US009139621B2

(12) United States Patent
Fraser et al.

(10) Patent No.: US 9,139,621 B2

(45) **Date of Patent: *Sep. 22, 2015**

(54) ***NEISSERIA MENINGITIDIS* ANTIGENS AND COMPOSITIONS**

(75) Inventors: Claire Fraser, Potomac, MD (US); Cesira Galeotti, Poggibonsi (IT); Guido Grandi, Segratf (IT); Erin Hickey, Palatine, IL (US); Vega Masignani, Siena (IT); Marirosa Mora, Siena (IT); Jeremy Petersen, Arlington, VA (US); Mariagrazia Pizza, Siena (IT); Rino Rappuoli, Siena (IT); Giulio Ratti, Siena (IT); Vincenzo Scarlato, Colle Val d'Elsa (IT); Maria Scarselli, Siena (IT); Herve Tettelin, Gaithersburg, MD (US); J. Craig Venter, Potomac, MD (US)

(73) Assignee: GlaxoSmithKline Biologicals SA, Rixensart (BE)

( * ) Notice: Subject to any disclaimer, the term of this patent is extended or adjusted under 35 U.S.C. 154(b) by 0 days.

This patent is subject to a terminal disclaimer.

(21) Appl. No.: 13/070,448

(22) Filed: Mar. 23, 2011

(65) Prior Publication Data

US 2012/0135024 A1 May 31, 2012

Related U.S. Application Data

(60) Division of application No. 12/013,047, filed on Jan. 11, 2008, now Pat. No. 7,988,979, which is a continuation of application No. 09/674,546, filed as application No. PCT/US99/09346 on Apr. 30, 1999, now Pat. No. 7,576,176.

(60) Provisional application No. 60/121,528, filed on Feb. 25, 1999, provisional application No. 60/103,796, filed on Oct. 9, 1998, provisional application No. 60/103,794, filed on Oct. 9, 1998, provisional application No. 60/103,749, filed on Oct. 9, 1998, provisional application No. 60/099,062, filed on Sep. 2, 1998, provisional application No. 60/098,994, filed on Sep. 2, 1998, provisional application No. 60/094,869, filed on Jul. 31, 1998, provisional application No. 60/083,758, filed on May 1, 1998.

(51) Int. Cl.

| | |
|---|---|
| ***C07K 14/22*** | (2006.01) |
| ***A61K 39/095*** | (2006.01) |
| ***A61K 39/00*** | (2006.01) |
| *A61K 38/00* | (2006.01) |

(52) U.S. Cl.

CPC ................ *C07K 14/22* (2013.01); *A61K 38/00* (2013.01); *A61K 39/00* (2013.01); *A61K 39/095* (2013.01); *Y10S 530/806* (2013.01); *Y10S 530/825* (2013.01)

(58) Field of Classification Search

None

See application file for complete search history.

(56) References Cited

U.S. PATENT DOCUMENTS

| | | | | |
|---|---|---|---|---|
| 5,514,581 | A | 5/1996 | Ferrari et al. | |
| 5,547,670 | A | 8/1996 | Goldstein et al. | |
| 5,550,213 | A | 8/1996 | Anderson et al. | |
| 5,554,372 | A | 9/1996 | Hunter | |
| 5,668,004 | A | 9/1997 | O'Donnell | |
| 6,013,267 | A | 1/2000 | Blake et al. | |
| 6,028,049 | A | 2/2000 | Jacobs et al. | |
| 6,060,065 | A | 5/2000 | Barney et al. | |
| 6,197,312 | B1 | 3/2001 | Peak et al. | |
| 6,214,566 | B1 * | 4/2001 | Asa et al. | 435/7.1 |
| 6,355,253 | B1 | 3/2002 | Zlotnick | |
| 6,472,518 | B1 | 10/2002 | Ribot et al. | |
| 6,709,660 | B1 | 3/2004 | Scarlato et al. | |
| 6,914,131 | B1 | 7/2005 | Scarlato et al. | |
| 7,018,636 | B1 | 3/2006 | Bhattacharjee et al. | |
| 7,348,006 | B2 | 3/2008 | Contorni et al. | |
| 7,368,261 | B1 | 5/2008 | Rappuoli | |
| 7,576,176 | B1 | 8/2009 | Fraser et al. | |
| 7,604,810 | B2 * | 10/2009 | Rappuoli | 424/250.1 |
| 7,862,827 | B2 * | 1/2011 | Giuliani et al. | 424/250.1 |
| 8,114,960 | B2 * | 2/2012 | Arico et al. | 530/324 |
| 8,703,914 | B2 | 4/2014 | Arico et al. | |
| 2002/0160016 | A1 | 10/2002 | Peak et al. | |
| 2004/0033234 | A1 | 2/2004 | Berinstein et al. | |
| 2004/0092711 | A1 | 5/2004 | Arico | |
| 2004/0110670 | A1 | 6/2004 | Arico et al. | |
| 2005/0222385 | A1 | 10/2005 | Pizza | |
| 2006/0051840 | A1 | 3/2006 | Arico et al. | |
| 2006/0171957 | A1 | 8/2006 | Pizza | |
| 2006/0240045 | A1 | 10/2006 | Berthet et al. | |
| 2007/0026021 | A1 | 2/2007 | Fraser et al. | |
| 2007/0082014 | A1 | 4/2007 | Costantino | |
| 2008/0241180 | A1 | 10/2008 | Contorni | |

(Continued)

FOREIGN PATENT DOCUMENTS

| | | | |
|---|---|---|---|
| EP | 0273116 | A2 | 7/1988 |
| EP | 0467714 | | 1/1992 |

(Continued)

OTHER PUBLICATIONS

Brenda Collins. Discovery Medicine, Jul. 2011.*

1997-11-17-NM_shotgun.dbs and 1997-12-15-NM.dbs, located at <ftp://ftp.sanger.ac.uk/pub/pathogens/nm/old data/>.

Ala'Aldeen et al. (1994). "Vaccine potential of meningococcal FrpB: studies on surface exposure and functional attributes of common epitopes," Vaccine, 12(6):535-541.

(Continued)

*Primary Examiner* — S. Devi

(74) *Attorney, Agent, or Firm* — Morrison & Foerster LLP

(57) ABSTRACT

The invention provides proteins from *Neisseria meningitidis*, including the amino acid sequences and the corresponding nucleotide sequences. The proteins are predicted to be useful antigens for vaccines and/or diagnostics.

9 Claims, 31 Drawing Sheets

(56) References Cited

U.S. PATENT DOCUMENTS

| | | | |
|---|---|---|---|
| 2009/0232820 | A1 | 9/2009 | Fraser et al. |
| 2010/0015151 | A1* | 1/2010 | Rappuoli et al. ............ 424/139.1 |
| 2010/0267931 | A1 | 10/2010 | Arico et al. |
| 2013/0236489 | A1 | 9/2013 | Serruto et al. |

FOREIGN PATENT DOCUMENTS

| | | |
|---|---|---|
| EP | 0818465 | 1/1998 |
| EP | 1790660 | 5/2007 |
| JP | 01144977 | 6/1989 |
| NL | 8901612 A | 7/1990 |
| WO | WO-90/06696 | 6/1990 |
| WO | WO-92/13871 | 8/1992 |
| WO | WO-94/08013 | 4/1994 |
| WO | WO-95/33049 A2 | 12/1995 |
| WO | WO-96/01901 | 1/1996 |
| WO | WO-96/29412 | 9/1996 |
| WO | WO-96/33276 | 10/1996 |
| WO | WO-97/13860 | 4/1997 |
| WO | WO-97/37044 | 10/1997 |
| WO | WO-99/24578 A2 | 5/1999 |
| WO | WO-99/36544 A2 | 7/1999 |
| WO | WO-99/57280 | 11/1999 |
| WO | WO-00/22430 A2 | 4/2000 |
| WO | WO-00/66741 A2 | 11/2000 |
| WO | WO-00/66791 | 11/2000 |
| WO | WO-00/71725 | 11/2000 |
| WO | WO-01/31019 | 5/2001 |
| WO | WO-01/52885 | 7/2001 |
| WO | WO-01/64920 A | 9/2001 |
| WO | WO-01/64922 A2 | 9/2001 |
| WO | WO-03/009869 A1 | 2/2003 |
| WO | WO-03/010194 A | 2/2003 |
| WO | WO-03/020756 A | 3/2003 |
| WO | WO-2004/032958 A1 | 4/2004 |
| WO | WO-2004/048404 | 6/2004 |
| WO | WO-2005/106009 | 11/2005 |
| WO | WO-2006/024954 | 3/2006 |

OTHER PUBLICATIONS

Baumler, A. J. and K. Hantke (1992). "A Lipoprotein of *Yersinia enterocolitica* Facilitates Ferrioxamine Uptake in *Escherichia coli*," Journal of Bacteriology 174(3): 1029-1035.

Baumler, A. J. et al. (1993). "Hypothetical 29.6 kD Protein in PCP 5' Region (ORF1)," Database Swissprot AC P31485.

Bernfield L. et al. (Sep. 2002). "Identification of a novel vaccine candidate for group B *Neisseria meningitidis*," Thirteenth International Pathogenic *Neisseria* Conference, Norwegian Institute of Public Health, Oslo, Norway, pp. 116 and 124.

Blake et al. (1995). "Vaccines for Gonorrhoea: Where are We on the Curve?" Trends in Microbiology 3(12): 469-474.

Boslego et al. (1991). "Gonorrhea Vaccines," Chapter 17 in Vaccines and Immunotherapy, Cryz S.J. (Ed.), Pergamon Press: New York, NY, pp. 211-223.

Burland, V. et al. (1994). "*Escherichia coli* K-12 Chromosomal Region From 92.8 to 00.1 Minutes," Database Empro1 AC U14003.

Campbell, A. M. (1984). "General properties and applications of monoclonal antibodies," in *Monoclonal Antibody Technology*. Elsevier Science Publishers, The Netherlands, Chapter 1, pp. 1-32.

Cantini et al. (Mar. 2006). "Solution Structure of the Immunodominant Domain of Protective Antigen GNA 1870 of *Neisseria meningitidis*," Journal of Biological Chemistry 281(11):7220-7227.

Conlin, C. A. et al. (1992). "*Escherichia coli* prIC Encodes an Endopeptidase and is Homologous to the *Salmonella typhimurium* opdA Gene," Journal of Bacteriology 174(18): 5881-5997.

Cowdery et al., (1996) "Bacterial DNA Induces NK Cells to Produce IFN-γ In Vivo and Increases the Toxicity of Lipopolysaccharides," J. Immunol. 156:4570-4575.

Cox et al, "Adjuvants—a classification and review of their modes of action" Vaccine, 1997, 15(3):248-256.

Cruse et al. (2003). *Illustrated Dictionary of Immunology*, 2nd Edn., CRC Press, pp. 46, 166, and 382.

Davis et al., (1998) "CpG DNA Is a Potent Enhancer of Specific Immunity in Mice Immunized with Recombinant Hepatitis B Surtace Antigen," J. Immunol, 160:870-876.

Declaration by Dr. Julian Parkhill dated Jun. 12, 2008. 2 pages.

Dempsey J.A. et al. (Nov. 1995). "The physical map of the chromosome of a serogroup A strain of *Neisseria meningitidis* shows complex rearrangement relative to the chromosomes of the two mapped strains of the closely related species *N. gonorrhoeae*," Journal of Bacteriology 177(22):6390-6400.

Dillard, J. P. et al. (1997) "A Peptidoglcan Hydrolase Similar to Bacteriophage Endolysins Acts as an Autolysin in *Neisseria gonorrhoeae*," Molecular Microbiology 25(5): 893-907.

European Examination Report mailed on May 2, 2006 for EP Application No. 99922752.3, filed Apr. 30, 1999, 5 pages.

European Examination Report mailed on Nov. 20, 2006 for EP 05077865.3, filed Apr. 30, 1999, 8 pages.

European Search Report mailed on Mar. 3, 2006 for EP Application No. 05077865.3, filed Apr. 30, 1999, 8 pages.

Farley J. et al. (Sep. 2002). "Characterization, cloning and expression of different subfamilies of the ORF 2086 gene from *Neisseria meningitidis*," Thirteenth International Pathogenic *Neisseria* Conference, Norwegian Institute of Public Health, Oslo, Norway, p. 124.

Fleischmann, R. D. et al. (1995). "Hypothetical Protein Hl0753," Database Swissprot AC P44861.

Fleischmann, R. D. et al. (1995). "Oligopeptidase A (EC 3.4.24.70)," Database Swissprot AC P44573.

Fletcher et al. (2004). "Vaccine Potential of the *Neisseria meningitidis* 2086 Lipoprotein," Infection and Immunity 72(4): 2088-2100.

Forest et al. (1997). "Type-4 pilus-structure: outside to inside and top to bottom—a minireview," Gene 192:165-169.

Gervais et al. (1992). "Putative Lipoprotein Yaec Precursor," Database Swissport Acc No. p28635.

Giuliani et al. (Feb. 2005). "The Region Comprising Amino Acids 100 to 255 of *Neisseria meningitidis* Lipoprotein GNA 1870 Elicits Bactericidal Antibodies," Infection and Immunity 73(2): 1151-1160.

Gomez et al. (1996). "Antigenicity, cross-reactivity and surface exposure of the *Neisseria meningitidis* 37 kDa protein (Fbp)," Vaccine 14(14):1340-1346.

Greenspan et al. (1999). "Defining Epitopes: Its Not as Easy as It Seems," Nature Biotechnology 17:936-937.

Hacker, J. et al. (1993). "Immunophilins: structure-function relationship and possible role in microbial pathogenicity," Molecular Microbiology 10(3): 445-456.

Houghten et al. New Approaches to Immunization, Vaccines 86, Cold Spring Harbor Laboratory, p. 21-25, 1986.

Huang, M. et al. (1995). "A Stomatin-Like Protein Necessary for Mechanosensation in *C. elegans*," Nature 378(6554): 292-295.

International Preliminary Examination Report mailed on Oct. 2, 2000 for PCT Application No. PCT/US99/09346 filed on Apr. 30, 1999, 11 paqes.

International Search Report mailed on Jun. 15, 2000 for PCT Application No. PCT/US99/09346 filed on Apr. 30, 1999, 14 paqes.

Jacobsson et al. (2009). "Prevalence and sequence variations of the genes encoding the five antigens included in the novel 5CVMB vaccine covering group B meningococcal disease" Vaccine. 27:1579-1584.

Kaneko, T. (1996). "Membrane-Bound Lytic Transglycosylase A MltA *Synechocystis* sp. Strain PCC 6803," Database TrEMBL AC Q55666.

Kohara, Y. (Aug. 12, 1994). "*Caenorhabditis elegans* cDNA clone yk26f2: 5' end, single read," Database accession No. D35881. Database EMBL [Online] EBI.

Lawrence, E. (1997). *Henderson's Dictionary of Biological Terms*, Eleventh Edition (1997) Longman Ltd. Defintion of "epitope," Cover pages, Table of Contents, and pp. 37 and 184.

Legrain et al. (1995). "Production of Lipidated Meningococcal Transferrin Binding Protein 2 in *Escherichia coli*," Protein Expression and Purification 6:570-578.

(56) References Cited

OTHER PUBLICATIONS

Lommatzsch et al. (1997). "Outer membrane localization of murein hydrolases: MltA, a third lipoprotein lytic transglycosylase in *Escherichia coli*," Journal of Bacteriology 179(17): 5465-5470.
Lucidarme et al., (Sep. 16, 2009) "Characterization of fHbp, nhba (gna2132), nadA, porA, sequence type (ST), and genomic presence of IS1301 in group B meningococcal ST269 clonal complex isolates from England and Wales" Journal of Clinical Microbiology, 47(11):3577-85.
Lucidarme et al., 2010 "Characterization of fHbp, nhba (gna2132), nadA, porA, and sequence type in group B meningococcal case isolates collected in England and Wales during Jan. 2008 and potential coverage of an investigational group B meningococcal vaccine" Clinical and Vaccine Immunology 17(6):919-929.
Malorny et al. (1998). "Sequence Diversity, Predicted Two-Dimensional Protein Structure, and Epitope Mapping of Neisserial Opa Proteins," J. Bacteriol, 180 (5):1323-1330.
Masignani V. (Mar. 17. 2003). "Vaccination against *Neisseria meningitidis* using three variants of the lipoprotein GNA1870," J. Exp. Med. 197(6):789-799.
McAllister, C. F. and D. S. Stephens. (1993). "Analysis in *Neisseria meningitidis* and other *Neisseria* species of genes homologous to the FKBP immunophilin family," Molecular Microbiology 10(1): 13-23.
McAllister, C. F. et al. (1993). "*Neisseria elongata* NRL FKBP Immunophilin Homolog Gene," Database Empro2 AC U001198.
McGuinness et al. (1993). "Class 1 outer membrane protein of *Neisseria meningitidis*: epitope analysis of the antigenic diversity between strains, implications for subtype definition and molecular epidemiology," Mol Microbiol. 7:505-514.
McGuinness et al. (Mar. 1991). "Point mutation in meningococcal porA gene associated with increased endemic disease," Lancet 337:514-517.
Morley, S. et al. (Dec. 12, 2001). "Vaccine prevention of meningococcal disease, coming soon?" Vaccine 20(5-6):666-687.
Notice of Opposition against European Patent EP 1645631, granted on Oct. 24, 2007. Opposition filed on Jul. 23, 2008. 20 pages.
Parkhill, J. et al. (Mar. 2000). "Complete DNA Sequence of a Serogroup A Strain of *Neisseria meningitides* Z2491," Nature 404(6777):502-506.
Pizza et al. (2000). "Identification of Vaccine Candidates Against Serogroup B Meningococcus by Whole-Genome Sequencing," Science 287(5459):1816-1820.
Poolman. (1995). "Development of a Meningococcal Vaccine," Infectious Agents and Disease 4:13-28.
Quentin-Millet, M. J. et al. (1998). "*N. meningitidis* HTR Tbp2 (de13777-385, de1407-465, de 1488-508)," Database GCG_ GenesEQ AC W14640.
Renauld-Mongenie et al. (1997). "Identification of Human Transferrin-Binding Sites Within Meningococcal Transferrin-Binding Protein B," J. Bacteriology 197(20):6400-6407.
Richard, M.E. (Oct. 25, 1997). "Applications of molecular microbiology to vaccinology," Lancet (North American Edition) 350(9086):1240-1244.
Rokbi et al. (1997). "Evaluation of Recombinant Transferrin-Binding Protein B Variants from *Neiseria meningitidis* for Their Ability to Induce Cross-Reactive and Bacterial Antibodies Against a Genetically Diverse Collection of Serogroup B Strains," Infection and Immunity 65(1): 55-63.
Rokbi et al. (1998). "Transferrin Binding Protein B, TbpB, *Neisseria meningitidis*," Database TrEMBL AC 069750.
Rokbi, B. et al. (1997). "Heterogeneity of tbpB, the transferrin-binding protein B gene, among serogroup B *Neisseria meningitidis* strains of the ET-5 complex," Clinical and Diagnostic Laboratory Immunology 4(5): 522-529.
Rudinger et al. (Jun. 1976). Peptide Hormones. (Ed) JA Parsons, University Park Press.
Sambrook et al. (1989). *Molecular Cloning: A Laboratory Manual*. Second Edition, Cold Spring Harbor, pp. 17.1-17.44.
Sampson, B. and E. C. Gotschlich. (1992). "*Neisseria meningitidis* encodes an FK506-inhibitable rotamase," Proc. Natl. Acad. Sci. USA 89(4): 1164-1168.
Serruto et al. (2010). "*Neisseria meningitidis* GNA2132, a heparin-binding protein that induces protective immunity in humans," PNAS 107(8):3770-3775.
Smith C.J. et al. (1995). "Nucleotide sequence determination and genetic analysis of the Bacteroides plasmid, pBl143," Plasmid 34(3):211-222.
Teerlink et al. (1987). "Antigenic and immunogenic properties of cyanogen bromide peptides from gonococcal outer membrane protein IB," J. Exp. Med. 166: 63-76.
Tettelin H et al. (Mar. 10, 2000). "Complete genome sequence of *Neisseria meningitidis* serogroup B strain MC58," Science 287(5459):789-799.
The printed output from the NCBI open reading frame finder (12 pages).
Van der Lay et al. (1995). "Construction of *Neisseria meningitidis* Strains Carrying Multiple Chromosomal Copies of the PorA Gene for Use in Production of a Multivalent Outer Membrane Vesicle Vaccine," Vaccine 13(4): 401-407.
Welsch et al. (2004). "Protective Activity of Monclonal Antibodies to Genome-Derived Neisserial Antigen 1870, a *Neisseria meningitidis* Candidate Vaccine," The Journal of Immunology 172: 5606-5615.
Welsch et al., 2003 "Antibody to genome-derived neisserial antigen 2132, a *Neisseria meningitidis* candidate vaccine, confers protection against bacteremia in the absence of complement-mediated bactericidal activity" Journal of Infectious Diseases 188 (11):1730-1740.
Wong, C. Y. et al. (1997). "Cloning and characterization of two immunophilin-like genes, ilpA and fkpA, on a single 3.9-kilobase fragment of *Aeromonas hydrophila* genomic DNA," Journal of Bacteriology 179(11): 3397-3403.
You, Z. et al. (1997). "Rhizobium etli Stomatin like Protein (slp) gene, complete cds.," Database Empro1 AC AF03483.
You, Z. et al. (1998). "A Stomatin-Like Protein Encoded by the slp Gene of *Rhizobium etli* is Required for Nodulation Competitiveness on the Common Bean," Microbiology 144(9): 2619-2627.
Experimental data: expression of NspA, '287' and '741' on 3 strains of bacteria, filed in opposition against EP1534326, dated Aug. 4, 2010. 2 pages.
Giuliani et al. (2010). "Measuring antigen-specific bactericidal responses to a multicomponent vaccine against serogroup B meningococcus," Vaccine 28:5023-5030.
Martin et al. (1998). "New Zealand epidemic of meningococcal disease identified by a strain with phenotype B:4:P1.4," JID 177:497-500.
Novartis (Jun. 9, 2011). "Novartis candidate vaccine Bexsero® shows significant potential in providing broad coverage against meningococcal serogroup B infections." Media Release, 6 pages.
Seib et al. (2010). "Influence of serogroup B meningococcal vaccine antigens on growth and survival of the mengococcus in vitro and in ex vivo and in vivo models of infection," Vaccine 28(12):2416-2427.
Voulhoux and Tommassen (2002). "Transport of lipoproteins to the cell surface in *Neisseria meningitidis*," 13th International Pathogenic *Neisseria* Conference 2002, p. 31.
Welsch et al. (2002). "Genome-derived antigen (GNA) 2132 elicits protective serum antibodies to groups B and C *Neisseria meningitidis* strains," 13th International Pathogenic *Neisseria* Conference 2002, p. 25.
Donnelly et al. (2010). "Qualitative and quantitative assessment of meningococcal antigens to evaluate the potential strain coverage of protein-based vaccines," Proc Natl Acad Sci U S A, 107(45):19490-5.
Plikaytis et al. (2012). "Interlaboratory standardization of the sandwich enzyme-linked immunosorbent assay designed for MATS, a rapid, reproducible method for estimating the strain coverage of investigational vaccines," Clin Vaccine Immunol, (10):1609-17.

* cited by examiner

FIG. 1A
919 (46 kDa)
Purification
M1 919
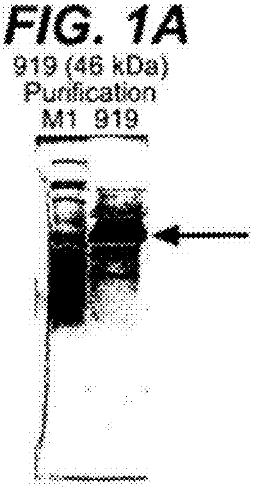
FIG. 1B
919 (46 kDa)
Expression
M1 919
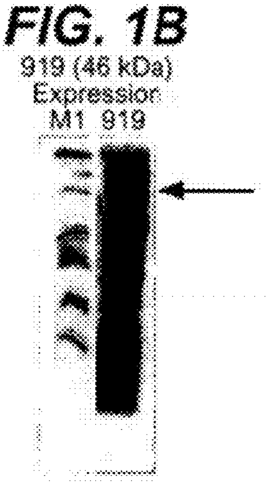
FIG. 1E
919 (46 kDa)
Western Blot
OMV TP PP
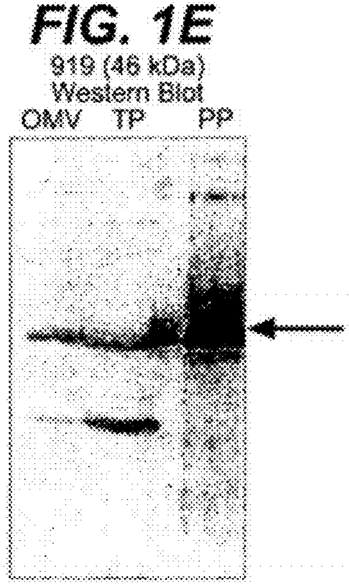
FIG. 1C
919 (46 kDa)
FACS
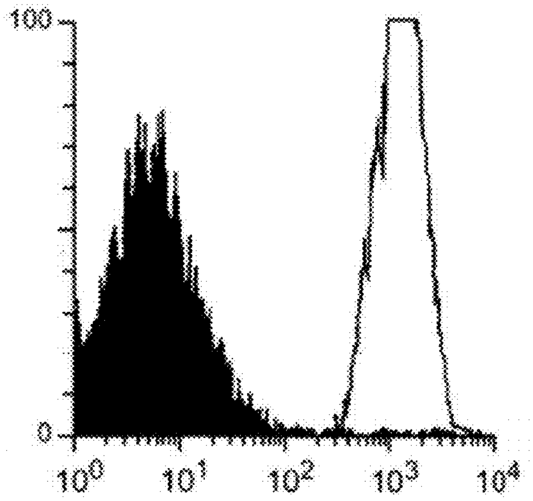
FIG. 1D
919 (46 kDa)
Bactericidal Assay
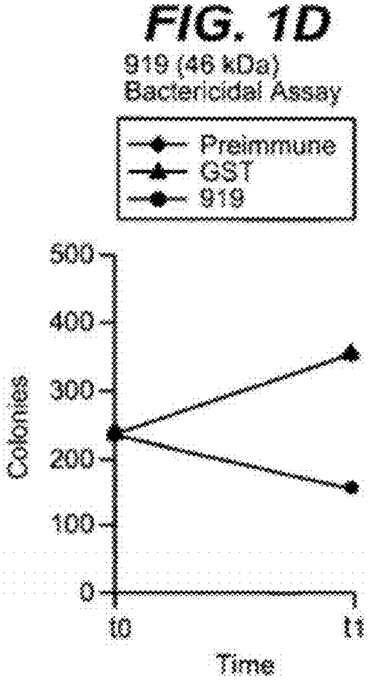
FIG. 1F
919 (46 kDa)
ELISA assay: positive FIG. 2A
279 (10.5 kDa)
Purification
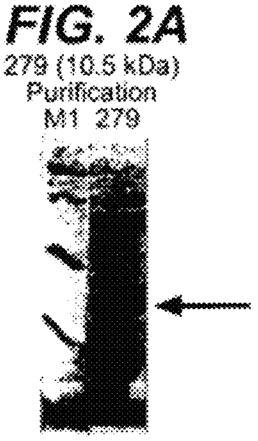
FIG. 2B
279 (10.5 kDa)
Western Blot
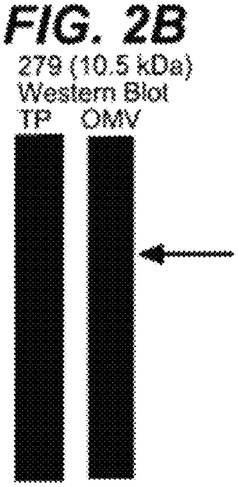
FIG. 2C
279 (10.5 kDa)
FACS
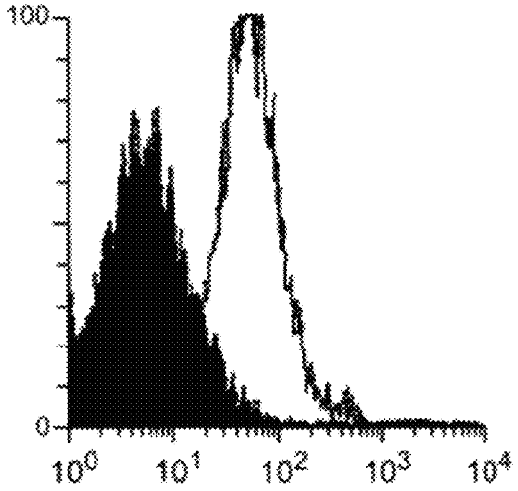
FIG. 2D
279 (10.5 kDa)
Bactericidal Assay
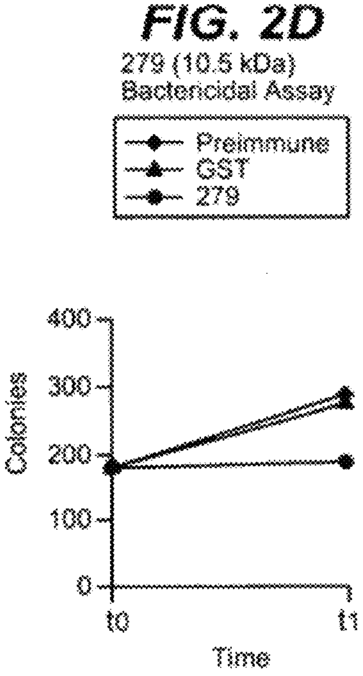
FIG. 2E
279 (10.5 kDa)
ELISA assay: positive FIG. 3A
576 (27.8 kDa)
Purification
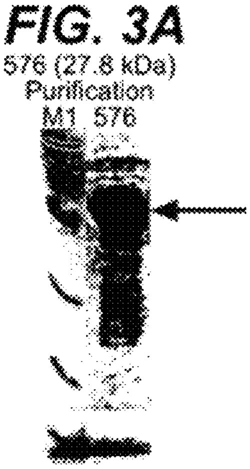
FIG. 3B
576 (27.8 kDa)
Western Blot
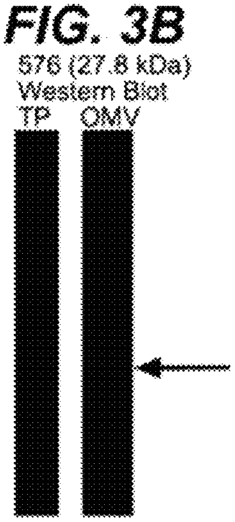
FIG. 3C
576 (27.8 kDa)
FACS
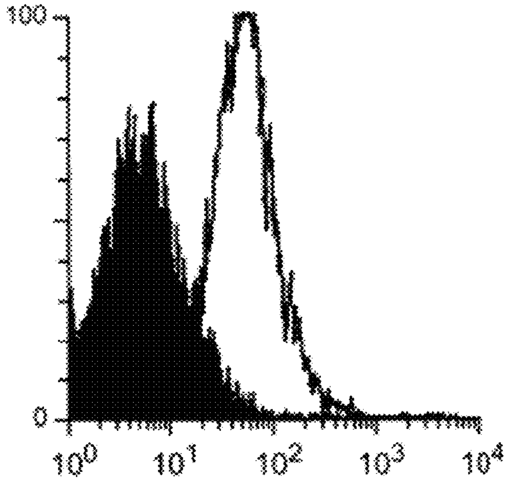
FIG. 3D
576 (27.8 kDa)
Bactericidal Assay
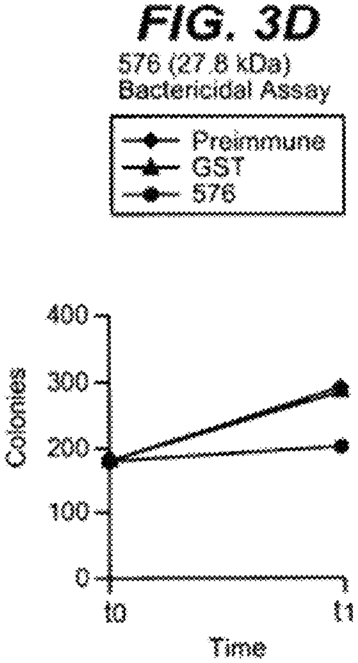
FIG. 3E
576 (27.8 kDa)
ELISA assay: positive

*FIG. 4A*
519 (33 kDa)
Purification
M1 519
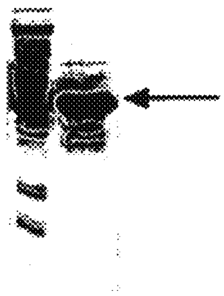
*FIG. 4B*
519 (33 kDa)
Western Blot
TP OMV
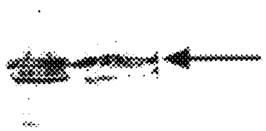
*FIG. 4C*
519 (33 kDa)
FACS
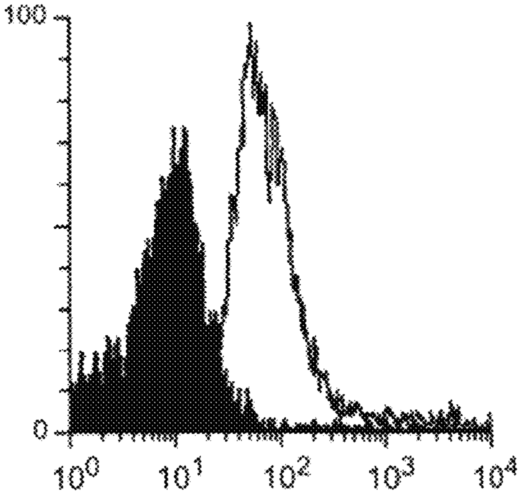
*FIG. 4D*
519 (33 kDa)
Bactericidal Assay
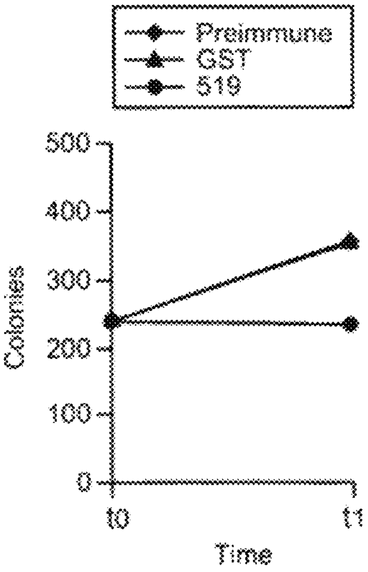
*FIG. 4E*
519 (33 kDa)
ELISA assay: positive FIG. 5A
121 (40 kDa)
Purification
M1 121
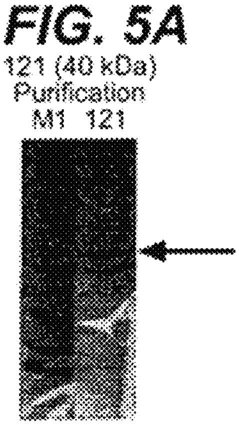
FIG. 5B
121 (40 kDa)
Western Blot
TP OMV
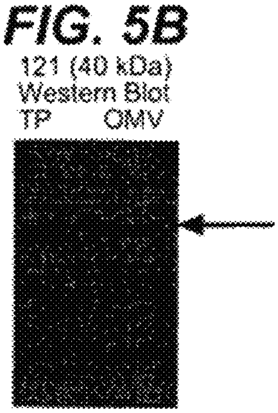
FIG. 5C
121 (40 kDa)
FACS
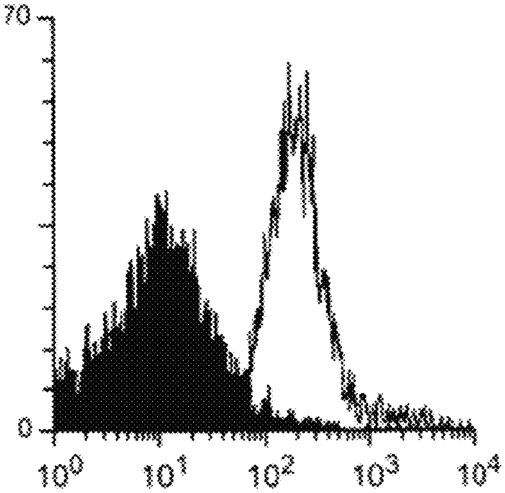
FIG. 5D
121 (40 kDa)
Bactericidal Assay
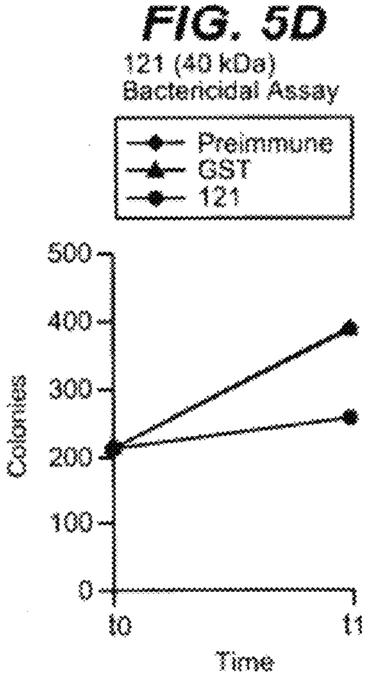
FIG. 5E
121 (40 kDa)
ELISA assay: positive FIG. 6A
128 (101 kDa)
Purification
M1 128
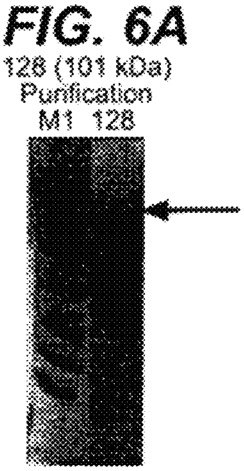
FIG. 6B
128 (101 kDa)
Western Blot
TP OMV
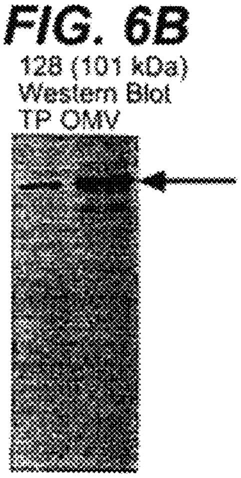
FIG. 6C
128 (101 kDa)
FACS
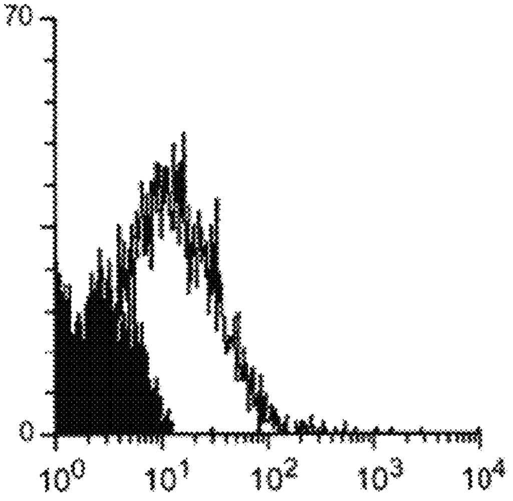
FIG. 6D
128 (101 kDa)
Bactericidal Assay
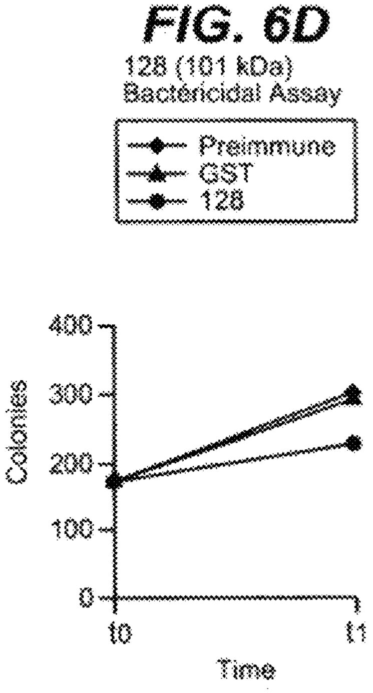
FIG. 6E
128 (101 kDa)
ELISA assay: positive FIG. 7A
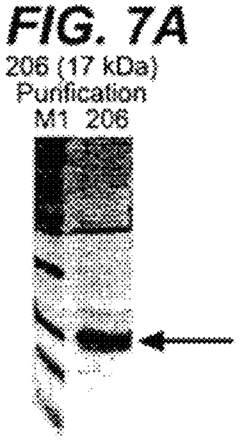
FIG. 7B
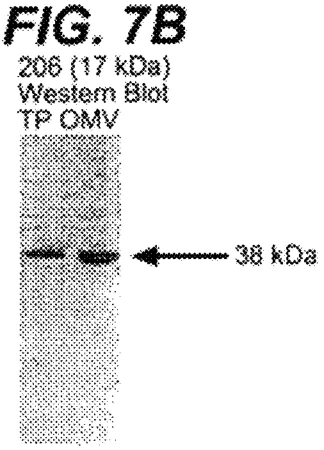
FIG. 7C
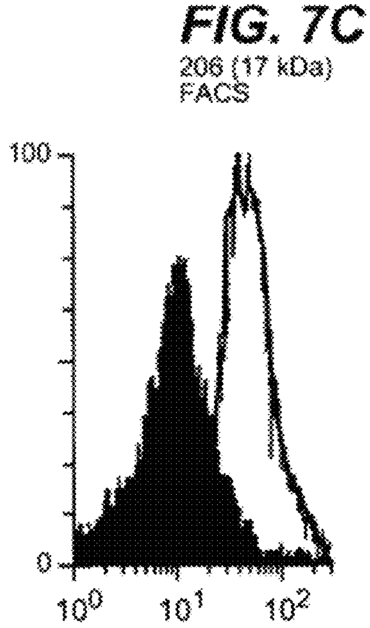
FIG. 7D
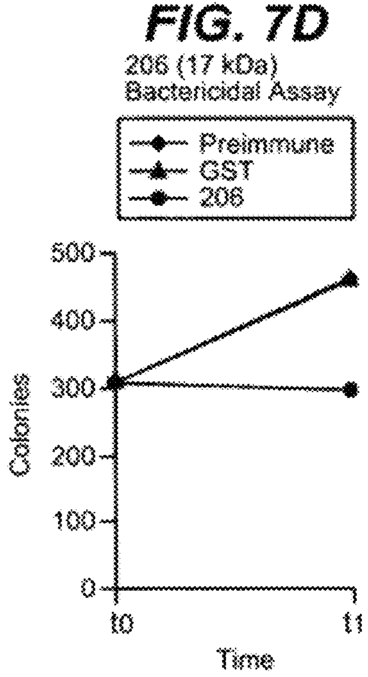
FIG. 7E
206 (17 kDa)
ELISA assay: positive FIG. 8A
287 (78 kDa)
Purification
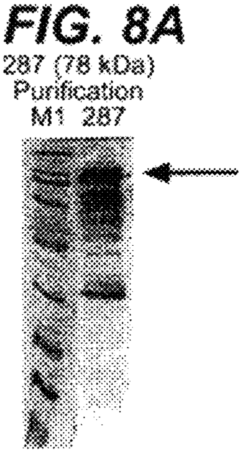
FIG. 8B
287 (78 kDa)
FACS
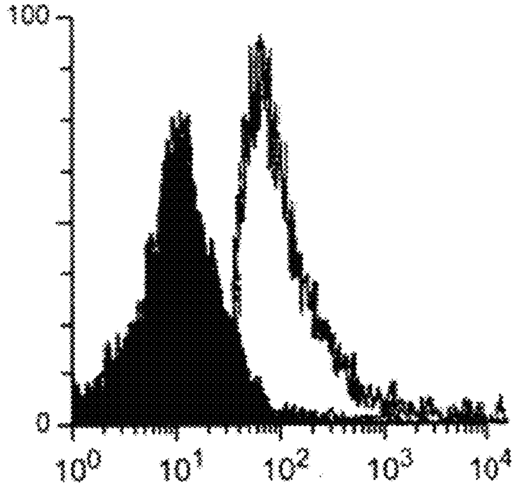
FIG. 8C
287 (78 kDa)
Bactericidal Assay
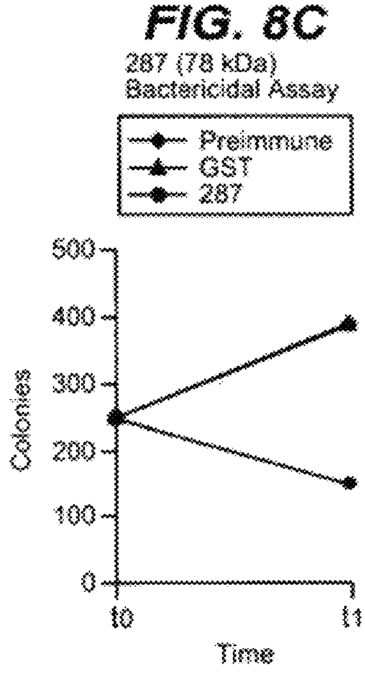
FIG. 8D
287 (78 kDa)
ELISA assay: positive FIG. 9A
406 (33 kDa)
Purification
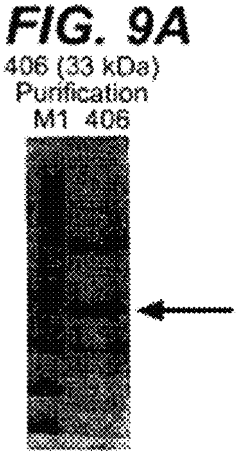
FIG. 9B
406 (33 kDa)
Western Blot
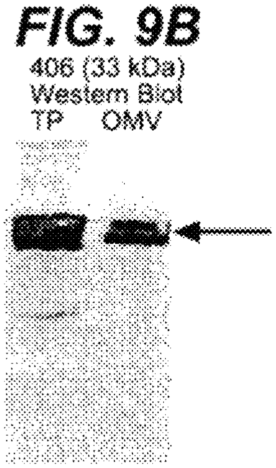
FIG. 9C
406 (33 kDa)
FACS
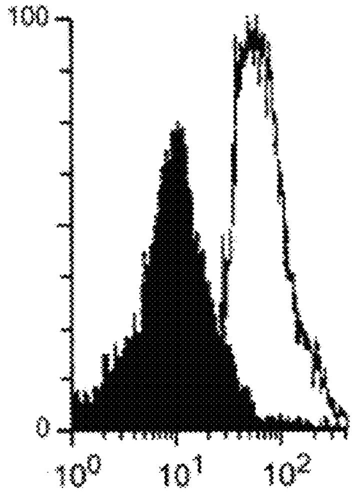
FIG. 9D
406 (33 kDa)
Bactericidal Assay
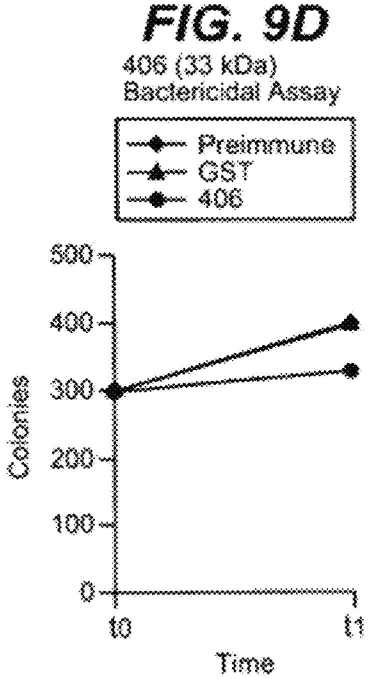
FIG. 9E
406 (33 kDa)
ELISA assay: positive

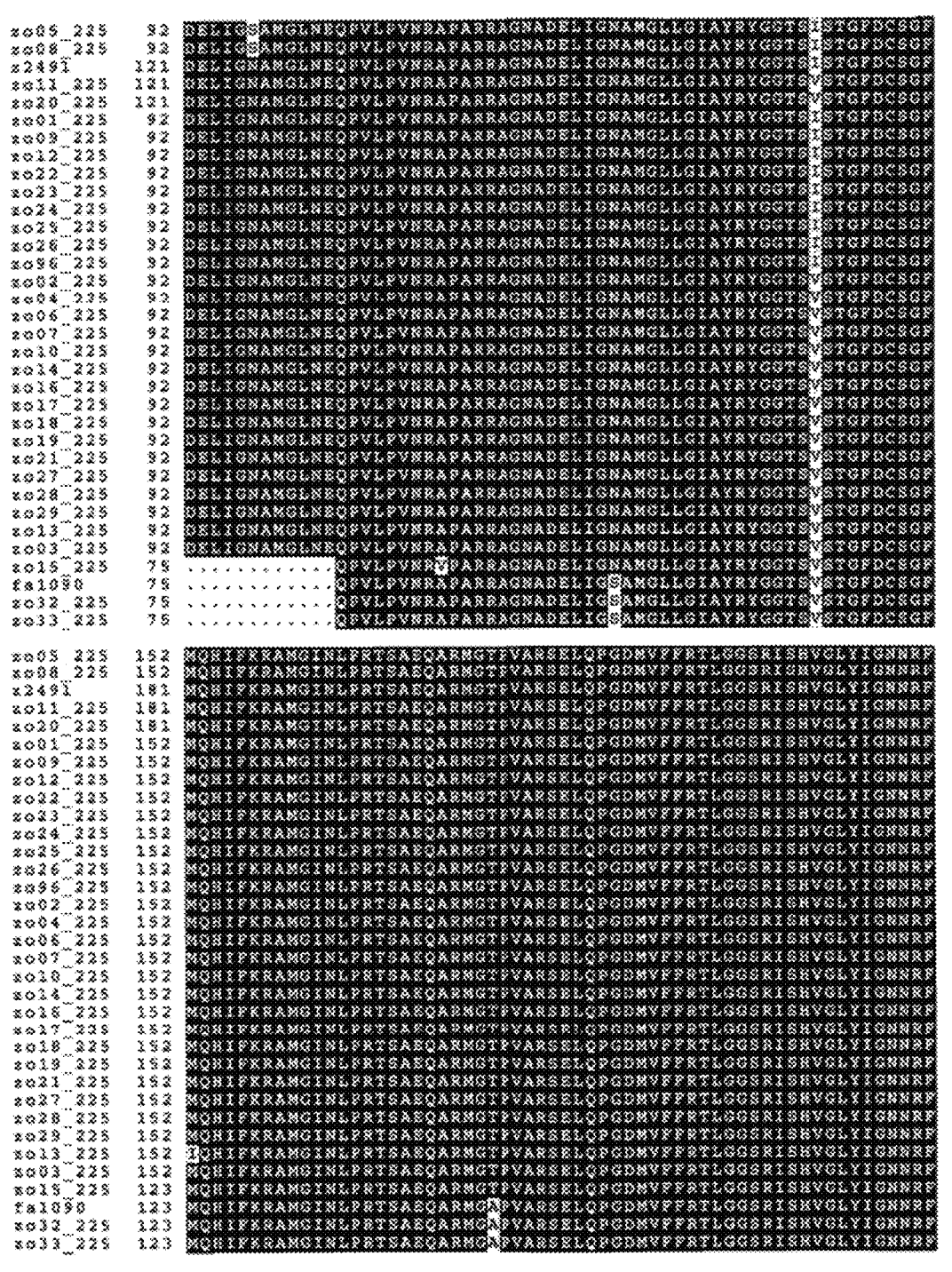

```
xo05_225    92  DELIGSANGLNEQPVLPVNRAPARRAGNADELIGNAMGLLGIAYRYGGTSISTGFDCSGF
xo08_225    92  DELIGSANGLNEQPVLPVNRAPARRAGNADELIGNAMGLLGIAYRYGGTSISTGFDCSGF
x2491      121  DELIGNANGLNEQPVLPVNRAPARRAGNADELIGNAMGLLGIAYRYGGTSISTGFDCSGF
xo11_225   121  DELIGNANGLNEQPVLPVNRAPARRAGNADELIGNAMGLLGIAYRYGGTSISTGFDCSGF
xo20_225   121  DELIGNANGLNEQPVLPVNRAPARRAGNADELIGNAMGLLGIAYRYGGTSISTGFDCSGF
xo01_225    92  DELIGNANGLNEQPVLPVNRAPARRAGNADELIGNAMGLLGIAYRYGGTSISTGFDCSGF
xo09_225    92  DELIGNANGLNEQPVLPVNRAPARRAGNADELIGNAMGLLGIAYRYGGTSISTGFDCSGF
xo12_225    92  DELIGNANGLNEQPVLPVNRAPARRAGNADELIGNAMGLLGIAYRYGGTSISTGFDCSGF
xo22_225    92  DELIGNANGLNEQPVLPVNRAPARRAGNADELIGNAMGLLGIAYRYGGTSISTGFDCSGF
xo23_225    92  DELIGNANGLNEQPVLPVNRAPARRAGNADELIGNAMGLLGIAYRYGGTSISTGFDCSGF
xo24_225    92  DELIGNANGLNEQPVLPVNRAPARRAGNADELIGNAMGLLGIAYRYGGTSISTGFDCSGF
xo25_225    92  DELIGNANGLNEQPVLPVNRAPARRAGNADELIGNAMGLLGIAYRYGGTSISTGFDCSGF
xo26_225    92  DELIGNANGLNEQPVLPVNRAPARRAGNADELIGNAMGLLGIAYRYGGTSISTGFDCSGF
xo96_225    92  DELIGNANGLNEQPVLPVNRAPARRAGNADELIGNAMGLLGIAYRYGGTSISTGFDCSGF
xo02_225    92  DELIGNANGLNEQPVLPVNRAPARRAGNADELIGNAMGLLGIAYRYGGTSVSTGFDCSGF
xo04_225    92  DELIGNANGLNEQPVLPVNRAPARRAGNADELIGNAMGLLGIAYRYGGTSVSTGFDCSGF
xo06_225    92  DELIGNANGLNEQPVLPVNRAPARRAGNADELIGNAMGLLGIAYRYGGTSVSTGFDCSGF
xo07_225    92  DELIGNANGLNEQPVLPVNRAPARRAGNADELIGNAMGLLGIAYRYGGTSVSTGFDCSGF
xo10_225    92  DELIGNANGLNEQPVLPVNRAPARRAGNADELIGNAMGLLGIAYRYGGTSVSTGFDCSGF
xo14_225    92  DELIGNANGLNEQPVLPVNRAPARRAGNADELIGNAMGLLGIAYRYGGTSVSTGFDCSGF
xo16_225    92  DELIGNANGLNEQPVLPVNRAPARRAGNADELIGNAMGLLGIAYRYGGTSVSTGFDCSGF
xo17_225    92  DELIGNANGLNEQPVLPVNRAPARRAGNADELIGNAMGLLGIAYRYGGTSVSTGFDCSGF
xo18_225    92  DELIGNANGLNEQPVLPVNRAPARRAGNADELIGNAMGLLGIAYRYGGTSVSTGFDCSGF
xo19_225    92  DELIGNANGLNEQPVLPVNRAPARRAGNADELIGNAMGLLGIAYRYGGTSVSTGFDCSGF
xo21_225    92  DELIGNANGLNEQPVLPVNRAPARRAGNADELIGNAMGLLGIAYRYGGTSVSTGFDCSGF
xo27_225    92  DELIGNANGLNEQPVLPVNRAPARRAGNADELIGNAMGLLGIAYRYGGTSVSTGFDCSGF
xo28_225    92  DELIGNANGLNEQPVLPVNRAPARRAGNADELIGNAMGLLGIAYRYGGTSVSTGFDCSGF
xo29_225    92  DELIGNANGLNEQPVLPVNRAPARRAGNADELIGNAMGLLGIAYRYGGTSVSTGFDCSGF
xo13_225    92  DELIGNANGLNEQPVLPVNRAPARRAGNADELIGNAMGLLGIAYRYGGTSVSTGFDCSGF
xo03_225    92  DELIGNANGLNEQPVLPVNRAPARRAGNADELIGNAMGLLGIAYRYGGTSVSTGFDCSGF
xo15_225    75  .............QPVLPVNRVPARRAGNADELIGNAMGLLGIAYRYGGTSVSTGFDCSGF
fa1090      75  .............QPVLPVNRAPARRAGNADELIGSAMGLLGIAYRYGGTSVSTGFDCSGF
xo32_225    75  .............QPVLPVNRAPARRAGNADELIGSAMGLLGIAYRYGGTSVSTGFDCSGF
xo33_225    75  .............QPVLPVNRAPARRAGNADELIGSAMGLLGIAYRYGGTSVSTGFDCSGF

xo05_225   152  MQHIFKRAMGINLPRTSAEQARMGTPVARSELQPGDMVFFRTLGGSRISHVGLYIGNNRF
xo08_225   152  MQHIFKRAMGINLPRTSAEQARMGTPVARSELQPGDMVFFRTLGGSRISHVGLYIGNNRF
x2491      181  MQHIFKRAMGINLPRTSAEQARMGTPVARSELQPGDMVFFRTLGGSRISHVGLYIGNNRF
xo11_225   181  MQHIFKRAMGINLPRTSAEQARMGTPVARSELQPGDMVFFRTLGGSRISHVGLYIGNNRF
xo20_225   181  MQHIFKRAMGINLPRTSAEQARMGTPVARSELQPGDMVFFRTLGGSRISHVGLYIGNNRF
xo01_225   152  MQHIFKRAMGINLPRTSAEQARMGTPVARSELQPGDMVFFRTLGGSRISHVGLYIGNNRF
xo09_225   152  MQHIFKRAMGINLPRTSAEQARMGTPVARSELQPGDMVFFRTLGGSRISHVGLYIGNNRF
xo12_225   152  MQHIFKRAMGINLPRTSAEQARMGTPVARSELQPGDMVFFRTLGGSRISHVGLYIGNNRF
xo22_225   152  MQHIFKRAMGINLPRTSAEQARMGTPVARSELQPGDMVFFRTLGGSRISHVGLYIGNNRF
xo23_225   152  MQHIFKRAMGINLPRTSAEQARMGTPVARSELQPGDMVFFRTLGGSRISHVGLYIGNNRF
xo24_225   152  MQHIFKRAMGINLPRTSAEQARMGTPVARSELQPGDMVFFRTLGGSRISHVGLYIGNNRF
xo25_225   152  MQHIFKRAMGINLPRTSAEQARMGTPVARSELQPGDMVFFRTLGGSRISHVGLYIGNNRF
xo26_225   152  MQHIFKRAMGINLPRTSAEQARMGTPVARSELQPGDMVFFRTLGGSRISHVGLYIGNNRF
xo96_225   152  MQHIFKRAMGINLPRTSAEQARMGTPVARSELQPGDMVFFRTLGGSRISHVGLYIGNNRF
xo02_225   152  MQHIFKRAMGINLPRTSAEQARMGTPVARSELQPGDMVFFRTLGGSRISHVGLYIGNNRF
xo04_225   152  MQHIFKRAMGINLPRTSAEQARMGTPVARSELQPGDMVFFRTLGGSRISHVGLYIGNNRF
xo06_225   152  MQHIFKRAMGINLPRTSAEQARMGTPVARSELQPGDMVFFRTLGGSRISHVGLYIGNNRF
xo07_225   152  MQHIFKRAMGINLPRTSAEQARMGTPVARSELQPGDMVFFRTLGGSRISHVGLYIGNNRF
xo10_225   152  MQHIFKRAMGINLPRTSAEQARMGTPVARSELQPGDMVFFRTLGGSRISHVGLYIGNNRF
xo14_225   152  MQHIFKRAMGINLPRTSAEQARMGTPVARSELQPGDMVFFRTLGGSRISHVGLYIGNNRF
xo16_225   152  MQHIFKRAMGINLPRTSAEQARMGTPVARSELQPGDMVFFRTLGGSRISHVGLYIGNNRF
xo17_225   152  MQHIFKRAMGINLPRTSAEQARMGTPVARSELQPGDMVFFRTLGGSRISHVGLYIGNNRF
xo18_225   152  MQHIFKRAMGINLPRTSAEQARMGTPVARSELQPGDMVFFRTLGGSRISHVGLYIGNNRF
xo19_225   152  MQHIFKRAMGINLPRTSAEQARMGTPVARSELQPGDMVFFRTLGGSRISHVGLYIGNNRF
xo21_225   152  MQHIFKRAMGINLPRTSAEQARMGTPVARSELQPGDMVFFRTLGGSRISHVGLYIGNNRF
xo27_225   152  MQHIFKRAMGINLPRTSAEQARMGTPVARSELQPGDMVFFRTLGGSRISHVGLYIGNNRF
xo28_225   152  MQHIFKRAMGINLPRTSAEQARMGTPVARSELQPGDMVFFRTLGGSRISHVGLYIGNNRF
xo29_225   152  MQHIFKRAMGINLPRTSAEQARMGTPVARSELQPGDMVFFRTLGGSRISHVGLYIGNNRF
xo13_225   152  IQHIFKRAMGINLPRTSAEQARMGTPVARSELQPGDMVFFRTLGGSRISHVGLYIGNNRF
xo03_225   152  MQHIFKRAMGINLPRTSAEQARMGTPVARSELQPGDMVFFRTLGGSRISHVGLYIGNNRF
xo15_225   123  MQHIFKRAMGINLPRTSAEQARMGTPVARSELQPGDMVFFRTLGGSRISHVGLYIGNNRF
fa1090     123  MQHIFKRAMGINLPRTSAEQARMGAPVARSELQPGDMVFFRTLGGSRISHVGLYIGNNRF
xo32_225   123  MQHIFKRAMGINLPRTSAEQARMGAPVARSELQPGDMVFFRTLGGSRISHVGLYIGNNRF
xo33_225   123  MQHIFKRAMGINLPRTSAEQARMGAPVARSELQPGDMVFFRTLGGSRISHVGLYIGNNRF
```

FIG. 19B

*NEISSERIA MENINGITIDIS* ANTIGENS AND COMPOSITIONS

RELATED APPLICATIONS

This application is a Divisional of U.S. patent application Ser. No. 12/013,047, (now U.S. Pat. No. 7,988,979) filed Jan. 11, 2008, which is continuation of U.S. patent application Ser. No. 09/674,546, (now U.S. Pat. No. 7,576,176) filed Nov. 4, 2002, which is the National Stage of International Application No. PCT/US99/09346, filed Apr. 30, 1999, which claims the benefit under 35 U.S.C. §119(e) of U.S. Provisional Patent Nos. 60/121,528, filed Feb. 25, 1999, 60/103,796, filed Oct. 9, 1998, 60/103,794, filed Oct. 9, 1998, 60/103,749, filed Oct. 9, 1998, 60/099,062, filed Sep. 2, 1998, 60/098,994, filed Sep. 2, 1998, 60/094,869, filed Jul. 31, 1998, and 60/083,758, filed May 1, 1998. Each of the foregoing patent applications is incorporated by reference in their entirety.

SUBMISSION OF SEQUENCE LISTING ON ASCII TEXT FILE

The content of the following submission on ASCII text file is incorporated herein by reference in its entirety: a computer readable form (CRF) of the Sequence Listing (file name: 529552002011SubSeqList34.txt, date recorded: Feb. 26, 2013, size: 6,323 KB).

FIELD OF THE INVENTION

This invention relates to antigens from the bacterial species: *Neisseria meningitidis* and *Neisseria gonorrhoeae.*

BACKGROUND

*Neisseria meningitidis* is a non-motile, gram negative *diplococcus* human pathogen. It colonizes the pharynx, causing meningitis and, occasionally, septicaemia in the absence of meningitis. It is closely related to *N. gonorrhoea*, although one feature that clearly differentiates meningococcus from gonococcus is the presence of a polysaccharide capsule that is present in all pathogenic meningococci.

*N. meningitidis* causes both endemic and epidemic disease. In the United States the attack rate is 0.6-1 per 100,000 persons per year, and it can be much greater during outbreaks. (see Lieberman et al. (1996) Safety and Immunogenicity of a Serogroups A/C *Neisseria meningitidis* Oligosaccharide-Protein Conjugate Vaccine in Young Children. *JAMA* 275 (19):1499-1503; Schuchat et al (1997) *Bacterial Meningitis in the United States in* 1995. *N Engl J Med* 337(14):970-976). In developing countries, endemic disease rates are much higher and during epidemics incidence rates can reach 500 cases per 100,000 persons per year. Mortality is extremely high, at 10-20% in the United States, and much higher in developing countries. Following the introduction of the conjugate vaccine against *Haemophilus influenzae, N. meningitidis* is the major cause of bacterial meningitis at all ages in the United States (Schuchat et al (1997) supra).

Based on the organism's capsular polysaccharide, 12 serogroups of *N. meningitidis* have been identified. Group A is the pathogen most often implicated in epidemic disease in sub-Saharan Africa. Serogroups B and C are responsible for the vast majority of cases in the United States and in most developed countries. Serogroups W135 and Y are responsible for the rest of the cases in the United States and developed countries. The meningococcal vaccine currently in use is a tetravalent polysaccharide vaccine composed of serogroups A, C, Y and W135. Although efficacious in adolescents and adults, it induces a poor immune response and short duration of protection, and cannot be used in infants [eg. Morbidity and Mortality weekly report, Vol. 46, No. RR-5 (1997)]. This is because polysaccharides are T-cell independent antigens that induce a weak immune response that cannot be boosted by repeated immunization. Following the success of the vaccination against *H. influenzae*, conjugate vaccines against serogroups A and C have been developed and are at the final stage of clinical testing (Zollinger W D "New and Improved Vaccines Against Meningococcal Disease". In: *New Generation Vaccines*, supra, pp. 469-488; Lieberman et al (1996) supra; Costantino et al (1992) Development and phase I clinical testing of a conjugate vaccine against meningococcus A and C. *Vaccine* 10:691-698).

Meningococcus B (menB) remains a problem, however. This serotype currently is responsible for approximately 50% of total meningitis in the United States, Europe, and South America. The polysaccharide approach cannot be used because the menB capsular polysaccharide is a polymer of α(2-8)-linked N-acetyl neuraminic acid that is also present in mammalian tissue. This results in tolerance to the antigen; indeed, if an immune response were elicited, it would be anti-self, and therefore undesirable. In order to avoid induction of autoimmunity and to induce a protective immune response, the capsular polysaccharide has, for instance, been chemically modified substituting the N-acetyl groups with N-propionyl groups, leaving the specific antigenicity unaltered (Romero & Outschoorn (1994) Current status of Meningococcal group B vaccine candidates: capsular or non-capsular? *Clin Microbiol Rev* 7(4):559-575).

Alternative approaches to menB vaccines have used complex mixtures of outer membrane proteins (OMPs), containing either the OMPs alone, or OMPs enriched in porins, or deleted of the class 4 OMPs that are believed to induce antibodies that block bactericidal activity. This approach produces vaccines that are not well characterized. They are able to protect against the homologous strain, but are not effective at large where there are many antigenic variants of the outer membrane proteins. To overcome the antigenic variability, multivalent vaccines containing up to nine different porins have been constructed (eg. Poolman J T (1992) Development of a meningococcal vaccine. *Infect. Agents Dis.* 4:13-28). Additional proteins to be used in outer membrane vaccines have been the opa and opc proteins, but none of these approaches have been able to overcome the antigenic variability (eg. Ala'Aldeen & Borriello (1996) The meningococcal transferrin-binding proteins 1 and 2 are both surface exposed and generate bactericidal antibodies capable of killing homologous and heterologous strains. *Vaccine* 14(1):49-53).

A certain amount of sequence data is available for meningococcal and gonoccocal genes and proteins (eg. EP-A-0467714, WO96/29412), but this is by no means complete. The provision of further sequences could provide an opportunity to identify secreted or surface-exposed proteins that are presumed targets for the immune system and which are not antigenically variable. For instance, some of the identified proteins could be components of efficacious vaccines against meningococcus B, some could be components of vaccines against all meningococcal serotypes, and others could be components of vaccines against all pathogenic *Neisseriae* including *Neisseria meningitidis* or *Neisseria gonorrhoeae*. Those sequences specific to *N. meningitidis* or *N. gonorrhoeae* that are more highly conserved are further preferred sequences.

It is thus an object of the invention is to provide Neisserial DNA sequences which encode proteins that are antigenic or immunogenic.

BRIEF DESCRIPTION OF THE DRAWINGS

FIG. 1 illustrates the products of (B) protein expression and (A) purification, (C) FACs analysis, (D) bactericidal assay, (E) western blot, and (F) ELISA assay of the predicted ORF 919 as cloned and expressed in *E. coli.*

FIG. 2 illustrates the products of (A) protein expression and purification, (B) western blot, (C) FACs analysis, (D) bactericidal assay, and (E) ELISA assay of the predicted ORF 279 as cloned and expressed in *E. coli.*

FIG. 3 illustrates the products of (A) protein expression and purification, (B) western blot, (C) FACs analysis, (D) bactericidal assay, and (E) ELISA assay of the predicted ORF 576-1 as cloned and expressed in *E. coli.*

FIG. 4 illustrates the products of (A) protein expression and purification, (B) western blot, (C) FACs analysis, (D) bactericidal assay, and (E) ELISA assay of the predicted ORF 519-1 as cloned and expressed in *E. coli.*

FIG. 5 illustrates the products of (A) protein expression and purification, (B) western blot, (C) FACs analysis, (D) bactericidal assay, and (E) ELISA assay of the predicted ORF 121-1 as cloned and expressed in *E. coli.*

FIG. 6 illustrates the products of (A) protein expression and purification, (B) western blot, (C) FACs analysis, (D) bactericidal assay, and (E) ELISA assay of the predicted ORF 128-1 as cloned and expressed in *E. coli.*

FIG. 7 illustrates the products of (A) protein expression and purification, (B) western blot, (C) FACs analysis, (D) bactericidal assay, and (E) ELISA assay of the predicted ORF 206 as cloned and expressed in *E. coli.*

FIG. 8 illustrates the products of (A) protein expression and purification, (B) FACs analysis, (C) bactericidal assay, and (D) ELISA assay of the predicted ORF 287 as cloned and expressed in *E. coli.*

FIG. 9 illustrates the products of (A) protein expression and purification, (B) western blot, (C) FACs analysis, (D) bactericidal assay, and (E) ELISA assay of the predicted ORF 406 as cloned and expressed in *E. coli.*

FIG. 19A-C shows an alignment comparison of amino acid sequences for ORF 225 for several strains of *Neisseria*. Dark shading indicates regions of homology, and gray shading indicates the conservation of amino acids with similar characteristics. The Figure demonstrates a high degree of conservation among the various strains, further confirming its utility as an antigen for both vaccines and diagnostics. The sequences in the Figure have the following SEQ ID NOs: FA1090 SEQ ID 3115; Z2491 SEQ ID 3116; ZO01__225 SEQ ID 3117; ZO02__225 SEQ ID 3118; ZO03__225 SEQ ID 3119; ZO04__225 SEQ ID 3120; ZO05__225 SEQ ID 3121; ZO06__225 SEQ ID 3122; ZO07__225 SEQ ID 3123; ZO08__225 SEQ ID 3124; ZO09__225 SEQ ID 3125; ZO10__225 SEQ ID 3126; ZO11__225 SEQ ID 3127; ZO12__225 SEQ ID 3128; ZO13__225 SEQ ID 3129; ZO14__225 SEQ ID 3130; ZO15__225 <SEQ ID 3131; ZO16__225 SEQ ID 3132; ZO17__225 SEQ ID 3133; ZO18__225 SEQ ID 3134; ZO19__225 SEQ ID 3135; ZO20__225 SEQ ID 3136; ZO21__225 SEQ ID 3137; ZO22__225 SEQ ID 3138; ZO23__225 SEQ ID 3139; ZO24__225 SEQ ID 3140; ZO25__225 SEQ ID 3141; ZO26__225 SEQ ID 3142; ZO27__225 SEQ ID 3143; ZO28__225 SEQ ID 3144; ZO29__225 SEQ ID 3145; ZO32__225 SEQ ID 3146; ZO33__225 SEQ ID 3147; and ZO96__225 SEQ ID 3148.

THE INVENTION

Figure 10:
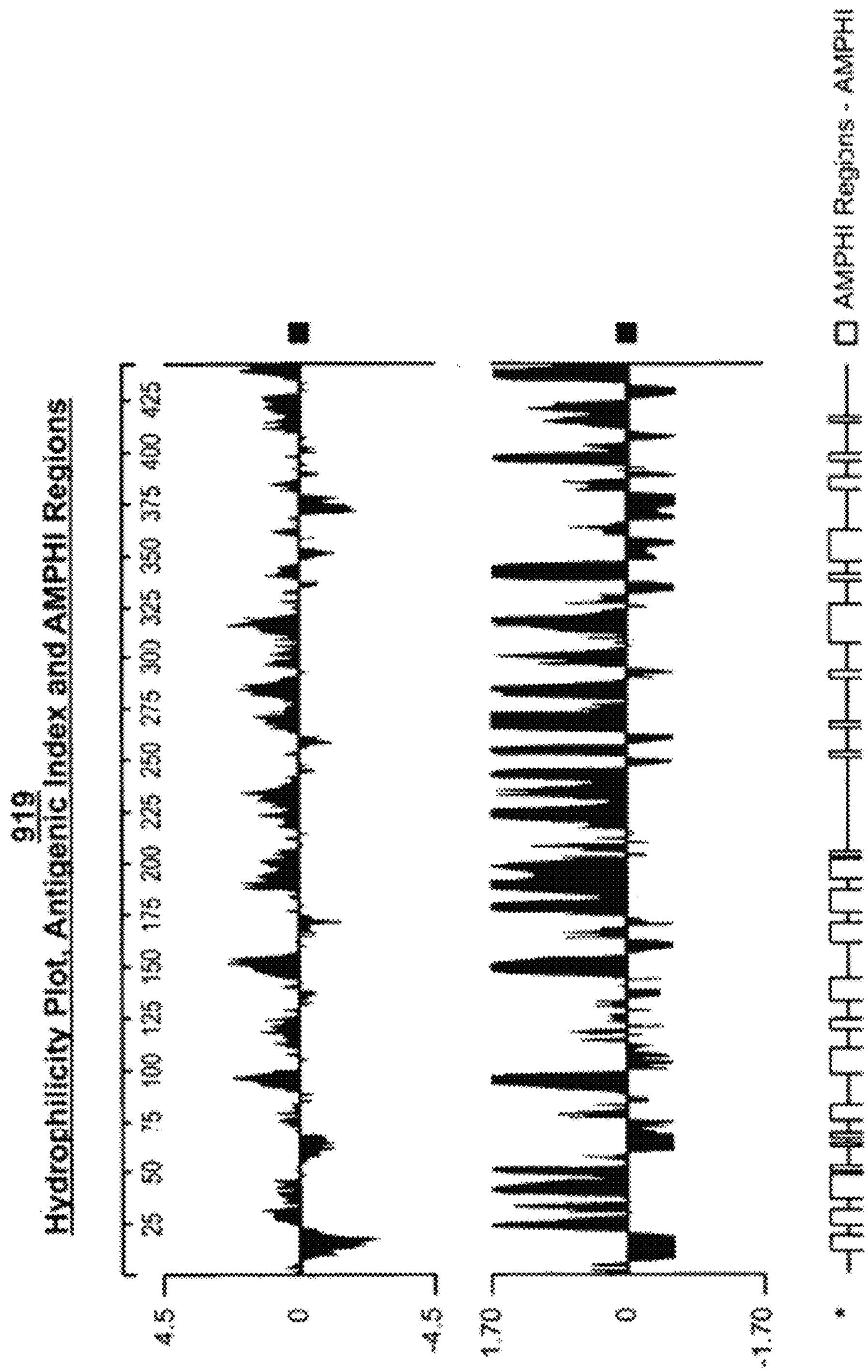
FIG. 10 illustrates the hydrophilicity plot, antigenic index and AMPHI regions of the products of protein expression the predicted ORF 919 as cloned and expressed in *E. coli.*

The invention provides proteins comprising the *N. meningitidis* amino acid sequences and *N. gonorrhoeae* amino acid sequences disclosed in the examples.

It also provides proteins comprising sequences homologous (i.e., those having sequence identity) to the *N. meningitidis* amino acid sequences disclosed in the examples. Depending on the particular sequence, the degree of homology (sequence identity) is preferably greater than 50% (eg. 60%, 70%, 80%, 90%, 95%, 99% or more). These proteins include mutants and allelic variants of the sequences disclosed in the examples. Typically, 50% identity or more between two proteins is considered to be an indication of functional equivalence. Identity between proteins is preferably determined by the Smith-Waterman homology search algorithm as implemented in MPSRCH program (Oxford Molecular) using an affine gap search with parameters:gap penalty 12, gap extension penalty 1.

The invention further provides proteins comprising fragments of the *N. meningitidis* amino acid sequences and *N. gonorrhoeae* amino acid sequences disclosed in the examples. The fragments should comprise at least n consecutive amino acids from the sequences and, depending on the particular sequence, n is 7 or more (eg. 8, 10, 12, 14, 16, 18, 20 or more). Preferably the fragments comprise an epitope from the sequence.

The proteins of the invention can, of course, be prepared by various means (eg. recombinant expression, purification from cell culture, chemical synthesis etc.) and in various forms (eg. native, fusions etc.). They are preferably prepared in substantially pure or isolated form (i.e. substantially free from other *N. meningitidis* or *N. gonorrhoeae* host cell proteins)

According to a further aspect, the invention provides antibodies which bind to these proteins. These may be polyclonal or monoclonal and may be produced by any suitable means.

According to a further aspect, the invention provides nucleic acid comprising the *N. meningitidis* nucleotide sequences and *N. gonorrhoeae* nucleotide sequences disclosed in the examples.

According to a further aspect, the invention comprises nucleic acids having sequence identity of greater than 50% (e.g., 60%, 70%, 80%, 90%, 95%, 99% or more) to the nucleic acid sequences herein. Sequence identity is determined as above-discussed.

According to a further aspect, the invention comprises nucleic acid that hybridizes to the sequences provided herein. Conditions for hybridization are set forth herein.

Nucleic acid comprising fragments of these sequences are also provided. These should comprise at least n consecutive nucleotides from the *N. meningitidis* sequences or *N. gonorrhoeae* sequences and depending on the particular sequence, n is 10 or more (eg 12, 14, 15, 18, 20, 25, 30, 35, 40 or more).

According to a further aspect, the invention provides nucleic acid encoding the proteins and protein fragments of the invention.

It should also be appreciated that the invention provides nucleic acid comprising sequences complementary to those described above (eg. for antisense or probing purposes).

Nucleic acid according to the invention can, of course, be prepared in many ways (eg. by chemical synthesis, in part or in whole, from genomic or cDNA libraries, from the organism itself etc.) and can take various forms (eg. single stranded, double stranded, vectors, probes etc.).

In addition, the term "nucleic acid" includes DNA and RNA, and also their analogues, such as those containing modified backbones, and also protein nucleic acids (PNA) etc.

According to a further aspect, the invention provides vectors comprising nucleotide sequences of the invention (eg. expression vectors) and host cells transformed with such vectors.

According to a further aspect, the invention provides compositions comprising protein, antibody, and/or nucleic acid according to the invention. These compositions may be suitable as vaccines, for instance, or as diagnostic reagents or as immunogenic compositions.

The invention also provides nucleic acid, protein, or antibody according to the invention for use as medicaments (eg. as vaccines) or as diagnostic reagents. It also provides the use of nucleic acid, protein, or antibody according to the invention in the manufacture of (I) a medicament for treating or preventing infection due to Neisserial bacteria (ii) a diagnostic reagent for detecting the presence of Neisserial bacteria or of antibodies raised against Neisserial bacteria or (iii) for raising antibodies. Said Neisserial bacteria may be any species or strain (such as *N. gonorrhoeae*) but are preferably *N. meningitidis*, especially strain B or strain C.

The invention also provides a method of treating a patient, comprising administering to the patient a therapeutically effective amount of nucleic acid, protein, and/or antibody according to the invention.

According to further aspects, the invention provides various processes.

A process for producing proteins of the invention is provided, comprising the step of culturing a host cell according to the invention under conditions which induce protein expression.

A process for detecting polynucleotides of the invention is provided, comprising the steps of: (a) contacting a nucleic probe according to the invention with a biological sample under hybridizing conditions to form duplexes; and (b) detecting said duplexes.

A process for detecting proteins of the invention is provided, comprising the steps of: (a) contacting an antibody according to the invention with a biological sample under conditions suitable for the formation of an antibody-antigen complexes; and (b) detecting said complexes.

A summary of standard techniques and procedures which may be employed in order to perform the invention (eg. to utilize the disclosed sequences for vaccination or diagnostic purposes) is attached as an Appendix to the application. This summary is not a limitation on the invention but, rather, gives examples that may be used, but are not required.

Having now generally described the invention, the same will be more readily understood through reference to the following examples which are provided by way of illustration, and are not intended to be limiting of the present invention, unless specified.

Methodology—Summary of Standard Procedures and Techniques.

General

This invention provides *Neisseria meningitidis* menB nucleotide sequences, amino acid sequences encoded therein. With these disclosed sequences, nucleic acid probe assays and expression cassettes and vectors can be produced. The expression vectors can be transformed into host cells to produce proteins. The purified or isolated polypeptides (which may also be chemically synthesized) can be used to produce antibodies to detect menB proteins. Also, the host cells or extracts can be utilized for biological assays to isolate agonists or antagonists. In addition, with these sequences one can search to identify open reading frames and identify amino acid sequences. The proteins may also be used in immunogenic compositions, antigenic compositions and as vaccine components.

The practice of the present invention will employ, unless otherwise indicated, conventional techniques of molecular biology, microbiology, recombinant DNA, and immunology, which are within the skill of the art. Such techniques are explained fully in the literature e.g., Sambrook *Molecular Cloning; A Laboratory Manual, Second Edition* (1989); *DNA Cloning, Volumes I and ii* (D. N Glover ed. 1985); *Oligonucleotide Synthesis* (M. J. Gait ed, 1984); *Nucleic Acid Hybridization* (B. D. Hames & S. J. Higgins eds. 1984); *Transcription and Translation* (B. D. Hames & S. J. Higgins eds. 1984); *Animal Cell Culture* (R. I. Freshney ed. 1986); *Immobilized Cells and Enzymes* (IRL Press, 1986); B. Perbal, *A Practical Guide to Molecular Cloning* (1984); the *Methods in Enzymology* series (Academic Press, Inc.), especially volumes 154 & 155*; Gene Transfer Vectors for Mammalian Cells* (J. H. Miller and M. P. Calos eds. 1987, Cold Spring Harbor Laboratory); Mayer and Walker, eds. (1987), *Immunochemical Methods in Cell and Molecular Biology* (Academic Press, London); Scopes, (1987) *Protein Purification: Principles and Practice*, Second Edition (Springer-Verlag, N.Y.), and *Handbook of Experimental Immunology, Volumes I-IV* (D. M. Weir and C. C. Blackwell eds 1986).

Standard abbreviations for nucleotides and amino acids are used in this specification.

All publications, patents, and patent applications cited herein are incorporated in full by reference.

Expression Systems

The *Neisseria* menB nucleotide sequences can be expressed in a variety of different expression systems; for example those used with mammalian cells, plant cells, baculoviruses, bacteria, and yeast.

i. Mammalian Systems

Mammalian expression systems are known in the art. A mammalian promoter is any DNA sequence capable of binding mammalian RNA polymerase and initiating the downstream (3') transcription of a coding sequence (e.g., structural gene) into mRNA. A promoter will have a transcription initiating region, which is usually placed proximal to the 5' end of the coding sequence, and a TATA box, usually located 25-30 base pairs (bp) upstream of the transcription initiation site. The TATA box is thought to direct RNA polymerase II to begin RNA synthesis at the correct site. A mammalian promoter will also contain an upstream promoter element, usually located within 100 to 200 bp upstream of the TATA box. An upstream promoter element determines the rate at which transcription is initiated and can act in either orientation (Sambrook et al. (1989) "Expression of Cloned Genes in Mammalian Cells." In *Molecular Cloning: A Laboratory Manual, 2nd ed.*).

Mammalian viral genes are often highly expressed and have a broad host range; therefore sequences encoding mammalian viral genes provide particularly useful promoter sequences. Examples include the SV40 early promoter, mouse mammary tumor virus LTR promoter, adenovirus major late promoter (Ad MLP), and herpes simplex virus promoter. In addition, sequences derived from non-viral genes, such as the murine metallothionein gene, also provide useful promoter sequences. Expression may be either constitutive or regulated (inducible). Depending on the promoter selected, many promotes may be inducible using known substrates, such as the use of the mouse mammary tumor virus (MMTV) promoter with the glucocorticoid responsive element (GRE) that is induced by glucocorticoid in hormone-responsive transformed cells (see for example, U.S. Pat. No. 5,783,681).

The presence of an enhancer element (enhancer), combined with the promoter elements described above, will usually increase expression levels. An enhancer is a regulatory DNA sequence that can stimulate transcription up to 1000-fold when linked to homologous or heterologous promoters, with synthesis beginning at the normal RNA start site. Enhancers are also active when they are placed upstream or downstream from the transcription initiation site, in either normal or flipped orientation, or at a distance of more than 1000 nucleotides from the promoter (Maniatis et al. (1987) *Science* 236:1237; Alberts et al. (1989) *Molecular Biology of the Cell,* 2nd ed.). Enhancer elements derived from viruses may be particularly useful, because they usually have a broader host range. Examples include the SV40 early gene enhancer (Dijkema et al (1985) *EMBO J.* 4:761) and the enhancer/promoters derived from the long terminal repeat (LTR) of the Rous Sarcoma Virus (Gorman et al. (1982b) *Proc. Natl. Acad. Sci.* 79:6777) and from human cytomegalovirus (Boshart et al. (1985) *Cell* 41:521). Additionally, some enhancers are regulatable and become active only in the presence of an inducer, such as a hormone or metal ion (Sassone-Corsi and Borelli (1986) *Trends Genet.* 2:215; Maniatis et al. (1987) *Science* 236:1237).

A DNA molecule may be expressed intracellularly in mammalian cells. A promoter sequence may be directly linked with the DNA molecule, in which case the first amino acid at the N-terminus of the recombinant protein will always be a methionine, which is encoded by the ATG start codon. If desired, the N-terminus may be cleaved from the protein by in vitro incubation with cyanogen bromide.

Alternatively, foreign proteins can also be secreted from the cell into the growth media by creating chimeric DNA molecules that encode a fusion protein comprised of a leader sequence fragment that provides for secretion of the foreign protein in mammalian cells. Preferably, there are processing sites encoded between the leader fragment and the foreign gene that can be cleaved either in vivo or in vitro. The leader sequence fragment usually encodes a signal peptide comprised of hydrophobic amino acids which direct the secretion of the protein from the cell. The adenovirus tripartite leader is an example of a leader sequence that provides for secretion of a foreign protein in mammalian cells.

Usually, transcription termination and polyadenylation sequences recognized by mammalian cells are regulatory regions located 3' to the translation stop codon and thus, together with the promoter elements, flank the coding sequence. The 3' terminus of the mature mRNA is formed by site-specific post-transcriptional cleavage and polyadenylation (Birnstiel et al. (1985) *Cell* 41:349; Proudfoot and Whitelaw (1988) "Termination and 3' end processing of eukaryotic RNA. In *Transcription and splicing* (ed. B. D. Hames and D. M. Glover); Proudfoot (1989) *Trends Biochem. Sci.* 14:105). These sequences direct the transcription of an mRNA which can be translated into the polypeptide encoded by the DNA. Examples of transcription terminator/polyadenylation signals include those derived from SV40 (Sambrook et al (1989) "Expression of cloned genes in cultured mammalian cells." In *Molecular Cloning: A Laboratory Manual*).

Usually, the above described components, comprising a promoter, polyadenylation signal, and transcription termination sequence are put together into expression constructs. Enhancers, introns with functional splice donor and acceptor sites, and leader sequences may also be included in an expression construct, if desired. Expression constructs are often maintained in a replicon, such as an extrachromosomal element (e.g., plasmids) capable of stable maintenance in a host, such as mammalian cells or bacteria. Mammalian replication systems include those derived from animal viruses, which require trans-acting factors to replicate. For example, plasmids containing the replication systems of papovaviruses, such as SV40 (Gluzman (1981) *Cell* 23:175) or polyomavirus, replicate to extremely high copy number in the presence of the appropriate viral T antigen. Additional examples of mammalian replicons include those derived from bovine papillomavirus and Epstein-Barr virus. Additionally, the replicon may have two replication systems, thus allowing it to be maintained, for example, in mammalian cells for expression and in a prokaryotic host for cloning and amplification. Examples of such mammalian-bacteria shuttle vectors include pMT2 (Kaufman et al. (1989) *Mol. Cell. Biol.* 9:946) and pHEBO (Shimizu et al. (1986) *Mol. Cell. Biol.* 6:1074).

The transformation procedure used depends upon the host to be transformed. Methods for introduction of heterologous polynucleotides into mammalian cells are known in the art and include dextran-mediated transfection, calcium phosphate precipitation, polybrene mediated transfection, protoplast fusion, electroporation, encapsulation of the polynucleotide(s) in liposomes, and direct microinjection of the DNA into nuclei.

Mammalian cell lines available as hosts for expression are known in the art and include many immortalized cell lines available from the American Type Culture Collection (ATCC), including but not limited to, Chinese hamster ovary (CHO) cells, HeLa cells, baby hamster kidney (BHK) cells, monkey kidney cells (COS), human hepatocellular carcinoma cells (e.g., Hep G2), and a number of other cell lines.

ii. Plant Cellular Expression Systems

There are many plant cell culture and whole plant genetic expression systems known in the art. Exemplary plant cellular genetic expression systems include those described in patents, such as: U.S. Pat. No. 5,693,506; U.S. Pat. No. 5,659,122; and U.S. Pat. No. 5,608,143. Additional examples of genetic expression in plant cell culture has been described by Zenk, *Phytochemistry* 30:3861-3863 (1991). Descriptions of plant protein signal peptides may be found in addition to the references described above in Vaulcombe et al., *Mol. Gen. Genet.* 209:33-40 (1987); Chandler et al., *Plant Molecular Biology* 3:407-418 (1984); Rogers, *J. Biol. Chem.* 260:3731-3738 (1985); Rothstein et al., *Gene* 55:353-356 (1987); Whittier et al., Nucleic Acids Research 15:2515-2535 (1987); Wirsel et al., *Molecular Microbiology* 3:3-14 (1989); Yu et al., *Gene* 122:247-253 (1992). A description of the regulation of plant gene expression by the phytohormone, gibberellic acid and secreted enzymes induced by gibberellic acid can be found in R. L. Jones and J. MacMillin, Gibberellins: in: *Advanced Plant Physiology*, Malcolm B. Wilkins, ed., 1984 Pitman Publishing Limited, London, pp. 21-52. References that describe other metabolically-regulated genes: Sheen, *Plant Cell,* 2:1027-1038 (1990); Maas et al., *EMBO J.* 9:3447-3452 (1990); Benkel and Hickey, *Proc. Natl. Acad. Sci.* 84:1337-1339 (1987)

Typically, using techniques known in the art, a desired polynucleotide sequence is inserted into an expression cassette comprising genetic regulatory elements designed for operation in plants. The expression cassette is inserted into a desired expression vector with companion sequences upstream and downstream from the expression cassette suitable for expression in a plant host. The companion sequences will be of plasmid or viral origin and provide necessary characteristics to the vector to permit the vectors to move DNA from an original cloning host, such as bacteria, to the desired plant host. The basic bacterial/plant vector construct will preferably provide a broad host range prokaryote replication origin; a prokaryote selectable marker; and, for *Agrobacterium* transformations, T DNA sequences for *Agrobacterium*-mediated transfer to plant chromosomes. Where the heterologous gene is not readily amenable to detection, the construct will preferably also have a selectable marker gene suitable for determining if a plant cell has been transformed. A general review of suitable markers, for example for the members of the grass family, is found in Wilmink and Dons, 1993*, Plant Mol. Biol. Reptr,* 11(2):165-185.

Sequences suitable for permitting integration of the heterologous sequence into the plant genome are also recommended. These might include transposon sequences and the like for homologous recombination as well as Ti sequences which permit random insertion of a heterologous expression cassette into a plant genome. Suitable prokaryote selectable markers include resistance toward antibiotics such as ampicillin or tetracycline. Other DNA sequences encoding additional functions may also be present in the vector, as is known in the art.

The nucleic acid molecules of the subject invention may be included into an expression cassette for expression of the protein(s) of interest. Usually, there will be only one expression cassette, although two or more are feasible. The recombinant expression cassette will contain in addition to the heterologous protein encoding sequence the following elements, a promoter region, plant 5' untranslated sequences, initiation codon depending upon whether or not the structural gene comes equipped with one, and a transcription and translation termination sequence. Unique restriction enzyme sites at the 5' and 3' ends of the cassette allow for easy insertion into a pre-existing vector.

A heterologous coding sequence may be for any protein relating to the present invention. The sequence encoding the protein of interest will encode a signal peptide which allows processing and translocation of the protein, as appropriate, and will usually lack any sequence which might result in the binding of the desired protein of the invention to a membrane. Since, for the most part, the transcriptional initiation region will be for a gene which is expressed and translocated during germination, by employing the signal peptide which provides for translocation, one may also provide for translocation of the protein of interest. In this way, the protein(s) of interest will be translocated from the cells in which they are expressed and may be efficiently harvested. Typically secretion in seeds are across the aleurone or scutellar epithelium layer into the endosperm of the seed. While it is not required that the protein be secreted from the cells in which the protein is produced, this facilitates the isolation and purification of the recombinant protein.

Since the ultimate expression of the desired gene product will be in a eucaryotic cell it is desirable to determine whether any portion of the cloned gene contains sequences which will be processed out as introns by the host's splicosome machinery. If so, site-directed mutagenesis of the "intron" region may be conducted to prevent losing a portion of the genetic message as a false intron code, Reed and Maniatis, *Cell* 41:95-105, 1985.

The vector can be microinjected directly into plant cells by use of micropipettes to mechanically transfer the recombinant DNA. Crossway, *Mol. Gen. Genet*, 202:179-185, 1985. The genetic material may also be transferred into the plant cell by using polyethylene glycol, Krens, et al., *Nature*, 296, 72-74, 1982. Another method of introduction of nucleic acid segments is high velocity ballistic penetration by small particles with the nucleic acid either within the matrix of small beads or particles, or on the surface, Klein, et al., *Nature*, 327, 70-73, 1987 and Knudsen and Muller, 1991, *Planta*, 185:330-336 teaching particle bombardment of barley endosperm to create transgenic barley. Yet another method of introduction would be fusion of protoplasts with other entities, either minicells, cells, lysosomes or other fusible lipid-surfaced bodies, Fraley, et al., *Proc. Natl. Acad. Sci. USA*, 79, 1859-1863, 1982.

The vector may also be introduced into the plant cells by electroporation. (Fromm et al., *Proc. Natl. Acad. Sci. USA* 82:5824, 1985). In this technique, plant protoplasts are electroporated in the presence of plasmids containing the gene construct. Electrical impulses of high field strength reversibly permeabilize biomembranes allowing the introduction of the plasmids. Electroporated plant protoplasts reform the cell wall, divide, and form plant callus.

All plants from which protoplasts can be isolated and cultured to give whole regenerated plants can be transformed by the present invention so that whole plants are recovered which contain the transferred gene. It is known that practically all plants can be regenerated from cultured cells or tissues, including but not limited to all major species of sugarcane, sugar beet, cotton, fruit and other trees, legumes and vegetables. Some suitable plants include, for example, species from the genera *Fragaria, Lotus, Medicago, Onobrychis, Trifolium, Trigonella, Vigna, Citrus, Linum, Geranium, Manihot, Daucus, Arabidopsis, Brassica, Raphanus, Sinapis, Atropa, Capsicum, Datura, Hyoscyamus, Lycopersion, Nicotiana, Solanum, Petunia, Digitalis, Majorana, Cichorium, Helianthus, Lactuca, Bromus, Asparagus, Antirrhinum, Hererocallis, Nemesia, Pelargonium, Panicum, Pennisetum, Ranunculus, Senecio, Salpiglossis, Cucumis, Browaalia, Glycine, Lolium, Zea, Triticum, Sorghum*, and *Datura*.

Means for regeneration vary from species to species of plants, but generally a suspension of transformed protoplasts containing copies of the heterologous gene is first provided. Callus tissue is formed and shoots may be induced from callus and subsequently rooted. Alternatively, embryo formation can be induced from the protoplast suspension. These embryos germinate as natural embryos to form plants. The culture media will generally contain various amino acids and hormones, such as auxin and cytokinins. It is also advantageous to add glutamic acid and proline to the medium, especially for such species as corn and alfalfa. Shoots and roots normally develop simultaneously. Efficient regeneration will depend on the medium, on the genotype, and on the history of the culture. If these three variables are controlled, then regeneration is fully reproducible and repeatable.

In some plant cell culture systems, the desired protein of the invention may be excreted or alternatively, the protein may be extracted from the whole plant. Where the desired protein of the invention is secreted into the medium, it may be collected. Alternatively, the embryos and embryoless-half seeds or other plant tissue may be mechanically disrupted to release any secreted protein between cells and tissues. The mixture may be suspended in a buffer solution to retrieve soluble proteins. Conventional protein isolation and purification methods will be then used to purify the recombinant protein. Parameters of time, temperature pH, oxygen, and volumes will be adjusted through routine methods to optimize expression and recovery of heterologous protein.

iii. Baculovirus Systems

The polynucleotide encoding the protein can also be inserted into a suitable insect expression vector, and is operably linked to the control elements within that vector. Vector construction employs techniques which are known in the art. Generally, the components of the expression system include a transfer vector, usually a bacterial plasmid, which contains both a fragment of the baculovirus genome, and a convenient restriction site for insertion of the heterologous gene or genes to be expressed; a wild type baculovirus with a sequence homologous to the baculovirus-specific fragment in the transfer vector (this allows for the homologous recombination of the heterologous gene in to the baculovirus genome); and appropriate insect host cells and growth media.

After inserting the DNA sequence encoding the protein into the transfer vector, the vector and the wild type viral genome are transfected into an insect host cell where the vector and viral genome are allowed to recombine. The packaged recombinant virus is expressed and recombinant plaques are identified and purified. Materials and methods for baculovirus/insect cell expression systems are commercially available in kit form from, inter alia, Invitrogen, San Diego Calif. ("MAXBAC™" kit). These techniques are generally known to those skilled in the art and fully described in Summers and Smith, *Texas Agricultural Experiment Station Bulletin No.* 1555 (1987) (hereinafter "Summers and Smith").

Prior to inserting the DNA sequence encoding the protein into the baculovirus genome, the above described components, comprising a promoter, leader (if desired), coding sequence of interest, and transcription termination sequence, are usually assembled into an intermediate transplacement construct (transfer vector). This construct may contain a single gene and operably linked regulatory elements; multiple genes, each with its owned set of operably linked regulatory elements; or multiple genes, regulated by the same set of regulatory elements. Intermediate transplacement constructs are often maintained in a replicon, such as an extrachromosomal element (e.g., plasmids) capable of stable maintenance in a host, such as a bacterium. The replicon will have a replication system, thus allowing it to be maintained in a suitable host for cloning and amplification.

Currently, the most commonly used transfer vector for introducing foreign genes into AcNPV is pAc373. Many other vectors, known to those of skill in the art, have also been designed. These include, for example, pVL985 (which alters the polyhedrin start codon from ATG to ATT, and which introduces a BamHI cloning site 32 basepairs downstream from the ATT; see Luckow and Summers, *Virology* (1989) 17:31.

The plasmid usually also contains the polyhedrin polyadenylation signal (Miller et al. (1988) *Ann. Rev. Microbiol.,* 42:177) and a prokaryotic ampicillin-resistance (amp) gene and origin of replication for selection and propagation in *E. coli.*

Baculovirus transfer vectors usually contain a baculovirus promoter. A baculovirus promoter is any DNA sequence capable of binding a baculovirus RNA polymerase and initiating the downstream (5' to 3') transcription of a coding sequence (e.g., structural gene) into mRNA. A promoter will have a transcription initiation region which is usually placed proximal to the 5' end of the coding sequence. This transcription initiation region usually includes an RNA polymerase binding site and a transcription initiation site. A baculovirus transfer vector may also have a second domain called an enhancer, which, if present, is usually distal to the structural gene. Expression may be either regulated or constitutive.

Structural genes, abundantly transcribed at late times in a viral infection cycle, provide particularly useful promoter sequences. Examples include sequences derived from the gene encoding the viral polyhedron protein, Friesen et al., (1986) "The Regulation of Baculovirus Gene Expression," in: *The Molecular Biology of Baculoviruses* (ed. Walter Doerfler); EPO Publ. Nos. 127 839 and 155 476; and the gene encoding the p10 protein, Vlak et al., (1988), *J. Gen. Virol.* 69:765.

DNA encoding suitable signal sequences can be derived from genes for secreted insect or baculovirus proteins, such as the baculovirus polyhedrin gene (Carbonell et al. (1988) *Gene,* 73:409). Alternatively, since the signals for mammalian cell posttranslational modifications (such as signal peptide cleavage, proteolytic cleavage, and phosphorylation) appear to be recognized by insect cells, and the signals required for secretion and nuclear accumulation also appear to be conserved between the invertebrate cells and vertebrate cells, leaders of non-insect origin, such as those derived from genes encoding human (alpha) α-interferon, Maeda et al., (1985), *Nature* 315:592; human gastrin-releasing peptide, Lebacq-Verheyden et al., (1988), *Molec. Cell. Biol.* 8:3129; human IL-2, Smith et al., (1985) *Proc. Nat'l Acad. Sci. USA,* 82:8404; mouse IL-3, (Miyajima et al., (1987) *Gene* 58:273; and human glucocerebrosidase, Martin et al. (1988) *DNA,* 7:99, can also be used to provide for secretion in insects.

A recombinant polypeptide or polyprotein may be expressed intracellularly or, if it is expressed with the proper regulatory sequences, it can be secreted. Good intracellular expression of nonfused foreign proteins usually requires heterologous genes that ideally have a short leader sequence containing suitable translation initiation signals preceding an ATG start signal. If desired, methionine at the N-terminus may be cleaved from the mature protein by in vitro incubation with cyanogen bromide.

Alternatively, recombinant polyproteins or proteins which are not naturally secreted can be secreted from the insect cell by creating chimeric DNA molecules that encode a fusion protein comprised of a leader sequence fragment that provides for secretion of the foreign protein in insects. The leader sequence fragment usually encodes a signal peptide comprised of hydrophobic amino acids which direct the translocation of the protein into the endoplasmic reticulum.

After insertion of the DNA sequence and/or the gene encoding the expression product precursor of the protein, an insect cell host is co-transformed with the heterologous DNA of the transfer vector and the genomic DNA of wild type baculovirus—usually by co-transfection. The promoter and transcription termination sequence of the construct will usually comprise a 2-5 kb section of the baculovirus genome. Methods for introducing heterologous DNA into the desired site in the baculovirus virus are known in the art. (See Summers and Smith supra; Ju et al. (1987); Smith et al., *Mol. Cell. Biol.* (1983) 3:2156; and Luckow and Summers (1989)). For example, the insertion can be into a gene such as the polyhedrin gene, by homologous double crossover recombination; insertion can also be into a restriction enzyme site engineered into the desired baculovirus gene. Miller et al., (1989), *Bioessays* 4:91. The DNA sequence, when cloned in place of the polyhedrin gene in the expression vector, is flanked both 5' and 3' by polyhedrin-specific sequences and is positioned downstream of the polyhedrin promoter.

The newly formed baculovirus expression vector is subsequently packaged into an infectious recombinant baculovirus. Homologous recombination occurs at low frequency (between about 1% and about 5%); thus, the majority of the virus produced after cotransfection is still wild-type virus. Therefore, a method is necessary to identify recombinant viruses. An advantage of the expression system is a visual screen allowing recombinant viruses to be distinguished. The polyhedrin protein, which is produced by the native virus, is produced at very high levels in the nuclei of infected cells at late times after viral infection. Accumulated polyhedrin protein forms occlusion bodies that also contain embedded particles. These occlusion bodies, up to 15 μm in size, are highly refractile, giving them a bright shiny appearance that is readily visualized under the light microscope. Cells infected with recombinant viruses lack occlusion bodies. To distinguish recombinant virus from wild-type virus, the transfection supernatant is plagued onto a monolayer of insect cells by techniques known to those skilled in the art. Namely, the plaques are screened under the light microscope for the presence (indicative of wild-type virus) or absence (indicative of recombinant virus) of occlusion bodies. *Current Protocols in Microbiology* Vol. 2 (Ausubel et al. eds) at 16.8 (Supp. 10, 1990); Summers and Smith, supra; Miller et al. (1989).

Recombinant baculovirus expression vectors have been developed for infection into several insect cells. For example, recombinant baculoviruses have been developed for, inter alia: *Aedes aegypti, Autographa californica, Bombyx mori, Drosophila melanogaster, Spodoptera frugiperda*, and *Trichoplusia ni* (PCT Pub. No. WO 89/046699; Carbonell et al., (1985) *J. Virol.* 56:153; Wright (1986) *Nature* 321:718; Smith et al., (1983) *Mol. Cell. Biol.* 3:2156; and see generally, Fraser, et al. (1989) In Vitro *Cell. Dev. Biol.* 25:225).

Cells and cell culture media are commercially available for both direct and fusion expression of heterologous polypeptides in a baculovirus/expression system; cell culture technology is generally known to those skilled in the art. See, e.g., Summers and Smith supra.

The modified insect cells may then be grown in an appropriate nutrient medium, which allows for stable maintenance of the plasmid(s) present in the modified insect host. Where the expression product gene is under inducible control, the host may be grown to high density, and expression induced. Alternatively, where expression is constitutive, the product will be continuously expressed into the medium and the nutrient medium must be continuously circulated, while removing the product of interest and augmenting depleted nutrients. The product may be purified by such techniques as chromatography, e.g., HPLC, affinity chromatography, ion exchange chromatography, etc.; electrophoresis; density gradient centrifugation; solvent extraction, or the like. As appropriate, the product may be further purified, as required, so as to remove substantially any insect proteins which are also secreted in the medium or result from lysis of insect cells, so as to provide a product which is at least substantially free of host debris, e.g., proteins, lipids and polysaccharides.

In order to obtain protein expression, recombinant host cells derived from the transformants are incubated under conditions which allow expression of the recombinant protein encoding sequence. These conditions will vary, dependent upon the host cell selected. However, the conditions are readily ascertainable to those of ordinary skill in the art, based upon what is known in the art.

iv. Bacterial Systems

Bacterial expression techniques are known in the art. A bacterial promoter is any DNA sequence capable of binding bacterial RNA polymerase and initiating the downstream (3') transcription of a coding sequence (e.g. structural gene) into mRNA. A promoter will have a transcription initiation region which is usually placed proximal to the 5' end of the coding sequence. This transcription initiation region usually includes an RNA polymerase binding site and a transcription initiation site. A bacterial promoter may also have a second domain called an operator, that may overlap an adjacent RNA polymerase binding site at which RNA synthesis begins. The operator permits negative regulated (inducible) transcription, as a gene repressor protein may bind the operator and thereby inhibit transcription of a specific gene. Constitutive expression may occur in the absence of negative regulatory elements, such as the operator. In addition, positive regulation may be achieved by a gene activator protein binding sequence, which, if present is usually proximal (5') to the RNA polymerase binding sequence. An example of a gene activator protein is the catabolite activator protein (CAP), which helps initiate transcription of the lac operon in *Escherichia coli* (*E. coli*) (Raibaud et al. (1984) *Annu. Rev. Genet.* 18:173). Regulated expression may therefore be either positive or negative, thereby either enhancing or reducing transcription.

Sequences encoding metabolic pathway enzymes provide particularly useful promoter sequences. Examples include promoter sequences derived from sugar metabolizing enzymes, such as galactose, lactose (lac) (Chang et al. (1977) *Nature* 198:1056), and maltose. Additional examples include promoter sequences derived from biosynthetic enzymes such as tryptophan (trp) (Goeddel et al. (1980) *Nuc. Acids Res.* 8:4057; Yelverton et al. (1981) *Nucl. Acids Res.* 9:731; U.S. Pat. No. 4,738,921; EPO Publ. Nos. 036 776 and 121 775). The beta-lactamase (bla) promoter system (Weissmann (1981) "The cloning of interferon and other mistakes." In *Interferon* 3 (ed. I. Gresser)), bacteriophage lambda PL (Shimatake et al. (1981) *Nature* 292:128) and T5 (U.S. Pat. No. 4,689,406) promoter systems also provide useful promoter sequences.

In addition, synthetic promoters which do not occur in nature also function as bacterial promoters. For example, transcription activation sequences of one bacterial or bacteriophage promoter may be joined with the operon sequences of another bacterial or bacteriophage promoter, creating a synthetic hybrid promoter (U.S. Pat. No. 4,551,433). For example, the tac promoter is a hybrid trp-lac promoter comprised of both trp promoter and lac operon sequences that is regulated by the lac repressor (Amann et al. (1983) *Gene* 25:167; de Boer et al. (1983) *Proc. Natl. Acad. Sci.* 80:21). Furthermore, a bacterial promoter can include naturally occurring promoters of non-bacterial origin that have the ability to bind bacterial RNA polymerase and initiate transcription. A naturally occurring promoter of non-bacterial origin can also be coupled with a compatible RNA polymerase to produce high levels of expression of some genes in prokaryotes. The bacteriophage T7 RNA polymerase/promoter system is an example of a coupled promoter system (Studier et al. (1986) *J. Mol. Biol.* 189:113; Tabor et al. (1985) *Proc Natl. Acad. Sci.* 82:1074). In addition, a hybrid promoter can also be comprised of a bacteriophage promoter and an *E. coli* operator region (EPO Publ. No. 267 851).

In addition to a functioning promoter sequence, an efficient ribosome binding site is also useful for the expression of foreign genes in prokaryotes. In *E. coli*, the ribosome binding site is called the Shine-Dalgarno (SD) sequence and includes an initiation codon (ATG) and a sequence 3-9 nucleotides in length located 3-11 nucleotides upstream of the initiation codon (Shine et al. (1975) *Nature* 254:34). The SD sequence is thought to promote binding of mRNA to the ribosome by the pairing of bases between the SD sequence and the 3' end of *E. coli* 16S rRNA (Steitz et al. (1979) "Genetic signals and nucleotide sequences in messenger RNA." In *Biological Regulation and Development: Gene Expression* (ed. R. F. Goldberger)). To express eukaryotic genes and prokaryotic genes with weak ribosome-binding site, it is often necessary to optimize the distance between the SD sequence and the ATG of the eukaryotic gene (Sambrook et al. (1989) "Expression of cloned genes in *Escherichia coli*." In *Molecular Cloning: A Laboratory Manual*).

A DNA molecule may be expressed intracellularly. A promoter sequence may be directly linked with the DNA molecule, in which case the first amino acid at the N-terminus will always be a methionine, which is encoded by the ATG start codon. If desired, methionine at the N-terminus may be cleaved from the protein by in vitro incubation with cyanogen bromide or by either in vivo or in vitro incubation with a bacterial methionine N-terminal peptidase (EPO Publ. No. 219 237).

Fusion proteins provide an alternative to direct expression. Usually, a DNA sequence encoding the N-terminal portion of an endogenous bacterial protein, or other stable protein, is fused to the 5' end of heterologous coding sequences. Upon expression, this construct will provide a fusion of the two amino acid sequences. For example, the bacteriophage lambda cell gene can be linked at the 5' terminus of a foreign gene and expressed in bacteria. The resulting fusion protein preferably retains a site for a processing enzyme (factor Xa) to cleave the bacteriophage protein from the foreign gene (Nagai et al. (1984) *Nature* 309:810). Fusion proteins can also be made with sequences from the lacZ (Jia et al. (1987) *Gene* 60:197), trpE (Allen et al. (1987) J. Biotechnol. 5:93; Makoff et al. (1989) *J. Gen. Microbiol.* 135:11), and Chey (EPO Publ. No. 324 647) genes. The DNA sequence at the junction of the two amino acid sequences may or may not encode a cleavable site. Another example is a ubiquitin fusion protein. Such a fusion protein is made with the ubiquitin region that preferably retains a site for a processing enzyme (e.g. ubiquitin specific processing-protease) to cleave the ubiquitin from the foreign protein. Through this method, native foreign protein can be isolated (Miller et al. (1989) *Bio/Technology* 7:698).

Alternatively, foreign proteins can also be secreted from the cell by creating chimeric DNA molecules that encode a fusion protein comprised of a signal peptide sequence fragment that provides for secretion of the foreign protein in bacteria (U.S. Pat. No. 4,336,336). The signal sequence fragment usually encodes a signal peptide comprised of hydrophobic amino acids which direct the secretion of the protein from the cell. The protein is either secreted into the growth media (gram-positive bacteria) or into the periplasmic space, located between the inner and outer membrane of the cell (gram-negative bacteria). Preferably there are processing sites, which can be cleaved either in vivo or in vitro encoded between the signal peptide fragment and the foreign gene.

DNA encoding suitable signal sequences can be derived from genes for secreted bacterial proteins, such as the *E. coli* outer membrane protein gene (ompA) (Masui et al. (1983), in: *Experimental Manipulation of Gene Expression*; Ghrayeb et al. (1984) *EMBO J.* 3:2437) and the *E. coli* alkaline phosphatase signal sequence (phoA) (Oka et al. (1985) *Proc. Natl. Acad. Sci.* 82:7212). As an additional example, the signal sequence of the alpha-amylase gene from various *Bacillus* strains can be used to secrete heterologous proteins from *B. subtilis* (Palva et al. (1982) *Proc. Natl. Acad. Sci. USA* 79:5582; EPO Publ. No. 244 042).

Usually, transcription termination sequences recognized by bacteria are regulatory regions located 3' to the translation stop codon, and thus together with the promoter flank the coding sequence. These sequences direct the transcription of an mRNA which can be translated into the polypeptide encoded by the DNA. Transcription termination sequences frequently include DNA sequences of about 50 nucleotides capable of forming stem loop structures that aid in terminating transcription. Examples include transcription termination sequences derived from genes with strong promoters, such as the trp gene in *E. coli* as well as other biosynthetic genes.

Usually, the above described components, comprising a promoter, signal sequence (if desired), coding sequence of interest, and transcription termination sequence, are put together into expression constructs. Expression constructs are often maintained in a replicon, such as an extrachromosomal element (e.g., plasmids) capable of stable maintenance in a host, such as bacteria. The replicon will have a replication system, thus allowing it to be maintained in a prokaryotic host either for expression or for cloning and amplification. In addition, a replicon may be either a high or low copy number plasmid. A high copy number plasmid will generally have a copy number ranging from about 5 to about 200, and usually about 10 to about 150. A host containing a high copy number plasmid will preferably contain at least about 10, and more preferably at least about 20 plasmids. Either a high or low copy number vector may be selected, depending upon the effect of the vector and the foreign protein on the host.

Alternatively, the expression constructs can be integrated into the bacterial genome with an integrating vector. Integrating vectors usually contain at least one sequence homologous to the bacterial chromosome that allows the vector to integrate. Integrations appear to result from recombinations between homologous DNA in the vector and the bacterial chromosome. For example, integrating vectors constructed with DNA from various *Bacillus* strains integrate into the *Bacillus* chromosome (EPO Publ. No. 127 328). Integrating vectors may also be comprised of bacteriophage or transposon sequences.

Usually, extrachromosomal and integrating expression constructs may contain selectable markers to allow for the selection of bacterial strains that have been transformed. Selectable markers can be expressed in the bacterial host and may include genes which render bacteria resistant to drugs such as ampicillin, chloramphenicol, erythromycin, kanamycin (neomycin), and tetracycline (Davies et al. (1978) *Annu. Rev. Microbiol.* 32:469). Selectable markers may also include biosynthetic genes, such as those in the histidine, tryptophan, and leucine biosynthetic pathways.

Alternatively, some of the above described components can be put together in transformation vectors. Transformation vectors are usually comprised of a selectable market that is either maintained in a replicon or developed into an integrating vector, as described above.

Expression and transformation vectors, either extra-chromosomal replicons or integrating vectors, have been developed for transformation into many bacteria. For example, expression vectors have been developed for, inter alia, the following bacteria: *Bacillus subtilis* (Palva et al. (1982) *Proc. Natl. Acad. Sci. USA* 79:5582; EPO Publ. Nos. 036 259 and 063 953; PCT Publ. No. WO 84/04541), *Escherichia coli* (Shimatake et al. (1981) *Nature* 292:128; Amann et al. (1985) *Gene* 40:183; Studier et al. (1986) *J. Mol. Biol.* 189:113; EPO Publ. Nos. 036 776, 136 829 and 136 907), *Streptococcus cremoris* (Powell et al. (1988) *Appl. Environ. Microbiol.* 54:655); *Streptococcus lividans* (Powell et al. (1988) *Appl. Environ. Microbiol.* 54:655), *Streptomyces lividans* (U.S. Pat. No. 4,745,056).

Methods of introducing exogenous DNA into bacterial hosts are well-known in the art, and usually include either the transformation of bacteria treated with $CaCl_2$ or other agents, such as divalent cations and DMSO. DNA can also be introduced into bacterial cells by electroporation. Transformation procedures usually vary with the bacterial species to be transformed. (See e.g., use of *Bacillus*: Masson et al. (1989) *FEMS Microbiol. Lett.* 60:273; Palva et al. (1982) *Proc. Natl. Acad. Sci. USA* 79:5582; EPO Publ. Nos. 036 259 and 063 953; PCT Publ. No. WO 84/04541; use of *Campylobacter*: Miller et al. (1988) *Proc. Natl. Acad. Sci.* 85:856; and Wang et al. (1990) *J. Bacteriol.* 172:949; use of *Escherichia coli*: Cohen et al. (1973) *Proc. Natl. Acad. Sci.* 69:2110; Dower et al. (1988) *Nucleic Acids Res.* 16:6127; Kushner (1978) "An improved method for transformation of *Escherichia coli* with ColE1-derived plasmids. In *Genetic Engineering: Proceedings of the International Symposium on Genetic Engineering* (eds. H. W. Boyer and S. Nicosia); Mandel et al. (1970) *J. Mol. Biol.* 53:159; Taketo (1988) *Biochim. Biophys. Acta* 949:318; use of *Lactobacillus*: Chassy et al. (1987) *FEMS Microbiol. Lett.* 44:173; use of *Pseudomonas*: Fiedler et al. (1988) *Anal. Biochem* 170:38; use of *Staphylococcus*: Augustin et al. (1990) *FEMS Microbiol. Lett.* 66:203; use of *Streptococcus*: Barany et al. (1980) *J. Bacteriol.* 144:698; Harlander (1987) "Transformation of *Streptococcus* lactis by electroporation, in: *Streptococcal Genetics* (ed. J. Ferretti and R. Curtiss III); Perry et al. (1981) *Infect. Immun.* 32:1295; Powell et al. (1988) *Appl. Environ. Microbiol.* 54:655; Somkuti et al. (1987) *Proc. 4th Evr. Cong. Biotechnology* 1:412.

v. Yeast Expression

Yeast expression systems are also known to one of ordinary skill in the art. A yeast promoter is any DNA sequence capable of binding yeast RNA polymerase and initiating the downstream (3') transcription of a coding sequence (e.g. structural gene) into mRNA. A promoter will have a transcription initiation region which is usually placed proximal to the 5' end of the coding sequence. This transcription initiation region usually includes an RNA polymerase binding site (the "TATA Box") and a transcription initiation site. A yeast promoter may also have a second domain called an upstream activator sequence (UAS), which, if present, is usually distal to the structural gene. The UAS permits regulated (inducible) expression. Constitutive expression occurs in the absence of a UAS. Regulated expression may be either positive or negative, thereby either enhancing or reducing transcription.

Yeast is a fermenting organism with an active metabolic pathway, therefore sequences encoding enzymes in the metabolic pathway provide particularly useful promoter sequences. Examples include alcohol dehydrogenase (ADH) (EPO Publ. No. 284 044), enolase, glucokinase, glucose-6-phosphate isomerase, glyceraldehyde-3-phosphate-dehydrogenase (GAP or GAPDH), hexokinase, phosphofructokinase, 3-phosphoglycerate mutase, and pyruvate kinase (PyK) (EPO Publ. No. 329 203). The yeast PHO5 gene, encoding acid phosphatase, also provides useful promoter sequences (Myanohara et al. (1983) *Proc. Natl. Acad. Sci. USA* 80:1).

In addition, synthetic promoters which do not occur in nature also function as yeast promoters. For example, UAS sequences of one yeast promoter may be joined with the transcription activation region of another yeast promoter, creating a synthetic hybrid promoter. Examples of such hybrid promoters include the ADH regulatory sequence linked to the GAP transcription activation region (U.S. Pat. Nos. 4,876,197 and 4,880,734). Other examples of hybrid promoters include promoters which consist of the regulatory sequences of either the ADH2, GAL4, GAL10, OR PHO5 genes, combined with the transcriptional activation region of a glycolytic enzyme gene such as GAP or PyK (EPO Publ. No. 164 556). Furthermore, a yeast promoter can include naturally occurring promoters of non-yeast origin that have the ability to bind yeast RNA polymerase and initiate transcription. Examples of such promoters include, inter alia, (Cohen et al. (1980) *Proc. Natl. Acad. Sci. USA* 77:1078; Henikoff et al. (1981) *Nature* 283:835; Hollenberg et al. (1981) *Curr. Topics Microbiol. Immunol.* 96:119; Hollenberg et al. (1979) "The Expression of Bacterial Antibiotic Resistance Genes in the Yeast *Saccharomyces cerevisiae*," in: *Plasmids of Medical, Environmental and Commercial Importance* (eds. K. N. Timmis and A. Puhler); Mercerau-Puigalon et al. (1980) *Gene* 11:163; Panthier et al. (1980) *Curr. Genet.* 2:109;).

A DNA molecule may be expressed intracellularly in yeast. A promoter sequence may be directly linked with the DNA molecule, in which case the first amino acid at the N-terminus of the recombinant protein will always be a methionine, which is encoded by the ATG start codon. If desired, methionine at the N-terminus may be cleaved from the protein by in vitro incubation with cyanogen bromide.

Fusion proteins provide an alternative for yeast expression systems, as well as in mammalian, plant, baculovirus, and bacterial expression systems. Usually, a DNA sequence encoding the N-terminal portion of an endogenous yeast protein, or other stable protein, is fused to the 5' end of heterologous coding sequences. Upon expression, this construct will provide a fusion of the two amino acid sequences. For example, the yeast or human superoxide dismutase (SOD) gene, can be linked at the 5' terminus of a foreign gene and expressed in yeast. The DNA sequence at the junction of the two amino acid sequences may or may not encode a cleavable site. See e.g., EPO Publ. No. 196056. Another example is a ubiquitin fusion protein. Such a fusion protein is made with the ubiquitin region that preferably retains a site for a processing enzyme (e.g. ubiquitin-specific processing protease) to cleave the ubiquitin from the foreign protein. Through this method, therefore, native foreign protein can be isolated (e.g., WO88/024066).

Alternatively, foreign proteins can also be secreted from the cell into the growth media by creating chimeric DNA molecules that encode a fusion protein comprised of a leader sequence fragment that provide for secretion in yeast of the foreign protein. Preferably, there are processing sites encoded between the leader fragment and the foreign gene that can be cleaved either in vivo or in vitro. The leader sequence fragment usually encodes a signal peptide comprised of hydrophobic amino acids which direct the secretion of the protein from the cell.

DNA encoding suitable signal sequences can be derived from genes for secreted yeast proteins, such as the yeast invertase gene (EPO Publ. No. 012 873; JPO Publ. No. 62:096,086) and the A-factor gene (U.S. Pat. No. 4,588,684). Alternatively, leaders of non-yeast origin, such as an interferon leader, exist that also provide for secretion in yeast (EPO Publ. No. 060 057).

A preferred class of secretion leaders are those that employ a fragment of the yeast alpha-factor gene, which contains both a "pre" signal sequence, and a "pro" region. The types of alpha-factor fragments that can be employed include the full-length pre-pro alpha factor leader (about 83 amino acid residues) as well as truncated alpha-factor leaders (usually about 25 to about 50 amino acid residues) (U.S. Pat. Nos. 4,546,083 and 4,870,008; EPO Publ. No. 324 274). Additional leaders employing an alpha-factor leader fragment that provides for secretion include hybrid alpha-factor leaders made with a presequence of a first yeast, but a pro-region from a second yeast alphafactor. (See e.g., PCT Publ. No. WO 89/02463.)

Usually, transcription termination sequences recognized by yeast are regulatory regions located 3' to the translation stop codon, and thus together with the promoter flank the coding sequence. These sequences direct the transcription of an mRNA which can be translated into the polypeptide encoded by the DNA. Examples of transcription terminator sequence and other yeast-recognized termination sequences, such as those coding for glycolytic enzymes.

Usually, the above described components, comprising a promoter, leader (if desired), coding sequence of interest, and transcription termination sequence, are put together into expression constructs. Expression constructs are often maintained in a replicon, such as an extrachromosomal element (e.g., plasmids) capable of stable maintenance in a host, such as yeast or bacteria. The replicon may have two replication systems, thus allowing it to be maintained, for example, in yeast for expression and in a prokaryotic host for cloning and amplification. Examples of such yeast-bacteria shuttle vectors include YEp24 (Botstein et al. (1979) *Gene* 8:17-24), pC1/1 (Brake et al. (1984) *Proc. Natl. Acad. Sci USA* 81:4642-4646), and YRp17 (Stinchcomb et al. (1982) *J. Mol. Biol.* 158:157). In addition, a replicon may be either a high or low copy number plasmid. A high copy number plasmid will generally have a copy number ranging from about 5 to about 200, and usually about 10 to about 150. A host containing a high copy number plasmid will preferably have at least about 10, and more preferably at least about 20. Enter a high or low copy number vector may be selected, depending upon the effect of the vector and the foreign protein on the host. See e.g., Brake et al., supra.

Alternatively, the expression constructs can be integrated into the yeast genome with an integrating vector. Integrating vectors usually contain at least one sequence homologous to a yeast chromosome that allows the vector to integrate, and preferably contain two homologous sequences flanking the expression construct. Integrations appear to result from recombinations between homologous DNA in the vector and the yeast chromosome (Orr-Weaver et al. (1983) *Methods in Enzymol.* 101:228-245). An integrating vector may be directed to a specific locus in yeast by selecting the appropriate homologous sequence for inclusion in the vector. See Orr-Weaver et al., supra. One or more expression construct may integrate, possibly affecting levels of recombinant protein produced (Rine et al. (1983) *Proc. Natl. Acad. Sci. USA* 80:6750). The chromosomal sequences included in the vector can occur either as a single segment in the vector, which results in the integration of the entire vector, or two segments homologous to adjacent segments in the chromosome and flanking the expression construct in the vector, which can result in the stable integration of only the expression construct.

Usually, extrachromosomal and integrating expression constructs may contain selectable markers to allow for the selection of yeast strains that have been transformed. Selectable markers may include biosynthetic genes that can be expressed in the yeast host, such as ADE2, HIS4, LEU2, TRP1, and ALG7, and the G418 resistance gene, which confer resistance in yeast cells to tunicamycin and G418, respectively. In addition, a suitable selectable marker may also provide yeast with the ability to grow in the presence of toxic compounds, such as metal. For example, the presence of CUP1 allows yeast to grow in the presence of copper ions (Butt et al. (1987) *Microbiol, Rev.* 51:351).

Alternatively, some of the above described components can be put together into transformation vectors. Transformation vectors are usually comprised of a selectable marker that is either maintained in a replicon or developed into an integrating vector, as described above.

Expression and transformation vectors, either extrachromosomal replicons or integrating vectors, have been developed for transformation into many yeasts. For example, expression vectors and methods of introducing exogenous DNA into yeast hosts have been developed for, inter alia, the following yeasts: *Candida albicans* (Kurtz, et al. (1986) *Mol. Cell. Biol.* 6:142); *Candida maltosa* (Kunze, et al. (1985) *J. Basic Microbiol.* 25:141); *Hansenula polymorpha* (Gleeson, et al. (1986) *J. Gen. Microbiol.* 132:3459; Roggenkamp et al. (1986) *Mol. Gen. Genet.* 202:302); *Kluyveromyces fragilis* (Das, et al. (1984) *J. Bacteriol.* 158:1165); *Kluyveromyces lactis* (De Louvencourt et al. (1983) *J. Bacteriol.* 154:737; Van den Berg et al. (1990) *Bio/Technology* 8:135); *Pichia guillerimondii* (Kunze et al. (1985) *J. Basic Microbiol.* 25:141); *Pichia pastoris* (Cregg, et al. (1985) *Mol. Cell. Biol.* 5:3376; U.S. Pat. Nos. 4,837,148 and 4,929,555); *Saccharomyces cerevisiae* (Hinnen et al. (1978) *Proc. Natl. Acad. Sci. USA* 75:1929; Ito et al. (1983) *J. Bacteriol.* 153:163); *Schizosaccharomyces pombe* (Beach and Nurse (1981) *Nature* 300:706); and *Yarrowia lipolytica* (Davidow, et al. (1985) *Curr. Genet.* 10:380471 Gaillardin, et al. (1985) *Curr. Genet.* 10:49).

Methods of introducing exogenous DNA into yeast hosts are well-known in the art, and usually include either the transformation of spheroplasts or of intact yeast cells treated with alkali cations. Transformation procedures usually vary with the yeast species to be transformed. See e.g., [Kurtz et al. (1986) *Mol. Cell. Biol.* 6:142; Kunze et al. (1985) *J. Basic Microbiol.* 25:141; *Candida*]; [Gleeson et al. (1986) *J. Gen. Microbiol.* 132:3459; Roggenkamp et al. (1986) *Mol. Gen. Genet.* 202:302; *Hansenula*]; [Das et al. (1984) *J. Bacteriol.* 158:1165; De Louvencourt et al. (1983) *J. Bacteriol.* 154:1165; Van den Berg et al. (1990) *Bio/Technology* 8:135; *Kluyveromyces*]; [Cregg et al. (1985) *Mol. Cell. Biol.* 5:3376; Kunze et al. (1985) *J. Basic Microbiol.* 25:141; U.S. Pat. Nos. 4,837,148 and 4,929,555; *Pichia*]; [Hinnen et al. (1978) *Proc. Natl. Acad. Sci. USA* 75; 1929; Ito et al. (1983) *J. Bacteriol.* 153:163 *Saccharomyces*]; [Beach and Nurse (1981) *Nature* 300:706; *Schizosaccharomyces*]; [Davidow et al. (1985) *Curr. Genet.* 10:39; Gaillardin et al. (1985) *Curr. Genet.* 10:49; *Yarrowia]*.

DEFINITIONS

A composition containing X is "substantially free of" Y when at least 85% by weight of the total X+Y in the composition is X. Preferably, X comprises at least about 90% by weight of the total of X+Y in the composition, more preferably at least about 95% or even 99% by weight.

A "conserved" *Neisseria* amino acid fragment or protein is one that is present in a particular Neisserial protein in at least x % of *Neisseria.* The value of x may be 50% or more, e.g., 66%, 75%, 80%, 90%, 95% or even 100% (i.e. the amino acid is found in the protein in question in all *Neisseria*). In order to determine whether an animo acid is "conserved" in a particular Neisserial protein, it is necessary to compare that amino acid residue in the sequences of the protein in question from a plurality of different *Neisseria* (a reference population). The reference population may include a number of different *Neisseria* species or may include a single species. The reference population may include a number of different serogroups of a particular species or a single serogroup. A preferred reference population consists of the 5 most common *Neisseria* The term "heterologous" refers to two biological components that are not found together in nature. The components may be host cells, genes, or regulatory regions, such as promoters. Although the heterologous components are not found together in nature, they can function together, as when a promoter heterologous to a gene is operably linked to the gene. Another example is where a Neisserial sequence is heterologous to a mouse host cell.

An "origin of replication" is a polynucleotide sequence that initiates and regulates replication of polynucleotides, such as an expression vector. The origin of replication behaves as an autonomous unit of polynucleotide replication within a cell, capable of replication under its own control. An origin of replication may be needed for a vector to replicate in a particular host cell. With certain origins of replication, an expression vector can be reproduced at a high copy number in the presence of the appropriate proteins within the cell. Examples of origins are the autonomously replicating sequences, which are effective in yeast; and the viral T-antigen, effective in COS-7 cells.

A "mutant" sequence is defined as a DNA, RNA or amino acid sequence differing from but having homology with the native or disclosed sequence. Depending on the particular sequence, the degree of homology (sequence identity) between the native or disclosed sequence and the mutant sequence is preferably greater than 50% (e.g., 60%, 70%, 80%, 90%, 95%, 99% or more) which is calculated as described above. As used herein, an "allelic variant" of a nucleic acid molecule, or region, for which nucleic acid sequence is provided herein is a nucleic acid molecule, or region, that occurs at essentially the same locus in the genome of another or second isolate, and that, due to natural variation caused by, for example, mutation or recombination, has a similar but not identical nucleic acid sequence. A coding region allelic variant typically encodes a protein having similar activity to that of the protein encoded by the gene to which it is being compared. An allelic variant can also comprise an alteration in the 5' or 3' untranslated regions of the gene, such as in regulatory control regions. (see, for example, U.S. Pat. No. 5,753,235).

Antibodies

As used herein, the term "antibody" refers to a polypeptide or group of polypeptides composed of at least one antibody combining site. An "antibody combining site" is the three-dimensional binding space with an internal surface shape and charge distribution complementary to the features of an epitope of an antigen, which allows a binding of the antibody with the antigen. "Antibody" includes, for example, vertebrate antibodies, hybrid antibodies, chimeric antibodies, humanized antibodies, altered antibodies, univalent antibodies, Fab proteins, and single domain antibodies.

Antibodies against the proteins of the invention are useful for affinity chromatography, immunoassays, and distinguishing/identifying *Neisseria* menB proteins. Antibodies elicited against the proteins of the present invention bind to antigenic polypeptides or proteins or protein fragments that are present and specifically associated with strains of *Neisseria meningitidis* menB. In some instances, these antigens may be associated with specific strains, such as those antigens specific for the menB strains. The antibodies of the invention may be immobilized to a matrix and utilized in an immunoassay or on an affinity chromatography column, to enable the detection and/or separation of polypeptides, proteins or protein fragments or cells comprising such polypeptides, proteins or protein fragments. Alternatively, such polypeptides, proteins or protein fragments may be immobilized so as to detect antibodies bindably specific thereto.

Antibodies to the proteins of the invention, both polyclonal and monoclonal, may be prepared by conventional methods. In general, the protein is first used to immunize a suitable animal, preferably a mouse, rat, rabbit or goat. Rabbits and goats are preferred for the preparation of polyclonal sera due to the volume of serum obtainable, and the availability of labeled anti-rabbit and anti-goat antibodies. Immunization is generally performed by mixing or emulsifying the protein in saline, preferably in an adjuvant such as Freund's complete adjuvant, and injecting the mixture or emulsion parenterally (generally subcutaneously or intramuscularly). A dose of 50-200 μg/injection is typically sufficient. Immunization is generally boosted 2-6 weeks later with one or more injections of the protein in saline, preferably using Freund's incomplete adjuvant. One may alternatively generate antibodies by in vitro immunization using methods known in the art, which for the purposes of this invention is considered equivalent to in vivo immunization. Polyclonal antisera is obtained by bleeding the immunized animal into a glass or plastic container, incubating the blood at 25° C. for one hour, followed by incubating at 4° C. for 2-18 hours. The serum is recovered by centrifugation (e.g., 1,000 g for 10 minutes). About 20-50 ml per bleed may be obtained from rabbits.

Monoclonal antibodies are prepared using the standard method of Kohler & Milstein (*Nature* (1975) 256:495-96), or a modification thereof. Typically, a mouse or rat is immunized as described above. However, rather than bleeding the animal to extract serum, the spleen (and optionally several large lymph nodes) is removed and dissociated into single cells. If desired, the spleen cells may be screened (after removal of nonspecifically adherent cells) by applying a cell suspension to a plate or well coated with the protein antigen. B-cells that express membrane-bound immunoglobulin specific for the antigen bind to the plate, and are not rinsed away with the rest of the suspension. Resulting B-cells, or all dissociated spleen cells, are then induced to fuse with myeloma cells to form hybridomas, and are cultured in a selective medium (e.g., hypoxanthine, aminopterin, thymidine medium, "HAT"). The resulting hybridomas are plated by limiting dilution, and are assayed for the production of antibodies which bind specifically to the immunizing antigen (and which do not bind to unrelated antigens). The selected MAb-secreting hybridomas are then cultured either in vitro (e.g., in tissue culture bottles or hollow fiber reactors), or in vivo (as ascites in mice).

If desired, the antibodies (whether polyclonal or monoclonal) may be labeled using conventional techniques. Suitable labels include fluorophores, chromophores, radioactive atoms (particularly $^{32}P$ and $^{125}I$), electron-dense reagents, enzymes, and ligands having specific binding partners. Enzymes are typically detected by their activity. For example, horseradish peroxidase is usually detected by its ability to convert 3,3',5,5'-tetramethylbenzidine (TMB) to a blue pigment, quantifiable with a spectrophotometer. "Specific binding partner" refers to a protein capable of binding a ligand molecule with high specificity, as for example in the case of an antigen and a monoclonal antibody specific therefor. Other specific binding partners include biotin and avidin or streptavidin, IgG and protein A, and the numerous receptor-ligand couples known in the art. It should be understood that the above description is not meant to categorize the various labels into distinct classes, as the same label may serve in several different modes. For example, $^{125}I$ may serve as a radioactive label or as an electron-dense reagent. HRP may serve as enzyme or as antigen for a MAb. Further, one may combine various labels for desired effect. For example, MAbs and avidin also require labels in the practice of this invention: thus, one might label a MAb with biotin, and detect its presence with avidin labeled with $^{125}I$, or with an anti-biotin MAb labeled with HRP. Other permutations and possibilities will be readily apparent to those of ordinary skill in the art, and are considered as equivalents within the scope of the instant invention.

Antigens, immunogens, polypeptides, proteins or protein fragments of the present invention elicit formation of specific binding partner antibodies. These antigens, immunogens, polypeptides, proteins or protein fragments of the present invention comprise immunogenic compositions of the present invention. Such immunogenic compositions may further comprise or include adjuvants, carriers, or other compositions that promote or enhance or stabilize the antigens, polypeptides, proteins or protein fragments of the present invention. Such adjuvants and carriers will be readily apparent to those of ordinary skill in the art.

Pharmaceutical Compositions

Pharmaceutical compositions can comprise (include) either polypeptides, antibodies, or nucleic acid of the invention. The pharmaceutical compositions will comprise a therapeutically effective amount of either polypeptides, antibodies, or polynucleotides of the claimed invention.

The term "therapeutically effective amount" as used herein refers to an amount of a therapeutic agent to treat, ameliorate, or prevent a desired disease or condition, or to exhibit a detectable therapeutic or preventative effect. The effect can be detected by, for example, chemical markers or antigen levels. Therapeutic effects also include reduction in physical symptoms, such as decreased body temperature, when given to a patient that is febrile. The precise effective amount for a subject will depend upon the subject's size and health, the nature and extent of the condition, and the therapeutics or combination of therapeutics selected for administration. Thus, it is not useful to specify an exact effective amount in advance. However, the effective amount for a given situation can be determined by routine experimentation and is within the judgment of the clinician.

For purposes of the present invention, an effective dose will be from about 0.01 mg/kg to 50 mg/kg or 0.05 mg/kg to about 10 mg/kg of the DNA constructs in the individual to which it is administered.

A pharmaceutical composition can also contain a pharmaceutically acceptable carrier. The term "pharmaceutically acceptable carrier" refers to a carrier for administration of a therapeutic agent, such as antibodies or a polypeptide, genes, and other therapeutic agents. The term refers to any pharmaceutical carrier that does not itself induce the production of antibodies harmful to the individual receiving the composition, and which may be administered without undue toxicity. Suitable carriers may be large, slowly metabolized macromolecules such as proteins, polysaccharides, polylactic acids, polyglycolic acids, polymeric amino acids, amino acid copolymers, and inactive virus particles. Such carriers are well known to those of ordinary skill in the art.

Pharmaceutically acceptable salts can be used therein, for example, mineral acid salts such as hydrochlorides, hydrobromides, phosphates, sulfates, and the like; and the salts of organic acids such as acetates, propionates, malonates, benzoates, and the like. A thorough discussion of pharmaceutically acceptable excipients is available in Remington's Pharmaceutical Sciences (Mack Pub. Co., N.J. 1991).

Pharmaceutically acceptable carriers in therapeutic compositions may contain liquids such as water, saline, glycerol and ethanol. Additionally, auxiliary substances, such as wetting or emulsifying agents, pH buffering substances, and the like, may be present in such vehicles. Typically, the therapeutic compositions are prepared as injectables, either as liquid solutions or suspensions; solid forms suitable for solution in, or suspension in, liquid vehicles prior to injection may also be prepared. Liposomes are included within the definition of a pharmaceutically acceptable carrier.

Delivery Methods

Once formulated, the compositions of the invention can be administered directly to the subject. The subjects to be treated can be animals; in particular, human subjects can be treated.

Direct delivery of the compositions will generally be accomplished by injection, either subcutaneously, intraperitoneally, intravenously or intramuscularly or delivered to the interstitial space of a tissue. The compositions can also be administered into a lesion. Other modes of administration include oral and pulmonary administration, suppositories, and transdermal and transcutaneous applications, needles, and gene guns or hyposprays. Dosage treatment may be a single dose schedule or a multiple dose schedule.

Vaccines

Vaccines according to the invention may either be prophylactic (i.e., to prevent infection) or therapeutic (i.e., to treat disease after infection).

Such vaccines comprise immunizing antigen(s) or immunogen(s), immunogenic polypeptide, protein(s) or protein fragments, or nucleic acids (e.g., ribonucleic acid or deoxyribonucleic acid), usually in combination with "pharmaceutically acceptable carriers," which include any carrier that does not itself induce the production of antibodies harmful to the individual receiving the composition. Suitable carriers are typically large, slowly metabolized macromolecules such as proteins, polysaccharides, polylactic acids, polyglycolic acids, polymeric amino acids, amino acid copolymers, lipid aggregates (such as oil droplets or liposomes), and inactive virus particles. Such carriers are well known to those of ordinary skill in the art. Additionally, these carriers may function as immunostimulating agents ("adjuvants"). Furthermore, the immunogen or antigen may be conjugated to a bacterial toxoid, such as a toxoid from diphtheria, tetanus, cholera, *H. pylori*, etc. pathogens.

Preferred adjuvants to enhance effectiveness of the composition include, but are not limited to: (1) aluminum salts (alum), such as aluminum hydroxide, aluminum phosphate, aluminum sulfate, etc; (2) oil-in-water emulsion formulations (with or without other specific immunostimulating agents such as muramyl peptides (see below) or bacterial cell wall components), such as for example (a) MF59 (PCT Publ. No. WO 90/14837), containing 5% Squalene, 0.5% TWEEN 80™, and 0.5% SPAN 85™ (optionally containing various amounts of MTP-PE (see below), although not required) formulated into submicron particles using a microfluidizer such as Model 110Y microfluidizer (Microfluidics, Newton, Mass.), (b) SAF, containing 10% Squalane, 0.4% Tween 80, 5% PLURONIC™-blocked polymer L121, and thr-MDP (see below) either microfluidized into a submicron emulsion or vortexed to generate a larger particle size emulsion, and (c) RIBI™ adjuvant system (RAS), (Ribi Immunochem, Hamilton, Mont.) containing 2% Squalene, 0.2% TWEEN 80™, and one or more bacterial cell wall components from the group consisting of monophosphorylipid A (MPL), trehalose dimycolate (TDM), and cell wall skeleton (CWS), preferably MPL+CWS (DETOX™); (3) saponin adjuvants, such as STIMULON™ (Cambridge Bioscience, Worcester, Mass.) may be used or particles generated therefrom such as ISCOMs (immunostimulating complexes); (4) Complete Freund's Adjuvant (CFA) and Incomplete Freund's Adjuvant (IFA); (5) cytokines, such as interleukins (e.g., IL-1, IL-2, IL-4, IL-5, IL-6, IL-7, IL-12, etc.), interferons (e.g., gamma interferon), macrophage colony stimulating factor (M-CSF), tumor necrosis factor (TNF), etc; and (6) other substances that act as immunostimulating agents to enhance the effectiveness of the composition. Alum and MF59 are preferred.

As mentioned above, muramyl peptides include, but are not limited to, N-acetyl-muramyl-L-threonyl-D-isoglutamine (thr-MDP), N-acetyl-normuramyl-L-alanyl-D-isoglutamine (nor-MDP), N-acetylmuramyl-L-alanyl-D-isoglutaminyl-L-alanine-2-(1'-2'-dipalmitoyl-sn-glycero-3-huydroxyphosphoryloxy)-ethylamine (MTP-PE), etc.

The vaccine compositions comprising immunogenic compositions (e.g., which may include the antigen, pharmaceutically acceptable carrier, and adjuvant) typically will contain diluents, such as water, saline, glycerol, ethanol, etc. Additionally, auxiliary substances, such as wetting or emulsifying agents, pH buffering substances, and the like, may be present in such vehicles. Alternatively, vaccine compositions comprising immunogenic compositions may comprise an antigen, polypeptide, protein, protein fragment or nucleic acid in a pharmaceutically acceptable carrier.

More specifically, vaccines comprising immunogenic compositions comprise an immunologically effective amount of the immunogenic polypeptides, as well as any other of the above-mentioned components, as needed. By "immunologically effective amount", it is meant that the administration of that amount to an individual, either in a single dose or as part of a series, is effective for treatment or prevention. This amount varies depending upon the health and physical condition of the individual to be treated, the taxonomic group of individual to be treated (e.g., nonhuman primate, primate, etc.), the capacity of the individual's immune system to synthesize antibodies, the degree of protection desired, the formulation of the vaccine, the treating doctor's assessment of the medical situation, and other relevant factors. It is expected that the amount will fall in a relatively broad range that can be determined through routine trials.

Typically, the vaccine compositions or immunogenic compositions are prepared as injectables, either as liquid solutions or suspensions; solid forms suitable for solution in, or suspension in, liquid vehicles prior to injection may also be prepared. The preparation also may be emulsified or encapsulated in liposomes for enhanced adjuvant effect, as discussed above under pharmaceutically acceptable carriers.

The immunogenic compositions are conventionally administered parenterally, e.g., by injection, either subcutaneously or intramuscularly. Additional formulations suitable for other modes of administration include oral and pulmonary formulations, suppositories, and transdermal and transcutaneous applications. Dosage treatment may be a single dose schedule or a multiple dose schedule. The vaccine may be administered in conjunction with other immunoregulatory agents.

As an alternative to protein-based vaccines, DNA vaccination may be employed (e.g., Robinson & Torres (1997) *Seminars in Immunology* 9:271-283; Donnelly et al. (1997) *Annu Rev Immunol* 15:617-648).

Gene Delivery Vehicles

Gene therapy vehicles for delivery of constructs, including a coding sequence of a therapeutic of the invention, to be delivered to the mammal for expression in the mammal, can be administered either locally or systemically. These constructs can utilize viral or non-viral vector approaches in in vivo or ex vivo modality. Expression of such coding sequence can be induced using endogenous mammalian or heterologous promoters. Expression of the coding sequence in vivo can be either constitutive or regulated.

The invention includes gene delivery vehicles capable of expressing the contemplated nucleic acid sequences. The gene delivery vehicle is preferably a viral vector and, more preferably, a retroviral, adenoviral, adeno-associated viral (AAV), herpes viral, or alphavirus vector. The viral vector can also be an astrovirus, coronavirus, orthomyxovirus, papovavirus, paramyxovirus, parvovirus, picornavirus, poxvirus, or togavirus viral vector. See generally, Jolly (1994) *Cancer Gene Therapy* 1:51-64; Kimura (1994) *Human Gene Therapy* 5:845-852; Connelly (1995) *Human Gene Therapy* 6:185-193; and Kaplitt (1994) *Nature Genetics* 6:148-153.

Retroviral vectors are well known in the art, including B, C and D type retroviruses, xenotropic retroviruses (for example, NZB-X1, NZB-X2 and NZB9-1 (see O'Neill (1985) *J. Virol.* 53:160) polytropic retroviruses e.g., MCF and MCF-MLV (see Kelly (1983) *J. Virol.* 45:291), spumaviruses and lentiviruses. See RNA Tumor Viruses, Second Edition, Cold Spring Harbor Laboratory, 1985.

Portions of the retroviral gene therapy vector may be derived from different retroviruses. For example, retrovector LTRs may be derived from a Murine Sarcoma Virus, a tRNA binding site from a Rous Sarcoma Virus, a packaging signal from a Murine Leukemia Virus, and an origin of second strand synthesis from an Avian Leukosis Virus.

These recombinant retroviral vectors may be used to generate transduction competent retroviral vector particles by introducing them into appropriate packaging cell lines (see U.S. Pat. No. 5,591,624). Retrovirus vectors can be constructed for site-specific integration into host cell DNA by incorporation of a chimeric integrase enzyme into the retroviral particle (see WO96/37626). It is preferable that the recombinant viral vector is a replication defective recombinant virus.

Packaging cell lines suitable for use with the above-described retrovirus vectors are well known in the art, are readily prepared (see WO95/30763 and WO92/05266), and can be used to create producer cell lines (also termed vector cell lines or "VCLs") for the production of recombinant vector particles. Preferably, the packaging cell lines are made from human parent cells (e.g., HT1080 cells) or mink parent cell lines, which eliminates inactivation in human serum.

Preferred retroviruses for the construction of retroviral gene therapy vectors include Avian Leukosis Virus, Bovine Leukemia Virus, Murine Leukemia Virus, Mink-Cell Focus-Inducing Virus, Murine Sarcoma Virus, Reticuloendotheliosis Virus and Rous Sarcoma Virus. Particularly preferred Murine Leukemia Viruses include 4070A and 1504A (Hartley and Rowe (1976) *J Virol* 19:19-25), Abelson (ATCC No. VR-999), Friend (ATCC No. VR-245), Graffi, Gross (ATCC Nol VR-590), Kirsten, Harvey Sarcoma Virus and Rauscher (ATCC No. VR-998) and Moloney Murine Leukemia Virus (ATCC No. VR-190). Such retroviruses may be obtained from depositories or collections such as the American Type Culture Collection ("ATCC") or isolated from known sources using commonly available techniques.

Exemplary known retroviral gene therapy vectors employable in this invention include those described in patent applications GB2200651, EP0415731, EP0345242, EP0334301, WO89/02468; WO89/05349, WO89/09271, WO90/02806, WO90/07936, WO94/03622, WO93/25698, WO93/25234, WO93/11230, WO93/10218, WO91/02805, WO91/02825, WO95/07994, U.S. Pat. No. 5,219,740, U.S. Pat. No. 4,405,712, U.S. Pat. No. 4,861,719, U.S. Pat. No. 4,980,289, U.S. Pat. No. 4,777,127, U.S. Pat. No. 5,591,624. See also Vile (1993) *Cancer Res* 53:3860-3864; Vile (1993) *Cancer Res* 53:962-967; Ram (1993) *Cancer Res* 53 (1993) 83-88; Takamiya (1992) *J Neurosci Res* 33:493-503; Baba (1993) *J Neurosurg* 79:729-735; Mann (1983) *Cell* 33:153; Cane (1984) *Proc Natl Acad Sci* 81:6349; and Miller (1990) *Human Gene Therapy* 1.

Human adenoviral gene therapy vectors are also known in the art and employable in this invention. See, for example, Berkner (1988) *Biotechniques* 6:616 and Rosenfeld (1991) *Science* 252:431, and WO93/07283, WO93/06223, and WO93/07282. Exemplary known adenoviral gene therapy vectors employable in this invention include those described in the above referenced documents and in WO94/12649, WO93/03769, WO93/19191, WO94/28938, WO95/11984, WO95/00655, WO95/27071, WO95/29993, WO95/34671, WO96/05320, WO94/08026, WO94/11506, WO93/06223, WO94/24299, WO95/14102, WO95/24297, WO95/02697, WO94/28152, WO94/24299, WO95/09241, WO95/25807, WO95/05835, WO94/18922 and WO95/09654. Alternatively, administration of DNA linked to killed adenovirus as described in Curiel (1992) *Hum. Gene Ther.* 3:147-154 may be employed. The gene delivery vehicles of the invention also include adenovirus associated virus (AAV) vectors. Leading and preferred examples of such vectors for use in this invention are the AAV-2 based vectors disclosed in Srivastava, WO93/09239. Most preferred AAV vectors comprise the two AAV inverted terminal repeats in which the native D-sequences are modified by substitution of nucleotides, such that at least 5 native nucleotides and up to 18 native nucleotides, preferably at least 10 native nucleotides up to 18 native nucleotides, most preferably 10 native nucleotides are retained and the remaining nucleotides of the D-sequence are deleted or replaced with non-native nucleotides. The native D-sequences of the AAV inverted terminal repeats are sequences of 20 consecutive nucleotides in each AAV inverted terminal repeat (i.e., there is one sequence at each end) which are not involved in HP formation. The non-native replacement nucleotide may be any nucleotide other than the nucleotide found in the native D-sequence in the same position. Other employable exemplary AAV vectors are pWP-19, pWN-1, both of which are disclosed in Nahreini (1993) *Gene* 124:257-262. Another example of such an AAV vector is psub201 (see Samulski (1987) *J. Virol.* 61:3096). Another exemplary AAV vector is the Double-D ITR vector. Construction of the Double-D ITR vector is disclosed in U.S. Pat. No. 5,478,745. Still other vectors are those disclosed in Carter U.S. Pat. No. 4,797,368 and Muzyczka U.S. Pat. No. 5,139,941, Chartejee U.S. Pat. No. 5,474,935, and Kotin WO94/288157. Yet a further example of an AAV vector employable in this invention is SSV9AFABTKneo, which contains the AFP enhancer and albumin promoter and directs expression predominantly in the liver. Its structure and construction are disclosed in Su (1996) *Human Gene Therapy* 7:463-470. Additional AAV gene therapy vectors are described in U.S. Pat. No. 5,354,678, U.S. Pat. No. 5,173,414, U.S. Pat. No. 5,139,941, and U.S. Pat. No. 5,252,479.

The gene therapy vectors comprising sequences of the invention also include herpes vectors. Leading and preferred examples are herpes simplex virus vectors containing a sequence encoding a thymidine kinase polypeptide such as those disclosed in U.S. Pat. No. 5,288,641 and EP0176170 (Roizman). Additional exemplary herpes simplex virus vectors include HFEM/ICP6-LacZ disclosed in WO95/04139 (Wistar Institute), pHSVlac described in Geller (1988) *Science* 241:1667-1669 and in WO90/09441 and WO92/07945, HSV Us3::pgC-lacZ described in Fink (1992) *Human Gene Therapy* 3:11-19 and HSV 7134, 2 RH 105 and GAL4 described in EP 0453242 (Breakefield), and those deposited with the ATCC as accession numbers ATCC VR-977 and ATCC VR-260.

Also contemplated are alpha virus gene therapy vectors that can be employed in this invention. Preferred alpha virus vectors are Sindbis viruses vectors. Togaviruses, Semliki Forest virus (ATCC VR-67; ATCC VR-1247), Middleberg virus (ATCC VR-370), Ross River virus (ATCC VR-373; ATCC VR-1246), Venezuelan equine encephalitis virus (ATCC VR923; ATCC VR-1250; ATCC VR-1249; ATCC VR-532), and those described in U.S. Pat. Nos. 5,091,309, 5,217,879, and WO92/10578. More particularly, those alpha virus vectors described in U.S. Ser. No. 08/405,627, filed Mar. 15, 1995, WO94/21792, WO92/10578, WO95/07994, U.S. Pat. No. 5,091,309 and U.S. Pat. No. 5,217,879 are employable. Such alpha viruses may be obtained from depositories or collections such as the ATCC or isolated from known sources using commonly available techniques. Preferably, alphavirus vectors with reduced cytotoxicity are used (see U.S. Ser. No. 08/679,640).

DNA vector systems such as eukarytic layered expression systems are also useful for expressing the nucleic acids of the invention. See WO95/07994 for a detailed description of eukaryotic layered expression systems. Preferably, the eukaryotic layered expression systems of the invention are derived from alphavirus vectors and most preferably from Sindbis viral vectors.

Other viral vectors suitable for use in the present invention include those derived from poliovirus, for example ATCC VR-58 and those described in Evans, Nature 339 (1989) 385 and Sabin (1973) *J. Biol. Standardization* 1:115; rhinovirus, for example ATCC VR-1110 and those described in Arnold (1990) *J Cell Biochem L*401; pox viruses such as canary pox virus or vaccinia virus, for example ATCC VR-111 and ATCC VR-2010 and those described in Fisher-Hoch (1989) *Proc Natl Acad Sci* 86:317; Flexner (1989) *Ann NY Acad Sci* 569:86, Flexner (1990) *Vaccine* 8:17; in U.S. Pat. No. 4,603,112 and U.S. Pat. No. 4,769,330 and WO89/01973; SV40 virus, for example ATCC VR-305 and those described in Mulligan (1979) *Nature* 277:108 and Madzak (1992) *J Gen Virol* 73:1533; influenza virus, for example ATCC VR-797 and recombinant influenza viruses made employing reverse genetics techniques as described in U.S. Pat. No. 5,166,057 and in Enami (1990) *Proc Natl Acad Sci* 87:3802-3805; Enami & Palese (1991) *J Virol* 65:2711-2713 and Luytjes (1989) *Cell* 59:110, (see also McMichael (1983) *NEJ Med* 309:13, and Yap (1978) *Nature* 273:238 and Nature (1979) 277:108); human immunodeficiency virus as described in EP-0386882 and in Buchschacher (1992) *J. Virol.* 66:2731; measles virus, for example ATCC VR-67 and VR-1247 and those described in EP-0440219; Aura virus, for example ATCC VR-368; Bebaru virus, for example ATCC VR-600 and ATCC VR-1240; Cabassou virus, for example ATCC VR-922; Chikungunya virus, for example ATCC VR-64 and ATCC VR-1241; Fort Morgan Virus, for example ATCC VR-924; Getah virus, for example ATCC VR-369 and ATCC VR-1243; Kyzylagach virus, for example ATCC VR-927; Mayaro virus, for example ATCC VR-66; Mucambo virus, for example ATCC VR-580 and ATCC VR-1244; Ndumu virus, for example ATCC VR-371; Pixuna virus, for example ATCC VR-372 and ATCC VR-1245; Tonate virus, for example ATCC VR-925; Triniti virus, for example ATCC VR-469; Una virus, for example ATCC VR-374; Whataroa virus, for example ATCC VR-926; Y-62-33 virus, for example ATCC VR-375; O'Nyong virus, Eastern encephalitis virus, for example ATCC VR-65 and ATCC VR-1242; Western encephalitis virus, for example ATCC VR-70, ATCC VR-1251, ATCC VR-622 and ATCC VR-1252; and coronavirus, for example ATCC VR-740 and those described in Hamre (1966) *Proc Soc Exp Biol Med* 121:190.

Delivery of the compositions of this invention into cells is not limited to the above mentioned viral vectors. Other delivery methods and media may be employed such as, for example, nucleic acid expression vectors, polycationic condensed DNA linked or unlinked to killed adenovirus alone, for example see U.S. Ser. No. 08/366,787, filed Dec. 30, 1994 and Curiel (1992) *Hum Gene Ther* 3:147-154 ligand linked DNA, for example see Wu (1989) *J Biol Chem* 264:16985-16987, eucaryotic cell delivery vehicles cells, for example see U.S. Ser. No. 08/240,030, filed May 9, 1994, and U.S. Ser. No. 08/404,796, deposition of photopolymerized hydrogel materials, hand-held gene transfer particle gun, as described in U.S. Pat. No. 5,149,655, ionizing radiation as described in U.S. Pat. No. 5,206,152 and in WO92/11033, nucleic charge neutralization or fusion with cell membranes. Additional approaches are described in Philip (1994) *Mol Cell Biol* 14:2411-2418 and in Woffendin (1994) *Proc Natl Acad Sci* 91:1581-1585.

Particle mediated gene transfer may be employed, for example see U.S. Ser. No. 60/023,867. Briefly, the sequence can be inserted into conventional vectors that contain conventional control sequences for high level expression, and then incubated with synthetic gene transfer molecules such as polymeric DNA-binding cations like polylysine, protamine, and albumin, linked to cell targeting ligands such as asialoorosomucoid, as described in Wu & Wu (1987) *J. Biol. Chem.* 262:4429-4432, insulin as described in Hucked (1990) *Biochem Pharmacol* 40:253-263, galactose as described in Plank (1992) *Bioconjugate Chem* 3:533-539, lactose or transferrin.

Naked DNA may also be employed to transform a host cell. Exemplary naked DNA introduction methods are described in WO 90/11092 and U.S. Pat. No. 5,580,859. Uptake efficiency may be improved using biodegradable latex beads. DNA coated latex beads are efficiently transported into cells after endocytosis initiation by the beads. The method may be improved further by treatment of the beads to increase hydrophobicity and thereby facilitate disruption of the endosome and release of the DNA into the cytoplasm.

Liposomes that can act as gene delivery vehicles are described in U.S. Pat. No. 5,422,120, WO95/13796, WO94/23697, WO91/14445 and EP-524,968. As described in U.S. Ser. No. 60/023,867, on non-viral delivery, the nucleic acid sequences encoding a polypeptide can be inserted into conventional vectors that contain conventional control sequences for high level expression, and then be incubated with synthetic gene transfer molecules such as polymeric DNA-binding cations like polylysine, protamine, and albumin, linked to cell targeting ligands such as asialoorosomucoid, insulin, galactose, lactose, or transferrin. Other delivery systems include the use of liposomes to encapsulate DNA comprising the gene under the control of a variety of tissue-specific or ubiquitously-active promoters. Further non-viral delivery suitable for use includes mechanical delivery systems such as the approach described in Woffendin et al (1994) *Proc. Natl. Acad. Sci. USA* 91(24):11581-11585. Moreover, the coding sequence and the product of expression of such can be delivered through deposition of photopolymerized hydrogel materials. Other conventional methods for gene delivery that can be used for delivery of the coding sequence include, for example, use of hand-held gene transfer particle gun, as described in U.S. Pat. No. 5,149,655; use of ionizing radiation for activating transferred gene, as described in U.S. Pat. No. 5,206,152 and WO92/11033.

Exemplary liposome and polycationic gene delivery vehicles are those described in U.S. Pat. Nos. 5,422,120 and 4,762,915; in WO 95/13796; WO94/23697; and WO91/14445; in EP-0524968; and in Stryer, Biochemistry, pages 236-240 (1975) W.H. Freeman, San Francisco; Szoka (1980) *Biochem Biophys Acta* 600:1; Bayer (1979) *Biochem Biophys Acta* 550:464; Rivnay (1987) *Meth Enzymol* 149:119; Wang (1987) *Proc Natl Acad Sci* 84:7851; Plant (1989) *Anal Biochem* 176:420.

A polynucleotide composition can comprises therapeutically effective amount of a gene therapy vehicle, as the term is defined above. For purposes of the present invention, an effective dose will be from about 0.01 mg/kg to 50 mg/kg or 0.05 mg/kg to about 10 mg/kg of the DNA constructs in the individual to which it is administered.

Delivery Methods

Once formulated, the polynucleotide compositions of the invention can be administered (1) directly to the subject; (2) delivered ex vivo, to cells derived from the subject; or (3) in vitro for expression of recombinant proteins. The subjects to be treated can be mammals or birds. Also, human subjects can be treated.

Direct delivery of the compositions will generally be accomplished by injection, either subcutaneously, intraperitoneally, intravenously or intramuscularly or delivered to the interstitial space of a tissue. The compositions can also be administered into a tumor or lesion. Other modes of administration include oral and pulmonary administration, suppositories, and transdermal applications, needles, and gene guns or hyposprays. Dosage treatment may be a single dose schedule or a multiple dose schedule.

Methods for the ex vivo delivery and reimplantation of transformed cells into a subject are known in the art and described in eg. WO93/14778. Examples of cells useful in ex vivo applications include, for example, stem cells, particularly hematopoetic, lymph cells, macrophages, dendritic cells, or tumor cells.

Generally, delivery of nucleic acids for both ex vivo and in vitro applications can be accomplished by the following procedures, for example, dextran-mediated transfection, calcium phosphate precipitation, polybrene mediated transfection, protoplast fusion, electroporation, encapsulation of the polynucleotide(s) in liposomes, and direct microinjection of the DNA into nuclei, all well known in the art.

Polynucleotide and Polypeptide Pharmaceutical Compositions

In addition to the pharmaceutically acceptable carriers and salts described above, the following additional agents can be used with polynucleotide and/or polypeptide compositions.

A. Polypeptides

One example are polypeptides which include, without limitation: asioloorosomucoid (ASOR); transferrin; asialoglycoproteins; antibodies; antibody fragments; ferritin; interleukins; interferons, granulocyte, macrophage colony stimulating factor (GM-CSF), granulocyte colony stimulating factor (G-CSF), macrophage colony stimulating factor (M-CSF), stem cell factor and erythropoietin. Viral antigens, such as envelope proteins, can also be used. Also, proteins from other invasive organisms, such as the 17 amino acid peptide from the circumsporozoite protein of *plasmodium falciparum* known as RII.

B. Hormones, Vitamins, Etc.

Other groups that can be included are, for example: hormones, steroids, androgens, estrogens, thyroid hormone, or vitamins, folic acid.

C. Polyalkylenes, Polysaccharides, Etc.

Also, polyalkylene glycol can be included with the desired polynucleotides or polypeptides. In a preferred embodiment, the polyalkylene glycol is polyethlylene glycol. In addition, mono-, di-, or polysaccarides can be included. In a preferred embodiment of this aspect, the polysaccharide is dextran or DEAE-dextran. Also, chitosan and poly(lactide-co-glycolide)

D. Lipids, and Liposomes

The desired polynucleotide or polypeptide can also be encapsulated in lipids or packaged in liposomes prior to delivery to the subject or to cells derived therefrom.

Lipid encapsulation is generally accomplished using liposomes which are able to stably bind or entrap and retain nucleic acid. The ratio of condensed polynucleotide or polypeptide to lipid preparation can vary but will generally be around 1:1 (mg DNA:micromoles lipid), or more of lipid. For a review of the use of liposomes as carriers for delivery of nucleic acids, see, Hug and Sleight (1991) *Biochim. Biophys. Acta.* 1097:1-17; Straubinger (1983) *Meth. Enzymol.* 101: 512-527.

Liposomal preparations for use in the present invention include cationic (positively charged), anionic (negatively charged) and neutral preparations. Cationic liposomes have been shown to mediate intracellular delivery of plasmid DNA (Felgner (1987) *Proc. Natl. Acad. Sci. USA* 84:7413-7416); mRNA (Malone (1989) *Proc. Natl. Acad. Sci. USA* 86:6077-6081); and purified transcription factors (Debs (1990) *J. Biol. Chem.* 265:10189-10192), in functional form.

Cationic liposomes are readily available. For example, N[1-2,3-dioleyloxy)propyl]-N,N,N-triethylammonium (DOTMA) liposomes are available under the trademark Lipofectin, from GIBCO BRL, Grand Island, N.Y. (See, also, Felgner supra). Other commercially available liposomes include transfectace (DDAB/DOPE) and DOTAP/DOPE (Boerhinger). Other cationic liposomes can be prepared from readily available materials using techniques well known in the art. See, eg. Szoka (1978) *Proc. Natl. Acad. Sci. USA* 75:4194-4198; WO90/11092 for a description of the synthesis of DOTAP (1,2-bis(oleoyloxy)-3-(trimethylammonio) propane) liposomes.

Similarly, anionic and neutral liposomes are readily available, such as from Avanti Polar Lipids (Birmingham, Ala.), or can be easily prepared using readily available materials. Such materials include phosphatidyl choline, cholesterol, phosphatidyl ethanolamine, dioleoylphosphatidyl choline (DOPC), dioleoylphosphatidyl glycerol (DOPG), dioleoylphoshatidyl ethanolamine (DOPE), among others. These materials can also be mixed with the DOTMA and DOTAP starting materials in appropriate ratios. Methods for making liposomes using these materials are well known in the art.

The liposomes can comprise multilammelar vesicles (MLVs), small unilamellar vesicles (SUVs), or large unilamellar vesicles (LUVs). The various liposome-nucleic acid complexes are prepared using methods known in the art. See eg. Straubinger (1983) *Meth. Immunol.* 101:512-527; Szoka (1978) *Proc. Natl. Acad. Sci. USA* 75:4194-4198; Papahadjopoulos (1975) *Biochim. Biophys. Acta* 394:483; Wilson (1979) *Cell* 17:77); Deamer & Bangham (1976) *Biochim. Biophys. Acta* 443:629; Ostro (1977) *Biochem. Biophys. Res. Commun.* 76:836; Fraley (1979) *Proc. Natl. Acad. Sci. USA* 76:3348); Enoch & Strittmatter (1979) *Proc. Natl. Acad. Sci. USA* 76:145; Fraley (1980) *J. Biol. Chem.* (1980) 255:10431; Szoka & Papahadjopoulos (1978) *Proc. Natl. Acad. Sci. USA* 75:145; and Schaefer-Ridder (1982) *Science* 215:166.

E. Lipoproteins

In addition, lipoproteins can be included with the polynucleotide or polypeptide to be delivered. Examples of lipoproteins to be utilized include: chylomicrons, HDL, IDL, LDL, and VLDL. Mutants, fragments, or fusions of these proteins can also be used. Also, modifications of naturally occurring lipoproteins can be used, such as acetylated LDL. These lipoproteins can target the delivery of polynucleotides to cells expressing lipoprotein receptors. Preferably, if lipoproteins are including with the polynucleotide to be delivered, no other targeting ligand is included in the composition.

Naturally occurring lipoproteins comprise a lipid and a protein portion. The protein portion are known as apoproteins. At the present, apoproteins A, B, C, D, and E have been isolated and identified. At least two of these contain several proteins, designated by Roman numerals, AI, AII, AIV; CI, CII, CIII.

A lipoprotein can comprise more than one apoprotein. For example, naturally occurring chylomicrons comprises of A, B, C, and E, over time these lipoproteins lose A and acquire C and E apoproteins. VLDL comprises A, B, C, and E apoproteins, LDL comprises apoprotein B; and HDL comprises apoproteins A, C, and E.

The amino acid of these apoproteins are known and are described in, for example, Breslow (1985) *Annu Rev. Biochem* 54:699; Law (1986) *Adv. Exp Med. Biol.* 151:162; Chen (1986) *J Biol Chem* 261:12918; Kane (1980) *Proc Natl Acad Sci USA* 77:2465; and Utermann (1984) *Hum Genet* 65:232.

Lipoproteins contain a variety of lipids including, triglycerides, cholesterol (free and esters), and phopholipids. The composition of the lipids varies in naturally occurring lipoproteins. For example, chylomicrons comprise mainly triglycerides. A more detailed description of the lipid content of naturally occurring lipoproteins can be found, for example, in *Meth. Enzymol.* 128 (1986). The composition of the lipids are chosen to aid in conformation of the apoprotein for receptor binding activity. The composition of lipids can also be chosen to facilitate hydrophobic interaction and association with the polynucleotide binding molecule.

Naturally occurring lipoproteins can be isolated from serum by ultracentrifugation, for instance. Such methods are described in *Meth. Enzymol.* (supra); Pitas (1980) *J. Biochem.* 255:5454-5460 and Mahey (1979) *J Clin. Invest* 64:743-750.

Lipoproteins can also be produced by in vitro or recombinant methods by expression of the apoprotein genes in a desired host cell. See, for example, Atkinson (1986) *Annu Rev Biophys Chem* 15:403 and Radding (1958) *Biochim Biophys Acta* 30: 443.

Lipoproteins can also be purchased from commercial suppliers, such as Biomedical Techniologies, Inc., Stoughton, Mass., USA.

Further description of lipoproteins can be found in Zuckermann et al., PCT. Appln. No. US97/14465.

F. Polycationic Agents

Polycationic agents can be included, with or without lipoprotein, in a composition with the desired polynucleotide or polypeptide to be delivered.

Polycationic agents, typically, exhibit a net positive charge at physiological relevant pH and are capable of neutralizing the electrical charge of nucleic acids to facilitate delivery to a desired location. These agents have both in vitro, ex vivo, and in vivo applications. Polycationic agents can be used to deliver nucleic acids to a living subject either intramuscularly, subcutaneously, etc.

The following are examples of useful polypeptides as polycationic agents: polylysine, polyarginine, polyornithine, and protamine. Other examples include histones, protamines, human serum albumin, DNA binding proteins, non-histone chromosomal proteins, coat proteins from DNA viruses, such as (X174, transcriptional factors also contain domains that bind DNA and therefore may be useful as nucleic aid condensing agents. Briefly, transcriptional factors such as C/CEBP, c-jun, c-fos, AP-1, AP-2, AP-3, CPF, Prot-1, Sp-1, Oct-1, Oct-2, CREP, and TFIID contain basic domains that bind DNA sequences.

Organic polycationic agents include: spermine, spermidine, and purtrescine.

The dimensions and of the physical properties of a polycationic agent can be extrapolated from the list above, to construct other polypeptide polycationic agents or to produce synthetic polycationic agents.

Synthetic Polycationic Agents

Synthetic polycationic agents which are useful include, for example, DEAE-dextran, polybrene. LIPOFECTIN™, and LIPOFECTAMINE™ are monomers that form polycationic complexes when combined with polynucleotides or polypeptides.

Immunodiagnostic Assays

Neisserial antigens of the invention can be used in immunoassays to detect antibody levels (or, conversely, anti-Neisserial antibodies can be used to detect antigen levels). Immunoassays based on well defined, recombinant antigens can be developed to replace invasive diagnostics methods. Antibodies to Neisserial proteins within biological samples, including for example, blood or serum samples, can be detected. Design of the immunoassays is subject to a great deal of variation, and a variety of these are known in the art. Protocols for the immunoassay may be based, for example, upon competition, or direct reaction, or sandwich type assays. Protocols may also, for example, use solid supports, or may be by immunoprecipitation. Most assays involve the use of labeled antibody or polypeptide; the labels may be, for example, fluorescent, chemiluminescent, radioactive, or dye molecules. Assays which amplify the signals from the probe are also known; examples of which are assays which utilize biotin and avidin, and enzyme-labeled and mediated immunoassays, such as ELISA assays.

Kits suitable for immunodiagnosis and containing the appropriate labeled reagents are constructed by packaging the appropriate materials, including the compositions of the invention, in suitable containers, along with the remaining reagents and materials (for example, suitable buffers, salt solutions, etc.) required for the conduct of the assay, as well as suitable set of assay instructions.

Nucleic Acid Hybridisation

"Hybridization" refers to the association of two nucleic acid sequences to one another by hydrogen bonding. Typically, one sequence will be fixed to a solid support and the other will be free in solution. Then, the two sequences will be placed in contact with one another under conditions that favor hydrogen bonding. Factors that affect this bonding include: the type and volume of solvent; reaction temperature; time of hybridization; agitation; agents to block the non-specific attachment of the liquid phase sequence to the solid support (Denhardt's reagent or BLOTTO); concentration of the sequences; use of compounds to increase the rate of association of sequences (dextran sulfate or polyethylene glycol); and the stringency of the washing conditions following hybridization. See Sambrook et al. [supra] Volume 2, chapter 9, pages 9.47 to 9.57.

"Stringency" refers to conditions in a hybridization reaction that favor association of very similar sequences over sequences that differ. For example, the combination of temperature and salt concentration should be chosen that is approximately 120 to 200° C. below the calculated Tm of the hybrid under study. The temperature and salt conditions can often be determined empirically in preliminary experiments in which samples of genomic DNA immobilized on filters are hybridized to the sequence of interest and then washed under conditions of different stringencies. See Sambrook et al. at page 9.50.

Variables to consider when performing, for example, a Southern blot are (1) the complexity of the DNA being blotted and (2) the homology between the probe and the sequences being detected. The total amount of the fragment(s) to be studied can vary a magnitude of 10, from 0.1 to 1 μg for a plasmid or phage digest to $10^{-9}$ to $10^{-8}$ g for a single copy gene in a highly complex eukaryotic genome. For lower complexity polynucleotides, substantially shorter blotting, hybridization, and exposure times, a smaller amount of starting polynucleotides, and lower specific activity of probes can be used. For example, a single-copy yeast gene can be detected with an exposure time of only 1 hour starting with 1 μg of yeast DNA, blotting for two hours, and hybridizing for 4-8 hours with a probe of $10^8$ cpm/μg. For a single-copy mammalian gene a conservative approach would start with 10 μg of DNA, blot overnight, and hybridize overnight in the presence of 10% dextran sulfate using a probe of greater than $10^8$ cpm/μg, resulting in an exposure time of ~24 hours.

Several factors can affect the melting temperature (Tm) of a DNA-DNA hybrid between the probe and the fragment of interest, and consequently, the appropriate conditions for hybridization and washing. In many cases the probe is not 100% homologous to the fragment. Other commonly encountered variables include the length and total G+C content of the hybridizing sequences and the ionic strength and formamide content of the hybridization buffer. The effects of all of these factors can be approximated by a single equation:

$$Tm=81+16.6(\log_{10}Ci)+0.4[\%(G+C)]-0.6(\%\ \text{formamide})-600/n-1.5(\%\ \text{mismatch}).$$

where Ci is the salt concentration (monovalent ions) and n is the length of the hybrid in base pairs (slightly modified from Meinkoth & Wahl (1984) *Anal. Biochem.* 138: 267-284).

In designing a hybridization experiment, some factors affecting nucleic acid hybridization can be conveniently altered. The temperature of the hybridization and washes and the salt concentration during the washes are the simplest to adjust. As the temperature of the hybridization increases (ie. stringency), it becomes less likely for hybridization to occur between strands that are nonhomologous, and as a result, background decreases. If the radiolabeled probe is not completely homologous with the immobilized fragment (as is frequently the case in gene family and interspecies hybridization experiments), the hybridization temperature must be reduced, and background will increase. The temperature of the washes affects the intensity of the hybridizing band and the degree of background in a similar manner. The stringency of the washes is also increased with decreasing salt concentrations.

In general, convenient hybridization temperatures in the presence of 50% formamide are 42° C. for a probe with is 95% to 100% homologous to the target fragment, 37° C. for 90% to 95% homology, and 32° C. for 85% to 90% homology. For lower homologies, formamide content should be lowered and temperature adjusted accordingly, using the equation above. If the homology between the probe and the target fragment are not known, the simplest approach is to start with both hybridization and wash conditions which are nonstringent. If non-specific bands or high background are observed after autoradiography, the filter can be washed at high stringency and reexposed. If the time required for exposure makes this approach impractical, several hybridization and/or washing stringencies should be tested in parallel.

Nucleic Acid Probe Assays

Methods such as PCR, branched DNA probe assays, or blotting techniques utilizing nucleic acid probes according to the invention can determine the presence of cDNA or mRNA. A probe is said to "hybridize" with a sequence of the invention if it can form a duplex or double stranded complex, which is stable enough to be detected.

The nucleic acid probes will hybridize to the Neisserial nucleotide sequences of the invention (including both sense and antisense strands). Though many different nucleotide sequences will encode the amino acid sequence, the native Neisserial sequence is preferred because it is the actual sequence present in cells. mRNA represents a coding sequence and so a probe should be complementary to the coding sequence; single-stranded cDNA is complementary to mRNA, and so a cDNA probe should be complementary to the non-coding sequence.

The probe sequence need not be identical to the Neisserial sequence (or its complement)—some variation in the sequence and length can lead to increased assay sensitivity if the nucleic acid probe can form a duplex with target nucleotides, which can be detected. Also, the nucleic acid probe can include additional nucleotides to stabilize the formed duplex. Additional Neisserial sequence may also be helpful as a label to detect the formed duplex. For example, a non-complementary nucleotide sequence may be attached to the 5' end of the probe, with the remainder of the probe sequence being complementary to a Neisserial sequence. Alternatively, non-complementary bases or longer sequences can be interspersed into the probe, provided that the probe sequence has sufficient complementarity with the a Neisserial sequence in order to hybridize therewith and thereby form a duplex which can be detected.

The exact length and sequence of the probe will depend on the hybridization conditions, such as temperature, salt condition and the like. For example, for diagnostic applications, depending on the complexity of the analyte sequence, the nucleic acid probe typically contains at least 10-20 nucleotides, preferably 15-25, and more preferably at least 30 nucleotides, although it may be shorter than this. Short primers generally require cooler temperatures to form sufficiently stable hybrid complexes with the template.

Probes may be produced by synthetic procedures, such as the triester method of Matteucci et al. [*J. Am. Chem. Soc.* (1981) 103:3185], or according to Urdea et al. [*Proc. Natl. Acad. Sci. USA* (1983) 80: 7461], or using commercially available automated oligonucleotide synthesizers.

The chemical nature of the probe can be selected according to preference. For certain applications, DNA or RNA are appropriate. For other applications, modifications may be incorporated eg. backbone modifications, such as phosphorothioates or methylphosphonates, can be used to increase in vivo half-life, alter RNA affinity, increase nuclease resistance etc. [eg. see Agrawal & Iyer (1995) *Curr Opin Biotechnol* 6:12-19; Agrawal (1996) *TIBTECH* 14:376-387]; analogues such as peptide nucleic acids may also be used [eg. see Corey (1997) *TIBTECH* 15:224-229; Buchardt et al. (1993) *TIBTECH* 11:384-386].

One example of a nucleotide hybridization assay is described by Urdea et al. in international patent application WO92/02526 [see also U.S. Pat. No. 5,124,246].

Alternatively, the polymerase chain reaction (PCR) is another well-known means for detecting small amounts of target nucleic acids. The assay is described in: Mullis et al. [*Meth. Enzymol.* (1987) 155: 335-350]; U.S. Pat. No. 4,683,195; and U.S. Pat. No. 4,683,202. Two "primer" nucleotides hybridize with the target nucleic acids and are used to prime the reaction. The primers can comprise sequence that does not hybridize to the sequence of the amplification target (or its complement) to aid with duplex stability or, for example, to incorporate a convenient restriction site. Typically, such sequence will flank the desired Neisserial sequence.

A thermostable polymerase creates copies of target nucleic acids from the primers using the original target nucleic acids as a template. After a threshold amount of target nucleic acids are generated by the polymerase, they can be detected by more traditional methods, such as Southern blots. When using the Southern blot method, the labelled probe will hybridize to the Neisserial sequence (or its complement).

Also, mRNA or cDNA can be detected by traditional blotting techniques described in Sambrook et al [supra]. mRNA, or cDNA generated from mRNA using a polymerase enzyme, can be purified and separated using gel electrophoresis. The nucleic acids on the gel are then blotted onto a solid support, such as nitrocellulose. The solid support is exposed to a labelled probe and then washed to remove any unhybridized probe. Next, the duplexes containing the labeled probe are detected. Typically, the probe is labelled with a radioactive moiety.

EXAMPLES

The examples describe nucleic acid sequences which have been identified in *N. meningitidis*, and *N. gonorrhoeae* along with their respective and putative translation products. Not all of the nucleic acid sequences are complete ie. they encode less than the full-length wild-type protein.

The examples are generally in the following format:

- a nucleotide sequence which has been identified in *N. meningitidis*
- the putative translation product of said *N. meningitidis* sequence
- a computer analysis of said translation product based on database comparisons
- a corresponding nucleotide sequence identified from *N. gonorrhoeae*
- the putative translation product of said *N. gonorrhoeae* sequence
- a comparison of the percentage of identity between the translation product of the *N. meningitidis* sequence and the *N. gonorrhoeae* sequence
- a description of the characteristics of the protein which indicates that it might be suitably antigenic or immunogenic.

Sequence comparisons were performed at NCBI (ncbi.nlm.nih.gov) using the algorithms BLAST, BLAST2, BLASTn, BLASTp, tBLASTn, BLASTx, & tBLASTx [eg. see also Altschul et al. (1997) Gapped BLAST and PSI-BLAST: a new generation of protein database search programs. *Nucleic Acids Research* 25:2289-3402]. Searches were performed against the following databases: non-redundant GenBank+EMBL+DDBJ+PDB sequences and non-redundant GenBank CDS translations+PDB+SwissProt+SPupdate+PIR sequences.

Dots within nucleotide sequences represent nucleotides which have been arbitrarily introduced in order to maintain a reading frame. In the same way, double-underlined nucleotides were removed. Lower case letters represent ambiguities which arose during alignment of independent sequencing reactions (some of the nucleotide sequences in the examples are derived from combining the results of two or more experiments).

Nucleotide sequences were scanned in all six reading frames to predict the presence of hydrophobic domains using an algorithm based on the statistical studies of Esposti et al. [Critical evaluation of the hydropathy of membrane proteins (1990) *Eur J Biochem* 190:207-219]. These domains represent potential transmembrane regions or hydrophobic leader sequences.

Open reading frames were predicted from fragmented nucleotide sequences using the program ORFFINDER (NCBI).

Underlined amino acid sequences indicate possible transmembrane domains or leader sequences in the ORFs, as predicted by the PSORT algorithm (psort.nibb.ac.jp). Functional domains were also predicted using the MOTIFS program (GCG Wisconsin & PROSITE).

For each of the following examples: based on the presence of a putative leader sequence and/or several putative transmembrane domains (single-underlined) in the gonococcal protein, it is predicted that the proteins from *N. meningitidis* and *N. gonorrhoeae*, and their respective epitopes, could be useful antigens or immunogenic compositions for vaccines or diagnostics.

The standard techniques and procedures which may be employed in order to perform the invention (e.g. to utilize the disclosed sequences for vaccination or diagnostic purposes) were summarized above. This summary is not a limitation on the invention but, rather, gives examples that may be used, but are not required.

In particular, the following methods were used to express, purify and biochemically characterize the proteins of the invention.

Chromosomal DNA Preparation

*N. meningitidis* strain 2996 was grown to exponential phase in 100 ml of GC medium, harvested by centrifugation, and resuspended in 5 ml buffer (20% Sucrose, 50 mM Tris-HCl, 50 mM EDTA, pH 8.0). After 10 minutes incubation on ice, the bacteria were lysed by adding 10 ml lysis solution (50 mM NaCl, 1% Na-SARKOSYL™, 50 μg/ml Proteinase K), and the suspension was incubated at 37° C. for 2 hours. Two phenol extractions (equilibrated to pH 8) and one $CHCl_3$/isoamylalcohol (24:1) extraction were performed. DNA was precipitated by addition of 0.3M sodium acetate and 2 volumes ethanol, and was collected by centrifugation. The pellet was washed once with 70% ethanol and redissolved in 4.0 ml TE buffer (10 mM Tris-HCl, 1 mM EDTA, pH 8). The DNA concentration was measured by reading the OD at 260 nm.

Oligonucleotide Design

Synthetic oligonucleotide primers were designed on the basis of the coding sequence of each ORF, using (a) the meningococcus B sequence when available, or (b) the gonococcus/meningococcus A sequence, adapted to the codon preference usage of meningococcus. Any predicted signal peptides were omitted, by deducing the 5'-end amplification primer sequence immediately downstream from the predicted leader sequence.

For most ORFs, the 5' primers included two restriction enzyme recognition sites (BamHI-NdeI, BamHI-NheI, EcoRI-NdeI or EcoRI-NheI), depending on the restriction pattern of the gene of interest. The 3' primers included a XhoI or a HindIII restriction site (table 1). This procedure was established in order to direct the cloning of each amplification product (corresponding to each ORF) into two different expression systems: pGEX-KG (using either BamHI-XhoI, BamHI-HindIII, EcoRI-XhoI, or EcoRI-HindIII), and pET21b+ (using either NdeI-XhoI, NheI-XhoI, NdeI-HindIII, or NheI-HindIII).

```
5'-end primer tail:
CGCGGATCCCATATG         (BamHI-NdeI)  (SEQ ID 3288)

CGCGGATCCGCTAGC         (BamHI-NheI)  (SEQ ID 3289)

CCGGAATTCTAGATATC       (EcoRI-NdeI)  (SEQ ID 3290)

CCGGAATTCTAGCTAGC       (EcoRI-NheI)  (SEQ ID 3291)

3'-end primer tail:
CCCGCTCGAG              (XhoI)        (SEQ ID 3292)

CCCGCTCGAG              (HindIII)     (SEQ ID 3293)
```

For cloning ORFs into the pGEX-His Vector, the 5' and 3' primers contained only one restriction enzyme site (EcoRI, KpnI or SalI for the 5' primers and PstI, XbaI, SphI or SalI for the 3' primers). Again restriction sites were chosen according to the particular restriction pattern of the gene (table 1).

```
5'-end primer tail:
(AAA)AAAGAATTC          (EcoRI)   (SEQ ID 3294)

(AAA)AAAGGATCC          (KpnI)    (SEQ ID 3295)

3'-end primer tail:
(AAA)AAACTGCAG          (PstI)    (SEQ ID 3296)

(AAA)AAATCTAGA          (XbaI)    (SEQ ID 3297)

5' or 3'-end primer tail:
AAAGCATGC               (SphI)    (SEQ ID 3298)

AAAAAAGAATCC            (PstI)    (SEQ ID 3299)
```

As well as containing the restriction enzyme recognition sequences, the primers included nucleotides which hybridized to the sequence to be amplified. The melting temperature depended on the number and type of hybridizing nucleotides in the whole primer, and was determined for each primer using the formulae:

$$Tm=4(G+C)+2(A+T) \text{ (tail excluded)}$$

$$T_m=64.9+0.41(\%\ GC)-600/N \text{ (whole primer)}$$

The melting temperature of the selected oligonucleotides were usually 65-70° C. for the whole oligo and 50-55° C. for the hybridising region alone.

Table 1 shows the forward and reverse primers used for each amplification. In certain cases, the sequences of the primer does not match exactly the sequence of the predicted ORF. This is because when initial amplifications were performed, the complete 5' and/or 3' sequences for some meningococcal B ORFs were not be known. However, the corresponding sequences had been identified in Gonococcus or in Meningococcus A. Hence, when the Meningococcus B sequence was incomplete or uncertain, Gonococcus or in Meningococcus A sequences were used as the basis for the primer design. These sequences were altered to take account of codon preference. It can be appreciated that, once the complete sequence is identified, this approach will no longer be necessary.

Oligonucleotides were synthesized using a Perkin Elmer 394 DNA/RNA SYNTHESIZER™, eluted from the columns in 2.0 ml $NH_4OH$, and deprotected by 5 hours incubation at 56° C. The oligos were precipitated by addition of 0.3M Na-Acetate and 2 volumes ethanol. The samples were centrifuged and the pellets resuspended in either 100 μl or 1.0 ml of water. The $OD_{260}$ was determined using a Perkin Elmer LAMBDA BIO™ spectophotometer and the concentration adjusted to 2-10 pmol/μl.

Amplification

The standard PCR protocol was as follows: 50-200 ng of genomic DNA was used as a template in the presence of 20-40 μM of each oligonucleotide primer, 400-800 μM dNTPs solution, 1×PCR buffer (including 1.5 mM $MgCl_2$), 2.5 units TaqI DNA polymerase (using Perkin-Elmer AMPLITAQ™, GIBCO Platinum, Pwo DNA polymerase, or Tahara Shuzo Taq polymerase). In some cases, PCR was optimised by the addition of 100 of DMSO or 500 of 2M Betaine.

After a hot start (adding the polymerase during a preliminary 3 minute incubation of the whole mix at 95° C.), each sample underwent a two-step amplification. The first 5 cycles were performed using the hybridization temperature that excluded the restriction enzyme tail of the primer (see above). This was followed by 30 cycles using the hybridization temperature calculated for the whole length oligos. The cycles were followed by a final 10 minute extension step at 72° C. The standard cycles were as follows:

| | Denaturation | Hybridisation | Elongation |
|---|---|---|---|
| First 5 cycles | 30 seconds<br>95° C. | 30 seconds<br>50-55° C. | 30-60 seconds<br>72° C. |
| Last 30 cycles | 30 seconds<br>95° C. | 30 seconds<br>65-70° C. | 30-60 seconds<br>72° C. |

The elongation time varied according to the length of the ORF to be amplified. Amplifications were performed using either a 9600 or a 2400 Perkin Elmer GeneAmp PCR System. To check the results, 1/10 of the amplification volume was loaded onto a 1-1.5% (w/v) agarose gel and the size of each amplified fragment compared with a DNA molecular weight marker.

The amplified DNA was either loaded directly on a 1% agarose gel or first precipitated with ethanol and resuspended in a volume suitable to be loaded on a 1.0% agarose gel. The DNA fragment corresponding to the band of the correct size was purified using the Qiagen Gel Extraction Kit, following the manufacturer's protocol. DNA fragments were eluted in a volume of 30 μl or 50 μl of either H2O or 10 mM Tris, pH 8.5.

Digestion of PCR Fragments

The purified DNA corresponding to the amplified fragment was double-digested with the appropriate restriction enzymes for; cloning into pET-21b+ and expressing the protein as a C-terminus His-tagged fusion, for cloning into pGEX-KG and expressing the protein as a N-terminus GST-fusion, and for cloning into pGEX-His and expressing the protein as a N-terminus GST-his tagged fusion.

Each purified DNA fragment was incubated at 37° C. for 3 hours to overnight with 20 units of appropriate restriction enzyme (New England Biolabs) in a either 30 or 40 μl in the presence of suitable digestion buffer. Digested products were purified using the QIAquick PCR purification kit (following the manufacturer's instructions) and eluted in a final volume of 30 or 50 μl of either H2O or 10 mM Tris, pH 8.5. The DNA concentration was determined by quantitative agarose gel electrophoresis (1.0% gel) in the presence of a titrated molecular weight marker.

Digestion of the Cloning Vectors (pET22B, pGEX-KG, pTRC-His A, pET21b+, pGEX-KG, and pGEX-His)

The vector pGEX-His is a modified pGEX-2T vector carrying a region encoding six histidine residues upstream of the thrombin cleavage site and containing the multiple cloning site of the vector pTRC99 (Pharmacia). 10 μg plasmid was double-digested with 50 units of each restriction enzyme in 200 μl reaction volume in the presence of appropriate buffer by overnight incubation at 37° C. After loading the whole digestion on a 1% agarose gel, the band corresponding to the digested vector was purified from the gel using the Qiagen QIAquick Gel Extraction Kit and the DNA was eluted in 50 μl of 10 mM Tris-HCl, pH 8.5. The DNA concentration was evaluated by measuring $OD_{260}$ of the sample, and adjusted to 50 μl. 1 μl of plasmid was used for each cloning procedure.

10 μg plasmid was double-digested with 50 units of each restriction enzyme in 200 reaction volume in the presence of appropriate buffer by overnight incubation at 37° C. The digest was loaded onto a 1% agarose gel and the band corresponding to the digested vector purified using the Qiagen QIAquick Gel Extraction Kit. DNA was eluted in 50 μl of 10 mM Tris-HCl, pH 8.5. The DNA concentration was evaluated by measuring $OD_{260}$ and the concentration adjusted to 50 μg/μl. 1 μl of plasmid was used for each cloning procedure.

Cloning

For some ORFs, the fragments corresponding to each ORF, previously digested and purified, were ligated in both pET22b and pGEX-KG. In a final volume of 20 μl, a molar ratio of 3:1 fragment/vector was ligated using 0.5 μl of NEB T4 DNA ligase (400 units/μl), in the presence of the buffer supplied by the manufacturer. The reaction was incubated at room temperature for 3 hours. In some experiments, ligation was performed using the Boheringer "Rapid Ligation Kit", following the manufacturer's instructions.

In order to introduce the recombinant plasmid in a suitable strain, 100 μl *E. coli* DH5 competent cells were incubated with the ligase reaction solution for 40 minutes on ice, then at 37° C. for 3 minutes, then, after adding 800 μl LB broth, again at 37° C. for 20 minutes. The cells were then centrifuged at maximum speed in an Eppendorf microfuge and resuspended in approximately 200 μl of the supernatant. The suspension was then plated on LB ampicillin (100 mg/ml).

The screening of the recombinant clones was performed by growing 5 randomly-chosen colonies overnight at 37° C. in either 2 ml (pGEX or pTC clones) or 5 ml (pET clones) LB broth+100 μg/ml ampicillin. The cells were then pelletted and the DNA extracted using the Qiagen QIAprep Spin Miniprep Kit, following the manufacturer's instructions, to a final volume of 30 μl. 5 μl of each individual miniprep (approximately 1 g) were digested with either NdeI/XhoI or BamHI/XhoI and the whole digestion loaded onto a 1-1.5% agarose gel (depending on the expected insert size), in parallel with the molecular weight marker (1 Kb DNA Ladder, GIBCO). The screening of the positive clones was made on the base of the correct insert size.

For other ORFs, the fragments corresponding to each ORF, previously digested and purified, were ligated in both pET21b+ and pGEX-KG. A molar ratio of 3:1 fragment/vector was used in a final volume of 20 μl, that included 0.5 μl of T4 DNA ligase (400 units/μl, NEB) and ligation buffer supplied by the manufacturer. The reaction was performed at room temperature for 3 hours. In some experiments, ligation was performed using the Boheringer "Rapid Ligation Kit" and the manufacturer's protocol.

Recombinant plasmid was transformed into 100 μl of competent *E. coli* DH5 or HB101 by incubating the ligase reaction solution and bacteria for 40 minutes on ice then at 37° C. for 3 minutes. This was followed by addition of 800 μl LB broth and incubation at 37° C. for 20 minutes. The cells were then centrifuged at maximum speed in an Eppendorf microfuge, resuspended in approximately 200 μl of the supernatant, and plated on LB ampicillin (100 mg/ml) agar.

Screening for recombinant clones was performed by growing 5 randomly selected colonies overnight at 37° C. in either 2.0 ml (pGEX-KG clones) or 5.0 ml (pET clones) LB broth+100 μg/ml ampicillin. Cells were pelleted and plasmid DNA extracted using the Qiagen QIAprep Spin Miniprep Kit, following the manufacturer's instructions. Approximately 1 μg of each individual miniprep was digested with the appropriate restriction enzymes and the digest loaded onto a 1-1.5% agarose gel (depending on the expected insert size), in parallel with the molecular weight marker (1 kb DNA Ladder, GIBCO). Positive clones were selected on the basis of the size of the insert.

ORFs were cloned in PGEX-His, by doubly-digesting the PC product and ligating into similarly digested vector. After cloning, recombinant plasmids were transformed into the *E. coli* host W3110. Individual clones were grown overnight at 37° C. in LB broth with 50 μg/ml ampicillin.

Certain ORFs may be cloned into the pGEX-HIS vector using EcoRI-PstI cloning sites, or EcoRI-SalI, or SalI-PstI. After cloning, the recombinant plasmids may be introduced in the *E. coli* host W3110.

Expression

Each ORF cloned into the expression vector may then be transformed into the strain suitable for expression of the recombinant protein product. 1 μl of each construct was used to transform 30 μl of *E. coli* BL21 (pGEX vector), *E. coli* TOP 10 (pTRC vector) or *E. coli* BL21-DE3 (pET vector), as described above. In the case of the pGEX-His vector, the same *E. coli* strain (W3110) was used for initial cloning and expression. Single recombinant colonies were inoculated into 2 ml LB+Amp (100 μg/ml), incubated at 37° C. overnight, then diluted 1:30 in 20 ml of LB+Amp (100 μg/ml) in 100 ml flasks, making sure that the $OD_{600}$ ranged between 0.1 and 0.15. The flasks were incubated at 30° C. into gyratory water bath shakers until OD indicated exponential growth suitable for induction of expression (0.4-0.8 OD for pET and pTRC vectors; 0.8-1 OD for pGEX and pGEX-His vectors). For the pET, pTRC and pGEX-His vectors, the protein expression was induced by addiction of 1 mM IPTG, whereas in the case of pGEX system the final concentration of IPTG was 0.2 mM. After 3 hours incubation at 30° C., the final concentration of the sample was checked by OD. In order to check expression, 1 ml of each sample was removed, centrifuged in a microfuge, the pellet resuspended in PBS, and analysed by 12% SDS-PAGE with Coomassie Blue staining. The whole sample was centrifuged at 6000 g and the pellet resuspended in PBS for further use.

GST-Fusion Proteins Large-Scale Purification.

For some ORFs, a single colony was grown overnight at 37° C. on LB+Amp agar plate. The bacteria were inoculated into 20 ml of LB+Amp liquid culture in a water bath shaker and grown overnight. Bacteria were diluted 1:30 into 600 ml of fresh medium and allowed to grow at the optimal temperature (20-37° C.) to $OD_{550}$ 0.8-1. Protein expression was induced with 0.2 mM IPTG followed by three hours incubation. The culture was centrifuged at 8000 rpm at 4° C. The supernatant was discarded and the bacterial pellet was resuspended in 7.5 ml cold PBS. The cells were disrupted by sonication on ice for 30 sec at 40 W using a Branson sonifier B-15, frozen and thawed two times and centrifuged again. The supernatant was collected and mixed with 150 μl GLUTATHIONE-SEPHAROSE 4B™ resin (Pharmacia) (previously washed with PBS) and incubated at room temperature for 30 minutes. The sample was centrifuged at 700 g for 5 minutes at 4 C. The resin was washed twice with 10 ml cold PBS for 10 minutes, resuspended in 1 ml cold PBS, and loaded on a disposable column. The resin was washed twice with 2 ml cold PBS until the flow-through reached $OD_{280}$ of 0.02-0.06. The GST-fusion protein was eluted by addition of 700 μl cold Glutathione elution buffer (10 mM reduced glutathione, 50 mM Tris-HCl) and fractions collected until the $OD_{280}$ was 0.1. 21 μl of each fraction were loaded on a 12% SDS gel using either Biorad SDS-PAGE Molecular weight standard broad range (M1) (200, 116.25, 97.4, 66.2, 45, 31, 21.5, 14.4, 6.5 kDa) or Amersham Rainbow Marker (M") (220, 66, 46, 30, 21.5, 14.3 kDa) as standards. As the MW of GST is 26 kDa, this value must be added to the MW of each GST-fusion protein.

For other ORFs, for each clone to be purified as a GST-fusion, a single colony was streaked out and grown overnight at 37° C. on LB/Amp (100 μg/ml) agar plate. An isolated colony from this plate was inoculated into 20 ml of LB/Amp (100 μg/ml) liquid medium and grown overnight at 37° C. with shaking. The overnight culture was diluted 1:30 into 600 ml of LB/Amp (100 μg/ml) liquid medium and allowed to grow at the optimal temperature (20-37° C.) until the $OD_{550}$ reached 0.6-0.8. Recombinant protein expression was induced by addition of IPTG (final concentration 0.2 mM) and the culture incubated for a further 3 hours. The bacteria were harvested by centrifugation at 8000×g for 15 min at 4° C.

The bacterial pellet was resuspended in 7.5 ml cold PBS. Cells were disrupted by sonication on ice for 30 sec at 40 W using a Branson sonifier 450 and centrifuged at 13 000×g for 30 min at 4° C. The supernatant was collected and mixed with 150 μl GLUTATHIONE-SEPHAROSE 4B™ resin (Pharmacia), previously equilibrated with PBS, and incubated at room temperature with gentle agitation for 30 min. The batch-wise preparation was centrifuged at 700×g for 5 min at 4° C. and the supernatant discarded. The resin was washed twice (batchwise) with 10 ml cold PBS for 10 min, resuspended in 1 ml cold PBS, and loaded onto a disposable column. The resin continued to be washed twice with cold PBS, until the $OD_{280nm}$ of the flow-through reached 0.02-0.01. The GST-fusion protein was eluted by addition of 700 μl cold glutathione elution buffer (10 mM reduced glutathione, 50 mM Tris-HCl pH 8.0) and fractions collected, until the $OD_{280nm}$ of the eluate indicated all the recombinant protein was obtained. 20 μl aliquots of each elution fraction were analyzed by SDS-PAGE using a 12% gel. The molecular mass of the purified proteins was determined using either the Bio-Rad broad range molecular weight standard (M1) (200, 116, 97.4, 66.2, 45.0, 31.0, 21.5, 14.4, 6.5 kDa) or the Amersham Rainbow Marker (M2) (220, 66.2, 46.0, 30.0, 21.5, 14.3 kDa). The molecular weights of GST-fusion proteins are a combination of the 26 kDa GST protein and its fusion partner. Protein concentrations were estimated using the Bradford assay.

His-Fusion Soluble Proteins Large-Scale Purification.

For some ORFs, a single colony was grown overnight at 37° C. on a LB+Amp agar plate. The bacteria were inoculated into 20 ml of LB+Amp liquid culture and incubated overnight in a water bath shaker. Bacteria were diluted 1:30 into 600 ml fresh medium and allowed to grow at the optimal temperature (20-37° C.) to $OD_{550}$ 0.6-0.8. Protein expression was induced by addition of 1 mM IPTG and the culture further incubated for three hours. The culture was centrifuged at 8000 rpm at 4° C., the supernatant was discarded and the bacterial pellet was resuspended in 7.5 ml cold 10 mM imidazole buffer (300 mM NaCl, 50 mM phosphate buffer, 10 mM imidazole, pH 8). The cells were disrupted by sonication on ice for 30 sec at 40 W using a Branson sonifier B-15, frozen and thawed two times and centrifuged again. The supernatant was collected and mixed with 150 μl $Ni^{2+}$-resin (Pharmacia) (previously washed with 10 mM imidazole buffer) and incubated at room temperature with gentle agitation for 30 minutes. The sample was centrifuged at 700 g for 5 minutes at 4° C. The resin was washed twice with 10 ml cold 10 mM imidazole buffer for 10 minutes, resuspended in 1 ml cold 10 mM imidazole buffer and loaded on a disposable column. The resin was washed at 4° C. with 2 ml cold 10 mM imidazole buffer until the flow-through reached the $O.D_{280}$ of 0.02-0.06. The resin was washed with 2 ml cold 20 mM imidazole buffer (300 mM NaCl, 50 mM phosphate buffer, 20 mM imidazole, pH 8) until the flow-through reached the $O.D_{280}$ of 0.02-0.06. The His-fusion protein was eluted by addition of 700 μl cold 250 mM imidazole buffer (300 mM NaCl, 50 mM phosphate buffer, 250 mM imidazole, pH 8) and fractions collected until the $O.D_{280}$ was 0.1. 21 μl of each fraction were loaded on a 12% SDS gel.

His-Fusion Insoluble Proteins Large-Scale Purification.

A single colony was grown overnight at 37° C. on a LB+Amp agar plate. The bacteria were inoculated into 20 ml of LB+Amp liquid culture in a water bath shaker and grown overnight. Bacteria were diluted 1:30 into 600 ml fresh medium and let to grow at the optimal temperature (37° C.) to $O.D_{550}$ 0.6-0.8. Protein expression was induced by addition of 1 mM IPTG and the culture further incubated for three hours. The culture was centrifuged at 8000 rpm at 4° C. The supernatant was discarded and the bacterial pellet was resuspended in 7.5 ml buffer B (urea 8M, 10 mM Tris-HCl, 100 mM phosphate buffer, pH 8.8). The cells were disrupted by sonication on ice for 30 sec at 40 W using a Branson sonifier B-15, frozen and thawed twice and centrifuged again. The supernatant was stored at −20° C., while the pellets were resuspended in 2 ml guanidine buffer (6M guanidine hydrochloride, 100 mM phosphate buffer, 10 mM Tris-HCl, pH 7.5) and treated in a homogenizer for 10 cycles. The product was centrifuged at 13000 rpm for 40 minutes. The supernatant was mixed with 150 μl $Ni^{2+}$-resin (Pharmacia) (previously washed with buffer B) and incubated at room temperature with gentle agitation for 30 minutes. The sample was centrifuged at 700 g for 5 minutes at 4° C. The resin was washed twice with 10 ml buffer B for 10 minutes, resuspended in 1 ml buffer B, and loaded on a disposable column. The resin was washed at room temperature with 2 ml buffer B until the flow-through reached the $OD_{280}$ of 0.02-0.06. The resin was washed with 2 ml buffer C (urea 8M, 10 mM Tris-HCl, 100 mM phosphate buffer, pH 6.3) until the flow-through reached the $O.D_{280}$ of 0.02-0.06. The His-fusion protein was eluted by addition of 700 μl elution buffer (urea 8M, 10 mM Tris-HCl, 100 mM phosphate buffer, pH 4.5) and fractions collected until the $OD_{280}$ was 0.1. 21 μl of each fraction were loaded on a 12% SDS gel.

Purification of His-fusion Proteins.

For each clone to be purified as a His-fusion, a single colony was streaked out and grown overnight at 37° C. on LB/Amp (100 μg/ml) agar plate. An isolated colony from this plate was inoculated into 20 ml of LB/Amp (100 μg/ml) liquid medium and grown overnight at 37° C. with shaking. The overnight culture was diluted 1:30 into 600 ml of LB/Amp (100 μg/ml) liquid medium and allowed to grow at the optimal temperature (20-37° C.) until the $OD_{550}$ reached 0.6-0.8. Expression of recombinant protein was induced by addition of IPTG (final concentration 1.0 mM) and the culture incubated for a further 3 hours. The bacteria were harvested by centrifugation at 8000×g for 15 min at 4° C.

The bacterial pellet was resuspended in 7.5 ml either (i) cold buffer A (300 mM NaCl, 50 mM phosphate buffer, 10 mM imidazole, pH 8.0) for soluble proteins or (ii) buffer B (8M urea, 10 mM TrisHCl, 100 mM phosphate buffer, pH 8.8) for insoluble proteins. Cells were disrupted by sonication on ice four times for 30 sec at 40 W using a Branson sonifier 450 and centrifuged at 13 000×g for 30 min at 4° C. For insoluble proteins, pellets were resuspended in 2.0 ml buffer C (6M guanidine hydrochloride, 100 mM phosphate buffer, 10 mM Tris-HCl, pH 7.5) and treated with a Dounce homogenizer for 10 cycles. The homogenate was centrifuged at 13 000×g for 40 min and the supernatant retained.

Supernatants for both soluble and insoluble preparations were mixed with 150 μl $Ni^{2+}$-resin (previously equilibrated with either buffer A or buffer B, as appropriate) and incubated at room temperature with gentle agitation for 30 min. The resin was CHELATING SEPHAROSE FAST FLOW™ (Pharmacia), prepared according to the manufacturers protocol. The batch-wise preparation was centrifuged at 700×g for 5 min at 4° C. and the supernatant discarded. The resin was washed twice (batch-wise) with 10 ml buffer A or B for 10 min, resuspended in 1.0 ml buffer A or B and loaded onto a disposable column. The resin continued to be washed with either (i) buffer A at 4° C. or (ii) buffer B at room temperature, the $OD_{280nm}$ of the flow-through reached 0.02-0.01. The resin was further washed with either (i) cold buffer C (300 mM NaCl, 50 mM phosphate buffer, 20 mM imidazole, pH 8.0) or (ii) buffer D (8M urea, 10 mM Tris-HCl, 100 mM phosphate buffer, pH 6.3) until the $OD_{280nm}$ of the flow-through reached 0.02-0.01. The His-fusion protein was eluted by addition of 700 μl of either (1) cold elution buffer A (300 mM NaCl, 50 mM phosphate buffer, 250 mM imidazole, pH 8.0) or (ii) elution buffer B (8 M urea, 10 mM Tris-HCl, 100 mM phosphate buffer, pH 4.5) and fractions collected until the $O.D_{280nm}$ indicated all the recombinant protein was obtained. 20 μl aliquots of each elution fraction were analyzed by SDS-PAGE using a 12% gel. Protein concentrations were estimated using the Bradford assay.

His-Fusion Proteins Renaturation

In the cases where denaturation was required to solubilize proteins, a renaturation step was employed prior to immunization. Glycerol was added to the denatured fractions obtained above to a final concentration of 10% (v/v). The proteins were then diluted to 200 μg/ml using dialysis buffer I (10% (v/v) glycerol, 0.5M arginine, 50 mM phosphate buffer, 5 mM reduced glutathione, 0.5 mM oxidised glutathione, 2M urea, pH 8.8) and dialysed against the same buffer for 12-14 hours at 4° C. Further dialysis was performed with buffer II (10% (v/v) glycerol, 0.5M arginine, 50 mM phosphate buffer, 50 mM reduced glutathione, 5.0 mM oxidised glutathione, pH 8.8) for 12-14 hours at 4° C.

Alternatively, 10% glycerol was added to the denatured proteins. The proteins were then diluted to 20 μg/ml using dialysis buffer I (10% glycerol, 0.5M arginine, 50 mM phosphate buffer, 5 mM reduced glutathione, 0.5 mM oxidised glutathione, 2M urea, pH 8.8) and dialysed against the same buffer at 4° C. for 12-14 hours. The protein was further dialysed against dialysis buffer II (10% glycerol, 0.5M arginine, 50 mM phosphate buffer, 5 mM reduced glutathione, 0.5 mM oxidised glutathione, pH 8.8) for 12-14 hours at 4° C.

Protein concentration was evaluated using the formula:

$$\text{Protein (mg/ml)}=(1.55\times OD_{280})-(0.76\times OD_{260})$$

Purification of Proteins

To analyse the solubility, pellets obtained from 3.0 ml cultures were resuspended in 500 μl buffer M1 (PBS pH 7.2). 25 μl of lysozyme (10 mg/ml) was added and the bacteria incubated for 15 min at 4° C. Cells were disrupted by sonication on ice four times for 30 sec at 40 W using a Branson sonifier 450 and centrifuged at 13 000×g for 30 min at 4° C. The supernatant was collected and the pellet resuspended in buffer M2 [8M urea, 0.5M NaCl, 20 mM imidazole and 0.1 M $NaH_2PO_4$] and incubated for 3 to 4 hours at 4° C. After centrifugation, the supernatant was collected and the pellet resuspended in buffer M3 [6M guanidinium-HCl, 0.5M NaCl, 20 mM imidazole and 0.1 M $NaH_2PO_4$] overnight at 4° C. The supernatants from all steps were analysed by SDS-PAGE. Some proteins were found to be soluble in PBS, others needed urea or guanidinium-HCl for solubilization.

For preparative scale purification, 500 ml cultures were induced and fusion proteins solubilized in either buffer M1, M2, or M3 using the procedure described above. Crude extracts were loaded onto a Ni-NTA superflow column (Qiagen) equilibrated with buffer M1, M2, or M3 depending on the solubilization buffer employed. Unbound material was eluted with the corresponding buffer containing 500 mM imidazole then dialysed against the same buffer in the absence of imidazole.

Mice Immunizations

20 μg of each purified protein are used to immunize mice intraperitoneally. In the case of some ORFs, Balb-C mice were immunised with $Al(OH)_3$ as adjuvant on days 1, 21 and 42, and immune response was monitored in samples taken on day 56. For other ORFs, CD1 mice could be immunised using the same protocol. For ORFs 25 and 40, CD1 mice were immunised using Freund's adjuvant, and the same immunisation protocol was used, except that the immune response was measured on day 42, rather than 56. Similarly, for still other ORFs, CD1 mice were immunised with Freund's adjuvant, but the immune response was measured on day 49. Alternatively, 20 μg of each purified protein was mixed with Freund's adjuvant and used to immunize CD1 mice intraperitoneally. For many of the proteins, the immunization was performed on days 1, 21 and 35, and immune response was monitored in samples taken on days 34 and 49. For some proteins, the third immunization was performed on day 28, rather than 35, and immune response was measured on days 20 and 42, rather than 34 and 49.

Elisa Assay (Sera Analysis)

The acapsulated MenB M7 strain was plated on chocolate agar plates and incubated overnight at 37° C. Bacterial colonies were collected from the agar plates using a sterile dracon swab and inoculated into 7 ml of Mueller-Hinton Broth (Difco) containing 0.25% Glucose. Bacterial growth was monitored every 30 minutes by following $OD_{620}$. The bacteria were let to grow until the OD reached the value of 0.3-0.4. The culture was centrifuged for 10 minutes at 10000 rpm. The supernatant was discarded and bacteria were washed once with PBS, resuspended in PBS containing 0.025% formaldehyde, and incubated for 2 hours at room temperature and then overnight at 4° C. with stirring. 100 μl bacterial cells were added to each well of a 96 well Greiner plate and incubated overnight at 4° C. The wells were then washed three times with PBT washing buffer (0.1% TWEEN-20™ in PBS). 200 μl of saturation buffer (2.7% Polyvinylpyrrolidone 10 in water) was added to each well and the plates incubated for 2 hours at 37° C. Wells were washed three times with PBT. 200 μl of diluted sera (Dilution buffer: 1% BSA, 0.1% TWEEN-20™, 0.1% $NaN_3$ in PBS) were added to each well and the plates incubated for 90 minutes at 37° C. Wells were washed three times with PBT. 100 μl of HRP-conjugated rabbit anti-mouse (Dako) serum diluted 1:2000 in dilution buffer were added to each well and the plates were incubated for 90 minutes at 37° C. Wells were washed three times with PBT buffer. 100 μl of substrate buffer for HRP (25 ml of citrate buffer pH5, 10 mg of O-phenildiamine and 10 μl of $H_2O$) were added to each well and the plates were left at room temperature for 20 minutes. 100 μl $H_2SO_4$ was added to each well and $OD_{490}$ was followed. The ELISA was considered positive when OD490 was 2.5 times the respective pre-immune sera.

Alternatively, The acapsulated MenB M7 strain was plated on chocolate agar plates and incubated overnight at 37° C. Bacterial colonies were collected from the agar plates using a sterile dracon swab and inoculated into Mueller-Hinton Broth (Difco) containing 0.25% Glucose. Bacterial growth was monitored every 30 minutes by following $OD_{620}$. The bacteria were let to grow until the OD reached the value of 0.3-0.4. The culture was centrifuged for 10 minutes at 10 000 rpm. The supernatant was discarded and bacteria were washed once with PBS, resuspended in PBS containing 0.025% formaldehyde, and incubated for 1 hour at 37° C. and then overnight at 4° C. with stirring. 100 μl bacterial cells were added to each well of a 96 well Greiner plate and incubated overnight at 4° C. The wells were then washed three times with PBT washing buffer (0.1% TWEEN-20™ in PBS). 200 μl of saturation buffer (2.7% Polyvinylpyrrolidone 10 in water) was added to each well and the plates incubated for 2 hours at 37° C. Wells were washed three times with PBT. 200 μl of diluted sera (Dilution buffer: 1% BSA, 0.1% TWEEN-20™, 0.1% $NaN_3$ in PBS) were added to each well and the plates incubated for 2 hours at 37° C. Wells were washed three times with PBT. 100 μl of HRP-conjugated rabbit anti-mouse (Dako) serum diluted 1:2000 in dilution buffer were added to each well and the plates were incubated for 90 minutes at 37° C. Wells were washed three times with PBT buffer. 100 μl of substrate buffer for HRP (25 ml of citrate buffer pH5, 10 mg of O-phenildiamine and 10 μl of $H_2O_2$) were added to each well and the plates were left at room temperature for 20 minutes. 100 μl $H_2SO_4$ was added to each well and $OD_{490}$ was followed. The ELISA titers were calculated arbitrarily as the dilution of sera which gave an $OD_{490}$ value of 0.4 above the level of preimmune sera. The ELISA was considered positive when the dilution of sera with $OD_{490}$ of 0.4 was higher than 1:400.

FACScan Bacteria Binding Assay Procedure.

The acapsulated MenB M7 strain was plated on chocolate agar plates and incubated overnight at 37° C. Bacterial colonies were collected from the agar plates using a sterile dracon swab and inoculated into 4 tubes containing 8 ml each Mueller-Hinton Broth (Difco) containing 0.25% glucose. Bacterial growth was monitored every 30 minutes by following $OD_{620}$. The bacteria were let to grow until the OD reached the value of 0.35-0.5. The culture was centrifuged for 10 minutes at 4000 rpm. The supernatant was discarded and the pellet was resuspended in blocking buffer (1% BSA, 0.4% $NaN_3$) and centrifuged for 5 minutes at 4000 rpm. Cells were resuspended in blocking buffer to reach $OD_{620}$ of 0.07. 100 μl bacterial cells were added to each well of a Costar 96 well plate. 100 μl of diluted (1:200) sera (in blocking buffer) were added to each well and plates incubated for 2 hours at 4° C. Cells were centrifuged for 5 minutes at 4000 rpm, the supernatant aspirated and cells washed by addition of 200 μl/well of blocking buffer in each well. 100 μl of R-Phicoerytrin conjugated $F(ab)_2$ goat anti-mouse, diluted 1:100, was added to each well and plates incubated for 1 hour at 4° C. Cells were spun down by centrifugation at 4000 rpm for 5 minutes and washed by addition of 200 μl/well of blocking buffer. The supernatant was aspirated and cells resuspended in 200 μl/well of PBS, 0.25% formaldehyde. Samples were transferred to FACScan tubes and read. The condition for FACScan setting were: FL1 on, FL2 and FL3 off; FSC-H Treshold: 92; FSC PMT Voltage: E 02; SSC PMT: 474; Amp. Gains 7.1; FL-2 PMT: 539. Compensation values: 0.

OMV Preparations

Bacteria were grown overnight on 5 GC plates, harvested with a loop and resuspended in 10 ml 20 mM Tris-HCl. Heat inactivation was performed at 56° C. for 30 minutes and the bacteria disrupted by sonication for 10' on ice (50% duty cycle, 50% output). Unbroken cells were removed by centrifugation at 5000 g for 10 minutes and the total cell envelope fraction recovered by centrifugation at 50000 g at 4° C. for 75 minutes. To extract cytoplasmic membrane proteins from the crude outer membranes, the whole fraction was resuspended in 2% sarkosyl (Sigma) and incubated at room temperature for 20 minutes. The suspension was centrifuged at 10000 g for 10 minutes to remove aggregates, and the supernatant further ultracentrifuged at 50000 g for 75 minutes to pellet the outer membranes. The outer membranes were resuspended in 10 mM Tris-HCl, pH8 and the protein concentration measured by the Bio-Rad Protein assay, using BSA as a standard.

Whole Extracts Preparation

Bacteria were grown overnight on a GC plate, harvested with a loop and resuspended in 1 ml of 20 mM Tris-HCl. Heat inactivation was performed at 56° C. for 30' minutes.

Western Blotting

Purified proteins (500 ng/lane), outer membrane vesicles (5 μg) and total cell extracts (25 μl) derived from MenB strain 2996 were loaded onto a 12% SDS-polyacrylamide gel and transferred to a nitrocellulose membrane. The transfer was performed for 2 hours at 150 mA at 4° C., using transfer buffer (0.3% Tris base, 1.44% glycine, 20% (v/v) methanol). The membrane was saturated by overnight incubation at 4° C. in saturation buffer (10% skimmed milk, 0.1% TRITON X100™ in PBS). The membrane was washed twice with washing buffer (3% skimmed milk, 0.1% TRITON X100™ in PBS) and incubated for 2 hours at 37° C. with mice sera diluted 1:200 in washing buffer. The membrane was washed twice and incubated for 90 minutes with a 1:2000 dilution of horseradish peroxidase labeled anti-mouse Ig. The membrane was washed twice with 0.1% TRITON X100™ in PBS and developed with the OPTI-4CN SUBSTRATE KIT™ (Bio-Rad). The reaction was stopped by adding water.

Bactericidal Assay

MC58 and 2996 strains were grown overnight at 37° C. on chocolate agar plates. 5-7 colonies were collected and used to inoculate 7 ml Mueller-Hinton broth. The suspension was incubated at 37° C. on a nutator and let to grow until $OD_{620}$ was in between 0.5-0.8. The culture was aliquoted into sterile 1.5 ml Eppendorf tubes and centrifuged for 20 minutes at maximum speed in a microfuge. The pellet was washed once in Gey's buffer (Gibco) and resuspended in the same buffer to an $OD_{620}$ of 0.5, diluted 1:20000 in Gey's buffer and stored at 25° C.

50 μl of Gey's buffer/1% BSA was added to each well of a 96-well tissue culture plate. 25 μl of diluted (1:100) mice sera (dilution buffer: Gey's buffer/0.2% BSA) were added to each well and the plate incubated at 4° C. 25 μl of the previously described bacterial suspension were added to each well. 25 μl of either heat-inactivated (56° C. water bath for 30 minutes) or normal baby rabbit complement were added to each well. Immediately after the addition of the baby rabbit complement, 22 μl of each sample/well were plated on Mueller-Hinton agar plates (time 0). The 96-well plate was incubated for 1 hour at 37° C. with rotation and then 22 μl of each sample/well were plated on Mueller-Hinton agar plates (time 1). After overnight incubation the colonies corresponding to time 0 and time 1 h were counted.

Gene Variability

The ORF4 and 919 genes were amplified by PCR on chromosomal DNA extracted from various *Neisseria* strains (see list of strains). The following oligonucleotides used as PCR primers were designed in the upstream and downstream regions of the genes:

```
                              (SEQ ID NO: 3266)
orf 4.1 (forward) CGAATCCGGACGGCAGGACTC

                              (SEQ ID NO: 3267)
orf 4.3 (reverse) GGCAGGGAATGGCGGATTAAAG

                              (SEQ ID NO: 3268)
919.1 (forward) AAAATGCCTCTCCACGGCTG
or

                              (SEQ ID NO: 3269)
CTGCGCCCTGTGTTAAAATCCCCT

                              (SEQ ID NO: 3270)
919.6 (reverse) CAAATAAGAAAGGAATTTTG
or

                              (SEQ ID NO: 3271)
GGTATCGCAAAACTTCGCCTTAATGCG
```

The PCR cycling conditions were:

| | |
|---|---|
| 1 cycle | 2 min. at 94° |
| 30 cycles | 30 sec. at 94° |
| | 30 sec. at ~54° or ~60° (in according to Tm of the primers) |
| | 40 sec. at 72° |
| 1 cycle | 7 min. at 72° |

The PCR products were purified from 1% agarose gel and sequenced using the following primers:

```
                                        (SEQ ID NO: 3272)
orf 4.1    (forward)   CGAATCCGGACGGCAGGACTC

                                        (SEQ ID NO: 3273)
orf 4.2    (forward)   CGACCGCGCCTTTGGGACTG

                                        (SEQ ID NO: 3274)
orf 4.3    (reverse)   GGCAGGGAATGGCGGATTAAAG

                                        (SEQ ID NO: 3275)
orf 4.4    (reverse)   TCTTTGAGTTTGATCCAACC

                                        (SEQ ID NO: 3276)
919.1      (forward)   AAAATGCCTCTCCACGGCTG
or

                                        (SEQ ID NO: 3277)
                       CTGCGCCCTGTGTTAAAATCCCCT

                                        (SEQ ID NO: 3278)
919.2      (forward)   ATCCTTCCGCCTCGGCTGCG

                                        (SEQ ID NO: 3279)
919.3      (forward)   AAAACAGCGGCACAATCGAC

                                        (SEQ ID NO: 3280)
919.4      (forward)   ATAAGGGCTACCTCAAACTC

                                        (SEQ ID NO: 3281)
919.5      (forward)   GCGCGTGGATTATTTTTGGG

                                        (SEQ ID NO: 3282)
919.6      (reverse)   CAAATAAGAAAGGAATTTTG
or

                                        (SEQ ID NO: 3283)
                       GGTATCGCAAAACTTCGCCTTAATGCG

                                        (SEQ ID NO: 3284)
919.7      (reverse)   CCCAAGGTAATGTAGTGCCG

                                        (SEQ ID NO: 3285)
919.8      (reverse)   TAAAAAAAAGTTCGACAGGG

                                        (SEQ ID NO: 3286)
919.9      (reverse)   CCGTCCGCCTGTCGTCGCCC

                                        (SEQ ID NO: 3287)
919.10     (reverse)   TCGTTCCGGCGGGGTCGGGG
```

All documents cited herein are incorporated by reference in their entireties.

The following Examples are presented to illustrate, not limit, the invention.

Example 1

Using the above-described procedures, the following oligonucleotide primers were employed in the polymerase chain reaction (PCR) assay in order to clone the ORFs as indicated:

TABLE 1

Oligonucleotides used for PCR for Examples 2-10

| ORF | Primer | Sequence | Restriction sites |
|---|---|---|---|
| 279 | Forward | CGCGGATCCCATATG-TTGCCTGCAATCACGATT <SEQ ID 3021> | BamHI-NdeI |
| | Reverse | CCCGCTCGAG-TTTAGAAGCGGGCGGCAA <SEQ ID 3022> | XhoI |
| 519 | Forward | CGCGGATCCCATATG-TTCAAATCCTTTGTCGTCA <SEQ ID 3023> | BamHI-NdeI |

TABLE 1-continued

Oligonucleotides used for PCR for Examples 2-10

| ORF | Primer | Sequence | Restriction sites |
|---|---|---|---|
| | Reverse | CCCGCTCGAG-TTTGGCGGTTTTGCTGC <SEQ ID 3024> | XhoI |
| 576 | Forward | CGCGGATCCCATATG-GCCGCCCCCGCATCT <SEQ ID 3025> | BamHI-NdeI |
| | Reverse | CCCGCTCGAG-ATTTACTTTTTTGATGTCGAC <SEQ ID 3026> | XhoI |
| 919 | Forward | CGCGGATCCCATATG-TGCCAAAGCAAGAGCATC <SEQ ID 3027> | BamHI-NdeI |
| | Reverse | CCCGCTCGAG-CGGGCGGTATTCGGG <SEQ ID 3028> | XhoI |
| 121 | Forward | CGCGGATCCCATATG-GAAACACAGCTTTACAT <SEQ ID 3029> | BamHI-NdeI |
| | Reverse | CCCGCTCGAG-ATAATAATATCCCGCGCCC <SEQ ID 3030> | XhoI |
| 128 | Forward | CGCGGATCCCATATG-ACTGACAACGCACT <SEQ ID 3031> | BamHI-NdeI |
| | Reverse | CCCGCTCGAG-GACCGCGTTGTCGAAA <SEQ ID 3032> | XhoI |
| 206 | Forward | CGCGGATCCCATATG-AAACACCGCCAACCGA <SEQ ID 3033> | BamHI-NdeI |
| | Reverse | CCCGCTCGAG-TTCTGTAAAAAAAGTATGTGC <SEQ ID 3034> | XhoI |
| 287 | Forward | CCGGAATTCTAGCTAGC-CTTTCAGCCTGCGGG <SEQ ID 3035> | EcoRI-NheI |
| | Reverse | CCCGCTCGAG-ATCCTGCTCTTTTTTGCC <SEQ ID 3036> | XhoI |
| 406 | Forward | CGCGGATCCCATATG-TGCGGGACACTGACAG <SEQ ID 3037> | BamHI-NdeI |
| | Reverse | CCCGCTCGAG-AGGTTGTCCTTGTCTATG <SEQ ID 3038> | XhoI |

Localization of the ORFs

The following DNA and amino acid sequences are identified by titles of the following form: [g, m, or a] [#].[seq or pep], where "g" means a sequence from *N. gonorrhoeae*, "m" means a sequence from *N. meningitidis* B, and "a" means a sequence from *N. meningitidis* A; "#" means the number of the sequence; "seq" means a DNA sequence, and "pep" means an amino acid sequence. For example, "g001.seq" refers to an *N. gonorrhoeae* DNA sequence, number 1. The presence of the suffix "-1" to these sequences indicates an additional sequence found for the same ORF, thus, data for an ORF having both an unsuffixed and a suffixed sequence designation applies to both such designated sequences. Further, open reading frames are identified as ORF #, where "#" means the number of the ORF, corresponding to the number of the sequence which encodes the ORF, and the ORF designations may be suffixed with ".ng" or ".a", indicating that the ORF corresponds to a *N. gonorrhoeae* sequence or a *N. meningitidis* A sequence, respectively. The word "partial" before a sequence indicates that the sequence may be partial or a complete ORF. Computer analysis was performed for the comparisons that follow between "g", "m", and "a" peptide sequences; and therein the "pep" suffix is implied where not expressly stated. Further, in the event of a conflict between the text immediately preceding and describing which sequences are being compared, and the designated sequences being compared, the designated sequence controls and is the actual sequence being compared ORF: contig:

279 gnm4.seq

The following partial DNA sequence was identified in *N. meningitidis* <SEQ ID 3039>:

```
m279.seq
  1 ATAACGCGGA TTTGCGGCTG CTTGATTTCA ACGGTTTTCA GGGCTTCGGC

 51 AAGTTTGTCG GCGGCGGGTT TCATCAGGCT GCAATGGGAA GGTACGGACA

101 CGGGCAGCGG CAGGGCGCGT TTGGCACCGG CTTCTTTGGC GGCAGCCATG
```

-continued

```
151 GCGCGTCCGA CGGCGGCGGC GTTGCCTGCA ATCACGATTT GTCCGGGTGA

201 GTTGAAGTTG ACGGCTTCGA CCACTTCGCT TTGGGCGGCT TCGGCACAAA

251 TGGCTTTAAC CTGCTCATCT TCCAAGCCGA GAATCGCCGC CATTGCGCCC

301 ACGCCTTGCG GTACGGCGGA CTGCATCAGT TCGGCGCGCA GGCGCACGAG

351 TTTGACCGCG TCGGCAAAAT TCAATGCGCC GGCGGCAACG AGTGCGGTGT

401 ATTCGCCGAG GCTGTGTCCG GCAACGGCGG CAGGCGTTTT GCCGCCCGCT

451 TCTAAATAG
```

This corresponds to the amino acid sequence <SEQ ID 3040; ORF 279>:

```
m279.pep
  1 ITRICGCLIS TVFRASASLS AAGFIRLQWE GTDTGSGRAR LAPASLAAAM

 51 ARPTAAALPA ITICPGELKL TASTTSLWAA SAQMALTCSS SKPRIAAIAP

101 TPCGTADCIS SARRRTSLTA SAKFNAPAAT SAVYSPRLCP ATAAGVLPPA

151 SK*
```

The following partial DNA sequence was identified in *N. gonorrhoeae* <SEQ ID 3041>:

```
g279.seq
  1 atgacgcgga tttgcggctg cttgatttca acggttttga gtgtttcggc

 51 aagtttgtcg gcggcgggtt tcatcaggct gcaatgggaa ggaacggata

101 ccggcagcgg cagggcgcgt ttggctccgg cttctttggc ggcagccatg

151 gtgcgtccga cggcggcggc gttgcctgca atcacgactt gtccgggcga

201 gttgaagttg acggcttcga ccacttcgcc ctgtgcggat tcggcacaaa

251 tctgcctgac ctgttcatct tccaaaccca aaatggccgc cattgcgcct

301 acgccttgcg gtacggcgga ctgcatcagt tcggcgcgca ggcggacgag

351 tttgacggca tcggcaaaat ccaatgcttc ggcggcgaca agcgcggtgt

401 attcgccgag gctgtgtccg gcaacggcgg caggcgtttt gccgcccact

451 tccaaatag
```

This corresponds to the amino acid sequence <SEQ ID 3042; ORF 279.ng>:

```
g279.pep
  1 MTRICGCLIS TVLSVSASLS AAGFIRLQWE GTDTGSGRAR LAPASLAAAM

 51 VRPTAAALPA ITTCPGELKL TASTTSPCAD SAQICLTCSS SKPKMAAIAP

101 TPCGTADCIS SARRRTSLTA SAKSNASAAT SAVYSPRLCP ATAAGVLPPT

151 SK*
```

ORF 279 shows 89.5% identity over a 152 aa overlap with a predicted ORF (ORF 279.ng) from *N. gonorrhoeae*:

```
                    10        20        30        40        50        60
m279.pep   ITRICGCLISTVFRASASLSAAGFIRLQWEGTDTGSGRARLAPASLAAAMARPTAAALPA
           :||||||||||: :||||||||||||||||||||||||||||||||||||:|||||||||
g279       MTRICGCLISTVLSVSASLSAAGFIRLQWEGTDTGSGRARLAPASLAAAMVRPTAAALPA
                    10        20        30        40        50        60
```

-continued

```
                70        80        90       100       110       120
m279.pep ITICPGELKLTASTTSLWAASAQMALTCSSSKPRIAAIAPTPCGTADCISSARRRTSLTA
         || |||||||||||||  | |||: ||||||||::|||||||||||||||||||||||||
g279     ITTCPGELKLTASTTSPCADSAQICLTCSSSKPKMAAIAPTPCGTADCISSARRRTSLTA
                70        80        90       100       110       120

130       140       150
m279.pep SAKFNAPAATSAVYSPRLCPATAAGVLPPASKX
         ||| || ||||||||||||||||||||||:|||
g279     SAKSNASAATSAVYSPRLCPATAAGVLPPTSKX
               130       140       150
```

The following partial DNA sequence was identified in *N. meningitidis* <SEQ ID 3043>:

```
a279.seq
  1 ATGACNCNGA TTTGCGGCTG CTTGATTTCA ACGGTTTNNA GGGCTTCGGC

51 GAGTTTGTCG GCGGCGGGTT TCATGAGGCT GCAATGGGAA GGTACNGACA

101 CNGGCAGCGG CAGGGCGCGT TTGGCGCCGG CTTCTTTGGC GGCAAGCATA

151 GCGCGCTCGA CGGCGGCGGC ATTGCCTGCA ATCACGACTT GTCCGGGCGA

201 GTTGAAGTTG ACGGCTTCAA CCACTTCATC CTGTGCGGAT TCGGCGCAAA

251 TTTGTTTTAC CTGTTCATCT TCCAAGCCGA GAATCGCCGC CATTGCGCCC

301 ACGCCTTGCG GTACGGCGGA CTGCATCAGT TCGGCGCGCA NGCGCACGAG

351 TTTGACCGCG TCGGCAAAAT CCAATGCGCC GGCGGCAACN AGTGCGGTGT

401 ATTCGCCGAN GCTGTGTCCG GCAACGGCGG CAGGCGTTTT GCCGCCCGCT

451 TCCGAATAG
```

This corresponds to the amino acid sequence <SEQ ID 3044; ORF 279.a>:

```
a279.pep
  1 MTXICGCLIS TVXRASASLS AAGFMRLQWE GTDTGSGRAR LAPASLAASI

51 ARSTAAALPA ITTCPGELKL TASTTSSCAD SAQICFTCSS SKPRIAAIAP

101 TPCGTADCIS SARXRTSLTA SAKSNAPAAT SAVYSPXLCP ATAAGVLPPA

151 SE*
``` m279/a279 ORFs 279 and 279.a showed a 88.2% identity in 152 aa overlap

```
                 10        20        30        40        50        60
m279.pep  ITRICGCLISTVFRASASLSAAGFIRLQWEGTDTGSGRARLAPASLAAAMARPTAAALPA
          :| ||||||||| |||||||||||:|||||||||||||||||||||||::|| |||||||
a279      MTXICGCLISTVXRASASLSAAGFMRLQWEGTDTGSGRARLAPASLAASIARSTAAALPA
                 10        20        30        40        50        60

70        80        90       100       110       120
m279.pep  ITICPGELKLTASTTSLWAASAQMALTCSSSKPRIAAIAPTPCGTADCISSARRRTSLTA
          || |||||||||||||  | |||: :||||||||||||||||||||||||||| ||||||
a279      ITTCPGELKLTASTTSSCADSAQICFTCSSSKPRIAAIAPTPCGTADCISSARXRTSLTA
                 70        80        90       100       110       120

130       140       150
m279.pep  SAKFNAPAATSAVYSPRLCPATAAGVLPPASKX
          ||| |||||||||||| ||||||||||||||:|
a279      SAKSNAPAATSAVYSPXLCPATAAGVLPPASEX
                130       140       150
```

519 and 519-1 gnm7.seq

The following partial DNA sequence was identified in *N. meningitidis* <SEQ ID 3045>:

```
m519.seq (partial)
  1. . . TCCGTTATCG GGCGTATGGA GTTGGACAAA ACGTTTGAAG AACGCGACGA

 51      AATCAACAGT ACTGTTGTTG CGGCTTTGGA CGAGGCGGCC GGGgCTTgGG

101      GTGTGAAGGT TTTGCGTTAT GAGATTAAAG ACTTGGTTCC GCCGCAAGAA

151      ATCCTTCGCT CAATGCAGGC GCAAATTACT GCCGAACGCG AAAAACGCGC

201      CCGTATCGCC GAATCCGAAG GTCGTAAAAT CGAACAAATC AACCTTGCCA

251      GTGGTCAGCG CGAAGCCGAA ATCCAACAAT CCGAAGGCGA GGCTCAGGCT

301      GCGGTCAATG CGTCAAATGC CGAGAAAATC GCCCGCATCA ACCGCGCCAA

351      AGGTGAAGCG GAATCCTTGC GCCTTGTTGC CGAAGCCAAT GCCGAAGCCA

401      TCCGTCAAAT TGCCGCCGCC CTTCAAACCC AAGGCGGTGC GGATGCGGTC

451      AATCTGAAGA TTGCGGAACA ATACGTCGCT GCGTTCAACA ATCTTGCCAA

501      AGAAAGCAAT ACGCTGATTA TGCCCGCCAA TGTTGCCGAC ATCGGCAGCC

551      TGATTTCTGC CGGTATGAAA ATTATCGACA GCAGCAAAAC CGCCAAaTAA
```

This corresponds to the amino acid sequence <SEQ ID 3046; ORF 519>:

```
m519.pep (partial)
  1. . . SVIGRMELDK TFEERDEINS TVVAALDEAA GAWGVKVLRY EIKDLVPPQE

 51      ILRSMQAQIT AEREKRARIA ESEGRKIEQI NLASGQREAE IQQSEGEAQA

101      AVNASNAEKI ARINRAKGEA ESLRLVAEAN AEAIRQIAAA LQTQGGADAV

151      NLKIAEQYVA AFNNLAKESN TLIMPANVAD IGSLISAGMK IIDSSKTAK*
```

The following partial DNA sequence was identified in *N. gonorrhoeae* <SEQ ID 3047>:

```
g519.seq
  1 atggaatttt tcattatctt gttggcagcc gtcgccgttt tcggcttcaa

 51 atcctttgtc gtcatccccc agcaggaagt ccacgttgtc gaaaggctcg

101 ggcgtttcca tcgcgccctg acggccggtt tgaatatttt gattcccttt

151 atcgaccgcg tcgcctaccg ccattcgctg aaagaaatcc ctttagacgt

201 acccagccag gtctgcatca cgcgcgataa tacgcaattg actgttgacg

251 gcatcatcta tttccaagta accgatccca aactcgcctc atacggttcg

301 agcaactaca ttatggcaat tacccagctt gcccaaacga cgctgcgttc

351 cgttatcggg cgtatggagt tggacaaaac gtttgaagaa cgcgacgaaa

401 tcaacagtac cgtcgtctcc gccctcgatg aagccgccgg ggcttggggt

451 gtgaaagtcc tccgttacga aatcaaggat ttggttccgc cgcaagaaat

501 ccttcgcgca atgcaggcac aaattaccgc cgaacgcgaa aaacgcgccc

551 gtattgccga atccgaaggc cgtaaaatcg aacaaatcaa ccttgccagt

601 ggtcagcgtg aagccgaaat ccaacaatcc gaaggcgagg ctcaggctgc

651 ggtcaatgcg tccaatgccg agaaaatcgc ccgcatcaac cgcgccaaag

701 gcgaagcgga atccctgcgc cttgttgccg aagccaatgc cgaagccaac

751 cgtcaaattg ccgccgccct tcaaacccaa agcggggcgg atgcggtcaa

801 tctgaagatt gcgggacaat acgttaccgc gttcaaaaat cttgccaaag

851 aagacaatac gcggattaag cccgccaagg ttgccgaaat cgggaaccct
```

-continued

```
901 aattttcggc ggcatgaaaa attttcgcca gaagcaaaaa cggccaaata

951 a
```

This corresponds to the amino acid sequence <SEQ ID 3048; ORF 519.ng>:

```
g519.pep
  1 MEFFIILLAA VAVFGFKSFV VIPQQEVHVV ERLGRFHRAL TAGLNILIPF

 51 IDRVAYRHSL KEIPLDVPSQ VCITRDNTQL TVDGIIYFQV TDPKLASYGS

101 SNYIMAITQL AQTTLRSVIG RMELDKTFEE RDEINSTVVS ALDEAAGAWG

151 VKVLRYEIKD LVPPQEILRA MQAQITAERE KRARIAESEG RKIEQINLAS

201 GQREAEIQQS EGEAQAAVNA SNAEKIARIN RAKGEAESLR LVAEANAEAN

251 RQIAAALQTQ SGADAVNLKI AGQYVTAFKN LAKEDNTRIK PAKVAEIGNP

301 NFRRHEKFSP EAKTAK*
```

ORF 519 shows 87.5% identity over a 200 aa overlap with a predicted ORF (ORF 519.ng) from *N. gonorrhoeae*:

```
m519/g519
                                                  10        20        30
m519.pep                                 SVIGRMELDKTFEERDEINSTVVAALDEAA
                                         |||||||||||||||||||||||:||||||
g519       YFQVTDPKLASYGSSNYIMAITQLAQTTLRSVIGRMELDKTFEERDEINSTVVSALDEAA
            90       100       110       120       130       140

                   40        50        60        70        80        90
m519.pep   GAWGVKVLRYEIKDLVPPQEILRSMQAQITAEREKRARIAESEGRKIEQINLASGQREAE
           |||||||||||||||||||||||:||||||||||||||||||||||||||||||||||||
g519       GAWGVKVLRYEIKDLVPPQEILRAMQAQITAEREKRARIAESEGRKIEQINLASGQREAE
            150       160       170       180       190       200

                  100       110       120       130       140       150
m519.pep   IQQSEGEAQAAVNASNAEKIARINRAKGEAESLRLVAEANAEAIRQIAAALQTQGGADAV
           ||||||||||||||||||||||||||||||||||||||||||| ||||||||||:|||||
g519       IQQSESEAQAAVNASNAEKIARINRAKGEAESLRLVAEANAEANRQIAAALQTQSGADAV
            210       220       230       240       250       260

                  160       170       180       190       200
m519.pep   NLKIAEQYVAAFNNLAKESNTLIMPANVADIGSL-ISAGMKIIDSSKTAK
           ||||| |||:||:|||||:|| | ||:||:||:  :    |:   :||||
g519       NLKIAGQYVTAFKNLAKEDNTRIKPAKVAEIGNPNFRRHEKFSPEAKTAK
            270       280       290       300       310
```

The following partial DNA sequence was identified in *N. meningitidis* <SEQ ID 3049>:

```
a519.seq
  1 ATGGAATTTT TCATTATCTT GCTGGCAGCC GTCGTTGTTT TCGGCTTCAA

 51 ATCCTTTGTT GTCATCCCAC AGCAGGAAGT CCACGTTGTC GAAAGGCTCG

101 GGCGTTTCCA TCGCGCCCTG ACGGCCGGTT TGAATATTTT GATTCCCTTT

151 ATCGACCGCG TCGCCTACCG CCATTCGCTG AAAGAAATCC CTTTAGACGT

201 ACCCAGCCAG GTCTGCATCA CGCGCGACAA TACGCAGCTG ACTGTTGACG

251 GTATCATCTA TTTCCAAGTA ACCGACCCCA AACTCGCCTC ATACGGTTCG

301 AGCAACTACA TTATGGCGAT TACCCAGCTT GCCCAAACGA CGCTGCGTTC

351 CGTTATCGGG CGTATGGAAT TGGACAAAAC GTTTGAAGAA CGCGACGAAA

401 TCAACAGCAC CGTCGTCTCC GCCCTCGATG AAGCCGCCGG AGCTTGGGGT

451 GTGAAGGTTT TGCGTTATGA GATTAAAGAC TTGGTTCCGC CGCAAGAAAT
```

-continued

```
501 CCTTCGCTCA ATGCAGGCGC AAATTACTGC TGAACGCGAA AAACGCGCCC

551 GTATCGCCGA ATCCGAAGGT CGTAAAATCG AACAAATCAA CCTTGCCAGT

601 GGTCAGCGCG AAGCCGAAAT CCAACAATCC GAAGGCGAGG CTCAGGCTGC

651 GGTCAATGCG TCAAATGCCG AGAAAATCGC CCGCATCAAC CGCGCCAAAG

701 GTGAAGCGGA ATCCTTGCGC CTTGTTGCCG AAGCCAATGC CGAAGCCATC

751 CGTCAAATTG CCGCCGCCCT TCAAACCCAA GGCGGTGCGG ATGCGGTCAA

801 TCTGAAGATT GCGGAACAAT ACGTCGCCGC GTTCAACAAT CTTGCCAAAG

851 AAAGCAATAC GCTGATTATG CCCGCCAATG TTGCCGACAT CGGCAGCCTG

901 ATTTCTGCCG GTATGAAAAT TATCGACAGC AGCAAAACCG CCAAATAA
```

This corresponds to the amino acid sequence <SEQ ID 3050; ORF 519.a>:

```
a519.pep

  1   MEFFIILLAA VVVFGFKSFV VIPQQEVHVV ERLGRFHRAL TAGLNILIPF

 51   IDRVAYRHSL KEIPLDVPSQ VCITRDNTQL TVDGIIYFQV TDPKLASYGS

101   SNYIMAITQL AQTTLRSVIG RMELDKTFEE RDEINSTVVS ALDEAAGAWG

151   VKVLRYEIKD LVPPQEILRS MQAQITAERE KRARIAESEG RKIEQINLAS

201   GQREAEIQQS EGEAQAAVNA SNAEKIARIN RAKGEAESLR LVAEANAEAI

251   RQIAAALQTQ GGADAVNLKI AEQYVAAFNN LAKESNTLIM PANVADIGSL

301   ISAGMKIIDS SKTAK*
```

```
m519/a519 ORFs 519 and 519.a showed a 99.5% identity in 199 aa overlap

                                                  10        20        30
m519.pep                                SVIGRMELDKTFEERDEINSTVVAALDEAA
                                        ||||||||||||||||||||||:|||||||
a519      YFQVTDPKLASYGSSNYIMAITQLAQTTLRSVIGRMELDKTFEERDEINSTVVSALDEAA
            90       100       110       120       130       140

                 40        50        60        70        80        90
m519.pep  GAWGVKVLRYEIKDLVPPQEILRSMQAQITAEREKRARIAESEGRKIEQINLASGQREAE
          ||||||||||||||||||||||||||||||||||||||||||||||||||||||||||||
a519      GAWGVKVLRYEIKDLVPPQEILRSMQAQITAEREKRARIAESEGRKIEQINLASGQREAE
           150       160       170       180       190       200

                100       110       120       130       140       150
m519.pep  IQQSEGEAQAAVNASNAEKIARINRAKGEAESLRLVAEANAEAIRQIAAALQTQGGADAV
          ||||||||||||||||||||||||||||||||||||||||||||||||||||||||||||
a519      IQQSEGEAQAAVNASNAEKIARINRAKGEAESLRLVAEANAEAIRQIAAALQTQGGADAV
           210       220       230       240       250       260

                160       170       180       190       200
m519.pep  NLKIAEQYVAAFNNLAKESNTLIMPANVADIGSLISAGMKIIDSSKTAKX
          ||||||||||||||||||||||||||||||||||||||||||||||||||
a519      NLKIAEQYVAAFNNLAKESNTLIMPANVADIGSLISAGMKIIDSSKTAKX
           270       280       290       300       310
```

Further work revealed the DNA sequence identified in *N. meningitidis* <SEQ ID 3051>:

```
m519-1.seq
  1 ATGGAATTTT TCATTATCTT GTTGGTAGCC GTCGCCGTTT TCGGTTTCAA

 51 ATCCTTTGTT GTCATCCCAC AACAGGAAGT CCACGTTGTC GAAAGGCTGG

101 GGCGTTTCCA TCGCGCCCTG ACGGcCGGTT TGAATATTTT GATTCCCTTT

151 ATCGACCGCG TCGCCTACCG CCATTCGCTG AAAGAAATCC CTTTAGACGT

201 ACCCAGCCAG GTCTGCATCA CGCGCGACAA TACGCAGCTG ACTGTTGACG
```

-continued

```
251 GCATCATCTA TTTCCAAGTA ACCGACCCCA AACTCGCCTC ATACGGTTCG
301 AGCAACTACA TTATGGCGAT TACCCAGCTT GCCCAAACGA CGCTGCGTTC
351 CGTTATCGGG CGTATGGAGT TGGACAAAAC GTTTGAAGAA CGCGACGAAA
401 TCAACAGTAC TGTTGTTGCG GCTTTGGACG AGGCGGCCGG GGCTTGGGGT
451 GTGAAGGTTT TGCGTTATGA GATTAAAGAC TTGGTTCCGC CGCAAGAAAT
501 CCTTCGCTCA ATGCAGGCGC AAATTACTGC CGAACGCGAA AAACGCGCCC
551 GTATCGCCGA ATCCGAAGGT CGTAAAATCG AACAAATCAA CCTTGCCAGT
601 GGTCAGCGCG AAGCCGAAAT CCAACAATCC GAAGGCGAGG CTCAGGCTGC
651 GGTCAATGCG TCAAATGCCG AGAAAATCGC CCGCATCAAC CGCGCCAAAG
701 GTGAAGCGGA ATCCTTGCGC CTTGTTGCCG AAGCCAATGC CGAAGCCATC
751 CGTCAAATTG CCGCCGCCCT TCAAACCCAA GGCGGTGCGG ATGCGGTCAA
801 TCTGAAGATT GCGGAACAAT ACGTCGCTGC GTTCAACAAT CTTGCCAAAG
851 AAAGCAATAC GCTGATTATG CCCGCCAATG TTGCCGACAT CGGCAGCCTG
901 ATTTCTGCCG GTATGAAAAT TATCGACAGC AGCAAAACCG CCAAATAA
```

This corresponds to the amino acid sequence <SEQ ID 3052; ORF 519-1>:

```
m519-1.
  1   MEFFIILLVA VAVFGFKSFV VIPQQEVHVV ERLGRFHRAL TAGLNILIPF
 51   IDRVAYRHSL KEIPLDVPSQ VCITRDNTQL TVDGIIYFQV TDPKLASYGS
101   SNYIMAITQL AQTTLRSVIG RMELDKTFEE RDEINSTVVA ALDEAAGAWG
151   VKVLRYEIKD LVPPQEILRS MQAQITAERE KRARIAESEG RKIEQINLAS
201   GQREAEIQQS EGEAQAAVNA SNAEKIARIN RAKGEAESLR LVAEANAEAI
251   RQIAAALQTQ GGADAVNLKI AEQYVAAFNN LAKESNTLIM PANVADIGSL
301   ISAGMKIIDS SKTAK*
```

The following partial DNA sequence was identified in *N. gonorrhoeae* <SEQ ID 3053>:

```
g519-1.seq
  1   ATGGAATTTT TCATTATCTT GTTGGCAGCC GTCGCCGTTT TCGGCTTCAA
 51   ATCCTTTGTC GTCATCCCCC AGCAGGAAGT CCACGTTGTC GAAAGGCTCG
101   GGCGTTTCCA TCGCGCCCTG ACGGCCGGTT TGAATATTTT GATTCCCTTT
151   ATCGACCGCG TCGCCTACCG CCATTCGCTG AAAGAAATCC CTTTAGACGT
201   ACCCAGCCAG GTCTGCATCA CGCGCGATAA TACGCAATTG ACTGTTGACG
251   GCATCATCTA TTTCCAAGTA ACCGATCCCA AACTCGCCTC ATACGGTTCG
301   AGCAACTACA TTATGGCAAT TACCCAGCTT GCCCAAACGA CGCTGCGTTC
351   CGTTATCGGG CGTATGGAGT TGGACAAAAC GTTTGAAGAA CGCGACGAAA
401   TCAACAGTAC CGTCGTCTCC GCCCTCGATG AAGCCGCCGG GGCTTGGGGT
451   GTGAAAGTCC TCCGTTACGA AATCAAGGAT TTGGTTCCGC CGCAAGAAAT
501   CCTTCGCGCA ATGCAGGCAC AAATTACCGC CGAACGCGAA AAACGCGCCC
551   GTATTGCCGA ATCCGAAGGC CGTAAAATCG AACAAATCAA CCTTGCCAGT
601   GGTCAGCGTG AAGCCGAAAT CCAACAATCC GAAGGCGAGG CTCAGGCTGC
```

-continued

```
651   GGTCAATGCG TCCAATGCCG AGAAAATCGC CCGCATCAAC CGCGCCAAAG

701   GCGAAGCGGA ATCCCTGCGC CTTGTTGCCG AAGCCAATGC CGAAGCCATC

751   CGTCAAATTG CCGCCGCCCT TCAAACCCAA GGCGGGGCGG ATGCGGTCAA

801   TCTGAAGATT GCGGAACAAT ACGTAGCCGC GTTCAACAAT CTTGCCAAAG

851   AAAGCAATAC GCTGATTATG CCCGCCAATG TTGCCGACAT CGGCAGCCTG

901   ATTTCTGCCG GCATGAAAAT TATCGACAGC AGCAAAACCG CCAAATAA
```

This corresponds to the amino acid sequence <SEQ ID 3054; ORF 519-1.ng>:

```
g519-1.pep

      1   MEFFIILLAA VAVFGFKSFV VIPQQEVHVV ERLGRFHRAL TAGLNILIPF

     51   IDRVAYRHSL KEIPLDVPSQ VCITRDNTQL TVDGIIYFQV TDPKLASYGS

    101   SNYIMAITQL AQTTLRSVIG RMELDKTFEE RDEINSTVVS ALDEAAGAWG

    151   VKVLRYEIKD LVPPQEILRA MQAQITAERE KRARIAESEG RKIEQINLAS

    201   GQREAEIQQS EGEAQAAVNA SNAEKIARIN RAKGEAESLR LVAEANAEAI

    251   RQIAAALQTQ GGADAVNLKI AEQYVAAFNN LAKESNTLIM PANVADIGSL

    301   ISAGMKIIDS SKTAK*

m519-1/g519-1 99.0% identity in 315 aa overlap

                    10        20        30        40        50        60
g519-1.pep  MEFFIILLAAVAVFGFKSFVVIPQQEVHVVERLGRFHRALTAGLNILIPFIDRVAYRHSL
            |||||||:||||||||||||||||||||||||||||||||||||||||||||||||||||
m519-1      MEFFIILLVAVAVFGFKSFVVIPQQEVHVVERLGRFHRALTAGLNILIPFIDRVAYRHSL
                    10        20        30        40        50        60

                    70        80        90       100       110       120
g519-1.pep  KEIPLDVPSQVCITRDNTQLTVDGIIYFQVTDPKLASYGSSNYIMAITQLAQTTLRSVIG
            ||||||||||||||||||||||||||||||||||||||||||||||||||||||||||||
m519-1      KEIPLDVPSQVCITRDNTQLTVDGIIYFQVTDPKLASYGSSNYIMAITQLAQTTLRSVIG
                    70        80        90       100       110       120

                   130       140       150       160       170       180
g519-1.pep  RMELDKTFEERDEINSTVVSALDEAAGAWGVKVLRYEIKDLVPPQEILRAMQAQITAERE
            |||||||||||||||||||:|||||||||||||||||||||||||||||:||||||||||
m519-1      RMELDKTFEERDEINSTVVAALDEAAGAWGVKVLRYEIKDLVPPQEILRSMQAQITAERE
                   130       140       150       160       170       180

                   190       200       210       220       230       240
g519-1.pep  KRARIAESEGRKIEQINLASGQREAEIQQSEGEAQAAVNASNAEKIARINRAKGEAESLR
            ||||||||||||||||||||||||||||||||||||||||||||||||||||||||||||
m519-1      KRARIAESEGRKIEQINLASGQREAEIQQSEGEAQAAVNASNAEKIARINRAKGEAESLR
                   190       200       210       220       230       240

                   250       260       270       280       290       300
g519-1.pep  LVAEANAEAIRQIAAALQTQGGADAVNLKIAEQYVAAFNNLAKESNTLIMPANVADIGSL
            ||||||||||||||||||||||||||||||||||||||||||||||||||||||||||||
m519-1      LVAEANAEAIRQIAAALQTQGGADAVNLKIAEQYVAAFNNLAKESNTLIMPANVADIGSL
                   250       260       270       280       290       300

                   310
g519-1.pep  ISAGMKIIDSSKTAKX
            ||||||||||||||||
m519-1      ISAGMKIIDSSKTAKX
                   310
```

The following DNA sequence was identified in *N. meningitidis* <SEQ ID 3055>:

```
a519-1.seq
     1   ATGGAATTTT TCATTATCTT GCTGGCAGCC GTCGTTGTTT TCGGCTTCAA

    51   ATCCTTTGTT GTCATCCCAC AGCAGGAAGT CCACGTTGTC GAAAGGCTCG

   101   GGCGTTTCCA TCGCGCCCTG ACGGCCGGTT TGAATATTTT GATTCCCTTT

   151   ATCGACCGCG TCGCCTACCG CCATTCGCTG AAAGAAATCC CTTTAGACGT
```

-continued

```
201   ACCCAGCCAG GTCTGCATCA CGCGCGACAA TACGCAGCTG ACTGTTGACG

251   GTATCATCTA TTTCCAAGTA ACCGACCCCA AACTCGCCTC ATACGGTTCG

301   AGCAACTACA TTATGGCGAT TACCCAGCTT GCCCAAACGA CGCTGCGTTC

351   CGTTATCGGG CGTATGGAAT TGGACAAAAC GTTTGAAGAA CGCGACGAAA

401   TCAACAGCAC CGTCGTCTCC GCCCTCGATG AAGCCGCCGG AGCTTGGGGT

451   GTGAAGGTTT TGCGTTATGA GATTAAAGAC TTGGTTCCGC CGCAAGAAAT

501   CCTTCGCTCA ATGCAGGCGC AAATTACTGC TGAACGCGAA AAACGCGCCC

551   GTATCGCCGA ATCCGAAGGT CGTAAAATCG AACAAATCAA CCTTGCCAGT

601   GGTCAGCGCG AAGCCGAAAT CCAACAATCC GAAGGCGAGG CTCAGGCTGC

651   GGTCAATGCG TCAAATGCCG AGAAAATCGC CCGCATCAAC CGCGCCAAAG

701   GTGAAGCGGA ATCCTTGCGC CTTGTTGCCG AAGCCAATGC CGAAGCCATC

751   CGTCAAATTG CCGCCGCCCT TCAAACCCAA GGCGGTGCGG ATGCGGTCAA

801   TCTGAAGATT GCGGAACAAT ACGTCGCCGC GTTCAACAAT CTTGCCAAAG

851   AAAGCAATAC GCTGATTATG CCCGCCAATG TTGCCGACAT CGGCAGCCTG

901   ATTTCTGCCG GTATGAAAAT TATCGACAGC AGCAAAACCG CCAAATAA
```

This corresponds to the amino acid sequence <SEQ ID 3056; ORF 519-1.a>:

```
a519-1.pep.

      1   MEFFIILLAA VVVFGFKSFV VIPQQEVHVV ERLGRFHRAL TAGLNILIPF

     51   IDRVAYRHSL KEIPLDVPSQ VCITRDNTQL TVDGIIYFQV TDPKLASYGS

    101   SNYIMAITQL AQTTLRSVIG RMELDKTFEE RDEINSTVVS ALDEAAGAWG

    151   VKVLRYEIKD LVPPQEILRS MQAQITAERE KRARIAESEG RKIEQINLAS

    201   GQREAEIQQS EGEAQAAVNA SNAEKIARIN RAKGEAESLR LVAEANAEAI

    251   RQIAAALQTQ GGADAVNLKI AEQYVAAFNN LAKESNTLIM PANVADIGSL

    301   ISAGMKIIDS SKTAK*
```

```
m519-1/a519-1  ORFs 519-1 and 519-1.a showed a 99.0% identity in 315 aa overlap

                      10        20        30        40        50        60
a519-1.pep    MEFFIILLAAVVVFGFKSFVVIPQQEVHVVERLGRFHRALTAGLNILIPFIDRVAYRHSL
              ||||||||:||:||||||||||||||||||||||||||||||||||||||||||||||||
m519-1        MEFFIILLVAVAVFGFKSFVVIPQQEVHVVERLGRFHRALTAGLNILIPFIDRVAYRHSL
                      10        20        30        40        50        60

                      70        80        90       100       110       120
a519-1.pep    KEIPLDVPSQVCITRDNTQLTVDGIIYFQVTDPKLASYGSSNYIMAITQLAQTTLRSVIG
              ||||||||||||||||||||||||||||||||||||||||||||||||||||||||||||
m519-1        KEIPLDVPSQVCITRDNTQLTVDGIIYFQVTDPKLASYGSSNYIMAITQLAQTTLRSVIG
                      70        80        90       100       110       120

                     130       140       150       160       170       180
a519-1.pep    RMELDKTFEERDEINSTVVSALDEAAGAWGVKVLRYEIKDLVPPQEILRSMQAQITAERE
              |||||||||||||||||||:||||||||||||||||||||||||||||||||||||||||
m519-1        RMELDKTFEERDEINSTVVAALDEAAGAWGVKVLRYEIKDLVPPQEILRSMQAQITAERE
                     130       140       150       160       170       180

                     190       200       210       220       230       240
a519-1.pep    KRARIAESEGRKIEQINLASGQREAEIQQSEGEAQAAVNASNAEKIARINRAKGEAESLR
              ||||||||||||||||||||||||||||||||||||||||||||||||||||||||||||
m519-1        KRARIAESEGRKIEQINLASGQREAEIQQSEGEAQAAVNASNAEKIARINRAKGEAESLR
                     190       200       210       220       230       240

                     250       260       270       280       290       300
a519-1.pep    LVAEANAEAIRQIAAALQTQGGADAVNLKIAEQYVAAFNNLAKESNTLIMPANVADIGSL
              ||||||||||||||||||||||||||||||||||||||||||||||||||||||||||||
m519-1        LVAEANAEAIRQIAAALQTQGGADAVNLKIAEQYVAAFNNLAKESNTLIMPANVADIGSL
                     250       260       270       280       290       300
```

-continued

```
                     310
a519-1.pep  ISAGMKIIDSSKTAKX
            ||||||||||||||||
m519-1      ISAGMKIIDSSKTAKX
                     310
```

576 and 576-1 gnm22.seq

The following partial DNA sequence was identified in *N. meningitidis* <SEQ ID 3057>:

```
m576.seq . . . (partial)
   1 . . . ATGCAGCAGG CAAGCTATGC GATGGGCGTG GACATCGGAC GCTCCCTGAA

  51       GCAAATGAAG GAACAGGGCG CGGAAATCGA TTTGAAAGTC TTTACCGAAG

 101       CCATGCAGGC AGTGTATGAC GGCAAAGAAA TCAAAATGAC CGAAGAGCAG

 151       GCTCAGGAAG TCATGATGAA ATTCCTTCAG GAACAACAGG CTAAAGCCGT

 201       AGAAAAACAC AAGGCGGACG CGAAGGCCAA TAAAGAAAAA GGCGAAGCCT

 251       TTCTGAAAGA AAATGCCGCC AAAGACGGCG TGAAGACCAC TGCTTCCGGC

 301       CTGCAATACA AAATCACCAA ACAGGGCGAA GGCAAACAGC CGACCAAAGA

 351       CGACATCGTT ACCGTGGAAT ACGAAGGCCG CCTGATTGAC GGTACGGTAT

 401       TCGACAGCAG CAAAGCCAAC GGCGGCCCGG TCACCTTCCC TTTGAGCCAA

 451       GTGATTCCGG GTTGGACCGA AGgCGTACAG CTTCTGAAAG AAGGCGGCGA

 501       AGCCACGTTC TACATCCCGT CCAACCTTGC CTACCGCGAA CAGGGTGCGG

 551       GCGACAAAAT CGGTCCGAAC GCCACTTTGG TATTTGATGT GAAACTGGTC

 601       AAAATCGGCG CACCCGAAAA CGCGCCCGCC AAGCAGCCGG CTCAAGTCGA

 651       CATCAAAAAA GTAAATTAA
```

This corresponds to the amino acid sequence <SEQ ID 3058; ORF 576>:

```
m576.pep . . . (partial)
   1 . . . MQQASYAMGV DIGRSLKQMK EQGAEIDLKV FTEAMQAVYD GKEIKMTEEQ

  51       AQEVMMKFLQ EQQAKAVEKH KADAKANKEK GEAFLKENAA KDGVKTTASG

 101       LQYKITKQGE GKQPTKDDIV TVEYEGRLID GTVFDSSKAN GGPVTFPLSQ

 151       VIPGWTEGVQ LLKEGGEATF YIPSNLAYRE QGAGDKIGPN ATLVFDVKLV

 201       KIGAPENAPA KQPAQVDIKK VN*
```

The following partial DNA sequence was identified in *N. gonorrhoeae* <SEQ ID 3059>:

```
g576.seq . . . (partial)
   1 . . . atgggcgtgg acatcggacg ctccctgaaa caaatgaagg aacagggcgc

  51       ggaaatcgat ttgaaagtct ttaccgatgc catgcaggca gtgtatgacg

 101       gcaaagaaat caaaatgacc gaagagcagg cccaggaagt gatgatgaaa

 151       ttcctgcagg agcagcaggc taaagccgta gaaaaacaca aggcggatgc

 201       gaaggccaac aaagaaaaag gcgaagcctt cctgaaggaa aatgccgccg

 251       aagacggcgt gaagaccact gcttccggtc tgcagtacaa aatcaccaaa

 301       cagggtgaag gcaaacagcc gacaaaagac gacatcgtta ccgtggaata

 351       cgaaggccgc ctgattgacg gtaccgtatt cgacagcagc aaagccaacg
```

-continued

```
401       gcggcccggc caccttccct ttgagccaag tgattccggg ttggaccgaa

451       ggcgtacggc ttctgaaaga aggcggcgaa gccacgttct acatcccgtc

501       caaccttgcc taccgcgaac agggtgcggg cgaaaaaatc ggtccgaacg

551       ccactttggt atttgacgtg aaactggtca aaatcggcgc acccgaaaac

601       gcgcccgcca agcagccgga tcaagtcgac atcaaaaaag taaattaa
```

This corresponds to the amino acid sequence <SEQ ID 3060; ORF 576.ng>:

```
g576.pep . . . (partial)
   1 . . . MGVDIGRSLK QMKEQGAEID LKVFTDAMQA VYDGKEIKMT EEQAQEVMMK

  51       FLQEQQAKAV EKHKADAKAN KEKGEAFLKE NAAEDGVKTT ASGLQYKITK

 101       QGEGKQPTKD DIVTVEYEGR LIDGTVFDSS KANGGPATFP LSQVIPGWTE

 151       GVRLLKEGGE ATFYIPSNLA YREQGAGEKI GPNATLVFDV KLVKIGAPEN

 201       APAKQPDQVD IKKVN*
```

Computer analysis of this amino acid sequence gave the following results:

Homology with a Predicted ORF from *N. gonorrhoeae*

```
m576/g576 97.2% identity in 215 aa overlap

                 10        20        30        40        50        60
m576.pep MQQASYAMGVDIGRSLKQMKEQGAEIDLKVFTEAMQAVYDGKEIKMTEEQAQEVMMKFLQ
                |||||||||||||||||||||||||:|||||||||||||||||||||||||||
g576            MGVDIGRSLKQMKEQGAEIDLKVFTDAMQAVYDGKEIKMTEEQAQEVMMKFLQ
                        10        20        30        40        50

                 70        80        90       100       110       120
m576.pep EQQAKAVEKHKADAKANKEKGEAFLKENAAKDGVKTTASGLQYKITKQGEGKQPTKDDIV
         ||||||||||||||||||||||||||||||:|||||||||||||||||||||||||||||
g576     EQQAKAVEKHKADAKANKEKGEAFLKENAAEDGVKTTASGLQYKITKQGEGKQPTKDDIV
              60        70        80        90       100       110

                130       140       150       160       170       180
m576.pep TVEYEGRLIDGTVFDSSKANGGPVTFPLSQVIPGWTEGVQLLKEGGEATFYIPSNLAYRE
         |||||||||||||||||||||||:|||||||||||||||:||||||||||||||||||||
g576     TVEYEGRLIDGTVFDSSKANGGPATFPLSQVIPGWTEGVRLLKEGGEATFYIPSNLAYRE
             120       130       140       150       160       170

                190       200       210       220
m576.pep QGAGDKIGPNATLVFDVKLVKIGAPENAPAKQPAQVDIKKVNX
         ||||:|||||||||||||||||||||||||||| |||||||||
g576     QGAGEKIGPNATLVFDVKLVKIGAPENAPAKQPDQVDIKKVNX
             180       190       200       210
```

The following partial DNA sequence was identified in *N. meningitidis* <SEQ ID 3061>:

```
a576.seq
    1   ATGAACACCA TTTTCAAAAT CAGCGCACTG ACCCTTTCCG CCGCTTTGGC

   51   ACTTTCCGCC TGCGGCAAAA AAGAAGCCGC CCCCGCATCT GCATCCGAAC

  101   CTGCCGCCGC TTCTTCCGCG CAGGGCGACA CCTCTTCGAT CGGCAGCACG

  151   ATGCAGCAGG CAAGCTATGC GATGGGCGTG GACATCGGAC GCTCCCTGAA

  201   GCAAATGAAG GAACAGGGCG CGGAAATCGA TTTGAAAGTC TTTACCGAAG

  251   CCATGCAGGC AGTGTATGAC GGCAAAGAAA TCAAAATGAC CGAAGAGCAG

  301   GCTCAGGAAG TCATGATGAA ATTCCTTCAG GAACAACAGG CTAAAGCCGT

  351   AGAAAAACAC AAGGCGGACG CGAAGGCCAA TAAAGAAAAA GGCGAAGCCT

  401   TTCTGAAAGA AATGCCGCCC AAAGACGGCG TGAAGACCAC TGCTTCCGGC
```

-continued

```
451   CTGCAATACA AAATCACCAA ACAGGGCGAA GGCAAACAGC CGACCAAAGA

501   CGACATCGTT ACCGTGGAAT ACGAAGGCCG CCTGATTGAC GGTACGGTAT

551   TCGACAGCAG CAAAGCCAAC GGCGGCCCGG TCACCTTCCC TTTGAGCCAA

601   GTGATTCTGG GTTGGACCGA AGGCGTACAG CTTCTGAAAG AAGGCGGCGA

651   AGCCACGTTC TACATCCCGT CCAACCTTGC CTACCGCGAA CAGGGTGCGG

701   GCGACAAAAT CGGCCCGAAC GCCACTTTGG TATTTGATGT GAAACTGGTC

751   AAAATCGGCG CACCCGAAAA CGCGCCCGCC AAGCAGCCGG CTCAAGTCGA

801   CATCAAAAAA GTAAATTAA
```

This corresponds to the amino acid sequence <SEQ ID 3062; ORF 576.a>:

```
a576.pep
      1  MNTIFKISAL TLSAALALSA CGKKEAAPAS ASEPAAASSA QGDTSSIGST

     51  MQQASYAMGV DIGRSLKQMK EQGAEIDLKV FTEAMQAVYD GKEIKMTEEQ

    101  AQEVMMKFLQ EQQAKAVEKH KADAKANKEK GEAFLKENAA KDGVKTTASG

    151  LQYKITKQGE GKQPTKDDIV TVEYEGRLID GTVFDSSKAN GGPVTFPLSQ

    201  VILGWTEGVQ LLKEGGEATF YIPSNLAYRE QGAGDKIGPN ATLVFDVKLV

    251  KIGAPENAPA KQPAQVDIKK VN*
```

```
m576/a576   99.5% identity in 222 aa overlap

                                            10        20        30
m576.pep                              MQQASYAMGVDIGRSLKQMKEQGAEIDLKV
                                      ||||||||||||||||||||||||||||||
a576      CGKKEAAPASASEPAAASSAQGDTSSIGSTMQQASYAMGVDIGRSLKQMKEQGAEIDLKV
                30        40        50        60        70        80

                40        50        60        70        80        90
m576.pep  FTEAMQAVYDGKEIKMTEEQAQEVMMKFLQEQQAKAVEKHKADAKANKEKGEAFLKENAA
          ||||||||||||||||||||||||||||||||||||||||||||||||||||||||||||
a576      FTEAMQAVYDGKEIKMTEEQAQEVMMKFLQEQQAKAVEKHKADAKANKEKGEAFLKENAA
                90       100       110       120       130       140

               100       110       120       130       140       150
m576.pep  KDGVKITASGLQYKITKQGEGKQPTKDDIVTVEYEGRLIDGTVFDSSKANGGPVTFPLSQ
          ||||||||||||||||||||||||||||||||||||||||||||||||||||||||||||
a576      KDGVKITASGLQYKITKQGEGKQPTKDDIVTVEYEGRLIDGTVFDSSKANGGPVTFPLSQ
               150       160       170       180       190       200

               160       170       180       190       200       210
m576.pep  VIPGWTEGVQLLKEGGEATFYIPSNLAYREQGAGDKIGPNATLVFDVKLVKIGAPENAPA
          || |||||||||||||||||||||||||||||||||||||||||||||||||||||||||
a576      VILGWTEGVQLLKEGGEATFYIPSNLAYREQGAGDKIGPNATLVFDVKLVKIGAPENAPA
               210       220       230       240       250       260

               220
m576.pep  KQPAQVDIKKVNX
          |||||||||||||
a576      KQPAQVDIKKVNX
               270
```

The following partial DNA sequence was identified in *N. meningitidis* <SEQ ID 3063>:

```
m576-1.seq
  1   ATGAACACCA TTTTCAAAAT CAGCGCACTG ACCCTTTCCG CCGCTTTGGC

 51   ACTTTCCGCC TGCGGCAAAA AAGAAGCCGC CCCCGCATCT GCATCCGAAC

101   CTGCCGCCGC TTCTTCCGCG CAGGGCGACA CCTCTTCGAT CGGCAGCACG

151   ATGCAGCAGG CAAGCTATGC GATGGGCGTG GACATCGGAC GCTCCCTGAA
```

-continued

```
201  GCAAATGAAG GAACAGGGCG CGGAAATCGA TTTGAAAGTC TTTACCGAAG

251  CCATGCAGGC AGTGTATGAC GGCAAAGAAA TCAAAATGAC CGAAGAGCAG

301  GCTCAGGAAG TCATGATGAA ATTCCTTCAG GAACAACAGG CTAAAGCCGT

351  AGAAAAACAC AAGGCGGACG CGAAGGCCAA TAAAGAAAAA GGCGAAGCCT

401  TTCTGAAAGA AAATGCCGCC AAAGACGGCG TGAAGACCAC TGCTTCCGGC

451  CTGCAATACA AAATCACCAA ACAGGGCGAA GGCAAACAGC CGACCAAAGA

501  CGACATCGTT ACCGTGGAAT ACGAAGGCCG CCTGATTGAC GGTACGGTAT

551  TCGACAGCAG CAAAGCCAAC GGCGGCCCGG TCACCTTCCC TTTGAGCCAA

601  GTGATTCCGG GTTGGACCGA AGGCGTACAG CTTCTGAAAG AAGGCGGCGA

651  AGCCACGTTC TACATCCCGT CCAACCTTGC CTACCGCGAA CAGGGTGCGG

701  GCGACAAAAT CGGTCCGAAC GCCACTTTGG TATTTGATGT GAAACTGGTC

751  AAAATCGGCG CACCCGAAAA CGCGCCCGCC AAGCAGCCGG CTCAAGTCGA

801  CATCAAAAAA GTAAATTAA
```

This corresponds to the amino acid sequence <SEQ ID 3064; ORF 576-1>:

```
m576-1.pep.
  1  MNTIFKISAL TLSAALALSA CGKKEAAPAS ASEPAAASSA QGDTSSIGST

 51  MQQASYAMGV DIGRSLKQMK EQGAEIDLKV FTEAMQAVYD GKEIKMTEEQ

101  AQEVMMKFLQ EQQAKAVEKH KADAKANKEK GEAFLKENAA KDGVKTTASG

151  LQYKITKQGE GKQPTKDDIV TVEYEGRLID GTVFDSSKAN GGPVTFPLSQ

201  VIPGWTEGVQ LLKEGGEATF YIPSNLAYRE QGAGDKIGPN ATLVFDVKLV

251  KIGAPENAPA KQPAQVDIKK VN*
```

The following partial DNA sequence was identified in *N. gonorrhoeae* <SEQ ID 3065>:

```
g576-1.seq
  1  ATGAACACCA TTTTCAAAAT CAGCGCACTG ACCCTTTCCG CCGCTTTGGC

 51  ACTTTCCGCC TGCGGCAAAA AAGAAGCCGC CCCCGCATCT GCATCCGAAC

101  CTGCCGCCGC TTCTGCCGCG CAGGGCGACA CCTCTTCAAT CGGCAGCACG

151  ATGCAGCAGG CAAGCTATGC AATGGGCGTG GACATCGGAC GCTCCCTGAA

201  ACAAATGAAG GAACAGGGCG CGGAAATCGA TTTGAAAGTC TTTACCGATG

251  CCATGCAGGC AGTGTATGAC GGCAAAGAAA TCAAAATGAC CGAAGAGCAG

301  GCCCAGGAAG TGATGATGAA ATTCCTGCAG GAGCAGCAGG CTAAAGCCGT

351  AGAAAAACAC AAGGCGGATG CGAAGGCCAA CAAAGAAAAA GGCGAAGCCT

401  TCCTGAAGGA AAATGCCGCC AAAGACGGCG TGAAGACCAC TGCTTCCGGT

451  CTGCAGTACA AAATCACCAA ACAGGGTGAA GGCAAACAGC CGACAAAAGA

501  CGACATCGTT ACCGTGGAAT ACGAAGGCCG CCTGATTGAC GGTACCGTAT

551  TCGACAGCAG CAAAGCCAAC GGCGGCCCGG CCACCTTCCC TTTGAGCCAA

601  GTGATTCCGG GTTGGACCGA AGGCGTACGG CTTCTGAAAG AAGGCGGCGA

651  AGCCACGTTC TACATCCCGT CCAACCTTGC CTACCGCGAA CAGGGTGCGG

701  GCGAAAAAAT CGGTCCGAAC GCCACTTTGG TATTTGACGT GAAACTGGTC
```

-continued

```
751   AAAATCGGCG CACCCGAAAA CGCGCCCGCC AAGCAGCCGG ATCAAGTCGA

801   CATCAAAAAA GTAAATTAA
```

This corresponds to the amino acid sequence <SEQ ID 3066; ORF 576-1.ng>:

```
g576-1.pep

      1  MNTIFKISAL TLSAALALSA CGKKEAAPAS ASEPAAASAA QGDTSSIGST

     51  MQQASYAMGV DIGRSLKQMK EQGAEIDLKV FTDAMQAVYD GKEIKMTEEQ

    101  AQEVMMKFLQ EQQAKAVEKH KADAKANKEK GEAFLKENAA KDGVKTTASG

    151  LQYKITKQGE GKQPTKDDIV TVEYEGRLID GTVFDSSKAN GGPATFPLSQ

    201  VIPGWTEGVR LLKEGGEATF YIPSNLAYRE QGAGEKIGPN ATLVFDVKLV

    251  KIGAPENAPA KQPDQVDIKK VN*
```

g576-1/m576-1 ORFa 576-1 and 567-1.a showed a 97.8% identity in 272 aa overlap

```
                    10        20        30        40        50        60
g576-1.pep MNTIFKISALTLSAALALSACGKKEAAPASASEPAAASAAQGDTSSIGSTMQQASYAMGV
           ||||||||||||||||||||||||||||||||||||||:|||||||||||||||||||||
m576-1     MNTIFKISALTLSAALALSACGKKEAAPASASEPAAASSAQGDTSSIGSTMQQASYAMGV
                    10        20        30        40        50        60

                    70        80        90       100       110       120
g576-1.pep DIGRSLKQMKEQGAEIDLKVFTDAMQAVYDGKEIKMTEEQAQEVMMKFLQEQQAKAVEKH
           ||||||||||||||||||||||:|||||||||||||||||||||||||||||||||||||
m576-1     DIGRSLKQMKEQGAEIDLKVFTEAMQAVYDGKEIKMTEEQAQEVMMKFLQEQQAKAVEKH
                    70        80        90       100       110       120

                   130       140       150       160       170       180
g576-1.pep KADAKANKEKGEAFLKENAAKDGVKTTASGLQYKITKQGEGKQPTKDDIVTVEYEGRLID
           ||||||||||||||||||||||||||||||||||||||||||||||||||||||||||||
m576-1     KADAKANKEKGEAFLKENAAKDGVKTTASGLQYKITKQGEGKQPTKDDIVTVEYEGRLID
                   130       140       150       160       170       180

                   190       200       210       220       230       240
g576-1.pep GTVFDSSKANGGPATFPLSQVIPGWTEGVRLLKEGGEATFYIPSNLAYREQGAGEKIGPN
           |||||||||||||:|||||||||||||||:||||||||||||||||||||||||:|||||
m576-1     GTVFDSSKANGGPVTFPLSQVIPGWTEGVQLLKEGGEATFYIPSNLAYREQGAGDKIGPN
                   190       200       210       220       230       240

                   250       260       270
g576-1.pep ATLVFDVKLVKIGAPENAPAKQPDQVDIKKVNX
           ||||||||||||||||||||||| |||||||||
m576-1     ATLVFDVKLVKIGAPENAPAKQPAQVDIKKVNX
                   250       260       270
```

The following DNA sequence was identified in *N. meningitidis* <SEQ ID 3067>:

```
a576-1.seq
     1  ATGAACACCA TTTTCAAAAT CAGCGCACTG ACCCTTTCCG CCGCTTTGGC

    51  ACTTTCCGCC TGCGGCAAAA AAGAAGCCGC CCCCGCATCT GCATCCGAAC

   101  CTGCCGCCGC TTCTTCCGCG CAGGGCGACA CCTCTTCGAT CGGCAGCACG

   151  ATGCAGCAGG CAAGCTATGC GATGGGCGTG GACATCGGAC GCTCCCTGAA

   201  GCAAATGAAG GAACAGGGCG CGGAAATCGA TTTGAAAGTC TTTACCGAAG

   251  CCATGCAGGC AGTGTATGAC GGCAAAGAAA TCAAAATGAC CGAAGAGCAG

   301  GCTCAGGAAG TCATGATGAA ATTCCTTCAG GAACAACAGG CTAAAGCCGT

   351  AGAAAAACAC AAGGCGGACG CGAAGGCCAA TAAAGAAAAA GGCGAAGCCT

   401  TTCTGAAAGA AAATGCCGCC AAAGACGGCG TGAAGACCAC TGCTTCCGGC

   451  CTGCAATACA AAATCACCAA ACAGGGCGAA GGCAAACAGC CGACCAAAGA

   501  CGACATCGTT ACCGTGGAAT ACGAAGGCCG CCTGATTGAC GGTACGGTAT

   551  TCGACAGCAG CAAAGCCAAC GGCGGCCCGG TCACCTTCCC TTTGAGCCAA
```

-continued

```
601  GTGATTCTGG GTTGGACCGA AGGCGTACAG CTTCTGAAAG AAGGCGGCGA

651  AGCCACGTTC TACATCCCGT CCAACCTTGC CTACCGCGAA CAGGGTGCGG

701  GCGACAAAAT CGGCCCGAAC GCCACTTTGG TATTTGATGT GAAACTGGTC

751  AAAATCGGCG CACCCGAAAA CGCGCCCGCC AAGCAGCCGG CTCAAGTCGA

801  CATCAAAAAA GTAAATTAA
```

This corresponds to the amino acid sequence <SEQ ID 3068; ORF 576-1.a>:

```
a576-1.pep
      1  MNTIFKISAL TLSAALALSA CGKKEAAPAS ASEPAAASSA QGDTSSIGST

     51  MQQASYAMGV DIGRSLKQMK EQGAEIDLKV FTEAMQAVYD GKEIKMTEEQ

    101  AQEVMMKFLQ EQQAKAVEKH KADAKANKEK GEAFLKENAA KDGVKTTASG

    151  LQYKITKQGE GKQPTKDDIV TVEYEGRLID GTVFDSSKAN GGPVTFPLSQ

    201  VIPGWTEGVQ LLKEGGEATF YIPSNLAYRE QGAGDKIGPN ATLVFDVKLV

    251  KIGAPENAPA KQPAQVDIKK VN*

a576-1/m576-1 99.6% identity in 272 aa overlap

                    10        20        30        40        50        60
a576-1.pep  MNTIFKISALTLSAALALSACGKKEAAPASASEPAAASSAQGDTSSIGSTMQQASYAMGV
            ||||||||||||||||||||||||||||||||||||||||||||||||||||||||||||
m576-1      MNTIFKISALTLSAALALSACGKKEAAPASASEPAAASSAQGDTSSIGSTMQQASYAMGV
                    10        20        30        40        50        60

                    70        80        90       100       110       120
a576-1.pep  DIGRSLKQMKEQGAEIDLKVFTEAMQAVYDGKEIKMTEEQAQEVMMKFLQEQQAKAVEKH
            ||||||||||||||||||||||||||||||||||||||||||||||||||||||||||||
m576-1      DIGRSLKQMKEQGAEIDLKVFTEAMQAVYDGKEIKMTEEQAQEVMMKFLQEQQAKAVEKH
                    70        80        90       100       110       120

                   130       140       150       160       170       180
a576-1.pep  KADAKANKEKGEAFLKENAAKDGVKTTASGLQYKITKQGEGKQPTKDDIVTVEYEGRLID
            ||||||||||||||||||||||||||||||||||||||||||||||||||||||||||||
m576-1      KADAKANKEKGEAFLKENAAKDGVKTTASGLQYKITKQGEGKQPTKDDIVTVEYEGRLID
                   130       140       150       160       170       180

                   190       200       210       220       230       240
a576-1.pep  GTVFDSSKANGGPVTFPLSQVILGWTEGVQLLKEGGEATFYIPSNLAYREQGAGDKIGPN
            |||||||||||||||||||||| |||||||||||||||||||||||||||||||||||||
m576-1      GTVFDSSKANGGPVTFPLSQVIPGWTEGVQLLKEGGEATFYIPSNLAYREQGAGDKIGPN
                   190       200       210       220       230       240

                   250       260       270
a576-1.pep  ATLVFDVKLVKIGAPENAPAKQPAQVDIKKVNX
            |||||||||||||||||||||||||||||||||
m576-1      ATLVFDVKLVKIGAPENAPAKQPAQVDIKKVNX
                   250       260       270
```

919 gnm43.seq

The following partial DNA sequence was identified in *N. meningitidis* <SEQ ID 3069>:

```
m919.seq
  1  ATGAAAAAAT ACCTATTCCG CGCCGCCCTG TACGGCATCG CCGCCGCCAT

 51  CCTCGCCGCC TGCCAAAGCA AGAGCATCCA AACCTTTCCG CAACCCGACA

101  CATCCGTCAT CAACGGCCCG GACCGGCCGG TCGGCATCCC CGACCCCGCC

151  GGAACGACGG TCGGCGGCGG CGGGGCCGTC TATACCGTTG TACCGCACCT

201  GTCCCTGCCC CACTGGGCGG CGCAGGATTT CGCCAAAAGC CTGCAATCCT

251  TCCGCCTCGG CTGCGCCAAT TTGAAAAACC GCCAAGGCTG GCAGGATGTG

301  TGCGCCCAAG CCTTTCAAAC CCCCGTCCAT TCCTTTCAGG CAAAACAGTT

351  TTTTGAACGC TATTTCACGC CGTGGCAGGT TGCAGGCAAC GGAAGCCTTG
```

-continued

```
 401  CCGGTACGGT TACCGGCTAT TACGAACCGG TGCTGAAGGG CGACGACAGG

 451  CGGACGGCAC AAGCCCGCTT CCCGATTTAC GGTATTCCCG ACGATTTTAT

 501  CTCCGTCCCC CTGCCTGCCG GTTTGCGGAG CGGAAAAGCC CTTGTCCGCA

 551  TCAGGCAGAC GGGAAAAAAC AGCGGCACAA TCGACAATAC CGGCGGCACA

 601  CATACCGCCG ACCTCTCCcG ATTCCCCATC ACCGCGCGCA CAACAGCAAT

 651  CAAAGGCAGG TTTGAAGGAA GCCGCTTCCT CCCCTACCAC ACGCGCAACC

 701  AAATCAACGG CGGCGCGCTT GACGGCAAAG CCCCGATACT CGGTTACGCC

 751  GAAGACCCTG TCGAACTTTT TTTTATGCAC ATCCAAGGCT CGGGCCGTCT

 801  GAAAACCCCG TCCGGCAAAT ACATCCGCAT CGGCTATGCC GACAAAAACG

 851  AACATCCyTA CGTTTCCATC GGACGCTATA TGGCGGATAA GGGCTACCTC

 901  AAACTCGGAC AAACCTCCAT GCAGGGCATT AAGTCTTATA TGCGGCAAAA

 951  TCCGCAACGC CTCGCCGAAG TTTTGGGTCA AAACCCCAGC TATATCTTTT

1001  TCCGCGAGCT TGCCGGAAGC AGCAATGACG GCCCTGTCGG CGCACTGGGC

1051  ACGCCGCTGA TGGGGGAATA TGCCGGCGCA GTCGACCGGC ACTACATTAC

1101  CTTGGGTGCG CCCTTATTTG TCGCCACCGC CCATCCGGTT ACCCGCAAAG

1151  CCCTCAACCG CCTGATTATG GCGCAGGATA CCGGCAGCGC GATTAAAGGC

1201  GCGGTGCGCG TGGATTATTT TTGGGGATAC GGCGACGAAG CCGGCGAACT

1251  TGCCGGCAAA CAGAAAACCA CGGGATATGT CTGGCAGCTC CTACCCAACG

1301  GTATGAAGCC CGAATACCGc CCGTAA
```

This corresponds to the amino acid sequence <SEQ ID 3070; ORF 919>:

```
m919.pep
   1  MKKYLFRAAL YGIAAAILAA CQSKSIQTFP QPDTSVINGP DRPVGIPDPA

  51  GTTVGGGGAV YTVVPHLSLP HWAAQDFAKS LQSFRLGCAN LKNRQGWQDV

 101  CAQAFQTPVH SFQAKQFFER YFTPWQVAGN GSLAGTVTGY YEPVLKGDDR

 151  RTAQARFPIY GIPDDFISVP LPAGLRSGKA LVRIRQTGKN SGTIDNTGGT

 201  HTADLSRFPI TARTTAIKGR FEGSRFLPYH TRNQINGGAL DGKAPILGYA

 251  EDPVELFFMH IQGSGRLKTP SGKYIRIGYA DKNEHPYVSI GRYMADKGYL

 301  KLGQTSMQGI KSYMRQNPQR LAEVLGQNPS YIFFRELAGS SNDGPVGALG

 351  TPLMGEYAGA VDRHYITLGA PLFVATAHPV TRKALNRLIM AQDTGSAIKG

 401  AVRVDYFWGY GDEAGELAGK QKTTGYVWQL LPNGMKPEYR P*
```

The following partial DNA sequence was identified in *N. gonorrhoeae* <SEQ ID 3071>:

```
g919.seq
   1  ATGAAAAAAC ACCTGCTCCG CTCCGCCCTG TACGGcatCG CCGCCgccAT

  51  CctcgCCGCC TGCCAAAgca gGAGCATCCA AACCTTTCCG CAACCCGACA

 101  CATCCGTCAT CAACGGCCCG GACCGGCCGG CCGGCATCCC CGACCCCGCC

 151  GGAACGACGG TTGCCGGCGG CGGGGCCGTC TATACCGTTG TGCCGCACCT

 201  GTCCATGCCC CACTGGGCGG CGCaggATTT TGCCAAAAGC CTGCAATCCT

 251  TCCGCCTCGG CTGCGCCAAT TTGAAAAACC GCCAAGGCTG GCAGGATGTG
```

-continued

```
 301 TGCGCCCAAG CCTTTCAAAC CCCCGTGCAT TCCTTTCAGG CAAAGcGgTT
 351 TTTTGAACGC TATTTCACGC cgtGGCaggt tgcaggcaAC GGAAGcCTTG
 401 Caggtacggt TACCGGCTAT TACGAACCGG TGCTGAAGGG CGACGGCAGG
 451 CGGACGGAAC GGGCCCGCTT CCCGATTTAC GGTATTCCCG ACGATTTTAT
 501 CTCCGTCCCG CTGCCTGCCG GTTTGCGGGG CGGAAAAAAC CTTGTCCGCA
 551 TCAGGCAGac ggGGAAAAAC AGCGGCACGA TCGACAATGC CGGCGGCACG
 601 CATACCGCCG ACCTCTCCCG ATTCCCCATC ACCGCGCGCA CAACGGcaat
 651 caaaGGCAGG TTTGAaggAA GCCGCTTCCT CCCTTACCAC ACGCGCAACC
 701 AAAtcaacGG CGGCgcgcTT GACGGCAAag cccCCATCCT CggttacgcC
 751 GAagaccCcG tcgaactttT TTTCATGCAC AtccaaggCT CGGGCCGCCT
 801 GAAAACCCcg tccggcaaat acatCCGCAt cggaTacgcc gacAAAAACG
 851 AACAtccgTa tgtttccatc ggACGctaTA TGGCGGACAA AGGCTACCTC
 901 AAGctcgggc agACCTCGAT GCAGGgcatc aaagcCTATA TGCGGCAAAA
 951 TCCGCAACGC CTCGCCGAAG TTTTGGGTCA AAACCCCAGC TATATCTTTT
1001 TCCGCGAGCT TGCCGGAAGC GGCAATGAGG GCCCCGTCGG CGCACTGGGC
1051 ACGCCACTGA TGGGGGAATA CGCCGGCGCA ATCGACCGGC ACTACATTAC
1101 CTTGGGCGCG CCCTTATTTG TCGCCACCGC CCATCCGGTT ACCCGCAAAG
1151 CCCTCAACCG CCTGATTATG GCGCAGGATA CAGGCAGCGC GATCAAAGGC
1201 GCGGTGCGCG TGGATTATTT TTGGGGTTAC GGCGACGAAG CCGGCGAACT
1251 TGCCGGCAAA CAGAAAACCA CGGGATACGT CTGGCAGCTC CTGCCCAACG
1301 GCATGAAGCC CGAATACCGC CCGTGA
```

This corresponds to the amino acid sequence <SEQ ID 3072; ORF 919.ng>:

```
g919.pep
   1 MKKHLLRSAL YGIAAAILAA CQSRSIQTFP QPDTSVINGP DRPAGIPDPA
  51 GTTVAGGGAV YTVVPHLSMP HWAAQDFAKS LQSFRLGCAN LKNRQGWQDV
 101 CAQAFQTPVH SFQAKRFFER YFTPWQVAGN GSLAGTVTGY YEPVLKGDGR
 151 RTERARFPIY GIPDDFISVP LPAGLRGGKN LVRIRQTGKN SGTIDNAGGT
 201 HTADLSRFPI TARTTAIKGR FEGSRFLPYH TRNQINGGAL DGKAPILGYA
 251 EDPVELFFMH IQGSGRLKTP SGKYIRIGYA DKNEHPYVSI GRYMADKGYL
 301 KLGQTSMQGI KAYMRQNPQR LAEVLGQNPS YIFFRELAGS GNEGPVGALG
 351 TPLMGEYAGA IDRHYITLGA PLFVATAHPV TRKALNRLIM AQDTGSAIKG
 401 AVRVDYFWGY GDEAGELAGK QKTTGYVWQL LPNGMKPEYR P*
```

ORF 919 shows 95.9% identity over a 441 aa overlap with a predicted ORF (ORF 919.ng) from *N. gonorrhoeae*:

```
m919/g919

                   10        20        30        40        50        60
m919.pep   MKKYLFRAALYGIAAAILAACQSKSIQTFPQPDTSVINGPDRPVGIPDPAGTTVGGGGAV
           |||:|:|:|||||||||||||||:|||||||||||||||||||:||||||||||:|||||
g919       MKKHLLRSALYGIAAAILAACQSRSIQTFPQPDTSVINGPDRPAGIPDPAGTTVAGGGAV
                   10        20        30        40        50        60
```

-continued

```
                70        80        90       100       110       120
m919.pep YTVVPHLSLPHWAAQDFAKSLQSFRLGCANLKNRQGWQDVCAQAFQTPVHSFQAKQFFER
         ||||||||:||||||||||||||||||||||||||||||||||||||||||||||:||||
g919     YTVVPHLSMPHWAAQDFAKSLQSFRLGCANLKNRQGWQDVCAQAFQTPVHSFQAKRFFER
                70        80        90       100       110       120

               130       140       150       160       170       180
m919.pep YFTPWQVAGNGSLAGTVTGYYEPVLKGDDRRTAQARFPIYGIPDDFISVPLPAGLRSGKA
         |||||||||||||||||||||||||||| ||| :||||||||||||||||||||||:||
g919     YFTPWQVAGNGSLAGTVTGYYEPVLKGDGRRTERARFPIYGIPDDFISVPLPAGLRGGKN
               130       140       150       160       170       180

               190       200       210       220       230       240
m919.pep LVRIRQTGKNSGTIDNTGGTHTADLSRFPITARTTAIKGRFEGSRFLPYHTRNQINGGAL
         ||||||||||||||||:|||||||||||||||||||||||||||||||||||||||||||
g919     LVRIRQTGKNSGTIDNAGGTHTADLSRFPITARTTAIKGRFEGSRFLPYHTRNQINGGAL
               190       200       210       220       230       240

               250       260       270       280       290       300
m919.pep DGKAPILGYAEDPVELFFMHIQGSGRLKTPSGKYIRIGYADKNEHPYVSIGRYMADKGYL
         ||||||||||||||||||||||||||||||||||||||||||||||||||||||||||||
g919     DGKAPILGYAEDPVELFFMHIQGSGRLKTPSGKYIRIGYADKNEHPYVSIGRYMADKGYL
               250       260       270       280       290       300

               310       320       330       340       350       360
m919.pep KLGQTSMQGIKSYMRQNPQRLAEVLGQNPSYIFFRELAGSSNDGPVGALGTPLMGEYAGA
         |||||||||||:||||||||||||||||||||||||||||||:|:|||||||||||||||
g919     KLGQTSMQGIKAYMRQNPQRLAEVLGQNPSYIFFRELAGSGNEGPVGALGTPLMGEYAGA
               310       320       330       340       350       360

               370       380       390       400       410       420
m919.pep VDRHYITLGAPLFVATAHPVTRKALNRLIMAQDTGSAIKGAVRVDYFWGYGDEAGELAGK
         :|||||||||||||||||||||||||||||||||||||||||||||||||||||||||||
g919     IDRHYITLGAPLFVATAHPVTRKALNRLIMAQDTGSAIKGAVRVDYFWGYGDEAGELAGK
               370       380       390       400       410       420

               430       440
m919.pep QKTTGYVWQLLPNGMKPEYRPX
         ||||||||||||||||||||||
g919     QKTTGYVWQLLPNGMKPEYRPX
               430       440
```

The following partial DNA sequence was identified in *N. meningitidis* <SEQ ID 3073>:

```
a919.seq
     1  ATGAAAAAAT ACCTATTCCG CGCCGCCCTG TGCGGCATCG CCGCCGCCAT

    51  CCTCGCCGCC TGCCAAAGCA AGAGCATCCA AACCTTTCCG CAACCCGACA

   101  CATCCGTCAT CAACGGCCCG GACCGGCCGG TCGGCATCCC CGACCCCGCC

   151  GGAACGACGG TCGGCGGCGG CGGGGCCGTT TATACCGTTG TGCCGCACCT

   201  GTCCCTGCCC CACTGGGCGG CGCAGGATTT CGCCAAAAGC CTGCAATCCT

   251  TCCGCCTCGG CTGCGCCAAT TTGAAAAACC GCCAAGGCTG GCAGGATGTG

   301  TGCGCCCAAG CCTTTCAAAC CCCCGTCCAT TCCGTTCAGG CAAAACAGTT

   351  TTTTGAACGC TATTTCACGC CGTGGCAGGT TGCAGGCAAC GGAAGCCTTG

   401  CCGGTACGGT TACCGGCTAT TACGAGCCGG TGCTGAAGGG CGACGACAGG

   451  CGGACGGCAC AAGCCCGCTT CCCGATTTAC GGTATTCCCG ACGATTTTAT

   501  CTCCGTCCCC CTGCCTGCCG GTTTGCGGAG CGGAAAAGCC CTTGTCCGCA

   551  TCAGGCAGAC GGGAAAAAAC AGCGGCACAA TCGACAATAC CGGCGGCACA

   601  CATACCGCCG ACCTCTCCCA ATTCCCCATC ACTGCGCGCA CAACGGCAAT

   651  CAAAGGCAGG TTTGAAGGAA GCCGCTTCCT CCCCTACCAC ACGCGCAACC

   701  AAATCAACGG CGGCGCGCTT GACGGCAAAG CCCCGATACT CGGTTACGCC

   751  GAAGACCCCG TCGAACTTTT TTTTATGCAC ATCCAAGGCT CGGGCCGTCT

   801  GAAAACCCCG TCCGGCAAAT ACATCCGCAT CGGCTATGCC GACAAAAACG

   851  AACATCCCTA CGTTTCCATC GGACGCTATA TGGCGGACAA AGGCTACCTC

   901  AAGCTCGGGC AGACCTCGAT GCAGGGCATC AAAGCCTATA TGCAGCAAAA
```

-continued

```
 951  CCCGCAACGC CTCGCCGAAG TTTTGGGGCA AAACCCCAGC TATATCTTTT

1001  TCCGAGAGCT TACCGGAAGC AGCAATGACG GCCCTGTCGG CGCACTGGGC

1051  ACGCCGCTGA TGGGCGAGTA CGCCGGCGCA GTCGACCGGC ACTACATTAC

1101  CTTGGGCGCG CCCTTATTTG TCGCCACCGC CCATCCGGTT ACCCGCAAAG

1151  CCCTCAACCG CCTGATTATG GCGCAGGATA CCGGCAGCGC GATTAAAGGC

1201  GCGGTGCGCG TGGATTATTT TTGGGGATAC GGCGACGAAG CCGGCGAACT

1251  TGCCGGCAAA CAGAAAACCA CGGGATATGT CTGGCAGCTT CTGCCCAACG

1301  GTATGAAGCC CGAATACCGC CCGTAA
```

This corresponds to the amino acid sequence <SEQ ID 3074; ORF 919.a>:

```
a919.pep
   1  MKKYLFRAAL CGIAAAILAA CQSKSIQTFP QPDTSVINGP DRPVGIPDPA

  51  GTTVGGGGAV YTVVPHLSLP HWAAQDFAKS LQSFRLGCAN LKNRQGWQDV

 101  CAQAFQTPVH SVQAKQFFER YFTPWQVAGN GSLAGTVTGY YEPVLKGDDR

 151  RTAQARFPIY GIPDDFISVP LPAGLRSGKA LVRIRQTGKN SGTIDNTGGT

 201  HTADLSQFPI TARTTAIKGR FEGSRFLPYH TRNQINGGAL DGKAPILGYA

 251  EDPVELFFMH IQGSGRLKTP SGKYIRIGYA DKNEHPYVSI GRYMADKGYL

 301  KLGQTSMQGI KAYMQQNPQR LAEVLGQNPS YIFFRELTGS SNDGPVGALG

 351  TPLMGEYAGA VDRHYITLGA PLFVATAHPV TRKALNRLIM AQDTGSAIKG

 401  AVRVDYFWGY GDEAGELAGK QKTTGYVWQL LPNGMKPEYR P*
```

m919/a919 98.6% identity in 441 aa overlap

```
                    10        20        30        40        50        60
m919.pep    MKKYLFRAALYGIAAAILAACQSKSIQTFPQPDTSVINGPDRPVGIPDPAGTTVGGGGAV
            |||||||||| |||||||||||||||||||||||||||||||||||||||||||||||||
a919        MKKYLFRAALCGIAAAILAACQSKSIQTFPQPDTSVINGPDRPVGIPDPAGTTVGGGGAV
                    10        20        30        40        50        60

                    70        80        90       100       110       120
m919.pep    YTVVPHLSLPHWAAQDFAKSLQSFRLGCANLKNRQGWQDVCAQAFQTPVHSFQAKQFFER
            ||||||||||||||||||||||||||||||||||||||||||||||||||| ||||||||
a919        YTVVPHLSLPHWAAQDFAKSLQSFRLGCANLKNRQGWQDVCAQAFQTPVHSVQAKQFFER
                    70        80        90       100       110       120

                   130       140       150       160       170       180
m919.pep    YFTPWQVAGNGSLAGTVTGYYEPVLKGDDRRTAQARFPIYGIPDDFISVPLPAGLRSGKA
            ||||||||||||||||||||||||||||||||||||||||||||||||||||||||||||
a919        YFTPWQVAGNGSLAGTVTGYYEPVLKGDDRRTAQARFPIYGIPDDFISVPLPAGLRSGKA
                   130       140       150       160       170       180

                   190       200       210       220       230       240
m919.pep    LVRIRQTGKNSGTIDNTGGTHTADLSRFPITARTTAIKGRFEGSRFLPYHTRNQINGGAL
            ||||||||||||||||||||||||||:|||||||||||||||||||||||||||||||||
a919        LVRIRQTGKNSGTIDNTGGTHTADLSQFPITARTTAIKGRFEGSRFLPYHTRNQINGGAL
                   190       200       210       220       230       240

                   250       260       270       280       290       300
m919.pep    DGKAPILGYAEDPVELFFMHIQGSGRLKTPSGKYIRIGYADKNEHPYVSIGRYMADKGYL
            ||||||||||||||||||||||||||||||||||||||||||||||||||||||||||||
a919        DGKAPILGYAEDPVELFFMHIQGSGRLKTPSGKYIRIGYADKNEHPYVSIGRYMADKGYL
                   250       260       270       280       290       300

                   310       320       330       340       350       360
m919.pep    KLGQTSMQGIKSYMRQNPQRLAEVLGQNPSYIFFRELAGSSNDGPVGALGTPLMGEYAGA
            |||||||||||:||:||||||||||||||||||||||:||||||||||||||||||||||
a919        KLGQTSMQGIKAYMQQNPQRLAEVLGQNPSYIFFRELTGSSNDGPVGALGTPLMGEYAGA
                   310       320       330       340       350       360
```

-continued

```
                 370       380       390       400       410       420
m919.pep   VDRHYITLGAPLFVATAHPVTRKALNRLIMAQDTGSAIKGAVRVDYFWGYGDEAGELAGK
           ||||||||||||||||||||||||||||||||||||||||||||||||||||||||||||
a919       VDRHYITLGAPLFVATAHPVTRKALNRLIMAQDTGSAIKGAVRVDYFWGYGDEAGELAGK
                 370       380       390       400       410       420

                 430       440
m919.pep   QKTTGYVWQLLPNGMKPEYRPX
           ||||||||||||||||||||||
a919       QKTTGYVWQLLPNGMKPEYRPX
           430     440
```

121 and 121-1

The following partial DNA sequence was identified in *N. meningitidis* <SEQ ID 3075>:

```
m121.seq
   1  ATGGAAACAC AGCTTTACAT CGGCATCATG TCGGGAACCA GCATGGACGG

  51  GGCGGATGCC GTACTGATAC GGATGGACGG CGGCAAATGG CTGGGCGCGG

 101  AAGGGCACGC CTTTACCCCC TACCCCGGCA GGTTACGCCG CCAATTGCTG

 151  GATTTGCAGG ACACAGGCGC AGACGAACTG CACCGCAGCA GGATTTTGTC

 201  GCAAGAACTC AGCCGCCTAT ATGCGCAAAC CGCCGCCGAA CTGCTGTGCA

 251  GTCAAAACCT CGCACCGTCC GACATTACCG CCCTCGGCTG CCACGGGCAA

 301  ACCGTCCGAC ACGCGCCGGA ACACGGTTAC AGCATACAGC TTGCCGATTT

 351  GCCGCTGCTG GCGxxxxxxx xxxxxxxxxx xxxxxxxxxx xxxxxxxxxx

 401  xxxxxxxxxx xxxxxxxxxx xxxxxxxxxx xxxxxxxxxx xxxxxxxxxx

 451  xxxxxxxxxx xxxxxxxxxx xxxxxxxxxx xxxxxxxxxx xxxxxxxxxx

 501  xxxxxxxxxx xxxxxxxxxx xxxxxxxxxx xxxxxxxxxx xxxxxxxxxx

 551  xxxxxxxxxx xxxxxxxxxx xxxxxxxxxx xxxxxxxxxx xxxxxxxxxx

 601  xxxxxxCAGC TTCCTTACGA CAAAAACGGT GCAAAGTCGG CACAAGGCAA

 651  CATATTGCCG CAACTGCTCG ACAGGCTGCT CGCCCACCCG TATTTCGCAC

 701  AACGCCACCC TAAAAGCACG GGGCGCGAAC TGTTTGCCAT AAATTGGCTC

 751  GAAACCTACC TTGACGGCGG CGAAAACCGA TACGACGTAT TGCGGACGCT

 801  TTCCCGTTTT ACCGCGCAAA CCGTTTGCGA CGCCGTCTCA CACGCAGCGG

 851  CAGATGCCCG TCAAATGTAC ATTTGCGACG GCGGCATCCG CAATCCTGTT

 901  TTAATGGCGG ATTTGGCAGA ATGTTTCGGC ACACGCGTTT CCCTGCACAG

 951  CACCGCCGAC CTGAACCTCG ATCCGCAATG GGTGGAAGCC GCCGnATTTG

1001  CGTGGTTGGC GGCGTGTTGG ATTAATCGCA TTCCCGGTAG TCCGCACAAA

1051  GCAACCGGCG CATCCAAACC GTGTATTCTG AnCGCGGGAT ATTATTATTG

1101  A
```

This corresponds to the amino acid sequence <SEQ ID 3076; ORF 121>:

```
m121.pep
   1  METQLYIGIM SGTSMDGADA VLIRMDGGKW LGAEGHAFTP YPGRLRRQLL

  51  DLQDTGADEL HRSRILSQEL SRLYAQTAAE LLCSQNLAPS DITALGCHGQ

 101  TVRHAPEHGY SIQLADLPLL Axxxxxxxxx xxxxxxxxxx xxxxxxxxxx

 151  xxxxxxxxxx xxxxxxxxxx xxxxxxxxxx xxxxxxxxxx xxxxxxxxxx
```

-continued

```
201  xxQLPYDKNG AKSAQGNILP QLLDRLLAHP YFAQRHPKST GRELFAINWL

251  ETYLDGGENR YDVLRTLSRF TAQTVCDAVS HAAADARQMY ICDGGIRNPV

301  LMADLAECFG TRVSLHSTAD LNLDPQWVEA AXFAWLAACW INRIPGSPHK

351  ATGASKPCIL XAGYYY*
```

The following partial DNA sequence was identified in *N. gonorrhoeae* <SEQ ID 3077>:

```
g121.seq
   1  ATGGAAACAC AGCTTTACAT CGGCATTATG TCGGGAACCA GTATGGACGG

  51  GGCGGATGCC GTGCTGGTAC GGATGGACGG CGGCAAATGG CTGGGCGCGG

 101  AAGGGCACGC CTTTACCCCC TACCCTGACC GGTTGCGCCG CAAATTGCTG

 151  GATTTGCAGG ACACAGGCAC AGACGAACTG CACCGCAGCA GGATGTTGTC

 201  GCAAGAACTC AGCCGCCTGT ACGCGCAAAC CGCCGCCGAA CTGCTGTGCA

 251  GTCAAAACCT CGCTCCGTGC GACATTACCG CCCTCGGCTG CCACGGGCAA

 301  ACCGTCCGAC ACGCGCCGGA ACACGGTtac AGCATACAGC TTGCCGATTT

 351  GCCGCTGCTG GCGGAACTGa cgcggatttT TACCGTCggc gacttcCGCA

 401  GCCGCGACCT TGCTGCCGGC GGacaAGGTG CGCCGCTCGT CCCCGCCTTT

 451  CACGAAGCCC TGTTCCGCGA TGACAGGGAA ACACGCGTGG TACTGAACAT

 501  CGGCGGGATT GCCAACATCA GCGTACTCCC CCCCGGCGCA CCCGCCTTCG

 551  GCTTCGACAC AGGGCCGGGC AATATGCTGA TGGAcgcgtg gacgcaggca

 601  cacTGGcagc TGCCTTACGA CAAAAacggt gcAAAGgcgg cacAAGGCAA

 651  catatTGCcg cAACTGCTCG gcaggctGCT CGCCcaccCG TATTTCTCAC

 701  AACCCcaccc aaAAAGCACG GGgcGCGaac TgtttgcccT AAattggctc

 751  gaaacctAcc ttgacggcgg cgaaaaccga tacgacgtat tgcggacgct

 801  ttcccgattc accgcgcaaA ccgTttggga cgccgtctca CACGCAGCGG

 851  CAGATGCCCG TCAAATGTAC ATTTGCGGCG GCGGCATCCG CAATCCTGTT

 901  TTAATGGCGG ATTTGGCAGA ATGTTTCGGC ACACGCGTTT CCCTGCACAG

 951  CACCGCCGAA CTGAACCTCG ATCCTCAATG GGTGGAGGCG gccgCATTtg

1001  cgtggttggC GGCGTGTTGG ATTAACCGCA TTCCCGGTAG TCCGCACAAA

1051  GCGACCGGCG CATCCAAACC GTGTATTCTG GGCGCGGGAT ATTATTATTG

1101  A
```

This corresponds to the amino acid sequence <SEQ ID 3078; ORF 121.ng>:

```
g121.pep
   1  METQLYIGIM SGTSMDGADA VLVRMDGGKW LGAEGHAFTP YPDRLRRKLL

  51  DLQDTGTDEL HRSRMLSQEL SRLYAQTAAE LLCSQNLAPC DITALGCHGQ

 101  TVRHAPEHGY SIQLADLPLL AELTRIFTVG DFRSRDLAAG GQGAPLVPAF

 151  HEALFRDDRE TRVVLNIGGI ANISVLPPGA PAFGFDTGPG NMLMDAWTQA

 201  HWQLPYDKNG AKAAQGNILP QLLGRLLAHP YFSQPHPKST GRELFALNWL

 251  ETYLDGGENR YDVLRTLSRF TAQTVWDAVS HAAADARQMY ICGGGIRNPV
```

-continued

```
301  LMADLAECFG TRVSLHSTAE LNLDPQWVEA AAFAWLAACW INRIPGSPHK

351  ATGASKPCIL GAGYYY*
```

ORF 121 shows 73.5% identity over a 366 aa overlap with a predicted ORF (ORF121.ng) from *N. gonorrhoeae*:

```
m121/g121

                      10        20        30        40        50        60
m121.pep      METQLYIGIMSGTSMDGADAVLIRMDGGKWLGAEGHAFTPYPGRLRRQLLDLQDTGADEL
              ||||||||||||||||||||||:||||||||||||||||||| ||||:||||||||:|||
g121          METQLYIGIMSGTSMDGADAVLVRMDGGKWLGAEGHAFTPYPDRLRRKLLDLQDTGTDEL
                      10        20        30        40        50        60

                      70        80        90       100       110       120
m121.pep      HRSRILSQELSRLYAQTAAELLCSQNLAPSDITALGCHGQTVRHAPEHGYSIQLADLPLL
              ||||:||||||||||||||||||||||||| |||||||||||||||||||||||||||||
g121          HRSRMLSQELSRLYAQTAAELLCSQNLAPCDITALGCHGQTVRHAPEHGYSIQLADLPLL
                      70        80        90       100       110       120

                     130       140       150       160       170       180
m121.pep      AXXXXXXXXXXXXXXXXXXXXXXXXXXXXXXXXXXXXXXXXXXXXXXXXXXXXXXXXXXX
              |  :   :                                :
g121          AELTRIFTVGDFRSRDLAAGGQGAPLVPAFHEALFRDDRETRVVLNIGGIANISVLPPGA
                     130       140       150       160       170       180

                     190       200       210       220       230       240
m121.pep      XXXXXXXXXXXXXXXXXXXXXXQLPYDKNGAKSAQGNILPQLLDRLLAHPYFAQRHPKST
                    :          :    ||||||||||:||||||||| ||||||||:| |||||
g121          PAFGFDTGPGNMLMDAWTQAHWQLPYDKNGAKAAQGNILPQLLGRLLAHPYFSQPHPKST
                     190       200       210       220       230       240

                     250       260       270       280       290       300
m121.pep      GRELFAINWLETYLDGGENRYDVLRTLSRFTAQTVCDAVSHAAADARQMYICDGGIRNPV
              ||||||:|||||||||||||||||||||||||||| |||||||||||||||| |||||||
g121          GRELFALNWLETYLDGGENRYDVLRTLSRFTAQTVWDAVSHAAADARQMYICGGGIRNPV
                     250       260       270       280       290       300

                     310       320       330       340       350       360
m121.pep      LMADLAECFGTRVSLHSTADLNLDPQWVEAAXFAWLAACWINRIPGSPHKATGASKPCIL
              |||||||||||||||||||:||||||||||| ||||||||||||||||||||||||||||
g121          LMADLAECFGTRVSLHSTAELNLDPQWVEAAAFAWLAACWINRIPGSPHKATGASKPCIL
                     310       320       330       340       350       360

m121.pep      XAGYYYX
               ||||||
g121          GAGYYYX
```

The following partial DNA sequence was identified in *N. meningitidis* <SEQ ID 3079>:

```
a121.seq
   1  ATGGAAACAC AGCTTTACAT CGGCATCATG TCGGGAACCA GCATGGACGG

  51  GGCGGATGCC GTACTGATAC GGATGGACGG CGGCAAATGG CTGGGCGCGG

 101  AAGGGCACGC CTTTACCCCC TACCCCGGCA GGTTACGCCG CAAATTGCTG

 151  GATTTGCAGG ACACAGGCGC GGACGAACTG CACCGCAGCA GGATGTTGTC

 201  GCAAGAACTC AGCCGCCTGT ACGCGCAAAC CGCCGCCGAA CTGCTGTGCA

 251  GTCAAAACCT CGCGCCGTCC GACATTACCG CCCTCGGCTG CCACGGGCAA

 301  ACCGTCAGAC ACGCGCCGGA ACACAGTTAC AGCGTACAGC TTGCCGATTT

 351  GCCGCTGCTG GCGGAACGGA CTCAGATTTT TACCGTCGGC GACTTCCGCA

 401  GCCGCGACCT TGCGGCCGGC GGACAAGGCG CGCCGCTCGT CCCCGCCTTT

 451  CACGAAGCCC TGTTCCGCGA CGACAGGGAA ACACGCGCGG TACTGAACAT

 501  CGGCGGGATT GCCAACATCA GCGTACTCCC CCCCGACGCA CCCGCCTTCG

 551  GCTTCGACAC AGGACCGGGC AATATGCTGA TGGACGCGTG GATGCAGGCA
```

-continued

```
 601 CACTGGCAGC TTCCTTACGA CAAAAACGGT GCAAAGGCGG CACAAGGCAA

 651 CATATTGCCG CAACTGCTCG ACAGGCTGCT CGCCCACCCG TATTTCGCAC

 701 AACCCCACCC TAAAAGCACG GGGCGCGAAC TGTTTGCCCT AAATTGGCTC

 751 GAAACCTACC TTGACGGCGG CGAAAACCGA TACGACGTAT TGCGGACGCT

 801 TTCCCGATTC ACCGCGCAAA CCGTTTTCGA CGCCGTCTCA CACGCAGCGG

 851 CAGATGCCCG TCAAATGTAC ATTTGCGGCG GCGGCATCCG CAATCCTGTT

 901 TTAATGGCGG ATTTGGCAGA ATGTTTCGGC ACACGCGTTT CCCTGCACAG

 951 CACCGCCGAA CTGAACCTCG ATCCGCAATG GGTAGAAGCC GCCGCGTTCG

1001 CATGGATGGC GGCGTGTTGG GTCAACCGCA TTCCCGGTAG TCCGCACAAA

1051 GCAACCGGCG CATCCAAACC GTGTATTCTG GGCGCGGGAT ATTATTATTG

1101 A
```

This corresponds to the amino acid sequence <SEQ ID 3080; ORF 121.a>:

```
a121.pep

     1  METQLYIGIM SGTSMDGADA VLIRMDGGKW LGAEGHAFTP YPGRLRRKLL

    51  DLQDTGADEL HRSRMLSQEL SRLYAQTAAE LLCSQNLAPS DITALGCHGQ

   101  TVRHAPEHSY SVQLADLPLL AERTQIFTVG DFRSRDLAAG GQGAPLVPAF

   151  HEALFRDDRE TRAVLNIGGI ANISVLPPDA PAFGFDTGPG NMLMDAWMQA

   201  HWQLPYDKNG AKAAQGNILP QLLDRLLAHP YFAQPHPKST GRELFALNWL

   251  ETYLDGGENR YDVLRTLSRF TAQTVFDAVS HAAADARQMY ICGGGIRNPV

   301  LMADLAECFG TRVSLHSTAE LNLDPQWVEA AARAWMAACW VNRIPGSPHK

   351  ATGASKPCIL GAGYY*
```

```
m121/a121    74.0% identity in 366 aa overlap

                      10        20        30        40        50        60
m121.pep      METQLYIGIMSGTSMDGADAVLIRMDGGKWLGAEGHAFTPYPGRLRRQLLDLQDTGADEL
              ||||||||||||||||||||||||||||||||||||||||||||||||||:|||||||||
a121          METQLYIGIMSGTSMDGADAVLIRMDGGKWLGAEGHAFTPYPGRLRRKLLDLQDTGADEL
                      10        20        30        40        50        60

                      70        80        90       100       110       120
m121.pep      HRSRILSQELSRLYAQTAAELLCSQNLAPSDITALGCHGQTVRHAPEHGYSIQLADLPLL
              ||||:|||||||||||||||||||||||||||||||||||||||||||:||:||||||||
a121          HRSRMLSQELSRLYAQTAAELLCSQNLAPSDITALGCHGQTVRHAPEHSYSVQLADLPLL
                      70        80        90       100       110       120

                     130       140       150       160       170       180
m121.pep      AXXXXXXXXXXXXXXXXXXXXXXXXXXXXXXXXXXXXXXXXXXXXXXXXXXXXXXXXXXX
              |  :   :                                :
a121          AERTQIFTVGDFRSRDLAAGGQGAPLVPAFHEALFRDDRETRAVLNIGGIANISVLPPDA
                     130       140       150       160       170       180

                     190       200       210       220       230       240
m121.pep      XXXXXXXXXXXXXXXXXXXXXXQLPYDKNGAKSAQGNILPQLLDRLLAHPYFAQRHPKST
                    :               ||||||||||:||||||||||||||||||||| |||||
a121          PAFGFDTGPGNMLMDAWMQAHWQLPYDKNGAKAAQGNILPQLLDRLLAHPYFAQPHPKST
                     190       200       210       220       230       240

                     250       260       270       280       290       300
m121.pep      GRELFAINWLETYLDGGENRYDVLRTLSRFTAQTVCDAVSHAAADARQMYICDGGIRNPV
              ||||||:|||||||||||||||||||||||||||| |||||||||||||||| |||||||
a121          GRELFALNWLETYLDGGENRYDVLRTLSRFTAQTVFDAVSHAAADARQMYICGGGIRNPV
                     250       260       270       280       290       300

                     310       320       330       340       350       360
m121.pep      LMADLAECFGTRVSLHSTADLNLDPQWVEAAXFAWLAACWINRIPGSPHKATGASKPCIL
              |||||||||||||||||||:||||||||||| |||:||||:|||||||||||||||||||
a121          LMADLAECFGTRVSLHSTAELNLDPQWVEAAAFAWMAACWVNRIPGSPHKATGASKPCIL
                     310       320       330       340       350       360
```

-continued

```
m121.pep     XAGYYYX
              ||||||
a121         GAGYYYX
```

The following partial DNA sequence was identified in *N. meningitidis* <SEQ ID 3081>:

```
m121-1.seq
   1 ATGGAAACAC AGCTTTACAT CGGCATCATG TCGGGAACCA GCATGGACGG

  51 GGCGGATGCC GTACTGATAC GGATGGACGG CGGCAAATGG CTGGGCGCGG

 101 AAGGGCACGC CTTTACCCCC TACCCCGGCA GGTTACGCCG CCAATTGCTG

 151 GATTTGCAGG ACACAGGCGC AGACGAACTG CACCGCAGCA GGATTTTGTC

 201 GCAAGAACTC AGCCGCCTAT ATGCGCAAAC CGCCGCCGAA CTGCTGTGCA

 251 GTCAAAACCT CGCACCGTCC GACATTACCG CCCTCGGCTG CCACGGGCAA

 301 ACCGTCCGAC ACGCGCCGGA ACACGGTTAC AGCATACAGC TTGCCGATTT

 351 GCCGCTGCTG GCGGAACGGA CGCGGATTTT TACCGTCGGC GACTTCCGCA

 401 GCCGCGACCT TGCGGCCGGC GGACAAGGCG CGCCACTCGT CCCCGCCTTT

 451 CACGAAGCCC TGTTCCGCGA CAACAGGGAA ACACGCGCGG TACTGAACAT

 501 CGGCGGGATT GCCAACATCA GCGTACTCCC CCCCGACGCA CCCGCCTTCG

 551 GCTTCGACAC AGGGCCGGGC AATATGCTGA TGGACGCGTG GACGCAGGCA

 601 CACTGGCAGC TTCCTTACGA CAAAAACGGT GCAAAGGCGG CACAAGGCAA

 651 CATATTGCCG CAACTGCTCG ACAGGCTGCT CGCCCACCCG TATTTCGCAC

 701 AACCCCACCC TAAAAGCACG GGGCGCGAAC TGTTTGCCCT AAATTGGCTC

 751 GAAACCTACC TTGACGGCGG CGAAAACCGA TACGACGTAT TGCGGACGCT

 801 TTCCCGTTTT ACCGCGCAAA CCGTTTGCGA CGCCGTCTCA CACGCAGCGG

 851 CAGATGCCCG TCAAATGTAC ATTTGCGGCG GCGGCATCCG CAATCCTGTT

 901 TTAATGGCGG ATTTGGCAGA ATGTTTCGGC ACACGCGTTT CCCTGCACAG

 951 CACCGCCGAC CTGAACCTCG ATCCGCAATG GGTGGAAGCC GCCGNATTTG

1001 CGTGGTTGGC GGCGTGTTGG ATTAATCGCA TTCCCGGTAG TCCGCACAAA

1051 GCAACCGGCG CATCCAAACC GTGTATTCTG ANCGCGGGAT ATTATTATTG

1101 A
```

This corresponds to the amino acid sequence <SEQ ID 3082; ORF 121-1>:

```
m121-1.pep

  1 METQLYIGIM SGTSMDGADA VLIRMDGGKW LGAEGHAFTP YPGRLRRQLL

 51 DLQDTGADEL HRSRILSQEL SRLYAQTAAE LLCSQNLAPS DITALGCHGQ

101 TVRHAPEHGY SIQLADLPLL AERTRIFTVG DFRSRDLAAG GQGAPLVPAF

151 HEALFRDNRE TRAVLNIGGI ANISVLPPDA PAFGFDTGPG NMLMDAWTQA

201 HWQLPYDKNG AKAAQGNILP QLLDRLLAHP YFAQPHPKST GRELFALNWL

251 ETYLDGGENR YDVLRTLSRF TAQTVCDAVS HAAADARQMY ICGGGIRNPV

301 LMADLAECFG TRVSLHSTAD LNLDPQWVEA AXFAWLAACW INRIPGSPHK

351 ATGASKPCIL XAGYYY*
```

-continued

```
m121-1/g121 95.6% identity in 366 aa overlap

                    10        20        30        40        50        60
m121-1.pep METQLYIGIMSGTSMDGADAVLIRMDGGKWLGAEGHAFTPYPGRLRRQLLDLQDTGADEL
           ||||||||||||||||||||||:||||||||||||||||||| ||||:||||||||:|||
g121       METQLYIGIMSGTSMDGADAVLVRMDGGKWLGAEGHAFTPYPDRLRRKLLDLQDTGTDEL
                    10        20        30        40        50        60

                    70        80        90       100       110       120
m121-1.pep HRSRILSQELSRLYAQTAAELLCSQNLAPSDITALGCHGQTVRHAPEHGYSIQLADLPLL
           ||||:|||||||||||||||||||||||| ||||||||||||||||||||||||||||||
g121       HRSRMLSQELSRLYAQTAAELLCSQNLAPCDITALGCHGQTVRHAPEHGYSIQLADLPLL
                    70        80        90       100       110       120

                   130       140       150       160       170       180
m121-1.pep AERTRIFTVGDFRSRDLAAGGQGAPLVPAFHEALFRDNRETRAVLNIGGIANISVLPPDA
           || ||||||||||||||||||||||||||||||||||:||||:||||||||||||||| |
g121       AELTRIFTVGDFRSRDLAAGGQGAPLVPAFHEALFRDDRETRVVLNIGGIANISVLPPGA
                   130       140       150       160       170       180

                   190       200       210       220       230       240
m121-1.pep PAFGFDTGPGNMLMDAWTQAHWQLPYDKNGAKAAQGNILPQLLDRLLAHPYFAQPHPKST
           ||||||||||||||||||||||||||||||||||||||||||| ||||||||:|||||||
g121       PAFGFDTGPGNMLMDAWTQAHWQLPYDKNGAKAAQGNILPQLLGRLLAHPYFSQPHPKST
                   190       200       210       220       230       240

                   250       260       270       280       290       300
m121-1.pep GRELFALNWLETYLDGGENRYDVLRTLSRFTAQTVCDAVSHAAADARQMYICGGGIRNPV
           ||||||||||||||||||||||||||||||||||| ||||||||||||||||||||||||
g121       GRELFALNWLETYLDGGENRYDVLRTLSRFTAQTVWDAVSHAAADARQMYICGGGIRNPV
                   250       260       270       280       290       300

                   310       320       330       340       350       360
m121-1.pep LMADLAECGFTRVSLHSTADLNLDPQWVEAAXFAWLAACWINRIPGSPHKATGASKPCIL
           ||||||||||||||||||:|||||||||||| ||||||||||||||||||||||||||||
g121       LMADLAECGFTRVSLHSTAELNLDPQWVEAAAFAWLAACWINRIPGSPHKATGASKPCIL
                   310       320       330       340       350       360

m121-1.pep XAGYYYX
            ||||||
g121       GAGYYYX
```

The following partial DNA sequence was identified in *N. meningitidis* <SEQ ID 3083>:

```
a121-1.seq
   1  ATGGAAACAC AGCTTTACAT CGGCATCATG TCGGGAACCA GCATGGACGG

  51  GGCGGATGCC GTACTGATAC GGATGGACGG CGGCAAATGG CTGGGCGCGG

 101  AAGGGCACGC CTTTACCCCC TACCCCGGCA GGTTACGCCG CAAATTGCTG

 151  GATTTGCAGG ACACAGGCGC GGACGAACTG CACCGCAGCA GGATGTTGTC

 201  GCAAGAACTC AGCCGCCTGT ACGCGCAAAC CGCCGCCGAA CTGCTGTGCA

 251  GTCAAAACCT CGCGCCGTCC GACATTACCG CCCTCGGCTG CCACGGGCAA

 301  ACCGTCAGAC ACGCGCCGGA ACACAGTTAC AGCGTACAGC TTGCCGATTT

 351  GCCGCTGCTG GCGGAACGGA CTCAGATTTT TACCGTCGGC GACTTCCGCA

 401  GCCGCGACCT TGCGGCCGGC GGACAAGGCG CGCCGCTCGT CCCCGCCTTT

 451  CACGAAGCCC TGTTCCGCGA CGACAGGGAA ACACGCGCGG TACTGAACAT

 501  CGGCGGGATT GCCAACATCA GCGTACTCCC CCCCGACGCA CCCGCCTTCG

 551  GCTTCGACAC AGGACCGGGC AATATGCTGA TGGACGCGTG GATGCAGGCA

 601  CACTGGCAGC TTCCTTACGA CAAAAACGGT GCAAAGGCGG CACAAGGCAA

 651  CATATTGCCG CAACTGCTCG ACAGGCTGCT CGCCCACCCG TATTTCGCAC

 701  AACCCCACCC TAAAAGCACG GGGCGCGAAC TGTTTGCCCT AAATTGGCTC

 751  GAAACCTACC TTGACGGCGG CGAAAACCGA TACGACGTAT TGCGGACGCT

 801  TTCCCGATTC ACCGCGCAAA CCGTTTTCGA CGCCGTCTCA CACGCAGCGG

 851  CAGATGCCCG TCAAATGTAC ATTTGCGGCG GCGGCATCCG CAATCCTGTT

 901  TTAATGGCGG ATTTGGCAGA ATGTTTCGGC ACACGCGTTT CCCTGCACAG
```

-continued

```
 951  CACCGCCGAA CTGAACCTCG ATCCGCAATG GGTAGAAGCC GCCGCGTTCG

1001  CATGGATGGC GGCGTGTTGG GTCAACCGCA TTCCCGGTAG TCCGCACAAA

1051  GCAACCGGCG CATCCAAACC GTGTATTCTG GGCGCGGGAT ATTATTATTG

1101  A
```

This corresponds to the amino acid sequence <SEQ ID 3084; ORF 121-1.a>:

```
a121-1.pep

      1  METQLYIGIM SGTSMDGADA VLIRMDGGKW LGAEGHAFTP YPGRLRRKLL

     51  DLQDTGADEL HRSRMLSQEL SRLYAQTAAE LLCSQNLAPS DITALGCHGQ

    101  TVRHAPEHSY SVQLADLPLL AERTQIFTVG DFRSRDLAAG GQGAPLVPAF

    151  HEALFRDDRE TRAVLNIGGI ANISVLPPDA PAFGFDTGPG NMLMDAWMQA

    201  HWQLPYDKNG AKAAQGNILP QLLDRLLAHP YFAQPHPKST FRELFALNWL

    251  ETYLDGGENR YDVLRTLSRF TAWTVFDAVS HAAADARQMY ICGGGIRNPV

    301  LMADLAECFG TRVSLHSTAE LNLDPQWVEA AAFAWMAACW VNRIPGSPHK

    351  ATGASKPCIL GAGYYY*

m121-1/a121-1  96.4% identity in 366 aa overlap

                     10        20        30        40        50        60
m121-1.pep  METQLYIGIMSGTSMDGADAVLIRMDGGKWLGAEGHAFTPYPGRLRRQLLDLQDTGADEL
            ||||||||||||||||||||||||||||||||||||||||||||||||:|||||||||||
a121-1      METQLYIGIMSGTSMDGADAVLIRMDGGKWLGAEGHAFTPYPGRLRRKLLDLQDTGADEL
                     10        20        30        40        50        60

                     70        80        90       100       110       120
m121-1.pep  HRSRILSQELSRLYAQTAAELLCSQNLAPSDITALGCHGQTVRHAPEHGYSIQLADLPLL
            ||||:|||||||||||||||||||||||||||||||||||||||||||:||:||||||||
a121-1      HRSRMLSQELSRLYAQTAAELLCSQNLAPSDITALGCHGQTVRHAPEHSYSVQLADLPLL
                     70        80        90       100       110       120

                    130       140       150       160       170       180
m121-1.pep  AERTRIFTVGDFRSRDLAAGGQGAPLVPAFHEALFRDNRETRAVLNIGGIANISVLPPDA
            ||||:|||||||||||||||||||||||||||||||||:|||||||||||||||||||||
a121-1      AERTQIFTVGDFRSRDLAAGGQGAPLVPAFHEALFRDDRETRAVLNIGGIANISVLPPDA
                    130       140       150       160       170       180

                    190       200       210       220       230       240
m121-1.pep  PAFGFDTGPGNMLMDAWTQAHWQLPYDKNGAKAAQGNILPQLLDRLLAHPYFAQPHPKST
            ||||||||||||||||| ||||||||||||||||||||||||||||||||||||||||||
a121-1      PAFGFDTGPGNMLMDAWMQAHWQLPYDKNGAKAAQGNILPQLLDRLLAHPYFAQPHPKST
                    190       200       210       220       230       240

                    250       260       270       280       290       300
m121-1.pep  GRELFALNWLETYLDGGENRYDVLRTLSRFTAQTVCDAVSHAAADARQMYICGGGIRNPV
            |||||||||||||||||||||||||||||||||||| |||||||||||||||||||||||
a121-1      GRELFALNWLETYLDGGENRYDVLRTLSRFTAQTVFDAVSHAAADARQMYICGGGIRNPV
                    250       260       270       280       290       300

                    310       320       330       340       350       360
m121-1.pep  LMADLAECFGTRVSLHSTADLNLDPQWVEAAXFAWLAACWINRIPGSPHKATGASKPCIL
            ||||||||||||||||||:||||||||||| |||:||||:||||||||||||||||||||
a121-1      LMADLAECFGTRVSLHSTAELNLDPQWVEAAAFAWMAACWVNRIPGSPHKATGASKPCIL
                    310       320       330       340       350       360

m121-1.pep  XAGYYYX
             ||||||
a121-1      GAGYYYX
```

128 and 128-1

The following partial DNA sequence was identified in *N. meningitidis* <SEQ ID 3085>:

```
m128.seq (partial)
     1  ATGACTGACA ACGCACTGCT CCATTTGGGC GAAGAACCCC GTTTTGATCA

    51  AATCAAAACC GAAGACATCA AACCCGCCCT GCAAACCGCC ATCGCCGAAG

   101  CGCGCGAACA AATCGCCGCC ATCAAAGCCC AAACGCACAC CGGCTGGGCA

   151  AACACTGTCG AACCCCTGAC CGGCATCACC GAACGCGTCG GCAGGATTTG

   201  GGGCGTGGTG TCGCACCTCA ACTGCGTCGC CGACACGCCC GAACTGCGCG

   251  CCGTCTATAA CGAACTGATG CCCGAAATCA CCGTCTTCTT CACCGAAATC

   301  GGACAAGACA TCGAGCTGTA CAACCGCTTC AAAACCATCA AAAATTCCCC

   351  CGAATTCGAC ACCCTCTCCC CCGCACAAAA AACCAAACTC AACCAC

     1  TACGCCAGCG AAAAACTGCG CGAAGCCAAA TACGCGTTCA GCGAAACCGA

    51  wGTCAAAAAA TAyTTCCCyG TCGGCAAwGT ATTAAACGGA CTGTTCGCCC

   101  AAmTCAAAAA ACTmTACGGC ATCGGATTTA CCGAAAAAAC yGTCCCCGTC

   151  TGGCACAAAG ACGTGCGCTA TTkTGAATTG CAACAAAACG GCGAAmCCAT

   201  AGGCGGCGTT TATATGGATT TGTACGCACG CGAAGGCAAA CGCGGCGGCG

   251  CGTGGATGAA CGACTACAAA GGCCGCCGCC GTTTTTCAGA CGGCACGCTG

   301  CAAyTGCCCA CCGCCTACCT CGTCTGCAAC TTCGCCCCAC CCGTCGGCGG

   351  CAGGGAAGCC CGCyTGAGCC ACGACGAAAT CCTCATCCTC TTCCACGAAA

   401  CCGGACACGG GCTGCACCAC CTGCTTACCC AAGTGGACGA ACTGGGCGTA

   451  TCCGGCATCA ACGGCGTAkA ATGGGACGCG GTCGAACTGC CCAGCCAGTT

   501  TATGGAAAAT TTCGTTTGGG AATACAATGT CTTGGCACAA mTGTCAGCCC

   551  ACGAAGAAAC CGGcgTTCCC yTGCCGAAAG AACTCTTsGA CAAAwTGCTC

   601  GCCGCCAAAA ACTTCCAAsG CGGCATGTTC yTsGTCCGGC AAwTGGAGTT

   651  CGCCCTCTTT GATATGATGA TTTACAGCGA AGACGACGAA GGCCGTCTGA

   701  AAAACTGGCA ACAGGTTTTA GACAGCGTGC GCAAAAAAGT CGCCGTCATC

   751  CAGCCGCCCG AATACAACCG CTTCGCCTTG AGCTTCGGCC ACATCTTCGC

   801  AGGCGGCTAT TCCGCAGCTn ATTACAGCTA CGCGTGGGCG GAAGTATTGA

   851  GCGCGGACGC ATACGCCGCC TTTGAAGAAA GCGACGATGT CGCCGCCACA

   901  GGCAAACGCT TTTGGCAGGA AATCCTCGCC GTCGGGGnAT CGCGCAGCGG

   951  nGCAGAATCC TTCAAAGCCT TCCGCGGCCG CGAACCGAGC ATAGACGCAC

  1001  TCTTGCGCCA CAGCGGTTTC GACAACGCGG TCTGA
```

This corresponds to the amino acid sequence <SEQ ID 3086; ORF 128>:

```
m128.pep (partial)
     1 MTDNALLHLG EEPRFDQIKT EDIKPALQTA IAEAREQIAA IKAQTHTGWA

    51 NTVEPLTGIT ERVGRIWGVV SHLNCVADTP ELRAVYNELM PEITVFFTEI

   101 GQDIELYNRF KTIKNSPEFD TLSPAQKTKL NH

//

     1 YASEKLREAK YAFSETXVKK YFPVGXVLNG LFAQXKKLYG IGFTEKTVPV

    51 WHKDVRYXEL QQNGEXIGGV YMDLYAREGK RGGAWMNDYK GRRRFSDGTL
```

-continued

```
101 QLPTAYLVCN FAPPVGGREA RLSHDEILIL FHETGHGLHH LLTQVDELGV

151 SGINGVXWDA VELPSQFMEN FVWEYNVLAQ XSAHEETGVP LPKELXDKXL

201 AAKNFQXGMF XVRQXEFALF DMMIYSEDDE GRLKNWQQVL DSVRKKVAVI

251 QPPEYNRFAL SFGHIFAGGY SAAXYSYAWA EVLSADAYAA FEESDDVAAT

301 GKRFWQEILA VGXSRSGAES FKAFRGREPS IDALLRHSGF DNAV*
```

The following partial DNA sequence was identified in *N. gonorrhoeae* <SEQ ID 3087>:

```
g128.seq
   1 atgattgaca acgCActgct ccacttgggc gaagaaccCC GTTTTaatca

  51 aatccaaacc gaagACAtca AACCCGCCGT CCAAACCGCC ATCGCCGAAG

 101 CGCGCGGACA AATCGCCGCC GTCAAAGCGC AAACGCACAC CGGCTGGGCG

 151 AACACCGTCG AGCGTCTGAC CGGCATCACC GAACGCGTCG GCAGGATTTG

 201 GGGCGTCGTG TCCCATCTCA ACTCCGTCGT CGACACGCCC GAACTGCGCG

 251 CCGTCTATAA CGAACTGATG CCTGAAATCA CCGTCTTCTT CACCGAAATC

 301 GGACAAGACA TCGAACTGTA CAACCGCTTC AAAACCATCA AAAATTCCCC

 351 CGAATTTGCA ACGCTTTCCC CCGCACAAAA AACCAAGCTC GATCACGACC

 401 TGCGCGATTT CGTATTGAGC GGCGCGGAAC TGCCGCCCGA ACGGCAGGCA

 451 GAACTGGCAA AACTGCAAAC CGAAGGCGCG CAACTTTCCG CCAAATTCTC

 501 CCAAAACGTC CTAGACGCGA CCGACGCGTT CGGCATTTAC TTTGACGATG

 551 CCGCACCGCT TGCCGGCATT CCCGAAGACG CGCTCGCCAT GTTTGCCGCC

 601 GCCGCGCAAA GCGAAGGCAA AACAGGTTAC AAAATCGGCT TGCAGATTCC

 651 GCACTACCTT GCCGTTATCC AATACGCCGG CAACCGCGAA CTGCGCGAAC

 701 AAATCTACCG CGCCTACGTT ACCCGTGCCA GCGAACTTTC AAACGACGGC

 751 AAATTCGACA ACACCGCCAA CATCGACCGC ACGCTCGAAA ACGCATTGAA

 801 AACCGccaaa cTGCTCGGCT TTAAAAATTA CGCCGAATTG TCGCTGGCAA

 851 CCAAAATGGC GGACACGCCC GAACAGGTTT TAAACTTCCT GCACGACCTC

 901 GCCCGCCGCG CCAAACCCTA CGCCGAAAAA GACCTCGCCG AAGTCAAAGC

 951 CTTCGCCCGC GAACACCTCG GTCTCGCCGA CCCGCAGCCG TGGGACTTGA

1001 GCTACGCCGG CGAAAAACTG CGCGAAGCCA AATACGCATT CAGCGAAACC

1051 GAAGTCAAAA AATACTTCCC CGTCGGCAAA GTTCTGGCAG GCCTGTTCGC

1101 CCAAATCAAA AAACTCTACG GCATCGGATT CGCCGAAAAA ACCGTTCCCG

1151 TCTGGCACAA AGACGTGCGC TATTTTGAAT TGCAACAAAA CGGCAAAACC

1201 ATCGGCGGCG TTTATATGGA TTTGTACGCA CGCGAAGGCA AACGCGGCGG

1251 CGCGTGGATG AACGACtaca AAGGCCGCCG CCGCTTTGCC GACGgcacGC

1301 TGCAACTGCC CACCGCCTAC CTCGTCTGCA ACTTCGCCCC GCCCGTCGGC

1351 GGCAAAGAAG CGCGTTTAAG CCACGACGAA ATCCTCACCC TCTTCCACGA

1401 AacCGGCCAC GGACTGCACC ACCTGCTTAC CCAAGTGGAC GAACTGGGCG

1451 TGTCCGGCAT CAAcggcgtA GAATGGGACG CGGTCGAACT GCCCAGCCAG

1501 TTTATGGAAA ACTTCGTTTG GGAATACAAT GTATTGGCAC AAATGTCCGC

1551 CCACGAAGAA AccgGCGAGC CCCTGCCGAA AGAACTCTTC GACAAAATGC
```

-continued

```
1601  TcgcCGCCAA AAACTTCCAG CGCGGTATGT TCCTCGTCCG GCAAATGGAG

1651  TTCGCCCTCT TCGATATGAT GATTTACAGT GAAAGCGACG AATGCCGTCT

1701  GAAAAACTGG CAGCAGGTTT TAGACAGCGT GCGCAAAGAA GTcGCCGTCA

1751  TCCAACCGCC CGAATACAAC CGCTTCGCCA ACAGCTTCGG CCacatctTC

1801  GCcggcGGCT ATTCCGCAGG CTATTACAGC TACGCATGGG CCGAAGTCCt

1851  cAGCACCGAT GCCTACGCCG CCTTTGAAGA AAGcGACGac gtcGCCGCCA

1901  CAGGCAAACG CTTCTGGCAA GAAAtccttg ccgtcggcgg ctCCCGCAGC

1951  gcgGCGGAAT CCTTCAAAGC CTTCCGCGGA CGCGAACCGA GCATAGACGC

2001  ACTGCTGCGC CAaagcggtT TCGACAACGC gGCttgA
```

This corresponds to the amino acid sequence <SEQ ID 3088; ORF 128.ng>:

```
g128.pep
   1  MIDNALLHLG EEPRFNQIQT EDIKPAVQTA IAEARGQIAA VKAQTHTGWA

  51  NTVERLTGIT ERVGRIWGVV SHLNSVVDTP ELRAVYNELM PEITVFFTEI

 101  GQDIELYNRF KTIKNSPEFA TLSPAQKTKL DHDLRDFVLS GAELPPERQA

 151  ELAKLQTEGA QLSAKFSQNV LDATDAFGIY FDDAAPLAGI PEDALAMFAA

 201  AAQSEGKTGY KIGLQIPHYL AVIQYAGNRE LREQIYRAYV TRASELSNDG

 251  KFDNTANIDR TLENALKTAK LLGFKNYAEL SLATKMADTP EQVLNFLHDL

 301  ARRAKPYAEK DLAEVKAFAR EHLGLADPQP WDLSYAGEKL REAKYAFSET

 351  EVKKYFPVGK VLAGLFAQIK KLYGIGFAEK TVPVWHKDVR YFELQQNGKT

 401  IGGVYMDLYA REGKRGGAWM NDYKGRRRFA DGTLQLPTAY LVCNFAPPVG

 451  GKEARLSHDE ILTLFHETGH GLHHLLTQVD ELGVSGINGV EWDAVELPSQ

 501  FMENFVWEYN VLAQMSAHEE TGEPLPKELF DKMLAAKNFQ RGMFLVRQME

 551  FALFDMMIYS ESDECRLKNW QQVLDSVRKE VAVIQPPEYN RFANSFGHIF

 601  AGGYSAGYYS YAWAEVLSTD AYAAFEESDD VAATGKRFWQ EILAVGGSRS

 651  AAESFKAFRG REPSIDALLR QSGFDNAA*
```

ORF 128 shows 91.7% identity over a 475 aa overlap with a predicted ORF (ORF 128.ng) from *N. gonorrhoeae*:

```
m128/g128

                   10        20        30        40        50        60
g128.pep   MIDNALLHLGEEPRFNQIQTEDIKPAVQTAIAEARGQIAAVKAQTHTGWANTVERLTGIT
           | ||||||||||||| :||:|||||||:|||||||| ||||:||||||||||||| |||||
m128       MTDNALLHLGEEPRFDQIKTEDIKPALQTAIAEAREQIAAIKAQTHTGWANTVEPLTGIT
                   10        20        30        40        50        60

                   70        80        90       100       110       120
g128.pep   ERVGRIWGVVSHLNSVVDTPELRAVYNELMPEITVFFTEIGQDIELYNRFKTIKNSPEFA
           |||||||||||||| |:|||||||||||||||||||||||||||||||||||||||||| 
m128       ERVGRIWGVVSHLNCVADTPELRAVYNELMPEITVFFTEIGQDIELYNRFKTIKNSPEFD
                   70        80        90       100       110       120

                  130       140       150       160       170       180
g128.pep   TLSPAQKTKLDHDLRDFVLSGAELPPERQAELAKLQTEGAQLSAKFSQNVLDATDAFGIY
           ||||||||||:|
m128       TLSPAQKTKLNH
                  130
             //
```

-continued

```
                                      340       350       360
g128.pep                           YAGEKLREAKYAFSETEVKKYFPVGKVLAG
                                   ||:|||||||||||| |||||||| || |
m128                               YASEKLREAKYAFSETXVKKYFPVGXVLNG
                                           10        20        30

           370       380       390       400       410       420
g128.pep   LFAQIKKLYGIGFAEKTVPVWHKDVRYFELQQNGKTIGGVYMDLYAREGKRGGAWMNDYK
           |||| ||||||||:||||||||||||| ||||||::||||||||||||||||||||||||
m128       LFAQXKKLYGIGFTEKTVPVWHKDVRYXELQQNGEXIGGVYMDLYAREGKRGGAWMNDYK
                   40        50        60        70        80        90

           430       440       450       460       470       480
g128.pep   GRRRFADGTLQLPTAYLVCNFAPPVGGKEARLSHDEILTLFHETGHGLHHLLTQVDELGV
           |||||:|||||||||||||||||||||:|||||||||| |||||||||||||||||||||
m128       GRRRFSDGTLQLPTAYLVCNFAPPVGGREARLSHDEILILFHETGHGLHHLLTQVDELGV
                  100       110       120       130       140       150

           490       500       510       520       530       540
g128.pep   SGINGVEWDAVELPSQFMENFVWEYNVLAQMSAHEETGEPLPKELFDKMLAAKNFQRGMF
           |||||| ||||||||||||||||||||||| ||||||| |||||| || ||||||| |||
m128       SGINGVXWDAVELPSQFMENFVWEYNVLAQXSAHEETGVPLPKELXDKXLAAKNFQXGMF
                  160       170       180       190       200       210

           550       560       570       580       590       600
g128.pep   LVRQMEFALFDMMIYSESDECRLKNWQQVLDSVRKEVAVIQPPEYNRFANSFGHIFAGGY
            ||| ||||||||||||:|| |||||||||||||||:||||||||||||| ||||||||||
m128       XVRQXEFALFDMMIYSEDDEGRLKNWQQVLDSVRKKVAVIQPPEYNRFALSFGHIFAGGY
                  220       230       240       250       260       270

           610       620       630       640       650       660
g128.pep   SAGYYSYAWAEVLSTDAYAAFEESDDVAATGKRFWQEILAVGGSRSAAESFKAFRGREPS
           ||: ||||||||||:||||||||||||||||||||||||||| |||:|||||||||||||
m128       SAAXYSYAWAEVLSADAYAAFEESDDVAATGKRFWQEILAVGXSRSGAESFKAFRGREPS
                  280       290       300       310       320       330

           670       679
g128.pep   IDALLRQSGFDNAAX
           ||||||:||||||:
m128       IDALLRHSGFDNAVX
                  340
```

The following partial DNA sequence was identified in *N. meningitidis* <SEQ ID 3089>:

```
a128.seq
  1  ATGACTGACA ACGCACTGCT CCATTTGGGC GAAGAACCCC GTTTTGATCA

 51  AATCAAAACC GAAGACATCA AACCCGCCCT GCAAACCGCC ATTGCCGAAG

101  CGCGCGAACA AATCGCCGCC ATCAAAGCCC AAACGCACAC CGGCTGGGCA

151  AACACTGTCG AACCCCTGAC CGGCATCACC GAACGCGTCG GCAGGATTTG

201  GGGCGTGGTG TCGCACCTCA ACTCCGTCAC CGACACGCCC GAACTGCGCG

251  CCGCCTACAA TGAATTAATG CCCGAAATTA CCGTCTTCTT CACCGAAATC

301  GGACAAGACA TCGAGCTGTA CAACCGCTTC AAAACCATCA AAAACTCCCC

351  CGAGTTCGAC ACCCTCTCCC ACGCGCAAAA AACCAAACTC AACCACGATC

401  TGCGCGATTT CGTCCTCAGC GGCGCGGAAC TGCCGCCCGA ACAGCAGGCA

451  GAATTGGCAA AACTGCAAAC CGAAGGCGCG CAACTTTCCG CCAAATTCTC

501  CCAAAACGTC CTAGACGCGA CCGACGCGTT CGGCATTTAC TTTGACGATG

551  CCGCACCGCT TGCCGGCATT CCCGAAGACG CGCTCGCCAT GTTTGCCGCT

601  GCCGCGCAAA GCGAAGGCAA AACAGGCTAC AAAATCGGTT TGCAGATTCC

651  GCACTACCTC GCCGTCATCC AATACGCCGA CAACCGCAAA CTGCGCGAAC

701  AAATCTACCG CGCCTACGTT ACCCGCGCCA GCGAGCTTTC AGACGACGGC

751  AAATTCGACA ACACCGCCAA CATCGACCGC ACGCTCGAAA ACGCCCTGCA

801  AACCGCCAAA CTGCTCGGCT TCAAAAACTA CGCCGAATTG TCGCTGGCAA
```

-continued

```
 851 CCAAAATGGC GGACACCCCC GAACAAGTTT TAAACTTCCT GCACGACCTC

 901 GCCCGCCGCG CCAAACCCTA CGCCGAAAAA GACCTCGCCG AAGTCAAAGC

 951 CTTCGCCCGC GAAAGCCTCG GCCTCGCCGA TTTGCAACCG TGGGACTTGG

1001 GCTACGCCGG CGAAAAACTG CGCGAAGCCA AATACGCATT CAGCGAAACC

1051 GAAGTCAAAA AATACTTCCC CGTCGGCAAA GTATTAAACG GACTGTTCGC

1101 CCAAATCAAA AAACTCTACG GCATCGGATT TACCGAAAAA ACCGTCCCCG

1151 TCTGGCACAA AGACGTGCGC TATTTTGAAT TGCAACAAAA CGGCGAAACC

1201 ATAGGCGGCG TTTATATGGA TTTGTACGCA CGCGAAGGCA AACGCGGCGG

1251 CGCGTGGATG AACGACTACA AAGGCCGCCG CCGTTTTTCA GACGGCACGC

1301 TGCAACTGCC CACCGCCTAC CTCGTCTGCA ACTTCACCCC GCCCGTCGGC

1351 GGCAAAGAAG CCCGCTTGAG CCATGACGAA ATCCTCACCC TCTTCCACGA

1401 AACCGGACAC GGCCTGCACC ACCTGCTTAC CCAAGTCGAC GAACTGGGCG

1451 TATCCGGCAT CAACGGCGTA GAATGGGACG CAGTCGAACT GCCCAGTCAG

1501 TTTATGGAAA ATTTCGTTTG GGAATACAAT GTCTTGGCGC AAATGTCCGC

1551 CCACGAAGAA ACCGGCGTTC CCATGACGAA AGAACTCTTC GACAAAATGC

1601 TCGCCGCCAA AAACTTCCAA CGCGGAATGT TCCTCGTCCG CCAAATGGAG

1651 TTCGCCCTCT TTGATATGAT GATTTACAGC GAAGACGACG AAGGCCGTCT

1701 GAAAAACTGG CAACAGGTTT TAGACAGCGT GCGCAAAGAA GTCGCCGTCG

1751 TCCGACCGCC CGAATACAAC CGCTTCGCCA ACAGCTTCGG CCACATCTTC

1801 GCAGGCGGCT ATTCCGCAGG CTATTACAGC TACGCGTGGG CGGAAGTATT

1851 GAGCGCGGAC GCATACGCCG CCTTTGAAGA AAGCGACGAT GTCGCCGCCA

1901 CAGGCAAACG CTTTTGGCAG GAAATCCTCG CCGTCGGCGG ATCGCGCAGC

1951 GCGGCAGAAT CCTTCAAAGC CTTCCGCGGA CGCGAACCGA GCATAGACGC

2001 ACTCTTGCGC CACAGCGGCT TCGACAACGC GGCTTGA
```

This corresponds to the amino acid sequence <SEQ ID 3090; ORF 128.a>:

```
a128.pep
  1 MTDNALLHLG EEPRFDQIKT EDIKPALQTA IAEAREQIAA IKAQTHTGWA

 51 NTVEPLTGIT ERVGRIWGVV SHLNSVTDTP ELRAAYNELM PEITVFFTEI

101 GQDIELYNRF KTIKNSPEFD TLSHAQKTKL NHDLRDFVLS GAELPPEQQA

151 ELAKLQTEGA QLSAKFSQNV LDATDAFGIY FDDAAPLAGI PEDALAMFAA

201 AAQSEGKTGY KIGLQIPHYL AVIQYADNRK LREQIYRAYV TRASELSDDG

251 KFDNTANIDR TLENALQTAK LLGFKNYAEL SLATKMADTP EQVLNFLHDL

301 ARRAKPYAEK DLAEVKAFAR ESLGLADLQP WDLGYAGEKL REAKYAFSET

351 EVKKYFPVGK VLNGLFAQIK KLYGIGFTEK TVPVWHKDVR YFELQQNGET

401 IGGVYMDLYA REGKRGGAWM NDYKGRRRFS DGTLQLPTAY LVCNFTPPVG

451 GKEARLSHDE ILTLFHETGH GLHHLLTQVD ELGVSGINGV EWDAVELPSQ

501 FMENFVWEYN VLAQMSAHEE TGVPLPKELF DKMLAAKNFQ RGMFLVRQME

551 FALFDMMIYS EDDEGRLKNW QQVLDSVRKE VAVVRPPEYN RFANSFGHIF
```

-continued

```
601  AGGYSAGYYS YAWAEVLSAD AYAAFEESDD VAATGKRFWQ EILAVGGSRS

651  AAESFKAFRG REPSIDALLR HSGFDNAA*
```

m128/a128 66.0% identity in 677 aa overlap

```
                   10        20        30        40        50        60
m128.pep    MTDNALLHLGEEPRFDQIKTEDIKPALQTAIAEAREQIAAIKAQTHTGWANTVEPLTGIT
            ||||||||||||||||||||||||||||||||||||||||||||||||||||||||||||
a128        MTDNALLHLGEEPRFDQIKTEDIKPALQTAIAEAREQIAAIKAQTHTGWANTVEPLTGIT
                   10        20        30        40        50        60

                   70        80        90       100       110       120
m128.pep    ERVGRIWGVVSHLNCVADTPELRAVYNELMPEITVFFTEIGQDIELYNRFKTIKNSPEFD
            ||||||||||||| |:||||||:|||||||||||||||||||||||||||||||||||||
a128        ERVGRIWGVVSHLNSVTDTPELRAAYNELMPEITVFFTEIGQDIELYNRFKTIKNSPEFD
                   70        80        90       100       110       120

                  130
m128.pep    TLSPAQKTKLNH------------------------------------------------
            ||| ||||||||
a128        TLSHAQKTKLNHDLRDFVLSGAELPPEQQAELAKLQTEGAQLSAKFSQNVLDATDAFGIY
                  130       140       150       160       170       180

m128.pep    ------------------------------------------------------------

a128        FDDAAPLAGIPEDALAMFAAAAQSEGKTGYKIGLQIPHYLAVIQYADNRKLREQIYRAYV
                  190       200       210       220       230       240

m128.pep    ------------------------------------------------------------

a128        TRASELSDDGKFDNTANIDRTLENALQTAKLLGFKNYAELSLATKMADTPEQVLNFLHDL
                  250       260       270       280       290       300

                                                      140       150
m128.pep    ----------------------------------YASEKLREAKYAFSETXVKKYFPVGX
                                              ||:||||||||||||| |||||||
a128        ARRAKPYAEKDLAEVKAFARESLGLADLQPWDLGYAGEKLREAKYAFSETEVKKYFPVGK
                  310       320       330       340       350       360

          160       170       180       190       200       210
m128.pep    VLNGLFAQXKKLYGIGFTEKTVPVWHKDVRYXELQQNGEXIGGVYMDLYAREGKRGGAWM
            |||||||| |||||||||||||||||||||| |||||||:||||||||||||||||||||
a128        VLNGLFAQIKKLYGIGFTEKTVPVWHKDVRYFELQQNGETIGGVYMDLYAREGKRGGAWM
                  370       380       390       400       410       420

          220       230       240       250       260       270
m128.pep    NDYKGRRRFSDGTLQLPTAYLVCNFAPPVGGREARLSHDEILILFHETGHGLHHLLTQVD
            |||||||||||||||||||||||||:|||||:|||||||||| |||||||||||||||||
a128        NDYKGRRRFSDGTLQLPTAYLVCNFTPPVGGKEARLSHDEILTLFHETGHGLHHLLTQVD
                  420       440       450       460       470       480

          280       290       300       310       320       330
m128.pep    ELGVSGINGVXWDAVELPSQFMENFVWEYNVLAQXSAHEETGVPLPKELXDKXLAAKNFQ
            |||||||||| |||||||||||||||||||||||| |||||||||||||| || |||||||
a128        ELGVSGINGVEWDAVELPSQFMENFVWEYNVLAQMSAHEETGVPLPKELFDKMLAAKNFQ
                  490       500       510       520       530       540

          340       350       360       370       380       390
m128.pep    XGMFXVRQXEFALFDMMIYSEDDEGRLKNWQQVLDSVRKKVAVIQPPEYNRFALSFGHIF
             ||| ||| |||||||||||||||||||||||||||||:|||::||||||||| ||||||
a128        RGMFLVRQMEFALFDMMIYSEDDEGRLKNWQQVLDSVRKEVAVVRPPEYNRFANSFGHIF
                  550       560       570       580       590       600

          400       410       420       430       440       450
m128.pep    AGGYSAAXYSYAWAEVLSADAYAAFEESDDVAATGKRFWQEILAVGXSRSGAESFKAFRG
            ||||||: |||||||||||||||||||||||||||||||||||||| |||:|||||||||
a128        AGGYSAGYYSYAWAEVLSADAYAAFEESDDVAATGKRFWQEILAVGGSRSAAESFKAFRG
                  610       620       630       640       650       660

          460       470
m128.pep    REPSIDALLRHSGFDNAVX
            |||||||||||||||||:
a128        REPSIDALLRHSGFDNAAX
                  670
```

The following partial DNA sequence was identified in *N. meningitidis* <SEQ ID 3091>:

```
m128-1.seq
     1  ATGACTGACA ACGCACTGCT CCATTTGGGC GAAGAACCCC GTTTTGATCA
    51  AATCAAAACC GAAGACATCA AACCCGCCCT GCAAACCGCC ATCGCCGAAG
   101  CGCGCGAACA AATCGCCGCC ATCAAAGCCC AAACGCACAC CGGCTGGGCA
   151  AACACTGTCG AACCCCTGAC CGGCATCACC GAACGCGTCG GCAGGATTTG
   201  GGGCGTGGTG TCGCACCTCA ACTCCGTCGC CGACACGCCC GAACTGCGCG
   251  CCGTCTATAA CGAACTGATG CCCGAAATCA CCGTCTTCTT CACCGAAATC
   301  GGACAAGACA TCGAGCTGTA CAACCGCTTC AAAACCATCA AAAATTCCCC
   351  CGAATTCGAC ACCCTCTCCC CCGCACAAAA AACCAAACTC AACCACGATC
   401  TGCGCGATTT CGTCCTCAGC GGCGCGGAAC TGCCGCCCGA ACAGCAGGCA
   451  GAACTGGCAA AACTGCAAAC CGAAGGCGCG CAACTTTCCG CCAAATTCTC
   501  CCAAAACGTC CTAGACGCGA CCGACGCGTT CGGCATTTAC TTTGACGATG
   551  CCGCACCGCT TGCCGGCATT CCCGAAGACG CGCTCGCCAT GTTTGCCGCC
   601  GCCGCGCAAA GCGAAAGCAA AACAGGCTAC AAAATCGGCT TGCAGATTCC
   651  ACACTACCTC GCCGTCATCC AATACGCCGA CAACCGCGAA CTGCGCGAAC
   701  AAATCTACCG CGCCTACGTT ACCCGCGCCA GCGAACTTTC AGACGACGGC
   751  AAATTCGACA ACACCGCCAA CATCGACCGC ACGCTCGCAA ACGCCCTGCA
   801  AACCGCCAAA CTGCTCGGCT TCAAAAACTA CGCCGAATTG TCGCTGGCAA
   851  CCAAAATGGC GGACACGCCC GAACAAGTTT TAAACTTCCT GCACGACCTC
   901  GCCCGCCGCG CCAAACCCTA CGCCGAAAAA GACCTCGCCG AAGTCAAAGC
   951  CTTCGCCCGC GAAAGCCTGA ACCTCGCCGA TTTGCAACCG TGGGACTTGG
  1001  GCTACGCCAG CGAAAAACTG CGCGAAGCCA AATACGCGTT CAGCGAAACC
  1051  GAAGTCAAAA AATACTTCCC CGTCGGCAAA GTATTAAACG GACTGTTCGC
  1101  CCAAATCAAA AAACTCTACG GCATCGGATT TACCGAAAAA ACCGTCCCCG
  1151  TCTGGCACAA AGACGTGCGC TATTTTGAAT TGCAACAAAA CGGCGAAACC
  1201  ATAGGCGGCG TTTATATGGA TTTGTACGCA CGCGAAGGCA AACGCGGCGG
  1251  CGCGTGGATG AACGACTACA AAGGCCGCCG CCGTTTTTCA GACGGCACGC
  1301  TGCAACTGCC CACCGCCTAC CTCGTCTGCA ACTTCGCCCC ACCCGTCGGC
  1351  GGCAGGGAAG CCCGCCTGAG CCACGACGAA ATCCTCATCC TCTTCCACGA
  1401  AACCGGACAC GGGCTGCACC ACCTGCTTAC CCAAGTGGAC GAACTGGGCG
  1451  TATCCGGCAT CAACGGCGTA GAATGGGACG CGGTCGAACT GCCCAGCCAG
  1501  TTTATGGAAA ATTTCGTTTG GGAATACAAT GTCTTGGCAC AAATGTCAGC
  1551  CCACGAAGAA ACCGGCGTTC CCCTGCCGAA AGAACTCTTC GACAAAATGC
  1601  TCGCCGCCAA AAACTTCCAA CGCGGCATGT TCCTCGTCCG GCAAATGGAG
  1651  TTCGCCCTCT TTGATATGAT GATTTACAGC GAAGACGACG AAGGCCGTCT
  1701  GAAAAACTGG CAACAGGTTT TAGACAGCGT GCGCAAAAAA GTCGCCGTCA
  1751  TCCAGCCGCC CGAATACAAC CGCTTCGCCT TGAGCTTCGG CCACATCTTC
  1801  GCAGGCGGCT ATTCCGCAGG CTATTACAGC TACGCGTGGG CGGAAGTATT
  1851  GAGCGCGGAC GCATACGCCG CCTTTGAAGA AAGCGACGAT GTCGCCGCCA
  1901  CAGGCAAACG CTTTTGGCAG GAAATCCTCG CCGTCGGCGG ATCGCGCAGC
```

-continued

```
1951 GCGGCAGAAT CCTTCAAAGC CTTCCGCGGC CGCGAACCGA GCATAGACGC

2001 ACTCTTGCGC CACAGCGGTT TCGACAACGC GGTCTGA
```

This corresponds to the amino acid sequence <SEQ ID 3092; ORF 128-1>:

```
m128-1.pep.
   1 MTDNALLHLG EEPRFDQIKT EDIKPALQTA IAEAREQIAA IKAQTHTGWA

  51 NTVEPLTGIT ERVGRIWGVV SHLNSVADTP ELRAVYNELM PEITVFFTEI

 101 GQDIELYNRF KTIKNSPEFD TLSPAQKTKL NHDLRDFVLS GAELPPEQQA

 151 ELAKLQTEGA QLSAKFSQNV LDATDAFGIY FDDAAPLAGI PEDALAMFAA

 201 AAQSESKTGY KIGLQIPHYL AVIQYADNRE LREQIYRAYV TRASELSDDG

 251 KFDNTANIDR TLANALQTAK LLGFKNYAEL SLATKMADTP EQVLNFLHDL

 301 ARRAKPYAEK DLAEVKAFAR ESLNLADLQP WDLGYASEKL REAKYAFSET

 351 EVKKYFPVGK VLNGLFAQIK KLYGIGFTEK TVPVWHKDVR YFELQQNGET

 401 IGGVYMDLYA REGKRGGAWM NDYKGRRRFS DGTLQLPTAY LVCNFAPPVG

 451 GREARLSHDE ILILFHETGH GLHHLLTQVD ELGVSGINGV EWDAVELPSQ

 501 FMENFVWEYN VLAQMSAHEE TGVPLPKELF DKMLAAKNFQ RGMFLVRQME

 551 FALFDMMIYS EDDEGRLKNW QQVLDSVRKK VAVIQPPEYN RFALSFGHIF

 601 AGGYSAGYYS YAWAEVLSAD AYAAFEESDD VAATGKRFWQ EILAVGGSRS

 651 AAESFKAFRG REPSIDALLR HSGFDNAV*
```

The following partial DNA sequence was identified in *N. gonorrhoeae* <SEQ ID 3093>:

```
g128-1.seq (partial)
   1 ATGATTGACA ACGCACTGCT CCACTTGGGC GAAGAACCCC GTTTTAATCA

  51 AATCAAAACC GAAGACATCA AACCCGCCGT CCAAACCGCC ATCGCCGAAG

 101 CGCGCGGACA AATCGCCGCC GTCAAAGCGC AAACGCACAC CGGCTGGGCG

 151 AACACCGTCG AGCGTCTGAC CGGCATCACC GAACGCGTCG GCAGGATTTG

 201 GGGCGTCGTG TCCCATCTCA ACTCCGTCGT CGACACGCCC GAACTGCGCG

 251 CCGTCTATAA CGAACTGATG CCTGAAATCA CCGTCTTCTT CACCGAAATC

 301 GGACAAGACA TCGAACTGTA CAACCGCTTC AAAACCATCA AAAATTCCCC

 351 CGAATTTGCA ACGCTTTCCC CCGCACAAAA AACCAAGCTC GATCACGACC

 401 TGCGCGATTT CGTATTGAGC GGCGCGGAAC TGCCGCCCGA ACGGCAGGCA

 451 GAACTGGCAA AACTGCAAAC CGAAGGCGCG CAACTTTCCG CCAAATTCTC

 501 CCAAAACGTC CTAGACGCGA CCGACGCGTT CGGCATTTAC TTTGACGATG

 551 CCGCACCGCT TGCCGGCATT CCCGAAGACG CGCTCGCCAT GTTTGCCGCC

 601 GCCGCGCAAA GCGAAGGCAA AACAGGTTAC AAAATCGGCT TGCAGATTCC

 651 GCACTACCTT GCCGTTATCC AATACGCCGG CAACCGCGAA CTGCGCGAAC

 701 AAATCTACCG CGCCTACGTT ACCCGTGCCA GCGAACTTTC AAACGACGGC

 751 AAATTCGACA ACACCGCCAA CATCGACCGC ACGCTCGAAA ACGCATTGAA

 801 AACCGCCAAA CTGCTCGGCT TTAAAAATTA CGCCGAATTG TCGCTGGCAA

 851 CCAAAATGGC GGACACGCCC GAACAGGTTT TAAACTTCCT GCACGACCTC
```

-continued

```
 901  GCCCGCCGCG CCAAACCCTA CGCCGAAAAA GACCTCGCCG AAGTCAAAGC
 951  CTTCGCCCGC GAACACCTCG GTCTCGCCGA CCCGCAGCCG TGGGACTTGA
1001  GCTACGCCGG CGAAAAACTG CGCGAAGCCA AATACGCATT CAGCGAAACC
1051  GAAGTCAAAA AATACTTCCC CGTCGGCAAA GTTCTGGCAG GCCTGTTCGC
1101  CCAAATCAAA AAACTCTACG GCATCGGATT CGCCGAAAAA ACCGTTCCCG
1151  TCTGGCACAA AGACGTGCGC TATTTTGAAT TGCAACAAAA CGGCAAAACC
1201  ATCGGCGGCG TTTATATGGA TTTGTACGCA CGCGAAGGCA AACGCGGCGG
1251  CGCGTGGATG AACGACTACA AAGGCCGCCG CCGCTTTGCC GACGGCACGC
1301  TGCAACTGCC CACCGCCTAC CTCGTCTGCA ACTTCGCCCC GCCCGTCGGC
1351  GGCAAAGAAG CGCGTTTAAG CCACGACGAA ATCCTCACCC TCTTCCACGA
1401  AACCGGCCAC GGACTGCACC ACCTGCTTAC CCAAGTGGAC GAACTGGGCG
1451  TGTCCGGCAT CAACGGCGTA AAA
```

This corresponds to the amino acid sequence <SEQ ID 3094; ORF 128-1.ng>:

```
g128-1.pep (partial)

      1  MIDNALLHLG EEPRFNQIKT EDIKPAVQTA IAEARGQIAA VKAQTHTGWA
     51  NTVERLTGIT ERVGRIWGVV SHLNSVVDTP ELRAVYNELM PEITVFFTEI
    101  GQDIELYNRF KTIKNSPEFA TLSPAQKTKL DHDLRDFVLS GAELPPERQA
    151  ELAKLQTEGA QLSAKFSQNV LDATDAFGIY FDDAAPLAGI PEDALAMFAA
    201  AAQSEGKTGY KIGLQIPHYL AVIQYAGNRE LREQIYRAYV TRASELSNDG
    251  KFDNTANIDR TLENALKTAK LLGFKNYAEL SLATKMADTP EQVLNFLHDL
    301  ARRAKPYAEK DLAEVKAFAR EHLGLADPQP WDLSYAGEKL REAKYAFSET
    351  EVKKYFPVGK VLAGLFAQIK KLYGIGFAEK TVPVWHKDVR YFELQQNGKT
    401  IGGVYMDLYA REGKRGGAWM NDYKGRRRFA DGTLQLPTAY LVCNFAPPVG
    451  GKEARLSHDE ILTLFHETGH GLHHLLTQVD ELGVSGINGV K

m128-1/g128-1  94.5% identity in 491 aa overlap

                       10        20        30        40        50        60
g128-1.pep   MIDNALLHLGEEPRFNQIKTEDIKPAVQTAIAEARGQIAAVKAQTHTGWANTVERLTGIT
             | |||||||||||||:||||||||||:|||||||| ||||:||||||||||||| |||||
m128-1       MTDNALLHLGEEPRFDQIKTEDIKPALQTAIAEAREQIAAIKAQTHTGWANTVEPLTGIT
                       10        20        30        40        50        60

                       70        80        90       100       110       120
g128-1.pep   ERVGRIWGVVSHLNSVVDTPELRAVYNELMPEITVFFTEIGQDIELYNRFKTIKNSPEFA
             ||||||||||||||||:|||||||||||||||||||||||||||||||||||||||||||
m128-1       ERVGRIWGVVSHLNSVADTPELRAVYNELMPEITVFFTEIGQDIELYNRFKTIKNSPEFA
                       70        80        90       100       110       120

                      130       140       150       160       170       180
g128-1.pep   TSLPAQKTKLDHDLRDFVLSGAELPPERQAELAKLQTEGAQLSAKFSQNVLDATDAFGIY
             ||||||||||:|||||||||||||||||:|||||||||||||||||||||||||||||||
m128-1       TSLPAQKTKLNHDLRDFVLSGAELPPEQQAELAKLQTEGAQLSAKFSQNVLDATDAFGIY
                      130       140       150       160       170       180

                      190       200       210       220       230       240
g128-1.pep   FDDAAPLAGIPEDALAMFAAAAQSEGKTGYKIGLQIPHYLAVIQYAGNRELREQIYRAYV
             |||||||||||||||||||||||||:|||||||||||||||||||| |||||||||||||
m128-1       FDDAAPLAGIPEDALAMFAAAAQSESKTGYKIGLQIPHYLAVIQYADNRELREQIYRAYV
                      190       200       210       220       230       240
```

-continued

```
                            250       260       270       280       290       300
g128-1.pep         TRASELSNDGKFDNTANIDRTLENALKTAKLLGFKNYAELSLATKMADTPEQVLNFLHDL
                   |||||||:|||||||||||||| |||:|||||||||||||||||||||||||||||||||
m128-1             TRASELSDDGKFDNTANIDRTLANALQTAKLLGFKNYAELSLATKMADTPEQVLNFLHDL
                            250       260       270       280       290       300

                            310       320       330       340       350       360
g128-1.pep         ARRAKPYAEKDLAEVKAFAREHLGLADPQPWDLSYAGEKLREAKYAFSETEVKKYFPVGK
                   ||||||||||||||||||||| |:||| |||||:||:|||||||||||||||||||||||
m128-1             ARRAKPYAEKDLAEVKAFARESLNLADLQPWDLGYASEKLREAKYAFSETEVKKYFPVGK
                            310       320       330       340       350       360

                            370       380       390       400       410       420
g128-1.pep         VLAGLFAQIKKLYGIGFAEKTVPVWHKDVRYFELQQNGKTIGGVYMDLYAREGKRGGAWM
                   || ||||||||||||||:|||||||||||||||||||||:||||||||||||||||||||
m128-1             VLNGLFAQIKKLYGIGFTEKTVPVWHKDVRYFELQQNGETIGGVYMDLYAREGKRGGAWM
                            370       380       390       400       410       420

                            430       440       450       460       470       480
g128-1.pep         NDYKGRRRFADGTLQLPTAYLVCNFAPPVGGKEARLSHDEILTLFHETGHGLHHLLTQVD
                   |||||||||:|||||||||||||||||||||:|||||||||| |||||||||||||||||
m128-1             NDYKGRRRFSDGTLQLPTAYLVCNFAPPVGGREARLSHDEILILFHETGHGLHHLLTQVD
                            430       440       450       460       470       480

                            490
g128-1.pep         ELGVSGINGVK
                   ||||||||||:
m128-1             ELGVSGINGVEWDAVELPSQFMENFVWEYNVLAQMSAHEETGVPLPKELFDKMLAAKNFQ
                            490       500       510       520       530       540
```

The following partial DNA sequence was identified in *N. meningitidis* <SEQ ID 3095>:

```
a128-1.seq
     1  ATGACTGACA ACGCACTGCT CCATTTGGGC GAAGAACCCC GTTTTGATCA

    51  AATCAAAACC GAAGACATCA AACCCGCCCT GCAAACCGCC ATTGCCGAAG

   101  CGCGCGAACA AATCGCCGCC ATCAAAGCCC AAACGCACAC CGGCTGGGCA

   151  AACACTGTCG AACCCCTGAC CGGCATCACC GAACGCGTCG GCAGGATTTG

   201  GGGCGTGGTG TCGCACCTCA ACTCCGTCAC CGACACGCCC GAACTGCGCG

   251  CCGCCTACAA TGAATTAATG CCCGAAATTA CCGTCTTCTT CACCGAAATC

   301  GGACAAGACA TCGAGCTGTA CAACCGCTTC AAAACCATCA AAAACTCCCC

   351  CGAGTTCGAC ACCCTCTCCC ACGCGCAAAA AACCAAACTC AACCACGATC

   401  TGCGCGATTT CGTCCTCAGC GGCGCGGAAC TGCCGCCCGA ACAGCAGGCA

   451  GAATTGGCAA AACTGCAAAC CGAAGGCGCG CAACTTTCCG CCAAATTCTC

   501  CCAAAACGTC CTAGACGCGA CCGACGCGTT CGGCATTTAC TTTGACGATG

   551  CCGCACCGCT TGCCGGCATT CCCGAAGACG CGCTCGCCAT GTTTGCCGCT

   601  GCCGCGCAAA GCGAAGGCAA AACAGGCTAC AAAATCGGTT TGCAGATTCC

   651  GCACTACCTC GCCGTCATCC AATACGCCGA CAACCGCAAA CTGCGCGAAC

   701  AAATCTACCG CGCCTACGTT ACCCGCGCCA GCGAGCTTTC AGACGACGGC

   751  AAATTCGACA ACACCGCCAA CATCGACCGC ACGCTCGAAA ACGCCCTGCA

   801  AACCGCCAAA CTGCTCGGCT TCAAAAACTA CGCCGAATTG TCGCTGGCAA

   851  CCAAAATGGC GGACACCCCC GAACAAGTTT TAAACTTCCT GCACGACCTC

   901  GCCCGCCGCG CCAAACCCTA CGCCGAAAAA GACCTCGCCG AAGTCAAAGC

   951  CTTCGCCCGC GAAAGCCTCG GCCTCGCCGA TTTGCAACCG TGGGACTTGG

  1001  GCTACGCCGG CGAAAAACTG CGCGAAGCCA AATACGCATT CAGCGAAACC

  1051  GAAGTCAAAA AATACTTCCC CGTCGGCAAA GTATTAAACG GACTGTTCGC
```

-continued

```
1101 CCAAATCAAA AAACTCTACG GCATCGGATT TACCGAAAAA ACCGTCCCCG
1151 TCTGGCACAA AGACGTGCGC TATTTTGAAT TGCAACAAAA CGGCGAAACC
1201 ATAGGCGGCG TTTATATGGA TTTGTACGCA CGCGAAGGCA AACGCGGCGG
1251 CGCGTGGATG AACGACTACA AAGGCCGCCG CCGTTTTTCA GACGGCACGC
1301 TGCAACTGCC CACCGCCTAC CTCGTCTGCA ACTTCACCCC GCCCGTCGGC
1351 GGCAAAGAAG CCCGCTTGAG CCATGACGAA ATCCTCACCC TCTTCCACGA
1401 AACCGGACAC GGCCTGCACC ACCTGCTTAC CCAAGTCGAC GAACTGGGCG
1451 TATCCGGCAT CAACGGCGTA GAATGGGACG CAGTCGAACT GCCCAGTCAG
1501 TTTATGGAAA ATTTCGTTTG GGAATACAAT GTCTTGGCGC AAATGTCCGC
1551 CCACGAAGAA ACCGGCGTTC CCCTGCCGAA AGAACTCTTC GACAAAATGC
1601 TCGCCGCCAA AAACTTCCAA CGCGGAATGT TCCTCGTCCG CCAAATGGAG
1651 TTCGCCCTCT TTGATATGAT GATTTACAGC GAAGACGACG AAGGCCGTCT
1701 GAAAAACTGG CAACAGGTTT TAGACAGCGT GCGCAAAGAA GTCGCCGTCG
1751 TCCGACCGCC CGAATACAAC CGCTTCGCCA ACAGCTTCGG CCACATCTTC
1801 GCAGGCGGCT ATTCCGCAGG CTATTACAGC TACGCGTGGG CGGAAGTATT
1851 GAGCGCGGAC GCATACGCCG CCTTTGAAGA AAGCGACGAT GTCGCCGCCA
1901 CAGGCAAACG CTTTTGGCAG GAAATCCTCG CCGTCGGCGG ATCGCGCAGC
1951 GCGGCAGAAT CCTTCAAAGC CTTCCGCGGA CGCGAACCGA GCATAGACGC
2001 ACTCTTGCGC CACAGCGGCT TCGACAACGC GGCTTGA
```

This corresponds to the amino acid sequence <SEQ ID 3096; ORF 128-1.a>:

```
a128-1.pep
  1 MTDNALLHLG EEPRFDQIKT EDIKPALQTA IAEAREQIAA IKAQTHTGWA
 51 NTVEPLTGIT ERVGRIWGVV SHLNSVTDTP ELRAAYNELM PEITVFFTEI
101 GQDIELYNRF KTIKNSPEFD TLSHAQKTKL NHDLRDFVLS GAELPPEQQA
151 ELAKLQTEGA QLSAKFSQNV LDATDAFGIY FDDAAPLAGI PEDALAMFAA
201 AAQSEGKTGY KIGLQIPHYL AVIQYADNRK LREQIYRAYV TRASELSDDG
251 KFDNTANIDR TLENALQTAK LLGFKNYAEL SLATKMADTP EQVLNFLHDL
301 ARRAKPYAEK DLAEVKAFAR ESLGLADLQP WDLGYAGEKL REAKYAFSET
351 EVKKYFPVGK VLNGLFAQIK KLYGIGFTEK TVPVWHKDVR YFELQQNGET
401 IGGVYMDLYA REGKRGGAWM NDYKGRRRFS DGTLQLPTAY LVCNFTPPVG
451 GKEARLSHDE ILTLFHETGH GLHHLLTQVD ELGVSGINGV EWDAVELPSQ
501 FMENFVWEYN VLAQMSAHEE TGVPLPKELF DKMLAAKNFQ RGMFLVRQME
551 FALFDMMIYS EDDEGRLKNW QQVLDSVRKE VAVVRPPEYN RFANSFGHIF
601 AGGYSAGYYS YAWAEVLSAD AYAAFEESDD VAATGKRFWQ EILAVGGSRS
651 AAESFKAFRG REPSIDALLR HSGFDNAA*
```

m128-1/a128-1 97.8% identity in 677 aa overlap

```
                   10         20         30         40         50         60
a128-1.pep  MTDNALLHLGEEPRFDQIKTEDIKPALQTAIAEAREQIAAIKAQTHTGWANTVEPLTGIT
            ||||||||||||||||||||||||||||||||||||||||||||||||||||||||||||
m128-1      MTDNALLHLGEEPRFDQIKTEDIKPALQTAIAEAREQIAAIKAQTHTGWANTVEPLTGIT
                   10         20         30         40         50         60

                   70         80         90        100        110        120
a128-1.pep  ERVGRIWGVVSHLNSVTDTPELRAAYNELMPEITVFFTEIGQDIELYNRFKTIKNSPEFD
            ||||||||||||||||:||||||:||||||||||||||||||||||||||||||||||||
m128-1      ERVGRIWGVVSHLNSVADTPELRAVYNELMPEITVFFTEIGQDIELYNRFKTIKNSPEFD
                   70         80         90        100        110        120

                  130        140        150        160        170        180
a128-1.pep  TLSHAQKTKLNHDLRDFVLSGAELPPEQQAELAKLQTEGAQLSAKFSQNVLDATDAFGIY
            ||| ||||||||||||||||||||||||||||||||||||||||||||||||||||||||
m128-1      TLSPAQKTKLNHDLRDFVLSGAELPPEQQAELAKLQTEGAQLSAKFSQNVLDATDAFGIY
                  130        140        150        160        170        180

                  190        200        210        220        230        240
a128-1.pep  FDDAAPLAGIPEDALAMFAAAAQSEGKTGYKIGLQIPHYLAVIQYADNRKLREQIYRAYV
            |||||||||||||||||||||||||:|||||||||||||||||||||||:||||||||||
m128-1      FDDAAPLAGIPEDALAMFAAAAQSESKTGYKIGLQIPHYLAVIQYADNRELREQIYRAYV
                  190        200        210        220        230        240

                  250        260        270        280        290        300
a128-1.pep  TRASELSDDGKFDNTANIDRTLENALQTAKLLGFKNYAELSLATKMADTPEQVLNFLHDL
            |||||||||||||||||||||| |||||||||||||||||||||||||||||||||||||
m128-1      TRASELSDDGKFDNTANIDRTLANALQTAKLLGFKNYAELSLATKMADTPEQVLNFLHDL
                  250        260        270        280        290        300

                  310        320        330        340        350        360
a128-1.pep  ARRAKPYAEKDLAEVKAFAREHLGLADPQPWDLSYAGEKLREAKYAFSETEVKKYFPVGK
            |||||||||||||||||||||||:||||||||||||:|||||||||||||||||||||||
m128-1      ARRAKPYAEKDLAEVKAFAREHLNLADPQPWDLSYASEKLREAKYAFSETEVKKYFPVGK
                  310        320        330        340        350        360

                  370        380        390        400        410        420
a128-1.pep  VLNGLFAQIKKLYGIGFTEKTVPVWHKDVRYFELQQNGETIGGVYMDLYAREGKRGGAWM
            ||||||||||||||||||||||||||||||||||||||||||||||||||||||||||||
m128-1      VLNGLFAQIKKLYGIGFTEKTVPVWHKDVRYFELQQNGETIGGVYMDLYAREGKRGGAWM
                  370        380        390        400        410        420

                  430        440        450        460        470        480
a128-1.pep  NDYKGRRRFSDGTLQLPTAYLVCNFTPPVGGKEARLSHDEILTLFHETGHGLHHLLTQVD
            |||||||||||||||||||||||||:|||||:|||||||||| |||||||||||||||||
m128-1      NDYKGRRRFSDGTLQLPTAYLVCNFAPPVGGREARLSHDEILILFHETGHGLHHLLTQVD
                  430        440        450        460        470        480

                  490        500        510        520        530        540
a128-1.pep  ELGVSGINGVEWDAVELPSQFMENFVWEYNVLAQMSAHEETGVPLPKELFDKMLAAKNFQ
            ||||||||||||||||||||||||||||||||||||||||||||||||||||||||||||
m128-1      ELGVSGINGVEWDAVELPSQFMENFVWEYNVLAQMSAHEETGVPLPKELFDKMLAAKNFQ
                  490        500        510        520        530        540

                  550        560        570        580        590        600
a128-1.pep  RGMFLVRQMEFALFDMMIYSEDDEGRLKNWQQVLDSVRKEVAVVRPPEYNRFANSFGHIF
            |||||||||||||||||||||||||||||||||||||||:|||::|||||||| ||||||
m128-1      RGMFLVRQMEFALFDMMIYSEDDEGRLKNWQQVLDSVRKKVAVIQPPEYNRFALSFGHIF
                  550        560        570        580        590        600

                  610        620        630        640        650        660
a128-1.pep  AGGYSAGYYSYAWAEVLSADAYAAFEESDDVAATGKRFWQEILAVGGSRSAAESFKAFRG
            ||||||||||||||||||||||||||||||||||||||||||||||||||||||||||||
m128-1      AGGYSAGYYSYAWAEVLSADAYAAFEESDDVAATGKRFWQEILAVGGSRSAAESFKAFRG
                  610        620        630        640        650        660

                  670      679
a128-1.pep  REPSIDALLRHSGFDNAAX
            ||||||||||||||||:
m128-1      REPSIDALLRHSGFDNAVX
                  670
```

206

The following partial DNA sequence was identified in *N. meningitidis* <SEQ ID 3097>:

```
m206.seq
  1 ATGTTTCCCC CCGACAAAAC CCTTTTCCTC TGTCTCAGCG CACTGCTCCT

 51 CGCCTCATGC GGCACGACCT CCGGCAAACA CCGCCAACCG AAACCCAAAC

101 AGACAGTCCG GCAAATCCAA GCCGTCCGCA TCAGCCACAT CGACCGCACA

151 CAAGGCTCGC AGGAACTCAT GCTCCACAGC CTCGGACTCA TCGGCACGCC

201 CTACAAATGG GGCGGCAGCA GCACCGCAAC CGGCTTCGAT TGCAGCGGCA

251 TGATTCAATT CGTTTACAAr AACGCCCTCA ACGTCAAGCT GCCGCGCACC

301 GCCCGCGACA TGGCGGCGGC AAGCCGsAAA ATCCCCGAcA GCCGCyTCAA

351 GGCCGGCGAC CTCGTATTCT TCAACACCGG CGGCGCACAC CGCTACTCAC

401 ACGTCGGACT CTACATCGGC AACGGCGAAT TCATCCATGC CCCCAGCAGC

451 GGCAAAAACCA TCAAAACCGA AAAACTCTCC ACACCGTTTT ACGCCAAAAA

501 CTACCTCGGC GCACATACTT TTTTTACAGA ATGA
```

This corresponds to the amino acid sequence <SEQ ID 3098; ORF 206>:

```
m206.pep . . .
  1 MFPPDKTLFL CLSALLLASC GTTSGKHRQP KPKQTVRQI QAVRISHIDRT

 51 QGSQELMLHS LGLIGTPYKW GGSSTATGFD CSGMIQFVY KNALNVKLPRT

101 ARDMAAASRK IPDSRXKAGD LVFFNTGGAH RYSHVGLYI GNGEFIHAPSS

151 GKTIKTEKLS TPFYAKNYLG AHTFFTE*
```

The following partial DNA sequence was identified in *N. gonorrhoeae* <SEQ ID 3099>:

```
g206.seq.
  1 atgttttccc ccgacaaaac ccttttcctc tgtctcggcg cactgctcct

 51 cgcctcatgc ggcacgacct ccggcaaaca ccgccaaccg aaacccaaac

101 agacagtccg gcaaatccaa gccgtccgca tcagccacat cggccgcaca

151 caaggctcgc aggaactcat gctccacagc ctcggactca tcggcacgcc

201 ctacaaatgg ggcggcagca gcaccgcaac cggcttcgac tgcagcggca

251 tgattcaatt ggtttacaaa aacgccctca acgtcaagct gccgcgcacc

301 gcccgcgaca tggcggcggc aagccgcaaa atccccgaca gccgcctcaa

351 ggccggcgac atcgtattct tcaacaccgg cggcgcacac cgctactcac

401 acgtcggact ctacatcggc aacggcgaat tcatccatgc ccccggcagc

451 ggcaaaacca tcaaaaccga aaaactctcc acaccgtttt acgccaaaaa

501 ctaccttgga gcgcatacgt tttttacaga atga
```

This corresponds to the amino acid sequence <SEQ ID 3100; ORF 206.ng>:

```
g206.pep
  1 MFSPDKTLFL CLGALLLASC GTTSGKHRQP KPKQTVRQIQ AVRISHIGRT

 51 QGSQELMLHS LGLIGTPYKW GGSSTATGFD CSGMIQLVYK NALNVKLPRT
```

-continued

```
101 ARDMAAASRK IPDSRLKAGD IVFFNTGGAH RYSHVGLYIG NGEFIHAPGS

151 GKTIKTEKLS TPFYAKNYLG AHTFFTE*
```

ORF 206 shows 96.0% identity over a 177 aa overlap with a predicted ORF (ORF 206.ng) from *N. gonorrhoeae*:

```
m206/g206

                 10        20        30        40        50        60
m206.pep MFPPDKTLFLCLSALLLASCGTTSGKHRQPKPKQTVRQIQAVRISHIDRTQGSQELMLHS
         || |||||||||:|||||||||||||||||||||||||||||||||| ||||||||||||
g206     MFSPDKTLFLCLGALLLASCGTTSGKHRQPKPKQTVRQIQAVRISHIGRTQGSQELMLHS
                 10        20        30        40        50        60

                 70        80        90       100       110       120
m206.pep LGLIGTPYKWGGSSTATGFDCSGMIQFVYKNALNVKLPRTARDMAAASRKIPDSRXKAGD
         ||||||||||||||||||||||||||:|||||||||||||||||||||||||||| ||||
g206     LGLIGTPYKWGGSSTATGFDCSGMIQLVYKNALNVKLPRTARDMAAASRKIPDSRLKAGD
                 70        80        90       100       110       120

                130       140       150       160       170
m206.pep LVFFNTGGAHRYSHVGLYIGNGEFIHAPSSGKTIKTEKLSTPFYAKNYLGAHTFFTEX
         :|||||||||||||||||||||||||||:||||||||||||||||||||||||||||
g206     IVFFNTGGAHRYSHVGLYIGNGEFIHAPGSGKTIKTEKLSTPFYAKNYLGAHTFFTE
                130       140       150       160       170
```

The following partial DNA sequence was identified in *N. meningitidis* <SEQ ID 3101>:

```
a206.seq
  1 ATGTTTCCCC CCGACAAAAC CCTTTTCCTC TGTCTCAGCG CACTGCTCCT

 51 CGCCTCATGC GGCACGACCT CCGGCAAACA CCGCCAACCG AAACCCAAAC

101 AGACAGTCCG GCAAATCCAA GCCGTCCGCA TCAGCCACAT CGACCGCACA

151 CAAGGCTCGC AGGAACTCAT GCTCCACAGC CTCGGACTCA TCGGCACGCC

201 CTACAAATGG GGCGGCAGCA GCACCGCAAC CGGCTTCGAT TGCAGCGGCA

251 TGATTCAATT CGTTTACAAA AACGCCCTCA ACGTCAAGCT GCCGCGCACC

301 GCCCGCGACA TGGCGGCGGC AAGCCGCAAA ATCCCCGACA GCCGCCTTAA

351 GGCCGGCGAC CTCGTATTCT TCAACACCGG CGGCGCACAC CGCTACTCAC

401 ACGTCGGACT CTATATCGGC AACGGCGAAT TCATCCATGC CCCCAGCAGC

451 GGCAAAACCA TCAAAACCGA AAAACTCTCC ACACCGTTTT ACGCCAAAAA

501 CTACCTCGGC GCACATACTT TCTTTACAGA ATGA
```

This corresponds to the amino acid sequence <SEQ ID 3102; ORF 206.a>:

```
a206.pep
  1 MFPPDKTLFL CLSALLLASC GTTSGKHRQP KPKQTVRQIQ AVRISHIDRT

 51 QGSQELMLHS LGLIGTPYKW GGSSTATGFD CSGMIQFVYK NALNVKLPRT

101 ARDMAAASRK IPDSRLKAGD LVFFNTGGAH RYSHVGLYIG NGEFIHAPSS

151 GKTIKTEKLS TPFYAKNYLG AHTFFTE*
```

m206/a206 99.4% identity in 177 aa overlap

```
                 10        20        30        40        50        60
m206.pep MFPPDKTLFLCLSALLLASCGTTSGKHRQPKPKQTVRQIQAVRISHIDRTQGSQELMLHS
         ||||||||||||||||||||||||||||||||||||||||||||||||||||||||||||
g206     MFPPDKTLFLCLSALLLASCGTTSGKHRQPKPKQTVRQIQAVRISHIDRTQGSQELMLHS
                 10        20        30        40        50        60
```

-continued

```
              70         80         90        100        110        120
m206.pep LGLIGTPYKWGGSSTATGFDCSGMIQFVYKNALNVKLPRTARDMAAASRKIPDSRXKAGD
         |||||||||||||||||||||||||||||||||||||||||||||||||||||||| ||||
g206     LGLIGTPYKWGGSSTATGFDCSGMIQFVYKNALNVKLPRTARDMAAASRKIPDSRLKAGD
              70         80         90        100        110        120

             130        140        150        160        170
m206.pep LVFFNTGGAHRYSHVGLYIGNGEFIHAPSSGKTIKTEKLSTPFYAKNYLGAHTFFTEX
         ||||||||||||||||||||||||||||||||||||||||||||||||||||||||||
g206     LVFFNTGGAHRYSHVGLYIGNGEFIHAPSSGKTIKTEKLSTPFYAKNYLGAHTFFTEX
             130        140        150        160        170
```

287

The following partial DNA sequence was identified in *N. meningitidis* <SEQ ID 3103>:

```
m287.seq
   1 ATGTTTAAAC GCAGCGTAAT CGCAATGGCT TGTATTTTTG CCCTTTCAGC
  51 CTGCGGGGGC GGCGGTGGCG GATCGCCCGA TGTCAAGTCG GCGGACACGC
 101 TGTCAAAACC TGCCGCCCCT GTTGTTTCTG AAAAAGAGAC AGAGGCAAAG
 151 GAAGATGCGC CACAGGCAGG TTCTCAAGGA CAGGGCGCGC CATCCGCACA
 201 AGGCAGTCAA GATATGGCGG CGGTTTCGGA AGAAAATACA GGCAATGGCG
 251 GTGCGGTAAC AGCGGATAAT CCCAAAAATG AAGACGAGGT GGCACAAAAT
 301 GATATGCCGC AAAATGCCGC CGGTACAGAT AGTTCGACAC CGAATCACAC
 351 CCCGGATCCG AATATGCTTG CCGGAAATAT GGAAAATCAA GCAACGGATG
 401 CCGGGGAATC GTCTCAGCCG GCAAACCAAC CGGATATGGC AAATGCGGCG
 451 GACGGAATGC AGGGGGACGA TCCGTCGGCA GGCGGGCAAA ATGCCGGCAA
 501 TACGGCTGCC CAAGGTGCAA ATCAAGCCGG AAACAATCAA GCCGCCGGTT
 551 CTTCAGATCC CATCCCCGCG TCAAACCCTG CACCTGCGAA TGGCGGTAGC
 601 AATTTTGGAA GGGTTGATTT GGCTAATGGC GTTTTGATTG ACGGGCCGTC
 651 GCAAAATATA ACGTTGACCC ACTGTAAAGG CGATTCTTGT AGTGGCAATA
 701 ATTTCTTGGA TGAAGAAGTA CAGCTAAAAT CAGAATTTGA AAAATTAAGT
 751 GATGCAGACA AAATAAGTAA TTACAAGAAA GATGGGAAGA ATGATAAATT
 801 TGTCGGTTTG GTTGCCGATA GTGTGCAGAT GAAGGGAATC AATCAATATA
 851 TTATCTTTTA TAAACCTAAA CCCACTTCAT TTGCGCGATT TAGGCGTTCT
 901 GCACGGTCGA GGCGGTCGCT TCCGGCCGAG ATGCCGCTGA TTCCCGTCAA
 951 TCAGGCGGAT ACGCTGATTG TCGATGGGGA AGCGGTCAGC CTGACGGGGC
1001 ATTCCGGCAA TATCTTCGCG CCCGAAGGGA ATTACCGGTA TCTGACTTAC
1051 GGGGCGGAAA AATTGCCCGG CGGATCGTAT GCCCTTCGTG TTCAAGGCGA
1101 ACCGGCAAAA GGCGAAATGC TTGCGGGCGC GGCCGTGTAC AACGGCGAAG
1151 TACTGCATTT CCATACGGAA AACGGCCGTC CGTACCCGAC CAGGGGCAGG
1201 TTTGCCGCAA AAGTCGATTT CGGCAGCAAA TCTGTGGACG GCATTATCGA
1251 CAGCGGCGAT GATTTGCATA TGGGTACGCA AAAATTCAAA GCCGCCATCG
1301 ATGGAAACGG CTTTAAGGGG ACTTGGACGG AAAATGGCAG CGGGGATGTT
1351 TCCGGAAAGT TTTACGGCCC GGCCGGCGAG GAAGTGGCGG GAAAATACAG
1401 CTATCGCCCG ACAGATGCGG AAAAGGGCGG ATTCGGCGTG TTTGCCGGCA
1451 AAAAAGAGCA GGATTGA
```

This corresponds to the amino acid sequence <SEQ ID 3104; ORF 287>:

```
m287.pep
   1 MFKRSVIAMA CIFALSACGG GGGGSPDVKS ADTLSKPAAP VVSEKETEAK

  51 EDAPQAGSQG QGAPSAQGSQ DMAAVSEENT GNGGAVTADN PKNEDEVAQN

 101 DMPQNAAGTD SSTPNHTPDP NMLAGNMENQ ATDAGESSQP ANQPDMANAA

 151 DGMQGDDPSA GGQNAGNTAA QGANQAGNNQ AAGSSDPIPA SNPAPANGGS

 201 NFGRVDLANG VLIDGPSQNI TLTHCKGDSC SGNNFLDEEV QLKSEFEKLS

 251 DADKISNYKK DGKNDKFVGL VADSVQMKGI NQYIIFYKPK PTSFARFRRS

 301 ARSRRSLPAE MPLIPVNQAD TLIVDGEAVS LTGHSGNIFA PEGNYRYLTY

 351 GAEKLPGGSY ALRVQGEPAK GEMLAGAAVY NGEVLHFHTE NGRPYPTRGR

 401 FAAKVDFGSK SVDGIIDSGD DLHMGTQKFK AAIDGNGFKG TWTENGSGDV

 451 SGKFYGPAGE EVAGKYSYRP TDAEKGGFGV FAGKKEQD*
```

The following partial DNA sequence was identified in *N. gonorrhoeae* <SEQ ID 3105>:

```
g287.seq
    1 atgtttaaac gcagtgtgat tgcaatggct tgtatttttc ccctttcagc

   51 ctgtgggggc ggcggtggcg gatcgcccga tgtcaagtcg gcggacacgc

  101 cgtcaaaacc ggccgccccc gttgttgctg aaaatgccgg ggaaggggtg

  151 ctgccgaaag aaaagaaaga tgaggaggca gcgggcggtg cgccgcaagc

  201 cgatacgcag gacgcaaccg ccggagaagg cagccaagat atggcggcag

  251 tttcggcaga aaatacaggc aatggcggtg cggcaacaac ggacaacccc

  301 aaaaatgaag acgcgggggc gcaaaatgat atgccgcaaa atgccgccga

  351 atccgcaaat caaacaggga acaaccaacc cgccggttct tcagattccg

  401 cccccgcgtc aaaccctgcc cctgcgaatg gcggtagcga ttttggaagg

  451 acgaacgtgg gcaattctgt tgtgattgac ggaccgtcgc aaaatataac

  501 gttgacccac tgtaaaggcg attcttgtaa tggtgataat ttattggatg

  551 aagaagcacc gtcaaaatca gaatttgaaa aattaagtga tgaagaaaaa

  601 attaagcgat ataaaaaaga cgagcaacgg gagaattttg tcggtttggt

  651 tgctgacagg gtaaaaaagg atggaactaa caaatatatc atcttctata

  701 cggacaaacc acctactcgt tctgcacggt cgaggaggtc gcttccggcc

  751 gagattccgc tgattcccgt caatcaggcc gatacgctga ttgtggatgg

  801 ggaagcggtc agcctgacgg ggcattccgg caatatcttc gcgcccgaag

  851 ggaattaccg gtatctgact tacggggcgg aaaaattgcc cggcggatcg

  901 tatgccctcc gtgtgcaagg cgaaccggca aaaggcgaaa tgcttgttgg

  951 cacggccgtg tacaacggcg aagtgctgca tttccatatg gaaaacggcc

 1001 gtccgtaccc gtccggaggc aggtttgccg caaaagtcga tttcggcagc

 1051 aaatctgtgg acggcattat cgacagcggc gatgatttgc atatgggtac

 1101 gcaaaaattc aaagccgcca tcgatggaaa cggctttaag gggacttgga

 1151 cggaaaatgg cggcggggat gtttccggaa ggttttacgg cccggccggc
```

-continued

```
1201 gaggaagtgg cgggaaaata cagctatcgc ccgacagatg ctgaaaaggg

1251 cggattcggc gtgtttgccg gcaaaaaaga tcgggattga
```

This corresponds to the amino acid sequence <SEQ ID 3106; ORF 287.ng>:

```
g287.pep.
  1 MFKRSVIAMA CIFPLSACGG GGGGSPDVKS ADTPSKPAAP VVAENAGEGV

 51 LPKEKKDEEA AGGAPQADTQ DATAGEGSQD MAAVSAENTG NGGAATTDNP

101 KNEDAGAQND MPQNAAESAN QTGNNQPAGS SDSAPASNPA PANGGSDFGR

151 TNVGNSVVID GPSQNITLTH CKGDSCNGDN LLDEEAPSKS EFEKLSDEEK

201 IKRYKKDEQR ENFVGLVADR VKKDGTNKYI IFYTDKPPTR SARSRRSLPA

251 EIPLIPVNQA DTLIVDGEAV SLTGHSGNIF APEGNYRYLT YGAEKLPGGS

301 YALRVQGEPA KGEMLVGTAV YNGEVLHFHM ENGRPYPSGG RFAAKVDFGS

351 KSVDGIIDSG DDLHMGTQKF KAAIDGNGFK GTWTENGGGD VSGRFYGPAG

401 EEVAGKYSYR PTDAEKGGFG VFAGKKDRD*
```

m287/g287 70.1% identity in 499 aa overlap

```
                  10        20         30        40              49
m287.pep  MFKRSVIAMACIFALSACGGGGGGSPDVKSADTLSKPAAPVVSE----------KETEA
          ||||||||||||| |||||||||||||||||||| |||||||:|          |: ||
g287      MFKRSVIAMACIFPLSACGGGGGGSPDVKSADTPSKPAAPVVAENAGEGVLPKEKKDEEA
                  10        20         30        40        50        60

                 50        60        70        80        90       100       109
m287.pep  KEDAPQAGSQGQGAPSAQGSQDMAAVSEENTGNGGAVTADNPKNEDEVAQNDMPQNAAGT
          |||| :|   |  :::||||||||| |||||||:|:|||||| ||||||||||||
g287      AGGAPQADTQD--ATAGEGSQDMAAVSAENTGNGGAATTDNPKNEDAGAQNDMPQNAA--
                  70        80        90       100       110

                110       120       130       140       150       160       169
m287.pep  DSSTPNHTPDPNMLAGNMENQATDAGESSQPANQPDMANAADGMQGDDPSAGGQNAGNTA

g287      ------------------------------------------------------------

                170       180       190       200       210       220       229
m287.pep  AQGANQAGNNQAAGSSDPIPASNPAPANGGSNFGRVDLANGVLIDGPSQNITLTHCKGDS
          ::||| ||||  |||||  |||||||:|||:::|::|:||||||||||||||||||||
g287      -ESANQTGNNQPAGSSDSAPASNPAPANGGSDFGRTNVGNSVVIDGPSQNITLTHCKGDS
                 120       130       140       150       160       170

                230       240       250       260       270       280       289
m287.pep  CSGNNFLDEEVQLKSEFEKLSDADKISNYKKDGKNDKFVGLVADSVQMKGINQYIIFYKP
          |:|:|:|||:  ||||||||||:||:  |||| : ::||||||| |:  | |:|||||
g287      CNGDNLLDEEAPSKSEFEKLSDEEKIKRYKKDEQRENFVGLVADRVKKDGTNKYIIFYTD
                 180       190       200                 220       230

                290       300       310       320       330       340       349
m287.pep  KPTSFARFRRSARSRRSLPAEMPLIPVNQADTLIVDGEAVSLTGHSGNIFAPEGNYRYLT
          || :      |||||||||||:|||||||||||||||||||||||||||||||||||||
g287      KPPT-----RSARSRRSLPAEIPLIPVNQADTLIVDGEAVSLTGHSGNIFAPEGNYRYLT
                 240       250       260       270       280       290

                350       360       370       380       390       400       409
m287.pep  YGAEKLPGGSYALRVQGEPAKGEMLAGAAVYNGEVLHFHTENGRPYPTRGRFAAKVDFGS
          |||||||||||||||||||||||||:|:||||||||||| ||||||| | ||||||||
g287      YGAEKLPGGSYALRVQGEPAKGEMLVGTAVYNGEVLHFHMENGRPYPSGGRFAAKVDFGS
                 300       310       320       330       340       350

                410       420       430       440       450       460       469
m287.pep  KSVDGIIDSGDDLHMGTQKFKAAIDGNGFKGTWTENGSGDVSGKFYGPAGEEVAGKYSYR
          ||||||||||||||||||||||||||||||||||||:||||:||||||||||||||||
g287      KSVDGIIDSGDDLHMGTQKFKAAIDGNGFKGTWTENGGGDVSGRFYGPAGEEVAGKYSYR
                 360       370       380       390       400       410
```

-continued

```
            470       480       489
m287.pep    PTDAEKGGFGVFAGKKEQDX
            ||||||||||||||||::||
g287        PTDAEKGGFGVFAGKKDRDX
                     420       430
```

The following partial DNA sequence was identified in *N. meningitidis* <SEQ ID 3107>:

```
a287.seq
   1 ATGTTTAAAC GCAGTGTGAT TGCAATGGCT TGTATTGTTG CCCTTTCAGC

  51 CTGTGGGGGC GGCGGTGGCG GATCGCCCGA TGTTAAGTCG GCGGACACGC

 101 TGTCAAAACC TGCCGCCCCT GTTGTTACTG AAGATGTCGG GGAAGAGGTG

 151 CTGCCGAAAG AAAAGAAAGA TGAGGAGGCG GTGAGTGGTG CGCCGCAAGC

 201 CGATACGCAG GACGCAACCG CCGGAAAAGG CGGTCAAGAT ATGGCGGCAG

 251 TTTCGGCAGA AAATACAGGC AATGGCGGTG CGGCAACAAC GGATAATCCC

 301 GAAAATAAAG ACGAGGGACC GCAAAATGAT ATGCCGCAAA ATGCCGCCGA

 351 TACAGATAGT TCGACACCGA ATCACACCCC TGCACCGAAT ATGCCAACCA

 401 GAGATATGGG AAACCAAGCA CCGGATGCCG GGGAATCGGC ACAACCGGCA

 451 AACCAACCGG ATATGGCAAA TGCGGCGGAC GGAATGCAGG GGGACGATCC

 501 GTCGGCAGGG GAAAATGCCG GCAATACGGC AGATCAAGCT GCAAATCAAG

 551 CTGAAAACAA TCAAGTCGGC GGCTCTCAAA ATCCTGCCTC TTCAACCAAT

 601 CCTAACGCCA CGAATGGCGG CAGCGATTTT GGAAGGATAA ATGTAGCTAA

 651 TGGCATCAAG CTTGACAGCG GTTCGGAAAA TGTAACGTTG ACACATTGTA

 701 AAGACAAAGT ATGCGATAGA GATTTCTTAG ATGAAGAAGC ACCACCAAAA

 751 TCAGAATTTG AAAAATTAAG TGATGAAGAA AAAATTAATA AATATAAAAA

 801 AGACGAGCAA CGAGAGAATT TTGTCGGTTT GGTTGCTGAC AGGGTAGAAA

 851 AGAATGGAAC TAACAAATAT GTCATCATTT ATAAAGACAA GTCCGCTTCA

 901 TCTTCATCTG CGCGATTCAG GCGTTCTGCA CGGTCGAGGC GGTCGCTTCC

 951 GGCCGAGATG CCGCTGATTC CCGTCAATCA GGCGGATACG CTGATTGTCG

1001 ATGGGGAAGC GGTCAGCCTG ACGGGGCATT CCGGCAATAT CTTCGCGCCC

1051 GAAGGGAATT ACCGGTATCT GACTTACGGG GCGGAAAAAT TGTCCGGCGG

1101 ATCGTATGCC CTCAGTGTGC AAGGCGAACC GGCAAAAGGC GAAATGCTTG

1151 CGGGCACGGC CGTGTACAAC GGCGAAGTGC TGCATTTCCA TATGGAAAAC

1201 GGCCGTCCGT CCCCGTCCGG AGGCAGGTTT GCCGCAAAAG TCGATTTCGG

1251 CAGCAAATCT GTGGACGGCA TTATCGACAG CGGCGATGAT TTGCATATGG

1301 GTACGCAAAA ATTCAAAGCC GTTATCGATG GAAACGGCTT TAAGGGGACT

1351 TGGACGGAAA ATGGCGGCGG GGATGTTTCC GGAAGGTTTT ACGGCCCGGC

1401 CGGCGAAGAA GTGGCGGGAA AATACAGCTA TCGCCCGACA GATGCGGAAA

1451 AGGGCGGATT CGGCGTGTTT GCCGGCAAAA AAGAGCAGGA TTGA
```

This corresponds to the amino acid sequence <SEQ ID 3108; ORF 287.a>:

```
a287.pep

     1  MFKRSVIAMA CIVALSACGG GGGGSPDVKS ADTLSKPAPP VVTEDVGEEV

    51  LPKEKKDEEA VSGAPQADTQ DATAGKGGQD MAAVSAENTG NGGAATTDNP

   101  ENKDEGPQND MPQNAADTDS STPNHTPAPN MPTRDMGNQA PDAGESAQPA

   151  NQPDMANAAD GMQGDDPSAG ENAGNTADQA ANQAENNQVG GSQNPASSTN

   201  PNATNGGSDF GRINVANGIK LDSGSENVTL THCKDKVCDR DFLDEEAPPK

   251  SEFEKLSDEE KINKYKKDEQ RENFVGLVAD RVEKNGTNKY VIIYKDKSAS

   301  SSSARFRRSA RSRRSLPAEM PLIPVNQADT LIVDGEAVSL TGHSGNIFAP

   351  EGNYRYLTYG AEKLSGGSYA LSVQGEPAKG EMLAGTAVYN GEVLHFHMEN

   401  GRPSPSGGRF AAKVDFGSKS VDGIIDSGDD LHMGTQKFKA VIDGNGFKGT

   451  WTENGGGDVS GRFYGPAGEE VAGKYSYRPT DAEKGGFGVF AGKKEQD*
```

```
m287/a287   77.2% identity in 501 aa overlap

                       10        20        30        40                  49
m287.pep       MFKRSVIAMACIFALSACGGGGGGSPDVKSADTLSKPAAPVVSE-----------KETEA
               |||||||||||| |||||||||||||||||||||||||||||:|           |: ||
a287           MFKRSVIAMACIVALSACGGGGGGSPDVKSADTLSKPAPPVVTEDVGEEVLPKEKKDEEA
                       10        20        30        40        50        60

              50        60        70        80        90       100      109
m287.pep       KEDAPQAGSQGQGAPSAQGSQDMAAVSEENTGNGGAVTADNPKNEDEVAQNDMPQNAAGT
                  |||| :|   | :::|:||||||| ||||||||:|:|||:|:||  ||||||||| |
a287           VSGAPQADTQ--DATAGKGGQDMAAVSAENTGNGGAATTDNPENKDEGPQNDMPQNAADT
                       70          80        90       100       110

             110       120       130       140       150       160       169
m287.pep       DSSTPNHTPDPNMLAGNMENQATDAGESSQPANQPDMANAADGMQGDDPSAGGQNAGNTA
               ||||||||| ||| : :| ||| |||||:||||||||||||||||||||||| :||||||
a287           DSSTPNHTPAPNMPTRDMGNQAPDAGESAQPANQPDMANAADGMQGDDPSAG-ENAGNTA
              120       130       140       150       160       170

             170       180       190       200       210       220       229
m287.pep       AQGANQAGNNQAAGSSDPIPASNPAPANGGSNFGRVDLANGVLIDGPSQNITLTHCKGDS
                |:|||| |||::||::|  ::||  :||||:|||:::|||: :|: |:|:||||||
a287           DQAANQAENNQVGGSQNPASSTNPNATNGGSDFGRINVANGIKLDSGSENVTLTHCKDKV
              180       190       200       210       220       230

             230       240       250       260       270       280       289
m287.pep       CSGNNFLDEEVQLKSEFEKLSDADKISNYKKDGKNDKFVGLVADSVQMKGINQYIIFYKP
               |:  :|||||:  ||||||||| :||::|||| : ::||||||| |: :| |:|:|:||
a287           CD-RDFLDEEAPPKSEFEKLSDEEKINKYKKDEQRENFVGLVADRVEKNGTNKYVIIYKD
                   240       250       260       270       280       290

             290       300       310       320       330       340       349
m287.pep       KP--TSFARFRRSARSRRSLPAEMPLIPVNQADTLIVDGEAVSLTGHSGNIFAPEGNYRY
               |   :| |||||||||||||||||||||||||||||||||||||||||||||||||||||
a287           KSASSSSARFRRSARSRRSLPAEMPLIPVNQADTLIVDGEAVSLTGHSGNIFAPEGNYRY
                300       310       320       330       340       350

               350       360       370       380       390       400
m287.pep       LTYGAEKLPGGSYALRVQGEPAKGEMLAGAAVYNGEVLHFHTENGRPYPTRGRFAAKVDF
               |||||||| |||||| |||||||||||||:||||||||||| ||||| |: |||||||||
a287           LTYGAEKLSGGSYALSVQGEPAKGEMLAGTAVYNGEVLHFHMENGRPSPSGGRFAAKVDF
                360       370       380       390       400       410

               410       420       430       440       450       460
m287.pep       GSKSVDGIIDSGDDLHMGTQKFKAAIDGNGFKGTWTENGSGDVSGKFYGPAGEEVAGKYS
               ||||||||||||||||||||||||:||||||||||||||:|||||:||||||||||||||
a287           GSKSVDGIIDSGDDLHMGTQKFKAVIDGNGFKGTWTENGGGDVSGRFYGPAGEEVAGKYS
                420       430       440       450       460       470

               470       480     489
m287.pep       YRPTDAEKGGFGVFAGKKEQDX
               ||||||||||||||||||||||
a287           YRPTDAEKGGFGVFAGKKEQDX
                480       490
```

406

The following partial DNA sequence was identified in *N. meningitidis* <SEQ ID 3109>:

```
m406.seq
  1 ATGCAAGCAC GGCTGCTGAT ACCTATTCTT TTTTCAGTTT TTATTTTATC

 51 CGCCTGCGGG ACACTGACAG GTATTCCATC GCATGGCGGA GGTAAACGCT

101 TTGCGGTCGA ACAAGAACTT GTGGCCGCTT CTGCCAGAGC TGCCGTTAAA

151 GACATGGATT TACAGGCATT ACACGGACGA AAAGTTGCAT TGTACATTGC

201 CACTATGGGC GACCAAGGTT CAGGCAGTTT GACAGGGGGT CGCTACTCCA

251 TTGATGCACT GATTCGTGGC GAATACATAA ACAGCCCTGC CGTCCGTACC

301 GATTACACCT ATCCACGTTA CGAAACCACC GCTGAAACAA CATCAGGCGG

351 TTTGACAGGT TTAACCACTT CTTTATCTAC ACTTAATGCC CCTGCACTCT

401 CTCGCACCCA ATCAGACGGT AGCGGAAGTA AAAGCAGTCT GGGCTTAAAT

451 ATTGGCGGGA TGGGGGATTA TCGAAATGAA ACCTTGACGA CTAACCCGCG

501 CGACACTGCC TTTCTTTCCC ACTTGGTACA GACCGTATTT TTCCTGCGCG

551 GCATAGACGT TGTTTCTCCT GCCAATGCCG ATACAGATGT GTTTATTAAC

601 ATCGACGTAT TCGGAACGAT ACGCAACAGA ACCGAAATGC ACCTATACAA

651 TGCCGAAACA CTGAAAGCCC AAACAAAACT GGAATATTTC GCAGTAGACA

701 GAACCAATAA AAAATTGCTC ATCAAACCAA AAACCAATGC GTTTGAAGCT

751 GCCTATAAAG AAAATTACGC ATTGTGGATG GGGCCGTATA AAGTAAGCAA

801 AGGAATTAAA CCGACGGAAG GATTAATGGT CGATTTCTCC GATATCCGAC

851 CATACGGCAA TCATACGGGT AACTCCGCCC CATCCGTAGA GGCTGATAAC

901 AGTCATGAGG GGTATGGATA CAGCGATGAA GTAGTGCGAC AACATAGACA

951 AGGACAACCT TGA
```

This corresponds to the amino acid sequence <SEQ ID 3110; ORF 406>:

```
m406.pep
  1 MQARLLIPIL FSVFILSACG TLTGIPSHGG GKRFAVEQEL VAASARAAVK

 51 DMDLQALHGR KVALYIATMG DQGSGSLTGG RYSIDALIRG EYINSPAVRT

101 DYTYPRYETT AETTSGGLTG LTTSLSTLNA PALSRTQSDG SGSKSSLGLN

151 IGGMGDYRNE TLTTNPRDTA FLSHLVQTVF FLRGIDVVSP ANADTDVFIN

201 IDVFGTIRNR TEMHLYNAET LKAQTKLEYF AVDRTNKKLL IKPKTNAFEA

251 AYKENYALWM GPYKVSKGIK PTEGLMVDFS DIRPYGNHTG NSAPSVEADN

301 SHEGYGYSDE VVRQHRQGQP *
```

The following partial DNA sequence was identified in *N. gonorrhoeae* <SEQ ID 3111>:

```
g406.seq
  1 ATGCGGGCAC GGCTGCTGAT ACCTATTCTT TTTTCAGTTT TTATTTTATC

 51 CGCCTGCGGG ACACTGACAG GTATTCCATC GCATGGCGGA GGCAAACGCT

101 TCGCGGTCGA ACAAGAACTT GTGGCCGCTT CTGCCAGAGC TGCCGTTAAA

151 GACATGGATT TACAGGCATT ACACGGACGA AAAGTTGCAT TGTACATTGC

201 AACTATGGGC GACCAAGGTT CAGGCAGTTT GACAGGGGGT CGCTACTCCA
```

-continued

```
251 TTGATGCACT GATTCGCGGC GAATACATAA ACAGCCCTGC CGTCCGCACC

301 GATTACACCT ATCCGCGTTA CGAAACCACC GCTGAAACAA CATCAGGCGG

351 TTTGACGGGT TTAACCACTT CTTTATCTAC ACTTAATGCC CCTGCACTCT

401 CGCGCACCCA ATCAGACGGT AGCGGAAGTA GGAGCAGTCT GGGCTTAAAT

451 ATTGGCGGGA TGGGGGATTA TCGAAATGAA ACCTTGACGA CCAACCCGCG

501 CGACACTGCC TTTCTTTCCC ACTTGGTGCA GACCGTATTT TTCCTGCGCG

551 GCATAGACGT TGTTTCTCCT GCCAATGCCG ATACAGATGT GTTTATTAAC

601 ATCGACGTAT TCGGAACGAT ACGCAACAGA ACCGAAATGC ACCTATACAA

651 TGCCGAAACA CTGAAAGCCC AAACAAAACT GGAATATTTC GCAGTAGACA

701 GAACCAATAA AAAATTGCTC ATCAAACCCA AAACCAATGC GTTTGAAGCT

751 GCCTATAAAG AAAATTACGC ATTGTGGATG GGGCCGTATA AAGTAAGCAA

801 AGGAATCAAA CCGACGGAAG GATTGATGGT CGATTTCTCC CGATATCCAA

851 CATACGGCAA TCATACGGGT AACTCCGCCC CATCCGTAGA GGCTGATAAC

901 AGTCATGAGG GGTATGGATA CAGCGATGAA GCAGTGCGAC AACATAGACA

951 AGGGCAACCT TGA
```

This corresponds to the amino acid sequence <SEQ ID 3112; ORF 406>:

```
g406.pep
  1 MRARLLIPIL FSVFILSACG TLTGIPSHGG GKRFAVEQEL VAASARAAVK

 51 DMDLQALHGR KVALYIATMG DQGSGSLTGG RYSIDALIRG EYINSPAVRT

101 DYTYPRYETT AETTSGGLTG LTTSLSTLNA PALSRTQSDG SGSRSSLGLN

151 IGGMGDYRNE TLTTNPRDTA FLSHLVQTVF FLRGIDVVSP ANADTDVFIN

201 IDVFGTIRNR TEMHLYNAET LKAQTKLEYF AVDRTNKKLL IKPKTNAFEA

251 AYKENYALWM GPYKVSKGIK PTEGLMVDFS DIQPYGNHTG NSAPSVEADN

301 SHEGYGYSDE AVRQHRQGQP *
```

ORF 406 shows 98.8% identity over a 320 aa overlap with a predicted ORF (ORF406.a) from *N. gonorrhoeae*:

```
g406/m406

                   10        20        30        40        50        60
g406.pep MRARLLIPILFSVFILSACGTLTGIPSHGGGKRFAVEQELVAASARAAVKDMDLQALHGR
         |:||||||||||||||||||||||||||||||||||||||||||||||||||||||||||
m406     MQARLLIPILFSVFILSACGTLTGIPSHGGGKRFAVEQELVAASARAAVKDMDLQALHGR
                   10        20        30        40        50        60

                   70        80        90       100       110       120
g406.pep KVALYIATMGDQGSGSLTGGRYSIDALIRGEYINSPAVRTDYTYPRYETTAETTSGGLTG
         ||||||||||||||||||||||||||||||||||||||||||||||||||||||||||||
m406     KVALYIATMGDQGSGSLTGGRYSIDALIRGEYINSPAVRTDYTYPRYETTAETTSGGLTG
                   70        80        90       100       110       120

                  130       140       150       160       170       180
g406.pep LTTSLSTLNAPALSRTQSDGSGSRSSLGLNIGGMGDYRNETLTTNPRDTAFLSHLVQTVF
         |||||||||||||||||||||||:||||||||||||||||||||||||||||||||||||
m406     LTTSLSTLNAPALSRTQSDGSGSKSSLGLNIGGMGDYRNETLTTNPRDTAFLSHLVQTVF
                  130       140       150       160       170       180

                  190       200       210       220       230       240
g406.pep FLRGIDVVSPANADTDVFINIDVFGTIRNRTEMHLYNAETLKAQTKLEYFAVDRTNKKLL
         ||||||||||||||||||||||||||||||||||||||||||||||||||||||||||||
m406     FLRGIDVVSPANADTDVFINIDVFGTIRNRTEMHLYNAETLKAQTKLEYFAVDRTNKKLL
                  190       200       210       220       230       240
```

-continued

```
             250        260        270        280        290        300
g406.pep IKPKTNAFEAAYKENYALWMGPYKVSKGIKPTEGLMVDFSDIQPYGNHTGNSAPSVEADN
         ||||||||||||||||||||||||||||||||||||||||||:|||||||||||||||||
m406     IKPKTNAFEAAYKENYALWMGPYKVSKGIKPTEGLMVDFSDIRPYGNHTGNSAPSVEADN
             250        260        270        280        290        300

             310        320
g406.pep SHEGYGYSDEAVRQHRQGQPX
         ||||||||||:||||||||||
m406     SHEGYGYSDEVVRQHRQGQPX
             310        320
```

The following partial DNA sequence was identified in *N. meningitidis* <SEQ ID 3113>:

```
a406.seq.
  1 ATGCAAGCAC GGCTGCTGAT ACCTATTCTT TTTTCAGTTT TTATTTTATC
 51 CGCCTGCGGG ACACTGACAG GTATTCCATC GCATGGCGGA GGTAAACGCT
101 TCGCGGTCGA ACAAGAACTT GTGGCCGCTT CTGCCAGAGC TGCCGTTAAA
151 GACATGGATT TACAGGCATT ACACGGACGA AAAGTTGCAT TGTACATTGC
201 AACTATGGGC GACCAAGGTT CAGGCAGTTT GACAGGGGGT CGCTACTCCA
251 TTGATGCACT GATTCGTGGC GAATACATAA ACAGCCCTGC CGTCCGTACC
301 GATTACACCT ATCCACGTTA CGAAACCACC GCTGAAACAA CATCAGGCGG
351 TTTGACAGGT TTAACCACTT CTTTATCTAC ACTTAATGCC CCTGCACTCT
401 CGCGCACCCA ATCAGACGGT AGCGGAAGTA AAAGCAGTCT GGGCTTAAAT
451 ATTGGCGGGA TGGGGGATTA TCGAAATGAA ACCTTGACGA CTAACCCGCG
501 CGACACTGCC TTTCTTTCCC ACTTGGTACA GACCGTATTT TTCCTGCGCG
551 GCATAGACGT TGTTTCTCCT GCCAATGCCG ATACGGATGT GTTTATTAAC
601 ATCGACGTAT TCGGAACGAT ACGCAACAGA ACCGAAATGC ACCTATACAA
651 TGCCGAAACA CTGAAAGCCC AAACAAAACT GGAATATTTC GCAGTAGACA
701 GAACCAATAA AAAATTGCTC ATCAAACCAA AAACCAATGC GTTTGAAGCT
751 GCCTATAAAG AAAATTACGC ATTGTGGATG GGACCGTATA AAGTAAGCAA
801 AGGAATTAAA CCGACAGAAG GATTAATGGT CGATTTCTCC GATATCCAAC
851 CATACGGCAA TCATATGGGT AACTCTGCCC CATCCGTAGA GGCTGATAAC
901 AGTCATGAGG GGTATGGATA CAGCGATGAA GCAGTGCGAC GACATAGACA
951 AGGGCAACCT TGA
```

This corresponds to the amino acid sequence <SEQ ID 3114; ORF 406.a>:

```
a406.pep
  1 MQARLLIPIL FSVFILSACG TLTGIPSHGG GKRFAVEQEL VAASARAAVK
 51 DMDLQALHGR KVALYIATMG DQGSGSLTGG RYSIDALIRG EYINSPAVRT
101 DYTYPRYETT AETTSGGLTG LTTSLSTLNA PALSRTQSDG SGSKSSLGLN
151 IGGMGDYRNE TLTTNPRDTA FLSHLVQTVF FLRGIDVVSP ANADTDVFIN
201 IDVFGTIRNR TEMHLYNAET LKAQTKLEYF AVDRTNKKLL IKPKTNAFEA
251 AYKENYALWM GPYKVSKGIK PTEGLMVDFS DIQPYGNHMG NSAPSVEADN
301 SHEGYGYSDE AVRRHRQGQP *
```

-continued

```
m406/a406   98.8% identity in 320 aa overlap

                        10        20        30        40        50        60
m406.pep        MQARLLIPILFSVFILSACGTLTGIPSHGGGKRFAVEQELVAASARAAVKDMDLQALHGR
                ||||||||||||||||||||||||||||||||||||||||||||||||||||||||||||
a406            MQARLLIPILFSVFILSACGTLTGIPSHGGGKRFAVEQELVAASARAAVKDMDLQALHGR
                        10        20        30        40        50        60

                        70        80        90       100       110       120
m406.pep        KVALYIATMGDQGSGSLTGGRYSIDALIRGEYINSPAVRTDYTYPRYETTAETTSGGLTG
                ||||||||||||||||||||||||||||||||||||||||||||||||||||||||||||
a406            KVALYIATMGDQGSGSLTGGRYSIDALIRGEYINSPAVRTDYTYPRYETTAETTSGGLTG
                        70        80        90       100       110       120

                       130       140       150       160       170       180
m406.pep        LTTSLSTLNAPALSRTQSDGSGSKSSLGLNIGGMGDYRNETLTTNPRDTAFLSHLVQTVF
                |||||||||||||||||||:||||||||||||||||||||||||||||||||||||||||
a406            LTTSLSTLNAPALSRTQSDGSGSKSSLGLNIGGMGDYRNETLTTNPRDTAFLSHLVQTVF
                       130       140       150       160       170       180

                       190       200       210       220       230       240
m406.pep        FLRGIDVVSPANADTDVFINIDVFGTIRNRTEMHLYNAETLKAQTKLEYFAVDRTNKKLL
                ||||||||||||||||||||||||||||||||||||||||||||||||||||||||||||
a406            FLRGIDVVSPANADTDVFINIDVFGTIRNRTEMHLYNAETLKAQTKLEYFAVDRTNKKLL
                       190       200       210       220       230       240

                       250       260       270       280       290       300
m406.pep        IKPKTNAFEAAYKENYALWMGPYKVSKGIKPTEGLMVDFSDIRPYGNHTGNSAPSVEADN
                ||||||||||||||||||||||||||||||||||||||||||:||||| |||||||||||
a406            IKPKTNAFEAAYKENYALWMGPYKVSKGIKPTEGLMVDFSDIQPYGNHMGNSAPSVEADN
                       250       260       270       280       290       300

                       310       320
m406.pep        SHEGYGYSDEVVRQHRQGQPX
                ||||||||||:||:|||||||
a406            SHEGYGYSDEAVRRHRQGQPX
                       310       320
```

Example 2

Expression of ORF 919

The primer described in Table 1 for ORF 919 was used to locate and clone ORF 919. The predicted gene 919 was cloned in pET vector and expressed in *E. coli*. The product of protein expression and purification was analyzed by SDS-PAGE. In panel A) is shown the analysis of 919-His fusion protein purification. Mice were immunized with the purified 919-His and sera were used for Western blot (panel B), FACS analysis (panel C), bactericidal assay (panel D), and ELISA assay (panel E). Symbols: M1, molecular weight marker; PP, purified protein, TP, *N. meningitidis* total protein extract; OMV, *N. meningitidis* outer membrane vesicle preparation. Arrows indicate the position of the main recombinant protein product (A) and the *N. meningitidis* immunoreactive band (B). These experiments confirm that 919 is a surface-exposed protein and that it is a useful immunogen. The hydrophilicity plots, antigenic index, and amphipatic regions of ORF 919 are provided in FIG. 10. The AMPHI program is used to predict putative T-cell epitopes (Gao et al 1989, *J. Immunol.* 143: 3007; Roberts et al. 1996, *AIDS Res Human Retroviruses* 12:593; Quakyi et al. 1992, *Scand J Immunol Suppl* 11:9). The nucleic acid sequence of ORF 919 and the amino acid sequence encoded thereby is provided in Example 1.

Example 3

Expression of ORF 279

Figure 11:
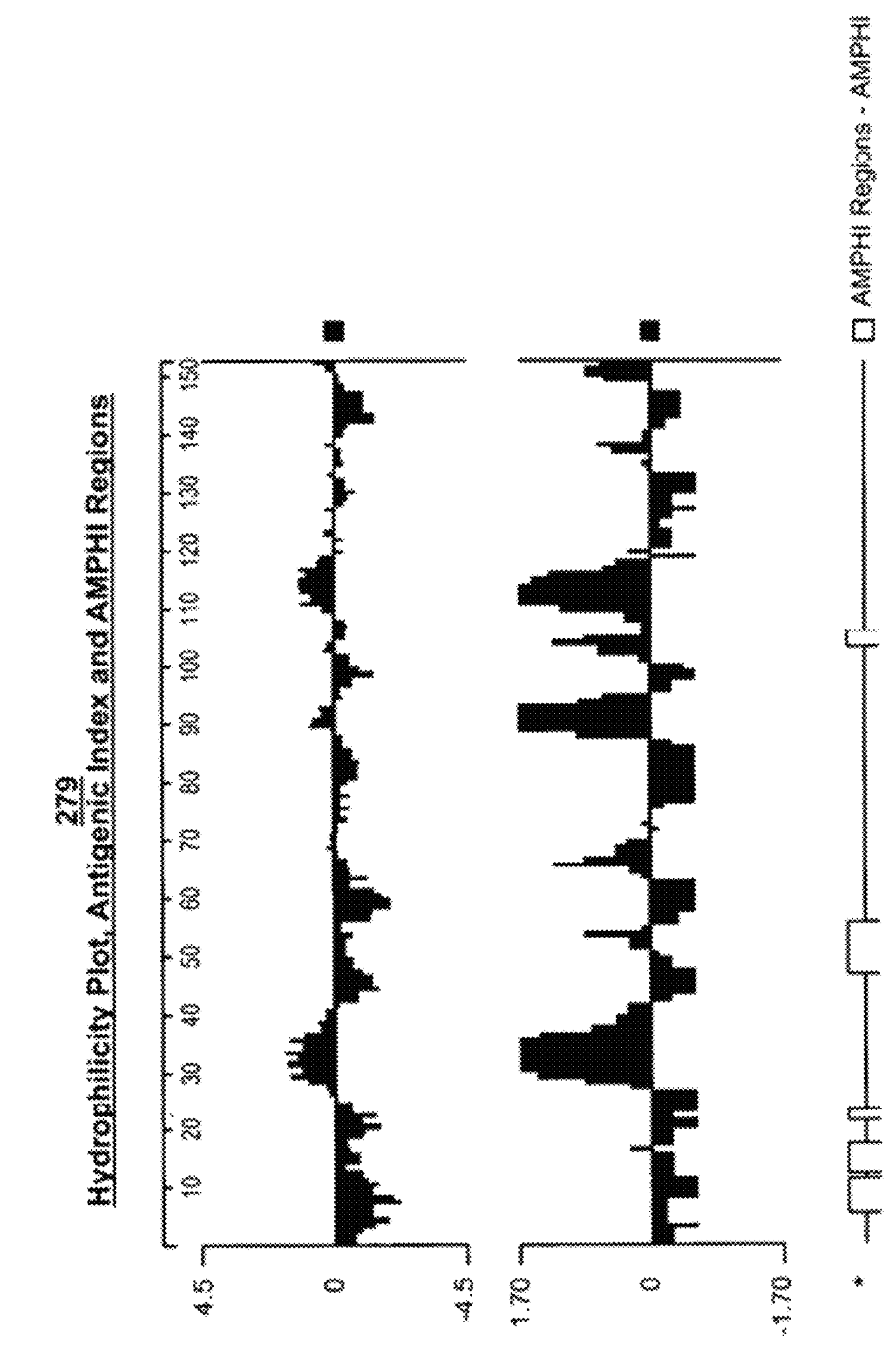
FIG. 11 illustrates the hydrophilicity plot, antigenic index and AMPHI regions of the products of protein expression the predicted ORF 279 as cloned and expressed in *E. coli.*

The primer described in Table 1 for ORF 279 was used to locate and clone ORF 279. The predicted gene 279 was cloned in pGex vector and expressed in *E. coli*. The product of protein expression and purification was analyzed by SDS-PAGE. In panel A) is shown the analysis of 279-GST purification. Mice were immunized with the purified 279-GST and sera were used for Western blot analysis (panel B), FACS analysis (panel C), bactericidal assay (panel D), and ELISA assay (panel E). Symbols: M1, molecular weight marker; TP, *N. meningitidis* total protein extract; OMV, *N. meningitidis* outer membrane vescicle preparation. Arrows indicate the position of the main recombinant protein product (A) and the *N. meningitidis* immunoreactive band (B). These experiments confirm that 279 is a surface-exposed protein and that it is a useful immunogen. The hydrophilicity plots, antigenic index, and amphipatic regions of ORF 279 are provided in FIG. 11. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 279 and the amino acid sequence encoded thereby is provided in Example 1.

Example 4

Expression of ORF 576 and 576-1

Figure 12:
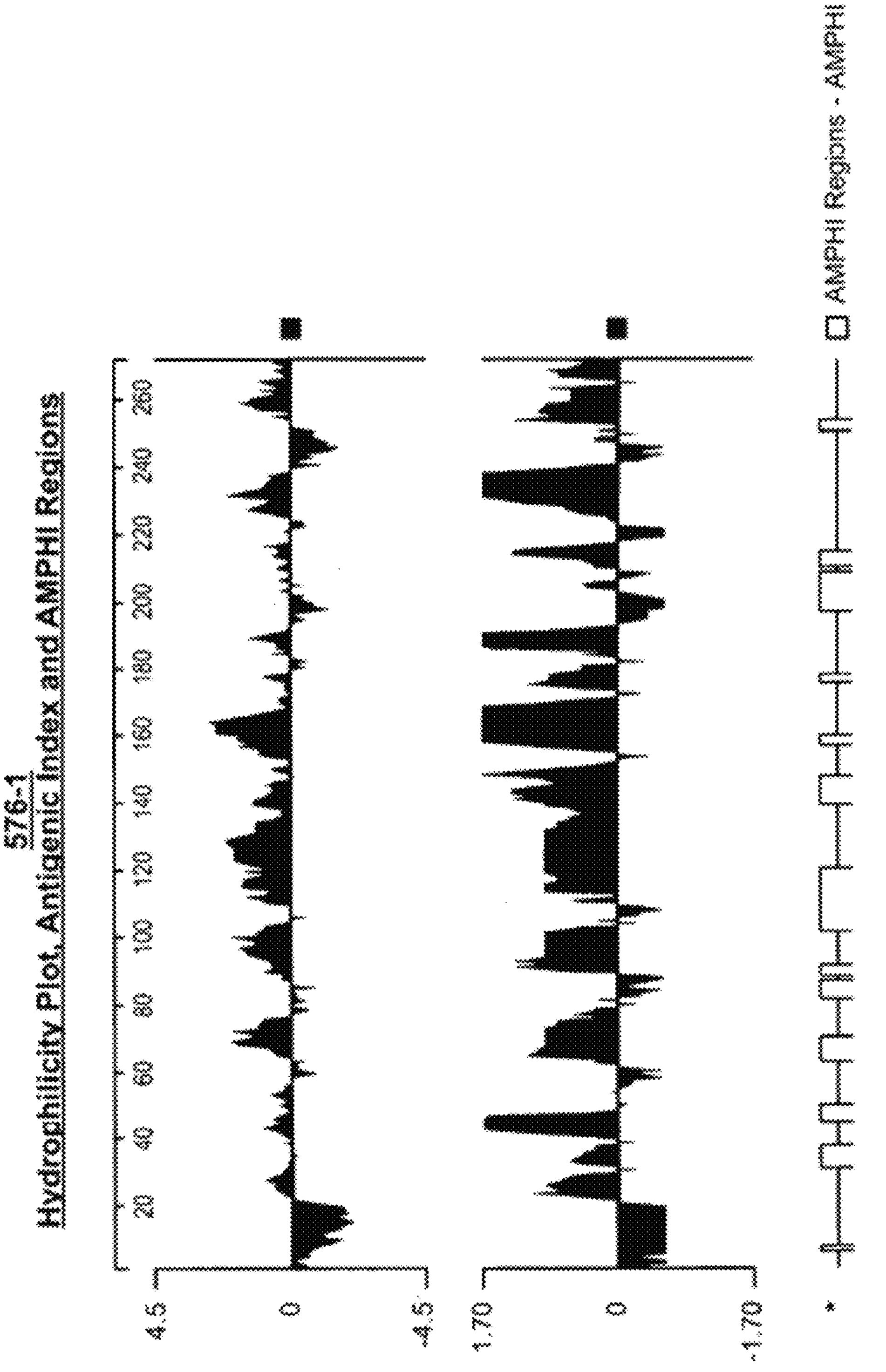
FIG. 12 illustrates the hydrophilicity plot, antigenic index and AMPHI regions of the products of protein expression the predicted ORF 576-1 as cloned and expressed in *E. coli.*

The primer described in Table 1 for ORF 576 was used to locate and clone ORF 576. The predicted gene 576 was cloned in pGex vector and expressed in *E. coli*. The product of protein purification was analyzed by SDS-PAGE. In panel A) is shown the analysis of 576-GST fusion protein purification. Mice were immunized with the purified 576-GST and sera were used for Western blot (panel B), FACS analysis (panel C), bactericidal assay (panel D), and ELISA assay (panel E). Symbols: M1, molecular weight marker; TP, *N. meningitidis* total protein extract; OMV, *N. meningitidis* outer membrane vescicle preparation. Arrows indicate the position of the main recombinant protein product (A) and the *N. meningitidis* immunoreactive band (B). These experiments confirm that ORF 576 is a surface-exposed protein and that it is a useful immunogen. The hydrophilicity plots, antigenic index, and amphipatic regions of ORF 576 are provided in FIG. 12. The AMPHI program is used to predict putative T-cell epitopes (Gao et al 1989*, J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 576 and the amino acid sequence encoded thereby is provided in Example 1.

Example 5

Expression of ORF 519 and 519-1

Figure 13:
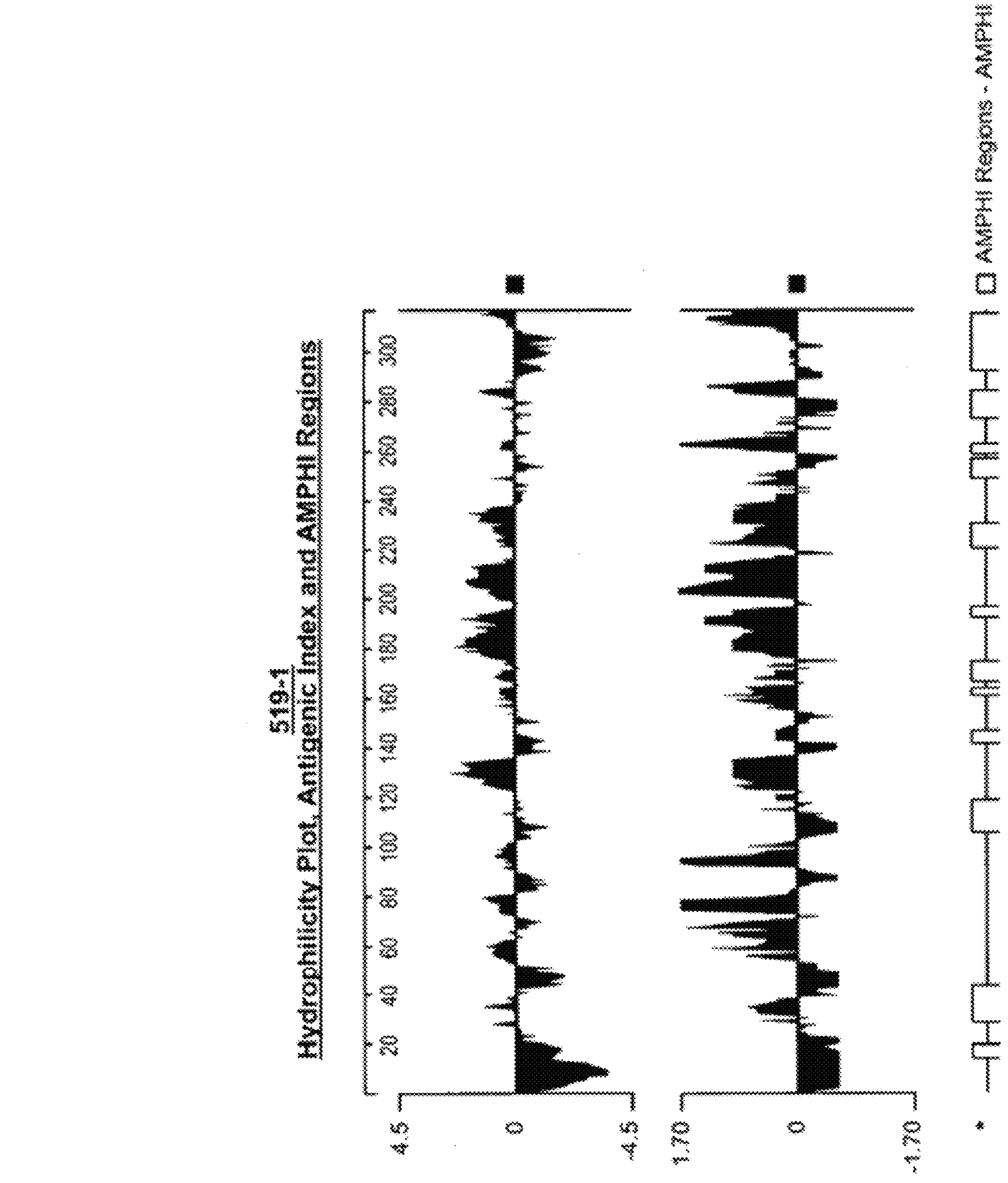
FIG. 13 illustrates the hydrophilicity plot, antigenic index and AMPHI regions of the products of protein expression the predicted ORF 519-1 as cloned and expressed in *E. coli.*

The primer described in Table 1 for ORF 519 was used to locate and clone ORF 519. The predicted gene 519 was cloned in pET vector and expressed in *E. coli*. The product of protein purification was analyzed by SDS-PAGE. In panel A) is shown the analysis of 519-His fusion protein purification. Mice were immunized with the purified 519-His and sera were used for Western blot (panel B), FACS analysis (panel C), bactericidal assay (panel D), and ELISA assay (panel E). Symbols: M1, molecular weight marker; TP, *N. meningitidis* total protein extract; OMV, *N. meningitidis* outer membrane vesicle preparation. Arrows indicate the position of the main recombinant protein product (A) and the *N. meningitidis* immunoreactive band (B). These experiments confirm that 519 is a surface-exposed protein and that it is a useful immunogen. The hydrophilicity plots, antigenic index, and amphipatic regions of ORF 519 are provided in FIG. 13. The AMPHI program is used to predict putative T-cell epitopes (Gao et al 1989*, J. Immunol* 143:3007; Roberts et al. 1996, *AIDS Res Human Retroviruses* 12:593; Quakyi et al. 1992, *Scand Immunol Suppl* 11:9). The nucleic acid sequence of ORF 519 and the amino acid sequence encoded thereby is provided in Example 1.

Example 6

Expression of ORF 121 and 121-1

Figure 14:
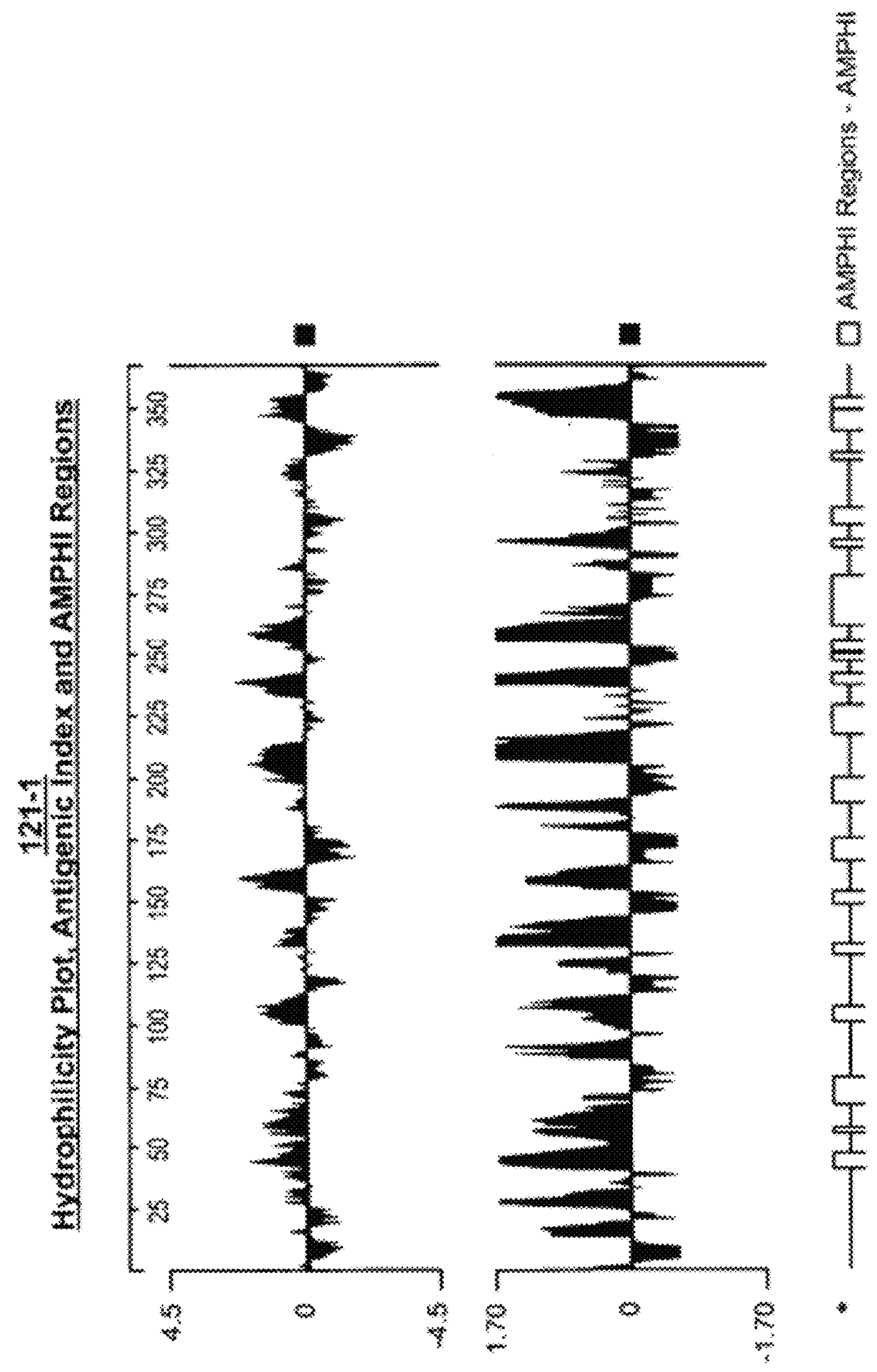
FIG. 14 illustrates the hydrophilicity plot, antigenic index and AMPHI regions of the products of protein expression the predicted ORF 121-1 as cloned and expressed in *E. coli.*

The primer described in Table 1 for ORF 121 was used to locate and clone ORF 121. The predicted gene 121 was cloned in pET vector and expressed in *E. coli*. The product of protein purification was analyzed by SDS-PAGE. In panel A) is shown the analysis of 121-His fusion protein purification. Mice were immunized with the purified 121-His and sera were used for Western blot analysis (panel B), FACS analysis (panel C), bactericidal assay (panel D), and ELISA assay (panel E). Results show that 121 is a surface-exposed protein. Symbols: M1, molecular weight marker; TP, *N. meningitidis* total protein extract; OMV, *N. meningitidis* outer membrane vescicle preparation. Arrows indicate the position of the main recombinant protein product (A) and the *N. meningitidis* immunoreactive band (B). These experiments confirm that 121 is a surface-exposed protein and that it is a useful immunogen. The hydrophilicity plots, antigenic index, and amphipatic regions of ORF 121 are provided in FIG. 14. The AMPHI program is used to predict putative T-cell epitopes (Gao et al 1989*, J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 121 and the amino acid sequence encoded thereby is provided in Example 1.

Example 7

Expression of ORF 128 and 128-1

Figure 15:
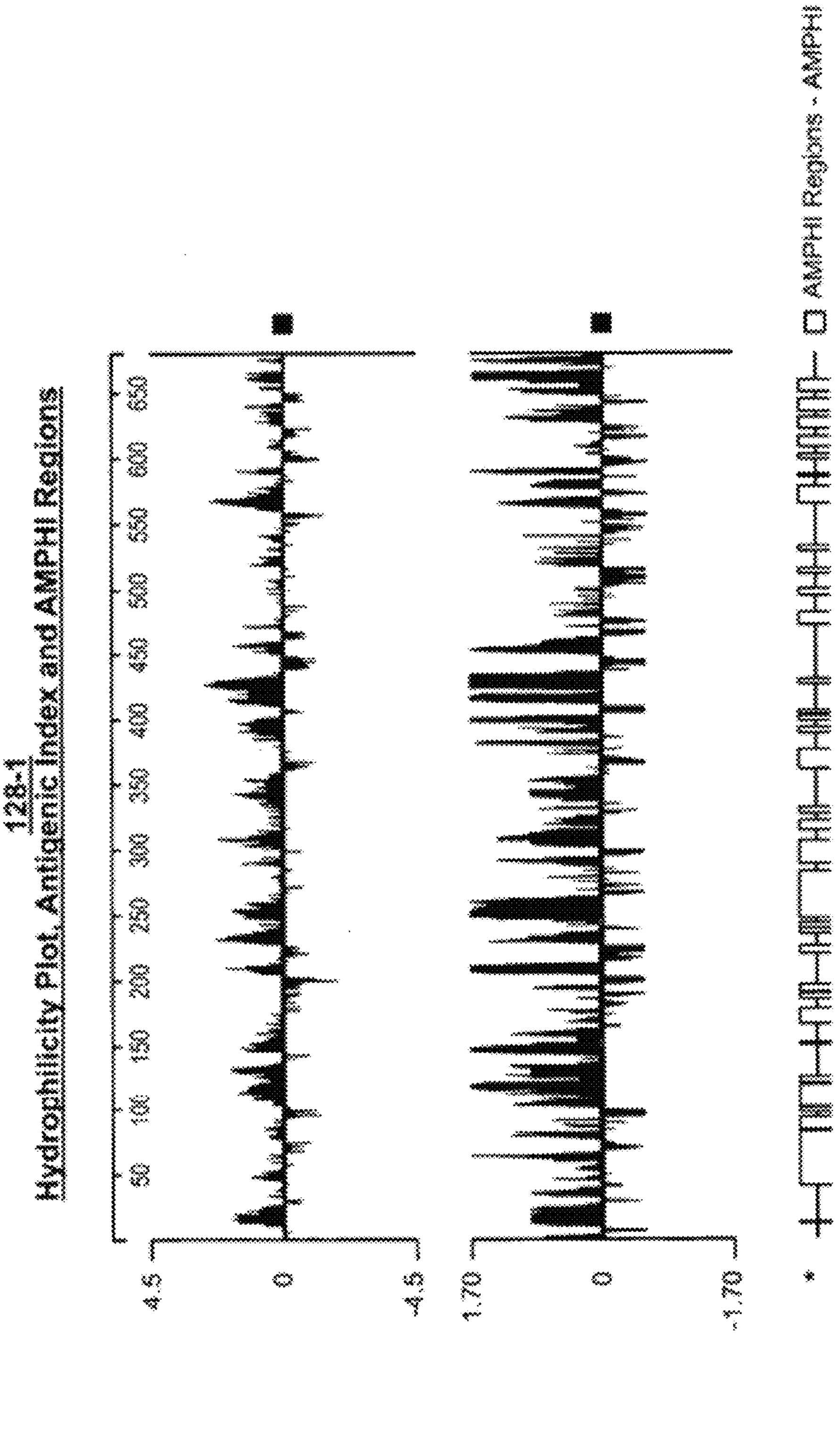
FIG. 15 illustrates the hydrophilicity plot, antigenic index and AMPHI regions of the products of protein expression the predicted ORF 128-1 as cloned and expressed in *E. coli.*

The primer described in Table 1 for ORF 128 was used to locate and clone ORF 128. The predicted gene 128 was cloned in pET vector and expressed in *E. coli*. The product of protein purification was analyzed by SDS-PAGE. In panel A) is shown the analysis of 128-His purification. Mice were immunized with the purified 128-His and sera were used for Western blot analysis (panel B), FACS analysis (panel C), bactericidal assay (panel D) and ELISA assay (panel E). Results show that 128 is a surface-exposed protein. Symbols: M1, molecular weight marker; TP, *N. meningitidis* total protein extract; OMV, *N. meningitidis* outer membrane vesicle preparation. Arrows indicate the position of the main recombinant protein product (A) and the *N. meningitidis* immunoreactive band (B). These experiments confirm that 128 is a surface-exposed protein and that it is a useful immunogen. The hydrophilicity plots, antigenic index, and amphipatic regions of ORF 128 are provided in FIG. 15. The AMPHI program is used to predict putative T-cell epitopes (Gao et al 1989*, J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 128 and the amino acid sequence encoded thereby is provided in Example 1.

Example 8

Expression of ORF 206

Figure 16:
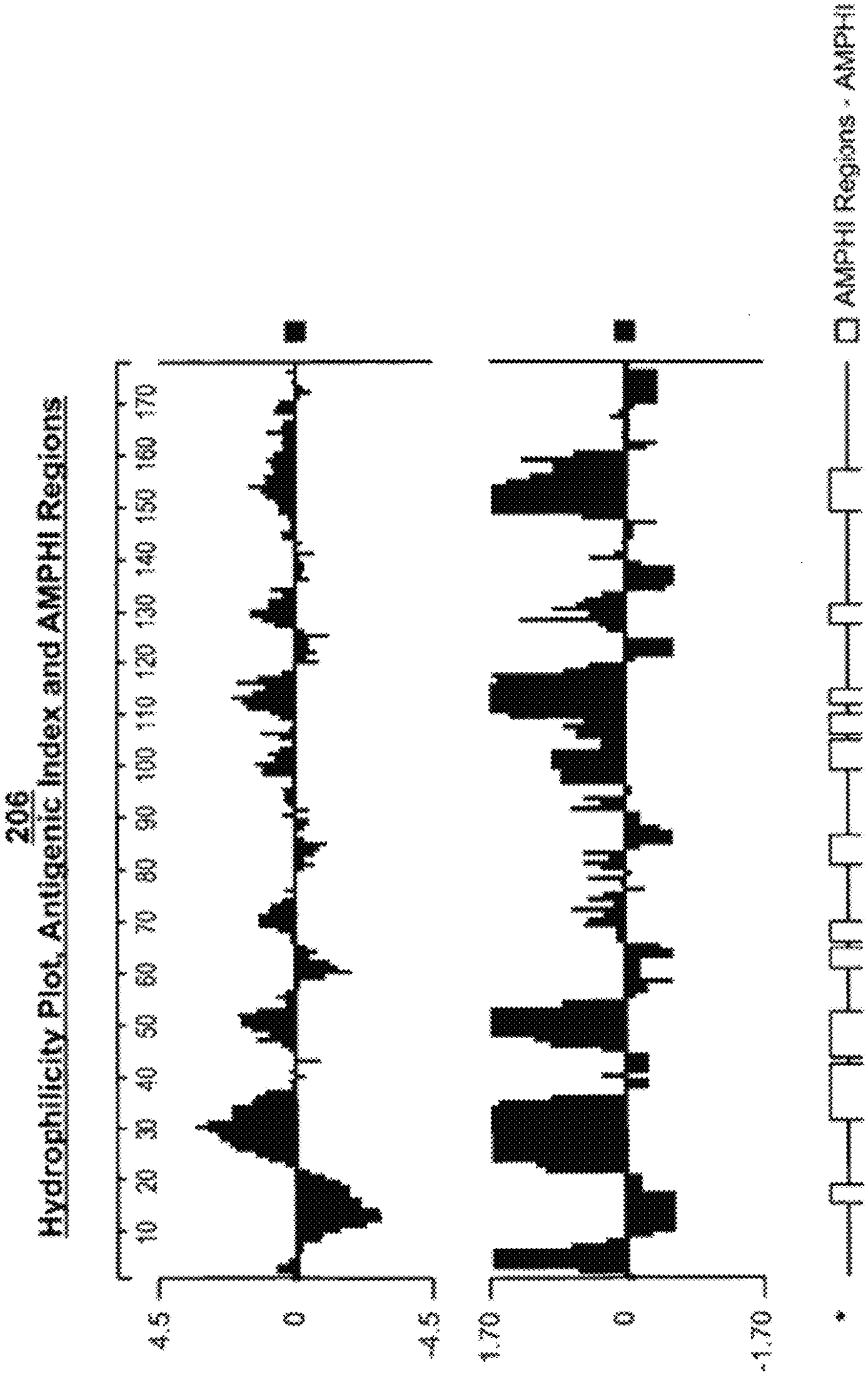
FIG. 16 illustrates the hydrophilicity plot, antigenic index and AMPHI regions of the products of protein expression the predicted ORF 206 as cloned and expressed in *E. coli.*

The primer described in Table 1 for ORF 206 was used to locate and clone ORF 206. The predicted gene 206 was cloned in pET vector and expressed in *E. coli*. The product of protein purification was analyzed by SDS-PAGE. In panel A) is shown the analysis of 206-His purification. Mice were immunized with the purified 206-His and sera were used for Western blot analysis (panel B). It is worthnoting that the immunoreactive band in protein extracts from meningococcus is 38 kDa instead of 17 kDa (panel A). To gain information on the nature of this antibody staining we expressed ORF 206 in *E. coli* without the His-tag and including the predicted leader peptide. Western blot analysis on total protein extracts from *E. coli* expressing this native form of the 206 protein showed a reactive band at a position of 38 kDa, as observed in meningococcus. We conclude that the 38 kDa band in panel B) is specific and that anti-206 antibodies, likely recognize a multimeric protein complex. In panel C is shown the FACS analysis, in panel D the bactericidal assay, and in panel E) the ELISA assay. Results show that 206 is a surface-exposed protein. Symbols: M1, molecular weight marker; TP, *N. meningitidis* total protein extract; OMV, *N. meningitidis* outer membrane vesicle preparation. Arrows indicate the position of the main recombinant protein product (A) and the *N. meningitidis* immunoreactive band (B). These experiments confirm that 206 is a surface-exposed protein and that it is a useful immunogen. The hydrophilicity plots, antigenic index, and amphipatic regions of ORF 519 are provided in FIG. 16. The AMPHI program is used to predict putative T-cell epitopes (Gao et al 1989*, J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 206 and the amino acid sequence encoded thereby is provided in Example 1.

Example 9

Expression of ORF 287

Figure 17:
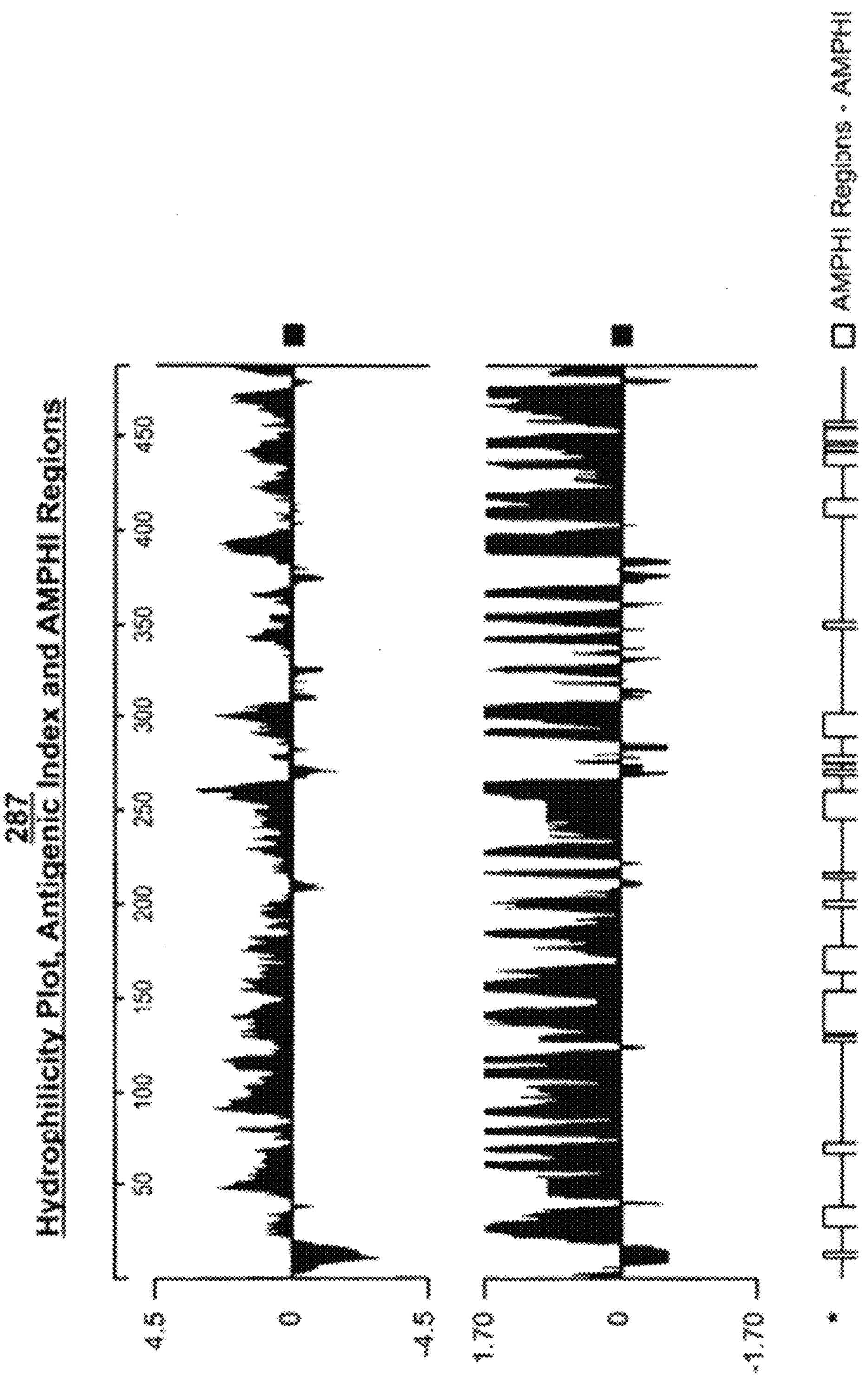
FIG. 17 illustrates the hydrophilicity plot, antigenic index and AMPHI regions of the products of protein expression the predicted ORF 287 as cloned and expressed in *E. coli.*

The primer described in Table 1 for ORF 287 was used to locate and clone ORF 287. The predicted gene 287 was cloned in pGex vector and expressed in *E. coli*. The product of protein purification was analyzed by SDS-PAGE. In panel A) is shown the analysis of 287-GST fusion protein purification. Mice were immunized with the purified 287-GST and sera were used for FACS analysis (panel B), bactericidal assay (panel C), and ELISA assay (panel D). Results show that 287 is a surface-exposed protein. Symbols: M1, molecular weight marker. Arrow indicates the position of the main recombinant protein product (A). These experiments confirm that 287 is a surface-exposed protein and that it is a useful immunogen. The hydrophilicity plots, antigenic index, and amphipatic regions of ORF 287 are provided in FIG. 17. The AMPHI program is used to predict putative T-cell epitopes (Gao et al 1989*, J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 287 and the amino acid sequence encoded thereby is provided in Example 1.

Example 10

Expression of ORF 406

Figure 18:
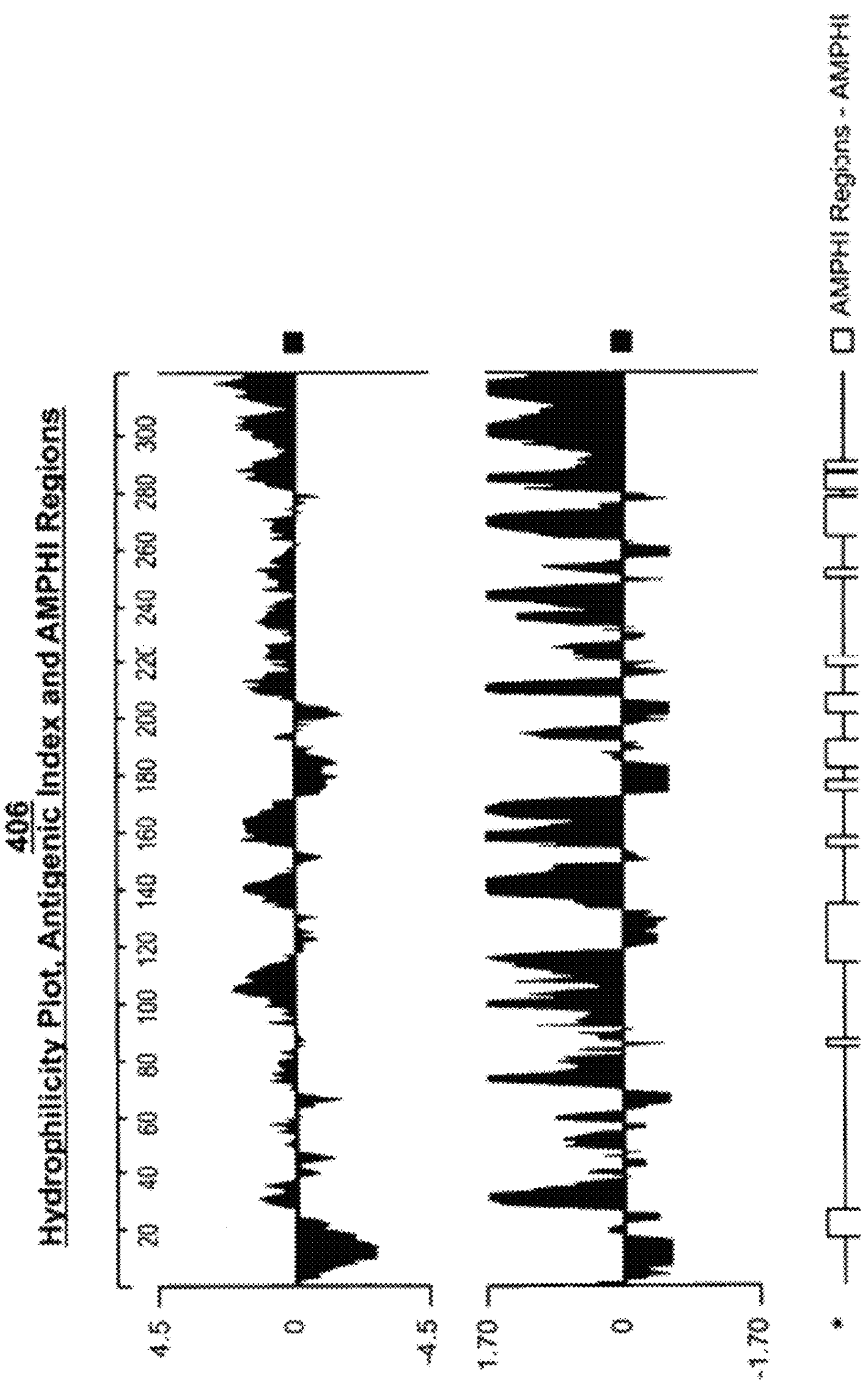
FIG. 18 illustrates the hydrophilicity plot, antigenic index and AMPHI regions of the products of protein expression the predicted ORF 406 as cloned and expressed in *E. coli.*

The primer described in Table 1 for ORF 406 was used to locate and clone ORF 406. The predicted gene 406 was cloned in pET vector and expressed in *E. coli*. The product of protein purification was analyzed by SDS-PAGE. In panel A) is shown the analysis of 406-His fusion protein purification. Mice were immunized with the purified 406-His and sera were used for Western blot analysis (panel B), FACS analysis (panel C), bactericidal assay (panel D), and ELISA assay (panel E). Results show that 406 is a surface-exposed protein. Symbols: M1, molecular weight marker; TP, *N. meningitidis* total protein extract; OMV, *N. meningitidis* outer membrane vescicle preparation. Arrows indicate the position of the main recombinant protein product (A) and the *N. meningitidis* immunoreactive band (B). These experiments confirm that 406 is a surface-exposed protein and that it is a useful immunogen. The hydrophilicity plots, antigenic index, and amphipatic regions of ORF 406 are provided in FIG. 18. The AMPHI program is used to predict putative T-cell epitopes (Gao et al 1989*, J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 406 and the amino acid sequence encoded thereby is provided in Example 1.

Example 11

Table 2 lists several *Neisseria* strains which were used to assess the conservation of the sequence of ORF 225 among different strains.

TABLE 2

225 gene variability: List of used *Neisseria* strains

| Identification Strains number | Source/reference |
|---|---|
| Group B | |
| zo01__225 NG6/88 | R. Moxon/Seiler et al., 1996 |
| zo02__225 BZ198 | R. Moxon/Seiler et al., 1996 |
| zo03__225 NG3/88 | R. Moxon/Seiler et al., 1996 |
| zo04__225 297-0 | R. Moxon/Seiler et al., 1996 |
| zo05__225 1000 | R. Moxon/Seiler et al., 1996 |
| zo06__225 BZ147 | R. Moxon/Seiler et al., 1996 |
| zo07__225 BZ169 | R. Moxon/Seiler et al., 1996 |
| zo08__225 528 | R. Moxon/Seiler et al., 1996 |
| zo09__225 NGP165 | R. Moxon/Seiler et al., 1996 |
| zo10__225 BZ133 | R. Moxon/Seiler et al., 1996 |
| zo11__225 NGE31 | R. Moxon/Seiler et al., 1996 |
| zo12__225 NGF26 | R. Moxon/Seiler et al., 1996 |
| zo13__225 NGE28 | R. Moxon/Seiler et al., 1996 |
| zo14__225 NGH38 | R. Moxon/Seiler et al., 1996 |
| zo15__225 SWZ107 | R. Moxon/Seiler et al., 1996 |
| zo16__225 NGH15 | R. Moxon/Seiler et al., 1996 |
| zo17__225 NGH36 | R. Moxon/Seiler et al., 1996 |
| zo18__225 BZ232 | R. Moxon/Seiler et al., 1996 |
| zo19__225 BZ83 | R. Moxon/Seiler et al., 1996 |
| zo20__225 44/76 | R. Moxon/Seiler et al., 1996 |
| zo21__225 MC58 | R. Moxon |
| zo96__225 2996 | Our collection |
| Group A | |
| zo22__225 205900 | R. Moxon |
| zo23__225 F6124 | R. Moxon |
| z2491 Z2491 | R. Moxon/Maiden et al., 1998 |
| Group C | |
| zo24__225 90/18311 | R. Moxon |
| zo25__225 93/4286 | R. Moxon |
| Others | |
| zo26__225 A22 (group W) | R. Moxon/Maiden et al., 1998 |
| zo27__225 E26 (group X) | R. Moxon/Maiden et al., 1998 |
| zo28__225 860800 (group Y) | R. Moxon/Maiden et al., 1998 |
| zo29__225 E32 (group Z) | R. Moxon/Maiden et al., 1998 |
| Gonococcus | |
| zo32__225 Ng F62 | R. Moxon/Maiden et al., 1998 |
| zo33__225 Ng SN4 | R. Moxon |
| fa1090 FA1090 | R. Moxon |

References:

Seiler A. et al., Mol. Microbiol., 1996, 19(4): 841-856.

Maiden et al., Proc. Natl. Acad. Sci. USA, 1998, 95: 3140-3145.

The amino acid sequences for each listed strain are as follows:

```
>FA1090
                                                 <SEQ ID 3115>
MDSFFKPAVWAVLWLMFAVRPALADELTNLLSSREQILRQFAEDEQPVLPVNRAPARRAG

NADELIGSAMGLNEQPVLPVNRAPARRAGNADELIGSAMGLLGIAYRYGGTSVSTGFDCS

GFMQHIFKRAMGINLPRTSAEQARMGAPVARSELQPGDMVFFRTLGGSRISHVGLYIGNN

RFIHAPRTGKNIEITSLSHKYWSGKYAFARRVKKNDPSRFLN*
```

-continued

Z2491

<SEQ ID 3116>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRVPARRAGNA

DELIGNAMGLNEQPVLPVNRAPARRAGNADELIGNAMGLLGIAYRYGGTSISTGFDCSGF

MQHIFKRAMGINLPRISAEQARMGTPVARSELQPGDMVFFRTLGGSRISHVGLYIGNNRF

IHAPRTGKNIEITSLSHKYWSGKYAFARRVKKNDPSRFLN*

ZO01_225

<SEQ ID 3117>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSISTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO02_225

<SEQ ID 3118>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO03_225

<SEQ ID 3119>

MDSFFKPAVWAVLWLMFAVRLALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO04_225

<SEQ ID 3120>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO05_225

<SEQ ID 3121>

MDSFFKPAVWAVLWLMFAVRPALADELTNLLSSREQILRQFAEDEQPVLPINRAPARRAG

NADELIGSAMGLNEQPVLPVNRVPARRAGNADELIGSAMGLNEQPVLPVNRAPARRAGNA

DELIGNAMGLLGIAYRYGGTSISTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO06_225

<SEQ ID 3122>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

-continued

SELQPGDMVFFRTLGGSRISHVGLYIGNNRFIHAPRTGKNIEITSLSHKYWSGKYAFARR

VKKNDPSRFLN*

ZO07_225

<SEQ ID 3123>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO08_225

<SEQ ID 3124>

MDSFFKPAVWAVLWLMFAVRPALADELTNLLSSREQILRQFAEDEQPVLPINRAPARRAG

NADELIGSAMGLNEQPVLPVNRVPARRAGNADELIGSAMGLNEQPVLPVNRAPARRAGNA

DELIGNAMGLLGIAYRYGGTSISTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO09_225

<SEQ ID 3125>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSISTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO10_225

<SEQ ID 3126>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO11_225

<SEQ ID 3127>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLNEQPVLPVNRAPARRAGNADELIGNAMGLLGIAYRYGGTSVSTGFDCSGF

MQHIFKRAMGINLPRTSAEQARMGTPVARSELQPGDMVFFRTLGGSRISHVGLYIGNNRF

IHAPRTGKNIEITSLSHKYWSGKYAFARRVKKNDPSRFLN*

ZO12_225

<SEQ ID 3128>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSISTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO13_225

<SEQ ID 3129>

MDSFFKPAVWAVLWLMFAVRPALADELTNLLSSREQILRQFAEDEQPVLPVNRAPARRAG

NADELIGSAMGLNEQPVLPVNRVPARRAGNADELIGNAMGLNEQPVLPVNRAPARRAGNA

-continued

DELIGNAMGLLGIAYRYGGTSVSTGFDCSGFIQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO14_225

<SEQ ID 3130>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO15_225

<SEQ ID 3131>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLLGIAYRYGGTSVSTGFDCS

GFMQHIFKRAMGINLPRTSAEQARMGTPVARSELQPGDMVFFRTLGGSRISHVGLYIGNN

RFIHAPRTGKNIEITSLSHKYWSGKYAFARRVKKNDPSRFLN*

ZO16_225

<SEQ ID 3132>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO17_225

<SEQ ID 3133>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO18_225

<SEQ ID 3134>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO19_225

<SEQ ID 3135>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

-continued

ZO20_225

<SEQ ID 3136>

MDSFFKPAVWAVLWLMFAVRPALADELTNLLSSREQILRQFAEDEQPVLPINRAPARRAG

NADELIGSAMGLNEQPVLPINRAPARRAGNADELIGSAMGLNEQPVLPVNRVPARRAGNA

DELIGNAMGLNEQPVLPVNRAPARRAGNADELIGNAMGLLGIAYRYGGTSVSTGFDCSGF

MQHIFKRAMGINLPRTSAEQARMGTPVARSELQPGDMVFFRTLGGSRISHVGLYIGNNRF

IHAPRTGKNIEITSLSHKYWSGKYAFARRVKKNDPSRFLN*

ZO21_225

<SEQ ID 3137>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO22_225

<SEQ ID 3138>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSISTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO23_225

<SEQ ID 3139>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSISTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO24_225

<SEQ ID 3140>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSISTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO25_225

<SEQ ID 3141>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSISTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO26_225

<SEQ ID 3142>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSISTGFDCSGFMQHIFKRAMGINLPRTSAEQARMGTPVAR

-continued

SELQPGDMVFFRTLGGSRISHVGLYIGNNRFIHAPRTGKNIEITSLSHKYWSGKYAFARR

VKKNDPSRFLN*

ZO27_225

<SEQ ID 3143>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO28_225

<SEQ ID 3144>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO29_225

<SEQ ID 3145>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO32_225

<SEQ ID 3146>

MDSFFKPAVWAVLWLMFAVRPALADELTNLLSSREQILRQFAEDEQPVLPVNRAPARRAG

NADELIGSAMGLNEQPVLPVNRAPARRAGNADELIGSAMGLLGIAYRYGGTSVSTGFDCS

GFMQHIFKRAMGINLPRTSAEQARMGAPVARSELQPGDMVFFRTLGGSRISHVGLYIGNN

RFIHAPRTGKNIEITSLSHKYWSGKYAFARRVKKNDPSRFLN*

ZO33_225

<SEQ ID 3147>

MDSFFKPAVWAVLWLMFAVRSALADELTNLLSSREQILRQFAEDEQPVLPVNRAPARRAG

NADELIGSAMGLNEQPVLPVNRAPARRAGNADELIGSAMGLLGIAYRYGGTSVSTGFDCS

GFMQHIFKRAMGINLPRTSAEQARMGAPVARSELQPGDMVFFRTLGGSRISHVGLYIGNN

RFIHAPRTGKNIEITSLSHKYWSGKYAFARRIKKNDPSRFLN*

ZO96_225

<SEQ ID 3148>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSISTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

Figure 19A:
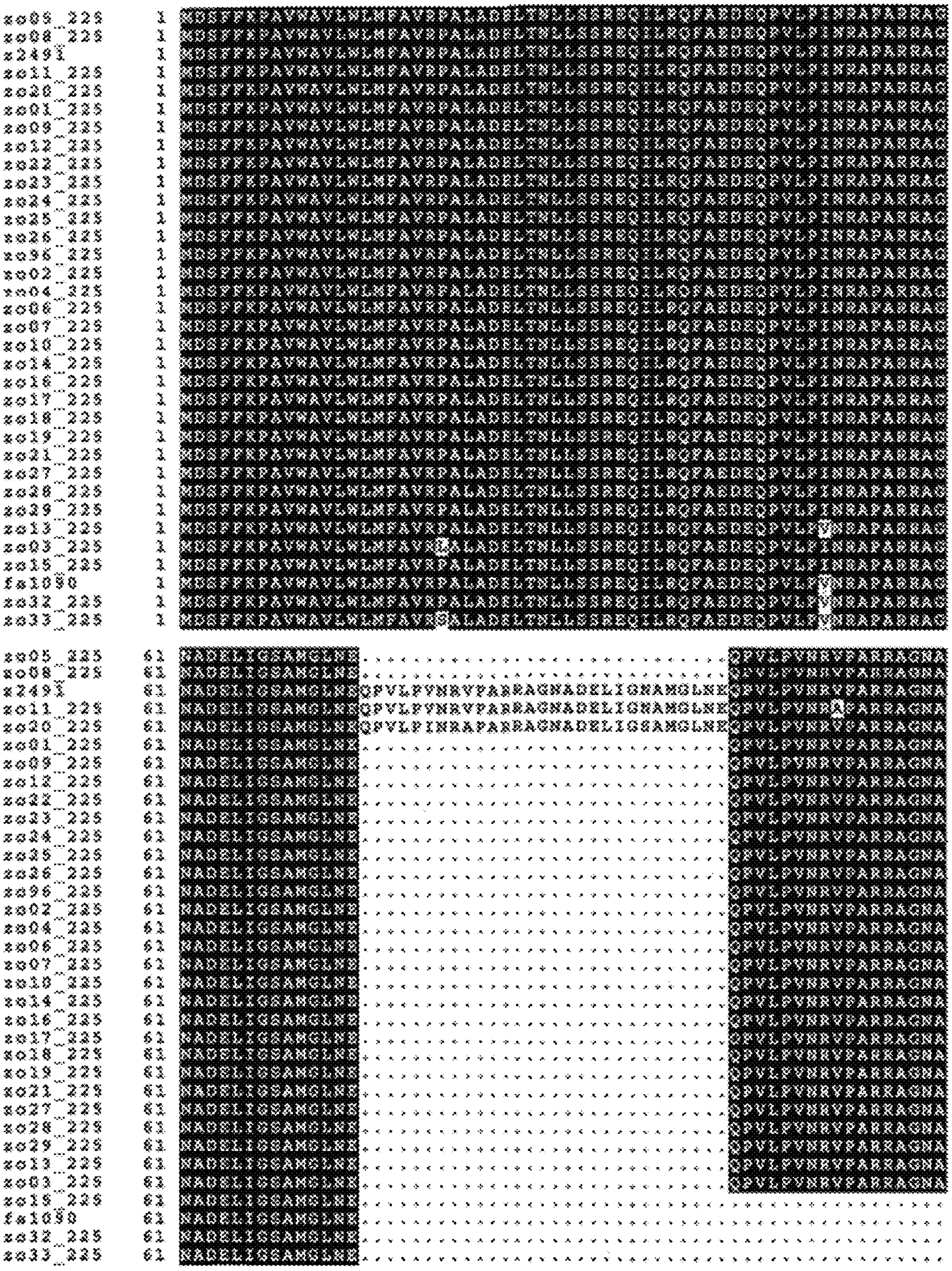
Figure 19C:
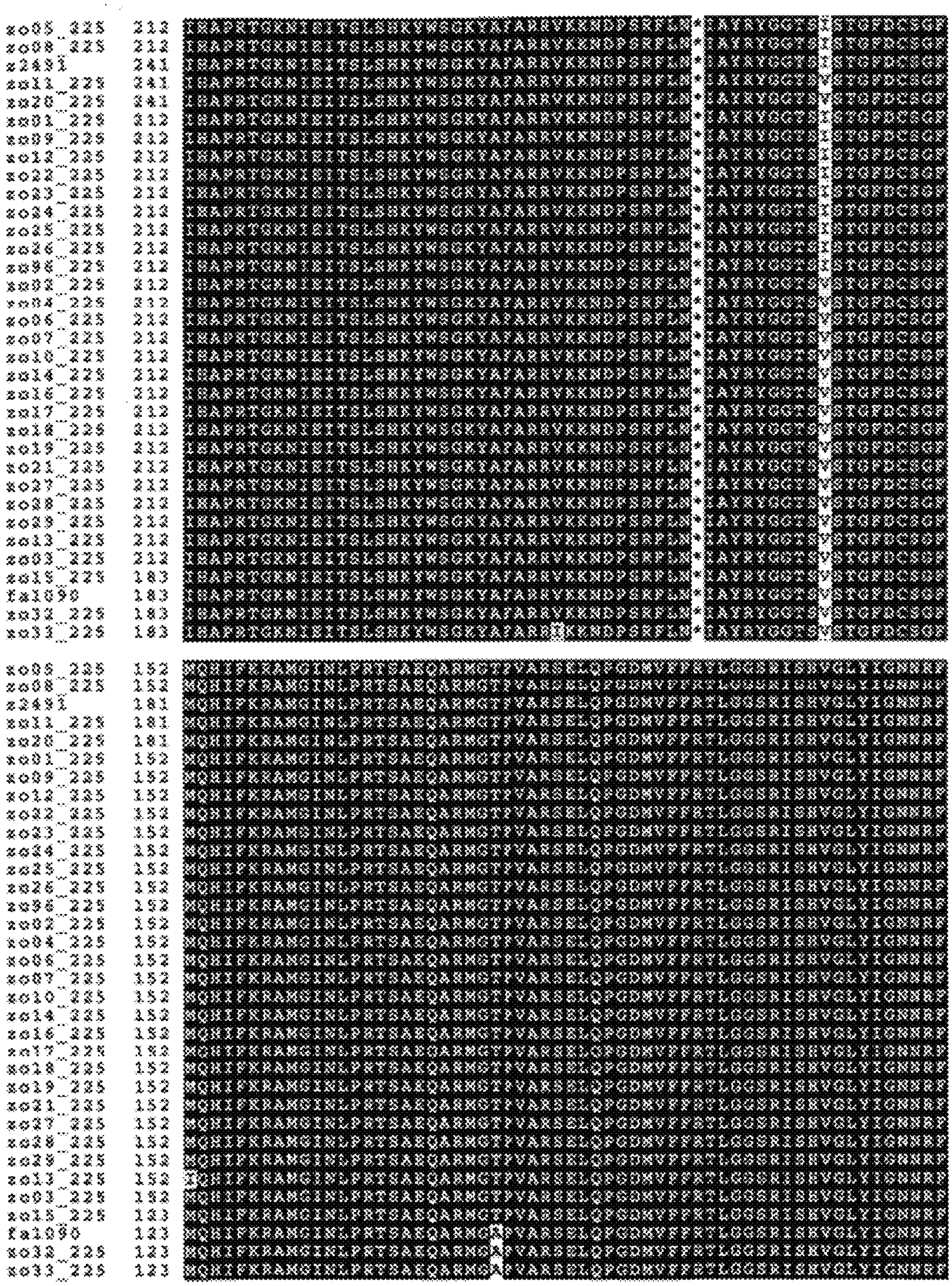

FIG. 19 shows the results of aligning the sequences of each of these strains. Dark shading indicates regions of homology, and gray shading indicates the conservation of amino acids with similar characteristics. As is readily discernible, there is significant conservation among the various strains of ORF 225, further confirming its utility as an antigen for both vaccines and diagnostics.

Example 12

Table 3 lists several *Neisseria* strains which were used to assess the conservation of the sequence of ORF 235 among different strains.

TABLE 3

235 gene variability: List of used *Neisseria* strains

| Identification Strains number | Reference |
|---|---|
| Group B | |
| gnmzq01 NG6/88 | Seiler et al., 1996 |
| gnmzq02 BZ198 | Seiler et al., 1996 |
| gnmzq03 NG3/88 | Seiler et al., 1996 |
| gnmzq04 1000 | Seiler et al., 1996 |
| gnmzq05 1000 | Seiler et al., 1996 |
| gnmzq07 BZ169 | Seiler et al., 1996 |
| gnmzq08 528 | Seiler et al., 1996 |
| gnmzq09 NGP165 | Seiler et al., 1996 |
| gnmzq10 BZ133 | Seiler et al., 1996 |
| gnmzq11 NGE31 | Seiler et al., 1996 |
| gnmzq13 NGE28 | Seiler et al., 1996 |
| gnmzq14 NGH38 | Seiler et al., 1996 |
| gnmzq15 SWZ107 | Seiler et al., 1996 |
| gnmzq16 NGH15 | Seiler et al., 1996 |
| gnmzq17 NGH36 | Seiler et al., 1996 |
| gnmzq18 BZ232 | Seiler et al., 1996 |
| gnmzq19 BZ83 | Seiler et al., 1996 |
| gnmzq21 MC58 | Virji et al., 1992 |
| Group A | |
| gnmzq22 205900 | Our collection |
| gnmzq23 F6124 | Our collection |
| z2491 Z2491 | Maiden et al., 1998 |
| Group C | |
| gnmzq24 90/18311 | Our collection |
| gnmzq25 93/4286 | Our collection |
| Others | |
| gnmzq26 A22 (group W) | Maiden et al., 1998 |
| gnmzq27 E26 (group X) | Maiden et al., 1998 |
| gnmzq28 860800 (group Y) | Maiden et al., 1998 |
| gnmzq29 E32 (group Z) | Maiden et al., 1998 |
| gnmzq31 *N. lactamica* | Our collection |
| Gonococcus | |
| gnmzq32 Ng F62 | Maiden et al., 1998 |
| gnmzq33 Ng SN4 | Our collection |
| fa1090 FA1090 | Dempsey et al. 1991 |

References:
Seiler A. et al., Mol. Microbiol., 1996, 19(4): 841-856.
Maiden R. et al., Proc. Natl. Acad. Sci. USA, 1998, 95: 3140-3145.
Virji M. et al., Mol. Microbiol., 1992, 6: 1271-1279
Dempsey J. F. et al., J. Bacteriol., 1991, 173: 5476-5486

The amino acid sequences for each listed strain are as follows:

FA1090

<SEQ ID 3149>

MKPLILGLAAVLALSACQVRKAPDLDYTSFKESKPASILVVPPLNESPDVNGTWGMLAST

AAPISEAGYYVFPAAVVEETFKENGLTNAADIHAVRPEKLHQIFGNDAVLYITVTEYGTS

YQILDSVTTVSAKARLVDSRNGKELWSGSASIREGSNNSNSGLLGALVGAVVNQIANSLT

DRGYQVSKTAAYNLLSPYSRNGILKGPRFVEEQPK*

GNMZQ01

<SEQ ID 3150>

MKPLILGLAAVLALSACQVQKAPDFDYTSFKESKPASILVVPPLNESPDVNGTWGVLAST

AAPLSEAGYYVFPAAVVEETFKENGLTNAADIHAVRPEKLHQIFGNDAVLYITVTEYGTS

YQILDSVTTVSAKARLVDSRNGKELWSGSASIREGSNNSNSGLLGALVSAVVNQIANNLT

DRGYQVSKTAAYNLLSPYSHNGILKGPRFVEEQPK*

GNMZQ02

<SEQ ID 3151>

MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ03

<SEQ ID 3152>

MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

-continued

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ04

<SEQ ID 3153>

MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ05

<SEQ ID 3154>

MKPLILGLAAVLALSACQVQKAPDFDYTSFKESKPASILVVPPLNESPDVNGTWGVLAST

AAPLSEAGYYVFPAAVVEETFKENGLTNAADIHAVRPEKLHQIFGNDAVLYITVTEYGTS

YQILDSVTTVSAKARLVDSRNGKELWSGSASIREGSNNSNSGLLGALVSAVVNQIANNLT

DRGYQVSKTAAYNLLSPYSHNGILKGPRFVEEQPK*

GNMZQ07

<SEQ ID 3155>

MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ08

<SEQ ID 3156>

MKPLILGLAAVLALSACQVQKAPDFDYTSFKESKPASILVVPPLNESPDVNGTWGVLAST

AAPLSEAGYYVFPAAVVEETFKENGLTNAADIHAVRPEKLHQIFGNDAVLYITVTEYGTS

YQILDSVTTVSAKARLVDSRNGKELWSGSASIREGSNNSNSGLLGALVSAVVNQIANNLT

DRGYQVSKTAAYNLLSPYSHNGILKGPRFVEEQPK*

GNMZQ09

<SEQ ID 3157>

MKPLILGLAAALVLSACQVQKAPDFDYTSFKESKPASILVVPPLNESPDVNGTWGMLAST

AEPLSEAGYYVFPAAVVEETFKQNGLTNAADIHAVQPEKLHQIFGNDAVLYITITEYGTS

YQILDSVTTVSARARLVDSRNGKVLWSGSASIREGSNNSNSGLLGALVSAVVNQIANSLT

DRGYQVSKTAAYNLLSPYSHNGILKGPRFVEEQPK*

GNMZQ10

<SEQ ID 3158>

MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ11

<SEQ ID 3159>

MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ13

<SEQ ID 3160>

MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

-continued

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ14

<SEQ ID 3161>

MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVGAVVNQIANSLT

DRGYQVSKTAAYNLLSPYSHNGILKGPRFVEEQPK*

GNMZQ15

<SEQ ID 3162>

MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ16

<SEQ ID 3163>

MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ17

<SEQ ID 3164>

MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ18

<SEQ ID 3165>

MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVGAVVNQIANSLT

DRGYQVSKTAAYNLLSPYSHNGILKGPRFVEEQPK*

GNMZQ19

<SEQ ID 3166>

MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ21

<SEQ ID 3166>

MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ22

<SEQ ID 3167>

MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

-continued

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ23

<SEQ ID 3168>

MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ24

<SEQ ID 3169>

MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ25

<SEQ ID 3170>

MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ26

<SEQ ID 3171>

MKPLILGLAAVLALSACQVQKAPDFDYTSFKESKPASILVVPPLNESPDVNGTWGMLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVGAVVNQIANSLT

DRGYQVSKTAAYNLLSPYSHNGILKGPRFVEEQPK*

GNMZQ27

<SEQ ID 3172>

MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ28

<SEQ ID 3173>

MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ29

<SEQ ID 3174>

MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ31

<SEQ ID 3175>

MKPLILGLAAVLALSACQVQKAPDFDYTAFKESKPASILVVPPLNESPDVNGTWGMLAST

AEPLSEAGYYVFPAAVVEETFKQNGLTNAADIHAVRPEKLHQIFGNDAVLYITITEYGTS

-continued

YQILDSVTTVSARARLVDSRNGKVLWSGSASIREGSNNSNSGLLGALVGAVVNQIANSLT

DRGYQVSKAAAYDLLSPYSHNGILKGPRFVEEQPK*

GNMZQ32

<SEQ ID 3176>

MKPLILGLAAVLALSACQVRKAPDLDYTSFKESKPASILVVPPLNESPDVNGTWGMLAST

AAPISEAGYYVFPAAVVEETFKENGLTNAADIHAVRPEKLHQIFGNDAVLYITVTEYGTS

YQILDSVTTVSAKARLVDSRNGKELWSGSASIREGSNNSNSGLLGALVGAVVNQIANSLT

DRGYQVSKTAAYNLLSPYSRNGILKGPRFVEEQPK*

GNMZQ33

<SEQ ID 3177>

MKPLILGLAAVLALSACQVRKAPDLDYTSFKESKPASILVVPPLNESPDVNGTWGMLAST

AAPISEAGYYVFPAAVVEETFKENGLTNAADIHAVRPEKLHQIFGNDAVLYITVTEYGTS

YQILDSVTTVSAKARLVDSRNGKELWSGSASIREGSNNSNSGLLGALVGAVVNQIANSLT

DRGYQVSKTAAYNLLSPYSRNGILKGPRFVEEQPK*

Z2491

<SEQ ID 3178>

MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

Figure 20A:
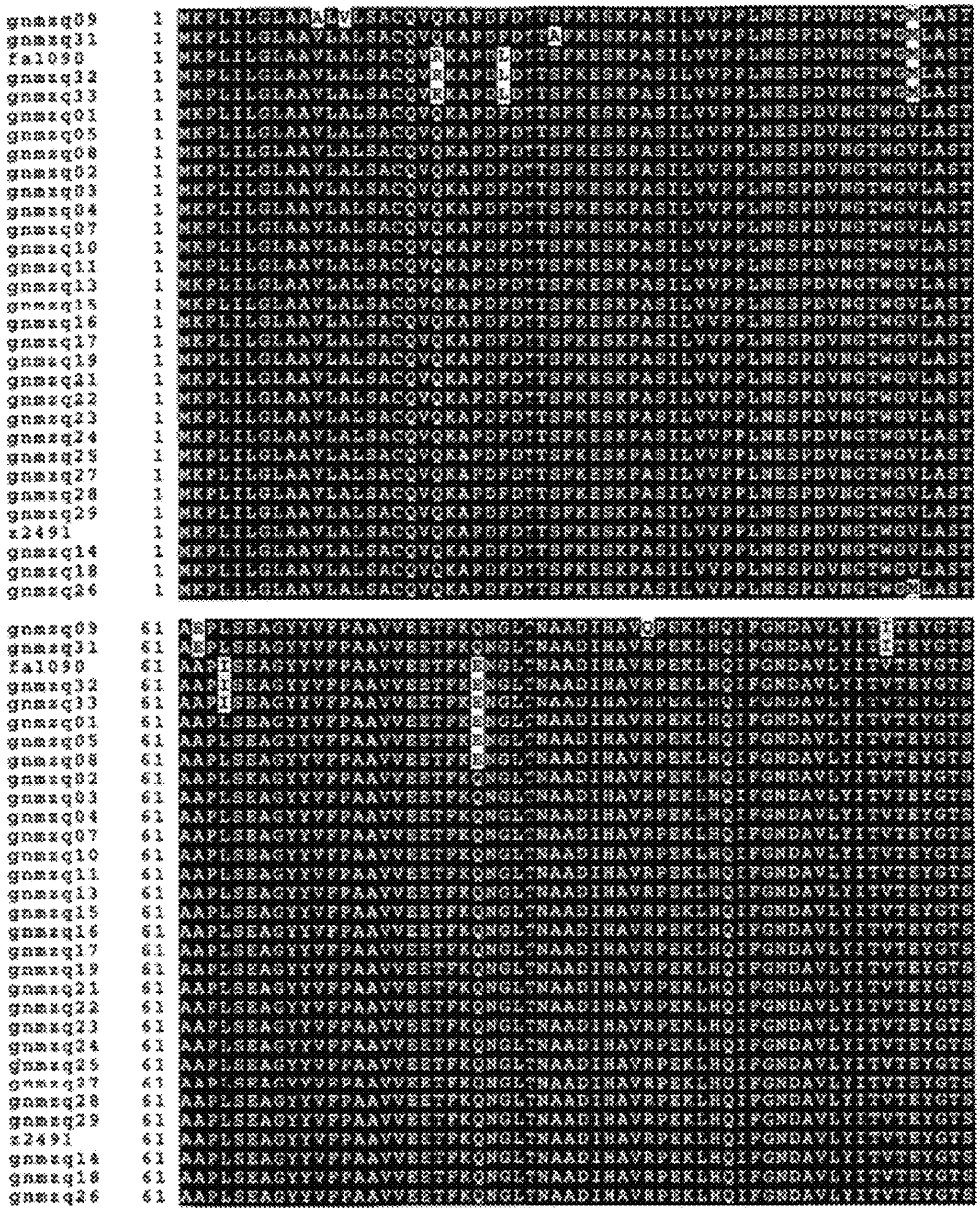
FIG. 20A-B shows an alignment comparison of amino acid sequences for ORF 235 for several strains of *Neisseria*. Dark shading indicates regions of homology, and gray shading indicates the conservation of amino acids with similar characteristics. The Figure demonstrates a high degree of conservation among the various strains, further confirming its utility as an antigen for both vaccines and diagnostics. The sequences in the Figure have the following SEQ ID NOs: FA1090 SEQ ID 3149; GNMZQ01 SEQ ID 3150; GNMZQ02 SEQ ID 3151; GNMZQ03 SEQ ID 31521; GNMZQ04 SEQ ID 3153; GNMZQ05 SEQ ID 3154; GNMZQ07 SEQ ID 3155; GNMZQ08 SEQ ID 3156; GNMZQ09 SEQ ID 3157; GNMZQ10 SEQ ID 3158; GNMZQ11 SEQ ID 3159; GNMZQ13 SEQ ID 3160; GNMZQ14 SEQ ID 3161; GNMZQ15 SEQ ID 3162; GNMZQ16 SEQ ID 3163; GNMZQ17 SEQ ID 3164; GNMZQ18 SEQ ID 3165; GNMZQ19 SEQ ID 3166; GNMZQ21 SEQ ID 3166; GNMZQ22 SEQ ID 3167; GNMZQ23 SEQ ID 3168; GNMZQ24 SEQ ID 3169; GNMZQ25 SEQ ID 3170; GNMZQ26 SEQ ID 3171; GNMZQ27 SEQ ID 3172; GNMZQ28 SEQ ID 3173; GNMZQ29 SEQ ID 3174; GNMZQ31 SEQ ID 3175; GNMZQ32 SEQ ID 3176; GNMZQ33 SEQ ID 3177; and Z2491 SEQ ID 3178.
Figure 20B:
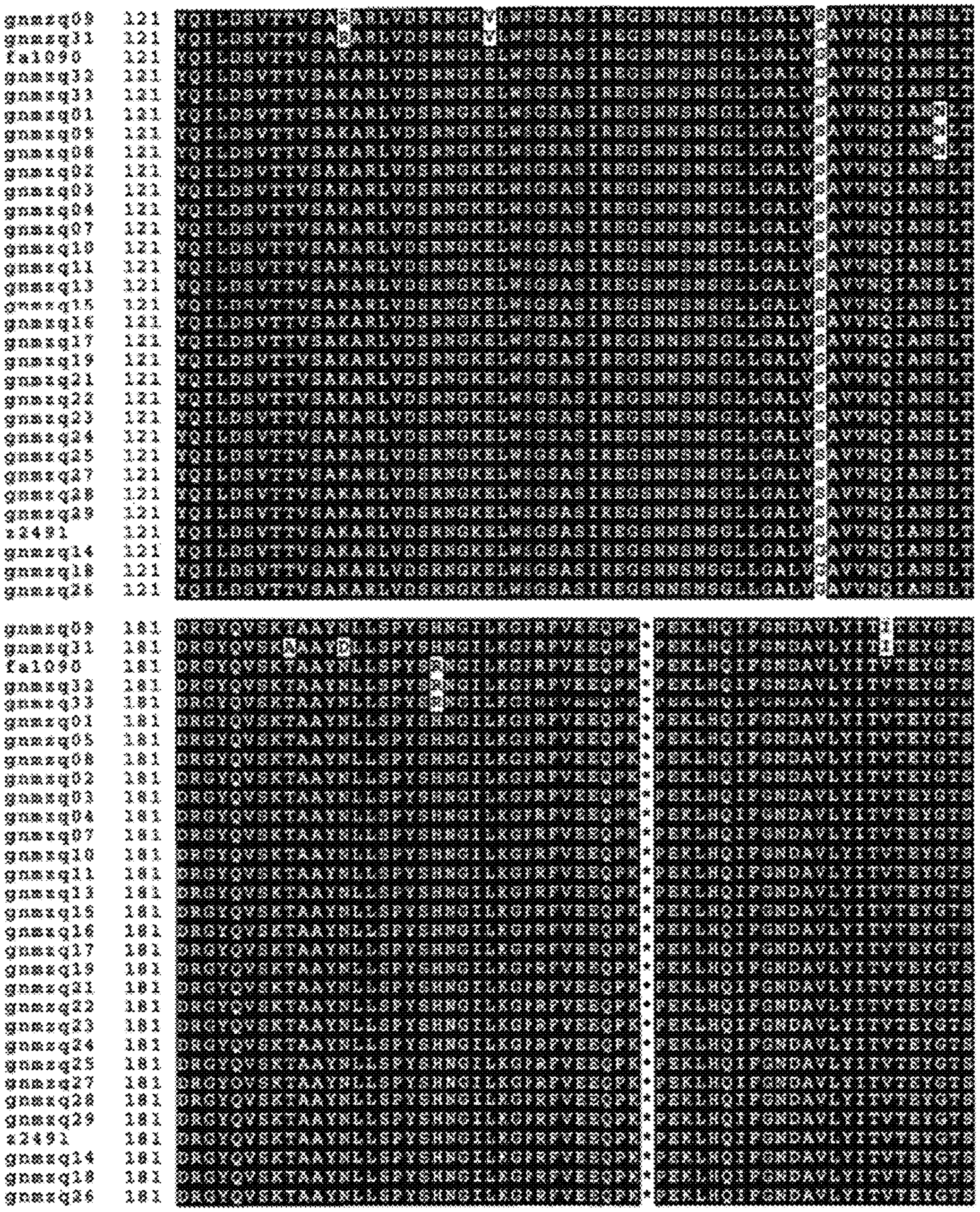

FIG. 20 shows the results of aligning the sequences of each of these strains. Dark shading indicates regions of homology, and gray shading indicates the conservation of amino acids with similar characteristics. As is readily discernible, there is significant conservation among the various strains of ORF 235, further confirming its utility as an antigen for both vaccines and diagnostics.

Example 13

Table 4 lists several *Neisseria* strains which were used to assess the conservation of the sequence of ORF 287 among different strains.

TABLE 4

287 gene variability: List of used *Neisseria* strains

| Identification Strains number | Reference |
|---|---|
| Group B | |
| 287_2 BZ198 | Seiler et al., 1996 |
| 287_9 NGP165 | Seiler et al., 1996 |
| 287_14 NGH38 | Seiler et al., 1996 |
| 287_21 MC58 | Virji et al., 1992 |
| Group A | |
| z2491 Z2491 | Maiden et al., 1998 |
| Gonococcus | |
| fa1090 FA1090 | Dempsey et al. 1991 |

References:
Seiler A. et al., Mol. Microbiol., 1996, 19(4): 841-856.
Maiden R. et al., Proc. Natl. Acad. Sci. USA, 1998, 95: 3140-3145.
Virji M. et al., Mol. Microbiol., 1992, 6: 1271-1279
Dempsey J. F. et al., J. Bacteriol., 1991, 173: 5476-5486

The amino acid sequences for each listed strain are as follows:

287_14

<SEQ ID 3179>

MFKRSVIAMACIFALSACGGGGGGSPDVKSADTLSKPAAPVVSEKETEAKEDAPQAGSQG

QGAPSAQGGQDMAAVSEENTGNGGAAATDKPKNEDEGAQNDMPQNAADTDSLTPNHTPAS

NMPAGNMENQAPDAGESEQPANQPDMANTADGMQGDDPSAGGENAGNTAAQGTNQAENNQ

TAGSQNPASSTNPSATNSGGDFGRTNVGNSVVIDGPSQNITLTHCKGDSCSGNNFLDEEV

QLKSEFEKLSDADKISNYKKDGKNDGKNDKFVGLVADSVQMKGINQYIIFYKPKPTSFAR

FRRSARSRRSLPAEMPLIPVNQADTLIVDGEAVSLTGHSGNIFAPEGNYRYLTYGAEKLP

-continued

GGSYALRVQGEPSKGEMLAGTAVYNGEVLHFHTENGRPSPSRGRFAAKVDFGSKSVDGII

DSGDGLHMGTQKFKAAIDGNGFKGTWTENGGGDVSGKFYGPAGEEVAGKYSYRPTDAEKG

GFGVFAGKKEQD*

287_2

<SEQ ID 3180>

MFKRSVIAMACIFALSACGGGGGGSPDVKSADTLSKPAAPVVSEKETEAKEDAPQAGSQG

QGAPSAQGGQDMAAVSEENTGNGGAAATDKPKNEDEGAQNDMPQNAADTDSLTPNHTPAS

NMPAGNMENQAPDAGESEQPANQPDMANTADGMQGDDPSAGGENAGNTAAQGTNQAENNQ

TAGSQNPASSTNPSATNSGGDFGRTNVGNSVVIDGPSQNITLTHCKGDSCSGNNFLDEEV

QLKSEFEKLSDADKISNYKKDGKNDGKNDKFVGLVADSVQMKGINQYIIFYKPKPTSFAR

FRRSARSRRSLPAEMPLIPVNQADTLIVDGEAVSLTGHSGNIFAPEGNYRYLTYGAEKLP

GGSYALRVQGEPSKGEMLAGTAVYNGEVLHFHTENGRPSPSRGRFAAKVDFGSKSVDGII

DSGDGLHMGTQKFKAAIDGNGFKGTWTENGGGDVSGKFYGPAGEEVAGKYSYRPTDAEKG

GFGVFAGKKEQD*

287_21.

<SEQ ID 3181>

MFKRSVIAMACIFALSACGGGGGGSPDVKSADTLSKPAAPVVSEKETEAKEDAPQAGSQG

QGAPSAQGSQDMAAVSEENTGNGGAVTADNPKNEDEVAQNDMPQNAAGTDSSTPNHTPDP

NMLAGNMENQATDAGESSQPANQPDMANAADGMQGDDPSAGGQNAGNTAAQGANQAGNNQ

AAGSSDPIPASNPAPANGGSNFGRVDLANGVLIDGPSQNITLTHCKGDSCSGNNFLDEEV

QLKSEFEKLSDADKISNYKKDGKNDKFVGLVADSVQMKGINQYIIFYKPKPTSFARFRRS

ARSRRSLPAEMPLIPVNQADTLIVDGEAVSLTGHSGNIFAPEGNYRYLTYGAEKLPGGSY

ALRVQGEPAKGEMLAGAAVYNGEVLHFHTENGRPYPTRGRFAAKVDFGSKSVDGIIDSGD

DLHMGTQKFKAAIDGNGFKGTWTENGSGDVSGKFYGPAGEEVAGKYSYRPTDAEKGGFGV

FAGKKEQD*

287_9

<SEQ ID 3182>

MFKRSVIAMACIVALSACGGGGGGSPDVKSADTLSKPAAPVVTEDVGEEVLPKEKKDEEA

VSGAPQADTQDATAGKGGQDMAAVSAENTGNGGAATTDNPENKDEGPQNDMPQNAADTDS

STPNHTPAPNMPTRDMGNQAPDAGESAQPANQPDMANAADGMQGDDPSAGENAGNTADQA

ANQAENNQVGGSQNPASSTNPNATNGGSDFGRINVANGIKLDSGSENVTLTHCKDKVCDR

DFLDEEAPPKSEFEKLSDEEKINKYKKDEQRENFVGLVADRVEKNGTNKYVIIYKDKSAS

SSSARFRRSARSRRSLPAEMPLIPVNQADTLIVDGEAVSLTGHSGNIFAPEGNYRYLTYG

AEKLSGGSYALSVQGEPAKGEMLAGTAVYNGEVLHFHMENGRPSPSGGRFAAKVDFGSKS

VDGIIDSGDDLHMGTQKFKAVIDGNGFKGTWTENGGGDVSGRFYGPAGEEVAGKYSYRPT

DAEKGGFGVFAGKKEQD*

FA1090

<SEQ ID 3183>

MFKRSVIAMACIFPLSACGGGGGGSPDVKSADTPSKPAAPVVAENAGEGVLPKEKKDEEA

AGGAPQADTQDATAGEGSQDMAAVSAENTGNGGAATTDNPKNEDAGAQNDMPQNAAESAN

QTGNNQPAGSSDSAPASNPAPANGGSDFGRTNVGNSVVIDGPSQNITLTHCKGDSCNGDN

LLDEEAPSKSEFEKLSDEEKIKRYKKDEQRENFVGLVADRVKKDGTNKYIIFYTDKPPTR

SARSRRSLPAEIPLIPVNQADTLIVDGEAVSLTGHSGNIFAPEGNYRYLTYGAEKLPGGS

YALRVQGEPAKGEMLVGTAVYNGEVLHFHMENGRPYPSGGRFAAKVDFGSKSVDGIIDSG

-continued

DDLHMGTQKFKAAIDGNGFKGTWTENGGGDVSGRFYGPAGEEVAGKYSYRPTDAEKGGFG

VFAGKKDRD*

Z2491

<SEQ ID 3184>

MFKRSVIAMACIFALSACGGGGGGSPDVKSADTLSKPAAPVVSEKETEAKEDAPQAGSQG

QGAPSAQGSQDMAAVSEENTGNGGAVTADNPKNEDEVAQNDMPQNAAGTDSSTPNHTPDP

NMLAGNMENQATDAGESSQPANQPDMANAADGMQGDDPSAGGQNAGNTAAQGANQAGNNQ

AAGSSDPIPASNPAPANGGSNFGRVDLANGVLIDGPSQNITLTHCKGDSCSGNNFLDEEV

QLKSEFEKLSDADKISNYKKDGKNDKFVGLVADSVQMKGINQYIIFYKPKPTSFARFRRS

ARSRRSLPAEMPLIPVNQADTLIVDGEAVSLTGHSGNIFAPEGNYRYLTYGAEKLPGGSY

ALRVQGEPAKGEMLAGAAVYNGEVLHFHTENGRPYPTRGRFAAKVDFGSKSVDGIIDSGD

DLHMGTQKFKAAIDGNGFKGTWTENGSGDVSGKFYGPAGEEVAGKYSYRPTDAEKGGFGV

FAGKKEQD*

Figure 21A:
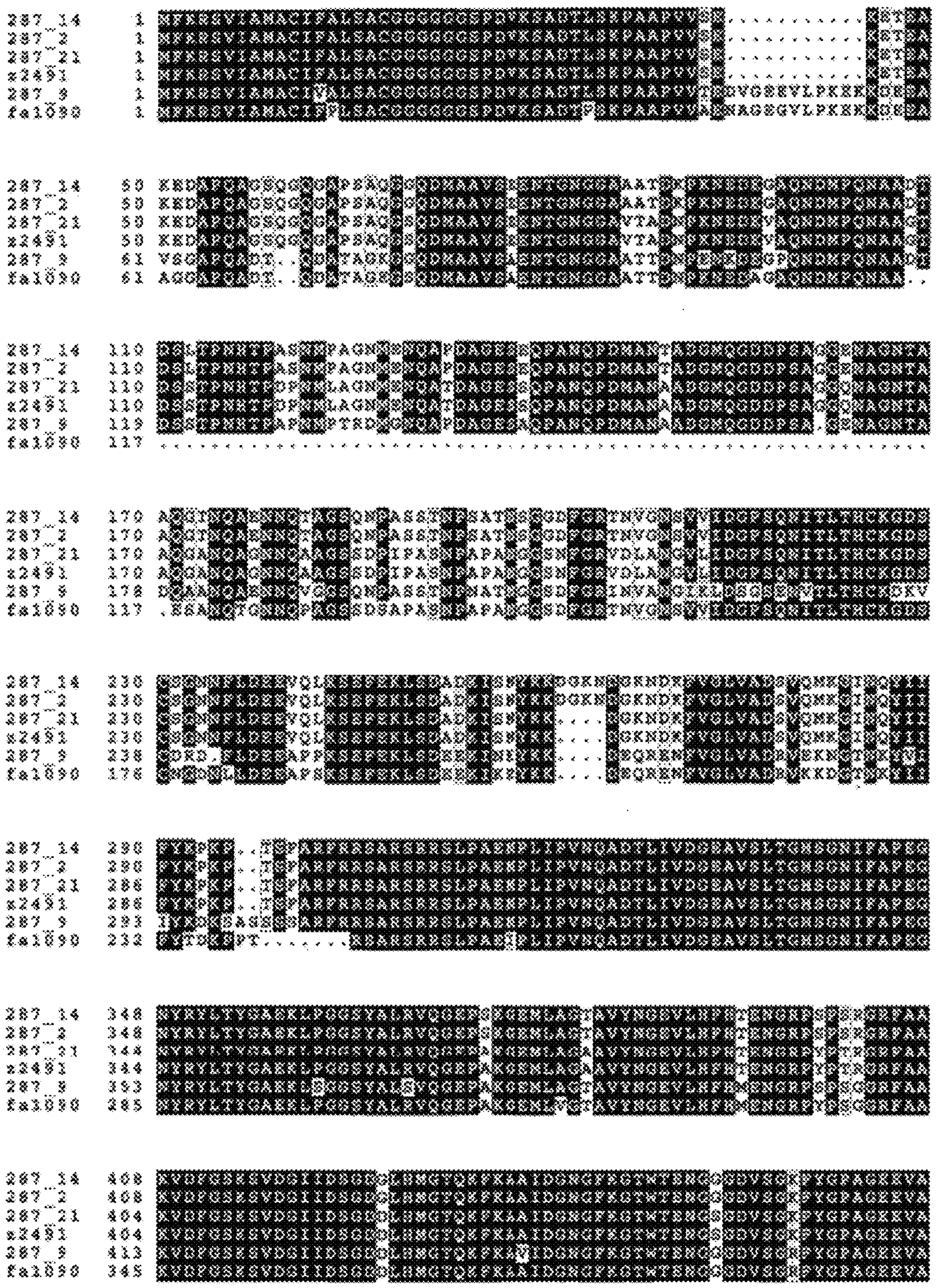
FIG. 21A-B shows an alignment comparison of amino acid sequences for ORF 287 for several strains of *Neisseria*. Dark shading indicates regions of homology, and gray shading indicates the conservation of amino acids with similar characteristics. The Figure demonstrates a high degree of conservation among the various strains, further confirming its utility as an antigen for both vaccines and diagnostics. The sequences in the Figure have the following SEQ ID NOs: 287__14 SEQ ID 3179; 287__2 SEQ ID 3180; 287__21. SEQ ID 3181; 287__9 SEQ ID 3182; FA1090 SEQ ID 3183; and Z2491 SEQ ID 3184.
Figure 21B:
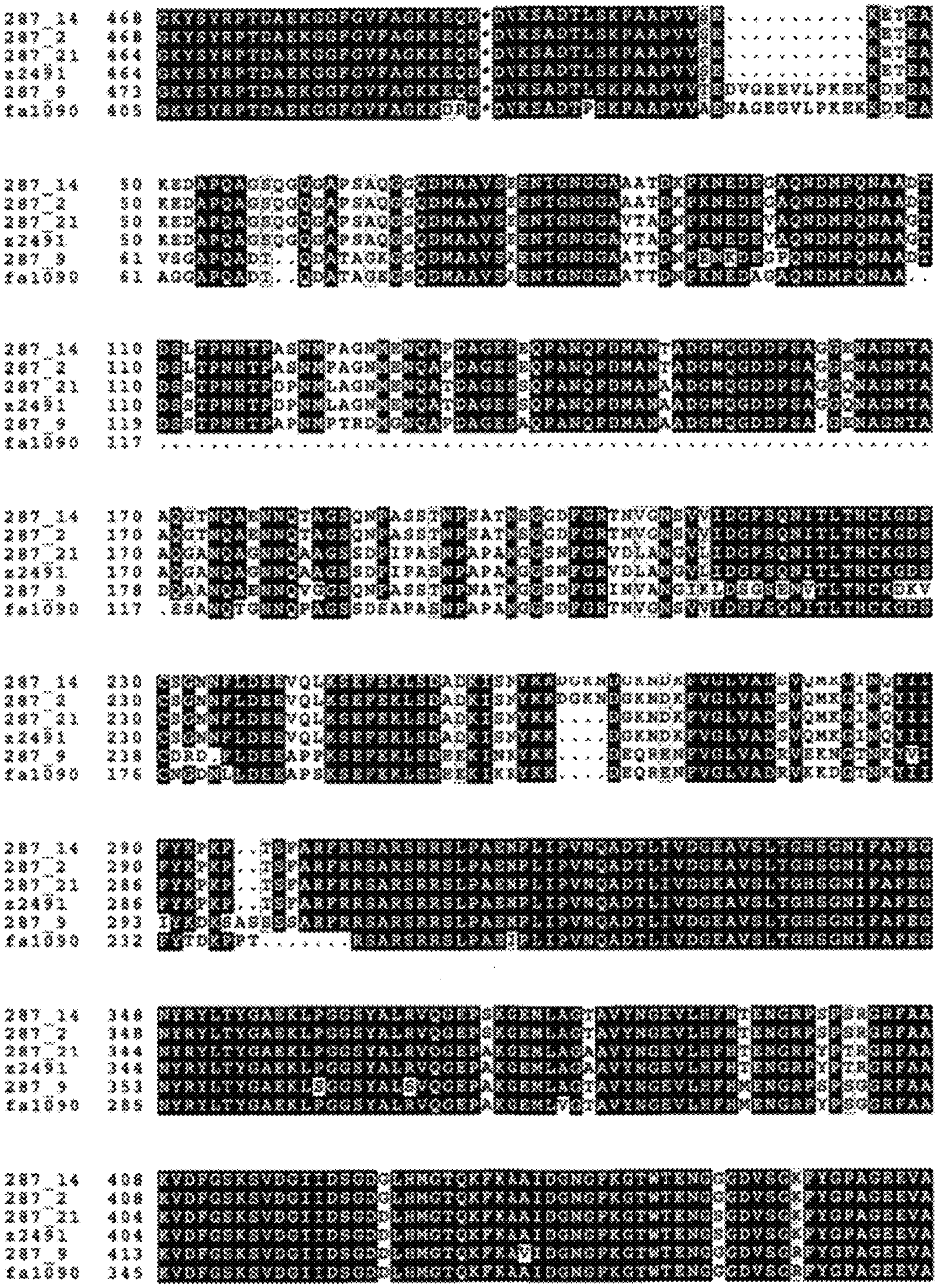

FIG. 21 shows the results of aligning the sequences of each of these strains. Dark shading indicates regions of homology, and gray shading indicates the conservation of amino acids with similar characteristics. As is readily discernible, there is significant conservation among the various strains of ORF 225, further confirming its utility as an antigen for both vaccines and diagnostics.

Example 14

Table 5 lists several *Neisseria* strains which were used to assess the conservation of the sequence of ORF 519 among different strains.

TABLE 5

519 gene variability: List of used *Neisseria* strains

| Identification Strains number | Source/reference |
|---|---|
| Group B | |
| zv01__519 NG6/88 | R. Moxon/Seiler et al., 1996 |
| zv02__519 BZ198 | R. Moxon/Seiler et al., 1996 |
| zv03__519ass NG3/88 | R. Moxon/Seiler et al., 1996 |
| zv04__519 297-0 | R. Moxon/Seiler et al., 1996 |
| zv05__519 1000 | R. Moxon/Seiler et al., 1996 |
| zv06__519ass BZ147 | R. Moxon/Seiler et al., 1996 |
| zv07__519 BZ169 | R. Moxon/Seiler et al., 1996 |
| zv11__519 NGE31 | R. Moxon/Seiler et al., 1996 |
| zv12__519 NGF26 | R. Moxon/Seiler et al., 1996 |
| zv18__519 BZ232 | R. Moxon/Seiler et al., 1996 |
| zv19__519 BZ83 | R. Moxon/Seiler et al., 1996 |
| zv20__519ass 44/76 | R. Moxon/Seiler et al., 1996 |
| zv21__519ass MC58 | R. Moxon |
| zv96__519 2996 | Our collection |
| Group A | |
| zv22__519ass 205900 | R. Moxon |
| z2491__519 Z2491 | R. Moxon/Maiden et al., 1998 |
| Others | |
| zv26__519 A22 (group W) | R. Moxon/Maiden et al., 1998 |
| zv27__519 E26 (group X) | R. Moxon/Maiden et al., 1998 |
| zv28__519 860800 (group Y) | R. Moxon/Maiden et al., 1998 |
| zv29__519ass E32 (group Z) | R. Moxon/Maiden et al., 1998 |
| Gonococcus | |
| zv32__519 Ng F62 | R. Moxon/Maiden et al., 1998 |
| fa1090__519 FA1090 | R. Moxon |

References:
Seiler A. et al., Mol. Microbiol., 1996, 19(4): 841-856.
Maiden et al., Proc. Natl. Acad. Sci. USA, 1998, 95: 3140-3145.

The amino acid sequences for each listed strain are as follows:

FA1090_519

<SEQ ID 3185>

MEFFIILLAAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVSALDEAAGAWGVKVLRYEIKDLVPPQEILRAMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

-continued

Z2491_519

<SEQ ID 3186>

MEFFIILLAAVVVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVSALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV01_519

<SEQ ID 3187>

MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVAALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV02_519

<SEQ ID 3188>

MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVSALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV03_519

<SEQ ID 3189>

MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVSALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV04_519

<SEQ ID 3190>

MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVSALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV05_519

<SEQ ID 3191>

MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVSALDEAAGAWGVKVLRYEIKDLVPPQEILRSMQAQITAERE

KRARIAESEGRKIEQINLASGQREAEIQQSEGEAQAAVNASNAEKIARINRAKGEAESLR

-continued

LVAEANAEAIRQIAAALQTQGGADAVNLKIAEQYVAAFNNLAKESNTLIMPANVADIGSL

ISAGMKIIDSSKTAK*

ZV06_519ASS

<SEQ ID 3192>

MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVFSALDEAAGAWGVKVLRYEIKDLVPPQEILRSMQAQITAERK

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV07_519

<SEQ ID 3193>

MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVAALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV11_519

<SEQ ID 3194>

MEFFIILLAAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVAALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV12_519

<SEQ ID 3195>

MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVAALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV18_519

<SEQ ID 3196>

MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVAALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV19_519

<SEQ ID 3197>

MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVAALDEAAGAWGVKVLRYEIKDLVPPQEILRSMQAQITAERE

-continued

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV20_519ASS

<SEQ ID 3198>

MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVAALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSM

ISAGMKIIDSSKTAK*

ZV21_519ASS

<SEQ ID 3199>

MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVAALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV22_519ASS

<SEQ ID 3200>

MEFFIILLAAVVVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVSALDEAAGAWGVKVLRYEIKDLVPPQEILRSMQAQITAERE

KRARIAESEGRKIEQINLASGQREAKIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV26_519

<SEQ ID 3201>

MEFFIILLAAVVVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVAALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV27_519

<SEQ ID 3202>

MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVAALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

-continued

ZV28_519

<SEQ ID 3203>

MEFFIILLAAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVAALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV29_519ASS

<SEQ ID 3204>

MEFFIILLAAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSIVVSALDEAAGAWGVKVLRYEIKDLVPPQEILRSMQAQITAERE

KRARIAESEGRKIEQINLASGQREPEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSNKTAK*

ZV32_519

<SEQ ID 3205>

MEFFIILLAAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVSALDEAAGAWGVKVLRYEIKDLVPPQEILRAMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV96_519

<SEQ ID 3206>

MEFFIILLAAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVAALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

Figure 22A:
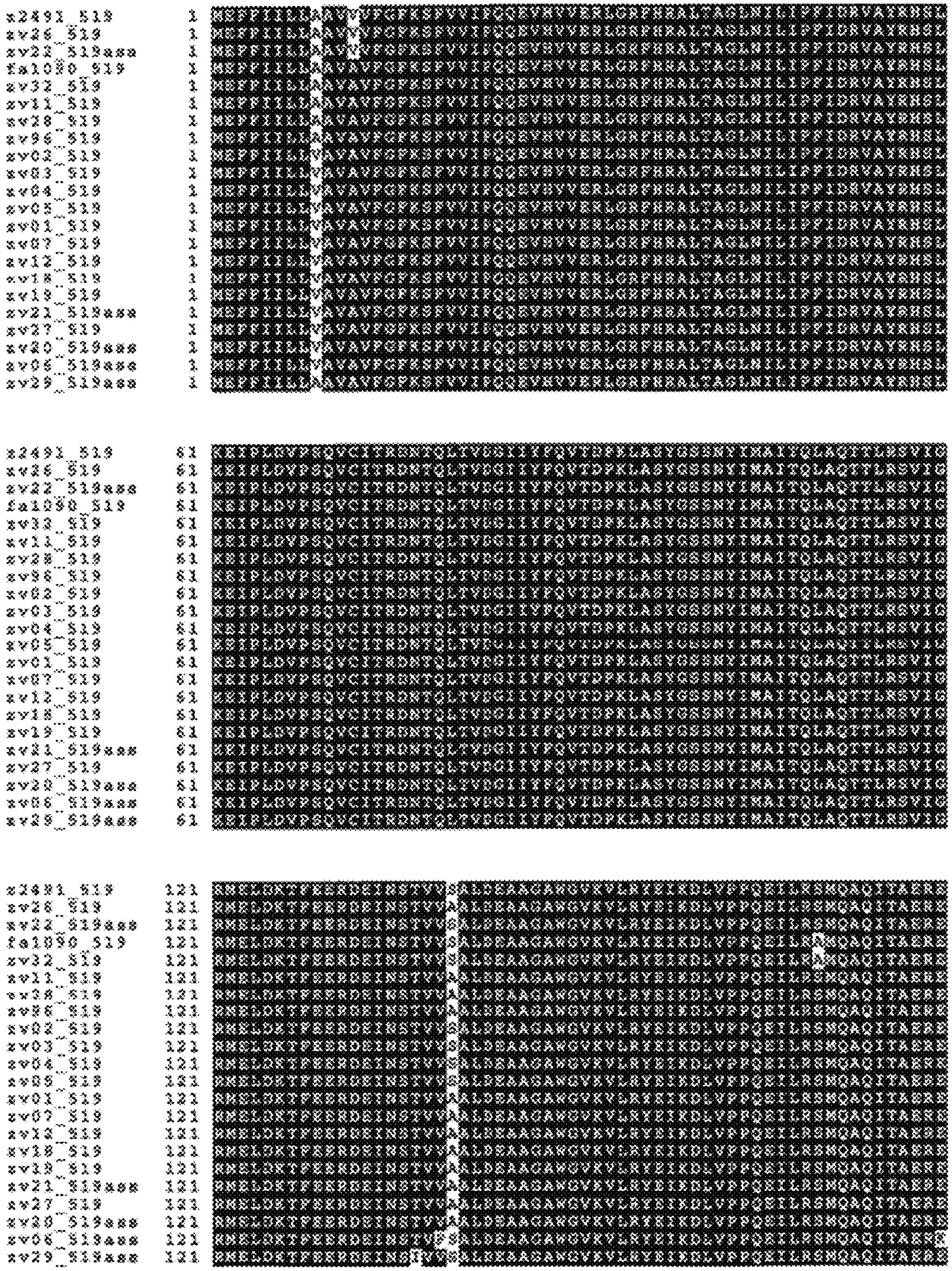
FIG. 22A-B shows an alignment comparison of amino acid sequences for ORF 519 for several strains of *Neisseria*. Dark shading indicates regions of homology, and gray shading indicates the conservation of amino acids with similar characteristics. The Figure demonstrates a high degree of conservation among the various strains, further confirming its utility as an antigen for both vaccines and diagnostics. The sequences in the Figure have the following SEQ ID NOs: FA1090_519 SEQ ID 3185; Z2491_519 SEQ ID 3186; ZV01_519 SEQ ID 3187; ZV02_519 SEQ ID 3188; ZV03_519 SEQ ID 3189; ZV04_519 SEQ ID 3190; ZV05_519 SEQ ID 3191; ZV06_519ASS SEQ ID 3192; ZV07_519 SEQ ID 3193; ZV11_519 SEQ ID 3194; ZV12_519 SEQ ID 3195; ZV18_519 SEQ ID 3196; ZV19_519 SEQ ID 3197; ZV20_519ASS SEQ ID 3198; ZV21_519ASS SEQ ID 3199; ZV22_519ASS SEQ ID 3200; ZV26_519 SEQ ID 3201; ZV27_519 SEQ ID 3202; ZV28_519 SEQ ID 3203; ZV29_519ASS SEQ ID 3204; ZV32_519 SEQ ID 3205; and ZV96_519 SEQ ID 3206.
Figure 22B:
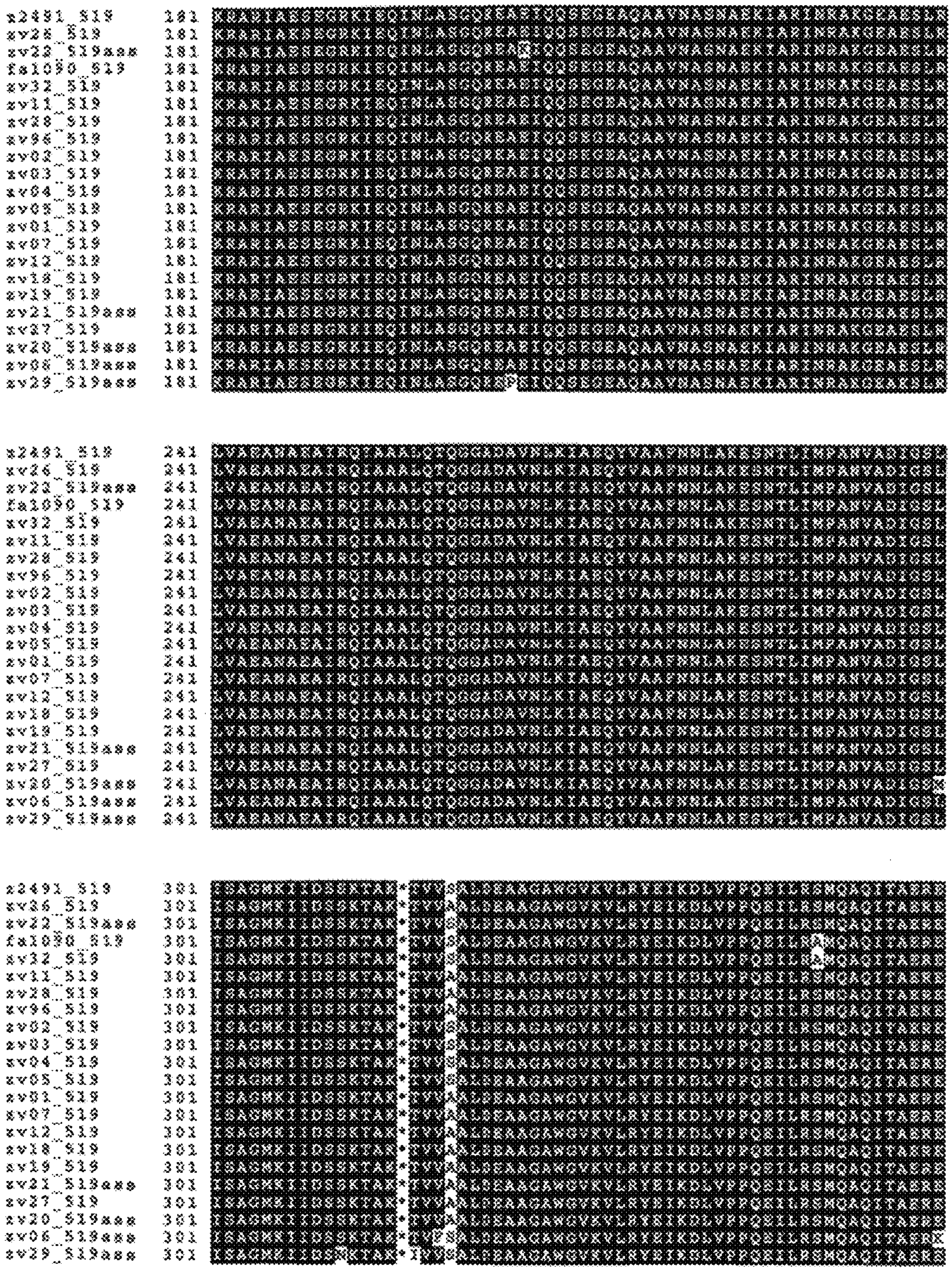
Figure 23A:
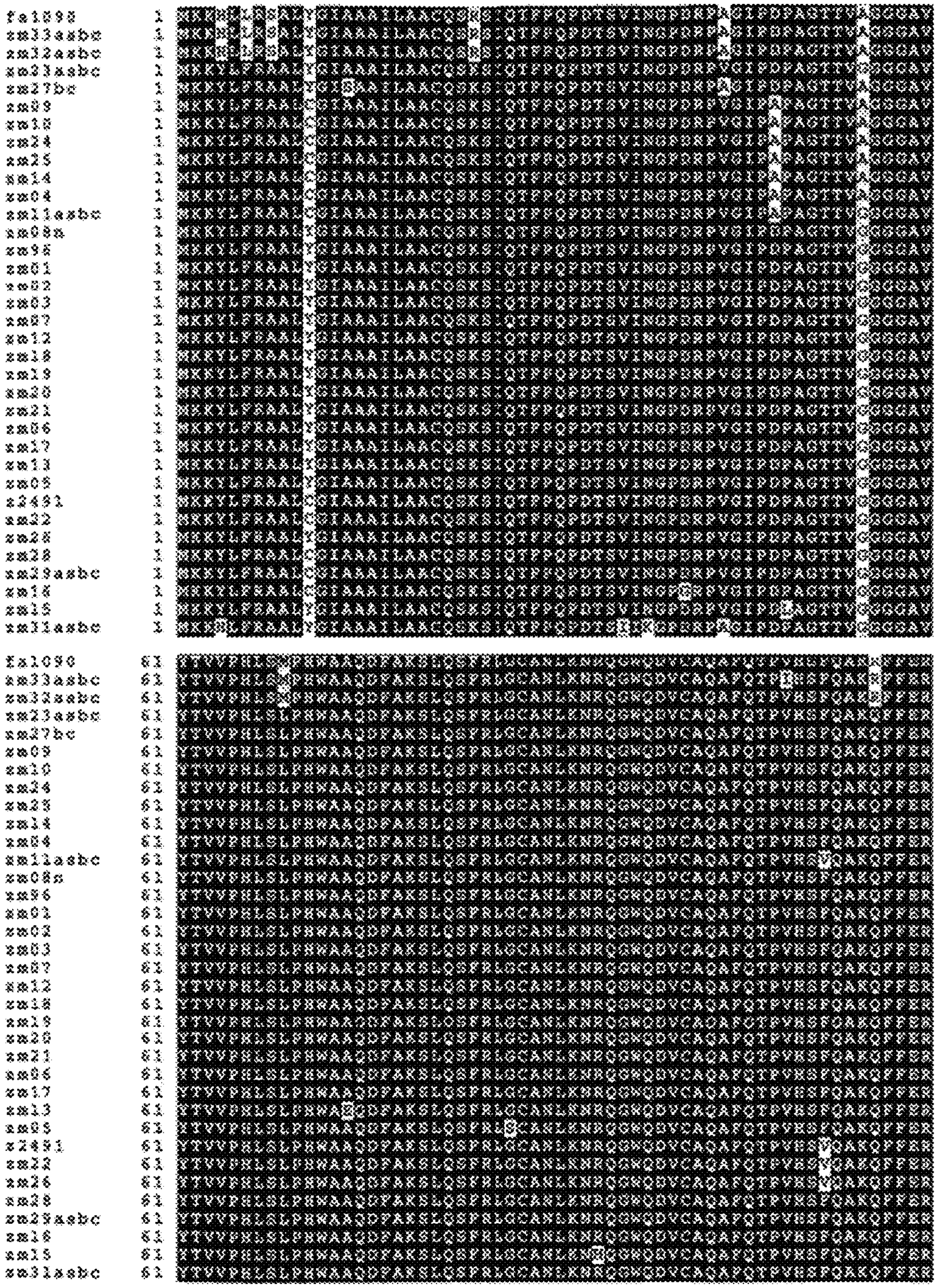
FIG. 23A-D shows an alignment comparison of amino acid sequences for ORF 919 for several strains of *Neisseria*. Dark shading indicates regions of homology, and gray shading indicates the conservation of amino acids with similar characteristics. The Figure demonstrates a high degree of conservation among the various strains, further confirming its utility as an antigen for both vaccines and diagnostics. The sequences in the Figure have the following SEQ ID NOs: FA1090 SEQ ID 3207; Z2491 <SEQ ID 3208; ZM01 SEQ ID 3209; ZM02 SEQ ID 3210; ZM03 SEQ ID 3211; ZM04 SEQ ID 3212; ZM05 SEQ ID 3213; ZM06 SEQ ID 3214; ZM07 SEQ ID 3215; ZM08N SEQ ID 3216; ZM09 SEQ ID 3217; ZM10 SEQ ID 3218; ZM11ASBC SEQ ID 3219; ZM12 SEQ ID 3220; ZM13 SEQ ID 3221; ZM14 SEQ ID 3222; ZM15 SEQ ID 3223; ZM16 SEQ ID 3224; ZM17 SEQ ID 3225; ZM18 SEQ ID 3226; ZM19 SEQ ID 3227; ZM20 SEQ ID 3228; ZM21 SEQ ID 3229; ZM22 SEQ ID 3230; ZM23ASBC SEQ ID 3231; ZM24 SEQ ID 3232; ZM25 SEQ ID 3233; ZM26 SEQ ID 3234; ZM27BC SEQ ID 3235; ZM28 SEQ ID 3236; ZM29ASBC SEQ ID 3237; ZM31ASBC SEQ ID 3238; ZM32ASBC SEQ ID 3239; ZM33ASBC SEQ ID 3240; ZM96 SEQ ID 3241.
Figure 23B:
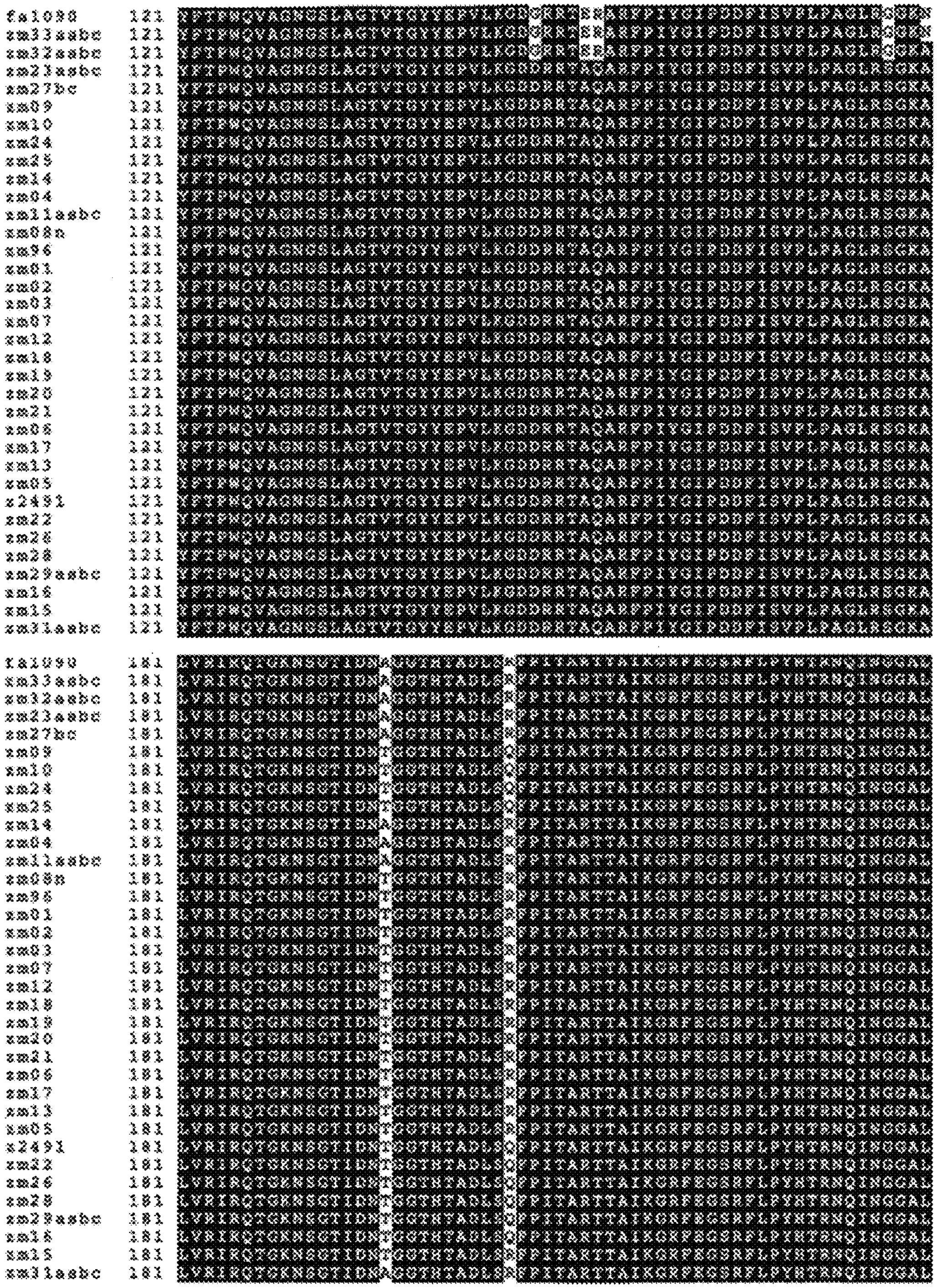
Figure 23C:
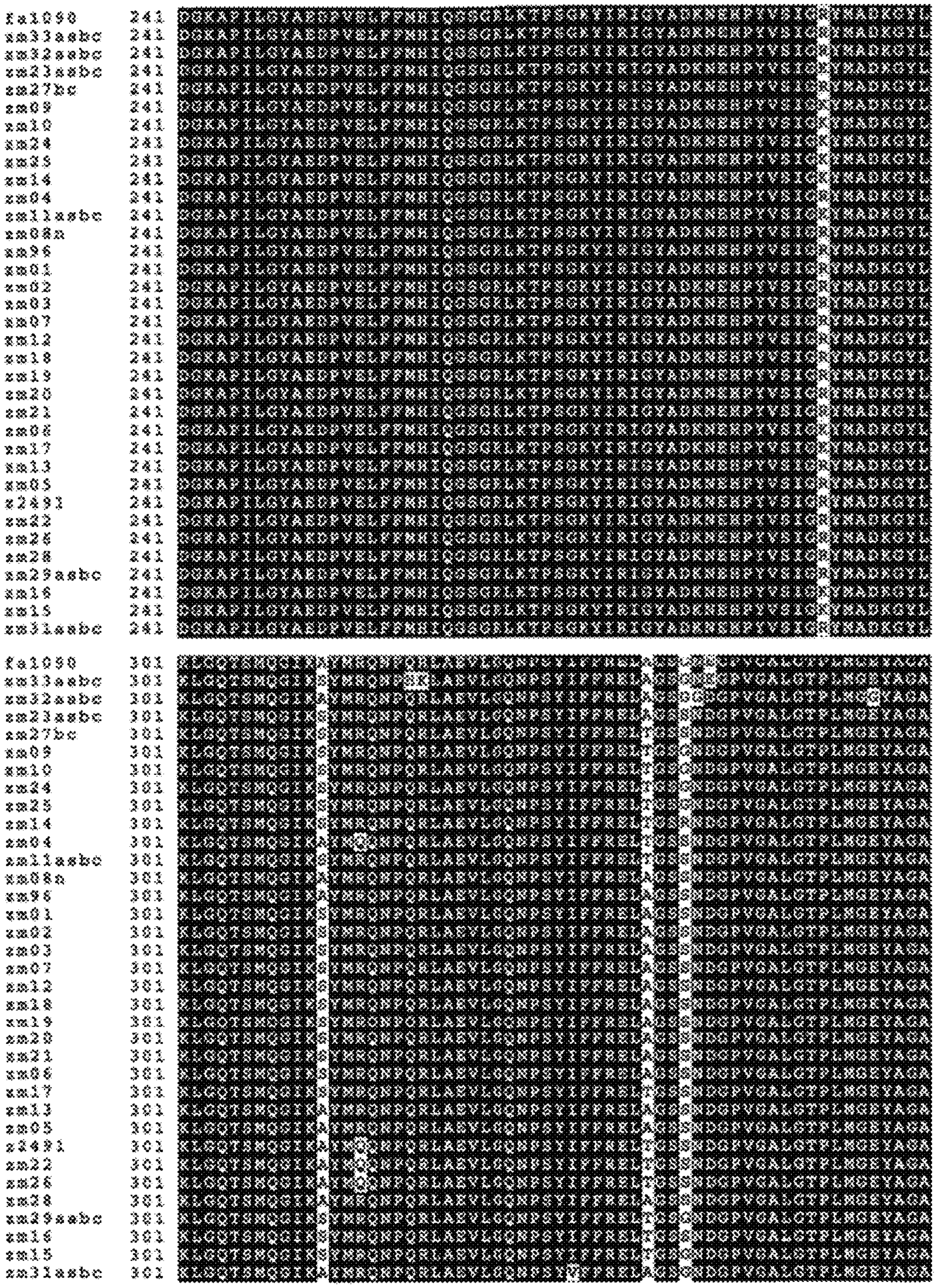
Figure 23D:
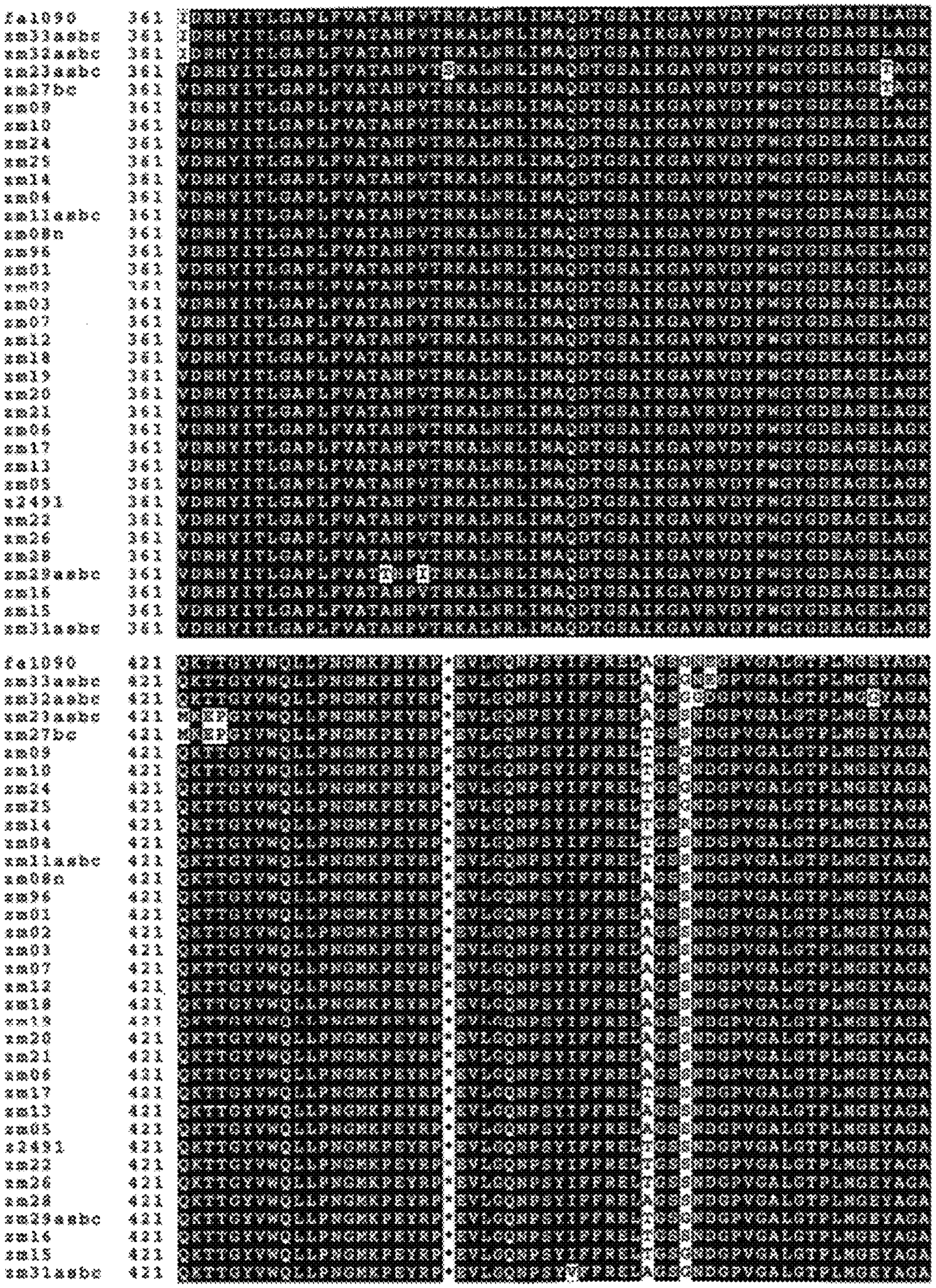

FIG. 22 shows the results of aligning the sequences of each of these strains. Dark shading indicates regions of homology, and gray shading indicates the conservation of amino acids with similar characteristics. As is readily discernible, there is significant conservation among the various strains of ORF 225, further confirming its utility as an antigen for both vaccines and diagnostics.

Example 15

Table 6 lists several *Neisseria* strains which were used to assess the conservation of the sequence of ORF 919 among different strains.

TABLE 6

919 gene variability: List of used *Neisseria* strains

| Identification Strains number | Source/reference |
|---|---|
| Group B | |
| zm01 NG6/88 | R. Moxon/Seiler et al., 1996 |
| zm02 BZ198 | R. Moxon/Seiler et al., 1996 |
| zm03 NG3/88 | R. Moxon/Seiler et al., 1996 |
| zm04 297-0 | R. Moxon/Seiler et al., 1996 |
| zm05 1000 | R. Moxon/Seiler et al., 1996 |
| zm06 BZ147 | R. Moxon/Seiler et al., 1996 |
| zm07 BZ169 | R. Moxon/Seiler et al., 1996 |
| zm08n 528 | R. Moxon/Seiler et al., 1996 |

TABLE 6-continued 919 gene variability: List of used *Neisseria* strains

| Identification Strains number | Source/reference |
|---|---|
| zm09 NGP165 | R. Moxon/Seiler et al., 1996 |
| zm10 BZ133 | R. Moxon/Seiler et al., 1996 |
| zm11asbc NGE31 | R. Moxon/Seiler et al., 1996 |
| zm12 NGF26 | R. Moxon/Seiler et al., 1996 |
| zm13 NGE28 | R. Moxon/Seiler et al., 1996 |
| zm14 NGH38 | R. Moxon/Seiler et al., 1996 |
| zm15 SWZ107 | R. Moxon/Seiler et al., 1996 |
| zm16 NGH15 | R. Moxon/Seiler et al., 1996 |
| zm17 NGH36 | R. Moxon/Seiler et al., 1996 |
| zm18 BZ232 | R. Moxon/Seiler et al., 1996 |
| zm19 BZ83 | R. Moxon/Seiler et al., 1996 |
| zm20 44/76 | R. Moxon/Seiler et al., 1996 |
| zm21 MC58 | R. Moxon |
| zm96 2996 | Our collection |
| Group A | |
| zm22 205900 | R. Moxon |
| zm23asbc F6124 | R. Moxon |
| z2491 Z2491 | R. Moxon/Maiden et al., 1998 |
| Group C | |
| zm24 90/18311 | R. Moxon |
| zm25 93/4286 | R. Moxon |
| Others | |
| zm26 A22 (group W) | R. Moxon/Maiden et al., 1998 |
| zm27bc E26 (group X) | R. Moxon/Maiden et al., 1998 |
| zm28 860800 (group Y) | R. Moxon/Maiden et al., 1998 |
| zm29asbc E32 (group Z) | R. Moxon/Maiden et al., 1998 |
| zm31asbc *N. lactamica* | R. Moxon |
| Gonococcus | |
| zm32asbc Ng F62 | R. Moxon/Maiden et al., 1998 |
| zm33asbc Ng SN4 | R. Moxon |
| fa1090 FA1090 | R. Moxon |

References:

Seiler A. et al., Mol. Microbiol., 1996, 19(4): 841-856.

Maiden et al., Proc. Natl. Acad. Sci. USA, 1998, 95: 3140-3145.

The amino acid sequences for each listed strain are as follows:

FA1090

<SEQ ID 3207>

MKKHLLRSALYGIAAAILAACQSRSIQTFPQPDTSVINGPDRPAGIPDPAGTTVAGGGAV

YTVVPHLSMPHWAAQDFAKSLQSFRLGCANLKNRQGWQDVCAQAFQTPVHSFQAKRFFER

YFTPWQVAGNGSLAGTVTGYYEPVLKGDGRRTERARFPIYGIPDDFISVPLPAGLRGGKN

LVRIRQTGKNSGTIDNAGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKAYMRQNPQRLAEVLGQNPSYIFFRELAGSGNEGPVGALGTPLMGEYAGA

IDRHYITLGAPLFVATAHPVTRKALNRLIMAQDTGSAIKGAVRVDYFWGYGDEAGELAGK

QKTTGYVWQLLPNGMKPEYRP*

Z2491

<SEQ ID 3208>

MKKYLFRAALCGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSVQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSQFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKAYMQQNPQRLAEVLGQNPSYIFFRELTGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM01

<SEQ ID 3209>

MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKSYMRQNPQRLAEVLGQNPSYIFFRELAGSSNDGPVGALGTPLMGEYAGA

-continued

VDRHYITLGAPLFVATAHPVTRKALNRLIMAQDTGSAIKGAVRVDYFWGYGDEAGELAGK

QKTTGYVWQLLPNGMKPEYRP*

ZM02

<SEQ ID 3210>

MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKSYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM03

<SEQ ID 3211>

MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKSYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM04

<SEQ ID 3212>

MKKYLFRAALCGIAAAILAACQSKSIQTFPQPDTSVINGPDRPVGIPAPAGTTVAGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNAGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKAYMQQNPQRLAEVLGQNPSYIFFRELTGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM05

<SEQ ID 3213>

MKKYLFRAALYGIAAAILAACQSKSIQTFPQPDTSVINGPDRPVGIPDPAGTTVGGGGAV

YTVVPHLSLPHWAAQDFAKSLQSFRLSCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKAYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM06

<SEQ ID 3214>

MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

-continued

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGKYMADKGYL

KLGQTSMQGIKSYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM07

<SEQ ID 3215>

MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKSYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM08N

<SEQ ID 3216>

MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKAYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM09

<SEQ ID 3217>

MKKYLFRAALCGIAAAILAACQSKSIQTFPQPDTSVINGPDRPVGIPAPAGTTVAGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSQFPITARTTAIKGRFEGSRFLPYHTRNQINGGAL

DGKAPILGYAEDPVELFFMHIQGSGRLKTPSGKYIRIGYADKNEHPYVSIGKYMADKGYL

KLGQTSMQGIKSYMRQNPQRLAEVLGQNPSYIFFRELTGSGNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM10

<SEQ ID 3218>

MKKYLFRAALCGIAAAILAACQSKSIQTFPQPDTSVINGPDRPVGIPAPAGTTVAGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSQFPITARTTAIKGRFEGSRFLPYHTRNQINGGAL

DGKAPILGYAEDPVELFFMHIQGSGRLKTPSGKYIRIGYADKNEHPYVSIGKYMADKGYL

KLGQTSMQGIKSYMRQNPQRLAEVLGQNPSYIFFRELTGSGNDGPVGALGTPLMGEYAGA

-continued

VDRHYITLGAPLFVATAHPVTRKALNRLIMAQDTGSAIKGAVRVDYFWGYGDEAGELAGK

QKTTGYVWQLLPNGMKPEYRP*

ZM11ASBC

<SEQ ID 3219>

MKKYLFRAALCGIAAAILAACQSKSIQTFPQPDTSVINGPDRPVGIPAPAGTTVGGGGAV

YTVVPHLSLPHWAAQDFAKSLQSFRLGCANLKNRQGWQDVCAQAFQTPVHSVQAKQFFER

YFTPWQVAGNGSLAGTVTGYYEPVLKGDDRRTAQARFPIYGIPDDFISVPLPAGLRSGKA

LVRIRQTGKNSGTIDNAGGTHTADLSRFPITARTTAIKGRFEGSRFLPYHTRNQINGGAL

DGKAPILGYAEDPVELFFMHIQGSGRLKTPSGKYIRIGYADKNEHPYVSIGKYMADKGYL

KLGQTSMQGIKSYMRQNPQRLAEVLGQNPSYIFFRELTGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM12

<SEQ ID 3220>

MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKSYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM13

<SEQ ID 3221>

MKKYLFRAALYGIAAAILAACQSKSIQTFPQPDTSVINGPDRPVGIPDPAGTTVGGGGAV

YTVVPHLSLPHWAEQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKAYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM14

<SEQ ID 3222>

MKKYLFRAALCGIAAAILAACQSKSIQTFPQPDTSVINGPDRPVGIPAPAGTTVAGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNAGGTHTADLSRFPITARTTAIKGRFEGSRFLPYHTRNQINGGAL

DGKAPILGYAEDPVELFFMHIQGSGRLKTPSGKYIRIGYADKNEHPYVSIGKYMADKGYL

KLGQTSMQGIKSYMRQNPQRLAEVLGQNPSYIFFRELTGSRNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM15

<SEQ ID 3223>

MKKYLFRAALYGIAAAILAACQSKSIQTFPQPDTSVINGPDRPVGIPDLAGTTVGGGGAV

YTVVPHLSLPHWAAQDFAKSLQSFRLGCANLKNHQGWQDVCAQAFQTPVHSFQAKQFFER

-continued

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGKYMADKGYL

KLGQTSMQGIKSYMRQNPQRLAEVLGQNPSYIFFRELTGSGNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM16

<SEQ ID 3224>

MKKYLFRAALCGIAAAILAACQSKSIQTFPQPDTSVINGPGRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSQFPITARTTAIKGRFEGSRFLPYHTRNQINGGAL

DGKAPILGYAEDPVELFFMHIQGSGRLKTPSGKYIRIGYADKNEHPYVSIGKYMADKGYL

KLGQTSMQGIKSYMRQNPQRLAEVLGQNPSYIFFRELTGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM17

<SEQ ID 3225>

MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGKYMADKGYL

KLGQTSMQGIKSYMRQNPQRLAEVLGQNPSYIFFRELTGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM18

<SEQ ID 3226>

MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKSYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM19

<SEQ ID 3227>

MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKSYMRQNPQRLAEVLGQNPSYIFFRELAGSSNDGPVGALGTPLMGEYAGA

-continued

VDRHYITLGAPLFVATAHPVTRKALNRLIMAQDTGSAIKGAVRVDYFWGYGDEAGELAGK

QKTTGYVWQLLPNGMKPEYRP*

ZM20

<SEQ ID 3228>

MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKSYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM21

<SEQ ID 3229>

MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKSYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM22

<SEQ ID 3230>

MKKYLFRAALCGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSVQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSQFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKAYMQQNPQRLAEVLGQNPSYIFFRELTGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM23ASBC

<SEQ ID 3231>

MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNAGGTHTADLSRFPITARTTAIKGRFEGSRFLPYHTRNQINGGAL

DGKAPILGYAEDPVELFFMHIQGSGRLKTPSGKYIRIGYADKNEHPYVSIGKYMADKGYL

KLGQTSMQGIKSYMRQNPQRLAEVLGQNPSYIFFRELAGSSNDGPVGALGTPLMGEYAGA

VDRHYITLGAPLFVATAHPVTSKALNRLIMAQDTGSAIKGAVRVDYFWGYGDEAGETAGK

MKEPGYVWQLLPNGMKPEYRP*

ZM24

<SEQ ID 3232>

MKKYLFRAALCGIAAAILAACQSKSIQTFPQPDTSVINGPDRPVGIPAPAGTTVAGGGAV

YTVVPHLSLPHWAAQDFAKSLQSFRLGCANLKNRQGWQDVCAQAFQTPVHSFQAKQFFER

-continued

YFTPWQVAGNGSLAGTVTGYYEPVLKGDDRRTAQARFPIYGIPDDFISVPLPAGLRSGKA

LVRIRQTGKNSGTIDNTGGTHTADLSQFPITARTTAIKGRFEGSRFLPYHTRNQINGGAL

DGKAPILGYAEDPVELFFMHIQGSGRLKTPSGKYIRIGYADKNEHPYVSIGKYMADKGYL

KLGQTSMQGIKSYMRQNPQRLAEVLGQNPSYIFFRELTGSGNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM25

<SEQ ID 3233>

MKKYLFRAALCGIAAAILAACQSKSIQTFPQPDTSVINGPDRPVGIPAPAGTTVAGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSQFPITARTTAIKGRFEGSRFLPYHTRNQINGGAL

DGKAPILGYAEDPVELFFMHIQGSGRLKTPSGKYIRIGYADKNEHPYVSIGKYMADKGYL

KLGQTSMQGIKSYMRQNPQRLAEVLGQNPSYIFFRELTGSGNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM26

<SEQ ID 3234>

MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSVQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSQFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKAYMQQNPQRLAEVLGQNPSYIFFRELTGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM27BC

<SEQ ID 3235>

MKKYLFRAALYGISAAILAACQSKSIQTFPQPDTSVINGPDRPAGIPDPAGTTVAGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNAGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKSYMRQNPQRLAEVLGQNPSYIFFRELTGSSNDGPVGALGTPLMGEYAGA

VDRHYITLGAPLFVATAHPVTRKALNRLIMAQDTGSAIKGAVRVDYFWGYGDEAGETAGK

MKEPGYVWQLLPNGMKPEYRP*

ZM28

<SEQ ID 3236>

MKKYLFRAALCGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSQFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKAYMRQNPQRLAEVLGQNPSYIFFRELAGSSNDGPVGALGTPLMGEYAGA

-continued

VDRHYITLGAPLFVATAHPVTRKALNRLIMAQDTGSAIKGAVRVDYFWGYGDEAGELAGK

QKTTGYVWQLLPNGMKPEYRP*

ZM29ASBC

<SEQ ID 3237>

MKKYLFRAALCGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSQFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKSYMRQNPQRLAEVLGQNPSYIFFRELTGSGNDGPVGALGTPLMGEYAGA

VDRHYITLGAPLFVATTHPITRKALNRLIMAQDTGSAIKGAVRVDYFWGYGDEAGELAGK

QKTTGYVWQLLPNGMKPEYRP*

ZM31ASBC

<SEQ ID 3238>

MKKHLFRAALYGIAAAILAACQSKSIQTFPQPDTSIIKGPDRPAGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNAGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKAYMRQNPQRLAEVLGQNPSYVFFRELAGSGNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM32ASBC

<SEQ ID 3239>

MKKHLLRSALYGIAAAILAACQSRSIQTFPQPDTSVINGPDRPAGIPDPAGTTVAGGGAV

YTVVPHLSMPHWAAQDFAKSLQSFRLGCANLKNRQGWQDVCAQAFQTPVHSFQAKRFFER

YFTPWQVAGNGSLAGTVTGYYEPVLKGDGRRTERARFPIYGIPDDFISVPLPAGLRGGKA

LVRIRQTGKNSGTIDNAGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKAYMRQNPQRLAEVLGQNPSYIFFRELAGSGGDGPVGALGTPLMGGYAGA

IDRHYITLGAPLFVATAHPVTRKALNRLIMAQDTGSAIKGAVRVDYFWGYGDEAGELAGK

QKTTGYVWQLLPNGMKPEYRP*

ZM33ASBC

<SEQ ID 3240>

MKKHLLRSALYGIAAAILAACQSRSIQTFPQPDTSVINGPDRPAGIPDPAGTTVAGGGAV

YTVVPHLSMPHWAAQDFAKSLQSFRLGCANLKNRQGWQDVCAQAFQTPIHSFQAKRFFER

YFTPWQVAGNGSLAGTVTGYYEPVLKGDGRRTERARFPIYGIPDDFISVPLPAGLRGGKN

LVRIRQTGKNSGTIDNAGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKSYMRQNPHKLAEVLGQNPSYIFFRELAGSGNEGPVGALGTPLMGEYAGA

IDRHYITLGAPLFVATAHPVTRKALNRLIMAQDTGSAIKGAVRVDYFWGYGDEAGELAGK

QKTTGYVWQLLPNGMKPEYRP*

ZM96

<SEQ ID 3241>

MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

-continued

```
YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKAYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*
```

FIG. 23 shows the results of aligning the sequences of each of these strains. Dark shading indicates regions of homology, and gray shading indicates the conservation of amino acids with similar characteristics. As is readily discernible, there is significant conservation among the various strains of ORF 225, further confirming its utility as an antigen for both vaccines and diagnostics.

Example 16

Using the above-described procedures, the following oligonucleotide primers were employed in the polymerase chain reaction (PCR) assay in order to clone the ORFs as indicated:

TABLE 7

Oligonucleotides used for PCR to amplify complete or partial ORFs

| ORF | SEQ ID | primer | Sequence | Restriction sites |
|---|---|---|---|---|
| 001 | 3300 | Forward | CGCGGATCCCATATG-TGGATGGTGCTGGTCAT | BamHI-NdeI |
| | 3301 | Reverse | CCCGCTCGAG-TGCCGTCTTGTCCCAC | XhoI |
| 003 | 3302 | Forward | CGCGGATCCCATATG-GTCGTATTCGTGGC | BamHI-NdeI |
| | 3303 | Reverse | CCCGCTCGAG-AAAATCATGAACACGCGC | XhoI |
| 005 | 3304 | Forward | CGCGGATCCCATATG-GACAATATTGACATGT | BamHI-NdeI |
| | 3305 | Reverse | CCCGCTCGAG-CATCACATCCGCCCG | XhoI |
| 006 | 3306 | Forward | CGCGGATCCCATATG-CTGCTGGTGCTGG | BamHI-NdeI |
| | 3307 | Reverse | CCCGCTCGAG-AGTTCCGGCTTTGATGT | XhoI |
| 007 | 3308 | Forward | CGCGGATCCCATATG-GCCGACAACAGCATCAT | BamHI-NdeI |
| | 3309 | Reverse | CCCGCTCGAG-AAGGCGTTCATGATATAAG | XhoI |
| 008 | 3310 | Forward | CGCGGATCCCATATG-AACAACAGACATTTTG | BamHI-NdeI |
| | 3311 | Reverse | CCCGCTCGAG-CCTGTCCGGTAAAAGAC | XhoI |
| 009 | 3312 | Forward | CGCGGATCCCATATG-CCCCGCGCTGCT | BamHI-NdeI |
| | 3313 | Reverse | CCCGCTCGAG-TGGCTTTTGCCACGTTTT | XhoI |
| 011 | 3314 | Forward | CGCGGATCCCATATG-AAGACACACCGCAAG | BamHI-NdeI |
| | 3315 | Reverse | CCCGCTCGAG-GGCGGTCAGTACGGT | XhoI |
| 012 | 3316 | Forward | CGCGGATCCCATATG-CTCGCCCGTTGCC | BamHI-NdeI |
| | 3317 | Reverse | CCCGCTCGAG-AGCGGGGAAGAGGCAC | XhoI |
| 013 | 3318 | Forward | CGCGGATCCCATATG-CCTTTGACCATGCT | BamHI-NdeI |
| | 3319 | Reverse | CCCGCTCGAG-CTGATTCGGCAAAAAAATCT | XhoI |

TABLE 7-continued

Oligonucleotides used for PCR to amplify complete or partial ORFs

| ORF | SEQ ID | primer | Sequence | Restriction sites |
|---|---|---|---|---|
| 018 | 3320 | Forward | CGCGGATCCCATATG-CAGCAGAGGCAGTT | BamHI-NdeI |
| | 3321 | Reverse | CCCGCTCGAG-GACGAGGCGAACGCC | XhoI |
| 019 | 3322 | Forward | AAAGAATTC-CTGCCAGCCGGCAAGACCCCGGC | Eco RI |
| | 3323 | Reverse | AAACTGCAG-TCAGCGGGCGGGGACAATGCCCAT | Pst I |
| 023 | 3324 | Forward | AAAGAATTC-AAAGAATATTCGGCATGGCAGGC | Eco RI |
| | 3325 | Reverse | AAACTGCAG-TTACCCCCAAATCACTTTAACTGA | Pst I |
| 025 | 3326 | Forward | AAAGAATTC-TGCGCCACCCAACAGCCTGCTCC | Eco RI |
| | 3327 | Reverse | AAACTGCAG-TCAGAACGCGATATAGCTGTTCGG | Pst I |
| 031 | 3328 | Forward | CGCGGATCCCATATG-GTCTCCCTTCGCTT | BamHI-NdeI |
| | 3329 | Reverse | CCCGCTCGAG-ATGTAAGACGGGGACAAC | XhoI |
| 032 | 3330 | Forward | CGCGGATCCCATATG-CGGCGAAACGTGC | BamHI-NdeI |
| | 3331 | Reverse | CCCGCTCGAG-CTGGTTTTTTGATATTTGTG | XhoI |
| 033 | 3332 | Forward | CGCGGATCCCATATG-GCGGCGGCAGACA | BamHI-NdeI |
| | 3333 | Reverse | CCCGCTCGAG-ATTTGCCGCATCCCGAT | XhoI |
| 034 | 3334 | Forward | CGCGGATCCCATATG-GCCGAAAACAGCTACGG | BamHI-NdeI |
| | 3335 | Reverse | CCCGCTCGAG-TTTGACGATTTGGTTCAATT | XhoI |
| 036 | 3336 | Forward | CGCGGATCCCATATG-CTGAAGCCGTGCG | BamHI-NdeI |
| | 3337 | Reverse | CCCGCTCGAG-CCGGACTGCGTATCGG | XhoI |
| 038 | 3338 | Forward | CGCGGATCCCATATG-ACCGATTTCCGCCA | BamHI-NdeI |
| | 3339 | Reverse | CCCGCTCGAG-TTCTACGCCGTACTGCC | XhoI |
| 039 | 3340 | Forward | CGCGGATCCCATATG-CCGTCCGAACCGC | BamHI-NdeI |
| | 3341 | Reverse | CCCGCTCGAG-TAGGATGACGAGGTAGG | XhoI |
| 041 | 3342 | Forward | CGCGGATCCCATATG-TTCGTGCGCGAACCGC | BamHI-NdeI |
| | 3343 | Reverse | CCCGCTCGAG-GCCCAAAAACTCTTTCAAA | XhoI |
| 042 | 3344 | Forward | CGCGGATCCCATATG-ACGATGATTTGCTTGC | BamHI-NdeI |
| | 3345 | Reverse | CCCGCTCGAG-TTTGCAGCCTGCATTTGAC | XhoI |
| 043 | 3346 | Forward | AAAAAAGGTACC-ATGGTTGTTTCAAATCAAAATATC | Kpn I |
| | 3347 | Reverse | AAACTGCAG-TTATTGCGCTTCACCTTCCGCCGC | Pst I |
| 043a | 3348 | Forward | AAAAAAGGTACC-GCAAAAGTGCATGGCGGCTTGGACGGTGC | Kpn I |
| | 3349 | Reverse | AAAAAACTGCAG-TTAATCCTGCAACACGAATTCGCCCGTCCG | Pst I |
| 044 | 3350 | Forward | CGCGGATCCCATATG-CCGTCCGACTAGAG | BamHI-NdeI |

TABLE 7-continued

Oligonucleotides used for PCR to amplify complete or partial ORFs

| ORF | SEQ ID | primer | Sequence | Restriction sites |
|---|---|---|---|---|
| | 3351 | Reverse | CCCGCTCGAG-ATGCGCTACGGTAGCCA | XhoI |
| 046 | 3352 | Forward | AAAGAATTC-ATGTCGGCAATGCTCCCGACAAG | Eco RI |
| | 3353 | Reverse | AAACTGCAG-TCACTCGGCGACCCACACCGTGAA | Pst I |
| 047 | 3354 | Forward | CGCGGATCCCATATG-GTCATCATACAGGCG | BamHI-NdeI |
| | 3355 | Reverse | CCCGCTCGAG-TCCGAAAAAGCCCATTTTG | XhoI |
| 048 | 3356 | Forward | AAAGAATTC-ATGCTCAACAAAGGCGAAGAATTGCC | Eco RI |
| | 3357 | Reverse | AAACTGCAG-TCAAGATTCGACGGGGATGATGCC | Pst I |
| 049 | 3358 | Forward | AAAGAATTC-ATGCGGGCGCAGGCGTTTGATCAGCC | Eco RI |
| | 3359 | Reverse | AAACTGCAG-AAGGCGTATCTGAAAAAATGGCAG | Pst I |
| 050 | 3360 | Forward | CGCGGATCCCATATG-GGCGCGGGCTGG | BamHI-NdeI |
| | 3361 | Reverse | CCCGCTCGAG-AATCGGGCCATCTTCGA | XhoI |
| 052 | 3362 | Forward | AAAAAAGAATTC-ATGGCTTTGGTGGCGGAGGAAAC | Eco RI |
| | 3363 | Reverse | AAAAAAGTCGAC-TCAGGCGGCGTTTTTCACCTTCCT | Sal I |
| 052a | 3364 | Forward | AAAAAAGAATTC-GTGGCGGAGGAAACGGAAATATCCGC | Eco RI |
| | 3365 | Reverse | AAAAAACTGCAG-TTAGCTGTTTTTGGAAACGCCGTCCAACCC | Pst I |
| 073 | 3366 | Forward | CGCGGATCCCATATG-TGTATGCCATATAAGAT | BamHI-NdeI |
| | 3367 | Reverse | CCCGCTCGAG-CACCGGATTGTCCGAC | XhoI |
| 075 | 3368 | Forward | CGCGGATCCCATATG-CCGTCTTACTTCATC | BamHI-NdeI |
| | 3369 | Reverse | CCCGCTCGAG-ATCACCAATGCCGATTATTT | XhoI |
| 077a | 3370 | Forward | AAAAAAGAATTC-GGCGGCATTTTCATCGACACCTTCCT | Eco RI |
| | 3371 | Reverse | AAAAAACTGCAG-TCAGACGAACATCTGCACAAACGCAAT | Pst I |
| 080 | 3372 | Forward | AAAGAATTC-GCGTCCGGGCTGGTTTGGTTTTACAATTC | Eco RI |
| | 3373 | Reverse | AAACTGCAG-CTATTCTTCGGATTCTTTTTCGGG | Pst I |
| 081 | 3374 | Forward | AAAGAATTC-ATGAAACCACTGGACCTAAATTTCATCTG | Eco RI |
| | 3375 | Reverse | AAACTGCAG-TCACTTATCCTCCAATGCCTC | Pst I |
| 082 | 3376 | Forward | AAAGAATTC-ATGTGGTTGTTGAAGTTGCCTGC | Eco RI |
| | 3377 | Reverse | AAACTGCAG-TTACGCGGATTCGGCAGTTGG | Pst I |
| 084 | 3378 | Forward | AAAGAATTC-TATCACCCAGAATATGAATACGGCTACCG | Eco RI |
| | 3379 | Reverse | AAACTGCAG-TTATACTTGGGCGCAACATGA | Pst I |
| 085 | 3380 | Forward | CGCGGATCCCATATG-GGTAAAGGGCAGGACT | BamHI-NdeI |
| | 3381 | Reverse | CCCGCTCGAG-CAAAGCCTTAAACGCTTCG | XhoI |
| 086 | 3382 | Forward | AAAAAAGGTACC-TATTTGGCATCAAAAGAAGGCGG | Kpn I |
| | 3383 | Reverse | AAACTGCAG-TTACTCCACCCGATAACCGCG | Pst I |
| 087 | 3384 | Forward | AAAGAATTC-ATGGGCGGTAAAACCTTTATGC | Eco RI |
| | 3385 | Reverse | AAACTGCAG-TTACGCCGCACACGCAATCGC | Pst I |

TABLE 7-continued

Oligonucleotides used for PCR to amplify complete or partial ORFs

| ORF | SEQ ID | primer | Sequence | Restriction sites |
|---|---|---|---|---|
| 087a | 3386 | Forward | AAAAAAGAATTC-AAGCTATTAGGCGTGCCGATTGTGATTCA | Eco RI |
| | 3387 | Reverse | AAAAAACTGCAG-TTACGCCTGCAAGATGCCCAGCTTGCC | Pst I |
| 088 | 3388 | Forward | AAAAAAGAATTC-ATGTTTTTATGGCTCGCACATTTCAG | Eco RI |
| | 3389 | Reverse | AAAAAACTGCAG-TCAGCGGATTTTGAGGGTACTCAAACC | Pst I |
| 089 | 3390 | Forward | CGCGGATCCCATATG-CCGCCCAAAATCAC | BamHI-NdeI |
| | 3391 | Reverse | CCCGCTCGAG-TGCGCATACCAAAGCCA | XhoI |
| 090 | 3392 | Forward | CGCGGATCCCATATG-CGCATAGTCGAGCA | BamHI-NdeI |
| | 3393 | Reverse | CCCGCTCGAG-AGCAAAACGGCGGTACG | XhoI |
| 091 | 3394 | Forward | AAAGAATTC-ATGGAAATACCCGTACCGCCGAGTCC | Eco RI |
| | 3395 | Reverse | AAACTGCAG-TCAGCGCAGGGGGTAGCCCAAGCC | Pst I |
| 092 | 3396 | Forward | AAAGAATTC-ATGTTTTTTATTTCAATCCG | Eco RI |
| | 3397 | Reverse | AAACTGCAG-TCAAATCTGTTTCGACAATGC | Pst I |
| 093 | 3398 | Forward | AAAGAATTC-ATGCAGAATTTTGGCAAAGTGGC | Eco RI |
| | 3399 | Reverse | AAACTGCAG-CTATGGCTCGTCATACCGGGC | Pst I |
| 094 | 3400 | Forward | AAAGAATTC-ATGCCGTCACGGAAGCGCATCAACTC | Eco RI |
| | 3401 | Reverse | AAACTGCAG-TTATCCCGGCCATACCGCCGAACA | Pst I |
| 095 | 3402 | Forward | AAAGAATTC-ATGTCCTTTCATTTGAACATGGACGG | Eco RI |
| | 3403 | Reverse | AAACTGCAG-TCAACGCCGCAGGCACTAACGCCC | Pst I |
| 096 | 3404 | Forward | AAAGAATTC-ATGGCTCGTCATACCGGGCAGGG | Eco RI |
| | 3405 | Reverse | AAACTGCAG-TCAAAGGAAAAGGCCGTCTGAAAAGCG | Pst I |
| 097 | 3406 | Forward | AAAGAATTC-ATGGACACTTCAAAACAAACACTGTTG | Eco RI |
| | 3407 | Reverse | AAACTGCAG-TCAGCCCAAATACCAGAATTTCAG | Pst I |
| 098 | 3408 | Forward | AAAGAATTC-GATGAACGCAGCCCAGCATGGATACG | Eco RI |
| | 3409 | Reverse | AAACTGCAG-TTACGACATTCTGATTTGGCA | Pst I |
| 102 | 3410 | Forward | AAAAAAGAATTC-GGCCTGATGATTTTGGAAGTCAACAC | Eco RI |
| | 3411 | Reverse | AAAAAACTGCAG-TTATCCTTTAAATACGGGGACGAGTTC | Pst I |
| 105 | 3412 | Forward | CGCGGATCCCATATG-TCCGCAAACGAATACG | BamHI-NdeI |
| | 3413 | Reverse | CCCGCTCGAG-GTGTTCTGCCAGTTTCAG | XhoI |
| 107 | 3414 | Forward | AAAAAAGAATTC-CTGATGATTTTGGAAGTCAACACCCATTATCC | Eco RI |
| | 3415 | Reverse | AAAAAACTGCAG-TTATCCTTTAAATACGGGGACGAGTTC | Pst I |
| 107b | 3416 | Forward | AAAAAAGAATTC-GATACCCAAGCCCCCGCCGGCACAAACTACTG | Eco RI |
| | 3417 | Reverse | AAAAAACTGCAG-TTACGCGTCGCCTTTAAAGTATTTGAGCAGGCTGGAGAC | Pst I |
| 108 | 3418 | Forward | AAAGAATTC-ATGTTGCCGGGCTTCAACCG | Eco RI |
| | 3419 | Reverse | AAACTGCAG-TTAGCGGTACAGGTGTTTGAAGCA | Pst I |
| 108a | 3420 | Forward | AAAAAAGAATTC-GGTAACACATTCGGCAGCTTAGACGGTGG | Eco RI |

TABLE 7-continued

Oligonucleotides used for PCR to amplify complete or partial ORFs

| ORF | SEQ ID | primer | Sequence | Restriction sites |
|---|---|---|---|---|
| | 3421 | Reverse | AAACTGCAG-TTAGCGGTACAGGTGTTTGAAGCA | Pst I |
| 109 | 3422 | Forward | AAAGAATTC-ATGTATTATCGCCGGGTTATGGG | Eco RI |
| | 3423 | Reverse | AAACTGCAG-CTAGCCCAAAGATTTGAAGTGTTC | Pst I |
| 111 | 3424 | Forward | CGCGGATCCCATATG-TGTTCGGAACAAACCGC | BamHI-NdeI |
| | 3425 | Reverse | CCCGCTCGAG-GCGGAGCAGTTTTTCAAA | XhoI |
| 114 | 3426 | Forward | CGCGGATCCCATATG-GCTTCCATCACTTCGC | BamHI-NdeI |
| | 3427 | Reverse | CCCGCTCGAG-CATCCGCGAAATCGTC | XhoI |
| 117 | 3428 | Forward | AAAAAAGGTACC-ATGGTCGAAGAACTGGAACTGCTG | Kpn I |
| | 3429 | Reverse | AAACTGCAG-TTAAAGCCGGGTAACGCTCAATAC | Pst I |
| 118 | 3430 | Forward | AAAGTCGACATGTGTGAGTTCAAGGATATTATAAG | Sal I |
| | 3431 | Reverse | AAAGCATGC-CTATTTTTTGTTGTAATAATCAAATC | Sph I |
| 121 | 3432 | Forward | CGCGGATCCCATATG-GAAACACAGCTTTACAT | BamHI-NdeI |
| | 3433 | Reverse | CCCGCTCGAG-ATAATAATATCCCGCGCCC | XhoI |
| 122 | 3434 | Forward | CGCGGATCCCATATG-GTCATGATTAAAATCCGCA | BamHI-NdeI |
| | 3435 | Reverse | CCCGCTCGAG-AATCTTGGTAGATTGGATTT | XhoI |
| 125 | 3436 | Forward | AAAGAATTC-ATGTCGGGCAATGCCTCCTCTCC | Eco RI |
| | 3437 | Reverse | AAACTGCAG-TCACGCCGTTTCAAGACG | Pst I |
| 125a | 3438 | Forward | AAAAAAGAATTC-ACGGCAGGCAGCACCGCCGCACAGGTTTC | Eco RI |
| | 3439 | Reverse | AAAAAACTGCAG-TTATTTTGCCACGTCGGTTTCTCCGGTGAACAACGC | Pst I |
| 126 | 3440 | Forward | CGCGGATCCCATATG-CCGTCTGAAACCC | BamHI-NdeI |
| | 3441 | Reverse | CCCGCTCGAG-ATATTCCGCCGAATGCC | XhoI |
| 127 | 3442 | Forward | AAAGAATTC-ATGGAAATATGGAATATGTTGGACACTTG | Eco RI |
| | 3443 | Reverse | AAACTGCAG-TTAAAGTGTTTCGGAGCCGGC | Pst I |
| 127a | 3444 | Forward | AAAAAAGAATTC-AAGGAACTGATTATGTGTCTGTCGGG | Eco RI |
| | 3445 | Reverse | AAACTGCAG-TTAAAGTGTTTCGGAGCCGGC | Pst I |
| 128 | 3446 | Forward | CGCGGATCCCATATG-ACTGACAACGCACT | BamHI-NdeI |
| | 3447 | Reverse | CCCGCTCGAG-GACCGCGTTGTCGAAA | XhoI |
| 130 | 3448 | Forward | CGCGGATCCCATATG-AAACAACTCCGCGA | BamHI-NdeI |
| | 3449 | Reverse | CCCGCTCGAG-GAATTTTGCACCGGATTG | XhoI |
| 132 | 3450 | Forward | AAAGAATTC-ATGGAACCCTTCAAAACCTTAATTTG | Eco RI |
| | 3451 | Reverse | AAAAAACTGCAG-TCACCATGTCGGCATTTGAAAAAC | Pst I |
| 134 | 3452 | Forward | CGCGGATCCCATATG-TCCCAAGAAATCCTC | BamHI-NdeI |
| | 3453 | Reverse | CCCGCTCGAG-CAGTTTGACCGAATGTTC | XhoI |

TABLE 7-continued

Oligonucleotides used for PCR to amplify complete or partial ORFs

| ORF | SEQ ID | primer | Sequence | Restriction sites |
|---|---|---|---|---|
| 135 | 3454 | Forward | CGCGGATCCCATATG-AAATACAAAAGAATCGTATT | BamHI-NdeI |
| | 3455 | Reverse | CCCGCTCGAG-AAATTCGGTCAGAAGCAGG | XhoI |
| 137 | 3456 | Forward | AAAAAAGGTACC-ATGATTACCCATCCCCAATTCGATCC | Kpn I |
| | 3457 | Reverse | AAAAAACTGCAG-TCAGTGCTGTTTTTTCATGCCGAA | Pst I |
| 137a | 3458 | Forward | AAAAAAGAATTC-GGCCGCAAACACGGCATCGGCTTCCT | Eco RI |
| | 3459 | Reverse | AAAAAACTGCAG-TTAAGCGGGATGACGCGGCAGCATACC | Pst I |
| 138 | 3460 | Forward | AAAAAAGAATTC-AACTCAGGCGAAGGAGTGCTTGTGGC | Eco RI |
| | 3461 | Reverse | AAAAAATCTAGA-TCAGTTTAGGGATAGCAGGCGTAC | Xba I |
| 141 | 3462 | Forward | AAAGAATTC-ATGAGCTTCAAAACCGATGCCGAAATCGC | Eco RI |
| | 3463 | Reverse | AAACTGCAG-TCAGAACAAGCCGTGAATCACGCC | Pst I |
| 142 | 3464 | Forward | CGCGGATCCCATATG-CGTGCCGATTTCATG | BamHI-NdeI |
| | 3465 | Reverse | CCCGCTCGAG-AAACTGCTGCACATGGG | XhoI |
| 143 | 3466 | Forward | AAAAAAGAATTC-ATGCTCAGTTTCGGCTTTCTCGGCGTTCAGAC | Eco RI |
| | 3467 | Reverse | AAAAAACTGCAG-TCAAACCCCGCCGTGTGTTTCTTTAAT | Pst I |
| 144 | 3468 | Forward | AAAAAAGAATTC-GGTCTGATCGACGGGCGTGCCGTAAC | Eco RI |
| | 3469 | Reverse | AAAAAATCTAGA-TCGGCATCGGCCGGCATATGTCCG | Xba I |
| 146 | 3470 | Forward | AAAAAAGAATTC-CGCCAAGTCGTCATTGACCACGACAAAGTC | Eco RI |
| | 3471 | Reverse | AAAAAACTGCAG-TTAGGCATCGGCAAATAGGAAACTGGG | Pst I |
| 147 | 3472 | Forward | AAAAAAGAATTC-ACTGAGCAATCGGTGGATTTGGAAAC | Eco RI |
| | 3473 | Reverse | AAAAAATCTAGA-TTAGGTAAAGCTGCGGCCCATTTGCGG | Xba I |
| 148 | 3474 | Forward | AAAAAAGAATTC-ATGGCGTTAAAAACATCAAACTTGGAACACGC | Eco RI |
| | 3475 | Reverse | AAAAAATCTAGA-TCAGCCCTTCATACAGCCTTCGTTTTG | Xba I |
| 149 | 3476 | Forward | CGCGGATCCCATATG-CTGCTTGACAACAAAGT | BamHI-NdeI |
| | 3477 | Reverse | CCCGCTCGAG-AAACTTCACGTTCACGCC | XhoI |
| 150 | 3478 | Forward | CGCGGATCCCATATG-CAGAACACAAATCCG | BamHI-NdeI |
| | 3479 | Reverse | CCCGCTCGAG-ATAAACATCACGCTGATAGC | XhoI |
| 151 | 3480 | Forward | AAAAAAGAATTC-ATGAAACAAATCCGCAACATCGCCATCATCGC | Eco RI |
| | 3481 | Reverse | AAAAAACTGCAG-TCAATCCAGCTTTTTAAAGTGGCGGCG | Pst I |
| 152 | 3482 | Forward | AAAAAAGAATTC-ATGAAAAACAAAACCAAAGTCTGGGACCTCCC | Eco RI |
| | 3483 | Reverse | AAAAAACTGCAG-TCAGGACAGGAGCAGGATGGCGGC | Pst I |
| 153 | 3484 | Forward | AAAAAAGAATTC-ATGGCGTTTGCTTACGGTATGAC | Eco RI |
| | 3485 | Reverse | AAAAAACTGCAG-TCAGTCATGTTTTTCCGTTTCATT | Pst I |
| 153a | 3486 | Forward | AAAAAAGAATTC-CGGACTTCGGTATCGGTTCCCCAGCATTG | Eco RI |

TABLE 7-continued

Oligonucleotides used for PCR to amplify complete or partial ORFs

| ORF | SEQ ID | primer | Sequence | Restriction sites |
|---|---|---|---|---|
| | 3487 | Reverse | AAAAAACTGCAG-TTACGCCGACGAAATACTCAGACTTTTCGG | Pst I |
| 154 | 3488 | Forward | CGCGGATCCCATATG-ACTGACAACAGCCC | BamHI-NdeI |
| | 3489 | Reverse | CCCGCTCGAG-TCGGCTTCCTTTCGGG | XhoI |
| 155 | 3490 | Forward | AAAAAAGAATTC-ATGAAAATCGGTATCCCACGCGAGTC | Eco RI |
| | 3491 | Reverse | AAAAAACTGCAG-TTACCCTTTCTTAAACATATTCAGCAT | Pst I |
| 156 | 3492 | Forward | AAAAAAGAATTC-GCACAGCAAAACGGTTTTGAAGC | Eco RI |
| | 3493 | Reverse | AAAAAACTGCAG-TCAAGCAGCCGCGACAAACAGCCC | Pst I |
| 157 | 3494 | Forward | CGCGGATCCCATATG-AGGAACGAGGAAAAAC | BamHI-NdeI |
| | 3495 | Reverse | CCCGCTCGAG-AAAACACAATATCCCCGC | XhoI |
| 158 | 3496 | Forward | AAAAAAGAATTC-GCGGAGCAGTTGGCGATGGCAAATTCTGC | Eco RI |
| | 3497 | Reverse | AAAAAATCTAGA-TTATCCACAGAGATTGTTTCCCAGTTC | Xba I |
| 160 | 3498 | Forward | CGCGGATCCCATATG-GACATTCTGGACAAAC | BamHI-NdeI |
| | 3499 | Reverse | CCCGCTCGAG-TTTTTGCCCGCCTTCTTT | XhoI |
| 163 | 3500 | Forward | AAAAAAGGTACC-ACCGTGCCGGATCAGGTGCAGATGTG | Kpn I |
| | 3501 | Reverse | AAAAAATCTAGA-TTACTCTGCCAATTCCACCTGCTCGTG | Xba I |
| 163a | 3502 | Forward | AAAAAAGAATTC-CGGCTGGTGCAGATAATGAGCCAGAC | Eco RI |
| | 3503 | Reverse | AAAAAATCTAGA-TTACTCTGCCAATTCCACCTGCTCGTG | Xba I |
| 164 | 3504 | Forward | CGCGGATCCCATATG-AACCGGACTTATGCC | BamHI-NdeI |
| | 3505 | Reverse | CCCGCTCGAG-TTTGTTTCCGTCAAACTGC | XhoI |
| 165 | 3506 | Forward | CGCGGATCCGCTAGC-GCTGAAGCGACAGACG | BamHI-NheI |
| | 3507 | Reverse | CCCGCTCGAG-AATATCCAATACTTTCGCG | XhoI |
| 206 | 3508 | Forward | CGCGGATCCCATATG-AAACACCGCCAACCGA | BamHI-NdeI |
| | 3509 | Reverse | CCCGCTCGAG-TTCTGTAAAAAAAGTATGTGC | XhoI |
| 209 | 3510 | Forward | CGCGGATCCCATATG-CTGCGGCATTTAGGA | BamHI-NdeI |
| | 3511 | Reverse | CCCGCTCGAG-TACCCCTGAAGGCAAC | XhoI |
| 211 | 3512 | Forward | AAAAAAGAATTC-ATGTTGCGGGTTGCTGCTGC | Eco RI |
| | 3513 | Reverse | AAAAAACTGCAG-CTATCCTGCGGATTGGCATTGAAA | Pst I |
| 212 | 3514 | Forward | CGCGGATCCCATATG-GACAATCTCGTATGG | BamHI-NdeI |
| | 3515 | Reverse | CCCGCTCGAG-AGGGGTTAGATCCTTCC | XhoI |
| 215 | 3516 | Forward | CGCGGATCCCATATG-GCATGGTTGGGTCGT | BamHI-NdeI |
| | 3517 | Reverse | CCCGCTCGAG-CATATCTTTTGTATCATAAATC | XhoI |
| 216 | 3518 | Forward | CGCGGATCCCATATG-GCAATGGCAGAAAACG | BamHI-NdeI |

TABLE 7-continued

Oligonucleotides used for PCR to amplify complete or partial ORFs

| ORF | SEQ ID | primer | Sequence | Restriction sites |
|---|---|---|---|---|
| | 3519 | Reverse | CCCGCTCGAG-TACAATCCGTGCCGCC | XhoI |
| 217 | 3520 | Forward | CGCGGATCCCATATG-GCGGATGACGGTGTG | BamHI-NdeI |
| | 3521 | Reverse | CCCGCTCGAG-ACCCCGAATATCGAATCC | XhoI |
| 218 | 3522 | Forward | CGCGGATCCCATATG-GTCGCGGTCGATC | BamHI-NdeI |
| | 3523 | Reverse | CCCGCTCGAG-TAACTCATAGAATCCTGC | XhoI |
| 219 | 3524 | Forward | CGCGGATCCGCTAGC-ACGGCAAGGTTAAG | BamHI-NheI |
| | 3525 | Reverse | CCCGCTCGAG-TTTAAACCATCTCCTCAAAAC | XhoI |
| 223 | 3526 | Forward | CGCGGATCCCATATG-GAATTCAGGCACCAAGTA | BamHI-NdeI |
| | 3527 | Reverse | CCCGCTCGAG-GGCTTCCCGCGTGTC | XhoI |
| 225 | 3528 | Forward | CGCGGATCCCATATG-GACGAGTTGACCAACC | BamHI-NdeI |
| | 3529 | Reverse | CCCGCTCGAG-GTTCAGAAAGCGGGAC | XhoI |
| 226 | 3530 | Forward | AAAGAATTC-CTTGCGATTATCGTGCGCACGCG | Eco RI |
| | 3531 | Reverse | AAACTGCAG-TCAAAATCCCAAAACGGGGAT | Pst I |
| 228 | 3532 | Forward | CGCGGATCCCATATG-TCGCAAGAAGCCAAACAG | BamHI-NdeI |
| | 3533 | Reverse | CCCGCTCGAG-TTTGGCGGCATCTTTCAT | XhoI |
| 229 | 3534 | Forward | CGCGGATCCCATATG-CAAGAGGTTTTGCCC | BamHI-NdeI |
| | 3535 | Reverse | CCCGCTCGAG-ACACAATATAGCGGATGAAC | XhoI |
| 230 | 3536 | Forward | CGCGGATCCCATATG-CATCCGGGTGCCGAC | BamHI-NdeI |
| | 3537 | Reverse | CCCGCTCGAG-AAGTTTGGCGGCTTCGG | XhoI |
| 232 | 3538 | Forward | AAAAAAGAATTC-ATGTACGCTAAAAAAGGCGGTTTGGG | Eco RI |
| | 3539 | Reverse | AAAAAACTGCAG-TCAAGGTTTTTTCCTGATTGCCGCCGC | Pst I |
| 232a | 3540 | Forward | AAAAAAGAATTC-GCCAAGGCTGCCGATACACAAATTGA | Eco RI |
| | 3541 | Reverse | AAAAAACTGCAG-TTAAACATTGTCGTTGCCGCCCAGATG | Pst I |
| 233 | 3542 | Forward | CGCGGATCCCATATG-GCGGACAAACCCAAG | BamHI-NdeI |
| | 3543 | Reverse | CCCGCTCGAG-GACGGCATTGAGCAG | XhoI |
| 234 | 3544 | Forward | CGCGGATCCCATATG-GCCGTTTCACTGACCG | BamHI-NdeI |
| | 3545 | Reverse | GCCCAAGCTT-ACGGTTGGATTGCCATG | Hind III |
| 235 | 3546 | Forward | CGCGGATCCCATATG-GCCTGCCAAGTTCAAA | BamHI-NdeI |
| | 3547 | Reverse | CCCGCTCGAG-TTTGGGCTGCTCTTC | XhoI |
| 236 | 3548 | Forward | CGCGGATCCCATATG-GCGCGTTTCGCCTT | BamHI-NdeI |
| | 3549 | Reverse | CCCGCTCGAG-ATGGGTCGCGCGCCGT | XhoI |

TABLE 7-continued

Oligonucleotides used for PCR to amplify complete or partial ORFs

| ORF | SEQ ID | primer | Sequence | Restriction sites |
|---|---|---|---|---|
| 238 | 3550 | Forward | CGCGGATCCGCTAGC-AACGGTTTGGATGCCCG | BamHI-NheI |
| | 3551 | Reverse | CCCGCTCGAG-TTTGTCTAAGTTCCTGATATG | XhoI |
| 239 | 3552 | Forward | CCGGAATTCTACATATG-CTCCACCATAAAGGTATTG | EcoRI-NdeI |
| | 3553 | Reverse | CCCGCTCGAG-TGGTGAAGAGCGGTTTAG | XhoI |
| 240 | 3554 | Forward | CGCGGATCCCATATG-GACGTTGGACGATTTC | BamHI-NdeI |
| | 3555 | Reverse | CCCGCTCGAG-AAACGCCATTACCCGATG | XhoI |
| 241 | 3556 | Forward | CCGGAATTCTACATATG-CCAACACGTCCAACT | EcoRI-NdeI |
| | 3557 | Reverse | CCCGCTCGAG-GAATGCGCCTGTAATTAATC | XhoI |
| 242 | 3558 | Forward | CGCGGATCCCATATG-ATCGGCAAACTTGTTG | BamHI-NdeI |
| | 3559 | Reverse | GCCCAAGCTT-ACCGATACGGTCGCAG | HindIII |
| 243 | 3560 | Forward | CGCGGATCCCATATG-ACGATTTTTTCGATGCTGC | BamHI-NdeI |
| | 3561 | Reverse | CCCGCTCGAG-CGACTTGGTTACCGCG | XhoI |
| 244 | 3562 | Forward | CGCGGATCCCATATG-CCGTCTGAAGCCC | BamHI-NdeI |
| | 3563 | Reverse | CCCGCTCGAG-TTTTTTCGGTAGGGGATTT | XhoI |
| 246 | 3564 | Forward | CGCGGATCCCATATG-GACATCGGCAGTGC | BamHI-NdeI |
| | 3565 | Reverse | CCCGCTCGAG-CCCGCGCTGCTGGAG | XhoI |
| 247 | 3566 | Forward | CGCGGATCCCATATG-GTCGGATCGAGTTAC | BamHI-NdeI |
| | 3567 | Reverse | CCCGCTCGAG-AAGTGTTCTGTTTGCGCA | XhoI |
| 248 | 3568 | Forward | CGCGGATCCCATATG-CGCAAACAGAACACT | BamHI-NdeI |
| | 3569 | Reverse | CCCGCTCGAG-CTCATCATTATTGCTAACA | XhoI |
| 249 | 3570 | Forward | CGCGGATCCCATATG-AAGAATAATGATTGCTTC | BamHI-NdeI |
| | 3571 | Reverse | CCCGCTCGAG-TTCCCGACCTCCGAC | XhoI |
| 251 | 3572 | Forward | CGCGGATCCCATATG-CGTGCTGCGGTAGT | BamHI-NdeI |
| | 3573 | Reverse | CCCGCTCGAG-TACGAAAGCCGGTCGTG | XhoI |
| 253 | 3574 | Forward | AAAAAAGAATTC-ATGATTGACAGGAACCGTATGCTGCG | Eco RI |
| | 3575 | Reverse | AAAAAACTGCAG-TTATTGGTCTTTCAAACGCCCTTCCTG | Pst I |
| 253a | 3576 | Forward | AAAAAAGAATTC-AAAATCCTTTTGAAAACAAGCGAAAACGG | Eco RI |
| | 3577 | Reverse | AAAAAACTGCAG-TTATTGGTCTTTCAAACGCCCTTCCTG | Pst I |
| 254 | 3578 | Forward | AAAAAAGAATTC-ATGTATACAGGCGAACGCTTCAATAC | Eco RI |
| | 3579 | Reverse | AAAAAATCTAGA-TCAGATTACGTAACCGTACACGCTGAC | Xba I |
| 255 | 3580 | Forward | CGCGGATCCCATATG-GCCGCGTTGCGTTAC | BamHI-NdeI |

TABLE 7-continued

Oligonucleotides used for PCR to amplify complete or partial ORFs

| ORF | SEQ ID | primer | Sequence | Restriction sites |
|---|---|---|---|---|
| | 3581 | Reverse | CCCGCTCGAG-ATCCGCAATACCGACCAG | XhoI |
| 256 | 3582 | Forward | CGCGGATCCGCTAGC-TTTTAACACCGCCGGAC | BamHI-NheI |
| | 3583 | Reverse | CCCGCTCGAG-ACGCCTGTTTGTGCGG | XhoI |
| 257 | 3584 | Forward | CGCGGATCCCATATG-GCGGTTTCTTTCCTG | BamHI-NdeI |
| | 3585 | Reverse | CCCGCTCGAG-GCGCGTGAATATCGCG | XhoI |
| 258 | 3586 | Forward | AAAAAAGAATTC-GATTATTTCTGGTGGATTGTTGCGTTCAG | Eco RI |
| | 3587 | Reverse | AAAAAACTGCAG-CTACGCATAAGTTTTTACCGTTTTTGG | Pst I |
| 258a | 3588 | Forward | AAAAAAGAATTC-GCGAAGGCGGTGGCGCAAGGCGA | Eco RI |
| | 3589 | Reverse | AAAAAACTGCAG-CTACGCATAAGTTTTTACCGTTTTTGG | Pst I |
| 259 | 3590 | Forward | CGCGGATCCCATATG-GAAGAGCTGCCTCCG | BamHI-NdeI |
| | 3591 | Reverse | CCCGCTCGAG-GGCTTTTCCGGCGTTT | XhoI |
| 260 | 3592 | Forward | CGCGGATCCCATATG-GGTGCGGGTATGGT | BamHI-NdeI |
| | 3593 | Reverse | CCCGCTCGAG-AACAGGGCGACACCCT | XhoI |
| 261 | 3594 | Forward | AAAAAAGAATTC-CAAGATACAGCTCGGGCATTCGC | Eco RI |
| | 3595 | Reverse | AAAAAACTGCAG-TCAAACCAACAAGCCTTGGTCACT | Pst I |
| 263 | 3596 | Forward | CGCGGATCCCATATG-GCACGTTTAACCGTA | BamHI-NdeI |
| | 3597 | Reverse | CCCGCTCGAG-GGCGTAAGCCTGCAATT | XhoI |
| 264 | 3598 | Forward | AAAAAAGGTACC-GCCGACGCAGTGGTCAAGGCAGAA | Kpn I |
| | 3599 | Reverse | AAACTGCAG-TCAGCCGGCGGTCAATACCGCCCG | Pst I |
| 265 | 3600 | Forward | AAAAAAGAATTC-GCGGAGGTCAAGAGAAGGTGTTTG | Eco RI |
| | 3601 | Reverse | AAAAAACTGCAG-TTACGAATACGTCGTCAAAATGGG | Pst I |
| 266 | 3602 | Forward | AAAGAATTC-CTCATCTTTGCCAACGCCCCCTTC | Eco RI |
| | 3603 | Reverse | AAACTGCAG-CTATTCCCTGTTGCGCGTGTGCCA | Pst I |
| 267 | 3604 | Forward | AAAGAATTC-TTCTTCCGATTCGATGTTAATCG | Eco RI |
| | 3605 | Reverse | AAACTGCAG-TTAGTAAAAACCTTTCTGCTTGGC | Pst I |
| 269 | 3606 | Forward | AAAGAATTC-TGCAAACCTTGCGCCACGTGCCC | Eco RI |
| | 3607 | Reverse | AAACTGCAG-TTACGAAGACCGCAACGAAAGGCAGAG | Pst I |
| 269a | 3608 | Forward | AAAAAAGAATTC-GACTTTATCCAAAACACGGCTTCGCC | Eco RI |
| | 3609 | Reverse | AAACTGCAG-TTACGAAGACCGCAACGAAAGGCAGAG | Pst I |
| 270 | 3610 | Forward | AAAGAATTC-GCCGTCAAGCTCGTTTTGTTGCAATG | Eco RI |
| | 3611 | Reverse | AAACTGCAG-TTATTCGGCGGTAAATGCCGTCTG | Pst I |
| 271 | 3612 | Forward | CGCGGATCCCATATG-CCTGTGTGCAGCTCGAC | BamHI-NdeI |
| | 3613 | Reverse | CCCGCTCGAG-TCCCAGCCCCGTGGAG | XhoI |
| 272 | 3614 | Forward | AAAGAATTC-ATGACCGCAAAGGAAGAACTGTTCGC | Eco RI |
| | 3615 | Reverse | AAACTGCAG-TCAGAGCAGTTCCAAATCGGGGCT | Pst I |

TABLE 7-continued

Oligonucleotides used for PCR to amplify complete or partial ORFs

| ORF | SEQ ID | primer | Sequence | Restriction sites |
|---|---|---|---|---|
| 273 | 3616 | Forward | AAAGAATTC-ATGAGTCTTCAGGCGGTATTTATATACCC | Eco RI |
| | 3617 | Reverse | AAACTGCAG-TTACGCGTAAGAAAAAACTGC | Pst I |
| 274 | 3618 | Forward | CGCGGATCCCATATG-ACAGATTTGGTTACGGAC | BamHI-NdeI |
| | 3619 | Reverse | CCCGCTCGAG-TTTGCTTTCAGTATTATTGAA | XhoI |
| 276 | 3620 | Forward | AAAAAAGAATTC-ATGATTTTGCCGTCGTCCATCACGATGATGCG | Eco RI |
| | 3621 | Reverse | AAAAAACTGCAG-CTACACCACCATCGGCGAATTTATGGC | Pst I |
| 277 | 3622 | Forward | AAAAAAGAATTC-ATGCCCCGCTTTGAGGACAAGCTCGTAGG | Eco RI |
| | 3623 | Reverse | AAAAAACTGCAG-TCATAAGCCATGCTTACCTTCCAACAA | Pst I |
| 277a | 3624 | Forward | AAAAAAGAATTC-GGGGCGGCGGCTGGGTTGGACGTAGG | Eco RI |
| | 3625 | Reverse | AAAAAACTGCAG-TCATAAGCCATGCTTACCTTCCAACAA | Pst I |
| 278 | 3626 | Forward | AAAAAAGGTACC-GTCAAAGTTGTATTAATCGGGCCTTTGCC | Kpn I |
| | 3627 | Reverse | AAAAAACTGCAG-TCATTCAACCATATCAAATCTGCC | Pst I |
| 278a | 3628 | Forward | AAAAAAGAATTC-AAAACTCTCCTAATTCGTCATAGTCG | Eco RI |
| | 3629 | Reverse | AAAAAACTGCAG-TCATTCAACCATATCAAATCTGCC | Pst I |
| 279 | 3630 | Forward | CGCGGATCCCATATG-TTGCCTGCAATCACGATT | BamHI-NdeI |
| | 3631 | Reverse | CCCGCTCGAG-TTTAGAAGCGGGCGGCAA | XhoI |
| 280 | 3632 | Forward | AAAAAAGGTACC-GCCCCCCTGCCGGTTGTAACCAG | Kpn I |
| | 3633 | Reverse | AAAAAACTGCAG-TTATTGCTTCATCGCGTTGGTCAAGGC | Pst I |
| 281 | 3634 | Forward | AAAAAAGAATTC-GCACCCGTCGGCGTATTCCTCGTCATGCG | Eco RI |
| | 3635 | Reverse | AAAAAATCTAGA-GGTCAGAATGCCGCCTTCTTTGCCGAG | Xba I |
| 281a | 3636 | Forward | AAAAAAGAATTC-TCCTACCACATCGAAATTCCTTCCGG | Eco RI |
| | 3637 | Reverse | AAAAAATCTAGA-GGTCAGAATGCCGCCTTCTTTGCCGAG | Xba I |
| 282 | 3638 | Forward | AAAAAAGAATTC-CTTTACCTTGACCTGACCAACGGGCACAG | Eco RI |
| | 3639 | Reverse | AAAAAACTGCAG-TCAACCTGCCAGTTGCGGGAATATCGT | Pst I |
| 283 | 3640 | Forward | CGCGGATCCCATATG-GCCGTCTTTACTTGGAAG | BamHI-NdeI |
| | 3641 | Reverse | CCCGCTCGAG-ACGGCAGTATTTGTTTACG | XhoI |
| 284 | 3642 | Forward | CGCGGATCCCATATG-TTTGCCTGCAAAAGAATCG | BamHI-NdeI |
| | 3643 | Reverse | CCCGCTCGAG-CCGACTTTGCAAAAACTG | XhoI |
| 286 | 3644 | Forward | CGCGGATCCCATATG-GCCGACCTTTCCGAAAA | BamHI-NdeI |
| | 3645 | Reverse | CCCGCTCGAG-GAAGCGCGTTCCCAAG | XhoI |
| 287 | 3646 | Forward | CCGGAATTCTAGCTAGC-CTTTCAGCCTGCGGG | EcoRI-NheI |
| | 3647 | Reverse | CCCGCTCGAG-ATCCTGCTCTTTTTGCC | XhoI |
| 288 | 3648 | Forward | CGCGGATCCCATATG-CACACCGGACAGG | BamHI-NdeI |

TABLE 7-continued

Oligonucleotides used for PCR to amplify complete or partial ORFs

| ORF | SEQ ID | primer | Sequence | Restriction sites |
|---|---|---|---|---|
| | 3649 | Reverse | CCCGCTCGAG-CGTATCAAAGACTTGCGT | XhoI |
| 290 | 3650 | Forward | CGCGGATCCCATATG-GCGGTTTGGGGCGGA | BamHI-NdeI |
| | 3651 | Reverse | CCCGCTCGAG-TCGGCGCGGCGGGC | XhoI |
| 292 | 3652 | Forward | CGCGGATCCCATATG-TGCGGGCAAACGCCC | BamHI-NdeI |
| | 3653 | Reverse | CCCGCTCGAG-TTGATTTTTGCGGATGATTT | XhoI |
| 294 | 3654 | Forward | AAAAAAGAATTC-GTCTGGTCGATTCGGGTTGTCAGAAC | Eco RI |
| | 3655 | Reverse | AAAAAACTGCAG-TTACCAGCTGATATAAAACATCGCTTT | Pst I |
| 295 | 3656 | Forward | CGCGGATCCCATATG-AACCGGCCGGCCTCC | BamHI-NdeI |
| | 3657 | Reverse | CCCGCTCGAG-CGATATTTGATTCCGTTGC | XhoI |
| 297 | 3658 | Forward | AAAAAAGAATTC-GCATACATTGCTTCGACAGAGAG | Eco RI |
| | 3659 | Reverse | AAAAAACTGCAG-TCAATCCGATTGCGACACGGT | Pst I |
| 298 | 3660 | Forward | AAAAAAGAATTC-CTGATTGCCGTGTGGTTCAGCCAAAACCC | Eco RI |
| | 3661 | Reverse | AAAAAACTGCAG-TCATGGCTGTGTACTTGATGGTTGCGT | Pst I |
| 299 | 3662 | Forward | CGCGGATCCGCTAGC-CTACCTGTCGCCTCCG | BamHI-NheI |
| | 3663 | Reverse | CCCGCTCGAG-TTGCCTGATTGCAGCGG | XhoI |
| 302 | 3664 | Forward | AAAAAAGAATTC-ATGAGTCAAACCGATACGCAACG | Eco RI |
| | 3665 | Reverse | AAAAAACTGCAG-TTAAGGTGCGGGATAGAATGTGGGCGC | Pst I |
| 305 | 3666 | Forward | AAAAAAGGTACC-GAATTTTTACCGATTTCCAGCACCGGA | Kpn I |
| | 3667 | Reverse | AAAAAACTGCAG-TCATTCCCAACTTATCCAGCCTGACAG | Pst I |
| 305a | 3668 | Forward | AAAAAAGGTACC-TCCCGTTCGGGCAGTACGATTATGGG | Kpn I |
| | 3669 | Reverse | AAAAAACTGCAG-TTACAAACCGACATCATGCAGGGTGAA | Pst I |
| 306 | 3670 | Forward | CGCGGATCCCATATG-TTTATGAACAAATTTTCCC | BamHI-NdeI |
| | 3671 | Reverse | CCCGCTCGAG-CCGCATCGGCAGAC | XhoI |
| 308 | 3672 | Forward | CGCGGATCCCATATG-TTAAATCGGGTATTTTATC | BamHI-NdeI |
| | 3673 | Reverse | CCCGCTCGAG-ATCCGCCATTCCCTGC | XhoI |
| 311 | 3674 | Forward | AAAAAAGGTACC-ATGTTCAGTTTTGGCTGGGTGTTT | Kpn I |
| | 3675 | Reverse | AAACTGCAG-ATGTTCATATTCCCTGCCTTCGGC | Pst I |
| 312 | 3676 | Forward | AAAAAAGGTACC-ATGAGTATCCCATCCGGCGAAATT | Kpn I |
| | 3677 | Reverse | AAACTGCAG-TCAGTTTTTCATCGATTGAACCGG | Pst I |
| 313 | 3678 | Forward | AAAAAAGAATTC-ATGGACGACCCGCGCACCTACGGATC | Eco RI |
| | 3679 | Reverse | AAAAAACTGCAG-TCAGCGGCTGCCGCCGATTTTGCT | Pst I |
| 401 | 3680 | Forward | CGCGGATCCCATATG-AAGGCGGCAACACAGC | BamHI-NdeI |
| | 3681 | Reverse | CCCGCTCGAG-CCTTACGTTTTTCAAAGCC | XhoI |
| 402 | 3682 | Forward | AAAAAAGAATTC-GTGCCTCAGGCATTTTCATTTACCCTTGC | Eco RI |

TABLE 7-continued

Oligonucleotides used for PCR to amplify complete or partial ORFs

| ORF | SEQ ID | primer | Sequence | Restriction sites |
|---|---|---|---|---|
| | 3683 | Reverse | AAAAAATCTAGA-TTAAATCCCTCTGCCGTATTTGTATTC | Xba I |
| 402a | 3684 | Forward | AAAAAAGAATTC-AGGCTGATTGAAAACAAACACGG | Eco RI |
| | 3685 | Reverse | AAAAAATCTAGA-TTAAATCCCTCTGCCGTATTTGTATTC | Xba I |
| 406 | 3686 | Forward | CGCGGATCCCATATG-TGCGGGACACTGACAG | BamHI-NdeI |
| | 3687 | Reverse | CCCGCTCGAG-AGGTTGTCCTTGTCTATG | XhoI |
| 501 | 3688 | Forward | CGCGGATCCCATATG-GCAGGCGGAGATGGC | BamHI-NdeI |
| | 3689 | Reverse | CCCGCTCGAG-GGTGTGATGTTCACCC | XhoI |
| 502 | 3690 | Forward | CGCGGATCCCATATG-GTAGACGCGCTTAAGCA | BamHI-NdeI |
| | 3691 | Reverse | CCCGCTCGAG-AGCTGCATGGCGGCG | XhoI |
| 503 | 3692 | Forward | CGCGGATCCCATATG-TGTTCGGGGAAAGGCG | BamHI-NdeI |
| | 3693 | Reverse | CCCGCTCGAG-CCGCGCATTCCTCGCA | XhoI |
| 504 | 3694 | Forward | CGCGGATCCCATATG-AGCGATATTGAAGTGACG | BamHI-NdeI |
| | 3695 | Reverse | GCCCAAGCTT-TGATTCAAGTCCTTGCCG | HindIII |
| 505 | 3696 | Forward | CGCGGATCCCATATG-TTTCGTTTACAATTCAGG | BamHI-NdeI |
| | 3697 | Reverse | CCCGCTCGAG-CGGCGTTTTATAGCGG | XhoI |
| 510 | 3698 | Forward | CGCGGATCCCATATG-CCTTCGCGGACAC | BamHI-NdeI |
| | 3699 | Reverse | CCCGCTCGAG-GCGCACTGGCAGCG | XhoI |
| 512 | 3700 | Forward | CGCGGATCCCATATG-GGACATGAAGTAACGGT | BamHI-NdeI |
| | 3701 | Reverse | CCCGCTCGAG-AGGAATAGCCTTTGACG | XhoI |
| 515 | 3702 | Forward | CGCGGATCCCATATG-GAGGAAATAGCCTTCGA | BamHI-NdeI |
| | 3703 | Reverse | CCCGCTCGAG-AAATGCCGCAAAGCATC | XhoI |
| 516 | 3704 | Forward | CGCGGATCCCATATG-TGTACGTTGATGTTGTGG | BamHI-NdeI |
| | 3705 | Reverse | CCCGCTCGAG-TTTGCGGGCGGCATC | XhoI |
| 517 | 3706 | Forward | CGCGGATCCCATATG-GGTAAAGGTGTGGAAATA | BamHI-NdeI |
| | 3707 | Reverse | CCCGCTCGAG-GTGCGCCCAGCCGT | XhoI |
| 518 | 3708 | Forward | AAAGAATTC-GCTTTTTTACTGCTCCGACCGGAAGG | Eco RI |
| | 3709 | Reverse | AAACTGCAG-TCAAATTTCAGACTCTGCCAC | Pst I |
| 519 | 3710 | Forward | CGCGGATCCCATATG-TTCAAATCCTTTGTCGTCA | BamHI-NdeI |
| | 3711 | Reverse | CCCGCTCGAG-TTTGGCGGTTTTGCTGC | XhoI |
| 520 | 3712 | Forward | CGCGGATCCCATATG-CCTGCGCTTCTTTCA | BamHI-NdeI |
| | 3713 | Reverse | CCCGCTCGAG-ATATTTACATTTCAGTCGGC | XhoI |

TABLE 7-continued

Oligonucleotides used for PCR to amplify complete or partial ORFs

| ORF | SEQ ID | primer | Sequence | Restriction sites |
|---|---|---|---|---|
| 521 | 3714 | Forward | CGCGGATCCCATATG-GCCAAAATCTATACCTGC | BamHI-NdeI |
| | 3715 | Reverse | CCCGCTCGAG-CATACGCCCCAGTTCC | XhoI |
| 522 | 3716 | Forward | CGCGGATCCCATATG-ACTGAGCCGAAACAC | BamHI-NdeI |
| | 3717 | Reverse | GCCCAAGCTT-TTCTGATTTCAAATCGGCA | HindIII |
| 523 | 3718 | Forward | CGCGGATCCCATATG-GCTCTGCTTTCCGCG | BamHI-NdeI |
| | 3719 | Reverse | CCCGCTCGAG-AGGGTGTGTGATAATAAGAAG | XhoI |
| 525 | 3720 | Forward | CGCGGATCCCATATG-GCCGAAATGGTTCAAATC | BamHI-NdeI |
| | 3721 | Reverse | CCCGCTCGAG-GCCCGTGCATATCATAAA | XhoI |
| 527 | 3722 | Forward | AAAGAATTC-TTCCCTCAATGTTGCCGTTTTCG | Eco RI |
| | 3723 | Reverse | AAACTGCAG-TTATGCTAAACTCGAAACAAATTC | Pst I |
| 529 | 3724 | Forward | CGCGGATCCGCTAGC-TGCTCCGGCAGCAAAAC | BamHI-NheI |
| | 3725 | Reverse | GCCCAAGCTT-ACGCAGTTCGGAATGGAG | HindIII |
| 530 | 3726 | Forward | CGCGGATCCCATATG-AGTGCGAGCGCGG | BamHI-NdeI |
| | 3727 | Reverse | CCCGCTCGAG-ACGACCGACTGATTCCG | XhoI |
| 531 | 3728 | Forward | AAAAAAGAATTC-TATGCCGCCGCCTACCAAATCTACGG | Eco RI |
| | 3729 | Reverse | AAAAAACTGCAG-TTAAAACAGCGCCGTGCCGACGACAAG | Pst I |
| 532 | 3730 | Forward | AAAAAAGAATTC-ATGAGCGGTCAGTTGGGCAAAGGTGC | Eco RI |
| | 3731 | Reverse | AAAAAACTGCAG-TCAGTGTTCCAAGTGGTCGGTATCAAA | Pst I |
| 532a | 3732 | Forward | AAAAAAGAATTC-TTGGGTGTCGCGTTTGAGCCGGAAGT | Eco RI |
| | 3733 | Reverse | AAAAAACTGCAG-TCAGTGTTCCAAGTGGTCGGTATCAAA | Pst I |
| 535 | 3734 | Forward | AAAGAATTC-ATGCCCTTTCCCGTTTTCAGAC | Eco RI |
| | 3735 | Reverse | AAACTGCAG-TCAGACGACCCCGCCTTCCCC | Pst I |
| 537 | 3736 | Forward | CGCGGATCCCATATG-CATACCCAAAACCAATCC | BamHI-NdeI |
| | 3737 | Reverse | CCCGCTCGAG-ATCCTGCAAATAAAGGGTT | XhoI |
| 538 | 3738 | Forward | CGCGGATCCCATATG-GTCGAGCTGGTCAAAGC | BamHI-NdeI |
| | 3739 | Reverse | CCCGCTCGAG-TGGCATTTCGGTTTCGTC | XhoI |
| 539 | 3740 | Forward | CGCGGATCCGCTAGC-GAGGATTTGCAGGAAA | BamHI-NheI |
| | 3741 | Reverse | CCCGCTCGAG-TACCAATGTCGGCAAATC | XhoI |
| 542 | 3742 | Forward | AAAGAATTC-ATGCCGTCTGAAACCGTGTC | Eco RI |
| | 3743 | Reverse | AAACTGCAG-TTACCGCGAACCGGTCAGGAT | Pst I |
| 543 | 3744 | Forward | AAAAAAGAATTC-GCCTTCGATGGCGACGTTGTAGGTAC | Eco RI |
| | 3745 | Reverse | AAAAAATCTAGA-TTAATGAAGAAGAACATATTGGAATTTTGG | Xba I |
| 543a | 3746 | Forward | AAAAAAGAATTC-GGCAAAACTCGTCATGAATTTGC | Eco RI |

TABLE 7-continued

Oligonucleotides used for PCR to amplify complete or partial ORFs

| ORF | SEQ ID | primer | Sequence | Restriction sites |
|---|---|---|---|---|
| | 3747 | Reverse | AAAAAATCTAGA-TTAATGAAGAAGAACATATTGGAATTTTGG | Xba I |
| 544 | 3748 | Forward | AAAGAATTC-GCGCCCGCCTTCTCCCTGCCCGACCTGCACGG | Eco RI |
| | 3749 | Reverse | AAACTGCAG-CTATTGCGCCACGCGCGTATCGAT | Pst I |
| 544a | 3750 | Forward | AAAAAAGAATTC-GCAAATGACTATAAAAACAAAAACTTCCAAGTACTTGC | Eco RI |
| | 3751 | Reverse | AAACTGCAG-CTATTGCGCCACGCGCGTATCGAT | Pst I |
| 547 | 3752 | Forward | AAAGAATTC-ATGTTCGTAGATAACGGATTTAATAAAAC | Eco RI |
| | 3753 | Reverse | AAACTGCAG-TTAACAACAAAAAACAAACCGCTT | Pst I |
| 548 | 3754 | Forward | AAAGAATTC-GCCTGCAAACCTCAAGACAACAGTGCGGC | Eco RI |
| | 3755 | Reverse | AAACTGCAG-TCAGAGCAGGGTCCTTACATCGGC | Pst I |
| 550 | 3756 | Forward | AAAAAAGTCGAC-ATGATAACGGACAGGTTTCATCTCTTTCATTTTCC | Sal I |
| | 3757 | Reverse | AAACTGCAG-TTACGCAAACGCTGCAAAATCCCC | Pst I |
| 550a | 3758 | Forward | AAAAAAGAATTC-GTAAATCACGCCTTTGGAGTCGCAAACGG | Eco RI |
| | 3759 | Reverse | AAACTGCAG-TTACGCAAACGCTGCAAAATCCCC | Pst I |
| 552 | 3760 | Forward | AAAAAAGAATTC-TTGGCGCGTTGGCTGGATAC | Eco RI |
| | 3761 | Reverse | AAACTGCAG-TTATTTCTGATGCCTTTTCCCAAC | Pst I |
| 554 | 3762 | Forward | CGCGGATCCCATATG-TCGCCCGCGCCCAAC | BamHI-NdeI |
| | 3763 | Reverse | CCCGCTCGAG-CTGCCCTGTCAGACAC | XhoI |
| 556 | 3764 | Forward | AAAGAATTC-GCGGGCGGTTTTGTTTGGACATCCCG | Eco RI |
| | 3765 | Reverse | AAACTGCAG-TTAACGGTGCGGACGTTTCTGACC | Pst I |
| 557 | 3766 | Forward | CGCGGATCCCATATG-TGCGGTTTCCACCTGAA | BamHI-NdeI |
| | 3767 | Reverse | CCCGCTCGAG-TTCCGCCTTCAGAAAGG | XhoI |
| 558 | 3768 | Forward | AAAGAATTC-GAGCTTTATATGTTTCAACAGGGGACGGC | Eco RI |
| | 3769 | Reverse | AAACTGCAG-CTAAACAATGCCGTCTGAAAGTGGAGA | Pst I |
| 558a | 3770 | Forward | AAAAAAGAATTC-ATTAGATTCTATCGCCATAAACAGACGGG | Eco RI |
| | 3771 | Reverse | AAAAAACTGCAG-CTAAACAATGCCGTCTGAAAGTGGAGA | Pst I |
| 560 | 3772 | Forward | AAAAAAGAATTC-TCGCCTTTCCGGGACGGGGCGCACAAGATGGC | Eco RI |
| | 3773 | Reverse | AAAAAACTGCAG-TCATGCGGTTTCAGACGGCATTTTGGC | Pst I |
| 561 | 3774 | Forward | CCGGAATTCTACATATG-ATACTGCCAGCCCGT | EcoRI-NdeI |
| | 3775 | Reverse | CCCGCTCGAG-TTTCAAGCTTTCTTCAGATG | XhoI |
| 562 | 3776 | Forward | CGCGGATCCCATATG-GCAAGCCCGTCGAG | BamHI-NdeI |
| | 3777 | Reverse | CCCGCTCGAG-AGACCAACTCCAACTCGT | XhoI |
| 565 | 3778 | Forward | CGCGGATCCCATATG-AAGTCGAGCGCGAAATAC | BamHI-NdeI |
| | 3779 | Reverse | CCCGCTCGAG-GGCATTGATCGGCGGC | XhoI |

TABLE 7-continued

Oligonucleotides used for PCR to amplify complete or partial ORFs

| ORF | SEQ ID | primer | Sequence | Restriction sites |
|---|---|---|---|---|
| 566 | 3780 | Forward | CGCGGATCCCATATG-GTCGGTGGCGAAGAGG | BamHI-NdeI |
| | 3781 | Reverse | CCCGCTCGAG-CGCATGGGCGAAGTCA | XhoI |
| 567 | 3782 | Forward | CCGGAATTCTACATATG-AGTGCGAACATCCTTG | EcoRI-NdeI |
| | 3783 | Reverse | CCCGCTCGAG-TTTCCCCGACACCCTCG | XhoI |
| 568 | 3784 | Forward | CGCGGATCCCATATG-CTCAGGGTCAGACC | BamHI-NdeI |
| | 3785 | Reverse | CCCGCTCGAG-CGGCGCGGCGTTCAG | XhoI |
| 569 | 3786 | Forward | AAAAAAGAATTC-CTGATTGCCTTGTGGGAATATGCCCG | Eco RI |
| | 3787 | Reverse | AAAAAACTGCAG-TTATGCATAGACGCTGATAACGGCAAT | Pst I |
| 570 | 3788 | Forward | CGCGGATCCCATATG-GACACCTTCCAAAAAATCG | BamHI-NdeI |
| | 3789 | Reverse | CCCGCTCGAG-GCGGGCGTTCATTTCTTT | XhoI |
| 571 | 3790 | Forward | AAAAAAGAATTC-ATGGGTATTGCCGGCGCCGTAAATGTTTTGAACCC | Eco RI |
| | 3791 | Reverse | AAAAAACTGCAG-TTATGGCCGACGCGCGGCTACCTGACG | Pst I |
| 572 | 3792 | Forward | CGCGGATCCCATATG-GCGCAAAAAGGCAAAACC | BamHI-NdeI |
| | 3793 | Reverse | CCCGCTCGAG-GCGCAGTGTGCCGATA | XhoI |
| 573 | 3794 | Forward | CGCGGATCCCATATG-CCCTGTTTGTGCCG | BamHI-NdeI |
| | 3795 | Reverse | CCCGCTCGAG-GACGGTGTCATTTCGCC | XhoI |
| 574 | 3796 | Forward | CGCGGATCCCATATG-TGGTTTGCCGCCCGC | BamHI-NdeI |
| | 3797 | Reverse | CCCGCTCGAG-AACTTCGATTTTATTCGGG | XhoI |
| 575 | 3798 | Forward | CGCGGATCCCATATG-GTTTCGGGCGAGG | BamHI-NdeI |
| | 3799 | Reverse | CCCGCTCGAG-CATTCCGAATCTGAACAG | XhoI |
| 576 | 3800 | Forward | CGCGGATCCCATATG-GCCGCCCCCGCATCT | BamHI-NdeI |
| | 3801 | Reverse | CCCGCTCGAG-ATTTACTTTTTTGATGTCGAC | XhoI |
| 577 | 3802 | Forward | CGCGGATCCCATATG-GAAAGGAACGGTGTATTT | BamHI-NdeI |
| | 3803 | Reverse | CCCGCTCGAG-AGGCTGTTTGGTAGATTCG | XhoI |
| 578 | 3804 | Forward | CGCGGATCCCATATG-AGAAGGTTCGTACAG | BamHI-NdeI |
| | 3805 | Reverse | CCCGCTCGAG-GCCAACGCCTCCACG | XhoI |
| 579 | 3806 | Forward | CGCGGATCCCATATG-AGATTGGGCGTTTCCAC | BamHI-NdeI |
| | 3807 | Reverse | CCCGCTCGAG-AGAATTGATGATGTGTATGT | XhoI |
| 580 | 3808 | Forward | CGCGGATCCCATATG-AGGCAGACTTCGCCGA | BamHI-NdeI |
| | 3809 | Reverse | CCCGCTCGAG-CACTTCCCCCGAAGTG | XhoI |

TABLE 7-continued

Oligonucleotides used for PCR to amplify complete or partial ORFs

| ORF | SEQ ID | primer | Sequence | Restriction sites |
|---|---|---|---|---|
| 581 | 3810 | Forward | CGCGGATCCCATATG-CACTTCGCCCAGC | BamHI-NdeI |
| | 3811 | Reverse | CCCGCTCGAG-CGCCGTTTGGCTTTGG | XhoI |
| 582 | 3812 | Forward | AAAAAAGAATTC-TTTGGAGAGACCGCGCTGCAATGCGC | Eco RI |
| | 3813 | Reverse | AAAAAATCTAGA-TCAGATGCCGTCCCAGTCGTTGAA | Xba I |
| 583 | 3814 | Forward | AAAAAAGAATTC-ACTGCCGGCAATCGACTGCATAATCG | Eco RI |
| | 3815 | Reverse | AAAAAACTGCAG-TTAACGGAGGTCAATATGATGAAATTG | Pst I |
| 584 | 3816 | Forward | AAAAAAGAATTC-GCGGCTGAAGCATTGAATTACAATATTGTC | Eco RI |
| | 3817 | Reverse | AAAAAACTGCAG-TCAGAACTGAACCGTCCCATTGACGCT | Pst I |
| 585 | 3818 | Forward | AAAAAAGGTACC-TCTTTCTGGCTGGTGCAGAACACCCTTGC | Eco RI |
| | 3819 | Reverse | AAAAAACTGCAG-TCAGTTCGCACTTTTTTCTGTTTTGGA | Pst I |
| 586 | 3820 | Forward | CGCGGATCCCATATG-GCAGCCCATCTCG | BamHI-NdeI |
| | 3821 | Reverse | CCCGCTCGAG-TTTCAGCGAATCAAGTTTC | XhoI |
| 587 | 3822 | Forward | CGCGGATCCCATATG-GACCTGCCCTTGACGA | BamHI-NdeI |
| | 3823 | Reverse | CCCGCTCGAG-AAATGTATGCTGTACGCC | XhoI |
| 588 | 3824 | Forward | AAAAAAGAATTC-GCCGTCCTGACTTCCTATCAAGAACCAGG | Eco RI |
| | 3825 | Reverse | AAAAAACTGCAG-TTATTTGTTTTTGGGCAGTTTCACTTC | Pst I |
| 589 | 3826 | Forward | AAAAAAGAATTC-ATGCAACAAAAAATCCGTTTCCAAATCGAAGG | Eco RI |
| | 3827 | Reverse | AAAAAACTGCAG-CTAATCGATTTTTACCCGTTTCAGGCG | Pst I |
| 590 | 3828 | Forward | AAAAAAGAATTC-ATGAAAAAACCTTTGATTTCAGTTGCGGC | Eco RI |
| | 3829 | Reverse | AAAAAACTGCAG-TTACTGCTGCGGCTCTGAAACCAT | Pst I |
| 591 | 3830 | Forward | AAAAAAGAATTC-CACTACATCGTTGCCAGATTGTGCGG | Eco RI |
| | 3831 | Reverse | AAAAAACTGCAG-CTAACCGAGCAGCCGGGTAACGTCGTT | Pst I |
| 592a | 3832 | Forward | AAAAAAGAATTC-CGCGATTACACCGCCAAGCTGAAAATGGG | Eco RI |
| | 3833 | Reverse | AAAAAACTGCAG-TTACCAAACGTCGGATTTGATACG | Pst I |
| 593 | 3834 | Forward | CGCGGATCCGCTAGC-CTTGAACTGAACGGACTC | BamHI-NheI |
| | 3835 | Reverse | CCCGCTCGAG-GCGGAAGCGGACGATT | XhoI |
| 594a | 3836 | Forward | AAAAAAGAATTC-GGTAAGTTCGCCGTTCAGGCCTTTCA | Eco RI |
| | 3837 | Reverse | AAAAAACTGCAG-TTACGCCGCCGTTTCCTGACACTCGCG | Pst I |
| 595 | 3838 | Forward | AAAAAAGAATTC-TGCCAGCCGCCGGAGGCGGAGAAAGC | Eco RI |
| | 3839 | Reverse | AAAAAACTGCAG-TTATTTCAAGCCGAGTATGCCGCG | Pst I |
| 596 | 3840 | Forward | CGCGGATCCCATATG-TCCCAACAATACGTC | BamHI-NdeI |
| | 3841 | Reverse | CCCGCTCGAG-ACGCGTTACCGGTTTGT | XhoI |
| 597 | 3842 | Forward | CGCGGATCCCATATG-CTGCTTCATGTCAGC | BamHI-NdeI |
| | 3843 | Reverse | GCCCAAGCTT-ACGTATCCAGCTCGAAG | HindIII |

TABLE 7-continued

Oligonucleotides used for PCR to amplify complete or partial ORFs

| ORF | SEQ ID | primer | Sequence | Restriction sites |
|---|---|---|---|---|
| 601 | 3844 | Forward | CGCGGATCCCATATG-ATATGTTCCCAACCGGCAAT | BamHI-NdeI |
| | 3845 | Reverse | CCCGCTCGAG-AAAACAATCCTCAGGCAC | XhoI |
| 602 | 3846 | Forward | CGCGGATCCGCTAGC-TTGCTCCATCAATGC | BamHI-NheI |
| | 3847 | Reverse | CCCGCTCGAG-ATGCAGCTGCTAAAAGCG | XhoI |
| 603 | 3848 | Forward | AAAAAAGAATTC-CTGTCCTCGCGTAGGCGGGGACGGGG | Eco RI |
| | 3849 | Reverse | AAAAAACTGCAG-CTACAAGATGCCGGCAAGTTCGGC | Pst I |
| 604 | 3850 | Forward | CGCGGATCCGCTAGC-CCCGAAGCGCACTT | BamHI-NheI |
| | 3851 | Reverse | CCCGCTCGAG-GACGGCATCTGCACGG | XhoI |
| 606a | 3852 | Forward | AAAAAAGAATTC-CGCGAATACCGCGCCGATGCGGGCGC | Eco RI |
| | 3853 | Reverse | AAAAAACTGCAG-TTAAAGCGATTTGAGGCGGGCGATACG | Pst I |
| 607 | 3854 | Forward | AAAAAAGAATTC-ATGCTGCTCGACCTCAACCGCTTTTC | Eco RI |
| | 3855 | Reverse | AAAAAACTGCAG-TCAGACGGCCTTATGCGATCTGAC | Pst I |
| 608 | 3856 | Forward | AAAAAAGAATTC-ATGTCCGCCCTCCTCCCCATCATCAACCG | Eco RI |
| | 3857 | Reverse | AAAAAACTGCAG-TTAGTCTATCCAAATGTCGCGTTC | Pst I |
| 609 | 3858 | Forward | CGCGGATCCCATATG-GTTGTGGATAGACTCG | BamHI-NdeI |
| | 3859 | Reverse | CCCGCTCGAG-CTGGATTATGATGTCTGTC | XhoI |
| 610 | 3860 | Forward | CGCGGATCCCATATG-ATTGGAGGGCTTATGCA | BamHI-NdeI |
| | 3861 | Reverse | CCCGCTCGAG-ACGCTTCAACATCTTTGCC | XhoI |
| 611 | 3862 | Forward | CGCGGATCCCATATG-CCGTCTCAAAACGGG | BamHI-NdeI |
| | 3863 | Reverse | CCCGCTCGAG-AACGACTTTGAACGCGCAA | XhoI |
| 613 | 3864 | Forward | CGCGGATCCCATATG-TCGCGTTCGAGCCG3 | BamHI-NdeI |
| | 3865 | Reverse | CCCGCTCGAG-AGCCTGTAAAATAAGCGGC | XhoI |
| 614 | 3866 | Forward | CGCGGATCCCATATG-TCCGTCGTGAGCGGC | BamHI-NdeI |
| | 3867 | Reverse | CCCGCTCGAG-CCATACTGCGGCGTTC | XhoI |
| 616 | 3868 | Forward | AAAAAAGAATTC-ATGTCAAACACAATCAAAATGGTTGTCGG | Eco RI |
| | 3869 | Reverse | AAAAAATCTAGA-TTAGTCCGGGCGGCAGGCAGCTCG | Xba I |
| 619a | 3870 | Forward | AAAAAAGAATTC-GGGCTTCTCGCCGCCTCGCTTGC | Eco RI |
| | 3871 | Reverse | AAAAAACTGCAG-TCATTTTTTGTGTTTTAAAACGAGATA | Pst I |
| 622 | 3872 | Forward | CGCGGATCCCATATG-GCCGCCCTGCCTAAAG | BamHI-NdeI |
| | 3873 | Reverse | CCCGCTCGAG-TTTGTCCAAATGATAAATCTG | XhoI |
| 624 | 3874 | Forward | CGCGGATCCCATATG-TCCCCGCGCTTTTACCG | BamHI-NdeI |
| | 3875 | Reverse | CCCGCTCGAG-AGATTCGGGCCTGCGC | XhoI |

TABLE 7-continued

Oligonucleotides used for PCR to amplify complete or partial ORFs

| ORF | SEQ ID | primer | Sequence | Restriction sites |
|---|---|---|---|---|
| 625 | 3876 | Forward | CGCGGATCCCATATG-TTTGCAACCAGGAAAATG | BamHI-NdeI |
| | 3877 | Reverse | CCCGCTCGAG-CGGCAAAATTACCGCCTT | XhoI |
| 627a | 3878 | Forward | AAAAAAGAATTC-AAAGCAGGCGAGGCAGGCGCGCTGGG | Eco RI |
| | 3879 | Reverse | AAAAAACTGCAG-TTACGAATGAAACAGGGTACCCGTCATCAAGGC | Pst I |
| 628 | 3880 | Forward | AAAAAAGGTACC-GCCTTACAAACATGGATTTTGCGTTC | Kpn I |
| | 3881 | Reverse | AAAAAACTGCAG-CTACGCACCTGAAGCGCTGGCAAA | Pst I |
| 629a | 3882 | Forward | AAAAAAGAATTC-GCCACCTTTATCGCGTATGAAAACGA | Eco RI |
| | 3883 | Reverse | AAAAAACTGCAG-TTACAACACCGCCGTCCGGTTCAAACC | Pst I |
| 630a | 3884 | Forward | AAAAAAGAATTC-GCGGCTTTGGGTATTTCTTTCGG | Eco RI |
| | 3885 | Reverse | AAAAAACTGCAG-TTAGGAGACTTCGCCAATGGAGCCGGG | Pst I |
| 635 | 3886 | Forward | AAAAAAGAATTC-ATGACCCAGCGACGGGTCGGCAAGCAAAACCG | Eco RI |
| | 3887 | Reverse | AAAAAACTGCAG-TTAATCCACTATAATCCTGTTGCT | Pst I |
| 638 | 3888 | Forward | AAAAAAGAATTC-ATGATTGGCGAAAAGTTTATCGTAGTTGG | Eco RI |
| | 3889 | Reverse | AAAAAACTGCAG-TCACGAACCGATTATGCTGATCGG | Pst I |
| 639 | 3890 | Forward | CGCGGATCCCATATG-ATGCTTTATTTTGTTCG | BamHI-NdeI |
| | 3891 | Reverse | CCCGCTCGAG-ATCGCGGCTGCCGAC | XhoI |
| 642 | 3892 | Forward | CGCGGATCCCATATG-CGGTATCCGCCGCAAT | BamHI-NdeI |
| | 3893 | Reverse | CCCGCTCGAG-AGGATTGCGGGGCATTA | XhoI |
| 643 | 3894 | Forward | CGCGGATCCCATATG-GCTTCGCCGTCGGCAG | BamHI-NdeI |
| | 3895 | Reverse | CCCGCTCGAG-AACCGAAAAACAGACCGC | XhoI |
| 644 | 3896 | Forward | AAAAAAGAATTC-ATGCCGTCTGAAAGGTCGGCGGATTGTTGCCC | Eco RI |
| | 3897 | Reverse | AAAAAATCTAGA-CTACCCGCAATATCGGCAGTCCAATAT | Pst I |
| 645 | 3898 | Forward | AAAAAAGAATTC-GTGGAACAGAGCAACACGTTAAATCG | Eco RI |
| | 3899 | Reverse | AAAAAACTGCAG-CTACGAGGAAACCGAAGACCAGGCCGC | Pst I |
| 647 | 3900 | Forward | AAAAAAGAATTC-ATGCAAAGGCTCGCCGCAGACGG | Eco RI |
| | 3901 | Reverse | AAAAAACTGCAG-TTAGATTATCAGGGATATCCGGTAGAA | Pst I |
| 648 | 3902 | Forward | AAAAAAGAATTC-ATGAACAGGCGCGACGCGCGGATCGAACG | Eco RI |
| | 3903 | Reverse | AAAAAACTGCAG-TCAAGCTGTGTGCTGATTGAATGCGAC | Pst I |
| 649 | 3904 | Forward | AAAAAAGAATTC-GGTACGTCAGAACCCGCCCACCG | Eco RI |
| | 3905 | Reverse | AAAAAACTGCAG-TTAACGGCGGAAACTGCCGCCGTC | Pst I |
| 650 | 3906 | Forward | AAAAAAGAATTC-ATGTCCAAACTCAAAACCATCGC | Eco RI |
| | 3907 | Reverse | AAAAAACTGCAG-TCAGACGGCATGGCGGTCTGTTTT | Pst I |
| 652 | 3908 | Forward | AAAAAAGGTACC-GCTGCCGAAGACTCAGGCCTGCCGCTTTACCG | Kpn I |

TABLE 7-continued

Oligonucleotides used for PCR to amplify complete or partial ORFs

| ORF | SEQ ID | primer | Sequence | Restriction sites |
|---|---|---|---|---|
| | 3909 | Reverse | AAAAAACTGCAG-TTATTTGCCCAGTTGGTAGAATGCGGC | Pst I |
| 653 | 3910 | Forward | AAAAAAGAATTC-GCGGCTTTGCCGGTAATTTTCATCGG | Eco RI |
| | 3911 | Reverse | AAAAAACTGCAG-CTATGCCGGTCTGGTTGCCGGCGGCGA | Pst I |
| 656a | 3912 | Forward | AAAAAAGAATTC-CGGCCGACGTCGTTGCGTCCTAAGTC | Eco RI |
| | 3913 | Reverse | AAAAAACTGCAG-CTACGATTTCGGCGATTTCCACATCGT | Pst I |
| 657 | 3914 | Forward | AAAAAAGAATTC-GCAGAATTTGCCGACCGCCATTTGTGCGC | Eco RI |
| | 3915 | Reverse | AAAAAACTGCAG-TTATAGGGACTGATGCAGTTTTTTTGC | Pst I |
| 658 | 3916 | Forward | CGCGGATCCCATATG-GTGTCCGGAATTGTG | BamHI-NdeI |
| | 3917 | Reverse | CCCGCTCGAG-GGCAGAATGTTTACCGTT | XhoI |
| 661 | 3918 | Forward | AAAAAAGAATTC-ATGCACATCGGCGGCTATTTTATCGACAACCC | Eco RI |
| | 3919 | Reverse | AAAAAACTGCAG-TCACGACGTGTCTGTTCGCCGTCGGGC | Pst I |
| 663 | 3920 | Forward | CGCGGATCCCATATG-TGTATCGAGATGAAATT | BamHI-NdeI |
| | 3921 | Reverse | CCCGCTCGAG-GTAAAAATCGGGGCTGC | XhoI |
| 664 | 3922 | Forward | CGCGGATCCCATATG-GCGGCTGGCGCGGT | BamHI-NdeI |
| | 3923 | Reverse | CCCGCTCGAG-AAATCGAGTTTTACACCAC | XhoI |
| 665 | 3924 | Forward | AAAAAAGAATTC-ATGAAATGGGACGAAACGCGCTTCGG | Eco RI |
| | 3925 | Reverse | AAAAAACTGCAG-TCAATCCAAAATTTTGCCGACGATTTC | Pst I |
| 666 | 3926 | Forward | AAAAAAGAATTC-AACTCAGGCGAAGGAGTGCTTGTGGC | Eco RI |
| | 3927 | Reverse | AAAAAATCTAGA-TCAGTTTAGGGATAGCAGGCGTAC | Xba I |
| 667 | 3928 | Forward | AAAAAAGAATTC-CCGCATCCGTTTGATTTCCATTTCGTATTCGTCCG | Eco RI |
| | 3929 | Reverse | AAAAAACTGCAG-TTAATGACACAATAGGCGCAAGTC | Pst I |
| 669 | 3930 | Forward | AAAAAAGAATTC-ATGCGCCGCATCATTAAAAAACACCAGCC | Eco RI |
| | 3931 | Reverse | AAAAAACTGCAG-TTACAGTATCCGTTTGATGTCGGC | Pst I |
| 670a | 3932 | Forward | AAAAAAGAATTC-AAAAACGCTTCGGGCGTTTCGTCTTC | Eco RI |
| | 3933 | Reverse | AAAAAACTGCAG-TTAGGAGCTTTTGGAACGCGTCGGACTGGC | Pst I |
| 671 | 3934 | Forward | CGCGGATCCCATATG-ACCAGCAGGGTAAC | BamHI-NdeI |
| | 3935 | Reverse | CCCGCTCGAG-AGCAACTATAAAAACGCAAG | XhoI |
| 672 | 3936 | Forward | CGCGGATCCCATATG-AGGAAAATCCGCACC | BamHI-NdeI |
| | 3937 | Reverse | CCCGCTCGAG-ACGGGATAGGCGGTTG | XhoI |
| 673 | 3938 | Forward | AAAAAAGAATTC-ATGGATATTGAAACCTTCCTTGCAGG | Eco RI |
| | 3939 | Reverse | AAAAAACTGCAG-CTACAAACCCAGCTCGCGCAGGAA | Pst I |
| 674 | 3940 | Forward | AAAAAAGAATTC-ATGAAAACAGCCCGCCGCCGTTCCCG | Eco RI |
| | 3941 | Reverse | AAAAAACTGCAG-TCAACGGCGTTTGGGCTCGTCGGG | Pst I |

TABLE 7-continued

Oligonucleotides used for PCR to amplify complete or partial ORFs

| ORF | SEQ ID | primer | Sequence | Restriction sites |
|---|---|---|---|---|
| 675 | 3942 | Forward | CGCGGATCCCATATG-AACACCATCGCCCC | BamHI-NdeI |
| | 3943 | Reverse | CCCGCTCGAG-TTCTTCGTCTTCAAACTGT | XhoI |
| 677a | 3944 | Forward | AAAAAAGAATTC-AGACGGCATTCCCGATCAGTCGATTTTGA | Eco RI |
| | 3945 | Reverse | AAAAAACTGCAG-TTACGTATGCGCGAAATCGACCGCCGC | Pst I |
| 680 | 3946 | Forward | CGCGGATCCGCTAGC-ACGAAGGGCAGTTCGG | BamHI-NheI |
| | 3947 | Reverse | CCCGCTCGAG-CATCAAAAACCTGCCGC | XhoI |
| 681 | 3948 | Forward | AAAAAAGAATTC-ATGACGACGCCGATGGCAATCAGTGC | Eco RI |
| | 3949 | Reverse | AAAAAACTGCAG-TTACCGTCTTCCGCAAAAAACAGC | Pst I |
| 683 | 3950 | Forward | CGCGGATCCCATATG-TGCAGCACACCGGACAA | BamHI-NdeI |
| | 3951 | Reverse | CCCGCTCGAG-GAGTTTTTTTCCGCATACG | XhoI |
| 684 | 3952 | Forward | CGCGGATCCCATATG-TGCGGTACTGTGCAAAG | BamHI-NdeI |
| | 3953 | Reverse | CCCGCTCGAG-CTCGACCATCTGTTGCG | XhoI |
| 685 | 3954 | Forward | CGCGGATCCCATATG-TGTTTGCTTAATAATAAACATT | BamHI-NdeI |
| | 3955 | Reverse | CCCGCTCGAG-CTTTTTCCCCGCCGCA | XhoI |
| 686 | 3956 | Forward | CGCGGATCCCATATG-TGCGGCGGTTCGGAAG | BamHI-NdeI |
| | 3957 | Reverse | CCCGCTCGAG-CATTCCGATTCTGATGAAG | XhoI |
| 687 | 3958 | Forward | CGCGGATCCCATATG-TGCGACAGCAAAGTCCA | BamHI-NdeI |
| | 3959 | Reverse | CCCGCTCGAG-CTGCGCGGCTTTTTGTT | XhoI |
| 690 | 3960 | Forward | CGCGGATCCCATATG-TGTTCTCCGAGCAAAGAC | BamHI-NdeI |
| | 3961 | Reverse | CCCGCTCGAG-TATTCGCCCCGTGTTTGG | XhoI |
| 691 | 3962 | Forward | CGCGGATCCCATATG-GCCACGGCTTATATCCC | BamHI-NdeI |
| | 3963 | Reverse | CCCGCTCGAG-TTTGAGGCAGGAAGAAAG | XhoI |
| 694 | 3964 | Forward | CGCGGATCCCATATG-TTGGTTTCCGCATCCGG | BamHI-NdeI |
| | 3965 | Reverse | CCCGCTCGAG-TCTGCGTCGGTGCGGT | XhoI |
| 695 | 3966 | Forward | CGCGGATCCCATATG-TTGCCTCAAACTCGTCCG | BamHI-NdeI |
| | 3967 | Reverse | CCCGCTCGAG-TCGTTTGCGCACGGCT | XhoI |
| 696 | 3968 | Forward | CGCGGATCCCATATG-TTGGGTTGCCGGCAGG | BamHI-NdeI |
| | 3969 | Reverse | CCCGCTCGAG-TTGATTGCCGCAATGATG | XhoI |
| 700a | 3970 | Forward | AAAAAAGAATTC-GCATCGACAGACGGTGTGTCGTGGAC | Eco RI |
| | 3971 | Reverse | AAAAAACTGCAG-TTACGCTACCGGCACGACTTCCAAACC | Pst I |
| 701 | 3972 | Forward | CGCGGATCCCATATG-AAGACTTGTTTGGATACTTC | BamHI-NdeI |

TABLE 7-continued

Oligonucleotides used for PCR to amplify complete or partial ORFs

| ORF | SEQ ID | primer | Sequence | Restriction sites |
|---|---|---|---|---|
| | 3973 | Reverse | CCCGCTCGAG-TGCCGACAACAGCCTC | XhoI |
| 702 | 3974 | Forward | AAAAAAGAATTC-ATGCCGTGTTCCAAAGCCAGTTGGATTTC | Eco RI |
| | 3975 | Reverse | AAAAAACTGCAG-TTAACCCCATTCCACCCGGAGAACCGA | Pst I |
| 703 | 3976 | Forward | CGCGGATCCGCTAGC-CAAACGCTGGCAACCG | BamHI-NheI |
| | 3977 | Reverse | CCCGCTCGAG-TTTTGCAGGTTTGATGTTTG | XhoI |
| 704a | 3978 | Forward | AAAAAAGAATTC-GCTTCTACCGGTACGCTGGCGCG | Eco RI |
| | 3979 | Reverse | AAAAAACTGCAG-TTAGTTTTGCCGGATAATATGGCGGGTGCG | Pst I |
| 707 | 3980 | Forward | CGCGGATCCGCTAGC-GAAATTATTAACGATGCAGA | BamHI-NheI |
| | 3981 | Reverse | CCCGCTCGAG-GAAACTGTAATTCAAGTTGA | XhoI |
| 708 | 3982 | Forward | CGCGGATCCGCTAGC-CCTTTTAAGCCATCCAAAA | BamHI-NheI |
| | 3983 | Reverse | CCCGCTCGAG-TTGACCGGTGAGGACG | XhoI |
| 710 | 3984 | Forward | CGCGGATCCCATATG-GAAACCCACGAAAAAATC | BamHI-NdeI |
| | 3985 | Reverse | CCCGCTCGAG-AACGGTTTCGGTCAG | XhoI |
| 714 | 3986 | Forward | CGCGGATCCCATATG-AGCTATCAAGACATCTT | BamHI-NdeI |
| | 3987 | Reverse | CCCGCTCGAG-GCGGTAGGTAAATCGGAT | XhoI |
| 716 | 3988 | Forward | CGCGGATCCCATATG-GCCAACAAACCGGCAAG | BamHI-NdeI |
| | 3989 | Reverse | CCCGCTCGAG-TTTAGAACCGCATTTGCC | XhoI |
| 718 | 3990 | Forward | CGCGGATCCCATATG-GAGCCGATAATGGCAAA | BamHI-NdeI |
| | 3991 | Reverse | CCCGCTCGAG-GGCGCGGGCATGGTCTTGTCC | XhoI |
| 720 | 3992 | Forward | CGCGGATCCCATATG-AGCGGATGGCATACC | BamHI-NdeI |
| | 3993 | Reverse | CCCGCTCGAG-TTTTGCATAGCTGTTGACCA | XhoI |
| 723 | 3994 | Forward | CGCGGATCCCATATG-CGACCCAAGCCCC | BamHI-NdeI |
| | 3995 | Reverse | CCCGCTCGAG-AATGCGAATCCGCCGCC | XhoI |
| 725 | 3996 | Forward | CGCGGATCCCATATG-GTGCGCACGGTTAAA | BamHI-NdeI |
| | 3997 | Reverse | CCCGCTCGAG-TTGCTTATCCTTAAGGGTTA | XhoI |
| 726 | 3998 | Forward | CGCGGATCCCATATG-ACCATCTATTTCAAAAAC | BamHI-NdeI |
| | 3999 | Reverse | CCCGCTCGAG-GCCGATGTTTAGCGTCC | XhoI |
| 728 | 4000 | Forward | CGCGGATCCCATATG-TTTTGGCTGGGAACGGG | BamHI-NdeI |
| | 4001 | Reverse | CCCGCTCGAG-GTGAGAAAGGTCGCGC | XhoI |
| 729 | 4002 | Forward | CGCGGATCCCATATG-TGCACCATGATTCCCCA | BamHI-NdeI |
| | 4003 | Reverse | GCCCAAGCTT-TTTGTCGGTTTGGGTATC | HindIII |

TABLE 7-continued

Oligonucleotides used for PCR to amplify complete or partial ORFs

| ORF | SEQ ID | primer | Sequence | Restriction sites |
|---|---|---|---|---|
| 731 | 4004 | Forward | CGCGGATCCGCTAGC-GCCGTGCCGGAGG | BamHI-NheI |
| | 4005 | Reverse | CCCGCTCGAG-ACGGGCGCGGCAG | XhoI |
| 732 | 4006 | Forward | CCGGAATTCTACATATG-TCGAAACCTGTTTTTAAGAA | EcoRI-NdeI |
| | 4007 | Reverse | CCCGCTCGAG-CTTCTTATCTTTTTTATCTTTC | XhoI |
| 733 | 4008 | Forward | CGCGGATCCCATATG-GCCTGCGGCGGCAA | BamHI-NdeI |
| | 4009 | Reverse | CCCGCTCGAG-TCGCTTGCCTCCTTTAC | XhoI |
| 734 | 4010 | Forward | CGCGGATCCCATATG-GCCGATACTTACGGCTAT | BamHI-NdeI |
| | 4011 | Reverse | CCCGCTCGAG-TTTGAGATTTTGAATCAAAGAG | XhoI |
| 735 | 4012 | Forward | CGCGGATCCCATATG-AAGCAGCAGGCGGTCA | BamHI-NdeI |
| | 4013 | Reverse | CCCGCTCGAG-ATTTCCGTAGCCGAGGG | XhoI |
| 737 | 4014 | Forward | CGCGGATCCCATATG-CACCACGACGGACACG | BamHI-NdeI |
| | 4015 | Reverse | CCCGCTCGAG-GTCGTCGCGGCGGGA | XhoI |
| 739 | 4016 | Forward | CGCGGATCCCATATG-GCAAAAAAACCGAACA | BamHI-NdeI |
| | 4017 | Reverse | CCCGCTCGAG-GAAGAGTTTGTCGAGAATT | XhoI |
| 740 | 4018 | Forward | CGCGGATCCCATATG-GCCAATCCGCCCGAAG | BamHI-NdeI |
| | 4019 | Reverse | CCCGCTCGAG-AAACGCGCCAAAATAGTG | XhoI |
| 741 | 4020 | Forward | CGCGGATCCCATATG-TGCAGCAGCGGAGGG | BamHI-NdeI |
| | 4021 | Reverse | CCCGCTCGAG-TTGCTTGGCGGCAAGGC | XhoI |
| 743 | 4022 | Forward | CGCGGATCCCATATG-GACGGTGTTGTGCCTGTT | BamHI-NdeI |
| | 4023 | Reverse | CCCGCTCGAG-CTTACGGATCAAATTGACG | XhoI |
| 745 | 4024 | Forward | CGCGGATCCCATATG-TTTTGGCAACTGACCG | BamHI-NdeI |
| | 4025 | Reverse | CCCGCTCGAG-CAAATCAGATGCCTTTAGG | XhoI |
| 746 | 4026 | Forward | CGCGGATCCCATATG-TCCGAAAACAAACAAAAC | BamHI-NdeI |
| | 4027 | Reverse | CCCGCTCGAG-TTCATTCGTTACCTGACC | XhoI |
| 747 | 4028 | Forward | CCGGAATTCTAGCTAGC-CTGACCCCTTGGG | EcoRI-NheI |
| | 4029 | Reverse | GCCCAAGCTT-TTTTGATTTTAATTGACTATAGAAC | HindIII |
| 749 | 4030 | Forward | CGCGGATCCCATATG-TGCCAGCCGCCG | BamHI-NdeI |
| | 4031 | Reverse | CCCGCTCGAG-TTTCAAGCCGAGTATGC | XhoI |
| 750 | 4032 | Forward | CGCGGATCCCATATG-TGTTCGCCCGAACCTG | BamHI-NdeI |
| | 4033 | Reverse | CCCGCTCGAG-CTTTTTCCCCGCCGCAA | XhoI |

TABLE 7-continued

Oligonucleotides used for PCR to amplify complete or partial ORFs

| ORF | SEQ ID | primer | Sequence | Restriction sites |
|---|---|---|---|---|
| 758 | 4034 | Forward | CGCGGATCCCATATG-AACAATCTGACCGTGTT | BamHI-NdeI |
| | 4035 | Reverse | CCCGCTCGAG-TGGCTCAATCCTTTCTGC | XhoI |
| 759 | 4036 | Forward | CGCGGATCCGCTAGC-CGCTTCACACACACCAC | BamHI-NheI |
| | 4037 | Reverse | CCCGCTCGAG-CCAGTTGTAGCCTATTTTG | XhoI |
| 763 | 4038 | Forward | CGCGGATCCCATATG-CTGCCTGAAGCATGGCG | BamHI-NdeI |
| | 4039 | Reverse | CCCGCTCGAG-TTCCGCAAATACCGTTTCC | XhoI |
| 764 | 4040 | Forward | CGCGGATCCCATATG-TTTTTCTCCGCCCTGA | BamHI-NdeI |
| | 4041 | Reverse | CCCGCTCGAG-TCGCTCCCTAAAGCTTTC | XhoI |
| 765 | 4042 | Forward | CGCGGATCCCATATG-TTAAGATGCCGTCCG | BamHI-NdeI |
| | 4043 | Reverse | CCCGCTCGAG-ACGCCGACGTTTTTTATTAA | XhoI |
| 767 | 4044 | Forward | CGCGGATCCCATATG-CTGACGGAAGGGGAAG | BamHI-NdeI |
| | 4045 | Reverse | CCCGCTCGAG-TTTCTGTACAGCAGGGG | XhoI |
| 768 | 4046 | Forward | CGCGGATCCCATATG-GCCCCGCAAAAACCCG | BamHI-NdeI |
| | 4047 | Reverse | CCCGCTCGAG-TTTCATCCCTTTTTTGAGC | XhoI |
| 770 | 4048 | Forward | CGCGGATCCCATATG-TGCGGCAGCGGCGAA | BamHI-NdeI |
| | 4049 | Reverse | CCCGCTCGAG-GCGTTTGTCGAGATTTTC | XhoI |
| 771 | 4050 | Forward | CGCGGATCCCATATG-TCCGTATATCGCACCTTC | BamHI-NdeI |
| | 4051 | Reverse | CCCGCTCGAG-CGGTTCTTTAGGTTTGAG | XhoI |
| 772 | 4052 | Forward | CGCGGATCCCATATG-TTTGCGGCGTTGGTGG | BamHI-NdeI |
| | 4053 | Reverse | CCCGCTCGAG-CAATGCCGACATCAAACG | XhoI |
| 774 | 4054 | Forward | CGCGGATCCCATATG-TCCGTTTCACCCGTTCC | BamHI-NdeI |
| | 4055 | Reverse | CCCGCTCGAG-TCGTTTGCGCACGGCT | XhoI |
| 790 | 4056 | Forward | CGCGGATCCCATATG-GCAAGAAGGTCAAAAAC | BamHI-NdeI |
| | 4057 | Reverse | CCCGCTCGAG-GGCGTTGTTCGGATTTCG | XhoI |
| 900 | 4058 | Forward | CGCGGATCCCATATG-CCGTCTGAAATGCCG | BamHI-NdeI |
| | 4059 | Reverse | CCCGCTCGAG-ATATGGAAAAGTCTGTTGTC | XhoI |
| 901 | 4060 | Forward | CGCGGATCCCATATG-CCCGATTTTTCGATG | BamHI-NdeI |
| | 4061 | Reverse | CCCGCTCGAG-AAAATGGAACAATACCAGG | XhoI |
| 902 | 4062 | Forward.2 | CCGGAATTCTACATATG-TTGCACTTTCAAAGGATAATC | EcoRI-NdeI |
| | 4063 | Reverse | CCCGCTCGAG-AAAAATGTACAATGGCGTAC | XhoI |

TABLE 7-continued

Oligonucleotides used for PCR to amplify complete or partial ORFs

| ORF | SEQ ID | primer | Sequence | Restriction sites |
|---|---|---|---|---|
| 903 | 4064 | Forward | CCGGAATTCTAGCTAGC-CAGCGTCAGCAGCACAT | EcoRI-NheI |
| | 4065 | Reverse | CCCGCTCGAG-GAAACTGTAATTCAAGTTGAA | XhoI |
| 904 | 4066 | Forward | AAAAAAGGTACC-ATGATGCAGCACAATCGTTTC | Kpn I |
| | 4067 | Reverse | AAACTGCAG-TTAATATCGATAGGTTATATG | Pst I |
| 904a | 4068 | Forward | AAAAAAGAATTC-CGGCTCGGCATTGTGCAGATGTTGCA | Eco RI |
| | 4069 | Reverse | AAACTGCAG-TTAATATCGATAGGTTATATG | Pst I |
| 905 | 4070 | Forward | CGCGGATCCCATATG-AACAAAATATACCGCATC | BamHI-NdeI |
| | 4071 | Reverse | CCCGCTCGAG-CCACTGATAACCGACAGAT | XhoI |
| 907 | 4072 | Forward | CGCGGATCCCATATG-GGCGCGCAACGTGAG | BamHI-NdeI |
| | 4073 | Reverse | CCCGCTCGAG-ACGCCACTGCCAGCG | XhoI |
| 908 | 4074 | Forward | AAAGAATTC-GCAGAGTTAGTAGGCGTTAATAAAAATAC | Eco RI |
| | 4075 | Reverse | AAACTGCAG-TTAATATGGTTTTGTCGTTCG | Pst I |
| 909 | 4076 | Forward | CGCGGATCCCATATG-TGCGCGTGGGAAACTTAT | BamHI-NdeI |
| | 4077 | Reverse | CCCGCTCGAG-TCGGTTTTGAAACTTTGGTTTT | XhoI |
| 910 | 4078 | Forward | AAAGAATTC-GCATTTGCCGGCGACTCTGCCGAGCG | Eco RI |
| | 4079 | Reverse | AAACTGCAG-TCAGCGATCGAGCTGCTCTTT | Pst I |
| 911 | 4080 | Forward | AAAGAATTC-GCTTTCCGCGTGGCCGGCGGTGC | Eco RI |
| | 4081 | Reverse | AAAAAACTGCAG-GTCGACTTATTCGGCGGCTTTTTCCGC | Pst I |
| 912 | 4082 | Forward | AAAAAAGAATTC-CAAATCCGTCAAAACGCCACTCAAGTATTGAG | Eco RI |
| | 4083 | Reverse | AAAAAACTGCAG-TTACAGTCCGTCCACGCCTTTCGC | Pst I |
| 913 | 4084 | Forward | CGCGGATCCCATATG-GAAACCCGCCCCGC | BamHI-NdeI |
| | 4085 | Reverse | CCCGCTCGAG-AGGTTGTGTTCCAGGTTG | XhoI |
| 915 | 4086 | Forward | CGCGGATCCCATATG-TGCCGGCAGGCGGAA | BamHI-NdeI |
| | 4087 | Reverse | CCCGCTCGAG-TTTGAAAATATAGGTATCAGG | XhoI |
| 914 | 4088 | Forward | AAAGAATTC-GACAGAATCGGCGATTTGGAAGCACG | Eco RI |
| | 4089 | Reverse | AAACTGCAG-CTATATGCGCGGCAGGACGCTCAACGG | Pst I |
| 916 | 4090 | Forward | CGCGGATCCCATATG-GCAATGATGGCGGCTG | BamHI-NdeI |
| | 4091 | Reverse | CCCGCTCGAG-TTTGGCGGCATCTTTCAT | XhoI |
| 917 | 4092 | Forward | AAAAAAGAATTC-CCTGCCGAAAAACCGGCACCGGC | Eco RI |
| | 4093 | Reverse | AAAAAACTGCAG-TTATTTCCCCGCCTTCACATCCTG | Pst I |
| 919 | 4094 | Forward | CGCGGATCCCATATG-TGCCAAAGCAAGAGCATC | BamHI-NdeI |
| | 4095 | Reverse | CCCGCTCGAG-CGGGCGGTATTCGGG | XhoI |

TABLE 7-continued

Oligonucleotides used for PCR to amplify complete or partial ORFs

| ORF | SEQ ID | primer | Sequence | Restriction sites |
|---|---|---|---|---|
| 920 | 4096 | Forward | CGCGGATCCCATATG-CACCGCGTCTGGGTC | BamHI-NdeI |
| | 4097 | Reverse | CCCGCTCGAG-ATGGTGCGAATGACCGA | XhoI |
| 921 | 4098 | Forward | AAAAAAGAATTC-TTGACGGAAATCCCCGTGAATCC | Eco RI |
| | 4099 | Reverse | AAAAAACTGCAG-TCATTTCAAGGGCTGCATCTTCAT | Pst I |
| 922 | 4100 | Forward.2 | CGCGGATCCGCTAGC-TGTACGGCGATGGAGGC | BamHI-NheI |
| | 4101 | Reverse | CCCGCTCGAG-CAATCCCGGGCCGCC | XhoI |
| 923 | 4102 | Forward | CGCGGATCCCATATG-TGTTACGCAATATTGTCCC | BamHI-NheI |
| | 4103 | Reverse | CCCGCTCGAG-GGACAAGGCGACGAAG | XhoI |
| 925 | 4104 | Forward | CGCGGATCCCATATG-AAACAAATGCTTTTAGCCG | BamHI-NdeI |
| | 4105 | Reverse | CCCGCTCGAG-GCCGTTGCATTTGATTTC | XhoI |
| 926 | 4106 | Forward | CGCGGATCCCATATG-TGCGCGCAATTACCTC | BamHI-NdeI |
| | 4107 | Reverse | CCCGCTCGAG-TCTCGTGCGCGCCG | XhoI |
| 927 | 4108 | Forward | CGCGGATCCCATATG-TGCAGCCCCGCAGC | BamHI-NdeI |
| | 4109 | Reverse | CCCGCTCGAG-GTTTTTTGCTGACGTAGT | XhoI |
| 929a | 4110 | Forward | AAAAAAGAATTC-CGCGGTTTGCTCAAAACAGGGCTGGG | Eco RI |
| | 4111 | Reverse | AAAAAATCTAGA-TTAAGAAAGACGGAAACTACTGCC | Xba I |
| 931 | 4112 | Forward | AAAAAAGAATTC-GCAACCCATGTTTTGATGGAAAC | Eco RI |
| | 4113 | Reverse | AAAAAACTGCAG-TTACTGCCCGACAACAACGCGACG | Pst I |
| 935 | 4114 | Forward | AAAAAAGAATTC-GCGGATGCGCCCGCGATTTTGGATGACAAGGC | Eco RI |
| | 4115 | Reverse | AAAAAACTGCAG-TCAAAACCGCCAATCCGCCGACAC | Pst I |
| 936 | 4116 | Forward | CGCGGATCCCATATG-GCCGCCGTCGGCGC | BamHI-NdeI |
| | 4117 | Reverse | CCCGCTCGAG-GCGTTGGACGTAGTTTTG | XhoI |
| 937 | 4118 | Forward | AAAAAAGAATTC-CCGGTTTACATTCAAACCGGCGCAAC | Eco RI |
| | 4119 | Reverse | AAAAAACTGCAG-TTAAAATGTATGCTGTACGCCAAA | Pst I |
| 939a | 4120 | Forward | AAAAAAGAATTC-GGTTCGGCAGCTGTGATGAAACC | Eco RI |
| | 4121 | Reverse | AAAAAACTGCAG-TTAACGCAAACCTTGGATAAAGTTGGC | Pst I |
| 950 | 4122 | Forward | CGCGGATCCCATATG-GCCAACAAACCGGCAAG | BamHI-NdeI |
| | 4123 | Reverse | CCCGCTCGAG-TTTAGAACCGCATTTGCC | XhoI |
| 953 | 4124 | Forward | CGCGGATCCCATATG-GCCACCTACAAAGTGGAC | BamHI-NdeI |
| | 4125 | Reverse | CCCGCTCGAG-TTGTTTGGCTGCCTCGAT | XhoI |
| 957 | 4126 | Forward | CGCGGATCCCATATG-TTTTGGCTGGGAACGGG | BamHI-NdeI |
| | 4127 | Reverse | CCCGCTCGAG-GTGAGAAAGGTCGCGC | XhoI |

TABLE 7-continued

Oligonucleotides used for PCR to amplify complete or partial ORFs

| ORF | SEQ ID | primer | Sequence | Restriction sites |
|---|---|---|---|---|
| 958 | 4128 | Forward | CGCGGATCCCATATG-GCCGATGCCGTTGCG | BamHI-NdeI |
| | 4129 | Reverse | GCCCAAGCTT-GGGTCGTTTGTTGCGTC | HindIII |
| 959 | 4130 | Forward | CGCGGATCCCATATG-CACCACGACGGACACG | BamHI-NdeI |
| | 4131 | Reverse | CCCGCTCGAG-GTCGTCGCGGCGGGA | XhoI |
| 961 | 4132 | Forward | CGCGGATCCCATATG-GCCACAAGCGACGACG | BamHI-NdeI |
| | 4133 | Reverse | CCCGCTCGAG-CCACTCGTAATTGACGC | XhoI |
| 972 | 4134 | Forward | AAAAAAGAATTC-TTGACTAACAGGGGGGGAGCGAAATTAAAAAC | Eco RI |
| | 4135 | Reverse | AAAAAATCTAGA-TTAAAAATAATCATAATCTACATTTTG | Xba I |
| 973 | 4136 | Forward | AAAAAAGAATTC-ATGGACGGCGCACAACCGAAAAC | Eco RI |
| | 4137 | Reverse | AAAAAACTGCAG-TTACTTCACGCGGGTCGCCATCAGCGT | Pst I |
| 982 | 4138 | Forward | CGCGGATCCCATATG-GCAGCAAAAGACGTAC | BamHI-NdeI |
| | 4139 | Reverse | CCCGCTCGAG-CATCATGCCGCCCATCC | XhoI |
| 983 | 4140 | Forward | CGCGGATCCCATATG-TTAGCTGTTGCAACAACAC | BamHI-NdeI |
| | 4141 | Reverse | CCCGCTCGAG-GAACCGGTAGCCTACG | XhoI |
| 987 | 4142 | Forward | CGCGGATCCCATATG-CCCCCACTGGAAGAAC | BamHI-NdeI |
| | 4143 | Reverse | CCCGCTCGAG-TAATAAACCTTCTATGGGC | XhoI |
| 988 | 4144 | Forward | CGCGGATCCCATATG-TCTTTAAATTTACGGGAAAAAG | BamHI-NdeI |
| | 4145 | Reverse | GCCCAAGCTT-TGATTTGCCTTTCCGTTTT | HindIII |
| 989 | 4146 | Forward | CCGGAATTCTACATATG-GTCCACGCATCCGGCTA | EcoRI-NdeI |
| | 4147 | Reverse | CCCGCTCGAG-TTTGAATTTGTAGGTGTATTGC | XhoI |
| 990 | 4148 | Forward.2 | CGCGGATCCGCTAGC-TTCAGAGCTCAGCTT | BamHI-NheI |
| | 4149 | Reverse | CCCGCTCGAG-AAACAGCCATTTGAGCGA | XhoI |
| 992 | 4150 | Forward | CGCGGATCCCATATG-GACGCGCCCGCCCG | BamHI-NdeI |
| | 4151 | Reverse | CCCGCTCGAG-CCAAATGCCCAACCATTC | XhoI |
| 993 | 4152 | Forward | CGCGGATCCCATATG-GCAATGCTGATTGAAATCA | BamHI-NdeI |
| | 4153 | Reverse | CCCGCTCGAG-GAACACATCGCGCCCG | XhoI |
| 996 | 4154 | Forward | CGCGGATCCCATATG-TGCGGCAGAAAATCCGC | BamHI-NdeI |
| | 4155 | Reverse | CCCGCTCGAG-TCTAAACCCCTGTTTTCTC | XhoI |
| 997 | 4156 | Forward | CCGGAATTCTAGCTAGC-CGGCACGCCGACGTT | EcoRI-NheI |
| | 4157 | Reverse | CCCGCTCGAG-GACGGCATCGCTCAGG | XhoI |

Underlined sequences indicate restriction recognition sites.

The following DNA and amino acid sequences are identified by titles of the following form: [g, m, or a] [#].[seq or pep], where "g" means a sequence from *N. gonorrhoeae*, "m" means a sequence from *N. meningitidis* B, and "a" means a sequence from *N. meningitidis* A; "#" means the number of the sequence; "seq" means a DNA sequence, and "pep" means an amino acid sequence. For example, "g001.seq" refers to an *N. gonorrohoeae* DNA sequence, number 1. The presence of the suffix "-1" to these sequences indicates an additional sequence found for the same ORF. Further, open reading frames are identified as ORF #, where "#" means the number of the ORF, corresponding to the number of the sequence which encodes the ORF, and the ORF designations may be suffixed with ".ng" or ".a", indicating that the ORF corresponds to a *N. gonorrhoeae* sequence or a *N. meningitidis* A sequence, respectively. Computer analysis was performed for the comparisons that follow between "g", "m", and "a" peptide sequences; and therein the "pep" suffix is implied where not expressly stated.

The following partial DNA sequence was identified in *N. gonorrhoeae* <SEQ ID 1>:

```
g001.seq
    1 ATGCTGCCGC AGGGGAAGGC GGCGCGGAGG GTGTCGGCGA ACGAGGTGTC
   51 CGGCAGGGCT TGCGCCCGGA TGGTGCTGGT CATCTGCCAG ACGCTGCCGA
  101 AACGCGATAC TTTAAACGGC TCGGGTACGC ATACTTTACC GGTTTGGGCG
  151 ATTTTGCCGA GGTCGTTGCG CAGCAAATCG ACAATCATCA CGTTTTCGGC
  201 GCGGTTTTTC GGGTCGGTTT GTAACTCGGC GGCGCGGCGT TCGTCTTGTC
  251 CGTCGCCCAA AATCGGCGCG GTGCCTTTCA TCGGTTCGGT GCTGATGGTG
  301 CCGTCTGAAG CGATGTTGAG GAAGAGTTCG GGCGAGAAAC ACAGCGTCCA
  351 CGCGGATTGC CCGGCTTCAT CGGGCAGGTG GGACAATACG GCATAG
```

This corresponds to the amino acid sequence <SEQ ID 2; ORF 001.ng>:

```
g001.pep
    1 MLPQGKAARR VSANEVSGRA CARMVLVICQ TLPKRDTLNG SGTHTLPVWA
   51 ILPRSLRSKS TIITFSARFF GSVCNSAARR SSCPSPKIGA VPFIGSVLMV
  101 PSEAMLRKSS GEKHSVHADC PASSGRWDNT A*
```

The following partial DNA sequence was identified in *N. meningitidis* <SEQ ID 3>:

```
m001.seq
    1 ATGCTGCCGC AGGGGAAGGC GGCGCGGAGG ATGTCGGCGA ACGAGGTGTG
   51 CGGcAssCTT ss.GCTTGGA yGGTGCTGGT CATCTGCCAA ACGCTGCCGA
  101 AACGCGATAC TTTAAACGGT TCGGGTACGC ATACTGTGCC GGTTTGGGCG
  151 ATTTTGCCGA GATCGTTACG CAGCAAATCG ACAATCATCA CGTTTTCGGC
  201 GCGGTTTTTC GGGTCTGCTT GCAACTCGGC GGCGCGGCGT TCGTCTTGTC
  251 CGTCGCCCAA AATCGGCGCG GTGCCTTTCA TCGGTTCGGT GCTGATGGTG
  301 CCGTCCGAAC CGATTTTGAG GAAGAGTTCG GGCGAGAAAC ACAGCGTCCA
  351 CGCGGATTGC CCCTCCGCAT CGGGCAGGTG GGACAAGACG GCATAG
```

This corresponds to the amino acid sequence <SEQ ID 4; ORF 001>:

```
m001.pep
    1 MLPQGKAARR MSANEVCGXL XAWXVLVICQ TLPKRDTLNG SGTHTVPVWA
   51 ILPRSLRSKS TIITFSARFF GSACNSAARR SSCPSPKIGA VPFIGSVLMV
  101 PSEPILRKSS GEKHSVHADC PSASGRWDKT A*
```

The following partial DNA sequence was identified in *N. meningitidis* <SEQ ID 5>:

```
a001.seq
   1  ATGCTGCCGC AGGGGAAGGC GGCGCGGAGG ATGTCGGCGA ACGAGGTGTG

  51  CGGCAAGGCT TGGGCTTGGA TGGTGCTGGT CATCTGCCAA ACGCTGCCGA

 101  AACGCGATAC TTTAAACGGT TCGGGTACGC ATACTGTGCC GGTTTGGGCG

 151  ATTTTGCCGA GGTCGTTACG CAGCAAATCG ACAATCATCA CGTTTTCGGC

 201  GCGGTTTTTC GGGTCTGCTT GCAACTCGGC GGCGCGGCGT TCGTCTTGTC

 251  CGTCGCCCAA AATCGGCGCG GTGCCTTTCA TCGGTTCGGT GCTGATGGTG

 301  CCGTCCGAAC CGATTTTGAG GAAGAGTTCG GGCGAGAAAC ACAGCGTCCA

 351  CGCGGATTGC CCTTGTGCAT CGGGCAGGTG GGACAAAACG GCATAG
```

This corresponds to the amino acid sequence <SEQ ID 6; ORF 001.a>:

```
a001.pep

       1  MLPQGKAARR MSANEVCGKA WAWMVLVICQ TLPKRDTLNG SGTHTVPVWA

      51  ILPRSLRSKS TIITFSARFF GSACNSAARR SSCPSPKIGA VPFIGSVLMV

     101  PSEPILRKSS GEKHSVHADC PCASGRWDKT A*

m001/a001   96.2% identity over a 131 aa overlap

                    10        20        30        40        50        60
m001.pep    MLPQGKAARRMSANEVCGXLXAWXVLVICQTLPKRDTLNGSGTHTVPVWAILPRSLRSKS
            ||||||||||||||||||   || ||||||||||||||||||||||||||||||||||||
a001.pep    MLPQGKAARRMSANEVCGKAWAWMVLVICQTLPKRDTLNGSGTHTVPVWAILPRSLRSKS
                    10        20        30        40        50        60

                    70        80        90       100       110       120
m001.pep    TIITFSARFFGSACNSAARRSSCPSPKIGAVPFIGSVLMVPSEPILRKSSGEKHSVHADC
            ||||||||||||||||||||||||||||||||||||||||||||||||||||||||||||
a001.pep    TIITFSARFFGSACNSAARRSSCPSPKIGAVPFIGSVLMVPSEPILRKSSGEKHSVHADC
                    70        80        90       100       110       120

                   130
m001.pep    PSASGRWDKTAX
            | ||||||||||
a001.pep    PCASGRWDKTAX
                   130
```

Computer analysis of this amino acid sequence gave the following results:

Homology with a Predicted ORF from *N. Gonorrhoeae*

ORF 001 shows 89.3% identity over a 131 aa overlap with a predicted ORF (ORF 001.ng) from *N. gonorrhoeae*:

```
m001/g001
                  10        20        30        40        50        60
m001.pep  MLPQGKAARRMSANEVCGXLXAWXVLVICQTLPKRDTLNGSGTHTVPVWAILPRSLRSKS
          ||||||||||:||||| |   |  |||||||||||||||||||||:||||||||||||||
g001      MLPQGKAARRVSANEVSGRACARMVLVICQTLPKRDTLNGSGTHTLPVWAILPRSLRSKS
                  10        20        30        40        50        60

                  70        80        90       100       110       120
m001.pep  TIITFSARFFGSACNSAARRSSCPSPKIGAVPFIGSVLMVPSEPILRKSSGEKHSVHADC
          ||||||||||||:|||||||||||||||||||||||||||||| :|||||||||||||||
g001      TIITFSARFFGSVCNSAARRSSCPSPKIGAVPFIGSVLMVPSEAMLRKSSGEKHSVHADC
                  70        80        90       100       110       120

                 130
m001.pep  PSASGRWDKTAX
          |::|||||:|||
g001      PASSGRWDNTAX
                 130
```

The following partial DNA sequence was identified in *N. gonorrhoeae* <SEQ ID 7>:

```
g003.seq
   1  ATGGTCGTAT TCGTGGCTGA AGGCGTATTC GGTCGCGCTG TTTTGGGTCA

  51  CTTGGTATTG CTCTTCGGTC AGGGTGCGTT TGAGTTCGGC GTCACTCGGT

 101  TTTTTATACG TTGCCGCGTC GAAGCCTTTG CCTTGCGGTG CGGCTTTGGT

 151  TTTGCCCGGC AGCGGTTCGT CGGCTTTGCG GATGTCGATG TGGCAGTAGC

 201  CGTTGGGGTT TTTAATCAGG TAGTCCTGAT GGTATTCCTC GGCGTCGTAG

 251  AAGTTTTTCA GCGGTTCGTT TTCAACAACG AGGGGCAGTT GGTATTTTTG

 301  CTGCTCGCGT TTGAGGGCGG CGGCGATGAC GGCTTTTTCG GCGGGGTCGG

 351  TGTAGTACAC GCCGCTGCGG TATTGCGTGC CGGTGTCGTT ACCCTGTTTG

 401  TTGAGGCTGG TCGGATCAAC GACGCGGAAA TAATATTGCA GGATGTCGTC

 451  CAGgCTGagt TTGTCGGCAT CGTaggtcac tTTGACGGTC TCGGCATGAC

 501  CCGTATGGCG GTaggacact tctTCgtanc TcGGGtTTTC CGTGttGCCG

 551  TTGGCgttac cGGATACCGC gtcaACCACG CCGTcgatgc gttggaAATa

 601  ggCTTCCAAg ccccaaaagc agccgccggc gaagtaaatg gtgcccgtgt

 651  tcatgattGC TGa
```

This corresponds to the amino acid sequence <SEQ ID 8; ORF 003.ng>:

```
g003.pep
   1  MVVFVAEGVF GRAVLGHLVL LFGQGAFEFG VTRFFIRCRV EAFALRCGFG

  51  FARQRFVGFA DVDVAVAVGV FNQVVLMVFL GVVEVFQRFV FNNEGQLVFL

 101  LLAFEGGGDD GFFGGVGVVH AAAVLRAGVV TLFVEAGRIN DAEIILQDVV

 151  QAEFVGIVGH FDGLGMTRMA VGHFFVRVFR VAVGVTGYRV NHAVDALEIG

 201  FQAPKAAAGE VNGARVHDC
```

The following partial DNA sequence was identified in *N. meningitidis* <SEQ ID 9>:

```
m003.sq
   1  ATGGTCGTAT TCGTGGCTGA AGGCATATTC GGTCGCGCTG TTTTGGGTAA

  51  CTTGGsTATTG CTCTTCGGTC AGGGTGCGTT TGAGTTCGGC GTCACTCGGT

 101  TTTTTATACG TTGCCGCGTC GAAGCCTTTG CCTTGCGGGG CGGTCTTGGT

 151  TTTGCCCGGC AGCGGTTCGT CAGCkTTGCG GATGTCGATG TGGCAGTAGC

 201  CGTTGGGGTT TTTAATCAAG TAGTCCTGAT GGTATTCCTC GGCATCGTAG

 251  AAGTTTTtCA GCGGCTCGTT TTCAACAACG AGGGGCAGTT GGTATTTTTG

 301  CTGCTCGCGT TTGAGGGCGk CGGCGATGAC GGCTTTTTCG kCGGGGTCGG

 351  TGTAGTACAC GCCGCTGCGG TATTGCGTAC CGGTGTCGTT GCCCTGTTTG

 401  TTGAGGCTGG TCGGATCAAC GACGCGGAAG AAATATTGCA GGATGTCGTC

 451  TAGGCTGAGT TTGTCGGCAT CGTAGGTCAC TTTGACGGTT TCGGCGTGGC

 501  CCGTATGGCG GTAGGACACG TCTTCATAGC TCGGATTTTT CGTGTTGCCG

 551  TTGGCGTAGC CGGATACCGC GTCAACCACG CCGTCGATGC GTTGGAAATA
```

-continued

```
601  GGCTTCCAAG CCCCAGAAGC AGCg.CCGGC GAGGTAAATG GTGCGCGTGT

651  TCATGATTTT TGA
```

This corresponds to the amino acid sequence <SEQ ID 10; ORF 003>:

```
m003.pep Length: 221
   1  MVVFVAEGIF GRAVLGNLXL LFGQGAFEFG VTRFFIRCRV EAFALRGGLG

  51  FARQRFVSXA DVDVAVAVGV FNQVVLMVFL GIVEVFQRLV FNNEGQLVFL

 101  LLAFEGXGDD GFFXGVGVVH AAAVLRTGVV ALFVEAGRIN DAEEILQDVV

 151  *AEFVGIVGH FDGFGVARMA VGHVFIARIF RVAVGVAGYR VNHAVDALEI

 201  GFQAPEAAXG EVNGARVHDF *
```

The following partial DNA sequence was identified in *N. meningitidis* <SEQ ID 11>:

```
a003.seq
   1  ATGGTCGTAT TCGTGGCTGA AGGCATATTC GGTCGCGCTG TTTTGGGTAA

  51  CTTGGTATTG CTCTTCGGTC AGGGTGCGTT TGAGTTCGGC GTCACTCGGT

 101  TTTTTATACG TTGCCGCGTC GAAGCCTTTG CCTTGCGGTG CGGTCTTGGT

 151  TTTGCCCGGC AGCGGTTCGT CGGCTTTGCG GATATCGATG TGGCAGTAGC

 201  CGTTGGGGTT TTTAATCAAG TAGTCCTGAT GGTATTCCTC GGCATCGTAG

 251  AAGTTTTTCA GCGGCTCGTT TTCAACAACG AGGGGCAGTT GGTATTTTTG

 301  CTGCTCGCGT TTGAGGGCGG CGGCGATGAC GGCTTTTTCG GCGGGGTCGG

 351  TGTAGTACAC GCCGCTGCGG TATTGCGTAC CGGTGTCGTT GCCCTGTTTG

 401  TTGAGGCTGG TCGGATCAAC GACGCGGAAG AAATATTGCA GGATGTCGTC

 451  TAGGCTGAGT TTGTCGGCAT CGTAGGTCAC TTTGACGGTT TCGGCGTGGC

 501  CCGTATGGCG GTAGGACACG TCTTCATAGC TCGGATTTTT CGTGTTGCCG

 551  TTGGCGTAGC CGGATACCGC GTCAACCACG CCGTCGATGC GTTGGAAATA

 601  GGCTTCCAAG CCCCAGAAGC AGCCGCCGGC GAGGTAGATG GTGCGCGTGT

 651  TCATGATTTT TGA
```

This corresponds to the amino acid sequence <SEQ ID 12; ORF 003.a>:

```
a003.pep
   1  MVVFVAEGIF GRAVLGNLVL LFGQGAFEFG VTRFFIRCRV EAFALRCGLG

  51  FARQRFVGFA DIDVAVAVGV FNQVVLMVFL GIVEVFQRLV FNNEGQLVFL

 101  LLAFEGGGDD GFFGGVGVVH AAAVLRTGVV ALFVEAGRIN DAEEILQDVV

 151  *AEFVGIVGH FDGFGVARMA VGHVFIARIF RVAVGVAGYR VNHAVDALEI

 201  GFQAPEAAAG EVDGARVHDF *
```

m003/a003 95.9% identity over a 220 aa overlap

```
                    10        20        30        40        50        60
m003.pep    MVVFVAEGIFGRAVLGNLXLLFGQGAFEFGVTRFFIRCRVEAFALRGGLGFARQRFVSXA
            |||||||||||||||||| |||||||||||||||||||||||||||| ||||||||||: |
a003        MVVFVAEGIFGRAVLGNLVLLFGQGAFEFGVTRFFIRCRVEAFALRCGLGFARQRFVGFA
                    10        20        30        40        50        60
```

-continued

```
                  70        80        90       100       110       120
m003.pep  DVDVAVAVGVFNQVVLMVFLGIVEVFQRLVFNNEGQLVFLLLAFEGXGDDGFFXGVGVVH
          |:|||||||||||||||||||||||||||||||||||||||||||| |||||| ||||||
a003      DIDVAVAVGVFNQVVLMVFLGIVEVFQRLVFNNEGQLVFLLLAFEGGGDDGFFGGVGVVH
                  70        80        90       100       110       120

                 130       140       150       160       170       180
m003.pep  AAAVLRTGVVALFVEAGRINDAEEILQDVVXAEFVGIVGHFDGFGVARMAVGHVFIARIF
          ||||||||||||||||||||||||||||||||||||||||||||||||||||||||||||
a003      AAAVLRTGVVALFVEAGRINDAEEILQDVVXAEFVGIVGHFDGFGVARMAVGHVFIARIF
                 130       140       150       160       170       180

                 190       200       210       220
m003.pep  RVAVGVAGYRVNHAVDALEIGFQAPEAAXGEVNGARVHDFX
          |||||||||||||||||||||||||||| |||:||||||||
a003      RVAVGVAGYRVNHAVDALEIGFQAPEAAXGEVDGARVHDFX
                 190       200       210       220
```

Computer analysis of this amino acid sequence gave the following results:

Homology with a Predicted ORF from *N. Gonorrhoeae*

ORF 003 shows 88.6% identity over a 219 aa overlap with a predicted ORF (ORF 003.ng) from *N. gonorrhoeae*:

m003/g003

```
                  10        20        30        40        50        60
m003.pep  MVVFVAEGIFGRAVLGNLXLLFGQGAFEFGVTRFFIRCRVEAFALRGGLGFARQRFVSXA
          ||||||||:|||||||:| ||||||||||||||||||||||||||| |:||||||||: |
g003      MVVFVAEGVFGRAVLGHLVLLFGQGAFEFGVTRFFIRCRVEAFALRCGFGFARQRFVGFA
                  10        20        30        40        50        60

                  70        80        90       100       110       120
m003.pep  DVDVAVAVGVFNQVVLMVFLGIVEVFQRLVFNNEGQLVFLLLAFEGXGDDGFFXGVGVVH
          |||||||||||||||||||||:||||||:||||||||||||||||| |||||| ||||||
g003      DVDVAVAVGVFNQVVLMVFLGVVEVFQRFVFNNEGQLVFLLLAFEGGGDDGFFGGVGVVH
                  70        80        90       100       110       120

                 130       140       150       160       170       180
m003.pep  AAAVLRTGVVALFVEAGRINDAEEILQDVVXAEFVGIVGHFDGFGVARMAVGHVFIARIF
          ||||||:|||:|||||||||||| |||||| ||||||||||||:|::|||||| |: |:|
g003      AAAVLRAGVVTLFVEAGRINDAEIILQDVVQAEFVGIVGHFDGLGMTRMAVGHFFV-RVF
                 130       140       150       160       170       180

                 190       200       210       220
m003.pep  RVAVGVAGYRVNHAVDALEIGFQAPEAAXGEVNGARVHDFX
          ||||||:||||||||||||||||||:|| ||||||||||
g003      RVAVGVTGYRVNHAVDALEIGFQAPKAAAGEVNGARVHDC
                  190       200       210
```

The following partial DNA sequence was identified in *N. gonorrhoeae* <SEQ ID 13>:

```
g004.seq
    1  ATGgtagAAC GGCATATCCA GCATTTGCGG AACGGTCATC TTCATTTGAT

   51  GCGCCCATGC CAACAagtga gccaAAtgtT CGGCGGCAGG GCCTacgatT

  101  TCCGCGCCGA TAAagcggcc gGTGgctTTT tcgGCataca ggcgcaTatg

  151  gCCTTTGTTT ACCAgcatca cgcggctgcg accttgaTTT TTGAACGATA

  201  CTTCGCCgaT GACAAATTCG TCGGCTTGGT ATTGCGCGGC AACCTGCGCG

  251  TATTTCAAAC CGACAAAGCC GATTTGCgga ctggtaaACA CCACGCCAAT

  301  GGTgctgcgg cGCAAACCGC TGCCGATATt cgGgtagcgg ccccgcgtta

  351  ttgcccggca atcttacctt ggtcggcggc ttcatGCAGC AGGGGCagtt

  401  ggttggacgc gtcgcccgca ataAAGATAT GCGGAATgct ggtCTGCATg

  451  gtCAGCGGAT CGGCAACGGG tacgccgcgc gcgtctttgT CGATATTGAT

  501  GTTTTCCAAA CCGATATtgT CAACGTTCGG ACGGCgACCT ACGGCTGCCA

  551  ACATATATTC GGCAACAAAT ACGCCTTTTT CGCCATCCTG CTCCCAATGG
```

-continued

```
601  ACTtctACAT TGCCGTCTGC GTCGAGTTTG ACCTCGGTTT TAGCATCCAG

651  ATGCAGTTTC AATtctTCTC CGAACACGGC TTTCGCCTCG TCTGAAACAA

701  CGGGGTCGGA AATGCCGCCG ATGATTCCGC CCAAACCGAA AATTTCAACT

751  TTCACACCCA AACGGTGCAA TGCCTGA
```

This corresponds to the amino acid sequence <SEQ ID 14; ORF 004.ng>:

```
g004.pep
  1  MVERHIQHLR NGHLHLMRPC QQVSQMFGGR AYDFRADKAA GGFFGIQAHM

 51  AFVYQHHAAA TLIFERYFAD DKFVGLVLRG NLRVFQTDKA DLRTGKHHAN

101  GAAAQTAADI RVAAPRYCPA ILPWSAASCS RGSWLDASPA IKICGMLVCM

151  VSGSATGTPR ASLSILMFSK PILSTFGRRP TAANIYSATN TPFSPSCSQW

201  TSTLPSASSL TSVLASRCSF NSSPNTAFAS SETTGSEMPP MIPPKPKIST

251  FTPKRCNA*
```

The following partial DNA sequence was identified in *N. meningitidis* <SEQ ID 15>:

```
m004.seq
  1  ATGGTAGAAC GGCATATCCA GCATTTGCGG AACGGTCATC TTCATTTGAT

 51  GTGCCCAAGC CAACAGGTGC GCCAAATGTT CGGCGGCAGG GCCTACGATT

101  TCCGCGCCGA TAAAGCGGCC GGTGGCTTTT TCGGCATACA GGCGCATATG

151  GCCTTTGTTC ACCAGCATCA CGCGGCTGCG GCCTTGGTTT TTGAACGATA

201  CTTCGCCGAT GACAAATTCG TCGGCTTGGT ATTGCGCGGC AACCTGCGCG

251  TATTTCAGAC CGACAAAGCC GATTTGCGGA CTGGTAAACA CCACGCCGAT

301  GGTGCTGCGC CGCAAACCGC CGCCGATATT CGGGTAGCGG CCGCGTTATC

351  GCCGGCAATC TTGCCTTGGT CGGCAGCTTC ATGCAGCAGA GGCAGTTGGT

401  TGGACGCATC GCCTGCGATG AAGATATGCG GAATACTGGT CTGCATGGTC

451  AGCGGGTCGG CAACAGGTAC GCCGCGCGCA TCTTTTTCGA TATTGATATT

501  TTCCAAACCG ATATTGTCAA CGTTCGGACG GCGGCCCACG GCTGCCAGCA

551  TATATTCGGC AACAAATACG CCTTTTTCGC CATCCTGCTC CCAATGGACT

601  TCTACATTGC CGTCTGCATC GAGTTTGACC TCGGTTTTAG CATCCAGATG

651  CAGTTTCAAT TCTTCGCCGA ACACGGCGTT CGCCTCGTCT GAAACGACGG

701  GGTCGGAAAT GCCGCCGATG ATTCCGCCCA AACCGAAAAT TTCAACTTTC

751  ACGCCCAAAC GGTGCAATGC CTGA
```

This corresponds to the amino acid sequence <SEQ ID 16; ORF 004>:

```
m004.pep
  1  MVERHIQHLR NGHLHLMCPS QQVRQMFGGR AYDFRADKAA GGFFGIQAHM

 51  AFVHQHHAAA ALVFERYFAD DKFVGLVLRG NLRVFQTDKA DLRTGKHHAD

101  GAAPQTAADI RVAAALSPAI LPWSAASCSR GSWLDASPAM KICGILVCMV

151  SGSATGTPRA SFSILIFSKP ILSTFGRRPT AASIYSATNT PFSPSCSQWT
```

-continued

```
201  STLPSASSLT SVLASRCSFN SSPNTAFASS ETTGSEMPPM IPPKPKISTF

251  TPKRCNA*
```

The following partial DNA sequence was identified in *N. meningitidis* <SEQ ID 17>:

```
a004.seq
   1  ATGGTAGAAC GGCATATCCA GCATTTGCGG AACGGTCATC TTCATTTGAT

  51  GTGCCCAAGC CAACAGGTGC GCCAAATGTT CGGCGGCCGG ACCTACGATT

 101  TCTGCGCCGA TGAAGCGGCC GGTGGCTTTT TCGGCATACA GGCGCATATG

 151  GCCTTTGTTT ACCAGCATCA CGCGGCTGCG GCCTTGGTTT TTGAACGATA

 201  CTTCGCCGAT GACAAATTCG TCGGCTTGGT ATTGCGCGGC AACCTGCGCG

 251  TATTTCAAAC CGACAAAGCC GATTTGCGGA CTGGTGAACA CTACGCCGAT

 301  GGTGCTGCGG CGCAAACCGC CGCCGATATT CGGGTAGCGG CCGCGTTATC

 351  GCCGGCAATC TTGCCTTGGT CGGCGGCTTC ATGCAGCAGG GGCAGTTGGT

 401  TGGACGCGTC GCCCGCAATA AAGATATGCG GAATACTGGT CTGCATAGTC

 451  AGCGGATCGG CAACGGGTAC GCCGCGCGCA TCTTTTTCGA TATTGATGTT

 501  TTCCAAACCG ATATTGTCAA CGTTCGGACG GCGGCCTACG GCTGCCAGCA

 551  TATATTCGGC AACAAATACG CCTTTTTCGC CATCCTGCTC CCAATGGACT

 601  TCTACATTGC CGTCTGCGTC GAGTTTGGCC TCGGTTTTAG CATCCAAATG

 651  CAGTTTCAAT TCTTCACCGA ACACGGCTTT CGCCTCGTCT GAAACGACGG

 701  GGTCGGAAAT GCCGCCGATG ATGCCACCCA AACCGAAAAT TTCAACTTTC

 751  ACGCCCAAAC GGTGCAATGC CTGA
```

This corresponds to the amino acid sequence <SEQ ID 18; ORF 004.a>:

```
a004.pep
   1  MVERHIQHLR NGHLHLMCPS QQVRQMFGGR TYDFCADEAA GGFFGIQAHM

  51  AFVYQHHAAA ALVFERYFAD DKFVGLVLRG NLRVFQTDKA DLRTGEHYAD

 101  GAAAQTAADI RVAAALSPAI LPWSAASCSR GSWLDASPAI KICGILVCIV

 151  SGSATGTPRA SFSILMFSKP ILSTFGRRPT AASIYSATNT PFSPSCSQWT

 201  STLPSASSLA SVLASKCSFN SSPNTAFASS ETTGSEMPPM MPPKPKISTF

 251  TPKRCNA*
```

m004/a004 94.9% identity over a 257 aa overlap

```
                    10        20        30        40        50        60
m004.pep    MVERHIQHLRNGHLHLMCPSQQVRQMFGGRAYDFRADKAAGGFFGIQAHMAFVHQHHAAA
            ||||||||||||||||||||||||||||||:||| ||:|||||||||||||||:||||||
a004        MVERHIQHLRNGHLHLMCPSQQVRQMFGGRTYDFCADEAAGGFFGIQAHMAFVYQHHAAA
                    10        20        30        40        50        60

                    70        80        90       100       110       120
m004.pep    ALVFERYFADDKFVGLVLRGNLRVFQTDKADLRTGKHHADGAAPQTAADIRVAAALSPAI
            |||||||||||||||||||||||||||||||||||:|:||||| ||||||||||||||||
a004        ALVFERYFADDKFVGLVLRGNLRVFQTDKADLRTGEHYADGAAAQTAADIRVAAALSPAI
                    70        80        90       100       110       120

                   130       140       150       160       170       180
m004.pep    LPWSAASCSRGSWLDASPAMKICGILVCMVSGSATGTPRASFSILIFSKPILSTFGRRPT
            |||||||||||||||||||:||||||||:||||||||||||||||:||||||||||||||
a004        LPWSAASCSRGSWLDASPAIKICGILVCIVSGSATGTPRASFSILMFSKPILSTFGRRPT
                   130       140       150       160       170       180
```

-continued

```
                      190       200       210       220       230       240
m004.pep       AASIYSATNTPFSPSCSQWTSTLPSASSLTSVLASRCSFNSSPNTAFASSETTGSEMPPM
               |||||||||||||||||||||||||||||:|||||:||||||||||||||||||||||||
a004           AASIYSATNTPFSPSCSQWTSTLPSASSLASVLASKCSFNSSPNTAFASSETTGSEMPPM
                      190       200       210       220       230       240

                      250
m004.pep       IPPKPKISTFTPKRCNAX
               :|||||||||||||||||
a004           MPPKPKISTFTPKRCNAX
                      250
```

Computer analysis of this amino acid sequence gave the following results:

Homology with a Predicted ORF from *N. Gonorrhoeae*

ORF 004 shows 93.4% identity over a 258 aa overlap with a predicted ORF (ORF 004.ng) from *N. gonorrhoeae*:

```
m004/g004

                        10        20        30        40        50        60
m004.pep       MVERHIQHLRNGHLHLMCPSQQVRQMFGGRAYDFRADKAAGGFFGIQAHMAFVHQHHAAA
               ||||||||||||||||| | ||| |||||||||||||||||||||||||||||:||||||
g004           MVERHIQHLRNGHLHLMRPCQQVSQMFGGRAYDFRADKAAGGFFGIQAHMAFVYQHHAAA
                        10        20        30        40        50        60

                        70        80        90       100       110       120
m004.pep       ALVFERYFADDKFVGLVLRGNLRVFQTDKADLRIGKHHADGAAPQTAADIRVAAA-LSPA
               :|:||||||||||||||||||||||||||||||||||||:||| ||||||||||    ||
g004           TLIFERYFADDKFVGLVLRGNLRVFQTDKADLRTGKHHANGAAAQTAADIRVAAPRYCPA
                        70        80        90       100       110       120

             120       130       140       150       160       170      179
m004.pep       ILPQSAASCSRGSWLDASPAMKICGILVCMVSGSATGTPRASFSILIFSKPILSTFGRRP
               ||||||||||||||||||||:||||:||||||||||||||||:|||:|||||||||||||
g004           ILPWSAASCSRGSWLDASPAIKICGMLVCMVSGSATGTPRASLSILMFSKPILSTFGRRP
                       130       140       150       160       170       180

             180       190       200       210       220       230      239
m004.pep       TAASIYSATNTPFSPSCSQWTSTLPSASSLTVLASRCSFNSSPNTAFASSETTGTSEMPP
               |||:||||||||||||||||||||||||||||||||||||||||||||||||||||||||
g004           TAANIYSATNTPFSPSCSQWTSTLPSASSLTSVLASRCSFNSSPNTAFASSETTGSEMPP
                       190       200       210       220       230       240

             240       250
m004.pep       MIPPKPKISTFTPKRCNAX
               ||||||||||||||||||
g004           MIPPKPKISTFTPKRCNA
                       250
```

The following partial DNA sequence was identified in *N. gonorrhoeae* <SEQ ID 19>:

```
g005.seq
   1 ATGGGGATGG ACAATATTGA TATGTTCATG CCTGAACAAG AGGAAATCCA

  51 ATCAATGTGG AAAGAAATTT TACTGAATTA CGGTATTTTC CTGCTCGAAC

 101 TGCTTACCGT GTTCGGCGCA ATTGCGCTGA TTGTGTTGGC TATCGTACAG

 151 AGTAAGAAAC AGTCGGAAAG CGGCAGTGTC GTACTGACAG ATTTTTCGGA

 201 AAATTATAAA AAACAGCGGC AATCGTTTGA AACATTCTTT TTAAGCGAGG

 251 AAGAGACAAA ACATCAGGAA AAAAAAGAAA AGAAAAAGGA AAAGGCGGAA

 301 GCCAAAGCAG AGAAAAAGCG TTTGAAGGAG GGCGGGGAGA AATCTGCCGA

 351 AACGCAAAAA TCCCGCCTTT TTGTGTTGGA TTTTGACGGC GATTTGTATG

 401 CACACGCCGT AGAATCCTTG CGTCATGAGA TTACGGCGGT GCTTTTGATT

 451 GCCAAGCCTG AAGATGAGGT TCTGCTCAGA TTGGAAAGTC CGGGCGGCGT

 501 GGTTCACGGT TACGGTTTGG CGGCTTCGCA GCTTAGGCGT TTGCGCGAAC

 551 GCAATATTCC GCTGAccgtc gccgTCGATA AGGTCGCGGC AAGCGgcggc
```

-continued

```
 601 tatatgatgg cgtgtgtgGC GGATAAAATT GTTTCCGCtc cgtttgcggt
 651 catcggttcg gtgggtgtgg tgGcggaagt gcCGAATATC CAccgCctGT
 701 TGAAAAAACA TGATATTGAT GTGGATGTGA TGACGGCGGG CGAATTTAAG
 751 CGCACGGTTA CTTTTATGGG TGAAAATACG GAAAAGGGCA AACAGAAATT
 801 CCGGCAGGAA CTGGAGGAAA CGCATCAGTT GTTCAAGCAG TTTGTCAGTG
 851 AAAACCGCCC CGGGTTGGAT ATTGAAAAAA TAGCGACGGG CGAGCATTGG
 901 TTCGGCCGGC AGGCGTTGGC GTTGAACTTG ATTGACGAGA TTTCGACCAG
 951 TGATGATTTG TTGTTGAAAG CGTTTGAAAA CAAACAGGtt aTCGAAGTGA
1001 AATATCAGGA GAAGCGAAGC CTGATCCAGC GCATTGGTTT GCAGGCGGAA
1051 GCTTCCGTTG AAAAGTTGTT TGCCAAACTT GTCAACCGGC GAGCGGATGT
1101 GATGTAG
```

This corresponds to the amino acid sequence <SEQ ID 20; ORF 005.ng>:

```
g005.pep
  1 MGMDNIDMFM PEQEEIQSMW KEILLNYGIF LLELLTVFGA IALIVLAIVQ
 51 SKKQSESGSV VLTDFSENYK KQRQSFETFF LSEEETKHQE KKEKKKEKAE
101 AKAEKKRLKE GGEKSAETQK SRLFVLDFDG DLYAHAVESL RHEITAVLLI
151 AKPEDEVLLR LESPGGVVHG YGLAASQLRR LRERNIPLTV AVDKVAASGG
201 YMMACVADKI VSAPFAVIGS VGVVAEVPNI HRLLKKHDID VDVMTAGEFK
251 RTVTFMGENT EKGKQKFRQE LEETHQLFKQ FVSENRPGLD IEKIATGEHW
301 FGRQALALNL IDEISTSDDL LLKAFENKQV IEVKYQEKRS LIQRIGLQAE
351 ASVEKLFAKL VNRRADVM*
```

The following partial DNA sequence was identified in *N. meningitidis* <SEQ ID 21>:

```
m005.seq
  1 ATGGACAATA TTGACATGTT CATGCCTGAA CAAGAGGAAA TCCAATCAAT
 51 GTGGAAAGAA ATTTTACTGA ATTACGGTAT TTTCCTGCTC GAACTGCTTA
101 CCGTGTTCGG CGCAATTGCG CTGATTGTGT TGGCTATCGT ACAGAGTAAG
151 AAACAGTCGG AwAGCGGCAG TGTCGTACTG ACGGATTTTT CGGAAAATTA
201 TAAAAAACAG CGGCAATCGT TTGAAGCATT CTTTTTAAGC GGGGAAGAGG
251 CACAACATCA GGAAAAAGAG GAAAAGAAAA AGGAAAAGGC GGAAGCCAAA
301 GCAGAGAAAA A.CGTTTGAA GGAGGGTGGG GAGAAATCTG CCGAAACGCA
351 nAAATCACGC CTTTTTGTGT TGGANNNNNN NNNNNNNNNN NNNNNNNNNN
401 NNNNNNNNNN NNNNNNNNNN NNNNNNNNNN NNNNNNNNNN NNNNNNNNNN
451 NNNNNNNNNN NNNNNNNNNN NNNNNNNNNN NNNNNNNNNN NNNNNNNNNN
501 NNNNNNNNNN NNNNNNNNNN NNNNNNNNNN NNNNNNNNNN NNNNNNNNNN
551 NNNNNNNNNN NNNNNNNNNN NNNNNNNNNN NNGCGAGCGG CGGTTATATG
601 ATGGCGTGTG TGGCGGATAA AATTGCTTCC GCTCCGTTTG CGATTGTCGG
651 TTCGGTGGGT GTGGTGGCGG AAGTACCGAA TATCCACCGC CTGTTGAAAA
701 AACATGATAT TGATGTGGAT GTGATGACGG CGGGCGAATT TAAGCGCACG
```

-continued

```
 751 GTTACTTTTA TGGGTGAAAA TACGGAAAAG GGCAAACAGA AATTCCGACA

 801 GGAACTGGAG GAAACGCATC AGTTGTTCAA GCAGTTTGTC AGCGAGAACC

 851 GCCCTCAATT GGATATTGAG GAAGTGGCAA CGGGCGAGCA TTGGTTCGGT

 901 CGGCAGGCGT TGGCGTTGAA CTTGATTGAC GAGATTTCGA CCAGTGATGA

 951 TTTGTTGTTG AAAGCGTTTG AAAACAAACA GGTTATCGAA GTGAAATATC

1001 AGGAGAAGCA AAGCCTGATC CAGCGCATTG GTTTGCAGGC GGAAGCTTCT

1051 GTTGAAAAGT TGTTTGCCAA ACTTGTCAAC CGGCGGGCGG ATGTGATGT A

1101 G
```

This corresponds to the amino acid sequence <SEQ ID 22; ORF 005>:

```
m005.pep
   1 MDNIDMFMPE QEEIQSMWKE ILLNYGIFLL ELLTVFGAIA LIVLAIVQSK

  51 KQSXSGSVVL TDFSENYKKQ RQSFEAFFLS GEEAQHQEKE EKKKEKAEAK

 101 AEKXRLKEGG EKSAETXKSR LFVLXXXXXX XXXXXXXXXX XXXXXXXXXX

 151 XXXXXXXXXX XXXXXXXXXX XXXXXXXXXX XXXXXXXXXX XXXXASGGYM

 201 MACVADKIAS APFAIVGSVG VVAEVPNIHR LLKKHDIDVD VMTAGEFKRT

 251 VTFMGENTEK GKQKFRQELE ETHQLFKQFV SENRPQLDIE EVATGEHWFG

 301 RQALALNLID EISTSDDLLL KAFENKQVIE VKYQEKQSLI QRIGLQAEAS

 351 VEKLFAKLVN RRADVM*
```

The following partial DNA sequence was identified in *N. meningitidis* <SEQ ID 23>:

```
a005.seq
   1 ATGGACAATA TTGACATGTT CATGCCTGAA CAAGAGGAAA TCCAATCAAT

  51 GTGGAAAGAA ATTTTACTGA ATTACGGTAT TTTCCTGCTC GAACTGCTTA

 101 CCGTGTTCGG CGCAATTGCG CTGATTGTGT TGGCTATCGT ACAGAGTAAG

 151 AAACAGTCGG AAAGCGGCAG TGTCGTACTG ACGGATTTTT CGGAAAATTA

 201 TAAAAAACAG CGGCAATCGT TTGAAGCATT CTTTTTAAGC GGGGAAGAGG

 251 CAAAACATCA GGAAAAAGAG GAAAAGAAAA AGGAAAAGGC GGAAGCCAAA

 301 GCAGAGAAAA AGCGTTTGAA GGAGGGTGGG GAGAAATCTT CCGAAACGCA

 351 AAAATCCCGC CTTTTTGTGT TGGATTTTGA CGGCGATTTG TATGCACACG

 401 CCGTAGAATC CTTGCGTCAT GAGATTACGG CGGTGCTTTT GATTGCCAAG

 451 CCTGAAGATG AGGTTCTGCT TAGATTGGAA AGTCCGGGCG GCGTGGTTCA

 501 CGGTTACGGT TTGGCGGCTT CGCAGCTTAG GCGTTTGCGC GAACGCAATA

 551 TTCCGCTGAC CGTCGCCGTC GATAAGGTGG CGGCGAGCGG TGGTTATATG

 601 ATGGCGTGTG TGGCGGATAA AATTGTTTCC GCTCCGTTTG CGATTGTCGG

 651 TTCGGTGGGT GTTGTAGCGG AAGTACCGAA TATCCACCGC CTGTTGAAAA

 701 AACATGATAT TGATGTGGAT GTGATGACGG CGGGCGAATT TAAGCGCACG

 751 GTTACTTTTA TGGGTGAAAA TACGGAAAAG GGCAAACAGA AATTCCGACA

 801 GGAACTGGAG GAAACGCATC AGTTGTTCAA GCAGTTTGTC AGCGAGAACC

 851 GCCCTCAATT GGATATTGAG GAAGTGGCAA CGGGCGAGCA TTGGTTCGGT
```

-continued

```
 901 CGGCAGGCGT TGGCGTTGAA CTTGATTGAC GAGATTTCGA CCAGTGATGA

 951 TTTGTTGTTG AAAGCGTTTG AAAACAAACA GGTTATCGAA GTGAAATATC

1001 AGGAGAAGCA AAGCCTGATC CAGCGCATTG GTTTGCAGGC GGAAGCTTCT

1051 GTTGAAAAGT TGTTTGCCAA ACTTGTCAAC CGGCGGGCGG ATGTGATGTA

1101 G
```

This corresponds to the amino acid sequence <SEQ ID 24; ORF 005.a>:

```
a005.pep
  1 MDNIDMFMPE QEEIQSMWKE ILLNYGIFLL ELLTVFGAIA LIVLAIVQSK

 51 KQSESGSVVL TDFSENYKKQ RQSFEAFFLS GEEAKHQEKE EKKKEKAEAK

101 AEKKRLKEGG EKSSETQKSR LFVLDFDGDL YAHAVESLRH EITAVLLIAK

151 PEDEVLLRLE SPGGVVHGYG LAASQLRRLR ERNIPLTVAV DKVAASGGYM

201 MACVADKIVS APFAIVGSVG VVAEVPNIHR LLKKHDIDVD VMTAGEFKRT

251 VTFMGENTEK GKQKFRQELE ETHQLFKQFV SENRPQLDIE EVATGEHWFG

301 RQALALNLID EISTSDDLLL KAFENKQVIE VKYQEKQSLI QRIGLQAEAS

351 VEKLFAKLVN RRADVM*
```

m005/a005 79.2% identity over a 366 aa overlap

```
                   10        20        30        40        50        60
m005.pep   MDNIDMFMPEQEEIQSMWKEILLNYGIFLLELLTVFGAIALIVLAIVQSKKQSXSGSVVL
           ||||||||||||||||||||||||||||||||||||||||||||||||||||| ||||||
a005       MDNIDMFMPEQEEIQSMWKEILLNYGIFLLELLTVFGAIALIVLAIVQSKKQSESGSVVL
                   10        20        30        40        50        60

                   70        80        90       100       110       120
m005.pep   TDFSENYKKQRQSFEAFFLSGEEAQHQEKEEKKKEKAEAKAEKXRLKEGGEKSAETXKSR
           ||||||||||||||||||||||||:|||||||||||||||||| |||||||||:|| |||
a005       TDFSENYKKQRQSFEAFFLSGEEAKHQEKEEKKKEKAEAKAEKKRLKEGGEKSSETQKSR
                   70        80        90       100       110       120

                  130       140       150       160       170       180
m005.pep   LFVLXXXXXXXXXXXXXXXXXXXXXXXXXXXXXXXXXXXXXXXXXXXXXXXXXXXXXXXX
           ||||                  :
a005       LFVLDFDGDLYAHAVESLRHEITAVLLIAKPEDEVLLRLESPGGVVHGYGLAASQLRRLR
                  130       140       150       160       170       180

                  190       200       210       220       230       240
m005.pep   XXXXXXXXXXXXXXASGGYMMACVADKIASAPFAIVGSVGVVAEVPNIHRLLKKHDIDVD
                 :       ||||||||||||||:|||||||||||||||||||||||||||||||
a005       ERNIPLTVAVDKVAASGGYMMACVADKIVSAPFAIVGSVGVVAEVPNIHRLLKKHDIDVD
                  190       200       210       220       230       240

                  250       260       270       280       290       300
m005.pep   VMTAGEFKRTVTFMGENTEKGKQKFRQELEETHQLFKQFVSENRPQLDIEEVATGEHWFG
           ||||||||||||||||||||||||||||||||||||||||||||||||||||||||||||
a005       VMTAGEFKRTVTFMGENTEKGKQKFRQELEETHQLFKQFVSENRPQLDIEEVATGEHWFG
                  250       260       270       280       290       300

                  310       320       330       340       350       360
m005.pep   RQALALNLIDEISTSDDLLLKAFENKQVIEVKYQEKQSLIQRIGLQAEASVEKLFAKLVN
           ||||||||||||||||||||||||||||:|||||:|||||||||||||||||||||||||
a005       RQALALNLIDEISTSDDLLLKAFENKQVIEVKYQEKQSLIQRIGLQAEASVEKLFAKLVN
                  310       320       330       340       350       360

m005.pep   RRADVMX
           |||||||
a005       RRADVMX
```

Computer analysis of this amino acid sequence gave the following results:
Homology with a Predicted ORF from *N. Gonorrhoeae*
ORF 005 shows 77.0% identity over a 366 aa overlap with a predicted ORF (ORF 005.ng) from *N. gonorrhoeae*:

```
m005/g005

                  10         20         30         40         50
    m005.pep      MDNIDMFMPEQEEIQSMWKEILLNYGIFLLELLTVFGAIALIVLAIVQSKKQSXSGSV
                  |||||||||||||||||||||||||||||||||||||||||||||||||||| ||||
    g005        MGMDNIDMFMPEQEEIQSMWKEILLNYGIFLLELLTVFGAIALIVLAIVQSKKQSESGSV
                    10         20         30         40         50         60

             60         70         80         90        100        110
    m005.pep  VLTDFSENYKKQRQSFEAFFLSGEEAQHQEKEEKKKEKAEAKAEKKRLKEGGEKSAETXK
              ||||||||||||||||||:||||  ||::||||:||||||||||||||||||||||||| |
    g005      VLTDFSENYKKQRQSFETFFLSEEETKHQEKKEKKKEKAEAKAEKKRLKEGGEKSAETQK
                      70         80         90        100        110        120

             120        130        140        150        160        170
    m005.pep  SRLFVLXXXXXXXXXXXXXXXXXXXXXXXXXXXXXXXXXXXXXXXXXXXXXXXXXXXX
              ||||||                                    :
    g005      SRLFVLDFDGDLYAHAVESLRHEITAVLLIAKPEDEVLLRLESPGGVVHGYGLAASQLRR
                      130        140        150        160        170        180

             180        190        200        210        220        230
    m005.pep  XXXXXXXXXXXXXXXXASGGYMMACVADKIASAPFAIVGSVGVVAEVPNIHRLLKKHDID
                       :       ||||||||||||:|||||::|||||||||||||||||||||||
    g005      LRERNIPLTVAVDKVAASGGYMMACVADKIVSAPFAVIGSVGVVAEVPNIHRLLKKHDID
                      190        200        210        220        230        240

             240        250        260        270        280        290
    m005.pep  VDVMTAGEFKRTVTFMGENTEKGKQKFRQELEETHQLFKQFVSENRPQLDIEEVATGEHW
              |||||||||||||||||||||||||||||||||||||||||||||||||||| ||::||||||
    g005      VDVMTAGEFKRTVTFMGENTEKGKQKFRQELEETHQLFKQFVSENRPGLDIEKIATGEHW
                      250        260        270        280        290        300

             300        310        320        330        340        350
    m005.pep  FGRQALALNLIDEISTSDDLLLKAFENKQVIEVKYQEKQSLIQRIGLQAEASVEKLFAKL
              ||||||||||||||||||||||||||||||||||||||:||||||||||||||||||||
    g005      FGRQALALNLIDEISTSDDLLLKAFENKQVIEVKYQEKRSLIQRIGLQAEASVEKLFAKL
                      310        320        330        340        350        360

             360
    m005.pep  VNRRADVMX
              |||||||||
    g005      VNRRADVMX
```

The following partial DNA sequence was identified in *N. gonorrhoeae* <SEQ ID 25>:

```
g006.seq
    1 ATGCTGCTGG TGCTggaatt ttggttCGGc gtGtCGGCGG TGGGCatact

   51 tgCGTTGTTT TTATGGCttt TGCCACGTTT TGCCGCCATC AGCGAAAACC

  101 TGTATTTCCG CCTGAACAAC AGCTTGGAAC gcgACAACCA CTTTATCCGA

  151 AAAGGCGACG AGCGGCAGCT GTACCGCCAT TACGGACTGG TTTCGCGCCT

  201 GCGTGTGCTG ATTTCCAACC GCGAAGCCTT CGGCTATCTC TGCGTCGGCG

  251 CGGCGATGGG TATTTTGTTC GGCTTTGCTT TTGTGATGAT GACGCTCAAA

  301 GGCTACGGCA GCGCGGGGCA TATTTATTCG GTCGGCACTT ATCTGTGGAT

  351 GTTTGCCATG AGTTTGGACG ATGTGCCGCG ATTGGTCGAA CAATATTCCA

  401 ATTTGAAAGA CATCGGACAA CGGATAGAGT GGTCGGAACG GAACATCAAA

  451 GCCGGAACTT GA
```

This corresponds to the amino acid sequence <SEQ ID 26; ORF 006.ng>:

```
g006.pep
    1 MLLVLEFWFG VSAVGILALF LWLLPRFAAI SENLYFRLNN SLERDNHFIR

   51 KGDERQLYRH YGLVSRLRVL ISNREAFGYL CVGAAMGILF GFAFVMMTLK
```

-continued

```
101 GYGSAGHIYS VGTYLWMFAM SLDDVPRLVE QYSNLKDIGQ RIEWSERNIK

151 AGT*
```

The following partial DNA sequence was identified in *N. meningitidis* <SEQ ID 27>:

```
m006.seq
    1 ATGCTGCTGG TGCTGGAATT TTGGGTCGGC GTGTCGGCGG TGGGCATACT

   51 TGCGTTGTTT TTATGGCTTT TGCCACGTTT TGCCGCCATC AGCGAAAACC

  101 TGTATTTCCG CCTGAACAAC AGCTTGGAAC GCGACAACCA CTTTATCCGA

  151 AAAGGCGACC GGCGGCAGCT GTACCGCCAT TACGGACTGC TTGCGCGCCT

  201 GCGTGTGCTG ATTTCCAACC GCGAAGCCTT CGGCTATCTC TGCGTCGGCA

  251 CGGCGATGGG TATTTTGTTC GGCTTTGCTT TTGTGATGAT GACGCTCAAA

  301 GGCTACAGCA GCGCGGGGCA TGTCTATTCG GTCGGCACTT ATCTGTGGAT

  351 GTTTGCCATG AGTTTGGACG ACGTGCCGCG ATTGGTCGAA CAATATTCCA

  401 ATTTGAAAGA CATCGGACAA CGGATAGAGT GGTCGGAACG GAACATCAAA

  451 GCCGGAACTTGA
```

This corresponds to the amino acid sequence <SEQ ID 28; ORF 006>:

```
m006.pep
    1 MLLVLEFWVG VSAVGILALF LWLLPRFAAI SENLYFRLNN SLERDNHFIR

   51 KGDRRQLYRH YGLLARLRVL ISNREAFGYL CVGTAMGILF GFAFVMMTLK

  101 GYSSAGHVYS VGTYLWMFAM SLDDVPRLVE QYSNLKDIGQ RIEWSERNIK

  151 AGT*
```

The following partial DNA sequence was identified in *N. meningitidis* <SEQ ID 29>:

```
a006.seq
    1 ATGCTGCTGG TGCTGGAATT TTGGGTCGGC GTGTCGGCGG TGGGCATACT

   51 TGCGTTGTTT TTATGGCTTT TGCCACGTTT TGCCGCCATC AGCGAAAACC

  101 TGTATTTCCG CCTGAAGAAC AGCTTGGAAC GCGACAACCA CTTTATCCGA

  151 AAAGGCGACG AGCGGCAGCT GGACCGCCAT TACGGACTGC TTGCGCGCCT

  201 GCGTGTGCTG ATTTCCAACC GCGAAGCCTT CGGCTATCTC TGCGTCGGCA

  251 CGGCGATGGG TATTTTGTTC GGCTTTGCTT TTGTGATGAT GACGCTCAAA

  301 GGCTACAGCA GCGCGGGGCA TGTCTATTCG GTCGGCACTT ATCTGTGGAT

  351 GTTTGCCATA AGTTTGGACG ACGTGCCGCG ATTGGTCGAA CAATATTCCA

  401 ATTTGAAAGA CATCGGACAA CGGATAGAGT GGTCGAAACG GAACATCAAA

  451 GCCGGAACTT GA
```

This corresponds to the amino acid sequence <SEQ ID 30; ORF 006.a>:

```
a006.pep
    1 MLLVLEFWVG VSAVGILALF LWLLPRFAAI SENLYFRLKN SLERDNHFIR

   51 KGDERQLDRH YGLLARLRVL ISNREAFGYL CVGTAMGILF GFAFVMMTLK

  101 GYSSAGHVYS VGTYLWMFAI SLDDVPRLVE QYSNLKDIGQ RIEWSKRNIK

  151 AGT*
```

m006/a006 96.7% identity over a 153 aa overlap

```
                      10        20        30        40        50        60
m006.pep      MLLVLEFWVGVSAVGILALFLWLLPRFAAISENLYFRLNNSLERDNHFIRKGDRRQLYRH
              ||||||||||||||||||||||||||||||||||||||:||||||||||||||:||| ||
a006          MLLVLEFWVGVSAVGILALFLWLLPRFAAISENLYFRLKNSLERDNGFIRKGDERQLDRH
                      10        20        30        40        50        60

                      70        80        90       100       110       120
m006.pep      YGLLARLRVLISNREAFGYLCVGTAMGILFGFAFVMMTLKGYSSAGHVYSVGTYLWMFAM
              |||||||||||||||||||||||||||||||||||||||||||||||||||||||||||:
a006          YGLLARLRVLISNREAFGYLCVGTAMGILFGFAFVMMTLKGYSSAGHVYSVGTYLWMFAI
                      70        80        90       100       110       120

                     130       140       150
m006.pep      SLDDVPRLVEQYSNLKDIGQRIEWSERNIKAGTX
              |||||||||||||||||||||||||:||||||||
a006          SLDDVPRLVEQYSNLKDIGQRIEWSKRNIKAGTX
                     130       140       150
```

Computer analysis of this amino acid sequence gave the following results:

Homology with a Predicted ORF from *N. Gonorrhoeae*

ORF 006 shows 95.4% identity over a 153 aa overlap with a predicted ORF (ORF 006.ng) from *N. gonorrhoeae*:

```
m006/g006

                    10        20        30        40        50        60
m006.pep    MLLVLEFWVGVSAVGILALFLWLLPRFAAISENLYFRLNNSLERDNHFIRKGDRRQLYRH
            |||||||| ||||||||||||||||||||||||||||||||||||||||||||:||||||
g006        MLLVLEFWFGVSAVGILALFLWLLPRFAAISENLYFRLNNSLERDNHFIRKGDERQLYRH
                    10        20        30        40        50        60

                    70        80        90       100       110       120
m006.pep    YGLLARLRVLISNREAFGYLCVGTAMGILFGFAFVMMTLKGYSSAGHVYSVGTYLWMFAM
            |||::||||||||||||||||||:||||||||||||||||||:||||:||||||||||||
g006        YGLVSRLRVLISNREAFGYLCVGAAMGILFGFAFVMMTLKGYGSAGHIYSVGTYLWMFAM
                    70        80        90       100       110       120

                   130       140       150
m006.pep    SLDDVPRLVEQYSNLKDIGQRIEWSERNIKAGTX
            |||||||||||||||||||||||||||||||||
g118        SLDDVPRLVEQYSNLKDIGQRIEWSERNIKAGT
                   130       140       150
```

The following partial DNA sequence was identified in *N. gonorrhoeae* <SEQ ID 31>:

```
g006-1.seq
    1 ATGTGGAAAA TGTTGAAACA CATAGCCAAA ACCCACCGCA AGCGATTGAT

   51 TGGCACATTT TCCCCGGTCG GACTGGAAAA CCTTTTGATG CTGGGGTATC

  101 CGGTGTTTGG CGGCTGGGCG ATTAATGCCG TGATTGCGGG GAGGGTGTGG

  151 CAGGCGTTGC TGTACGCTTT GGTTGTATTT TTGATGTGGC TGGTCGGTGC

  201 GGCACGGCGG ATTGCCGATA CGCGCACGTT TACGCGGATT TATACCGAAA
```

-continued

```
251 TCGCCGTGCC GGTTGTGTTG GAACAACGGC AGCGGCAAGT CCCGCATTCA

301 GCGGTAACTG CACGGGTTGC CCTGTCGCGT GAATTTGTCA GCTTTTTTGA

351 AGAACACCTG CCGATTGCCG CGACATCCGT CGTATCCATA TTCGGCGCGT

401 GCATCATGCT GCTGGTGCTG GAATTTTGGG TCGGCGTGTC GGCGGTGGGC

451 ATACTTGCGT TGTTTTTATG GCTTTTGCCA CGTTTTGCCG CCATCAGCGA

501 AAACCTGTAT TTCCGCCTGA ACAACAGCTT GGAACGCGAC AACCACTTTA

551 TCCGAAAAGG CGACGAGCGG CAGCTGTACC GCCATTACGG ACTGGTTTCG

601 CGCCTGCGTG TGCTGATTTC CAACCGCGAA GCCTTCGGCT ATCTCTGCGT

651 CGGCGCGGCG ATGGGTATTT TGTTCGGCTT TGCTTTTGTG ATGATGACGC

701 TCAAAGGCTA CGGCAGCGCG GGGCATATTT ATTCGGTCGG CACTTATCTG

751 TGGATGTTTG CCATGAGTTT GGACGATGTG CCGCGATTGG TCGAACAATA

801 TTCCAATTTG AAAGACATCG GACAACGGAT AGAGTGGTCG GAACGGAACA

851 TCAAAGCCGG AACTTGA
```

This corresponds to the amino acid sequence <SEQ ID 32; ORF 006-1.ng>:

```
g006-1.pep
  1 MWKMLKHIAK THRKRLIGTF SPVGLENLLM LGYPVFGGWA INAVIAGRVW

 51 QALLYALVVF LMWLVGAARR IADTRTFTRI YTEIAVPVVL EQRQRQVPHS

101 AVTARVALSR EFVSFFEEHL PIAATSVVSI FGACIMLLVL EFWVGVSAVG

151 ILALFLWLLP RFAAISENLY FRLNNSLERD NHFIRKGDER QLYRHYGLVS

201 RLRVLISNRE AFGYLCVGAA MGILFGFAFV MMTLKGYGSA GHIYSVGTYL

251 WMFAMSLDDV PRLVEQYSNL KDIGQRIEWS ERNIKAGT*
```

The following partial DNA sequence was identified in *N. meningitidis* <SEQ ID 33>:

```
m006-1.seq
  1 ATGTGGAAAA TGTTGAAACA CATAGCCCAA ACCCACCGCA AGCGATTGAT

 51 TGGCACATTT TCCCTGGTCG GACTGGAAAA CCTTTTGATG CTGGTGTATC

101 CGGTGTTTGG CGGCCGGGCG ATCAATGCCG TGATTGCGGG GGAGGTGTGG

151 CAGGCGTTGC TGTACGCTTT GGTTGTGCTT TTGATGTGGC TGGTCGGTGC

201 GGTGCGGCGG ATTGCCGATA CGCGCACGTT TACGCGGATT TATACCGAAA

251 TCGCCGTGCC GGTCGTGTTG GAACAGCGGC AGCGACAAGT CCCGCATTCG

301 GCGGTAACTG CGCGGGTTGC CCTGTCGCGT GAGTTTGTCA GCTTTTTTGA

351 AGAACACCTG CCGATTGCCG CGACATCCGT CGTATCCATA TTCGGCGCGT

401 GCATCATGCT GCTGGTGCTG GAATTTTGGG TCGGCGTGTC GGCGGTGGGC

451 ATACTTGCGT TGTTTTTATG GCTTTTGCCA CGTTTTGCCG CCATCAGCGA

501 AAACCTGTAT TTCCGCCTGA ACAACAGCTT GGAACGCGAC AACCACTTTA

551 TCCGAAAAGG CGACCGGCGG CAGCTGTACC GCCATTACGG ACTGCTTGCG

601 CGCCTGCGTG TGCTGATTTC CAACCGCGAA GCCTTCGGCT ATCTCTGCGT

651 CGGCACGGCG ATGGGTATTT TGTTCGGCTT TGCTTTTGTG ATGATGACGC

701 TCAAAGGCTA CAGCAGCGCG GGGCATGTCT ATTCGGTCGG CACTTATCTG
```

-continued

```
751 TGGATGTTTG CCATGAGTTT GGACGACGTG CCGCGATTGG TCGAACAATA

801 TTCCAATTTG AAAGACATCG GACAACGGAT AGAGTGGTCG GAACGGAACA

851 TCAAAGCCGG AACTTGA
```

This corresponds to the amino acid sequence <SEQ ID 34; ORF 006-1>:

```
m006-1.pep
  1 MWKMLKHIAQ THRKRLIGTF SLVGLENLLM LVYPVFGGRA INAVIAGEVW

 51 QALLYALVVL LMWLVGAVRR IADTRTFTRI YTEIAVPVVL EQRQRQVPHS

101 AVTARVALSR EFVSFFEEHL PIAATSVVSI FGACIMLLVL EFWVGVSAVG

151 ILALFLWLLP RFAAISENLY FRLNNSLERD NHFIRKGDRR QLYRHYGLLA

201 RLRVLISNRE AFGYLCVGTA MGILFGFAFV MMTLKGYSSA GHVYSVGTYL

251 WMFAMSLDDV PRLVEQYSNL KDIGQRIEWS ERNIKAGT*
```

m006-1/g006-1 95.5% identity in 288 aa overlap

```
                    10        20        30        40        50        60
m006-1.pep  MWKMLKHIAQTHRKRLIGTFSLVGLENLLMLVYPVFGGRAINAVIAGEVWQALLYALVVL
            |||||||||:||||||||||| ||||||||| |||||| ||||||||:|||||||||||:
g006-1      MWKMLKHIAKTHRKRLIGTFSPVGLENLLMLGYPVFGGWAINAVIAGRVWQALLYALVVF
                    10        20        30        40        50        60

                    70        80        90       100       110       120
m006-1.pep  LMWLVGAVRRIADTRTFTRIYTEIAVPVVLEQRQRQVPHSAVTARVALSREFVSFFEEHL
            |||||||:||||||||||||||||||||||||||||||||||||||||||||||||||||
g006-1      LMWLVGAARRIADTRTFTRIYTEIAVPVVLEQRQRQVPHSAVTARVALSREFVSFFEEHL
                    70        80        90       100       110       120

                   130       140       150       160       170       180
m006-1.pep  PIAATSVVSIFGACIMLLVLEFWVGVSAVGILALFLWLLPRFAAISENLYFRLNNSLERD
            ||||||||||||||||||||||||||||||||||||||||||||||||||||||||||||
g006-1      PIAATSVVSIFGACIMLLVLEFWVGVSAVGILALFLWLLPRFAAISENLYFRLNNSLERD
                   130       140       150       160       170       180

                   190       200       210       220       230       240
m006-1.pep  NHFIRKGDRRQLYRHYGLLARLRVLISNREAFGYLCVGTAMGILFGFAFVMMTLKGYSSA
            ||||||||:|||||||||::||||||||||||||||||:||||||||||||||||||:||
g006-1      NHFIRKGDERQLYRHYGLVSRLRVLISNREAFGYLCVGAAMGILFGFAFVMMTLKGYGSA
                   190       200       210       220       230       240

                   250       260       270       280      289
m006-1.pep  GHVYSVGTYLWMFAMSLDDVPRLVEQYSNLKDIGQRIEWSERNIKAGTX
            ||:||||||||||||||||||||||||||||||||||||||||||||||
g006-1      GHIYSVGTYLWMFAMSLDDVPRLVEQYSNLKDIGQRIEWSERNIKAGTX
                   250       260       270       280
```

The following partial DNA sequence was identified in *N. meningitidis* <SEQ ID 35>:

```
a006-1.seq(partial)
  1  ..AGCCAAAACC ACCGCAAGCG ATTGATTGGC ACATTTTTTC TGGTCGGACT

 51    GGAAAACCTT TTGATGCTGG TGTATCCGGT GTTTGGCGGC TGGGCGATTA

101    ATGCCGTGAT TGCGGGGCAG GCGTGGCAGG CGTTGCTGTA CGCTTTGGTT

151    GTGCTTTTGA TGTGGCTGGT CGGTGCGGCG CGGCGGATTG CCGATACGCG

201    CACGTTTACG CGGATTTATA CCGAAATCGC CGTGCCGGTT GTGTTGGAAC

251    AGCGGCAGCG GCAAGTCCCG CATTCGGCGG TAACTGCGCG GGTTGCCCTG

301    TCGCGTGAGT TTGTCAGCTT TTTTGAAGAA CACCTGCCGA TTGCCGCGAC

351    ATCCGTCGTA TCCATATTCG GCGCGTGCAT CATGCTGCTG GTGCTGGAAT

401    TTTGGGTCGG CGTGTCGGCG GTGGGCATAC TTGCGTTGTT TTTATGGCTT

451    TTGCCACGTT TTGCCGCCAT CAGCGAAAAC CTGTATTTCC GCCTGAAGAA
```

-continued

```
501    CAGCTTGGAA CGCGACAACC ACTTTATCCG AAAAGGCGAC GAGCGGCAGC

551    TGGACCGCCA TTACGGACTG CTTGCGCGCC TGCGTGTGCT GATTTCCAAC

601    CGCGAAGCCT TCGGCTATCT CTGCGTCGGC ACGGCGATGG GTATTTTGTT

651    CGGCTTTGCT TTTGTGATGA TGACGCTCAA AGGCTACAGC AGCGCGGGGC

701    ATGTCTATTC GGTCGGCACT TATCTGTGGA TGTTTGCCAT AAGTTTGGAC

751    GACGTGCCGC GATTGGTCGA ACAATATTCC AATTTGAAAG ACATCGGACA

801    ACGGATAGAG TGGTCGAAAC GGAACATCAA AGCCGGAACT TGA
```

This corresponds to the amino acid sequence <SEQ ID 36; ORF 006-1.a>:

```
a006-1.pep (partial)
     1  ..SQNHRKRLIG TFFLVGLENL LMLVYPVFGG WAINAVIAGQ AWQALLYALV
    51    VLLMWLVGAA RRIADTRTFT RIYTEIAVPV VLEQRQRQVP HSAVTARVAL
   101    SREFVSFFEE HLPIAATSVV SIFGACIMLL VLEFWVGVSA VGILALFLWL
   151    LPRFAAISEN LYFRLKNSLE RDNHFIRKGD ERQLDRHYGL LARLRVLISN
   201    REAFGYLCVG TAMGILFGFA FVMMTLKGYS SAGHVYSVGT YLWMFAISLD
   251    DVPRLVEQYS NLKDIGQRIE WSKRNIKAGT *
a006-1/m006-1 95.7% identity in 280 aa overlap
                        10        20        30        40        50
a006-1.pep          SQNHRKRLIGTFFLVGLENLLMLVYPVFGGWAINAVIAGQAWQALLYALVVL
                    :|:||||||||| ||||||||||||||||| ||||||||::|||||||||||
m006-1         MWKMLKHIAQTHRKRLIGTFSLVGLENLLMLVYPVFGGRAINAVIAGEVWQALLYALVVL
                       10        20        30        40        50        60

                  60        70        80        90       100       110
a006-1.pep     LMWLVGAARRIADTRTFTRIYTEIAVPVVLEQRQRQVPHSAVTARVALSREFVSFFEEHL
               ||||||:|||||||||||||||||||||||||||||||||||||||||||||||||||||
m006-1         LMWLVGAVRRIADTRTFTRIYTEIAVPVVLEQRQRQVPHSAVTARVALSREFVSFFEEHL
                       70        80        90       100       110       120

                 120       130       140       150       160       170
a006-1.pep     PIAATSVVSIFGACIMLLVLEFWVGVSAVGILALFLWLLPRFAAISENLYFRLKNSLERD
               ||||||||||||||||||||||||||||||||||||||||||||||||||||:|||||||
m006-1         PIAATSVVSIFGACIMLLVLEFWVGVSAVGILALFLWLLPRFAAISENLYFRLNNSLERD
                      130       140       150       160       170       180

                 180       190       200       210       220       230
a006-1.pep     NHFIRKGDERQLDRHYGLLARLRVLISNREAFGYLCVGTAMGILFGFAFVMMTLKGYSSA
               ||||||||:||| |||||||||||||||||||||||||||||||||||||||||||||||
m006-1         NHFIRKGDRRQLYRHYGLLARLRVLISNREAFGYLCVGTAMGILFGFAFVMMTLKGYSSA
                      190       200       210       220       230       240

                 240       250       260       270       280
a006-1.pep     GHVYSVGTYLWMFAISLDDVPRLVEQYSNLKDIGQRIEWSKRNIKAGTX
               |||||||||||||:||||||||||||||||||||||||||:||||||||
m006-1         GHVYSVGTYLWMFAMSLDDVPRLVEQYSNLKDIGQRIEWSERNIKAGTX
                      250       260       270       280
```

The following partial DNA sequence was identified in *N. gonorrhoeae* <SEQ ID 37>:

```
g007.seq
    1  atgaACACAA CCCGACTGCC GACCGCCTTC ATCTTGTGCT GCCTCTGcgC

   51  CGCcGCTTCT GCCGccgaca acAGCatcat gaCaAAAGGG CAAAAAGTGT

  101  ACGAATCcAa ctGCATCGCC TGCCACGGCA AGAAAGGGGA AGGGCGCGGC

  151  ACTGCGtTTC CTccgctTTT CCggtcgGac tgtattatga acaAACCGCa

  201  cgTCCtgctg cacagcatgg tcaaaggcAt cgacgggaca ttcaaagtgg
```

-continued

```
251  agcggcaaaa cctacgacgg atttatgCcc gcaaccgcca tcagcgATGC

301  GGACATTGCC GCCGTCGCCA CTTATATCAT GAACGCCTTT GA
```

This corresponds to the amino acid sequence <SEQ ID 38; ORF 007.ng>:

```
g007.pep
  1  MNTTRLPTAF ILCCLCAAAS AADNSIMTKG QKVYESNCIA CHGKKGEGRG

 51  TAFPPLFRSD CIMNKPHVLL HSMVKGIDGT FKVERQNLRR IYARNRHQRC

101  GHCRRRHLYH ERL*
```

The following partial DNA sequence was identified in *N. meningitidis* <SEQ ID 39>:

```
m007.seq
  1  ATGAACACAA CCCGACTGCC GACCGCCCTC GTCTTGGGCT GCTTCTGCGC

 51  CGCCGCTTCT GCCGCCGACA ACAGCATCAT GACAAAAGGG CAAAAAGTGT

101  ACGAATCCAA CTGCGTCGCC TGCCACGGCA AAAAGGGCGA AGGCCGCGGA

151  ACCATGTTTC CGCCGCTCTA CCGCTCCGAC TTCATCATGA AAAAACCGCA

201  GGTGCTGCTG CACAGCATGG TCAAAGGCAT CAACGGTACA ATCAAAGTC.

251  AACGGCAAAA CCTACAACGG ATTCATGCCC GCAACCGCCA TCAGCGATGC

301  GGACATTGCC GCCGTCGCCA CTTATATCAT GAACGCCTTT GA
```

This corresponds to the amino acid sequence <SEQ ID 40; ORF 007>:

```
m007.pep
  1  MNTTRLPTAL VLGCFCAAAS AADNSIMTKG QKVYESNCVA CHGKKGEGRG

 51  TMFPPLYRSD FIMKKPQVLL HSMVKGINGT IKVXRQNLQR IHARNRHQRC

101  GHCRRRHLYH ERL*
```

The following partial DNA sequence was identified in *N. meningitidis* <SEQ ID 41>:

```
a007.seq
  1  ATGAACACAA CCCGACTGCC GACCGCCCTC GTCTTGGGCT GCCTCTGCGC

 51  CGCCGCTTCT GCCGCCGACA ACAGCATCAT GACAAAAGGG CAAAAAGTGT

101  ACGAATCCAA CTGCGTCGCC TGCCACGGCA AAAAGGGCGA AGGCCGCGGA

151  ACCATGTTTC CGCCGCTCTA CCGCTCCGAC TTCATCATGA AAAAACCGCA

201  GGTGCTGCTG CACAGCATGG TCAAAGGCAT CAACGGTACA ATCAAAGTC.

251  AACGGCAAAA CCTACAACGG ATTCATGCCC GCCACTGCCA TCAGCGATGC

301  GGACATTGCC GCCGTCGCCA CTTATATCAT GAACGCCTTT GA
```

This corresponds to the amino acid sequence <SEQ ID 42; ORF 007.a>:

```
a007.pep
  1  MNTTRLPTAL VLGCLCAAAS AADNSIMTKG QKVYESNCVA CHGKKGEGRG

 51  TMFPPLYRSD FIMKKPQVLL HSMVKGINGT IKVXRQNLQR IHARHCHQRC

101  GHCRRRHLYH ERL*
```

m007/a007 97.3% identity over a 113 aa overlap

```
                    10        20        30        40        50        60
m007.pep    MNTTRLPTALVLGCFCAAASAADNSIMTKGQKVYESNCVACHGKKGEGRGTMFPPLYRSD
            |||||||||||||||:||||||||||||||||||||||||||||||||||||||||||||
a007        MNTTRLPTALVLGCLCAAASAADNSIMTKGQKVYESNCVACHGKKGEGRGTMFPPLYRSD
                    10        20        30        40        50        60
                    70        80        90       100       110
m007.pep    FIMKKPQVLLHSMVKGINGTIKVXRQNLQRIHARNRHQRCGHCRRRHLYHERLX
            ||||||||||||||||||||||||||||||||||: ||||||||||||||||||
a007        FIMKKPQVLLHSMVKGINGTIKVXRQNLQRIHARHCHQRCGHCRRRHLYHERLX
                    70        80        90       100       110
```

Computer analysis of this amino acid sequence gave the following results:

Homology with a Predicted ORF from *N. gonorrhoeae*

ORF 007 shows 86.7% identity over a 113 aa overlap with a predicted ORF (ORF 007.ng) from *N. gonorrhoeae*:

```
m007/g007

                    10        20        30        40        50        60
m007.pep    MNTTRLPTALVLGCFCAAASAADNSIMTKGQKVYESNCVACHGKKGEGRGTMFPPLYRSD
            |||||||||::| |:|||||||||||||||||||||||:|||||||||||| ||||:|||
g007        MNTTRLPTAFILCCLCAAASAADNSIMTKGQKVYESNCIACHGKKGEGRGTAFPPLFRSD
                    10        20        30        40        50        60
                    70        80        90       100       110
m007.pep    FIMKKPQVLLHSMVKGINGTIKVXRQNLQRIHARNRHQRCGHCRRRHLYHERLX
             ||:||:||||||||||:||:|| ||||:||:|||||||||||||||||||||
g007        CIMNKPHVLLHSMVKGIDGTFKVERQNLRRIYARNRHQRCGHCRRRHLYHERL
                    70        80        90       100       110
```

The following partial DNA sequence was identified in *N. gonorrhoeae* <SEQ ID 43>:

```
g007-1.seq (partial)
    1  ATGAACACAA CCCGACTGCC GACCGCCTTC ATCTTGTGCT GCCTCTGCGC

   51  CGCCGCTTCT GCCGCCGACA ACAGCATCAT GACAAAAGGG CAAAAAGTGT

  101  ACGAATCCAA CTGCATCGCC TGCCACGGCA AGAAAGGGGA AGGGCGCGGC

  151  ACTGCGTTTC CTCCGCTTTT CCGGTCGGAC TATATTATGA ACAAACCGCA

  201  CGTCCTGCTG CACAGCATGG TCAAAGGCAT CAACGGTACA ATCAAAGTCA

  251  ACGGCAAAAC CTACAACGGA TTCATGCCCG CAACCGCCAT CAGCGATGCG

  301  GACATTGCCG CCGTCGCCAC TTATATCATG AACGCCTTTG ACAACGGCGG

  351  CGGAAGCGTT ACCGAAAAAG ACGTAAAACA GGCAAAAGGC AAAAAAAAC.
```

This corresponds to the amino acid sequence <SEQ ID 44; ORF 007-1.ng>:

```
g007-1.pep (partial)
    1  MNTTRLPTAF ILCCLCAAAS AADNSIMTKG QKVYESNCIA CHGKKGEGRG

   51  TAFPPLFRSD YIMNKPHVLL HSMVKGINGT IKVNGKTYNG FMPATAISDA

  101  DIAAVATYIM NAFDNGGGSV TEKDVKQAKG KKN...
```

The following partial DNA sequence was identified in *N. meningitidis* <SEQ ID 45>:

```
m007-1.seq
    1  ATGAACACAA CCCGACTGCC GACCGCCCTC GTCTTGGGCT GCTTCTGCGC

   51  CGCCGCTTCT GCCGCCGACA ACAGCATCAT GACAAAAGGG CAAAAAGTGT
```

-continued

```
101  ACGAATCCAA CTGCGTCGCC TGCCACGGCA AAAAGGGCGA AGGCCGCGGA

151  ACCATGTTTC CGCCGCTCTA CCGCTCCGAC TTCATCATGA AAAAACCGCA

201  GGTGCTGCTG CACAGCATGG TCAAAGGCAT CAACGGTACA ATCAAAGTCA

251  ACGGCAAAAC CTACAACGGA TTCATGCCCG CAACCGCCAT CAGCGATGCG

301  GACATTGCCG CCGTCGCCAC TTATATCATG AACGCCTTTG ACAACGGCGG

351  CGGAAGCGTT ACCGAAAAAG ACGTAAAACA GGCAAAAAGC AAAAAAAACT

401  AA
```

This corresponds to the amino acid sequence <SEQ ID 46; ORF 007-1>

```
m007-1.pep
   1  MNTTRLPTAL VLGCFCAAAS AADNSIMTKG QKVYESNCVA CHGKKGEGRG

  51  TMFPPLYRSD FIMKKPQVLL HSMVKGINGT IKVNGKTYNG FMPATAISDA

 101  DIAAVATYIM NAFDNGGGSV TEKDVKQAKS KKN*
```

m007-1/g007-1 91.7% identity in 133 aa overlap

```
                        10        20        30        40        50        60
    m007-1.pep   MNTTRLPTALVLGCFCAAASAADNSIMTKGQKVYESNCVACHGKKGEGRGTMFPPLYRSD
                 |||||||||::| |:|||||||||||||||||||||||:|||||||||||| ||||:|||
    g007-1       MNTTRLPTAFILCCLCAAASAADNSIMTKGQKVYESNCIACHGKKGEGRGTAFPPLFRSD
                        10        20        30        40        50        60

                        70        80        90       100       110       120
    m007-1.pep   FIMKKPQVLLHSMVKGINGTIKVNGKTYNGFMPATAISDADIAAVATYIMNAFDNGGGSV
                 :||:||:|||||||||||||||||||||||||||||||||||||||||||||||||||||
    g007-1       YIMNKPHVLLHSMVKGINGTIKVNGKTYNGFMPATAISDADIAAVATYIMNAFDNGGGSV
                        70        80        90       100       110       120

                       130
    m007-1.pep   TEKDVKQAKSKKNX
                 |||||||||:|||
    g007-1       TEKDVKQAKGKKN
                       130
```

The following partial DNA sequence was identified in *N. meningitidis* <SEQ ID 47>:

```
a007-1.seq (partial)
   1  ATGAACACAA CCCGACTGCC GACCGCCCTC GTCTTGGGCT GCCTCTGCGC

  51  CGCCGCTTCT GCCGCCGACA ACAGCATCAT GACAAAAGGG CAAAAAGTGT

 101  ACGAATCCAA CTGCGTCGCC TGCCACGGCA AAAAGGGCGA AGGCCGCGGA

 151  ACCATGTTTC CGCCGCTCTA CCGCTCCGAC TTCATCATGA AAAAACCGCA

 201  GGTGCTGCTG CACAGCATGG TCAAAGGCAT CAACGGTACA ATCAAAGTCA

 251  ACGGCAAAAC CTACAACGGA TTCATGCCCG CCACTGCCAT CAGCGATGCG

 301  GACATTGCCG CCGTCGCCAC TTATATCATG AACGCCTTTG ACAACGGCGG

 351  CGGAAGCGTT ACCGAAAAAG ACGTAAAACA GGCAAAAAAC AAAAAA..
```

This corresponds to the amino acid sequence <SEQ ID 48; ORF 007-1.a>:

```
a007-1.pep (partial)
   1  MNTTRLPTAL VLGCLCAAAS AADNSIMTKG QKVYESNCVA CHGKKGEGRG
```

-continued

```
 51  TMFPPLYRSD FIMKKPQVLL HSMVKGINGT IKVNGKTYNG FMPATAISDA

101  DIAAVATYIM NAFDNGGGSV TEKDVKQAKN KK..
```

m007-1/a007-1 98.5% identity in 132 aa overlap

```
                       10        20        30        40        50        60
m007-1.pep    MNTTRLPTALVLGCFCAAASAADNSIMTKGQKVYESNCVACHGKKGEGRGTMFPPLYRSD
              ||||||||||||||:|||||||||||||||||||||||||||||||||||||||||||||
a007-1        MNTTRLPTALVLGCLCAAASAADNSIMTKGQKVYESNCVACHGKKGEGRGTMFPPLYRSD
                       10        20        30        40        50        60
                       70        80        90       100       110       120
m007-1.pep    FIMKKPQVLLHSMVKGINGTIKVNGKTYNGFMPATAISDADIAAVATYIMNAFDNGGGSV
              ||||||||||||||||||||||||||||||||||||||||||||||||||||||||||||
a007-1        FIMKKPQVLLHSMVKGINGTIKVNGKTYNGFMPATAISDADIAAVATYIMNAFDNGGGSV
                       70        80        90       100       110       120
                      130
m007-1.pep    TEKDVKQAKSKKNX
              |||||||||:||
a007-1        TEKDVKQAKNKK
                      130
```

The following partial DNA sequence was identified in *N. gonorrhoeae* <SEQ ID 49>:

```
g008.seq
  1  ATGAACAACA GACATTTTGC CGTCAtcgCC TTGGGCAGCA ACCTTGACAA

 51  CCCCGCACAA CAAATacgcg gcgcattaga cgcgctctcg tcccatcctg

101  acatccggct tgaaCaggtt tcctcactgt aTatgaccgc acctgtcggt

151  tacgAcaaTC agcccgATTT CATCaatgcc gTCTgcaccg TTTCCACCAC

201  CtTGGACGGC ATTGcccTGC TTGCCgaACT CAAccgTATC GAAGCCGATT

251  TCGGACGCGA aCGCAGTTTC CGCAATGCAC CGCGCACATT GGATTTGGAC

301  ATTATCGACT TTGACGGCAT CTCCAGCGAC GACCCCCGCC TTACCCTGCC

351  GCATCCGCGC GCGCACGAAC GCAGTTTCGT CATACGCCCT TTGGCAGAAA

401  TCCTCCCTGA TTTTATTTTG GGAAAATACG GAAAGGTTGT CGAATTGTCA

451  AAACGGCTGG GCAATCAAGG CATCCGTCTT TTACCGGACA GGTAA
```

This corresponds to the amino acid sequence <SEQ ID 50; ORF 008.ng>:

```
g008.pep
  1  MNNRHFAVIA LGSNLDNPAQ QIRGALDALS SHPDIRLEQV SSLYMTAPVG

 51  YDNQPDFINA VCTVSTTLDG IALLAELNRI EADFGRERSF RNAPRTLDLD

101  IIDFDGISSD DPRLTLPHPR AHERSFVIRP LAEILPDFIL GKYGKVVELS

151  KRLGNQGIRL LPDR*
```

The following partial DNA sequence was identified in *N. meningitidis* <SEQ ID 51>:

```
m008.seq
  1  ATGAACAACA GACATTTTGC CGTCATCGCC CTGGGCAGTA ATCTTGAAAA

 51  CCCTGCTCAA CAGGTACGCG CCGCATTGGA CACGCTGTCG TCCCATCCTG

101  ACATCCGTCT TAAACAGGCT TCCTCACTGT ATATGACCGC GCCCGTCGGT

151  TACGACAATC AGCCCGATTT TGTCAATGCC GTCTGCACCG TTTCCACCAC
```

-continued

```
201  TCTGGACGGC ATTGCCyTGC TTGCCGAACT CAACCGTATC GAGGCTGATT

251  TCGGACGCGA ACGCAGCTTC CGCAACGCGC CGCGCACATT GkATTTGGAC

301  ATTATCGACT TTGACGGCAT CTCCAGCGAC GACACsCGAC TcACCtTGCC

351  GCATCCGCGC GCGCACGAAC GCAGTTTCGT CATCCGCCCT TTGGCAGAAA

401  TCCTCCCTGA TTTTGTTTTA GGAAAACACG GAAAGGTTGC CGAATTGTCA

451  AAACGGyTGG GCAATCAAGG TATCCGTCTT TTACCGGACA GGTAATT
```

This corresponds to the amino acid sequence <SEQ ID 52; ORF 008>:

```
m008.pep
    1  MNNRHFAVIA LGSNLENPAQ QVRAALDTLS SHPDIRLKQAS SLYMTAPVG

   51  YDNQPDFVNA VCTVSTTLDG IALLAELNRI EADFGRERSFR NAPRTLXLD

  101  IIDFDGISSD DTRLTLPHPR AHERSFVIRP LAEILPDFVLG KHGKVAELS

  151  KRLGNQGIRL LPDR*
```

The following partial DNA sequence was identified in *N. meningitidis*<SEQ ID 53>:

```
a008.seq
    1  ATGAACAACA GACATTTTGC CGTCATCGCC CTGGGCAGTA ATCTTGAAAA

   51  CCCTGCCCAA CAGGTACGCG CCGCATTGGA CACGCTGTCG TCCCATCCTG

  101  ACATCCGTCT TAAACAGGCT TCCTCACTGT ATATGACCGC GCCCGTCGGT

  151  TACGACAATC AGCCCGATTT CGTCAATGCC GTCTGCACCG TTTCCACCAC

  201  CTTGGACGGC ATTGCCCTGC TTGCCGAACT CAACCGTATC GAAGCCGATT

  251  TCGGACGCGA ACGCAGCTTC CGCAACGCGC CGCGCACATT GGATTTGGAC

  301  ATTATCGACT TTGACGGCAT CTCCAGCGAC GACCCCCGAC TCACCCTGCC

  351  GCATCCGCGC GCGCACGAAC GCAGTTTCGT CATACGCCCT TTGGCAGAAA

  401  TCCTCCCTGA TTTTATTTTG GGAAAACACG GAAAGGTTGC CGAATTGTCA

  451  AAACGGCTGG GCAATCAAGG CATCCGTCTT TTACCGGATA AGTAA
```

This corresponds to the amino acid sequence <SEQ ID 54; ORF 008.a>:

```
a008.pep
    1  MNNRHFAVIA LGSNLENPAQ QVRAALDTLS SHPDIRLKQA SSLYMTAPVG

   51  YDNQPDFVNA VCTVSTTLDG IALLAELNRI EADFGRERSF RNAPRTLDLD

  101  IIDFDGISSD PRLTLPHPRA HERSFVIRPL LAEILPDFIL GKHGKVAELS

  151  KRLGNQGIRL LPDK*
```

m008/a008 97.6% identity over a 164 aa overlap

```
                        10        20        30        40        50        60
m008.pep    MNNRHFAVIALGSNLENPAQQVRAALDTLSSHPDIRLKQASSLYMTAPVGYDNQPDFVNA
            ||||||||||||||||||||||||||||||||||||||||||||||||||||||||||||
a008        MNNRHFAVIALGSNLENPAQQVRAALDTLSSHPDIRLKQASSLYMTAPVGYDNQPDFVNA
                        10        20        30        40        50        60
```

-continued

```
                   70        80        90       100       110       120
m008.pep    VCTVSTTLDGIALLAELNRIEADFGRERSFRNAPRTLXLDIIDFDGISSDDTRLTLPHPR
            |||||||||||||||||||||||||||||||||||||| ||||||||||||| ||||||||
a008        VCTVSTTLDGIALLAELNRIEADFGRERSFRNAPRTLDLDIIDFDGISSDDPRLTLPHPR
                   70        80        90       100       110       120

                  130       140       150       160
m008.pep    AHERSFVIRPLAEILPDFVLGKHGKVAELSKRLGNQGIRLLPDRX
            |||||||||||||||||:||||||||||||||||||||||||||:|
a008        AHERSFVIRPLAEILPDFILGKHGKVAELSKRLGNQGIRLLPDKX
                  130       140       150       160
```

Computer analysis of this amino acid sequence gave the following results:

Homology with a Predicted ORF from *N. gonorrhoeae*

ORF 008 shows 92.7% identity over a 164 aa overlap with a predicted ORF (ORF008.ng) from *N. gonorrhoeae*:

```
m008/g008

                   10        20        30        40        50        60
m008.pep    MNNRHFAVIALGSNLENPAQQVRAALDTLSSHPDIRLKQASSLYMTAPVGYDNQPDFVNA
            ||||||||||||||:|||||:|:|||:|||||||||:|:||||||||||||||||||:||
g008        MNNRHFAVIALGSNLDNPAQQIRGALDALSSHPDIRLEQVSSLYMTAPVGYDNQPDFINA
                   10        20        30        40        50        60
                   70        80        90       100       110       120
m008.pep    VCTVSTTLDGIALLAELNRIEADFGRERSFRNAPRTLXLDIIDFDGISSDDTRLTLPHPR
            |||||||||||||||||||||||||||||||||||||| ||||||||||||| ||||||||
g008        VCTVSTTLDGIALLAELNRIEADFGRERSFRNAPRTLDLDIIDFDGISSDDPRLTLPHPR
                   70        80        90       100       110       120
                  130       140       150       160
m008.pep    AHERSFVIRPLAEILPDFVLGKHGKVAELSKRLGNQGIRLLPDRX
            |||||||||||||||||:|||:|||:|||||||||||||||||||
g008        AHERSFVIRPLAEILPDFILGKYGKVVELSKRLGNQGIRLLPDRX
                  130       140       150       160
```

The following partial DNA sequence was identified in *N. gonorrhoeae* <SEQ ID 55>:

```
g009.seq
   1  ATGCCCCGCG CTGCCGTAGC CTTTGAGCGT CATCATCACA AAAGCAAAGC

  51  CGAACAAAAT ACCCATCGCC GCGCCGACGC AGAGATAGCC GAAGGCTTCG

 101  CGGTTGGAAA TCAGCACACG CAGGCGCGAA ACCAGTCCGT AATGGCGGTA

 151  CAGCTGCCGC TCGTCGCCTT TTCGGATAAA GTGGTTGTcg cGTTCCAAGC

 201  TGTTGTTCAG GCGGAAATAC AGGTTTTCGC TGATGGCGGC AAAACGTGGC

 251  AaaaGCCATA A
```

This corresponds to the amino acid sequence <SEQ ID 56; ORF 009.ng>:

```
g009.pep
   1  MPRAAVAFER HHHKSKAEQN THRRADAEIA EGFAVGNQHT QARNQSVMAV

  51  QLPLVAFSDK VVVAFQAVVQ AEIQVFADGG KTWQKP*
```

The following partial DNA sequence was identified in *N. meningitidis* <SEQ ID 57>:

```
m009.seq
   1  ATGCCCCGCG CTGCTGTAGC CTTTGAGCGT CATCATCACA AAAGCAAAGC

  51  CGAACAAAAT ACCCATCGCC GTGCCGACGC AGAGATAGCC GAAGGCTTCG

 101  CGGTTGGAAA TCAGCACACG CAGGCGCGCA AGCAGTCCGT AATGGCGGTA
```

-continued

```
151  CAGCTGCCGC CGGTCGCCTT TTCGGATAAA GTGGTTGTCG CGTTCCAAGC

201  TGTTGTTCAG GCGGAAATAC AGGTTTTCGC TGATGGCGGC AAAACGTGGC

251  AAAAGCCATA A
```

This corresponds to the amino acid sequence <SEQ ID 58; ORF 009>:

```
m009.pep
   1  MPRAAVAFER HHHKSKAEQN THRRADAEIA EGFAVGNQHT QARKQSVMAV

  51  QLPPVAFSDK VVVAFQAVVQ AEIQVFADGG KTWQKP*
```

Computer analysis of this amino acid sequence gave the following results:

Homology with a Predicted ORF from *N. gonorrhoeae*

ORF 009 shows 97.7% identity over a 86 aa overlap with a predicted ORF (ORF 009.ng) from *N. gonorrhoeae*:

```
m009/g009

                  10        20        30        40        50        60
m009.pep  MPRAAVAFERHHHKSKAEQNTHRRADAEIAEGFAVGNQHTQARKQSVMAVQLPPVAFSDK
          ||||||||||||||||||||||||||||||||||||||||||:|||||||||| ||||||
g009      MPRAAVAFERHHHKSKAEQNTHRRADAEIAEGFAVGNQHTQARNQSVMAVQLPLVAFSDK
                  10        20        30        40        50        60

                  70        80
m009.pep  VVVAFQAVVQAEIQVFADGGKTWQKPX
          |||||||||||||||||||||||||||
g009      VVVAFQAVVQAEIQVFADGGKTWQKPX
                  70        80
```

The following partial DNA sequence was identified in *N. meningitidis* <SEQ ID 59>:

```
a009.seq
   1  ATGCCCCGCG CTGCTGTAGC CTTTGAGCGT CATCATCACA AAAGCAAAGC

  51  CGAACAAAAT ACCCATCGCC GTGCCGACGC AGAGATAGCC GAAGGCTTCG

 101  CGGTTGGAAA TCAGCACACG CAGGCGCGCA AGCAGTCCGT AATGGCGGTC

 151  CAGCTGCCGC TCGTCGCCTT TTCGGATAAA GTGGTTGTCG CGTTCCAAGC

 201  TGTTCTTCAG GCGGAAATAC AGGTTTTCGC TGATGGCGGC AAAACGTGGC

 251  AAAAGCCATA A
```

This corresponds to the amino acid sequence <SEQ ID 60; ORF 009.a>:

```
a009.pep
   1  MPRAAVAFER HHHKSKAEQN THRRADAEIA EGFAVGNQHT QARKQSVMAV

  51  QLPLVAFSDK VVVAFQAVLQ AEIQVFADGG KTWQKP*
```

m005/a009 97.7% identity over a 86 aa overlap

```
                  10        20        30        40        50        60
m009.pep  MPRAAVAFERHHHKSKAEQNTHRRADAEIAEGFAVGNQHTQARKQSVMAVQLPPVAFSDK
          ||||||||||||||||||||||||||||||||||||||||||||||||||||| ||||||
a009      MPRAAVAFERHHHKSKAEQNTHRRADAEIAEGFAVGNQHTQARKQSVMAVQLPLVAFSDK
                  10        20        30        40        50        60
```

-continued

```
                 70         80
m009.pep   VVVAFQAVVQAEIQVFADGGKTWQKPX
           ||||||||:||||||||||||||||||
a009       VVVAFQAVLQAEIQVFADGGKTWQKPX
                 70         80
```

The following partial DNA sequence was identified in *N. gonorrhoeae* <SEQ ID 61>:

```
g010.seq
     1 ATGGGTTTTC CTGTTCGCAA GTTTGATGCC GTGATTGTCG GCGGTGGCGG

    51 TGCAGGTTTA CGTGCAGCCC TCCAATTATC CAAATCCGGT TTGAATTGTG

   101 CCGTTTTGTC TAAAGTGTTC CCGACCCGCT CGCATACCGT AGCGGCGCAG

   151 GGCGGTATTT CCGCCTCTCT GGGTAATGTG CAGGAGGACC GTTGGGACTG

   201 GCACATGTAC GATACCGTGA AAGGTTCCGA CTGGCTGGGC GACCAAGATG

   251 CGATTGAGTT TATGTGTCGC GCTGCGCCTG AAGCGGTGAT TGAGTTGGAA

   301 CACATGGGTA TGCCTTTTGA CCGCGTTGAA AGCGGCAAAA TTTATCAGCG

   351 TCCTTTCGGC GGACATACTG CCGAACATGG TAAACGTGCG GTAGAACGTG

   401 CATGTGCGGT TGCCGACCGT ACCGGTCATG CGATGTTGCA TACTTTGTAC

   451 CAACAAAACG TCCGTGCCAA TACACAATTC TTTGTGGAAT GGACGGCGCA

   501 AGATTTGATT CGTGATGAAA ACGGCGATGT CGTCGGCGTA ACCGCCATGG

   551 AAATGGAAAC GGGCGAAGTT TATATTTTCC ACGCCAAGGC CGTGATGTTT

   601 GCTACCGGTG GCGGCGGTCG TATTTATGCT TCTTCTACCA ATGCTTATAT

   651 GAATACCGGT GACGGTTTGG GCATTTGCGC CCGTGCGGGC ATTCCGTTGG

   701 AAGATATGGA ATTCTGGCAA TTCCACCCGA CCGGCGTGGC GGGTGCGGGC

   751 GTGTTGATTA CCGAAGGCGT ACGCGGCGAG GGCGGTATTC TGTTGAacgc

   801 cgacggcgaA cgcTTTATGG AAcgctatgc GCcgACCGta aAagaCTTGG

   851 CTTCTCGCga cgtGGTTTCA CgcgcGatgG CGatggaAAt ctatgaaggt

   901 cgcggctgTG GtaaAAAcaA agaCCacgtC TTACTGAAAA TCGACcAtAt

   951 cggtGCAGAA AAAATTATGG AAAAACTGCC GGGCATCCGC GAGATTTCCA

  1001 TTCagtttgc cGGTATCGAT CCGATTAAAG ACCCGATTcc ggttgTGCCG

  1051 ACTACCCACT ATATGATGGG CGGCATTCcg aCCAATTATC ACGGTGAAGT

  1101 TGTTGTTCCG CAAGGCGACG AGTACGAAGT ACCTGTAAAA GGCCTGTATG

  1151 CCGCAGGTGA GTGCGCCTGT GCTTCCGTAC ACGGTGCGAA CCGTTTGGGT

  1201 ACGAACTCCC TGCTGGACTT GGTGGTGTTC cgcccaaccc cccggtga
```

This corresponds to the amino acid sequence <SEQ ID 62; ORF 010.ng>:

```
g010.pep
     1 MGFPVRKFDA VIVGGGGAGL RAALQLSKSG LNCAVLSKVF PTRSHTVAAQ

    51 GGISASLGNV QEDRWDWHMY DTVKGSDWLG DQDAIEFMCR AAPEAVIELE

   101 HMGMPFDRVE SGKIYQRPFG GHTAEHGKRA VERACAVADR TGHAMLHTLY

   151 QQNVRANTQF FVEWTAQDLI RDENGDVVGV TAMEMETGEV YIFHAKAVMF

   201 ATGGGGRIYA SSTNAYMNTG DGLGICARAG IPLEDMEFWQ FHPTGVAGAG

   251 VLITEGVRGE GGILLNADGE RFMERYAPTV KDLASRDVVS RAMAMEIYEG
```

-continued

```
301  RGCGKNKDHV LLKIDHIGAE KIMEKLPGIR EISIQFAGID PIKDPIPVVP

351  TTHYMMGGIP TNYHGEVVVP QGDEYEVPVK GLYAAGECAC ASVHGANRLG

401  TNSLLDLVVF RPTPR*
```

The following partial DNA sequence was identified in *N. meningitidis* <SEQ ID 63>:

```
m010.seq (PARTIAL)
   1  ..nTCCAATTAT CCAAATCCGG TCTGAATTGT GCCGTTTTGT CTAAAGTGTT

  51    CCCGACCCGT TCGCATACCG TAGCGGCGCA GGGCGGTATT TCCGCCTCTn

 101    TGGGTAATGT GCAGGAAGAC CGTTGGGACT GGCACATGTA CGATACCGTG

 151    AAAGGTTCCG ACTGGTTGGG CGACCAAGAT GCGATTGAGT TTATGTGCCG

 201    CGCCGCGCCT GAAGCCGTAA TTGAGTTGGA ACACATGGGT ATGCCTTTTG

 251    ACCGTGTGGA AAGCGGTAAA ATTTATCAGC GTCCTTTCGG CGGCCATACT

 301    GCCGAACACG GTAAACGCGC GGTAGAACGC GyCTGTGCGG TTGCCGACCG

 351    TACAGGTCAT GCGATGCTGC ATACTTTGTA CCAACAAAAC GTCCGTGCCA

 401    ATACGCAATT CTTTGTGGAA TGGACGGCAC AAGATTTGAT TCGTGATGAA

 451    AACGGCGATG TCGTCGGCGT AACCGCCATG GAAATGGAAA CCGGCGAAgT

 501    TTATATTTTC CACGCTAAAG CTGTGATGTT TGCTACCGGC GGCGGCGGTC

 551    GTATTTATGC GTCTTCTACC AATGCCTATA TGAATACCGG CGATGGTTTG

 601    GGTATTTGTG CGCGTGCAGG TATCCCGTTG GAAGACATGG AATTCTGGCA

 651    ATTCCAGCCG ACCGGCGTGG CGGGTGCGGG CGTGTTGATT ACCGAA....
```

This corresponds to the amino acid sequence <SEQ ID 64; ORF 010>:

```
m010.pep (PARTIAL)
   1  ..XQLSKSGLNC AVLSKVFPTR SHTVAAQGGI SASXGNVQED RWDWHMYDTV

  51    KGSDWLGDQD AIEFMCRAAP EAVIELEHMG MPFDRVESGK IYQRPFGGHT

 101    AEHGKRAVER XCAVADRTGH AMLHTLYQQN VRANTQFFVE WTAQDLIRDE

 151    NGDVVGVTAM EMETGEVYIF HAKAVMFATG GGGRIYASST NAYMNTGDGL

 201    GICARAGIPL EDMEFWQFQP TGVAGAGVLI TE...
```

The following partial DNA sequence was identified in *N. meningitidis* <SEQ ID 65>:

```
a010.seq
    1 ATGGGCTTTC CTGTTCGCAA GTTTGATGCC GTGATTGTCG GCGGTGGTGG

   51 TGCAGGTTTA CGCGCANCCC TCCAATTATC CAAATCCGGT CTGAATTGTG

  101 CCGTTTTGTC TAAAGTGTTC CCGACCCGTT CGCATACCGT AGCGGCGCAG

  151 GGCGGTATTT CCGCCTCTCT GGGTAATGTG CAGGAAGACC GTTGGGACTG

  201 GCACATGTAC GATACCGTGA AAGGTTCCGA CTGGTTGGGC GACCAAGATG

  251 CGATTGAGTT TATGTGCCGC GCCGCGCCTG AAGCCGTAAT TGAGTTGGAA

  301 CACATGGGTA TGCCTTTTGA CCGTGTGGAA AGCGGTAAAA TTTATCAGCG

  351 TCCTTTCGGC GGCCATACTG CCGAACACGG TAAACGCGCG GTAGAACGCG

  401 CCTGTGCNGT TGCCGACCGT ACAGGTCATG CGATGCTGCA TACTTTGTAC
```

-continued

```
 451 CAACAAAATG TCCGTGCCAA TACGCAATTC TTTGTGGAAT GGACGGCACA

 501 AGATTTGATT CGTGATGAAA ACGGCGATGT CGTCGGCGTA ACCGCCATGG

 551 AAATGGAAAC CGGCGAAGTT TATATTTTCC ACGCTAAAGC TGTGATGTTT

 601 GCTACCGGCG GCGGCGGCCG TATTTATGCG TCTTCTACCA ATGCCTATAT

 651 GAATACCGGC GATGGTTTGG GTATTTGTGC GCGTGCAGGT ATCCCGTTGG

 701 AAGACATGGA ATTCTGGCAA TTCCACCCGA CCGGCGTGGC AGGTGCGGGC

 751 GTGTTGATTA CCGAAGGCGT ACGCGGCGAG GGCGGTATTC TGTTGAATGC

 801 CGACGGCGAA CGCTTTATGG AACGCTATGC GCCGACCGTA AAAGACTTGG

 851 CTTCTCGCGA CGTTGTTTCC CGCGCGATGG CGATGGAAAT CTACGAAGGT

 901 CGCGGCTGCG GTAAAAACAA AGACCATGTC TTACTGAAAA TCGACCATAT

 951 CGGCGCAGAA AAAATTATGG AAAAACTGCC GGGCATCCGC GAGATTTCCA

1001 TTCAGTTCGC CGGTATCGAT CCGATTAAAG ACCCGATTCC CGTTGTGCCG

1051 ACTACCCACT ATATGATGGG CGGTATTCCG ACCAACTACC ATGGCGAAGT

1101 TGTCGTTCCT CAAGGCGACG AATACGAAGT GCCTGTAAAA GGTCTGTATG

1151 CGGCAGGTGA GTGCGCCTGT GCTTCCGTAC ACGGTGCGAA CCGCTTGGGT

1201 ACGAACTCCC TGCTGGACTT AGTGGTATTC GGTAAAGCTG CCGGCGACAG

1251 CATGATTAAA TTCATCAAAG AGCAAAGCGA CTGGAAACCT TTGCCTGCTA

1301 ATGCCGGCGA ACTGACCCGC CAACGTATCG AGCGTTTGGA CAATCAAACT

1351 GATGGTGAAA ACGTTGATGC ATTGCGCCGC GAACTGCAAC GCTCCGTACA

1401 ATTGCACGCC GGCGTGTTCC GTACTGATGA GATTCTGAGC AAAGGCGTTC

1451 GAGAAGTCAT GGCGATTGCC GAGCGTGTGA AACGTACCGA AATCAAAGAC

1501 AAGAGCAAAG TGTGGAATAC CGCGCGTATC GAGGCTTTGG AATTGGATAA

1551 CCTAATTGAA GTGGCGAAAG CGACTTTGGT GTCTGCCGAA GCACGTAAAG

1601 AATCACGCGG TGCGCACGCT TCAGACGACC ATCCTGAGCG CGATGATGAA

1651 AACTGGATGA AACATACGCT GTACCATTCA GATGCCAATA CCTTGTCCTA

1701 CAAACCGGTG CACACCAAGC CTTTGAGCGT GGAATACATC AAACCGGCCA

1751 AGCGCGTTTA TTGA
```

This corresponds to the amino acid sequence <SEQ ID 66; ORF 010.a>:

```
a010.pep
  1 MGFPVRKFDA VIVGGGGAGL RAXLQLSKSG LNCAVLSKVF PTRSHTVAAQ

 51 GGISASLGNV QEDRWDWHMY DTVKGSDWLG DQDAIEFMCR AAPEAVIELE

101 HMGMPFDRVE SGKIYQRPFG GHTAEHGKRA VERACAVADR TGHAMLHTLY

151 QQNVRANTQF FVEWTAQDLI RDENGDVVGV TAMEMETGEV YIFHAKAVMF

201 ATGGGGRIYA SSTNAYMNTG DGLGICARAG IPLEDMEFWQ FHPTGVAGAG

251 VLITEGVRGE GGILLNADGE RFMERYAPTV KDLASRDVVS RAMAMEIYEG

301 RGCGKNKDHV LLKIDHIGAE KIMEKLPGIR EISIQFAGID PIKDPIPVVP

351 TTHYMMGGIP TNYHGEVVVP QGDEYEVPVK GLYAAGECAC ASVHGANRLG

401 TNSLLDLVVF GKAAGDSMIK FIKEQSDWKP LPANAGELTR QRIERLDNQT

451 DGENVDALRR ELQRSVQLHA GVFRTDEILS KGVREVMAIA ERVKRTEIKD
```

-continued

```
501  KSKVWNTARI EALELDNLIE VAKATLVSAE ARKESRGAHA SDDHPERDDE

551  NWMKHTLYHS DANTLSYKPV HTKPLSVEYI KPAKRVY*
```

m010/a010 98.7% identity over a 231 aa overlap

```
                                               10        20        30
m010.pep                                 XQLSKSGLNCAVLSKVFPTRSHTVAAQGGISASXGNV
                                          |||||||||||||||||||||||||||||||| |||
a010             MGFPVRKFDAVIVGGGGAGLRAXLQLSKSGLNCAVLSKVFPTRSHTVAAQGGISASLGNV
                         10        20        30        40        50        60

                  40        50        60        70        80        90
m010.pep         QEDRWDWHMYDTVKGSDWLGDQDAIEFMCRAAPEAVIELEHMGMPFDRVESGKIYQRPFG
                 ||||||||||||||||||||||||||||||||||||||||||||||||||||||||||||
a010             QEDRWDWHMYDTVKGSDWLGDQDAIEFMCRAAPEAVIELEHMGMPFDRVESGKIYQRPFG
                         70        80        90       100       110       120

                 100       110       120       130       140       150
m010.pep         GHTAEHGKRAVERXCAVADRTGHAMLHTLYQQNVRANTQFFVEWTAQDLIRDENGDVVGV
                 ||||||||||||| ||||||||||||||||||||||||||||||||||||||||||||||
a010             GHTAEHGKRAVERACAVADRTGHAMLHTLYQQNVRANTQFFVEWTAQDLIRDENGDVVGV
                        130       140       150       160       170       180

                 160       170       180       190       200       210
m010.pep         TAMEMETGEVYIFHAKAVMFATGGGGRIYASSTNAYMNTGDGLGICARAGIPLEDMEFWQ
                 ||||||||||||||||||||||||||||||||||||||||||||||||||||||||||||
a010             TAMEMETGEVYIFHAKAVMFATGGGGRIYASSTNAYMNTGDGLGICARAGIPLEDMEFWQ
                        190       200       210       220       230       240

                 220       230
m010.pep         FQPTGVAGAGVLITE
                 |:|||||||||||||
a010             FHPTGVAGAGVLITEGVRGEGGILLNADGERFMERYAPTVKDLASRDVVSRAMAMEIYEG
                        250       260       270       280       290       300
```

Computer analysis of this amino acid sequence gave the following results:

Homology with a Predicted ORF from *N. gonorrhoeae*

ORF 010 shows 98.7% identity over a 231 aa overlap with a predicted ORF (ORF 010.ng) from *N. gonorrhoeae*:

```
m010.pep/g010.pep

                                               10        20        30
m010.pep                                 XQLSKSGLNCAVLSKVFPTRSHTVAAQGGISASXGNV
                                          |||||||||||||||||||||||||||||||| |||
a010             MGFPVRKFDAVIVGGGGAGLRAXLQLSKSGLNCAVLSKVFPTRSHTVAAQGGISASLGNV
                         10        20        30        40        50        60

                  40        50        60        70        80        90
m010.pep         QEDRWDWHMYDTVKGSDWLGDQDAIEFMCRAAPEAVIELEHMGMPFDRVESGKIYQRPFG
                 ||||||||||||||||||||||||||||||||||||||||||||||||||||||||||||
a010             QEDRWDWHMYDTVKGSDWLGDQDAIEFMCRAAPEAVIELEHMGMPFDRVESGKIYQRPFG
                         70        80        90       100       110       120

                 100       110       120       130       140       150
m010.pep         GHTAEHGKRAVERXCAVADRTGHAMLHTLYQQNVRANTQFFVEWTAQDLIRDENGDVVGV
                 ||||||||||||| ||||||||||||||||||||||||||||||||||||||||||||||
a010             GHTAEHGKRAVERACAVADRTGHAMLHTLYQQNVRANTQFFVEWTAQDLIRDENGDVVGV
                        130       140       150       160       170       180

                 160       170       180       190       200       210
m010.pep         TAMEMETGEVYIFHAKAVMFATGGGGRIYASSTNAYMNTGDGLGICARAGIPLEDMEFWQ
                 ||||||||||||||||||||||||||||||||||||||||||||||||||||||||||||
a010             TAMEMETGEVYIFHAKAVMFATGGGGRIYASSTNAYMNTGDGLGICARAGIPLEDMEFWQ
                        190       200       210       220       230       240

                 220       230
m010.pep         FQPTGVAGAGVLITE
                 |:|||||||||||||
a010             FHPTGVAGAGVLITEGVRGEGGILLNADGERFMERYAPTVKDLASRDVVSRAMAMEIYEG
                        250       260       270       280       290       300
```

The following partial DNA sequence was identified in *N. gonorrhoeae* <SEQ ID 67>:

```
g010-1.seq..
     1 ATGGGTTTTC CTGTTCGCAA GTTTGATGCC GTGATTGTCG GCGGTGGCGG
    51 TGCAGGTTTA CGTGCAGCCC TCCAATTATC CAAATCCGGT TTGAATTGTG
   101 CCGTTTTGTC TAAAGTGTTC CCGACCCGCT CGCATACCGT AGCGGCGCAG
   151 GGCGGTATTT CCGCCTCTCT GGGTAATGTG CAGGAGGACC GTTGGGACTG
   201 GCACATGTAC GATACCGTGA AAGGTTCCGA CTGGCTGGGC GACCAAGATG
   251 CGATTGAGTT TATGTGTCGC GCTGCGCCTG AAGCGGTGAT TGAGTTGGAA
   301 CACATGGGTA TGCCTTTTGA CCGCGTTGAA AGCGGCAAAA TTTATCAGCG
   351 TCCTTTCGGC GGACATACTG CCGAACATGG TAAACGTGCG GTAGAACGTG
   401 CATGTGCGGT TGCCGACCGT ACCGGTCATG CGATGTTGCA TACTTTGTAC
   451 CAACAAAACG TCCGTGCCAA TACACAATTC TTTGTGGAAT GGACGGCGCA
   501 AGATTTGATT CGTGATGAAA ACGGCGATGT CGTCGGCGTA ACCGCCATGG
   551 AAATGGAAAC GGGCGAAGTT TATATTTTCC ACGCCAAGGC CGTGATGTTT
   601 GCTACCGGTG GCGGCGGTCG TATTTATGCT TCTTCTACCA ATGCTTATAT
   651 GAATACCGGT GACGGTTTGG GCATTTGCGC CCGTGCGGGC ATTCCGTTGG
   701 AAGATATGGA ATTCTGGCAA TTCCACCCGA CCGGCGTGGC GGGTGCGGGC
   751 GTGTTGATTA CCGAAGGCGT ACGCGGCGAG GGCGGTATTC TGTTGAACGC
   801 CGACGGCGAA CGCTTTATGG AACGCTATGC GCCGACCGTA AAAGACTTGG
   851 CTTCTCGCGA CGTGGTTTCA CGCGCGATGG CGATGGAAAT CTATGAAGGT
   901 CGCGGCTGTG GTAAAAACAA AGACCACGTC TTACTGAAAA TCGACCATAT
   951 CGGTGCAGAA AAAATTATGG AAAAACTGCC GGGCATCCGC GAGATTTCCA
  1001 TTCAGTTTGC CGGTATCGAT CCGATTAAAG ACCCGATTCC GGTTGTGCCG
  1051 ACTACCCACT ATATGATGGG CGGCATTCCG ACCAATTATC ACGGTGAAGT
  1101 TGTTGTTCCG CAAGGCGACG AGTACGAAGT ACCTGTAAAA GGCCTGTATG
  1151 CCGCAGGTGA GTGCGCCTGT GCTTCCGTAC ACGGTGCGAA CCGTTTGGGT
  1201 ACGAACTCCC TGCTGGACTT GGTGGTGTTC cgcccaaccc cccggtga
```

This corresponds to the amino acid sequence <SEQ ID 68; ORF 010-1.ng>:

```
g010-1.pep
     1  MGFPVRKFDA VIVGGGGAGL RAALQLSKSG LNCAVLSKVF PTRSHTVAAQ
    51  GGISASLGNV QEDRWDWHMY DTVKGSDWLG DQDAIEFMCR AAPEAVIELE
   101  HMGMPFDRVE SGKIYQRPFG GHTAEHGKRA VERACAVADR TGHAMLHTLY
   151  QQNVRANTQF FVEWTAQDLI RDENGDVVGV TAMEMETGEV YIFHAKAVMF
   201  ATGGGGRIYA SSTNAYMNTG DGLGICARAG IPLEDMEFWQ FHPTGVAGAG
   251  VLITEGVRGE GGILLNADGE RFMERYAPTV KDLASRDVVS RAMAMEIYEG
   301  RGCGKNKDHV LLKIDHIGAE KIMEKLPGIR EISIQFAGID PIKDPIPVVP
   351  TTHYMMGGIP TNYHGEVVVP QGDEYEVPVK GLYAAGECAC ASVHGANRLG
   401  TNSLLDLVVF RPTPR*
```

-continued

```
g010-1 (SEQ ID 68)/P10444 (SEQ ID 4158)
sp|P10444|DHSA_ECOLI SUCCINATE DEHYDROGENASE FLAVOPROTEIN SUBUNIT
gnl|PID|d101527.0 (D90711) Succinate dehydrogenase, flavoprotein [Escherichia coli] gi|1786942
(AE000175) succinate dehydrogenase flavoprotein subunit [Escherichia coli] Length = 588
Score = 1073 (495.6 bits), Expect = 6.7e-169, Sum P(2) = 6.7e-169
Identities = 191/303 (63%), Positives = 238/303 (78%)
Query:     1 MGFPVRKFDAVIVXXXXXXXXXXXXXXSKSGLNCAVLSKVFPTRSHTVAAQGGISASLGNV 60
             M  PVR+FDAV++              S+SG  CA+LSKVFPTRSHTV+AQGGI+ +LGN
Sbjct:     1 MKLPVREFDAVVIGAGGAGMRAALQISQSGQTCALLSKVFPTRSHTVSAQGGITVALGNT 60

Query:    61 QEDRWDWHMYDTVKGSDWLGDQDAIEFMCRAAPEAVIELEHMGMPFDRVESGKIYQRPFG 120
              ED W+WHMYDTVKGSD++GDQDAIE+MC+  PEA++ELEHMG+PF R++ G+IYQRPFG
Sbjct:    61 HEDNWEWHMYDTVKGSDYIGDQDAIEYMCKTGPEAILELEHMGLPFSRLDDGRIYQRPFG 120

Query:   121 GHTAEHGKRAVERACAVADRTGHAMLHTLYQQNVRANTQFFVEWTAQDLIRDENGDVVGV 180
             G +   G     R  A ADRTGHA+LHTLYQQN++ +T  F EW A DL+++++G VVG
Sbjct:   121 GQSKNFGGEQAARTAAAADRTGHALLHTLYQQNLKNHTTIFSEWYALDLVKNQDGAVVGC 180

Query:   181 TAMEMETGEVYIFHAKAVMFATGGGGRIYASSTNAYMNTGDGLGICARAGIPLEDMEFWQ 240
             TA+ +ETGEV  F A+A + ATGG GRIY S+TNA++NTGDG+G+  RAG+P++DME WQ
Sbjct:   181 TALCIETGEVVYFKARATVLATGGAGRIYQSTTNAHINTGDGVGMAIRAGVPVQDMEMWQ 240

Query:   241 FHPTGVAGAGVLITEGVRGEGGILLNADGERFMERYAPTVKDLASRDVVSRAMAMEIYEG 300
             FHPTG+AGAGVL+TEG RGEGG LLN  GERFMERYAP  KDLA RDVV+R++ +EI EG
Sbjct:   241 FHPTGIAGAGVLVTEGCRGEGGYLLNKHGERFMERYAPNAKDLAGRDVVARSIMIEIREG 300

Query:   301 RGC 303
             RGC
Sbjct:   301 RGC 303

Score = 249 (115.0 bits), Expect = 6.7e-169, Sum P(2) = 6.7e-169
Identities = 53/102 (51%), Positives = 62/102 (60%)
Query:   309 HVLLKIDHIGAEKIMEKLPGIREISIQFAGXXXXXXXXXXXXTTHYMMGGIPTNYHGEVV 368
             H  LK+DH+G E +  +LPGI E+S  FA             T HYMMGGIPT   G+ +
Sbjct:   310 HAKLKLDHLGKEVLESRLPGILELSRTFAHVDPVKEPIPVIPTCHYMMGGIPTKVTGQAL 369

Query:   369 VPQGDEYEVPVKGLYAAGECACASVHGANRLGTNSLLDLVVF 410
                    +V V GL+A GE AC SVHGANRLG NSLLDLVVF
Sbjct:   370 TVNEKGEDVVVPGLFAVGEIACVSVHGANRLGGNSLLDLVVF 411
```

The following partial DNA sequence was identified in *N. meningitidis* <SEQ ID 69>:

```
m010-1.seg..
     1  ATGGGTTTTC CTGTTCGCAA GTTTGATGCC GTGATTGTCG GCGGTGGTGG

    51  TGCAGGTTTA CGCGCAGCCC TCCAATTATC CAAATCCGGT CTGAATTGTG

   101  CCGTTTTGTC TAAAGTGTTC CCGACCCGTT CGCATACCGT AGCGGCGCAg

   151  GGCGGTATTT CCGCCTCTCT GGGTAATGTG CAGGAAGACC GTTGGGACTG

   201  GCACATGTAC GATACCGTGA AAGGTTCCGA CTGGTTGGGC GACCAAGATG

   251  CGATTGAGTT TATGTGCCGC GCCGCGCCTG AAGCCGTAAT TGAGTTGGAA

   301  CACATGGGTA TGCCTTTTGA CCGTGTGGAA AGCGGTAAAA TTTATCAGCG

   351  TCCTTTCGGC GGCCATACTG CCGAACACGG TAAACGCGCG GTAGAACGCG

   401  CCTGTGCGGT TGCCGACCGT ACAGGTCATG CGATGCTGCA TACTTTGTAC

   451  CAACAAAACG TCCGTGCCAA TACGCAATTC TTTGTGGAAT GGACGGCACA

   501  AGATTTGATT CGTGATGAAA ACGGCGATGT CGTCGGCGTA ACCGCCATGG

   551  AAATGGAAAC CGGCGAAGTT TATATTTTCC ACGCTAAAGC TGTGATGTTT

   601  GCTACCGGCG GCGGCGGTCG TATTTATGCG TCTTCTACCA ATGCCTATAT

   651  GAATACCGGC GATGGTTTGG GTATTTGTGC GCGTGCAGGT ATCCCGTTGG

   701  AAGACATGGA ATTCTGGCAA TTCCACCCGA CCGGCGTGGC GGGTGCGGGC

   751  GTGTTGATTA CCGAAGGCGT ACGCGGCGAG GGCGGTATTC TGTTGAATGC

   801  CGACGGCGAA CGCTTTATGG AACGCTATGC GCCGACCGTA AAAGACTTGG
```

-continued

```
 851  CTTCTCGCGA CGTTGTTTCC CGCGCGATGG CGATGGAAAT CTACGAAGGT

 901  CGCGGCTGCG GTAAAAACAA AGACCATGTC TTACTGAAAA TCGACCATAT

 951  CGGCGCAGAA AAAATTATGG AAAAACTGCC GGGCATCCGC GAGATTTCCA

1001  TTCAGTTCGC CGGTATCGAT CCGATTAAAG ACCCGATTCC CGTTGTGCCG

1051  ACTACCCACT ATATGATGGG CGGCATTCCG ACCAATTACC ACGGCGAAGT

1101  TGTCGTTCCG CAAGGTGAAG ATTACGAAGT GCCTGTAAAA GGTCTGTATG

1151  CGGCAGGTGA GTGCGCTTGT GCTTCCGTAC ACGGTGCGAA CCGCTTGGGT

1201  ACCAATTACC TGTTGGACTT GGTGGTATTC GGTAAAGCTG CCGGCGACAG

1251  CATGATTAAA TTCATCAAAG AGCAAAGCGA CTGGAAACCT TTGCCTGCTA

1301  ATGCAGGTGA GTTGACCCGC CAACGTATCG AGCGTTTGGA CAACCAAACC

1351  GATGGTGAAA ACGTTGATGC ATTGCGTCGC GAACTGCAAC GCTCTGTACA

1401  ACTGCACGCC GGCGTGTTCC GTACTGATGA GATTCTGAGC AAAGGCGTTC

1451  GAGAAGTCAT GGCGATTGCC GAGCGTGTGA AACGTACCGA AATCAAAGAC

1501  AAGAGCAAAG TGTGGAATAC CGCGCGTATC GAGGCTTTGG AATTGGATAA

1551  CCTGATTGAA GTGGCGAAAG CGACTTTGGT GTCTGCCGAA GCACGTAAAG

1601  AATCACGCGG TGCGCACGCT TCAGACGACC ATCCTGAGCG CGATGATGAA

1651  AACTGGATGA AACATACGCT GTACCATTCA GATATCAATA CCTTGTCCTA

1701  CAAACCGGTG CACACCAAGC CTTTGAGCGT GGAATACATC AAACCGGCCA

1751  AGCGCGTTTA TTGATGA
```

This corresponds to the amino acid sequence <SEQ ID 70; ORF 010-1>:

```
m010-1.pep...

      1  MGFPVRKFDA VIVGGGGAGL RAALQLSKSG LNCAVLSKVF PTRSHTVAAQ

     51  GGISASLGNV QEDRWDWHMY DTVKGSDWLG DQDAIEFMCR AAPEAVIELE

    101  HHGMPFDRVE SGKIYQRPFG GHTAEHGKRA VERACAVADR TGHAMLHTLY

    151  QQNVRANTQF FVEWTAQDLI RDENGDVVGV TAMEMETGEV YIFHAKAVMF

    201  ATGGGGRIYA SSTNAYMNTG DGLGICARAG IPLEDMEFWQ FHPTGVAGAG

    251  VLITEGVRGE GGILLNADGE RFMERYAPTV KDLASRDVVS RAMAMEITEG

    301  RGCGKNKDHV LLKIDGIGAE KIMEKLPGIR EISIQFAGID PIKDPIPVVP

    351  TTHYMMGGIP TNYHGEVVVP QGDEYEVPVK GLYAAGECAC ASVHGANRLG

    401  TNSLLDLVVF GKAAGDSMIK FIKEQSDWKP LPANAGELTR QRIERLDNQT

    451  DGENVDALRR ELQRSVQLHA GVFRTDEILS KGVREVMAIA ERVKRTEIKD

    501  KSKVWNTARI EALELDNLIE VAKATLVSAE ARKESRGAHA SDDHPERDDE

    551  NWMKHTLYHS DANTLSYKPV HTKPLSVEYI KPAKRVY*
```

```
m010-1/g010-1  99.5% identity in 410 aa overlap

                       10        20        30        40        50        60
m010-1.pep     MGFPVRKFDAVIVGGGGAGLRAALQLSKSGLNCAVLSKVFPTRSHTVAAQGGISASLGNV
               ||||||||||||||||||||||||||||||||||||||||||||||||||||||||||||
a010-1         MGFPVRKFDAVIVGGGGAGLRAALQLSKSGLNCAVLSKVFPTRSHTVAAQGGISASLGNV
                       10        20        30        40        50        60

                       70        80        90       100       110       120
m010-1.pep     QEDRWDWHMYDTVKGSDWLGDQDAIEFMCRAAPEAVIELEHHGMPFDRVESGKIYQRPFG
               ||||||||||||||||||||||||||||||||||||||||||||||||||||||||||||
g010-1         QEDRWDWHMYDTVKGSDWLGDQDAIEFMCRAAPEAVIELEHHGMPFDRVESGKIYQRPFG
                       70        80        90       100       110       120
```

-continued

```
                           130       140       150       160       170       180
m010-1.pep          GHTAEHGKRAVERACAVADRTGHAMLHTLYQQNVRANTQFFVEWTAQDLIRDENGDVVGV
                    ||||||||||||||||||||||||||||||||||||||||||||||||||||||||||||
g010-1              GHTAEHGKRAVERACAVADRTGHAMLHTLYQQNVRANTQFFVEWTAQDLIRDENGDVVGV
                           130       140       150       160       170       180

                           190       200       210       220       230       240
m010-1.pep          TAMEMETGEVYIFHAKAVMFATGGGGRIYASSTNAYMNTGDGLGICARAGIPLEDMEFWQ
                    ||||||||||||||||||||||||||||||||||||||||||||||||||||||||||||
g010-1              TAMEMETGEVYIFHAKAVMFATGGGGRIYASSTNAYMNTGDGLGICARAGIPLEDMEFWQ
                           190       200       210       220       230       240

                           250       260       270       280       290       300
m010-1.pep          FHPTGVAGAGVLITEGVRGEGGILLNADGERFMERYAPTVKDLASRDVVSRAMAMEIYEG
                    ||||||||||||||||||||||||||||||||||||||||||||||||||||||||||||
g010-1              FHPTGVAGAGVLITEGVRGEGGILLNADGERFMERYAPTVKDLASRDVVSRAMAMEIYEG
                           250       260       270       280       290       300

                           310       320       330       340       350       360
m010-1.pep          RGCGKNKDHVLLKIDHIGAEKIMEKLPGIREISIQFAGIDPIKDPIPVVPTTHYMMGGIP
                    ||||||||||||||||||||||||||||||||||||||||||||||||||||||||||||
g010-1              RGCGKNKDHVLLKIDHIGAEKIMEKLPGIREISIQFAGIDPIKDPIPVVPTTHYMMGGIP
                           310       320       330       340       350       360

                           370       380       390       400       410       420
m010-1.pep          TNYHGEVVVPQGEDYEVPVKGLYAAGECACASVHGANRLGTNSLLDLVVFGKAAGDSMIK
                    ||||||||||||::||||||||||||||||||||||||||||||||||||
g010-1              TNYHGEVVVPQGDEYEVPVKGLYAAGECACASVHGANRLGTNSLLDLVVFRPTPRX
                           370       380       390       400       410

                           430       440       450       460       470       480
m010-1.pep          FIKEQSDWKPLPANAGELTRQRIERLDNQTDGENVDALRRELQRSVQLHAGVFRTDEILS
```

The following partial DNA sequence was identified in *N. meningitidis* <SEQ ID 71>:

```
a010-1.seq..
   1  ATGGGCTTTC CTGTTCGCAA GTTTGATGCC GTGATTGTCG GCGGTGGTGG

  51  TGCAGGTTTA CGCGCANCCC TCCAATTATC CAAATCCGGT CTGAATTGTG

 101  CCGTTTTGTC TAAAGTGTTC CCGACCCGTT CGCATACCGT AGCGGCGCAG

 151  GGCGGTATTT CCGCCTCTCT GGGTAATGTG CAGGAAGACC GTTGGGACTG

 201  GCACATGTAC GATACCGTGA AAGGTTCCGA CTGGTTGGGC GACCAAGATG

 251  CGATTGAGTT TATGTGCCGC GCCGCGCCTG AAGCCGTAAT TGAGTTGGAA

 301  CACATGGGTA TGCCTTTTGA CCGTGTGGAA AGCGGTAAAA TTTATCAGCG

 351  TCCTTTCGGC GGCCATACTG CCGAACACGG TAAACGCGCG GTAGAACGCG

 401  CCTGTGCNGT TGCCGACCGT ACAGGTCATG CGATGCTGCA TACTTTGTAC

 451  CAACAAAATG TCCGTGCCAA TACGCAATTC TTTGTGGAAT GGACGGCACA

 501  AGATTTGATT CGTGATGAAA ACGGCGATGT CGTCGGCGTA ACCGCCATGG

 551  AAATGGAAAC CGGCGAAGTT TATATTTTCC ACGCTAAAGC TGTGATGTTT

 601  GCTACCGGCG GCGGCGGCCG TATTTATGCG TCTTCTACCA ATGCCTATAT

 651  GAATACCGGC GATGGTTTGG GTATTTGTGC GCGTGCAGGT ATCCCGTTGG

 701  AAGACATGGA ATTCTGGCAA TTCCACCCGA CCGGCGTGGC AGGTGCGGGC

 751  GTGTTGATTA CCGAAGGCGT ACGCGGCGAG GGCGGTATTC TGTTGAATGC

 801  CGACGGCGAA CGCTTTATGG AACGCTATGC GCCGACCGTA AAAGACTTGG

 851  CTTCTCGCGA CGTTGTTTCC CGCGCGATGG CGATGGAAAT CTACGAAGGT

 901  CGCGGCTGCG GTAAAAACAA AGACCATGTC TTACTGAAAA TCGACCATAT

 951  CGGCGCAGAA AAAATTATGG AAAAACTGCC GGGCATCCGC GAGATTTCCA

1001  TTCAGTTCGC CGGTATCGAT CCGATTAAAG ACCCGATTCC CGTTGTGCCG

1051  ACTACCCACT ATATGATGGG CGGTATTCCG ACCAACTACC ATGGCGAAGT
```

```
1101 TGTCGTTCCT CAAGGCGACG AATACGAAGT GCCTGTAAAA GGTCTGTATG

1151 CGGCAGGTGA GTGCGCCTGT GCTTCCGTAC ACGGTGCGAA CCGCTTGGGT

1201 ACGAACTCCC TGCTGGACTT AGTGGTATTC GGTAAAGCTG CCGGCGACAG

1251 CATGATTAAA TTCATCAAAG AGCAAAGCGA CTGGAAACCT TTGCCTGCTA

1301 ATGCCGGCGA ACTGACCCGC CAACGTATCG AGCGTTTGGA CAATCAAACT

1351 GATGGTGAAA ACGTTGATGC ATTGCGCCGC GAACTGCAAC GCTCCGTACA

1401 ATTGCACGCC GGCGTGTTCC GTACTGATGA GATTCTGAGC AAAGGCGTTC

1451 GAGAAGTCAT GGCGATTGCC GAGCGTGTGA AACGTACCGA ATCAAAGAC

1501 AAGAGCAAAG TGTGGAATAC CGCGCGTATC GAGGCTTTGG AATTGGATAA

1551 CCTAATTGAA GTGGCGAAAG CGACTTTGGT GTCTGCCGAA GCACGTAAAG

1601 AATCACGCGG TGCGCACGCT TCAGACGACC ATCCTGAGCG CGATGATGAA

1651 AACTGGATGA AACATACGCT GTACCATTCA GATGCCAATA CCTTGTCCTA

1701 CAAACCGGTG CACACCAAGC CTTTGAGCGT GGAATACATC AAACCGGCCA

1751 AGCGCGTTTA TTGA
```

This corresponds to the amino acid sequence <SEQ ID 72; ORF 010-1.a>:

```
a010-1.pep...
    1 MGFPVRKFDA VIVGGGGAGL RAXLQLSKSG LNCAVLSKVF PTRSHTVAAQ
   51 GGISASLGNV QEDRWDWHMY DTVKGSDWLG DQDAIEFMCR AAPEAVIELE
  101 HHGMPFDRVE SGKIYQRPFG GHTAEHGKRA VERACAVADR TGHAMLHTLY
  151 QQNVRANTQF FVEWTAQDLI RDENGDVVGV TAMEMETGEV YIFHAKAVMF
  201 ATGGGGRIYA SSTNAYMNTG DGLGICARAG IPLEDMEFWQ FHPTGVAGAG
  251 VLITEGVRGE GGILLNADGE RFMERYAPTV KDLASRDVVS RAMAMEITEG
  301 RGCGKNKDHV LLKIDGIGAE KIMEKLPGIR EISIQFAGID PIKDPIPVVP
  351 TTHYMMGGIP TNYHGEVVVP QGDEYEVPVK GLYAAGECAC ASVHGANRLG
  401 TNSLLDLVVF GKAAGDSMIK FIKEQSDWKP LPANAGELTR QRIERLDNQT
  451 DGENVDALRR ELQRSVQLHA GVFRTDEILS KGVREVMAIA ERVKRTEIKD
  501 KSKVWNTARI EALELDNLIE VAKATLVSAE ARKESRGAHA SDDHPERDDE
  551 NWMKHTLYHS DANTLSYKPV HTKPLSVEYI KPAKRVY*

m010-1/a010-1  99.3% identity in 587 aa overlap

                    10         20         30         40         50         60
a010-1.pep  MGFPVRKFDAVIVGGGGAGLRAXLQLSKSGLNCAVLSKVFPTRSHTVAAQGGISASLGNV
            |||||||||||||||||||||| |||||||||||||||||||||||||||||||||||||
a010-1      MGFPVRKFDAVIVGGGGAGLRAALQLSKSGLNCAVLSKVFPTRSHTVAAQGGISASLGNV
                    10         20         30         40         50         60

                    70         80         90        100        110        120
a010-1.pep  QEDRWDWHMYDTVKGSDWLGDQDAIEFMCRAAPEAVIELEHMGMPFDRVESGKIYQRPFG
            ||||||||||||||||||||||||||||||||||||||||||||||||||||||||||||
m010-1      QEDRWDWHMYDTVKGSDWLGDQDAIEFMCRAAPEAVIELEHMGMPFDRVESGKIYQRPFG
                    70         80         90        100        110        120

                   130        140        150        160        170        180
a010-1.pep  GHTAEHGKRAVERACAVADRTGHAMLHTLYQQNVRANTQFFVEWTAQDLIRDENGDVVGV
            ||||||||||||||||||||||||||||||||||||||||||||||||||||||||||||
m010-1      GHTAEHGKRAVERACAVADRTGHAMLHTLYQQNVRANTQFFVEWTAQDLIRDENGDVVGV
                   130        140        150        160        170        180
```

-continued

```
                    190        200        210        220        230        240
a010-1.pep    TAMEMETGEVYIFHAKAVMFATGGGGRIYASSTNAYMNTGDGLGICARAGIPLEDMEFWQ
              ||||||||||||||||||||||||||||||||||||||||||||||||||||||||||||
m010-1        TAMEMETGEVYIFHAKAVMFATGGGGRIYASSTNAYMNTGDGLGICARAGIPLEDMEFWQ
                    190        200        210        220        230        240

                    250        260        270        280        290        300
a010-1.pep    FHPTGVAGAGVLITEGVRGEGGILLNADGERFMERYAPTVKDLASRDVVSRAMAMEIYEG
              ||||||||||||||||||||||||||||||||||||||||||||||||||||||||||||
m010-1        FHPTGVAGAGVLITEGVRGEGGILLNADGERFMERYAPTVKDLASRDVVSRAMAMEIYEG
                    250        260        270        280        290        300

                    310        320        330        340        350        360
a010-1.pep    RGCGKNKDHVLLKIDHIGAEKIMEKLPGIREISIQFAGIDPIKDPIPVVPTTHYMMGGIP
              ||||||||||||||||||||||||||||||||||||||||||||||||||||||||||||
m010-1        RGCGKNKDHVLLKIDHIGAEKIMEKLPGIREISIQFAGIDPIKDPIPVVPTTHYMMGGIP
                    310        320        330        340        350        360

                    370        380        390        400        410        420
a010-1.pep    TNYHGEVVVPQGDEYEVPVKGLYAAGECACASVHGANRLGTNSLLDLVVFGKAAGDSMIK
              ||||||||||||::||||||||||||||||||||||||||||||||||||||||||||||
m010-1        TNYHGEVVVPQGEDYEVPVKGLYAAGECACASVHGANRLGTNSLLDLVVFGKAAGDSMIK
                    370        380        390        400        410        420

                    430        440        450        460        470        480
a010-1.pep    FIKEQSDWKPLPANAGELTRQRIERLDNQTDGENVDALRRELQRSVQLHAGVFRTDEILS
              ||||||||||||||||||||||||||||||||||||||||||||||||||||||||||||
m010-1        FIKEQSDWKPLPANAGELTRQRIERLDNQTDGENVDALRRELQRSVQLHAGVFRTDEILS
                    430        440        450        460        470        480

                    490        500        510        520        530        540
a010-1.pep    KGVREVMAIAERVKRTEIKDKSKVWNTARIEALELDNLIEVAKATLVSAEARKESRGAHA
              ||||||||||||||||||||||||||||||||||||||||||||||||||||||||||||
m010-1        KGVREVMAIAERVKRTEIKDKSKVWNTARIEALELDNLIEVAKATLVSAEARKESRGAHA
                    490        500        510        520        530        540

                    550        560        570        580
a010-1.pep    SDDHPERDDENWMKHTLYHSDANTLSYKPVHTKPLSVEYIKPAKRVYX
              |||||||||||||||||||| ||||||||||||||||||||||||||
m010-1        SDDHPERDDENWMKHTLYHSDINTLSYKPVHTKPLSVEYIKPAKRVYX
                    550        560        570        580
```

The following partial DNA sequence was identified in *N. gonorrhoeae* <SEQ ID 73>:

```
g011.seq
     1  ATGAAGACAC ACCGCAAGAC CTGCTCTGCG GTGTGTTTTG CTTTTCAGAC

    51  GGCATCGAAA CCCGCCGTTT CCATCCGACA TCCCAGCGAG GACATCATGA

   101  GCCTGAAAAC CCGCCTTACC GAAGATATGA AAACCGCGAT GCGCGCCAAA

   151  GATCAAGTTT CCCTCGGCAC CATCCGCCTC ATCAATGCCG CCGTCAAACA

   201  GTTTGAAGTA GACGAACGCA CCGAAGCCGA CGATGCCAAA ATCACCGCCA

   251  TCCTGACCAA AATGGTCAAA CAGCGCAAAG ACGGCGCGAA AATCTACACT

   301  GAAGCCGGCC GTCAGGATTT GGCAGACAAA GAAAACGCCG AAATCGACGT

   351  GCTGCACCGC TACCTGCCGC AAATGCTCTC CGCCGGCGAA ATCCGCACCG

   401  CCGTCGAAGC AGCCGTTGCC GAAACCGGCG CGGCAGGTAT GGCGGATATG

   451  GGCAAAGTGA TGGTCGTATT GAAAAcccGC CTCGCCGGCA AAGccgATAT

   501  GGGCGAAGTC AACAAAATCT TGAAAAccGt aCTGACCGCC tga
```

This corresponds to the amino acid sequence <SEQ ID 74; ORF 011.ng>:

```
g011.pepr
     1  MKTHRKTCSA VCFAFQTASK PAVSIRHPSE DIMSLKTRLT EDMKTAMRAK


    51  DQVSLGTIRL INAAVKQFEV DERTEADDAK ITAILTKMVK QRKDGAKIYT
```

-continued

```
101  EAGRQDLADK ENAEIDVLHR YLPQMLSAGE IRTAVEAAVA ETGAAGMADM

151  GKVMVVLKTR LAGKADMGEV NKILKTVLTA *
```

The following partial DNA sequence was identified in *N. meningitidis* <SEQ ID 75>:

```
m011.seq (partial)
  1  ATGAGGACAC ACCGCAAGAC CTGCTCTGCG GTGTGTTTTG CTTTTCAGAC

 51  GGCATCGAAA CCCGCCGTTT CCATCCGACA TCCCAGCGAG GACATCATGA

101  GCCTGAAAAT CCGCCTTACC GAAGACATGA AAACCGCGAT GCGCGCCAAA

151  GACCAAGTTT CCCTCGGCAC CATCCGCCTC ATCAACGCCG CCGTCAAACA

201  GTTTGAAGTG GACGAACGCA CCGAAGCCGA CGATGCCAAA ATCACCGCCA

251  TCCTGACCAA AATGGTCAAA CAGCGAAAAG ACAGCGCGAA AATCTACACT

301  GAAGCCGGCC GTCAGGATTT GGCAGACAAA GAAAACGCCG AAATCGAGGT

351  ACTGCACCGC TACCTTCCCC AAATGCTTTC CGCCGGCGAA ATCCGTACCG

401  AGGTCGAAGC TGCCGTTGCC GAAACCGGCG CGGCAGGTAT GGCGGATATG

451  GGTAAAGTCA TGGGGCTGCT GAAAACCCGC CTCGCAGGTA AAGCCGA...
```

This corresponds to the amino acid sequence <SEQ ID 76; ORF 011>:

```
m011.pep (partial)
  1  MRTHRKTCSA VCFAFQTASK PAVSIRHPSE DIMSLKIRLT EDMKTAMRAK

 51  DQVSLGTIRL INAAVKQFEV DERTEADDAK ITAILTKMVK QRKDSAKIYT

101  EAGRQDLADK ENAEIEVLHR YLPQMLSAGE IRTEVEAAVA ETGAAGMADM

151  GKVMGLLKTR LAGKA.....
```

Computer analysis of this amino acid sequence gave the following results:

Homology with a Predicted ORF from *N. gonorrhoeae*

ORF 011 shows 95.8% identity over a 165 aa overlap with a predicted ORF (ORF 011.ng) from *N. gonorrhoeae*:

```
m011/g011

                   10        20        30        40        50        60
m011.pep    MRTHRKTCSAVCFAFQTASKPAVSIRHPSEDIMSLKIRLTEDMKTAMRAKDQVSLGTIRL
            |:|||||||||||||||||||||||||||||||||| |||||||||||||||||||||||
g011        MKTHRKTCSAVCFAFQTASKPAVSIRHPSEDIMSLKTRLTEDMKTAMRAKDQVSLGTIRL
                   10        20        30        40        50        60

                   70        80        90       100       110       120
m011.pep    INAAVKQFEVDERTEADDAKITAILTKMVKQRKDSAKIYTEAGRQDLADKENAEIEVLHR
            ||||||||||||||||||||||||||||||||||:|||||||||||||||||||||:||||
g011        INAAVKQFEVDERTEADDAKITAILTKMVKQRKDGAKIYTEAGRQDLADKENAEIDVLHR
                   70        80        90       100       110       120

                  130       140       150       160
m011.pep    YLPQMLSAGEIRTEVEAAVAETGAAGMADMGKVMGLLKTRLAGKA
            |||||||||||| ||||||||||||||||||||| :|||||||||
g011        YLPQMLSAGEIRTAVEAAVAETGAAGMADMGKVMVVLKTRLAGKADMGEVNKILKTVLTA
                  130       140       150       160       170       180

g011        X
```

The following partial DNA sequence was identified in *N. gonorrhoeae* <SEQ ID 77>:

```
g012.seq
  1 ATGCTCGCCC GTCGCTATTT TTTCAATATC CAACCCGGGG CGGTTTTCAC
 51 TGACAAACTG CTTGAACAAC TGATGCGTTT CCTCCAGTTC CTGCCGGAAT
101 TTCTGTTTGC CCTTTTCCGT ATTTTCACCC ATAAAAGTAA CCGTGCGCTT
151 AAATTCGCCC GCCGTCATCA CATCCACATC AATATCATGT TTTTTCAACa
201 gGcggTGGAT ATTCGgcact tccgCcacca cacccaccga accgatgacc
251 gcaaacggaG CGGAAACAAT TTTATCCGCc acacacgcca tcatatagcc
301 gcCGCTTGCC GCGACCTTAT CGAcggcgac ggTCAGCGGA ATATTGCGTT
351 CGCGCAAACG CCTAAGCTGC GAAGCCGCCA AACCGTAACC GTGAACCACG
401 CCGCCCGGAC TTTCCAATCT GAGCAGAACC TCATCTTCAG GCTTGGCAAT
451 CAAAAGCACC GCCGTAATCT CATGACGCAA GGATTCTACG GCGTGTGCAT
501 ACAAATCGCC GTCAAAATCC AACACAAAAA GGCGGGATTT TTGCGTTTCG
551 GCAGATTTCT CCCCGCCCTC CTTCAAACGC TTTTTCTCTG CTTTGGCTTC
601 CGCCTTTTCC TTTTTCTTTT CTTTTTTTTC CTGATGTTTT GTCTCTTCCT
651 CGCTTAA
```

This corresponds to the amino acid sequence <SEQ ID 78; ORF 012.ng>:

```
g012.pep
  1 MLARRYFFNI QPGAVFTDKL LEQLMRFLQF LPEFLFALFR IFTHKSNRAL
 51 KFARRHHIHI NIMFFQQAVD IRHFRHHTHR TDDRKRSGNN FIRHTRHHIA
101 AACRDLIDGD GQRNIAFAQT PKLRSRQTVT VNHAARTFQS EQNLIFRLGN
151 QKHRRNLMTQ GFYGVCIQIA VKIQHKKAGF LRFGRFLPAL LQTLFLCFGF
201 RLFLFLFFFF LMFCLFLA*
```

The following partial DNA sequence was identified in *N. meningitidis* <SEQ ID 79>:

```
m012.seq
  1 ATGCTCGCCC GTTGCCACTT CCTCAATATC CAATTGAGGG CGGTTCTCGC
 51 TGACAAACTG CTTGAACAAC TGATGCGTTT CCTCCAGTTC CTGTCGGAAT
101 TTCTGTTTGC CCTTTTCCGT ATTTTCACCC ATAAAAGTAA CCGTGCGCTT
151 AAATTCGCCC GCCGTCATCA CATCCACATC AATATCATGT TTTTTCAACA
201 GGCGGTGGAT ATTCGGTACT TCCGCCACCA CACCCACCGA ACCGACAATC
251 GCAAACGGAG CGGAAGCAAT TTTATCCGCC ACACACGCCA TCATATAACC
301 GCCGCTCGCn nnnnnnnnnn nnnnnnnnnn nnnnnnnnnn nnnnnnnnnn
351 nnnnnnnnnn nnnnnnnnnn nnnnnnnnnn nnnnnnnnnn nnnnnnnnnn
401 nnnnnnnnnn nnnnnnnnnn nnnnnnnnnn nnnnnnnnnn nnnnnnnnnn
451 nnnnnnnnnn nnnnnnnnnn nnnnnnnnnn nnnnnnnnnn nnnnnnnnnn
501 nnnnnnnnnn nnnnnnnnnC AACACAAAAA GGCGTGATTT nTGCGTTTCG
551 GCAGATTTCT CCCCACCCTC CTTCAAACGT TTTTCcTCTG CTTTGGCTTC
```

-continued

```
601  CGCCTTTTCC TTTTTCTTTT CCTCTTTTTC CTGATGTTGT GCCTCTTCCC

651  CGCTTAA
```

This corresponds to the amino acid sequence <SEQ ID 80; ORF 012>:

```
m012.pep
  1  MLARCHFLNI QLRAVLADKL LEQLMRFLQF LSEFLFALFR IFTHKSNRAL

 51  KFARRHHIHI NIMFFQQAVD IRYFRHHTHR TDNRKRSGSN FIRHTRHHIT

101  AARXXXXXXX XXXXXXXXXX XXXXXXXXXX XXXXXXXXXX XXXXXXXXXX

151  XXXXXXXXXX XXXXXXXXXX XXXQHKKA*F XRFGRFLPTL LQTFFLCFGF

201  RLFLFLFLFF LMLCLFPA*
```

The following partial DNA sequence was identified in *N. meningitidis* <SEQ ID 81>:

```
a012.seq
  1  ATGCTCGCCC GTTGCCACTT CCTCAATATC CAATTGAGGG CGGTTCTCGC

 51  TGACAAACTG CTTGAACAAC TGATGCGTTT CCTCCAGTTC CTGTCGGAAT

101  TTCTGTTTGC CCTTTTCCGT ATTTTCACCC ATAAAAGTAA CCGTGCGCTT

151  AAATTCGCCC GCCGTCATCA CATCCACATC AATATCATGT TTTTTCAACA

201  GGCGGTGGAT ATTCGGTACT TCCGCTACAA CACCCACCGA ACCGACAATC

251  GCAAACGGAG CGGAAACAAT TTTATCCGCC ACACACGCCA TCATATAACC

301  ACCGCTCGCC GCCACCTTAT CGACGGCGAC GGTCAGCGGA ATATTGCGTT

351  CGCGCAAACG CCTAAGCTGC GAAGCCGCCA AACCGTAACC GTGAACCACG

401  CCGCCCGGAC TTTCCAATCT AAGCAGAACC TCATCTTCAG GCTTGGCAAT

451  CAAAAGCACC GCCGTAATCT CATGACGCAA GGATTCTACG GCGTGTGCAT

501  ACAAATCGCC GTCAAAATCC AACACAAAAA GGCGGGATTT TTGCGTTTCG

551  GAAGATTTCT CCCCACCCTC CTTCAAACGC TTTTTCTCTG CTTTGGCTTC

601  CGCCTTTTCC TTTTTCTTTT CCTCTTTTTC CTGATGTTTT GCCTCTTCCC

651  CGCTTAA
```

This corresponds to the amino acid sequence <SEQ ID 82; ORF 012.a>:

```
a012.pep.
  1  MLARCHFLNI QLRAVLADKL LEQLMRFLQF LSEFLFALFR IFTHKSNRAL

 51  KFARRHHIHI NIMFFQQAVD IRYFRYNTHR TDNRKRSGNN FIRHTRHHIT

101  TARRHLIDGD GQRNIAFAQT PKLRSRQTVT VNHAARTFQS KQNLIFRLGN

151  QKHRRNLMTQ GFYGVCIQIA VKIQHKKAGF LRFGRFLPTL LQTLFLCFGF

201  RLFLFLFLFF LMFCLFPA*
```

m012/a012 64.2% identity over a 218 aa overlap

```
                      10         20         30         40         50         60
m012.pep     MLARCHFLNIQLRAVLADKLLEQLMRFLQFLSEFLFALFRIFTHKSNRALKFARRHHIHI
             ||||||||||||||||||||||||||||||||||||||||||||||||||||||||||||
a012         MLARCHFLNIQLRAVLADKLLEQLMRFLQFLSEFLFALFRIFTHKSNRALKFARRHHIHI
                      10         20         30         40         50         60
```

-continued

```
                   70        80        90       100       110       120
m012.pep    NIMFFQQAVDIRYFRHHTHRTDNRKRSGSNFIRHTRHHITAARXXXXXXXXXXXXXXXXX
            |||||||||||||||::|||||||||||:|||||||||||:||                :
a012        NIMFFQQAVDIRYFRYNTHRTDNRKRSGNNFIRHTRHHITTARRHLIDGDGQRNIAFAQT
                   70        80        90       100       110       120

                  130       140       150       160       170       180
m012.pep    XXXXXXXXXXXXXXXXXXXXXXXXXXXXXXXXXXXXXXXXXXXXXXXXXXXXXXXQHKKAXF
                   : :      :                     :               ||||| |
a012        PKLRSRQTVTVNHAARTFQSKQNLIFRLGNQKHRRNLMTQGFYGVCIQIAVKIQHKKAGF
                  130       140       150       160       170       180

                  190       200       210      200
m012.pep    XRFGRFLPTLLQTFFLCFGFRLFLFLFLFFLMLCLFPAX
             ||||||||||||:||||||||||||||||||:||||||
a012        LRFGRFLPTLLQTLFLCFGFRLFLFLFLFFLMFCLFPAX
                  190       200       210
```

Computer analysis of this amino acid sequence gave the following results:

Homology with a Predicted ORF from *N. gonorrhoeae*

ORF 012 shows 58.7% identity over a 218 aa overlap with a predicted ORF (ORF 012.ng) from *N. gonorrhoeae*:

```
m012/g012

                   10        20        30        40        50        60
m012.pep    MLARCHFLNIQLRAVLADKLLEQLMRFLQFLSEFLFALFRIFTHKSNRALKFARRHHIHI
            |||| :|:|||  ||::|||||||||||||| ||||||||||||||||||||||||||||
g012        MLARRYFFNIQPGAVFTDKLLEQLMRFLQFLPEFLFALFRIFTHKSNRALKFARRHHIHI
                   10        20        30        40        50        60

                   70        80        90       100       110       120
m012.pep    NIMFFQQAVDIRYFRHHTHRTDNRKRSGSNFIRHTRHHITAARXXXXXXXXXXXXXXXXX
            ||||||||||||:|||||||||:|||||:||||||||||:||                 :
g012        NIMFFQQAVDIRHFRHHTHRTDDRKRSGNNFIRHTRHHIAAACRDLIDGDGQRNIAFAQT
                   70        80        90       100       110       120
                  130       140       150       160       170       180
m012.pep    XXXXXXXXXXXXXXXXXXXXXXXXXXXXXXXXXXXXXXXXXXXXXXXXXXXXXXXQHKKAXF
                   : :      :                     :               ||||| |
g012        PKLRSRQTVTVNHAARTFQSEQNLIFRLGNQKHRRNLMTQGFYGVCIQIAVKIQHKKAGF
                  130       140       150       160       170       180
                  190       200       210      219
m012.pep    XRFGRFLPTLLQTFFLCFGFRLFLFLFLFFLMLCLFPAX
             |||||||:||||:|||||||||||||:||||:||| ||
g012        LRFGRFLPALLQTLFLCFGFRLFLFLFFFFLMFCLFLAX
                  190       200       210
```

The following partial DNA sequence was identified in *N. meningitidis* <SEQ ID 83>:

```
m012-1.seq
  1 ATGCTCGCCC GTTGCCACTT CCTCAATATC CAATTGAGGG CGGTTCTCGC

 51 TGACAAACTG CTTGAACAAC TGATGCGTTT CCTCCAGTTC CTGTCGGAAT

101 TTCTGTTTGC CCTTTTCCGT ATTTTCACCC ATAAAAGTAA CCGTGCGCTT

151 AAATTCGCCC GCCGTCATCA CATCCACATC AATATCATGT TTTTTCAACA

201 GGCGGTGGAT ATTCGGTACT TCCGCCACCA CACCCACCGA ACCGACAATC

251 GCAAACGGAG CGGAAGCAAT TTTATCCGCC ACACACGCCA TCATATAACC

301 GCCGCTCGCC GCCACCTTAT CGACGGCGAC GGTCAGCGGA ATATTGCGTT

351 CGCGCAAACG CyTAAGCTGC GAAGCCGCCA AACCGTAACC GTGAACCACG

401 CCGCCCGGAC TTTCCAATCT GAGCAGAACC TCATCTTCAG GCTTGGCAAT

451 CAAAAGCACC GCCGTAATCT CATGACGCAA GGATTCTACG GCGTGTGCAT

501 ACAAATCGCC GTCAAAATCC AACACAAAAA GGCGGGATTT TTGCGTTTCG
```

-continued

```
551 GCAGATTTCT CCCCACCCTC CTTCAAACGC TTTTTCTCTG CTTTGGCTTC

601 CGCCTTTTCC TTTTTCTTTT CCTCTTTTTC CTGATGTTTT GCCTCTTCCC

651 CGCTTAA
```

This corresponds to the amino acid sequence <SEQ ID 84; ORF 012-1>:

```
m012-1.pep

      1 MLARCHFLNI QLRAVLADKL LEQLMRFLQF LSEFLFALFR IFTHKSNRAL

     51 KFARRHHIHI NIMFFQQAVD IRYFRHHTHR TDNRKRSGSN FIRHTRHHIT

    101 AARRHLIDGD GQRNIAFAQT XKLRSRQTVT VNHAARTFQS EQNLIFRLGN

    151 QKHRRNLMTQ GFYGVCIQIA VKIQHKKAGF LRFGRFLPTL LQTLFLCFGF

    201 RLFLFLFLFF LMFCLFPA*

m012-1/g012 91.7% identity in 218 aa overlap

                    10        20        30        40        50        60
m012-1.pep MLARCHFLNIQLRAVLADKLLEQLMRFLQFLSEFLFALFRIFTHKSNRALKFARRHHIHI
           |||| :|:|||  ||::|||||||||||||| ||||||||||||||||||||||||||||
g012       MLARRYFFNIQPGAVFTDKLLEQLMRFLQFLPEFLFALFRIFTHKSNRALKFARRHHIHI
                    10        20        30        40        50        60

                    70        80        90       100       110       120
m012-1.pep NIMFFQQAVDIRYFRHHTHRTDNRKRSGSNFIRHTRHHITAARRHLIDGDGQRNIAFAQT
           ||||||||||||:|||||||||:|||||:||||||||||:|| | |||||||||||||||
g012       NIMFFQQAVDIRHFRHHTHRTDDRKRSGNNFIRHTRHHIAAACRDLIDGDGQRNIAFAQT
                    70        80        90       100       110       120

                   130       140       150       160       170       180
m012-1.pep XKLRSRQTVTVNHAARTFQSEQNLIFRLGNQKHRRNLMTQGFYGVCIQIAVKIQHKKAGF
            |||||||||||||||||||||||||||||||||||||||||||||||||||||||||||
g012       PKLRSRQTVTVNHAARTFQSEQNLIFRLGNQKHRRNLMTQGFYGVCIQIAVKIQHKKAGF
                   130       140       150       160       170       180

                   190       200       210      219
m012-1.pep LRFGRFLPTLLQTLFLCFGFRLFLFLFLFFLMFCLFPAX
           ||||||||:||||||||||||||||||:|||||||| ||
g012       LRFGRFLPALLQTLFLCFGFRLFLFLFFFFLMFCLFLAX
                   190       200       210
```

The following partial DNA sequence was identified in *N. meningitidis* <SEQ ID 85>:

```
a012-1.seq
  1 ATGCTCGCCC GTTGCCACTT CCTCAATATC CAATTGAGGG CGGTTCTCGC

 51 TGACAAACTG CTTGAACAAC TGATGCGTTT CCTCCAGTTC CTGTCGGAAT

101 TTCTGTTTGC CCTTTTCCGT ATTTTCACCC ATAAAAGTAA CCGTGCGCTT

151 AAATTCGCCC GCCGTCATCA CATCCACATC AATATCATGT TTTTTCAACA

201 GGCGGTGGAT ATTCGGTACT TCCGCTACAA CACCCACCGA ACCGACAATC

251 GCAAACGGAG CGGAAACAAT TTTATCCGCC ACACACGCCA TCATATAACC

301 ACCGCTCGCC GCCACCTTAT CGACGGCGAC GGTCAGCGGA ATATTGCGTT

351 CGCGCAAACG CCTAAGCTGC GAAGCCGCCA AACCGTAACC GTGAACCACG

401 CCGCCCGGAC TTTCCAATCT AAGCAGAACC TCATCTTCAG GCTTGGCAAT

451 CAAAAGCACC GCCGTAATCT CATGACGCAA GGATTCTACG GCGTGTGCAT

501 ACAAATCGCC GTCAAAATCC AACACAAAAA GGCGGGATTT TTGCGTTTCG

551 GAAGATTTCT CCCCACCCTC CTTCAAACGC TTTTTCTCTG CTTTGGCTTC
```

-continued

```
601 CGCCTTTTCC TTTTTCTTTT CCTCTTTTTC CTGATGTTTT GCCTCTTCCC

651 CGCTTAA
```

This corresponds to the amino acid sequence <SEQ ID 86; ORF 012-1.a>:

```
a012-1.pep
      1 MLARCHFLNI QLRAVLADKL LEQLMRFLQF LSEFLFALFR IFTHKSNRAL

     51 KFARRHHIHI NIMFFQQAVD IRYFRYNTHR TDNRKRSGNN FIRHTRHHIT

    101 TARRHLIDGD GQRNIAFAQT PKLRSRQTVT VNHAARTFQS KQNLIFRLGN

    151 QKHRRNLMTQ GFYGVCIQIA VKIQHKKAGF LRFGRFLPTL LQTLFLCFGF

    201 RLFLFLFLFF LMFCLFPA*
```

```
a012-1/m012-1 97.2% identity in 218 aa overlap

                    10        20        30        40        50        60
a012-1.pep MLARCHFLNIQLRAVLADKLLEQLMRFLQFLSEFLFALFRIFTHKSNRALKFARRHHIHI
           ||||||||||||||||||||||||||||||||||||||||||||||||||||||||||||
m012-1     MLARCHFLNIQLRAVLADKLLEQLMRFLQFLSEFLFALFRIFTHKSNRALKFARRHHIHI
                    10        20        30        40        50        60

                    70        80        90       100       110       120
a012-1.pep NIMFFQQAVDIRYFRYNTHRTDNRKRSGNNFIRHTRHHITTARRHLIDGDGQRNIAFAQT
           ||||||||||||||||::||||||||||:|||||||||||:|||||||||||||||||||
m012-1     NIMFFQQAVDIRYFRHHTHRTDNRKRSGSNFIRHTRHHITAARRHLIDGDGQRNIAFAQT
                    70        80        90       100       110       120

                   130       140       150       160       170       180
a012-1.pep PKLRSRQTVTVNHAARTFQSKQNLIFRLGNQKHRRNLMTQGFYGVCIQIAVKIQHKKAGF
            |||||||||||||||||||:|||||||||||||||||||||||||||||||||||||||
m012-1     XKLRSRQTVTVNHAARTFQSEQNLIFRLGNQKHRRNLMTQGFYGVCIQIAVKIQHKKAGF
                   130       140       150       160       170       180

                   190       200       210      219
a012-1.pep LRFGRFLPTLLQTLFLCFGFRLFLFLFLFFLMFCLFPAX
           ||||||||||||||||||||||||||||||||||||||
m012-1     LRFGRFLPTLLQTLFLCFGFRLFLFLFLFFLMFCLFPAX
                   190       200       210
```

The following partial DNA sequence was identified in *N. gonorrhoeae* <SEQ ID 87>:

```
g013.seq
  1 aTgcctttga ccatgctgtg cagcaGGAcg tGCGGTTtgt tcataataca

 51 gtCcgaccGG AAAagcggAG GAAaCGCAGT GCCGCGCCCT TCCCCTTTCT

101 TGCCGTGGCA GGCGATGCag tTgGATTCGT ACACTTTTTG CCCTTTtGtc

151 atgatGCTgt tgtcggCGGC AGAAGCgGCG GcgCAGAGGC AGCACAAGAT

201 GAAGGCGGTC GGCAGTCGGG TTGTGTtcat tGgcgTTTCC cctaatgttt

251 tgaaaccttg ttttttgatt Ttgcctttac ggggtgaaaa gtttttTtgg

301 cccaaatccg gaatttag
```

This corresponds to the amino acid sequence <SEQ ID 88; ORF 013.ng:

```
g013.pep
  1 MPLTMLCSRT CGLFIIQSDR KSGGNAVPRP SPFLPWQAMQ LDSYTFCPFV

 51 MMLLSAAEAA AQRQHKMKAV GSRVVFIGVS PNVLKPCFLI LPLRGEKFFW

101 PKSGI*
```

The following partial DNA sequence was identified in *N. meningitidis* <SEQ ID 89>:

```
m013.seq
   1 ATGCCTTTGA CCATGCTGTG CAGCAGCACC TGCGGTTTTT TCATGATGAA

  51 GTCGGAGCGG TAGAGCGGCG GAAACATGGT TCCGCGGCCT TCGCCCTTTT

 101 TGCCGTGGCA GGCGACGCAG TTGGATTCGT ACACTTTTTG CCCTTTTGTC

 151 ATGATGCTGT TGTCGGCGGC AGAAGCGGCG GCGCAGAAGC AGCCCAAGAC

 201 GAGGGCGGTC GGCAGTCGGG TTGTGTTCAT TGGTGTTTCC TTCATGTTTG

 251 AAACCTTGTT GTTGATTTTG CGTAGCGGGT GAAAGATTTT TTTGCCGAAT

 301 CAGTAG
```

This corresponds to the amino acid sequence <SEQ ID 90; ORF 013>:

```
m013.pep
   1 MPLTMLCSST CGFFMMKSER XSGGNMVPRP SPFLPWQATQ LDSYTFCPFV

  51 MMLLSAAEAA AQKQPKTRAV GSRVVFIGVS FMFETLLLIL RSGXKIFLPN

 101 Q*
```

The following partial DNA sequence was identified in *N. meningitidis* <SEQ ID 91>:

```
a013.seq
   1 ATGCCTTTGA CCATGCTGTG CAGCAGCACC TGCGGTTTTT TCATGATGAA

  51 GTCGGAGCGG TAGAGCGGCG GAAACATGGT TCCGCGGCCT TCGCCCTTTT

 101 TGCCGTGGCA GGCGACGCAG TTGGATTCGT ACACTTTTTG CCCTTTTGTC

 151 ATGATGCTGT TGTCGGCGGC AGAAGCGGCG GCGCAGAGGC AGCCCAAGAC

 201 GAGGGCGGTC GGCAGTCGGG TTGTGTTCAT TGGTGTTTCC TTAATGTTTG

 251 AAACCTTGTT GTTGATTTTG CGTAGCGGGT GAAAGATTTT CTTGCCGAAT

 301 CGGTAG
```

This corresponds to the amino acid sequence <SEQ ID 92; ORF 013.a>:

```
a013.pep
   1 MPLTMLCSST CGFFMMKSER *SGGNMVPRP SPFLPWQATQ LDSYTFCPFV

  51 MMLLSAAEAA AQRQPKTRAV GSRVVFIGVS LMFETLLLIL RSG*KIFLPN

 101 R*
```

m013/a013 97.0% identity over a 101 aa overlap

```
                    10        20        30        40        50        60
m013.pep    MPLTMLCSSTCGFFMMKSERXSGGNMVPRPSPFLPWQATQLDSYTFCPFVMMLLSAAEAA
            ||||||||||||||||||||||||||||||||||||||||||||||||||||||||||||
a013        MPLTMLCSSTCGFFMMKSERXSGGNMVPRPSPFLPWQATQLDSYTFCPFVMMLLSAAEAA
                    10        20        30        40        50        60

                    70        80        90       100
m013.pep    AQKQPKTRAVGSRVVFIGVSFMFETLLLILRSGXKIFLPNQX
            ||:|||||||||||||||||:||||||||||||||||||:|
a013        AQRQPKTRAVGSRVVFIGVSLMFETLLLILRSGXKIFLPNRX
                    70        80        90       100
```

Computer analysis of this amino acid sequence gave the following results:

Homology with a Predicted ORF from *N. gonorrhoeae*

ORF 013 shows 73.3% identity over a 101 aa overlap with a predicted ORF (ORF 013.ng) from *N. gonorrhoeae*:

```
m013/g013

                   10        20        30        40        50        60
m013.pep  MPLTMLCSSTCGFFMMKSERXSGGNMVPRPSPFLPWQATQLDSYTFCPFVMMLLSAAEAA
          |||||||| |||:|:::|:| |||| |||||||||||| |||||||||||||||||||||
g013      MPLTMLCSRTCGLFIIQSDRKSGGNAVPRPSPFLPWQAMQLDSYTFCPFVMMLLSAAEAA
                   10        20        30        40        50        60

                   70        80         90       100
m013.pep  AQKQPKTRAVGSRVVFIGVSF-MFETLLLILR-SGXKIFLPNQX
          ||:| | :||||||||||||  :::  :|||   | |:| |:
g013      AQRQHKMKAVGSRVVFIGVSPNVLKPCFLILPLRGEKFFWPKSGIX
                   70        80        90       100
```

The following partial DNA sequence was identified in *N. gonorrhoeae* <SEQ ID 93>:

```
g015.seq
  1 ATGCAGTATC TGATTGTCAA ATACAGCCAT CAAATCTTCG TTACCATCAC

 51 CATTTTGGTA TTCAACATCC GTTTTTTCCT ACTTTGGAAA AATCCAGAAA

101 AGCCCTTGGT CGGCTTTTGG AAAGCACTGC CCCACCTCAA CGACACGATG

151 CTGCTGTTTA CGGGATTGTG GCTGATGAAG ATTACCCATT TCTCCCCGTT

201 CAACGCGCCT TGGCTCGGCA CAAAAATCCT GCTCCTGTTC GCCTACATCG

251 CACTGGGCAT GGTAATGATG CGCGCCCGTC CGCGTTCGAC CAAGTTCTAC

301 ACCGTTTACC TGCTCGCTAT GTGTTGCATC GCCTGCATCG TTTACCTTGC

351 CAAAACCAAA GTCCTGCCAT TCTGA
```

This corresponds to the amino acid sequence <SEQ ID 94; ORF 015.ng>:

```
g015.pep
  1 MQYLIVKYSH QIFVTITILV FNIRFFLLWK NPEKPLVGFW KALPHLNDTM

 51 LLFTGLWLMK ITHFSPFNAP WLGTKILLLF AYIALGMVMM RARPRSTKFY

101 TVYLLAMCCI ACIVYLAKTK VLPF*
```

The following partial DNA sequence was identified in *N. meningitidis* <SEQ ID 95>:

```
m015.seq (partial)
  1 . . . AAAATCAGAA AAGCCTTGGC GGGCTTTTGG AAGGCACTGC CCCACCTTAA

 51       CGACACCAT GCTGCTGTTTA CGGGATTGTG GCTGATGAAA ATTACCCATT

101       TCTCCCCGT TCAACGCGCCT TGGCTCGGTA CAAAAATCCT GCTTCTGCTC

151       GCCTATATC GCATTGGGTAT GATGATGATG CGCGCCCGTC CGCGTTCGAC

201       CAAGTTCTA CACCGTTTACC TGCTCGCCAT GTGTTGCGTC GCCTGCATCG

251       TTTACCTTG CCAAAACCAAA GTCCTGCCTT TCTGA
```

This corresponds to the amino acid sequence <SEQ ID 96; ORF 015:

```
m015.pep (partial)
   1 . . . KIRKALAGFW KALPHLNDTM LLFTGLWLMK ITHFSPFNAP WLGTKILLLL

  51       AYIALGMMMM RARPRSTKFY TVYLLAMCCV ACIVYLAKTK VLPF*
```

The following partial DNA sequence was identified in *N. meningitidis* <SEQ ID 97>:

```
a015.seq
   1 ATGCAGTATC TGATTGTCAA ATACAGCCAT CAAATCTTCG TTACCATCAC

  51 CATTTTGGTA TTCAACATCC GTGTTTTCNT ACTTTGGAAA AATCCAGAAA

 101 AGCCCTTGGC GGGCTTTTGG AAGGCACTGC CCCACCTTAA CGACACCATG

 151 CTGCTGTTTA CGGGATTGTG GCTGATGAAA ATTACCCATT TCTCCCCGTT

 201 CAACGCGCCT TGGCTCGGTA CAAAAATCCT GCTTCTGCTC GCCTATATCG

 251 CATTGGGTAT GATGATGATG CGCGCCCGTC CGCGTTCGAC CAAGTTCTAC

 301 ACCGTTTACC TGCTCGCCAT GTGTTGCCTC ACCTGCATCG TTTACCTTGC

 351 CAAAACCAAA GTCCTGCCTT TCTGA
```

This corresponds to the amino acid sequence <SEQ ID 98; ORF 015.a>:

```
a015.pep
   1 MQYLIVKYSH QIFVTITILV FNIRVFXLWK NPEKPLAGFW KALPHLNDTM

  51 LLFTGLWLMK ITHFSPFNAP WLGTKILLLL AYIALGMMMM RARPRSTKFY

 101 TVYLLAMCCL TCIVYLAKTK VLPF*
```

m015/a015 96.7% identity over a 91 aa overlap

```
                                               10        20        30
m015.pep                                KIRKALAGFWKALPHLNDTMLLFTGLWLMKITH
                                           | |||||||||||||||||||||||||||||
a015       LIVKYSHQIFVTITILVFNIRVFXLWKNPEKPLAGFWKALPHLNDTMLLFTGLWLMKITH
                  10        20        30        40        50        60

                  40        50        60        70        80        90
m015.pep   FSPFNAPWLGTKILLLLAYIALGMMMMRARPRSTKFYTVYLLAMCCVACIVYLAKTKVLP
           ||||||||||||||||||||||||||||||||||||||||||||||::||||||||||||
a015       FSPFNAPWLGTKILLLLAYIALGMMMMRARPRSTKFYTVYLLAMCCLTCIVYLAKTKVLP
                  70        80        90       100       110       120

m015.pep   FX
           ||
a015       FX
```

Computer analysis of this amino acid sequence gave the following results:

Homology with a Predicted ORF from *N. gonorrhoeae*

ORF 015 shows 94.5% identity over a 91 aa overlap with a predicted ORF (ORF 015.ng) from *N. gonorrhoeae*:

```
m015/g015

                                               10        20        30
m015.pep                                KIRKALAGFWKALPHLNDTMLLFTGLWLMKITH
                                           | |:|||||||||||||||||||||||||
g015       LIVKYSHQIFVTITILVFNIRFFLLWKNPEKPLVGFWKALPHLNDTMLLFTGLWLMKITH
                  10        20        30        40        50        60
```

-continued

```
                40        50        60        70        80        90
m015.pep FSPFNAPWLGTKILLLLAYIALGMMMMRARPRSTKFYTVYLLAMCCVACIVYLAKTKVLP
         |||||||||||||||:|||||||:|||||||||||||||||||:|||||||||||||
g015     FSPFNAPWLGTKILLLFAYIALGMVMMRARPRSTKFYTVYLLAMCCIACIVYLAKTKVLP
                70        80        90       100       110       120

m015.pep FX
         ||
g015     FX
```

The following partial DNA sequence was identified in *N. gonorrhoeae* <SEQ ID 99>:

```
g018.seq
  1 atGCAGCAGG GGCagttggt tggacgcgtc gcccgcaata AAGATATGCG

 51 GAATgctggt CTGCATggtC AGCGGATCGG CAACGGGtac gccgcgcgcg

101 tctttgTCGA TATTGATGTT TTCCAAACCG ATATtgTCAA CGTTCGGACG

151 GCgACCTACG GCTGCCAACA TATATTCGGC AACAAATACG CCTTTTTCGC

201 CATCCTGCTC CCAATGGACT tctACATTGC CGTCTGCGTC GAGTTTGACC

251 TCGGTTTTAG CATCCAGATG CAGTTTCAAT tctTCTCCGA ACACGGCTTT

301 CGCCTCGTCT GA
```

This corresponds to the amino acid sequence <SEQ ID 100; ORF 018.ng>:

```
g018.pep
  1 MQQGQLVGRV ARNKDMRNAG LHGQRIGNGY AARVFVDIDV FQTDIVNVRT

 51 ATYGCQHIFG NKYAFFAILL PMDFYIAVCV EFDLGFSIQM QFQFFSEHGF

101 RLV*
```

The following partial DNA sequence was identified in *N. meningitidis* <SEQ ID 101>:

```
m018.seq
  1 ATGCAGCAGA GGCAGTTGGT TGGACGCATC GCCTGCGATG AAGATATGCG

 51 GAATACTGGT CTGCATGGTC AGCGGGTCGG CAACAGGTAC GCCGCGCGCA

101 TCTTTTTCGA TATTGATATT TTCCAAACCG ATATTGTCAA CGTTCGGACG

151 GCGGCCCACG GCTGCCAGCA TATATTCGGC AACAAATACG CCTTTTTCGC

201 CATCCTGCTC CCAATGGACT TCTACATTGC CGTCTGCATC GAGTTTGACC

251 TCGGTTTTAG CATCCAGATG CAGTTTCAAT TCTTCGCCGA ACACGGCGTT

301 CGCCTCGTCT GA
```

This corresponds to the amino acid sequence <SEQ ID 102; ORF 018>:

```
m018.pepr
  1 MQQRQLVGRI ACDEDMRNTG LHGQRVGNRY AARIFFDIDI FQTDIVNVRT

 51 AAHGCQHIFG NKYAFFAILL PMDFYIAVCI EFDLGFSIQM QFQFFAEHGV

101 RLV*
```

The following partial DNA sequence was identified in *N. meningitidis* <SEQ ID 103>:

```
a018.seq
  1 ATGCAGCAGG GGCAGTTGGT TGGACGCGTC GCCCGCAATA AAGATATGCG

 51 GAATACTGGT CTGCATAGTC AGCGGATCGG CAACGGGTAC GCCGCGCGCA

101 TCTTTTTCGA TATTGATGTT TTCCAAACCG ATATTGTCAA CGTTCGGACG

151 GCGGCCTACG GCTGCCAGCA TATATTCGGC AACAAATACG CCTTTTTCGC

201 CATCCTGCTC CCAATGGACT TCTACATTGC CGTCTGCGTC GAGTTTGGCC

251 TCGGTTTTAG CATCCAAATG CAGTTTCAAT TCTTCACCGA ACACGGCTTT

301 CGCCTCGTCT GA
```

This corresponds to the amino acid sequence <SEQ ID 104; ORF 018.a>.

```
a018.pep
  1 MQQGQLVGRV ARNKDMRNTG LHSQRIGNGY AARIFFDIDV FQTDIVNVRT

 51 AAYGCQHIFG NKYAFFAILL PMDFYIAVCV EFGLGFSIQM QFQFFTEHGF

101 RLV*
```

m018/a018 86.4% identity over a 103 aa overlap

```
                   10         20         30         40         50         60
    m018.pep   MQQRQLVGRIACDEDMRNTGLHGQRVGNRYAARIFFDIDIFQTDIVNVRTAAHGCQHIFG
               ||| ||||||:| ::||||||:||:|| ||||||:| |||:|||||||||||::||||||
    a018       MQQGQLVGRVARNKDMRNTGLHSQRIGNGYAARIFFDIDVFQTDIVNVRTAAYGCQHIFG
                   10         20         30         40         50         60

                   70         80         90        100
    m018.pep   NKYAFFAILLPMDFYIAVCIEFDLGFSIQMQFQFFAEHGVRLVX
               |||||||||||||||||||:|||||||||||||||:||| ||||
    a018       NKYAFFAILLPMDFYIAVCVEFGLGFSIQMQFQFFTEHGFRLVX
                   70         80         90        100
```

Computer analysis of this amino acid sequence gave the following results:
Homology with a Predicted ORF from *N. gonorrhoeae*
ORF 018 shows 84.5% identity over a 103 aa overlap with a predicted ORF (ORF 018.ng) from *N. gonorrhoeae*:

```
    m018/g018

                   10         20         30         40         50         60
    m018.pep   MQQRQLVGRIACDEDMRNTGLHGQRVGNRYAARIFFDIDIFQTDIVNVRTAAHGCQHIFG
               ||| ||||||:| ::|||||:|||||||:|| ||||:| |||:||||||||||::|||||||
    g018       MQQGQLVGRVARNKDMRNAGLHGQRIGNGYAARVFVDIDVFQTDIVNVRTATYGCQHIFG
                   10         20         30         40         50         60

                   70         80         90        100
    m018.pep   NKYAFFAILLPMDFYIAVCIEFDLGFSIQMQFQFFAEHGVRLVX
               |||||||||||||||||||:||||||||||||||||:||| ||||
    g018       NKYAFFAILLPMDFYIAVCVEFDLGFSIQMQFQFFSEHGFRLVX
                   70         80         90        100
```

The following partial DNA sequence was identified in *N. gonorrhoeae* <SEQ ID 105>:

```
g019.seq (partial)
  1. . . ctgctggcgg ccctggtgct tgccgcgtgt tcttcgACAA ACAcacTGCC

 51      AGCCGGCAAG ACCCCGGCAG ACAATATAGA AActgcCgAC CTTTCGGCAA

101      GCGTTCCCAC ccgcCCTGCC GAACCGGAAG GAAAAACGCT GGCAGATTAC

151      GGCGGCTACC CGTCCGCACT GGATGCAGTG AAACAGAACA ACGATGCGGC

201      AGCCGCCGCC TATTTGGAAA Acgcaggaga cagCGcgatg gcGGAAAatg

251      tccgcaagga gtgGCTGa
```

This corresponds to the amino acid sequence <SEQ ID 106; ORF 019.ng>:

```
g019.pep (partial)
 1 . . . LLAALVLAAC SSTNTLPAGK TPADNIETAD LSASVPTRPA EPEGKTLADY

51       GGYPSALDAV KQNNDAAAAA YLENAGDSAM AENVRKEWL*
```

The following partial DNA sequence was identified in *N. meningitidis* <SEQ ID 107>:

```
m019.seq.(partial)
   1 ATGTACCTAC CCTCTATGAA GCATTCCCTG CCGCTGCTGG CGGCCCTGGT

  51 GCTTGCCGCG TGTTCTTCGA CAAACACACT GCCAGCCGGC AAGACCCCGG

 101 CAGACAATAT AGAAACTGCC GACCTTTCGG CAAGCGTTCC CACCCGCCCT

 151 GCCGAACCCG AAAGAAAAAC GCTGGCAGAT TACGGCGGCT ACCCGTCCGC

 201 ACTGGATGCA GTGAAACAGA AAAACGATGC CGCCGTCGCC GCCTATTTGG

 251 AAAACGCCGG CGACAGCGCG ATGGCGGAAA ATGTCCGCAA CGAGTGGCTG

 301 AAGTCTTTGG GCGCACGCAG ACAGTGGACG CTGTTTGCAC AGGAATACGC

 351 CAAACTCGAA CCGGCAGGGC GCGCCCAAGA AGTCGAATGC TACGCCGATT

 401 CGAGCCGCAA CGACTATACG CGTGCCGCTG AACTGGTCAA AAATACGGGC

 451 AAACTGCCTT CGGGCTGCAC CAAACTGTTG GAACAGGCAG CCGCATCCGG

 501 CTTGTTGGAC GGCAACGACG CCTGGAGGCG CGTGCGCGGA CTGCTGGCCG

 551 GCCGCCAAAC CACAGACGCA CGCAACCTTG CCGCCGCATT GGGCAGCCCG

 601 TTTGACGGCG GTACACAAGG TTCGCGCGAA TATGCCCTGT TGAACGTCAT

 651 CGGCAAAGAA GCACGCAAAT CGCCGAATGC CGCCCGCCCTG CTGTCCGAAA

 701 TGGAAAGCGG TTTAAGCCTC GAACAACGCA GTTTCGCGTG GGGCGTATTG

 751 GGGCATTATC AGTCGCAAAA CCTCAATGTG CCTGCCGCCT TGGACTATTA

 801 CGGCAAGGTT GCCGACCGCC GCCAACTGAC CGACGACCAA ATCGAGTGGT

 851 ACGCCCGCGC CGCCTTGCGC GCCCGACGTT GGGACGAGCT GGCCTCCGTT

 901 ATCTCGCATA TGCCCGAAAA ACTGCAAAAA AGCCCGACCT GGCTCTACTG

 951 GCTGGCACGC AGCCGCGCCG CAACGGGCAA CACGCAAGAG GCGGAAAAAC

1001 TTTACAAACA GGCGGCAGCG ACGGGCAGGA ATTTTTATGC GGTGCTGGCA

1051 GGGGAAGAAT TGGGTCGGAA AATCGATACG CGCAACAATG TGCCCGATGC

1101 CGGCAAAAAC AGCGTCCGCC GCATGGCGGA AGACGGTGCA GTCAAACGCG

1151 CACTGGTACT GTTCCAAAAC AGCCAATCTG CCGGTGATGC AAAAATGCGC
```

-continued

```
1201 CGTCAGGCTC AGGCGGAATG GCGTTTTGCC ACACGCGGCT TTGACGAAGA

1251 CAAGCTGCTG ACCGCCGCGC AAACCGCGTT CGACCACGGT TTTTACGATA

1301 TGGCGGTCAA CAGCGCGGAA CGCACCGACC GCAAACTCAA CTACACCTTG

1351 CGCTATATTT CGCCGTTTAA AGACACGGTA ATCCGCCACG CGCAAAATGT

1401 TAATGTCGAT CCGGCTTGGG TTTATGGGCT GATTCGTCAG GAAAGCCGCT

1451 TCGTTATAGG CGCGCAATCC CGCGTAGGCG CGCAGGGGCT GATGCAGGTT

1501 ATGCCTGCCA CCGCGCGCGA AATCGCCGGC AAAATCGGTA TGGATGCCGC

1551 ACAACTTTAC ACCGCCGACG GG . . .
```

This corresponds to the amino acid sequence <SEQ ID 108; ORF 019>:

```
m019.pep (partial)
  1 MYLPSMKHSL PLLAALVLAA CSSTNTLPAG KTPADNIETA DLSASVPTRP

 51 AEPERKTLAD YGGYPSALDA VKQKNDAAVA AYLENAGDSA MAENVRNEWL

101 KSLGARRQWT LFAQEYAKLE PAGRAQEVEC YADSSRNDYT RAAELVKNTG

151 KLPSGCTKLL EQAAASGLLD GNDAWRRVRG LLAGRQTTDA RNLAAALGSP

201 FDGGTQGSRE YALLNVIGKE ARKSPNAAAL LSEMESGLSL EQRSFAWGVL

251 GHYQSQNLNV PAALDYYGKV ADRRQLTDDQ IEWYARAALR ARRWDELASV

301 ISHMPEKLQK SPTWLYWLAR SRAATGNTQE AEKLYKQAAA TGRNFYAVLA

351 GEELGRKIDT RNNVPDAGKN SVRRMAEDGA VKRALVLFQN SQSAGDAKMR

401 RQAQAEWRFA TRGFDEDKLL TAAQTAFDHG FYDMAVNSAE RTDRKLNYTL

451 RYISPFKDTV IRHAQNVNVD PAWVYGLIRQ ESRFVIGAQS RVGAQGLMQV

501 MPATAREIAG KIGMDAAQLY TADG . . .
```

The following partial DNA sequence was identified in *N. meningitidis* <SEQ ID 109>:

```
a019.seq
  1 ATGTACCCAC CCTCTCTGAA GCATTCCCTG CCGCTGCTGG TGGNCCTGGT

 51 GCTTGCCGCG TGTTCTTNGA CAAACACACT GTCAGCCGAC AAGACCCCGG

101 CAGACAATAT AGAAACTGCC GACCTTTCGG CAAGCGTTCC CACCNGCCCT

151 GCCGAACCCG AANGAAAAAC GTNGGCAGAT TACGGCGGCT ACCCGTCCGC

201 ACTGGATGCA GTGAAACAGA AAAACGATGC CGCCGTCGCC GCCTATTTGG

251 AAAACGCCGG CGACAGCGCG ATGGCGGAAA ATGTCCGCAA CGAGTGGCTG

301 AAGTCTTTGG GCGCGCGCAG ACAGTGGACG CTGTNTGCAC ANGAATATGC

351 NAAACTCGAA CCGGCANGGC GCGCCCAAGA AGTCGAATGC TACGCCGATT

401 CGAGCCGCAA CGACTATACG CGTGCCGCCG AACTGGTCAA AAATACGGGC

451 AAACTGCCTT CGGGCTGCAC CAAACTGTTG GAACAGGCAG CCGCATCCGG

501 CTTGTTGGAC GGCAACGACG CCTGGAGGCG CGTGCGCGGA CTGCTGGCCG

551 GCCGCCAAAC CACAGACGCA CGCAACCTTG CCGCCGCATT GGGCAGCCCG

601 TTTGACGGCG GTACACAAGG TTCGCGCGAA TATGCCCTGT TGAACGTCAT

651 CGGCAAAGAA GCACGCAAAT CGCCGAATGC CGCCGCCCTG CTGTCCGAAA

701 TGGAAAGCGG TTTAAGCCTC GAACAACGCA GTTTCGCGTG GGGCGTATTG
```

-continued

```
 751 GGGCATTATC AGTCGCAAAA CCTCAATGTG CCTGCCGCCT TGGACTATTA

 801 NGGCAAGGTT GCCGACCGCC GCCAACTGAC CGACGACCAA ATCGAGTGGT

 851 ACGCCCGCGC CGCNNTNNGC NNNCGNNGTT NGNANGANNT GGCNNCCGNN

 901 ANCNCGNNNN TGCNNGANAA ACNNNNNNAN AGNCNNANNT NGNTNNANTG

 951 NNTGGCACGC AGCCGCGCCG CNACGGGCAA CACGCAANAN GCGGANAAAC

1001 TNTACAAACA GGCGGCAGCA NCGGGCANGA ATTTTTATGC NGTGCTGNCN

1051 GGGGAAGAGT TGGGGCGCAN AATCGATACG CGCAACAATG TGCCCGATGC

1101 CGGCAAAANC AGCGTCCTCC GTATGGCGGA AGACGGCGCG ATTAAGCGCG

1151 CGCTGGTGCT GTTCCGAAAC AGCCGAACCG CCGGCGATGC GAAAATGCGC

1201 CGTCNGGCTC AGGCGGAATG GCGTTTCGCC ACACGCGGCT TCGATGAAGA

1251 CAAGCTGCTG ACCGCCGCGC AAACCGCGTT CGACCACGGT TTTTACGATA

1301 TGGCGGTCAA CAGCGCGGAA CGCACCGACC GCAAACTCAA CTACACCTTG

1351 CGCTACATTT CGNNNNNTNA NGACACGGTA ATCCGCCACG CGCAAAATGT

1401 TAATGTCGAT CCGGCGTGGG TTTACGGGCT GATTCGTCAG GAAAGCCGCT

1451 TCGTTATGGG CGCGCAATCC CGCGTAGGCG CGCAGGGGCT GATGCAGGTT

1501 ATGCCTGCCA CCGCGCGCGA AATCGCCGGC AAAATCGGTA TGGATGCCGC

1551 ACAACTTTAC ACCGCCGACG GCAATATCCG TATGGGGACG TGGTATATGG

1601 CGGACACCAA ACGCCGCCTG CAAAACAACG AAGTCCTCGC CACCGCAGGC

1651 TATAACGCCG GTCCCGGCAG GGCGCGCCGA TGGCAGGCGG ACACGCGGCT

1701 CGAAGGCGCG GTATATGCCG AAACCATCCC GTTTTCCGAA ACGCGCGACT

1751 ATGTCAAAAA AGTGATGGCC AATGCCGCCT ACTACGCCTC CCTCTTCGGC

1801 GCGCCGCACA TCCCGCTCAA ACAGCGTATG GGCATTGTCC CCGCCCGCTG

1851 A
```

This corresponds to the amino acid sequence <SEQ ID 110; ORF 019.a>:

```
a019.pep
  1 MYPPSLKHSL PLLVXLVLAA CSXTNTLSAD KTPADNIETA DLSASVPTXP

 51 AEPEXKTXAD YGGYPSALDA VKQKNDAAVA AYLENAGDSA MAENVRNEWL

101 KSLGARRQWT LXAXEYAKLE PAXRAQEVEC YADSSRNDYT RAAELVKNTG

151 KLPSGCTKLL EQAAASGLLD GNDAWRRVRG LLAGRQTTDA RNLAAALGSP

201 FDGGTQGSRE YALLNVIGKE ARKSPNAAAL LSEMESGLSL EQRSFAWGVL

251 GHYQSQNLNV PAALDYXGKV ADRRQLTDDQ IEWYARAAXX XRXXXXXAXX

301 XXXXXXKXXX XXXXXXXXAR SRAATGNTQX AXKLYKQAAA XGXNFYAVLX

351 GEELGRXIDT RNNVPDAGKX SVLRMAEDGA IKRALVLFRN SRTAGDAKMR

401 RXAQAEWRFA TRGFDEDKLL TAAQTAFDHG FYDMAVNSAE RTDRKLNYTL

451 RYISXXXDTV IRHAQNVNVD PAWVYGLIRQ ESRFVMGAQS RVGAQGLMQV

501 MPATAREIAG KIGMDAAQLY TADGNIRMGT WYMADTKRRL QNNEVLATAG

551 YNAGPGRARR WQADTPLEGA VYAETIPFSE TRDYVKKVMA NAAYYASLFG

601 APHIPLKQRM GIVPAR*
```

m019/a019 88.9% identity over a 524 aa overlap

```
                 10        20        30        40        50        60
m019.pep MYLPSMKHSLPLLAALVLAACSSTNTLPAGKTPADNIETADLSASVPTRPAEPERKTLAD
         || ||:|||||||: ||||||| |||| | |||||||||||||||||| ||||| || ||
a019     MYPPSLKHSLPLLVXLVLAACSXTNTLSADKTPADNIETADLSASVPTXPAEPEXKTXAD
                 10        20        30        40        50        60

                 70        80        90       100       110       120
m019.pep YGGYPSALDAVKQKNDAAVAAYLENAGDSAMAENVRNEWLKSLGARRQWTLFAQEYAKLE
         ||||||||||||||||||||||||||||||||||||||||||||||||||| | ||||||
a019     YGGYPSALDAVKQKNDAAVAAYLENAGDSAMAENVRNEWLKSLGARRQWTLXAXEYAKLE
                 70        80        90       100       110       120

                130       140       150       160       170       180
m019.pep PAGRAQEVECYADSSRNDYTRAAELVKNTGKLPSGCTKLLEQAAASGLLDGNDAWRRVRG
         || |||||||||||||||||||||||||||||||||||||||||||||||||||||||||
a019     PAXRAQEVECYADSSRNDYTRAAELVKNTGKLPSGCTKLLEQAAASGLLDGNDAWRRVRG
                130       140       150       160       170       180

                190       200       210       220       230       240
m019.pep LLAGRQTTDARNLAAALGSPFDGGTQGSREYALLNVIGKEARKSPNAAALLSEMESGLSL
         ||||||||||||||||||||||||||||||||||||||||||||||||||||||||||||
a019     LLAGRQTTDARNLAAALGSPFDGGTQGSREYALLNVIGKEARKSPNAAALLSEMESGLSL
                190       200       210       220       230       240

                250       260       270       280       290       300
m019.pep EQRSFAWGVLGHYQSQNLNVPAALDYYGKVADRRQLTDDQIEWYARAALRARRWDELASV
         |||||||||||||||||||||||||| |||||||||||||||||||||   |     |  
a019     EQRSFAWGVLGHYQSQNLNVPAALDYXGKVADRRQLTDDQIEWYARAAXXXRXXXXXAXX
                250       260       270       280       290       300

                310       320       330       340       350       360
m019.pep ISHMPEKLQKSPTWLYWLARSRAATGNTQEAEKLYKQAAATGRNFYAVLAGEELGRKIDT
               |     :     ||||||||||| | ||||||||:| |||||| |||||| |||
a019     XXXXXXKXXXXXXXXXXXXARSRAATGNTQXAXKLYKQAAAXGXNFYAVLXGEELGRXIDT
                310       320       330       340       350       360

                370       380       390       400       410       420
m019.pep RNNVPDAGKNSVRRMAEDGAVKRALVLFQNSQSAGDAKMRRQAQAEWRFATRGFDEDKLL
         ||||||||| || |||||||:|||||||:||::|||||||| ||||||||||||||||||
a019     RNNVPDAGKXSVLRMAEDGAIKRALVLFRNSRTAGDAKMRRXAQAEWRFATRGFDEDKLL
                370       380       390       400       410       420

                430       440       450       460       470       480
m019.pep TAAQTAFDHGFYDMAVNSAERTDRKLNYTLRYISPFKDTVIRHAQNVNVDPAWVYGLIRQ
         |||||||||||||||||||||||||||||||||   ||||||||||||||||||||||||
a019     TAAQTAFDHGFYDMAVNSAERTDRKLNYTLRYISXXXDTVIRHAQNVNVDPAWVYGLIRQ
                430       440       450       460       470       480

                490       500       510       520
m019.pep ESRFVIGAQSRVGAQGLMQVMPATAREIAGKIGMDAAQLYTADG
         |||||:||||||||||||||||||||||||||||||||||||||
a019     ESRFVMGAQSRVGAQGLMQVMPATAREIAGKIGMDAAQLYTADGNIRMGTWYMADTKRRL
                490       500       510       520       530       540

a019     QNNEVLATAGYNAGPGRARRWQADTPLEGAVYAETIPFSETRDYVKKVMANAAYYASLFG
                550       560       570       580       590       600
```

Computer analysis of this amino acid sequence gave the following results:

Homology with a Predicted ORF from *N. gonorrhoeae*

ORF 019 shows 95.5% identity over a 89 aa overlap with a predicted ORF (ORF 019.ng) from *N. gonorrhoeae*:

```
g019/m019

                              10        20        30        40      49
g019.pep              LLAALVLAACSSTNTLPAGKTPADNIETADLSASVPTRPAEPEGKTLAD
                      |||||||||||||||||||||||||||||||||||||||||||| |||||
m019      MYLPSMKHSLPLLAALVLAACSSTNTLPAGKTPADNIETADLSASVPTRPAEPERKTLAD
                  10        20        30        40        50        60

         50        60        70        80       89
g019.pep  YGGYPSALDAVKQNNDAAAAAYLENAGDSAMAENVRKEWL
          |||||||||||||:||||:|||||||||||||||||:|||
m019      YGGYPSALDAVKQKNDAAVAAYLENAGDSAMAENVRNEWLKSLGARRQWTLFAQEYAKLE
                  70        80        90       100       110       120
```

The following partial DNA sequence was identified in *N. gonorrhoeae* <*SEQ ID* 111>:

```
g023.seq
  1 ATGGTAGAAC GTAAATTGAC CGGTGCCCAT TACGGTTTGC GCGATTGGGT
 51 AATGCAGCGT GCGACTGCGG TTATTATGTT GATTTATACC GTTGCACTTT
101 TAGTGGTTCT ATTTGCCCTG CCTAAAGAAT ATCCGGCATG GCAGGCATTT
151 TTTAGTCAAG CTTGGGTAAA AGTATTTACC CAAGTGAGCT TTATCGCCGT
201 ATTCTTGCAC GCTTGGGTGG GTATCCGCGA TTTGTGGATG GACTATATCA
251 AACCCTTCGG CGTGCGTTTG TTTTTGCAGG TTGCCACCAT TGtctGGCTG
301 GTCGGCTGCC TCGTGTATTC AGTTAAAGTG ATTTGGGGGT AA
```

This corresponds to the amino acid sequence <SEQ ID 112; ORF 023.ng>:

```
g023.pep
  1 MVERKLTGAH YGLRDWVMQR ATAVIMLIYT VALLVVLFAL PKEYPAWQAF
 51 FSQAWVKVFT QVSFIAVFLH AWVGIRDLWM DYIKPFGVRL FLQVATIVWL
101 VGCLVYSVKV IWG*
```

The following partial DNA sequence was identified in *N. meningitidis* <SEQ ID 113>:

```
m023.seq
  1 ATGGTAGAAC GTAAATTGAC CGGTGCCCAT TACGGTTTGC GCGATTGGGT
 51 GATGCAACGT GCGACTGCGG TTATTATGTT GATTTATACC GTTGCACTTT
101 TAGTGGTTCT ATTTTCCCTG CCTAAAGAAT ATTCGGCATG GCAGGCATTT
151 TTTAGTCAAA CTTGGGTAAA AGTATTTACC CAAGTGAGCT TCATCGCCGT
201 ATTCTTGCAC GCTTGGGTGG GTATCCGCGA TTTGTGGATG GACTATATCA
251 AACCCTTCGG CGTGCGTTTG TTTTTGCAGG TTGCCACCAT CGTTTGGCTG
301 GTCGGCTGTC TCGTGTATTC AGTTAAAGTG ATTTGGGGGT AA
```

This corresponds to the amino acid sequence <SEQ ID 114; ORF 023>:

```
m023.pep
  1 MVERKLTGAH YGLRDWVMQR ATAVIMLIYT VALLVVLFSL PKEYSAWQAF
 51 FSQTWVKVFT QVSFIAVFLH AWVGIRDLWM DYIKPFGVRL FLQVATIVWL
101 VGCLVYSVKV IWG*
```

The following partial DNA sequence was identified in *N. meningitidis* <SEQ ID 115>:

```
a023.seq
  1 ATGGTAGAAC GTAAATTGAC CGGTGCCCAT TACGGTTTGC GGGATTGGGC
 51 GATGCAACGT GCGACCGCGG TTATTATGTT GATTTATACC GTTGCACTTT
101 TAGTGGTTCT ATTTGCTCTG CCTAAAGAAT ATTCGGCATG GCAGGCATTT
151 TTTAGTCAAA CTTGGGTAAA AGTATTTACC CAAGTGAGCT TCATCGCCGT
201 ATTCTTGCAC GCTTGGGTGG GTATCCGCGA TTTGTGGATG GACTATATNA
```

-continued

```
251 AACCCTTCGG CGTGCGTTTG TTTTTGCAGG TTGCCACCAT CGTCTGGCTG

301 GTCGGCTGCT TGGTGTATTC AATTAAAGTA ATTTGGGGGT AA
```

This corresponds to the amino acid sequence <SEQ ID 116; ORF 023.a>:

```
a023.pep
  1 MVERKLTGAH YGLRDWAMQR ATAVIMLIYT VALLVVLFAL PKEYSAWQAF

 51 FSQTWVKVFT QVSFIAVFLH AWVGIRDLWM DYXKPFGVRL FLQVATIVWL

101 VGCLVYSIKV IWG*
```

m023/a023 96.5% identity over a 113 aa overlap

```
                  10        20        30        40        50        60
m023.pep   MVERKLTGAHYGLRDWVMQRATAVIMLIYTVALLVVLFSLPKEYSAWQAFFSQTWVKVFT
           |||||||||||||||:||||||||||||||||||||:|||||||||||||||||||
a023       MVERKLTGAHYGLRDWAMQRATAVIMLIYTVALLVVLFALPKEYSAWQAFFSQTWVKVFT
                  10        20        30        40        50        60
                  70        80        90       100       110
m023.pep   QVSFIAVFLHAWVGIRDLWMDYIKPFGVRLFLQVATIVWLVGCLVYSVKVIWGX
           |||||||||||||||||||||| ||||||||||||||||||||||||:||||||
a023       QVSFIAVFLHAWVGIRDLWMDYXKPFGVRLFLQVATIVWLVGCLVYSIKVIWGX
                  70        80        90       100       110
```

Computer analysis of this amino acid sequence gave the following results:

Homology with a Predicted ORF from *N. gonorrhoeae*

ORF 023 shows 97.3% identity over a 113 aa overlap with a predicted ORF (ORF 023.ng) from *N. gonorrhoeae*:

```
g023/m023

                  10        20        30        40        50        60
g023.pep   MVERKLTGAHYGLRDWVMQRATAVIMLIYTVALLVVLFALPKEYPAWQAFFSQAWVKVFT
           ||||||||||||||||||||||||||||||||||||||:||||| ||||||||:|||||||
m023       MVERKLTGAHYGLRDWVMQRATAVIMLIYTVALLVVLFSLPKEYSAWQAFFSQTWVKVFT
                  10        20        30        40        50        60
                  70        80        90       100       110
g023.pep   QVSFIAVFLHAWVGIRDLWMDYIKPFGVRLFLQVATIVWLVGCLVYSVKVIWGX
           ||||||||||||||||||||||||||||||||||||||||||||||||||||||
m023       QVSFIAVFLHAWVGIRDLWMDYIKPFGVRLFLQVATIVWLVGCLVYSVKVIWGX
                  70        80        90       100       110
```

The following partial DNA sequence was identified in *N. gonorrhoeae* <SEQ ID 117>:

```
g025.seq
  1 ATGTTGAAAC AAAcgACACT TTTGGCAGCT TGTACCGCCG TTGCCGCTCT

 51 GTTGGGCGGT TGcgCCACCC AACAGCCTGC TccTGTCATT GCAGGCAATT

101 CAGGTATGCA GACCGTATCG TCTGCGCCGG TTTACAATCC TTATGGCGCA

151 ACGCCGTACA ATGCCGCTCC TGCCGCCAac gatgcGCCgT ATGTGCCGCC

201 CGTGCAAact gcgccggtttT ATTCGCCTCC TGCTTATGTT CCGCcgtCTG

251 CACCTGCCGT TTCGGgtaca tatgtTCCTT CTTACGCACC CgtcgACATC

301 aacgCGGCGa cgCataCTAT TGTGCGTGGC GACACgGtgt acaACATTTc
```

-continued

```
 351 caaAcgCtac CATATCTCTC AAGACGATTT CCGTGCGTGG AACGGCATGA

 401 CCGACAATAC GTTGAGCATC GGTCAGATTG TTAAAGTCAA ACCGGCaggA

 451 TATGCCGCAC CGAAAACCGC AGCCGTAGAA AGCAGGCCCG CCGTACCGGC

 501 TGCCGCGCAA ACCCCTGTGA AACCCGCCGC gcaACCGCCC GTTCAGTCCG

 551 CGCCGCAACC TGCCGCGCCC GCTGCGGAAA ATAAAGCGGT TCCCGCCCCC

 601 GCGCCCGCCC CGCAATCTCC TGCCGCTTCG CCTTCCGGCA CGCGTTCGGT

 651 CGGCGGCATT GTTTGGCAGC GTCCGACCCA AGGTAAAGTG GTTGCCGATT

 701 TCGGCGGCGG CAACAAGGGT GTCGATATTG CCGGCAATGC CGGACAACCC

 751 GTTTTGGCGG CGGCTGACGG CAAAGTGGTT TATGCCGGTT CAGGTTTGAG

 801 GGGATACGGA AACTTGGTCA TCATCCAGCA CAATTCCTCT TTCCTGACCG

 851 CGTACGGGCA CAACCAAAAA TTGCTGGTCG GCGAAGGTCA GCAGGTCAAA

 901 CGCGGTCAGC AGGTTGCTTT GATGGGTAAT ACCGATGCTT CCAGAACGCA

 951 GCTTCATTTC GAGGTGCGTC AAAACGGCAA ACCGGTTAAC CCGAACAGCT

1001 ATATCGCGTT CTGA
```

This corresponds to the amino acid sequence <SEQ ID 118; ORF 025.ng>:

```
g025.pep
  1 MLKQTTLLAA CTAVAALLGG CATQQPAPVI AGNSGMQTVS SAPVYNPYGA

 51 TPYNAAPAAN DAPYVPPVQT APVYSPPAYV PPSAPAVSGT YVPSYAPVDI

101 NAATHTIVRG DTVYNISKRY HISQDDFRAW NGMTDNTLSI GQIVKVKPAG

151 YAAPKTAAVE SRPAVPAAAQ TPVKPAAQPP VQSAPQPAAP AAENKAVPAP

201 APAPQSPAAS PSGTRSVGGI VWQRPTQGKV VADFGGGNKG VDIAGNAGQP

251 VLAAADGKVV YAGSGLRGYG NLVIIQHNSS FLTAYGHNQK LLVGEGQQVK

301 RGQQVALMGN TDASRTQLHF EVRQNGKPVN PNSYIAF*
```

The following partial DNA sequence was identified in *N. meningitidis* <SEQ ID 119>:

```
m025.seq1 (partial)
   1 ...GTGCCGCCGG TGCAAAGCGC GCCGGTTTAT ACGCCTCCTG CTTATGTTCC

  51    GCCGTCTGCA CCTGCCGTTT CGGGTACATA CGTTCCTTCT TACGCACCCG

 101    TCGACATCAA CGCGGCGACG CATACTATTG TGCGCGGCGA CACGGTGTAC

 151    AACATTTCCA AACGCTACCA TATCTCTCAA GACGATTTCC GTGCGTGGAA

 201    CGGCATGACC GACAATACGT TGAGCATCGG TCAGATTGTT AAAGTCAAAC

 251    CGGCAGGATA TGCCGCACCG AAAGCCGCAG CCGTAAAAAG CAGGCCCGCC

 301    GTACCGGCTG CCGCGCAACC GCCCGTACAG TCCGCACCCG TCGACATTAA

 351    CGCGGCGACG CATACTATTG TGCGCGGCGA CACGGTGTAC AACATTTCCA

 401    AACGCTACCA TATCTCTCAA GACGATTTCC GTGCGTGGAA CGGCATGACC

 451    GACAATATGT TGAGCATCGG TCAGATTGTT AAAGTCAAAC CGGCAGGATA

 501    TGCCGCACCG AAAACCGCAG CCGTAGAAAG CAGGCCCGCC GTACCGGCTG

 551    CCGTGCAAAC CCCTGTGAAA CCCGCCGCGC AACCGCCTGT GCAGTCCGCG

 601    CCGCAACCTG CCGCGCCCGC TGCGGAAAAT AAAGCGGTTC CCGCGCCCGC
```

-continued

```
 651    CCCGCAATCT CCTGCCGCTT CGCCTTCCGG CACGCGTTCG GTCGGCGGCA

 701    TTGTTTGGCA GCGTCCGACG CAAGGTAAAG TGGTTGCCGA TTTCGGCGGC

 751    AACAACAAGG GTGTCGATAT TGCCGGTAAT GCGGGACAGC CCGTTTTGGC

 801    GGCGGCTGAC GGCAAAGTGG TTTATGCCGG TTCAGGTTTG AGGGGATACG

 851    GAAACTTGGT CATCATCCAG CATAATTCTT CTTTCCTGAC CGCATACGGG

 901    CACAACCAAA AATTGCTGGT CGGCGAGGGG CAGCAGGTCA AACGCGGTCA

 951    GCAGGTTGCT TTGATGGGCA ATACCGATGC TTCCAGAACG CAGCTTCATT

1001    TCGAGGTGCG TCAAAACGGC AAACCGGTTA ACCCGAACAG CTATATCGCG

1051    TTCTGA
```

This corresponds to the amino acid sequence <SEQ ID 110; ORF 025>:

```
m025.pep (partial)
  1 ...VPPVQSAPVY TPPAYVPPSA PAVSGTYVPS YAPVDINAAT HTIVRGDTVY

 51    NISKRYHISQ DDFRAWNGMT DNTLSIGQIV KVKPAGYAAP KAAAVKSRPA

101    VPAAAQPPVQ SAPVDINAAT HTIVRGDTVY NISKRYHISQ DDFRAWNGMT

151    DNMLSIGQIV KVKPAGYAAP KTAAVESRPA VPAAVQTPVK PAAQPPVQSA

201    PQPAAPAAEN KAVPAPAPQS PAASPSGTRS VGGIVWQRPT QGKVVADFGG

251    NNKGVDIAGN AGQPVLAAAD GKVVYAGSGL RGYGNLVIIQ HNSSFLTAYG

301    HNQKLLVGEG QQVKRGQQVA LMGNTDASRT QLHFEVRQNG KPVNPNSYIA

351    F*
```

The following partial DNA sequence was identified in *N. meningitidis* <SEQ ID 111>:

```
a025.seq
    1 ATGTTGACAC CAACAACACT TTAGGTAGCT TGTACCGCCC TTGCCGCTCA

   51 GTTGGGCGGA TGCCCCACCC AACACCCTTC TCCTGTCATT GCAGGCAATT

  101 CAGGTATGCA GACCGTACCG TCTGCGCCGG TTTACAATCC TTATGGCGCA

  151 ACGCCGTACA ATGCCGCTCC TGCCGCCAAC GATGCGCCGT ATGTGCCGCC

  201 GGTGCAAAGC GCGCCGGTTT ATANGCCTCC TGCTTATGTT CCGCCGTCTG

  251 CACCTGCCGT TTCGGGTACA TACGTTCCTT CTTACGCANC CGTCGACATC

  301 AACGCGGCGA CGCATACTAT TGTGCGCGGC GACACCGTGT ACAAGATTTC

  351 CAAATGCTAC CATATCTCTC AAGACGATTT CCGTGCGTGG AACGGCATGA

  401 CCGACAATAC GTTGAGCATC GGTCAGATTG TTAAAGTCAA ACCGGCAGGA

  451 TATGCCGCAC CGAAAGCCGC AGCCGTAAAA AGCAGGCCCG CCGTACCGGC

  501 TGCCGCGCAA CCGCTCGTAC AGTCCGCACC CGTCGACATC AACGCGGCGA

  551 CGCATACTAT TGTGCGCGGC GACACGGTGT ACAACATTTC CAAACGCTAC

  601 CATATCTCTC AAGACGATTT CCGTGCGTGG AACGGCATGA CCGACAATAC

  651 GTTGAGCATC GGTCAGATTG TTAAAGTCAA ACCGGCAGGA TATGCCGCAC

  701 CGAAAGCCGC AGCCGTAAAA AGCAGGCCCG CCGTACCGGC TGCCGTGCAA

  751 ACCCCTGTGA AACCCGCCGC GCAACCGCCT GTGCAGTCCG CGCCGCAACC

  801 TGCCGCGCCC GCTGCGGAAA ATAAAGCGGT TCCCGCGCCC GCCCCGCAAT
```

-continued

```
 851 CTCCTGCCGC TTCGCCTTCC GGCACGCGTT CGGTCGGCGG CATTGTTTGG

 901 CAGCGTCCGA CGCAAGGTAA AGTGGTTGCC GATTTCGGCG GCAACAACAA

 951 GGGTGTCGAT ATTGCAGGAA ATGCGGGACA GCCCGTTTTG GCGGCGGCTG

1001 ACGGCAAAGT GGTTTATGCA GGTTCCGGTT TGAGGGGATA CGGCAATTTG

1051 GTCATCATCC AGCATAATTC TTCCTTCCTG ACCGCATACG GGCACAACCA

1101 AAAATTGCTG GTCGGCGAAG GCCAGCAGGT CAAACGCGGG CAGCAGGTCG

1151 CTTTGATGGG CAATACCGAG GCTTCTAGAA CGCAGCTTCA TTTCGAGGTG

1201 CGGCAAAACG GCAAACCGGT TAATCCGAAC AGCTATATCG CGTTCTGA
```

This corresponds to the amino acid sequence <SEQ ID 112; ORF 025.a>:

```
a025.pep

      1 MLTPTTL*VA CTALAAQLGG CPTQHPSPVI AGNSGMQTVP SAPVYNPYGA

     51 TPYNAAPAAN DAPYVPPVQS APVYXPPAYV PPSAPAVSGT YVPSYAXVDI

    101 NAATHTIVRG DTVYKISKCY HISQDDFRAW NGMTDNTLSI GQIVKVKPAG

    151 YAAPKAAAVK SRPAVPAAAQ PLVQSAPVDI NAATHTIVRG DTVYNISKRY

    201 HISQDDFRAW NGMTDNTLSI GQIVKVKPAG YAAPKAAAVK SRPAVPAAVQ

    251 TPVKPAAQPP VQSAPQPAAP AAENKAVPAP APQSPAASPS GTRSVGGIVW

    301 QRPTQGKVVA DFGGNNKGVD IAGNAGQPVL AAADGKVVYA GSGLRGYGNL

    351 VIIQHNSSFL TAYGHNQKLL VGEGQQVKRG QQVALMGNTE ASRTQLHFEV

    401 RQNGKPVNPN SYIAF*
```

```
m025/a025 97.4% identity over a 351 aa overlap

                                            10        20        30
m025.pep                              VPPVQSAPVYTPPAYVPPSAPAVSGTYVPS
                                      ||||||||||:|||||||||||||||||||
a025     GMQTVPSAPVYNPYGATPYNAAPAANDAPYVPPVQSAPVYXPPAYVPPSAPAVSGTYVPS
             40        50        60        70        80        90

                 40        50        60        70        80        90
m025.pep YAPVDINAATHTIVRGDTVYNISKRYHISQDDFRAWNGMTDNTLSIGQIVKVKPAGYAAP
         || |||||||||||||||||:||| |||||||||||||||||||||||||||||||||||
a025     YAXVDINAATHTIVRGDTVYKISKCYHISQDDFRAWNGMTDNTLSIGQIVKVKPAGYAAP
             100       110       120       130       140       150

                100       110       120       130       140       150
m025.pep KAAAVKSRPAVPAAAQPPVQSAPVDINAATHTIVRGDTVYNISKRYHISQDDFRAWNGMT
         ||||||||||||||||| ||||||||||||||||||||||||||||||||||||||||||
a025     KAAAVKSRPAVPAAAQPLVQSAPVDINAATHTIVRGDTVYNISKRYHISQDDFRAWNGMT
             160       170       180       190       200       210

                160       170       180       190       200       210
m025.pep DNMLSIGQIVKVKPAGYAAPKTAAVESRPAVPAAVQTPVKPAAQPPVQSAPQPAAPAAEN
         || ||||||||||||||||||:|||:||||||||||||||||||||||||||||||||||
a025     DNTLSIGQIVKVKPAGYAAPKAAAVKSRPAVPAAVQTPVKPAAQPPVQSAPQPAAPAAEN
             220       230       240       250       260       270

                220       230       240       250       260       270
m025.pep KAVPAPAPQSPAASPSGTRSVGGIVWQRPTQGKVVADFGGNNKGVDIAGNAGQPVLAAAD
         ||||||||||||||||||||||||||||||||||||||||||||||||||||||||||||
a025     KAVPAPAPQSPAASPSGTRSVGGIVWQRPTQGKVVADFGGNNKGVDIAGNAGQPVLAAAD
             280       290       300       310       320       330

                280       290       300       310       320       330
m025.pep GKVVYAGSGLRGYGNLVIIQHNSSFLTAYGHNQKLLVGEGQQVKRGQQVALMGNTDASRT
         |||||||||||||||||||||||||||||||||||||||||||||||||||||||:||||
a025     GKVVYAGSGLRGYGNLVIIQHNSSFLTAYGHNQKLLVGEGQQVKRGQQVALMGNTEASRT
             340       350       360       370       380       390

                340       350
m025.pep QLHFEVRQNGKPVNPNSYIAFX
         ||||||||||||||||||||||
a025     QLHFEVRQNGKPVNPNSYIAFX
             400       410
```

Computer analysis of this amino acid sequence gave the following results:

Homology with a Predicted ORF from *N. gonorrhoeae*

ORF 025 shows 75.6% identity over a 353 aa overlap with a predicted ORF (ORF 025.ng) from *N. gonorrhoeae*:

```
m025/g025

                                                       10        20        30
m025.pep                                      VPPVQSAPVYTPPAYVPPSAPAVSGTYVPS
                                              |||||:||||:|||||||||||||||||||
g025        GMQTVSSAPVYNPYGATPYNAAPAANDAPYVPPVQTAPVYSPPAYVPPSAPAVSGTYVPS
                40        50        60        70        80        90
                    40        50        60        70        80        90
m025.pep    YAPVDINAATHTIVRGDTVYNISKRYHISQDDFRAWNGMTDNTLSIGQIVKVKPAGYAAP
            ||||||||||||||||||||||||||||||||||||||||||||||||||||||||||||
g025        YAPVDINAATHTIVRGDTVYNISKRYHISQDDFRAWNGMTDNTLSIGQIVKVKPAGYAAP
               100       110       120       130       140       150
                   100       110       120       130       140       150
m025.pep    KAAAVKSRPAVPAAAQPPVQSAPVDINAATHTIVRGDTVYNISKRYHISQDDFRAWNGMT
            |
g025        K-----------------------------------------------------------
                   160       170       180       190       200       210
m025.pep    DNMLSIGQIVKVKPAGYAAPKTAAVESRPAVPAAVQTPVKPAAQPPVQSAPQPAAPAAEN
                                 |||||||||||:||||||||||||||||||||||||
g025        ---------------------TAAVESRPAVPAAAQTPVKPAAQPPVQSAPQPAAPAAEN
                                   160       170       180       190
                     220       230       240       250       260
m025.pep    KAVPAPAP--QSPAASPSGTRSVGGIVWQRPTQGKVVADFGGNNKGVDIAGNAGQPVLAA
            ||||||||  ||||||||||||||||||||||||||||||||:|||||||||||||||||
g025        KAVPAPAPAPQSPAASPSGTRSVGGIVWQRPTQGKVVADFGGGNKGVDIAGNAGQPVLAA
               200       210       220       230       240       250
          270       280       290       300       310       320
m025.pep    ADGKVVYAGSGLRGYGNLVIIQHNSSFLTAYGHNQKLLVGEGQQVKRGQQVALMGNTDAS
            ||||||||||||||||||||||||||||||||||||||||||||||||||||||||||||
g025        ADGKVVYAGSGLRGYGNLVIIQHNSSFLTAYGHNQKLLVGEGQQVKRGQQVALMGNTDAS
               260       270       280       290       300       310
          330       340       350
m025.pep    RTQLHFEVRQNGKPVNPNSYIAFX
            ||||||||||||||||||||||||
g025        RTQLHFEVRQNGKPVNPNSYIAFX
               320       330
```

The following partial DNA sequence was identified in *N. gonorrhoeae* <SEQ ID 113>:

```
g031.seq
  1 ATGGTGTCCC TCCGCTTCAG ATTCGGCAAC CACTTTAAAC GCCGACATTC

 51 TGACAATTTC CTTTTCCGCC AGCCAAATAT CATGCGTATC TTTCGGTTCG

101 GGCTTGTTGG GCATGGCAAC CTTCAACAGC CGCGCCATCA CAGGAATCGT

151 CGTTCCCTGA ATCAGCAGCG ACAGCACCAC CACGGCAAAC GCCACATCAA

201 ACAGCAGGTG CGAATTGGGA ACGCCCATCA CCAGCGGCAT CATCGCCAGC

251 GAAATCGGTA CGGCTCCTCG CAAGCCCAAC CAACTGATAT ACGCCTTTTC

301 ACGCAGGCTG TAATTGAATT TCCACAAACC GCCGAACACT GCCAGCGGAC

351 GCGCGACCAG CATCAGGAAC GCCGCAATCG CCAAGGCTTC CGCCGCCCTG

401 TCCAACACGC CGGCGGGAGA AACCAGCAGA CCGAGCATGA CGAACAAAGT

451 TGCCTGCGCC AGCCAAGCCA AACCGTCCAT CACACGCAAA ACGTGTTCCG
```

-continued

```
501 TcgcACGGTT GCGCTGGTTA CCGACAATGA TGCCGGCAAG GTAAACCGCC

551 AAAAAGCCGC TGCCGCCTAT GGTATTGGTA AACGCAAACA CAAGCAGCCC

601 GCCCGACACA ATCATCAGCG CGTACAGACC TTCCGtacac acctccaatt

651 cccaatcaac gtcatagctg tctcccgtgt taaaatgttc ttcacttcag

701 aatccccccc ttcttcccag cccgaaacct tcatgtgtta naccctgggg

751 tgccccaacg gatttagtaa cctcccaatg actctgcttg tcgcccccttt

801 cgcccgcttt ctccttccgg gaaaacttgt tgtccccgtc ttacattaa
```

This corresponds to the amino acid sequence <SEQ ID 114; ORF 031.ng>:

```
g031.pep
  1 MVSLRFRFGN HFKRRHSDNF LFRQPNIMRI FRFGLVGHGN LQQPRHHRNR

 51 RSLNQQRQHH HGKRHIKQQV RIGNAHHQRH HRQRNRYGSS QAQPTDIRLF

101 TQAVIEFPQT AEHCQRTRDQ HQERRNRQGF RRPVQHAGGR NQQTEHDEQS

151 CLRQPSQTVH HTQNVFRRTV ALVTDNDAGK VNRQKAAAAY GIGKRKHKQP

201 ARHNHQRVQT FRTHLQFPIN VIAVSRVKMF FTSESPPSSQ PETFMCXTLG

251 CPNGFSNLPM TLLVAPFARF LLPGKLVVPV LH*
```

The following partial DNA sequence was identified in *N. meningitidis* <SEQ ID 115>:

```
m031.seq (partial)
  1 ...CGCCTGAAGC ACGGTGTCGG ACTGCATTTC TATTCGGCTA TACGCCTTTT

 51    CACGCAGGCT GTAATTGAAT TTCCACAAAC CGCCGAACAC TGCCGACGGA

101    CGCGCGACCA GCATCAGGAA CGCCGCAATC GCCAAgGCTT CCGCCGCCCT

151    GTCCAACACG TTGGCAGGAG AAACCAGCAG CAAAGGCATT CCCAAACGTG

201    CGGACAAAGT GGTCGAAACC ACGCTCAGAA ACAACAGTGC GCCACCCGGC

251    AG...
```

This corresponds to the amino acid sequence <SEQ ID 116; ORF 031>:

```
m031.pep (partial)
  1 ...RLKHGVGLHF YSAIRLFTQA VIEFPQTAEH CRRTRDQHQE RRNRQGFRRP

 51    VQHVGRRNQQ QRHSQTCGQS GRNHAQKQQC ATRQ....
```

The following partial DNA sequence was identified in *N. meningitidis* <SEQ ID 117>:

```
a031.seq
  1 ATACGCCTTT TCACGCAGGC TGTAATTGAA TTTCCACAAA CCGCCGAACA

 51 CTGCCGGCGG ACGCGCGACC AGCATCAGGA ACGCCGCAAT CGCCAAGGCT

101 TCCGCCGCCC CGTCCAACAC GTTGGCAGGA GAAACCAGCA GCAAAGGCAT

151 TCCCAAACGT GCGGACAAAG TGGTCGAAAC CACGCTCAGA AACAACAGTG

201 CGCCACCCGG CAG
```

This corresponds to the amino acid sequence <SEQ ID 118; ORF 031.a>:

```
a031.pep (partial)
   1 IRLFTQAVIE FPQTAEHCRR TRDQHQERRN RQGFRRPVQH VGRRNQQQRH

  51 SQTCGQSGRN HAQKQQCATR Q
```

m031/a031 100.0% identity over a 71 aa overlap

```
                   10        20        30        40        50        60
m031.pep  RLKHGVGLHFYSAIRLFTQAVIEFPQTAEHCRRTRDQHQERRNRQGFRRPVQHVGRRNQQ
                        ||||||||||||||||||||||||||||||||||||||||||||||
a031                    IRLFTQAVIEFPQTAEHCRRTRDQHQERRNRQGFRRPVQHVGRRNQQ
                                10        20        30        40
                   70        80
m031.pep  QRHSQTCGQSGRNHAQKQQCATRQ
          ||||||||||||||||||||||||
a031      QRHSQTCGQSGRNHAQKQQCATRQ
            50        60        70
```

Computer analysis of this amino acid sequence gave the following results:

Homology with a Predicted ORF from *N. gonorrhoeae*

ORF 031 shows 60.0% identity over a 85 aa overlap with a predicted ORF (ORF 031.ng) from *N. gonorrhoeae*:

```
m031/g031
                                                 10        20        30
m031.pep                                 RLKHGVGLHFYSAIRLFTQAVIEFPQTAEH
                                         | ::| :    : ||||||||||||||||
g031       NQQRQHHHGKRHIKQQVRIGNAHHQRHHRQRNRYGSSQAQPTDIRLFTQAVIEFPQTAEH
                  60        70        80        90       100       110
                40        50        60         70        80
m031.pep   CRRTRDQHQERRNRQGFRRPVQHVGRRNQQQRHS-QTCGQSGRNHAQKQQCATRQ
           |:|||||||||||||||||||||:| |||| :|: |:| ::  : ::: | : |:
g031       CQRTRDQHQERRNRQGFRRPVQHAGGRNQQTEHDEQSCLRQPSQTVHHTQNVFRRTVALV
                 120       130       140       150       160       170
g031       TDNDAGKVNRQKAAAAYGIGKRKHKQPARHNHQRVQTFRTHLQFPINVIAVSRVKMFFTS
                 180       190       200       210       220       230
```

The following partial DNA sequence was identified in *N. gonorrhoeae* <SEQ ID 119>:

```
g032.seq
   1 ATGCGGCGAA ACGTGCCTGC CGTCGCCGTA TTGCGCCGCC CACGATTCGA

  51 GGCGTTTTTG GATTTGGCGT TGGCTCAGGC GCGTGCCGTT CCTGCCGGTA

 101 AACAGGGCTT TGCCGTCCGA TGCCGTCTGA CGCAGCGGCA GATAGTTTTT

 151 CAAGGCTTCC ACGCTTTTGC CGGTCAGCGG AACCTGACGC TGCTTGCGCC

 201 CTTTGCCGGT AACGTGTACC CACGCTTCGT CCAAATATAC ATCATCTGCA

 251 TTCAAGCCGT GTATCTCGCT CACGCGCAAA CCGCTGCCGT ACATCAGCTC

 301 GAACAGCGCG TGGTCGCGCA CCGCCAGCGG GTCGCCGCCG TCCACGGGCA

 351 AATCCAACAT CCGGTTCAGC CATTCCTGCG GCAGGGCTTT GGGTACGCGC

 401 TCGGGCTGCT TCGGCGGTTT GATGTCGGCG GTCGGGTCGG CGCGCATCAG

 451 CCCGCGTTTG ACCAGCCAGG CGCAATACTG CCGCCACGCC GACAGCTTGC

 501 GCGCCAGCGT CCGACCGTCC AAACCGCGCT GCGACAGCCG CCGCAACGCC
```

-continued

```
551 GccgTAAAAT CGCGCCGCGA CAAGTCCTGC GGCACGCcgc ctgcaTCTTC

601 AGACGGCATT TGTGCCAACA GTGCAAACAG TTCTTCCAAA TCGCGCCGGT

651 ATGCCGCAAC CGTGTGCTCC GACTTGCCCT CGCGCACGAT GTTTTCCAAA

701 TAAGCGTCAA AATacgccgC AAACccgTCC AAAACCATAA CCGTCCCACA

751 CAAATATCAA AAAACCAGTG A
```

This corresponds to the amino acid sequence <SEQ ID 110; ORF 032.ng>:

```
g032.pep
  1 MRRNVPAVAV LRRPRFEAFL DLALAQARAV PAGKQGFAVR CRLTQRQIVF

 51 QGFHAFAGQR NLTLLAPFAG NVYPRFVQIY IICIQAVYLA HAQTAAVHQL

101 EQRVVAHRQR VAAVHGQIQH PVQPFLRQGF GYALGLLRRF DVGGRVGAHQ

151 PAFDQPGAIL PPRRQLARQR PTVQTALRQP PQRRRKIAPR QVLRHAACIF

201 RRHLCQQCKQ FFQIAPVCRN RVLRLALAHD VFQISVKIRR KPVQNHNRPT

251 QISKNQ*
```

The following partial DNA sequence was identified in *N. meningitidis* <SEQ ID 111>:

```
m032.seq (partial)
  1 ATGCGGCGAA ACGTGCmTGC mGTCGCCGTT kTGCGCCGCC CATTGCGCCA

 51 AACGTTTTTG GATTTGGCGT TGGCTCAGGC GCGTGCCGTT CCTGCCGGTA

101 AACAGGGCTT TGCCGTCCGA TGCCGTCTGA CGCAGCGGCA GATAGTTTTT

151 CAGGGCTTCC ACGCTTTTGC CGACCAGCGG CACCTGCCGC TgTT.GCGCC

201 CTTTGCCGAT AAcGTGTACC CACGCyTCGT CCAAATAGAC ATCATCTGCA

251 TTCAAGCCGT GTATCTCGCT CACGCGCAAA CCGCTGCCGT ACATCAGTTC

301 GAACAGGGCG TGGTCGCGCA CCGCCAGCGG GTCGCCGCCG TCCACGGGCA

351 AATCCAGCAT CCGGTTCAGC CATTCCTGCG GCAGGGCTTT GGGTACGCGC

401 TCGGGCTGCT TCGGCGGTTT GATGTCGGCG GTCGGGTCGG CGTGCATCAG

451 GCCGCGCTTT ACCAGCCAAA CGCAATACTG CCGCCAAGAC GAAAGCTTGC

501 GAGCCAGCGT CCGTTCCCCC AAACCGCG...
```

This corresponds to the amino acid sequence <SEQ ID 112; ORF 032>:

```
m032.pep (partial)
  1 MRRNVXAVAV XRRPLRQTFL DLALAQARAV PAGKQGFAVR CRLTQRQIVF

 51 QGFHAFADQR HLPLXAPFAD NVYPRXVQID IICIQAVYLA HAQTAAVHQF

101 EQGVVAHRQR VAAVHGQIQH PVQPFLRQGF GYALGLLRRF DVGGRVGVHQ

151 AALYQPNAIL PPRRKLASQR PFPQTA . . .
```

The following partial DNA sequence was identified in *N. meningitidis* <SEQ ID 113>:

```
a032.seq
  1 ATGCGGCGAA ACGTGCCTGC CGTCGCCGTT TTGCGCCGCC CATTGCGCCA

 51 AACGTTTTTG GATTTGGCGT TGGCTCAGGC GCGTGCCGTT CCTGCCGGTA
```

-continued

```
101 AACAGGGCTT TGCCGTCCGA TGCCGTCTGA CGCAGCGGCA GATAGTTTTT

151 CAGGGCTTCC ACGCTTTTGC CGGTCAGCGG AACCTGCCGC TGCTTGCGTC

201 CTTTGCCGGT AACGTGTACC CACGCCTCGT CCAAATATAC ATCATCTGCA

251 TTCAAGCCGT GTATCTCGCT CACGCGCAAA CCGCTGCCGT ACATCAGTTC

301 GAACAGCGCG TGATCGCGCA CCGCCAGCGG GTCGCCGCCG TCCACGGGCA

351 AATCCAGCAT CCGGTTCAGC CATTCCTGCG GCAGGGCTTT GGGTACGCGC

401 TCGGGCTGCT TCGGCGGTTT GATGTCGGCG GTCGGGTCGG TATGCAGCAG

451 ACCGCGTTTG ACCAGCCAGG CGCAATACTG CCGCCAAGAC GACAGCTTGC

501 GCGCCAGCGT CCGCGCATTC AAACCGCGCT GCGACAGCCG CCGCAACGCC

551 GCCGTAAAAT CGCGCTGCGA CAAGCCCTGC GGCACGCCGC CTGCATCTTC

601 AGACGGCATT TGTGCCAACA GCGCAAACAG TTCTTCCAAA TCGCGCCGGT

651 ATGCCGCCAC CGTGTGCTCC GACTTGCCCT CGCGCACGAT GTTTTCCAAA

701 TAAGCGTCAA AATGCGCCGC AAACCCGTCC AAAACCATAA CCGCCCCACA

751 CAAATATCAA AAAAACAGTG A
```

This corresponds to the amino acid sequence <SEQ ID 114; ORF 032.a>:

```
a032.pep
  1 MRRNVPAVAV LRRPLRQTFL DLALAQARAV PAGKQGFAVR CRLTQRQIVF

 51 QGFHAFAGQR NLPLLASFAG NVYPRLVQIY IICIQAVYLA HAQTAAVHQF

101 EQRVIAHRQR VAAVHGQIQH PVQPFLRQGF GYALGLLRRF DVGGRVGMQQ

151 TAFDQPGAIL PPRRQLARQR PRIQTALRQP PQRRRKIALR QALRHAACIF

201 RRHLCQQRKQ FFQIAPVCRH RVLRLALAHD VFQISVKMRR KPVQNHNRPT

251 QISKKQ*
```

m032/a032 88.1% identity over a 176 aa overlap

```
                    10        20        30        40        50        60
m032.pep   MRRNVXAVAVXRRPLRQTFLDLALAQARAVPAGKQGFAVRCRLTQRQIVFQGFHAFADQR
           ||||| |||| |||||||||||||||||||||||||||||||||||||||||||||| ||
a032       MRRNVPAVAVLRRPLRQTFLDLALAQARAVPAGKQGFAVRCRLTQRQIVFQGFHAFAGQR
                    10        20        30        40        50        60

                    70        80        90       100       110       120
m032.pep   HLPLXAPFADNVYPRXVQIDIICIQAVYLAHAQTAAVHQFEQGVVAHRQRVAAVHGQIQH
           :||| | || ||||| ||| |||||||||||||||||||||| |:|||||||||||||||
a032       NLPLLASFAGNVYPRLVQIYIICIQAVYLAHAQTAAVHQFEQRVIAHRQRVAAVHGQIQH
                    70        80        90       100       110       120

                   130       140       150       160       170
m032.pep   PVQPFLRQGFGYALGLLRRFDVGGRVGVHQAALYQPNAILPPRRKLASQRPFPQTA
           |||||||||||||||||||||||||||::|:|: ||:|||||||:|| |||  |||
a032       PVQPFLRQGFGYALGLLRRFDVGGRVGMQQTAFDQPGAILPPRRQLARQRPRIQTALRQP
                   130       140       150       160       170       180

a032       PQRRRKIALRQALRHAACIFRRHLCQQRKQFFQIAPVCRHRVLRLALAHDVFQISVKMRR
                   190       200       210       220       230       240
```

Computer analysis of this amino acid sequence gave the following results:

Homology with a Predicted ORF from *N. gonorrhoeae*

ORF 032 shows 86.4% identity over a 176 aa overlap with a predicted ORF (ORF 032.ng) from *N. gonorrhoeae*:

```
m032/g032

                    10        20        30        40        50        60
m032.pep    MRRNVXAVAVXRRPLRQTFLDLALAQARAVPAGKQGFAVRCRLTQRQIVFQGFHAFADQR
            ||||| |||| |||  ::||||||||||||||||||||||||||||||||||||||| ||
g032        MRRNVPAVAVLRRPRFEAFLDLALAQARAVPAGKQGFAVRCRLTQRQIVFQGFHAFAGQR
                    10        20        30        40        50        60
                    70        80        90       100       110       120
m032.pep    HLPLXAPFADNVYPRXVQIDIICIQAVYLAHAQTAAVHQFEQGVVAHRQRVAAVHGQIQH
            :| | |||| ||||| ||| |||||||||||||||||||:|| |||||||||||||||||
g032        NLTLLAPFAGNVYPRFVQIYIICIQAVYLAHAQTAAVHQLEQRVVAHRQRVAAVHGQIQH
                    70        80        90       100       110       120
                   130       140       150       160       170
m032.pep    PVQPFLRQGFGYALGLLRRFDVGGRVGVHQAALYQPNAILPPRRKLASQRPFPQTA
            |||||||||||||||||||||||||||:|| |: ||:|||||||:|| |||  |||
g032        PVQPFLRQGFGYALGLLRRFDVGGRVGAHQPAFDQPGAILPPRRQLARQRPTVQTALRQP
                   130       140       150       160       170       180
g032        PQRRRKIAPRQVLRHAACIFRRHLCQQCKQFFQIAPVCRNRVLRLALAHDVFQISVKIRR
                   190       200       210       220       230       240
```

The following partial DNA sequence was identified in *N. gonorrhoeae* <SEQ ID 115>:

```
g033.seq
   1 ATGGCGGCGG CGGACAAACT CTTGGGCGGC GACCGCCGCA GCGTCGCCAT

  51 CATCGGAGAC GGCGCGATGA CGGCGGGGCA GGCGTTTGAA GCCTTGAATT

 101 GCGCGGGCGA TATGGATGTG GATTTGCTGG TCGTCCTCAA CGACAACGAA

 151 ATGTCGATTT CCCCCAACGT CGGCGCGTTG CCCAAATATC TTGCCAGCAA

 201 CGTCGTGCGC GATATGCACG GACTGTTGAG TACCGTCAAA GCGCAAAcgg

 251 GCAAGGTATT AGACAAAATA CCCGGCGCGA TGGagtTTGC CCAAAAAGTC

 301 GAACAcaaaA TCAAAACCCT TGCCGAAGAA GCCGAACACG CCAAACAGTC

 351 GCTGTCGCTG TTTGAAAATT TCGGCTTCCG CTACACCGGC CCCGTGGACG

 401 GACACAACGT CGAGAATCTG GTGGACGTAT TGAAAGACTT GCGCAGCCGC

 451 AAAGGCCCTC AGTTGCTGCA CGTCATCACC AAAAAGGGCA ACGGCTACAA

 501 ACTCGCCGAA AACGACCCcg tcaAATACCA CGCCGTCGCc aACCTGCcta

 551 AAGAAGGCGG GGCGCAAATg ccGTCTGAAA AAGAACCCAA GCCCGCCgCc

 601 aaaccgACCT ATACCCAAGT ATTCGGCAAA TGGCTGTGCG ACCGGGCGGC

 651 GGCAGATTCC CGACTGGTTG CGATTACCCC CGCCATGCGC GAGGGCAGCG

 701 GACTGGTGGA GTTTGAACAA CGATTCCCCG ACCGCTATTT CGATGTCGGC

 751 ATCGCCGAGC AGCACGCCGT tacCTTTGCC GGCGGTTTGG CGTGCGAAGG

 801 CATGAAGCCC GTCGTGGCGA TTTATTCCAC CTTTTTACAA CGCGCCTACG

 851 ACCAACTGGT GCACGACATC GCCCTGCAAA ACCTGCCCGT TTTGTTTGCC

 901 GTCGACCGTG CGGGCATCGT CGGCGCGGAC GGTCCGACCC ATGCCGGCTT

 951 GTACGATTTG AGCTTCTTGC GCTGTGTGCC GAACATGATT GTTGCCGCGC

1001 CGAGCGATGA AAACGAATGC CGCCTGCTGC TTTCGACCTG CTATCAGGCG
```

-continued

```
1051 GATGCGCCCG CCGCCGTCCG CTATCCGCGC GGCACGGGTA CGGGCGCGCC
1101 GGTTTCAGAC GGCATGGAAA CCGTGGAAAT CGGCAAGGGC ATTATCCGCC
1151 GCGAAGGTGA GAAAACCGCC TTcatTGCCT TCGGCAGTAT GGTCGCCACC
1201 GCATTGGCGG TTGCCGAAAA ACTGAACGCC ACCGTCGCCG ATATGCGCTt
1251 cgtcaaacCG ATAGACGAAG AGTTGATTGT CCGCCTTGCC CGAAGCCAcg
1301 accGCATCGT TACCCTTGAA GAAAACGCCG AACAGGGCGG CGCAGGCGGC
1351 GCGGTCTTGG AAGTGTTGGC GAAACACGGC ATCTGCAAAC CCGTTTTGCT
1401 TTTGGGCGTT GCCGATACCG TAACCGAACA CGGCGATCCG AAAAAACTTT
1451 TGGACGATTT GGGTTTGAGT GCCGAAGCGG TGGAACGCCG GGTGCGCGAG
1501 TGGCTGCCGG ACCGTGATGC GGCAAATTAA
```

This corresponds to the amino acid sequence <SEQ ID 116; ORF 033.ng>:

```
g033.pep
  1 MAAADKLLGG DRRSVAIIGD GAMTAGQAFE ALNCAGDMDV DLLVVLNDNE
 51 MSISPNVGAL PKYLASNVVR DMHGLLSTVK AQTGKVLDKI PGAMEFAQKV
101 EHKIKTLAEE AEHAKQSLSL FENFGFRYTG PVDGHNVENL VDVLKDLRSR
151 KGPQLLHVIT KKGNGYKLAE NDPVKYHAVA NLPKEGGAQM PSEKEPKPAA
201 KPTYTQVFGK WLCDRAAADS RLVAITPAMR EGSGLVEFEQ RFPDRYFDVG
251 IAEQHAVTFA GGLACEGMKP VVAIYSTFLQ RAYDQLVHDI ALQNLPVLFA
301 VDRAGIVGAD GPTHAGLYDL SFLRCVPNMI VAAPSDENEC RLLLSTCYQA
351 DAPAAVRYPR GTGTGAPVSD GMETVEIGKG IIRREGEKTA FIAFGSMVAT
401 ALAVAEKLNA TVADMRFVKP IDEELIVRLA RSHDRIVTLE ENAEQGGAGG
451 AVLEVLAKHG ICKPVLLLGV ADTVTEHGDP KKLLDDLGLS AEAVERRVRE
501 WLPDRDAAN*
```

The following partial DNA sequence was identified in *N. meningitidis* <SEQ ID 117>:

```
m033.seq
  1 ATGGCGGCGG CAGACAAACT CTTGGGCAGC GACCGCCGCA GCGTCGCCAT
 51 CATCGGCGAC GGCGCGATGA CGGCGGGGCA GGCGTTTGAA GCCTTGAATT
101 GCGCaG.CGA TATGGATGTr GATTTGCTrG TCGTCCTCAA CGACAACGAA
151 ATGTCGATTT CCCCCAACGT CGGCGCGCTG CCGAAATACC TTGCCAGCAA
201 CGTCGTGCGC GATATGCACG GCCTGTTGAG TACCGTCAAA GCGCAAACGG
251 GCAAGGTATT AGACAAAATA CCCGGCGCGA TGGAGTTTGC CCAAAAAGTC
301 GAACACAAAA TCAAAACCCT TGCCGAAGAA GCCGAACACG CCAAACAGTC
351 GCTGTCTTTG TTTGAAAACT TCGGCTTCCG CTACACCGGC CCCGTGGACG
401 GACACAACGT CGAAAATCTG GTGGACGTAT TGAAAGACTT GCGCAGCCGC
451 AAAGGCCCTC AGTTGCTGCA CGTCATCACC AAAAAGGGCA ACGGCTACAA
501 ACTCGCCGAA AACGACCCCG TCAAATACCA CGCCGTCGCC AACCTGCCTA
551 AAGAAAGCGC GGCGCAAATG CCGTCTGAAA AAGAACCCAA GCCCGCCGCC
601 AAACCGACCT ATACCCAAGT GTTCGGCAAA TGGCTGTGCG ACCGGGCGGC
```

-continued

```
 651 GGCAGATTCC CGACTGGTTG CGATTACCCC CGCCATGCGC GAGGGCAGCG
 701 GCTTGGTTGA GTTTGAACAA CGATTCCCCG ACCGCTATTT CGATGTCGGC
 751 ATCGCCGAGC AGCACGCCGT TACCTTTGCC GGCGGTTTGG CTTGCGAAGG
 801 GATGAAGCCC GTCGTGGCGA TTTATTCCAC CTTTTTACAA CGCGCCTACG
 851 ACCAACTGGT GCACGACATC GCCCTGCAAA ACCTACCCGT TTTGTTTGCC
 901 GTCGACCGCG CGGGCATCGT CGGCGCGGAC GGCCCGACCC ATGCCGGTCT
 951 GTACGATTTG AGCTTTTTGC GCTGCGTGCC GAACATGATT GTCGCCGCGC
1001 CGAGCGATGA AAACGAATGC CGCCTGTTGC TTTCGACCTG CTATCAGGCA
1051 GACGCGCCCG CCGCCGTCCG CTATCCGCGC GGCACGGGTA CGGGCGCGCC
1101 GGTTTCAGAC GGCATGGAAA CCGTGGAAAT CGGCAAGGGC ATTATCCGCC
1151 GCGAAGGTGA GAAAACCGCA TTCATTGCCT TCGGCAGTAT GGTCGCCCCC
1201 GCATTGGCGG TTGCCGAAAA ACTGAACGCC ACCGTCGCCG ATATGCGCTT
1251 CGTCAAACCG ATAGACGAAG AGTTGATTGT CCGCCTTGCC CGAAGCCACG
1301 ACCGCATCGT TACCCTTGAA GAAAACGCCG AACAGGGCGG CGCAGGCGGC
1351 GCGGTGCTGG AAGTATTGGC GAAACACGGC ATCTGCAAAC CCGTTTTGCT
1401 TTTGGGCGTT GCCGATACCG TAACCGGACA CGGCGATCCG AAAAAACTTT
1451 TAGACGATTT GGGCTTGAGT GCCGAAGCGG TGGAACGGCG TGTGCGCGCG
1501 TGGCTGTCGG ATCGGGATGC GGCAAATTAA
```

This corresponds to the amino acid sequence <SEQ ID 118; ORF 033>:

```
m033.pep
  1 MAAADKLLGS DRRSVAIIGD GAMTAGQAFE ALNCAXDMDV DLLVVLNDNE
 51 MSISPNVGAL PKYLASNVVR DMHGLLSTVK AQTGKVLDKI PGAMEFAQKV
101 EHKIKTLAEE AEHAKQSLSL FENFGFRYTG PVDGHNVENL VDVLKDLRSR
151 KGPQLLHVIT KKGNGYKLAE NDPVKYHAVA NLPKESAAQM PSEKEPKPAA
201 KPTYTQVFGK WLCDRAAADS RLVAITPAMR EGSGLVEFEQ RFPDRYFDVG
251 IAEQHAVTFA GGLACEGMKP VVAIYSTFLQ RAYDQLVHDI ALQNLPVLFA
301 VDRAGIVGAD GPTHAGLYDL SFLRCVPNMI VAAPSDENEC RLLLSTCYQA
351 DAPAAVRYPR GTGTGAPVSD GMETVEIGKG IIRREGEKTA FIAFGSMVAP
401 ALAVAEKLNA TVADMRFVKP IDEELIVRLA RSHDRIVTLE ENAEQGGAGG
451 AVLEVLAKHG ICKPVLLLGV ADTVTGHGDP KKLLDDLGLS AEAVERRVRA
501 WLSDRDAAN*
```

The following partial DNA sequence was identified in *N. meningitidis* <SEQ ID 119>:

```
a033.seq
  1 ATGGCGGCGG CGGACAAACA GTTGGGCAGC GACCGCCGCA GCGTCGCCAT
 51 CATCGGCGAC GGCGCGATGA CGGCGGGTCA GGCGTTTGAA GCCTTGAACT
101 GCGCGGGCGA TATGGATGTG GATTTGCTGG TCGTCCTCAA CGACAACGAA
151 ATGTCGATTT CCCCCAACGT CGGTGCGTTG CCCAAATACC TTGCCAGCAA
201 CGTCGTGCGC GATATGCACG GACTGTTGAG TACCGTCAAA GCGCAAACGG
```

-continued

```
 251 GCAAGGTATT AGACAAAATA CCCGGCGCGA TGGAGTTTGC CCAAAAAGTC

 301 GAACATAAAA TCAAAACCCT TGCCGAAGAA GCCGAACACG CCAAACAGTC

 351 ACTGTCTTTG TTTGAAAACT TCGGCTTCCG CTATACCGGC CCCGTGGACG

 401 GACACAACGT CGAAAATCTG GTCGATGTAT TGGAAGACCT GCGCGGACGC

 451 AAAGGCCCGC AGCTTCTGCA CGTCATCACC AAAAAGGGCA ACGGCTACAA

 501 ACTCGCCGAA AACGATCCCG TCAAATACCA CGCCGTCGCC AACCTGCCTA

 551 AAGAAAGCGC GGCGCAAATG CCGTCTGAAA AAGAACCCAA GCCCGCCGCC

 601 AAACCGACCT ATACCCAAGT GTTCGGCAAA TGGCTGTGCG ACCGGGCGGC

 651 GGCAGATTCC CGACTGGTTG CGATTACCCC CGCCATGCGC GAGGGCAGCG

 701 GCTTGGTTGA GTTTGAACAA CGATTCCCCG ACCGCTATTT CGATGTCGGC

 751 ATCGCCGAGC AGCACGCCGT TACCTTTGCC GGCGGTTTGG CTTGCGAAGG

 801 GATGAAGCCC GTCGTGGCGA TTTATTCCAC CTTTTTACAA CGCGCCTACG

 851 ACCAACTGGT GCACGACATC GCCCTGCAAA ACCTGCCCGT TTTGTTTGCC

 901 GTCGACCGCG CGGGCATCGT CGGCGCGGAC GGCCCGACCC ATGCCGGTTT

 951 GTACGATTTA AGCTTTTTGC GCTGCATTCC GAATATGATT GTCGCCGCGC

1001 CGAGCGATGA AAATGAATGC CGCCTGCTGC TTTCGACCTG CTATCAGGCA

1051 GACGCGCCCG CCGCCGTCCG CTATCCGCGC GGCACGGGTA CGGGCGTGCC

1101 GGTTTCAGAC GGCATGGAAA CCGTGGAAAT CGGCAAGGGC ATTATCCGCC

1151 GCGAAGGTGA GAAAACCGCA TTCATTGCCT TCGGCAGTAT GGTCGCCCCT

1201 GCATTGGCGG TCGCCGGAAA ACTGAACGCC ACCGTCGCCG ATATGCGCTT

1251 CGTCAAACCG ATAGACGAAG AGTTGATTGT CCGCCTTGCC CGAAGCCACG

1301 ACCGCATCGT TACCCTTGAA GAAAACGCCG AACAGGGCGG CGCAGGCAGC

1351 GCGGTGCTGG AAGTGTTGGC GAAACACGGC ATCTGCAAAC CCGTCTTGCT

1401 TTTGGGCGTT GCCGATACCG TAACCGGACA CGGCGATCCG AAAAAACTTT

1451 TAGACGATTT GGGCTTGAGT GCCGAAGCGG TGGAACGGCG TGTGCGCGCG

1501 TGGCTGTCGG ATCGGGATGC GGCAAATTAA
```

This corresponds to the amino acid sequence <SEQ ID 120; ORF 033.a>:

```
a033.pep
  1 MAAADKQLGS DRRSVAIIGD GAMTAGQAFE ALNCAGDMDV DLLVVLNDNE

 51 MSISPNVGAL PKYLASNVVR DMHGLLSTVK AQTGKVLDKI PGAMEFAQKV

101 EHKIKTLAEE AEHAKQSLSL FENFGFRYTG PVDGHNVENL VDVLEDLRGR

151 KGPQLLHVIT KKGNGYKLAE NDPVKYHAVA NLPKESAAQM PSEKEPKPAA

201 KPTYTQVFGK WLCDRAAADS RLVAITPAMR EGSGLVEFEQ RFPDRYFDVG

251 IAEQHAVTFA GGLACEGMKP VVAIYSTFLQ RAYDQLVHDI ALQNLPVLFA

301 VDRAGIVGAD GPTHAGLYDL SFLRCIPNMI VAAPSDENEC RLLLSTCYQA

351 DAPAAVRYPR GTGTGVPVSD GMETVEIGKG IIRREGEKTA FIAFGSMVAP

401 ALAVAGKLNA TVADMRFVKP IDEELIVRLA RSHDRIVTLE ENAEQGGAGS

451 AVLEVLAKHG ICKPVLLLGV ADTVTGHGDP KKLLDDLGLS AEAVERRVRA

501 WLSDRDAAN*
```

m033/a033 98.4% identity over a 509 aa overlap

```
                 10        20        30        40        50        60
m033.pep MAAADKLLGSDRRSVAIIGDGAMTAGQAFEALNCAXDMDVDLLVVLNDNEMSISPNVGAL
         |||||| ||||||||||||||||||||||||||||| |||||||||||||||||||||||
a033     MAAADKQLGSDRRSVAIIGDGAMTAGQAFEALNCAGDMDVDLLVVLNDNEMSISPNVGAL
                 10        20        30        40        50        60

                 70        80        90       100       110       120
m033.pep PKYLASNVVRDMHGLLSTVKAQTGKVLDKIPGAMEFAQKVEHKIKTLAEEAEHAKQSLSL
         ||||||||||||||||||||||||||||||||||||||||||||||||||||||||||||
a033     PKYLASNVVRDMHGLLSTVKAQTGKVLDKIPGAMEFAQKVEHKIKTLAEEAEHAKQSLSL
                 70        80        90       100       110       120

                130       140       150       160       170       180
m033.pep FENFGFRYTGPVDGHNVENLVDVLKDLRSRKGPQLLHVITKKGNGYKLAENDPVKYHAVA
         ||||||||||||||||||||||||:|||:|||||||||||||||||||||||||||||||
a033     FENFGFRYTGPVDGHNVENLVDVLEDLRGRKGPQLLHVITKKGNGYKLAENDPVKYHAVA
                130       140       150       160       170       180

                190       200       210       220       230       240
m033.pep NLPKESAAQMPSEKEPKPAAKPTYTQVFGKWLCDRAAADSRLVAITPAMREGSGLVEFEQ
         ||||||||||||||||||||||||||||||||||||||||||||||||||||||||||||
a033     NLPKESAAQMPSEKEPKPAAKPTYTQVFGKWLCDRAAADSRLVAITPAMREGSGLVEFEQ
                190       200       210       220       230       240

                250       260       270       280       290       300
m033.pep RFPDRYFDVGIAEQHAVTFAGGLACEGMKPVVAIYSTFLQRAYDQLVHDIALQNLPVLFA
         ||||||||||||||||||||||||||||||||||||||||||||||||||||||||||||
a033     RFPDRYFDVGIAEQHAVTFAGGLACEGMKPVVAIYSTFLQRAYDQLVHDIALQNLPVLFA
                250       260       270       280       290       300

                310       320       330       340       350       360
m033.pep VDRAGIVGADGPTHAGLYDLSFLRCVPNMIVAAPSDENECRLLLSTCYQADAPAAVRYPR
         |||||||||||||||||||||||||:||||||||||||||||||||||||||||||||||
a033     VDRAGIVGADGPTHAGLYDLSFLRCIPNMIVAAPSDENECRLLLSTCYQADAPAAVRYPR
                310       320       330       340       350       360

                370       380       390       400       410       420
m033.pep GTGTGAPVSDGMETVEIGKGIIRREGEKTAFIAFGSMVAPALAVAEKLNATVADMRFVKP
         |||||:||||||||||||||||||||||||||||||||||||||| ||||||||||||||
a033     GTGTGVPVSDGMETVEIGKGIIRREGEKTAFIAFGSMVAPALAVAGKLNATVADMRFVKP
                370       380       390       400       410       420

                430       440       450       460       470       480
m033.pep IDEELIVRLARSHDRIVTLEENAEQGGAGGAVLEVLAKHGICKPVLLLGVADTVTGHGDP
         |||||||||||||||||||||||||||||:||||||||||||||||||||||||||||||
a033     IDEELIVRLARSHDRIVTLEENAEQGGAGSAVLEVLAKHGICKPVLLLGVADTVTGHGDP
                430       440       450       460       470       480

                490       500       510
m033.pep KKLLDDLGLSAEAVERRVRAWLSDRDAANX
         ||||||||||||||||||||||||||||||
a033     KKLLDDLGLSAEAVERRVRAWLSDRDAANX
                490       500       510
```

Computer analysis of this amino acid sequence gave the following results:

Homology with a Predicted ORF from *N. gonorrhoeae*

ORF 033 shows 98.4% identity over a 509 aa overlap with a predicted ORF (ORF 033.ng) from *N. gonorrhoeae*:

```
m033/g033

m033.pep MAAADKLLGSDRRSVAIIGDGAMTAGQAFEALNCAXDMDVDLLVVLNDNEMSISPNVGAL  60
         |||||||||:|||||||||||||||||||||||||| |||||||||||||||||||||||
g033     MAAADKLLGGDRRSVAIIGDGAMTAGQAFEALNCAGDMDVDLLVVLNDNEMSISPNVGAL  60
m033.pep PKYLASNVVRDMHGLLSTVKAQTGKVLDKIPGAMEFAQKVEHKIKTLAEEAEHAKQSLSL 120
         ||||||||||||||||||||||||||||||||||||||||||||||||||||||||||||
g033     PKYLASNVVRDMHGLLSTVKAQTGKVLDKIPGAMEFAQKVEHKIKTLAEEAEHAKQSLSL 120
m033.pep FENFGFRYTGPVDGHNVENLVDVLKDLRSRKGPQLLHVITKKGNGYKLAENDPVKYHAVA 180
         ||||||||||||||||||||||||||||||||||||||||||||||||||||||||||||
g033     FENFGFRYTGPVDGHNVENLVDVLKDLRSRKGPQLLHVITKKGNGYKLAENDPVKYHAVA 180
m033.pep NLPKESAAQMPSEKEPKPAAKPTYTQVFGKWLCDRAAADSRLVAITPAMREGSGLVEFEQ 240
         |||||::|||||||||||||||||||||||||||||||||||||||||||||||||||||
g033     NLPKEGGAQMPSEKEPKPAAKPTYTQVFGKWLCDRAAADSRLVAITPAMREGSGLVEFEQ 240
m033.pep RFPDRYFDVGIAEQHAVTFAGGLACEGMKPVVAIYSTFLQRAYDQLVHDIALQNLPVLFA 300
         ||||||||||||||||||||||||||||||||||||||||||||||||||||||||||||
g033     RFPDRYFDVGIAEQHAVTFAGGLACEGMKPVVAIYSTFLQRAYDQLVHDIALQNLPVLFA 300
m033.pep VDRAGIVGADGPTHAGLYDLSFLRCVPNMIVAAPSDENECRLLLSTCYQADAPAAVRYPR 360
         ||||||||||||||||||||||||||||||||||||||||||||||||||||||||||||
g033     VDRAGIVGADGPTHAGLYDLSFLRCVPNMIVAAPSDENECRLLLSTCYQADAPAAVRYPR 360
```

-continued

```
m033.pep GTGTGAPVSDGMETVEIGKGIIRREGEKTAFIAFGSMVAPALAVAEKLNATVADMRFVKP 420
         |||||||||||||||||||||||||||||||||||||| |||||||||||||||||||
g033     GTGTGAPVSDGMETVEIGKGIIRREGEKTAFIAFGSMVATALAVAEKLNATVADMRFVKP 420

m033.pep IDEELIVRLARSHDRIVTLEENAEQGGAGGAVLEVLAKHGICKPVLLLGVADTVTGHGDP 480
         |||||||||||||||||||||||||||||||||||||||||||||||||||||| ||||
g033     IDEELIVRLARSHDRIVTLEENAEQGGAGGAVLEVLAKHGICKPVLLLGVADTVTEHGDP 480

m033.pep KKLLDDLGLSAEAVERRVRAWLSDRDAANX                               510
         |||||||||||||||||| || |||||||
g033     KKLLDDLGLSAEAVERRVREWLPDRDAANX                               510
```

The following partial DNA sequence was identified in *N. gonorrhoeae* <SEQ ID 121>:

```
g034.seq
   1 ATGAGCCGTT TATGGTTTTT TGCCGTAAAA AACATTATAA TCCGCCTTAT
  51 TTACCTATTG CCCAAGGAGA CACAAATGGC ACTCGTATCC ATGCGCCAAC
 101 TGCTTGACCA CGCCGCCGAA AACAGCTACG GCCTGCCCGC GTTCAACGTC
 151 AACAACCTCG AACAAATGCG CGCCATTATG GAAGCCGCCG ACCAAGTCAA
 201 CGCGCCCGTC ATCGTACAGG CGAGCGCAGG TGCGCGCAAA TACGcggGCG
 251 CGCCGTTTTT GCGCCACCTG ATTCTGGCGG CAGTCGAAGA ATTTCCGCAC
 301 ATCCCCGTCG TGATGCACCA AGACCACGGC GCATCGCCCG ACGTgtgCCA
 351 ACGCTCCATC CAACTGGGCT TCTCCTCCGT GATGATGGAC GGCTCTTTGC
 401 TCGAAGACGG CAAAACCCCT TCTTCTTACG AATACAACGT CAACGCCACC
 451 CGTACCGTCG TCAACTTCTC CCACGCCTGC GGCGTGTCCG TCGAAGGCGA
 501 AATCGGCGTA TTGGGCAACC TCGAAACCGG CGAAGCAGGC GAAGAAGACG
 551 GAGTGGGCGC GGCAGGCAAA CTCTCACACG ACCAAATGCT CACCAGCGTT
 601 GAAGATGCCG TGCGTTTCGT TAAAGATACC GGCGTTGACG CATTGGCGAT
 651 TGCCGTCGGC ACCAGCCACG GCGCATACAA ATTCACCCGT CCGCCCACAG
 701 GCGACGTATT GCGTATCGAC CGCATCAAGG AAATCCACCA AGCCCTGCCC
 751 AATACACACA TCGTGATGCA CGgctCCAGC TCCGTTCCGC AAGAatgGCT
 801 GAAAGTCATC AACGAATACG GCGGCAATAT CGGCGAAACC TACGGCGTGC
 851 CGGTTGAAGA AATCGTCGAA GGCATCAAAC ACGGCGTGCG CAAAGTCAAC
 901 ATCGATACCG ACCTGCGCCT CGCTTCCACC GGCGCGGTAC GCCGCTACCT
 951 TGCCGAAAAC CCGTCCGACT TTGATCCGCG CAAATACTTG GGCAAAACCA
1001 TTGAAGCGAT GAAGCAAATC TGCCTCGACC GTTATCTTGC GTTCGGTTGC
1051 GAAGGTCAGG CAGGCAAAAT CAAACCTGTT TCGTTGGAAA AAATGGCAAG
1101 CCCTTATCCC AAGGGCGAAT TGAACCAAAT CGTCAAATAA
```

This corresponds to the amino acid sequence <SEQ ID 122; ORF 034.ng>:

g034.pep

1 <u>MSRLWFFAVK NIIIRLIYLL PKETOMALVS MRQLLDHA</u>AE NSYGLPAFNV

51 NNLEQMRAIM EAADQVNAPV IVQASAGARK YAGAPFLRHL ILAAVEEFPH

101 IPVVMHQDHG ASPDVCQRSI QLGFSSVMMD GSLLEDGKTP SSYEYNVNAT

151 RTVVNFSHAC GVSVEGEIGV LGNLETGEAG EEDGVGAAGK LSHDQMLTSV

201 EDAVRFVKDT GVDALAIAVG TSHGAYKFTR PPTGDVLRID RIKEIHQALP

-continued

```
251 NTHIVMHGSS SVPQEWLKVI NEYGGNIGET YGVPVEEIVE GIKHGVRKVN

301 IDTDLRLAST GAVRRYLAEN PSDFDPRKYL GKTIEAMKQI CLDRYLAFGC

351 EGQAGKIKPV SLEKMASRYA KGELNQIVK*
```

The following partial DNA sequence was identified in *N. meningitidis* <SEQ ID 123>:

```
m034.seq (partial)
  1 ATGAGCTGTT TATGGTTTTT TGCTGTAAAA AACATTATAA TCCGCCTTAT

 51 TTACCTATTG CCCAAGGAGA CACAAATGGC ACTCGTATCC ATGCGCCAAC

101 TGCTTGATCA TGCTGCCGAA wACAGCTACG GCyTGCCGGC GTTCAACGTC

151 AACAACCTCG wACAGATGCG CGCCATCATG GAGGCTGCAG ACCAAGTCGA

201 CGCCCCCGTC ATCGTACAGG CGAGTGCCGG TGCGCGCAAA TATGCGGGTG

251 CGCCGTTTTT ACGCCACCTG ATTTTGGCGG CTGTCGAAGT ATTTCCACAC

301 ATCCCCGTCG TCATGCACCA AGACCACGGC GCATCACCCG ACGTGTGCCA

351 ACGCTCCATC CAACTGGGCT TCTCCTCTGT AATGATGGAC GGCTCGCTGA

401 TGGAAGACGG CAAAACCCCT TCTTCTTACG AATACAACGT CAACGCCACA

451 CGTACCGTGG TTAACTTCTC CCACGCTTGC GGCGTATCCG TTGAAGGCGA

501 AATCGGCGTA TTGGGCAACC TCGAAACCGG CGATGCAGGC GAAGAAGACG

551 GTGTAGGCGC AGTGGGCAAA CTTTCCCACG ACCAAATGCT GACCAGCGTC

601 GAAGATGCCG TATGTTTCGT TAAAGATACC GGCGTTGACG CATTGGCTAT

651 TGCCGTCGGC ACCAGCCACG GCGCATACAA ATTCACCCGT CCGCCCACAG

701 GCGATGTATT ACGTATCGAC CGCATCAAAG AAATCCACCA AGCCCTGCCC

751 AATACACACA TCGTGATGCA C . . .
```

This corresponds to the amino acid sequence <SEQ ID 124; ORF 034>:

```
m034.pep (partial)
  1 MSCLWFFAVK NIIIRLIYLL PKETQMALVS MRQLLDHAAE XSYGLPAFNV

 51 NNLXQMRAIM EAADQVDAPV IVQASAGARK YAGAPFLRHL ILAAVEVFPH

101 IPVVMHQDHG ASPDVCQRSI QLGFSSVMMD GSLMEDGKTP SSYEYNVNAT

151 RTVVNFSHAC GVSVEGEIGV LGNLETGDAG EEDGVGAVGK LSHDQMLTSV

201 EDAVCFVKDT GVDALAIAVG TSHGAYKFTR PPTGDVLRID RIKEIHQALP

251 NTHIVMH . . .
```

The following partial DNA sequence was identified in *N. meningitidis* <SEQ ID 125>:

```
a034.seq
  1 ATGAGCCGTT TATGGTTTTT TGCCGCAAAA AACATTATAA TCCGCCTTAT

 51 TTACCTATTG CCCAAGGAGA CACAAATGGC ACTCGTATCC ATGCGCCAAC

101 TGCTTGATCA TGCTGCCGAA AACAGCTACG GCCTGCCCGC GTTCAACGTC

151 AACAACCTCG AACAAATGCG CGCCATTATG GAAGCCGCCG ACCAAGTCAA

201 CGCGCCCGTC ATCGTACAGG CGAGCGCAGG TGCGCGCAAA TACGCGGGCG

251 CGCCGTTTTT GCGCCACCTG ATTTTGGCGG CTGTCGAAGA ATTTCCGCAC
```

-continued

```
 301 ATCCCCGTCG TGATGCACCA AGACCACGGC GCATCGCCCG ACGTGTGCCA

 351 ACGCTCCATC CAACTGGGCT TTTCCTCCGT GATGATGGAC GGCTCGCTGA

 401 TGGAAGACGG CAAAACCCCT TCTTCTTATG AATACAACGT CAACGCCACC

 451 CGTACCGTGG TTAATTTCTC CCACGCCTGC GGCGTATCCG TTGAAGGCGA

 501 AATCGGCGTA TTGGGCAACC TCGAAACTGG CGAAGCCGGC GAAGAAGACG

 551 GTGTAGGCGC AGTGGGCAAA CTTTCCCACG ACCAAATGCT CACCAGCGTC

 601 GAAGATGCCG TGCGTTTCGT TAAAGATACC GGCGTTGACG CATTGGCGAT

 651 TGCCGTCGGC ACCAGCCACG GCGCGTACAA ATTCACCCGT CCGCCCACAG

 701 GCGACGTGTT GCGTATCGAC CGCATCAAAG AAATCCACCA AGCCCTGCCC

 751 AATACACACA TCGTGATGCA CGGCTCCAGC TCCGTTCCGC AAGAATGGCT

 801 GAAAGTCATC AACGAATACG GCGGCAATAT CGGCGAAACC TACGGCGTGC

 851 CGGTTGAAGA AATCGTCGAA GGCATCAAAC ACGGCGTGCG TAAAGTCAAC

 901 ATCGATACCG ACTTGCGCCT TGCTTCCACC GGCGCGGTAC GCCGCTACCT

 951 TGCCGAAAAC CCGTCCGACT TCGATCCGCG CAAATATTTG AGCAAAACCA

1001 TTGAAGCGAT GAAGCAAATC TGCCTCGACC GCTACCTCGC GTTCGGTTGC

1051 GAAGGTCAGG CAGGCAAAAT CAAACCGGTT TCCTTGGAAA AAATGGCAAA

1101 CCGTTATGCC AAGGGCGAAT TGAACCAAAT CGTCAAATAA
```

This corresponds to the amino acid sequence <SEQ ID 126; ORF 034.a>:

```
a034.pep
  1 MSRLWFFAAK NIIIRLIYLL PKETQMALVS MRQLLDHAAE NSYGLPAFNV

 51 NNLEQMRAIM EAADQVNAPV IVQASAGARK YAGAPFLRHL ILAAVEEFPH

101 IPVVMHQDHG ASPDVCQRSI QLGFSSVMMD GSLMEDGKTP SSYEYNVNAT

151 RTVVNFSHAC GVSVEGEIGV LGNLETGEAG EEDGVGAVGK LSHDQMLTSV

201 EDAVRFVKDT GVDALAIAVG TSHGAYKFTR PPTGDVLRID RIKEIHQALP

251 NTHIVMHGSS SVPQEWLKVI NEYGGNIGET YGVPVEEIVE GIKHGVRKVN

301 IDTDLRLAST GAVRRYLAEN PSDFDPRKYL SKTIEAMKQI CLDRYLAFGC

351 EGQAGKIKPV SLEKMANRYA KGELNQIVK*
```

m034/a034 96.9% identity over a 257 aa overlap

```
                    10        20        30        40        50        60
m034.pep    MSCLWFFAVKNIIIRLIYLLPKETQMALVSMRQLLDHAAEXSYGLPAFNVNNLXQMRAIM
            || |||||:||||||||||||||||||||||||||||||| |||||||||||| ||||||
a034        MSRLWFFAAKNIIIRLIYLLPKETQMALVSMRQLLDHAAENSYGLPAFNVNNLEQMRAIM
                    10        20        30        40        50        60

                    70        80        90       100       110       120
m034.pep    EAADQVDAPVIVQASAGARKYAGAPFLRHLILAAVEVFPHIPVVMHQDHGASPDVCQRSI
            ||||||:||||||||||||||||||||||||||||| |||||||||||||||||||||||
a034        EAADQVNAPVIVQASAGARKYAGAPFLRHLILAAVEEFPHIPVVMHQDHGASPDVCQRSI
                    70        80        90       100       110       120

                   130       140       150       160       170       180
m034.pep    QLGFSSVMMDGSLMEDGKTPSSYEYNVNATRTVVNFSHACGVSVEGEIGVLGNLETGDAG
            |||||||||||||||||||||||||||||||||||| ||||||||||||||||||||:||
a034        QLGFSSVMMDGSLMEDGKTPSSYEYNVNATRTVVNFSHACGVSVEGEIGVLGNLETGEAG
                   130       140       150       160       170       180
```

-continued

```
                190        200        210        220        230        240
m034.pep  EEDGVGAVGKLSHDQMLTSVEDAVCFKKDTGVDALAIAVGTSHGAYKFTRPPTGDVLRID
          |||||||||||||||||||||||| | |||||||||||||||||||||||||||||||||
a034      EEDGVGAVGKLSHDQMLTSVEDAVRFVKDTGVDALAIAVGTSHGAYKFTRPPTGDVLRID
                190        200        210        220        230        240

                250
m034.pep  RIKEIHQALPNTHIVMH
          |||||||||||||||||
a034      RIKEIHQALPNTHIVMHGSSSVPQEWLKVINEYGGNIGETYGVPVEEIVEGIKHGVRKVN
                250        260        270        280        290        300
```

Computer analysis of this amino acid sequence gave the following results:

Homology with a Predicted ORF from *N. gonorrhoeae*

ORF 034 shows 96.5% identity over a 257 aa overlap with a predicted ORF (ORF 034.ng) from *N. gonorrhoeae*:

```
m034/g034

m034.pep  MSCLWFFAVKNIIIRLIYLLPKETQMALVSMRQLLDHAAEXSYGLPAFNVNNLXQMRAIM   60
          || ||||||||||||||||||||||||||||||||||||| |||||||||||| ||||||
g034      MSRLWFFAVKNIIIRLIYLLPKETQMALVSMRQLLDHAAENSYGLPAFNVNNLEQMRAIM   60
m034.pep  EAADQVDAPVIVQASAGARKYAGAPFLRHLILAAVEVFPHIPVVMHQDHGASPDVCQRSI  120
          ||||||:||||||||||||||||||||||||||||| |||||||||||||||||||||||
g034      EAADQVNAPVIVQASAGARKYAGAPFLRHLILAAVEEFPHIPVVMHQDHGASPDVCQRSI  120
m034.pep  QLGFSSVMMDGSLMEDGKTPSSYEYNVNATRTVVNFSHACGVSVEGEIGVLGNLETGDAG  180
          |||||||||||||:|||||||||||||||||||||||||||||||||||||||||||:||
g034      QLGFSSVMMDGSLLEDGKTPSSYEYNVNATRTVVNFSHACGVSVEGEIGVLGNLETGEAG  180
m034.pep  EEDGVGAVGKLSHDQMLTSVEDAVCFVKDTGVDALAIAVGTSHGAYKFTRPPTGDVLRID  240
          |||||||:|||||||||||||||| |||||||||||||||||||||||||||||||||||
g034      EEDGVGAAGKLSHDQMLTSVEDAVRFVKDTGVDALAIAVGTSHGAYKFTRPPTGDVLRID  240
m034.pep  RIKEIHQALPNTHIVMH                                            257
          |||||||||||||||||
g034      RIKEIHQALPNTHIVMHGSSSVPQEWLKVINEYGGNIGETYGVPVEEIVEGIKHGVRKVN  300
```

The following partial DNA sequence was identified in *N. gonorrhoeae* <SEQ ID 127>:

```
g036.seq
  1 ATGCTGAAGC CGTGTTTGGT ATACAGTGCC TGTGCGGCGG cgttgcCTGC

 51 GCGGACTTCG AGCAGCAGGC GTTGCGTGCC TTCGGGCAGA TGTGCGTACC

101 AATATTCGAG CAGGGCGGAC GCAACGCCCC GTCGGCGGCA TTCGGGCGCG

151 GTGGCAATCA GGTGCAGTTC GGATTCGTCG GGCAGGTTCT GCCAAACGAT

201 AAAGGCGGCA ATCCTGCCGT CTTTTTCCGC AAGGAAAACC TGTTCGGACG

251 GCGAAACAAG CGCGGACTCA AATTGGCGTT GCGTCCACGC GGACGGGTTG

301 CAGACGGTAT CGAGCGCGGC CAGTGCGGCG CAGTCGGACG GTGAGGCTGG

351 GCGGATGTTC ATGTTCGTGC CTTCCGTTCC GCCTGTTCTT TGGCAGTCAG

401 GGCGATTTTG TTGCGGACGT AGAGCAGTTC GGCGTGTGCC GCGCCAGTTG

451 CGGGATAGCC GCCGCCGAGG GCGAGCGCGA GAAAATCGGC GGCGGTCGGC

501 ATATCGGGTT TGCCTGAGAA GGGCGGACGG TTTTCCAGTG CGAACGCACT

551 GCCGATGCCG TCTGAAAAGA CGTACCCCTC GGGGAGGGCA ATGTCTGCCG

601 CCCTACCGAC TTGATAATCG CTCAAACGGC GGCGGTTCAG CGTGTCGAAC

651 CACGCATAAA ACACTTCGCC CATACGCGCG TCCGCAGCGG CGAGTATGCA
```

-continued

```
701 GCTTTGCGGC GGCGGCAGCG AGGCGGCGGC ATCGAGCGTG GGGATGCCGA

751 TTAAAGGCGT GTCGAACGGC GTTGCCAAAC CTTGCGCCAC GCCGATGCCG

801 ATACGCAGTC CGGTAA
```

This corresponds to the amino acid sequence <SEQ ID 128; ORF 036.ng>:

```
g036.pep
  1 MLKPCLVYSA CAAALPARTS SSRRCVPSGR CAYQYSSRAD ATPRRRHSGA

 51 VAIRCSSDSS GRFCQTIKAA ILPSFSARKT CSDGETSADS NWRCVHADGL

101 QTVSSAASAA QSDGEAGRMF MFVPSVPPVL WQSGRFCCGR RAVRRVPRQL

151 RDSRRRGRAR ENRRRSAYRV CLRRADGFPV RTHCRCRLKR RTPRGGQCLP

201 PYRLDNRSNG GGSACRTTHK TLRPYARPQR RVCSFAAAAA RRRHRAWGCR

251 LKACRTALPN LAPRRCRYAV R*
```

The following partial DNA sequence was identified in *N. meningitidis* <SEQ ID 129>:

```
m036.seq
  1 ATGCTGAAGC CGTGCGCCGT GTACAGTGCC TGTGCGGCGG TGTTGCCTGC

 51 ACGGACTTCG AGCAGCAGGC GTTGCGTGTC TTCGGGCAGA TGTGTGAACC

101 AATATTCGAG CAGGGCGGAC GCAATTCCTT GGCGGCGGCA TTCGGGCGCG

151 GTGGCAATCA GGTGCAGTTC GGATTCGTCG GGCAGGTTCT GCCAAACGAT

201 AAAGGCGGCA ATCCCg.CGT CTTTTTCCGC AAGGAAAACC TGTTCGGACG

251 GCGAAACCAG TGCGGACTCA AATTGGCGTT GCGTCCATGC GGACGGGTTG

301 CAGACGGCAT CGAGTGCGGC CAGCTCCTCA CAATCGGCAC AAACGGCACG

351 GCGGATGTTC ACGGGCGCGC TCTCCGTTCG GCCTGTTCTT TGGCAGTCAG

401 GGCGATTTTG TTGCGGACGT AGAGCAAACC GGCGTGTGCG GCATGGACGG

451 CAGGATAACC GCCCTTGGCT GCCAATGCGA GAAAGTCGGC GGCAGTCGGC

501 ATATCCGGTC TGCCTGAGAA CGGCGGAGCT TCTTCCAGCG CGAACGCGCT

551 GCCTATGCCG TCTGAAAAGG CGCATCCCTC CGGCAGCCGG ATGTCTGCCG

601 CCCGCCCGAC CTGATAATCG CTCAAACGGT GGCAGTTCAG CGTATCGAAC

651 CATGCATAAA ACACTTCGCC CATACGAGCG TCCGTAGCGG CAAGGATGCA

701 GCTTTGCGGC GGCGGCAGCG AGGCGGCGGC ATCGAGCGAG GGTACGCCGA

751 TTAAGGGGGT ATCAAACGGC GTTGCCAAAC CCTGAGCTAC ACCGATGCCG

801 ATACGCAGTC CGGTAA
```

This corresponds to the amino acid sequence <SEQ ID 130; ORF 036>:

```
m036.pep
  1 MLKPCAVYSA CAAVLPARTS SSRRCVSSGR CVNQYSSRAD AIPWRRHSGA

 51 VAIRCSSDSS GRFCQTIKAA IPXSFSARKT CSDGETSADS NWRCVHADGL

101 QTASSAASSS QSAQTARRMF TGALSVRPVL WQSGRFCCGR RANRRVRHGR

151 QDNRPWLPMR ESRRQSAYPV CLRTAELLPA RTRCLCRLKR RIPPAAGCLP
```

-continued

```
201 PARPDNRSNG GSSAYRTMHK TLRPYERP*R QGCSFAAAAA RRRHRARVRR

251 LRGYQTALPN PELHRCRYAV R*
```

The following partial DNA sequence was identified in *N. meningitidis* <SEQ ID 131>:

```
a036.seq
  1 ATGCTGAAGC CGTGCGCCGT GTACAGTGCC TGTGCGGCGG TGTTGCCTGC

 51 ACGGACTTCG AGCAGCAGGC GTTGCGTGTC TTCGGGCAGA TGTGTGAACC

101 AATATTCGAG CAGGGCGGAC GCAATTCCTT GGCGGCGGCA TTCGGGCGCG

151 GTGGCAATCA GGTGCAGTTC GGATTCGTCG GGCAGGTTCT GCCAAACGAT

201 AAAGGCGGCA ATCCCGCCGT CTTTTTCCGC AAGGAAAACC TGTTCGGACG

251 GCGAAACCAG TGCGGACTCA AATTGGCGTT GCGTCCACGC GGACGGGTTG

301 CAGACGGCAT CGAGCGCGGC GAGTGCGGCG CAATCGGCAT AAACGGCGCG

351 GCGGATGTTC ACAGGCGCGC CCTCCGTTCC GCCTGTTCTT TGGCAGTCAA

401 GGCGATTTTG TTGCGGACGT AGAGCAGCTC GGCGTGTGCC GCAGCGACGG

451 CGGGAAAACC GCCTTCAGCC GCCAGATTGA GGAAGTCGGC GGCGGTCGGC

501 ATATCGGGTT TGCCTGAGAA GGGCGGACGG TTTTCCAGCG CGAACGCATT

551 GCCGATGCCG TCTGAAAAGG CGCATCCTTC CGGCAGCCGG ATGTCTGCCG

601 CCCGACCGAC CTGATAATCG CTCAAACGGC GGCGGTTCAG CGTGTCGAAC

651 CATGCATAAA ACACTTCGCC CATACGTGCG TCCGCAGCGG CAAGGATGCA

701 GCTTTGCGGC GGCGGCAGCG AGGCGGCGGC ATCGAGCGAG GGTACGCCGA

751 TTAAAGGAGT ATCAAACGGC GTTGCCAAAC CTTGCGCCAC GCCGATGCCG

801 ATACGCAGTC CCGTAA
```

This corresponds to the amino acid sequence <SEQ ID 132; ORF 036.a>:

```
a036.pep
  1 MLKPCAVYSA CAAVLPARTS SSRRCVSSGR CVNQYSSRAD AIPWRRHSGA

 51 VAIRCSSDSS GRFCQTIKAA IPPSFSARKT CSDGETSADS NWRCVHADGL

101 QTASSAASAA QSA*TARRMF TGAPSVPPVL WQSRRFCCGR RAARRVPQRR

151 RENRLQPPD* GSRRRSAYRV CLRRADGFPA RTHCRCRLKR RILPAAGCLP

201 PDRPDNRSNG GGSACRTMHK TLRPYVRPQR QGCSFAAAAA RRRHRARVRR

251 LKEYQTALPN LAPRRCRYAV P*
```

m036/a036 85.6% identity over a 270 aa overlap

```
                    10        20        30        40        50        60
m036.pep    MLKPCAVYSACAAVLPARTSSSRRCVSSGRCVNQYSSRADAIPWRRHSGAVAIRCSSDSS
            ||||||||||||||||||||||||||||||||||||||||||||||||||||||||||||
a036        MLKPCAVYSACAAVLPARTSSSRRCVSSGRCVNQYSSRADAIPWRRHSGAVAIRCSSDSS
                    10        20        30        40        50        60

                    70        80        90       100       110       120
m036.pep    GRFCQTIKAAIPXSFSARKTCSDGETSADSNWRCVHADGLQTASSAASSSQSAQTARRMF
            |||||||||||| |||||||||||||||||||||||||||||||||||||::||| ||||||
a036        GRFCQTIKAAIPPSFSARKTCSDGETSADSNWRCVHADGLQTASSAASAAQSAXTARRMF
                    70        80        90       100       110       120
```

-continued

```
                   130       140       150       160       170       180
m036.pep    TGALSVRPVLWQSGRFCCGRRANRRVRHGRQDNRPWLPMRESRRQSAYPVCLRTAELLPA
            ||| || |||||| |||||||| ||| : |::||   |   |||:||| |||| |: :||
a036        TGAPSVPPVLWQSRRFCCGRRAARRVPQRRRENRLQPPDXGSRRRSAYRVCLRRADGFPA
                   130       140       150       160       170       180

                   190       200       210       220       230       240
m036.pep    RTRCLCRLKRRIPPAAGCLPPARPDNRSNGGSSAYRTMHKTLRPYERPXRQGCSFAAAAA
            ||:| ||||||| |||||||| |||||||||:|| |||||||||| || |||||||||||
a036        RTHCRCRLKRRILPAAGCLPPDRPDNRSNGGGSACRTMHKTLRPYVRPQRQGCSFAAAAA
                   190       200       210       220       230       240

                   250       260       270
m036.pep    RRRHRARVRRLRGYQTALPNPELHRCRYAVRX
            |||||||||||: |||||||   :||||||
a036        RRRHRARVRRLKEYQTALPNLAPRRCRYAVPX
                   250       260       270
```

Computer analysis of this amino acid sequence gave the following results:

Homology with a Predicted ORF from *N. gonorrhoeae*

ORF 036 shows 74.9% identity over a 271 aa overlap with a predicted ORF (ORF 036.ng) from *N. gonorrhoeae*:

```
m036/g036

                10        20        30        40        50        60
m036.pep MLKPCAVYSACAAVLPARTSSSRRCVSSGRCVNQYSSRADAIPWRRHSGAVAIRCSSDSS
         ||||| |||||||:|||||||||||| ||||: |||||||| | ||||||||||||||||
g036     MLKPCLVYSACAAALPARTSSSRRCVPSGRCAYQYSSRADATPRRRHSGAVAIRCSSDSS
                10        20        30        40        50        60

                70        80        90       100       110       120
m036.pep GRFCQTIKAAIPXSFSARKTCSDGETSADSNWRCVHADGLQTASSAASSSQSAQTARRMF
         |||||||||||  |||||||||||||||||||||||||||||:|||||::||   | |||
g036     GRFCQTIKAAILPSFSARKTCSDGETSADSNWRCVHADGLQTVSSAASAAQSDGEAGRMF
                70        80        90       100       110       120

               130       140       150       160       170       180
m036.pep TGALSVRPVLWQSGRFCCGRRANRRVRHGRQDNRPWLPMRESRRQSAYPVCLRTAELLPA
           : || ||||||||||||||| ||| :  :|:|     ||:||:||| |||| |: :|:
g036     MFVPSVPPVLWQSGRFCCGRRAVRRVPRQLRDSRRRGRARENRRRSAYRVCLRRADGFPV
               130       140       150       160       170       180

               190       200       210       220       230       240
m036.pep RTRCLCRLKRRIPPAAGCLPPARPDNRSNGGSSAYRTMHKTLRPYERPXRQGCSFAAAAA
         ||:| |||||| | :: |||| | |||||||:|| || ||||||| || |: ||||||||
g036     RTHCRCRLKRRTPRGGQCLPPYRLDNRSNGGGSACRTTHKTLRPYARPQRRVCSFAAAAA
               190       200       210       220       230       240

               250       260       270
m036.pep RRRHRARVRRLRGYQTALPNPELHRCRYAVRX
         ||||||   ||:: :|||||   :||||||||
g036     RRRHRAWGCRLKACRTALPNLAPRRCRYAVRX
               250       260       270
```

The following partial DNA sequence was identified in *N. meningitidis* <SEQ ID 133>:

```
m036-1.seq
  1 ATGCTGAAGC CGTGCGCCGT GTACAGTGCC TGTGCGGCGG TGTTGCCTGC

 51 ACGGACTTCG AGCAGCAGGC GTTGCGTGTC TTCGGGCAGA TGTGTGAACC

101 AATATTCGAG CAGGGCGGAC GCAATTCCTT GGCGGCGGCA TTCGGGCGCG

151 GTGGCAATCA GGTGCAGTTC GGATTCGTCG GGCAGGTTCT GCCAAACGAT

201 AAAGGCGGCA ATCCCGCCGT CTTTTTCCGC AAGGAAAACC TGTTCGGACG

251 GCGAAACCAG TGCGGACTCA AATTGGCGTT GCGTCCATGC GGACGGGTTG

301 CAGACGGCAT CGAGTGCGGC CAGCTCCTCA CAATCGGCAC AAACGGCACG

351 GCGGATGTTC ACGGGCGCGC TCTCCGTTCG GCCTGTTCTT TGGCAGTCAG
```

-continued

```
401 GGCGATTTTG TTGCGGACGT AGAGCAAACC GGCGTGTGCG GCATGGACGG

451 CAGGATAACC GCCCTTGGCT GCCAATGCGA GAAAGTCGGC GGCAGTCGGC

501 ATATCCGGTC TGCCTGAGAA CGGCGGAGCT TCTTCCAGCG CGAACGCGCT

551 GCCTATGCCG TCTGAAAAGG CGCATCCCTC CGGCAGCCGG ATGTCTGCCG

601 CCCGCCCGAC CTGATAATCG CTCAAACGGT GGCAGTTCAG CGTATCGAAC

651 CATGCATAAA ACACTTCGCC CATACGAGCG TCCGTAG
```

This corresponds to the amino acid sequence <SEQ ID 134; ORF 0036-1>:

```
m036-1.pep
  1 MLKPCAVYSA CAAVLPARTS SSRRCVSSGR CVNQYSSRAD AIPWRRHSGA

 51 VAIRCSSDSS GRFCQTIKAA IPPSFSARKT CSDGETSADS NWRCVHADGL

101 QTASSAASSS QSAQTARRMF TGALSVRPVL WQSGRFCCGR RANRRVRHGR

151 QDNRPWLPMR ESRRQSAYPV CLRTAELLPA RTRCLCRLKR RIPPAAGCLP

201 PARPDNRSNG GSSAYRTMHK TLRPYERP*
```

m036-1/g036 76.8% identity in 228 aa overlap

```
                    10        20        30        40        50        60
m036-1.pep  MLKPCAVYSACAAVLPARTSSSRRCVSSGRCVNQYSSRADAIPWRRHSGAVAIRCSSDSS
            ||||| |||||||:|||||||||||| ||||: |||||||| | ||||||||||||||||
g036        MLKPCLVYSACAAALPARTSSSRRCVPSGRCAYQYSSRADATPRRRHSGAVAIRCSSDSS
                    10        20        30        40        50        60

                    70        80        90       100       110       120
m036-1.pep  GRFCQTIKAAIPPSFSARKTCSDGETSADSNWRCVHADGLQTASSAASSSQSAQTARRMF
            ||||||||||| ||||||||||||||||||||||||||||||:|||||::||   | |||
g036        GRFCQTIKAAILPSFSARKTCSDGETSADSNWRCVHADGLQTVSSAASAAQSDGEAGRMF
                    70        80        90       100       110       120

                   130       140       150       160       170       180
m036-1.pep  TGALSVRPVLWQSGRFCCGRRANRRVRHGRQDNRPWLPMRESRRQSAYPVCLRTAELLPA
              : || ||||||||||||||| ||| :  :|:|     ||:||:||| |||| |: :|:
g036        MFVPSVPPVLWQSGRFCCGRRAVRRVPRQLRDSRRRGRARENRRRSAYRVCLRRADGFPV
                   130       140       150       160       170       180

                   190       200       210       220       229
m036-1.pep  RTRCLCRLKRRIPPAAGCLPPARPDNRSNGGSSAYRTMHKTLRPYERPX
            ||:| |||||| | :: |||| | |||||||:|| || ||||||| ||
g036        RTHCRCRLKRRTPRGGQCLPPYRLDNRSNGGGSACRTTHKTLRPYARPQRRVCSFAAAAA
                   190       200       210       220       230       240

g036        RRRHRAWGCRLKACRTALPNLAPRRCRYAVRX
                   250       260       270
```

The following partial DNA sequence was identified in *N. gonorrhoeae* <SEQ ID 135>:

```
g038.seq
  1 ATGACTGATT TCCGCCAAGA TTTCCTCAAA TTCTCCCTCG CCCAAAATGT

 51 TTTGAAATTC GGCGAATTTA CCACCAAAGC CGGACGGCGG TCGCCCTATT

101 TCTTCAATGC CGGCCTCTTC AACGACGGCG CGTCCACGCT GCAACTGGCA

151 AAATTCTATG CACAATCCAT CATTGAAAGC GGCATCCGAT TCGATATGCT

201 GTTCGGCCCC GCCTACAAAG GCATTATTTT GGCGGCGGCA ACCGCGATGA

251 TGCTGGCGGA AAAAGGCGTG AACGTCCCGT TTGCCTACAA CCGCAAAGAA

301 GCCAAAGACC GCGGCGAAGG CGGCGTGTTG GTCGGCGCGC CGCTTAAAGG

351 GCGCGTGCTG ATTATCGACG ACGTGATTTC CGCCGGCACA TCCGTACGCG

401 AATCAATCAA ACTGATTGAA GCGGAGGGTG CAACCCCCGC CGGTGTCGCC
```

-continued

451 ATCGCGCTCG ACCGCATGGA AAAAGGCACG GGTAAATTGT CCGCCGTTCA

501 GGAAGTGGAA AAACAATACG GCCTGCCCGT CGCCCCCATC GCCAGCCTGA

551 ACGATTTGTT TATCCTGTTG CAAAACAACC CCGAATTCGG ACAGTTCCTC

601 GAACCCGTCC GCACCTACCG CCGGCAGTAC GGCGTAGAAT AA

This corresponds to the amino acid sequence <SEQ ID 136; ORF 038.ng>:

g038.pep

1 MTDFRQDFLK FSLAQNVLKF GEFTTKAGRR SPYFFNAGLF NDGASTLQLA

51 KFYAQSIIES GIRFDMLFGP AYKGIILAAA TAMMLAEKGV NVPFAYNRKE

101 AKDRGEGGVL VGAPLKGRVL IIDDVISAGT SVRESIKLIE AEGATPAGVA

151 IALDRMEKGT GKLSAVQEVE KQYGLPVAPI ASLNDLFILL QNNPEFGQFL

201 EPVRTYRRQY GVE*

The following partial DNA sequence was identified in *N. meningitidis* <SEQ ID 137>:

m038.seq

1 ATGACCGATT TCCGCCAAGA TTTCCTCAAA TTCTCCCTCG CCCAAAATGT

51 TTTGAAATTC GGCGAATTTA CCACCAAGGC AGGACGGCGG TCGCCCTATT

101 TCTTCAATGC CGGCCTCTTT AACGACGGCT TGTCCACGCT GCAACTGGCA

151 AAATTTTACG CACAATCCAT CATTGAAAGC GGCATCCGATTCGATATGCT

201 GTTCGGTCCC GCCTACAAAG GCATTATTTT GGCGGCGGCA ACCGCGATGA

251 TGCTGGCGGA AAAAGGCGTG AACGTCCCGT TTGCCTACAA CCGCAAAGAA

301 GCCAAAGACC ACGGCGAAGG CGGCGTGTTG GTCGGCGCGC CGCTTAAAGG

351 GCGCGTGCTG ATTATCGACG ACGTGATTTC CGCCGGCACA TCCGTACGCG

401 AATCGATCAA ACTGATTGAA GCGGAGGGTG CAACCCCcGC CGGTGTCGCC

451 ATCGCGCTCG ATCGCATGGA AAAAGGCACG GGTGAATTGA GCGCGGTTCA

501 GGAAGTGGAr AAACAATACG GkCTGCCCGT CGCCCCCATC GCCAGCCTGA

551 ACGATTTGTT TATTCTGTTG CAAAACAACC CCGAATTCGG ACAGTTCCTC

601 GAACCCGTCC GAGCCTACCG TCGGCAGTAC GGCGTAGAAT AA

This corresponds to the amino acid sequence <SEQ ID 138; ORF 038>:

m038.pep

1 MTDFRQDFLK FSLAQNVLKF GEFTTKAGRR SPYFFNAGLF NDGLSTLQLA

51 KFYAQSIIES GIRFDMLFGP AYKGIILAAA TAMMLAEKGV NVPFAYNRKE

101 AKDHGEGGVL VGAPLKGRVL IIDDVISAGT SVRESIKLIE AEGATPAGVA

151 IALDRMEKGT GELSAVQEVE KQYGLPVAPI ASLNDLFILL QNNPEFGQFL

201 EPVRAYRRQY GVE*

The following partial DNA sequence was identified in *N. meningitidis* <SEQ ID 139>:

```
a038.seq
  1 ATGACCGATT TCCGCCAAGA TTTCCTCAAA TTCTCCCTCG CCCAAAATGT

 51 TTTGAAATTC GGCGAATTCA CCACCAAAGC CGGACGGCGG TCGCCCTATT

101 TCTTCAATGC CGGCCTCTTT AACGACGGCT TGTCCACGCT GCAACTGGCA

151 AAATTTTACG CACAATCCAT CATTGAAAGC GGCATCCGAT TCGATATGCT

201 GTTCGGCCCC GCCTACAAAG GCATTATTTT GGCGGCGGCA ACCGCGATGA

251 TGCTGGCGGA AAAAGGCGTG AACGTCCCGT TTGCCTACAA CCGCAAAGAA

301 GCCAAAGACC ACGGCGAAGG CGGCGTGTTG GTCGGCGCGC CGCTTAAAGG

351 GCGCGTGCTG ATTATCGACG ACGTGATTTC CGCCGGCACA TCCGTACGCG

401 AATCGATCAA ACTGATTGAA GCGGAGGGTG CAACCCCCGC CGGTGTCGCC

451 ATCGCGCTCG ACCGCATGGA AAAAGGCACG GGTGAATTGA GCGCGGTTCA

501 GGAAGTGGAA AAACAATACG GCCTGCCCGT CGCCCCCATC GCCAGCCTGA

551 ACGATTTGTT TATTCTGTTG CAAAACAACC CCGAATTCGG ACAGTTCCTC

601 GAACCCGTCC GAGCCTACCG TCGGCAGTAC GGCGTAGAAT AA
```

This corresponds to the amino acid sequence <SEQ ID 140; ORF 038.a>:

```
a038.pep
  1 MTDFRQDFLK FSLAQNVLKF GEFTTKAGRR SPYFFNAGLF NDGLSTLQLA

 51 KFYAQSIIES GIRFDMLFGP AYKGIILAAA TAMMLAEKGV NVPFAYNRKE

101 AKDHGEGGVL VGAPLKGRVL IIDDVISAGT SVRESIKLIE AEGATPAGVA

151 IALDRMEKGT GELSAVQEVE KQYGLPVAPI ASLNDLFILL QNNPEFGQFL

201 EPVRAYRRQY GVE*
```

m038/a038 100.0% identity over a 213 aa overlap

```
                 10        20        30        40        50        60
m038.pep   MTDFRQDFLKFSLAQNVLKFGEFTTKAGRRSPYFFNAGLFNDGLSTLQLAKFYAQSIIES
           ||||||||||||||||||||||||||||||||||||||||||||||||||||||||||||
a038       MTDFRQDFLKFSLAQNVLKFGEFTTKAGRRSPYFFNAGLFNDGLSTLQLAKFYAQSIIES
                 10        20        30        40        50        60

                 70        80        90       100       110       120
m038.pep   GIRFDMLFGPAYKGIILAAATAMMLAEKGVNVPFAYNRKEAKDHGEGGVLVGAPLKGRVL
           ||||||||||||||||||||||||||||||||||||||||||||||||||||||||||||
a038       GIRFDMLFGPAYKGIILAAATAMMLAEKGVNVPFAYNRKEAKDHGEGGVLVGAPLKGRVL
                 70        80        90       100       110       120

                130       140       150       160       170       180
m038.pep   IIDDVISAGTSVRESIKLIEAEGATPAGVAIALDRMEKGTGELSAVQEVEKQYGLPVAPI
           ||||||||||||||||||||||||||||||||||||||||||||||||||||||||||||
a038       IIDDVISAGTSVRESIKLIEAEGATPAGVAIALDRMEKGTGELSAVQEVEKQYGLPVAPI
                130       140       150       160       170       180

                190       200       210
m038.pep   ASLNDLFILLQNNPEFGQFLEPVRAYRRQYGVEX
           ||||||||||||||||||||||||||||||||||
a038       ASLNDLFILLQNNPEFGQFLEPVRAYRRQYGVEX
                190       200       210
```

Computer analysis of this amino acid sequence gave the following results:

Homology with a Predicted ORF from *N. gonorrhoeae*

ORF 038 shows 98.1% identity over a 213 aa overlap with a predicted ORF (ORF 038.ng) from *N. gonorrhoeae:* m038/g038

```
                    10        20        30        40        50        60
m038.pep    MTDFRQDFLKFSLAQNVLKFGEFTTKAGRRSPYFFNAGLFNDGLSTLQLAKFYAQSIIES
            |||||||||||||||||||||||||||||||||||||||||||| |||||||||||||||
g038        MTDFRQDFLKFSLAQNVLKFGEFTTKAGRRSPYFFNAGLFNDGASTLQLAKFYAQSIIES
                    10        20        30        40        50        60

                    70        80        90       100       110       120
m038.pep    GIRFDMLFGPAYKGIILAAATAMMLAEKGVNVPFAYNRKEAKDHGEGGVLVGAPLKGRVL
            ||||||||||||||||||||||||||||||||||||||||||:|||||||||||||||||
g038        GIRFDMLFGPAYKGIILAAATAMMLAEKGVNVPFAYNRKEAKDRGEGGVLVGAPLKGRVL
                    70        80        90       100       110       120

                   130       140       150       160       170       180
m038.pep    IIDDVISAGTSVRESIKLIEAEGATPAGVAIALDRMEKGTGELSAVQEVEKQYGLPVAPI
            |||||||||||||||||||||||||||||||||||||||||:||||||||||||||||||
g038        IIDDVISAGTSVRESIKLIEAEGATPAGVAIALDRMEKGTGKLSAVQEVEKQYGLPVAPI
                   130       140       150       160       170       180

                   190       200       210
m038.pep    ASLNDLFILLQNNPEFGQFLEPVRAYRRQYGVEX
            ||||||||||||||||||||||||:|||||||||
g038        ASLNDLFILLQNNPEFGQFLEPVRTYRRQYGVEX
                   190       200       210
```

The following partial DNA sequence was identified in *N. gonorrhoeae* <SEQ ID 141>:

```
g039.seq
     1 ATGCCGTCCG AACCACCTGC CGCTTCAGAC GGCATCAAAC CGACACACAC

    51 CGAGAAAACA TCATGCCCGC CTGTTTCTGT CCGCACTGCA AAACCCGCCT

   101 CTGGGTCAAA GAAAcccagC TCAAcgtCgC ccaagGCTTC GTCGTCTgcc

   151 aaAAAtgcga agGGCTgttt aaAgccaaaG accAtctggc aaGcacGAAA

   201 gaacctatat tcaacgattg gcccgaagct gtttcgggat TcaaaCTCGg

   251 TCcaccgcaT cggcacgcac gccattagca aGAaacagat gtcccgcgac

   301 gaaatCgccg atatcctcaa cggcggtaca acCCTGCACG ATACGCCGCC

   351 CGCAACCGCC GCTGCCGCac ctGCCGCCGC ACCGCaggTT TCCGTACCGC

   401 CCGCCCGTCA GGAAGGGCTC AACTGGACTA TTGCAACCCT GTTCGCACTT

   451 ATCGTCCTCA TTATGCAGCT TTCCTACCTC TTCATCCTAT GA
```

This corresponds to the amino acid sequence <SEQ ID 142; ORF 039.ng>:

```
g039.pep
     1 MPSEPPAASD GIKPTHTEKT SCPPVSVRTA KPASGSKKPS STSPKASSSA

    51 KNAKGCLKPK TIWQARKNLY STIGPKLFRD VKLVHRIGTH AISKKQMSRD

   101 EIADILNGGT TLHDTPPATA AAAPAAAPQV SVPPARQEGL NWTIATLFAL

   151 IVLIMQLSYL FIL*
```

The following partial DNA sequence was identified in *N. meningitidis* <SEQ ID 143>:

```
m039.seq
    1 ATGCCGTCCG AACCGCCTTA CGCCTCAGAC GGCATCAAAC CTGACACACA

   51 CGAGGAAATA CCATGCCCGC CTGTTTCTGC CCCCACTGCA AAACCCGTCT

  101 CTGGGTCAAA GAAACCCAAC TCAATGTCGC CGnnnnnnnn nnnnnnnnnn

  151 nnnnnnnnnn nnnnnnnnnn nnnnnnnnnn nnnnnnnnnn nnnnnnnnnn

  201 nnnnnnnnnn nnnnnnnnnn nnnnnnnnnn nnnnnnnCCC GAGGCTGTTT

  251 CGGATGTCAA ACTCGTTCAC CGTATCGGCA CGCGCGCCAT CGGCAAGAAA

  301 CAGATTTCCC GTGACGAAAT CGCCGGCATC CTCAACGGCG GTACAACCCA

  351 GCCCGATATT CCGCCCGCAA CCGCCGCCAC CCCTGCTGCC GCACCGCAGG

  401 TTACCGTACC GCCCGCCGCG CCCGCCCGTC AGGATGGGTT CAACTGGACG

  451 ATTGCAACCC TGTTTGCCCT TATCGTCCTC ATTATGCAGC TTTCCTACCT

  501 CGTCATCCTA TGA
```

This corresponds to the amino acid sequence <SEQ ID 144; ORF 039>:

```
m039.pep
    1 MPSEPPYASD GIKPDTHEEI PCPPVSAPTA KPVSGSKKPN SMSPXXXXXX

   51 XXXXXXXXXX XXXXXXXXXX XXXXXXXXXP EAVSDVKLVH RIGTRAIGKK

  101 QISRDEIAGI LNGGTTQPDI PPATAATPAA APQVTVPPAA PARQDGFNWT

  151 IATLFALIVL IMQLSYLVIL *
```

The following partial DNA sequence was identified in *N. meningitidis* <SEQ ID 145>:

```
a039.seq
    1 ATGCCGTCTG AACCGCCTTA CGCCTCAGAC GGCATCAAAC CTGACACACA

   51 CGAGGAAATA CCATGCCCGC CTGTTTCTGC CCCCACTGCA AAACCCGTCT

  101 CTGGGTCAAA GAAACCCAAC TCAATGTCGC CCAAGGCTTC GTCGTCTGCC

  151 AAAAATGCGA AGGAATGTTT AAAGCCAAAG ACCATCTGGC AAGCACGAAA

  201 GAACCCATAT TCAACGATT. TGCCCGAAGC TGTTTCGGAT GTCAAACTCG

  251 TTCACCGCAT CGGCACGAGC GCCATCGGCA AGAAACAGAT TTCCCGTGAC

  301 GAAATCGCCG GCATCCTCAA CGGCGGCACA ACCCAGCCCG ATATTCCGCC

  351 CGCAACCGCC GCCACCCCTG CTGCCGCACC GCAGGTTACC GTACCGCCCG

  401 CCGCGCCCGC CCGTCAGGAT GGGTTCAACT GGACGATTGC AACCCTGTTT

  451 GCCCTTATCG TCCTCATTAT GCAGCTTTCC TACCTCGTCA TCCTATGA
```

This corresponds to the amino acid sequence <SEQ ID 146; ORF 039.a>:

```
a039.pep
    1 MPSEPPYASD GIKPDTHEEI PCPPVSAPTA KPVSGSKKPN SMSPKASSSA

   51 KNAKECLKPK TIWQARKNPY STIXPEAVSD VKLVHRIGTS AIGKKQISRD

  101 EIAGILNGGT TQPDIPPATA ATPAAAPQVT VPPAAPARQD GFNWTIATLF

  151 ALIVLIMQLS YLVIL*
```

m039/a039 79.4% identity over a 170 aa overlap

```
                       10        20        30        40        50        60
m039.pep    MPSEPPYASDGIKPDTHEEIPCPPVSAPTAKPVSGSKKPNSMSPXXXXXXXXXXXXXXXX
            ||||||||||||||||||||||||||||||||||||||||||||
a039        MPSEPPYASDGIKPDTHEEIPCPPVSAPTAKPVSGSKKPNSMSPKASSSAKNAKECLKPK
                       10        20        30        40        50        60
                       70        80        90       100       110       120
m039.pep    XXXXXXXXXXXXXXXXXXXPEAVSDVKLVHRIGTRAIGKKQISRDEIAGILNGGTTQPDI
            :          : |     ||||||||||||||| |||||||||||||||||||||||||
a039        TIWQARKNPYSTIX-----PEAVSDVKLVHRIGTSAIGKKQISRDEIAGILNGGTTQPDI
                       70             80        90       100       110
                      130       140       150       160       170
m039.pep    PPATAATPAAAPQVTVPPAAPARQDGFNWTIATLFALIVLIMQLSYLVILX
            |||||||||||||||||||||||||||||||||||||||||||||||||||
a039        PPATAATPAAAPQVTVPPAAPARQDGFNWTIATLFALIVLIMQLSYLVILX
              120       130       140       150       160
```

Computer analysis of this amino acid sequence gave the following results:

Homology with a Predicted ORF from *N. gonorrhoeae*

ORF 039 shows 60.8% identity over a 171 aa overlap with a predicted ORF (ORF 039.ng) from *N. gonorrhoeae*:

```
m039/g039

                    10        20        30        40        50        60
m039.pep MPSEPPYASDGIKPDTHEEIPCPPVSAPTAKPVSGSKKPNSMSPXXXXXXXXXXXXXXXX
         |||||| |||||||   |:  |||||: ||||:||||||:| ||
g039     MPSEPPAASDGIKPTHTEKTSCPPVSVRTAKPASGSKKPSSTSPKASSSAKNAKGCLKPK
                    10        20        30        40        50        60
                    70        80        90       100       110       120
m039.pep XXXXXXXXXXXXXXXXXXXPEAVSDVKLVHRIGTRAIGKKQISRDEIAGILNGGTTQPDI
         :          :       |:   ||||||||||:||:|||:|||||| |||||||  |
g039     TIWQARKNLYSTIG-----PKLFRDVKLVHRIGTHAISKKQMSRDEIADILNGGTTLHDT
                    70             80        90       100       110
                   130       140       150       160       170
m039.pep PPATAAT-PAAAPQVTVPPAAPARQDGFNWTIATLFALIVLIMQLSYLVILX
         ||||||: |||||||:||||   ||:|:|||||||||||||||||||| |||
g039     PPATAAAAPAAAPQVSVPPA---RQEGLNWTIATLFALIVLIMQLSYLFILX
           120       130            140       150       160
```

The following partial DNA sequence was identified in *N. gonorrhoeae* <SEQ ID 147>:

```
g040.seq
      1 ATGAACGCGC CCGACAGCTT TGTCGCCCAC TTCCGCGAAG CCGCCCCCTA

     51 CATCCGCCAA ATGCGCGGCA CGACACTGGT CGCCGGCATA GAcggCCGCC

    101 TGCTCGAAGG CGGCACCTTA AATAAGCTCG CCGCCGACAT CGGGCTGTTG

    151 TCGCAACTGG GCATCCGACT CGTCCTCATC CACGGCGCGT ACCACTTCCT

    201 CGAccgCCTC GCCGCCGCGC AAGgccGCAC GCCGCATTAT TGCCGgggtt

    251 tGCGCGTTAC CGACGaAACc tcGctcggAC AGGCGCAGCA GtttGCCGGC

    301 AccgTCCGCA GCCGTTTTGA agcCGCATTG tgcggcagCG tttcaggatt

    351 cgcgCGCGCG CCTTCCGTCC CGCTCGTAtc gggcaacttc ctgacCGCCC

    401 GTCcgatggg cgtgattgac ggaACCGata tggaatacgc gggggttatc

    451 cgcaaaaccg ACACCGCCGC CCTCCGTTTC CAACTCGACG CGGGCAATAT

    501 CGTCTGGATG CCGCCGCTCG GGCATTCCTA CGGCGGCAAA ACCTTCAATC

    551 TCGATATGGT GCAGGCCGCC GCTTCCGTCG CCGTCTCGCT TCAGGCCGAA
```

-continued

```
 601 AAACTCGTTT ACCTGACCCT TTCAGACGGC ATTTCCCGCC CCGACGGCAC

 651 GCTCGCCGAA ACCCTCTCGG CACAGGAAGC GCAATCGCTG GCGGAACACG

 701 CCGCCAGCGA AACCCGACGA CTGATTTCGT CCGCCGTTGC CGCGCTCGAA

 751 GGCGGCGTGC ATCGCGTCCA AATCCTCAAC GGGGCCGCCG ACGGCAGCCT

 801 GCTGCAAGAA CTCTTCACCC GCAACGGCAT CGGCACGTCC ATTGCCAAAG

 851 AAGCCTTCGT CTCCATCCGG CAGGCGCACA GCGGCGACAT CCCGCACATC

 901 GCCGCACTCA TCCGCCCGCT GGAAGAACAG GGCGTCCTAT TGCACCGCAG

 951 CCGCGAATAC CTCGAAAACC ACATTTCCGA ATTTTCCATC CTCGAACACG

1001 ACGGCGACCT GTACGGCTGT GCCGCACTCA AAACCTTTGC CGAAGCCGAT

1051 TGCGGCGAAA TCGCCTGCCT TGCCGTCTCG CCGCAGGCAC AGGACGGCGg

1101 ctACGGCGAA CGCCTGCTTG CCCACATTAT CGATAAGGCG CGCGGCATAG

1151 GCATAAGCAG GCTGTTCGCA CTGTCCACAA ATACCGGCGA ATGGTTTGCC

1201 GAACGCGGCT TTCAGACGGC ATCGGAAGAC GAGCTGCCCG AAACGCGGCG

1251 CAAAGACTAC CGCAGCAACG GACGAAACCC GCATATTCTG GTGCGTCGCC

1301 TGCACCGCTG A
```

This corresponds to the amino acid sequence <SEQ ID 148; ORF 040.ng>:

```
g040.pep 1
  1 MNAPDSFVAH FREAAPYIRQ MRGTTLVAGI DGRLLEGGTL NKLAADIGLL

 51 SQLGIRLVLI HGAYHFLDRL AAAQGRTPHY CRGLRVTDET SLGQAQQFAG

101 TVRSRFEAAL CGSVSGFARA PSVPLVSGNF LTARPMGVID GTDMEYAGVI

151 RKTDTAALRF QLDAGNIVWM PPLGHSYGGK TFNLDMVQAA ASVAVSLQAE

201 KLVYLTLSDG ISRPDGTLAE TLSAQEAQSL AEHAASETRR LISSAVAALE

251 GGVHRVQILN GAADGSLLQE LFTRNGIGTS IAKEAFVSIR QAHSGDIPHI

301 AALIRPLEEQ GVLLHRSREY LENHISEFSI LEHDGDLYGC AALKTFAEAD

351 CGEIACLAVS PQAQDGGYGE RLLAHIIDKA RGIGISRLFA LSTNTGEWFA

401 ERGFQTASED ELPETRRKDY RSNGRNPHIL VRRLHR*
```

The following partial DNA sequence was identified in *N. meningitidis* <SEQ ID 149>:

```
m040.seq
  1 ATGAGCGCGC CCGACCTCTT TGTCGCCCAC TTCCGCGAAG CCGTCCCCTA

 51 CATCCGCCAA ATGCGCGGCA AAACGCTGGT CGCCGGCATA GACGACCGCC

101 TGCTCGAAGG TGATACCTTA AACAAGCTCG CCGCCGACAT CGGGCTGTTG

151 TCGCAACTGG GCATCAGGCT CGTCCTCATC CACGGCGCGC GCCACTTCCT

201 CGACCGCCAC GCCGCCGCTC AAGGCCGCAC GCCGCATTAT TGCCGGGGCT

251 TGCGCGTTAC CGACGAAACC TCGCTCGAAC AGGCGCAgCA GTTTGCCGGC

301 ACCGTCCGCA GCCGTTTTGA AGCCGCATTG TGCGGCAGCG TTTCCGGGTT

351 CGCGCGCGCG CCTTCCGTCC CGCTCGTATC GGGCAACTTC CTGACCGCCC

401 GTCCGATAGG TGTGATTGAC GGAACCGATA TGGAATACGC GGGCGTTATC

451 CGCAAAACCG ACACCGCCGC CCTCCGTTTC CAACTCGACG CGGGCAATAT
```

-continued

```
501 CGTCTGGCTG CCGCCGCTCG GACATTCCTA CAGCGGCAAG ACCTTCTATC
551 TCGATATGCT TCAAACCGCC GCCTCCGCCG CCGTCTCGCT TCAGGCCGAA
601 AAACTCGTTT ACCTGACCCT TTCAGACGGC ATTTCCCGCC CCGACGGCAC
651 GCTCGCCGAA ACCCTCTCGG CACAGGAAGC GCAATCGCTG GCGGAACACG
701 CCGGCGGGCA AACGCGACGG CTGATTTCGT CCGCCGAACT CTTCACCCGC
751 AACGGCATCG GCACGTCCAT TGCCAAAGAA GCCTTCGTCT CCATCCGGCA
801 rGCGCAywgG G.CGACATCC CGCACATCGC CGCCCTCATC CGCCCGCTGG
851 AAGAACAGGG CATCCTGCTG CACCGCAs.c GCGAATACCT CGAAAACCAC
901 ATTTCCGAAT TTTCCATCCT CGAACACGAC GGCAACCTGT ACGGTTGCGC
951 CGCCCTGAAA ACCTTTGCCG AAGCCGATTG CGGCGAAATC GCCTGCCTTG
1001 CCGTCTCGCC GCag.cACAG GACGGCGGCT ACGGCGAACG CnTGCTTGCC
1051 CACATTATCG ATAAGGCGCG CGGCATAGGC ATAAGCAGGC TGTTCGCACT
1101 GTCCACAAAT ACCGGCGAAT GGTTTGCCGA ACGCGGCTTT CAGACGGCAT
1151 CGGAAGACGA GTTGCCCGAA ACGCGGCGCA AAGACTACCG CAGCAACGGA
1201 CGGAACTCGC ATATTCTGGT ACGTCGCCTG CACCGCTGA
```

This corresponds to the amino acid sequence <SEQ ID 150; ORF 040>:

```
m040.pep
  1 MSAPDLFVAH FREAVPYIRQ MRGKTLVAGI DDRLLEGDTL NKLAADIGLL
 51 SQLGIRLVLI HGARHFLDRH AAAQGRTPHY CRGLRVTDET SLEQAQQFAG
101 TVRSRFEAAL CGSVSGFARA PSVPLVSGNF LTARPIGVID GTDMEYAGVI
151 RKTDTAALRF QLDAGNIVWL PPLGHSYSGK TFYLDMLQTA ASAAVSLQAE
201 KLVYLTLSDG ISRPDGTLAE TLSAQEAQSL AEHAGGQTRR LISSAELFTR
251 NGIGTSIAKE AFVSIRQAHX XDIPHIAALI RPLEEQGILL HRXREYLENH
301 ISEFSILEHD GNLYGCAALK TFAEADCGEI ACLAVSPQXQ DGGYGERXLA
351 HIIDKARGIG ISRLFALSTN TGEWFAERGF QTASEDELPE TRRKDYRSNG
401 RNSHILVRRL HR*
```

The following partial DNA sequence was identified in *N. meningitidis* <SEQ ID 151>:

```
a040.seq
  1 ATGATCGTGC CCGACCTCTT TGTCGCCCAC TTCCGCGAAG CCGCCCCCTA
 51 CATCCGCCAA ATGCGCGGCA AAACGCTGGT CGCCGGCATA GACGACCGCC
101 TGCTCGAAGG TGATACCTTA AACAAGTTCG CCGCCGACAT CGGGCTTTTG
151 TCGCAACTGG GCATCAGGCT CGTCCTCATC CACGGCGCGC GCCACTTCCT
201 CGACCGCCAC GCCGCCGCGC AAGGCCGCAC GCCGCATTAT TGCCGGGGCT
251 TGCGCGTTAC CGACGAAACC TCGCTCGAAC AGGCGCAGCA GTTTGCCGGC
301 ACCGTCCGCA GCCGTTTTGA AGCCGCATTG TGCGGCAGCG TTTCCGGGTT
351 CGCGCGCGCG CCTTCCGTCC CGCTCGTATC GGGCAACTTC CTGACCGCCC
401 GTCCGATAGG TGTGATTGAC GGAACCGATA TGGAATACGC GGGCGTTATC
451 CGCAAAACCG ACACCGCCGC CCTCCGTTTC CAACTCGACG CGGGCAATAT
```

-continued

```
 501 CGTCTGGCTG CCGCCGCTCG GACATTCCTA CAGCGGCAAG ACCTTCCATC

 551 TCGATATGCT TCAAACCGCC GCCTCCGTCG CCGTCTCGCT TCAGGCCGAA

 601 AAACTCGTTT ACCTGACCCT TTCAGACGGC ATTTCCCGCC CCGACGGCAC

 651 GCTCGCCGTA ACCCTCTCGG CACAGGAAGC GCAATCGCTG GCGGAACACG

 701 CCGGCGGCGA AACGCGACGG CTGATTTCGT CCGCCGTTGC CGCGCTCGAA

 751 GGCGGCGTGC ATCGCGTCCA AATCCTCAAC GGAGCCGCCG ACGGCAGCCT

 801 GCTGCAAGAA CTCTTCACCC GCAACGGCAT CGGCACGTCC ATTGCCAAAG

 851 AAGCCTTCGT CTCCATCCGG CAGGCGCACA GCGGCGACAT CCCGCACATT

 901 GCCGCCCTCA TCCGCCCGCT GGAAGAACAG GGCATCCTGC TGCACCGCAG

 951 CCGCGAATAC CTCGAAAACC ACATTTCCGA ATTTTCCATC CTCGAACACG

1001 ACGGCAACCT GTACGGTTGC GCCGCCCTGA AAACCTTTGC CGAAGCCGAT

1051 TGCGGCGAAA TCGCCTGCCT TGCCGTCTCG CCGCAGGCAC AGGACGGCGG

1101 CTACGGCGAA CGCCTGCTTG CCCACATTAT CGATAAGGCG CGCGGCATAG

1151 GCATAAGCAG GCTGTTCGCA CTGTCCACAA ATACCGGCGA ATGGTTTGCC

1201 GAACGCGGCT TTCAGACGGC ATCGGAAGAC GAGTTGCCCG AAACGCGGCG

1251 CAAAGACTAC CGCAGCAACG GACGGAACTC GCATATTCTG GTGCGTCGCC

1301 TGCACCGCTG A
```

This corresponds to the amino acid sequence <SEQ ID 152; ORF 040.a>:

```
a040.pep

      1 MIVPDLFVAH FREAAPYIRQ MRGKTLVAGI DDRLLEGDTL NKFAADIGLL

     51 SQLGIRLVLI HGARGFLDRH AAAQGRTPHY CRGLRVTDET SLEQAQQFAG

    101 TVESRFEAAL CGSVSGFARA PSVPLVSGNF LTARPIGVID GTDMEYAGVI

    151 RKTDTAALRF QLDAGNIVWL PPLGHSYSGK TFHLDMLQTA ASVAVSLQAE

    201 KLVYLTLSDG ISRPDGTLAV TLSAQEAQSL AEHAGGETRR LISSAVAALE

    251 GGVHRVQILN GAADGSLLQE LFTRNGIGTS IAKEAFVSIR QAHSGDIPHI

    301 AALIRPLEEQ GILLHRSREY LENHISEFSI LEHDGNLYGC AALKTFAEAD

    351 CGEIACLAVS PQAQDGGYGE RLLAHIIDKA RGIGISRLFA LSTNTGEWFA

    401 ERGFQTASED ELPETRRKDY RSNGRNSHIL VRRLHR*
```

m040/a040 91.5% identity in 436 aa overlap

```
                  10        20        30        40        50        60
m040.pep  MSAPDLFVAHFREAVPYIRQMRGKTLVAGIDDRLLEGDTLNKLAADIGLLSQLGIRLVLI
          | :|||||||||||:||||||||||||||||||||||||||||:||||||||||||||||
a040      MIVPDLFVAHFREAAPYIRQMRGKTLVAGIDDRLLEGDTLNKFAADIGLLSQLGIRLVLI
                  10        20        30        40        50        60

                  70        80        90       100       110       120
m040.pep  HGARHFLDRHAAAQGRTPHYCRGLRVTDETSLEQAQQFAGTVRSRFEAALCGSVSGFARA
          ||||||||||||||||||||||||||||||||||||||||||||||||||||||||||||
a040      HGARHFLDRHAAAQGRTPHYCRGLRVTDETSLEQAQQFAGTVRSRFEAALCGSVSGFARA
                  70        80        90       100       110       120

                 130       140       150       160       170       180
m040.pep  PSVPLVSGNFLTARPIGVIDGTDMEYAGVIRKTDTAALRFQLDAGNIVWLPPLGHSYSGK
          ||||||||||||||||||||||||||||||||||||||||||||||||||||||||||||
a040      PSVPLVSGNFLTARPIGVIDGTDMEYAGVIRKTDTAALRFQLDAGNIVWLPPLGHSYSGK
                 130       140       150       160       170       180
```

-continued

```
                  190       200       210       220       230       240
m040.pep    TFYLDMLQTAASAAVSLQAEKLVYLTLSDGISRPDGTLAETLSAQEAQSLAEHAGGQTRR
            ||:|||||||||:|||||||||||||||||||||||||| ||||||||||||||||:|||
a040        TFHLDMLQTAASVAVSLQAEKLVYLTLSDGISRPDGTLAVTLSAQEAQSLAEHAGGETRR
                  190       200       210       220       230       240

                                              250       260       270
m040.pep    LISSA------------------------ELFTRNGIGTSIAKEAFVSIRQAHXXDIPHI
            |||||                        ||||||||||||||||||||||||  |||||
a040        LISSAVAALEGGVHRVQILNGAADGSLLQELFTRNGIGTSIAKEAFVSIRQAHSGDIPHI
                  250       260       270       280       290       300

             280       290       300       310       320       330
m040.pep    AALIRPLEEQGILLHRXREYLENHISEFSILEHDGNLYGCAALKTFAEADCGEIACLAVS
            |||||||||||||||| |||||||||||||||||||||||||||||||||||||||||||
a040        AALIRPLEEQGILLHRSREYLENHISEFSILEHDGNLYGCAALKTFAEADCGEIACLAVS
                  310       320       330       340       350       360

             340       350       360       370       380       390
m040.pep    PQXQDGGYGERXLAHIIDKARGIGISRLFALSTNTGEWFAERGFQTASEDELPETRRKDY
            || |||||||| ||||||||||||||||||||||||||||||||||||||||||||||||
a040        PQAQDGGYGERLLAHIIDKARGIGISRLFALSTNTGEWFAERGFQTASEDELPETRRKDY
                  370       380       390       400       410       420

             400       410
m040.pep    RSNGRNSHILVRRLHRX
            ||||||||||||||||
a040        RSNGRNSHILVRRLHRX
                  430
```

Computer analysis of this amino acid sequence gave the following results:

Homology with a Predicted ORF from *N. gonorrhoeae*

ORF 040 shows 88.3% identity over a 436 aa overlap with a predicted ORF (ORF 040.ng) from *N. gonorrhoeae*:

```
m040/g040

m040.pep    MSAPDLFVAHFREAVPYIRQMRGKTLVAGIDDRLLEGDTLNKLAADIGLLSQLGIRLVLI   60
            |:||| ||||||||:|||||||| ||||||| ||||| ||||||||||||||||||||||
g040        MNAPDSFVAHFREAAPYIRQMRGTTLVAGIDGRLLEGGTLNKLAADIGLLSQLGIRLVLI   60

m0404.pep   HGARHFLDRHAAAQGRTPHYCRGLRVTDETSLEQAQQFAGTVRSRFEAALCGSVSGFARA  120
            ||| ||||| |||||||||||||||||||||| |||||||||||||||||||||||||||
g040        HGAYHFLDRLAAAQGRTPHYCRGLRVTDETSLGQAQQFAGTVRSRFEAALCGSVSGFARA  120

m040.pep    PSVPLVSGNFLTARPIGVIDGTDMEYAGVIRKTDTAALRFQLDAGNIVWLPPLGHSYSGK  180
            |||||||||||||||:|||||||||||||||||||||||||||||||||:|||||||:||
g040        PSVPLVSGNFLTARPMGVIDGTDMEYAGVIRKTDTAALRFQLDAGNIVWMPPLGHSYGGK  180

m040.pep    TFYLDMLQTAASAAVSLQAEKLVYLTLSDGISRPDGTLAETLSAQEAQSLAEHAGGQTRR  240
            || |||:|:|||:||||||||||||||||||||||||||||||||||||||||||:::||
g040        TFNLDMVQAAASVAVSLQAEKLVYLTLSDGISRPDGTLAETLSAQEAQSLAEHAASETRR  240

m040.pep    LISSA------------------------ELFTRNGIGTSIAKEAFVSIRQAHXXDIPHI  276
            |||||                        ||||||||||||||||||||||||  |||||
g040        LISSAVAALEGGVHRVQILNGAADGSLLQELFTRNGIGTSIAKEAFVSIRQAHSGDIPHI  300

m040.pep    AALIRPLEEQGILLHRXREYLENHISEFSILEHDGNLYGCAALKTFAEADCGEIACLAVS  336
            |||||||||||:|||| |||||||||||||||||||:||||||||||||||||||||||||
g040        AALIRPLEEQGVLLHRSREYLENHISEFSILEHDGDLYGCAALKTFAEADCGEIACLAVS  360

m040.pep    PQXQDGGYGERXLAHIIDKARGIGISRLFALSTNTGEWFAERGFQTASEDELPETRRKDY  396
            || |||||||| ||||||||||||||||||||||||||||||||||||||||||||||||
g040        PQAQDGGYGERLLAHIIDKARGIGISRLFALSTNTGEWFAERGFQTASEDELPETRRKDY  420

m040.pep    RSNGRNSHILVRRLHRX  413
            |||||| |||||||||
g040        RSNGRNPHILVRRLHRX  437
```

The following partial DNA sequence was identified in *N. gonorrhoeae* <SEQ ID 153>:

```
g041.seq
  1 ATGAGTTCGC CCAAACACAT CGGCTTGCAG GGCGGCAGCA ACGGCGGCCT

 51 GATTACCGCC GCCGCCTTCG TGCGCGAACC GCAAAGCATC GGTGCGCTGG

101 TGTGCGAAGT ACCGCTGACC GATATGATCC GTTATCCGCT GCTGTCCGCC

151 GGTTCAAGTT GGACGGACGA ATACGGCAAT CCGCAGAAAT ACGAAGCCTG

201 CAAACGCCGG CTGGGCGAAT TGTCGCCGTA TCACAATCTT TCAGACGGCA

251 TCGATTATCC GCCCGCACTC ATTACCACCA GCCTCAGCGA CGACCGCGTC

301 CATCCCGCCC ACGCGCTCAA ATTCTACGCC AAACTGCGCG AAACCTCGCC

351 GCAATCTTGG CTCTACTCGC CTGACGGCGG CGGCCATACC GGCAACGGCA

401 CCCAACGCGA ATCCGCCGAC AAACTCGCCT GCGTGTTGCT GTTTTTGAAA

451 GAATTTTTGG GATAA
```

This corresponds to the amino acid sequence <SEQ ID 154; ORF 041.ng>:

```
g041.pep
  1 MSSPKHIGLQ GGSNGGLITA AAFVREPQSI GALVCEVPLT DMIRYPLLSA

 51 GSSWTDEYGN PQKYEACKRR LGELSPYHNL SDGIDYPPAL ITTSLSDDRV

101 HPAHALKFYA KLRETSPQSW LYSPDGGGHT GNGTQRESAD KLACVLLFLK

151 EFLG*
```

The following partial DNA sequence was identified in *N. meningitidis* <SEQ ID 155>:

```
m041.seq
  1 ATCAGTTCGC CCGAACACAT CGGCTTGCAG GGCGGCAGCA ACGGCGGACT

 51 GATTACTGCC GCCGCCTTCG TGCGCGAACC GCAAAGCATC GGCGCGCTGG

101 TGTGCGAAGT GCCGCTGACC GACATGATCC GTTATCCGCT GCTCTCCGCC

151 GGTTCAAGCT GGACAGACGA ATACGGCAAT CCGCAAAAAT ACGAAGTCTG

201 CAAACGCCGG TTGGGCGAAT TGTCGCCGTA TCACAATCTT TCAGACGGCA

251 TCGATTATCC GCCCGCGCTC ATTACCACCA GCCTGTCCGA CGATCGCGTC

301 CATCCCGCCC ACGCGCTCAA GTTCTACGCC AAACTGCGCG AAACCTCCGC

351 GCAATCTTGG CTCTACTCGC CTGACGGCGG CGGCCATACC GGCAACGGCA

401 CCCAACGCGA ATCCGCCGAC GAACTCGCCT GCGTCTTGCT GTTTTTGAAA

451 GAGTTTTTGG GCTAA
```

This corresponds to the amino acid sequence <SEQ ID 156; ORF 041>:

```
m041.pep
  1 ISSPEHIGLQ GGSNGGLITA AAFVREPQSI GALVCEVPLT MIRYPLLSAD

 51 GSSWTDEYGN PQKYEVCKRR LGELSPYHNL SDGIDYPPAL ITTSLSDDRV

101 HPAHALKFYA KLRETSAQSW LYSPDGGGHT GNGTQRESAD ELACVLLFLK

151 EFLG*
```

The following partial DNA sequence was identified in *N. meningitidis* <SEQ ID 157>:

```
a041.seq
   1 ATCAGTTCGC CCGAACACAT CGGCTTGCAG GGCGGCAGCA ACGGCGGACT

  51 GATTACTGCC GCCGCCTTCG TGCGCGAACC GCAAAGCATA GGCGCGCTGG

 101 TGTGCGAAGT GCCGCTGACC GACATGATCC GTTATCCGCT GCTCTCCGCC

 151 GGTTCAAGCT GGACAGACGA ATACGGCAAT CCGCAAAAAT ACGAAGTCTG

 201 CAAACGCCGG TTGGGCGAAT TGTCGCCGTA TCACAATCTT TCAGACGGCA

 251 TCGATTATCC GCCCGCGCTC ATTACCACCA GCCTGTCCGA CGATCGCGTC

 301 CATCCCGCCC ACGCGCTCAA GTTCTACGCC AAACTGCGCG AAACCTCGCC

 351 GCAATCTTGG CTCTACTCGC CTGACGGCGG CGGCCATACC GGCAACGGCA

 401 CGCAGCGCGA AGCCGCCGAC GAACTCGCCT GCGTGTTGCT GTTTTTGAAA

 451 GAGTTTTTGG GCTAA
```

This corresponds to the amino acid sequence <SEQ ID 158; ORF 041.a>:

```
a041.pep
   1 ISSPEHIGLQ GGSNGGLITA AAFVREPQSI GALVCEVPLT DMIRYPLLSA

  51 GSSWTDEYGN PQKYEVCKRR LGELSPYHNL SDGIDYPPAL ITTSLSDDRV

 101 HPAHALKFYA KLRETSPQSW LYSPDGGGHT GNGTQREAAD ELACVLLFLK

 151 EFLG*
```

m041/a041 98.7% identity over a 154 aa overlap

```
                    10        20        30        40        50        60
m041.pep   ISSPEHIGLQGGSNGGLITAAAFVREPQSIGALVCEVPLTDMIRYPLLSAGSSWTDEYGN
           ||||||||||||||||||||||||||||||||||||||||||||||||||||||||||||
a041       ISSPEHIGLQGGSNGGLITAAAFVREPQSIGALVCEVPLTDMIRYPLLSAGSSWTDEYGN
                    10        20        30        40        50        60

                    70        80        90       100       110       120
m041.pep   PQKYEVCKRRLGELSPYHNLSDGIDYPPALITTSLSDDRVHPAHALKFYAKLRETSAQSW
           |||||||||||||||||||||||||||||||||||||||||||||||||||||||| |||
a041       PQKYEVCKRRLGELSPYHNLSDGIDYPPALITTSLSDDRVHPAHALKFYAKLRETSPQSW
                    70        80        90       100       110       120

                   130       140       150
m041.pep   LYSPDGGGHTGNGTQRESADELACVLLFLKEFLGX
           ||||||||||||||||:||||||||||||||||||
a041       LYSPDGGGHTGNGTQREAADELACVLLFLKEFLGX
                   130       140       150
```

Computer analysis of this amino acid sequence gave the following results:

Homology with a Predicted ORF from *N. gonorrhoeae*

ORF 041 shows 96.8% identity over a 154 aa overlap with a predicted ORF (ORF 041.ng) from *N. gonorrhoeae*:

```
m041/g041

                    10        20        30        40        50        60
m041.pep   ISSPEHIGLQGGSNGGLITAAAFVREPQSIGALVCEVPLTDMIRYPLLSAGSSWTDEYGN
           :|||:|||||||||||||||||||||||||||||||||||||||||||||||||||||||
g041       MSSPKHIGLQGGSNGGLITAAAFVREPQSIGALVCEVPLTDMIRYPLLSAGSSWTDEYGN
                    10        20        30        40        50        60

                    70        80        90       100       110       120
m041.pep   PQKYEVCKRRLGELSPYHNLSDGIDYPPALITTSLSDDRVHPAHALKFYAKLRETSAQSW
           |||||:|||||||||||||||||||||||||||||||||||||||||||||||||| |||
g041       PQKYEACKRRLGELSPYHNLSDGIDYPPALITTSLSDDRVHPAHALKFYAKLRETSPQSW
                    70        80        90       100       110       120
```

-continued

```
                130       140       150
m041.pep   LYSPDGGGHTGNGTQRESADELACVLLFLKEFLGX
           |||||||||||||||||||:|||||||||||||||
g041       LYSPDGGGHTGNGTQRESADKLACVLLFLKEFLGX
                130       140       150
```

The following partial DNA sequence was identified in *N. gonorrhoeae* <SEQ ID 159>:

```
g041-1.seq
   1 ATGAAATCCT ACCCCGACCC CTACCGCCAT TTTGAAAACC TCGATTCCGC
  51 CGAAACGCAA AACTTCGCTG CTGAAGCGAA TGCCGAAACG CGCGCGCGTT
 101 TTTTAAACAA CGACAAGGCG CGCGCACTTT CAGACGGCAT TTTGAATCAA
 151 ATGCAGGACA CGCGGCAGAT TCCGTTTTGT CAGGAACACC GCGCGCGGAT
 201 GTACCATTTC CATCAGAATG CGGAATATCC GAAGGGCGTG TACCGCATGT
 251 GTACGGCGGC GACCTACCGT TCCGGCTATC CCGAGTGGAA AATCCTGTTT
 301 TCGGTGGCGG ATTTCGATGA GTTGCTCGGC GACGATGTGT ATTTGGGCGG
 351 CGTGTCGCAC TTGGTGGAGC AGCCCAACCG CGCGCTGCTG ACTTTGAACA
 401 AATCGGGCGG CGATACGGCG TATACGCTGG AAGTGGATTT GGAAGCAGGG
 451 GAATTGGTAG AGGGCGGTTT TCACTTTCCG GCAGGCAAAA ACCATGTGTC
 501 GTGGCGCGAT GAAAACAGCG TGTGGGTGTG TCCGGCTTGG GACGAACGCC
 551 AGTTGACCGA ATCGGGCTAT CCGCGCGAAG TGTGGCTGGT GGAACGCGGC
 601 AAGAGTTTCG AGGAAAGCCT GCCGGCGTAC CAAATCGATA AAGGCGCGAT
 651 GATGGTAAAC GCGTGGCGTT ACCTCGATCC GCAGGGTTCG CCGATTGATT
 701 TGATTGAAGC GTCGGACGGT TTTTACACCA AGACGTATTT GCAGGTGTCG
 751 TCCGAAGGCG GGGCGAAACC GTTGAACCTG CCTAATGATT GCGATGTGGT
 801 CGGCTATCTG GCGGGACATC TTTTGCTGAC GCTGCGCAAG GACTGGCACC
 851 GCGCGAACCA AAGCTATCCG AGTGGCGCGT TGGTGGCGGT GAAACTGAAT
 901 CGGGGCGAAC TCGGGGCGGC GCAGCTTTTG TTTGCGCCCG ATGAAACGCA
 951 GGCATTGGAA AGCGTGGAAA CGACCAAGCG TTTTGTGGTG GCAAGCCTGC
1001 TGGAGAATGT ACAAGGCCGT CTGAAAGCGT GGCGGTTTGC CGACAGCAAA
1051 TGGCAGGAAG CCGAGTTGCC GCACCTGCCC TCGGGCGCGT TGGAAATGAC
1101 CGACCAACCG TGGGGCGGCG ACGTGGTTTA TCTTGCCGCC AGCGATTTCA
1151 CCACGCCGCT GACGCTGTTT GCGCTGGATT TGAACGTGAT GGAACTGACC
1201 GTCATGCGCC TCCAGCCGCA GCAGTTTGTT TCAGACGGCA TCGAAGTGCG
1251 GCAGTTTTGG GCGGTGTCGT CCGACGGCGA ACGCATTCCT TATTTCCACG
1301 TCGGCAAAAA CGCCGCGCCC GACACGCCGA CCTTAGTCTA TGCTTACGGA
1351 GGTTTCGGCA TTCCTGAATT GCCGCATTAT CTGGGCAGCG TCGGCAAATA
1401 TTGGCTGGAA GAGGGCAATG CCTTTGTATT GGCAAACATC CGCGGCGGCG
1451 GAGAATTCGG CCCGCGCTGG CATCAGGCGG CGCAGGGAAT CAGCAAACAC
1501 AAAAGCGTTG ATGATTTGTT GGCAGTCGTG CGTGATTTGT CCGAACGCGG
1551 CATGAGTTCG CCCAAACACA TCGGCTTGCA GGGCGGCAGC AACGGCGGCC
1601 TGATTACCGC CGCCGCCTTC GTGCGCGAAC CGCAAAGCAT CGGTGCGCTG
1651 GTGTGCGAAG TACCGCTGAC CGATATGATC CGTTATCCGC TGCTGTCCGC
```

-continued

```
1701 CGGTTCAAGT TGGACGGACG AATACGGCAA TCCGCAGAAA TACGAAGCCT

1751 GCAAACGCCG GCTGGGCGAA TTGTCGCCGT ATCACAATCT TTCAGACGGC

1801 ATCGATTATC CGCCCGCACT CATTACCACC AGCCTCAGCG ACGACCGCGT

1851 CCATCCCGCC CACGCGCTCA AATTCTACGC CAAACTGCGC GAAACCTCGC

1901 CGCAATCTTG GCTCTACTCG CCTGACGGCG GCGGCCATAC CGGCAACGGC

1951 ACCCAACGCG AATCCGCCGA CAAACTCGCC TGCGTGTTGC TGTTTTTGAA

2001 AGAATTTTTG GGATAA
```

This corresponds to the amino acid sequence <SEQ ID 160; ORF 041-1.>:

```
g041-1.pep
   1 MKSYPDPYRH FENLDSAETQ NFAAEANAET RARFLNNDKA RALSDGILNQ

  51 MQDTRQIPFC QEHRARMYHF HQNAEYPKGV YRMCTAATYR SGYPEWKILF

 101 SVADFDELLG DDVYLGGVSH LVEQPNRALL TLNKSGGDTA YTLEVDLEAG

 151 ELVEGGFHFP AGKNHVSWRD ENSVWVCPAW DERQLTESGY PREVWLVERG

 201 KSFEESLPAY QIDKGAMMVN AWRYLDPQGS PIDLIEASDG FYTKTYLQVS

 251 SEGGAKPLNL PNDCDVVGYL AGHLLLTLRK DWHRANQSYP SGALVAVKLN

 301 RGELGAAQLL FAPDETQALE SVETTKRFVV ASLLENVQGR LKAWRFADSK

 351 WQEAELPHLP SGALEMTDQP WGGDVVYLAA SDFTTPLTLF ALDLNVMELT

 401 VMRLQPQQFV SDGIEVRQFW AVSSDGERIP YFHVGKNAAP DTPTLVYAYG

 451 GFGIPELPHY LGSVGKYWLE EGNAFVLANI RGGGEFGPRW HQAAQGISKH

 501 KSVDDLLAVV RDLSERGMSS PKHIGLQGGS NGGLITAAAF VREPQSIGAL

 551 VCEVPLTDMI RYPLLSAGSS WTDEYGNPQK YEACKRRLGE LSPYHNLSDG

 601 IDYPPALITT SLSDDRVHPA HALKFYAKLR ETSPQSWLYS PDGGGHTGNG

 651 TQRESADKLA CVLLFLKEFL G*
```

The following partial DNA sequence was identified in *N. meningitidis* <SEQ ID 161>:

```
m041-1.seq
   1 ATGAAATCCT ACCCCGACCC CTACCGCCAT TTTGAAAACC TCGATTCCGC

  51 CGAAACGCAA AACTTCGCTG CTGAAGCGAA TGCCGAAACG CGCGCGCGTT

 101 TTTTAGAAAA CGACAAGGCG CGCGCGCTTT CAGACGGCAT TTTGGCGCAG

 151 TTGCAGGACA CGCGGCAGAT TCCGTTTTGT CAGGAACACC GCGCGCGGAT

 201 GTACCATTTC CATCAGGACG CGGAGTATCC GAAGGGCGTG TACCGCGTGT

 251 GTACCGCGGC GACGTATCGT TCCGGCTATC CCGAGTGGAA AATCCTGTTT

 301 TCGGTGGCGG ATTTCGACGA ATTGCTTGGC GACGATGTGT ATTTGGGCGG

 351 CGTGTCGCAC TTGGTGGAAC AGCCCAACCG CGCGTTGTTA ACACTGAGCA

 401 AATTGGGCAG CGATACGGCG TACACGCTGG AAGTGGATTT GGAAGCAGGG

 451 GAGTTGGTCG AAGGCGGTTT TCACTTTCCG GCAGGCAAAA ACCATGTGTC

 501 GTGGCGCGAT GAAAACAGCG TGTGGGTGTG TCCGGCTTGG AACGAACGCC

 551 AGTTGACCCA ATCGGGCTAT CCGCGCGAAG TATGGCTGGT GGAACGCGGC

 601 AAGAGTTTCG AGGAAAGCCT GCCTGTGTAT CAAATCGGCG AAGACGGCAT
```

-continued

```
 651 GATGGTGAAC GCGTGGCGTT ATCTCGATCC GCAGGGTTCG CCGATTGATT
 701 TGATTGAAGC GTCGGACGGT TTTTACACCA AAACCTATTT GCGGGTCTCA
 751 GCCGAAGGCG AGGCGAAACC GTTAAACCTG CCCAACGATT GCGACGTGGT
 801 CGGCTATCTG GCGGGGCATC TTTTGCTGAC GCTGCGCAAG GACTGGAACC
 851 GCGCGAACCA AAGCTATCCG AGCGGCGCGC TGGTGGCGGT GAAGCTGAAT
 901 CGGGGCGAAC TCGGGGCGGC GCAGCTTTTG TTTGCGCCCG ATGAAACGCA
 951 GGCATTGGAA AGCGTGGAAA CGACCAAGCG TTTTGTGGTG GCGAGCCTGT
1001 TGGAGAACGT ACAAGGCCGT CTGAAAGCAT GGCGGTTTGC CGACGGCAAA
1051 TGGCAGGAAG TCGAATTGCC GCGCCTGCCT TCGGGCGCGT TGGAAATGAC
1101 CGACCAACCT TGGGGCGGCG ACGTGGTTTA CCTTGCCGCC AGCGATTTCA
1151 CCACGCCGCT GACGCTGTTT GCGCTGGATT TGAACGTGAT GGAACTGACC
1201 GTCATGCGCC GCCAGCCGCA GCAGTTTGAT TCAGACGGCA TTAACGTGCA
1251 GCAGTTTTGG ACGACTTCGG CTGACGGCGA GCGCATTCCT TATTTCCACG
1301 TCGGCAAAAA CGCCGCGCCC GACATGCCGA CGCTGGTCTA TGCCTACGGC
1351 GGTTTCGGCA TTCCCGAATT GCCGCATTAT CTGGGCAGCA TTGGCAAATA
1401 TTGGCTGGAA GAGGGCAATG CCTTTGTATT GGCGAACATC CGCGGCGGCG
1451 GCGAGTTCGG CCCGCGCTGG CATCAGGCGG CGCAGGGAAT CAGCAAACAT
1501 AAAAGCGTTG ATGATTTATT GGCAGTCGTG CGCGATTTGT CCGAACGCGG
1551 TATCAGTTCG CCCGAACACA TCGGCTTGCA GGGCGGCAGC AACGGCGGAC
1601 TGATTACTGC CGCCGCCTTC GTGCGCGAAC CGCAAAGCAT CGGCGCGCTG
1651 GTGTGCGAAG TGCCGCTGAC CGACATGATC CGTTATCCGC TGCTCTCCGC
1701 CGGTTCAAGC TGGACAGACG AATACGGCAA TCCGCAAAAA TACGAAGTCT
1751 GCAAACGCCG GTTGGGCGAA TTGTCGCCGT ATCACAATCT TTCAGACGGC
1801 ATCGATTATC CGCCCGCGCT CATTACCACC AGCCTGTCCG ACGATCGCGT
1851 CCATCCCGCC CACGCGCTCA AGTTCTACGC CAAACTGCGC GAAACCTCCG
1901 CGCAATCTTG GCTCTACTCG CCTGACGGCG GCGGCCATAC CGGCAACGGC
1951 ACCCAACGCG AATCCGCCGA CGAACTCGCC TGCGTCTTGC TGTTTTTGAA
2001 AGAGTTTTTG GGCTAA
```

This corresponds to the amino acid sequence <SEQ ID 162; ORF 041-1>:

```
m041-1.pep
      1 MKSYPDPYRH FENLDSAETQ NFAAEANAET RARFLENDKA RALSDGILAQ
     51 LQDTRQIPFC QEHRARMYHF HQDAEYPKGV YRVCTAATYR SGYPEWKILF
    101 SVADFDELLG DDVYLGGVSH LVEQPNRALL TLSKLGSDTA YTLEVDLEAG
    151 ELVEGGFHFP AGKNHVSWRD ENSVWVCPAW NERQLTQSGY PREVWLVERG
    201 KSFEESLPVY QIGEDGMMVN AWRYLDPQGS PIDLIEASDG FYTKTYLRVS
    251 AEGEAKPLNL PNDCDVVGYL AGHLLLTLRK DWNRANQSYP SGALVAVKLN
    301 RGELGAAQLL FAPDETQALE SVETTKRFVV ASLLENVQGR LKAWRFADGK
    351 WQEVELPRLP SGALEMTDQP WGGDVVYLAA SDFTTPLTLF ALDLNVMELT
    401 VMRRQPQQFD SDGINVQQFW TTSADGERIP YFHVGKNAAP DMPTLVYAYG
```

-continued

```
451 GFGIPELPHY LGSIGKYWLE EGNAFVLANI RGGGEFGPRW HQAAQGISKH

501 KSVDDLLAVV RDLSERGISS PEHIGLQGGS NGGLITAAAF VREPQSIGAL

551 VCEVPLTDMI RYPLLSAGSS WTDEYGNPQK YEVCKRRLGE LSPYHNLSDG

601 IDYPPALITT SLSDDRVHPA HALKFYAKLR ETSAQSWLYS PDGGGHTGNG

651 TQRESADELA CVLLFLKEFL G*
```

m041-1/g041-1 94.6% identity in 671 aa overlap

```
                    10        20        30        40        50        60
m041-1.pep  MKSYPDPYRHFENLDSAETQNFAAEANAETRARFLENDKARALSDGILAQLQDTRQIPFC
            ||||||||||||||||||||||||||||||||||||:|||||||||||| |:||||||||
g041-1      MKSYPDPYRHFENLDSAETQNFAAEANAETRARFLNNDKARALSDGILNQMQDTRQIPFC
                    10        20        30        40        50        60

                    70        80        90       100       110       120
m041-1.pep  QEHRARMYHFHQDAEYPKGVYRVCTAATYRSGYPEWKILFSVADFDELLGDDVYLGGVSH
            ||||||||||||:|||||||||:|||||||||||||||||||||||||||||||||||||
g041-1      QEHRARMYHFHQNAEYPKGVYRMCTAATYRSGYPEWKILFSVADFDELLGDDVYLGGVSH
                    70        80        90       100       110       120

                   130       140       150       160       170       180
m041-1.pep  LVEQPNRALLTLSKLGSDTAYTLEVDLEAGELVEGGFHFPAGKNHVSWRDENSVWVCPAW
            ||||||||||||:| |:|||||||||||||||||||||||||||||||||||||||||||
g041-1      LVEQPNRALLTLNKSGGDTAYTLEVDLEAGELVEGGFHFPAGKNHVSWRDENSVWVCPAW
                   130       140       150       160       170       180

                   190       200       210       220       230       240
m041-1.pep  NERQLTQSGYPREVWLVERGKSFEESLPVYQIGEDGMMVNAWRYLDPQGSPIDLIEASDG
            :|||||:|||||||||||||||||||||:||| : :||||||||||||||||||||||||
g041-1      DERQLTESGYPREVWLVERGKSFEESLPAYQIDKGAMMVNAWRYLDPQGSPIDLIEASDG
                   190       200       210       220       230       240

                   250       260       270       280       290       300
m041-1.pep  FYTKTYLRVSAEGEAKPLNLPNDCDVVGYLAGHLLLTLRKDWNRANQSYPSGALVAVKLN
            |||||||:||:|| ||||||||||||||||||||||||||||:|||||||||||||||||
g041-1      FYTKTYLQVSSEGGAKPLNLPNDCDVVGYLAGHLLLTLRKDWHRANQSYPSGALVAVKLN
                   250       260       270       280       290       300

                   310       320       330       340       350       360
m041-1.pep  RGELGAAQLLFAPDETQALESVETTKRFVVASLLENVQGRLKAWRFADGKWQEVELPRLP
            ||||||||||||||||||||||||||||||||||||||||||||||||:||||:|||:||
g041-1      RGELGAAQLLFAPDETQALESVETTKRFVVASLLENVQGRLKAWRFADSKWQEAELPHLP
                   310       320       330       340       350       360

                   370       380       390       400       410       420
m041-1.pep  SGALEMTDQPWGGDVVYLAASDFTTPLTLFALDLNVMELTVMRRQPQQFDSDGINVQQFW
            ||||||||||||||||||||||||||||||||||||||||||| ||||| ||||:|:|||
g041-1      SGALEMTDQPWGGDVVYLAASDFTTPLTLFALDLNVMELTVMRLQPQQFVSDGIEVRQFW
                   370       380       390       400       410       420

                   430       440       450       460       470       480
m041-1.pep  TTSADGERIPYFHVGKNAAPDMPTLVYAYGGFGIPELPHYLGSIGKYWLEEGNAFVLANI
            ::|:||||||||||||||| |||||||||||||||||||||:||||||||||||||||
g041-1      AVSSDGERIPYFHVGKNAAPDTPTLVYAYGGFGIPELPHYLGSVGKYWLEEGNAFVLANI
                   430       440       450       460       470       480

                   490       500       510       520       530       540
m041-1.pep  RGGGEFGPRWHQAAQGISKHKSVDDLLAVVRDLSERGISSPEHIGLQGGSNGGLITAAAF
            |||||||||||||||||||||||||||||||||||||:|||:||||||||||||||||||
g041-1      RGGGEFGPRWHQAAQGISKHKSVDDLLAVVRDLSERGMSSPKHIGLQGGSNGGLITAAAF
                   490       500       510       520       530       540

                   550       560       570       580       590       600
m041-1.pep  VREPQSIGALVCEVPLTDMIRYPLLSAGSSWTDEYGNPQKYEVCKRRLGELSPYHNLSDG
            ||||||||||||||||||||||||||||||||||||||||||:|||||||||||||||||
g041-1      VREPQSIGALVCEVPLTDMIRYPLLSAGSSWTDEYGNPQKYEACKRRLGELSPYHNLSDG
                   550       560       570       580       590       600

                   610       620       630       640       650       660
m041-1.pep  IDYPPALITTSLSDDRVHPAHALKFYAKLRETSAQSWLYSPDGGGHTGNGTQRESADELA
            ||||||||||||||||||||||||||||||||| |||||||||||||||||||||||:||
g041-1      IDYPPALITTSLSDDRVHPAHALKFYAKLRETSPQSWLYSPDGGGHTGNGTQRESADKLA
                   610       620       630       640       650       660

                   670
m041-1.pep  CVLLFLKEFLGX
            ||||||||||||
g041-1      CVLLFLKEFLGX
                   670
```

```
m041-1 (SEQ ID 162)/P55577 (SEQ ID 4159)
sp|P55577|Y4NA_RHISN PROBABLE PEPTIDASE Y4NA > gi|2182536 (AE000086) Y4nA [Rhizobium sp.
NGR234] Length = 726
Score = 370 bits (940), Expect = e-101
Indentities = 217/682 (31%), Positives = 331/682 (47%), Gaps = 22/682 (3%)
```

-continued

```
Query:   2 KSYPDPYRHFENLDSAETQNFAAEANAETRARFLENDKARALSDGILAQLQDTRQIPFCQ  61
           K   DP  +   +D  +   +    N  T  +  ++ +        L  LQ T +I
Sbjct:  42 KDASDPRAYLNEIDGDKAMTWVEAHNLSTVDKLSKDPRYSEYQADALTILQATDRIASPS 101

Query:  62 EHRARMY-HFHQDAEYPKGVYRVCTAATYRSGYPEWKILFSVADFDELLGDDVYLGGVSH 120
             R  M  +F QD  + +G++R  T  +YRSG P+W+ +  V    +  G      G
Sbjct: 102 FARDGMIDNFWQDGTHVQGLWRRTTWESYRSGNPQWRTILDVDALSKAEGKTWVFEGGDC 161

Query: 121 LVEQPNRALLTLSKLGSDTAYTLEVDLEAGELVEGGFHFPAGKNHVSWRDENSVWVCPAW 180
           L    N  L+ LS  G D     E D+  GE V+ GF  P GK  V+W DEN+++V   W
Sbjct: 162 LPPTSNLCLIRLSDGGKDADVVREFDIAKGEFVKEGFVLPEGKQSVTWVDENTIYVTREW 221

Query: 181 NERQLTQSGYPREVWLVERGKSFEESLPVYQ------IGEDGMM--VNAWRYLDPQGSPI 232
              ++T SGY     +V+RG+S ++++ +++        E G++  ++    +D     +
Sbjct: 222 TPGEVTSSGYAYVTKVVKRGQSLDQAVEIFRGQKKDVSAERGVLRDIDGKYVMDTSYRGL 281

Query: 233 DLIEASDGFYTKTYLRVSAEGEAKPLNLPNDCDVVGYLAGHLLLTLRKDWNRANQS-YPS 291
           D       FY   +     +     L LP      GY  G  +  L+ DW  A  + + +
Sbjct: 282 DFFNTELAFYPNGH----PDTRKVVLPLPTTAVFSGYYKGQAIYWLKSDWTSAKGTVFHN 337

Query: 292 GALVAVKLNRGELGAAQL----LFAPDETQALESVETTKRFVVASLLENVQGRLKAWRFA 347
           GA++A  L       A++    LF P+E Q++     TK  +V S+L NV   ++++ F
Sbjct: 338 GAIIAFDLKAALADPARVEPLVLFMPNEHQSVAGTTQTKNRLVLSILSNVTSEVRSFDFG 397

Query: 348 DGKWQEVELPRLPSGALEMTDQPWGGDVVYLAASDFTTPLTLFALDLNVMELTVMRRQPQ 407
            G W   +L    +  L +T      D +++ +  F  P TLF  D    ++  +   P
Sbjct: 398 KGGWSSFKLALPENSTLSLTSSDDESDQLFVFSEGFLEPSTLFCADAATGQVEKITSTPA 457

Query: 408 QFDSDGINVQQFWTTSADGERIPYFHVGKNAAP---DMPTLVYAYGGFGIPELPHYLGSI 464
           +FD+ G+  QQFW TS DG ++PYF V +         PT++YAYGGF IP  P Y   +
Sbjct: 458 RFDAGGLQAQQFWATSKDGTKVPYFLVARKDVKLDGTNPTILYAYGGFQIPMQPSYSAVL 517

Query: 465 GKYWLEEGNAFVLANIRGGGEFGPRWHQAAQGISKHKSVDDLLAVVRDLSERGISSPEHI 524
           GK WLE+G A+ LANIRGGGEFGP+WH A    ++ +  DD  AV +DL  + ++S  H+
Sbjct: 518 GKLWLEKGGAYALANIRGGGEFGPKWHDAGLKTNRQRVYDDFQAVAQDLIAKKVTSTPHL 577

Query: 525 GLQGGSNGGLITAAAFVREPQSIGALVCEVPLTDMIRYPLLSAGSSWTDEYGNPQKYEVC 584
           G+ GGWSNGGL+    ++ P    A+V +VPL DM+ +  +SAG+SW  EYG+P    V
Sbjct: 578 GIMGGSNGGLLMGVQMIQRPDLWNAVVIQVPLLDMVNFTRMSAGASWQAEYGSPDD-PVE 636

Query: 585 KRRLGELSPYHNLSDGIDYPPALITTSLSDDRVHPAHALKFYAKLRETSAQSWLYSPDGG 644
              L  +SPYHN   G+ YP     TS  DDRV P HA K  A   +     + Y    G
Sbjct: 637 GAFLRSISPYHNVKAGVAYPEPFFETSTKDDRVGPVHARKMAALFEDMGLPFYYYENIEG 696

Query: 645 GHTGNGTQRESADELACVLLFL                                       666
           GH      +E A       +++
Sbjct: 697 GHAAAANLQEHARRYALEYIYM                                       718
```

The following partial DNA sequence was identified in *N. meningitidis* <SEQ ID 163>:

```
a041-1.seq
  1 ATGAAATCCT ACCCCGACCC CTACCGCCAT TTTGAAAACC TCGATTCCGC

 51 CGAAACGCAA AACTTCGCTG CTGAAGCGAA TGCCGAAACG CGCGCGCGTT

101 TTTTAAACAA CGACAAGGCA CGCGCATTGT CTGACGGCAT TTTGGCGCAG

151 TTGCAGGACA CGCGGCAAAT TCCGTTTTGT CAGGAACACC GCGCGCGGAT

201 GTACCATTTC CATCAAGATG CGGAATATCC GAAAGGCGTG TACCGCGTGT

251 GTACCGCGGC GACTTACCGT TCGGGCTATC CTGAGTGGAA AATCCTGTTT

301 TCGGTGGCGG ATTTCGACGA ATTGCTCGGT GACGATGTAT ATCTAGGCGG

351 CGTGTCGCAC CTGGTGGAAC AGCCCAACCG CGCGTTGTTA ACACTGAGCA

401 AATCGGGCGG CGATACCGCG TACACGCTGG AAGTGGATTT GGAAGCAGGG

451 GAGTTGGTAG AAGGCGGTTT TCACTTTCCG GCAGGCAAAA ACCATGTGTC

501 GTGGCGCGAT GAAAACAGCG TGTGGGTGTG TCCGGCTTGG GACGAACGCC

551 AGTTGACCGA ATCGGGCTAT CCGCGCGAGG TGTGGCTGGT GGAACGCGGC

601 AAGAGTTTCG AGGAAAGCCT GCCGGTGTAC CAAATTGCTG AAGACGGCAT

651 GATGGTGAAC GCGTGGCGTT ACCTCGATCC GCAGGGTTCG CCGATTGATT

701 TGATTGAAGC GTCTGACGGT TTTTACACCA AAACCTATTT GCAGGTCTCA

751 GCCGAAGGCG AAGCGAAACC GTTAAACCTG CCCAACGATT GCGACGTAGT

801 CGGCTATCTG GCCGGACATC TTTTGCTGAC CTTGCGTAAA GACTGGCACC

851 GCGCGAACCA AAGCTATCCG AGTGGCGCAT TGGTAGCAGT AAAATTAAAC
```

-continued

```
 901 CGCGGCGAAT TGGGCGCGGC GCAGCTTTTG TTTGCGCCCA ATGAAACGCA

 951 GGCATTGGAA AGCGTGGAAA CGACCAAGCG TTTTGTCGTG GCGAGCCTGC

1001 TGGAAAACGT ACAGGGTCGT CTGAAAGCGT GGCGTTTTAC TGATGGCAAA

1051 TGGCAGGAAA CCGAGTTGCC GCGCCTGCCT TCGGGCGCGT TGGAAATGAC

1101 CGACCAACCG TGGGGGGGCG ACGTAGTTTA CCTTGCCGCC AGCGATTTCA

1151 CCACGCCGCT GACGCTGTTT GCATTGGATT TGAACGTGAT GGAACTGACC

1201 GTCATGCGCC GCCAGCCGCA GCAGTTTGAT TCAGACGGCA TTAACGTGCA

1251 GCAGTTTTGG ACGACTTCGG CTGACGGCGA GCGCATTCCT TATTTCCACG

1301 TCGGCAAAAA CGCCGCGCCC GACATGCCGA CGCTGGTCTA TGCCTACGGC

1351 GGTTTCGGCA TTCCCGAATT GCCGCATTAT CTGGGCAGCA TTGGCAAATA

1401 TTGGCTGGAA GAGGGCAATG CCTTTGTATT GGCGAACATC CGCGGCGGCG

1451 GCGAGTTCGG CCCGCGCTGG CATCAGGCGG CGCAGGGAAT CAGCAAACAT

1501 AAAAGCGTTG ATGATTTATT GGCAGTCGTG AGCGATTTGT CCGAACGCGG

1551 TATCAGTTCG CCCGAACACA TCGGCTTGCA GGGCGGCAGC AACGGCGGAC

1601 TGATTACTGC CGCCGCCTTC GTGCGCGAAC CGCAAAGCAT AGGCGCGCTG

1651 GTGTGCGAAG TGCCGCTGAC CGACATGATC CGTTATCCGC TGCTCTCCGC

1701 CGGTTCAAGC TGGACAGACG AATACGGCAA TCCGCAAAAA TACGAAGTCT

1751 GCAAACGCCG GTTGGGCGAA TTGTCGCCGT ATCACAATCT TTCAGACGGC

1801 ATCGATTATC CGCGCGCGTT CATTACCACC AGCCTGTCCG ACGATCGCGT

1851 CCATCCCGCC CACGCGCTCA AGTTCTACGC CAAACTGCGC GAAACCTCGC

1901 CGCAATCTTG GCTCTACTCG CCTGACGGCG GCGGCCATAC CGGCAACGGC

1951 ACGCAGCGCG AAGCCGCCGA CGAACTCGCC TGCGTGTTGC TGTTTTTGAA

2001 AGAGTTTTTG GGCTAA
```

This corresponds to the amino acid sequence <SEQ ID 164; ORF 041-1.a>:

```
a041-1.pep

  1 MKSYPDPYRH FENLDSAETQ NFAAEANAET RARFLNNDKA RALSDGILAQ
 51 LQDTRQIPFC QEHRARMYHF HQDAEYPKGV YRVCTAATYR SGYPEWKILF
101 SVADFDELLG DDVYLGGVSH LVEQPNRALL TLSKSGGDTA YTLEVDLEAG
151 ELVEGGFHFP AGKNHVSWRD ENSVWVCPAW DERQLTESGY PREVWLVERG
201 KSFEESLPVY QIAEDGMMVN AWRYLDPQGS PIDLIEASDG FYTKTYLQVS
251 AEGEAKPLNL PNDCDVVGYL AGHLLLTLRK DWHRANQSYP SGALVAVKLN
301 RGELGAAQLL FAPNETQALE SVETTKRFVV ASLLENVQGR LKAWRFTDGK
351 WQETELPRLP SGALEMTDQP WGGDVVYLAA SDFTTPLTLF ALDLNVMELT
401 VMRRQPQQFD SDGINVQQFW TTSADGERIP YFHVGKNAAP DMPTLVYAYG
451 GFGIPELPHY LGSIGKYWLE EGNAFVLANI RGGGEFGPRW HQAAQGISKH
501 KSVDDLLAVV SDLSERGISS PEHIGLQGGS NGGLITAAAF VREPQSIGAL
551 VCEVPLTDMI RYPLLSAGSS WTDEYGNPQK YEVCKRRLGE LSPYHNLSDG
601 IDYPPALITT SLSDDRVHPA HALKFYAKLR ETSPQSWLYS PDGGGHTGNG
651 TQREAADELA CVLLFLKEFL G*

a041-1/m041-1  97.9% identity in 671 aa overlap
```

-continued

```
                    10        20        30        40        50        60
m041-1.pep  MKSYPDPYRHFENLDSAETQNFAAEANAETRARFLNNDKARALSDGILAQLQDTRQIPFC
            |||||||||||||||||||||||||||||||||||:||||||||||||||||||||||||
m041-1      MKSYPDPYRHFENLDSAETQNFAAEANAETRARFLENDKARALSDGILAQLQDTRQIPFC
                    10        20        30        40        50        60

70        80        90       100       110       120
m041-1.pep  QEHRARMYHFHQDAEYPKGVYRVCTAATYRSGYPEWKILFSVADFDELLGDDVYLGGVSH
            ||||||||||||||||||||||||||||||||||||||||||||||||||||||||||||
m041-1      QEHRARMYHFHQDAEYPKGVYRVCTAATYRSGYPEWKILFSVADFDELLGDDVYLGGVSH
                    70        80        90       100       110       120

130       140       150       160       170       180
m041-1.pep  LVEQPNRALLTLSKSGGDTAYTLEVDLEAGELVEGGFHFPAGKNHVSWRDENSVWVCPAW
            |||||||||||||| |:|||||||||||||||||||||||||||||||||||||||||||
m041-1      LVEQPNRALLTLSKLGSDTAYTLEVDLEAGELVEGGFHFPAGKNHVSWRDENSVWVCPAW
                   130       140       150       160       170       180

190       200       210       220       230       240
m041-1.pep  DERQLTESGYPREVWLVERGKSFEESLPVYQIAEDGMMVNAWRYLDPQGSPIDLIEASDG
            :|||||:|||||||||||||||||||||||||:|||||||||||||||||||||||||||
m041-1      NERQLTQSGYPREVWLVERGKSFEESLPVYQIGEDGMMVNAWRYLDPQGSPIDLIEASDG
                   190       200       210       220       230       240

250       260       270       280       290       300
m041-1.pep  FYTKTYLQVSAEGEAKPLNLPNDCDVVGYLAGHLLLTLRKDWHRANQSYPSGALVAVKLN
            |||||||:||||||||||||||||||||||||||||||||||:|||||||||||||||||
m041-1      FYTKTYLRVSAEGEAKPLNLPNDCDVVGYLAGHLLLTLRKDWNRANQSYPSGALVAVKLN
                   250       260       270       280       290       300

310       320       330       340       350       360
m041-1.pep  RGELGAAQLLFAPNETQALESVETTKRFVVASLLENVQGRLKAWRFTDGKWQETELPRLP
            |||||||||||||:||||||||||||||||||||||||||||||||:||||||:||||||
m041-1      RGELGAAQLLFAPDETQALESVETTKRFVVASLLENVQGRLKAWRFADGKWQEVELPRLP
                   310       320       330       340       350       360

370       380       390       400       410       420
m041-1.pep  SGALEMTDQPWGGDVVYLAASDFTTPLTLFALDLNVMELTVMRRQPQQFDSDGINVQQFW
            ||||||||||||||||||||||||||||||||||||||||||||||||||||||||||||
m041-1      SGALEMTDQPWGGDVVYLAASDFTTPLTLFALDLNVMELTVMRRQPQQFDSDGINVQQFW
                   370       380       390       400       410       420

430       440       450       460       470       480
m041-1.pep  TTSADGERIPYFHVGKNAAPDMPTLVYAYGGFGIPELPHYLGSIGKYWLEEGNAFVLANI
            ||||||||||||||||||||||||||||||||||||||||||||||||||||||||||||
m041-1      TTSADGERIPYFHVGKNAAPDMPTLVYAYGGFGIPELPHYLGSIGKYWLEEGNAFVLANI
                   430       440       450       460       470       480

490       500       510       520       530       540
m041-1.pep  RGGGEFGPRWHQAAQGISKHKSVDDLLAVVSDLSERGISSPEHIGLQGGSNGGLITAAAF
            |||||||||||||||||||||||||||||| |||||||||||||||||||||||||||||
m041-1      RGGGEFGPRWHQAAQGISKHKSVDDLLAVVRDLSERGISSPEHIGLQGGSNGGLITAAAF
                   490       500       510       520       530       540

550       560       570       580       590       600
m041-1.pep  VREPQSIGALVCEVPLTDMIRYPLLSAGSSWTDEYGNPQKYEVCKRRLGELSPYHNLSDG
            ||||||||||||||||||||||||||||||||||||||||||||||||||||||||||||
m041-1      VREPQSIGALVCEVPLTDMIRYPLLSAGSSWTDEYGNPQKYEVCKRRLGELSPYHNLSDG
                   550       560       570       580       590       600

610       620       630       640       650       660
m041-1.pep  IDYPPALITTSLSDDRVHPAHALKFYAKLRETSPQSWLYSPDGGGHTGNGTQREAADELA
            ||||||||||||||||||||||||||||||||| ||||||||||||||||||||:|||||
m041-1      IDYPPALITTSLSDDRVHPAHALKFYAKLRETSAQSWLYSPDGGGHTGNGTQRESADELA
                   610       620       630       640       650       660

670
m041-1.pep  CVLLFLKEFLGX
            ||||||||||||
m041-1      CVLLFLKEFLGX
                   670
```

The following partial DNA sequence was identified in *N. gonorrhoeae* <SEQ ID 165>:

```
g042.seq
  1  ATGACGATGA TTTGCTTGCG CTTCCAagcG TTCGTGCCGC ATACCAGCGC

51  GTTATCCAAC ACTTCCACGG CAGCCGGCCC TTCCTGCCCG ATGGCGGCGG

101  TGCGGTCGAT GATGAAAATC CAGCCGGGGT TTTTCTCTTT GATGTATTCG

151  AAGGAAACGG GCTGCCCGTG CCCTTCGTTG CGTAAAGATT CGTCCACGGG

201  CGGCAGGCCG ATGTCGCCGT GTATCCAACT TGCCAACCGC GATTGCGTGC
```

-continued

251 CGAAGGCGGA CACCTTGTTG CCTGTAACCG ACAGCACCAG CCCGCGTCCT

301 TTGCCTTTGG cggCTTCGCG CTTTTGGGCG AACAGCGCGT CAATCTGCGC

351 ATTCAATTCC GCCACGCGCG CTTCCTTACC GAAAATCCGC GACAGGGTCT

401 CCATCTGCTT CTCGCCGCTG GTGCGGATAT TGCCGTTGTC CACCGTCAAA

451 TCTATGgtgG TCGCGTTTTT CGCCAACTGT TCATACGCTT CCGCACCCGG

501 CCCGCCGGTA ATGACAAACT GCGGATTGTG GCGGTGCAGG GATTCGCAAT

551 CGGGCTCAAA CAGCGTCCCC ACCGTTGCCG CCTTGTCAAA TGCAGGCTGC

601 AAATAG

This corresponds to the amino acid sequence <SEQ ID 166; ORF 042.ng>:

g042.pep

1 MTMICLRFQA FVPHTSALSN TSTAAGPSCP MAAVRSMMKI QPGFFSLMYS

51 KETGCPCPSL RKDSSTGGRP MSPCIQLANR DCVPKADTLL PVTDSTSPRP

101 LPLAASRFWA NSASICAFNS ATRASLPKIR DRVSICFSPL VRILPLSTVK

151 SMVVAFFANC SYASAPGPPV MTNCGLWRCR DSQSGSNSVP TVAALSNAGC

201 K*

The following partial DNA sequence was identified in *N. meningitidis* <SEQ ID 167>:

m042.seq

1 ATGACGATGA TTTGCTTGCG CTTCCAAGCG TTCGTGCCGC GTACCAGCGC

51 GTTATCCAmT ACTTCGACAG CCGcCGGCCy TTCyTGCCCG ATGGCGGCGG

101 TACGGTCGAT GATGAAAATC CAATCGGGGT TTTTCTCTTT GATGTATTCG

151 AAGGAAACAG GCTGCCCGTG CACCTTGTTG CGTAAAGATT CGTCTACAGG

201 CGGTAGGCCG ATGTCGCCGT GTATCCAACT TGCCAACCGC GACTGCGTGC

251 CGAAGGCGGA CACCTTGTTG CCCGTAACCG ACAGCACCAG CCCGCGTCCT

301 TTGCCTTTGG CGGCTTCGCG CGTTTGGGCG AACAGCGCGT CAATCTGCGC

351 CTTCAATTCC GCCGCGCGCG CTTCCTTGCC GAAAATCCGC GCCAAGGTCT

401 CCATCTGCTT TTCGCCGCTG GTGCGGATAT TGCCGTTGTC CACCGTCAGA

451 TCTATGGTGG TCGCGTTTTT CGCTAACTGT TCATACGCTT CCGCGCCCGG

501 CCCGCCGGTA ATGACAAGCT GAGGATTGTA GCGGTGCAGG GCTTCGTAAT

551 CGGGCTCGAA CAGCGTCCCC ACCGTTGCCG CCTTGTCAAA TGCAGGCTGC

601 AAATAA

This corresponds to the amino acid sequence <SEQ ID 168; ORF 042>:

m042.pep

1 MTMICLRFQA FVPRTSALSX TSTAAGXSCP MAAVRSMMKI QSGFFSLMYS

51 KETGCPCPSL RKDSSTGGRP MSPCIQLANR DCVPKADTLL PVTDSTSPRP

101 LPLAASRVWA NSASICAFNS AARASLPKIR AKVSICFSPL VRILPLSTVR

151 SMVVAFFANC SYASAPGPPV MTSXGLXRCR ASXSGSNSVP TVAALSNAGC

201 K*

The following partial DNA sequence was identified in *N. meningitidis* <SEQ ID 169>:

```
a042.seq
  1  ATGACGATGA TTTGCTTGCG CTTCCAAGCG TTCGTGCCGC GTACCAGCGC

 51  GTTATCCAAT ACTTCGACAG CCGCCGGCCC TTCCTGCCCG ATGGCGGCGG

101  TACGGTCGAT GATGAAAATC CAATCGGGGT TTTTCTCTTT GATGTATTCG

151  AAGGAAACAG GCTGCCCGTG CACCTTGTTG CGTAAAGATT CGTCTACAGG

201  CGGTAGGCCG ATGTCGCCGT GTATCCAACT TGCCAACCGC GACTGCGTGC

251  CGAAGGCGGA CACCTTGTTG CCCGTAACCG ACAGCACCAG CCCGCGTCCT

301  TTGCCTTTGG CGGCTTCGCG CGTTTGGGCG AACAGCGCGT CAATCTGCGC

351  CTTCAATTCC GCCGCGCGCG CTTCCTTGCC GAAAATCCGC GCCAAGGTCT

401  CCATCTGCTT TTCGCCGCTG GTGCGGATAT TGCCGTTGTC CACCGTCAGA

451  TCTATGGTGG TCGCGTTTTT CGCCAACTGT TCATACGCTT CCGCGCCCGG

501  CCCGCCGGTA ATGACAAGCT GAGGATTGTA GCGGTGCAGG GCTTCGTAAT

551  CGGGCTCGAA CAGCGTCCCC ACCGTTGCCG CCTTGTCAAA TGCAGGCTGC

601  AAATAA
```

This corresponds to the amino acid sequence <SEQ ID 170; ORF 042.a>:

```
a042.pep
  1  MTMICLRFQA FVPRTSALSN TSTAAGPSCP MAAVRSMMKI QSGFFSLMYS

 51  KETGCPCPSL RKDSSTGGRP MSPCIQLANR DCVPKADTLL PVTDSTSPRP

101  LPLAASRVWA NSASICAFNS AARASLPKIR AKVSICFSPL VRILPLSTVR

151  SMVVAFFANC SYASAPGPPV MTS*GL*RCR AS*SGSNSVP TVAALSNAGC

201  K*
```

m042/a042 99.0% identity over a 201 aa overlap

```
                   10        20        30        40        50        60
m042.pep   MTMICLRFQAFVPRTSALSXTSTAAGXSCPMAAVRSMMKIQSGFFSLMYSKETGCPCPSL
           |||||||||||||||||| |||||| |||||||||||||||||||||||||||||||||
a042       MTMICLRFQAFVPRTSALSNTSTAAGPSCPMAAVRSMMKIQSGFFSLMYSKETGCPCPSL
                   10        20        30        40        50        60

                   70        80        90       100       110       120
m042.pep   RKDSSTGGRPMSPCIQLANRDCVPKADTLLPVTDSTSPRPLPLAASRVWANSASICAFNS
           ||||||||||||||||||||||||||||||||||||||||||||||||||||||||||||
a042       RKDSSTGGRPMSPCIQLANRDCVPKADTLLPVTDSTSPRPLPLAASRVWANSASICAFNS
                   70        80        90       100       110       120

                  130       140       150       160       170       180
m042.pep   AARASLPKIRAKVSICFSPLVRILPLSTVRSMVVAFFANCSYASAPGPPVMTSXGLXRCR
           ||||||||||||||||||||||||||||||||||||||||||||||||||||||||||||
a042       AARASLPKIRAKVSICFSPLVRILPLSTVRSMVVAFFANCSYASAPGPPVMTSXGLXRCR
                  130       140       150       160       170       180

                  190       200
m042.pep   ASXSGSNSVPTVAALSNAGCKX
           ||||||||||||||||||||||
a042       ASXSGSNSVPTVAALSNAGCKX
                  190       200
```

Computer analysis of this amino acid sequence gave the following results:
Homology with a Predicted ORF from *N. gonorrhoeae*
ORF 042 shows 93.0% identity over a 201 aa overlap with a predicted ORF (ORF 042.ng) from *N. gonorrhoeae*:

```
m042/g042

                 10         20         30         40         50         60
   m042.pep  MTMICLRFQAFVPRTSALSXTSTAAGXSCPMAAVRSMMKIQSGFFSLMYSKETGCPCPSL
             ||||||||||||:|||||  ||||||| ||||||||||||| ||||||||||||||||||
       g042  MTMICLRFQAFVPHTSALSNTSTAAGPSCPMAAVRSMMKIQPGFFSLMYSKETGCPCPSL
                 10         20         30         40         50         60

                 70         80         90        100        110        120
   m042.pep  RKDSSTGGRPMSPCIQLANRDCVPKADTLLPVTDSTSPRPLPLAASRVWANSASICAFNS
             |||||||||||||||||||||||||||||||||||||||||||||||:||||||||||||
       g042  RKDSSTGGRPMSPCIQLANRDCVPKADTLLPVTDSTSPRPLPLAASRFWANSASICAFNS
                 70         80         90        100        110        120

                130        140        150        160        170        180
   m042.pep  AARASLPKIRAKVSICFSPLVRILPLSTVRSMVVAFFANCSYASAPGPPVMTSXGLXRCR
             |:||||||| :|||||||||||||||||||:|||||||||||||||||||||: || |||
       g042  ATRASLPKIRDRVSICFSPLVRILPLSTVKSMVVAFFANCSYASAPGPPVMTNCGLWRCR
                130        140        150        160        170        180

                190        200
   m042.pep  ASXSGSNSVPTVAALSNAGCKX
             |  |||||||||||||||||||
       g042  DSQSGSNSVPTVAALSNAGCKX
                190        200
```

The following partial DNA sequence was identified in *N. meningitidis* <SEQ ID 171>:

```
m042-1.seq
   1  ATGACGATGA TTTGCTTGCG CTTCCAAGCG TTCGTGCCGC GTACCAGCGC

  51  GTTATCCAAT ACTTCGACAG CCGCCGGCCC TTCCTGCCCG ATGGCGGCGG

 101  TACGGTCGAT GATGAAAATC CAATCGGGGT TTTTCTCTTT GATGTATTCG

 151  AAGGAAACAG GCTGCCCGTG CACCTTGTTG CGTAAAGATT CGTCTACAGG

 201  CGGTAGGCCG ATGTCGCCGT GTATCCAACT TGCCAACCGC GACTGCGTGC

 251  CGAAGGCGGA CACCTTGTTG CCCGTAACCG ACAGCACCAG CCCGCGTCCT

 301  TTGCCTTTGG CGGCTTCGCG CGTTTGGGCG AACAGCGCGT CAATCTGCGC

 351  CTTCAATTCC GCCGCGCGCG CTTCCTTGCC GAAAATCCGC GCCAAGGTCT

 401  CCATCTGCTT TTCGCCGCTG GTGCGGATAT TGCCGTTGTC CACCGTCAGA

 451  TCTATGGTGG TCGCGTTTTT CGCTAACTGT TCATACGCTT CCGCGCCCGG

 501  CCCGCCGGTA A
```

This corresponds to the amino acid sequence <SEQ ID 172; ORF 042-1>:

```
m042-1.pep

     1  MTMICLRFQA FVPRTSALSN TSTAAGPSCP MAAVRSMMKI QSGFFSLMYS

    51  KETGCPCPSL RKDSSTGGRP MSPCIQLANR DCVPKADTLL PVTDSTSPRP

   101  LPLAASRVWA NSASICAFNS AARASLPKIR AKVSICFSPL VRILPLSTVR

   151  SMVVAFFANC SYASAPGPPV MTS*

m042-1/g042 95.4% identity in 173 aa overlap

                 10         20         30         40         50         60
 m042-1.pep  MTMICLRFQAFVPRTSALSNTSTAAGPSCPMAAVRSMMKIQSGFFSLMYSKETGCPCPSL
             ||||||||||||:|||||||||||||||||||||||||||| ||||||||||||||||||
       g042  MTMICLRFQAFVPHTSALSNTSTAAGPSCPMAAVRSMMKIQPGFFSLMYSKETGCPCPSL
                 10         20         30         40         50         60
```

-continued

```
                 70        80        90        100       110       120
m042-1.pep RKDSSTGGRPMSPCIQLANRDCVPKADTLLPVTDSTSPRPLPLAASRVWANSASICAFNS
           |||||||||||||||||||||||||||||||||||||||||||||| ||||||||||||
g042       RKDSSTGGRPMSPCIQLANRDCVPKADTLLPVTDSTSPRPLPLAASRFWANSASICAFNS
                 70        80        90        100       110       120

                130       140       150       160       170
m042-1.pep AARASLPKIRAKVSICFSPLVRILPLSTVRSMVVAFFANCSYASAPGPPVMTSX
           |:||||||| :||||||||||||||||:||||||||||||||||||||||:
g042       ATRASLPKIRDRVSICFSPLVRILPLSTVKSMVVAFFANCSYASAPGPPVMTNCGLWRCR
                130       140       150       160       170       180

g042       DSQSGSNSVPTVAALSNAGCKX
                190       200
```

The following partial DNA sequence was identified in *N. meningitidis* <SEQ ID 173>:

```
a042-1.seq
  1  ATGACGATGA TTTGCTTGCG CTTCCAAGCG TTCGTGCCGC GTACCAGCGC

 51  GTTATCCAAT ACTTCGACAG CCGCCGGCCC TTCCTGCCCG ATGGCGGCGG

101  TACGGTCGAT GATGAAAATC CAATCGGGGT TTTTCTCTTT GATGTATTCG

151  AAGGAAACAG GCTGCCCGTG CACCTTGTTG CGTAAAGATT CGTCTACAGG

201  CGGTAGGCCG ATGTCGCCGT GTATCCAACT TGCCAACCGC GACTGCGTGC

251  CGAAGGCGGA CACCTTGTTG CCCGTAACCG ACAGCACCAG CCCGCGTCCT

301  TTGCCTTTGG CGGCTTCGCG CGTTTGGGCG AACAGCGCGT CAATCTGCGC

351  CTTCAATTCC GCCGCGCGCG CTTCCTTGCC GAAAATCCGC GCCAAGGTCT

401  CCATCTGCTT TTCGCCGCTG GTGCGGATAT TGCCGTTGTC CACCGTCAGA

451  TCTATGGTGG TCGCGTTTTT CGCCAACTGT TCATACGCTT CCGCGCCCGG

501  CCCGCCGGTA A
```

This corresponds to the amino acid sequence <SEQ ID 174; ORF 042-1.a>:

```
a042-1.pep

      1  MTMICLRFQA FVPRTSALSN TSTAAGPSCP MAAVRSMMKI QSGFFSLMYS

     51  KETGCPCPSL RKDSSTGGRP MSPCIQLANR DCVPKADTLL PVTDSTSPRP

    101  LPLAASRVWA NSASICAFNS AARASLPKIR AKVSICFSPL VRILPLSTVR

    151  SMVVAFFANC SYASAPGPPV MTS*

m042-1/a042-1  100.0% identity in 173 aa overlap

                 10        20        30        40        50        60
m042-1.pep MTMICLRFQAFVPRTSALSNTSTAAGPSCPMAAVRSMMKIQSGFFSLMYSKETGCPCPSL
           ||||||||||||||||||||||||||||||||||||||||||||||||||||||||||||
a042-1     MTMICLRFQAFVPRTSALSNTSTAAGPSCPMAAVRSMMKIQSGFFSLMYSKETGCPCPSL
                 10        20        30        40        50        60

                 70        80        90        100       110       120
m042-1.pep RKDSSTGGRPMSPCIQLANRDCVPKADTLLPVTDSTSPRPLPLAASRVWANSASICAFNS
           ||||||||||||||||||||||||||||||||||||||||||||||||||||||||||||
a042-1     RKDSSTGGRPMSPCIQLANRDCVPKADTLLPVTDSTSPRPLPLAASRVWANSASICAFNS
                 70        80        90        100       110       120

                130       140       150       160       170
m042-1.pep AARASLPKIRAKVSICFSPLVRILPLSTVRSMVVAFFANCSYASAPGPPVMTSX
           ||||||||||||||||||||||||||||||||||||||||||||||||||||||
a042-1     AARASLPKIRAKVSICFSPLVRILPLSTVRSMVVAFFANCSYASAPGPPVMTSX
                130       140       150       160       170
```

The following partial DNA sequence was identified in *N. gonorrhoeae* <SEQ ID 175>:

```
g043.seq
  1  ATGGTTGTTT CAAATCAAAA TATCTATGCC GTCGGCCCAT CAGCACTTTT

 51  TCACATCCGA AGGCAAAAAT CCGTAATGCC GCCTGAACGC TTCgttgaAC

101  CGTCCCGCGT ggcggtagcc gcAAAAGTGC ATcGCGGCTT GGATGGTGCT

151  GCCCGATTCG ATGAGGGcga gcGCGTGTTC CAGCCGCAGG CGGCGCAGGC

201  GTCCGGCGAC GGTTTCGCCG GTTTGCGCTT TGAAATAGCG TTTCAGGTAG

251  CATTCGTTCA GCCCGACGCG GCGGGCGATT TCGGCGATGG TCAGCGGGCG

301  GGCGAATTCG CTGTTCAAAA TATCGGCGGC TTCGTCTATG CGCCGGCGGC

351  GGTAGCCGTT GTCGTGGCGG CGGAAGGTGA AGCGTAA
```

This corresponds to the amino acid sequence <SEQ ID 176; ORF 043.ng>:

```
g043.pep
  1  MVVSNQNIYA VGPSALFHIR RQKSVMPPER FVEPSRVAVA AKVHRGLDGA

 51  ARFDEGERVF QPQAAQASGD GFAGLRFEIA FQVAFVQPDA AGDFGDGQRA

101  GEFAVQNIGG FVYAPAAVAV VVAAEGEA*
```

The following partial DNA sequence was identified in *N. meningitidis* <SEQ ID 177>:

```
m043.seq
  1  ATGGTTGTTT CAAATCAAAA TATCTATGCC GCCGGCCCCT CAGCACTTCT

 51  TCACATCCGA AGGCAAAAAT CCGTAATGCC GTCTGAACGC TTCGTTGAAC

101  CGTCCCGCGT GGCGGTAGCC GCAAAAGTGC ATGGCGGCTT GGACGGTGCT

151  GCCGGATTCG ATGAGGGCGA GCGCGTGTTC CAGCCGCAGG CGGCGCAgGC

201  ATCCGGCGAC GGTTTCGCCG GTTTGCGCTT TGAAATAGCG TTTCAGGTAG

251  CATTCGTTCA GTCCGACGCG GCGGGCGATT TCGGCGATGG TCAGCGGACG

301  GGCGAATTCG TGTTGCAGGA TGTCGGCGGC TTCGTCTATG CGCCGACGGC

351  GGTAACCGTT GTCGTGGCGG CGGAAGGTGA AGCGCAATAA
```

This corresponds to the amino acid sequence <SEQ ID 178; ORF 043>:

```
m043.pep
  1  MVVSNQNIYA AGPSALLHIR RQKSVMPSER FVEPSRVAVA AKVHGGLDGA

 51  AGFDEGERVF QPQAAQASGD GFAGLRFEIA FQVAFVQSDA AGDFGDGQRT

101  GEFVLQDVGG FVYAPTAVTV VVAAEGEAQ*
```

Computer analysis of the amino acid sequences gave the following results:

Homology with a Predicted ORF from *N. meningitidis* menA with menB

ORF 043 shows 89.8% identity over a 128 aa overlap with a predicted ORF (ORF043.a) from *N. gonorrhoeae*:

```
m043/g043

                   10        20        30        40        50        60
m043.pep    MVVSNQNIYAAGPSALLHIRRQKSVMPSERFVEPSRVAVAAKVHGGLDGAAGFDEGERVF
            ||||||||||:|||||:|||||||||| |||||||||||||||| |||||| ||||||||
g043        MVVSNQNIYAVGPSALFHIRRQKSVMPPERFVEPSRVAVAAKVHRGLDGAARFDEGERVF
                   10        20        30        40        50        60

                   70        80        90       100       110       120
m043.pep    QPQAAQASGDGFAGLRFEIAFQVAFVQSDAAGDFGDGQRTGEFVLQDVGGFVYAPTAVTV
            ||||||||||||||||||||||||||| |||||||||||:|||::|::||||||||:||:
g043        QPQAAQASGDGFAGLRFEIAFQVAFVQPDAAGDFGDGQRAGEFAVQNIGGFVYAPAAVAV
                   70        80        90       100       110       120

                  130
m043.pep    VVAAEGEAQX
            ||||||||
g043        VVAAEGEAXX
                  130
```

The following partial DNA sequence was identified in *N. meningitidis* <SEQ ID 179>:

```
a043.seq
  1  ATGGTTGTTT CAAATCAAAA TATCTATGCC GCCGGCCCCT CAGCACTTCT

 51  TCACATCCGA AGGCAAAAAT CCGTAATGCC GTCTGAACGC TTCGTTGAAC

101  CGTCCCGCGT GGCGGTAGCC GCAAAAGTGC ATGGCGGCTT GGACGGTGCT

151  GCCGGATTCG ATGAGGGCGA GCGCGTGTTC CAGCCGCAGG CGGCGCAGGC

201  ATCCGGCGAC GGTTTCGCCG GTTTGCGCTT TGAAATAGCG TTTCAGGTAG

251  CATTCGTTCA GTCCGACGCG GCGGGCGATT TCGGCGATGG TCAGCGGACG

301  GGCGAATTCG TGTTGCAGGA TGTCGGCGGC TTCGTCTATG CGCCGACGGC

351  GGTAACCGTT GTCGTGGCGG CGGAAGGTGA AGCGCAATAA
```

This corresponds to the amino acid sequence <SEQ ID 180; ORF 043.a>:

```
a043.pep

      1  MVVSNQNIYA AGPSALLHIR RQKSVMPSER FVEPSRVAVA AKVHGGLDGA

     51  AGFDEGERVF QPQAAQASGD GFAGLRFEIA FQVAFVQSDA AGDFGDGQRT

    101  GEFVLQDVGG FVYAPTAVTV VVAAEGEAQ*

m043/a043  100.0% identity in 129 aa overlap

                   10        20        30        40        50        60
m043.pep    MVVSNQNIYAAGPSALLHIRRQKSVMPSERFVEPSRVAVAAKVHGGLDGAAGFDEGERVF
            ||||||||||||||||||||||||||||||||||||||||||||||||||||||||||||
a043        MVVSNQNIYAAGPSALLHIRRQKSVMPSERFVEPSRVAVAAKVHGGLDGAAGFDEGERVF
                   10        20        30        40        50        60

                   70        80        90       100       110       120
m043.pep    QPQAAQASGDGFAGLRFEIAFQVAFVQSDAAGDFGDGQRTGEFVLQDVGGFVYAPTAVTV
            ||||||||||||||||||||||||||||||||||||||||||||||||||||||||||||
a043        QPQAAQASGDGFAGLRFEIAFQVAFVQSDAAGDFGDGQRTGEFVLQDVGGFVYAPTAVTV
                   70        80        90       100       110       120

                  130
m043.pep    VVAAEGEAQX
            ||||||||||
a043        VVAAEGEAQX
                  130
```

The following partial DNA sequence was identified in *N. gonorrhoeae* <SEQ ID 181>:

```
g044.seq
   1 ATGCTGCCCG ACCAGAGCGT CGAGTTCTTG CCACAAGTCG TCGTTTTTGA

  51 CGGGCTGTTT GGCGGCGGTT TTCCAGCCGT TGCGCTTCCA ACCGTGTATC

 101 CAGTTTTCCA TGCCGTTTTT GACGTATTGC GAGTCGGTGC AGATGATGAC

 151 GGTGCAGCGG CGTTTGAGCG ATTTCAGCCC TTCGATAACG GCGGTCAGCT

 201 CCATGCGGTT GTTGGTGGTT TGCGCTTCGC CGCCGAAAAG TTCTTTTTCG

 251 CGGCTGCCGT AGCGCATTAA
```

This corresponds to the amino acid sequence <SEQ ID 182; ORF 044.ng>:

```
g044.pep
  1 MLPDQSVEFL PQVVVFDGLF GGGFPAVALP TVYPVFHAVF DVLRVGADDD

 51 GAAAFERFQP FDNGGQLHAV VGGLRFAAEK FFFAAAVAH*
```

The following partial DNA sequence was identified in *N. meningitidis* <SEQ ID 183>:

```
m044.seq
   1 ATGCCGTCCG ACTAGAGCGT CGAGTTCTTT CCAGAAGTCG TCGTTTTTGA

  51 CGGGCTGTTT GGAGGCGGTT TTCCAGCCGT TGCGCTTCCA ACCGTGTATC

 101 CAGTTTTCCA TGCCATTTTT GACGTATTGC GAGTCGGTGC AGATGATGAC

 151 GGTGCAGCGG CGTTTGAGCG ATTTCAGTCC TTCGATGACG GCAGTCAGTT

 201 CCATGCGGTT GTTGGTGGTT TGCGCTTCGC CGCCGAAAAG TTCTTTTTCG

 251 TGGCTACCGT AGCGCAyTAa
```

This corresponds to the amino acid sequence <SEQ ID 184; ORF 044>:

```
m044.pep
  1 MPSDXSVEFF PEVVVFDGLF GGGFPAVALP TVYPVFHAIF DVLRVGADDD

 51 GAAAFERFQS FDDGSQFHAV VGGLRFAAEK FFFVATVAH*
```

The following partial DNA sequence was identified in *N. meningitidis* <SEQ ID 185>:

```
a044.seq
   1 GTGCCGTCCG ACCAGCGCGT CGAGTTCTTT CCACAAGTCG TCGTTTTTGA

  51 CGGGCTGTTT GGCGGCGGTT TTCCAGCCGT TGCGCTTCCA ACCGTGTATC

 101 CAGTTTTCCA TGCCGTTTTT GACGTATTGC GAGTCGGTGC AGATGATGAC

 151 GGTGCAGCGG CGTTTGAGCG ATTTCAGTCC TTCGATGACG GCGGTCAGTT

 201 CCATACGGTT GTTGGTGGTT TGCGCTTCGC CGCCGAAAAG TTCTTTTTCG

 251 TGGCTGCCGT AGCGCATTAA
```

This corresponds to the amino acid sequence <SEQ ID 186; ORF 044.a>:

```
a044.pep
  1 VPSDQRVEFF PQVVVFDGLF GGGFPAVALP TVYPVFHAVF DVLRVGADDD

 51 GAAAFERFQS FDDGGQFHTV VGGLRFAAEK FFFVAAVAH*
```

m044/a044 91.0% identity over a 89 aa overlap

```
                      10        20        30        40        50        60
    m044.pep  MPSDXSVEFFPEVVVFDGLFGGGFPAVALPTVYPVFHAIFDVLRVGADDDGAAAFERFQS
              :|||  |||||:||||||||||||||||||||||||||:|||||||||||||||||||||
    a044      VPSDQRVEFFPQVVVFDGLFGGGFPAVALPTVYPVFHAVFDVLRVGADDDGAAAFERFQS
                      10        20        30        40        50        60
                      70        80        90
    m044.pep  FDDGSQFHAVVGGLRFAAEKFFFVATVAHX
              ||||:|||:||||||||||||||||:||||
    a044      FDDGGQFHTVVGGLRFAAEKFFFVAAVAHX
                      70        80        90
```

Computer analysis of this amino acid sequence gave the following results:

Homology with a Predicted ORF from *N. gonorrhoeae*

ORF 044 shows 86.5% identity over a 89 aa overlap with a predicted ORF (ORF 044.ng) from *N. gonorrhoeae*:

```
    m044/g044

                      10        20        30        40        50        60
    m044.pep  MPSDXSVEFFPEVVVFDGLFGGGFPAVALPTVYPVFHAIFDVLRVGADDDGAAAFERFQS
              |  | ||||:|:||||||||||||||||||||||||||:||||||||||||||||||||
    g044      MLPDQSVEFLPQVVVFDGLFGGGFPAVALPTVYPVFHAVFDVLRVGADDDGAAAFERFQP
                      10        20        30        40        50        60
                      70        80        90
    m044.pep  FDDGSQFHAVVGGLRFAAEKFFFVATVAHX
              ||:|:|:||||||||||||||||:|:||||
    g044      FDNGGQLHAVVGGLRFAAEKFFFAAAVAHX
                      70        80        90
```

The following partial DNA sequence was identified in *N. gonorrhoeae* <SEQ ID 187>:

```
g046.seq
  1 ATGTCGGCAA TGCTGCGTCC GACAAGCAGC CCGCCGCgcc gCGCCTGTAT

 51 GATGACCATC CGCACGCGGT CGTCTGCAAA ACGTAAAACC TGCAATGCGC

101 CCGGGCAGTC TATCAGGCCG GCAAGCTGTT CGGTAACGAG CTGTTCGGGG

151 CTGATGGTTT CGGTTATGCC gaATATGGAA AGGCTGCCGt TTTcGTTGTT

201 TTCGAGCTTG GGGCTGAGGT ATTCGAGGTA TtcgctGGAA CGGACGCGCG

251 CGATGCGGCC GGGGATGTTG AACAGGTCGG CGGCAACTTT GCAGGCGACG

301 ATGTTGGTTT CGTCGCTGCG GGagaGCGCG AGcagcaagt cggcatcttC

351 CgcgccggcG Cgttataatg tgAAGGGGGA TGCGccgttg ccgaAAACGG

401 TTTGGacatc gaggcggctg CCTGTTTCCT GCAATGCTTT TTCGTCGATG

451 TCGATAAcgg TTACGTCGTT GTTGGTGATG GCGGCAAGGT TTTGCGCGAC

501 GGTAGAACCT ACCTGCCCGT TGCCTAAAAT GAGGATTTTC ACGGTATGGG

551 TCGCCGGGTG A
```

This corresponds to the amino acid sequence <SEQ ID 188; ORF 046.ng>:

```
g046.pep
    1 MSAMLRPTSS PPRRACMMTI RTRSSAKRKT CNAPGQSIRP ASCSVTSCSG

   51 LMVSVMPNME RLPFSLFSSL GLRYSRYSLE RTRAMRPGML NRSAATLQAT

  101 MLVSSLRESA SSKSASSAPA RYNVKGDAPL PKTVWTSRRL PVSCNAFSSM

  151 SITVTSLLVM AARFCATVEP TCPLPKMRIF TVWVAG*
```

The following partial DNA sequence was identified in *N. meningitidis* <SEQ ID 189>:

```
m046.seq
    1 ATGTCGGCAA TGCTGCGTCC GACAAGCAsT CCGC.r.sGC gCGcCTGTAT

   51 GATGACCATC CGCACGCGGT CGTCTGCAAA ACGTAAAACC TGCAATGCGC

  101 CCGGGCAGTC TATCAGGCCG GCAAGCTGTT CGGTAACGAG CTGTTCGGGG

  151 CTGATGGTTT CGGTTATGCC GAATATGGAA AGGCTGCCGT TTTCGTTGTT

  201 TTCGAGCTTG GGGCTGAGGT ATTCGAGGTA TTCGCTGGAA CGGACGCGCG

  251 CGATGCGGCC GGGGATGTTG AACAGGTCGG CGGCAACTTT GCAGGCGACG

  301 ATGTTGGTTT CGTCGCTGCG GGAGAGCGCG AGCAGCAAGT CGGCATCTTC

  351 CGCGCCGGCG CGTTCTAATG TGAAGGGGGA TGCGCCGTTG CCGAAAACGG

  401 TTTGGACATC GAGGCGGCTG CCTGTTTCCT GCAATGCTTT TTCGTCGATG

  451 TCGATAACGG TTACGTCGTT GTTGGGTATG GCGGCAAGGT TTTGTGCGAC

  501 GGTAGAACCT ACCTGTCCGT TGCCTAAAAT GAGGATTTTC ACGGTGTGGG

  551 TCGCCGAGTG A
```

This corresponds to the amino acid sequence <SEQ ID 190; ORF 046>:

```
m046.pep
    1 MSAMLRPTSX PXXRACMMTI RTRSSAKRKT CNAPGQSIRP ASCSVTSCSG

   51 LMVSVMPNME RLPFSLFSSL GLRYSRYSLE RTRAMRPGML NRSAATLQAT

  101 MLVSSLRESA SSKSASSAPA RSNVKGDAPL PKTVWTSRRL PVSCNAFSSM

  151 SITVTSLLGM AARFCATVEP TCPLPKMRIF TVWVAE*
```

The following partial DNA sequence was identified in *N. meningitidis* <SEQ ID 191>:

```
a046.seq
    1 ATGTCGGCAA TGCTGCGTCC GACAAGCAGT CCGCCGCGCC GCGCCTGTAT

   51 GATGACCATC CGCACGCGGT CGTCTGCAAA ACGTAAAACC TGCAATGCGC

  101 CCGGGCAGTC TATCAGGCCG GCAAGCTGTT CGGTAACGAG CTGTTCGGGG

  151 CTGATGGTTT CGGTTATGCC GAATATGGAA AGGCTGCCGT TTTCGTTGTT

  201 TTCGAGCTTG GGGCTGAGGT ATTCGAGGTA TTCGCTGGAA CGGACGCGCG

  251 CGATGCGGCC GGGGATGTTG AACAGGTCGG CGGCAACTTT GCAGGCGACG

  301 ATGTTGGTTT CGTCGCTGCG GGAGAGCGCG AGCAGCAAGT CGGCATCTTC

  351 CGCGCCGGCG CGTTCTAATG TGAAGGGGGA TGCGCCGTTG CCGAAAACGG

  401 TTTGGACATC GAGGCGGCTG CCTGTTTCCT GCAATGCTTT TTCGTCGATG
```

-continued

```
451 TCGATAACGG TTACGTCGTT GTTGGGTATG GCGGCAAGGT TTTGTGCGAC

501 GGTAGAACCT ACCTGTCCGT TGCCTAAAAT GAGGATTTTC ACGGTGTGGG

551 TCGCCGAGTG A
```

This corresponds to the amino acid sequence <SEQ ID 192; ORF 046.a>:

```
a046.pep
  1 MSAMLRPTSS PPRRACMMTI RTRSSAKRKT CNAPGQSIRP ASCSVTSCSG

 51 LMVSVMPNME RLPFSLFSSL GLRYSRYSLE RTRAMRPGML NRSAATLQAT

101 MLVSSLRESA SSKSASSAPA RSNVKGDAPL PKTVWTSRRL PVSCNAFSSM

151 SITVTSLLGM AARFCATVEP TCPLPKMRIF TVWVAE*
```

m046/a046 98.4% identity over a 186 aa overlap

```
                    10        20        30        40        50        60
m046.pep MSAMLRPTSXPXXRACMMTIRTRSSAKRKTCNAPGQSIRPASCSVTSCSGLMVSVMPNME
         ||||||||| |  |||||||||||||||||||||||||||||||||||||||||||||||
a046     MSAMLRPTSSPPRRACMMTIRTRSSAKRKTCNAPGQSIRPASCSVTSCSGLMVSVMPNME
                    10        20        30        40        50        60

                    70        80        90       100       110       120
m046.pep RLPFSLFSSLGLRYSRYSLERTRAMRPGMLNRSAATLQATMLVSSLRESASSKSASSAPA
         ||||||||||||||||||||||||||||||||||||||||||||||||||||||||||||
a046     RLPFSLFSSLGLRYSRYSLERTRAMRPGMLNRSAATLQATMLVSSLRESASSKSASSAPA
                    70        80        90       100       110       120

                   130       140       150       160       170       180
m046.pep RSNVKGDAPLPKTVWTSRRLPVSCNAFSSMSITVTSLLGMAARFCATVEPTCPLPKMRIF
         ||||||||||||||||||||||||||||||||||||||||||||||||||||||||||||
a046     RSNVKGDAPLPKTVWTSRRLPVSCNAFSSMSITVTSLLGMAARFCATVEPTCPLPKMRIF
                   130       140       150       160       170       180

m046.pep TVWVAEX
         ||||||
a046     TVWVAEX
```

Computer analysis of this amino acid sequence gave the following results:

Homology with a Predicted ORF from *N. gonorrhoeae*

ORF 046 shows 97.3% identity over a 185 aa overlap with a predicted ORF (ORF 046.ng) from *N. gonorrhoeae*:

```
m046/g046

                    10        20        30        40        50        60
m046.pep MSAMLRPTSXPXXRACMMTIRTRSSAKRKTCNAPGQSIRPASCSVTSCSGLMVSVMPNME
         ||||||||| |  |||||||||||||||||||||||||||||||||||||||||||||||
g046     MSAMLRPTSSPPRRACMMTIRTRSSAKRKTCNAPGQSIRPASCSVTSCSGLMVSVMPNME
                    10        20        30        40        50        60

                    70        80        90       100       110       120
m046.pep RLPFSLFSSLGLRYSRYSLERTRAMRPGMLNRSAATLQATMLVSSLRESASSKSASSAPA
         ||||||||||||||||||||||||||||||||||||||||||||||||||||||||||||
g046     RLPFSLFSSLGLRYSRYSLERTRAMRPGMLNRSAATLQATMLVSSLRESASSKSASSAPA
                    70        80        90       100       110       120

                   130       140       150       160       170       180
m046.pep RSNVKGDAPLPKTVWTSRRLPVSCNAFSSMSITVTSLLGMAARFCATVEPTCPLPKMRIF
         | |||||||||||||||||||||||||||||||||||| |||||||||||||||||||||
g046     RYNVKGDAPLPKTVWTSRRLPVSCNAFSSMSITVTSLLVMAARFCATVEPTCPLPKMRIF
                   130       140       150       160       170       180

m046.pep TVWVAEX
         |||||
g046     TVWVAGX
```

The following partial DNA sequence was identified in *N. gonorrhoeae* <SEQ ID 193>:

```
g047.seq
   1 ATGGTCATCA TACAGGCGcg gcGCGGCGGG CTGCTTGTCG GACGCAGCAT

  51 TGCCGACATC GCCCAAGATT TGCCCGACGG GGCCGACTGC CAAATCTGCG

 101 CCGTTTACCG CAACAACCGC CTCATCGTCC CCGCGCCGCA AACCGTCATC

 151 ATCGAAGGCG ACGAAATCCT GTTTGCCGCC GCCGCCGAAA ACATCGGGGC

 201 GGTCATACCc gaATTGCGCC CCAAAGAAAC CAGCACCCGC CGCATCATGA

 251 TTGCCGGCGG CGGCAACATc tgctACCGCC TCGCCAAGCA GCTCGAACAC

 301 GCATAcaacG TCAAAATCAT CGAATGCCGG CCGCGCcgtg ccgaATGGAT

 351 AGCCGAAAAC ctcgAcaaCA CCCTCGTCCT GCAAGGTTCG Gcaaccgacg

 401 aAaccctgct cgAcaacgaa tacatcgacg aaatcgaCGT ATTCTGCGCC

 451 CTGACCAACG ACGACGAAAG CAACATTAtg tCCGCCCTTT TGGCGAAAAA

 501 CCTcggcgCG AAGCgcgtca tcggCATCGT CAACCGCTCA AGCTACGTCG

 551 ATTTGCTCGA AGGCAACAAA ATCGACATCG TCGTCTCCCC CCACCTCATC

 601 ACCATCGGCT CGATACTCGC CCACATCCGG CGCGGCGACA TCGTTGCCGT

 651 CCACCTCATC CGGCGCGGCA CGGCGGAAGC CATCGAAGTC GTCGCGCACG

 701 GCGACAAAAA AACTTCCGCC ATCATCGGCA GGCGCATCAG CGGCATCAAA

 751 TGGCCCGAAG GCTGCCACAT TGCCGCCGTC GTCCGCGCCG GAACCGGCGA

 801 AACCATTATG GGACACCATA CCGAAACCGT CATCCAAGAC GGTGACCACA

 851 TCATCTTTTT CGTCTCGCGC CGGCGCATCC TGAACGAACT GGAGAAACTC

 901 ATCCAAGTCA AAATGGGCTT TTTCGGATAA
```

This corresponds to the amino acid sequence <SEQ ID 194; ORF 047.ng>:

```
g047.pep
   1 MVIIQARRGG LLVGRSIADI AQDLPDGADC QICAVYRNNR LIVPAPQTVI

  51 IEGDEILFAA AAENIGAVIP ELRPKETSTR RIMIAGGGNI CYRLAKQLEH

 101 AYNVKIIECR PRRAEWIAEN LDNTLVLQGS ATDETLLDNE YIDEIDVFCA

 151 LTNDDESNIM SALLAKNLGA KRVIGIVNRS SYVDLLEGNK IDIVVSPHLI

 201 TIGSILAHIR RGDIVAVHPI RRGTAEAIEV VAHGDKKTSA IIGRRISGIK

 251 WPEGCHIAAV VRAGTGETIM GHHTETVIQD GDHIIFFVSR RRILNELEKL

 301 IQVKMGFFG*
```

The following partial DNA sequence was identified in *N. meningitidis* <SEQ ID 195>:

```
m047.seq
   1 ATGGTCATCA TACAGgCGcG C..syGCGGA sTGCTTGTCG GACGCAGCAT

  51 TGCCGACATC GCCCAAGATT TGCCCGACGG GGCCGACTGC CAAATCTGCG

 101 CCGTTTACCG CAACAACCGC CTCATCGTCC CCGCGCCGCA AACCGTCATC

 151 ATCGAAGGCG ACGAAATCCT ATTTGCCGCC GCCGCCGAAA ACATCGGCGC

 201 GGTCATACCC GAATTGCGCC CCAAAGAAAC CCAAAGAAAC CAGCcCmgmm

 251 GcATCATGAT TkCCGGCGGC GGCAACATCG GCTACCGTCT CGCCAAGCAG
```

-continued

```
301 CTCGAACACG CATACAACGT yAAAATCATC GAATGCCGGC CGCGCCGTGC

351 CGAATGGATA GCCGAAAACC TCGACAACAC CCTCGTCyTG CAAGGTTCGG

401 CAACCGACGA AACCCTGCTC GACAACGAAT ACATCGACGA AATCGACGTA

451 TTCTGCGCCC TGACCAACGA CGACGAAAGC AACATTATGT CCGCCCTTTT

501 GGCGAaAAAC CTCGGCGCGA AGCGCGTCAT CGGCATCGTC AACCGCTCAA

551 GCTACGTCGA TTTGCTCGAA GGCAACAAAA TCGACATCGT CGTCTCCCCC

601 CACCTCATCA CCATCGGCTC GATACTCGCC CACATCCGGC GCGGCGACAT

651 CGTTGCCGTC CACCCCATCC GGCGCGGCAC GGCGGAAGCC ATCGAAGTCG

701 TCGCACACGG CGACAAAAAA ACTTCCGCCA TCATCGGCAG GCGCATCAGC

751 GGCATCAAAT GGCCCGAAGG CTGCCACATT GCCGCCGTCG TCCGCGCCGG

801 AACCGGCGAA ACCATTATGG GACACCATAC CGAAACCGTC ATCCAAGACG

851 GCGACCACAT CATCTTTTTC GTCTCGCGCC GGCGCATCCT GAACGAACTG

901 GAAAAACTCA TCCAGGTCAA AATGGGCTTT TTCGGATAA
```

This corresponds to the amino acid sequence <SEQ ID 196; ORF 047>:

```
m047.pep
  1 MVIIQARXXG XLVGRSIADI AQDLPDGADC QICAVYRNNR LIVPAPQTVI

 51 IEGDEILFAA AAENIGAVIP ELRPKETQRN QPXXIMIXGG GNIGYRLAKQ

101 LEHAYNVKII ECRPRRAEWI AENLDNTLVL QGSATDETLL DNEYIDEIDV

151 FCALTNDDES NIMSALLAKN LGAKRVIGIV NRSSYVDLLE GNKIDIVVSP

201 HLITIGSILA HIRRGDIVAV HPIRRGTAEA IEVVAHGDKK TSAIIGRRIS

251 GIKWPEGCHI AAVVRAGTGE TIMGHHTETV IQDGDHIIFF VSRRRILNEL

301 EKLIQVKMGF FG*
```

The following partial DNA sequence was identified in *N. meningitidis* <SEQ ID 197>:

```
a047.seq
  1 ATGGTCATCA TACAGGCGCG GCGCGGCGGA CTGCTTGTCG GACGCAGCAT

 51 TGCCGACATC GCCCAAGATT TGCCCGACGG GGCCGACTGC CAAATCTGCG

101 CCGTTTACCG CAACAACCGC CTCATCGTCC CCGCGCCGCA AACCGTCATC

151 ATCGAAGGCG ACGAAATCCT ATTTGCCGCC GCCGCCGAAA ACATCGGCGC

201 GGTCATACCC GAATTGCGCC CCAAAGAAAC CAGCACCCGC CGCATCATGA

251 TTGCCGGCGG CGGCAACATC GGCTACCGTC TCGCCAAGCA GCTCGAACAC

301 GCATACAACG TCAAAATCAT CGAATGCCGG CCGCGCCGTG CCGAATGGAT

351 AGCCGAAAAC CTCGACAACA CCCTCGTCCT GCAAGGTTCG GCAACCGACG

401 AAACCCTGCT CGACAACGAA TACATCGACG AAATCGACGT ATTCTGCGCC

451 CTGACCAACG ACGACGAAAG CAACATTATG TCCGCCCTTT TGGCGAAAAA

501 CCTCGGCGCG AAGCGCGTCA TCGGCATCGT CAACCGCTCA AGCTACGTCG

551 ATTTGCTCGA AGGCAACAAA ATCGACATCG TCGTCTCCCC CCACCTCATC

601 ACCATCGGCT CGATACTCGC CCACATCCGG CGCGGCGACA TCGTTGCCGT

651 CCACCTCATC CGGCGCGGCA CGGCGGAAGC CATCGAAGTC GTCGCACACG
```

-continued

```
701 GCGACAAAAA AACTTCCGCC ATCATCGGCA GGCGCATCAG CGGCATCAAA

751 TGGCCCGAAG GCTGCCACAT TGCCGCCGTC GTCCGCGCCG GAACCGGCGA

801 AACCATTATG GGACACCATA CCGAAACCGT CATCCAAGAC GGCGACCACA

851 TCATCTTTTT CGTCTCGCGC CGGCGCATCC TGAACGAACT GGAAAAACTC

901 ATCCAAGTCA AAATGGGCTT TTTCGGATAA
```

This corresponds to the amino acid sequence <SEQ ID 198; ORF 047.a>:

```
a047.pep
  1 MVIIQARRGG LLVGRSIADI AQDLPDGADC QICAVYRNNR LIVPAPQTVI

 51 IEGDEILFAA AAENIGAVIP ELRPKETSTR RIMIAGGGNI GYRLAKQLEH

101 AYNVKIIECR PRRAEWIAEN LDNTLVLQGS ATDETLLDNE YIDEIDVFCA

151 LTNDDESNIM SALLAKNLGA KRVIGIVNRS SYVDLLEGNK IDIVVSPHLI

201 TIGSILAHIR RGDIVAVHPI RRGTAEAIEV VAHGDKKTSA IIGRRISGIK

251 WPEGCHIAAV VRAGTGETIM GHHTETVIQD GDHIIFFVSR RRILNELEKL

301 IQVKMGFFG*
```

m047/a047 96.5% identity over a 312 aa overlap

```
                    10        20        30        40        50        60
m047.pep    MVIIQARXXGXLVGRSIADIAQDLPDGADCQICAVYRNNRLIVPAPQTVIIEGDEILFAA
            |||||||  |||||||||||||||||||||||||||||||||||||||||||||||||||
a047        MVIIQARRGGXLVGRSIADIAQDLPDGADCQICAVYRNNRLIVPAPQTVIIEGDEILFAA
                    10        20        30        40        50        60

                    70        80        90       100       110       120
m047.pep    AAENIGAVIPELRPKETQRNQPXXIMIXGGGNIGYRLAKQLEHAYNVKIIECRPRRAEWI
            |||||||||||||||||:  :   ||| ||||||||||||||||||||||||||||||||
a047        AAENIGAVIPELRPKETSTRR---IMIAGGGNIGYRLAKQLEHAYNVKIIECRPRRAEWI
                    70        80           90       100       110

                   130       140       150       160       170       180
m047.pep    AENLDNTLVLQGSATDETLLDNEYIDEIDVFCALTNDDESNIMSALLAKNLGAKRVIGIV
            ||||||||||||||||||||||||||||||||||||||||||||||||||||||||||||
a047        AENLDNTLVLQGSATDETLLDNEYIDEIDVFCALTNDDESNIMSALLAKNLGAKRVIGIV
            120       130       140       150       160       170

                   190       200       210       220       230       240
m047.pep    NRSSYVDLLEGNKIDIVVSPHLITIGSILAHIRRGDIVAVHPIRRGTAEAIEVVAHGDKK
            ||||||||||||||||||||||||||||||||||||||||||||||||||||||||||||
a047        NRSSYVDLLEGNKIDIVVSPHLITIGSILAHIRRGDIVAVHPIRRGTAEAIEVVAHGDKK
            180       190       200       210       220       230

                   250       260       270       280       290       300
m047.pep    TSAIIGRRISGIKWPEGCHIAAVVRAGTGETIMGHHTETVIQDGDHIIFFVSRRRILNEL
            ||||||||||||||||||||||||||||||||||||||||||||||||||||||||||||
a047        TSAIIGRRISGIKWPEGCHIAAVVRAGTGETIMGHHTETVIQDGDHIIFFVSRRRILNEL
            240       250       260       270       280       290

                   310
m047.pep    EKLIQVKMGFFGX
            |||||||||||||
a047        EKLIQVKMGFFGX
            300       310
```

Computer analysis of this amino acid sequence gave the following results:

Homology with a Predicted ORF from *N. gonorrhoeae*

ORF 047 shows 96.2% identity over a 312 aa overlap with a predicted ORF (ORF 047.ng) from *N. gonorrhoeae*:

```
m047/g045

m047.pep MVIIQARXXGXLVGRSIADIAQDLPDGADCQICAVYRNNRLIVPAPQTVIIEGDEILFAA   60
         |||||||  | |||||||||||||||||||||||||||||||||||||||||||||||
g047     MVIIQARRGGLLVGRSIADIAQDLPDGADCQICAVYRNNRLIVPAPQTVIIEGDEILFAA   60
m047.pep AAENIGAVIPELRPKETQRNQPXXIMIXGGGNIGYRLAKQLEHAYNVKIIECRPRRAEWI  120
         |||||||||||||||||:  :   ||| ||||| ||||||||||||||||||||||||||
g047     AAENIGAVIPELRPKETSTRR---IMIAGGGNICYRLAKQLEHAYNVKIIECRPRRAEWI  117
m047.pep AENLDNTLVLQGSATDETLLDNEYIDEIDVFCALTNDDESNIMSALLAKNLGAKRVIGIV  180
         ||||||||||||||||||||||||||||||||||||||||||||||||||||||||||||
g047     AENLDNTLVLQGSATDETLLDNEYIDEIDVFCALTNDDESNIMSALLAKNLGAKRVIGIV  177
m047.pep NRSSYVDLLEGNKIDIVVSPHLITIGSILAHIRRGDIVAVHPIRRGTAEAIEVVAHGDKK  240
         ||||||||||||||||||||||||||||||||||||||||||||||||||||||||||||
g047     NRSSYVDLLEGNKIDIVVSPHLITIGSILAHIRRGDIVAVHPIRRGTAEAIEVVAHGDKK  237
m047.pep TSAIIGRRISGIKWPEGCHIAAVVRAGTGETIMGHHTETVIQDGDHIIFFVSRRRILNEL  300
         ||||||||||||||||||||||||||||||||||||||||||||||||||||||||||||
g047     TSAIIGRRISGIKWPEGCHIAAVVRAGTGETIMGHHTETVIQDGDHIIFFVSRRRILNEL  297
m047.pep EKLIQVKMGFFGX                                                313
         |||||||||||||
g047     EKLIQVKMGFFGX                                                310
```

The following partial DNA sequence was identified in *N. gonorrhoeae* <SEQ ID 199>:

```
g048.seq
  1 ATGCTCGACA AAGGCGAGGA GTTGCCCGTC GATTTCACCA ACCGCCTGAT

 51 TTACTACGTc ggcCCcgTCG ATCCGGTCGG CGATGAAGTC GTCGGTCCCG

101 CAGGTCCGAC CACAGCCACC CGCATGGACA AATTTACCCG CCAAATGCTC

151 AAACAAACCG GCCTCTTGGG CATGATCGGC AAATCCGagc gcgGcgcggc

201 cacctGCGAA GCcatCGCCG ACAACAAGGC CGTGTACCTC ATGGCAGTCG

251 GCGGCGCGGC ATACCTCGTG GCAAAAGCCA TCAAATCTTC CAAAGTCTTG

301 GCGTTCCCCG AATTGGGTAT GGAAGCCGTT TACGAATTTG AAGTCAAAGA

351 TATGCCCGTA ACCGTCGCCG TGGACAGCAA AGGCGAATCC ATCCACGCCA

401 CCGCCCCGCG CAAATGGCAG GCGAAAATCG GCATCATCCC CGTCGAGTCT

451 TGA
```

This corresponds to the amino acid sequence <SEQ ID 200; ORF 048.ng>:

```
g048.pep
  1 MLDKGEELPV DFTNRLIYYV GPVDPVGDEV VGPAGPTTAT RMDKFTRQML

 51 KQTGLLGMIG KSERGAATCE AIADNKAVYL MAVGGAAYLV AKAIKSSKVL

101 AFPELGMEAV YEFEVKDMPV TVAVDSKGES IHATAPRKWQ AKIGIIPVES

151 *
```

The following partial DNA sequence was identified in *N. meningitidis* <SEQ ID 201>:

```
m048.seq
  1 ATGCTCAACA AAGGCGAAGA ATTGCCCGTC GATTTCACCA ACCGCCTGAT

 51 TTACTACGTC GGCCCCGTCG ATCCGGTCGG CGATGAAGTC GTCGGTCCGG
```

-continued

```
101 CAGGTCCGAC CACAGCCACC CGCATGGACA AATTCACCCG CCAAATGCTC

151 GAACAAACCG ACCTCTTGGG CATGATCGGC AAATCCGAGC GCGGCGTGGC

201 CACCTGCGAA GCCATCGCCG ACAACAAAGC CGTGTACCTC ATGGCAGTCG

251 GCGGCGCGGC GTATCTCGTG GCAAAAGCCA TCAAATCTTC CAAAGTCTTG

301 GCGTTCCCCG AATTGGGCAT GGAAGCCATT TACGAATTTG AAGTCAAAGA

351 CATGCCCGTA ACCGTCGCCG TAGATAGCAA AGGCGAATCC ATCCACGCCA

401 CCGCCCCGCG CAAATGGCAG GCGAAAATCG GCATCATCCC CGTCGAATCT

451 TGA
```

This corresponds to the amino acid sequence <SEQ ID 202; ORF 048>:

```
m048.pep
  1 MLNKGEELPV DFTNRLIYYV GPVDPVGDEV VGPAGPTTAT RMDKFTRQML

 51 EQTDLLGMIG KSERGVATCE AIADNKAVYL MAVGGAAYLV AKAIKSSKVL

101 AFPELGMEAI YEFEVKDMPV TVAVDSKGES IHATAPRKWQ AKIGIIPVES

151 *
```

The following partial DNA sequence was identified in *N. meningitidis* <SEQ ID 203>:

```
a048.seq
  1 ATGCTCGACA AAGGCGAAGA ATTGCCCGTC GATTTCACCA ACCGCCTGAT

 51 TTACTACGTC GGCCCCGTCG ATCCGGTCGG CGACGAAATC GTCGGCCCAG

101 CAGGTCCGAC CACCGCCACC CGCATGGACA AATTCACCCG CCAAATGCTC

151 GAACAAACCG ACCTCTTGGG CATGATCGGC AAATCCGAGC GCGGCGCGGC

201 CACCTGCGAA GCCATCGCCG ACAACAAAGC CGTGTACCTC ATGGCAGTCG

251 GCGGCGCGGC GTATCTCGTG GCAAAAGCCA TCAAATCTTC CAAAGTCTTG

301 GCGTTCCCCG AATTGGGCAT GGAAGCCATT TACGAATTTG AAGTCAAAGA

351 CATGCCCGTA ACCGTCGCCG TAGACAGCAA AGGCGAATCC ATCCACGCCA

401 CCGCCCCGCC CCAATGGCAG GCGAAAATCG GCATCATCCC CGTCAAATCT

451 TGA
```

This corresponds to the amino acid sequence <SEQ ID 204; ORF 048.a>:

```
a048.pep
  1 MLDKGEELPV DFTNRLIYYV GPVDPVGDEI VGPAGPTTAT RMDKFTRQML

 51 EQTDLLGMIG KSERGAATCE AIADNKAVYL MAVGGAAYLV AKAIKSSKVL

101 AFPELGMEAI YEFEVKDMPV TVAVDSKGES IHATAPPQWQ AKIGIIPVKS

151 *
```

m048/a048 96.0% identity over a 150 aa overlap

```
                   10        20        30        40        50        60
m048.pep   MLNKGEELPVDFTNRLIYYVGPVDPVGDEVVGPAGPTTATRMDKFTRQMLEQTDLLGMIG
           ||:|||||||||||||||||||||||||:|||||||||||||||||||||||||||||||
a048       MLDKGEELPVDFTNRLIYYVGPVDPVGDEIVGPAGPTTATRMDKFTRQMLEQTDLLGMIG
                   10        20        30        40        50        60
```

-continued

```
                    70         80         90        100        110        120
m048.pep    KSERGVATCEAIADNKAVYLMAVGGAAYLVAKAIKSSKVLAFPELGMEAIYEFEVKDMPV
            |||||:||||||||||||||||||||||||||||||||||||||||||||||||||||||
a048        KSERGAATCEAIADNKAVYLMAVGGAAYLVAKAIKSSKVLAFPELGMEAIYEFEVKDMPV
                    70         80         90        100        110        120

                   130        140        150
m048.pep    TVAVDSKGESIHATAPRKWQAKIGIIPVESX
            |||||||||||||||| :||||||||||:||
a048        TVAVDSKGESIHATAPPQWQAKIGIIPVKSX
                   130        140        150
```

Computer analysis of this amino acid sequence gave the following results:

Homology with a Predicted ORF from *N. gonorrhoeae*

ORF 048 shows 96.4% identity over a 150 aa overlap with a predicted ORF (ORF 048.ng) from *N. gonorrhoeae*:

```
m048/g048

                    10         20         30         40         50         60
m048.pep    MLNKGEELPVDFTNRLIYYVGPVDPVGDEVVGPAGPTTATRMDKFTRQMLEQTDLLGMIG
            ||:||||||||||||||||||||||||||||||||||||||||||||||||:||||||||
g048        MLDKGEELPVDFTNRLIYYVGPVDPVGDEVVGPAGPTTATRMDKFTRQMLKQTDLLGMIG
                    10         20         30         40         50         60

                    70         80         90        100        110        120
m048.pep    KSERGVATCEAIADNKAVYLMAVGGAAYLVAKAIKSSKVLAFPELGMEAIYEFEVKDMPV
            |||||:||||||||||||||||||||||||||||||||||||||||||:|||||||||||
g048        KSERGAATCEAIADNKAVYLMAVGGAAYLVAKAIKSSKVLAFPELGMEAVYEFEVKDMPV
                    70         80         90        100        110        120

                   130        140        150
m048.pep    TVAVDSKGESIHATAPRKWQAKIGIIPVESX
            |||||||||||||||||||||||||||||||
g048        TVAVDSKGESIHATAPRKWQAKIGIIPVESX
                   130        140        150
```

The following partial DNA sequence was identified in *N. gonorrhoeae* <SEQ ID 205>:

```
g049.seq
  1 ATGCGGGCGC AGGCGTTTGA TCAACCGTTC GGTCAGCTCC TGTTCGGACA

 51 GGCAGAACAC TTCGCGCCGG TTGACGGCTT TCGGGTTCAG GATATTGATT

101 TGGACGGGCA TCAACGCCTC TTCCGCACCG CCTTCGCCGT TTTCCGCAAC

151 CCCGTCTGCC GCCGTACCGG ATTCTGCCGC ATCGGCGTTT TCCCCGCCCT

201 CAATCTGTGC GGTTTCAAAT TCGGCACTGT CTTTTTTGGC ATCGAACCGG

251 ATTCTCCGCC GCGATTCGAT GTGTTTTTCC GAAAccggca tTTGCAGGGA

301 AGCCTgcgcg TTGAGCCAGT TTTCCTGAAG GACGATCATC GGGTCGGTTT

351 CGACTTCCTC GCCGCAATCG GCAACGGCgc tGTTGTGTTC TTCCTGCCAT

401 TTCTTCAGAT ACGCCTTTAA
```

This corresponds to the amino acid sequence <SEQ ID 206; ORF 049.ng>:

```
g049.pep
  1 MRAQAFDQPF GQLLFGQAEH FAPVDGFRVQ DIDLDGHQRL FRTAFAVFRN

 51 PVCRRTGFCR IGVFPALNLC GFKFGTVFFG IEPDSPPRFD VFFRNRHLQG

101 SLRVEPVFLK DDHRVGFDFL AAIGNGAVVF FLPFLQIRL*
```

The following partial DNA sequence was identified in *N. meningitidis* <SEQ ID 207>:

```
m049.seq (partial)
   1 ATGCGGGCGC AGGCGTTTGA TCAGCCGTTC GGTCAGCTCC TGTTCGGACA

  51 GGCAGAACAC TTCGCGCCGG TTGACGGCTT TCGGGTTCAG GATATTGATT

 101 TGGACGGGCA TCAACGTTTC TTCCGCATCG TTTTCCCCGT TTTCCGAAAC

 151 CGCCGGCTCA TTCGTGCCGG ATTCTGCCTC GTCGGCGTTT TCCCCGCTTT

 201 CAATCTGTCC GGTTTCAAAT TCGACACTGT CTTTTTTGGT ATCAAACCGG

 251 ATTCTCCGCC GCGATTCGAT GTGTTTTTCC GAAACCGACA TTTGCAGGGA

 301 AGCCTGCGCG TTGAGCCAGT TTTCCTGAAG GACGATCATC GGGTCGGTTT

 351 CGACTTCCTC GCCGCAATCG GCAACGGCGG CATTGTGTTC CTCCTGCCAT

 401 TTTTTCAGAT ACGCCTT...
```

This corresponds to the amino acid sequence <SEQ ID 208; ORF 049>:

```
m049.pep (partial)
   1 MRAQAFDQPF GQLLFGQAEH FAPVDGFRVQ DIDLDGHQRF FRIVFPVFRN

  51 RRLIRAGFCL VGVFPAFNLS GFKFDTVFFG IKPDSPPRFD VFFRNRHLQG

 101 SLRVEPVFLK DDHRVGFDFL AAIGNGGIVF LLPFFQIRL...
```

The following partial DNA sequence was identified in *N. meningitidis* <SEQ ID 209>:

```
a049.seq
   1 ATGCGGGCGC AGGCGTTTGA TCAGCCGTTC GGTCAGCTCC TGTTCGGACA

  51 GGCAGAACAC TTCGCGCCGG TTGACGGCTT TCGGGTTCAG AATATTGATT

 101 TGGACGGGCA TCAACGCTTC TTCCGCACCG CCTTCGCCGT TTTCCGCAAC

 151 CCCGTCTGCC GCCGTACCCG ATTCTGCCGC ATCGGCGTTT TCCCCGCCTT

 201 CAATCTGTCC GGTTTCAAAT TCGGCACTGT CTTTTTTGGC ATCAAACCGG

 251 ATTCTCCGCC GCGATTCGAT GTGTTTTTCC GAAACCGACA TTTGCAGGGA

 301 AGCCTGCGCG TTGAGCCAGT TTTCCTGAAG GACGATCATC GGGTCGGTTT

 351 CGACTTCCTC GCCGCAATCG GCAACGGCGG CATTGTGTTC CTCCTGCCAT

 401 TTTTTCAGAT ACGCCTT
```

This corresponds to the amino acid sequence <SEQ ID 210; ORF 049.a>:

```
a049.pep
   1 MRAQAFDQPF GQLLFGQAEH FAPVDGFRVQ NIDLDGHQRF FRTAFAVFRN

  51 PVCRRTRFCR IGVFPAFNLS GFKFGTVFFG IKPDSPPRFD VFFRNRHLQG

 101 SLRVEPVFLK DDHRVGFDFL AAIGNGGIVF LLPFFQIRL
```

m049/a049 90.6% identity over a 139 aa overlap

```
                    10        20        30        40        50        60
m049.pep   MRAQAFDQPFGQLLFGQAEHFAPVDGFRVQDIDLDGHQRFFRIVFPVFRNRRLIRAGFCL
           ||||||||||||||||||||||||||||||:||||||||||| :| ||||    |: || 
a049       MRAQAFDQPFGQLLFGQAEHFAPVDGFRVQNIDLDGHQRFFRTAFAVFRNPVCRRTRFCR
                    10        20        30        40        50        60
```

-continued

```
                  70        80        90       100       110       120
m049.pep   VGVFPAFNLSGFKFDTVFFGIKPDSPPRFDVFFRNRHLQGSLRVEPVFLKDDHRVGFDFL
           :||||||||||||| |||||||||||||||||||||||||||||||||||||||||||||
a049       IGVFPAFNLSGFKFGTVFFGIKPDSPPRFDVFFRNRHLQGSLRVEPVFLKDDHRVGFDFL
                  70        80        90       100       110       120

                 130      139
m049.pep   AAIGNGGIVFLLPFFQIRL
           |||||||||||||||||||
a049       AAIGNGGIVFLLPFFQIRL
                 130
```

Computer analysis of this amino acid sequence gave the following results:

Homology with a Predicted ORF from *N. gonorrhoeae*

ORF 049 shows 86.3% identity over a 139 aa overlap with a predicted ORF (ORF 049.ng) from *N. gonorrhoeae*:

```
m049/g049

                  10        20        30        40        50        60
m049.pep   MRAQAFDQPFGQLLFGQAEHFAPVDGFRVQDIDLDGHQRFFRIVFPVFRNRRLIRAGFCL
           |||||||||||||||||||||||||||||||||||||||:|| :| ||||    |:||| 
g049       MRAQAFDQPFGQLLFGQAEHFAPVDGFRVQDIDLDGHQRLFRTAFAVFRNPVCRRTGFCR
                  10        20        30        40        50        60

                  70        80        90       100       110       120
m049.pep   VGVFPAFNLSGFKFDTVFFGIKPDSPPRFDVFFRNRHLQGSLRVEPVFLKDDHRVGFDFL
           :|||||:|| |||| ||||||:||||||||||||||||||||||||||||||||||||||
g049       IGVFPALNLCGFKFGTVFFGIEPDSPPRFDVFFRNRHLQGSLRVEPVFLKDDHRVGFDFL
                  70        80        90       100       110       120

                 130      139
m049.pep   AAIGNGGIVFLLPFFQIRL
           ||||||::||:|||:||||
g049       AAIGNGAVVFFLPFLQIRLX
                 130       140
```

The following partial DNA sequence was identified in *N. gonorrhoeae* <SEQ ID 211>:

```
g050.seq
     1 atgggcgCGG GCTGGTGTCC TCCCGGCATC TTGGGCATCG GCATCGGCGg

    51 cacgcccGAA AAAGccgtgt TGATGGcaaA AGAATCCCTG ATGAGCCACA

   101 TCGAcatCca aGaATTGCAG GAAAAAGCCG CGTccggggc ggaattgtcc

   151 accaccgaAG ccCTGCGCCT cGAACTCTTT GAAAAGGTCA ACGCGCTGGG

   201 CATCGGCGCG CAAGGCTTGG GCGGTCTGAC CACCGTGTTG GACGTGAAAA

   251 TCCTCGATTA CCCGACCCAT GCCGCCTCCA AACCGATTGC CATGATTCCC

   301 AACTGTGCcg ccacCCGcca cgtcgAATTT GAATTGgACG GCTCAGGtcc

   351 TGTCGAactc acgccGCcgc gtgtCGAAGA CTGA
```

This corresponds to the amino acid sequence <SEQ ID 212; ORF 050.ng>:

```
g050.pep
     1 MGAGWCPPGI LGIGIGGTPE KAVLMAKESL MSHIDIQELQ EKAASGAELS

    51 TTEALRLELF EKVNALGIGA QGLGGLTTVL DVKILDYPTH AASKPIAMIP

   101 NCAATRHVEF ELDGSGPVEL TPPRVED*
```

The following partial DNA sequence was identified in *N. meningitidis* <SEQ ID 213>:

```
m050.seq
   1 ATGGGCGCGG GCTGGTGTCC TCCCGGCATC TTGGGTATCG GCATCGGCGG

  51 C..agCCgAA AAAGCCGTGC TGATGGCAAA AGAGTCCCTG ATGAGCCACA

 101 TCGACATTCA AGAATTGCAG GAAAAGGCCG CGTCCGGCGC GgAATTGTCC

 151 ACCACCGAAG CCCTGCGCCT CGAACTCTTT GAAAAAGTCA ACGCGCTGGG

 201 CATCGGCGCA CAAGGCTTGG GCGGACTGAC CACCGTGTTG GACGTGAAAA

 251 TCCTCGATTA TCCGACCCAC GCCGCCTCCA AACCGATTGC CATGATTCCG

 301 AACTGCGCCG CCACCCGCCA CGTCGAATTT GAATTGGACG GCTCAGGCCC

 351 TGTCGAACTC ACGCCGCCGC GCGTCGAAGA TGGCCCGATT TGA
```

This corresponds to the amino acid sequence <SEQ ID 214; ORF 050>:

```
m050.pep
   1 MGAGWCPPGI LGIGIGGXAE KAVLMAKESL MSHIDIQELQ EKAASGAELS

  51 TTEALRLELF EKVNALGIGA QGLGGLTTVL DVKILDYPTH AASKPIAMIP

 101 NCAATRHVEF ELDGSGPVEL TPPRVEDGPI *
```

The following partial DNA sequence was identified in *N. meningitidis* <SEQ ID 215>:

```
a050.seq
   1 ATGGGCGCGG GCTGGTGTCC TCCCGGCATC TTGGGCATCG GCATCGGCGG

  51 TACGCCCGAA AAAGCCGTGT TGATGGCGAA AGAATCCCTG ATGAGCCACA

 101 TCGACATCCA AGAATTGCAG GAAAAAGCCG CGTCCGGCGC GGAATTGTCC

 151 ACCACCGAAG CCCTGCGCCT CGAACTCTTT GAAAAAGTCA ACGCGCTAGG

 201 CATCGGCGCG CAAGGCTTGG GCGGTCTGAC CACCGTGTTG GACGTGAAAA

 251 TCCTCGATTA CCCGACCCAC GCCGCCTCCA AACCGATTGC CATGATTCCG

 301 AACTGCGCCG CCACCCGCCA CGTCGAATTT GAATTGGACG GCTCAGGCCC

 351 TGTCGAACTC ACGCCGCCGC GCGTCGAAGA CTGGCCC
```

This corresponds to the amino acid sequence <SEQ ID 216; ORF 050.a>:

```
a050.pep
   1 MGAGWCPPGI LGIGIGGTPE KAVLMAKESL MSHIDIQELQ EKAASGAELS

  51 TTEALRLELF EKVNALGIGA QGLGGLTTVL DVKILDYPTH AASKPIAMIP

 101 NCAATRHVEF ELDGSGPVEL TPPRVEDWP
```

m050/a050 97.7% identity over a 129 aa overlap

```
                    10        20        30        40        50        60
m050.pep    MGAGWCPPGILGIGIGGXAEKAVLMAKESLMSHIDIQELQEKAASGAELSTTEALRLELF
            ||||||||||||||||| :|||||||||||||||||||||||||||||||||||||||||
a050        MGAGWCPPGILGIGIGGTPEKAVLMAKESLMSHIDIQELQEKAASGAELSTTEALRLELF
                    10        20        30        40        50        60
```

-continued

```
                 70         80         90        100        110        120
m050.pep   EKVNALGIGAQGLGGLTTVLDVKILDYPTHAASKPIAMIPNCAATRHVEFELDGSGPVEL
           ||||||||||||||||||||||||||||||||||||||||||||||||||||||||||||
a050       EKVNALGIGAQGLGGLTTVLDVKILDYPTHAASKPIAMIPNCAATRHVEFELDGSGPVEL
                 70         80         90        100        110        120

                130
m050.pep   TPPRVEDGPIX
           ||||||| |
a050       TPPRVEDWP
```

Computer analysis of this amino acid sequence gave the following results:

Homology with a Predicted ORF from *N. gonorrhoeae*

ORF 050 shows 98.4% identity over a 127 aa overlap with a predicted ORF (ORF 050.ng) from *N. gonorrhoeae*:

```
m050/g050

                 10         20         30         40         50         60
m050.pep   MGAGWCPPGILGIGIGGXAEKAVLMAKESLMSHIDIQELQEKAASGAELSTTEALRLELF
           |||||||||||||||||: |||||||||||||||||||||||||||||||||||||||||
g050       MGAGWCPPGILGIGIGGTPEKAVLMAKESLMSHIDIQELQEKAASGAELSTTEALRLELF
                 10         20         30         40         50         60

                 70         80         90        100        110        120
m050.pep   EKVNALGIGAQGLGGLTTVLDVKILDYPTHAASKPIAMIPNCAATRHVEFELDGSGPVEL
           ||||||||||||||||||||||||||||||||||||||||||||||||||||||||||||
g050       EKVNALGIGAQGLGGLTTVLDVKILDYPTHAASKPIAMIPNCAATRHVEFELDGSGPVEL
                 70         80         90        100        110        120

                130
m050.pep   TPPRVEDGPIX
           |||||||
g050       TPPRVEDX
```

The following partial DNA sequence was identified in *N. gonorrhoeae* <SEQ ID 217>:

```
g050-1.seq
   1 ATGACCGTTA TCAAGCAAGA AGACTTTATT CAAAGTATCT GCGATGCCTT

  51 CCAATTCATC AGCTACTACC ATCCAAAAGA CTACATCGAC GCGCTTTATA

 101 AGGCGTGGCA GAAGGAAGAA AATCCCGCCG CCAAAGACGC GATGACGCAG

 151 ATTTTGGTCA ACAGCCGTAT GTGTGCCGAA AACAACCGCC CCATCTGCCA

 201 AGACACAGGT ATCGCAACCG TCTTCCTCAA AGTCGGTATG GATGTGCAAT

 251 GGGATGCGGA CATGAGCGTG GAAAAGATGG TTAACGAAGG CGTACGCCGC

 301 GCCTACACTT GGGAAGGCAA CACCCTGCGC GCTTCCGTCC TCGCCGATCC

 351 GGCCGGCAAA CGCCAAAACA CCAAAGACAA CACCCCCGCC GTCATCCACA

 401 TGAGCATCGT GCCGGGCGGT AAAGTCGAAG TAACCTGCGC GGCAAAAGGC

 451 GGCGGCTCTG AAAACAAATC CAAACTCGCT ATGCTCAACC CTTCCGACAA

 501 CATCGTCGAT TGGGTATTGA AAACCATCCC GACGATGGGC GCGGGCTGGT

 551 GTCCTCCCGG CATCTTGGGC ATCGGCATCG GCGGCAcgcC CGAAAAAGCC

 601 GTGTTGATGG cgaAAGAATC CCTGATGAGC CACATCGACA TCCAAGAATT

 651 GCAGGAAAAA GCCGCGTCCG GCGCGGAATT GTCCACCACC GAAGCCCTGC

 701 GCCTCGAACT CTTTGAAAAG GTCAACGCGC TGGGCATCGG CGCGCAAGGC

 751 TTGGGCGGTC TGACCACCGT GTTGGACGTG AAAATCCTCG ATTACCCGAC

 801 CCATGCCGCC TCCAAACCGA TTGCCATGAT TCCCAACTGT GCCGCCACCC

 851 GCCACGTCGA ATTTGAATTG GACGGCTCAG GTCCTGTCGA ACTCACGCCG
```

-continued

901 CCGCGCGTCG AAGACTGACC CGATCTGACT TACAGCCCCG ACAACGGCAA

951 ACGCGTCGAT GTCGATAAGC TGACCAAAGA AGAAGTGGCA AGCTGGAAAA

1001 CCGGCGACGT ATTGCTGTTG AACGGCAAAA TCCTCACCGG CCGCGATGCC

1051 GCGCACAAAC GCCTCGTCAA TATGCTCGAC AAAGGCGAGG AGTTGCCCGT

1101 CGATTTCACC AACCGCCTGA TTTACTACGT CGGCCCCGTC GATCCGGTCG

1151 GCGATGAAGT CGTCGGTCCC GCAGGTCCGA CCACAGCCAC CCGCATGGAC

1201 AAATTTACCC GCCAAATGCT CAAACAAACC GGCCTCTTGG GCATGATCGG

1251 CAAATCCGAG CGCGGCGCGG CCACCTGCGA AGCCATCGCC GACAACAAGG

1301 CCGTGTACCT CATGGCAGTC GGCGGCGCGG CATACCTCGT GGCAAAAGCC

1351 ATCAAATCTT CCAAAGTCTT GGCGTTCCCC GAATTGGGTA TGGAAGCCGT

1401 TTACGAATTT GAAGTCAAAG ATATGCCCGT AACCGTCGCC GTGGACAGCA

1451 AAGGCGAATC CATCCACGCC ACCGCCCCGC GCAAATGGCA GGCGAAAATC

1501 GGCATCATCC CCGTCGAGTC TTGA

This corresponds to the amino acid sequence <SEQ ID 218; ORF 050-1.ng>:

g050-1.pep

1 MTVIKQEDFI QSICDAFQFI SYYHPKDYID ALYKAWQKEE NPAAKDAMTQ

51 ILVNSRMCAE NNRPICQDTG IATVFLKVGM DVQWDADMSV EKMVNEGVRR

101 AYTWEGNTLR ASVLADPAGK RQNTKDNTPA VIHMSIVPGG KVEVTCAAKG

151 GGSENKSKLA MLNPSDNIVD WVLKTIPTMG AGWCPPGILG IGIGGTPEKA

201 VLMAKESLMS HIDIQELQEK AASGAELSTT EALRLELFEK VNALGIGAQG

251 LGGLTTVLDV KILDYPTHAA SKPIAMIPNC AATRHVEFEL DGSGPVELTP

301 PRVED*PDLT YSPDNGKRVD VDKLTKEEVA SWKTGDVLLL NGKILTGRDA

351 AHKRLVNMLD KGEELPVDFT NRLIYYVGPV DPVGDEVVGP AGPTTATRMD

401 KFTRQMLKQT GLLGMIGKSE RGAATCEAIA DNKAVYLMAV GGAAYLVAKA

451 IKSSKVLAFP ELGMEAVYEF EVKDMPVTVA VDSKGESIHA TAPRKWQAKI

501 GIIPVES*

```
g050-1 (SEQ ID 218)/p14407 (SEQ ID 4160)
 sp|P14407|FUMB_ECOLI FUMARATE HYDRATASE CLASS I, ANAEROBIC (FUMARASE)
>gi|280063|pir||B44511 fumarate hydratase (EC 4.2.1.2) fumB, iron-dependent-Escherichia coli
>gi|146048 (M27058) anaerobic class I fumarase (EC 4.2.1.2) [Escherichia coli] Length = 548
 Score = 172 bits (432), Expect = 4e-42
 Identities = 138/488 (28%), Positives = 216/488 (43%), Gaps = 22/488 (4%)

Query:  11 QSICDAFQFISYYHPKDYIDALYKAWQKEENPAAKDAMTQILVNSRMCAENNRPICQDTG 70
           Q+  DA   +   H K     L+     E +   K    Q L NS + A+   P CQDTG
Sbjct:  53 QAFHDASFMLRPAHQKQVAAILHDPEASEND---KYVALQFLRNSEIAAKGVLPTCQDTG 109

Query:  71 IATVFLKVGMDVQWDADMSVEKMVNEGVRRAYTWEGNTLRASVLADPAGKRQNTKDNTPA 130
            A +  K G  V W      E+ +++GV   Y  E N   +   A    K  NT  N PA
Sbjct: 110 TAIIVGKKGQRV-WTGGGD-EETLSKGVYNTYI-EDNLRYSQNAALDMYKEVNTGTNLPA 166

Query: 131 VIHMSIVPGGKVEVTCAAKGGGSENKSKL-----AMLNPSDNIVDWVLKTIPTMGAGWCP 185
            I +  V G + +  C AKGGGS NK+ L     A+L P   + +++++ + T+G   CP
Sbjct: 167 QIDLYAVDGDEYKFLCVAKGGGSANKTYLYQETKALLTPG-KLKNFLVEKMRTLGTAACP 225

Query: 186 PXXXXXXXXXTPEKAVLMAKESLMSHIDIQELQEKAASGAELSTTEALRLELFEKVNXXX 245
           P         T  +  L   +   +H    EL  +     +      L  EL E+
Sbjct: 226 PYHIAFVIGGTSAETNLKTVKLASAHY-YDELPTEGNEHGQAFRDVQLEQELLEEAQKLG 284

Query: 246 XXXXXXXXXTTVLDVKILDYPTHAASKPIAMIPNCAATRHVEFELDGSG----PVELTPP 301
                        D++++  P H AS P+ M  +C+A R+++ +++  G     +E  P
Sbjct: 285 LGAQFGGKYFAH-DIRVIRLPRHGASCPVGMGVSCSADRNIKAKINREGIWIEKLEHNPG 343

Query: 302 RVEDXPDLTYSPDNGKRVDVDKLTKE---EVASWKTGDVLLLNGKILTGRDAAHKRLVNM 358
           +               +VD+++  KE   +++ +     L L G I+ GRD AH +L  +
Sbjct: 344 QYIPQELRQAGEGEAVKVDLNRPMKEILAQLSQYPVSTRLSLTGTIIVGRDIAHAKLKEL 403
```

-continued

```
Query: 359 LDKGEELPVDFTNRLIYYXXXXXXXXXXXXXXXXXTTATRMDKFTRQMLKQTGLLGMIGK 418
           +D G+ELP    +  IYY                  TTA RMD +    +    G + M+ K
Sbjct: 404 IDAGKELPQYIKDHPIYYAGPAKTPAGYPSGSLGPTTAGRMDSYVDLLQSHGGSMIMLAK 463

Query: 419 SERGAATCEAIADNKAVYLMAVGG-AAYLVAKAIKSSKVLAFPELGMEAVYEFEVKDMPV 477
             R     +A   +   YL ++GG AA L   ++IK  + +A+PELGMEA+++ EV+D P
Sbjct: 464 GNRSQQVTDACHKHGGFYLGSIGGPAAVLAQQSIKHLECVAYPELGMEAIWKIEVEDFPA 523

Query: 478 TVAVDSKG                                                     485
           + VD KG
Sbjct: 524 FILVDDKG                                                     531
```

The following partial DNA sequence was identified in *N. meningitidis* <SEQ ID 219>:

```
m050-1.seq
   1 ATGACCGTCA TCAAACAGGA AGACTTTATC CAAAGCATTT GCGATGCCTT
  51 CCAATTCATC AGCTACTATC ATCCCAAAGA CTACATCGAC GCGCTTTATA
 101 AGGCGTGGCA GAAGGAAGAA AATCCTGCCG CCAAAGACGC GATGACGCAG
 151 ATTTTGGTCA ACAGCCGTAT GTGTGCGGAA AACAACCGCC CCATCTGCCA
 201 AGACACAGGT ATCGCAACCG TCTTCCTCAA AGTCGGTATG AACGTCCAAT
 251 GGGATGCGGA CATGAGCGTG GAAGAGATGG TTAACGAAGG CGTACGCCGC
 301 GCCTACACTT GGGAAGGCAA TACGCTGCGC GCTTCCGTCC TCGCCGATCC
 351 GGCCGGCAAA CGCCAAAACA CCAAAGACAA CACCCCCGCC GTCATCCATA
 401 TGAGCATCGT GCCGGGCGGT AAAGTCGAAG TAACCTGCGC GGCAAAAGGC
 451 GGCGGCTCTG AAAACAAATC CAAACTCGCC ATGCTCAATC CTTCCGACAA
 501 CATCGTCGAT TGGGTATTGA AACCATCCC GACCATGGGC GCGGGCTGGT
 551 GTCCTCCCGG CATCTTGGGT ATCGGCATCG GCGGCACGCC CGAAAAAGCC
 601 GTGCTGATGG CAAAAGAGTC CCTGATGAGC CACATCGACA TTCAAGAATT
 651 GCAGGAAAAG GCCGCGTCCG GCGCGGAATT GTCCACCACC GAAGCCCTGC
 701 GCCTCGAACT CTTTGAAAAA GTCAACGCGC TGGGCATCGG CGCACAAGGC
 751 TTGGGCGGAC TGACCACCGT GTTGGACGTG AAAATCCTCG ATTATCCGAC
 801 CCACGCCGCC TCCAAACCGA TTGCCATGAT TCCGAACTGC GCCGCCACCC
 851 GCCACGTCGA ATTTGAATTG GACGGCTCAG GCCCTGTCGA ACTCACGCCG
 901 CCGCGCGTCG AAGACTGGCC CGATTTGACT TACAGCCCCG ACAACGGCAA
 951 ACGCGTCGAT GTCGACAAGC TGACCAAAGA AGAAGTGGCA AGCTGGAAAA
1001 CCGGCGACGT ATTGCTGTTG AACGGCAAAA TCCTCACCGG CCGCGATGCC
1051 GCACACAAAC GCCTCGTCGA TATGCTCAAC AAAGGCGAAG AATTGCCCGT
1101 CGATTTCACC AACCGCCTGA TTTACTACGT CGGCCCCGTC GATCCGGTCG
1151 GCGATGAAGT CGTCGGTCCG GCAGGTCCGA CCACAGCCAC CCGCATGGAC
1201 AAATTCACCC GCCAAATGCT CGAACAAACC GACCTCTTGG GCATGATCGG
1251 CAAATCCGAG CGCGGCGTGG CCACCTGCGA AGCCATCGCC GACAACAAAG
1301 CCGTGTACCT CATGGCAGTC GGCGGCGCGG CGTATCTCGT GGCAAAAGCC
1351 ATCAAATCTT CCAAAGTCTT GGCGTTCCCC GAATTGGGCA TGGAAGCCAT
1401 TTACGAATTT GAAGTCAAAG ACATGCCCGT AACCGTCGCC GTAGATAGCA
1451 AAGGCGAATC CATCCACGCC ACCGCCCCGC GCAAATGGCA GGCGAAAATC
1501 GGCATCATCC CCGTCGAATC TTGA
```

This corresponds to the amino acid sequence <SEQ ID 220; ORF 050-1>:

```
m050-1.pep

      1  MTVIKQEDFI QSICDAFQFI SYYHPKDYID ALYKAWQKEE NPAAKDAMTQ

     51  ILVNSRMCAE NNRPICQDTG IATVFLKVGM NVQWDADMSV EKMVNEGVRR

    101  AYTWEGNTLR ASVLADPAGK RQNTKDNTPA VIHMSIVPGG KVEVTCAAKG

    151  GGSENKSKLA MLNPSDNIVD WVLKTIPTMG AGWCPPGILG IGIGGTPEKA

    201  VLMAKESLMS HIDIQELQEK AASGAELSTT EALRLELFEK VNALGIGAQG

    251  LGGLTTVLDV KILDYPTHAA SKPIAMIPNC AATRHVEFEL DGSGPVELTP

    301  PRVEDWPDLT YSPDNGKRVD VDKLTKEEVA SWKTGDVLLL NGKILTGRDA

    351  AHKRLVDMLN KGEELPVDFT NRLIYYVGPV DPVGDEVVGP AGPTTATRMD

    401  KFTRQMLEQT DLLGMIGKSE RGVATCEAIA DNKAVYLMAV GGAAYLVAKA

    451  IKSSKVLAFP ELGMEAIYEF EVKDMPVTVA VDSKGESIHA TAPRKWQAKI

    501  GIIPVES*

m050-1/g050-1 98.2% identity in 507 aa overlap

                   10        20        30        40        50        60
m050-1.pep MTVIKQEDFIQSICDAFQFISYYHPKDYIDALYKAWQKEENPAAKDAMTQILVNSRMCAE
           ||||||||||||||||||||||||||||||||||||||||||||||||||||||||||||
g050-1     MTVIKQEDFIQSICDAFQFISYYHPKDYIDALYKAWQKEENPAAKDAMTQILVNSRMCAE
                   10        20        30        40        50        60

                   70        80        90       100       110       120
m050-1.pep NNRPICQDTGIATVFLKVGMNVQWDADMSVEEMVNEGVRRAYTWEGNTLRASVLADPAGK
           ||||||||||||||||||||:||||||||||:||||||||||||||||||||||||||||
g050-1     NNRPICQDTGIATVFLKVGMDVQWDADMSVEKMVNEGVRRAYTWEGNTLRASVLADPAGK
                   70        80        90       100       110       120

                  130       140       150       160       170       180
m050-1.pep RQNTKDNTPAVIHMSIVPGGKVEVTCAAKGGGSENKSKLAMLNPSDNIVDWVLKTIPTMG
           ||||||||||||||||||||||||||||||||||||||||||||||||||||||||||||
g050-1     RQNTKDNTPAVIHMSIVPGGKVEVTCAAKGGGSENKSKLAMLNPSDNIVDWVLKTIPTMG
                  130       140       150       160       170       180

                  190       200       210       220       230       240
m050-1.pep AGWCPPGILGIGIGGTPEKAVLMAKESLMSHIDIQELQEKAASGAELSTTEALRLELFEK
           ||||||||||||||||||||||||||||||||||||||||||||||||||||||||||||
g050-1     AGWCPPGILGIGIGGTPEKAVLMAKESLMSHIDIQELQEKAASGAELSTTEALRLELFEK
                  190       200       210       220       230       240

                  250       260       270       280       290       300
m050-1.pep VNALGIGAQGLGGLTTVLDVKILDYPTHAASKPIAMIPNCAATRHVEFELDGSGPVELTP
           ||||||||||||||||||||||||||||||||||||||||||||||||||||||||||||
g050-1     VNALGIGAQGLGGLTTVLDVKILDYPTHAASKPIAMIPNCAATRHVEFELDGSGPVELTP
                  250       260       270       280       290       300

                  310       320       330       340       350       360
m050-1.pep PRVEDWPDLTYSPDNGKRVDVDKLTKEEVASWKTGDVLLLNGKILTGRDAAHKRLVDMLN
           ||||| ||||||||||||||||||||||||||||||||||||||||||||||||:||:
g050-1     PRVEDXPDLTYSPDNGKRVDVDKLTKEEVASWKTGDVLLLNGKILTGRDAAHKRLVNMLD
                  310       320       330       340       350       360

                  370       380       390       400       410       420
m050-1.pep KGEELPVDFTNRLIYYVGPVDPVGDEVVGPAGPTTATRMDKFTRQMLEQTDLLGMIGKSE
           |||||||||||||||||||||||||||||||||||||||||||||||:|| |||||||||
g050-1     KGEELPVDFTNRLIYYVGPVDPVGDEVVGPAGPTTATRMDKFTRQMLKQTGLLGMIGKSE
                  370       380       390       400       410       420

                  430       440       450       460       470       480
m050-1.pep RGVATCEAIADNKAVYLMAVGGAAYLVAKAIKSSKVLAFPELGMEAIYEFEVKDMPVTVA
           ||:|||||||||||||||||||||||||||||||||||||||||||:|||||||||||||
g050-1     RGAATCEAIADNKAVYLMAVGGAAYLVAKAIKSSKVLAFPELGMEAVYEFEVKDMPVTVA
                  430       440       450       460       470       480

                  490       500
m050-1.pep VDSKGESIHATAPRKWQAKIGIIPVESX
           |||||||||||||||||||||||||||
g050-1     VDSKGESIHATAPRKWQAKIGIIPVESX
                  490       500
```

The following partial DNA sequence was identified in *N. meningitidis* <SEQ ID 221>:

```
a050-1.seq
   1 ATGACCGTCA TCAAACAGGA AGACTTTATC CAAAGCATTT GCGATGCCTT
  51 CCAATTCATC AGCTACTACC ATCCCAAAGA CTACATCGAC GCGCTTTATA
 101 AGGCGTGGCA GAAGGAAGAA AACCCCGCCG CCAAAGACGC GATGACGCAG
 151 ATTTTGGTCA ACAGCCGCAT GTGTGCCGAA AACAACCGCC CCATCTGCCA
 201 AGATACCGGT ATCGCGACCG TGTTTTTGAA AGTCGGTATG GATGTGCAAT
 251 GGGATGCAGA CATGAGCGTC GAAGAGATGG TTAACGAAGG CGTGCGCCGC
 301 GCCTACACTT GGGAAGGCAA TACGCTGCGC GCTTCCGTTC TCGCCGACCC
 351 CGCCGGCAAA CGCCAAAATA CCAAAGACAA CACGCCCGCC GTCATCCATA
 401 TGAGCATCGT GCCGGGCGAC AAAGTCGAAG TAACCTGCGC GGCAAAAGGC
 451 GGCGGTTCTG AAAACAAATC CAAACTCGCC ATGCTCAACC CTTCCGACAA
 501 CATCGTCGAT TGGGTATTGA AAACCATTCC GACCATGGGC GCGGGCTGGT
 551 GTCCTCCCGG CATCTTGGGC ATCGGCATCG GCGGTACGCC CGAAAAAGCC
 601 GTGTTGATGG CGAAAGAATC CCTGATGAGC CACATCGACA TCCAAGAATT
 651 GCAGGAAAAA GCCGCGTCCG GCGCGGAATT GTCCACCACC GAAGCCCTGC
 701 GCCTCGAACT CTTTGAAAAA GTCAACGCGC TAGGCATCGG CGCGCAAGGC
 751 TTGGGCGGTC TGACCACCGT GTTGGACGTG AAAATCCTCG ATTACCCGAC
 801 CCACGCCGCC TCCAAACCGA TTGCCATGAT TCCGAACTGC GCCGCCACCC
 851 GCCACGTCGA ATTTGAATTG GACGGCTCAG GCCCTGTCGA ACTCACGCCG
 901 CCGCGCGTCG AAGACTGGCC CGATTTGACT TACAGCCCCG ACAACGGCAA
 951 ACGCGTCGAT GTCGACAAGC TGACCAAAGA AGAAGTGGCA AGCTGGAAAA
1001 CCGGCGACGT ATTGCTGTTG AACGGCAAAA TCCTCACCGG CCGCGATGCC
1051 GCACACAAAC GCCTCGTCGA TATGCTCGAC AAAGGCGAAG AATTGCCCGT
1101 CGATTTCACC AACCGCCTGA TTTACTACGT CGGCCCCGTC GATCCGGTCG
1151 GCGACGAAAT CGTCGGCCCA GCAGGTCCGA CCACCGCCAC CCGCATGGAC
1201 AAATTCACCC GCCAAATGCT CGAACAAACC GACCTCTTGG GCATGATCGG
1251 CAAATCCGAG CGCGGCGCGG CCACCTGCGA AGCCATCGCC GACAACAAAG
1301 CCGTGTACCT CATGGCAGTC GGCGGCGCGG CGTATCTCGT GGCAAAAGCC
1351 ATCAAATCTT CCAAAGTCTT GGCGTTCCCC GAATTGGGCA TGGAAGCCAT
1401 TTACGAATTT GAAGTCAAAG ACATGCCCGT AACCGTCGCC GTAGACAGCA
1451 AAGGCGAATC CATCCACGCC ACCGCCCCGC CCCAATGGCA GGCGAAAATC
1501 GGCATCATCC CCGTCAAATC TTGA
```

This corresponds to the amino acid sequence <SEQ ID 222; ORF 050-1.a>:

```
a050-1.pep
   1  MTVIKQEDFI QSICDAFQFI SYYHPKDYID ALYKAWQKEE NPAAKDAMTQ
  51  ILVNSRMCAE NNRPICQDTG IATVFLKVGM DVQWDADMSV EEMVNEGVRR
 101  AYTWEGNTLR ASVLADPAGK RQNTKDNTPA VIHMSIVPGD KVEVTCAAKG
 151  GGSENKSKLA MLNPSDNIVD WVLKTIPTMG AGWCPPCILG IGIGGTPEKA
```

-continued

```
201  VLMAKESLMS HIDIQELQEK AASGAELSTT EALRLELFEK VNALGIGAQG

251  LGGLTTVLDV KILDYPTHAA SKPIAMIPNC AATRHVEFEL DGSGPVELTP

301  PRVEDWPDLT YSPDNGKRVD VDKLTKEEVA SWKTGDVLLL NGKILTGRDA

351  AHKRLVDMLD KGEELPVDFT NRLIYYVGPV DPVGDEIVGP AGPTTATRMD

401  KFTRQMLEQT DLLGMIGKSE RGAATCEAIA DNKAVYLMAV GGAAYLVAKA

451  IKSSVKLAFP ELGMEAIYEF EVKDMPVTVA VDSKGESIHA TAPPQWQAKI

501  GIIPVKS*
```

```
a050-1/m050-1 98.4% identity in 507 aa overlap

                    10        20        30        40        50        60
a050-1.pep  MTVIKQEDFIQSICDAFQFISYYHPKDYIDALYKAWQKEENPAAKDAMTQILVNSRMCAE
            |||||||||||||:||||||||||||||||||||||||||| ||||||||||||||||||
m050-1      MTVIKQEDFIQSICDAFQFISYYHPKDYIDALYKAWQKEENPAAKDAMTQILVNSRMCAE
                    10        20        30        40        50        60

                    70        80        90       100       110       120
a050-1.pep  NNRPICQDTGIATVFLKVGMDVQWDADMSVEEMVNEGVRRAYTWEGNTLRASVLADPAGK
            ||||||||||||||||||||:|||||||||||||||||||||||||||| ||||||||||||
m050-1      NNRPICQDTGIATVFLKVGMNVQWDADMSVEEMVNEGVRRAYTWEGNTLRASVLADPAGK
                    70        80        90       100       110       120

                   130       140       150       160       170       180
a050-1.pep  RQNTKDNTPAVIHMSIVPGDKVEVTCAAKGGGSENKSKLAMLNPSDNIVDWVLKTIPTMG
            ||||||||||||||||||| ||||||||||||||||||||||||||||||||||||||||
m050-1      RQNTKDNTPAVIHMSIVPGGKVEVTCAAKGGGSENKSKLAMLNPSDNIVDWVLKTIPTMG
                   130       140       150       160       170       180

                   190       200       210       220       230       240
a050-1.pep  AGWCPPGILGIGIGGTPEKAVLMAKESLMSHIDIQELQEKAASGAELSTTEALRLELFEK
            ||||||||||||||||||| ||||||||||||||||||||||||||||||||||||||||
m050-1      AGWCPPGILGIGIGGTPEKAVLMAKESLMSHIDIQELQEKAASGAELSTTEALRLELFEK
                   190       200       210       220       230       240

                   250       260       270       280       290       300
a050-1.pep  VNALGIGAQGLGGLTTVLDVKILDYPTHAASKPIAMIPNCAATRHVEFELDGSGPVELTP
            ||||||||||||||||||| ||||||||||||||||||||||||||||||||||||||||
m050-1      VNALGIGAQGLGGLTTVLDVKILDYPTHAASKPIAMIPNCAATRHVEFELDGSGPVELTP
                   250       260       270       280       290       300

                   310       320       330       340       350       360
a050-1.pep  PRVEDWPDLTYSPDNGKRVDVDKLTKEEVASWKTGDVLLLNGKILTGRDAAHKRLVDMLD
            ||||||||||||||||||| |||||||||||||||||||||||||||||||||||||||:
m050-1      PRVEDWPDLTYSPDNGKRVDVDKLTKEEVASWKTGDVLLLNGKILTGRDAAHKRLVDMLN
                   310       320       330       340       350       360

                   370       380       390       400       410       420
a050-1.pep  KGEELPVDFTNRLIYYVGPVDPVGDEIVGPAGPTTATRMDKFTRQMLEQTDLLGMIGKSE
            ||||||||||||||||||| ||||||:|||||||||||||||||||||||||||||||||
m050-1      KGEELPVDFTNRLIYYVGPVDPVGDEVVGPAGPTTATRMDKFTRQMLEQTDLLGMIGKSE
                   370       380       390       400       410       420

                   430       440       450       460       470       480
a050-1.pep  RGAATCEAIADNKAVYLMAVGGAAYLVAKAIKSSVKLAFPELGMEAIYEFEVKDMPVTVA
            ||:|||||||||||||||| ||||||||||||||||||||||||||||||||||||||||
m050-1      RGVATCEAIADNKAVYLMAVGGAAYLVAKAIKSSVKLAFPELGMEAIYEFEVKDMPVTVA
                   430       440       450       460       470       480

                   490       500
a050-1.pep  VDSKGESIHATAPPQWQAKIGIIPVKSX
            ||||||||||||| :||||||||||:||
m050-1      VDSKGESIHATAPRKWQAKIGIIPVESX
                   490       500
```

The following partial DNA sequence was identified in *N. gonorrhoeae* <SEQ ID 223>:

```
g052.seq
   1 ATGGCTTTGG TGGCGGAGGA AACGGAAATA TCCGCGCCGT GTTTCAAAGG

  51 CTGCGAGCCG ACGGGCGACA GCAGGCTGTT GTCCACCACC AAGAGCGCGC

 101 CGATGCCGTG CGCCAATTCC GCCAAGGCTT CCAAGTCGGC CACTTCGCCC

 151 AAGGGGTTGG ACGGCGTTTC CAAAAACAGC AGTTTGGTGT TGGCTTTGAC

 201 GGCGGCTTTC CATTCATTTA TATCAGTCGG CGACACGCGG CTCACTCCGA

 251 TGCCGAATTT GGTAACGATG TTATTGATAA AGCCGACGGT CGTGCCGAAC
```

-continued

```
301 AGGCTGCGGC TGGAAACCAC ATGGTCGCCC GCCTGCAGGA AGGTGAAAAA

351 CGCCGCCTGA
```

This corresponds to the amino acid sequence <SEQ ID 224; ORF 052.ng>:

```
g052.pep
   1 MALVAEETEI SAPCFKGCEP TGDSRLLSTT KSAPMPCANS AKASKSATSP

  51 KGLDGVSKNS SLVLALTAAF HSFISVGDTR LTPMPNLVTM LLIKPTVVPN

 101 RLRLETTWSP ACRKVKNAA*
```

The following partial DNA sequence was identified in *N. meningitidis* <SEQ ID 225>:

```
m052.seq
   1 ATGGCTTTGG TGGCGGAGGA AACGGAAATA TCCGCGCCGT GTTTCAAAGG

  51 CTGCGAGCCG ACGGGCGACA GCAGGCTGTT GTCCACCACC AAGAGCGCGC

 101 CGATGCCGTG CGCCAATTCC GCCAAGGCTT CCAAGTCGGC CACTTCGCCC

 151 AAGGGGTTGG ACGGCGTTTC CAAAAACAGC AGTTTGGTGT TGGCTTTGAC

 201 GGCGGCTTTC CATTCATTTA TATCAGTCGG CGACACGCGG CTCACTCCGA

 251 TGCCGAATTT GGTAACGATG TTATTGATAA AGCCGACGGT CGTGCCGAAC

 301 AGGCTGCGGC TGGAAACCAC ATGGTCGCCC GCCTGCAGGA AGGTGAAAAA

 351 CGCCGCCTGA
```

This corresponds to the amino acid sequence <SEQ ID 226; ORF 052>:

```
m052.pep
   1 MALVAEETEI SAPCFKGCEP TGDSRLLSTT KSAPMPCANS AKASKSATSP

  51 KGLDGVSKNS SLVLALTAAF HSFISVGDTR LTPMPNLVTM LLIKPTVVPN

 101 RLRLETTWSP ACRKVKNAA*
```

The following partial DNA sequence was identified in *N. meningitidis* <SEQ ID 227>:

```
a052.seq
   1 ATGGCTTTGG TCGCGGAGGA AACGGAAATA TCCGCGCCGT GTTTCAAAGG

  51 CTGAGAGCCG ACAGGCGACA GCAGGCTGTT GTCCACCACC AAGAGCGCGC

 101 CGATGCCGTG CGCCAATTCC GCCAAGGCTT CCAAGTCGGC CACTTCTCCC

 151 AAGGGATTGG ACGGCGTTTC CAAAAACAGC AGTTTGGTGT TGGCTTTGAC

 201 GGCGGCTTTC CATTCGTTTA TATCAGTCGG CGACACGTGA CTCACTTCGA

 251 TGCCGAATTT GGTAACGATG TTATTGATAA AGCCGACGGT CGTGCCGAAC

 301 AGGCTGCGGC TGGAAATCAC ATGGTCGCCC GCCTGCAAAA AGGTGAAAAA

 351 CGCCGCCTGA
```

This corresponds to the amino acid sequence <SEQ ID 228; ORF 052.a>:

```
a052.pep
  1  MALVAEETEI SAPCFKG*EP TGDSRLLSTT KSAPMPCANS AKASKSATSP
```

-continued

```
 51 KGLDGVSKNS SLVLALTAAF HSFISVGDT* LTSMPNLVTM LLIKPTVVPN

101 RLRLEITWSP ACKKVKNAA*
```

m052/a052 95.8% identity over a 119 aa overlap

```
                  10        20        30        40        50        60
m052.pep  MALVAEETEISAPCFKGCEPTGDSRLLSTTKSAPMPCANSAKASKSATSPKGLDGVSKNS
          |||||||||||||||||| |||||||||||||||||||||||||||||||||||||||||
a052      MALVAEETEISAPCFKGXEPTGDSRLLSTTKSAPMPCANSAKASKSATSPKGLDGVSKNS
                  10        20        30        40        50        60

                  70        80        90       100       110       120
m052.pep  SLVLALTAAFHSFISVGDTRLTPMPNLVTMLLIKPTVVPNRLRLETTWSPACRKVKNAAX
          |||||||||||||||||| || |||||||||||||||||||||| ||||||:|||||||
a052      SLVLALTAAFHSFISVGDTXLTSMPNLVTMLLIKPTVVPNRLRLEITWSPACKKVKNAAX
                  70        80        90       100       110       120
```

Computer analysis of this amino acid sequence gave the following results:

Homology with a Predicted ORF from *N. gonorrhoeae*

ORF 052 shows 95.8% identity over a 119 aa overlap with a predicted ORF (ORF 052.ng) from *N. gonorrhoeae*:

```
m052/g052

                  10        20        30        40        50        60
m052.pep  MALVAEETEISAPCFKGCEPTGDSRLLSTTKSAPMPCANSAKASKSATSPKGLDGVSKNS
          ||||||||||||||||||||||||||||||||||||||||||||||||||||||||||||
g052      MALVAEETEISAPCFKGCEPTGDSRLLSTTKSAPMPCANSAKASKSATSPKGLDGVSKNS
                  10        20        30        40        50        60

                  70        80        90       100       110       120
m052.pep  SLVLALTAAFHSFISVGDTWLTSMPNLATMLLIKPTVVPNRLRLEITWSPACKKVKNAAX
          |||||||||||||||||| || ||||:|||||||||||||||| ||||||:|||||||
g052      SLVLALTAAFHSFISVGDTRLTPMPNLVTMLLIKPTVVPNRLRLETTWSPACRKVKNAAX
                  70        80        90       100       110       120
```

The following partial DNA sequence was identified in *N. gonorrhoeae* <SEQ ID 229>:

```
g073.seq
  1 ATGTGTATGC CATACGCAAT AAGGGTTTCA GACGGCATCT GCCGCATTTT

 51 TCCGCCGATG CCGTCTGAAA CACGCAATCA GCGCGCGAGT GCCTGTTTCA

101 AATCGTCAAT CAAATCGCCA ACATATTCCA AACCGACCGA CAGGCGCACC

151 AGTCCGGGGC GGatacCGGC GGCGAGTTTT TCTTCGGGCT GCATCCTGCC

201 GTGCGTGGTT GTCCACGGAT TGGTGATGGT CGAGCGCACG TCGCCGAGGT

251 TGGCGGTACG GGAAAAGAGT TCCACGACTT TCCACGCGGC TGCTTGGTCG

301 GCGACTTCAA AACCGATGAC GATGCCGCCG CCGTTTTGCT GTTTGCGGAT

351 AAGCTCCGCC TGCGGATGGT CGGGCAATCC GGTGTAG
```

This corresponds to the amino acid sequence <SEQ ID 230; ORF 073.ng>:

```
g073.pep
  1 MCMPYAIRVS DGICRIFPPM PSETRNQRAS ACFKSSIKSP TYSKPTDRRT

 51 SPGRIPAASF SSGCILPCVV VHGLVMVERT SPRLAVREKS STTFHAAAWS

101 ATSKPMTMPP PFCCLRISSA CGWSGNPV*
```

The following partial DNA sequence was identified in *N. meningitidis* <SEQ ID 231>:

```
m073.seq
    1 ATGTGTATGC CATATAAGAT AAGGGTTTCA GACGGCATCT GCTGTCCAAT

   51 GCCGTCTGAA ACACGCAATC AGCGTGCGAG TGCCTGTTTC AAATCGTCAA

  101 TCAAATCGCC AACATATTCC AAACCGACCG ACAGGCGCAC CAATCCGGGG

  151 CGGATGTTGG CGGCGAGTTT TTCTTCGGGC TGCATCCTGC CGTGCGTGGT

  201 TGTCCACGGG TGGGTAATGG TCGAGCGCAC GTCACCGAGG TTGGCGGTGC

  251 GGGAAAAGAG TTCCACGCCG TCCACAACTT TCCACGCCGC TTCTTGATCG

  301 GCAACTTCAA AGCCGATGAC GATGCCGCCG CCGTTTTGCT GTTTGCGGAT

  351 AAGCGCCGCC TGAGGATGGT CGGACAATCC GGTGTAG
```

This corresponds to the amino acid sequence <SEQ ID 232; ORF 073>:

```
m073.pep
    1 MCMPYKIRVS DGICCPMPSE TRNQRASACF KSSIKSPTYS KPTDRRTNPG

   51 RMLAASFSSG CILPCVVVHG WVMVERTSPR LAVREKSSTP STTFHAASXS

  101 ATSKPMTMPP PFCCLRISAA XGWSDNPV*
```

The following partial DNA sequence was identified in *N. meningitidis* <SEQ ID 233>:

```
a073.seq
    1 ACGTGTATGT CATATAAGAT AAGGGTTTCA GACGGCATTT GCGGTGTTTT

   51 TCCGCCGATG CCGTCTGAA. CACGCAATCA GCGCGCGAGT GCCTGTTTCA

  101 AATCGTCAAT CAAATCGCCA ACATATTCCA AACCGACCGA CAGGCGCACC

  151 AATCCGGGGC GGATGTTGGC GGCGAGTTTT TCTTCGGGCT GCATCCTGCC

  201 GTGCGTGGTT GTCCACGGAT GGGTAATGGT CGAGCGCACG TCGCCGAGGT

  251 TGGCGGTACG GGAGAAAAGT TCGACGCCGT CCACGACTTT CCACGCGGCT

  301 GCTTGGTCGG CGACTTCAAA GCCGATGACG ATGCCGCCGC CGTTTTGCTG

  351 TTTGCGGATA AGCTCCGCCT GAGGATGGTC GGGTAATCCG GTGTAA
```

This corresponds to the amino acid sequence <SEQ ID 234; ORF 073.a>:

```
a073.pep
    1 TCMSYKIRVS DGICGVFPPM PSEXRNQRAS ACFKSSIKSP TYSKPTDRRT

   51 NPGRMLAASF SSGCILPCVV VHGWVMVERT SPRLAVREKS STPSTTFHAA

  101 AWSATSKPMT MPPPFCCLRI SSA*GWSGNP V*
```

m073/a073 92.3% identity over a 130 aa overlap

```
                    10                  20             30             40             50
m073.pep   MCMPYKIRVSDGICC---PMPSETRNQRASACFKSSIKSPTYSKPTDRRTNPGRMLAASF
           || ||||||||||     |||||:||||||||||||||||||||||||||||||||||||
a073       TCMSYKIRVSDGICGVFPPMPSEXRNQRASACFKSSIKSPTYSKPTDRRTNPGRMLAASF
                    10             20             30             40             50             60
```

-continued

```
              60        70        80        90       100       110
m073.pep   SSGCILPCVVVHGWVMVERTSPRLAVREKSSTPSTTFHAASXSATSKPMTMPPPFCCLRI
           |||||||||||||||||||||||||||||||||||||||||: |||||||||||||||||
a073       SSGCILPCVVVHGWVMVERTSPRLAVREKSSTPSTTFHAAAWSATSKPMTMPPPFCCLRI
                   70        80        90       100       110       120

           120      129
m073.pep   SAAXGWSDNPVX
           |:||||| ||||
a073       SSAXGWSGNPVX
                  130
```

Computer analysis of this amino acid sequence gave the following results:

Homology with a Predicted ORF from *N. gonorrhoeae*

ORF 073 shows 87.0% identity over a 131 aa overlap with a predicted ORF (ORF 073.ng) from *N. gonorrhoeae*:

```
m073/g073

                   10          20        30        40        50
m073.pep   MCMPYKIRVSDGICC---PMPSETRNQRASACFKSSIKSPTYSKPTDRRTNPGRMLAASF
           ||||| ||||||||    |||||||||||||||||||||||||||||||:|||: ||||
g073       TCMSYAIRVSDGICRIFPPMPSETRNQRASACFKSSIKSPTYSKPTDRRTSPGRIPAASF
                   10        20        30        40        50        60

              60        70        80        90       100       110
m073.pep   SSGCILPCVVVHGWVMVERTSPRLAVREKSSTPSTTFHAASXSATSKPMTMPPPFCCLRI
           ||||||||||||||||||||||||||||||||   |||||: |||||||||||||||||
g073       SSGCILPCVVVHGWVMVERTSPRLAVREKSST---TFHAAAWSATSKPMTMPPPFCCLRI
                   70        80        90            100       110

           120      129
m073.pep   SAAXGWSDNPVX
           |:| ||| ||||
g073       SSACGWSGNPVX
           120
```

The following partial DNA sequence was identified in *N. gonorrhoeae* <SEQ ID 235>:

```
g075.seq
  1 ATGCCGCCTT ACTTCATCAC CCTCTTAACG ATGGAAAATA CAAAAAGCGC

 51 GGCGAAAACG CCCACTACAA TCCAACCGGC TTCCATACCG TCCGCTTTTG

101 CGGCTTCCAA AGCGTTTTTT GCCGTTTCGG GCAACGCTGC GTTTGCCTGT

151 GCCGCCAAAG CCAGCGGGGC GGCTGTTACA ACAGCCAGTT TTGCGCCGTA

201 TTTACGGCAG GTGTTAATAA ATTTCATGAT ATTTTCCTTT ACGAAATTTT

251 TAAAAAAATG TGTTTGCGGG CTTTGTGAAG GTTTTAGAGA CCGCCTGCCG

301 GGCCTCTTAA ACTTAATCTT CTTTTTCGTA GAATCCGAAA ATTACAAATT

351 CCCCGCCTAT CTCTTCCAAT GCCGAGCTAA AAGCGTCTTC ATAGCTGTCA

401 TATTTACCGG CTGA
```

This corresponds to the amino acid sequence <SEQ ID 236; ORF 075.ng>:

```
g075.pep
  1 MPPYFITLLT MENTKSAAKT PTTIQPASIP SAFAASKAFF AVSGNAAFAC

 51 AAKASGAAVT TASFAPYLRQ VLINFMIFSF TKFLKKCVCG LCEGFRDRLP

101 GLLNLIFFFV ESENYKFPAY LFQCRAKSVF IAVIFTG*
```

The following partial DNA sequence was identified in *N. meningitidis* <SEQ ID 237>:

```
m075.seq
   1 ATGCCGTCTT ACTTCATCAC TCTCTTAACG ATGGAAAATA CAAAAAGCGC

  51 GGCGAAAATG CCCACTACAA TCCAACCGGC TTCCATACCG TCCGCTTTTG

 101 CGGCTTCCAA AGCGTTTTTT GCCGTATCGG GCAACGTTGC ATTTGCATGT

 151 GCGGCCAAAG CCAGGGGAGC AGCTGTTACA ACAGCCAGTT TTGCGCCGTA

 201 TTTACGGCAG GTGTTAATAA ATTTCATGAT ATTTTCCTTC AAAAAGTGTT

 251 TGGCGGTAAT GGATGGAGCG TTTTTCAGAC GACCGCCGAA CATCCGAAAA

 301 TCAGTCTTTC AAAAATCCGA ATACGACAAA TTCGTATTGG TTGCCGATTT

 351 CTTCCAAACC TGCGTTAATC GCTTCTTCGA AGTCGTAGAA ATAATCGGCA

 401 TTGGTGATTA A
```

This corresponds to the amino acid sequence <SEQ ID 238; ORF 075>:

```
m075.pep
   1 MPSYFITLLT MENTKSAAKM PTTIQPASIP SAFAASKAFF AVSGNVAFAC

  51 AAKARGAAVT TASFAPYLRQ VLINFMIFSF KKCLAVMDGA FFRRPPNIRK

 101 SVFQKSEYDK FVLVADFFQT CVNRFFEVVE IIGIGD*
```

Computer analysis of this amino acid sequence gave the following results:

Homology with a Predicted ORF from *N. gonorrhoeae*

ORF 075 shows 65.7% identity over a 137 aa overlap with a predicted ORF (ORF 075.ng) from *N. gonorrhoeae*:

```
m075/g075

                   10        20        30        40        50        60
m075.pep  MPSYFITLLTMENTKSAAKMPTTIQPASIPSAFAASKAFFAVSGNVAFACAAKARGAAVT
          || |||||||||||||||| |||||||||||||||||||||||||:|||||||| |||||
g075      MPPYFITLLTMENTKSAAKTPTTIQPASIPSAFAASKAFFAVSGNAAFACAAKASGAAVT
                   10        20        30        40        50        60

                    70        80            90       100       110
m075.pep   TASFAPYLRQVLINFMIFSF----KKCLAVMDGAFFRRPPNIRKSVFQKSEYDKFVLVAD
           ||||||||||||||||||||    |||:  :  :|  | |:: : :|   | ::: : |
g075       TASFAPYLRQVLINFMIFSFTKFLKKCVCGLCEGFRDRLPGLLNLIFFFVESENYKFPAY
                    70        80        90       100       110       120

           120       130
m075.pep  FFQTCVNRFFEVVEIIGIGDX
          :||  ::  | :| : |
g075      LFQCRAKSVFIAVIFTGX
                 130
```

The following partial DNA sequence was identified in *N. meningitidis* <SEQ ID 239>:

```
a075.seq
   1 ATGCCGTCTT ACTTCATCAC TCTCTTAACG ATGGAAAAGA CAAAAAGCGC

  51 GGCGAAAACG CCCACTACAA TCCAACCGGC TTCCATACCG TCCGCTTTTG

 101 CGGCTTCCAA AGCGTTTTTT GCTGTATCGG GCAACGTTGC ATTTGCATGT

 151 GCGGCCAAAG CCAGGGGAGC AGCTGTTACA ACAGCCAGTT TTGCGCCGTA

 201 TTTACGGCAG GTGTTAATAA ATTTCATGAT ATTTTCCTTC AAAAAGTGTT

 251 TGGCGGTAAT GGATGGAGCG TTTTTCAGAC GACCGCCGAA CATCCGAAAA
```

-continued

```
301 TCAGTCTTTC AAAAATCCGA ATACGACAAA TTCGTATTGG TTGCCGATTT

351 CTTCCAAACC TGCGTTAATC GCTTCTTCGA AGTCGTAGAA ATAATCGGCA

401 TTGGTGATTA A
```

This corresponds to the amino acid sequence <SEQ ID 240; ORF 075.a>:

```
a075.pep
  1 MPSYFITLLT MEKTKSAAKT PTTIQPASIP SAFAASKAFF AVSGNVAFAC

 51 AAKARGAAVT TASFAPYLRQ VLINFMIFSF KKCLAVMDGA FFRRPPNIRK

101 SVFQKSEYDK FVLVADFFQT CVNRFFEVVE IIGIGD*
```

m075/a075 98.5% identity over a 136 aa overlap

```
                   10        20        30        40        50        60
m075.pep MPSYFITLLTMENTKSAAKMPTTIQPASIPSAFAASKAFFAVSGNVAFACAAKARGAAVT
         ||||||||||||:|||||| ||||||||||||||||||||||||||||||||||||||||
a075     MPSYFITLLTMEKTKSAAKTPTTIQPASIPSAFAASKAFFAVSGNVAFACAAKARGAAVT
                   10        20        30        40        50        60
                    70        80        90       100       110       120
m075.pep  TASFAPYLRQVLINFMIFSFKKCLAVMDGAFFRRPPNIRKSVFQKSEYDKFVLVADFFQT
          ||||||||||||||||||||||||||||||||||||||||||||||||||||||||||||
a075      TASFAPYLRQVLINFMIFSFKKCLAVMDGAFFRRPPNIRKSVFQKSEYDKFVLVADFFQT
                    70        80        90       100       110       120
                   130
m075.pep  CVNRFFEVVEIIGIGDX
          ||||||||||||||||
a075      CVNRFFEVVEIIGIGDX
                   130
```

The following partial DNA sequence was identified in *N. gonorrhoeae* <SEQ ID 241>:

```
g080.seq
  1 ATGTGGGATA ATGCCGAAGC GATGGAACGG CTGACGCGCT GGCTGCTTGT

 51 CATGATGGCG ATGCTGCTTG CTGCGTCCGG GCTGGTTTGG TTTTACAATT

101 CGAATCATCT GCCCGTCAAG CAGGTGTCGC TGAAGGGCAA CCTGGTTTAT

151 TCCGATAAGA AGGCATTGGG CAGTTTGGCG AAAGAATACA TCCATGGGAA

201 TATTTTGAGG ACGGACATCA ATGGCGCACA GGAAGCCTAC CGCCGGTATC

251 CGTGGATTGC GTCGGTCATG GTGCGCCGCC GTTTTCCCGA TACGGTTGAG

301 GTCGTCCTGA CCGAGCGCAA GCCGGTTGCA CGTTGGGGCG ACCATGCCTT

351 GGTGGACGGC GAAGGCAATG TTTTTGAAGC CCGCTTGGAC AGACCCGGAA

401 TGCCGGTATT CAGAGGCGCG GAAGGAACGT CTGCCGAAAT GCTCCGCCGT

451 TATGACGAAT TTTCGACTGT TTTGGCAAAA CAGGGTTTGG GCATCAAAGA

501 GATGACCTAT ACGGCACGTT CGGCGTGGAA TGTCGTTTTG GACAACGGCA

551 TCACCGTCAG GCTCGGACGG GAAAAcgaGA TGAAACGCCT CCgGCTTTTT

601 ACcgAAGCGT GGCAGCATCT gttgcGTAAG AATAAAAATC GGTTATCCTA

651 TGTGGATATG Aggtataagg acggatttTC agtcccccat gctCCCGACG

701 GTTTACCCGA AAAAGAATcc gAAGAATatt gggaacaggt ttgggacata

751 ttacggcctg gcgtcggaaa cggttcgacg caaatttcaa tcagttatAA

801 GGGCAGacga acaatggaac AGcagtaa
```

This corresponds to the amino acid sequence <SEQ ID 242; ORF 080.ng>:

```
g080.pep
   1 MWDNAEAMER LTRWLLVMMA MLLAASGLVW FYNSNHLPVK QVSLKGNLVY

  51 SDKKALGSLA KEYIHGNILR TDINGAQEAY RRYPWIASVM VRRRFPDTVE

 101 VVLTERKPVA RWGDHALVDG EGNVFEARLD RPGMPVFRGA EGTSAEMLRR

 151 YDEFSTVLAK QGLGIKEMTY TARSAWNVVL DNGITVRLGR ENEMKRLRLF

 201 TEAWQHLLRK NKNRLSYVDM RYKDGFSVPH APDGLPEKES EEYWEQVWDI

 251 LRPGVGNGST QISISYKGRR TMEQQ*
```

The following partial DNA sequence was identified in *N. meningitidis* <SEQ ID 243>:

```
m080.seq
   1 ATGTGGGATA ATGCCGAAGC GATGGAACGG CTGACGCGCT GGCTGCTTGT

  51 CATGATGGCG ATGCTGCTTG CTGCGTCCGG GCTGGTTTGG TTTTACAATT

 101 CGAATCATCT GCCCGTCAAG CAGGTGTCGC TGAAGGGCAA CCTGGTTTAT

 151 TCCGATAAGA AGACATTGGG CAGTTTGGCG AAAGAATACA TCCATGGGAA

 201 TATTTTGAGG ACGGACATCA ATGGCGCACA GGAGGCCTAC CGCCGGTATC

 251 CGTGGATTGC GTCGGTCATG GTGCGCCGCC GTTTTCCCGA CACGGTTGAG

 301 GTCGTCCTGA CCGAGCGCAA GCCGGTCGCG CGTTGGGGCG ACCATGCCTT

 351 GGTGGACGGC GAAGGCAATG TTTTTGAAGC CCGCTTGGAC AGACCCGGAA

 401 TGCCGGTATT CAGAGGCGCG GAAGGAACGT CTGCCGAAAT GCTCCGCCGT

 451 TATGACGAAT TTTCGACTGT TTTGGCAAAA CAGGGTTTGG GCATCAAAGA

 501 GATGACCTAT ACGGCACGTT CGGCGTGGAT TGTCGTTTTG GACAACGGCA

 551 TCACCGTCAG GCTCGGACGG GAAAACGAGA TGAAACGCCT CCGGCTTTTT

 601 ACCGAAGCGT GGCAGCATCT GTTGCGTAAA AATAAAAATC GGTTATCCTA

 651 TGTGGATATG AGGTATAAGG ACGGATTTTC AGTCCGCTAT GCTTCCGACG

 701 GTTTACCCGA AAAAGAATCC GAAGAATAG
```

This corresponds to the amino acid sequence <SEQ ID 2441; ORF 080>:

```
m080.pep
   1 MWDNAEAMER LTRWLLVMMA MLLAASGLVW FYNSNHLPVK QVSLKGNLVY

  51 SDKKTLGSLA KEYIHGNILR TDINGAQEAY RRYPWIASVM VRRRFPDTVE

 101 VVLTERKPVA RWGDHALVDG EGNVFEARLD RPGMPVFRGA EGTSAEMLRR

 151 YDEFSTVLAK QGLGIKEMTY TARSAWIVVL DNGITVRLGR ENEMKRLRLF

 201 TEAWQHLLRK NKNRLSYVDM RYKDGFSVRY ASDGLPEKES EE*
```

Computer analysis of this amino acid sequence gave the following results:

Homology with a Predicted ORF from *N. gonorrhoeae*

ORF 080 shows 97.9% identity over a 242 aa overlap with a predicted ORF (ORF 080.ng) from *N. gonorrhoeae*:

```
m080/g080

                  10         20         30         40         50         60
m080.pep   MWDNAEAMERLTRWLLVMMAMLLAASGLVWFYNSNHLPVKQVSLKGNLVYSDKKTLGSLA
           ||||||||||||||||||||||||||||||||||||||||||||||||||||||:|||||
080        MWDNAEAMERLTRWLLVMMAMLLAASGLVWFYNSNHLPVKQVSLKGNLVYSDKKALGSLA
                  10         20         30         40         50         60

                  70         80         90        100        110        120
m080.pep   KEYIHGNILRTDINGAQEAYRRYPWIASVMVRRRFPDTVEVVLTERKPVARWGDHALVDG
           ||||||||||||||||||||||||||||||||||||||||||||||||||||||||||||
080        KEYIHGNILRTDINGAQEAYRRYPWIASVMVRRRFPDTVEVVLTERKPVARWGDHALVDG
                  70         80         90        100        110        120

                 130        140        150        160        170        180
m080.pep   EGNVFEARLDRPGMPVFRGAEGTSAEMLRRYDEFSTVLAKQGLGIKEMTYTARSAWIVVL
           |||||||||||||||||||||||||||||||||||||||||||||||||||||||| |||
080        EGNVFEARLDRPGMPVFRGAEGTSAEMLRRYDEFSTVLAKQGLGIKEMTYTARSAWNVVL
                 130        140        150        160        170        180

                 190        200        210        220        230        240
m080.pep   DNGITVRLGRENEMKRLRLFTEAWQHLLRKNKNRLSYVDMRYKDGFSVRYASDGLPEKES
           |||||||||||||||||||||||||||||||||||||||||||||||| :| ||||||||
080        DNGITVRLGRENEMKRLRLFTEAWQHLLRKNKNRLSYVDMRYKDGFSVPHAPDGLPEKES
                 190        200        210        220        230        240

m080.pep   EEX
           ||
080        EEYWEQVWDILRPGVGNGSTQISISYKGRRTMEQQX
                 250        260        270
```

The following partial DNA sequence was identified in *N. meningitidis* <SEQ ID 245>:

```
a080.seq
   1  ATGTGGGATA ATGCCGAAGC GATGGAACGG CTGACGCGCT GGCTGCTTGT

  51  CATGATGGCG ATGCTGCTTG CTGCGTCCGG GCTGGTTTGG TTTTACAATT

 101  CGAATCATCT GCCCGTCAAG CAGGTGTCGC TGAAGGGCAA CCTAGTTTAT

 151  TCCGATAAGA AAGCATTGGG CAGTTTGGCG AAAGAATACA TCCATGGGAA

 201  TATTTTGAGG ACGGACATCA ATGGCGCACA GGAGGCCTAC CGCCGGTATC

 251  CGTGGATTGC GTCGGTCATG GTGCGCCGCC GTTTTCCCGA CACGGTTGAG

 301  GTCGTCCTGA CCGAGCGCAA GCCGGTCGCG CGTTGGGGCG ACCATGCCTT

 351  GGTGGACGGC GAAGGCAATG TTTTTGAAGC CCGTTTGGAC AGACCCGGAA

 401  TGCCGGTATT CAGAGGCGCG GAAGGAACGT CTGCCGAAAT GCTCCGCCGT

 451  TATGACGAAT TTTCGACTGT TTTGGCAAAA CAGGGTTTGG GCATCAAAGA

 501  GATGACCTAT ACGGCACGTT CGGCGTGGAT TGTCGTTTTG GACAACGGCA

 551  TCACCGTCAG GCTCGGACGG GAAAACGAGA TGAAACGCCT CCGGCTTTTT

 601  ACCGAAGCGT GGCAACATCT GTTGCGTAAA AATAAAAATC GGTTATCCTA

 651  TGTGGATATG AGGTATAAGG ACGGATTTTC AGTCCGCTAT GCTCCCGACG

 701  GTTTACCCGA AAAAGAATCC GAAGAATAG
```

This corresponds to the amino acid sequence <SEQ ID 246; ORF 080.a>:

```
a080.pep
   1  MWDNAEAMER LTRWLLVMMA MLLAASGLVW FYNSNHLPVK QVSLKGNLVY
```

-continued

```
 51  SDKKALGSLA KEYIHGNILR TDINGAQEAY RRYPWIASVM VRRRFPDTVE

101  VVLTERKPVA RWGDHALVDG EGNVFEARLD RPGMPVFRGA EGTSAEMLRR

151  YDEFSTVLAK QGLGIKEMTY TARSAWIVVL DNGITVRLGR ENEMKRLRLF

201  TEAWQHLLRK NKNRLSYVDM RYKDGFSVRY APDGLPEKES EE*
```

m080/a080 99.2% identity over a 242 aa overlap

```
                  10        20        30        40        50        60
m080.pep  MWDNAEAMERLTRWLLVMMAMLLAASGLVWFYNSNHLPVKQVSLKGNLVYSDKKTLGSLA
          ||||||||||||||||||||||||||||||||||||||||||||||||||||||:|||||
a080      MWDNAEAMERLTRWLLVMMAMLLAASGLVWFYNSNHLPVKQVSLKGNLVYSDKKALGSLA
                  10        20        30        40        50        60
                  70        80        90       100       110       120
m080.pep  KEYIHGNILRTDINGAQEAYRRYPWIASVMVRRRFPDTVEVVLTERKPVARWGDHALVDG
          ||||||||||||||||||||||||||||||||||||||||||||||||||||||||||||
a080      KEYIHGNILRTDINGAQEAYRRYPWIASVMVRRRFPDTVEVVLTERKPVARWGDHALVDG
                  70        80        90       100       110       120
                 130       140       150       160       170       180
m080.pep  EGNVFEARLDRPGMPVFRGAEGTSAEMLRRYDEFSTVLAKQGLGIKEMTYTARSAWIVVL
          ||||||||||||||||||||||||||||||||||||||||||||||||||||||||||||
a080      EGNVFEARLDRPGMPVFRGAEGTSAEMLRRYDEFSTVLAKQGLGIKEMTYTARSAWIVVL
                 130       140       150       160       170       180
                 190       200       210       220       230       240
m080.pep  DNGITVRLGRENEMKRLRLFTEAWQHLLRKNKNRLSYVDMRYKDGFSVRYASDGLPEKES
          |||||||||||||||||||||||||||||||||||||||||||||||||||| |||||||
a080      DNGITVRLGRENEMKRLRLFTEAWQHLLRKNKNRLSYVDMRYKDGFSVRYAPDGLPEKES
                 190       200       210       220       230       240
m080.pep  EEX
          |||
a080      EEX
```

The following partial DNA sequence was identified in *N. gonorrhoeae* <SEQ ID 247>:

```
g081.seq
  1  ATGAAACCAC TGGACCTAAA TTTCATCTGC CAAGGCTTCA AGCTTCCGAT

 51  GCCGTCTGAA AACAAACCCG TGTCGCGCAT CGTAACCGAC AGCCGCGATA

101  TTCGGGAAGG CGATGTGTTT TTCGCATTGG CGGGCGGGCG GTTTGACGCG

151  CATGATTTTG TTGGAGGCGT ATTGTCTGCG GGCGCGGCGG CGGTTGTGGT

201  TTCGCGCGAA GATTGCGCGG CTTTGGGCGG CGCGTTGAAA GTCGATGACA

251  CGCTTGCCGC GTTGCAAACG TTGGCGAAGG CGTGGCGCGA TAATGTGAAC

301  CCGTTTGTGT TCGGCATTAC CGGTTCGGGC GGCAAGACGA CGGTGAAGGA

351  GATGCTGGCT GCGGTATTGC GCCGCCGTTT CGGCGATGAT GCCGTTTCGG

401  CGACGGCAGG CAACTTCAAC AACCACAtcg gaTTGCCGCT GACTTTATTG

451  AAATtaaAcg aAAAACACCG CTATGCCGTG ATTGAAATGG GCATGAACCA

501  TTTTGGcgaa ctggcggtTt taacgcaaaT CGCCAAACCC GATGCCGCTT

551  TGGtcaACAA CGCCCTGCGC GCCCATGTCG GATGCGGTTt cgacggagtg

601  GGCGATATTG CCAAAGcgaa aagcGAGATT TatgcagGct tATGTTCAGA

651  CGGCATGGCA CTGATTCCTC AAGAAGATGC CAATATGGCT GTCTTCAAAA

701  CGGCAACGTT TAATTTGAAT ACGTGCACTT TCGGCGTCGA TAGCGGCGAT

751  GTCCGCGCGG AAAATATCGT GCTGAAACCT TTGTCGTGCG AATTTGATTT

801  GGTGTGCGGC GACGAGCGCA CTGCCGTGGT GCTGCCTGTT CCCGGCCGCC

851  ACAATGTCCA CAACGCCGCC GCTGCCGCCG CGCTGGCTTT GGCTGCCGGT
```

-continued

901 TTGAGTTTGA ACGATGTGGC GGAAGGTTTG CAAGGCTTCA GCAACATCAA

951 AGGCCGTCTG AACGTCAAAG CCGGCATCAA GGGCGCAACC CTGATTGACG

1001 ATACTTATAA TGCGAATCCC GACAGTATGA AAGCCGCGGT TGACGTGTTG

1051 GCGCGTATGC CTGCGCCGCG CATTTTCGTG ATGGGCGATA TGGGCGAACT

1101 GGGCGAGGAc gaAGCCGCCG CCATGCACGC CGAagtcgGC GCGTACGCCC

1151 GCGACCAAGG CATCGAAGCG GCTTATTTTG TCGGCGACAA CAGCGTCGAA

1201 GCGGcggaAA AATTTGGCGC GGACGGTTTG TGGTTCGCCG CCAAAGACCC

1251 GTTGATTCAA GTGTTGAGCC ACGATTTGCC CGAACGCGCC ACCGTGTTGG

1301 TGAAAGGTTC GCGCTTTATG CAGAtggAAG AAGTGGTCGA GGCATTGGAG

1351 GATAAGTga

This corresponds to the amino acid sequence <SEQ ID 248; ORF 081.ng>:

g081.pep

1 MKPLDLNFIC QALKLPMPSE NKPVSRIVTD SRDIREGDVF FALAGGRFDA

51 HDFVGGVLSA GAAAVVVSRE DCAALGGALK VDDTLAALQT LAKAWRDNVN

101 PFVFGITGSG GKTTVKEMLA AVLRRRFGDD AVSATAGNFN NHIGLPLTLL

151 KLNEKHRYAV IEMGMNHFGE LAVLTQIAKP DAALVNNALR AHVGCGFDGV

201 GDIAKAKSEI YAGLCSDGMA LIPQEDANMA VFKTATFNLN TCTFGVDSGD

251 VRAENIVLKP LSCEFDLVCG DERTAVVLPV PGRHNVHNAA AAAALALAAG

301 LSLNDVAEGL QGFSNIKGRL NVKAGIKGAT LIDDTYNANP DSMKAAVDVL

351 ARMPAPRIFV MGDMGELGED EAAAMHAEVG AYARDQGIEA AYFVGDNSVE

401 AAEKFGADGL WFAAKDPLIQ VLSHDLPERA TVLVKGSRFM QMEEVVEALE

451 DK*

The following partial DNA sequence was identified in *N. meningitidis* <SEQ ID 249>:

m081.seq

1 ATGAAACCAC TGGACCTAAA TTTCATCTGC CAAGCCCTCA AGCTTCCGAT

51 GCCGTCTGAA AGCAAACCCG TGTCGCGCAT CGTAACCGAC AGCCGCGACA

101 TCCGCGCGGG CGATGTGTTT TTCGCATTGG CGGGCGAGCG GTTTGACGCG

151 CATGATTTTG TTGAAGACGT ATTGGCTGCT GGTGCGGCGG CGGTTGTGGT

201 TTCGCGCGAA GATTGTGCTG CAATGGATGG CGCGTTGAAA GTCGATGACA

251 CGCTTGCCGC ATTGCAAACG CTGGCAAAGG CGTGGCGTGA AAATGTGAAT

301 CCGTTTGTGT TCGGCATTAC CGGTTCGGGC GGCAAGACGA CGGTGAAGGA

351 AATGCTGGCT GCGGTATTGC GCCgCCGTTT CGGCGATGAT GCCGTGTTGG

401 CGACGGCAGG CAACTTCAAC AACCATATCG GATTGCCGCT GACTTTGTTG

451 AAGTTAAACG AAAAACACCG CTATGCCGTG ATTGAAATGG GCATGAACCA

501 TTTCGGCGAA CTGGCGGTTT TAACGCAmAT CGCCAAACCA AATGCCGCAT

551 TGGTCAACAA CGCCATGCGC GCCCATGTCG GCTGCGGTTT CGACGGAGTG

601 GGCGATATTG CCAAAGCGAA AAGCGAGATT TACCAAGGTT TATGTTCAGA

651 CGGCATTGCA CTGATTCCTC AAGAAGATGC CAATATGGCT GTCTTCAAAA

-continued

```
 701 CGGCAACGCT TAATTTGAAT ACGCGCACTT TCGGCATCGA TAGCGGCGAT

 751 GTTCACGCGG AAAATATTGT GCTGAAACCG TTGTCGTGCG AATTTGATTT

 801 GGTGTGCGGC GATGAGCGCG CCGCCGTGGT GCTGCCTGTT CCCGGCCGCC

 851 ACAATGTCCA CAACGCCGCC GCTGCCGCCG CGCTGGCTTT GGCTGCGGGT

 901 TTGAGTTTGA ACGATGTGGC GGAAGGTTTG AAAGGCTTCA GCAATATCAA

 951 AGGCCGTCTG AACGTCAAAT CCGGAATCAA GGGCGCAACC CTGATTGACG

1001 ATACTTATAA TGCGAACCCT GACAGCATGA AAGCTGCGAT TGACGTGTTG

1051 GCGCGTATGC CTGCGCCGCG TATTTTCGTG ATGGGCGATA TGGGCGAACT

1101 GGGCGAACTG GGCGAGGACG AAGCCGCCGC TATGCACGCC GAAGTCGGCG

1151 CGTATGCCCG CGACCAAGGC ATCGAAGCGG CTTATTTTGT CGGCGACAAC

1201 AGCGTCGAAG CGGCGGAAAA ATTTGGCGCG GACGGTTTGT GGTTCGCCGC

1251 CAAAGACCCG TTGATTCAAG TGTTGCGCCA CGATTTGCCC GAACGCGCCA

1301 CCGTGTTGGT GAAAGGTTCG CGCTTTATGC AGATGGAAGA AGTGGTCGAG

1351 GCATTGGAGG ATAAGTGA
```

This corresponds to the amino acid sequence <SEQ ID 250; ORF 081>:

```
m081.pep
  1  MKPLDLNFIC QALKLPMPSE SKPVSRIVTD SRDIRAGDVF FALAGERFDA

 51  HDFVEDVLAA GAAAVVVSRE DCAAMDGALK VDDTLAALQT LAKAWRENVN

101  PFVFGITGSG GKTTVKEMLA AVLRRRFGDD AVLATAGNFN NHIGLPLTLL

151  KLNEKHRYAV IEMGMNHFGE LAVLTXIAKP NAALVNNAMR AHVGCGFDGV

201  GDIAKAKSEI YQGLCSDGIA LIPQEDANMA VFKTATLNLN TRTFGIDSGD

251  VHAENIVLKP LSCEFDLVCG DERAAVVLPV PGRHNVHNAA AAAALALAAG

301  LSLNDVAEGL KGFSNIKGRL NVKSGIKGAT LIDDTYNANP DSMKAAIDVL

351  ARMPAPRIFV MGDMGELGEL GEDEAAAMHA EVGAYARDQG IEAAYFVGDN

401  SVEAAEKFGA DGLWFAAKDP LIQVLRHDLP ERATVLVKGS RFMQMEEVVE

451  ALEDK*
```

Computer analysis of this amino acid sequence gave the following results:

Homology with a Predicted ORF from *N. gonorrhoeae*

ORF 081 shows 94.1% identity over a 455 aa overlap with a predicted ORF (ORF 081.ng) from *N. gonorrhoeae*:

```
m081/g081

                  10        20        30        40        50        60
m081.pep MKPLDLNFICQALKLPMPSESKPVSRIVTDSRDIRAGDVFFALAGERFDAHDFVEDVLAA
         ||||||||||||||||||||:|||||||||||||| ||||||||| ||||||||  ||:|
g081     MKPLDLNFICQALKLPMPSENKPVSRIVTDSRDIREGDVFFALAGGRFDAHDFVGGVLSA
                  10        20        30        40        50        60

                  70        80        90       100       110       120
m081.pep GAAAVVVSREDCAAMDGALKVDDTLAALQTLAKAWRENVNPFVFGITGSGGKTTVKEMLA
         ||||||||||||||: ||||||||||||||||||||:|||||||||||||||||||||||
g081     GAAAVVVSREDCAALGGALKVDDTLAALQTLAKAWRDNVNPFVFGITGSGGKTTVKEMLA
                  70        80        90       100       110       120
```

-continued

```
                      130       140       150       160       170       180
m081.pep AVLRRRFGDDAVLATAGNFNNHIGLPLTLLKLNEKHRYAVIEMGMNHFGELAVLTXIAKP
         |||||||||||| |||||||||||||||||||||||||||||||||||||||||| ||||
g081     AVLRRRFGDDAVSATAGNFNNHIGLPLTLLKLNEKHRYAVIEMGMNHFGELAVLTQIAKP
                      130       140       150       160       170       180

                      190       200       210       220       230       240
m081.pep NAALVNNAMRAHVGCGFDGVGDIAKAKSEIYQGLCSDGIALIPQEDANMAVFKTATLNLN
         :|||||||:|||||||||||||||||||||| ||||||:|||||||||||||||||:|||
g081     DAALVNNALRAHVGCGFDGVGDIAKAKSEIYAGLCSDGMALIPQEDANMAVFKTATFNLN
                      190       200       210       220       230       240

                      190       200       210       220       230       240
m081.pep TRTFGIDSGDVHAENIVLKPLSCEFDLVCGDERAAVVLPVPGRHNVHNAAAAAALALAAG
         | |||:|||||:|||||||||||||||||||||:||||||||||||||||||||||||||
g081     TCTFGVDSGDVRAENIVLKPLSCEFDLVCGDERTAVVLPVPGRHNVHNAAAAAALALAAG
                      190       200       210       220       230       240

                      310       320       330       340       350       360
m081.pep LSLNDVAEGLKGFSNIKGRLNVKSGIKGATLIDDTYNANPDSMKAAIDVLARMPAPRIFV
         ||||||||||:||||||||||||:||||||||||||||||||||||:|||||||||||||
g081     LSLNDVAEGLQGFSNIKGRLNVKAGIKGATLIDDTYNANPDSMKAAVDVLARMPAPRIFV
                      310       320       330       340       350       360

                      370       380       390       400       410       420
m081.pep MGDMGELGELGEDEAAAMHAEVGAYARDQGIEAAYFVGDNSVEAAEKFGADGLWFAAKDP
         |||||||||   |||||||||||||||||||||||||||||||||||||||||||||||
g081     MGDMGELGE---DEAAAMHAEVGAYARDQGIEAAYFVGDNSVEAAEKFGADGLWFAAKDP
                      370       380       390       400       410       420

                      430       440       450
m081.pep LIQVLRHDLPERATVLVKGSRFMQMEEVVEALEDKX
         ||||| ||||||||||||||||||||||||||||||
g081     LIQVLSHDLPERATVLVKGSRFMQMEEVVEALEDKX
                      430       440       450
```

The following partial DNA sequence was identified in *N. meningitidis* <SEQ ID 251>:

```
a081.seq
   1  ATGAAACCAC TGGACCTAAA TTTCATCTGC CAAGCCCTCA AGCTTCCGAT

  51  GCCGTCTGAA AGCAAACCCG TGTCGCGCAT CGTAACCGAC AGCCGCGACA

 101  TCCGCGCGGG CGATGTGTTT TTCGCATTGG CGGGCGGGCG GTTTGATGCG

 151  CATGATTTTG TTGAAGACGT ATTGGCTGCG GGTGCGGCGG CGGTTGTGGT

 201  TTCGCGCGAA GATTGCGTTG CAATGGATGG CGCGTTGAAA GTCGATGACA

 251  CGCTTACCGC GTTGCAAATG TTGGCGAAGG CGTGGCGCGA GAATGTGAAC

 301  CCGTTTGTGT TCGGTATTAC CGGCTCGGGC GGCAAGACGA CGGTGAAGGA

 351  AATGTTGGCT GCGGTATTGC GCCGCCGTTT CGGCGATAAT GCCGTTTTGG

 401  CGACGGCAGG CAACTTCAAC AACCACATCG GATTGCCGTT GACTTTGTTG

 451  AAATTAAACG AAAAACACCG CTATGCCGTG ATTGAAATGG GTATGAACCA

 501  TTTTGGCGAA CTGGCGGTTT TGACACAAAT CGCCAAACCC GATGCCGCAT

 551  TGGTCAACAA CGCCATGCGC GCCCATGTCG GCTGCGGTTT CGACGGAGTG

 601  GGCGATATTG CCAAAGCGAA AAGCGAGATT TATCAAGGCT TATGTTCAGA

 651  CGGCATGGCG CTGATTCCTC AAGAAGATGC CAATATGGCT GTCTTCAAAA

 701  CGGCAACGCT TAATTTGAAT ACGCGCACTT TCGGCATCGA TAGCGGCGAT

 751  GTCCACGCGG AAAATATCGT GCTGAAACCG TTGTCGTGCG AATTTGATTT

 801  GGTGTGCGGC AACGAGTGCG CAGCCGTGGT TCTGCCCGTT CCCGGCCGCC

 851  ACAATGTCCA CAACGCCGCC GCCGCCGCCG CGCTGTCTTT GGCTGCAGGT

 901  TTGAGTTTGA ACGATGTGGC GGAAGGTTTG AAAGGCTTCA GCAATATCAA

 951  AGGCCGTCTG AACGTCAAAT CCGGAATCAA GGGCGCAACC CTGATTGACG

1001  ATACTTATAA TGCGAACCCT GACAGCATGA AAGCTGCGGT TGACGTGTTG
```

-continued

```
1051  GCGCGTATGC  CTGCGCCGCG  TATTTTCGTG  ATGGGCGATA  TGGGCGAACT

1101  GGGTGAGGAC  GAAGCCGCCG  CCATGCACGC  CGAAGTCGGC  GCGTACGCCC

1151  GCGACCAAGG  CATCGAAGCG  GCTTATTTTG  TCGGCGACAA  CAGCGTCGAA

1201  GCGGCGGAAA  AATTTGGCGC  GGACGGTTTG  TGGTTCGCCG  CCAAAGACCC

1251  GTTGATTCAA  GTGTTGCGCC  ACGATTTGCC  CGAACGCGCC  ACCGTGTTGG

1301  TGAAAGGTTC  GCGCTTTATG  CAGATGGAAG  AAGTGGTCGA  GGCATTGGAG

1351  GATAAGTGA
```

This corresponds to the amino acid sequence <SEQ ID 252; ORF 081.a>:

```
a081.pep
   1  MKPLDLNFIC  QALKLPMPSE  SKPVSRIVTD  SRDIRAGDVF  FALAGGRFDA

  51  HDFVEDVLAA  GAAAVVVSRE  DCVAMDGALK  VDDTLTALQM  LAKAWRENVN

 101  PFVFGITGSG  GKTTVKEMLA  AVLRRRFGDN  AVLATAGNFN  NHIGLPLTLL

 151  KLNEKHRYAV  IEMGMNHFGE  LAVLTQIAKP  DAALVNNAMR  AHVGCGFDGV

 201  GDIAKAKSEI  YQGLCSDGMA  LIPQEDANMA  VFKTATLNLN  TRTFGIDSGD

 251  VHAENIVLKP  LSCEFDLVCG  NECAAVVLPV  PGRHNVHNAA  AAALSLAAG

 301  LSLNDVAEGL  KGFSNIKGRL  NVKSGIKGAT  LIDDTYNANP  DSMKAAVDVL

 351  ARMPAPRIFV  MGDMGELGED  EAAAMHAEVG  AYARDQGIEA  AYFVGDNSVE

 401  AAEKFGADGL  WFAAKDPLIQ  VLRHDLPERA  TVLVKGSRFM  QMEEVVEALE

 451  DK*
```

m081/a081 96.7% identity over a 455 aa overlap

```
                    10        20        30        40        50        60
m081.pep    MKPLDLNFICQALKLPMPSESKPVSRIVTDSRDIRAGDVFFALAGERFDAHDFVEDVLAA
            ||||||||||||||||||||||||||||||||||||||||||||| ||||||||||||||
a081        MKPLDLNFICQALKLPMPSESKPVSRIVTDSRDIRAGDVFFALAGGRFDAHDFVEDVLAA
                    10        20        30        40        50        60

                    70        80        90       100       110       120
m081.pep    GAAAVVVSREDCAAMDGALKVDDTLAALQTLAKAWRENVNPFVFGITGSGGKTTVKEMLA
            ||||||||||||:||||||||||||:||| ||||||||||||||| ||||||||||||||
a081        GAAAVVVSREDCVAMDGALKVDDTLTALQMLAKAWRENVNPFVFGITGSGGKTTVKEMLA
                    70        80        90       100       110       120

                   130       140       150       160       170       180
m081.pep    AVLRRRFGDDAVLATAGNFNNHIGLPLTLLKLNEKHRYAVIEMGMNGFGELAVLTXIAKP
            |||||||||:||||||||||||||||||| ||||||||||||||||||||||||| ||||
a081        AVLRRRFGDNAVLATAGNFNNHIGLPLTLLKLNEKHRYAVIEMGMNHFGELAVLTQIAKP
                   130       140       150       160       170       180

                   190       200       210       220       230       240
m081.pep    NAALVNNAMRAHVGCGFDGVGDIAKAKSEIYQGLCSDGIALIPQEDANMAVFKTATLNLN
            :|||||||||||||||||||||||||||||||||||||:|||||||||||||||||||||
a081        DAALVNNAMRAHVGCGFDGVGDIAKAKSEIYQGLCSDGMALIPQEDANMAVFKTATLNLN
                   190       200       210       220       230       240

                   250       260       270       280       290       300
m081.pep    TRTFGIDSGDVHAENIVLKPLSCEFDLVCGDERAAVVLPVPGRHNVHNAAAAAALALAAG
            ||||||||||||||||||||||||||||||:| ||||||||||||||||||||||:||||
a081        TRTFGIDSGDVHAENIVLKPLSCEFDLVCGNECAAVVLPVPGRHNVHNAAAAAALSLAAG
                   250       260       270       280       290       300

                   310       320       330       340       350       360
m081.pep    LSLNDVAEGLKGFSNIKGRLNVKSGIKGATLIDDTYNANPDSMKAAIDVLARMPAPRIFV
            ||||||||||||||||||||||||||||||||||||||||||||||:|||||||||||||
a081        LSLNDVAEGLKGFSNIKGRLNVKSGIKGATLIDDTYNANPDSMKAAVDVLARMPAPRIFV
                   310       320       330       340       350       360

                   370       380       390       400       410       420
m081.pep    MGDMGELGELGEDEAAAMHAEVGAYARDQGIEAAYFVGDNSVEAAEKFGADGLWFAAKDP
            ||||||||||||||||||||||||||||||||||||||||||||||||||||||||||||
a081        MGDMGELGE---DEAAAMHAEVGAYARDQGIEAAYFVGDNSVEAAEKFGADGLWFAAKDP
                       370       380       390       400       410
```

-continued

```
                  430        440        450
m081.pep LIQVLRHDLPERATVLVKGSRFMQMEEVVEALEDKX
         ||||||||||||||||||||||||||||||||||||
a081     LIQVLRHDLPERATVLVKGSRFMQMEEVVEALEDKX
         420        430        440        450
```

The following partial DNA sequence was identified in *N. gonorrhoeae* <SEQ ID 253>:

```
g082.seq
   1  aTGTGGTTGT TGAAGTTGCC TGCCGTCGCC GAAACGGCAT CATCGCCGAA
  51  ACGGCGGCGC AATACCGCAG CCAGCATCTC CTTCACCGTC GTCTTGCCGC
 101  CCGAACCGGT AATGCCGAAC ACAAACGGGT TCACATTATC GCGCCACGCC
 151  TTCGCCAACG TTTGCAACGC GGCAAGCGTG TCATCGACTT TCAACGCGCC
 201  GCCCAAAGCC GCGCAATCTT CGCGCGAAAC CACAACCGCC GCCGCGCCCG
 251  CAGACAATAC GCCTCCAACA AAATCATGCG CGTCAAACCG CCCGCCCGCC
 301  AATGCGAAAA ACACATCGCC TTCCCGAATA TCGCGGCTGT CGGTTACGAT
 351  GCGCGACACG GGTTTGTTTT CAGACGGCAT CGGAAGCTTG AGGGCTTGGC
 401  AGATGAAATT TAGGTCCAGT GGTTTCATAT TTGCTTTCGT TAATATTCGG
 451  GCGGCGGACA CATCGGTAGC GGCTGATTTT TTTATCGCCT GTTTTGCTGT
 501  GGTAAAACAC AGATTATTTT CCCATTCTCA TTCGGCATTT TTTCTGTACG
 551  TATCATTTTT TAGACGTATT TTTAGCCGAT TTGCCTTTTC CCGCATACCA
 601  CGGCGCGGGG TCGTCGGACT GTCTGTCGAT AAAGGCAAGG TTATTGCCTT
 651  CGCCCGGCAC ATCGGGGACA TTCCCCCAAA AATCATAGCC GTCATCGGGC
 701  AACTCGTCGG TTTCGATACC CGTCCAACTG CCGAATCCGC GTAA
```

This corresponds to the amino acid sequence <SEQ ID 254; ORF 082.ng>:

```
g082.pep
   1  MWLLKLPAVA ETASSPKRRR NTAASISFTV VLPPEPVMPN TNGFTLSRHA
  51  FANVCNAASV SSTFNAPPKA AQSSRETTTA AAPADNTPPT KSCASNRPPA
 101  NAKNTSPSRI SRLSVTMRDT GLFSDGIGSL RAWQMKFRSS GFIFAFVNIR
 151  AADTSVAADF FIACFAVVKH RLFSHSHSAF FLYVSFFRRI FSRFAFSRIP
 201  RRGVVGLSVD KGKVIAFARH IGDIPPKIIA VIGQLVGFDT RPTAESA*
```

The following partial DNA sequence was identified in *N. meningitidis* <SEQ ID 255>:

```
m082.seq
   1  ATGnnGTTGT TGAAGTTGCC TGCCGTCGCC AACACGGCAT CATCGCCGAA
  51  ACGGcGGCGC AATACCGCAG CCAGCATTTC CTTCACCGTC GTCTTGCCGC
 101  CCGAACCGGT AATGCCGAAC ACAAACGGAT TCACATTTTC ACGCCACGCC
 151  TTTGCCAGCG TTTGCAATGC GGCAAGCGTG TCATCGACTT TCAACGCGCC
 201  ATCCATTGCA GCACAATCTT CGCGCGAAAC CACAACCGCC GCCGCACCAG
 251  CAGCCAATAC GTCTTCAACA AAATCATGCG CGTCAAACCG CTCGCCCGCC
 301  AATGCGAAAA ACACATCGCC CGCGCGGATG TCGCGGCTGT CGGTTACGAT
 351  GCGCGACACG GGTTTGCTTT CAGACGGCAT CGGAAGCTTG AGGGCTTGGC
```

-continued

```
401  AGATGAAATT TAGGTCCAGT GGTTTCATAT TTACTTTCGT TAATATTCGG

451  GCGGCGGACA CATCGGTAGC GGCTGATTTT TTTATCGCCT GTTTTGCTGT

501  GGTAAAACAC AGATTATTTT CCCATTCTCA TTCGGsATTT TTTCTGTACG

551  TATCATTTTT TAGACGTATT TTTAGTCGAT TTGCCTTTTC CCGCATACCA

601  CGGCGCGGGG TCGTCGGGCA GTCCGTCGAT AAAGGCAAGG TTATTGCCTT

651  CGCCCTGCAC ATCGGGAACA TTCCCCCAAA AATCATAGCC GTCATCGGGC

701  AACTCGTCGG TTTCGATACC CGTCCAACTG CCGAATCCGC GTAA
```

This corresponds to the amino acid sequence <SEQ ID 256; ORF 082>:

```
m082.pep
  1  MXLLKLPAVA NTASSPKRRR NTAASISFTV VLPPEPVMPN TNGFTFSRHA

 51  FASVCNAASV SSTFNAPSIA AQSSRETTTA AAPAANTSST KSCASNRSPA

101  NAKNTSPARM SRLSVTMRDT GLLSDGIGSL RAWQMKFRSS GFIFTFVNIR

151  AADTSVAADF FIACFAVVKH RLFSHSHSXF FLYVSFFRRI FSRFAFSRIP

201  RRGVVGQSVD KGKVIAFALH IGNIPPKIIA VIGQLVGFDT RPTAESA*
```

Computer analysis of this amino acid sequence gave the following results:

Homology with a Predicted ORF from *N. gonorrhoeae*

ORF 082 shows 92.7% identity over a 247 aa overlap with a predicted ORF (ORF 082.ng) from *N. gonorrhoeae*:

```
m082/g082

                   10         20         30         40         50         60
m082.pep  MXLLKLPAVANTASSPKRRRNTAASISFTVVLPPEPVMPNTNGFTFSRHAFASVCNAASV
          | |||||||:||||||||||||||||||||||||||||||||||:||||||:|||||||
g082      MWLLKLPAVAETASSPKRRRNTAASISFTVVLPPEPVMPNTNGFTLSRHAFANVCNAASV
                   10         20         30         40         50         60

                   70         80         90        100        110        120
m082.pep  SSTFNAPSIAAQSSRETTTAAAPAANTSSTKSCASNRSPANAKNTSPARMSRLSVTMRDT
          |||||||  |||||||||||||| ||  |||||||| |||||||||:|:||||||||||
g082      SSTFNAPPKAAQSSRETTTAAAPADNTPPTKSCASNRPPANAKNTSPSRISRLSVTMRDT
                   70         80         90        100        110        120

                  130        140        150        600        170        180
m082.pep  GLLSDGIGSLRAWQMKFRSSGFIFTFVNIRAADTSVAADFFIACFAVVKHRLFSHSHSXF
          ||:||||||||||||||||||||:|||||||||||||||||||||||||||||||||| |
g082      GLFSDGIGSLRAWQMKFRSSGFIFAFVNIRAADTSVAADFFIACFAVVKHRLFSHSHSAF
                  130        140        150        600        170        180

                  190        200        210        220        230        240
m082.pep  FLYVSFFRRIFSRFAFSRIPRRGVVGQSVDKGKVIAFALHIGNIPPKIIAVIGQLVGFDT
          |||||||||||||||||||||||||| ||||||||||| |||:|||||||||||||||||
g082      FLYVSFFRRIFSRFAFSRIPRRGVVGLSVDKGKVIAFARHIGDIPPKIIAVIGQLVGFDT
                  190        200        210        220        230        240

m082.pep  RPTAESAX
          ||||||||
g082      RPTAESAX
```

The following partial DNA sequence was identified in *N. meningitidis* <SEQ ID 257>:

```
a082.seq
  1  ATGTGGTTGT TGAAGTTGCC TGCCGTCGCC AAAACGGCAT TATCGCCGAA

 51  ACGGCGGCGC AATACCGCAG CCAACATTTC CTTCACCGTC GTCTTGCCGC

101  CCGAGCCGGT AATACCGAAC ACAAACGGGT TCACATTCTC GCGCCACGCC

151  TTCGCCAACA TTTGCAACGC GGTAAGCGTG TCATCGACTT TCAACGCGCC
```

-continued

```
201  ATCCATTGCA ACGCAATCTT CGCGCGAAAC CACAACCGCC GCCGCACCCG

251  CAGCCAATAC GTCTTCAACA AAATCATGCG CATCAAACCG CCCGCCCGCC

301  AATGCGAAAA ACACATCGCC CGCGCGGATG TCGCGGCTGT CGGTTACGAT

351  GCGCGACACG GGTTTGCTTT CAGACGGCAT CGGAAGCTTG AGGGCTTGGC

401  AGATGAAATT TAGGTCCAGT GGTTTCATAT TTACTTTCGT TAATATTCGG

451  GCGGCGGACA CATCGGTAGC GGCTGATTTT TTTATCGCCT GTTTTGCTGT

501  GGTAAAACAC AGATTATTTT CCCATTCTCA TTCGGCATTT TTTCTGTACG

551  TATCATTTTT TAGACGTATT TTTAGTCGAT TTGCCTTTTC CCGCATACCA

601  CGGCGCGGGG TCGTCGGGCA GTCCGTCGAT AAAGGCAAGG TTATTGCCTT

651  CGCCCTGCAC ATCGGGAACA TTCCCCCAAA AATCATAGCC GTCATCGGGC

701  AACTCGTCGG TTTCGATACC CGTCCAACTG CCGAATCCGC GTAA
```

This corresponds to the amino acid sequence <SEQ ID 258; ORF 082.a>:

```
a082.pep
   1  MWLLKLPAVA KTALSPKRRR NTAANISFTV VLPPEPVIPN TNGFTFSRHA

  51  FANICNAVSV SSTFNAPSIA TQSSRETTTA AAPAANTSST KSCASNRPPA

 101  NAKNTSPARM SRLSVTMRDT GLLSDGIGSL RAWQMKFRSS GFIFTFVNIR

 151  AADTSVAADF FIACFAVVKH RLFSHSHSAF FLYVSFFRRI FSRFAFSRIP

 201  RRGVVGQSVD KGKVIAFALH IGNIPPKIIA VIGQLVGFDT RPTAESA*
```

m082/a082 95.5% identity over a 247 aa overlap

```
                    10        20        30        40        50        60
m082.pep    MXLLKLPAVANTASSPKRRRNTAASISFTVVLPPEPVMPNTNGFTFSRHAFASVCNAASV
            | ||||||||:|| ||||||||||:||||||||||||:||||||||||||||::|||:||
a082        MWLLKLPAVAKTALSPKRRRNTAANISFTVVLPPEPVIPNTNGFTFSRHAFANICNAVSV
                    10        20        30        40        50        60

                    70        80        90       100       110       120
m082.pep    SSTFNAPSIAAQSSRETTTAAAPAANTSSTKSCASNRSPANAKNTSPARMSRLSVTMRDT
            ||||||||||:|||  ||||||||:|||||||||||| ||||||||||||||||||||||
a082        SSTFNAPSIATQSSRETTTAAAPAANTSSTKSCASNRPPANAKNTSPARMSRLSVTMRDT
                    70        80        90       100       110       120

                   130       140       150       160       170       180
m082.pep    GLLSDGIGSLRAWQMKFRSSGFIFTFVNIRAADTSVAADFFIACFAVVKHRLFSHSHSXF
            ||||||||||||||||||||||||||||||||||||||||||||||||||||||||||||
a082        GLLSDGIGSLRAWQMKFRSSGFIFTFVNIRAADTSVAADFFIACFAVVKHRLFSHSHSAF
                   130       140       150       160       170       180

                   190       200       210       220       230       240
m082.pep    FLYVSFFRRIFSRFAFSRIPRRGVVGQSVDKGKVIAFALHIGNIPPKIIAVIGQLVGFDT
            ||||||||||||||||||||||||||||||||||||||||||||||||||||||||||||
a082        FLYVSFFRRIFSRFAFSRIPRRGVVGQSVDKGKVIAFALHIGNIPPKIIAVIGQLVGFDT
                   190       200       210       220       230       240

m082.pep    RPTAESAX
            ||||||||
a082        RPTAESAX
```

The following partial DNA sequence was identified in *N. gonorrhoeae* <SEQ ID 259>:

```
g084.seq
   1  ATGAAacaAT CCGcccgaat aAAAAATATG GATCAGACAT TAAAAAATAc

  51  attgggcatt tGCGCGcttt tagcctTTTG TTTTggcgcG gccaTCGCAT

 101  CAGGTTATCA CTTGGAATAT GAATACGGCT ACCGTTATTC TGCCGTGGGC
```

-continued

151 GCTTTGGCTT CGGTTGTATT TTTATTATTA TTGGCACGCG GCTTCCCGCG

201 CGTTTCTTCA GTTGTTTTAC TGATTTACGT CGGCACAACC GCCCTATATT

251 TGCCGGTCGG CTGGCTGTAT GGTGCGCCTT CTTATCAGAT AGTCGGTTCG

301 ATATTGGAAA GCAATCCTGC CGAGGCGCGT GAATTTGTCG GCAATCTTCC

351 CGGGTCGCTT TATTTTGTGC AGGCATTATT TTTCATTTTT GGCTTGACAG

401 TTTGGAAATA TTGTGTATCT GTGGGGGTAT TTGCTGACGT AAAAAACTAT

451 AAACGTCGCA GCAAAATATG GCTGACCATA TTATTGACTT TGATTTTGTC

501 CTGCGCGGTG ATGGAGAAAA TCGccggcga taaAGATTGG CGAGaacctg 551 atgccggcct gttgttgaat ATTTTcgacc tgtattaCga cttggctttc 601 cgcgccggca cAATATGCCG CCAAGCGCGC CCAcattttg gaagCagcaa 651 aaaaaacatC AACATGGCAt atccaccaac ttacacccaa aTAtaa This corresponds to the amino acid sequence <SEQ ID 260; ORF 084.ng>:

g084.pep
1 MKQSARIKNM DQILKNTLGI CALLAFCFGA AIASGYHLEY EYGYRYSAVG

51 ALASVVFLLL LARGFPRVSS VVLLIYVGTT ALYLPVGWLY GAPSYQIVGS

101 ILESNPAEAR EFVGNLPGSL YFVQALFFIF GLTVWKYCVS VGVFADVKNY

151 KRRSKIWLTI LLTLILSCAV MEKIAGDKDW REPDAGLLLN IFDLYYDLAF

201 RAGTICRQAR PHFGSSKKSV NMAYPPTCAQ V*

The following partial DNA sequence was identified in *N. meningitidis* <SEQ ID 261>:

m084.seq
1 ATGAAACAAT CCGCCcGAAT AAAa.ATATG AATCAGACAT TACTTTATAC

51 ATTGGGCATT TGCGCGCTTT TAACCTTTnn nnnnnnnnnn nnnnnnnnnn 101 nnnnnTATCA CCCnGAATAT GAATACGGCT ACCGTTATTC TGCCGTGGGT

151 GCTTTGGCTT CGGTTGTATT TTTATTATTA TTGGCACGCG GTTTCCCGCG

201 CGTTTCTTCA GTTGTTTTAC TGATTTACGT CGGCACAACC GCCCTATATT

251 TGCCGGTCGG CTGGCTGTAT GGTGCGCCGT CTTATCAGAT AGTCGGTTCG

301 ATATTGGAAA GCAATCCTGC CGAGGCGCGT GAATTTGTCG GCAATCTTCC

351 CGGGTCGCTT TATTTTGTGC AGGCATTATT TTTCATTTTT GGCTTGACAG

401 TTTGGAAATA TTGTGTATCG GGGGGGGTAT TTGCTGACGT AAAAAACTAT

451 AAACGCCGCA GCAAAATATG GCTGACTATA TTATTGACTT TGATTTTGTC

501 CTGCGCGGTG ATGGATAAAA TCGCCAGCGA TAAAGATTTG CGAGAACCTG

551 ATGCCGGCCT GTTGTTGAAT ATTTTCGACC TGTATTACGA TTTGGCT.TC

601 CGCGCCGGCA CAATATGCCG CCAAGCGCGC CCACATTTTG GAAGCAGCAA

651 AAAAAGCGTC AACATGGCAT ATCCGTCATG TTGCGCCCAA GTATAA

This corresponds to the amino acid sequence <SEQ ID 262; ORF 084>:

m084.pep
1 MKQSARIKXM NQTLLYTLGI CALLTFXXXX XXXXXYHPEY EYGYRYSAVG

-continued

```
 51 ALASVVFLLL LARGFPRVSS VVLLIYVGTT ALYLPVGWLY GAPSYQIVGS

101 ILESNPAEAR EFVGNLPGSL YFVQALFFIF GLTVWKYCVS GGVFADVKNY

151 KRRSKIWLTI LLTLILSCAV MDKIASDKDL REPDAGLLLN IFDLYYDLAX

201 RAGTICRQAR PHFGSSKKSV NMAYPSCCAQ V*
```

Computer analysis of this amino acid sequence gave the following results:

Homology with a Predicted ORF from *N. gonorrhoeae*

ORF 084 shows 90.5% identity over a 231 aa overlap with a predicted ORF (ORF 084.ng) from *N. gonorrhoeae*:

```
m084/g084

                    10        20                  30        40        50
m084.pep  MKQSARIKXMNQTLLYTLGICALLTF---------YHPEYEYGYRYSAVGALASVVFLLL
          |||||||| |:|||  ||||||||:|         || ||||||||||||||||||||||
g084      MKQSARIKNMDQTLKNTLGICALLAFCFGAAIASGYHLEYEYGYRYSAVGALASVVFLLL
                    10        20        30        40        50        60

                    60        70        80        90       100       110
m084.pep  LARGFPRVSSVVLLIYVGTTALYLPVGWLYGAPSYQIVGSILESNPAEAREFVGNLPGSL
          ||||||||||||||||||||||||||||||||||||||||||||||||||||||||||||
g084      LARGFPRVSSVVLLIYVGTTALYLPVGWLYGAPSYQIVGSILESNPAEAREFVGNLPGSL
                    70        80        90       100       110       120

                   120       130       140       150       160       170
m084.pep  YFVQALFFIFGLTVWKYCVSGGVFADVKNYKRRSKIWLTILLTLILSCAVMDKIASDKDL
          |||||||||||||||||||| ||||||||||||||||||||||||||||||:|||:||| 
g084      YFVQALFFIFGLTVWKYCVSVGVFADVKNYKRRSKIWLTILLTLILSCAVMEKIAGDKDW
                   130       140       150       160       170       180

                   180       190       200       210       220
m084.pep  REPDAGLLLNIFDLYYDLAXRAGTICRQARPHFGSSKKSVNMAYPSCCAQVX
          ||||||||||||||||||| |||||||||||||||||||||||||  |||||
g084      REPDAGLLLNIFDLYYDLAFRAGTICRQARPHFGSSKKSVNMAYPPTCAQVX
                   190       200       210       220       230
```

The following partial DNA sequence was identified in *N. meningitidis* <SEQ ID 263>:

```
a084.seq
  1 ATGAAACAAT CCGCCCGAAT AAAAAATATG GATCAGACAT TAAAAAATAC

 51 ATTGGGCATT TGCGCGCTTT TAGCCTTTTG TTTTGGCGCG GCCATCGCAT

101 CAGGTTATCA CTTGGAATAT GAATACGGCT ACCGTTATTC TGCCGTGGGT

151 GCTTTGGCTT CGGTTGTATT TTTATTATTA TTGGCACGCG GTTTCCCGCG

201 CGTTTCTTCA GTTGTTTTAC TGATTTACGT CGGCACAACC GCCCTATATT

251 TGCCGGTCGG CTGGCTGTAT GGTGCGCCGT CTTATCAGAT AGTCGGTTCG

301 ATATTGGAAA GCAATCCTGC CGAGGCGCGT GAATTTGTCG GCAATCTTCC

351 CGGGTCGCTT TATTTTGTGC AGGCATTATT TTTCATTTTT GGCTTGACAG

401 TTTGGAGATA TTGTGTATCG GGGGGGGTAT TTGCTGACGT AAAAAACTAT

451 AAACGCCGCA GCAAAATATG GCTGACTATA TTATTGACTT TGATTTTGTC

501 CTGCGCGGTG ATGGATAAAA TCGCCAGCGA TAAAGATTTG CGAGAACCTG

551 ATGCCGGCCT GTTGTTGAAT ATTTTCGACC TGTATTACGA TTTGGCTTCC

601 .GCGCCGGCA CAATATGCCG CCAAGCGCGC CCACATTTTG GAAGCAGCAA

651 AAAAAGCGTC AACATGGCAT ATCCGTCATG TTGCGCCCAA GTATAA
```

This corresponds to the amino acid sequence <SEQ ID 264; ORF 084.a>:

```
a084.pep
  1 MKQSARIKNM DQTLKNTLGI CALLAFCFGA AIASGYHLEY EYGYRYSAVG

 51 ALASVVFLLL LARGFPRVSS VVLLIYVGTT ALYLPVGWLY GAPSYQIVGS

101 ILESNPAEAR EFVGNLPGSL YFVQALFFIF GLTVWRYCVS GGVFADVKNY

151 KRRSKIWLTI LLTLILSCAV MDKIASDKDL REPDAGLLLN IFDLYYDLAS

201 XAGTICRQAR PHFGSSKKSV NMAYPSCCAQ V*
```

m084/a084 92.2% identity over a 231 aa overlap

```
                   10        20        30        40        50        60
m084.pep  MKQSARIKXMNQTLLYTLGICALLTFXXXXXXXXXYHPEYEYGYRYSAVGALASVVFLLL
          |||||||| |:|||   ||||||||:|         || |||||||||||||||||||||
a084      MKQSARIKNMDQTLKNTLGICALLAFCFGAAIASGYHLEYEYGYRYSAVGALASVVFLLL
                   10        20        30        40        50        60

                   70        80        90       100       110       120
m084.pep  LARGFPRVSSVVLLIYVGTTALYLPVGWLYGAPSYQIVGSILESNPAEAREFVGNLPGSL
          |||||||| |:|||   ||||||||:|         || |||||||||||||||||||||
a084      LARGFPRVSSVVLLIYVGTTALYLPVGWLYGAPSYQIVGSILESNPAEAREFVGNLPGSL
                   70        80        90       100       110       120

                  130       140       150       160       170       180
m084.pep  YFVQALFFIFGLTVWKYCVSGGVFADVKNYKRRSKIWLTILLTLILSCAVMDKIASDKDL
          ||||||||||||||||:|||||||||||||||||||||||||||||||||||||||||||
a084      YFVQALFFIFGLTVWRYCVSGGVFADVKNYKRRSKIWLTILLTLILSCAVMDKIASDKDL
                  130       140       150       160       170       180

                  190       200       210       220       230
m084.pep  REPDAGLLLNIFDLYYDLAXRAGTICRQARPHFGSSKKSVNMAYPSCCAQVX
          ||||||||||||||||||||||||||||||||||||||||||||||||||||
a084      REPDAGLLLNIFDLYYDLASXAGTICRQARPHFGSSKKSVNMAYPSCCAQVX
                  190       200       210       220       230
```

The following partial DNA sequence was identified in *N. gonorrhoeae* <SEQ ID 265>:

```
g085.seq
  1 ATGGGCAAAG GGCAGGACTT CACGCCCCTG CGCGACGCGT TGAAAGATAA

 51 GGCAAAAGGC GTGTTCCTGA TCGGCGTCGA TGCGCCGCAA ATCCGCCGCG

101 ATTTGGACGG CTGCGGCTTG AACCTGACCG ACTGCGTCAC TTTGGAAGAG

151 GCGGTTCAGA CGGCATACGC CCAAGCCGAA GCGGGCGATA TTGTCTTGCT

201 CAGCCCCGCC TGCGCGAGTT TCGATATGTT TAAAGGCTAC GCGCACCGTT

251 CGGAAGTGTT tatCGAAGCG TTTAAGGCTT TGTGA
```

This corresponds to the amino acid sequence <SEQ ID 266; ORF 085.ng>:

```
g085.pep
  1 MGKGQDFTPL RDALKDKAKG VFLIGVDAPQ IRRDLDGCGL NLTDCVTLEE

 51 AVQTAYAQAE AGDIVLLSPA CASFDMFKGY AHRSEVFIEA FKAL*
```

The following partial DNA sequence was identified in *N. meningitidis* <SEQ ID 267>:

```
m085.seq
  1 ATGGGTAAAG GGCAGGACTT CACGCCCCTG CGCGATGCAC TGGTAGGCAA

 51 GGCAAAAGGC GTGTTCTTGA TTGGTGTCGA TGCGCCGCAA ATCCGCCGCG

101 ATTTGGACGG CTGCGGCTTG AATATGACCG ACTGCGCCAC TTTGGGAGAA
```

-continued

```
151 GCCGTTCAGA CGGCATATGC CCAAGCCGAA GCAGGCGATA TTGTGTTGCT

201 CAGCCCCGCC TGCGCGAGCT TTGATATGTT CAAAGGCTAC GCGCACCGTT

251 CGGAAGTGTT TATCGAAGCG TTTAAGGCTT TGTGA
```

This corresponds to the amino acid sequence <SEQ ID 268; ORF 085>:

```
m085.pep
  1 MGKGQDFTPL RDALVGKAKG VFLIGVDAPQ IRRDLDGCGL NMTDCATLGE

 51 AVQTAYAQAE AGDIVLLSPA CASFDMFKGY AHRSEVFIEA FKAL*
```

Computer analysis of this amino acid sequence gave the following results:

Homology with a Predicted ORF from *N. gonorrhoeae*

ORF 085 shows 94.7% identity over a 94 aa overlap with a predicted ORF (ORF 085.ng) from *N. gonorrhoeae*:

```
m085/g085

                    10        20        30        40        50        60
m085.pep   MGKGQDFTPLRDALVGKAKGVFLIGVDAPQIRRDLDGCGLNMTDCATLGEAVQTAYAQAE
           |||||||||||||  ||||||||||||||||||||||||||:|||:|| |||||||||||
g085       MGKGQDFTPLRDALKDKAKGVFLIGVDAPQIRRDLDGCGLNLTDCVTLEEAVQTAYAQAE
                    10        20        30        40        50        60

                    70        80        90
m085.pep   AGDIVLLSPACASFDMFKGYAHRSEVFIEAFKALX
           ||||||||||||||||||||||||||||||||||
g085       AGDIVLLSPACASFDMFKGYAHRSEVFIEAFKALX
                    70        80        90
```

The following partial DNA sequence was identified in *N. meningitidis* <SEQ ID 269>:

```
a085.seq
  1 ATGGGCAAAG GGCAGGACTT CACGCCCCTG CGCGACGCGC TTGCCGGCAA

 51 GGCAAAAGGC GTGTTCCTGA TCGGTGTCGA TGCGCCGCAA ATCCGCCGCG

101 ATTTGGACGG CTGCGATCTG AATATGACCG ACTGCGCCAC TTTGGAAGAA

151 GCGGTTCAGA AGGCATATGC CCAAGCCGAA GCGGGCGATA TCGTGCTGCT

201 CAGCCCCGCC TGCGCGAGTT TCGATATGTT TAAAGGCTAC GCGCACCGTT

251 CGGAAGTGTT TATCGGGGCG TTTAAGGCTT TGTGA
```

This corresponds to the amino acid sequence <SEQ ID 270; ORF 085.a>:

```
a085.pep
  1 MGKGQDFTPL RDALAGKAKG VFLIGVDAPQ IRRDLDGCDL NMTDCATLEE

 51 AVQKAYAQAE AGDIVLLSPA CASFDMFKGY AHRSEVFIGA FKAL*
```

m085/a085 94.7% identity over a 94 aa overlap

```
                    10        20        30        40        50        60
m085.pep   MGKGQDFTPLRDALVGKAKGVFLIGVDAPQIRRDLDGCGLNMTDCATLGEAVQTAYAQAE
           ||||||||||||||:|||||||||||||||||||||| |||||||||| |||| ||||||
a085       MGKGQDFTPLRDALAGKAKGVFLIGVDAPQIRRDLDGCDLNMTDCATLEEAVQKAYAQAE
                    10        20        30        40        50        60
```

-continued

```
                 70         80         90
m085.pep   AGDIVLLSPACASFDMFKGYAHRSEVFIEAFKALX
           ||||||||||||||||||||||||||||| ||||||
a085       AGDIVLLSPACASFDMFKGYAHRSEVFIGAFKALX
                 70         80         90
```

The following partial DNA sequence was identified in *N. gonorrhoeae* <SEQ ID 271>:

```
g086.seq
   1 ATGGTGGTGC TGATGACGGC GTTCGGCCTG CTGATGATTT ATTCGGCTTC
  51 TGTGTATTTG GCATCGAAGG AAGGCGGCGA TCAGTTTTTC TATTTGACCA
 101 GGCAGGCGGG GTTCGTCGTT GCCGGCCTTA TAGCGAGCGG TTTTTTATGG
 151 TTTCTTTGCA GGATGAGGAC ATGGCGGCGG CTTGTGCCGT GGATTTTTGC
 201 CTTATCCGGC CTGTTGCTGG TAGCCGTATT GATTGCCGGG CGCGAAATCA
 251 ATGGCGCGAC CCGTTGGATA CCTTTGGGTC CGTTGAATTT CCAGCCGACC
 301 GAGCTGTTCA AGCTGGCAGT CATCCTTTAT TTGGCAAGCC TGTTCACGCG
 351 CCGTGAAGAA GTGTTGCGCA GCATGGAAAG TTTGGGTTGG CAGTCGATTT
 401 GGCGGGGGAC GGCCAACCTG ATTATGTCCG CCACCAATCC GCAGGCACGT
 451 CGTGAAACAT TAGAAATGTA CGgcCGTTTC CGGGCGATCA TCCTGCCGAT
 501 TATGCTGGTG GCGTTCGGTT TGGTGCTGAT AATGGTACAG CCGGATTTCG
 551 GTTCGTTTGT CGTCATTACC GTCATTACCG TTGGAATGCT GTTTCTGGCA
 601 GGATTGCCGT GGAAATATTT TTTTGTCCTG GTAGGCAGCG TCTTGGGTGG
 651 GATGGTGCTG ATGATTACCG CCGCTCCCTA CCGTGTGCAG CGGGTAGTGG
 701 CATTTTTGGA CCCGTGGAAA GACCCGCAGG GTGCCGGCTA CCAGCTTACC
 751 CACTCTCTGA TGGCAATCGG GCGCGGAGAG TGGTTCGGTA TGGGTTTGGG
 801 TGCGAGTTTG AGCAAACGCG GCTTTCTGCC GGAAGCGCAT ACCGATTTTA
 851 TTTTTGCCAT CATCGCTGAA GAATTCGGCT TCTTCGGGAT GTGCGTGCTG
 901 ATATTCTGTT ACGGCTGGCT GGTGGTGCGG GCGTTTTCCA TCGGCAAGCA
 951 GTCGCGCGAT TTGGGtttgA CTTTCAACGC CTATATCGCT TCGGGTATCG
1001 GCATTTGGAT CGGTATCCAA AGTTTCTTCA ATATCGGTGT GAACATCGGT
1051 GCTTTGCCGA CCAAAGGTCT GACGctgCcg tTGATGTCCT ATGGcggTTC
1101 GTCAGTCTTT TTCATGCTGA TCAGCATGAT GCTGCTGTTG CGTATCGATT
1151 ATGATTACCG CCAGAAAATG CGCGGTTACC GGGTGGAGTA AA
```

This corresponds to the amino acid sequence <SEQ ID 272; ORF 086.ng>:

```
g086.pep
   1 MVVLMTAFGL LMIYSASVYL ASKEGGDQFF YLTRQAGFVV AGLIASGFLW
  51 FLCRMRTWRR LVPWIFALSG LLLVAVLIAG REINGATRWI PLGPLNFQPT
 101 ELFKLAVILY LASLFTRREE VLRSMESLGW QSIWRGTANL IMSATNPQAR
 151 RETLEMYGRF RAIILPIMLV AFGLVLIMVQ PDFGSFVVIT VITVGMLFLA
 201 GLPWKYFFVL VGSVLGGMVL MITAAPYRVQ RVVAFLDPWK DPQGAGYQLT
 251 HSLMAIGRGE WFGMGLGASL SKRGFLPEAH TDFIFAIIAE EFGFFGMCVL
```

-continued

301 IFCYGWLVVR AFSIGKQSRD LGLTFNAYIA SGIGIWIGIQ SFFNIGVNIG

351 ALPTKGLTLP LMSYGGSSVF FMLISMMLLL RIDYENRQKM RGYRVE*

The following partial DNA sequence was identified in *N. meningitidis* <SEQ ID 273>:

m086.seq

1 ATGGTGGTGC TGATGACGGC GTTCAGCCTG CTGATGATTT ATTCGGCTTC

51 TGTGTATTTG GCATCAAAAG AAGGCGGCGA TCAGTTTTTC TATTTGACCA

101 GACAGGCGGG GTTCGTCGTT GCCGGCTTGA TAGCGAGCGG TTTGTTATGG

151 TTTCTTTGCA GGATGAGGAC ATGGCGGCGG CTTGTGCCGT GGATTTTTGC

201 CCTATCCGGC CTGTTGCTGG TAGTCGTATT GATTGCCGGG CGCGAAATCA

251 ATGGCGCGAC CCGTTGGATA CCTTTGGGTC CGTTGAATTT CCAGCCGACc

301 GAGCTGTTCA AGCtGGCGGT CATCCTTTAT TTGGCAAGCC TGTTCACGCG

351 CCGTGAAGAA GTGTTGcGCA GCATGGAAAG TTTGGGTTGG CAGTCGATTT

401 GGCGGGGGAC GGCCAATCTG ATCATGTCCG CCACCAATCC GCAGrCACGT

451 CGTGAaACAT TAGAAATGTA CGGCCGTwTC CGGGCGATCA TCCTGCCGAT

501 TATGCTGGTG GCGTTCGGTT TGGTGCTGAT AATGGTACAG CCGGATTTCG

551 GTTCGTTTGT CGTCATTACC GTCATTGCCG TTGGAATGCT GTTTTTGGCA

601 GGATTGCCGT GGAAATATTT TTTCGTCCTG GTAGGCAGCG TCTTGGGCGG

651 GATGGTGCTG ATGATTACCG CCGCTCCCTA CCGTGTGCAG CGGGTAGTGG

701 CATTTTTGGA CCCGTGGAAA GACCCGCAGG GTGCCGGCTA CCAGCTTACC

751 CACTCTCTGA TGGCAATCGG GCGCGGAGAG TGGTTCGGTA TGGGTTTGGG

801 TGCGAGTTTG AGCAAACGCG GCTTTCTGCC GGAAGCGCAT ACCGATTTTA

851 TTTTTGCCAT CATCGCCGAA GAATTCGGTT TCTTCGGTAT GTGCGTGCTG

901 ATATTCTGTT ACGGCTGGCT GGTGGTGCGG GCGTTTTCCA TCGGCAAGCA

951 GTCGCGCGAT TTGGGTTTGA CTTTCAACGC CTATATCGCT TCGGGTATCG

1001 GCATTTGGAT CGGGkrTCCAA AGTTTCTTCA ATATCGGTGT GAACATCGGT

1051 GCTTTGCCGA mCAAAgGyCT GACGCyGCCG Tg.AtGTCCw ATGGCGGTTC

1101 GTCAGTCTTT TTCATGCTGA TCAGCATGAT GCTGCTGTkG CGTATAGATT

1151 ATGAAAACCG CCGGAAAATG CGCGGTTATC GGGTGGAGTA A

This corresponds to the amino acid sequence <SEQ ID 274; ORF 086>:

m086.pep

1 MVVLMTAFSL LMIYSASVYL ASKEGGDQFF YLTRQAGFVV AGLIASGLLW

51 FLCRMRTWRR LVPWIFALSG LLLVVVLIAG REINGATRWI PLGPLNFQPT

101 ELFKLAVILY LASLFTRREE VLRSMESLGW QSIWRGTANL IMSATNPQXR

151 RETLEMYGRX RAIILPIMLV AFGLVLIMVQ PDFGSFVVIT VIAVGMLFLA

201 GLPWKYFFVL VGSVLGGMVL MITAAPYRVQ RVVAFLDPWK DPQGAGYQLT

251 HSLMAIGRGE WFGMGLGASL SKRGFLPEAH TDFIFAIIAE EFGFFGMCVL

301 IFCYGWLVVR AFSIGKQSRD LGLTFNAYIA SGIGIWIGXQ SFFNIGVNIG

351 ALPXKGLTXP XMSXGGSSVF FMLISMMLLX RIDYENRRKM RGYRVE*

Computer analysis of this amino acid sequence gave the following results:

Homology with a Predicted ORF from *N. gonorrhoeae*

ORF 086 shows 96.7% identity over a 396 aa overlap with a predicted ORF (ORF 086.ng) from *N. gonorrhoeae*:

```
m086/g086

                 10        20        30        40        50        60
m086.pep MVVLMTAFSLLMIYSASVYLASKEGGDQFFYLTRQAGFVVAGLIASGLLWFLCRMRTWRR
         ||||||||:||||||||||||||||||||||||||||||||||||||:||||||||||||
g086     MVVLMTAFGLLMIYSASVYLASKEGGDQFFYLTRQAGFVVAGLIASGFLWFLCRMRTWRR
                 10        20        30        40        50        60

                 70        80        90       100       110       120
m086.pep LVPWIFALSGLLLVVVLIAGREINGATRWIPLGPLNFQPTELFKLAVILYLASLFTRREE
         |||||||||||||:||||||||||||||||||||||||||||||||||||||||||||||
g086     LVPWIFALSGLLLVAVLIAGREINGATRWIPLGPLNFQPTELFKLAVILYLASLFTRREE
                 70        80        90       100       110       120

                130       140       150       160       170       180
m086.pep VLRSMESLGWQSIWRGTANLIMSATNPQXRRETLEMYGRXRAIILPIMLVAFGLVLIMVQ
         |||||||||||||||||||||||||||| |||||||||| ||||||||||||||||||||
g086     VLRSMESLGWQSIWRGTANLIMSATNPQARRETLEMYGRFRAIILPIMLVAFGLVLIMVQ
                130       140       150       160       170       180

                190       200       210       220       230       240
m086.pep PDFGSFVVITVIAVGMLFLAGLPWKYFFVLVGSVLGGMVLMITAAPYRVQRVVAFLDPWK
         ||||||||||||:|||||||||||||||||||||||||||||||||||||||||||||||
g086     PDFGSFVVITVITVGMLFLAGLPWKYFFVLVGSVLGGMVLMITAAPYRVQRVVAFLDPWK
                190       200       210       220       230       240

                250       260       270       280       290       300
m086.pep DPQGAGYQLTHSLMAIGRGEWFGMGLGASLSKRGFLPEAHTDFIFAIIAEEFGFFGMCVL
         ||||||||||||||||||||||||||||||||||||||||||||||||||||||||||||
g086     DPQGAGYQLTHSLMAIGRGEWFGMGLGASLSKRGFLPEAHTDFIFAIIAEEFGFFGMCVL
                250       260       270       280       290       300

                310       320       330       340       350       360
m086.pep IFCYGWLVVRAFSIGKQSRDLGLTFNAYIASGIGIWIGXQSFFNIGVNIGALPXKGLTXP
         |||||||||||||||||||||||||||||||||||||| ||||||||||||||:|||| |
g086     IFCYGWLVVRAFSIGKQSRDLGLTFNAYIASGIGIWIGIQSFFNIGVNIGALPTKGLTLP
                310       320       330       340       350       360

                370       380       390
m086.pep XMSXGGSSVFFMLISMMLLXRIDYENRRKMRGYRVEX
          || ||||||||||||||| |||||||:|||||||||
g086     LMSYGGSSVFFMLISMMLLLRIDYENRQKMRGYRVEX
                370       380       390
```

The following partial DNA sequence was identified in *N. meningitidis* <SEQ ID 275>:

```
a086.seq
     1 ATGGTGGTGC TGATGACGGC GTTCAGCCTG CTGATGATTT ATTCGGCTTC

    51 TGTGTATTTG GCATCAAAAG AAGGCGGCGA TCAGTTTTTC TATTTGACCA

   101 GACAGGCGGG GTTCGTCGTT GCCGGCTTGA TAGCGAGCGG TTTGTTATGG

   151 TTTCTTTGCA GGATGAGGAC ATGGCGGCGG CTTGTGCCGT GGATTTTTGC

   201 CCTATCCGGC CTGTTGCTGG TAGTCGTATT GATTGCCGGG CGCGAAATCA

   251 ATGGCGCGAC CCGTTGGATA CCTTTGGGTC CGTTGAATTT CCAGCCGACC

   301 GAGCTGTTCA AGCTGGCGGT CATCCTTTAT TTGGCAAGCC TGTTCACGCG

   351 CCGTGAAGAA GTGTTGCGCA GCATGGAAAG TTTGGGTTGG CAGTCGATTT

   401 GGCGGGGGAC GGCCAATCTG ATCATGTCCG CCACCAATCC GCAGGCACGT

   451 CGTGAAACAT TAGAAATGTA CGGCCGTTTC CGGGCGATCA TCCTGCCGAT

   501 TATGCTGGTG GCGTTCGGTT TGGTGCTGAT AATGGTACAG CCGGATTTCG

   551 GTTCGTTTGT CGTCATTACC GTCATTGCCG TTGGAATGCT GTTTTTGGCA

   601 GGATTGCCGT GGAAATATTT TTTCGTCCTG GTAGGCAGCG TCTTGGGCGG

   651 GATGGTGCTG ATGATTACCG CCGCTCCCTA CCGTGTGCAG CGGGTAGTGG
```

-continued

```
 701 CATTTTTGGA CCCGTGGAAA GACCCGCAGG GTGCCGGCTA CCAGCTTACC

 751 CACTCTCTGA TGGCAATCGG GCGCGGAGAG TGGTTCGGTA TGGGTTTGGG

 801 TGCGAGTTTG AGCAAACGCG GCTTTCTGCC GGAAGCGCAT ACCGATTTTA

 851 TTTTTGCCAT CATCGCCGAA GAATTCGGTT TCTTCGGTAT GTGCGTGCTG

 901 ATATTCTGTT ACGGCTGGCT GGTGGTGCGG GCGTTTTCCA TCGGCAAGCA

 951 GTCGCGCGAT TTGGGTTTGA CTTTCAACGC CTATATCGCT TCGGGTATCG

1001 GCATTTGGAT CGGTATCCAA AGTTTCTTCA ATATCGGTGT GAACATCGGT

1051 GCTTTGCCGA CCAAAGGTCT GACGCTGCCG TTGATGTCCT ATGGCGGTTC

1101 GTCAGTCTTT TTCATGCTGA TCAGCATGAT GCTGCTGTTG CGTATAGATT

1151 ATGAAAACCG CCGGAAAATG CGCGGTTACC GGGTGGAGTA A
```

This corresponds to the amino acid sequence <SEQ ID 276; ORF 086.a>:

```
a086.pep
  1  MVVLMTAFSL LMIYSASVYL ASKEGGDQFF YLTRQAGFVV AGLIASGLLW

 51  FLCRMRTWRR LVPWIFALSG LLLVVVLIAG REINGATRWI PLGPLNFQPT

101  ELFKLAVILY LASLFTRREE VLRSMESLGW QSIWRGTANL IMSATNPQAR

151  RETLEMYGRF RAIILPIMLV AFGLVLIMVQ PDFGSFVVIT VIAVGMLFLA

201  GLPWKYFFVL VGSVLGGMVL MITAAPYRVQ RVVAFLDPWK DPQGAGYQLT

251  HSLMAIGRGE WFGMGLGASL SKRGFLPEAH TDFIFAIIAE EFGFFGMCVL

301  IFCYGWLVVR AFSIGKQSRD LGLTFNAYIA SGIGIWIGIQ SFFNIGVNIG

351  ALPTKGLTLP LMSYGGSSVF FMLISMMLLL RIDYENRRKM RGYRVE*
```

m086/a086 98.0% identity over a 396 aa overlap

```
                     10        20        30        40        50        60
m086.pep     MVVLMTAFSLLMIYSASVYLASKEGGDQFFYLTRQAGFVVAGLIASGLLWFLCRMRTWRR
             ||||||||||||||||||||||||||||||||||||||||||||||||||||||||||||
a086         MVVLMTAFSLLMIYSASVYLASKEGGDQFFYLTRQAGFVVAGLIASGLLWFLCRMRTWRR
                     10        20        30        40        50        60

                     70        80        90       100       110       120
m086.pep     LVPWIFALSGLLLVVVLIAGREINGATRWIPLGPLNFQPTELFKLAVILYLASLFTRREE
             ||||||||||||||||||||||||||||||||||||||||||||||||||||||||||||
a086         LVPWIFALSGLLLVVVLIAGREINGATRWIPLGPLNFQPTELFKLAVILYLASLFTRREE
                     70        80        90       100       110       120

                    130       140       150       160       170       180
m086.pep     VLRSMESLGWQSIWRGTANLIMSATNPQXRRETLEMYGRXRAIILPIMLVAFGLVLIMVQ
             ||||||||||||||||||||||||||||||||||||||||||||||||||||||||||||
a086         VLRSMESLGWQSIWRGTANLIMSATNPQARRETLEMYGRXRAIILPIMLVAFGLVLIMVQ
                    130       140       150       160       170       180

                    190       200       210       220       230       240
m086.pep     PDFGSFVVITVIAVGMLFLAGLPWKYFFVLVGSVLGGMVLMITAAPYRVQRVVAFLDPWK
             ||||||||||||||||||||||||||||||||||||||||||||||||||||||||||||
a086         PDFGSFVVITVIAVGMLFLAGLPWKYFFVLVGSVLGGMVLMITAAPYRVQRVVAFLDPWK
                    190       200       210       220       230       240

                    250       260       270       280       290       300
m086.pep     DPQGAGYQLTHSLMAIGRGEWFGMGLGASLSKRGFLPEAHTDFIFAIIAEEFGFFGMCVL
             ||||||||||||||||||||||||||||||||||||||||||||||||||||||||||||
a086         DPQGAGYQLTHSLMAIGRGEWFGMGLGASLSKRGFLPEAHTDFIFAIIAEEFGFFGMCVL
                    250       260       270       280       290       300

                    310       320       330       340       350       360
m086.pep     IFCYGWLVVRAFSIGKQSRDLGLTFNAYIASGIGIWIGXQSFFNIGVNIGALPXKGLTXP
             ||||||||||||||||||||||||||||||||||||||| |||||||||||||:|||| |
a086         IFCYGWLVVRAFSIGKQSRDLGLTFNAYIASGIGIWIGIQSFFNIGVNIGALPTKGLTLP
                    310       320       330       340       350       360
```

-continued

```
                 370        380        390
m086.pep    XMSXGGSSVFFMLISMMLLXRIDYENRRKMRGYRVEX
             || ||||||||||||||| ||||||||||||||||
a086        LMSYGGSSVFFMLISMMLLLRIDYENRRKMRGYRVEX
                 370        380        390
```

The following partial DNA sequence was identified in *N. gonorrhoeae* <SEQ ID 277>:

```
g087.seq
   1  ATGGGCGGTA AAACCTTTAT GCTGATGGCG GGCGGAACGG GCGGACACAT

  51  TTTCCCAGCT CTGGCTGTGG CGGATTCATT GCGCGTGCGC GGTCATCATG

 101  TAATTTGGCT GGGCAGCAAG GATTCGATGG AAGAGCGCAT CGTGCCGCAA

 151  TACGGCATAC GCTTGGAAAC GCTGGCGATT AAAGGAATAC GCGGCAACGG

 201  CATCAAACGC AAGCTGATGC TTCCGTTTAC TCTGTACAAA ACCGTCCGCG

 251  AAGCGCAGCG GATTATCCGC AAACACCGTG TCGAGTGCGT CATCGGCTTC

 301  GGCGGTTTTG TTACCTTTCC CGGCGGTCTG GCGGCGAAAC TCTTGGGCGT

 351  GCCGATTGTG ATTCACGAGC AAAACGCCGT GGCAGGCTTG TCCAACCGCC

 401  AccTGTCGCg ctGGGCGAAA CGGGTGTTGT ACGCTTTTCC GAAAGCGTTC

 451  AGCCACGAAG GCGGTTTGGT CGGCAACCCC GTCCGCGCCG ATATTAGCAA

 501  CCTGCCCGTG CCTGCCGAAC GCTTCCAAGG GCGCGAAGGC CGTCTGAAAA

 551  TTTTGGTGGT CGGCGGCAGT TTGGGTGCGG ACGTTTTGAA CAAAACCGTA

 601  CCGCAGGCGT TGGCACTGCT GCCTGAAGAG GTGCGCCCGC AGATGTACCA

 651  CCAGTCGGGG CGTAACAAGC TGGGCAATCT TCAGGCGGAT TATGACGCGT

 701  TGGGCGTGAA AGCGGAATGC GTGGAATTTA TTACCGACAT GGTGTCCGCC

 751  TACCGTGATG CCGATTTGGT GATTTGCCGT GCCGGCGCGC TGACGATTGC

 801  CGAGTTGACG GCGGCGGGGC TGGGCGCGTT GTTAGTGCCG TATCCTCACG

 851  CCGTTGATGA CCATCAAACC GCCAACGCGC GTTTCATGGT GCAGGCAGAA

 901  GCGGGGCTGC TGTTGCCGCA AACCCAGTTG ACGGCGGAAA AACTCGCCGA

 951  AATCCTCGGC AGCCTCAACC GCGAAAAATG CCTCAAATGG GCGGAAAACG

1001  CCCGTACGTT GGCATTGCCG CACAGCGCGG ATGACGTTGC CGAAGCCGCG

1051  ATTGCGTGTG CGGCGTAAA
```

This corresponds to the amino acid sequence <SEQ ID 278; ORF 087.ng>:

```
g087.pep
   1  MGGKTFMLMA GGTGGHIFPA LAVADSLRVR GHHVIWLGSK DSMEERIVPQ

  51  YGIRLETLAI KGIRGNGIKR KLMLPFTLYK TVREAQRIIR KHRVECVIGF

 101  GGFVTFPGGL AAKLLGVPIV IHEQNAVAGL SNRHLSRWAK RVLYAFPKAF

 151  SHEGGLVGNP VRADISNLPV PAERFQGREG RLKILVVGGS LGADVLNKTV

 201  PQALALLPEE VRPQMYHQSG RNKLGNLQAD YDALGVKAEC VEFITDMVSA

 251  YRDADLVICR AGALTIAELT AAGLGALLVP YPHAVDDHQT ANARFMVQAE

 301  AGLLLPQTQL TAEKLAEILG SLNREKCLKW AENARTLALP HSADDVAEAA

 351  IACAA*
```

The following partial DNA sequence was identified in *N. meningitidis* <SEQ ID 279>:

```
m087.seq
   1  ATGGGCGGTA AAACCTTTAT GCTGAwkkCG GGCGGAACGG GCGGACATAT

  51  TTTCCCCGCG CTGGCGGTGG CGGATTCATT GCGCGCGCGC GGCCATCATG

 101  TGATTTGGCT GGGCAGCAAG GATTCGATGG AAGAGCGTAT CGTGCCGCAA

 151  TACGGCATAC GCTTGGAAAC GCTGGCGATT AAAGGCGTGC GCGGCAACGG

 201  CATCAAACGC AAACTGATGC TGCCGGTTAC TTTGTATCAA ACCGTCCGCG

 251  AAGCGCAGCG GATTATCCGC AAACACCGTG TCGAGTGCGT CATCGGCTTC

 301  GGCGGCTTCG TTACCTTCCC CGGCGGTTTG GCGGCGAAGC TATTArGCGT

 351  GCCGATTGTG ATTCACGAGC AAAACGCCGT GGCAGGTTTG TCCAACCGCC

 401  ACCTGTCGCG CTGGGCGAAG CGGGTGTTGT ACGCTTTTCC GAAAGCGTTC

 451  AGCCACGAAG GCGGCTTGGT CGGCAACCCC GTCCGCGCCG ATATTAGCAA

 501  CCTGCCCGTG CCTGCCGAAC GCTTCCAAGG GCGTGAAGGC CGTCTGAAAA

 551  TTTTGGTGGT CGGCGGCAGT TTGGGCGCGG ACGTTTTGAA CAAAACCGTA

 601  CCGCATGCAT TGGCTTTGCT GCCCGACAAT GCGCGTCCGC ATATGTACCA

 651  CCAATCGGGA CGGGGCAAGC TGGGCATCTT GCAGGCGnnn nnnnnnnnnn

 701  nnnnnnnnnn nnnnnnnnnn nnnnnnnnnn nnnnnnnnnn nnnnnnnnnn

 751  nnnGCGGGAT TGGGTGCGTT GTTAGTGCCG TATCCTCACG CGGTTGACGA

 801  TCACCAAACC GCCAACGCGC GTTTTATGGT GCAGGCGGAG GCGGGATTGC

 851  TGTTGCCGCA AACCCAGTTG ACGGCGGAAA AACTCGCCGA GATTCTCGGC

 901  GGCTTAAACC GCGAAAAATG CCTCAAATGG GCAGAAAACG CCCGTACGTT

 951  GGCACTGCCG CACAGTGCGG ACGACGTGGC GGAAGCCGCG ATTGCGTGTG

1001  CGGCGTAA
```

This corresponds to the amino acid sequence <SEQ ID 280; ORF 087>:

```
m087.pep
   1  MGGKTFMLXX GGTGGHIFPA LAVADSLRAR GHHVIWLGSK DSMEERIVPQ

  51  YGIRLETLAI KGVRGNGIKR KLMLPVTLYQ TVREAQRIIR KHRVECVIGF

 101  GGFVTFPGGL AAKLLXVPIV IHEQNAVAGL SNRHLSRWAK RVLYAFPKAF

 151  SHEGGLVGNP VRADISNLPV PAERFQGREG RLKILVVGGS LGADVLNKTV

 201  PHALALLPDN ARPHMYHQSG RGKLGILQAX XXXXXXXXXX XXXXXXXXXX

 251  XAGLGALLVP YPHAVDDHQT ANARFMVQAE AGLLLPQTQL TAEKLAEILG

 301  GLNREKCLKW AENARTLALP HSADDVAEAA IACAA*
```

Computer analysis of this amino acid sequence gave the following results:

Homology with a Predicted ORF from *N. gonorrhoeae*

ORF 087 shows 83.9% identity over a 355 aa overlap with a predicted ORF (ORF 087.ng) from *N. gonorrhoeae*:

```
m087/g087

                      10        20        30        40        50        60
m087.pep      MGGKTFMLXXGGTGGHIFPALAVADSLRARGHHVIWLGSKDSMEERIVPQYGIRLETLAI
              ||||||||  ||||||||||||||||||:|||||||||||||||||||||||||||||||
g087          MGGKTFMLMAGGTGGHIFPALAVADSLRVRGHHVIWLGSKDSMEERIVPQYGIRLETLAI
                      10        20        30        40        50        60

                      70        80        90       100       110       120
m087.pep      KGVRGNGIKRKLMLPVTLYQTVREAQRIIRKHRVECVIGFGGFVTFPGGLAAKLLXVPIV
              ||:|||||||||||| |||:||||||||||||||||||||||||||||||||||| ||||
g087          KGIRGNGIKRKLMLPFTLYKTVREAQRIIRKHRVECVIGFGGFVTFPGGLAAKLLGVPIV
                      70        80        90       100       110       120

                     130       140       150       160       170       180
m087.pep      IHEQNAVAGLSNRHLSRWAKRVLYAFPKAFSHEGGLVGNPVRADISNLPVPAERFQGREG
              ||||||||||||||||||||||||||||||||||||||||||||||||||||||||||||
g087          IHEQNAVAGLSNRHLSRWAKRVLYAFPKAFSHEGGLVGNPVRADISNLPVPAERFQGREG
                     130       140       150       160       170       180

                     190       200       210       220      229
m087.pep      RLKILVVGGSLGADVLNKTVPHALALLPDNARPHMYHQSGRGKLGILQA-----------
              |||||||||||||||||||||:||||||:::||:|||||||:||| |||
g087          RLKILVVGGSLGADVLNKTVPQALALLPEEVRPQMYHQSGRNKLGNLQADYDALGVKAEC
                     190       200       210       220       230       240

                                                     230       240       250
m087.pep      -------------------------------AGLGALLVPYPHAVDDHQTANARFMVQAE
                                             |||||||||||||||||||||||||||||
g087          VEFITDMVSAYRDADLVICRAGALTIAELTAAGLGALLVPYPHAVDDHQTANARFMVQAE
                     250       260       270       280       290       300

             260       270       280       290       300       310
m087.pep      AGLLLPQTQLTAEKLAEILGGLNREKCLKWAENARTLALPHSADDVAEAAIACAAX
              ||||||||||||||||||||:|||||||||||||||||||||||||||||||||||
g087          AGLLLPQTQLTAEKLAEILGSLNREKCLKWAENARTLALPHSADDVAEAAIACAAX
                     310       320       330       340       350
```

The following partial DNA sequence was identified in *N. meningitidis* <SEQ ID 281>:

```
a087.seq
      1  ATGGGCGGTA AAACCTTTAT GCTGATGGCG GGCGGAACGG GCGGACATAT

     51  TTTCCCCGCG CTGGCGGTGG CGGATTCATT GCGCGCGCGC GGCCATCATG

    101  TAATTTGGCT GGGCAGCAAG GATTCGATGG AAGAGCGCAT CGTGCCGCAA

    151  TACGACATCC TGCTCGAAAC GCTGGCGATT AAAGGCGTGC GCGGCAACGG

    201  CATCAAACGC AAGCTGATGC TGCCGTTTAC TTTGTATCAA ACTGTCCGCG

    251  AAGCGCAGCA GATTATCCGC AAACACCGTG TCGAGTGCGT CATCGGCTTC

    301  GGCGGCTTCG TTACCTTTCC CGGCGGTTTG GCGGCGAAGT TATTAGGCGT

    351  GCCGATTGTG ATTCACGAGC AAAACGCCGT GGCAGGTTTG TCCAACCGCC

    401  ACCTGTCGCG CTGGGCGAAG CGGGTGTTGT ACGCTTTTCC GAAAGCGTTC

    451  AGCCACGAAG GCGGCTTGGT CGGCAACCCC GTCCGCGCCG ATATTAGCAA

    501  CCTGCCCGTG CCTGCCGAAC GCTTCCAAGG GCGTGAAGGC CGTCTGAAAA

    551  TTTTGGTGGT CGGCGGCAGT TTGGGCGCGG ACGTTTTGAA CAAAACCGTA

    601  CCGCAGGCAT TGGCTTTGCT GCCCGACAAT GCGCGTCCGC AGATGTACCA

    651  CCAATCGGGA CGGGGCAAGC TGGGCAGCTT GCAGGCGGAT TACGACGCGC

    701  TGGGCGTGCA AGCGGAATGC GTGGAATTTA TTACCGATAT GGTGTCCGCC
```

-continued

```
 751  TACCGCGATG CCGATTTGGT GATTTGCCGT GCCGGCGCGC TGACGATTGC

 801  CGAGTTGACG GCGGCGGGAT TGGGTGCGTT GTTAGTGCCG TATCCTCACG

 851  CCGTTGATGA CCATCAAACC GCCAACGCGC GTTTTATGGT GCAGGCGGAG

 901  GCGGGATTGC TGTTGCCGCA AACCCAGTTG ACGGCGGAAA AACTCGCCGA

 951  GATTCTCGGC GGCTTAAACC GCGAAAAATG CCTCAAATGG GCAGAAAACG

1001  CCCGTACGTT GGCACTGCCG CACAGTGCGG ACGACGTTGC CGAAGCCGCG

1051  ATTGCGTGTG CGGCGTAA
```

This corresponds to the amino acid sequence <SEQ ID 282; ORF 087.a>:

```
a087.pep
   1  MGGKTFMLMA GGTGGHIFPA LAVADSLRAR GHHVIWLGSK DSMEERIVPQ

  51  YDILLETLAI KGVRGNGIKR KLMLPFTLYQ TVREAQQIIR KHRVECVIGF

 101  GGFVTFPGGL AAKLLGVPIV IHEQNAVAGL SNRHLSRWAK RVLYAFPKAF

 151  SHEGGLVGNP VRADISNLPV PAERFQGREG RLKILVVGGS LGADVLNKTV

 201  PQALALLPDN ARPQMYHQSG RGKLGSLQAD YDALGVQAEC VEFITDMVSA

 251  YRDADLVICR AGALTIAELT AAGLGALLVP YPHAVDDHQT ANARFMVQAE

 301  AGLLLPQTQL TAEKLAEILG GLNREKCLKW AENARTLALP HSADDVAEAA

 351  IACAA*
```

m087/a087 85.4% identity over a 355 aa overlap

```
                   10        20        30        40        50        60
m087.pep   MGGKTFMLXXGGTGGHIFPALAVADSLRARGHHVIWLGSKDSMEERIVPQYGIRLETLAI
           ||||||||  |||||||||||||||||||||||||||||||||||||||||| | ||||||
a087       MGGKTFMLMAGGTGGHIFPALAVADSLRARGHHVIWLGSKDSMEERIVPQYDILLETLAI
                   10        20        30        40        50        60

                   70        80        90       100       110       120
m087.pep   KGVRGNGIKRKLMLPVTLYQTVREAQRIIRKHRVECVIGFGGFVTFPGGLAAKLLXVPIV
           ||||||||||||||| ||||||||||:||||||||||||||||||||||||||||| ||||
a087       KGVRGNGIKRKLMLPFTLYQTVREAQQIIRKHRVECVIGFGGFVTFPGGLAAKLLGVPIV
                   70        80        90       100       110       120

                  130       140       150       160       170       180
m087.pep   IHEQNAVAGLSNRHLSRWAKRVLYAFPKAFSHEGGLVGNPVRADISNLPVPAERFQGREG
           ||||||||||||||||||||||||||||||||||||||||||||||||||||||||||||
a087       IHEQNAVAGLSNRHLSRWAKRVLYAFPKAFSHEGGLVGNPVRADISNLPVPAERFQGREG
                  130       140       150       160       170       180

                  190       200       210       220       230       240
m087.pep   RLKILVVGGSLGADVLNKTVPHALALLPDNARPHMYHQSGRGKLGILQAXXXXXXXXXXX
           |||||||||||||||||||||:|||||||||||:||||||||||| |||
a087       RLKILVVGGSLGADVLNKTVPQALALLPDNARPQMYHQSGRGKLGSLQADYDALGVQAEC
                  190       200       210       220       230       240

                                               250       260       270       280
m087.pep   XX-------------------XXXXXXXXXAGLGALLVPYPHAVDDHQTANARFMVQAE
                                :    : ||||||||||||||||||||||||||||||
a087       VEFITDMVSAYRDADLVICRAGALTIAELTAAGLGALLVPYPHAVDDHQTANARFMVQAE
                  250       260       270       280       290       300

                  290       300       310       320       330
m087.pep   AGLLLPQTQLTAEKLAEILGGLNREKCLKWAENARTLALPHSADDVAEAAIACAAX
           ||||||||||||||||||||||||||||||||||||||||||||||||||||||||
a087       AGLLLPQTQLTAEKLAEILGGLNREKCLKWAENARTLALPHSADDVAEAAIACAAX
                  310       320       330       340       350
```

The following partial DNA sequence was identified in *N. gonorrhoeae* <SEQ ID 283>:

```
g088.seq
   1 ATGTTTTTAT GGCTCGCACA TTTCAGCAAC TGGTTAACCG GTCTGAATAT
  51 TTTTCAATAC ACCACATTCC GCGCCGTTAT GGCGGCGTTG ACCGCCTTGG
 101 CGTTTTCCCT GATGTTCGGC CCGTGGACGA TACGCAGGCT GACCGCGCTC
 151 AAATGCGGGC AGGCAGTGCG TACCGACGGC CCGCAAACCC ACCTCGTCAA
 201 AAACGGCACG CCGACGATGG GCGGTTCGCT GATTCTGACC GCCATTACCG
 251 TGTCCACCCT GTTGTGGGGC AACTGGGCGA ACCCGTATAT CTGGATTCTC
 301 TTGGGCGTAC TGCTTGCCAC CGGTGCGCTC GGTTTTTACG ACGACTGGCG
 351 CAAAGTCGTT TATAAAGACC CCAACGGCGT GTCCGCCAAA TTCAAAATGG
 401 TGTGGCAGTC AAGCGTTGCC GTTatcgcCG GTttggcaTT GTTTTACctt
 451 gCcgcCAATT CCGCCAACAA TATTTTGATT GTCCCGtttT TCAAACAAAT
 501 CGCCCTGCCG CTGGGCGTGG TCGGCTTttt gGtgttgTCT TACCTGACCA
 551 TCGTCGGCAC ATCCAACGCC GTCAACCTCA CcgaCGGCTT GGACGGCCTT
 601 GCCGCcttcc cgttcgtcct cgttgccgcC GGGCTCGCCA ttttcgccTA
 651 CGTCAGCGGA CACTACCAAT TTTCCCAATA CCTCCAGCTT CCCTATGTCG
 701 CCGGCGCGAA CGAAGTCGCT ATATTCTGCA CCGCCATGTG CGGCGCGTGC
 751 CTCGGATTTT TGTGGTTCAA CGCCTATCCC GCGCAAGTCT TTATGGGCGA
 801 TGTCGGCGCG CTGGCATTGG GTGCCGCGCT CGGTaccGtt gCCGTcaTcg
 851 tCCGCCAAGA ATTTGTcctc gtcattaTGG GCGGTCTGTT cgtcgtagaa
 901 gccgtgTCCG TTATGCTTCa tgtcggCTGG TACAAGAAAA Ccaaaaaacg
 951 CATCTTcCTg acgGcaccga ttcatcacca ttaCCaactt cgatgCTGGa
1001 aagaaacgca agtcgtcgtc CGTTtCTGGA TTAtTAccat cgtcgtggtt
1051 tTgataggtt tGagtacccT caAAattcgc ggaaactatg ccgTCCGAAC
1101 ACCTTTCAGA CGGCATTTGA ACGCGCAATA A
```

This corresponds to the amino acid sequence <SEQ ID 284; ORF 088.ng>:

```
g088.pep
   1 MFLWLAHFSN WLTGLNIFQY TTFRAVMAAL TALAFSLMFG PWTIRRLTAL
  51 KCGQAVRTDG PQTHLVKNGT PTMGGSLILT AITVSTLLWG NWANPYIWIL
 101 LGVLLATGAL GFYDDWRKVV YKDPNGVSAK FKMVWQSSVA VIAGLALFYL
 151 AANSANNILI VPFFKQIALP LGVVGFLVLS YLTIVGTSNA VNLTDGLDGL
 201 AAFPFVLVAA GLAIFAYVSG HYQFSQYLQL PYVAGANEVA IFCTAMCGAC
 251 LGFLWFNAYP AQVFMGDVGA LALGAALGTV AVIVRQEFVL VIMGGLFVVE
 301 AVSVMLHVGW YKKTKKRIFL TAPIHHHYQL RCWKETQVVV RFWIITIVVV
 351 LIGLSTLKIR GNYAVRTPFR RHLNAQ*
```

The following partial DNA sequence was identified in *N. meningitidis* <SEQ ID 285>:

```
m088.seq
   1 ATGTTTTTAT GGCTCGCACA TTTCAGCAnC TGGTTAACCG GTCTGAATnn
```

-continued

```
  51 nnnnnnnnnn nnnnnnnnnn nnnnnnnnnn nnnnnnnnnn nnnnnnnnnn

 101 nnnnnnnnnn nnnnnnnnnn nnnnnnnnnn nnnnnnnnnn nnnnnnnnnn

 151 nnnnnnnnnn nnnnnnnnnn nnnnnnnnnn nnnnnnnnnn nnnnnnnnnn

 201 nnnnnnnnnn nnnnnnnnnn nnnnnnnnnn nnnnnnnnnn nnnnnnnnnn

 251 nnnnnnnnnn nnnnnnnnnn nnnnnnnnnn nnnnnnnnnn nnnnnnnnnn

 301 nnnnnnnnnn nnnnnnnnnn nnnnnnnnnn nnnnnnnnnn nnnnnnnnnn

 351 nnnnnnnnnn nnnnnnnnnn nnnnnnnnnn nnnnnnnnnn nnnnnnnnnn

 401 nnnnnnnnnn nnnnnnnnnn nnnnnnnnnn nnnnnnnnnn nnnnnnnnnn

 451 nnnnnnnnnn nnnnnnnnnn nnnnnnnnnn nnnnnnnnnn nnnnnnnnnn

 501 nnnnnnnnnn nnnGGCGTGG TCGGCTTTTT GGTGTTGTCT TACCTGACCA

 551 TCGTCGGCAC ATCCAATGCC GTCAACCTCA CCGACGGCTT GGACGGCCTT

 601 GCGACCTTCC CCGTCGTCCT CGTTGCCGCC GGCCTCGCCA TCTTCGCCTA

 651 TGCCAGCGGC CACTCACAAT TTGCCCAATA CCTGCAATTA CCTTACGTTG

 701 CCGGCGCAAA CGAAGTGGTG ATTTTCTGTA CCGCCATGTG CGGCGCGTGC

 751 CTCGGTTTCT TGTGGTTTAA CGCCTATCCC GCGCAAGTCT TTATGGGCGA

 801 TGTCGGTGCA TTGGCATTGG GTGCCGCGCT CGGTACCGTC GCCGTTATCG

 851 TCCGCCAAGA GTTTGTCCTC GTCATTATGG GCGGATTATT TGTCGTAGAA

 901 GCCGTATCCG TTATGCTTCA GGTTGGCTGG TATAAGAAAA CCAAAAAACG

 951 CATCTTCCTG ATGGCGCCCA TCCATCACCA CTACGAACAA AAAGGCTGGA

1001 AAGAAACCCA AGTCGTCGTC CGCTTTTGGA TTATTACCAT CGTCTTGGTG

1051 TTGATCGGTT TGAGTACCCT CAAAATCCGC TGAACCTATG CCGTCTGAAC

1101 ATCTTTCAGA CGGCATTTGA ACGCGCAATA A

   1 MFLWLAHFSN WLTGLNIFQY TTFRAVMAAL TALAFSLMFG PWTIRRLTAL

  51 KCGQAVRTDG PQTHLVKNGT PTMGGSLILT AITVSTLLWG NWANPYIWIL

 101 LGVLLATGAL GFYDDWRKVV YKDPNGVSAK FKMVWQSSVA VIAGLALFYL

 151 AANSANNILI VPFFKQIALP LGVVGFLVLS YLTIVGTSNA VNLTDGLDGL

 201 AAFPFVLVAA GLAIFAYVSG HYQFSQYLQL PYVAGANEVA IFCTAMCGAC

 251 LGFLWFNAYP AQVFMGDVGA LALGAALGTV AVIVRQEFVL VIMGGLFVVE

 301 AVSVMLHVGW YKKTKKRIFL TAPIHHHYQL RCWKETQVVV RFWIITIVVV

 351 LIGLSTLKIR GNYAVRTPFR RHLNAQ*
```

This corresponds to the amino acid sequence <SEQ ID 286; ORF 088>:

```
m088.pep
   1 MFLWLAHFSX WLTGLNXXXX XXXXXXXXXX XXXXXXXXXX XXXXXXXXXX

  51 XXXXXXXXXX XXXXXXXXXX XXXXXXXXXX XXXXXXXXXX XXXXXXXXXX

 101 XXXXXXXXXX XXXXXXXXXX XXXXXXXXXX XXXXXXXXXX XXXXXXXXXX

 151 XXXXXXXXXX XXXXXXXXXX XGVVGFLVLS YLTIVGTSNA VNLTDGLDGL

 201 ATFPVVLVAA GLAIFAYASG HSQFAQYLQL PYVAGANEVV IFCTAMCGAC

 251 LGFLWFNAYP AQVFMGDVGA LALGAALGTV AVIVRQEFVL VIMGGLFVVE
```

-continued

```
301  AVSVMLQVGW YKKTKKRIFL MAPIHHHYEQ KGWKETQVVV RFWIITIVLV

351  LIGLSTLKIR XTYAVXTSFR RHLNAQ*
```

Computer analysis of this amino acid sequence gave the following results:

Homology with a Predicted ORF from *N. gonorrhoeae*

ORF 088 shows 91.7% identity over a 205 aa overlap with a predicted ORF (ORF 088.ng) from *N. gonorrhoeae*:

```
m088/g088

                                                  10        20        30
m088.pep                                GVVGFLVLSYLTIVGTSNAVNLTDGLDGLA
                                        ||||||||||||||||||||||||||||||
g088          IAGLALFYLAANSANNILIVPFFKQIALPLGVVGFLVLSYLTIVGTSNAVNLTDGLDGLA
                    150       160       170       180       190       200

                    40        50        60        70        80        90
m088.pep      TFPVVLVAAGLAIFAYASGHSQFAQYLQLPYVAGANEVVIFCTAMCGACLGFLWFNAYPA
              :|| ||||||||||||:||| ||:||||||||||||||:|||||||||||||||||||||
g088          AFPFVLVAAGLAIFAYVSGHYQFSQYLQLPYVAGANEVAIFCTAMCGACLGFLWFNAYPA
                    210       220       230       240       250       260

                   100       110       120       130       140       150
m088.pep      QVFMGDVGALALGAALGTVAVIVRQEFVLVIMGGLFVVEAVSVMLQVGWYKKTKKRIFLM
              |||||||||||||||||||||||||||||||||||||||||||||:|||||||||||||
g088          QVFMGDVGALALGAALGTVAVIVRQEFVLVIMGGLFVVEAVSVMLHVGWYKKTKKRIFLT
                    270       280       290       300       310       320

                   160       170       180       190       200
m088.pep      APIHHHYEQKGWKETQVVVRFWIITIVLVLIGLSTLKIRXTYAVXTSFRRHLNAQX
              |||||||: : ||||||||||||||||:||||||||||| :||| | |||||||||
g088          APIHHHYQLRCWKETQVVVRFWIITIVVVLIGLSTLKIRGNYAVRTPFRRHLNAQX
                    330       340       350       360       370
```

The following partial DNA sequence was identified in *N. meningitidis* <SEQ ID 287>:

```
a088.seq
     1  ATGTTTTTAT GGCTCGCACA TTTCAGCAAC TGGTTAACCG GTCTGAATAT

    51  TTTTCAATAC ACCACATTCC GCGCCGTCAT GGCGGCGTTG ACCGCCTTGG

   101  CGTTTTCCCT GATGTTCGGC CCGTGGACGA TACGCAGGCT GACCGCGCTC

   151  AAATGCGGGC AGGCAGTGCG TACCGACGGT CCGCAAACCC ACCTCGTCAA

   201  AAACGGCACG CCGACGATGG GCGGTTCGCT GATTCTGACC GCCATTACCG

   251  TGTCCACCCT GTTGTGGGGC AACTGGGCAA ACCCGTATAT CTGGATTCTC

   301  TTGGGCGTAT TGCTCGCCAC GGGCGCACTC GGTTTTTACG ACGACTGGCG

   351  CAAAGTCGTC TATAAAGACC CCAACGGCGT GTCCGCCAAA TTCAAAATGG

   401  TGTGGCAGTC AAGCGTTGCC ATTATCGCCG GTTTGGCATT GTTTTACCTT

   451  GCCGCCAATT CCGCCAACAA TATTTTGATT GTCCCGTTCT TCAAACAAAT

   501  CGCCCTGCCG CTGGGCGTGG TCGGCTTTTT GGTGTTGTCT TACCTGACCA

   551  TCGTCGGCAC ATCCAATGCC GTCAACCTCA CCGACGGCTT GGACGGCCTT

   601  GCGACCTTCC CCGTCGTCCT CGTTGCCGCC GGCCTCGCCA TCTTCGCCTA

   651  TGCCAGCGGC CACTCACAAT TTGCCCAATA CCTGCAATTA CCTTACGTTG

   701  CCGGCGCAAA CGAAGTGGTG ATTTTCTGTA CCGCCATGTG CGGCGCGTGC

   751  CTCGGTTTCT TGTGGTTTAA CGCCTATCCC GCGCAAGTCT TTATGGGCGA

   801  TGTCGGTGCA TTGGCATTGG GTGCCGCGCT CGGTACCGTC GCCGTCATCG

   851  TCCGCCAAGA GTTTGTCCTC GTCATTATGG GCGGATTATT TGTCGTAGAA

   901  GCCGTATCCG TTATGCTTCA GGTCGGCTGG TATAAGAAAA CCAAAAAACG
```

-continued

```
 951 CATCTTCCTG ATGGCGCCCA TCCATCACCA CTACGAACAA AAAGGCTGGA

1001 AAGAAACCCA AGTCGTCGTC CGCTTTTGGA TTATTACCAT CGTCTTGGTG

1051 TTGATCGGTT TGAGTACCCT CAAAATCCGC TGAACCTATG CCGTCTGAAC

1101 ACCTTTCAGA CGGCATTTGA ACGCGCAATA A
```

This corresponds to the amino acid sequence <SEQ ID 288; ORF 088.a>:

```
a088.pep
   1 MFLWLAHFSN WLTGLNIFQY TTFRAVMAAL TALAFSLMFG PWTIRRLTAL

  51 KCGQAVRTDG PQTHLVKNGT PTMGGSLILT AITVSTLLWG NWANPYIWIL

 101 LGVLLATGAL GFYDDWRKVV YKDPNGVSAK FKMVWQSSVA IIAGLALFYL

 151 AANSANNILI VPFFKQIALP LGVVGFLVLS YLTIVGTSNA VNLTDGLDGL

 201 ATFPVVLVAA GLAIFAYASG HSQFAQYLQL PYVAGANEVV IFCTAMCGAC

 251 LGFLWFNAYP AQVFMGDVGA LALGAALGTV AVIVRQEFVL VIMGGLFVVE

 301 AVSVMLQVGW YKKTKKRIFL MAPIHHHYEQ KGWKETQVVV RFWIITIVLV

 351 LIGLSTLKIR *TYAV*TPFR RHLNAQ*
```

m088/a088 99.5% identity over a 205 aa overlap

```
                  150       160       170       180       190       200
m088.pep   XXXXXXXXXXXXXXXXXXXXXXXXXXXXXXGVVGFLVLSYLTIVGTSNAVNLTDGLDGLA
                                         ||||||||||||||||||||||||||||||
a088       IAGLALFYLAANSANNILIVPFFKQIALPLGVVGFLVLSYLTIVGTSNAVNLTDGLDGLA
                  150       160       170       180       190       200
                  210       220       230       240       250       260
m088.pep   TFPVVLVAAGLAIFAYASGHSQFAQYLQLPYVAGANEVVIFCTAMCGACLGFLWFNAYPA
           ||||||||||||||||||||||||||||||||||||||||||||||||||||||||||||
a088       TFPVVLVAAGLAIFAYASGHSQFAQYLQLPYVAGANEVVIFCTAMCGACLGFLWFNAYPA
                  210       220       230       240       250       260
                  270       280       290       300       310       320
m088.pep   QVFMGDVGALALGAALGTVAVIVRQEFVLVIMGGLFVVEAVSVMLQVGWYKKTKKRIFLM
           ||||||||||||||||||||||||||||||||||||||||||||||||||||||||||||
a088       QVFMGDVGALALGAALGTVAVIVRQEFVLVIMGGLFVVEAVSVMLQVGWYKKTKKRIFLM
                  270       280       290       300       310       320
                  330       340       350       360       370
m088.pep   APIHHHYEQKGWKETQVVVRFWIITIVLVLIGLSTLKIRXTYAVXTSFRRHLNAQX
           |||||||||||||||||||||||||||||||||||||||||||||| |||||||||
a088       APIHHHYEQKGWKETQVVVRFWIITIVLVLIGLSTLKIRXTYAVXTPFRRHLNAQX
                  330       340       350       360       370
```

The following partial DNA sequence was identified in *N. gonorrhoeae* <SEQ ID 289>:

```
g089.seq
   1 ATGCCGCCCA AAATCACGAA GAGCGGGTTT TGCAAACCGG CAATCGCGGC

  51 GGCGGTCGCG CCGACATTCG TGCCTTTGCT GTCGTCGATG AATACCACGC

 101 CGTTTTTCTC GCCGATTTTT TCCACACGGT GCGGCAAGCC TTGGAAGGTT

 151 TTGACGTGTT CCAGCAATGC TTCGCGCGGC AAACCGACGG CCTCGCACAA

 201 AGCCACGGCA GCCATAACGT TGGCGGCGTT GTGCAAACCT TGCAGCGGGA

 251 TGTCTTGCGT AGAAATCAAA TCTTCATTGC CTTGTTTTAA ACAGCCCGTC

 301 CCGCGTTCCA ACCAAAAATC GGCTTCGTGT TCCAAGGAAA ACCGTTTCAC
```

-continued

```
351  TTCACGCCCT GCCCGTTTCA TGGCGCGGCA GAACACGTCG TCCGCATTCA

401  AAACCTGCAC TCCATCGCCA CGGAAAATCT CGGCTTTGGT ATGCGCGTAG
```

This corresponds to the amino acid sequence <SEQ ID 290; ORF 089.ng>:

```
g089.pep
    1 MPPKITKSGF CKPAIAAAVA PTFVPLLSSM NTTPFFSPIF STRCGKPWKV

   51 LTCSSNASRG KPTASHKATA AITLAALCKP CSGMSCVEIK SSLPCFKQPV

  101 PRSNQKSASC SKENRFTSRP ARFMARQNTS SAFKTCTPSP RKISALVCA*
```

The following partial DNA sequence was identified in *N. meningitidis* <SEQ ID 291>:

```
m089.seq
    1 ATGCCGCCCA AAATCACkAw GAGCGGATTT TGCAAACCGG CAATCGCGGC

   51 GGCAGTCGCG CCGACATTCG TGCCTTTGCT GTCGTCGATA AACACCACGC

  101 CGTTTTTCTC GCCGATTTTT TCCACGCGGT GCGGCAGGCC TTGGAAGGTT

  151 TTGACGTGTT CGAGCAATGC TTCGCGCGAC AAACCGATGG CCTCACACAA

  201 AGCCACkGCA GCCATGACGT TAGCGGCGTT GTGCAkACCT TGCAACGGwA

  251 TGTCTTGCGT GACAATCAAA TCTTCATTGC CTTGTTTCAG GCGGCCTGTC

  301 TCGCGTTCCA ACCAGAAATC AGCTTCGTGT TCCAACGAAA ACCATTTTAC

  351 CTCGCGCCCG GCACGCTTCA TCGCGCGGCA GAACGCATCG TCCGCATTCA

  401 AAACCTGCAC GCCGTCGCCA CGGAAAATCT TGGCTTTGGT ATGCGCATAG
```

This corresponds to the amino acid sequence <SEQ ID 292; ORF 089>:

```
m089.pep
    1 MPPKITXSGF CKPAIAAAVA PTFVPLLSSI NTTPFFSPIF STRCGRPWKV

   51 LTCSSNASRD KPMASHKATA AMTLAALCXP CNGMSCVTIK SSLPCFRRPV

  101 SRSNQKSASC SNENHFTSRP ARFIARQNAS SAFKTCTPSP RKILALVCA*
```

Computer analysis of this amino acid sequence gave the following results:

Homology with a Predicted ORF from *N. gonorrhoeae*

ORF 089 shows 88.6% identity over a 149 aa overlap with a predicted ORF (ORF 089.ng) from *N. gonorrhoeae*:

```
m089/g089

                      10        20        30        40        50        60
m089.pep      MPPKITXSGFCKPAIAAAVAPTFVPLLSSINTTPFFSPIFSTRCGRPWKVLTCSSNASRD
              |||||| ||||||||||||||||||||||:|||||||||||||||:|||||||||||||
g089          MPPKITKSGFCKPAIAAAVAPTFVPLLSSMNTTPFFSPIFSTRCGKPWKVLTCSSNASRG
                      10        20        30        40        50        60

                      70        80        90       100       110       120
m089.pep      KPMASHKATAAMTLAALCXPCNGMSCVTIKSSLPCFRRPVSRSNQKSASCSNENHFTSRP
              || |||||||:|||||| ||:||||| ||||||||::|| ||||||||||:||:|||||
g089          KPTASHKATAAITLAALCKPCSGMSCVEIKSSLPCFKQPVPRSNQKSASCSKENRFTSRP
                      70        80        90       100       110       120

                     130       140       150
m089.pep      ARFIARQNASSAFKTCTPSPRKILALVCAX
              |||:||||:|||||||||||||| ||||||
g089          ARFMARQNTSSAFKTCTPSPRKISALVCAX
                     130       140       150
```

The following partial DNA sequence was identified in *N. meningitidis* <SEQ ID 293>:

```
a089.seq
    1 ATGCCGCCTA AAATCACGAA GAGCGGATTT TGCAAACCGG CAATCGCGGC

   51 GGCGGTCGCA CCGACGTTCG TGCCTTTGCT GTCGTCGATG AACACCACGC

  101 CATTTTTCTC GCCGATTTTT TCCACGCGGT GCGGCAGGCC TTGAAAGGTT

  151 TTGACGTGTT CGAGCAATGC TTCGCGCGGC AAACCGACGG CTTCGCACAA

  201 GGCAACGGCA GCCATCACGT TAGTGGCGTT GTGCAAGCCT TGCAGCGGAA

  251 TATCTTGCGT GGCAATCAAA TCTTCATTGC CTTGTTTCAG GCGACCTGTC

  301 TCACGTTCCA ACCAAAAATC GGCTTCGTAT TCCAACGAAA ACCATTTCAC

  351 CTCGCGCCCG GCGCGCTTCA TCGCACGACA GAACGCATCG TCCGCATTCA

  401 AAACCTGCAC ACCGTCGCCA CGGAAAATCT TGGCTTTGGT ATGCGCGTAG
```

This corresponds to the amino acid sequence <SEQ ID 294; ORF 089.a>:

```
a089.pep
    1 MPPKITKSGF CKPAIAAAVA PTFVPLLSSM NTTPFFSPIF STRCGRP*KV

   51 LTCSSNASRG KPTASHKATA AITLVALCKP CSGISCVAIK SSLPCFRRPV

  101 SRSNQKSASY SNENHFTSRP ARFIARQNAS SAFKTCTPSP RKILALVCA*
```

m089/a089 91.9% identity over a 149 aa overlap

```
                       10        20        30        40        50        60
m089.pep      MPPKITXSGFCKPAIAAAVAPTFVPLLSSINTTPFFSPIFSTRCGRPWKVLTCSSNASRD
              |||||| |||||||||||||||||||||:|||||||||||||||| |||||||||||||
a089          MPPKITKSGFCKPAIAAAVAPTFVPLLSSMNTTPFFSPIFSTRCGRPXKVLTCSSNASRG
                       10        20        30        40        50        60

                       70        80        90       100       110       120
m089.pep      KPMASHKATAAMTLAALCXPCNGMSCVTIKSSLPCFRRPVSRSNQKSASCSNENHFTSRP
              || ||||||||:||:||| ||:|:|||:||||||||||||||||||||| ||||||||||
a089          KPTASHKATAAITLVALCKPCSGISCVAIKSSLPCFRRPVSRSNQKSASYSNENHFTSRP
                       70        80        90       100       110       120

                      130       140       150
m089.pep      ARFIARQNASSAFKTCTPSPRKILALVCAX
              ||||||||||||||||||||||||||||||
a089          ARFIARQNASSAFKTCTPSPRKILALVCAX
                      130       140       150
```

The following partial DNA sequence was identified in *N. gonorrhoeae* <*SEQ ID* 295>:

```
g090.seq
    1 ATGCGCGTAG TCGAGCAAAT CGTCGTAGCG GTCGAGATGG TCTTCGGAAA

   51 TGTTCATCAC CGTCGCCGCA GTCGGGCGCA GGCTTTCGGT GTTTTCCAGT

  101 TGGAAGCTGG AAAGCTCcca CACCCACACG TCCGCCTTTT TGCCTTCgcg

  151 ctgCAATtct gcctccaaga cgggcgtacc gatATTGCCC GCAATGAcgg

  201 tatccagccc gcacttgatg CAGAGatagc ggaccaggct ggttaccgTG

  251 GTTttgccgt tgctgCcggt aatcgCaatc accttgtcgC CGCGGCGGtt

  301 cAcaaTGTCc gccaGCAATt ggATGTCGCC TAgCACGCGC .ccgccgTTT

  351 TGCttga
```

This corresponds to the amino acid sequence <SEQ ID 296; ORF 090.ng>:

```
g090.pep
    1 MRVVEQIVVA VEMVFGNVHH RRRSRAQAFG VFQLEAGKLP HPHVRLFAFA

   51 LQFCLQDGRT DIARNDGIQP ALDAEIADQA GYRGFAVAAG NRNHLVAAAV

  101 HNVRQQLDVA XHAXRRFA*
```

The following partial DNA sequence was identified in *N. meningitidis* <SEQ ID 297>:

```
m090.seq.
    1 ATGCGCATAG TCGAGCAAGT CGTCGTAGCG GTCGAGATGG TCTTCGGAAA

   51 TGTTCAGCAC CGTCGCCGCA GTCGGACGCA GGCTTTCGGT GTTTTCCAGT

  101 TGGAAGCTGG AAAGCTCCAA CACCCACACG TCCGCCTTTT TGCCTTCGCG

  151 CTGCCATTCC GCCTCCAAAA CCGGCGTGCC GATATTGCCC GCGATAACGG

  201 TATCCAGCCC GCACTTGATA CAGAGATAGC CGACCAGGCT CGTTACCGTG

  251 GTTTTGCCGT TGCTGCCGGT AATCGCAATT ACCTTGTCGT CCCGGCGGTT

  301 CACAATGTCC GCCAGCAATT CGATGTCGCC CAACACGCGT .CCGCCGTTT

  351 TGCTTGA
```

This corresponds to the amino acid sequence <SEQ ID 298; ORF 090>:

```
m090.pep
    1 MRIVEQVVVA VEMVFGNVQH RRRSRTQAFG VFQLEAGKLQ HPHVRLFAFA

   51 LPFRLQNRRA DIARDNGIQP ALDTEIADQA RYRGFAVAAG NRNYLVVPAV

  101 HNVRQQFDVA QHAXRRFA*
```

Computer analysis of this amino acid sequence gave the following results:

Homology with a Predicted ORF from *N. gonorrhoeae*

ORF 090 shows 83.9% identity over a 118 aa overlap with a predicted ORF (ORF 090.ng) from *N. gonorrhoeae*:

```
m090/g090

                     10        20        30        40        50        60
m090.pep     MRIVEQVVVAVEMVFGNVQHRRRSRTQAFGVFQLEAGKLQHPHVRLFAFALPFRLQNRRA
             ||:|||:|||||||||||:||||||:||||||||||||| ||||||||||| | ||: |:
g090         MRVVEQIVVAVEMVFGNVHHRRRSRAQAFGVFQLEAGKLPHPHVRLFAFALQFCLQDGRT
                     10        20        30        40        50        60

                     70        80        90       100       110       119
m090.pep     DIARDNGIQPALDTEIADQARYRGFAVAAGNRNYLVVPAVHNVRQQFDVAQHAXRRFAX
             ||||::|||||||:|||||| ||||||||||||:||: ||||||||:||| ||||||||
g090         DIARNDGIQPALDAEIADQAGYRGFAVAAGNRNHLVAAAVHNVRQQLDVAXHAXRRFAX
                     70        80        90       100       110
```

The following partial DNA sequence was identified in *N. meningitidis* <SEQ ID 299>:

```
a090.seq
    1 ATGCGCGTAG TCGAGCAAGT CGTCGTAGCG GTCGAGATGG TCTTCGGAAA

   51 TGTTCAGCAC TGTCGCCGCA GTCGGGCGCA GGCTTTCGGT GTTTTCCAGT

  101 TGGAAACTGG AAAGCTCCAA CACCCACACG TCCGCCTTTT TGCCTTCGCG
```

-continued

```
151 CTGCAATTCC GCCTCCAAAA CCGGCGCGCC GATATTGCCC GCGATAACGG

201 TATCCAGCCC ACACTTGATG CAGAGATAGC CGACCAGGCT CGTTACCGTG

251 GTTTTGCCGT TGCTGCCGGT AATCGCAATC ACCTTGTCGC CGCGGCGGTT

301 CACAATGTCC GCCAGCAATT CGATGTCGCC CAACACGCGT C.CGCCGTTT

351 CGCTTAA
```

This corresponds to the amino acid sequence <SEQ ID 300; ORF 090.a>:

```
a090.pep
    1 MRVVEQVVVA VEMVFGNVQH CRRSRAQAFG VFQLETGKLQ HPHVRLFAFA

   51 LQFRLQNRRA DIARDNGIQP TLDAEIADQA RYRGFAVAAG NRNHLVAAAV

  101 HNVRQQFDVA QHAXRRFA*
```

m09/a090 91.5% identity over a 117 aa overlap

```
                   10        20        30        40        50        60
m090.pep    MRIVEQVVVAVEMVFGNVQHRRRSRTQAFGVFQLEAGKLQHPHVRLFAFALPFRLQNRRA
            ||:|||||||||||||||| ||||:|||||||||:|||||||||||||||| ||||||||
a090        MRVVEQVVVAVEMVFGNVQHCRRSRAQAFGVFQLETGKLQHPHVRLFAFALQFRLQNRRA
                   10        20        30        40        50        60

                   70        80        90       100       110      119
m090.pep    DIARDNGIQPALDTEIADQARYRGFAVAAGNRNYLVVPAVHNVRQQFDVAQHAXRRFAX
            ||||||||||:||:||||||||||||||||||||:||: |||||||||||||||||||||
a090        DIARDNGIQPTLDAEIADQARYRGFAVAAGNRNHLVAAAVHNVRQQFDVAQHAXRRFAX
                   70        80        90       100       110
```

The following partial DNA sequence was identified in *N. gonorrhoeae* g090-1.seq This sequence contains multiple stop codons (not shown)

This corresponds to the amino acid sequence <ORF 090-1.ng>:

g090-1.pep (not shown)

The following partial DNA sequence was identified in *N. meningitidis* <SEQ ID 2>:

```
m090-1.seq
    1 ATGACGGCGT TTGCATTTCA GACGGCATCA CAAAGCCTTA AACGCTTCGA

   51 TAAACACTTC CGAACGGTGC GCGTAGCCTT TGAACATATC AAAGCTCGCG

  101 CAGGCGGGGC TGAGCAACAC AATATCGCCT GCTTCGGCTT GGGCATATGC

  151 CGTCTGAACG GCTTCTCCCA AAGTGGCGCA GTCGGTCATA TTCAAGCCGC

  201 AGCCGTCCAA ATCGCGGCGG ATTTGCGGCG CATCGACACC AATCAAGAAC

  251 ACGCCTTTTG CCTTGCCTAC CAGTGCATCG CGCAGGGGCG TGAAGTCCTG

  301 CCCTTTACCC ATGCCGCCCA AAATCACGAA GAGCGGATTT TGCAAACCGG

  351 CAATCGCGGC GGCAGTCGCG CCGACATTCG TGCCTTTGCT GTCGTCGATA

  401 AACACCACGC CGTTTTTCTC GCCGATTTTT TCCACGCGGT GCGGCAGGCC

  451 TTGGAAGGTT TTGACGTGTT CGAGCAATGC TTCGCGCGAC AAACCGATGG

  501 CCTCACACAA AGCCACGGCA GCCATGACGT TAGCGGCGTT GTGCAGACCT

  551 TGCAACGGAA TGTCTTGCGT GACAATCAAA TCTTCATTGC CTTGTTTCAG

  601 GCGGCCTGTC TCGCGTTCCA ACCAGAAATC AGCTTCGTGT TCCAACGAAA

  651 ACCATTTTAC CTCGCGCCCG GCACGCTTCA TCGCGCGGCA GAACGCATCG

  701 TCCGCATTCA AAACCTGCAC GCCGTCGCCA CGGAAAATCT TGGCTTTGGT
```

-continued

751 ATGCGCATAG TCGAGCAAGT CGTCGTAGCG GTCGAGATGG TCTTCGGAAA

801 TGTTCAGCAC CGTCGCCGCA GTCGGACGCA GGCTTTCGGT GTTTTCCAGT

851 TGGAAGCTGG AAAGCTCCAA CACCCACACG TCCGCCTTTT TGCCTTCGCG

901 CTGCCATTCC GCCTCCAAAA CCGGCGTGCC GATATTGCCC GCGATAACGG

951 TATCCAGCCC GCACTTGATA CAGAGATAGC CGACCAGGCT CGTTACCGTG

1001 GTTTTGCCGT TGCTGCCGGT AATCGCAATT ACCTTGTCGT CCCGGCGGTT

1051 CACAATGTCC GCCAGCAATT CGATGTCGCC CAACACGCGT CCGCCGTTTT

1101 GCTTGAACGC CTCAATATCC GGCTGCCGCT CGCTGATGCC GGGACTGAGA

1151 GCCAGAATAT CGAAACCGTT GTCCAGCGCA TCTTTCAGAC GGCCCGTGTA

1201 AAACACCAAC CCGTCAAACA TCTTACCGAT TTGCGACACG CGTTCCGGCT

1251 TCAGCTCCGC ATCATACGCA GCAACCTCCG CGCCGTTTTT GCGCAGGTAG

1301 GCAATCATGG AAATACCCGT ACCGCCGAGT CCGGCGACGA GGATTTTTTT

1351 GTTTTGAAAA GTCATTTTGG TTTGTCCTAA

This corresponds to the amino acid sequence <SEQ ID 3; ORF 090-1>:

m090-1.pep

1 MTAFAFQTAS QSLKRFDKHF RTVRVAFEHI KARAGGAEQH NIACFGLGIC

51 RLNGFSQSGA VGHIQAAAVQ IAADLRRIDT NQEHAFCLAY QCIAQGREVL

101 PFTHAAQNHE ERILQTGNRG GSRADIRAFA VVDKHHAVFL ADFFHAVRQA

151 LEGFDVFEQC FARQTDGLTQ SHGSHDVSGV VQTLQRNVLR DNQIFIALFQ

201 AACLAFQPEI SFVFQRKPFY LAPGTLHRAA ERIVRIQNLH AVATENLGFG

251 MRIVEQVVVA VEMVFGNVQH RRRSRTQAFG VFQLEAGKLQ HPHVRLFAFA

301 LPFRLQNRRA DIARDNGIQP ALDTEIADQA RYRGFAVAAG NRNYLVVPAV

351 HNVRQQFDVA QHASAVLLER LNIRLPLADA GTESQNIETV VQRIFQTARV

401 KHQPVKHLTD LRHAFRLQLR IIRSNLRAVF AQVGNHGNTR TAESGDEDFF

451 VLKSHFGLS*

The following partial DNA sequence was identified in *N. gonorrhoeae* <SEQ ID 303>:

g091.seq

1 ATGGAAATAC CCGTGCCGCC AAGTCCGGCG ACGAGGATTT TTTTGTTTGA

51 AAGTCATTTT GGTTTTGTCC TAAAACAAAT CATATTGGGC AGGAGACGTC

101 CGCCCTTGCC CAAGCCGCTT TCAGACGGCA TCGCGAGCCG ATTAATAACC

151 CGCCTTCAGG CGTTGGTCAT TGTCGCAGCT GTTTTGGTCT CCGTTTTGAC

201 AAGCCTTGCC AAGCCATTGT TGAGCGAGCG CAAGGTCTTG GCGCACGCCG

251 CGTCCATCGT AATACATCAA GCCCAAATTG TATTGGGCTT GGGCATCCCC

301 TTGTTCTGA

This corresponds to the amino acid sequence <SEQ ID 304; ORF 091.ng>:

g091.pep

1 MEIPVPPSPA TRIFLFESHF GFVLKQIILG RRRPPLPKPL SDGIASRLIT

-continued

```
 51 RLQALVIVAA VLVSVLTSLA KPLLSERKVL AHAASIVIHQ AQIVLGLGIP

101 LF*
```

The following partial DNA sequence was identified in *N. meningitidis* <SEQ ID 305>:

```
m091.seq
  1 ATGGAAATAC CCGTACCGCC GAGTCCGGCG ACGAGGATTT TTTTGTTTGA

 51 AAAGTCATT TTGGTTTGTCC TAAAACAAAT CATATTGAGC AGGAGATGTC

101 CGCCCCTGC CCAAGCCGCTT TCAGACGGCA TCGCGAGCTG TTCAATAACC

151 CGCCTTCAG GCGTTGGTCAT TGTCGCAGCC GTCTTGGTCT CCGTTTTGAC

201 AAGCCTTGC CAAACCATTCT TGTGCAAGGG CGCGGTCTTG GCGCACGCCG

251 CGTCTTTCG GCATACATCAC GCCCAAATTG TTTTGGGCTT GGGCTACCCC

301 CTGCGC...
```

This corresponds to the amino acid sequence <SEQ ID 306; ORF 091>:

```
m091.pep
  1 MEIPVPPSPA TRIFLFEKSF WFVLKQIILS RRCPPLPKPL SDGIASCSIT

 51 RLQALVIVAA VLVSVLTSLA KPFLCKGAVL AHAASFGIHH ACIVLGLGYP

101 LR.
```

Computer analysis of this amino acid sequence gave the following results:

Homology with a Predicted ORF from *N. gonorrhoeae*

ORF 091 shows 84.2% identity over a 101 aa overlap with a predicted ORF (ORF 091.ng) from *N. gonorrhoeae*:

```
m091/g091

                    10        20        30        40        50        60
m091.pep    MEIPVPPSPATRIFLFEKSFWFVLKQIILSRRCPPLPKPLSDGIASCSITRLQALVIVAA
            ||||||||||||||||: | ||||||||:|| |||||||||||||  ||||||||||||
g091        MEIPVPPSPATRIFLFESHFGFVLKQIILGRRRPPLPKPLSDGIASRLITRLQALVIVAA
                    10        20        30        40        50        60

                    70        80        90       100
m091.pep    VLVSVLTSLAKPFLCKGAVLAHAASFGIHHAQIVLGLGYPLR
            |||||||||||:| :  ||||||: ||:|||||||| ||
g091        VLVSVLTSLAKPLLSERKVLAHAASIVIHQAQIVLGLGIPLFX
                    70        80        90       100
```

The following partial DNA sequence was identified in *N. meningitidis* <SEQ ID 307>:

```
a091.seq
  1 ATGGAAATAC CCGTGCCGCC AAGTCCGGCG ACGAGGATTT TTTTGTTTTG

 51 GAAATCATTT TGGTTTGTCC TAAAACAAAT CATATTGAGC AGGGGATGTC

101 TGATCCTGCT CAAGCCGCTT TCAGACGGCA TCGCGAGCTG TTCAATAACC

151 CGCTTTCAGG CGTTGGTCAT TGTCGCAGCT GTCTTGGTAT CCGTTTTGAC

201 AAGCCTTGCC AAGCCATTCT TGTGCAAGGG CGCGGTCTTG GCGCACGCCG

251 CGTCTTTCGG CATACATCAC GCCCAAATTG TTTTGGGC
```

This corresponds to the amino acid sequence <SEQ ID 308; ORF 091.a>:

```
a091.pep.
    1 MEIPVPPSPA TRIFLFWKSF WFVLKQIILS RGCLILLKPL SDGIASCSIT

   51 RFQALVIVAA VLVSVLTSLA KPFLCKGAVL AHAASFGIHH AQIVLG
```

m091/a091 93.8% identity over a 96 aa overlap

```
                       10        20        30        40        50        60
    m091.pep    MEIPVPPSPATRIFLFEKSFWFVLKQIILSRRCPPLPKPLSDGIASCSITRLQALVIVAA
                |||||||||||||||| ||||||||||||| |   | |||||||||||||:||||||||
    a091        MEIPVPPSPATRIFLFWKSFWFVLKQIILSRGCLILLKPLSDGIASCSITRFQALVIVAA
                       10        20        30        40        50        60

                       70        80        90       100
    m091.pep    VLVSVLTSLAKPFLCKGAVLAHAASFGIHHAQIVLGLGYPLR
                ||||||||||||||||||||||||||||||||||||
    a091        VLVSVLTSLAKPFLCKGAVLAHAASFGIHHAQIVLG
                       70        80        90
```

The following partial DNA sequence was identified in *N. gonorrhoeae* <SEQ ID 309>:

```
g092.seq
    1 ATGTTTTTTA TTTCAATCCG CTATATATTT GTCAGAAAAC TATGGTGCGC

   51 AAACGGTCAG ACCTTTAAAA TAACGCCTTT ACGCACTAAA AACCAACCGG

  101 AACGCAACAT TATGATGAAA AATCGAGTAA GCAACATCCA TTTTGTCGGT

  151 ATCGGCGGCG TCGGCATGAG CGGTATCGCC GAAGTCTTGC ACAATTTGGG

  201 CTTTAAAGTT TCCGGTTCGG ATCAGGCGCG AAATGCCGCT ACCGAGCATT

  251 TGAGCAGCCT GGGCATTCAA GTTTATCCCG GCCATACCGC AGAACACGTT

  301 AACGGTgcgg ATGTCGTCGT TGCCTCTACC GCCGTCAAGA AAGAAaatcC

  351 CGAAGTtgtc gcTGCGTTGG AGCGGCAAAT TCCCGTTATT CCGCGCGCCT

  401 TGATGCTGGC AGAGCTGATG CGCTTCCGTG ACGgcatcgc cattgccggT

  451 ACGCACGGCA AAACCACGAC CACCAGCCTG ACCGCCTCCA TCCTCGGCGC

  501 GGCAGGACTC GACCCCACTT TCGTTATCGG CGGCAAACTC AACGCCGCAG

  551 GCACCAACGC CCGCTTGGGC AAAGGCGAAT ACATCGTTGC CGAAGCCGAC

  601 GAATCCGATG CCTCTTTCCT ACATCTGACC CCGATTATGT CCGTCGTTAC

  651 CAATATCGAC GAAGACCATA TGGATACCTA CGGGCACAGC GTCGAAAAAC

  701 TGCATCAGGC GTTTATCGAT TTCATCCACC GTATGCCCTT CTACGGCAAA

  751 GCCTTTTTGT GTGTTGACAG CGAACACGTC CGCGCGATTT TGCCCAAAGT

  801 GAGCAAACCT TATGCTACTT ACGGTTTGGA CGATACCGCC GACATCTACG

  851 CCACCGACAT CGAAAACGTC GGCGCGCAAA TGAAATTCAC CGTCCATGTT

  901 CAAATGAAAG GACATGAGCA GGGGTCGTTT GAAGTCGTGC TGAATATGCC

  951 CGGCAGACAC AACGTGCTGA ACGCATTGGC AGCCATCGGc gtggcGCTgg

 1001 aagtcGgCGC ATcggttgAA GCGAtcCAAA AaggCTTGCT CGGCTTTGAA

 1051 GGCGTCGGCC GCCGCTTCCA AAAATAcggc gacatCAagt tgccaaacgg

 1101 cggGaccgCT TTgctGGTGG ACGATTAcgg ACACCACCCC GTCGAAATGG

 1151 CGGcaaccct tgccgcTGCA CGCGGCGCGT ATCCGGAAAA acgtTTGGTG

 1201 CtcgCCTTCC AGCCGCACCG CTATACCCGC ACGCGCGATT TGTTTGAAGA
```

-continued

1251 CTTTACCAAA GTACTCAATA CCGTTGatgC GCTGGTACTG ACCGAAGTTT

1301 AtgccgccgG CGAAGAGCCG GTTGCCGCCG CCGactcCCG CGCCTTGGCG

1351 CGTGCTATCC GCGTATTGGG CAAACTTGAG CCGATTTACT GCGAAAatgt 1401 cgccgACCTG CCGCAAATGC TGATGAATGT TTTACAGGAT Ggcgatgttg 1451 tgttgAATAT GggTgcggga agcatcaacc gcgttccttc cgcgctgttg 1501 gaattgtcga AACAGAtttq A This corresponds to the amino acid sequence <SEQ ID 310; ORF 092.ng>:

g092.pep

1 MFFISIRYIF VRKLWCANGQ TFKITPLRTK NQPERNIMMK NRVSNIHFVG

51 IGGVGMSGIA EVLHNLGFKV SGSDQARNAA TEHLSSLGIQ VYPGHTAEHV

101 NGADVVVAST AVKKENPEVV AALERQIPVI PRALMLAELM RFRDGIAIAG

151 THGKTTTTSL TASILGAAGL DPTFVIGGKL NAAGTNARLG KGEYIVAEAD

201 ESDASFLHLT PIMSVVTNID EDHMDTYGHS VEKLHQAFID FIHRMPFYGK

251 AFLCVDSEHV RAILPKVSKP YATYGLDDTA DIYATDIENV GAQMKFTVHV

301 QMKGHEQGSF EVVLNMPGRH NVLNALAAIG VALEVGASVE AIQKGLLGFE

351 GVGRRFQKYG DIKLPNGGTA LLVDDYGHHP VEMAATLAAA RGAYPEKRLV

401 LAFQPHRYTR TRDLFEDFTK VLNTVDALVL TEVYAAGEEP VAAADSRALA

451 RAIRVLGKLE PIYCENVADL PQMLMNVLQD GDVVLNMGAG SINRVPSALL

501 ELSKOI*

The following partial DNA sequence was identified in *N. meningitidis* <SEQ ID 311>:

m092.seg

1 ATGTTTTTTA TTTCAATCCG CTATATATTT GTCAGAAAAC TATGGCGCGC

51 AAACGGTCAG CCCTTTAAAA TAACGCCTTT ACGCATCGAA AATCCACCGG

101 AACGCAACAT TATGATGAAA AATCGAGTTA CCAACATCCA TTTTGTCGGT

151 ATCGGCGGCG TCGGCATGAG CGGCATCGCC GAAGTCTTGC ACAATTTGGG

201 CTTTAAAGTT TCCGGTTCGG ATCAgGCGCG AAATGCCGCT ACCGAGCATT

251 TGGGCAGCCT GGGCATTCAA GTTTATCCCG GCCATACCGC CGAACACGTT

301 AACGGTGCGG ATGTCGTCGT TACCTCTACC GCCGTCAAAA AAGAAAATCC

351 CGAAGTTGTC GCTGCGTTGG AGCAGCAAAT TCCCGTTATT CCGCGCGCCC

401 TGATGTTGGC GGAGTTGATG CGCTTCCGTG ACGGCATCGC CATTGCCGGC

451 ACGCACGGCA AAACCACGAC CACCAGCCTG ACCGCCTCCA TCCTCGGCGC

501 GGCAGGACTT GACCCGACTT TCGTTATCGG CGGCAAACTC AACGCCGCAG

551 GCACTAACGC CCGCTTGGGC AAAGGCGAAT ACATCGTTGC CGAAGCCGAC

601 GAGTCGGATG CATCCTTTCT GCACCTGACA CCGATTATGT CCGTCGTTAC

651 CAATATCGAC GAAGACCATA TGGATACCTA CGGGCACAGC GTCGAAAAAC

701 TGCATCAGGC GTTTATCGAT TTCATCCACC GTATGCCCTT CTACGGCAAA

751 GCCTTTTTGT GTATTGACAG CGAACACGTC CGCGCGATTT TGCCCAAAGT

801 GAGCAAACCT TATGCTACTT ACGGTTTGGA CGATACCGCC GACATCTACG

-continued

```
 851 CCACCGACAT CGAAAACGTC GGCGCGCAAA TGAAATTCAC CGTCCATGTT

 901 CAAATGAAAG GACATGAGCA GGGGTCGTTT GAAGTCGTGC TGAATATGCC

 951 CGGCAGACAC AACGTGCTGA ACGCATTGGC AGCCATCGGC GTGGCGCTGG

1001 AAGTCGGCGC ATCGGTTGAA GCGATCCAAA AAGGCTTGCT CGGCTTTGAA

1051 GGCGTCGGCC GCCGCTTCCA AAAATACGGC GACATCAAGT TGCCAAACGG

1101 CGGGACCGCG CTCTTGGTGG ACGACTACGG ACACCACCCC GTCGAAATGG

1151 CGGCGACCCT TGCCGCCGCA CGCGGCGCGT ATCTGGAAAA ACGTTTGGTA

1201 CTCGCCTTCC AGCCGCACCG CTATACCCGC ACGCGCGATT TGTTTGAAGA

1251 CTTTACCAAA GTCCTCAATA CCGTTGACGC GCTGGTGCTG ACCGAAGTTT

1301 ATGCCGCCGG TGAAGAGCCG ATTGCCGCCG CCGATTCCCG CGCTCTTGCC

1351 CGCGCCATCC GCGTGTTGGG CAAACTCGAG CCGATTTACT GCGAAAACGT

1401 TGCCGATCTG CCCGAAATGC TGTTGAACGT TTTGCAGGAC GGCGACATCG

1451 TGTTGAATAT GGGCGCGGGA AGCATCAACC GCGTCCCCGC CGCGCTGCTG

1501 GCATTGTCGA AACAGATTTG A
```

This corresponds to the amino acid sequence <SEQ ID 312; ORF 092>:

```
m092.pep
   1 MFFISIRYIF VRKLWRANGQ PFKITPLRIE NPPERNIMMK NRVTNIHFVG

  51 IGGVGMSGIA EVLHNLGFKV SGSDQARNAA TEHLGSLGIQ VYPGHTAEHV

 101 NGADVVVTST AVKKENPEVV AALEQQIPVI PRALMLAELM RFRDGIAIAG

 151 THGKTTTTSL TASILGAAGL DPTFVIGGKL NAAGTNARLG KGEYIVAEAD

 201 ESDASFLHLT PIMSVVTNID EDHMDTYGHS VEKLHQAFID FIHRMPFYGK

 251 AFLCIDSEHV RAILPKVSKP YATYGLDDTA DIYATDIENV GAQMKFTVHV

 301 QMKGHEQGSF EVVLNMPGRH NVLNALAAIG VALEVGASVE AIQKGLLGFE

 351 GVGRRFQKYG DIKLPNGGTA LLVDDYGHHP VEMAATLAAA RGAYLEKRLV

 401 LAFQPHRYTR TRDLFEDFTK VLNTVDALVL TEVYAAGEEP IAAADSRALA

 451 RAIRVLGKLE PIYCENVADL PEMLLNVLQD GDIVLNMGAG SINRVPAALL

 501 ALSKQI*
```

Computer analysis of this amino acid sequence gave the following results:

Homology with a Predicted ORF from *N. gonorrhoeae*

ORF 092 shows 96.6% identity over a 506 aa overlap with a predicted ORF (ORF 092.ng) from *N. gonorrhoeae*:

```
m092/g092

                        10        20        30        40        50        60
m092.pep       MFFISIRYIFVRKLWRANGQPFKITPLRIENPPERNIMMKNRVTNIHFVGIGGVGMSGIA
               ||||||||||||||| |||| ||||||| :| |||||||||||:||||||||||||||||
g092           MFFISIRYIFVRKLWCANGQTFKITPLRTKNQPERNIMMKNRVSNIHFVGIGGVGMSGIA
                        10        20        30        40        50        60

                        70        80        90       100       110       120
m092.pep       EVLHNLGFKVSGSDQARNAATEHLGSLGIQVYPGHTAEHVNGADVVVTSTAVKKENPEVV
               ||||||||||||||||||||||||:||||||||||||||||||||||:||||||||||||
g092           EVLHNLGFKVSGSDQARNAATEHLSSLGIQVYPGHTAEHVNGADVVVASTAVKKENPEVV
                        70        80        90       100       110       120
```

-continued

```
                130       140       150       160       170       180
m092.pep   AALEQQIPVIPRALMLAELMRFRDGIAIAGTHGKTTTTSLTASILGAAGLDPTFVIGGKL
           ||||:|||||||||||||||||||||||||||||||||||||||||||||||||||||||
g092       AALERQIPVIPRALMLAELMRFRDGIAIAGTHGKTTTTSLTASILGAAGLDPTFVIGGKL
                130       140       150       160       170       180

                190       200       210       220       230       240
m092.pep   NAAGTNARLGKGEYIVAEADESDASFLHLTPIMSVVTNIDEDHMDTYGHSVEKLHQAFID
           ||||||||||||||||||||||||||||||||||||||||||||||||||||||||||||
g092       NAAGTNARLGKGEYIVAEADESDASFLHLTPIMSVVTNIDEDHMDTYGHSVEKLHQAFID
                190       200       210       220       230       240

                250       260       270       280       290       300
m092.pep   FIHRMPFYGKAFLCIDSEHVRAILPKVSKPYATYGLDDTADIYATDIENVGAQMKFTVHV
           ||||||||||||||:|||||||||||||||||||||||||||||||||||||||||||||
g092       FIHRMPFYGKAFLCVDSEHVRAILPKVSKPYATYGLDDTADIYATDIENVGAQMKFTVHV
                250       260       270       280       290       300

                310       320       330       340       350       360
m092.pep   QMKGHEQGSFEVVLNMPGRHNVLNALAAIGVALEVGASVEAIQKGLLGFEGVGRRFQKYG
           ||||||||||||||||||||||||||||||||||||||||||||||||||||||||||||
g092       QMKGHEQGSFEVVLNMPGRHNVLNALAAIGVALEVGASVEAIQKGLLGFEGVGRRFQKYG
                310       320       330       340       350       360

                370       380       390       400       410       420
m092.pep   DIKLPNGGTALLVDDYGHHPVEMAATLAAARGAYLEKRLVLAFQPHRYTRTRDLFEDFTK
           |||||||||||||||||||||||||||||||||| |||||||||||||||||||||||||
g092       DIKLPNGGTALLVDDYGHHPVEMAATLAAARGAYPEKRLVLAFQPHRYTRTRDLFEDFTK
                370       380       390       400       410       420

                430       440       450       460       470       480
m092.pep   VLNTVDALVLTEVYAAGEEPIAAADSRALARAIRVLGKLEPIYCENVADLPEMLLNVLQD
           ||||||||||||||||||||:|||||||||||||||||||||||||||||||||:||:||||
g092       VLNTVDALVLTEVYAAGEEPVAAADSRALARAIRVLGKLEPIYCENVADLPQMLMNVLQD
                430       440       450       460       470       480

                490       500
m092.pep   GDIVLNMGAGSINRVPAALLALSKQIX
           ||:|||||||||||||:||| ||||||
g092       GDVVLNMGAGSINRVPSALLELSKQIX
                490       500
```

The following partial DNA sequence was identified in *N. meningitidis* <SEQ ID 313>:

```
a092.seq
     1 ATGTTTTTTA TTTCAATCCG CTATATATTT GTCAGAAAAC TATGGCGCGC

    51 AAACGGTCAG CCCTTTAAAA TAACGCCTTT ACGCATCGAA AATCCACCGG

   101 AACGCAACAT TATGATGAAA AATCGAGTGA CCAACATCCA TTTTGTCGGT

   151 ATCGGCGGCG TCGGCATGAG CGGTATCGCC GAAGTCTTGC ACAATTTGGG

   201 TTTTAAAGTT TCCGGTTCGG ATCAGGCGCG AAATGCCGCT ACCGAGCATT

   251 TGGGCAGCCT GGGCATTCAA GTTTATCCCG GCCATACCGC AGAACACGTT

   301 AACGGTGCGG ATGTCGTCGT TACCTCTACC GCCGTCAAAA AAGAAAATCC

   351 CGAAGTTGTC GCTGCGTTGG AGCAGCAAAT TCCCGTTATT CCGCGCGCCC

   401 TGATGTTGGC GGAGTTGATG CGCTTCCGTG ACGGCATCGC CATTGCCGGC

   451 ACGCACGGCA AAACCACGAC CACCAGCCTG ACCGCCTCCA TCCTCGGCGC

   501 GGCAGGACTT GACCCGACTT TCGTTATCGG CGGCAAACTC AACGCCGCAG

   551 GCACCAACGC CCGCTTGGGC AAAGGCGAAT ACATCGTTGC CGAAGCCGAC

   601 GAGTCGGATG CATCCTTTCT GCACCTGACA CCGATTATGT CCGTCGTTAC

   651 CAATATCGAC GAAGACCATA TGGATACCTA CGGGCACAGT GTTGAGAAGC

   701 TGCATCAGGC GTTTATCGAT TTCATCCACC GTATGCCCTT CTACGGCAAA

   751 GCCTTTTTGT GTATTGACAG CGAACACGTC CGCGCGATTT TGCCCAAAGT

   801 GAGCAAACCT TATGCTACTT ACGGTTTGGA CGATACCGCC GACATCTACG

   851 CCACCGACAT CGAAAACGTC GGCGCGCAAA TGAAATTCAC CGTCCATGTT
```

-continued

```
 901 CAAATGAAAG GACATGAGCA GGGGTCGTTT GAAGTCGTGC TGAATATGCC

 951 CGGCAGACAC AACGTGCTGA ACGCATTGGC AGCCATCGGC GTGGCGCTGG

1001 AAGTCGGCGC ATCGGTTGAA GCGATCCAAA AAGGCTTGCT CGGCTTTGAA

1051 GGTGTCGGCC GCCGCTTCCA AAAATACGGC GACATCAAGT TGCCAAACGG

1101 TGGAACCGCG CTCTTGGTGG ACGACTACGG ACACCACCCC GTCGAAATGG

1151 CGGCGACCCT TTCCGCCGCA CGCGGCGCGT ATCCGGAAAA ACGTTTGGTA

1201 CTCGCCTTCC AGCCGCACCG CTATACCCGC ACGCGCGATT TGTTTGAAGA

1251 CTTTACCAAA GTCCTCAATA CCGTTGACGC GCTGGTGCTG ACCGAAGTTT

1301 ATGCCGCCGG TGAAGAGCCG ATTGCCGCCG CTGATTCCCG CGCTCTTGCC

1351 CGCGCCATCC GCGTGTTGGG CAAACTCGAG CCGATTTACT GCGAAAACGT

1401 TGCCGATCTG CCCGAAATGC TGTTGAACGT TTTGCAGGAC GGCGACATCG

1451 TGTTGAATAT GGGTGCGGGA AGCATCAACC GCGTCCCCGC CGCGCTGCTG

1501 GAATTGTCGA AACAGATTTG A
```

This corresponds to the amino acid sequence <SEQ ID 314; ORF 092.a>:

```
a092.pep
   1 MFFISIRYIF VRKLWRANGQ PFKITPLRIE NPPERNIMMK NRVTNIHFVG

  51 IGGVGMSGIA EVLHNLGFKV SGSDQARNAA TEHLGSLGIQ VYPGHTAEHV

 101 NGADVVVTST AVKKENPEVV AALEQQIPVI PRALMLAELM RFRDGIAIAG

 151 THGKTTTTSL TASILGAAGL DPTFVIGGKL NAAGTNARLG KGEYIVAEAD

 201 ESDASFLHLT PIMSVVTNID EDHMDTYGHS VEKLHQAFID FIHRMPFYGK

 251 AFLCIDSEHV RAILPKVSKP YATYGLDDTA DIYATDIENV GAQMKFTVHV

 301 QMKGHEQGSF EVVLNMPGRH NVLNALAAIG VALEVGASVE AIQKGLLGFE

 351 GVGRRFQKYG DIKLPNGGTA LLVDDYGHHP VEMAATLSAA RGAYPEKRLV

 401 LAFQPHRYTR TRDLFEDFTK VLNTVDALVL TEVYAAGEEP IAAADSRALA

 451 RAIRVLGKLE PIYCENVADL PEMLLNVLQD GDIVLNMGAG SINRVPAALL

 501 ELSKQI*
```

m092/a092 99.4% identity over a 506 aa overlap

```
                   10        20        30        40        50        60
m092.pep   MFFISIRYIFVRKLWRANGQPFKITPLRIENPPERNIMMKNRVTNIHFVGIGGVGMSGIA
           ||||||||||||||||||||||||||||||||||||||||||||||||||||||||||||
a092       MFFISIRYIFVRKLWRANGQPFKITPLRIENPPERNIMMKNRVTNIHFVGIGGVGMSGIA
                   10        20        30        40        50        60

                   70        80        90       100       110       120
m092.pep   EVLHNLGFKVSGSDQARNAATEHLGSLGIQVYPGHTAEHVNGADVVVTSTAVKKENPEVV
           ||||||||||||||||||||||||||||||||||||||||||||||||||||||||||||
a092       EVLHNLGFKVSGSDQARNAATEHLGSLGIQVYPGHTAEHVNGADVVVTSTAVKKENPEVV
                   70        80        90       100       110       120

                  130       140       150       160       170       180
m092.pep   AALEQQIPVIPRALMLAELMRFRDGIAIAGTHGKTTTTSLTASILGAAGLDPTFVIGGKL
           ||||||||||||||||||||||||||||||||||||||||||||||||||||||||||||
a092       AALEQQIPVIPRALMLAELMRFRDGIAIAGTHGKTTTTSLTASILGAAGLDPTFVIGGKL
                  130       140       150       160       170       180
```

-continued

```
                190        200        210        220        230        240
m092.pep    NAAGTNARLGFGEYIVAEADESDASFLHLTPIMSVVTNIDEDHMDTYGHSVEKLHQAFID
            ||||||||||||||||||||||||||||||||||||||||||||||||||||||||||||
a092        NAAGTNARLGKGEYIVAEADESDASFLHLTPIMSVVTNIDEDHMDTYGHSVEKLHQAFID
                190        200        210        220        230        240

                250        260        270        280        290        300
m092.pep    FIHRMPFYGKAFLCIDSEHVRAILPKVSKPYATYGLDDTADIYATDIENVGAQMKFTVHV
            ||||||||||||||||||||||||||||||||||||||||||||||||||||||||||||
a092        FIHRMPFYGKAFLCIDSEHVRAILPKVSKPYATYGLDDTADIYATDIENVGAQMKFTVHV
                250        260        270        280        290        300

                310        320        330        340        350        360
m092.pep    QMKGHEQGSFEVVLNMPGRHNVLNALAAIGVALEVGASVEAIQKGLLGFEGVGRRFQKYG
            ||||||||||||||||||||||||||||||||||||||||||||||||||||||||||||
a092        QMKGHEQGSFEVVLNMPGRHNVLNALAAIGVALEVGASVEAIQKGLLGFEGVGRRFQKYG
                310        320        330        340        350        360

                370        380        390        400        410        420
m092.pep    DIKLPNGGTALLVDDYGHHPVEMAATLAAARGAYLEKRLVLAFQPHRYTRTRDLFEDFTK
            |||||||||||||||||||||||||||:|||||| |||||||||||||||||||||||||
a092        DIKLPNGGTALLVDDYGHHPVEMAATLSAARGAYPEKRLVLAFQPHRYTRTRDLFEDFTK
                370        380        390        400        410        420

                430        440        450        460        470        480
m092.pep    VLNTVDALVLTEVYAAGEEPIAAADSRALARAIRVLGKLEPIYCENVADLPEMLLNVLQD
            ||||||||||||||||||||||||||||||||||||||||||||||||||||||||||||
a092        VLNTVDALVLTEVYAAGEEPIAAADSRALARAIRVLGKLEPIYCENVADLPEMLLNVLQD
                430        440        450        460        470        480

                490        500
m092.pep    GDIVLNMGAGSINRVPAALLALSKQIX
            |||||||||||||||||||| ||||||
a092        GDIVLNMGAGSINRVPAALLELSKQIX
                490        500
```

The following partial DNA sequence was identified in *N. gonorrhoeae* <SEQ ID 315>:

```
g093.seq
  1 aTGCAGAATt ttgGCAAAGT ggccgtATTG ATGGGtggtT TTTCCAGCGA

 51 ACGAGAaatc tcgcTGGACA GCgGTACCGC CATTTTGAAC GCCTTAAAAA

101 GCAAAGGCAT AGACGCATAC GCCTTCGACC CTAAGGAAAC GCCGTTATCC

151 GAACTGAAGG AGCGGGGCTT TCAGACGGCA TTCAACATCC TTCACGGTAC

201 TTACGGCGAA GACGGGGCTG TTCAGGGTGC ATTGGAACTG TTGGGCATTC

251 CCTATACCGG CAGCGGTGTC GCCGCCTCCG CCATCGGCAT GGACAAATAC

301 CGCTGCAAAC TGATTTGGCA GGCATTGGGA TTACCCGTTC CCGAGTTCGC

351 CGTACTGTAC GATGATACCG ATTTCGATGC CGTCGAAGAA AAATTGGGTC

401 TGCCGATGTT TGTGAAGCCG GCGGCCGAAG GCAGCAGCgt cggcgtggta

451 aAAGTCAAAG AAAaaggccg TCTGAAAAGC GTTtacgaag aatTGAaaCA

501 CCTTcagggg cgaAAtcatt gccgAacgTT TTATCGGCGG CGGCGAATAT

551 TCCTGCCCCG TCCTGAACGG CAAAGGGCTG CCCGGCATAC ACATCATCCC

601 CGCAACCGAG TTTTACGAct acgaagccaa GtacaaCCGA GACGAcacca

651 tttaTCAATG TCCTTCGGAA GATTTGACCG AAGCCGAAGA AAGCCTGATG

701 CGCGAACTGG CGGTTCGCGG CGCACAGGCA ATCGGTGCGG AAGGCTGCGT

751 GCGCGTCGAT TTCCTCAAAG ATACCGACGG CAAACTCTAT CTGTTGGAAA

801 TCAACACCCT GCCCGGTATG ACCGGCCATA G
```

This corresponds to the amino acid sequence <SEQ ID 316; ORF 093.ng>:

```
g093.pep
     1 MQNFGKVAVL MGGFSSEREI SLDSGTAILN ALKSKGIDAY AFDPKETPLS
    51 ELKERGFQTA FNILHGTYGE DGAVQGALEL LGIPYTGSGV AASAIGMDKY
   101 RCKLIWQALG LPVPEFAVLY DDTDFDAVEE KLGLPMFVKP AAEGSSVGVV
   151 KVKEKGRLKS VYEELKHLQG RNHCRTFYRR RRIFLPRPER QRAARHTHHP
   201 RNRVLRLRSQ VQPRRHHLSM SFGRFDRSRR KPDARTGGSR RTGNRCGRLR
   251 ARRFPQRYRR QTLSVGNQHP ARYDRP*
```

The following partial DNA sequence was identified in *N. meningitidis* <SEQ ID 317>:

```
m093.seq
     1 ATGCAGAATT TTGGCAAAGT GGCCGTATTG ATGGGCGGTT TTTCCAGCGA
    51 ACGAGAAATC TCGCTGGACA GCGGCACCGC CATTTTGAAT GCTTTAAAAA
   101 GCAAAGGCAT AGACGCATAC GCCTTCGATC CTAAAGAAAC CCCATTGTCT
   151 GAATTGAAGG CACAAGGTTT TCAGACGGCA TTCAACATCC TTCACGGTAC
   201 TTACGGCrAA GACGGGGCGG TTCAGGGTGC ATTGGAACTG TTGGGCATTC
   251 CCTATACCGG CAGCGGTGTC GCCGCATCCG CCATCGGCAT GGACAAATAC
   301 CGCTGCAAAC TGATTTGGCA GGCATTGGGA TTGCCCGTTC CCGAGTTCGC
   351 CGTCCTGCAC GACGACACTG ATTTCGATGC CGTCGAAGAA AAATTGGGCC
   401 TGCCGATGTT TGTGAAACCG GCGGCCGAAG GCAGCAGCGT AGGCGTGGTA
   451 AAAGTCAAAG GAAAAGGCCG TCTGAAAAGC GTTTACGAAG AATTGAAACA
   501 CCTTCAGGG. CGAAATCATT GCCGAACGTT TTATCGGCGG CGGCGAATAT
   551 TCCTGCCCCG TCCTGAACGG CAAAGGGCTG CCCGGCATAC ACATCATTCC
   601 CGCAACCGAG TTTTACGACT ACGAAGCCAA GTACAACCGC GACGACACCA
   651 TTTATCAATG TCCTTCGGAA GATTTGACCG AAGCCGAAGA AAGCCTGATG
   701 CGCGAACTGG CGGTTCGCGG CGCGCAGGCA ATCGGTGCGG AAGGCTGCGT
   751 GCGCGTCGAT TTCCTCAAAG ATACCGACGG CAAACTCTAT CTGTTGGAAA
   801 TCAACACCCT GCCCGGTATG ACGAGCCATA G
```

This corresponds to the amino acid sequence <SEQ ID 318; ORF 093>:

```
m093.pep
     1 MQNFGKVAVL MGGFSSEREI SLDSGTAILN ALKSKGIDAY AFDPKETPLS
    51 ELKAQGFQTA FNILHGTYGX DGAVQGALEL LGIPYTGSGV AASAIGMDKY
   101 RCKLIWQALG LPVPEFAVLH DDTDFDAVEE KLGLPMFVKP AAEGSSVGVV
   151 KVKGKGRLKS VYEELKHLQX RNHCRTFYRR RRIFLPRPER QRAARHTHHS
   201 RNRVLRLRSQ VQPRRHHLSM SFGRFDRSRR KPDARTGGSR RAGNRCGRLR
   251 ARRFPQRYRR QTLSVGNQHP ARYDEP*
```

Computer analysis of this amino acid sequence gave the following results:

Homology with a Predicted ORF from *N. gonorrhoeae*

ORF 093 shows 96.7% identity over a 276 aa overlap with a predicted ORF (ORF 093.ng) from *N. gonorrhoeae*:

```
m093/g093

                    10        20        30        40        50        60
m093.pep    MQNFGKVAVLMGGFSSEREISLDSGTAILNALKSKGIDAYAFDPKETPLSELKAQGFQTA
            |||||||||||||||||||||||||||||||||||||||||||||||||||| :|||||
g093        MQNFGKVAVLMGGFSSEREISLDSGTAILNALKSKGIDAYAFDPKETPLSELKERGFQTA
                    10        20        30        40        50        60

                    70        80        90       100       110       120
m093.pep    FNILHGTYGXDGAVQGALELLGIPYTGSGVAASAIGMDKYRCKLIWQALGLPVPEFAVLH
            ||||||||| |||||||||||||||||||||||||||||||||||||||||||||||||:
g093        FNILHGTYGEDGAVQGALELLGIPYTGSGVAASAIGMDKYRCKLIWQALGLPVPEFAVLY
                    70        80        90       100       110       120

                   130       140       150       160       170       180
m093.pep    DDTDFDAVEEKLGLPMFVKPAAEGSSVGVVKVKGKGRLKSVYEELKHLQXRNHCRTFYRR
            |||||||||||||||||||||||||||||||| ||||||||||||||| ||||||||||
g093        DDTDFDAVEEKLGLPMFVKPAAEGSSVGVVKVKEKGRLKSVYEELKHLQGRNHCRTFYRR
                   130       140       150       160       170       180

                   190       200       210       220       230       240
m093.pep    RRIFLPRPERQRAARHTHHSRNRVLRLRSQVQPRRHHLSMSFGRFDRSRRKPDARTGGSR
            |||||||||||||||||| |||||||||||||||||||||||||||||||||||||||||
g093        RRIFLPRPERQRAARHTHHPRNRVLRLRSQVQPRRHHLSMSFGRFDRSRRKPDARTGGSR
                   190       200       210       220       230       240

                   250       260       270
m093.pep    RAGNRCGRLRARRFPQRYRRQTLSVGNQHPARYDEPX
            |:||||||||||||||||||||||||||||||||:||
g093        RTGNRCGRLRARRFPQRYRRQTLSVGNQHPARYDRPX
                   250       260       270
```

The following partial DNA sequence was identified in *N. meningitidis* <SEQ ID 319>:

```
a093.seq
     1 ATGCAGAATT TTGGCAAAGT GGCCGTATTG ATGGGCGGTT TTTCCAGCGA

    51 ACGAGAAATC TCGCTGGACA GCGGCACCGC CATTTTGAAT GCTTTAAAAA

   101 GCAAAGGCAT AGACGCATAC GCCTTCGATC CCAAGGAAAC CCCATTGTCT

   151 GAATTGAAGG CACAAGGTTT TCAGACGGCA TTCAACATCC TTCACGGTAC

   201 TTACGGCGAA GACGGGGCTG TTCAGGGTGC ATTGGAACTG TTGGGCATTC

   251 CCTATACCGG CAGCGGTGTC GCCGCATCCG CCATCGGCAT GGACAAATAC

   301 CGCTGCAAAC TGATTTGGCA GGCATTGGGA TTGCCCGTTC CCGAGTTCGC

   351 CGTCCTGCAC GACGACACTG ATTTCGATGC CGTCGAAGAA AAATTGGGCC

   401 TGCCGATGTT TGTGAAACCG GCGGCCGAAG GCAGCAGCGT AGGCGTGGTA

   451 AAAGTCAAAG GAAAAGGCCG TCTGAAAAGC GTTTACGAAG AATTGAAACA

   501 CTTTCAGGG. CGAAATCATT GCCGAACGGT TTATCGGCGG CGGCGAATAT

   551 TCCTGCCCTG TGTTGAACGG CAAAGGCCTG CCCGGCATAC ACATCATCCC

   601 CGCGACCGAG TTTTATGACT ACGAAGCCAA GTACAACCGC AACGACACCA

   651 TTTATCAATG TCCTTCGGAA GATCTGACCG AAGCCGAAGA AAGCCTGATG

   701 CGCGAACTGG CGGTTCGCGG CGCGCAGGCA ATCGGTGCGG AAGGCTGCGT

   751 GCGCGTCGAT TTCCTCAAAG ATACCGACGG CAAACTCTAT CTGTTGGAAA

   801 TCAACACCCT GCCCGGTATG ACCGGCCATA G
```

This corresponds to the amino acid sequence <SEQ ID 320; ORF 093.a>:

```
a093.pep
    1  MQNFGKVAVL MGGFSSEREI SLDSGTAILN ALKSKGIDAY AFDPKETPLS

   51  ELKAQGFQTA FNILHGTYGE DGAVQGALEL LGIPYTGSGV AASAIGMDKY

  101  RCKLIWQALG LPVPEFAVLH DDTDFDAVEE KLGLPMFVKP AAEGSSVGVV

  151  KVKGKGRLKS VYEELKHFQX RNHCRTVYRR RRIFLPCVER QRPARHTHHP

  201  RDRVL*LRSQ VQPQRHHLSM SFGRSDRSRR KPDARTGGSR RAGNRCGRLR

  251  ARRFPQRYRR QTLSVGNQHP ARYDRP*
```

m093/a093 95.7% identity over a 276 aa overlap

```
                        10        20        30        40        50        60
    m093.pep    MQNFGKVAVLMGGFSSEREISLDSGTAILNALKSKGIDAYAFDPKETPLSELKAQGFQTA
                ||||||||||||||||||||||||||||||||||||||||||||||||||||||||||||
    a093        MQNFGKVAVLMGGFSSEREISLDSGTAILNALKSKGIDAYAFDPKETPLSELKAQGFQTA
                        10        20        30        40        50        60
                        70        80        90       100       110       120
    m093.pep    FNILHGTYGXDGAVQGALELLGIPYTGSGVAASAIGMDKYRCKLIWQALGLPVPEFAVLH
                ||||||||| ||||||||||||||||||||||||||||||||||||||||||||||||||
    a093        FNILHGTYGEDGAVQGALELLGIPYTGSGVAASAIGMDKYRCKLIWQALGLPVPEFAVLH
                        70        80        90       100       110       120
                       130       140       150       160       170       180
    m093.pep    DDTDFDAVEEKLGLPMFVKPAAEGSSVGVVKVKGKGRLKSVYEELKHLQXRNHCRTFYRR
                |||||||||||||||||||||||||||||||||||||||||||||||:|||||||| |||
    a093        DDTDFDAVEEKLGLPMFVKPAAEGSSVGVVKVKGKGRLKSVYEELKHFQXRNHCRTVYRR
                       130       140       150       160       170       180
                       190       200       210       220       230       240
    m093.pep    RRIFLPRPERQRAARHTHHSRNRVLRLRSQVQPRRHHLSMSFGRFDRSRRKPDARTGGSR
                ||||||  |||| |||||| |:||| |||||||:|||||||||| |||||||||||||||
    a093        RRIFLPCVERQRPARHTHHPRDRVLXLRSQVQPQRHHLSMSFGRSDRSRRKPDARTGGSR
                       190       200       210       220       230       240
                       250       260       270
    m093.pep    RAGNRCGRLRARRFPQRYRRQTLSVGNQHPARYDEPX
                ||||||||||||||||||||||||||||||||||:||
    a093        RAGNRCGRLRARRFPQRYRRQTLSVGNQHPARYDRPX
                       250       260       270
```

The following partial DNA sequence was identified in *N. gonorrhoeae* <SEQ ID 321>:

```
g094.seq
    1  ATGTATTCGC CTTTGCCCAA GCGGGCGTTG GTGCCTGCGG CGTTGAGTTT

   51  GCCGCCGATA ACGAAAGTGG GGTCGAGTCC TGCCGCGCCG AGGATGGAGG

  101  CGGTCAGGCT GGTGGTCGTG GTTTTGCCGT GCGTAccggc aatggcgatg

  151  cCGTCACGGA AGCGCATCAG CTCTGCCAGC ATCAAGGCGC GCGGAATAAC

  201  GGGAATTTGC CGCTCCAACG CAgcgacaAC TTCGGgattT TCTTTCTTGA

  251  CGGCGGTAGA GGCAACGACG ACATccgcAC CGTTAACGTG TTCTGCGGTA

  301  TGGCCGGGAT AA
```

This corresponds to the amino acid sequence <SEQ ID 322; ORF 094.ng>:

```
g094.pep
    1  MYSPLPKRAL VPAALSLPPI TKVGSSPAAP RMEAVRLVVV VLPCVPAMAM
```

-continued

```
 51  PSRKRISSAS IKARGITGIC RSNAATTSGF SFLTAVEATT TSAPLTCSAV

101  WPG*
```

The following partial DNA sequence was identified in *N. meningitidis* <SEQ ID 323>:

```
m094.seq
  1  ATGTATTCGC CTTTGCCCAA GCGGGCGTTA GTGCCTGCGG CGTTGAGTTT

 51  GCCGCCGATA ACGAAAGTCG GGTCAAGTCC TGCCGCGCCG AGGATGGAGG

101  CGGTCAGGCT GGTGGTCGTG GTTTTGCCGT GCGTGCCGGC AATGGCGATG

151  CCGTCACGGA AGCGCATCAA CTCCGCCAAC ATCAGGGCGC GCGGAATAAC

201  GGGAATTTGC TGCTCCAACG CAGCGACAAC TTCGGGATTT TCTTTTTTGA

251  CGGCGGTAGA GGTAACGACG ACATCCGCAC CGTTAACGTG TTCGGCGGTA

301  TGGCCGGGAT AA
```

This corresponds to the amino acid sequence <SEQ ID 324; ORF 094>:

```
m094.pep
  1  MYSPLPKRAL VPAALSLPPI TKVGSSPAAP RMEAVRLVVV VLPCVPAMAM

 51  PSRKRINSAN IRARGITGIC CSNAATTSGF SFLTAVEVTT TSAPLTCSAV

101  WPG*
```

Computer analysis of this amino acid sequence gave the following results:

Homology with a Predicted ORF from *N. gonorrhoeae*

ORF 094 shows 95.1% identity over a 103 aa overlap with a predicted ORF (ORF 094.ng) from *N. gonorrhoeae*:

```
m094/g094

                      10        20        30        40        50        60
m094.pep    MYSPLPKRALVPAALSLPPITKVGSSPAAPRMEAVRLVVVVLPCVPAMAMPSRKRINSAN
            ||||||||||||||||||||||||||||||||||||||||||||||||||||||||:||:
g094        MYSPLPKRALVPAALSLPPITKVGSSPAAPRMEAVRLVVVVLPCVPAMAMPSRKRISSAS
                      10        20        30        40        50        60

                      70        80        90       100
m094.pep    IRARGITGICCSNAATTSGFSFLTAVEVTTTSAPLTCSAVWPGX
            |:|||||||| ||||||||||||||||:|||||||||||||||
g094        IKARGITGICRSNAATTSGFSFLTAVEATTTSAPLTCSAVWPGX
                      70        80        90       100
```

The following partial DNA sequence was identified in *N. meningitidis* <SEQ ID 325>:

```
a094.seq
  1  ATGTATTCGC CTTTGCCCAA GCGGGCGTTG GTGCCTGCGG CGTTGAGTTT

 51  GCCGCCGATA ACGAAAGTCG GGTCAAGTCC TGCCGCGCCG AGGATGGAGG

101  CGGTCAGGCT GGTGGTCGTG GTTTTGCCGT GCGTGCCGGC AATGGCGATG

151  CCGTCACGGA AGCGCATCAA CTCCGCCAAC ATCAGGGCGC GCGGAATAAC

201  GGGAATTTGC TGCTCCAACG CAGCGACAAC TTCGGGATTT TCTTTTTTGA

251  CGGCGGTAGA GGTAACGACG ACATCCGCAC CGTTAACGTG TTCTGCGGTA

301  TGGCCGGGAT AA
```

This corresponds to the amino acid sequence <SEQ ID 326; ORF 094.a>:

```
a094.pep
    1  MYSPLPKRAL VPAALSLPPI TKVGSSPAAP RMEAVRLVVV VLPCVPAMAM

   51  PSRKRINSAN IRARGITGIC CSNAATTSGF SFLTAVEVTT TSAPLTCSAV

  101  WPG*
```

m094/a094 100.0% identity over a 103 aa overlap

```
                       10        20        30        40        50        60
   m094.pep    MYSPLPKRALVPAALSLPPITKVGSSPAAPRMEAVRLVVVVLPCVPAMAMPSRKRINSAN
               ||||||||||||||||||||||||||||||||||||||||||||||||||||||||||||
   a094        MYSPLPKRALVPAALSLPPITKVGSSPAAPRMEAVRLVVVVLPCVPAMAMPSRKRINSAN
                       10        20        30        40        50        60

                       70        80        90       100
   m094.pep    IRARGITGICCSNAATTSGFSFLTAVEVTTTSAPLTCSAVWPGX
               ||||||||||||||||||||||||||||||||||||||||||||
   a094        IRARGITGICCSNAATTSGFSFLTAVEVTTTSAPLTCSAVWPGX
                       70        80        90       100
```

The following partial DNA sequence was identified in *N. gonorrhoeae* <SEQ ID 327>:

```
g095.seq
    1  ATGTCCTTTC ATTTGAACAT GGACGGTGAA TTTCATTTGC GCGCCGACGT

   51  TTTCGATGTC GGTGGCGTAG ATGTCGGCGG TATCGTCCAA ACCGTAAGTA

  101  GCATAAGGTT TGCTCACTTT GGGCAAAATC GCGCGGACGT GTTCGCTGTC

  151  AACACACAAA AAGGCTTTGC CGTAGAAGGG CATACGGTGG ATGAAATCGA

  201  TAAACGCCTG ATGCAGTTTT TCGACGCTGT GCCCGTAGGT ATCCATATGG

  251  TCTTCGTCGA TATTGGTAAC GACGGACATA ATCGGGGTCA GTGTAGGAAA

  301  GAGGCATCGG ATCGTCGGCT TCGGCAACGA TGTATTCGCC TTTGCCCAAG

  351  CGGGCGTTGG TGCCTGCGGC GTTGA
```

This corresponds to the amino acid sequence <SEQ ID 328; ORF 095.ng>:

```
g095.pep
    1  MSFHLNMDGE FHLRADVFDV GGVDVGGIVQ TVSSIRFAHF GQNRADVFAV

   51  NTQKGFAVEG HTVDEIDKRL MQFFDAVPVG IHMVFVDIGN DGHNRGQCRK

  101  EASDRRLRQR CIRLCPSGRW CLRR*
```

The following partial DNA sequence was identified in *N. meningitidis* <SEQ ID 329>:

```
m095.seq
    1  ATGTCCTTTC ATTTGAACAT GGACGGTGAA TTTCATTTGC GCGCCGACGT

   51  TTTCGATGTC GGTGGCGTAG ATGTCGGCGG TATCGTCCAA ACCGTAAGTA

  101  GCATAAGGTT TGCTCACTTT GGGCAAAATC GCGCGGACGT GTTCGCTGTC

  151  AATACACAAA AAGGCTTTGC CGTAGAAGGG CATACGGTGG ATGAAATCGA

  201  TAAACGCCTG ATGCAGTTTT TCGACGCTGT GCCCGTAGGT ATCCATATGG

  251  TCTTCGTCGA TATTGGTAAC GACGGACATA ATCGGTGTCA GTGCAGAAAG
```

-continued

```
301  GATGCATCCG ACCGTCGGCT TCGGCAACGA TGTATTCGCC TTTGCCCAAG

351  CGGGCGTTAG TGCCTGCGGC GTTGA
```

This corresponds to the amino acid sequence <SEQ ID 330; ORF 095>:

```
m095.pep
   1  MSFHLNMDGE FHLRADVFDV GGVDVGGIVQ TVSSIRFAHF GQNRADVFAV

  51  NTQKGFAVEG HTVDEIDKRL MQFFDAVPVG IHMVFVDIGN DGHNRCQCRK

 101  DASDRRLRQR CIRLCPSGRX CLRR*
```

Computer analysis of this amino acid sequence gave the following results:

Homology with a Predicted ORF from *N. gonorrhoeae*

ORF 095 shows 97.6% identity over a 124 aa overlap with a predicted ORF (ORF 095.ng) from *N. gonorrhoeae*:

```
m095/g095

                    10        20        30        40        50        60
m095.pep    MSFHLNMDGEFHLRADVFDVGGVDVGGIVQTVSSIRFAHFGQNRADVFAVNTQKGFAVEG
            ||||||||||||||||||||||||||||||||||||||||||||||||||||||||||||
g095        MSFHLNMDGEFHLRADVFDVGGVDVGGIVQTVSSIRFAHFGQNRADVFAVNTQKGFAVEG
                    10        20        30        40        50        60
                    70        80        90       100       110       120
m095.pep    HTVDEIDKRLMQFFDAVPVGIHMVFVDIGNDGHNRCQCRKDASDRRLRQRCIRLCPSGRX
            ||||||||||||||||||||||||||||||||||| ||||:|||||||||||||||||||
g095        HTVDEIDKRLMQFFDAVPVGIHMVFVDIGNDGHNRGQCRKEASDRRLRQRCIRLCPSGRW
                    70        80        90       100       110       120
m095.pep    CLRRX
            |||||
g095        CLRRX
```

The following partial DNA sequence was identified in *N. meningitidis* <SEQ ID 331>:

```
a095.seq
   1  ATGTCCTTTC ATTTGAACAT GGACGGTGAA TTTCATTTGC GCGCCGACGT

  51  TTTCGATGTC GGTGGCGTAG ATGTCGGCGG TATCGTCCAA ACCGTAAGTA

 101  GCATAAGGTT TGCTCACTTT GGGCAAAATC GCGCGGACGT GTTCGCTGTC

 151  AATACACAAA AAGGCTTTGC CGTAGAAGGG CATACGGTGG ATGAAATCGA

 201  TAAACGCCTG ATGCAGCTTC TCAACACTGT GCCCGTAGGT ATCCATATGG

 251  TCTTCGTCGA TATTGGTAAC GACGGACATA ATCGGTGTCA GTGCAGAAAG

 301  GATGCATCCG ACCGTCGGCT TCGGCAACGA TGTATTCGCC TTTGCCCAAG

 351  CGGGCGTTGG TGCCTGCGGC GTTGA
```

This corresponds to the amino acid sequence <SEQ ID 332; ORF 095.a>:

```
a095.pep

   1  MSFHLNMDGE FHLRADVFDV GGVDVGGIVQ TVSSIRFAHF GQNRADVFAV

  51  NTQKGFAVEG HTVDEIDKRL MQLLNTVPVG IHMVFVDIGN DGHNRCQCRK

 101  DASDRRLRQR CIRLCPSGRW CLRR*
```

-continued

```
m095/a095    96.0% identity in 124 aa overlap

                     10        20        30        40        50        60
m095.pep     MSFHLNMDGEFHLRADVFDVGGVDVGGIVQTVSSIRFAHFGQNRADVFAVNTQKGFAVEG
             ||||||||||||||||||||||||||||||||||||||||||||||||||||||||||||
a095         MSFHLNMDGEFHLRADVFDVGGVDVGGIVQTVSSIRFAHFGQNRADVFAVNTQKGFAVEG
                     10        20        30        40        50        60

                     70        80        90       100       110       120
m095.pep     HTVDEIDKRLMQFFDAVPVGIHMVFVDIGNDGHNRCQCRKDASDRRLRQRCIRLCPSGRX
             |||||||||||::::|||||||||||||||||||||||||||||||||||||||||||||
a095         HTVDEIDKRLMQLLNTVPVGIHMVFVDIGNDGHNRCQCRKDASDRRLRQRCIRLCPSGRW
                     70        80        90       100       110       120

m095.pep     CLRRX
             |||||
a095         CLRRX
```

The following partial DNA sequence was identified in *N. gonorrhoeae* <SEQ ID 333>:

```
g096.seq
   1  ATGGCCGGTC ATACCGGGCA GGGTGTTGAT TTCCAACAGA TAGAGTTTGC

  51  CGTCGGTATC TTTGAGGAAA TCGACGCGCA CGCAGCCTTC CGCACCGATT

 101  GCCTGTGCGC CGCGAACCGC CAGTTCGCGC ATCAGGCTTT CTTCGGCTTC

 151  GGTCAAATCT TCCGAAGGAC ATTGAtaaat ggtgTCGTCT CGGttgtaCt

 201  tggcttcgta gTCGTAAAAC TCGGTTGCGG GGATGATGTG TATGCCGGGC

 251  AGCCCTTTGC CGTTCAGGAC GGGGCAGGAA TATTCGCCGC CGCCGATAAA

 301  AcgtTcggca atgaTTtcgc ccctgAAGGT GttTCAattc ttcgtaAACG

 351  CTTTTCAGAc ggcctttTTC TTTGA
```

This corresponds to the amino acid sequence <SEQ ID 334; ORF 096.ng>:

```
g096.pep
   1  MAGHTGQGVD FQQIEFAVGI FEEIDAHAAF RTDCLCAANR QFAHQAFFGF

  51  GQIFRRTLIN GVVSVVLGFV VVKLGCGDDV YAGQPFAVQD GAGIFAAADK

 101  TFGNDFAPEG VSILRKRFSD GLFL*
```

The following partial DNA sequence was identified in *N. meningitidis* <SEQ ID 335>:

```
m096.seq
   1  ATGGCTCGTC ATACCGGGCA GGGTGTTGAT TTCCAACAGA TAGAGTTTGC

  51  CGTCGGTATC TTTGAGGAAA TCGACGCGCA CGCAGCCTTC CGCACCGATT

 101  GCCTGCGCGC CGCGAACCGC CAGTTCGCGC ATCAGGCTTT CTTCGGCTTC

 151  GGTCAAATCT TCCGAAGGAC ATTGATAAAT GGTGTCGTCG CGGTTGTACT

 201  TGGCTTCGTA GTCGTAAAAC TCGGTTGCGG GAATGATGTG TATGCCGGGC

 251  AGCCCTTTGC CGTTCAGGAC GGGGCAGGAA TATTCGCCGC CGCCGATAAA

 301  ACGTTCGGCA ATGATTTCGC CC.TGAAGGT GTTTCAATTC TTCGTAAACG

 351  CTTTTCAGAC GGCCTTTTCC TTTGA
```

This corresponds to the amino acid sequence <SEQ ID 336; ORF 096>:

```
m096.pep

      1  MARHTGQGVD FQQIEFAVGI FEEIDAHAAF RTDCLRAANR QFAHQAFFGF

     51  GQIFRRTLIN GVVAVVLGFV VVKLGCGNDV YAGQPFAVQD GAGIFAAADK

    101  TFGNDFAXEG VSILRKRFSD GLFL*

m096/g096  96.0% identity in 124 aa overlap

                    10        20        30        40        50        60
m096.pep    MARHTGQGVDFQQIEFAVGIFEEIDAHAAFRTDCLRAANRQFAHQAFFGFGQIFRRTLIN
            || |||||||||||||||||||||||||||||||| ||||||||||||||||||||||||
g096        MAGHTGQGVDFQQIEFAVGIFEEIDAHAAFRTDCLCAANRQFAHQAFFGFGQIFRRTLIN
                    10        20        30        40        50        60

                    70        80        90       100       110       120
m096.pep    GVVAVVLGFVVVKLGCGNDVYAGQPFAVQDGAGIFAAADKTFGNDFAXEGVSILRKRFSD
            |||:|||||||||||||:|||||||||||||||||||||||||||||| |||||||||||
g096        GVVSVVLGFVVVKLGCGDDVYAGQPFAVQDGAGIFAAADKTFGNDFAPEGVSILRKRFSD
                    70        80        90       100       110       120

m096.pep    GLFLX
            |||||
g096        GLFLX
```

The following partial DNA sequence was identified in *N. meningitidis* <SEQ ID 337>:

```
a096.seq
   1  ATGGCCGGTC ATACCGGGCA GGGTGTTGAT TTCCAACAGA TAGAGTTTGC

  51  CGTCGGTATC TTTGAGGAAA TCGACGCGCA CGCAGCCTTC CGCACCGATT

 101  GCCTGCGCGC CGCGAACCGC CAGTTCGCGC ATCAGGCTTT CTTCGGCTTC

 151  GGTCAGATCT TCCGAAGGAC ATTGATAAAT GGTGTCGTTG CGGTTGTACT

 201  TGGCTTCGTA GTCATAAAAC TCGGTCGCGG GGATGATGTG TATGCCGGGC

 251  AGGCCTTTGC CGTTCAACAC AGGGCAGGAA TATTCGCCGC CGCCGATAAA

 301  CCGTTCGGCA ATGATTTCGC CCT.GAAAGT GTTTCAATTC TTCGTAAACG

 351  CTTTTCAGAC GGCCTTTTCC TTTGA
```

This corresponds to the amino acid sequence <SEQ ID 338; ORF 096.ng>:

```
a096.pep

          1  MAGHTGQGVD FQQIEFAVGI FEEIDAHAAF RTDCLRAANR QFAHQAFFGF

         51  GQIFRRTLIN GVVAVVLGFV VIKLGRGDDV YAGQAFAVQH RAGIFAAADK

        101  PFGNDFAXES VSILRKRFSD GLFL*

m096/a096   92.7% identity in 124 aa overlap

                    10        20        30        40        50        60
m096.pep    MARHTGQGVDFQQIEFAVGIFEEIDAHAAFRTDCLRAANRQFAHQAFFGFGQIFRRTLIN
            || |||||||||||||||||||||||||||||||||||||||||||||||||||||||||
a096        MAGHTGQGVDFQQIEFAVGIFEEIDAHAAFRTDCLRAANRQFAHQAFFGFGQIFRRTLIN
                    10        20        30        40        50        60

                    70        80        90       100       110       120
m096.pep    GVVAVVLGFVVVKLGCGNDVYAGQPFAVQDGAGIFAAADKTFGNDFAXEGVSILRKRFSD
            |||||||||||:||| |:|||||| ||||  ||||||||| ||||||||:||||||||||
a096        GVVAVVLGFVVIKLGRGDDVYAGQAFAVQHRAGIFAAADKPFGNDFAXESVSILRKRFSD
                    70        80        90       100       110       120

m096.pep    GLFLX
            |||||
a096        GLFLX
```

The following partial DNA sequence was identified in *N. gonorrhoeae* <SEQ ID 339>:

```
g097.seq
     1  ATGGATATTT CAAAACAAAC ATTGCTGGAT AGGGTTTTTA ACCTGAAGGC
    51  AAACGGTACG ACGGTACGTA CCGAGTTGAT GGCGGGTTTG ACGACCTTTT
   101  TGACGATGTG CTACATCGTT ATCGTCAATC CCCTGATTTT GGGCGAGACC
   151  GGAATGGATA TGGGGGCGGT ATTCGTCGCT ACCTGTATCG CATCCGCCAT
   201  CGGCTGTTTT GTCATGGGTT TTATCGGCAA CTATCCGATT GCGCTTGCCC
   251  CGGGGATGGG GCTGAATGCC TATTTCACCT TTGCCGTCGT TAAGGGTATG
   301  GGCGTGCCTT GGCAGGTGGC GTTGGGTGCG GTGTTCATTT CCGGTCTGAT
   351  TTTCATCCTG TTCAGCTTTT TTAAAGTCAG GGAAATGCTG GTCAACGCAC
   401  TGCCTATGGG TTTGAAAATG TCGATTGCCG CCGGTATCGG TTTGTTTTTG
   451  GCACTGATTT CCCTGAAAGG CGCAGGCATT ATCGTTGCCA ATCCGGCAAC
   501  CTTGGTCGGC TTGGGCGATA TTCATCAGCC CAGCGCACTG TTGGCATTGT
   551  TCGGTTTTGT CATGGTGGTC GTATTGGGGT ATTTCCGCGT TCAAGGCGCA
   601  ATCATCATCA CCATTCTGAC GATTACCGTC ATTGCCAGCC TGATGGGTTT
   651  GAACGAGTTT CACGGCGTGG TCGGCGAAGT ACCGGGCATT GCGCCGACCT
   701  TTATGCAGAT GGATTTTAAA GGTCTGTTTA CCGTCAGCAT GGTCAGCGTG
   751  ATTTTCGTCT TCTTCTTGGT CGATTTGTTC GACAGTACCG GAACGCTGGT
   801  CGGCGTATCC CACCGTGCCG GACTGCTGGT GGACGGTAAG CTGCCCCGCC
   851  TGAAACGCGC ACTGCTTGCA GACTCTACCG CCATTGTGGC AGGTGCGGCT
   901  TTGGGTACTT CTTCAACCAC GCCTTATGTG GAAAGCGCGG CGGGCGTATC
   951  GGCAGGCGGA CGGACCGGCC TGACGGCGGT TACCGTCGGC GTATTGATGC
  1001  TGGCGTGTCT GATGTTCTCC CCATTGGCGA AAAGTGTTCC GGTATTTGCC
  1051  ACCGCGCCCG CACTGCTTTA TGTCGGCACG CAGATGCTCC GCAGTGCGAG
  1101  GGACATTGAT TGGGACGATA TGACTGAAGC CGCGCCCGCG TTCCTGACCA
  1151  TTGTCTTCAT GCCGTTTACC TATTCGATTG CAGACGGCAT CGCCTTCGGC
  1201  TTCATCAGCT ATGCCGTGGT CAAACTTTTG TGTCGCCGGA CTGGGGACGT
  1251  GCCGCCTATG GTATGGGTTG TTGCCGTATT GTGGGCATTG AAATTCTGGT
  1301  ATTTGGGCTG A
```

This corresponds to the amino acid sequence <SEQ ID 340; ORF 097.ng>:

```
g097.pep
     1  MDISKQTLLD RVFNLKANGT TVRTELMAGL TTFLTMCYIV IVNPLILGET
    51  GMDMGAVFVA TCIASAIGCF VMGFIGNYPI ALAPGMGLNA YFTFAVVKGM
   101  GVPWQVALGA VFISGLIFIL FSFFKVREML VNALPMGLKM SIAAGIGLFL
   151  ALISLKGAGI IVANPATLVG LGDIHQPSAL LALFGFVMVV VLGYFRVQGA
   201  IIITILTITV IASLMGLNEF HGVVGEVPGI APTFMQMDFK GLFTVSMVSV
   251  IFVFFLVDLF DSTGTLVGVS HRAGLLVDGK LPRLKRALLA DSTAIVAGAA
   301  LGTSSTTPYV ESAAGVSAGG RTGLTAVTVG VLMLACLMFS PLAKSVPVFA
```

-continued

351 TAPALLYVGT QMLRSARDID WDDMTEAAPA FLTIVFMPFT YSIADGIAFG

401 FISYAVVKLL CRRTGDVPPM VWVVAVLWAL KFWYLG*

The following partial DNA sequence was identified in *N. meningitidis* <SEQ ID 341>:

m097.seq

1 ATGGACACTT CAAAACAAAC ACTGTTGGAC GGGATTTTTA AGCTGAAGGC

51 AAACGGTACk ACGGTGCGTA CCGAGTTGAT GGCGGGTTTG ACAACTTTTT

101 TGACGATGTG CTACATCGTT ATCGTCAACC CTCyGATTTT GGGCGAGACC

151 GGCATGGATA TGGGGGCGGT ATTCGTCGCT ACCTGTATCG CGTCTGCCAT

201 CGGCTGTTTT GTTATGGGTT TTGTCGGCAA CTATCCGATT GCACTCGCAC

251 CGGGGATGGG GCTGAATGCC TATTTCACCT TTGCCGTCGT TAAGGGTATG

301 GGCGTGCCTT GGCAGGTTGC GTTGGGTGCG GTGTTCATCT CCGGTCTGAT

351 TTTTATCCTG TTCAGCTTTT TTAAAGTCAG GGAAATGCTG GTCAACGCAC

401 TGCCTATGGG TTTGAAAATG TCGATTGCTG CCGGTATCGG TTTGTTTTTG

451 GCACTGATTT CCCTGAAAGG CGCAGGCATT ATCGTTGCCA ATCCGGCAAC

501 CTTGGTCGGT TTGGGCGATA TTCATCAGCC GTCCGCGTTG TTGGCATTGT

551 TCGGTTTTGC TATGGTGGTC GTATTGGGAC ATTTCCGCGT TCAAGGCGCA

601 ATCATCATCA CCATCTTGAC CATTACCGTC ATTGCCAGCC TGATGGGTTT

651 GAATGAATTT CACGGCATCA TCGGCGAAGT ACCGAGCATT GCGCCGACTT

701 TTATGCAGAT GGATTTTGAA GGCCTGTTTA CCGTCAGCAT GGTCAGTGTG

751 ATTTTCGTCT TCTTCTTGGT CGATCTATTT GACAGTACCG GAACGCTGGT

801 CGGCATATCC CACCGTGCCG GGCTGCTGGT GGACGGTAAG CTGCCCCGCC

851 TGAAACGCGC ACTGCTTGCA GACTCTACCG CCATTGTGGC AGGTGCGGCT

901 TTGGGTACTT CTTCCACCAC GCCTTATGTG GAAAGCGCGG CGGGCGTATC

951 GGCAGGCGGA CGGACCGGCC TGACGGCGGT TACCGTCGGC GTATTGATGC

1001 TCGCCTGCCT GATGTTTTCA CCTTTGGCGA AAAGTGTTCC CGCTTTTGCC

1051 ACCGCGCCCG CCCTGCTTTA TGTCGGCACG CAGATGCTCC GCAGTGCGAG

1101 GGATATTGAT TGGGACGATA TGACGGAAGC CGCACCTGCG TTCCTGACCA

1151 TTGTTTTCAT GCCGTTTACT TATTCGATTG CAGACGGCAT CGCTTTCGGC

1201 TTCATCAGTT ATGCCGTGGT TAAACTTTTA TGCCGCCGCA CCAAAGACGT

1251 TCCGCCTATG GTATGGATTG TTGCCGTATT GTGGGCACTG AAATTCTGGT

1301 ATTTGGGCTG A

This corresponds to the amino acid sequence <SEQ ID 342; ORF 097>:

m097.pep

1 MDTSKQTLLD GIFKLKANGT TVRTELMAGL TTFLTMCYIV IVNPXILGET

51 GMDMGAVFVA TCIASAIGCF VMGFVGNYPI ALAPGMGLNA YFTFAVVKGM

101 GVPWQVALGA VFISGLIFIL FSFFKVREML VNALPMGLKM SIAAGIGLFL

151 ALISLKGAGI IVANPATLVG LGDIHQPSAL LALFGFAMVV VLGHFRVQGA

201 IIITILTITV IASLMGLNEF HGIIGEVPSI APTFMQMDFE GLFTVSMVSV

-continued

```
251  IFVFFLVDLF DSTGTLVGIS HRAGLLVDGK LPRLKRALLA DSTAIVAGAA

301  LGTSSTTPYV ESAAGVSAGG RTGLTAVTVG VLMLACLMFS PLAKSVPAFA

351  TAPALLYVGT QMLRSARDID WDDMTEAAPA FLTIVFMPFT YSIADGIAFG

401  FISYAVVKLL CRRTKDVPPM VWIVAVLWAL KFWYLG*
```

Computer analysis of this amino acid sequence gave the following results:

Homology with a Predicted ORF from *N. gonorrhoeae*

ORF 097 shows 96.3% identity over a 436 aa overlap with a predicted ORF (ORF 097.ng) from *N. gonorrhoeae*:

```
m097/g097

                      10        20        30        40        50        60
m097.pep    MDTSKQTLLDGIFKLKANGTTVRTELMAGLTTFLTMCYIVIVNPXILGETGMDMGAVFVA
            || ||||||| :|:|||||||||||||||||||||||||||||| |||||||||||||||
g097        MDISKQTLLDRVFNLKANGTTVRTELMAGLTTFLTMCYIVIVNPLILGETGMDMGAVFVA
                      10        20        30        40        50        60

                      70        80        90       100       110       120
m097.pep    TCIASAIGCFVMGFVGNYPIALAPGMGLNAYFTFAVVKGMGVPWQVALGAVFISGLIFIL
            ||||||||||||||:|||||||||||||||||||||||||||||||||||||||||||||
g097        TCIASAIGCFVMGFIGNYPIALAPGMGLNAYFTFAVVKGMGVPWQVALGAVFISGLIFIL
                      70        80        90       100       110       120

                     130       140       150       160       170       180
m097.pep    FSFFKVREMLVNALPMGLKMSIAAGIGLFLALISLKGAGIIVANPATLVGLGDIHQPSAL
            ||||||||||||||||||||||||||||||||||||||||||||||||||||||||||||
g097        FSFFKVREMLVNALPMGLKMSIAAGIGLFLALISLKGAGIIVANPATLVGLGDIHQPSAL
                     130       140       150       160       170       180

                     190       200       210       220       230       240
m097.pep    LALFGFAMVVVLGHFRVQGAIIITILTITVIASLMGLNEFHGIIGEVPSIAPTFMQMDFE
            ||||||:||||||:||||||||||||||||||||||||||||::||||:||||||||||:
g097        LALFGFVMVVVLGYFRVQGAIIITILTITVIASLMGLNEFHGVVGEVPGIAPTFMQMDFK
                     190       200       210       220       230       240

                     250       260       270       280       290       300
m097.pep    GLFTVSMVSVIFVFFLVDLFDSTGTLVGISHRAGLLVDGKLPRLKRALLADSTAIVAGAA
            ||||||||||||||||||||||||||||:|||||||||||||||||||||||||||||||
g097        GLFTVSMVSVIFVFFLVDLFDSTGTLVGVSHRAGLLVDGKLPRLKRALLADSTAIVAGAA
                     250       260       270       280       290       300

                     310       320       330       340       350       360
m097.pep    LGTSSTTPYVESAAGVSAGGRTGLTAVTVGVLMLACLMFSPLAKSVPAFATAPALLYVGT
            |||||||||||||||||||||||||||||||||||||||||||||||:||||||||||||
g097        LGTSSTTPYVESAAGVSAGGRTGLTAVTVGVLMLACLMFSPLAKSVPVFATAPALLYVGT
                     310       320       330       340       350       360

                     370       380       390       400       410       420
m097.pep    QMLRSARDIDWDDMTEAAPAFLTIVFMPFTYSIADGIAFGFISYAVVKLLCRRTKDVPPM
            |||||||||||||||||||||||||||||||||||||||||||||||||||||| |||||
g097        QMLRSARDIDWDDMTEAAPAFLTIVFMPFTYSIADGIAFGFISYAVVKLLCRRTGDVPPM
                     370       380       390       400       410       420

                     430
m097.pep    VWIVAVLWALKFWYLGX
            ||:||||||||||||||
g097        VWVVAVLWALKFWYLGX
                     430
```

The following partial DNA sequence was identified in *N. meningitidis* <SEQ ID 343>

```
a097.seq
     1  ATGGACACTT CAAAACAAAC ACTGTTGGAC GGGATTTTTA AGCTGAAGGC

    51  AAACGGTACG ACGGTGCGTA CCGAGTTGAT GGCGGGTTTG ACAACTTTTT

   101  TGACGATGTG CTACATCGTT ATCGTCAACC CTCTGATTTT GGGCGAGACC

   151  GGCATGGATA TGGGGGCGGT ATTCGTCGCT ACCTGTATCG CGTCTGCCAT
```

-continued

```
 201  CGGCTGTTTT GTTATGGGTT TTGTCGGCAA CTATCCGATT GCACTCGCAC
 251  CGGGGATGGG GCTGAATGCC TATTTCACCT TTGCCGTCGT TAAGGGTATG
 301  GGCGTGCCTT GGCAGGTTGC GTTGGGTGCG GTGTTCATCT CCGGTCTGAT
 351  TTTCATCCTG TTCAGCTTTT TTAAAGTCAG GGAAATGCTG GTCAACGCAC
 401  TGCCTATGGG TTTGAAAATG TCGATTGCTG CCGGTATCGG TTTGTTTTTG
 451  GCACTGATTT CCCTGAAAGG CGCAGGCATT ATCGTTGCCA ATCCGGCAAC
 501  CTTGGTCGGC TTGGGCGATA TTCATCAGCC GTCCGCGTTG TTGGCACTGT
 551  TCGGTTTTGC CATGGTGGTC GTATTGGGAC ATTTCCGCGT TCAAGGCGCA
 601  ATCATCATCA CCATTTTGAC GATTACCGTC ATTGCCAGCC TGATGGGTTT
 651  GAACGAATTT CACGGCATCA TCGGCGAAGT GCCGAGCATT GCGCCGACTT
 701  TTATGCAGAT GGATTTTAAA GGGTTGTTTA CCGTCAGCAT GGTCAGCGTG
 751  ATTTTCGTCT TTTTCCTAGT CGATCTGTTC GACAGTACCG GAACACTGGT
 801  CGGTGTATCG CATCGTGCCG GACTGCTGGT GGACGGTAAG CTGCCCCGCC
 851  TGAAACGCGC ACTGCTTGCA GACTCTACCG CTATTGTGGC AGGTGCGGCT
 901  TTGGGTACTT CTTCAACCAC GCCTTATGTG GAAAGTGCGG CGGGCGTATC
 951  GGCAGGCGGG CGGACAGGTC TGACGGCGGT TACCGTCGGC GTATTGATGC
1001  TCGCCTGCCT GATGTTTTCA CCTTTGGCGA AAAGTGTTCC CGCTTTTGCC
1051  ACCGCGCCCG CCCTGCTTTA TGTCGGCACG CAGATGCTCC GCAGTGCGAG
1101  GGACATCGAT TGGGACGATA TGACGGAAGC CGCACCCGCA TTCCTGACCA
1151  TTGTCTTCAT GCCGTTTACC TATTCGATTG CAGACGGCAT CGCTTTCGGC
1201  TTCATCAGTT ATGCCGTGGT TAAACTTTTA TGCCGCCGCA CCAAAGACGT
1251  TCCGCCTATG GTATGGATTG TTGCCGTATT GTGGGCACTG AAATTCTGGT
1301  ATTTGGGCTG A
```

This corresponds to the amino acid sequence <SEQ ID 344; ORF 097.a>:

```
a097.pep

      1  MDTSKQTLLD GIFKLKANGT TVRTELMAGL TTFLTMCYIV IVNPLILGET
     51  GMDMGAVFVA TCIASAIGCF VMGFVGNYPI ALAPGMGLNA YFTFAVVKGM
    101  GVPWQVALGA VFISGLIFIL FSFFKVREML VNALPMGLKM SIAAGIGLFL
    151  ALISLKGAGI IVANPATLVG LFGIHQPSAL LALFGFAMVV VLGHFRVQGA
    201  IIITILTITV IASLMGLNEF HGIIGEVPSI APTFMQMDFK GLFTVSMVSV
    251  IFVFFLVDLF DSTGTLVGVS HRAGLLVDGK LPRLKRALLA DSTAIVAGAA
    301  LGTSSTTPYV ESAAGVSAGG RTGLTAVTVG VLMLACLMFS PLAKSVPAFA
    351  TAPALLYVGT QMLRSARDID WDDMTEAAPA FLTIVFMPFT YSIADGIAFG
    401  FISYAVVKLL CRRTKDVPPM VWIVAVLWAL KFWYLG*

m097/a097   99.3% identity in 436 aa overlap

                    10        20        30        40        50        60
m097.pep    MDTSKQTLLDGIFKLKANGTTVRTELMAGLTTFLTMCYIVIVNPXILGETGMDMGAVFVA
            |||||||||||||||||||||||||||||||||||||||||||| |||||||||||||||
a097        MDTSKQTLLDGIFKLKANGTTVRTELMAGLTTFLTMCYIVIVNPLILGETGMDMGAVFVA
                    10        20        30        40        50        60
```

-continued

```
                 70        80        90       100       110       120
m097.pep   TCIASAIGCFVMGFVGNYPIALAPGMGLNAYFTFAVVKGMGVPWQVALGAVFISGLIFIL
           ||||||||||||||||||||||||||||||||||||||||||||||||||||||||||||
a097       TCIASAIGCFVMGFVGNYPIALAPGMGLNAYFTFAVVKGMGVPWQVALGAVFISGLIFIL
                 70        80        90       100       110       120

                130       140       150       160       170       180
m097.pep   FSFFKVREMLVNALPMGLKMSIAAGIGLFLALISLKGAGIIVANPATLVGLGDIHQPSAL
           ||||||||||||||||||||||||||||||||||||||||||||||||||||||||||||
a097       FSFFKVREMLVNALPMGLKMSIAAGIGLFLALISLKGAGIIVANPATLVGLGDIHQPSAL
                130       140       150       160       170       180

                190       200       210       220       230       240
m097.pep   LALFGFAMVVVLGHFRVQGAIIITILTITVIASLMGLNEFHGIIGEVPSIAPTFMQMDFE
           |||||||||||||||||||||||||||||||||||||||||||||||||||||||||||:
a097       LALFGFAMVVVLGHFRVQGAIIITILTITVIASLMGLNEFHGIIGEVPSIAPTFMQMDFK
                190       200       210       220       230       240

                250       260       270       280       290       300
m097.pep   GLFTVSMVSVIFVFFLVDLFDSTGTLVGISHRAGLLVDGKLPRLKRALLADSTAIVAGAA
           |||||||||||||||||||||||||||:||||||||||||||||||||||||||||||||
a097       GLFTVSMVSVIFVFFLVDLFDSTGTLVGVSHRAGLLVDGKLPRLKRALLADSTAIVAGAA
                250       260       270       280       290       300

                310       320       330       340       350       360
m097.pep   LGTSSTTPYVESAAGVSAGGRTGLTAVTVGVLMLACLMFSPLAKSVPAFATAPALLYVGT
           ||||||||||||||||||||||||||||||||||||||||||||||||||||||||||||
a097       LGTSSTTPYVESAAGVSAGGRTGLTAVTVGVLMLACLMFSPLAKSVPAFATAPALLYVGT
                310       320       330       340       350       360

                370       380       390       400       410       420
m097.pep   QMLRSARDIDWDDMTEAAPAFLTIVFMPFTYSIADGIAFGFISYAVVKLLCRRTKDVPPM
           ||||||||||||||||||||||||||||||||||||||||||||||||||||||||||||
a097       QMLRSARDIDWDDMTEAAPAFLTIVFMPFTYSIADGIAFGFISYAVVKLLCRRTGDVPPM
                370       380       390       400       410       420

                430
m097.pep   VWIVAVLWALKFWYLGX
           ||||||||||||||||
a097       VWIVAVLWALKFWYLGX
                430
```

The following partial DNA sequence was identified in *N. gonorrhoeae* <SEQ ID 345>:

```
g098.seq
    1  ATGACCGCCG ACGGTCTCTT CGTCGCTTTC AACTTCAATA CGTTTGCCGT

   51  TGTGCGAATA TTGATACCAG TACAGCAGGA TGCTGCCCAG GCTGGCGATC

  101  AGTTTGTCGG CGATGTCGCG CGCTTCGCTG TCGGGATGGC TTTCGCGTTC

  151  GGGATGAACG CAGCCGAGCA TGGACACGCC GGTACGCATC ACGTCCATCG

  201  GATGGGTATG TGCAGGCAGG CTTTCCAAAA CTTTAATCAC ACGGATAGGC

  251  AGGCCGCGCA TGGATTTGAG CTTGGTTTTA TAAGCGGCCA GCTCGAATTT

  301  GTTGGGCAGA TGGCCGTGAA TCAGCAAGTG TGCGACTTCT TCAAACTCGC

  351  ATTTTTGTGC CAAATTAGAA TGTCGTAA
```

This corresponds to the amino acid sequence <SEQ ID 346; ORF 098.ng>:

```
g098.pep
    1  MTADGLFVAF NFNTFAVVRI LIPVQQDAAQ AGDQFVGDVA RFAVGMAFAF

   51  GMNAAEHGHA GTHHVHRMGM CRQAFQNFNH TDRQAAHGFE LGFISGQLEF

  101  VGQMAVNQQV CDFFKLAFLC QIRMS*
```

The following partial DNA sequence was identified in *N. meningitidis* <SEQ ID 347>:

```
m098.seq
    1  ATGACCGCCG ATGGTCTCTT CGTCGCTTTC AACCTCAATG CGTTTGCCGT

   51  TGTGCGAATA TTGATACCAG TACAAGAGGA TGCTGCCGAG GCTGGCGATC

  101  AGTTTGTCGG CGATGTCGCG CGCTTCACTT TCCGGATGGC TTTCACGTTC

  151  AGGATGAACG CAGCCCAGCA TGGATACGCC GGTACGCATT ACGTCCATCG

  201  GATGGGTATG TGCAGGCAGG CTTTCCAAAA CTTTAATCAC ACGGATAGGC

  251  AGGCCGCGCA TGGATTTGAG CTTGGTTTTA TAAGCGGCCA GCTCGAATTT

  301  GTTGGGCAGA TGGCCGTGAA TCAGCAGGTG GGCGACTTCT TCAAACTCGC

  351  ATTTTTGTGC CAAATCAGAA TGTCGTAA
```

This corresponds to the amino acid sequence <SEQ ID 348; ORF 098>:

```
m098.pep.
    1  MTADGLFVAF NLNAFAVVRI LIPVCEDAAE AGDQFVGDVA RFTFRMAFTF

   51  RMNAAQHGYA GTHYVHRMGM CRQAFQNFNH TDRQAAHGFE LGFISGQLEF

  101  VGQMAVNQQV GDFFKLAFLC QIRMS*
```

Computer analysis of this amino acid sequence gave the following results:

Homology with a Predicted ORF from *N. gonorrhoeae*

ORF 098 shows 89.6% identity over a 125 aa overlap with a predicted ORF (ORF 098.ng) from *N. gonorrhoeae*:

```
m098/g098

                     10        20        30        40        50        60
m098.pep    MTADGLFVAFNLNAFAVVRILIPVQEDAAEAGDQFVGDVARFTFRMAFTFRMNAAQHGYA
            |||||||||||:|:|||||||||||:|||:||||||||||||:  |||:| ||||:||:|
g098        MTADGLFVAFNFNTFAVVRILIPVQQDAAQAGDQFVGDVARFAVGMAFAFGMNAAEHGHA
                     10        20        30        40        50        60

                     70        80        90       100       110       120
m098.pep    GTHYVHRMGMCRQAFQNFNHTDRQAAHGFELGFISGQLEFVGQMAVNQQVGDFFKLAFLC
            |||:||||||||||||||||||||||||||||||||||||||||||||||| ||||||||
g098        GTHHVHRMGMCRQAFQNFNHTDRQAAHGFELGFISGQLEFVGQMAVNQQVCDFFKLAFLC
                     70        80        90       100       110       120

m098.pep    QIRMSX
            ||||||
g098        QIRMSX
```

The following partial DNA sequence was identified in *N. meningitidis* <SEQ ID 349>:

```
a098.seq
    1  ATGACCGCCG ATGGTCTCTT CGTCGCTTTC AACCTCAATG CGTTTGCCGT

   51  TGTGCGAATA TTGATACCAG TACAAGAGGA TGCTGCCGAG GCTGGCGATC

  101  AGTTTGTCGG CGATGTCGCG CGCTTCACTT TCCGGATGGC TTTCACGTTC

  151  AGGATGAACG CAGCCCAGCA TGGATACGCC GGTACGCATT ACGTCCATCG

  201  GATGGGTATG TGCAGGCAGG CTTTCCAAAA CTTTAATCAC ACGGATAGGC

  251  AGGCCGCGCA TGGATTTGAG CTTGGTTTTA TAAGCGGCCA GCTCGAATTT

  301  GTTGGGCAGA TGGCCGTGAA TCAGCAGGTG GGCGACTTCT TCAAACTCGC

  351  ATTTTTGTGC CAAATCAGAA TGTCGTAA
```

This corresponds to the amino acid sequence <SEQ ID 350; ORF 098.a>:

```
a098.pep

         1  MTADGLFVAF NLNAFAVVRI LIPVQEDAAE AGDQFVGDVA RFTFRMAFTF

        51  RMNAAQHGYA GTHYVHRMGM CRQAFQNFNH TDRQAAHGFE LGFISGQLEF

       101  VGQMAVNQQV GDFFKLAFLC QIRMS*

m098/a098   100.0% identity in 125 aa overlap

                    10        20        30        40        50        60
m098.pep    MTADGLFVAFNLNAFAVVRILIPVQEDAAEAGDQFVGDVARFTFRMAFTFRMNAAQHGYA
            ||||||||||||||||||||||||||||||||||||||||||||||||||||||||||||
a098        MTADGLFVAFNLNAFAVVRILIPVQEDAAEAGDQFVGDVARFTFRMAFTFRMNAAQHGYA
                    10        20        30        40        50        60
                    70        80        90       100       110       120
m098.pep    GTHYVHRMGMCRQAFQNFNHTDRQAAHGFELGFISGQLEFVGQMAVNQQVGDFFKLAFLC
            ||||||||||||||||||||||||||||||||||||||||||||||||||||||||||||
a098        GTHYVHRMGMCRQAFQNFNHTDRQAAHGFELGFISGQLEFVGQMAVNQQVGDFFKLAFLC
                    70        80        90       100       110       120
m098.pep    QIRMSX
            ||||||
a098        QIRMSX
```

The following partial DNA sequence was identified in *N. gonorrhoeae* <SEQ ID 351>:

```
g099.seg
   1 ATGCTGGGAC GCGCGTCCAT GATGCGCCTG CCCGATATTG TCGGCGTGGA

  51 GCTGACGGGC AAACGGCAGG CGGGCATTAC TGCCACAGAC ATCGTGTTGG

 101 CACTGACCGA ATTCTTGCGT AAAGAGCGCG TGGTCGGGGC GTTTGTCGAA

 151 TTTTTCGGCG AGGGCGCGAG AAGCCTGTCT ATCGGCGACC GCGCGACCAT

 201 TTCCAACATG ACGCCGGAGT TCGGCGCGAC TGCCGCCATG TTCGCCATCG

 251 ACGCGCAAAC TATTGATTAT TTGAAACTGA CCGGACGTGA CGACGCGCAG

 301 GTGAAATTGG TGGAAACCTA CGCCAAAACC GCAGGCTTAT GGGCAGGTGG

 351 CTTGAAAACC GCCGTTTATC CGCGCGTTTT GAAATTTGAT TTGAGCAGCG

 401 TAACGCGCAA TATGGCAGGC CCGAGCAACC CGCACGCGCG TTTTGCCACC

 451 GCCGATTTGG CGGCGAAAGG GCTGGCGAAG CCTTACGAAG AGCCTTCAGA

 501 CGGCCAAATG CCTGACGGTG CAGTGATTAT TGCCGCGATT ACTTCGTGTA

 551 CCAATACTTC CAACCCGCGC AACGTTGTCG CCGCCGCACT GTTGGCACGC

 601 AATGCCAACC GCCTCGGCTT GAAACGCAAA CCTTGGGTGA AATCTTCGTT

 651 TGCCCCGGGT TCAAAAGTAG CCGGAATCTA TTTGAAAGAA GCAGGCTTGT

 701 TGCCCGAAAT GGAAAAACTC GGCTTCGGTA TCGTCGCCTT CGCATGTACC

 751 ACCTGTAACG GCATGAgcgG CGCGCTcgaC CCGAAAATCC AACAAGAAAT

 801 CATCGACCGC GAtttgtacg cCACCGCCGT ATTGTCAGGC AACCGCAACT

 851 TCGACGGCCG TATCCATCCG TATGCGAAAC AGGCTTTCCT CGCTTCGCCT

 901 CCTTTGGTCG TTGCCTACGC ATTGGCAGGT AGCATCCGTT TCGATATTGA

 951 AAACGACGTA CTCGGCGTTG CAGACGGCCG CGAAATCCGC CTGAAAGATA

1001 TCTGGCCGAC AGACGAAGAA ATCGATGCCA TCGTTGCCGA ATATGTGAAA

1051 CCGCAACAAT TCCGCGACAT TTATATCCCG ATGTCCGACA CCGGCACAGC

1101 GCAAAAAGCA CCAAGCCCGC TGTACGACTG GCGACCGATG TCCACCTACA
```

-continued

```
1151 TCCGCCGTCC GCCCTATTGG GAAGGCGCAC TGGCAGGGGA ACGTACATTA
1201 AGAGGTATGC GTCCGCCGGC GATTTTGCCC GACAACATCA CCACCGACCA
1251 CATCTCgcca tCCAATGCGA TTTTGGCCGG cagTGCcgca ggtgaATATT
1301 TGGCGAAAAT GGGTTTGCCT GAAGAagaCT TCAACTCTTA CGCAACCCAC
1351 CGCGGCGACC ACTTGACCGC CCAACGCGCA ACCTTCGCCA ATCCGAAACT
1401 GTTTAACGAA ATGGTGAGAA ACGAAGACGG CAGCGTACGC CAAGGTtcgt
1451 tggcacgcgT tgaacCAGAA GGCCAAACCA TGCGCATGTG GGAAGCCATC
1501 GAAACCTATA TGAACCGCAA ACAGCCGCTT ATCATCATTG CCGGTGCGGA
1551 CTATGGTCAA GGCTCAAGCC GCGACTGGGC GGCGAAGGGC GTGCGGCTGG
1601 CGGGTGTGGA AGCCATCGCC GCCGAAGGTT TCGAGCGCAT CCACCGCACC
1651 AACCTCATCG GCATGGGCGT CTTGCCGCTG CAATTCAAAC CCGGCACCAA
1701 CCGCCATACC CTGCAACTGG ACGGTACGGA AACCTACGAC GTTGTCGGCG
1751 AACGCACACC GCGCTGCGGC CTGACCCTCG TGATTCACCG TAAAAACGGA
1801 GAAACCGTCG AAGTTCCGGT TACCTGCCGC CCCGATACCG CAGAAGAAGC
1851 ATTGGTATAT GAAGCCGGCG GCGTATTGCA ACGGTTTGCA CAGGACTTTT
1901 TGGAAGGGAA CGCGGCTTAG
```

This corresponds to the amino acid sequence <SEQ ID 352; ORF 099.ng>:

```
g099.pep
  1 MLGRASMMRL PDIVGVELTG KRQAGITATD IVLALTEFLR KERVVGAFVE
 51 FFGEGARSLS IGDRATISNM TPEFGATAAM FAIDAQTIDY LKLTGRDDAQ
101 VKLVETYAKT AGLWAGGLKT AVYPRVLKFD LSSVTRNMAG PSNPHARFAT
151 ADLAAKGLAK PYEEPSDGQM PDGAVIIAAI TSCTNTSNPR NVVAAALLAR
201 NANRLGLKRK PWVKSSFAPG SKVAGIYLKE AGLLPEMEKL GFGIVAFACT
251 TCNGMSGALD PKIQQEIIDR DLYATAVLSG NRNFDGRIHP YAKQAFLASP
301 PLVVAYALAG SIRFDIENDV LGVADGREIR LKDIWPTDEE IDAIVAEYVK
351 PQQFRDIYIP MSDTGTAQKA PSPLYDWRPM STYIRRPPYW EGALAGERTL
401 RGMRPPAILP DNITTDHISP SNAILAGSAA GEYLAKMGLP EEDFNSYATH
451 RGDHLTAQRA TFANPKLFNE MVRNEDGSVR QGSLARVEPE GQTMRMWEAI
501 ETYMNRKQPL IIIAGADYGQ GSSRDWAAKG VRLAGVEAIA AEGFERIHRT
551 NLIGMGVLPL QFKPGTNRHT LQLDGTETYD VVGERTPRCG LTLVIHRKNG
601 ETVEVPVTCR PDTAEEALVY EAGGVLQRFA QDFLEGNAA*
```

The following partial DNA sequence was identified in *N. meningitidis* <SEQ ID 353>:

```
m099.seq
  1 ATGCTGGGAC GCGCGTCCAT GATGCGCCTG CCCGATATTG TCGGCGTTGA
 51 GCTGAACGGC AAACGGCAGG CGGGCATTAC GGCGACGGAT ATTGTGTTGG
101 CACTGACCGA GTTTCTGCGC AAAGAACGCG TGGTCGGGGC GTTTGTCGAA
151 TTCTTCGGCG AGGGCGCGAG AAGCCTGTCT ATCGGCGACC GCGCGACCAT
201 TTCCAACATG ACGCCGGAGT TCGGCGCGAC TGCCGCGATG TTCGCTATTG
```

-continued

```
 251  ATGAGCAAAC CATTGATTAT TTGAAACTGA CCGGACGCGA CGACGCGCAG
 301  GTGAAATTGG TGGAAACCTA CGCCAAAACC GCAGGCTTGT GGGCAGATGC
 351  CTTGAAAACC GCCGTTTATC CTCGCGTTTT GAAATTTGAT TTGAGCAGCG
 401  TAACGCGCAA TATGGCAGGC CCAAGTAACC CGCATGCCCG TTTTGCGACC
 451  GCCGATTTGG CGGCGAAAGG GCTGGCGAAG CCTTACGAAG AGCCTTCGGA
 501  CGGCCAAATG CCCGACGGCT CGGTCATCAT CGCCGCGATT ACCAGTTGCA
 551  CCAACACTTC CAACCCGCGC AACGTTGTTG CCGCCGCGCT CTTGGCACGC
 601  AATGCCAACC GTCTCGGCTT GAAACGCAAA CCTTGGGTGA AATCTTCGTT
 651  TGCCCCGGGT TCAAAAGTAG CCGAAATCTA TTTGAAAGAA GCGGGCCTGT
 701  TGCCCGAAAT GGAAAAACTC GGCTTCGGTA TCGTCGCCTT CGCCTGCACC
 751  ACCTGCAACG GCATGAGTGG CGCGCTGGAT CCGAAAATCC AGAAAGAAAT
 801  CATCGACCGC GATTTGTACG CCACCGCCGT ATTATCAGGC AACCGCAACT
 851  TCGACGGCCG TATCCACCCG TATGCGAAAC AGGCTTTCCT CGCTTCGCCT
 901  CCGTTGGTCG TTGCCTACGC GCTGGCAGGC AGTATCCGTT TCGATATTGA
 951  AAACGACGTA CTCGGCGTTG CAGACGGCAA GGAAATCCGC CTGAAAGACA
1001  TTTGGCCTGC CGATGAAGAA ATCGATGCCG TCGTTGCCGA ATATGTGAAA
1051  CCGCAGCAGT TCCGCGATGT GTATGTACCG ATGTTCGACA CCGGCACAGC
1101  GCAAAAAGCA CCCAGTCCGC TGTACGATTG GCGTCCGATG TCCACCTACA
1151  TCCGCCGTCC GCCTTACTGG GAAGGCGCGC TGGCAGGGGA ACGCACATTA
1201  AGAGGTATGC GTCCGCTGGC GATTTTGCCC GACAACATCA CCACCGACCA
1251  CCTCTCGCCG TCCAATGCGA TTTTGGCCGT CAGTGCCGCA GGCGAGTATT
1301  TGGCGAAAAT GGGTTTGCCT GAAGAAGACT TCAACTCTTA CGCAACCCAC
1351  CGCGGCGACC ACTTGACCGC CCAACGCGCT ACCTTCGCCA ATCCGAAACT
1401  GTTTAACGAA ATGGTGAAAA ACGAAGACGG CAGCGTGCGC CAAGGCTCGT
1451  TCGCCCGCGT CGAACCCGAA GGCGAAACCA TGCGCATGTG GGAAGCCATC
1501  GAAACCTATA TGAACCGCAA ACAGCCGCTC ATCATCATTG CCGGTGCGGA
1551  CTATGGTCAA GGCTCAAGCC GCGACTGGGC TGCAAAAGGC GTACGCCTCG
1601  CCGGCGTAGA AGCGATTGTT GCCGAAGGCT TCGAGCGTAT CCACCGCACC
1651  AACCTTATCG GCATGGGCGT GTTGCCGCTG CAGTTCAAAC CCGACACCAA
1701  CCGCCATACC CTGCAACTGG ACGGTACGGA AACCTACGAC GTGGTCGGCG
1751  AACGCACACC GCGCTGCGAC CTGACCCTCG TGATTCACCG TAAAAACGGC
1801  GAAACCGTTG AAGTTCCCGT TACCTGCTGC CTCGATACTG CAGAAGAAGT
1851  ATTGGTATAT GAAGCCGGCG GCGTGTTGCA ACGGTTTGCA CAGGATTTTT
1901  TGGAAGGGAA CGCGGCTTAG
```

This corresponds to the amino acid sequence <SEQ ID 354; ORF 099>:

```
m099.pep
   1  MLGRASMMRL PDIVGVELNG KRQAGITATD IVLALTEFLR KERVVGAFVE
  51  FFGEGARSLS IGDRATISNM TPEFGATAAM FAIDEQTIDY LKLTGRDDAQ
 101  VKLVETYAKT AGLWADALKT AVYPRVLKFD LSSVTRNMAG PSNPHARFAT
```

-continued

```
151  ADLAAKGLAK PYEEPSDGQM PDGSVIIAAI TSCTNTSNPR NVVAAALLAR

201  NANRLGLKRK PWVKSSFAPG SKVAEIYLKE AGLLPEMEKL GFGIVAFACT

251  TCNGMSGALD PKIQKEIIDR DLYATAVLSG NRNFDGRIHP YAKQAFLASP

301  PLVVAYALAG SIRFDIENDV LGVADGKEIR LKDIWPADEE IDAVVAEYVK

351  PQQFRDVYVP MFDTGTAQKA PSPLYDWRPM STYIRRPPYW EGALAGERTL

401  RGMRPLAILP DNITTDHLSP SNAILAVSAA GEYLAKMGLP EEDFNSYATH

451  RGDHLTAQRA TFANPKLFNE MVKNEDGSVR QGSFARVEPE GETMRMWEAI

501  ETYMNRKQPL IIIAGADYGQ GSSRDWAAKG VRLAGVEAIV AEGFERIHRT

551  NLIGMGVLPL QFKPDTNRHT LQLDGTETYD VVGERTPRCD LTLVIHRKNG

601  ETVEVPVTCC LDTAEEVLVY EAGGVLQRFA QDFLEGNAA*
```

Computer analysis of this amino acid sequence gave the following results:

Homology with a Predicted ORF from *N. gonorrhoeae*

ORF 099 shows 96.2% identity over a 639 aa overlap with a predicted ORF (ORF 099.ng) from *N. gonorrhoeae*:

```
m099/g099

                    10        20        30        40        50        60
m099.pep    MLGRASMMRLPDIVGVELNGKRQAGITATDIVLALTEFLRKERVVGAFVEFFGEGARSLS
            ||||||||||||||||||:|||||||||||||||||||||||||||||||||||||||||||
g099        MLGRASMMRLPDIVGVELTGKRQAGITATDIVLALTEFLRKERVVGAFVEFFGEGARSLS
                    10        20        30        40        50        60

                    70        80        90       100       110       120
m099.pep    IGDRATISNMTPEFGATAAMFAIDEQTIDYLKLTGRDDAQVKLVETYAKTAGLWADALKT
            |||||||||||||||||||||||| |||||||||||||||||||||||||||||| :|||
g099        IGDRATISNMTPEFGATAAMFAIDAQTIDYLKLTGRDDAQVKLVETYAKTAGLWAGGLKT
                    70        80        90       100       110       120

                   130       140       150       160       170       180
m099.pep    AVYPRVLKFDLSSVTRNMAGPSNPHARFATADLAAKGLAKPYEEPSDGQMPDGSVIIAAI
            |||||||||||||||||||||||||||||||||||||||||||||||||||||:||||||
g099        AVYPRVLKFDLSSVTRNMAGPSNPHARFATADLAAKGLAKPYEEPSDGQMPDGAVIIAAI
                   130       140       150       160       170       180

                   190       200       210       220       230       240
m099.pep    TSCTNTSNPRNVVAAALLARNANRLGLKRKPWVKSSFAPGSKVAEIYLKEAGLLPEMEKL
            ||||||||||||||||||||||||||||||||||||||||||| ||||||||||||||||
g099        TSCTNTSNPRNVVAAALLARNANRLGLKRKPWVKSSFAPGSKVAGIYLKEAGLLPEMEKL
                   190       200       210       220       230       240

                   250       260       270       280       290       300
m099.pep    GFGIVAFACTTCNGMSGALDPKIQKEIIDRDLYATAVLSGNRNFDGRIHPYAKQAFLASP
            ||||||||||||||||||||||||:|||||||||||||||||||||||||||||||||||
g099        GFGIVAFACTTCNGMSGALDPKIQQEIIDRDLYATAVLSGNRNFDGRIHPYAKQAFLASP
                   250       260       270       280       290       300

                   310       320       330       340       350       360
m099.pep    PLVVAYALAGSIRFDIENDVLGVADGKEIRLKDIWPADEEIDAVVAEYVKPQQFRDVYVP
            ||||||||||||||||||||||||||:|||||||||:||||||:||||||||||||:|:|
g099        PLVVAYALAGSIRFDIENDVLGVADGREIRLKDIWPTDEEIDAIVAEYVKPQQFRDIYIP
                   310       320       330       340       350       360

                   370       380       390       400       410       420
m099.pep    MFDTGTAQKAPSPLYDWRPMSTYIRRPPYWEGALAGERTLRGMRPLAILPDNITTDHLSP
            | ||||||||||||||||||||||||||||||||||||||||||| |||||||||||:||
g099        MSDTGTAQKAPSPLYDWRPMSTYIRRPPYWEGALAGERTLRGMRPPAILPDNITTDHISP
                   370       380       390       400       410       420

                   430       440       450       460       470       480
m099.pep    SNAILAVSAAGEYLAKMGLPEEDFNSYATHRGDHLTAQRATFANPKLFNEMVKNEDGSVR
            |||||| |||||||||||||||||||||||||||||||||||||||||||||:|||||||
g099        SNAILAGSAAGEYLAKMGLPEEDFNSYATHRGDHLTAQRATFANPKLFNEMVRNEDGSVR
                   430       440       450       460       470       480
```

-continued

```
                  490        500        510        520        530        540
m099.pep   QGSFARVEPEGETMRMWEAIETYMNRKQPLIIIAGADYGQGSSRDWAAKGVRLAGVEAIV
           |||:|||||||:||||||||||||||||||||||||||||||||||||||||||||||||:
g099       QGSLARVEPEGQTMRMWEAIETYMNRKQPLIIIAGADYGQGSSRDWAAKGVRLAGVEAIA
                  490        500        510        520        530        540
                  550        560        570        580        590        600
m099.pep   AEGFERIHRTNLIGMGVLPLQFKPDTNRHTLQLDGTETYDVVGERTPRCDLTLVIHRKNG
           |||||||||||||||||||||||| |||||||||||||||||||||| ||||||||||
g099       AEGFERIHRTNLIGMGVLPLQFKPGTNRHTLQLDGTETYDVVGERTPRCGLTLVIHRKNG
                  550        560        570        580        590        600

                  610        620        630        640
m099.pep   ETVEVPVTCCLDTAEEVLVYEAGGVLQRFAQDFLEGNAAX
           |||||||||  |||||:||||||||||||||||||||||
g099       ETVEVPVTCRPDTAEEALVYEAGGVLQRFAQDFLEGNAAX
                  610        620        630        640
```

The following partial DNA sequence was identified in *N. meningitidis* <SEQ ID 355>:

```
a099.seq
   1 ATGCTGGGAC GCGCGTCCAT GATGCGCCTG CCCGATATTG TCGGCGTTGA

  51 GCTGAACGGC AAACGGAAGG CGGGCATTAC GGCGACGGAT ATTGTGTTGG

 101 CACTGACCGA GTTTCTGCGC AAAGAACGCG TGGTCGGGGC GTTTGTCGAA

 151 TTCTTCGGCG AGGGCGCGAG AAGCCTGTCT ATCGGCGACC GCGCGACCAT

 201 TTCCAACATG ACGCCGGAGT TCGGCGCGAC TGCCGCGATG TTCGCTATTG

 251 ATGAGCAAAC CATTGATTAT TTGAAACTGA CCGGACGCGA CGACGCGCAG

 301 GTGAAATTGG TGGAAACCTA CGCCAAAACC GCAGGCTTGT GGGCAGATGC

 351 CTTGAAAACC GCCGTTTATC CGCGCGTTTT GAAATTTGAT TTGAGCAGCG

 401 TAACGCGCAA TATGGCAGGC CCGAGCAACC CGCACGCGCG TTTTGCGACC

 451 GCCGATTTGG CCGGCAAAGG CTTGGCTAAA CCTTACGAAG AGCCTTCAGA

 501 CGGCCAAATG CCTGACGGTG CAGTGATTAT TGCCGCGATT ACTTCCTGTA

 551 CCAATACTTC CAATCCGCGC AACGTTGTCG CCGCCGCGCT GTTGGCACGC

 601 AATGCCAACC GCCTCGGCTT GCAACGCAAA CCTTGGGTGA AATCTTCGTT

 651 TGCCCCGGGT TCAAAAGTAG CCGAAATCTA TTTGAAAGAA GCAGATCTGC

 701 TGCCCGAAAT GGAAAAACTC GGCTTCGGTA TCGTTGCCTT CGCATGTACC

 751 ACCTGTAACG GCATGAGCGG CGCGCTGGAT CCGAAAATCC AGAAAGAAAT

 801 CATCGACCGC GATTTGTACG CCACCGCCGT ATTGTCAGGC AACCGCAACT

 851 TTGACGGCCG TATCCATCCG TATGCGAAAC AGGCTTTCCT CGCTTCGCCT

 901 CCGTTGGTCG TTGCCTACGC GCTGGCAGGC AGCATCCGTT TCGATATTGA

 951 AAACGACGTA CTCGGCGTTG CAGACGGCAA AGAAATCCGC CTGAAAGACA

1001 TTTGGCCTAC CGATGAAGAA ATCGATGCCA TCGTTGCCGA ATATGTGAAA

1051 CCGCAGCAAT TTCGCGACGT TTATATCCCG ATGTTCGACA CCGGCACAGC

1101 GCAAAAAGCA CCAAGCCCGC TGTACGACTG GCGTCCAATG TCTACCTATA

1151 TCCGCCGCCC ACCTTACTGG GAAGGCGCAC TGGCAGGGGA ACGCACATTA

1201 AGCGGTATGC GTCCGCTGGC GATTTTGCCC GACAACATCA CCACCGACCA

1251 TCTCTCGCCA TCCAATGCGA TTTTGGCAAG CAGTGCCGCA GGCGAATATT

1301 TGGCAAAAAT GGGTTTGCCT GAAGAAGACT TCAACTCTTA CGCAACCCAC

1351 CGTGGCGACC ACTTGACCGC CCAACGCGCA ACCTTCGCCA ATCCGAAACT
```

-continued

```
1401 GTTTAACGAA ATGGTGAGAA ACGAAGACGG CAGCGTACGC CAAGGTTCGC

1451 TGGCACGCGT TGAACCCGAA GGCCAAACCA TGCGCATGTG GGAAGCCATC

1501 GAAACCTATA TGAACCGCAA ACAGCCGCTC ATCATCATTG CCGGCGCGGA

1551 CTACGGTCAA GGCTCAAGCC GCGACTGGGC TGCAAAAGGC GTACGCCTCG

1601 CCGGCGTGGA AGCGATTGTT GCCGAAGGCT TCGAGCGTAT CCACCGCACC

1651 AACTTGATCG GTATGGGCGT GTTGCCGCTG CAGTTCAAAC CGGGTACCAA

1701 CCGCCACACC CTGCAACTGG ACGGTACGGA AACCTACGAC GTTGTCGGCG

1751 AACGCACACC GCGCTGCGAC CTGACCCTTG TGATTCACCG TAAAAACGGC

1801 GAGACCGTCG AAGTCCCCAT TACCTGCCGC CTCGATACCG CAGAAGAAGT

1851 GTTGGTATAT GAAGCCGGTG GCGTATTGCA ACGGTTTGCA CAGGATTTTT

1901 TGGAAGGGAA CGCGGCTTAG
```

This corresponds to the amino acid sequence <SEQ ID 356; ORF 099.a>:

```
a099.pep

      1 MLGRASMMRL PDIVGVELNG KRKAGITATD IVLALTEFLR KERVVGAFVE

     51 FFGEGARSLS IGDRATISNM TPEFGATAAM FAIDEQTIDY LKLTGRDDAQ

    101 VKLVETYAKT AGLWADALKT AVYPRVLKFD LSSVTRNMAG PSNPHARFAT

    151 ADLAGKGLAK PYEEPSDGQM PDGAVIIAAI TSCTNTSNPR NVVAAALLAR

    201 NANRLGLQRK PWVKSSFAPG SKVAEIYLKE ADLLPEMEKL GFGIVAFACT

    251 TCNGMSGALD PKIQKEIIDR DLYATAVLSG NRNFDGRIHP YAKQAFLASP

    301 PLVVAYALAG SIRFDIENDV LGVADGKEIR LKDIWPTDEE IDAIVAEYVK

    351 PQQFRDVYIP MFDTGTAQKA PSPLYDWRPM STYIRRPPYW EGALAGERTL

    401 SGMRPLAILP DNITTDHLSP SNAILASSAA GEYLAKMGLP EEDFNSYATH

    451 RGDHLTAQRA TFANPKLFNE MVRNEDGSVR QGSLARVEPE GQTMRMWEAI

    501 ETYMNRKQPL IIIAGADYGQ GSSRDWAAKG VRLAGVEAIV AEGFERIHRT

    551 NLIGMGVLPL QFKPGTNRHT LQLDGTETYD VVGERTPRCD LTLVIHRKNG

    601 ETVEVPITCR LDTAEEVLVY EAGGVLQRFA QDFLEGNAA*

m099/a099 97.5% identity in 639 aa overlap

                    10        20        30        40        50        60
m099.pep    MLGRASMMRLPDIVGVELNGKRQAGITATDIVLALTEFLRKERVVGAFVEFFGEGARSLS
            ||||||||||||||||||||||:|||||||||||||||||||||||||||||||||||||
a099        MLGRASMMRLPDIVGVELNGKRKAGITATDIVLALTEFLRKERVVGAFVEFFGEGARSLS
                    10        20        30        40        50        60

                    70        80        90       100       110       120
m099.pep    IGDRATISNMTPEFGATAAMFAIDEQTIDYLKLTGRDDAQVKLVETYAKTAGLWADALKT
            ||||||||||||||||||||||||||||||||||||||||||||||||||||||||||||
a099        IGDRATISNMTPEFGATAAMFAIDEQTIDYLKLTGRDDAQVKLVETYAKTAGLWADALKT
                    70        80        90       100       110       120

                   130       140       150       160       170       180
m099.pep    AVYPRVLKFDLSSVTRNMAGPSNPHARFATADLAAKGLAKPYEEPSDGQMPDGSVIIAAI
            ||||||||||||||||||||||||||||||||||:|||||||||||||||||||:|||||
a099        AVYPRVLKFDLSSVTRNMAGPSNPHARFATADLAGKGLAKPYEEPSDGQMPDGAVIIAAI
                   130       140       150       160       170       180

                   190       200       210       220       230       240
m099.pep    TSCTNTSNPRNVVAAALLARNANRLGLKRKPWVKSSFAPGSKVAEIYLKEAGLLPEMEKL
            |||||||||||||||||||||||||||:||||||||||||||||||||||| ||||||||
a099        TSCTNTSNPRNVVAAALLARNANRLGLQRKPWVKSSFAPGSKVAEIYLKEADLLPEMEKL
                   190       200       210       220       230       240
```

-continued

```
                       250       260       270       280       290       300
m099.pep        GFGIVAFACTTCNGMSGALDPKIQKEIIDRDLYATAVLSGNRNFDGRIHPYAKQAFLASP
                ||||||||||||||||||||||||||||||||||||||||||||||||||||||||||||
a099            GFGIVAFACTTCNGMSGALDPKIQKEIIDRDLYATAVLSGNRNFDGRIHPYAKQAFLASP
                       250       260       270       280       290       300

                       310       320       330       340       350       360
m099.pep        PLVVAYALAGSIRFDIENDVLGVADGKEIRLKDIWPADEEIDAVVAEYVKPQQFRDVYVP
                ||||||||||||||||||||||||||||||||||||:||||||:||||||||||||||:|
a099            PLVVAYALAGSIRFDIENDVLGVADGKEIRLKDIWPTDEEIDAIVAEYVKPQQFRDVYIP
                       310       320       330       340       350       360

                       370       380       390       400       410       420
m099.pep        MFDTGTAQKAPSPLYDWRPMSTYIRRPPYWEGALAGERTLRGMRPLAILPDNITTDHLSP
                |||||||||||||||||||||||||||||||||||||||| |||||||||||||||||||
a099            MFDTGTAQKAPSPLYDWRPMSTYIRRPPYWEGALAGERTLSGMRPLAILPDNITTDHLSP
                       370       380       390       400       410       420

                       430       440       450       460       470       480
m099.pep        SNAILAVSAAGEYLAKMGLPEEDFNSYATHRGDHLTAQRATFANPKLFNEMVKNEDGSVR
                |||||| |||||||||||||||||||||||||||||||||||||||||||||:|||||||
a099            SNAILASSAAGEYLAKMGLPEEDFNSYATHRGDHLTAQRATFANPKLFNEMVRNEDGSVR
                       430       440       450       460       470       480

                       490       500       510       520       530       540
m099.pep        QGSFARVEPEGETMRMWEAIETYMNRKQPLIIIAGADYGQGSSRDWAAKGVRLAGVEAIV
                |||:|||||||:||||||||||||||||||||||||||||||||||||||||||||||||
a099            QGSLARVEPEGQTMRMWEAIETYMNRKQPLIIIAGADYGQGSSRDWAAKGVRLAGVEAIV
                       490       500       510       520       530       540

                       550       560       570       580       590       600
m099.pep        AEGFERIHRTNLIGMGVLPLQFKPDTNRHTLQLDGTETYDVVGERTPRCDLTLVIHRKNG
                |||||||||||||||||||||||| |||||||||||||||||||||||||||||||||||
a099            AEGFERIHRTNLIGMGVLPLQFKPGTNRHTLQLDGTETYDVVGERTPRCDLTLVIHRKNG
                       550       560       570       580       590       600

                       610       620       630       640
m099.pep        ETVEVPVTCCLDTAEEVLVYEAGGVLQRFAQDFLEGNAAX
                ||||||:|| ||||||||||||||||||||||||||||||
a099            ETVEVPITCRLDTAEEVLVYEAGGVLQRFAQDFLEGNAAX
                       610       620       630       640
```

The following partial DNA sequence was identified in *N. gonorrhoeae* <SEQ ID 357>:

```
g102.seq
   1 AtgtCCGCCA AAactccgtc gctcttcggc ggcgcgatga Ttatcgccgg

  51 gaaggttatc ggcgcAGgta tgttccccaa ccccaccgcc aacttggggg

 101 acgggttaat aggctcgctg attgtgctgc tgtacacctg gtttccattc

 151 tcctccggcg ccctcatgat tttggaagtc aacacccata acCCccgagg

 201 ggcaAGtttt gacaccATGg tcAAagacct gctcggGaCGc ggctggaaca

 251 tcatcaacgg catcgccgtc gctttggTCc tatacggctc gacctacgcg

 301 tacattttag tcggcggtga cctGACCGCC AAAGGCAtcg GCAgCGCAGT

 351 AGGCGGCAAA ATTTCgctca CCGTCGGACA actcgtcttc tTCGGCATCC

 401 TCGCCTTTTG CGTATGGGCA TCCGCACGCT TGGTCGACCG CTTTACCGGC

 451 GTCCTCATCG GCGGCATGGT ATTAACCTTT ATTTGGGCAA CCGGCGGCCT

 501 GGTTGCCGAT GCCAAACCGT CCGTCCTCTT CGACACCCAA GCCCCCGTCG

 551 GCACCGGCTA CTGGATTTAC GCCGCCACCG CCCTGCCCGT CTGCCTCGCT

 601 TCCTTCGGCT TCCACGGCAA CGTTTCCAGC CTGCTCAAAT ACTTTAAAGG

 651 CGACGcgcCc aaagtGgCGA aATCcatctg gGcaggtaca ttggTTGCCt

 701 tggtaattta cgtccTCTgg caaaccgcca tCcaaagcaa ccTGCcgcgc

 751 aacgagttcg cCCCcgtgat tgccgccgag aggcaactCT CCGTCCTgaa

 801 tgaaacccTG tccaaattcg cccaaaccgg cgatatggat aAaatattgt

 851 ccctatttcc ctacatggca atcgccacct cctttttagg cgTAACctta
```

-continued

```
 901 ggcctgtttg acaacatcgc cgacatcttc aaatggaacg acagtatgtc

 951 cgggcggggc accaaaaccg tcgcgctgaa cttcctgccg CCCCtgattt

1001 cctggctgct cctccccacc ggcttcttta ccgccattgg tgcgtccggc

1051 ctggcggcaa ccgtctggga ccaagGcatc atccccgcca tgctgctcta

1101 cgtttccccc caaaaaattG gcGcaggcaa gacttataAa gtttaCGGCG

1151 gcttgtggct gatgttagtc ttccttttcg gcatcgccaa catcgccgca

1201 CAGGTATTGA GccaAatgGa ACtcgtCccc GTATTTAAAG GATAA
```

This corresponds to the amino acid sequence <SEQ ID 358; ORF 102.ng>:

```
g102.pep
  1 MSAKTPSLFG GAMIIAGKVI GAGMFPNPTA NLGDGLIGSL IVLLYTWFPF

 51 SSGALMILEV NTHNPRGASF DTMVKDLLGR GWNIINGIAV ALVLYGSTYA

101 YILVGGDLTA KGIGSAVGGK ISLTVGQLVF FGILAFCVWA SARLVDRFTG

151 VLIGGMVLTF IWATGGLVAD AKPSVLFDTQ APVGTGYWIY AATALPVCLA

201 SFGFHGNVSS LLKYFKGDAP KVAKSIWAGT LVALVIYVLW QTAIQSNLPR

251 NEFAPVIAAE RQLSVLNETL SKFAQTGDMD KILSLFPYMA IATSFLGVTL

301 GLFDNIADIF KWNDSMSGRG TKTVALNFLP PLISWLLLPT GFFTAIGASG

351 LAATVWDQGI IPAMLLYVSP QKIGAGKTYK VYGGLWLMLV FLFGIANIAA

401 QVLSQMELVP VFKG*
```

The following partial DNA sequence was identified in *N. meningitidis* <SEQ ID 359>:

```
m102.seq
   1 ATGCCCAACA AAACCCCTTC ACTGTTCGGC GGCGCGATGA TTATCGCCGG

  51 CACGGTCATC GGCGCAGGCA TGCTCGCCAA CCCGACCGCC ACATCCGGCG

 101 TATGGTTTAC CGGCTCGCTG GCCGTGTTGC TGTACACCTG GTTTTCTATG

 151 CTTTCCAGCG GCCTGATGAT TTTGGAAGTC AACACCCATT ATCCGCACGG

 201 CGCAAGTTTC GACACGATGG TCAAAGACCT GCTCGGACGC GGCTGGAACA

 251 TCATCAACGG CATCGCCGTC GCCTTCGTTT TATACCTGCT TACTTACGCT

 301 TATATCTTCG TCGGCGGCGA CCTGACCGCC AAAGGCTTAG GCAGCGCGGC

 351 AGGCGGCGAC GTTTCACTCA CCGTCGGACA ACTCGTCTTC TTCGGCATCC

 401 TCGCCTTTTG CGTATGGGCA TCCGCACGCT TGGTCGACCG CTTCACCGGC

 451 GTCCTTATCG GCGGCATGGT ATTGACCTTT ATTTGGGCGG CCGGCGGGCT

 501 GATTGCCGAT GCCAAGCCGT CCGTCCTCTT CGATACCCAA GCCCCCGCCG

 551 GCACAAACTA CTGGATTTAC GCCGCCACCG CCCTGCCCGT CTGCCTCGCT

 601 TCCTTCGGCT TCCACGGCAA CGTCTCCAGC CTGCTCAAAT ACTTTAAAGG

 651 CGACGCGCCC AAAGTGGCTA AATCCATCTG GACGGGCACA CTGATTGCGC

 701 TGGTAATTTA CGTCCTCTGG CAAACCGCCA TCCAAGGCAA CCTGCCGCGC

 751 AACGAGTTCG CCCCCGTCAT CGCCGCCGAA GGGCAAGTCT CCGTCCTCAT

 801 CGAAACCCTG TCCAAATTCG CCCAAACCGG CAATATGGAC AAAATATTGT

 851 CCCTGTTTTC CTATATGGCG ATCGCCACCT CGTTTTTAGG CGTAACGCTC
```

-continued

```
 901 GGACTCTTCG ACTACATCGC CGACATCTTC AAATGGAACG ACAGCATCTC

 951 CGGCCGCACC AAAACCGCCG CGCTGACCTT CCTGCCGCCC CTGATTTCCT

1001 GCCTGCTCTT CCCCACCGGC TTCGTTACCG CCATCGGCTA CGTCGGCCTG

1051 GCGGCAACCG TCTGGACAGG CATCATCCCC GCCATGCTGC TCTACCGTTC

1101 GCGCAAAAAA TTCGGCGCAG GCAAAACCTA TAAAGTTTAC GGCGGCTTGT

1151 GGCTGATGGT TTGGGTCTTC CTTTTCGGCA TCGTCAACAT CGCCGCACAG

1201 GTATTGAGCC AAATGGAACT CGTCCCCGTA TTTAAAGGAT AA
```

This corresponds to the amino acid sequence <SEQ ID 360; ORF 102>:

```
m102.pep..

  1 MPNKTPSLFG GAMIIAGTVI GAGMLANPTA TSGVWFTGSL AVLLYTWFSM

 51 LSSGLMILEV NTHYPHGASF DTMVKDLLGR GWNIINGIAV AFVLYLLTYA

101 YIFVGGDLTA KGLGSAAGGD VSLTVGQLVF FGILAFCVWA SARLVDRFTG

151 VLIGGMVLTF IWAAGGLIAD AKPSVLFDTQ APAGTNYWIY AATALPVCLA

201 SFGFHGNVSS LLKYFKGDAP KVAKSIWTGT LIALVIYVLW QTAIQGNLPR

251 NEFAPVIAAE GQVSVLIETL SKFAQTGNMD KILSLFSYMA IATSFLGVTL

301 GLFDYIADIF KWNDSISGRT KTAALTFLPP LISCLLFPTG FVTAIGYVGL

351 AATVWTGIIP AMLLYRSRKK FGAGKTYKVY GGLWLMVWVF LFGIVNIAAQ

401 VLSQMELVPV FKG*

m102/g102  86.0% identity in 415 aa overlap

                    10        20        30        40        50        60
m102.pep    MPNKTPSLFGGAMIIAGTVIGAGMLANPTATSGVWFTGSLAVLLYTWFSMLSSGLMILEV
            |  |||||||||||||| ||||||: ||||: |  : ||| ||||||| : |::||||||
g102        MSAKTPSLFGGAMIIAGKVIGAGMFPNPTANLGDGLIGSLIVLLYTWFPFSSGALMILEV
                    10        20        30        40        50        60

                    70        80        90       100       110       120
m102.pep    NTHYPHGASFDTMVKDLLGRGWNIINGIAVAFVLYLLTYAYIFVGGDLTAKGLGSAAGGD
            ||| |:|||||||||||||||||||||||||:|||  |||||:|||||||||:|||:|| 
g102        NTHNPRGASFDTMVKDLLGRGWNIINGIAVALVLYGSTYAYILVGGDLTAKGIGSAVGGK
                    70        80        90       100       110       120

                   130       140       150       160       170       180
m102.pep    VSLTVGQLVFFGILAFCVWASARLVDRFTGVLIGGMVLTFIWAAGGLIADAKPSVLFDTQ
            :||||||||||||||||||||||||||||||||||||||||||:|||:||||||||||||
g102        ISLTVGQLVFFGILAFCVWASARLVDRFTGVLIGGMVLTFIWATGGLVADAKPSVLFDTQ
                   130       140       150       160       170       180

                   190       200       210       220       230       240
m102.pep    APAGTNYWIYAATALPVCLASFGFHGNVSSLLKYFKGDAPKVAKSIWTGTLIALVIYVLW
            ||:||:|||||||||||||||||||||||||||||||||||||||||:|||:||||||||
g102        APVGTGYWIYAATALPVCLASFGFHGNVSSLLKYFKGDAPKVAKSIWAGTLVALVIYVLW
                   190       200       210       220       230       240

                   250       260       270       280       290       300
m102.pep    QTAIQGNLPRNEFAPVIAAEGQVSVLIETLSKFAQTGNMDKILSLFSYMAIATSFLGVTL
            |||||:|||||||||||||| |:||| ||||||||||:|||||||| |||||||||||||
g102        QTAIQSNLPRNEFAPVIAAERQLSVLNETLSKFAQTGDMDKILSLFPYMAIATSFLGVTL
                   250       260       270       280       290       300

                   310        320       330       340       350
m102.pep    GLFDYIADIFKWNDSISGR-TKTAALTFLPPLISCLLFPTGFVTAIGYVGLAATVWT-GI
            |||| ||||||||||:||| |||:||:||||||| ||:|||| ||||  |||||||  ||
g102        GLFDNIADIFKWNDSMSGRGTKTVALNFLPPLISWLLLPTGFFTAIGASGLAATVWDQGI
                   310       320       330       340       350       360
```

-continued

```
              360        370        380        390        400        410
m102.pep   IPAMLLYRSRKKFGAGKTYKVYGGLWLMVWVFLFGIVNIAAQVLSQMELVPVFKGX
           |||||||  |  :|:|||||||||||||||: ||||||:|||||||||||||||||||
g102       IPAMLLYVSPQKIGAGKTYKVYGGLWLML-VFLFGIANIAAQVLSQMELVPVFKGX
                   370        380        390        400        410
```

The following partial DNA sequence was identified in *N. meningitidis* <SEQ ID 361>:

```
a102.seq
   1 ATGCCCACCA AAACCCCTTC ACTGTTCGGC GGCGCGATGA TTATCGCCGG
  51 CACGNTCATC GGCGCAGGTA TGCTCGCCAA CCTGACCGCC ACATCCGGCG
 101 TATGGTTTAC CGGCTCGCTG GCCGTGTTGC TGTACACCTG GTTTTCCATG
 151 CTCTCCAGCG GCCTGATGAT TTTGGAAGTC AACACCCACT ACCCCCACGG
 201 CGCGANCTTC GACACCATGG TTAAAGACCT GCTCGGACGG AGCTGGAACA
 251 TCATCAACGG CATCGCCGTC GCCTTCGTTT TATACCTGCT TACTTACGCT
 301 TATATCTTCG TCGGCGGCGA CCTGACCGCC AAAGGCTTAG GCAGCGCGGC
 351 AGGCGGCAAT GTTTCACTCA CCGTCGGACA ACTCGTCTTC TTCGGCATTC
 401 TCGCCTTTTG CGTATGGGCA TCCGCACGCT TGGTCGACCG ATTCACCAGC
 451 GTCCTCATCG GCGGCATGGT ATTAACCTTT ATTTGGGCAA CCGGCGGCCT
 501 GATTGCCGAT GCCAAACTGC CCGTCCTCTT CGACACCCAA GCCCCTACCG
 551 GCACCAACTA CTGGATTTAT GTCGCCACCG CCCTGCCCGT CTGCCTTGCG
 601 TCATTCGGTT TCCACGGCAA CGTCTCCAGC CTGCTCAAAT ACTTTAAAGG
 651 CGACGCGCCC AAAGTGGCTA AATCCATCTG GACGGGCACA CTGATTGCGC
 701 TGGTAATTTA CGTCCTCTGG CAAACCGCCA TCCAANGCAA CCTGCCGCGC
 751 AACGAGTTCG CCCCCGTGAT TGCCGCCGAA GGGCAAGTCT CCGTCNTGAT
 801 TGAAACCCTG TCCAAATTCG CCCAAACCGG CAATATGGAC AAAATATTGT
 851 CCCTGTTTTC CTATATGGCG ATCGCCACCT CGTTTTTAGG CGTAACGCTC
 901 GGACTCTTCG ACTACATCGC CGACATCTTC AAATGGAACG ACAGCGTGTC
 951 CGGCCGCACC AAAACCGCCG CGCTGACCTT CCTGCCGCCT NTAATTTCCT
1001 GCCTGCTCTT CCCCACCGGC TTTGTTACCG CCATCGGNTA CGTCGGCCTG
1051 GCGGCAACCG TCTGGACAGG CATCATCCCC GCCATGCTGC TNTACCGTTC
1101 GCGCAAAAAA TTCGGCGCAG GCAAAACCTA TAAAGTTTAC GGCGGCTTGT
1151 GGCTGATGGT TTGGGTCTTC CTTTTCGGCA TCNTCAACAT CGCCGCACAN
1201 GTATTGAGCC AAATGGAACT CGTCCCCGTA TTTAAAGGAT AA
1202
```

This corresponds to the amino acid sequence <SEQ ID 362; ORF 102.a>:

```
a102.pep

  1 MPTKTPSLFG GAMIIAGTXI GAGMLANPTA TSGVWFTGSL AVLLYTWFSM
 51 LSSGLMILEV NTHYPHGAXF DTMVKDLLGR SWNIINGIAV AFVLYLLTYA
101 YIFVGGDLTA KGLGSAAGGN VSLTVGQLVF FGILAFCVWA SARLVDRFTS
151 VLIGGMVLTF IWATGGLIAD AKLPVLFDTQ APTGTNYWIY VATALPVCLA
```

-continued

```
201  SFGFHGNVSS LLKYFKGDAP KVAKSIWTGT LIALVIYVLW QTAIQXNLPR

251  NEFAPVIAAE GQVSVXIETL SKFAQTGNMD KILSLFSYMA IATSFLGVTL

301  GLFDYIADIF KWNDSVSGRT KTAALTFLPP XISCLLFPTG FVTAIGYVGL

351  AATVWTGIIP AMLLYRSRKK FGAGKTYKVY GGLWLMVWVF LFGIXNIAAX

401  VLSQMELVPV FKG*
```

m102/a102 95.9% identity in 413 aa overlap

```
                  10        20        30        40        50        60
m102.pep  MPNKTPSLFGGAMIIAGTVIGAGMLANPTATSGVWFTGSLAVLLYTWFSMLSSGLMILEV
          ||:||||||||||||||| |||||||||||||||||||||||||||||||||||||||||
a102      MPTKTPSLFGGAMIIAGTXIGAGMLANPTATSGVWFTGSLAVLLYTWFSMLSSGLMILEV
                  10        20        30        40        50        60

                  70        80        90       100       110       120
m102.pep  NTHYPHGASFDTMVKDLLGRGWNIINGIAVAFVLYLLTYAYIFVGGDLTAKGLGSAAGGD
          |||||||| ||||||||||||:|||||||||||||||||||||||||||||||||||||:
a102      NTHYPHGAXFDTMVKDLLGRSWNIINGIAVAFVLYLLTYAYIFVGGDLTAKGLGSAAGGN
                  70        80        90       100       110       120

                 130       140       150       160       170       180
m102.pep  VSLTVGQLVFFGILAFCVWASARLVDRFTGVLIGGMVLTFIWAAGGLIADAKPSVLFDTQ
          |||||||||||||||||||||||||||||:|||||||||||||:||||||||  ||||||
a102      VSLTVGQLVFFGILAFCVWASARLVDRFTSVLIGGMVLTFIWATGGLIADAKLPVLFDTQ
                 130       140       150       160       170       180

                 190       200       210       220       230       240
m102.pep  APAGTNYWIYAATALPVCLASFGFHGNVSSLLKYFKGDAPKVAKSIWTGTLIALVIYVLW
          ||:|||||||:|||||||||||||||||||||||||||||||||||||||||||||||||
a102      APTGTNYWIYVATALPVCLASFGFHGNVSSLLKYFKGDAPKVAKSIWTGTLIALVIYVLW
                 190       200       210       220       230       240

                 250       260       270       280       290       300
m102.pep  QTAIQGNLPRNEFAPVIAAEGQVSVLIETLSKFAQTGNMDKILSLFSYMAIATSFLGVTL
          ||||| ||||||||||||||||||| ||||||||||||||||||||||||||||||||||
a102      QTAIQXNLPRNEFAPVIAAEGQVSVXIETLSKFAQTGNMDKILSLFSYMAIATSFLGVTL
                 250       260       270       280       290       300

                 310       320       330       340       350       360
m102.pep  GLFDYIADIFKWNDSISGRTKTAALTFLPPLISCLLFPTGFVTAIGYVGLAATVWTGIIP
          |||||||||||||||:|||||||||||||| |||||||||||||||||||||||||||||
a102      GLFDYIADIFKWNDSVSGRTKTAALTFLPPXISCLLFPTGFVTAIGYVGLAATVWTGIIP
                 310       320       330       340       350       360

                 370       380       390       400       410
m102.pep  AMLLYRSRKKFGAGKTYKVYGGLWLMVWVFLFGIVNIAAQVLSQMELVPVFKGX
          |||||||||||||||||||||||||||||||||| |||| ||||||||||||||
a102      AMLLYRSRKKFGAGKTYKVYGGLWLMVWVFLFGIXNIAAXVLSQMELVPVFKGX
                 370       380       390       400       410
```

The following partial DNA sequence was identified in *N. gonorrhoeae* <SEQ ID 363>:

```
g105.seq
  1 Atgtccgcag aaaCATACAc acAAAtcggc tGGgtaggct taggGcaaat

 51 gGgtctgcct atgGTAACGC GGCTCTTGGA CGGCGGCATC GAAGTCGGCG

101 TATACAACCG CTCGCCCGAC AAAACTGCCC CCATCTCcgc CAAAGGAGCA

151 AAAGTTTACG GCagcACCGC CGAACTCGTC CGCGCCTGCC CCGTCATTTT

201 CCTGATGGTT TCCGACTATG CCGCCGTGTG CGACATCCTG AACGGAGTCC

251 GCGACGGATT GGCCGGCAAA ATCATCGTCA ACATGAGCAC CATCTCCCCG

301 ACCGAAAACC TCGCCGTCAA AGCACTTGTC GAAGCCGCAG GCGGACAGTT

351 TGCCGAAGCA CCCGTTTCCG GATCGGTCGG ACCCGCCACC AACGGCACAC

401 TGCTGATTCT GTTCGGCGGC AGCGAAGCCG TTTTAAACCC GCTGCAAAAA

451 ATATTTTCCC TTGTCGGCAA AAAAACCTTC CATTTCGGCG ATGTCGGCAA

501 AGGCTCGGGC GCGAAACTCG TCTTGAACTC GCTCTTAGGC ATTTTCGGCG
```

-continued

```
551 AAGCGTACAG CGAAGCGATG CTGATGGCGC GGCAGTTCGG CATCGATACC

601 GACACCATCG TCGAAGCCAT CGGCGGCTCG GCAATGGACT CGCCTATGTT

651 TCAAACAAAA AAATCACTAT GGGCAAACCG TGAGTTCCCC CCTGCCTTTG

701 CACTCAAACA CGCTTCCAAA GAcctTAACC TCGccgtcAA AGAGCTTGAA

751 CAGGCAGGCA ACACCCTGCC CGCCGTCGAA ACCGTTGCTG CCAGCTACCG

801 CAAAGCAGTT GAAGCCGGCT ACGGCGAACA GGACGTTTCC GGCGTTTACC

851 TGAAATTGGC AGAACACTGA
```

This corresponds to the amino acid sequence <SEQ ID 364; ORF 105.ng>:

```
g105.pep
  1 MSAETYTQIG WVGLGQMGLP MVTRLLDGGI EVGVYNRSPD KTAPISAKGA

 51 KVYGSTAELV RACPVIFLMV SDYAAVCDIL NGVRDGLAGK IIVNMSTISP

101 TENLAVKALV EAAGGQFAEA PVSGSVGPAT NGTLLILFGG SEAVLNPLQK

151 IFSLVGKKTF HFGDVGKGSG AKLVLNSLLG IFGEAYSEAM LMARQFGIDT

201 DTIVEAIGGS AMDSPMFQTK KSLWANREFP PAFALKHASK DLNLAVKELE

251 QAGNTLPAVE TVAASYRKAV EAGYGEQDVS GVYLKLAEH
```

The following partial DNA sequence was identified in *N. meningitidis* <SEQ ID 365>:

```
m105.seq
  1 ATGTCCGCAA ACGAATACGC ACAAATCGGC TGGaTAGGCT TAGGGCAAAT

 51 GGGTCTGCCT ATGGTAACGC GGCTCTTGGA CGGCGGCATC GAAGTCGGCG

101 TATACAACCG CTCGCCCGAC AAAACTGCCC CCATCTCCGC CAAAGGCGCA

151 AAAGTTTACG GCAACACCGC CGAACTCGTC CGCGACTATC CCGTCATTTT

201 CCTGATGGTT TCCGACTATG CCGCCGTGTG CGACATCCTG AACGGAGTCC

251 GCGACGGATT GGCCGGCAAm ATCATCGTCA ACATGAGCAC CATCTCCCCG

301 ACCGAAAaGC TCGCCGTCAA AGCACTTGTC GAAGCGCAGm GaCAGTTTGC

351 CGAAGCACCC GTTTCCGGAT CGGTCGGGCC CGCCACCAAC GGCACGCTGC

401 TGATTCTGTT CGGCGGCAGC GAAcCGtTTT AAACCCGCTG CAAAAAATAT

451 TTTCCCTCGT CGGCAAAAAA ACCTTCCATT TCGGCGATGT CGGCAAAGGT

501 TCGGGCGCGA AACTCGTCTT GAACTCGCTC TTGGGCATTT TCGGCGAaCG

551 TAcAGCGAAs GmTgCTGATG GCGCGGCAGT TCGGCATCGA TACCGACACC

601 ATCGTCGAAG CCATCGGsGA CTCGGCAATG GACTCGCCCA TGTTCCAAAC

651 CAAAAAATCC CTGTGGGCAA ACCGCGAATT CCCGmCCGmC TTCGCCCTCA

701 AACACGCCTC CAAAGACCTC AACCTCGCCG TCAAAGAGCT TGAACAGGCA

751 GGCAACACCC TGCCCGCCGT CGAAACCGTT GCTGCCAGCT ACCGCAAAGC

801 AGTCGAAGCC GGCTACGGGA CACAGGACGT TTCCGGCGTT TACCTGAAAC

851 TGGCAGAACA CTGA
```

This corresponds to the amino acid sequence <SEQ ID 366; ORF 105>:

```
m105.pep
   1 MSANEYAQIG WIGLGQMGLP MVTRLLDGGI EVGVYNRSPD KTAPISAKGA

  51 KVYGNTAELV RDYPVIFLMV SDYAAVCDIL NGVRDGLAGX IIVNMSTISP

 101 TEKLAVKALV EAQRQFAEAP VSGSVGPATN GTLLILFGGS EPFXTRCKKY

 151 FPSSAKKPSI SAMSAKVRAR NSSXTRSWAF SANVQRXXLM ARQFGIDTDT

 201 IVEAIGDSAM DSPMFQTKKS LWANREFPXX FALKHASKDL NLAVKELEQA

 251 GNTLPAVETV AASYRKAVEA GYGTQDVSGV YLKLAEH
```

Computer analysis of this amino acid sequence gave the following results:

Homology with a Predicted ORF from *N. gonorrhoeae*

ORF 105 shows 79.9% identity over a 289 aa overlap with a predicted ORF (ORF 105.ng) from *N. gonorrhoeae*:

```
m105/g105

                        10        20        30        40        50        60
g105.pep    MSAETYTQIGWVGLGQMGLPMVTRLLDGGIEVGVYNRSPDKTAPISAKGAKVYGSTAELV
            |||: |:||||:||||||||||||||||||||||||||||||||||||||||||:|||||
m105        MSANEYAQIGWIGLGQMGLPMVTRLLDGGIEVGVYNRSPDKTAPISAKGAKVYGNTAELV
                        10        20        30        40        50        60

                        70        80        90       100       110       120
g105.pep    RACPVIFLMVSDYAAVCDILNGVRDGLAGKIIVNMSTISPTENLAVKALVEAAGGQFAEA
            |  |||||||||||||||||||||||||| ||||||||||||:|||||||||   |||||
m105        RDYPVIFLMVSDYAAVCDILNGVRDGLAGXIIVNMSTISPTEKLAVKALVEAQR-QFAEA
                        70        80        90       100       110

                       130       140       150       160       170       180
g105.pep    PVSGSVGPATNGTLLILFGGSEAVLNPLQKIFSLVGKKTFHFGDVGKGSGAKLVLNSLLG
            ||||||||||||||||||||||   :  :|  |  :||   : : : :  |:    :
m105        PVSGSVGPATNGTLLILFGGSEPFXTRCKKYGPSSAKKP-SISAMSAKVRARNSSXTRSW
         120       130       140       150           160       170

                       190       200       210       220       230       240
g105.pep    IFGEAYSEAMLMARQFGIDTDTIVEAIGGSAMDSPMFQTKKSLWANREFPPAFALKHASK
             |:  : :  |||||||||||||||||| |||||||||||||||||||||  ||||||||
m105        AFSANVQRXXLMARQFGIDTDTIVEAIGDSAMDSPMFQTKKSLWANREFPXXFALKHASK
          180       190       200       210       220       230

                       250       260       270       280      289
g105.pep    DLNLAVKELEQAGNTLPAVETVAASYRKAVEAGYGEQDVSGVYLKLAEH
            ||||||||||||||||||||||||||||||||||| |||||||||||||
m105        DLNLAVKELEQAGNTLPAVETVAASYRKAVEAGYGTQDVSGVYLKLAEH
          240       250       260       270       280
```

The following partial DNA sequence was identified in *N. meningitidis* <SEQ ID 367>:

```
a105.seq
   1 ATGTCCGCAA ACGAATACAC ACAAATCGGC TGGATAGGCT TAGGGCAAAT

  51 GGGTCTGCCT ATGGTAACGC GGCTCTTGGA CGGCGGCATC GAAGTCGGCG

 101 TATACAACCG CTCGCCCGAC AAAACTGCCC CCATCTCCGC CAAAGGCGCA

 151 AAAGTTTACG GCAACACCGC CGAACTCGTC CGCGACTATC CCGTCATTTT

 201 CCTGATGGTT TCCGACTATG CCGCCGTGTG CGACATCCTG AACGGAGTCC

 251 GCGACGGATT GGCCGGCAAA ATCATCGTCA ACATGAGCAC CATCTCCCCG

 301 ACCGAAAACC TCGCCGTCAA AGCACTTGTC GAAGCCGCAG GCGGACAGTT

 351 TGCCGAAGCA CCCGTTTCCG GATCGGTCGG GCCCGCCACC AACGGCACGC

 401 TGCTGATTCT GTTCGGCGGC AGCGAAGCCG TTTTAAACCC GCTGCAAAAA
```

-continued

```
451 ATATTTTCCC TCGTCGGCAA AAAAACCTTC CATTTCGGCG ATGTCGGCAA

501 AGGTTCGGGC GCGAAACTCG TCTTGAACTC GCTCTTGGGC ATTTTCGGCG

551 AAGCGTACAG CGAAGCGATG CTGATGGCGC GGCAGTTCGG CATCGATACC

601 GACACCATCG TCGAAGCCAT CGGCGGCTCG GCAATGGACT CGCCCATGTT

651 CCAAACCAAA AAATCCCTGT GGGCAAACCG CGAATTCCCA CCCGCCTTCG

701 CCCTCAAACA CGCCTCCAAA GACCTCAACC TCGCCGTCAA AGAGCTTGAA

751 CAGGCAGGCA ACACCCTGCC CGCCGTCGAA ACCGTTGCTG CCAGCTACCG

801 CAAAGCAGTC GAAGCCGGCT ACGGCGAACA GGACGTTTCC GGCGTTTACC

851 TGAAATTGGC AGAACACTGA
```

This corresponds to the amino acid sequence <SEQ ID 368; ORF 105.a>:

```
a105.pep

  1 MSANEYTQIG WIGLGQMGLP MVTRLLDGGI EVGVYNRSPD KTAPISAKGA

 51 KVYGNTAELV RDYPVIFLMV SDYAAVCDIL NGVRDGLAGK IIVNMSTISP

101 TENLAVKALV EAAGGQFAEA PVSGSVGPAT NGTLLILFGG SEAVLNPLQK

151 IFSLVGKKTF HFGDVGKGSG AKLVLNSLLG IFGEAYSEAM LMARQFGIDT

201 DTIVEAIGGS AMDSPMFQTK KSLWANREFP PAFALKHASK DLNLAVKELE

251 QAGNTLPAVE TVAASYRKAV EAGYGEQDVS GVYLKLAEH*

m105/a105  96.5% identity in 289 aa overlap

                    10        20        30        40        50        60
m105.pep    MSANEYAQIGWIGLGQMGLPMVTRLLDGGIEVGVYNRSPDKTAPISAKGAKVYGNTAELV
            ||||||:|||||||||||||||||||||||||||||||||||||||||||||||||||||
a105        MSANEYTQIGWIGLGQMGLPMVTRLLDGGIEVGVYNRSPDKTAPISAKGAKVYGNTAELV
                    10        20        30        40        50        60

                    70        80        90       100       110       119
m105.pep    RDYPVIFLMVSDYAAVCDILNGVRDGLAGKIIVNMSTISPTENLAVKALVEAAG-QFAEA
            |||||||||||||||||||||||||||||||||||||||||||||||||||||| |||||
a105        RDYPVIFLMVSDYAAVCDILNGVRDGLAGKIIVNMSTISPTENLAVKALVEAAGGQFAEA
                    70        80        90       100       110       120

         120       130       140       150       160       170       179
m105.pep    PVSGSVGPATNGTLLILFGGSEAVLNPLQKIFSLVGKKTFHFGDVGKGSGAKLVLNSLLG
            ||||||||||||||||||||||||||||||||||||||||||||||||||||||||||||
a105        PVSGSVGPATNGTLLILFGGSEAVLNPLQKIFSLVGKKTFHFGDVGKGSGAKLVLNSLLG
                   130       140       150       160       170       180

          180       190       200       210       220       230
m105.pep    IFGDV-QRXMLMARQFGIDTDTIVEAIGDSAMDSPMFQTKKSLWANREFPXAFALKHASK
            |||:: :: ||||||||||||||||||| ||||||||||||||||||||| |||||||||
a105        IFGEAYSEAMLMARQFGIDTDTIVEAIGGSAMDSPMFQTKKSLWANREFPPAFALKHASK
                   190       200       210       220       230       240

           240       250       260       270       280
m105.pep    DLNLAVKELEQAGNTLPAVETVAASYRKAVEAGYGEQDVSGVYLKLAEHX
            ||||||||||||||||||||||||||||||||||||||||||||||||||
a105        DLNLAVKELEQAGNTLPAVETVAASYRKAVEAGYGEQDVSGVYLKLAEHX
                   250       260       270       280       290
```

The following partial DNA sequence was identified in *N. gonorrhoeae* <SEQ ID 369>:

```
g105-1.seq
  1 ATGTCCGCAG AAACATACAC ACAAATCGGC TGGGTAGGCT TAGGGCAAAT

 51 GGGTCTGCCT ATGGTAACGC GGCTCTTGGA CGGCGGCATC GAAGTCGGCG

101 TATACAACCG CTCGCCCGAC AAAACTGCCC CCATCTCCGC CAAAGGAGCA
```

-continued

```
151 AAAGTTTACG GCAGCACCGC CGAACTCGTC CGCGCCTGCC CCGTCATTTT

201 CCTGATGGTT TCCGACTATG CCGCCGTGTG CGACATCCTG AACGGAGTCC

251 GCGACGGATT GGCCGGCAAA ATCATCGTCA ACATGAGCAC CATCTCCCCG

301 ACCGAAAACC TCGCCGTCAA AGCACTTGTC GAAGCCGCAG GCGGACAGTT

351 TGCCGAAGCA CCCGTTTCCG GATCGGTCGG ACCCGCCACC AACGGCACAC

401 TGCTGATTCT GTTCGGCGGC AGCGAAGCCG TTTTAAACCC GCTGCAAAAA

451 ATATTTTCCC TTGTCGGCAA AAAAACCTTC CATTTCGGCG ATGTCGGCAA

501 AGGCTCGGGC GCGAAACTCG TCTTGAACTC GCTCTTAGGC ATTTTCGGCG

551 AAGCGTACAG CGAAGCGATG CTGATGGCGC GGCAGTTCGG CATCGATACC

601 GACACCATCG TCGAAGCCAT CGGCGGCTCG GCAATGGACT CGCCTATGTT

651 TCAAACAAAA AAATCACTAT GGGCAAACCG TGAGTTCCCC CCTGCCTTTG

701 CACTCAAACA CGCTTCCAAA GACCTTAACC TCGCCGTCAA AGAGCTTGAA

751 CAGGCAGGCA ACACCCTGCC CGCCGTCGAA ACCGTTGCTG CCAGCTACCG

801 CAAAGCAGTT GAAGCCGGCT ACGGCGAACA GGACGTTTCC GGCGTTTACC

851 TGAAATTGGC AGAACACTGA
```

This corresponds to the amino acid sequence <SEQ ID 370; ORF 105-1.ng>:

```
g105-1.pep
  1 MSAETYTQIG WVGLGQMGLP MVTRLLDGGI EVGVYNRSPD KTAPISAKGA

 51 KVYGSTAELV RACPVIFLMV SDYAAVCDIL NGVRDGLAGK IIVNMSTISP

101 TENLAVKALV EAAGGQFAEA PVSGSVGPAT NGTLLILFGG SEAVLNPLQK

151 IFSLVGKKTF HFGDVGKGSG AKLVLNSLLG IFGEAYSEAM LMARQFGIDT

201 DTIVEAIGGS AMDSPMFQTK KSLWANREFP PAFALKHASK DLNLAVKELE

251 QAGNTLPAVE TVAASYRKAV EAGYGEQDVS GVYLKLAEH*
```

The following partial DNA sequence was identified in *N. meningitidis* <SEQ ID 371>:

```
m105-1.seq
  1 ATGTCCGCAA ACGAATACGC ACAAATCGGC TGGATAGGCT TAGGGCAAAT

 51 GGGTCTGCCT ATGGTAACGC GGCTCTTGGA CGGCGGCATC GAAGTCGGCG

101 TATACAACCG CTCGCCCGAC AAAACTGCCC CCATCTCCGC CAAAGGCGCA

151 AAAGTTTACG GCAACACCGC CGAACTCGTC CGCGACTATC CCGTCATTTT

201 CCTGATGGTT TCCGACTATG CCGCCGTGTG CGACATCCTG AACGGAGTCC

251 GCGACGGATT GGCCGGCAAA ATCATCGTCA ACATGAGCAC CATCTCCCCG

301 ACCGAAAACC TCGCCGTCAA AGCACTTGTC GAAGCCGCAG GCGGACAGTT

351 TGCCGAAGCA CCCGTTTCCG GATCGGTCGG GCCCGCCACC AACGGCACGC

401 TGCTGATTCT GTTCGGCGGC AGCGAAGCcG TTTTAAACCC GCTGCAAAAA

451 ATATTTTCCC TCGTCGGCAA AAAAACCTTC CATTTCGGCG ATGTCGGCAA

501 AGGTTCGGGC GCGAAACTCG TCTTGAACTC GCTCTTGGGC ATTTTCGGCG

551 AAGCGTACAG CGAAnCGATG CTGATGGCGC GGCAGTTCGG CATCGATACC

601 GACACCATCG TCGAAGCCAT CGGsGACTCG GCAATGGACT CGCCCATGTT
```

-continued

```
651 CCAAACCAAA AAATCCCTGT GGGCAAACCG CGAATTCCCG CCCGCCTTCG

701 CCCTCAAACA CGCCTCCAAA GACCTCAACC TCGCCGTCAA AGAGCTTGAA

751 CAGGCAGGCA ACACCCTGCC CGCCGTCGAA ACCGTTGCTG CCAGCTACCG

801 CAAAGCAGTC GAAGCCGGCT ACGGCGAACA GGACGTTTCC GGCGTTTACC

851 TGAAACTGGC AGAACACTGA
```

This corresponds to the amino acid sequence <SEQ ID 372; ORF 105-1>:

```
m105-1.pep

      1  MSANEYAQIG WIGLGQMGLP MVTRLLDGGI EVGVYNRSPD KTAPISAKGA
     51  KVYGNTAELV RDYPVIFLMV SDYAAVCDIL NGVRDGLAGK IIVNMSTISP
    101  TENLAVKALV EAAGGQFAEA PVSGSVGPAT NGTLLILFGG SEAVLNPLQK
    151  IFSLVGKKTF HFGDVGKGSG AKLVLNSLLG IFGEAYSEXM LMARQFGIDT
    201  DTIVEAIGDS AMDSPMFQTK KSLWANREFP PAFALKHASK DLNLAVKELE
    251  QAGNTLPAVE TVAASYRKAV EAGYGEQDVS GVYLKLAEH*
```

```
mA05-1/g105-1  96.9% identity in 289 aa overlap

                     10        20        30        40        50        60
m105-1.pep   MSANEYAQIGWIGLGQMGLPMVTRLLDGGIEVGVYNRSPDKTAPISAKGAKVYGNTAELV
             |||: |:||||:||||||||||||||||||||||||||||||||||||||||||:|||||
g105-1       MSAETYTQIGWVGLGQMGLPMVTRLLDGGIEVGVYNRSPDKTAPISAKGAKVYGSTAELV
                     10        20        30        40        50        60
                     70        80        90       100       110       120
m105-1.pep   RDYPVIFLMVSDYAAVCDILNGVRDGLAGKIIVNMSTISPTENLAVKALVEAAGGQFAEA
             |  |||||||||||||||||||||||||||||||||||||||||||||||||||||||||
g105-1       RACPVIFLMVSDYAAVCDILNGVRDGLAGKIIVNMSTISPTENLAVKALVEAAGGQFAEA
                     70        80        90       100       110       120
                    130       140       150       160       170       180
m105-1.pep   PVSGSVGPATNGTLLILFGGSEAVLNPLQKIFSLVGKKTFHFGDVGKGSGAKLVLNSLLG
             ||||||||||||||||||||||||||||||||||||||||||||||||||||||||||||
g105-1       PVSGSVGPATNGTLLILFGGSEAVLNPLQKIFSLVGKKTFHFGDVGKGSGAKLVLNSLLG
                    130       140       150       160       170       180
                    190       200       210       220       230       240
m105-1.pep   IFGEAYSEXMLMARQFGIDTDTIVEAIGDSAMDSPMFQTKKSLWANREFPPAFALKHASK
             |||||||| ||||||||||||||||||| |||||||||||||||||||||||||||||||
g105-1       IFGEAYSEAMLMARQFGIDTDTIVEAIGGSAMDSPMFQTKKSLWANREFPPAFALKHASK
                    190       200       210       220       230       240
                    250       260       270       280       290
m105-1.pep   DLNLAVKELEQAGNTLPAVETVAASYRKAVEAGYGEQDVSGVYLKLAEHX
             ||||||||||||||||||||||||||||||||||||||||||||||||||
g105-1       DLNLAVKELEQAGNTLPAVETVAASYRKAVEAGYGEQDVSGVYLKLAEHX
                    250       260       270       280       290
```

The following partial DNA sequence was identified in *N. meningitidis* <SEQ ID 373>:

```
a105-1.seq
  1 ATGTCCGCAA ACGAATACAC ACAAATCGGC TGGATAGGCT TAGGGCAAAT

 51 GGGTCTGCCT ATGGTAACGC GGCTCTTGGA CGGCGGCATC GAAGTCGGCG

101 TATACAACCG CTCGCCCGAC AAAACTGCCC CCATCTCCGC CAAAGGCGCA

151 AAAGTTTACG GCAACACCGC CGAACTCGTC CGCGACTATC CCGTCATTTT

201 CCTGATGGTT TCCGACTATG CCGCCGTGTG CGACATCCTG AACGGAGTCC

251 GCGACGGATT GGCCGGCAAA ATCATCGTCA ACATGAGCAC CATCTCCCCG

301 ACCGAAAACC TCGCCGTCAA AGCACTTGTC GAAGCCGCAG GCGGACAGTT
```

-continued

```
351 TGCCGAAGCA CCCGTTTCCG GATCGGTCGG GCCCGCCACC AACGGCACGC

401 TGCTGATTCT GTTCGGCGGC AGCGAAGCCG TTTTAAACCC GCTGCAAAAA

451 ATATTTTCCC TCGTCGGCAA AAAAACCTTC CATTTCGGCG ATGTCGGCAA

501 AGGTTCGGGC GCGAAACTCG TCTTGAACTC GCTCTTGGGC ATTTTCGGCG

551 AAGCGTACAG CGAAGCGATG CTGATGGCGC GGCAGTTCGG CATCGATACC

601 GACACCATCG TCGAAGCCAT CGGCGGCTCG GCAATGGACT CGCCCATGTT

651 CCAAACCAAA AAATCCCTGT GGGCAAACCG CGAATTCCCA CCCGCCTTCG

701 CCCTCAAACA CGCCTCCAAA GACCTCAACC TCGCCGTCAA AGAGCTTGAA

751 CAGGCAGGCA ACACCCTGCC CGCCGTCGAA ACCGTTGCTG CCAGCTACCG

801 CAAAGCAGTC GAAGCCGGCT ACGGCGAACA GGACGTTTCC GGCGTTTACC

851 TGAAATTGGC AGAACACTGA
```

This corresponds to the amino acid sequence <SEQ ID 374; ORF 105-1.a>:

```
a105-1.pep

      1 MSANEYTQIG WIGLGQMGLP MVTRLLDGGI EVGVYNRSPD KTAPISAKGA

     51 KVYGNTAELV RDYPVIFLMV SDYAAVCDIL NGVRDGLAGK IIVNMSTISP

    101 TENLAVKALV EAAGGQFAEA PVSGSVGPAT NGTLLILFGG SEAVLNPLQK

    151 IFSLVGKKTF HFGDVGKGSG AKLVLNSLLG IFGEAYSEAM LMARQFGIDT

    201 DTIVEAIGGS AMDSPMFQTK KSLWANREFP PAFALKHASK DLNLAVKELE

    251 QAGNTLPAVE TVAASYRKAV EAGYGEQDVS GVYLKLAEH*

a105-1/m105-1  99.0% identity in 289 aa overlap

                      10        20        30        40        50        60
a105-1•pep  MSANEYAQIGWIGLGQMGLPMVTRLLDGGIEVGVYNRSPDKTAPISAKGAKVYGNTAELV
            ||||||:|||||||||||||||||||||||||||||||||||||||||||||||||||||
m105-1      MSANEYTQIGWIGLGQMGLPMVTRLLDGGIEVGVYNRSPDKTAPISAKGAKVYGNTAELV
                    10        20        30        40        50        60

                    70        80        90       100       110       120
a105-1.pep  RDYPVIFLMVSDYAAVCDILNGVRDGLAGKIIVNMSTISPTENLAVKALVEAAGGQFAEA
            ||||||||||||||||||||||||||||||||||||||||||||||||||||||||||||
m105-1      RDYPVIFLMVSDYAAVCDILNGVRDGLAGKIIVNMSTISPTENLAVKALVEAAGGQFAEA
                    70        80        90       100       110       120

                   130       140       150       160       170       180
a105-1.pep  PVSGSVGPATNGTLLILFGGSEAVLNPLQKIFSLVGKKTFHFGDVGKGSGAKKVLNSLLG
            ||||||||||||||||||||||||||||||||||||||||||||||||||||||||||||
m105-1      PVSGSVGPATNGTLLILFGGSEAVLNPLQKIFSLVGKKTFHFGDVGKGSGAKLVLNSLLG
                   130       140       150       160       170       180

                     190       200       210       220       230       240
a105-1.pep    IFGEAYSEAMLMARQFGIDTDTIVEAIGGSAMDSPMFQTKKSLWANREFPPAFALKHASK
              |||||||| ||||||||||||||||||| |||||||||||||||||||||||||||||||
m105-1        IFGEAYSEXMLMARQFGIDTDTIVEAIGDSAMDSPMFQTKKSLWANREFPPAFALKHASK
                     190       200       210       220       230       240

                     250       260       270       280       290
a105-1.pep    DLNLAVKELEQAGNTLPAVETVAASYRKAVEAGYGEQDVSGVYLKLAEHX
              |||||||||||||||||||||||||||||||||||||||||||||||||
m105-1        DLNLAVKELEQAGNTLPAVETVAASYRKAVEAGYGEQDVSGVYLKLAEHX
                     250       260       270       280       290
```

The following partial DNA sequence was identified in *N. gonorrhoeae* <SEQ ID 375>:

```
g107.seq
  1 ATGGTATTAA CCTTTATTTG GGCAACCGGC GGCCTGGTTG CCGATGCCAA
```

-continued

```
 51 ACCGTCCGTC CTCTTCGACA CCCAAGCCCC CGTCGGCACC GGCTACTGGA

101 TTTACGCCGC CACCGCCCTG CCCGTCTGCC TCGCTTCCTT CGGCTTCCAC

151 GGCAACGTTT CCAGCCTGCT CAAATACTTT AAAGGCGACG cgcCcaaagt

201 GgCGAaATCc atctggGcag gtacattggT TGCCttggta atttacgtcc

251 TCTggcaaac cgccatCcaa agcaaccTGC cgcgcaacga gttcgcCCCc

301 gtgattgccg ccgagaggca actCTCCGTC CTgaatgaaa cccTGtccaa

351 attcgcccaa accggcgata tggataAaat attgtcccta tttccctaca

401 tggcaatcgc cacctccttt ttaggcgTAA Ccttaggcct gtttgacaac

451 atcgccggac atcttcaaat ggaacgacag tatgtccggg cggcaccaaa

501 accgtcgcgc tga
```

This corresponds to the amino acid sequence <SEQ ID 376; ORF 107.ng>:

```
g107.pep
  1 MVLTFIWATG GLVADAKPSV LFDTQAPVGT GYWIYAATAL PVCLASFGFH

 51 GNVSSLLKYF KGDAPKVAKS IWAGTLVALV IYVLWQTAIQ SNLPRNEFAP

101 VIAAERQLSV LNETLSKFAQ TGDMDKILSL FPYMAIATSF LGVTLGLFDN

151 IAGHLQMERQ YVRAAPKPSR *
```

The following partial DNA sequence was identified in *N. meningitidis* <SEQ ID 377>:

```
m107.seq
  1 ATGGTATTGA CCTTTATTTG GGCGGCCGGC GGGCTGATTG CCGATGCCAA

 51 GCCGTCCGTC CTCTTCGATA CCCAAGCCCC CGCCGGCACA AACTACTGGA

101 TTTACGCCGs CACCGCCCTG CCCGTCTGCC TCGCTTCCTT CGGCTTCCAC

151 GGCAACGTCT CCAGCCTGCT CAAATACTTT AAAGGCGACG CGCCCAAAGT

201 GGCTAAATCC ATCTGGACGG GCACACTGAT TGCGCTGGTA ATTTACGTCC

251 TCTGGCAAAC CGCCATCCAA GGCAACCTGC CGCGCAACGA GTTCGCCCCC

301 GTCATCGCCG CCGAAGGGCA AGTCTCCGTC CTCATCGAAA CCCTGTCCAA

351 ATTCGCCCAA ACCGGCAATA TGGACAAAAT ATTGTCCCTG TTTTCCTATA

401 TGGCGATCGC CACCTCGTTT TTAGGCGTAA CGCTCGGACT CTTCGACTAC

451 ATCGCCCATC TTCAAATGGA ACGACAGCAT CTCCGGgCCG CACCAAAACC

501 GCCGCGCTGA
```

This corresponds to the amino acid sequence <SEQ ID 378; ORF 107>:

```
m107.pep . . .
  1 MVLTFIWAAG GLIADAKPSV LFDTQAPAGT NYWIYAXTAL PVCLASFGFH

 51 GNVSSLLKYF KGDAPKVAKS IWTGTLIALV IYVLWQTAIQ GNLPRNEFAP

101 VIAAEGQVSV LIETLSKFAQ TGNMDKILSL FSYMAIATSF LGVTLGLFDY

151 IAHLQMERQH LRAAPKPPR*
```

Computer analysis of this amino acid sequence gave the following results:

Homology with a Predicted ORF from *N. gonorrhoeae*

ORF 107 shows 89.4% identity over a 170 aa overlap with a predicted ORF (ORF 107.ng) from *N. gonorrhoeae*:

```
m107/g107

                    10        20        30        40        50        60
m107.pep    MVLTFIWAAGGLIADAKPSVLFDTQAPAGTNYWIYAXTALPVCLASFGFHGNVSSLLKYF
            ||||||||:|||:||||||||||||||:||:||||| |||||||||||||||||||||||
g107        MVLTFIWATGGLVADAKPSVLFDTQAPVGTGYWIYAATALPVCLASFGFHGNVSSLLKYF
                    10        20        30        40        50        60

                    70        80        90       100       110       120
m107.pep    KGDAPKVAKSIWTGTLIALVIYVLWQTAIQGNLPRNEFAPVIAAEGQVSVLIETLSKFAQ
            ||||||||||||:|||:|||||||||||||:|||||||||||||| |:||| ||||||||
g107        KGDAPKVAKSIWAGTLVALVIYVLWQTAIQSNLPRNEFAPVIAAERQLSVLNETLSKFAQ
                    70        80        90       100       110       120

                   130       140       150        160       170
m107.pep    TGNMDKILSLFSYMAIATSFLGVTLGLFDYIA-HLQMERQHLRAAPKPPR
            ||:|||||||| ||||||||||||||||| || |||||||::|||||| |
g107        TGGMDKILSLFPYMAIATSFLGVTLGLFDNIAGHLQMERQYVRAAPKPPR
                   130       140       150       160       170
```

The following partial DNA sequence was identified in *N. meningitidis* <SEQ ID 379>:

```
a107.seq
   1 ATGGTATTAA CCTTTATTTG GGCAACCGGC GGCCTGATTG CCGATGCCAA

  51 ACTGCCCGTC CTCTTCGACA CCCAAGCCCC TACCGGCACC AACTACTGGA

 101 TTTATGTCGC CACCGCCCTG CCCGTCTGCC TTGCGTCATT CGGTTTCCAC

 151 GGCAACGTCT CCAGCCTGCT CAAATACTTT AAAGGCGACG CGCCCAAAGT

 201 GGCTAAATCC ATCTGGACGG GCACACTGAT TGCGCTGGTA ATTTACGTCC

 251 TCTGGCAAAC CGCCATCCAA GGCAACCTGC CGCGCAACGA GTTCGCCCCC

 301 GTGATTGCCG CCGAAGGGCA AGTCTCCGTC CTGATTGAAA CCCTGTCCAA

 351 ATTCGCCCAA ACCGGCAATA TGGACAAAAT ATTGTCCCTG TTTTCCTATA

 401 TGGCGATCGC CACCTCGTTT TTAGGCGTAA CGCTCGGACT CTTCGACTAC

 451 ATCGCCGACA TCTTCAAATG GAACGACAGC GTGTCCGGCC GCACCAAAAC

 501 CGCCGCGCTG ACCTTCCTGC CGCCTCTAAT TTCCTGCCTG CTCTTCGACA

 551 CCGGCTTTGT TACCGCCATC GGCTACGTCG GCCTGGCGGC AACCGTCTGG

 601 ACAGGCATCA TCCCCGCCAT GCTGCTCTAC CGTTCGCGCA AAAAATTCGG

 651 CGCAGGCAAA ACCTATAAAG TTTACGGCGG CTTGTGGCTG ATGGTTTGGG

 701 TCTTCCTTTT CGGCATCGTC AACATCGCCG CACAGGTATT GAGCCAAATG

 751 GAACTCGTCC CCGTATTTAA AGGATAA
```

This corresponds to the amino acid sequence <SEQ ID 380; ORF 107.a>:

```
a107.pep

      1 MVLTFIWATG GLIADAKLPV LFDTQAPTGT NYWIYVATAL PVCLASFGFH

     51 GNVSSLLKYF KGDAPKVAKS IWTGTLIALV IYVLWQTAIQ GNLPRNEFAP

    101 VIAAEGQVSV LIETLSKFAQ TGNMDKILSL FSYMAIATSF LGVTLGLFDY

    151 IADIFKWNDS VSGRTKTAAL TFLPPLISCL LFPTGFVTAI GYVGLAATVW
```

-continued

```
201 TGIIPAMLLY RSRKKFGAGK TYKVYGGLWL MVWVFLFGIV NIAAQVLSQM

251 ELVPVFKG*
```

```
m107/a107  94.8% identity in 154 aa overlap

                    10        20        30        40        50        60
m107.pep   MVLTFIWAAGGLIADAKPSVLFDTQAPAGTNYWIYAXTALPVCLASFGFHGNVSSLLKYF
           |||||||:||||||||| ||||||||:|||||||: ||||||||||||||||||||||||
a107       MVLTFIWATGGLIADAKLPVLFDTQAPTGTNYWIYVATALPVCLASFGFHGNVSSLLKYF
                   10        20        30        40        50        60

                    70        80        90       100       110       120
m107.pep   KGDAPKVAKSIWTGTLIALVIYVLWQTAIQGNLPRNEFAPVIAAEGQVSVLIETLSKFAQ
           ||||||||||||||||||||||||||||||||||||||||||||||||||||||||||||
a107       KGDAPKVAKSIWTGTLIALVIYVLWQTAIQGNLPRNEFAPVIAAEGQVSVLIETLSKFAQ
                   70        80        90       100       110       120

                   130       140       150       160       170
m107.pep   TGNMDKILSLFSYMAIATSFLGVTLGLFDYIAHLQMERQHLRAAPKPPRX
           ||||||||||||||||||||||||||||||||  :
a107       TGNMDKILSLFSYMAIATSFLGVTLGLFDYIADIFKWNDSVSGRTKTAALTFLPPLISCL
                  130       140       150       160       170       180

a107       LFPTGFVTAIGYVGLAATVWTGIIPAMLLYRSRKKFGAGKTYKVYGGLWLMVWVFLFGIV
                  190       200       210       220       230       240
```

The following partial DNA sequence was identified in *N. gonorrhoeae* <SEQ ID 381>:

```
g108.seq
  1 ATGttgccgg gCTTCAACCG GATATTCAaa cggTTTGCTC CAACACTCGG

 51 AAcggCGCAT AAAACGCCgc ccTTCGCGTT ATCCCGAACG GGGCGGCTAA

101 TCAGATCCTA TCGCCATAAA AGGCGGGGTT TCAACCGAAA AGGAATTGAG

151 ATGAATAAAA CCTTGTCTAT TTTGCCGGCG GCAATCTTAC TCGGCGGGTG

201 CGCCGCCGGC GGCAACACAT TCGGCAGCTT AGACGGCGGC ACGGGTATGG

251 GTGGCAGCAT CGTCAAAATG ACGGTAGAAA gccAATGCCG TGCGGAATTG

301 GACAGGCGCA GCGAATGGCG TTTGACCGCG CTGGCGATGA GTGCCGAAAA

351 ACAGGCGGAA TGGGAAAACA AGATTTGCGG CTGCGCTACC GAAGAAGCAC

401 CTAACCAGCT GACCGGCAAC GATGTGATGC AGATGCTGAa ccagtccacG

451 CGCaatcagg cacTtgccgc CCtgaccgTC AAAacggtTT CcgcctgcTT

501 CAaacgcctg tACCGCTAa
```

This corresponds to the amino acid sequence <SEQ ID 382; ORF 108.ng>:

```
g108.pep
  1 MLPGFNRIFK RFAPTLGTAH KTPPFALSRT GRLIRSYRHK RRGFNRKGIE

 51 MNKTLSILPA AILLGGCAAG GNTFGSLDGG TGMGGSIVKM TVESQCRAEL

101 DRRSEWRLTA LAMSAEKQAE WENKICGCAT EEAPNQLTGN DVMQMLNQST

151 RNQALAALTV KTVSACFKRL YR*
```

The following partial DNA sequence was identified in *N. meningitidis* <SEQ ID 383>:

```
m108.seq
  1 ATGTTGCCGG GCTTCAACCG GATATTCAAA CGGTTTGTTC CAACACTCGG

 51 AACGGCGCAT AAAACGCCGC CCTTCGCGTT ATCCCGAACG GGGCGGCTAA

101 TCAGATTCTA TCGCCATAAA AGGCGGGGTT TCAACCGAAA AGGAATTGAG
```

-continued

```
151 ATGAATAAAA CCTTGTCTAT TTTGCCGGTG GCAATCTTAC TCGGCGGCTG

201 CGCCGCCGGA GGCGGTAACA CATTCGGCAG CTTAGACGGT GGCACAGGCA

251 TGGGCGGCAG CATCGTCAAA ATGGCGGTTG GGAGCCAATG CCGTGCGGAA

301 TTGGACAAAC GCAGCGAATG GCGTTTGACC GCGCTGGCGA TGAGTGCCGA

351 AAAACAGGCG GAGTGGGAAA ACAAGATTTG CGCTTGCGTC GCCCAAGAAG

401 CACCCGAACG GATGACCGGC AACGATGTGA TGCAGATGCT GGCTCCGTCC

451 ACGCGCAATC AGGCACTTGC CGCCCTGACC GCCAAAACGG TTTCCGCCTG

501 CTTCAAACAC CTGTACCGCT AA
```

This corresponds to the amino acid sequence <SEQ ID 384; ORF 108>:

```
m108.pep
  1 MLPGFNRIFK RFVPTLGTAH KTPPFALSRT GRLIRFYRHK RRGFNRKGIE

 51 MNKTLSILPV AILLGGCAAG GGNTFGSLDG GTGMGGSIVK MAVGSQCRAE

101 LDKRSEWRLT ALAMSAEKQA EWENKICACV AQEAPERMTG NDVMQMLAPS

151 TRNQALAALT AKTVSACFKH LYR*
```

Computer analysis of this amino acid sequence gave the following results:

Homology with a Predicted ORF from *N. gonorrhoeae*

ORF 108 shows 89.6% identity over a 173 aa overlap with a predicted ORF (ORF 108.ng) from *N. gonorrhoeae*:

```
m108/g108

                     10        20        30        40        50        60
m108.pep    MLPGFNRIFKRFVPTLGTAHKTPPFALSRTGRLIRFYRHKRRGFNRKGIEMNKTLSILPV
            ||||||||||||:|||||||||||||||||||||| |||||||||||||||||||||||:
g108        MLPGFNRIFKRFAPTLGTAHKTPPFALSRTGRLIRSYRHKRRGFNRKGIEMNKTLSILPA
                     10        20        30        40        50        60

                     70        80        90       100       110       120
m108.pep    AILLGGCAAGGGNTFGSLDGGTGMGGSIVKMAVGSQCRAELDKRSEWRLTALAMSAEKQA
            ||||||||||| |||||||||||||||||||:| ||||||||:|||||||||||||||||
g108        AILLGGCAAGG-NTFGSLDGGTGMGGSIVKMTVESQCRAELDRRSEWRLTALAMSAEKQA
                     70         80        90       100       110

                    130       140       150       160       170
m108.pep    EWENKICACVAQEAPERMTGNDVMQMLAPSTRNQALAALTAKTVSACFKHLYRX
            |||||||:|:::|||:::|||||||||  |||||||||||:||||||||:|||
g108        EWENKICGCATEEAPNQLTGNDVMQMLNQSTRNQALAALTVKTVSACFKRLYRX
         120       130       140       150       160       170
```

The following partial DNA sequence was identified in *N. meningitidis* <SEQ ID 385>:

```
a108.seq
  1 ATGTTGCCGG GCTTCAACCG GATATTCAAA CGGTTTGTTC CAACACTCGG

 51 AACGGCGCAT AAAACGCCGC CCTTCGCGTT ATCCCGAACG GGGCGGCTAA

101 TCAGATTCTA TCGCCATAAA AGGCGGGGTT TCAACCGAAA AGGAATTGAG

151 ATGAATAAAA CCTTGTCTAT TTTGCCGGTG GCAATCTTAC TCGGCGGCTG

201 CGCCGCCGGG GGCGGTAACA CATTCGGCAG CTTAGACGGC GGCACAGGTA

251 TGGGCGGCAG CATCGTCAAA ATGGCGGTAG AAAGCCAATG CCGTGCGGAA

301 TTGAACAAAC GCAGCGAATG GCGTTTGACC GCGCTGGCGA TGAGTGCCGA
```

-continued

```
351 AAAACAGGCG GAATGGGAAA ACAAGATTTG CGCTTGCGTC GCCCAAGAAG

401 CACCCAACCA GCTGACCGGC AACGATGTGA TGCAGATGCT GGATCCGTCC

451 ACGCGCAATC AGGCACTTGC CGCCCTGACC GCCAAAACGG TTTCCGCCTG

501 CTTCAAACAC CTGTACCGCT AA
```

This corresponds to the amino acid sequence <SEQ ID 386; ORF 108.a>:

```
a108.pep

      1  MLPGFNRIFK RFVPTLGTAH KTPPFALSRT GRLIRFYRHK RRGFNRKGIE

     51  MNKTLSILPV AILLGGCAAG GGNTFGSLDG GTGMGGSIVK MAVESQCRAE

    101  LNKRSEWRLT ALAMSAEKQA EWENKICACV AQEAPNQLTG NDVMQMLDPS

    151  TRNQALAALT AKTVSACFKH LYR*

m108/a108  96.5% identity in 173 aa overlap

                   10        20        30        40        50        60
m108.pep  MLPGFNRIFKRFVPTLGTAHKTPPFALSRTGRLIRFYRHKRRGFNRKGIEMNKTLSILPV
          ||||||||||||||||||||||||||||||||||||||||||||||||||||||||||||
a108      MLPGFNRIFKRFVPTLGTAHKTPPFALSRTGRLIRFYRHKRRGFNRKGIEMNKTLSILPV
                   10        20        30        40        50        60
                   70        80        90       100       110       120
m108.pep  AILLGGCAAGGGNTFGSLDGGTGMGGSIVKMAVGSQCRAELDKRSEWRLTALAMSAEKQA
          ||||||||||||||||||||||||||||||||| |||||||:||||||||||||||||||
a108      AILLGGCAAGGGNTFGSLDGGTGMGGSIVKMAVESQCRAELNKRSEWRLTALAMSAEKQA
                   70        80        90       100       110       120
                  130       140       150       160       170
m108.pep  EWENKICACVAQEAPERMTGNDVMQMLAPSTRNQALAALTAKTVSACFKHLYRX
          |||||||||||||||:::||||||||| ||||||||||||||||||||||||||
a108      EWENKICACVAQEAPNQLTGNDVMQMLDPSTRNQALAALTAKTVSACFKHLYRX
                  130       140       150       160       170
```

The following partial DNA sequence was identified in *N. gonorrhoeae* <SEQ ID 387>:

```
g109.seq
  1 ATGTATTATC GCCGGGTTGT GGGGCTATCC GATGGACTTG GCGATTTGGC

 51 AGCCGGTATT GATCGTAGGC GTATGCTTAC CGCTTTTGGA AGCGGGCATG

101 GAAATGACGC GCAAAGGCAA AACCACCCAA TCCGCCGCCA TCGTGGTGTT

151 CTCTTCCGTC TGGTCAATCC GGTTTTCGGC TGGGCGTTGA CGATGCTGTT

201 GGATAATTTG GGCTTAATCG GCTGCAAAGA ACGCAGCGCG CAATTAGGTT

251 TTGTCGGACG AGTATTGATA CCCGCAGTAG GTTTCTTAAT CTTGTGTGTG

301 GCGATGGGTG CGGTCGGGAT GCTGCCCGGT ATCCCTCCGT TTTGGAGCA

351 GTTCAAATCT TTGGGCTAG
```

This corresponds to the amino acid sequence <SEQ ID 388; ORF 109.ng>:

```
g109.pep
  1 MYYRRVVGLS DGLGDLAAGI DRRRMLTAFG SGHGNDAQRQ NHPIRRHRGV

 51 LFRLVNPVFG WALTMLLDNL GLIGCKERSA QLGFVGRVLI PAVGFLILCV

101 AMGAVGMLPG IPPFLEQFKS LG
```

The following partial DNA sequence was identified in *N. meningitidis* <SEQ ID 389>:

```
m109.seq
   1 ATGTATTATC GCCGGGTTAT GGGGCTATCC GATGGACTTG GCGATTTGGC

  51 AGCCGGTATT GAGCGTAGCC TTGGTCGTAG GCGTATACTT ACCGCTTTTG

 101 GAAGCGGGCA TGGAAATGAC GCGCAAAGGC AAAACCACCC AATCCGCCGC

 151 CATCGTGGTG TTCTCTTCCG CCTTGTCAAT CCGGTTTTCG GCTGGGCGTT

 201 GACGATGCTG TTGGATAATT TGGGCTTAAT CGGCTGCAAA GAGCGCAGTG

 251 CGCAATTAGG TTTCGCCGGA CGCGTGTTGA TACCCGCAGT AGGTTTCTTG

 301 ATCTTGTGTG TGGCGATGGG TGCGGTCGGG ATGCTGCCCG GTATCCCGCC

 351 GTTTTTGGAA CACTTCAAAT CTTTGGGCTA G
```

This corresponds to the amino acid sequence <SEQ ID 4; ORF 109>:

```
m109.pep
   1 MYYRRVMGLS DGLGDLAAGI ERSLGRRRIL TAFGSGHGND AQRQNHPIRR

  51 HRGVLFRLVN PVFGWALTML LDNLGLIGCK ERSAQLGFAG RVLIPAVGFL

 101 ILCVAMGAVG MLPGIPPFLE HFKSLG*
```

Computer analysis of this amino acid sequence gave the following results:

Homology with a Predicted ORF from *N. gonorrhoeae*

ORF 109 shows 92.9% identity over a 126 aa overlap with a predicted ORF (ORF 109.ng) from *N. gonorrhoeae*:

```
m109/g109

                   10        20        30        40        50        60
m109.pep   MYYRRVMGLSDGLGDLAAGIERSLGRRRILTAFGSGHGNDAQRQNHPIRRHRGVLFRLVN
           ||||||:||||||||||||||:|    ||:|||||||||||||||||||||||||||||||
g109       MYYRRVVGLSDGLGDLAAGIDR----RRMLTAFGSGHGNDAQRQNHPIRRHRGVLFRLVN
                   10        20            30        40        50

                   70        80        90       100       110       120
m109.pep   PVFGWALTMLLDNLGLIGCKERSAQLGFAGRVLIPAVGFLILCVAMGAVGMLPGIPPFLE
           ||||||||||||||||||||||||||||:|||||||||||||||||||||||||||||||
g109       PVFGWALTMLLDNLGLIGCKERSAQLGFVGRVLIPAVGFLILCVAMGAVGMLPGIPPFLE
             60        70        80        90       100       110

m109.pep   HFKSLGX
           :|||||
g109       QFKSLGX
            120
```

The following partial DNA sequence was identified in *N. meningitidis* <SEQ ID 391>:

```
a109.seq
   1 ATGTATTATC GCCGGGTTGT GGGGCTATCC GATGGACTTG GCGATTTGGC

  51 AGCCGGTATT GAGCGTAGCC TTGGTCGTAG GCGTATACTT ACCGCTTTTG

 101 GAAGCGGGCA TGGAAATGAC GCGCAAAGGC AAAACCACCC AATCCGCCGC

 151 CACCGTGGTG TTCTCTTCCG CTTGGTCAAT CCGGTTTTCG GCTGGGCGTT

 201 GACGATGCTG TTGGATAATT TGGGCTTAAT CGGCTGCAAA GAGCGCAGCG

 251 CGCAATTAGG TTTCACCGGA CGCGTATTGA TACCCGTAGT AGGTTTCTTG

 301 ATCTTGTGTG TGGCGATGGG TGCGGTCGGG ATGCTGCCCG GTATCCCGCC

 351 GTTTTTGGAG CACTTCAAAT CTTTGGGCTA G
```

This corresponds to the amino acid sequence <SEQ ID 392; ORF 109>:

```
a109.pep

      1 MYYRRVVGLS DGLGDLAAGI ERSLGRRRIL TAFGSGHGND AQRQNHPIRR

     51 HRGVLFRLVN PVFGWALTML LDNLGLIGCK ERSAQLGFTG RVLIPVVGFL

    101 ILCVAMGAVG MLPGIPPFLE HFKSLG*

m109/a109 97.6% identity in 126 aa overlap

                    10        20        30        40        50        60
m109.pep    MYYRRVMGLSDGLGDLAAGIERSLGRRRILTAFGSGHGNDAQRQNHPIRRHRGVLFRLVN
            ||||||:|||||||||||||||||||||||||||||||||||||||||||||||||||||
a109        MYYRRVVGLSDGLGDLAAGIERSLGRRRILTAFGSGHGNDAQRQNHPIRRHRGVLFRLVN
                    10        20        30        40        50        60

                    70        80        90       100       110       120
m109.pep    PVFGWALTMLLDNLGLIGCKERSAQLGFAGRVLIPAVGFLILCVAMGAVGMLPGIPPFLE
            ||||||||||||||||||||||||||||:||||||:||||||||||||||||||||||||
a109        PVFGWALTMLLDNLGLIGCKERSAQLGFTGRVLIPVVGFLILCVAMGAVGMLPGIPPFLE
                    70        80        90       100       110       120

m109.pep    HFKSLGX
            |||||||
a109        HFKSLGX
```

The following partial DNA sequence was identified in *N. gonorrhoeae* <SEQ ID 393>:

```
g111.seq
   1 ATGCCGTCTG AAACACGCCT GCCGAACCTT ATCCGCGCCT TGATATTTGC

  51 CCTGGGTTTC ATCTTCCTGA ACGCCTGTTC GGaacaaacC GCGCAaaccg

 101 TTACCCTGCA AGGCGAAACG ATGGGTACGA CCtATACCGT CAAATACCTT

 151 TCAAATAATC GGGACAAACT CCCCTCCCCT GCCAAAATAC AAAAGCGCAT

 201 TGATGATGCG CTTAAAGAAG TCAACCGGCA GATGtccaCC TACCAGACCG

 251 ATTCCGAAAT CAGCCGGTTt atacagacan atgctggaga gctcttcgcg

 301 tntcatgcag nttctataac tgattccgcc gaagactgtc tgcctaatac

 351 gcctatctca tcggcgctct ga
```

This corresponds to the amino acid sequence <SEQ ID 394; ORF 111.ng>:

```
g111.pep
   1 MPSETRLPNL IRALIFALGF IFLNACSEQT AQTVTLQGET MGTTYTVKYL

  51 SNNRDKLPSP AKIQKRIDDA LKEVNRQMST YQTDSEISRF IQTAGELFAH

 101 ASITDSAEDC LPNTPISSAL *
```

The following partial DNA sequence was identified in *N. meningitidis* <SEQ ID 395>:

```
m111.seq
   1 ATGCCGTCTG AAACACGCCT GCCGAACTTT ATCCGCGTCT TGATATTTGC

  51 CCTGGGTTTC ATCTTCCTGA ACGCCTGTTC GGAACAAACC GCGCAAACCG

 101 TTACCCTGCA AGGCGAAACG ATGGGCACGA CCTATAyCGT CAAATACCTT

 151 TCAAATAATC GGGACAAACT CCCCTCACCT GCCGAAATAC AwAAACGCAT
```

-continued

```
 201 CGATGACGCG CTTAAAGAAk TCAACCGGyA GATGTCCACC TATCAGCCCG

 251 ACTCCGAAAT CAGCCGGTTC AACCAACACA CAGCCGGCAA GCCCCTCCGC

 301 ATTTCAAGCG ACTTCGCACA CGTTACTGCC GAAGCCGTCC GCCTGAACCG

 351 CCTGACACAC GGCGCGCTGG ACGTAACCGT CGGCCCCTTG GTCAACCTTT

 401 GGGGATTCGG CCCCGACAAA TCCGTTACCC GTGAACCGTC GCCGGAACAA

 451 ATCAAACAGG CGGCATCTTA TACGGGCATA GACAAAATCA TTTTGAAACA

 501 AGGCAAAGAT TACGCTTCCT TGAGCAAAAC CCACCCCAAG GCCTATTTGG

 551 ATTTATCTTC GATTGCCAAA GGCTTCGGCG TTGATAAAGT TGCGGGCGAA

 601 CTGGAAAAAT ACGGCATTCA AAATTATCTG GTCGAAATCG GCGGCGAGTT

 651 GCACGGCAAA GGCAAAAACG CGCGCGGCGA ACCGTGGCGC ATCGGTATCG

 701 AGCAGCCCAA TATCGTCCAA GGCGGCAATA CGCAGATTAT CGTCCCGCTG

 751 AACAACCGTT CGCTTGCCAC TTCCGGCGAT TACCGTATTT CCACGTCGA

 801 TAAAAACGGC AAACGCCTCT CCCATATCAT CAACCCGAAC AACAAACGAC

 851 CCATCAGCCA CAACCTCGCC TCCATCAGCG TGGTCGCAGA CAGTGCGATG

 901 ACGGCGGACG GCTTGTCCAC AGGATTATTC GTATTGGGCG AAACCGAAGC

 951 CTTAAAGCTG GCAGAGCGCG AAAAACTCGC TGTTTTCCTG ATTGTCAGGG

1001 ATAAAGGCGG cTACCGCACC GCCATGTCTT CCGAATTTGA AAAACTGcTC

1051 CGCTAA
```

This corresponds to the amino acid sequence <SEQ ID 396; ORF 111>:

```
m111.pep
  1 MPSETRLPNF IRVLIFALGF IFLNACSEQT AQTVTLQGET MGTTYXVKYL

 51 SNNRDKLPSP AEIXKRIDDA LKEXNRXMST YQPDSEISRF NQHTAGKPLR

101 ISSDFAHVTA EAVRLNRLTH GALDVTVGPL VNLWGFGPDK SVTREPSPEQ

151 IKQAASYTGI DKIILKQGKD YASLSKTHPK AYLDLSSIAK GFGVDKVAGE

201 LEKYGIQNYL VEIGGELHGK GKNARGEPWR IGIEQPNIVQ GGNTQIIVPL

251 NNRSLATSGD YRIFHVDKNG KRLSHIINPN NKRPISHNLA SISVVADSAM

301 TADGLSTGLF VLGETEALKL AEREKLAVFL IVRDKGGYRT AMSSEFEKLL

351 R*
```

ORF 111 shows 88.7% identity over a 97 aa overlap with a predicted ORF (ORF 111.ng) from *N. gonorrhoeae*:

```
m111.pep/g111.pep

                    10         20         30         40         50         60
     m111.pep  MPSETRLPNFIRVLIFALGFIFLNACSEQTAQTVTLQGETMGTTYXVKYLSNNRDKLPSP
               ||||||||:||:||||||||||||||||||||||||||||||||:||||||||||||||
     g111      MPSETRLPNLIRALIFALGFIFLNACSEQTAQTVTLQGETMGTTYTVKYLSNNRDKLPSP
                    10         20         30         40         50         60

                    70         80         90        100        110        120
     m111.pep  AEIXKRIDDALKEXNRXMSTYQPDSEISRFNQHTAGKPLRISSDFAHVTAEAVRLNRLTH
               |:| |||||||||| || ||||| |||||||| | :||:
     g111      AKIQKRIDDALKEVNRQMSTYQTDSEISRFIQTXAGELFAXHAXSITDSAEDCLPNTPIS
                    70         80         90        100        110        120
```

-continued

```
              130        140        150        160        170        180
m111.pep   GALDVTVGPLVNLWGFGPDKSVTREPSPEQIKQAASYTGIDKIILKQGKDYASLSKTHPK

g111       SALX
```

The following partial DNA sequence was identified in *N. meningitidis* <SEQ ID 397>:

```
a111.seq
   1 ATGCCGTCTG AAACACGCCT GCCGAACTTT ATCCGCACCT TGATATTTGC
  51 CCTGAGTTTT ATCTTCCTGA ACGCCTGTTC GGAACAAACC GCGCAAACCG
 101 TTACCCTGCA AGGTGAAACG ATGGGCACGA CCTATACCGT CAAATACCTT
 151 TCAAATAATC GGGACAAACT CCCCTCACCT GCCGAAATAC AAAAGCGCAT
 201 CGATGACGCG CTTAAAGAAG TCAACCGGCA GATGTCCACC TATCAGCCCG
 251 ACTCCGAAAT CAGCCGGTTC AACCAACACA CAGCCGGCAA GCCCCTCCGC
 301 ATTTCAAGCG ACTTCGCACA CGTTACTGCC GAAGCCGTCC ACCTGAACCG
 351 CCTGACACAC GGCGCGCTGG ACGTAACCGT CGGCCCCTTG GTCAACCTTT
 401 GGGGATTCGG CCCCGACAAA TCCGTTACCC GTGAACCGTC GCCGGAACAA
 451 ATCAAACAAG CAGCATCTTA TACGGGCATA GACAAAATCA TTTTGAAACA
 501 AGGCAAAGAT TACGCTTCCT TGAGCAAAAC CCACCCCAAG GCCTATTTGG
 551 ATTTATCTTC GATTGCCAAA GGCTTCGGCG TTGATAAAGT TGCGGGCGAA
 601 CTGGAAAAAT ACGGCATTCA AAATTATCTG GTCGAAATCG GCGGCGAGTT
 651 GCACGGCAAA GGCAAAAACG CGCGCGGCGA ACCTTGGCGC ATCGGCATCG
 701 AACAGCCCAA CATCGTCCAA GGCGGCAATA CGCAGATTAT CGTCCCGCTG
 751 AACAACCGTT CGCTTGCCAC TTCCGGCGAT TACCGTATTT TCCACGTCGA
 801 TAAAAGCGGC AAACGCCTCT CCCATATCAT TAATCCGAAC AACAAACGAC
 851 CCATCAGCCA CAACCTCGCC TCCATCAGCG TGGTCGCAGA CAGTGCGATG
 901 ACGGCGGACG GCTTGTCCAC AGGATTATTC GTATTGGGCG AAACCGAAGC
 951 CTTAAAGCTG GCAGAGCGCG AAAAACTCGC TGTTTTCCTG ATTGTCAGGG
1001 ATAAAGGCGG CTACCGCACC GCCATGTCTT CCGAATTTGA AAAACTGCTC
1051 CGCTAA
```

This corresponds to the amino acid sequence <SEQ ID 398; ORF 111.a>:

```
a111•pep
     1 MPSETRLPNF IRTLIFALSF IFLNACSEQT AQTVTLQGET MGTTYTVKYL
    51 SNNRDKLPSP AEIQKRIDDA LKEVNRQMST YQPDSEISRF NQHTAGKPLR
   101 ISSDFAHVTA EAVHLNRLTH GALDVTVGPL VNLWGFGPDK SVTREPSPEQ
   151 IKQAASYTGI DKIILKQGKD YASLSKTHPK AYLDLSSIAK GFGVDKVAGE
   201 LEKYGIQNYL VEIGGELHGK GKNARGEPWR IGIEQPNIVQ GGNTQIIVPL
   251 NNRSLATSGD YRIFHVDKSG KRLSHIINPN NKRPISHNLA SISVVADSAM
   301 TADGLSTGLF VLGETEALKL AEREKLAVFL IVRDKGGYRT AMSSEFEKLL
   351 R*
```

-continued

```
m111/a111  97.7% identity in 351 aa overlap

                   10        20        30        40        50        60
m111.pep   MPSETRLPNFIRVLIFALGFIFLNACSEQTAQTVTLQGETMGTTYXVKYLSNNRDKLPSP
           |||||||||||:|||||:|||||||||||||||||||||||||||:||||||||||||||
a111       MPSETRLPNFIRTLIFALSFIFLNACSEQTAQTVTLQGETMGTTYTVKYLSNNRDKLPSP
                   10        20        30        40        50        60

                   70        80        90       100       110       120
m111.pep   AEIXKRIDDALKEXNRXMSTYQPDSEISRFNQHTAGKPLRISSDFAHVTAEAVRLNRLTH
           ||| ||||||||| || ||||||||||||||||||||||||||||||||||||:||||||
a111       AEIQKRIDDALKEVNRQMSTYQPDSEISRFNQHTAGKPLRISSDFAHVTAEAVHLNRLTH
                   70        80        90       100       110       120

                  130       140       150       160       170       180
m111.pep   GALDVTVGPLVNLWGFGPDKSVTREPSPEQIKQAASYTGIDKIILKQGKDYASLSKTHPK
           ||||||||||||||||||||||||||||||||||||||||||||||||||||||||||||
a111       GALDVTVGPLVNLWGFGPDKSVTREPSPEQIKQAASYTGIDKIILKQGKDYASLSKTHPK
                  130       140       150       160       170       180

                  190       200       210       220       230       240
m111.pep   AYLDLSSIAKGFGVDKVAGELEKYGIQNYLVEIGGELHGKGKNARGEPWRIGIEQPNIVQ
           ||||||||||||||||||||||||||||||||||||||||||||||||||||||||||||
a111       AYLDLSSIAKGFGVDKVAGELEKYGIQNYLVEIGGELHGKGKNARGEPWRIGIEQPNIVQ
                  190       200       210       220       230       240

                  250       260       270       280       290       300
m111.pep   GGNTQIIVPLNNRSLATSGDYRIFHVDKNGKRLSHIINPNNKRPISHNLASISVVADSAM
           ||||||||||||||||||||||||||||:|||||||||||||||||||||||||||||||
a111       GGNTQIIVPLNNRSLATSGDYRIFHVDKSGKRLSHIINPNNKRPISHNLASISVVADSAM
                  250       260       270       280       290       300

                  310       320       330       340       350
m111.pep   TADGLSTGLFVLGETEALKLAEREKLAVFLIVRDKGGYRTAMSSEFEKLLRX
           ||||||||||||||||||||||||||||||||||||||||||||||||||||
a111       TADGLSTGLFVLGETEALKLAEREKLAVFLIVRDKGGYRTAMSSEFEKLLRX
                  310       320       330       340       350
```

The following partial DNA sequence was identified in *N. gonorrhoeae* <SEQ ID 399>:

```
g111-1.seq
   1 ATGCCGTCTG AAACACGCCT GCCGAACCTT ATCCGCGCCT TGATATTTGC
  51 CCTGGGTTTC ATCTTCCTGA ACGCCTGTTC GGAACAAACC GCGCAAacCG
 101 TTACCCTGCA AGGCGAAACG ATGGGTACGA CCTATACCGT CAAATACCTT
 151 TCAAATAATC GGGACAAACT CCCCTCCCCT GCCAAAATAC AAAAGCGCAT
 201 TGATGATGCG CTTAAAGAAG TCAACCGGCA GATGTCCACC TACCAGACCG
 251 ATTCCGAAAT CAGCCGGTTC AACCAACACA CAGCCGGCAA GCCCCTCCGC
 301 ATTTCAAGCG ATTTCGCACA CGTTACCGCC GAAGCCGTCC GCCTGAACCG
 351 CCTGACTCAC GGCGCACTGG ACGTAACCGT CGGCCCTTTG GTCAACCTTT
 401 GGGGGTTCGG CCCCGACAAA TCCGTTACCC GTGAACCGTC GCCGGAACAA
 451 ATCAAACAGG CGGCATCTTA TACGGGCATA GACAAAATCA TTTTGCAACA
 501 AGGCAAAGAT TACGCTTCCT TGAGCAAAAC CCACCCCAAA GCCTATTTGG
 551 ATTTATCTTC GATTGCCAAA GGCTTCGGCG TTGATAAAGT TGCGGGCGAA
 601 CTGGAAAAAT ACGGCATTCA AAATTATCTG GTCGAAATCG GCggcGAGTT
 651 GCACGGCAAA GGCAAAAATG CGCACGGCGA ACCGTGGCGC ATCGGTATAG
 701 AGCAACCCAA TATcatccaa ggcggcaata cgcAGattat cgtcccgctg
 751 aaCaaccgtt cgcttgccac ttccggcgAT taccgtaTTT tccacgtcgA
 801 TAAAAACGGC Aaacgccttt cccacATCAT CAATCCCAAC AACAAACGAC
 851 CCATCAGcCA CAAcctcgcc tcCATCAgCg TGGTCTCAGA CAGTGCAATG
 901 ACGGCGGACG GTTTATCCAC AGGATTATTT GTTTTAGGCG AAACCGAAGC
```

```
 951 CTTAAGGCTG GCAGAACAAG AAAAACTCGC TGTTTTCCTA ATTGTCCGGG

1001 ATAAGGACGG CTACCGCACC GCCATGTCTT CCGAATTTGC CAAGCTGCTC

1051 CGCTAA
```

This corresponds to the amino acid sequence <SEQ ID 400; ORF 111-1.ng>:

```
g111-1.pep
  1 MPSETRLPNL IRALIFALGF IFLNACSEQT AQTVTLQGET MGTTYTVKYL

 51 SNNRDKLPSP AKIQKRIDDA LKEVNRQMST YQTDSEISRF NQHTAGKPLR

101 ISSDFAHVTA EAVRLNRLTH GALDVTVGPL VNLWGFGPDK SVTREPSPEQ

151 IKQAASYTGI DKIILQQGKD YASLSKTHPK AYLDLSSIAK GFGVDKVAGE

201 LEKYGIQNYL VEIGGELHGK GKNAHGEPWR IGIEQPNIIQ GGNTQIIVPL

251 NNRSLATSGD YRIFHVDKNG KRLSHIINPN NKRPISHNLA SISVVSDSAM

301 TADGLSTGLF VLGETEALRL AEQEKLAVFL IVRDKDGYRT AMSSEFAKLL

351 R*
```

The following partial DNA sequence was identified in *N. meningitidis* <SEQ ID 401>:

```
m111-1.seq
   1 ATGCCGTCTG AAACACGCCT GCCGAACTTT ATCCGCGTCT TGATATTTGC

  51 CCTGGGTTTC ATCTTCCTGA ACGCCTGTTC GGAACAAACC GCGCAAACCG

 101 TTACCCTGCA AGGCGAAACG ATGGGCACGA CCTATACCGT CAAATACCTT

 151 TCAAATAATC GGGACAAACT CCCCTCACCT GCCGAAATAC AAAAACGCAT

 201 CGATGACGCG CTTAAAGAAG TCAACCGGCA GATGTCCACC TATCAGCCCG

 251 ACTCCGAAAT CAGCCGGTTC AACCAACACA CAGCCGGCAA GCCCCTCCGC

 301 ATTTCAAGCG ACTTCGCACA CGTTACTGCC GAAGCCGTCC GCCTGAACCG

 351 CCTGACACAC GGCGCGCTGG ACGTAACCGT CGGCCCCTTG GTCAACCTTT

 401 GGGGATTCGG CCCCGACAAA TCCGTTACCC GTGAACCGTC GCCGGAACAA

 451 ATCAAACAGG CGGCATCTTA TACGGGCATA GACAAAATCA TTTTGAAACA

 501 AGGCAAAGAT TACGCTTCCT TGAGCAAAAC CCACCCCAAG GCCTATTTGG

 551 ATTTATCTTC GATTGCCAAA GGCTTCGGCG TTGATAAAGT TGCGGGCGAA

 601 CTGGAAAAAT ACGGCATTCA AAATTATCTG GTCGAAATCG GCGGCGAGTT

 651 GCACGGCAAA GGCAAAAACG CGCGCGGCGA ACCGTGGCGC ATCGGTATCG

 701 AGCAGCCCAA TATCGTCCAA GGCGGCAATA CGCAGATTAT CGTCCCGCTG

 751 AACAACCGTT CGCTTGCCAC TTCCGGCGAT TACCGTATTT TCCACGTCGA

 801 TAAAAACGGC AAACGCCTCT CCCATATCAT CAACCCGAAC AACAAACGAC

 851 CCATCAGCCA CAACCTCGCC TCCATCAGCG TGGTCGCAGA CAGTGCGATG

 901 ACGGCGGACG GCTTGTCCAC AGGATTATTC GTATTGGGCG AAACCGAAGC

 951 CTTAAAGCTG GCAGAGCGCG AAAAACTCGC TGTTTTCCTG ATTGTCAGGG

1001 ATAAAGGCG GCTACCGCACC GCCATGTCTT CCGAATTTGA AAAACTGCTC

1051 CGCTAA
```

This corresponds to the amino acid sequence <SEQ ID 402; ORF 111-1>:

m111-1.pep

1 MPSETRLPNF IRTLIFALSF IFLNACSEQT AQTVTLQGET MGTTYTVKYL

51 SNNRDKLPSP AEIQKRIDDA LKEVNRQMST YQPDSEISRF NQHTAGKPLR

101 ISSDFAHVTA EAVRLNRLTH GALDVTVGPL VNLWGFGPDK SVTREPSPEQ

151 IKQAASYTGI DKIILKQGKD YASLSKTHPK AYLDLSSIAK GFGVDKVAGE

201 LEKYGIQNYL VEIGGELHGK GKNARGEPWR IGIEQPNIVQ GGNTQIIVPL

251 NNRSLATSGD YRIFHVDKNG KRLSHIINPN NKRPISHNLA SISVVADSAM

301 TADGLSTGLF VLGETEALKL AEREKLAVFL IVRDKGGYRT AMSSEFEKLL

351 R* m111-1/g111-1 96.6% identity in 351 aa overlap

```
                    10        20        30        40        50        60
m111-1.pep MPSETRLPNFIRVLIFALGFIFLNACSEQTAQTVTLQGETMGTTYTVKYLSNNRDKLPSP
           |||||||||:||:|||||||||||||||||||||||||||||||||||||||||||||||
g111-1     MPSETRLPNLIRALIFALGFIFLNACSEQTAQTVTLQGETMGTTYTVKYLSNNRDKLPSP
                    10        20        30        40        50        60

                    70        80        90       100       110       120
m111-1.pep AEIQKRIDDALKEVNRQMSTYQPDSEISRFNQHTAGKPLRISSDFAHVTAEAVRLNRLTH
           |:|||||||||||||||||||| |||||||||||||||||||||||||||||||||||||
g111-1     AKIQKRIDDALKEVNRQMSTYQTDSEISRFNQHTAGKPLRISSDFAHVTAEAVRLNRLTH
                    70        80        90       100       110       120

                   130       140       150       160       170       180
m111-1.pep GALDVTVGPLVNLWGFGPDKSVTREPSPEQIKQAASYTGIDKIILKQGKDYASLSKTHPK
           |||||||||||||||||||||||||||||||||||||||||||||:||||||||||||||
g111-1     GALDVTVGPLVNLWGFGPDKSVTREPSPEQIKQAASYTGIDKIILQQGKDYASLSKTHPK
                   130       140       150       160       170       180

                   190       200       210       220       230       240
m111-1.pep AYLDLSSIAKGFGVDKVAGELEKYGIQNYLVEIGGELHGKGKNARGEPWRIGIEQPNIVQ
           ||||||||||||||||||||||||||||||||||||||||||||||||:|||||||||:|
g111-1     AYLDLSSIAKGFGVDKVAGELEKYGIQNYLVEIGGELHGKGKNAHGEPWRIGIEQPNIIQ
                   190       200       210       220       230       240

                   250       260       270       280       290       300
m111-1.pep GGNTQIIVPLNNRSLATSGDYRIFHVDKNGKRLSHIINPNNKRPISHNLASISVVADSAM
           |||||||||||||||||||||||||||||||||||||||||||||||||||||||:||||
g111-1     GGNTQIIVPLNNRSLATSGDYRIFHVDKNGKRLSHIINPNNKRPISHNLASISVVSDSAM
                   250       260       270       280       290       300

                   310       320       330       340       350
m111-1.pep TADGLSTGLFVLGETEALKLAEREKLAVFLIVRDKGGYRTAMSSEFEKLLRX
           ||||||||||||||||||:|||:||||||||||||| ||||||||| |||||
g111-1     TADGLSTGLFVLGETEALRLAEQEKLAVFLIVRDKDGYRTAMSSEFAKLLRX
                   310       320       330       340       350
```

g111-1 (SEQ ID 400)/p44550 (SEQ ID 4161)

sp|P44550|YOJL_HAEIN HYPOTHETICAL LIPOPROTEIN HI0172 PRECURSOR >gi|1074292|pir||C64144 hypothetical protein HI0172 - Haemophilus influenzae (strain Rd KW20) > gi|1573128 (U32702) lipoprotein, putative [Haemophilus influenzae Rd] Length = 346

Score = 349 bits (885), Expect = 2e - 95

Identities = 177/328 (53%), Positives = 240/328 (72%), Gaps = 4/328 (1%)

```
Query:  23  LNACSEQTAQTVTLQGETMGTTYXVKYLSNNRDKLPSPAEIXKRIDDALKEXNRXMSTYQ  82
            L AC ++T + ++L G+TMGTTY VKYL +      S  +  + I+  LK+ N  MSTY+
Sbjct:  17  LAACQKET-KVISLSGKTMGTTYHVKYLDDGSITATS-EKTHEEIEAILKDVNAKMSTYK  74

Query:  83  PDSEISRFNQHT-AGKPLRISSDFAHVTAEAVRLNRLTHGALDVTVGPLVNLWGFGPDKS 141
             DSE+SRFNQ+T    P+ IS+DFA V AEA+RLN++T GALDVTVGP+VNLWGFGP+K
Sbjct:  75  KDSELSRFNQNTQVNTPIEISADFAKVLAEAIRLNKVTEGALDVTVGPVVNLWGFGPEKR 134

Query: 142  VTREPSPEQIKQAASYTGIDKIILKQGKDYASLSKTHPKAYLDLSSIAKGFGVDKVAGEL 201
              ++P+PEQ+ +  ++ GIDKI L   K+ A+LSK  P+ Y+DLSSIAKGFGVD+VA +L
Sbjct: 135  PEKQPTPEQLAERQAWVGIDKITLDTNKEKATLSKALPQVYVDLSSIAKGFGVDQVAEKL 194

Query: 202  EKYGIQNYLVEIGGELHGKGKNARGEPWRIGIEQPNIVQGGNTQIIVPLNNRSLATSGDY 261
            E+   QNY+VEIGGE+  KGKN  G+PW+I IE+P        + ++ LNN  +A+SGDY
Sbjct: 195  EQLNAQNYMVEIGGEIRAKGKNIEGKPWQIAIEKPTTTGERAVEAVIGLNNMGMASSGDY 254

Query: 262  RIFHVDKNGKRLSHIINPNNKRPISHNLASISVVADSAMTADGLSTGLFVLGETEALKLA 321
            RI+  ++NGKR +H I+P    PI H+LASI+V+A ++MTADGLSTGLFVLGE +AL++A
Sbjct: 255  RIY-FEENGKRFAHEIDPKTGYPIQHHLASITVLAPTSMTADGLSTGLFVLGEDKALEVA 313
```

-continued

```
Query: 322  EREKLAVFLIVRDKGGYRTAMSSEFEKL 349
            E+  LAV+LI+R   G+ T  SS F+KL
Sbjct: 314  EKNNLAVYLIIRTDNGFVTKSSSAFKKL 341
```

The following partial DNA sequence was identified in *N. meningitidis* <SEQ ID 403>:

```
a111-1.seq
   1 ATGCCGTCTG AAACACGCCT GCCGAACTTT ATCCGCACCT TGATATTTGC

  51 CCTGAGTTTT ATCTTCCTGA ACGCCTGTTC GGAACAAACC GCGCAAACCG

 101 TTACCCTGCA AGGTGAAACG ATGGGCACGA CCTATACCGT CAAATACCTT

 151 TCAAATAATC GGGACAAACT CCCCTCACCT GCCGAAATAC AAAAGCGCAT

 201 CGATGACGCG CTTAAAGAAG TCAACCGGCA GATGTCCACC TATCAGCCCG

 251 ACTCCGAAAT CAGCCGGTTC AACCAACACA CAGCCGGCAA GCCCCTCCGC

 301 ATTTCAAGCG ACTTCGCACA CGTTACTGCC GAAGCCGTCC ACCTGAACCG

 351 CCTGACACAC GGCGCGCTGG ACGTAACCGT CGGCCCCTTG GTCAACCTTT

 401 GGGGATTCGG CCCCGACAAA TCCGTTACCC GTGAACCGTC GCCGGAACAA

 451 ATCAAACAAG CAGCATCTTA TACGGGCATA GACAAAATCA TTTTGAAACA

 501 AGGCAAAGAT TACGCTTCCT TGAGCAAAAC CCACCCCAAG GCCTATTTGG

 551 ATTTATCTTC GATTGCCAAA GGCTTCGGCG TTGATAAAGT TGCGGGCGAA

 601 CTGGAAAAAT ACGGCATTCA AAATTATCTG GTCGAAATCG GCGGCGAGTT

 651 GCACGGCAAA GGCAAAAACG CGCGCGGCGA ACCTTGGCGC ATCGGCATCG

 701 AACAGCCCAA CATCGTCCAA GGCGGCAATA CGCAGATTAT CGTCCCGCTG

 751 AACAACCGTT CGCTTGCCAC TTCCGGCGAT TACCGTATTT TCCACGTCGA

 801 TAAAAGCGGC AAACGCCTCT CCCATATCAT TAATCCGAAC AACAAACGAC

 851 CCATCAGCCA CAACCTCGCC TCCATCAGCG TGGTCGCAGA CAGTGCGATG

 901 ACGGCGGACG GCTTGTCCAC AGGATTATTC GTATTGGGCG AAACCGAAGC

 951 CTTAAAGCTG GCAGAGCGCG AAAAACTCGC TGTTTTCCTG ATTGTCAGGG

1001 ATAAAGGCGG CTACCGCACC GCCATGTCTT CCGAATTTGA AAAACTGCTC

1051 CGCTAA
```

This corresponds to the amino acid sequence <SEQ ID 404; ORF 111-1.a>:

a111-1.pep

1 MPSETRLPNF IRTLIFALSF IFLNACSEQT AQTVTLQGET MGTTYTVKYL

51 SNNRDKLPSP AEIQKRIDDA LKEVNRQMST YQPDSEISRF NQHTAGKPLR

101 ISSDFAHVTA EAVHLNRLTH GALDVTVGPL VNLWGFGPDK SVTREPSPEQ

151 IKQAASYTGI DKIILKQGKD YASLSKTHPK AYLDLSSIAK GFGVDKVAGE

201 LEKYGIQNYL VEIGGELHGK GKNARGEPWR IGIEQPNIVQ GGNTQIIVPL

251 NNRSLATSGD YRIFHVDKSG KRLSHIINPN NKRPISHNLA SISVVADSAM

301 TADGLSTGLF VLGETEALKL AEREKLAVFL IVRDKGGYRT AMSSEFEKLL

351 R*

-continued

```
a111-1/m111-1  98.9% identity in 351 aa overlap

                   10        20        30        40        50        60
a111-1.pep  MPSETRLPNFIRTLIFALSFIFLNACSEQTAQTVTLQGETMGTTYTVKYLSNNRDKLPSP
            |||||||||||:|||||:||||||||||||||||||||||||||||||||||||||||||
m111-1      MPSETRLPNFIRVLIFALGFIFLNACSEQTAQTVTLQGETMGTTYTVKYLSNNRDKLPSP
                   10        20        30        40        50        60

                   70        80        90       100       110       120
a111-1.pep  AEIQKRIDDALKEVNRQMSTYQPDSEISRFNQHTAGKPLRISSDFAHVTAEAVHLNRLTH
            |||||||||||||||||||||||||||||||||||||||||||||||||||||:||||||
m111-1      AEIQKRIDDALKEVNRQMSTYQPDSEISRFNQHTAGKPLRISSDFAHVTAEAVRLNRLTH
                   70        80        90       100       110       120

                  130       140       150       160       170       180
a111-1.pep  GALDVTVGPLVNLWGFGPDKSVTREPSPEQIKQAASYTGIDKIILKQGKDYASLSKTHPK
            ||||||||||||||||||||||||||||||||||||||||||||||||||||||||||||
m111-1      GALDVTVGPLVNLWGFGPDKSVTREPSPEQIKQAASYTGIDKIILKQGKDYASLSKTHPK
                  130       140       150       160       170       180

                  190       200       210       220       230       240
a111-1.pep  AYLDLSSIAKGFGVDKVAGELEKYGIQNYLVEIGGELHGKGKNARGEPWRIGIEQPNIVQ
            ||||||||||||||||||||||||||||||||||||||||||||||||||||||||||||
m111-1      AYLDLSSIAKGFGVDKVAGELEKYGIQNYLVEIGGELHGKGKNARGEPWRIGIEQPNIVQ
                  190       200       210       220       230       240

                  250       260       270       280       290       300
a111-1.pep  GGNTQIIVPLNNRSLATSGDYRIFHVDKSGKRLSHIINPNNKRPISHNLASISVVADSAM
            ||||||||||||||||||||||||||||:|||||||||||||||||||||||||||||||
m111-1      GGNTQIIVPLNNRSLATSGDYRIFHVDKNGKRLSHIINPNNKRPISHNLASISVVADSAM
                  250       260       270       280       290       300

                  310       320       330       340       350
a111-1.pep  TADGLSTGLFVLGETEALKLAEREKLAVFLIVRDKGGYRTAMSSEFEKLLRX
            ||||||||||||||||||||||||||||||||||||||||||||||||||||
m111-1      TADGLSTGLFVLGETEALKLAEREKLAVFLIVRDKGGYRTAMSSEFEKLLRX
                  310       320       330       340       350
```

The following partial DNA sequence was identified in *N. gonorrhoeae* <SEQ ID 405>:

```
g114.seq
  1  ATGGCTTCCA TCACTTCGCC GCTGCACGGGG CGCAGCAGG AATGCAGCAA

 51  GACTTTTTTA TGTCCGCCGG GCGGGACGAGT ATGGGGCGG TCAATGTCGG

101  TAACGGTAGG TTTGTTTTGT GTTTCCATTAA CTTAACAAT ATCTGTCGAA

151  TACGGTCAAA GCGGCTATTT TACCAGAGCCG CCGAATGTA AAACAGGGTG

201  TCAGGGCATC AGCCCGAGCT GCCTGAACGAA CGGACGGTT TGCGAGGTAA

251  CGATAAAATG GTCGAGCAGC GAAACATCAAC CAGCGACAT GGCCTGTGCC

301  AGCCGCCTTG TGAACATGAT GTCTTCCTGCG AAGGTTCAG GCGAGCCGCC

351  CGGATGGTTG TGCGCGATAA TCAGGCTGTCG GCATATTCG TCCAATGCCA

401  GTTTGACGAT TTCGCGGATG TAA
```

This corresponds to the amino acid sequence <SEQ ID 406; ORF 114.ng>:

```
g114.pep
  1  MASITSPLHG AQQECSKTFL CPPGGTSMGR SMSVTVGLFC VSINLTISVE

 51  YGQSGYFTRA AECKTGCQGI SPSCLNERTV CEVTIKWSSS ETSTSDMACA

101  SRLVNMMSSC EGSGEPPGWL CAIIRLSAYS SNASLTISRM *
```

The following partial DNA sequence was identified in *N. meningitidis* <SEQ ID 407>:

```
m114.seq
  1  ATGGCTTCCA TCACTTCGCC GCTGCACGGG GCGCACAGAG AATGCAGCAA
```

-continued

```
 51  GACTTTTTTA TGTCCACCGG GCGGGACGAG TATAGGGCGG TCAATGTCGG
101  TAACGGTAGG TTTGTTTTGT GTTTCCATTA ACTTAACAAT ATCTGTTGAA
151  TACGGTTGAA GCGGCTATTT TATCAGAGCC GCCGCATGTA AAACAGAGTG
201  TCAGGGCATC AACCCGAGCT GTCTGAACGA ACAGACGCTT TGCGAkGTAA
251  CGATAAAATG GTCGAGCAGC GACACATCGA CCAGCGACAT TGCCTGTGCC
301  AGCCGCCTTG TGAACATGAT GTCTTCCTGC GAArGTTCsG GCGAGCCGcC
351  CGgATGGTTG TGCGCAATAA TCAGGCTGTC GGCATATTCG TCCAATGCCA
401  GTTTGACGAT TTCGCGGATG TAA
```

This corresponds to the amino acid sequence <SEQ ID 408; ORF 114>:

```
m114.pep

  1  MASITSPLHG AHRECSKTFL CPPGGTSIGR SMSVTVGLFC VSINLTISVE
 51  YGXSGYFIRA AACKTECQGI NPSCLNEQTL CXVTIKWSSS DTSTSDIACA
101  SRLVNMMSSC EXSGEPPGWL CAIIRLSAYS SNASLTISRM *

m114/g114  90.0%  identity over a 140 aa overlap

                   10        20        30        40        50        60
m114.pep   MASITSPLHGAHRECSKTFLCPPGGTSIGRSMSVTVGLFCVSINLTISVEYGXSGYFIRA
           ||||||||||::||||||||||||||:||||||||||||||||||||||| |||| ||
g114       MASITSPLHGAQQECSKTFLCPPGGTSMGRSMSVTVGLFCVSINLTISVEYGQSGYFTRA
                   10        20        30        40        50        60

                   70        80        90       100       110       120
m114.pep   AACKTECQGINPSCLNEQTLCXVTIKWSSSDTSTSDIACASRLVNMMSSCEXSGEPPGWL
           | ||| ||||:||||||:|:| ||||||||:|||||:|||||||||||||| ||||||||
g114       AECKTGCQGISPSCLNERTVCEVTIKWSSSETSTSDMACASRLVNMMSSCEGSGEPPGWL
                   70        80        90       100       110       120
                  130       140
m114.pep   CAIIRLSAYSSNASLTISRMX
           ||||||||||||||||||||
g114       CAIIRLSAYSSNASLTISRMX
                  130       140
```

The following partial DNA sequence was identified in *N. gonorrhoeae* <SEQ ID 409>:

```
a114.seq
  1  ATGCCGGAGG CAAGCATCGC CTCCATCACT TCGCCGCTGC ACGGGGCGCA
 51  ACAGGAATGC AGCAAGACTT TTTTATGTCC GCCGGGCGGG ACGAGTATGG
101  GGCGGTCAAT GTCGGTAACG GTAGGTTTGT TTTGTGTTTC CATTAACTTA
151  ACGATATCTG TCGAATACGG TTGAAGCGGC TATTTTATCA GAGCCGCCGC
201  ATGTAAAACA GGGTGTCAGG GCATCAGCCC GAGCTGCCTG AACGAACGGA
251  CGGTTTGCGC CGTTACGATA AAATGGTCGA GCAGCGACAC ATCGACCAGC
301  GACATTGCCT GTGCCAGCCG CCTTGTGAAC ATGATGTCTT CCTGCGAAGG
351  TTCGGGCGAG CCGCCCGGAT GGTTGTGCGC GATAATCAGG CTGTCGGCAT
401  ATTCGTCCAA TGCCAGTTTG ACAATTTCAC GGATGTAA
```

This corresponds to the amino acid sequence <SEQ ID 410; ORF 114.a>:

```
a114.pep

      1 MPEASIASIT SPLHGAQQEC SKTFLCPPGG TSMGRSMSVT VGLFCVSINL

     51 TISVEYG*SG YFIRAAACKT GCQGISPSCL NERTVCAVTI KWSSSDTSTS

    101 DIACASRLVN MMSSCEGSGE PPGWLCAIIR LSAYSSNASL TISRM*

m114/a114 92.9% identity in 140 aa overlap

                       10        20        30        40        50
m114.pep       MASITSPLHGAHRECSKTFLCPPGGTSIGRSMSVTVGLFCVSINLTISVEYGXSG
               :||||||||::|||||||||||||:||||||||||||||||||||||||||
a114      MPEASIASITSPLHGAQQECSKTFLCPPGGTSMGRSMSVTVGLFCVSINLTISVEYGXSG
                  10        20        30        40        50        60
             60        70        80        90       100       110
m114.pep  YFIRAAACKTECQGINPSCLNEQTLCXVTIKWSSSDTSTSDIACASRLVNMMSSCEXSGE
          |||||||||| ||||:||||||:|:| |||||||||||||||||||||||||||| |||
a114      YFIRAAACKTGCQGISPSCLNERTVCAVTIKWSSSDTSTSDIACASRLVNMMSSCEGSGE
                  70        80        90       100       110       120
            120       130       140
m114.pep  PPGWLCAIIRLSAYSSNASLTISRMX
          ||||||||||||||||||||||||||
a114      PPGWLCAIIRLSAYSSNASLTISRMX
                 130       140
```

The following partial DNA sequence was identified in *N. gonorrhoeae* <SEQ ID 411>:

```
g117.seq
   1 atggtcgacg aactcgacCT GCTGCCCGAT GCCGTCGCCG CCACCCTGCT

  51 TGCCGACATC GGACGCTACG TCCCCGATTG GAACCTATTG GTTTCCGAGC

 101 GCTGCAACAG CACCGTCGCC GAGCTGGTCA AAGGTGtgga CGAAGTGCAG

 151 AAACTTACCC ACTTCGCCCG GGTGGACAGC CTCGCCACGC CGGAAGAACG

 201 CGCACAGCAA GCGGAAACCA TGCGGAAAAT GCTGCTGGCg atggttaccg

 251 Acatccgcgt cgtaTTAATC AAACTGGCGA TGCGTacgcg caccCTGcta

 301 ttTTtaaGCA ACGCCCCCGA CAGCCCTGAA AAACgcgccG TCgccaaAga

 351 aacccTCGAC ATCTTCGCCC CGCTCGCCAA CCGCTTGGGC GTGTGGCAGC

 401 TCAAATGGCA GCTCGAAGAT TTGGGCTTCC GCCATCAAGA ACCCGAAAAA

 451 TACCGCGAAA TCGCCCTGCT TTTGGACGAA AAACGCACCG AACGCCTCGA

 501 ATACATCGAA AACTTCCTCG ATATCCTGCG TACGGAACTC AAAAAATACA

 551 ATATCCACTT TGAAGTCGCC GGCCGTCCGA AACACATCTA CTCCATTTAC

 601 AAAAAAATGG TGAAGAAAAA ACTCAGCTTC GACGgccTGT TCGACATCCG

 651 CGCCGTGCGG ATTCTGGTCG ATACCGTCCC CGaGTGTTAC ACCACGCTGG

 701 gcaTCGTCCA CAGCCTCTGG CAGCCCATTC CCGGCGagtt CGAcgactAC

 751 ATCGCCAACC CCAAAGgcaA CGgttATAAA AGtTTGCACA CCGTCATCGT

 801 cggcccGGAa gacaaaggtg tggaaGtgCA AATCCGCACC TTCGAtatGC

 851 accAATTCaa CgaatTcggT gtcgccgCCC ACTGGCGtta caaagaaggc

 901 ggcaaaggcg attccGCCtA cgaacaaAAA ATcgccTggt TGCgccaACT

 951 CTTGGACTGG CGCGAAAATA TGGCGGAAAG CGGCAAGGAA GACCTCGCCG

1001 CCGCCTTCAA AACCGAGCTT TTCAACGACA CGATTTATGT TTTGACCCCG
```

-continued

```
1051 CACGGCAAAG TCCTCTCTCT GCCAACGGGC GCAACCCCCA TCGACTTCGC

1101 CTACGCCCTG CACAGCAGCA TcggCGACCG CTGCCGGGGC GCGAAAGTCG

1151 AaggGCAGAT TGTGCCGCTG TCCACCCCGC TCGAAAACGG ACAGCGCGTC

1201 GAAATcatta cCGCcaaAGA AGGGCATCCT TCCGTCAACT GGCTTTACGA

1251 AGGctgGGtc aAATCCGGCA AGGCCATCGG caaAATCCGC GCCTAcatCC

1301 GCCAGcaaAa cgCcgaCACC GTGCGCGAAG AAGGCCGTGT CCAACTCGAC

1351 AAGCAGCTTG CCAAACTCAC GCCCAAACCC AACCTGCAAG AGCTTgccga

1401 aaATCTCGGC tacaaAAAGC cagaagacct ctacacCGCc gtcggacaag

1451 gcgaaatttc caaccgcgcc atCcaaaaag cctgcggcac GCTgaacgaa

1501 ccgccccCCG TGCCCGTCAG CGCAACCACC ATCGTCAAAC AGTCCAAAAT

1551 CAAAAAAGGT GGCAAAACCG GCGTGCTCAT CGACGGCGAA GACGGCTTGA

1601 TGACCACGCT TGCCAAATGC TGCAAACCCG CGCCGCCCGA CGATATTGCC

1651 GGCTTCGTTA CCCGCGAGCG CGGCATTTCC GTCCACCGCA AAACCTGCCC

1701 CTCTTTCCGA CACCTTGCCG AACACGCGCC CGAAAAAGTA CTGGACGCAA

1751 GTTGGGCGGC GTTGCAGGAA GGGCAAGTGT TCGCCGTCGA TATCGAAATC

1801 CGCGCCCAAG ACCGCTCCGG GCTTTTGCGC GACGTATCCG ACGCGCTCGC

1851 CCGCCACAAA CTCAACGTTA CCGCCGTGCA AACCCAGTCC CGCGACTTGG

1901 AAGCCAGCAT GAGGTTCACG CTCGAAGTCA AACAAGtCAA CGacCTCCCG

1951 CGCGTCCTCG CCGGCCTCGG CGATGTCAAA GGCGTATTGA GCGTTACCCG

2001 GCTTTAA
```

This corresponds to the amino acid sequence <SEQ ID 412; ORF 117.ng>:

```
g117.pep
  1  MVDELDLLPD AVAATLLADI GRYVPDWNLL VSERCNSTVA ELVKGVDEVQ

 51  KLTHFARVDS LATPEERAQQ AETMRKMLLA MVTDIRVVLI KLAMRTRTLL

101  FLSNAPDSPE KRAVAKETLD IFAPLANRLG VWQLKWQLED LGFRHQEPEK

151  YREIALLLDE KRTERLEYIE NFLDILRTEL KKYNIHFEVA GRPKHIYSIY

201  KKMVKKKLSF DGLFDIRAVR ILVDTVPECY TTLGIVHSLW QPIPGEFDDY

251  IANPKGNGYK SLHTVIVGPE DKGVEVQIRT FDMHQFNEFG VAAHWRYKEG

301  GKGDSAYEQK IAWLRQLLDW RENMAESGKE DLAAAFKTEL FNDTIYVLTP

351  HGKVLSLPTG ATPIDFAYAL HSSIGDRCRG AKVEGQIVPL STPLENGQRV

401  EIITAKEGHP SVNWLYEGWV KSGKAIGKIR AYIRQQNADT VREEGRVQLD

451  KQLAKLTPKP NLQELAENLG YKKPEDLYTA VGQGEISNRA IQKACGTLNE

501  PPPVPVSATT IVKQSKIKKG GKTGVLIDGE DGLMTTLAKC CKPAPPDDIA

551  GFVTRERGIS VHRKTCPSFR HLAEHAPEKV LDASWAALQE GQVFAVDIEI

601  RAQDRSGLLR DVSDALARHK LNVTAVQTQS RDLEASMRFT LEVKQVNDLP

651  RVLAGLGDVK GVLSVTRL*
```

The following partial DNA sequence was identified in *N. meningitidis* <SEQ ID 413>:

```
m117.seq (partial)
   1 . . . GTGAAACTCA AGAAATACAA TGTCCATTTC GAAGTCGCCG GCCGTGCGAA

  51       ACACATCTAC TCCATTTACA AAAAAATGGT GAAGAAAAAA CTCAGCTTCG

 101       ACGGCCTCTT TGACATCCGC GCCGTGCGAA TTCTGGTTGA TATCGTCCAC

 151       GAGTGTTACA CCACGCTGGG TATCGTCCAC AGCCTCTGGC AGCCCATTCC

 201       CGGCGAGTTC GACGACTACA TCGCCAATCC CAAAGGCAAC GGCTATAAAA

 251       GTTTGCACAC CGTCATCGTC GGCAAGGAAG ACAAAGGCGT GGAAGTACAA

 301       ATCCGCACCT TCGATATGCA CCAATTCAAC GAATTCGGTG TCGCCGCCCA

 351       CTGgCGTTAC AAAGAGGGCG GCAAGGGCGA TTCCGCCTAC GAACAGAAAA

 401       TCGCCTGGTT GCGCCAACTC TTGGACTGGC GCGAAAACAT GGCGGAAAGC

 451       GGCAAGGAAG ACCTCGCCGC CGCCTTCAAA ACCGAGCTTT TCAACGACAC

 501       GATTTATGTT TTGACCCCGC ACGGCAAAGT CCTCTCCCTG CCCACGGGCG

 551       CGACCCCCAT CGACTTCGCC TACGCCCTGC ACAGCAGCAT CGGCGACCGT

 601       TGCCGCGGTG CGAAAGTCGA AGGGCAGATT GTGCCGCTGT CCACCCCGCT

 651       CGAAAACGGA CAGCGCGTCG AAATCATTAC CGCCAAAGAA GGGCATCCTT

 701       CCGTCAACTG GCTTTACGAA GGCTGGGTCA AATCCAACAA GGCAATCGGC

 751       AAAATCCGCG CCTACATCCG CCAGCAAAAC GCCGACACCG TGCGCGAAGA

 801       AGGCCGCGTC CAACTCGACA AACAGCTTGC CAAACTCACG CCCAAACCCA

 851       ACCTGCAAGA GCTTGCCGAA AATCTCGGCT ACAAAAAGCC AGAAGACCTC

 901       TACACCGCCG TCGGACAAGG CGAAATTTCC AACCGCGCCA TCCAAAAAGC

 951       CTGCGGCACg CTGAACGAAC CGGCGACCGT ACCCGTCAGC GAAACCACCA

1001       TCGTCAAACA GTCCAAAATC AAAAAAGGCG GCAAAAACGG CGTGCTCATC

1051       GACGGCGAAG ACGGTCTGAT GACCACGCTT GCCAAATGCT GCAAACCCGC

1101       GCCGCCCGAC GATATTATCG GCTTCGTTAC CCGCGAGCGC GgCATTTCAG

1151       TGCACCGCAA AwyyTkCyCG TCTTTCCAAC ACCTCGCCGA ACACGCGCCC

1201       GAwAAAGTGC TGGACGCAAG CTGGGCGGCA TTGCAGGAAG GACAAGTATT

1251       CGCCGTCGAT ATCGAAATCC GCGCCCAAGA CCGCTCCGGG CTTTTGCGCG

1301       ACGTATCCGA CGCGCTCGCC CGCCACAAAC TCAACGTTAC CGCCGTGCAA

1351       ACCCAGTCCC GCGACTTGGA AGCCAGCATG AGGTTCACGC TCGAAGTCAA

1401       ACAAGTCAAC GACCTCCCGC GCGTCCTCGC CAGCCTCGGC GACGTCAAAG

1451       GCGTATTGAG CGTTACCCGG CTTTAA
```

This corresponds to the amino acid sequence <SEQ ID 414; ORF 117>:

```
m117.pep (partial)
  1 . . . VKLKKYNVHF EVAGRPKHIY SIYKKMVKKK LSFDGLFDIR AVRILVDTVP

 51       ECYTTLGIVH SLWQPIPGEF DDYIANPKGN GYKSLHTVIV GPEDKGVEVQ

101       IRTFDMHQFN EFGVAAHWRY KEGGKGDSAY EQKIAWLRQL LDWRENMAES

151       GKEDLAAAFK TELFNDTIYV LTPHGKVLSL PTGATPIDFA YALHSSIGDR

201       CRGAKVEGQI VPLSTPLENG QRVEIITAKE GHPSVNWLYE GWVKSNKAIG
```

-continued

```
251       KIRAYIRQQN ADTVREEGRV QLDKQLAKLT PKPNLQELAE NLGYKKPEDL

301       YTAVGQGEIS NRAIQKACGT LNEPPPVPVS ETTIVKQSKI KKGGKNGVLI

351       DGEDGLMTTL AKCCKPAPPD DIIGFVTRER GISVHRKXXX SFQHLAEHAP

401       XKVLDASWAA LQEGQVFAVD IEIRAQDRSG LLRDVSDALA RHKLNVTAVQ

451       TQSRDLEASM RFTLEVKQVN DLPRVLASLG DVKGVLSVTR L*
```

Computer analysis of this amino acid sequence gave the following results:

Homology with a Predicted ORF from *N. gonorrhoeae*

ORF 117 shows 97.6% identity over a 490 aa overlap with a predicted ORF (ORF 117.ng) from *N. gonorrhoeae*:

```
m117/g117

                                             10        20        30
m117.pep                               VKLKKYNVHFEVAGRPKHIYSIYKKMVKKKL
                                        :|||||:|||||||||||||||||||||||
g117        EKYREIALLLDEKRTERLEYIENFLDILRTELKKYNIHFEVAGRPKHIYSIYKKMVKKKL
            150       160       170       180       190       200

                   40        50        60        70        80        90
m117.pep    SFDGLFDIRAVRILVDTVPECYTTLGIVHSLWQPIPGEFDDYIANPKGNGYKSLHTVIVG
            ||||||||||||||||||||||||||||||||||||||||||||||||||||||||||||
g117        SFDGLFDIRAVRILVDTVPECYTTLGIVHSLWQPIPGEFDDYIANPKGNGYKSLHTVIVG
            210       220       230       240       250       260

                  100       110       120       130       140       150
m117.pep    PEDKGVEVQIRTFDMHQFNEFGVAAHWRYKEGGKGDSAYEQKIAWLRQLLDWRENMAESG
            ||||||||||||||||||||||||||||||||||||||||||||||||||||||||||||
g117        PEDKGVEVQIRTFDMHQFNEFGVAAHWRYKEGGKGDSAYEQKIAWLRQLLDWRENMAESG
            270       280       290       300       310       320

                  160       170       180       190       200       210
m117.pep    KEDLAAAFKTELFNDTIYVLTPHGKVLSLPTGATPIDFAYALHSSIGDRCRGAKVEGQIV
            ||||||||||||||||||||||||||||||||||||||||||||||||||||||||||||
g117        KEDLAAAFKTELFNDTIYVLTPHGKVLSLPTGATPIDFAYALHSSIGDRCRGAKVEGQIV
            330       340       350       360       370       380

                  220       230       240       250       260       270
m117.pep    PLSTPLENGQRVEIITAKEGHPSVNWLYEGWVKSNKAIGKIRAYIRQQNADTVREEGRVQ
            ||||||||||||||||||||||||||||||||||:|||||||||||||||||||||||||
g117        PLSTPLENGQRVEIITAKEGHPSVNWLYEGWVKSGKAIGKIRAYIRQQNADTVREEGRVQ
            390       400       410       420       430       440

                  280       290       300       310       320       330
m117.pep    LDKQLAKLTPKPNLQELAENLGYKKPEDLYTAVGQGEISNRAIQKACGTLNEPPPVPVSE
            ||||||||||||||||||||||||||||||||||||||||||||||||||||||||||| 
g117        LDKQLAKLTPKPNLQELAENLGYKKPEDLYTAVGQGEISNRAIQKACGTLNEPPPVPVSA
            450       460       470       480       490       500

                  340       350       360       370       380       390
m117.pep    TTIVKQSKIKKGGKNGVLIDGEDGLMTTLAKCCKPAPPDDIIGFVTRERGISVHRKXXXS
            ||||||||||||||:|||||||||||||||||||||||||| ||||||||||||||:  |
g117        TTIVKQSKIKKGGKTGVLIDGEDGLMTTLAKCCKPAPPDDIAGFVTRERGISVHRKTCPS
            510       520       530       540       550       560

                  400       410       420       430       440       450
m117.pep    FQHLAEHAPXKVLDASWAALQEGQVFAVDIEIRAQDRSGLLRDVSDALARHKLNVTAVQT
            |:||||||| ||||||||||||||||||||||||||||||||||||||||||||||||||
g117        FRHLAEHAPEKVLDASWAALQEGQVFAVDIEIRAQDRSGLLRDVSDALARHKLNVTAVQT
            570       580       590       600       610       620

                  460       470       480       490
m117.pep    QSRDLEASMRFTLEVKQVNDLPRVLASLGDVKGVLSVTRLX
            ||||||||||||||||||||||||||:|||||||||||||||
g117        QSRDLEASMRFTLEVKQVNDLPRVLAGLGDVKGVLSVTRLX
            630       640       650       660
```

The following partial DNA sequence was identified in *N. meningitidis* <SEQ ID 415>:

```
a117.seq
   1 ATGGTTCATG AACTCGACCT GCTCCCCGAT GCCGTCGCCG CCACCCTGCT
  51 TGCCGACATC GGACGCTACG TCCCCGACTG GAACCTATTG GTTTCCGAAC
 101 GCTGCAACAG TACCGTCGCC GAGCTGGTCA AAGGTGTGGA CGAAGTGCAG
 151 AAACTCACCC ACTTCGCCCG GGTGGACAGC CTCGCCACGC CGGAAGAACG
 201 CGCCCAGCAG GCAGAAACTA TGCGGAAAAT GCTGCTGGCG ATGGTTACCG
 251 ACATCCGCGT CGTGTTAATC AAACTGGCGA TGCGTACGCG CACCCTGCAA
 301 TTTTTAAGCA ACGCCCCCGA CAGCCCCGAA AAACGCGCCG TCGCCAAAGA
 351 AACCCTCGAC ATCTTCGCCC CGCTCGCCAA CCGTTTGGGC GTGTGGCAGC
 401 TCAAATGGCA GCTCGAAGAT TTGGGCTTCC GCCATCAAGA ACCCGAAAAA
 451 TACCGCGAAA TCGCCCTGCT TTTGGACGAA AAACGCACCG AACGCCTCGA
 501 ATACATCGAA AACTTCCTTA ATATCCTGCG TACGGAACTC AAAAAATACA
 551 ATATCCACTT TGAAGTCGCC GGCCGTCCGA AACACATCTA CTCCATTTAC
 601 AAAAAAATGG TGAAGAAAAA ACTCAGCTTC GACGGGTTGT TCGACATCCG
 651 CGCCGTGCGG ATTCTGGTTG ATACCGTCCC CGAGTGTTAC ACCACACTGG
 701 GCATTGTCCA CAGCCTCTGG CAGCCCATTC CCGGCGAGTT CGACGACTAC
 751 ATCGCCAACC CGAAAGGCAA CGGCTATAAA AGTTTGCACA CCGTCATCGT
 801 CGGCAAGGAA GACAAAGGCG TGGAAGTGCA AATCCGCACC TTCGATATGC
 851 ACCAATTCAA CGAATTCGGT GTCGCCGCGC ACTGGCGTTA CAAAGAGGGC
 901 GGCAAAGGCG ATTCCGCCTA CGAACAAAAA ATCGCCTGGT TACGCCAACT
 951 TTTGGACTGG CGCGAAAACA TGGCGGAAAG CGGCAAGGAA GACCTCGCCG
1001 CCGCCTTCAA AACCGAGCTT TTCAACGACA CGATTTATGT TTTGACCCCG
1051 CACGGCAAAG TCCTCTCCCT GCCCACAGGC GCGACCCCCA TCGACTTCGC
1101 CTACGCCCTG CACAGCAGCA TCGGCGACCG TTGCCGCGGT GCGAAAGTCG
1151 AAGGGCAGAT TGTGCCGCTG TCCACCCCGC TCGAAAACGG ACAGCGTGTC
1201 GAAATCATTA CCGCCAAAGA AGGGCATCCT TCCGTCAACT GGCTTTACGA
1251 AGGCTGGGTC AAATCCAACA AGGCAATCGG CAAAATCCGC GCCTACATCC
1301 GCCAGCAAAA CGCCGACACC GTGCGCGAAG AAGGCCGCGT CCAACTCGAC
1351 AAACAGCTTG CCAAACTCAC GCCCAAACCC AACCTGCAAG AGCTTGCCGA
1401 AAATCTCGGC TACAAAAAGC CAGAAGACCT CTACACCGCC GTCGGACAAG
1451 GCGAAATTTC CAACCGCGCC ATCCAAAAAG CCTGCGGCAC GCTGAACGAA
1501 CCGCCGCCCG TACCCGTCAG CGAAACCACC ATCGTCAAAC AGTCCAAAAT
1551 CAAAAAAGGC GGCAAAAACG GCGTGCTCAT CGACGGCGAA GACGGTCTGA
1601 TGACCACGCT TGCCAAATGC TGCAAACCCG CGCCGCCCGA CGACATTGTC
1651 GGCTTCGTTA CCCGCGATCG CGGCATTTCG GTACACCGCA AAACCTGCCC
1701 CTCTTTCCGA CACCTCGCCG AACACGCGCC CGAAAAAGTA CTGGACGCAA
1751 GTTGGGCGGC GTTGCAGGAA GGACAAGTGT TCGCCGTCGA TATCGAAATC
1801 CGCGCCCAAG ACCGCTCCGG GCTTTTGCGC GACGTATCCG ACGCGCTCGC
1851 CCGCCACAAA CTCAACGTTA CCGCCGTGCA AACCCAGTCC CGCGACTTGG
1901 AAGCCAGCAT GAGGTTCACG CTCGAAGTCA AACAAGTTAC CGACCTCCCA
```

-continued

```
1951 CGCGTCCTCG CCAGCCTCGG CGACGTCAAA GGCGTATTGA GCGTTACCCG

2001 GCTTTAA
```

This corresponds to the amino acid sequence <SEQ ID 416; ORF 117.a>:

```
a117.pep

  1 MVHELDLLPD AVAATLLADI GRYVPDWNLL VSERCNSTVA ELVKGVDEVQ

 51 KLTHFARVDS LATPEERAQQ AETMRKMLLA MVTDIRVVLI KLAMRTRTLQ

101 FLSNAPDSPE KRAVAKETLD IFAPLANRLG VWQLKWQLED LGFRHQEPEK

151 YREIALLLDE KRTERLEYIE NFLNILRTEL KKYNIHFEVA GRPKHIYSIY

201 KKMVKKKLSF DGLFDIRAVR ILVDTVPECY TTLGIVHSLW QPIPGEFDDY

251 IANPKGNGYK SLHTVIVGPE DKGVEVQIRT FDMHQFNEFG VAAHWRYKEG

301 GKGDSAYEQK IAWLRQLLDW RENMAESGKE DLAAAFKTEL FNDTIYVLTP

351 HGKVLSLPTG ATPIDFAYAL HSSIGDRCRG AKVEGQIVPL STPLENGQRV

401 EIITAKEGHP SVNWLYEGWV KSNKAIGKIR AYIRQQNADT VREEGRVQLD

451 KQLAKLTPKP NLQELAENLG YKKPEDLYTA VGQGEISNRA IQKACGTLNE

501 PPPVPVSETT IVKQSKIKKG GKNGVLIDGE DGLMTTLAKC CKPAPPDDIV

551 GFVTRDRGIS VHRKTCPSFR HLAEHAPEKV LDASWAALQE GQVFAVDIEI

601 RAQDRSGLLR DVSDALARHK LNVTAVQTQS RDLEASMRFT LEVKQVTDLP

651 RVLASLGDVK GVLSVTRL*
```

```
m117/a117 98.0% identity in 490 aa overlap

                                                  10        20        30
m114.pep                                  VKLKKYNVHFEVAGRPKHIYSIYKKMVKKKL
                                          :|||||:||||||||||||||||||||||||
a114       EKYREIALLLDEKRTERLEYIENFLNILRTELKKYNIHFEVAGRPKHIYSIYKKMVKKKL
         150       160       170       180       190       200

                  40        50        60        70        80        90
m117.pep   SFDGLFDIRAVRILVDTVPECYTTLGIVHSLWQPIPGEFDDYIANPKGNGYKSLHTVIVG
           ||||||||||||||||||||||||||||||||||||||||||||||||||||||||||||
a117       SFDGLFDIRAVRILVDTVPECYTTLGIVHSLWQPIPGEFDDYIANPKGNGYKSLHTVIVG
         210       220       230       240       250       260

                 100       110       120       130       140       150
m117.pep   PEDKGVEVQIRTFDMHQFNEFGVAAHWRYKEGGKGDSAYEQKIAWLRQLLDWRENMAESG
           ||||||||||||||||||||||||||||||||||||||||||||||||||||||||||||
a117       PEDKGVEVQIRTFDMHQFNEFGVAAHWRYKEGGKGDSAYEQKIAWLRQLLDWRENMAESG
         270       280       290       300       310       320

                 160       170       180       190       200       210
m117.pep   KEDLAAAFKTELFNDTIYVLTPHGKVLSLPTGATPIDFAYALHSSIGDRCRGAKVEGQIV
           ||||||||||||||||||||||||||||||||||||||||||||||||||||||||||||
a117       KEDLAAAFKTELFNDTIYVLTPHGKVLSLPTGATPIDFAYALHSSIGDRCRGAKVEGQIV
         330       340       350       360       370       380

                 220       230       240       250       260       270
m117.pep   PLSTPLENGQRVEIITAKEGHPSVNWLYEGWVKSNKAIGKIRAYIRQQNADTVREEGRVQ
           ||||||||||||||||||||||||||||||||||||||||||||||||||||||||||||
a117       PLSTPLENGQRVEIITAKEGHPSVNWLYEGWVKSNKAIGKIRAYIRQQNADTVREEGRVQ
         390       400       410       420       430       440

                 280       290       300       310       320       330
m117.pep   LDKQLAKLTPKPNLQELAENLGYKKPEDLYTAVGQGEISNRAIQKACGTLNEPPPVPVSE
           ||||||||||||||||||||||||||||||||||||||||||||||||||||||||||||
a117       LDKQLAKLTPKPNLQELAENLGYKKPEDLYTAVGQGEISNRAIQKACGTLNEPPPVPVSE
         450       460       470       480       490       500
```

-continued

```
                340       350       360       370       380       390
m117.pep  TTIVKQSKIKKGGKNGVLIDGEDGLMTTLAKCCKPAPPDDIIGFVTRERGISVHRKXXXS
          ||||||||||||||||||||||||||||||||||||||||:|||||:||||||||:  |
a117      TTIVKQSKIKKGGKNGVLIDGEDGLMTTLAKCCKPAPPDDIVGFVTRDRGISVHRKTCPS
        510       520       530       540       550       560

                400       410       420       430       440       450
m117.pep  FQHLAEHAPXKVLDASWAALQEGQVFAVDIEIRAQDRSGLLRDVSDALARHKLNVTAVQT
          |:||||||| ||||||||||||||||||||||||||||||||||||||||||||||||||
a117      FRHLAEHAPEKVLDASWAALQEGQVFAVDIEIRAQDRSGLLRDVSDALARHKLNVTAVQT
        570       580       590       600       610       620
                460       470       480       490
m117.pep  QSRDLEASMRFTLEVKQVNDLPRVLASLGDVKGVLSVTRLX
          ||||||||| |||||||:||||||||||||||||||||
a117      QSRDLEASMRFTLEVKQVTDLPRVLASLGDVKGVLSVTRLX
        630       640       650       660
```

The following partial DNA sequence was identified in *N. gonorrhoeae* <SEQ ID 417>:

```
g117-1.seq
   1 ATGACCGCCA TCAGCCCGAT TCAAGACACG CAAAGCGCGA CCCTGCAAGA

  51 ATTGCGCGAA TGGTTCGACA GCTACTGCGC CGCTCTGCCG GACAACGATA

 101 AAAACCTCAT CGGTACCGCA TGGTCGCTGG CGCAGGAACA TTATCCTGCC

 151 GATGCCGCCA CGCCGTATGG CGAGCCGCTG CCCGACCACT TCCTCGGCGC

 201 GGCGCAAATG GTCGACGAAC TCGACCTGCT GCCCGATGCC GTCGCCGCCA

 251 CCCTGCTTGC CGACATCGGA CGCTACGTCC CCGATTGGAA CCTATTGGTT

 301 TCCGAGCGCT GCAACAGCAC CGTCGCCGAG CTGGTCAAAG GTGTGGACGA

 351 AGTGCAGAAA CTTACCCACT TCGCCCGGGT GGACAGCCTC GCCACGCCGG

 401 AAGAACGCGC ACAGCAAGCG GAAACCATGC GGAAAATGCT GCTGGCGATG

 451 GTTACCGACA TCCGCGTCGT ATTAATCAAA CTGGCGATGC GTACGCGCAC

 501 CCTGCAATTT TTAAGCAACG CCCCCGACAG CCCTGAAAAA CGCGCCGTCG

 551 CCAAAGAAAC CCTCGACATC TTCGCCCCGC TCGCCAACCG CTTGGGCGTG

 601 TGGCAGCTCA AATGGCAGCT CGAAGATTTG GGCTTCCGCC ATCAAGAACC

 651 CGAAAAATAC CGCGAAATCG CCCTGCTTTT GGACGAAAAA CGCACCGAAC

 701 GCCTCGAATA CATCGAAAAC TTCCTCGATA TCCTGCGTAC GGAACTCAAA

 751 AAATACAATA TCCACTTTGA AGTCGCCGGC CGTCCGAAAC ACATCTACTC

 801 CATTTACAAA AAAATGGTGA AGAAAAAACT CAGCTTCGAC GGCCTGTTCG

 851 ACATCCGCGC CGTGCGGATT CTGGTCGATA CCGTCCCCGA GTGTTACACC

 901 ACGCTGGGCA TCGTCCACAG CCTCTGGCAG CCCATTCCCG GCGagttCGA

 951 cgactACATC GCCAACCCCA AAGgcaACGg ttATAAAAGt TTGCACACCG

1001 TCATCGTcgg cccGGAagaa aaaggtgtgg aagtgcAAAT CCGCACCTTC

1051 GATATGCacc AATTCaaCga ATTCGGTGTC GCCGCCCACT GGCGTTACAA

1101 AGAAGGCGGC AAAGGCGATT CCGCCTACGA ACAAAAAATC GCCTGGTTGC

1151 GCCAACTCTT GGACTGGCGC GAAAATATGG CGGAAAGCGG CAAGGAAGAC

1201 CTCGCCGCCG CCTTCAAAAC CGAGCTTTTC AACGACACGA TTTATGTTTT

1251 GACCCCGCAC GGCAAAGTCC TCTCTCTGCC AACGGGCGCA ACCCCCATCG

1301 ACTTCGCCTA CGCCCTGCAC AGCAGCATCG GCGACCGCTG CCGGGGCGCG
```

-continued

```
1351 AAAGTCGAAG GGCAGATTGT GCCGCTGTCC ACCCCGCTCG AAAACGGACA

1401 GCGCGTCGAA ATCATTACCG CCAAAGAAGG GCATCCTTCC GTCAACTGGC

1451 TTTACGAAGG CTGGGTCAAA TCCGGCAAGG CCATCGGCAA AATCCGCGCC

1501 TACATCCGCC AGCAAAACGC CGACACCGTG CGCGAAGAAG GCCGTGTCCA

1551 ACTCGACAAG CAGCTTGCCA AACTCACGCC CAAACCCAAC CTGCAAGAGC

1601 TTGCCGAAAA TCTCGGCTAC AAAAAGCCAG AAGACCTCTA CACCGCCGTC

1651 GGACAAGGCG AAATTTCCAA CCGCGCCATC CAAAAAGCCT GCGGCACGCT

1701 GAACGAACCG CCGCCCGTGC CCGTCAGCGC AACCACCATC GTCAAACAGT

1751 CCAAAATCAA AAAAGGTGGC AAAACCGGCG TGCTCATCGA CGGCGAAGAC

1801 GGCTTGATGA CCACGCTTGC CAAATGCTGC AAACCCGCGC CGCCCGACGA

1851 TATTGCCGGC TTCGTTACCC GCGAGCGCGG CATTTCCGTC CACCGCAAAA

1901 CCTGCCCCTC TTTCCGACAC CTTGCCGAAC ACGCGCCCGA AAAAGTACTG

1951 GACGCAAGTT GGGCGGCGTT GCAGGAAGGG CAAGTGTTCG CCGTCGATAT

2001 CGAAATCCGC GCCCAAGACC GCTCCGGGCT TTTGCGCGAC GTATCCGACG

2051 CGCTCGCCCG CCACAAACTC AACGTTACCG CCGTGCAAAC CCAGTCCCGC

2101 GACTTGGAAG CCAGCATGAG GTTCACGCTC GAAGTCAAAC AAGTCAACGA

2151 CCTCCCGCGC GTCCTCGCCG GCCTCGGCGA TGTCAAAGGC GTATTGAGCG

2201 TTACCCGGCT TTAA
```

This corresponds to the amino acid sequence <SEQ ID 418; ORF 117-1.ng>:

```
g117-1.pep
  1  MTAISPIQDT QSATLQELRE WFDSYCAALP DNDKNLIGTA WSLAQEHYPA

 51  DAATPYGEPL PDHFLGAAQM VDELDLLPDA VAATLLADIG RYVPDWNLLV

101  SERCNSTVAE LVKGVDEVQK LTHFARVDSL ATPEERAQQA ETMRKMLLAM

151  VTDIRVVLIK LAMRTRTLQF LSNAPDSPEK RAVAKETLDI FAPLANRLGV

201  WQLKWQLEDL GFRHQEPEKY REIALLLDEK RTERLEYIEN FLDILRTELK

251  KYNIHFEVAG RPKHIYSIYK KMVKKKLSFD GLFDIRAVRI LVDTVPECYT

301  TLGIVHSLWQ PIPGEFDDYI ANPKGNGYKS LHTVIVGPEE KGVEVQIRTF

351  DMHQFNEFGV AAHWRYKEGG KGDSAYEQKI AWLRQLLDWR ENMAESGKED

401  LAAAFKTELF NDTIYVLTPH GKVLSLPTGA TPIDFAYALH SSIGDRCRGA

451  KVEGQIVPLS TPLENGQRVE IITAKEGHPS VNWLYEGWVK SGKAIGKIRA

501  YIRQQNADTV REEGRVQLDK QLAKLTPKPN LQELAENLGY KKPEDLYTAV

551  GQGEISNRAI QKACGTLNEP PPVPVSATTI VKQSKIKKGG KTGVLIDGED

601  GLMTTLAKCC KPAPPDDIAG FVTRERGISV HRKTCPSFRH LAEHAPEKVL

651  DASWAALQEG QVFAVDIEIR AQDRSGLLRD VSDALARHKL NVTAVQTQSR

701  DLEASMRFTL EVKQVNDLPR VLAGLGDVKG VLSVTRL*
```

The following partial DNA sequence was identified in *N. meningitidis* <SEQ ID 419>:

```
m117-1.seq
   1 ATGACCGCCA TCAGCCCGAT TCAAGACACG CAAAGCGCGA CTCTGCAAGA
```

-continued

51 ATTGCGCGAA TGGTTCGACA GCTACTGCGC CGCTCTGCCG GACAACGATA

101 AAAACCTCAT CGGTACCGCA TGGTTGCTGG CGCAGGAACA TTACCCCGCC

151 GATGCCGCCA CGCCGTATGG CGAGCCGCTG CCCGACCACT TCCTCGGCGC

201 GGCGCAAATG GTTCATGAAC TCGACCTGCT CCCCGATGCC GTCGCCGCCA

251 CCCTGCTTGC CGACATCGGA CGCTACGTCC CCGACTGGAA CCTATTGGTT

301 TCCGAACGCT GCAACAGTAC CGTCGCCGAG CTGGTCAAAG GTGTGGACGA

351 AGTGCAGAAA CTCACCCACT TCGCCCGGGT GGACAGCCTC GCCACGCCGG

401 AAGAACGCGC CCAGCAGGCA GAAACTATGC GGAAAATGCT GCTGGCGATG

451 GTTACCGACA TCCGCGTCGT GTTAATCAAA CTGGCGATGC GTACGCGCAC

501 CCTGCAATTT TTAAGCAACG CCCCCGACAG CCCCGAAAAA CGCGCCGTCG

551 CCAAAGAAAC CCTCGACATC TTCGCCCCGC TCGCCAACCG TTTGGGCGTG

601 TGGCAGCTCA AATGGCAGCT CGAAGATTTG GGCTTCCGCC ATCAAAAGCC

651 CGAAAAATAC CGCGAAATCG CGCTGCTTTT GGACGAAAAA CGCACCGAAC

701 GCCTCGAATA CATCGAAAAC TTCCTCAACA TCCTGCGCGG TGAACTCAAG

751 AAATACAATG TCCATTTCGA AGTCGCCGGC CGCCCGAAAC ACATCTACTC

801 CATTTACAAA AAAATGGTGA AGAAAAAACT CAGCTTCGAC GGCCTCTTTG

851 ACATCCGCGC CGTGCGAATT CTGGTTGATA CCGTCCCCGA GTGTTACACC

901 ACGCTGGGTA TCGTCCACAG CCTCTGGCAG CCCATTCCCG GCGAGTTCGA

951 CGACTACATC GCCAATCCCA AAGGCAACGG CTATAAAAGT TTGCACACCG

1001 TCATCGTCGG CCCGGAAGAC AAAGGCGTGG AAGTACAAAT CCGCACCTTC

1051 GATATGCACC AATTCAACGA ATTCGGTGTC GCCGCCCACT GGCGTTACAA

1101 AGAGGGCGGC AAGGGCGATT CCGCCTACGA ACAGAAAATC GCCTGGTTGC

1151 GCCAACTCTT GGACTGGCGC GAAAACATGG CGGAAAGCGG CAAGGAAGAC

1201 CTCGCCGCCG CCTTCAAAAC CGAGCTTTTC AACGACACGA TTTATGTTTT

1251 GACCCCGCAC GGCAAAGTCC TCTCCCTGCC CACGGGCGCG ACCCCCATCG

1301 ACTTCGCCTA CGCCCTGCAC AGCAGCATCG GCGACCGTTG CCGCGGTGCG

1351 AAAGTCGAAG GGCAGATTGT GCCGCTGTCC ACCCCGCTCG AAAACGGACA

1401 GCGCGTCGAA ATCATTACCG CCAAAGAAGG GCATCCTTCC GTCAACTGGC

1451 TTTACGAAGG CTGGGTCAAA TCCAACAAGG CAATCGGCAA AATCCGCGCC

1501 TACATCCGCC AGCAAAACGC CGACACCGTG CGCGAAGAAG GCCGCGTCCA

1551 ACTCGACAAA CAGCTTGCCA AACTCACGCC CAAACCCAAC CTGCAAGAGC

1601 TTGCCGAAAA TCTCGGCTAC AAAAAGCCAG AAGACCTCTA CACCGCCGTC

1651 GGACAAGGCG AAATTTCCAA CCGCGCCATC CAAAAAGCCT GCGGCACGCT

1701 GAACGAACCG CCGCCCGTAC CCGTCAGCGA AACCACCATC GTCAAACAGT

1751 CCAAAATCAA AAAAGGCGGC AAAAACGGCG TGCTCATCGA CGGCGAAGAC

1801 GGTCTGATGA CCACGCTTGC CAAATGCTGC AAACCCGCGC CGCCCGACGA

1851 TATTATCGGC TTCGTTACCC GCGAGCGCGG CATTTCAGTG CACCGCAAAA

1901 CCTGCCCGTC TTTCCAACAC CTCGCCGAAC ACGCGCCCGA AAAAGTGCTG

1951 GACGCAAGCT GGGCGGCATT GCAGGAAGGA CAAGTATTCG CCGTCGATAT

2001 CGAAATCCGC GCCCAAGACC GCTCCGGGCT TTTGCGCGAC GTATCCGACG

2051 CGCTCGCCCG CCACAAACTC AACGTTACCG CCGTGCAAAC CCAGTCCCGC

-continued

```
2101 GACTTGGAAG CCAGCATGAG GTTCACGCTC GAAGTCAAAC AAGTCAACGA

2151 CCTCCCGCGC GTCCTCGCCA GCCTCGGCGA CGTCAAAGGC GTATTGAGCG

2201 TTACCCGGCT TTAA
```

This corresponds to the amino acid sequence <SEQ ID 420; ORF 117-1>:

```
m117-1.pep

  1 MTAISPIQDT QSATLQELRE WFDSYCAALP DNDKNLIGTA WLLAQEHYPA

 51 DAATPYGEPL PDHFLGAAQM VHELDLLPDA VAATLLADIG RYVPDWNLLV

101 SERCNSTVAE LVKGVDEVQK LTHFARVDSL ATPEERAQQA ETMRKMLLAM

151 VTDIRVVLIK LAMRTRTLQF LSNAPDSPEK RAVAKETLDI FAPLANRLGV

201 WQLKWQLEDL GFRHQKPEKY REIALLLDEK RTERLEYIEN FLNILRGELK

251 KYNVHFEVAG RPKHIYSIYK KMVKKKLSFD GLFDIRAVRI LVDTVPECYT

301 TLGIVHSLWQ PIPGEFDDYI ANPKGNGYKS LHTVIVGPED KGVEVQIRTF

351 DMHQFNEFGV AAHWRYKEGG KGDSAYEQKI AWLRQLLDWR ENMAESGKED

401 LAAAFKTELF NDTIYVLTPH GKVLSLPTGA TPIDFAYALH SSIGDRCRGA

451 KVEGQIVPLS TPLENGQRVE IITAKEGHPS VNWLYEGWVK SNKAIGKIRA

501 YIRQQNADTV REEGRVQLDK QLAKLTPKPN LQELAENLGY KKPEDLYTAV

551 GQGEISNRAI QKACGTLNEP PPVPVSETTI VKQSKIKKGG KNGVLIDGED

601 GLMTTLAKCC KPAPPDDIIG FVTRERGISV HRKTCPSFQH LAEHAPEKVL

651 DASWAALQEG QVFAVDIEIR AQDRSGLLRD VSDALARHKL NVTAVQTQSR

701 DLEASMRFTL EVKQVNDLPR VLASLGDVKG VLSVTRL*
```

```
m117-1/g117-1 98.2% identity in 737 aa overlap

                   10        20        30        40        50        60
m117-1.pep MTAISPIQDTQSATLQELREWFDSYCAALPDNDKNLIGTAWLLAQEHYPADAATPYGEPL
           ||||||||||||||||||||||||||||||||||||||||| ||||||||||||||||||
g117-1     MTAISPIQDTQSATLQELREWFDSYCAALPDNDKNLIGTAWSLAQEHYPADAATPYGEPL
                   10        20        30        40        50        60

                   70        80        90       100       110       120
m117-1.pep PDHFLGAAQMVHELDLLPDAVAATLLADIGRYVPDWNLLVSERCNSTVAELVKGVDEVQK
           ||||||||||| ||||||||||||||||||||||||||||||||||||||||||||||||
g117-1     PDHFLGAAQMVDELDLLPDAVAATLLADIGRYVPDWNLLVSERCNSTVAELVKGVDEVQK
                   70        80        90       100       110       120

                  130       140       150       160       170       180
m117-1.pep LTHFARVDSLATPEERAQQAETMRKMLLAMVTDIRVVLIKLAMRTRTLQFLSNAPDSPEK
           ||||||||||||||||||||||||||||||||||||||||||||||||||||||||||||
g117-1     LTHFARVDSLATPEERAQQAETMRKMLLAMVTDIRVVLIKLAMRTRTLQFLSNAPDSPEK
                  130       140       150       160       170       180

                  190       200       210       220       230       240
m117-1.pep RAVAKETLDIFAPLANRLGVWQLKWQLEDLGFRHQKPEKYREIALLLDEKRTERLEYIEN
           |||||||||||||||||||||||||||||||||||:||||||||||||||||||||||||
g117-1     RAVAKETLDIFAPLANRLGVWQLKWQLEDLGFRHQEPEKYREIALLLDEKRTERLEYIEN
                  190       200       210       220       230       240

                  250       260       270       280       290       300
m117-1.pep FLNILRGELKKYNVHFEVAGRPKHIYSIYKKMVKKKLSFDGLFDIRAVRILVDTVPECYT
           ||:||| ||||||:||||||||||||||||||||||||||||||||||||||||||||||
g117-1     FLDILRTELKKYNIHFEVAGRPKHIYSIYKKMVKKKLSFDGLFDIRAVRILVDTVPECYT
                  250       260       270       280       290       300
```

-continued

```
                       310        320        330        340        350        360
m117-1.pep TLGIVHSLWQPIPGEFDDYIANPKGNGYKSLHTVIVGPEDKGVEVQIRTFDMHQFNEFGV
           |||||||||||||||||||||||||||||||||||||||:||||||||||||||||||||
g117-1     TLGIVHSLWQPIPGEFDDYIANPKGNGYKSLHTVIVGPEEKGVEVQIRTFDMHQFNEFGV
                   310        320        330        340        350        360

                   370        380        390        400        410        420
m117-1.pep AAHWRYKEGGKGDSAYEQKIAWLRQLLDWRENMAESGKEDLAAAFKTELFNDTIYVLTPH
           ||||||||||||||||||||||||||||||||||||||||||||||||||||||||||||
g117-1     AAHWRYKEGGKGDSAYEQKIAWLRQLLDWRENMAESGKEDLAAAFKTELFNDTIYVLTPH
                   370        380        390        400        410        420

                   430        440        450        460        470        480
m117-1.pep GKVLSLPTGATPIDFAYALHSSIGDRCRGAKVEGQIVPLSTPLENGQRVEIITAKEGHPS
           ||||||||||||||||||||||||||||||||||||||||||||||||||||||||||||
g117-1     GKVLSLPTGATPIDFAYALHSSIGDRCRGAKVEGQIVPLSTPLENGQRVEIITAKEGHPS
                   430        440        450        460        470        480

                   490        500        510        520        530        540
m117-1.pep VNWLYEGWVKSNKAIGKIRAYIRQQNADTVREEGRVQLDKQLAKLTPKPNLQELAENLGY
           |||||||||||:||||||||||||||||||||||||||||||||||||||||||||||||
g117-1     VNWLYEGWVKSGKAIGKIRAYIRQQNADTVREEGRVQLDKQLAKLTPKPNLQELAENLGY
                   490        500        510        520        530        540

                   550        560        570        580        590        600
m117-1.pep KKPEDLYTAVGQGEISNRAIQKACGTLNEPPPVPVSETTIVKQSKIKKGGKNGVLIDGED
           |||||||||||||||||||||||||||||||||||| ||||||||||||||:||||||||
g117-1     KKPEDLYTAVGQGEISNRAIQKACGTLNEPPPVPVSATTIVKQSKIKKGGKTGVLIDGED
                   550        560        570        580        590        600

                   610        620        630        640        650        660
m117-1.pep GLMTTLAKCCKPAPPDDIIGFVTRERGISVHRKTCPSFQHLAEHAPEKVLDASWAALQEG
           |||||||||||||||||| |||||||||||||||||||:|||||||||||||||||||||
g117-1     GLMTTLAKCCKPAPPDDIAGFVTRERGISVHRKTCPSFRHLAEHAPEKVLDASWAALQEG
                   610        620        630        640        650        660

                   670        680        690        700        710        720
m117-1.pep QVFAVDIEIRAQDRSGLLRDVSDALARHKLNVTAVQTQSRDLEASMRFTLEVKQVNDLPR
           ||||||||||||||||||||||||||||||||||||||||||||||||||||||||||||
g117-1     QVFAVDIEIRAQDRSGLLRDVSDALARHKLNVTAVQTQSRDLEASMRFTLEVKQVNDLPR
                   670        680        690        700        710        720

                   730
m117-1.pep VLASLGDVKGVLSVTRLX
           |||:||||||||||||||
g117-1     VLAGLGDVKGVLSVTRLX
                   730
```

```
m117-1 (SEQ ID 420)/Re1A (SEQ ID 4162)
sp|P55133|RELA_VIBSS GTP PYROPHOSPHOKINASE (ATP:GTP 3'-PYROPHOSPHOTRANSFERASE) (PPGPP SYNTHETASEI)
>gi|537617 (U13769) ppGpp synthetase I [Vibrio sp.] Length = 744 Score = 536 bits (1366),
Expect = e-151 Identities = 288/685 (42%), Positives = 432/685 (63%), Gaps = 31/685 (4%)

Query:  74   LDLLPDAVAATLLADI---GRYVPDWNLLVSERCNSTVAELVKGVDEVQKLTHFARVDSL  130
             L +  D + A LL  +   G Y  D    + E  + T+  LV+GV+++  ++   ++ S
Sbjct:  68   LSMDADTLIAALLYPLVEGGCYSTD---ALKEEYSGTILHLVQGVQMCAIS---QLKST  121

Query: 131   ATPEERAQQAETMRKMLLAMVTDIRVVLIKLAMRTRTLQFLSNAPDSPEKRAVAKETLDI  190
             A    +A Q + +R+MLL+MV D R V+IKLA R   L+ + + PD   +RA A+E  +I
Sbjct: 122   AEETAQAAQVDNIRRMLLSMVDDFRCVVIKLAERICNLREVKDQPDEV-RRAAAQECANI  180

Query: 191   FAPLANRLGVWQLKWQLEDLGFRHQKPEKYREIALLLDEKRTERLEYIENFLNILRGELK  250
             +APLANRLG+ QLKW++ED  FR+Q P+ Y++IA  L E+R +R +YI +F++ L   +K
Sbjct: 181   YAPLANRLGIGQLKWEIEDYAFRYQHPDTYKQIAKQLSERRIDREDYITHFVDDLSDAMK  240

Query: 251   KYNVHFEVAGRPKHIYSIYKKMVKKKLSFDGLFDIRAVRILVDTVPECYTTLGIVHSLWQ  310
               N+  EV GRPKHIYSI++KM KK L FD LFD+RAVRI+ + + +CY  LG+VH+ ++
Sbjct: 241   ASNIRAEVQGRPKHIYSIWRKMQKKSLEFDELFDVRAVRIVAEELQDCYAALGVVHTKYR  300

Query: 311   PIPGEFDDYIANPKGNGYKSLHTVIVGPEDKGVEVQIRTFDMHQFNEFGVAAHWRYKEG-  369
              +P EFDDY+ANPK NGY+S+HTV++GPE K +E+QIRT  MH+ +E GVAAHW+YKEG
Sbjct: 301   HLPKEFDDYVANPKPNGYQSIHTVVLGPEGKTIEIQIRTKQMHEESELGVAAHWKYKEGT  360

Query: 370   --GKGDSAYEQKIAWLRQLLDWRENMAESGKEDLAAAFKTELFNDTIYVLTPHGKVLSLP  427
               G   SAY++KI WLR+LL W+E M++SG  ++    ++++F+D +Y  TP G V+ LP
Sbjct: 361   ASGGAQSAYDEKINWLRKLLAWQEEMSDSG--EMLDELRSQVFDDRVYAFTPKGDVVDLP  418

Query: 428   TGATPIDFAYALHSSIGDRCRGAKVEGQIVPLSTPLENGQRVEIITAKEGHPSVNWLYE-  486
             + ATP+DFAY +HS +G RC GAKVEG+IVP +  L+ G +VEIIT KE +PS +WL
Sbjct: 419   SNATPLDFAYHIHSEVGHRCIGAKVEGRIVPFTYHLQMGDQVEIITQKEPNPSRDWLNPN  478

Query: 487   -GWVKSNKAIGKIRAYIRQQNADTVREEGRVQLDKQLAKL--TPKPNLQELAENLGYKKP  543
              G+V S++A  K+ A+ R+Q+ D     G+  L+ +L K+  T K      A+    K P
Sbjct: 479   LGFVTSSRARAKVHAWFRKQDRDKNIIAGKEILEAELVKIHATLKDAQYYAAKRFNVKSP  538
```

-continued

```
Query: 544  EDLYTAVGQGEIS-NRAIQKACGTLNEPPPVPVSETTIVKQSKI--------KKGGKNGV  594
            E+LY  +G G++  N+ I      +N+P       +  + K S+          KK  ++ V
Sbjct: 539  EELYAGIGSGDLRINQVINHINALVNKPTAEEEDQQLLEKLSEASNKQATSHKKPQRDAV  598

Query: 595  LIDGEDGLMTTLAKCCKPAPPDDIIGFVTRERGISVHRKTCPSFQHLAEHAPEKVLDASW  654
            +++G D LMT LA+CC+P P DDI GFVT+ RGISVHR  C   + L  HAPE+++D  W
Sbjct: 599  VVEGVDNLMTHLARCCQPIPGDDIQGFVTQGRGISVHRMDCEQLEELRHHAPERIIDTVW  658

Query: 655  AALQEGQVFAVDIEIRAQDRSGLLRDVSDALARHKLNVTAVQTQ--SRDLEASMRFTLEV  712
                 G  + + + + A +R+GLL+++++ L   K+ V  ++++    +   + M F LE+
Sbjct: 659  GGGFVGN-YTITVRVTASERNGLLKELTNTLMNEKVKVAGMKSRVDYKKQMSIMDFELEL  717

Query: 713  KQVNDLPRVLASLGDVKGVLSVTRL                                    737
             +  L RVL  +  VK V    RL
Sbjct: 718  TDLEVLGRVLKRIEQVKDVAEAKRL                                    742
```

The following partial DNA sequence was identified in *N. meningitidis* <SEQ ID 421>:

```
a117-1.seq
   1 ATGACCGCCA TCAGCCCGAT TCAAGACACG CAAAGCGCGA CTCTGCAAGA

  51 ATTGCGCGAA TGGTTCGACA GCTACTGCAC CGCGCTGCCG AACAACGATA

 101 AAAAACTTGT CTTAGCCGCC CGTTCGCTGG CGGAAGCACA TTACCCCGCC

 151 GATGCCGCCA CGCCGTATGG CGAACCGCTG CCCGACCACT TCCTCGGCGC

 201 GGCGCAAATG GTTCATGAAC TCGACCTGCT CCCCGATGCC GTCGCCGCCA

 251 CCCTGCTTGC CGACATCGGA CGCTACGTCC CCGACTGGAA CCTATTGGTT

 301 TCCGAACGCT GCAACAGTAC CGTCGCCGAG CTGGTCAAAG GTGTGGACGA

 351 AGTGCAGAAA CTCACCCACT TCGCCCGGGT GGACAGCCTC GCCACGCCGG

 401 AAGAACGCGC CCAGCAGGCA GAAACTATGC GGAAAATGCT GCTGGCGATG

 451 GTTACCGACA TCCGCGTCGT GTTAATCAAA CTGGCGATGC GTACGCGCAC

 501 CCTGCAATTT TTAAGCAACG CCCCCGACAG CCCCGAAAAA CGCGCCGTCG

 551 CCAAAGAAAC CCTCGACATC TTCGCCCCGC TCGCCAACCG TTTGGGCGTG

 601 TGGCAGCTCA AATGGCAGCT CGAAGATTTG GGCTTCCGCC ATCAAGAACC

 651 CGAAAAATAC CGCGAAATCG CCCTGCTTTT GGACGAAAAA CGCACCGAAC

 701 GCCTCGAATA CATCGAAAAC TTCCTTAATA TCCTGCGTAC GGAACTCAAA

 751 AAATACAATA TCCACTTTGA AGTCGCCGGC CGTCCGAAAC ACATCTACTC

 801 CATTTACAAA AAAATGGTGA AGAAAAAACT CAGCTTCGAC GGGTTGTTCG

 851 ACATCCGCGC CGTGCGGATT CTGGTTGATA CCGTCCCCGA GTGTTACACC

 901 ACACTGGGCA TTGTCCACAG CCTCTGGCAG CCCATTCCCG GCGAGTTCGA

 951 CGACTACATC GCCAACCCGA AAGGCAACGG CTATAAAAGT TTGCACACCG

1001 TCATCGTCGG CCCGGAAGAC AAAGGCGTGG AAGTGCAAAT CCGCACCTTC

1051 GATATGCACC AATTCAACGA ATTCGGTGTC GCCGCGCACT GGCGTTACAA

1101 AGAGGGCGGC AAAGGCGATT CCGCCTACGA ACAAAAAATC GCCTGGTTAC

1151 GCCAACTTTT GGACTGGCGC GAAAACATGG CGGAAAGCGG CAAGGAAGAC

1201 CTCGCCGCCG CCTTCAAAAC CGAGCTTTTC AACGACACGA TTTATGTTTT

1251 GACCCCGCAC GGCAAAGTCC TCTCCCTGCC CACAGGCGCG ACCCCCATCG

1301 ACTTCGCCTA CGCCCTGCAC AGCAGCATCG GCGACCGTTG CCGCGGTGCG

1351 AAAGTCGAAG GGCAGATTGT GCCGCTGTCC ACCCCGCTCG AAAACGGACA

1401 GCGTGTCGAA ATCATTACCG CCAAAGAAGG GCATCCTTCC GTCAACTGGC

1451 TTTACGAAGG CTGGGTCAAA TCCAACAAGG CAATCGGCAA AATCCGCGCC
```

-continued

```
1501 TACATCCGCC AGCAAAACGC CGACACCGTG CGCGAAGAAG GCCGCGTCCA
1551 ACTCGACAAA CAGCTTGCCA AACTCACGCC CAAACCCAAC CTGCAAGAGC
1601 TTGCCGAAAA TCTCGGCTAC AAAAAGCCAG AAGACCTCTA CACCGCCGTC
1651 GGACAAGGCG AAATTTCCAA CCGCGCCATC CAAAAAGCCT GCGGCACGCT
1701 GAACGAACCG CCGCCCGTAC CCGTCAGCGA AACCACCATC GTCAAACAGT
1751 CCAAAATCAA AAAAGGCGGC AAAAACGGCG TGCTCATCGA CGGCGAAGAC
1801 GGTCTGATGA CCACGCTTGC CAAATGCTGC AAACCCGCGC CGCCCGACGA
1851 CATTGTCGGC TTCGTTACCC GCGATCGCGG CATTTCGGTA CACCGCAAAA
1901 CCTGCCCCTC TTTCCGACAC CTCGCCGAAC ACGCGCCCGA AAAAGTACTG
1951 GACGCAAGTT GGGCGGCGTT GCAGGAAGGA CAAGTGTTCG CCGTCGATAT
2001 CGAAATCCGC GCCCAAGACC GCTCCGGGCT TTTGCGCGAC GTATCCGACG
2051 CGCTCGCCCG CCACAAACTC AACGTTACCG CCGTGCAAAC CCAGTCCCGC
2101 GACTTGGAAG CCAGCATGAG GTTCACGCTC GAAGTCAAAC AAGTTACCGA
2151 CCTCCCACGC GTCCTCGCCA GCCTCGGCGA CGTCAAAGGC GTATTGAGCG
2201 TTACCCGGCT TTAA
```

This corresponds to the amino acid sequence <SEQ ID 422; ORF 117-1.a>:

```
a117-1.pep
      1 MTAISPIQDT QSATLQELRE WFDSYCTALP NNDKKLVLAA RSLAEAHYPA
     51 DAATPYGEPL PDHFLGAAQM VHELDLLPDA VAATLLADIG RYVPDWNLLV
    101 SERCNSTVAE LVKGVDEVQK LTHFARVDSL ATPEERAQQA ETMRKMLLAM
    151 VTDIRVVLIK LAMRTRTLQF LSNAPDSPEK RAVAKETLDI FAPLANRLGV
    201 WQLKWQLEDL GFRHQEPEKY REIALLLDEK RTERLEYIEN FLNILRTELK
    251 KYNIHFEVAG RPKHIYSIYK KMVKKKLSFD GLFDIRAVRI LVDTVPECYT
    301 TLGIVHSLWQ PIPGEFDDYI ANPKGNGYKS LHTVIVGPED KGVEVQIRTF
    351 DMHQFNEFGV AAHWRYKEGG KGDSAYEQKI AWLRQLLDWR ENMAESGKED
    401 LAAAFKTELF NDTIYVLTPH GKVLSLPTGA TPIDFAYALH SSIGDRCRGA
    451 KVEGQIVPLS TPLENGQRVE IITAKEGHPS VNWLYEGWVK SNKAIGKIRA
    501 YIRQQNADTV REEGRVQLDK QLAKLTPKPN LQELAENLGY KKPEDLYTAV
    551 GQGEISNRAI QKACGTLNEP PPVPVSETTI VKQSKIKKGG KNGVLIDGED
    601 GLMTTLAKCC KPAPPDDIVG FVTRDRGISV HRKTCPSFRH LAEHAPEKVL
    651 DASWAALQEG QVFAVDIEIR AQDRSGLLRD VSDALARHKL NVTAVQTQSR
    701 DLEASMRFTL EVKQVNDLPR VLASLGDVKG VLSVTRL*

a117-1/m117-1 97.7% identity in 737 aa overlap

                    10        20        30        40        50        60
m117-1.pep  MTAISPIQDTQSATLQELREWFDSYCAALPDNDKNLIGTAWLLAQEHYPADAATPYGEPL
            ||||||||||||||||||||||||||:|||:|||:|: :|  ||: ||||||||||||||
a117-1      MTAISPIQDTQSATLQELREWFDSYCTALPNNDKKLVLAARSLAEAHYPADAATPYGEPL
                    10        20        30        40        50        60

                    70        80        90       100       110       120
m117-1.pep  PDHFLGAAQMVHELDLLPDAVAATLLADIGRYVPDWNLLVSERCNSTVAELVKGVDEVQK
            ||||||||||||||||||||||||||||||||||||||||||||||||||||||||||||
a117-1      PDHFLGAAQMVHELDLLPDAVAATLLADIGRYVPDWNLLVSERCNSTVAELVKGVDEVQK
                    70        80        90       100       110       120
```

-continued

```
                  130        140        150        160        170        180
m117-1.pep LTHFARVDSLATPEERAQQAETMRKMLLAMVTDIRVVLIKLAMRTRTLQFLSNAPDSPEK
           ||||||||||||||||||||||||||||||||||||||||||||||||||||||||||||
a117-1     LTHFARVDSLATPEERAQQAETMRKMLLAMVTDIRVVLIKLAMRTRTLQFLSNAPDSPEK
                  130        140        150        160        170        180
                  190        200        210        220        230        240
m117-1.pep RAVAKETLDIFAPLANRLGVWQLKWQLEDLGFRHQKPEKYREIALLLDEKRTERLEYIEN
           |||||||||||||||||||||||||||||||||||:||||||||||||||||||||||||
a117-1     RAVAKETLDIFAPLANRLGVWQLKWQLEDLGFRHQEPEKYREIALLLDEKRTERLEYIEN
                  190        200        210        220        230        240
                  250        260        270        280        290        300
m117-1.pep FLNILRGELKKYNVHFEVAGRPKHIYSIYKKMVKKKLSFDGLFDIRAVRILVDTVPECYT
           |||||| ||||||:||||||||||||||||||||||||||||||||||||||||||||||
a117-1     FLNILRTELKKYNIHFEVAGRPKHIYSIYKKMVKKKLSFDGLFDIRAVRILVDTVPECYT
                  250        260        270        280        290        300
                  310        320        330        340        350        360
m117-1.pep TLGIVHSLWQPIPGEFDDYIANPKGNGYKSLHTVIVGPEDKGVEVQIRTFDMHQFNEFGV
           ||||||||||||||||||||||||||||||||||||||||||||||||||||||||||||
a117-1     TLGIVHSLWQPIPGEFDDYIANPKGNGYKSLHTVIVGPEDKGVEVQIRTFDMHQFNEFGV
                  310        320        330        340        350        360
                  370        380        390        400        410        420
m117-1.pep AAHWRYKEGGKGDSAYEQKIAWLRQLLDWRENMAESGKEDLAAAFKTELFNDTIYVLTPH
           ||||||||||||||||||||||||||||||||||||||||||||||||||||||||||||
a117-1     AAHWRYKEGGKGDSAYEQKIAWLRQLLDWRENMAESGKEDLAAAFKTELFNDTIYVLTPH
                  370        380        390        400        410        420
                  430        440        450        460        470        480
m117-1.pep GKVLSLPTGATPIDFAYALHSSIGDRCRGAKVEGQIVPLSTPLENGQRVEIITAKEGHPS
           ||||||||||||||||||||||||||||||||||||||||||||||||||||||||||||
a117-1     GKVLSLPTGATPIDFAYALHSSIGDRCRGAKVEGQIVPLSTPLENGQRVEIITAKEGHPS
                  430        440        450        460        470        480
                  490        500        510        520        530        540
m117-1.pep VNWLYEGWVKSNKAIGKIRAYIRQQNADTVREEGRVQLDKQLAKLTPKPNLQELAENLGY
           ||||||||||||||||||||||||||||||||||||||||||||||||||||||||||||
a117-1     VNWLYEGWVKSNKAIGKIRAYIRQQNADTVREEGRVQLDKQLAKLTPKPNLQELAENLGY
                  490        500        510        520        530        540
                  550        560        570        580        590        600
m117-1.pep KKPEDLYTAVGQGEISNRAIQKACGTLNEPPPVPVSETTIVKQSKIKKGGKNGVLIDGED
           ||||||||||||||||||||||||||||||||||||||||||||||||||||||||||||
a117-1     KKPEDLYTAVGQGEISNRAIQKACGTLNEPPPVPVSETTIVKQSKIKKGGKNGVLIDGED
                  550        560        570        580        590        600
                  610        620        630        640        650        660
m117-1.pep GLMTTLAKCCKPAPPDDIIGFVTRERGISVHRKTCPSFQHLAEHAPEKVLDASWAALQEG
           ||||||||||||||||||:|||||:|||||||||||||:|||||||||||||||||||||
a117-1     GLMTTLAKCCKPAPPDDIVGFVTRDRGISVHRKTCPSFRHLAEHAPEKVLDASWAALQEG
                  610        620        630        640        650        660
                  670        680        690        700        710        720
m117-1.pep QVFAVDIEIRAQDRSGLLRDVSDALARHKLNVTAVQTQSRDLEASMRFTLEVKQVNDLPR
           |||||||||||||||||||||||||||||||||||||||||||||||||||||||:||||
a117-1     QVFAVDIEIRAQDRSGLLRDVSDALARHKLNVTAVQTQSRDLEASMRFTLEVKQVTDLPR
                  670        680        690        700        710        720
                  730
m117-1.pep VLASLGDVKGVLSVTRLX
           |||||||||||||||||
a117-1     VLASLGDVKGVLSVTRLX
                  730
```

The following partial DNA sequence was identified in *N. gonorrhoeae* <SEQ ID 423>:

```
g118.seq
  1  ATGTGCGAGT TCAAGGATTT TAGAAGAAAC ATCCCTTGTT TTGAAGAGTA

 51  TGACGAAAAT TCATTTATTG GCAAATGGTA TGATGACGGG GTGTGGGATG
```

-continued

```
101  ATGAAGAATA TTGGAAGCTG GAGAATGATT TAATcgaGGT TAGGAGAAAA

151  TATCCTTATC CGATGGATAT ACCAAGGGAT ATTGTGATTG GAATCGGTAC

201  CATTATTGAT TTTTTAATGG TTCCAAATTG GGAGCTTTTT GAAATTAAAG

251  CTTCCCCTTG GTTGCCTGAT AGCGTGGGAA TTCATGAACG TTATGAAAGA

301  TTCACAACGA TGCTCCGTTA TATTTTTACC GAGAAAGACA TAGTCAACGT

351  GCGATTTGAT TATTACAaCA AAAAATAG
```

This corresponds to the amino acid sequence <SEQ ID 424; ORF 118.ng>:

```
g118.pep
  1  MCEFKDFRRN IPCFEEYDEN SFIGKWYDDG VWDDEEYWKL ENDLIEVRRK

 51  YPYPMDIPRD IVIGIGTIID FLMVPNWELF EIKASPWLPD SVGIHERYER

101  FTTMLRYIFT EKDIVNVRFD YYNKK*
```

The following partial DNA sequence was identified in *N. meningitidis* <SEQ ID 425>:

```
m118.seq
  1  ATGTGTGAGT TCAAGGATAT TATAAGAAAC GTTCCTTATT TTGAGGGGTA

 51  TGACGAAAAT TCATTTATTG GCAAATGGTA TGATGACGGG GTGTGGGATG

101  ATGAAGAATA TTGGAAGTTG GAGAATGATT TAATCGAGGT TAGAAAAAAA

151  TATCCTTATC CGATGGACAT ACCAAGATAT GTTGTCATTG GAATCGGTAC

201  CATTATTGAT TTCTTAATGG TTCCAAATTG GAAACTTTTT GAAATTAAAG

251  CTTCCCCTTG GTTGCCTGAT AGTGTGGGAA TTCATGAACG TTATGAAAGA

301  TTCACAACGA TGCTCCGTTA TATTTTTACC GAGAAAGACA TAGTCAACGT

351  GCGATTTGAT TATTACAACA AAAAATAG
```

This corresponds to the amino acid sequence <SEQ ID 426; ORF 118>:

```
m118.pep
  1  MCEFKDIIRN VPYFEGYDEN SFIGKWYDDG VWDDEEYWKL ENDLIEVRKK

 51  YPYPMDIPRY VVIGIGTIID FLMVPNWKLF EIKASPWLPD SVGIHERYER

101  FTTMLRYIFT EKDIVNVRFD YYNKK*
```

Computer analysis of this amino acid sequence gave the following results:

Homology with a Predicted ORF from *N. gonorrhoeae*

ORF 118 shows 92.8% identity over a 125 aa overlap with a predicted ORF (ORF 118.ng) from *N. gonorrhoeae*:

```
m118/g118

                    10        20        30        40        50        60
m118.pep   MCEFKDIIRNVPYFEGYDENSFIGKWYDDGVWDDEEYWKLENDLIEVRKKYPYPMDIPRY
           ||||||:  ||:|  ||  |||||||||||||||||||||||||||||:||||||||||
g118       MCEFKDFRRNIPCFEEYDENSFIGKWYDDGVWDDEEYWKLENDLIEVRRKYPYPMDIPRD
                    10        20        30        40        50        60
```

```
                  70         80         90        100        110        120
m118.pep  VVIGIGTIIDFLMVPNWKLFEIKASPWLPDSVGIHERYERFTTMLRYIFTEKDIVNVRFD
          :||||||||||||||:||||||||||||||||||||||||||||||||||||||||||||
g118      IVIGIGTIIDFLMVPNWELFEIKASPWLPDSVGIHERYERFTTMLRYIFTEKDIVNVRFD
                  70         80         90        100        110        120

m118.pep  YYNKKX
          ||||||
g118      YYNKKX
```

The following partial DNA sequence was identified in *N. meningitidis* <SEQ ID 427>:

```
a118.seq
  1  ATGTGTGAGT TCAAGGATTT TAGAAGAAAC ATCCCTTGTT TTGAAGAGTA

 51  TGACGAAAAT TCATTTATTG GCAAATGGTA TGATGACGGG GTGTGGGATG

101  ATGAAGAATA TTGGAAATTG GAGAATGATT TAATCGAGGT TAGAAAAAAA

151  TATCCTTATC CGATGGATAT ACCAAGGGAT ATTGTGATTG GAATCGGTAC

201  CATTATTGAT TTTTTAATGG TTCCAAATTG GGAGCTTTTT GAAATTAAAG

251  CTTCCCCTTG GTTGCCTGAT AGTGTGGGAA TTCATGAACG TTATGAAAGA

301  TTCACAACGA TGCTCCGTTA TATTTTTACC GAGAAAGACA TAGTCAACGT

351  GCGATTTGAT TATTACAACA AAAAATAG
```

This corresponds to the amino acid sequence <SEQ ID 428; ORF 118.a>:

```
a118.pep

    1  MCEFKDFRRN IPCFEEYDEN SFIGKWYDDG VWDDEEYWKL ENDLIEVRKK
   51  YPYPMDIPRD IVIGIGTIID FLMVPNWELF EIKASPWLPD SVGIHERYER
  101  FTTMLRYIFT EKDIVNVRFD YYNKK*

m118/a118  93.6% identity in 125 aa overlap

                  10         20         30         40         50         60
m118.pep  MCEFKDIIRNVPYFEGYDENSFIGKWYDDGVWDDEEYWKLENDLIEVRKKYPYPMDIPRY
          ||||||:||:|||||||||||||||||||||||||||||||||||||||||||||||||
a118      MCEFKDFRRNIPCFEEYDENSFIGKWYDDGVWDDEEYWKLENDLIEVRKKYPYPMDIPRD
                  10         20         30         40         50         60
                  70         80         90        100        110        120
m118.pep  VVIGIGTIIDFLMVPNWKLFEIKASPWLPDSVGIHERYERFTTMLRYIFTEKDIVNVRFD
          :||||||||||||||:||||||||||||||||||||||||||||||||||||||||||||
a118      IVIGIGTIIDFLMVPNWELFEIKASPWLPDSVGIHERYERFTTMLRYIFTEKDIVNVRFD
                  70         80         90        100        110        120

m118.pep  YYNKKX
          ||||||
a118      YYNKKX
```

The following partial DNA sequence was identified in *N. gonorrhoeae* <SEQ ID 429>:

```
g120.seq
  1  ATGATGAAGA CTTTTAAAAA TATATTTTCC GCCGCCATTT TGTCCGCCGC

 51  CCTGCCGTGC GCGTATGCGG CAAGGCTACC CCAATCCGCC GTGCTGCACT

101  ATTCCGGCAG CTACGGCATT CCCGCCACGA TGACATTTGA ACGCAGCGGC

151  AATGCTTACA AAATCGTTTC GACGATTAAA GTGCCGCTAT ACAATATCCG
```

-continued

201 TTTCGAATCC GGCGGTACGG TTGTCGGCAA TACCCTGCAC CCTGCCTACT

251 ATAAAGACAT ACGCAGGGGC AAACTGTATG CGGAAGCCAA ATTCGCCGAC

301 GGCAGCGTAA CCTACGGCAA AGCGGGCGAG AGCAAAACCG AGCAAAGCCC

351 CAAGGCTATG GATTTGTTCA CGCTTGCCTG GCAGTTGGCG GCAAATGACG

401 CGAAACTCCC CCCGGGTCTG AAAATCACCA ACGGCAAAAA ACTTTATTCC

451 GTCGGCGGCC TGAATAAGGC GGGTACGGGA AAATACAGCA Taggcggcgt 501 gGAAACCGAA GTCGTCAAAT ATCGGGTGCG GCGCGGCGAC GATACGGTAA

551 CGTATTTCTT CGCACCGTCC CTGAACAATA TTCCGGCACA AATCGGCTAT

601 ACCGAcgaCG GCAAAACCTA TACGCTGAAG CTCAAATCGG TGCAGATCAA

651 CGGACAGGCC GCCAAACCGT AA

This corresponds to the amino acid sequence <SEQ ID 430; ORF 120.ng>:

g120.pep
1 MMKTFKNIFS AAILSAALPC AYAARLPQSA VLHYSGSYGI PATMTFERSG

51 NAYKIVSTIK VPLYNIRFES GGTVVGNTLH PAYYKDIRRG KLYAEAKFAD

101 GSVTYGKAGE SKTEQSPKAM DLFTLAWQLA ANDAKLPPGL KITNGKKLYS

151 VGGLNKAGTG KYSIGGVETE VVKYRVRRGD DTVTYFFAPS LNNIPAQIGY

201 TDDGKTYTLK LKSVQINGQA AKP*

The following partial DNA sequence was identified in *N. meningitidis* <SEQ ID 431>:

m120.seq
1 ATGATGAAGA CTTTTAAAAA TATATTTTCC GCCGCCATTT TGTCCGCCGC

51 CCTGCCGTGC GCGTATGCGG CAGGGCTGCC CCAATCCGCC GTGCTGmACT

101 ATTCCGGCAG CTACGGCATT CCCGCCACGA TGACATTTGA ACGCAGCGGC

151 AATGCTTACA AAATCGTTTC GACGATTAAA GTGCCGCTAT ACAATATCCG

201 TTTCGAGTCC GGCGGTACGG TTGTCGGCAA TACCCTGCAC CCTACCTACT

251 ATAGAGACAT ACGCAGGGGC AAACTGTATG CGGAAGCcAA ATTCGCCGAC

301 GGCAGCGTAA CTTACGGCAA AGCGGGCGAG AGCAAAACCG AGCAAAGCCC

351 CAAGGCTATG GATTTGTTCA CGCTTGCCTG GCAGTTGGCG GCAAATGACG

401 CGAAACTCCC CCCGGGGCTG AAAATCACCA ACGGCAAAAA ACTTTATTCC

451 GTCGGCGGTT TGAATAAGGC GGGTACAGGA AAATACAGCA TAGGCGGCGT

501 GGAAACCGAA GTCGTCAAAT ATCGGGTGCG GCGCGGCGAC GATGCGGTAA

551 TGTATTTCTT CGCACCGTCC CTGAACAATA TTCCGGCACA AATCGGCTAT

601 ACCGACGACG GCAAAACCTA TACGCTGAAA CTCAAATCGG TGCAGATCAA

651 CGGCCAGGCA GCCAAACCG

This corresponds to the amino acid sequence <SEQ ID 432; ORF 120>:

m120.pep
1 MMKTFKNIFS AAILSAALPC AYAAGLPQSA VLXYSGSYGI PATMTFERSG

51 NAYKIVSTIK VPLYNIRFES GGTVVGNTLH PTYYRDIRRG KLYAEAKFAD

-continued

```
101  GSVTYGKAGE SKTEQSPKAM DLFTLAWQLA ANDAKLPPGL KITNGKKLYS

151  VGGLNKAGTG KYSIGGVETE VVKYRVRRGD DAVMYFFAPS LNNIPAQIGY

201  TDDGKTYTLK LKSVQINGQA AKP
```

Computer analysis of this amino acid sequence gave the following results:

Homology with a Predicted ORF from *N. gonorrhoeae*

ORF 120 shows 97.3% identity over a 223 aa overlap with a predicted ORF (ORF 120.ng) from *N. gonorrhoeae*:

```
m120/g120

                  10        20        30        40        50        60
m120.pep  MMKTFKNIFSAAILSAALPCAYAAGLPQSAVLXYSGSYGIPATMTFERSGNAYKIVSTIK
          ||||||||||||||||||||||||| |||||||| |||||||||||||||||||||||||
g120      MMKTFKNIFSAAILSAALPCAYAARLPQSAVLHYSGSYGIPATMTFERSGNAYKIVSTIK
                  10        20        30        40        50        60

                  70        80        90       100       110       120
m120.pep  VPLYNIRFESGGTVVGNTLHPTYYRDIRRGKLYAEAKFADGSVTYGKAGESKTEQSPKAM
          |||||||||||||||||||||:||:|||||||||||||||||||||||||||||||||||
g120      VPLYNIRFESGGTVVGNTLHPAYYKDIRRGKLYAEAKFADGSVTYGKAGESKTEQSPKAM
                  70        80        90       100       110       120

                 130       140       150       160       170       180
m120.pep  DLFTLAWQLAANDAKLPPGLKITNGKKLYSVGGLNKAGTGKYSIFFVETEVVKYRVRRGD
          ||||||||||||||||||||||||||||||||||||||||||||||||||||||||||||
g120      DLFTLAWQLAANDAKLPPGLKITNGKKLYSVGGLNKAGTGKYSIFFVETEVVKYRVRRGD
                 130       140       150       160       170       180

                 190       200       210       220
m120.pep  DAVMYFFAPSLNNIPAQIGYTDDGKTYTLKLKSVQINGQAAKP
          |:| |||||||||||||||||||||||||||||||||||||||
g120      DTVTYFFAPSLNNIPAQIGYTDDGKTYTLKLKSVQINGQAAKPX
                 190       200       210       220
```

The following partial DNA sequence was identified in *N. meningitidis* <SEQ ID 433>:

```
a120.seq
  1  ATGATGAAGA CTTTTAAAAA TATATTTTCC GCCGCCATTT TGTCCGCCGC

 51  CCTGCCGTGC GCGTATGCGG CAGGGCTGCC CCAATCCGCC GTGCTGCACT

101  ATTCCGGCAG CTACGGCATT CCCGCCACGA TGACATTTGA ACGCAGCGGC

151  AATGCTTACA AAATCGTTTC GACGATTAAA GTGCCGCTAT ACAATATCCG

201  TTTCGAGTCC GGCGGTACGG TTGTCGGCAA TACCCTGCAC CCTACCTACT

251  ATAGAGACAT ACGCAGGGGC AAACTGTATG CGGAAGCCAA ATTCGCCGAC

301  GGCAGCGTAA CCTACGGCAA AGCGGGCGAG AGCAAAACCG AGCAAAGCCC

351  CAAGGCTATG GATTTGTTCA CGCTTGCCTG GCAGTTGGCG GCAAATGACG

401  CGAAACTCCC CCCGGGGCTG AAAATCACCA ACGGCAAAAA ACTTTATTCC

451  GTCGGCGGTT TGAATAAGGC GGGTACAGGA AAATACAGCA TAGGCGGCGT

501  GGAAACCGAA GTCGTCAAAT ATCGGGTGCG GCGCGGCGAC GATGCGGTAA

551  TGTATTTCTT CGCACCGTCC CTGAACAATA TTCCGGCACA AATCGGCTAT

601  ACCGACGACG GCAAAACCTA TACGCTGAAA CTCAAATCGG TGCAGATCAA

651  CGGCCAGGCA GCCAAACCGT AA
```

This corresponds to the amino acid sequence <SEQ ID 434; ORF 120.a>:

```
a120.pep

     1  MMKTFKNIFS AAILSAALPC AYAAGLPQSA VLHYSGSYGI PATMTFERSG

    51  NAYKIVSTIK VPLYNIRFES GGTVVGNTLH PTYYRDIRRG KLYAEAKFAD

   101  GSVTYGKAGE SKTEQSPKAM DLFTLAWQLA ANDAKLPPGL KITNGKKLYS

   151  VGGLNKAGTG KYSIGGVETE VVKYRVRRGD DAVMYFFAPS LNNIPAQIGY

   201  TDDGKTYTLK LKSVQINGQA AKP*

m120/a120  99.6% identity in 223 aa overlap

                  10         20         30         40         50         60
m120.pep  MMKTFKNIFSAAILSAALPCAYAAGLPQSAVLXYSGSYGIPATMTFERSGNAYKIVSTIK
          ||||||||||||||||||||||||||||||| ||||||||||||||||||||||||||||
a120      MMKTFKNIFSAAILSAALPCAYAAGLPQSAVLHYSGSYGIPATMTFERSGNAYKIVSTIK
                  10         20         30         40         50         60

                  70         80         90        100        110        120
m120.pep  VPLYNIRFESGGTVVGNTLHPTYYRDIRRGKLYAEAKFADGSVTYGKAGESKTEQSPKAM
          ||||||||||||||||||||||||||||||||||||||||||||||||||||||||||||
a120      VPLYNIRFESGGTVVGNTLHPTYYRDIRRGKLYAEAKFADGSVTYGKAGESKTEQSPKAM
                  70         80         90        100        110        120

                 130        140        150        160        170        180
m120.pep  DLFTLAWQLAANDAKLPPGLKITNGKKLYSVGGLNKAGTGKYSIGGVETEVVKYRVRRGD
          ||||||||||||||||||||||||||||||||||||||||||||||||||||||||||||
a120      DLFTLAWQLAANDAKLPPGLKITNGKKLYSVGGLNKAGTGKYSIGGVETEVVKYRVRRGD
                 130        140        150        160        170        180

                 190        200        210        220
m120.pep  DAVMYFFAPSLNNIPAQIGYTDDGKTYTLKLKSVQINGQAKPX
          ||||||||||||||||||||||||||||||||||||||||||
a120      DAVMYFFAPSLNNIPAQIGYTDDGKTYTLKLKSVQINGQAKPX
                 190        200        210        220
```

The following partial DNA sequence was identified in *N. gonorrhoeae* <SEQ ID 435>:

```
g121.seq
   1 ATGGAAACAC AGCTTTACAT CGGCATTATG TCGGGAACCA GTATGGACGG

  51 GGCGGATGCC GTGCTGGTAC GGATGGACGG CGGCAAATGG CTGGGCGCGG

 101 AAGGGCACGC CTTTACCCCC TACCCTGACC GGTTGCGCCG CAAATTGCTG

 151 GATTTGCAGG ACACAGGCAC AGACGAACTG CACCGCAGCA GGATGTTGTC

 201 GCAAGAACTC AGCCGCCTGT ACGCGCAAAC CGCCGCCGAA CTGCTGTGCA

 251 GTCAAAACCT CGCTCCGTGC GACATTACCG CCCTCGGCTG CCACGGGCAA

 301 ACCGTCCGAC ACGCGCCGGA ACACGGTtac AGCATACAGC TTGCCGATTT

 351 GCCGCTGCTG GCGGAACTGa cgcggatttT TACCGTCggc gacttcCGCA

 401 GCCGCGACCT TGCTGCCGGC GGacaAGGTG CGCCGCTCGT CCCCGCCTTT

 451 CACGAAGCCC TGTTCCGCGA TGACAGGGAA ACACGCGTGG TACTGAACAT

 501 CGGCGGGATT GCCAACATCA GCGTACTCCC CCCCGGCGCA CCCGCCTTCG

 551 GCTTCGACAC AGGGCCGGGC AATATGCTGA TGGAcgcgtg gacgcaggca

 601 cacTGGcagc TGCCTTACGA CAAAAacggt gcAAAGgcgg cacAAGGCAA

 651 catatTGCcg cAACTGCTCG gcaggctGCT CGCCcaccCG TATTTCTCAC

 701 AACCCcaccc aaAAAGCACG GGgcGCGaac TgtttgcccT AAattggctc

 751 gaaacctAcc ttgacggcgg cgaaaaccga tacgacgtat tgcggacgct

 801 ttcccgattc accgcgcaaA ccgTttggga cgccgtctca CACGCAGCGG
```

-continued

```
 851 CAGATGCCCG TCAAATGTAC ATTTGCGGCG GCGGCATCCG CAATCCTGTT

 901 TTAATGGCGG ATTTGGCAGA ATGTTTCGGC ACACGCGTTT CCCTGCACAG

 951 CACCGCCGAA CTGAACCTCG ATCCTCAATG GGTGGAGGCG gccgCATTtg

1001 cgtggttggC GGCGTGTTGG ATTAACCGCA TTCCCGGTAG TCCGCACAAA

1051 GCGACCGGCG CATCCAAACC GTGTATTCTG GGCGCGGGAT ATTATTATTG

1101 A
```

This corresponds to the amino acid sequence <SEQ ID 436; ORF 121.ng>:

```
g121.pep
   1  METQLYIGIM SGTSMDGADA VLVRMDGGKW LGAEGHAFTP YPDRLRRKLL

  51  DLQDTGTDEL HRSRMLSQEL SRLYAQTAAE LLCSQNLAPC DITALGCHGQ

 101  TVRHAPEHGY SIQLADLPLL AELTRIFTVG DFRSRDLAAG GQGAPLVPAF

 151  HEALFRDDRE TRVVLNIGGI ANISVLPPGA PAFGFDTGPG NMLMDAWTQA

 201  HWQLPYDKNG AKAAQGNILP QLLGRLLAHP YFSQPHPKST GRELFALNWL

 251  ETYLDGGENR YDVLRTLSRF TAQTVWDAVS HAAADARQMY ICGGGIRNPV

 301  LMADLAECFG TRVSLHSTAE LNLDPQWVEA AAFAWLAACW INRIPGSPHK

 351  ATGASKPCIL GAGYYY*
```

The following partial DNA sequence was identified in *N. meningitidis* <SEQ ID 437>:

```
m121.seq
   1  ATGGAAACAC AGCTTTACAT CGGCATCATG TCGGGAACCA GCATGGACGG

  51  GGCGGATGCC GTACTGATAC GGATGGACGG CGGCAAATGG CTGGGCGCGG

 101  AAGGGCACGC CTTTACCCCC TACCCCGGCA GGTTACGCCG CCAATTGCTG

 151  GATTTGCAGG ACACAGGCGC AGACGAACTG CACCGCAGCA GGATTTTGTC

 201  GCAAGAACTC AGCCGCCTAT ATGCGCAAAC CGCCGCCGAA CTGCTGTGCA

 251  GTCAAAACCT CGCACCGTCC GACATTACCG CCCTCGGCTG CCACGGGCAA

 301  ACCGTCCGAC ACGCGCCGGA ACACGGTTAC AGCATACAGC TTGCCGATTT

 351  GCCGCTGCTG GCGxxxxxxx xxxxxxxxxx xxxxxxxxxx xxxxxxxxxx

 401  xxxxxxxxxx xxxxxxxxxx xxxxxxxxxx xxxxxxxxxx xxxxxxxxxx

 451  xxxxxxxxxx xxxxxxxxxx xxxxxxxxxx xxxxxxxxxx xxxxxxxxxx

 501  xxxxxxxxxx xxxxxxxxxx xxxxxxxxxx xxxxxxxxxx xxxxxxxxxx

 551  xxxxxxxxxx xxxxxxxxxx xxxxxxxxxx xxxxxxxxxx xxxxxxxxxx

 601  xxxxxxCAGC TTCCTTACGA CAAAAACGGT GCAAAGTCGG CACAAGGCAA

 651  CATATTGCCG CAACTGCTCG ACAGGCTGCT CGCCCACCCG TATTTCGCAC

 701  AACGCCACCC TAAAAGCACG GGGCGCGAAC TGTTTGCCAT AAATTGGCTC

 751  GAAACCTACC TTGACGGCGG CGAAAACCGA TACGACGTAT TGCGGACGCT

 801  TTCCCGTTTT ACCGCGCAAA CCGTTTGCGA CGCCGTCTCA CACGCAGCGG

 851  CAGATGCCCG TCAAATGTAC ATTTGCGACG GCGGCATCCG CAATCCTGTT

 901  TTAATGGCGG ATTTGGCAGA ATGTTTCGGC ACACGCGTTT CCCTGCACAG

 951  CACCGCCGAC CTGAACCTCG ATCCGCAATG GGTGGAAGCC GCCGnATTTG
```

-continued

```
1001 CGTGGTTGGC GGCGTGTTGG ATTAATCGCA TTCCCGGTAG TCCGCACAAA

1051 GCAACCGGCG CATCCAAACC GTGTATTCTG AnCGCGGGAT ATTATTATTG

1101 A
```

This corresponds to the amino acid sequence <SEQ ID 438; ORF 121>:

```
m121.pep
   1 METQLYIGIM SGTSMDGADA VLIRMDGGKW LGAEGHAFTP YPGRLRRQLL

  51 DLQDTGADEL HRSRILSQEL SRLYAQTAAE LLCSQNLAPS DITALGCHGQ

 101 TVRHAPEHGY SIQLADLPLL Axxxxxxxxx xxxxxxxxxx xxxxxxxxxx

 151 xxxxxxxxxx xxxxxxxxxx xxxxxxxxxx xxxxxxxxxx xxxxxxxxxx

 201 xxQLPYDKNG AKSAQGNILP QLLDRLLAHP YFAQRHPKST GRELFAINWL

 251 ETYLDGGENR YDVLRTLSRF TAQTVCDAVS HAAADARQMY ICDGGIRNPV

 301 LMADLAECFG TRVSLHSTAD LNLDPQWVEA AXFAWLAACW INRIPGSPHK

 351 ATGASKPCIL XAGYYY*
```

Computer analysis of the amino acid sequences gave the following results:

Homology with a Predicted ORF from *N. meningitidis* menA with menB

ORF 121 shows 73.5% identity over a 366 aa overlap with a predicted ORF (ORF121.ng) from *N. gonorrhoeae*:

```
m121/g121
                     10        20        30        40        50        60
m121.pep     METQLYIGIMSGTSMDGADAVLIRMDGGKWLGAEGHAFTPYPGRLRRQLLDLQDTGADEL
             |||||||||||||||||||||:||||||||||||||||||| |||||:|||||||:|||
g121         METQLYIGIMSGTSMDGADAVLVRMDGGKWLGAEGHAFTPYPDRLRRKLLDLQDTGTDEL
                     10        20        30        40        50        60

                     70        80        90       100       110       120
m121.pep     HRSRILSQELSRLYAQTAAELLCSQNLAPSDITALGCHGQTVRHAPEHGYSIQLADLPLL
             ||||:|||||||||||||||||||||||| ||||||||||||||||||||||||||||||
g121         HRSRMLSQELSRLYAQTAAELLCSQNLAPCDITALGCHGQTVRHAPEHGYSIQLADLPLL
                     70        80        90       100       110       120

                    130       140       150       160       170       180
m121.pep     AXXXXXXXXXXXXXXXXXXXXXXXXXXXXXXXXXXXXXXXXXXXXXXXXXXXXXXXXXXX
             |  :   :                                :
g121         AELTRIFTVGDFRSRDLAAGGQGAPLVPAFHEALFRDDRETRVVLNIGGIANISVLPPGA
                    130       140       150       160       170       180

                    190       200       210       220       230       240
m121.pep     XXXXXXXXXXXXXXXXXXXXXXQLPYDKNGAKSAQGNILPQLLDRLLAHPYFAQRHPKST
                   :          :    ||||||||||:|||||||||| ||||||||:| |||||
g121         PAFGFDTGPGNMLMDAWTQAHWQLPYDKNGAKAAQGNILPQLLGRLLAHPYFSQPHPKST
                    190       200       210       220       230       240

                    250       260       270       280       290       300
m121.pep     GRELFAINWLETYLDGGENRYDVLRTLSRFTAQTVCDAVSHAAADARQMYICDGGIRNPV
             ||||||:|||||||||||||||||||||||||||| |||||||||||||||| |||||||
g121         GRELFALNWLETYLDGGENRYDVLRTLSRFTAQTVWDAVSHAAADARQMYICGGGIRNPV
                    250       260       270       280       290       300

                    310       320       330       340       350       360
m121.pep     LMADLAECFGTRVSLHSTADLNLDPQWVEAAXFAWLAACWINRIPGSPHKATGASKPCIL
             ||||||||||||||||||:|||||||||||| ||||||||||||||||||||||||||||
g121         LMADLAECFGTRVSLHSTAELNLDPQWVEAAAFAWLAACWINRIPGSPHKATGASKPCIL
                    310       320       330       340       350       360
```

-continued

```
m121.pep   XAGYYYX
            ||||||
g121       GAGYYYX
```

The following partial DNA sequence was identified in *N. meningitidis* <SEQ ID 439>:

```
a121.seq
     1 ATGGAAACAC AGCTTTACAT CGGCATCATG TCGGGAACCA GCATGGACGG
    51 GGCGGATGCC GTACTGATAC GGATGGACGG CGGCAAATGG CTGGGCGCGG
   101 AAGGGCACGC CTTTACCCCC TACCCCGGCA GGTTACGCCG CAAATTGCTG
   151 GATTTGCAGG ACACAGGCGC GGACGAACTG CACCGCAGCA GGATGTTGTC
   201 GCAAGAACTC AGCCGCCTGT ACGCGCAAAC CGCCGCCGAA CTGCTGTGCA
   251 GTCAAAACCT CGCGCCGTCC GACATTACCG CCCTCGGCTG CCACGGGCAA
   301 ACCGTCAGAC ACGCGCCGGA ACACAGTTAC AGCGTACAGC TTGCCGATTT
   351 GCCGCTGCTG GCGGAACGGA CTCAGATTTT TACCGTCGGC GACTTCCGCA
   401 GCCGCGACCT TGCGGCCGGC GGACAAGGCG CGCCGCTCGT CCCCGCCTTT
   451 CACGAAGCCC TGTTCCGCGA CGACAGGGAA ACACGCGCGG TACTGAACAT
   501 CGGCGGGATT GCCAACATCA GCGTACTCCC CCCCGACGCA CCCGCCTTCG
   551 GCTTCGACAC AGGACCGGGC AATATGCTGA TGGACGCGTG GATGCAGGCA
   601 CACTGGCAGC TTCCTTACGA CAAAAACGGT GCAAAGGCGG CACAAGGCAA
   651 CATATTGCCG CAACTGCTCG ACAGGCTGCT CGCCCACCCG TATTTCGCAC
   701 AACCCCACCC TAAAAGCACG GGGCGCGAAC TGTTTGCCCT AAATTGGCTC
   751 GAAACCTACC TTGACGGCGG CGAAAACCGA TACGACGTAT TGCGGACGCT
   801 TTCCCGATTC ACCGCGCAAA CCGTTTTCGA CGCCGTCTCA CACGCAGCGG
   851 CAGATGCCCG TCAAATGTAC ATTTGCGGCG GCGGCATCCG CAATCCTGTT
   901 TTAATGGCGG ATTTGGCAGA ATGTTTCGGC ACACGCGTTT CCCTGCACAG
   951 CACCGCCGAA CTGAACCTCG ATCCGCAATG GGTAGAAGCC GCCGCGTTCG
  1001 CATGGATGGC GGCGTGTTGG GTCAACCGCA TTCCCGGTAG TCCGCACAAA
  1051 GCAACCGGCG CATCCAAACC GTGTATTCTG GGCGCGGGAT ATTATTATTG
  1101 A
```

This corresponds to the amino acid sequence <SEQ ID 440; ORF 121.a>:

```
a121.pep
       1  METQLYIGIM SGTSMDGADA VLIRMDGGKW LGAEGHAFTP YPGRLRRKLL
      51  DLQDTGADEL HRSRMLSQEL SRLYAQTAAE LLCSQNLAPS DITALGCHGQ
     101  TVRHAPEHSY SVQLADLPLL AERTQIFTVG DFRSRDLAAG GQGAPLVPAF
     151  HEALFRDDRE TRAVLNIGGI ANISVLPPDA PAFGFDTGPG NMLMDAWMQA
     201  HWQLPYDKNG AKAAQGNILP QLLDRLLAHP YFAQPHPKST GRELFALNWL
     251  ETYLDGGENR YDVLRTLSRF TAQTVFDAVS HAAADARQMY ICGGGIRNPV
     301  LMADLAECFG TRVSLHSTAE LNLDPQWVEA AAFAWMAACW VNRIPGSPHK
     351  ATGASKPCIL GAGYYY*
```

-continued

```
m121/a121  74.0% identity in 366 aa overlap

                     10        20        30        40        50        60
m121.pep     METQLYIGIMSGTSMDGADAVLIRMDGGKWLGAEGHAFTPYPGRLRRQLLDLQDTGADEL
             |||||||||||||||||||||||||||||||||||||||||||||||:||||||||||||
a121         METQLYIGIMSGTSMDGADAVLIRMDGGKWLGAEGHAFTPYPGRLRRKLLDLQDTGADEL
                     10        20        30        40        50        60

                     70        80        90       100       110       120
m121.pep     HRSRILSQELSRLYAQTAAELLCSQNLAPSDITALGCHGQTVRHAPEHGYSIQLADLPLL
             ||||:|||||||||||||||||||||||||||||||||||||||||||:||:||||||||
a121         HRSRMLSQELSRLYAQTAAELLCSQNLAPSDITALGCHGQTVRHAPEHSYSVQLADLPLL
                     70        80        90       100       110       120

                    130       140       150       160       170       180
m121.pep     AXXXXXXXXXXXXXXXXXXXXXXXXXXXXXXXXXXXXXXXXXXXXXXXXXXXXXXXXXXX
             |  :   :                                :
a121         AERTQIFTVGDFRSRDLAAGGQGAPLVPAFHEALFRDDRETRAVLNIGGIANISVLPPDA
                    130       140       150       160       170       180

                    190       200       210       220       230       240
m121.pep     XXXXXXXXXXXXXXXXXXXXXXQLPYDKNGAKSAQGNILPQLLDRLLAHPYFAQRHPKST
                   :               ||||||||||:||||||||||||||||||||| |||||
a121         PAFGFDTGPGNMLMDAWMQAHWQLPYDKNGAKAAQGNILPQLLDRLLAHPYFAQPHPKST
                    190       200       210       220       230       240

                    250       260       270       280       290       300
m121.pep     GRELFAINWLETYLDGGENRYDVLRTLSRFTAQTVCDAVSHAAADARQMYICDGGIRNPV
             ||||||:|||||||||||||||||||||||||||| |||||||||||||||| |||||||
a121         GRELFALNWLETYLDGGENRYDVLRTLSRFTAQTVFDAVSHAAADARQMYICGGGIRNPV
                    250       260       270       280       290       300

                    310       320       330       340       350       360
m121.pep     LMADLAECFGTRVSLHSTADLNLDPQWVEAAXFAWLAACWINRIPGSPHKATGASKPCIL
             |||||||||||||||||||:||||||||||| |||:||||:|||||||||||||||||||
a121         LMADLAECFGTRVSLHSTAELNLDPQWVEAAAFAWMAACWVNRIPGSPHKATGASKPCIL
                    310       320       330       340       350       360

m121.pep     XAGYYYX
              ||||||
a121         GAGYYYX
```

The following partial DNA sequence was identified in *N. meningitidis* <SEQ ID 441>:

```
m121-1.seq
   1  ATGGAAACAC AGCTTTACAT CGGCATCATG TCGGGAACCA GCATGGACGG

  51  GGCGGATGCC GTACTGATAC GGATGGACGG CGGCAAATGG CTGGGCGCGG

 101  AAGGGCACGC CTTTACCCCC TACCCCGGCA GGTTACGCCG CCAATTGCTG

 151  GATTTGCAGG ACACAGGCGC AGACGAACTG CACCGCAGCA GGATTTTGTC

 201  GCAAGAACTC AGCCGCCTAT ATGCGCAAAC CGCCGCCGAA CTGCTGTGCA

 251  GTCAAAACCT CGCACCGTCC GACATTACCG CCCTCGGCTG CCACGGGCAA

 301  ACCGTCCGAC ACGCGCCGGA ACACGGTTAC AGCATACAGC TTGCCGATTT

 351  GCCGCTGCTG GCGGAACGGA CGCGGATTTT TACCGTCGGC GACTTCCGCA

 401  GCCGCGACCT TGCGGCCGGC GGACAAGGCG CGCCACTCGT CCCCGCCTTT

 451  CACGAAGCCC TGTTCCGCGA CAACAGGGAA ACACGCGCGG TACTGAACAT

 501  CGGCGGGATT GCCAACATCA GCGTACTCCC CCCCGACGCA CCCGCCTTCG

 551  GCTTCGACAC AGGGCCGGGC AATATGCTGA TGGACGCGTG GACGCAGGCA

 601  CACTGGCAGC TTCCTTACGA CAAAAACGGT GCAAAGGCGG CACAAGGCAA

 651  CATATTGCCG CAACTGCTCG ACAGGCTGCT CGCCCACCCG TATTTCGCAC

 701  AACCCCACCC TAAAAGCACG GGGCGCGAAC TGTTTGCCCT AAATTGGCTC

 751  GAAACCTACC TTGACGGCGG CGAAAACCGA TACGACGTAT TGCGGACGCT

 801  TTCCCGTTTT ACCGCGCAAA CCGTTTGCGA CGCCGTCTCA CACGCAGCGG
```

-continued

851 CAGATGCCCG TCAAATGTAC ATTTGCGGCG GCGGCATCCG CAATCCTGTT

901 TTAATGGCGG ATTTGGCAGA ATGTTTCGGC ACACGCGTTT CCCTGCACAG

951 CACCGCCGAC CTGAACCTCG ATCCGCAATG GGTGGAAGCC GCCGNATTTG

1001 CGTGGTTGGC GGCGTGTTGG ATTAATCGCA TTCCCGGTAG TCCGCACAAA

1051 GCAACCGGCG CATCCAAACC GTGTATTCTG ANCGCGGGAT ATTATTATTG

1101 A

This corresponds to the amino acid sequence <SEQ ID 442; ORF 121-1>:

m121-1.pep

1 METQLYIGIM SGTSMDGADA VLIRMDGGKW LGAEGHAFTP YPGRLRRQLL

51 DLQDTGADEL HRSRILSQEL SRLYAQTAAE LLCSQNLAPS DITALGCHGQ

101 TVRHAPEHGY SIQLADLPLL AERTRIFTVG DFRSRDLAAG GQGAPLVPAF

151 HEALFRDNRE TRAVLNIGGI ANISVLPPDA PAFGFDTGPG NMLMDAWTQA

201 HWQLPYDKNG AKAAQGNILP QLLDRLLAHP YFAQPHPKST GRELFALNWL

251 ETYLDGGENR YDVLRTLSRF TAQTVCDAVS HAAADARQMY ICGGGIRNPV

301 LMADLAECFG TRVSLHSTAD LNLDPQWVEA AXFAWLAACW INRIPGSPHK

351 ATGASKPCIL XAGYYY* m121-1/g121 95.6% identity in 366 aa overlap

```
                         10        20        30        40        50        60
m121-1.pep      METQLYIGIMSGTSMDGADAVLIRMDGGKWLGAEGHAFTPYPGRLRRQLLDLQDTGADEL
                ||||||||||||||||||||||:||||||||||||||||||| ||||:||||||||:|||
g121            METQLYIGIMSGTSMDGADAVLVRMDGGKWLGAEGHAFTPYPDRLRRKLLDLQDTGTDEL
                         10        20        30        40        50        60

                         70        80        90       100       110       120
m121-1.pep      HRSRILSQELSRLYAQTAAELLCSQNLAPSDITALGCHGQTVRHAPEHGYSIQLADLPLL
                ||||:|||||||||||||||||||||||| ||||||||||||||||||||||||||||||
g121            HRSRMLSQELSRLYAQTAAELLCSQNLAPCDITALGCHGQTVRHAPEHGYSIQLADLPLL
                         70        80        90       100       110       120

                        130       140       150       160       170       180
m121-1.pep      AERTRIFTVGDFRSRDLAAGGQGAPLVPAFHEALFRDNRETRAVLNIGGIANISVLPPDA
                || ||||||||||||||||||||||||||||||||||:||||:||||||||||||||| |
g121            AELTRIFTVGDFRSRDLAAGGQGAPLVPAFHEALFRDDRETRVVLNIGGIANISVLPPGA
                        130       140       150       160       170       180

                        190       200       210       220       230       240
m121-1.pep      PAFGFDTGPGNMLMDAWTQAHWWLPYDKNGAKAAQGNILPQLLDRLLAHPYFAQPHPKST
                ||||||||||||||||||||||||||||||||||||||||||| ||||||||:|||||||
g121            PAFGFDTGPGNMLMDAWTQAHWQLPYDKNGAKAAQGNILPQLLGRLLAHPYFSQPHPKST
                        190       200       210       220       230       240

                        250       260       270       280       290       300
m121-1.pep      GRELFALNWLETYLDGGENRYDVLRTLSRFTAQTVCDAVSHAAADARQMYICGGGIRNPV
                ||||||||||||||||||||||||||||||||||| ||||||||||||||||||||||||
g121            GRELFALNWLETYLDGGENRYDVLRTLSRFTAQTVWDAVSHAAADARQMYICGGGIRNPV
                        250       260       270       280       290       300

                        310       320       330       340       350       360
m121-1.pep      LMADLAECFGTRVSLHSTADLNLDPQWVEAAXFAWLAACWINRIPGSPHKATGASKPCIL
                |||||||||||||||||||:||||||||||| ||||||||||||||||||||||||||||
g121            LMADLAECFGTRVSLHSTAELNLDPQWVEAAAFAWLAACWINRIPGSPHKATGASKPCIL
                        310       320       330       340       350       360

m121-1.pep      XAGYYYX
                 ||||||
g121            GAGYYYX
```

The following partial DNA sequence was identified in *N. meningitidis* <SEQ ID 443>:

```
a121-1.seq
     1  ATGGAAACAC AGCTTTACAT CGGCATCATG TCGGGAACCA GCATGGACGG

    51  GGCGGATGCC GTACTGATAC GGATGGACGG CGGCAAATGG CTGGGCGCGG

   101  AAGGGCACGC CTTTACCCCC TACCCCGGCA GGTTACGCCG CAAATTGCTG

   151  GATTTGCAGG ACACAGGCGC GGACGAACTG CACCGCAGCA GGATGTTGTC

   201  GCAAGAACTC AGCCGCCTGT ACGCGCAAAC CGCCGCCGAA CTGCTGTGCA

   251  GTCAAAACCT CGCGCCGTCC GACATTACCG CCCTCGGCTG CCACGGGCAA

   301  ACCGTCAGAC ACGCGCCGGA ACACAGTTAC AGCGTACAGC TTGCCGATTT

   351  GCCGCTGCTG GCGGAACGGA CTCAGATTTT TACCGTCGGC GACTTCCGCA

   401  GCCGCGACCT TGCGGCCGGC GGACAAGGCG CGCCGCTCGT CCCCGCCTTT

   451  CACGAAGCCC TGTTCCGCGA CGACAGGGAA ACACGCGCGG TACTGAACAT

   501  CGGCGGGATT GCCAACATCA GCGTACTCCC CCCCGACGCA CCCGCCTTCG

   551  GCTTCGACAC AGGACCGGGC AATATGCTGA TGGACGCGTG GATGCAGGCA

   601  CACTGGCAGC TTCCTTACGA CAAAAACGGT GCAAAGGCGG CACAAGGCAA

   651  CATATTGCCG CAACTGCTCG ACAGGCTGCT CGCCCACCCG TATTTCGCAC

   701  AACCCCACCC TAAAAGCACG GGGCGCGAAC TGTTTGCCCT AAATTGGCTC

   751  GAAACCTACC TTGACGGCGG CGAAAACCGA TACGACGTAT TGCGGACGCT

   801  TTCCCGATTC ACCGCGCAAA CCGTTTTCGA CGCCGTCTCA CACGCAGCGG

   851  CAGATGCCCG TCAAATGTAC ATTTGCGGCG GCGGCATCCG CAATCCTGTT

   901  TTAATGGCGG ATTTGGCAGA ATGTTTCGGC ACACGCGTTT CCCTGCACAG

   951  CACCGCCGAA CTGAACCTCG ATCCGCAATG GGTAGAAGCC GCCGCGTTCG

  1001  CATGGATGGC GGCGTGTTGG GTCAACCGCA TTCCCGGTAG TCCGCACAAA

  1051  GCAACCGGCG CATCCAAACC GTGTATTCTG GGCGCGGGAT ATTATTATTG

  1101  A
```

This corresponds to the amino acid sequence <SEQ ID 444; ORF 121-1.a>:

```
a114.pep

      1  METQLYIGIM SGTSMDGADA VLIRMDGGKW LGAEGHAFTP YPGRLRRKLL

     51  DLQDTGADEL HRSRMLSQEL SRLYAQTAAE LLCSQNLAPS DITALGCHGQ

    101  TVRHAPEHSY SVQLADLPLL AERTQIFTVG DFRSRDLAAG GQGAPLVPAF

    151  HEALFRDDRE TRAVLNIGGI ANISVLPPDA PAFGFDTGPG NMLMDAWMQA

    201  HWQLPYDKNG AKAAQGNILP QLLDRLLAHP YFAQPHPKST GRELFALNWL

    251  ETYLDGGENR YDVLRTLSRF TAQTVFDAVS HAAADARQMY ICGGGIRNPV

    301  LMADLARCFG TRVSLHSTAE LNLDPQWVEA AAFAWMAACW VNRIPGSPHK

    351  ATGASKPCIL GAGYYY*

m121-1/a121-1 96.4% identity in 366 aa overlap

                     10        20        30        40        50        60
m121-1.pep  METQLYIGIMSGTSMDGADAVLIRMDGGKWLGAEGHAFTPYPGRLRRQLLDLQDTGADEL
            ||||||||||||||||||||||||||||||||||||||||||||||||:|||||||||||
a121-1      METQLYIGIMSGTSMDGADAVLIRMDGGKWLGAEGHAFTPYPGRLRRKLLDLQDTGADEL
                     10        20        30        40        50        60
```

-continued

```
                 70         80         90        100        110        120
m114.pep   HRSRILSQELSRLYAQTAAELLCSQNLAPSDITALGCHGQTVRHAPEHGYSIQLADLPLL
           ||||:|||||||||||||||||||||||||||||||||||||||||||:||:||||||||
a121-1     HRSRMLSQELSRLYAQTAAELLCSQNLAPSDITALGCHGQTVRHAPEHSYSVQLADLPLL
                 70         80         90        100        110        120
                130        140        150        160        170        180
m114.pep   AERTRIFTVGDFRSRDLAAGGQGAPLVPAFHEALFRDNRETRAVLNIGGIANISVLPPDA
           ||||:||||||||||||||||||||||||||||||||:||||||||||||||||||||||
a121-1     AERTQIFTVGDFRSRDLAAGGQGAPLVPAFHEALFRDDRETRAVLNIGGIANISVLPPDA
                130        140        150        160        170        180
                190        200        210        220        230        240
m114.pep   PAFGFDTGPGNMLMDAWTQAHWQLPYDKNGAKAAQGNILPQLLDRLLAHPYFAQPHPKST
           ||||||||||||||||| ||||||||||||||||||||||||||||||||||||||||||
a121-1     PAFGFDTGPGNMLMDAWMQAHWQLPYDKNGAKAAQGNILPQLLDRLLAHPYFAQPHPKST
                190        200        210        220        230        240
                250        260        270        280        290        300
m114.pep   GRELFALNWLETYLDGGENRYDVLRTLSRFTAQTVCDAVSHAAADARQMYICGGGIRNPV
           ||||||||||||||||||||||||||||||||||| ||||||||||||||||||||||||
a121-1     GRELFALNWLETYLDGGENRYDVLRTLSRFTAQTVFDAVSHAAADARQMYICGGGIRNPV
                250        260        270        280        290        300
                310        320        330        340        350        360
m114.pep   LMADLAECFGTRVSLHSTADLNLDPQWVEAAXFAWLAACWINRIPGSPHKATGASKPCIL
           |||||||||||||||||||:||||||||||| |||:||||:|||||||||||||||||||
a121-1     LMADLAECFGTRVSLHSTAELNLDPQWVEAAAFAWMAACWVNRIPGSPHKATGASKPCIL
                310        320        330        340        350        360
m114.pep   XAGYYYX
            ||||||
a121-1     GAGYYYX
```

The following partial DNA sequence was identified in *N. gonorrhoeae* <SEQ ID 445>:

```
g122.seq
   1  ATGGCTTTAC TGAGCATCCG CAAGCTGCAC AAACAATACG GCAGCGTAAC

  51  CGCCATCCAA TCCTTAGACT TGGACTTGGA AAAAGGCGAA GtcatCGTAC

 101  TGCTGGGCCC gTccggctgc ggCAAATCCA CCCTcctgcg ctgcgtcaaC

 151  GGTTTGGAGC CGCACCAagg cgGCAGCATC GTGATGGACG GTgtcgGCGA

 201  ATTCggcAAA GACGTTTCCT GGCAAACCGC CCGGCAAAAa gtcggtatgg

 251  tctttcaaag taacgAactg Tttgcccaca tgaccgtcat cgAaaacatc

 301  ttcttAggcC CGGTAAagga aCAAAAcCgc gaccgtgccg aagcaGAGGC

 351  gCAAGCCGGC AAactGttgg aacgcgTCGG actgctAGAC CGCAAAAACG

 401  CCTATCCGCG CGAACTTTCC GGCGGTCAGA AACAGCGCAT CGCCATTGTC

 451  CGCGCCCTGT GCCTGAATCC GGAAGTCATC CTGCTGGACG AAATCACCGC

 501  CGCACTTGAC CCCGAAATGG TGCGCGAAGT CTTGGAAGTG GTTTTGGAAC

 551  TCGCCCGCGA AGGGATGAGT ATGCTCATCG TAACCCACGA AATGGGGTTC

 601  GCACGCAAAG TTGCCGACCG CATCGTCTTT ATGGACAAAG GCGGCATCGT

 651  CGAATCGTCC GACCCCGAAA CCTTTTTTTC CGCACCAAAA AGCGAACGCG

 701  CCCGCCAATT TCTGGCAGGT ATGGACTACT GA
```

This corresponds to the amino acid sequence <SEQ ID 446; ORF 122.ng>:

```
g122.pep
   1  MALLSIRKLH KQYGSVTAIQ SLDLDLEKGE VIVLLGPSGC GKSTLLRCVN
```

-continued

```
 51  GLEPHQGGSI VMDGVGEFGK DVSWQTARQK VGMVFQSNEL FAHMTVIENI

101  FLGPVKEQNR DRAEAEAQAG KLLERVGLLD RKNAYPRELS GGQKQRIAIV

151  RALCLNPEVI LLDEITAALD PEMVREVLEV VLELAREGMS MLIVTHEMGF

201  ARKVADRIVF MDKGGIVESS DPETFFSAPK SERARQFLAG MDY*
```

The following partial DNA sequence was identified in *N. meningitidis* <SEQ ID 447>:

```
m122.seq
  1  GTTGTCATGA TTAAAATCCG CAATATCCAT AAGACCTTTG GCGAAAACAC

 51  TATTTTGCGC GGCATCGATT TGGATGTGTG CAAAGGGCAG GTGGTCGTCA

101  TCCTCGGGcC TTCCGGCTCA GGCAAAACGA CGTTTCTGCG ATGCCTAAAC

151  GCGTTGGAAA TGCCCGAAGA CGGACAAATC GAGTTCGACA ACGAGCGACC

201  GCTGAAAATC GATTTTTCTA AAAAACCAAG CAAACACGAT ATTTTGGCAC

251  TGCGCCGCAA ATCAkGCATG GTGTTTCAAC AATACAAyCT CTTTCCGCAC

301  AAAACCGCCT TGGAAAACGT AATGGAAGGA CCGGTTGCCG TACAgGGCAA

351  GCCTGCCGCC CAAGCGCGCG AAGAGGCTCT GAAACTGCTG GAAAAAGTCG

401  GCTTGGGCGA CAAAGTGGAT TTGTATCCCT ACCAGCTTTC CGGCGGTCAG

451  CAGCAGCGCG TCGGCATTGC CCGCGCATTG GCGATTCAGC CTGAACTGAT

501  GCTGTTTGAC GAACCGACTT CCGCGCTCGA TCCTGAATTG GTGCAAGATG

551  TTTTGGATmC CATGAAGGAA TTGGCGCAAG AAGGCTGGAC CATGGTTGTC

601  GTTACGCATG AAATCAAGTT CGCCTTAGAA GTGGCAACCA CCGwCGTCGT

651  GATGGACrGC GGCGTTATTG TCGAACAAGG CAGCCCGCAA GATTTGTTCG

701  ACCACCCCAA ACACGAACGG ACGCGGAGAT TTTTAAGCCA AATCCAATCT

751  ACCAAGATTT GA
```

This corresponds to the amino acid sequence <SEQ ID 448; ORF 122>:

```
m122.pep
  1  VVMIKIRNIH KTFGENTILR GIDLDVCKGQ VVVILGPSGS GKTTFLRCLN

 51  ALEMPEDGQI EFDNERPLKI DFSKKPSKHD ILALRRKSXM VFQQYNLFPH

101  KTALENVMEG PVAVQGKPAA QAREEALKLL EKVGLGDKVD LYPYQLSGGQ

151  QQRVGIARAL AIQPELMLFD EPTSALDPEL VQDVLDXMKE LAQEGWTMVV

201  VTHEIKFALE VATTXVVMDX GVIVEQGSPQ DLFDHPKHER TRRFLSQIQS

251  TKI*
```

Computer analysis of this amino acid sequence gave the following results:

Homology with a Predicted ORF from *N. gonorrhoeae*

ORF 122 shows 47.2% identity over a 246 aa overlap with a predicted ORF (ORF 122.ng) from *N. gonorrhoeae*:

```
m122/g122

                      10        20        30        40        50        60
m122.pep      VVMIKIRNIHKTFGENTILRGIDLDVCKGQVVVILGPSGSGKTTFLRCLNALEMPEDGQI
              :::::||::|| :|  | ::::|||: ||:|:|:||||| ||:|:|||:|:||  : |:|
g122          MALLSIRKLHKQYGSVTAIQSLDLDLEKGEVIVLLGPSGCGKSTLLRCVNGLEPHQGGSI
                      10        20        30        40        50        60

                      70        80        90       100       110       120
m122.pep      EFDNERPLKIDFSKKPSKHDILALRRKSXMVFQQYNLFPHKTALENVMEGPVAVQGKPAA
               :|:   :  | | : :       |:|  ||||: :|| | |::||:: |||  |::  |
g122          VMDGVGEFGKDVSWQTA-------RQKVGMVFQSNELFAHMTVIENIFLGPVKEQNRDRA
                      70               80        90       100       110

                     130       140       150       160       170       180
m122.pep      QAREEALKLLEKVGLGDKVDLYPYQLSGGQQQRVGIARALAIQPELMLFDEPTSALDPEL
              :|: :| ||||:||| |: : || :|||||:||::|:||| ::||::|:|| |:|||||:
g122          EAEAQAGKLLERVGLLDRKNAYPRELSGGQKQRIAIVRALCLNPEVILLDEITAALDPEM
                  120       130       140       150       160       170

                     190       200       210       220       230       240
m122.pep      VQDVLDXMKELAQEGWTMVVVTHEIKFALEVATTXVVMDXGVIVEQGSPQDLFDHPKHER
              |::||: : |||:|| :|::||||: || :||   | || | |||:::|: :|: || ||
g122          VREVLEVVLELAREGMSMLIVTHEMGFARKVADRIVFMDKGGIVESSDPETFFSAPKSER
                  180       190       200       210       220       230

                     250
m122.pep      TRRFLSQIQSTKIX
              :|:||:
g122          ARQFLAGMDYX
                  240
```

The following partial DNA sequence was identified in *N. meningitidis* <SEQ ID 449>:

```
a122.seq
   1  GTTGTCATGA TTAAAATCCG CAATATCCAT AAGACCTTCG GCAAAAATAC

  51  CATTTTGCGC GGCATCAATT TGGATGTGTG CAAAGGGCAG GTGGTCGTCA

 101  TCCTCGGGCC TTCCGGCTCA GGCAAAACGA CGTTTCTGCG ATGCCTAAAC

 151  GCGTTGGAAA TGCCCGAAGA CGGACAAATC GAGTTCGACA ACGAGCGACC

 201  GCTGAAAATC GATTTTTCTA AAAAACCAAG CAAACACGAT ATTTTGGCAC

 251  TGCGCCGCAA ATCAGGCATG GTGTTTCAAC AATACAACCT CTTTCCGCAC

 301  AAAACCGCCT TGGAAAACGT GATGGAAGGA CCGGTTGCCG TACAGGGCAA

 351  GCCTGCCGCC CAAGCGCGCG AAGAGGCTCT GAAACTGCTG GAAAAAGTCG

 401  GCTTGGGCGA CAAAGTGGAT TTGTATCCCT ACCAGCTTTC CGGCGGTCAG

 451  CAGCAGCGCG TCGGCATTGC CCGAGCATTG GCGATTCAGC CCGAGCTGAT

 501  GTTGTTTGAC GAACCCACTT CCGCGCTTGA CCCCGAGTTG GTGCAAGACG

 551  TGTTGAACGC CATGAAGGAA TTGGCGCGGG AAGGTTGGAC GATGGTCGTC

 601  GTTACCCACG AAATCAAGTT CGCGCTGGAA GTTGCCACGA CCGTTGTCGT

 651  GATGGACGGC GGCGTTATCG TAGAGCAGGG CAGCCCGAAA GAGTTGTTCG

 701  ACCACCCCAA ACACGAACGG ACGCGGAGAT TTTTAAGCCA AATCCAATCT

 751  ACCAAGATTT GA
```

This corresponds to the amino acid sequence <SEQ ID 450; ORF 122.a>:

```
a122.pep
    1  VVMIKIRNIH KTFGKNTILR GINLDVCKGQ VVVILGPSGS GKTTFLRCLN

   51  ALEMPEDGQI EFDNERPLKI DFSKKPSKHD ILALRRKSGM VFQQYNLFPH

  101  KTALENVMEG PVAVQGKPAA QAREEALKLL EKVGLGDKVD LYPYQLSGGQ

  151  QQRVGIARAL AIQPELMLFD EPTSALDPEL VQDVLNAMKE LAREGWTMVV

  201  VTHEIKFALE VATTVVVMDG GVIVEQGSPK ELFDHPKHER TRRFLSQIQS

  251  TKI*
```

m122/a122 96.0% identity in 253 aa overlap

```
                     10        20        30        40        50        60
   m122.pep  VVMIKIRNIHKTFGENTILRGIDLDVCKGQVVVILGPSGSGKTTFLRCLNALEMPEDGQI
             ||||||||||||||:|||||||:|||||||||||||||||||||||||||||||||||||
   a122      VVMIKIRNIHKTFGKNTILRGINLDVCKGQVVVILGPSGSGKTTFLRCLNALEMPEDGQI
                     10        20        30        40        50        60

                     70        80        90       100       110       120
   m122.pep  EFDNERPLKIDFSKKPSKHDILALRRKSXMVFQQYNLFPHKTALENVMEGPVAVQGKPAA
             |||||||||||||||||||||||||||| |||||||||||||||||||||||||||||||
   a122      EFDNERPLKIDFSKKPSKHDILALRRKSGMVFQQYNLFPHKTALENVMEGPVAVQGKPAA
                     70        80        90       100       110       120

                    130       140       150       160       170       180
   m122.pep  QAREEALKLLEKVGLGDKVDLYPYQLSGGQQQRVGIARALAIQPELMLFDEPTSALDPEL
             ||||||||||||||||||||||||||||||||||||||||||||||||||||||||||||
   a122      QAREEALKLLEKVGLGDKVDLYPYQLSGGQQQRVGIARALAIQPELMLFDEPTSALDPEL
                    130       140       150       160       170       180

                    190       200       210       220       230       240
   m122.pep  VQDVLDXMKELAQEGWTMVVVTHEIKFALEVATTXVVMDXGVIVEQGSPQDLFDHPKHER
             |||||: |||||:||||||||||||||||||||| |||| |||||||||::|||||||||
   a122      VQDVLNAMKELAREGWTMVVVTHEIKFALEVATTVVVMDGGVIVEQGSPKELFDHPKHER
                    190       200       210       220       230       240

                    250
   m122.pep  TRRFLSQIQSTKIX
             ||||||||||||||
   a122      TRRFLSQIQSTKIX
                    250
```

The following partial DNA sequence was identified in *N. gonorrhoeae* <SEQ ID 451>:

```
g122-1.seq
    1  ATGATTAAAA TCCGCAATAT CCATAAGACC TTTGGCGAAA ACACCATTTT

   51  GCGCGGCATC GATTTGGATG TGGGCAAAGG GCAGGTGGTC GTCATCCTCG

  101  GGCCTTCCGG CTCGGGTAAA ACAACATTTC TGCGCTGCCT AAACGCGTTG

  151  GAAATGCCCG AAGACGGACA AATCGAGTTC GACAACGCGC GGCCGTTACG

  201  CATTGATTTT TCCAAAAAAA CAAGCAAACA CGATATTTTG GCACTGCGCC

  251  GCAAGTCCGG AATGGTATTC CAACAATACA ACCTCTTCCC GCATAAAACC

  301  GTGTTGGAAA ACGTGATGGA AGGGCCGGTT GCCGTACAGG GCAAGCCTGC

  351  CGCCCAAGCG CGCGAAGAGG CTTTGAAACT GCTGGAAAAA GTCGGCTTGG

  401  GCGATAAAGT GGATTTGTAT CCCTACCAGC TTTCCGGCGG TCAGCAGCAG

  451  CGTGTCGGTA TCGCCCGCGC ACTGGCGATT CAGCCTGAAT TGATGCTGTT

  501  TGACGAACCC ACTTCCGCGC TGGACCCCGA GTTGGTGCAA GACGTGTTGG
```

-continued

```
551  ACGCCATGAA GGAATTGGCG CGGGAAGGTT GGACGATGGT CGTCGTTACC

601  CACGAAATCA AGTTCACGCT GGAAGTTGCC ACGAACGTCG TCGTGATGGA

651  CGGCGGCGTT ATCGTAGAGC AGGGCAGCCC GAAAGAGTTG TTCGACCACC

701  TCAAACACGA ACGGACGCGG AGATTTTTAA GCCAAATCCA ATCTGCCAAG

751  ATTTGA
```

This corresponds to the amino acid sequence <SEQ ID 452; ORF 122-1.ng>:

```
g122-1.pep
  1  MIKIRNIHKT FGENTILRGI DLDVGKGQVV VILGPSGSGK TTFLRCLNAL

 51  EMPEDGQIEF DNARPLRIDF SKKTSKHDIL ALRRKSGMVF QQYNLFPHKT

101  VLENVMEGPV AVQGKPAAQA REEALKLLEK VGLGDKVDLY PYQLSGGQQQ

151  RVGIARALAI QPELMLFDEP TSALDPELVQ DVLDAMKELA REGWTMVVVT

201  HEIKFTLEVA TNVVVMDGGV IVEQGSPKEL FDHLKHERTR RFLSQIQSAK

251  I*
```

The following partial DNA sequence was identified in *N. meningitidis* <SEQ ID 453>:

```
m122-1.seq
  1  ATGATTAAAA TCCGCAATAT CCATAAGACC TTTGGCGAAA ACACTATTTT

 51  GCGCGGCATC GATTTGGATG TGTGCAAAGG GCAGGTGGTC GTCATCCTCG

101  GGCCTTCCGG CTCAGGCAAA ACGACGTTTC TGCGATGCCT AAACGCGTTG

151  GAAATGCCCG AAGACGGACA AATCGAGTTC GACAACGAGC GACCGCTGAA

201  AATCGATTTT TCTAAAAAAC CAAGCAAACA CGATATTTTG GCACTGCGCC

251  GCAAATCAGG CATGGTGTTT CAACAATACA ACCTCTTTCC GCACAAAACC

301  GCCTTGGAAA ACGTAATGGA AGGACCGGTT GCCGTACAGG GCAAGCCTGC

351  CGCCCAAGCG CGCGAAGAGG CTCTGAAACT GCTGGAAAAA GTCGGCTTGG

401  GCGACAAAGT GGATTTGTAT CCCTACCAGC TTTCCGGCGG TCAGCAGCAG

451  CGCGTCGGCA TTGCCCGCGC ATTGGCGATT CAGCCTGAAC TGATGCTGTT

501  TGACGAACCG ACTTCCGCGC TCGATCCTGA ATTGGTGCAA GATGTTTTGG

551  ATACCATGAA GGAATTGGCG CAAGAAGGCT GGACCATGGT TGTCGTTACG

601  CATGAAATCA AGTTCGCCTT AGAAGTGGCA ACCACCGTCG TCGTGATGGA

651  CGGCGGCGTT ATTGTCGAAC AAGGCAGCCC GCAAGATTTG TTCGACCACC

701  CCAAACACGA ACGGACGCGG AGATTTTTAA GCCAAATCCA ATCTACCAAG

751  ATTTGA
```

This corresponds to the amino acid sequence <SEQ ID 454; ORF 122-1>:

```
m122-1.pep

  1 MIKIRNIHKT FGENTILRGI DLDVCKGQVV VILGPSGSGK TTFLRCLNAL

 51 EMPEDGQIEF DNERPLKIDF SKKPSKHDIL ALRRKSGMVF QQYNLFPHKT

101 ALENVMEGPV AVQGKPAAQA REEALKLLEK VGLGDKVDLY PYQLSGGQQQ
```

-continued

```
151 RVGIARALAI QPELMLFDEP TSALDPELVQ DVLDTMKELA QEGWTMVVVT

201 HEIKFALEVA TTVVVMDGGV IVEQGSPQDL FDHPKHERTR RFLSQIQSTK

251 I*
```

m122-1/g122-1 94.8% identity in 251 aa overlap

```
                     10        20        30        40        50        60
m122-1.pep    MIKIRNIHKTFGENTILRGIDLDVCKGQVVVILGPSGSGKTTFLRCLNALEMPEDGQIEF
              |||||||||||||||||||||||| ||||||||||||||||||||||||||||||||||||
g122-1        MIKIRNIHKTFGENTILRGIDLDVGKGQVVVILGPSGSGKTTFLRCLNALEMPEDGQIEF
                     10        20        30        40        50        60

                     70        80        90       100       110       120
m122-1.pep    DNERPLKIDFSKKPSKHDILALRRKSGMVFQQYNLFPHKTALENVMEGPVAVQGKPAAQA
              || |||:|||||| ||||||||||||||||||||||||||:|||||||||||||||||||
g122-1        DNARPLRIDFSKKTSKHDILALRRKSGMVFQQYNLFPHKTVLENVMEGPVAVQGKPAAQA
                     70        80        90       100       110       120

                    130       140       150       160       170       180
m122-1.pep    REEALKLLEKVGLGDKVDLYPYQLSGGQQQRVGIARALAIQPELMLFDEPTSALDPELVQ
              ||||||||||||||||||||||||||||||||||||||||||||||||||||||||||||
g122-1        REEALKLLEKVGLGDKVDLYPYQLSGGQQQRVGIARALAIQPELMLFDEPTSALDPELVQ
                    130       140       150       160       170       180

                    190       200       210       220       230       240
m122-1.pep    DVLDTMKELAQEGWTMVVVTHEIKFALEVATTVVVMDGGVIVEQGSPQDLFDHPKHERTR
              ||||:|||||:||||||||||||||:|||||:||||||||||||||||::|||| ||||||
g122-1        DVLDAMKELAREGWTMVVVTHEIKFTLEVATNVVVMDGGVIVEQGSPKELFDHLKHERTR
                    190       200       210       220       230       240

                    250
m122-1.pep    RFLSQIQSTKIX
              ||||||||:|||
g122-1        RFLSQIQSAKIX
                    250
```

The following partial DNA sequence was identified in *N. meningitidis* <SEQ ID 455>:

```
a122-1.seq
   1  ATGATTAAAA TCCGCAATAT CCATAAGACC TTCGGCAAAA ATACCATTTT

  51  GCGCGGCATC AATTTGGATG TGTGCAAAGG GCAGGTGGTC GTCATCCTCG

 101  GGCCTTCCGG CTCAGGCAAA ACGACGTTTC TGCGATGCCT AAACGCGTTG

 151  GAAATGCCCG AAGACGGACA AATCGAGTTC GACAACGAGC GACCGCTGAA

 201  AATCGATTTT TCTAAAAAAC CAAGCAAACA CGATATTTTG GCACTGCGCC

 251  GCAAATCAGG CATGGTGTTT CAACAATACA ACCTCTTTCC GCACAAAACC

 301  GCCTTGGAAA ACGTGATGGA AGGACCGGTT GCCGTACAGG GCAAGCCTGC

 351  CGCCCAAGCG CGCGAAGAGG CTCTGAAACT GCTGGAAAAA GTCGGCTTGG

 401  GCGACAAAGT GGATTTGTAT CCCTACCAGC TTTCCGGCGG TCAGCAGCAG

 451  CGCGTCGGCA TTGCCCGAGC ATTGGCGATT CAGCCCGAGC TGATGTTGTT

 501  TGACGAACCC ACTTCCGCGC TTGACCCCGA GTTGGTGCAA GACGTGTTGA

 551  ACGCCATGAA GGAATTGGCG CGGGAAGGTT GGACGATGGT CGTCGTTACC

 601  CACGAAATCA AGTTCGCGCT GGAAGTTGCC ACGACCGTTG TCGTGATGGA

 651  CGGCGGCGTT ATCGTAGAGC AGGGCAGCCC GAAAGAGTTG TTCGACCACC

 701  CCAAACACGA ACGGACGCGG AGATTTTTAA GCCAAATCCA ATCTACCAAG

 751  ATTTGA
```

This corresponds to the amino acid sequence <SEQ ID 456; ORF 122-1.a>:

```
a122-1.pep

      1 MIKIRNIHKT FGENTILRGI NLDVCKGQVV VILGPSGSGK TTFLRCLNAL

     51 EMPEDGQIEF DNERPLKIDF SKKPSKHDIL ALRRKSGMVF QQYNLFPHKT

    101 ALENVMEGPV AVQGKPAAQA REEALKLLEK VGLGDKVDLY PYQLSGGQQQ

    151 RVGIARALAI QPELMLFDEP TSALDPELVQ DVLDTMKELA REGWTMVVVT

    201 HEIKFALEVA TTVVVMDGGV IVEQGSPKEL FDHPKHERTR RFLSQIQSTK

    251 I*

a122-1/m122-1  97.2% identity in 251 aa overlap

                      10        20        30        40        50        60
a122-1.pep    MIKIRNIHKTFGKNTILRGINLDVCKGQVVVILGPSGSGKTTFLRCLNALEMPEDGQIEF
              ||||||||||||:|||||||:|||||||||||||||||||||||||||||||||||||||
m122-1        MIKIRNIHKTFGENTILRGIDLDVGKGQVVVILGPSGSGKTTFLRCLNALEMPEDGQIEF
                      10        20        30        40        50        60

                      70        80        90       100       110       120
a122-1.pep    DNERPLKIDFSKKPSKHDILALRRKSGMVFQQYNLFPHKTALENVMEGPVAVQGKPAAQA
              ||||||||||||||||||||||||||||||||||||||||||||||||||||||||||||
m122-1        DNERPLKIDFSKKPSKHDILALRRKSGMVFQQYNLFPHKTALENVMEGPVAVQGKPAAQA
                      70        80        90       100       110       120

                     130       140       150       160       170       180
a122-1.pep    REEALKLLEKVGLGDKVDLYPYQLSGGQQQRVGIARALAIQPELMLFDEPTSALDPELVQ
              ||||||||||||||||||||||||||||||||||||||||||||||||||||||||||||
m122-1        REEALKLLEKVGLGDKVDLYPYQLSGGQQQRVGIARALAIQPELMLFDEPTSALDPELVQ
                     130       140       150       160       170       180

                     190       200       210       220       230       240
a122-1.pep    DVLNAMKELAREGWTMVVVTHEIKFALEVATTVVVMDGGVIVEQGSPKELFDHPKHERTR
              |||::|||||:|||||||||||||||||||||||||||||||||||::||||||||||||
m122-1        DVLDTMKELAQEGWTMVVVTHEIKFALEVATTVVVMDGGVIVEQGSPQDLFDHPKHERTR
                     190       200       210       220       230       240

                     250
a122-1.pep    RFLSQIQSTKIX
              ||||||||||||
m122-1        RFLSQIQSTKIX
                     250
```

The following partial DNA sequence was identified in *N. gonorrhoeae* <SEQ ID 457>:

```
g125.seq.
    1  ATGTCGGGCA ATGCCTCCTC TCCTTCATCT TCCGCCGCCA TCGGGCTGGT

   51  TTGGTTCGGC GCGGCGGTAT CGATTGCCGA AATCAGCACG GGTACGCTGC

  101  TCGCCCCCTT GGGCTGGCAG CGCGGTCTGG CGGCCCTGCT TTTGGGTCAT

  151  GCCGTCGGCG GCGCGCTGTT TTTTGCGGCG GCGTATATCG GCGCACTGAC

  201  CGGACGCAGC TCGATGGAAA GTGTGCGCCT GTCGTTCGGC AAATGCGGTT

  251  CAGTGCTGTT TTCCGTGGCG AATATGCTGC AACTGGCCGG CTGGACGGCG

  301  GTGATGATTT ACGTCGGCGC AacggTCAGC TCCGCTTTGG GCAAAGTGTT

  351  GTGGGACggc gaATCCTTTG TCTGGTGGGC ATTGGCAAAC GGCGCACTGA

  401  TCGTGCTGTG GCTGGTTTTC GGCGCACGCA GAACGGGCGG GCTGAAAACC

  451  GTTTCGATGC TGCTGATGCT GCTTGCCGTG TTGTGGTTGA GCGTCGAAGT

  501  GTTCGCTTCG TCCGGCACAA ACGCCGCGCC CGCCGTTTCA GACGGCATGA

  551  CCTTCGGAAC GGCAGTCGAA CTGTCCGCCG TCATGCCGCT TTCCTGGCTG

  601  CCGCTGGCCG CCGACTACAC GCGCCAAGCA CGCCGCCCGT TTGCGGCAAC

  651  CCTGACGGCA ACGCTCGCCT ATACGCTGAC GGGCTGCTGG ATGTATGCCT
```

-continued

```
 701 TGGGTTTGGC GGCGGCTCTG TTTACCGGAG AAACCGACGT GGCGAAAATC

 751 CTGTTGGGCG CGGGCTTGGG CATAACGGGC ATTCTGGCAG TCGTCCTCTC

 801 CACCGTTACC ACAACGTTTC TCGATACCTA TTCCGCCGGC GCGAGTGCGA

 851 ACAACATTTC CGCGCGTTTT GCGGAAATAC CCGTCGCTGT CGGCGTTACC

 901 CTGatccgca ccgtgcttgc cgtcatgctg cccgttaccg aatataaaaa

 951 cttcctgctg cttatccgct cggtatttgg gccgatggcg ggtggttttg

1001 attgccgaCT TTTttgtctt AAAACGGCGT GA
```

This corresponds to the amino acid sequence <SEQ ID 458; ORF 125.ng>:

The following partial DNA sequence was identified in *N. meningitidis* <SEQ ID 459>:

```
m125.seq
   1 ATGTCGGGCA ATGCCTCCTC TCCTTCATCT TCCTCCGCCA TCGGGCTGAT

  51 TTGGTTCGGC GCGGCGGTAT CGATTGCCGA AATCAGCACG GGTACGCTGC

 101 TTGCGCCTTT GGGCTGGCAG CGCGGTCTGG CGGCTCTACT TTTGGGTCAT

 151 GCCGTCGGCG GCGCGCTGTT TTTTGCGGCG GCGTATATCG GCGCACTGAC

 201 CGGACGCAGC TCGATGGAAA GCGTGCGCCT GTCGTTCGGC AAACGCGGTT

 251 CAGTGCTGTT TTCCGTGGCG AATATGCTGC AACTGGCCGG CTGGACGGCG

 301 GTGATGATTT ACGCCGGCGC AACGGTCAGC TCCGCTTTGG GCAAAGTGTT

 351 GTGGGACGGC GAATCTTTTG TCTGGTGGGC ATTGGCAAAC GGCGCGCTGA

 401 TTGTGCTGTG GCTGGTTTTC GGCGCACGCA AAACAGGCGG GCTGAAAACC

 451 GTTTCGATGC TGCTGATGCT GTTGGCGGTT CTGTGGCTGA GTGCCGAAGT

 501 CTTTTCCACG GCAGGCAGCA CCGCCGCACA GGTTTCAGAC GGCATGAGTT

 551 TCGGAACGGC AGTCGAGCTG TCCGCCGTGA TGCCGCTTTC CTGGCTGCCG

 601 CTTGCCGCCG ACTACACGCG CCACGCGCGC CGCCCGTTTG CGGCAACCCT

 651 GACGGCAACG CTCGCCTACA CGCTGACCGG CTGCTGGATG TATGCCTTGG

 701 GTTTGGCAGC GGCGTTGTTC ACCGGAGAAA CCGACGTGGC AAAAATCCTG

 751 CTGGGCGCAr GTTTGgGTGC GGCAGGCATT TTGGCGGTCG TCCTCTCCAC

 801 CGTTACCACA ACGTTTCTCG ATGCCTATTC CGCCGGCGCG AGTGCGAACA

 851 ACATTTCCGC GCGTTTTGCG GAAACACCCG TCGCTGTCrG CGTTACCCTG

 901 ATCGGCACGG TACTTGCCGT CATGCTGCCC GTTACCGAAT ATGAAAACTT

 951 CCTGCTGCTT ATCGGCTCGG TATTTGCGCC GATGGCGGgC GGTTTTGATT

1001 GCCGACTTTT TCGTCTTGAA ACGGCGTGA
```

This corresponds to the amino acid sequence <SEQ ID 460; ORF 125>:

```
m125.pep
   1 MSGNASSPSS SSAIGLIWFG AAVSIAEIST GTLLAPLGWQ RGLAALLLGH

  51 AVGGALFFAA AYIGALTGRS SMESVRLSFG KRGSVLFSVA NMLQLAGWTA

 101 VMIYAGATVS SALGKVLWDG ESFVWWALAN GALIVLWLVF GARKTGGLKT

 151 VSMLLMLLAV LWLSAEVFST AGSTAAQVSD GMSFGTAVEL SAVMPLSWLP

 201 LAADYTRHAR RPFAATLTAT LAYTLTGCWM YALGLAAALF TGETDVAKIL
```

-continued

```
251  LGAXLGAAGI LAVVLSTVTT TFLDAYSAGA SANNISARFA ETPVAVXVTL

301  IGTVLAVMLP VTEYENFLLL IGSVFAPMAG GFDCRLFRLE TA*
```

Computer analysis of this amino acid sequence gave the following results:

Homology with a Predicted ORF from *N. gonorrhoeae*

ORF 125 shows 92.1% identity over a 343 aa overlap with a predicted ORF (ORF 125.ng) from *N. gonorrhoeae*:

```
m125/g125

                    10        20        30        40        50        60
m125.pep   MSGNASSPSSSSAIGLIWFGAAVSIAEISTGTLLAPLGWQRGLAALLLGHAVGGALFFAA
           ||||||||||:||||:||||||||||||||||||||||||||||||||||||||||||||
g125       MSGNASSPSSSAAIGLVWFGAAVSIAEISTGTLLAPLGWQRGLAALLLGHAVGGALFFAA
                    10        20        30        40        50        60

                    70        80        90       100       110       120
m125.pep   AYIGALTGRSSMESVRLSFGKRGSVLFSVANMLQLAGWTAVMIYAGATVSSALGKVLWDG
           |||||||||||||||||||| ||||||||||||||||||||||:||||||||||||||||
g125       AYIGALTGRSSMESVRLSFGKCGSVLFSVANMLQLAGWTAVMIYVGATVSSALGKVLWDG
                    70        80        90       100       110       120

                   130       140       150       160       170      179
m125.pep   ESFVWWALANGALIVLWLVFGARKTGGLKTVSMLLMLLAVLWLSAEVFSTAGSTAAQ-VS
           ||||||||||||||||||||||:|||||||||||||||||||:|||:::|::||  ||
g125       ESFVWWALANGALIVLWLVFGARRTGGLKTVSMLLMLLAVLWLSVEVFASSGTNAAPAVS
                   130       140       150       160       170       180

         180       190       200       210       220       230      239
m125.pep   DGMSFGTAVELSAVMPLSWLPLAADYTRHARRPFAATLTATLAYTLTGCWMYALGLAAAL
           |||:||||||||||||||||||||||||:|||||||||||||||||||||||||||||||
g125       DGMTFGTAVELSAVMPLSWLPLAADYTRQARRPFAATLTATLAYTLTGCWMYALGLAAAL
                   190       200       210       220       230       240

         240       250       260       270       280       290      299
m125.pep   FTGETDVAKILLGAXLGAAGILAVVLSTVTTTFLDAYSAGASANNISARFAETPVAVXVT
           ||||||||||||| || :||||||||||||||:||||||||||||||| |||| ||
g125       FTGETDVAKILLGAGLGITGILAVVLSTVTTTFLDTYSAGASANNISARFAEIPVAVGVT
                   250       260       270       280       290       300

         300       310       320       330       340
m125.pep   LIGTVLAVMLPVTEYENFLLLIGSVFAPMAGGFDCRLFRLETAX
           || |||||||||||:|||||| |||:||||||||||| |:|||
g125       LIRTVLAVMLPVTEYKNFLLLIRSVFGPMAGGFDCRLFCLKTAX
                   310       320       330       340
```

The following partial DNA sequence was identified in *N. meningitidis* <SEQ ID 461>:

```
a125.seq
     1  ATGTCGGGCA ATGCCTCCTC TCCTTCATCT TCCGCCGCCA TCGGGCTGAT

    51  TTGGTTCGGC GCGGCGGTAT CGATTGCCGA AATCAGCACG GGTACACTGC

   101  TTGCGCCTTT GGGCTGGCAG CGCGGTCTGG CGGCTCTGCT TTTGGGTCAT

   151  GCCGTCGGCG GCGCGCTGTT TTTTGCGGCG GCGTATATCG GCGCACTGAC

   201  CGGACGCAGC TCGATGGAAA GCGTGCGCCT GTCGTTCGGC AAACGCGGTT

   251  CAGTGCTGTT TTCCGTGGCG AATATGCTGC AACTGGCCGG CTGGACGGCG

   301  GTGATGATTT ACGCCGGCGC AACGGTCAGC TCCGCTTTGG GCAAAGTGTT

   351  GTGGGACGGC GAATCTTTTG TCTGGTGGGC ATTGGCAAAC GGCGCGCTGA

   401  TTGTGCTGTG GCTGGTTTTC GGCGCACGCA AAACAGGCGG GCTGAAAACC

   451  GTTTCGATGC TGCTGATGCT GTTGGCGGTT CTGTGGCTGA GTGCCGAAGT
```

-continued

```
 501 CTTTTCCACG GCAGGCAGCA CCGCCGCACA GGTTTCAGAC GGCATGAGTT

 551 TCGGAACGGC AGTCGAGCTG TCCGCCGTGA TGCCGCTTTC TTGGCTGCCG

 601 CTGGCCGCCG ACTACACGCG CCACGCGCGC CGCCCGTTTG CGGCAACCCT

 651 GACGGCAACG CTCGCCTACA CGCTGACCGG CTGCTGGATG TATGCCTTGG

 701 GTTTGGCAGC GGCGTTGTTC ACCGGAGAAA CCGACGTGGC AAAAATCCTG

 751 CTGGGCGCAG GTTTGGGTGC GGCAGGCATT TTGGCGGTCG TCCTGTCGAC

 801 CGTTACCACC ACTTTTCTCG ATGCCTACTC CGCCGGCGTA AGTGCCAACA

 851 ATATTTCCGC CAAACTTTCG GAAATACCCA TCGCCGTTGC CGTCGCCGTT

 901 GTCGGCACAC TGCTTGCCGT CCTCCTGCCC GTTACCGAAT ATGAAAACTT

 951 CCTGCTGCTT ATCGGCTCGG TATTTGCGCC GATGGCG.GC GGTTTTGATT

1001 GCCGACTTTT TCGTCTTGAA ACGGCGTGA
```

This corresponds to the amino acid sequence <SEQ ID 462; ORF 125.a>:

```
a125.pep.
  1  MSGNASSPSS SAAIGLIWFG AAVSIAEIST GTLLAPLGWQ RGLAALLLGH

 51  AVGGALFFAA AYIGALTGRS SMESVRLSFG KRGSVLFSVA NMLQLAGWTA

101  VMIYAGATVS SALGKVLWDG ESFVWWALAN GALIVLWLVF GARKTGGLKT

151  VSMLLMLLAV LWLSAEVFST AGSTAAQVSD GMSFGTAVEL SAVMPLSWLP

201  LAADYTRHAR RPFAATLTAT LAYTLTGCWM YALGLAAALF TGETDVAKIL

251  LGAGLGAAGI LAVVLSTVTT TFLDAYSAGV SANNISAKLS EIPIAVAVAV

301  VGTLLAVLLP VTEYENFLLL IGSVFAPMAX GFDCRLFRLE TA*
```

m125/a125 95.6% identity in 342 aa overlap

```
                   10        20        30        40        50        60
m125.pep   MSGNASSPSSSSAIGLIWFGAAVSIAEISTGTLLAPLGWQRGLAALLLGHAVGGALFFAA
           |||||||||||:||||||||||||||||||||||||||||||||||||||||||||||||
a125       MSGNASSPSSSAAIGLIWFGAAVSIAEISTGTLLAPLGWQRGLAALLLGHAVGGALFFAA
                   10        20        30        40        50        60

                   70        80        90       100       110       120
m125.pep   AYIGALTGRSSMESVRLSFGKRGSVLFSVANMLQLAGWTAVMIYAGATVSSALGKVLWDG
           ||||||||||||||||||||||||||||||||||||||||||||||||||||||||||||
a125       AYIGALTGRSSMESVRLSFGKRGSVLFSVANMLQLAGWTAVMIYAGATVSSALGKVLWDG
                   70        80        90       100       110       120

                  130       140       150       160       170       180
m125.pep   ESFVWWALANGALIVLWLVFGARKTGGLKTVSMLLMLLAVLWLSAEVFSTAGSTAAQVSD
           ||||||||||||||||||||||||||||||||||||||||||||||||||||||||||||
a125       ESFVWWALANGALIVLWLVFGARKTGGLKTVSMLLMLLAVLWLSAEVFSTAGSTAAQVSD
                  130       140       150       160       170       180

                  190       200       210       220       230       240
m125.pep   GMSFGTAVELSAVMPLSWLPLAADYTRHARRPFAATLTATLAYTLTGCWMYALGLAAALF
           ||||||||||||||||||||||||||||||||||||||||||||||||||||||||||||
a125       GMSFGTAVELSAVMPLSWLPLAADYTRHARRPFAATLTATLAYTLTGCWMYALGLAAALF
                  190       200       210       220       230       240

                  250       260       270       280       290       300
m125.pep   TGETDVAKILLGAXLGAAGILAVVLSTVTTTFLDAYSAGASANNISARFAETPVAVXVTL
           ||||||||||||| |||||||||||||||||||||||||:|||||||:::| |:|| |::
a125       TGETDVAKILLGAGLGAAGILAVVLSTVTTTFLDAYSAGVSANNISAKLSEIPIAVAVAV
                  250       260       270       280       290       300
```

-continued

```
              310        320        330        340
m125.pep   IGTVLAVMLPVTEYENFLLLIGSVFAPMAGGFDCRLFRLETAX
           :||:|||:||||||||||||||||||||| ||||||||||||
a125       VGTLLAVLLPVTEYENFLLLIGSVFAPMAXGFDCRLFRLETAX
              310        320        330        340
```

The following partial DNA sequence was identified in *N. gonorrhoeae* <SEQ ID 463>:

```
g126.seq
    1  AtgccgtcTG AAaccCcaaa ggcACGCCGC CGGCTTTCAG ACGGCATCGC

   51  GTCCGACAAC CATACCAAAG AATCCATCAT GCTCACCctg tacggcGAAA

  101  CTTTCCCTTC GCGGCTGCTg ctcggcacgG cggcctacCC GACCCCTGAA

  151  ATCCTCAAAC AATCCGTCCG AACCGCCCGG CCCGCGATGA ttaccGTCTC

  201  GCTGCGCCGC ACGGGATGCG GCGGCGAGGC GCACGGTCAG GGGTTTTGGT

  251  CGCTGCTTCA AGAAACCGGC GTTCCCGTCC TGCCGAACAC GGCAGGCTGC

  301  CAAAGCGTGC AGGAAGCGGT AACGACGGCG CAAATGGCGC GCGAAGTGTT

  351  TGAAACCGAT TGGATAAAAT TGGAACTCAT CGGCGACGAC GACACCTTGC

  401  AGCCGGACGT GTTCCAACTC GTCGAAGCGG CGGAAATCCT GATTAAAGAC

  451  GGCTTCAAAG TGCTGCCTTA TTGCACCGAA GACCTGATTG CCTGCCGCCG

  501  CCTGCTCGAT GCGGGCTGTC AGGCGTTGAT GCCGTGGGCG GCTCCCATCG

  551  GCACGGGTTT GGGGGCGGTT CACGCCTATG CGCTCAAAAT CCTGCGCGAA

  601  CGCCTGCCCG ACACGCCGCT GATTATCGAC GCGGGCTTGG GTTTGCCTTC

  651  CCAAGCGGCA CAAGTGATGG AATGGGGTTT TGACGGCGTA TTGTTAAACA

  701  CCGCCGTTTC CCGCAGCGGC GACCCCGTCA ACATGGCGCG CGCCTTCGCA

  751  CTCGCCGTCG AATCCGGACG GCTGGCATTT GAAGCCGGGC CGGTCGAAGC

  801  GCGAACCAAA GCCCAAGCCA GCACGCCGAC AGTCGGACAA CCGTTTTGGC

  851  ATTCGGCGGA ATATTGA
```

This corresponds to the amino acid sequence <SEQ ID 464; ORF 126.ng>:

```
g126.pep
    1  MPSETPKARR RLSDGIASDN HTKESIMLTL YGETFPSRLL LGTAAYPTPE

   51  ILKQSVRTAR PAMITVSLRR TGCGGEAHGQ GFWSLLQETG VPVLPNTAGC

  101  QSVQEAVTTA QMAREVFETD WIKLELIGDD DTLQPDVFQL VEAAEILIKD

  151  GFKVLPYCTE DLIACRRLLD AGCQALMPWA APIGTGLGAV HAYALKILRE

  201  RLPDTPLIID AGLGLPSQAA QVMEWGFDGV LLNTAVSRSG DPVNMARAFA

  251  LAVESGRLAF EAGPVEARTK AQASTPTVGQ PFWHSAEY*
```

The following partial DNA sequence was identified in *N. meningitidis* <SEQ ID 465>:

```
m126.seq. (partial)
    1  ..CACTATACAA AGGAACCCAT TATGCTCACC CTATACGGCG AAACTTTCCC

   51    CTCGCGGCTG CTGCTCGGCA CGGCTGCCTA CCCGACCCCC GAAATCCTCA

  101    AACAATCCAT CCAAACCGCC CAGCCTGCGA TGATTACCGT CTCGCTGCGC
```

-continued

```
151    CGCGCGGGAA GCGGCGGCGA GGCGCACGGT CAGGGGTTTT GGTCGCTGCT

201    TCAAGAAACC GGCGTTCCCG TCCTGCCGAA CACGGCAGGC TGCCAAAGCG

251    TGCAGGAAGC GGTAACGACG GCGCAAATGG CGCGCGAAGT GTTTGAAACC

301    GATTGGATAA AATTGGAACT CATCGGAGAT GACGACACCT TGCAGCCGGA

351    TGTGTTCCAG CTTGTCGAAG CGGCGGAAAT CCTGATTAAA GACGGCTTCA

401    AAGTGCTGCC TTATTGCACC GAAGACCTGA TTGCCTGCCG CCGCCTGCTC

451    GACGCGGGCT GTCAGGCGTT GATGCCGTGG GCGGCGGCGA TCGGCACGGG

501    TTTGGGCGCG GTTCACGCCT ACGCGTTGAA CGTCCTGCGC GAACGCCTGC

551    CCGACACGCC GCTGATTATC GACGCGGGCT TGGGTTTGCC CTCACAGGCG

601    GCACAAGTGA TGGAATGGGG CTTTGACGGC GTGCTTTTGA ATACTGCCGT

651    TTCCCGCAGC GGCGATCCGG TCAATATGGC ACGCGCCTTC GCACTCGCCG

701    TCGAATCCGG ACGGCTGGCA TTTGAAGCCG GACCGGTCGA AGCACGCGAC

751    AAAGCGCAAG CCAGCACGCC GACAGTCGGA CAACCGTTTT GGCATTCGGC

801    GGAATATTGA
```

This corresponds to the amino acid sequence <SEQ ID 466; ORF 126>:

```
m126.pep (partial)
   1  ..HYTKEPIMLT LYGETFPSRL LLGTAAYPTP EILKQSIQTA QPAMITVSLR

  51    RAGSGGEAHG QGFWSLLQET GVPVLPNTAG CQSVQEAVTT AQMAREVFET

 101    DWIKLELIGD DDTLQPDVFQ LVEAAEILIK DGFKVLPYCT EDLIACRRLL

 151    DAGCQALMPW AAPIGTGLGA VHAYALNVLR ERLPDTPLII DAGLGLPSQA

 201    AQVMEWGFDG VLLNTAVSRS GDPVNMARAF ALAVESGRLA FEAGPVEARD

 251    KAQASTPTVG QPFWHSAEY*
```

Computer analysis of this amino acid sequence gave the following results:

Homology with a Predicted ORF from *N. gonorrhoeae*

ORF 126 shows 95.9% identity over a 269 aa overlap with a predicted ORF (ORF 126.ng) from *N. gonorrhoeae*:

```
m126/g126

                                         10        20        30        40
m126.pep                         HYTKEPIMLTLYGETFPSRLLLGTAAYPTPEILKQSIQTAQ
                                 ::||| ||||||||||||||||||||||||||||||::||:
g126        MPSETPKARRRLSDGIASDNHTKESIMLTLYGETFPSRLLLGTAAYPTPEILKQSVRTAR
                    10        20        30        40        50        60

                  50        60        70        80        90       100
m126.pep    PAMITVSLRRAGSGGEAHGQGFWSLLQETGVPVLPNTAGCQSVQEAVTTAQMAREVFETD
            ||||||||||:| ||||||||||||||||||||||||||||||||||||||||||||||||
g126        PAMITVSLRRTGCGGEAHGQGFWSLLQETGVPVLPNTAGCQSVQEAVTTAQMAREVFETD
                    70        80        90       100       110       120

                 110       120       130       140       150       160
m126.pep    WIKLELIGDDDTLQPDVFQLVEAAEILIKDGFKVLPYCTEDLIACRRLLDAGCQALMPWA
            ||||||||||||||||||||||||||||||||||||||||||||||||||||||||||||
g126        WIKLELIGDDDTLQPDVFQLVEAAEILIKDGFKVLPYCTEDLIACRRLLDAGCQALMPWA
                   130       140       150       160       170       180

                 170       180       190       200       210       220
m126.pep    APIGTGLGAVHAYALNVLRERLPDTPLIIDAGLGLPSQAAQVMEWGFDGVLLNTAVSRSG
            ||||||||||||||::||||||||||||||||||||||||||||||||||||||||||||
g126        APIGTGLGAVHAYALKILRERLPDTPLIIDAGLGLPSQAAQVMEWGFDGVLLNTAVSRSG
                   190       200       210       220       230       240
```

-continued

```
                  230       240       250       260       270
m126.pep    DPVNMARAFALAVESGRLAFEAGPVEARDKAQASTPTVGQPFWHSAEYX
            |||||||||||||||||||||||||||| ||||||||||||||||||||
g126        DPVNMARAFALAVESGRLAFEAGPVEARTKAQASTPTVGQPFWHSAEYX
                    250       260       270       280
```

The following partial DNA sequence was identified in *N. meningitidis* <SEQ ID 467>:

```
a126.seq
   1  TTGTTAATCC ACTATACAAA GGAACCCATT ATGCTCACCC TGTACAGCGA
  51  AACTTTCCCT TCGCGGCTGC TGCTCGGCAC AGCCGCCTAC CCGACCCCTG
 101  AAATCCTCAA ACAATCCGTC CGAACCGCCC GGCCCGCGAT GATTACCGTC
 151  TCGCTGCGCC GCGCGGGATG CGGCGGCGAG GCGCACGGTC AGGGGTTTTG
 201  GTCGCTGCTT CAAGAAACCG GCGTTCCCGT CCTGCCGAAC ACGGCAGGCT
 251  GCCAAAGCGT GCAGGAAGCG GTAACGACGG CGCAAATGGC GCGCGAAGTG
 301  TTTGAAACCG ATTGGATTAA ACTCGAACTC ATCGGCGACG ACGACACCTT
 351  GCAGCCGGAT GTGTTCCAAC TTGTCGAAGC GGCGGAAATC CTGATTAAAG
 401  ACGGCTTCAA AGTGCTGCCT TATTGCACCG AAGACCTGAT TGCCTGCCGC
 451  CGCCTGCTCG ACGCGGGCTG TCAGGCGTTG ATGCCGTGGG CGGCCCCGAT
 501  CGGCACGGGT TTGGGCGCGG TTCACGCCTA CGCGTTGAAC GTCCTGCGCG
 551  AACGCCTGCC CGACACGCCG CTGATTATCG ACGCGGGCTT GGGTTTGCCC
 601  TCACAGGCGG CACAAGTGAT GGAATGGGGC TTTGACGGCG TGCTTTTGAA
 651  TACTGCCGTT TCCCGCAGCG GCGATCCGGT CAATATGGCA CGCGCCTTCG
 701  CACTCGCCGT CGAATCCGGA CGGCTGGCAT TTGAAGCCGG ACCGGTCGAA
 751  GCACGCGACA AAGCGCAAGC CAGCACGCCG ACAGTCGGAC AACCGTTTTG
 801  GCATTCGGCG GAATATTGA
```

This corresponds to the amino acid sequence <SEQ ID 468; ORF 126.a>:

```
a126.pep
  1   LLIHYTKEPI MLTLYSETFP SRLLLGTAAY PTPEILKQSV RTARPAMITV
 51   SLRRAGCGGE AHGQGFWSLL QETGVPVLPN TAGCQSVQEA VTTAQMAREV
101   FETDWIKLEL IGDDDTLQPD VFQLVEAAEI LIKDGFKVLP YCTEDLIACR
151   RLLDAGCQAL MPWAAPIGTG LGAVHAYALN VLRERLPDTP LIIDAGLGLP
201   SQAAQVMEWG FDGVLLNTAV SRSGDPVNMA RAFALAVESG RLAFEAGPVE
251   ARDKAQASTP TVGQPFWHSA EY*
```

m126/a126 98.1% identity in 269 aa overlap

```
                      10        20        30        40        50
m126.pep       HYTKEPIMLTLYGETFPSRLLLGTAAYPTPEILKQSIQTAQPAMITVSLRRAGSGGE
               |||||||||||:|||||||||||||||||||||||||::||:||||||||||| |||
a126        LLIHYTKEPIMLTLYSETFPSRLLLGTAAYPTPEILKQSVRTARPAMITVSLRRAGCGGE
                    10        20        30        40        50        60
```

-continued

```
                60        70        80        90        100       110
m126.pep   AHGQGFWSLLQETGVPVLPNTAGCQSVQEAVTTAQMAREVFETDWIKLELIGDDDTLQPD
           ||||||||||||||||||||||||||||||||||||||||||||||||||||||||||||
a126       AHGQGFWSLLQETGVPVLPNTAGCQSVQEAVTTAQMAREVFETDWIKLELIGDDDTLQPD
                   70        80        90        100       110       120

           120       130       140       150       160       170
m126.pep   VFQLVEAAEILIKDGFKVLPYCTEDLIACRRLLDAGCQALMPWAAPIGTGLGAVHAYALN
           ||||||||||||||||||||||||||||||||||||||||||||||||||||||||||||
a126       VFQLVEAAEILIKDGFKVLPYCTEDLIACRRLLDAGCQALMPWAAPIGTGLGAVHAYALN
                   130       140       150       160       170       180

           180       190       200       210       220       230
m126.pep   VLRERLPDTPLIIDAGLGLPSQAAQVMEWGFDGVLLNTAVSRSGDPVNMARAFALAVESG
           ||||||||||||||||||||||||||||||||||||||||||||||||||||||||||||
a126       VLRERLPDTPLIIDAGLGLPSQAAQVMEWGFDGVLLNTAVSRSGDPVNMARAFALAVESG
                   190       200       210       220       230       240

           240       250       260       270
m126.pep   RLAFEAGPVEARDKAQASTPTVGQPFWHSAEYX
           |||||||||||||||||||||||||||||||||
a126       RLAFEAGPVEARDKAQASTPTVGQPFWHSAEYX
                   250       260       270
```

The following partial DNA sequence was identified in *N. gonorrhoeae* <SEQ ID 469>:

```
g126-1.seq
   1  ATGCTCACCC TGTACGGCGA AACTTTCCCT TCGCGGCTGC TGCTCGGCAC

  51  GGCCGCCTAC CCGACCCCTG AAATCCTCAA ACAATCCGTC CGAACCGCCC

 101  GGCCCGCGAT GATTACCGTC TCGCTGCGCC GCACGGGATG CGGCGGCGAG

 151  GCGCACGGTC AGGGGTTTTG GTCGCTGCTT CAAGAAACCG GCGTTCCCGT

 201  CCTGCCGAAC ACGGCAGGCT GCCAAAGCGT GCAGGAAGCG GTAACGACGG

 251  CGCAAATGGC GCGCGAAGTG TTTGAAACCG ATTGGATAAA ATTGGAACTC

 301  ATCGGCGACG ACGACACCTT GCAGCCGGAC GTGTTCCAAC TCGTCGAAGC

 351  GGCGGAAATC CTGATTAAAG ACGGCTTCAA AGTGCTGCCT TATTGCACCG

 401  AAGACCTGAT TGCCTGCCGC CGCCTGCTCG ATGCGGGCTG TCAGGCGTTG

 451  ATGCCGTGGG CGGCTCCCAT CGGCACGGGT TTGGGGGCGG TTCACGCCTA

 501  TGCGCTCAAA ATCCTGCGCG AACGCCTGCC CGACACGCCG CTGATTATCG

 551  ACGCGGGCTT GGGTTTGCCT TCCCAAGCGG CACAAGTGAT GGAATGGGGT

 601  TTTGACGGCG TATTGTTAAA CACCGCCGTT TCCCGCAGCG GCGACCCCGT

 651  CAACATGGCG CGCGCCTTCG CACTCGCCGT CGAATCCGGA CGGCTGGCAT

 701  TTGAAGCCGG GCCGGTCGAA GCGCGAACCA AAGCCCAAGC CAGCACGCCG

 751  ACAGTCGGAC AACCGTTTTG GCATTCGGCG GAATATTGA
```

This corresponds to the amino acid sequence <SEQ ID 470; ORF 126-1.ng>:

```
g126-1.pep.
   1  MLTLYGETFP SRLLLGTAAY PTPEILKQSV RTARPAMITV SLRRTGCGGE

  51  AHGQGFWSLL QETGVPVLPN TAGCQSVQEA VTTAQMAREV FETDWIKLEL

 101  IGDDDTLQPD VFQLVEAAEI LIKDGFKVLP YCTEDLIACR RLLDAGCQAL

 151  MPWAAPIGTG LGAVHAYALK ILRERLPDTP LIIDAGLGLP SQAAQVMEWG

 201  FDGVLLNTAV SRSGDPVNMA RAFALAVESG RLAFEAGPVE ARTKAQASTP

 251  TVGQPFWHSA EY*
```

The following partial DNA sequence was identified in *N. meningitidis* <SEQ ID 471>:

```
m126-1.seq
    1  ATGCTCACCC TATACGGCGA AACTTTCCCC TCGCGGCTGC TGCTCGGCAC

   51  GGCTGCCTAC CCGACCCCCG AAATCCTCAA ACAATCCATC CAAACCGCCC

  101  AGCCTGCGAT GATTACCGTC TCGCTGCGCC GCGCGGGAAG CGGCGGCGAG

  151  GCGCACGGTC AGGGGTTTTG GTCGCTGCTT CAAGAAACCG GCGTTCCCGT

  201  CCTGCCGAAC ACGGCAGGCT GCCAAAGCGT GCAGGAAGCG GTAACGACGG

  251  CGCAAATGGC GCGCGAAGTG TTTGAAACCG ATTGGATAAA ATTGGAACTC

  301  ATCGGAGATG ACGACACCTT GCAGCCGGAT GTGTTCCAGC TTGTCGAAGC

  351  GGCGGAAATC CTGATTAAAG ACGGCTTCAA AGTGCTGCCT TATTGCACCG

  401  AAGACCTGAT TGCCTGCCGC CGCCTGCTCG ACGCGGGCTG TCAGGCGTTG

  451  ATGCCGTGGG CGGCCCCGAT CGGCACGGGT TTGGGCGCGG TTCACGCCTA

  501  CGCGTTGAAC GTCCTGCGCG AACGCCTGCC CGACACGCCG CTGATTATCG

  551  ACGCGGGCTT GGGTTTGCCC TCACAGGCGG CACAAGTGAT GGAATGGGGC

  601  TTTGACGGCG TGCTTTTGAA TACTGCCGTT TCCCGCAGCG GCGATCCGGT

  651  CAATATGGCA CGCGCCTTCG CACTCGCCGT CGAATCCGGA CGGCTGGCAT

  701  TTGAAGCCGG ACCGGTCGAA GCACGCGACA AAGCGCAAGC CAGCACGCCG

  751  ACAGTCGGAC AACCGTTTTG GCATTCGGCG GAATATTGA
```

This corresponds to the amino acid sequence <SEQ ID 5; ORF 126-1>:

```
m126-1.pep

      1 MLTLYGETFP SRLLLGTAAY PTPEILKQSI QTAQPAMITV SLRRAGSGGE

     51 AHGQGFWSLL QETGVPVLPN TAGCQSVQEA VTTAQMAREV FETDWIKLEL

    101 IGDDDTLQPD VFQLVEAAEI LIKDGFKVLP YCTEDLIACR RLLDAGCQAL

    151 MPWAAPIGTG LGAVHAYALN VLRERLPDTP LIIDAGLGLP SQAAQVMEWG

    201 FDGVLLNTAV SRSGDPVNMA RAFALAVESG RLAFEAGPVE ARDKAQASTP

    251 TVGQPFWHSA EY*

m126-1/g126-1  96.9% identity in 262 aa overlap

                    10        20        30        40        50        60
m126-1.pep  MLTLYGETFPSRLLLGTAAYPTPEILKQSIQTAQPAMITVSLRRAGSGGEAHGQGFWSLL
            ||||||||||||||||||||||||||||::||:||||||||||:| ||||||||||||||
g126-1      MLTLYGETFPSRLLLGTAAYPTPEILKQSVRTARPAMITVSLRRTGCGGEAHGQGFWSLL
                    10        20        30        40        50        60

                    70        80        90       100       110       120
m126-1.pep  QETGVPVLPNTAGCQSVQEAVTTAQMAREVFETDWIKLELIGDDDTLQPDVFQLVEAAEI
            ||||||||||||||||||||||||||||||||||||||||||||||||||||||||||||
g126-1      QETGVPVLPNTAGCQSVQEAVTTAQMAREVFETDWIKLELIGDDDTLQPDVFQLVEAAEI
                    70        80        90       100       110       120

                   130       140       150       160       170       180
m126-1.pep  LIKDGFKVLPYCTEDLIACRRLLDAGCQALMPWAAPIGTGLGAVHAYALNVLRERLPDTP
            ||||||||||||||||||||||||||||||||||||||||||||||||||::||||||||
g126-1      LIKDGFKVLPYCTEDLIACRRLLDAGCQALMPWAAPIGTGLGAVHAYALKILRERLPDTP
                   130       140       150       160       170       180

                   190       200       210       220       230       240
m126-1.pep  LIIDAGLGLPSQAAQVMEWGFDGVLLNTAVSRSGDPVNMARAFALAVESGRLAFEAGPVE
            ||||||||||||||||||||||||||||||||||||||||||||||||||||||||||||
g126-1      LIIDAGLGLPSQAAQVMEWGFDGVLLNTAVSRSGDPVNMARAFALAVESGRLAFEAGPVE
                   190       200       210       220       230       240
```

-continued

```
                  250       260
m126-1.pep  ARDKAQASTPTVGQPFWHSAEYX
            || ||||||||||||||||||||
g126-1      ARTKAQASTPTVGQPFWHSAEYX
                  250       260
```

The following partial DNA sequence was identified in *N. meningitidis* <SEQ ID 473>:

```
a126-1.seq
   1  ATGCTCACCC TGTACAGCGA AACTTTCCCT TCGCGGCTGC TGCTCGGCAC

  51  AGCCGCCTAC CCGACCCCTG AAATCCTCAA ACAATCCGTC CGAACCGCCC

 101  GGCCCGCGAT GATTACCGTC TCGCTGCGCC GCGCGGGATG CGGCGGCGAG

 151  GCGCACGGTC AGGGGTTTTG GTCGCTGCTT CAAGAAACCG GCGTTCCCGT

 201  CCTGCCGAAC ACGGCAGGCT GCCAAAGCGT GCAGGAAGCG GTAACGACGG

 251  CGCAAATGGC GCGCGAAGTG TTTGAAACCG ATTGGATTAA ACTCGAACTC

 301  ATCGGCGACG ACGACACCTT GCAGCCGGAT GTGTTCCAAC TTGTCGAAGC

 351  GGCGGAAATC CTGATTAAAG ACGGCTTCAA AGTGCTGCCT TATTGCACCG

 401  AAGACCTGAT TGCCTGCCGC CGCCTGCTCG ACGCGGGCTG TCAGGCGTTG

 451  ATGCCGTGGG CGGCCCCGAT CGGCACGGGT TTGGGCGCGG TTCACGCCTA

 501  CGCGTTGAAC GTCCTGCGCG AACGCCTGCC CGACACGCCG CTGATTATCG

 551  ACGCGGGCTT GGGTTTGCCC TCACAGGCGG CACAAGTGAT GGAATGGGGC

 601  TTTGACGGCG TGCTTTTGAA TACTGCCGTT TCCCGCAGCG GCGATCCGGT

 651  CAATATGGCA CGCGCCTTCG CACTCGCCGT CGAATCCGGA CGGCTGGCAT

 701  TTGAAGCCGG ACCGGTCGAA GCACGCGACA AAGCGCAAGC CAGCACGCCG

 751  ACAGTCGGAC AACCGTTTTG GCATTCGGCG GAATATTGA
```

This corresponds to the amino acid sequence <SEQ ID 474; ORF 126-1.a>:

```
a126-1.pep

      1 MLTLYGETFP SRLLLGTAAY PTPEILKQSV RTAQPAMITV SLRRAGSGGE

     51 AHGQGFWSLL QETGVPVLPN TAGCQSVQEA VTTAQMAREV FETDWIKLEL

    101 IGDDDTLQPD VFQLVEAAEI LIKDGFKVLP YCTEDLIACR RLLDAGCQAL

    151 MPWAAPIGTG LGAVHAYALN VLRERLPDTP LIIDAGLGLP SQAAQVMEWG

    201 FDGVLLNTAV SRSGDPVNMA RAFALAVESG RLAFEAGPVE ARDKAQASTP

    251 TVGQPFWHSA EY*

a126-1/m126-1  98.1% identity in 262 aa overlap

                     10        20        30        40        50        60
a126-1.pep  MLTLYSETFPSRLLLGTAAYPTPEILKQSVRTARPAMITVSLRRAGCGGEAHGQGFWSLL
            |||||:|||||||||||||||||||||||::||:|||||||||||| |||||||||||||
m126-1      MLTLYGETFPSRLLLGTAAYPTPEILKQSIQTAQPAMITVSLRRTGSGGEAHGQGFWSLL
                     10        20        30        40        50        60

                     70        80        90       100       110       120
a126-1.pep  QETGVPVLPNTAGCQSVQEAVTTAQMAREVFETDWIKLELIGDDDTLQPDVFQLVEAAEI
            ||||||||||||||||||||||||||||||||||||||||||||||||||||||||||||
m126-1      QETGVPVLPNTAGCQSVQEAVTTAQMAREVFETDWIKLELIGDDDTLQPDVFQLVEAAEI
                     70        80        90       100       110       120
```

-continued

```
                 130       140       150       160       170       180
a126-1.pep  LIKDGFKVLPYCTEDLIACRRLLDAGCQALMPWAAPIGTGLGAVHAYALNVLRERLPDTP
            ||||||||||||||||||||||||||||||||||||||||||||||||||||||||||||
m126-1      LIKDGFKVLPYCTEDLIACRRLLDAGCQALMPWAAPIGTGLGAVHAYALNVLRERLPDTP
                 130       140       150       160       170       180

                 190       200       210       220       230       240
a126-1.pep  LIIDAGLGLPSQAAQVMEWGFDGVLLNTAVSRSGDPVNMARAFALAVESGRLAFEAGPVE
            ||||||||||||||||||||||||||||||||||||||||||||||||||||||||||||
m126-1      LIIDAGLGLPSQAAQVMEWGFDGVLLNTAVSRSGDPVNMARAFALAVESGRLAFEAGPVE
                 190       200       210       220       230       240

                 250       260
a126-1.pep  ARDKAQASTPTVGQPFWHSAEYX
            |||||||||||||||||||||||
m126-1      ARDKAQASTPTVGQPFWHSAEYX
                 250       260
```

The following partial DNA sequence was identified in *N. gonorrhoeae* <SEQ ID 475>:

```
g127.seq
  1  ATGGAAATAT GGAATATGTT GAACACTTGG CCCGATGCCG TCCCGATACG
 51  CGCGGAGGCG GCCGAATCCG TGGCGGCGGT CGCGGCTTTG CTGCTGGCGC
101  GCGCCCTTCT GTTGAATATC CACTTCAGAC GGCATCCGGA TTTCGGCATC
151  GAAAGCAAGC GGCGGTTTTT GGTTGCCAGC CGCAATATAA CGCTGCTTTT
201  GGTGCTGTTT TCGCTGGCAT TTATCTGGTC GGCGCAAATT CAAACGCTGG
251  CTTTGTCGAT GTTTGCGGTG GCGGCGGCGG TCGTCGTGGC GACAAAAGAA
301  CTGATTATGT GTCTGTCGGG CAGTATTTTA aggtctGCCA CCCAGCAATA
351  CTCGGTCGGC GACTATATCG AAATCAACGG CCTGCGCGGG CGCGTGGTCG
401  ACATCAATCT GTTGAACACG CTGATGATGC AGGTCGGTCC GAACCCCTTG
451  GTCGGACAGC TTGCGGGAAC CACCGTTTCT TTCCCCAACA GCCTGTTGTT
501  GAGCCACCCC GTGCGCCGCG ACAATATTTT GGGCGACTAT GTCATCCATA
551  CGGTCGAAAT CCCCGTTCCC ATCCATTTGG ATTCGGATGA AGCCGTATGC
601  CGTCTGAAAG CCGTACTCGA GCCCTTGTGC GCGCCCTACA TCCCCGCCAT
651  TCAGCGGTAT TTGGAAAACG TGCAGGCGGA AAAACTGTTT ATCACGCCCG
701  CCGCCAGGCC GCGCGTTACC CGCGTACCGT ACGACGACAA GGCATACCGC
751  ATCATCGTCC GCTTCGCCTC CCCCGTTTCA AAGCGGCTGG AAATCCAACA
801  GGCGGTTATG GACGAATTTT TGCGCGTACA ATACCGCCTG TTAAATCATC
851  CCGCCGcfct cccrAAACAC TTTAA
```

This corresponds to the amino acid sequence <SEQ ID 476; ORF 127.ng>:

```
g127.pep
  1  MEIWNMLNTW PDAVPIRAEA AESVAAVAAL LLARALLLNI HFRRHPDFGI
 51  ESKRRFLVAS RNITLLLVLF SLAFIWSAQI QTLALSMFAV AAAVVVATKE
101  LIMCLSGSIL RSATQQYSVG DYIEINGLRG RVVDINLLNT LMMQVGPNPL
151  VGQLAGTTVS FPNSLLLSHP VRRDNILGDY VIHTVEIPVP IHLDSDEAVC
201  RLKAVLEPLC APYIPAIQRY LENVQAEKLF ITPAARPRVT RVPYDDKAYR
251  IIVRFASPVS KRLEIQQAVM DEFLRVQYRL LNHPAGSETL *
```

The following partial DNA sequence was identified in *N. meningitidis* <SEQ ID 477>:

```
m127.seq
    1  ATGGAAATAT GGAATATGTT GGACACTTGG CTCGGTGCCG TCCCGATACG

   51  TGCGGAGGCG GTCGAATCCG TGGCGGCGGT TGCGGCTTTG CTGCTGGCGC

  101  GCGCCCTTCT GTTGAATATC CACTTCAAAC GGCATCCGGA TTTCGGCATC

  151  GAAAGCAAGC GGCGGTTTTT GGTTGCCAGC CGCAATATAA CGCTGCTTTT

  201  GGTGCTGTTT TCGCTGGCAT TTATCTGGTC GGCGCAAATC CAAACGCTGG

  251  CTTTGTCGAT GTTTGCGGTG GCGGCGGCGG TCGTCGTGGC GACGAAGGAA

  301  CTGATTATGT GTCTGTCGGG CAGTATTTTA AGGTCTGCCA CCCAGCAATA

  351  CTCGGTCGGC GACTATATCG AAATCAACGG CCTGCGCGGG CGCGTGGTCG

  401  ACATCAACCT GTTGAACACG CTGATGATGC AGGTCGGTCC GAACCCCTTG

  451  GTCGGACAGC TTGCGGGAAC CACCGTTTCT TTCCCCAACA GCCTGTTGTT

  501  GAGCCACCCC GTGCGCCGCG ACAATATTTT GGGCGACTAT GTCATCCATA

  551  CGGTCGAAAT CCCCGTTCCC ATCCATTTGG ATTCGGATGA AGCCGTATGC

  601  CGTCTGAAAG CCGTACTCGA GCCCTTGTGC GCGCCCTACA TCCCCGCCAT

  651  CCAACGGsAT TTGGAAAACG TGCAGGCGGA AAAACTGTTT ATCACGCCCG

  701  CCGCCAGACC GCGCGTTACC CGCGTGCCGT ACGATGACAA GGCATACCGC

  751  ATCATCGTCC GCTTCGCTTC CCCCGTTTCA AAGCGGCTGG AAATCCAACA

  801  GGCGGTTATG GACGAATTTT TGCGCGTACA ATACCGCCTG TTAAATCACC

  851  CCGCCGGCTC CGAAACACTT TAA
```

This corresponds to the amino acid sequence <SEQ ID 478; ORF 127>:

```
m127.pep
    1  MEIWNMLDTW LGAVPIRAEA VESVAAVAAL LLARALLLNI HFKRHPDFGI

   51  ESKRRFLVAS RNITLLLVLF SLAFIWSAQI QTLALSMFAV AAAVVVATKE

  101  LIMCLSGSIL RSATQQYSVG DYIEINGLRG RVVDINLLNT LMMQVGPNPL

  151  VGQLAGTTVS FPNSLLLSHP VRRDNILGDY VIHTVEIPVP IHLDSDEAVC

  201  RLKAVLEPLC APYIPAIQRX LENVQAEKLF ITPAARPRVT RVPYDDKAYR

  251  IIVRFASPVS KRLEIQQAVM DEFLRVQYRL LNHPAGSETL *
```

Computer analysis of this amino acid sequence gave the following results:

Homology with a Predicted ORF from *N. gonorrhoeae*

ORF 127 shows 97.9% identity over a 290 aa overlap with a predicted ORF (ORF 127.ng) from *N. gonorrhoeae*:

```
m127/g127

                    10        20        30        40        50        60
m127.pep   MEIWNMLDTWLGAVPIRAEAVESVAAVAALLLARALLLNIHFKRHPDFGIESKRRFLVAS
           |||||||:||  |||||||:|||||||||||||||||||||:|||||||||||||||||
g127       MEIWNMLNTWPDAVPIRAEAAESVAAVAALLLARALLLNIHFRRHPDFGIESKRRFLVAS
                    10        20        30        40        50        60
```

-continued

```
                 70        80        90       100       110       120
m127.pep  RNITLLLVLFSLAFIWSAQIQTLALSMFAVAAAVVVATKELIMCLSGSILRSATQQYSVG
          ||||||||||||||||||||||||||||||||||||||||||||||||||||||||||||
g127      RNITLLLVLFSLAFIWSAQIQTLALSMFAVAAAVVVATKELIMCLSGSILRSATQQYSVG
                 70        80        90       100       110       120
                130       140       150       160       170       180
m127.pep  DYIEINGLRGRVVDINLLNTLMMQVGPNPLVGQLAGTTVSFPNSLLLSHPVRRDNILGDY
          ||||||||||||||||||||||||||||||||||||||||||||||||||||||||||||
g127      DYIEINGLRGRVVDINLLNTLMMQVGPNPLVGQLAGTTVSFPNSLLLSHPVRRDNILGDY
                130       140       150       160       170       180
                190       200       210       220       230       240
m127.pep  VIHTVEIPVPIHLDSDEAVCRLKAVLEPLCAPYIPAIQRXLENVQAEKLFITPAARPRVT
          ||||||||||||||||||||||||||||||||||||||| ||||||||||||||||||||
g127      VIHTVEIPVPIHLDSDEAVCRLKAVLEPLCAPYIPAIQRYLENVQAEKLFITPAARPRVT
                190       200       210       220       230       240
                250       260       270       280       290
m127.pep  RVPYDDKAYRIIVRFASPVSKRLEIQQAVMDEFLRVQYRLLNHPAGSETLX
          |||||||||||||||||||||||||||||||||||||||||||||||||||
g127      RVPYDDKAYRIIVRFASPVSKRLEIQQAVMDEFLRVQYRLLNHPAGSETLX
                250       260       270       280       290
```

The following partial DNA sequence was identified in *N. meningitidis* <SEQ ID 479>:

```
a127.seq
   1  ATGGAAATAT GGAATATGTT GGACACTTGG CTCGGTGCCG TCCCGATACG

  51  TGCGGAGGCG GTCGAATCCG TGGCGGTGGT CGCGGCTTTG CTGCTGGCGC

 101  GCGCCCTTCT GTTGAATATC CACTTCAAAC GGCATCCGGA TTTCGGCATC

 151  GAAAGCAAGC GGCGGTTTTT GGTTGCCAGC CGCAATATAA CGCTGCTTTT

 201  GGTGCTGTTT TCGCTGGCAT TTATCTGGTC GGCGCAAATC CAAACGCTGG

 251  CTTTGTCGAT GTTTGCGGTG GCGGCGGCGG TCGTCGTGGC GACGAAGGAA

 301  CTGATTATGT GTCTGTCGGG CAGCATTTTA AGGTCTGCCA CCCAGCAATA

 351  CTCGGTCGGC GACTATATCG AAATCAACGG CCTGCGCGGG CGCGTGGTCG

 401  ACATCAACCT GTTGAACACG CTGATGATGC AGGTCGGTCC GAACCCCTTG

 451  GTCGGACAGC TTGCGGGAAC CACCGTTTCT TTCCCCAACA GCCTGTTGTT

 501  GAGCCACCCC GTGCGCCGCG ACAATATTTT GGGCGACTAC GTCATCCATA

 551  CGGTCGAAAT CCCGGTTCCC ATCCATTTGG ATTCGGATGA AGCCGTATGC

 601  CGTCTGAAAG CCGTACTCGA GCCCTTGTGC GCGCCCTACA TCCCCGCCAT

 651  CCAACGGCAT TTGGAAAACG TGCAGGCGGA AAAACTGTTT ATCACGCCCG

 701  CCGCCAAACC GCGCGTTACC CGCGTGCCGT ACGATGACAA GGCATACCGC

 751  ATCATCGTCC GCTTCGCCTC CCCCGTTTCA AAGCGGCTGG AAATCCAACA

 801  GGCGGTTATG GACGAATTTT TGCGCGTACA ATACCGCCTG TTAAATTACC

 851  CCGCCGGCTC CGAAACACTT TAA
```

This corresponds to the amino acid sequence <SEQ ID 480; ORF 127.a>:

```
a127.pep.
   1  MEIWNMLDTW LGAVPIRAEA VESVAVVAAL LLARALLLNI HFKRHPDFGI

  51  ESKRRFLVAS RNITLLLVLF SLAFIWSAQI QTLALSMFAV AAAVVVATKE

 101  LIMCLSGSIL RSATQQYSVG DYIEINGLRG RVVDINLLNT LMMQVGPNPL
```

-continued

```
151  VGQLAGTTVS FPNSLLLSHP VRRDNILGDY VIHTVEIPVP IHLDSDEAVC

201  RLKAVLEPLC APYIPAIQRH LENVQAEKLF ITPAAKPRVT RVPYDDKAYR

251  IIVRFASPVS KRLEIQQAVM DEFLRVQYRL LNYPAGSETL *
```

m127/a127 98.6% identity in 290 aa overlap

```
                   10         20         30         40         50         60
m127.pep   MEIWNMLDTWLGAVPIRAEAVESVAAVAALLLARALLLNIHFKRHPDFGIESKRRFLVAS
           |||||||||||||||||||||||:||||||||||||||||||||||||||||||||||||
a127       MEIWNMLDTWLGAVPIRAEAVESVAVVAALLLARALLLNIHFKRHPDFGIESKRRFLVAS
                   10         20         30         40         50         60

                   70         80         90        100        110        120
m127.pep   RNITLLLVLFSLAFIWSAQIQTLALSMFAVAAAVVVATKELIMCLSGSILRSATQQYSVG
           ||||||||||||||||||||||||||||||||||||||||||||||||||||||||||||
    a127   RNITLLLVLFSLAFIWSAQIQTLALSMFAVAAAVVVATKELIMCLSGSILRSATQQYSVG
                   70         80         90        100        110        120

                  130        140        150        160        170        180
m127.pep   DYIEINGLRGRVVDINLLNTLMMQVGPNPLVGQLAGTTVSFPNSLLLSHPVRRDNILGDY
           ||||||||||||||||||||||||||||||||||||||||||||||||||||||||||||
a127       DYIEINGLRGRVVDINLLNTLMMQVGPNPLVGQLAGTTVSFPNSLLLSHPVRRDNILGDY
                  130        140        150        160        170        180

                  190        200        210        220        230        240
m127.pep   VIHTVEIPVPIHLDSDEAVCRLKAVLEPLCAPYIPAIQRXLENVQAEKLFITPAARPRVT
           ||||||||||||||||||||||||||||||||||||||| ||||||||||||||:||||
a127       VIHTVEIPVPIHLDSDEAVCRLKAVLEPLCAPYIPAIQRHLENVQAEKLFITPAAKPRVT
                  190        200        210        220        230        240

                  250        260        270        280        290
m127.pep   RVPYDDKAYRIIVRFASPVSKRLEIQQAVMDEFLRVQYRLLNHPAGSETLX
           ||||||||||||||||||||||||||||||||||||||||||:|||||||
a127       RVPYDDKAYRIIVRFASPVSKRLEIQQAVMDEFLRVQYRLLNYPAGSETLX
                  250        260        270        280        290
```

The following partial DNA sequence was identified in *N. gonorrhoeae* <SEQ ID 481>:

```
g128.seq
     1  atgattgaca acgCActgct ccacttgggc gaagaacccC GTTTTaatca

    51  aatccaaacc gaagACAtca AACCCGCCGT CCAAACCGCC ATCGCCGAAG

   101  CGCGCGGACA AATCGCCGCC GTCAAAGCGC AAACGCACAC CGGCTGGGCG

   151  AACACCGTCG AGCGTCTGAC CGGCATCACC GAACGCGTCG GCAGGATTTG

   201  GGGCGTCGTG TCCCATCTCA ACTCCGTCGT CGACACGCCC GAACTGCGCG

   251  CCGTCTATAA CGAACTGATG CCTGAAATCA CCGTCTTCTT CACCGAAATC

   301  GGACAAGACA TCGAACTGTA CAACCGCTTC AAAACCATCA AAAATTCCCC

   351  CGAATTTGCA ACGCTTTCCC CCGCACAAAA AACCAAGCTC GATCACGACC

   401  TGCGCGATTT CGTATTGAGC GGCGCGGAAC TGCCGCCCGA ACGGCAGGCA

   451  GAACTGGCAA AACTGCAAAC CGAAGGCGCG CAACTTTCCG CCAAATTCTC

   501  CCAAAACGTC CTAGACGCGA CCGACGCGTT CGGCATTTAC TTTGACGATG

   551  CCGCACCGCT TGCCGGCATT CCCGAAGACG CGCTCGCCAT GTTTGCCGCC

   601  GCCGCGCAAA GCGAAGGCAA AACAGGTTAC AAAATCGGCT TGCAGATTCC

   651  GCACTACCTT GCCGTTATCC AATACGCCGG CAACCGCGAA CTGCGCGAAC

   701  AAATCTACCG CGCCTACGTT ACCCGTGCCA GCGAACTTTC AAACGACGGC

   751  AAATTCGACA ACACCGCCAA CATCGACCGC ACGCTCGAAA ACGCATTGAA

   801  AACCGccaaa cTGCTCGGCT TTAAAAATTA CGCCGAATTG TCGCTGGCAA

   851  CCAAAATGGC GGACACGCCC GAACAGGTTT TAAACTTCCT GCACGACCTC
```

-continued

```
 901 GCCCGCCGCG CCAAACCCTA CGCCGAAAAA GACCTCGCCG AAGTCAAAGC

 951 CTTCGCCCGC GAACACCTCG GTCTCGCCGA CCCGCAGCCG TGGGACTTGA

1001 GCTACGCCGG CGAAAAACTG CGCGAAGCCA AATACGCATT CAGCGAAACC

1051 GAAGTCAAAA AATACTTCCC CGTCGGCAAA GTTCTGGCAG GCCTGTTCGC

1101 CCAAATCAAA AAACTCTACG GCATCGGATT CGCCGAAAAA ACCGTTCCCG

1151 TCTGGCACAA AGACGTGCGC TATTTTGAAT TGCAACAAAA CGGCAAAACC

1201 ATCGGCGGCG TTTATATGGA TTTGTACGCA CGCGAAGGCA AACGCGGCGG

1251 CGCGTGGATG AACGACtaca AAGGCCGCCG CCGCTTTGCC GACGgcacGC

1301 TGCAACTGCC CACCGCCTAC CTCGTCTGCA ACTTCGCCCC GCCCGTCGGC

1351 GGCAAAGAAG CGCGTTTAAG CCACGACGAA ATCCTCACCC TCTTCCACGA

1401 AacCGGCCAC GGACTGCACC ACCTGCTTAC CCAAGTGGAC GAACTGGGCG

1451 TGTCCGGCAT CAAcggcgtA GAATGGGACG CGGTCGAACT GCCCAGCCAG

1501 TTTATGGAAA ACTTCGTTTG GGAATACAAT GTATTGGCAC AAATGTCCGC

1551 CCACGAAGAA AccgGCGAGC CCCTGCCGAA AGAACTCTTC GACAAAATGC

1601 TcgcCGCCAA AAACTTCCAG CGCGGTATGT TCCTCGTCCG GCAAATGGAG

1651 TTCGCCCTCT TCGATATGAT GATTTACAGT GAAAGCGACG AATGCCGTCT

1701 GAAAAACTGG CAGCAGGTTT TAGACAGCGT GCGCAAAGAA GTcGCCGTCA

1751 TCCAACCGCC CGAATACAAC CGCTTCGCCA ACAGCTTCGG CCacatctTC

1801 GCcggcGGCT ATTCCGCAGG CTATTACAGC TACGCATGGG CCGAAGTCCt

1851 cAGCACCGAT GCCTACGCCG CCTTTGAAGA AAGcGACGac gtcGCCGCCA

1901 CAGGCAAACG CTTCTGGCAA GAAAtccttg ccgtcggcgg ctCCCGCAGC

1951 gcgGCGGAAT CCTTCAAAGC CTTCCGCGGA CGCGAACCGA GCATAGACGC

2001 ACTGCTGCGC CAaagcggtT TCGACAACGC gGCttgA
```

This corresponds to the amino acid sequence <SEQ ID 482; ORF 128.ng>:

```
g128.pep
  1 MIDNALLHLG EEPRFNQIQT EDIKPAVQTA IAEARGQIAA VKAQTHTGWA

 51 NTVERLTGIT ERVGRIWGVV SHLNSVVDTP ELRAVYNELM PEITVFFTEI

101 GQDIELYNRF KTIKNSPEFA TLSPAQKTKL DHDLRDFVLS GAELPPERQA

151 ELAKLQTEGA QLSAKFSQNV LDATDAFGIY FDDAAPLAGI PEDALAMFAA

201 AAQSEGKTGY KIGLQIPHYL AVIQYAGNRE LREQIYRAYV TRASELSNDG

251 KFDNTANIDR TLENALKTAK LLGFKNYAEL SLATKMADTP EQVLNFLHDL

301 ARRAKPYAEK DLAEVKAFAR EHLGLADPQP WDLSYAGEKL REAKYAFSET

351 EVKKYFPVGK VLAGLFAQIK KLYGIGFAEK TVPVWHKDVR YFELQQNGKT

401 IGGVYMDLYA REGKRGGAWM NDYKGRRRFA DGTLQLPTAY LVCNFAPPVG

451 GKEARLSHDE ILTLFHETGH GLHHLLTQVD ELGVSGINGV EWDAVELPSQ

501 FMENFVWEYN VLAQMSAHEE TGEPLPKELF DKMLAAKNFQ RGMFLVRQME

551 FALFDMMIYS ESDECRLKNW QQVLDSVRKE VAVIQPPEYN RFANSFGHIF

601 AGGYSAGYYS YAWAEVLSTD AYAAFEESDD VAATGKRFWQ EILAVGGSRS

651 AAESFKAFRG REPSIDALLR QSGFDNAA*
```

The following partial DNA sequence was identified in *N. meningitidis* <SEQ ID 483>:

```
m128.seq (partial)
     1  ATGACTGACA ACGCACTGCT CCATTTGGGC GAAGAACCCC GTTTTGATCA

    51  AATCAAAACC GAAGACATCA AACCCGCCCT GCAAACCGCC ATCGCCGAAG

   101  CGCGCGAACA AATCGCCGCC ATCAAAGCCC AAACGCACAC CGGCTGGGCA

   151  AACACTGTCG AACCCCTGAC CGGCATCACC GAACGCGTCG GCAGGATTTG

   201  GGGCGTGGTG TCGCACCTCA ACTGCGTCGC CGACACGCCC GAACTGCGCG

   251  CCGTCTATAA CGAACTGATG CCCGAAATCA CCGTCTTCTT CACCGAAATC

   301  GGACAAGACA TCGAGCTGTA CAACCGCTTC AAAACCATCA AAAATTCCCC

   351  CGAATTCGAC ACCCTCTCCC CCGCACAAAA AACCAAACTC AACCAC

     1  TACGCCAGCG AAAAACTGCG CGAAGCCAAA TACGCGTTCA GCGAAACCGA

    51  wGTCAAAAAA TAyTTCCCyG TCGGCAAwGT ATTAAACGGA CTGTTCGCCC

   101  AAmTCAAAAA ACTmTACGGC ATCGGATTTA CCGAAAAAAC yGTCCCCGTC

   151  TGGCACAAAG ACGTGCGCTA TTkTGAATTG CAACAAAACG GCGAAmCCAT

   201  AGGCGGCGTT TATATGGATT TGTACGCACG CGAAGGCAAA CGCGGCGGCG

   251  CGTGGATGAA CGACTACAAA GGCCGCCGCC GTTTTTCAGA CGGCACGCTG

   301  CAAyTGCCCA CCGCCTACCT CGTCTGCAAC TTCGCCCCAC CCGTCGGCGG

   351  CAGGGAAGCC CGCyTGAGCC ACGACGAAAT CCTCATCCTC TTCCACGAAA

   401  CCGGACACGG GCTGCACCAC CTGCTTACCC AAGTGGACGA ACTGGGCGTA

   451  TCCGGCATCA ACGGCGTAkA ATGGGACGCG GTCGAACTGC CCAGCCAGTT

   501  TATGGAAAAT TTCGTTTGGG AATACAATGT CTTGGCACAA mTGTCAGCCC

   551  ACGAAGAAAC CGGcgTTCCC yTGCCGAAAG AACTCTTsGA CAAAwTGCTC

   601  GCCGCCAAAA ACTTCCAAsG CGGCATGTTC yTsGTCCGGC AAwTGGAGTT

   651  CGCCCTCTTT GATATGATGA TTTACAGCGA AGACGACGAA GGCCGTCTGA

   701  AAAACTGGCA ACAGGTTTTA GACAGCGTGC GCAAAAAAGT CGCCGTCATC

   751  CAGCCGCCCG AATACAACCG CTTCGCCTTG AGCTTCGGCC ACATCTTCGC

   801  AGGCGGCTAT TCCGCAGCTn ATTACAGCTA CGCGTGGGCG GAAGTATTGA

   851  GCGCGGACGC ATACGCCGCC TTTGAAGAAA GCGACGATGT CGCCGCCACA

   901  GGCAAACGCT TTTGGCAGGA AATCCTCGCC GTCGGGGnAT CGCGCAGCGG

   951  nGCAGAATCC TTCAAAGCCT TCCGCGGCCG CGAACCGAGC ATAGACGCAC

  1001  TCTTGCGCCA CAGCGGTTTC GACAACGCGG TCTGA
```

This corresponds to the amino acid sequence <SEQ ID 484; ORF 128>.

```
m128.pep (partial)
     1  MTDNALLHLG EEPRFDQIKT EDIKPALQTA IAEAREQIAA IKAQTHTGWA

    51  NTVEPLTGIT ERVGRIWGVV SHLNCVADTP ELRAVYNELM PEITVFFTEI

   101  GQDIELYNRF KTIKNSPEFD TLSPAQKTKL NH

//

     1  YASEKLREAK YAFSETXVKK YFPVGXVLNG LFAQXKKLYG IGFTEKTVPV

    51  WHKDVRYXEL QQNGEXIGGV YMDLYAREGK RGGAWMNDYK GRRRFSDGTL
```

-continued

```
101  QLPTAYLVCN FAPPVGGREA RLSHDEILIL FHETGHGLHH LLTQVDELGV

151  SGINGVXWDA VELPSQFMEN FVWEYNVLAQ XSAHEETGVP LPKELXDKXL

201  AAKNFQXGMF XVRQXEFALF DMMIYSEDDE GRLKNWQQVL DSVRKKVAVI

251  QPPEYNRFAL SFGHIFAGGY SAAXYSYAWA EVLSADAYAA FEESDDVAAT

301  GKRFWQEILA VGXSRSGAES FKAFRGREPS IDALLRHSGF DNAV*
```

Computer analysis of this amino acid sequence gave the following results:

Homology with a Predicted ORF from *N. gonorrhoeae*

ORF 128 shows 91.7% identity over a 475 aa overlap with a predicted ORF (ORF 128.ng) from *N. gonorrhoeae*:

```
m128/g128
                  10        20        30        40        50        60
g128.pep  MIDNALLHLGEEPRFNQIQTEDIKPAVQTAIAEARGQIAAVKAQTHTGWANTVERLTGIT
          | |||||||||||||:||:|||||||:|||||||| ||||:||||||||||||| |||||
m128      MTDNALLHLGEEPRFDQIKTEDIKPALQTAIAEAREQIAAIKAQTHTGWANTVEPLTGIT
                  10        20        30        40        50        60

                  70        80        90       100       110       120
g128.pep  ERVGRIWGVVSHLNSVVDTPELRAVYNELMPEITVFFTEIGQDIELYNRFKTIKNSPEFA
          |||||||||||||| |:|||||||||||||||||||||||||||||||||||||||||| 
m128      ERVGRIWGVVSHLNCVADTPELRAVYNELMPEITVFFTEIGQDIELYNRFKTIKNSPEFD
                  70        80        90       100       110       120

                 130       140       150       160       170       180
g128.pep  TLSPAQKTKLDHDLRDFVLSGAELPPERQAELAKLQTEGAQLSAKFSQNVLDATDAFGIY
          ||||||||||:|
m128      TLSPAQKTKLNH
                 130
            //

                                         340       350       360
g128.pep                                YAGEKLREAKYAFSETEVKKYFPVGKVLAG
                                        ||:||||||||||||| |||||||| || |
m128                                    YASEKLREAKYAFSETXVKKYFPVGXVLNG
                                                10        20        30

             370       380       390       400       410       420
g128.pep  LFAQIKKLYGIGFAEKTVPVWHKDVRYFELQQNGKTIGGVYMDLYAREGKRGGAWMNDYK
          |||| ||||||||:||||||||||||| ||||||::||||||||||||||||||||||||
m128      LFAQXKKLYGIGFTEKTVPVWHKDVRYXELQQNGEXIGGVYMDLYAREGKRGGAWMNDYK
                  40        50        60        70        80        90

             430       440       450       460       470       480
g128.pep  GRRRFADGTLQLPTAYLVCNFAPPVGGKEARLSHDEILTLFHETGHGLHHLLTQVDELGV
          |||||:|||||||||||||||||||||:|||||||||| |||||||||||||||||||||
m128      GRRRFSDGTLQLPTAYLVCNFAPPVGGREARLSHDEILILFHETGHGLHHLLTQVDELGV
                 100       110       120       130       140       150

             490       500       510       520       530       540
g128.pep  SGINGVEWDAVELPSQFMENFVWEYNVLAQMSAHEETGEPLPKELFDKMLAAKNFQRGMF
          |||||| ||||||||||||||||||||||| ||||||| |||||| || ||||||| |||
m128      SGINGVXWDAVELPSQFMENFVWEYNVLAQXSAHEETGVPLPKELXDKXLAAKNFQXGMF
                 160       170       180       190       200       210

             550       560       570       580       590       600
g128.pep  LVRQMEFALFDMMIYSESDECRLKNWQQVLDSVRKEVAVIQPPEYNRFANSFGHIFAGGY
           ||| ||||||||||||:|| ||||||||||||||:||||||||||||| ||||||||||
m128      XVRQXEFALFDMMIYSEDDEGRLKNWQQVLDSVRKKVAVIQPPEYNRFALSFGHIFAGGY
                 220       230       240       250       260       270

             610       620       630       640       650       660
g128.pep  SAGYYSYAWAEVLSTDAYAAFEESDDVAATGKRFWQEILAVGGSRSAAESFKAFRGREPS
          ||: ||||||||||:||||||||||||||||||||||||||| |||:|||||||||||||
m128      SAAXYSYAWAEVLSADAYAAFEESDDVAATGKRFWQEILAVGXSRSGAESFKAFRGREPS
                 280       290       300       310       320       330

             670      679
g128.pep  IDALLRQSGFDNAAX
          ||||||:||||||:
m128      IDALLRHSGFDNAVX
                 340
```

The following partial DNA sequence was identified in *N. meningitidis* <SEQ ID 485>:

```
a128.seq
     1  ATGACTGACA ACGCACTGCT CCATTTGGGC GAAGAACCCC GTTTTGATCA
    51  AATCAAAACC GAAGACATCA AACCCGCCCT GCAAACCGCC ATTGCCGAAG
   101  CGCGCGAACA AATCGCCGCC ATCAAAGCCC AAACGCACAC CGGCTGGGCA
   151  AACACTGTCG AACCCCTGAC CGGCATCACC GAACGCGTCG GCAGGATTTG
   201  GGGCGTGGTG TCGCACCTCA ACTCCGTCAC CGACACGCCC GAACTGCGCG
   251  CCGCCTACAA TGAATTAATG CCCGAAATTA CCGTCTTCTT CACCGAAATC
   301  GGACAAGACA TCGAGCTGTA CAACCGCTTC AAAACCATCA AAAACTCCCC
   351  CGAGTTCGAC ACCCTCTCCC ACGCGCAAAA AACCAAACTC AACCACGATC
   401  TGCGCGATTT CGTCCTCAGC GGCGCGGAAC TGCCGCCCGA ACAGCAGGCA
   451  GAATTGGCAA AACTGCAAAC CGAAGGCGCG CAACTTTCCG CCAAATTCTC
   501  CCAAAACGTC CTAGACGCGA CCGACGCGTT CGGCATTTAC TTTGACGATG
   551  CCGCACCGCT TGCCGGCATT CCCGAAGACG CGCTCGCCAT GTTTGCCGCT
   601  GCCGCGCAAA GCGAAGGCAA AACAGGCTAC AAAATCGGTT TGCAGATTCC
   651  GCACTACCTC GCCGTCATCC AATACGCCGA CAACCGCAAA CTGCGCGAAC
   701  AAATCTACCG CGCCTACGTT ACCCGCGCCA GCGAGCTTTC AGACGACGGC
   751  AAATTCGACA ACACCGCCAA CATCGACCGC ACGCTCGAAA ACGCCCTGCA
   801  AACCGCCAAA CTGCTCGGCT TCAAAAACTA CGCCGAATTG TCGCTGGCAA
   851  CCAAAATGGC GGACACCCCC GAACAAGTTT TAAACTTCCT GCACGACCTC
   901  GCCCGCCGCG CCAAACCCTA CGCCGAAAAA GACCTCGCCG AAGTCAAAGC
   951  CTTCGCCCGC GAAAGCCTCG GCCTCGCCGA TTTGCAACCG TGGGACTTGG
  1001  GCTACGCCGG CGAAAAACTG CGCGAAGCCA AATACGCATT CAGCGAAACC
  1051  GAAGTCAAAA AATACTTCCC CGTCGGCAAA GTATTAAACG GACTGTTCGC
  1101  CCAAATCAAA AAACTCTACG GCATCGGATT TACCGAAAAA ACCGTCCCCG
  1151  TCTGGCACAA AGACGTGCGC TATTTTGAAT TGCAACAAAA CGGCGAAACC
  1201  ATAGGCGGCG TTTATATGGA TTTGTACGCA CGCGAAGGCA AACGCGGCGG
  1251  CGCGTGGATG AACGACTACA AAGGCCGCCG CCGTTTTTCA GACGGCACGC
  1301  TGCAACTGCC CACCGCCTAC CTCGTCTGCA ACTTCACCCC GCCCGTCGGC
  1351  GGCAAAGAAG CCCGCTTGAG CCATGACGAA ATCCTCACCC TCTTCCACGA
  1401  AACCGGACAC GGCCTGCACC ACCTGCTTAC CCAAGTCGAC GAACTGGGCG
  1451  TATCCGGCAT CAACGGCGTA GAATGGGACG CAGTCGAACT GCCCAGTCAG
  1501  TTTATGGAAA ATTTCGTTTG GGAATACAAT GTCTTGGCGC AAATGTCCGC
  1551  CCACGAAGAA ACCGGCGTTC CCATGACGAA AGAACTCTTC GACAAAATGC
  1601  TCGCCGCCAA AAACTTCCAA CGCGGAATGT TCCTCGTCCG CCAAATGGAG
  1651  TTCGCCCTCT TTGATATGAT GATTTACAGC GAAGACGACG AAGGCCGTCT
  1701  GAAAAACTGG CAACAGGTTT TAGACAGCGT GCGCAAAGAA GTCGCCGTCG
  1751  TCCGACCGCC CGAATACAAC CGCTTCGCCA ACAGCTTCGG CCACATCTTC
  1801  GCAGGCGGCT ATTCCGCAGG CTATTACAGC TACGCGTGGG CGGAAGTATT
  1851  GAGCGCGGAC GCATACGCCG CCTTTGAAGA AAGCGACGAT GTCGCCGCCA
  1901  CAGGCAAACG CTTTTGGCAG GAAATCCTCG CCGTCGGCGG ATCGCGCAGC
```

-continued

```
1951 GCGGCAGAAT CCTTCAAAGC CTTCCGCGGA CGCGAACCGA GCATAGACGC

2001 ACTCTTGCGC CACAGCGGCT TCGACAACGC GGCTTGA
```

This corresponds to the amino acid sequence <SEQ ID 486; ORF 128.a>:

```
a128.pep
  1  MTDNALLHLG EEPRFDQIKT EDIKPALQTA IAEAREQIAA IKAQTHTGWA

 51  NTVEPLTGIT ERVGRIWGVV SHLNSVTDTP ELRAAYNELM PEITVFFTEI

101  GQDIELYNRF KTIKNSPEFD TLSHAQKTKL NHDLRDFVLS GAELPPEQQA

151  ELAKLQTEGA QLSAKFSQNV LDATDAFGIY FDDAAPLAGI PEDALAMFAA

201  AAQSEGKTGY KIGLQIPHYL AVIQYADNRK LREQIYRAYV TRASELSDDG

251  KFDNTANIDR TLENALQTAK LLGFKNYAEL SLATKMADTP EQVLNFLHDL

301  ARRAKPYAEK DLAEVKAFAR ESLGLADLQP WDLGYAGEKL REAKYAFSET

351  EVKKYFPVGK VLNGLFAQIK KLYGIGFTEK TVPVWHKDVR YFELQQNGET

401  IGGVYMDLYA REGKRGGAWM NDYKGRRRFS DGTLQLPTAY LVCNFTPPVG

451  GKEARLSHDE ILTLFHETGH GLHHLLTQVD ELGVSGINGV EWDAVELPSQ

501  FMENFVWEYN VLAQMSAHEE TGVPLPKELF DKMLAAKNFQ RGMFLVRQME

551  FALFDMMIYS EDDEGRLKNW QQVLDSVRKE VAVVRPPEYN RFANSFGHIF

601  AGGYSAGYYS YAWAEVLSAD AYAAFEESDD VAATGKRFWQ EILAVGGSRS

651  AAESFKAFRG REPSIDALLR HSGFDNAA*
```

m128/a128 66.0% identity in 677 aa overlap

```
                   10        20        30        40        50        60
m128.pep   MTDNALLHLGEEPRFDQIKTEDIKPALQTAIAEAREQIAAIKAQTHTGWANTVEPLTGIT
           ||||||||||||||||||||||||||||||||||||||||||||||||||||||||||||
a128       MTDNALLHLGEEPRFDQIKTEDIKPALQTAIAEAREQIAAIKAQTHTGWANTVEPLTGIT
                   10        20        30        40        50        60

                   70        80        90       100       100       120
m128.pep   ERVGRIWGVVSHLNCVADTPELRAVYNELMPEITVFFTEIGQDIELYNRFKTINKSPEFD
           |||||||||||||| |:|||||||:|||||||||||||||||||||||||||||||||||
a128       ERVGRIWGVVSHLNSVTDTPELRAAYNELMPEITVFFTEIGQDIELYNRFKTIKNSPEFD
                   70        80        90       100       110       120

                  130
m128.pep   TLSPAQKTKLNH------------------------------------------------
           ||| ||||||||
a128       TLSHAQKTKLNHDLRDFVLSGAELPPEQQAELAKLQTEGAQLSAKFSQNVLDATDAFGIY
                  130       140       150       160       170       180

m128.pep   -----------------------------------------------------------

a128       FDDAAPLAGIPEDALAMFAAAQSEGKTGYKIGLQIPHYLAVIQYADNRKLREQIYRAYV
                  190       200       210       220       230       240

m128.pep   ------------------------------------------------------------

a128       TRASELSDDGKFDNTANIDRTLENALQTAKLLGFKNYAELSLATKMADTPEQVLNFLHDL
                  250       260       270       280       290       300

                                                  140       150
m128.pep   ----------------------------------YASEKLREAKYAFSETXVKKYFPVGX
                                             ||:||||||||||||| |||||||| 
a128       ARRAKPYAEKDLAEVKAFARESLGLADLQPWDLGYAGEKLREAKYAFSETEVKKYFPVGK
                  310       320       330       340       350       360

          160       170       180       190       200       210
m128.pep   VLNGLFAQXKKLYGIGFTEKTVPVWHKDVRYXELQQNGEXIGGVYMDLYAREGKRGGAWM
           |||||||| |||||||||||||||||||||| |||||||:||||||||||||||||||||
a128       VLNGLFAQIKKLYGIGFTEKTVPVWHKDVRYFELQQNGETIGGVYMDLYAREGYRGGAWM
                  370       380       390       400       410       420
```

-continued

```
           220       230       240       250       260       270
m128.pep   NDYKGRRRFSDGTLQLPTAYLVCNFAPPVGGREARLSHDEILILFHETGHGLHHLLTQVD
           |||||||||||||||||||||||||:|||||:||||||||||:|||||||||||||||||
a128       NDYKGRRRFSDGTLQLPTAYLVCNFTPPVGGKEARLSHDEILTLFHETGHGLHHLLTQVD
                   430       440       450       460       470       480

           280       230       240       250       260       270
m128.pep   ELGVSGINGVXWDAVELPSQFMENFVWEYNVLAQXSAHEETGVPLPKELXDKXLAAKNFQ
           |||||||||| ||||||||||||||||||||||| |||||||||||||| || |||||||
a128       ELGVSGINGVEWDAVELPSQFMENFVWEYNVLAQMSAHEETGVPLPKELFDKMLAAKNFQ
                   490       500       510       520       530       540

           340       350       360       370       380       390
m128.pep   XGMFXVRQXEFALFDMMIYSEDDEGRLKNWQQVLDSVRKKVAVIQPPEYNRFALSFGHIF
            ||| ||| ||||||||||||||||||||||||||||||:|||::|||||||| ||||||
a128       RGMFLVRQMEFALFDMMIYSEDDEGRLKNWQQVLDSVRKEVAVVRPPEYNRFANSFGHIF
                   550       560       570       580       590       600

           400       410       420       430       440       450
m128.pep   AGGYSAAXYSYAWAEVLSADAYAAFEESDDVAATGKRFWQEILAVGXSRSGAESFKAFRG
           ||||||:||||||||||||||||||||||||||||||||||||||| |||:|||||||||
a128       AGGYSAGYYSYAWAEVLSADAYAAFEESDDVAATGKRFWQEILAVGGSRSAAESFKAFRG
                   610       620       630       640       650       660

           460       470
m128.pep   REPSIDALLRHSGFDNAVX
           |||||||||||||||||:|
a128       REPSIDALLRHSGFDNAAX
                   670
```

The following partial DNA sequence was identified in *N. gonorrhoeae* <SEQ ID 487>:

```
g128-1.seq (partial)
   1  ATGATTGACA ACGCACTGCT CCACTTGGGC GAAGAACCCC GTTTTAATCA

  51  AATCAAAACC GAAGACATCA AACCCGCCGT CCAAACCGCC ATCGCCGAAG

 101  CGCGCGGACA AATCGCCGCC GTCAAAGCGC AAACGCACAC CGGCTGGGCG

 151  AACACCGTCG AGCGTCTGAC CGGCATCACC GAACGCGTCG GCAGGATTTG

 201  GGGCGTCGTG TCCCATCTCA ACTCCGTCGT CGACACGCCC GAACTGCGCG

 251  CCGTCTATAA CGAACTGATG CCTGAAATCA CCGTCTTCTT CACCGAAATC

 301  GGACAAGACA TCGAACTGTA CAACCGCTTC AAAACCATCA AAAATTCCCC

 351  CGAATTTGCA ACGCTTTCCC CCGCACAAAA AACCAAGCTC GATCACGACC

 401  TGCGCGATTT CGTATTGAGC GGCGCGGAAC TGCCGCCCGA ACGGCAGGCA

 451  GAACTGGCAA AACTGCAAAC CGAAGGCGCG CAACTTTCCG CCAAATTCTC

 501  CCAAAACGTC CTAGACGCGA CCGACGCGTT CGGCATTTAC TTTGACGATG

 551  CCGCACCGCT TGCCGGCATT CCCGAAGACG CGCTCGCCAT GTTTGCCGCC

 601  GCCGCGCAAA GCGAAGGCAA AACAGGTTAC AAAATCGGCT TGCAGATTCC

 651  GCACTACCTT GCCGTTATCC AATACGCCGG CAACCGCGAA CTGCGCGAAC

 701  AAATCTACCG CGCCTACGTT ACCCGTGCCA GCGAACTTTC AAACGACGGC

 751  AAATTCGACA ACACCGCCAA CATCGACCGC ACGCTCGAAA ACGCATTGAA

 801  AACCGCCAAA CTGCTCGGCT TTAAAAATTA CGCCGAATTG TCGCTGGCAA

 851  CCAAAATGGC GGACACGCCC GAACAGGTTT TAAACTTCCT GCACGACCTC

 901  GCCCGCCGCG CCAAACCCTA CGCCGAAAAA GACCTCGCCG AAGTCAAAGC

 951  CTTCGCCCGC GAACACCTCG GTCTCGCCGA CCCGCAGCCG TGGGACTTGA

1001  GCTACGCCGG CGAAAAACTG CGCGAAGCCA AATACGCATT CAGCGAAACC

1051  GAAGTCAAAA AATACTTCCC CGTCGGCAAA GTTCTGGCAG GCCTGTTCGC

1101  CCAAATCAAA AACTCTACGG GCATCGGATT CGCCGAAAAA ACCGTTCCCG

1151  TCTGGCACAA AGACGTGCGC TATTTTGAAT TGCAACAAAA CGGCAAAACC
```

-continued

```
1201  ATCGGCGGCG TTTATATGGA TTTGTACGCA CGCGAAGGCA AACGCGGCGG

1251  CGCGTGGATG AACGACTACA AAGGCCGCCG CCGCTTTGCC GACGGCACGC

1301  TGCAACTGCC CACCGCCTAC CTCGTCTGCA ACTTCGCCCC GCCCGTCGGC

1351  GGCAAAGAAG CGCGTTTAAG CCACGACGAA ATCCTCACCC TCTTCCACGA

1401  AACCGGCCAC GGACTGCACC ACCTGCTTAC CCAAGTGGAC GAACTGGGCG

1451  TGTCCGGCAT CAACGGCGTA AAA
```

This corresponds to the amino acid sequence <SEQ ID 488; ORF 128-1.ng>:

```
g128-1.pep.(partial)
    1  MIDNALLHLG EEPRFNQIKT EDIKPAVQTA IAEARGQIAA VKAQTHTGWA

   51  NTVERLTGIT ERVGRIWGVV SHLNSVVDTP ELRAVYNELM PEITVFFTEI

  101  GQDIELYNRF KTIKNSPEFA TLSPAQKTKL DHDLRDFVLS GAELPPERQA

  151  ELAKLQTEGA QLSAKFSQNV LDATDAFGIY FDDAAPLAGI PEDALAMFAA

  201  AAQSEGKTGY KIGLQIPHYL AVIQYAGNRE LREQIYRAYV TRASELSNDG

  251  KFDNTANIDR TLENALKTAK LLGFKNYAEL SLATKMADTP EQVLNFLHDL

  301  ARRAKPYAEK DLAEVKAFAR EHLGLADPQP WDLSYAGEKL REAKYAFSET

  351  EVKKYFPVGK VLAGLFAQIK KLYGIGFAEK TVPVWHKDVR YFELQQNGKT

  401  IGGVYMDLYA REGKRGGAWM NDYKGRRRFA DGTLQLPTAY LVCNFAPPVG

  451  GKEARLSHDE ILTLFHETGH GLHHLLTQVD ELGVSGINGV K
```

The following partial DNA sequence was identified in *N. meningitidis* <SEQ ID 489>:

```
m128-1.seq
   1 ATGACTGACA ACGCACTGCT CCATTTGGGC GAAGAACCCC GTTTTGATCA

  51 AATCAAAACC GAAGACATCA AACCCGCCCT GCAAACCGCC ATCGCCGAAG

 101 CGCGCGAACA AATCGCCGCC ATCAAAGCCC AAACGCACAC CGGCTGGGCA

 151 AACACTGTCG AACCCCTGAC CGGCATCACC GAACGCGTCG GCAGGATTTG

 201 GGGCGTGGTG TCGCACCTCA ACTCCGTCGC CGACACGCCC GAACTGCGCG

 251 CCGTCTATAA CGAACTGATG CCCGAAATCA CCGTCTTCTT CACCGAAATC

 301 GGACAAGACA TCGAGCTGTA CAACCGCTTC AAAACCATCA AAAATTCCCC

 351 CGAATTCGAC ACCCTCTCCC CCGCACAAAA AACCAAACTC AACCACGATC

 401 TGCGCGATTT CGTCCTCAGC GGCGCGGAAC TGCCGCCCGA ACAGCAGGCA

 451 GAACTGGCAA AACTGCAAAC CGAAGGCGCG CAACTTTCCG CCAAATTCTC

 501 CCAAAACGTC CTAGACGCGA CCGACGCGTT CGGCATTTAC TTTGACGATG

 551 CCGCACCGCT TGCCGGCATT CCCGAAGACG CGCTCGCCAT GTTTGCCGCC

 601 GCCGCGCAAA GCGAAAGCAA AACAGGCTAC AAAATCGGCT TGCAGATTCC

 651 ACACTACCTC GCCGTCATCC AATACGCCGA CAACCGCGAA CTGCGCGAAC

 701 AAATCTACCG CGCCTACGTT ACCCGCGCCA GCGAACTTTC AGACGACGGC

 751 AAATTCGACA ACACCGCCAA CATCGACCGC ACGCTCGCAA ACGCCCTGCA

 801 AACCGCCAAA CTGCTCGGCT TCAAAAACTA CGCCGAATTG TCGCTGGCAA

 851 CCAAAATGGC GGACACGCCC GAACAAGTTT TAAACTTCCT GCACGACCTC
```

-continued

901 GCCCGCCGCG CCAAACCCTA CGCCGAAAAA GACCTCGCCG AAGTCAAAGC

951 CTTCGCCCGC GAAAGCCTGA ACCTCGCCGA TTTGCAACCG TGGGACTTGG

1001 GCTACGCCAG CGAAAAACTG CGCGAAGCCA AATACGCGTT CAGCGAAACC

1051 GAAGTCAAAA AATACTTCCC CGTCGGCAAA GTATTAAACG GACTGTTCGC

1101 CCAAATCAAA AAACTCTACG GCATCGGATT TACCGAAAAA ACCGTCCCCG

1151 TCTGGCACAA AGACGTGCGC TATTTTGAAT TGCAACAAAA CGGCGAAACC

1201 ATAGGCGGCG TTTATATGGA TTTGTACGCA CGCGAAGGCA AACGCGGCGG

1251 CGCGTGGATG AACGACTACA AAGGCCGCCG CCGTTTTTCA GACGGCACGC

1301 TGCAACTGCC CACCGCCTAC CTCGTCTGCA ACTTCGCCCC ACCCGTCGGC

1351 GGCAGGGAAG CCCGCCTGAG CCACGACGAA ATCCTCATCC TCTTCCACGA

1401 AACCGGACAC GGGCTGCACC ACCTGCTTAC CCAAGTGGAC GAACTGGGCG

1451 TATCCGGCAT CAACGGCGTA GAATGGGACG CGGTCGAACT GCCCAGCCAG

1501 TTTATGGAAA ATTTCGTTTG GGAATACAAT GTCTTGGCAC AAATGTCAGC

1551 CCACGAAGAA ACCGGCGTTC CCCTGCCGAA AGAACTCTTC GACAAAATGC

1601 TCGCCGCCAA AAACTTCCAA CGCGGCATGT TCCTCGTCCG GCAAATGGAG

1651 TTCGCCCTCT TTGATATGAT GATTTACAGC GAAGACGACG AAGGCCGTCT

1701 GAAAAACTGG CAACAGGTTT TAGACAGCGT GCGCAAAAAA GTCGCCGTCA

1751 TCCAGCCGCC CGAATACAAC CGCTTCGCCT TGAGCTTCGG CCACATCTTC

1801 GCAGGCGGCT ATTCCGCAGG CTATTACAGC TACGCGTGGG CGGAAGTATT

1851 GAGCGCGGAC GCATACGCCG CCTTTGAAGA AAGCGACGAT GTCGCCGCCA

1901 CAGGCAAACG CTTTTGGCAG GAAATCCTCG CCGTCGGCGG ATCGCGCAGC

1951 GCGGCAGAAT CCTTCAAAGC CTTCCGCGGC CGCGAACCGA GCATAGACGC

2001 ACTCTTGCGC CACAGCGGTT TCGACAACGC GGTCTGA

This corresponds to the amino acid sequence <SEQ ID 490; ORF 128-1>:

m128-1.pep.

1 MTDNALLHLG EEPRFDQIKT EDIKPALQTA IAEAREQIAA IKAQTHTGWA

51 NTVEPLTGIT ERVGRIWGVV SHLNSVADTP ELRAVYNELM PEITVFFTEI

101 GQDIELYNRF KTIKNSPEFD TLSPAQKTKL NHDLRDFVLS GAELPPEQQA

151 ELAKLQTEGA QLSAKFSQNV LDATDAFGIY FDDAAPLAGI PEDALAMFAA

201 AAQSESKTGY KIGLQIPHYL AVIQYADNRE LREQIYRAYV TRASELSDDG

251 KFDNTANIDR TLANALQTAK LLGFKNYAEL SLATKMADTP EQVLNFLHDL

301 ARRAKPYAEK DLAEVKAFAR ESLNLADLQP WDLGYASEKL REAKYAFSET

351 EVKKYFPVGH VLNGLFAQIK KLYGIGFTEK TVPVWHKDVR YFELQQNGET

401 IGGVYMDLYA REGKRGGAWM NDYKGRRRFS DGTLQLPTAY LVCNFAPPVG

451 GREARLSHDE ILILFHETGH GLHHLLTQVD ELGVSGINGV EWDAVELPSQ

501 FMENFVWEYN VLAQMSAHEE TGVPLPKELF DKMLAAKNFQ RGMFLVRQME

551 FALFDMMIYS EDDEGRLKNW QQVLDSVRKK VAVIQPPEYN RFALSFGHIF

601 AGGYSAGYYS YAWAEVLSAD AYAAFEESDD VAATGKRFWQ EILAVGGSRS

651 AAESFKAFRG REPSIDALLR HSGFDNAV*

-continued

```
m128-1/g128-1 94.5% identity in 491 aa overlap

                  10        20        30        40        50        60
g128-1.pep  MIDNALLHLGEEPRFNQIKTEDIKPAVQTAIAEARGQIAAVKAQTHTGWANTVERLTGIT
            | |||||||||||||:||||||||||:|||||||| ||||:||||||||||||| |||||
m128-1      MTDNALLHLGEEPRFDQIKTEDIKPALQTAIAEAREQIAAIKAQTHTGWANTVEPLTGIT
                  10        20        30        40        50        60
                  70        80        90       100       110       120
g128-1.pep  ERVGRIWGVVSHLNSVVDTPELRAVYNELMPEITVFFTEIGQDIELYNRFKTIKNSPEFA
            ||||||||||||||||:|||||||||||||||||||||||||||||||||||||||||||
m128-1      ERVGRIWGVVSHLNSVADTPELRAVYNELMPEITVFFTEIGQDIELYNRFKTIKNSPEFD
                  70        80        90       100       110       120
                 130       140       150       160       170       180
g128-1.pep  TLSPAQKTKLDHDLRDFVLSGAELPPERQAELAKLQTEGAQLSAKFSQNVLDATDAFGIY
            ||||||||||:||||||||||||||||:||||||||||||||||||||||||||||||||
m128-1      TLSPAQKTKLNHDLRDFVLSGAELPPEQQAELAKLQTEGAQLSAKFSQNVLDATDAFGIY
                 130       140       150       160       170       180
                 190       200       210       220       230       240
g128-1.pep  FDDAAPLAGIPEDALAMFAAAAQSEGKTGYKIGLQIPHYLAVIQYAGNRELREQIYRAYV
            ||||||||||:||||||||||||||||:||||||||||||||||||||||||||||||||
m128-1      FDDAAPLAGIPEDALAMFAAAAQSESKTGYKIGLQIPHYLAVIQYADNRELREQIYRAYV
                 190       200       210       220       230       240
                 250       260       270       280       290       300
g128-1.pep  TRASELSNDGKFDNTANIDRTLENALKTAKLLGFKNYAELSLATKMADTPEQVLNFLHDL
            |||||||:|||||||||||||| |||:|||||||||||||||||||||||||||||||||
m128-1      TRASELSDDGKFDNTANIDRTLANALQTAKLLGFKNYAELSLATKMADTPEQVLNFLHDL
                 250       260       270       280       290       300
                 310       320       330       340       350       360
g128-1.pep  ARRAKPYAEKDLAEVKAFAREHLGLADPQPWDLSYAGEKLREAKYAFSETEVKKYFPVGK
            ||||||||||||||||||||| |:||| |||||:||:|||||||||||||||||||||||
m128-1      ARRAKPYAEKDLAEVKAFARESLNLADLQPWDLGYASEKLREAKYAFSETEVKKYFPVGK
                 310       320       330       340       350       360
                 370       380       390       400       410       420
g128-1.pep  VLAGLFAQIKKLYGIGFAEKTVPVWHKDVRYFELQQNGKTIGGVYMDLYAREGKRGGAWM
            || ||||||||||||||:||||||||||||||||||||:|||||||||||||||||||||
m128-1      VLNGLFAQIKKLYGIGFTEKTVPVWHKDVRYFELQQNGETIGGVYMDLYAREGKRGGAWM
                 370       380       390       400       410       420
                 430       440       450       460       470       480
g128-1.pep  NDYKGRRRFADGTLQLPTAYLVCNFAPPVGGKEARLSHDEILTLFHETGHGLHHLLTQVD
            |||||||||:|||||||||||||||||||||:||||||||||||||||||||||||||||
m128-1      NDYKGRRRFSDGTLQLPTAYLVCNFAPPVGGREARLSHDEILILFHETGHGLHHLLTQVD
                 430       440       450       460       470       480
                 490
g128-1.pep  ELGVSGINGVK
            ||||||||||:
m128-1      ELGVSGINGVEWDAVELPSQFMENFVWEYNVLAQMSAHEETGVPLPKELFDKMLAAKNFQ
                 490       500       510       520       530       540
```

The following partial DNA sequence was identified in *N. meningitidis* <SEQ ID 491>:

```
a128-1.seq
   1 ATGACTGACA ACGCACTGCT CCATTTGGGC GAAGAACCCC GTTTTGATCA

  51 AATCAAAACC GAAGACATCA AACCCGCCCT GCAAACCGCC ATTGCCGAAG

 101 CGCGCGAACA AATCGCCGCC ATCAAAGCCC AAACGCACAC CGGCTGGGCA

 151 AACACTGTCG AACCCCTGAC CGGCATCACC GAACGCGTCG GCAGGATTTG

 201 GGGCGTGGTG TCGCACCTCA ACTCCGTCAC CGACACGCCC GAACTGCGCG

 251 CCGCCTACAA TGAATTAATG CCCGAAATTA CCGTCTTCTT CACCGAAATC

 301 GGACAAGACA TCGAGCTGTA CAACCGCTTC AAAACCATCA AAAACTCCCC

 351 CGAGTTCGAC ACCCTCTCCC ACGCGCAAAA AACCAAACTC AACCACGATC
```

-continued

```
401 TGCGCGATTT CGTCCTCAGC GGCGCGGAAC TGCCGCCCGA ACAGCAGGCA
451 GAATTGGCAA AACTGCAAAC CGAAGGCGCG CAACTTTCCG CCAAATTCTC
501 CCAAAACGTC CTAGACGCGA CCGACGCGTT CGGCATTTAC TTTGACGATG
551 CCGCACCGCT TGCCGGCATT CCCGAAGACG CGCTCGCCAT GTTTGCCGCT
601 GCCGCGCAAA GCGAAGGCAA AACAGGCTAC AAAATCGGTT TGCAGATTCC
651 GCACTACCTC GCCGTCATCC AATACGCCGA CAACCGCAAA CTGCGCGAAC
701 AAATCTACCG CGCCTACGTT ACCCGCGCCA GCGAGCTTTC AGACGACGGC
751 AAATTCGACA ACACCGCCAA CATCGACCGC ACGCTCGAAA ACGCCCTGCA
801 AACCGCCAAA CTGCTCGGCT TCAAAAACTA CGCCGAATTG TCGCTGGCAA
851 CCAAAATGGC GGACACCCCC GAACAAGTTT TAAACTTCCT GCACGACCTC
901 GCCCGCCGCG CCAAACCCTA CGCCGAAAAA GACCTCGCCG AAGTCAAAGC
951 CTTCGCCCGC GAAAGCCTCG GCCTCGCCGA TTTGCAACCG TGGGACTTGG
1001 GCTACGCCGG CGAAAAACTG CGCGAAGCCA AATACGCATT CAGCGAAACC
1051 GAAGTCAAAA AATACTTCCC CGTCGGCAAA GTATTAAACG GACTGTTCGC
1101 CCAAATCAAA AAACTCTACG GCATCGGATT TACCGAAAAA ACCGTCCCCG
1151 TCTGGCACAA AGACGTGCGC TATTTTGAAT TGCAACAAAA CGGCGAAACC
1201 ATAGGCGGCG TTTATATGGA TTTGTACGCA CGCGAAGGCA AACGCGGCGG
1251 CGCGTGGATG AACGACTACA AAGGCCGCCG CCGTTTTTCA GACGGCACGC
1301 TGCAACTGCC CACCGCCTAC CTCGTCTGCA ACTTCACCCC GCCCGTCGGC
1351 GGCAAAGAAG CCCGCTTGAG CCATGACGAA ATCCTCACCC TCTTCCACGA
1401 AACCGGACAC GGCCTGCACC ACCTGCTTAC CCAAGTCGAC GAACTGGGCG
1451 TATCCGGCAT CAACGGCGTA GAATGGGACG CAGTCGAACT GCCCAGTCAG
1501 TTTATGGAAA ATTTCGTTTG GGAATACAAT GTCTTGGCGC AAATGTCCGC
1551 CCACGAAGAA ACCGGCGTTC CCCTGCCGAA AGAACTCTTC GACAAAATGC
1601 TCGCCGCCAA AAACTTCCAA CGCGGAATGT TCCTCGTCCG CCAAATGGAG
1651 TTCGCCCTCT TTGATATGAT GATTTACAGC GAAGACGACG AAGGCCGTCT
1701 GAAAAACTGG CAACAGGTTT TAGACAGCGT GCGCAAAGAA GTCGCCGTCG
1751 TCCGACCGCC CGAATACAAC CGCTTCGCCA ACAGCTTCGG CCACATCTTC
1801 GCAGGCGGCT ATTCCGCAGG CTATTACAGC TACGCGTGGG CGGAAGTATT
1851 GAGCGCGGAC GCATACGCCG CCTTTGAAGA AAGCGACGAT GTCGCCGCCA
1901 CAGGCAAACG CTTTTGGCAG GAAATCCTCG CCGTCGGCGG ATCGCGCAGC
1951 GCGGCAGAAT CCTTCAAAGC CTTCCGCGGA CGCGAACCGA GCATAGACGC
2001 ACTCTTGCGC CACAGCGGCT TCGACAACGC GGCTTGA
```

This corresponds to the amino acid sequence <SEQ ID 492; ORF 128-1.a>:

```
a128-1.pep.

  1 MTDNALLHLG EEPRFDQIKT EDIKPALQTA IAEAREQIAA IKAQTHTGWA
 51 NTVEPLTGIT ERVGRIWGVV SHLNSVADTP ELRAVYNELM PEITVFFTEI
101 GQDIELYNRF KTIKNSPEFD TLSPAQKTKL NHDLRDFVLS GAELPPEQQA
151 ELAKLQTEGA QLSAKFSQNV LDATDAFGIY FDDAAPLAGI PEDALAMFAA
```

-continued

```
201 AAQSESKTGY KIGLQIPHYL AVIQYADNRE LREQIYRAYV TRASELSDDG

251 KFDNTANIDR TLANALQTAK LLGFKNYAEL SLATKMADTP EQVLNFLHDL

301 ARRAKPYAEK DLAEVKAFAR ESLNLADLQP WDLGYASEKL REAKYAFSET

351 EVKKYFPVGH VLNGLFAQIK KLYGIGFTEK TVPVWHKDVR YFELQQNGET

401 IGGVYMDLYA REGKRGGAWM NDYKGRRRFS DGTLQLPTAY LVCNFAPPVG

451 GREARLSHDE ILILFHETGH GLHHLLTQVD ELGVSGINGV EWDAVELPSQ

501 FMENFVWEYN VLAQMSAHEE TGVPLPKELF DKMLAAKNFQ RGMFLVRQME

551 FALFDMMIYS EDDEGRLKNW QQVLDSVRKK VAVIQPPEYN RFALSFGHIF

601 AGGYSAGYYS YAWAEVLSAD AYAAFEESDD VAATGKRFWQ EILAVGGSRS

651 AAESFKAFRG REPSIDALLR HSGFDNAV*
```

m128-1/a128-1 97.8% identity in 677 aa overlap

```
                    10        20        30        40        50        60
a128-1.pep. MTDNALLHLGEEPRFDQIKTEDIKPALQTAIAEAREQIAAIKAQTHTGWANTVEPLTGIT
            ||||||||||||||||||||||||||||||||||||||||||||||||||||||||||||
m128-1      MTDNALLHLGEEPRFDQIKTEDIKPALQTAIAEAREQIAAIKAQTHTGWANTVEPLTGIT
                    10        20        30        40        50        60

                    70        80        90       100       110       120
a128-1.pep. ERVGRIWGVVSHLNSVTDTPELRAAYNELMPEITVFFTEIGQDIELYNRFKTIKNSPEFD
            ||||||||||||||||:|||||||:|||||||||||||||||||||||||||||||||||
m128-1      ERVGRIWGVVSHLNSVADTPELRAVYNELMPEITVFFTEIGQDIELYNRFKTIKNSPEFD
                    70        80        90       100       110       120

                   130       140       150       160       170       180
a128-1.pep. TLSHAQKTKLNHDLRDFVLSGAELPPEQQAELAKLQTEGAQLSAKFSQNVLDATDAFGIY
            ||| ||||||||||||||||||||||||||||||||||||||||||||||||||||||||
m128-1      TLSPAQKTKLNHDLRDFVLSGAELPPEQQAELAKLQTEGAQLSAKFSQNVLDATDAFGIY
                   130       140       150       160       170       180

                   190       200       210       220       230       240
a128-1.pep. FDDAAPLAGIPEDALAMFAAAAQSEGKTGYKIGLQIPHYLAVIQYADNRKLREQIYRAYV
            |||||||||||||||||||||||||:|||||||||||||||||||||||:||||||||||
m128-1      FDDAAPLAGIPEDALAMFAAAAQSESKTGYKIGLQIPHYLAVIQYADNRELREQIYRAYV
                   190       200       210       220       230       240

                   250       260       270       280       290       300
a128-1.pep. TRASELSDDGKFDNTANIDRTLENALQTAKLLGFKNYAELSLATKMADTPEQVLNFLHDL
            |||||||||||||||||||||| |||||||||||||||||||||||||||||||||||||
m128-1      TRASELSDDGKFDNTANIDRTLANALQTAKLLGFKNYAELSLATKMADTPEQVLNFLHDL
                   250       260       270       280       290       300

                   310       320       330       340       350       360
a128-1.pep. ARRAKPYAEKDLAEVKAFARESLGLADLQPWDLGYAGEKLREAKYAFSETEVKKYFPVGK
            |||||||||||||||||||||||:||||||||||||:|||||||||||||||||||||||
m128-1      ARRAKPYAEKDLAEVKAFARESLNLADLQPWDLGYASEKLREAKYAFSETEVKKYFPVGK
                   310       320       330       340       350       360

                   370       380       390       400       410       420
a128-1.pep. VLNGLFAQIKKLYGIGFTEKTVPVWHKDVRYFELQQNGETIGGVYMDLYAREGKRGGAWM
            ||||||||||||||||||||||||||||||||||||||||||||||||||||||||||||
m128-1      VLNGLFAQIKKLYGIGFTEKTVPVWHKDVRYFELQQNGETIGGVYMDLYAREGKRGGAWM
                   370       380       390       400       410       420

                   430       440       450       460       470       480
a128-1.pep. NDYKGRRRFSDGTLQLPTAYLVCNFTPPVGGKEARLSHDEILTLFHETGHGLHHLLTQVD
            |||||||||||||||||||||||||:|||||:|||||||||| |||||||||||||||||
m128-1      NDYKGRRRFSDGTLQLPTAYLVCNFAPPVGGREARLSHDEILTLFHETGHGLHHLLTQVD
                   430       440       450       460       470       480

                 490       500       510       520       530       540
a128-1.pep ELGVSGINGVEWDAVELPSQFMENFVWEYNVLAQMSAHEETGVPLPKELFDKMLAAKNFQ
           ||||||||||||||||||||||||||||||||||||||||||||||||||||||||||||
m128-1     ELGVSGINGVEWDAVELPSQFMENFVWEYNVLAQMSAHEETGVPLPKELFDKMLAAKNFQ
                 490       500       510       520       530       540
```

-continued

```
               550       560       570       580       590       600

a128-1.pep RGMFLVRQMEFALFDMMIYSEDDEGRLKNWQQVLDSVRKEVAVVRPPEYNRFANSFGHIF
           |||||||||||||||||||||||||||||||||||||:|||::|||||||| ||||||
m128-1     RGMFLVRQMEFALFDMMIYSEDDEGRLKNWQQVLDSVRKKVAVIQPPEYNRFALSFGHIF

               550       560       570       580       590       600
               610       620       630       640       650       660

a128-1.pep AGGYSAGYYSYAWAEVLSADAYAAFEESDDVAATGKRFWQEILAVGGSRSAAESFKAFRG
           ||||||||||||||||||||||||||||||||||||||||||||||||||||||||||||
m128-1     AGGYSAGYYSYAWAEVLSADAYAAFEESDDVAATGKRFWQEILAVGGSRSAAESFKAFRG

               610       620       630       640       650       660
               670       679

a128-1.pep REPSIDALLRHSGFDNAAX
           ||||||||||||||||:
m128-1     REPSIDALLRHSGFDNAVX

               670
```

a128-1 (SEQ ID 492)/P44573 (SEQ ID 4163)

sp|P44573|OPDA_HAELIN OLIGOPEPTIDASE A >gi|1075082|pir||C64055 oligopeptidase A (prlC) homolog - Haemophilus influenzae (strain Rd KW20)
>gi|1573174 (U32706) oligopeptidase A (prlC) [Haemophilus influenzae Rd] Length = 681
Score = 591 bits (1507), Expect = e-168
Identities = 309/677 (45%), Positives = 415/677 (60%), Gaps = 4/677 (0%)

```
Query:   4 NALLHLGEEPRFDQIKTEDIKPALQTXXXXXXXXXXXXXXXTHTGWANTVEPLTGITERV  63
           N LL+    P F QIK E I+PA++                H  W N + PLT   +R+
Sbjct:   5 NPLLNIQGLPPFSQIKPEHIRPAVEKLIQDCRNTIEQVLKQPHFTWENFILPLTETNDRL  64

Query:  64 GRIWGVVSHLNSVTDTPELRAAYNELMPEITVFFTEIGQDIELYNRFKTIKNSPEFDTLS 123
            R W  VSHLNSV ++ ELR AY   +P ++ + T +GQ   LYN +  +KNS EF   S
Sbjct:  65 NRAWSPVSHLNSVKNSTELREAYQTCLPLLSEYSTWVGQHKGLYNAYLALKNSAEFADYS 124

Query: 124 HAQKTKLNHDLRDFVLSGAELPPEQQAELAKLQTEGAQLSAKFSQNVLDATDAFGIYFDD 183
            AQK  + + LRDF LSG  L  E+Q    ++    ++L+++FS NVLDAT  +    ++
Sbjct: 125 IAQKKAIENSLRDFELSGIGLSEEKQQRYGEIVARLSELNSQFSNNVLDATMGWEKLIEN 184

Query: 184 AAPLAGIPEDALAMFAAAAQSEGKTGYKIGLQIPHYLAVIQYADNRKLREQIYRAYVTRA 243
            A LAG+PE AL     +A+S+G  GY+  L+IP YL V+ y +NR LRE++YRAY TRA
Sbjct: 185 EAELAGLPESALQAAQQSAESKGLKGYRFTLEIPSYLPVMTYCENRALREEMYRAYATRA 244

Query: 244 SELSDD-GKFDNTANIDRTLENALQTAKLLGFKNYAELSLATKMADTPEQVLNFLHDLAR 302
           SE   + GK+DN+  ++  L   ++ AKLLGF  Y ELSLATKMA+ P+QVL+FL  LA
Sbjct: 245 SEQGPNAGKWDNSKVMEEILTLRVELAKLLGFNTYTELSLATKMAENPQQVLDFLDHLAE 304

Query: 303 RAKPYAEKDLAEVKAFARESLGLADLQPWDLGYAGEKLREAKYAFSETEVKKYFPVGKVL 362
           RAKP  EK+L E+K +  +  G+ +L PWD+G+  EK ++  YA ++ E++ YFP  +V+
Sbjct: 305 RAKPQGEKELQELKGYCEKEFGVTELAPWDIGFYSEKQKQHLYAINDEELRPYFPENRVI 364

Query: 363 NGLFAQIKKLYGIGFTE-KTVPVWHKDVRYFEL-QQNGETIGGVYMDLYAREGKRGGAWM 420
           +GLF  IK+++ i   E K V  WHKDVR+F+L  +N +  G  Y+DLYARE KRGGAWM
Sbjct: 365 SGLFELIKRIFNIRAVERKGVDTWHKDVRFFDLIDENDQLRGSFYLDLYAREHKRGGAWM 480

Query: 421 NDYKGRRRFSDGTLQLPTAYLVCNFTPPVGGKEARLSHDEIXXXXXXXXXXXXXXXXQVD 480
           +D  GR+R  DG+++ P AYL CNF  P+G K A  +H+E+                Q+D
Sbjct: 425 DDCIGRKRKLDGSIETPVAYLTCNFNAPIGNKPALFTHNEVTTLFHEFGHGIHHMLTQID 484

Query: 481 ELGVSGINGVEWDAVELPSQFMENFVWEYNVLAQMSAHEETGVPLPKELFDKMLAAKNFQ 540
             V+GINGV WDAVELPSQFMEN+ WE   LA +S H ETG PLPKE   ++L AKNFQ
Sbjct: 485 VSDVAGINGVPWDAVELPSQFMENWCWEEEALAFISGHYETGEPLPKEKLTQLLKAKNFQ 544

Query: 541 RGMFLVRQMEFALFDMMIYSEDDEGRLKNWQQVLDSVRKEVAVVRPPEYNRFANSFGHIF 600
             MF++RQ+EF +FD  ++   D  +       L SV+ +VAV++  ++ R  +SF HIF
Sbjct: 545 AAMFILRQLEFGIFDFRLHHTEDAEKTNQILDTLKSVKSQVAVIKGVDWARAPHSFSHIF 604

Query: 601 XXXXXXXXXXXXWAEVLSADAYAAFEESDDV-AATGKRFWQEILAVGGSRSAAESFKAFR 659
                       WAEVLSADAY+ FEE       TGK F  EIL  GGS    E FK FR
Sbjct: 605 AGGYAAGYYSYLWAEVLSADAYSRFEEEGIFNPITGKSFLDEILTRGGSEEPMELFKRFR 664

Query: 660 GREPSIDALLRHSGFDN 676
           GREP +DALLRH G  N
Sbjct: 665 GREPQLDALLRHKGIMN 681
```

55

The following partial DNA sequence was identified in *N. gonorrhoeae* <SEQ ID 493>:

```
g129.seq
   1 ATGCTTTCAC CTCCTCGGCG TAAAACGGCG GCACATCAAT CAAGCCGTCT

  51 TTCATTTGCG TGCGGAAAAA ATGCGGCGTG TTGCCGTGAT CAAAATCAAT

 101 ATCGTGCAGC ATCCAGCCCA AATCGCGGTT TGCCTCGCTT TCCGATAACG

 151 CCGACGGCGG CAGCGGTTCA CCCTTATCCG CGCTTTCGCC ATTTGCCCTT
```

-continued

```
201 TCAGGCTGCG GGCATAGGGG CGGAACAGGC GGCGGTCGAA TCCTGTTTCA

251 TCCGGACAAA CGCGTTGGCA GTCGGAAAAT CCGGCCGGCC GTGTCAAATA

301 ATGCGTTACT TTGGCCGGGT CTTGTCCTTT GTAAGCGGCG GTCTTTTTTT

351 GCGCGCCATC CGCATCTGTT TGGGCGCATG GCAAACGGCG GCTGCCGTAC

401 AATCAAAATG TTTGGCGATT TCATGCAGAC AGGCATCCGG ATGCCGCCCG

451 ACATATCGAG CCGGTTTTTG CCTATCCGAT TTGGCGGCAT TTAGGCCGGT

501 AACTTGA
```

This corresponds to the amino acid sequence <SEQ ID 494; ORF 129.ng>:

```
g129.pep
  1 MLSPPRRKTA AHQSSRLSFA CGKNAACCRD QNQYRAASSP NRGLPRFPIT

 51 PTAAAVHPYP RFRHLPFQAA GIGAEQAAVE SCFIRTNALA VGKSGRPCQI

101 MRYFGRVLSF VSGGLFLRAI RICLGAWQTA AAVQSKCLAI SCRQASGCRP

151 TYRAGFCLSD LAAFRPVT*
```

The following partial DNA sequence was identified in *N. meningitidis* <SEQ ID 495>:

```
m129.seq (partial)
  1 ..TATCTGCGCT TTCACTATTT GCCCTTTCAG GCTGCGGGCA TAGGGACGGA

 51   ACAGGTAGCG GTCAAATCCT GTTTCATCCA AATAAACACG TTGGTAGTCG

101   GAAAATTCGG CCGGCTGTGT CAAATAATGC GTTACTTTGG CCGGGTCTTG

151   TTCTTTGTAA GTGGTGGTCT TTTTTTGCGC GTTATCCCCA TCTGTTTGAG

201   TGCATAGCAA ATGGTGGCTG CCGTACAATC AAAATGTTTG GCGATTTCAT

251   GCAGATAGGC ATCCGGGTGT TGCCCAACAT ATTGAGCCGG TTTTTGCCTA

301   TCCGATTTGA CGGCATTTAG ACCGGTAACT TGA
```

This corresponds to the amino acid sequence <SEQ ID 496; ORF 129>:

```
m129.pep (partial)
  1 ..YLRFHYLPFQ AAGIGTEQVA VKSCFIQINT LVVGKFGRLC QIMRYFGRVL

 51   FFVSGGLFLR VIPICLSAXQ MVAAVQSKCL AISCRXASGC CPTYXAGFCL

101   SDLTAFRPVT *
```

Computer analysis of this amino acid sequence gave the following results:

Homology with a Predicted ORF from *N. gonorrhoeae*

ORF 129 shows 79.1% identity over a 110 aa overlap with a predicted ORF (ORF 129.ng) from *N. gonorrhoeae*:

```
m129/g129

                                                    10        20        30
m129.pep                                  YLRFHYLPFQAAGIGTEQVAVKSCFIQINT
                                          | ||::|||||||||:||:||:||||: |:
g129        RDQNQYRAASSPNRGLPRFPITPTAAAVHPYPRFRHLPFQAAGIGAEQAAVESCFIRTNA
            30        40        50        60        70        80
```

-continued

```
                40        50        60        70        80        90
m129.pep  LVVGKFGRLCQIMRYFGRVLFFVSGGLFLRVIPICLSAXQMVAAVQSKCLAISCRXASGC
          |:||| || ||||||||||| |||||||||:| |||:| | :|||||||||||| ||||
g129      LAVGKSGRPCQIMRYFGRVLSFVSGGLFLRAIRICLGAWQTAAAVQSKCLAISCRQASGC
          90       100       110       120       130       140

               100       110
m129.pep  CPTYXAGFCLSDLTAFRPVTX
           ||| ||||||||:|||||||
g129      RPTYRAGFCLSDLAAFRPVTX
         150       160
```

The following partial DNA sequence was identified in *N. meningitidis* <SEQ ID 497>:

```
a129.seq (partial)
  1 TATCTGCGCT TTCACTATTT GCCCTTTCAG GCTGCGGGCA TAGGGACGGA

 51 ACAGGTAGCG GTCAAATCCT GTTTCATCCA AATAAACACG TTGGTAGTCG

101 GAAAATTCGG CCAGCTGTGT CAAATAATGC GTTACTTTGG CCGGGTCTTG

151 TTCTTTGTAA GTGGTGGTCT TTTTTTGCGC GTTATCCCCA TCTGTTTGAG

201 TGCATAGCAA ATGGTGGCTG CCGTACAATC AAAATGTTTG GCGATTTCAT

251 GCAGATAGGC ATCCTGGTGT TGCCCAACAT ATTGAGCCGG TTTTTGCCTA

301 TCCGATTTGA CGGCATTTAG ACCGGTAACT TGA
```

This corresponds to the amino acid sequence <SEQ ID 498; ORF 129.a>:

```
a129.pep (partial)
  1 YLRFHYLPFQ AAGIGTEQVA VKSCFIQINT LVVGKFGQLC QIMRYFGRVL

 51 FFVSGGLFLR VIPICLSA*Q MVAAVQSKCL AISCR*ASWC CPTY*AGFCL

101 SDLTAFRPVT *
```

m129/a129 98.2% identity in 110 aa overlap

```
                   10        20        30        40        50        60
m129-1.pep  YLRFHYLPFQAAGIGTEQVAVKSCFIQINTLVVGKFGRLCQIMRYFGRVLFFVSGGLFLR
            |||||||||||||||||||||||||||||||||||||:||||||||||||||||||||||
a129        YLRFHYLPFQAAGIGTEQVAVKSCFIQINTLVVGKFGQLCQIMRYFGRVLFFVSGGLFLR
                   10        20        30        40        50        60

                   70        80        90       100       110
m129-1.pep  VIPICLSAXQMVAAVQSKCLAISCRXASGCCPTYXAGFCLSDLTAFRPVTX
            |||||||||||||||||||||||||||| ||||||||||||||||||||||
a129        VIPICLSAXQMVAAVQSKCLAISCRXASWCCPTYXACFCLSDLTAFRPVTX
                   70        80        90       100       110
```

The following partial DNA sequence was identified in *N. gonorrhoeae* <SEQ ID 499>:

```
g130.seq
  1 ATGAAACAAC TCCGCGACAA CAAAGCCCAA GGCTCTGCAC TGTTTACCCT

 51 TGTGAGCGGT ATCGTTATTG TTATTGCAGT CCTTTATTTC CTGATTAAGC

101 TGGCGGGCAG TGGATCGTTC GGCGATGTCG ATGCCACTAC GGAAGCGGCA

151 ACGCAGACCC GCATCCAGCC TGTCGGACAA TTGACGATGG GTGACGGCAT

201 CCCCGTCGGC GAACGCCAAG GCGAACAGAT TTTCGGCAAA ATCTGTATCC

251 AATGCCACGC GGCGGACAGC AATGTGCCGA ACGCTCCGAA ACTGGAACAC
```

-continued

```
301 AACGGCGACT GGGCGCCGCG TATCGCGCAA GGCTTCGATA CCTTGTTCCA

351 ACACGCGCTG AACGGCTTTA ACGCCATGCC TGCCAAAGGC GGTGCGGCAG

401 ACCTGACCGA TCAGGAACTC AAACGGGCGA TTACCTACAT GGCGAATAAA

451 AGCGGCGGTT CTTTCCCGAA TCCTGATGAG GCTGCGCCTG CCGACAATGC

501 CGCTTCAGGA ACAGCTTCTG CTCCTGCCGA TAGTGCAGCT CCGGCAGAAG

551 CGAAGGCAGA AGACAAGGGT GCGGCAGCCC CTGCGGTCGG CGTTGACGGT

601 AAAAAAGTCT TCGAAGCAAC CTGTCAGGTG TGCCACGGCG GTTCGATTCC

651 CGGTATTCCC GGCATAGGCA AAAAAGACGA TTGGGCACCG CGTATCAAAA

701 AAGGCAAAGA AACCTTGCAC AAACATGCCC TTGAAGGCTT TAACGCGATG

751 CCGGCCAAAG GCGGCAATGC AGGTTTGAGC GATGACGAAG TCAAAGCGGC

801 TGTTGACTAT ATGGCAAACC AATCCGGTGC AAAATTCTAA
```

This corresponds to the amino acid sequence <SEQ ID 500; ORF 130.ng>:

```
g130.pep
   1 MKQLRDNKAQ GSALFTLVSG IVIVIAVLYF LIKLAGSGSF GDVDATTEAA

  51 TQTRIQPVGQ LTMGDGIPVG ERQGEQIFGK ICIQCHAADS NVPNAPKLEH

 101 NGDWAPRIAQ GFDTLFQHAL NGFNAMPAKG GAADLTDQEL KRAITYMANK

 151 SGGSFPNPDE AAPADNAASG TASAPADSAA PAEAKAEDKG AAAPAVGVDG

 201 KKVFEATCQV CHGGSIPGIP GIGKKDDWAP RIKKGKETLH KHALEGFNAM

 251 PAKGGNAGLS DDEVKAAVDY MANQSGAKF*
```

The following partial DNA sequence was identified in *N. meningitidis* <SEQ ID 501>:

```
m130.seq (partial)
   1 ..GGCGAACAGA TTTTCGGCAA AATCTGTATC CAATGCCACG CGGCGGACAG

  51   CAATGTGCCG AACGCTCCGA AACTGGAACA CAACGGCGAT TrGGCACCGC

 101   GTATCGGcAA GGCTTCGATA CCTTGTTCCA ACACGCGCTG AACGGCTTTA

 151   ACGCCATGCC TGCAAAAGGC GGTGCGGCAG ACCTGACCGA TCAGGAACTT

 201   AAACGGGCGA TTACTTACAT GGCGAACAAA AGCGGCGGTT CTTTCCCGAA

 251   TCCTGATGAG GCTGCGCCTG CCGACAATGC CGCTTCAGGA ACAGCTTCTG

 301   CTCCTGCCGA TAGTGCAGCT CCGGCAGAAG CGAAGGCAGA AGACAAGGGT

 351   GCGGCAcCCC TGCGGTCGGC GTTGACGGTA AAAAAGTCTT CGAAGCAACC

 401   TGTCAGGTGT GCCACGGCGG TTCGATTCCC GGTATTCCCG GCATAGGCAA

 451   AAAAGACGAT TGGGCACCGC GTATCAAAAA AGGCAAAGAA ACCTTGCACA

 501   AACACGCCCT TGAAGGCTTT AACGCGATGC CTGCCAAArG CGgCAATGCA

 551   GGTTTGAGCG ATGACGAAgT CAAAGCGGCT GTTGACTATA TGGCAAACCA

 601   ATCCGGTGCA AAATTCTAA
```

This corresponds to the amino acid sequence <SEQ ID 502; ORF 130>:

```
m130.pep (partial)
  1   ..GEQIFGKICI QCHAADSNVP NAPKLEHNGD XAPRIQGFDT LFQHALNGFN
```

-continued

```
 51    AMPAKGGAAD LTDQELKRAI TYMANKSGGS FPNPDEAAPA DNAASGTASA

101    PADSAAPAEA KAEDKGAAPA VGVDGKKVFE ATCQVCHGGS IPGIPGIGKK

151    DDWAPRIKKG KETLHKHALE GFNAMPAKXG NAGLSDDEVK AAVDYMANQS

201    GAKF*
```

Computer analysis of this amino acid sequence gave the following results:

Homology with a Predicted ORF from *N. gonorrhoeae*

ORF 130 shows 98.1% identity over a 206 aa overlap with a predicted ORF (ORF 130.ng) from *N. gonorrhoeae*:

```
m130/g130

                                                10        20        30
m130.pep                              GEQIFGKICIQCHAADSNVPNAPKLEHNGD
                                      ||||||||||||||||||||||||||||||
g130        DATTEAATQTRIQPVGQLTMGDGIPVGERQGEQIFGKICIQCHAADSNVPNAPKLEHNGD
                    50        60        70        80        90       100

                    40        50        60        70        80        89
m130.pep    XAPRI-QGFDTLFQHALNGFNAMPAKGGAADLTDQELKRAITYMANKSGGSFPNPDEAAP
             |||| |||||||||||||||||||||||||||||||||||||||||||||||||||||||
g130        WAPRIAQGFDTLFQHALNGFNAMPAKGGAADLTDQELKRAITYMANKSGGSFPNPDEAAP
                   110       120       130       140       150       160

           90       100       110       120       130       140
m130.pep    ADNAASGTASAPADSAAPAEAKAEDKGAA-PAVGVDGKKVFEATCQVCHGGSIPGIPGIG
            ||||||||||||||||||||||||||||| ||||||||||||||||||||||||||||||
g130        ADNAASGTASAPADSAAPAEAKAEDKGAAAPAVGVDGKKVFEATCQVCHGGSIPGIPGIG
                   170       180       190       200       210       220

          150       160       170       180       190       200
m130.pep    KKDDWAPRIKKGKETLHKHALEGFNAMPAKXGNAGLSDDEVKAAVDYMANQSGAKFX
            ||||||||||||||||||||||||||||||| |||||||||||||||||||||||||
g130        KKDDWAPRIKKGKETLHKHALEGFNAMPAKGGNAGLSDDEVKAAVDYMANQSGAKFX
                   230       240       250       260       270       280
```

The following partial DNA sequence was identified in *N. meningitidis* <SEQ ID 503>:

```
a130.seq
  1 ATGAAACAAC TCCGCGACAA CAAAGCCCAA GGCTCTGCAC TGTTTACCCT

 51 TGTGAGCGGT ATCGTTATTG TTATTGCAGT CCTTTATTTC CTGATTAAGC

101 TGGCGGGCAG CGGCTCGTTC GGCGATGTCG ATGCCACTAC GGAAGCAGCA

151 ACGCAGACCC GTATCCAGCC TGTCGGACAA TTGACGATGG GCGACGGCAT

201 CCCCGTCGGC GAACGCCAAG GCGAACAGAT TTTCGGCAAA ATCTGTATCC

251 AATGCCACGC GGCGGACAGC AATGTGCCGA ACGCTCCGAA ACTGGAACAC

301 AACGGCGATT GGGCGCCGCG TATCGCGCAA GGCTTCGATA CCTTGTTCCA

351 ACACGCGCTG AACGGCTTTA ACGCCATGCC TGCCAAAGGC GGTGCGGTAG

401 ACCTGACCGA TCAGGAACTC AAACGGGCGA TTACTTACAT GGCGAACAAA

451 AGCGGCGGTT CTTTCCCGAA TCCTGATGAG GCTGCGCCTG CCGACAATGC

501 CGCTTCAGGA ACAGCTTCTG CTCCTGCCGA TAGTGCAGCT CCGGCAGAAG

551 CGAAGGCAGA AGACAAGGGT GCGGCAGCCC CTGCGGTCGG CGTTGACGGT

601 AAAAAAGTCT TCGAAGCAAC CTGTCAGGTG TGCCACGGCG GTTCGATTCC

651 CGGTATTCCC GGCATAGGCA AAAAAGACGA TTGGGCACCG CGTATCAAAA

701 AAGGCAAAGA AACCTTGCAC AAACACGCCC TTGAAGGCTT TAACGCGATG
```

-continued

```
751 CCTGCCAAAG GCGGCAATGC AGGTTTGAGC GATGACGAAG TCAAAGCGGC

801 TGTTGACTAT ATGGCAAACC AATCCGGTGC AAAATTCTAA
```

This corresponds to the amino acid sequence <SEQ ID 504; ORF 130.a>:

```
a130.pep
  1 MKQLRDNKAQ GSALFTLVSG IVIVIAVLYF LIKLAGSGSF GDVDATTEAA

 51 TQTRIQPVGQ LTMGDGIPVG ERQGEQIFGK ICIQCHAADS NVPNAPKLEH

101 NGDWAPRIAQ GFDTLFQHAL NGFNAMPAKG GAVDLTDQEL KRAITYMANK

151 SGGSFPNPDE AAPADNAASG TASAPADSAA PAEAKAEDKG AAAPAVGVDG

201 KKVFEATCQV CHGGSIPGIP GIGKKDDWAP RIKKGKETLH KHALEGFNAM

251 PAKGGNAGLS DDEVKAAVDY MANQSGAKF*
```

m130/a130 97.6% identity in 206 aa overlap

```
                                                 10        20        30
m130.pep                                 GEQIFGKICIQCHAADSNVPNAPKLEHNGD
                                         ||||||||||||||||||||||||||||||
a130       DATTEAATQTRIQPVGQLTMGDGIPVGERQGEQIFGKICIQCHAADSNVPNAPKLEHNGD
              50        60        70        80        90       100

                    40        50        60        70        80       89
m130.pep   XAPRI-QGFDTLFQHALNGFNAMPAKGGAADLTDQELKRAITYMANKSGGSFPNPDEAAP
            |||| |||||||||||||||||||||||:||||||||||||||||||||||||||||||
a130       WAPRIAQGFDTLFQHALNGFNAMPAKGGAVDLTDQELKRAITYMANKSGGSFPNPDEAAP
             110       120       130       140       150       160

          90       100       110        120       130       140
m130.pep   ADNAASGTASAPADSAAPAEAKAEDKGAA-PAVGVDGKKVFEATCQVCHGGSIPGIPGIG
           ||||||||||||||||||||||||||||| ||||||||||||||||||||||||||||||
a130       ADNAASGTASAPADSAAPAEAKAEDKGAAAPAVGVDGKKVFEATCQVCHGGSIPGIPGIG
             170       180       190       200       210       220

         150       160       170       180       190       200
m130.pep   KKDDWAPRIKKGKETLHKHALEGFNAMPAKXGNAGLSDDEVKAAVDYMANQSGAKFX
           |||||||||||||||||||||||||||||| ||||||||||||||||||||||||||
a130       KKDDWAPRIKKGKETLHKHALEGFNAMPAKGGNAGLSDDEVKAAVDYMANQSGAKFX
             230       240       250       260       270       280
```

The following partial DNA sequence was identified in *N. gonorrhoeae* <SEQ ID 505>:

```
g132.seq
  1 ATGGAAGCCT TCAAAACCCT AATTTGGATT ATTAATATTA TTTCCGCTTT

 51 GGCCGTCATC GTGTTAGTAT TGCTCCAACA CGGCAAAGGC GCGGATGCCG

101 GCGCGACCTT CGGATCGGGA AGCGGCAGCG CGCAAGGCGT ATTCGGCTCT

151 GCCGGCAACG CCAACTTcct CAgccGCTCG AccGccGTTG CAGCAACAtt

201 tttcttTGca acctgcAtgg gctatggTgt atattcacac CCACACGACA

251 AAACACGGTT TGGACTtcag caacataCGA CAGACTCAGC AagcACCCAA

301 ACCcgtAAGC AATACCGAAC CTTCTGCCCC TGTTCCTCAG CAGCAGAAAT

351 AACagtTTTT CAAATgccga caTGgtga
```

This corresponds to the amino acid sequence <SEQ ID 506; ORF 132.ng>:

```
g132.pep
  1 MEAFKTLIWI INIISALAVI VLVLLQHGKG ADAGATFGSG SGSAQGVFGS
```

```
 51 AGNANFLSRS TAVAATFFFA TCMGYGVYSH PHDKTRFGLQ QHTTDSASTQ

101 TRKQYRTFCP CSSAAEITVF QMPTW*
```

The following partial DNA sequence was identified in *N. meningitidis* <SEQ ID 507>:

```
m132.seq (partial)
    1 ATGGAACCCT TCAAACCTT AATTTGGATT GTTAATTTAA TTTCCGCTTT

   51 GGCCGTCTTC GTGTTAGTAT TGCTCCAACA CGGCAAAGGC GCGGATGCCG

  101 GCGCGACTTT CGGA...
```

This corresponds to the amino acid sequence <SEQ ID 508; ORF 132>:

```
m132.pep (partial)
1 MEPFKTLIWI VNLISALAVF VLVLLQHGKG ADAGATFG...
```

Computer analysis of this amino acid sequence gave the following results:
Homology with a Predicted ORF from *N. gonorrhoeae*
ORF 132 shows 89.5% identity over a 38 aa overlap with a predicted ORF (ORF 132.ng) from *N. gonorrhoeae*:

```
    m132/g132
                        10        20        30
        m132.pep    MEPFKTLIWIVNLISALAVFVLVLLQHGKGADAGATFG
                    || ||||||||:|:||||||:||||||||||||||||||
        g132        MEAFKTLIWIINIISALAVIVLVLLQHGKGADAGATFGSGSGSAQGVFGSAGNANFLSRS
                        10        20        30        40        50        60
```

The following partial DNA sequence was identified in *N. meningitidis* <SEQ ID 509>:

```
a132.seq
    1 ATGGAAGCCT TCAAAACCCT AATTTGGATT GTTAATATAA TTTCCGCTTT

   51 GGCCGTCATC GTGTTAGTAT TGCTCCAACA CGGCAAAGGC GCGGATGCCG

  101 GCGCGACTTT CGGATCGGGA AGCGGCAGCG CGCAAGGCGT ATTCGGCTCT

  151 GCCGGCAACG CTAACTTCCT CAGCCGCTCG ACCGCCGTTG CAGCAACATT

  201 TTTCTTTGCA ACCTGCATGg GCTATGGTGT ATATTCACAC CCACACGACA

  251 AAACACGGTT TGGACTTCAG CAACGTACAA CAAACTCAGC AAGCACCCAA

  301 ACCCGTAAGC AATACCGAAC CTTCTGCCCC TGTTCCTCAG CAGCAGAAAT

  351 AACAGTTTTT CAAATGCCGA CATGGTGA
```

This corresponds to the amino acid sequence <SEQ ID 510; ORF 132.a>:

```
a132.pep
    1 MEAFKTLIWI VNIISALAVI VLVLLQHGKG ADAGATFGSG SGSAQGVFGS

   51 AGNANFLSRS TAVAATFFFA TCMGYGVYSH PHDKTRFGLQ QRTTNSASTQ

  101 TRKQYRTFCP CSSAAEITVF QMPTW*
```

m132/a132 92.1% identity in 38 aa overlap

```
                    10        20        30
m132.pep     MEPFKTLIWIVNLISALAVFVLVLLQHGKGADAGATFG
             || |||||||||:||||||:|||||||||||||||||
a132         MEAFKTLIWIINIISALAVIVLVLLQHGKGADAGATFGSGSGSAQGVFGSAGNANFLSRS
                    10        20        30        40        50        60
```

The following partial DNA sequence was identified in *N. gonorrhoeae* <SEQ ID 511>:

```
g134.seq
   1 ATGTCCCAAG AAATCCTCGA CCAAGTGCGC CGCCGCCGCA CGTTTGCCAT

  51 CATCTCCCAC CCCGATGCGG GTAAAACCAC GCTGACCGAA AAACTGCTGC

 101 TGTTTTCGGG CGCGATTCAA AGCGCAGGCA CGGTGAAAGG TAAGAAAACC

 151 GGCAAATTCG CCACCTCCGA CTGGATGGAC ATCGAGAAGC AGCGCGGCAT

 201 TTCCGTGGCA TCAAGCGTGA TGCAGTTCGA CTACAAAGAC CACACCGTCA

 251 ACCTCTTGGA CACGCCGGGA CACCAAGACT TCTCCGAAGA CACCTACCGC

 301 GTTTTAACCG CAGTGGACAG CGCCTTGATG GTCATCGACG CGGCAAAAGG

 351 CGTGGAAGCG CAAACCATCA AACTCTTGAA CGTCTGCCGC CTGCGCGATA

 401 CGCCGATTGT TACCTTCATG AACAAATACG ACCGCGAAGT GCGCGATTCT

 451 TTGGAACTCT TGGACGAAGT GGAAGACATC CTGCAAATCC GCTGCGCGCC

 501 CGTTACCTGG CCGATCGGTA TGGGCAAAAA CTTCAAGGGC GTGTACCACA

 551 TCCTGAACGA CGAAATCTAT CTCTTTGAAG CGGGCGGCGA ACGCCTGCCG

 601 CACGAGTTCG ACATCATCAA AGGCATAAAC AATCCCGAAT TGGAACAACG

 651 CTTTCCGTTG GAAATCCAGC AGTTGCGCGA CGAAATCGAA TTGGTGCAGG

 701 CGGCTTCCAA CGAATTTAAT CTCGacgaAT TTCTCGccgG CGAACTCACG

 751 CCAGTGTTCT TCGGCTCTGC GATTAACAAC TTCGGCATTC AGGAAATCCT

 801 CAATTCATTG ATTGACTGGG CACCCGCACC GAAACCGCGC GACGCGACCA

 851 TGCGCATGGT CGGGCCGGAC GAGCCGAAAT TTTCCGGATT TATCTTTAAA

 901 ATCCAAGCCA ATATGGACCC GAAACACCGC GACCGTATCG CCTTCTTGCG

 951 CGTCTGCTCC GGTAAATTCG AGCGCGGCAT GAAGATGAAA CACCTGCGTA

1001 TCAACCGCGA AATCGCCGCC TCCAGCGTAG TAACCTTCAT GTCGCACGAC

1051 CGCGAACTGG CGGAAGAAGC CTACGCCGGC GACATCATCG GCATCCCGAA

1101 CCACGGCAAC ATCCAAATCG GCGACAGCTT CTCCGAAGGC GAACAACTGG

1151 CGTTTACCGG CATCCCATTC TTCGCGCCCG AACTGTTCCG CAGCGTCCGC

1201 ATCAAAAACC CGCTGAAAAT CAAACAACTG CAAAAAGGTT TGCAACAACT

1251 CGGCGAAGAA GGTGCGGTTC AAGTATTCAA ACCGATGAGC GGCGCGGATT

1301 TGATTTTGGG TGCGGTCGGC GTGTTGCAGT TTGAAGTCGT AACCTCACGC

1351 CTCGCCAACG AATACGGCGT GGAAGCCGTG TTCGACAGCG CATCCATCTG

1401 GTCGGCGCGC TGGGTATCGT GCGACGACAA GAAAAAACTG GCGGAATTTG

1451 AAAAAGCCAA CGCAGGCAAC CTCGCCATCG ACGCAGGCGG CAACCTCGCC

1501 TACCTCGCCC CCAACCGCGT GAATTTGGGG TTGACGCAAG AACGCTGGCC

1551 GGACATCGTG TTCCACGAAA CGCGCGAACA TTCGGTCAAA CTCTAA
```

This corresponds to the amino acid sequence <SEQ ID 512; ORF 134.ng>:

```
g134.pep.
   1 MSQEILDQVR RRRTFAIISH PDAGKTTLTE KLLLFSGAIQ SAGTVKGKKT

  51 GKFATSDWMD IEKQRGISVA SSVMQFDYKD HTVNLLDTPG HQDFSEDTYR

 101 VLTAVDSALM VIDAAKGVEA QTIKLLNVCR LRDTPIVTFM NKYDREVRDS

 151 LELLDEVEDI LQIRCAPVTW PIGMGKNFKG VYHILNDEIY LFEAGGERLP

 201 HEFDIIKGIN NPELEQRFPL EIQQLRDEIE LVQAASNEFN LDEFLAGELT

 251 PVFFGSAINN FGIQEILNSL IDWAPAPKPR DATMRMVGPD EPKFSGFIFK

 301 IQANMDPKHR DRIAFLRVCS GKFERGMKMK HLRINREIAA SSVVTFMSHD

 351 RELAEEAYAG DIIGIPNHGN IQIGDSFSEG EQLAFTGIPF FAPELFRSVR

 401 IKNPLKIKQL QKGLQQLGEE GAVQVFKPMS GADLILGAVG VLQFEVVISR

 451 LANEYGVEAV FDSASIWSAR WVSCDDKKKL AEFEKANAGN LAIDAGGNLA

 501 YLAPNRVNLG LTQERWPDIV FHETREHSVK L*
```

The following partial DNA sequence was identified in *N. meningitidis* <SEQ ID 513>:

```
m134.seq
   1 ATGTCCCAAG AAATCCTCGA CCAAGTGCGC CGCCGCCGCA CGTTTGCCAT

  51 CATCTCCCAC CCTGACGCAG GTAAAACCAC GTTGACTGAA AAACTCTTGC

 101 TGTTTTCGGG CGCGATTCAG AGCGCGGGTA CGGTAAAAGG CAAGAAAACC

 151 GGCAAATTCG CCACTTCCGA CTGGATGGAA ATCGAGAAGC AGCGCGGCAT

 201 TTCCGTGGCA TCAAGTGTGA TGCAGTTCGA TTACAAAGAC CACACCGTCA

 251 ACCTCTTGGA CACGCCGGGA CACCAAGACT TCTCCGAAGA CACCTACCGC

 301 GTTTTAACCG CCGTGGACAG CGCATTAATG GTCATCGACG CGGCAAAAGG

 351 CGTGGAAGCG CAAACCATCA AGCTCTTAAA CGTCTGCCGC CTGCGCGATA

 401 CACCGATTGT TACGTTTATG AACAAATACG ACCGCGAAGT GCGCGATTCC

 451 CTGGAACTTT TGGACGAAGT GGAAAACATT TTAAAAATCC GCTGCGCGCC

 501 CGTTACCTGG CCGATCGGTA TGGGCAAAAA CTTCAAGGGC GTGTACCACA

 551 TCCTGAACGA TGAAATTTAT CTCTTTGAAG CTGGCGGCGA ACGCCTGCCG

 601 CACGAGTTCG ACATCATCAA AGGCATCGAT AATCCTGAAT TGGAACAACG

 651 CTTTCCGTTG GAAATCCAGC AGTTGCGCGA CGAAATCGAA TTGGTGCAGG

 701 CGGCTTCCAA CGAGTTTAAT CTCGACGAAT TCCTCGCCGG CGAACTCACG

 751 CCCGTATTCT TCGGCTCTGC GATTAACAAC TTCGGTATTC AGGAAATCCT

 801 CAATTCATTG ATTGACTGGG CGCCCGCGCC GAAACCGCGC GACGCGACCG

 851 TACGTATGGT CGAGCCGGAC GAGCCGAAGT TTTCCGGATT TATCTTCAAA

 901 ATCCAAGCCA ATATGGACCC GAAACACCGC GACCGTATTG CCTTCTTGCG

 951 CGTCTGCTCC GGCAAATTCG AGCGCGGCAT GAAGATGAAA CACCTGCGTA

1001 TCAACCGCGA AATCGCCGCC TCCAGCGTGG TTACCTTCAT GTCGCACGAC

1051 CGCGAGCTGG TTGAAGAAGC CTACGCCGGC GACATTATCG GCATCCCGAA

1101 CCACGGCAAC ATCCAAATCG GCGACAGCTT CTCCGAAGGC GAACAACTGG

1151 CGTTCACCGG CATCCCATTC TTCGCACCCG AACTGTTCCG CAGCGTACGC
```

-continued

```
1201 ATCAAAAACC CGCTGAAAAT CAAACAACTG CAAAAAGGCT TGCAACAGCT

1251 CGGCGAAGAA GGCGCGGTGC AGGTGTTCAA ACCGATGAGC GGCGCGGATT

1301 TGATTTTGGG CGCGGTCGGC GTGTTGCAGT TTGAAGTCGT TACCTCGCGC

1351 CTCGCCAACG AATACGGCGT AGAAGCCGTG TTCGACAGCG CATCCATCTG

1401 GTCGGCGCGC TGGGTATCGT GCGACGACAA GAAAAAACTG GCTGAATTTG

1451 AAAAAGCCAA CGCGGGCAAC CTCGCCATCG ACGCAGGCGG CAACCTCGCC

1501 TACCTCGCGC CCAACCGCGT GAATTTGGGA CTCACGCAAG AACGTTGGCC

1551 GGACATCGTG TTCCACGAAA CACGCGAACA TTCGGTCAAA CTGTAA
```

This corresponds to the amino acid sequence <SEQ ID 514; ORF 134>:

```
m134.pep
   1 MSQEILDQVR RRRTFAIISH PDAGKTTLTE KLLLFSGAIQ SAGTVKGKKT

  51 GKFATSDWME IEKQRGISVA SSVMQFDYKD HTVNLLDTPG HQDFSEDTYR

 101 VLTAVDSALM VIDAAKGVEA QTIKLLNVCR LRDTPIVTFM NKYDREVRDS

 151 LELLDEVENI LKIRCAPVTW PIGMGKNFKG VYHILNDEIY LFEAGGERLP

 201 HEFDIIKGID NPELEQRFPL EIQQLRDEIE LVQAASNEFN LDEFLAGELT

 251 PVFFGSAINN FGIQEILNSL IDWAPAPKPR DATVRMVEPD EPKFSGFIFK

 301 IQANMDPKHR DRIAFLRVCS GKFERGMKMK HLRINREIAA SSVVTFMSHD

 351 RELVEEAYAG DIIGIPNHGN IQIGDSFSEG EQLAFTGIPF FAPELFRSVR

 401 IKNPLKIKQL QKGLQQLGEE GAVQVFKPMS GADLILGAVG VLQFEVVTSR

 451 LANEYGVEAV FDSASIWSAR WVSCDDKKKL AEFEKANAGN LAIDAGGNLA

 501 YLAPNRVNLG LTQERWPDIV FHETREHSVK L*
```

Computer analysis of this amino acid sequence gave the following results:

Homology with a Predicted ORF from *N. gonorrhoeae*

ORF 134 shows 98.7% identity over a 531 aa overlap with a predicted ORF (ORF 134.ng) from *N. gonorrhoeae*:

```
m134/g134

                    10        20        30        40        50        60
m134.pep    MSQEILDQVRRRRTFAIISHPDAGKTTLTEKLLLFSGAIQSAGTVKGKKTGKFATSDWME
            |||||||||||||||||||||||||||||||||||||||||||||||||||||||||||:
g134        MSQEILDQVRRRRTFAIISHPDAGKTTLTEKLLLFSGAIQSAGTVKGKKTGKFATSDWMD
                    10        20        30        40        50        60

                    70        80        90       100       110       120
m134.pep    IEKQRGISVASSVMQFDYKDHTVNLLDTPGHQDFSEDTYRVLTAVDSALMVIDAAKGVEA
            ||||||||||||||||||||||||||||||||||||||||||||||||||||||||||||
g134        IEKQRGISVASSVMQFDYKDHTVNLLDTPGHQDFSEDTYRVLTAVDSALMVIDAAKGVEA
                    70        80        90       100       110       120

                   130       140       150       160       170       180
m134.pep    QTIKLLNVCRLRDTPIVTFMNKYDREVRDSLELLDEVENILKIRCAPVTWPIGMGKNFKG
            ||||||||||||||||||||||||||||||||||||:||:||||||||||||||||||||
g134        QTIKLLNVCRLRDTPIVTFMNKYDREVRDSLELLDEVEDILQIRCAPVTWPIGMGKNFKG
                   130       140       150       160       170       180

                   190       200       210       220       230       240
m134.pep    VYHILNDEIYLFEAGGERLPHEFDIIKGIDNPELEQRFPLEIQQLRDEIELVQAASNEFN
            ||||||||||||||||||||||||||||:|||||||||||||||||||||||||||||||
g134        VYHILNDEIYLFEAGGERLPHEFDIIKGINNPELEQRFPLEIQQLRDEIELVQAASNEFN
                   190       200       210       220       230       240
```

-continued

```
                 250        260        270        280        290        300
m134.pep  LDEFLAGELTPVFFGSAINNFGIQEILNSLIDWAPAPKPRDATVRMVEPDEPKFSGFIFK
          ||||||||||||||||||||||||||||||||||||||||||||:||| |||||||||||
g134      LDEFLAGELTPVFFGSAINNFGIQEILNSLIDWAPAPKPRDATMRMVGPDEPKFSGFIFK
                 250        260        270        280        290        300
                 310        320        330        340        350        360
m134.pep  IQANMDPKHRDRIAFLRVCSGKFERGMKMKHLRINREIAASSVVTFMSHDRELVEEAYAG
          |||||||||||||||||||||||||||||||||||||||||||||||||||||:||||||
g134      IQANMDPKHRDRIAFLRVCSGKFERGMKMKHLRINREIAASSVVTFMSHDRELAEEAYAG
                 310        320        330        340        350        360
                 370        380        390        400        410        420
m134.pep  DIIGIPNHGNIQIGDSFSEGEQLAFTGIPFFAPELFRSVRIKNPLKIKQLQKGLQQLGEE
          ||||||||||||||||||||||||||||||||||||||||||||||||||||||||||||
g134      DIIGIPNHGNIQIGDSFSEGEQLAFTGIPFFAPELFRSVRIKNPLKIKQLQKGLQQLGEE
                 370        380        390        400        410        420
                 430        440        450        460        470        480
m134.pep  GAVQVFKPMSGADLILGAVGVLQFEVVTSRLANEYGVEAVFDSASIWSARWVSCDDKKKL
          ||||||||||||||||||||||||||||||||||||||||||||||||||||||||||||
g134      GAVQVFKPMSGADLILGAVGVLQFEVVTSRLANEYGVEAVFDSASIWSARWVSCDDKKKL
                 430        440        450        460        470        480
                 490        500        510        520        530
m134.pep  AEFEKANAGNLAIDAGGNLAYLAPNRVNLGLTQERWPDIVFHETREHSVKLX
          ||||||||||||||||||||||||||||||||||||||||||||||||||||
g134      AEFEKANAGNLAIDAGGNLAYLAPNRVNLGLTQERWPDIVFHETREHSVKLX
                 490        500        510        520        530
```

The following partial DNA sequence was identified in *N. meningitidis* <SEQ ID 515>:

```
a134.seq
   1 ATGTCCCAAG AAATCCTCGA CCAAGTGCGC CGCCGCCGCA CGTTTGCCAT
  51 CATCTCCCAC CCTGACGCAG GTAAAACCAC GTTGACTGAA AAACTCTTGC
 101 TGTTTTCAGG TGCGATTCAA AGCGCGGGTA CGGTAAAAGG CAAGAAAACC
 151 GGCAAATTCG CCACCTCCGA CTGGATGGAC ATCGAGAAGC AGCGCGGCAT
 201 TTCCGTGGCA TCAAGCGTGA TGCAGTTCGA CTATAAAGAC CACACCGTCA
 251 ACCTTTTGGA CACGCCGGGA CACCAAGACT TCTCCGAAGA CACCTACCGC
 301 GTTTTGACCG CCGTCGATAG TGCCTTGATG GTCATCGACG CGGCAAAAGG
 351 CGTGGAAGCG CAAACCATCA AACTCTTGAA CGTCTGCCGC CTGCGCAATA
 401 CGCCGATTGT TACGTTCATG AACAAATACG ACCGCGAAGT GCGCGATTCC
 451 CTGGAATTGC TGGACGAAGT GGAAAACATC CTGCAAATCC GCTGCGCGCC
 501 CGTAACCTGG CCGATCGGCA TGGGCAAAAA CTTCAAAGGC GTGTACCACA
 551 TCCTGAACGA CGAAATCTAT CTCTTTGAAG CGGGCGGCGA ACGCTTGCCG
 601 CACGAGTTCG ACATCATCAA AGGCATCGAT AATCCCGAAT TGGAACAACG
 651 CTTTCCGTTA GAAATACAGC AGTTGCGCGA CGAAATCGAA TTGGTGCAGG
 701 CGGCTTCCAA CGAGTTCAAT CTCGACGAAT TCCTCGCCGG CGAACTCACG
 751 CCCGTATTCT TCGGCTCTGC GATTAACAAC TTCGGTATTC AGGAAATCCT
 801 CAATTCATTG ATTGAATGGG CGCCCGCGCC GAAACCACGC GATGCGACCG
 851 TGCGTATGGT CGAGCCGGAC GAGCCGAAGT TTTCCGGATT TATCTTCAAA
 901 ATCCAAGCCA ATATGGACCC GAAACACCGC GACCGTATTG CCTTCTTGCG
 951 CGTCTGCTCC GGCAAATTCG AGCGCGGCAT GAAAATGAAA CACCTGCGTA
1001 TCAACCGCGA AATCGCCGCC TCCAGCGTGG TAACCTTCAT GTCCCACGAC
1051 CGCGAGCTGG TTGAAGAAGC CTACGCCGGC GACATTATCG GTATCCCAAA
1101 CCACGGCAAC ATCCAAATCG GCGACAGCTT CTCCGAAGGC GAACAACTGA
```

-continued

```
1151 CGTTTACCGG CATCCCATTC TTCGCGCCCG AACTGTTCCG CAGCGTTCGC

1201 ATCAAAAACC CGCTGAAAAT CAAGCAACTG CAAAAAGGTT TGCAACAGCT

1251 TGGCGAAGAA GGTGCGGTGC AGGTGTTCAA ACCAATGAGC GGCGCGGATT

1301 TGATTTTGGG CGCGGTCGGC GTGTTGCAGT TTGAAGTCGT TACCTCGCGC

1351 CTTGCCAACG AATACGGCGT GGAAGCCGTG TTCGACAACG CATCCATCTG

1401 GTCGGCGCGC TGGGTATCGT GCGACGACAA GAAAAAACTG GCGGAATTTG

1451 AAAAAGCCAA CGCGGGCAAC CTCGCCATCG ACGCGGGCGG CAACCTCGCC

1501 TACCTCGCGC CTAACCGCGT GAATCTGGGA CTCACGCAAG AACGCTGGCC

1551 GGACATCGTG TTCCACGAAA CGCGCGAGCA TTCGGTCAAA CTTTAA
```

This corresponds to the amino acid sequence <SEQ ID 516; ORF 134.a>:

```
a134.pep
  1 MSQEILDQVR RRRTFAIISH PDAGKTTLTE KLLLFSGAIQ SAGTVKGKKT

 51 GKFATSDWMD IEKQRGISVA SSVMQFDYKD HTVNLLDTPG HQDFSEDTYR

101 VLTAVDSALM VIDAAKGVEA QTIKLLNVCR LRNTPIVTFM NKYDREVRDS

151 LELLDEVENI LQIRCAPVTW PIGMGKNFKG VYHILNDEIY LFEAGGERLP

201 HEFDIIKGID NPELEQRFPL EIQQLRDEIE LVQAASNEFN LDEFLAGELT

251 PVFFGSAINN FGIQEILNSL IEWAPAPKPR DATVRMVEPD EPKFSGFIFK

301 IQANMDPKHR DRIAFLRVCS GKFERGMKMK HLRINREIAA SSVVTFMSHD

351 RELVEEAYAG DIIGIPNHGN IQIGDSFSEG EQLTFTGIPF FAPELFRSVR

401 IKNPLKIKQL QKGLQQLGEE GAVQVFKPMS GADLILGAVG VLQFEVVTSR

451 LANEYGVEAV FDNASIWSAR WVSCDDKKKL AEFEKANAGN LAIDAGGNLA

501 YLAPNRVNLG LTQERWPDIV FHETREHSVK L*
```

m134/a134 98.9% identity in 531 aa overlap

```
                    10        20        30        40        50        60
m134.pep    MSQEILDQVRRRRTFAIISHPDAGKTTLTEKLLLFSGAIQSAGTVKGKKTGKFATSDWME
            |||||||||||||||||||||||||||||||||||||||||||||||||||||||||||:
a134        MSQEILDQVRRRRTFAIISHPDAGKTTLTEKLLLFSGAIQSAGTVKGKKTGKFATSDWMD
                    10        20        30        40        50        60
                    70        80        90       100       110       120
m134.pep    IEKQRGISVASSVMQFDYKDHTVNLLDTPGHQDFSEDTYRVLTAVDSALMVIDAAKGVEA
            ||||||||||||||||||||||||||||||||||||||||||||||||||||||||||||
a134        IEKQRGISVASSVMQFDYKDHTVNLLDTPGHQDFSEDTYRVLTAVDSALMVIDAAKGVEA
                    70        80        90       100       110       120
                   130       140       150       160       170       180
m134.pep    QTIKLLNVCRLRDTPIVTFMNKYDREVRDSLELLDEVENILKIRCAPVTWPIGMGKNFKG
            ||||||||||||:||||||||||||||||||||||||||||:||||||||||||||||||
a134        QTIKLLNVCRLRNTPIVTFMNKYDREVRDSLELLDEVENILQIRCAPVTWPIGMGKNFKG
                   130       140       150       160       170       180
                   190       200       210       220       230       240
m134.pep    VYHILNDEIYLFEAGGERLPHEFDIIKGIDNPELEQRFPLEIQQLRDEIELVQAASNEFN
            ||||||||||||||||||||||||||||||||||||||||||||||||||||||||||||
a134        VYHILNDEIYLFEAGGERLPHEFDIIKGIDNPELEQRFPLEIQQLRDEIELVQAASNEFN
                   190       200       210       220       230       240
                   250       260       270       280       290       300
m134.pep    LDEFLAGELTPVFFGSAINNFGIQEILNSLIDWAPAPKPRDATVRMVEPDEPKFSGFIFK
            |||||||||||||||||||||||||||||||:||||||||||||||||||||||||||||
a134        LDEFLAGELTPVFFGSAINNFGIQEILNSLIEWAPAPKPRDATVRMVEPDEPKFSGFIFK
                   250       260       270       280       290       300
```

-continued

```
                 310        320        330        340        350        360
m134.pep    IQANMDPKHRDRIAFLRVCSGKFERGMKMKHLRINREIAASSVVTFMSHDRELVEEAYAG
            ||||||||||||||||||||||||||||||||||||||||||||||||||||||||||||
a134        IQANMDPKHRDRIAFLRVCSGKFERGMKMKHLRINREIAASSVVTFMSHDRELVEEAYAG
                 310        320        330        340        350        360

                 370        380        390        400        410        420
m134.pep    DIIGIPNHGNIQIGDSFSEGEQLAFTGIPFFAPELFRSVRIKNPLKIKQLQKGLQQLGEE
            ||||||||||||||||||||||:|||||||||||||||||||||||||||||||||||||
a134        DIIGIPNHGNIQIGDSFSEGEQLTFTGIPFFAPELFRSVRIKNPLKIKQLQKGLQQLGEE
                 370        380        390        400        410        420

                 430        440        450        460        470        480
m134.pep    GAVQVFKPMSGADLILGAVGVLQFEVVTSRLANEYGVEAVFDSASIWSARWVSCDDKKKL
            ||||||||||||||||||||||||||||||||||||||||||:|||||||||||||||||
a134        GAVQVFKPMSGADLILGAVGVLQFEVVTSRLANEYGVEAVFDNASIWSARWVSCDDKKKL
                 430        440        450        460        470        480

                 490        500        510        520        530
m134.pep    AEFEKANAGNLAIDAGGNLAYLAPNRVNLGLTQERWPDIVFHETREHSVKLX
            ||||||||||||||||||||||||||||||||||||||||||||||||||||
a134        AEFEKANAGNLAIDAGGNLAYLAPNRVNLGLTQERWPDIVFHETREHSVKLX
                 490        500        510        520        530
```

The following partial DNA sequence was identified in *N. gonorrhoeae* <SEQ ID 517>:

```
g135.seq
   1 ATGAAATACA AAAGAATCGT ATTTAAAGTC GGCACATCTT CGATTACCCG

  51 TTCGGAcgGC AGCCTCTCGC GCGGCAAAAT CCAAACCATC ACCCGCCAGC

 101 TTGCCGCATT GCATCATGCG GGACACGAGC TGGTCTTGGT GTCTTCCGGC

 151 GCGGTTGCTG CAGGGTTCGG CGCGCTGGGT TTCAAAAAAC GTCCGGTCAA

 201 AATCGCCGAC AAACAGGCTT CCGCCGCCGT CGGGCAGGGG CTGCTGATGG

 251 AAGAATATAC GGCAAACCTG TCTTCAGACG GCATCGTGTC CGCACAAATC

 301 CTGCTCAGCC GTGCCGACTT TGCCGACAAA CGCCGCTACC AAAATGCCGG

 351 CGGCGCACTT TCCGTGCTGC TGCAACGCCG CGCGATTCCC ATCATCAATG

 401 AAAACGACAC GGTTTCGGTT GAGGAGTTGA AAATCGGCGA CAACGACACA

 451 TTGAGTGCGC AAGTGGCGGC GATGATACAG GCAGACCTCT TGGTGCTGCT

 501 GACCGACATA GACGGTCTTT ACACCGGCAA CCCGAACAGC AATCCCGATG

 551 CCGTACGGCT GGACAAAATC GAACACATCA ACCATGAAAT CATCGAAATG

 601 GCGGGCGGCT CGGGTTCGGC AAACGGCACG GGCGGTATGC TGACCAAAAT

 651 CAAAGCGGCA ACCATCGCCG CCGAATCCGG CGTACCGGTG TATATCTGTT

 701 CCTCACTCAA ACCCGATTCA TTGGCCGAAG CCGCCGAACA TCAGGCGGAC

 751 GGCTCGTTTT TCGTcccCcg tgCCAAAGGT TTGCGGACAC AGAAGCAATG

 801 GctggCGTTC TATTCcgaaa gcggGGgcag cgttTAtgtg gacgaaagtg

 851 cggaacacgc tTtgtccgaa caagggaaag cctgCTGA
```

This corresponds to the amino acid sequence <SEQ ID 518; ORF 135.ng>:

```
g135.pep
   1 MKYKRIVFKV GTSSITRSDG SLSRGKIQTI TRQLAALHHA GHELVLVSSG

  51 AVAAGFGALG FKKRPVKIAD KQASAAVGQG LLMEEYTANL SSDGIVSAQI

 101 LLSRADFADK RRYQNAGGAL SVLLQRRAIP IINENDTVSV EELKIGDNDT
```

-continued

```
151 LSAQVAAMIQ ADLLVLLTDI DGLYTGNPNS NPDAVRLDKI EHINHEIIEM

201 AGGSGSANGT GGMLTKIKAA TIAAESGVPV YICSSLKPDS LAEAAEHQAD

251 GSFFVPRAKG LRTQKQWLAF YSESGGSVYV DESAEHALSE QGKAC*
```

The following partial DNA sequence was identified in *N. meningitidis* <SEQ ID 519>:

```
m135.seq.
   1 ATGAAATACA AAAGAATCGT ATTTAAAGTC GGCACATCTT CGATTACCCA

  51 TTCGGACGGC AGTCTCTCGC GCGGCAAAAT CCAAACCATC ACCTGCCAGC

 101 TTGCCGCATT GCATCATGCG GGACACGAGC TGGTCTTGGT GTCTTCCGGC

 151 GCGGTTGCGG CAGGGTTCGG TGCGCTGGGT TTCAAAAAAC GTCCGGTCAA

 201 AATCGCCGAC AAACAGGCTT CCGCCGCCGT CGGGCAGGGG CTGCTGATGG

 251 AAGAATATAC GGCAAACCTG TCTTCAGACG GCATCGTGTC CGCGCAAATC

 301 CTGCTCAGCC GCGCCGACTT TGCCGACAAA CGCCGCTACC AAAATGCCGG

 351 CGGCGCACTT TCCGTGCTGC TGCAACGCCG CGCCGTCCCC ATCATCAATG

 401 AAAACGATAC GGTTTCGGTT GAGGAATTGA AAATCGGCGA CAACGACACA

 451 TTGAGTGCGC AAGTGGCGGC GATGATACAG GCAGACCTCT TGGTGCTGCT

 501 GACCGACATA GACGGTCTTT ACACGGGCAA CCCGAACAGC AATCCCGATG

 551 CCGTACGGCT GGACAAAATC GAACACATCA ACCATGAAAT CATCGAAATG

 601 GCGGGCGGCT CGGGTTCGGC AAACGGCACG GGCGGTATGC TGACCAAAAT

 651 CAAAGCGGCA ACCATCGCCG CCGAATCCGG CGTACCGGTG TATATCTGTT

 701 CCTCGCTCAA ACCCGATGCA CTTGCCGAAG CTGCCGAACA TCAGGCGGAC

 751 GGCTCGTTTT TCGTCCCCCG TGCCAAAGGT TTGCGGACGC AGAAGCAATG

 801 GCTGGCGTTC TATTCCGAAA GCCGGGGCAG CGTTTATGTG GACGAAGGTG

 851 CGGAACACGC TTTGTCCGAA CAGGGGAAAA GCCTGCTGAT GTCGGGCATT

 901 GCCGGAATCG AAGGGCATTT TTCCCGTATG GACACCGTAA CCGTGTACAG

 951 CAAGGCAACC AAACAGCCCC TGGGCAAAGG GCGCGTCCTG TTCGGCTCTG

1001 CCGCCGCCGA AGACCTGCTC AAATCGCGTA AGGCGAAAGG CGTGTTCATC

1051 CATCGGGACG ACTGGATTTC CATCACGCCC GAAATACGCC TGCTTCTGAC

1101 CGAATTTTAG
```

This corresponds to the amino acid sequence <SEQ ID 520; ORF 135>:

```
m135.pep
  1 MKYKRIVFKV GTSSITHSDG SLSRGKIQTI TCQLAALHHA GHELVLVSSG

 51 AVAAGFGALG FKKRPVKIAD KQASAAVGQG LLMEEYTANL SSDGIVSAQI

101 LLSRADFADK RRYQNAGGAL SVLLQRRAVP IINENDTVSV EELKIGDNDT

151 LSAQVAAMIQ ADLLVLLTDI DGLYTGNPNS NPDAVRLDKI EHINHEIIEM

201 AGGSGSANGT GGMLTKIKAA TIAAESGVPV YICSSLKPDA LAEAAEHQAD

251 GSFFVPRAKG LRTQKQWLAF YSESRGSVYV DEGAEHALSE QGKSLLMSGI

301 AGIEGHFSRM DTVTVYSKAT KQPLGKGRVL FGSAAAEDLL KSRKAKGVFI

351 HRDDWISITP EIRLLLTEF*
```

Computer analysis of this amino acid sequence gave the following results:

Homology with a Predicted ORF from *N. gonorrhoeae*

ORF 135 shows 97.6% identity over a 294 aa overlap with a predicted ORF (ORF 135.ng) from *N. gonorrhoeae*:

```
m135/g135

                       10        20        30        40        50        60
m135.pep      MKYKRIVFKVGTSSITHSDGSLSRGKIQTITCQLAALHHAGHELVLVSSGAVAAGFGALG
              ||||||||||||||||:|||||||||||||| ||||||||||||||||||||||||||||
g135          MKYKRIVFKVGTSSITRSDGSLSRGKIQTITRQLAALHHAGHELVLVSSGAVAAGFGALG
                       10        20        30        40        50        60

                       70        80        90       100       110       120
m135.pep      FKKRPVKIADKQASAAVGQGLLMEEYTANLSSDGIVSAQILLSRADFADKRRYQNAGGAL
              ||||||||||||||||||||||||||||||||||||||||||||||||||||||||||||
g135          FKKRPVKIADKQASAAVGQGLLMEEYTANLSSDGIVSAQILLSRADFADKRRYQNAGGAL
                       70        80        90       100       110       120

                      130       140       150       160       170       180
m135.pep      SVLLQRRAVPIINENDTVSVEELKIGDNDTLSAQVAAMIQADLLVLLTDIDGLYTGNPNS
              |||||||:||||||||||||||||||||||||||||||||||||||||||||||||||||
g135          SVLLQRRAIPIINENDTVSVEELKIGDNDTLSAQVAAMIQADLLVLLTDIDGLYTGNPNS
                      130       140       150       160       170       180

                      190       200       210       220       230       240
m135.pep      NPDAVRLDKIEHINHEIIEMAGGSGSANGTGGMLTKIKAATIAAESGVPVYICSSLKPDA
              |||||||||||||||||||||||||||||||||||||||||||||||||||||||||||:
g135          NPDAVRLDKIEHINHEIIEMAGGSGSANGTGGMLTKIKAATIAAESGVPVYICSSLKPDS
                      190       200       210       220       230       240

                      250       260       270       280       290       300
m135.pep      LAEAAEHQADGSFFVPRAKGLRTQKQWLAFYSESRGSVYVDEGAEHALSEQGKSLLMSGI
              |||||||||||||||||||||||||||||||||| |||||||:|||||||||||:
g135          LAEAAEHQADGSFFVPRAKGLRTQKQWLAFYSESGGSVYVDESAEHALSEQGKACX
                      250       260       270       280       290       300

                      310       320       330       340       350       360
m135.pep      AGIEGHFSRMDTVTVYSKATKQPLGKGRVLFGSAAAEDLLKSRKAKGVFIHRDDWISITP
```

The following partial DNA sequence was identified in *N. meningitidis* <SEQ ID 521>:

```
a135.seq
  1 ATGAAATACA AAAGAATCGT ATTTAAAGTC GGCACATCTT CGATTACCCA

 51 TTCGGACGGC AGTCTCTCGC GCGGCAAAAT CCAAACCATC ACCCGCCAGC

101 TTGCCGCATT GCATCATGCG GGACACGAGC TGGTCTTGGT GTCTTCCGGC

151 GCGGTTGCGG CAGGGTTCGG TGCGCTGGGT TTCAAAAAAC GTCCGGTCAA

201 AATCGCCGAC AAACAGGCTT CCGCCGCCGT CGGGCAGGGG CTGCTGATGG

251 AAGAATATAC GGCAAACCTG TCTTCAGACG GCATCGTGTC CGCACAAATC

301 CTGCTCAGCC GCGCCGACTT TGCCGACAAA CGCCGCTACC AAAATGCCGG

351 CGGCGCACTT TCCGTGCTGC TGCAACGCCG CGCCGTCCCC ATCATCAATG

401 AAAACGATAC GGTTTCGGTT GAGGAATTGA AAATCGGCGA CAACGACACA

451 TTGAGTGCGC AAGTGGCGGC GATGATACAG GCAGACCTCT TGGTGCTGCT

501 GACCGACATA GACGGTCTTT ACACCGGCAA CCCGAACAGC AATCCCGATG

551 CCGTACGGCT GGACAAAATC GAACACATCA ACCATGAAAT CATCGAAATG

601 GCGGGCGGCT CGGGTTCGGC AAACGGCACA GGCGGTATGC TGACTAAAAT

651 CAAAGCGGCG ACGATTGCGA CCGAGTCCGG CGTACCGGTC TATATCTGTT

701 CCTCGCTCAA ACCCGATGCA CTTGCCGAAG CGGCAGATAA TCAGGCGGAC

751 GGCTCGTTTT TCGTCCCCCG TGCCAAAGGT TTGCGGACGC AGAAGCAATG

801 GCTGGCGTTC TATTCCGAAA GCAGGGGCGG CGTTTATGTG GACGAAGGTG
```

-continued

```
 851 CGGAACACGC TTTGTCCGAA CAGGGAAAAA GCCTGCTGAT GTCGGGCATT

 901 GCCGGAATCG AAGGGCATTT TTCCCGTATG GACACCGTAA CCGTGTACAG

 951 CAAGGCAACC AAACAGCCTT TGGGCAAAGG GCGAGTCCTG TTCGGCTCTG

1001 CCGCCGCCGA AGACCTGCTC AAATTGCGTA AGGCGAAAGG CGTGTTCATC

1051 CATCGGGACG ACTGGATTTC CATCACGCCC GAAATACGCC TGCTTCTGAC

1101 CGAATTTTAG
```

This corresponds to the amino acid sequence <SEQ ID 522; ORF 135.a>:

```
a135.pep
  1 MKYKRIVFKV GTSSITHSDG SLSRGKIQTI TRQLAALHHA GHELVLVSSG

 51 AVAAGFGALG FKKRPVKIAD KQASAAVGQG LLMEEYTANL SSDGIVSAQI

101 LLSRADFADK RRYQNAGGAL SVLLQRRAVP IINENDTVSV EELKIGDNDT

151 LSAQVAAMIQ ADLLVLLTDI DGLYTGNPNS NPDAVRLDKI EHINHEIIEM

201 AGGSGSANGT GGMLTKIKAA TIATESGVPV YICSSLKPDA LAEAADNQAD

251 GSFFVPRAKG LRTQKQWLAF YSESRGGVYV DEGAEHALSE QGKSLLMSGI

301 AGIEGHFSRM DTVTVYSKAT KQPLGKGRVL FGSAAAEDLL KLRKAKGVFI

351 HRDDWISITP EIRLLLTEF*
```

m135/a135 98.4% identity in 369 aa overlap

```
                   10        20        30        40        50        60
m135.pep   MKYKRIVFKVGTSSITHSDGSLSRGKIQTITCQLAALHHAGHELVLVSSGAVAAGFGALG
           ||||||||||||||||||||||||||||||| ||||||||||||||||||||||||||||
a135       MKYKRIVFKVGTSSITHSDGSLSRGKIQTITRQLAALHHAGHELVLVSSGAVAAGFGALC
                   10        20        30        40        50        60

                   70        80        90       100       110       120
m135.pep   FKKRPVKIADKQASAAVGQGLIMEEYTANLSSDGIVSAQILLSRADFADKRRYQNAGGAL
           ||||||||||||||||||||||||||||||||||||||||||||||||||||||||||||
a135       FKKRPVKIADKQASAAVGQGLIMEEYTANLSSDGIVSAQILLSRADFADKRRYQNAGGAL
                   70        80        90       100       110       120

                  130       140       150       160       170       180
m135.pep   SVLLQRRAVPIINENDTVSVEELKIGDNDTLSAQVAAMIQADLLVLLTDIDGLYTGNPNS
           ||||||||||||||||||||||||||||||||||||||||||||||||||||||||||||
a135       SVLLQRRAVPIINENDTVSVEELKIGDNDTLSAQVAAMIQADLLVLLTDIDGLYTGNPNS
                  130       140       150       160       170       180

                  190       200       210       220       230       240
m135.pep   NPDAVRLDKIEHINHEIIEMAGGSGSANGTGGMLTKIKAATIAAESGVPVYICSSLKPDA
           |||||||||||||||||||||||||||||||||||||||||:||||||||||||||||||
a135       NPDAVRLDKIEHINHEIIEMAGGSGSANGTGGMLTKIKAATIATESGVPVYICSSLKPDA
                  190       200       210       220       230       240

                  250       260       270       280       290       300
m135.pep   LAEAAEHQADGSFFVPRAKGLRTQKQWLAFYSESRGSVYVDEGAEHALSEQGKSLLMSGI
           |||||::|||||||||||||||||||||||||||||||||||||||||||||||||||||
a135       LAEAADNQADGSFFVPRAKGLRTQKQWLAFYSESRGGVYVDEGAEHALSEQGKSLLMSGI
                  250       260       270       280       290       300

                  310       320       330       340       350       360
m135.pep   AGIEGHFSRMDTVTVYSKATKQPLGKGRVLFGSAAEDLLKSRAKAKGVFIHRDDWISITP
           |||||||||||||||||||||||||||||||||||||||| |||||||||||||||||||
a135       AGIEGHFSRMDTVTVYSKATKQPLGKGRVLFGSAAAEDLLKLRKAKGVFIHRDDWISITP
                  310       320       330       340       350       360

                  370
m135.pep   EIRLLLTEFX
           ||||||||||
a135       EIRLLLTEFX
                  370
```

The following partial DNA sequence was identified in *N. gonorrhoeae* <SEQ ID 523>:

```
g136.seq
   1 ATGGAAATCC GGTTTCAGAC AGCATTTTTA CGTTTGGTTC AGatgaAAAC

  51 AAACGCTtca aTTCTtaccg caACACGCCT TGTATTTCCT GccgCTGCCG

 101 CACGGACAGG GATCGTTCCT GCCGgtTTTT TCCCCTTCCC TGCGGACGGT

 151 TTGCGGTTTG TTGATGACCG CCTGCCAGTA GCGGTAGATG TCtgccagcg

 201 cgTAAGGCag tTCGGAcgca agttccgcca gctcgccttc ggTGAATTGC

 251 AGgcggataa cgccgtttTC CTCTTCGTCg taaatgccgc ccactgccat

 301 cacgGGGTAA AACAGCTCTT CAAACGCTTC ATCATCGGCG GCTTCAAACC

 351 AATCGGTCGG CACAATGTCC AAACCGTAAA GATAGGCGTT GCACCAAGTG

 401 TAAAAATCGC TGCCGCCCTC GCCGTCGTCG TAGAGCCACA AATCGGGCAG

 451 CTTTTTATCC GACATCGCGG CGGTTGTTTC CATCGCCATT GCCAAAACCA

 501 GCCGTTCGAT TTCGGAACGT TCGGCGGCGG TAAATTGCGA TTCGTCGCCC

 551 AACACTTCGG GCAGCCAGTC GAGCGGTGCC AATTTGTCCG GCCCGCTCAA

 601 CAGCGCCGTC ATAAAACCTT GAACCTCGTC GCAACGCATC GTGTTGCCTT

 651 GTTCGCTTTT GGCATCCAAT AA
```

This corresponds to the amino acid sequence <SEQ ID 524; ORF 136.ng>:

```
g136.pep
   1 MEIRFQTAFL RLVQMKTNAS ILTATRLVFP AAAARTGIVP AGFFPFPADG

  51 LRFVDDRLPV AVDVCQRVRQ FGRKFRQLAF GELQADNAVF LFVVNAAHCH

 101 HGVKQLFKRF IIGGFKPIGR HNVQTVKIGV APSVKIAAAL AVVVEPQIGQ

 151 LFIRHRGGCF HRHCQNQPFD FGTFGGGKLR FVAQHFGQPV ERCQFVRPAQ

 201 QRRHKTLNLV ATHRVALFAF GIQ*
```

The following partial DNA sequence was identified in *N. meningitidis* <SEQ ID 525>:

```
m136.seq
   1 ATGGAAACAA ACGCTTCAAT TCTTACCGCA ACACGCCTTG TATTTTCTGC

  51 CGCTGCCGCA CGGACAGGGA TCGTTCCTGC CTGTTTTTTC GCCTTCCCTG

 101 CGGACGGTTT GCGGTTTGTT GATGACTGCC TGCCAGTAGC GGTAGATATC

 151 CGCCAATGCA TAAGGCAACT CGGATTCCAG TTCCGCCAGC TCGCCTTCTG

 201 TGAATTGCAG ACGGATAGCG CCGTTTTCCT CTTCGTCGTA AATACCGCCC

 251 AATGCCATGA TGGGATAAAA CAACTCTTCA AACGCTTCAT CATCGACGGC

 301 TTCAAACCAA TCGGTCGGCA CAATATCCAA ACCGTAAAGA TAAGCATTGC

 351 ACCATGTGTA AAAATCGCTG CCGCCGTCTT CGTTTTCATA CAGCCACAAA

 401 TCGGGCAGTT TTTTATCCGA CATCGCGGCG GTTGTTTCCA TCGCCATTGC

 451 CAAAACCAGC CGTTCGATTT CGGAACGTTC GGCGGCGGTA AATTGCGATT

 501 CGTCGCCCAA CACTTCGGGC AGCCAGTCGA GCGGTGTCAA TTTGTCCGGC

 551 CCGCTCAACA GCGCCGTCAT AAAACCTTGA ACCTCGTCGC AACGCATCGT

 601 GTTGCCTTGT TCGCTTTTGG CATCCAACAA TTCGCTCAAC CGCCGTTTGG
```

```
-continued
651 ATGCTTCGGT AAATTTTCGG GAATCCATCA TTTTCCTTTT CAAATGGGTT

701 TTGCGCCCTA TTATCGCCGC AATGCCGTCT GA
```

This corresponds to the amino acid sequence <SEQ ID 526; ORF 136>:

```
m136.pep
  1 METNASILTA TRLVFSAAAA RTGIVPACFF AFPADGLRFV DDCLPVAVDI

 51 RQCIRQLGFQ FRQLAFCELQ TDSAVFLFVV NTAQCHDGIK QLFKRFIIDG

101 FKPIGRHNIQ TVKISIAPCV KIAAAVFVFI QPQIGQFFIR HRGGCFHRHC

151 QNQPFDFGTF GGGKLRFVAQ HFGQPVERCQ FVRPAQQRRH KTLNLVATHR

201 VALFAFGIQQ FAQPPFGCFG KFSGIHHFPF QMGFAPYYRR NAV*
```

Computer analysis of this amino acid sequence gave the following results:
Homology with a Predicted ORF from *N. gonorrhoeae*
ORF 136 shows 85.6% identity over a 209 aa overlap with a predicted ORF (ORF 136.ng) from *N. gonorrhoeae*:

```
   m136/g136
                                10        20        30        40
        m136.pep            METNASILTATRLVFSAAAARTGIVPACFFAFPADGLRFVDDCLPV
                            |:||||||||||||| ||||||||| || ||||||||||| |||
        g136        MEIRFQTAFLRLVQMKTNASILTATRLVFPAAAARTGIVPAGFFPFPADGLRFVDDRLPV
                            10        20        30        40        50        60

                        50        60        70        80        90       100
        m136.pep    AVDIRQCIRQLGFQFRQLAFCELQTDSAVFLFVVNTAQCHDGIKQLFKRFIIDGFKPIGR
                    |||:  |  :||:| :|||||| |||:|:||||||||::|||||:|:|||||||| ||||||
        g136        AVDVCQRVRQFGRKFRQLAFGELQADNAVFLFVVNAAHCHHGVKQLFKRFITGGFKPIGR
                        70        80        90       100       110       120

                        110       120       130       140       150       160
        m136.pep    HNIQTVKISIAPCVKIAAAVFVFIQPGIGQFFIRHRGGCFHRHCQNQPFDFGTFGGGKLR
                    ||:|||||::||  ||||||:  |  ::|||||||||||||||||||||||||||||||||
        g136        HNVQTVKIGVAPSVKIAAALAVVVEPQIGQLFIRHRGGCFHRHCQNQPFDFGTFGGGKLR
                        130       140       150       160       170       180

                        170       180       190       200       210       220
        m136.pep    FVAQHFGQPVERCQFVRPAQQRRHKTLNLVATHRVALFAFGIQQFAQPPFGCFGKFSGIH
                    ||||||||||||||||||||||||||||||||||||||||||||
        g136        FVAQHFGQPVERCQFVRPAQQRRHKTLNLVATHRVALFAFGIQX
                        190       200       210       220

                        230       240
        m136.pep    HFPFQMGFAPYYRRNAVX
```

The following partial DNA sequence was identified in *N. meningitidis* <SEQ ID 527>:

```
a136.seq
  1 ATGGAAACAA ACGCTTCAAT TCTTACCGCA ACACGCCTTG TATTTTCTGC

 51 CGCTGCCGCA CGGACAGGGA TCGTTCCTGC CTGTTTTTTC GCCTTCCCTG

101 CGGACGGTTT GCGGCTTGTT GATGACCGCC TGCCAGTAGC GGTAGATATC

151 CGCCAATGCA TAAGGCAACT CGGATTCCAG TTCCGCCAGC TCGCCTTCTG

201 TGAATTGCAG ACGGATAGTG CCGTTGTCCT CTTCGTCGTA AATACCGCCC

251 AATGCCATGA TGGGATAAAA CAACTCTTCA AACGCTTCAT CATCGACGGC

301 TTCAAACCAA TCGGTCGGCA CAATATCCAA ACCGTAAAGA TAAGCATTGC

351 ACCATGTGTA AAAATCGCTG CCGCCGTCTT CGTTTTCATA CAGCCACAAA

401 TCGGGCAGTT TTTTATCCGA CATCGCGGCG GTTGTTCCA TCGCCATTGC

451 CAAAACCAGC CGTTCGATTT CGGAACGTTC GGCGGCGGTA AATTGCGATT
```

-continued

```
501 CGTCGCCCAA CACTTCGGGC AGCCAGTCGA GCGGTGTCAA TTTGTCCGGC

551 CCGCTCAACA GCGCCGTCAT AAAACCTTGA ACCTCGTCGC AACGCATCGT

601 GTTGCCTTGT TCGCTTTTGG CATCCAACAA TTCGCTCAAC CGCCGTTTGG

651 ATGCTTCGGT AAATTTTCGG GAATCCATCA TTTTCCTTTT CCAATGGGTT

701 TTGCGCCCTA TTATAGTGGA TTAAATTTAA ATCAGGACAA GGCGACGAAG

751 CCGCAGACAG TACAAATAGT ACGGCAAGGC GAGGCAACGC CGTACTGGTT

801 TAAATTTAAT CCACTATATC GCCGCAATGC CGTCTGA
```

This corresponds to the amino acid sequence <SEQ ID 528; ORF 136.a>:

```
a136.pep
  1 METNASILTA TRLVFSAAAA RTGIVPACFF AFPADGLRLV DDRLPVAVDI

 51 RQCIRQLGFQ FRQLAFCELQ TDSAVVLFVV NTAQCHDGIK QLFKRFIIDG

101 FKPIGRHNIQ TVKISIAPCV KIAAAVFVFI QPQIGQFFIR HRGGCFHRHC

151 QNQPFDFGTF GGGKLRFVAQ HFGQPVERCQ FVRPAQQRRH KTLNLVATHR

201 VALFAFGIQQ FAQPPFGCFG KFSGIHHFPF PMGFAPYYSG LNLNQDKATK

251 PQTVQIVRQG EATPYWFKFN PLYRRNAV*
```

m136/a136 98.3% identity in 238 aa overlap

```
                    10        20        30        40        50        60
m136.pep    METNASILTATRLVFSAAAARTGIVPACFFAFPADGLRFVDDCLPVAVDIRQCIRQLGFQ
            |||||||||||||||||||||||||||||||||||||||||:||| ||||||||||||||
a136        METNASILTATRLVFSAAAARTGIVPACFFAFPADGLRLVDDRLPVAVDIRQCIRQLGFQ
                    10        20        30        40        50        60

                    70        80        90       100       110       120
m136.pep    FRQLAFCELQTDSAVFLFVVNTAQCHDGIKQLFKRFIIDGFKPIGRHNIQTVKISIAPCV
            ||||||||||||||| ||||||||||||||||||||||||||||||||||||||||||||
a136        FRQLAFCELQTDSAVVLFVVNTAQCHDGIKQLFKRFIIDGFKPIGRHNIQTVKISIAPCV
                    70        80        90       100       110       120

                   130       140       150       160       170       180
m136.pep    KIAAAVFVFIQPQIGQFFIRHRGGCFHRHCQNQPFDFGTFGGGKLRFVAQHFGQPVERCQ
            ||||||||||||||||||||||||||||||||||||||||||||||||||||||||||||
a136        KIAAAVFVFIQPQIGQFFIRHRGGCFHRHCQNQPFDFGTFGGGKLRFVAQHFGQPVERCQ
                   130       140       150       160       170       180

                   190       200       210       220       230       240
m136.pep    FVRPAQQRRHKTLNLVATHRVALFAFGIQQFAQPPFGCFGKFSGIHHFPFQMGFAPYYRR
            |||||||||||||||||||||||||||||||||||||||||||||||||| |||||||
a136        FVRPAQQRRHKTLNLVATHRVALFAFGIQQFAQPPFGCFGKFSGIHHFPFPMGFAPYYSG
                   190       200       210       220       230       240

m136.pep    NAVX

a136        LNLNQDKATKPQTVQIVRQGEATPYWFKFNPLYRRNAVX
                   250       260       270
```

The following partial DNA sequence was identified in *N. gonorrhoeae* <SEQ ID 529>:

```
g137.seq
  1 ATGATTATCC ATCACcaaTT CGATCCCGTC CTCATCAGTA TCGGCCCGCT

 51 TGCCGTCCGC TGGTATGCCT TAAGCTACAT CCTCGGATTT ATTCTTTTTA

101 CCTTTCTCGG CAGAAGGCGC ATCGCGCAAG GCTTGTCCGT TTTTACCAAA

151 GAATCGCTCG ACGACTTCCT GACATGGGGC ATTTTGGGCG TGATTTTGGG

201 CGGACGCTTG GGCTATGTCC TGTTTTACAA ATTCTCCGAC TACCTCGCCC

251 ATCCGCTTGA TATTTTCAAG GTATGGGAAG GCGGAATGTC GTTCCACGGC
```

-continued

```
301 GGCTTTTTGG GTGTAGTTAT TGCCATATGG TTGTTCAGCC GCAAGCACGG

351 CATCGGCTTC CTCAAACTGA TGGACACGGT CGCGCCGCTC GTTCCGCTGG

401 GTCTCGCTTC GGGACGTATC GGCAACTTTA TCAACGGCGA ACTTTGGGGA

451 CGCATTACCG ACATTAACGC ATTTTGGGCA ATGGGCTTCC CGCAAGCGCA

501 TTACGAAGAT GCCGAAGCCG CCGCGCACAA TCCGCTTTGG GCAGAATGGC

551 TGCAACAATA CGGTATGCTG CCGCGTCATC CCTCGCAGCT TTATCAGTTT

601 GCCCTTGAAG GCATCTGCCT GTTCGCCGTC GTTTGGCTGT TTTCCAAAAA

651 ACCGCGCCCG ACCGGGCAGA CTGCCGCGCT TTTTCTCGGC GGCTACGGCG

701 TGTTCCGCTT TATTGCCGAA TTTGCGCGCC AACCCGACGA CTATCTCGGG

751 CTGCTGACCT TGGGGCTGTC GATGGGGCAA TGGTTGAGCG TCCCGATGAT

801 TGTTTTGGGT ATCGTCGGCT TTGTCCGGTT CGGCATGAAA AAACAGCACT

851 GA
```

This corresponds to the amino acid sequence <SEQ ID 530; ORF 137.ng>:

```
g137.pep
  1 MIIHHQFDPV LISIGPLAVR WYALSYILGF ILFTFLGRRR IAQGLSVFTK

 51 ESLDDFLTWG ILGVILGGRL GYVLFYKFSD YLAHPLDIFK VWEGGMSFHG

101 GFLGVVIAIW LFSRKHGIGF LKLMDTVAPL VPLGLASGRI GNFINGELWG

151 RITDINAFWA MGFPQAHYED AEAAAHNPLW AEWLQQYGML PRHPSQLYQF

201 ALEGICLFAV VWLFSKKPRP TGQTAALFLG GYGVFRFIAE FARQPDDYLG

251 LLTLGLSMGQ WLSVPMIVLG IVGFVRFGMK KQH*
```

The following partial DNA sequence was identified in *N. meningitidis* <SEQ ID 531>:

```
m137.seq
  1 ATGATTACCC ATCCCCAATT CGATCCCGTC CTTATCAGTA TCGGCCCGCT

 51 TGCCGTCCGC TGGTATGCCC TAAGCTACAT CCTCGGATTT ATTCTTTTTA

101 CCTTTCTCGG CAGAAGGCGC ATCGCGCAAG GCTTGTCCGT TTTTACCAAA

151 GAATCGCTCG ACGACTTCCT GACATGGGGC ATTTTGGGCG TAATTTTGGG

201 CGGGCGTTTG GGTTACGTCC TGTTTTACAA GTTTTCCGAC TACCTCGCCC

251 ATCCGCTTGA TATTTTCAAG GTATGGGAAG GCGGAATGTC GTTCCACGGC

301 GGCTTTTTGG GTGTAGTTAT TGCCATACGG TTGTTCGGCC GCAAACACGG

351 CATCGGCTTC CTCAAACTGA TGGATACGGT CGCACCGCTC GTTCCGCTGG

401 GTCTCGCTTC GGGACGTATC GGCAACTTCA TCAACGGCGA ACTTTGGGGA

451 CGCGTTACCG ACATCAACGC ATTTTGGGCA ATGGGCTTCC CGCAGGCGCG

501 TTACGAAGAT GCCGAAGCCG CCGCGCACAA TCCGCTTTGG GCAGAATGGC

551 TGCAACAATA CGGTATGCTG CCGCGTCATC CCTCGCAGCT TTATCAGTTT

601 GCACTTGAAG GCATCTGCCT GTTCACCGTC ATTTGGCTGT TCTCTAAAAA

651 ACAGCGGTCG ACCGGACAAG TCGCCTCGCT CTTCCTCGGC GGCTACGGCA

701 TATTCCGCTT CATTGCCGAA TTCGCACGCC AACCCGACGA CTATCTCGGG

751 CTGCTGACCT TGGGGCTGTC GATGGGGCAA TGGTTGAGCG TCCCGATGAT
```

-continued

```
801 TGTTTTGGGT ATCGTCGGCT TTGTCCGGTT CGGCATGAAA AAACAGCACT

851 GA
```

This corresponds to the amino acid sequence <SEQ ID 532; ORF 137>:

```
m137.pep
  1 MITHPQFDPV LISIGPLAVR WYALSYILGF ILFTFLGRRR IAQGLSVFTK

 51 ESLDDFLTWG ILGVILGGRL GYVLFYKFSD YLAHPLDIFK VWEGGMSFHG

101 GFLGVVIAIR LFGRKHGIGF LKLMDTVAPL VPLGLASGRI GNFINGELWG

151 RVTDINAFWA MGFPQARYED AEAAAHNPLW AEWLQQYGML PRHPSQLYQF

201 ALEGICLFTV IWLFSKKQRS TGQVASLFLG GYGIFRFIAE FARQPDDYLG

251 LLTLGLSMGQ WLSVPMIVLG IVGFVRFGMK KQH*
```

Computer analysis of this amino acid sequence gave the following results:

Homology with a Predicted ORF from *N. gonorrhoeae*

ORF 137 shows 95.4% identity over a 283 aa overlap with a predicted ORF (ORF 137.ng) from *N. gonorrhoeae*:

```
m137/g137

                 10        20        30        40        50        60
m137.pep MITHPQFDPVLISIGPLAVRWYALSYILGFILFTFLGRRRIAQGLSVFTKESLDDFLTWG
         || | |||||||||||||||||||||||||||||||||||||||||||||||||||||||
g137     MIIHHQFDPVLISIGPLAVRWYALSYILGFILFTFLGRRRIAQGLSVFTKESLDDFLTWG
                 10        20        30        40        50        60

                 70        80        90       100       110       120
m137.pep ILGVILGGRLGYVLFYKFSDYLAHPLDIFKVWEGGMSFHGGFLGVVIAIRLFGRKHGIGF
         |||||||||||||||||||||||||||||||||||||||||| |||||| ||:|||||||
g133     ILGVILGGRLGYVLFYKFSDYLAHPLDIFKVWEGGMSFHGGFLGVVIAIWLFSRKHGIGF
                 70        80        90       100       110       120

                130       140       150       160       170       180
m137.pep LKLMDTVAPLVPLGLASGRIGNFINGELWGRVTDINAFWAMGFPQARYEDAEAAAHNPLW
         |||||||||||||||||||||||||||||||:|||||||||| |||:|||||||||||||
g137     LKLMDTVAPLVPLGLASGRIGNFINGELWGRITDINAFWAMGFPQAHYEDAEAAAHNPLW
                130       140       150       160       170       180

                190       200       210       220       230       240
m137.pep AEWLQQYGMLPRHPSQLYQFALEGICLFTVIWLFSKKQRSTGQVASLFLGGYGIFRFIAE
         ||||||||||||||||||||||||||||:|:|||||| | || :|:|||||||:||||||
g137     AEWLQQYGMLPRHPSQLYQFALEGICLFAVVWLFSKKPRPTGQTAALFLGGYGVFRFIAE
                190       200       210       220       230       240

                250       260       270       280
m137.pep FARQPDDYLGLLTLGLSMGQWLSVPMIVLGIVGFVRFGMKKQHX
         |||||||||||||||||||||||||||||||||||||||||||
g137     FARQPDDYLGLLTLGLSMGQWLSVPMIVLGIVGFVRFGMKKQHX
                250       260       270       280
```

The following partial DNA sequence was identified in *N. meningitidis* <SEQ ID 533>:

```
a137.seq
  1 ATGATTACCC ATCCCCAATT CGACCCCGTC CTTATCAGTA TCGGCCCGCT

 51 TGCCGTCCGC TGGTATGCCC TAAGCTACAT CCTCGGATTT ATTCTTTTTA

101 CCTTTCTCGG CAGAAGGCGC ATCGCGCAAG GCTTGTCCGT TTTTACCAAA

151 GAATCGCTCG ACGACTTCCT GACATGGGGC ATTTTGGGCG TAATTTTGGG

201 CGGGCGTTTG GGTTACGTCC TGTTTTACAA GTTTTCCGAC TACCTCGCCC

251 ATCCGCTTGA TATTTTCAAG GTATGGGAAG GCGGAATGTC GTTCCACGGC

301 GGCTTTTTGG GTGTAGTTAT TGCCATATGG TTGTTCGGTC GCAAACACGG
```

-continued

```
351 CATCGGCTTC CTCAAACTGA TGGACACGGT CGCACCGCTC GTTCCACTGG

401 GTCTCGCTTC GGGACGTATC GGCAACTTCA TCAACGGCGA ACTTTGGGGA

451 CGCGTTACCG ACATCAACGC ATTTTGGGCA ATGGGCTTCC CGCAGGCGCG

501 TTACGAAGAC CTCGAAGCCG CCGCGCACAA TCCGCTTTGG GCAGAATGGC

551 TGCAACAATA CGGTATGCTG CCGCGTCATC CCTCGCAGCT TTATCAGTTT

601 GCACTTGAAG GCATCTGCCT GTTCGCCGTC GTTTGGCTGT TCTCTAAAAA

651 ACAGCGGCCG ACCGGACAAG TCGCCTCACT CTTCCTCGGC GGCTACGGCA

701 TATTCCGCTT CATTGCCGAA TTTGCACGCC AACCCGACGA CTATCTCGGG

751 CTGCTGACCT TGGGGCTGTC GATGGGGCAA TGGTTGAGCG TCCCGATGAT

801 TGTTTTGGGT ATCGTCGGCT TTGTCCGGTT CGGCATGAAA AAACAGCACT

851 GA
```

This corresponds to the amino acid sequence <SEQ ID 534; ORF 137.a>:

```
a137.pep
  1 MITHPQFDPV LISIGPLAVR WYALSYILGF ILFTFLGRRR IAQGLSVFTK

 51 ESLDDFLTWG ILGVILGGRL GYVLFYKFSD YLAHPLDIFK VWEGGMSFHG

101 GFLGVVIAIW LFGRKHGIGF LKLMDTVAPL VPLGLASGRI GNFINGELWG

151 RVTDINAFWA MGFPQARYED LEAAAHNPLW AEWLQQYGML PRHPSQLYQF

201 ALEGICLFAV VWLFSKKQRP TGQVASLFLG GYGIFRFIAE FARQPDDYLG

251 LLTLGLSMGQ WLSVPMIVLG IVGFVRFGMK KQH*
```

m137/a137 98.2% identity in 283 aa overlap

```
                    10        20        30        40        50        60
m137.pep    MITHPQFDPVLISIGPLAVRWYALSYILGFILFTFLGRRRIAQGLSVFTKESLDDFLTWG
            ||||||||||||||||||||||||||||||||||||||||||||||||||||||||||||
a137        MIIHPQFDPVLISIGPLAVRWYALSYILGFILFTFLGRRRIAQGLSVFTKESLDDFLTWG
                    10        20        30        40        50        60

                    70        80        90       100       110       120
m137.pep    ILGVILGGRLGYVLFYKFSDYLAHPLDIFKVWEGGMSFHGGFLGVVIAIRLFGRKHGIGF
            |||||||||||||||||||||||||||||||||||||||||||||||||| |||||||||
a137        ILGVILGGRLGYVLFYKFSDYLAHPLDIFKVWEGGMSFHGGFLGVVIAIWLFGRKHGIGF
                    70        80        90       100       110       120

                   130       140       150       160       170       180
m137.pep    LKLMDTVAPLVPLGLASGRIGNFINGELWGRVTDINAFWAMGFPQARYEDAEAAAHNPLW
            |||||||||||||||||||||||||||||||||||||||||||||||||| |||||||||
a137        LKLMDTVAPLVPLGLASGRIGNFINGELWGRVTDINAFWAMGFPQARYEDLEAAAHNPLW
                   130       140       150       160       170       180

                   190       200       210       220       230       240
m137.pep    AEWLQQYGMLPRHPSQLYQFALEGICLFTVIWLFSKKQRSTGQVASLFLGGYGIFRFIAE
            ||||||||||||||||||||||||||||:|:|||||||| ||||||||||||||||||||
a137        AEWLQQYGMLPRHPSQLYQFALEGICLFAVVWLFSKKQRPTGQVASLFLGGYGIFRFIAE
                   190       200       210       220       230       240

                   250       260       270       280
m137.pep    FARQPDDYLGLLTLGLSMGQWLSVPMIVLGIVGFVRFGMKKQHX
            ||||||||||||||||||||||||||||||||||||||||||||
a137        FARQPDDYLGLLTLGLSMGQWLSVPMIVLGIVGFVRFGMKKQHX
                   250       260       270       280
```

The following partial DNA sequence was identified in *N. gonorrhoeae* <SEQ ID 535>:

```
g138.seq
  1  ATGGAGTTTG AAAACATTAT TTCCGCCGCc gaCAAGGCGC GTATCCTTGC
```

-continued

```
 51 CGAAGCACTG CCTTACAtcc gccgGTTTTC CGGTTCGGTC GCCGTCATCA

101 AGTATGGCGG CAACGCGATG ACCGAACCTG CCTTGAAAGA AGGGTTTGCC

151 CGCGATGTCG TGCTGCTGAA GCTGGTCGGC ATTCATCCCG TCATCGTTCA

201 CGGCGGCGGG CCGCAGATCA ATGCGATGCT TGAAAAAGTC GGCAAAAAGG

251 GCGAATTTGT CCAAGGAATG CGCGTTACCG ACAAAGAGAC GATGGATATT

301 GTCGAAATGG TATTGGGCGG GCACGTCAAC AAGGAAATCG TGTCGATGAT

351 TAACACATAT GGAGGGCACG CGGTCGGCGT GAGCGGGCGC GACGACCATT

401 TCATTAAGGC GAAGAAACTT TTGGTCGATA CGCCCGAACA GAATAGCGTG

451 GACATCGGAC AGGTCGGTAC GGTGGAAAGC ATCGATACCG GTTTGGTTAA

501 AGGGCTGATA GAACGCGGCT GCATTCCCGT CGTCGCCCCC GTCGGCGTAG

551 GTGAAAAAGG CGAAGCGTTC AACATCAACG CCGATTTGGT GGCAGGCAAA

601 TTGGCGGAAG AATTGAACGC CGAAAAACTC TTGATGATGA CGAAtatcgc

651 cgGTGTGATG GACAAAACGG GCAATCTGCT GACCAAACTC acgCCGAAAC

701 GGATTGATGG GCTGATTGCC GACGGCACGC TGTATGGCGG TATGCTGCCG

751 AAAATCGCTT CTGCGGTCGA AGCcgccgtc aACGGTGTGA AAGCCACGCA

801 CATCATCGAC GGCAGGTTGC CCAACGCGCT TTTGCTGGAA ATCTTTACCG

851 ATGCCGGTAT CGGGTCGATG ATTTTAGGCA GAGGGGAAGA TGCCTGA
```

This corresponds to the amino acid sequence <SEQ ID 536; ORF 138.ng>:

```
g138.pep
  1 MEFENIISAA DKARILAEAL PYIRRFSGSV AVIKYGGNAM TEPALKEGFA

 51 RDVVLLKLVG IHPVIVHGGG PQINAMLEKV GKKGEFVQGM RVTDKETMDI

101 VEMVLGGHVN KEIVSMINTY GGHAVGVSGR DDHFIKAKKL LVDTPEQNSV

151 DIGQVGTVES IDTGLVKGLI ERGCIPVVAP VGVGEKGEAF NINADLVAGK

201 LAEELNAEKL LMMTNIAGVM DKTGNLLTKL TPKRIDGLIA DGTLYGGMLP

251 KIASAVEAAV NGVKATHIID GRLPNALLLE IFTDAGIGSM ILGRGEDA*
```

The following partial DNA sequence was identified in *N. meningitidis* <SEQ ID 537>:

```
m138.seq
  1 ATGGAGTCTG AAAACATTAT TTCCGCCGCC GACAAGGCGC GTATCCTTGC

 51 CGAAGCGCTG CCTTACATCC GCCGGTTTTC CGGTTCGGTC GCCGTCATCA

101 AATACGGCGG CAACGCGATG ACCGAACCTG CCTTGAAAGA AGGGTTTGCC

151 CGCGATGTCG TGCTGCTGAA GCTGGTCGGC ATTCATCCCG TCATCGTTCA

201 CGGCGGCGGG CCGCAGATCA ATGCGATGCT TGAAAAAGTC GGCAAAAAGG

251 GTGAGTTTGT CCAAGGAATG CGCGTTACCG ACAAAGAGGC GATGGATATT

301 GTCGAAATGG TGTTGGGCGG GCATGTCAAT AAAGAAATCG TGTCGATGAT

351 TAACACATAT GGCGGACACG CGGTCGGCGT AAGCGGACGC GACGACCATT

401 TCATTAAGGC GAAGAAACTT TTGATCGATA CGCCCGAACA GAATGGCGTG

451 GACATCGGAC AGGTCGGTAC GGTGGAAAGC ATCGATACCG GTTTGGTTAA

501 AGGGCTGATA GAACGTGGCT GCATTCCCGT CGTCGCCCCC GTCGGCGTAG
```

```
-continued
551 GTGAAAAAGG CGAAGCGTTC AACATCAACG CCGATTTGGT AGCAGGCAAA

601 TTGGCGGAAG AATTGAACGC CGAAAAACTC TTGATGATGA CGAATATCGC

651 CGGTGTGATG GACAAAACGG GCAATCTGCT GACCAAACTC ACGCCGAAAC

701 GGATTGATGA ACTGATTGCC GACGGCACGC TGTATGGCGG TATGCTGCCG

751 AAAATCGCTT CTGCGGTCGA AGCCGCCGTC AACGGTGTGA AAGCCACGCA

801 TATCATCGAC GGCAGGTTGC CCAACGCGCT TTTGCTGGAA ATCTTTACCG

851 ATGCCGGTAT CGGTTCGATG ATTTTGGGCG GTGGGGAAGA TGCCTGA
```

This corresponds to the amino acid sequence <SEQ ID 538; ORF 138>:

```
m138.pep
   1 MESENIISAA DKARILAEAL PYIRRFSGSV AVIKYGGNAM TEPALKEGFA

  51 RDVVLLKLVG IHPVIVHGGG PQINAMLEKV GKKGEFVQGM RVTDKEAMDI

 101 VEMVLGGHVN KEIVSMINTY GGHAVGVSGR DDHFIKAKKL LIDTPEQNGV

 151 DIGQVGTVES IDTGLVKGLI ERGCIPVVAP VGVGEKGEAF NINADLVAGK

 201 LAEELNAEKL LMMTNIAGVM DKTGNLLTKL TPKRIDELIA DGTLYGGMLP

 251 KIASAVEAAV NGVKATHIID GRLPNALLLE IFTDAGIGSM ILGGGEDA*
```

Computer analysis of this amino acid sequence gave the following results:
Homology with a Predicted ORF from *N. gonorrhoeae*
ORF 138 shows 98.0% identity over a 298 aa overlap with a predicted ORF (ORF 138.ng) from *N. gonorrhoeae*:

```
m138/g138
                  10         20         30         40         50         60
     m138.pep MESENIISAADKARILAEALPYIRRFSGSVAVIKYGGNAMTEPALKEGFARDVVLLKLVG
              || |||||||||||||||||||||||||||||||||||||||||||||||||||||||||
         g138 MEFENIISAADKARILAEALPYIRRFSGSVAVIKYGGNAMTEPALKEGFARDVVLLKLVG
                  10         20         30         40         50         60
                  70         80         90        100        110        120
     m138.pep IHPVIVHGGGPQINAMLEKVGKKGEFVQGMRVTDKEAMDIVEMVLGGHVNKEIVSMINTY
              |||||||||||||||||||||||||||||||||||||:||||||||||||||||||||||
         g138 IHPVIVHGGGPQINAMLEKVGKKGEFVQGMRVTDKETMDIVEMVLGGHVNKEIVSMINTY
                  70         80         90        100        110        120
                 130        140        150        160        170        180
     m138.pep GGHAVGVSGRDDHFIKAKKLLIDTPEQNGVDIGQVGTVESIDTGLVKGLIERGCIPVVAP
              ||||||||||||||||||||:||||||:||||||||||||||||||||||||||||||||
         g138 GGHAVGVSGRDDHFIKAKKLLVDTPEQNSVDIGQVGTVESIDTGLVKGLIERGCIPVVAP
                 130        140        159        160        170        180
                 190        200        210        220        230        240
     m138.pep VGVGEKGEAFNINADLVAGKLAEELNAEKLLMMTNIAGVMDKTGNLLTKLTPKRIDELIA
              ||||||||||||||||||||||||||||||||||||||||||||||||||||||||| |||
         g138 VGVGEKGEAFNINADLVAGKLAEELNAEKLLMMTNIAGVMDKTGNLLTKLTPKRIDGLIA
                 190        200        210        220        230        240
                 250        260        270        280        290        299
     m138.pep DGTLYGGMLPKIASAVEAAVNGVKATHIIDGRLPNALLLEIFTDAGIGSMILGGGEDAX
              |||||||||||||||||||||||||||||||||||||||||||||||||||| |||||
         g138 DGTLYGGMLPKIASAVEAAVNGVKATHIIDGRLPNALLLEIFTDAGIGSMILGRGEDAX
                 250        260        270        280        290
```

The following partial DNA sequence was identified in *N. meningitidis* <SEQ ID 539>:

```
a138.seq
   1 ATGGAGTCTG AAAACATTAT TTCCGCCGCC GACAAGGCGC GTATCCTTGC
```

-continued

```
 51 CGAAGCGCTG CCTTACATCC GCCGGTTTTC CGGTTCGGTC GCCGTCATCA

101 AATACGGCGG CAACGCGATG ACCGAACCTG CCTTGAAAGA AGGGTTTGCC

151 CGCGATGTCG TGCTGCTGAA GCTGGTCGGC ATTCATCCCG TCATCGTTCA

201 CGGCGGCGGG CCGCAGATCA ATGCGATGCT TGAAAAAGTC GGCAAAAAGG

251 GTGAGTTTGT CCAAGGAATG CGCGTTACCG ACAAAGAGGC GATGGATATT

301 GTCGAAATGG TGTTGGGCGG GCATGTCAAT AAAGAAATCG TGTCGATGAT

351 TAACACATAT GGCGGACACG CGGTCGGCGT AAGCGGACGC GACGACCATT

401 TCATTAAGGC GAAGAAACTT TTGATCGATA CGCCCGAACA GAATGGCGTG

451 GACATCGGAC AGGTCGGTAC GGTGGAAAGC ATCGATACCG GTTTGGTTAA

501 AGGGCTGATA GAACGTGGCT GCATTCCCGT CGTCGCCCCC GTCGGCGTAG

551 GTGAAAAAGG CGAAGCGTTC AACATCAACG CCGATTTGGT AGCAGGCAAA

601 TTGGCGGAAG AATTGAACGC CGAAAAACTC TTGATGATGA CGAATATCGC

651 CGGTGTGATG GACAAAACGG GCAATCTGCT GACCAAACTC ACGCCGAAAC

701 GGATTGATGA ACTGATTGCC GACGGCACGC TGTATGGCGG TATGCTGCCG

751 AAAATCGCTT CTGCGGTCGA AGCCGCCGTC AACGGCGTGA AAGCCACGCA

801 TATCATCGAC GGCAGGGTGC CCAACGCGCT TTTGCTGGAA ATCTTTACCG

851 ATGCCGGTAT CGGTTCGATG ATTTTGGGCG GTGGGGAAGA TGCCTGA
```

This corresponds to the amino acid sequence <SEQ ID 540; ORF 138.a>:

```
a138.pep
  1 MESENIISAA DKARILAEAL PYIRRFSGSV AVIKYGGNAM TEPALKEGFA

 51 RDVVLLKLVG IHPVIVHGGG PQINAMLEKV GKKGEFVQGM RVTDKEAMDI

101 VEMVLGGHVN KEIVSMINTY GGHAVGVSGR DDHFIKAKKL LIDTPEQNGV

151 DIGQVGTVES IDTGLVKGLI ERGCIPVVAP VGVGEKGEAF NINADLVAGK

201 LAEELNAEKL LMMTNIAGVM DKTGNLLTKL TPKRIDELIA DGTLYGGMLP

251 KIASAVEAAV NGVKATHIID GRVPNALLLE IFTDAGIGSM ILGGGEDA*
```

m138/a138 99.7% identity in 298 aa overlap

```
                    10        20        30        40        50        60
m138.pep    MESENIISAADKARILAEALPYIRRFSGSVAVIKYGGNAMTEPALKEGFARDVVLLKLVG
            ||||||||||||||||||||||||||||||||||||||||||||||||||||||||||||
g138        MESENIISAADKARILAEALPYIRRFSGSVAVIKYGGNAMTEPALKEGFARDVVLLKLVG
                    10        20        30        40        50        60

                    70        80        90       100       110       120
m138.pep    IHPVIVHGGGPQINAMLEKVGKKGEFVQGMRVTDKEAMDIVEMVLGGHVNKEIVSMINTY
            ||||||||||||||||||||||||||||||||||||||||||||||||||||||||||||
g138        IHPVIVHGGGPQINAMLEKVGKKGEFVQGMRVTDKEAMDIVEMVLGGHVNKEIVSMINTY
                    70        80        90       100       110       120

                   130       140       150       160       170       180
m138.pep    GGHAVGVSGRDDHFIKAKKLLIDTPEQNGVDIGQVGTVESIDTGLVKGLIERGCIPVVAP
            ||||||||||||||||||||||||||||||||||||||||||||||||||||||||||||
g138        GGHAVGVSGRDDHFIKAKKLLIDTPEQNGVDIGQVGTVESIDTGLVKGLIERGCIPVVAP
                   130       140       159       160       170       180

                   190       200       210       220       230       240
m138.pep    VGVGEKGEAFNINADLVAGKLAEELNAEKLLMMTNIAGVMDKTGNLLTKLTPKRIDELIA
            |||||||||||||||||||||||||||||||||||||||||||||||||||||||| |||
g138        VGVGEKGEAFNINADLVAGKLAEELNAEKLLMMTNIAGVMDKTGNLLTKLTPKRIDGLIA
                   190       200       210       220       230       240
```

-continued

```
                 250        260        270        280        290      299
m138.pep  DGTLYGGMLPKIASAVEAAVNGVKATHIIDGRLPNALLLEIFTDAGIGSMILGGGEDAX
          ||||||||||||||||||||||||||||||||:||||||||||||||||||||||||||
g138      DGTLYGGMLPKIASAVEAAVNGVKATHIIDGRVPNALLLEIFTDAGIGSMILGGGEDAX
                 250        260        270        280        290
```

The following partial DNA sequence was identified in *N. gonorrhoeae* <SEQ ID 541>:

```
g139.seq
   1 ATGCGAACCA CCTCAACCTT CCCTACAAAA ACTTTCAAAC CGGCTGCCAT

  51 GGCGTTAGCT GTTGCAACAA CACTTTCTGC CTGCTTAggc ggcggcggag

 101 gcGGCACTTC TGCTCCCGAC TTTAATGCAG GCGGCACCGG TATCGGCAGC

 151 AACAGCAGGG CAACGATAGC GGAATCAGCA GCAGTATCTT ACGCCGGTAT

 201 AAAAAACGAA ATGTGCAAAG ACAGAAGCAT GCTCTGTGCC GGTCGGGATG

 251 ACGTTGCGGT TACAGACAGG GATGCCAAAA TCAAAGCCCC CCGAATCTGC

 301 ATACCGGAGA CTTTTCAAAC CCAAATGACC AATATTAAGA ATATGATCAA

 351 CCTCAAACCT GCAATTGAAG CAGGCTATAC AGGACGCGGG GTAGAGGTAG

 401 GTATCGTCGA TACAGGCGAA TCCGTCGGCA GCATATCCTT TCCCGAACTG

 451 TATGGCAGAA AAGAACACGG CTATAACGAA AATTACAAAA ACAAATTACA

 501 AAAACTATAC GGCGTATATG CGGAAGGAAG CGCCTGA
```

This corresponds to the amino acid sequence <SEQ ID 542; ORF 138.ng>:

```
g139.pep
   1 MRTTSTFPTK TFKPAAMALA VATTLSACLG GGGGGTSAPD FNAGGTGIGS

  51 NSRATIAESA AVSYAGIKNE MCKDRSMLCA GRDDVAVTDR DAKIKAPRIC

 101 IPETFQTQMT NIKNMINLKP AIEAGYTGRG VEVGIVDTGE SVGSISFPEL

 151 YGRKEHGYNE NYKNKLQKLY GVYAEGSA*
```

The following partial DNA sequence was identified in *N. meningitidis* <SEQ ID 543>:

```
m139.seq
   1 ATGCGAACGA CCCCAACCTT CCCTACAAAA ACTTTCAAAC CGACTGCCAT

  51 GGCGTTAGCT GTTGCAACAA CACTTTCTGC CTGCTTAGGC GGCGGCGGAG

 101 GCGGCACTTC TGCGCCCGAC TTCAATGCAG GCGGTACCGG TATCGGCAGC

 151 AACAGCAGAG CAACAACAGC GAAATCAGCA GCAGTATCTT ACGCCGGTAT

 201 CAAGAACGAA ATGTGCAAAG ACAGAAGCAT GCTCTGTGCC GGTCGGGATG

 251 ACGTTGCGGT TACAGACAGG GATGCCAAAA TCAATGCCCC CCCCCGAATC

 301 TGCATACCGG AGACTTTCCA AACCCAAATG ACGCATtACA AGAATTTGAT

 351 CAACCTCAAA CCTGCAATTG AAGCAGGCTA TACAGGACGC GGGGTAGAGG

 401 TAGGTATCGT CGACACAGGC GAATCCGTCG GCAGCATATC CTTTCCCGAA

 451 CTGTATGGCA GAAAAGAACA CGGCTATAAC GAAAATTACG AAAAACTATA

 501 CGGCGTATAT GCGGAAGGAA GCGCCTGA
```

This corresponds to the amino acid sequence <SEQ ID 544; ORF 138>:

```
m139.pep
   1 MRTTPTFPTK TFKPTAMALA VATTLSACLG GGGGGTSAPD FNAGGTGIGS

  51 NSRATTAKSA AVSYAGIKNE MCKDRSMLCA GRDDVAVTDR DAKINAPPRI

 101 CIPETFQTQM THYKNLINLK PAIEAGYTGR GVEVGIVDTG ESVGSISFPE

 151 LYGRKEHGYN ENYEKLYGVY AEGSA*
```

Computer analysis of this amino acid sequence gave the following results:

Homology with a Predicted ORF from *N. gonorrhoeae*

ORF 138 shows 92.2% identity over a 179 aa overlap with a predicted ORF (ORF 138.ng) from *N. gonorrhoeae*:

```
m139/g139

                    10        20        30        40        50        60
m139.pep    MRTTPTFPTKTFKPTAMALAVATTLSACLGGGGGGTSAPDFNAGGTGIGSNSRATTAKSA
            |||| |||||||||:|||||||||||||||||||||||||||||||||||||||| |:||
g139        MRTTSTFPTKTFKPAAMALAVATTLSACLGGGGGGTSAPDFNAGGTGIGSNSRATIAESA
                    10        20        30        40        50        60
                    70        80        90       100       110       120
m139.pep    AVSYAGIKNEMCKDRSMLCAGRDDVAVTDRDAKINAPPRICIPETFQTQMTHYKNLINLK
            ||||||||||||||||||||||||||||||||||:|| ||||||||||||||: ||:||||
g139        AVSYAGIKNEMCKDRSMLCAGRDDVAVTDRDAKIKAP-RICIPETFQTQMTNIKNMINLK
                    70        80        90       100       110
                     130       140       150       160            170
m139.pep      PAIEAGYTGRGVEVGIVDTGESVGSISFPELYGRKEHGYNENY----EKLYGVYAEGSAX
              |||||||||||||||||||||||||||||||||||||||||||    :||||||||||||
g139          PAIEAGYTGRGVEVGIVDTGESVGSISFPELYGRKEHGYNENYKNKLQKLYGVYAEGSAX
            120       130       140       150       160       170
```

The following partial DNA sequence was identified in *N. meningitidis* <SEQ ID 545>:

```
a139.seq
   1 ATGCGAACGA CCCCAACCTT CCCTACAAAA ACTTTCAAAC CGGCTGCCAT

  51 GGCGTTAGCT GTTGCAACAA CACTTTCTGC CTGCTTAGGC GGCGGCGGAG

 101 GCGGCACTTC TGCGCCCGAC TTCAATGCAG GCGGCACCGG TATCGGCAGC

 151 AACAGCAGGG CAACAACAGC GAAATCAGCA GCAATATCTT ACGCCGGTAT

 201 CAAGAACGAA ATGTGCAAAG ACAGAAGCAT GCTCTGTGCC GGTCGGGATG

 251 ACGTTGCGGT TACAGACAGG GATGCCAAAA TCAATGCCCC CCCCCGAATC

 301 TGCATACCGG AGACTTTACA AACCCAAATG ACGCAT.ACA AGAATTTGAT

 351 CAACCTCAAA CCTGCAATTG AAGCAGGCTA TACAGGACGC GGGGTAGAGG

 401 TAGGTATCGT CGACACAGGC GAATCCGTCG GCAGCATATC CTTTCCCGAA

 451 CTGTATGGCA GAAAAGAACA CGGCTATAAC GAAAATTAC. AAAAACTATA

 501 CGGCGTATAT GCGGAAGGAA GCGCCTGA
```

This corresponds to the amino acid sequence <SEQ ID 546; ORF 139.a>:

```
a139.pep
   1 MRTTPTFPTK TFKPAAMALA VATTLSACLG GGGGGTSAPD FNAGGTGIGS

  51 NSRATTAKSA AISYAGIKNE MCKDRSMLCA GRDDVAVTDR DAKINAPPRI
```

-continued

```
101 CIPETLQTQM THXKNLINLK PAIEAGYTGR GVEVGIVDTG ESVGSISFPE

151 LYGRKEHGYN ENYXKLYGVY AEGSA*
```

m139/a139 97.1% identity in 175 aa overlap

```
                 10        20        30        40        50        60
m139.pep MRTTPTFPTKTFKPTAMALAVATTLSACLGGGGGGTSAPDFNAGGTGIGSNSRATTAKSA
         ||||||||||||||:|||||||||||||||||||||||||||||||||||||||||||||
a139     MRTTPTFPTKTFKPAAMALAVATTLSACLGGGGGGTSAPDFNAGGTGIGSNSRATTAKSA
                 10        20        30        40        50        60

                 70        80        90       100       110       120
m139.pep AVSYAGIKNEMCKDRSMLCAGRDDVAVTDRDAKINAPPRICIPETFQTQMTHYKNLINLK
         |:|||||||||||||||||||||||||||||||||||||||||||:|||||| |||||||
a139     AISYAGIKNEMCKDRSMLCAGRDDVAVTDRDAKINAPPRICIPETLQTQMTHXKNLINLK
                 70        80        90       100       110       120

                130       140       150       160       170
m139.pep PAIEAGYTGRGVEVGIVDTGESVGSISFPELYGRKEHGYNENYEKLYGVYAEGSAX
         ||||||||||||||||||||||||||||||||||||||||||| ||||||||||||
a139     PAIEAGYTGRGVEVGIVDTGESVGSISFPELYGRKEHGYNENYXKLYGVYAEGSAX
                130       140       150       160       170
```

The following partial DNA sequence was identified in *N. gonorrhoeae* <*SEQ ID* 547>:

```
g140.seq
   1 Atgtcggcac gCGGCAAGGG GGCAGgctat ctcAACAGTA CCGGACGACa

  51 TGTTCCCTTC CTGAGTGCCG CCAAAATCGG GCAGGATTAT TCTTTCTTCA

 101 AAAATATCAA AACCGACGGC GGTCTGCTGG CTTCCCTCGA CAGCGTCGAA

 151 AAAACAGCGG GCAGTGAAGG CGACACGCCG TCCTATTATG TCCGTCGCGG

 201 CAATGCGGCA CGGACTGCTT CGGCAGCGGC ACATTCCGCG CCCGCCGGTC

 251 TGAAACACGC CGTAGAACAG GGCGGCAGCA ATCTGGAAAA CCTGATGGTC

 301 GAGCTGGATG CCTCCGAATC ATCCGCAACA CCCGAGACGG TTGAAACTGC

 351 GGTCGCCGAC CGCACAGATA TGCCGGGCAT CCGCCTACGG CGCACAACTT

 401 TCCGCACAGC GGCAGCCGTA CAGCATGCGA ATACCGCCGA CGGCGTACGc

 451 aTCTTcaaCA GTCTCGCCGC TAccgTCTAt GccgACAGTG CCGCCGCCCA

 501 TGccgATATG CAGGGACGCC GCCTGAAAGC CGTATCGGAC GGGTTGGACC

 551 ACAACGGTAC GGGTCTGCGC GTCATCGCGC AAACCCAACA GGACGGTGGA

 601 ACGTGGGAAC AGGGCGGTGT CGAAGGCAAA ATGCGCGGCA GTACCCAAAC

 651 TATCGGCATT GCCGCGAAAA CCGGCGAAAA TACGACAGCA GCCGCCACAC

 701 TGGGCATAGG ACGCAGCACA TGGAGCGAAA ACAGTGCAAA TGCAAAAACC

 751 GACAGCATTA GTCTGTTTGC AGGCATACGG CACGATGTGG GCGATATCGG

 801 CTATCTCAAA GGCCTGTTCT CctaCGGACG CTACAAAAAC AGCATCAGCC

 851 GCAGCACCGG TGCGGATGAA TATGCGGAAG GCAGCGTCAA CGGCACGCTG

 901 ATGCAGCTGG GCGCACTGGG TGGTGTCAAC GTTCCGTTTG CCGCAACGGG

 951 AGATTTGACG GTTGAAGGCG GTCTGCGCCA CGACCTGCTC AAACAGGATG

1001 CATTCGCCGA AAAAGGCagt GCTTTGGGCT GGAGCGGCAA CAGCCTCACT

1051 GAAGGCACAC TGGTCGGACT CGCGGGTCTG AAACTGTCGC AACCCTTGAG

1101 CGATAAAGCC GTCCTGTCTG CGACGGCGGG CGTGGAACGC GACCTGAACG

1151 GACGCGACTA CGCGGTAACG GGCGGCTTTA CCGGCGCGGC TGCAGCAACC

1201 GGCAAGACGG GTGCACGCAA TATGCCGCAC ACCCGCCGGG TTGCCGGTCT
```

-continued

```
1251 GGGGGTGGAT GTCGAATTCG GCAACGGCTG GAACGGCTTG GCACGTTACA

1301 GCTACACCGG TTCCAAACAG TACGGCAACC ACAGCGGACA AATCGGCGTA

1351 GGCTACCGGT TCTGA
```

This corresponds to the amino acid sequence <SEQ ID 548; ORF 140.ng>:

```
g140.pep
   1 MSARGKGAGY LNSTGRHVPF LSAAKIGQDY SFFKNIKTDG GLLASLDSVE

  51 KTAGSEGDTP SYYVRRGNAA RTASAAAHSA PAGLKHAVEQ GGSNLENLMV

 101 ELDASESSAT PETVETAVAD RTDMPGIRLR RTTFRTAAAV QHANTADGVR

 151 IFNSLAATVY ADSAAAHADM QGRRLKAVSD GLDHNGTGLR VIAQTQQDGG

 201 TWEQGGVEGK MRGSTQTIGI AAKTGENTTA AATLGIGRST WSENSANAKT

 251 DSISLFAGIR HDVGDIGYLK GLFSYGRYKN SISRSTGADE YAEGSVNGTL

 301 MQLGALGGVN VPFAATGDLT VEGGLRHDLL KQDAFAEKGS ALGWSGNSLT

 351 EGTLVGLAGL KLSQPLSDKA VLSATAGVER DLNGRDYAVT GGFTGAAAAT

 401 GKTGARNMPH TRRVAGLGVD VEFGNGWNGL ARYSYTGSKQ YGNHSGQIGV

 451 GYRF*
```

The following partial DNA sequence was identified in *N. meningitidis* <SEQ ID 549>:

```
m140.seq
   1 ATGTCGGCAC GCGGCAAGGG GGCAGGCTAT CTCAACAGTA CCGGACGACG

  51 TGTTCCCTTC CTGAGTGCCG CCAAAATCGG GCAGGATTAT TCTTTCTTCA

 101 CAAACATCGA AACCGACGGC GGCCTGCTGG CTTCCCTCGA CAGCGTCGAA

 151 AAAACAGCGG GCAGTGAAGG CGACACGCTG TCCTATTATG TCCGTCGCGG

 201 CAATGCGGCA CGGACTGCTT CGGCAGCGGC ACATTCCGCG CCCGCCGGTC

 251 TGAAACACGC CGTAGAACAG GGCGGCAGCA ATCTGGAAAA CCTGATGGTC

 301 GAACTGGATG CCTCCGAATC ATCCGCAACA CCCGAGACGG TTGAAACTGC

 351 GGCAGCCGAC CGCACAGATA TGCCGGGCAT CCGCCCCTAC GGCGCAACTT

 401 TCCGCGCAGC GGCAGCCGTA CAGCATGCGA ATGCCGCCGA CGGTGTACGC

 451 ATCTTCAACA GTCTCGCCGC TACCGTCTAT GCCGACAGTA CCGCCGCCCA

 501 TGCCGATATG CAGGGACGCC GCCTGAAAGC CGTATCGGAC GGGTTGGACC

 551 ACAACGGCAC GGGTCTGCGC GTCATCGCGC AAACCCAACA GGACGGTGGA

 601 ACGTGGGAAC AGGGCGGTGT TGAAGGCAAA ATGCGCGGCA GTACCCAAAC

 651 CGTCGGCATT GCCGCGAAAA CCGGCGAAAA TACGACAGCA GCCGCCACAC

 701 TGGGCATGGG ACGCAGCACA TGGAGCGAAA ACAGTGCAAA TGCAAAAACC

 751 GACAGCATTA GTCTGTTTGC AGGCATACGG CACGATGCGG GCGATATCGG

 801 CTATCTCAAA GGCCTGTTCT CCTACGGACG CTACAAAAAC AGCATCAGCC

 851 GCAGCACCGG TGCGGACGAA CATGCGGAAG GCAGCGTCAA CGGCACGCTG

 901 ATGCAGCTGG GCGCACTGGG CGGTGTCAAC GTTCCGTTTG CCGCAACGGG

 951 AGATTTGACG GTCGAAGGCG GTCTGCGCTA CGACCTGCTC AAACAGGATG

1001 CATTCGCCGA AAAAGGCAGT GCTTTGGGCT GGAGCGGCAA CAGCCTCACT
```

-continued

```
1051 GAAGGCACGC TGGTCGGACT CGCGGGTCTG AAGCTGTCGC AACCCTTGAG

1101 CGATAAAGCC GTCCTGTTTG CAACGGCGGG CGTGGAACGC GACCTGAACG

1151 GACGCGACTA CACGGTAACG GGCGGCTTTA CCGGCGCGAC TGCAGCAACC

1201 GGCAAGACGG GGGCACGCAA TATGCCGCAC ACCCGTCTGG TTGCCGGCCT

1251 GGGCGCGGAT GTCGAATTCG GCAACGGCTG GAACGGCTTG GCACGTTACA

1301 GCTACGCCGG TTCCAAACAG TACGGCAACC ACAGCGGACG AGTCGGCGTA

1351 GGCTACCGGT TCTGA
```

This corresponds to the amino acid sequence <SEQ ID 550; ORF 140>:

```
m140.pep
   1 MSARGKGAGY LNSTGRRVPF LSAAKIGQDY SFFTNIETDG GLLASLDSVE

  51 KTAGSEGDTL SYYVRRGNAA RTASAAAHSA PAGLKHAVEQ GGSNLENLMV

 101 ELDASESSAT PETVETAAAD RTDMPGIRPY GATFRAAAAV QHANAADGVR

 151 IFNSLAATVY ADSTAAHADM QGRRLKAVSD GLDHNGTGLR VIAQTQQDGG

 201 TWEQGGVEGK MRGSTQTVGI AAKTGENTTA AATLGMGRST WSENSANAKT

 251 DSISLFAGIR HDAGDIGYLK GLFSYGRYKN SISRSTGADE HAEGSVNGTL

 301 MQLGALGGVN VPFAATGDLT VEGGLRYDLL KQDAFAEKGS ALGWSGNSLT

 351 EGTLVGLAGL KLSQPLSDKA VLFATAGVER DLNGRDYTVT GGFTGATAAT

 401 GKTGARNMPH TRLVAGLGAD VEFGNGWNGL ARYSYAGSKQ YGNHSGRVGV

 451 GYRF*
```

Computer analysis of this amino acid sequence gave the following results:

Homology with a Predicted ORF from *N. gonorrhoeae*

ORF 140 shows 94.5% identity over a 454 aa overlap with a predicted ORF (ORF 140.ng) from *N. gonorrhoeae*:

```
m140/g140

                 10        20        30        40        50        60
m140.pep MSARGKGAGYLNSTGRRVPFLSAAKIGQDYSFFTNIETDGGLLASLDSVEKTAGSEGDTL
         ||||||||||||||||:|||||||||||||||| ||:||||||||||||||||||||||
g140     MSARGKGAGYLNSTGRHVPFLSAAKIGQDYSFFKNIKTDGGLLASLDSVEKTAGSEGDTP
                 10        20        30        40        50        60

                 70        80        90       100       110       120
m140.pep SYYVRRGNAARTASAAAHSAPAGLKHAVEQGGSNLENLMVELDASESSATPETVETAAAD
         |||||||||||||||||||||||||||||||||||||||||||||||||||||||||:||
g140     SYYVRRGNAARTASAAAHSAPAGLKHAVEQGGSNLENLMVELDASESSATPETVETAVAD
                 70        80        90       100       110       120

                130       140       150       160       170       180
m140.pep RTDMPGIRPYGATFRAAAAVQHANAADGVRIFNSLAATVYADSTAAHADMQGRRLKAVSD
         ||||||||   :|||:||||||||:||||||||||||||||||:||||||||||||||||
g140     RTDMPGIRLRRTTFRTAAAVQHANTADGVRIFNSLAATVYADSAAAHADMQGRRLKAVSD
                130       140       150       160       170       180

                190       200       210       220       230       240
m140.pep GLDHNGTGLRVIAQTQQDGGTWEQGGVEGKMRGSTQTVGIAAKTGENTTAAATLGMGRST
         |||||||||||||||||||||||||||||||||||||:|||||||||||||||||:||||
g140     GLDHNGTGLRVIAQTQQDGGTWEQGGVEGKMRGSTQTIGIAAKTGENTTAAATLGIGRST
                190       200       210       220       230       240

                250       260       270       280       290       300
m140.pep WSENSANAKTDSISLFAGIRHDAGDIGYLKGLFSYGRYKNSISRSTGADEHAEGSVNGTL
         ||||||||||||||||||||||:|||||||||||||||||||||||||||:|||||||||
g140     WSENSANAKTDSISLFAGIRHDVGDIGYLKGLFSYGRYKNSISRSTGADEYAEGSVNGTL
                250       260       270       280       290       300
```

-continued

```
                310         320         330         340         350         360
m140.pep MQLGALGGVNVPFAATGDLTVEGGLRYDLLKQDAFAEKGSALGWSGNSLTEGTLVGLAGL
         ||||||||||||||||||||||||||:|||||||||||||||||||||||||||||||||
g140     MQLGALGGVNVPFAATGDLTVEGGLRHDLLKQDAFAEKGSALGWSGNSLTEGTLVGLAGL
                310         320         330         340         350         360

                370         380         390         400         410         420
m140.pep KLSQPLSDKVALFATAGVERDLNGRDYTVTGGFTGATAATGKTGARNMPHTRLVAGLGAD
         ||||||||||| ||||||||||||||:||||||||:|||||||||||||||| |||||:|
g140     KLSQPLSDKAVLSATAGVERDLNGRDYAVTGGFTGAAAATGKTGARNMPHTRRVAGLGVD
                370         380         390         400         410         420

                430         440         450
m140.pep VEFGNGWNGLARYSYAGSKQYGNHSGRVGVGYRFX
         ||||||||||||||:||||||||||::|||||||
g140     VEFGNGWNGLARYSYTGSKQYGNHSGQIGVGYRFX
                430         440         450
```

The following partial DNA sequence was identified in *N. meningitidis* <SEQ ID 551>:

```
a140.seq
     1 ATGTCGGCAG GCGGTAAGGG GGCAGGCTAT CTCAACCGTA CCGGACAACG

    51 TGTTCCCTTC CTGAGTGCCG CCAAAATCGG GCGGGATTAT TCTTTCTTCA

   101 CAAACATCGA AACCGACGGC GGTCTGCTGG CTTCCCTCGA CAGCGTCGAA

   151 AAAACAGCGG GTAGTGAAGG CGACACGCTG TCCTATTATG TCCGTCGCGG

   201 CAATGCGGCA CGGACTGCTT CGGCAGCGGC ACATTCCGCG CCCGCCGGTC

   251 TGAAACACGC CGTAGAACAG GGCGGCAGCA ATCTGGAAAA CCTGATGGTC

   301 GAACTGGATG CCTCCGAATC ATCCGCAACA CCCGAGACGG TTGAAACTGC

   351 GGCCGCCGAC CGCACAGATA TGCCGGGCAT CCGCCCCTAC GGCGCAACTT

   401 TCCGCGCAGC GGCAGCCGTA CAGCATGCGA ATGCCGCCGA CGGTGTACGC

   451 ATCTTCAACA ATCTCGCCGC TACCGTCTAT GCCGACAGTA CCGCCGCCCA

   501 TGCCGATATG CAGGGACGCC GCCTGAAAGC CGTATCGGAC GGGTTGGACC

   551 ACAACGCTAC GGGTCTGCGC GTCATCGCGC AAACCCAACA GGACGGTGGA

   601 ACGTGGGAAC AGGGCGGTGT TGAAGGCAAA ATGCGCGGCA GTACCCAAAC

   651 CGTCGGCATT GCCGCGAAAA CCGGCGAAAA TACGACAGCA GCCGCCACAC

   701 TGGGCATGGG ACACAGCACA TGGAGCGAAA ACAGTGCAAA TGCAAAAACC

   751 GACAGCATTA GTCTGTTTGC AGGCATACGG CACGATGCGG GCGATATCGG

   801 CTATCTCAAA GGCCTGTTCT CCTACGGACG CTACAAAAAC AGCATCAGCC

   851 GCAGCACCGG TGCGGACGAA CATGCGGAAG GCAGCGTCAA CGGCACGCTG

   901 ATGCAGCTGG GCGCACTGGG CGGTGTCAAC GTTCCGTTTG CCGCAACGGG

   951 AGATTTGACG GTCGAAGGCG GTCTGCGCTA CGACCTGCTC AAACAGGATG

  1001 CATTCGCCGA AAAAGGCAGT GCTTTGGGCT GGAGCGGCAA CAGCATCACT

  1051 GAAGGCACAC TGGTCGGACT CGCGGGTCTG AAGCTGTCGC AACCCTTGAG

  1101 CGATAAAGCC GTCCTGTTTG CAACGGCGGG CGTGGAACGC GACCTGAACG

  1151 GACGCGACTA CACGGTAACG GGCGGCTTTA CCGGCGCGAC TGCAGCAACC

  1201 GGCAAGACGG GGGCACGCAA TATGCCGCAC ACCCGCCTGG TTGCCGGTCT

  1251 GGGCGCGGAT GTCGAATTCG GCAACGGCTG GAACGGCTTG GCACGTTACA

  1301 GCTACGCCGG TTCCAAACAG TACGGCAACC ACAGCGGACG AGTCGGCGTA

  1351 GGCTACCGGT TCTGA
```

This corresponds to the amino acid sequence <SEQ ID 552; ORF 140.a>:

```
a140.pep
    1 MSAGGKGAGY LNRTGQRVPF LSAAKIGRDY SFFTNIETDG GLLASLDSVE

   51 KTAGSEGDTL SYYVRRGNAA RTASAAAHSA PAGLKHAVEQ GGSNLENLMV

  101 ELDASESSAT PETVETAAAD RTDMPGIRPY GATFRAAAAV QHANAADGVR

  151 IFNNLAATVY ADSTAAHADM QGRRLKAVSD GLDHNATGLR VIAQTQQDGG

  201 TWEQGGVEGK MRGSTQTVGI AAKTGENTTA AATLGMGHST WSENSANAKT

  251 DSISLFAGIR HDAGDIGYLK GLFSYGRYKN SISRSTGADE HAEGSVNGTL

  301 MQLGALGGVN VPFAATGDLT VEGGLRYDLL KQDAFAEKGS ALGWSGNSIT

  351 EGTLVGLAGL KLSQPLSDKA VLFATAGVER DLNGRDYTVT GGFTGATAAT

  401 GKTGARNMPH TRLVAGLGAD VEFGNGWNGL ARYSYAGSKQ YGNHSGRVGV

  451 GYRF*
```

m140/a140 98.2% identity in 454 aa overlap

```
                   10        20        30        40        50        60
m140.pep   MSARGKGAGYLNSTGRRVPFLSAAKIGQDYSFFTNIETDGGLLASLDSVEKTAGSEGDTL
           ||| |||||||| ||:|||||||||||:||||||||||||||||||||||||||||||||
a140       MSAGGKGAGYLNRTGQRVPFLSAAKIGRDYSFFTNIETDGGLLASLDSVEKTAGSEGDTL
                   10        20        30        40        50        60

                   70        80        90       100       110       120
m140.pep   SYYVRRGNAARTASAAAHSAPAGLKHAVEQGGSNLENLMVELDASESSATPETVETAAAD
           ||||||||||||||||||||||||||||||||||||||||||||||||||||||||||||
a140       SYYVRRGNAARTASAAAHSAPAGLKHAVEQGGSNLENLMVELDASESSATPETVETAAAD
                   70        80        90       100       110       120

                  130       140       150       160       170       180
m140.pep   RTDMPGIRPYGATFRAAAAVQHANAADGVRIFNSLAATVYADSTAAHADMQGRRLKAVSD
           |||||||||||||||||||||||||||||||||:||||||||||||||||||||||||| 
a140       RTDMPGIRPYGATFRAAAAVQHANAADGVRIFNNLAATVYADSTAAHADMQGRRLKAVSD
                  130       140       150       160       170       180

                  190       200       210       220       230       240
m140.pep   GLDHNGTGLRVIAQTQQDGGTWEQGGVEGKMRGSTQTVGIAAKTGENTTAAATLGMGRST
           |||||:|||||||||||||||||||||||||||||||||||||||||||||||||||:||
a140       GLDHNATGLRVIAQTQQDGGTWEQGGVEGKMRGSTQTVGIAAKTGENTTAAATLGMGHST
                  190       200       210       220       230       240

                  250       260       270       280       290       300
m140.pep   WSENSANAKTDSISLFAGIRHDAGDIGYLKGLFSYGRYKNSISRSTGADEHAEGSVNGTL
           ||||||||||||||||||||||||||||||||||||||||||||||||||||||||||||
a140       WSENSANAKTDSISLFAGIRHDAGDIGYLKGLFSYGRYKNSISRSTGADEHAEGSVNGTL
                  250       260       270       280       290       300

                  310       320       330       340       350       360
m140.pep   MQLGALGGVNVPFAATGDLTVEGGLRYDLLKQDAFAEKGSALGWSGNSLTEGTLVGLAGL
           ||||||||||||||||||||||||||||||||||||||||||||||||:|||||||||||
a140       MQLGALGGVNVPFAATGDLTVEGGLRYDLLKQDAFAEKGSALGWSGNSITEGTLVGLAGL
                  310       320       330       340       350       360

                  370       380       390       400       410       420
m140.pep   KLSQPLSDKAVLFATAGVERDLNGRDYTVTGGFTGATAATGKTGARNMPHTRLVAGLGAD
           ||||||||||||||||||||||||||||||||||||||||||||||||||||||||||||
a140       KLSQPLSDKAVLFATAGVERDLNGRDYTVTGGFTGATAATGKTGARNMPHTRLVAGLGAD
                  370       380       390       400       410       420

                  430       440       450
m140.pep   VEFGNGWNGLARYSYAGSKQYGNHSGRVGVGYRFX
           |||||||||||||||||||||||||||||||||||
a140       VEFGNGWNGLARYSYAGSKQYGNHSGRVGVGYRFX
                  430       440       450
```

The following partial DNA sequence was identified in *N. gonorrhoeae* <SEQ ID 553>:

```
g141.seq
   1 atgagcttca aAAccgATGC CGAAACCGCC CAATCCTCCA CCATGCGCCC
  51 GATTGGCGAA ATTGCCGCCA AGCTGGGTTT GAACGTTGAC AACATTGAGC
 101 CTTACGGTCA TTACAAAGCC AAAATCAATC CTGCCGAAGC GTTCAAGCTG
 151 CCGCAAAAAC AAGGCAGGCT GATTTTGGTT ACCGCCATCA ACCCGACTCC
 201 GGCGGGCGAA GGCAAAACCA CCGTAACCAT CGGTTTGGCG GACGCATTGC
 251 GCCATATCGG CAAAGACTCT GTGATTGCTT TGCGCGAGCC TTCTTTGGGT
 301 CCGGTGTTCG GCGTGAAAGG CGGCGCGGCA GGCGGCGGCT ACGCGCAAGT
 351 TTTGCCGATG GAAGACATCA ACCTGCACTT CACCGGCGAC TTCCACGCCA
 401 TCGGTGCGGC GAATAACCTC CTCGCCGCCA TGCTCGACAA CCATATCTAC
 451 CAAGGTAACG AGTTGAACAT CGACCCCAAA CGCGTGCTGT GGCGGCGCGT
 501 GGTCGATATG AACGACCGCC AGTTGCGCAA CATCATCGAC GGTATGGGCA
 551 AGCCTGTtga cggCGTGATG CGtcccGACG GCTTCGACAT CACCGTCGCC
 601 TCCGAAGTGa tggcgGTATT CTGCCTTGCC AAAGACATCA GCGATTTGAA
 651 AGAGCGTTtt gGCAATATTC TCGTCGCCTA CGCCAAAGAC GGCAGCCCCG
 701 TTTACGCCAA AGATTTGAAG GCACACGGCG CGATGGCGGC ATTGCTAAAA
 751 GATGCGATTA AGCCCAATTT GGTGCAAACC ATCGAAGGCA CTCCGGCCTT
 801 TGTACACGGC GGCCCGTTCG CCAACATCGC CCACGGCTGC AACTCCGTTA
 851 CCGCAACCCG TCTGGCGAAA CACCTTGCCG ATTACGCCGT AACCGAAGCA
 901 GGCTTCGGCG CGGACTTGGG TGCGGAAAAA TTCTGCGACA TCAAATGCCG
 951 CCTTGCCGGT TTGAAACCTG ATGCGGCAGT CGTCGTGGCG ACTGTCCGCG
1001 CCCTGAAATA CAACGGCGGC GTGGAACGCG CCAACCTTGG TGAAGAAAAC
1051 CTCGAAGCCT TGGCAAAAGG TTTGCCCAAC CTGTTGAAAC ACATTTCCAA
1101 CCTGAAAAAC GTATTCGGAC TGCCCGTCGT CGTTGCGCTC AACCGCTTCG
1151 TGTCCGACTC CGATGCCGAG TTGGCGATGA TTGAAAAAGC CTGTGCCGAA
1201 CACGGCGTTG AAGTTTCCCT GACCGAAGTG TGGGGCAAAG GCGGCGCGGG
1251 CGGCGCGGAT TTGGCGCGCA AAGTCGTCAA TGCCATCGAC AACCAACCTA
1301 ATAACTTCGG TTTCGCCTAC GATGTCGAGT TGGGCATCAA AGACAAAATC
1351 CGTGCGATTG CCCAAAAAGT GTACGGCGCG GAAGATGTCG ATTTCAGCGC
1401 GGAAGCGTCT GCCGAAATCG CCTCGCTGGA AAAACTGGGC TTGGACAAAA
1451 TGCCGATCTG CATGGCGAAA ACCCAATATT CATTGAGCGA CAACGCCAAA
1501 CTCTTGGGCT GCCCCGAAGG CTTCCGCATC GCCGTACGCG GTATCACTGT
1551 TTCCGCCGGC GCGGGCTTCA TCGTTGCGTT GTGCGGCAAT ATGATGAAAA
1601 TGCCGGGCCT GCCGAAAGTT CCGGCTGCCG AGAAAATCGA TGTGGACGAA
1651 CACGGCGTGA TTCACGGCTT GTTCTGA
```

This corresponds to the amino acid sequence <SEQ ID 554; ORF 141.ng>:

```
g141.pep
   1 MSFKTDAETA QSSTMRPIGE IAAKLGLNVD NIEPYGHYKA KINPAEAFKL
```

-continued

51 PQKQGRLILV TAINPTPAGE GKTTVTIGLA DALRHIGKDS VIALREPSLG

101 PVFGVKGGAA GGGYAQVLPM EDINLHFTGD FHAIGAANNL LAAMLDNHIY

151 QGNELNIDPK RVLWRRVVDM NDRQLRNIID GMGKPVDGVM RPDGFDITVA

201 SEVMAVFCLA KDISDLKERF GNILVAYAKD GSPVYAKDLK AHGAMAALLK

251 DAIKPNLVQT IEGTPAFVHG GPFANIAHGC NSVTATRLAK HLADYAVTEA

301 GFGADLGAEK FCDIKCRLAG LKPDAAVVVA TVRALKYNGG VERANLGEEN

351 LEALAKGLPN LLKHISNLKN VFGLPVVVAL NRFVSDSDAE LAMIEKACAE

401 HGVEVSLTEV WGKGGAGGAD LARKVVNAID NQPNNFGFAY DVELGIKDKI

451 RAIAQKVYGA EDVDFSAEAS AEIASLEKLG LDKMPICMAK TQYSLSDNAK

501 LLGCPEGFRI AVRGITVSAG AGFIVALCGN MMKMPGLPKV PAAEKIDVDE

551 HGVIHGLF*

The following partial DNA sequence was identified in *N. meningitidis* <SEQ ID 555>:

m141.seq

1 ATGAGCTTCA AAACCGATGC CGAAATCGCC CAATCCTCCA CCATGCGCCC

51 GATTGGCGAA ATTGCCGCCA AGCTTGGTCT GAATGCCGAC AACATTGAGC

101 CTTACGGTCA TTACAAGGCG AAAATCAATC CTGCCGAAGC GTTCAAACTG

151 CCGCAAAAAC AGGGCAGGCT GATTTTGGTT ACCGCCATCA ACCCGACTCC

201 GGCGGGCGAA GGCAAAACCA CCGTAACCAT CGGTTTGGCG GACGCGTTGC

251 GCCACATCGG CAAAGATGCC GTGATTGCCC TGCGCGAACC TTCTCTGGGG

301 CCGGTGTTCG GCGTGAAAGG CGGCGCGGCA GGCGGCGGCT ATGCCCAAGT

351 TTTGCCGATG GAAGACATCA ACCTGCACTT CACCGGAGAT TTTCACGCCA

401 TCGGTGCGGC AAATAATCTG CTTGCCGCGA TGCTCGACAA CCATATCTAC

451 CAAGGCAACG AGTTGAACAT CGACCCCAAA CGCGTGCTGT GGCGGCGCGT

501 GGTCGATATG AACGACCGCC AGTTGCGCAA CATCATCGAC GGCATGGGTA

551 AACCCGTTGA CGGCGTGATG CGTCCTGACG GTTTCGATAT TACCGTTGCT

601 TCCGAAGTGA TGGCGGTATT CTGTCTTGCC AAAGACATCA GCGATTTGAA

651 AGAGCGTTTG GGCAACATCC TTGTCGCCTA CGCCAAAGAC GGCAGCCCCG

701 TTTACGCCAA AGATTTGAAA GCGAATGGCG CGATGGCGGC ATTGCTTAAA

751 GATGCGATTA AGCCCAACTT GGTGCAAACC ATCGAAGGCA CGCCCGCCTT

801 CGTACACGGC GGCCCGTTCG CCAACATCGC CCACGGCTGC AACTCCGTAA

851 CCGCAACCCG TCTGGCGAAA CACCTTGCCG ATTACGCCGT AACCGAAGCA

901 GGCTTCGGCG CGGACTTGGG CGCGGAAAAA TTCTGCGACA TCAAATGCCG

951 CCTTGCCGGT TTGAAACCTG ATGCGGCTGT TGTCGTGGCG ACTGTCCGCG

1001 CGTTGAAATA TAACGGCGGC GTGGAACGCG CCAACCTCGG CGAAGAAAAT

1051 TTAGACGCTT TGGAAAAAGG TTTGCCCAAC CTGCTGAAAC ACATTTCCAA

1101 CCTGAAAAAC GTATTCGGAC TGCCCGTCGT CGTTGCGCTC AACCGCTTCG

1151 TGTCCGACGC CGATGCCGAG TTGGCGATGA TTGAAAAAGC CTGTGCCGAA

1201 CACGGCGTTG AAGTTTCCCT GACCGAAGTG TGGGGCAAAG GTGGTGCGGG

1251 CGGCGCGGAT TTGGCGCGCA AAGTCGTCAA CGCCATTGAA AGTCAAACCA

-continued

```
1301 ATAACTTCGG TTTCGCCTAC GATGTCGAGT TGGGCATCAA AGACAAAATC

1351 CGTGCGATTG CCCAAAAAGT GTACGGCGCG GAAGATGTTG ATTTCAGCGC

1401 GGAAGCGTCT GCCGAAATCG CTTCACTGGA AAAACTGGGC TTGGACAAAA

1451 TGCCGATCTG CATGGCGAAA ACCCAATACT CTTTGAGCGA CAACGCCAAA

1501 CTGTTGGGCT GCCCCGAAGA CTTCCGCATC GCCGTGCGCG GCATCACCGT

1551 TTCCGCAGGC GCAGGTTTCA TCGTCGCCCT GTGCGGCAAC ATGATGAAAA

1601 TGCCCGGCCT GCCCAAAGTT CCGGCTGCCG AGAAAATCGA TGTGGACGCA

1651 GAAGGCGTGA TTCACGGCTT GTTCTGA
```

This corresponds to the amino acid sequence <SEQ ID 556; ORF 141>:

```
m141.pep
  1 MSFKTDAEIA QSSTMRPIGE IAAKLGLNAD NIEPYGHYKA KINPAEAFKL

 51 PQKQGRLILV TAINPTPAGE GKTTVTIGLA DALRHIGKDA VIALREPSLG

101 PVFGVKGGAA GGGYAQVLPM EDINLHFTGD FHAIGAANNL LAAMLDNHIY

151 QGNELNIDPK RVLWRRVVDM NDRQLRNIID GMGKPVDGVM RPDGFDITVA

201 SEVMAVFCLA KDISDLKERL GNILVAYAKD GSPVYAKDLK ANGAMAALLK

251 DAIKPNLVQT IEGTPAFVHG GPFANIAHGC NSVTATRLAK HLADYAVTEA

301 GFGADLGAEK FCDIKCRLAG LKPDAAVVVA TVRALKYNGG VERANLGEEN

351 LDALEKGLPN LLKHISNLKN VFGLPVVVAL NRFVSDADAE LAMIEKACAE

401 HGVEVSLTEV WGKGGAGGAD LARKVVNAIE SQTNNFGFAY DVELGIKDKI

451 RAIAQKVYGA EDVDFSAEAS AEIASLEKLG LDKMPICMAK TQYSLSDNAK

501 LLGCPEDFRI AVRGITVSAG AGFIVALCGN MMKMPGLPKV PAAEKIDVDA

551 EGVIHGLF*
```

Computer analysis of this amino acid sequence gave the following results:

Homology with a Predicted ORF from *N. gonorrhoeae*

ORF 141 shows 97.5% identity over a 558 aa overlap with a predicted ORF (ORF 141.ng) from *N. gonorrhoeae*:

```
m141/g141

                    10        20        30        40        50        60
m141.pep    MSFKTDAEIAQSSTMRPIGEIAAKLGLNADNIEPYGHYKAKINPAEAFKLPQKQGRLILV
            |||||||| |||||||||||||||||||:|||||||||||||||||||||||||||||||
g141        MSFKTDAETAQSSTMRPIGEIAAKLGLNVDNIEPYGHYKAKINPAEAFKLPQKQGRLILV
                    10        20        30        40        50        60

                    70        80        90       100       110       120
m141.pep    TAINPTPAGEGKTTVTIGLADALRHIGKDAVIALREPSLGPVFGVKGGAAGGGYAQVLPM
            |||||||||||||||||||||||||||||:||||||||||||||||||||||||||||||
g141        TAINPTPAGEGKTTVTIGLADALRHIGKDSVIALREPSLGPVFGVKGGAAGGGYAQVLPM
                    70        80        90       100       110       120

                   130       140       150       160       170       180
m141.pep    EDINLHFTGDFHAIGAANNLLAAMLDNHIYQGNELNIDPKRVLWRRVVDMNDRQLRNIID
            ||||||||||||||||||||||||||||||||||||||||||||||||||||||||||||
g141        EDINLHFTGDFHAIGAANNLLAAMLDNHIYQGNELNIDPKRVLWRRVVDMNDRQLRNIID
                   130       140       150       160       170       180

                   190       200       210       220       230       240
m141.pep    GMGKPVDGVMRPDGFDITVASEVMAVFCLAKDISDLKERLGNILVAYAKDGSPVYAKDLK
            |||||||||||||||||||||||||||||||||||||||:||||||||||||||||||||
g141        GMGKPVDGVMRPDGFDITVASEVMAVFCLAKDISDLKERFGNILVAYAKDGSPVYAKDLK
                   190       200       210       220       230       240
```

-continued

```
                  250       260       270       280       290       300
m141.pep   ANGAMAALLKDAIKPNLVQTIEGTPAFVHGGPFANIAHGCNSVTATRLAKHLADYAVTEA
           |:||||||||||||||||||||||||||||||||||||||||||||||||||||||||||
g141       AHGAMAALLKDAIKPNLVQTIEGTPAFVHGGPFANIAHGCNSVTATRLAKHLADYAVTEA
                  250       260       270       280       290       300

                  310       320       330       340       350       360
m141.pep   GFGADLGAEKFCDIKCRLAGLKPDAAVVVATVRALKYNGGVERANLGEENLDALEKGLPN
           |||||||||||||||||||||||||||||||||||||||||||||||||||:|| |||||
g141       GFGADLGAEKFCDIKCRLAGLKPDAAVVVATVRALKYNGGVERANLGEENLEALAKGLPN
                  310       320       330       340       350       360

                  370       380       390       400       410       420
m141.pep   LLKHISNLKNVFGLPVVVALNRFVSDADAELAMIEKACAEHGVEVSLTEVWGKGGAGGAD
           ||||||||||||||||||||||||||||:|||||||||||||||||||||||||||||||
g141       LLKHISNLKNVFGLPVVVALNRFVSDADSELAMIEKACAEHGVEVSLTEVWGKGGAGGAD
                  370       380       390       400       410       420

                  430       440       450       460       470       480
m141.pep   LARKVVNAIESQTNNFGFAYDVELGIKDKIRAIAQKVYGAEDVDFSAEASAEIASLEKLG
           |||||||||::| |||||||||||||||||||||||||||||||||||||||||||||||
g141       LARKVVNAIDNQPNNFGFAYDVELGIKDKIRAIAQKVYGAEDVDFSAEASAEIASLEKLG
                  430       440       450       460       470       480

                  490       500       510       520       530       540
m141.pep   LDKMPICMAKTQYSLSDNAKLLGCPEDFRIAVRGITVSAGAGFIVALCGNMMKMPGLPKV
           |||||||||||||||||||||||||| |||||||||||||||||||||||||||||||||
g141       LDKMPICMAKTQYSLSDNAKLLGCPEGFRIAVRGITVSAGAGFIVALCGNMMKMPGLPKV
                  490       500       510       520       530       540

                  550       559
m141.pep   PAAEKIDVDAEGVIHGLFX
           ||||||||| :||||||||
g141       PAAEKIDVDEHGVIHGLFX
                  550       559
```

The following partial DNA sequence was identified in *N. meningitidis* <SEQ ID 557>:

```
a141.seq
   1 ATGAGTTTCA AAACCGATGC CGAAATCGCC CAATCCTCCA CCATGCGCCC

  51 GATTGGCGAA ATTGCCGCCA AGCTGGGTTT GAACGTTGAC AACATTGAGC

 101 CTTACGGTCA TTACAAAGCC AAAATCAATC CTGCCGAAGC GTTCAAACTG

 151 CCGCAAAAAC AGGGCAGGCT GATTTTGGTT ACCGCCATCA ACCCGACTCC

 201 GGCGGGCGAA GGTAAAACCA CCGTAACCAT CGGTTTGGCG GACGCATTGC

 251 GCCATATCGG CAAAGACTCT GTGATTGCTT TGCGCGAGCC TTCTTTGGGT

 301 CCGGTGTTCG GCGTGAAAGG CGGCGCGGCA GGCGGCGGCT ATGCCCAAGT

 351 TTTGCCGATG GAAGACATCA ACCTGCACTT CACCGGAGAT TTTCACGCCA

 401 TCGGTGCGGC AAATAATCTG CTTGCCGCGA TGCTCGACAA CCATATCTAC

 451 CAAGGCAACG AGTTGAACAT CGACCCCAAA CGCGTGCTGT GGCGGCGCGT

 501 GGTCGATATG AACGACCGCC AGTTGCGCAA CATCATCGAC GGCATGGGCA

 551 AGCCTGTTGA CGGCGTGATG CGTCCTGACG GTTTCGATAT TACCGTTGCT

 601 TCCGAAGTGA TGGCGGTATT CTGTCTTGCC AAAGACATCA GCGATTTGAA

 651 AGAGCGTTTG GGCAACATCC TTGTCGCCTA CGCCAAAGAC GGCAGCCCCG

 701 TTTACGCCAA AGATTTGAAA GCGAATGGCG CGATGGCGGC ATTGCTTAAA

 751 GATGCGATTA AGCCCAACTT GGTGCAAACC ATCGAAGGCA CGCCCGCCTT

 801 CGTACACGGC GGCCCGTTCG CCAACATCGC CCACGGCTGC AACTCCGTAA

 851 CCGCAACCCG TCTGGCGAAA CACCTTGCCG ATTACGCCGT AACCGAAGCA

 901 GGCTTCGGCG CGGACTTGGG CGCGGAAAAA TTCTGCGACA TCAAATGCCG

 951 CCTTGCCGGT TTGAAACCTG ATGCGGCTGT TGTCGTGGCG ACTGTCCGCG

1001 CGTTGAAATA TAACGGCGGC GTGGAACGCG CCAACCTCGG CGAAGAAAAT
```

-continued

```
1051 TTAGACGCTT TGGAAAAAGG TTTGCCCAAC CTGCTGAAAC ACATTTCCAA

1101 CCTGAAAAAC GTATTCGGAC TGCCCGTCGT CGTTGCGCTC AACCGCTTCG

1151 TGTCCGACTC CGATGCCGAG TTGGCGATGA TTGAAAAAGC CTGTGCCGAA

1201 CACGGCGTTG AAGTTTCCCT GACCGAAGTG TGGGGCAAAG GTGGTGCGGG

1251 CGGCGCGGAT TTGGCGCGCA AAGTCGTCAA CGCCATTGAA AGTCAAACCA

1301 ATAACTTCGG TTTCGCCTAC GATGTCGAGT TGGGCATCAA AGACAAAATC

1351 CGTGCGATTG CCCAAAAAGT GTACGGCGCG GAAGATGTTG ATTTCAGCGC

1401 GGAAGCGTCT GCCGAAATCG CTTCACTGGA AAAACTGGGC TTGGACAAAA

1451 TGCCGATCTG CATGGCGAAA ACCCAATACT CTTTGAGCGA CAACGCCAAA

1501 CTGTTGGGCT GCCCCGAAGA CTTCCGCATC GCCGTGCGCG GCATCACCGT

1551 TTCCGCAGGC GCAGGTTTCA TCGTCGCCCT GTGCGGCAAC ATGATGAAAA

1601 TGCCCGGCCT GCCCAAAGTT CCGGCTGCCG AGAAAATCGA TGTGGACGCA

1651 GAAGGCGTGA TTCACGGCTT GTTCTGA
```

This corresponds to the amino acid sequence <SEQ ID 558; ORF 141.a>:

```
a141.pep
   1 MSFKTDAEIA QSSTMRPIGE IAAKLGLNVD NIEPYGHYKA KINPAEAFKL

  51 PQKQGRLILV TAINPTPAGE GKTTVTIGLA DALRHIGKDS VIALREPSLG

 101 PVFGVKGGAA GGGYAQVLPM EDINLHFTGD FHAIGAANNL LAAMLDNHIY

 151 QGNELNIDPK RVLWRRVVDM NDRQLRNIID GMGKPVDGVM RPDGFDITVA

 201 SEVMAVFCLA KDISDLKERL GNILVAYAKD GSPVYAKDLK ANGAMAALLK

 251 DAIKPNLVQT IEGTPAFVHG GPFANIAHGC NSVTATRLAK HLADYAVTEA

 301 GFGADLGAEK FCDIKCRLAG LKPDAAVVVA TVRALKYNGG VERANLGEEN

 351 LDALEKGLPN LLKHISNLKN VFGLPVVVAL NRFVSDSDAE LAMIEKACAE

 401 HGVEVSLTEV WGKGGAGGAD LARKVVNAIE SQTNNFGFAY DVELGIKDKI

 451 RAIAQKVYGA EDVDFSAEAS AEIASLEKLG LDKMPICMAK TQYSLSDNAK

 501 LLGCPEDFRI AVRGITVSAG AGFIVALCGN MMKMPGLPKV PAAEKIDVDA

 551 EGVIHGLF*
```

m141/a141 99.5% identity in 558 aa overlap

```
                    10        20        30        40        50        60
m141.pep    MSFKTDAEIAQSSTMRPIGEIAAKLGLNADNIEPYGHYKAKINPAEAFKLPQKQGRLILV
            ||||||||||||||||||||||||||||:|||||||||||||||||||||||||||||||
a141        MSFKTDAEIAQSSTMRPIGEIAAKLGLNVDNIEPYGHYKAKINPAEAFKLPQKQGRLILV
                    10        20        30        40        50        60

                    70        80        90       100       110       120
m141.pep    TAINPTPAGEGKTTVTIGLADALRHIGKDAVIALREPSLGPVFGVKGGAAGGGYAQVLPM
            |||||||||||||||||||||||||||||:||||||||||||||||||||||||||||||
a141        TAINPTPAGEGKTTVTIGLADALRHIGKDSVIALREPSLGPVFGVKGGAAGGGYAQVLPM
                    70        80        90       100       110       120

                   130       140       150       160       170       180
m141.pep    EDINLHFTGDFHAIGAANNLLAAMLDNHIYQGNELNIDPKRVLWRRVVDMNDRQLRNIID
            ||||||||||||||||||||||||||||||||||||||||||||||||||||||||||||
a141        EDINLHFTGDFHAIGAANNLLAAMLDNHIYQGNELNIDPKRVLWRRVVDMNDRQLRNIID
                   130       140       150       160       170       180
```

-continued

```
                190         200         210         220         230         240
m141.pep    GMGKPVDGVMRPDGFDITVASEVMAVFCLAKDISDLKERLGNILVAYAKDGSPVYAKDLK
            ||||||||||||||||||||||||||||||||||||||||||||||||||||||||||||
a141        GMGKPVDGVMRPDGFDITVASEVMAVFCLAKDISDLKERLGNILVAYAKDGSPVYAKDLK
                190         200         210         220         230         240

                250         260         270         280         290         300
m141.pep    ANGAMAALLKDAIKPNLVQTIEGTPAFVHGGPFANIAHGCNSVTATRLAKHLADYAVTEA
            ||||||||||||||||||||||||||||||||||||||||||||||||||||||||||||
a141        ANGAMAALLKDAIKPNLVQTIEGTPAFVHGGPFANIAHGCNSVTATRLAKHLADYAVTEA
                250         260         270         280         290         300

                310         320         330         340         350         360
m141.pep    GFGADLGAEKFCDIKCRLAGLKPDAAVVVATVRALKYNGGVERANLGEENLDALEKGLPN
            ||||||||||||||||||||||||||||||||||||||||||||||||||||||||||||
a141        GFGADLGAEKFCDIKCRLAGLKPDAAVVVATVRALKYNGGVERANLGEENLDALEKGLPN
                310         320         330         340         350         360

                370         380         390         400         410         420
m141.pep    LLKHISNLKNVFGLPVVVALNRFVSDADAELAMIEKACAEHGVEVSLTEVWGKGGAGGAD
            ||||||||||||||||||||||||||||:|||||||||||||||||||||||||||||||
a141        LLKHISNLKNVFGLPVVVALNRFVSDADSELAMIEKACAEHGVEVSLTEVWGKGGAGGAD
                370         380         390         400         410         420

                430         440         450         460         470         480
m141.pep    LARKVVNAIESQTNNFGFAYDVELGIKDKIRAIAQKVYGAEDVDFSAEASAEIASLEKLG
            ||||||||||||||||||||||||||||||||||||||||||||||||||||||||||||
a141        LARKVVNAIESQTNNFGFAYDVELGIKDKIRAIAQKVYGAEDVDFSAEASAEIASLEKLG
                430         440         450         460         470         480

                490         500         510         520         530         540
m141.pep    LDKMPICMAKTQYSLSDNAKLLGCPEDFRIAVRGITVSAGAGFIVALCGNMMKMPGLPKV
            ||||||||||||||||||||||||||||||||||||||||||||||||||||||||||||
a141        LDKMPICMAKTQYSLSDNAKLLGCPEDFRIAVRGITVSAGAGFIVALCGNMMKMPGLPKV
                490         500         510         520         530         540

                550       559
m141.pep    PAAEKIDVDAEGVIHGLFX
            |||||||||||||||||||
a141        PAAEKIDVDAEGVIHGLFX
                550
```

The following partial DNA sequence was identified in *N. gonorrhoeae* <SEQ ID 559>:

```
g142.seq
    1 ATGCGTGCCG ATTTCATGTT TGCCGACAAT ATGCCCGTGC AGGTGCGCCA

   51 ACGCGCCTTC TATTTCAAGT TGTCCCGTTT TGCCGCGATG CCAAATATGG

  101 TAGGCAAACC GCTCTTCGGG CGACAGGCCG GTCAGCCCGG CAAAATGTTC

  151 GGCAACATCC TGATGTTCGT CCGCCAGCAT ATTGATGCAG AGgCTGCCGT

  201 TTTCCGACAG GATcggaATG AttcgCGCAC TCCGGTTTAT GCACAGCATC

  251 ACGGTCGGCG GCTCGTCGGT AACCGGCGCA ACCGCCGTCA TTGTAATGCC

  301 GTAACGCCCT GCCGCACCGT CTGTCGTGAT GACATGAACG CCTGCCGCAC

  351 AGGATGCCAT CGCATCACGG AACGAAGTTT GAAAAGTTTT CTGCAAATCC

  401 GCCATTTTTC CCCTTTAAAC CGTCCCCTAT ATAAGAATGC TGCACACAAG

  451 GCATCCCCCC ATGTGCAGCA GTTCTGA
```

This corresponds to the amino acid sequence <SEQ ID 560; ORF 142.ng>:

```
g142.pep
    1 MRADFMFADN MPVQVRQRAF YFKLSRFAAM PNMVGKPLFG RQAGQPGKMF

   51 GNILMFVRQH IDAEAAVFRQ DRNDSRTPVY AQHHGRRLVG NRRNRRHCNA

  101 VTPCRTVCRD DMNACRTGCH RITERSLKSF LQIRHFSPLN RPLYKNAAHK

  151 ASPHVQQF*
```

The following partial DNA sequence was identified in *N. meningitidis* <SEQ ID 561>:

```
m142.seq
    1 ATGCGTGCCG ATTTCATGTT TGCCGACAAT ATGCCCGTGC AGGTGCGCCA

   51 ACGCGCCCTC TATTTCAAGT TGTCCCGTTT TGCCGCGATG CCAGATGTGG

  101 TAGGCAAACC GCTCTTCGGG CGACAGGCCG GTCAGCCCGG CAAAATGTTC

  151 GGCAACATCC TGATGTTCGT CCGCCAGCGT ATTGATGCAG AGGCTGCCGT

  201 TTTCCGACAG GATCGGAATG ATTCGCGCAC TCCGGTTGAT GCACAGCATC

  251 ACGGTCGGCG GCTCGTCGGT AACCGGCGCG ACCGCCGTCA TTGTAATGCC

  301 GTAACGCCCT GCCGCACCGT CTGTCGTGAT GACATGAACG CCTGCCGCGC

  351 AAGATGCCAT CGCATCACGG AACGAAGTTT GAAAATTTTT CTGCAAATCC

  401 GCCATTTTTC CCCTTTAAAC TGTCCCCTAT ATAAGAATGC TGCACACAAG

  451 GCATCCCCcC ATGTGCAGCA GTTTTGA
```

This corresponds to the amino acid sequence <SEQ ID 562; ORF 142>:

```
m142.pep
    1 MRADFMFADN MPVQVRQRAL YFKLSRFAAM PDVVGKPLFG RQAGQPGKMF

   51 GNILMFVRQR IDAEAAVFRQ DRNDSRTPVD AQHHGRRLVG NRRDRRHCNA

  101 VTPCRTVCRD DMNACRARCH RITERSLKIF LQIRHFSPLN CPLYKNAAHK

  151 ASPHVQQF*
```

Computer analysis of this amino acid sequence gave the following results:

Homology with a Predicted ORF from *N. gonorrhoeae*

ORF 142 shows 93.7% identity over a 158 aa overlap with a predicted ORF (ORF 142.ng) from *N. gonorrhoeae*:

```
m142/g142

                  10        20        30        40        50        60
m142.pep MRADFMFADNMPVQVRQRALYFKLSRFAAMPDVVGKPLFGRQAGQPGKMFGNILMFVRQR
         ||||||||||||||||||:|||||||||||||::|||||||||||||||||||||||||:
g142     MRADFMFADNMPVQVRQRAFYFKLSRFAAMPNMVGKPLFGRQAGQPGKMFGNILMFVRQH
                  10        20        30        40        50        60

                  70        80        90       100       110       120
m142.pep IDAEAAVFRQDRNDSRTPVDAQHHGRRLVGNRRDRRHCNAVTPCRTVCRDDMNACRARCH
         ||||||||||||||||||| |||||||||||||:||||||||||||||||||||||: ||
g142     IDAEAAVFRQDRNDSRTPVYAQHHGRRLVGNRRNRRHCNAVTPCRTVCRDDMNACRTGCH
                  70        80        90       100       110       120

                 130       140       150      159
m142.pep RITERSLKIFLQIRHFSPLNCPLYKNAAHKASPHVQQFX
         |||||||| ||||||||||| |||||||||||||||||
g142     RITERSLKSFLQIRHFSPLNRPLYKNAAHKASPHVQQFX
                 130       140       150
```

The following partial DNA sequence was identified in *N. meningitidis* <SEQ ID 563>:

```
    1 ATGCGTGCCG ATTTCATGTT TGCCGACAAT ATGCCCGTGC AGGTGCGCCA

   51 ACGCGCCCTC TATTTCAAGT TGTCCCGTTT TGCCGCGATG CCAGATGTGG

  101 TAGGCAAACC GCTCTTCGGG CGACAGGCCG GTCAGCCCGG CAAAATGTTC

  151 GGCAACATCC TGATGTTCGT CCGCCAGCGT ATTGATGCAG AGGCTGCCGT

  201 TTTCCGACAG GATCGGAATG ATTCGCGCAC TCCGGTTGAT GCACAGCATC
```

-continued

```
251 ACGGTCGGCG GCTCGTCCGT AACCGGCGCA ACCGCCGTCA TTGTAATGCC

301 GTAACGCCCT GCCGCACCGT CTGTCGTGAT GACATGAACG CCTGCCGCAC

351 AGGATGCCAT CGCATCACGG AACGAAGTTT GAAAAGTTTT CTGCAAATCC

401 GCCATTTTTC CCCTTTAAAC TGTCCCCTAT ATAAGAATGC TGCACACAAG

451 GCACCCCCCA TGTGCAGCAG TTCTGATTCA AAAAGCCGTC GGTCGGACAT

501 TTCCGCGCGT TACGGCGTAT TACGAGTTCA ACGCATCCTC GATTTTGGCA

551 AGTTCTGCCA ACAGGTCTTT AAGCAGCAGC ATTTTCTCGC GGCCCAGCAC

601 TTCCTCGATA GCGTCGTAAC GCTCGTCCAC TTCTTCGCCG ATTTCCTCAT

651 ACAGCTTCTC GCCCTCGGCA GTCAGCTTCA GAAAAACACG TCGTTGGTCG

701 TTGGAAGGTT TCAGGCGGAC AACCAAACCC GCTTTTTCAA GGCGGGTCAG

751 GATACCGGTC AGGCTGGGGC GCAAAATGCA CGCCTGATTC GCCAAATCTT

801 GAAAGTCCAG CGTGCCGTTT TCCGCCAAAA GACGGATAAT CCGCCATTGC

851 TGATCGGTAA TATTCGCCTG ATTCAGAATA GGCCTGAATT GGGTCATCAG

901 GGCTTCCCTT GCCTGTATCA GACCGATATT GATAGACGCA TGTTTTGA
```

This corresponds to the amino acid sequence <SEQ ID 564; ORF 142.a>:

```
a142.pep
    1 MRADFMFADN MPVQVRQRAL YFKLSRFAAM PDVVGKPLFG RQAGQPGKMF

   51 GNILMFVRQR IDAEAAVFRQ DRNDSRTPVD AQHHGRRLVR NRRNRRHCNA

  101 VTPCRTVCRD DMNACRTGCH RITERSLKSF LQIRHFSPLN CPLYKNAAHK

  151 APPMCSSSDS KSRRSDISAR YGVLRVQRIL DFGKFCQQVF KQQHFLAAQH

  201 FLDSVVTLVH FFADFLIQLL ALGSQLQKNT SLVVGRFQAD NQTRFFKAGQ

  251 DTGQAGAQNA RLIRQILKVQ RAVFRQKTDN PPLLIGNIRL IQNRPELGHQ

  301 GFPCLYQTD IDRRMF*
```

m142/a142 96.1% identity in 153 aa overlap

```
                    10        20        30        40        50        60
m142.pep    MRADFMFADNMPVQVRQRALYFKLSRFAAMPDVVGKPLFGRQAGQPGKMFGNILMFVRQR
            ||||||||||||||||||||||||||||||||||||||||||||||||||||||||||||
a142        MRADFMFADNMPVQVRQRALYFKLSRFAAMPDVVGKPLFGRQAGQPGKMFGNILMFVRQR
                    10        20        30        40        50        60

                    70        80        90       100       110       120
m142.pep    IDAEAAVFRQDRNDSRTPVDAQHHGRRLVGNRRDRRHCNAVTPCRTVCRDDMNACRARCH
            ||||||||||||||||||||||||||||| |||:||||||||||||||||||||||: ||
a142        IDAEAAVFRQDRNDSRTPVDAQHHGRRLVRNRRNRRHCNAVTPCRTVCRDDMNACRTGCH
                    70        80        90       100       110       120

                   130       140       150      159
m142.pep    RITERSLKIFLQIRHFSPLNCPLYKNAAHKASPHVQQFX
            |||||||| |||||||||||||||||||||| |
a142        RITERSLKSFLQIRHFSPLNCPLYKNAAHKAPPMCSSSDSKSRRSDISARYGVLRVQRIL
                   130       140       150       160       170       180

a142        DFGKFCQQVFKQQHFLAAQHFLDSVVTLVHFFADFLIQLLALGSQLQKNTSLVVGRFQAD
                   190       200       210       220       230       240
```

The following partial DNA sequence was identified in *N. gonorrhoeae* <SEQ ID 565>:

```
g143.seq
    1 ATGTTGAGCT TCGGCTATCT CGGCGTTCAG ACGGCCTTTA CCCTGCAAAG
```

-continued

```
  51 CTCGCAGATG AGCCGCATTT TTCAAACGCT AGGCGCAGAC CCGCACAATT
 101 TGGGCTGGTT TTTCATCCTG CCGCCGCTGG CGGGGATGCT GGTTCAGCCG
 151 ATAGTGgGCT ACTACTCAGA CCGCACTTGG AAGCCGCGCT TGGGCGGCCG
 201 CCGCCTGCCG TATCTGCTTT ACGGCACGCT GATTGCGGTC ATCGTGATGA
 251 TTTTGATGCC GAACTCGGGC AGCTTCGGTT TCGGCTATGC GTCGCTGGCG
 301 GCCTTGTCGT TCGGCGCGCT GATGATTGCG CTGTTGGACG TGTCGTCGAA
 351 TATGGCGATG CAGCCGTTTA AGATGATGGT CGGCGATATG GTCAACGAGG
 401 AGCAGAAAAG CTACGCCTAC GGGATTCAAA GTTTCTTAGC GAATACGGAC
 451 GCGGTTGTGG CAGCGATTCT GCCGTTTGTG TTcgcgtata TCGGTTTGGC
 501 GAACACTGCC GAGAAAGGCG TTGTGCCACA AACCGTGGTC GTAGCATTCT
 551 ATGTGGGTGC GGCGTTACTG ATTATTACCA GTGCGTTCAC AATCTCCAAA
 601 GTCAAAGAAT ACGACCCGGA AACCTACGCC CGTTACCACG GCATCGATGT
 651 CGCCGCGAAT CAGGAAAAAG CCAACTGGTT CGAACTCTTA AAAACCGCGC
 701 CTAAAGTGTT TTGGACGGTT ACTCCGGTAC AGTTTTTCTG CTGGTTCGCC
 751 TTCCGGTATA TGTGGACTTA CTCGGCAGGC GCGATTGCAG AAAACGTCTG
 801 GCACACTACC GATGCGTCTT CCGTAGGCCA TCAGGAGGCG GGCAACCGGT
 851 ACGGCGTTTT GGCGGCGGTG TAGTCGGTTG CGGCGGTGAT TTGTTCGTTT
 901 ATTCTGGCAA AAGTACCGAA TAAATACCAT AAGGCGGGTT ATTTCGGCTG
 951 TTTGGCTTTG GGCGCGCTCG GTTTCTTCTC TATCTTCTTC ATCTACAATC
1001 AATACGCACT CATCCTGTCT TATATCTTAA TCGGCATCGC TTGGGCGGGC
1051 ATTATCACTT ATCCGCTGAC GATTGTGGCC AACGCTTTGT CGGGCAAACA
1101 CATGGATACT TATTTGGGCC TGTttaacgg ctctgtCTGT ATGCcgcaaa
1151 tcgTcgctTC GctgttgAGT TTCGTGCTTT TCCCGATGCT GGGCGGCCAT
1201 CAGGCAACCA TGTTCTTGGT TGCAGGCGCA GTCTTGCTGC TGGGAGCCTT
1251 CTCAGTCTGT CTGATTAAAG AGATCCACGG CGGGGTTTGA
```

This corresponds to the amino acid sequence <SEQ ID 566; ORF 143.ng>:

```
g143.pep
  1 MLSFGYLGVQ TAFTLQSSQM SRIFQTLGAD PHNLGWFFIL PPLAGMLVQP
 51 IVGYYSDRTW KPRLGGRRLP YLLYGTLIAV IVMILMPNSG SFGFGYASLA
101 ALSFGALMIA LLDVSSNMAM QPFKMMVGDM VNEEQKSYAY GIQSFLANTD
151 AVVAAILPFV FAYIGLANTA EKGVVPQTVV VAFYVGAALL IITSAFTISK
201 VKEYDPETYA RYHGIDVAAN QEKANWFELL KTAPKVFWTV TPVQFFCWFA
251 FRYMWTYSAG AIAENVWHTT DASSVGHQEA GNRYGVLAAV *SVAAVICSF
301 ILAKVPNKYH KAGYFGCLAL GALGFFSIFF IYNQYALILS YILIGIAWAG
351 IITYPLTIVA NALSGKHMDT YLGLFNGSVC MPQIVASLLS FVLFPMLGGH
401 QATMFLVAGA VLLLGAFSVC LIKEIHGGV*
```

The following partial DNA sequence was identified in *N. meningitidis* <SEQ ID 567>:

```
m143.seq
   1 ATGCTCAGTT TCGGCTTTCT CGGCGTTCAG ACGGCCTTTA CCCTGCAAAG

  51 CTCGCAAATG AGCCGCATTT TTCAAACGCT AGGCGCAGAC CCGCACAATT

 101 TGGGCTGGTT TTTCATCCTG CCGCCGCTGG CGGGGATGCT GGTGCAGCCG

 151 ATTGTCGGCC ATTACTCCGA CCGCACTTGG AAGCCGCGTT TGGGCGGCCG

 201 CCGTCTGCCG TATCTGCTTT ATGGCACGCT GATTGCGGTT ATTGTGATGA

 251 TTTTGATGCC GAACTCGGGC AGCTTCGGTT TCGGCTATGC GTCGCTGGCG

 301 GCTTTGTCGT TCGGCGCGCT GATGATTGCG CTGTTAGACG TGTCGTCAAA

 351 TATGGCGATG CAGCCGTTTA AGATGATGGT CGGCGACATG GTCAACGAGG

 401 AGCAGAAAGG CTACGCCTAC GGGATTCAAA GTTTCTTAGC AAATACGGGC

 451 GCGGTCGTGG CGGCGATTCT GCCGTTTGTG TTTGCGTATA TCGGTTTGGC

 501 GAACACCGCC GAGAAAGGCG TTGTGCCGCA GACCGTGGTC GTGGCGTTTT

 551 ATGTGGGTGC GGCGTTGCTG GTGATTACCA GCGCGTTCAC GATTTTCAAA

 601 GTGAAGGAAT ACGATCCGGA AACCTACGCC CGTTACCACG GCATCGATGT

 651 CGCCGCGAAT CAGGAAAAAG CCAACTGGAT CGAACTCTTG AAAACCGCGC

 701 CTAAGGCGTT TTGGACGGTT ACTTTGGTGC AATTCTTCTG CTGGTTCGCC

 751 TTCCAATATA TGTGGACTTA CTCGGCAGGC GCGATTGCGG AAAACGTCTG

 801 GCACACCACC GATGCGTCTT CCGTAGGTTA TCAGGAGGCG GGTAACTGGT

 851 ACGGCGTTTT GGCGGCGGTG CAGTCGGTTG CGGCGGTGAT TTGTTCGTTT

 901 GTATTGGCGA AAGTGCCGAA TAAATACCAT AAGGCGGGTT ATTTCGGCTG

 951 TTTGGCTTTG GGCGCGCTCG GCTTTTTCTC CGTTTTCTTC ATCGGCAACC

1001 AATACGCGCT GGTGTTGTCT TATACCTTAA TCGGCATCGC TTGGGCGGGC

1051 ATTATCACTT ATCCGCTGAC GATTGTGACC AACGCCTTGT CGGGCAAGCA

1101 TATGGGCACT TACTTGGGCT TGTTTAACGG CTCTATCTGT ATGCCTCAAA

1151 TCGTCGCTTC GCTGTTGAGT TTCGTGCTTT TCCCTATGCT GGGCGGCTTG

1201 CAGGCCACTA TGTTCTTGGT AGGGGGCGTC GTCCTGCTGC TGGGCGCGTT

1251 TTCCGTGTTC CTGATTAAAG AAACACACGG CGGGGTTTGA
```

This corresponds to the amino acid sequence <SEQ ID 568; ORF 143>:

```
m143.pep
  1 MLSFGFLGVQ TAFTLQSSQM SRIFQTLGAD PHNLGWFFIL PPLAGMLVQP

 51 IVGHYSDRTW KPRLGGRRLP YLLYGTLIAV IVMILMPNSG SFGFGYASLA

101 ALSFGALMIA LLDVSSNMAM QPFKMMVGDM VNEEQKGYAY GIQSFLANTG

151 AVVAAILPFV FAYIGLANTA EKGVVPQTVV VAFYVGAALL VITSAFTIFK

201 VKEYDPETYA RYHGIDVAAN QEKANWIELL KTAPKAFWTV TLVQFFCWFA

251 FQYMWTYSAG AIAENVWHTT DASSVGYQEA GNWYGVLAAV QSVAAVICSF

301 VLAKVPNKYH KAGYFGCLAL GALGFFSVFF IGNQYALVLS YTLIGIAWAG

351 IITYPLTIVT NALSGKHMGT YLGLFNGSIC MPQIVASLLS FVLFPMLGGL

401 QATMFLVGGV VLLLGAFSVF LIKETHGGV*
```

Computer analysis of this amino acid sequence gave the following results:

Homology with a Predicted ORF from *N. gonorrhoeae*

```
m143/g143  93.9% identity in 429 aa overlap

                    10        20        30        40        50        60
m143.pep    MLSFGFLGVQTAFTLQSSQMSRIFQTLGADPHNLGWFFILPPLAGMLVQPIVGHYSDRTW
            |||||:|||||||||||||||||||||||||||||||||||||||||||||||:||||||
g143        MLSFGYLGVQTAFTLQSSQMSRIFQTLGADPHNLGWFFILPPLAGMLVQPIVGYYSDRTW
                    10        20        30        40        50        60

                    70        80        90       100       110       120
m143.pep    KPRLGGRRLPYLLYGTLIAVIVMILMPNSGSFGFGYASLAALSFGALMIALLDVSSNMAM
            ||||||||||||||||||||||||||||||||||||||||||||||||||||||||||||
g143        KPRLGGRRLPYLLYGTLIAVIVMILMPNSGSFGFGYASLAALSFGALMIALLDVSSNMAM
                    70        80        90       100       110       120

                   130       140       150       160       170       180
m143.pep    QPFKMMVGDMVNEEQKGYAYGIQSFLANTGAVVAAILPFVFAYIGLANTAEKGVVPQTVV
            ||||||||||||||||:|||||||||||| ||||||||||||||||||||||||||||||
g143        QPFKMMVGDMVNEEQKSYAYGIQSFLANTDAVVAAILPFVFAYIGLANTAEKGVVPQTVV
                   130       140       150       160       170       180

                   190       200       210       220       230       240
m143.pep    VAFYVGAALLVITSAFTIFKVKEYDPETYARYHGIDVAANQEKANWIELLKTAPKAFWTV
            ||||||||||:||||||| |||||||||||||||||||||||||||:||||||||:||||
g143        VAFYVGAALLIITSAFTISKVKEYDPETYARYHGIDVAANQEKANWFELLKTAPKVFWTV
                   190       200       210       220       230       240

                   250       260       270       280       290       300
m143.pep    TLVQFFCWFAFQYMWTYSAGAIAENVWHTTDASSVGYQEAGNWYGVLAAVQSVAAVICSF
            | |||||||||:||||||||||||||||||||||||:||||| ||||||| |||||||||
g143        TPVQFFCWFAFRYMWTYSAGAIAENVWHTTDASSVGHQEAGNRYGVLAAVXSVAAVICSF
                   250       260       270       280       290       300

                   310       320       330       340       350       360
m143.pep    VLAKVPNKYHKAGYFGCLALGALGFFSVFFIGNQYALVLSYTLIGIAWAGIITYPLTIVT
            :||||||||||||||||||||||||||:||| |||||:||| |||||||||||||||||:
g143        ILAKVPNKYHKAGYFGCLALGALGFFSIFFIYNQYALILSYILIGIAWAGIITYPLTIVA
                   310       320       330       340       350       360

                   370       380       390       400       410       420
m143.pep    NALSGKHMGTYLGLFNGSICMPQIVASLLSFVLFPMLGGLQATMFLVGGVVLLLGAFSVF
            |||||||| |||||||||:|||||||||||||||||||| |||||||:|:||||||||||
g143        NALSGKHMDTYLGLFNGSVCMPQIVASLLSFVLFPMLGGHQATMFLVAGAVLLLGAFSVF
                   370       380       390       400       410       420

                   430
m143.pep    LIKETHGGVX
            |||| |||||
g143        LIKEIHGGVX
                   430
```

The following partial DNA sequence was identified in *N. meningitidis* <SEQ ID 569>:

```
a143.seq
   1 ATGCTCAGTT TCGGCTTTCT CGGCGTTCAG ACGGCCTTTA CCCTGCAAAG

  51 CTCGCAGATG AGCCGCATCT TCCAGACGCT CGGTGCCGAT CCGCACAGCC

 101 TCGGCTGGTT CTTTATCCTG CCGCCGCTGG CGGGGATGCT GGTGCAGCCG

 151 ATTGTCGGCC ATTACTCCGA CCGCACTTGG AAGCCGCGTT TGGGCGGCCG

 201 CCGTCTGCCG TATCTGCTTT ATGGCACGCT GATTGCGGTT ATTGTGATGA

 251 TTTTGATGCC GAACTCGGGC AGCTTCGGTT TCGGCTATGC GTCGCTGGCG

 301 GCTTTGTCGT TCGGCGCGCT GATGATTGCG CTGTTAGACG TGTCGTCAAA

 351 TATGGCGATG CAGCCGTTTA AGATGATGGT CGGCGACATG GTCAACGAGG

 401 AGCAGAAAGG CTACGCCTAC GGGATTCAAA GTTTCTTAGC GAATACGGGC

 451 GCGGTCGTGG CGGCGATTCT GCCGTTTGTG TTTGCGTATA TCGGTTTGGC

 501 GAACACCGCC GAGAAAGGCG TTGTGCCGCA GACCGTGGTC GTGGCGTTTT

 551 ATGTGGGTGC GGCGTTGCTG GTGATTACCA GCGCGTTCAC GATTTTCAAA
```

```
-continued
 601 GTGAAGGAAT ACAATCCGGA AACCTACGCC CGTTACCACG GCATCGATGT
 651 CGCCGCGAAT CAGGAAAAAG CCAACTGGAT CGAACTCTTG AAAACCGCGC
 701 CTAAGGCGTT TTGGACGGTT ACTTTGGTGC AATTCTTCTG CTGGTTCGCC
 751 TTCCAATATA TGTGGACTTA CTCGGCAGGC GCGATTGCGG AAAACGTCTG
 801 GCACACCACC GATGCGTCTT CCGTAGGTTA TCAGGAGGCG GGTAACTGGT
 851 ACGGCGTTTT GGCGGCGGTG CAGTCGGTTG CGGCGGTGAT TTGTTCGTTT
 901 GTATTGGCGA AAGTGCCGAA TAAATACCAT AAGGCGGGTT ATTTCGGCTG
 951 TTTGGCTTTG GGCGCGCTCG GCTTTTTCTC CGTTTTCTTC ATCGGCAACC
1001 AATACGCGCT GGTGTTGTCT TATACCTTAA TCGGCATCGC TTGGGCGGGC
1051 ATTATCACTT ATCCGCTGAC GATTGTGACC AACGCCTTGT CGGGCAAGCA
1101 TATGGGCACT TACTTGGGCC TGTTTAACGG CTCTATCTGT ATGCCGCAAA
1151 TCGTCGCTTC GCTGTTGAGT TTCGTGCTTT TCCCTATGCT GGGCGGCTTG
1201 CAGGCCACTA TGTTCTTGGT AGGGGGCGTC GTCCTGCTGC TGGGCGCGTT
1251 TTCCGTGTTC CTGATTAAAG AAACACACGG CGGGGTTTGA
```

This corresponds to the amino acid sequence <SEQ ID 570; ORF 143.a>:

```
a143.pep

     1 MLSFGFLGVQ TAFTLQSSQM SRIFQYLGAD PHSLGWFFIL PPLAGMLVQP

    51 IVGHYSDRTW KPRLGGRRLP YLLYGTLIAV IVMILMPNSG SFGFGYASLA

   101 ALSFGALMIA LLDVSSNMAM QPFKMMVGDM VNEEQKGYAY GIOQSLANTG

   151 AVVAAILPFV FAYIGLANTA EKGVVPQTVV VAFYVGAALL VITSAFTIFK

   201 VKEYNPETYA RYHGIDVAAN QEKANWIELL KTAPKAFWTV TLVQFFCWFA

   251 FQYMWTYSAG AIAENVWHTT DASSVGYQEA GNWYGVLAAV QSVAAVICSF

   301 VLAKVPNKYH KAGYFGCLAL GALGFFSVFF IGNQYALVLS YTLIGIAWAG

   351 IITYPLTIVT NALSGKHMGT YLGLFNGSIC MPQIVASLLS FVLFPMLGGL

   401 QATMFLVGGV VLLGAFSVF LIKETHGGV*

m143/a143  99.5% identity in 429 aa overlap

                  10         20         30         40         50         60
m143.pep  MLSFGFLGVQTAFTLQSSQMSRIFQTLGADPHNLGWFFILPPLAGMLVQPIVGHYSDRTW
          ||||||||||||||||||||||||||||||:||||||||||||||||||||||||||||
a143      MLSFGFLGVQTAFTLQSSQMSRIFQTLGADPHSLGWFFILPPLAGMLVQPIVGHYSDRTW
                  10         20         30         40         50         60

                  70         80         90        100        110        120
m143.pep  KPRLGGRRLPYLLYGTLIAVIVMILMPNSGSFGFGYASLAALSFGALMIALLDVSSNMAM
          ||||||||||||||||||||||||||||||||||||||||||||||||||||||||||||
a143      KPRLGGRRLPYLLYGTLIAVIVMILMPNSGSFGFGYASLAALSFGALMIALLDVSSNMAM
                  70         80         90        100        110        120

                 130        140        150        160        170        180
m143.pep  QPFKMMVGDMVNEEQKGYAYGIQSFLANTGAVVAAILPFVFAYIGLANTAEKGVVPQTVV
          ||||||||||||||||||||||||||||||||||||||||||||||||||||||||||||
a143      QPFKMMVGDMVNEEQKGYAYGIQSFLANTGAVVAAILPFVFAYIGLANTAEKGVVPQTVV
                 130        140        150        160        170        180

                 190        200        210        220        230        240
m143.pep  VAFYVGAALLVITSAFTIFKVKEYDPETYARYHGIDVAANQEKANWIELLKTAPKAFWTV
          |||||||||||||||||||||||||:||||||||||||||||||||||||||||||||||
a143      VAFYVGAALLVITSAFTIFKVKEYNPETYARYHGIDVAANQEKANWIELLKTAPKAFWTV
                 190        200        210        220        230        240

                 250        260        270        280        290        300
m143.pep  TLVQFFCWFAFQYMWTYSAGAIAENVWHTTDASSVGYQEAGNWYGVLAAVQSVAAVICSF
          ||||||||||||||||||||||||||||||||||||||||||||||||||||||||||||
a143      TLVQFFCWFAFQYMWTYSAGAIAENVWHTTDASSVGYQEAGNWYGVLAAVQSVAAVICSF
                 250        260        270        280        290        300
```

-continued

```
                310         320         330         340         350         360
m143.pep    VLAKVPNKYHKAGYFGCLALGALGFFSVFFIGNQYALVLSYTLIGIAWAGIITYPLTIVT
            ||||||||||||||||||||||||||||||||||||||||||||||||||||||||||||
a143        VLAKVPNKYHKAGYFGCLALGALGFFSVFFIGNQYALVLSYTLIGIAWAGIITYPLTIVT
                310         320         330         340         350         360

                370         380         390         400         410         420
m143.pep    NALSGKHMGTYLGLFNGSICMPQIVASLLSFVLFPMLGGLQATMFLVGGVVLLLGAFSVF
            ||||||||||||||||||||||||||||||||||||||||||||||||||||||||||||
a143        NALSGKHMGTYLGLFNGSICMPQIVASLLSFVLFPMLGGLQATMFLVGGVVLLLGAFSVF
                370         380         390         400         410         420

                430
m143.pep    LIKETHGGVX
            ||||||||||
a143        LIKETHGGVX
                430
```

The following partial DNA sequence was identified in *N. gonorrhoeae* <SEQ ID 571>:

```
g144.seq
  1 ATGAGCGATA CCCCCGCTAC CCGCGATTTC GGCCTGATCG ACGGGCGGGC

 51 CGTAACCGGC TATGTGCTGT CCAACCGGCG TGGTACGTGC GTCTTCGTGC

101 TGGACTTGGG CGGGATTGTG CAGGAATTTT CCGTTTTGGC AGACGGCGTG

151 CGCGAAAACC CCGTGGTGTC GTTCGACGAT GCGGCTTCCT ATGCGGACAA

201 TCCGTTTCAG ATTAACAAGC AGATAGGGCG CGTGGCCGGA CGCATCCGCG

251 GTGCGGCGTT CGACATCAAC GGTAGGACTT ACCGCGTGGA GGCCAACGAA

301 GGCAGGAACG CGCTGCACGG CGGTTCGCAC GGGCTGGCCG TTACCcgtTT

351 CAACGCGGTG GCGGCAGACG GccgacggTt atCCCAACGA TTTGGatatT

401 TCctaccgCT TGGACGAGGA CGGCCGGCTT ACCGTtaccT ATCGCGCCAC

451 CGCgctCGGC GACACGGTGT TCGACCCGAC GCTGCACATT TACTGGCGGC

501 TGGACGCGGG CCTGCACGAT GCGGTTCTGC ATATTCCGCA GGGCGGACAT

551 ATTCCGGCCG ATGCCGAAAA ACTGCCCGTC TTAACGGTTT CAGACGGCCT

601 CGAAGTATTT GA
```

This corresponds to the amino acid sequence <SEQ ID 572; ORF 144.ng>:

```
g144.pep
  1 MSDTPATRDF GLIDGRAVTG YVLSNRRGTC VFVLDLGGIV QEFSVLADGV

 51 RENPVVSFDD AASYADNPFQ INKQIGRVAG RIRGAAFDIN GRTYRVEANE

101 GRNALHGGSH GLAVTRFNAV AADGRRLSQR FGYFLPLGRG RPAYRYLSRH

151 RARRHGVRPD AAHLLAAGRG PARCGSAYSA GRTYSGRCRK TARLNGFRRP

201 RSI*
```

The following partial DNA sequence was identified in *N. meningitidis* <SEQ ID 573>:

```
m144.seq
  1 ATGAGCGATA CCCCCGCTAC CCGCGATTTC GGTCTGATCG ACGGGCGTGC

 51 CGTAACCGGC TATGTGCTGT CCAACCGGCG TGGTACGCGT GTCTGCGTGC

101 TGGACTTGGG CGGGATTGTG CAGGAATTTT CCGTTTTGGC AGACGGCGTG

151 CGCGAAAACC TCGTGGTGTC GTTCGATGAT GCGGCTTCCT ATGCGGACAA
```

-continued

```
201 TCCGTTTCAG ATTAACAAAC AGATAGGGCG CGTGGCCGGA CGCATCCGCG

251 GTGCGGCGTT CGACATCAAC GGCAGGACTT ACCGCGTGGA GGCCAACGAA

301 GGCAGGAACG CGCTGCACGG CGGTTCGCAC GGGCTGGCCG TTACCCGTTT

351 CAACGCGGTG GCGGCAGACG GCCGTTCGGT GGTGCTGCGC AGCCGCCTGg

401 CAACAGTCGG CCGACGGTTA TCCCAACGAT TTGGATTTGG ATATTTCCTA

451 CCGCTTGGAC GAGGACGACC GGCTTACCGT TAcCTATCGC GCCACCGCGC

501 TCGGCGACAC GGTGTTCGAC CCGACGCTGC ACATTTACTG GCGGCTGGAC

551 GCGGGCCTGC ACGATGCGGT TCTGCATATT CCGCAGGGCG GACATATGCC

601 GGCCGATGCC GAAAAACTGC CCGTCTCAAC GGTTTCAGAC GACCTCGAAG

651 TATTTGA
```

This corresponds to the amino acid sequence <SEQ ID 574; ORF 144>:

```
m144.pep
  1 MSDTPATRDF GLIDGRAVTG YVLSNRRGTR VCVLDLGGIV QEFSVLADGV

 51 RENLVVSFDD AASYADNPFQ INKQIGRVAG RIRGAAFDIN GRTYRVEANE

101 GRNALHGGSH GLAVTRFNAV AADGRSVVLR SRLATVGRRL SQRFGFGYFL

151 PLGRGRPAYR YLSRHRARRH GVRPDAAHLL AAGRGPARCG SAYSAGRTYA

201 GRCRKTARLN GFRRPRSI*
```

Computer analysis of this amino acid sequence gave the following results:

Homology with a Predicted ORF from *N. gonorrhoeae*

```
m144/g144  91.3% identity in 218 aa overlap

                   10        20        30        40        50        60
m144.pep   MSDTPATRDFFLIDGRAVTGYVLSNRRGTRVCVLDLGGIVQEFSVLADGVRENLVVSFDD
           |||||||||||||||||||||||||||||| | |||||||||||||||||||| ||||||
g144       MSDTPATRDFFLIDGRAVTGYVLSNRRGTCVFVLDLGGIVQEFSVLADGVRENPVVSFDD
                   10        20        30        40        50        60

                   70        80        90       100       110       120
m144.pep   AASYADNPFQINKQIGRVAGRIRGAAFDINGRTYRVEANEGRNALHGGSHGLAVTRFNAV
           ||||||||||||||||||||||||||||||||||||||||||||||||||||||||||||
g144       AASYADNPFQINKQIGRVAGRIRGAAFDINGRTYRVEANEGRNALHGGSHGLAVTRFNAV
                   70        80        90       100       110       120

                  130       140       150       160       170       180
m144.pep   AADGRSVVLRSRLATVGRRLSQRFGFGYFLPLGRGRPAYRYLSRHRARRHGVRPDAAHLL
           |||             ||||||||| ||||||||||||||||||||||||||||||||||
g144       AAD-------------GRRLSQRFG--YFLPLGRGRPAYRYLSRHRARRHGVRPDAAHLL
                              130       140       150       160

                  190       200       210      219
m144.pep   AAGRGPARCGSAYSAGRTYAGRCRKTARLNGFRRPRSIX
           |||||||||||||||||||:|||||||||||||||||||
g144       AAGRGPARCGSAYSAGRTYSGRCRKTARLNGFRRPRSIX
             170       180       190       200
```

The following partial DNA sequence was identified in *N. meningitidis* <SEQ ID 575>:

```
a144.seq
  1 ATGAGCGATA CCCCCGCTAC CCGCGATTTC GGCCTGATCG ACGGGCGTGC

 51 CGTAACCGGC TATGTGCTGT CCAACCGGCG TGGTACGCGT GTCTGCGTGC

101 TGGACTTGGG CGGGATTGTG CAGGAATTTT CCGTTTTGGC AGACGGCGTG

151 CGCGAAAACC TCGTGGTGTC GTTCGACGAT GCGGCTTCCT ATGCGGACAA
```

-continued

```
201 TCCGTTTCAG ATTAACAAGC AGATAGGGCG CGTGGCCGGA CGCATCCGCG

251 GTGCGGCGTT CGACATCAAC GGCAGGACTT ACCGCGTGGA GGCCAACGAA

301 GGCAGGAACG CGCTGCACGG CGGTTCGCAC GGGCTGGCCG TTACCCGTTT

351 CAACGCGGTG GCGGCAGACG GCCGTTCGGT GGTGCTGCGC AGCCGCCTG.

401 CAACAGTCGG CCGACGGTTA TCCCAACGAT TTGGATTTGG ATATTTCCTA

451 CCGCTTGGAC GAGGACGACC GGCTTACCGT TACCTATCGC GCCACCGCGC

501 TCGGCGACAC GGTGTTCGAC CCGACGCTGC ACATTTACTG GCGGCTGGAC

551 GCGGGCCTGC ACGATGCGGT TCTGCATATT CCGCAGGGCG GACATATTCC

601 GGCCGATGCC GAAAAACTGC CCGTCTCAAC GGTTTCAGAC GACCTCGAAG

651 TATTTGA
```

This corresponds to the amino acid sequence <SEQ ID 576; ORF 144.a>:

```
a144.pep
      1 MSDTPATRDF GLIDGRAVTG YVLSNRRGTR VCVLDLGGIV QEFSVLADGV

     51 RENLVVSFDD AASYADNPFQ INKQIGRVAG RIRGAAFDIN GRTYRVEANE

    101 GRNALHGGSH GLAVTRFNAV AADGRSVVLR SRLXTVGRRL SQRFGFGYFL

    151 PLGRGRPAYR YLSRHRARRH GVRPDAAHLL AAGRGPARCG SAYSAGRTYS

    201 GRCRKTARLN GFRRPRSI*

m144/a144 99.1% identity in 218 aa overlap

                  10        20        30        40        50        60
m144.pep MSDTPATRDFGLIDGRAVTGYVLSNRRGTRVCVLDLGGIVQEFSVLADGVRENLVVSFDD
         ||||||||||||||||||||||||||||||||||||||||||||||||||||||||||||
a144     MSDTPATRDFGLIDGRAVTGYVLSNRRGTRVCVLDLGGIVQEFSVLADGVRENLVVSFDD
                  10        20        30        40        50        60

                  70        80        90       100       110       120
m144.pep AASYADNPFQINKQIGRVAGRIRGAAFDINGRTYRVEANEGRNALHGGSHGLAVTRFNAV
         ||||||||||||||||||||||||||||||||||||||||||||||||||||||||||||
a144     AASYADNPFQINKQIGRVAGRIRGAAFDINGRTYRVEANEGRNALHGGSHGLAVTRFNAV
                  70        80        90       100       110       120

                 130       140       150       160       170       180
m144.pep AADGRSVVLRSRLATVGRRLSQRFGFGYFLPLGRGRPAYRYLSRHRARRHGVRPDAAHLL
         ||||||||||||| ||||||||||||||||||||||||||||||||||||||||||||||
a144     AADGRSVVLRSRLXTVGRRLSQRFGFGYFLPLGRGRPAYRYLSRHRARRHGVRPDAAHLL
                 130       140       150       160       170       180

                 190       200       210      219
m144.pep AAGRGPARCGSAYSAGRTYAGRCRKTARLNGFRRPRSIX
         |||||||||||||||||||:|||||||||||||||||||
a144     AAGRGPARCGSAYSAGRTYSGRCRKTARLNGFRRPRSIX
                 190       200       210      219
```

The following partial DNA sequence was identified in *N. gonorrhoeae* <SEQ ID 577>:

```
g146.seq
  1 ATGAAGCAAA TCCCCCTCCG CCTTCTCCAG GTCGTCATTG ACCACGACAA

 51 AGTCGAACAA TACGGACTGT TCGATTTCAT GCCTTGCCTT CGACAGCCTC

101 CTTTGGATAa ctTCCCGACT GTCCGTCCCG CGCcctTTGA GGCGCGCGGC

151 AAGCACGTCG AAAGAAGGCG GCAGGATAAA GATACCGACA GCTTCCGGCA

201 GCGCGTTGCG AACCTGCGCC GCGCCCTGAA CGTCGATTTC CAAAATCACG

251 TCATAGCCTG CCGCCGCCAA CGCATTCACG CCCTCCGTGC TTGTGCCGTA
```

-continued

```
301 ATAGTTGCCG AATACGTCTG CGTATTCCAA AAAAGCCTCC TGCGCGATAA

351 GCGATTCAAA CTCTTCTTTG GAAACAAAGT GATAATGTAC GCCGTTTGCT

401 TCGCCTTCAC GCGGCGGGCG CGTCGTATGC GACACGGAAA CGCGCAAACC

451 GTTATGGTTT GCCAACAGCC GCGACACCAG CGTGGTTTTG CCCGTGCCGG

501 AAGCGGCCGA AATGATAAAG ATGTTGCCTT TTCGATAAGC GGACATATTT

551 TTTACCTGTA TATTTTCCAA CCGATTGTAT CACAACGGAC ACCCTATTTC

601 ATATTTGCCG ATGCCCATAT TTTGCCGCTA TTGTTTTGA
```

This corresponds to the amino acid sequence <SEQ ID 578; ORF 146.ng>:

```
g146.pep
  1 MKQIPLRLLQ VVIDHDKVEQ YGLFDFMPCL RQPPLDNFPT VRPAPFEARG

 51 KHVERRRQDK DTDSFRQRVA NLRRALNVDF QNHVIACRRQ RIHALRACAV

101 IVAEYVCVFQ KSLLRDKRFK LFFGNKVIMY AVCFAFTRRA RRMRHGNAQT

151 VMVCQQPRHQ RGFARAGSGR NDKDVAFSIS GHIFYLYIFQ PIVSQRTPYF

201 IFADAHILPL LF*
```

The following partial DNA sequence was identified in *N. meningitidis* <SEQ ID 579>:

```
m146.seq
  1 ATGGCGCAAA TCCTCCTCCG CTCGCGCCAA GTCGTCATTG ACCACGACAA

 51 AGTCAAACAA TACGGACTGC TCGATTTCAT GCCTTGCCTT CGACAGCCTC

101 CTTTGGATAA CTTCCCGACT GTCCGTCCCG CGTCCGTTGA GGCGCGCGGC

151 AAGTACGTCG AAAGAAGGCG GCAGGATAAA GATGCCGACG GCTTCGGGCA

201 GCGCGTCGCG AACCTGCGCC GCGCCCTGAA CGTCGATTTC CAAAATCACG

251 TCATAGCCTG CCGCCGCCAA CGCATTCACA CCCTCCGCGC CTGTGCCGTA

301 ATAGTTGCCA AATACGTCGG CGTATTCCAA AAAAGCTTCC TGCGCGATAA

351 GCGACTCAAA CTCTTCTTTG GAAACAAAGT GATAATGTAC GCCGTTTGCT

401 TCGCCTTCAC GCGGCGGGCG CGTCGTGTGC GACACGGAAA CGCGCAAACC

451 GTTATGGTTT GCCAACAGCC GCGACACCAG CGTGGTTTTG CCCGTGCCGG

501 AAGCGGCCGA AATGATAAAG ATGTTGCCTT TTCGATAAGC GGACATATTT

551 TTTACCTGTA TATTTTCCAG CCGATTGTAT CACAATGGAC ACCCAGTTTC

601 CTATTTGCCG ATGCCCATAT TTTGCCGCTA TTGTTTTGA
```

This corresponds to the amino acid sequence <SEQ ID 580; ORF 146>:

```
m146.pep
  1 MAQILLRSRQ VVIDHDKVKQ YGLLDFMPCL RQPPLDNFPT VRPASVEARG

 51 KYVERRRQDK DADGFGQRVA NLRRALNVDF QNHVIACRRQ RIHTLRACAV

101 IVAKYVGVFQ KSFLRDKRLK LFFGNKVIMY AVCFAFTRRA RRVRHGNAQT

151 VMVCQQPRHQ RGFARAGSGR NDKDVAFSIS GHIFYLYIFQ PIVSQWTPSF

201 LFADAHILPL LF*
```

Computer analysis of this amino acid sequence gave the following results:
Homology with a Predicted ORF from *N. gonorrhoeae*

```
m146/g146  90.1% identity in 212 aa overlap

                    10         20         30         40         50         60
m146.pep   MAQILLRSRQVVIDHDKVKQYGLLDFMPCLRQPPLDNFPTVRPASVEARGKYVERRRQDK
           | || ||  ||||||:||||:||||||||||||||||||||  |||||:||||||||
g146       MKQIPLRLLQVVIDHDEVKQYGLFDFMPCLRQPPLDNFPTVRPAPFEARGKHVERRRQDK
                    10         20         30         40         50         60

                    70         80         90        100        110        120
m146.pep   DADGFGQRVANLRRALNVDFQNHVIACRRQRIHTLRACAVIVAKYVGVFQKSFLRDKRLK
           |:|:| |||||||||||||||||||||||||:|||||||||:|| |||||:|||||:|
g146       DTDSFRQRVANLRRALNVDFQNHVIACRRQRIHALRACAVIVAEYVCVFQKSLLRDKRFK
                    70         80         90        100        110        120

                   130        140        150        160        170        180
m146.pep   LFFGNKVIMYAVCFAFTRRARRVRHGNAQTVMVCQQPRHQRGFARAGSGRNDKDVAFSIS
           |||||||||||||||||||||:||||||||||||||||||||||||||||||||||||||
g146       LFFGNKVIMYAVCFAFTRRARRMRHGNAQTVMVCQQPRHQRGFARAGSGRNDKDVAFSIS
                   130        140        150        160        170        180

                   190        200        210
m146.pep   GHIFYLYIFQPIVSQWTPSFLFADAHILPLLFX
           ||||||||||||||| || |:||||||||||||
g146       GHIFYLYIFQPIVSQRTPYFIFADAHILPLLFX
                   190        200        210

                   250        260        270        280        290        300
m146.pep   TLVQFFCWFAFQYMWTYSAGAIAENVWHTTDASSVGYQEAGNWYGVLAAVQSVAAVICSF
           | |||||||||:|||||||||||||||||||||||:||||| ||||||| |||||||||
g146       TPVQFFCWFAFRYMWTYSAGAIAENVWHTTDASSVGHQEAGNRYGVLAAVXSVAAVICSF
                   250        260        270        280        290        300
```

The following partial DNA sequence was identified in *N. meningitidis* <SEQ ID 581>:

```
a146.seq
  1 ATGGCGCAAA TCCTCCTCCG CCCGCGCCAA GTCATCATTG ACCACGACAA

 51 AATCGAACAA TACGGACTGT TCGATTTCAT GCCTTGCCTT CGACAGCCTC

101 CTTTGGATAA CTTCCCGACT GTCCGTCCCG CGTCCGTTGA GACGCGCAGC

151 AAGCACATCG AAAGACGGCG GCAGGATAAA GATGCCGACG GCTTCGGGCA

201 GCGCATCTCG AACCTGAGCC GCGCCCTGAA CGTCGATTTC CAAAATCACG

251 TCATAACCTG CCGCCGCCAA CGCATTCACA CCCTCCGCGC TTGTGCCGTA

301 ATAGTTGCCG AACACGTCCG CGTATTCCAA AAAAGCCTCC TGCGCGATAA

351 GCGACTCAAA CTCTTCTTTG GAAACAAAGT GATAATGTAC GCCGTTTGCT

401 TCGCCTTCAC GCGGCGGACG CGTCGTGTGC GACACGGAAA CGCGCAAACC

451 GTTATGGTTT GCCAACAGCC GCGACACCAG CGTGGTTTTG CCCGTGCCGG

501 AAGCGGCCGA AATGATAAAG ATGTTGCCTT TTCGATAAGC GGACATATTT

551 TTTACCTGTA TATTTTCCAG CCGATTGTAT CACAACGGAC ACCCGGTTTC

601 CTATTTGCCG ATGCCCATAT TTTGCCGCTA TTGTTTTGA
```

This corresponds to the amino acid sequence <SEQ ID 582; ORF 146.a>:

```
a143.pep

  1 MAQILLRPRQ VIIDHDKIEQ YGLFDFMPCL RQPPLDNFPT VRPASVETRS

 51 KHIERRRQDK DADGFGQRIS NLSRALNVDF QNHVITCRRQ RIHTLRACAV

101 IVAEHVRVFQ KSLLRDKRLK LFFGNKVIMY AVCFAFTRRT RRVRHGNAQT
```

-continued

```
151 VMVCQQPRHQ RGFARAGSGR NDKDVAFSIS GHIFYLYIFQ PIVSQRTPGF

201 LFADAHILPL LF*
```

```
m146/a146  90.6% identity in 212 aa overlap

                   10        20        30        40        50        60
m146.pep   MAQILLRSRQVVIDHDKVKQYGLLDFMPCLRQPPLDNFPTVRPASVEARGKYVERRRQDK
           ||||||| |||:|||||::||||:||||||||||||||||||||||:|:|::|||||||
a146       MAQILLRPRQVIIDHDKIEQYGLFDFMPCLRQPPLDNFPTVRPASVETRSKHIERRRQDK
                   10        20        30        40        50        60

                   70        80        90       100       110       120
m146.pep   DADGFGQRVANLRRALNVDFQNHVIACRRQRIHTLRACAVIVAKYVGVFQKSFLRDKRLK
           |||||||||::|| |||||||||||:||||||||||||||||||::| |||||:|||||||
a146       DADGFGQRVISLRSALNVDFQNHVITCRRQRIHTLRACAVIVAEHVRVFQKSLLRDKRLK
                   70        80        90       100       110       120

                  130       140       150       160       170       180
m146.pep   LFFGNKVIMYAVCFAFTRRARRVRHGNAQTVMVCQQPRHQRGFARAGSGRNDKDVAFSIS
           ||||||||||||||||||:|||||||||||||||||||||||||||||||||||||||||
a146       LFFGNKVIMYAVCFAFTRRTRRVRHGNAQTVMVCQQPRHQRGFARAGSGRNDKDVAFSIS
                  130       140       150       160       170       180

                  190       200       210
m146.pep   GHIFYLYIFQPIVSQWTPSFLFADAHILPLLFX
           ||||||||||||||| ||:||||||||||||||
a146       GHIFYLYIFQPIVSQRTPGFLFADAHILPLLFX
                  190       200       210
```

The following partial DNA sequence was identified in *N. gonorrhoeae* <SEQ ID 583>:

```
g147.seq(partial)
  1 ..ATGCGACGAG AAGCCAAAAT GGCACAAATC ACACTCAAAC CCATTGTTTT

 51   ATCAATTCTT TTAATCAACA CACCCCTCCT CGCCCAAGCG CATGAAACTG

101   AGCAATCGGT GGGCTTGGAA ACGGTCAGCG TCGTCGGCAA AAGCCGTCCG

151   CGCGCGACTT CGGGGCTGCT GCACACTTCG ACCGCCTCCG ACAAAATCAT

201   CTCCGGCGAT ACTTTGCGCC AAAAAGCCGT CAACTTGGGC GACGCTTTGG

251   ACGGCGTACC GGGCATCCAC GCTTCGCAAT ACGGCGGCGG CGCATCCGCT

301   CCCGTTATTC GCGGTCAAAC GGGCAGACGG ATTAAAGTAT TGAACCATCA

351   CGGCGAAACG GGCGATATGG CGGACTTTTC TCCCGATCAC GCCATTATGG

401   TAGATACCGC CTTGTCGCAA CAGGTTGAAA TCCTGCGCGG GCCGGTTACG

451   CTCTTGTACA GCTCGGgcaa tgtggccgGG GCTGGtcaat gttgccgatg

501   gAAAAAtccc ccaaaaAAtg cc..
```

This corresponds to the amino acid sequence <SEQ ID 584; ORF 147.ng>:

```
g147.pep (partial)
  1 . . . MRREAKMAQI TLKPIVLSIL LINTPLLAQA HETEQSVGLE TVSVVGKSRP

 51       RATSGLLHTS TASDKIISGD TLRQKAVNLG DALDGVPGIH ASQYGGGASA

101       PVIRGQTGRR IKVLNHHGET GDMADFSPDH AIMVDTALSQ QVEILRGPVT

151       LLYSSGNVAG AGQCCRWKNP PKNA . . .
```

The following partial DNA sequence was identified in *N. meningitidis* <SEQ ID 585>:

```
m147.seq (partial)
   1 . . . CCGCATAAAA CTGAGCAATC GGTGGATTTG GAAACGGTCA GCGTCGTCGG

  51       CAAAAGCCGT CCGCGCGCCA CGTCGGGGCT GTTGCACACT TCGACCGCCT
```

-continued

101 CCGACAAAAT CATCTCCGGC GATACCTTGC GCCAAAAAGC CGTCAACTTG
151 GGCGACGCTT TAGACGGCGT ACCGGGCATC CACGCTTCGC AATACGGCGG
201 CGGCGCGTCT GCTCCCGTCA TTCGCGGTCA AACAGGCAGG CGGATTAAAG
251 TGTTGAACCA TCACGGCGAA ACAGGCGATA TGGCGGATTT TTCGCCCGAT
301 CACGCCATTA TGGTAGATAC CGCCTTGTCG CAACAGGTCG AAATCCTGCG
351 CGGGCCGGTT ACGCTCTTGT ACAGCTCGGG CAATGTGGCG GGGCTGGTCG
401 ATGTTGCCGA TGGCAAAATC CCCGAAAAAA TGCCTGAAAA CGGCGTATCG
451 GGCGAACTCG GATTGCGTTT GAGCAGCGGC AATCTGGAAA AACTCACGTC
501 CGGCGGCATC AATATCGGTT TGGGCAAAAA CTTTGTATTG CACACGGAAG
551 GGCTGTACCG CAAATCGGGG GATTACGCCG TACCGCGTTA CCGCAATCTG
601 AAACGCCTGC CCGACAGCCA CGCCGATTCG CAAACGGGCA GCATCGGGCT
651 GTCTTGGGTT GGCGAAAAAG GTTTTATCGG CGTAGCGTAC AGCGACCGTC
701 GCGACCAATA TGGTCTGCCT GCCCACAGCC ACGAATACGA TGATTGCCAC
751 GCCGACATCA TCTGGCAAAA GAGCTTGATT AACAAACGCT ATTTACAGCT
801 TTATCCGCAC CTGTTGACCG AAGAAGACAT CGATTACGAC AATCCGGGCT
851 TGAGCTGCGG CTTCCACGAC GACGATAATG CACACGCACA CACCCACAGC
901 GGCAGACCGT GGATAGACCT GCGCAACAAA CGCTACGAAC TCCGTGCCGA
951 ATGGAAGCAA CCGTTCCCCG GTTTTGAAGC CCTGCGCGTA CACCTGAACC
1001 GCAACGACTA CCGCCACGAC GAAAAAGCAG GCGATGCAGT CGAAAACTTT
1051 TTTAACAACC AAACGCAAAA CGGCGGCATC GAGTTGCGCC AACAACCGAT
1101 AGGTCGTCTG AAAGGCAGCT GGGGCGTGCA ATATTTACAA CAAAAATCCA
1151 GTGCTTTATC TGCCATATCC GAAGCGGTTA AACAACCGAT GCTGCTTGAC
1201 AACAAAGTGC AACATTACAG CTTTTTCGGT GTAGAACAGG CAAACTGGGA
1251 CAACTTCACG CTTGAAGGAG GCGTACGCGT GGAAAAACAA AAAGCCTCCA
1301 TTCAGTACGA CAAAGCATTG ATTGATCGGG AAAACTACTA CAACCACCCC
1351 CTGCCCGACC TCGGCGCGCA CCGCCAAACC GCCCGCTCAT TCGCACTTTC
1401 GGGCAACTGG TATTTCACGC CACAACACAA ACTCAGCCTG ACCGCCTCCC
1451 ATCAGGAACG CCTGCCGTCA ACGCAAGAGC TGTACGCACA CGGCAAACAC
1501 GTCGCCACCA ACACCTTTGA AGTCGGCAAC AAACACCTCA ACAAAGAGCG
1551 TTCCAACAAT ATCGAACTCG CGCTGGGCTA CGAAGGCGAC CGCTGGCAAT
1601 ACAATCTGGC ACTCTACCGC AACCGCTTCG GTAACTACAT TTACGCCCAA
1651 ACCTTAAACG ACGGACGCGG CCCCAAATCC ATCGAAGACG ACAGCGAAAT
1701 GAAGCTCGTG CGCTACAACC AATCCGGCGC CGACTTCTAC GGCGCGGAAG
1751 GCGAAATCTA CTTCAAACCG ACACCGCGCT ACCGCATCGG CGTTTCCGGC
1801 GACTATGTAC GAGGCCGTCT GAAAAACCTG CCTTCCCTAC CCGGCAGAGA
1851 AGATGCCTAC GGCAACCGTC CTTTCATCGC ACAGGACGAC CAAAATGCCC
1901 CCCGTGTTCC GGCTGCGCGC CTCGGCTTCC ACCTGAAAGC CTCGCTGACC
1951 GACCGTATCG ATGCCAATTT GGACTACTAC CGCGTGTTCG CCCAAAACAA
2001 ACTCGCCCGC TACGAAACGC GCACGCCCGG ACACCATATG CTCAACCTCG
2051 GCGCAAACTA CCGCCGCAAT ACGCGCTATG GCGAGTGGAA TTGGTACGTC

-continued

```
2101       AAAGCCGACA ACCTGCTCAA CCAATCCGTT TACGCCCACA GCAGCTTTCT

2151       CTCTGATACG CCGCAAATGG GCCGCAGCTT TACCGGCGGC GTGAACGTGA

2201       AGTTTTAA
```

This corresponds to the amino acid sequence <SEQ ID 586; ORF 147>:

```
m147.pep (partial)
  1 . . . PHKTEQSVDL ETVSVVGKSR PRATSGLLHT STASDKIISG DTLRQKAVNL

 51       GDALDGVPGI HASQYGGGAS APVIRGQTGR RIKVLNHHGE TGDMADFSPD

101       HAIMVDTALS QQVEILRGPV TLLYSSGNVA GLVDVADGKI PEKMPENGVS

151       GELGLRLSSG NLEKLTSGGI NIGLGKNFVL HTEGLYRKSG DYAVPRYRNL

201       KRLPDSHADS QTGSIGLSWV GEKGFIGVAY SDRRDQYGLP AHSHEYDDCH

251       ADIIWQKSLI NKRYLQLYPH LLTEEDIDYD NPGLSCGFHD DDNAHAHTHS

301       GRPWIDLRNK RYELRAEWKQ PFPGFEALRV HLNRNDYRHD EKAGDAVENF

351       FNNQTQNARI ELRHQPIGRL KGSWGVQYLQ QKSSALSAIS EAVKQPMLLD

401       NKVQHYSFFG VEQANWDNFT LEGGVRVEKQ KASIQYDKAL IDRENYYNHP

451       LPDLGAHRQT ARSFALSGNW YFTPQHKLSL TASHQERLPS TQELYAHGKH

501       VATNTFEVGN KHLNKERSNN IELALGYEGD RWQYNLALYR NRFGNYIYAQ

551       TLNDGRGPKS IEDDSEMKLV RYNQSGADFY GAEGEIYFKP TPRYRIGVSG

601       DYVRGRLKNL PSLPGREDAY GNRPFIAQDD QNAPRVPAAR LGFHLKASLT

651       DRIDANLDYY RVFAQNKLAR YETRTPGHHM LNLGANYRRN TRYGEWNWYV

701       KADNLLNQSV YAHSSFLSDT PQMGRSFTGG VNVKF*
```

Computer analysis of this amino acid sequence gave the following results:
Homology with a Predicted ORF from *N. gonorrhoeae*

```
m147/g147 92.3% identity in 142 aa overlap

                                                10        20        30
m147.pep                               PHKTEQSVDLETVSVVGKSRPRATSGLLHTS
                                        |:||||| |||||||||||||||||||||||
g147     MRREAKMAQITLKPIVLSILLINTPLLAQAHETEQSVGLETVSVVGKSRPRATSGLLHTS
                 10        20        30        40        50        60

                 40        50        60        70        80        90
m147.pep TASDKIISGDTLRQKAVNLGDALDGVPGIHASQYGGGASAPVIRGQTGRRIKVLNHHGET
         ||||||||||||||||||||||||||||||||||||||||||||||||||||||||||||
g147     TASDKIISGDTLRQKAVNLGDALDGVPGIHASQYGGGASAPVIRGQTGRRIKVLNHHGET
                 70        80        90       100       110       120

               100       110       120       130       140       150
m147.pep GDMADFSPDHAIMVDTALSQQVEILRGPVTLLYSSGNVAGLVDVADGKIPEKMPENGVSG
         ||||||||||||||||||||||||||||||||||||||  :     | | |
g147     GDMADFSPDHAIMVDTALSQQVEILRGPVTLLYSSGNVAGAGQCCRWKNPPKNA
```

The following partial DNA sequence was identified in *N. meningitidis* <SEQ ID 587>:

```
a147.seq
   1 ATGCGACGAG AAGCCAAAAT GGCACAAACT ACACTCAAAC CCATTGTTTT

  51 ATCAATTCTT TTAATCAACA CACCCCTCCT CTCCCAAGCG CATGGAACTG

 101 AGCAATCAGT GGGCTTGGAA ACGGTCAGCG TCGTCGGCAA AAGCCGTCCG

 151 CGCGCCACTT CGGGGCTGCT GCACACTTCT ACCGCCTCCG ACAAAATCAT
```

-continued

201 CAGCGGCGAC ACCTTGCGAC AAAAAGCCGT CAACTTGGGT GATGCTTTAG
251 ACGGCGTACC GGGCATTCAT GCCTCGCAAT ACGGCGGCGG CGCATCCGCT
301 CCCGTTATTC GCGGTCAAAC AGGCAGACGG ATTAAAGTGT TGAACCATCA
351 CGGCGAAACG GGCGACATGG CGGACTTCTC TCCAGACCAT GCAATCATGG
401 TGGACAGCGC CTTGTCGCAA CAGGTCGAAA TCCTGCGCGG TCCGGTTACG
451 CTCTTGTACA GCTCGGGCAA TGTGGCGGGG CTGGTCGATG TTGCCGATGG
501 CAAAATCCCC GAAAAAATGC CTGAAAACGG CGTATCGGGC GAACTCGGAT
551 TGCGTTTGAG CAGCGGCAAT CTGGAAAAAC TCACGTCCGG CGGCATCAAT
601 ATCGGTTTGG GCAAAAACTT TGTATTGCAC ACGGAAGGGC TGTACCGCAA
651 ATCGGGGGAT TACGCCGTAC CGCGTTACCG CAATCTGAAA CGCCTGCCCG
701 ACAGCCACGC CGATTCGCAA ACGGGCAGCA TCGGGCTGTC TTGGGTTGGC
751 GAAAAAGGCT TTATCGGCGC AGCATACAGC GACCGTCGCG ACCAATATGG
801 TCTGCCTGCC CACAGCCACG AATACGATGA TTGCCACGCC GACATCATCT
851 GGCAAAAGAG TTTGATTAAC AAACGCTATT TGCAGCTTTA TCCGCACCTG
901 TTGACCGAAG AAGACATCGA TTACGACAAT CCGGGCTTGA GCTGCGGCTT
951 TCACGACGAC GATGATGCAC ACGCCCATGC CCACAACGGC AAACCTTGGA
1001 TAGACCTGCG CAACAAACGC TACGAACTCC GCGCCGAATG GAAGCAACCG
1051 TTCCCCGGTT TTGAAGCCCT GCGCGTACAC CTGAACCGCA ACGACTACCG
1101 CCACGACGAA AAAGCAGGCG ATGCAGTAGA AAACTTTTTT AACAACCAAA
1151 CGCAAAACGC CCGTATCGAG TTGCGCCACC AACCCATAGG CCGTCTGAAA
1201 GGCAGCTGGG GCGTGCAATA TTTGGGACAA AAATCCAGTG CTTTATCTGC
1251 CACATCCGAA GCGGTCAAAC AACCGATGCT GCTTGACAAT AAAGTGCAAC
1301 ATTACAGCTT TTTCGGTGTA GAACAGGCAA ACTGGGACAA CTTCACGCTT
1351 GAAGGCGGCG TACGCGTGGA AAAACAAAAA GCCTCCATCC GCTACGACAA
1401 AGCATTGATT GATCGGGAAA ACTACTACAA CCATCCCCTG CCCGACCTCG
1451 GCGCGCACCG CCAAACCGCC CGCTCATTCG CACTTTCGGG CAACTGGTAT
1501 TTCACGCCAC AACACAAACT CAGCCTGACC GCCTCCCATC AGGAACGCCT
1551 GCCGTCAACG CAAGAGCTGT ACGCACACGG CAAACACGTC GCCACCAACA
1601 CCTTTGAAGT CGGCAACAAA CACCTCAACA AAGAGCGTTC CAACAATATC
1651 GAACTCGCGC TGGGCTACGA AGGCGACCGC TGGCAATACA ATCTGGCACT
1701 CTACCGCAAC CGCTTCGGCA ACTACATTTA CGCCCAAACC TTAAACGACG
1751 GACGCGGCCC CAAATCCATC GAAGACGACA GCGAAATGAA GCTCGTGCGC
1801 TACAACCAAT CCGGTGCGGA CTTCTACGGC GCGGAAGGCG AAATCTACTT
1851 CAAACCGACA CCGCGCTACC GCATCGGCGT TTCCGGCGAC TATGTACGAG
1901 GCCGTCTGAA AAACCTGCCT TCCCTACCCG GCAGGGAAGA CGCCTACGGC
1951 AACCGCCCAC TCATTGCCCA AGCCGACCAA AACGCCCCTC GCGTTCCGGC
2001 TGCGCGCCTC GGCGTCCACC TGAAAGCCTC GCTGACCGAC CGCATCGATG
2051 CCAATTTGGA CTACTACCGC GTGTTCGCCC AAAACAAACT CGCCCGCTAC
2101 GAAACGCGCA CGCCCGGACA CCATATGCTC AACCTCGGCG CAAACTACCG
2151 CCGCAATACG CGCTATGGCG AGTGGAATTG GTACGTCAAA GCCGACAACC

-continued

```
2201 TGCTCAACCA ATCCGTTTAC GCCCACAGCA GCTTCCTCTC TGATACGCCG

2251 CAAATGGGCC GCAGCTTTAC CGGCGGCGTG AACGTGAAGT TTTAA
```

This corresponds to the amino acid sequence <SEQ ID 588; ORF 147.a>:

```
a147.pep

  1 MRREAKMAQT TLKPIVLSIL LINTPLLSQA HGTEQSVGLE TVSVVGKSRP

 51 RATSGLLHTS TASDKIISGD TLRQKAVNLG DALDGVPGIH ASQYGGGASA

101 PVIRGQTGRR IKVLNHHGET GDMADFSPDH AIMVDSALSQ QVEILRGPVT

151 LLYSSGNVAG LVDVADGKIP EKMPENGVSG ELGLRLSSGN LEKLTSGGIN

201 IGLGKNFVLH TEGLYRKSGD YAVPRYRNLK RLPDSHADSQ TGSIGLSWVG

251 EKGFIGAAYS DRRDQYGLPA HSHEYDDCHA DIIWQKSLIN KRYLQLYPHL

301 LTEEDIDYDN PGLSCGFHDD DDAHAHAHNG KPWIDLRNKR YELRAEWKQP

351 FPGFEALRVH LNRNDYRHDE KAGDAVENFF NNQTQNARIE LRHQPIGRLK

401 GSWGVQYLGQ KSSALSATSE AVKQPMLLDN KVQHYSFFGV EQANWDNFTL

451 EGGVRVEKQK ASIRYDKALI DRENYYNHPL PDLGAHRQTA RSFALSGNWY

501 FTPQHKLSLT ASHQERLPST QELYAHGKHV ATNTFEVGNK HLNKERSNNI

551 ELALGYEGDR WQYNLALYRN RFGNYIYAQT LNDGRGPKSI EDDSEMKLVR

601 YNQSGADFYG AEGEIYFKPT PRYRIGVSGD YVRGRLKNLP SLPGREDAYG

651 NRPLIAQADQ NAPRVPAARL GVHLKASLTD RIDANLDYYR VFAQNKLARY

701 ETRTPGHHML NLGANYRRNT RYGEWNWYVK ADNLLNQSVY AHSSFLSDTP

751 QMGRSFTGGV NVKF*
```

m147/a147 98.1% identity in 734 aa overlap

```
                                                 10        20        30
m147.pep                              PHKTEQSVDLETVSVVGKSRPRATSGLLHTS
                                       | |||||  ||||||||||||||||||||||
a147       MRREAKMAQTTLKPIVLSILLINTPLLSQAHGTEQSVGLETVSVVGKSRPRATSGLLHTS
                   10        20        30        40        50        60

                  40        50        60        70        80        90
m147.pep   TASDKIISGDTLRQKAVNLGDALDGVPGIHASQYGGGASAPVIRGQTGRRIKVLNHHGET
           ||||||||||||||||||||||||||||||||||||||||||||||||||||||||||||
a147       TASDKIISGDTLRQKAVNLGDALDGVPGIHASQYGGGASAPVIRGQTGRRIKVLNHHGET
                   70        80        90       100       110       120

                 100       110       120       130       140       150
m147.pep   GDMADFSPDHAIMVDTALSQQVEILRGPVTLLYSSGNVAGLVDVADGKIPEKMPENGVSG
           |||||||||||||||:||||||||||||||||||||||||||||||||||||||||||||
a147       GDMADFSPDHAIMVDSALSQQVEILRGPVTLLYSSGNVAGLVDVADGKIPEKMPENGVSG
                  130       140       150       160       170       180

                 160       170       180       190       200       210
m147.pep   ELGLRLSSGNLEKLTSGGINIGLGKNFVLHTEGLYRKSGDYAVPRYRNLKRLPDSHADSQ
           ||||||||||||||||||||||||||||||||||||||||||||||||||||||||||||
a147       ELGLRLSSGNLEKLTSGGINIGLGKNFVLHTEGLYRKSGDYAVPRYRNLKRLPDSHADSQ
                  190       200       210       220       230       240

                 220       230       240       250       260       270
m147.pep   TGSIGLSWVGEKGFIGVAYSDRRDQYGLPAHSHEYDDCHADIIWQKSLINKRYLQLYPHL
           ||||||||||||||||:|||||||||||||||||||||||||||||||||||||||||||
a147       TGSIGLSWVGEKGFIGAAYSDRRDQYGLPAHSHEYDDCHADIIWQKSLINKRYLQLYPHL
                  250       260       270       280       290       300

                 280       290       300       310       320       330
m147.pep   LTEEDIDYDNPGLSCGFHDDDNAHAHTHSGRPWIDLRNKRYELRAEWKQPFPGFEALRVH
           |||||||||||||||||||||:||||:|:|:|||||||||||||||||||||||||||||
a147       LTEEDIDYDNPGLSCGFHDDDDAHAHAHNGKPWIDLRNKRYELRAEWKQPFPGFEALRVH
                  310       320       330       340       350       360

                 340       350       360       370       380       390
m147.pep   LNRNDYRHDEKAGDAVENFFNNQTQNARIELRHQPIGRLKGSWGVQYLQQKSSALSAISE
           |||||||||||||||||||||||||||||||||||||||||||||||| |||||||| ||
a147       LNRNDYRHDEKAGDAVENFFNNQTQNARIELRHQPIGRLKGSWGVQYLGQKSSALSATSE
                  370       380       390       400       410       420
```

-continued

```
                 400       410       420       430       440       450
m147.pep   AVKQPMLLDNKVQHYSFFGVEQANWDNFTLEGGVRVEKQKASIQYDKALIDRENYYNHPL
           |||||||||||||||||||||||||||||||||||||||||||:||||||||||||||||
a147       AVKQPMLLDNKVQHYSFFGVEQANWDNFTLEGGVRVEKQKASIRYDKALIDRENYYNHPL
                  430       440       450       460       470       480

                 460       470       480       490       500       510
m147.pep   PDLGAHRQTARSFALSGNWYFTPQHKLSLTASHQERLPSTQELYAHGKHVATNTFEVGNK
           |||||||||||||||||||||||||||||||||||||||||||:||||||||||||||||
a147       PDLGAHRQTARSFALSGNWYFTPQHKLSLTASHQERLPSTQELYAHGKHVATNTFEVGNK
                  490       500       510       520       530       540

                 520       530       540       550       560       570
m147.pep   HLNKERSNNIELALGYEGDRWQYNLALYRNRFGNYIYAQTLNDGRGPKSIEDDSEMKLVR
           ||||||||||||||||||||||||||||||||||||||||||||||||||||||||||||
a147       HLNKERSNNIELALGYEGDRWQYNLALYRNRFGNYIYAQTLNDGRGPKSIEDDSEMKLVR
                  550       560       570       580       590       600

                 580       590       600       610       620       630
m147.pep   YNQSGADFYGAEGEIYFKPTPRYRIGVSGDYVRGRLKNLPSLPGREDAYGNRPFIAQDDQ
           |||||||||||||||||||||||||||||||||||||||||||||||||||||:||| ||
a147       YNQSGADFYGAEGEIYFKPTPRYRIGVSGDYVRGRLKNLPSLPGREDAYGNRPLIAQADQ
                  610       620       630       640       650       660

                 640       650       660       670       680       690
m147.pep   NAPRVPAARLGFHLKASLTDRIDANLDYYRVFAQNKLARYETRTPGHHMLNLGANYRRNT
           ||||||||||| ||||||||||||||||||||||||||||||||||||||||||||||||
a147       NAPRVPAARLGVHLKASLTDRIDANLDYYRVFAQNKLARYETRTPGHHMLNLGANYRRNT
                  670       680       690       700       710       720

                 700       710       720       730
m147.pep   RYGEWNWYVKADNLLNQSVYAHSSFLSDTPQMGRSFTGGVNVKFX
           ||||||||||| |||||||||||||||||||||||||||||||||
a147       RYGEWNWYVKADNLLNQSVYAHSSFLSDTPQMGRSFTGGVNVKFX
                  730       740       750       760
```

The following partial DNA sequence was identified in *N. gonorrhoeae* <SEQ ID 589>:

```
g148.seq
  1  ATGGCGTTAA AAACATCAAA CTTGGAACAC GCAATGctgg ttcaTCCCGA

 51  AgctATgagt gtcggcgCGC TTGccgAcaa AATCCGCAAA AtcgaAAact

101  gGCCGCAAAA AGgcaTCTTA TTCCACGACA TCACGCCCGT CCTGCAAAGT

151  GCGGAATACT TCCGCCTTTT GGTCGATTTG CTGGTTTACC GCTATATGGA

201  TCAGAAAATC GACATCGTTG CCGGCTTGGA CGCGCGCGGC TTCATTATCG

251  GCGCGGCACT CGCCTACCAG CTCAaCGtcg gctTCGTCCC CATCCGCAAA

301  AAAGGCAAGC TGCCTTTTGA AACCGTATCG CAAAGCTAcg cgcTCGAATA

351  CGGGGAAGCT GCGGTGGAAA TCCACACCGa tgccgTCAAA CCCGGTTCGC

401  GCGTCCTGCT GGTCGATGAT TTGGTTGCCA CGGGCGGCAC AATGCTTGCC

451  GGGCTGGAAC TGATCCGCAA ACTCGGCGGG GAAATTGTCG AAgccgccgC

501  CATTTTGGAA TTTACCGACC TTCAAGGCGG CAAGAATATC CGCGCAAGTG

551  GCGCGCCCTT ATTTACCCTG CTTCAAAACG AAGGCTGCAT GAAAGGCTGA
```

This corresponds to the amino acid sequence <SEQ ID 590; ORF 148.ng>:

```
g148.pep
  1  MALKTSNLEH AMLVHPEAMS VGALADKIRK IENWPQKGIL FHDITPVLQS

 51  AEYFRLLVDL LVYRYMDQKI DIVAGLDARG FIIGAALAYQ LNVGFVPIRK

101  KGKLPFETVS QSYALEYGEA AVEIHTDAVK PGSRVLLVDD LVATGGTMLA

151  GLELIRKLGG EIVEAAAILE FTDLQGGKNI RASGAPLFTL LQNEGCMKG*
```

The following partial DNA sequence was identified in *N. meningitidis* <SEQ ID 591>:

```
m148.seq
  1  ATGGCGTTAA AAACATCAAA CTTGGAACAC GCAATGCTGG TTCATCCCGA

 51  AGCTATGAGT GTCGGCGCGC TTGCCGACAA AATCCGCAAA ATCGAAAACT

101  GGCCGCAAAA AGGCATCTTA TTCCACGACA TCACGCCCGT CCTTCAAAGC

151  GCGGAATACT TCCGCCTTTT GGTTGATTTA TTGGTTTACC GCTATATGGA

201  TCAGAAAATC GACATCGTTG CCGGTTTGGA CGCGCGCGGC TTCATTATCG

251  GCGCGGCACT CGCCTACCAG CTCAACGTCG GTTTCGTCCC CATCCGCAAA

301  AAAGGCAAGC TGCCTTTTGA AACCGTATCG CAAAGCTACG CGCTCGAATA

351  CGGGGAAGCT GCGGTGGAAA TCCACACCGA TGCCGTCAAA CTCGGTTCGC

401  GCGTGCTGCT GGTCGATGAT TTGATTGCCA CGGGCGGCAC GATGCTTGCC

451  GGACTGGAAC TGATCCGCAA ACTCGGCGGA GAAATTGTCG AAGCCGCCGC

501  CATTTTGGAA TTTACCGACC TTCAAGGCGG CAAGAATATC CGTGCAAGCG

551  GCGCGCCCTT ATTTACCCTG CTTCAAAACG AAGGCTGTAT GAAGGGCTGA
```

This corresponds to the amino acid sequence <SEQ ID 592; ORF 148>:

```
m148.pep
  1  MALKTSNLEH AMLVHPEAMS VGALADKIRK IENWPQKGIL FHDITPVLQS

 51  AEYFRLLVDL LVYRYMDQKI DIVAGLDARG FIIGAALAYQ LNVGFVPIRK

101  KGKLPFETVS QSYALEYGEA AVEIHTDAVK LGSRVLLVDD LIATGGTMLA

151  GLELIRKLGG EIVEAAAILE FTDLQGGKNI RASGAPLFTL LQNEGCMKG*
```

Computer analysis of this amino acid sequence gave the following results:

Homology with a Predicted ORF from *N. gonorrhoeae*

```
m148/g148 99.0% identity in 199 aa overlap

                10        20        30        40        50        60
m148.pep MALKTSNLEHAMLVHPEAMSVGALADKIRKIENWPQKGILFHDITPVLQSAEYFRLLVDL
         ||||||||||||||||||||||||||||||||||||||||||||||||||||||||||||
g148     MALKTSNLEHAMLVHPEAMSVGALADKIRKIENWPQKGILFHDITPVLQSAEYFRLLVDL
                10        20        30        40        50        60

                70        80        90       100       110       120
m148.pep LVYRYMDQKIDIVAGLDARGFIIGAALAYQLNVGFVPIRKKGKLPFETVSQSYALEYGEA
         ||||||||||||||||||||||||||||||||||||||||||||||||||||||||||||
g148     LVYRYMDQKIDIVAGLDARGFIIGAALAYQLNVGFVPIRKKGKLPFETVSQSYALEYGEA
                70        80        90       100       110       120

               130       140       150       160       170       180
m148.pep AVEIHTDAVKLGSRVLLVDDLIATGGTMLAGLELIRKLGGEIVEAAAILEFTDLQGGKNI
         |||||||||| ||||||||||:||||||||||||||||||||||||||||||||||||||
g148     AVEIHTDAVKPGSRVLLVDDLVATGGTMLAGLELIRKLGGEIVEAAAILEFTDLQGGKNI
               130       140       150       160       170       180

               190       200
m148.pep RASGAPLFTLLQNEGCMKGX
         |||||||||||||||||||
g148     RASGAPLFTLLQNEGCMKGX
               190       200
```

The following partial DNA sequence was identified in *N. meningitidis* <SEQ ID 593>:

```
a148.seq
  1  ATGGCGTTAA AAACATCAAA CTTGGAACAC GCAATGCTGG TTCATCCCGA
```

-continued

```
 51  AGCTATGAGT GTCGGTGCGC TTGCCGACAA AATCCGCAAA ATCGAAAACT

101  GGCCGCAAAA AGGCATCTTA TTCCACGACA TCACGCCCGT CCTGCAAAGC

151  GCGGAATACT TCCGACTTTT GGTTGATTTA TTGGTTTACC GCTATATGGA

201  TCAGAAAATC GACATCGTTG CCGGTTTGGA CGCGCGCGGC TTCATTATCG

251  GCGCGGCACT CGCCTACCAG CTCAACGTCG GTTTCGTCCC CATCCGCAAA

301  AAAGGCAAGC TGCCTTTTGA AACCGTATCG CAAAGCTACG CGCTCGAATA

351  CGGGGAAGCT GCGGTGGAAA TCCACACCGA TGCCGTCAAA CTCGGTTCGC

401  GCGTGCTGCT GGTCGATGAT TTGGTTGCCA CGGGCGGCAC GATGCTTGCC

451  GGACTGGAGC TGATCCGCAA ACTCGGCGGG GAAATTGTCG AAGCCGCCGC

501  CATTTTGGAA TTTACCGACC TTCAAGGCGG CAAGAATATC CGTGCAAGCG

551  GCGCGCCCTT ATTTACCCTG CTTCAAAACG AAGGCTGTAT GAAGGGCTGA
```

This corresponds to the amino acid sequence <SEQ ID 594; ORF 148.a>:

```
a148.pep

      1 MALKTSNLEH AMLVHPEAMS VGALADKIRK IENWPQKGIL FHDITPVLQS

     51 AEYFRLLVDL LVYRYMDQKI DIVAGLDARG FIIGAALAYQ LNVGFVPIRK

    101 KGKLPFETVS QSYALEYGEA AVEIHTDAVK LGSRVLLVDD LVATGGTMLA

    151 GLELIRKLGG EIVEAAAILE FTDLQGGKNI RASGAPLFTL LQNEGCMKG*

m148/a148  99.5% identity in 199 aa overlap

                   10        20        30        40        50        60
m148.pep   MALKTSNLEHAMLVHPEAMSVGALADKIRKIENWPQKGILFHDITPVLQSAEYFRLLVDL
           ||||||||||||||||||||||||||||||||||||||||||||||||||||||||||||
a148       MALKTSNLEHAMLVHPEAMSVGALADKIRKIENWPQKGILFHDITPVLQSAEYFRLLVDL
                   10        20        30        40        50        60

                   70        80        90       100       110       120
m148.pep   LVYRYMDQKIDIVAGLDARGFIIGAALAYQLNVGFVPIRKKGKLPFETVSQSYALEYGEA
           ||||||||||||||||||||||||||||||||||||||||||||||||||||||||||||
a148       LVYRYMDQKIDIVAGLDARGFIIGAALAYQLNVGFVPIRKKGKLPFETVSQSYALEYGEA
                   70        80        90       100       110       120

                  130       140       150       160       170       180
m148.pep   AVEIHTDAVKLGSRVLLVDDLIATGGTMLAGLELIRKLGGEIVEAAAILEFTDLQGGKNI
           |||||||||||||||||||||:||||||||||||||||||||||||||||||||||||||
a148       AVEIHTDAVKLGSRVLLVDDLVATGGTMLAGLELIRKLGGEIVEAAAILEFTDLQGGKNI
                  130       140       150       160       170       180

                  190       200
m148.pep   RASGAPLFTLLQNEGCMKGX
           ||||||||||||||||||||
a148       RASGAPLFTLLQNEGCMKGX
                  190       200
```

The following partial DNA sequence was identified in *N. gonorrhoeae* <SEQ ID 595>:

```
g149.seq
  1 ATGTTGATTG ACAACAATGT CCGCCATTAC AGCTTTTTCG GTGTAGAACA

 51 GGCAAATTGG GACAACTTCA CGCTTGAAGG CGGCGTACGC GTGGAAAAAC

101 AAAAAGCCTC CATCCGGTAC GACAAAGCAT TGATTGATCG AGAAAACTAC

151 TACAACCAGC CCCTGCCCGA CCTCGGCGCG CACCGCCAAA CCGCCCGCTC

201 GTTCGCACTT TCGGGCAACT GGTATTTCAC GCCACACCAC AAACTCAGCC

251 TGACCGCCTC CCATCAGGAa cgCCTGCCGT CAACGCaagA actGtACgca
```

-continued

```
 301 cacggcAAGC ACGtcgccac CAACACCTTT GAagtcggca acaaACACCT
 351 CAACAAAGaG CgttccaacA atatcgaACT CGCGCTGGgc tAcaaaggcg
 401 accGCTGGCA ATACAATCTG GCAGCCTACC GCAACCGAtT CGGCAACTAC
 451 ATTTACGCCC AAACCTTAaa cgacggacgC GGCCCCAAAT CCATCgaaga
 501 cgacagcgaA ATGaagcTCG TGCGCTACAA CCAATCCGGT GCCGACTTCT
 551 ACGgcgcggA aggcgaaatc tACTTcaaaC CGAcACCGCG CTACCGCATC
 601 GGTGTTTCCG GCGACTatgt acgaggccgT CTGAAAAACC TGCCGTCCCT
 651 ACCCGGCAGG gaagatcccT AcggcAAACG TCccttcaTC GCACAAGCCG
 701 ACCAAAACGC CCCCCGCATT ccggctGCGC GCCTCGGCTT CCACCTGAAA
 751 ACCTCGCTAA CCGACCGTAT CGATGCCAAT TTGGACTACT ACCGCGTGTT
 801 CGCCCAAAAC AAACTCGCCC GCTACGAAAC GCGTACGCCC GGACACCATA
 851 TGCTCAACCT CGGTGCAAAC TACCGCCGCA ATACGCGCTA TGGCGAGTGG
 901 AATTGGTACG TCAAAGCCGA CAACCTGCtc aACcaatCcg tTTACGCCCa
 951 cAGCAGCTTC CTCTCTGATA CGCCGCAAAt gGGCCGCAGC TTtgccgGCg
1001 gcgtaAACGT GaAGTTttaA
```

This corresponds to the amino acid sequence <SEQ ID 596; ORF 149.ng>:

```
g149.pep
   1 MLIDNNVRHY SFFGVEQANW DNFTLEGGVR VEKQKASIRY DKALIDRENY
  51 YNQPLPDLGA HRQTARSFAL SGNWYFTPHH KLSLTASHQE RLPSTQELYA
 101 HGKHVATNTF EVGNKHLNKE RSNNIELALG YKGDRWQYNL AAYRNRFGNY
 151 IYAQTLNDGR GPKSIEDDSE MKLVRYNQSG ADFYGAEGEI YFKPTPRYRI
 201 GVSGDYVRGR LKNLPSLPGR EDPYGKRPFI AQADQNAPRI PAARLGFHLK
 251 TSLTDRIDAN LDYYRVFAQN KLARYETRTP GHHMLNLGAN YRRNTRYGEW
 301 NWYVKADNLL NQSVYAHSSF LSDTPQMGRS FAGGVNVKF*
```

The following partial DNA sequence was identified in *N. meningitidis* <SEQ ID 597>:

```
m149.seq
   1 ATGCTGCTTG ACAACAAAGT GCAACATTAC AGCTTTTTCG GTGTAGAACA
  51 GGCAAACTGG GACAACTTCA CGCTTGAAGG AGGCGTACGC GTGGAAAAAC
 101 AAAAAGCCTC CATTCAGTAC GACAAAGCAT TGATTGATCG GGAAAACTAC
 151 TACAACCACC CCCTGCCCGA CCTCGGCGCG CACCGCCAAA CCGCCCGCTC
 201 ATTCGCACTT TCGGGCAACT GGTATTTCAC GCCACAACAC AAACTCAGCC
 251 TGACCGCCTC CCATCAGGAA CGCCTGCCGT CAACGCAAGA GCTGTACGCA
 301 CACGGCAAAC ACGTCGCCAC CAACACCTTT GAAGTCGGCA ACAAACACCT
 351 CAACAAAGAG CGTTCCAACA ATATCGAACT CGCGCTGGGC TACGAAGGCG
 401 ACCGCTGGCA ATACAATCTG GCACTCTACC GCAACCGCTT CGGTAACTAC
 451 ATTTACGCCC AAACCTTAAA CGACGGACGC GGCCCCAAAT CCATCGAAGA
 501 CGACAGCGAA ATGAAGCTCG TGCGCTACAA CCAATCCGGC GCCGACTTCT
 551 ACGGCGCGGA AGGCGAAATC TACTTCAAAC CGACACCGCG CTACCGCATC
```

-continued

```
 601 GGCGTTTCCG GCGACTATGT ACGAGGCCGT CTGAAAAACC TGCCTTCCCT

 651 ACCCGGCAGA GAAGATGCCT ACGGCAACCG TCCTTTCATC GCACAGGACG

 701 ACCAAAATGC CCCCCGTGTT CCGGCTGCGC GCCTCGGCTT CCACCTGAAA

 751 GCCTCGCTGA CCGACCGTAT CGATGCCAAT TTGGACTACT ACCGCGTGTT

 801 CGCCCAAAAC AAACTCGCCC GCTACGAAAC GCGCACGCCC GGACACCATA

 851 TGCTCAACCT CGGCGCAAAC TACCGCCGCA ATACGCGCTA TGGCGAGTGG

 901 AATTGGTACG TCAAAGCCGA CAACCTGCTC AACCAATCCG TTTACGCCCA

 951 CAGCAGCTTT CTCTCTGATA CGCCGCAAAT GGGCCGCAGC TTTACCGGCG

1001 GCGTGAACG TGAAGTTTTA A
```

This corresponds to the amino acid sequence <SEQ ID 598; ORF 149>:

```
m149.pep
  1  MLLDNKVQHY SFFGVEQANW DNFTLEGGVR VEKQKASIQY DKALIDRENY

 51  YNHPLPDLGA HRQTARSFAL SGNWYFTPQH KLSLTASHQE RLPSTQELYA

101  HGKHVATNTF EVGNKHLNKE RSNNIELALG YEGDRWQYNL ALYRNRFGNY

151  IYAQTLNDGR GPKSIEDDSE MKLVRYNQSG ADFYGAEGEI YFKPTPRYRI

201  GVSGDYVRGR LKNLPSLPGR EDAYGNRPFI AQDDQNAPRV PAARLGFHLK

251  ASLTDRIDAN LDYYRVFAQN KLARYETRTP GHHMLNLGAN YRRNTRYGEW

301  NWYVKADNLL NQSVYAHSSF LSDTPQMGRS FTGGVNVKF*
```

Computer analysis of this amino acid sequence gave the following results:

Homology with a Predicted ORF from *N. gonorrhoeae*

ORF 149 shows 95.9% identity over a 339 aa overlap with a predicted ORF (ORF 149.ng) from *N. gonorrhoeae*:

```
m149/g149

                     10        20        30        40        50        60
m149.pep    MLLDNKVQHYSFFGVEQANWDNFTLEGGVRVEKQKASIQYDKALIDRENYYNHPLPDLGA
            ||:||:|:||||||||||||||||||||||||||||||:|||||||||||||:|||||||
g149        MLIDNNVRHYSFFGVEQANWDNFTLEGGVRVEKQKASIRYDKALIDRENYYNQPLPDLGA
                     10        20        30        40        50        60

                     70        80        90       100       110       120
m149.pep    HRQTARSFALSGNWYFTPQHKLSLTASHQERLPSTQELYAHGKHVATNTFEVGNKHLNKE
            |||||||||||||||||:||||||||||||||||||||||||||||||||||||||||||
g149        HRQTARSFALSGNWYFTPHHKLSLTASHQERLPSTQELYAHGKHVATNTFEVGNKHLNKE
                     70        80        90       100       110       120

                    130       140       150       160       170       180
m149.pep    RSNNIELALGYEGDRWQYNLALYRNRFGNYIYAQTLNDGRGPKSIEDDSEMKLVRYNQSG
            |||||||||||:||||||||| ||||||||||||||||||||||||||||||||||||||
g149        RSNNIELALGYKGDRWQYNLAAYRNRFGNYIYAQTLNDGRGPKSIEDDSEMKLVRYNQSG
                    130       140       150       160       170       180

                    190       200       210       220       230       240
m149.pep    ADFYGAEGEIYFKPTPRYRIGVSGDYVRGRLKNLPSLPGREDAYGNRPFIAQDDQNAPRV
            |||||||||||||||||||||||||||||||||||||||||| ||:|||||| ||||||:
g149        ADFYGAEGEIYFKPTPRYRIGVSGDYVRGRLKNLPSLPGREDPYGKRPFIAQADONAPRI
                    190       200       210       220       230       240

                    250       260       270       280       290       300
m149.pep    PAARLGFHLKASLTDRIDANLDYYRVFAQNKLARYETRTPGHHMLNLGANYRRNTRYGEW
            ||||||||||:|||||||||||||||||||||||||||||||||||||||||||||||||
g149        PAARLGFHLKTSLTDRIDANLDYYRVFAQNKLARYETRTPGHHMLNLGANYRRNTRYGEW
                    250       260       270       280       290       300

                    310       320       330       340
m149.pep    NWYVKADNLLNQSVYAHSSFLSDTPQMGRSFTGGVNVKFX
            |||||||||||||||||||||||||||||||:||||||||
g149        NWYVKADNLLNQSVYAHSSFLSDTPQMGRSFAGGVNVKFX
                    310       320       330       340
```

The following partial DNA sequence was identified in *N. meningitidis* <SEQ ID 599>:

```
a149.seq
   1 ATGCTGCTTG ACAATAAAGT GCAACATTAC AGCTTTTTCG GTGTAGAACA

  51 GGCAAACTGG GACAACTTCA CGCTTGAAGG CGGCGTACGC GTGGAAAAAC

 101 AAAAAGCCTC CATCCGCTAC GACAAAGCAT TGATTGATCG GGAAAACTAC

 151 TACAACCATC CCCTGCCCGA CCTCGGCGCG CACCGCCAAA CCGCCCGCTC

 201 ATTCGCACTT TCGGGCAACT GGTATTTCAC GCCACAACAC AAACTCAGCC

 251 TGACCGCCTC CCATCAGGAA CGCCTGCCGT CAACGCAAGA GCTGTACGCA

 301 CACGGCAAAC ACGTCGCCAC CAACACCTTT GAAGTCGGCA ACAAACACCT

 351 CAACAAAGAG CGTTCCAACA ATATCGAACT CGCGCTGGGC TACGAAGGCG

 401 ACCGCTGGCA ATACAATCTG GCACTCTACC GCAACCGCTT CGGCAACTAC

 451 ATTTACGCCC AAACCTTAAA CGACGGACGC GGCCCCAAAT CCATCGAAGA

 501 CGACAGCGAA ATGAAGCTCG TGCGCTACAA CCAATCCGGT GCGGACTTCT

 551 ACGGCGCGGA AGGCGAAATC TACTTCAAAC CGACACCGCG CTACCGCATC

 601 GGCGTTTCCG GCGACTATGT ACGAGGCCGT CTGAAAAACC TGCCTTCCCT

 651 ACCCGGCAGG GAAGACGCCT ACGGCAACCG CCCACTCATT GCCCAAGCCG

 701 ACCAAAACGC CCCTCGCGTT CCGGCTGCGC GCCTCGGCGT CCACCTGAAA

 751 GCCTCGCTGA CCGACCGCAT CGATGCCAAT TTGGACTACT ACCGCGTGTT

 801 CGCCCAAAAC AAACTCGCCC GCTACGAAAC GCGCACGCCC GGACACCATA

 851 TGCTCAACCT CGGCGCAAAC TACCGCCGCA ATACGCGCTA TGGCGAGTGG

 901 AATTGGTACG TCAAAGCCGA CAACCTGCTC AACCAATCCG TTTACGCCCA

 951 CAGCAGCTTC CTCTCTGATA CGCCGCAAAT GGGCCGCAGC TTTACCGGCG

1001 GCGTGAACGT GAAGTTTTAA
```

This corresponds to the amino acid sequence <SEQ ID 600; ORF 149.a>:

```
a149.pep
  1  MLLDNKVQHY SFFGVEQANW DNFTLEGGVR VEKQKASIRY DKALIDRENY

 51  YNHPLPDLGA HRQTARSFAL SGNWYFTPQH KLSLTASHQE RLPSTQELYA

101  HGKHVATNTF EVGNKHLNKE RSNNIELALG YEGDRWQYNL ALYRNRFGNY

151  IYAQTLNDGR GPKSIEDDSE MKLVRYNQSG ADFYGAEGEI YFKPTPRYRI

201  GVSGDYVRGR LKNLPSLPGR EDAYGNRPLI AQADQNAPRV PAARLGVHLK

251  ASLTDRIDAN LDYYRVFAQN KLARYETRTP GHHMLNLGAN YRRNTRYGEW

301  NWYVKADNLL NQSVYAHSSF LSDTPQMGRS FTGGVNVKF*
```

m149/a149 98.8% identity in 339 aa overlap

```
                   10        20        30        40        50        60
m149.pep   MLLDNKVQHYSFFGVEQANWDNFTLEGGVRVEKQKASIQYDKALIDRENYYNHPLPDLGA
           ||||||||||||||||||||||||||||||||||||||:|||||||||||||||||||||
a149       MLLDNKVQHYSFFGVEQANWDNFTLEGGVRVEKQKASIRYDKALIDRENYYNHPLPDLGA
                   10        20        30        40        50        60

                   70        80        90       100       110       120
m149.pep   HRQTARSFALSGNWYFTPQHKLSLTASHQERLPSTQELYAHGKHVATNTFEVGNKHLNKE
           ||||||||||||||||||||||||||||||||||||||||||||||||||||||||||||
a149       HRQTARSFALSGNWYFTPQHKLSLTASHQERLPSTQELYAHGKHVATNTFEVGNKHLNKE
                   70        80        90       100       110       120
```

-continued

```
                130       140       150       160       170       180
m149.pep RSNNIELALGYEGDRWQYNLALYRNRFGNYIYAQTLNDGRGPKSIEDDSEMKLVRYNQSG
         ||||||||||||||||||||||||||||||||||||||||||||||||||||||||||||
a149     RSNNIELALGYEGDRWQYNLALYRNRFGNYIYAQTLNDGRGPKSIEDDSEMKLVRYNQSG
                130       140       150       160       170       180

                190       200       210       220       230       240
m149.pep ADFYGAEGEIYFKPTPRYRIGVSGDYVRGRLKNLPSLPGREDAYGNRPFIAQDDQNAPRV
         ||||||||||||||||||||||||||||||||||||||||||||||||:||| |||||||
a149     ADFYGAEGEIYFKPTPRYRIGVSGDYVRGRLKNLPSLPGREDAYGNRPLIAQADQNAPRV
                190       200       210       220       230       240

                250       260       270       280       290       300
m149.pep PAARLGFHLKASLTDRIDANLDYYRVFAQNKLARYETRTPGHHMLNLGANYRRNTRYGEW
         |||||| |||||||||||||||||||||||||||||||||||||||||||||||||||||
a149     PAARLGVHLKASLTDRIDANLDYYRVFAQNKLARYETRTPGHHMLNLGANYRRNTRYGEW
                250       260       270       280       290       300

                310       320       330       340
m149.pep NWYVKADNLLNQSVYAHSSFLSDTPQMGRSFTGGVNVKFX
         ||||||||||||||||||||||||||||||||||||||||
a149     NWYVKADNLLNQSVYAHSSFLSDTPQMGRSFTGGVNVKFX
                310       320       330       340
```

The following partial DNA sequence was identified in *N. gonorrhoeae* <SEQ ID 601>:

```
g149-1.seq
   1  ATGGCACAAA TCACACTCAA ACCCATTGTT TTATCAATTC TTTTAATCAA

  51  CACACCCCTC CTCGCCCAAG CGCATGAAAC TGAGCAATCG GTGGGCTTGG

 101  AAACGGTCAG CGTCGTCGGC AAAAGCCGTC CGCGCGCGAC TTCGGGGCTG

 151  CTGCACACTT CGACCGCCTC CGACAAAATC ATCTCCGGCG ATACTTTGCG

 201  CCAAAAAGCC GTCAACTTGG GCGACGCTTT GGACGGCGTA CCGGGCATCC

 251  ACGCTTCGCA ATACGGCGGC GGCGCATCCG CTCCCGTTAT TCGCGGTCAA

 301  ACGGGCAGAC GGATTAAAGT ATTGAACCAT CACGGCGAAA CGGGCGATAT

 351  GGCGGACTTT TCTCCCGATC ACGCCATTAT GGTAGATACC GCCTTGTCGC

 401  AACAGGTTGA AATCCTGCGC GGGCCGGTTA CGCTCTTGTA CAGCTCGGGC

 451  AATGTGGCGG GGCTGGTCGA TGTTGCCGAT GGAAAAATCC CCGAAAAAAT

 501  GCCTGAAAAC GGCGTATCGG GCGaagccgG ATTGCGTTTG AGCAGCGGCA

 551  ATTTAGAAAA ACTGACATCC GCAGGCATCA ATATCGGACT GGGCAAAAAC

 601  TTCGTGCTGC ATACCGAAGG CTTGTACCGC AAATCGGGCG ATTACGCCGT

 651  ACCGCGTTAC CGCAATCTGA AACGCCTGCC CGACAGCCAT GCCGATTCGC

 701  AAACGGGCAG CATCGGGCTG TCTTGGGTGG GCGAAAAAGG CTTTATCGGC

 751  GCAGCATACA GCGACCGTCG CGACCGCTAC GGCCTGCCTG CCCACAGCCA

 801  CGAATACGAT GATTGCCACG CCGACATCAT CTGGCAAAAG AGTTTGATCA

 851  ACAAACGCTA TTTGCAGCTT TATCCGCACT TGTTGACCGA AGAAGACATC

 901  GATTACGACA ATCCGGGCTT GAGCTGCGGC TTCCACGACG GCGACGGTGC

 951  ACACGCACAC ACCCACAACG GCAAACCGTG GATAGACCTG CGCAACAAAC

1001  GCTACGAACT CCGCGCCGAA TGGAAGCAGC CATTCCCCGG TTTTGAAGCC

1051  CTGCGCGTAC ATCTGAACCG CAATGACTAC CACCACGACG AAAAAGCAGG

1101  CGATGCAGTA GAAAACTTCT TCAACAACAA AACACACAAC GCCCGTATCG

1151  AGTTGCGCCA CCAACCCATA GGCCGTCTGA AAGGCAGCTG GGGCGTGCAA

1201  TATTTGGGAC AAAAATCCAG CGCGCTTTCC GCCATTCCCG AAACCGTCCA

1251  ACAACCGATG TTGATTGACA ACAATGTCCG CCATTACAGC TTTTTCGGTG
```

-continued

```
1301 TAGAACAGGC AAATTGGGAC AACTTCACGC TTGAAGGCGG CGTACGCGTG

1351 GAAAAACAAA AAGCCTCCAT CCGGTACGAC AAAGCATTGA TTGATCGAGA

1401 AAACTACTAC AACCAGCCCC TGCCCGACCT CGGCGCGCAC CGCCAAACCG

1451 CCCGCTCGTT CGCACTTTCG GGCAACTGGT ATTTCACGCC ACACCACAAA

1501 CTCAGCCTGA CCGCCTCCCA TCAGGAACGC CTGCCGTCAA CGCAAGAACT

1551 GTACGCACAC GGCAAGCACG TCGCCACCAA CACCTTTGAA GTCGGCAACA

1601 AACACCTCAA CAAAGAGCGT TCCAACAATA TCGAACTCGC GCTGGGCTAC

1651 GAAGGCGACC GCTGGCAATA CAATCTGGCA GCCTACCGCA ACCGATTCGG

1701 CAACTACATT TACGCCCAAA CCTTAAACGA CGGACGCGGC CCCAAATCCA

1751 TCGAAGACGA CAGCGAAATG AAGCTCGTGC GCTACAACCA ATCCGGTGCC

1801 GACTTCTACG GCGCGGAAGG CGAAATCTAC TTCAAACCGA CACCGCGCTA

1851 CCGCATCGGT GTTTCCGGCG ACTATGTACG AGGCCGTCTG AAAAACCTGC

1901 CGTCCCTACC CGGCAGGGAA GATCCCTACG GCAAACGTCC CTTCATCGCA

1951 CAAGCCGACC AAAACGCCCC CCGCATTCCG GCTGCGCGCC TCGGCTTCCA

2001 CCTGAAAACC TCGCTAACCG ACCGTATCGA TGCCAATTTG GACTACTACC

2051 GCGTGTTCGC CCAAAACAAA CTCGCCCGCT ACGAAACGCG TACGCCCGGA

2101 CACCATATGC TCAACCTCGG TGCAAACTAC CGCCGCAATA CGCGCTATGG

2151 CGAGTGGAAT TGGTACGTCA AAGCCGACAA CCTGCTCAAC CAATCCGTTT

2201 ACGCCCACAG CAGCTTCCTC TCTGATACGC CGCAAATGGG CCGCAGCTTT

2251 ACCGGCGGCG TAAACGTGAA GTTTTAA
```

This corresponds to the amino acid sequence <SEQ ID 602; ORF 149-1.ng>:

```
g149-1.pep
   1 MAQITLKPIV LSILLINTPL LAQAHETEQS VGLETVSVVG KSRPRATSGL

  51 LHTSTASDKI ISGDTLRQKA VNLGDALDGV PGIHASQYGG GASAPVIRGQ

 101 TGRRIKVLNH HGETGDMADF SPDHAIMVDT ALSQQVEILR GPVTLLYSSG

 151 NVAGLVDVAD GKIPEKMPEN GVSGEAGLRL SSGNLEKLTS AGINIGLGKN

 201 FVLHTEGLYR KSGDYAVPRY RNLKRLPDSH ADSQTGSIGL SWVGEKGFIG

 251 AAYSDRRDRY GLPAHSHEYD DCHADIIWQK SLINKRYLQL YPHLLTEEDI

 301 DYDNPGLSCG FHDGDGAHAH THNGKPWIDL RNKRYELRAE WKQPFPGFEA

 351 LRVHLNRNDY HHDEKAGDAV ENFFNNKTHN ARIELRHQPI GRLKGSWGVQ

 401 YLGQKSSALS AIPETVQQPM LIDNNVRHYS FFGVEQANWD NFTLEGGVRV

 451 EKQKASIRYD KALIDRENYY NQPLPDLGAH RQTARSFALS GNWYFTPHHK

 501 LSLTASHQER LPSTQELYAH GKHVATNTFE VGNKHLNKER SNNIELALGY

 551 EGDRWQYNLA AYRNRFGNYI YAQTLNDGRG PKSIEDDSEM KLVRYNQSGA

 601 DFYGAEGEIY FKPTPRYRIG VSGDYVRGRL KNLPSLPGRE DPYGKRPFIA

 651 QADQNAPRIP AARLGFHLKT SLTDRIDANL DYYRVFAQNK LARYETRTPG

 701 HHMLNLGANY RRNTRYGEWN WYVKADNLLN QSVYAHSSFL SDTPQMGRSF

 751 TGGVNVKF*
```

The following partial DNA sequence was identified in *N. meningitidis* <SEQ ID 603>:

```
m149-1.seq
     1  ATGGCACAAA CTACACTCAA ACCCATTGTT TTATCAATTC TTTTAATCAA

    51  CACACCCCTC CTCGCCCAAG CGCATGAAAC TGAGCAATCG GTGGATTTGG

   101  AAACGGTCAG CGTCGTCGGC AAAAGCCGTC CGCGCGCCAC GTCGGGGCTG

   151  TTGCACACTT CGACCGCCTC CGACAAAATC ATCTCCGGCG ATACCTTGCG

   201  CCAAAAAGCC GTCAACTTGG GCGACGCTTT AGACGGCGTA CCGGGCATCC

   251  ACGCTTCGCA ATACGGCGGC GGCGCGTCTG CTCCCGTCAT TCGCGGTCAA

   301  ACAGGCAGGC GGATTAAAGT GTTGAACCAT CACGGCGAAA CAGGCGATAT

   351  GGCGGATTTT TCGCCCGATC ACGCCATTAT GGTAGATACC GCCTTGTCGC

   401  AACAGGTCGA AATCCTGCGC GGGCCGGTTA CGCTCTTGTA CAGCTCGGGC

   451  AATGTGGCGG GGCTGGTCGA TGTTGCCGAT GGCAAAATCC CCGAAAAAAT

   501  GCCTGAAAAC GGCGTATCGG GCGAACTCGG ATTGCGTTTG AGCAGCGGCA

   551  ATCTGGAAAA ACTCACGTCC GGCGGCATCA ATATCGGTTT GGGCAAAAAC

   601  TTTGTATTGC ACACGGAAGG GCTGTACCGC AAATCGGGGG ATTACGCCGT

   651  ACCGCGTTAC CGCAATCTGA AACGCCTGCC CGACAGCCAC GCCGATTCGC

   701  AAACGGGCAG CATCGGGCTG TCTTGGGTTG GCGAAAAAGG TTTTATCGGC

   751  GTAGCGTACA GCGACCGTCG CGACCAATAT GGTCTGCCTG CCCACAGCCA

   801  CGAATACGAT GATTGCCACG CCGACATCAT CTGGCAAAAG AGCTTGATTA

   851  ACAAACGCTA TTTACAGCTT TATCCGCACC TGTTGACCGA AGAAGACATC

   901  GATTACGACA ATCCGGGCTT GAGCTGCGGC TTCCACGACG ACGATAATGC

   951  ACACGCACAC ACCCACAGCG GCAGACCGTG GATAGACCTG CGCAACAAAC

  1001  GCTACGAACT CCGTGCCGAA TGGAAGCAAC CGTTCCCCGG TTTTGAAGCC

  1051  CTGCGCGTAC ACCTGAACCG CAACGACTAC CGCCACGACG AAAAAGCAGG

  1101  CGATGCAGTC GAAAACTTTT TTAACAACCA AACGCAAAAC GCCCGCATCG

  1151  AGTTGCGCCA CCAACCCATA GGTCGTCTGA AAGGCAGCTG GGGCGTGCAA

  1201  TATTTACAAC AAAAATCCAG TGCTTTATCT GCCATATCCG AAGCGGTTAA

  1251  ACAACCGATG CTGCTTGACA ACAAAGTGCA ACATTACAGC TTTTTCGGTG

  1301  TAGAACAGGC AAACTGGGAC AACTTCACGC TTGAAGGAGG CGTACGCGTG

  1351  GAAAAACAAA AAGCCTCCAT TCAGTACGAC AAAGCATTGA TTGATCGGGA

  1401  AAACTACTAC AACCACCCCC TGCCCGACCT CGGCGCGCAC CGCCAAACCG

  1451  CCCGCTCATT CGCACTTTCG GGCAACTGGT ATTTCACGCC ACAACACAAA

  1501  CTCAGCCTGA CCGCCTCCCA TCAGGAACGC CTGCCGTCAA CGCAAGAGCT

  1551  GTACGCACAC GGCAAACACG TCGCCACCAA CACCTTTGAA GTCGGCAACA

  1601  AACACCTCAA CAAAGAGCGT TCCAACAATA TCGAACTCGC GCTGGGCTAC

  1651  GAAGGCGACC GCTGGCAATA CAATCTGGCA CTCTACCGCA ACCGCTTCGG

  1701  TAACTACATT TACGCCCAAA CCTTAAACGA CGGACGCGGC CCCAAATCCA

  1751  TCGAAGACGA CAGCGAAATG AAGCTCGTGC GCTACAACCA ATCCGGCGCC

  1801  GACTTCTACG GCGCGGAAGG CGAAATCTAC TTCAAACCGA CACCGCGCTA

  1851  CCGCATCGGC GTTTCCGGCG ACTATGTACG AGGCCGTCTG AAAAACCTGC

  1901  CTTCCCTACC CGGCAGAGAA GATGCCTACG GCAACCGTCC TTTCATCGCA
```

-continued

```
1951 CAGGACGACC AAAATGCCCC CCGTGTTCCG GCTGCGCGCC TCGGCTTCCA

2001 CCTGAAAGCC TCGCTGACCG ACCGTATCGA TGCCAATTTG GACTACTACC

2051 GCGTGTTCGC CCAAAACAAA CTCGCCCGCT ACGAAACGCG CACGCCCGGA

2101 CACCATATGC TCAACCTCGG CGCAAACTAC CGCCGCAATA CGCGCTATGG

2151 CGAGTGGAAT TGGTACGTCA AAGCCGACAA CCTGCTCAAC CAATCCGTTT

2201 ACGCCCACAG CAGCTTTCTC TCTGATACGC CGCAAATGGG CCGCAGCTTT

2251 ACCGGCGGCG TGAACGTGAA GTTTTAA
```

This corresponds to the amino acid sequence <SEQ ID 604; ORF 149-1>:

```
m149-1.pep

      1 MAQTTLKPIV LSILLINTPL LAQAHETEQS VDLETVSVVG KSRPRATSGL

     51 LHTSTASDKI ISGDTLRQKA VNLGDALDGV PGIHASQYGG GASAPVIRGQ

    101 TGRRIKVLNH HGETGDMADF SPDHAIMVDT ALSQQVEILR GPVTLLYSSG

    151 NVAGLVDVAD GKIPEKMPEN GVSGELGLRL SSGNLEKLTS GGINIGLGKN

    201 FVLHTEGLYR KSGDYAVPRY RNLKRLPDSH ADSQTGSIGL SWVGEKGFIG

    251 VAYSDRRDQY GLPAHSHEYD DCHADIIWQK SLINKRYLQL YPHLLTEEDI

    301 DYDNPGLSCG FHDDDNAHAH THSGRPWIDL RNKRYELRAE WKQPFPGFEA

    351 LRVHLNRNDY RHDEKAGDAV ENFFNNQTQN ARIELRHQPI GRLKGSWGVQ

    401 YLQQKSSALS AISEAVKQPM LLDNKVQHYS FFGVEQANWD NFTLEGGVRV

    451 EKQKASIQYD KALIDRENYY NHPLPDLGAH RQTARSFALS GNWYFTPQHK

    501 LSLTASHQER LPSTQELYAH GKHVATNTFE VGNKHLNKER SNNIELALGY

    551 EGDRWQYNLA LYRNRFGNYI YAQTLNDGRG PKSIEDDSEM KLVRYNQSGA

    601 DFYGAEGEIY FKPTPRYRIG VSGDYVRGRL KNLPSLPGRE DAYGNRPFIA

    651 QDDQNAPRVP AARLGFHLKA SLTDRIDANL DYYRVFAQNK LARYETRTPG

    701 HHMLNLGANY RRNTRYGEWN WYVKADNLLN QSVYAHSSFL SDTPQMGRSF

    751 TGGVNVKF*

m149-1/g149-1 96.2% identity in 758 aa overlap

                    10        20        30        40        50        60
m149-1.pep  MAQTTLKPIVLSILLINTPLLAQAHETEQSVDLETVSVVGKSRPRATSGLLHTSTASDKI
            ||| |||||||||||||||||||||||||| |||||||||||||||||||||||||||||
g149-1      MAQITLKPIVLSILLINTPLLAQAHETEQSVGLETVSVVGKSRPRATSGLLHTSTASDKI
                    10        20        30        40        50        60

                    70        80        90       100       110       120
m149-1.pep  ISGDTLRQKAVNLGDALDGVPGIHASQYGGGASAPVIRGQTGRRIKVLNHHGETGDMADF
            ||||||||||||||||||||||||||||||||||||||||||||||||||||||||||||
g149-1      ISGDTLRQKAVNLGDALDGVPGIHASQYGGGASAPVIRGQTGRRIKVLNHHGETGDMADF
                    70        80        90       100       110       120

                   130       140       150       160       170       180
m149-1.pep  SPDHAIMVDTALSQQVEILRGPVTLLYSSGNVAGLVDVADGKIPEKMPENGVSGELGLRL
            ||||||||||||||||||||||||||||||||||||||||||||||||||||||||||||
g149-1      SPDHAIMVDTALSQQVEILRGPVTLLYSSGNVAGLVDVADGKIPEKMPENGVSGELGLRL
                   130       140       150       160       170       180

                   190       200       210       220       230       240
m149-1.pep  SSGNLEKLTSGGINIGLGKNFVLHTEGLYRKSGDYAVPRYRNLKRLPDSHADSQTGSIGL
            ||||||||||:|||||||||||||||||||||||||||||||||||||||||||||||||
g149-1      SSGNLEKLTSAGINIGLGKNFVLHTEGLYRKSGDYAVPRYRNLKRLPDSHADSQTGSIGL
                   190       200       210       220       230       240
```

-continued

```
                      250       260       270       280       290       300
m149-1.pep     SWVGEKGFIGVAYSDRRDQYGLPAHSHEYDDCHADIIWQKSLINKRYLQLYPHLLTEEDI
               ||||||||||:|||||||:|||||||||||||||||||||||||||||||||||||||||
g149-1         SWVGEKGFIGAAYSDRRDRYGLPAHSHEYDDCHADIIWQKSLINKRYLQLYPHLLTEEDI
                      250       260       270       280       290       300

                      310       320       330       340       350       360
m149-1.pep     DYDNPGLSCGFHDDDNAHAHTHSGRPWIDLRNKRYELRAEWKQPFPGFEALRVHLNRNDY
               ||||||||||||| |:||||||:|:|||||||||||||||||||||||||||||||||||
g149-1         DYDNPGLSCGFHDGDGAHAHTHNGKPWIDLRNKRYELRAEWKQPFPGFEALRVHLNRNDY
                      310       320       330       340       350       360

                      370       380       390       400       410       420
m149-1.pep     RHDEKAGDAVENFFNNQTQNARIELRHQPIGRLKGSWGVQYLQQKSSALSAISEAVKQPM
               :|||||||||||||||:|:||||||||||||||||||||||| ||||||||| |:|:|||
g149-1         HHDEKAGDAVENFFNNKTHNARIELRHQPIGRLKGSWGVQYLGQKSSALSAIPETVQQPM
                      370       380       390       400       410       420

                      430       440       450       460       470       480
m149-1.pep     LLDNKVQHYSFFGVEQANWDNFTLEGGVRVEKQKASIQYDKALIDRENYYNHPLPDLGAH
               |:||:|:||||||||||||||||||||||||||||||:|||||||||||||:||||||||
g149-1         LIDNNVRHYSFFGVEQANWDNFTLEGGVRVEKQKASIRYDKALIDRENYYNOPLPDLGAH
                      430       440       450       460       470       480

                      490       500       510       520       530       540
m149-1.pep     RQTARSFALSGNWYFTPQHKLSLTASHQERLPSTQELYAHGKHVATNTFEVGNKHLNKER
               |||||||||||||||||:||||||||||||||||||||||||||||||||||||||||||
g149-1         RQTARSFALSGNWYFTPHHKLSLTASHQERLPSTQELYAHGKHVATNTFEVGNKHLNKER
                      490       500       510       520       530       540

                      550       560       570       580       590       600
m149-1.pep     SNNIELALGYEGDRWQYNLALYRNRFGNYIYAQTLNDGRGPKSIEDDSEMKLVRYNQSGA
               |||||||||||||||||||| |||||||||||||||||||||||||||||||||||||||
g149-1         SNNIELALGYEGDRWQYNLAAYRNRFGNYIYAQTLNDGRGPKSIEDDSEMKLVRYNQSGA
                      550       560       570       580       590       600

                      610       620       630       640       650       660
m149-1.pep     DFYGAEGEIYFKPTPRYRIGVSGDYVRGRLKNLPSLPGREDAYGNRPFIAQDDQNAPRVP
               ||||||||||||||||||||||||||||||||||||||||| ||:|||||| ||||||:|
g149-1         DFYGAEGEIYFKPTPRYRIGVSGDYVRGRLKNLPSLPGREDPYGKRPFIAQADQNAPRIP
                      610       620       630       640       650       660

                      670       680       690       700       710       720
m149-1.pep     AARLGFHLKASLTDRIDANLDYYRVFAQNKLARYETRTPGHHMLNLGANYRRNTRYGEWN
               |||||||||:||||||||||||||||||||||||||||||||||||||||||||||||||
g149-1         AARLGFHLKTSLTDRIDANLDYYRVFAQNKLARYETRTPGHHMLNLGANYRRNTRYGEWN
                      670       680       690       700       710       720

                      730       740       750      759
m149-1.pep     WYVKADNLLNQSVYAHSSFLSDTPQMGRSFTGGVNVKFX
               ||||||||||||||||||||||||||||||||||||||
g149-1         WYVKADNLLNQSVYAHSSFLSDTPQMGRSFTGGVNVKFX
                      730       740       750
```

The following partial DNA sequence was identified in *N. meningitidis* <SEQ ID 605>:

```
a149-1.seq
     1  ATGGCACAAA CTACACTCAA ACCCATTGTT TTATCAATTC TTTTAATCAA

    51  CACACCCCTC CTCTCCCAAG CGCATGGAAC TGAGCAATCA GTGGGCTTGG

   101  AAACGGTCAG CGTCGTCGGC AAAAGCCGTC CGCGCGCCAC TTCGGGGCTG

   151  CTGCACACTT CTACCGCCTC CGACAAAATC ATCAGCGGCG ACACCTTGCG

   201  ACAAAAAGCC GTCAACTTGG GTGATGCTTT AGACGGCGTA CCGGGCATTC

   251  ATGCCTCGCA ATACGGCGGC GGCGCATCCG CTCCCGTTAT TCGCGGTCAA

   301  ACAGGCAGAC GGATTAAAGT GTTGAACCAT CACGGCGAAA CGGGCGACAT

   351  GGCGGACTTC TCTCCAGACC ATGCAATCAT GGTGGACAGC GCCTTGTCGC

   401  AACAGGTCGA AATCCTGCGC GGTCCGGTTA CGCTCTTGTA CAGCTCGGGC

   451  AATGTGGCGG GGCTGGTCGA TGTTGCCGAT GGCAAAATCC CCGAAAAAAT

   501  GCCTGAAAAC GGCGTATCGG GCGAACTCGG ATTGCGTTTG AGCAGCGGCA

   551  ATCTGGAAAA ACTCACGTCC GGCGGCATCA ATATCGGTTT GGGCAAAAAC
```

-continued

```
 601  TTTGTATTGC ACACGGAAGG GCTGTACCGC AAATCGGGGG ATTACGCCGT
 651  ACCGCGTTAC CGCAATCTGA AACGCCTGCC CGACAGCCAC GCCGATTCGC
 701  AAACGGGCAG CATCGGGCTG TCTTGGGTTG GCGAAAAAGG CTTTATCGGC
 751  GCAGCATACA GCGACCGTCG CGACCAATAT GGTCTGCCTG CCCACAGCCA
 801  CGAATACGAT GATTGCCACG CCGACATCAT CTGGCAAAAG AGTTTGATTA
 851  ACAAACGCTA TTTGCAGCTT TATCCGCACC TGTTGACCGA AGAAGACATC
 901  GATTACGACA ATCCGGGCTT GAGCTGCGGC TTTCACGACG ACGATGATGC
 951  ACACGCCCAT GCCCACAACG GCAAACCTTG GATAGACCTG CGCAACAAAC
1001  GCTACGAACT CCGCGCCGAA TGGAAGCAAC CGTTCCCCGG TTTTGAAGCC
1051  CTGCGCGTAC ACCTGAACCG CAACGACTAC CGCCACGACG AAAAAGCAGG
1101  CGATGCAGTA GAAAACTTTT TTAACAACCA AACGCAAAAC GCCCGTATCG
1151  AGTTGCGCCA CCAACCCATA GGCCGTCTGA AAGGCAGCTG GGGCGTGCAA
1201  TATTTGGGAC AAAAATCCAG TGCTTTATCT GCCACATCCG AAGCGGTCAA
1251  ACAACCGATG CTGCTTGACA ATAAAGTGCA ACATTACAGC TTTTTCGGTG
1301  TAGAACAGGC AAACTGGGAC AACTTCACGC TTGAAGGCGG CGTACGCGTG
1351  GAAAAACAAA AAGCCTCCAT CCGCTACGAC AAAGCATTGA TTGATCGGGA
1401  AAACTACTAC AACCATCCCC TGCCCGACCT CGGCGCGCAC CGCCAAACCG
1451  CCCGCTCATT CGCACTTTCG GGCAACTGGT ATTTCACGCC ACAACACAAA
1501  CTCAGCCTGA CCGCCTCCCA TCAGGAACGC CTGCCGTCAA CGCAAGAGCT
1551  GTACGCACAC GGCAAACACG TCGCCACCAA CACCTTTGAA GTCGGCAACA
1601  AACACCTCAA CAAAGAGCGT TCCAACAATA TCGAACTCGC GCTGGGCTAC
1651  GAAGGCGACC GCTGGCAATA CAATCTGGCA CTCTACCGCA ACCGCTTCGG
1701  CAACTACATT TACGCCCAAA CCTTAAACGA CGGACGCGGC CCCAAATCCA
1751  TCGAAGACGA CAGCGAAATG AAGCTCGTGC GCTACAACCA ATCCGGTGCG
1801  GACTTCTACG GCGCGGAAGG CGAAATCTAC TTCAAACCGA CACCGCGCTA
1851  CCGCATCGGC GTTTCCGGCG ACTATGTACG AGGCCGTCTG AAAAACCTGC
1901  CTTCCCTACC CGGCAGGGAA GACGCCTACG GCAACCGCCC ACTCATTGCC
1951  CAAGCCGACC AAAACGCCCC TCGCGTTCCG GCTGCGCGCC TCGGCGTCCA
2001  CCTGAAAGCC TCGCTGACCG ACCGCATCGA TGCCAATTTG GACTACTACC
2051  GCGTGTTCGC CCAAAACAAA CTCGCCCGCT ACGAAACGCG CACGCCCGGA
2101  CACCATATGC TCAACCTCGG CGCAAACTAC CGCCGCAATA CGCGCTATGG
2151  CGAGTGGAAT TGGTACGTCA AAGCCGACAA CCTGCTCAAC CAATCCGTTT
2201  ACGCCCACAG CAGCTTCCTC TCTGATACGC CGCAAATGGG CCGCAGCTTT
2251  ACCGGCGGCG TGAACGTGAA GTTTTAA
```

This corresponds to the amino acid sequence <SEQ ID 606; ORF 149-1.a>:

```
a149-1.pep

 1 MAQTTLKPIV LSILLINTPL LSQAHGTEQS VGLETVSVVG KSRPRATSGL
51 LHTSTASDKI ISGDTLRQKA VNLGDALDGV PGIHASQYGG GASAPVIRGQ
```

-continued

```
101 TGRRIKVLNH HGETGDMADF SPDHAIMVDS ALSQQVEILR GPVTLLYSSG

151 NVAGLVDVAD GKIPEKMPEN GVSGELGLRL SSGNLEKLTS GGINIGLGKN

201 FVLHTEGLYR KSGDYAVPRY RNLKRLPDSH ADSQTGSIGL SWVGEKGFIG

251 AAYSDRRDQY GLPAHSHEYD DCHADIIWQK SLINKRYLQL YPHLLTEEDI

301 DYDNPGLSCG FHDDDDAHAH AHNGKPWIDL RNKRYELRAE WKQPFPGFEA

351 LRVHLNRNDY RHDEKAGDAV ENFFNNQTQN ARIELRHQPI GRLKGSWGVQ

401 YLGQKSSALS ATSEAVKQPM LLDNKVQHYS FFGVEQANWD NFTLEGGVRV

451 EKQKASIRYD KALIDRENYY NHPLPDLGAH RQTARSFALS GNWYFTPQHK

501 LSLTASHQER LPSTQELYAH GKHVATNTFE VGNKHLNKER SNNIELALGY

551 EGDRWQYNLA LYRNRFGNYI YAQTLNDGRG PKSIEDDSEM KLVRYNQSGA

601 DFYGAEGEIY FKPTPRYRIG VSGDYVRGRL KNLPSLPGRE DAYGNRPLIA

651 QADQNAPRVP AARLGVHLKA SLTDRIDANL DYYRVFAQNK LARYETRTPG

701 HHMLNLGANY RRNTRYGEWN WYVKADNLLN QSVYAHSSFL SDTPQMGRSF

751 TGGVNVKF*
```

a149-1/m149-1 98.0% identity in 758 aa overlap

```
                       10        20        30        40        50        60
a149-1.pep     MAQTTLKPIVLSILLINTPLLSQAHGTEQSVDLETVSVVGKSRPRATSGLLHTSTASDKI
               |||||||||||||||||||||:||| ||||| ||||||||||||||||||||||||||||
m149-1         MAQTTLKPIVLSILLINTPLLAQAHETEQSVGLETVSVVGKSRPRATSGLLHTSTASDKI
                       10        20        30        40        50        60

                       70        80        90       100       110       120
a149-1.pep     ISGDTLRQKAVNLGDALDGVPGIHASQYGGGASAPVIRGQTGRRIKVLNHHGETGDMADF
               ||||||||||||||||||||||||||||||||||||||||||||||||||||||||||||
m149-1         ISGDTLRQKAVNLGDALDGVPGIHASQYGGGASAPVIRGQTGRRIKVLNHHGETGDMADF
                       70        80        90       100       110       120

                      130       140       150       160       170       180
a149-1.pep     SPDHAIMVDSALSQQVEILRGPVTLLYSSGNVAGLVDVADGKIPEKMPENGVSGELGLRL
               |||||||||:||||||||||||||||||||||||||||||||||||||||||||||||||
m149-1         SPDHAIMVDTALSQQVEILRGPVTLLYSSGNVAGLVDVADGKIPEKMPENGVSGELGLRL
                      130       140       150       160       170       180

                      190       200       210       220       230       240
a149-1.pep     SSGNLEKLTSGGINIGLGKNFVLHTEGLYRKSGDYAVPRYRNLKRLPDSHADSQTGSIGL
               ||||||||||||||||||||||||||||||||||||||||||||||||||||||||||||
m149-1         SSGNLEKLTSGGINIGLGKNFVLHTEGLYRKSGDYAVPRYRNLKRLPDSHADSQTGSIGL
                      190       200       210       220       230       240

                      250       260       270       280       290       300
a149-1.pep     SWVGEKGFIGAAYSDRRDQYGLPAHSHEYDDCHADIIWQKSLINKRYLQLYPHLLTEEDI
               ||||||||||:|||||||||||||||||||||||||||||||||||||||||||||||||
m149-1         SWVGEKGFIGVAYSDRRDQYGLPAHSHEYDDCHADIIWQKSLINKRYLQLYPHLLTEEDI
                      250       260       270       280       290       300

                      310       320       330       340       350       360
a149-1.pep     DYDNPGLSCGFHDDDDAHAHAHNGKPWIDLRNKRYELRAEWKQPFPGFEALRVHLNRNDY
               |||||||||||||||:||||:|:|:|||||||||||||||||||||||||||||||||||
m149-1         DYDNPGLSCGFHDDDGAHAHTHSGRPWIDLRNKRYELRAEWKQPFPGFEALRVHLNRNDY
                      310       320       330       340       350       360

                      370       380       390       400       410       420
a149-1.pep     RHDEKAGDAVENFFNNQTQNARIELRHQPIGRLKGSWGVQYLGQKSSALSATSEAVKQPM
               |||||||||||||||||||||||||||||||||||||||||| |||||||| ||||||||
m149-1         RHDEKAGDAVENFFNNQTQNARIELRHQPIGRLKGSWGVQYLQQKSSALSAISEAVKQPM
                      370       380       390       400       410       420

                      430       440       450       460       470       480
a149-1.pep     LLDNKVQHYSFFGVEQANWDNFTLEGGVRVEKQKASIRYDKALIDRENYYNHPLPDLGAH
               |||||||||||||||||||||||||||||||||||||:||||||||||||||||||||||
m149-1         LLDNKVQHYSFFGVEQANWDNFTLEGGVRVEKQKASIQYDKALIDRENYYNHPLPDLGAH
                      430       440       450       460       470       480

                      490       500       510       520       530       540
a149-1.pep     RQTARSFALSGNWYFTPQHKLSLTASHQERLPSTQELYAHGKHVATNTFEVGNKHLNKER
               ||||||||||||||||||||||||||||||||||||||||||||||||||||||||||||
m149-1         RQTARSFALSGNWYFTPQHKLSLTASHQERLPSTQELYAHGKHVATNTFEVGNKHLNKER
                      490       500       510       520       530       540
```

-continued

```
                  550        560        570        580        590        600
a149-1.pep   SNNIELALGYEGDRWQYNLALYRNRFGNYIYAQTLNDGRGPKSIEDDSEMKLVRYNQSGA
             |||||||||||||||||||| ||||||||||||||||||||||||||||||||||||||||
m149-1       SNNIELALGYEGDRWQYNLAAYRNRFGNYIYAQTLNDGRGPKSIEDDSEMKLVRYNQSGA
                  550        560        570        580        590        600

                  610        620        630        640        650        660
a149-1.pep   DFYGAEGEIYFKPTPRYRIGVSGDYVRGRLKNLPSLPGREDPYGKRPLIAQADQNAPRVP
             ||||||||||||||||||||||||||||||||||||||||||||||||:||| |||||||
m149-1       DFYGAEGEIYFKPTPRYRIGVSGDYVRGRLKNLPSLPGREDPYGKRPFIAQDDQNAPRVP
                  610        620        630        640        650        660

                  670        680        690        700        710        720
a149-1.pep   AARLGVHLKASLTDRIDANLDYYRVFAQNKLARYETRTPGHHMLNLGANYRRNTRYGEWN
             ||||| ||||||||||||||||||||||||||||||||||||||||||||||||||||||
m149-1       AARLGFHLKASLTDRIDANLDYYRVFAQNKLARYETRTPGHHMLNLGANYRRNTRYGEWN
                  670        680        690        700        710        720

                  730        740        750       759
a149-1.pep   WYVKADNLLNQSVYAHSSFLSDTPQMGRSFTGGVNVKFX
             |||||||||||||||||||||||||||||||||||||||
m149-1       WYVKADNLLNQSVYAHSSFLSDTPQMGRSFTGGVNVKFX
                  730        740        750
```

The following partial DNA sequence was identified in *N. gonorrhoeae* <SEQ ID 607>:

```
g150.seq (partial)
   1 ..TACTGCAAGG CAGACCCCTT TCCCGCCGCC CTGCTGGCCA ATCAGAAAAT

  51   CACCGCCCGC CAATCCGATA AAGACGTGCG CCACATCGAA ATCGATTTGA

 101   GCGGTTCGGA TTTGCACTAC CTCCCGGGCG ACGCGCTCGG CGTTTGGTTT

 151   GACAACGATC CGGCACTGGT CGGGGAAATC CTAGACCTGC TCGGCATCAA

 201   TCCGGCAACG GAAATACAGG CGGGCGGAAA AACCCTGCCG GTTGCCTCCG

 251   CACTGTTATC CCATTTCGAA CTCACGCAAA ACACCCCCGC CTTTGTCAAA

 301   GGCTATGCCA CGTTCGCCGA TAATGACGAA CTCGACCGTA TTGCTGCCGA

 351   CAACGCCGTT TTGCAAGGCT TTGTGCAAAG CACGCCGATT GCCGGTGTGC

 401   TGCACCGCTT CCCGGCAAAA CTGACGGCGG AACAATTCGC CGGCCTGCTG

 451   CGCCCGCTTG CGCCGCGCCT GTATTCGATT TCCTCGTCGC AGGCGGAAGC

 501   GGGGGACGAA GTGCACCTGA CCGTCGGCGC AGTGCGTTTC GAACACGAAG

 551   GGCGCGCCAG GGCGGGCGGC GCATCGGGTT TCTTTGCCGA CCGGCTGGAA

 601   GAGGACGGCA CGGTGCGCGT GTTTGCGGAA CGCAACGACG GCTTCAGGCT

 651   GCCCGAAGAC AGCCGCAAGC CGATTGTGAT GATCGGCTCC GGTACCGGCG

 701   TCGCACCGTT CCGCGCCTTC GTCCAACAAC GTGCCGCAGA AAATGCGGAA

 751   GGCAGAAACT GGCTGATTTT CGGCAATCCG CATTTTGCCG CCGACTTCCT

 801   CTATCAGACC GAATGGCAGC AGTTTGCCAA AGACGGCTTC CTGCACAGAT

 851   ATGACTTCGC CTGGTCGCGC GATCAGGAAG AAAAAATCTA TGTGCAGGAC

 901   AAAATCCGCG AACAGGCGGA AGGACTTTGG CAATGGCTGC AGGAAGGCGC

 951   GCATATCTAT GTGTGCGGCG ATGCGGCAAA AATGGCAAAA GAAGTGGAAG

1001   CCGCCTTGCT GGATGTGATT ATCGGGGCAG GGCATTCGGA CGAAGACGGC

1051   GCAGAAGGAT ATTTGGATAT GCTGCGCGAA GAAAAACGCT ATCAGCGTGA

1101   TGTTTATTGA
```

This corresponds to the amino acid sequence <SEQ ID 608; ORF 150.ng>:

```
g150.pep (partial)
   1  ..YCKADPFPAA LLANQKITAR QSDKDVRHIE IDLSGSDLHY LPGDALGVWF

  51    DNDPALVGEI LDLLGINPAT EIQAGGKTLP VASALLSHFE LTQNTPAFVK

 101    GYATFADNDE LDRIAADNAV LQGFVQSTPI AGVLHRFPAK LTAEQFAGLL

 151    RPLAPRLYSI SSSQAEAGDE VHLTVGAVRF EHEGRARAGG ASGFFADRLE

 201    EDGTVRVFAE RNDGFRLPED SRKPIVMIGS GTGVAPFRAF VQQRAAENAE

 251    GRNWLIFGNP HFAADFLYQT EWQQFAKDGF LHRYDFAWSR DQEEKIYVQD

 301    KIREQAEGLW QWLQEGAHIY VCGDAAKMAK EVEAALLDVI IGAGHSDEDG

 351    AEGYLDMLRE EKRYQRDVY*
```

The following partial DNA sequence was identified in *N. meningitidis* <SEQ ID 609>:

```
m150.seq
   1  ATGCAGAACA CAAATCCGCC ATTACCGCCT CTGCCGCCCG AAATCACGCA

  51  GCTCCTGTCG GGGCTGGACG CGGCACAATG GGCGTGGCTG TCCGGCTACG

 101  CTTGGGCAAA AGCAGGAAAC GGGGCATCTG CAGGACTGCC CGCGCTTCAG

 151  ACGGCATTGC CGGCGGCAGA ACCTTTTTCC GTAACCGTCC TTTCCGCCTC

 201  GCAAACCGGC AATGCGAAAT CCGTTGCCGA CAAAGCGGCG GACAGCCTGG

 251  AAGCCGCCGG CATCCAAGTC AGTCGCGCCG AACTGAAAGA CTATAAGGCG

 301  AAAAACATCG CCGGCGAACG CCGCCTGCTG CTGGTTACCT CCACCCAAGG

 351  CGAAGGCGAA CCGCCGAAAG AAGCCGTCGT GCTGCACAAA CTGCTGAACG

 401  GCAAAAAAGC CCCGAAATTG GACAAACTCC AATTTGCCGT ACTGGGTTTG

 451  GGCGACAGTT CCTATCCGAA TTTCTGTCAG GCAGGTAAAG ATTTCGACCG

 501  GCGTTTTGAA GAATTGGGCG CAAAACGGCT GCTCGAACGC GTTGATGCGG

 551  ATTTGGACTT TACCGCCTCC GCAAACGCCT GGACAGATAA TATCGCCGCA

 601  CTCTTAAAAG AAGAAGCCGC AAAAAACCGG GCAACGCCCG CGCCGCAGAC

 651  AACGCCCCCC GCCGGCCTTC AGACGGCACC GGATGGCAGG TACTGCAAGG

 701  CAGCCCCCTT TCCCGCCGCC CTGCTGGCCA ATCAGAAAAT CACCGCCCGC

 751  CAATCCGATA AAGACGTGCG CCACATCGAA ATCGATTTGA GCGGTTCGGA

 801  TTTGCACTAC CTCCCGGGCG ACGCGCTCGG CGTTTGGTTT GACAACGATC

 851  CGGCACTGGT CAGGGAAATC CTAGACCTGC TCGGCATCGA TCCGGCAACG

 901  GAAATACAGG CGGGCGGAAA GATGATGCCG GTTGCGCGCG CACTTTCATC

 951  TCATTTCGAA CTCACGCAAA ACACTCCGGC TTTCGTCAAA GGCTATGCCG

1001  CGTTCGCCCA TTATGAAGAA CTCGATAAAA TCATTGCCGA TAACGCCGTT

1051  TTGCAGGATT TCGTGCAAAA CACGCCTATT GTCGATGTGC TGCACCGCTT

1101  CCCGGCAAGC CTGACGGCAG AACAATTCAT CCGTTTACTG CGTCCGCTTG

1151  CACCCCGTTT GTATTCGATT TCTTCAGCAC AGGCGGAAGT GGGCGATGAA

1201  GTGCATTTAA CTGTCGGCGT GGTTCGTTTT GAACACGAAG GCCGCGCCAG

1251  AACGGGCGGC GCATCGGGTT TCCTTGCCGA CCGGCTGGAA GAGGACGGCA

1301  CGGTGCGCGT GTTTGTGGAA CGCAACGACG GCTTCAGGCT GCCCGAAGAC
```

-continued

```
1351 AGCCGCAAGC CGATTGTGAT GATCGGCTCG GGCACCGGCG TCGCACCGTT

1401 CCGCGCTTTC GTCCAACAAC GTGCCGCAGA AAATGCGGAA GGCAAAAACT

1451 GGCTGATTTT CGGCAATCCG CATTTTGCCC GTGATTTTCT CTATCAAACC

1501 GAATGGCAGC AGTTTGCCAA AGACGGCTTC CTGCACAGGT ACGATTTCGC

1551 CTGGTCCCGC GATCAGGAAG AAAAAATCTA TGTGCAGGAC AAAATCCGCG

1601 AACAGGCGGA AGGACTTTGG CAATGGCTGC AGGAAGGCGC GCATATCTAT

1651 GTGTGCGGCG ATGCGGCAAA AATGGCAAAA GACGTGGAAG CCGCCTTGCT

1701 GGATGTGATT ATCGGGGCAG GACATTTGGA CGAAGAGGGC GCAGAAGAAT

1751 ATTTGGATAT GCTGCGCGAA GAAAAACGCT ATCAGCGTGA TGTTTATTGA
```

This corresponds to the amino acid sequence <SEQ ID 610; ORF 150>:

```
m150.pep
   1 MQNTNPPLPP LPPEITQLLS GLDAAQWAWL SGYAWAKAGN GASAGLPALQ

  51 TALPAAEPFS VTVLSASQTG NAKSVADKAA DSLEAAGIQV SRAELKDYKA

 101 KNIAGERRLL LVTSTQGEGE PPKEAVVLHK LLNGKKAPKL DKLQFAVLGL

 151 GDSSYPNFCQ AGKDFDRRFE ELGAKRLLER VDADLDFTAS ANAWTDNIAA

 201 LLKEEAAKNR ATPAPQTTPP AGLQTAPDGR YCKAAPFPAA LLANQKITAR

 251 QSDKDVRHIE IDLSGSDLHY LPGDALGVWF DNDPALVREI LDLLGIDPAT

 301 EIQAGGKMMP VARALSSHFE LTQNTPAFVK GYAAFAHYEE LDKIIADNAV

 351 LQDFVQNTPI VDVLHRFPAS LTAEQFIRLL RPLAPRLYSI SSAQAEVGDE

 401 VHLTVGVVRF EHEGRARTGG ASGFLADRLE EDGTVRVFVE RNDGFRLPED

 451 SRKPIVMIGS GTGVAPFRAF VQQRAAENAE GKNWLIFGNP HFARDFLYQT

 501 EWQQFAKDGF LHRYDFAWSR DQEEKIYVQD KIREQAEGLW QWLQEGAHIY

 551 VCGDAAKMAK DVEAALLDVI IGAGHLDEEG AEEYLDMLRE EKRYQRDVY*
```

Computer analysis of this amino acid sequence gave the following results:

Homology with a Predicted ORF from *N. gonorrhoeae*

ORF 150 shows 91.3% identity over a 369 aa overlap with a predicted ORF (ORF 150.ng) from *N. gonorrhoeae*:

```
m150/g150

                210       220       230       240       250       260
m150.pep LLKEEAAKNRATPAPQTTPPAGLQTAPDGRYCKAAPFPAALLANQKITARQSDKDVRHIE
                                       ||| ||||||||||||||||||||||||||
g150                                   YCKADPFPAALLANQKITARQSDKDVRHIE
                                               10        20        30

                270       280       290       300       310       320
m150.pep IDLSGSDLHYLPGDALGVWFDNDPALVREILDLLGIDPATEIQAGGKMMPVARALSSHFE
         ||||||||||||||||||||||||||| ||||||||:|||||||||| :||| || ||||
g150     IDLSGSDLHYLPGDALGVWFDNDPALVGEILDLLGINPATEIQAGGKTLPVASALLSHFE
                 40        50        60        70        80        90

                330       340       350       360       370       380
m150.pep LTQNTPAFVKGYAAFAHYEELDKIIADNAVLQDFVQNTPIVDVLHRFPASLTAEQFIRLL
         |||||||||||||:||  :|||:| ||||||| |||:|||: |||||||:||||||  ||
g150     LTQNTPAFVKGYATFADNDELDRIAADNAVLQGFVQSTPIAGVLHRFPAKLTAEQFAGLL
                100       110       120       130       140       150

                390       400       410       420       430       440
m150.pep RPLAPRLYSISSAQAEVGDEVHLTVGVVRFEHEGRARTGGASGFLADRLEEDGTVRVFVE
         ||||||||||||:|||:|||||||||:||||||||||:||||||:|||||||||||||:|
g150     RPLAPRLYSISSSQAEAGDEVHLTVGAVRFEHEGRARAGGASGFFADRLEEDGTVRVFAE
                160       170       180       190       200       210
```

-continued

```
                450       460       470       480       490       500
m150.pep RNDGFRLPEDSRKPIVMIGSGTGVAPFRAFVQQRAAENAEGKNWLIFGNPHFARDFLYQT
         |||||||||||||||||||||||||||||||||||||||||:||||||||||| ||||||
g150     RNDGFRLPEDSRKPIVMIGSGTGVAPFRAFVQQRAAENAEGRNWLIFGNPHFAADFLYQT
                220       230       240       250       260       270

                510       520       530       540       550       560
m150.pep EWQQFAKDGFLHRYDFAWSRDQEEKIYVQDKIREQAEGLWQWLQEGAHIYVCGDAAKMAK
         ||||||||||||||||||||||||||||||||||||||||||||||||||||||||||||
g150     EWQQFAKDGFLHRYDFAWSRDQEEKIYVQDKIREQAEGLWQWLQEGAHIYVCGDAAKMAK
                280       290       300       310       320       330

                570       580       590       600
m150.pep DVEAALLDVIIGAGHLDEEGAEEYLDMLREEKRYQRDVYX
         :||||||||||||| ||:||| ||||||||||||||||||
g150     EVEAALLDVIIGAGHSDEDGAEGYLDMLREEKRYQRDVYX
                340       350       360       370
```

The following partial DNA sequence was identified in *N. meningitidis* <SEQ ID 611>:

```
a150.seq
     1 ATGCAGAACA CAAATCCGCC ATTACCGCCT ATGCCGCCCG AAATCACGCA

    51 GCTCCTGTCG GGGCTGGACG CGGCACAATG GGCGTGGCTG TCCGGCTACG

   101 CTTGGGCAAA AGCAGGAAAC GGGGCATCTG CAGGACTGCC CGCGCTTCAG

   151 ACGGCATTGC CGACGGCAGA ACCTTTTTCC GTAACCGTCC TTTCCGCCTC

   201 GCAAACCGGC AATGCGAAAT CCGTTGCCGA CAAAGCGGCG GACAGCCTGG

   251 AAGCCGCCGG CATCCAAGTC AGTCGCGCCG AACTGAAAGA CTATAAGGCG

   301 AAAAACATCG CCGGCGAACG CCGCCTGCTG CTGGTTACCT CCACCCAAGG

   351 CGAAGGCGAA CCGCCGGAAG AAGCCGTCGT GCTGCACAAA CTGCTGAACG

   401 GCAAAAAAGC CCCGAAATTG GACAAACTCC AATTTGCCGT ACTGGGTTTG

   451 GGCGACAGCT CCTATCCGAA TTTCTGCCGG GCGGGCAAAG ATTTCGACAA

   501 ACGTTTTGAA GAATTGGGCG CAAAACGCCT GCTCGAACGC GTTGATGCGG

   551 ATTTGGACTT TGCCGCCGCC GCAGACGGAT GGACAGATAA TATCGCCGCA

   601 CTCTTAAAAG AAGAAGCCGC AAAAAACCGG GCAACGCCCG CGCCGCAGAC

   651 AACGCCCCCC GCCGGCCTTC AGACGGCACC GGATGGCAGG TACTGCAAGG

   701 CAGACCCCTT TGCCGCCGCC CTGCTGGCCA ATCAGAAAAT CACCGCCCGC

   751 CAATCCGATA AAGACGTGCG CCACATCGAA ATCGATTTGA GCGGTTCGGA

   801 TTTGCACTAC CTCCCGGGCG ACGCGCTCGG CGTTTGGTTT GACAACGATC

   851 CGGCACTGGT CAGGGAAATC CTAGACCTGC TCGGCATCGA TCAGGCAACG

   901 GAAATACAGG CGGGCGGAAA AACCCTGCCG GTTGCCTCCG CACTGTTATC

   951 CCATTTTGAA CTCACGCAAA ACACCCCCGC CTTTGTCAAA GGCTATGCCC

  1001 CGTTCGCCGA TGATGACGAA CTCGACCGTA TTGCTGCCGA CAACGCCGTT

  1051 TTGCAAGGCT TTGTGCAAAG CACGCCGATT GCCGATGTGC TGCACCGCTT

  1101 CCCGGCAAAA CTGACAGCGG AACAATTCGC CGGCCTACTG CGCCCGCTTG

  1151 CGCCGCGCCT GTATTCGATT TCCTCGTCGC AGGCGGAAGT GGGGGACGAA

  1201 GTGCACCTGA CCGTCGGCGC GGTGCGTTTC GAACACGAAG GGCGCGCCAG

  1251 GGCGGGCGGC GCATCGGGTT TCCTTGCCGA CCGGCTGGAA GAGGACGGCA

  1301 CGGTGCGCGT GTTTGTGGAA CGCAACGACG GCTTCAGGCT GCCCGAAGAC

  1351 AGCCGCAAGC CGATTGTGAT GATCGGCTCG GGCACCGGCG TCGCACCGTT

  1401 CCGCGCTTTC GTCCAACAAC GTGCCGCAGA AAATGCGGAA GGCAAAAACT
```

-continued

```
1451  GGCTGTTTTT CGGCAATCCG CATTTTGCCC GTGATTTTCT CTATCAAACC

1501  GAATGGCAGC AGTTTGCCAA AGACGGCTTC CTGCACAGAT ACGATTTCGC

1551  CTGGTCGCGC GATCAGGAAG AAAAAATCTA TGTGCAGGAC AAAATCCGCG

1601  AACAGGCGGA AGGACTTTGG CAATGGCTGC AGGAAGGCGC GCATATCTAT

1651  GTGTGCGGCG ATGCGGCAAA AATGGCAAAA GACGTGGAAG CCGCCTTGCT

1701  GGATGTGATT ATCGGGGCAG GACATTTGGA CGAAGAGGGC GCAGAAGAAT

1751  ATTTGGATAT GCTGCGCGAA GAAAAACGCT ATCAGCGTGA TGTTTATTGA
```

This corresponds to the amino acid sequence <SEQ ID 612; ORF 150.a>:

```
a150.pep

      1 MQNTNPPLPP MPPEITQLLS GLDAAQWAWL SGYAWAKAGN GASAGLPALQ

     51 TALPTAEPFS VTVLSASQTG NAKSVADKAA DSLEAAGIQV SRAELKDYKA

    101 KNIAGERRLL LVTSTQGEGE PPEEAVVLHK LLNGKKAPKL DKLQFAVLGL

    151 GDSSYPNFCR AGKDFDKRFE ELGAKRLLER VDADLDFAAA ADGWTDNIAA

    201 LLKEEAAKNR ATPAPQTTPP AGLQTAPDGR YCKADPFPAA LLANQKITAR

    251 QSDKDVRHIE IDLSGSDLHY LPGDALGVWF DNDPALVREI LDLLGIDQAT

    301 EIQAGGKTLP VASALLSHFE LTQNTPAFVK GYAPFADDDE LDRIAADNAV

    351 LQGFVQSTPI ADVLHRFPAK LTAEQFAGLL RPLAPRLYSI SSSQAEVGDE

    401 VHLTVGAVRF EHEGRARAGG ASGFLADRLE EDGTVRVFVE RNDGFRLPED

    451 SRKPIVMIGS GTGVAPFRAF VQQRAAENAE GKNWLFFGNP HFARDFLYQT

    501 EWQQFAKDGF LHRYDFAWSR DQEEKIYVQD KIREQAEGLW QWLQEGAHIY

    551 VCGDAAKMAK DVEAALLDVI IGAGHLDEEG AEEYLDMLRE EKRYQRDVY*
```

```
m150/a150 94.8% identity in 599 aa overlap

                 10        20        30        40        50        60
m150.pep MQNTNPPLPPLPPEITQLLSGLDAAQWAWLSGYAWAKAGNGASAGLPALQTALPAAEPFS
         ||||||||||:|||||||||||||||||||||||||||||||||||||||||||:|||||
a150     MQNTNPPLPPMPPEITQLLSGLDAAQWAWLSGYAWAKAGNGASAGLPALQTALPTAEPFS
                 10        20        30        40        50        60

                 70        80        90       100       110       120
m150.pep VTVLSASQTGNAKSVADKAADSLEAAGIQVSRAELKDYKAKNIAGERRLLLVTSTQGEGE
         ||||||||||||||||||||||||||||||||||||||||||||||||||||||||||||
a150     VTVLSASQTGNAKSVADKAADSLEAAGIQVSRAELKDYKAKNIAGERRLLLVTSTQGEGE
                 70        80        90       100       110       120

                130       140       150       160       170       180
m150.pep PPKEAVVLHKLLNGKKAPKLDKLQFAVLGLGDSSYPNFCQAGKDFDRRFEELGAKRLLER
         ||:||||||||||||||||||||||||||||||||||||:||||||:|||||||||||||
a150     PPEEAVVLHKLLNGKKAPKLDKLQFAVLGLGDSSYPNFCRAGKDFDKRFEELGAKRLLER
                130       140       150       160       170       180

                190       200       210       220       230       240
m150.pep VDADLDFTASANAWTDNIAALLKEEAAKNRATPAPQTTPPAGLQTAPDGRYCKAAPFPAA
         |||||||:|:|::||||||||||||||||||||||||||||||||||||||||| |||||
a150     VDADLDFAAAADGWTDNIAALLKEEAAKNRATPAPQTTPPAGLQTAPDGRYCKADPFPAA
                190       200       210       220       230       240

                250       260       270       280       290       300
m150.pep LLANQKITARQSDKDVRHIEIDLSGSDLHYLPGDALGVWFDNDPALVREILDLLGIDPAT
         ||||||||||||||||||||||||||||||||||||||||||||||||||||||||| ||
a150     LLANQKITARQSDKDVRHIEIDLSGSDLHYLPGDALGVWFDNDPALVREILDLLGIDQAT
                250       260       270       280       290       300

                310       320       330       340       350       360
m150.pep EIQAGGKMMPVARALSSHFELTQNTPAFVKGYAAFAHYEELDKIIADNAVLQDFVQNTPI
         ||||||| :||| || |||||||||||||||||| ||  :|||:| |||||||| |||:|||
a150     EIQAGGKTLPVASALLSHFELTQNTPAFVKGYAPFADDDELDRIAADNAVLQGFVQSTPI
                310       320       330       340       350       360
```

-continued

```
                370        380        390        400        410        420
m150.pep VDVLHRFPASLTAEQFIRLLRPLAPRLYSISSAQAEVGDEVHLTVGVVRFEHEGRARTGG
         :||||||||:||||||  ||||||||||||||:|||||||||||||:||||||||||:||
a150     ADVLHRFPAKLTAEQFAGLLRPLAPRLYSISSSQAEVGDEVHLTVGAVRFEHEGRARAGG
                370        380        390        400        410        420

                430        440        450        460        470        480
m150.pep ASGFLADRLEEDGTVRVFVERNDGFRLPEDSRKPIVMIGSGTGVAPFRAFVQQRAAENAE
         ||||||||||||||||||||||||||||||||||||||||||||||||||||||||||||
a150     ASGFLADRLEEDGTVRVFVERNDGFRLPEDSRKPIVMIGSGTGVAPFRAFVQQRAAENAE
                430        440        450        460        470        480

                490        500        510        520        530        540
m150.pep GKNWLIFGNPHFARDFLYQTEWQQFAKDGFLHRYDFAWSRDQEEKIYVQDKIREQAEGLW
         |||||:||||||||||||||||||||||||||||||||||||||||||||||||||||||
a150     GKNWLFFGNPHFARDFLYQTEWQQFAKDGFLHRYDFAWSRDQEEKIYVQDKIREQAEGLW
                490        500        510        520        530        540

                550        560        570        580        590        600
m150.pep QWLQEGAHIYVCGDAAKMAKDVEAALLDVIIGAGHLDEEGAEEYLDMLREEKRYQRDVYX
         ||||||||||||||||||||||||||||||||||||||||||||||||||||||||||||
a150     QWLQEGAHIYVCGDAAKMAKDVEAALLDVIIGAGHLDEEGAEEYLDMLREEKRYQRDVYX
                550        560        570        580        590        600
```

The following partial DNA sequence was identified in *N. gonorrhoeae* <SEQ ID 613>:

```
g151.seq
   1 ATGAAACAAA TCCGCAACAT CGCCATCATC GCACACGTCG ACCACGGCAA

  51 AACCACATTG GTCGACCAAC TGCTGCGCCA ATCCGGCACA TTCCGCGCCA

 101 ACCAGCAGGT TGACGAGCGC GTGATGGACA GCAACGACCT TGAAAAAGAA

 151 CGCGGCATCA CCATCCTCGC CAAAAACACC GCCATCGATT ACGAAGGCTG

 201 CCACATCAAT ATCGTCGACA CGCCGGGACA CGCCGACTTC GGCGGCGAAG

 251 TGGAGCGCGT TTTGGGGATG GTGGATTGCG TCGTCTTGTT GGTGGACGCA

 301 CAGGAAGGTC CGATGCCGCA AACCCGTTTC GTGACCAAAA AAGCCTTGGC

 351 TTTGGGGCTG AAACCGATTG TCGTCATCAA CAAAATCGAC AAACCGTCCG

 401 CCCGTCCGAG CTGGGTTATC GACCAGACTT TCGAGTTGTT CGACAACTTG

 451 GGTGCGACCG ACGAGCAGTT GGATTTCCCG ATTGTTTACG CTTCAGGTTT

 501 GAGCGGCTTT GCCAAGCTGG AAGAAAccga CGAGAGCAGC GATATGCGCC

 551 CGCtgttcgA CACCATCCTA AAATACAcgc ctgCACCGAG CGGCAGCGCG

 601 GACGAGCCGC TGCAACTGCA AATTTCCCAA CTCGACTACG ACAACTACAC

 651 CGGCCGCCTC GGTATCGGTC GTATCTTGAA CGGACGCATC AAACCCGGCC

 701 AAACCGTTGC CGTGATGAAC CACGAGCAGC AAATCGCCCA AGGCCGCATC

 751 AACCAGCTTT TGGGTTTCAA AGGCTTGGAA CGCGTGCCGC TTGAAGAAGC

 801 CGAAGCCGGC GACATTGTGA TTATTTCCGG TATCGAAGAC ATCGGCATCG

 851 GCGTAACCAT CACCGACAAA GACAACCCCA AAGGCCTGCC GATGTTGAGC

 901 GTGGACGAAC CGACGCTGAC GATGGACTTT ATGGTAAACA CCAGCCCGCT

 951 CGCAGGTACA GAAGGCAAAT TCGTGACCAG CCGCCAAATC CGCGACCGCC

1001 TGCAAAAAGA ATTGCTGACC AACGTTGCCC TGCGCGTGGA AGACACCGCC

1051 GatgCCGACG TGTTCCGCGT ATCcgGGCGC GGCGAACTGC ACCTGACGAT

1101 TTTGCTGGAA AATATGCGCC GCGAAGGCTA CGAACTCGCC GTCGGCAAGC

1151 CGCGCGTCGT GTACCGAGAC ATCGACGGTC AAAAATGCGA ACCTTATGAA

1201 AACCTGACTG TGGACGTACc cgacgacAAC CAAGGCGCGG TAATGGAAGA

1251 ACTCGGCCGC CGCCGTGGCG AACTGACCAA TATGGAAAGC GACGGCAACG
```

-continued

```
1301 GacgCACCCG CCTCGAATAC CATATTCCAG CGCGCGGCTT GATCGGTTTC

1351 CAAGGCGAAT TCATGACCCT GACGCGCGGC GTCGGGCTGA TGAgccacGT

1401 GTTcgacgac tacgcgcccg tcaAACCCGA TATGCCCGGC CGCCACAACG

1451 GCGTactggt GtcccaAGAG CAGGGCGAGG CGGTTGCTTA CGCCTTGTGG

1501 AATCTTGAAG ACCGCGGCCG TATGTTCGTA TCGCCCAACG ACAAAATCTA

1551 CGAAGGTATG ATTATCGGCA TCCACAGCCG CGACAACGAT TTGGTGGTCA

1601 ACCCGCTCAA AGGCAAAAAA CTCACCAATA TCCGTGCCAG CGGTACCGAC

1651 GAAGCGGTGC GCCTGACCAC GCCGATCAAA CTGAcgcTGG AAGGCGCGGT

1701 CGAGTTTATC GACGATGACG AGCTGGTGGA AATCACGCCG CAAtccatcc

1751 gcctgcgcat gcgttacctG AGCGaattgg aacgccgccg tcaTTTTAAA

1801 AagctgGATT AA
```

This corresponds to the amino acid sequence <SEQ ID 614; ORF 151.ng>:

```
g151.pep
   1  MKQIRNIAII AHVDHGKTTL VDQLLRQSGT FRANQQVDER VMDSNDLEKE

  51  RGITILAKNT AIDYEGCHIN IVDTPGHADF GGEVERVLGM VDCVVLLVDA

 101  QEGPMPQTRF VTKKALALGL KPIVVINKID KPSARPSWVI DQTFELFDNL

 151  GATDEQLDFP IVYASGLSGF AKLEETDESS DMRPLFDTIL KYTPAPSGSA

 201  DEPLQLQISQ LDYDNYTGRL GIGRILNGRI KPGQTVAVMN HEQQIAQGRI

 251  NQLLGFKGLE RVPLEEAEAG DIVIISGIED IGIGVTITDK DNPKGLPMLS

 301  VDEPTLTMDF MVNTSPLAGT EGKFVTSRQI RDRLQKELLT NVALRVEDTA

 351  DADVFRVSGR GELHLTILLE NMRREGYELA VGKPRVVYRD IDGQKCEPYE

 401  NLTVDVPDDN QGAVMEELGR RRGELTNMES DGNGRTRLEY HIPARGLIGF

 451  QGEFMTLTRG VGLMSHVFDD YAPVKPDMPG RHNGVLVSQE QGEAVAYALW

 501  NLEDRGRMFV SPNDKIYEGM IIGIHSRDND LVVNPLKGKK LTNIRASGTD

 551  EAVRLTTPIK LTLEGAVEFI DDDELVEITP QSIRLRMRYL SELERRRHFK

 601  KLD*
```

The following partial DNA sequence was identified in *N. meningitidis* <SEQ ID 615>:

```
m151.seq
   1  ATGAAACAAA TCCGCAACAT CGCCATCATC GCCCACGTCG ACCACGGCAA

  51  AACCACATTG GTCGACCAAC TGCTGCGCCA ATCCGGCACA TTCCGCGCCA

 101  ACCAGCAGGT TGACGAGCGC GTGATGGACA GCAACGACCT TGAAAAAGAA

 151  CGCGGCATCA CCATCCTCGC CAAAAACACC GCCATCGATT ACGAAGGCTA

 201  CCACATCAAT ATCGTCGACA CGCCGGGACA CGCCGACTTC GGCGGCGAAG

 251  TAGAGCGCGT TTTGGGGATG GTGGACTGCG TCGTCTTGTT GGTGGACGCG

 301  CAGGAAGGCC CGATGCCGCA AACCCGTTTC GTGACCAAAA AAGCCTTGGC

 351  TTTGGGGCTG AAACCGATTG TCGTCATCAA CAAAATCGAC AAGCCGTCCG

 401  CTCGTCCGAG CTGGGTTATC GACCAAACTT TCGAGCTGTT CGACAACTTG

 451  GGCGCGACCG ACGAGCAGTT GGATTTCCCG ATTGTTTACG CTTCAGGGTT
```

-continued

```
 501 GAGCGGTTTC GCCAAATTGG AAGAAACCGA CGAGAGCAAC GACATGCGTC

 551 CGCTGTTCGA TACTATCTTA AAATATACGC CTGCACCGAG CGGCAGCGCG

 601 GACGAAACGC TGCAACTGCA AATTTCCCAA CTCGACTACG ACAACTACAC

 651 CGGCCGCCTC GGTATCGGTC GTATCTTGAA CGGACGCATC AAACCCGGCC

 701 AAACCGTTGC CGTCATGAAC CACGATCAGC AAATCGCCCA AGGCCGCATC

 751 AACCAGCTTT TGGGTTTCAA AGGTTTGGAA CGCGTGCCGC TTGAAGAAGC

 801 CGAAGCCGGC GACATCGTGA TTATTTCCGG TATCGAAGAC ATCGGTATCG

 851 GCGTAACCAT CACCGACAAA GACAATCCCA AAGGCCTACC GATGTTGAGC

 901 GTGGACGAAC CGACGCTGAC GATGGACTTT ATGGTCAACA CCAGCCCGCT

 951 GGCGGGTACG GAAGGCAAAT TCGTAACCAG CCGCCAAATC CGCGACCGCC

1001 TGCAAAAAGA ATTGCTGACC AACGTCGCCC TGCGCGTGGA AGATACCGCC

1051 GATGCCGACG TGTTCCGCGT ATCCGGGCGC GGCGAGCTGC ACCTGACCAT

1101 TTTGCTGGAA AACATGCGCC GCGAAGGCTA CGAACTCGCC GTCGGCAAAC

1151 CGCGCGTCGT GTACCGCGAC ATCGACGGTC AAAAATGCGA ACCGTATGAA

1201 AACCTGACCG TGGATGTACC CGACGACAAC CAAGGCGCGG TAATGGAAGA

1251 ACTCGGCCGC CGCCGTGGCG AACTGACTAA TATGGAAAGC GACGGCAACG

1301 GACGCACCCG CCTCGAATAC CATATTCCAG CGCGCGGCTT GATCGGTTTC

1351 CAAGGCGAAT TTATGACCCT GACGCGCGGG GTCGGGCTGA TGAGCCACGT

1401 GTTCGACGAT TACGCGCCCG TCAAACCCGA TATGCCCGGC CGCCACAACG

1451 GCGTGCTGGT GTCCCAAGAG CAGGGCGAGG CAGTCGCTTA CGCCTTGTGG

1501 AATCTGGAAG ACCGCGGCCG TATGTTCGTA TCGCCCAACG ACAAAATCTA

1551 CGAAGGCATG ATTATCGGCA TCCACAGTCG CGACAACGAT TTGGTGGTCA

1601 ACCCGCTCAA AGGCAAAAAA CTTACCAACA TCCGTGCCAG CGGTACCGAC

1651 GAAGCCGTTC GCCTGACCAC GCCAATCAAG CTGACGCTGG AAGGTGCGGT

1701 TGAGTTTATC GACGATGACG AACTCGTTGA AATCACGCCG CAATCCATCC

1751 GTCTGCGCAA GCGTTACTTG AGCGAATTGG AACGCCGCCG CCACTTTAAA

1801 AAGCTGGATT GA
```

This corresponds to the amino acid sequence <SEQ ID 616; ORF 151>:

```
m151.pep
   1 MKQIRNIAII AHVDHGKTTL VDQLLRQSGT FRANQQVDER VMDSNDLEKE

  51 RGITILAKNT AIDYEGYHIN IVDTPGHADF GGEVERVLGM VDCVVLLVDA

 101 QEGPMPQTRF VTKKALALGL KPIVVINKID KPSARPSWVI DQTFELFDNL

 151 GATDEQLDFP IVYASGLSGF AKLEETDESN DMRPLFDTIL KYTPAPSGSA

 201 DETLQLQISQ LDYDNYTGRL GIGRILNGRI KPGQTVAVMN HDQQIAQGRI

 251 NQLLGFKGLE RVPLEEAEAG DIVIISGIED IGIGVTITDK DNPKGLPMLS

 301 VDEPTLTMDF MVNTSPLAGT EGKFVTSRQI RDRLQKELLT NVALRVEDTA

 351 DADVFRVSGR GELHLTILLE NMRREGYELA VGKPRVVYRD IDGQKCEPYE

 401 NLTVDVPDDN QGAVMEELGR RRGELTNMES DGNGRTRLEY HIPARGLIGF

 451 QGEFMTLTRG VGLMSHVFDD YAPVKPDMPG RHNGVLVSQE QGEAVAYALW
```

-continued

```
501  NLEDRGRMFV SPNDKIYEGM IIGIHSRDND LVVNPLKGKK LTNIRASGTD

551  EAVRLTTPIK LTLEGAVEFI DDDELVEITP QSIRLRKRYL SELERRRHFK

601  KLD*
```

Computer analysis of this amino acid sequence gave the following results:

Homology with a Predicted ORF from *N. gonorrhoeae*

ORF 151 shows 99.2% identity over a 603 aa overlap with a predicted ORF (ORF 151.ng) from *N. gonorrhoeae*:

```
m151/g151

                   10        20        30        40        50        60
m151.pep  MKQIRNIAIIAHVDHGKTTLVDQLLRQSGTFRANQQVDERVMDSNDLEKERGITILAKNT
          ||||||||||||||||||||||||||||||||||||||||||||||||||||||||||||
g151      MKQIRNIAIIAHVDHGKTTLVDQLLRQSGTFRANQQVDERVMDSNDLEKERGITILAKNT
                   10        20        30        40        50        60

                   70        80        90       100       110       120
m151.pep  AIDYEGYHINIVDTPGHADFGGEVERVLGMVDCVVLLVDAQEGPMPQTRFVTKKALALGL
          ||||| ||||||||||||||||||||||||||||||||||||||||||||||||||||||
g151      AIDYEGCHINIVDTPGHADFGGEVERVLGMVDCVVLLVDAQEGPMPQTRFVTKKALALGL
                   70        80        90       100       110       120

                  130       140       150       160       170       180
m151.pep  KPIVVINKIDKPSARPSWVIDQTFELFDNLGATDEQLDFPIVYASGLSGFAKLEETDESN
          |||||||||||||||||||||||||||||||||||||||||||||||||||||||||||:
a151      KPIVVINKIDKPSARPSWVIDQTFELFDNLGATDEQLDFPIVYASGLSGFAKLEETDESS
                  130       140       150       160       170       180

                  190       200       210       220       230       240
m151.pep  DMRPLFDTILKYTPAPSGSADETLQLQISQLDYDNYTGRLGIGRILNGRIKPGQTVAVMN
          |||||||||||||||||||||| ||||||||||||||||||||||||||||||||| ||||
g151      DMRPLFDTILKYTPAPSGSADEPLQLQISQLDYDNYTGRLGIGRILNGRIKPGQTVAVMN
                  190       200       210       220       230       240

                  250       260       270       280       290       300
m151.pep  HDQQIAQGRINQLLGFKGLERVPLEEAEAGDIVIISGIEDIGIGVTITDKDNPKGLPMLS
          |:||||||||||||||||||||||||||||||||||||||||||||||||||||||||||
g151      HEQQIAQGRINQLLGFKGLERVPLEEAEAGDIVIISGIEDIGIGVTITDKDNPKGLPMLS
                  250       260       270       280       290       300

                  310       320       330       340       350       360
m151.pep  VDEPTLTMDFMVNTSPLAGTEGKFVTSRQIRDRLQKELLTNVALRVEDTADADVFRVSGR
          ||||||||||||||||||||||||||||||||||||||||||||||||||||||||||||
g151      VDEPTLTMDFMVNTSPLAGTEGKFVTSRQIRDRLQKELLTNVALRVEDTADADVFRVSGR
                  310       320       330       340       350       360

                  370       380       390       400       410       420
m151.pep  GELHLTILLENMRREGYELAVGKPRVVYRDIDGQKCEPYENLTVDVPDDNQGAVMEELGR
          ||||||||||||||||||||||||||||||||||||||||||||||||||||||||||||
g151      GELHLTILLENMRREGYELAVGKPRVVYRDIDGQKCEPYENLTVDVPDDNQGAVMEELGR
                  370       380       390       400       410       420

                  430       440       450       460       470       480
m151.pep  RRGELTNMESDGNGRTRLEYHIPARGLIGFQGEFMTLTRGVGLMSHVFDDYAPVKPDMPG
          ||||||||||||||||||||||||||||||||||||||||||||||||||||||||||||
g151      RRGELTNMESDGNGRTRLEYHIPARGLIGFQGEFMTLTRGVGLMSHVFDDYAPVKPDMPG
                  430       440       450       460       470       480

                  490       500       510       520       530       540
m151.pep  RHNGVLVSQEQGEAVAYALWNLEDRGRMFVSPNDKIYEGMIIGIHSRDNDLVVNPLKGKK
          ||||||||||||||||||||||||||||||||||||||||||||||||||||||||||||
g151      RHNGVLVSQEQGEAVAYALWNLEDRGRMFVSPNDKIYEGMIIGIHSRDNDLVVNPLKGKK
                  490       500       510       520       530       540

                  550       560       570       580       590       600
m151.pep  LTNIRASGTDEAVRLTTPIKLTLEGAVEFIDDDELVEITPQSIRLRKRYLSELERRRHFK
          |||||||||||||||||||||||||||||||||||||||||||||| |||||||||||||
g151      LTNIRASGTDEAVRLTTPIKLTLEGAVEFIDDDELVEITPQSIRLRMRYLSELERRRHFK
                  550       560       570       580       590       600

m151.pep  KLDX
          ||||
g151      KLDX
```

The following partial DNA sequence was identified in *N. meningitidis* <SEQ ID 617>:

```
a151.seq
    1  ATGAAACAAA TCCGCAACAT CGCCATCATC GCCCACGTCG ACCACGGCAA
```

-continued

```
  51 AACCACATTG GTCGACCAAC TGCTGCGCCA ATCCGGCACA TTCCGCGCCA
 101 ACCAGCAGGT TGACGAGCGC GTGATGGACA GCAACGACCT TGAAAAAGAA
 151 CGCGGCATCA CCATCCTCGC CAAAAACACC GCCATCGATT ACGAAGGCTA
 201 CCACATCAAT ATCGTCGACA CGCCGGGACA CGCCGACTTC GGCGGCGAAG
 251 TAGAGCGAGT TTTGGGGATG GTGGACTGCG TCGTCTTGTT GGTGGACGCG
 301 CAGGAAGGCC CGATGCCGCA AACCCGTTTC GTGACCAAAA AAGCCTTGGC
 351 TTTGGGGCTG AAACCGATTG TCGTCATCAA TAAAATCGAC AAACCGTCCG
 401 CCCGTCCGAG CTGGGTCATC GACCAAACTT TCGAGCTGTT CGACAACTTG
 451 GGCGCGACCG ACGAGCAGTT GGATTTCCCG ATTGTTTATG CTTCCGGTCT
 501 GTCCGGTTTC GCCAAATTGG AAGAAACCGA CGAGAGCAAC GACATGCGTC
 551 CGCTGTTCGA TACTATCTTA AAATATACGC CTGCACCGAG CGGCAGCGCG
 601 GACGAAACGC TGCAACTGCA AATTTCCCAA CTCGACTACG ACAACTACAC
 651 CGGCCGCCTC GGTATCGGTC GTATCTTGAA CGGACGTATC AAGCCCGGTC
 701 AAGTTGTTGC CGTCATGAAC CACGATCAAC AAATCGCCCA AGGCCGCATC
 751 AACCAGCTTT TGGGTTTCAA AGGTTTAGAA CGCGTGCCGC TTGAAGAAGC
 801 CGAAGCCGGC GACATCGTGA TTATTTCCGG TATTGAAGAC ATCGGCATCG
 851 GCGTAACCAT CACCGACAAA GACAACCCCA AAGGCCTGCC GATGTTGAGC
 901 GTGGACGAAC CGACGCTGAC GATGGACTTT ATGGTCAACA CCAGCCCGTT
 951 GGCAGGTACG GAAGGCAAAT TCGTAACCAG CCGCCAAATC CGCGACCGCC
1001 TGCAAAAAGA ATTGCTGACC AACGTCGCCC TGCGCGTGGA AGATACCGCC
1051 GATGCCGACG TGTTCCGCGT ATCCGGGCGC GGCGAGCTGC ACCTGACCAT
1101 TTTGCTGGAA AACATGCGCC GCGAAGGCTA CGAACTCGCC GTCGGCAAAC
1151 CGCGCGTCGT GTACCGCGAC ATCGACGGTC AAAAATGCGA ACCGTATGAA
1201 AACCTGACCG TGGACGTACC CGACGACAAC CAAGGCGCGG TAATGGAAGA
1251 ACTCGGCCGC CGCCGTGGCG AACTGACTAA TATGGAAAGC GACGGCAACG
1301 GACGCACCCG CCTCGAATAC CATATTCCAG CGCGCGGCTT GATCGGCTTC
1351 CAAGGCGAAT TTATGACCCT GACGCGCGGG GTCGGGCTGA TGAGCCACGT
1401 GTTCGACGAT TACGCGCCCG TCAAACCCGA TATGCCTGGC CGCCACAACG
1451 GCGTGCTGGT GTCCCAAGAG CAGGGCGAGG CAGTCGCTTA CGCCTTGTGG
1501 AATCTGGAAG ACCGCGGCCG TATGTTCGTA TCGCCCAACG ACAAAATCTA
1551 CGAAGGTATG ATTATCGGCA TCCACAGTCG CGACAACGAT TTGGTGGTCA
1601 ACCCGCTCAA AGGCAAAAAA CTTACCAACA TCCGTGCCAG CGGTACCGAC
1651 GAAGCCGTTC GCCTGACCAC GCCGATTAAG CTGACGCTGG AAGGTGCGGT
1701 CGAGTTTATC GACGATGATG AGCTGGTAGA AATCACGCCG CAATCCATCC
1751 GTCTGCGCAA GCGTTACTTG AGCGAATTGG AACGCCGCCG CCATTTCAAA
1801 AAGCTAGATT GA
```

This corresponds to the amino acid sequence <SEQ ID 618; ORF 151.a>:

```
a151.pep
        1 MKQIRNIAII AHVDHGKTTL VDQLLRQSGT FRANQQVDER VMDSNDLEKE
```

-continued

```
 51 RGITILAKNT AIDYEGYHIN IVDTPGHADF GGEVERVLGM VDCVVLLVDA

101 QEGPMPQTRF VTKKALALGL KPIVVINKID KPSARPSWVI DQTFELFDNL

151 GATDEQLDFP IVYASGLSGF AKLEETDESN DMRPLFDTIL KYTPAPSGSA

201 DETLQLQISQ LDYDNYTGRL GIGRILNGRI KPGQVVAVMN HDQQIAQGRI

251 NQLLGFKGLE RVPLEEAEAG DIVIISGIED IGIGVTITDK DNPKGLPMLS

301 VDEPTLTMDF MVNTSPLAGT EGKFVTSRQI RDRLQKELLT NVALRVEDTA

351 DADVFRVSGR GELHLTILLE NMRREGYELA VGKPRVVYRD IDGQKCEPYE

401 NLTVDVPDDN QGAVMEELGR RRGELTNMES DGNGRTRLEY HIPARGLIGF

451 QGEFMTLTRG VGLMSHVFDD YAPVKPDMPG RHNGVLVSQE QGEAVAYALW

501 NLEDRGRMFV SPNDKIYEGM IIGIHSRDND LVVNPLKGKK LTNIRASGTD

551 EAVRLTTPIK LTLEGAVEFI DDDELVEITP QSIRLRKRYL SELERRRHFK

601 KLD*
```

m151/a151 99.8% identity in 603 aa overlap

```
                   10        20        30        40        50        60
m151.pep    MKQIRNIAIIAHVDHGKTTLVDQLLRQSGTFRANQQVDERVMDSNDLEKERGITILAKNT
            ||||||||||||||||||||||||||||||||||||||||||||||||||||||||||||
a151        MKQIRNIAIIAHVDHGKTTLVDQLLRQSGTFRANQQVDERVMDSNDLEKERGITILAKNT
                   10        20        30        40        50        60

                   70        80        90       100       110       120
m151.pep    AIDYEGYHINIVDTPGHADFGGEVERVLGMVDCVVLLVDAQEGPMPQTRFVTKKALALGL
            ||||||||||||||||||||||||||||||||||||||||||||||||||||||||||||
a151        AIDYEGYHINIVDTPGHADFGGEVERVLGMVDCVVLLVDAQEGPMPQTRFVTKKALALGL
                   70        80        90       100       110       120

                  130       140       150       160       170       180
m151.pep    KPIVVINKIDKPSARPSWVIDQTFELFDNLGATDEQLDFPIVYASGLSGFAKLEETDESN
            ||||||||||||||||||||||||||||||||||||||||||||||||||||||||||||
a151        KPIVVINKIDKPSARPSWVIDQTFELFDNLGATDEQLDFPIVYASGLSGFAKLEETDESN
                  130       140       150       160       170       180

                  190       200       210       220       230       240
m151.pep    DMRPLFDTILKYTPAPSGSADETLQLQISQLDYDNYTGRLGIGRILNGRIKPGQTVAVMN
            ||||||||||||||||||||||||||||||||||||||||||||||||||||||:|||||
a151        DMRPLFDTILKYTPAPSGSADETLQLQISQLDYDNYTGRLGIGRILNGRIKPGQVVAVMN
                  190       200       210       220       230       240

                  250       260       270       280       290       300
m151.pep    HDQQIAQGRINQLLGFKGLERVPLEEAEAGDIVIISGIEDIGIGVTITDKDNPKGLPMLS
            ||||||||||||||||||||||||||||||||||||||||||||||||||||||||||||
a151        HDQQIAQGRINQLLGFKGLERVPLEEAEAGDIVIISGIEDIGIGVTITDKDNPKGLPMLS
                  250       260       270       280       290       300

                  310       320       330       340       350       360
m151.pep    VDEPTLTMDFMVNTSPLAGTEGKFVTSRQIRDRLQKELLTNVALRVEDTADADVFRVSGR
            ||||||||||||||||||||||||||||||||||||||||||||||||||||||||||||
a151        VDEPTLTMDFMVNTSPLAGTEGKFVTSRQIRDRLQKELLTNVALRVEDTADADVFRVSGR
                  310       320       330       340       350       360

                  370       380       390       400       410       420
m151.pep    GELHLTILLENMRREGYELAVGKPRVVYRDIDGQKCEPYENLTVDVPDDNQGAVMEELGR
            ||||||||||||||||||||||||||||||||||||||||||||||||||||||||||||
a151        GELHLTILLENMRREGYELAVGKPRVVYRDIDGQKCEPYENLTVDVPDDNQGAVMEELGR
                  370       380       390       400       410       420

                  430       440       450       460       470       480
m151.pep    RRGELTNMESDGNGRTRLEYHIPARGLIGFQGEFMTLTRGVGLMSHVFDDYAPVKPDMPG
            ||||||||||||||||||||||||||||||||||||||||||||||||||||||||||||
a151        RRGELTNMESDGNGRTRLEYHIPARGLIGFQGEFMTLTRGVGLMSHVFDDYAPVKPDMPG
                  430       440       450       460       470       480

                  490       500       510       520       530       540
m151.pep    RHNGVLVSQEQGEAVAYALWNLEDRGRMFVSPNDKIYEGMIIGIHSRDNDLVVNPLKGKK
            ||||||||||||||||||||||||||||||||||||||||||||||||||||||||||||
a151        RHNGVLVSQEQGEAVAYALWNLEDRGRMFVSPNDKIYEGMIIGIHSRDNDLVVNPLKGKK
                  490       500       510       520       530       540

                  550       560       570       580       590       600
m151.pep    LTNIRASGTDEAVRLTTPIKLTLEGAVEFIDDDELVEITPQSIRLRKRYLSELERRRHFK
            ||||||||||||||||||||||||||||||||||||||||||||||||||||||||||||
a151        LTNIRASGTDEAVRLTTPIKLTLEGAVEFIDDDELVEITPQSIRLRKRYLSELERRRHFK
                  550       560       570       580       590       600

m151.pep    KLDX
            ||||
a151        KLDX
```

The following partial DNA sequence was identified in *N. gonorrhoeae* <SEQ ID 619>:

```
g152.seq
  1 ATGAAAAaca aAACCaaagt ctgGGacttc cCcacccgcc ttTTCCactG
 51 GctgcttgCC gCATCCctgc CCTTTATGTG gtatagCGCA AAAGCCGGCG
101 GcgataTGCT GcaatgGCAC ACGCGCGTCG GGCTGCTCGT CCTTTTCCTG
151 CTCGTATTCC GCCTCTGCTG GGGCATTTGG GGCAgcgATA CCGCCCGTTT
201 CTCccgTtTC GTCCGAGGTT GGGCAGGTAT ACGCGGCTAT CTGAAAAAcg
251 gCATTCCCGA ACAtatcCAG CCCGGACACA ACCCCTTGGG CGCACTgatg
301 gtcGTTGCGC TTTTGgccgc cgtcTCATTT CAagtcggcA CGGGGCTTTT
351 Tgccgccaat gaaaacacct tcagcaCCAa cggctacctc aaccatttgg
401 tttccgaaca tacgGGCAGC CTTATACGGA AAATCCACCT CAACTTTTTC
451 AAGCTGCTCG CCGTTTTTTC CGCAGTCCAC ATCGCCGCCG TCGCCGCATA
501 CCGCATATTC AAAAAGAAAA ACCTCGTCCG CCCGATGATA ACCGGCTTCA
551 AATACATCGA AGGCAAAACC TCAATCCGCT TTGCCGGCAA AGCCGCGCTT
601 GCCGCCGCAT TATCGGTTGC CGCGCTTGCC GCAGCCGCCA TCCTGCTCCT
651 GTCCTGA
```

This corresponds to the amino acid sequence <SEQ ID 620; ORF 152.ng>:

```
g152.pep
  1 MKNKTKVWDF PTRLFHWLLA ASLPFMWYSA KAGGDMLQWH TRVGLLVLFL
 51 LVFRLCWGIW GSDTARFSRF VRGWAGIRGY LKNGIPEHIQ PGHNPLGALM
101 VVALLAAVSF QVGTGLFAAN ENTFSTNGYL NHLVSEHTGS LIRKIHLNFF
151 KLLAVFSAVH IAAVAAYRIF KKKNLVRPMI TGFKYIEGKT SIRFAGKAAL
201 AAALSVAALA AAAILLLS*
```

The following partial DNA sequence was identified in *N. meningitidis* <SEQ ID 621>:

```
m152.seq
  1 ATGAAAAACA AAACCAAAGT CTGGGACCTC CCCACCCGCC TTTTCCACTG
 51 GCTGCTTGCC GCGTCCCTGC CCTTTATGTG GTATAGCGCG AAAGCCGGCG
101 GCGATATGCT GCAATGGCAC ACGCGCGTCG GGCTGTTCGT CCTTTTCCTG
151 CTCGTATTTC GCCTCTGCTG GGGCATTTGG GGCAGCGATA CCGCCCGTTT
201 TTCCCGTTTC GTCCAAGGCT GGGCAGGCAT ACGCGGCTAT CTGAAAAACG
251 GTATTCCCGA ACACATCCAG CCCGGACACA ACCCCTTGGG CGCACTGATG
301 GTCGTTGCGC TTTTGGCCGC CGTGTCCTTC CAAGTCGGCA CCGGGCTTTT
351 TGCCGCCGAT GAAAACACCT TCAGCACCAA CGGCTACCTC AACCATTTGG
401 TTTCCGAACA TACGGGCAGC CTTATGCGGA AAATCCACCT CAACTTTTTC
451 AAGCTGCTCG CCGTTTTTTC TGCAATCCAC ATCGCCGCCG TCGCCGCATA
501 CCGCGTATTC AAAAAGAAAA ACCTCATCCT CCCGATGATA ACCGGCTTCA
551 AATACATCGA AGGCAAAACC TCAATCCGCT TTGCAGGCAA AGCCGCGCTT
```

-continued

```
601  GCCGCCGCAT TATCGGTTGC CTCGCTTGCC GCAGCCGCCA TCCTGCTCCT

651  GTCCTGA
```

This corresponds to the amino acid sequence <SEQ ID 622; ORF 152>:

```
m152.pep
  1  MKNKTKVWDL PTRLFHWLLA ASLPFMWYSA KAGGDMLQWH TRVGLFVLFL

 51  LVFRLCWGIW GSDTARFSRF VQGWAGIRGY LKNGIPEHIQ PGHNPLGALM

101  VVALLAAVSF QVGTGLFAAD ENTFSTNGYL NHLVSEHTGS LMRKIHLNFF

151  KLLAVFSAIH IAAVAAYRVF KKKNLILPMI TGFKYIEGKT SIRFAGKAAL

201  AAALSVASLA AAAILLLS*
```

Computer analysis of this amino acid sequence gave the following results:

Homology with a Predicted ORF from *N. gonorrhoeae*

ORF 152 shows 95.4% identity over a 218 aa overlap with a predicted ORF (ORF 152.ng) from *N. gonorrhoeae*:

```
m152/g152

                 10        20        30        40        50        60
m152.pep MKNKTKVWDLPTRLFHWLLAASLPFMWYSAKAGGDMLQWHTRVGLFVLFLLVFRLCWGIW
         |||||||||:||||||||||||||||||||||||||||||||||:|||||||||||||||
g152     MKNKTKVWDFPTRLFHWLLAASLPFMWYSAKAGGDMLQWHTRVGLLVLFLLVFRLCWGIW
                 10        20        30        40        50        60

                 70        80        90       100       110       120
m152.pep GSDTARFSRFVQGWAGIRGYLKNGIPEHIQPGHNPLGALMVVALLAAVSFQVGTGLFAAD
         ||||||||||:||||||||||||||||||||||||||||||||||||||||||||||||:
g152     GSDTARFSRFVRGWAGIRGYLKNGIPEHIQPGHNPLGALMVVALLAAVSFQVGTGLFAAN
                 70        80        90       100       110       120

                130       140       150       160       170       180
m152.pep ENTFSTNGYLNHLVSEHTGSLMRKIHLNFFKLLAVFSAIHIAAVAAYRVFKKKNLILPMI
         ||||||||||||||||||||:|||||||||||||||:|||||||||:||||||: |||
g152     ENTFSTNGYLNHLVSEHTGSLIRKIHLNFFKLLAVFSAVHIAAVAAYRIFKKKNLVRPMI
                130       140       150       160       170       180

                190       200       210      219
m152.pep TGFKYIEGKTSIRFAGKAALAAALSVASLAAAAILLLSX
         ||||||||||||||||||||||||||:|||||||||||
g152     TGFKYIEGKTSIRFAGKAALAAALSVAALAAAAILLLSX
                190       200       210
```

The following partial DNA sequence was identified in *N. meningitidis* <SEQ ID 623>:

```
a152.seq
  1  ATGAAAAACA AAACCAAAGT CTGGGACTTC CCCACCCGCC TTTTCCACTG

 51  GCTGCTTGCC GCATCCCTAC CCTTTATGTG GTATAGCGCG AAAACCGGCG

101  GCGATATGCT GCAATGGCAC ACGCGCGTCG GGCTGTTTAT CCTTTTCCTG

151  CTCGTATTCC GCCTCTGCTG GGGCATTTGG GGCAGCGATA CCGCCCGTTT

201  CTCCCGTTTC GTCCGCGGAT GGTCGGGTAT CAGAGAGTAT ATGAAAAACG

251  GTATTCCCGA ACACGTCCAA CCCGGACACA ACCCCTTGGG CGCACTGATG

301  GTCGTTGCGC TTTTGGCCGC CGTGTCGTTC CAAGTCGGCA CAGGGCTTTT

351  TGCCGCCGAT GTAAACACCT TCAGCACCAA CGGCTACCTC AACCATTTGG

401  TTTCCGAACA TACGGGCAGC CTTATGCGGA AAATCCATCT CAACTTTTTC

451  AAACTGCTCG CCGTTTTTTC CGCAGTCCAC ATCGCCGNCG TCGCCGCATA

501  CCGCGTGTTC AAAAAGAAAA ACCTCGTCCT CCCGATGATA ACCGGCTTCA
```

-continued

```
551  AATACATCGA AGGCAAAACC TCAATCCGCT TTGCCGGCAA AGCCGCGCTT

601  GCCGCCGCAT TATCGGTTGC CGCGCTTGCC GCAGCCGCCA TCCTGCTCCT

651  GTCCTGA
```

This corresponds to the amino acid sequence <SEQ ID 624; ORF 152.a>:

```
a152.pep
  1  MKNKTKVWDF PTRLFHWLLA ASLPFMWYSA KTGGDMLQWH TRVGLFILFL

 51  LVFRLCWGIW GSDTARFSRF VRGWSGIREY MKNGIPEHVQ PGHNPLGALM

101  VVALLAAVSF QVGTGLFAAD VNTFSTNGYL NHLVSEHTGS LMRKIHLNFF

151  KLLAVFSAVH IAXVAAYRVF KKKNLVLPMI TGFKYIEGKT SIRFAGKAAL

201  AAALSVAALA AAAILLLS*
```

m152/a152 94.0% identity in 218 aa overlap

```
                    10        20        30        40        50        60
m152.pep  MKNKTKVWDLPTRLFHWLLAASLPFMWYSAKAGGDMLQWHTRVGLFVLFLLVFRLCWGIW
          |||||||||:|||||||||||||||||||||||:||||||||||||:|||||||||||||
a152      MKNKTKVWDFPTRLFHWLLAASLPFMWYSAKTGGDMLQWHTRVGLFILFLLVFRLCWGIW
                    10        20        30        40        50        60

                    70        80        90       100       110       120
m152.pep  GSDTARFSRFVQGWAGIRGYLKNGIPEHIQPGHNPLGALMVVALLAAVSFQVGTGLFAAD
          |||||||||||:||:||| |:|||||||:|||||||||||||||||||||||||||||||
a152      GSDTARFSRFVRGWSGIREYMKNGIPEHVQPGHNPLGALMVVALLAAVSFQVGTGLFAAD
                    70        80        90       100       110       120

                   130       140       150       160       170       180
m152.pep  ENTFSTNGYLNHLVSEHTGSLMRKIHLNFFKLLAVFSAIHIAAVAAYRVFKKKNLILPMI
           |||||||||||||||||||||||||||||||||||||:||| ||||||||||||:||||
a152      VNTFSTNGYLNHLVSEHTGSLMRKIHLNFFKLLAVFSAVHIAXVAAYRVFKKKNLVLPMI
                   130       140       150       160       170       180

                   190       200       210      219
m152.pep  TGFKYIEGKTSIRFAGKAALAAALSVASLAAAAILLLSX
          |||||||||||||||||||||||||||:|||||||||||
a152      TGFKYIEGKTSIRFAGKAALAAALSVAALAAAAILLLSX
                   190       200       210
```

The following partial DNA sequence was identified in *N. gonorrhoeae* <SEQ ID 625>:

```
g153.seq
  1  atggggtttg cttaCAgtat gacgtatatc gaggtCGGGa taccggaggc

 51  ggcatccgtc ctttCgctGC CCGAGATgat gcgcctgatG GTGTTtCagg

101  attATGGTTT TttggcCGAA GTGATGTTTG TGctgaCTTT cGGCGcgcCG

151  GTTCTGTTtC TGCTGCTGTG CCTGTATGTC TATGCCGCGC TGATACGGAA

201  ACAGGCGTAT CCTGCGCTGC GTTTGGCAAC GCGTGTGATG GTGCGCTTGA

251  GGCAGGCGAT GATGGTGGAT GTGTTTTTTG TTTCCACTCT GGTGGCGTAT

301  ATCAAGCTCT CGTCTGTGGC AAAGGTTCGC TTCGGGCCGG CGTTTTATCT

351  GATGTTCGCG CTGTCGGTTA TGCTGATTCG GACTTCGGTA TCGGTTCCCC

401  AGCATTGGGT GTATTTCCAA ATCGGGCGGC TGACGGGGAA TAATGCGGTT

451  CAGACGGCAT CGGAAGGCAA AACCTGTTGC AGCCGCTGCC TGTATTTccg

501  cgacAGTgcc gaatccCCCT GCGGGGTGTg cgGCGcggaA CTgtacggcg

551  gacggccgaa aagtCTGAGt atttCgtCGG CGTTTCTgac ggcggcggTT

601  GTTTTGTATT TCCctgCcaa TATCctgccg attaTGAttt cgtccAATCc
```

-continued 651 tgccgccacg GAGGcCAACA CCATCTTTAG CGGCATCGCT TATATGTGGG
701 ACGagggcgA CAGGCTGATT GCGGCGGTTA TTTTCAGCGC GAGTATTTTG
751 GTGCCGGTGC TGAAGATTGC GGCAATGTCG GTTTTGATTG CGGCGGCACG
801 GTTCGCTTTG CCGGCGGGCG CAAAGAAATT GTCGCACCTC tacCGCATCA
851 CCGAAGCGGT CGGCCGCTGG TCGATGATTG ATATTTTTGT GATTATTATT
901 TTGATGTGTT CGTTCCacaC TTATGCCGCG CGCGTCATTC CGGGCAGTGC
951 GGCAGTCTAT TTCTGCCTGG TCGTGATTTT GACGATGCTG TCCGCCTATT
1001 ATTTCGACCC GCGCCTGCTT TGGGACAAAC GCGCTTCAGA CGGCATTGCT
1051 TTCAACGAAA CGGAAAAATA TGACTGA This corresponds to the amino acid sequence <SEQ ID 626; ORF 153.ng>:

g153.pep
1 MGFAYSMTYI EVGIPEAASV LSLPEMMRLM VFQDYGFLAE VMFVLTFGAP
51 VLFLLLCLYV YAALIRKQAY PALRLATRVM VRLRQAMMVD VFFVSTLVAY
101 IKLSSVAKVR FGPAFYLMFA LSVMLIRTSV SVPQHWVYFQ IGRLTGNNAV
151 QTASEGKTCC SRCLYFRDSA ESPCGVCGAE LYGGRPKSLS ISSAFLTAAV
201 VLYFPANILP IMISSNPAAT EANTIFSGIA YMWDEGDRLI AAVIFSASIL
251 VPVLKIAAMS VLIAAARFAL PAGAKKLSHL YRITEAVGRW SMIDIFVIII
301 LMCSFHTYAA RVIPGSAAVY FCLVVILTML SAYYFDPRLL WDKRASDGIA
351 FNETEKYD*

The following partial DNA sequence was identified in *N. meningitidis* <SEQ ID 627>:

m153.seq
1 ATGGCGTTTG CTTACGGTAT GACGTATATC GAGGTCGGGA TACCGGGTGC
51 GGCATCCGTC CTTTCGCTGC CCGAGATGAT GCGCCTGATG GTGTTTCAGG
101 ATTATGGTTT TTTGGCCGAA GTGATGTTTG TGCTGACTTT CGGCGCGCCG
151 GTTCTGTTTC TGCTGCTGTG CCTGTATGTC TATGCCGCGC TGATACGGAA
201 ACAGGCGTAT CCTGCGCTGC GTTTGGCAAC GCGTGTGATG GTGCGCTTGA
251 GACAGGCGAT GATGGTGGAT GTGTTTTTTG TTTCCACTTT GGTGGCGTAT
301 ATCAAGCTCT CGTCTGTGGC AGAGGTTCGC TTCGGGCCGG CGTTTTATCT
351 GATGTTCGCG CTGTCAGTTA TGCTGATTCG GACTTCGGTA TCGGTTCCCC
401 AGCATTGGGT GTATTTTCAA ATCGGGCGGC TGACGGGGGA TAATGCGGTT
451 CAGACGGCAT CGGAAGGTAA AACCTGTTGC AGCCGCTGCC TGTATTTCCG
501 CGACAGTGCC GAATCCCCCT GCGGCGTGTG CGGTGCGGAA CTGTACCGCC
551 GACGGCCGAA AAGTCTGAGT ATTTCGTCGG CGTTTCTGAC GGCGGCGGTT
601 ATTTTGTATT TCCCTGCCAA TATCCTGCCG ATTATGATTT CGTCCAATCC
651 TGCCGCCACG GAGGTCAATA CCATCCTTAA CGGCATCGCT TATATGTGGG
701 ACGAGGGCGA CAGGCTGATT GCGGCGGTTA TTTTCAGCGC GAGTATTTTG
751 GTGCCGGTAC TGAAGATTGC GGCAATGTCG GTTTTGATTG CGTCCGCCCG
801 CTTCGCTTTG CCAACGGGTG CAAAGAAATT GTCGCACCTC TACCGCATCA -continued

```
 851 CCGAAGCGGT CGGCCGCTGG TCGATGATTG ATATTTTTGT GATTATTATT

 901 TTGATGTGTT CGTTCCACAC TTATGCCGCG CGCGTCATTC CGGGCAGTGC

 951 GGCAGTCTAT TTCTGCCTGG TCGTGATTCT GACGATGCTG TCCGCCTATT

1001 ATTTCGACCC GCGCCTGCTT TGGGACAAAC GCGCTTCAGA CGGCATTGCT

1051 TTCAATGAAA CGGAAAAACA TGACTGA
```

This corresponds to the amino acid sequence <SEQ ID 628; ORF 153>:

```
m153.pep

  1 MAFAYGMTYI EVGIPGAASV LSLPEMMRLM VFQDYGFLAE VMFVLTFGAP

 51 VLFLLLCLYV YAALIRKQAY PALRLATRVM VRLRQAMMVD VFFVSTLVAY

101 IKLSSVAEVR FGPAFYLMFA LSVMLIRTSV SVPQHWVYFQ IGRLTGDNAV

151 QTASEGKTCC SRCLYFRDSA ESPCGVCGAE LYRRRPKSLS ISSAFLTAAV

201 ILYFPANILP IMISSNPAAT EVNTILNGIA YMWDEGDRLI AAVIFSASIL

251 VPVLKIAAMS VLIASARFAL PTGAKKLSHL YRITEAVGRW SMIDIFVIII

301 LMCSFHTYAA RVIPGSAAVY FCLVVILTML SAYYFDPRLL WDKRASDGIA

351 FNETEKHD*
```

m153/g153 96.1% identity in 358 aa overlap

```
                 10        20        30        40        50        60
m153.pep MAFAYGMTYIEVGIPGAASVLSLPEMMRLMVFQDYGFLAEVMFVLTFGAPVLFLLLCLYV
         |:|||:||||||||| ||||||||||||||||||||||||||||||||||||||||||||
g153     MGFAYSMTYIEVGIPEAASVLSLPEMMRLMVFQDYGFLAEVMFVLTFGAPVLFLLLCLYV
                 10        20        30        40        50        60

                 70        80        90       100       110       120
m153.pep YAALIRKQAYPALRLATRVMVRLRQAMMVDVFFVSTLVAYIKLSSVAEVRFGPAFYLMFA
         |||||||||||||||||||||||||||||||||||||||||||||||:||||||||||||
g153     YAALIRKQAYPALRLATRVMVRLRQAMMVDVFFVSTLVAYIKLSSVAKVRFGPAFYLMFA
                 70        80        90       100       110       120

                130       140       150       160       170       180
m153.pep LSVMLIRTSVSVPQHWVYFQIGRLTGDNAVQTASEGKTCCSRCLYFRDSAESPCGVCGAE
         ||||||||||||||||||||||||||:|||||||||||||||||||||||||||||||||
g153     LSVMLIRTSVSVPQHWVYFQIGRLTGNNAVQTASEGKTCCSRCLYFRDSAESPCGVCGAE
                130       140       150       160       170       180

                190       200       210       220       230       240
m153.pep LYRRRPKSLSISSAFLTAAVILYFPANILPIMISSNPAATEVNTILNGIAYMWDEGDRLI
         ||  ||||||||||||||||:||||||||||||||||||||:|||::|||||||||||||
g153     LYGGRPKSLSISSAFLTAAVVLYFPANILPIMISSNPAATEANTIFSGIAYMWDEGDRLI
                190       200       210       220       230       240

                250       260       270       280       290       300
m153.pep AAVIFSASILVPVLKIAAMSVLIASARFALPTGAKKLSHLYRITEAVGRWSMIDIFVIII
         ||||||||||||||||||||||||:||||||:||||||||||||||||||||||||||||
g153     AAVIFSASILVPVLKIAAMSVLIAAARFALPAGAKKLSHLYRITEAVGRWSMIDIFVIII
                250       260       270       280       290       300

                310       320       330       340       350      359
m153.pep LMCSFHTYAARVIPGSAAVYFCLVVILTMLSAYYFDPRLLWDKRASDGIAFNETEKHDX
         ||||||||||||||||||||||||||||||||||||||||||||||||||||||||:||
g153     LMCSFHTYAARVIPGSAAVYFCLVVILTMLSAYYFDPRLLWDKRASDGIAFNETEKYDX
                310       320       330       340       350
```

The following partial DNA sequence was identified in *N. meningitidis* <SEQ ID 629>:

```
a153.seq
  1 ATGGCGTTTG CTTACGGTAT GACGTATATC GAGGTCGGGA TACCGGGTGC

 51 GGCATCCGTC CTTTCGCTGC CCGAGATGAT GCGCCTGATG GTGTTTCAGG

101 ATTATGGTTT TTTGGCCGAA GTGATGTTTG TGCTGACCTT CGGCGCGCCG
```

-continued

```
 151 GTTCTGTTTC TGCTGCTGTG CCTGTATGTC TATGCCGCGC TGATACGGAA

 201 ACAGGCGTAT CCTGCGCTGC GTTTGGCAAC GCGTGTGATG GTGCGCTTGA

 251 GACAGGCGAT GATGGTGGAT GTGTTTTTTG TTTCCACTTT GGTGGCGTAT

 301 ATCAAGCTCT CGTCTGTGGC AGAGGTTCGC TTCGGATCGG CGTTTTATCT

 351 GATGTTCGCG CTGTCGGTTA TGCTGATTCG GACTTCGGTA TCGGTTCCCC

 401 AGCATTGGGT GTATTTTCAA ATCGGGCGGC TGACGGGGGA TAATGCGGTT

 451 CAGACGGCAT CGGAAGGTAA AACCTGTTGC AGCCGCTGCC TGTATTTCCG

 501 CGACAGTGCC GAATCCCCCT GCGGCGTGTG CGGTGCGGAA CTGTACCGCC

 551 GACGGCCGAA AAGTCTGAGT ATTTCGTCGG CGTTTCTGAC GGCGGCGGTT

 601 ATTTTGTATT TCCCTGCCAA TATCCTGCCG ATTATGATTT CGTCCAATCC

 651 TGCCGCCACG GAGGTCAATA CCATCCTTAA CGGCATCGCT TATATGTGGG

 701 ACGAGGGCGA CAGGCTGATT GCGGCGGTTA TTTTCAGCGC GAGTATTTTG

 751 GTGCCGGTAC TGAAGATTGC GGCAATGTCG GTTTTGATTG CGTCCGCCCG

 801 CTTCGCTTTG CCAACGGGTG CAAAGAAATT GTCGCACCTC TACCGCATCA

 851 CCGAAGCGGT CGGCCGCTGG TCGATGATTG ATATTTTTGT GATTATTATT

 901 TTGATGTGTT CGTTCCACAC TTATGCCGCG CGCGTCATTC CGGGCAGTGC

 951 GGCAGTCTAT TTCTGCCTGG TCGTGATTCT GACGATGCTG TCCGCCTATT

1001 ATTTCGACCC GCGCCTGCTT TGGGACAAAC GCGCTTCAGA CGGCATTGCT

1051 TTCAATGAAA CGGAAAAACA TGACTGA
```

This corresponds to the amino acid sequence <SEQ ID 630; ORF 153.a>:

```
a153.pep
   1 MAFAYGMTYI EVGIPGAASV LSLPEMMRLM VFQDYGFLAE VMFVLTFGAP

  51 VLFLLLCLYV YAALIRKQAY PALRLATRVM VRLRQAMMVD VFFVSTLVAY

 101 IKLSSVAEVR FGSAFYLMFA LSVMLIRTSV SVPQHWVYFQ IGRLTGDNAV

 151 QTASEGKTCC SRCLYFRDSA ESPCGVCGAE LYRRRPKSLS ISSAFLTAAV

 201 ILYFPANILP IMISSNPAAT EVNTILNGIA YMWDEGDRLI AAVIFSASIL

 251 VPVLKIAAMS VLIASARFAL PTGAKKLSHL YRITEAVGRW SMIDIFVIII

 301 LMCSFHTYAA RVIPGSAAVY FCLVVILTML SAYYFDPRLL WDKRASDGIA

 351 FNETEKHD*
```

m153/a153 99.7% identity in 358 aa overlap

```
                   10        20        30        40        50        60
m153.pep  MAFAYGMTYIEVGIPGAASVLSLPEMMRLMVFQDYGFLAEVMFVLTFGAPVLFLLLCLYV
          ||||||||||||||||||||||||||||||||||||||||||||||||||||||||||||
a153      MAFAYGMTYIEVGIPGAASVLSLPEMMRLMVFQDYGFLAEVMFVLTFGAPVLFLLLCLYV
                   10        20        30        40        50        60

                   70        80        90       100       110       120
m153.pep  YAALIRKQAYPALRLATRVMVRLRQAMMVDVFFVSTLVAYIKLSSVAEVRFGPAFYLMFA
          ||||||||||||||||||||||||||||||||||||||||||||||||||||| ||||||
a153      YAALIRKQAYPALRLATRVMVRLRQAMMVDVFFVSTLVAYIKLSSVAEVRFGSAFYLMFA
                   70        80        90       100       110       120

                  130       140       150       160       170       180
m153.pep  LSVMLIRTSVSVPQHWVYFQIGRLTGDNAVQTASEGKTCCSRCLYFRDSAESPCGVCGAE
          ||||||||||||||||||||||||||||||||||||||||||||||||||||||||||||
a153      LSVMLIRTSVSVPQHWVYFQIGRLTGDNAVQTASEGKTCCSRCLYFRDSAESPCGVCGAE
                  130       140       150       160       170       180
```

-continued

```
               190        200        210        220        230        240
m153.pep LYRRRPKSLSISSAFLTAAVILYFPANILPIMISSNPAATEVNTILNGIAYMWDEGDRLI
         ||||||||||||||||||||||||||||||||||||||||||||||||||||||||||||
a153     LYRRRPKSLSISSAFLTAAVILYFPANILPIMISSNPAATEVNTILNGIAYMWDEGDRLI
               190        200        210        220        230        240

               250        260        270        280        290        300
m153.pep AAVIFSASILVPVLKIAAMSVLIASARFALPTGAKKLSHLYRITEAVGRWSMIDIFVIII
         ||||||||||||||||||||||||||||||||||||||||||||||||||||||||||||
a153     AAVIFSASILVPVLKIAAMSVLIASARFALPTGAKKLSHLYRITEAVGRWSMIDIFVIII
               250        260        270        280        290        300

               310        320        330        340        350      359
m153.pep LMCSFHTYAARVIPGSAAVYFCLVVILTMLSAYYFDPRLLWDKRASDGIAFNETEKHDX
         |||||||||||||||||||||||||||||||||||||||||||||||||||||||||||
a153     LMCSFHTYAARVIPGSAAVYFCLVVILTMLSAYYFDPRLLWDKRASDGIAFNETEKHDX
               310        320        330        340        350
```

The following partial DNA sequence was identified in *N. gonorrhoeae* <SEQ ID 631>:

```
g154.seq
   1  ATGACTGACA ACAGCCCTCC TCCAAACGGA CACGCTCAAG CACGCGTCCG

  51  CAAAAACAAC accttcctCT CCGCCGTCTG GCTGGTCCCG CTGATCGCGC

 101  TGATTGCCGG CGGCTGGCTT TGGGTTAAGG AAATCCGCAA CAGGGGGCCT

 151  GTGGTTACGC TCTTGATGGA CAGCGCGGAA GGCATCGAAG TCAACAATAC

 201  GGTCATTAAG GTATTGAGCA TCGATGTCGG ACGCGTTACC CGAATCAAAC

 251  TGCGCGACGA CCAAAAAGGC GTGGAAGTTA CTGCCCAACT CAATGCGGAC

 301  GTATCCGGCC TCATCCGCAG CGATACCCAG TTTTGGGTGG TCAAGCCGCG

 351  TATCGACCAA AGCGGcgtAA CCGGTTTGGG TACGCTGCTT TCGGGTTCGT

 401  ACATCGCTTT TACACCCGGC AAAAGCGGCG AGGCAAAAGA CGTGTTCCAA

 451  GTGCAGGACA TTCCGCCCGT TACCGCCATC GGGCAAAgcg GGCTGCGCTT

 501  GAATTTGATT GGTAAAAACG AccgCATCCT CAACGTcaaC AGCCCTGTTT

 551  TGTATGAAAA CTTTATGGTC GGGCAAATCG AAAGCGCGCA TTTCGAcccG

 601  TCCGACCAAA GCGTGCATTA CACCATCTTC ATCCAAAGCC CCAACGACAA

 651  ACTGATTCAT TCCGCCAGCC GTTTTTGGCT GGAAAGCGGC ATCAATATCG

 701  AAACCACAGG CAGCGGCATC AAACTCAATT CCGCCCCTCT GCCTGCCCTG

 751  CTGTCAGGCG CGATTTCATT TGATTCGCCG AAAACCAAAA ACAGTAAAAA

 801  CGTCAAAAGC GAGGACAGCT TCACGCTTTA CGACAGCCGC AGCGAAATCG

 851  CCAACCTGCC TGACGACCGC TCGCTGTACT ACACCGCGTT TTTCAAACAA

 901  TCCGTGCGCG GACTGACCGT cggTTCGCCT GTcgaATACA AAGGGCtgaA

 951  TGTcggCATG GTTTCCGATG TCCCTTATTT TGACCGCAAt gacagCCTGC

1001  ACCtgtTTGA aaacggctgg aTTcccGtac gCATCCGCAT cgagccTTCC

1051  CGTTTGGAAA TCAATGCCGA CGAGCAAAGC AAAGAGCATT GGAAACAACA

1101  ATTCCAGACG GCCTTAAACA AAGGCCTGAC CGCCACCATC TCCAGCAACA

1151  ACCTGCTGAC CGGCGGCAAA ATGATTGAGT TGAACGATCA GCCTTCCGCC

1201  TCGCCCAAGC TGCGACCGCA TACCGTTTAT GCAGGCGATA CCGTCATCGC

1251  CACACGGGGC GGCGGTTTGG ATGACTTGCA GGTCAAATTG GCGGATTTGC

1301  TGGACaaatT CAACAATCTG CCATTggata aAACCGTTGC CGAATTGAAC

1351  GGCTCGCTCG CCGAACTCAA GTCCGCACTC AAATCCGCCA ATGCCGCCCT

1401  AAGCTCCATT GacaAACTGG TCGgcaaTCC GCAGACGCAA AACATCCCGA
```

-continued

1451 ACGAACTGAA CCAAACTCTG AAAGAGTTGC GCATAACCCT GCAAGGCGTA

1501 TCGcctCAAT CGCCTATCTa cgGAgacgta caAAATAcgc tgCaAAGTTT

1551 GGACAAAACC TTAAAagacg TtcaACCCGT CATTAACACT TTGAaAGAAa 1601 aacCCaaCgc actGATTTtc aacaACAGCA GCAAAGAccc tATCCCGAAA

1651 GGAAGCCGAT AA

This corresponds to the amino acid sequence <SEQ IS 632; ORF 154.ng>:

g154.pep
1 MTDNSPPPNG HAQARVRKNN TFLSAVWLVP LIALIAGGWL WVKEIRNRGP

51 VVTLLMDSAE GIEVNNTVIK VLSIDVGRVT RIKLRDDQKG VEVTAQLNAD

101 VSGLIRSDTQ FWVVKPRIDQ SGVTGLGTLL SGSYIAFTPG KSGEAKDVFQ

151 VQDIPPVTAI GQSGLRLNLI GKNDRILNVN SPVLYENFMV GQIESAHFDP

201 SDQSVHYTIF IQSPNDKLIH SASRFWLESG INIETTGSGI KLNSAPLPAL

251 LSGAISFDSP KTKNSKNVKS EDSFTLYDSR SEIANLPDDR SLYYTAFFKQ

301 SVRGLTVGSP VEYKGLNVGM VSDVPYFDRN DSLHLFENGW IPVRIRIEPS

351 RLEINADEQS KEHWKQQFQT ALNKGLTATI SSNNLLTGGK MIELNDQPSA

401 SPKLRPHTVY AGDTVIATRG GGLDDLQVKL ADLLDKFNNL PLDKTVAELN

451 GSLAELKSAL KSANAALSSI DKLVGNPQTQ NIPNELNQTL KELRITLQGV

501 SPQSPIYGDV QNTLQSLDKT LKDVQPVINT LKEKPNALIF NNSSKDPIPK

551 GSR*

The following partial DNA sequence was identified in *N. meningitidis* <SEQ ID 633>:

m154.seq
1 ATGACTGACA ACAGCCCTCC TCCAAACGGA CACGCCCAAG CACGCGTCCG

51 CAAAAACAAC ACCTTCCTCT CTGCCGTCTG GCTGGTTCCG CTGATCGCGC

101 TGATTGCCGG CGGCTGGCTT TGGGTTAAGG AAATCCGCAA CAGGGGGCCT

151 GTGGTTACGC TCTTGATGGA CAGCGCGGAA GGCATTGAGG TCAACAATAC

201 GGTCATCAAA GTATTGAGCA TCGATGTCGG ACGCGTTACC CGAATCAAAC

251 TGCGCGACGA CCAAAAAGGC GTGGAAGTAA CCGCCCAACT CAATGCGGAC

301 GTATCCGGCC TCATCCGCAG CGATACCCAG TTTTGGGTGG TCAAGCCGCG

351 TATCGACCAA AGCGGCGTAA CCGGTTTGGG TACGCTGCTT TCGGGTTCGT

401 ACATCGCCTT TACACCCGGC AAAAGCGACG AGGCAAAAGA CGTGTTCCAA

451 GTGCAGGACA TTCCGCCCGT TACCGCCATC GGGCAAAGCG GGCTGCGCTT

501 GAATTTGATT GGTAAAAACG ACCGCATCCT CAACGTCAAC AGCCCTGTTT

551 TGTATGAAAA TTTTATGGTC GGGCAAGTCG AAAGCGCGCA TTTCGACCCG

601 TCCGACCAAA GCGTGCATTA CACCATCTTC ATCCAAAGCC CCAACGACAA

651 ACTGATTCAT TCCGCCAGCC GTTTTTGGCT GGAAAGCGGC ATCAATATCG

701 AAACCACAGG CAGCGGCATC AAACTCAATT CCGCCCCTCT GCCTGCCCTG

751 CTGTCGGGCG CGATTTCATT TGATTCGCCG AAAACCAAAA ACAGTAAAAA

801 CGTCAAAAGC GAAGACAGCT TCACGCTTTA CGACAGCCGC AGCGAAGTCG

-continued

```
 851 CCAACCTGCC TGACGACCGC TCGCTGTACT ACACCGCGTT TTTCAAACAA
 901 TCCGTGCGCG GCCTGACCGT CGGTTCGCCC GTCGAGTACA AAGGGCTGAA
 951 TGTCGGCGTG GTTTCCGACG TTCCTTATTT CGACCGCAAC GACAGCCTGC
1001 ACCTGTTTGA AAACGGCTGG ATACCCGTAC GCATCCGCAT TGAACCTTCC
1051 CGTTTGGAAA TCAATGCCGA CGAACAAAGC AAAGAACATT GGAAACAACA
1101 ATTTCAGACG GCCTTAAACA AAGGCCTGAC CGCCACCATC TCCAGCAACA
1151 ACCTGCTGAC CGGAAGCAAA ATGATTGAGT TGAACGATCA GCCTTCCGCA
1201 TCACCTAAGC TGCGACCGCA TACCGTTTAT GCAGGCGATA CCGTTATCGC
1251 GACCCAGGGC GGCGGTTTGG ACGATTTGCA GGTCAAATTG GCGGATTTGC
1301 TGGACAAGTT CGACAAACTG CCTTTAGATA AGACGGTTGC CGAATTGAAC
1351 GGTTCGCTTG CCGAGCTCAA ATCCACACTC AAATCTGCCA ATGCCGCCCT
1401 AAGCTCCATC GACAAACTGG TCGGCAAACC GCAGACACAA AACATTCCGA
1451 ACGAACTGAA CCAAACCCTG AAAGAGTTGC GCACAACCCT GCAAGGCGTA
1501 TCGCCGCAAT CGCCTATCTA CGGCGACGTA CAAAATACGC TGCAAAGTTT
1551 GGACAAAACT TTAAAAGACG TTCAACCCGT GATTAATACT TTGAAAGAAA
1601 AACCCAACGC GCTGATTTTC AACAGCAGCA GCAAAGACCC TATCCCGAAA
1651 GGAAGCCGAT AA
```

This corresponds to the amino acid sequence <SEQ ID 634 ORF 154.a>:

```
m154.pep
      1 MTDNSPPPNG HAQARVRKNN TFLSAVWLVP LIALIAGGWL WVKEIRNRGP
     51 VVTLLMDSAE GIEVNNTVIK VLSIDVGRVT RIKLRDDQKG VEVTAQLNAD
    101 VSGLIRSDTQ FWVVKPRIDQ SGVTGLGTLL SGSYIAFTPG KSDEAKDVFQ
    151 VQDIPPVTAI GQSGLRLNLI GKNDRILNVN SPVLYENFMV GQVESAHFDP
    201 SDQSVHYTIF IQSPNDKLIH SASRFWLESG INIETTGSGI KLNSAPLPAL
    251 LSGAISFDSP KTKNSKNVKS EDSFTLYDSR SEVANLPDDR SLYYTAFFKQ
    301 SVRGLTVGSP VEYKGLNVGV VSDVPYFDRN DSLHLFENGW IPVRIRIEPS
    351 RLEINADEQS KEHWKQQFQT ALNKGLTATI SSNNLLTGSK MIELNDQPSA
    401 SPKLRPHTVY AGDTVIATQG GGLDDLQVKL ADLLDKFDKL PLDKTVAELN
    451 GSLAELKSTL KSANAALSSI DKLVGKPQTQ NIPNELNQTL KELRTTLQGV
    501 SPQSPIYGDV QNTLQSLDKT LKDVQPVINT LKEKPNALIF NSSSKDPIPK
    551 GSR*

m154/g154 97.8% identity in 553 aa overlap

                  10        20        30        40        50        60
m154.pep MTDNSPPPNGHAQARVRKNNTFLSAVWLVPLIALIAGGWLWVKEIRNRGPVVTLLMDSAE
         ||||||||||||||||||||||||||||||||||||||||||||||||||||||||||||
g154     MTDNSPPPNGHAQARVRKNNTFLSAVWLVPLIALIAGGWLWVKEIRNRGPVVTLLMDSAE
                  10        20        30        40        50        60

                  70        80        90       100       110       120
m154.pep GIEVNNTVIKVLSIDVGRVTRIKLRDDQKGVEVTAQLNADVSGLIRSDTQFWVVKPRIDQ
         ||||||||||||||||||||||||||||||||||||||||||||||||||||||||||||
g154     GIEVNNTVIKVLSIDVGRVTRIKLRDDQKGVEVTAQLNADVSGLIRSDTQFWVVKPRIDQ
                  70        80        90       100       110       120
```

-continued

```
                130       140       150       160       170       180
m154.pep SGVTGLGTLLSGSYIAFTPGKSDEAKDVFQVQDIPPVTAIGQSGLRLNLIGKNDRILNVN
         ||||||||||||||||||||| ||||||||||||||||||||||||||||||||||||||
g154     SGVTGLGTLLSGSYIAFTPGKSGEAKDVFQVQDIPPVTAIGQSGLRLNLIGKNDRILNVN
                130       140       150       160       170       180

                190       200       210       220       230       240
m154.pep SPVLYENFMVGQVESAHFDPSDQSVHYTIFIQSPNDKLIHSASRFWLESGINIETTGSGI
         ||||||||||||:|||||||||||||||||||||||||||||||||||||||||||||||
g154     SPVLYENFMVGQIESAHFDPSDQSVHYTIFIQSPNDKLIHSASRFWLESGINIETTGSGI
                190       200       210       220       230       240

                250       260       270       280       290       300
m154.pep KLNSAPLPALLSGAISFDSPKTKNSKNVKSEDSFTLYDSRSEVANLPDDRSLYYTAFFKQ
         ||||||||||||||||||||||||||||||||||||||||||:|||||||||||||||||
g154     KLNSAPLPALLSGAISFDSPKTKNSKNVKSEDSFTLYDSRSEIANLPDDRSLYYTAFFKQ
                250       260       270       280       290       300

                310       320       330       340       350       360
m154.pep SVRGLTVGSPVEYKGLNVGVVSDVPYFDRNDSLHLFENGWIPVRIRIEPSRLEINADEQS
         |||||||||||||||||||:||||||||||||||||||||||||||||||||||||||||
g154     SVRGLTVGSPVEYKGLNVGMVSDVPYFDRNDSLHLFENGWIPVRIRIEPSRLEINADEQS
                310       320       330       340       350       360

                370       380       390       400       410       420
m154.pep KEHWKQQFQTALNKGLTATISSNNLLTGSKMIELNDQPSASPKLRPHTVYAGDTVIATQG
         ||||||||||||||||||||||||||||||||||||||||||||||||||||||||||:|
g154     KEHWKQQFQTALNKGLTATISSNNLLTGGKMIELNDQPSASPKLRPHTVYAGDTVIATRG
                370       380       390       400       410       420

                430       440       450       460       470       480
m154.pep GGLDDLQVKLADLLDKFDKLPLDKTVAELNGSLAELKSTLKSANAALSSIDKLVGKPQTQ
         ||||||||||||||||::||||||||||||||||||||:|||||||||||||||||:||||
g154     GGLDDLQVKLADLLDKFNNLPLDKTVAELNGSLAELKSALKSANAALSSIDKLVGNPQTQ
                430       440       450       460       470       480

                490       500       510       520       530       540
m154.pep NIPNELNQTLKELRTTLQGVSPQSPIYGDVQNTLQSLDKTLKDVQPVINTLKEKPNALIF
         ||||||||||||| ||||||||||||||||||||||||||||||||||||||||||||||
g154     NIPNELNQTLKELRITLQGVSPQSPIYGDVQNTLQSLDKTLKDVQPVINTLKEKPNALIF
                490       500       510       520       530       540

                550
m154.pep NSSSKDPIPKGSRX
         |:||||||||||||
g154     NNSSKDPIPKGSRX
                550
```

The following partial DNA sequence was identified in *N. meningitidis* <SEQ ID 635>:

```
a154.seq
    1  ATGACTGACA ACAGCCCTCC TCCAAACGGA CACGCCCAAG CACGCGTCCG

   51  CAAAAACAAC ACCTTCCTCT CTGCCGTCTG GCTGGTTCCG CTGATCGCGC

  101  TGATTGCCGG CGGCTGGCTT TGGGTTAAGG AAATCCGCAA CAGGGGGCCT

  151  GTGGTTACGC TCTTGATGGA CAGCGCGGAA GGCATTGAGG TCAACAATAC

  201  GGTCATCAAA GTATTGAGCA TCGATGTCGG ACGCGTTACC CGAATCAAAC

  251  TGCGCGACGA CCAAAAAGGC GTGGAAGTAA CCGCCCAACT CAATGCGGAC

  301  GTATCCGGCC TCATCCGCAG CGATACCCAG TTTTGGGTGG TCAAGCCGCG

  351  TATCGACCAA AGCGGCGTAA CCGGTTTGGG TACGCTGCTT TCGGGTTCGT

  401  ACATCGCCTT TACACCCGGC AAAAGCGACG AGGCAAAAGA CGTGTTCCAA

  451  GTGCAGGACA TTCCGCCCGT TACCGCCATC GGGCAAAGCG GGCTGCGCTT

  501  GAATTTGATT GGTAAAAACG ACCGCATCCT CAACGTCAAC AGCCCTGTTT

  551  TGTATGAAAA CTTTATGGTC GGGCAAGTCG AAAGCGCGCA TTTCGACCCG

  601  TCCGACCAAA GCGTGCATTA CACCATCTTC ATCCAAAGCC CCAACGACAA

  651  ACTGATTCAT TCCGCCAGCC GTTTCTGGCT GGAAAGCGGC ATCAATATCG

  701  AAACCACAGG CAGCGGCATC AAACTCAATT CCGCCCCTCT GCCTGCCCTG

  751  CTGTCGGGCG CGATTTCATT TGATTCGCCG AAAACCAAAA ACAGTAAAAA
```

-continued

```
 801 CGTCAAAAGC GAAGACAGCT TCACGCTTTA CGACAGCCGC AGCGAAGTCG

 851 CCAACCTGCC TGATGACCGT TCGCTGTACT ACACCGCGTT TTTCAAACAA

 901 TCCGTGCGCG GACTGACCGT CGGTTCGCCT GTCGAGTACA AAGGGCTGAA

 951 TGTCGGCGTG GTTTCCGATG TTCCTTATTT CGACCGCAAC GACAGCCTGC

1001 ACCTGTTTGA AAACGGCTGG ATTCCCGTAC GCATCCGTAT TGAGCCTTCC

1051 CGTTTGGAAA TCAATGCCGA CGAACAAAGC AAAGAACATT GGAAACAACA

1101 ATTTCAGACG GCCTTAAACA AAGGCCTGAC CGCCACCATC TCCAGCAACA

1151 ACCTGCTGAC CGGCAGCAAA ATGATTGAGT TGAACGATCA GCCTTCCGCC

1201 TCGCCCAAGC TGCGACCGCA TACCGTTTAT GCAGGCGATA CCGTTATCGC

1251 GACCCAGGGC GGCGGTTTGG ACGATTTGCA GGTCAAATTG GCGGATTTGC

1301 TGGACAAGTT CGACAAACTG CCTTTAGATA AGACGGTTGC CGAATTGAAC

1351 GGTTCGCTTG CCGAGCTCAA ATCCACACTC AAATCTGCCA ATGCCGCCCT

1401 AAGCTCCATC GACAAACTGG TCGGCAAACC GCAGACACAA AACATTCCGA

1451 ACGAACTGAA CCAAACCCTG AAAGAGTTGC GCACAACCCT GCAAGGCGTA

1501 TCGCCTCAAT CGCCTATCTA CGGCGACGTA CAAAATACGC TGCAAAGTTT

1551 GGACAAAACC TTAAAAGACG TTCAACCCGT CATTAACACT TTGAAAGAAA

1601 AACCCAACGC GCTGATTTTC AACAGCAGCA GCAAAGACCC TATCCCGAAA

1651 GGAAGCCGAT AA
```

This corresponds to the amino acid sequence <SEQ ID 636; ORF 154.a>:

```
a154.pep
   1 MTDNSPPPNG HAQARVRKNN TFLSAVWLVP LIALIAGGWL WVKEIRNRGP

  51 VVTLLMDSAE GIEVNNTVIK VLSIDVGRVT RIKLRDDQKG VEVTAQLNAD

 101 VSGLIRSDTQ FWVVKPRIDQ SGVTGLGTLL SGSYIAFTPG KSDEAKDVFQ

 151 VQDIPPVTAI GQSGLRLNLI GKNDRILNVN SPVLYENFMV GQVESAHFDP

 201 SDQSVHYTIF IQSPNDKLIH SASRFWLESG INIETTGSGI KLNSAPLPAL

 251 LSGAISFDSP KTKNSKNVKS EDSFTLYDSR SEVANLPDDR SLYYTAFFKQ

 301 SVRGLTVGSP VEYKGLNVGV VSDVPYFDRN DSLHLFENGW IPVRIRIEPS

 351 RLEINADEQS KEHWKQQFQT ALNKGLTATI SSNNLLTGSK MIELNDQPSA

 401 SPKLRPHTVY AGDTVIATQG GGLDDLQVKL ADLLDKFDKL PLDKTVAELN

 451 GSLAELKSTL KSANAALSSI DKLVGKPQTQ NIPNELNQTL KELRTTLQGV

 501 SPQSPIYGDV QNTLQSLDKT LKDVQPVINT LKEKPNALIF NSSSKDPIPK

 551 GSR*
```

m154/a154 100.0% identity in 553 aa overlap

```
                   10        20        30        40        50        60
m154.pep   MTDNSPPPNGHAQARVRKNNTFLSAVWLVPLIALIAGGWLWVKEIRNRGPVVTLLMDSAE
           ||||||||||||||||||||||||||||||||||||||||||||||||||||||||||||
a154       MTDNSPPPNGHAQARVRKNNTFLSAVWLVPLIALIAGGWLWVKEIRNRGPVVTLLMDSAE
                   10        20        30        40        50        60

                   70        80        90       100       110       120
m154.pep   GIEVNNTVIKVLSIDVGRVTRIKLRDDQKGVEVTAQLNADVSGLIRSDTQFWVVKPRIDQ
           ||||||||||||||||||||||||||||||||||||||||||||||||||||||||||||
a154       GIEVNNTVIKVLSIDVGRVTRIKLRDDQKGVEVTAQLNADVSGLIRSDTQFWVVKPRIDQ
                   70        80        90       100       110       120
```

-continued

```
                130       140       150       160       170       180
m154.pep SGVTGLGTLLSGSYIAFTPGKSDEAKDVFQVQDIPPVTAIGQSGLRLNLIGKNDRILNVN
         ||||||||||||||||||||||||||||||||||||||||||||||||||||||||||||
a154     SGVTGLGTLLSGSYIAFTPGKSDEAKDVFQVQDIPPVTAIGQSGLRLNLIGKNDRILNVN
                130       140       150       160       170       180

                190       200       210       220       230       240
m154.pep SPVLYENFMVGQVESAHFDPSDQSVHYTIFIQSPNDKLIHSASRFWLESGINIETTGSGI
         ||||||||||||||||||||||||||||||||||||||||||||||||||||||||||||
a154     SPVLYENFMVGQVESAHFDPSDQSVHYTIFIQSPNDKLIHSASRFWLESGINIETTGSGI
                190       200       210       220       230       240

                250       260       270       280       290       300
m154.pep KLNSAPLPALLSGAISFDSPKTKNSKNVKSEDSFTLYDSRSEVANLPDDRSLYYTAFFKQ
         ||||||||||||||||||||||||||||||||||||||||||||||||||||||||||||
a154     KLNSAPLPALLSGAISFDSPKTKNSKNVKSEDSFTLYDSRSEVANLPDDRSLYYTAFFKQ
                250       260       270       280       290       300

                310       320       330       340       350       360
m154.pep SVRGLTVGSPVEYKGLNVGVVSDVPYFDRNDSLHLFENGWIPVRIRIEPSRLEINADEQS
         ||||||||||||||||||||||||||||||||||||||||||||||||||||||||||||
a154     SVRGLTVGSPVEYKGLNVGVVSDVPYFDRNDSLHLFENGWIPVRIRIEPSRLEINADEQS
                310       320       330       340       350       360

                370       380       390       400       410       420
m154.pep KEHWKQQFQTALNKGLTATISSNNLLTGSKMIELNDQPSASPKLRPHTVYAGDTVIATQG
         ||||||||||||||||||||||||||||||||||||||||||||||||||||||||||||
a154     KEHWKQQFQTALNKGLTATISSNNLLTGSKMIELNDQPSASPKLRPHTVYAGDTVIATQG
                370       380       390       400       410       420

                430       440       450       460       470       480
m154.pep GGLDDLQVKLADLLDKFDKLPLDKTVAELNGSLAELKSTLKSANAALSSIDKLVGKPQTQ
         ||||||||||||||||||||||||||||||||||||||||||||||||||||||||||||
a154     GGLDDLQVKLADLLDKFDKLPLDKTVAELNGSLAELKSTLKSANAALSSIDKLVGKPQTQ
                430       440       450       460       470       480

                490       500       510       520       530       540
m154.pep NIPNELNQTLKELRTTLQGVSPQSPIYGDVQNTLQSLDKTLKDVQPVINTLKEKPNALIF
         ||||||||||||||||||||||||||||||||||||||||||||||||||||||||||||
a154     NIPNELNQTLKELRTTLQGVSPQSPIYGDVQNTLQSLDKTLKDVQPVINTLKEKPNALIF
                490       500       510       520       530       540

                550
m154.pep NSSSKDPIPKGSRX
         ||||||||||||||
a154     NSSSKDPIPKGSRX
                550
```

The following partial DNA sequence was identified in *N. gonorrhoeae* <SEQ ID 637>:

```
g155.seq
    1  atGAAaatcg GtatcCCACG CGAGTCAtta tcCGGCGAAA cccgcgtagc

   51  ctgcAcgccc gCCACCGTTG CCctgctggg caAactAGGC TTTGAAACCG

  101  TTGtcgaAAG CGGTGCAggt TTGGCGGCAA GTTTggaCGA TGCCGCTTAC

  151  CAAACAGCAG GCGCAACCGT TGCCGACAAA GCGGCGGTTT GGGCCTGCCC

  201  TTTAATTTAT AAGGTCAACG CGCCGTCCGA AGGCGAGCTG CCGCTGCTCA

  251  AAGAAGGTCA AACCATCGTC AGCTTCCTGT GGCCGCGCCA AAACGAGGCT

  301  TTGGTCGAGG CCTTGCGCGC CAAGAAAGTC AACGCGCTGG CGATGGACAT

  351  GGTTCCCCGC ATTTCCCGCG CTCAGGCCTT GGACGCTTTG TCTTCAATGG

  401  CAAACATCAG CGGCTACCGC GCCGTGATTG AAGCCGCCAA CGCCTTCGGC

  451  CGTTTCTTCA CCGGTCAAAT CACTGCCGCC GGCAAAGTGC CGCCTGCGCA

  501  GGTTTTGGTG ATTGGCGCCG GTGTGGCGGG TTTGGCGGCA ATCGGTACGG

  551  CAAATTCGCT CGGCGCAGTG GTGCGCGCGT TCGATACCCG CTTGGAAGTG

  601  GCGGAACAAA TCGAATCGAT GGGCGGTAAG TTcctGAAAC TCGACTTCCT

  651  GCAAGAATCG GGCGGCAGCG GAGACGgctA CGCCAAAGTG ATGAGCGACG

  701  AATTTATCGC CGCCGAAATG AAGCTCTTTG CCGAACAGGC GAAAGAAGTG

  751  GACATCATCA TCACCACCGC CGCCATTCCG GGCAAACCCG CTCCCAAGCT
```

-continued

```
 801 GATTACCAAA GAAATGGTGG AAAGCATGAA ATCCGGATCC GTCATCGTCG
 851 ATTTGGCGGC GACGGGCGGC AACTGCGAAC TCACCCGACC GGGCGAATTG
 901 TCCGTAACCG GCAACGGCGT GAAAATCATC GGCTACACCG ACATGGCAAA
 951 CCGCCTTGCC GGACAGTCTT CCCAGCTTTA CGCCACCAAC TTGGTGAACC
1001 TGACCAAGCT GTTAAGCCCG AACAAAGAcg gcgaAATCAC GCTGGACTTC
1051 GAAGacgtGA TTATCCGCAA TATGACCGTT ACCCGcgacg gcgaaATCAC
1101 CTTCCCGCCT CCGccgaTTc aggtTTCcgc ccggccgCAG CAAAcgccgt
1151 ctgaAAAagc cgcGCCTGCC GCCAagcccg AgccGaaacc tgttCCcctg
1201 tggaAAAaac tcgCGCCCGC CGCcatcgCC GCCGTATTGG tgctgtgGgt
1251 cggCgcggtc gcacccgcag CATTCTTGAA CCACTTTATC GTCTTCGTCC
1301 TCGCCTGCGT CATCGGCTAC CATGTCGTTT GgaacgTCAG CCACTCGCTG
1351 CACACACCGC TGAtgtcggt aaccaaCgcc atctccGGCA tcatggtcgt
1401 cggCGCGCTG CTGCAAATCG GTCAGGGcaa cggcttcgtT TCgctGCTGT
1451 CGTTTGTTGC CATCCTGATT GCCGGCATCA ATATCTTCGG CGGCTTTGCG
1501 GTTACACGGC GTATGCTGAA TATGTTTAAG AAAGGGTAA
```

This corresponds to the amino acid sequence <SEQ ID 638; ORF 155.ng>:

```
g155.pep
   1 MKIGIPRESL SGETRVACTP ATVALLGKLG FETVVESGAG LAASLDDAAY
  51 QTAGATVADK AAVWACPLIY KVNAPSEGEL PLLKEGQTIV SFLWPRQNEA
 101 LVEALRAKKV NALAMDMVPR ISRAQALDAL SSMANISGYR AVIEAANAFG
 151 RFFTGQITAA GKVPPAQVLV IGAGVAGLAA IGTANSLGAV VRAFDTRLEV
 201 AEQIESMGGK FLKLDFLQES GGSGDGYAKV MSDEFIAAEM KLFAEQAKEV
 251 DIIITTAAIP GKPAPKLITK EMVESMKSGS VIVDLAATGG NCELTRPGEL
 301 SVTGNGVKII GYTDMANRLA GQSSQLYATN LVNLTKLLSP NKDGEITLDF
 351 EDVIIRNMTV TRDGEITFPP PPIQVSARPQ QTPSEKAAPA AKPEPKPVPL
 401 WKKLAPAAIA AVLVLWVGAV APAAFLNHFI VFVLACVIGY HVVWNVSHSL
 451 HTPLMSVTNA ISGIMVVGAL LQIGQGNGFV SLLSFVAILI AGINIFGGFA
 501 VTRRMLNMFK KG*
```

The following partial DNA sequence was identified in *N. meningitidis* <SEQ ID 639>:

```
m155.seq
   1 ATGAAAATCG GTATCCCACG CGAGTCATTA TCCGGCGAAA CCCGCGTCGC
  51 CTGTACGCCC GCCACCGTCG CCCTGCTGGG CAAACTGGGC TTTGAAACCG
 101 TTGTCGAAAG CGGTGCAGGT TTGGCGGCAA GTTTGGACGA TGCCGCTTAC
 151 CAAACAGCAG GCGCAACCGT TGCCGACAAA GCGGCGGTTT GGGTCTGCCC
 201 TTTGATTTAT AAGGTCAACG CGCCGTCCGA ACAGGAACTG CCGCTTTTGA
 251 ACGAAGGTCA AACCATCGTC AGCTTCCTGT GGCCGCGCCA AAACGAGGCT
 301 TTGGTCGAAG CCTTGCGCGC CAAGAAAGTG AACGCGCTGG CGATGGATAT
 351 GGTGCCCCGC ATTTCGCGCG CGCAGGCTTT GGACGCTTTG TCTTCGATGG
```

-continued

```
 401 CAAACATCAG CGGCTACCGC GCCGTAATTG AAGCCGCCAA CGCCTTCGGC
 451 CGTTTCTTCA CCGGTCAAAT TACCGCCGCC GGCAAAGTGC CGCCCGCGCA
 501 GGTTTTGGTG ATTGGTGCAG GTGTGGCAGG TTTGGCGGCG ATCGGTACGG
 551 CAAACTCGCT CGGCGCAGTG GTACGCGCGT TCGATACCCG CTTGGAAGTG
 601 GCGGAACAAA TCGAATCGAT GGGCGGCAAG TTCCTGAAAC TCGACTTCCC
 651 ACAAGAATCG GGCGGCAGCG GAGACGGCTA CGCCAAAGTG ATGAGCGACG
 701 AATTTATCGC AGCCGAGATG AAGCTCTTTG CCGAGCAGGC GAAAGAAGTG
 751 GACATCATCA TCACCACCGC CGCCATTCCG GGCAAACCCG CGCCCAAGCT
 801 GATTACCAAA GAAATGGTGG AAAGCATGAA ATCCGGCTCC GTCATCGTCG
 851 ATTTGGCGGC GGCGACGGGC GGCAACTGCG AACTCACCCG CCCGGGCGAA
 901 TTGTCCGTAA CCGGCAACGG CGTGAAAATC ATCGGCTACA CCGACATGGC
 951 AAACCGCCTT GCCGGACAGT CTTCCCAGCT TTACGCCACC AACTTGGTCA
1001 ACCTGACCAA GCTGTTAAGC CCGAACAAAG ACGGCGAAAT CACGTTGGAC
1051 TTCGAAGACG TGATTATCCG CAACATGACC GTTACCCACG ACGGCGAAAT
1101 CACCTTCCCG CCTCCGCCGA TTCAAGTTTC CGCCCAGCCG CAGCAAACGC
1151 CGTCTGAAAA AGCCGTGCCT GCCGCCAAGC CCGAGCCAAA ACCCGTTCCC
1201 CTGTGGAAAA AACTCGCGCC CGCCGTCATC GCCGCCGTCT TGGTACTGTG
1251 GGTCGGCGCG GTCGCACCCG CAGCATTCCT GAACCACTTT ATCGTGTTCG
1301 TTCTCGCCTG CGTCATCGGC TACTACGTCG TCTGGAACGT CAGCCACTCG
1351 CTGCACACAC CGCTGATGTC GGTAACCAAC GCCATCTCCG GCATCATCGT
1401 CGTCGGCGCG CTGCTGCAAA TCGGTCAGGG CAACGGCTTC GTTTCGCTGC
1451 TGTCGTTTGT TGCCATCCTG ATTGCCGGCA TCAACATCTT CGGCGGCTTT
1501 GCGGTAACAC GGCGTATGCT GAATATGTTT AAGAAAGGGT AA
```

This corresponds to the amino acid sequence <SEQ ID 640; ORF 155>:

```
m155.pep
  1 MKIGIPRESL SGETRVACTP ATVALLGKLG FETVVESGAG LAASLDDAAY
 51 QTAGATVADK AAVWVCPLIY KVNAPSEQEL PLLNEGQTIV SFLWPRQNEA
101 LVEALRAKKV NALAMDMVPR ISRAQALDAL SSMANISGYR AVIEAANAFG
151 RFFTGQITAA GKVPPAQVLV IGAGVAGLAA IGTANSLGAV VRAFDTRLEV
201 AEQIESMGGK FLKLDFPQES GGSGDGYAKV MSDEFIAAEM KLFAEQAKEV
251 DIIITTAAIP GKPAPKLITK EMVESMKSGS VIVDLAAATG GNCELTRPGE
301 LSVTGNGVKI IGYTDMANRL AGQSSQLYAT NLVNLTKLLS PNKDGEITLD
351 FEDVIIRNMT VTHDGEITFP PPPIQVSAQP QQTPSEKAVP AAKPEPKPVP
401 LWKKLAPAVI AAVLVLWVGA VAPAAFLNHF IVFVLACVIG YYVVWNVSHS
451 LHTPLMSVTN AISGIIVVGA LLQIGQGNGF VSLLSFVAIL IAGINIFGGF
501 AVTRRMLNMF KKG*
```

Computer analysis of this amino acid sequence gave the following results:

Homology with a Predicted ORF from *N. gonorrhoeae*

ORF 155 shows 97.9% identity over a 513 aa overlap with a predicted ORF (ORF 155.ng) from *N. gonorrhoeae*:

```
m155/g155 97.9% identity in 513 aa overlap

                    10        20        30        40        50        60
m155.pep    MKIGIPRESLSGETRVACTPATVALLGKLGFETVVESGAGLAASLDDAAYQTAGATVADK
            ||||||||||||||||||||||||||||||||||||||||||||||||||||||||||||
g155        MKIGIPRESLSGETRVACTPATVALLGKLGFETVVESGAGLAASLDDAAYQTAGATVADK
                    10        20        30        40        50        60

                    70        80        90       100       110       120
m155.pep    AAVWVCPLIYKVNAPSEQELPLLNEGQTIVSFLWPRQNEALVEALRAKKVNALAMDMVPR
            ||||:||||||||||| |||||:|||||||||||||||||||||||||||||||||||||
g155        AAVWACPLIYKVNAPSEGELPLLKEGQTIVSFLWPRQNEALVEALRAKKVNALAMDMVPR
                    70        80        90       100       110       120

                   130       140       150       160       170       180
m155.pep    ISRAQALDALSSMANISGYRAVIEAANAFGRFFTGQITAAGKVPPAQVLVIGAGVAGLAA
            ||||||||||||||||||||||||||||||||||||||||||||||||||||||||||||
g155        ISRAQALDALSSMANISGYRAVIEAANAFGRFFTGQITAAGKVPPAQVLVIGAGVAGLAA
                   130       140       150       160       170       180

                   190       200       210       220       230       240
m155.pep    IGTANSLGAVVRAFDTRLEVAEQIESMGGKFLKLDFPQESGGSGDGYAKVMSDEFIAAEM
            |||||||||||||||||||||||||||||||||||| |||||||||||||||||||||||
g155        IGTANSLGAVVRAFDTRLEVAEQIESMGGKFLKLDFLQESGGSGDGYAKVMSDEFIAAEM
                   190       200       210       220       230       240

                   250       260       270       280       290       300
m155.pep    KLFAEQAKEVDIIITTAAIPGKPAPKLITKEMVESMKSGSVIVDLAAATGGNCELTRPGE
            ||||||||||||||||||||||||||||||||||||||||||||||| ||||||||||||
g155        KLFAEQAKEVDIIITTAAIPGKPAPKLITKEMVESMKSGSVIVDLAA-TGGNCELTRPGE
                   250       260       270       280       290

                   310       320       330       340       350       360
m155.pep    LSVTGNGVKIIGYTDMANRLAGQSSQLYATNLVNLTKLLSPNKDGEITLDFEDVIIRNMT
            ||||||||||||||||||||||||||||||||||||||||||||||||||||||||||||
g155        LSVTGNGVKIIGYTDMANRLAGQSSQLYATNLVLLTKLLSPNKDGEITLDFEDVIIRNMT
               300       310       320       330       340       350

                   370       380       390       400       410       420
m155.pep    VTHDGEITFPPPPIQVSAQPQQTPSEKAVPAAKPEPKPVPLWKKLAPAVIAAVLVLWVGA
            ||:|||||||||||||||:|||||||||:||||||||||||||||||||:||||||||||
g155        VTRDGEITFPPPPIQVSARPQQTPSEKAAPAAKPEPKPVPLWKKLAPAAIAAVLVLWVGA
               360       370       380       390       400       410

                   430       440       450       460       470       480
m155.pep    VAPAAFLNHFIVFVLACVIGYYVVWNVSHSLHTPLMSVTNAISGIIVVGALLQIGQGNGF
            ||||||||||||||||||||:|||||||||||||||||||||||:|||||||||||||||
g155        VAPAAFLNHFIVFVLACVIGYHVVWNVSHSLHTPLMSVTNAISGIMVVGALLQIGQGNGF
               420       430       440       450       460       470

                   490       500       510
m155.pep    VSLLSFVAILIAGINIFGGFAVTRRMLNMFKKGX
            ||||||||||||||||||||||||||||||||||
g155        VSLLSFVAILIAGINIFGGFAVTRRMLNMFKKGX
               480       490       500       510
```

The following partial DNA sequence was identified in *N. meningitidis* <SEQ ID 641>:

```
a155.seq
     1  ATGAAAATCG GTATCCCACG TGAGTCATTA TCCGGCGAAA CCCGCGTCGC
    51  CTGTACGCCC GCCACCGTCG CCCTGCTGGG CAAACTGGGC TTTGAAACCG
   101  TTGTCGAAAG CGGCGCAGGT TTGGCGGCAA GTTTGGACGA TGCCGCTTAC
   151  CAAGCAGCAG GCGCAACCGT TGCCGACAAA GCAGCGGTTT GGGCATACCC
   201  TTTAATTTAT AAGGTTAACG CGCCGTCCGA AGACGAGCTG CCGCTGCTCA
   251  AAGAAGGACA GACCATCGTC AGCTTCCTGT GGCCGCGCCA AAACGAGGCT
   301  TTGGTCGAAG CCTTGCGCGC CAAGAAAGTG AACGCGCTGG CAATGGACAT
   351  GGTGCCCCGC ATTTCGCGCG CGCAGGCTTT GGACGNTTTG TCTTNGATGG
   401  CAAACATCAG CGGCTACCGC GCCGTGATTG AAGCCGCCAA CGCCTTCGGC
```

-continued

```
 451 CGTTTNTTCA CCGGCCAAAT TACTGCCGCA GGCAAAGTGC CGCCCGCGCA

 501 GGTTTTGGTG ATTGGTGCAG GTGTGGCAGG TTTGGCGGCG ATCGGTACGG

 551 CAAACTCGCT CGGCGCAGTG GTACGCGTGT TCGATACCCG CCTG.AAGTG

 601 GCGGAACAAT TAGAATCGAT GGGCGGCAAG TTCCTGAAAC TCGACTTCCC

 651 GCAAGAATCG GGCGGCAGCG GCGACGGCTA CGCCAAAGTG ATGAGCGACG

 701 AATTTATCGC CGCCGAGATG AAGCTTTTTG CCGAGCAGGC GAAAGAAGTG

 751 GACATCATCA TCACCACCGC CGCCATTCCG GGCAAACCCG CGCCCAAGCN

 801 NNTNANCAAA GAAATGGTCG AAAGCATGAA ACCCGGCTCC GTCATCGTCG

 851 ATTTGGCGGC GGCGACGGGC GGCAACTGCG AACTCACCAA ACAGGGCGAA

 901 TTGTTCGTAA CCGGCAACGG CGTGAAAATC ATCGGCTACA CCGACATGGC

 951 AAACCGCCTT GCCGGACAGT CTTCGCAGCT TTACGCCACC AACTTGGTCA

1001 ACCTGACCAA GCTGTTAAGC CCGAACAAAG ACGGCGAAAT CACGCTGGAC

1051 TTCGAAGACG TGATTATCCG CAACATGACC GTTACCCGCG ACGGCGAAAT

1101 CACCTTCCCG CCTCCGCCGA TTCAAGTTTC CGCCCAACCG CAGCAAACGC

1151 CGTCTGAAAA AGCCGCGCCT GCCGCCAAGC CCGAACCGAA ACCCGTTCCC

1201 CTGTGGAAAA AACTCGCGCC CGCCNTNATC GCCGCCGTGT TGGTACTGTG

1251 GGTCGGCGCG GTCGCACCCG CAGCATTCCT GAACCACTTT ATCGTCTTCG

1301 TCCTCGCCTG CGTCATCGGC TACTATGTCG TTTGGAACGT CAGCCACTCG

1351 CTGCACACAC CGCTGATGTC GGTGACCAAC GCCATTTCCG GCATCATCGT

1401 CGTCGGCGCG CTGCTGCAAA TCGGTCAGGG CAACGGCTTC GTTTCGCTGC

1451 TGTCGTTTGT TGCCATCCTG ATTGCCAGCA TCAACATCTT CGGCGGCTTC

1501 TTTGTAACGC GGCGGATGCT GAATATGTTT AGGAAAGGGT AA
```

This corresponds to the amino acid sequence <SEQ ID 642; ORF 155.a>:

```
a155.pep

      1 MKIGIPRESL SGETRVACTP ATVALLGKLG FETVVESGAG LAASLDDAAY

     51 QAAGATVADK AAVWAYPLIY KVNAPSEDEL PLLKEGQTIV SFLWPRQNEA

    101 LVEALRAKKV NALAMDMVPR ISRAQALDXL SXMANISGYR AVIEAANAFG

    151 RXFTGQITAA GKVPPAQVLV IGAGVAGLAA IGTANSLGAV VRVFDTRLXV

    201 AEQLESMCCK FLKLDFPQES CCSCDCYAKV MSDEFIAAEM KLFAEQAKEV

    251 DIIITTAAIP GKPAPKXXXK EMVESMKPGS VIVDLAAATG GNCELTKQGE

    301 LFVTGNGVKI IGYTDMANRL AGQSSQLYAT NLVNLTKLLS PNKDGEITLD

    351 FEDVIIRNMT VTRDGEITFP PPIQVSAQP QQTPSEKAAP AAKPEPKPVP

    401 LWKKLAPAXI AAVLVLWVGA VAPAAFLNHF IVFVLACVIG YYVVWNVSHS

    451 LHTPLMSVTN AISGIIVVGA LLQIGQGNGF VSLLSFVAIL IASINIFGGF

    501 FVTRRMLNMF RKG*

m155/a155 95.3% identity in 513 aa overlap

                  10        20        30        40        50        60
m155.pep MKIGIPRESLSGETRVACTPATVALLGKLGFETVVESGAGLAASLDDAAYQTAGATVADK
         ||||||||||||||||||||||||||||||||||||||||||||||||||:||||||||
a155     MKIGIPRESLSGETRVACTPATVALLGKLGFETVVESGAGLAASLDDAAYQAAGATVADK
                  10        20        30        40        50        60
```

-continued

```
                   70        80        90       100       110       120
m155.pep AAVWVCPLIYKVNAPSEQELPLLNEGQTIVSFLWPRQNEALVEALRAKKVNALAMDMVPR
         ||||: |||||||||||:|||||:||||||||||||||||||||||||||||||||||||
a155     AAVWAYPLIYKVNAPSEDELPLLKEGQTIVSFLWPRQNEALVEALRAKKVNALAMDMVPR
                   70        80        90       100       110       120

                  130       140       150       160       170       180
m155.pep ISRAQALDALSSMANISGYRAVIEAANAFGRFFTGQITAAGKVPPAQVLVIGAGVAGLAA
         |||||||| || ||||||||||||||||||| ||||||||||||||||||||||||||||
a155     ISRAQALDXLSXMANISGYRAVIEAANAFGRXFTGQITAAGKVPPAQVLVIGAGVAGLAA
                  130       140       150       160       170       180

                  190       200       210       220       230       240
m155.pep IGTANSLGAVVRAFDTRLEVAEQIESMGGKFLKLDFPQESGGSGDGYAKVMSDEFIAAEM
         ||||||||||||:||||| ||||:||||||||||||||||||||||||||||||||||||
a155     IGTANSLGAVVRVFDTRLXVAEQLESMGGKFLKLDFPQESGGSGDGYAKVMSDEFIAAEM
                  190       200       210       220       230       240

                  250       260       270       280       290       300
m155.pep KLFAEQAKEVDIIITTAAIPGKPAPKLITKEMVESMKSGSVIVDLAAATGGNCELTRPGE
         ||||||||||||||||||||||||||   :||||||| ||||||||||||||||||: ||
a155     KLFAEQAKEVDIIITTAAIPGKPAPKXXXKEMVESMKPGSVIVDLAAATGGNCELTKQGE
                  250       260       270       280       290       300

                  310       320       330       340       350       360
m155.pep LSVTGNGVKIIGYTDMANRLAGQSSQLYATNLVNLTKLLSPNKDGEITLDFEDVIIRNMT
         | ||||||||||||||||||||||||||||||||||||||||||||||||||||||||||
a155     LFVTGNGVKIIGYTDMANRLAGQSSQLYATNLVNLTKLLSPNKDGEITLDFEDVIIRNMT
                  310       320       330       340       350       360

                  370       380       390       400       410       420
m155.pep VTHDGEITFPPPPIQVSAQPQQTPSEKAVPAAKPEPKPVPLWKKLAPAVIAAVLVLWVGA
         ||:|||||||||||||||||||||||||:||||||||||||||||||| |||||||||||
a155     VTRDGEITFPPPPIQVSAQPQQTPSEKAAPAAKPEPKPVPLWKKLAPAXIAAVLVLWVGA
                  370       380       390       400       410       420

                  430       440       450       460       470       480
m155.pep VAPAAFLNHFIVFVLACVIGYYVVWNVSHSLHTPLMSVTNAISGIIVVGALLQIGQGNGF
         ||||||||||||||||||||||||||||||||||||||||||||||||||||||||||||
g155     VAPAAFLNHFIVFVLACVIGYYVVWNVSHSLHTPLMSVTNAISGIIVVGALLQIGQGNGF
                  430       440       450       460       470       480

                  490       500       510
m155.pep VSLLSFVAILIAGINIFGGFAVTRRMLNMFKKGX
         ||||||||||||:||||||| |||||||||:|||
a155     VSLLSFVAILIASINIFGGFFVTRRMLNMFRKGX
                  490       500       510
```

The following partial DNA sequence was identified in *N. gonorrhoeae* <SEQ ID 643>:

```
g156.seq
    1  ATGACTTTCG CCTATTGGTG CATTCTGATT GCCTGCCTAT TGCCGCTTTT

   51  TTGTGCGGCG TATGCCAAAA AAGCGGGCGG ATTCCGGTTT AAAGACAACC

  101  ACAATCCTCG CGGTTTTCTG GCACATACGC AAGGCGCAGC CGCCCGTGCC

  151  CACGCCGCGC AGCAAAACGG TTTTGAAGCC TTTGCACCGT TTGCCGCCGC

  201  CGTTTTGACG GCACACGCAA CCGGCAATGC CGGACAAGCA ACCGTCAACA

  251  CGCTTGCCGG ATTGTTCATC CTGTTCCGCC TCGCCTTTAT CTGGTGCTAC

  301  ATCGCAGACA AAGCAGCATT GCGCTCGCTG ATGTGGGCGG GCGGATTTGC

  351  CTGCACCGTC GGACTGTTTG TCGCGGCTGC TTGA
```

This corresponds to the amino acid sequence <SEQ ID 644; ORF 156.ng>:

```
g156.pep
    1  MTFAYWCILI ACLLPLFCAA YAKKAGGFRF KDNHNPRGFL AHTQGAAARA

   51  HAAQQNGFEA FAPFAAAVLT AHATGNAGQA TVNTLAGLFI LFRLAFIWCY

  101  IADKAALRSL MWAGGFACTV GLFVAAA*
```

The following partial DNA sequence was identified in *N. meningitidis* <SEQ ID 645>:

```
m156.seq.
    1  ATGACTTTCG CCTATTGGTG TATTCTGATT GCCTGCCTAT TGCCGCTTTT

   51  TTGTGCGGCG TATGCCAAAA AAGCGGGCGG ATTCCGGTTT AAAGACAACC

  101  ACAATCCGCG CGGTTTTCTA GCGCACACGC AAGGCGCAGC CGCCCGTGCC

  151  CACGCCGCAC AGCAAAACGG TTTTGAAGCC TTTGCACCGT TTGCCGCCGC

  201  CGTTTTGACG GCACACGCAA CCGGCAATGC GGCGCAATCG ACCATCAACA

  251  CGCTTGCCTG CCTGTTCATC CTGTTCCGCC TCGCCTTTAT CTGGTGCTAT

  301  ATCGCCGACA AAGCCGCTAT GCGCTCACTG ATGTGGGCAG GCGGATTTGC

  351  CTGCACCGTC GGGCTGTTTG TCGCGGCTGC TTGA
```

This corresponds to the amino acid sequence <SEQ ID 646; ORF 156>:

```
m156.pep
    1  MTFAYWCILI ACLLPLFCAA YAKKAGGFRF KDNHNPRGFL AHTQGAAARA

   51  HAAQQNGFEA FAPFAAAVLT AHATGNAAQS TINTLACLFI LFRLAFIWCY

  101  IADKAAMRSL MWAGGFACTV GLFVAAA*
```

Computer analysis of this amino acid sequence gave the following results:

Homology with a Predicted ORF from *N. gonorrhoeae*

```
m156/g156 96.1% identity in 127 aa overlap

                    10        20        30        40        50        60
m156.pep  MTFAYWCILIACLLPLFCAAYAKKAGGFRFKDNHNPRGFLAHTQGAAARAHAAQQNGFEA
          |||||||||||||||| |||||||||||||||||||||||||||||||||||||||||||
g156      MTFAYWCILIACLLPLFCAAYAKKAGGFRFKDNHNPRGFLAHTQGAAARAHAAQQNGFEA
                    10        20        30        40        50        60

                    70        80        90       100       110       120
m156.pep  FAPFAAAVLTAHATGNAAQSTINTLACLFILFRLAFIWCYIADKAAMRSLMWAGGFACTV
          ||||||||||||||||:|:|:|||| ||||||||||||||||||||:|||||||||||||
g156      FAPFAAAVLTAHATGNAGQATVNTLAGLFILFRLAFIWCYIADKAALRSLMWAGGFACTV
                    70        80        90       100       110       120

m156.pep  GLFVAAAX
          ||||||||
g156      GLFVAAAX
```

The following partial DNA sequence was identified in *N. meningitidis* <SEQ ID 647>:

```
a156.seq
    1  ATGACTTTCG CCTATTGGTG TATTCTGATT GCCTACCTAT TGCCGCTTTT

   51  TTGTGCGGCG TATGCCAAAA AAGCGGGCGG ATTCCGGTTT AAAGACAACC

  101  ACAATCCGCG CGATTTTCTG GCGCGCACGC AAGGCACAGC CGCCCGTGCC

  151  CACGCCGCGC AGCAAAACGG TTTTGAAGCC TTTGCACCGT TTGCAGCCGC

  201  CGTTTTGACG GCACACGCAA CCGGCAATGC CGGACAAGCA ACCGTCAACA

  251  CGCTTGCCGG CCTGTTCATC CTGTTCCGCC TCGCCTTTAT CTGGTGCTAC

  301  ATCGCAGACA AAGCAGCATT ACGCTCGCTG ATGTGGGTGG GCGGATTTGT

  351  CTGCACCGTC GGGCTGTTTG TCGTGGCTGC TTGA
```

This corresponds to the amino acid sequence <SEQ ID 648; ORF 156.a>:

```
a156.pep

      1 MTFAYWCILI AYLLPLFCAA YAKKAGGFRF KDNHNPRDFL ARTQGTAARA

     51 HAAQQNGFEA FAPFAAAVLT AHATGNAGQA TVNTLAGLFI LFRLAFIWCY

    101 IADKAALRSL MWVGGFVCTV GLFVVAA*

m156/a156 90.6% identity in 127 aa overlap

                10        20        30        40        50        60
m156.pep MTFAYWCILIACLLPLFCAAYAKKAGGFRFKDNHNPRGFLAHTQGAAARAHAAQQNGFEA
         |||||||||| |||||||||||||||||||||||||| |||:|||:|||||||||||||
a156     MTFAYWCILIAYLLPLFCAAYAKKAGGFRFKDNHNPRDFLARTQGTAARAHAAQQNGFEA
                10        20        30        40        50        60
                70        80        90       100       110       120
m156.pep FAPFAAAVLTAHATGNAAQSTINTLACLFILFRLAFIWCYIADKAAMRSLMWAGGFACTV
         ||||||||||||||||:|:|:|||| ||||||||||||||||||:|||||:|||:|||
a156     FAPFAAAVLTAHATGNAGQATVNTLAGLFILFRLAFIWCYIADKAALRSLMWVGGFVCTV
                70        80        90       100       110       120

m156.pep GLFVAAAX
         ||||:|||
a156     GLFVVAAX
```

The following partial DNA sequence was identified in *N. gonorrhoeae* <SEQ ID 649>:

```
g157.seq
    1  atgaggaacg aggAAAAACg cgccctgcgc cgcgaattgC gCgGgcggcg

   51  ttcgcAAATg GGgcgagacg tGCGggCGGC GGCGgCgatA Aaaatcaacc

  101  gcctgctcaa aCGTtatatc AAGCGCggtc gGaAaatcgG CGTGTATTgg

  151  cCGATGGGCA AGGAATTGcg TTTGGGCGgc tTtgtcCGCG CGGCGCAAAA

  201  ACGCgGCGCA AAactctatc tgccttATAT CGAACCGCAC ACGCGGCGGA

  251  TGTGGTTTAC GCCGTATCCT GAACGCGGAA TGGAACGGGA ACGCAAGCGC

  301  GGTAGGGCGA AGCTGCATGT CCCTCAGTTT GCAGGGCGCA AAATCCGCGT

  351  GCACGGTTTG TCGGTATTGC TCGTCCCGCT TGTCGGCATA GACCGCGAAG

  401  GCTACCGTTT GGGGCAGGCA GGCGGCTATT ACGATGCGAC GCTTTCGGCG

  451  ATGAAATACC GTTTGCAGGC GAAAACCGTG GGCGTGGGCT TTGCCTGCCA

  501  GTTGGTGGAC AGGCTCCCAC GCGAGGCGCA CGACCTGCCG CTGGACGGTT

  551  TTGTATCGGA AGCGGGGATA TTGTGTTTTT AG
```

This corresponds to the amino acid sequence <SEQ ID 650; ORF 1 57.ng>:

```
g157.pep
    1  MRNEEKRALR RELRGRRSQM GRDVRAAAAI KINRLLKRYI KRGRKIGVYW

   51  PMGKELRLGG FVRAAQKRGA KLYLPYIEPH TRRMWFTPYP ERGMERERKR

  101  GRAKLHVPQF AGRKIRVHGL SVLLVPLVGI DREGYRLGQA GGYYDATLSA

  151  MKYRLQAKTV GVGFACQLVD RLPREAHDLP LDGFVSEAGI LCF*
```

The following partial DNA sequence was identified in *N. meningitidis* <SEQ ID 651>:

```
m157.seq
    1  ATGAGGAACG AGGAAAAACG CGCCCTGCGC CGCGAATTGC GCGGGCGGCG
```

-continued

```
 51  TTCGCAAATG GGGCGGGACG TGCGGGCGGC GGCAACGGTA AAAATCAACC

101  ACCTGCTCAA ACGTTATATT AAAAAAGGGC GGAAAATCGG CGTGTATTGG

151  CCGATGGGCA AGGAATTGCG TTTGGACGGC TTTGTCCGCG CGGCGCAAAA

201  ACGCGGTGCG GAACTCTACC TGCCTTATAT CGAACCGCGT TCGCGGCGGA

251  TGTGGTTTAC GCCGTATCCT GCCGATGGAG TAAAACAAGA ACGCAAGCGC

301  GGTAGGGCGA AGCTGCATGT CCCTCAGTTT GCAGGTCGGA AAAAGCGTGT

351  GCATGATTTG AACCTCCTGC TTGTGCCAGT GGTCGGTATG GACAGGCTGG

401  GCTACCGCTT GGGACAGGCA GGCGGCTATT ACGATGCGAC GCTTTCAGCG

451  ATGAAATACC GTTTGCAGGC AAAAACCGTG GGCGTGGGCT TTGCCTGCCA

501  GTTGGTGGAC AGGCTGCCGG TCGAGGCGCA CGACCGGTCT TTGGACGGTT

551  TTGTGTCGGA GGCGGGGATA TTGTGTTTTT AG
```

This corresponds to the amino acid sequence <SEQ ID 652; ORF 157>:

```
m157.pep
  1  MRNEEKRALR RELRGRRSQM GRDVRAAATV KINHLLKRYI KKGRKIGVYW

 51  PMGKELRLDG FVRAAQKRGA ELYLPYIEPR SRRMWFTPYP ADGVKQERKR

101  GRAKLHVPQF AGRKKRVHDL NLLLVPVVGM DRLGYRLGQA GGYYDATLSA

151  MKYRLQAKTV GVGFACQLVD RLPVEAHDRS LDGFVSEAGI LCF*
```

Computer analysis of this amino acid sequence gave the following results:

Homology with a Predicted ORF from *N. gonorrhoeae*

```
m157/g157 88.1% identity in 193 aa overlap

                 10        20        30        40        50        60
m157.pep MRNEEKRALRRELRGRRSQMGRDVRAAATVKINHLLKRYIKKGRKIGVYWPMGKELRLDG
         ||||||||||||||||||||||||||||::|||:|||||||:|||||||||||||||| |
g157     MRNEEKRALRRELRGRRSQMGRDVRAAAAIKINRLLKRYIKRGRKIGVYWPMGKELRLGG
                 10        20        30        40        50        60

                 70        80        90       100       110       120
m157.pep FVRAAQKRGAELYLPYIEPRSRRMWFTPYPADGVKQERKRGRAKLHVPQFAGRKKRVHDL
         ||||||||||:||||||||::|||||||||  |:::|||||||||||||||||| ||| |
g157     FVRAAQKRGAKLYLPYIEPHTRRMWFTPYPERGMERERKRGRAKLHVPQFAGRKIRVHGL
                 70        80        90       100       110       120

                130       140       150       160       170       180
m157.pep NLLLVPVVGMDRLGYRLGQAGGYYDATLSAMKYRLQAKTVGVGFACQLVDRLPVEAHDRS
         ::||||:||:|| |||||||||||||||||||||||||||||||||||||||| ||||
g157     SVLLVPLVGIDREGYRLGQAGGYYDATLSAMKYRLQAKTVGVGFACQLVDRLPREAHDLP
                130       140       150       160       170       180

                190
m157.pep LDGFVSEAGILCFX
         ||||||||||||||
g157     LDGFVSEAGILCFX
                190
```

The following partial DNA sequence was identified in *N. meningitidis* <SEQ ID 653>:

```
a157.seq
  1  ATGAGGAACG AGGAAAAACA CGCCTTGCGC CGAGAGTTGC GCCGCGCCCG

 51  CGCGCAGATG GGGCATCAAG GGCGGTTGGC GGCGGGGCAA ACGATTAACC

101  GCCTGCTCAA ACGTTATATC AAGCGTGGTC GGAAAATCGG CGTGTATTGG

151  CCGATGGGCA AGGAATTGCG TTTGGACGGC TTTGTCCGCG CGGCGCAAAA
```

-continued

```
201  ACGCGGTGCA AAACTTTATC TGCCTTATAT CGAACCGCGT TCGCGGCGGA

251  TGTGGTTTAC GCCGTATCCT GAAAGCGGAA TGGAACGGGA GCGCATACGG

301  GGCAGGGCGA AGTTGAACGT GCCGCAGTTT GCAGGGCGCA AAATCCGCGT

351  GCACGGTTTG TCGGTATTGC TCGTCCCGCT TGTCGGCATA GACCGCGAGG

401  GCTACCGCTT AGGACAGGCA GGCGGCTATT ACGATGCGAC GCTTGCGGCG

451  ATGAAATACC GTTTGCAGGC AAAAACCGTG GGCGTGGGCT TTGCCTGCCA

501  GTTTGTGGAC AGGCTGCCGC GCGAACCGCA CGATCTGCTG CTGGACGGTT

551  TTGTGTCGGA GGCGGGGATA TTGTGCTTTT AG
```

This corresponds to the amino acid sequence <SEQ ID 654; ORF 157.a>:

```
a157.pep

      1 MRNEEKHALR RELRRARAQM GHQGRLAAGQ TINRLLKRYI KRGRKIGVYW

     51 PMGKELRLDG FVRAAQKRGA KLYLPYIEPR SRRMWFTPYP ESGMERERIR

    101 GRAKLNVPQF AGRKIRVHGL SVLLVPLVGI DREGYRLGQA GGYYDATLAA

    151 MKYRLQAKTV GVGFACQFVD RLPREPHDLL LDGFVSEAGI LCF*

m157/a157 82.4% identity in 193 aa overlap

                 10        20        30        40        50        60
m157.pep MRNEEKRALRRELRGRRSQMGRDVRAAATVKINHLLKRYIKKGRKIGVYWPMGKELRLDG
         ||||||:|||||||  |:|||:: | ||   ||:|||||||:||||||||||||||||||
a157     MRNEEKHALRRELRRARAQMGHQGRLAAGQTINRLLKRYIKRGRKIGVYWPMGKELRLDG
                 10        20        30        40        50        60

                 70        80        90       100       110       120
m157.pep FVRAAQKRGAELYLPYIEPRSRRMWFTPYPADGVKQERKRGRAKLHVPQFAGRKKRVHDL
         ||||||||||:||||||||||||||||||| :|:::|| ||||||:|||||||| ||| |
a157     FVRAAQKRGAKLYLPYIEPRSRRMWFTPYPESGMERERIRGRAKLNVPQFAGRKIRVHGL
                 70        80        90       100       110       120

                130       140       150       160       170       180
m157.pep NLLLVPVVGMDRLGYRLGQAGGYYDATLSAMKYRLQAKTVGVGFACQLVDRLPVEAHDRS
         ::||||:||:|| |||||||||||||||:||||||||||||||||||:| ||| | ||
a157     SVLLVPLVGIDREGYRLGQAGGYYDATLAAMKYRLQAKTVGVGFACQFVDRLPREPHDLL
                130       140       150       160       170       180

                190
m157.pep LDGFVSEAGILCFX
         ||||||||||||||
a157     LDGFVSEAGILCFX
                190
```

The following partial DNA sequence was identified in *N. gonorrhoeae* <SEQ ID 655>:

```
g158.seq
   1 ATGAAAACCA ATTCAGAAGA ACTGACCGTA TTTGTTCAAG TGGTGGAAAG

  51 CGGCAGCTTC AGCCGTGCGG CGgagcAGTT GGAGAtggCA AATTCTGCCG

 101 TAAGCCGCAT CGTCAAACGG CTGGAGGAAA AGTTGGGCGT GAAcCTGCtc

 151 aACCGCACCA CGCGGCAACT CAATCTGACG GAAGAAGGCG CGCAATATTT

 201 CCGCCGCGCG CAGAGAATCC TGCAAGAAAT GGCAGCGGCG GAAACCGAAA

 251 TGCTGGCAGT GCACGAAGTA CCGCAAGGCG TGTTGCGCGT GGATTCCGCG

 301 ATGCcgatgg TGCTGCATCT GCTGGCGCCG CTGGCAGCAA AATTCAACGA

 351 ACGCTATCCG CATATCcgaC TTTCGCTCGT TTCTTCCGAa ggctatatca

 401 atctGattGA Acgcaaagtc gAtatTGCCT TACGGGCCGG AGAATTGGAC

 451 GATTCCGGGC TGCGTGCACG CCATCTGTTT GACAGCCACT TCCGCGtagt
```

-continued

```
501 cgCCAGTCCT GAATATTTAG CAAAACACGG CACGCCACAA TCTGCAGAAG

551 atcTTGCCAA CCATCAATGT TTAGGCTTCA CAGAACCCGG TTCTCTAAAT

601 ACATGGGCGG TTTTAGAtgC GCAGGGAAAT CCCTATAAAA TTTCACCGCA

651 CTTTACCGCC AGCAGCGGTG AAATCTTACG CTCGTTGTGC CTTTCAAGtt

701 gCGGTATTGC TTGCTTATCA GATTTTTTGG TTGACAACGA CATCACTGAA

751 GGAAAGTTAA TTCCcctatt cgCCGAACAA ACCTCCAATA AAACACACCC

801 CTTTAATGCT GTTTATTACA GCGATAAAGC CGTCAACCTC CGCTTACGCG

851 TATTTTTGGA TTTTTTAGTG AAGGAACTGG GAAAAAATAT GAATAGAACG

901 AATACCAAAT AA
```

This corresponds to the amino acid sequence <SEQ ID 656; ORF 158.ng>:

```
g158.pep
  1 MKTNSEELTV FVQVVESGSF SRAAEQLEMA NSAVSRIVKR LEEKLGVNLL

 51 NRTTRQLNLT EEGAQYFRRA QRILQEMAAA ETEMLAVHEV PQGVLRVDSA

101 MPMVLHLLAP LAAKFNERYP HIRLSLVSSE GYINLIERKV DIALRAGELD

151 DSGLRARHLF DSHFRVVASP EYLAKHGTPQ SAEDLANHQC LGFTEPGSLN

201 TWAVLDAQGN PYKISPHFTA SSGEILRSLC LSSCGIACLS DFLVDNDITE

251 GKLIPLFAEQ TSNKTHPFNA VYYSDKAVNL RLRVFLDFLV KELGKNMNRT

301 NTK*
```

The following partial DNA sequence was identified in *N. meningitidis* <SEQ ID 657>:

```
m158.seq
  1 ATGAAAACCA ATTCAGAAGA ACTGACCGTA TTTGTTCAAG TGGTGGAAAG

 51 CGGCAGCTTC AGCCGTGCGG CGGAGCAGTT GGCGATGGCA AATTCTGCCG

101 TAAGCCGCAT CGTCAAACGG CTGGAGGAAA AGTTGGGTGT GAACCTGCTC

151 AACCGCACCA CGCGGCAACT CAGTCTGACG GAAGAAGGCG CGCAATATTT

201 CCGCCGCGCG CAGAGAATCC TGCAAGAAAT GGCAGCGGCG GAAACCGAAA

251 TGCTGGCAGT GCACGAAATA CCGCAAGGCG TGTTGAGCGT GGATTCCGCG

301 ATGCCGATGG TGCTGCATCT GCTGGCGCCG CTGGCAGCAA AATTCAACGA

351 ACGCTATCCG CATATCCGAC TTTCGCTCGT TTCTTCCGAA GGCTATATCA

401 ATCTGATTGA ACGCAAAGTC GATATTGCCT TACGGGCCGG AGAATTGGAC

451 GATTCCGGGC TGCGTGCACG CCATCTGTTT GACAGCCGCT TCCGCGTAAT

501 CGCCAGTCCT GAATACCTGG CAAAACACGG CACGCCGCAA TCTACAGAAG

551 AGCTTGCCGG CCACCAATGT TTAGGCTTCA CCGAACCCGG TTCTCTAAAT

601 ACATGGGCGG TTTTAGATGC GCAGGGAAAT CCCTATAAGA TTTCACCGCA

651 CTTTACCGCC AGCAGCGGTG AAATCTTACG CTCGTTGTGC CTTTCAGGTT

701 GCGGTATTGT TTGCTTATCA GATTTTTTGG TTGACAACGA CATCGCTGAA

751 GGAAAGTTAA TTCCCCTGCT CGCCGAACAA ACCTCCGATA AAACACACCC

801 CTTTAATGCT GTTTATTACA GCGATAAAGC CGTCAATCTC CGCTTACGCG

851 TATTTTTGGA TTTTTTAGTG GAGGAACTGG GAAACAATCT CTGTGGATAA
```

This corresponds to the amino acid sequence <SEQ ID 658; ORF 158>:

```
m158.pep
  1 MKTNSEELTV FVQVVESGSF SRAAEQLAMA NSAVSRIVKR LEEKLGVNLL

 51 NRTTRQLSLT EEGAQYFRRA QRILQEMAAA ETEMLAVHEI PQGVLSVDSA

101 MPMVLHLLAP LAAKFNERYP HIRLSLVSSE GYINLIERKV DIALRAGELD

151 DSGLRARHLF DSRFRVIASP EYLAKHGTPQ STEELAGHQC LGFTEPGSLN

201 TWAVLDAQGN PYKISPHFTA SSGEILRSLC LSGCGIVCLS DFLVDNDIAE

251 GKLIPLLAEQ TSDKTHPFNA VYYSDKAVNL RLRVFLDFLV EELGNNLCG*
```

Computer analysis of this amino acid sequence gave the following results:

Homology with a Predicted ORF from *N. gonorrhoeae*

```
m158/g158 94.3% identity in 297 aa overlap

                    10        20        30        40        50        60
m158.pep    MKTNSEELTVFVQVVESGSFSRAAEQLAMANSAVSRIVKRLEEKLGVNLLNRTTRQLSLT
            |||||||||||||||||||||||||||| ||||||||||||||||||||||||||||:||
g158        MKTNSEELTVFVQVVESGSFSRAAEQLEMANSAVSRIVKRLEEKLGVNLLNRTTRQLNLT
                    10        20        30        40        50        60

                    70        80        90       100       110       120
m158.pep    EECAQYFRRAQRILQEMAAAETEMLAVHEIPQCVLSVDSAMPMVLHLLAPLAAKFNERYP
            |||||||||||||||||||||||||||||:||||| ||||||||||||||||||||||||
g158        EEGAQYFRRAQRILQEMAAAETEMLAVHEVPQGVLRVDSAMPMVLHLLAPLAAKFNERYP
                    70        80        90       100       110       120

                   130       140       150       160       170       180
m158.pep    HIRLSLVSSEGYINLIERKVDIALRAGELDDSGLRARHLFDSRFRVIASPEYLAKHGTPQ
            |||||||||||||||||||||||||||||||||||||||||:|||:||||||||||||||
g158        HIRLSLVSSEGYINLIERKVDIALRAGELDDSGLRARHLFDSHFRVVASPEYLAKHGTPQ
                   130       140       150       160       170       180

                   190       200       210       220       230       240
m158.pep    STEELAGHQCLGFTEPGSLNTWAVLDAQGNPYKISPHFTASSGEILRSLCLSGCGIVCLS
            |:|:||:|||||||||||||||||||||||||||||||||||||||||||||:|||:|||
g158        SAEDLANHQCLGFTEPGSLNTWAVLDAQGNPYKISPHFTASSGEILRSLCLSSCGIACLS
                   190       200       210       220       230       240

                   250       260       270       280       290       300
m158.pep    DFLVDNDIAEGKLIPLLAEQTSDKTHPFNAVYYSDKAVNLRLRVFLDFLVEELGNNLCGX
            ||||||||:|||||||:|||||:|||||||||||||||||||||||||||:|||:|:
g158        DFLVDNDITEGKLIPLFAEQTSNKTHPFNAVYYSDKAVNLRLRVFLDFLVKELGKNMNRT
                   250       260       270       280       290       300

g158        NTKX
```

The following partial DNA sequence was identified in *N. meningitidis* <SEQ ID 659>:

```
a158.seq
  1 ATGAAAACCA ATTCAGAAGA ACTGACCGTA TTTGTTCAAG TGGTGGAAAG

 51 CGGCAGCTTC AGCCGTGCGG CGGAGCAGTT GGCGATGGCA AATTCTGCCG

101 TAAGCCGCAT CGTCAAACGG CTGGAGGAAA AGTTGGGTGT GAACCTGCTC

151 AACCGCACCA CGCGGCAACT CAGTCTGACG GAAGAAGGCG CGCAATATTT

201 CCGCCGCGCG CAGAGAATCC TGCAAGAAAT GGCAGCGGCG GAAACCGAAA

251 TGCTGGCAGT GCACGAAATA CCGCAAGGCG TGTTGCGCGT GGATTCCGCG

301 ATGCCGATGG TGCTGCATCT GCTGGCGCCG CTGGCAGCAA AATTCAACGA

351 ACGCTATCCG CATATCCGAC TTTCGCTCGT TTCTTCCGAA GGCTATATCA

401 ATCTGATTGA ACGCAAAGTC GATATTGCCT TACGGGCCGG AGAATTGGAC

451 GATTCCGGGC TGCGTGCACG CCATCTGTTT GACAGCCGCT TCCGCGTAAT

501 CGCCAGTCCT GAATACCTGG CAAAACACGG CACGCCGCAA TCTACAGAAG
```

-continued

```
551 AGCTTGCCGG CCACCAATGT TTAGGCTTCA CCGAACCCGG TTCTCTAAAT

601 ACATGGGCGG TTTTAGATGC GCAGGGAAAT CCCTATAAGA TTTCACCGCA

651 CTTTACCGCC AGCAGCGGTG AAATCTTACG CTCGTTGTGC CTTTCAGGTT

701 GCGGTATTGC TTGCTTATCA GATTTTTTGG TTGACAACGA CATCGCTGAA

751 GGAAAGTTAA TTCCCCTGCT CGCCGAACAA ACCTCCAATA AAACGCACCC

801 CTTTAATGCT GTTTATTACA GCGATAAAGC CGTCAACCTC CGCTTACGCG

851 TATTTTTGGA TTTTTTAGTG GAGGAACTGG GAAACAATCT CTGTGGATAA
```

This corresponds to the amino acid sequence <SEQ ID 660; ORF 158.a>:

```
a158.pep
      1 MKTNSEELTV FVQVVESCSF SRAAEQLAMA NSAVSRIVKR LEEKLCVNLL

     51 NRTTRQLSLT EEGAQYFRRA QRILQEMAAA ETEMLAVHEI PQGVLRVDSA

    101 MPMVLHLLAP LAAKFNERYP HIRLSLVSSE GYINLIERKV DIALRAGELD

    151 DSGLRARHLF DSRFRVIASP EYLAKHGTPQ STEELAGHQC LGFTEPGSLN

    201 TWAVLDAQGN PYKISPHFTA SSGEILRSLC LSGGGIACLS DFLVDNDIAE

    251 GKLIPLLAEQ TSNKTHPFNA VYYSDKAVNL RLRVFLDFLV EELGNNLCG*

m158/a158 99.0% identity in 299 aa overlap

                   10        20        30        40        50        60
m158.pep    MKTNSEELTVFVQVVESGSFSRAAEQLAMANSAVSRIVKRLEEKLGVNLLNRTTRQLSLT
            ||||||||||||||||||||||||||||||||||||||||||||||||||||||||||||
a158        MKTNSEELTVFVQVVESGSFSRAAEQLAMANSAVSRIVKRLEEKLGVNLLNRTTRQLSLT
                   10        20        30        40        50        60

                   70        80        90       100       110       120
m158.pep    EEGAQYFRRAQRILQEMAAAETEMLAVHEIPQGVLSVDSAMPMVLHLLAPLAAKFNERYP
            ||||||||||||||||||||||||||||||||||| ||||||||||||||||||||||||
a158        EEGAQYFRRAQRILQEMAAAETEMLAVHEIPQGVLRVDSAMPMVLHLLAPLAAKFNERYP
                   70        80        90       100       110       120

                  130       140       150       160       170       180
m158.pep    HIRLSLVSSEGYINLIERKVDIALRAGELDDSGLRARHLFDSRFRVIASPEYLAKHGTPQ
            ||||||||||||||||||||||||||||||||||||||||||||||||||||||||||||
a158        HIRLSLVSSEGYINLIERKVDIALRAGELDDSGLRARHLFDSRFRVIASPEYLAKHGTPQ
                  130       140       150       160       170       180

                  190       200       210       220       230       240
m158.pep    STEELAGHQCLGFTEPGSLNTWAVLDAQGNPYKISPHFTASSGEILRSLCLSGCGIVCLS
            ||||||||||||||||||||||||||||||||||||||||||||||||||||||||:|||
a158        STEELAGHQCLGFTEPGSLNTWAVLDAQGNPYKISPHFTASSGEILRSLCLSGCGIACLS
                  190       200       210       220       230       240

                  250       260       270       280       290       300
m158.pep    DFLVDNDIAEGKLIPLLAEQTSDKTHPFNAVYYSDKAVNLRLRVFLDFLVEELGNNLCGX
            ||||||||||||||||||||||:|||||||||||||||||||||||||||||||||||||
a158        DFLVDNDIAEGKLIPLLAEQTSNKTHPFNAVYYSDKAVNLRLRVFLDFLVEELGNNLCGX
                  250       260       270       280       290       300
```

The following partial DNA sequence was identified in *N. gonorrhoeae* <SEQ ID 661>:

```
g160.seq
  1 ATGGAcattc tgGACAAact ggtcgatCTC GCccaATTGA CGGGCAGTGC

 51 GGATGTGCAG TgcctTTTGG GCGGACAATG gcATGaaacc TTGCAACGCG

101 AAGGGCTGGT ACACATTGTT ACGGCGGGCA GCGGTTATCT CTGCATCGAC

151 GGCGAAACTT CCCCGCGTCC GGTCGGCACG GGCGATATTG TATTTTTCCC

201 GCGCGGCTTG GGTCATGTGT TGAGCCACGA CGGAAAATAC GGAGAAAGTT

251 TACAACCGGA CATACGACAA AACGGCACAT TTATGGTCAA ACAGTGCGGC
```

-continued

```
301 AACGGGCTGG ATATGAGCCT GTTTTGCGCC CGTTTCCGCT ACGACACCCA

351 CGCCGATTTG ATGAACGGGC TGCCGGAAAC CGTTTTTCTG AACATTGCCC

401 ATCCAAGTTT GCAGTATGTG GTTTCAATGC TGCAACTGGA AAGCGAAAAA

451 CCTTTGACGG GGACGGTTTC CGTGGTCAAC GCATTACCGT CCGTCCTGCT

501 GGTGCTTATC CTGCGCGCCT ATCTCGAACA GGATAAGGAT GTCGAACTCT

551 CGGGCGTATT GAAAGGTTGG CAGGACAAAC GTTTGGGACA TTTGATCCAA

601 AAGGTGATAG ACAAACCGGA AGACGAATGG AATATTGACA AAATGGTTGC

651 CGCCGCCAAT ATGTCGCGCG CGCAACTGAT GCGCCGCTTC AAAAGCCAAG

701 TCGGACTCAG CCCGCACGCC TTTGTGAACC ATATCCGCCT GCAAAAAGGC

751 GCATTGCTGC TGAAGAAAAC CCCGGATTCG GTTTTGGAGG TCGCGCTGTC

801 GGTGGGCTTT CAGTCGGAAA CGCATTTCGG CAAGGCGTTC AAACGGCAAT

851 ATCACGTTTC GCCGGGGCAA TACCGGAAAG AAGGCGGGCA AAAATAA
```

This corresponds to the amino acid sequence <SEQ ID 662; ORF 160.ng>:

```
g160.pep
  1 MDILDKLVDL AQLTGSADVQ CLLGGQWHET LQREGLVHIV TAGSGYLCID

 51 GETSPRPVGT GDIVFFPRGL GHVLSHDGKY GESLQPDIRQ NGTFMVKQCG

101 NGLDMSLFCA RFRYDTHADL MNGLPETVFL NIAHPSLQYV VSMLQLESEK

151 PLTGTVSVVN ALPSVLLVLI LRAYLEQDKD VELSGVLKGW QDKRLGHLIQ

201 KVIDKPEDEW NIDKMVAAAN MSRAQLMRRF KSQVGLSPHA FVNHIRLQKG

251 ALLLKKTPDS VLEVALSVGF QSETHFGKAF KRQYHVSPGQ YRKEGGQK*
```

The following partial DNA sequence was identified in *N. meningitidis* <SEQ ID 663>:

```
m160.seq
  1 ATGGACATTC TGGACAAACT GGTCGATTTC GCCCAATTGA CGGGCAGTGT

 51 GGATGTGCAG TGCCTTTTGG GCGGACAATG GTCGGTACGG CATGAAACCT

101 TGCAACGCGA AGGATTGGTA CACATTGTTA CATCGGGCAG CGGCTATCTC

151 TGCATCGACG GCGAAACTTC CCCGCGTCCG GTCAGTACAG GGGATATTGT

201 ATTTTTCCCG CGCGGCTTGG GTCATGTGTT GAGCCACGAC GGAAAATGCG

251 GAGAAAGTTT ACAACCGGAT ATGCGGCAGC ACGGTGCGTT TACGGTCAAG

301 CAGTGCGGCA ACGGACAGGA TATGAGCCTG TTTTGCGCCC GTTTCCGCTA

351 CGACACCCAC GCCGATTTGA TGAACGGGCT GCCTGAAACC GTTTTTCTGA

401 ACATTGCCCA TCCGAGTTTA CAGTATGTGG TTTCAATGCT GCAACTGGAA

451 AGCAAAAAAC CTTTGACGGG GACGGTTTCC ATGGTCAACG CATTGTCGTC

501 CGTCCTGCTG GTGCTTATCC TGCGCGCCTA TCTCGAACAG GATAAGGATG

551 TCGAACTCTC GGGCGTATTG AAAGGTTGGC AGGACAAACG TTTGGGACAT

601 TTAATCCAAA AGGTGATAGA CAAACCGGAA GACGAATGGA ATGTCGACAA

651 AATGGTGGCG GCTGCCAATA TGTCGCGCGC GCAACTGATG CGCCGTTTCA

701 AAAGCCGGGT CGGACTCAGC CCGCACGCCT TTGTGAACCA TATCCGCCTG

751 CAAAAAGGCG CGTTGCTGCT GAAAAAAAAC CCGGATTCGG TTTTGTCGGT
```

-continued

```
801 CGCACTGTCG GTAGGCTTTC AGTCGGAAAC GCACTTCGGC AAGGCGTTCA

851 AACGGCAATA TCACGTTTCG CCGGGTCAAT ACCGGAAAGA AggCGGGCAA

901 AAATAA
```

This corresponds to the amino acid sequence <SEQ ID 664; ORF 160>:

```
m160.pep
   1 MDILDKLVDF AQLTGSVDVQ CLLGGQWSVR HETLQREGLV HIVTSGSGYL

  51 CIDGETSPRP VSTGDIVFFP RGLGHVLSHD GKCGESLQPD MRQHGAFTVK

 101 QCGNGQDMSL FCARFRYDTH ADLMNGLPET VFLNIAHPSL QYVVSMLQLE

 151 SKKPLTGTVS MVNALSSVLL VLILRAYLEQ DKDVELSGVL KGWQDKRLGH

 201 LIQKVIDKPE DEWNVDKMVA AANMSRAQLM RRFKSRVGLS PHAFVNHIRL

 251 QKGALLLKKN PDSVLSVALS VGFQSETHFG KAFKRQYHVS PGQYRKEGGQ

 301 K*
```

Computer analysis of this amino acid sequence gave the following results:

Homology with a Predicted ORF from *N. gonorrhoeae*

```
m160/g160     93.4% identity in 301 aa overlap

                        10        20        30        40        50        60
m160.pep      MDILDKLVDFAQLTGSVDVQCLLGGQWSVRHETLQREGLVHIVTSGSGYLCIDGETSPRP
              ||||||||:||||||:||||||||||   |||||||||||||:||||||||||||||||
g160          MDILDKLVDLAQLTGSADVQCLLGGQW---HETLQREGLVHIVTAGSGYLCIDGETSPRP
                        10        20           30        40        50

                        70        80        90       100       110       120
m160.pep      VSTGDIVFFPRGLGHVLSHDGKCGESLQPDMRQHGAFTVKQCGNGQDMSLFCARFRYDTH
              |:||||||||||||||||||| ||||||:||:|:| |||||| |||||||||||||
g160          VGTGDIVFFPRGLGHVLSHDGKYGESLQPDIRQNGTFMVKQCGNGLDMSLFCARFRYDTH
               60        70        80        90       100       110

                       130       140       150       160       170       180
m160.pep      ADLMNGLPETVFLNIAHPSLQYVVSMLQLESKKPLTGTVSMVNALSSVLLVLILRAYLEQ
              ||||||||||||||||||||||||||||||:||||||||:|||| |||||||||||||
g160          ADLMNGLPETVFLNIAHPSLQYVVSMLQLESEKPLTGTVSVVNALPSVLLVLILRAYLEQ
              120       130       140       150       160       170

                       190       200       210       220       230       240
m160.pep      DKDVELSGVLKGWQDKRLGHLIQKVIDKPEDEWNVDKMVAAANMSRAQLMRRFKSRVGLS
              |||||||||||||||||||||||||||||||||:|||||||||||||||||||:||||
g160          DKDVELSGVLKGWQDKRLGHLIQKVIDKPEDEWNIDKMVAAANMSRAQLMRRFKSQVGLS
              180       190       200       210       220       230

                       250       260       270       280       290       300
m160.pep      PHAFVNHIRLQKGALLLKKNPDSVLSVALSVGFQSETHFGKAFKRQYHVSPGQYRKEGGQ
              |||||||||||||||||:||||| ||||||||||||||||||||||||||||||||||
g160          PHAFVNHIRLQKGALLLKKTPDSVLEVALSVGFQSETHFGKAFKRQYHVSPGQYRKEGGQ
              240       250       260       270       280       290

m160.pep      KX
              ||
g160          KX
```

The following partial DNA sequence was identified in *N. meningitidis* <SEQ ID 665>:

```
a160.seq
   1 ATGGACATTC TGGACAAACT GGTCGATTTC GCCCAATTGA CGGGCAGTGT

  51 GGATGTGCAG TGCCTTTTGG GCGGACAATG GTCGGTACGG CATGAAACCT

 101 TGCAACGCGA AGGATTGGTA CACATTGTTA CATCGGGCAG CGGCTATCTC

 151 TGCATCGACG GCGAAACTTC CCCGCGTCCG GTCAGTACAG GGGATATTGT

 201 ATTTTTCCCG CGCGGCTTGG GTCATGTGTT GAGCCACGAC GGAAAATGCG
```

-continued

```
251 GAGAAAGTTT ACAACCGGAT ATGCGGCAGC ACGGTGCGTT TACGGTCAAG

301 CAGTGCGGCA ACGGACAGGA TATGAGCCTG TTTTGCGCCC GTTTCCGCTA

351 CGACACCCAC GCCGATTTGA TGAACGGGCT GCCTGAAACC GTTTTTCTGA

401 ACATTGCCCA TCCGAGTTTA CAGTATGTGG TTTCAATGCT GCAACTGGAA

451 AGCAAAAAAC CTTTGACGGG GACGGTTTCC ATGGTCAACG CATTGTCGTC

501 CGTCCTGCTG GTGCTTATCC TGCGCGCCTA TCTCGAACAG GATAAGGATG

551 TCGAACTCTC GGGCGTATTG AAAGGTTGGC AGGACAAACG TTTGGGACAT

601 TTAATCCAAA AGGTGATAGA CAAACCGGAA GACGAATGGA ATGTCGACAA

651 AATGGTGGCG GCTGCCAATA TGTCGCGCGC GCAACTGATG CGCCGTTTCA

701 AAAGCCGGGT CGGACTCAGC CCGCACGCCT TTGTGAACCA TATCCGCCTG

751 CAAAAAGGCG CGTTGCTGCT GAAAAAAAAC CCGGATTCGG TTTTGTCGGT

801 CGCACTGTCG GTAGGCTTTC AGTCGGAAAC GCACTTCGGC AAGGCGTTCA

851 AACGGCAATA TCACGTTTCG CCGGGTCAAT ACCGGAAAGA AGGCGGGCAA

901 AAATAA
```

This corresponds to the amino acid sequence <SEQ ID 666; ORF 160.a>:

```
a160.pep
      1 MDILDKLVDF AQLTGSVDVQ CLLGGQWSVR HETLQREGLV HIVTSGSGYL

     51 CIDGETSPRP VSTGDIVFFP RGLGHVLSHD GKCGESLQPD MRQHGAFTVK

    101 QCGNGQDMSL FCARFRYDTH ADLMNGLPET VFLNIAHPSL QYVVSMLQLE

    151 SKKPLTGTVS MVNALSSVLL VLILRAYLEQ DKDVELSGVL KGWQDKRLGH

    201 LIQKVIDKPE DEWNVDKMVA AANMSRAQLM RRFKSRVGLS PHAFVNHIRL

    251 QKGALLLKKN PDSVLSVALS VGFQSETHFG KAFKRQYHVS PGQYRKEGGQ

    301 K*

m160/a160    100.0% identity in 301 aa overlap

                     10        20        30        40        50        60
m160.pep     MDILDKLVDFAQLTGSVDVQCLLGGQWSVRHETLQREGLVHIVTSGSGYLCIDGETSPRP
             ||||||||||||||||||||||||||||||||||||||||||||||||||||||||||||
g160         MDILDKLVDFAQLTGSVDVQCLLGGQWSVRHETLQREGLVHIVTSGSGYLCIDGETSPRP
                     10        20        30        40        50        60

                     70        80        90       100       110       120
m160.pep     VSTGDIVFFPRGLGHVLSHDGKCGESLQPDMRQHGAFTVKQCGNGQDMSLFCARFRYDTH
             ||||||||||||||||||||||||||||||||||||||||||||||||||||||||||||
a160         VSTGDIVFFPRGLGHVLSHDGKCGESLQPDMRQHGAFTVKQCGNGQDMSLFCARFRYDTH
                     70        80        90       100       110       120

                    130       140       150       160       170       180
m160.pep     ADLMNGLPETVFLNIAHPSLQYVVSMLQLESKKPLTGTVSMVNALSSVLLVLILRAYLEQ
             ||||||||||||||||||||||||||||||||||||||||||||||||||||||||||||
a160         ADLMNGLPETVFLNIAHPSLQYVVSMLQLESKKPLTGTVSMVNALSSVLLVLILRAYLEQ
                    130       140       150       160       170       180

                    190       200       210       220       230       240
m160.pep     DKDVELSGVLKGWQDKRLGHLIQKVIDKPEDEWNVDKMVAAANMSRAQLMRRFKSRVGLS
             ||||||||||||||||||||||||||||||||||||||||||||||||||||||||||||
a160         DKDVELSGVLKGWQDKRLGHLIQKVIDKPEDEWNVDKMVAAANMSRAQLMRRFKSRVGLS
                    190       200       210       220       230       240

                    250       260       270       280       290       300
m160.pep     PHAFVNHIRLQKGALLLKKNPDSVLSVALSVGFQSETHFGKAFKRQYHVSPGQYRKEGGQ
             ||||||||||||||||||||||||||||||||||||||||||||||||||||||||||||
a160         PHAFVNHIRLQKGALLLKKNPDSVLSVALSVGFQSETHFGKAFKRQYHVSPGQYRKEGGQ
                    250       260       270       280       290       300

m160.pep     KX
             ||
a160         KX
```

The following partial DNA sequence was identified in *N. gonorrhoeae* <SEQ ID 667>:

```
g161.seq
   1 ATGGATACCG CAAAAAAAGA CATTTTAGGA TCGGGCTGGA TGCTGGTGGC

  51 GGCGGCCTGC TTCACCGTTA TGAACGTATT GATTAAAGAG GCATCGGCAA

 101 AATTTGCCCT CGGCAGCGGC GAATTGGTCT TTTGGCGCAT GCTGTTTTCA

 151 ACCGTTACGC TCGGTGCTGC CGCCGTATTG CGGCGCGACA CCTTCCGCAC

 201 GCCCCATTGG AAAAACCACT TAAACCGCAG TATGGTCGGG ACGGGGGCGA

 251 TGCTGCTGCT GTTTTACGCG GTAACGCATC TGCCTTTGAC AACCGGCGTT

 301 ACCCTGAGTT ACACCTCGTC GATTTTTttg GCGGTATTTT CCTTCCTGAT

 351 TTTGAAAGAA CGGATTTCCG TTTACACGCA GGCGGTGCTG CTCCTTGGTT

 401 TTGCCGGCGT GGTATTGCTG CTTAATCCCT CGTTCCGCAG CGGTCAGGAA

 451 CCGGCGGCAC TCGCCGGGCT GGCGGGCGGC GCGATGTCCG GCTGGGCGTA

 501 TTTGAAAGTG CGCGAACTGT CTTTGGCGGG CGAACCCGGC TGGCGCGTCG

 551 TGTTTTACCT TTCCGCAACC GGCGTGGCGA TGTCGTCggt ttgggcgacg

 601 Ctgaccggct ggCACAcccT GTCCTTTcca tcggcagttt ATCtgtCGGG

 651 CATCGGCGTG tccgcgCtgA TTGCCCAaCT GtcgatgAcg cGCGcctaca

 701 aaGTCGGCGA CAAATTCACG GTTGCCTCGC tttcctaTAt gaccgtcGTC

 751 TTTTCCGCCC TGTCTGCCGC ATTTTTTCTg ggcgaagagc ttttctggCA

 801 GGAAATACTC GGTATGTGCA TCATTATcct CAGCGGCATT TTGAGCAGCA

 851 TCCGCCCCAT TGCCTTCAAA CAGCGGCTGC AAGCCCTCTT CCGCCAAAGA

 901 TAA
```

This corresponds to the amino acid sequence <SEQ ID 668; ORF 161.ng>:

```
g161.pep
   1 MDTAKKDILG SGWMLVAAAC FTVMNVLIKE ASAKFALGSG ELVFWRMLFS

  51 TVTLGAAAVL RRDTFRTPHW KNHLNRSMVG TGAMLLLFYA VTHLPLTTGV

 101 TLSYTSSIFL AVFSFLILKE RISVYTQAVL LLGFAGVVLL LNPSFRSGQE

 151 PAALAGLAGG AMSGWAYLKV RELSLAGEPG WRVVFYLSAT GVAMSSVWAT

 201 LTGWHTLSFP SAVYLSGIGV SALIAQLSMT RAYKVGDKFT VASLSYMTVV

 251 FSALSAAFFL GEELFWQEIL GMCIIILSGI LSSIRPIAFK QRLQALFRQR

 301 *
```

The following partial DNA sequence was identified in *N. meningitidis* <SEQ ID 669>:

```
m161.seq
   1 ATGGATACCG CAAAAAAAGA CATTTTAGGA TCGGGCTGGA TGCTGGTGGC

  51 GGCGGCCTGC TTTACCATTA TGAACGTATT GATTAAAGAG GCATCGGCAA

 101 AATTTGCCCT CGGCAGCGGC GAATTGGTCT TTTGGCGCAT GCTGTTTTCA

 151 ACCGTTGCGC TCGGGGCTGC CGCCGTATTG CGTCGGGACA mCTTCCGCAC

 201 GCCCCATTGG AAAAACCACT TAAACCGCAG TATGGTCGGG ACGGGGGCGA

 251 TGCTGCTGCT GTTTTACGCG GTAACGCATC TGCCTTTGGC CACTGGCGTT
```

-continued

```
301 ACCCTGAGTT ACACCTCGTC GATTTTTTTG GCGGTATTTT CCTTCCTGAT

351 TTTGAAAGAA CGGATTTCCG TTTACACGCA GGCGGTGCTG CTCCTTGGTT

401 TTGCCGGCGT GGTATTGCTG CTTAATCCCT CGTTCCGCAG CGGTCAGGAA

451 ACGGCGGCAC TCGCCGGGCT GGCGGGCGGC GCGATGTCCG GCTGGGCGTA

501 TTTGAAAGTG CGCGAACTGT CTTTGGCGGG CGAACCCGGC TGGCGCGTCG

551 TGTTTTACCT TTCCGTGACA GGTGTGGCGA TGTCGTCGGT TTGGGCGACG

601 CTGACCGGCT GGCACACCCT GTCCTTTCCA TCGGCAGTTT ATCTGTCGTG

651 CATCGGCGTG TCCGCGCTGA TTGCCCAACT GTCGATGACG CGCGCCTACA

701 AAGTCGGCGA CAAATTCACG GTTGCCTCGC TTTCCTATAT GACCGTCGTT

751 TTTTCCGCTC TGTCTGCCGC ATTTTTTCTG GGCGAAGAGC TTTTCTGGCA

801 GGAAATACTC GGTATGTGCA TCATCATCCT CAGCGGTATT TTGAGCAGCA

851 TCCGCCCCAC TGCCTTCAAA CAGCGGCTGC AATCCCTGTT CCGCCAAAGA

901 TAA
```

This corresponds to the amino acid sequence <SEQ ID 670; ORF 161>:

```
m161.pep
  1 MDTAKKDILG SGWMLVAAAC FTIMNVLIKE ASAKFALGSG ELVFWRMLFS

 51 TVALGAAAVL RRDXFRTPHW KNHLNRSMVG TGAMLLLFYA VTHLPLATGV

101 TLSYTSSIFL AVFSFLILKE RISVYTQAVL LLGFAGVVLL LNPSFRSGQE

151 TAALAGLAGG AMSGWAYLKV RELSLAGEPG WRVVFYLSVT GVAMSSVWAT

201 LTGWHTLSFP SAVYLSCIGV SALIAQLSMT RAYKVGDKFT VASLSYMTVV

251 FSALSAAFFL GEELFWQEIL GMCIIILSGI LSSIRPTAFK QRLQSLFRQR

301 *
```

Computer analysis of this amino acid sequence gave the following results:

Homology with a Predicted ORF from *N. gonorrhoeae*

```
m161/g161    97.0% identity in 300 aa overlap

                     10        20        30        40        50        60
m161.pep     MDTAKKDILGSGWMLVAAACFTIMNVLIKEASAKFALGSGELVFWRMLFSTVALGAAAVL
             ||||||||||||||||||||||:|||||||||||||||||||||||||||||:|||||||
g161         MDTAKKDILGSGWMLVAAACFTVMNVLIKEASAKFALGSGELVFWRMLFSTVTLGAAAVL
                     10        20        30        40        50        60

                     70        80        90       100       110       120
m161.pep     RRDXFRTPHWKNHLNRSMVGTGAMLLLFYAVTHLPLATGVTLSYTSSIFLAVFSFLILKE
             |||:||||||||||||||||||||||||||||||||:|||||||||||||||||||||||
g161         RRDTFRTPHWKNHLNRSMVGTGAMLLLFYAVTHLPLTTGVTLSYTSSIFLAVFSFLILKE
                     70        80        90       100       110       120

                    130       140       150       160       170       180
m161.pep     RISVYTQAVLLLGFAGVVLLLNPSFRSGQETAALAGLAGGAMSGWAYLKVRELSLAGEPG
             |||||||||||||||||||||||||||||| |||||||||||||||||||||||||||||
g161         RISVYTQAVLLLGFAGVVLLLNPSFRSGQEPAALAGLAGGAMSGWAYLKVRELSLAGEPG
                    130       140       150       160       170       180

                    190       200       210       220       230       240
m161.pep     WRVVFYLSVTGVAMSSVWATLTGWHTLSFPSAVYLSCIGVSALIAQLSMTRAYKVGDKFT
             ||||||||:||||||||||||||||||||||||||| |||||||||||||||||||||||
g161         WRVVFYLSATGVAMSSVWATLTGWHTLSFPSAVYLSGIGVSALIAQLSMTRAYKVGDKFT
                    190       200       210       220       230       240

                    250       260       270       280       290       300
m161.pep     VASLSYMTVVFSALSAAFFLGEELFWQEILGMCIIILSGILSSIRPTAFKQRLQSLFRQR
             |||||||||||||||||||||||||||||||||||||||||||||| |||||||:|||||
g161         VASLSYMTVVFSALSAAFFLGEELFWQEILGMCIIILSGILSSIRPIAFKQRLQALFRQR
                    250       260       270       280       290       300
```

-continued

```
m161.pep      X
              |
g161          X
```

The following partial DNA sequence was identified in *N. meningitidis* <SEQ ID 671>:

```
a161.seq
  1 ATGGATACCG CAAAAAAAGA CATTTTAGGA TCGGGCTGGA TGCTGGTGGC

 51 GGCGGCCTGC TTTACCATTA TGAACGTATT GATTAAAGAG GCATCGGCAA

101 AATTTGCCCT CGGCAGCGGC GAATTGGTCT TTTGGCGCAT GCTGTTTTCA

151 ACCGTTGCGC TCGGGGCTGC CGCCGTATTG CGTCGGGACA CCTTCCGCAC

201 GCCCCATTGG AAAAACCACT TAAACCGCAG TATGGTCGGG ACGGGGGCGA

251 TGCTGCTGCT GTTTTACGCG GTAACGCATC TGCCTTTGGC CACCGGCGTT

301 ACCCTGAGTT ACACCTCGTC GATTTTTTTG GCGGTATTTT CCTTCCTGAT

351 TTTGAAAGAA CGGATTTCCG TTTACACGCA GGCGGTGCTG CTCCTTGGTT

401 TTGCCGGCGT GGTATTGCTG CTTAATCCCT CGTTCCGCAG CGGTCAGGAA

451 ACGGCGGCAC TCGCCGGGCT GGCGGGCGGC GCGATGTCCG GCTGGGCGTA

501 TTTGAAAGTG CGCGAACTGT CTTTGGCGGG CGAACCCGGC TGGCGCGTCG

551 TGTTTTACCT TTCCGTGACA GGTGTGGCGA TGTCATCGGT TTGGGCGACG

601 CTGACCGGCT GGCACACCCT GTCCTTTCCA TCGGCAGTTT ATCTGTCGTG

651 CATCGGCGTG TCCGCGCTGA TTGCCCAACT GTCGATGACG CGCGCCTACA

701 AAGTCGGCGA CAAATTCACG GTTGCCTCGC TTTCCTATAT GACCGTCGTT

751 TTTTCCGCTC TGTCTGCCGC ATTTTTTCTG GCCGAAGAGC TTTTCTGGCA

801 GGAAATACTC GGTATGTGCA TCATCATCCT CAGCGGTATT TTGAGCAGCA

851 TCCGCCCCAC TGCCTTCAAA CAGCGGCTGC AATCCCTGTT CCGCCAAAGA

901 TAA
```

This corresponds to the amino acid sequence <SEQ ID 672; ORF 161.a>:

```
a161.pep

  1 MDTAKKDILG SGWMLVAAAC FTIMNVLIKE ASAKFALGSG ELVFWRMLFS

 51 TVALGAAAVL RRDTFRTPHW KNHLNRSMVG TGAMLLLFYA VTHLPLATGV

101 TLSYTSSIFL AVFSFLILKE RISVYTQAVL LLGFAGVVLL LNPSFRSGQE

151 TAALAGLAGG AMSGWAYLKV RELSLAGEPG WRVVFYLSVT GVAMSSVWAT

201 LTGWHTLSFP SAVYLSCIGV SALIAQLSMT RAYKVGDKFT VASLSYMTVV

251 FSALSAAFFL AEELFWQEIL GMCIIILSGI LSSIRPTAFK QRLQSLFRQR

301 *
```

```
m161/a161      99.3% identity in 300 aa overlap

                       10        20        30        40        50        60
m161.pep      MDTAKKDILGSGWMLVAAACFTIMNVLIKEASAKFALGSGELVFWRMLFSTVALGAAAVL
              ||||||||||||||||||||||||||||||||||||||||||||||||||||||||||||
a161          MDTAKKDILGSGWMLVAAACFTIMNVLIKEASAKFALGSGELVFWRMLFSTVALGAAAVL
                       10        20        30        40        50        60
```

-continued

```
                    70        80        90       100       110       120
m161.pep      RRDXFRTPHWKNHLNRSMVGTGAMLLLFYAVTHLPLATGVTLSYTSSIFLAVFSFLILKE
              |||:||||||||||||||||||||||||||||||||||||||||||||||||||||||||
a161          RRDTFRTPHWKNHLNRSMVGTGAMLLLFYAVTHLPLATGVTLSYTSSIFLAVFSFLILKE
                    70        80        90       100       110       120
                   130       140       150       160       170       180
m161.pep      RISVYTQAVLLLGFAGVVLLLNPSFRSGQETAALAGLAGGAMSGWAYLKVRELSLAGEPG
              ||||||||||||||||||||||||||||||||||||||||||||||||||||||||||||
a161          RISVYTQAVLLLGFAGVVLLLNPSFRSGQETAALAGLAGGAMSGWAYLKVRELSLAGEPG
                   130       140       150       160       170       180
                   190       200       210       220       230       240
m161.pep      WRVVFYLSVTGVAMSSVWATLTGWHTLSFPSAVYLSCIGVSALIAQLSMTRAYKVGDKFT
              ||||||||||||||||||||||||||||||||||||||||||||||||||||||||||||
a161          WRVVFYLSVTGVAMSSVWATLTGWHTLSFPSAVYLSCIGVSALIAQLSMTRAYKVGDKFT
                   190       200       210       220       230       240
                   250       260       270       280       290       300
m161.pep      VASLSYMTVVFSALSAAFFLGEELFWQEILGMCIIILSGILSSIRPTAFKQRLQSLFRQR
              ||||||||||||||||||||:|||||||||||||||||||||||||||||||||||||||
a161          VASLSYMTVVFSALSAAFFLAEELFWQEILGMCIIILSGILSSIRPTAFKQRLQSLFRQR
                   250       260       270       280       290       300

m161.pep      X
              |
a161          X
```

The following partial DNA sequence was identified in *N. gonorrhoeae* <SEQ ID 673>:

```
g163.seq
   1 ATGGTTATTT TGACGACTTT GTTTTTGTG  TGTGTTTTGG TGGTATTGGT

  51 TTTAACCGTG CCGGATCAGG TGCAGATGTG gctCGACCGG GCAAAAGAAG

 101 TCATTTTTAC CGAGTTCAGC TGGTTTTATG TTTTAACGTT TTCCATTTTt

 151 ctgGGTTTtc tgctGATACT CTCGGTCAGC GGTTTGGGAA ACATcagGCT

 201 AGGACGGGAT GAAGATGTGC CGGAATTCGG CTTCCTGTCG TGGCTGGCGA

 251 TGCTGTTTGC GGCCGGGATG GGCGTGGGCC TGATGTTTTT CGGCGTGGCA

 301 GAGCCGTTGA TGCATTATTT TTCGGACATT ACGGTCGGCG CGCCGGAACA

 351 CAGGCAGCAG CAGGCATTGC TGCACACGGT GTTCCATTGG GGCGTTCACG

 401 CCTGGTCGGT GTACGGTACG ATTGCATTGG CTTTGGCTTA TTTCGGTTTC

 451 CGCTACAAAC TGCCGCTTGC CCTGCGTTCT TGTTTTTACC CCCTGTTGAA

 501 AGAAAAAATT TCCGGAAGGT TCGGCGATGC CATTGATATT ATGGCGTTGC

 551 TTGCTACTTT TTTCGGCATC ATCACCACAT TGGGGTTCGG GGCTTCGCAA

 601 CTGGGCGCCG GATTGCAGGA AATGGGCTGG ATTGCCGAAA ACAGCTTCGG

 651 CGTGCAGGTC TTGATTATCG CCGCCGTAAT GTCCCTCGCC GTCGTTTCGG

 701 CAATATCCGG CGTGGGGAAG GGCGTGAAGG TGTTGAGCGA GTTGAACCTG

 751 GGCCTTGCGT TTTTGCTGCT GTTTTTTGTT TTGGCGGCGG ACCCCACTGT

 801 TTACCTGTTG TCGGCATTCG GCGACAACAT AGGGAACTAC CTCGGAAATC

 851 TGGTGCGCCT CAGTTTGAAA ACTTATGCGT ACGAACGGGA ACACAAGCCG

 901 TGGTTTGAAT CTTGGACGGT GCTTTATTGG GCGTGGTGGT GTTCTTGGgc

 951 gcCGTTTGTG GGTTTGTTTA TCGCGCGCAT TTCAAAGGGg cgcaccatCc

1001 gcgagtttgt CTTCGGGGTT TTGCTCATCC CCGGCCTGTT CGGCGTTTTG

1051 TGGTTTACCG TCTTCGGCAA TACGGCGATT TGGCTGAATG ACGGGGTTGC

1101 GGGGGGAATG CTCGAAAAGA TGACCTCCTC TCCGGAAACG CTGCTTTTTA

1151 AATTCTTTAA TTACCTCCCC CTGCCCGAAC TGACGAGCAT CGTCAGCCTG
```

-continued

```
1201 CTGGTCATTT CCCTGTTTTT TGTAACTTCT GCCGACTCCG GGATTTATGT

1251 CCTGAACAAT ATTACCTCTC GGGACAAAGG CTTGAGCGCG CCACGGTGGC

1301 AGGCGGTTAT GTGGGGCGTG CTGatgtcTG CCGTTGCCGT TTTGCTGATG

1351 CGCTCGGGCG GACTCGGCAA CCTGCAGTCT ATGACCCTGA TTGTTTCCCT

1401 GCCGTTTGCC CTGCTGATGC TGATAATGTG TTTCAGCCTG TGGAAAGGCT

1451 TGAGTGCGGA TAAGAAATAT TTTGAGACCC GGGTCAACCC TACCAGTGTA

1501 TTTTGGACGG GCGGCAAGTG GAAAGAACGG CTGGTGCGGA TAATGAGCCA

1551 GACGCAGGAG CAGGATATTT TAAAATTCCT CAAACATACC GCATCGCCCG

1601 CTATGCACGA GTTGCAACGG GAGCTTTCGG AAGAATACGG CTTGAGCGTC

1651 CGGGTCGATA AGATGTTTCA TCAGGACGAG CCCGCAATCG AGTTCGTCAT

1701 TCGGAAAGAG ACGATGCGCG ATTTTATGTA CGGGATTAAG TCTGTCGGGC

1751 AGGATGTATC CGACCAGTTG ATTAACGACG GCAAGCTGCC GCATATCCGG

1801 CACCAGACAA CTTACAAACC CTACGCTTAT TTTTTCGACG GGCGCGTCGG

1851 GTACGATGTG CAGTATATGA ACAAGGACGA GCTGATTGCC GACATTTTGA

1901 AAAACTACGA ACGTTATTTG ATGTTGTTGG ATGATGTCGG TCAGGAACTG

1951 ATGGCGCACG AGCAGGTGGA ATTGGCAGAG TAA
```

This corresponds to the amino acid sequence <SEQ ID 674; ORF 163.ng>:

```
g163.pep
  1  MVILTTLFFV CVLVVLVLTV PDQVQMWLDR AKEVIFTEFS WFYVLTFSIF

 51  LGFLLILSVS GLGNIRLGRD EDVPEFGFLS WLAMLFAAGM GVGLMFFGVA

101  EPLMHYFSDI TVGAPEHRQQ QALLHTVFHW GVHAWSVYGT IALALAYFGF

151  RYKLPLALRS CFYPLLKEKI SGRFGDAIDI MALLATFFGI ITTLGFGASQ

201  LGAGLQEMGW IAENSFGVQV LIIAAVMSLA VVSAISGVGK GVKVLSELNL

251  GLAFLLLFFV LAADPTVYLL SAFGDNIGNY LGNLVRLSLK TYAYEREHKP

301  WFESWTVLYW AWWCSWAPFV GLFIARISKG RTIREFVFGV LLIPGLFGVL

351  WFTVFGNTAI WLNDGVAGGM LEKMTSSPET LLFKFFNYLP LPELTSIVSL

401  LVISLFFVTS ADSGIYVLNN ITSRDKGLSA PRWQAVMWGV LMSAVAVLLM

451  RSGGLGNLQS MTLIVSLPFA LLMLIMCFSL WKGLSADKKY FETRVNPTSV

501  FWTGGKWKER LVRIMSQTQE QDILKFLKHT ASPAMHELQR ELSEEYGLSV

551  RVDKMFHQDE PAIEFVIRKE TMRDFMYGIK SVGQDVSDQL INDGKLPHIR

601  HQTTYKPYAY FFDGRVGYDV QYMNKDELIA DILKNYERYL MLLDDVGQEL

651  MAHEQVELAE *
```

The following partial DNA sequence was identified in *N. meningitidis* <SEQ ID 675>:

```
m163.seq
  1 ATGGTTATTT TGACGACTTT GTTTTTTGTG TGTGTTTTGG TGGTATTGGT

 51 TTTAACCGTG CCGGATCAGG TGCAGATGTG GCTCGATCGG GCAAAAGAAG

101 TCATTTTTAC CGAGTTCAGC TGGTTTTATG TTTTAACGTT TTCCATTTTT

151 CTGGGTTTCC TGCTGATACT CTCGGTCAGC AGTTTGGGAA ACATCAGGCT
```

-continued

201 CGGACGGGAT GAAGATGTGC CGGAATTCGG CTTCCTGTCG TGGCTGGCGA

251 TGCTGTTTGC GGCCGGGATG GGCGTGGGTC TGATGTTTTT CGGCGTGGCA

301 GAGCCGTTGA TGCATTATTT TTCGGACATT ACGGCCGGCA CGCCGGAACA

351 CAGGCAGCAG CAGGCATTGC TGCACACGGT GTTCCATTGG GGCGTTCACG

401 CTTGGTCGGT GTACGGTACG ATTGCATTGG CTTTGGCTTA TTTCGGTTTC

451 CGCTACAAGC TGCCGCTTGC CCTGCGTTCT TGTTTTTACC CCCTGTTGAA

501 AGAAAAAATT TCCGGAAGGT TCGGCGATGC CATTGATATT ATGGCGTTGC

551 TTGCTACTTT TTTCGGCATC ATCACCACAT TGGGGTTCGG GGCTTCGCAA

601 CTGGGCGCCG GATTGCAGGA AATGGGCTGG ATTGCCGAAA ACAGCTTCAG

651 CGTGCAGGTT TTGATTATCG CCGCCGTCAT GTCCCTCGCC GTCGTTTCGG

701 CAATATCCGG CGTGGGGAAG GGCGTGAAGG TGTTGAGCGA GTTGAACCTG

751 GGCCTTGCGT TTTTGCTGCT GTTTTTTGTT TTGGCGGCGG GACCCACTGT

801 TTACCTGTTG TCGGCATTCG GCGACAACAT AGGGAACTAC CTCGGAAATC

851 TGGTGCGCCT CAGTTTTAAA ACTTATGCGT ACGAACGGGA ACACAAGCCG

901 TGGTTTGAAT CTTGGACGGT GCTTTATTGG GCGTGGTGGT GTTCTTGGGC

951 GCCGTTTGTG GGTTTGTTTA TCGCGCGCAT TTCAAAGGGG CGCACCATCC

1001 GCGAGTTTGT CTTCGGGGTT TTGCTCATCC CCGGCCTGTT CGGCGTTTTG

1051 TGGTTTACCG TCTTCGGCAA TACGGCGATT TGGCTGAATG ACGGGGTTGC

1101 GGGGGGAATG CTCGAAAAGA TGACCTCCTC TCCGGAAACG CTGCTTTTTA

1151 AATTCTTTAA TTACCTCCCC CTGCCCGAAT TGACGAGCAT CGTCAGCCTG

1201 CTGGTCATTT CTCTGTTTTT TGTAACTTCT GCCGATTCCG GGATTTATGT

1251 CCTGAACAAT ATTACCTCTC GGGACAAAGG CTTGAGCGCG CCACGGTGGC

1301 AGGCGGTTAT GTGGGGCGTG CTGATGTCTG CCGTTGCCGT TTTGCTGATG

1351 CGCTCGGGCG GACTCGGCAA CCTGCAGTCT ATGACCCTGA TTGTTTCCCT

1401 GCCGTTTGCC CTGCTGATGC TGATAATGTG TTTCAGCCTG TGGAAAGGCT

1451 TGAGTGCGGA TAAGAAATAT TTTGAGACCC GGGTTAACCC TACCAGTGTA

1501 TTTTGGACGG GCGGCAAGTG GAAAGAACGG CTGGTGCAGA TAATGAGCCA

1551 GACGCAGGAG CAGGATATTT TAAAATTCCT CAAACAGACT GCATCGCCCG

1601 CTATGCACGA GTTGCAACGG GAGCTTTCGG AAGAATACGG CTTGAGCGTC

1651 CGGGTCGATA AAATGTTTCA TCGGGACGAG CCCGCAATCG AGTTCGTCAT

1701 TCGGAAAGAG ACGATGCGCG ATTTTATGTA CGGGATTAAG TCTGTCGGGC

1751 AGGATGTATC CGACCAGTTG ATTAACGACG GCAAGCTGCC GCATATCCGG

1801 CATCAGACAA CTTACAAACC CTACGCTTAT TTTTTCGACG GGCGCGTCGG

1851 GTACGATGTG CAGTATATGA ACAAGGACGA GCTGATTGCC GACATTTTGA

1901 AAAACTACGA ACGTTATTTG ATGTTGTTGG ATGATGTCGG TCAGGAACTG

1951 ATGGCGCACG AGCAGGTGGA ATTGGCAGAG TAA

This corresponds to the amino acid sequence <SEQ ID 676; ORF 163>:

m163.pep

1 MVILTTLFFV CVLVVLVLTV PDQVQMWLDR AKEVIFTEFS WFYVLTFSIF

-continued

```
 51  LGFLLILSVS SLGNIRLGRD EDVPEFGFLS WLAMLFAAGM GVGLMFFGVA
101  EPLMHYFSDI TAGTPEHRQQ QALLHTVFHW GVHAWSVYGT IALALAYFGF
151  RYKLPLALRS CFYPLLKEKI SGRFGDAIDI MALLATFFGI ITTLGFGASQ
201  LGAGLQEMGW IAENSFSVQV LIIAAVMSLA VVSAISGVGK GVKVLSELNL
251  GLAFLLLFFV LAAGPTVYLL SAFGDNIGNY LGNLVRLSFK TYAYEREHKP
301  WFESWTVLYW AWWCSWAPFV GLFIARISKG RTIREFVFGV LLIPGLFGVL
351  WFTVFGNTAI WLNDGVAGGM LEKMTSSPET LLFKFFNYLP LPELTSIVSL
401  LVISLFFVTS ADSGIYVLNN ITSRDKGLSA PRWQAVMWGV LMSAVAVLLM.
451  RSGGLGNLQS MTLIVSLPFA LLMLIMCFSL WKGLSADKKY FETRVNPTSV
501  FWTGGKWKER LVQIMSQTQE QDILKFLKQT ASPAMHELQR ELSEEYGLSV
551  RVDKMFHRDE PAIEFVIRKE TMRDFMYGIK SVGQDVSDQL INDGKLPHIR
601  HQTTYKPYAY FFDGRVGYDV QYMNKDELIA DILKNYERYL MLLDDVGQEL
651  MAHEQVELAE *
```

Computer analysis of this amino acid sequence gave the following results:

Homology with a Predicted ORF from *N. gonorrhoeae*

```
m163/g163    98.6% identity in 660 aa overlap

                     10        20        30        40        50        60
m163.pep     MVILTTLFFVCVLVVLVLTVPDQVQMWLDRAKEVIFTEFSWFYVLTFSIFLGFLLILSVS
             ||||||||||||||||||||||||||||||||||||||||||||||||||||||||||||
g163         MVILTTLFFVCVLVVLVLTVPDQVQMWLDRAKEVIFTEFSWFYVLTFSIFLGFLLILSVS
                     10        20        30        40        50        60

                     70        80        90       100       110       120
m163.pep     SLGNIRLGRDEDVPEFGFLSWLAMLFAAGMGVGLMFFGVAEPLMHYFSDITAGTPEHRQQ
             :||||||||||||||||||||||||||||||||||||||||||||||||||:|:||||||
g163         GLGNIRLGRDEDVPEFGFLSWLAMLFAAGMGVGLMFFGVAEPLMHYFSDITVGAPEHRQQ
                     70        80        90       100       110       120

                    130       140       150       160       170       180
m163.pep     QALLHTVFHWGVHAWSVYGTIALALAYFGFRYKLPLALRSCFYPLLKEKISGRFGDAIDI
             ||||||||||||||||||||||||||||||||||||||||||||||||||||||||||||
g163         QALLHTVFHWGVHAWSVYGTIALALAYFGFRYKLPLALRSCFYPLLKEKISGRFGDAIDI
                    130       140       150       160       170       180

                    190       200       210       220       230       240
m163.pep     MALLATFFGIITTLGFGASQLGAGLQEMGWIAENSFSVQVLIIAAVMSLAVVSAISGVGK
             |||||||||||||||||||||||||||||||||||||||:||||||||||||||||||||
g163         MALLATFFGIITTLGFGASQLGAGLQEMGWIAENSFGVQVLIIAAVMSLAVVSAISGVGK
                    190       200       210       220       230       240

                    250       260       270       280       290       300
m163.pep     GVKVLSELNLGLAFLLLFFVLAAGPTVYLLSAFGDNIGNYLGNLVRLSFKTYAYEREHKP
             ||||||||||||||||||||||| |||||||||||||||||||||||||||:||||||||
g163         GVKVLSELNLGLAFLLLFFVLAADPTVYLLSAFGDNIGNYLGNLVRLSLKTYAYEREHKP
                    250       260       270       280       290       300

                    310       320       330       340       350       360
m163.pep     WFESWTVLYWAWWCSWAPFVGLFIARISKGRTIREFVFGVLLIPGLFGVLWFTVFGNTAI
             ||||||||||||||||||||||||||||||||||||||||||||||||||||||||||||
g163         WFESWTVLYWAWWCSWAPFVGLFIARISKGRTIREFVFGVLLIPGLFGVLWFTVFGNTAI
                    310       320       330       340       350       360

                    370       380       390       400       410       420
m163.pep     WLNDGVAGGMLEKMTSSPETLLFKFFNYLPLPELTSIVSLLVISLFFVTSADSGIYVLNN
             ||||||||||||||||||||||||||||||||||||||||||||||||||||||||||||
g163         WLNDGVAGGMLEKMTSSPETLLFKFFNYLPLPELTSIVSLLVISLFFVTSADSGIYVLNN
                    370       380       390       400       410       420

                    430       440       450       460       470       480
m163.pep     ITSRDKGLSAPRWQAVMWGVLMSAVAVLLMRSGGLGNLQSMTLIVSLPFALLMLIMCFSL
             ||||||||||||||||||||||||| ||||||||||||||||||||||||||||||||||
g163         ITSRDKGLSAPRWQAVMWGVLMSAVAVLLMRSGGLGNLQSMTLIVSLPFALLMLIMCFSL
                    430       440       450       460       470       480
```

-continued

```
                    490       500       510       520       530       540
m163.pep     WKGLSADKKYFETRVNPTSVFWTGGKWKERLVQIMSQTQEQDILKFLKQTASPAMHELQR
             |||||||||||||||||||||||||||||||||:|||||||||||||||:||||||||||||
g163         WKGLSADKKYFETRVNPTSVFWTGGKWKERLVRIMSQTQEQDILKFLKHTASPAMHELQR
                    490       500       510       520       530       540

                    550       560       570       580       590       600
m163.pep     ELSEEYGLSVRVDKMFHRDEPAIEFVIRKETMRDFMYGIKSVGQDVSDQLINDGKLPHIR
             ||||||||||||||||||:|||||||||||||||||||||||||||||||||||||||||||
g163         ELSEEYGLSVRVDKMFHQDEPAIEFVIRKETMRDFMYGIKSVGQDVSDQLINDGKLPHIR
                    550       560       570       580       590       600

                    610       620       630       640       650       660
m163.pep     HQTTYKPYAYFFDGRVGYDVQYMNKDELIADILKNYERYLMLLDDVGQELMAHEQVELAE
             ||||||||||||||||||||||||||||||||||||||||||||||||||||||||||||
g163         HQTTYKPYAYFFDGRVGYDVQYMNKDELIADILKNYERYLMLLDDVGQELMAHEQVELAE
                    610       620       630       640       650       660

m163.pep     X
             |
g163         X
```

The following partial DNA sequence was identified in *N. meningitidis* <SEQ ID 677>:

```
a163.seq
   1 ATGGTTATTT TGACGACTTT GTTTTTTGTG TGTGTTTTGG TGGTATTGGT

  51 TTTAACCGTG CCGGATCAGG TGCAGATGTG GCTCGATCGG GCAAAAGAAG

 101 TCATTTTTAC CGAGTTCAGC TGGTTTTATG TTTTAACGTT TTCCATTTTT

 151 CTGGGTTTCC TGCTGATACT CTCGGTCAGC AGTTTGGGAA ACATCAGGCT

 201 CGGACGGGAT GAAGATGTGC CGGAATTCGG CTTCCTGTCG TGGCTGGCGA

 251 TGCTGTTTGC GGCCGGGATG GGCGTGGGTC TGATGTTTTT CGGCGTGGCA

 301 GAGCCGTTGA TGCATTATTT TTCGGACATT ACGGCCGGCA CGCCGGAACA

 351 CAGGCAGCAG CAGGCATTGC TGCACACGGT GTTCCATTGG GGCGTTCACG

 401 CTTGGTCGGT GTACGGTACG ATTGCATTGG CTTTGGCTTA TTTCGGTTTC

 451 CGCTACAAGC TGCCGCTTGC CCTGCGTTCT TGTTTTTACC CCCTGTTGAA

 501 AGAAAAAATT TCCGGAAGGT TCGGCGATGC CATTGATATT ATGGCGTTGC

 551 TTGCTACTTT TTTCGGCATC ATCACCACAT TGGGGTTCGG GGCTTCGCAA

 601 CTGGGCGCCG GATTGCAGGA AATAGGCTGG ATTGCCGAAA ACAGCTTCAG

 651 CGTGCAGGTT TTGATTATCG CCGCCGTCAT GTCCCTCGCC GTCGTTTCGG

 701 CAATATCCGG CGTGGGGAAG GGTGTGAAGG TGTTGAGCGA GTTGAACCTG

 751 GGTCTTGCGT TTTTGCTGCT GTTTTTTGTT TTGGCGGCGG GTCCCACTGT

 801 TTACCTGTTG TCGGCATTCG GCGACAACAT AGGGAACTAC CTCGGAAATC

 851 TGGTGCGCCT CAGTTTTAAA ACTTATGCGT ACGAACGGGA ACACAAGCCG

 901 TGGTTTGAAT CTTGGACGGT GCTTTATTGG GCGTGGTGGT GTTCTTGGGC

 951 GCCGTTTGTG GGTTTGTTTA TCGCGCGCAT TTCAAAGGGG CGCACCATCC

1001 GCGAGTTTGT CTTCGGGGTT TTGCTCATCC CCGGCCTGTT CGGCGTTTTG

1051 TGGTTTACCG TCTTCGGCAA TACGGCGATT TGGCTGAATG ACGGGGTTGC

1101 GGGGGGAGTG CTCGAAAAGA TGACCTCCTC TCCGGAAACG CTGCTTTTTA

1151 AATTCTTTAA TTACCTCCCC CTGCCCGAAT TGACGAGCAT CGTCAGCCTG

1201 CTGGTCATTT CTCTGTTTTT TGTAACTTCT GCCGATTCCG GGATTTATGT

1251 CCTGAACAAT ATTACCTCTC GGGACAAAGG CTTGAGCGCG CCACGGTGGC

1301 AGGCGGTTAT GTGGGGCGTG CTGATGTCTG CCGTTGCCGT TTTGCTGATG
```

-continued

```
1351 CGCTCGGGCG GACTCGGCAA CCTGCAGTCT ATGACCCTGA TTGTTTCCCT

1401 GCCGTTTGCC CTGCTGATGC TGATAATGTG TTTCAGCCTG TGGAAAGGAT

1451 TGAGTGCGGA TAAGAAATAT TTTGAGACCC GGGTTAACCC TACCAGTGTA

1501 TTTTGGACGG GCGGCAAGTG GAAAGAACGG CTGGTGCAGA TAATGAGCCA

1551 GACGCAGGAG CAGGATATTT TAAAATTCCT CAAACATACC GCATCGCCCG

1601 CTATGCACGA GTTACAACGG GAGCTTTCGG AAGAATACGG CTTGAGCGTC

1651 CGGGTCGATA AGATGTTTCA TCAGGACGAG CCCGCAATCG AGTTCGTCAT

1701 TCGGAAAGAG ACGATGCGCG ATTTTATGTA CGGGATTAAG TCTGTCGGGC

1751 AGGATGTATC CGACCAGTTG ATTAACGACG GCAAGCTGCC GCATATCCGG

1801 CATCAGACAA CTTACAAACC CTACGCTTAT TTTTTCGACG GGCGCGTCGG

1851 GTACGATGTG CAGTATATGA ACAAGGACGA GCTGATTGCC GACATTTTGA

1901 AAAACTACGA ACGTTATTTG ATGTTGTTGG ATGATGTCGG TCAGGAACTG

1951 ATGGCGCACG AGCAGGTGGA ATTGGCAGAG TAA
```

This corresponds to the amino acid sequence <SEQ ID 678; ORF 163.a>:

```
a163.pep

  1 MVILTTLFFV CVLVVLVLTV PDQVQMWLDR AKEVIFTEFS WFYVLTFSIF

 51 LGFLLILSVS SLGNIRLGRD EDVPEFGFLS WLAMLFAAGM GVGLMFFGVA

101 EPLMHYFSDI TAGTPEHRQQ QALLHTVFHW GVHAWSVYGT IALALAYFGF

151 RYKLPLALRS CFYPLLKEKI SGRFGDAIDI MALLATFFGI ITTLGFGASQ

201 LGAGLQEIGW IAENSFSVQV LIIAAVMSLA VVSAISGVGK GVKVLSELNL

251 GLAFLLLFFV LAAGPTVYLL SAFGDNIGNY LGNLVRLSFK TYAYEREHKP

301 WFESWTVLYW AWWCSWAPFV GLFIARISKG RTIREFVFGV LLIPGLFGVL

351 WFTVFGNTAI WLNDGVAGGV LEKMTSSPET LLFKFFNYLP LPELTSIVSL

401 LVISLFFVTS ADSGIYVLNN ITSRDKGLSA PRWQAVMWGV LMSAVAVLLM

451 RSGGLGNLQS MTLIVSLPFA LLMLIMCFSL WKGLSADKKY FETRVNPTSV

501 FWTGGKWKER LVQIMSQTQE QDILKFLKHT ASPAMHELQR ELSEEYGLSV

551 RVDKMFHQDE PAIEFVIRKE TMRDFMYGIK SVGQDVSDQL INDGKLPHIR

601 HQTTYKPYAY FFDGRVGYDV QYMNKDELIA DILKNYERYL MLLDDVGQEL

651 MAHEQVELAE *
```

```
m163/a163    99.4% identity in 660 aa overlap

                    10        20        30        40        50        60
m163.pep    MVILTTLFFVCVLVVLVLTVPDQVQMWLDRAKEVIFTEFSWFYVLTFSIFLGFLLILSVS
            ||||||||||||||||||||||||||||||||||||||||||||||||||||||||||||
a163        MVILTTLFFVCVLVVLVLTVPDQVQMWLDRAKEVIFTEFSWFYVLTFSIFLGFLLILSVS
                    10        20        30        40        50        60

                    70        80        90       100       110       120
m163.pep    SLGNIRLGRDEDVPEFGFLSWLAMLFAAGMGVGLMFFGVAEPLMHYFSDITAGTPEHRQQ
            ||||||||||||||||||||||||||||||||||||||||||||||||||||||||||||
a163        SLGNIRLGRDEDVPEFGFLSWLAMLFAAGMGVGLMFFGVAEPLMHYFSDITAGTPEHRQQ
                    70        80        90       100       110       120

                   130       140       150       160       170       180
m163.pep    QALLHTVFHWGVHAWSVYGTIALALAYFGFRYKLPLALRSCFYPLLKEKISGRFGDAIDI
            ||||||||||||||||||||||||||||||||||||||||||||||||||||||||||||
a163        QALLHTVFHWGVHAWSVYGTIALALAYFGFRYKLPLALRSCFYPLLKEKISGRFGDAIDI
                   130       140       150       160       170       180
```

-continued

```
                 190       200       210       220       230       240
m163.pep   MALLATFFGIITTLGFGASQLGAGLQEMGWIAENSFSVQVLIIAAVMSLAVVSAISGVGK
           |||||||||||||||||||||||||||:||||||||||||||||||||||||||||||||
a163       MALLATFFGIITTLGFGASQLGAGLQEIGWIAENSFSVQVLIIAAVMSLAVVSAISGVGK
                 190       200       210       220       230       240

                 250       260       270       280       290       300
m163.pep   GVKVLSELNLGLAFLLLFFVLAAGPTVYLLSAFGDNIGNYLGNLVRLSFKTYAYEREHKP
           ||||||||||||||||||||||||||||||||||||||||||||||||||||||||||||
a163       GVKVLSELNLGLAFLLLFFVLAAGPTVYLLSAFGDNIGNYLGNLVRLSFKTYAYEREHKP
                 250       260       270       280       290       300

                 310       320       330       340       350       360
m163.pep   WFESWTVLYWAWWCSWAPFVGLFIARISKGRTIREFVFGVLLIPGLFGVLWFTVFGNTAI
           ||||||||||||||||||||||||||||||||||||||||||||||||||||||||||||
a163       WFESWTVLYWAWWCSWAPFVGLFIARISKGRTIREFVFGVLLIPGLFGVLWFTVFGNTAI
                 310       320       330       340       350       360

                 370       380       390       400       410       420
m163.pep   WLNDGVAGGMLEKMTSSPETLLFKFFNYLPLPELTSIVSLLVISLFFVTSADSGIYVLNN
           |||||||||:||||||||||||||||||||||||||||||||||||||||||||||||||
a163       WLNDGVAGGVLEKMTSSPETLLFKFFNYLPLPELTSIVSLLVISLFFVTSADSGIYVLNN
                 370       380       390       400       410       420

                 430       440       450       460       470       480
m163.pep   ITSRDKGLSAPRWQAVMWGVLMSAVAVLLMRSGGLGNLQSMTLIVSLPFALLMLIMCFSL
           ||||||||||||||||||||||||||||||||||||||||||||||||||||||||||||
a163       ITSRDKGLSAPRWQAVMWGVLMSAVAVLLMRSGGLGNLQSMTLIVSLPFALLMLIMCFSL
                 430       440       450       460       470       480

                 490       500       510       520       530       540
m163.pep   WKGLSADKKYFETRVNPTSVFWTGGKWKERLVQIMSQTQEQDILKFLKQTASPAMHELQR
           ||||||||||||||||||||||||||||||||||||||||||||||||:|||||||||||
a163       WKGLSADKKYFETRVNPTSVFWTGGKWKERLVQIMSQTQEQDILKFLKHTASPAMHELQR
                 490       500       510       520       530       540

                 550       560       570       580       590       600
m163.pep   ELSEEYGLSVRVDKMFHRDEPAIEFVIRKETMRDFMYGIKSVGQDVSDQLINDGKLPHIR
           |||||||||||||||||:||||||||||||||||||||||||||||||||||||||||||
a163       ELSEEYGLSVRVDKMFHQDEPAIEFVIRKETMRDFMYGIKSVGQDVSDQLINDGKLPHIR
                 550       560       570       580       590       600

                 610       620       630       640       650       660
m163.pep   HQTTYKPYAYFFDGRVGYDVQYMNKDELIADILKNYERYLMLLDDVGQELMAHEQVELAE
           ||||||||||||||||||||||||||||||||||||||||||||||||||||||||||||
a163       HQTTYKPYAYFFDGRVGYDVQYMNKDELIADILKNYERYLMLLDDVGQELMAHEQVELAE
                 610       620       630       640       650       660

m163.pep   X
           |
a163       X
```

The following partial DNA sequence was identified in *N. gonorrhoeae* <SEQ ID 679>:

```
g164.seq (partial)
   1 . . . ATGAACACAT TTTTGAAAAA CAGCGAATAC GCGTATATCC TGAACGACTG

  51       CAAGGCGCGC TTCCTGTTCG CCTCGGCCGG CCTGTCAAAA GAATTGGCGG

 101       GCCTGAAGGC GCAAACGCCC GTCGAAAAAA TCATTTGGAC GGACAAAAGC

 151       CGGCCGGCCG GCGAAACGGC GGAAGGCGAT GCCTTTTTTG AAAACGTGCG

 201       CCGCTTCCCC GAAAAACCCG ACTTGGGCCG CCAACCCCGG ATAAATGATT

 251       TGGCACACAT CATCTACACC TCCGGCACGA CGGGGCATCC CAAAGGCGCG

 301       CTAATCAGTT ACGCCAACCT GTTCGCCAAC CTGAACGGCA TCGAACGCAT

 351       CTTtaaAATT TCCAAACGCG ACCGCTTTAT CGTTTTCctg ccgatgTTCC

 401       ACAGCTTCAC GCTGACGGCT ATGGTGCTGC TGCCGATTTA TATGGCGTGT

 451       TCGATTATTT TGGTCAAAtc cgttttCCCc ttttccaacG TTTTGAAACA

 501       GGCCCTGCTC AAACGCGCAA CCGTGTTTTT GGGCGTACCC GCGATTTACA

 551       CCGCGATGAG CAAGGCAAAA ATCCCTTGGT ATTTCAGATG GTTCAACCGC

 601       ATCCGCCTGT TTATCAGCGG CGGCGCGCCT TTGGCGGAAC AAACCATCCT

 651       CGATTTTAAA GCCAAGTTCC CCCGCGCCAA ATTGCTGGAA GGCTACGGAC
```

-continued

```
 701       TGAGCGAAGC CTCGCCCGTC GTCGCCGTCA ATACGCCCGA ACGGCAAAAA

 751       GCCCGCAGCG TCGGCATCCC CCTGCCCGGT TTGGAAGCCA AAGCCGTCGA

 801       TGAAGAATTG GTCGAAGTGC CGCGCGGCGA AGTGGGCGAA CTGATCGTCA

 851       GGGGCGGTTC GGTGATGCGG GGCTACCTCA ATATGCCTGC CGCCACCGAT

 901       GAAACCATCG TCAACGGCTG GTTGAAAACG GGCGATTTCG TTACCATAGA

 951       CGAGGACGGC TTTATCTTTA TCGTCGACCG CAAAAAAGAT TTGATTATTT

1001       CCAAAGGTCA AAACGTCTAT CCGCGCGAGA TCGAAGAAGA AATCCACAAA

1051       CTCGATGCCG TCGAAGCCGC CGCCGTCATC GGCGTGAAAG ACCGTTATGC

1101       CGACGAGGAA ATCGTCGCCT TCGTCCAATT GAAGGAAGGT ATGGATTTGG

1151       GCGAGGACGA aatccgccgc caccTGCGTA CCGTGCTGGC AAATTTCAAA

1201       ATCCCCAAAC AGATCCACTT TAAAGACGGG CTGCCGCGCA ACGCTACGGG

1251       CAAAGTATTG AAACGGGTGC TGAAGGAGCA GTTTGAAGGA AACAAATGA
```

This corresponds to the amino acid sequence <SEQ ID 680; ORF 164.ng>:

```
g164.pep (partial)
  1  . . . MNTFLKNSEY AYILNDCKAR FLFASAGLSK ELAGLKAQTP VEKIIWTDKS

 51        RPAGETAEGD AFFENVRRFP EKPDLGRQPR INDLAHIIYT SGTTGHPKGA

101        LISYANLFAN LNGIERIFKI SKRDRFIVFL PMFHSFTLTA MVLLPIYMAC

151        SIILVKSVFP FSNVLKQALL KRATVFLGVP AIYTAMSKAK IPWYFRWFNR

201        IRLFISGGAP LAEQTILDFK AKFPRAKLLE GYGLSEASPV VAVNTPERQK

251        ARSVGIPLPG LEAKAVDEEL VEVPRGEVGE LIVRGGSVMR GYLNMPAATD

301        ETIVNGWLKT GDFVTIDEDG FIFIVDRKKD LIISKGQNVY PREIEEEIHK

351        LDAVEAAAVI GVKDRYADEE IVAFVQLKEG MDLGEDEIRR HLRTVLANFK

401        IPKQIHFKDG LPRNATGKVL KRVLKEQFEG NK*
```

The following partial DNA sequence was identified in *N. meningitidis* <SEQ ID 681>:

```
m164.seq
  1 ATGAACCGGA CTTATGCCAA TTTCTACGAA ATGCTCGCCG CCGCCTGCCG

 51 CAAAAACGGA AACGGCACGG CAGTGTTCGA CGGCAAGGAA AAAACCGCCT

101 ACCGCGCGCT CAAGCAGGAG GCCGAAGCCG TCGCGGCGTA TCTGCAAAAT

151 ATCGGCGTGA AGTTCGGCGA CACGGTCGCG CTGGCGGTTT CCAATTCCAC

201 AGAATTTATT ACCGCCTATT TCGCCATCTC CGCCATCGGC GCGGTCGCCG

251 TACCGATGAA CACATTTTTG AAAAACAGCG AATACGCGTA TATCCTGAAC

301 GACTGCAAGG CGCGCTTCCT GTTCGCCTCG GCCGGCCTGT CAAAAGAATT

351 GGCGGGCTTG AAGGCGCAAA CGCCCGTCGA AAAAATCATT TGGACGGACA

401 AAAGCCGTCC GACCGGCGAA ACGGCGGAAG GCGATGCCTT TTTTGAAGAC

451 GTGCGCCGCT TCCCCGAAAA ACCCGACTTG GGCCGCCAAC CCCGGATAAA

501 TGATTTGGCA CACATCATCT ACACCTCCGG CACGACGGGG CATCCCAAAG

551 GCGCGCTAAT CAGTTACGCC AACCTGTTCG CCAACCTGAA CGGCATCGAA

601 CGCATCTTTA AAATTTCCAA GCGCGACCGC TTTATCGTTT TCCTGCCGAT
```

-continued

```
 651 GTTCCACAGC TTCACGCTGA CGGCTATGGT GCTGCTGCCG ATTTATATGG

 701 CGTGTTCGAT TATTTTGGTC AAATCCGTTT TTCCGTTTTC CAACGTTTTG

 751 AAACAGACAC TGCTCAAACG CGCGACCGTG TTTTTGGGCG TACCCGCGAT

 801 TTACACCGCG ATGAGCAAGG CGAAAATCCC TTGGTATTTC AGATGGTTCA

 851 ACCGCATTCG CCTGTTTATC AGCGGCGGCG CGCCTTTGGC GGAACAAACC

 901 ATCCTCGATT TCAAAGCCAA GTTCCCCCGC GCCAAATTGC TGGAAGGCTA

 951 CGGACTGAGC GAAGCCTCTC CCGTCGTCGC CGTCAATACG CCCGAGAGGC

1001 AAAAAGCCCG CAGCGTCGGC ATCCCCCTGC CCGGTTTGGA AGCCAAAGCC

1051 GTCGATGAAG AATTGGTCGA AGTGCCGCGC GGCGAAGTGG GCGAACTGAT

1101 CGTCAGGGGC GGTTCGGTGA TGCGGGGCTA CCTCAATATG CCTGCCGCCA

1151 CCGATGAAAC CATCGTCAAC GGCTGGTTGA AAACGGGCGA TTTCGTTACC

1201 ATAGACGAAG ACGGCTTTAT CTTTATCGTC GACCGCAAAA AAGATTTGAT

1251 TATTTCCAAA GGTCAAAATG TCTATCCGCG CGAGATTGAA GAAGAAATCT

1301 ACAAACTCGA TGCCGTCGAA GCCGCCGCCG TCATCGGCGT GAAAGACCGT

1351 TATGCCGACG AGGAAATCGT CGCCTTCGTC CAATTGAAGG AAGGTATGGA

1401 TTTGGGCGAG AACGAAATCC GCCGCCACCT GCGTACCGTG CTGGCAAATT

1451 TCAAAATCCC CAAACAAATC CACTTTAAAG ACGGGCTGCC GCGCAACGCT

1501 ACGGGCAAGG TATTGAAACG GGTGTTGAAG GAGCAGTTTG ACGGAAACAA

1551 ATGA
```

This corresponds to the amino acid sequence <SEQ ID 682; ORF 164>:

```
m164.pep
  1  MNRTYANFYE MLAAACRKNG NGTAVFDGKE KTAYRALKQE AEAVAAYLQN

 51  IGVKFGDTVA LAVSNSTEFI TAYFAISAIG AVAVPMNTFL KNSEYAYILN

101  DCKARFLFAS AGLSKELAGL KAQTPVEKII WTDKSRPTGE TAEGDAFFED

151  VRRFPEKPDL GRQPRINDLA HIIYTSGTTG HPKGALISYA NLFANLNGIE

201  RIFKISKRDR FIVFLPMFHS FTLTAMVLLP IYMACSIILV KSVFPFSNVL

251  KQTLLKRATV FLGVPAIYTA MSKAKIPWYF RWFNRIRLFI SGGAPLAEQT

301  ILDFKAKFPR AKLLEGYGLS EASPVVAVNT PERQKARSVG IPLPGLEAKA

351  VDEELVEVPR GEVGELIVRG GSVMRGYLNM PAATDETIVN GWLKTGDFVT

401  IDEDGFIFIV DRKKDLIISK GQNVYPREIE EEIYKLDAVE AAAVIGVKDR

451  YADEEIVAFV QLKEGMDLGE NEIRRHLRTV LANFKIPKQI HFKDGLPRNA

501  TGKVLKRVLK EQFDGNK*
```

Computer analysis of this amino acid sequence gave the following results:

Homology with a Predicted ORF from *N. gonorrhoeae* m164/g164 98.6% identity in 432 aa overlap

```
                  60        70        80        90       100       110
m164.pep GDTVALAVSNSTEFITAYFAISAIGAVAVPMNTFLKNSEYAYILNDCKARFLFASAGLSK
                                       ||||||||||||||||||||||||||||||
g164                                   MNTFLKNSEYAYILNDCKARFLFASAGLSK
                                               10        20        30
```

-continued

```
              120       130       140       150       160       170
m164.pep  ELACLKAQTPVEKIIWTDKSRPTCETAECDAFFEDVRRFPEKPDLCRQPRINDLAHIIYT
          ||||||||||||||||||||:||||||||||:|||||||||||||||||||||||||
g164      ELAGLKAQTPVEKIIWTDKSRPAGETAEGDAFFENVRRFPEKPDLGRQPRINDLAHIIYT
                  40        50        60        70        80        90

              180       190       200       210       220       230
m164.pep  SGTTGHPKGALISYANLFANLNGIERIFKISKRDRFIVFLPMFHSFTLTAMVLLPIYMAC
          ||||||||||||||||||||||||||||||||||||||||||||||||||||||||||||
g164      SGTTGHPKGALISYANLFANLNGIERIFKISKRDRFIVFLPMFHSFTLTAMVLLPIYMAC
                 100       110       120       130       140       150

              240       250       260       270       280       290
m164.pep  SIILVKSVFPFSNVLKQTLLKRATVFLGVPAIYTAMSKAKIPWYFRWFNRIRLFISGGAP
          ||||||||||||||||:|||||||||||||||||||||||||||||||||||||||||||
g164      SIILVKSVFPFSNVLKQALLKRATVFLGVPAIYTAMSKAKIPWYFRWFNRIRLFISGGAP
                 160       170       180       190       200       210

              300       310       320       330       340       350
m164.pep  LAEQTILDFKAKFPRAKLLEGYGLSEASPVVAVNTPERQKARSVGIPLPGLEAKAVDEEL
          ||||||||||||||||||||||||||||||||||||||||||||||||||||||||||||
g164      LAEQTILDFKAKFPRAKLLEGYGLSEASPVVAVNTPERQKARSVGIPLPGLEAKAVDEEL
                 220       230       240       250       260       270

              360       370       380       390       400       410
m164.pep  VEVPRGEVGELIVRGGSVMRGYLNMPAATDETIVNGWLKTGDFVTIDEDGFIFIVDRKKD
          ||||||||||||||||||||||||||||||||||||||||||||||||||||||||||||
g164      VEVPRGEVGELIVRGGSVMRGYLNMPAATDETIVNGWLKTGDFVTIDEDGFIFIVDRKKD
                 280       290       300       310       320       330

              420       430       440       450       460       470
m164.pep  LIISKGQNVYPREIEEEIYKLDAVEAAAVIGVKDRYADEEIVAFVQLKEGMDLGENEIRR
          ||||||||||||||||||:||||||||||||||||||||||||||||||||||||:||||
g164      LIISKGQNVYPREIEEEIHKLDAVEAAAVIGVKDRYADEEIVAFVQLKEGMDLGEDEIRR
                 340       350       360       370       380       390

              480       490       500       510
m164.pep  HLRTVLANFKIPKQIHFKDGLPRNATGKVLKRVLKEQFDGNKX
          |||||||||||||||||||||||||||||||||||||:||||
g164      HLRTVLANFKIPKQIHFKDGLPRNATGKVLKRVLKEQFEGNKX
                 400       410       420       430
```

The following partial DNA sequence was identified in *N. meningitidis* <SEQ ID 683>:

```
a164.seq
   1 ATGAACCGGA CTTATGCCAA TTTCTACGAA ATGCTGACCG CCGCCTGCCG

  51 CAAAAACGGC AACGGCACGG CAGTGTTCGA CGGCAAGGAA AAAACCGCCT

 101 ACCGCGCGCT CAAGCAGGAA GCCGAAGCCG TTGCGGCGTA TCTGCAAAAT

 151 ATCGGCGTGA AGTTCGGCGA CACGGTCGCG CTGGCGGTTT CCAATTCCAC

 201 GGAATTTATT ACCGCCTATT TCGCCGTATC CGCCATCGGC GCGGTTGCCG

 251 TACCGATGAA CACATTTTTG AAAAACAGCG AATACGCGTA TATCCTGAAC

 301 GACTGCAAGG CGCGCTTCCT GTTCGCCTCG GCCGGCCTGT CAAAAGAATT

 351 GGCGGGCTTG AAGGCGCAAA CGCCCGTCGA AAAAATCATT TGGACGGGCC

 401 AAAGCCGTCC GGACGGCGAA ATGGCGGAAG GCGATGCCTT TTTTGAAGAC

 451 GTGCGCCGCT TCCCCGAAAA ACCCGACTTG GGCCGCCAAC CCCGGATAAA

 501 TGATTTGGCA CACATCATCT ACACCTCCGG CACGACGGGG CATCCCAAAG

 551 GTGCGCTAAT CAGCTACGCC AACCTGTTCG CCAACCTGAA CGGCATCGAA

 601 CGCATCTTTA AAATCTCCAA GCGCGACCGC TTTATCGTTT TCCTGCCGAT

 651 GTTCCACAGC TTCACGCTGA CGGCTATGGT GCTGCTGCCG ATTTATATGG

 701 CGTGTTCGAT TATTTTGGTC AAATCCGTTT TCCCCTTTTC CAACGTTTTG

 751 AAACAGGCAC TGCTCAAACG CGCGACCGTG TTTTTGGGCG TGCCCGCGAT

 801 TTACACCGCG ATGAGCAAGA CGAAAATCCC TTGGTATTTC AGATGGTTCA

 851 ACCGCATCCG CCTGTTTATC AGCGGCGGAG CACCTTTGGC GGAACAAACC

 901 ATCCTCGATT TCAAAGCCAA GTTCCCCCGC GCCAAATTGC TGGAAGGCTA
```

-continued

```
 951 CGGACTGAGC GAAGCCTCGC CCGTCGTCGC CGTCAATACG CCCGAGAGGC
1001 AAAAAGCCCG CAGCGTCGGC ATCCCCCTGC CCGGTTTGGA AGTCAAAGCC
1051 GTCGATGAAG AATTGGTCGA AGTGCCGCGC GGCGAAGTGG GCGAACTGAT
1101 CGTCAGGGGC GGTTCGGTGA TGCGGGGCTA CCTCAATATG CCTGCCGCCA
1151 CCGATGAAAC CATCGTCAAC GGCTGGTTGA AAACGGGCGA TTTCGTTACC
1201 ATAGACGAAG ACGGCTTTAT CTTTATCGTC GACCGCAAAA AAGATTTGAT
1251 TATTTCCAAA GGTCAAAATG TCTATCCGCG CGAAATCGAA GAAGAAATCT
1301 ACAAACTCGA TGCCGTCGAA GCCGCCGCCG TCATCGGCGT GAAAGACCGT
1351 TATGCCGACG AGGAAATCGT CGCCTTCGTC CAATTGAAGG AAGGTATGGA
1401 TTTGGGCGAG AACGAAATCC GCCGCCACCT GCGTACCGTG CTGGCAAATT
1451 TCAAAATCCC CAAACAAATC CACTTTAAAG ACGGGCTGCC GCGCAACGCT
1501 ACGGGCAAGG TATTGAAACG GGTGTTGAAG GAGCAGTTTG ACGGAAACAA
1551 ATGA
```

This corresponds to the amino acid sequence <SEQ ID 684; ORF 164.a>:

```
a164.pep
      1 MNRTYANFYE MLTAACRKNG NGTAVFDGKE KTAYRALKQE AEAVAAYLQN
     51 IGVKFGDTVA LAVSNSTEFI TAYFAVSAIG AVAVPMNTFL KNSEYAYILN
    101 DCKARFLFAS AGLSKELAGL KAQTPVEKII WTGQSRPDGE MAEGDAFFED
    151 VRRFPEKPDL GRQPRINDLA HITYTSGTTG HPKGALISYA NLFANLNGIE
    201 RIFKISKRDR FIVFLPMFHS FTLTAMVLLP IYMACSIILV KSVFPFSNVL
    251 KQALLKRATV FLGVPAIYTA MSKTKIPWYF RWFNRIRLFI SGGAPLAEQT
    301 ILDFKAKFPR AKLLEGYGLS EASPVVAVNT PERQKARSVG IPLPGLEVKA
    351 VDEELVEVPR GEVGELIVRG GSVMRGYLNM PAATDETIVN GWLKTGDFVT
    401 IDEDGFIFIV DRKKDLIISK GQNVYPREIE EEIYKLDAVE AAAVIGVKDR
    451 YADEEIVAFV QLKEGMDLGE NEIRRHLRTV LANFKIPKQI HFKDGLPRNA
    501 TGKVLKRVLK EQFDGNK*

m164/a164    98.3% identity in 517 aa overlap

                    10        20        30        40        50        60
m164.pep    MNRTYANFYEMLAAACRKNGNGTAVFDGKEKTAYRALKQEAEAVAAYLQNIGVKFGDTVA
            ||||||||||||:|||||||||||||||||||||||||||||||||||||||||||||||
a164        MNRTYANFYEMLTAACRKNGNGTAVFDGKEKTAYRALKQEAEAVAAYLQNIGVKFGDTVA
                    10        20        30        40        50        60

                    70        80        90       100       110       120
m164.pep    LAVSNSTEFITAYFAISAIGAVAVPMNTFLKNSEYAYILNDCKARFLFASAGLSKELAGL
            |||||||||||||||:||||||||||||||||||||||||||||||||||||||||||||
a164        LAVSNSTEFITAYFAVSAIGAVAVPMNTFLKNSEYAYILNDCKARFLFASAGLSKELAGL
                    70        80        90       100       110       120

                   130       140       150       160       170       180
m164.pep    KAQTPVEKIIWTDKSRPTGETAEGDAFFEDVRRFPEKPDLGRQPRINDLAHITYTSGTTG
            |||||||||||| :||| || |||||||||||||||||||||||||||||||||||||||
a164        KAQTPVEKIIWTGQSPRDGEMAEGDAFFEDVRRFPEKPDLGRQPRINDLAHIIYTSGTTG
                   130       140       150       160       170       180

                   190       200       210       220       230       240
m164.pep    HPKGALISYANLFANLNGIERIFKISKRDRFIVFLPMFHSFTLTAMVLLPIYMACSIILV
            ||||||||||||||||||||||||||||||||||||||||||||||||||||||||||||
a164        HPKGALISYANLFANLNGIERIFKISKRDRFIVFLPMFHSFTLTAMVLLPIYMACSIILV
                   190       200       210       220       230       240
```

-continued

```
                      250       260       270       280       290       300
m164.pep    KSVFPFSNVLKQTLLKRATVFLGVPAIYTAMSKAKIPWYFRWFNRIRLFISGGAPLAEQT
            ||||||||||||:||||||||||||||||||||:||||||||||||||||||||||||||
a164        KSVFPFSNVLKQALLKRATVFLGVPAIYTAMSKTKIPWYFRWFNRIRLFISGGAPLAEQT
                      250       260       270       280       290       300

                      310       320       330       340       350       360
m164.pep    ILDFKAKFPRAKLLEGYGLSEASPVVAVNTPERQKARSVGIPLPGLEAKAVDEELVEVPR
            |||||||||||||||||||||||||||||||||||||||||||||||:||||||||||||
a164        ILDFKAKFPRAKLLEGYGLSEASPVVAVNTPERQKARSVGIPLPGLEVKAVDEELVEVPR
                      310       320       330       340       350       360

                      370       380       390       400       410       420
m164.pep    GEVGELIVRGGSVMRGYLNMPAATDETIVNGWLKTGDFVTIDEDGFIFIVDRKKDLIISK
            ||||||||||||||||||||||||||||||||||||||||||||||||||||||||||||
a164        GEVGELIVRGGSVMRGYLNMPAATDETIVNGWLKTGDFVTIDEDGFIFIVDRKKDLIISK
                      370       380       390       400       410       420

                      430       440       450       460       470       480
m164.pep    GQNVYPREIEEEIYKLDAVEAAAVIGVKDRYADEEIVAFVQLKEGMDLGENEIRRHLRTV
            ||||||||||||||||||||||||||||||||||||||||||||||||||||||||||||
a164        GQNVYPREIEEEIYKLDAVEAAAVIGVKDRYADEEIVAFVQLKEGMDLGENEIRRHLRTV
                      430       440       450       460       470       480

                      490       500       510
m164.pep    LANFKIPKQIHFKDGLPRNATGKVLKRVLKEQFDGNKX
            ||||||||||||||||||||||||||||||||||||||
a164        LANFKIPKQIHFKDGLPRNATGKVLKRVLKEQFDGNKX
                      490       500       510
```

The following partial DNA sequence was identified in *N. gonorrhoeae* <SEQ ID 685>:

```
g165.seq
   1 ATGGCTGAAG CGACAGACGT TGTCTTGGTG GGCGGCGGCA TTATGAGCGC

  51 GACTTTGGGC GTTTTGCTCA AAGAACTCGA ACCGTCTTGG GAAATCACCC

 101 TGATTGAACG CTTGGAagat gTGGCGTTGG AATCGTCAAA cGCGTGGAAC

 151 AACGcCGgca CGGGGCATTC CGcGCTGTGc GAATTGAACT AtgcgccGCT

 201 GGGtgcggac ggcgtcatCA ATCCGGCGCg cgCCCTGAAT ATTGCCGAAC

 251 AGTTTCATGT CAGCCGCCAG TTTTGGGcga cgctgGTCGC GGAAGGCAAG

 301 TTGGAagaCA ATTCCTTCAT CAATGCcgtg ccgcatatGT Ctttggtgat

 351 gAacgaagac cactgCCgtt acCTGCAAAA ACGCTATGAT GTGTTTAAAA

 401 CGCAGAAACT TTTTGAAAAT ATGGAATTTT CCACCGATCG GAACAAAATT

 451 TCCGATTGGG CtccgCTGAT TATGCGCGGC CGGgacgaaA ACCAACCCGT

 501 CGCCGCCAAC TATTCCGCCG Aaggcacgga tgtcgATTTC GGACGGCTGA

 551 CGCGCCAGAT GGTGAAATAT TTGCAGGGCA AGGGCGTAAA AACCGAGTTC

 601 AACCGCCACG TCGAAGACAT CAAACGCGAA TCCGACGGCG CGTGGGTGCT

 651 CAAAACCGCC GATACCCGCA ACCCAGACTG GCAGCTCACC CTCCGCACCC

 701 GCTTCCTCTT CCTCGGCGCG GGCGGCGGCG CACTGACCCT GCTGCAAAAA

 751 TCCGGCATCC CCGAAGGCAA AGGCTACGGC GGCTTACCCG TGTCCGGCCT

 801 GTTCTTCCGC AACAGCAACC CCGAAACCGC CGAACAACAC AACGCCAAAG

 851 TGTACGGGCA GGCTTCCGTC GGCGCGCCGC CGATGTCCGT CCCGCACCTC

 901 GACACACGCA ACGTAGACGG CAAACGACAC CTTATGTTCG GTCCTTACGC

 951 AGGTTTCCGT TCCAACTTCC TCAAGCAAGG CTCGTTTATG GATTTGCCGC

1001 TGTCCATCCA TATGGACAAC CTCTATCCTA TGCTGCGCGC CGGCTGGGCG

1051 AATATGCCGC TGACCAAATA CcTGCTGGgC gAaTTGCgtt aa
```

This corresponds to the amino acid sequence <SEQ ID 686; ORF 165.ng>:

```
g165.pep
  1  MAEATDVVLV GGGIMSATLG VLLKELEPSW EITLIERLED VALESSNAWN

 51  NAGTGHSALC ELNYAPLGAD GVINPARALN IAEQFHVSRQ FWATLVAEGK

101  LEDNSFINAV PHMSLVMNED HCRYLQKRYD VFKTQKLFEN MEFSTDRNKI

151  SDWAPLIMRG RDENQPVAAN YSAEGTDVDF GRLTRQMVKY LQGKGVKTEF

201  NRHVEDIKRE SDGAWVLKTA DTRNPDWQLT LRTRFLFLGA GGGALTLLQK

251  SGIPEGKGYG GLPVSGLFFR NSNPETAEQH NAKVYGQASV GAPPMSVPHL

301  DTRNVDGKRH LMFGPYAGFR SNFLKQGSFM DLPLSIHMDN LYPMLRAGWA

351  NMPLTKYLLG ELR*
```

The following partial DNA sequence was identified in *N. meningitidis* <SEQ ID 687>:

```
m165.seq (partial)
   1 ATGGCTGAAG CGACAGACGT TGTCTTGGTG GGCGGCGGCA TTATGAGCGC

  51 GACTTTGGGC GTTTTGCTCA AAGAACTCGA ACCGTCTTGG GAAATCACCC

 101 TGATTGAACG CTTGGAAGAT GTGGCGTTGG AATCGTCAAA CGCGTGGAAC

 151 AACGCCGGCA CGGGGCATTC CGCGCTGTGC GAATTGAACT ATGCGCCGTT

 201 GGGTGCAAAT GGGATTATCG ATCCGGCGCG CGCCCTCAAT ATTGCCGAAC

 251 AGTTTCATGT CAGCCGCCAG TTTTGGGCGA CGCTGGTCGC GGAAGGCAAG

 301 TTGGAAGACA ATTCCTTCAT CAATGCCGTG CCGCATATGT CTTTGGTGAT

 351 GAATGAAGAC CATTGTTCTT ATCTTCAAAA ACGTTATGAC GCGTTTAAAA

 401 CCCAAAAACT TTTTGAAAAT ATGGAATTTT CCACCGATCG GAACAAAATT

 451 TCCGATTGGG CTCCGCTGAT GATGCGCGGC CGGGACGAAA ACCAACCCGT

 501 CGCCGCCAAC TACTCCGCCG AAGgTACGGA TGTCGATTTC GGACGGCTGA

 551 CGCGCCAAAT GGTGAAATAT TTGCAGGGCA AGGGCGTAAA AACCGAGTTC

 601 AACCGCCACG TCGAAGACAT CAAACGCGAA TCCGACGGCG CGTGGGTGCT

 651 CAAAACCGCC GATACCCGCA ACCCCGACGG GCAGCTCACC CTCCGTACCC

 701 GCTTCCTCTT CCTCGGCGCG GGCGGCGGCG CGCTGACCCT GCTGCAAAAA

 751 TCCGGCATCC CCGAAGGCAA AGGCTACGGC GGCTTCCCCG TGTCCGGCCT

 801 GTTCTTCCGC AACAGCAACC CCGAAACCGC CGAACAACAC AACGCCAAAG

 851 TGTACGGGCA GGCTTCCGTC GGCGCGCCGC CGATGTCCGT CCCGCACCTC

 901 GACACACGCA ACGTGGACGG CAAACGCCAC CTTATGTTCG GCCCTTACGC

 951 AGGCTTCCGT TCCAACTTCC TCAAGCAAGG CTCGCTTATG GATTTGCCGC

1001 TGTCCATCCA TATGGACAAC CTCTATCCTA TGCTGTGCGC CGGCTGGGCG

1051 AATATGCCGC TGACCAAA . . .
```

This corresponds to the amino acid sequence <SEQ ID 688; ORF 165>:

```
m165.pep (partial)
  1  MAEATDVVLV GGGIMSATLG VLLKELEPSW EITLIERLED VALESSNAWN

 51  NAGTGHSALC ELNYAPLGAN GIIDPARALN IAEQFHVSRQ FWATLVAEGK
```

-continued

```
101  LEDNSFINAV PHMSLVMNED HCSYLQKRYD AFKTQKLFEN MEFSTDRNKI

151  SDWAPLMMRG RDENQPVAAN YSAEGTDVDF GRLTRQMVKY LQGKGVKTEF

201  NRHVEDIKRE SDGAWVLKTA DTRNPDGQLT LRTRFLFLGA GGGALTLLQK

251  SGIPEGKGYG GFPVSGLFFR NSNPETAEQH NAKVYGQASV GAPPMSVPHL

301  DTRNVDGKRH LMFGPYAGFR SNFLKQGSLM DLPLSIHMDN LYPMLCAGWA

351  NMPLTK . . .
```

Computer analysis of this amino acid sequence gave the following results:

Homology with a Predicted ORF from *N. gonorrhoeae*

```
m165/g165    97.2% identity in 356 aa overlap

                     10        20        30        40        50        60
m165.pep     MAEATDVVLVGGGIMSATLGVLLKELEPSWEITLIERLEDVALESSNAWNNAGTGHSALC
             ||||||||||||||||||||||||||||||||||||||||||||||||||||||||||||
g165         MAEATDVVLVGGGIMSATLGVLLKELEPSWEITLIERLEDVALESSNAWNNAGTGHSALC
                     10        20        30        40        50        60

                     70        80        90       100       110       120
m165.pep     ELNYAPLGANGIIDPARALNIAEQFHVSRQFWATLVAEGKLEDNSFINAVPHMSLVMNED
             |||||||||:|:|:||||||||||||||||||||||||||||||||||||||||||||||
g165         ELNYAPLGADGVINPARALNIAEQFHVSRQFWATLVAEGKLEDNSFINAVPHMSLVMNED
                     70        80        90       100       110       120

                    130       140       150       160       170       180
m165.pep     HCSYLQKRYDAFKTQKLFENMEFSTDRNKISDWAPLMMRGRDENQPVAANYSAEGTDVDF
             || |||||||:|||||||||||||||||||||||||:|||||||||||||||||||||||
g165         HCRYLQKRYDVFKTQKLFENMEFSTDRNKISDWAPLIMRGRDENQPVAANYSAEGTDVDF
                    130       140       150       160       170       180

                    190       200       210       220       230       240
m165.pep     GRLTRQMVKYLQGKGVKTEFNRHVEDIKRESDGAWVLKTADTRNPDGQLTLRTRFLFLGA
             |||||||||||||||||||||||||||||||||||||||||||||| |||||||||||||
g165         GRLTRQMVKYLQGKGVKTEFNRHVEDIKRESDGAWVLKTADTRNPDWQLTLRTRFLFLGA
                    190       200       210       220       230       240

                    250       260       270       280       290       300
m165.pep     GGGALTLLQKSGIPEGKGYGGFPVSGLFFRNSNPETAEQHNAKVYGQASVGAPPMSVPHL
             |||||||||||||||||||||:|||||||||||||||||||||||| |||||||||||||
g165         GGGALTLLQKSGIPEGKGYGGLPVSGLFFRNSNPETAEQHNAKVYGQASVGAPPMSVPHL
                    250       260       270       280       290       300

                    310       320       330       340       350
m165.pep     DTRNVDGKRHLMFGPYAGFRSNFLKQGSLMDLPLSIHMDNLYPMLCAGWANMPLTK
             ||||||||||||||||||||||||||||:|||||||||||||||| ||||||||||
g165         DTRNVDGKRHLMFGPYAGFRSNFLKQGSFMDLPLSIHMDNLYPMLRAGWANMPLTKYLLG
                    310       320       330       340       350       360

g165         ELRX
```

The following partial DNA sequence was identified in *N. meningitidis* <SEQ ID 689>:

```
a165.seq
   1  ATGGCTGAAG CGACAGACGT TGTCTTGGTG GGCGGCGGCA TTATGAGCGC

  51  GACTTTGGGC GTTTTGCTCA AAGAACTCGA ACCGTCTTGG GAAATCACCC

 101  TGATTGAACG CTTGGAAGAT GTGGCGTTGG AATCGTCAAA CGCGTGGAAC

 151  AACGCCGGCA CGGGGCATTC CGCGCTGTGC GAATTGAACT ATGCGCCGTT

 201  GGGTGCAAAT GGGATTATCG ATCCGGCGCG CGCCCTCAAT ATTGCCGAAC

 251  AGTTTCATGT CAGCCGCCAG TTTTGGGCGA CGTTGGTCGC GGAAGGCAAG

 301  TTGGAAGACA ATTCCTTCAT CAATGCCGTG CCGCATATGT CTTTGGTGAT

 351  GAATGAAGAC CATTGTTCTT ATCTTCAAAA ACGTTATGAC GCGTTTAAAA

 401  CCCAAAAACT TTTTGAAAAT ATGGAATTTT CCACCGATCG GAACAAAATT

 451  TCCGATTGGG CTCCGCTGAT GATGCGCGGC CGGGACGAAA ACCAACCCGT
```

-continued

```
 501 CGCCGCCAAC TACTCCGCCG AAGGCACGGA TGTCGATTTC GGACGGCTGA
 551 CGCGCCAAAT GGTGAAATAT TTGCAGGGCA AGGGCGTAAA AACCGAGTTC
 601 AACCGCCACG TCGAAGACAT CAAACGCGAA TCCGACGGCG CGTGGGTGCT
 651 CAAAACCGCC GATACCCGCA ACCCCGACGG GCAGCTCACC CTCCGTACCC
 701 GCTTCCTCTT CCTCGGCGCG GGCGGCGGCG CGCTGACCCT GCTGCAAAAA
 751 TCCGGCATCC CCGAAGGCAA AGGCTACGGT GGCTTTCCCG TGTCCGGCCT
 801 GTTCTTCCGC AACAGCAACC CCGAAACCGC CGAACAACAC AACGCCAAAG
 851 TGTACGGGCA GGCTTCCGTC GGCGCGCCGC CGATGTCCGT CCCGCACCTC
 901 GACACACGCA ACGTGGACGG CAAACGCCAC CTTATGTTCG GCCCTTACGC
 951 AGGCTTCCGT TCCAACTTCC TCAAGCAAGG CTCACTTATG GATTTGCCGC
1001 TGTCCATCCA TATGGACAAC CTCTATCCTA TGCTGCGCGC CGGCTGGGCG
1051 AATATGCCGC TGACCAAATA CCTGCTGGGC GAATTGCGTA AAACCAAAGA
1101 AGAACGCTTC GCCTCCCTGC TGGAATACTA CCCCGAGGCA AACCCCGACG
1151 ACTGGGAACT CATCACCGCA GGGCAACGCG TTCAAATCAT TAAAAAAGAC
1201 TCCGAAAAAG GCGGCGTGTT GCAGTTTGGT ACGGAGATTG TCGCACACGC
1251 CGACGGCTCG CTCGCCGCAT TGCTGGGCGC GTCGCCGGGC GCATCGACCG
1301 CCGTGCCGCT GATGATCCGG CTGATGCACC AATGCTTCCC CGAACGCACC
1351 CCGTCTTGGG AAGGCCGTCT GAAAGAGCTG GTACCGGGTT ACGGCATCAA
1401 GTTGAACGAA AACCCCGAAA GGGCGGATGA AATTATCGCC TATACCGCGA
1451 AAGTGTTGGA TATTTAA
```

This corresponds to the amino acid sequence <SEQ ID 690; ORF 165.a>:

```
a165.pep
      1 MAEATDVVLV GGGIMSATLG VLLKELEPSW EITLIERLED VALESSNAWN
     51 NAGTGHSALC ELNYAPLGAN GIIDPARALN IAEQFHVSRQ FWATLVAEGK
    101 LEDNSFINAV PHMSLVMNED HCSYLQKRYD AFKTQKLFEN MEFSTDRNKI
    151 SDWAPLMMRG RDENQPVAAN YSAEGTDVDF GRLTRQMVKY LQGKGVKTEF
    201 NRHVEDIKRE SDGAWVLKTA DTRNPDGQLT LRTRFLFLGA GGGALTLLQK
    251 SGIPEGKGYG GFPVSGLFFR NSNPETAEQH NAKVYGQASV GAPPMSVPHL
    301 DTRNVDGKRH LMFGPYAGFR SNFLKQGSLM DLPLSIHMDN LYPMLRAGWA
    351 NMPLTKYLLG ELRKTKEERF ASLLEYYPEA NPDDWELITA GQRVQIIKKD
    401 SEKGGVLQFG TEIVAHADGS LAALLGASPG ASTAVPLMIR LMHQCFPERT
    451 PSWEGRLKEL VPGYGIKLNE NPERADEIIA YTAKVLDI*
```

```
m165/a165  99.7% identity in 365 aa overlap

                   10        20        30        40        50        60
m165.pep   MAEATDVVLVGGGIMSATLGVLLKELEPSWEITLIERLEDVALESSNAWNNAGTGHSALC
           ||||||||||||||||||||||||||||||||||||||||||||||||||||||||||||
a165       MAEATDVVLVGGGIMSATLGVLLKELEPSWEITLIERLEDVALESSNAWNNAGTHGSALC
                   10        20        30        40        50        60

                   70        80        90       100       110       120
m165.pep   ELNYAPLGANGIIDPARALNIAEQFHVSRQFWATLVAEGKLEDNSFINAVPHMSLVMNED
           ||||||||||||||||||||||||||||||||||||||||||||||||||||||||||||
a165       ELNYAPLGANGIIDPARALNIAEQFHVSRQFWATLVAEGKLEDNSFINAVPHMSLVMNED
                   70        80        90       100       110       120
```

-continued

```
                 130        140        150        160        170        180
m165.pep   HCSYLQKRYDAFKTQKLFENMEFSTDRNKISDWARLMMRGRDENQPVAANYSAEGTDVDF
           ||||||||||||||||||||||||||||||||||||||||||||||||||||||||||||
a165       HCSYLQKRYDAFKTQKLFENMEFSTDRNKISDWARLMMRGRDENQPVAANYSAEGTDVDF
                 130        140        150        160        170        180

                 190        200        210        220        230        240
m165.pep   GRLTRQMVKYLQGKGVKTEFNRHVEDIKRESDGAWVLKTADTRNPDGQLTLRTRFLFLGA
           ||||||||||||||||||||||||||||||||||||||||||||||||||||||||||||
a165       GRLTRQMVKYLQGKGVKTEFNRHVEDIKRESDGAWVLKTADTRNPDGQLTLRTRFLFLGA
                 190        200        210        220        230        240

                 250        260        270        280        290        300
m165.pep   GGGALTLLQKSGIPEGKGYGGFPVSGLFFRNSNPETAEQHNAKVYGQASVGAPPMSVPHL
           ||||||||||||||||||||||||||||||||||||||||||||||||||||||||||||
a165       GGGALTLLQKSGIPEGKGYGGFPVSGLFFRNSNPETAEQHNAKVYGQASVGAPPMSVPHL
                 250        260        270        280        290        300

                 310        320        330        340        350
m165.pep   DTRNVDGKRHLMFGPYAGFRSNFLKQGSLMDLPLSIHMDNLYPMLRAGWANMPLTK
           ||||||||||||||||||||||||||||||||||||||||||||||||||||||||
a165       DTRNVDGKRHLMFGPYAGFRSNFLKQGSLMDLPLSIHMDNLYPMLRAGWANMPLTKYLLG
                 310        320        330        340        350        360

a165       ELRKTKEERFASLLEYYPEANPDDWELITAGQRVQIIKKDSEKGGVLQFGTEIVAHADGS
                 370        380        390        400        410        420
```

The following partial DNA sequence was identified in *N. gonorrhoeae* <SEQ ID 691>:

```
g165-1.seq
   1 ATGGCTGAAG CGACAGACGT TGTCTTGGTG GGCGGCGGCA TTATGAGCGC

  51 GACTTTGGGC GTTTTGCTCA AAGAACTCGA ACCGTCTTGG GAAATCACCC

 101 TGATTGAACG CTTGGAagat gTGGCGTTGG AATCGTCAAA cGCGTGGAAC

 151 AACGcCGgca CGGGGCATTC CGcGCTGTGc GAATTGAACT AtgcgccGCT

 201 GGGtgcggac ggcgtcatCA ATCCGGCGCg cgCCCTGAAT ATTGCCGAAC

 251 AGTTTCATGT CAGCCGCCAG TTTTGGGcga cgctggTCGC GGAAGGCAAG

 301 TTGGAAGACA ATTCCTTCAT CAATGCCGTG CCGCATATGT CTTTGGTGAT

 351 GAACGAAGAC CACTGCCGTT ACCTGCAAAA ACGCTATGAT GTGTTTAAAA

 401 CGCAGAAACT TTTTGAAAAT ATGGAATTTT CCACCGATCG GAACAAAATT

 451 TCCGATTGGG CtccgCTGAT TATGCGCGGC CGGGACGAAA ACCAACCCGT

 501 CGCCGCCAAC TATTCCGCCG AAGGCACGGA TGTCGATTTC GGACGGCTGA

 551 CGCGCCAGAT GGTGAAATAT TTGCAGGGCA AGGGCGTAAA AACCGAGTTC

 601 AACCGCCACG TCGAAGACAT CAAACGCGAA TCCGACGGCG CGTGGGTGCT

 651 CAAAACCGCC GATACCCGCA ACCCAGACTG GCAGCTCACC CTCCGCACCC

 701 GCTTCCTCTT CCTCGGCGCG GGCGGCGGCG CACTGACCCT GCTGCAAAAA

 751 TCCGGCATCC CCGAAGGCAA AGGCTACGGC GGCTTACCCG TGTCCGGCCT

 801 GTTCTTCCGC AACAGCAACC CCGAAACCGC CGAACAACAC AACGCCAAAG

 851 TGTACGGGCA GGCTTCCGTC GGCGCGCCGC CGATGTCCGT CCCGCACCTC

 901 GACACACGCA ACGTAGACGG CAAACGACAC CTTATGTTCG GTCCTTACGC

 951 AGGTTTCCGT TCCAACTTCC TCAAGCAAGG CTCGTTTATG GATTTGCCGC

1001 TGTCCATCCA TATGGACAAC CTCTATCCTA TGCTGCGCGC CGGCTGGGCG

1051 AATATGCCGC TGACCAAATA CCTGCTGGGC GAATTGCGTA AAACCAAAGA

1101 AGAACGCTtt gCCTCCCTGC TGgaatacta cccGaggcag acccGACGAc

1151 tggtactcat cacgcaggnc acGCGTcata tcattanata tgactCgaaa

1201 ctgcgcgtgc tgcagttgta cgagattgtg ccaCGCGacg ctcgctcgcg
```

-continued

```
1251 cattctggag cgtcgcggcg catcacgctn tgcgctgata tccgctgatg
1301 acactgctcc gaGCGcgccc gtcttggaaa gtgtctga
```

This corresponds to the amino acid sequence <SEQ ID 692; ORF 165-1.ng>:

```
g165-1.pep
  1  MAEATDVVLV GGGIMSATLG VLLKELEPSW EITLIERLED VALESSNAWN
 51  NAGTGHSALC ELNYAPLGAD GVINPARALN IAEQFHVSRQ FWATLVAEGK
101  LEDNSFINAV PHMSLVMNED HCRYLQKRYD VFKTQKLFEN MEFSTDRNKI
151  SDWAPLIMRG RDENQPVAAN YSAEGTDVDF GRLTRQMVKY LQGKGVKTEF
201  NRHVEDIKRE SDGAWVLKTA DTRNPDWQLT LRTRFLFLGA GGGALTLLQK
251  SGIPEGKGYG GLPVSGLFFR NSNPETAEQH NAKVYGQASV GAPPMSVPHL
301  DTRNVDGKRH LMFGPYAGFR SNFLKQGSFM DLPLSIHMDN LYPMLRAGWA
351  NMPLTKYLLG ELRKTKEERF ASLLEYYPRQ TRRLVLITQX TRHIIXYDSK
401  LRVLQLYEIV PRDARSRILE RRGASRXALI SADDTAPSAP VLESV*
```

The following partial DNA sequence was identified in *N. meningitidis* <SEQ ID 693>:

```
m165-1.seq
   1 ATGGCTGAAG CGACAGACGT TGTCTTGGTG GGCGGCGGCA TTATGAGCGC
  51 GACTTTGGGC GTTTTGCTCA AAGAACTCGA ACCGTCTTGG GAAATCACCC
 101 TGATTGAACG CTTGGAAGAT GTGGCGTTGG AATCGTCAAA CGCGTGGAAC
 151 AACGCCGGCA CGGGGCATTC CGCGCTGTGC GAATTGAACT ATGCGCCGTT
 201 GGGTGCAAAT GGGATTATCG ATCCGGCGCG CGCCCTCAAT ATTGCCGAAC
 251 AGTTTCATGT CAGCCGCCAG TTTTGGGCGA CGCTGGTCGC GGAAGGCAAG
 301 TTGGAAGACA ATTCCTTCAT CAATGCCGTG CCGCATATGT CTTTGGTGAT
 351 GAATGAAGAC CATTGTTCTT ATCTTCAAAA ACGTTATGAC GCGTTTAAAA
 401 CCCAAAAACT TTTTGAAAAT ATGGAATTTT CCACCGATCG GAACAAAATT
 451 TCCGATTGGG CTCCGCTGAT GATGCGCGGC CGGGACGAAA ACCAACCCGT
 501 CGCCGCCAAC TACTCCGCCG AAGGTACGGA TGTCGATTTC GGACGGCTGA
 551 CGCGCCAAAT GGTGAAATAT TTGCAGGGCA AGGGCGTAAA AACCGAGTTC
 601 AACCGCCACG TCGAAGACAT CAAACGCGAA TCCGACGGCG CGTGGGTGCT
 651 CAAAACCGCC GATACCCGCA ACCCCGACGG GCAGCTCACC CTCCGTACCC
 701 GCTTCCTCTT CCTCGGCGCG GGCGGCGGCG CGCTGACCCT GCTGCAAAAA
 751 TCCGGCATCC CCGAAGGCAA AGGCTACGGC GGCTTCCCCG TGTCCGGCCT
 801 GTTCTTCCGC AACAGCAACC CCGAAACCGC CGAACAACAC AACGCCAAAG
 851 TGTACGGGCA GGCTTCCGTC GGCGCGCCGC CGATGTCCGT CCCGCACCTC
 901 GACACACGCA ACGTGGACGG CAAACGCCAC CTTATGTTCG GCCCTTACGC
 951 AGGCTTCCGT TCCAACTTCC TCAAGCAAGG CTCGCTTATG GATTTGCCGC
1001 TGTCCATCCA TATGGACAAC CTCTATCCTA TGCTGTGCGC CGGCTGGGCG
1051 AATATGCCGC TGACCAAATA CCTGCTGGGC GAATTGCGTA AAACCAAAGA
1101 AGAACGCTTC GCCTCCCTGC TGGAATACTA CCCCGAGGCA AACCCCGACG
```

-continued

```
1151 ACTGGGAACT CATCACCGCA GGGCAACGCG TCCAAATCAT TAAAAAAGAC

1201 TCCGAAAAAG GCGGCGTGCT CCAGTTTGGT ACGGAGATTG TCGCCCACGC

1251 CGACGGCTCA CTCGCCGCAT TGCTGGGCGC GTCGCCGGGC GCATCGACCG

1301 CTGTGCCGCT GATGATCCGG CTGATGCACC AATGCTTCCC CGAGCGCGCC

1351 CCGTCTTGGG AAGACCGTCT GAAAGAGCTG GTACCGGGTT ACGGCATCAA

1401 GTTGAACGAA AACCCTGAAA GGGCGGATGA AATTATCGCC TATACCGCGA

1451 AAGTATTGGA TATTTAA
```

This corresponds to the amino acid sequence <SEQ ID 694; ORF 165-1>:

```
m165-1.PEP

      1 MAEATDVVLV GGGIMSATLG VLLKELEPSW EITLIERLED VALESSNAWN

     51 NAGTGHSALC ELNYAPLGAN GIIDPARALN IAEQFHVSRQ FWATLVAEGK

    101 LEDNSFINAV PHMSLVMNED HCSYLQKRYD AFKTQKLFEN MEFSTDRNKI

    151 SDWAPLMMRG RDENQPVAAN YSAEGTDVDF GRLTRQMVKY LQGKGVKTEF

    201 NRHVEDIKRE SDGAWVLKTA DTRNPDGQLT LRTRFLFLGA GGGALTLLQK

    251 SGIPEGKGYG GFPVSGLFFR NSNPETAEQH NAKVYGQASV GAPPMSVPHL

    301 DTRNVDGKRH LMFGPYAGFR SNFLKQGSLM DLPLSIHMDN LYPMLCAGWA

    351 NMPLTKYLLG ELRKTKEERF ASLLEYYPEA NPDDWELITA GQRVQIIKKD

    401 SEKGGVLQFG TEIVAHADGS LAALLGASPG ASTAVPLMIR LMHQCFPERA

    451 PSWEDRLKEL VPGYGIKLINE NPERADEIIA YTAKVLDI*
```

```
m165-1/g165-1 89.7% identity in 428 aa overlap

                      10        20        30        40        50        60
m165-1.pep    MAEATDVVLVGGGIMSATLGVLLKELEPSWEITLIERLEDVALESSNAWNNAGTGHSALC
              ||||||||||||||||||||||||||||||||||||||||||||||||||||||||||||
g165-1        MAEATDVVLVGGGIMSATLGVLLKELEPSWEITLIERLEDVALESSNAWNNAGTGHSALC
                      10        20        30        40        50        60

                      70        80        90       100       110       120
m165-1.PEP    ELNYAPLGANGIIDPARALNIAEQFHVSRQFWATLVAEGKLEDNSKINAVPHMSLVMNED
              |||||||||:|:|:||||||||||||||||||||||||||||||||| ||||||||||||||
g165-1        ELNYAPLGADGVINPARALNIAEQFHVSRQFWATLVAEGKLEDNSFINAVPHMSLVMNED
                      70        80        90       100       110       120

                     130       140       150       160       170       180
m165-1.pep    HCSYLQKRYDAFKTQKLFENMEFSTDRNKISDWAPLMMRGRDENQPVAANYSAEGTDVDF
              || |||||||:|||||||||||||||||||||||||:|||||||||||||||||||||||
g165-1        HCRYLQKRYDVFKTQKLFENMEFSTDRNKISDWAPLIMRGRDENQPVAANYSAEGTDVDF
                     130       140       150       160       170       180

                     190       200       210       220       230       240
m165-1.pep    GRLTRQMVKYLQGKGVKTEFNRHVEDIKRESDGAWVLKTADTRNPDGQLTLRTRFLFLGA
              |||||||||||||||||||||||||||||||||||||||||||||| |||||||||||||
g165-1        GRLTRQMVKYLQGKGVKTEFNRHVEDIKRESDGAWVLKTADTRNPDWQLTLRTRFLFLGA
                     190       200       210       220       230       240

                     250       260       270       280       290       300
m165-1.pep    GGGALTLLQKSGIPEGKGYGGFPVSGLFFRNSNPETAEQHNAKVYGQASVGAPPMSVPHL
              |||||||||||||||||||||:||||||||||||||||||||||||||||||||||||||
g165-1        GGGALTLLQKSGIPEGKGYGGLPVSGLFFRNSNPETAEQHNAKVYGQASVGAPPMSVPHL
                     250       260       270       280       290       300

                     310       320       330       340       350       360
m165-1.pep    DTRNVDGKRHLMFGPYAGFRSNFLKQGSLMDLPLSIHMDNLYPMLCAGWANMPLTKYLLG
              ||||||||||||||||||||||||||||:|||||||||||||||| ||||||||||||||
g165-1        DTRNVDGKRHLMFGPYAGFRSNFLKQGSFMDLPLSIHMDNLYPMLRAGWANMPLTKYLLG
                     310       320       330       340       350       360

                     370       380       390       400       410       420
m165-1.pep    ELRKTKEERFASLLEYYPEANPDDWELITAGQRVQIIKKDSEKGGVLQFGTEIVAHADGS
              |||||||||||||||||: :      |||   | :||  || |  |||:   :   | :
g165-1        ELRKTKEERFASLLEYYRR-QTRRLVLITQXTR-HIIXYDS-KLRVLQLYEIVPRDARSR
                     370       380       390       400       410       420
```

-continued

```
                430        440        450        460        470        480
m165-1.pep   LAALLGASPGASTAVPLMIRLMHQCFPERAPSWEDRLKELVPGYGIKLNENPERADEIIA
             :    |||
g165-1       ILERRGASRXALISADDTAPSAPVLESVX
             420        430        440
```

The following partial DNA sequence was identified in *N. meningitidis* <SEQ ID 695>:

```
a165-1.seq
   1 ATGGCTGAAG CGACAGACGT TGTCTTGGTG GGCGGCGGCA TTATGAGCGC

  51 GACTTTGGGC GTTTTGCTCA AAGAACTCGA ACCGTCTTGG GAAATCACCC

 101 TGATTGAACG CTTGGAAGAT GTGGCGTTGG AATCGTCAAA CGCGTGGAAC

 151 AACGCCGGCA CGGGGCATTC CGCGCTGTGC GAATTGAACT ATGCGCCGTT

 201 GGGTGCAAAT GGGATTATCG ATCCGGCGCG CGCCCTCAAT ATTGCCGAAC

 251 AGTTTCATGT CAGCCGCCAG TTTTGGGCGA CGTTGGTCGC GGAAGGCAAG

 301 TTGGAAGACA ATTCCTTCAT CAATGCCGTG CCGCATATGT CTTTGGTGAT

 351 GAATGAAGAC CATTGTTCTT ATCTTCAAAA ACGTTATGAC GCGTTTAAAA

 401 CCCAAAAACT TTTTGAAAAT ATGGAATTTT CCACCGATCG GAACAAAATT

 451 TCCGATTGGG CTCCGCTGAT GATGCGCGGC CGGGACGAAA ACCAACCCGT

 501 CGCCGCCAAC TACTCCGCCG AAGGCACGGA TGTCGATTTC GGACGGCTGA

 551 CGCGCCAAAT GGTGAAATAT TTGCAGGGCA AGGGCGTAAA AACCGAGTTC

 601 AACCGCCACG TCGAAGACAT CAAACGCGAA TCCGACGGCG CGTGGGTGCT

 651 CAAAACCGCC GATACCCGCA ACCCCGACGG GCAGCTCACC CTCCGTACCC

 701 GCTTCCTCTT CCTCGGCGCG GGCGGCGGCG CGCTGACCCT GCTGCAAAAA

 751 TCCGGCATCC CCGAAGGCAA AGGCTACGGT GGCTTTCCCG TGTCCGGCCT

 801 GTTCTTCCGC AACAGCAACC CCGAAACCGC CGAACAACAC AACGCCAAAG

 851 TGTACGGGCA GGCTTCCGTC GGCGCGCCGC CGATGTCCGT CCCGCACCTC

 901 GACACACGCA ACGTGGACGG CAAACGCCAC CTTATGTTCG GCCCTTACGC

 951 AGGCTTCCGT TCCAACTTCC TCAAGCAAGG CTCACTTATG GATTTGCCGC

1001 TGTCCATCCA TATGGACAAC CTCTATCCTA TGCTGCGCGC CGGCTGGGCG

1051 AATATGCCGC TGACCAAATA CCTGCTGGGC GAATTGCGTA AAACCAAAGA

1101 AGAACGCTTC GCCTCCCTGC TGGAATACTA CCCCGAGGCA AACCCCGACG

1151 ACTGGGAACT CATCACCGCA GGGCAACGCG TTCAAATCAT TAAAAAAGAC

1201 TCCGAAAAAG GCGGCGTGTT GCAGTTTGGT ACGGAGATTG TCGCACACGC

1251 CGACGGCTCG CTCGCCGCAT TGCTGGGCGC GTCGCCGGGC GCATCGACCG

1301 CCGTGCCGCT GATGATCCGG CTGATGCACC AATGCTTCCC CGAACGCACC

1351 CCGTCTTGGG AAGGCCGTCT GAAAGAGCTG GTACCGGGTT ACGGCATCAA

1401 GTTGAACGAA AACCCCGAAA GGGCGGATGA AATTATCGCC TATACCGCGA

1451 AAGTGTTGGA TATTTAA
```

This corresponds to the amino acid sequence <SEQ ID 696; ORF 165-1.a>:

```
a165-1.pep

      1  MAEATDVVLV GGGIMSATLG VLLKELEPSW EITLIERLED VALESSNAWN

     51  NAGTGHSALC ELNYAPLGAN GIIDPARALN IAEQFHVSRQ FWATLVAEGK

    101  LEDNSFINAV PHMSLVMNED HCSYLQKRYD AFKTQKLFEN MEFSTDRNKI

    151  SDWAPLMMRG RDENQPVAAN YSAEGTDVDF GRLTRQMVKY LQGKGVKTEF

    201  NRHVEDIKRE SDGAWVLKTA DTRNPDGQLT LRTRFLFLGA GGGALTLLQK

    251  SGIPEGKGYG GFPVSGLFFR NSNPETAEQH NAKVYGQASV GAPPMSVPHL

    301  DTRNVDGKRH LMFGPYAGFR SNFLKQGSLM DLPLSIHMDN LYPMLRAGWA

    351  NMPLTKYLLG ELRKTKEERF ASLLEYYPEA NPDDWELITA GQRVQIIKKD

    401  SEKGGVLQFG TEIVAHADGS LAALLGASPG ASTAVPLMIR LMHQCFPERT

    451  PSWEGRLKEL VPGYGIKLNE NPERADEIIA YTAKVLDI*

a165-1/m165-1  99.4% identity in 488 aa overlap

                     10        20        30        40        50        60
a165-1.pep    MAEATDVVLVGGGIMSATLGVLLKELEPSWEITLIERLEDVALESSNAWNNAGTGHSALC
              ||||||||||||||||||||||||||||||||||||||||||||||||||||||||||||
m165-1        MAEATDVVLVGGGIMSATLGVLLKELEPSWEITLIERLEDVALESSNAWNNAGTGHSALC
                     10        20        30        40        50        60

                     70        80        90       100       110       120
a165-1.pep    ELNYAPLGANGIIDPARALNIAEQFHVSRQFWATLVAEGKLEDNSFINAVPHMSLVMNED
              ||||||||||||||||||||||||||||||||||||||||||||||||||||||||||||
m165-1        ELNYAPLGANGIIDPARALNIAEQFHVSRQFWATLVAEGKLEDNSFINAVPHMSLVMNED
                     70        80        90       100       110       120

                    130       140       150       160       170       180
a165-1.pep    HCSYLQKRYDAFKTQKLFENMEFSTDRNKISDWAPLMMRGRDENQPVAANYSAEGTDVDF
              ||||||||||||||||||||||||||||||||||||||||||||||||||||||||||||
m165-1        HCSYLQKRYDAFKTQKLFENMEFSTDRNKISDWAPLMMRGRDENQPVAANYSAEGTDVDF
                    130       140       150       160       170       180

                    190       200       210       220       230       240
a165-1.pep    GRLTRQMVKYLQGKGVKTEFNRHVEDIKRESDGAWVLKTADTRNPDGQLTLRTRFLFLGA
              ||||||||||||||||||||||||||||||||||||||||||||||||||||||||||||
m165-1        GRLTRQMVKYLQGKGVKTEFNRHVEDIKRESDGAWVLKTADTRNPDGQLTLRTRFLFLGA
                    190       200       210       220       230       240

                    250       260       270       280       290       300
a165-1.pep    GGGALTLLQKSGIPEGKGYGGFPVSGLFFRNSNPETAEQHNAKVYGQASVGAPPMSVPHL
              ||||||||||||||||||||||||||||||||||||||||||||||||||||||||||||
m165-1        GGGALTLLQKSGIPEGKGYGGFPVSGLFFRNSNPETAEQHNAKVYGQASVGAPPMSVPHL
                    250       260       270       280       290       300

                    310       320       330       340       350       360
a165-1.pep    DTRNVDGKRHLMFGPYAGFRSNFLKQGSLMDLPLSIHMDNLYPMLRAGWANMPLTKYLLG
              |||||||||||||||||||||||||||||||||||||||||||||| |||||||||||||
m165-1        DTRNVDGKRHLMFGPYAGFRSNFLKQGSLMDLPLSIHMDNLYPMLCAGWANMPLTKYLLG
                    310       320       330       340       350       360

                    370       380       390       400       410       420
a165-1.pep    ELRKTKEERFASLLEYYPEANPDDWELITAGQRVQIIKKDSEKGGVLQFGTEIVAHADGS
              ||||||||||||||||||||||||||||||||||||||||||||||||||||||||||||
m165-1        ELRKTKEERFASLLEYYPEANPDDWELITAGQRVQIIKKDSEKGGVLQFGTEIVAHADGS
                    370       380       390       400       410       420

                    430       440       450       460       470       480
a165-1.pep    LAALLGASPGASTAVPLMIRLMHQCFPERTPSWEGRLKELVPGYGIKLNENPERADEIIA
              |||||||||||||||||||||||||||||:|||| |||||||||||||||||||||||||
m165-1        LAALLGASPGASTAVPLMIRLMHQCFPERAPSWEDRLKELVPGYGIKLNENPERADEIIA
                    430       440       450       460       470       480

                   489
a165-1.pep    YTAKVLDIX
              |||||||||
m165-1        YTAKVLDIX

a165-1 (SEQ ID 696)/p33940 (SEQ ID 4164)
 sp|P33940|YOJH_ECOLI HYPOTHETICAL 60.2 KD PROTEIN IN ECO-ALKB INTERGENIC
REGION >gi|1736851|gln|PID|d1016718 (D90850) ORF_ID:o372#5; similar to
[SwissProt Accession Number P33940] [Escherichia coli] >gi|1788539 (AE000310)
f548; This 548 aa ORF is 100 pct identical to 490 residues of
YOJH_ECOLI SW: P33940 (492 aa) but contains 56 additional N-ter aa; 100 pct
identical to GB: ECOHU49_33
ACCESSION: U00008 (490 aa) but contains 58 aditional N-term resi... Length = 548
 Score = 458 bits (1167), Expect = e-128
 Identities = 233/490 (47%), Positives = 303/490 (61%), Gaps = 5/490 (1%)
```

-continued

```
Query:   3  EATDVVLVGGGIMSATLGVLLKELEPSWEITLIERLEDVALESSNAWNNAGTGHSALCEL   62
            + TDV+L+GGGIMSATLG  L+ELEP W +T++ERLE VA ESSN WNNAGTGHSAL EL
Sbjct:  30  QETDVLLIGGGIMSATLGTYLRELEPEWSMTMVERLEGVAQESSNGWNNAGTGHSALMEL   89

Query:  63  NYAPLGANGIIDPARALNIAEQFHVSRQFWATLVAEGKLED-NSFINAVPHMSLVMNEDH  121
            NY P  A+G I   +A+ I E F +SRQFWA  V  G L    SFIN VPHMS V  ED+
Sbjct:  90  NYTPQNADGSISIEKAVAINEAFQISRQFWAHQVERGVLRTPRSFINTVPHMSFVWGEDN  149

Query: 122  CSYLQKRYDAFKTQKLFENMEFSTDRNKISDWAPLMMRGRDENQPVAANYSAEGTDVDFG  181
             ++L+ RY A +   LF  M +S D  +I +WAPL+M GRD  Q VAA  +  GTDV++G
Sbjct: 150  VNFLRARYAALQQSSLFRGMRYSEDHAQIKEWAPLVMEGRDPQQKVAATRTEIGTDVNYG  209

Query: 182  RLTRQMVKYLQGKG-VKTEFNRHVEDIKRESDGAWVLKTADTRNPDGQLTXXXXXXXXXX  240
             +TRQ++  LQ K     + +  V  +KR  D  W +  AD +N   Q
Sbjct: 210  EITRQLIASLQKKSNFSLQLSSEVRALKRNDDNTWTVTVADLKNGTAQ-NIRAKFVFIGA  268

Query: 241  XXXXXXXXQKSGIPEGKGYGGFPVSGLFFRNSNPETAEQHNAKVYGQASVGAPPMSVPHL  300
                    Q+SGIPE K Y GFPV G F  + NP+     H AKVYG+ASVGAPPMSVPH+
Sbjct: 269  GGAALKLLQESGIPEAKDYAGFPVGGQFLVSENPDVVNHHLAKVYGKASVGAPPMSVPHI  328

Query: 301  DTRNVDGKRHLMFGPYAGFRSNFLKQGSLMDLPLSIHMDNLYPMLRAGWANMPLTKYLLG  360
            DTR +DGKR ++FGP+A F + FLK GSL DL  S    N+ PM+  G  N  L KYL+
Sbjct: 329  DTRVLDGKRVVLFGPFATFSTKFLKNGSLWDLMSSTTTSNVMPMMHVGLDNFDLVKYLVS  388

Query: 361  ELRKTKEERFASLLEYYPEANPDDWELITAGQRVQIIKKDSEKGGVLQFGTEIVXXXXXX  420
            ++  ++E+RF +L EYYP+A  +DW L  AGQRVQIIK+D+EDGGVL+ GTE+V
Sbjct: 389  QVMLSEEDRFEALKEYYPQAKKEDWRLWQAGQRVQIIKRDAEKGGVLRLGTEVVSDQQGT  448

Query: 421  XXXXXXXXXXXXXXVPLMIRLMHQCFPER--TPSWEGRLKELVPGYGIKLNENPERADEI  478
                          P+M+ L+ + F +R  +P W+  LK +VP YG KLN +    +
Sbjct: 449  IAALLGASPGASTAAPIMLNLLEKVFGDRVSSPQWQATLKAIVPSYGRKLNGDVAATERE  508

Query: 479  IAYTAKVLDI                                                    488
            + YT++VL +
Sbjct: 509  LQYTSEVLGL                                                    518
```

The following partial DNA sequence was identified in *N. gonorrhoeae* <SEQ ID 697>:

```
g204.seq
  1  atggcggcgg cggaaataaa acgccccctc gctgtcgatt tccagcacat

 51  agcgtccgtt ctgcacggcg gcatagccgc ttttgcctgc ctgatagggt

101  tgcagggcgg aatgcgaaat caggtaatca gtcagtttgc cgccgtcttc

151  ggcgatattg cccaccagtt tggcaaacaa ggtatggcac acgccgtttt

201  ccgcccagcc cgaaggcgcg tcctttccgt cggtttccat acatttgccg

251  acgacggctt ccaagtcgtt gggatgcttt ccggtcagcc ggacggcgtt

301  ttgttccggc aagcctttaa tcggataact gatttgtttt ttgccgtcgt

351  tggttttgcc ttcgctactt tgtcccaaag ccaaaccggc aatcgccgta

401  ttgtcgatgt atttgacttt gaaaaccggt ttcggcgcgc tttgtgccgc

451  atttgcggc  tgttccgccg tattttcgga tttgccgcag gcggcaagca

501  gcaggcagcc gcccaacacg gcaaaaggta ttttcagcat tccgcactcc

551  tgatggtttc aaaatgccgt ctgaaatgcc gtctgaaacg tggcaggcgg

601  aggttcggac ggcattgggt ttatttcaac gggcggatgc cgaccgcatc

651  gcgtacttta tccaacaatt cgcgcgcttc tttgcgcgct ttttgcgcgc

701  ctgcctgcaa aatctcttcg atttgcgaag gattagaggt caatgcgttg

751  tag
```

This corresponds to the amino acid sequence <SEQ ID 698; ORF 204.ng>:

```
g204.pep
  1  MAAAEIKRPL AVDFQHIASV LHGGIAAFAC LIGLQGGMRN QVISQFAAVF

 51  GDIAHQFGKQ GMAHAVFRPA RRRVLSVGFH TFADDGFQVV GMLSGQPDGV

101  LFRQAFNRIT DLFFAVVGFA FATLSQSQTG NRRIVDVFDF ENRFRRALCR
```

-continued

```
151  ILRLFRRIFG FAAGGKQQAA AQHGKRYFQH SALLMVSKCR LKCRLKRGRR

201  RFGRHWVYFN GRMPTASRTL SNNSRASLRA FCAPACKISS ICEGLEVNAL

251  *
```

The following partial DNA sequence was identified in *N. meningitidis* <SEQ ID 699>:

```
m204.seq
  1  ATGGCGGCGG CGGAAATAAA ACGCCCCTTC GCTGTCGATT TCCAGCACAT

 51  AGCGTCCGTT CTGCACGGCG GCATAGCCGC TTTTGCCTGC CTGATAGGGT

101  TGCAGGGCGG CATGCGAAAC TAGGTAATCC GTCAGTTTGC CGCCGTCTTC

151  GGCGATATTG CCCACCAGTT TGGCAAACAA GGTATGGCAC ACGCCGTTTT

201  CTGCCCAACC TGCCGGACTG TCCTTATCAT CGGTTTCCAT ACATTTGCCG

251  CTGACGGCTT CCAAGTCGCC GGGATGCTTG CCGATCAGTC GGATAACATT

301  TTGTTCCGGC AAGCCTTTAA TCGGATAACT GATTTGTTTT TTGCCGTCGT

351  TGGTTTTGCC TTCGCTGCTT TGTCCCAAAT CCAAACCGGC AATCGCCGTA

401  TTGTCGATAT ATATGACTTT GAAAACCGGT TTCGGCGCGC TTTGTACCGC

451  GTTTTGCGGC TGTACCGCCG TATTTwCGGA TTTGCCGCaC GGCaArGCAG

501  CAGGCAGCCG CCCAATACGG CAAAArAwGT wTTCAGCATT CCACAyTCCT

551  GATGGTTTCA AAATGCCGTC TGAAACGCGG CAGGCGGAGG TTCGGACGGC

601  ATCGGGTTCA TTTCAACGGG CGGATGcCGA CCGCATCgGT ACTTTGTCCA

651  ATAATTCGCG TGCTTCTTTA CGCGCTTTCG CCGCGCCTGC CTGCAAAATC

701  TCTTCGATTT GCGAAGGGTC GGCGGTCAGC TCGTTGTAG
```

This corresponds to the amino acid sequence <SEQ ID 700; ORF 204>:

```
m204.pep
  1  MAAAEIKRPF AVDFQHIASV LHGGIAAFAC LIGLQGGMRN *VIRQFAAVF

 51  GDIAHQFGKQ GMAHAVFCPT CRTVLIIGFH TFAADGFQVA GMLADQSDNI

101  LFRQAFNRIT DLFFAVVGFA FAALSQIQTG NRRIVDIYDF ENRFRRALYR

151  VLRLYRRIXG FAATAXQQAA AQYGKXXXQH STXLMVSKCR LKRGRRRFGR

201  HRVHFNGRMP TASGTLSNNS RASLRAFAAP ACKISSICEG SAVSSL*
```

Computer analysis of this amino acid sequence gave the following results:

Homology with a Predicted ORF from *N. gonorrhoeae*

ORF 204 shows 82.0% identity over a 250 aa overlap with a predicted ORF (ORF 204.ng) from *N. gonorrhoeae*:

```
m204/g204

                    10        20        30        40        50        60
m204.pep    MAAAEIKRPFAVDFQHIASVLHGGIAAFACLIGLQGGMRNXVIRQFAAVFGDIAHQFGKQ
            |||||||||:|||||||||||||||||||||||||||||| || ||||||||||||||||
g204        MAAAEIKRPLAVDFQHIASVLHGGIAAFACLIGLQGGMRNQVISQFAAVFGDIAHQFGKQ
                    10        20        30        40        50        60

                    70        80        90       100       110       120
m204.pep    GMAHAVFCPTCRTVLIIGFHTFAADGFQVAGMLADQSDNILFRQAFNRITDLFFAVVGFA
            ||||||| |: | || :|||||| |||||:|||: | |::||||||||||||||||||||
g204        GMAHAVFRPARRRVLSVGFHTFADDGFQVVGMLSGQPDGVLFRQARNRITDLFFAVVGFA
                    70        80        90       100       110       120
```

-continued

```
                     130       140       150       160       170       180
m204.pep      FAALSQIQTGNRRIVDIYDFENRFRRALYRVLRLYRRIXGFAATAXQQAAAQYGKXXXQH
              ||:||| |||||||||::|||||||||| |:|||:||| |||| : |||||| ||   ||
g204          FATLSQSQTGNRRIVDVFDFENRFRRALCRILRLFRRIFGFAAGGKQQAAAQHGKRYFQH
                     130       140       150       160       170       180

                     190           200       210       220       230
m204.pep      STXLMVSKCRLK----RGRRRFGRHRVHFNGRMPTASGTLSNNSRASLRAFAAPACKISS
              |: |||||||||    ||||||||| |:||||||||| ||||||||||||| ||||||||
g204          SALLMVSKCRLKCRLKRGRRRFGRHWVYFNGRMPTASRTLSNNSRASLRAFCAPACKISS
                     190       200       210       220       230       240

               240
m204.pep      ICEGSAVSSLX
              ||||  |::|
g204          ICEGLEVNAL
                     250
```

The following partial DNA sequence was identified in *N. meningitidis* <SEQ ID 701>:

```
a204.seq
  1  ATGGCGGCGG CGGAAATAAA ACGCCCCCTC GCTGTCGATT TCCAGCACAT

 51  AGCGTCCGTT CTGCACGGCG GCATAGCCGC TTTTGCCTGC CTGATAGGGT

101  TGCAGGGCGG AATGCGAAAT CAGGTAATCC GTCAGTTTGC CGCCGTCTTC

151  GGCGATATTG CCCACCAGTT TGGCAAACAA GGTATGGCAC ACGCCGTTTG

201  CCGGTCAGCC CGAAGGCGCG CCCTTTCCGT CGGTTTCCAT ACATTTGCCG

251  ACGACGGCTT CCAAGTCGTT GGGATGCTTG CCGGTCAGCC GGACGACGTT

301  TTGTTCCGGC AAGCCTTT.. .......... .......... ..........

351  .......... .......... .......... .......... ..........

401  .......... .......... .......... .......... ..........

451  .......... .......... .......... .......... ..........

501  .......... .......... .......... .......... ..........

551  .......... .......... .......... .....AAGAG GTTCGGACGG

601  CATTGGGTTT ATTTCAACGG GCGGATACCG ACCGCATCAC GTACTTTGCC

651  CAATAATTCG CGTGCTTCTT TACGCGCTTT TTGCGCGCCT GCCTGCAAAA

701  TCTCTTCGAT TTGCGAAGGG TCGGCGGTCA GCTCGTTGTA G
```

This corresponds to the amino acid sequence <SEQ ID 702; ORF 204.a>:

```
a204.pep
  1  MAAAEIKRPL AVDFQHIASV LHGGIAAFAC LIGLQGGMRN QVIRQFAAVF

 51  GDIAHQFGKQ GMAHAVCRPA RRRALSVGFH TFADDGFQVV GMLAGQPDDV

101  LFRQAF.... .......... .......... .......... ..........

151  .......... .......... .......... .......... .....KRFGR

201  HWVYFNGRIP TASRTLPNNS RASLRAFCAP ACKISSICEG SAVSSL*
```

m204/a204 54.5% identity in 246 aa overlap

```
                       10        20        30        40        50        60
m204.pep      MAAAEIKRPFAVDFQHIASVLHGGIAAFACLIGLQGGMRNXVIRQFAAVFGDIAHQFGKQ
              |||||||||:|||||||||||||||||||||||||||||| |||||||||||||||||||
a204          MAAAEIKRPLAVDFQHIASVLHGGIAAFACLIGLQGGMRNQVIRQFAAVFGDIAHQFGKQ
                       10        20        30        40        50        60
```

-continued

```
                    70        80        90       100       110       120
m204.pep    GMAHAVFCPTCRTVLIIGFHTFAADGFQVAGMLADQSDNILFRQAFNRITDLFFAVVGFA
            ||||||  |: | :| :|||||| |||||:|||| | |::||||||||||||||||||||
a204        GMAHAVCRPARRRALSVGFHTFADDGFQVVGMLAGQPDGVLFRQAR--------------
                    70        80        90       100

                   130       140       150       160       170       180
m204.pep    FAALSQIQTGNRRIVDIYDFENRFRRALYRVLRLYRRIXGFAATAXQQAAAQYGKXXXQH

a204        ------------------------------------------------------------

                   190       200       210       220       230       240
m204.pep    STXLMVSKCRLKRGRRRFGRHRVHFNGRMPTASGTLSNNSRASLRAFAAPACKISSICEG
                           :||||| |:||||:|||| || |||||||||| |||||||||||
a204        ---------------KRFGRHWVYFNGRIPTASRTLPNNSRASLRAFCAPACKISSICEG
                          110       120       130       140       150

m204.pep    SAVSSLX
            |||||||
a204        SAVSSLX
```

The following partial DNA sequence was identified in *N. gonorrhoeae* <SEQ ID 703>:

```
g205.seq
  1   atgctgaaaa taccttttgc cgtgttgggc ggctgcctgc tgcttgccgc

 51   ctgcggcaaa tccgaaaata cggcggaaca gccgcaaaat gcggcacaaa

101   gcgcgccgaa accggttttc aaagtcaaat acatcgacaa tacggcgatt

151   gccggtttgg ctttgggaca aagtagcgaa ggcaaaacca acgacggcaa

201   aaaacaaatc agttatccga ttaaaggctt gccggaacaa aacgccgtcc

251   ggctgaccgg aaagcatccc aacgacttgg aagccgtcgt cggcaaatgt

301   atggaaaccg acggaaagga cgcgccttcg ggctgggcgg aaaacggcgt

351   gtgccatacc ttgtttgcca aactggtggg caatatcgcc gaagacggcg

401   gcaaactgac tgattacctg atttcgcatt ccgccctgca accctatcag

451   gcaggcaaaa gcggctatgc cgccgtgcag aacggacgct atgtgctgga

501   aatcgacagc gagggggcgt tttatttccg ccgccgccat tattga
```

This corresponds to the amino acid sequence <SEQ ID 704; ORF 205.ng>:

```
g205.pep
  1   MLKIPFAVLG GCLLLAACGK SENTAEQPQN AAQSAPKPVF KVKYIDNTAI

 51   AGLALGQSSE GKTNDGKKQI SYPIKGLPEQ NAVRLTGKHP NDLEAVVGKC

101   METDGKDAPS GWAENGVCHT LFAKLVGNIA EDGGKLTDYL ISHSALQPYQ

151   AGKSGYAAVQ NGRYVLEIDS EGAFYFRRRH Y
```

The following partial DNA sequence was identified in *N. meningitidis* <SEQ ID 705>:

```
m205.seq
  1   ATGCTGAAwA CwTyTTTTGC CGTATTGGGC GGCTGCCTGC TGCyTtGCCG

 51   tGCGGCAAAT CCGwAAATAC GGCGGTACAG CCGCAAAACG CGGTACAAAG

101   CGCGCCGAAA CCGGTTTTCA AAGTCATATA TATCGACAAT ACGGCGATTG

151   CCGGTTTGGA TTTGGGACAA AGCAGCGAAG GCAAAACCAA CGACGGCAAA

201   AAACAAATCA GTTATCCGAT TAAAGGCTTG CCGGAACAAA ATGTTATCCG

251   ACTGATCGGC AAGCATCCCG GCGACTTGGA AGCCGTCAGC GGCAAATGTA
```

-continued

```
301  TGGAAACCGA TGATAAGGAC AGTCCGGCAG GTTGGGCAGA AAACGGCGTG

351  TGCCATACCT TGTTTGCCAA ACTGGTGGGC AATATCGCCG AAGACGGCGG

401  CAAACTGACG GATTACCTAG TTTCGCATGC CGCCCTGCAA CCCTATCAGG

451  CAGGCAAAAG CGGCTATGCC GCCGTGCAGA ACGGACGCTA TGTGCTGGAA

501  ATCGACAGCG AAGGGGCGTT TTATTTCCGC CGCCGCCATT ATTGA
```

This corresponds to the amino acid sequence <SEQ ID 706; ORF 205>:

```
m205.pep
  1  MLXTXFAVLG GCLLXCRCGK SXNTAVQPQN AVQSAPKPVF KVIYIDNTAI

 51  AGLDLGQSSE GKTNDGKKQI SYPIKGLPEQ NVIRLIGKHP GDLEAVSGKC

101  METDDKDSPA GWAENGVCHT LFAKLVGNIA EDGGKLTDYL VSHAALQPYQ

151  AGKSGYAAVQ NGRYVLEIDS EGAFYFRRRH Y*
```

Computer analysis of this amino acid sequence gave the following results:

Homology with a Predicted ORF from *N. gonorrhoeae*

ORF 205 shows 88.4% identity over a 181 aa overlap with a predicted ORF (ORF 205.ng) from *N. gonorrhoeae*:

```
m205/g205

                    10        20        30        40        50        60
m205.pep    MLXTXFAVLGGCLLXCRCGKSXNTAVQPQNAVQSAPKPVFKVIYIDNTAIAGLDLGQSSE
            ||   |||||||||   |||| ||| |||||:|||||||||| |||||||||| ||||||
g205        MLKIPFAVLGGCLLLAACGKSENTAEQPQNAAQSAPKPVFKVKYIDNTAIAGLALGQSSE
                    10        20        30        40        50        60

                    70        80        90       100       110       120
m205.pep    GKTNDGKKQISYPIKGLPEQNVIRLIGKHPGDLEAVSGKCMETDDKDSPAGWAENGVCHT
            |||||||||||||||||||||::|| ||||:||||| ||||||| ||:|:||||||||||
g205        GKTNDGKKQISYPIKGLPEQNAVRLTGKHPNDLEAVVGKCMETDGKDAPSGWAENGVCHT
                    70        80        90       100       110       120

                   130       140       150       160       170       180
m205.pep    LFAKLVGNIAEDGGKLTDYLVSHAALQPYQAGKSGYAAVQNGRYVLEIDSEGAFYFRRRH
            ||||||||||||||||||||:||:||||||||||||||||||||||||||||||||||||
g205        LFAKLVGNIAEDGGKLTDYLISHSALQPYQAGKSGYAAVQNGRYVLEIDSEGAFYFRRRH
                   130       140       150       160       170       180

m205.pep    YX
            |
g205        Y
```

The following partial DNA sequence was identified in *N. meningitidis* <SEQ ID 707>:

```
a205.seq (partial)
  1  TCCGAACCTC TTAAAGGCTT GCCGGAACAA AACGTCGTCC GGCTGACCGG

 51  CAAGCATCCC AACGACTTGG AAGCCGTCGT CGGCAAATGT ATGGAAACCG

101  ACGGAAAGGG CGCGCCTTCG GGCTGGGCGG CAAACGGCGT GTGCCATACC

151  TTGTTTGCCA AACTGGTGGG CAATATCGCC GAAGACGGCG GCAAACTGAC

201  GGATTACCTG ATTTCGCATT CCGCCCTGCA ACCCTATCAG GCAGGCAAAA

251  GCGGCTATGC CGCCGTGCAG AACGGACGCT ATGTGCTGGA AATCGACAGC

301  GAGGGGGCGT TTTATTTCCG CCGCCGCCAT TATTGA
```

This corresponds to the amino acid sequence <SEQ ID 708; ORF 205.a>:

```
a205.pep (partial)
   1 SEPLKGLPEQ NVVRLTGKHP NDLEAVVGKC METDGKGAPS GWAANGVCHT

  51 LFAKLVGNIA EDGGKLTDYL ISHSALQPYQ AGKSGYAAVQ NGRYVLEIDS

 101 EGAFYFRRRH Y*
```

m205/a205 88.3% identity in 111 aa overlap

```
                  50        60        70        80        90       100
m205.pep   KVIYIDNTAIAGLDLGQSSEGKTNDGKKQISYPIKGLPEQNVIRLIGKHPGDLEAVSGKC
                                           | |:|||||||:|| ||||:||||| |||
a205                                       SEPLKGLPEQNVVRLTGKHPNDLEAVVGKC
                                                   10        20        30

                 110       120       130       140       150       160
m205.pep   METDDKDSPAGWAENGVCHTLFAKLVGNIAEDGGKLTDYLVSHAALQPYQAGKSGYAAVQ
           |||| | :|:||| |||||||||||||||||||||||||:||:|||||||||||||||
a205       METDGKGAPSGWAANGVCHTLFAKLVGNIAEDGGKLTDYLISHSALQPYQAGKSGYAAVQ
                   40        50        60        70        80        90

                 170       180
m205.pep   NGRYVLEIDSEGAFYFRRRHYX
           ||||||||||||||||||||||
a205       NGRYVLEIDSEGAFYFRRRHYX
                 100       110
```

The following partial DNA sequence was identified in *N. gonorrhoeae* <SEQ ID 709>:

```
g205-1.seq (partial)
   1 ATGCTGAAAA TAcCTTTTGC CGTGTTGGGC GGCTGCCTGC TGCTTGCCGC

  51 CTGCGGCAAA TCCGAAAATA CGGCGGAACA GCCGCAAAAT GCGGCACAAA

 101 GCGCGCCGAA ACCGGTTTTC AAAGTCAAAT ACATCGACAA TACGGCGATT

 151 GCCGGTTTGG CTTTGGGACA AAGTAGCGAA GGCAAAACCA ACGACGGCAA

 201 AAAACAAATC AGTTATCCGA TTAAAGGCTT GCCGGAACAA AACGCCGTCC

 251 GGCTGACCGG AAAGCATCCC AACGACTTGG AAGCCGTCGT CGGCAAATGT

 301 ATGGAAACCG ACGGAAAGGA CGCGCCTTCG GGCTGGGCGG AAAACGGCGT

 351 GTGCCATACC TTGTTTGCCA AACTGGTGGG CAATATCGCC GAAGACGGCG

 401 GCAAACTGAC TGATTACCTG ATTTCGCATT CCGCCCTGCA ACCCTATCAG

 451 GCAGGCAAAA GCGGCTATGC CGCCGTGCAG AACGGACGCT ATGTGCTGGA

 501 AATCGACAGC GAGGGGGCGT TTTA
```

This corresponds to the amino acid sequence <SEQ ID 710; ORF 205-1.ng>:

```
g205-1.pep (partial).
   1 MLKIPFAVLG GCLLLAACGK SENTAEQPQN AAQSAPKPVF KVKYIDNTAI

  51 AGLALGQSSE GKTNDGKKQI SYPIKGLPEQ NAVRLTGKHP NDLEAVVGKC

 101 METDGKDAPS GWAENGVCHT LFAKLVGNIA EDGGKLTDYL ISHSALQPYQ

 151 AGKSGYAAVQ NGRYVLEIDS EGAF
```

The following partial DNA sequence was identified in *N. meningitidis* <SEQ ID 711>:

```
m205-1.seq . . .
   1 ATGCTGAAAA CATCTTTTGC CGTATTGGGC GGCTGCCTGC TGCTTGCCGC

  51 CTGCGGCAAA TCCGAAAATA CGGCGGAACA GCCGCAAAAC GCGGTACAAA

 101 GCGCGCCGAA ACCGGTTTTC AAAGTCAAAT ATATCGACAA TACGGCGATT

 151 GCCGGTTTGG ATTTGGGACA AAGCAGCGAA GGCAAAACCA ACGACGGCAA

 201 AAAACAAATC AGTTATCCGA TTAAAGGCTT GCCGGAACAA AATGTTATCC

 251 GACTGATCGG CAAGCATCCC GGCGACTTGG AAGCCGTCAG CGGCAAATGT

 301 ATGGAAACCG ATGATAAGGA CAGTCCGGCA GGTTGGGCAG AAAACGGCGT

 351 GTGCCATACC TTGTTTGCCA AACTGGTGGG CAATATCGCC GAAGACGGCG

 401 GCAAACTGAC GGATTACCTA GTTTCGCATG CCGCCCTGCA ACCCTATCAG

 451 GCAGGCAAAA GCGGCTATGC CGCCGTGCAG AACGGACGCT ATGTGCTGGA

 501 AATCGACAGC GAAGGGCGT TTTATTTCCG CCGCCGCCAT TATTGA
```

This corresponds to the amino acid sequence <SEQ ID 712; ORF 205-1>:

```
m205-1.pep

     1   MLKTSFAVLG GCLLLAACGK SENTAEQPQN AVQSAPKPVF KVKYIDNTAI

    51   AGLDLGQSSE GKTNDGKKQI SYPIKGLPEQ NVIRLIGKHP GDLEAVSGKC

   101   METDDKDSPA GWAENGVCHT LFAKLVGNIA EDGGKLTDYL VSHAALQPYQ

   151   AGKSGYAAVQ NGRYVLEIDS EGAFYFRRRH Y*

m205/g205-1 92.0% identity in 174 aa overlap

                    10         20         30         40         50         60
   g205-1.pep  MLKIPFAVLGGCLLLAACGKSENTAEQPQNAAQSAPKPVFKVKYIDNTAIAGLALGQSSE
               |||  |||||||||||||||||||||||||| :||||||||||||||||||| | |||||
   m205-1      MLKTSFAVLGGCLLLAACGKSENTAEQPQNAVQSAPKPVFKVKYIDNTAIAGLDLGQSSE
                    10         20         30         40         50         60

                    70         80         90        100        110        120
   g205-1.pep  GKTNDGKKQISYPIKGLPEQNAVRLTGKHPNDLEAVVGKCMETDGKDAPSGWAENGVCHT
               ||||||||||||||||||||| ::||  ||||:|||||  ||||||  ||:|::||||||||
   m205-1      GKTNDGKKQISYPIKGLPEQNVIRLIGKHPGDLEAVSGKCMETDDKDSPAGWAENGVCHT
                    70         80         90        100        110        120

                   130        140        150        160        170
   g205-1.pep  LFAKLVGNIAEDGGKLTDYLISHSALQPYQAGKSGYAAVQNGRYVLEIDSEGAF
               |||||||||||||||||||| :||||||||||||||||||||||||||||||||
   m205-1      LFAKLVGNIAEDGGKLTDYLVSHAALQPYQAGKSGYAAVQNGRYVLEIDSEGAFYFRRRH
                   130        140        150        160        170        180
```

The following partial DNA sequence was identified in *N. meningitidis* <SEQ ID 713>:

```
a205-1.seq (partial)
   1 CCTCTTAAAG GCTTGCCGGA ACAAAACGTC GTCCGGCTGA CCGGCAAGCA

  51 TCCCAACGAC TTGGAAGCCG TCGTCGGCAA ATGTATGGAA ACCGACGGAA

 101 AGGGCGCGCC TTCGGGCTGG GCGGCAAACG GCGTGTGCCA TACCTTGTTT

 151 GCCAAACTGG TGGGCAATAT CGCCGAAGAC GGCGGCAAAC TGACGGATTA

 201 CCTGATTTCG CATTCCGCCC TGCAACCCTA TCAGGCAGGC AAAAGCGGCT

 251 ATGCCGCCGT GCAGAACGGA CGCTATGTGC TGGAAATCGA CAGCGAGGGG

 301 GCGTTTTATT TCCGCCGCCG CCATTATTGA
```

This corresponds to the amino acid sequence <SEQ ID 714; ORF 205-1.a>:

```
a205-1.pep (partial)

      1  PLKGLPEQNV VRLTGKHPND LEAVVGKCME TDGKGAPSGW AANGVCHTLF

     51  AKLVGNIAED GGKLTDYLIS HSALQPYQAG KSGYAAVQNG RYVLEIDSEG

    101  AFYFRRRHY*

 m205-1/a205-1  89.0% identity in 109 aa overlap

                        50        60        70        80        90       100
m205-1.pep      KYIDNTAIAGLDLGQSSEGKTNDGKKQISYPIKGLPEQNVIRLIGKHPGDLEAVSGKCME
                                              |:||||||||:|| ||||:||||| |||||
a205-1                                        PLKGLPEQNVVRLTGKHPNDLEAVVGKCME
                                                      10        20        30

                       110       120       130       140       150       160
m205-1.pep      TDDKDSPAGWAENGVCHTLFAKLVGNIAEDGGKLTDYLVSHAALQPYQAGKSGYAAVQNG
                || | :|:||| ||||||||||||||||||||||||||:||:||||||||||||||||||
a205-1          TDGKGAPSGWAANGVCHTLFAKLVGNIAEDGGKLTDYLISHSALQPYQAGKSGYAAVQNG
                        40        50        60        70        80        90

                       170       180
m205-1.pep      RYVLEIDSEGAFYFRRRHYX
                ||||||||||||||||||||
a205-1          RYVLEIDSEGAFYFRRRHYX
                       100       110
```

The following partial DNA sequence was identified in *N. gonorrhoeae* <SEQ ID 715>:

```
g206.seq
   1 atgttttccc ccgacaaaac ccttttcctc tgtctcggcg cactgctcct

  51 cgcctcatgc ggcacgacct ccggcaaaca ccgccaaccg aaacccaaac

 101 agacagtccg gcaaatccaa gccgtccgca tcagccacat cggccgcaca

 151 caaggctcgc aggaactcat gctccacagc ctcggactca tcggcacgcc

 201 ctacaaatgg ggcggcagca gcaccgcaac cggcttcgac tgcagcggca

 251 tgattcaatt ggtttacaaa aacgccctca acgtcaagct gccgcgcacc

 301 gcccgcgaca tggcggcggc aagccgcaaa atccccgaca gccgcctcaa

 351 ggccggcgac atcgtattct tcaacaccgg cggcgcacac cgctactcac

 401 acgtcggact ctacatcggc aacggcgaat tcatccatgc cccggcagc

 451 ggcaaaacca tcaaaaccga aaaactctcc acaccgtttt acgccaaaaa

 501 ctaccttgga gcgcatacgt tttttacaga atga
```

This corresponds to the amino acid sequence <SEQ ID 716; ORF 206.ng>:

```
g206.pep
   1 MFSPDKTLFL CLGALLLASC GTTSGKHRQP KPKQTVRQIQ AVRISHIGRT

  51 QGSQELMLHS LGLIGTPYKW GGSSTATGFD CSGMIQLVYK NALNVKLPRT

 101 ARDMAAASRK IPDSRLKAGD IVFFNTGGAH RYSHVGLYIG NGEFIHAPGS

 151 GKTIKTEKLS TPFYAKNYLG AHTFFTE*
```

The following partial DNA sequence was identified in *N. meningitidis* <SEQ ID 717>:

```
m206.seq
  1  ATGTTTCCCC CCGACAAAAC CCTTTTCCTC TGTCTCAGCG CACTGCTCCT
```

-continued

```
 51 CGCCTCATGC GGCACGACCT CCGGCAAACA CCGCCAACCG AAACCCAAAC

101 AGACAGTCCG GCAAATCCAA GCCGTCCGCA TCAGCCACAT CGACCGCACA

151 CAAGGCTCGC AGGAACTCAT GCTCCACAGC CTCGGACTCA TCGGCACGCC

201 CTACAAATGG GGCGGCAGCA GCACCGCAAC CGGCTTCGAT TGCAGCGGCA

251 TGATTCAATT CGTTTACAAr AACGCCCTCA ACGTCAAGCT GCCGCGCACC

301 GCCCGCGACA TGGCGGCGGC AAGCCGsAAA ATCCCCGAcA GCCGCyTCAA

351 GGCCGGCGAC CTCGTATTCT TCAACACCGG CGGCGCACAC CGCTACTCAC

401 ACGTCGGACT CTACATCGGC AACGGCGAAT TCATCCATGC CCCCAGCAGC

451 GGCAAAACCA TCAAAACCGA AAAACTCTCC ACACCGTTTT ACGCCAAAAA

501 CTACCTCGGC GCACATACTT TTTTTACAGA ATGA
```

This corresponds to the amino acid sequence <SEQ ID 718; ORF 206>:

```
m206.pep . . .
  1 MFPPDKTLFL CLSALLLASC GTTSGKHRQP KPKQTVRQIQ AVRISHIDRT

 51 QGSQELMLHS LGLIGTPYKW GGSSTATGFD CSGMIQFVYK NALNVKLPRT

101 ARDMAAASRK IPDSRXKAGD LVFFNTGGAH RYSHVGLYIG NGEFIHAPSS

151 GKTIKTEKLS TPFYAKNYLG AHTFFTE*
```

Computer analysis of this amino acid sequence gave the following results:

Homology with a Predicted ORF from *N. gonorrhoeae*

ORF 206 shows 96.0% identity over a 177 aa overlap with a predicted ORF (ORF 206.ng) from *N. gonorrhoeae*:

```
m206/g206

                    10        20        30        40        50        60
m206.pep    MFPPDKTLFLCLSALLLASCGTTSGKHRQPKPKQTVRQIQAVRISHIDRTQGSQELMLHS
            || |||||||||:||||||||||||||||||||||||||||||||||| |||||||||||
g206        MFSPDKTLFLCLGALLLASCGTTSGKHRQPKPKQTVRQIQAVRISHIGRTQGSQELMLHS
                    10        20        30        40        50        60

                    70        80        90       100       110       120
m206.pep    LGLIGTPYKWGGSSTATGFDCSGMIQFVYKNALNVKLPRTARDMAAASRKIPDSRXKAGD
            |||||||||||||||||||||||||:||||||||||||||||||||||||||||| ||||
g206        LGLIGTPYKWGGSSTATGFDCSGMIQLVYKNALNVKLPRTARDMAAASRKIPDSRLKAGD
                    70        80        90       100       110       120

                   130       140       150       160       170
m206.pep    LVFFNTGGAHRYSHVGLYIGNGEFIHAPSSGKTIKTEKLSTPFYAKNYLGAHTFFTEX
            :||||||||||||||||||||||||||:|||||||||||||||||||||||||||||
g206        IVFFNTGGAHRYSHVGLYIGNGEFIHAPGSGKTIKTEKLSTPFYAKNYLGAHTFFTE
                   130       140       150       160       170
```

The following partial DNA sequence was identified in *N. meningitidis* <SEQ ID 719>:

```
a206.seq
  1 ATGTTTCCCC CCGACAAAAC CCTTTTCCTC TGTCTCAGCG CACTGCTCCT

 51 CGCCTCATGC GGCACGACCT CCGGCAAACA CCGCCAACCG AAACCCAAAC

101 AGACAGTCCG GCAAATCCAA GCCGTCCGCA TCAGCCACAT CGACCGCACA

151 CAAGGCTCGC AGGAACTCAT GCTCCACAGC CTCGGACTCA TCGGCACGCC

201 CTACAAATGG GGCGGCAGCA GCACCGCAAC CGGCTTCGAT TGCAGCGGCA

251 TGATTCAATT CGTTTACAAA AACGCCCTCA ACGTCAAGCT GCCGCGCACC
```

-continued

```
301 GCCCGCGACA TGGCGGCGGC AAGCCGCAAA ATCCCCGACA GCCGCCTTAA

351 GGCCGGCGAC CTCGTATTCT TCAACACCGG CGGCGCACAC CGCTACTCAC

401 ACGTCGGACT CTATATCGGC AACGGCGAAT TCATCCATGC CCCCAGCAGC

451 GGCAAAACCA TCAAAACCGA AAAACTCTCC ACACCGTTTT ACGCCAAAAA

501 CTACCTCGGC GCACATACTT TCTTTACAGA ATGA
```

This corresponds to the amino acid sequence <SEQ ID 720; ORF 206.a>:

```
a206.pep
  1 MFPPDKTLFL CLSALLLASC GTTSGKHRQP KPKQTVRQIQ AVRISHIDRT

 51 QGSQELMLHS LGLIGTPYKW GGSSTATGFD CSGMIQFVYK NALNVKLPRT

101 ARDMAAASRK IPDSRLKAGD LVFFNTGGAH RYSHVGLYIG NGEFIHAPSS

151 GKTIKTEKLS TPFYAKNYLG AHTFFTE*
```

m206/a206 99.4% identity in 177 aa overlap

```
                  10        20        30        40        50        60
m206.pep  MFPPDKTLFLCLSALLLASCGTTSGKHRQPKPKQTVRQIQAVRISHIDRTQGSQELMLHS
          ||||||||||||||||||||||||||||||||||||||||||||||||||||||||||||
a206      MFPPDKTLFLCLSALLLASCGTTSGKHRQPKPKQTVRQIQAVRISHIDRTQGSQELMLHS
                  10        20        30        40        50        60

                  70        80        90       100       110       120
m206.pep  LGLIGTPYKWGGSSTATGFDCSGMIQFVYKNALNVKLPRTARDMAAASRKIPDSRXKAGD
          ||||||||||||||||||||||||||||||||||||||||||||||||||||||| ||||
a206      LGLIGTPYKWGGSSTATGFDCSGMIQFVYKNALNVKLPRTARDMAAASRKIPDSRLKAGD
                  70        80        90       100       110       120

                 130       140       150       160       170
m206.pep  LVFFNTGGAHRYSHVGLYIGNGEFIHAPSSGKTIKTEKLSTPFYAKNYLGAHTFFTEX
          ||||||||||||||||||||||||||||||||||||||||||||||||||||||||||
a206      LVFFNTGGAHRYSHVGLYIGNGEFIHAPSSGKTIKTEKLSTPFYAKNYLGAHTFFTEX
                 130       140       150       160       170
```

The following partial DNA sequence was identified in *N. gonorrhoeae* <SEQ ID 721>:

```
g209.seq
  1 atgctgcggc atttaggaaa cgacttcgcc ttgggcgcgt tgtttttcga

 51 tgctgcggtt gatgtgccac tgctgggcga tggtcaggag gttgttgacc

101 acccagtaga gaaccaaacc ggcagggaag aagaagaaca tgacggagaa

151 aaccaacggc atgattttca tcattttcgc ctgcatcggg tcggtcggcg

201 gcgggttcag ataggtttgg gcgaacatcg ttgccgccat aatgatgggc

251 aggatgtagt aggggtcggc gcggctgagg tcggtaatcc agcccagcca

301 aggtgcctgg cgcaattcta cggaggcgaa caatgcccag tacaagccga

351 tgaagacggg gatttgcaac agcataggca gacagccgcc cagcgggttg

401 atttcctcgt cttcgaaaag ctgcatcatc gcttgctgtt gcgccatacg

451 gtcgtcgccg tatttttctt tgatggtctg cagttcgggt gcggcggcac

501 gcattttcgc catcgaacgg taggaggcgt tggtcaatgg atacagtacg

551 gctttgacga tgatggtcaa aacgacgatt gcccagcccc agttgccgat

601 aatgttgtgc agttggttca ggagccagaa gagcggcgat gcgaaccagt

651 gtactttacc gtagtctttt gccagttgca ggttgtcggc gatgtttgcg
```

-continued

```
701 ataacggatg tggtttgcgg accggcatac aggttgaccg ccattttcgg

751 ttttggcccc cgggttggga tagcggttaa
```

This corresponds to the amino acid sequence <SEQ ID 722; ORF 209.ng>:

```
g209.pep
  1 MLRHLGNDFA LGALFFDAAV DVPLLGDGQE VVDHPVENQT GREEEEHDGE

 51 NQRHDFHHFR LHRVGRRRVQ IGLGEHRCRH NDGQDVVGVG AAEVGNPAQP

101 RCLAQFYGGE QCPVQADEDG DLQQHRQTAA QRVDFLVFEK LHHRLLLRHT

151 VVAVFFFDGL QFGCGGTHFR HRTVGGVGQW IQYGFDDDGQ NDDCPAPVAD

201 NVVQLVQEPE ERRCEPVYFT VVFCQLQVVG DVCDNGCGLR TGIQVDRHFR

251 FWPPGWDSG*
```

The following partial DNA sequence was identified in *N. meningitidis* <SEQ ID 723>:

```
m209.seq
   1 ATGCTGCGGC ATTTAGGAAA CGACTTCGCC TTGGgGCGTT GTTTTTCGAT

  51 GCTGCGGTTG ATGTGCCATT GCTGGGCGAT GGTCAGGAGG TTGTTGACTA

  10 CCCAGTACAA TACCAGACCG GCAGGGAAGA AGAAGAACAT GACGGAGAAA

 151 ACCAACGGCA TGATTTTCAT CATTTTCGCC TGCATCGGGT CGGTCGGCGG

 201 CGGGTTCAGA TAAGTTTGGG CGAACATCGT TGCCGCCATA ATGATGGGCA

 251 GGATGTAGTA GGGGTCGGCG CGGCTGAGGT CGGTAATCCA ACCCAGCCAA

 301 GGTGCCTGGC GCAATTCTAC GGAGGCGAAC AATGCCCAAT ACAATCCGAT

 351 GAAGACGGGG ATTTGCAACA GCATAGGCAG GCAGCCGCCC AGCGGGTTGA

 401 TTTTCTCGTC TGTGTAAAGC TGCATCATCG CCTGTTGTTG CGCCATACGG

 451 TCGTCGCCGT ATTTCTCTTT GATGGCTTGC AGTTTGGGTG CGGCGGCACG

 501 CATTTTCGCC ATAGAGCGGT AAGAGGCGTT GGTCAATGGA TACAGTACGG

 551 CTTTGACGAT GATGGTTAAA ACGATAATCG CCCAGCCCCA GTTGCCGATG

 601 ATGTTGTGCA GTTGGTTCAG GAGCCAGAAG AGCGGGGAGG CGAACCAGTG

 651 TACTTTGCCG TAGTCTTTGG CCAGTTGCAG GTTGTCGGCG ATGTTTGCGA

 701 TGACGGATGT GGTCTGCGGG CCGGCGTAGA GGTTGATGGA GGCTTCGgTT

 751 TCGCGCCGTT TTGGATGGCG GCTAAAGGCA CGCTGACGCT GGTGCTGTAC

 801 AGCTTGTCGT TGCGGCGTTT GATGTCGATG TTGCACTCGC CTGCGGCGCA

 851 AACGCTTTGT CTGCCTTTAG GTTGGAGAAT CCAGGTGGAC ATGAAGTGGT

 901 GTTCAATCAT GCCGAGCCAG CCGGTCGGGG TTTTGCGGAT GTATTCGGCC

 951 TCGGATTTGC CGGATTTGGC ATCGTCGTCC AAGTCGGAAA AGCTGACTTT

1001 TTGGAAGTTG CCTTCAGGGG TATAA
```

This corresponds to the amino acid sequence <SEQ ID 724; ORF 209>:

```
m209.pep
  1 MLRHLGNDFA LGALFFDAAV DVPLLGDGQE VVDYPVQYQT GREEEEHDGE

 51 NQRHDFHHFR LHRVGRRRVQ ISLGEHRCRH NDGQDVVGVG AAEVGNPTQP
```

-continued

```
101 RCLAQFYGGE QCPIQSDEDG DLQQHRQAAA QRVDFLVCVK LHHRLLLRHT

151 VVAVFLFDGL QFGCGGTHFR HRAVRGVGQW IQYGFDDDG* NDNRPAPVAD

201 DVVQLVQEPE ERGGEPVYFA VVFGQLQVVG DVCDDGCGLR AGVEVDGGFG

251 FAPFWMAAKG TLTLVLYSLS LRRLMSMLHS PAAQTLCLPL GWRIQVDMKW

301 CSIMPSQPVG VLRMYSASDL PDLASSSKSE KLTFWKLPSG V*
```

Computer analysis of this amino acid sequence gave the following results:

Homology with a Predicted ORF from *N. gonorrhoeae*

ORF 209 shows 88.5% identity over a 253 aa overlap with a predicted ORF (ORF 209.ng) from *N. gonorrhoeae*:

```
m209/g209
                   10        20        30        40        50        60
m209.pep    MLRHLGNDFALGALFFDAAVDVPLLGDGQEVVDYPVQYQTGREEEEHDGENQRHDFHHFR
            ||||||||||||||||||||||||||||||||:||: ||||||||||||||||||||
g209        MLRHLGNDFALGALFFDAAVDVPLLGDGQEVVDHPVENQTGREEEEHDGENQRHDFHHFR
                   10        20        30        40        50        60

                   70        80        90       100       110       120
m209.pep    LHRVGRRRVQISLGEHRCRHNDGQDVVGVGAAEVGNPTQPRCLAQFYGGEQCPIQSDEDG
            ||||||||||:|||||||||||||||||||||||||:||||||||||||||:|:||||
g209        LHRVGRRRVQIGLGEHRCRHNDGQDVVGVGAAEVGNPAQPRCLAQFYGGEQCPVQADEDG
                   70        80        90       100       110       120

                  130       140       150       160       170       180
m209.pep    DLQQHRQAAAQRVDFLVCVKLHHRLLLRHTVVAVFLFDGLQFGCGGTHFRHRAVRGVGQW
            |||||||:|||||||||  ||||||||||||||||:||||||||||||||||:| |||||
g209        DLQQHRQTAAQRVDFLVFEKLHHRLLLRHTVVAVFFFDGLQFGCGGTHFRHRTVGGVGQW
                  130       140       150       160       170       180

                  190       200       210       220       230       240
m209.pep    IQYGFDDDGXNDNRPAPVADDVVQLVQEPEERGGEPVYFAVVFGQLQVVGDVCDDGCGLR
            |||||||| ||: ||||||:|||||||||||  |||||:||| ||||||||||:|||||
g209        IQYGRDDDGQNDDCPAPVADNVVQLVQEPEERRCEPVYFTVVFCQLQVVGDVCDNGCGLR
                  190       200       210       220       230       240

                  250       260       270       280       290       299
m209.pep    AGVEVDGGFGF-APFWMAAKGTLTLVLYSLSLRRLMSMLHSPAAQTLCLPLGWRIQVDMK
            :|::||  | |  | |
g209        TGIQVDRHFRFWPPGWDSG
                  250
```

The following partial DNA sequence was identified in *N. meningitidis* <SEQ ID 725>:

```
a209.seq
  1 ATGCTGCGGC ATTTAGGAAA CGACTTCGCC TTGGGCGCGT TGTTTTTCGA

 51 TGCTGCGGTT GATGTGCCAT TGCTGGGCGA TGGTCAGGAG GTTGTTGATC

101 ACCCAGTACA ATACCAGACC GGCAGGGAAG AAGAAGAACA TGACGGAGAA

151 AACCAAAGGC ATGATTTTCA TCATTTTCGC CTGCATCGGG TCGGTCGGCG

201 GCGGGTTCAG ATAGGTTTGG GCGAACATCG TTGCCGCCAT AATGATGGGC

251 AGGATGTAGT AGGGGTCGGC GCGGCTGAGG TCGGTAATCC AACCCAGCCA

301 AGGTGCCTGG CGCAATTCTA CGGAGGCGAA CAATGCCCAA TACAATCCGA

351 TGAAGACGGG GATTTGCAAC AGCATAGGCA GGCAGCCGCC CAGCGGGTTG

401 ATTTTCTCGT CTGTGTAAAG CTGCATCATG GCTTGTTGCT GCGCCATACG

451 GTCGTCGCCG TATTTCTCTT TGATGGCTTG CAGTTTGGGC GCGGCGGCAC

501 GCATTTTCGC CATCGAACGG TAAGAGGCGT TGGTCAATGG ATACAGTACG

551 GCTTTGACGA TGATGGTTAA AACGATAATC GCCCAGCCCC AGTTGCCGAT

601 GATGTTGTGC AGTTGGTTCA AAAGCCAAAA GAGGGGGGAG GCGAACCAGT

651 GTACTTTGCC GTAGTCTTTG GCCAGTTGCA GGTTGTCGGC GATGTTTGCG
```

-continued

```
 701 ATAACGGATG TGGTCTGTGG GCCGGCGTAG AGGTTGATGG AGGCTTCGGT

 751 TTCGCACCGT TTTGGATAGC GGCTAAAGGC ACGCTGACGC TGGTGCTGTA

 801 CAGCTTGTCG TTGCGGCGTT TGATGTCGAT ACGGCAGTCG CCAGCGGCGC

 851 AAACGCTTTG TCCGCCTTTG GGTTGGAGGA TCCAGGTGGA CATGAAGTGG

 901 TGTTCAATCA TGCCGAGCCA GCCGGTCGGG GTTTTGCGGA TGTATTCGGC

 951 CTCGGATTTG CCGGATTTGG CATCGTCGTC CAAGTCGGAG AAGCTGACTT

1001 TTTGGAAGTT GCCTTCAGGG GTATAA
```

This corresponds to the amino acid sequence <SEQ ID 726; ORF 209.a>:

```
a209.pep
   1 MLRHLGNDFA LGALFFDAAV DVPLLGDGQE VVDHPVQYQT GREEEEHDGE

  51 NQRHDFHHFR LHRVGRRRVQ IGLGEHRCRH NDGQDVVGVG AAEVGNPTQP

 101 RCLAQFYGGE QCPIQSDEDG DLQQHRQAAA QRVDFLVCVK LHHGLLLRHT

 151 VVAVFLFDGL QFGRGGTHFR HRTVRGVGQW IQYGFDDDG* NDNRPAPVAD

 201 DVVQLVQKPK EGGGEPVYFA VVFGQLQVVG DVCDNGCGLW AGVEVDGGFG

 251 FAPFWIAAKG TLTLVLYSLS LRRLMSIRQS PAAQTLCPPL GWRIQVDMKW

 301 CSIMPSQPVG VLRMYSASDL PDLASSSKSE KLTFWKLPSG V*
```

m209/a209 95.6% identity in 341 aa overlap

```
                     10        20        30        40        50        60
m209.pep     MLRHLGNDFALGALFFDAAVDVPLLGDGQEVVDYPVQYQTGREEEEHDGENQRHDFHHFR
             |||||||||||||||||||||||||||||||||:||||||||||||||||||||||||||
a209         MLRHLGNDFALGALFFDAAVDVPLLGDGQEVVDHPVQYQTGREEEEHDGENQRHDFHHFR
                     10        20        30        40        50        60

                     70        80        90       100       110       120
m209.pep     LHRVGRRRVQISLGEHRCRHNDGQDVVGVGAAEVGNPTQPRCLAQFYGGEQCPIQSDEDG
             |||||||||||:||||||||||||||||||||||||||||||||||||||||||||||||
a209         LHRVGRRRVQIGLGEHRCRHNDGQDVVGVGAAEVGNPTQPRCLAQFYGGEQCPIQSDEDG
                     70        80        90       100       110       120

                    130       140       150       160       170       180
m209.pep     DLQQHRQAAAQRVDFLVCVKLHHRLLLRHTVVAVFLFDGLQFGCGGTHFRHRAVRGVGQW
             ||||||||||||||||||||||| ||||||||||||||||||| ||||||||:|||||||
a209         DLQQHRQAAAQRVDFLVCVKLHHGLLLRHTVVAVFLFDGLQFGRGGTHFRHRTVRGVGQW
                    130       140       150       160       170       180

                    190       200       210       220       230       240
m209.pep     IQYGFDDDGXNDNRPAPVADDVVQLVQEPEERGGEPVYFAVVFGQLQVVGDVCDDGCGLR
             |||||||||||||||||||||||||||:|:| ||||||||||||||||||||||:|||| 
a209         IQYGRDDDGXNDNRPAPVADDVVQLVQKPKEGGGEPVYFAVVFGQLQVVGDVCDNGCGLW
                    190       200       210       220       230       240

                    250       260       270       280       290       300
m209.pep     AGVEVDGGFGFAPFWMAAKGTLTLVLYSLSLRRLMSMLHSPAAQTLCLPLGWRIQVDMKW
             |||||||||||||||:||||||||||||||||||||: :|||||||| ||||||||||||
a209         AGVEVDGGFGRAPFWIAAKGTLTLVLYSLSLRRLMSIRQSPAAQTLCPPLGWRIQVDMKW
                    250       260       270       280       290       300

                    310       320       330       340
m209.pep     CSIMPSQPVGVLRMYSASDLPDLASSSKSEKLTFWKLPSGVX
             ||||||||||||||||||||||||||||||||||||||||||
a209         CSIMPSQPVGVLRMYSASDLPDLASSSKSEKLTFWKLPSGVX
                    310       320       330       340
```

The following partial DNA sequence was identified in *N. gonorrhoeae* <SEQ ID 727>:

```
g211.seq
   1 atgttgcgga ttgctgctgc caatcagttg ggcggtcgaa atggtgcggc

  51 ggtgggaaac ggggtcgata agtttgggcg tggtgctgat aatcaggttg
```

-continued

```
101 agtttttgga aggaaacctg attgtagtcg gcgcgtccgg gcgtgccgct

151 gtaacggtag ccgtggcgca attcgagcgt gcgtttgttg tccttcagcg

201 agaagttacc ttctttggcg aagatgatgt tgtcgccgcc gtttttgtcc

251 tgttcgcgca ggaacaggtt tttcatgatg ccggattcgg tgtcaaaggt

301 ttcgacgaaa taaaccctgc cgttgcgctt gcccaagtta ttgaactcgc

351 cggcttccac caaagacaat tcctgcttct gcttcaaaat ttcggcatat

401 tcgcggctgc gcagctctgc ccacggtatc acccaaagct gcatgacggc

451 aatcaggatg gcaaacggca cggcaaactg catgacgggg cgtatccact

501 gtttcaacgc caatccgcag gatag
```

This corresponds to the amino acid sequence <SEQ ID 728; ORF 211.ng>:

```
g211.pep
  1 MLRIAAANQL GGRNGAAVGN GVDKFGRGAD NQVEFLEGNL IVVGASGRAA

 51 VTVAVAQFER AFVVLQREVT FFGEDDVVAA VFVLFAQEQV FHDAGFGVKG

101 FDEINPAVAL AQVIELAGFH QRQFLLLLQN FGIFAAAQLC PRYHPKLHDG

151 NQDGKRHGKL HDGAYPLFQR QSAG*
```

The following partial DNA sequence was identified in *N. meningitidis* <SEQ ID 729>:

```
m211.seq
  1 ATGTTGCGGG TTGCTGCTGC CAATCAGTTG GGCGGTCGGA ATGGTACGGC

 51 GGTGGGAAAC GGGGTCGATG AGTTTGGGCG TGGTGCTGAT AATCAGGTTG

101 AGTTTTTGGA AGGAAACCTG ATTGTAGTCG GCGCGTCCGG GCGTGCCGCT

151 GTAACGGTAG CCGTGGCGCA ATTCGAGCGT GCGTTTGTTG TCGTTCAGCG

201 AGAAGTTACC TTCTTTGGCG AAGATGATGT TGTCGCCGCC GTTTTTGTCC

251 TGTTCGCGCA GGAACAGGTT TTTCATGATG CCGGATTCGG TATCGAAGGT

301 TTCGACAAAA TAAACCCTGC CGTTGCGCTT GCCCAAACTG TTGAACTCGC

351 CTGCCTCCAC CAAAGACAAT TCCTGCTTCT GCTTCAGGAT TTCAGCGTAT

401 TCGCGGCTGC GTAGCTCTGC CCACGGTATC ACCCAAAGCT GCATGACGGC

451 AACCAAAACG GCAAACGGCA CGGCAAACTG CATCACCGGG CGTATCCATT

501 GTTTCAATGC CAATCCGCAg GATAG
```

This corresponds to the amino acid sequence <SEQ ID 730; ORF 211>:

```
m211.pep
  1 MLRVAAANQL GGRNGTAVGN GVDEFGRGAD NQVEFLEGNL IVVGASGRAA

 51 VTVAVAQFER AFVVVQREVT FFGEDDVVAA VFVLFAQEQV FHDAGFGIEG

101 FDKINPAVAL AQTVELACLH QRQFLLLLQD FSVFAAAXLC PRYHPKLHDG

151 NQNGKRHGKL HHRAYPLFQC QSAG*
```

Computer analysis of this amino acid sequence gave the following results:

Homology with a Predicted ORF from *N. gonorrhoeae*

ORF 211 shows 89.1% identity over a 174 aa overlap with a predicted ORF (ORF 211.ng) from *N. gonorrhoeae*:

```
m211/g211

                 10        20        30        40        50        60
m211.pep MLRVAAANQLGGRNGTAVGNGVDEFGRGADNQVEFLEGNLIVVGASGRAAVTVAVAQFER
         |||:|||||||||||:|||||||:||||||||||||||||||||||||||||||||||||
g211     MLRIAAANQLGGRNGAAVGNGVDKFGRGADNQVEFLEGNLIVVGASGRAAVTVAVAQFER
                 10        20        30        40        50        60

                 70        80        90       100       110       120
m211.pep AFVVVQREVTFFGEDDVVAAVFVLFAQEQVFHDAGFGIEGFDKINPAVALAQTVELACLH
         ||||:||||||||||||||||||||||||||||||||::|||:|||||||||::||| :|
g211     AFVVLQREVTFFGEDDVVAAVFVLFAQEQVFHDAGFGVKGFDEINPAVALAQVIELAGFH
                 70        80        90       100       110       120

                130       140       150       160       170
m211.pep QRQFLLLLQDFSVFAAAXLCPRYHPKLHDGNQNGKRHGKLHHRAYPLFQCQSAGX
         |||||||||:|::|||| |||||||||||||||:|||||||  |||||| ||||
g211     QRQFLLLLQNFGIFAAAQLCPRYHPKLHDGNQNGKRHGKLHDGAYPLFQRQSAGX
                130       140       150       160       170
```

The following partial DNA sequence was identified in *N. meningitidis* <SEQ ID 731>:

```
a211.seq
   1 ATGTTGCGGG TTGCTGCTGC CAATCAGTTG GGCGGTCGGA ATGGTACGGC

  51 GGTGGGAAAC GGGGTCGATG AGTTTGGGCG TGGTGCTGAT AATCAGGTTG

 101 AGTTTTTGGA AGGAAACCTG ATTGTAGTCG GCGCGTCCGG GCGTGCCGCT

 151 GTAACGGTAG CCGTGGCGCA ATTCGAGCGT GCGTTTGTTG TCGTTCAGCG

 201 AGAAGTTACT TTCTTTGGCG AAGATGATGT TGTCGCCGCC GTTTTTGTCC

 251 TGTTCGCGCA GGAACAGGTT TTTCATGATG CCGGATTCGG TATCGAAGGT

 301 TTCGACAAAA TAAACCCTGC CGTTGCGCTT GCCCAAACTG TTGAACCCGC

 351 CTGCCTCCAC CAAAGACAAT TCCTGCTTCT GCTTCAGGAT TTCAGCGTAT

 401 TCGCGGCTGC GTAGCTCTGC CCACGGTATC ACCCAAAGCT GCATGACGGC

 451 AACCAAAACG GCAAACGGCA CGGCAAACTG CATCACCGGG CGTATCCATT

 501 GTTTCAATGC CAATCCGCAG GATAG
```

This corresponds to the amino acid sequence <SEQ ID 732; ORF 211.a>:

```
a211.pep
   1 MLRVAAANQL GGRNGTAVGN GVDEFGRGAD NQVEFLEGNL IVVGASGRAA

  51 VTVAVAQFER AFVVVQREVT FFGEDDVVAA VFVLFAQEQV FHDAGFGIEG

 101 FDKINPAVAL AQTVEPACLH QRQFLLLLQD FSVFAAA*LC PRYHPKLHDG

 151 NQNGKRHGKL HHRAYPLFQC QSAG*
```

m211/a211 99.4% identity in 174 aa overlap

```
                     10        20        30        40        50        60
m211.pep     MLRVAAANQLGGRNGTAVGNGVDEFGRGADNQVEFLEGNLIVVGASGRAAVTVAVAQFER
             ||||||||||||||||||||||||||||||||||||||||||||||||||||||||||||
a211         MLRVAAANQLGGRNGTAVGNGVDEFGRGADNQVERLEGNLIVVGASGRAAVTVAVAQFER
                     10        20        30        40        50        60
```

-continued

```
                    70        80        90        100       110       120
m211.pep    AFVVVQREVTFFGEDDVVAAVFVLFAQEQVFHDAGFGIEGFDKINPAVALAQTVELACLH
            |||||||||||||||||||||||||||||||||||||||||||||||||||||| ||||
a211        AFVVVQREVTFFGEDDVVAAVFVLFAQEQVFHDAGFGIEGFDKINPAVALAQTVEPACLH
                    70        80        90        100       110       120

                    130       140       150       160       170
m211.pep    QRQFLLLLQDFSVFAAAXLCPRYHPKLHDGNQNGKRHGKLHHRAYPLFQCQSAGX
            |||||||||||||||||||||||||||||||||||||||||||||||||||||||
a211        QRQFLLLLQDFSVFAAAXLCPRYHPKLHDGNQNGKRHGKLHHRAYPLFQCQSAGX
                    130       140       150       160       170
```

The following partial DNA sequence was identified in *N. gonorrhoeae* <SEQ ID 733>:

```
g212.seq (partial)
   1 atggacaatc tcgtatggga cggcattccc gacatccgca cactcgacca

  51 aaccatccgc aaacacgcac acccgctcaa cctgattgtc tgcctccccg

 101 ataatcagat tcccgatttt caaaccgcac aagatgcttc ggactcggaa

 151 tgccgtctga agcaccgttt ggatcaggca acccagtgcc tccagttcga

 201 cagcatcaac ctcatcgaac acatcctgcc cgatgtccgc ttctggctgg

 251 ttccccccttc acgcacccgc cgcctgcacg aacacttcca ccacatttcc

 301 tggcagaccg aagccatccc gcaaaccgaa agcaagtccg acaaaccctg

 351 gtttgcactt ccacaaacat ccgaacggaa aaaaccggaa cacgtcctcg

 401 tcatcggtgc aggcattgcc ggcgcatcga ccgcccacgc cttagcatca

 451 cacggcattt ccgttaccgt attggaagcc cgaaaagccg ctcaagccgc

 501 cagcggcaac cggcaagggc tgctttacgc caaaatctcg ccgcacgaca

 551 ccggacagac cgaactgctg cttgccggct acggctacac caaacgcctg

 601 ctcggacaca tcctgcccga ctccgacact tggggcggca acggcatcat

 651 ccacctcaat tacagccgca ccgaacaaca acgcaatcac gaattgggtt

 701 tgcaaaaaca ccataaccac ctctaccgca gcatcacgtc tgcagaagcc

 751 gaaaaaaatcg ccggcatccc gctgaacacg ccctacgccg aaccattatg

 801 cggactctac tggcaacacg gcgtatggct caatccgccc gcattcgtcc

 851 gcaccctcct cagccatccg ctgatcgaac tatatgaaaa cacaacgtta

 901 accggcattt cccacgacgg agaaaagtgg attgcaagca cgccaaacgg

 951 cacatttacc gccacacaca tcatctactg caccggcgcg cacagcccct

1001 gcctgcccga aaccaacctc gccgccctac ccctcaggca aatacgcgga

1051 caaaccggcc tcacaccgtc caccccgttt tccgaacaac tgcgttgcgc

1101 cgtttcaggc gaaagctaca tcagcccgtc gtggcacgga ctgcactgct

1151 acggcgcgag ttttattccc aacagcagca ataccggatg gaacgaagcc

1201 gaagaagcct caaaccgcca agcattggca caccttaacc ccgcccttgc

1251 cgaatcattg ttt...
```

This corresponds to the amino acid sequence <SEQ ID 734; ORF 212.ng>:

```
g212.pep (partial)
   1  MDNLVWDGIP DIRTLDQTIR KHAHPLNLIV CLPDNQIPDF QTAQDASDSE

  51  CRLKHRLDQA TQCLQFDSIN LIEHILPDVR FWLVPPSRTR RLHEHFHHIS
```

-continued

```
101 WQTEAIPQTE SKSDKPWFAL PQTSERKKPE HVLVIGAGIA GASTAHALAS

151 HGISVTVLEA RKAAQAASGN RQGLLYAKIS PHDTGQTELL LAGYGYTKRL

201 LGHILPDSDT WGGNGIIHLN YSRTEQQRNH ELGLQKHHNH LYRSITSAEA

251 EKIAGIPLNT PYAEPLCGLY WQHGVWLNPP AFVRTLLSHP LIELYENTTL

301 TGISHDGEKW IASTPNGTFT ATHIIYCTGA HSPCLPETNL AALPLRQIRG

351 QTGLTPSTPF SEQLRCAVSG ESYISPSWHG LHCYGASFIP NSSNTGWNEA

401 EEASNRQALA HLNPALAESL F...
```

The following partial DNA sequence was identified in *N. meningitidis* <SEQ ID 735>:

```
m212.seq
   1 ATGGACAATC TCGTATGGGA CGGCATTCCC GACATCCGCA CACTCGACCA

  51 AGCCATCCGC AAACACGCAC CCCCGCTCAA CCTGATTATC TGCCTCCCCG

 101 ATAATCAGAT TCCCGATTTT CAAACCGCAC AAGATGCTTC GGACGCGGAA

 151 TGCCGTCTGA AGCACCGTTT GGATCAGGCA ATGCAGTGCC TCCAGTTCGA

 201 CAGCATCAAC CTCATCGAAC ACATCCTGCC CGATGTCCGC TTCTGGCTGG

 251 TTCCCCCTTC ACGCAATCAC CACCTGCACG AACATTTCCA CCACATTTCC

 301 TGGCAGACCG AAGCCATCCC GCAAACCGAA AGCAAGCCCG ACAAACCCTG

 351 GTTTGCACTT CCACAAACAT CCGAACGGCA AAAACCGGAA CACATCCTCG

 401 TTATCGGCGC GGGCATATCC GGCGCGGCAA CCGCCCACGC CTTAGCATCA

 451 CACGGCATTT CCGTTACCGT ATTGGAAGCC CGAAAAGCCG CCCAAGCCGC

 501 CAGCGGCAAC CGCCAAGGGC TGCTCTACGC CAAAATCTCG CCGCACGACA

 551 CCGAACAGAC CGAACTTTTG CTTGCCGGCT ACGGCTACAC CAAACGCCTG

 601 CTCGGACACA TCCTGCCCGA ATCCGAAACC TGGGGCGGCA ACGGCATCAT

 651 CCACCTCAAT TACAGCCGCA CCGAACAACA ACGCAATCAC GAATTGGGTT

 701 TGCAAAAACA CCATAACCAC CTCTACCGCA GCATCACATC TGCAGAAGCC

 751 GAAAAAATCG CCGGTATCCC ACTGTCCGTC CCATACGACC ACCCTTCATG

 801 CGGACTCTAC TGGCAACACG GCGTATGGCT CAATCCACCC GCATTCGTCC

 851 GCACCCTCCT CAACCATCCG CTCATTGGAC TACACGAAGA CACACCCTTG

 901 ACCGACATTT CCCACGACGG GGaAAAGTGG ATTGCAAGCA CGCCAAACGG

 951 CACATTTACC GCCACACACA TCATCTACTG CACCGGTGCG AACAGCCCCT

1001 ACCTACCCGA AACCAACCTC GCCGCCCTGC CTCTCAGGCA AATACGCGGA

1051 CAAACCGGCC TCACACCGTC CACCCCGTTT TCCGAACAAC TGCGTTGCGC

1101 CGTTTCAGGC GAAAGCTACA TCAGCCCGTC GTGGCACGGA CTGCACTGCT

1151 ACGGCGCGAG TTTTATTCCC AACAGCAGCC ATACCGGATG GAACGAAGCC

1201 GAAGAAGCCT CAAACCGCCA AGCATTGGCA CACCTTAACC CCGCCCTTTC

1251 CGAATCATTG TTTGCCGCCA ACCCAAACCC CCAAAAACAC CAAGGGCACG

1301 CCGCCATACG CTGCGACAGC CCCGACCACC TTCCCCTAGT CGGCGCACTC

1351 GGCGACATTG CCGCCATGCG GCAGACCTAC ACCAAACTCG CGCTGGACAA

1401 AAACTACCGC ATCGACACCC CATGCCCATA CCTGCCTAAT GCCTACGTCA

1451 ACACCGCGCA CGGCACCCGC GGACTCGCCA CCGCCCCCAT CTGCGCCGCC
```

-continued

```
1501 GmCAwTGCAG CCCAAATCsT AGGCyTGCCC CATCCCTTTT yAcAAcGCCT

1551 gCGCCACGCC cTAcACCCCA ACCGCACCAT CATCCGCGCC ATCGTCAGAA

1601 GGAAGGATCT AACCCCTTAA
```

This corresponds to the amino acid sequence <SEQ ID 736; ORF 212>:

```
m212.pep
   1 MDNLVWDGIP DIRTLDQAIR KHAPPLNLII CLPDNQIPDF QTAQDASDAE

  51 CRLKHRLDQA MQCLQFDSIN LIEHILPDVR FWLVPPSRTH HLHEHFHHIS

 101 WQTEAIPQTE SKPDKPWFAL PQTSERQKPE HILVIGAGIS GAATAHALAS

 151 HGISVTVLEA RKAAQAASGN RQGLLYAKIS PHDTEQTELL LAGYGYTKRL

 201 LGHILPESET WGGNGIIHLN YSRTEQQRNH ELGLQKHHNH LYRSITSAEA

 251 EKIAGIPLSV PYDHPSCGLY WQHGVWLNPP AFVRTLLNHP LIGLHEDTPL

 301 TDISHDGEKW IASTPNGTFT ATHIIYCTGA NSPYLPETNL AALPLRQIRG

 351 QTGLTPSTPF SEQLRCAVSG ESYISPSWHG LHCYGASFIP NSSHTGWNEA

 401 EEASNRQALA HLNPALSESL FAANPNPQKH QGHAAIRCDS PDHLPLVGAL

 451 GDIAAMRQTY TKLALDKNYR IDTPCPYLPN AYVNTAHGTR GLATAPICAA

 501 XXAAQIXGLP HPFXQRLRHA LHPNRTIIRA IVRRKDLTP*
```

Computer analysis of this amino acid sequence gave the following results:

Homology with a Predicted ORF from *N. gonorrhoeae*

ORF 212 shows 92.9% identity over a 421 aa overlap with a predicted ORF (ORF 212.ng) from *N. gonorrhoeae*:

```
m212/g212
                    10        20        30        40        50        60
m212.pep    MDNLVWDGIPDIRTLDQAIRKHAPPLNLIICLPDNQIPDFQTAQDASDAECRLKHRLDQA
            ||||||||||||||||||:|||| |||||:|||||||||||||||||||:||||||||||
g212        MDNLVWDGIPDIRTLDQTIRKHAHPLNLIVCLPDNQIPDFQTAQDASDSECRLKHRLDQA
                    10        20        30        40        50        60

                    70        80        90       100       110       120
m212.pep    MQCLQFDSINLIEHILPDVRFWLVPPSRTHHLHEHFHHISWQTEAIPQTESKPKDPWFAL
             ||||||||||||||||||||||||||||::||||||||||||||||||||| |||||||
g212        TQCLQFDSINLIEHILPDVRFWLVPPSRTRRLHEHFHHISWQTEAIPQTESKSDKPWFAL
                    70        80        90       100       110       120

                   130       140       150       160       170       180
m212.pep    PQTSERQKPEHILVIGAGISGAATAHALASHGISVTVLEARKAAQAASGNRQGLLYAKIS
            ||||||:||||:|||||||:||:|||||||||||||||||||||||||||||||||||||
g212        PQTSERKKPEHVLVIGAGIAGASTAHALASHGISVTVLEARKAAQAASGNRQGLLYAKIS
                   130       140       150       160       170       180

                   190       200       210       220       230       240
m212.pep    PHDTEQTELLLAGYGYTKRLLGHILPESETWGGNGIIHLNYSRTEQQRNHELGLQKHHNH
            |||| |||||||||||||||||||||:|:|||||||||||||||||||||||||||||||
g212        PHDTGQTELLLAGYGYTKRLLGHILPDSDTWGGNGIIHLNYSRTEQQRNHELGLQKHHNH
                   190       200       210       220       230       240

                   250       260       270       280       290       300
m212.pep    LYRSITSAEAEKIAGIPLSVPYDHPSCGLYWQHGVWLNPPAFVRTLLNHPLIGLHEDTPL
            ||||||||||||||||||::|| :| |||||||||||||||||||||:|||| |:|:| |
g212        LYRSITSAEAEKIAGIPLNTPYAEPLCGLYWQHGVWLNPPAFVRTLLSHPLIELYENTTL
                   250       260       270       280       290       300

                   310       320       330       340       350       360
m212.pep    TDISHDGEKWIASTPNGTFTATHIIYCTGANSPYLPETNLAALPLRQIRGQTGLTPSTPF
            | ||||||||||||||||||||||||||||:|| ||||||||||||||||||||||||||
g212        TGISHDGEKWIASTPNGTFTATHIIYCTGAHSPCLPETNLAALPLRQIRGQTGLTPSTPF
                   310       320       330       340       350       360

                   370       380       390       400       410       420
m212.pep    SEQLRCAVSGESYISPSWHGLHCYGASFIPNSSHTGWNEAEEASNRQALAHLNPALSESL
            |||||||||||||||||||||||||||||||||:||||||||||||||||||||||:|||
g212        SEQLRCAVSGESYISPSWHGLHCYGASFIPNSSNTGWNEAEEASNRQALAHLNPALAESL
                   370       380       390       400       410       420
```

-continued

```
                  430        440        450        460        470        480
m212.pep   FAANPNPQKHQGHAAIRCDSPDHLPLVGALGDIAAMRQTYTKLALDKNYRIDTPCPYLPN
           |
g212       F
```

The following partial DNA sequence was identified in *N. meningitidis* <SEQ ID 737>:

```
a212.seq
   1 ATGGACAATC TCGCATGGAA CGGCATTCCC GACATCCGCA CACTCGACCA

  51 AACCATCCGC AAACACGCAC ACCCGCTCAA CCTGATTGTC TGCCTCCCCG

 101 ATAATCAGAT TCCCAATTTT CAAACCGCAC AAGATGCTTC GGACGCGGAA

 151 TGCCGTCTGA AGCACCGTTT GGATCAGGCA ACCCAGTGCC TCCAGTTCGA

 201 CAGCATCAAC CTGATTGAAC ACATCCTGCC CGATGTCCGC TTCTGGCTGG

 251 TTCCCCCTTC ACGCACCCGC CGCCTGCACG AACACTTCCA CCACATTTCC

 301 TGGCAGACCG AAGCCATCCC GCAAACCGAA AGTAAGCCCG ACAAACCCTG

 351 GTTTGCACTT CCACAAACAT CCGAACGGCA AAAACCGGAA CACATCCTCG

 401 TTATCGGAGC GGGCATATCC GGCGCGGCAA CCGCCCACGC CTTAGCATCA

 451 TACGGCATTT CCGTTACCGT ATTGGAAGCC CGAAAAGCCG CCCAAGCCGC

 501 CAGCGGCAAC CGCCAAGGGC TGCTCTACGC CAAAATCTCG CCGCACGACA

 551 CCGAACAAAC CGAACTGCTG CTTGCCGGCT ACGGCTACAC CAAACGCCTG

 601 CTCGGACATA TCCTGCCCGA ATCCGAAACC TGGGGCGGCA ACGGCATCAT

 651 CCACCTCAAT TACAGCCGCA CCGAACAACA ACGCAATCAC GAATTGGGTT

 701 TGCAAAAACA CCATAACCAC CTCTACCGCA GCATCACGCA GGCAGAAGCC

 751 GAAAAAATCG CCGGCATCCC TCTGAACACG CCCTACGCCG AACCATTATG

 801 CGGACTGTTT TGGCAGTACG GCGTATGGCT CAATCCTCCC ACATTCGTCC

 851 GCGCCCTCCT CAGCCATCCG CTCATTGGAC TACACGAAGA CACACCGTTA

 901 ACCGACATTT CCCACGACGG GGAAAAGTGG ATTGCAAGCA CGCCAAACGG

 951 CACATTTACC GCCACACACA TCATCTACTG CACCGGTGCG AACAGCCCCT

1001 ACCTACCCGA AACCAACCTC GCCACCCTGC CCCTCAGGCA AATACGCGGA

1051 CAAACCGGCC TCACACCGTC CACCCCGTTT TCCGAACAAC TGCGTTGCGC

1101 CGTTTCAGGC GAAAGCTACA TCAGCCCGTC GTGGCACGGA CTGCACTGCT

1151 ACGGCGCGAG TTTTATTCCC AACAGCAGCC ATACCGGATG GAACGAAGCC

1201 GAAGAAGCCT CAAACCGCCA AGCATTGGCA CACCTTAACC CCGCCCTTTC

1251 CGAATCATTG TTTGCCGCCA ACCCAAACCC CCAAAAACAC CAAGGGCACG

1301 CCGCCATACG CTGCGACAGC CCCGACCACC TTCCCCTAGT CGGCGCACTC

1351 GGCGACATTG CCGCTATGCA ACAAACTTAC GCCAAACTCG CGCTGGACAA

1401 AAACTATCGC ATCGATGCCC CCTGCCCGTA CCTGCCCAAT GCCTACGCCA

1451 ACACCGCCCA CGGCACACGC GGGCTTGCCA CCGCCCCCAT CTGCGCCGCC

1501 GCCGTTGCAG CCGAAATCCT AGGCTTGCCC CATCCCCTCT CAAAACGCCT

1551 GCGCCACGCC CTACACCCCA ACCGCGCCAT CATCCGCGCC ATCGTCAGAA

1601 GGAAGGATCT AACCCCTTAA
```

This corresponds to the amino acid sequence <SEQ ID 738; ORF 212.a>:

```
a212.pep
   1 MDNLAWNGIP DIRTLDQTIR KHAHPLNLIV CLPDNQIPNF QTAQDASDAE

  51 CRLKHRLDQA TQCLQFDSIN LIEHILPDVR FWLVPPSRTR RLHEHFHHIS

 101 WQTEAIPQTE SKPDKPWFAL PQTSERQKPE HILVIGAGIS GAATAHALAS

 151 YGISVTVLEA RKAAQAASGN RQGLLYAKIS PHDTEQTELL LAGYGYTKRL

 201 LGHILPESET WGGNGIIHLN YSRTEQQRNH ELGLQKHHNH LYRSITQAEA

 251 EKIAGIPLNT PYAEPLCGLF WQYGVWLNPP TFVRALLSHP LIGLHEDTPL

 301 TDISHDGEKW IASTPNGTFT ATHIIYCTGA NSPYLPETNL ATLPLRQIRG

 351 QTGLTPSTPF SEQLRCAVSG ESYISPSWHG LHCYGASFIP NSSHTGWNEA

 401 EEASNRQALA HLNPALSESL FAANPNPQKH QGHAAIRCDS PDHLPLVGAL

 451 GDIAAMQQTY AKLALDKNYR IDAPCPYLPN AYANTAHGTR GLATAPICAA

 501 AVAAEILGLP HPLSKRLRHA LHPNRAIIRA IVRRKDLTP*
```

m212/a212 93.7% identity in 539 aa overlap

```
                    10        20        30        40        50        60
m212.pep    MDNLVWDGIPDIRTLDQAIRKHAPPLNLIICLPDNQIPDFQTAQDASDAECRLKHRLDQA
            ||||:|:|||||||||||:||||| |||||:||||||||:||||||||||||||||||||
a212        MDNLAWNGIPDIRTLDQTIRKHAHPLNLIVCLPDNQIPNFQTAQDASDSECRLKHRLDQA
                    10        20        30        40        50        60

                    70        80        90       100       110       120
m212.pep    MQCLQFDSINLIEHILPDVRFWLVPPSRTHHLHEHFHHISWQTEAIPQTESKPKDPWFAL
             ||||||||||||||||||||||||||||::|||||||||||||||||||||||||||||
a212        TQCLQFDSINLIEHILPDVRFWLVPPSRTRRLHEHFHHISWQTEAIPQTESKPDKPWFAL
                    70        80        90       100       110       120

                   130       140       150       160       170       180
m212.pep    PQTSERQKPEHILVIGAGISGAATAHALASHGISVTVLEARKAAQAASGNRQGLLYAKIS
            ||||||||||||||||||||||||||||||:|||||||||||||||||||||||||||||
a212        PQTSERQKPEHILVIGAGISGAATAHALASYGISVTVLEARKAAQAASGNRQGLLYAKIS
                   130       140       150       160       170       180

                   190       200       210       220       230       240
m212.pep    PHDTEQTELLLAGYGYTKRLLGHILPESETWGGNGIIHLNYSRTEQQRNHELGLQKHHNH
            ||||||||||||||||||||||||||||||||||||||||||||||||||||||||||||
a212        PHDTEQTELLLAGYGYTKRLLGHILPESETWGGNGIIHLNYSRTEQQRNHELGLQKHHNH
                   190       200       210       220       230       240

                   250       260       270       280       290       300
m212.pep    LYRSITSAEAEKIAGIPLSVPYDHPSCGLYWQHGVWLNPPAFVRTLLNHPLIGLHEDTPL
            ||||||:|||||||||||::|| :| |||:||:|||||||:|||:||:||||||||||||
a212        LYRSITQAEAEKIAGIPLNTPYAEPLCGLFWQYGVWLNPPTFVRALLSHPLIGLHEDTPL
                   250       260       270       280       290       300

                   310       320       330       340       350       360
m212.pep    TDISHDGEKWIASTPNGTFTATHIIYCTGANSPYLPETNLAALPLRQIRGQTGLTPSTPF
            |||||||||||||||||||||||||||||||||||||||||:||||||||||||||||||
a212        TDISHDGEKWIASTPNGTFTATHIIYCTGANSPYLPETNLATLPLRQIRGQTGLTPSTPF
                   310       320       330       340       350       360

                   370       380       390       400       410       420
m212.pep    SEQLRCAVSGESYISPSWHGLHCYGASFIPNSSHTGWNEAEEASNRQALAHLNPALSESL
            ||||||||||||||||||||||||||||||||||||||||||||||||||||||||||||
a212        SEQLRCAVSGESYISPSWHGLHCYGASFIPNSSHTGWNEAEEASNRQALAHLNPALSESL
                   370       380       390       400       410       420

                   430       440       450       460       470       480
m212.pep    FAANPNPQKHQGHAAIRCDSPDHLPLVGALGDIAAMRQTYTKLALDKNYRIDTPCPYLPN
            ||||||||||||||||||||||||||||||||||||:|||:|||||||||||:|||||||
a212        FAANPNPQKHQGHAAIRCDSPDHLPLVGALGDIAAMQQTYAKLALDKNYRIDAPCPYLPN
                   430       440       450       460       470       480

                   490       500       510       520       530       540
m212.pep    AYVNTAHGTRGLATAPICAAXXAAQIXGLPHPFXQRLRHALHPNRTIIRIAVRRKDLTPX
            ||:|||||||||||||||||  ||:| |||||: :||||||||||:||||||||||||||
a212        AYANTAHGTRGLATAPICAAAVAAEILGLPHPLSKRLRHALHPNRAIIRAIVRRKDLTPX
                   490       500       510       520       530       540
```

The following partial DNA sequence was identified in *N. gonorrhoeae* <SEQ ID 739>:

```
g214.seq
   1 atgatacaaa agatatgtaa gctatttgtt ttaattgtaa tttttgcaac

  51 ttctcccgct tttgcccttc aaagcgacag cagacggccc atccaaatcg

 101 aagccgacca aggttcgctc gatcaagcca accaaaggac cacatttagc

 151 ggcaatgtca tcatcagaca gggtacgctc aacatttccg cctcgtgtgt

 201 caacgtcaca cgcggcaggc aaaggcggcg aatccgtgag ggcggaaggt

 251 tcgcccgtcc gcttcagcca aacgttggac gggggcaaag ggacggtgcg

 301 cggtcaggca aacaacgtta cctattcctc cgcaggaagc actgtcgttc

 351 tgaccggcaa tgccaaagtg cagcgcggcg gcgacgttgc cgaaggtgcg

 401 gtcattacct acaacaccaa aaccgaagtc tataccatca acggcagcac

 451 gaaatcgggt gcgaaatccg cttccaaaac cggcagggtc agcgtcgtca

 501 tccagccttc aagcacacaa aaaaccgaat aaccccgatg ccgtctgaaa

 551 cggaaacgca gttcagacgg catttgccga ccgaaatgcc gagaagagat

 601 tattga
```

This corresponds to the amino acid sequence <SEQ ID 740; ORF 214.ng>:

```
g214.pep
   1 MIQKICKLFV LIVIFATSPA FALQSDSRRP IQIEADQGSL DQANQRTTFS

  51 GNVIIRQGTL NISASCVNVT RGRQRRRIRE GGRFARPLQP NVGRGQRDGA

 101 RSGKQRYLFL RRKHCRSDRQ CQSAARRRRC RRCGHYLQHQ NRSLYHQRQH

 151 EIGCEIRFQN RQGQRRHPAF KHTKNRITPM PSETETQFRR HLPTEMPRRD

 201 Y
```

The following partial DNA sequence was identified in *N. meningitidis* <SEQ ID 741>:

```
m214.seq (partial)
   1 ATGATACAAA AGATATGTAA GCTATTTGTT TTAATAGCAT TTTTTTCGGC

  51 GTCCCCCGCT TTTGCCCTTC AAAGCGACAG CAGGCAGCCT ATTCAGATTG

 101 AGGCCGACCA AGGTTCGCTC GATCAAGCCA ACCAAAGCAC CACATTCAGC

 151 GGAAACGTCG TCATCAGACA GGGTACGCTC AATATTTCCG CCGCCCGCGT

 201 CAATGTTACA CGCGGCGGCA AAGGCGGCGA ATCCGTGAGG GCGGAAGGTT

 251 CGCCAGTCCG CTTCAGCCAG ACATTGGACG GCGGCAAAGG CACGGTGCGC

 301 GGACAGGCAA ACAACGTTGC TTATTCATCT GCAGGCAGCA CCGTAGTCTT

 351 AACCGGTAAT GCCAAAGTAC AGCGCGGCGG CGATGTCGCC GAAGGTGCGG

 401 TGATTACATA CAACACCAAA ACCGAAGTCT ATACCATCAG CGGCAGCACA

 451 AAATT...
```

This corresponds to the amino acid sequence <SEQ ID 742; ORF 214>:

```
m214.pep (partial)
   1 MICKICKLFV LIAFFSASPA FALQSDSRQP IQIEADQGSL DQANQSTTFS
```

-continued

```
 51 GNVVIRQGTL NISAARVNVT RGRQRRRIRE GGRFASPLQP DIGRRQRHGA

101 RTGKQRCLFI CRQHRSLNR* CQSTARRRCR RRCGDYIQHQ NRSLYHQRQH

151 KI...
```

Computer analysis of this amino acid sequence gave the following results:

Homology with a Predicted ORF from *N. gonorrhoeae*

ORF 214 shows 80.3% identity over a 152 aa overlap with a predicted ORF (ORF 214.ng) from *N. gonorrhoeae*:

```
m214/g214

                    10        20        30        40        50        60
m214.pep   MIQKICKLFVLIAFFSASPAFALQSDSRQPIQIEADQGSLDQANQSTTFSGNVVIRQGTL
           ||||||||||||::|::|||||||||||:|||||||||||||||| |||||||:||||||
g214       MIQKICKLFVLIVIFATSPAFALQSDSRRPIQIEADQGSLDQANQRTTFSGNVIIRQGTL
                    10        20        30        40        50        60

                    70        80        90       100       110       120
m214.pep   NISAARVNVTRGRQRRRIREGGRFASPLQPDIGRRQRHGARTGKQRCLFICRQHRSLNRX
           ||||: ||||||||||||||||||| ||||::|| || |||:|||| ||: |:|    :|
g214       NISASCVNVTRGRQRRRIREGGRFARPLQPNVGRGQRDGARSGKQRYLFLRRKHCRSDRQ
                    70        80        90       100       110       120

                   130       140       150
m214.pep   CQSTARRRCRRRCGDYIQHQNRSLYHQRQHKI
           |||:||||  |||| |:|||||||||||||:|
g214       CQSAARRRRCRRCGHYLQHQNRSLYHQRQHEIGCEIRFQNRQGQRRHPAFKHTKNRITPM
                   130       140       150       160       170       180

g214       PSETETQFRRHLPTEMPRRDY
                   190       200
```

The following partial DNA sequence was identified in *N. meningitidis* <SEQ ID 743>:

```
a214.seq
  1 ATGATACAAA AGATATGTAA GCTATTTGTT TTAATAGCAT TTTTTTCGGC

 51 GTCCCCCGCT TTTGCCCTTC AAAGCGACAG CAGGCAGCCT ATTCAGATTG

101 AGGCCGACCA AGGTTCGCTC GATCAAGCCA ACCAAAGCAC CACATTCAGC

151 GGAAACGTCG TCATCAGACA GGGTACGCTC AATATTTCCG CCGCCCGCGT

201 CAATGTTACA CGCGGC.GGC AAAGGCGGCG AATCCGTGAG GGCGGAAGGT

251 TCGCCAGTCC GCTTCAGCCA GACATTGGAC GGCGGCAAAG GCACGGTGCG

301 CGGACAGGCA AACAACGTTG CTTATTCATC TGCAGGCAGC ACCGTAGTCT

351 TAACCGGTAA TGCCAAAGTA CAGCGCGGCG GCGATGTCGC CGAAGGTGCG

401 GTGATTACAT ACAACACCAA AACCGAAGTC TATACCATCA GCGGCAGCAC

451 AAAATCCGGC GCAAAATCCG CTTCCAAATC CGGCAGGGTC AGCGTCGTTA

501 TCCAGCCTTC GAGTACGCAA AAATCCGAAT AATCCCAATG CCGTCTGAAA

551 CATAAACCTG GTTCGGACGG CATTTGCCGA CCGAAATATT GAAGAGATAT

601 TTATGA
```

This corresponds to the amino acid sequence <SEQ ID 744; ORF 214.a>:

a214.pep

1 <u>MIQKICKLFV LIAFFSASPA FA</u>LQSDSRQP IQIEADQGSL DQANQSTTFS

```
 51 GNVVIRQGTL NISAARVNVT RGXQRRRIRE GGRFASPLQP DIGRRQRHGA

101 RTGKQRCLFI CRQHRSLNR* CQSTARRRCR RRCGDYIQHQ NRSLYHQRQH
```

-continued

```
151 KIRRKIRFQI RQGQRRYPAF EYAKIRIIPM PSET*TWFGR HLPTEILKRY

201 L*
```

m214/a214 99.3% identity in 152 aa overlap

```
                    10        20        30        40        50        60
m214.pep    MIQKICKLFVLIAFFSASPAFALQSDSRQPIQIEADQGSLDQANQSTTFSGNVVIRQGTL
            ||||||||||||||||||||||||||||||||||||||||||||||||||||||||||||
a214        MIQKICKLFVLIAFFSASPAFALQSDSRQPIQIEADQGSLDQANQSTTFSGNVVIRQGTL
                    10        20        30        40        50        60
                    70        80        90       100       110       120
m214.pep    NISAARVNVTRGRQRRRIREGGRFASPLQPDIGRRQRHGARTGKQRCLFICRQHRSLNRX
            |||||||||||| |||||||||||||||||||||||||||||||||||||||||||||||
a214        NISAARVNVTRGXQRRRIREGGRFASPLQPDIGRRQRHGARTGKQRCLFICRQHRSLNRX
                    70        80        90       100       110       120
                   130       140       150
m214.pep    CQSTARRRCRRRCGDYIQHQNRSLYHQRQHKI
            ||||||||||||||||||||||||||||||||
a214        CQSTARRRCRRRCGDYIQHQNRSLYHQRQHKIRRKIRFQIRQGQRRYPAFEYAKIRIIPM
                   130       140       150       160       170       180
a214        PSETXTWFGRHLPTEILKRYLX
                   190       200
```

The following partial DNA sequence was identified in *N. gonorrhoeae* <SEQ ID 745>:

```
g214-1.seq
    1 ATGATACAAA AGATATGTAA GCTATTTGTT TTAATTGTAA TTTTTGCAAC

   51 TTCTCCCGCT TTTGCCCTTC AAAGCGACAG CAGACGGCCC ATCCAAATCG

  101 AAGCCGACCA AGGTTCGCTC GATCAAGCCA ACCAAAGTAC CACATTTAGC

  151 GGCAATGTCA TCATCAGACA GGGTACGCTC AACATTTCCG CCTCGCGCGT

  201 CAACGTCACA CGCGGCGGCA AAGGCGGCGA ATCCGTGAGG GCGGAAGGTT

  251 CGCCCGTCCG CTTCAGCCAA ACGTTGGACG GGGGCAAAGG GACGGTGCGC

  301 GGTCAGGCAA ACAACGTTAC CTATTCCTCC GCAGGAAGCA CCGTCGTTCT

  351 GACCGGCAAT GCCAAAGTGC AGCGCGGCGG CGACGTTGCC GAAGGTGCGG

  401 TCATTACCTA CAACACCAAA ACCGAAGTCT ATACCATCAA CGGCAGCACG

  451 AAATCGGGTG CGAAATCCGC TTCCAAAACC GGCAGGGTCA GCGTCGTCAT

  501 CCAGCCTTCA AGCACACAAA AAACCGAATA A
```

This corresponds to the amino acid sequence <SEQ ID 746; ORF 214-1.ng>:

```
g214-1.pep
    1 MIQKICKLFV LIVIFATSPA FALQSDSRRP IQIEADQGSL DQANQSTTFS

   51 GNVIIRQGTL NISASRVNVT RGGKGGESVR AEGSPVRFSQ TLDGGKGTVR

  101 GQANNVTYSS AGSTVVLTGN AKVQRGGDVA EGAVITYNTK TEVYTINGST

  151 KSGAKSASKT GRVSVVIQPS STQKTE*
```

The following partial DNA sequence was identified in *N. meningitidis* <SEQ ID 747>:

```
m214-1.seq
    1 ATGATACAAA AGATATGTAA GCTATTTGTT TTAATAGCAT TTTTTTCGGC

   51 GTCCCCCGCT TTTGCCCTTC AAAGCGACAG CAGGCAGCCT ATTCAGATTG
```

-continued

```
101 AGGCCGACCA AGGTTCGCTC GATCAAGCCA ACCAAAGCAC CACATTCAGC

151 GGAAACGTCG TCATCAGACA GGGTACGCTC AATATTTCCG CCGCCCGCGT

201 CAATGTTACA CGCGGCGGCA AAGGCGGCGA ATCCGTGAGG GCGGAAGGTT

251 CGCCAGTCCG CTTCAGCCAG ACATTGGACG GCGGCAAAGG CACGGTGCGC

301 GGACAGGCAA ACAACGTTGC TTATTCATCT GCAGGCAGCA CCGTAGTCTT

351 AACCGGTAAT GCCAAAGTAC AGCGCGGCGG CGATGTCGCC GAAGGTGCGG

401 TGATTACATA CAACACCAAA ACCGAAGTCT ATACCATCAG CGGCAGCACA

451 AAATCCGGCG CAAAATCCGC TTCCAAATCC GGCAGGGTCA GCGTCGTTAT

501 CCAGCCTTCG AGTACGCAAA AATCCGAATA A
```

This corresponds to the amino acid sequence <SEQ ID 748; ORF 214-1>:

```
m214-1.pep

  1   MIQKICKLFV LIAFFSASPA FALQSDSRQP IQIEADQGSL DQANASTTFS

 51   GNVVIRQGTL NISAARVNVT RGGKGGESVR AEGSPVRFSQ TLDGGKGTVR

101   GQANNVAYSS AGSTVVLTGN AKVQRGGDVA EGAVITYNTK TEVYTISGST

151   KSGAKSASKS GRVSVVIQPS STQKSE*

m214-1/g214-1  93.8% identity in 176 aa overlap

                     10        20        30        40        50        60
m214-1.pep    MIQKICKLFVLIAFFSASPAFALQSDSRQPIQIEADQGSLDQANQSTTFSGNVVIRQGTL
              |||||||||||::|::||||||||||:|||||||||||||||||||||||||:||||||
g214-1        MIQKICKLFVLIVIFATSPAFALQSDSRRPIQIEADQGSLDQANQSTTFSGNVIIRQGTL
                     10        20        30        40        50        60

                     70        80        90       100       110       120
m214-1.pep    NISAARVNVTRGGKGGESVRAEGSPVRFSQTLDGGKGTVRGQANNVAYSSAGSTVVLTGN
              ||||:|||||||||||||||||||||||||||||||||||||||||:||||||||||||||
g214-1        NISASRVNVTRGGKGGESVRAEGSPVRFSQTLDGGKGTVRGQANNVTYSSAGSTVVLTGN
                     70        80        90       100       110       120

                    130       140       150       160       170
m214-1.pep    AKVQRGGDVAEGAVITYNTKTEVYTISGSTKSGAKSASKSGRVSVVIQPSSTQKSEX
              |||||||||||||||||||||||||:|||||||||||||:||||||||||||||:||
g214-1        AKVQRGGDVAEGAVITYNTKTEVYTINGSTKSGAKSASKTGRVSVVIQPSSTQKTEX
                    130       140       150       160       170

g214-1 (SEQ ID 746)/p38685 (SEQ ID 4165)
sp|P38685|YHBN_ECOLI 17.3 KD PROTEIN IN MURA-RPON INTERGENIC REGION PRECURSOR (ORF185)
>gi|551336 (U12684) orf185 [Escherichia coli] >gi|606139 (U18997_ ORF_o185 [Escherichia coli]
>gi|1789592 (AE0000399) orf, hypothetical protein [Escherichia coli] Length = 185
Score = 97.1 bits (238), Expect = 6e-20
Identities = 57/126 (45%), Positives = 74/126 (58%), Gaps = 3/126 (2%)

Query: 19   PAFALQSDSRQPIQIEADQGSLDQANQSTTFSGNVVIRQGTLNISAARVNVTR--GGKGG 76
             PAFA+  D+ QPI IE+DQ SLD      TF+GNV++ QGT+ I+A +V VTR  G +G
Sbjct: 24   PAFAVTGDTDQPIHIESDQQSLDMQGNVVTFTGNVIVTQGTIKINADKVVVTRPGGEQGK 83

Query: 77   ESVRAEGSPVRFSQTLDGGKGTVRGQANNVAYSSAGSTVVLTGNAKVQRGGDVAEGAVIT 136
             E +   G P  F Q  D GK  V G A+ + Y  A   VVLTGNA +Q+     +G  IT
Sbjct: 84   EVIDGYGKPATFYQMQDNGK-PVEGHASQMHYELAKDFVVLTGNAYLQQVDSNIKGDKIT 142

Query: 137  YNTKTE 142
             Y  K +
Sbjct: 143  YLVKEQ 148
```

The following partial DNA sequence was identified in *N. meningitidis* <SEQ ID 749>:

```
a214-1.seq
  1 ATGATACAAA AGATATGTAA GCTATTTGTT TTAATAGCAT TTTTTTCGGC

 51 GTCCCCCGCT TTTGCCCTTC AAAGCGACAG CAGGCAGCCT ATTCAGATTG

101 AGGCCGACCA AGGTTCGCTC GATCAAGCCA ACCAAAGCAC CACATTCAGC
```

-continued

```
151 GGAAACGTCG TCATCAGACA GGGTACGCTC AATATTTCCG CCGCCCGCGT

201 CAATGTTACA CGCGGCGGCA AAGGCGGCGA ATCCGTGAGG GCGGAAGGTT

251 CGCCAGTCCG CTTCAGCCAG ACATTGGACG GCGGCAAAGG CACGGTGCGC

301 GGACAGGCAA ACAACGTTGC TTATTCATCT GCAGGCAGCA CCGTAGTCTT

351 AACCGGTAAT GCCAAAGTAC AGCGCGGCGG CGATGTCGCC GAAGGTGCGG

401 TGATTACATA CAACACCAAA ACCGAAGTCT ATACCATCAG CGGCAGCACA

451 AAATCCGGCG CAAAATCCGC TTCCAAATCC GGCAGGGTCA GCGTCGTTAT

501 CCAGCCTTCG AGTACGCAAA AATCCGAATA A
```

This corresponds to the amino acid sequence <SEQ ID 750; ORF 214-1.a>:

```
a214-1.pep

      1  MIQKICKLFV LIAFFSASPA FALQSDSRQP IQIEADQGSL DQANQSTTFS

     51  GNVVIRQGTL NISAARVNVT RGGKGGESVR AEGSPVRFSQ TLDGGKGTVR

    101  GQANNVAYSS AGSTVVLTGN AKVQRGGDVA EGAVITYNTK TEVYTISGST

    151  KSGAKSASKS GRVSVVIQPS STQKSE*
```

```
a214-1/m214-1  100.0% identity in 176 aa overlap

                      10        20        30        40        50        60
a214-1.pep    MIQKICKLFVLIAFFSASPAFALQSDSRQPIQIEADQGSLDQANQSTTFSGNVVIRQGTL
              ||||||||||||||||||||||||||||||||||||||||||||||||||||||||||||
m214-1        MIQKICKLFVLIAFFSASPAFALQSDSRQPIQIEADQGSLDQANQSTTFSGNVVIRQGTL
                      10        20        30        40        50        60

                      70        80        90       100       110       120
a214-1.pep    NISAARVNVTRGGKGGESVRAEGSPVRFSQTLDGGKGTVRGQANNVAYSSAGSTVVLTGN
              ||||||||||||||||||||||||||||||||||||||||||||||||||||||||||||
m214-1        NISAARVNVTRGGKGGESVRAEGSPVRFSQTLDGGKGTVRGQANNVAYSSAGSTVVLTGN
                      70        80        90       100       110       120

                     130       140       150       160       170
a214-1.pep    AKVQRGGDVAEGAVITYNTKTEVYTISGSTKSGAKSASKSGRVSVVIQPSSTQKSEX
              |||||||||||||||||||||||||||||||||||||||||||||||||||||||||
m214-1        ARVQRGGDVAEGAVITYNTKTEVYTISGSTKSGAKSASKSGRVSVVIQPSSTQKSEX
                     130       140       150       160       170
```

The following partial DNA sequence was identified in *N. gonorrhoeae* <SEQ ID 751>:

```
g215.seq
    1 atgaaagtaa gatggcggta cggaattgcg ttcccattga tattggcggt

   51 tgccttgggc agcctgtcgg catggttggg ccgtatcagc gaagtcgaaa

  101 tcgaggaagt caggctcaat cccgacgaac ctcaatacac aatggacggc

  151 ttggacggaa ggcggtttga cgaacaggga tacttgaaag aacatttgag

  201 cgcgaaaggt gcgaaacagt ttcccgaaaa cagcgacatc cattttgatt

  251 cgccgcatct cgtgttcttc caagaaggca ggctgttgta cgaagtcggc

  301 agcgatgaag ccgtttacca taccgaaaac aaacaggttc tttttaaaaa

  351 caacgttgtg ctgaccaaaa ccgccgacgg caggcggcag gcgggtaaag

  401 tcgaaaccga aaaactgcac gtcgataccg aatctcaata tgcccaaacc

  451 gatacgcctg tcagtttcca atatggcgcg tcgcacggtc aggcgggcgg

  501 tatgacctac aaccacaaaa caggcatgtt gaacttctca tctaaagtga

  551 aaaccacaat ttataataca aaaaatatat aa
```

This corresponds to the amino acid sequence <SEQ ID 752; ORF 215.ng>:

```
g215.pep
    1 MKVRWRYGIA FPLILAVALG SLSAWLGRIS EVEIEEVRLN PDEPQYTMDG

   51 LDGRRFDEQG YLKEHLSAKG AKQFPENSDI HFDSPHLVFF QEGRLLYEVG

  101 SDEAVYHTEN KQVLFKNNVV LTKTADGRRQ AGKVETEKLH VDTESQYAQT

  151 DTPVSFQYGA SHGQAGGMTY NHKTGMLNFS SKVKAAIYDT KDM*
```

The following partial DNA sequence was identified in *N. meningitidis* <SEQ ID 753>:

```
m215.seq (partial)
    1 ..AGCCTGTCGG CATGGTTGGG TCGTATCAGC GAAGTCGAGA TTGAAGAAGT

   51   CAGGCTCAAT CCCGACGAAC CGCAATACAC AATGGACAGC TTGGACGGCA

  101   GGCGGTTTGA CGAACAGGGA TACTTGAAAG AACATTTGAG CGCGAAGGGC

  151   GCGAAACAGT TTCCGGAAAG CAGCGACATC CATTTTGATT CGCCGCATCT

  201   CGTGTTCTTC CAAGAAGGCA GGTTGTTGTA CGAAGTCGGC AGCGACGAAG

  251   CCGTTTACCA TACCGAAAAC AAACAGGTTC TTTTTAAAAA CAACGTTGTG

  301   CTGACCAAAA CCGCCGACGG CAAACGGCAG GCGGGTAAAG TTGAAGCCGA

  351   AAAGCTGCAC GTCGATACCG AATCTCAATA TGCCCAAACC GATACGCCTG

  401   CAGTTTCCA ATATGGTGCA TCGCACGGTC AGGCGGGCGG CATGACTTAC

  451   GACCACAwwA CAGGCATGTT GAACTTCTCA TCTAAAGTGA AAGCCACGAT

  501   TTATGATACA AAAGATATGT AA
```

This corresponds to the amino acid sequence <SEQ ID 754; ORF 215>:

```
m215.pep (partial)
    1 ..SLSAWLGRIS EVEIEEVRLN PDEPQYTMDS LDGRRFDEQG YLKEHLSAKG

   51   AKQFPESSDI HFDSPHLVFF QEGRLLYEVG SDEAVYHTEN KQVLFKNNVV

  101   LTKTADGKRQ AGKVEAEKLH VDTESQYAQT DTPVSFQYGA SHGQAGGMTY

  151   DHXTGMLNFS SKVKATIYDT KDM*
```

Computer analysis of this amino acid sequence gave the following results:

Homology with a Predicted ORF from *N. gonorrhoeae*

ORF 215 shows 96.0% identity over a 173 aa overlap with a predicted ORF (ORF 215.ng) from *N. gonorrhoeae*:

```
m215/g215

                                         10        20        30        40
m215.pep                         SLSAWLGRISEVEIEEVRLNPDEPQYTMDSLDGRRFDEQG
                                 ||||||||||||||||||||||||||||:|||||||||||
g215      MKVRWRYGIAFPLILAVALGSLSAWLGRISEVEIEEVRLNPDEPQYTMDGLDGRRFDEQG
                   10        20        30        40        50        60

                   50        60        70        80        90       100
m215.pep  YLKEHLSAKGAKQFPESSDIHFDSPHLVFFQEGRLLYEVGSDEAVYHTENKQVLFKNNVV
          ||||||||||||||||:|||||||||||||||||||||||||||||||||||||||||||
g215      YLKEHLSAKGAKQFPENSDIHFDSPHLVFFQEGRLLYEVGSDEAVYHTENKQVLFKNNVV
                   70        80        90       100       110       120
```

-continued

```
                110        120        130        140        150        160
m215.pep LTKTADGKRQAGKVEAEKLHVDTESQYAQTDTPVSFQYGASHGQAGGMTYDHXTGMLNFS
         |||||||:|||||||:||||||||||||||||||||||||||||||||||:| |||||||
g215     LTKTADGRRQAGKVETEKLHVDTESQYAQTDTPVSFQYGASHGQAGGMTYNHXTGMLNFS
                130        140        150        160        170        180

                170
m215.pep SKVKATIYDTKDMX
         |||||:||||||||
g215     SKVKAAIYDTKDMX
                190
```

The following partial DNA sequence was identified in *N. meningitidis* <SEQ ID 755>:

```
a215.seq
     1 ATGAAAGTAA GATGGCGGTA CGGAATTGCG TTCCCATTGA TATTGGCGGT

    51 TGCCTTGGGC AGCCTGTCGG CATGGTTGGG ACGCATCAGC GAAGTCGAGA

   101 TTGAAGAAGT CAGGCTCAAT CCCGACGAAC CGCAATACAC AATGGACGGA

   151 TTGGATGGCA GGCGGTTTGA CGAACAGGGA TACTTGAAAG AACATTTGAG

   201 TTCGAAGGGC GCGAAACAGT TTCCCGAAAG CAGCGACATT CATTTCGACT

   251 CACCGCATCT CGTGTTCTTC CAAGAAGGCA GGTTGTTGTA CGAAGTCGGC

   301 AGCGATGAAG CCGTTTACCA TACCGAAAAC AAACAGGTTC TTTTTAAAAA

   351 CAACGTTGTG CTGACCAAAA CCGCCGACGG CAAACGGCAG GCGGGTAAAG

   401 TTGAAGCCGA AAAGCTGCAC GTCGATACCG AATCTCAATA TGCCCAAACC

   451 GATACGCCTG TCAGTTTCCA ATATGGTGCA TCGCACGGTC AGGCGGGCGG

   501 CATGACTTAC GACCACAAAA CAGGCATGTT GAACTTCTCA TCTAAAGTGA

   551 AAGCCACGAT TTATGATACA AAAGATATGT AA
```

This corresponds to the amino acid sequence <SEQ ID 756; ORF 215.a>:

```
a215.pep
     1 MKVRWRYGIA FPLILAVALG SLSAWLGRIS EVEIEEVRLN PDEPQYTMDG

    51 LDGRRFDEQG YLKEHLSSKG AKQFPESSDI HFDSPHLVFF QEGRLLYEVG

   101 SDEAVYHTEN KQVLFKNNVV LTKTADGKRQ AGKVEAEKLH VDTESQYAQT

   151 DTPVSFQYGA SHGQAGGMTY DHKTGMLNFS SKVKATIYDT KDM*
```

m215/a215 98.3% identity in 173 aa overlap

```
                                            10        20        30        40
m215.pep                         SLSAWLGRISEVEIEEVRLNPDEPQYTMDSLDGRRFDEQG
                                 ||||||||||||||||||||||||||||||:|||||||||
a215               MKVRWRYGIAFPLILAVALGSLSAWLGRISEVEIEEVRLNPDEPQYTMDGLDGRRFDEQG
                            10        20        30        40        50        60

                            50        60        70        80        90       100
m215.pep           YLKEHLSAKGAKQFPESSDIHFDSPHLVFFQEGRLLYEVGSDEAVYHTENKQVLFKNNVV
                   |||||||:||||||||||||||||||||||||||||||||||||||||||||||||||||
a215               YLKEHLSSKGAKQRPESSDIHFDSPHLVFFQEGRLLYEVGSDEAVYHTENKQVLFKNNVV
                            70        80        90       100       110       120

                           110       120       130       140       150       160
m215.pep           LTKTADGKRQAGKVEAEKLHVDTESQYAQTDTPVSFQYGASHGQAGGMTYDHXTGMLNFS
                   |||||||||||||||||||||||||||||||||||||||||||||||||||| |||||||
a215               LTKTADGKRQAGKVEAEKLHVDTESQYAQTDTPVSFQYGASHGQAGGMTYDHKTGMLNFS
                           130       140       150       160       170       180
```

-continued

```
                    170
m215.pep      SKVKATIYDTKDMX
              ||||||||||||||
a215          SKVKATIYDTKDMX
                    190
```

The following partial DNA sequence was identified in *N. gonorrhoeae* <SEQ ID 757>:

```
g216.seq (partial)
   1 . . . atgatatcga tttcgagctc ggtacccagc gacgaaatca ccgccatcat

  51       ccccgcactc aaacgcaaag acattaccct cgtctgcatc accgcccgcc

 101       ccgattcaac catggcgcgc catgccgata tccacatcac cgcatcggtt

 151       tcgcaagaag cctgcccgtt ggggcttgcc ccgaccacca gcaccaccgc

 201       cgttatggct ttgggcgacg cgttggcggt cgtcctgctg cgcgcccgcg

 251       cgttcacgcc cgacgacttc gccttgatcc accctgccgg cagcctcggc

 301       aaacgcctgc ttttgcgcgt tgccgacatt atgcacaaag gcggcggcct

 351       gcccgccgtc cgactcggca cgcccttgaa aggagccatc gtcagcatga

 401       gcgagaaagg tttgggcatg tgggcgggaa cggacgggca aaggctgtct

 451       gaaaggcctt tttactga
```

This corresponds to the amino acid sequence <SEQ ID 758; ORF 216.ng>:

```
g216.pep (partial)
   1 . . . MISISSSVPS DEITAIIPAL KRKDITLVCI TARPDSTMAR HADIHITASV

  51       SQEACPLGLA PTTSTTAVMA LGDALAVVLL RARAFTPDDF ALIHPAGSLG

 101       KRLLLRVADI MHKGGGLPAV RLGTPLKGAI VSMSEKGLGM WAGTDGQRLS

 151       ERPFY*
```

The following partial DNA sequence was identified in *N. meningitidis* <SEQ ID 759>:

```
m216.seq
    1  ATGGCAATGG CAGAAAACGG AAAATATCTC GACTGGGCAC GCGAAGTGTT

   51  GCACGCCGAA GCGGAAGGCT TGCGCGAAAT TGCAGCGGAA TTGsACAAAA

  101  ACTTCGTCCT TGCGGCAGAC GCGTTGTTGC ACTGCAAGGG CAGGGTCGTT

  151  ATCACGGGCA TGGTCAAGTC GGGACATATC GGGCGCAAAA TGGCGGCAAC

  201  TATGGCCTCG ACCGGCACGC CTGCGTTTTT CGTCCACCCT GCGGAAGCGG

  251  CACACGgCGA TTTGGGTATG ATTGTGGACA rCGACGTGGT CGTCGCGATT

  301  TCCAATTCCG GCGAAAGCGA CGAAATCGCC GCCATCATCC CCGCACTCAA

  351  ACGCAAAGAC ATCACGCTTG TCTGCATCAC CGCCCGCCCC GATTCAACCA

  401  TGGCGCGCCA TGCCGACATC CACATCACGG CGTCGGTTTC CAAAGAAGCC

  451  TGCCCGCTGG GGCTTGCCCC GACCACCAGC ACCACCGCCG TCATGGCTTT

  501  GGGCGATGCG TTGGCGGTCG TCCtGCTGCG CgcACGCGCG TTCACGCCCG

  551  ACGATTTCGC CTTGAGCCAT CCTGCCGGCA GCCTCGGCAA ACGCCTACTT

  601  TTGCGCGTTG CCGACATTAT GCACAAAGGC GGCGGCCTGC CTGCCGTCCG

  651  ACTCGGCACG CCCTTGAAAG AAGCCATCGT CAGCATGAGT GAAAAAGGGC
```

-continued

701 TGGGCATGTT GGCGGTAACG GACGGGCAAG GCCGTCTGAA AGGCGTATTC

751 ACCGACGGCG ATTTGCGCCG CCTGTTTCAA GAATGCGACA ATTTTACCGG

801 TCTTTCGATA GACGAAGTCA TGCATACGCA TCCTAAAACC ATCTCCGCCG

851 AACGTCTCGC CACCGAAGCC CTGAAAGTCA TGCAGGCAAA CCATGTGAAC

901 GGGCTTCTGG TTACCGATGC AGATGGCGTG CTGATCGGCG CGCTGAATAT

951 GCACGACCTG CTGGCGGCAC GGATTGTATA G

This corresponds to the amino acid sequence <SEQ ID 760; ORF 216>:

m216.pep

1 MAMAENGKYL DWAREVLHAE AEGLREIAAE LXKNFVLAAD ALLHCKGRVV

51 ITGMVKSGHI GRKMAATMAS TGTPAFFVHP AEAAHGDLGM IVDXDVVVAI

101 SNSGESDEIA AIIPALKRKD ITLVCITARP DSTMARHADI HITASVSKEA

151 CPLGLAPTTS TTAVMALGDA LAVVLLRARA FTPDDFALSH PAGSLGKRLL

201 LRVADIMHKG GGLPAVRLGT PLKEAIVSMS EKGLGMLAVT DGQGRLKGVF

251 TDGDLRRLFQ ECDNFTGLSI DEVMHTHPKT ISAERLATEA LKVMQANHVN

301 GLLVTDADGV LIGALNMHDL LAARIV*

Computer analysis of this amino acid sequence gave the following results:

Homology with a Predicted ORF from *N. gonorrhoeae*

ORF 216 shows 91.8% identity over a 147 aa overlap with a predicted ORF (ORF 216.ng) from *N. gonorrhoeae*:

```
m216/g216

           70        80        90       100       110       120
m216.pep TMASTGTPAFFVHPAEAAHGDLGMIVDXDVVVAISNSGESDEIAAIIPALKRKDITLVCI
                                       :::||:|  ||||:||||||||||||||||
g216                                   MISISSSVPSDEITAIIPALKRKDITLVCI
                                               10        20        30

          130       140       150       160       170       180
m216.pep TARPDSTMARHADIHITASVSKEACPLGLAPTTSTTAVMALGDALAVVLLRARAFTPDDF
         |||||||||||||||||||||:||||||||||||||||||||||||||||||||||||||
g216     TARPDSTMARHADIHITASVSQEACPLGLAPTTSTTAVMALGDALAVVLLRARAFTPDDF
                 40        50        60        70        80        90

          190       200       210       220       230       240
m216.pep ALSHPAGSLGKRLLLRVADIMHKGGGLPAVRLGTPLKEAIVSMSEKGLGMLAVTDGQGRL
         || |||||||||||||||||||||||||||||||||| |||||||||||| | ||||
g216     ALIHPAGSLGKRLLLRVADIMHKGGGLPAVRLGTPLKGAIVSMSEKGLGMWAGTDGQRLS
                100       110       120       130       140       150
```

The following partial DNA sequence was identified in *N. meningitidis* <SEQ ID 761>:

a216.seq

1 ATGGCGATGG CAGGAAACGA AAAATATCTT GATTGGGCAC GCGAAGTGTT

51 GCACACCGAA GCGGAAGGCT TGCGCGAAAT TGCGGCGGAT TTGGACGAAA

101 ACTTCGCCCT TGCGGCGGAC GCGTTGTTGC ACTGCAAAGG CAGGGTCGTT

151 ATCACGGGCA TGGGCAAGTC GGGACATATC GGGCGCAAAA TGGCGGCAAC

201 CATGGCCTCG ACCGGCACGC CCGCGTTTTT CGTCCACCCT GCGGAAGCGG

251 CACACGGCGA TTTGGGCATG ATTGTGGACA ACGACGTGGT CGTCGCGATT

301 TCCAATTCCG GTGAAAGCGA CGAAATCGCC GCCATCATCC CCGCGCTCAA

-continued

```
351  ACGCAAAGAT ATCACGCTTG TCTGCATCAC CGCCCGCCCC GATTCAACCA

401  TGGCGCGCCA TGCCGACATC CACATCACGG CGTCGGTTTC CAAAGAAGCC

451  TGCCCGCTGG GGCTTGCCCC GACCACCAGC ACCACCGCCG TTATGGCTTT

501  GGGCGATGCG TTGGCGGTTG TCCTGCTGCG CGCCCGCGCG TTCACGCCCG

551  ACGACTTCGC CTTGAGCCAC CCTGCCGGCA GCCTCGGCAA ACGCCTACTT

601  TTGCGCGTTG CCGACATTAT GCACAAAGGC GGCGGCCTGC CTGCCGTCCG

651  ACTCGGCACG CCCTTGAAAG AAGCCATCGT CAGCATGAGT GAAAAAGGGC

701  TGGGCATGTT GGCGGTAACG GACGGGCAAG GCCGTCTGAA AGGCGTATTC

751  ACCGACGGCG ATTTGCGCCG CCTGTTTCAA GAATGCGACA ATTTTACCGG

801  TCTTTCGATA GACGAAGTCA TGCATACGCA TCCTAAAACC ATCTCCGCCG

851  AACGTCTCGC CACCGAAGCC CTGAAAGTCA TGCAGGCAAA CCATGTGAAC

901  GGGCTTCTGG TTACCGATGC AGATGGCGTG CTGATCGGCG CGCTGAATAT

951  GCACGACCTT TTGGCGGCGC GGATTGTATA G
```

This corresponds to the amino acid sequence <SEQ ID 762; ORF 216.a>:

```
a216.pep
  1  MAMAGNEKYL DWAREVLHTE AEGLREIAAD LDENFALAAD ALLHCKGRVV

 51  ITGMGKSGHI GRKMAATMAS TGTPAFFVHP AEAAHGDLGM IVDNDVVVAI

101  SNSGESDEIA AIIPALKRKD ITLVCITARP DSTMARHADI HITASVSKEA

151  CPLGLAPTTS TTAVMALGDA LAVVLLRARA FTPDDFALSH PAGSLGKRLL

201  LRVADIMHKG GGLPAVRLGT PLKEAIVSMS EKGLGMLAVT DGQGRLKGVF

251  TDGDLRRLFQ ECDNFTGLSI DEVMHTHPKT ISAERLATEA LKVMQANHVN

301  GLLVTDADGV LIGALNMHDL LAARIV*
```

m216/a216 971% identity in 326 aa overlap

```
                    10        20        30        40        50        60
m216.pep   MAMAENGKYLDWAREVLHAEAEGLREIAAELXKNFVLAADALLHCKGRVVITGMVKSGHI
           |||| | |||||||||||:||||||||||:| :||:|||||||||||||||||| |||||
a216       MAMAGNEKYLDWAREVLHTEAEGLREIAADLDENFALAADALLHCKGRVVITGMGKSGHI
                    10        20        30        40        50        60

                    70        80        90       100       110       120
m216.pep   GRKMAATMASTGTPAFFVHPAEAAHGDLGMIVDXDVVVAISNSGESDEIAAIIPALKRKD
           ||||||||||||||||||||||||||||||||| ||||||||||||||||||||||||||
a216       GRKMAATMASTGTPAFFVHPAEAAHGDLGMIVDNDVVVAISNSGESDEIAAIIPALKRKD
                    70        80        90       100       110       120

                   130       140       150       160       170       180
m216.pep   ITLVCITARPDSTMARHADIHITASVSKEACPLGLAPTTSTTAVMALGDALAVVLLRARA
           ||||||||||||||||||||||||||||||||||||||||||||||||||||||||||||
a216       ITLVCITARPDSTMARHADIHITASVSKEACPLGLAPTTSTTAVMALGDALAVVLLRARA
                   130       140       150       160       170       180

                   190       200       210       220       230       240
m216.pep   FTPDDFALSHPAGSLGKRLLLRVADIMHKGGGLPAVRLGTPLKEAIVSMSEKGLGMLAVT
           ||||||||||||||||||||||||||||||||||||||||||||||||||||||||||||
a216       FTPDDFALSHPAGSLGKRLLLRVADIMHKGGGLPAVRLGTPLKEAIVSMSEKGLGMLAVT
                   190       200       210       220       230       240

                   250       260       270       280       290       300
m216.pep   DGQGRLKGVFTDGDLRRLFQECNDFTGLSIDEVMHTHPKTISAERLATEALKVMQANHVN
           ||||||||||||||||||||||||||||||||||||||||||||||||||||||||||||
a216       DGQGRLKGVFTDGDLRRLFQECNDFTGLSIDEVMHTHPKTISAERLATEALKVMQANHVN
                   250       260       270       280       290       300
```

-continued

```
              310       320
m216.pep GLLVTDADGVLIGALNMHDLLAARIVX
         |||||||||||||||||||||||||||
a216     GLLVTDADGVLIGALNMHDLLAARIVX
              310       320
```

The following partial DNA sequence was identified in *N. gonorrhoeae* <SEQ ID 763>:

```
g217.seq
    1  atggcggatg acggtttgtt gcggcaactg tccgaaaaac ccagccaaag

   51  tgctctcttc ctgccatttg acccattcgt tttcgaggtt ttggactgcc

  101  ttttggtcat cgggcccggc ttgaaacaat gtttcaagca aatcccggca

  151  acgcgccacc cattcgccga ccgtcgcagg ttgccgccat atccgggcaa

  201  tatccgacag ggtttcgagg aaggcggcaa aacgtccgaa catggcggtt

  251  tgattcacgt cggcatacca cgcgctgaca tcctgccaca tcgggttgcc

  301  gccttcgggc agcatccagc ccaatatcat acggtctgcc gcctgcttcc

  351  aggtaaacag ctgatccgtg ccgccgcgca tttctccgtc caatccccaa

  401  tggacgttca aatcggcaac catatcgtgc aaaagcggca aatcgtcccc

  451  ggtcagtccg aaacggcgca acacgggcgc ggtttccaaa agcgcgagca

  501  ctttgccgac ttcaaaacgg ctttccagca agtcggacac gcactccaac

  551  gcataaaaaa acggttgccg gcggctgatt ttcacgtccg aaacggaata

  601  cggcaatgcc tgcgcgccgg gttgcgcctg tccgaacacg gcttccataa

  651  aaggcgtata gggttcgata ttcggggtta a
```

This corresponds to the amino acid sequence <SEQ ID 764; ORF 217.ng>:

```
g217.pep..
    1  MADDGLLRQL SEKPSQSALF LPFDPFVFEV LDCLLVIGPG LKQCFKQIPA

   51  TRHPFADRRR LPPYPGNIRQ GFEEGGKTSE HGGLIHVGIP RADILPHRVA

  101  AFGQHPAQYH TVCRLLPGKQ LIRAAAHFSV QSPMDVQIGN HIVQKRQIVP

  151  GQSETAQHGR GFQKREHFAD FKTAFQQVGH ALQRIKKRLP AADFHVRNGI

  201  RQCLRAGLRL SEHGFHKRRI GFDIRG*
```

The following partial DNA sequence was identified in *N. meningitidis* <SEQ ID 765>:

```
m217.seq
    1  ATGGCGGATG ACGGTGTGCG GCGGCAACTG TCCGGAAAAT TGCGCCAATT

   51  CGGTTTCCGC CTrCCATTTG ACCCATTCGT TTTCAAGGTT TTGGACTGAC

  101  TTTTGGTCAT CGGCTTCAGC TTGGAACAAT GTTTCAAGCA AATCCCGGCA

  151  ACGCGCCACC CATTCGCCGA CCGTTGCGGG CTGCCGCCAT ATCCGTACAA

  201  TATCCGTCAG GGTTTCGAGG AAGGCGGCAA AACGTCCGAA CATGGCGGTT

  251  TGATTCACGT CGGCATACCA CGCGCTGACA TCCTGCCACA TCGGATTGCC

  301  GCCTTTGGGC AGCATCCAGC CCAATATCAT GCGTTCTACC GCCTGCTTCC

  351  AGGTGAACAG CTGATCCGTG CCGCCGCGCA TTTCTCCGTC CAAACCCCAG

  401  TGGACGTTCA AATCGGCAAC CATGTCGTGC AAAAGCGGTA AATCGTCCTC
```

-continued

```
451  AGTCAGTCCG AAACGGCGCA ACACGGGCGC GGTTTCTAAA AGCACAAGCA

501  CTTTATCGAC TTCAAATCGG CTTTCCAACA AGTCGAACAG GCATGACAAA

551  GCATGAAACA GCGGTTGGCG GCGGCTGATT TTCACGTCTG ACACGGAATA

601  CGGCAATGCC TGCGCACCgG GctGCGCCTG TCCGAACACG GCTTCGATAA

651  AAGGCGTATA GGATTCGATA TTCGGGGTTA A
```

This corresponds to the amino acid sequence <SEQ ID 766; ORF 217>:

```
m217.pep
  1  MADDGVRRQL SGKLRQFGFR LPFDPFVFKV LDXLLVIGFS LEQCFKQIPA

 51  TRHPFADRCG LPPYPYNIRQ GFEEGGKTSE HGGLIHVGIP RADILPHRIA

101  AFGQHPAQYH AFYRLLPGEQ LIRAAAHFSV QTPVDVQIGN HVVQKRXIVL

151  SQSETAQHGR GFXKHKHFID FKSAFQQVEQ AXQSMKQRLA AADFHVXHGI

201  RQCLRTGLRL SEHGFDKRRI GFDIRG*
```

Computer analysis of this amino acid sequence gave the following results:

Homology with a Predicted ORF from *N. gonorrhoeae*

ORF 217 shows 80.5% identity over a 226 aa overlap with a predicted ORF (ORF 217.ng) from *N. gonorrhoeae*:

```
m217/g217

                  10        20        30        40        50        60
m217.pep MADDGVRRQLSGKLRQFGFRLPFDPFVFKVLDXLLVIGFSLEQCFKQIPATRHPFADRCG
         |||||: |||| |   | :: ||||||||:||| |||||  :|:||||||||||||||||
g217     MADDGLLRQLSGKPSQSALFLPFDPFVFEVLDCLLVIGPGLKQCFKQIPATRHPFADRRR
                  10        20        30        40        50        60

                  70        80        90       100       110       120
m217.pep LPPYPYNIRQGFEEGGKTSEHGGLIHVGIPRADILPHRIAAFGQHPAQYHAFYRLLPGEQ
         ||||| |||||||||||||||||||||||||||||:|||||||||||:   |||||:|
g217     LPPGPYNIRQGFEEGGKTSEHGGLIHVGIPRADILPHRVAAFGQHPAQYHTVCRLLPGKQ
                  70        80        90       100       110       120

                 130       140       150       160       170       180
m217.pep LIRAAAHFSVQTPVDVQIGNHVVQKRXIVLSQSETAQHGRGFXKHKHFIDFKSAFQQVEQ
         |||||||||||:|:||||||||:|||| || :||||||||||| |::|| |||:||||| :
g217     LIRAAAHFSVQSPMDVQIGNHIVQKRQIVPGQSETAQHGRGFQKREHFADFKTAFQQVGH
                 130       140       150       160       170       180

                 190       200       210       220
m217.pep AXQSMKQRLAAADFHVXHGIRQCLRTGLRLSEHGFDKRRIGFDIRGX
         | |  :|:|| |||||| :|||||||:||||||||| ||||||||||
g217     ALQRIKQRLPAADFHVRNGIRQCLRAGLRLSEHGFHKRRIGFDIRG
                 190       200       210       220
```

The following partial DNA sequence was identified in *N. meningitidis* <SEQ ID 767>:

```
a217.seq
  1  GTGGCGGATG ACGGTGTGCA GCGGCAACTG TCCGGAAAAT TGCGCCAATT

 51  CGGTTTCCGC CTGCCATTTG ACCCATTCGT TTTCGAGGCT TTGGACTGCC

101  TTTTGGTCAT CGCCTTCGAC TTGGAACAAT GTTTCAAGCA AATCCCGGCA

151  ACGCGCCACC CATTCGTCAA CCGTCGCAGG TTGCCGCCAT ATCCGTACAA

201  TATCCGTCAG GGTTTCGAGG AAGGCGGCAA AACGTCCGAA CAGGGCGGTT

251  TGGTTCACGT CGGCATACCA CGCGCTGACC CCCTGCCACA TCGGATTGCC

301  GCCTTCGGGC AGCATCCAGC CCAATATCAT GCGTTCTACC GCCTGCTTCC
```

-continued

```
351  AGGTGAACAG CTGATCCGTG CCGCCGCGCA TTTCTCCGTC CAAACCCCAG

401  CGGACGTTCA AATCGGCAAC CATGTCGTGC AAAAGCGGCA AATCGTCCTC

451  AGTCAGTCCG AAATGGCGCA ACACGGGCGC GGTTTCTAAA AGCACAAGCA

501  CTTTATCGAC TTCAAATCGG CTTTCCAACA AGTCGAACAG GCATGACAAA

551  GCATGAAACA GCGGTTGTCG GCGGCTGATT TTCACATCCG AAACGGAATA

601  CGGCAATGCC TGCGCGCCGG GCTGCGCCTG TCCGAACACG GCTTCGATAA

651  AAGGCGTATA GGATTCGATA TTCGGGGTTA A
```

This corresponds to the amino acid sequence <SEQ ID 768; ORF 217.a>:

```
a217.pep
    1  VADDGVQRQL SGKLRQFGFR LPFDPFVFEA LDCLLVIAFD LEQCFKQIPA

   51  TRHPFVNRRR LPPYPYNIRQ GFEEGGKTSE QGGLVHVGIP RADPLPHRIA

  101  AFGQHPAQYH AFYRLLPGEQ LIRAAAHFSV QTPADVQIGN HVVQKRQIVL

  151  SQSEMAQHGR GF*KHKHFID FKSAFQQVEQ A*QSMKQRLS AADFHIRNGI

  201  RQCLRAGLRL SEHGFDKRRI GFDIRG*
```

m217/a217 90.1% identity in 226 aa overlap

```
                   10        20        30        40        50        60
m217.pep   MADDGVRRQLSGKLRQFGFRLPFDPFVFKVLDXLLVIGFSLEQCFKQIPATRHPFADRCG
           :|||||:|||||||||||||||||||||::|| ||||:|:||||||||||||||||::|
a217       VADDGVQRQLSGKLRQFGFRLPFDPFVFEALDCLLVIAFDLEQCFKQIPATRHPFVNRRR
                   10        20        30        40        50        60

                   70        80        90       100       110       120
m217.pep   LPPYPYNIRQGFEEGGKTSEHGGLIHVGIPRADILPHRIAAFGQHPAQYHAFYRLLPGEQ
           ||||||||||||||||||||:|||:|||||||| ||||||||||||||||||||||||||
a217       LPPYPYNIRQGFEEGGKTSEQGGLVHVGIPRADPLPHRIAAFGQHPAQYHAFYRLLPGEQ
                   70        80        90       100       110       120

                  130       140       150       160       170       180
m217.pep   LIRAAAHFSVQTPVDVQIGNHVVQKRXIVLSQSETAQHGRGFXKHKHFIDFKSAFQQVEQ
           |||||||||||||:|||||||||||| ||||||| |||||||||||||||||||||||||
a217       LIRAAAHFSVQTPADVQIGNHVVQKRQIVLSQSEMAQHGRGFXKHKHFIDFKSAFQQVEQ
                  130       140       150       160       170       180

                  190       200       210       220
m217.pep   AXQSMKQRLAAADFHVXHGIRQCLRTGLRLSEHGFDKRRIGFDIRGX
           |||||||||:|||||: :|||||||:||||||||||||||||||||||
a217       AXQSMKQRLSAADFHIRNGIRQCLRAGLRLSEHGFDKRRIGFDIRGX
                  190       200       210       220
```

The following partial DNA sequence was identified in *N. gonorrhoeae* <SEQ ID 769>:

```
g218.seq
    1  atggttgcgg tggatcctta tacggcaaaa gtggtcaaca ccatgccgcg

   51  caatcagggt tggtatcaca ctatggatga aatccacggc gatatgatgc

  101  tcggtgcggc aggcgattat cttttggaaa cggcagcttc actgaccatt

  151  attatggttg tcagcggctt gtacctttgg tgggcgaaac agcgcggcat

  201  taaagcgatg ctgctgccgc caaaaagcag ggcgcgttct tggtggcgga

  251  atctgcacgg cgcgtttgga acttgggtgt cgttgatttt actgttgttc

  301  tgcctgtcgg gtattgcttg ggcaggtatt tggggcggca aattcgtgca

  351  ggcttggaat cagttcccgg ccggcaaatg gggtgtcgaa ccgaaccccg

  401  tttcaatcgt gccgacccac ggcgaggtat tgaatgacgg caaggttaag
```

-continued

```
451  gaagtgccgt ggattttgga gcttatgcct atgcctgtct cagggacgac
501  tgtgggtgaa aacggcatta accccaccga gcccaataac attggaaacc
551  gtcgaccgtt tcgcgcggga aatcggtttc aaagggcgtt atcagttgaa
601  tttgcccaaa ggcgaggacg gggtatggac tttgtcgcag gattctatga
651  gttatga
```

This corresponds to the amino acid sequence <SEQ ID 770; ORF 218.ng>:

```
g218.pep
  1  MVAVDPYTAK VVNTMPRNQG WYHTMDEIHG DMMLGAAGDY LLETAASLTI
 51  IMVVSGLYLW WAKQRGIKAM LLPPKSRARS WWRNLHGAFG TWVSLILLLF
101  CLSGIAWAGI WGGKFVQAWN QFPAGKWGVE PNPVSIVPTH GEVLNDGKVK
151  EVPWILELMP MPVSGTTVGE NGINPTEPNN IGNRRPFRAG NRFQRALSVE
201  FAQRRGRGMD FVAGFYEL*
```

The following partial DNA sequence was identified in *N. meningitidis* <SEQ ID 771>:

```
m218.seq
  1  ATGGTCGCGG TCGATCCTTA TACGGCAAAA GTGGTCAGTA CCATGCCGCG
 51  CAATCAGGGT TGGTATTACA CGATGGATGA AATCCACAGC GATATGATGC
101  TCGGTGCGGC AGGCGATTAT CTTTTGGAAA CGGCAGCTTC ACTGACCATT
151  ATTATGGTTG TCAGCGGCTT GTACCTTTGG TGGGTGAAAC GGCGCGGCAT
201  CAAGGCGATG CTGCTGCCGT CAAAAGGCAr GGCGCGTTCT TGGTGGCGGA
251  ATCTGCACGG CACGTTTGGA ACTTGGGTGT CGTTGATTTT GCTGTTGTTC
301  TGCCTGTCGG GTATTGCTTG GGCGGGTATT TGGGGCGGCA AGTTCGTACA
351  GGCTTGGAGT CAGTTCCCTG CCGGTAAATG GGGTGTCGAA CCGAACCCCG
401  TTTCAGTCGT GCCGACCCAC GGCGAGGTAT TGAATGACGG CAAGGTTAAG
451  GAAGTGCCGT GGGTTTTGGA GCTTACGCCT ATGCCTGTTT CAGGGACGaC
501  yGtgGGCAAA GACGGCATTA ACCCTGACGA GCCGATGACA TTGGAAACCG
551  TCGACCGCTT TGCGCGGnGA AATCGGTTTC AAAGGGCGTT ATCAGTTGAA
601  TTTGCCCAAA GGCGAGGACG GCGTATGGAC TTTGTCGCAG GATTCTATGA
651  GTTA
```

This corresponds to the amino acid sequence <SEQ ID 772; ORF 218>:

```
m218.pep
  1  MVAVDPYTAK VVSTMPRNQG WYYTMDEIHS DMMLGAAGDY LLETAASLTI
 51  IMVVSGLYLW WVKRRGIKAM LLPSKGXARS WWRNLHGTFG TWVSLILLLF
101  CLSGIAWAGI WGGKFVQAWS QFPAGKWGVE PNPVSVVPTH GEVLNDGKVK
151  EVPWVLELTP MPVSGTTVGK DGINPDEPMT LETVDRFARX NRFQRALSVE
201  FAQRRGRRMD FVAGFYEL
```

Computer analysis of this amino acid sequence gave the following results:

Homology with a Predicted ORF from *N. gonorrhoeae*

ORF 218 shows 87.2% identity over a 218 aa overlap with a predicted ORF (ORF 218.ng) from *N. gonorrhoeae*:

```
m218/g218

                      10        20        30        40        50        60
m218.pep      MVAVDPYTAKVVSTMPRNQGWYYTMDEIHSDMMLGAAGDYLLETAASLTIIMVVSGLYLW
              ||||||||||||:|||||||||:||||||:||||||||||||||||||||||||||||||
g218          MVAVDPYTAKVVNTMPRNQGWYHTMDEIHGDMMLGAAGDYLLETAASLTIIMVVSGLYLW
                      10        20        30        40        50        60

70        80          90       100       110       120
m218.pep      WVKRRGIKAMLLPSKGXARSWWRNLHGTFGTWVSLILLLFCLSGIAWAGIWGGKFVQAWS
              |:|:||||||||| |: ||||||||||:|||||||||||||||||||||||||||||||:
g218          WAKQRGIKAMLLPPKSRARSWWRNLHGAFGTWVSLILLLFCLSGIAWAGIWGGKFVQAWN
                      70        80        90       100       110       120

                     130       140       150       160       170       180
m218.pep      QFPAGKWGVEPNPVSVVPTHGEVLNDGKVKEVPWVLELTPMPVSGTTVGKDGINPDEPMT
              |||||||||||||||:||||||||||||||||||:||||||||||||||::|||| || :
g218          QFPAGKWGVEPNPVSIVPTHGEVLNDGKVKEVPWILELTPMPVSGTTVGENGINPTEPNN
                     130       140       150       160       170       180

                     190       200       210
m218.pep      LETVDRFARXNRFQRALSVEFAQRRGRRMDFVAGFYEL
              : :   |   ||||||||||||||||| ||||||||||
g218          IGNRRPFRAGNRFQRALSVEFAQRRGRGMDFVAGFYEL
                     190       200       210
```

The following partial DNA sequence was identified in *N. meningitidis* <SEQ ID 773>:

```
a218.seq
  1 ATGGTCGCGG TCGATCCTTA TACGGCAAAA GTGGTCAGTA CCATGCCGCG

 51 CAATCAGGGT TGGTATTACG CGATGGATGA AATCCACAGC GATATGATGC

101 TCGGTTCGAC AGGTGATTAT CTTTTGGAAA CGGCTGCATC GCTGACGATT

151 ATCATGATAA TCAGCGGTTT GTACCTTTGG TGGGTGAAAC GGCGCGGCAT

201 CAAGGCGATG CTGCTGCCGC CAAAAGGCAG GGCGCGTTCT TGGTGGCGGA

251 ATCTGCACGG CGCGTTTGGA ACTTGGGTGT CGTTGATTTT ACTGTTGTTC

301 TGCCTGTCGG GTATTGCTTG GGCAGGTATT TGGGGCGGCA AGTTCGTGCA

351 GGCTTGGAGT CAGTTCCCGG CAGGCAAATG GGGTGTCGAA CCGAACCCTG

401 TTTCAGTCGT GCCGACCCAC GGCGAGGTAT TGAATGACGG CAAGGTTAAG

451 GAAGTGCCGT GGGTTTTGGA GCTTACGCCT ATGCCTGTTT CAGGGACGAC

501 TGTGGGCAAA GACGGTATTA ACCCTGACGA GCCGATGACA TTGGAAACCG

551 TCGACCGTTT TGCGCGG.GA AATCGGTTTC AAAGGGCGTT ATCAGCTGAA

601 TTTGCCCAAA GGCGAGGACG GCGTATGGAC TTTGTCGCAG GATTCTATGA

651 GTTA
```

This corresponds to the amino acid sequence <SEQ ID 774; ORF 218.a>:

```
a218.pep
  1 MVAVDPYTAK VVSTMPRNQG WYYAMDEIHS DMMLGSTGDY LLETAASLTI


 51 IMIISGLYLW WVKRRGIKAM LLPPKGRARS WWRNLHGAFG TWVSLILLLF


101 CLSGIAWAGI WGGKFVQAWS QFPAGKWGVE PNPVSVVPTH GEVLNDGKVK
```

-continued

```
151 EVPWVLELTP MPVSGTTVGK DGINPDEPMT LETVDRFARX NRFQRALSAE

201 FAQRRGRRMD FVAGFYEL
```

m218/a218 95.9% identity in 218 aa overlap

```
                 10        20        30        40        50        60
m218.pep MVAVDPYTAKVVSTMPRNQGWYYTMDEIHSDMMLGAAGDYLLETAASLTIIMVVSGLYGW
         |||||||||||||||||||||||:|||||||||||::|||||||||||||||::||||||
a218     MVAVDPYTAKVVSTMPRNQGWYYAMDEIHSDMMLGSTGDYLLETAASLTIIMIISGLYGW
                 10        20        30        40        50        60

                 70        80        90       100       110       120
m218.pep WVKRRGIKAMLLPSKGXARSWWRNLHGTFGTWVSLILLLFCLSGIAWAGIWGGKFVQAWS
         ||||||||||||| || ||||||||||:||||||||||||||||||||||||||||||||
a218     WVKRRGIKAMLLPPKGRARSWWRNLHGAFGTWVSLILLLFCLSGIAWAGIWGGKFVQAWS
                 70        80        90       100       110       120

                130       140       150       160       170       180
m218.pep QFPAGKWGVEPNPVSVVPTHGEVLNDGKVKEVPWVLELTPMPVSGTTVGKDGINPDEPMT
         ||||||||||||||||||||||||||||||||||||||||||||||||||||||||||||
a218     QFPAGKWGVEPNPVSVVPTHGEVLNDGKVKEVPWVLELTPMPVSGTTVGKDGINPDEPMT
                130       140       150       160       170       180

                190       200       210
m218.pep LETVDRFARXNRFQRALSVEFAQRRGRRMDFVAGFYEL
         ||||||||||||||||||:|||||||||||||||||||
a218     LETVDRFARXNRFQRALSAEFAQRRGRRMDFVAGFYEL
                190       200       210
```

The following partial DNA sequence was identified in *N. gonorrhoeae* <SEQ ID 775>:

```
g219.seq
  1 atgacggcaa ggttaaggaa gtgccgtgga ttttggagct tatgcctatg

 51 cctgtctcag ggacgactgt gggtgaaaac ggcattaacc ccaccgagcc

101 caataacatt ggaaaccgtc gaccgtttcg cgcgggaaat cggtttcaaa

151 gggcgttatc agttgaattt gcccaaaggc gaggacgggg tatggacttt

201 gtcgcaggat tctatgagtt atgacatgat cagcccgttt gccgaccgca

251 cggtacatat cgaccagtac agcggcgaga ttcttgccga catccgtttt

301 gacgattaca acccgttcgg caaatttatg gcggcaagca ttgcgctgca

351 tatggggact ttgggctggt ggagcgtgtt ggcgaacgtc gtgttctgcc

401 ttgccgtgat ttttatcggc atcagcggct gcgtgatgtg gtggaaacgc

451 cgtccgtccg gcgtggcggg cattgttcct ccggcgcaaa aaatcaaact

501 gcccgtctgg tgggcgatgg cattgccgct gctgttgatt gcactgcttt

551 tcccgaccgc gctgcttgcc attgccgtga tttggctgtt ggataccttg

601 ctgctgtcgc ggattcctgt gttgaggaaa tggtttaaat ga
```

This corresponds to the amino acid sequence <SEQ ID 776; ORF 219.ng>:

```
g219.pep
  1 MTARLRKCRG FWSLCLCLSQ GRLWVKTALT PPSPITLETV DRFAREIGFK

 51 GRYQLNLPKG EDGVWTLSQD SMSYDMISPF ADRTVHIDQY SGEILADIRF

101 DDYNPFGKFM AASIALHMGT LGWWSVLANV VFCLAVIFIG ISGCVMWWKR

151 RPSGVAGIVP PAQKIKLPVW WAMALPLLLI ALLFPTALLA IAVIWLLDTL

201 LLSRIPVLRK WFK*
```

The following partial DNA sequence was identified in *N. meningitidis* <SEQ ID 777>:

```
m219.seq
   1 ATGACGGCAA GGTTAAGGAA GTGCCGTGGG TTTTGGAGCT TACGCCTATG

  51 CCTGTTTCAG GGACGaCyGt gGGCAAAGAC GGCATTAACC CTGACGAGCC

 101 GATGACATTG GAAACCGTCG ACCGCTTTGC GCGGnGAAAT CGGTTTCAAA

 151 GGGCGTTATC AGTTGAATTT GCCCAAAGGC GAGGACGGCG TATGGACTTT

 201 GTCGCAGGAT TCTATGAGTT ACGACATGAT CAGCCCGTTT GCCGACCGCA

 251 CGGTACATAT CGACCAGTAC AGCGGCAAAA TCCTTGCCGA CATCCGTTTT

 301 GACGATTACA ACCCGTTCGG CAAATTTATG GCGGCAAGCA TTGCGCTGCA

 351 TATGGGGACT CTGGGCTGGT GGAGCGTGTT GGCGAACGTC TTGTTCTGCC

 401 TTGCCGTCAT TTTTATCGGT ATCAGCGGCT GCGTGATGTG GTGGAAACGC

 451 CGTCCGACCG GAGCGGTGGG CATCGTTCCG CCGGCGCAGA AAGTCAAGCT

 501 GCCGGTTTGG TGGATGATGG CATTGCCGCT ATTGGCAATC GCACTGCTCT

 551 TCCCGACCTC ACTGCTTGCC ATTGCCGTGA TTTGGCTGTT GGATACGCTG

 601 CTGTTGTCGC GGATTCCTGT TTTGAGGAGA TGGTTTAAAT GA
```

This corresponds to the amino acid sequence <SEQ ID 778; ORF 219>:

```
m219.pep
   1 MTARLRKCRG FWSLRLCLFQ GRXWAKTALT LTSRXHWKPS TALRGEIGFK

  51 GRYQLNLPKG EDGVWTLSQD SMSYDMISPF ADRTVHIDQY SGKILADIRF

 101 DDYNPFGKFM AASIALHMGT LGWWSVLANV LFCLAVIFIG ISGCVMWWKR

 151 RPTGAVGIVP PAQKVKLPVW WMMALPLLAI ALLFPTSLLA IAVIWLLDTL

 201 LLSRIPVLRR WFK*
```

Computer analysis of this amino acid sequence gave the following results:

Homology with a Predicted ORF from *N. gonorrhoeae*

ORF 219 shows 86.9% identity over a 213 aa overlap with a predicted ORF (ORF 219.ng) from *N. gonorrhoeae*:

```
m219/g219

                   10        20        30        40        50        60
m219.pep  MTARLRKCRGFWSLRLCLFQGRXWAKTALTLTSRXHWKPSTALRGEIGFKGRYQLNLPKG
          |||||||||||||| ||| ||| |:|||||  |     :   :  |||||||||||||||
g219      MTARLRKCRGFWSLCLCLSQGRLWVKTALTPPSPITLETVDRFAREIGFKGRYQLNLPKG
                  10        20        30        40        50        60

                   70        80        90       100       110       120
m219.pep  EDGVWTLSQDSMSYDMISPFADRTVHIDQYSGKILADIRFDDYNPFGKFMAASIALHMGT
          ||||||||||||||||||||||||||||||||:|||||||||||||||||||||||||||
g219      EDGVWTLSQDSMSYDMISPFADRTVHIDQYSGEILADIRFDDYNPFGKFMAASIALHMGT
                  70        80        90       100       110       120

                  130       140       150       160       170       180
m219.pep  LGWWSVLANVLFCLAVIFIGISGCVMWWKRRPTGAVGIVPPAQKVKLPVWWMMALPLLAI
          ||||||||||:|||||||||||||||||||||:|::||||||||:|||||| |||||| |
g219      LGWWSVLANVVFCLAVIFIGISGCVMWWKRRPSGVAGIVPPAQKIKLPVWWAMALPLLLI
                 130       140       150       160       170       180

                  190       200       210
m219.pep  ALLFPTSLLAIAVIWLLDTLLLSRIPVLRRWFKX
          ||||||:||||||||||||||||||||||:|||
g219      ALLFPTALLAIAVIWLLDTLLLSRIPVLRKWFK
                 190       200       210
```

The following partial DNA sequence was identified in *N. meningitidis* <SEQ ID 779>:

```
a219.seq
   1 ATGACGGCAA GGTTAAGGAA GTGCCGTGGG TTTTGGAGCT TACGCCTATG

  51 CCTGTTTCAG GGACGACTGT GGGCAAAGAC GGTATTAACC CTGACGAGCC

 101 GATGACATTG GAAACCGTCG ACCGTTTTGC GCGG.GAAAT CGGTTTCAAA

 151 GGGCGTTATC AGCTGAATTT GCCCAAAGGC GAGGACGGCG TATGGACTTT

 201 GTCGCAGGAT TCTATGAGTT ACGACATGAT CAGCCCGTTT GCTGACCGCA

 251 CGGTGCATAT CGACCAGTAC AGCGGCAAGA TTCTTGCCGA CATCCGTTTT

 301 GACGATTACA ACCCGTTCGG CAAATTTATG GCGGCAAGCA TTGCGCTGCA

 351 TATGGGGACT TTGGGCTGGT GGAGCGTGTT GGCGAACGTT TTGTTCTGCC

 401 TTGCCGTGAT TTTTATCGGC ATCAGCGGCT GCGTGATGTG GTGGAAACGC

 451 CGTCCGTCCG GCGCGGTGGG CATGGTTCCG CCGGCGCAAA AAATCAAGCT

 501 GCCCGTCTGG TGGGCAATGG CGGTGCCGCT GCTGCTGATT GCATTGCTTT

 551 TCCCGACCGC GTTGCTTGCC ATTGCCGTGA TTTGGCTGTT GGATACGCTG

 601 CTGTTGTCGC GGATTCCTGT TTTGAGGAGA TGGTTTAAAT GA
```

This corresponds to the amino acid sequence <SEQ ID 780; ORF 219.a>:

```
a219.pep
   1 MTARLRKCRG FWSLRLCLFQ GRLWAKTVLT LTSR*HWKPS TVLRXEIGFK

  51 GRYQLNLPKG EDGVWTLSQD SMSYDMISPF ADRTVHIDQY SGKILADIRF

 101 DDYNPFGKFM AASIALHMGT LGWWSVLANV LFCLAVIFIG ISGCVMWWKR

 151 RPSGAVGMVP PAQKIKLPVW WAMAVPLLLI ALLFPTALLA IAVIWLLDTL

 201 LLSRIPVLRR WFK*
```

m219/a219 94.8% identity in 213 aa overlap

```
                    10        20        30        40        50        60
m219.pep    MTARLRKCRGFWSLRLCLFQGRXWAKTALTLTSRXHWKPSTALRGEIGFKGRYQLNLPKG
            |||||||||||||||||||||| ||||:|||||||||||||:|| |||||||||||||||
a219        MTARLRKCRGFWSLRLCLFQGRLWAKTVLTLTSRXHWKPSTVLRXEIGFKGRYQLNLPKG
                    10        20        30        40        50        60

                    70        80        90       100       110       120
m219.pep    EDGVWTLSQDSMSYDMISPFADRTVHIDQYSGKILADIRFDDYNPFGKFMAASIALHMGT
            ||||||||||||||||||||||||||||||||||||||||||||||||||||||||||||
a219        EDGVWTLSQDSMSYDMISPFADRTVHIDQYSGKILADIRFDDYNPFGKFMAASIALHMGT
                    70        80        90       100       110       120

                   130       140       150       160       170       180
m219.pep    LGWWSVLANVLFCLAVIFIGISGCVMWWKRRPTGAVGIVPPAQKVKLPVWWMMALPLLAI
            ||||||||||||||||||||||||||||||||:||||:||||||:|||||| ||:||| |
a219        LGWWSVLANVLFCLAVIFIGISGCVMWWKRRPSGAVGMVPPAQKIKLPVWWAMAVPLLLI
                   130       140       150       160       170       180

                   190       200       210
m219.pep    ALLFPTSLLAIAVIWLLDTLLLSRIPVLRRWFKX
            ||||||:|||||||||||||||||||||||||||
a219        ALLFPTALLAIAVIWLLDTLLLSRIPVLRRWFKX
                   190       200       210
```

The following partial DNA sequence was identified in *N. gonorrhoeae* <SEQ ID 781>:

```
g221.seq
  1  atgcacgacc acggcgccat ggatcgccgc ctccccgctt tcggaagtct
```

-continued

```
 51 gatgcggcga gccgtaaatc adatcgacgc tgacggattt gaaccctgcc

101 tcacgggcgg catcgatgac ttctttggtt tcttcgtagc tttggatgcg

151 gttgactgcc gcctgcactt tggggtcgaa atcctgaatg ccgacgctca

201 tgcggttgaa gccgagtctg ccgagcatga ggacggtgtc gcggctgact

251 ttgcgcgggt cgatttcgat ggaatattcg ccggacggta tcagttcgaa

301 atgtttgcgg atcatgcgga agacacgttc gatctgttcg tcgctcaaaa

351 aggtcggcgt gccgccgccg aagtgcagtt gggcaagctg gtgccgtccg

401 ttcagatgtg gagcgagcag ttccatttct ttttcaagat attcgatgta

451 ggtatcggcg cggcttttgt ctttggtgat gattttgttg cagccgcagt

501 agtagcagat ggtgttgcaa aacggaatgt gaatgtaaag ggaaagcggt

551 ttgtttaa
```

This corresponds to the amino acid sequence <SEQ ID 782; ORF 221.ng>:

g221.pep

```
  1 MHDHGAMDRR LPAFGSLMRR AVNXIDADGF EPCLTGGIDD FFGFFVALDA

 51 VDCRLHFGVE ILNADAHAVE AESAEHEDGV AADFARVDFD GIFAGRYQFE

101 MFADHAEDTF DLFVAQKGRR AAAEVQLGKL VPSVQMWSEQ FHFFFKIFDV

151 GIGAAFVFGD DFVAAAVVAD GVAKRNVNVK GKRFV*
```

The following partial DNA sequence was identified in *N. meningitidis* <SEQ ID 783>:

m221.seq

```
  1 ATGGyGGTTT TGATGcwcmg AAGTCTGGTG CGGCAGGCCG TAAATCAAAT

 51 CGACGCTGAC GGATTTGAAC CCCGCTTCGC GCGCCGCATC GATGACTTCT

101 TTGGTTTCTT CGTAACTTTG GATGCGGTTG ACCGCCGCCT GCACTTTGGG

151 GTCGAAATCC TGAATGCCGA TGCTCATGCG GTTGAAGCCG AGTCTGCCGA

201 GCATGAGGAC GGTGTCGCGG CTGACTTTGC GCGGGTCGAT TTCGATGGAG

251 TATTCGCCGG TGGGGATTAA CTCGAAATGT TTGCGTATCA TGCGGAAGAC

301 ACGTTCGATC TGTTCGTCGC TCAAAAAGGt GCGTGCcCCG CCGAAGTGCA

351 GTTGGGCAAG CTGGTGCCGT CCGTTCAGAT GTGGAGCGAG CAGTTCCATT

401 TCTTTTTCAA GATATTCGAT GTAGGCATCG GCGCGGCTTT TGTCTTTGGT

451 GATGATTTTG TTGCAGCCGC AGTAGTAGCA GATGGTGTTG CAGAACGGAA

501 TGTGAATGTA AAGGGAAAGC GGTTTGTTTA A
```

This corresponds to the amino acid sequence <SEQ ID 784; ORF 221>:

m221.pep

```
  1 MXVLMXRSLV RQAVNQIDAD GFEPRFARRI DDFFGFFVTL DAVDRRLHFG

 51 VEILNADAHA VEAESAEHED GVAADFARVD FDGVFAGGDX LEMFAYHAED

101 TFDLFVAQKG ACPAEVQLGK LVPSVQMWSE QFHFFFKIFD VGIGAAFVFG

151 DDFVAAAVVA DGVAERNVNV KGKRFV*
```

Computer analysis of this amino acid sequence gave the following results:

Homology with a Predicted ORF from *N. gonorrhoeae*

ORF 221 shows 87.6% identity over a 170 aa overlap with a predicted ORF (ORF 221.ng) from *N. gonorrhoeae*:

```
m221/g221

                           10        20        30        40        50
m221.pep           MXVLMXRSLVRQAVNQIDADGFEPRFARRIDDFFGFFVTLDAVDRRLHFGVE
                           ||:|:||| |||||||| ::  ||||||||:||||| |||||||
g221         MHDHGAMDRRLPAFGSLMRRAVNXIDADGFEPCLTGGIDDFFGFFVALDAVDCRLHFGVE
                     10        20        30        40        50        60

                   60        70        80        90       100       110
m221.pep     ILNADAHAVEAESAEHEDGVAADFARVDFDGVFAGGDXLEMFAYHAEDTFDLFVAQKGA-
             ||||||||||||||||||||||||||||||:|||   :|||| |||||||||||||||
g221         ILNADAHAVEAESAEHEDGVAADFARVDFDGIFAGRYQFEMFADHAEDTFDLFVAQKGRR
                   70        80        90       100       110       120

                 120       130       140       150       160       170
m221.pep     CPAEVQLGKLVPSVQMWSEQFHFFFKIFDVGIGAAFVFGDDGVAAAVVADGVAERNVNVK
              ||||||||||||||||||||||||||||||||||||||||||||||||||:||||||
g221         AAAEVQLGKLVPSVQMWSEQFHFFFKIFDVGIGAAFVFGDDGVAAAVVADGVAKRNVNVK
                  130       140       150       160       170       180

m221.pep     GKRFVX
             ||||||
g221         GKRFVX
```

The following partial DNA sequence was identified in *N. meningitidis* <SEQ ID 785>:

```
a221.seq
   1 ATGGTGGTTT TGATGCTCCG AAGTCTGGTG CGGCAGGCCG TAAATCAAAT

  51 CGACGCTGAC GGATTTGAAC CCCGCTTCGC GCGCCGCATC GATGACTTCT

 101 TTGGTTTCTT CGTAACTTTG GATGCGGTTG ACCGCCGCCT GCACTTTGGG

 151 GTCGAAATCC TGAATGCCGA TGCTCATGCG GTTGAAGCCG AGTCTGCCGA

 201 GCATGAGGAC GGTGTCGCGG CTGACTTTGC GCGGGTCGAT TTCGATGGAG

 251 TATTCGCCGG TGGGGATTAA CTCGAAATGT TTGCGTATCA TGCGGAAGAC

 301 ACGTTCGATT TGGTCGTCGC TCAAAAAGGT CGGCGTGCCG CCGCCGAAGT

 351 GCAGTTGGGC AAGCTGGTGC CGTCCGTTCA GATGTGGAGC GAGCAGTTCC

 401 ATTTCTTTTT CAAGAAATTC GATGTAGGCA TCGGCGCGGC TTTTGTCTTT

 451 GGTGATGATT TTGTTGCAGC CGCAGTAGTA GCAGATGGTG TTGCAGAACG

 501 GAATGTGAAT GTAAAGGGAA AGCGGTTTGT TTAA
```

This corresponds to the amino acid sequence <SEQ ID 786; ORF 221.a>:

```
a221.pep
   1 MVVLMLRSLV RQAVNQIDAD GFEPRFARRI DDFFGFFVTL DAVDRRLHFG

  51 VEILNADAHA VEAESAEHED GVAADFARVD FDGVFAGGD* LEMFAYHAED

 101 TFDLVVAQKG RRAAAEVQLG KLVPSVQMWS EQFHFFFKKF DVGIGAAFVF

 151 GDDFVAAAVV ADGVAERNVN VKGKRFV*
```

m221/a221 95.5% identity in 177 aa overlap

```
                    10        20        30        40        50        60
m221.pep   MXVLMXRSLVRQAVNQIDADGFEPRFARRIDDFFGFFVTLDAVDRRLHFGVEILNADAHA
           | ||| ||||||||||||||||||||||||||||||||||||||||||||||||||||||
a221       MVVLMLRSLVRQAVNQIDADGFEPRFARRIDDFFGFFVTLDAVDRRLHFGVEILNADAHA
                    10        20        30        40        50        60

                    70        80        90       100       110       119
m221.pep   VEAESAEHEDGVAADFARVDFDGVFAGGDXLEMFAYHAEDTFDLFVAQKGA-CPAEVQLG
           |||||||||||||||||||||||||||||||||||||||||||| |||||    ||||||
a221       VEAESAEHEDGVAADFARVDFDGVFAGGDXLEMFAYHAEDTFDLVVAQKGRRAAAEVQLG
                    70        80        90       100       110       120

         120       130       140       150       160       170
m221.pep   KLVPSVQMWSEQFHFFFKIFDVGIGAAFVFGDDFVAAAVVADGVAERNVNVKGKRFVX
           ||||||||||||||||| ||||||||||||||||||||||||||||||||||||||||
a221       KLVPSVQMWSEQFHFFFKKFDVGIGAAFVFGDDFVAAAVVADGVAERNVNVKGKRFVX
                   130       140       150       160       170
```

The following partial DNA sequence was identified in *N. gonorrhoeae* <SEQ ID 787>:

```
g223.seq
  1 atggaattca ggcaccaggt agtggtagtt ggtgtcgaac catttggtca

 51 tttcgatggc gaattggtct ttgttgccgc gcgccagttg gaagaattgt

101 tccaaaggca ggttttggct atcgaagccg aaacgggcgg gaatcgcgcc

151 cgtggatact tgcaggtcga ggatgtgatg gtagaaagtg aaatcacgta

201 cagcaacgta atcagcgtta ggagcagctt ggtgtttcca gtttttctcg

251 cgcaggtctt tggcaacgtc gagcagctct tgttcactga tctctttgcg

301 ccagtatttt tcttgggcga atttcaattc acggaaggcg ccgacacgcg

351 ggaagcctga
```

This corresponds to the amino acid sequence <SEQ ID 788; ORF 223.ng>:

```
g223.pep..
  1 MEFRHQVVVV GVEPFGHFDG ELVFVAARQL EELFQRQVLA IEAETGGNRA

 51 RGYLQVEDVM VESEITYSNV ISVRSSLVFP VFLAQVFGNV EQLLFTDLFA

101 PVFFLGEFQF TEGADTREA*
```

The following partial DNA sequence was identified in *N. meningitidis* <SEQ ID 789>:

```
m223.seq
  1 GTGGAATTCA GGCACCAAGT AGTGGTAGTT GGTGTCGAAC CATTTGGTCA

 51 TTTCGATAGC GAATTGGTCT TTGTTACCGC GCGCCAGTTG GAAGAATTGT

101 TCCAAAGACA GGTTTTGGCT GTCGAAGCCG AAGCGGGCGG GAATCGCGCC

151 GGTGGCGACT TGCAGGTCGA GGATGTGGTC GTAGAAAGTG AAATCsCTAC

201 GGCAACGAAA TCGGCGTTGG CAGCGACCTG GTGTTTCCAG TTTTTCTCGC

251 GCAAGTCTTT AGCAACAGCC AGCAATTCTT GCTCGCTGAT TTCTTTGCGC

301 CAGTATTTTT CTTGTGCGAA TTTCAATTCG CGGAAGGCGC CGACACGCGG

351 GAAGCCTGA
```

This corresponds to the amino acid sequence <SEQ ID 790; ORF 223>:

```
m223.pep
   1 VEFRHQVVVV GVEPFGHFDS ELVFVTARQL EELFQRQVLA VEAEAGGNRA

  51 GGDLQVEDVV VESEIXYGNE IGVGSDLVFP VFLAQVFSNS QQFLLADFFA

 101 PVFFLCEFQF AEGADTREA*
```

Computer analysis of this amino acid sequence gave the following results:

Homology with a Predicted ORF from *N. gonorrhoeae*

ORF 223 shows 80.7% identity over a 119 aa overlap with a predicted ORF (ORF 223.ng) from *N. gonorrhoeae*:

```
    m223/g223

                       10        20        30        40        50        60
    m223.pep   VEFRHQVVVVGVEPFGHFDSELVFVTARQLEELFQRQVLAVEAEAGGNRAGGDLQVEDVV
               :||||||||||||||||||:|||||:|||||||||||||:|||:||||| | ||||||:
    g223       MEFRHQVVVVGVEPFGHFDGELVFVAARQLEELFQRQVLAIEAETGGNRARGYLQVEDVM
                       10        20        30        40        50        60

                       70        80        90       100       110       119
    m223.pep   VESEIXYGNEIGVGSDLVFPVFLAQVFSNSQQFLLADFFAPVFFLCEFQFAEGADTREAX
               |||||:|:| |:| |:||||||||||:| :|:|::|:||||||| ||||:|||||||||
    g223       VESEITYSNVISVRSSLVFPVFLAQVFGNVEQLLFTDLFAPVFFLGEFQFTEGADTREAX
                       70        80        90       100       110       120
```

The following partial DNA sequence was identified in *N. meningitidis* <SEQ ID 791>:

```
a223.seq
   1 GTGGAATTCA GGCACCAAGT AGTGGTAGTT GGTGTCGAAC CATTTGGTCA

  51 TTTCGATAGC GAATTGGTCT TTGTTACCGC GCGCCAGTTG GAAGAATTGT

 101 TCCAAAGATA GGTTTTGGCT GTCGAAGCCG AAGCGGGCGG GAATCGCGCC

 151 GGTGGCGACT TGCAGGTCGA GGATGTGGTC GTAGAAAGTG AAATCGCCTA

 201 CGGCAACGTA ATCGGCGTTG GCAGCGGCCT GGTGTTTCCA GTTTTTCTCG

 251 CGCAAGTCTT TAGCAACAGC CAGCAATTCT TGCTCGCTGA TTTCTTTGCG

 301 CCAGTATTTT TCTTGTGCGA ATTTCAATTC GCGGAAGGCA CCGACACGCG

 351 GGAAGCCTGA
```

This corresponds to the amino acid sequence <SEQ ID 792; ORF 223.a>:

```
a223.pep
   1 VEFRHQVVVV GVEPFGHFDS ELVFVTARQL EELFQR*VLA VEAEAGGNRA

  51 GGDLQVEDVV VESEIAYGNV IGVGSGLVFP VFLAQVFSNS QQFLLADFFA

 101 PVFFLCEFQF AEGTDTREA*
```

m223/a223 95.8% identity in 119 aa overlap

```
                     10        20        30        40        70        60
    m223.pep VEFRHQVVVVGVEPFGHFDSELVFVTARQLEELFQRQVLAVEAEAGGNRAGGDLQVEDVV
             |||||||||||||||||||||||||||||||||||| |||||||||||||||||||||||
    a223     VEFRHQVVVVGVEPFGHFDSELVFVTARQLEELFQRXVLAVEAEAGGNRAGGDLQVEDVV
                     10        20        30        40        70        60
```

-continued

```
                 70        80        90       100       110       120
m223.pep VESEIXYGNEIGVGSDLVFPVFLAQVFSNSQQFLLADFFAPVFFLCEFQFAEGADTREAX
         ||||| ||| ||||| |||||||||||||||||||||||||||||||||||||:||||||
a223     VESEIAYGNVIGVGSGLVFPVFLAQVFSNSQQFLLADFFAPVFFLCEFQFAEGTDTREAX
                 70        80        90       100       110       120
```

The following partial DNA sequence was identified in *N. gonorrhoeae* <SEQ ID 793>:

```
g225.seq
  1 atggattctt ttttcaaacc ggcagtttgg gcggttttgt ggctgatgtt

 51 tgccgtccgc cccgcccttg ccgacgagtt gaccaacctg ctcagcagcc

101 gcgagcagat tctcagacag tttgccgaag acgaacagcc cgttttaccc

151 gtcaaccgag cccccgcccg gcgggcgggc aatgccgacg aactcatcgg

201 cggcgcgatg gggcttaacg aacagcccgt tgtacgcgtc aaccgagccn

251 ccgcccggcg ggcgggcaat gccgacaaac tcatcggcag cgcgatgcgg

301 cttttgggta ttgcctaccg ctacggcggc acatcggtgt ctaccggttt

351 tgactgcagc ggattcatgc agcacatctt caaacgcgcc atgggcatca

401 acctgccgcg cacgtcggcg gaacaggcgc ggatgggcgc acccgttgcc

451 cgaagcgaat tgcagcccgg ggatatggtg tttttccgca cgctcggcgg

501 cagccgcatt tcccatgtcg gactttatat cggcaacaac cgcttcatcc

551 acgcgccgcg cacggggaaa aatatcgaaa tcaccagcct gagccacaaa

601 tattggagcg gcaaatatgc gttcgcccgc cgggtcaaga aaaacgaccc

651 gtcacgcttt ctgaactga
```

This corresponds to the amino acid sequence <SEQ ID 794; ORF 225.ng>:

```
g225.pep
  1 MDSFFKPAVW AVLWLMFAVR PALADELTNL LSSREQILRQ FAEDEQPVLP

 51 VNRAPARRAG NADELIGGAM GLNEQPVVRV NRAXARRAGN ADKLIGSAMR

101 LLGIAYRYGG TSVSTGFDCS GFMQHIFKRA MGINLPRTSA EQARMGAPVA

151 RSELQPGDMV FFRTLGGSRI SHVGLYIGNN RFIHAPRTGK NIEITSLSHK

201 YWSGKYAFAR RVKKNDPSRF LN*
```

The following partial DNA sequence was identified in *N. meningitidis* <SEQ ID 795>:

```
m225.seq (partial)
  1 ..TTTTCAAACC CGGCAGTTTG GGCGGTTTTG TGGCTGAwGT TTGCCGTCCG

 51   CCCCGCCCTT GCCGACGAGT TGACCAACCT GCTCAGCAGC CGCGAGCAGA

101   TTCTCAGACA GTTTGCCGAA GACGAACAGC CCGTTTTACC CATCAACCGA

151   GCCCCCGCCC GGCGGGCGGG CAATGCCGAC GAACTCATCG GCAGCGCGAT

201   GGGGCTTAAC GAACAGCCCG TTTTACCCGT CAACCGAGTC CCCGCCCGGC

251   GGGCGGGCAA TGCCGACGAA CTCATCGGCA ACGCGATGGG GCTTAACGAA

301   CAGCCCGTTT TACCCGTCAA CCGAGCCCCC GGCGGGCGGG CGGGCAATGC

351   CGACGAACTC ATCGGCAACG CGATGGGACT TTTGGGTATT GCCTACCGCT

401   ACGGCGGCAC ATCGGTTTCT ACCGGTTTTG ACTGCAGCGG CTTCATGCAG
```

-continued

451 CACATCTTCA AACGCGCCAT GGGCATCAAC CTGCCGCGCA CGTCGGCAGA

501 ACAGGCACGG ATGGGTACGC CGGTTGCCCG AAGCGAATTG CAGCCCGGAG

551 ATATGGTGTT TTTCCGCACG CTCGGCGGCA GCCGCATTTC CCATGTCGGA

601 CTTTATATCG GCAACAACCG CTTCATCCAC GCGCCGCGCA CGGGGAAAAA

651 TATCGAAATC ACCAGCCTGA GCCACAAATA TTGGAGCGGC AAATACGCGT

701 TCGCCCGCCG GGTCAAGAAA AACGACCCGT CCCGCTTTCT GAACTGA

This corresponds to the amino acid sequence <SEQ ID 796; ORF 225>:

m225.pep (partial)

1 ..FSNPAVWAVL WLXFAVRPAL ADELTNLLSS REQILRQFAE DEQPVLPINR

51 APARRAGNAD ELIGSAMGLN EQPVLPVNRV PARRAGNADE LIGNAMGLNE

101 QPVLPVNRAP ARRAGNADEL IGNAMGLLGI AYRYGGTSVS TGFDCSGFMQ

151 HIFKRAMGIN LPRTSAEQAR MGTPVARSEL QPGDMVFFRT LGGSRISHVG

201 LYIGNNRFIH APRTGKNIEI TSLSHKYWSG KYAFARRVKK NDPSRFLN*

Computer analysis of this amino acid sequence gave the following results:

Homology with a Predicted ORF from *N. gonorrhoeae*

ORF 225 shows 83.5% identity over a 248 aa overlap with a predicted ORF (ORF 225.ng) from *N. gonorrhoeae*:

```
m225/g225

                     10        20        30        40        50
m225.pep     FSNPAVWAVLWLXFAVRPALADELTNLLSSREQILRQFAEDEQPVLPINRAPARRAG
             | :||||||||| ||||||||||||||||||||||||||||||||||:|||||||||
g225      MDSFFKPAVWAVLWLMFAVRPALADELTNLLSSREQILRQFAEDEQPVLPVNRAPARRAG
                     10        20        30        40        50      60

           60        70        80        90       100       110
m225.pep  NADELIGSAMGLNEQPVLPVNRVPARRAGNADELIGNAMGLNEQPVLPVNRAPARRAGNA
          |||||||                             :|||||||||: |||| |||||||
g225      NADELIG-----------------------------GAMGLNEQPVVRVNRAXARRAGNA
                                               70        80        90

          120       130       140       150       160       170
m225.pep  DELIGNAMGLLGIAYRYGGTSVSTGFDCSGFMQHIFKRAMGINLPRTSAEQARMGTPVAR
          |:|||:|| ||||||||||||||||||||||||||||||||||||||||||||||:||||
g225      DKLIGSAMRLLGIAYRYGGTSVSTGFDCSGFMQHIFKRAMGINLPRTSAEQARMGAPVAR
               100       110       120       130       140       150

          180       190       200       210       210       230
m225.pep  SELQPGDMVFFRTLGGSRISHVGLYIGNNRFIHAPRTGKNIEITSLSHKYWSGKYAFARR
          ||||||||||||||||||||||||||||||||||||||||||||||||||||||||||||
g225      SELQPGDMVFFRTLGGSRISHVGLYIGNNRFIHAPRTGKNIEITSLSHKYWSGKYAFARR
                160       170       180       190       200       210

          240      249
m225.pep  VKKNDPSRFLNX
          |||||||||||
g225      VKKNDPSRFLN
                220
```

The following partial DNA sequence was identified in *N. meningitidis* <SEQ ID 797>:

a225.seq

1 ATGGATTCTT TTTTCAAACC GGCAGTTTGG GCGGTTTTGT GGCTGATGTT

51 TGCCGTCCGC CCCGCCCTTG CCGACGAGTT GACCAACCTG CTCAGCAGCC

101 GCGAGCAGAT TCTCAGACAG TTTGCCGAAG ACGAACAGCC CGTTTTACCC

151 ATCAACCGAN CCCCCGCCCG GCGGGCGGGC AATGCCGACG AACTCATCGG

-continued

```
201 CAGCGCGATG GGGCTTAACG AACAGCCCGT TTTACCCGTC AACCGANTCC

251 CCGCCCGGCG GGCGGGCAAT GCCGACNAAC TCATCGGCAA CGCGATGGGG

301 CTTAACGAAC AGCCCGTTTT ACCCGTCAAC CGAGTCCCCG CCCGGCGGGC

351 GGGCAATGCC GACGAACTCA TCGGCAACGC GATGGGGCTT AACGAACAGC

401 CCGTTTTACC CGTCAACCGA GCCCCCGCCC GGCGGGCGGG CAATGCCGAC

451 GAACTCATCG GCAACGCGAT GGGACTTTTG GGTATTGCCT ACCGCTACGG

501 CGGCACATCG ATTTCTACCG GTTTTGACTG CAGCGGCTTC ATGCAGCACA

551 TCTTCAAACG CGCCATGGGC ATCAACCTGC CGCGCACGTC GGCAGAACAG

601 GCGCGGATGG GTACGCCGGT TGCCCGAAGC GAATTGCAGC CCGGGGATAT

651 GGTGTNTTTC CGCACGCTCG GCGGCAGCCG CATTTCCCAT GTCGGACTTT

701 ATATCGGCAA CAACCGCTTC ATCCACGCGC CGCGCACGGG GAAAAATATC

751 GAAATCACCA GCCTGAGCCA CAAATATTGG AGCGGCAAAT ACGCGTTCGC

801 CCGCCGGGTC AAGAAAAACG ACCCGTCCCG CTTTCTGAAC TGA
```

This corresponds to the amino acid sequence <SEQ ID 798; ORF 225.a>:

```
a225.pep
  1 MDSFFKPAVW AVLWLMFAVR PALADELTNL LSSREQILRQ FAEDEQPVLP

 51 INRXPARRAG NADELIGSAM GLNEQPVLPV NRXPARRAGN ADXLIGNAMG

101 LNEQPVLPVN RVPARRAGNA DELIGNAMGL NEQPVLPVNR APARRAGNAD

151 ELIGNAMGLL GIAYRYGGTS ISTGFDCSGF MQHIFKRAMG INLPRTSAEQ

201 ARMGTPVARS ELQPGDMVXF RTLGGSRISH VGLYIGNNRF IHAPRTGKNI

251 EITSLSHKYW SGKYAFARRV KKNDPSRFLN *
```

m225/a225 87.4% identity in 277 aa overlap

```
                   10        20        30        40        50
m225.pep    FSNPAVWAVLWLXFAVRPALADELTNLLSSREQILRQFAEDEQPVLPINRAPARRAG
            | :||||||||| |||||||||||||||||||||||||||||||||||| || ||||||
a225     MDSFFKPAVWAVLWLMFAVRPALADELTNLLSSREQILRQFAEDEQPVLPVNRXPARRAG
                10        20        30        40        50        60

          60        70       79                            80
m225.pep NADELIGSAMGLNEQPVLPVNR-----------------------------VPARRAGNA
         ||||||||||||||||||||||                             |||||||||
a225     NADELIGSAMGLNEQPVLPVNRXPARRAGNADXLIGNAMGLNEQPVLPVNRVPARRAGNA
                70        80        90       100       110       120

          90       100       110       120       130       140
m225.pep DELIGNAMGLNEQPVLPVNRAPARRAGNADELIGNAMGLLGIAYRYGGTSVSTGFDCSGF
         ||||||||||||||||||||||||||||||||||||||||||||||||||:|||||||||
a225     DELIGNAMGLNEQPVLPVNRAPARRAGNADELIGNAMGLLGIAYRYGGTSISTGFDCSGF
                130       140       150       160       170       180

         150       160       170       180       190       200
m225.pep MQHIFKRAMGINLPRTSAEQARMGTPVARSELQPGDMVFFRTLGGSRISHVGLYIGNNRF
         |||||||||||||||||||||||||||||||||||||| |||||||||||||||||||||
a225     MQHIFKRAMGINLPRTSAEQARMGTPVARSELQPGDMVXFRTLGGSRISHVGLYIGNNRF
                190       200       210       220       230       240

         210       220       230       240      249
m225.pep IHAPRTGKNIEITSLSHKYWSGKYAFARRVKKNDPSRFLNX
         |||||||||||||||||||||||||||||||||||||||||
a225     IHAPRTGKNIEITSLSHKYWSGKYAFARRVKKNDPSRFLNX
                250       260       270       280
```

The following partial DNA sequence was identified in *N. gonorrhoeae* <SEQ ID 799>:

```
g225-1.seq
   1 atggattctt ttttcaaacc ggcagtttgg gcggttttgt ggctgatgtt

  51 tgccgtccgc cccgcccttg ccgacgagtt gaccaacctg ctcagcagcc

 101 gcgagcagat tctcagacag tttgccgaag acgaacagcc cgttttaccc

 151 gtcaaccgag cccccgcccg gcgggcgggc aatgccgacg aactcatcgg

 201 cggcgcgatg gggcttaacg aacagcccgt tgtacgcgtc aaccgagccn

 251 ccgcccggcg ggcgggcaat gccgacaaac tcatcggcag cgcgatgcgg

 301 cttttgggta ttgcctaccg ctacggcggc acatcggtgt ctaccggttt

 351 tgactgcagc ggattcatgc agcacatctt caaacgcgcc atgggcatca

 401 acctgccgcg cacgtcggcg gaacaggcgc ggatgggcgc acccgttgcc

 451 cgaagcgaat tgcagcccgg ggatatggtg tttttccgca cgctcggcgg

 501 cagccgcatt tcccatgtcg gactttatat cggcaacaac cgcttcatcc

 551 acgcgccgcg cacggggaaa aatatcgaaa tcaccagcct gagccacaaa

 601 tattggagcg gcaaatatgc gttcgcccgc cgggtcaaga aaaacgaccc

 651 gtcacgcttt ctgaactga
```

This corresponds to the amino acid sequence <SEQ ID 800; ORF 225-1.ng>:

```
g225-1.pep
   1 MDSFFKPAVW AVLWLMFAVR PALADELTNL LSSREQILRQ FAEDEQPVLP

  51 VNRAPARRAG NADELIGGAM GLNEQPVVRV NRAXARRAGN ADKLIGSAMR

 101 LLGIAYRYGG TSVSTGFDCS GFMQHIFKRA MGINLPRTSA EQARMGAPVA

 151 RSELQPGDMV FFRTLGGSRI SHVGLYIGNN RFIHAPRTGK NIEITSLSHK

 201 YWSGKYAFAR RVKKNDPSRF LN*
```

The following partial DNA sequence was identified in *N. meningitidis* <SEQ ID 801>:

```
m225-1.seq
   1 ATGGATTCTT TTTTCAAACC GGCAGTTTGG GCGGTTTTGT GGCTGATGTT

  51 TGCCGTCCGC CCCGCCCTTG CCGACGAGTT GACCAACyTG CTCAGCAGCC

 101 GCGAGCAGAT TCTCAGACAG TTTGCCGAAG ACGAACAGCC CGTTTTACCC

 151 ATCAACCGAG CCCCCGCCCG GCGGGCGGGC AATGCCGACG AACTCATCGG

 201 CAGCGCGATG GGGCTTAACG AACAGCCCGT TTTACCCGTC AACCGAGTCC

 251 CCGCCCGGCG GGCGGGCAAT GCCGACGAAC TCATCGGCAA CGCGATGGGG

 301 CTTAACGAAC AGCCCGTTTT ACCCGTCAAC CGAGCCCCCG CCCGGCGGGC

 351 GGGCAATGCC GACGAACTCA TCGGCAACGC GATGGGACTT TTGGGTATTG

 401 CCTACCGCTA CGGCGGCACA TCGGTTTCTA CCGGTTTTGA CTGCAGCGGC

 451 TTCATGCAGC ACATCTTCAA ACGCGCCATG GGCATCAACC TGCCGCGCAC

 501 GTCGGCAGAA CAGGCACGGA TGGGTACGCC GGTTGCCCGA AGCGAATTGC

 551 AGCCCGGAGA TATGGTGTTT TTCCGCACGC TCGGCGGCAG CCGCATTTCC

 601 CATGTCGGAC TTTATATCGG CAACAACCGC TTCATCCACG CGCCGCGCAC
```

-continued

```
651 GGGGAAAAAT ATCGAAATCA CCAGCCTGAG CCACAAATAT TGGAGCGGCA

701 AATACGCGTT CGCCCGCCGG GTCAAGAAAA ACGACCCGTC CCGCTTTCTG

751 AACTGA
```

This corresponds to the amino acid sequence <SEQ ID 802; ORF 217>:

```
m225-1.pep

      1 MDSFFKPAVW AVLWLMFAVR PALADELTNL LSSREQILRQ FAEDEQPVLP

     51 INRAPARRAG NADELIGSAM GLNEQPVLPV NRVPARRAGN ADELIGNAMG

    101 LNEQPVLPVN RAPARRAGNA DELIGNAMGL LGIAYRYGGT SVSTGFDCSG

    151 FMQHIFKRAM GINLPRTSAE QARMGTPVAR SELQPGDMVF FRTLGGSRIS

    201 HVGLYIGNNR FIHAPRTGKN IEITSLSHKY WSGKYAFARR VKKNDPSRFL

    251 N*

m225-1/g225-1 84.9% identity in 251 aa overlap

                    10        20        30        40        50        60
m225-1. pep MDSFFKPAVWAVLWLMFAVRPALADELTNLLSSREQILRQFAEDEQPVLPINRAPARRAG
            ||||||||||||||||||||||||||||||||||||||||||||||||||:|||||||||
g225-1      MDSFFKPAVWAVLWLMFAVRPALADELTNLLSSREQILRQFAEDEQPVLPVNRAPARRAG
                    10        20        30        40        50        60

                    70        80        90       100       110       120
m225-1. pep NADELIGSAMGLNEQPVLPVNRVPARRAGNADELIGNAMGLNEQPVLPVNRAPARRAGNA
            ||||                            |||:|||||||||: |||| |||||||
g225-1      NADE----------------------------LIGGAMGLNEQPVVRVNRAXARRAGNA
                                                    70        80        90

                   130       140       150       160       170       180
m225-1. pep DELIGNAMGLLGIAYRYGGTSVSTGFDCSGFMQHIFKRAMGINLPRTSAEQARMGTPVAR
            |:|||:|| ||||||||||||||||||||||||||||||||||||||||||||:||||
g225-1      DKLIGSAMRLLGIAYRYGGTSVSTGFDCSGFMQHIFKRAMGINLPRTSAEQARMGAPVAR
                  100       110       120       130       140       150

                   190       200       210       220       230       240
m225-1. pep SELQPGDMVFFRTLGGSRISHVGLYIGNNRFIHAPRTGKNIEITSLSHKYWSGKYAFARR
            ||||||||||||||||||||||||||||||||||||||||||||||||||||||||||||
g225-1      SELQPGDMVFFRTLGGSRISHVGLYIGNNRFIHAPRTGKNIEITSLSHKYWSGKYAFARR
                  160       170       180       190       200       210

                   250
m225-1. pep VKKNDPSRFLNX
            ||||||||||||
g225-1      VKKNDPSRFLNX
                  220
```

The following partial DNA sequence was identified in *N. meningitidis* <SEQ ID 803>:

```
a225-1.seq
  1 ATGGATTCTT TTTTCAAACC GGCAGTTTGG GCGGTTTTGT GGCTGATGTT

 51 TGCCGTCCGC CCCGCCCTTG CCGACGAGTT GACCAACCTG CTCAGCAGCC

101 GCGAGCAGAT TCTCAGACAG TTTGCCGAAG ACGAACAGCC CGTTTTACCC

151 ATCAACCGAN CCCCCGCCCG GCGGGCGGGC AATGCCGACG AACTCATCGG

201 CAGCGCGATG GGGCTTAACG AACAGCCCGT TTTACCCGTC AACCGANTCC

251 CCGCCCGGCG GGCGGGCAAT GCCGACNAAC TCATCGGCAA CGCGATGGGG

301 CTTAACGAAC AGCCCGTTTT ACCCGTCAAC CGAGTCCCCG CCCGGCGGGC

351 GGGCAATGCC GACGAACTCA TCGGCAACGC GATGGGGCTT AACGAACAGC

401 CCGTTTTACC CGTCAACCGA GCCCCCGCCC GGCGGGCGGG CAATGCCGAC

451 GAACTCATCG GCAACGCGAT GGGACTTTTG GGTATTGCCT ACCGCTACGG
```

-continued

```
501 CGGCACATCG ATTTCTACCG GTTTTGACTG CAGCGGCTTC ATGCAGCACA

551 TCTTCAAACG CGCCATGGGC ATCAACCTGC CGCGCACGTC GGCAGAACAG

601 GCGCGGATGG GTACGCCGGT TGCCCGAAGC GAATTGCAGC CCGGGGATAT

651 GGTGTNTTTC CGCACGCTCG GCGGCAGCCG CATTTCCCAT GTCGGACTTT

701 ATATCGGCAA CAACCGCTTC ATCCACGCGC CGCGCACGGG GAAAAATATC

751 GAAATCACCA GCCTGAGCCA CAAATATTGG AGCGGCAAAT ACGCGTTCGC

801 CCGCCGGGTC AAGAAAAACG ACCCGTCCCG CTTTCTGAAC TGA
```

This corresponds to the amino acid sequence <SEQ ID 804; ORF 225-1.a>:

```
a225-1.pep

  1 MDSFFKPAVW AVLWLMFAVR PALADELTNL LSSREQILRQ FAEDEQPVLP

 51 INRXPARRAG NADELIGSAM GLNEQPVLPV NRXPARRAGN ADXLIGNAMG

101 LNEQPVLPVN RVPARRAGNA DELIGNAMGL NEQPVLPVNR APARRAGNAD

151 ELIGNAMGLL GIAYRYGGTS ISTGFDCSGF MQHIFKRAMG INLPRTSAEQ

201 ARMGTPVARS ELQPGDMVXF RTLGGSRISH VGLYIGNNRF IHAPRTGKNI

251 EITSLSHKYW SGKYAFARRV KKNDPSRFLN *

a225-1/m225-1 88.6% identity in 280 aa overlap

                    10        20        30        40        50        60
a225-1. pep MDSFFKPAVWAVLWLMFAVRPALADELTNLLSSREQILRQFAEDEQPVLPINRXPARRAG
            |||||||||||||||||||||||||||||||||||||||||||||||||||||| ||||||
m225-1      MDSFFKPAVWAVLWLMFAVRPALADELTNLLSSREQILRQFAEDEQPVLPINRAPARRAG
                    10        20        30        40        50        60

                    70        80        90       100       110       120
a225-1. pep NADELIGSAMGLNEQPVLPVNRXPARRAGNADXLIGNAMGLNEQPVLPVNRVPARRAGNA
            ||||||||||||||||                            ||||||||||||||||
m225-1      NADELIGSAMGLNEQP----------------------------VLPVNRVPARRAGNA
                    70                                        80        90

                   130       140       150       160       170       180
a225-1. pep DELIGNAMGLNEQPVLPVNRAPARRAGNADELIGNAMGLLGIAYRYGGTSISTGFDCSGF
            |||||||||||||||||||||||||||||||||||||||||||||||||||:|||||||||
m225-1      DELIGNAMGLNEQPVLPVNRAPARRAGNADELIGNAMGLLGIAYRYGGTSVSTGFDCSGF
                  100       110       120       130       140       150

                   190       200       210       220       230       240
a225-1. pep MQHIFKRAMGINLPRTSAEQARMGTPVARSELQPGDMVXFRTLGGSRISHVGLYIGNNRF
            |||||||||||||||||||||||||||||||||||||| |||||||||||||||||||||
m225-1      MQHIFKRAMGINLPRTSAEQARMGTPVARSELQPGDMVFFRTLGGSRISHVGLYIGNNRF
                  160       170       180       190       200       210

                   250       260       270       280
a225-1. pep IHAPRTGKNIEITSLSHKYWSGKYAFARRVKKNDPSRFLNX
            |||||||||||||||||||||||||||||||||||||||||
m225-1      IHAPRTGKNIEITSLSHKYWSGKYAFARRVKKNDPSRFLNX
                  220       230       240       250
```

The following partial DNA sequence was identified in *N. gonorrhoeae* <SEQ ID 805>:

```
g226.seq
  1 ATGAGCGAAA TCCTCAGGCA GCCCAGCGTT CTGCTTTTCC TCACGCTTGC

 51 CGTGTACGCG CTTGCGATTA TCGTGCGCAC GCGCACGGGC AATATCTTCT

101 GCAACCCCGT ACTCGTCAGC ACTATCGTGC TGATTGCCTA CCTGAAAATC

151 CTCGGTATCG ATTATGCGGT GTACCACAAC GCCGCGCAAT TCATTGATTT

201 TCGGCTGAAA cccGccgtCG TCGTGCTTGC CGTGCCGCTC TACCAAAACC
```

-continued

```
251 GCCGTAAAAT CTTCAACCAG TGGCTGCCCG TCATCGTTTC GCAGCTTGCG

301 GGCAGCGTTA cggGCATTGT tacggggATG TATTTTgccg cttggctcgg

351 gccggatacc caattctcct tcccgcctcg tcttcaatat ctgttattta

401 caccctctgg aatcccaatt cacaccctgt atgcgcgggt tctcccgcca

451 tttctgttgc ctccgcctct cctgccgcgc ctcggcccgc atacattgcg

501 ccggttcaca atacttccaa aaaaactacg gccgtttaag cccctcctcc

551 cagttgtggt cctttctcct Ccgggcctcg cccctcccct cttataa
```

This corresponds to the amino acid sequence <SEQ ID 806; ORF 226.ng>:

```
g226.pep
  1 MSEILRQPSV LLFLTLAVYA LAIIVRTRTG NIFCNPVLVS TIVLIAYLKI

 51 LGIDYAVYHN AAQFIDFRLK PAVVVLAVPL YQNRRKIFNQ WLPVIVSQLA

101 GSVTGIVTGM YFAAWLGPDT QFSFPPRLQY LLFTPSGIPI HTLYARVLPP

151 FLLPPPLLPR LGPHTLRRFT ILPKKLRPFK PLLPVVVLSP PGLAPPLL*
```

The following partial DNA sequence was identified in *N. meningitidis* <SEQ ID 807>:

```
m226.seq
  1 ATGAACGAAA TCCTCAGGCA GCCCAGCGTT CTGCTTTTCC TCACGCTTGC

 51 CGTGTACGCG CTTGCGATTA TCGtGCGCAC GCGCACGGGC AATATCTTCT

101 GCAACCCCGT ACTCGTCAGC ACTATCGTGC TGATTGCCTA CCTGAAAATC

151 CTCGGTATCG ATTATGCGGT GTACCACAAC GCCGCGCAAT TCATTGATTT

201 TTGGCTGAAA CCCGCCGTCG TCGTGCTTGC CGTGCCGCTC TACCAAAACC

251 GCCGTAAAAT CTTCAACCAG TGGCTGCCCG TCATCGTTTC ACAGCTTGCG

301 GGCAGCGTTA CGGGCATTGT TACAGGGATG TATTTTGCCA AATGGCTGGG

351 CGCGGAACGC GAAGTCGTCC TCTCGCTCGC GTCCAAATCT GTTACCAACC

401 CCATCGCTAT TGAAATCACC CGCTCCATCG GCGGCATTCC CGCCATTACC

451 GCCGCCACCG TCATCATTGC CGGTCTGGTC GGACAGATTG CCGGTTACAA

501 AATGCTGAAG AACACGGTCG TCATGCCCTC GTCCGTGGGT ATGTCGCTCG

551 GCACGGCTTC GCACGCGATG GGGATTGCCG CCTCGCTCGA ACGCAGCCGC

601 CGTATGGCGG CATACGCGGG GCTGGGGCTG ACGTTCAACG GCGTACTGAC

651 CGCGCTGATT GCGCCGCTGC TCATCCCCGT TTTGGGATTT TGA
```

This corresponds to the amino acid sequence <SEQ ID 808; ORF 226>:

```
m226.pep
  1 MNEILRQPSV LLFLTLAVYA LAIIVRTRTG NIFCNPVLVS TIVLIAYLKI

 51 LGIDYAVYHN AAQFIDFWLK PAVVVLAVPL YQNRRKIFNQ WLPVIVSQLA

101 GSVTGIVTGM YFAKWLGAER EVVLSLASKS VTNPIAIEIT RSIGGIPAIT

151 AATVIIAGLV GQIAGYKMLK NTVVMPSSVG MSLGTASHAM GIAASLERSR

201 RMAAYAGLGL TFNGVLTALI APLLIPVLGF *
```

Computer analysis of this amino acid sequence gave the following results:

Homology with a Predicted ORF from *N. gonorrhoeae*

ORF 226 shows 94.2% identity over a 121 aa overlap with a predicted ORF (ORF 226.ng) from *N. gonorrhoeae*:

```
m226/g226

                 10        20        30        40        50        60
m226 pep MNEILRQPSVLLFLTLAVYALAIIVRTRTGNIFCNPVLVSTIVLIAYLKILGIDYAVYHN
         |:||||||||||||||||||||||||||||||||||||||||||||||||||||||||||
g226     MSEILRQPSVLLFLTLAVYALAIIVRTRTGNIFCNPVLVSTIVLIAYLKILGIDYAVYHN
                 10        20        30        40        50        60

                 70        80        90       100       110       120
m226 pep AAQFIDFWLKPAVVVLAVPLYQNRRKIFNQWLPVIVSQLAGSVTGIVTGMYFAKWLGAER
         ||||||| ||||||||||||||||||||||||||||||||||||||||||||| ||| : 
g226     AAQFIDFRLKPAVVVLAVPLYQNRRKIFNQWLPVIVSQLAGSVTGIVTGMYFAAWLGPDT
                 70        80        90       100       110       120

                130       140       150       160       170       180
m226 pep EVVLSLASKSVTNPIAIEITRSIGGIPAITAATVIIAGLVGQIAGYKMLKNTVVMPSSVG
         :
g226     QFSFPPRLQYLLFTPSGIPIHTLYARVLPPFLLPPPLLPRLGPHTLRRFTILPKKLRPFK
                130       140       150       160       170       180
```

The following partial DNA sequence was identified in *N. meningitidis* <SEQ ID 809>:

```
a226.seq
  1 ATGAACGAAA TCCTCAGGCA GCCGAGCATC CTGCTTTTCC TCACGCTTGC

 51 CGTGTACGCG CTTGCGATTA TCGTGCGCAC GCGCACGGGT AATATCTTCT

101 GCAACCCCGT ACTCGTCAGC ACTATCGTGC TGATTGCCTA CCTGAAAATC

151 CTCGGTATCG ATTATGCGGT GTACCACAAC GCCGCGCAGT TTATCGATTT

201 CTGGCTCAAG CCCGCCGTCG TCGTGCTTGC CGTGCCGCTC TACCAAAACC

251 GCCGTAAAAT CTTCAACCAA TGGCTGCCCG TCATCGTTTC GCAGCTTGCG

301 GGCAGCGTTA CGGGCATTGT TACGGGGATG TATTTTGCCA AATGGCTGGG

351 CGCGGAACGC GAAGTCGTCC TCTCGCTCGC GTCCAAATCT GTTACCAATC

401 CTATCGCCAT CGAAATCACC CGCTCCATCG GCGGCATTCC CGCCATTACC

451 GCCGCCACCG TCATCATTGC CGGCCTGGTC GGACAGATTG CCGGTTACAA

501 AATGTTGAAA AACACGGTCG TTATGCCCTC ATCTGTCGGA ATGTCGCTCG

551 GCACGGCTTC GCACGCGATG GGCATTGCCG CCTCGCTCGA ACGCAGCCGC

601 CGCATGGCGG CATACGCGGG GCTGGGGCTG ACGTTCAACG GCGTACTGAC

651 CGCGCTGATT GCGCCGCTGC TTATCCCCGT TTTGGGATTT TGA
```

This corresponds to the amino acid sequence <SEQ ID 810; ORF 226.a>:

```
a226.pep
  1 MNEILRQPSI LLFLTLAVYA LAIIVRTRTG NIFCNPVLVS TIVLIAYLKI

 51 LGIDYAVYHN AAQFIDFWLK PAVVVLAVPL YQNRRKIFNQ WLPVIVSQLA

101 GSVTGIVTGM YFAKWLGAER EVVLSLASKS VTNPIAIEIT RSIGGIPAIT

151 AATVIIAGLV GQIAGYKMLK NTVVMPSSVG MSLGTASHAM GIAASLERSR

201 RMAAYAGLGL TFNGVLTALI APLLIPVLGF *
```

m226/a226 99.6% identity in 230 aa overlap

```
                10        20        30        40        50        60
m226.pep MNEILRQPSVLLFLTLAVYALAIIVRTRTGNIFCNPVLVSTIVLIAYLKILGIDYAVYHN
         |||||||||:||||||||||||||||||||||||||||||||||||||||||||||||||
a226     MNEILRQPSILLFLTLAVYALAIIVRTRTGNIFCNPVLVSTIVLIAYLKILGIDYAVYHN
                10        20        30        40        50        60

                70        80        90       100       110       120
m226.pep AAQFIDFWLKPAVVVLAVPLYQNRRKIFNQWLPVIVSQLAGSVTGIVTGMYFAKWLGAER
         ||||||||||||||||||||||||||||||||||||||||||||||||||||||||||||
a226     AAQFIDFWLKPAVVVLAVPLYQNRRKIFNQWLPVIVSQLAGSVTGIVTGMYFAKWLGAER
                70        80        90       100       110       120

               130       140       150       160       170       180
m226.pep EVVLSLASKSVTNPIAIEITRSIGGIPAITAATVIIAGLVGQIAGYKMLKNTVVMPSSVG
         ||||||||||||||||||||||||||||||||||||||||||||||||||||||||||||
a226     EVVLSLASKSVTNPIAIEITRSIGGIPAITAATVIIAGLVGQIAGYKMLKNTVVMPSSVG
               130       140       150       160       170       180

               190       200       210       220       230
m226.pep MSLGTASHAMGIAASLERSRRMAAYAGLGTFNGVLTALIAPLLIPVLGFX
         |||||||||||||||||||||||||||||||||||||||||||||||||
a226     MSLGTASHAMGIAASLERSRRMAAYAGLGTFNGVLTALIAPLLIPVLGFX
               190       200       210       220       230
```

The following partial DNA sequence was identified in *N. gonorrhoeae* <SEQ ID 811>:

```
g227.seq
  1 atgaacatca tccgcgcgct cctcatcatc ctcggctgcc tcgccgccgg

 51 cgaaaccgcc gttttcctag caggcatcaa actgcccggc agcatcgtcg

101 gcatgggcgt gctgtttgcg cttttgcagg cgggttggct caaaacgtct

151 tggctgcaac agcttaccga cgcgctgatg gcaaacctga cgctgttcct

201 cgtgccgccc tgcgtggcgg tcatcagcta tttggatttg attgccgacg

251 attggttttc gatactggtt tccgcctccg ccagcacttt gtgcgtactg

301 ctggttacgg gcaaggttca ccgctggata cggagcatta tctga
```

This corresponds to the amino acid sequence <SEQ ID 812; ORF 227.ng>:

```
g227.pep
  1 MNIIRALLII LGCLAAGETA VFLAGIKLPG SIVGMGVLFA LLQAGWLKTS

 51 WLQQLTDALM ANLTLFLVPP CVAVISYLDL IADDWFSILV SASASTLCVL

101 LVTGKVHRWI RSII*
```

The following partial DNA sequence was identified in *N. meningitidis* <SEQ ID 813>:

```
m227.seq (partial)
  1 ..ACGTCTTkGC TGCAACAGCT TACCGACGCG CTGATGTCGA ACCTGACGCT

 51   GTtCCTCGTG CCgCC.TGCG TGGCGGTCAT CAGCTATTTG GATTTGATTG

101   CCGACGATTG GTTTTCGATA CTGGTTTCCG CCTCCGCCAG cACTTTGTGC

151   GTACTGCTGG TTACGGGCAA AGTCCACCGG TGGATACGGG GTATTATCCG

201   ATGA
```

This corresponds to the amino acid sequence <SEQ ID 814; ORF 227>:

```
m227.pep (partial)
   1  ..TSXLQQLTDA LMSNLTLFLV PPCVAVISYL DLIADDWFSI LVSASASTLC

  51    VLLVTGKVHR WIRGIIR*
```

Computer analysis of this amino acid sequence gave the following results:

Homology with a Predicted ORF from *N. gonorrhoeae*

ORF 227 shows 95.5% identity over a 66 aa overlap with a predicted ORF (ORF 227.ng) from *N. gonorrhoeae*:

```
m227/g227

                                                 10        20        30
m227.pep                                 TSXLQQLTDALMSNLTLFLVPPCVAVISYL
                                         || ||||||||:||||||||||||||||||
g227     TAVFLAGIKLPGSIVGMGVLFALLQAGWLKTSWLQQLTDALMANLTLFLVPPCVAVISYL
         20        30        40        50        60        70       60

                 40        50        60
m227.pep DLIADDWFSILVSASASTLCVLLVTGKVHRWIRGIIRX
         |||||||||||||||||||||||||||||||||:|||
g227     DLIADDWFSILVSASASTLCVLLVTGKVHRWIRSIIX
         80        90       100       110
```

The following partial DNA sequence was identified in *N. meningitidis* <SEQ ID 815>:

```
a227.seq
   1 ATGAACATCA TCCGCGCGCT CCTCATCATC CTCGGCTGCC TCGCCACCGG

  51 CGAAACCGCC GTTTTCCTAG CAGGCATCAA ACTGCCCGGC AGCATCGTCG

 101 GCATGGGCGT ACTGTTTGCG CTTTTGCAGG CGGGTTGGGT CAAAACGTCT

 151 TGGCTGCAAC AGCTTACCGA CGCGCTGATG GCGAATCTGA CGTTGTTTCT

 201 CGTGCCGCCC TGCGTGGCGG TCATCAGCTA TTTGGATTTG ATTGCCGACG

 251 ATTGGTTTTC GATACTGGTT TCCGCCTCCG CCAGCACTTT GTGCGTACTG

 301 CTGGTTACAG GCAAGGTTCA CCGCTGGATA CGGAGCATTA TCTGA
```

This corresponds to the amino acid sequence <SEQ ID 816; ORF 227.a>:

```
a227.pep
   1 MNIIRALLII LGCLATGETA VFLAGIKLPG SIVGMGVLFA LLQAGWVKTS

  51 WLQQLTDALM ANLTLFLVPP CVAVISYLDL IADDWFSILV SASASTLCVL

 101 LVTGKVHRWI RSII*
```

m227/a227 95.5% identity in 66 aa overlap

```
                                                 10        20        30
m227.pep                                 TSXLQQLTDALMSNLTLFLVPPCVAVISYL
                                         || ||||||||:||||||||||||||||||
a227     TAVFLAGIKLPGSIVGMGVLFALLQAGWVKTSWLQQLTDALMANLTLFLVPPCVAVISYL
         20        30        40        50        60        70       60

                 40        50        60
m227.pep DLIADDWFSILVSASASTLCVLLVTGKVHRWIRGIIRX
         |||||||||||||||||||||||||||||||||:|||
a227     DLIADDWFSILVSASASTLCVLLVTGKVHRWIRSIIX
         80        90       100       110
```

The following partial DNA sequence was identified in *N. meningitidis* <SEQ ID 817>:

```
m228.seq
   1 ATGAAAAAAT TATTGATTGC CGCAATGATG GCGGCTGCCT TGGCAGCTTG

  51 TTCGCAAGAA GCCAAACAGG AGGTTAAGGA AGCGGTTCAA GCCGTTGAGT

 101 CCGATGTTAA AGACACTGCG GCTTCTGCCG CCGAGTCTGC CGCTTCTGCC

 151 GTCGAAGAAG CGAAAGACCA AGTCAAAGAT GCTGCGGCTG ATGCAAAGGC

 201 AAGTGCCGAG GAAGCTGTAA CTGAAGCCAA AGAAGCTGTA ACTGAAGCAG

 251 CTAAAGATAC TTTGAACAAA GCTGCCGACG CGACTCAGGA AGCGGCAGAC

 301 AAAATGAAAG ATGCCGCCAA ATAA
```

This corresponds to the amino acid sequence <SEQ ID 818; ORF 228>:

```
m228.pep
   1 MKKLLIAAMM AAALAACSQE AKQEVKEAVQ AVESDVKDTA ASAAESAASA

  51 VEEAKDQVKD AAADAKASAE EAVTEAKEAV TEAAKDTLNK AADATQEAAD

 101 KMKDAAK*
```

Computer analysis of this amino acid sequence gave the following results:

The following partial DNA sequence was identified in *N. meningitidis* <SEQ ID 819>:

```
a228.seq
   1 ATGAAAAAAT TATTGATTGC CGCAATGATG GCGGCTGCCT TGGCAGCTTG

  51 TTCGCAAGAA GCCAAACAGG AGGTTAAGGA AGCGGTTCAA GCCGTTGAGT

 101 CCGATGTTAA AGACACTGCG GCTTCTGCCG CCGAGTCTGC CGCTTCTGCC

 151 GTCGAAGAAG CGAAAGACCA AGTCAAAGAT GCTGCGGCTG ATGCAAAGGC

 201 AAGTGCCGAG GAAGCTGTAA CTGAAGCCAA AGAAGCTGTA ACTGAAGCAG

 251 CTAAAGATAC TTTGAACAAA GCTGCCGACG CGACTCAGGA AGCGGCAGAC

 301 AAAATGAAAG ATGCCGCCAA ATAA
```

This corresponds to the amino acid sequence <SEQ ID 820; ORF 228.a>:

```
a228.pep
   1 MKKLLIAAMM AAALAACSQE AKQEVKEAVQ AVESDVKDTA ASAAESAASA

  51 VEEAKDQVKD AAADAKASAE EAVTEAKEAV TEAAKDTLNK AADATQEAAD

 101 KMKDAAK*
```

m228/a228 100.0% identity in 107 aa overlap

```
                    10        20        30        40        50        60
m228.pep    MKKLLIAAMMAAALAACSQEAKQEVKEAVQAVESDVKDTAASAAESAASAVEEAKDQVKD
            ||||||||||||||||||||||||||||||||||||||||||||||||||||||||||||
a228        MKKLLIAAMMAAALAACSQEAKQEVKEAVQAVESDVKDTAASAAESAASAVEEAKDQVKD
                    10        20        30        40        50        60

                    70        80        90       100
m228.pep    AAADAKASAEEAVTEAKEAVTEAAKDTLNKAADATQEAADKMKDAAKX
            ||||||||||||||||||||||||||||||||||||||||||||||||
a228        AAADAKASAEEAVTEAKEAVTEAAKDTLNKAADATQEAADKMKDAAKX
                    70        80        90       100
```

The following partial DNA sequence was identified in *N. gonorrhoeae* <SEQ ID 821>:

```
g229.seq
   1 atggctgccg tatcgggcgg cggtgcggtc ttcctgataa tgcttccaca

  51 tattgcccgc gttcagcgtc agccgccagc gttcgcccaa gcgtcgggag

 101 aaatcggcat tgaagccgcc ggcgaaattg tatcggctgc cgcccaagag

 151 gttttgcccg acaaacggca cggtgccgaa cgagcgcgtt accgaacggt

 201 tttgatggcc gaacgacagg cgcaggttct gttcgctgaa atctttgtta

 251 tcccaataat gcacgccgcg gctgatgccg ccgtagagga aatgatgccc

 301 gcccgcattg atttcgcgcg acacgcccaa gccgtagcgc aaaccgtgtg

 351 ccttttgcgg caggctgtcg gcggttttcg tccagcttct gcccgcaaat

 401 tcaatcgttt tttcggacga agcgttgttt atagcggatt aacaaaaatc

 451 aggacaaggc ggcgggccgc aggcagtacg gatggtacgg aaccggttcg

 501 cccggtgctt ggacgcctta gggaaccgtt ccctttgagc cggggcgggg

 551 caacccgtac cggtttttgt tcatccgcca tattgtgttg a
```

This corresponds to the amino acid sequence <SEQ ID 822; ORF 229.ng>:

```
g229.pep
   1 MAAVSGGGAV FLIMLPHIAR VQRQPPAFAQ ASGEIGIEAA GEIVSAAAQE

  51 VLPDKRHGAE RARYRTVLMA ERQAQVLFAE IFVIPIMHAA ADAAVEEMMP

 101 ARIDFARHAQ AVAQTVCLLR QAVGGFRPAS ARKFNRFFGR SVVYSGLTKI

 151 RTRRRAAGST DGTEPVRPVL GRLREPFPLS RGGATRTGFC SSAILC*
```

The following partial DNA sequence was identified in *N. meningitidis* <SEQ ID 823>:

```
m229.seq (partial)
   1 ..GCTCAAGCGT TGGGAGAAAT CGGCATTGAA GCCGCCGACG AAATTGTATC

  51   GGCTGCCGCC TAAGAGGTTT TGCTCGACAA ACGGCACGAT GCCGAACGAG

 101   CGCGTTACCG AACGGTTTTT ATAGCCGAAC GACAGGCGCA GGCTCTGTTC

 151   GCTGAAATCT TTGTTATCCC AATAATGCAC GCCGCCGCCG CTGATGCCGC

 201   CGTAGAGGAA ATGATGCCTG CCCGCATTGA TTTCGCGCGA CACGCCTAAG

 251   CCCTAGCGCA AACCGTGTGC CTTTTGCGGC AGGCTGTCGG CGGTTTTCGT

 301   CCAGCTTCTG CCCGCAAATT CAATCGTTTT TTCGGACGAA GCGTTGTTTA

 351   TAGCGGATTA ACAAAAATCA GGACAAGGCA ACGAAGCCGC AGACAGTACA

 401   AATAGTACGG AACCGATTCA CTTGGTGCTT CAGCACcTTA GAGAATCGTT

 451   CTCTTTTTTG TTCATCCGCT ATATTGTGTT GA
```

This corresponds to the amino acid sequence <SEQ ID 824; ORF 229>:

```
m229.pep (partial)
   1 ..AQALGEIGIE AADEIVSAAA XEVLLDKRHD AERARYRTVF IAERQAQALF

  51   AEIFVIPIMH AAAADAAVEE MMPARIDFAR HAXALAQTVC LLRQAVGGFR
```

-continued

```
101   PASARKFNRF FGRSVVYSGL TKIRTRQRSA DSTNSTEPIH LVLQHLRESR

151   SLFCSSAILC *
```

Computer analysis of this amino acid sequence gave the following results:

Homology with a Predicted ORF from *N. gonorrhoeae*

ORF 229 shows 80.5% identity over a 169 aa overlap with a predicted ORF (ORF 229.ng) from *N. gonorrhoeae*:

```
m229/g209

                                                   10        20        30
m229.pep                                    AQALGEIGIEAADEIVSAAAXEVLLDKRHDAE
                                            ||| |||||||| ||||||| ||| |||| ||
g229           MAAVSGGGAVFLIMLPHIARVQRQPPAFAQASGEIGIEAAGEIVSAAAQEVLPDKRHGAE
                       10        20        30        40        50        60

                     40        50        60        70        80        90
m229.pep       RARYRTVFIAERQAQALFAEIFVIPIMHAAAADAAVEEMMPARIDFARHAXALAQTVCLL
               |||||||::||||||:||||||||||||||| |||||||||||||||||| |:|||||||
g229           RARYRTVLMAERQAQVLFAEIFVIPIMHAAA-DAAVEEMMPARIDFARHAQAVAQTVCLL
                       70        80        90       100       110

                    100       110       120       130       140
m229.pep       RQAVGGFRPASARKFNRFFGRSVVYSGLTKIRTRQRSADSTNSTEPIHLVLQHLRE----
               ||||||||||||||||||||||||||||||||||:|:| ||::|||:: || :|||
g229           RQAVGGFRPASARKFNRFFGRSVVYSGLTKIRTRRRAAGSTDGTEPVRPVLGRLREPFPL
             120       130       140       150       160       170

                   150       160
m229.pep       -----SRSLFCSSAILCX
                    :|: ||||||||
g229           SRGGATRTGFCSSAILC
             180       190
```

The following partial DNA sequence was identified in *N. meningitidis* <SEQ ID 825>:

```
a229.seq (partial)
  1 ATGGCTGTCG TATCGGGCGG CGGTGCGGTC TTCCTGATAA CGCTTCCACA

 51 TATTGCCCAC GTTCAGCGTC AGCCGCCA.. GTTCGCTCAA GCGTCGGGAG

101 AAATCGGCAT TGAAGCCGCC GACGAAATTG TATCGGCTGC CGCCTAAGAG

151 GTTTTGCTCG ATAAACGGCA CGATGCCGAA TGAGCGCGTT ACTGAACGGT

201 TTTTATAGCC GAGCGACAGG CGCAGGCTCT GTTCGCTGAA ATCTTTGTTA

251 TCCTAATAGT GCACGCCGCC GCCGCTGATG TCTCCGTAGA GGAAATGATG

301 CCCGCCCGCA TTGATTTCGC GCGACACGCC CAAGCCGTAG CGCAAACCGT

351 GTGCCTTTTG CGGCAGGCTG TCGGCGGTTT TCGTCCAGCT TCTGCCTGCA

401 AATTCAATCG TTTTTTCGGA CGAAGCGTTG TTTATAGCGG ATTAACAAAA

451 ATCAGGACAA GGCGACGAAG CGCAGACAGT ACAGATAGTA CGGAACCGAT

501 TCACTTGGTG CTTCAGCACC TTAGAGAATC GTCTCTTTGA GCTAAGGCGA

551 GGCAACGCCG TACTGGTTTT TGTTCATCCA CTATA
```

This corresponds to the amino acid sequence <SEQ ID 826; ORF 229.a>:

```
a229.pep (partial)
  1 MAVVSGGGAV FLITLPHIAH VQRQPPXFAQ ASGEIGIEAA DEIVSAAA*E

 51 VLLDKRHDAE *ARY*TVFIA ERQAQALFAE IFVILIVHAA AADVSVEEMM

101 PARIDFARHA QAVAQTVCLL RQAVGGFRPA SACKFNRFFG RSVVYSGLTK

151 IRTRRRSADS TDSTEPIHLV LQHLRESSL* AKARQRRTGF CSSTI
```

m229/a229 85.6% identity in 167 aa overlap

```
                                             10        20        30
m229.pep                             AQALCEICIEAADEIVSAAAXEVLLDKRHDAE
                                     ||| ||||||||||||||||||||||||||||
a229        MAVVSGGGAVFLITLPHIAHVQRQPPXFAQASGEIGIEAADEIVSAAAXEVLLDKRHDAE
                   10        20        30        40        50        60

                40        50        60        70        80
m229.pep    RARYRTVFIAERQAQALFAEIFVIPIMHAAAADAAVEEMMPARIDFARHAXALAQTVCLL
             ||| |||||||||||||||||| |:|||||::|||||||||||||| |:|||||||
a229        XARYXTVFIAERQAQALFAEIFVILIVHAAAADVSVEEMMPARIDFARHAQAVAQTVCLL
                   70        80        90       100       110       120

               100       110       120       130       140     149
m229.pep    RQAVGGFRPASARKFNRFFGRSVVYSGLTKIRTRQRSADSTNSTEPIHLVLQHLRES---
            |||||||||||| ||||||||||||||||||||||:||||||:|||||||||||||||
a229        RQAVGGFRPASACKFNRFFGRSVVYSGLTKIRTRRRSADSTDSTEPIHLVLQHLRESSLX
                  130       140       150       160       170       180

              150       160
m229.pep    ------RSLFCSSAILCX
                  |: ||||:|
a229        AKARQRRTGFCSSTI
                  190
```

The following partial DNA sequence was identified in *N. gonorrhoeae* <SEQ ID 827>:

```
g230.seq
   1 atgttccatt ccatcgaaaa atacagaaca cccgcccaag tcttattagg

  51 cctgattgca ttaacttttg tcggcttcgg cgtcagcacg gtttcccatc

 101 cgggcgccga ctacatcgtc caagtgggcg acgaaaaaat cagcgagcac

 151 tcaatcaaca acgccatgca gaacgagcag gcggacggcg gcagcccttg

 201 gcgcgacgcg gtgttccaat ccctgctgca acgcgcctac ctgaaacagg

 251 gcgcgaagct gatgggcatt tcggtttctt ccgaacaaat caagcagatg

 301 attgtggacg atcccaattt ccacgacgca aacggcaaat tcagtcacgc

 351 gcttttgagt caatacctgt cgcaacgcca tatgtctgaa gaccagtttg

 401 tcgaagaaat ccgcgatcag tttgccttgc agaatttggt aagcctcgtc

 451 caaaacggcg tattggtcgg cgacgcgcag gcggaacagc tgatcaggct

 501 gacgcaggtc aaccgcacca tccgttcgca cactttcaac cccgacgagt

 551 tcatcgccca agtcaaagcg tctgaagccg atttgcagaa attttataat

 601 gcgaacaaaa aagactatct gctgccgcag gcggtcaaat tggaatatgt

 651 cgccttgaat ctgaaggatt ttgcagacaa gcagaccgtc agtgaaacgg

 701 aagtgaaaaa tgcgtttgaa gagcgcgtgg cgcgtttgcc ggcacatgaa

 751 gccaaacctt ctttcgagca ggaaaaagcc gccgtcgaaa acgaattgaa

 801 aatgaaaaag gcggttgccg acttcaacaa ggcaaaagaa aagctgggcg

 851 acgatgcgtt caatcatccc tcctcgcttg ccgaagccgc caaaaacagc

 901 ggtttgaaag tggaaaccca agaaacttgg ctgagcaggc aggacgcaca

 951 aatgtccggc atgcccgaaa acctaatcaa tgccgtattc agcgacgacg

1001 tattgaagaa aaaacacaat tccgaagtgc tgaccatcaa cagcgaaacc

1051 gcgtgggtcg tccgcgccaa agaagtccgc gaagaaaaaa acctactgtt

1101 tgaagaagcc aaagatgcgg tgcgtcaggc ctatatccgt accgaagccg

1151 ccaaactttt gaaaacaatg taa
```

This corresponds to the amino acid sequence <SEQ ID 828; ORF 230.ng>:

```
g230.pep
   1 MFHSIEKYRT PAQVLLGLIA LTFVGFGVST VSHPGADYIV QVGDEKISEH

  51 SINNAMQNEQ ADGGSPWRDA VFQSLLQRAY LKQGAKLMGI SVSSEQIKQM

 101 IVDDPNFHDA NGKFSHALLS QYLSQRHMSE DQFVEEIRDQ FALQNLVSLV

 151 QNGVLVGDAQ AEQLIRLTQV NRTIRSHTFN PDEFIAQVKA SEADLQKFYN

 201 ANKKDYLLPQ AVKLEYVALN LKDFADKQTV SETEVKNAFE ERVARLPAHE

 251 AKPSFEQEKA AVENELKMKK AVADFNKAKE KLGDDAFNHP SSLAEAAKNS

 301 GLKVETQETW LSRQDAQMSG MPENLINAVF SDDVLKKKHN SEVLTINSET

 351 AWVVRAKEVR EEKNLLFEEA KDAVRQAYIR TEAAKLLKTM *
```

The following partial DNA sequence was identified in *N. meningitidis* <SEQ ID 829>:

```
m230.seq (partial)
    1 ATGTTCCATT CCATCGAAAA ATACAGAACG CCCGCCCAAG TCCTTTTGGG

   51 CCTGATTGCA TTAACCTTCG TCGGCTTCGG GGTCAGCACG GTATCCCATC

  101 CGGGTGCCGA CTACATCGTC CAAGTGGGCG ACGAAAAAaT CAGCGACCAC

  151 TCCATCAACA ACGCCATACA GAACGAACAG GCGGACGGCG GCGGCCCTTC

  201 GCc.GACGCG GTGTTCCAAT CCCTGCTGCA ACGCGCCTAC CTGAAACAGG

  251 GCGCGAAGCT GATGGGCATT TCGGTTTCTT CCGAACAAAT CAAGCAAATT

  301 ATCGTGGACG ATCCCAATTT CCACGACGCA AACGGCAAAT TCGACCACGC

  351 GCTTTTAAAC CGCTACCTTT CCCAACGCCA TATGTCTGAA GACCAGTTTG

  401 TCGAAGAAAT CCGCGATCAG TTTGCCTTGC AGAATTTGGT AAACCTCGTC

  451 CAAAACGGCG TATTGGTCGG CGACGCGCAG GCGGAACAGC TGATCAGGCT

  501 GACACAGGTC AACCGCACCA TCCGTTCGCA CACTTTCAAC CCCGACGAGT

  551 TCATCGCCCA AGTCAAAGTG TCTGAAGCCG ATTTGCAGAA ATTTTATAAT

  601 GCGAACAAAA AAGACTATCT GCTGCCGCAG gCGGTCAAAT TGGAATATGT

  651 CGCCTTGAAT CTGAAGGATT TTGCAGACAA GCAGACCGTC AGTGAAACGg

  701 AAGTGAAAAA TGCATTTGAA GAGCGCGTGG CGCGTTTGCC GGCAAATGAA

  751 GCCAAACCTT CTTTCGAGCA GGAAAAAGCC GCCGTCGAAA ACGAATTGAA

  801 AATGAAAAAG GCGGTTGCCG ACTTCAACAA GGCAAAAGAA AAATTGGGCG

  851 ACGATGC.GT cAACCATCCT TCyTCGCTTG CCGAAGCCGC CAAAAACAGC

  901 GGTTTGAAAG TCGAAACCCA AGAAACTTGG CTGAGTAGGC AGGACGCGCA

  951 AATGTCCGGT ATGCCCGAAA ACCTGATCAA TGCCGTATTC AGCGACGACG

 1001 TATTGAAGAA AAAACACAAT TCCGAAGTGC TGACCATCAA CAGCGAAACC

 1051 GCGTGGGTCG TCCGCGCCAA AGAAGTCCGC GAAGAGAAAA CCCTGCCGTT

 1101 TGCCGAAGCC AAAGACGCGG TACGTCAGGC TTATATCCGT ACCGAAGCCG

 1151 CCAAACTT.. ...
```

This corresponds to the amino acid sequence <SEQ ID 830; ORF 230>:

```
m230.pep (partial)
    1  MFHSIEKYRT PAQVLLGLIA LTFVGFGVST VSHPGADYIV QVGDEKISDH

   51  SINNAIQNEQ ADGGGPSPDA VFQSLLQRAY LKQGAKLMGI SVSSEQIKQI

  101  IVDDPNFHDA NGKFDHALLN RYLSQRHMSE DQFVEEIRDQ FALQNLVNLV

  151  QNGVLVGDAQ AEQLIRLTQV NRTIRSHTFN PDEFIAQVKV SEADLQKFYN

  201  ANKKDYLLPQ AVKLEYVALN LKDFADKQTV SETEVKNAFE ERVARLPANE

  251  AKPSFEQEKA AVENELKMKK AVADFNKAKE KLGDDAVNHP SSLAEAAKNS

  301  GLKVETQETW LSRQDAQMSG MPENLINAVF SDDVLKKKHN SEVLTINSET

  351  AWVVRAKEVR EEKTLPFAEA KDAVRQAYIR TEAAKL....
```

Computer analysis of this amino acid sequence gave the following results:

Homology with a Predicted ORF from *N. gonorrhoeae*

ORF 230 shows 95.9% identity over a 386 aa overlap with a predicted ORF (ORF 230.ng) from *N. gonorrhoeae*:

```
m230/g230

                       10        20        30        40        50        60
m230.pep       MFHSIEKYRTPAQVLLGLIALTFVGFGVSTVSHPGADYIVQVGDEKISDHSINNAIQNEQ
               |||||||||||||||||||||||||||||||||||||||||||||||||:||||||:|||
g230           MFHSIEKYRTPAQVLLGLIALTFVGFGVSTVSHPGADYIVQVGDEKISEHSINNAMQNEQ
                       10        20        30        40        50        60

                       70        80        90       100       110       120
m230.pep       ADGGGPSPDAVFQSLLQRAYLKQGAKLMGISVSSEQIKQIIVDDPNFHDANGKFDHALLN
               ||||:|  ||||||||||||||||||||||||||||||:||||||||||||||:||||:
g230           ADGGSPWRDAVFQSLLQRAYLKQGAKLMGISVSSEQIKQMIVDDPNFHDANGKFSHALLS
                       70        80        90       100       110       120

                      130       140       150       160       170       180
m230.pep       RYLSQRHMSEDQFVEEIRDQFALQNLVNLVQNGVLVGDAQAEQLIRLTQVNRTIRSHTFN
               :||||||||||||||||||||||||||:||||||||||||||||||||||||||||||||
g230           QYLSQRHMSEDQFVEEIRDQFALQNLVSLVQNGVLVGDAQAEQLIRLTQVNRTIRSHTFN
                      130       140       150       160       170       180

                      190       200       210       220       230       240
m230.pep       PDEFIAQVKVSEADLQKFYNANKKDYLLPQAVKLEYVALNLKDFADKQTVSETEVKNAFE
               |||||||||:||||||||||||||||||||||||||||||||||||||||||||||||||
g230           PDEFIAQVKASEADLQKFYNANKKDYLLPQAVKLEYVALNLKDFADKQTVSETEVKNAFE
                      190       200       210       220       230       240

                      250       260       270       280       290       300
m230.pep       ERVARLPANEAKPSFEQEKAAVENELKMKKAVADFNKAKEKLGDDAVNHPSSLAEAAKNS
               ||||||||:||||||||||||||||||||||||||||||||||||| |||||||||||||
g230           ERVARLPAHEAKPSFEQEKAAVENELKMKKAVADFNKAKEKLGDDAFNHPSSLAEAAKNS
                      250       260       270       280       290       300

                      310       320       330       340       350       360
m230.pep       GLKVETQETWLSRQDAQMSGMPENLINAVFSDDVLKKKHNSEVLTINSETAWVVRAKEVR
               ||||||||||||||||||||||||||||||||||||||||||||||||||||||||||||
g230           GLKVETQETWLSRQDAQMSGMPENLINAVFSDDVLKKKHNSEVLTINSETAWVVRAKEVR
                      310       320       330       340       350       360

                      370       380
m230.pep       EEKTLPFAEAKDAVRQAYIRTEAAKL
               |||:| | ||||||||||||||||||
g230           EEKNLLFEEAKDAVRQAYIRTEAAKLLKTM
                      370       380       390
```

The following partial DNA sequence was identified in *N. meningitidis* <SEQ ID 831>:

```
a230.seq (partial)
    1 ATGTTCCATT CCATCGAAAA ATACAGAACG CCCGCCCAAG TCCTTTTGGG

   51 CCTGATTGCA TTAACCTTCG TCGGCTTCGG GGTCAGCACG GTATCCCATC

  101 CGGGTGCCGA CTACATCGTC CAAGTGGGCG ACGAAAAAAT CAGCGACCAC
```

-continued

```
 151 TCCATCAACA ACGCCATACA GAACGAACAG GCGGACGGCG GCGGCCCTTC
 201 GCGCGACGCG GTGTTCCAAT CCCTGCTACA ACGCGCCTAC CTGAAACAGG
 251 GCGCGAAGCT GATGGGCATT TCGGTTTCTT CCGAACAAAT CAAGCAGATT
 301 ATCGTGGACG ATCCCAATTT CCACGACGCA AACGGCAAAT TCGACCACGC
 351 GCTTTTAAAC CGCTACCTTT CCCAACGTCA TATGTCTGAA GACCAGTTTG
 401 TCGAAGAAAT CCGCGATCAG TTTGCCTTGC AGAATTTGGT AAACCTCGTC
 451 CAAAACGGCG TATTGGTCGG CGACGCGCAG GCGGAACAGC TGATCAGGCT
 501 GACGCAGGTC AACCGCACCA TCCGTTCGCA CACTTTCAAC CCCGACGAAT
 551 TCATCGCCCA AGTCAAAGTG TCTGAAGCCG ATTTGCAGAA GTTTTATAAC
 601 GCAAACAAAA AAGACTACCT GCTTCCCAAA GCGGTCAAAT TGGAATATGT
 651 CGCCTTGAAT CTGAAAGACT TTGCAGACAA ACAGACCGTC AGCGAAACAG
 701 AAGTGAAAAA TGCGTTTGAA GAGCGCGTGG CGCGTTTGCC GGCAAATGAA
 751 GCCAAACCTT CTTTCGAGCA GGAAAAAGCC GCCGTCGAAA ACGAATTGAA
 801 AATGAAAAAG GCGGTTGCCG ACTTCAATAA GGCAAAAGAA AAGCTGGGCG
 851 ATGACGCGTT CAACCATCCT TCCTCGCTTG CCGAAGCCGC CAAAAACAGC
 901 GGTTTGAAAG TCGAAACCCA AGAAACTTGG CTGAGCAGGC AGGATGCGCA
 951 AATGTCCGGT ATGCCCGAAA ACCTGATCAA TGCCGTATTC AGCGACGACG
1001 TATTGAAGAA AAAACACAAT TCCGAAGTGC TGACCATCAA CAGCGAAACC
1051 GCGTGGGTCG TCCGCGCCAA AGAAGTCCGC GAAGAGAAAA CCCTGCCGTT
1101 TGCCGAAGCC AAAGACGCGG TACGTCAGGC TTATATCCGT ACCGAAGCCG
1151 CCAAACTT
```

This corresponds to the amino acid sequence <SEQ ID 832; ORF 230.a>:

```
a230.pep (partial)
  1 MFHSIEKYRT PAQVLLGLIA LTFVGFGVST VSHPGADYIV QVGDEKISDH
 51 SINNAIQNEQ ADGGGPSRDA VFQSLLQRAY LKQGAKLMGI SVSSEQIKQI
101 IVDDPNFHDA NGKFDHALLN RYLSQRHMSE DQFVEEIRDQ FALQNLVNLV
151 QNGVLVGDAQ AEQLIRLTQV NRTIRSHTFN PDEFIAQVKV SEADLQKFYN
201 ANKKDYLLPK AVKLEYVALN LKDFADKQTV SETEVKNAFE ERVARLPANE
251 AKPSFEQEKA AVENELKMKK AVADFNKAKE KLGDDAFNHP SSLAEAAKNS
301 GLKVETQETW LSRQDAQMSG MPENLINAVF SDDVLKKKHN SEVLTINSET
351 AWVVRAKEVR EEKTLPFAEA KDAVRQAYIR TEAAKL
```

m230/a230 99.2% identity in 386 aa overlap

```
                  10        20        30        40        50        60
m230.pep  MFHSIEKYRTPAQVLLGLIALTFVGFGVSTVSHPGADYIVQVGDEKISDHSINNAIQNEQ
          ||||||||||||||||||||||||||||||||||||||||||||||||||||||||||||
A230      MFHSIEKYRTPAQVLLGLIALTFVGFGVSTVSHPGADYIVQVGDEKISDHSINNAIQNEQ
                  10        20        30        40        50        60

                  70        80        90       100       110       120
m230.pep  ADGGGPSPDAVFQSLLQRAYLKQGAKLMGISVSSEQIKQIIVDDPNFHDANGKFDHALLN
          ||||||| ||||||||||||||||||||||||||||||||||||||||||||||||||||
a230      ADGGGPSRDAVFQSLLQRAYLKQGAKLMGISVSSEQIKQIIVDDPNFHDANGKFDHALLN
                  70        80        90       100       110       120
```

-continued

```
                    130       140       150       160       170       180
m230.pep     RYLSQRHMSEDQFVEEIRDQFALQNLVNLVQNGVLVGDAQAEQLIRLTQVNRTIRSHTFN
             ||||||||||||||||||||||||||||||||||||||||||||||||||||||||||||
a230         RYLSQRHMSEDQFVEEIRDQFALQNLVNLVQNGVLVGDAQAEQLIRLTQVNRTIRSHTFN
                    130       140       150       160       170       180

                    190       200       210       220       230       240
m230.pep     PDEFIAQVKVSEADLQKFYNANKKDYLLPQAVKLEYVALNLKDFADKQTVSETEVKNAFE
             |||||||||||||||||||||||||||||:||||||||||||||||||||||||||||||
a230         PDEFIAQVKVSEADLQKFYNANKKDYLLPKAVKLEYVALNLKDFADKQTVSETEVKNAFE
                    190       200       210       220       230       240

                    250       260       270       280      290        300
m230.pep     ERVARLPANEAKPSFEQEKAAVENELKMKKAVADFNKAKEKLGDDAVNHPSSLAEAAKNS
             |||||||||||||||||||||||||||||||||||||||||||||| |||||||||||||
a230         ERVARLPANEAKPSFEQEKAAVENELKMKKAVADFNKAKEKLGDDAFNHPSSLAEAAKNS
                    250       260       270       280       290       300

                    310       320       330       340       350       360
m230.pep     GLKVETQETWLSRQDAQMSGMPENLINAVFSDDVLKKKHNSEVLTINSETAWVVRAKEVR
             ||||||||||||||||||||||||||||||||||||||||||||||||||||||||||||
a230         GLKVETQETWLSRQDAQMSGMPENLINAVFSDDVLKKKHNSEVLTINSETAWVVRAKEVR
                    310       320       330       340       350       360

                    370       380
m230.pep     EEKTLPFAEAKDAVRQAYIRTEAAKL
             ||||||||||||||||||||||||||
a230         EEKTLPFAEAKDAVRQAYIRTEAAKL
```

The following partial DNA sequence was identified in *N. gonorrhoeae* <SEQ ID 833>:

```
g230-1.seq
   1 ATGTTCCATT CCATCGAAAA ATACAGAACA CCCGCCCAAG TCTTATTAGG

  51 CCTGATTGCA TTAACTTTTG TCGGCTTCGG CGTCAGCACG GTTTCCCATC

 101 CGGGCGCCGA CTACATCGTC CAAGTGGGCG ACGAAAAAAT CAGCGAGCAC

 151 TCAATCAACA ACGCCATGCA GAACGAGCAG GCGGACGGCG GCAGCCCTTG

 201 GCGCGACGCG GTGTTCCAAT CCCTGCTGCA ACGCGCCTAC CTGAAACAGG

 251 GCGCGAAGCT GATGGGCATT TCGGTTTCTT CCGAACAAAT CAAGCAGATG

 301 ATTGTGGACG ATCCCAATTT CCACGACGCA AACGGCAAAT TCAGTCACGC

 351 GCTTTTGAGT CAATACCTGT CGCAACGCCA TATGTCTGAA GACCAGTTTG

 401 TCGAAGAAAT CCGCGATCAG TTTGCCTTGC AGAATTTGGT AAGCCTCGTC

 451 CAAAACGGCG TATTGGTCGG CGACGCGCAG GCGGAACAGC TGATCAGGCT

 501 GACGCAGGTC AACCGCACCA TCCGTTCGCA CACTTTCAAC CCCGACGAGT

 551 TCATCGCCCA AGTCAAAGCG TCTGAAGCCG ATTTGCAGAA ATTTTATAAT

 601 GCGAACAAAA AAGACTATCT GCTGCCGCAG GCGGTCAAAT TGGAATATGT

 651 CGCCTTGAAT CTGAAGGATT TTGCAGACAA GCAGACCGTC AGTGAAACGG

 701 AAGTGAAAAA TGCGTTTGAA GAGCGCGTGG CGCGTTTGCC GGCACATGAA

 751 GCCAAACCTT CTTTCGAGCA GGAAAAAGCC GCCGTCGAAA ACGAATTGAA

 801 AATGAAAAAG GCGGTTGCCG ACTTCAACAA GGCAAAAGAA AAGCTGGGCG

 851 ACGATGCGTT CAATCATCCC TCCTCGCTTG CCGAAGCCGC CAAAAACAGC

 901 GGTTTGAAAG TGGAAACCCA AGAAACTTGG CTGAGCAGGC AGGACGCACA

 951 AATGTCCGGC ATGCCCGAAA ACCTAATCAA TGCCGTATTC AGCGACGACG

1001 TATTGAAGAA AAAACACAAT TCCGAAGTGC TGACCATCAA CAGCGAAACC

1051 GCGTGGGTCG TCCGCGCCAA AGAAGTCCGC GAAGAAAAAA ACCTACTGTT

1101 TGAAGAAGCC AAAGATGCGG TGCGTCAGGC CTATATCCGT ACCGAAGCCG

1151 CCAAACTTGC CGAAAACAAG GCAAAAGAAG TGCTTACCCA ACTGAACGGC
```

-continued

```
1201 GGCAAGGCAG TTGACGTGAA ATGGTCGGAA GTGTCCGTTT TGGGCGCGCA

1251 GCAGGCAAGG CAGTCCATGC CGCCCGAGGC TTATGCGGAA CTGCTGAAAG

1301 CAAAACCGGC AAACGGCAAA CCCGCCTATG TCAGACTGAC CGGTCTGCCG

1351 GCACCCGTGA TTGTCGAGGC GCAGGCAGTC ACGCCTCCGG AGGATATTGC

1401 CGCACAGCTT CCTCCTGCGA AACAGGCTTT GGCGCAACAG CAGTCTGCCA

1451 ATACTTTCGA CCTGCTGATC CGCTATTTCA ACGGAAAAAT CAAACAGACT

1501 AAAGGAGCAC AATCGGTTGA CAACGGCGAT GGTCAGTAA
```

This corresponds to the amino acid sequence <SEQ ID 834; ORF 230-1.ng>:

```
g230-1.pep.
  1 MFHSIEKYRT PAQVLLGLIA LTFVGFGVST VSHPGADYIV QVGDEKISEH

 51 SINNAMQNEQ ADGGSPWRDA VFQSLLQRAY LKQGAKLMGI SVSSEQIKQM

101 IVDDPNFHDA NGKFSHALLS QYLSQRHMSE DQFVEEIRDQ FALQNLVSLV

151 QNGVLVGDAQ AEQLIRLTQV NRTIRSHTFN PDEFIAQVKA SEADLQKFYN

201 ANKKDYLLPQ AVKLEYVALN LKDFADKQTV SETEVKNAFE ERVARLPAHE

251 AKPSFEQEKA AVENELKMKK AVADFNKAKE KLGDDAFNHP SSLAEAAKNS

301 GLKVETQETW LSRQDAQMSG MPENLINAVF SDDVLKKKHN SEVLTINSET

351 AWVVRAKEVR EEKNLLFEEA KDAVRQAYIR TEAAKLAENK AKEVLTQLNG

401 GKAVDVKWSE VSVLGAQQAR QSMPPEAYAE LLKAKPANGK PAYVRLTGLP

451 APVIVEAQAV TPPEDIAAQL PPAKQALAQQ QSANTFDLLI RYFNGKIKQT

501 KGAQSVDNGD GQ*
```

The following partial DNA sequence was identified in *N. meningitidis* <SEQ ID 835>:

```
m230-1.seq
  1 ATGTTCCATT CCATCGAAAA ATACAGAACG CCCGCCCAAG TCCTTTTGGG

 51 CCTGATTGCA TTAACCTTCG TCGGCTTCGG GGTCAGCACG GTATCCCATC

101 CGGGTGCCGA CTACATCGTC CAAGTGGGCG ACGAAAAAAT CAGCGACCAC

151 TCCATCAACA ACGCCATACA GAACGAACAG GCGGACGGCG GCGGCCCTTC

201 GCGCGACGCG GTGTTCCAAT CCCTGCTGCA ACGCGCCTAC CTGAAACAGG

251 GCGCGAAGCT GATGGGCATT TCGGTTTCTT CCGAACAAAT CAAGCAAATT

301 ATCGTGGACG ATCCCAATTT CCACGACGCA AACGGCAAAT TCGACCACGC

351 GCTTTTAAAC CGCTACCTTT CCCAACGCCA TATGTCTGAA GACCAGTTTG

401 TCGAAGAAAT CCGCGATCAG TTTGCCTTGC AGAATTTGGT AAACCTCGTC

451 CAAAACGGCG TATTGGTCGG CGACGCGCAG GCGGAACAGC TGATCAGGCT

501 GACACAGGTC AACCGCACCA TCCGTTCGCA CACTTTCAAC CCCGACGAGT

551 TCATCGCCCA AGTCAAAGTG TCTGAAGCCG ATTTGCAGAA ATTTTATAAT

601 GCGAACAAAA AAGACTATCT GCTGCCGCAG GCGGTCAAAT TGGAATATGT

651 CGCCTTGAAT CTGAAGGATT TTGCAGACAA GCAGACCGTC AGTGAAACGG

701 AAGTGAAAAA TGCATTTGAA GAGCGCGTGG CGCGTTTGCC GGCAAATGAA

751 GCCAAACCTT CTTTCGAGCA GGAAAAAGCC GCCGTCGAAA ACGAATTGAA
```

-continued

```
 801 AATGAAAAAG GCGGTTGCCG ACTTCAACAA GGCAAAAGAA AAATTGGGCG

 851 ACGATGCGTT CAACCATCCT TCCTCGCTTG CCGAAGCCGC CAAAAACAGC

 901 GGTTTGAAAG TCGAAACCCA AGAAACTTGG CTGAGTAGGC AGGACGCGCA

 951 AATGTCCGGT ATGCCCGAAA ACCTGATCAA TGCCGTATTC AGCGACGACG

1001 TATTGAAGAA AAAACACAAT TCCGAAGTGC TGACCATCAA CAGCGAAACC

1051 GCGTGGGTCG TCCGCGCCAA AGAAGTCCGC GAAGAGAAAA CCCTGCCGTT

1101 TGCCGAAGCC AAAGACGCGG TACGTCAGGC TTATATCCGT ACCGAAGCCG

1151 CCAAACTTGC CGAAAACAAG GCAAAAGACG TGCTTACCCA ACTGAACGGC

1201 GGCAAGGCTG TTGACGTGAA ATGGTCGGAA GTGTCCGTTT TGGGCGCACA

1251 GCAGGCAAGG CAGTCCATGC CGCCCGAGGC TTATGCGGAA CTGCTGAAAG

1301 CAAAACCGGC AAACGGCAAA CCCGCCTACG TCAGGCTGAT CGGTCTGCCG

1351 GCACCCGTGA TTGTCGAAGT ACAGGCTGTA ACCCCGCCGG ATGATATCGC

1401 CGCACAGCTT CCGCTTGCAA AACAGGCTTT GGCGCAACAG CAGTCTGCCA

1451 ATACTTTCGA CTTGTTGATA CGTTATTTCA ACGGCAAAAT CAAACAGACC

1501 AAAGGAGCGC AATCGGTCGA CAACGGCGAC GGTCAGTAA
```

This corresponds to the amino acid sequence <SEQ ID 836; ORF 230-1>:

```
a230-1.pep

      1  MFHSIEKYRT PAQVLLGLIA LTFVGFGVST VSHPGADYIV QVGDEKISDH

     51  SINNAIQNEQ ADGGGPSRDA VFQSLLQRAY LKQGAKLMGI SVSSEQIKQI

    101  IVDDPNGHDA NGKFDHALLN RYLSQRHMSE DQGVEEIRDQ FALQNLVNLV

    151  QNGVLVGDAQ AEQLIRLTQV NRTIRSHTFN PDEFIAQVKV SEADLQKFYN

    201  ANKKDYLLPQ AVKLEYVALN LKDFADKQTV SETEVKNAFE ERVARLPANE

    251  AKPSFEQEKA AVENELKMKK AVADFNKAKE KLGDDAFNHP SSLAEAAKNS

    301  GLKVETQETW LSRQDAQMSG MPENLINAVF SDDVLKKKHN SEVLTINSET

    351  AWVVRAKEVR EEKTLPFAEA KDAVRQAYIR TEAAKLAENK AKDVLTQLNG

    401  GKAVDVKWSE VSVLGAQQAR QSMPPEAYAE LLKAKPANGK PAYVRLIGLP

    451  APVIVEVQAV TPPDDIAAQL PLAKQALAQQ QSANTFDLLI RYFNGKIKQT

    501  KGAQSVDNGD GQ*

m230-1/g230-1  96.3% identity in 512 aa overlap

                   10        20        30        40        50        60
m230-1.pep MFHSIEKYRTPAQVLLGLIALTFVGFGVSTVSHPGADYIVQVGDEKISDHSINNAIQNEQ
           |||||||||||||||||||||||||||||||||||||||||||||||||:|||||:||||
g230-1     MFHSIEKYRTPAQVLLGLIALTFVGFGVSTVSHPGADYIVQVGDEKISEHSINNAMQNEQ
                   10        20        30        40        50        60

                   70        80        90       100       110       120
m230-1.pep ADGGGPSRDAVFQSLLQRAYLKQGAKLMGISVSSEQIKQIIVDDPNFHDANGKFDHALLN
           ||||:| ||||||||||||||||||||||||||||||||:||||||||||||||:||||:
g230-1     ADGGSPWRDAVFQSLLQRAYLKQGAKLMGISVSSEQIKQMIVDDPNFHDANGKFSHALLS
                   70        80        90       100       110       120

                  130       140       150       160       170       180
m230-1.pep RYLSQRHMSEDQFVEEIRDQFALQNLVNLVQNGVLVGDAQAEQLIRLTQVNRTIRSHTFN
           :||||||||||||||||||||||||||:||||||||||||||||||||||||||||||||
g230-1     QYLSQRHMSEDQFVEEIRDQFALQNLVSLVQNGVLVGDAQAEQLIRLTQVNRTIRSHTFN
                  130       140       150       160       170       180

                  190       200       210       220       230       240
m230-1.pep PDEFIAQVKVSEADLQKFYNANKKDYLLPQAVKLEYVALNLKDFADKQTVSETEVKNAFE
           |||||||||:||||||||||||||||||||||||||||||||||||||||||||||||||
g230-1     PDEFIAQVKASEADLQKFYNANKKDYLLPQAVKLEYVALNLKDFADKQTVSETEVKNAFE
                  190       200       210       220       230       240
```

-continued

```
                  250        260        270        280        290        300
m230-1.pep ERVARLPANEAKPSFEQEKAAVENELKMKKAVADFNKAKEKLGDDAFNHPSSLAEAAKNS
           ||||||||:|||||||||||||||||||||||||||||||||||||||||||||||||||
g230-1     ERVARLPAHEAKPSFEQEKAAVENELKMKKAVADFNKAKEKLGDDAFNHPSSLAEAAKNS
                  250        260        270        280        290        300

                  310        320        330        340        350        360
m230-1.pep GAKVETQETWLSRQDAQMSGMPENLINAVFSDDVLKKKHNSEVLTINSETAWVVRAKEVR
           ||||||||||||||||||||||||||||||||||||||||||||||||||||||||||||
g230-1     GAKVETQETWLSRQDAQMSGMPENLINAVFSDDVLKKKHNSEVLTINSETAWVVRAKEVR
                  310        320        330        340        350        360

                  370        380        390        400        410        420
m230-1.pep EEKTLPFAEAKDAVRQAYIRTEAAKLAENKAKDVLTQLNGGKAVDVKWSEVSVLGAQQAR
           |||:| | ||||||||||||||||||||||:|||||||||||||||||||||||||||
g230-1     EEKNLLFEEAKDAVRQAYIRTEAAKLAENKAKEVLTQLNGGKAVDVKWSEVSVLGAQQAR
                  370        380        390        400        410        420

                  430        440        450        460        470        480
m230-1.pep QSMPPEAYAELLKAKPANGKPAYVRLIGLPAPVIVEVQAVTPPDDIAAQLPLAKQALAQQ
           |||||||||||||||||||||||||| |||||||||:||||||:||||||| ||||||||
g230-1     QSMPPEAYAELLKAKPANGKPAYVRLTGLPAPVIVEAQAVTPPEDIAAQLPPAKQALAQQ
                  430        440        450        460        470        480

                  490        500        510
m230-1.pep QSANTFDLLIRYFNGKIKQTKGAQSVDNGDGQX
           |||||||||||||||||||||||||||||||||
g230-1     QSANTFDLLIRYFNGKIKQTKGAQSVDNGDGQX
                  490        500        510
```

The following partial DNA sequence was identified in *N. meningitidis* <SEQ ID 837>:

```
a230-1.seq
   1 ATGTTCCATT CCATCGAAAA ATACAGAACG CCCGCCCAAG TCCTTTTGGG

  51 CCTGATTGCA TTAACCTTCG TCGGCTTCGG GGTCAGCACG GTATCCCATC

 101 CGGGTGCCGA CTACATCGTC CAAGTGGGCG ACGAAAAAAT CAGCGACCAC

 151 TCCATCAACA ACGCCATACA GAACGAACAG GCGGACGGCG GCGGCCCTTC

 201 GCGCGACGCG GTGTTCCAAT CCCTGCTACA ACGCGCCTAC CTGAAACAGG

 251 GCGCGAAGCT GATGGGCATT TCGGTTTCTT CCGAACAAAT CAAGCAGATT

 301 ATCGTGGACG ATCCCAATTT CCACGACGCA AACGGCAAAT TCGACCACGC

 351 GCTTTTAAAC CGCTACCTTT CCCAACGTCA TATGTCTGAA GACCAGTTTG

 401 TCGAAGAAAT CCGCGATCAG TTTGCCTTGC AGAATTTGGT AAACCTCGTC

 451 CAAAACGGCG TATTGGTCGG CGACGCGCAG GCGGAACAGC TGATCAGGCT

 501 GACGCAGGTC AACCGCACCA TCCGTTCGCA CACTTTCAAC CCCGACGAAT

 551 TCATCGCCCA AGTCAAAGTG TCTGAAGCCG ATTTGCAGAA GTTTTATAAC

 601 GCAAACAAAA AAGACTACCT GCTTCCCAAA GCGGTCAAAT TGGAATATGT

 651 CGCCTTGAAT CTGAAAGACT TTGCAGACAA ACAGACCGTC AGCGAAACAG

 701 AAGTGAAAAA TGCGTTTGAA GAGCGCGTGG CGCGTTTGCC GGCAAATGAA

 751 GCCAAACCTT CTTTCGAGCA GGAAAAAGCC GCCGTCGAAA ACGAATTGAA

 801 AATGAAAAAG GCGGTTGCCG ACTTCAATAA GGCAAAAGAA AAGCTGGGCG

 851 ATGACGCGTT CAACCATCCT TCCTCGCTTG CCGAAGCCGC CAAAAACAGC

 901 GGTTTGAAAG TCGAAACCCA AGAAACTTGG CTGAGCAGGC AGGATGCGCA

 951 AATGTCCGGT ATGCCCGAAA ACCTGATCAA TGCCGTATTC AGCGACGACG

1001 TATTGAAGAA AAAACACAAT TCCGAAGTGC TGACCATCAA CAGCGAAACC

1051 GCGTGGGTCG TCCGCGCCAA AGAAGTCCGC GAAGAGAAAA CCCTGCCGTT

1101 TGCCGAAGCC AAAGACGCGG TACGTCAGGC TTATATCCGT ACCGAAGCCG

1151 CCAAACTTGC CGAAAACAAG GCAAAAGACG TGCTTACCCA ACTGAACGGC
```

-continued

```
1201 GGCAAGGCTG TTGACGTGAA ATGGTCGGAA GTGTCCGTTT TGGGCGCACA

1251 GCAGGCAAGG CAGTCCATGC CGCCCGAGGC TTATGCGGAA CTGCTGAAAG

1301 CAAAACCGGC AAACGGCAAA CCCGCCTACG TCAGGCTGAT CGGTCTGCCG

1351 GCACCCGTGA TTGTCGAAGT ACAGGCTGTA ACCCCGCCGG ATGATATCGC

1401 CGCACAGCTT CCGCTTGCAA AACAGGCTTT GGCGCAACAG CAGTCTGCCA

1451 ATACTTTCGA CTTGTTGATA CGTTATTTCA ACGGCAAAAT CAAACAGACC

1501 AAAGGAGCGC AATCGGTCGA CAACGGCGAC GGTCAGTAA
```

This corresponds to the amino acid sequence <SEQ ID 838; ORF 230-1.a>:

```
a230-1.pep
      1  MFHSIEKYRT PAQVLLGLIA LTFVGFGVST VSHPGADYIV QVGDEKISDH
     51  SINNAIQNEQ ADGGGPSRDA VFQSLLQRAY LKQGAKLMGI SVSSEQIKQI

    101  IVDDPNGHDA NGKFDHALLN RYLSQRHMSE DQGVEEIRDQ FALQNLVNLV

    151  QNGVLVGDAQ AEQLIRLTQV NRTIRSHTFN PDEFIAQVKV SEADLQKFYN

    201  ANKKDYLLPQ AVKLEYVALN LKDFADKQTV SETEVKNAFE ERVARLPANE

    251  AKPSFEQEKA AVENELKMKK AVADFNKAKE KLGDDAFNHP SSLAEAAKNS

    301  GLKVETQETW LSRQDAQMSG MPENLINAVF SDDVLKKKHN SEVLTINSET

    351  AWVVRAKEVR EEKTLPFAEA KDAVRQAYIR TEAAKLAENK AKDVLTQLNG

    401  GKAVDVKWSE VSVLGAQQAR QSMPPEAYAE LLKAKPANGK PAYVRLIGLP

    451  APVIVEVQAV TPPDDIAAQL PLAKQALAQQ QSANTFDLLI RYFNGKIKQT

    501       KGAQSVDNGD GQ*
```

```
a230-1/m230-1  99.8% identity in 512 aa overlap

                   10        20        30        40        50        60
a230-1.pep MFHSIEKYRTPAQVLLGLIALTFVGFGVSTVSHPGADYIVQVGDEKISDHSINNAIQNEQ
           ||||||||||||||||||||||||||||||||||||||||||||||||||||||||||||
m230-1     MFHSIEKYRTPAQVLLGLIALTFVGFGVSTVSHPGADYIVQVGDEKISDHSINNIMQNEQ
                   10        20        30        40        50        60

                   70        80        90       100       110       120
a230-1.pep ADGGGPSRDAVFQSLLQRAYLKQGAKLMGISVSSEQIKQIIVDDPNFHDANGKFDHALLN
           ||||||||||||||||||||||||||||||||||||||||||||||||||||||||||||
m230-1     ADGGGPSRDAVFQSLLQRAYLKQGAKLMGISVSSEQIKQIIVDDPNFHDANGKFDHALLN
                   70        80        90       100       110       120

                  130       140       150       160       170       180
a230-1.pep RYLSQRHMSEDQFVEEIRDQFALQNLVNLVQNGVLVGDAQAEQLIRLTQVNRTIRSHTFN
           ||||||||||||||||||||||||||||||||||||||||||||||||||||||||||||
m230-1     RYLSQRHMSEDQFVEEIRDQFALQNLVNLVQNGVLVGDAQAEQLIRLTQVNRTIRSHTFN
                  130       140       150       160       170       180

                  190       200       210       220       230       240
a230-1.pep PDEFIAQVKVSEADLQKFYNANKKDYLLPKAVKLEYVALNLKDFADKQTVSETEVKNAFE
           |||||||||||||||||||||||||||||:||||||||||||||||||||||||||||||
m230-1     PDEFIAQVKVSEADLQKFYNANKKDYLLPQAVKLEYVALNLKDFADKQTVSETEVKNAFE
                  190       200       210       220       230       240

                  250       260       270       280       290       300
a230-1.pep ERVARLPANEAKPSFEQEKAAVENELKMKKAVADFNKAKEKLGDDAFNHPSSLAEAAKNS
           ||||||||||||||||||||||||||||||||||||||||||||||||||||||||||||
m230-1     ERVARLPANEAKPSFEQEKAAVENELKMKKAVADFNKAKEKLGDDAFNHPSSLAEAAKNS
                  250       260       270       280       290       300

                  310       320       330       340       350       360
a230-1.pep GAKVETQETWLSRQDAQMSGMPENLINAVFSDDVLKKKHNSEVLTINSETAWVVRAKEVR
           ||||||||||||||||||||||||||||||||||||||||||||||||||||||||||||
m230-1     GAKVETQETWLSRQDAQMSGMPENLINAVFSDDVLKKKHNSEVLTINSETAWVVRAKEVR
                  310       320       330       340       350       360

                  370       380       390       400       410       420
a230-1.pep EEKTLPFAEAKDAVRQAYIRTEAAKLAENKAKDVLTQLNGGKAVDVKWSEVSVLGAQQAR
           ||||||||||||||||||||||||||||||||||||||||||||||||||||||||||||
m230-1     EEKTLPFAEAKDAVRQAYIRTEAAKLAENKAKDVLTQLNGGKAVDVKWSEVSVLGAQQAR
                  370       380       390       400       410       420
```

-continued

```
                    430       440       450       460       470       480
a230-1.pep QSMPPEAYAELLKAKPANGKPAYVRLIGLPAPVIVEVQAVTPPDDIAAQLPLAKQALAQQ
           ||||||||||||||||||||||||||||||||||||||||||||||||||||||||||||
m230-1     QSMPPEAYAELLKAKPANGKPAYVRLIGLPAPVIVEVQAVTPPDDIAAQLPLAKQALAQQ
                    430       440       450       460       470       480

                    490       500       510
a230-1.pep QSANTFDLLIRYFNGKIKQTKGAQSVDNGDGQX
           |||||||||||||||||||||||||||||||||
m230-1     QSANTFDLLIRYFNGKIKQTKGAQSVDNGDGQX
                    490       500       510
```

The following partial DNA sequence was identified in *N. gonorrhoeae* <SEQ ID 839>:

```
g231.seq
     1 atgtcaaaac gaaaatccat aaaccgtccg tatcaaaaac cggcggaact
    51 gccgccgttg caaaataatc cgccatttta ccgtaaaaac cgccgcctga
   101 actttttat cgcggcagac ggcggttgcg cgtctccgca aaaatgcagg
   151 gcgcgcggtt ttcagacggc atttgccgtt caaggccgtg cggtgtcttt
   201 accaaatgcc caaccattcg cccacggaat ccatccaatc cttattgccc
   251 ccgccgctcc tgcctgcccg gcggtacgcc cacggcgctt gcggattttt
   301 agctttccac aatcctttgc gttccctttc cgcctgaatt tgagcgtcgg
   351 catagtcggc aaaatccgcc ttatcctgct gttctttagc ataactttta
   401 taatgccacg ccgccccgtc ctgcacctgc atcaggttca aatcggtttt
   451 gccggcggat acctgcgcca cttcgcgctg atagcggtcg gtttcaaaca
   501 cacgtacact gactttccta ccctccgccg ccgcgcgcag gttgtcgcgc
   551 gaacgtgtac cgtaagcctg tttcatctcc ggtgcgtcga tatacgccat
   601 ccgaatttta tgtttcgcgc cgtcgccgtc gatgacgtga agggtatcgc
   651 cgtcatagac tttggacacc gtgcctgtgt agctgtggcc ggatttcgcc
   701 gatgcccgtc ggcgaacggg cgcgtcgaaa cccacgtccc ctgcagtgcc
   751 gagtacgtcg agtacggcaa ccgccgtccg caccgcctca ctgtcatatc
   801 ccgtataacc caacgcgccc aaaagcgaca gggcgacggg aagccatttc
   851 atgatttttt taatctgcat atttttcaaa tgccgatgcc gtctgaacat
   901 ctctga
```

This corresponds to the amino acid sequence <SEQ ID 840; ORF 231.ng>:

```
g231.pep
     1 MSKRKSINRP YQKPAELPPL QNNPPFYRKN RRLNFFIAAD GGCASPQKCR
    51 ARGFQTAFAV QGRAVSLPNA QPFAHGIHPI LIAPAAPACP AVRPRRLRIF
   101 SFPQSFAFPF RLNLSVGIVG KIRLILLFFS ITFIMPRRPV LHLHQVQIGF
   151 AGGYLRHFAL IAVGFKHTYT DFPTLRRRAQ VVARTCTVSL FHLRCVDIRH
   201 PNFMFRAVAV DDVKGIAVID FGHRACVAVA GFRRCPSANG RVETHVPCSA
   251 EYVEYGNRRP HRLTVISRIT QRAQKRQGDG KPFHDFFNLH IFQMPMPSEH
   301 L*
```

The following partial DNA sequence was identified in *N. meningitidis* <SEQ ID 841>:

```
m231.seq (partial)
    1 ATGTCAAAAC GAAAATCCAT AAACCGTCCG TATCAAAAAC CGGCGGAACT

   51 GCCGCCGTTG CAAAATAATC CGCCATTTTA CCGTAAAAAC CGCCGCCTGA

  101 ACTTTTTTAT CGCGGCAGAC GGCGGTTGCG CGTCTCCGCA AAAATGCAGG

  151 GCGCGCGGTT TTCAGACGGC ATTTGCCGTT CAAAGCCGTG CGGTGTCTTT

  201 ACCAAATGCC CAACCATTCG GC.....
```

This corresponds to the amino acid sequence <SEQ ID 842; ORF 231>:

```
m231.pep (partial)
    1 MSKRKSINRP YQKPAELPPL QNNPPFYRKN RRLNFFIAAD GGCASPQKCR

   51 ARGFQTAFAV QSRAVSLPNA QPFG.....
```

Computer analysis of this amino acid sequence gave the following results:

Homology with a Predicted ORF from *N. gonorrhoeae*

ORF 231 shows 98.6% identity over a 73 aa overlap with a predicted ORF (ORF 231.ng) from *N. gonorrhoeae*:

```
m231/g231

                   10        20        30        40        50        60
m231.pep  MSKRKSINRPYQKPAELPPLQNNPPFYRKNRRLNFFIAADGGCASPQKCRARGFQTAFAV
          ||||||||||||||||||||||||||||||||||||||||||||||||||||||||||||
g231      MSKRKSINRPYQKPAELPPLQNNPPFYRKNRRLNFFIAADGGCASPQKCRARGFQTAFAV
                   10        20        30        40        50        60

                    70
m231.pep    QSRAVSLPNAQPFG
            |:|||||||||||:
g231        QGRAVSLPNAQPFAHGIHPILIAPAAPACPAVRPRRLRIFSFPQSFAFPPFRLNLSVGIVG
                    70        80        90       100       110       120
```

The following partial DNA sequence was identified in *N. meningitidis* <SEQ ID 843>:

```
a231.seq(partial)
    1 ATGTCAAAAC GAAAATCCAT AAACCGTCCG TATCAAAAAC CGGCGGAACT

   51 GCCGCCGTTG CAAAATAATC CGCCATTTTA CCGTAAAAAC CGCCGCCTGA

  101 ACTTTTTTAT CGNGGCAGAC GGCGGTTGCG CGTCTCCGCA AAAATGCAGG

  151 GCGCGCGGTT TTCAGACGGC ATTTGCCGTT CAAAGCCGTG CGGTGTCTTT

  201 ACCAAATGCC CAACCATTCG CCCACGGCAT CCATCCAATC CTTATTGCCC

  251 CCGCCGCTCC TGCCTGCCCG GCGGTACGCC CACGGCGCTT GCGGATTTTT

  301 AGCTTTCCAC AATCCTTTGC GTTCCCTTTC CGCCTGAATT TGAGCGTCGG

  351 CATAATCGGC AAAATCCGCC TTATCCTGCT GTTCTTTAGC ATAACTTTTA

  401 TAATGCCACG CCGCCCCGTC CTGCACCTGC ATCAGGTTCA AATCGGTTTT

  451 GCCGACAGAA ACCTGCGCCA CTTCGCGCTG GTAGCGGTCG GTGTCGAACA

  501 CGCGGACGCT GACTTTCCTG CCTTCCGCCG CCGCGCGCAG GTTGTCGCGC

  551 GAACGCGTGC CGTAAGCCTG TTTCATCTCC GGCGCGTCGA TATACGCCAT

  601 CCGGATTTTG TGTTTCGCGC CGTCGCCGTC GATAACGTGA AGGGTGTCGC

  651 CGTCATAGAC TTTGGACACC GTGCCTGTGT AGCGGTGGCC GGATTTCGCC
```

-continued

```
701 GATGCTCGGC GGCGGGCGGG CGCGTCGGAA CCCGCGTCCC CTGCCGCGCC

751 GAGTACGTCG AGTACGGCAA CCGCCGTCCG CACCGCCTCG CTGCCGTACC

801 CCGTATAACC CAACGCACCC AAAAGCGACA AGGCGACGGG AAGCCATTTC

851 ATGATTTTTT TAATCTGCAT ATTTTTCAAA TGCCGATGCC GTCTGAACAT

901 ATC
```

This corresponds to the amino acid sequence <SEQ ID 844; ORF 217.a>:

```
a231.pep(partial)
  1 MSKRKSINRP YQKPAELPPL QNNPPFYRKN RRLNFFIXAD GGCASPQKCR

 51 ARGFQTAFAV QSRAVSLPNA QPFAHGIHPI LIAPAAPACP AVRPRRLRIF

101 SFPQSFAFPF RLNLSVGIIG KIRLILLFFS ITFIMPRRPV LHLHQVQIGF

151 ADRNLRHFAL VAVGVEHADA DFPAFRRRAQ VVARTRAVSL FHLRRVDIRH

201 PDFVFRAVAV DNVKGVAVID FGHRACVAVA GFRRCSAAGG RVGTRVPCRA

251 EYVEYGNRRP HRLAAVPRIT QRTQKRQGDG KPFHDFFNLH IFQMPMPSEH

301 I
```

m231/a231 98.6% identity in 73 aa overlap

```
                    10        20        30        40        50        60
m231.pep    MSKRKSINRPYQKPAELPPLQNNPPFYRKNRRLNFFIAADGGCASPQKCRARGFQTAFAV
            ||||||||||||||||||||||||||||||||||||| ||||||||||||||||||||||
a231        MSKRKSINRPYQKPAELPPLQNNPPFYRKNRRLNFFIXADGGCASPQKCRARGFQTAFAV
                    10        20        30        40        50        60
                    70
m231.pep    QSRAVSLPNAQPFG
            |||||||||||||:
a231        QSRAVSLPNAQPFAHGIHPILIAPAAPACPAVRPRRLRIFSFPQSFAFPFRLNLSVGIIG
                    70        80        90       100       110       120
```

The following partial DNA sequence was identified in *N. gonorrhoeae* <SEQ ID 845>:

```
g231-1.seq
  1 ATGTCAAAAC GAAAATCCAT AAACCGTCCG TATCAAAAAC CGGCGGAACT

 51 GCCGCCGTTG CAAAATAATC CGCCATTTTA CCGTAAAAAC CGCCGcCTGA

101 ACTTTTTTAT CGCGGCAGAC GGCGGTTGCG CGTCTCCGCA AAAATGCAGG

151 GCGCGCGGTT TTCAGACGGC ATTTGCCGTT CAAGGCCGTG CGGTGTCTTT

201 ACCAAATGCC CAACCATTCG CCCACGGAAT CCATCCAATC CTTATTGCCC

251 CCGCCGCTCC TGCCTGCCCG GCGGTACGCC CACGGCGCTT GCGGATTTTT

301 AGCTTTCCAC AATCCTTTGC GTTCCCTTTC CGCCTGAATT TGAGCGTCGG

351 CATAGTCGGC AAAATCCGCC TTATCCTGCT GTTCTTTAGC ATAACTTTTA

401 TAATGCCACG CCGCCCCGTC CTGCACCTGC ATCAGGTTCA AATCGGTTTT

451 GCCGGCGGAT ACCTGCGCCA CTTCGCGCTG ATAGCGGTCG GTTTCAAACa

501 CaCgTaCaat gagtttcgtA ccctccGCCG ccgcgcgCAG GTTGtcgcGC

551 GAACgTGTAC CGTAagcgtg TTtcatctcc GGTGCgtcGA TATACGCCaT

601 cCgAATTTta tGTttcgcgc cgtcgcCgtc gATGACGTGA AGGGtatcGC

651 CgtcATAGAC TTTGGACACC Gtgcctgcgt AGctGTGGCC GGATttcgc
```

This corresponds to the amino acid sequence <SEQ ID 846; ORF 231-1.ng>:

```
g231-1.pep
    1 MSKRKSINRP YQKPAELPPL QNNPPFYRKN RRLNFFIAAD GGCASPQKCR

   51 ARGFQTAFAV QGRAVSLPNA QPFAHGIHPI LIAPAAPACP AVRPRRLRIF

  101 SFPQSFAFPF RLNLSVGIVG KIRLILLFFS ITFIMPRRPV LHLHQVQIGF

  151 AGGYLRHFAL IAVGFKHTYN EFRTLRRRAQ VVARTCTVSV FHLRCVDIRH

  201 PNFMFRAVAV DDVKGIAVID FGHRACVAVA GFR
```

The following partial DNA sequence was identified in *N. meningitidis* <SEQ ID 847>:

```
m231-1.seq
    1 ATGTCAAAAC GAAAATCCAT AAACCGTCCG TATCAAAAAC CGGCGGAACT

   51 GCCGCCGTTG CAAAATAATC CGCCATTTTA CCGTAAAAAC CGCCGCCTGA

  101 ACTTTTTTAT CGCGGCAGAC GGCGGTTGCG CGTCTCCGCA AAAATGCAGG

  151 GCGCGCGGTT TTCAGACGGC ATTTGCCGTT CAAAGCCGTG CGGTGTCTTT

  201 ACCAAATGCC CAACCATTCG CCCACGGCAT CCATCCAATC CTTATTGCCC

  251 CCGCCGCTCC TGCCTGCTCG GCGGTACGCC CACGGCGCTT GCGGATTTTT

  301 AGCTTTCCAC AATCCTTTGC GTTCCCTTTC CGCCTGAATT TGAGCGTCGG

  351 CATAATCGGC AAAATCCGCC TTATCCTGCT GTTCTTTAGC ATAACTTTTA

  401 TAATGCCACG CCGCCCCGTC CTGCACCTGC ATCAGGTTCA AATCGGTTTT

  451 GCCGACAGAA ACCTGCGCCA CTTCGCGCTG GTAGCGGTCG GTATCGAACA

  501 CGCGCACGCT GACTTTCCTG CCTTCCGCCG CCGCGCGCAG GTTGTCGCGC

  551 GAACGCGTGC CGTAAGCCTG TTTCATCTCC GGCGCGTCGA TATACGCCAT

  601 CCGGATTTTG TGTTTCGCGC CGTCGCCGTC GATAACGTGA AGGGTGTCGC

  651 CGTCATAGAC TTTGGACACC GTGCCTGTGT AGCGGTGGCC GGATTTCGCC

  701 GATGCTCGGC GGCGGGCGGG CGCGTCGGAA CCCGCGTCCC CTGCCGCGCC

  751 GAGTACGTCG AGTACGGCAA CCGCCGTCCG CACCGCCTCG CTGCCGTACC

  801 CCGTATAACC CAACGCACCC AAAAGCGACA GGGCGACGGG AAGCCATTTC

  851 ATGATTTTTT TAATCTGCAT ATTTTTCAAA TGCCGATGCC GTCTGAACAT

  901 ATCGGAATCG GATTTCAGAC GGCATCTTAA
```

This corresponds to the amino acid sequence <SEQ ID 848; ORF 231-1>:

```
m231-1.pep

      1 MSKRKSINRP YQKPAELPPL QNNPPFYRKN RRLNFFIAAD GGCASPQKCR
     51 ARGFQTAFAV QSRAVSLPNA QPFAHGIHPI LIAPAAPACS AVRPRRLRIF
    101 SFPQSFAFPF RLNLSVGIIG KIRLILLFFS ITFIMPRRPV LHLHQVQIGF
    151 ADRNLRHFAL VAVGIEHAHA DFPAFRRRAQ VVARTRAVSL FHLRRVDIRH
    201 PDFVFRAVAV DNVKGVAVID FGHRACVAVA GFRRCSAAGG RVGTRVPCRA
    251 EYVEYGNRRP HRLAAVPRIT QRTQKRQGDG KPFHDFFNLH IFQMPMPSEH
    301 IGIGFQTAS*

g231-1/m231-1 87.0% identity in 262 aa overlap
```

-continued

```
                   10        20        30        40        50        60
g231-1.pep  MSKRKSINRPYQKPAELPPLQNNPPFYRKNRRLNFFIAADGGCASPQKCRARGFQTAFAV
            ||||||||||||||||||||||||||||||||||||||||||||||||||||||||||||
m231-1      MSKRKSINRPYQKPAELPPLQNNPPFYRKNRRLNFFIAADGGCASPQKCRARGFQTAFAV
                   10        20        30        40        50        60

                   70        80        90       100       110       120
g231-1.pep  QGRAVSLPNAQPFAHGIHPILIAPAAPACPAVRPRRLRIFSFPQSFAFPFRLNLSVGIVG
            |:||||||||||||||||||||||||||| ||||||||||||||||||||||||||||:|
m231-1      QSRAVSLPNAQPFAHGIHPILIAPAAPACSAVRPRRLRIFSFPQSFAFPFRLNLSVGIIG
                   70        80        90       100       110       120

                  130       140       150       160       170       180
g231-1.pep  KIRLILLFFSITFIMPRRPVLHLHQVQIGFAGGYLRHFALIAVGFKHTYNEFRTLRRRAQ
            |||||||||||||||||||||||||||||||   ||||||:|||::|:: :| ::|||||
m231-1      KIRLILLFFSITFIMPRRPVLHLHQVQIGFADRNLRHFALVAVGIEHAHADFPAFRRRAQ
                  130       140       150       160       170       180

                  190       200       210       220       230       240
g231-1.pep  VVARTCTVSVFHLRCVDIRHPNFMFRAVAVDDVKGIAVIDFGHRACVAVAGFRXCPSANG
            ||||| :||:|||| ||||||:|:|||||||:|||:||||||||||||||||| | :|:|
m231-1      VVARTRAVSLFHLRRVDIRHPDFVFRAVAVDNVKGVAVIDFGHRACVAVAGFRRCSAANG
                  190       200       210       220       230       240

                  250       260
g231-1.pep  CVETHVPCSAEYVVXGNRRPHR
             | |:||| ||||  |||||||
m231-1      RVGTRVPCRAEYVEYGNRRPHRLAAVPRITQRTQKRQGDGKPFHDFFNLHIFQMPMPSEH
                  250       260       270       280       290       300
```

The following partial DNA sequence was identified in *N. meningitidis* <SEQ ID 849>:

```
a231-1.seq
   1 ATGTCAAAAC GAAAATCCAT AAACCGTCCG TATCAAAAAC CGGCGGAACT

  51 GCCGCCGTTG CAAAATAATC CGCCATTTTA CCGTAAAAAC CGCCGCCTGA

 101 ACTTTTTTAT GCGGCAGACG GCGGTTGCGC GTCTCCGCA AAAATGCAGG

 151 GCGCGCGGTT TTCAGACGGC ATTTGCCGTT CAAAGCCGTG CGGTGTCTTT

 201 ACCAAATGCC CAACCATTCG CCCACGGCAT CCATCCAATC CTTATTGCCC

 251 CCGCCGCTCC TGCCTGCCCG GCGGTACGCC CACGGCGCTT GCGGATTTTT

 301 AGCTTTCCAC AATCCTTTGC GTTCCCTTTC CGCCTGAATT TGAGCGTCGG

 351 CATAATCGGC AAAATCCGCC TTATCCTGCT GTTCTTTAGC ATAACTTTTA

 401 TAATGCCACG CCGCCCCGTC CTGCACCTGC ATCAGGTTCA AATCGGTTTT

 451 GCCGACAGAA ACCTGCGCCA CTTCGCGCTG GTAGCGGTCG GTGTCGAACA

 501 CGCGGACGCT GACTTTCCTG CCTTCCGCCG CCGCGCGCAG GTTGTCGCGC

 551 GAACGCGTGC CGTAAGCCTG TTTCATCTCC GGCGCGTCGA TATACGCCAT

 601 CCGGATTTTG TGTTTCGCGC CGTCGCCGTC GATAACGTGA AGGGTGTCGC

 651 CGTCATAGAC TTTGGACACC GTGCCTGTGT AGCGGTGGCC GGATTTCGCC

 701 GATGCTCGGC GGCGGGCGGG CGCGTCGGAA CCCGCGTCCC CTGCCGCGCC

 751 GAGTACGTCG AGTACGGCAA CCGCCGTCCG CACCGCCTCG CTGCCGTACC

 801 CCGTATAACC CAACGCACCC AAAAGCGACA AGGCGACGGG AAGCCATTTC

 851 ATGATTTTTT TAATCTGCAT ATTTTTCAAA TGCCGATGCC GTCTGAACAT

 901 ATCGGAATCG GATTTCAGAC GGCATCTTAA
```

This corresponds to the amino acid sequence <SEQ ID 850; ORF 231-1.a>:

```
a231-1.pep

     1  MSKRKSINRP YQKPAELPPL QNNPPFYRKN RRLNFFIAAD GGCASPQKCR
```

-continued

```
 51  ARGFQTAFAV QSRAVSLPNA QPFAHGIHPI LIAPAAPACS AVRPRRLRIF

101  SFPQSFAFPF RLNLSVGIIF KIRLILLFFS ITFIMPRRPV LHLHQVQIFG

151  ADRNLRHFAL VAVGIEHAHA DFPAFRRRAQ VVARTRAVSL FHLRRVDIRH

201  PDFVFRAVAV DNVKGVAVID FGHRACVAVA GFRRCSAAGG RVGTRVPCRA

251  EYVEYGNRRP HRLAAVPRIT QRTQKRQGDG KPFHDFFNLH IFQMPMPSEH

301  IGIGFQTAS*
```

```
a231-1/m231-1  99.0% identity in 309 aa overlap

                    10        20        30        40        50        60
a231-1.pep MSKRKSINRPYQKPAELPPLQNNPPFYRKNRRLNFFIAADGGCASPQKCRARGFQTAFAV
           ||||||||||||||||||||||||||||||||||||||||||||||||||||||||||||
m231-1     MSKRKSINRPYQKPAELPPLQNNPPFYRKNRRLNFFIAADGGCASPQKCRARGFQTAFAV
                    10        20        30        40        50        60

                    70        80        90       100       110       120
a231-1.pep QSRAVSLPNAQPFAHGIHPILIAPAAPACPAVRPRRRLRIFSFPQSFAFPFRLNLSVIIG
           |||||||||||||||||||||||||||||| |||||||||||||||||||||||||||||
m231-1     QSRAVSLPNAQPFAHGIHPILIAPAAPACSAVRPRRRLRIFSFPQSFAFPFRLNLSVIIG
                    70        80        90       100       110       120

                   130       140       150       160       170       180
a231-1.pep KIRLILLFFSITFIMPRRPVLHLHQVQIGFADRNLRHFALVAVGVEHADADFPAFRRRAQ
           |||||||||||||||||||||||||||||||||||||||||||||:||| ||||||||||
m231-1     KIRLILLFFSITFIMPRRPVLHLHQVQIGFADRNLRHFALVAVGIEHAHADFPAFRRRAQ
                   130       140       150       160       170       180

                   190       200       210       220       230       240
a231-1.pep VVARTRAVSLFHLRRVDIRHPDFVFRAVAVDNVKGVAVIDFGHRACVAVAGFRRCSAAGG
           ||||||||||||||||||||||||||||||||||||||||||||||||||||||||||||
m231-1     VVARTRAVSLFHLRRVDIRHPDFVFRAVAVDNVKGVAVIDFGHRACVAVAGFRRCSAAGG
                   190       200       210       220       230       240

                   250       260       270       280       290       300
a231-1.pep RVGTRVPCRAEYVEYGNRRPHRLAAVPRITQRTQKRQGDGKPFHDFFNLHIFQMPMPSEH
           ||||||||||||||||||||||||||||||||||||||||||||||||||||||||||||
m231-1     RVGTRVPCRAEYVEYGNRRPHRLAAVPRITQRTQKRQGDGKPFHDFFNLHIFQMPMPSEH
                   250       260       270       280       290       300

                   310
a231-1.pep IGIGFQTASX
           ||||||||||
m231-1     IGIGFQTASX
                   310
```

The following partial DNA sequence was identified in *N. gonorrhoeae* <SEQ ID 851>:

```
g232.seq
   1 atgatgggca acagcctgat tgaatccggt acgtttgtcg ccatcctgtt

  51 tggtcagatt ttgggaacgg cggttgccgg cgcgccgcct tatattgtcg

 101 ggatactggt tttgctggtc gccgtcggag gaacggccgg cagcctgttt

 151 atgccgtccg tacccgccaa ggctgccgat acccaaatcg agtggaatat

 201 tgtccgtggt acaaaaatccc tgctgcgtga aacggtgcgg cacaatcccg

 251 tttttaccgc cattatcggc atctcgtggt tttggtttgt cggcgcggtt

 301 tataccacgc aactgccgac ctttacccaa atccatttgg gcggcaacga

 351 taatgttttt aacctgatgc ttgctttgtt ttccatcggt attgccgccg

 401 gttcggtact gtgtgccaag ttcggcaggg aacggctgat gttggcttgg

 451 gtaacggttg gtgcgttggg ttcgacggtt tgcggcctgg ttttggtgtg

 501 gctgacgcac ggacaccgtt ttgaagggct gaacggcatt ttttggtttt

 551 tatcgcaagg atgggcatac cccgtgatgg cggtgatgac gctgatcggc

 601 tttttcggcg gatttttctc cgttccgctc tatacctggc tgcaaaccgc

 651 cagcagcgag actttccgcg cccgcgccgt tgccgccaac aatatcgtta

 701 acggcatctt tatggtttcc gccgccgttt tgagcgcggt attgctgttt
```

-continued

```
751 ttgtttgaca gcatttccct gctgtatctg attgtcgcct tgggcaatat

801 tccgttggcg gtatttttga ttaagcgcga aaggcggttt ttaggcgcgg

851 cggcaatcag gaaaaaacct tga
```

This corresponds to the amino acid sequence <SEQ ID 852; ORF 232.ng>:

```
g232.pep
  1 MMGNSLIESG TFVAILFGQI LGTAVAGAPP YIVGILVLLV AVGGTAGSLF

 51 MPSVPAKAAD TQIEWNIVRG TKSLLRETVR HNPVFTAIIG ISWFWFVGAV

101 YTTQLPTFTQ IHLGGNDNVF NLMLALFSIG IAAGSVLCAK FGRERLMLAW

151 VTVGALGSTV CGLVLVWLTH GHRFEGLNGI FWFLSQGWAY PVMAVMTLIG

201 FFGGFFSVPL YTWLQTASSE TFRARAVAAN NIVNGIFMVS AAVLSAVLLF

251 LFDSISLLYL IVALGNIPLA VFLIKRERRF LGAAAIRKKP *
```

The following partial DNA sequence was identified in *N. meningitidis* <SEQ ID 853>:

```
  1 ATGATGGGCA ACAGCCTGAT TGAATCGGGT ACGTTTGTCG CCATCCTGTT

 51 CGGTCAGATT TTGGGAACGG CGGTGGCAGG TGTACCGCCT TATATTGTCG

101 GGATACTGGT TTTGCTGGTC GCCGTCGGAG GCACGGTCGG CAGCCTGTTT

151 ATGCCGTCCG TACCCGCCAA GGCTGCCGAT ACACAAATTG AGTGGAATAT

201 TGTCCGTGGC ACAAAATCCC TGCTGCGTGA AACGGTGCGG CACAAGCCCG

251 TTTTTACCGC CATTATCGGT ATTTCGTGGT TTTGGTTTGT CGGCGCGGTT

301 TATACCACGC AACTGCCGAC CTTTACCCAA ATCCATCTGG GCGGCAACGA

351 CAATGTTTTC AACCTGATGC TTGCTCTGTT TTCCATCGGT ATTGCCGCCG

401 GTTCGGTACT GTGTGCCAAG TTCAGCAkGG AACGCCTGAT GTTGGCTTGG

451 GTAACGGTTG GTGCGTTGGG TTTGACGGTT TGCGGCTTGG TTTTGGTGTG

501 GCTGACGCAC GGACACCGTT TTGAAGGGCT GAACGGCATT TTTTrGTTTT

551 TATCGCAAGG ATGGGCATAT CCCGTGATGG CGGTGATGAC GCTGATCGGC

601 TTTTTCGGCG GATTTTTCTC CGTTCCGCTC TATACCt(g)TG CAAACCGCCa

651 TAGCGAGaTT TCCGCGCCCg GCCGTTGCCG CCAACAATAT CGTTAACGGT

701 ATTTTTATGG TTTCCGCTGC CGTTTTGAGC GCGGTGTTGC TGTTTTTGTT

751 TGACAGCATT TCCTTGTTGT ATCTGATTGT CGCTTTGGGC AATATTCCGT

801 TGTCGGTATT TTTGATTAAG CGCGAAAGGC GGTTTTTAGG CGCGGCGGCA

851 ATCAGGAAAA AACCTTGA
```

This corresponds to the amino acid sequence <SEQ ID 854; ORF 232>:

```
m232.pep
  1 MMGNSLIESG TFVAILFGQI LGTAVAGVPP YIVGILVLLV AVGGTVGSLF

 51 MPSVPAKAAD TQIEWNIVRG TKSLLRETVR HKPVFTAIIG ISWFWFVGAV

101 YTTQLPTFTQ IHLGGNDNVF NLMLALFSIG IAAGSVLCAK FSXERLMLAW

151 VTVGALGLTV CGLVLVWLTH GHRFEGLNGI FXFLSQGWAY PVMAVMTLIG
```

-continued

```
201  FFGGFFSVPL YTVQTAIARF PRPAVAANNI VNGIFMVSAA VLSAVLLFLF

251  DSISLLYLIV ALGNIPLSVF LIKRERRFLG AAAIRKKP*
```

Computer analysis of this amino acid sequence gave the following results:

Homology with a Predicted ORF from *N. gonorrhoeae*

ORF 232 shows 94.1% identity over a 290 aa overlap with a predicted ORF (ORF 232.ng) from *N. gonorrhoeae*:

```
m232/g232

                   10        20        30        40        50        60
m232.pep   MMGNSLIESGTFVAILFGQILGTAVAGVPPYIVGILVLLVAVGGTVGSLFMPSVPAKAAD
           |||||||||||||||||||||||||||:|||||||||||||||||:||||||||||||||
g232       MMGNSLIESGTFVAILFGQILGTAVAGAPPYIVGILVLLVAVGGTAGSLFMPSVPAKAAD
                   10        20        30        40        50        60

                   70        80        90       100       110       120
m232.pep   TQIEWNIVRGTKSLLRETVRHKPVFTAIIGISWFWFVGAVYTTQLPTFTQIHLGGNDNVF
           ||||||||||||||||||||||:|||||||||||||||||||||||||||||||||||||
g232       TQIEWNIVRGTKSLLRETVRHNPVFTAIIGISWFWFVGAVYTTQLPTFTQIHLGGNDNVF
                   70        80        90       100       110       120

                  130       140       150       160       170       180
m232.pep   NLMLALFSIGIAAGSVLCAKFSXERLMLAWVTVGALGLTVCGLVLVWLTHGHRFEGLNGI
           |||||||||||||||||||||: |||||||||||||| ||||||||||||||||||||||
g232       NLMLALFSIGIAAGSVLCAKFGRERLMLAWVTVGALGSTVCGLVLVWLTHGHRFEGLNGI
                  130       140       150       160       170       180

                  190       200       210        220        230
m232.pep   FXFLSQGWAYPVMAVMTLIGFFGGFFSVPLYT-VQTAIARFPRP-AVAANNIVNGIFMVS
           | |||||||||||||||||||||||||||||| :||| ::  |  |||||||||||||||
g232       FWFLSQGWAYPVMAVMTLIGFFGGFFSVPLYTWLQTASSETFRARAVAANNIVNGIFMVS
                  190       200       210       220       230       240

           240       200       210        220        230
m232.pep    AAVLSAVLLFLFDSISLLYLIVALGNIPLSVFLIKRERRFLGAAAIRKKPX
            |||||||||||||||||||||||||||||:||||||||||||||||||||
g232        AAVLSAVLLFLFDSISLLYLIVALGNIPLAVFLIKRERRFLGAAAIRKKP
                    250       260       280       280       290
```

The following partial DNA sequence was identified in *N. meningitidis* <SEQ ID 855>:

```
a232.seq
   1 ATGTACGCTA AAAAAGGCGG TTTGGGACTG GTTAAAAGCC GCCGTTTCGC

  51 ACCTCTTTTC GCTACGCAGT TTCTCGGCGC GTTCAACGAC AATGTGTTCA

 101 AAACCGCGCT GTTTGTGATG ATTGGGTTTT ACGGTTTGGG GCAAAACGGC

 151 TTCCTGCCTG CCGGACAGAT GTTGAACTTG GGCGCGTTGC TGTTTATTTT

 201 GCCGTATTTC CTGTTTTCCT CGCTGTCGGG GCAGTTGGGT AACAAATTCG

 251 ACAAGGCCGT TTTGGCGCGT TGGGCCAAGG TGCTGGAAAT GATCATTATG

 301 GCGGTGGCGG CATACGGGTT TTATATCCGG TCTGCCCCGC TGCTTTTGGC

 351 GTGTCTGTTT TGCATGGGCG CGCAATCGAC GCTGTTCGGG CCGCTGAAAT

 401 ACGCCATCCT GCCCGATTAT CTCGACGACA AAGAGTTGAT GATGGGCAAC

 451 AGCCTGATTG AATCGGGTAC GTTTGTCGCC ATCCTGTTCG GTCAGATACT

 501 GGGGACTGCG GTGGCAGGTG TACCGCCTTA TATTGTCGGG ATACTGGTTT

 551 TGCTGGTCGC CGTAGGAGGC ACGGTCGGCA GCCTGTTTAT GCCGTCCGTA

 601 CCCGCCAAGG CTGCCGATAC ACAAATTGAG TGGAATATTG TCCGGGGTAC

 651 AAAATCCCTG CTGCGTGAAA CGGTGCGGCA CAAGCCCGTT TTTACCGCCA

 701 TTATCGGTAT TTCGTGGTTT TGGTTTGTCG GCGCGGTTTA TACCACGCAA

 751 CTGCCGACCT TTACCCAAAT CCATCTAGGC GGCAACGACA ATGTTTTCAA
```

-continued

```
 801 CCTGATGCTT GCCCTGTTTT CCATCGGTAT TGCCGCCGGT TCGGTACTGT

 851 GTGCCAAGTT CAGCAGGGAA CGGCTGAGGT TGGCTTGGGT AACGGTTGGT

 901 GCGTTGGGTT TGACGGTTTG CGGCTTGGTT TTGGTGTGGC TGACGCACGG

 951 ACACCGTTTT GAAGGGCTGA ACGGCATTTT TTGGTTTTTA TCGCAAGGAT

1001 GGGCATATCC CGTGATGGCG GTGATGACGC TGATCGGCTT TTTCGGCGGA

1051 TTTTTCTCCG TTCCGCTCTA TACCTGGCTG CAAACCGCCA GTAGCGAGAC

1101 TTTCCGCGCC CGCGCCGTTG CCGCCAACAA TATCGTTAAC GGTATTTTTA

1151 TGGTTTCCGC TGCCGTTTTG AGCGCGGTGT TGCTGTTTTT GTTTGACAGC

1201 ATTTCCTTGT TGTATCTGAT TGTCGCTTTG GGCAATATTC CGTTGTCGGT

1251 ATTTTTGATT AAGCGCGAAA GGCGGTTTTT AGGCGCGGCG GCAATCAGGA

1301 AAAAACCTTG A
```

This corresponds to the amino acid sequence <SEQ ID 856; ORF 232.a>:

```
a232.pep
  1  MYAKKGGLGL VKSRRFAPLF ATQFLGAFND NVFKTALFVM IGFYGLGQNG

 51  FLPAGQMLNL GALLFILPYF LFSSLSGQLG NKFDKAVLAR WAKVLEMIIM

101  AVAAYGFYIR SAPLLLACLF CMGAQSTLFG PLKYAILPDY LDDKELMMGN

151  SLIESGTFVA ILFGQILGTA VAGVPPYIVG ILVLLVAVGG TVGSLFMPSV

201  PAKAADTQIE WNIVRGTKSL LRETVRHKPV FTAIIGISWF WFVGAVYTTQ

251  LPTFTQIHLG GNDNVFNLML ALFSIGIAAG SVLCAKFSRE RLRLAWVTVG

301  ALGLTVCGLV LVWLTHGHRF EGLNGIFWFL SQGWAYPVMA VMTLIGFFGG

351  FFSVPLYTWL QTASSETFRA RAVAANNIVN GIFMVSAAVL SAVLLFLFDS

401  ISLLYLIVAL GNIPLSVFLI KRERRFLGAA AIRKKP*
```

m232/a232 95.9% identity in 290 aa overlap

```
                                                    10        20        30
m232.pep                                   MMGNSLIESGTFVAILFGQILGTAVAGVPP
              ||||||||||||||||||||||||||||||||||||||||||||||||||||||||||||
a232          ACLFCMGAQSTLFGPLKYAILPDYLDDKELMMGNSLIESGTFVAILFGQILGTAVAGVPP
                120       130       140       150       160       170

                      40        50        60        70        80        90
m232.pep      YIVGILVLLVAVGGTVGSLFMPSVPAKAADTQIEWNIVRGTKSLLRETVRHKPVFTAIIG
              ||||||||||||||||||||||||||||||||||||||||||||||||||||||||||||
a232          YIVGILVLLVAVGGTVGSLFMPSVPAKAADTQIEWNIVRGTKSLLRETVRHKPVFTAIIG
                180       190       200       210       220       230

                     100       110       120       130       140       150
m232.pep      ISWFWFVGAVYTTQLPTFTQIHLGGNDNVFNLMLALFSIGIAAGSVLCAKFSXERLMLAW
              |||||||||||||||||||||||||||||||||||||||||||||||||||| ||| |||
a232          ISWFWFVGAVYTTQLPTFTQIHLGGNDNVFNLMLALFSIGIAAGSVLCAKFSRERLRLAW
                240       250       260       270       280       290

                     160       170       180       190       200       210
m232.pep      VTVGALGLTVCGLVLVWLTHGHRFEGLNGIFXGLSQGWAYPVMAVMTLIGFFGGFFSVPL
              ||||||||||||||||||||||||||||||| ||||||||||||||||||||||||||||
a232          VTVGALGLTVCGLVLVWLTHGHRFEGLNGIFWGLSQGWAYPVMAVMTLIGFFGGFFSVPL
                300       310       320       330       340       350

                     220       230       240       250       260
m232.pep      YY-VQTAIARFPRP-AVAANNIVNGIFMVSAAVLSAVLLFLFDSISLLYLIVALGNIPLS
              || :||| : :  |  |||||||||||||||||||||||||||||||||||||||||||||
a232          YTWLQTASSETFRARAVAANNIVNGIFMVSAAVLSAVLLFLFDSISLLYLIVALGNIPLS
                360       370       380       390       400       410
```

-continued

```
           270        280       289
m232.pep VFLIKRERRFLGAAAIRKKPX
         ||||||||||||||||||||| 
a232     VFLIKRERRFLGAAAIRKKPX
           420        430
```

The following partial DNA sequence was identified in *N. gonorrhoeae* <SEQ ID 857>:

```
g233.seq
     1  atgaaacgca aaaatatcgc gctgattccc gccgccggca tcggggtgcg
    51  tttcggtgcg gacaaaccca agcaatatgt cgaaatcgga agcaaaaccg
   101  ttttagaaca tgtacttggg atttttgaac ggcatgaggc cgtcgatttg
   151  accgtcgttg tcgtctcgcc cgaagacacg tttgccgata aggttcagac
   201  ggcatttcca caggttcggg tgtggaaaaa cggtggacag acccgcgccg
   251  aaactgtccg caacggtgtg gcaaaactgt tggaaaccgg tttggcggcg
   301  gaaaccgaca atattctggt acacgatgcc gcccgctgct gcctgccgtc
   351  tgaagctctg gcgcggttga tagaacaggc gggcaacgcc gccgaaggcg
   401  ggattttggc agttcccgtt gccgatacgc tcaagcgcgc agaaagcgga
   451  caaatcagtg caactgtcga ccgttcgggg ctttggcagg cgcaaacgcc
   501  gcagcttttt caagcgggtt tgctgcaccg cgcattggct gcggaaaact
   551  tgggcggcat taccgatgaa gcgtccgccg tggaaaaact gggtgtgcgt
   601  ccgctactga tacagggcga cgcgcgcaat ttgaaactga cgcagccgca
   651  ggacgcatac atcgtcaggc tgctgctcaa tgccgtctga
```

This corresponds to the amino acid sequence <SEQ ID 858; ORF 233.ng>:

```
g233.pep
     1  MKRKNIALIP AAGIGVRFGA DKPKQYVEIG SKTVLEHVLG IFERHEAVDL
    51  TVVVVSPEDT FADKVQTAFP QVRVWKNGGQ TRAETVRNGV AKLLETGLAA
   101  ETDNILVHDA ARCCLPSEAL ARLIEQAGNA AEGGILAVPV ADTLKRAESG
   151  QISATVDRSG LWQAQTPQLF QAGLLHRALA AENLGGITDE ASAVEKLGVR
   201  PLLIQGDARN LKLTQPQDAY IVRLLLNAV*
```

The following partial DNA sequence was identified in *N. meningitidis* <SEQ ID 859>:

```
m233.seq (partial)
     1  ATGAAGCGCA AAAATATCGC GCTGATTCCC GCCGCCGGCA TCGGGGCGCG
    51  TTTCGGTGCG GACAAACCCA AGCAATATGT CGAAATCGGA AGCAAAACCG
   101  TTTTAGAACA TACGATTGGG ATTTTTGAAC GGCATGAGGC CGTCGATTTG
   151  ACCGTCGTTG TCGTCTCGCC CGAAGACACG TTTGCCGATA AGGTTCAGAC
   201  GGCATTTCCA CAGGTTCGGG TGTGGAAAAA CGGCGGACAG ACCCGCGCCG
   251  AAACCGTCCG CAACGGTGTG GCAAAACTGT TGGAAACCGG TTTGGCGGCG
   301  GAAACCGACA ATATTCTGGT ACACGATGCC GCGCGTTGCT GCCTGCCGTC
   351  TGAAGCTTTG ACGCGGTTGA TAGAACAGGC GGGCAACGCC GCCGAAGGCG
```

-continued

```
401  GGATTTTGGC AATTCCCATT GCCGATACGC TCAAGTGCGC GGACGGTGGG

451  AACATT....
```

This corresponds to the amino acid sequence <SEQ ID 860; ORF 233>:

```
m233.pep (partial)
  1  MKRKNIALIP AAGIGARFGA DKPKQYVEIG SKTVLEHTIG IFERHEAVDL

 51  TVVVVSPEDT FADKVQTAFP QVRVWKNGGQ TRAETVRNGV AKLLETGLAA

101  ETDNILVHDA ARCCLPSEAL TRLIEQAGNA AEGGILAIPI ADTLKCADGG

151  NI....
```

Computer analysis of this amino acid sequence gave the following results:

Homology with a Predicted ORF from *N. gonorrhoeae*

ORF 233 shows 93.4% identity over a 152 aa overlap with a predicted ORF (ORF 233.ng) from *N. gonorrhoeae*:

```
m233/g233

                   10        20        30        40        50        60
m233.pep  MKRKNIALIPAAGIGARFGADKPKQYVEIGSKTVLEHTIGIFERHEAVDLTVVVVSPEDT
          ||||||||||||||:|||||||||||||||||||||||::||||||||||||||||||||
g233      MKRKNIALIPAAGIGVRFGADKPKQYVEIGSKTVLEHVLGIFERHEAVDLTVVVVSPEDT
                   10        20        30        40        50        60

                   70        80        90       100       110       120
m233.pep  FADKVQTAFPQVRVWKNGGQTRAETVRNGVAKLLETGLAAETDNILVHDAARCCLPSEAL
          ||||||||||||||||||||||||||||||||||||||||||||||||||||||||||||
g233      FADKVQTAFPQVRVWKNGGQTRAETVRNGVAKLLETGLAAETDNILVHDAARCCLPSEAL
                   70        80        90       100       110       120

                  130       140       150
m233.pep  TRLIEQAGNAAEGGILAIPIADTLKCADGGNI
          :||||||||||||||||:|:||||| |::|:|
g233      ARLIEQAGNAAEGGILAVPVADTLKRAESGQISATVDRSGLWQAQTPQLFQAGLLHRALA
                  130       140       150       160       170       180
```

The following partial DNA sequence was identified in *N. meningitidis* <SEQ ID 861>:

```
a233.seq
  1  ATGAAGCGCA AAAATATCGC GCTGATTCCC GCCGCCGGCA TCGGGGCGCG

 51  TTTCGGTGCG GACAAACCCA AGCAATATGT CGAAATCGGA AGCAAAACCG

101  TTTTAGAACA TACGATTGGG ATTTTTGAAC GGCATGAGGC CGTCGATTTG

151  ACCGTCGTTG TCGTCTCGCC CGAAGACACG TTTGCCGATA AGGTTCAGAC

201  GGCATTTCCA CAGGTTCGGG TGTGGAAAAA CGGCGGACAG ACCCGCGCCG

251  AAACTGTCCG CAACGGTGTG GCAAAATTGT TGGAAACCGG TTTGGCGGCG

301  GAAACCGACA ATATTCTGGT ACACGATGCC GCGCGTTGCT GCCTGCCGTC

351  TGAAGCTTTG ACGCGGTTGA TAGAACAGGC GGGCAACGCT GCCGAAGGTG

401  GGATTTTGGC AATTCCCGTT GCCGATACGC TCAAGTGCGC GGACGGTGGG

451  AACATTAGTG CAACCGTCGA GCGGACGAGC CTTTGGCAGG CGCAAACGCC

501  GCAGCTTTTC CGCGCCGGGC TGCTGCACCG CGCATTGGCT GCGGAAAACT

551  TGGACGGCAT TACCGATGAA GCGTCCGCCG TGGAAAAATT GGGCATCCGC

601  CCTTTGCTGG TGCAGGGCGA CGCGCGCAAT TTGAAACTGA CGCAGCCGCA

651  GGACGCATAC ATCGTCAGGC TGCTGCTCGA TGCCGTCTGA
```

This corresponds to the amino acid sequence <SEQ ID 862; ORF 233.a>:

```
a233.pep
    1  MKRKNIALIP AAGIGARFGA DKPKQYVEIG SKTVLEHTIG IFERHEAVDL

   51  TVVVVSPEDT FADKVQTAFP QVRVWKNGGQ TRAETVRNGV AKLLETGLAA

  101  ETDNILVHDA ARCCLPSEAL TRLIEQAGNA AEGGILAIPV ADTLKCADGG

  151  NISATVERTS LWQAQTPQLF RAGLLHRALA AENLDGITDE ASAVEKLGIR

  201  PLLVQGDARN LKLTQPQDAY IVRLLLDAV*
```

m233/a233 99.3% identity in 152 aa overlap

```
                   10        20        30        40        50        60
m233.pep   MKRKNIALIPAAGIGARFGADKPKQYVEIGSKTVLEHTIGIFERHEAVDLTVVVVSPEDT
           ||||||||||||||||||||||||||||||||||||||||||||||||||||||||||||
a233       MKRKNIALIPAAGIGARFGADKPKQYVEIGSKTVLEHTIGIFERHEAVDLTVVVVSPEDT
                   10        20        30        40        50        60

                   70        80        90       100       110       120
m233.pep   FADKVQTAFPQVRVWKNGGQTRAETVRNGVAKLLETGLAAETDNILVHDAARCCLPSEAL
           ||||||||||||||||||||||||||||||||||||||||||||||||||||||||||||
a233       FADKVQTAFPQVRVWKNGGQTRAETVRNGVAKLLETGLAAETDNILVHDAARCCLPSEAL
                   70        80        90       100       110       120

                  130       140       150
m233.pep   TRLIEQAGNAAEGGILAIPIADTLKCADGGNI
           |||||||||||||||||||:||||||||||||
a233       TRLIEQAGNAAEGGILAIPVADTLKCADGGNISATVERTSLWQAQTPQLGRAGLLHRALA
                  130       140       150       160       170       180

a233       AENLDGITDEASAVEKLGIRPLLVQGDARNLKLTQPQDAYIVRLLLDAVX
                  190       200       210       220       230
```

The following partial DNA sequence was identified in *N. gonorrhoeae* <SEQ ID 863>:

```
g234.seq
    1  atgaaaaccg tttccgccgc catcgctttt gccgccgctg ccgtttcact

   51  gaccggctgt gcgaccgagt cctcacgcag cctcgaggtt gcaaaagtcg

  101  cctcctgcaa tacgcaatat cacggtgttc gcaccccgat ttccgtcgga

  151  acattcgaca accgctccag cttccaaaaa ggcattttct ccgacagtga

  201  agaccgtctg ggcagccagg caaaaaccat cctggtaaca cacctgcaac

  251  aaaccaaccg cttcaacgta ctgaaccgca ccaaccttag cgcattgaaa

  301  caggaatccg gcatttccgg caaagcgcag aacctgaaag gcgcagatta

  351  tgtcgttacc ggcgatgtaa ccgaattcgg acgcagagat gtcggcgatc

  401  atcagctctt cggcattttg ggtcgcggca aatcgcaaat cgcctatgca

  451  aaagtggctc tgaatatcgt caacgtcaat acttccgaaa tcgtctattc

  501  cacacagggc gcgggcgaat acgcactttc caaccgcgaa atcatcggtt

  551  tcggcggcac ttccggctac gatgcgactt tgaacggcaa agttttagac

  601  ttggcaatcc gcgaagccgt cgacaacttg gttcaggctg tcgacaacgg

  651  cgcatggcaa tccaaccgtt aa
```

This corresponds to the amino acid sequence <SEQ ID 864; ORF 234.ng>:

```
g234.pep
   1  MKTVSAAIAF AAAAVSLTGC ATESSRSLEV AKVASCNTQY HGVRTPISVG
```

-continued

```
 51  TFDNRSSFQK GIFSDSEDRL GSQAKTILVT HLQQTNRFNV LNRTNLSALK

101  QESGISGKAQ NLKGADYVVT GDVTEFGRRD VGDHQLFGIL GRGKSQIAYA

151  KVALNIVNVN TSEIVYSTQG AGEYALSNRE IIGFGGTSGY DATLNGKVLD

201  LAIREAVDNL VQAVDNGAWQ SNR*
```

The following partial DNA sequence was identified in *N. meningitidis* <SEQ ID 865>:

```
m234.seq (partial)
  1...GGCGCGGGCG AATACGCACT TTCCAACCGt GAAATCATCG GTTTCGGCGG

 51   CACTTCCGGC TACGATGCGA CTTTGAACGG CAAAGTTTTA GACTTGGCAA

101   TCCGCGAAGC .gTCAACAGC CTGGTTCAGG CTGTTGACAA CGGCGCATGG

151   CAACCCAACC GTTAA
```

This corresponds to the amino acid sequence <SEQ ID 866; ORF 234>:

```
m234.pep (partial)
  1 ..GAGEYALSNR EIIGFGGTSG YDATLNGKVL DLAIREAVNS LVQAVDNGAW

 51   QPNR*
```

Computer analysis of this amino acid sequence gave the following results:

Homology with a Predicted ORF from *N. gonorrhoeae*

ORF 234 shows 94.4% identity over a 54 aa overlap with a predicted ORF (ORF 234.ng) from *N. gonorrhoeae*:

```
m234/g234

                                                10        20        30
m234.pep                                GAGEYALSNREIIGFGGTSGYDATLNGKVL
                                        ||||||||||||||||||||||||||||||
g234          LGRGKSQIAYAKVALNIVNVNTSEIVYSTQGAGEYALSNREIIGFGGTSGYDATLNGKVL
            140       150       160       170       180       190

                    40        50
m234.pep      DLAIREAVNSLVQAVDNGAWQPNRX
              ||||||||::|||||||||||| |||
g234          DLAIREAVDNLVQAVDNGAWQSNRX
            200       210       220
```

The following partial DNA sequence was identified in *N. meningitidis* <SEQ ID 867>:

```
a234.seq (partial)
  1  AACCGCACCT ATTTGAACGC ATTAAAACAG GAATCCGGCA TTTCCGGCAA

 51  AGCGCATAAC CTGAAAGGCG CAAATTATGT CGNNACCGGC GATGTAACCG

101  AATTCGGACG CANAGATGTC GGCGATCATC AGCTCTTCGG CATTTTGGGT

151  CGCGGCAAAT CGCAAATCGC CTATGCAAAA GTGGCTCTGA ATATCGTCAA

201  CGTCAATACT TCCGAAATCG TCTATTCCGC ACAGGGCGCG GGCGAATACG

251  CACTTTCCAA CCGTGAAATC ATCGGTTTCG GCGGCACTTC CGGCTACGAT

301  GCGACTTTGA ACGGCAAAGT TTTAGACTTG GCAATCCGCG AAGCCGTCAA

351  CAGCCTGGTT CAGGCTGTTG ACAACGGCGC ATGGCAACCC AACCGTTAA
```

This corresponds to the amino acid sequence <SEQ ID 868; ORF 234.a>:

```
a234.pep (partial)
    1  NRTYLNALKQ ESGISGKAHN LKGANYVXTG DVTEFGRXDV GDHQLFGILG

   51  RGKSQIAYAK VALNIVNVNT SEIVYSAQGA GEYALSNREI IGFGGTSGYD

  101  ATLNGKVLDL AIREAVNSLV QAVDNGAWQP NR*
```

m234/a234 100.0% identity in 54 aa overlap

```
                                             10        20        30
m234.pep                            GAGEYALSNREIIGFGGTSGYDATLNGKVL
                                    ||||||||||||||||||||||||||||||
a234      LGRGKSQIAYAKVALNIVNVNTSEIVYSAQGAGEYALSNREIIGFGGTSGYDATLNGKVL
          50        60        70        80        90       100

                   40        50
m234.pep   DLAIREAVNSLVQAVDNGAWQPNRX
           |||||||||||||||||||||||||
a234       DLAIREAVNSLVQAVDNGAWQPNRX
          110       120       130
```

The following partial DNA sequence was identified in *N. gonorrhoeae* <SEQ ID 869>:

```
g235.seq
   1 atgaaacctt tgattttagg gcttgccgcc gtgttggctc tgtctgcctg

  51 ccaagttcga aaagctcccg acctcgacta cacgtcattc aaagaaagca

 101 aaccggcttc aattttggtg gttccgccgc tgaacgagtc gcctgatgtc

 151 aacggcactt gggggatgct ggcttcgacc gccgcgccga tttccgaagc

 201 cggctattac gtctttcccg ccgcagtcgt ggaggaaacc ttcaaagaaa

 251 acggcttgac caatgccgcc gatattcacg ccgtccggcc ggaaaaactg

 301 catcaaattt tcggcaatga tgcggttttg tacattacgg ttaccgaata

 351 cggcacttca tatcaaattt tagacagcgt gacgaccgta tccgccaaag

 401 cacggctggt cgattcccgc aacgggaaag agttgtggtc gggttcggcc

 451 agcatccgcg aaggcagcaa caacagcaac agcggcctgt tgggggcttt

 501 ggtcggcgca gtggtcaatc agattgccaa cagcctgacc gaccgcggtt

 551 atcaggtttc caaaaccgcc gcatacaacc tactgtcgcc ctattcccgc

 601 aacggtatct tgaaaggtcc gagattcgtc gaagagcagc ccaaataa
```

This corresponds to the amino acid sequence <SEQ ID 870; ORF 235.ng>:

g235.pep

1 <u>MKPLILGLAA VLALS</u>ACQVR KAPDLDYTSF KESKPASILV VPPLNESPDV

51 NGTWGMLAST AAPISEAGYY VFPAAVVEET FKENGLTNAA DIHAVRPEKL

101 HQIFGNDAVL YITVTEYGTS YQILDSVTTV SAKARLVDSR NGKELWSGSA

151 SIREGSNNSN SGLLGALVGA VVNQIANSLT DRGYQVSKTA AYNLLSPYSR

201 NGILKGPRFV EEQPK*

The following partial DNA sequence was identified in *N. meningitidis* <SEQ ID 871>:

```
m235.seq
   1 ATGAAACCTT TGATTTTAGG GCTTGCCGCC GTGTTGGCGC TGTCTGCCTG

  51 CCAAGTTCAA AAAGCGCCCG ATTTCGACTA CACGTCATTC AAGGAAAGCA

 101 AACCGGCTTC AATTTTGGTG GTTCCGCCGC TGAACGAATC GCCCGATGTC

 151 AACGGAACAT GGGGTGTACT GGCTTCGACC GCCGCGCCGC TTTCCGAAGC

 201 CGGCTATTAC GTCTTCCCCG CCGCAGTCGT GGAGGAAACC TTCAAACAAA

 251 ACGGCTTGAC CAATGCCGCC GATATTCACG CCGTCCGGCC GGAAAAACTG

 301 CATCAGATTT TCGGCAATGA TGCGGTTTTG TACATTACGG TTACCGAATA

 351 CGGCACTTCA TATCAAATTT TAGACAGCGT GACGACCGTA TCCGCCAAAG

 401 CACGGCTGGT CGATTCCCGC AACGGAAAAG AGTTGTGGTC GGGTTCGGCC

 451 AGCATCCGCG AAGGCAGCAA CAACAGCAAC AGCGGCCTGT TGGGGGCTTT

 501 GGTCAGCGCA GTGGTCAATC AGATTGCCAA CAGCCTGACC GACCGCGGTT

 551 ATCAGGTTTC CAAAACCGCC GCATACAACC TGCTGTCGCC CTATTCTCAC

 601 AACGGCATCT TGAAAGGTCC GAGATTCGTT GAAGAGCAGC CCAAATAA
```

This corresponds to the amino acid sequence <SEQ ID 872; ORF 235>:

```
m235.pep
   1 MKPLILGLAA VLALSACQVQ KAPDFDYTSF KESKPASILV VPPLNESPDV

  51 NGTWGVLAST AAPLSEAGYY VFPAAVVEET FKQNGLTNAA DIHAVRPEKL

 101 HQIFGNDAVL YITVTEYGTS YQILDSVTTV SAKARLVDSR NGKELWSGSA

 151 SIREGSNNSN SGLLGALVSA VVNQIANSLT DRGYQVSKTA AYNLLSPYSH

 201 NGILKGPRFV EEQPK*
```

Computer analysis of this amino acid sequence gave the following results:

Homology with a Predicted ORF from *N. gonorrhoeae*

ORF 235 shows 96.7% identity over a 215 aa overlap with a predicted ORF (ORF 235.ng) from *N. gonorrhoeae*:

```
m235/g235

                    10        20        30        40        50        60
m235.pep    MKPLILGLAAVLALSACQVQKAPDFDYTSFKESKPASILVVPPLNESPDVNGTWGVLAST
            |||||||||||||||||||:||||:|||||||||||||||||||||||||||||||:||||
g235        MKPLILGLAAVLALSACQVRKAPDLDYTSFKESKPASILVVPPLNESPDVNGTWGMLAST

                    70        80        90       100       110       120
m235.pep    AAPLSEAGYYVFPAAVVEETFKQNGLTNAADIHAVRPEKLHQIFGNDAVLYITVTEYGTS
            |||:|||||||||||||||||||:||||||||||||||||||||||||||||||||||||||
g235        AAPISEAGYYVFPAAVVEETFKENGLTNAADIHAVRPEKLHQIFGNDAVLYITVTEYGTS
                    70        80        90       100       110       120

                   130       140       150       160       170       180
m235.pep    YQILDSVTTVSAKARLVDSRNGKELWSGSASIREGSNNSNSGLLGALVSAVVNQIANSLT
            ||||||||||||||||||||:||||||||||||||||||||||||||||:|||||||||||
g235        YQILDSVTTVSAKARLVDSRNGKELWSGSASIREGSNNSNSGLLGALVGAVVNQIANSLT
                   130       140       150       160       170       180

                   190       200       210
m235.pep    DRGYQVSKTAAYNLLSPYSHNGILKGPRFVEEQPKX
            ||||||||||||||||||:||||||||||||||||||
g235        DRGYQVSKTAAYNLLSPYSRNGILKGPRFVEEQPKX
                   190       200       210
```

The following partial DNA sequence was identified in *N. meningitidis* <SEQ ID 873>:

```
a235.seq
   1 ATGAAACCTT TGATTTTAGG GCTTGCCGCC GTGTTGGCGC TGTCTGCCTG

  51 CCAAGTTCAA AAAGCGCCCG ATTTCGACTA CACGTCATTC AAGGAAAGCA

 101 AACCGGCTTC AATTTTGGTG GTTCCGCCGC TGAACGAATC GCCCGATGTC

 151 AACGGAACAT GGGGTGTACT GGCTTCGACC GCCGCGCCGC TTTCCGAAGC

 201 CGGCTATTAC GTCTTCCCCG CCGCAGTCGT GGAGGAAACC TTCAAACAAA

 251 ACGGCTTGAC CAATGCCGCC GATATTCACG CCGTCCGGCC GGAAAAACTG

 301 CATCAGATTT TCGGCAATGA TGCGGTTTTG TACATTACGG TTACCGAATA

 351 CGGCACTTCA TATCAAATTT TAGACAGCGT GACGACCGTA TCCGCCAAAG

 401 CACGGCTGGT CGATTCCCGC AACGGAAAAG AGTTGTGGTC GGGTTCGGCC

 451 AGCATCCGCG AAGGCAGCAA CAACAGCAAC AGCGGCCTGT TGGGGGCTTT

 501 GGTCAGCGCA GTGGTCAATC AGATTGCCAA CAGCCTGACC GACCGCGGTT

 551 ATCAGGTTTC TAAAACCGCC GCATACAACC TGCTGTCGCC CTATTCTCAC

 601 AACGGCATCT TGAAAGGTCC GAGATTCGTC GAAGAGCAGC CCAAATAA
```

This corresponds to the amino acid sequence <SEQ ID 874; ORF 235.a>:

```
a235.pep.
   1 MKPLILGLAA VLALSACQVQ KAPDFDYTSF KESKPASILV VPPLNESPDV

  51 NGTWGVLAST AAPLSEAGYY VFPAAVVEET FKQNGLTNAA DIHAVRPEKL

 101 HQIFGNDAVL YITVTEYGTS YQILDSVTTV SAKARLVDSR NGKELWSGSA

 151 SIREGSNNSN SGLLGALVSA VVNQIANSLT DRGYQVSKTA AYNLLSPYSH

 201 NGILKGPRFV EEQPK*
```

m235/a235 100.0% identity in 215 aa overlap

```
                    10        20        30        40        50        60
m235.pep    MKPLILGLAAVLALSACQVQKAPDFDYTSFKESKPASILVVPPLNESPDVNGTWGVLAST
            ||||||||||||||||||||||||||||||||||||||||||||||||||||||||||||
a235        MKPLILGLAAVLALSACQVQKAPDFDYTSFKESKPASILVVPPLNESPDVNGTWGVLAST
                    10        20        30        40        50        60
                    70        80        90       100       110       120
m235.pep    AAPLSEAGYYVFPAAVVEETFKQNGLTNAADIHAVRPEKLHQIFGNDAVLYITVTEYGTS
            ||||||||||||||||||||||||||||||||||||||||||||||||||||||||||||
a235        AAPLSEAGYYVFPAAVVEETFKQNGLTNAADIHAVRPEKLHQIFGNDAVLYITVTEYGTS
                    70        80        90       100       110       120
                   130       140       150       160       170       180
m235.pep    YQILDSVTTVSAKARLVDSRNGKELWSGSASIREGSNNSNSGLLGALVSAVVNQIANSLT
            ||||||||||||||||||||||||||||||||||||||||||||||||||||||||||||
a235        YQILDSVTTVSAKARLVDSRNGKELWSGSASIREGSNNSNSGLLGALVSAVVNQIANSLT
                   130       140       150       160       170       180
                   190       200       210
m235.pep    DRGYQVSKTAAYNLLSPYSHNGILKGPRFVEEQPKX
            ||||||||||||||||||||||||||||||||||||
a235        DRGYQVSKTAAYNLLSPYSHNGILKGPRFVEEQPKX
                   190       200       210
```

The following partial DNA sequence was identified in *N. gonorrhoeae* <SEQ ID 875>:

```
g236.seq
  1  ATGGCGCGTT TCGCCTTCTC CGCCGACATT CTCCGCACAG CGTTTGCAGA
```

-continued

51 CGGTTTCATA ACCTGCAACC GCGCCCACAT CGCGGGTGTA ATGCCAGCAG

101 CGTTCGCATT TTTCGCCGTC GCTGGCTTTG GCGGCAACGG CAAGTTCATC

151 ACCGACTTTC ACTTCTGCTT TAGACACCAG CAGGGCAAAG CGCAATTCTT

201 CGCCCAAAGC ATTCAGATAG CCGGCCATTT CTTCCGGCGC GGTAATTTCG

251 GCTTCCGCCT GCAAggacga accgacagTT TTGTcggcGC GCAAAGGCTC

301 GAtagcggcg gTTACTGCTT CGCGCGCTTC GCGGATTGCC GTCCATTTTT

351 TCACCAGTTC GGCTTCGGCT TTTTCGTTGA TGGCCGGGAA CTCGTGCCAA

401 GTATGGAAGA GGACGCTGTC TTCTTCGCCG CCGCCGATGA TGTCCCACGC

451 TTCTTCGCCG GTGAAGCACA AAATCGGTGC AATCAAGAGA ACCAGGCTGC

501 GCGTGATGTG GTACAGGGCG GTTTGCGCGC TGCGGCGGGC GCGGCTGTCG

551 GCTTTGGTGG TGTAGAGGCG GTCTTTCAGG ATGTCGAGGT AGAACGCGCC

601 CAAGTCTTCC GAGCAGAAAG AAACAATGTC TTTCACGGCG AAGTGGAAGG

651 CATAGCGCGG ATAGTAACCG CCTGCCAAAC GCTCTTGCAG CCGCCGCGCC

701 AATACCAAGG CGTAGCGGTC GATTTCCACC ATATCCGCCT GTTGCACGGC

751 ATCTTCAATC GGATTAAAGT CGCTCAAATT GGCAAAcagG AAGCTCAAGG

801 TATTGCGGAT GCGGCGGTAG CTTTCGGTAA CGCGTTTGAG GATTTCTTTG

851 GAAatcgCCA ATtcgccgct gTAATCGGTG GATGCCGCCC ACAGGCGCAG

901 GATGTCCGCG CCGAATTCGT TATAGACTTC CTGCGGCGCG ACGACGTTGC

951 CGATGGATTT CGACATTTTG CGGCCGTTTT GGTCAACCAC GAAACCGTGG

1001 GTCAGCAGCT GTTTATACGG TGCGCGTCCC ATGGATGA

This corresponds to the amino acid sequence <SEQ ID 876; ORF 236.ng>:

g236.pep

1 MARFAFSADI LRTAFADGFI TCNRAHIAGV MPAAFAFFAV AGFGGNGKFI

51 TDFHFCFRHQ QGKAQFFAQS IQIAGHFFRR GNFGFRLQGR TDSFVGAQRL

101 DSGGYCFARF ADCRPFFHQF GFGFFVDGRE LVPSMEEDAV FFAAADDVPR

151 FFAGEAQNRC NQENQAARDV VQGGLRAAAG AAVGFGGVEA VFQDVEVERA

201 QVFRAERNNV FHGEVEGIAR IVTACQTLLQ PPRQYQGVAV DFHHIRLLHG

251 IFNRIKVAQI GKQEAQGIAD AAVAFGNAFE DFFGNRQFAA VIGGCRPQAQ

301 DVRAEFVIDF LRRDDVADGF RHFAAVLVNH ETVGQQLFIR CASHG*

The following partial DNA sequence was identified in *N. meningitidis* <SEQ ID 877>:

m236.seq (partial)

1 ..TTGCACGGAC GAACCGACGG TTTTGTCGGC GCGCAAAGGC TCGATGGCGG

51 CGGTTACCGC TTCGCGGGCT TCGCGGATTG CCGTCCATTT TTTCACCAGT

101 TCGGCTTCGG TTTTTTCGTT GATGGTCGGG AACTCGTGCC AAGTATGGAA

151 GAGGACGCTG TCkTCTTCGC CGCCGCCGwT GAyGTCCCAC GCTTCTTCGC

201 CGGTGAAGCA CAAAATCGGT GCAATCAAGA GAACCAAACT GCGTGTGATG

251 TGATACAGGG CAGTTTGTGC GCTGCGGCGT GCATGGCTGT CTGCTTTGGT

301 GGTGTAGAGG CGGTCTTTCA GGATGTCGAG GTAGAACGCA CCCAAGTCTT

-continued

351 CCGAGCAGAA AGAAACArTG TCTTTTACGG CAAAGTGGaA kGCATAACGC

401 GGATAGTAAT CGCCTGCCAG ACACTCTTGC AGCTGACGTG CCAATACCAC

451 GGCGTAGCGG TCGATTTCCA CCATATCCGC CTGTTGCACG GCATCTTCAA

501 TCGGATTAAA GTCGCTCAAG TTGGCAAACA AAAAGCTCAA GGTATTGCGG

551 ATACGGCGGT AgCTTTCGGT TACGCGTTTG AGGATTTCTT TGGAAATCGC

601 CAATTCGCCG CTGTAATCGG TAGATGCCGC CCACAGGCGC AGGATGTCTG

651 CGCCGAATTC GTTATAAACC TCTTGCGGTG CAACGACGTT GCCGATGGAT

701 TTCGACATTT TTTTGCCTTC GCCGTCGACA ACGAAACCAT GGGTCAGCAG

751 CTGTTTATAC GGCGCGCGAC CCATTGA

This corresponds to the amino acid sequence <SEQ ID 878; ORF 236>:

m236.pep (partial)

1 ..LHGRTDGFVG AQRLDGGGYR FAGFADCRPF FHQFGFGFFV DGRELVPSME

51 EDAVXFAAAX DVPRFFAGEA QNRCNQENQT ACDVIQGSLC AAACMAVCFG

101 GVEAVFQDVE VERTQVFRAE RNXVFYGKVE XITRIVIACQ TLLQLTCQYH

151 GVAVDFHHIR LLHGIFNRIK VAQVGKQKAQ GIADTAVAFG YAFEDFFGNR

201 QFAAVIGRCR PQAQDVCAEF VINLLRCNDV ADGFRHFFAF AVDNETMGQQ

251 LFIRRATH*

Computer analysis of this amino acid sequence gave the following results:

Homology with a Predicted ORF from *N. gonorrhoeae*

ORF 236 shows 82.9% identity over a 258 aa overlap with a predicted ORF (ORF 236.ng) from *N. gonorrhoeae*:

```
m236/g236

                                                    10        20        30
m236.pep                                    LHGRTDGFVGAQRLDGGGYRFAGFADCRPF
                                            |:||||:||||||||:||| || |||||||
g236          FRHQQGKAQFFAQSIQIAGHFFRRGNFGFRLQGRTDSFVGAQRLDSGGYCFARFADCRPF
                60        70        80        90       100       110

                      40        50        60        70        80        90
m236.pep      FHQFGFGFFVDGRELVPSMEEDAVXFAAAXDVPRFFAGEAQNRCNQENQTACDVIQGSLC
              |||||||||||||||||||||||| |||| |||||||||||||||||||:| ||:||:| 
g236          FHQFGFGFFVDGRELVPSMEEDAVFFAAADDVPRFFAGEAQNRCNQENQAARDVVQGGLR
               120       130       140       150       160       170

                     100       110       120       130       140       150
m236.pep      AAACMAVCFGGVEAVFQDVEVERTQVFRAERNXVFYGKVEXITRIVIACQTLLQLTCQYH
              |||  || |||||||||||||||:|||||||| ||:|:|| |:||| |||||||   ||:
g236          AAAGAAVGFGGVEAVFQDVEVERAQVFRAERNNVFHGEVEGIARIVTACQTLLQPPRQYQ
               180       190       200       210       220       230

                     160       170       180       190       200       210
m236.pep      GVAVDFHHIRLLHGIFNRIKVAQVGKQKAQGIADTAVAFGYAFEDFFGNRQFAAVIGRCR
              |||||||||||||||||||||||:|||:||||||:||||| |||||||||||||||| ||
g236          GVAVDFHHIRLLHGIFNRIKVAQIGKQEAQGIADAAVAFGNAFEDFFGNRQFAAVIGGCR
               240       250       260       270       280       290

                     220       230       240       250      259
m236.pep      PQAQDVCAEFVINLLRCNDVADGFRHFFAFAVDNETMGQQLFIRRATHX
              |||||| |||||::|| :||||||||| |  |::||:||||||| |:| 
g236          PQAQDVRAEFVIDFLRRDDVADGFRHFAAVLVNHETVGQQLFIRCASHG
               300       310       320       330       340
```

The following partial DNA sequence was identified in *N. meningitidis* <SEQ ID 879>:

```
a236.seq
   1 ATGGCGCGTT TCGCCTTCTC CGCCGACATT CTCTGCACAG CGTTTGCAGA

  51 CGGTTTCATG GCCTGCAACC GCGCCCACAT CGCGGGTGTA GTGCCAGCAG

 101 CGTTCGCATT TTTCACCATC ACTGGCTTTA GCGGCAACGG CAAGTTCGCT

 151 GCCTACTTTC ACTTCTGCTT TAGACACCAG CAAAGCAAAG CGCAATTCTT

 201 CGCCCAAAGC ATTCAGATAG CCGGCCATTT CTTCCGGCGC GGTAATTTCG

 251 GCTTCGGCTT GCAAGGACGA ACCGACGGTT TTGTCGGCGC GCAAAGGCTC

 301 GATGGCGGCG GTTACCGCTT CGCGGGCTTC GCGGATTGCC GTCCATTTTT

 351 TCACCAGTTC GGCTTCGGCT TTTTCGTTGA TGGTCGGGAA CTCGTGCCAA

 401 GTATGGAAAA GCACGCTGTC TTCTGCGCCG CCGCCGATGA TGTCCCACGC

 451 TTCTTCGCCG GTGAAGCACA AAATCGGTGC AATCAAGAGA ACCAGGCTGC

 501 GCGTGATGTG GTACAGGGCG GTTTGCGCGC TGCGGCGGGC GCGGCTGTCG

 551 GCTTTGGTGG TATAGAGGCG GTCTTTCAGG ATATCGAGGT AGAACGCGCC

 601 CAAGTCTTCC GAGCAGAAAG AAACCATTTC TTTCACGGCA AAGTGGAAGG

 651 CATAACGCGG ATAAAAATCA CCGGCAACGC GTTCTTGCAG CCGCCTTGCC

 701 AACACCAAGG CATAGCGGTC GATTTCCACC ATATCCGCCT GTTGCACGGC

 751 ATCTTCAATA GGATTGAAGT CGCTCAAGTT GGCAAACAAA AAGCTCAAGG

 801 TATTGCGGAT ACGGCGGTAG CTTTCGGTTA CGCGCTTGAG GATTTCTTTG

 851 GAAATCGCCA ATTCGCCGCT GTAATCGGTG GATGCCGCCC ACAGGCGCAG

 901 GATGTCCGCG CCGAACTCGT TATACACTTC TTGCGGCGCG ACGACGTTGC

 951 CGATGGATTT CGACATTTTG CGCCCGTTTT GATCCACCAC GAAACCATGG

1001 GTCAGCAGCT GTTTGTACGG CGCGCGACCC ATTGA
```

This corresponds to the amino acid sequence <SEQ ID 880; ORF 236.a>:

```
a236.pep
   1 MARFAFSADI LCTAFADGFM ACNRAHIAGV VPAAFAFFTI TGFSGNGKFA

  51 AYFHFCFRHQ QSKAQFFAQS IQIAGHFFRR GNFGFGLQGR TDGFVGAQRL

 101 DGGGYRFAGF ADCRPFFHQF GFGFFVDGRE LVPSMEKHAV FCAAADDVPR

 151 FFAGEAQNRC NQENQAARDV VQGGLRAAAG AAVGFGGIEA VFQDIEVERA

 201 QVFRAERNHF FHGKVEGITR IKITGNAFLQ PPCQHQGIAV DFHHIRLLHG

 251 IFNRIEVAQV GKQKAQGIAD TAVAFGYALE DFFGNRQFAA VIGGCRPQAQ

 301 DVRAELVIHF LRRDDVADGF RHFAPVLIHH ETMGQQLFVR RATH*
```

m236/a236 81.0% identity in 258 aa overlap

```
                                                      10        20        30
m236.pep                                      LHGRTDGFVGAQRLDGGGYRFAGFADCRPF
                                              |:||||||||||||||||||||||||||||
a236            FRHQQSKAQFFAQSIQIAGHFFRRGNFGFGLQGRTDGFVGAQRLDGGGYRFAGFADCRPF
                  60        70        80        90       100       110

                        40        50        60        70        80        90
m236.pep        FHQFGFGFFVDGRELVPSMEEDAVXFAAAXDVPRFFAGEAQNRCNQENQTACDVIQGSLC
                |||||||||||||||||||| : ||  ||| |||||||||||||||||||:| ||:||:| 
a236            FHQFGFGFFVDGRELVPSMEKHAVFCAAADDVPRFFAGEAQNRCNQENQAARDVVQGGLR
                120       130       140       150       160       170
```

-continued

```
                  100       110       120       130       140       150
m236.pep   AAACMAVCFGGVEAVFQDVEVERTQVFRAERNXVFYGKVEXITRIVIACQTLLQLTCQYH
           |||  || |||:||||||:||||:||||||||  |:|||| |||| |: :::||  ||::
a236       AAAGAAVGFGGIEAVFQDIEVERAQVFRAERNHFFHGKVEGITRIKITGNAFLQPPCQHQ
              180       190       200       210       220       230

                  160       170       180       190       200       210
m236.pep   GVAVDFHHIRLLHGIFNRIKVAQVGKQKAQGIADTAVAFGYAFEDFFGNRQFAAVIGRCR
           |:|||||||||||||||||:||||||||||||||||||||||:|||||||||||||| ||
a236       GIAVDFHHIRLLHGIFNRIEVAQVGKQKAQGIADTAVAFGYALEDFFGNRQFAAVIGGCR
              240       250       260       270       280       290

                  220       230       240       250       259
m236.pep   PQAQDVCAEFVINLLRCNDVADGFRHFFAFAVDNETMGQQLFIRRATHX
           |||||| ||:||::|| :|||||||||    : :||||||||:||||||
a236       PQAQDVRAELVIHFLRRDDVADGFRHFAPVLIHHETMGQQLFVRRATHX
              300       310       320       330       340
```

15

The following partial DNA sequence was identified in *N. gonorrhoeae* <SEQ ID 881>:

```
g237.seq
   1 atgcgggaca aggttggcgg taatatcgca ctccccgccc cacgaatatt

  51 cgattctaac atcggcaagc tgcggaaaaa ctttaagcat atcttggcgg

 101 acaagctcgg tcatacgcgc aggattgtcg ataaattcgt tatccttacc

 151 gccgaaaagc agcctgccgt ccgcgctgag gcggtaataa tccaaaatat

 201 ggcggttgtc gcatactgcc atattgttgc ggataagccc ttttgtgcgc

 251 gcgcccaagg gttcggtggc aataataaag gtgctgacgg caatcgcctt

 301 gcgttccaaa ggccggaata tcgggttcaa accgacataa gtattgacgg

 351 catagaccac atttttacac tcgacgctgc cttcgggcgt gtaaaccagc

 401 caaccgtttt gatacggttc gatgcgcgtc atcggggatt gctcgaaaat

 451 ctgcgcgccg gcttcggcag cggcgctggc aacacccaac gtgtaattga

 501 gcggatgaag atgcccggac aagggatcga actgtgcgcc ttggtacata

 551 tcgctgtcaa gctgctgttt caactcggct ttatcccaaa gttgataatg

 601 actcgcaccg taatgccgtt gggcgtgttc atgccactgc tgcaactctt

 651 cccaatgctg cggacggacg gcaaccgtgg cataaccgcg ctgccaatcg

 701 caatcgatgg catgtttgcg gacgcgttcg tccaccagtt cgaccgcctg

 751 caaagactgt tgccaaaacc attgcgcctg ctccaagccg acctgttttt

 801 caatttcccc cataccgcag gcgtagtcgc tgataacctg cccgccactc

 851 ctgccggacg cgccgaagcc gatacgtgcg gcttccaaaa cgacggcttc

 901 atgtccgtgt tccgccagcg gcaatgcggt acacaaaccg ctcaaaccgc

 951 cgccgataat gcaggtttcg gctttcagac ggcattggag tttcggataa

1001 acagtatgcg gattaaccga actaaaataa taagaaggca gatattcttg

1051 aaaatcaggg cgaatcattg tgtttgcttt atcgggtata ttttcggacg

1101 gaatgataca gactgtcggg ccatatcgtc caaacagaaa atcggttga
```

This corresponds to the amino acid sequence <SEQ ID 882; ORF 237.ng>:

```
g237.pep
  1 MRDKVGGNIA LPAPRIFDSN IGKLRKNFKH ILADKLGHTR RIVDKFVILT

 51 AEKQPAVRAE AVIIQNMAVV AYCHIVADKP FCARAQGFGG NNKGADGNRL

101 AFQRPEYRVQ TDISIDGIDH IFTLDAAFGR VNQPTVLIRF DARHRGLLEN
```

-continued

```
151 LRAGFGSGAG NTQRVIERMK MPGQGIELCA LVHIAVKLLF QLGFIPKLIM

201 TRTVMPLGVF MPLLQLFPML RTDGNRGITA LPIAIDGMFA DAFVHQFDRL

251 QRLLPKPLRL LQADLFFNFP HTAGVVADNL PATPAGRAEA DTCGFQNDGF

301 MSVFRQRQCG TQTAQTAADN AGFGFQTALE FRINSMRINR TKIIRRQIFL

351 KIRANHCVCF IGYIFGRNDT DCRAISSKQK IG*
```

The following partial DNA sequence was identified in *N. meningitidis* <SEQ ID 883>:

```
m237.seq
   1 ATGCGGGACA AGGTTGGCGG TAATGTCGCA CTCCCCGCCC CACGAATATT

  51 CGATTTTGAC ATCGGCAAGC TGCGGAAAAA CTTTAAGCAT ATCTTGGCGG

 101 ACAAGCTCGG TCATaCGCTC AGGATTGTCG ATAAACTCGT TATCCTTACC

 151 GCCGAAAAGC AGTCTGCCGT CCGCGCTGAG GCGGTAATAA TCCAAAATAT

 201 GGCGGTTGTC GCATACTGCC ATATTGTTAC GGATAAGCCC TTTTGCGCGC

 251 GCCCCCAAGG GTTCGGTCGC AATAATAAAG GTGCTGACAG CAATCGCCTT

 301 GCGTTCCAAA GGCCGGAATA TCGGGTTCAA ACCTGCATAA GTATTGACAG

 351 CATAGACCAC ATTTTTGCAC TCGACGCTGC CTTCGGGCGT GTAAACCAGC

 401 CAACCGTTTT GATGCGGTTC GATGCACGTC ATCGGGGATT GCTCGAAAAT

 451 CTGCGCACCG GCTTCGGCAG CGGCACGAGC GATGCCCAAA GTGTAAGTGA

 501 GCGGATGCAG GTGTCCGGAT AAGGGGTCGA ATTGTGCCCC TTGGTACATA

 551 TCGCTGTCAA GCTGCTGTTT CAACTCGGCT TTATCCCAAA GTTGATAATG

 601 ACTCGCACCG TAATGCCGTT GGGCGTGTTC ATGCCACTGC TGCAACTCTT

 651 CCCAATGCTG CGGACGGACG GCAACCGTGG CATAACCGCG CTGCCAATCA

 701 CAATCGACGG CATGTTTGCG GACGCGTTCG TCCACCAGTT CGACCGCCTG

 751 CAAAGACTGT TGCCAAAACC ATTGCGCCTG CTCCAAGCCG ACCTGTTTTT

 801 CAATTTCCCC CATACCGCAG nCGTAATCGC TGATAACCTG CCCGCCACTC

 851 CGTCCCGACG CGCCGAAACC GATACGCGCG GCTTCCAACA CAACCGTTTC

 901 ATGTCCCTGC TCCGCCAAGG GCAATGCAGT GCACAAACCA CCCAATCCGC

 951 CGCCGATGAT ACAGGTATCG GTTTTCAGAC GGCATTGAAG TTtCGGATAA

1001 ACAGTATGAG GATTAACCGA ACTGAAATAA TAAGAAGGCA GATATTCTTG

1051 AAAATCAGGG CGAATCATTG TGTTTGCTTT ATCAGGTGTA TTTTCGGACG

1101 GAATGATACA GGCTGTCGGG CCATATCGTC CAwACAGAAA ATCGGTTGA
```

This corresponds to the amino acid sequence <SEQ ID 884; ORF 237>:

```
m237.pep
  1  MRDKVGGNVA LPAPRIFDFD IGKLRKNFKH ILADKLGHTL RIVDKLVILT

 51  AEKQSAVRAE AVIIQNMAVV AYCHIVTDKP FCARPQGFGR NNKGADSNRL

101  AFQRPEYRVQ TCISIDSIDH IFALDAAFGR VNQPTVLMRF DARHRGLLEN

151  LRTGFGSGTS DAQSVSERMQ VSGXGVELCP LVHIAVKLLF QLGFIPKLIM

201  TRTVMPLGVF MPLLOLFPML RTDGNRGITA LPITIDGMFA DAFVHQFDRL

251  QRLLPKPLRL LQADLFFNFP HTAXVIADNL PATPSRRAET DTRGFQHNRF
```

-continued

```
301  MSLLRQGQCS AQTTQSAADD TGIGFQTALK FRINSMRINR TEIIRRQIFL

351  KIRANHCVCF IRCIFGRNDT GCRAISSXQK IG*
```

Computer analysis of this amino acid sequence gave the following results:

Homology with a Predicted ORF from *N. gonorrhoeae*

ORF 237 shows 86.1% identity over a 382 aa overlap with a predicted ORF (ORF 237.ng) from *N. gonorrhoeae*:

```
m237/g237

                  10        20        30        40        50        60
m237.pep MRDKVGGNVALPAPRIFDFDIGKLRKNFKHILADKLGHTLRIVDKLVILTAEKQSAVRAE
         ||||||||:||||||||| :||||||||||||||||||| |||||:|||||||| |||||
g237     MRDKVGGNIALPAPRIFDSNIGKLRKNFKHILADKLGHTRRIVDKFVILTAEKQPAVRAE
                  10        20        30        40        50        60

                  70        80        90       100       110       120
m237.pep AVIIQNMAVVAYCHIVTDKPFCARPQGFGRNNKGADSNRLAFQRPEYRVQTCISIDSIDH
         ||||||||||||||||:||||||| |||| ||||||:|||||||||||||| ||||:|||
g237     AVIIQNMAVVAYCHIVADKPFCARAQGFGGNNKGADGNRLAFQRPEYRVQTDISIDGIDH
                  70        80        90       100       110       120

                 130       140       150       160       170       180
m237.pep IFALDAAFGRVNQPTVLMRFDARHRGLLENLRTGFGSGTSDAQSVSERMQVSGXGVELCP
         ||:||||||||||||||:||||||||||||||:|||||::::| | |||:: | |:||| 
g237     IFTLDAAFGRVNQPTVLIRFDARHRGLLENLRAGFGSGAGNTQRVIERMKMPGQGIELCA
                 130       140       150       160       170       180

                 190       200       210       220       230       240
m237.pep LVHIAVKLLFQLGFIPKLIMTRTVMPLGVFMPLLQLFPMLRTDGNRGITALPITIDGMFA
         |||||||||||||||||||||||||||||||||||||||||||||||||||||:||||||
g237     LVHIAVKLLFQLGFIPKLIMTRTVMPLGVFMPLLQLFPMLRTDGNRGITALPIAIDGMFA
                 190       200       210       220       230       240

                 250       260       270       280       290       300
m237.pep DAFVHQFDRLQRLLPKPLRLLQADLFFNFPHTAXVIADNLPATPSRRAETDTRGFQHNRF
         ||||||||||||||||||||||||||||||||| |:||||||||: |||:|| |||:: |
g237     DAFVHQFDRLQRLLPKPLRLLQADLFFNFPHTAGVVADNLPATPAGRAEADTCGFQNDGF
                 250       260       270       280       290       300

                 310       320       330       340       350       360
m237.pep MSLLRQGQCSAQTTQSAADDTGIGFQTALKFRINSMRINRTEIIRRQIFLKIRANHCVCF
         ||::|| ||::||:|:|||::|:||||||:|||||||||||:||||||||||||||||||
g237     MSVFRQRQCGTQTAQTAADNAGFGFQTALEFRINSMRINRTKIIRRQIFLKIRANHCVCF
                 310       320       330       340       350       360

                 370       380
m237.pep IRCIFGRNDTGCRAISSXQKIGX
         |  ||||||| |||||| |||||
g237     IGYIFGRNDTDCRAISSKQKIGX
                 370       380
```

The following partial DNA sequence was identified in *N. meningitidis* <SEQ ID 885>:

```
a237.seq
   1 ATGCGGGACA AGGTTGGCGG TAATGTCGCA CTCCCCGCCC CACGAATATT

  51 CGATTTTGAC ATCGGCAAGC TGCGGAAAAA CTTTAAGCAT ATCTTGGCGG

 101 ACAAGCTCGG TCATACGCGC GGGATTGTCG ATAAACTCGT TATCCTTACC

 151 GCCGAAAAGC AGTCTGCCGT CCGCGCTGAG GCGGTAATAA TCCAAAATAT

 201 GACGGTTGTC GCATACTGCC ATATTGTTGC GGATAAGCCC TTTTGCACGC

 251 GCGCCCAAGG GTTCTGTGGC AATAATAAAG GTGCTGACAG CAATCGCCTT

 301 GCGCTCCAAA GGCTTGAATA TCGGATTCAA ACCGGCATAA GTATTGACGG

 351 CGTACACCAG ATTTTTGCAT TCGACGCTGC CTTCGGGGGT GTAAACCAGC

 401 CAACCGTTTT GATAAGGTTC AATGCGTATC ATGGGAGAAT GCTCAAAAAT

 451 CTTCGTACCA GCTTCGGCAG CGGCGCGGGC GATGCCCAAC GTGTAATTGA

 501 GCGGATGGAG ATGCCCGGAC AAGGGATCGA ACTGTGCGCC TTGGTACATA
```

-continued

```
 551 TCGCTGTCAA GCTGCTGCTT CAGTTCAGTG TTATCCCAGA GTTGATAATG

 601 AGTTGCACCG TAATATTTTT GGGCGTGCTC ATGCCATTGT TGCAATTCTT

 651 CCCAATGCTG CGAACGGATG GCAACCGTGG CATAACCGCG CTGCCAATCG

 701 CAATCAATGG CATGTTTGCG GACGCGTTCG TCCACCAGTT CGACCGCCTG

 751 CAAAGACTGT TGCCAAAACC ATTGCGCTTG CTCCAAACCG ACCTGTTTTT

 801 CAATTTCCTC CATACCGCAG GCGTAATCGC TGATAACCTG CCCGCCACTC

 851 CGTCCCGACG CGCCGAAACC GATACGCGCG GCTTCCAACA CAACCGTTTC

 901 ATGTCCCTGC TCCGCCAAGG GCAATGCAGT GCACAAACCA CTCAATCCGC

 951 CGCCGATGAT ACAGGTATCG GTTTTCAGAC GGCATTGAAG TTTCGGATAA

1001 ACAGTATGAG GATTAACCGA ACTGAAATAA TAAGAAGGCA GATATTCTTG

1051 AAAATCAGGG CGAATCATTG TGTTTGCTTT ATCGGGTATA TTTTCGGACG

1101 GAATGATACA GGCTGTCGAG CCATATCGTC CAAACAGAAA ATCGGTTGA
```

This corresponds to the amino acid sequence <SEQ ID 886; ORF 237.a>:

```
a237.pep
  1  MRDKVGGNVA LPAPRIFDFD IGKLRKNFKH ILADKLGHTR GIVDKLVILT

 51  AEKQSAVRAE AVIIQNMTVV AYCHIVADKP FCTRAQGFCG NNKGADSNRL

101  ALQRLEYRIQ TGISIDGVHQ IFAFDAAFGG VNQPTVLIRF NAYHGRMLKN

151  LRTSFGSGAG DAQRVIERME MPGQGIELCA LVHIAVKLLL QFSVIPELIM

201  SCTVIFLGVL MPLLQFFPML RTDGNRGITA LPIAINGMFA DAFVHQFDRL

251  QRLLPKPLRL LQTDLFFNFL HTAGVIADNL PATPSRRAET DTRGFQHNRF

301  MSLLRQGQCS AQTTQSAADD TGIGFQTALK FRINSMRINR TEIIRRQIFL

351  KIRANHCVCF IGYIFGRNDT GCRAISSKQK IG*
```

m237/a237 85.6% identity in 382 aa overlap

```
                    10        20        30        40        50        60
m237.pep    MRDKVGGNVALPAPRIFDFDIGKLRKNFKHILADKLGHTLRIVDKLVILTAEKQSAVRAE
            ||||||||||||||||||||||||||||||||||||||||  ||||||||||||||||||
a237        MRDKVGGNVALPAPRIFDFDIGKLRKNFKHILADKLGHTRGIVDKLVILTAEKQSAVRAE
                    10        20        30        40        50        60

                    70        80        90       100       110       120
m237.pep    AVIIQNMAVVAYCHIVTDKPFCARPQGFGRNNKGADSNRLAFQRPEYRVQTCISIDSIDH
            |||||||:||||||||:|||||:| |||  |||||||||||:|| |||:|| ||||:: :
a237        AVIIQNMTVVAYCHIVADKPFCTRAQGFCGNNKGADSNRLALQRLEYRIQTGISIDGVHQ
                    70        80        90       100       110       120

                     130       140       150       160       170  180
m237.pep    IFALDAAFGRVNQPTVLMRFDARHRGLLENLRTGFGSGTSDAQSVSERMQVSGXGVELCP
            |||:||||| |||||||:||:| |  :|:||||:||||::||| | |||:: | |:||| 
a237        IFAFDAAFGGVNQPTVLIRFNAYHGRMLKNLRTSFGSGAGDAQRVIERMEMPGQGIELCA
                   130       140       150       160       170       180

                   190       200       210       220       230       240
m237.pep    LVHIAVKLLFQLGFIPKLIMTRTVMPLGVFMPLLQLFPMLRTDGNRGITALPITIDGMFA
            |||||||||:|:: ||:|||: ||: |||:|||||:||||||||||||||||:|:|||||
a237        LVHIAVKLLLQFSVIPELIMSCTVIFLGVLMPLLQFFPMLRTDGNRGITALPIAINGMFA
                   190       200       210       220       230       240

                   250       260       270       280       290       300
m237.pep    DAFVHQFDRLQRLLPKPLRLLQADLFFNFPHTAXVIADNLPATPSRRAETDTRGFQHNRF
            ||||||||||||||||||||||:|||||| ||| ||||||||||||||||||||||||||
a237        DAFVHQFDRLQRLLPKPLRLLQTDLFFNFLHTACVIADNLPATPSRRAETDTRCFQHNRF
                   250       260       270       280       290       300
```

-continued

```
                 310       320       330       340       350       360
m237.pep  MSLLRQGQCSAQTTQSAADDTGIGFQTALKFRINSMRINRTEIIRRQIFLKIRANHCVCF
          ||||||||||||||||||||||||||||||||||||||||||||||||||||||||||||
a237      MSLLRQGQCSAQTTQSAADDTGIGFQTALKFRINSMRINRTEIIRRQIFLKIRANHCVCF
                 310       320       330       340       350       360

                 370       380
m237.pep  IRCIFGRNDTGCRAISSXQKIGX
          |  |||||||||||||| |||||
a237      IGYIFGRNDTGCRAISSKQKIGX
                 370       380
```

The following partial DNA sequence was identified in *N. gonorrhoeae* <SEQ ID 887>:

```
g238.seq
   1 atgaatttgc ctattcaaaa attcatgatg ctgttggcag cggcaatatc

  51 gatgctgcat atccccatta gtcatgcgaa cggtttggat gcccgtttgc

 101 gcgatgatat gcaggcaaaa cactacgaac cgggtggcaa ataccatctg

 151 tttggtaatg ctcgcggcag tgttaaaaat cgggtttgcg ccgtccaaac

 201 atttgatgca actgcggtcg gccccatact gcctattaca cacgaacgga

 251 caggatttga aggtgttatc ggctatgaaa cccatttttc aggacacgga

 301 cacgaagtac acagtccgtt cgataatcat gattcaaaaa gcacttctga

 351 tttcagcggc ggcgtagacg gcggttttac cgtttaccaa cttcatcgga

 401 cagggtcgga aatacatccc gcagacggat atgacgggcc tcaaggcggc

 451 ggttatccgg aaccacaagg ggcaagggat atatacagct accatatcaa

 501 aggaacttca accaaaacaa agataaacac tgttccgcaa gcccctttt t

 551 cagaccgctg gctaaaagaa aatgccggtg ccgcttccgg ttttctcagc

 601 cgtgcggatg aagcaggaaa actgatatgg gaaaacgacc ccgataaaaa

 651 ttggcgggct aaccgtatgg atgatattcg cggcatcgtc caaggtgcgg

 701 ttaatccttt tttaacgggt tttcaagggg tagggattgg ggcaattaca

 751 gacagtgcgg taagcccggt cacagataca gccgctcagc agactctaca

 801 aggtattaat gatttaggaa atttaagtcc ggaagcacaa cttgccgccg

 851 cgagcctatt acaggacagt gcctttgcgg taaaagacgg catcaattcc

 901 gccagacaat gggctgatgc ccatccgaat ataacagcaa cagcccaaac

 951 tgcccttgcc gtagcagagg ccgcaggtac ggtttggcgc ggtaaaaaag

1001 tagaacttaa cccgaccaaa tgggattggg ttaaaaatac cggctataaa

1051 aaacctgctg cccgccatat gcagactgta gatggggaga tggcaggggg

1101 gaatagaccg cctaaatcta taacgtcgga aggaaaagct aatgctgcaa

1151 cctatcctaa gttggttaat cagctaaatg agcaaaactt aaataacatt

1201 gcggctcaag atccaagatt gagtctagct attcatgagg gtaaaaaaaa

1251 ttttccaata ggaactgcaa cttatgaaga ggcagataga ctaggtaaaa

1301 tttgggttgg tgagggtgca agacaaacta gtggaggcgg atggttaagt

1351 agagatggca ctcgacaata tcggccacca acagaaaaaa aatcacaatt

1401 tgcaactaca ggtattcaag caaattttga aacttatact attgattcaa

1451 atgaaaaaag aaataaaatt aaaaatggac atttaaatat taggtaa
```

This corresponds to the amino acid sequence <SEQ ID 888; ORF 238.ng>:

```
g238.pep
  1  MNLPIQKFMM LLAAAISMLH IPISHANGLD ARLRDDMQAK HYEPGGKYHL

 51  FGNARGSVKN RVCAVQTFDA TAVGPILPIT HERTGFEGVI GYETHFSGHG

101  HEVHSPFDNH DSKSTSDFSG GVDGGFTVYQ LHRTGSEIHP ADGYDGPQGG

151  GYPEPQGARD IYSYHIKGTS TKTKINTVPQ APFSDRWLKE NAGAASGFLS

201  RADEAGKLIW ENDPDKNWRA NRMDDIRGIV QGAVNPFLTG FQGVGIGAIT

251  DSAVSPVTDT AAQQTLQGIN DLGNLSPEAQ LAAASLLQDS AFAVKDGINS

301  ARQWADAHPN ITATAQTALA VAEAAGTVWR GKKVELNPTK WDWVKNTGYK

351  KPAARHMQTV DGEMAGGNRP PKSITSEGKA NAATYPKLVN QLNEQNLNNI

401  AAQDPRLSLA IHEGKKNFPI GTATYEEADR LGKIWVGEGA RQTSGGGWLS

451  RDGTRQYRPP TEKKSQFATT GIQANFETYT IDSNEKRNKI KNGHLNIR*
```

The following partial DNA sequence was identified in *N. meningitidis* <SEQ ID 889>:

```
m238.seq
   1 ATGAATTTGC CTATTCAAAA ATTCATGATG CTGTTTGCAG CAGCAATATC

  51 GTTGCTGCAA ATCCCCATTA GTCATGCGAA CGGTTTGGAT GCCCGTTTGC

 101 GCGATGATAT GCAGGCAAAA CAcTACGAAC CGGGTGGTAA ATACCATCTG

 151 TTTGGTAATG CTCGCGGCAG TGTTAAAAAG CGGGTTTACG CCGTCCAGAC

 201 ATTTGATGCA ACTGCGGTCA GTCCTGTACT GCCTATTACA CACGAACGGA

 251 CAGGGTTTGA AGGTGTTATC GGTTATGAAA CCCATTTTTC AGGGCACGGA

 301 CATGAAGTAC ACAGTCCGTT CGATCATCAT GATTCAAAAA GCACTTCTGA

 351 TTTCAGCGGC GGTGTAGACG GCGGTTTTAC TGTTTACCAA CTTCATCGAA

 401 CAGGGTCGGA AATCCATCCG GAGGATGGAT ATGACGGGCC GCAAGGCAGC

 451 GATTATCCGC CCCCCGGAGG AGCAAGGGAT ATATACAGCT ATTATGTCAA

 501 AGGAACTTCA ACAAAAACAA AGACTAATAT TGTCCCTCAA GCCCCATTTT

 551 CAGACCGTTG GCTAAAAGAA AATGCCGGTG CCGCCTCTGG TTTTTTCAGC

 601 CGTGCGGATG AAGCAGGAAA ACTGATATGG GAAAGCGACC CCAATAAAAA

 651 TTGGTGGGCT AACCGTATGG ATGATGTTCG CGGCATCGTC CAAGGTGCGG

 701 TTAATCCTTT TTTAATGGGT TTTCAAGGAG TAGGGATTGG GGCAATTACA

 751 GACAGTGCAG TAAGCCCGGT CACAGATACA GCCGCGCAGC AGACTCTACA

 801 AGGTATTAAT GATTTAGGAA AATTAAGTCC GGAAGCACAA CTTGCTGCCG

 851 CGAGCCTATT ACAGGACAGT GCTTTTGCGG TAAAAGACGG TATCAACTCT

 901 GCCAAACAAT GGGCTGATGC CCATCCAAAT ATAACAGCTA CTGCCCAAAC

 951 TGCCCTTTCC GCAGCAGAGG CCGCAGGTAC GGTTTGGAGA GGTAAAAAAG

1001 TAGAACTTAA CCCGACTAAA TGGGATTGGG TTAAAAATAC CGGTTATAAA

1051 AAACCTGCTG CCCGCCATAT GCAGACTTTA GATGGGGAGA TGGCAGGTGG

1101 GAATAAACCT ATTAAATCTT TACCAAACAG TGCCGCTGAA AAAAGAAAAC

1151 AAAATTTTGA GAAGTTTAAT AGTAACTGGA GTTCAGCAAG TTTTGATTCA

1201 GTGCACAAAA CACTAACTCC CAATGCACCT GGTATTTTAA GTCCTGATAA
```

-continued

```
1251 AGTTAAAACT CGATACACTA GTTTAGATGG AAAAATTACA ATTATAAAAG

1301 ATAACGAAAA CAACTATTTT AGAATCCATG ATAATTCACG AAAACAGTAT

1351 CTTGATTCAA ATGGTAATGC TGTGAAAACC GGTAATTTAC AAGGTAAGCA

1401 AGCAAAAGAT TATTTACAAC AACAAACTCA TATCAGGAAC TTAGACAAAT

1451 GA
```

This corresponds to the amino acid sequence <SEQ ID 890; ORF 238>:

```
m238.pep
  1  MNLPIQKFMM LFAAAISLLQ IPISHANGLD ARLRDDMQAK HYEPGGKYHL

 51  FGNARGSVKK RVYAVQTFDA TAVSPVLPIT HERTGFEGVI GYETHFSGHG

101  HEVHSPFDHH DSKSTSDFSG GVDGGFTVYQ LHRTGSEIHP EDGYDGPQGS

151  DYPPPGGARD IYSYYVKGTS TKTKTNIVPQ APFSDRWLKE NAGAASGFFS

201  RADEAGKLIW ESDPNKNWWA NRMDDVRGIV QGAVNPFLMG FQGVGIGAIT

251  DSAVSPVTDT AAQQTLQGIN DLGKLSPEAQ LAAASLLQDS AFAVKDGINS

301  AKQWADAHPN ITATAQTALS AAEAAGTVWR GKKVELNPTK WDWVKNTGYK

351  KPAARHMQTL DGEMAGGNKP IKSLPNSAAE KRKQNFEKFN SNWSSASFDS

401  VHKTLTPNAP GILSPDKVKT RYTSLDGKIT IIKDNENNYF RIHDNSRKQY

451  LDSNGNAVKT GNLQGKQAKD YLQQQTHIRN LDK*
```

Computer analysis of this amino acid sequence gave the following results:

Homology with a Predicted ORF from *N. gonorrhoeae*

ORF 238 shows 86.0% identity over a 401 aa overlap with a predicted ORF (ORF 238.ng) from *N. gonorrhoeae*:

```
m238/g238

                     10        20        30        40        50        60
m238.pep     MNLPIQKFMMLFAAAISLLQIPISHANGLDARLRDDMQAKHYEPGGKYHLFGNARGSVKK
             |||||||||||:|||||:|:|||||||||||||||||||||||||||||||||||||||:
g238         MNLPIQKFMMLLAAAISMLHIPISHANGLDARLRDDMQAKHYEPGGKYHLFGNARGSVKN
                     10        20        30        40        50        60

                     70        80        90       100       110       120
m238.pep     RVYAVQTFDATAVSPVLPITHERTGFEGVIGYETHFSGHGHEVHSPFDHHDSKSTSDFSG
             || ||||||||||:|:|||||||||||||||||||||||||||||||||:||||||||||
g238         RVCAVQTFDATAVGPILPITHERTGFEGVIGYETHFSGHGHEVHSPFDNHDSKSTSDFSG
                     70        80        90       100       110       120

                    130       140       150       160       170       180
m238.pep     GVDGGFTVYQLHRTGSEIHPEDGYDGPQGSDYPPPGGARDIYSYYVKGTSTKTKTNIVPQ
             |||||||||||||||||||| ||||||||: || | ||||||||::|||||||| | |||
g238         GVDGGFTVYQLHRTGSEIHPADGYDGPQGGGYPEPQGARDIYSYHIKGTSTKTKINTVPQ
                    130       140       150       160       170       180

                    190       200       210       220       230       240
m238.pep     APFSDRWLKENAGAASGFFSRADEAGKLIWESDPNKNWWANRMDDVRGIVQGAVNPFLMG
             ||||||||||||||||||:||||||||||||:||:||| ||||||:|||||||||||| |
g238         APFSDRWLKENAGAASGFLSRADEAGKLIWENDPDKNWRANRMDDIRGIVQGAVNPFLTG
                    190       200       210      2200       230       240

                    250       260       270       280       290       300
m238.pep     FQGVGIGAITDSAVSPVTDTAAQQTLQGINDLGKLSPEAQLAAASLLQDSAFAVKDGINS
             |||||||||||||||||||||||||||||||||:||||||||||||||||||||||||||
g238         FQGVGIGAITDSAVSPVTDTAAQQTLQGINDLGNLSPEAQLAAASLLQDSAFAVKDGINS
                    250       260       270       280       290       300

                    310       320       330       340       350      360
m238.pep     AKQWADAHPNITATAQTALSAAEAAGTVWRGKKVELNPTKWDWVKNTGYKKPAARHMQTL
             |:|||||||||||||||||::||||||||||||||||||||||||||||||||||||||:
g238         ARQWADAHPNITATAQTALAVAEAAGTVWRGKKVELNPTKWDWVKNTGYKKPAARHMQTV
                    310       320       330       340       350       360
```

-continued

```
                 370        380        390        400        410        420
m238.pep    DGEMAGGNKPIKSLPNSAAEKRKQNFEKFNSNWSSASFDSVHKTLTPNAPGILSPDKVKT
            ||||||||:| ||:  :| ||     :: |: :: :  :::::
g238        DGEMAGGNRPPKSI-TSEGKANAATYPKLVNQLNEQNLNNIAAQDPRLSLAIHEGKKNFP
                 370         380        390        400        410

                   430        440        450        460        470        480
m238.pep      RYTSLDGKITIIKDNENNYFRIHDNSRKQYLDSNGNAVKTGNLQGKQAKDYLQQQTHIRN

g238          IGTATYEEADRLGKIWVGEGARQTSGGGWLSRDGTRQYRPPTEKKSQFATTGIQANFETY
            420        430        440        450        460        470
```

The following partial DNA sequence was identified in *N. meningitidis* <SEQ ID 891>:

```
a238.seq (partial)
   1 ATGAATTTGC CTATTCAAAA ATTCATGATG CTGTTTGCAG CAGCAATATC

  51 GTTGCTGCAA ATCCCCATTA GTCATGCGAA CGGTTTGGAT GCCCGTTTGC

 101 GCGATGATAT GCAGGCAAAA CACTACGAAC CGGGTGGTAA ATACCATCTG

 151 TTTGGTAATG CTCGCGGCAG TGTTAAAAAT CGGGTTTACG CCGTCCAAAC

 201 ATTTGATGCA ACTGCGGTCG GCCCCATACT GCCTATTACA CACGAACGGA

 251 CAGGATTTGA AGGCATTATC GGTTATGAAA CCCATTTTTC AGGACATGGA

 301 CATGAAGTAC ACAGTCCGTT CGATAATCAT GATTCAAAAA GCACTTCTGA

 351 TTTCAGCGGC GGCGTAGACG GTGGTTTTAC CGTTTACCAA CTTCATCGGA

 401 CAGGGTCGGA AATCCATCCG GAGGATGGAT ATGACGGGCC GCAAGGCAGC

 451 GATTATCCGC CCCCCGGAGG AGCAAGGGAT ATATACAGCT ACTATGTCAA

 501 AGGAACTTCA ACAAAAACAA AGAGTAATAT TGTTCCCCGA GCCCCATTTT

 551 CAGACCGCTG GCTAAAAGAA AATGCCGGTG CCGCCTCTGG TTTTTTCAGC

 601 CGTGCTGATG AAGCAGGAAA ACTGATATGG GAAAGCGACC CCAATAAAAA

 651 TTGGTGGGCT AACCGTATGG ATGATATTCG CGGCATCGTC CAAGGTGCGG

 701 TTAATCCTTT TTTAATGGGT TTTCAAGGAG TAGGGATTGG GGCAATTACA

 751 GACAGTGCAG TAAGCCCGGT CACAGATACA GCCGCGCAGC AGACTCTACA

 801 AGGTATTAAT CATTTAGGAA ATTTAAGTCC CGAAGCACAA CTTGCGGCTG

 851 CAACCGCATT ACAAGACAGT GCTTTTGCGG TAAAAGACGG TATCAATTCC

 901 GCCAGACAAT GGGCTGATGC CCATCCGAAT ATAACTGCAA CAGCCCAAAC

 951 TGCCCTTGCC GTAGCAGAGG CCGCAACTAC GGTTTGGGGC GGTAAAAAAG

1001 TAGAACTTAA CCCGACCAAA TGGGATTGGG TTAAAAATAC CGGCTATAAA

1051 ACACCTGCTG TTCGCACCAT GCATACTTTG GATGGGGAAA TGGCCGGTGG

1101 GAATAGACCG CCTAAATCTA TAACGTCCAA CAGCAAAGCA GATGCTTCCA

1151 CACAA
```

This corresponds to the amino acid sequence <SEQ ID 892; ORF 238.a>:

```
a238.pep (partial)
  1  MNLPIQKFMM LFAAAISLLQ IPISHANGLD ARLRDDMQAK HYEPGGKYHL

 51  FGNARGSVKN RVYAVQTFDA TAVGPILPIT HERTGFEGII GYETHFSGHG

101  HEVHSPFDNH DSKSTSDFSG GVDGGFTVYQ LHRTGSEIHP EDGYDGPQGS

151  DYPPPGGARD IYSYYVKGTS TKTKSNIVPR APFSDRWLKE NAGAASGFFS
```

-continued

```
201  RADEAGKLIW ESDPNKNWWA NRMDDIRGIV QGAVNPFLMG FQGVGIGAIT

251  DSAVSPVTDT AAQQTLQGIN HLGNLSPEAQ LAAATALQDS AFAVKDGINS

301  ARQWADAHPN ITATAQTALA VAEAATTVWG GKKVELNPTK WDWVKNTGYK

351  TPAVRTMHTL DGEMAGGNRP PKSITSNSKA DASTQ
```

m238/a238 91.9% identity in 385 aa overlap

```
                   10        20        30        40        50        60
m238.pep MNLPIQKFMMLFAAAISLLQIPISHANGLDARLRDDMQAKHYEPGGKYHLFGNARGSVKK
         |||||||||||||||||||||||||||||||||||||||||||||||||||||||||||:
a238     MNLPIQKFMMLFAAAISLLQIPISHANGLDARLRDDMQAKHYEPGGKYHLFGNARGSVKN
                   10        20        30        40        50        60

                   70        80        90       100       110       120
m238.pep RVYAVQTFDATAVSPVLPITHERTGFEGVIGYETHFSGHGHEVHSPFDHHDSKSTSDFSG
         ||||||||||||:|:||||||||||||:||||||||||||||||||||:|||||||||||
a238     RVYAVQTFDATAVGPILPITHERTGFEGIIGYETHFSGHGHEVHSPFDNHDSKSTSDFSG
                   70        80        90       100       110       120

                  130       140       150       160       170       180
m238.pep GVDGGFTVYQLHRTGSEIHPEDGYDGPQGSDYPPPGGARDIYSYYVKGTSTKTKTNIVPQ
         ||||||||||||||||||||||||||||||||||||||||||||||||||||:||||:
a238     GVDGGFTVYQLHRTGSEIHPEDGYDGPQGSDYPPPGGARDIYSYYVKGTSTKTKSNIVPR
                  130       140       150       160       170       180

                  190       200       210       220       230       240
m238.pep APFSDRWLKENAGAASGFFSRADEAGKLIWESDPNYNWWANRMDDVRGIVQGAVNPFLMG
         |||||||||||||||||||||||||||||||||||||||||||||:||||||||||||||
a238     APFSDRWLKENAGAASGFFSRADEAGKLIWESDPNYNWWANRMDDIRGIVQGAVNPFLMG
                  190       200       210       220       230       240

                  250       260       270       280       290       300
m238.pep GQGVGIGAITDSAVSPVTDTAAQQTLQGINDLGKLSPEAQLAAASLLQDSAFAVKDGINS
         |||||||||||||||||||||||||||||| ||:||||||||||: ||||||||||||||
a238     GQGVGIGAITDSAVSPVTDTAAQQTLQGINHLGNLSPEAQLAAATALQDSAFAVKDGINS
                  250       260       270       280       290       300

                  310       320       330       340       350       360
m238.pep AKQWADAHPNITATAQTALSAAEAAGTVWRGKKVELNPTKWDWVKNTGYKKPAARHMQTL
         |:|||||||||||||||||::|||| ||| ||||||||||||||||||| ||:| |:||
a238     ARQWADAHPNITATAQTALAVAEAATTVWGGKKVELNPTKWDWVKNTGYKTPAVRTMHTL
                  310       320       330       340       350       360

                  370       380        390       400       410      419
m238.pep DGEMAGGNKPIKSLP-NSAAEKRKQNFEKFNSNWSSASFDSVHKTLTPNAPGILSPDKVK
         ||||||||:| ||:   || |:    |
a238     DGEMAGGNRPPKSITSNSKADASTQ
```

The following partial DNA sequence was identified in *N. gonorrhoeae* <SEQ ID 893>:

```
g239.seq
  1  atgttccacc ataaaggtat tgcccgaaac cggcggatgg aggttttgtt

 51  tttctgccgc cgccctgatc gcttcgtgat tcgccaaacg cgcctgttgc

101  agcctcattt gcgcataatc ctgctccaag gcgatttcct gttttttcgc

151  cttgtccaaa gctgtgaagt tgagcctgta ctggttttgc tgcatcacaa

201  cggaaaaagc ggaaacgcac accgcaagca gcagaaagaa attcgatttg

251  ttcattgccg ttcagacgtt tttctctgtt attattccgg tatcggaccg

301  gcagtccgct ccgccacacg caaaactgcg ctcctcgccc tcgggttggc

351  ggcaatttcc gcttcacccg gctttaatgc cctgcccacg attttcaggg

401  gcggatcggg caaatccgct tctctgaccg ccgcccagct cggcaggggc

451  tcgtgttgcg aatatttttt gacaaactgc ttcacaatgc ggtcttccaa

501  cgaatggaaa gcaatgaccg ccaaacgccc gccctctttc agacggcaca

551  tgacctgcgg caataccgcc cctacttctt caagctcgcg gttaataaag

601  atgcggattg cctggaaggt gcgcgtcgca ggatcctgcc cccgctcgcg
```

-continued

```
651  agtacggacg ttttgtgcca cgatctgcgc cagcttgcgg gttgtatcga

701  ttggactttc cgcccgttgc gcgacaatgg cgcgcacaat ctggcggcta

751  aaccgctctt caccataa
```

This corresponds to the amino acid sequence <SEQ ID 894; ORF 239.ng>:

```
g239.pep
  1  MFHHKGIARN RRMEVLFFCR RPDRFVIRQT RLLQPHLRII LLQGDFLFFR

 51  LVQSCEVEPV LVLLHHNGKS GNAHRKQQKE IRFVHCRSDV FLCYYSGIGP

101  AVRSATRKTA LLALGLAAIS ASPGFNALPT IFRGGSGKSA SLTAAQLGRG

151  SCCEYFLTNC FTMRSSNEWK AMTAKRPPSF RRHMTCGNTA PTSSSSRLIK

201  MRIAWKVRVA GSCPRSRVRT FCATICASLR VVSIGLSARC ATMARTIWRL

251  NRSSP*
```

The following partial DNA sequence was identified in *N. meningitidis* <SEQ ID 895>:

```
m239.seq
  1  ATGCTCCACC ATAAAGGTmy kGCCCGAAAC CGGCkGATGG AGGTTTTGTT

 51  TTTCTGCCGC CGCCCTGATC GCTTCGTGGT TCGCCAAACG CGCCTGTTGC

101  AGCCTCATTT GCGCATAATC CTGCTCCAAG GCGATTTCCT GTTTTTTCGC

151  CTTATCCAAA GCTGTGAAAT TGAGCCTGTA CTGGTTTTGC TGCATCACAA

201  CGGAAAAAGC GGAAACGCAC ACCGCAAGCA GCAGAAGGAA ATTCAATTTG

251  TTCATTGCCA TTCAGACGTT TTTCTCTGTG ATTGTTCCGG TATCGGACCG

301  GCAGTCCGCT CCGCCACACG CAAAACCGCA CTTCTCGCCC TCGGATTGGC

351  GGCAATTTCC GCCTCACCCG GCTTTAATGC CCTGCCCACG ATTTTCAGGG

401  GCAGCTCGGG CAAATCCGCT TCCCTGaCCG CCGCCCAGCG CGGCAGGGGC

451  GCGTGTTGCG AATATTTTTT GACAAACTGC TTCACAATGC GATCTTCCAA

501  CGAATGGAAA GCAATGACCG CCAAACGTCC GCCCTCTTTC AGACGACACA

551  TGACCTGCGG CAATACTGCC CCTACTTCTT CAAGCTCGCG GTTAATAAAG

601  ATGCGGACCG CCTGGAAGGT GCGCGTCGCA GGATCCTGCC CAAGCTCGCG

651  AGTACGGACG TTTTGTGCCA CGATCTGCGC CAGCTTGCGG GTTGTATCGA

701  TTGGACTTTC CGCCTGTTGC GCAACAATGG CGCGCGCAAT cCGGCGGCTa

751  AACCGCTCTT cACCATAA
```

This corresponds to the amino acid sequence <SEQ ID 896; ORF 239>:

```
m239.pep
  1  MLHHKGXARN RXMEVLFFCR RPDRFVVRQT RLLQPHLRII LLQGDFLFFR

 51  LIQSCEIEPV LVLLHHNGKS GNAHRKQQKE IQFVHCHSDV FLCDCSGIGP

101  AVRSATRKTA LLALGLAAIS ASPGFNALPT IFRGSSGKSA SLTAAQRGRG

151  ACCEYFLTNC FTMRSSNEWK AMTAKRPPSF RRHMTCGNTA PTSSSSRLIK

201  MRTAWKVRVA GSCPRSRVRT FCATICASLR VVSIGLSARC ATMARAIRRL

251  NRSSP*
```

Computer analysis of this amino acid sequence gave the following results:

Homology with a Predicted ORF from *N. gonorrhoeae*

ORF 239 shows 93.7% identity over a 255 aa overlap with a predicted ORF (ORF 239.ng) from *N. gonorrhoeae*:

```
m239/g239

                   10        20        30        40        50        60
m239.pep  MLHHKGXARNRXMEVLFFCRRPDRFVVRQTRLLQPHLRIILLQGDFLFFRLIQSCEIEPV
          |:|||| |||| ||||||||||||||:||||||||||||||||||||||||:||||:|||
g239      MFHHKGIARNRRMEVLFFCRRPDRFVIRQTRLLQPHLRIILLQGDFLFFRLVQSCEVEPV
                   10        20        30        40        50        60

                   70        80        90       100       110       120
m239.pep  LVLLHHNGKSGNAHRKQQKEIQFVHCHSDVFLCDCSGIGPAVRSATRKTALLALGLAAIS
          |||||||||||||||||||||:||||:||||||  |||||||||||||||||||||||||
g239      LVLLHHNGKSGNAHRKQQKEIRFVHCRSDVFLCYYSGIGPAVRSATRKTALLALGLAAIS
                   70        80        90       100       110       120

                  130       140       150       160       170       180
m239.pep  ASPGFNALPTIFRGSSGKSASLTAAQRGRGACCEYFLTNCFTMRSSNEWKAMTAKRPPSF
          |||||||||||||||:|||||||||| |||:|||||||||||||||||||||||||||||
g239      ASPGFNALPTIFRGSGGKSASLTAAQLGRGSCCEYFLTNCFTMRSSNEWKAMTAKRPPSF
                  130       140       150       160       170       180

                  190       200       210       220       230       240
m239.pep  RRHMTCGNTAPTSSSSRLIKMRTAWKVRVAGSCPRSRVRTFCATICASLRVVSIGLSARC
          |||||||||||||||||||||| |||||||||||||||||||||||||||||||||||||
g239      RRHMTCGNTAPTSSSSRLIKMRIAWKVRVAGSCPRSRVRTFCATICASLRVVSIGLSARC
                  190       200       210       220       230       240

                  250
m239.pep  ATMARAIRRLNRSSPX
          |||||:| ||||||||
g239      ATMARTIWRLNRSSPX
                  250
```

The following partial DNA sequence was identified in *N. meningitidis* <SEQ ID 897>:

```
a239.seq
  1  ATGCTCCACC ATAAAGGTAT TGCCCGAAAC CGGCGGATGG AGGTTTTGTT

 51  TTTCTGCCGC CGCCCTGATC GCTTCGTGGT TCGCCAAACG CGCCTGTTGC

101  AGCCTCATTT GCGCATAATC CTGCTCCAAG GCGATTTCCT GTTTTTTCGC

151  CTTATCCAAA GCTGTGAAGT TGAGCCTGTA CTGGTTTTGC TGCATCACAA

201  CGGAAAAAGC GGAAACGCAC ACCGCAAGCA GCAGAAGGAA ATTCAATTTG

251  TTCATTGCCA TTCAGACGTT TTTCTCTGTG ATTGTTCCGG TATCGGACCG

301  GCAGTCCGCT CCGCCACACG CAAAACCGCA CTTCTCGCCC TCGGATTGGC

351  GGCAATTTCC GCCTCACCCG GCTTTAATGC CCTGCCCGCG ATTTTCAGGG

401  GCGGCTCGGG CAAATCCGCT TCCCTGACCG CCGCCCAGCG CGGCAGGGGC

451  GCGTGTTGCG AATATTTTTT GACAAACTGC TTCACAATGC GGTCTTCCAA

501  CGAATGGAAA GCAATGACCG CCAAACGTCC GCCCTCTTTC AGACGACACA

551  TGACCTGCGG CAATACTGCC CCTACTTCTT CAAGCTCGCG GTTAATAAAG

601  ATGCGGATTG CCTGGAAGGT GCGCGTCGCA GGATCCTGCC CAAGCTCGCG

651  AGTACGGACG TTTTGTGCCA CGATCTGCGC CAGCTTGCGG GTTGTATCGA

701  TTGGACTTTC CGCCTGTTGC GCAACAATGG CGCGCGCAAT CTGGCGGCTA

751  AACCGCTCTT CACCATAA
```

This corresponds to the amino acid sequence <SEQ ID 898; ORF 239.a>:

```
a239.pep
  1  MLHHKGIARN RRMEVLFFCR RPDRFVVRQT RLLQPHLRII LLQGDFLFFR

 51  LIQSCEVEPV LVLLHHNGKS GNAHRKQQKE IQFVHCHSDV FLCDCSGIGP

101  AVRSATRKTA LLALGLAAIS ASPGFNALPA IFRGGSGKSA SLTAAQRGRG

151  ACCEYFLTNC FTMRSSNEWK AMTAKRPPSF RRHMTCGNTA PTSSSSRLIK

201  MRIAWKVRVA GSCPRSRVRT FCATICASLR VVSIGLSARC ATMARAIWRL

251  NRSSP*
```

m239/a239 97.3% identity in 255 aa overlap

```
                 10        20        30        40        50        60
m239.pep MLHHKGXARNRXMEVLFFCRRPDRFVVRQTRLLQPHLRIILLQGDFLFFRLIQSCEIEPV
         |||||| |||| ||||||||||||||||||||||||||||||||||||||||||||:|||
a239     MLHHKGIARNRRMEVLFFCRRPDRFVVRQTRLLQPHLRIILLQGDFLFFRLIQSCEVEPV
                 10        20        30        40        50        60

                 70        80        90       100       110       120
m239.pep LVLLHHNGKSGNAHRKQQKEIQFVHCHSDVFLCDCSGIGPAVRSATRKTALLALGLAAIS
         ||||||||||||||||||||||||||||||||||||||||||||||||||||||||||||
a239     LVLLHHNGKSGNAHRKQQKEIQFVHCHSDVFLCDCSGIGPAVRSATRKTALLALGLAAIS
                 70        80        90       100       110       120

                130       140       150       160       170       180
m239.pep ASPGFNALPTIFRGSSGKSASLTAAQRGRGACCEYFLTNCFTMRSSNEWKAMTAKRPPSF
         |||||||||:|||||:||||||||||||||||||||||||||||||||||||||||||||
a239     ASPGFNALPAIFRGSGGKSASLTAAQRGRGACCEYFLTNCFTMRSSNEWKAMTAKRPPSF
                130       140       150       160       170       180

                190       200       210       220       230       240
m239.pep RRHMTCGNTAPTSSSSRLIKMRTAWKVRVAGSCPRSRVRTFCATICASLRVVSIGLSARC
         |||||||||||||||||||||| |||||||||||||||||||||||||||||||||||||
a239     RRHMTCGNTAPTSSSSRLIKMRIAWKVRVAGSCPRSRVRTFCATICASLRVVSIGLSARC
                190       200       210       220       230       240

                250
m239.pep ATMARAIRRLNRSSPX
         ||||||| ||||||||
a239     ATMARAIWRLNRSSPX
                250
```

The following partial DNA sequence was identified in *N. gonorrhoeae* <SEQ ID 899>:

```
g240.seq
  1  atgatagaag tcatacattt cttcggcgcc gaaacgcgca gacagtttgc

 51  ttgtgccgac gttggacgat ttctgcataa tgccgcgcac atccaaagag

101  gggtaaacat gggtatcatc gcgcacggga gacggtccga ttttataagg

151  ctgcgtattc agccgttcgt tcaaatcggt tttgcccgca tccaatgcct

201  tcgcaatcac gaacggtttg attgccgaac caggttcgat catatcggtt

251  acggcacggt tgcgccgctg ttcgctgtct gcccggccgg gtctgttggg

301  atcgtaggcg ggcgtattgg ccaaggcgag gatttccccc gtgcgggcat

351  ccaaaaccac caccgttccg gcttttgcct gatggtattc gaccgccttg

401  ttcaactctt cataggccaa ggtctgaatc ctctgatcga gggaaaggat

451  gatgtctttg ccgttttgcg gtgctttatt gcgcggggag tccaagctgt

501  ccacaatatt gccctgccgg tcccgcaaaa caacttccgc gccgtcttcg

551  ccatacaggc tgtcttcaag cgaaagttcc aaaccttcct gacctttgcc

601  gtcaatatcg gtaaatccga tgacgtgtgc aaacaggttg cccatcgggt

651  aatggcgttt taa
```

This corresponds to the amino acid sequence <SEQ ID 900; ORF 240.ng>:

```
g240.pep
   1 MIEVIHFFGA ETRRQFACAD VGRFLHNAAH IQRGVNMGII AHGRRSDFIR

  51 LRIQPFVQIG FARIQCLRNH ERFDCRTRFD HIGYGTVAPL FAVCPAGSVG

 101 IVGGRIGQGE DFPRAGIQNH HRSGFCLMVF DRLVQLFIGQ GLNPLIEGKD

 151 DVFAVLRCFI ARGVQAVHNI ALPVPQNNFR AVFAIQAVFK RKFQTFLTFA

 201 VNIGKSDDVC KQVAHRVMAF*
```

The following partial DNA sequence was identified in *N. meningitidis* <SEQ ID 901>:

```
m240.seq
   1 ATGATAGAAG TCATACATTT CTTCGGCACC GAAACGCGCA GACAGTTTGC

  51 TTGTGCCGAC GTTGGACGAT TTCTGCATGA TGCCGCGCAC ATCCAAAGAG

 101 GGGTAAACAT GGGTATCGCG CACGGGAGAC GGTCCGATTT TATAAGGCTG

 151 CGTATTCAGC CGTTCGTTCA AATCGGTTTT GCCCGCATCC AATGCCTTCG

 201 CAATCACAAA CGGTTTGATT GCCGAACCGG GTTCGATCAT ATCGGTTACG

 251 GCACGGTTGC GCCGCTGTTC GCTGTCTGCC CGGCCGGGCC TGTTGGGATC

 301 GTAGGCGGGC GTATTGGCCA AGGCGAGGAT TTCCCCCGTG CGGGCATCCA

 351 ArACCACCAC CGTTCCGGCT TTTGCCTGAT GGTATTCGAC CGCCTTGTTC

 401 AACTCTTCAT AGGCCAAGGT CTGAATCCTC TGATCGAGGG AAAGGATGAT

 451 GTCTTTGCCG TTTTTCGGGG CTTTAkTGCG CGGGGAGTCC AAGCTGTCCA

 501 CAATATTGCC CTGCCGGTCC CGCAAAACGA CTTCCGCGCC GTCTTCGCCA

 551 TGCAAGCTGT CTTCAAGCGA AAGTTCCAAA CCTTCCTGAC CTTTGCCGTC

 601 AATATCGGTA AATCCGATGA CGTGTGCAAA CAGGTTGCCC ATCGGGTAAT

 651 GGCGTTTTAA
```

This corresponds to the amino acid sequence <SEQ ID 902; ORF 240>:

```
m240.pep
   1 MIEVIHFFGT ETRRQFACAD VGRFLHDAAH IQRGVNMGIA HGRRSDFIRL

  51 RIQPFVQIGF ARIQCLRNHK RFDCRTGFDH IGYGTVAPLF AVCPAGPVGI

 101 VGGRIGQGED FPRAGIQXHH RSGFCLMVFD RLVQLFIGQG LNPLIEGKDD

 151 VFAVFRGFXA RGVQAVHNIA LPVPQNDFRA VFAMQAVFKR KFQTFLTFAV

 201 NIGKSDDVCK QVAHRVMAF*
```

Computer analysis of this amino acid sequence gave the following results:

Homology with a Predicted ORF from *N. gonorrhoeae*

ORF 240 shows 94.5% identity over a 220 aa overlap with a predicted ORF (ORF 240.ng) from *N. gonorrhoeae*:

```
m240/g240

                     10        20        30         40        50        59
m240.pep     MIEVIHFFGTETRRQFACADVGRFLHDAAHIQRGVNMGI-AHGRRSDFIRLRIQPFVQIG
             |||||||||:||||||||||||||||:|||||||||||| ||||||||||||||||||||
g240         MIEVIHFFGAETRRQFACADVGRFLHNAAHIQRGVNMGIIAHGRRSDFIRLRIQPFVQIG
                     10        20        30        40        50        60

            60        70        80        90       100       110       119
m240.pep     FARIQCLRNHKRFDCRTGFDHIGYGTVAPLFAVCPAGPVGIVGGRIGQGEDFPRAGIQXH
             ||||||||||:|||||| ||||||||||||||||||| |||||||||||||||||||| |
g240         FARIQCLRNHERGDCRTRFDHIGYGTVAPLFAVCPAGSVGIVGGRIGQGEDFPRAGIQNH
                     70        80        90       100       110       120

           120       130       140       150       160       170       179
m240.pep     HRSGFCLMVFDRLVQLFIGQGLNPLIEGKDDVFAVFRGFXARGVQAVHNIALPVPQNDFR
             |||||||||||||||||||||||||||||||||||:| | |||||||||||||||||:||
g240         HRSGFCLMVFDRLVQLFIGQGLNPLIEGKDDVFAVLRCFIARGVQAVHNIALPVPQNNFR
                    130       140       150       160       170       180

           180       190       200       210       220
m240.pep     AVFAMQAVFKRKFQTFLTFAVNIGKSDDVCKQVAHRVMAFX
             ||||:|||||||||||||||||||||||||||||||||||
g240         AVFAIQAVFKRKFQTFLTFAVNIGKSDDVCKQVAHRVMAF
                    190       200       210       220
```

The following partial DNA sequence was identified in *N. meningitidis* <SEQ ID 903>:

```
a240.seq
   1 ATGATAGAAG TCATACATTT CTTCGGCACC GAAACGCGCA GACAGTTTGC

  51 TTGTGCCGAC GTTGGACGAT TTCTGCATGA TGCCGCGCAC ATCCAAAGAG

 101 GGGTAAACAT GGGTATCGCG CACGGGAGAC GGTCCGATTT TATAAGGCTG

 151 CGTATTCAGC CGTTCGTTCA AATCGGTTTT GCCCGCATCC AATGCCTTCG

 201 CAATCACAAA CGGTTTGATT GCCGAACCGG GTTCGATCAT ATCGGTTACG

 251 GCACGGTTGC GCCGCTGTTC GCTGTCTGCC CGGCCGGGCC TGTTGGGATC

 301 GTAGGCGGGC GTATTGGCCA AGGCGAGGAT TTCCCCCGTG CGGGCATCCA

 351 AAACCACCAC CGTTCCGGCT TTTGCCTGAT GGTATTCGAC CGCCTTGTTC

 401 AACTCTTCAT AGGCCAAGGT CTGAATCCTC TGATCGAGGG AAAGGATGAT

 451 GTCTTTGCCG TTTTTCGGGG CTTTATTGCG CGGGGAGTCC AAGCTGTCCA

 501 CAATATTGCC CTGCCGGTCC CGCAAAACGA CTTCCGCGCC GTCTTCGCCA

 551 TGCAGGCTGT CTTCAAGCGA AAGTTCCAAA CCTTCCTGAC CTTTGCCGTC

 601 AATATCGGTA AATCCGATGA CGTGTGCAAA CAGGTTGCCC ATCGGGTAAT

 651 GGCGTTTTAA
```

This corresponds to the amino acid sequence <SEQ ID 904; ORF 240.a>:

```
a240.pep
   1 MIEVIHFFGT ETRRQFACAD VGRFLHDAAH IQRGVNMGIA HGRRSDFIRL

  51 RIQPFVQIGF ARIQCLRNHK RFDCRTGFDH IGYGTVAPLF AVCPAGPVGI

 101 VGGRIGQGED FPRAGIQNHH RSGFCLMVFD RLVQLFIGQG LNPLIEGKDD
```

-continued

```
151 VFAVFRGFIA RGVQAVHNIA LPVPQNDFRA VFAMQAVFKR KFQTFLTFAV

201 NIGKSDDVCK QVAHRVMAF*
```

m240/a240 99.1% identity in 219 aa overlap

```
                 10        20        30        40        50        60
m240.pep  MIEVIHFFGTETRRQFACADVGRFLHDAAHIQRGVNMGIAHGRRSDFIRLRIQPFVQIGF
          ||||||||||||||||||||||||||||||||||||||||||||||||||||||||||||
a240      MIEVIHFFGTETRRQFACADVGRFLHDAAHIQRGVNMGIAHGRRSDFIRLRIQPFVQIGF
                 10        20        30        40        50        60
                 70        80        90       100       110       120
m240.pep  ARIQCLRNHKRFDCRTGFDHIGYGTVAPLFAVCPAGPVGIVGGRIGQGEDFPRAGIQXHH
          ||||||||||||||||||||||||||||||||||||||||||||||||||||||||| ||
a240      ARIQCLRNHKRFDCRTGFDHIGYGTVAPLFAVCPAGPVGIVGGRIGQGEDFPRAGIQNHH
                 70        80        90       100       110       120
                130       140       150       160       170       180
m240.pep  RSGFCLMVFDRLVQLFIGQGLNPLIEGKDDVFAVFRGFXARGVQAVHNIALPVPQNDFRA
          |||||||||||||||||||||||||||||||||||||| |||||||||||||||||||||
a240      RSGFCLMVFDRLVQLFIGQGLNPLIEGKDDVFAVFRGFIARGVQAVHNIALPVPQNDFRA
                130       140       150       160       170       180
                190       200       210       220
m240.pep  VFAMQAVFKRKFQTFLTFAVNIGKSDDVCKQVAHRVMAFX
          ||||||||||||||||||||||||||||||||||||||||
a240      VFAMQAVFKRKFQTFLTFAVNIGKSDDVCKQVAHRVMAFX
                190       200       210       220
```

The following partial DNA sequence was identified in *N. gonorrhoeae* <SEQ ID 905>:

```
g241.seq
  1 ATGATAGAAG TCATACATTT CTTCGGCACC GAAACGCGCA GACAGTTTGC

 51 TTGTGCCGAC GTTGGACGAT TTCTGCATGA TGCCGCGCAC ATCCAAAGAG

101 GGGTAAACAT GGGTATCGCG CACGGGAGAC GGTCCGATTT TATAAGGCTG

151 CGTATTCAGC CGTTCGTTCA AATCGGTTTT GCCCGCATCC AATGCCTTCG

201 CAATCACAAA CGGTTTGATT GCCGAACCGG GTTCGATCAT ATCGGTTACG

251 GCACGGTTGC GCCGCTGTTC GCTGTCTGCC CGGCCGGGCC TGTTGGGATC

301 GTAGGCGGGC GTATTGGCCA AGGCGAGGAT TTCCCCCGTG CGGGCATCCA

351 ArACCACCAC CGTTCCGGCT TTTGCCTGAT GGTATTCGAC CGCCTTGTTC

401 AACTCTTCAT AGGCCAAGGT CTGAATCCTC TGATCGAGGG AAAGGATGAT

451 GTCTTTGCCG TTTTTCGGGG CTTTAkTGCG CGGGGAGTCC AAGCTGTCCA

501 CAATATTGCC CTGCCGGTCC CGCAAAACGA CTTCCGCGCC GTCTTCGCCA

551 TGCAAGCTGT CTTCAAGCGA AAGTTCCAAA CCTTCCTGAC CTTTGCCGTC

601 AATATCGGTA AATCCGATGA CGTGTGCAAA CAGGTTGCCC ATCGGGTAAT

651 GGCGTTTTAA
```

This corresponds to the amino acid sequence <SEQ ID 906; ORF 241.ng>:

```
g241.pep
  1 MPTRPTRAAN PPTPTTWLQT AYCPRPPYRP PSVQTHTPHE PASSTCAAKS

 51 ANRRENSHNA QPTYLLHPSN KMPSETEQTL FRRHQIPPSC RQSVVVMTVR
```

-continued

```
101 TVDMTVCDFL IGCIAHAFNR SFKADFHACQ RMVAVHHRLA VGNIGYTIDD

151 NIAGFRIVRF KHHTDLDFNR ERARIFNTDQ LRIMLTERIV GRKRHFDRIA

201 GILTVQRLFH QRENAVVTAV QIRNRFFGFI QKLIVGIIHL IMQRNHGIFC

251 NSHICPFRNS RLITGAF*
```

The following partial DNA sequence was identified in *N. meningitidis* <SEQ ID 907>:

```
m241.seq (partial)
   1 ..CGGCAATCAG TGGTGGTGAT GACCGTGCGG GCCGTGGACA TGACCGTGTG

  51   CGATTTCCTC ATCGGATGCA TCGCGCACGC TTTCAACTGT AGCCTTAAAG

 101   CGGATTTTCA TGCCTGCCAA AGGATGGTTG CCGTCCACCA CCGCCTTGCC

 151   GTCGGCAACA TCGGTTACAC GATAGACGAC AACATCGCCG GTTTCAGGAT

 201   CGTCGGCTTC AAACATCATG CCGACTTCGA CTTCAACAGG GAACACGCCC

 251   GCATCTTCGA TACGGACCAA CTCCGGATCC TGCTCGCCGA ACGCATCGTC

 301   GGGCGACAGC GCCACATCGA CCGTATCGCC GGCATCCTTA CCGTGCAACG

 351   CCTCTTCCAC CAAAGGGAAA ATGCCGTCGT AACCGCCGTG CAGATACGCA

 401   ATCGGTTCTT CGGTTTTGTC CAAAAGCTGA TTGTTGGCAT CATACATCTC

 451   ATAATGCAGC GAAACCACGG AATTTTTCAC GATAGCCATA TTTGTCCTTT

 501   CAGGAACAGC AGATTAATTA CAGGCGCATT CTAA
```

This corresponds to the amino acid sequence <SEQ ID 908; ORF 241>:

```
m241.pep (partial)
   1 ..RQSVVVMTVR AVDMTVCDFL IGCIAHAFNC SLKADFHACQ RMVAVHHRLA

  51   VGNIGYTIDD NIAGFRIVGF KHHADFDFNR EHARIFDTDQ LRILLAERIV

 101   GRQRHIDRIA GILTVQRLFH QRENAVVTAV QIRNRFFGFV QKLIVGIIHL

 151   IMQRNHGIFH DSHICPFRNS RLITGAF*
```

Computer analysis of this amino acid sequence gave the following results:

Homology with a Predicted ORF from *N. gonorrhoeae*

ORF 241 shows 91.5% identity over a 177 aa overlap with a predicted ORF (ORF 241.ng) from *N. gonorrhoeae*:

```
m241/g241


                                                     10        20        30
m241.pep                                     RQSVVVMTVRAVDMTVCDFLIGCIAHAFNC
                                             ||||||||||:|||||||||||||||||
g241          QPTYLLHPSNKMPSETEQTLFRRHQIPPSCRQSVVVMTVRTVDMTVCDFLIGCIAGAFNR
                      70        80        90       100       110       120


                      40        50        60        70        80        90
m241.pep      SLKADFHACQRMVAVHHRLAVGNIGYTIDDNIAGFRIVGFKHHADFDFNREHARIFDTDQ
              |:|||||||||||||||||||||||||||||||||||| ||||:|:|||||:||||:|||
g241          SFKADFHACQRMVAVHHRLAVGNIGYTIDDNIAGFRIVRFKHHTDLDFNRERARIFNTDQ
                     130       140       150       160       170       180
```

-continued

```
                  100        110        120        130        140        150
m241.pep      LRILLAERIVGRQRHIDRIAGILTVQRLFHQRENAVVTAVQIRNRFFGFVQKLIVGIIHL
              |||:|:||||||:||:|||||||||||||||||||||||||||||||||:||||||||||
g241          LRIMLTERIVGRKRHFDRIAGILTVQRLFHQRENAVVTAVQIRNRFFGFIQKLIVGIIHL
                  190        200        210        220        230        240

                  160        170
m241.pep      IMQRNHGIFHDSHICPFRNSRLITGAFX
              ||||||||| :|||||||||||||||||
g241          IMQRNHGIFCNSHICPFRNSRLITGAFX
                  250        260
```

The following partial DNA sequence was identified in *N. meningitidis* <SEQ ID 909>:

```
a241.seq
  1 ATGCCAACAC GTCCAACTCG CGCCGCAAAG CATCCAACCC CGCCAACCTG

 51 GCTTCAGACG GCATACTGCC CTCGTCCGCC ATATCGTCCG CCGTCCGTGC

101 AAACGCATAC ACCGCATGAA CCGGCTTCCT CAACCTGCGC GGCAAAATCA

151 GCGAACCGAC GGGAAAATTT TCATAATGCC CAACCGACAT ACCTTCTCCA

201 TCCATCAAAC AAAATGCCGT CTGAAATGGA ACAAACCCTT TTCAGACGGC

251 ATCAGATACC TCCAAGCTGC CGGCAATCAG TGGTGGTGAT GACCGTGCGG

301 ACCGTGGACA TGACCGTGTG CGATTTCCTC ATCGGATGCA TCGCGCACAC

351 TTTCAACCGT AGCCTTAAAG CGGATTTTCA TGCCTGCCAA AGGATGGTTG

401 CCGTCCACCA CCGCCTTACC GTCGGCAACA TCGGTTACAC GATAGACGAC

451 AACATCGCCG GTTTCAGGAT CGTCGGCTTC AAACATCATG CCGACTTCGA

501 CTTCAACAGG GAACACGCCC GCATCTTCAA TACGGACCAA CTCCGGATCC

551 TGCTCGCCGA ACGCATCGTC GGGCGAAAGC GCCACATCGA CCGTATCGCC

601 GGCATCCTTA CCGTGCAACG CCTCTTCCAC CAAAGGGAAA ATGCCGTCGT

651 AACCGCCGTG CAGATACGCA ATCGGTTCTT CGGTTTTGTC CAAAAGCTGA

701 TTGTTGGCAT CATACATCTC ATAATGCAGC GAAACCACGG AATTCTTCAC

751 GATAGCCATA TTTGTCCTTT CAGGAACAGC AGATTAATTA CAGGCGCATT

801 CTAA
```

This corresponds to the amino acid sequence <SEQ ID 910; ORF 241.a>:

```
a241.pep
  1 MPTRPTRAAK HPTPPTWLQT AYCPRPPYRP PSVQTHTPHE PASSTCAAKS

 51 ANRRENFHNA QPTYLLHPSN KMPSEMEQTL FRRHQIPPSC RQSVVVMTVR

101 TVDMTVCDFL IGCIAHTFNR SLKADFHACQ RMVAVHHRLT VGNIGYTIDD

151 NIAGFRIVGF KHHADFDFNR EHARIFNTDQ LRILLAERIV GRKRHIDRIA

201 GILTVQRLFH QRENAVVTAV QIRNRFFGFV QKLIVGIIHL IMQRNHGILH

251 DSHICPFRNS RLITGAF*
```

m241/a241 96.0% identity in 177 aa overlap

```
                                          10        20        30
m241.pep                                  RQSVVVMTVRAVDMTVCDFLIGCIAHAFNC
                                          ||||||||||:|||||||||||||||:||
a241          QPTYLLHPSNKMPSEMEQTLFRRHQIPPSCRQSVVVMTVRTVDMTVCDFLIGCIAHTFNR
                      70        80        90       100       110       120
                     40        50        60        70        80        90
m241.pep      SLKADFHACQRMVAVHHRLAVGNIGYTIDDNIAGFRIVGFKHHADFDFNREHARIFDTDQ
              ||||||||||||||||||:||||||||||||||||||||||||||||||||||||:|||
a241          SLKADFHACQRMVAVHHRLTVGNIGYTIDDNIAGFRIVGFKHHADFDFNREHARIFNTDQ
                     130       140       150       160       170       180
                     100       110       120       130       140       150
m241.pep      LRILLAERIVGRQRHIDRIAGILTVQRLFHQRENAVVTAVQIRNRFFGFVQKLIVGIIHL
              ||||||||||||:|||||||||||||||||||||||||||||||||||||||||||||||
a241          LRILLAERIVGRKRHIDRIAGILTVQRLFHQRENAVVTAVQIRNRFFGFVQKLIVGIIHL
                     190       200       210       220       230       240
                      160       170
m241.pep      IMQRNHGIFHDSHICPFRNSRLITGAFX
              ||||||||:||||||||||||||||||
a241          IMQRNHGILHDSHICPFRNSRLITGAFX
                      250       260
```

The following partial DNA sequence was identified in *N. gonorrhoeae* <SEQ ID 911>:

```
g241-1.seq
  1 ATGATAGAAG TCATACATTT CTTCGGCACC GAAACGCGCA GACAGTTTGC

 51 TTGTGCCGAC GTTGGACGAT TTCTGCATGA TGCCGCGCAC ATCCAAAGAG

101 GGGTAAACAT GGGTATCGCG CACGGGAGAC GGTCCGATTT TATAAGGCTG

151 CGTATTCAGC CGTTCGTTCA AATCGGTTTT GCCCGCATCC AATGCCTTCG

201 CAATCACAAA CGGTTTGATT GCCGAACCGG GTTCGATCAT ATCGGTTACG

251 GCACGGTTGC GCCGCTGTTC GCTGTCTGCC CGGCCGGGCC TGTTGGGATC

301 GTAGGCGGGC GTATTGGCCA AGGCGAGGAT TTCCCCCGTG CGGGCATCCA

351 ArACCACCAC CGTTCCGGCT TTTGCCTGAT GGTATTCGAC CGCCTTGTTC

401 AACTCTTCAT AGGCCAAGGT CTGAATCCTC TGATCGAGGG AAAGGATGAT

451 GTCTTTGCCG TTTTTCGGGG CTTTAkTGCG CGGGGAGTCC AAGCTGTCCA

501 CAATATTGCC CTGCCGGTCC CGCAAAACGA CTTCCGCGCC GTCTTCGCCA

551 TGCAAGCTGT CTTCAAGCGA AAGTTCCAAA CCTTCCTGAC CTTTGCCGTC

601 AATATCGGTA AATCCGATGA CGTGTGCAAA CAGGTTGCCC ATCGGGTAAT

651 GGCGTTTTAA
```

This corresponds to the amino acid sequence <SEQ ID 912; ORF 241-1.ng>:

```
g241-1.pep
  1 MPTRPTRAAN PPTPTTWLQT AYCPRPPYRP PSVQTHTPHE PASSTCAAKS

 51 ANRRENSHNA QPTYLLHPSN KMPSETEQTL FRRHQIPPSC RQSVVVMTVR

101 TVDMTVCDFL IGCIAHAFNR SFKADFHACQ RMVAVHHRLA VGNIGYTIDD

151 NIAGFRIVRF KHHTDLDFNR ERARIFNTDQ LRIMLTERIV GRKRHFDRIA
```

-continued

```
201 GILTVQRLFH QRENAVVTAV QIRNRFFGFI QKLIVGIIHL IMQRNHGIFC

251 NSHICPFRNS RLITGAF*
```

The following partial DNA sequence was identified in *N. meningitidis* <SEQ ID 913>:

```
m241-1.seq
  1 ATGCCAACAC GTCCAACTCG CGCTGCAAAC CCTCCAACCC CGCCAACCTG

 51 GCTTCAGACG GCATACTGCC CTCGTCCGCC ATATCGTCCG CCGTCCGTGC

101 AAACGCGTAC ACCGCGTGAA CCGGCTTCCT CAACCTGCGC GGCAAAATCA

151 GCGAACCGAC GGGAAAATTC TCATAATGCC CAACCGACAT ACCTTCTCCA

201 TCCATCAAAC AAAATGCCGT CTGAAACGGA ACAAACCCTT TTCAGACGGC

251 ATCAGATACC TCCAAGCTGC CGGCAATCAG TGGTGGTGAT GACCGTGCGG

301 GCCGTGGACA TGACCGTGTG CGATTTCCTC ATCGGATGCA TCGCGCACGC

351 TTTCAACTGT AGCCTTAAAG CGGATTTTCA TGCCTGCCAA AGGATGGTTG

401 CCGTCCACCA CCGCCTTGCC GTCGGCAACA TCGGTTACAC GATAGACGAC

451 AACATCGCCG GTTTCAGGAT CGTCGGCTTC AAACATCATG CCGACTTCGA

501 CTTCAACAGG GAACACGCCC GCATCTTCGA TACGGACCAA CTCCGGATCC

551 TGCTCGCCGA ACGCATCGTC GGGCGACAGC GCCACATCGA CCGTATCGCC

601 GGCATCCTTA CCGTGCAACG CCTCTTCCAC CAAAGGGAAA ATGCCGTCGT

651 AACCGCCGTG CAGATACGCA ATCGGTTCTT CGGTTTTGTC CAAAAGCTGA

701 TTGTTGGCAT CATACATCTC ATAATGCAGC GAAACCACGG AATTTTTCAC

751 GATAGCCATA TTTGTCCTTT CAGGAACAGC AGATTAATTA CAGGCGCATT

801 CTAA
```

This corresponds to the amino acid sequence <SEQ ID 914; ORF 241-1>:

```
m241-1.pep

  1  MPTRPTRAAN PPTPPTWLQT AYCPRPPYRP PSVQTRTPRE PASSTCAAKS

 51  ANRRENSHNA QPTYLLHPSN KMPSETEQTL FRRHQIPPSC RQSVVVMTVR

101  AVDMTVCDFL IGCIAHAFNC SLKADFHACQ RMVAVHHRLA VGNIGYTIDD

151  NIAGFRIVGF KHHADFDFNR EHARIFDTDQ LRILLAERIV GRQRHIDRIA

201  GILTVQRLFH QRENAVVTAV QIRNRFFGFV QKLIVGIIHL IMQRNHGIFH

251  DSHICPFRNS RLITGAF*

m241-/g241-1     93.3% identity in 267 aa overlap

                      10        20        30        40        50        60
m241-1.pep    MPTRPTRAANPPTPPTWLQTAYCPRPPYRPPSVQTRTPREPASSTCAAKSANRRENSHNA
              |||||||||||||| ||||||||||||||||||||:||:|||||||||||||||||||||
g241          MPTRPTRAANPPTPTTWLQTAYCPRPPYRPPSVQTHTPHEPASSTCAAKSANRRENSHNA
                      10        20        30        40        50        60

                      70        80        90       100       110       120
m241-1.pep    QPTYLLHPSNKMPSETEQTLFRRHQIPPSCRQSVVVMTVRAVDMTVCDFLIGCIAHAFNC
              |||||||||||||||||||||||||||||||||||||||:||||||||||||||||||| 
g241          QPTYLLHPSNKMPSETEQTLFRRHQIPPSCRQSVVVMTVRTVDMTVCDFLIGCIAHAFNR
                      70        80        90       100       110       120

                     130       140       150       160       170       180
m241-1.pep    SLKADFHACQRMVAVHHRLAVGNIGYTIDDNIAGFRIVGFKHHADFDFNREHARIFDTDQ
              |:|||||||||||||||||||||||||||||||||||| ||||:||||||||:||||:|||
g241          SFKADFHACQRMVAVHHRLAVGNIGYTIDDNIAGFRIVRFKHHTDLDFNRERARIFNTDQ
                     130       140       150       160       170       180
```

-continued

```
                 190       200       210       220       230       240
m241-1.pep  LRILLAERIVGRQRHIDRIAGILTVQRLFHQRENAVVTAVQIRNRFFGFVQKLIVGIIHL
            |||:|:||||||:||:|||||||||||||||||||||||||||||||||:||||||||||
g241        LRIMLTERIVGRKRHFDRIAGILTVQRLFHQRENAVVTAVQIRNRFFGFIQKLIVGIIHL
                 190       200       210       220       230       240

                 250       260
m241-1.pep  IMQRNHGIFHDSHICPFRNSRLITGAFX
            ||||||||| :|||||||||||||||||
g241        IMQRNHGIFCNSHICPFRNSRLITGAFX
                 250       260
```

The following partial DNA sequence was identified in *N. meningitidis* <SEQ ID 915>:

```
a241-1.seq
   1 ATGCCAACAC GTCCAACTCG CGCCGCAAAG CATCCAACCC CGCCAACCTG

  51 GCTTCAGACG GCATACTGCC CTCGTCCGCC ATATCGTCCG CCGTCCGTGC

 101 AAACGCATAC ACCGCATGAA CCGGCTTCCT CAACCTGCGC GGCAAAATCA

 151 GCGAACCGAC GGGAAAATTT TCATAATGCC CAACCGACAT ACCTTCTCCA

 201 TCCATCAAAC AAAATGCCGT CTGAAATGGA ACAAACCCTT TTCAGACGGC

 251 ATCAGATACC TCCAAGCTGC CGGCAATCAG TGGTGGTGAT GACCGTGCGG

 301 ACCGTGGACA TGACCGTGTG CGATTTCCTC ATCGGATGCA TCGCGCACAC

 351 TTTCAACCGT AGCCTTAAAG CGGATTTTCA TGCCTGCCAA AGGATGGTTG

 401 CCGTCCACCA CCGCCTTACC GTCGGCAACA TCGGTTACAC GATAGACGAC

 451 AACATCGCCG GTTTCAGGAT CGTCGGCTTC AAACATCATG CCGACTTCGA

 501 CTTCAACAGG GAACACGCCC GCATCTTCAA TACGGACCAA CTCCGGATCC

 551 TGCTCGCCGA ACGCATCGTC GGGCGAAAGC GCCACATCGA CCGTATCGCC

 601 GGCATCCTTA CCGTGCAACG CCTCTTCCAC CAAAGGGAAA ATGCCGTCGT

 651 AACCGCCGTG CAGATACGCA ATCGGTTCTT CGGTTTTGTC CAAAAGCTGA

 701 TTGTTGGCAT CATACATCTC ATAATGCAGC GAAACCACGG AATTCTTCAC

 751 GATAGCCATA TTTGTCCTTT CAGGAACAGC AGATTAATTA CAGGCGCATT

 801 CTAA
```

This corresponds to the amino acid sequence <SEQ ID 916; ORF 241-1.a>:

```
a244-1.pep

      1 MPTRPTRAAK HPTPPTWLQT AYCPRPPYRP PSVQTHTPHE PASSTCAAKS

     51 ANRRENFHNA QPTYLLHPSN KMPSEMEQTL FRRHQIPPSC RQSVVVMTVR

    101 TVDMTVCDFL IGCIAHTFNR SLKADFHACQ RMVAVHHRLT VGNIGYTIDD

    151 NIAGFRIVGF KHHADFDFNR EHARIFNTDQ LRILLAERIV GRKRHIDRIA

    201 GILTVQRLFH QRENAVVTAV QIRNRFFGFV QKLIVGIIHL IMQRNHGILH

    251 DSHICPFRNS RLITGAF*

m241-1/a241-1  95.1% identity in 267 aa overlap

                10        20        30        40        50        60
m241-1.pep  MPTRPTRAANPPTPPTWLQTAYCPRPPYRPPSVQTRTPREPASSTCAAKSANRRENSHNA
            |||||||||: |||||||||||||||||||||||:||:||||||||||||||||| |||
a241        MPTRPTRAAKHPTPPTWLQTAYCPRPPYRPPSVQTHTPHEPASSTCAAKSANRRENFHNA
                10        20        30        40        50        60
```

-continued

```
                 70        80        90       100       110       120
m241-1.pep  QPTYLLHPSNKMPSETEQTLFRRHQIPPSCRQSVVVMTVRAVDMTVCDFLIGCIAHAFNC
            |||||||||||||| |||||||||||||||||||||||:|||||||||||||||:||
a241        QPTYLLHPSNKMPSEMEQTLFRRHQIPPSCRQSVVVMTVRTVDMTVCDFLIGCIAHTFNR
                 70        80        90       100       110       120
                130       140       150       160       170       180
m241-1.pep  SLKADFHACQRMVAVHHRLAVGNIGYTIDDNIAGFRIVGFKHHADFDFNREHARIFDTDQ
            ||||||||||||||||||:||||||||||||||||||||||||||||||||||||:|||
a241        SLKADFHACQRMVAVHHRLTVGNIGYTIDDNIAGFRIVGFKHHADFDFNREHARIFNTDQ
                130       140       150       160       170       180
                190       200       210       220       230       239
m241-1.pep  LRILLAERIVGRQRHIDRIAGILTVQRLFHQRENAVVTAVQIRNRFFGFVQKLIVGIIHL
            ||||||||||||:|||||||||||||||||||||||||||||||||||||||||||||||
a241        LRILLAERIVGRKRHIDRIAGILTVQRLFHQRENAVVTAVQIRNRFFGFVQKLIVGIIHL
                190       200       210       220       230       240
                250       260
m241-1.pep  IMQRNHGIFHDSHICPFRNSRLITGAFX
            ||||||||:||||||||||||||||||
a241        IMQRNHGILHDSHICPFRNSRLITGAFX
                250       260
```

The following partial DNA sequence was identified in *N. gonorrhoeae* <SEQ ID 917>:

```
g242.seq
   1 atgatcggcg aacttgttgt tttgttcgtg atcgagcact tcaagcaacg

  51 cgctggcggg atcgccccga aagtcgctgc ccaatttgtc gatttcgtcg

 101 agcaggaaca acgggtttct tacgcctgct tttgccatat tctgcaaaat

 151 cttgccgggc atagagccga tataggtacg gcggtgcccg cggatttcgc

 201 tttcgtcgcg cacgccgccc aaggccatac ggacatattt ccgccccgtt

 251 gctttggcga tggattcgcc caaagaggtt ttgcccacgc ccggagggcc

 301 gaccaaacac agaatcggac ctttgagctt gtccatacgt ttttggacgg

 351 cgaggtattc caaaatccgt tctttgactt tttccaggcc gtagtggtcg

 401 gcatccagca ccagtccggc tttggcgatg tctttgctga cgcgggattt

 451 tttcttccac ggcagtccga gcagggtgtc gatgtagttg cgtacgacgg

 501 tggattcggc agacatcggc ggcatcattt tgagtttttt cagttcggac

 551 aggcattttt cttccgcttc tttggtcata cccgcctttt tgatgcctgc

 601 ctccaaggca tccagttcgc cgttttcgtc ttcttcgccc aattctttgt

 651 gtatcgcttt aatctgttcg ttcagataat attcgcgttg ggatttttcc

 701 atttggcgtt tgacgcgtcc gcgtatgcgt ttttcggcct gcataatgtc

 751 gagttcggat tccagctttg ccagcaggaa ttccatccgt ttgccgattt

 801 cgggaatctc caaaatctgt tggcgttgcg ccagtttcaa ctgcaaatgc

 851 gctgcgaccg tatcggttag
```

This corresponds to the amino acid sequence <SEQ ID 918; ORF 242.ng>:

```
g242.pep
   1 MIGELVVLFV IEHFKQRAGG IAPKVAAQFV DFVEQEQRVS YACFCHILQN

  51 LAGHRADIGT AVPADFAFVA HAAQGHTDIF PPRCFGDGFA QRGFAHARRA
```

-continued

```
101 DQTQNRTFEL VHTFLDGEVF QNPFFDFFQA VVVGIQHQSG FGDVFADAGF

151 FLPRQSEQGV DVVAYDGGFG RHRRHHFEFF QFGQAFFFRF FGHTRLFDAC

201 LQGIQFAVFV FFAQFFVYRF NLFVQIIFAL GFFHLAFDAS AYAFFGLHNV

251 EFGFQLCQQE FHPFADFGNL QNLLALRQFQ LQMRCDRIG*
```

The following partial DNA sequence was identified in *N. meningitidis* <SEQ ID 919>:

```
m242.seq
  1 ATGATCGGCA AACTTGTTGT TTTGTTCGGG ATCGAGCACT TCGAGCAACG

 51 CGCTGGCGGG ATCGCCTCGG AAGTCGTTAC CCAATTTGTC GATTTCGTCG

101 AGCAGGAACA AGGGGTTTTT CACGCCGGCT TTTGCCATAT TCTGCAAAAT

151 CTTACCGGGC ATAGAGCCGA TATAGGTGCG GCGGTGTCCC CTGATTTCGC

201 TTTCGTCGCG CACGCCGCCC AAAGCCATGC GGACATATTT CCGCCCCGTT

251 GCTTTGGCGA TGGATTCGCC CAAAGAGGTT TTGCCCACGC CCGGAGGGCC

301 GACCAGGCAC AGAATCGGGC CTTTGAGTTT GTCCATACGT TTTTGGACGG

351 CGAGGTATTC CAAAATCCGT TCTTTGACTT TTTCCAGGCC GTAGTGGTCG

401 GCATCCAGCA CCAGTCCGGC TTTGGCGATG TCTTTGCTGA CGCGGGATTT

451 TTTCTTCCAC GGCAGCTCGA GCAAAGTGTC GATGTAGTTG CGTACGACGG

501 TGGATTCCGC AGACATCGGT GGCATCATTT TGAGCTTTTT CAGTTCGGAC

551 AGGCATTTTT CTTCCGCTTC TTTGGTCATA CCCGCCTTTT TGATATCTGC

601 TTCCAAGGCA TCCAGTTCGC CGTTTTCGTC TTCTTCGCCC AGTTCTTTGT

651 GTATCGCTTT AATCTGTTCG TTCAGATAAT ATTCGCGCTG GGATTTTTCC

701 ATTTGGCGTT TGACGCGTCC GCGTATGCGT TTTTCGGCCT GCATAATGTC

751 GAGTTCGGAT TCCAGCTGTG CCAGCAGGAA TTCCATCCGT TTGCCGATTT

801 CGGGAATTTC CAAAATCTGT TGGCGTTGCG CCAGTTTCAA CTGCAAATGC

851 GCTGCGACCG TATCGGTTAG
```

This corresponds to the amino acid sequence <SEQ ID 920; ORF 242>:

```
m242.pep
  1 MIGKLVVLFG IEHFEQRAGG IASEVVTQFV DFVEQEQGVF HAGFCHILQN

 51 LTGHRADIGA AVSPDFAFVA HAAQSHADIF PPRCFGDGFA QRGFAHARRA

101 DQAQNRAFEF VHTFLDGEVF QNPFFDFFQA VVVGIQHQSG FGDVFADAGF

151 FLPRQLEQSV DVVAYDGGFR RHRWHHFELF QFGQAFFFRF FGHTRLFDIC

201 FQGIQFAVFV FFAQFFVYRF NLFVQIIFAL GFFHLAFDAS AYAFFGLHNV

251 EFGFQLCQQE FHPFADFGNF QNLLALRQFQ LQMRCDRIG*
```

Computer analysis of this amino acid sequence gave the following results:

Homology with a Predicted ORF from *N. gonorrhoeae*

ORF 242 shows 90.3% identity over a 289 aa overlap with a predicted ORF (ORF 242.ng) from *N. gonorrhoeae*:

```
m242/g24290.3% identity in 289 aa overlap
                    10        20        30        40        50        60
m242.pep    MIGKLVVLFGIEHFEQRAGGIASEVVTQFVDFVEQEQGVFHAGFCHILQNLTGHRADIGA
            |||:||||| ||||:|| |||| :|::|||||||||| | :| ||||||||:|||||||:
g242        MIGELVVLFVIEHFKQRAGGIAPKVAAQFVDFVEQEQRVSYACFCHILQNLAGHRADIGT
                    10        20        30        40        50        60

                    70        80        90       100       110       120
m242.pep    AVSPDFAFVAHAAQSHADIFPPRCFGDGFAQRGFAHARRADQAQNRAFEFVHTFLDGEVF
            ||  ||||||||||:|:|||||||||||||||||||||||||:|||:||:||||||||||
g242        AVPADFAFVAHAAQGHTDIFPPRCFGDGFAQRGFAHARRADQTQNRTFELVHTFLDGEVE
                    70        80        90       100       110       120

                   130       140       150       160       170       180
m242.pep    QNPFFDFFQAVVVGIQHQSGFGDVFADAGFFLPRQLEQSVDVVAYDGGFRRHRWHHFELF
            ||||||||||||||||||||||||||||||||||| ||:|||||||||| ||| ||||:|
g242        QNPFFDFFQAVVVGIQHQSGFGDVFADAGFFLPRQSEQGVDVVAYDGGFGRHRRHHFEFF
                   130       140       150       160       170       180

                   190       200       210       220       230       240
m242.pep    QFGQAFFFRFFGHTRLFDICFQGIQFAVFVFFAQFFVYRFNLFVQIIFALGFFHLAFDAS
            |||||||||||||||||| |:|||||||||||||||||||||||||||||||||||||||
g242        QFGQAFFFRFFGHTRLFDACLQGIQFAVFVFFAQFFVYRFNLFVQIIFALGFFHLAFDAS
                   190       200       210       220       230       240

                   250       260       270       280       290
m242.pep    AYAFFGLHNVEFGFQLCQQEFHPFADFGNFQNLLALRQFQLQMRCDRIGX
            |||||||||||||||||||||||||||||:||||||||||||||||||||
g242        AYAFFGLHNVEFGFQLCQQEFHPFADFGNLQNLLALRQFQLQMRCDRIGX
                   250       260       270       280
```

The following partial DNA sequence was identified in *N. meningitidis* <SEQ ID 921>:

```
a242.seq
   1 ATGATCGGCG AACTTGTTGT TTTGCTCGGG ATCAAGCACT TCGAGCAACG

  51 CGCTGGCGGG ATCGCCCCGG AAGTCGCTAN CCAATTTGTC GATTTCGTCG

 101 AGCAGGAACA ATGGGTTTTT TACGCCGGCT TTTGCCATAT TCTGCAAAAT

 151 CTTACCGGGC ATGGAGCCGA TATAGGTGCG GCGGTGTCCC CGGATTTCGC

 201 TTTCGTCGCG CACGCCGCCC AAAGCCATGC GGACATATTT CCGCCCCGTT

 251 GCTTTGGCGA TGGATTCGCC CAAAGAGGTT TTGCCCACGC CTGGAGGGCC

 301 GACCAGGCAC AGAATCGGGC CTTTGAGTTT GTCCATACGT TTTTGGACGG

 351 CGAGGTATTC CAAAATCCGT TCTTTGACTT TTTCCAGGCC GTAGTGGTCG

 401 GTATCCAGCA CCAATCCGGC TTTGGCGATG TCTTTGCTGA CGCGGGATTT

 451 TTTCTTCCAC GGCAGTTCGA GCAGGGTGTC GATGTAGTTG CGTACGACGG

 501 TGGATTCGGC AGACATCGGC GGCATCATTT TGAGCTTTTT CAGTTCGGAC

 551 AGGCATTTTT CTTCCGCTTC TTTGGTCATA CCCGCCTTTT TGATATCTGC

 601 TTCCAAGGCA TCCAGTTCGC CGTTTTCGTC TTCTTCGCCC AGTTCTTTGT

 651 GTATCGCTTT AATCTGTTCG TTCAGATAAT ATTCGCGCTG GGATTTTTCC

 701 ATTTGGCGTT TGACGCGTCC GCGTATGCGT TTTTCGGCCT GCATAATGTC

 751 GAGTTCGGAT TCCAGCTGTG CCAGCAGGAA TTCCATCCGT TTGCCGATTT

 801 CGGGAATTTC CAAAATCTGT TGGCGTTGCG CCAGTTTCAA CTGCAAATGC

 851 GCTGCGACCG TATCGGTTAG
```

This corresponds to the amino acid sequence <SEQ ID 922; ORF 242.a>:

```
a242.pep
   1 MIGELVVLLG IKHFEQRAGG IAPEVAXQFV DFVEQEQWVF YAGFCHILQN

  51 LTGHGADIGA AVSPDFAFVA HAAQSHADIF PPRCFGDGFA QRGFAHAWRA

 101 DQAQNRAFEF VHTFLDGEVF QNPFFDFFQA VVVGIQHQSG FGDVFADAGF

 151 FLPRQFEQGV DVVAYDGGFG RHRRHHFELF QFGQAFFFRF FGHTRLFDIC

 201 FQGIQFAVFV FFAQFFVYRF NLFVQIIFAL GFFHLAFDAS AYAFFGLHNV

 251 EFGFQLCQQE FHPFADFGNF QNLLALRQFQ LQMRCDRIG*
```

m242/a242 95.2% identity in 289 aa overlap

```
                        10        20        30        40        50        60
m242.pep        MIGKLVVLFGIEHFEQRAGGIASEVVTQFVDFVEQEQGVFHAGFCHILQNLTGHRADIGA
                |||:||||:||:|||||||||| ||::|||||||||| ||:||||||||||||| |||||
a242            MIGELVVLLGIKHFEQRAGGIAPEVAXQFVDFVEQEQWVFYAGFCHILQNLTGHGADIGA
                        10        20        30        40        50        60

                        70        80        90       100       110       120
m242.pep        AVSPDFAFVAHAAQSHADIFPPRCFGDGFAQRGFAHARRADQAQNRAFEFVHTFLDGEVF
                ||||||||||||||||||||||||||||||||||||| ||||||||||||||||||||||
a242            AVSPDFAFVAHAAQSHADIFPPRCFGDGFAQRGFAHAWRADQAQNRAFEFVHTFLDGEVE
                        70        80        90       100       110       120

                       130       140       150       160       170       180
m242.pep        QNPFFDFFQAVVVGIQHQSGFGDVFADAGFFLPRQLEQSVDVVAYDGGFRRHRWHHFELF
                |||||||||||||||||||||||||||||||||||:||:|||||||||| ||| ||||||
a242            QNPFFDFFQAVVVGIQHQSGFGDVFADAGFFLPRQFEQGVDVVAYDGGFGRHRRHHFELF
                       130       140       150       160       170       180

                       190       200       210       220       230       240
m242.pep        QFGQAFFFRFFGHTRLFDICFQGIQFAVFVFFAQFFVYRFNLFVQIIFALGFFHLAFDAS
                ||||||||||||||||||||||||||||||||||||||||||||||||||||||||||||
a242            QFGQAFFFRFFGHTRLFDICFQGIQFAVFVFFAQFFVYRFNLFVQIIFALGFFHLAFDAS
                       190       200       210       220       230       240

                       250       260       270       280       290
m242.pep        AYAFFGLHNVEFGFQLCQQEFHPFADFGNFQNLLALRQFQLQMRCDRIGX
                |||||||||||||||||||||||||||||||||||||||||||||||||
a242            AYAFFGLHNVEFGFQLCQQEFHPFADFGNFQNLLALRQFQLQMRCDRIGX
                       250       260       270       280
```

The following partial DNA sequence was identified in *N. gonorrhoeae* <SEQ ID 923>:

```
g243.seq
   1 ATGGTaatcg tctGGTTGCc cgAGTTaccg CCGATGCCGG CGACGATGGG

  51 CATCAGCGCG GCGAGTGCGA CGATTTTTTC gatactgcCT TCAAACGCGC

 101 CGATGACGCG GCTGGCGAGG AAGGCGGTGC AGAGGTTGAC GGCGAGCCAC

 151 ATCCAGCGGT TTTTGACGGA ATCCAAGACG GGGGCGAACA GGTCTTCCTC

 201 TTCCTGCAAA CCTGCCATGT TCAACATATC CGCTTCGGAT TCTTCGCGGA

 251 TCACGTCCAC CATCTCGTCG ATGGTAATCc tgCCGATGAG CTTTTTGTTT

 301 TCATCAACGA CGGGCGCGGT AACCAAGTCG TAG
```

This corresponds to the amino acid sequence <SEQ ID 924; ORF 243.ng>:

```
g243.pep
   1 MVIVWLPELP PMPATMGISA ASATIFSILP SNAPMTRLAR KAVQRLTASH
```

-continued

```
 51 IQRFLTESKT GANRSSSSCK PAMFNISASD SSRITSTISS MVILPMSFLF

101 SSTTGAVTKS *
```

The following partial DNA sequence was identified in *N. meningitidis* <SEQ ID 925>:

```
m243.seq
  1 ATGGTAATCG TCTGGTTGCC CGAGTTACCG CCTATGCCGG CGACGATGGG

 51 CATCAGCGCG GyGAGTGCGA CGATTTTTTC GATGCTGCCT TCAAACGCGC

101 CGATAACACG GyTGGCGAGG AAGGCGGTGC AGAGGTTGAC GGCGAGCCAC

151 ATCCAGyGGT TTTTCACCGA ATCCCACACG GGGGCGAAyA GGTCTTCCTC

201 TTCCTGCAAA CCCGCCATAT TCAGCATATC CGCTTCCGAT TCTTCGCGGA

251 TCACGTCCAC CATCTCGTCG ATGGTAATCC TGCCGATGAG CTTTTTGTTT

301 TCATCGACGA CGGGCGCGGT AACCAAGTCG TAG
```

This corresponds to the amino acid sequence <SEQ ID 926; ORF 243>:

```
m243.pep
  1 MVIVWLPELP PMPATMGISA XSATIFSMLP SNAPITRLAR KAVQRLTASH

 51 IQXFFTESHT GANRSSSSCK PAIFSISASD SSRITSTISS MVILPMSFLF

101 SSTTGAVTKS *
```

Computer analysis of this amino acid sequence gave the following results:

Homology with a Predicted ORF from *N. gonorrhoeae*

ORF 243 shows 92.7% identity over a 110 aa overlap with a predicted ORF (ORF 243.ng) from *N. gonorrhoeae*:

```
m243/g243
                    10        20        30        40        50        60
m243.pep    MVIVWLPELPPMPATMGISAXSATIFSMLPSNAPITRLARKAVQRLTASHIQXFFTESHT
            |||||||||||||||||||| ||||||:||||||:||||||||||||||||| |:|||:|
g243        MVIVWLPELPPMPATMGISAASATIFSILPSNAPMTRLARKAVQRLTASHIQRFLTESKT
                    10        20        30        40        50        60

                    70        80        90       100       110
m243.pep    GANRSSSSCKPAIFSISASDSSRITSTISSMVILPMSFLFSSTTGAVTKSX
            ||||||||||||:|:|||||||||||||||||||||||||||||||||||||
g243        GANRSSSSCKPAMFNISASDSSRITSTISSMVILPMSFLFSSTTGAVTKSX
                    70        80        90       100       110
```

The following partial DNA sequence was identified in *N. meningitidis* <SEQ ID 927>:

```
a243.seq
  1 ATGGTAATCG TCTGGTTGCC CGAGTTACCG CCTATGCCGG CGACGATGGG

 51 CATCAGCGCG GCGAGTGCGA CGATTTTTTC GATGCTGCCT TCAAACGCGC

101 CGATAACACG GCTGGCGAGG AAGGCGGTGC AGAGGTTGAC GGCGAGCCAC

151 ATCCAGCGGT TTTTGACGGA ATCCAAGACG GGGGCGAATA AGTCTTCCTC

201 TTCTTGCAAA CCCGCCATAT TCAACATATC CGCTTCGGAT TCTTCGCGGA

251 TCACGTCCAC CATTTCGTCA ACGGTCACCC TGCCGATGAG CTTTTTGTTT

301 TCATCGACGA CGGGCGCGGT AACCAAGTCA TAG
```

This corresponds to the amino acid sequence <SEQ ID 928; ORF 243.a>:

```
a243.pep
   1 MVIVWLPELP PMPATMGISA ASATIFSMLP SNAPITRLAR KAVQRLTASH

  51 IQRFLTESKT GANKSSSSCK PAIFNISASD SSRITSTISS TVTLPMSFLF

 101 SSTTGAVTKS *
```

m243/a243 92.7% identity in 110 aa overlap

```
                     10        20        30        40        50        60
m243.pep     MVIVWLPELPPMPATMGISAXSATIFSMLPSNAPITRLARKAVQRLTASHIQXFFTESHT
             |||||||||||||||||||| ||||||||||||||||||||||||||||||| |:|||:|
a243         MVIVWLPELPPMPATMGISAASATIFSMLPSNAPITRLARKAVQRLTASHIQRFLTESKT
                     10        20        30        40        50        60

                     70        80        90       100       110
m243.pep     GANRSSSSCKPAIFSISASDSSRITSTISSMVILPMSFLFSSTTGAVTKSX
             |||:||||||||||:|||||||||||||||| | |||||||||||||||||
a243         GANKSSSSCKPAIFNISASDSSRITSTISSTVTLPMSFLFSSTTGAVTKSX
                     70        80        90       100       110
```

The following partial DNA sequence was identified in *N. gonorrhoeae* <SEQ ID 929>:

```
g244.seq
   1 atgccgcctg aagcccggcc ggcgggttca gacggcattg ccgctttact

  51 tcgatcggtt tatacgcaaa acgcgcttca ggaaataaat cagattattc

 101 cccagacgcc ttcaggcttc cttccgtgcc accgtaacca tagccgggcg

 151 caacacacgg tcggacaggg tataaccctt cttcatcaca ccaaccacgg

 201 tattgggttc ctgctcactg gccaccgcct gcatcgcctg atggatattc

 251 ggatcgagct tatcgcccgc tttaggattg atttccttga tttgcgtggc

 301 atcaaacgcc ttctgcaact cattcaaagt catctgcaca cccattttca

 351 gcgcatcgaa attaccgctc tgatccaaaa gcgccatttc cagataatcc

 401 ttgaccggca acatttccac ggcaaacttc tgtccggcga acttgtgcgt

 451 atcggcaatt tcctgctggt ggcggcggcg caggttttgc tcgtttgcca

 501 aagcgcgcag ttgttcgtct ttcaactgcg cttccagctc ggcaatccgc

 551 gcctgcaaat cctcataagc cggctcggcg gcagcctgtt cctgtacacc

 601 gtccgcattt cctactgtct cgacggtttc caccgcctcc acattttcaa

 651 ccgcttcttc actgttttgc tgctgtgtct gttcgctcat atcgtatccc

 701 tcaaaacaaa ttggaaatca aaatccggtt attacccgag caagataagg

 751 acattttcaa gaaacttcaa gcaaaggcag gaaatttcac atccgccgcc

 801 gaatacccta ccgcaaaaac catataaacg gtaa
```

This corresponds to the amino acid sequence <SEQ ID 930; ORF 244.ng>:

```
g244.pep
   1 MPPEARPAGS DGIAALLRSV YTQNALQEIN QIIPQTPSGF LPCHRNHSRA

  51 QHTVGQGITL LHHTNHGIGF LLTGHRLHRL MDIRIELIAR FRIDFLDLRG

 101 IKRLLQLIQS HLHTHFQRIE ITALIQKRHF QIILDRQHFH GKLLSGELVR
```

-continued

```
151 IGNFLLVAAA QVLLVCQSAQ LFVFQLRFQL GNPRLQILIS RLGGSLFLYT

201 VRISYCLDGF HRLHIFNRFF TVLLLCLFAH IVSLKTNWKS KSGYYPSKIR

251 TFSRNFKQRQ EISHPPPNTL PQKPYKR*
```

The following partial DNA sequence was identified in *N. meningitidis* <SEQ ID 931>:

```
m244.seq
  1 ATGCCGTCTG AAGCCCGACA GGCGGGTTCA GACGGCATTG CCGCTTTACT

 51 TCGATCGGTT TATACGCAAA ACGCGCTTCA GGAAATAAAT CAGATTATTC

101 CCCAGACGCC TTCAGGCTTC CTTCTGCGCC ACCGTAACCA TAGCCGGGCG

151 CAACACGCGG TCGGACAGCG TATAACCCTT CTTCATCACA CCCACCACGG

201 TATTCGGCTC CTGTTCGCTT GCCACCGCCT GCATCGCCTG ATGGATATTC

251 GGATCGAGCT TATCGCCCGC TTTAGGGTTG ATTTCCTTGA TTTGCGTAGC

301 ATCAAATGCT TTCTGCAACT CGTTCAAAGT CATCTGCACG CCCATTTTCA

351 GCGCATCGAA ATTGCCGCTC TGATCCAAAA GCGCCATTTC CAGATAATCC

401 TTGACCGGCA GCATTTCCAC GGCAAACTTC TGTCCGGCGA ACTTGTGCGT

451 ATCCGCAATT TyCTGCTGGT GGCGGCGGCG CAGGTTTTGC TCGTTTGCCA

501 AAGCGCGCTG CTCGTCTTTC AACTGCGTTT CCAGCTCGGC AATCCGCGCC

551 TGCAAATCCT CATAAGCCGG CTCTGCGGCA GCCTGTTCCT GCACACCGTC

601 CGCATTTCCT ACTGTTTCGA CGGTTTCCAC CGCCTCCACA TTTTCAACCG

651 CTTCTTCACT GTTTTGCTGC TGTGTCTGTT CGCTCATATC GTATCCCTTA

701 AAACAAATTG GAAATCAAAA TCCAGTTATT ACCCGCGCAA GATAAGGACA

751 TTTTCAAGAA ACTTCAAkCA AAAkCAGAGA ATTTCAAATT CATTTTCAAA

801 TCCCCTACCG AAAAAATAAT ATAGACGGTA A
```

This corresponds to the amino acid sequence <SEQ ID 932; ORF 244>:

```
m244.pep
  1 MPSEARQAGS DGIAALLRSV YTQNALQEIN QIIPQTPSGF LLRHRNHSRA

 51 QHAVGQRITL LHHTHHGIRL LFACHRLHRL MDIRIELIAR FRVDFLDLRS

101 IKCFLQLVQS HLHAHFQRIE IAALIQKRHF QIILDRQHFH GKLLSGELVR

151 IRNFLLVAAA QVLLVCQSAL LVFQLRFQLG NPRLQILISR LCGSLFLHTV

201 RISYCFDGFH RLHIFNRFFT VLLLCLFAHI VSLKTNWKSK SSYYPRKIRT

251 FSRNFXQXQR ISNSFSNPLP KKXYRR*
```

Computer analysis of this amino acid sequence gave the following results:

Homology with a Predicted ORF from *N. gonorrhoeae*

ORF 244 shows 86.3% identity over a 277 aa overlap with a predicted ORF (ORF 244.ng) from *N. gonorrhoeae*:

```
M244/G244

                      10        20        30        40        50        60
m244.pep      MPSEARQAGSDGIAALLRSVYTQNALQEINQIIPQTPSGFLLRHRNHSRAQHAVGQRITL
              || ||| ||||||||||||||||||||||||||||||||||  |||||||||:||| |||
g244          MPPEARPAGSDGIAALLRSVYTQNALQEINQIIPQTPSGFLPCHRNHSRAQHTVGQGITL
                      10        20        30        40        50        60
                      70        80        90       100       110       120
m244.pep      LHHTHHGIRLLFACHRLHRLMDIRIELIARFRVDFLDLRSIKCFLQLVQSHLHAHFQRIE
              ||||:||| :|:: ||||||||||||||||||:||||||:|| :|||:|||||:||||||
g244          LHHTNHGIGFLLTGHRLHRLMDIRIELIARFRIDFLDLRGIKRLLQLIQSHLHTHFQRIE
                      70        80        90       100       110       120
                     130       140       150       160       170       180
m244.pep      IAALIQKRHFQIILDRQHFHGKLLSGELVRIRNFLLVAAAQVLLVCQSAALLVFQLRFQL
              |:||||||||||||||||||||||||||||| ||||||||||||||||| |:||||||||
g244          ITALIQKRHFQIILDRQHFHGKLLSGELVRIGNFLLVAAAQVLLVCQSAQLFVFQLRFQL
                     130       140       150       160       170       180
                     190       200       210       220       230       240
m244.pep      GNPRLQILISRLCGSLFLHTVRISYCFDGFHRLHIFNRFFTVLLLCLFAHIVSLKTNWKS
              |||||||||||| |||||:|||||||:|||||||||||||||||||||||||||||||||
g244          GNPRLQILISRLGGSLFLYTVRISYCLDGFHRLHIFNRFFTVLLLCLFAHIVSLKTNWKS
                     190       200       210       220       230       240
                     250       260       270
m244.pep      KSSYYPRKIRTFSRNFXQXQRISNSFSNPLPKKXYRRX
              ||:||| ||||||||| | |:||:   | ||:| |:||
g244          KSGYYPSKIRTFSRNFKQRQEISHPPPNTLPQKPYKRX
                     250       260       270
```

The following partial DNA sequence was identified in *N. meningitidis* <SEQ ID 933>:

```
a244.seq
   1 ATGCCGTCTG AAGCCCGACA GGCGGGTTCA GACGGCATTG CCGCTTTACT

  51 TCGATCGGTT TATACGCAAA ACGCGCTTCA GGAAATAAAT CAGATTATTC

 101 CCCAGACGCC TTCAGGCTTC CTTCTGTGCC ACCGTAACCA TAGCCGGGCG

 151 CAACACGCGG TCGGACAGCG TATAACCCTT CTTCATCACG CCCACCACGG

 201 TATTGGGTTC CTGTTCGCTT GCCACCGCCT GCATCGCCTG ATGGATATTC

 251 GGATCGAGCT TATCGCCCGC TTTAGGATTG ATTTCCTTGA TTTGCGTAGC

 301 ATCAAATGCT TTCTGCAACT CGTTCAAAGT CATCTGCACG CCCATTTTCA

 351 GCGCATCGAA ATTGCCGCTC TGATCCAAAA GCGCCATTTC CAGATAATCC

 401 TTGACCGGCA GCATTTCCAC GGCAAACTTC TGTCCGGCGA ACTTGTGCGT

 451 ATCCGCAATT TCCTGCTGGT GGCGGCGGCG CAGGTTTTGC TCGTTTGCCA

 501 AAGCGCGCAG CTGCTCGTCT TTCAACTGCG CTTCCAGCTC GGCAATCCGC

 551 GCCTGCAAAT CCTCATAAGC CGGCTCTGCG GCAGCCTGTT CCTGCACACC

 601 GTCCGCATTT CCTACTGTCT CGACGGTTTC CACCGCCTCC ACATTTTCAA

 651 CCGCTTCTTC ACTGTTTTGC TGCTGTGTCT GTTCGCTCAT ATCGTATCCC

 701 TTAAAACAAA TTGGAAATCA AAATCCAGTT ATTACCCGCG CAAGATAAGG
```

-continued

```
751 ACATTTTCAA GAAACTTCAA GCAAAGGCAG AGAATTTCAA ATTCATTTTC

801 AAATCCCCTA CCGAAAAAAT AATATAGACG GTAA
```

This corresponds to the amino acid sequence <SEQ ID 934; ORF 244.a>:

```
a244.pep
  1 MPSEARQAGS DGIAALLRSV YTQNALQEIN QIIPQTPSGF LLCHRNHSRA

 51 QHAVGQRITL LHHAHHGIGF LFACHRLHRL MDIRIELIAR FRIDFLDLRS

101 IKCFLQLVQS HLHAHFQRIE IAALIQKRHF QIILDRQHFH GKLLSGELVR

151 IRNFLLVAAA QVLLVCQSAQ LLVFQLRFQL GNPRLQILIS RLCGSLFLHT

201 VRISYCLDGF HRLHIFNRFF TVLLLCLFAH IVSLKTNWKS KSSYYPRKIR

251 TFSRNFKQRQ RISNSFSNPL PKK*YRR*
```

m244/a244 96.8% identity in 277 aa overlap

```
                     10        20        30        40        50        60
m244.pep    MPSEARQAGSDGIAALLRSVYTQNALQEINQIIPQTPSGFLLRHRNHSRAQHAVGQRITL
            |||||||||||||||||||||||||||||||||||||||||| |||||||||||||||||
a244        MPSEARQAGSDGIAALLRSVYTQNALQEINQIIPQTPSGFLLCHRNHSRAQHAVGQRITL
                     10        20        30        40        50        60
                     70        80        90       100       110       120
m244.pep    LHHTHHGIRLLFACHRLHRLMDIRIELIARFRVDFLDLRSIKCFLQLVQSHLHAHFQRIE
            |||:|||| :|||||||||||||||||||||||:||||||||||||||||||||||||||
a244        LHHAHHGIGFLFACHRLHRLMDIRIELIARFRIDFLDLRSIKCFLQLVQSHLHAHFQRIE
                     70        80        90       100       110       120
                    130       140       150       160       170       179
m244.pep    IAALIQKRHFQIILDRQHFHGKLLSGELVRIRNFLLVAAAQVLLVCQSA-LLVFQLRFQL
            ||||||||||||||||||||||||||||||||||||||||||||||||| ||||||||||
a244        IAALIQKRHFQIILDRQHFHGKLLSGELVRIRNFLLVAAAQVLLVCQSAQLLVFQLRFQL
                    130       140       150       160       170       180
          180       190       200       210       220       230       239
m244.pep    GNPRLQILISRLCGSLFLHTVRISYCFDGFHRLHIFNRFFTVLLLCLFAHIVSLKTNWKS
            ||||||||||||||||||||||||||:|||||||||||||||||||||||||||||||||
a244        GNPRLQILISRLCGSLFLHTVRISYCLDGFHRLHIFNRFFTVLLLCLFAHIVSLKTNWKS
                    190       200       210       220       230       240
          240       250       260       270
m244.pep    KSSYYPRKIRTFSRNFXQXQRISNSFSNPLPKKXYRRX
            |||||||||||||||| | |||||||||||||||||||
a244        KSSYYPRKIRTFSRNFKQRQRISNSFSNPLPKKXYRRX
                    250       260       270
```

The following partial DNA sequence was identified in *N. gonorrhoeae* <SEQ ID 935>:

```
g244-1.seq
  1 atgccgcctg aagcccggcc ggcgggttca gacggcattg ccgctttact

 51 tcgatcggtt tatacgcaaa acgcgcttca ggaaataaat cagattattc

101 cccagacgcc ttcaggcttc cttccgtgcc accgtaacca tagccgggcg

151 caacacacgg tcggacaggg tataaccctt cttcatcaca ccaaccacgg

201 tattgggttc ctgctcactg gccaccgcct gcatcgcctg atggatattc

251 ggatcgagct tatcgcccgc tttaggattg atttccttga tttgcgtggc

301 atcaaacgcc ttctgcaact cattcaaagt catctgcaca cccattttca
```

-continued

```
351 gcgcatcgaa attaccgctc tgatccaaaa gcgccatttc cagataatcc

401 ttgaccggca acatttccac ggcaaacttc tgtccggcga acttgtgcgt

451 atcggcaatt tcctgctggt ggcggcggcg caggttttgc tcgtttgcca

501 aagcgcgcag ttgttcgtct ttcaactgcg cttccagctc ggcaatccgc

551 gcctgcaaat cctcataagc cggctcggcg gcagcctgtt cctgtacacc

601 gtccgcattt cctactgtct cgacggtttc caccgcctcc acattttcaa

651 ccgcttcttc actgttttgc tgctgtgtct gttcgctcat atcgtatccc

701 tcaaaacaaa ttggaaatca aaatccggtt attacccgag caagataagg

751 acattttcaa gaaacttcaa gcaaaggcag gaaatttcac atccgccgcc

801 gaatacccta ccgcaaaaac catataaacg gtaa
```

This corresponds to the amino acid sequence <SEQ ID 936; ORF 244-1.ng>:

```
g244-1.pep
  1 MPPEARPAGS DGIAALLRSV YTQNALQEIN QIIPQTPSGF LPCHRNHSRA

 51 QHTVGQGITL LHHTNHGIGF LLTGHRLHRL MDIRIELIAR FRIDFLDLRG

101 IKRLLQLIQS HLHTHFQRIE ITALIQKRHF QIILDRQHFH GKLLSGELVR

151 IGNFLLVAAA QVLLVCQSAQ LFVFQLRFQL GNPRLQILIS RLGGSLFLYT

201 VRISYCLDGF HRLHIFNRFF TVLLLCLFAH IVSLKTNWKS KSGYYPSKIR

251 TFSRNFKQRQ EISHPPPNTL PQKPYKR*
```

The following partial DNA sequence was identified in *N. meningitidis* <SEQ ID 937>:

```
m244-1.seq
  1 ATGCCGTCTG AAGCCCGACA GGCGGGTTCA GACGGCATTG CCGCTTTACT

 51 TCGATCGGTT TATACGCAAA ACGCGCTTCA GGAAATAAAT CAGATTATTC

101 CCCAGACGCC TTCAGGCTTC CTTCTGCGCC ACCGTAACCA TAGCCGGGCG

151 CAACACGCGG TCGGACAGCG TATAACCCTT CTTCATCACA CCCACCACGG

201 TATTCGGCTC CTGTTCGCTT GCCACCGCCT GCATCGCCTG ATGGATATTC

251 GGATCGAGCT TATCGCCCGC TTTAGGGTTG ATTTCCTTGA TTTGCGTAGC

301 ATCAAATGCT TTCTGCAACT CGTTCAAAGT CATCTGCACG CCCATTTTCA

351 GCGCATCGAA ATTGCCGCTC TGATCCAAAA GCGCCATTTC CAGATAATCC

401 TTGACCGGCA GCATTTCCAC GGCAAACTTC TGTCCGGCGA ACTTGTGCGT

451 ATCCGCAATT TyCTGCTGGT GGCGGCGGCG CAGGTTTTGC TCGTTTGCCA

501 AAGCGCGCTG CTCGTCTTTC AACTGCGTTT CCAGCTCGGC AATCCGCGCC

551 TGCAAATCCT CATAAGCCGG CTCTGCGGCA GCCTGTTCCT GCACACCGTC

601 CGCATTTCCT ACTGTTTCGA CGGTTTCCAC CGCCTCCACA TTTTCAACCG

651 CTTCTTCACT GTTTTGCTGC TGTGTCTGTT CGCTCATATC GTATCCCTTA

701 AAACAAATTG GAAATCAAAA TCCAGTTATT ACCCGCGCAA GATAAGGACA

751 TTTTCAAGAA ACTTCAAkCA AAAkCAGAGA ATTTCAAATT CATTTTCAAA

801 TCCCCTACCG AAAAAATAA
```

This corresponds to the amino acid sequence <SEQ ID 938; ORF 244-1>:

```
m244-1.pep

1  MPSEARQAGS DGIAALLRSV YTQNALQEIN QIIPQTPSGF LLRHRNHSRA

51  QHAVGQRITL LHHTHHGIRL LFACHRLHRL MDIRIELIAR FRVDFLDLRS

101  IKCFLQLVQS HLHAHFQRIE IAALIQKRHF QIILDRQHFH GKLLSGELVR

151  IRNFLLVAAA QVLLVCQSAL LVFQLRFQLG NPRLQILISR LCGSLFLHTV

201  RISYCFDGFH RLHIFNRFFT VLLLCLFAHI VSLKTNWKSK SSYYPRKIRT

251  FSRNFXQXQR ISNSFSNPLP KK*
```

```
m244-1/G244-1  86.3% identity in 277 aa overlap 10        20        30        40        50        60
m244-1.pep      MPSEARQAGSDGIAALLRSVYTQNALQEINQIIPQTPSGFLLRHRNHSRAQHAVGQRITL
                || ||| ||||||||||||||||||||||||||||||||||  |||||||||:||| |||
g244-1          MPPEARPAGSDGIAALLRSVYTQNALQEINQIIPQTPSGFLPCHRNHSRAQHTVGQGITL
                         10        20        30        40        50        60

70        80        90       100       110       120
m244-1.pep      LHHTHHGIRLLFACHRLHRLMDIRIELIARFRVDFLDLRSIKCFLQLVQSHLHAHFQRIE
                ||||:||| :|:: ||||||||||||||||||:||||||:|| :|||:|||||:||||||
g244-1          LHHTNHGIGFLLTGHRLHRLMDIRIELIARFRIDFLDLRGIKRLLQLIQSHLHTHFQRIE
                         70        80        90       100       110       120

130       140       150       160       170       180
m244-1.pep      IAALIQKRHFQIILDRQHFHGKLLSGELVRIRNFLLVAAAQVLLVCQSAALLVFQLRFQL
                |:||||||||||||||||||||||||||||| ||||||||||||||||| |:||||||||
g244-1          ITALIQKRHFQIILDRQHFHGKLLSGELVRIGNFLLVAAAQVLLVCQSAQLFVFQLRFQL
                        130       140       150       160       170       180

190       200       210       220       230       240
m244-1.pep      GNPRLQILISRLCGSLFLHTVRISYCFDGFHRLHIFNRFFTVLLLCLFAHIVSLKTNWKS
                |||||||||||| |||||:|||||||:|||||||||||||||||||||||||||||||||
g244-1          GNPRLQILISRLGGSLFLYTVRISYCLDGFHRLHIFNRFFTVLLLCLFAHIVSLKTNWKS
                        190       200       210       220       230       240

250       260       270
m244-1.pep      KSSYYPRKIRTFSRNFXQXQRISNSFSNPLPKKX
                ||:||| ||||||||| | |:||:   | ||:|
g244-1          KSGYYPSKIRTFSRNFKQRQEISHPPPNTLPQKPYKRX
                          250       260       270
```

The following partial DNA sequence was identified in *N. meningitidis* <SEQ ID 939>:

```
a244-1.seq
   1 ATGCCGTCTG AAGCCCGACA GGCGGGTTCA GACGGCATTG CCGCTTTACT

51 TCGATCGGTT TATACGCAAA ACGCGCTTCA GGAAATAAAT CAGATTATTC

101 CCCAGACGCC TTCAGGCTTC CTTCTGTGCC ACCGTAACCA TAGCCGGGCG

151 CAACACGCGG TCGGACAGCG TATAACCCTT CTTCATCACG CCCACCACGG

201 TATTGGGTTC CTGTTCGCTT GCCACCGCCT GCATCGCCTG ATGGATATTC

251 GGATCGAGCT TATCGCCCGC TTTAGGATTG ATTTCCTTGA TTTGCGTAGC

301 ATCAAATGCT TTCTGCAACT CGTTCAAAGT CATCTGCACG CCCATTTTCA

351 GCGCATCGAA ATTGCCGCTC TGATCCAAAA GCGCCATTTC CAGATAATCC

401 TTGACCGGCA GCATTTCCAC GGCAAACTTC TGTCCGGCGA ACTTGTGCGT

451 ATCCGCAATT TCCTGCTGGT GGCGGCGGCG CAGGTTTTGC TCGTTTGCCA

501 AAGCGCGCAG CTGCTCGTCT TTCAACTGCG CTTCCAGCTC GGCAATCCGC

551 GCCTGCAAAT CCTCATAAGC CGGCTCTGCG GCAGCCTGTT CCTGCACACC

601 GTCCGCATTT CCTACTGTCT CGACGGTTTC CACCGCCTCC ACATTTTCAA

651 CCGCTTCTTC ACTGTTTTGC TGCTGTGTCT GTTCGCTCAT ATCGTATCCC

701 TTAAAACAAA TTGGAAATCA AAATCCAGTT ATTACCCGCG CAAGATAAGG
```

-continued

```
751 ACATTTTCAA GAAACTTCAA GCAAAGGCAG AGAATTTCAA ATTCATTTTC

801 AAATCCCCTA CCGAAAAAAT AA
```

This corresponds to the amino acid sequence <SEQ ID 940; ORF 244-1.a>:

```
a244-1.pep
      1 MPSEARQAGS DGIAALLRSV YTQNALQEIN QIIPQTPSGF LLCHRNHSRA

     51 QHAVGQRITL LHHAHHGIGF LFACHRLHRL MDIRIELIAR FRIDFLDLRS

    101 IKCFLQLVQS HLHAHFQRIE IAALIQKRHF QIILDRQHFH GKLLSGELVR

    151 IRNFLLVAAA QVLLVCQSAQ LLVFQLRFQL GNPRLQILIS RLCGSLFLHT

    201 VRISYCLDGF HRLHIFNRFF TVLLLCLFAH IVSLKTNWKS KSSYYPRKIR

    251 TFSRNFKQRQ RISNSFSNPL PKK*

m244-1/a244-1  96.8% identity in 274 aa overlap

                      10        20        30        40        50        60
m244-1.pep  MPSEARQAGSDGIAALLRSVYTQNALQEINQIIPQTPSGFLLRHRNHSRAQHAVGQRITL
            |||||||||||||||||||||||||||||||||||||||||| |||||||||||||||||
a244-1      MPSEARQAGSDGIAALLRSVYTQNALQEINQIIPQTPSGFLLCHRNHSRAQHAVGQRITL
                      10        20        30        40        50        60
                      70        80        90       100       110       120
m244-1.pep  LHHTHHGIRLLFACHRLHRLMDIRIELIARFRVDFLDLRSIKCFLQLVQSHLHAHFQRIE
            |||:|||| :||||||||||||||||||||||:|||||||||||||||||||||||||||
a244-1      LHHAHHGIGFLFACHRLHRLMDIRIELIARFRIDFLDLRSIKCFLQLVQSHLHAHFQRIE
                      70        80        90       100       110       120
                    130       140       150       160       170       179
m244-1.pep  IAALIQKRHFQIILDRQHFHGKLLSGELVRIRNFLLVAAAQVLLVCQSA-LLVFQLRFQL
            ||||||||||||||||||||||||||||||||||||||||||||||||| ||||||||||
a244-1      IAALIQKRHFQIILDRQHFHGKLLSGELVRIRNFLLVAAAQVLLVCQSAQLLVFQLRFQL
                    130       140       150       160       170       180
          180       190       200       210       220       230       239
m244-1.pep  GNPRLQILISRLCGSLFLHTVRISYCFDGFHRLHIFNRFFTVLLLCLFAHIVSLKTNWKS
            ||||||||||||||||||||||||||:|||||||||||||||||||||||||||||||||
a244-1      GNPRLQILISRLCGSLFLHTVRISYCLDGFHRLHIFNRFFTVLLLCLFAHIVSLKTNWKS
                    190       200       210       220       230       240
          240       250       260       270
m244-1.pep  KSSYYPRKIRTFSRNFXQXQRISNSFSNPLPKKX
            |||||||||||||||| | |||||||||||||||
a244-1      KSSYYPRKIRTFSRNFKQRQRISNSFSNPLPKKX
                    250       260       270
```

The following partial DNA sequence was identified in *N. gonorrhoeae* <SEQ ID 941>:

```
g246.seq
   1 atgtacgggc ggaacggtag tactcaagcg gccgttgcct tcgttttcga

  51 ccagacacag cgtgcccgtt tcggcaacgg cgaagtttac gccgctcaag

 101 ccgacatcgg cagtgctgta aatatcgcgc agggctttgc gggcgaatcc

 151 ggtcagttgg tccacgtcgt ctgtaagcgg tgtgccgagg ttttggtgga

 201 acagttcgct gacctgttct ttggttttat ggattgcggg catcacgata

 251 tgggtcggtt tttcgcctgc catttggacg ataaactcgc ccaagtcgct

 301 ttccaccgcc ttaatgcctt ttgcttcaag ataatggttc agctcgattt

 351 cttcgctgac catggatttg cctttgacca tcagcttgcc gtttttggct
```

-continued

```
401 gtgatgatgt cgtggataat ttggcaggct tcggcagggg tttccgccca

451 gtgtactttc acgcccaact tagtcaggtt ttcttccaac tgctccagca

501 gcgcgggtaa
```

This corresponds to the amino acid sequence <SEQ ID 942; ORF 246.ng>:

```
g246.pep
  1 MYGRNGSTQA AVAFVFDQTQ RARFGNGEVY AAQADIGSAV NIAQGFAGES

 51 GQLVHVVCKR CAEVLVEQFA DLFFGFMDCG HHDMGRFFAC HLDDKLAQVA

101 FHRLNAFCFK IMVQLDFFAD HGFAFDHQLA VFGCDDVVDN LAGFGRGFRP

151 VYFHAQLSQV FFQLLQQRG*
```

The following partial DNA sequence was identified in *N. meningitidis* <SEQ ID 943>:

```
m246.seq (partial)
  1 ATGCACGGGC GGTACGGTGG TACTCAAGCG ACCGTTgCTT CGTTTTCCAC

 51 CAGACACAGC GTACCTGTTT CAGCAACGGC AAAGTTTACG CCACTCAAAC

101 CGACATCGGC AGTGCTGTAA ATATCGCGCA GTGCTTTACG GGCGAAGCCG

151 GTCAGTTGGT CTACATCGTC TGTCAGCGGC GTACCGAGGT TTTGGTGGAA

201 CAGTTCGCTA ACCTGTTCTT TGGTTTTGTG GATAGCAGGC ATCACGATAT

251 GGGTCGGTTT TTCGCCTGCC ATTTGGACGA TGAACTCGCC CAAGTCGCTT

301 TCTACCGCTT TAATGCyTTT TGCTTCAAGA TAATGrTTCA GCTCGATTTC

351 CTCGCTGACC ATCGATTTGC CTTTGACCAT CAGCTTGCCG TTTTTGGCTG

401 TGATGATGTC GTGGATAATT TGGCAGGCTT CGGTCGGGGT TTCTGCCCG...
```

This corresponds to the amino acid sequence <SEQ ID 944; ORF 246>:

```
m246.pep (partial)
  1 MHGRYGGTQA TVAFVFHQTQ RTCFSNGKVY ATQTDIGSAV NIAQCFTGEA

 51 GQLVYIVCQR RTEVLVEQFA NLFFGFVDSR HHDMGRFFAC HLDDELAQVA

101 FYRFNAFCFK IMXQLDFLAD HRFAFDHQLA VFGCDDVVDN LAGFGRGFCP...
```

Computer analysis of this amino acid sequence gave the following results:

Homology with a Predicted ORF from *N. gonorrhoeae*

ORF 246 shows 80.0% identity over a 150 aa overlap with a predicted ORF (ORF 246.ng) from *N. gonorrhoeae*:

```
m246/g246

                    10        20        30        40        50        60
m246.pep    MHGRYGGTQATVAFVFHQTQRTCFSNGKVYATQTDIGSAVNIAQCFTGEAGQLVYIVCQR
            |:|| |:|||:||||| ||||: |:||:|||:|:||||||||| |:||:||||::||:|
g246        MYCRNGSTQAAVAFVFDQTQRARFGNGEVYAAQADIGSAVNIAQGFAGESGQLVHVVCKR
                    10        20        30        40        50        60

                    70        80        90       100       110       120
m246.pep    RTEVLVEQFANLFFGFVDSRHHDMGRFFACHLDDELAQVAFYRFNAFCFKIMXQLDFLAD
             :||||||||:|||||:|  ||||||||||||||:||||||:|:|||||||| ||||:||
g246        CAEVLVEQFADLFFGFMDCGHHDMGRFFACHLDDKLAQVAFHRLNAFCFKIMVQLDFFAD
                    70        80        90       100       110       120
```

-continued

```
                    130       140       150
m246.pep    HRFAFDHQLAVFGCDDVVDNLAGFGRGFCP
            | |||||||||||||||||||||||||| |
g246        HGFAFDHQLAVFGCDDVVDNLAGFGRGFRPVYFHAQLSQVFFQLLQQRGX
                    130       140       150       160
```

The following partial DNA sequence was identified in *N. meningitidis* <SEQ ID 945>:

```
a246.seq (partial)
  1 ATGCACGGGC GGAACGGTGG TACTCAAGCG ACCGTTGCCT TCGTTTTCCA

 51 CCAGACACAG CGTACCTGTT TCAGCAACGG CGAAGTTCAC GCCACTCAAA

101 CCGACATCGG CAGTGCTGTA AATATCGCGC AGTGCTTTAC GGGCGAAGCC

151 GGTCAGTTGG TCTACGTCGT CCGTTAACGG TGTGCCGAGG TTTTGGTGGA

201 ACAGTTCGCT AACCTGTTCT TTGGTTTTAT GGATTGCGGG CATCACGATA

251 TGGGTCGGTT TTTCACCTGC CATTTGGACG ATGAACTCGC CCAAGTCGCT

301 TTCCACCGCT TTAATGCCTT TTGCTTCAAG ATAATGGTTC AGCTCGATTT

351 CCTCGCTGAC CATCGATTTG CCTTTGACCA TCAGCTTGCC GTTTTTGGCT

401 GTGATGATGT CGTGGATGAT TTCGCAGGCT TCGGCCGGTG TTTCCGCCCA

451 GTGTACTTTT ACGCCCAACT TGGTCAGGTT TTCTTCCAGC TGCTCCAGCA

501 G
```

This corresponds to the amino acid sequence <SEQ ID 946; ORF 246.a>:

```
a246.pep (partial)
  1 MHGRNGGTQA TVAFVFHQTQ RTCFSNGEVH ATQTDIGSAV NIAQCFTGEA

 51 GQLVYVVR*R CAEVLVEQFA NLFFGFMDCG HHDMGRFFTC HLDDELAQVA

101 FHRFNAFCFK IMVQLDFLAD HRFAFDHQLA VFGCDDVVDD FAGFGRCFRP

151 VYFYAQLGQV FFQLLQQ
```

m246/a246 88.0% identity in 150 aa overlap

```
                     10        20        30        40        50        60
m246.pep    MHGRYGGTQATVAFVFHQTQRTCFSNGKVYATQTDIGSAVNIAQCFTGEAGQLVYIVCQR
            |||| ||||||||||||||||||||||:|:|||||||||||||||||||||||||:|  |
a246        MHGRNGGTQATVAFVFHQTQRTCFSNGEVHATQTDIGSAVNIAQCFTGEAGQLVYVVRXR
                     10        20        30        40        50        60
                     70        80        90       100       110       120
m246.pep    RTEVLVEQFANLFFGFVDSRHHDMGRFFACHLDDELAQVAFYRFNAFCFKIMXQLDFLAD
             :||||||||||||||:|  ||||||||:||||||||||||:|||||||||| |||||||
a246        CAEVLVEQFANLFFGFMDCGHHDMGRFFTCHLDDELAQVAFHRFNAFCFKIMVQLDFLAD
                     70        80        90       100       110       120
                    130       140       150
m246.pep    HRFAFDHQLAVFGCDDVVDNLAGFGRGFCP
            |||||||||||||||||||::||||| | |
a246        HRFAFDHQLAVFGCDDVVDDFAGFGRCFRPVYFYAQLGQVFFQLLQQ
                    130       140       150       160
```

The following partial DNA sequence was identified in *N. gonorrhoeae* <SEQ ID 947>:

```
g247.seq
   1 atgaaacgta aaatgctaaa cgtaccaaag ggcggttatg atggtatgaa

  51 gggttttacc attgttgaat ttctggttgc gggcctgctc agtataattg

 101 tcctgatagc ggtcgtatcg agttacttta catcccggaa attaaatgat

 151 gtggcaaacg agcgtcttgc cattcaacag gatttgcgga atgcggcaac

 201 attaattgtc cgcgatgcaa gaatggcggg gagcttcggt tgtttcaata

 251 tgtccgagca tactaaagac gatattgttg attcaagtaa tcaaactcaa

 301 tctaaccttg caaaacccgg tgccaaacaa gaaaatcccc ttttttcctt

 351 aaaaaggagc ggcatggata aacaactgat tcccgttgct gaatccatag

 401 atattaaata tccgggtttt atccagcgcc ttaacgcatt ggttttccaa

 451 tacggtatcg atgatcttga tgcgagtgct gagactgttg tagtcagcag

 501 ctgttccaaa atagcaaaac cgggtaagaa aatatctacc ttgcaagaag

 551 caaagagtgc attacagatt actaatgatg ataaacaaaa tggaaatatc

 601 acccgtcaga aacatgtggt caatgcctat gcggtcggca ggtttggcaa

 651 taatgaggaa agtttgttcc gcttccaatt ggatgataag ggcaagtggg

 701 gtaatcctca gttgctcgtg aaaaaggtta aacgtatgga tgtgcggtat

 751 atttatgttt ccggttgtcc tgaagatgaa gatgccggca aagaggaaaa

 801 attcagatat acgaataaat tcgacaaatc caaaaatgct gttacgcctg

 851 ccggggtgga ggttttattg gatagcggcc ttaatgccaa gattgccgct

 901 tcttcagaca atagtattta tgcttaccgt atcaatgcga caatacgcgg

 951 gggaaatgta tgcgcaaaca gaacactttg a
```

This corresponds to the amino acid sequence <SEQ ID 948; ORF 247.ng>:

```
g247.pep
   1 MKRKMLNVPK GGYDGMKGFT IVEFLVAGLL SIIVLIAVVS SYFTSRKLND

  51 VANERLAIQQ DLRNAATLIV RDARMAGSFG CFNMSEHTKD DIVDSSNQTQ

 101 SNLAKPGAKQ ENPLFSLKRS GMDKQLIPVA ESIDIKYPGF IQRLNALVFQ

 151 YGIDDLDASA ETVVVSSCSK IAKPGKKIST LQEAKSALQI TNDDKQNGNI

 201 TRQKHVVNAY AVGRFGNNEE SLFRFQLDDK GKWGNPQLLV KKVKRMDVRY

 251 IYVSGCPEDE DAGKEEKFRY TNKFDKSKNA VTPAGVEVLL DSGLNAKIAA

 301 SSDNSIYAYR INATIRGGNV CANRTL*
```

The following partial DNA sequence was identified in *N. meningitidis* <SEQ ID 949>:

```
m247.seq (partial)
   1 ATsAGACGTA AAATGCTAAA CGTwsyArAA GGCAGTTATG ATGGTATGAA

  51 AGGTTTTACC ATTATTGAAT TTTTGGTTGC GGGCCTGCTC AGTATGATTG

 101 TCCTGATGGC GGTCGGATCG AGTTACTTCA CATCCCGGAA ATTAAATGAT

 151 GCGGCAAACG AGCGTCTTGC CGCGCAACAG GATTTGCGGA ATGCGGCAAC

 201 ATTGATTGTC CGCGATGCGA GAATGGCAGG CGGCTTCGGT TGTTTCAATA
```

-continued

```
251 TGTCCGAGCA TCCTGCAACT GATGTTATTC CCGATACGAC GCAACAAAAT

301 TCTCCTTTTT CCTTAAAAAG GAACGGTATA GATAAACTTA TTCCCATAGC

351 GGAATCTTCA AATATCAATT ATCAGAATTT TTTCCAGGTT GGTAGCGCAT

401 TGATTTTTCA ATACGGAATC GATGATGTTA ATGCAAGCAC CGCGACTACC

451 GTCGTCAGCA GCTGTGCCGC AATATCGAAA CCGGGCAAGC AAATCCCTAC

501 TTTAGAAGAT GCAAAAAAAG AATTGAAGAT TCCGGATCAG GATAAGGAGC

551 AAAATGGCAA TATAGCGCGT CAAAGGCATG TGGTCAATGC CTATGCGGTC

601 GGCAGGATTG CCGATGAGGA AAGTTTGTTC CGCTTCCAAT TGGATGATAA

651 GGGCAAGTGG GGTAATCCTC AGTTGC...
```

This corresponds to the amino acid sequence <SEQ ID 950; ORF 247>:

```
m247.pep (partial)
  1 XRRKMLNVXX GSYDGMKGFT IIEFLVAGLL SMIVLMAVGS SYFTSRKLND

 51 AANERLAAQQ DLRNAATLIV RDARMAGGFG CFNMSEHPAT DVIPDTTQQN

101 SPFSLKRNGI DKLIPIAESS NINYQNFFQV GSALIFQYGI DDVNASTATT

151 VVSSCAAISK PGKQIPTLED AKKELKIPDQ DKEQNGNIAR QRHVVNAYAV

201 GRIADEESLF RFQLDDKGKW GNPQL....
```

Computer analysis of this amino acid sequence gave the following results:

Homology with a Predicted ORF from *N. gonorrhoeae*

ORF 247 shows 69.3% identity over a 238 aa overlap with a predicted ORF (ORF 247.ng) from *N. gonorrhoeae*:

```
m247/g247

                        10        20        30        40        50        60
m247.pep        XRRKMLNVXXGSYDGMKGFTIIEFLVAGLLSMIVLMAVGSSYFTSRKLNDAANERLAAQQ
                 :||||||  |:|||||||||:|||||||||:|||:|| |||||||||||:|||||| ||
g247            MKRKMLNVPKGGYDGMKGFTIVEFLVAGLLSIIVLIAVVSSYFTSRKLNDVANERLAIQQ
                        10        20        30        40        50        60

                        70        80        90                   100
m247.pep        DLRNAATLIVRDARMAGGFGCFNMSEHPATDVI------------PDTTQQNSPFSLKRN
                |||||||||||||||||:|||||||||   |::            | : |:|  |||||:
g247            DLRNAATLIVRDARMAGSFGCFNMSEHTKDDIVDSSNQTQSNLAKPGAKQENPLFSLKRS
                        70        80        90       100       110       120

               110        120       130      140        150       160
m247.pep        GIDK-LIPIAESSNINYQNFFQVGSALIFQYGIDDVNASTATTVVSSCAAISKPGKQIPT
                |:|| |||:||| :|:| :|:|  :||:|||||||::||: |:|||||: |:||||:| |
g247            GMDKQLIPVAESIDIKYPGFIQRLNALVFQYGIDDLDASAETVVVSSCSKIAKPGKKIST
                       130       140       150       160       170       180

                170       180       190       200        210       220
m247.pep        LEDAKKELKIPDQDKEQNGNIARQRHVVNAYAVGRIAD-EESLFRFQLDDKGKWGNPQL
                |::||: |:| ::|| |||||:||:||||||||||::: ||||||||||||||||||||
g247            LQEAKSALQITNDDK-QNGNITRQKHVVNAYAVGRFGNNEESLFRFQLDDKGKWGNPQLL
                       190        200       210       220       230

g247            VKKVKRMDVRYIYVSGCPEDEDAGKEEKFRYTNKFDKSKNAVTPAGVEVLLDSGLNAKIA
              240       250       260       270       280       290
```

The following partial DNA sequence was identified in *N. meningitidis* <SEQ ID 951>:

```
a247.seq
  1 ATGAGACGTA AAATGCTAAA CGTACCAAAA GGCAATTATG ATGGTATGAA

 51 GGGTTTTACC ATTATTGAAT TTTTGGTTGC GGGCATGCTC AGTATGATTG

101 TCCTGATGGC GGTCGGATCG AGTTACTTCA CATCCCGGAA ATTAAATGAT
```

-continued

```
151 GCGGCAAACG AGCGTCTTTC CGCGCAACAG GATTTGCGGA ATGCGGCAAC
201 ATTGATTGTC CGCGATGCAA GAATGGCAGG GGGCTTCGGT TGTTTCAATA
251 TGTCCGAGCA TACTAAAAAT GATATTATTG TTGATCCAAG TAAGCAAACT
301 CAACATGTCC CTGTAAAACC CGGTGCCAAA CAAGAAAATC CCCTTTTTTC
351 TTTAGAGTGG GCTAATACTA ATAATACTAA TAATAATACA GCTAAATTGA
401 TTCCTATTGC TGAATCCACA GATATTAAAT ATCCGGGTTT TGCCCAGGCT
451 CGTCCGGCAT TGATTTTCCA ATACGGCATC GATGATCTTG ATGCGAGTGC
501 TGAGACTGTT GTAGTCAGCA GCTGTTCCAA AATAGCAAAA CCGGGTAAGA
551 AAATATCTAC CTTGCAAGAA GCAAAGAGTG CATTACAGAT TACTAATGAT
601 GATAAACAAA ATGGAAATAT CACCCGTCAA AGGCATGTGG TCAATGCCTA
651 TGCGGTCGGC AGGATTGCCG GTGAGGAAGG TTTGTTCCGC TTCCAATTGG
701 ATGATAAGGG CAAGTGGGGT AATCCTCAGT TGCTCGTGAA AAAGATTAGA
751 CATATGAAAG TGCGGTATAT CTATGTTTCC GACTGTCCTG AAGATGACGA
801 TGCCGGCAAA GAGGAAAAAT TCAAATATAC GGGTACATTC GACAGCTCCA
851 CAAATGCTGT TACGCCCGCC GGGGTGGAGG TTTTATTGAG TANCGGTACT
901 GATACCAAGA TTGCCGCTTC TTCAGACAAT CATATTTATG CTTACCGTAT
951 CGATGCGACA ATACGCGGGG GAAATGTATG CGCAAACAGA ACACTTTGA
```

This corresponds to the amino acid sequence <SEQ ID 952; ORF 247.a>:

```
a247.pep
  1 MRRKMLNVPK GNYDGMKGFT IIEFLVAGML SMIVLMAVGS SYFTSRKLND
 51 AANERLSAQQ DLRNAATLIV RDARMAGGFG CFNMSEHTKN DIIVDPSKQT
101 QHVPVKPGAK QENPLFSLEW ANTNNTNNNT AKLIPIAEST DIKYPGFAQA
151 RPALIFQYGI DDLDASAETV VVSSCSKIAK PGKKISTLQE AKSALQITND
201 DKQNGNITRQ RHVVNAYAVG RIAGEEGLFR FQLDDKGKWG NPQLLVKKIR
251 HMKVRYIYVS DCPEDDDAGK EEKFKYTGTF DSSTNAVTPA GVEVLLSXGT
301 DTKIAASSDN HIYAYRIDAT IRGGNVCANR TL*
```

m247/a247 70.9% identity in 244 aa overlap

```
                       10        20        30        40        50        60
m247.pep     XRRKMLNVXXGSYDGMKGFTIIEFLVAGLLSMIVLMAVGSSYFTSRKLNDAANERLAAQQ
              |||||||  |:||||||||||||||||:|||||||||||||||||||||||||||:|||
a247         MRRKMLNVPKGNYDGMKGFTIIEFLVAGMLSMIVLMAVGSSYFTSRKLNDAANERLSAQQ
                       10        20        30        40        50        60

                       70        80        90                   100
m247.pep     DLRNAATLIVRDARMAGGFGCFNMSEHPATDVI-------------PDTTQQNSPFSLK-
             |||||||||||||||||||||||||||  :|:|             | : |:|  |||:
a247         DLRNAATLIVRDARMAGGFGCFNMSEHTKNDIIVDPSKQTQHVPVKPGAKQENPLFSLEW
                       70        80        90       100       110       120

                      110       120       130      140        150       160
m247.pep     ------RNGIDKLIPIAESSNINYQNFFQVGSALIFQYGIDDVNASTATTVVSSCAAISK
                    |:  ||||||||::|:| :| |:  ||||||||||::||: |:|||||: |:|
a247         ANTNNTNNNTAKLIPIAESTDIKYPGFAQARPALIFQYGIDDLDASAETVVVSSCSKIAK
                      130       140       150       160       170       180

                      170       180       190       200       210       220
m247.pep     PGKQIPTLEDAKKELKIPDQDKEQNGNIARQRHVVNAYAVGRIADEESLFRFQLDDKGKW
             |||:| ||::||: |:| ::|| |||||:||||||||||||||| ||:||||||||||||
a247         PGKKISTLQEAKSALQITNDDK-QNGNITRQRHVVNAYAVGRIAGEEGLFRFQLDDKGKW
                      190       200       210       220       230
```

-continued

```
m247.pep     GNPQL
             |||||
a247         GNPQQLLVKKIRHMKVRYIYVSDCPEDDDAGKEEKFKYTGTFDSSTNAVTPAGVEVLLSXG
           240        250        260        270        280        290
```

The following partial DNA sequence was identified in *N. gonorrhoeae* <SEQ ID 953>:

```
g247-1.seq (partial) ..
   1 CCCGGTGCCA AACAAGAAAA TCCCCTTTTT TCCTTAAAAA GGAGCGGCAT

  51 GGATAAACAA CTGATTCCCG TTGCTGAATC CATAGATATT AAATATCCGG

 101 GTTTTATCCA GCGCCTTAAC GCATTGGTTT TCCAATACGG TATCGATGAT

 151 CTTGATGCGA GTGCTGAGAC TGTTGTAGTC AGCAGCTGTT CCAAAATAGC

 201 AAAACCGGGT AAGAAAATAT CTACCTTGCA AGAAGCAAAG AGTGCATTAC

 251 AGATTACTAA TGATGATAAA CAAAATGGAA ATATCACCCG TCAGAAACAT

 301 GTGGTCAATG CCTATGCGGT CGGCAGGTTT GGCAATAATG AGGAAAGTTT

 351 GTTCCGCTTC CAATTGGATG ATAAGGGCAA GTGGGGTAAT CCTCAGTTGC

 401 TCGTGAAAAA GGTTAAACGT ATGGATGTGC GGTATATTTA TGTTTCCGGT

 451 TGTCCTGAAG ATGAAGATGC CGGCAAAGAG GAAAAATTCA GATATACGAA

 501 TAAATTCGAC AAATCCAAAA ATGCTGTTAC GCCTGCCGGG GTGGAGGTTT

 551 TATTGGATAG CGGCCTTAAT GCCAAGATTG CCGCTTCTTC AGACAATAGT

 601 ATTTATGCTT ACCGTATCAA TGCGACAATA CGCGGGGGAA ATGTATGCGC

 651 AAACAGAACA CTTTGA
```

This corresponds to the amino acid sequence <SEQ ID 954; ORF 247-1.ng>:

```
g247-1.pep (partial) ..
   1 PGAKQENPLF SLKRSGMDKQ LIPVAESIDI KYPGFIQRLN ALVFQYGIDD

  51 LDASAETVVV SSCSKIAKPG KKISTLQEAK SALQITNDDK QNGNITRQKH

 101 VVNAYAVGRF GNNEESLFRF QLDDKGKWGN PQLLVKKVKR MDVRYIYVSG

 151 CPEDEDAGKE EKFRYTNKFD KSKNAVTPAG VEVLLDSGLN AKIAASSDNS

 201 IYAYRINATI RGGNVCANRT L*
```

The following partial DNA sequence was identified in *N. meningitidis* <SEQ ID 955>:

```
m247-1.seq
   1 ATGAGACGTA AAATGCTAAA CGTACCAAAA GGCAGTTATG ATGGTATGAA

  51 AGGTTTTACC ATTATTGAAT TTTTGGTTGC GGGCCTGCTC AGTATGATTG

 101 TCCTGATGGC GGTCGGATCG AGTTACTTCA CATCCCGGAA ATTAAATGAT

 151 GCGGCAAACG AGCGTCTTGC CGCGCAACAG GATTTGCGGA ATGCGGCAAC

 201 ATTGATTGTC CGCGATGCGA GAATGGCAGG CGGCTTCGGT TGTTTCAATA

 251 TGTCCGAGCA TCCTGCAACT GATGTTATTC CCGATACGAC GCAACAAAAT

 301 TCTCCTTTTT CCTTAAAAAG GAACGGTATA GATAAACTTA TTCCCATAGC

 351 GGAATCTTCA AATATCAATT ATCAGAATTT TTTCCAGGTT GGTAGCGCAT

 401 TGATTTTTCA ATACGGAATC GATGATGTTA ATGCAAGCAC CGCGACTACC
```

-continued

451 GTCGTCAGCA GCTGTGCCGC AATATCGAAA CCGGGCAAGC AAATCCCTAC

501 TTTAGAAGAT GCAAAAAAAG AATTGAAGAT TCCGGATCAG GATAAGGAGC

551 AAAATGGCAA TATAGCGCGT CAAAGGCATG TGGTCAATGC CTATGCGGTC

601 GGCAGGATTG CCGATGAGGA AGGTTTGTTC CGCTTCCAAT TGGATGATAA

651 GGGCAAGTGG GGTAATCCTC AGTTGCTCGT GAAAAAGGTT AGACATATGA

701 AAGTGCGGTA TATCTATGTT TCCGGCTGTC CTGAAGATGA CGATGCCGGC

751 AAAGAGGAAA CATTCAAATA TACGGATAAA TTCGACAGCG CCCAAAATGC

801 TGTTACGCCC GCCGGGGTGG AGGTTTTATT GAGTAGCGGT ACTGATACCA

851 AGATTGCCGC TTCTTCAGAC AATCATATTT ATGCTTACCG TATCGATGCG

901 ACAATACGCG GGGGAAATGT ATGCGCAAAC AGAACACTTT GA

This corresponds to the amino acid sequence <SEQ ID 956; ORF 247-1>:

m247-1.pep

1 MRRKMLNVPK GSYDGMKGFT IIEFLVAGLL SMIVLMAVGS SYFTSRKLND

51 AANERLAAQQ DLRNAATLIV RDARMAGGFG CFNMSEHPAT DVIPDTTQQN

101 SPFSLKRNGI DKLIPIAESS NINYQNFFQV GSALIFQYGI DDVNASTATT

151 VVSSCAAISK PGKQIPTLED AKKELKIPDQ DKEQNGNIAR QRHVVNAYAV

201 GRIADEEGLF RFQLDDKGKW GNPQLLVKKV RHMKVRYIYV SGCPEDDDAG

251 KEETFKYTDK FDSAQNAVTP AGVEVLLSSG TDTKIAASSD NHIYAYRIDA

301 TIRGGNVCAN RTL* m247-1/g247-1 72.1% identity in 222 aa overlap

```
                   70        80        90       100       110        120
m247-1.pep    NAATLIVRDARMAGGFGCFNMSEHPATDVIPDTTQQNSPFSLKRNGIDK-LIPIAESSNI
                                            | : |:|  |||||:|:|| |||:||| :|
g247-1                                      PGAKQENPLFSLKRSGMDKQLIPVAESIDI
                                                    10        20        30

                   130       140       150       160       170       180
m247-1.pep    NYQNFFQVGSALIFQYGIDDVNASTATTVVSSCAAISKPGKQIPTLEDAKKELKIPDQDK
              :| :|:|  :||:|||||||::||: |:|||||: |:||||:| ||::||: |:| ::||
g247-1        KYPGFIQRLNALVFQYGIDDLDASAETVVVSSCSKIAKPGKKISTLQEAKSALQITNDDK
                      40        50        60        70        80        90

                  190       200        210       220       230       240
m247-1.pep    EQNGNIARQRHVVNAYAVGRIAD-EEGLFRFQLDDKGKWGNPQLLVKKVRHMKVRYIYVS
               |||||:||:||||||||||::: ||:||||||||||||||||||||||::| |||||||
g247-1        -QNGNITRQKHVVNAYAVGRFGNNEESLFRFQLDDKGKWGNPQLLVKKVKRMDVRYIYVS
                      100       110       120       130       140

                   250       260       270       280       290       300
m247-1.pep    GCPEDDDAGKEETFKYTDKFDSAQNAVTPAGVEVLLSSGTDTKIAASSDNHIYAYRIDAT
              |||||:|||||| |:||:|||:::||||||||||||:|| ::|||||||| ||||||:||
g247-1        GCPEDEDAGKEEKFRYTNKFDKSKNAVTPAGVEVLLDSGLNAKIAASSDNSIYAYRINAT
            150       160       170       180       190       200

                   310
m247-1.pep    IRGGNVCANRTLX
              |||||||||||||
g247-1        IRGGNVCANRTLX
            210       220
```

The following partial DNA sequence was identified in *N. meningitidis* <SEQ ID 957>:

a247-1.seq (partial)

1 AATAATACAG CTAAATTGAT TCCTATTGCT GAATCCACAG ATATTAAATA

51 TCCGGGTTTT GCCCAGGCTC GTCCGGCATT GATTTTCCAA TACGGCATCG

101 ATGATCTTGA TGCGAGTGCT GAGACTGTTG TAGTCAGCAG CTGTTCCAAA

-continued

151 ATAGCAAAAC CGGGTAAGAA AATATCTACC TTGCAAGAAG CAAAGAGTGC

201 ATTACAGATT ACTAATGATG ATAAACAAAA TGGAAATATC ACCCGTCAAA

251 GGCATGTGGT CAATGCCTAT GCGGTCGGCA GGATTGCCGG TGAGGAAGGT

301 TTGTTCCGCT TCCAATTGGA TGATAAGGGC AAGTGGGGTA ATCCTCAGTT

351 GCTCGTGAAA AAGATTAGAC ATATGAAAGT GCGGTATATC TATGTTTCCG

401 ACTGTCCTGA AGATGACGAT GCCGGCAAAG AGGAAAAATT CAAATATACG

451 GGTACATTCG ACAGCTCCAC AAATGCTGTT ACGCCCGCCG GGGTGGAGGT

501 TTTATTGAGT AGCGGTACTG ATACCAAGAT TGCCGCTTCT TCAGACAATC

551 ATATTTATGC TTACCGTATC GATGCGACAA TACGCGGGGG AAATGTATGC

601 GCAAACAGAA CACTTTGA

This corresponds to the amino acid sequence <SEQ ID 958; ORF 247-1.a>:

a247-1.pep (partial)..

1 NNTAKLIPIA ESTDIKYPGF AQARPALIFQ YGIDDLDASA ETVVVSSCSK

51 IAKPGKKIST LQEAKSALQI TNDDKQNGNI TRQRHVVNAY AVGRIAGEEG

101 LFRFQLDDKG KWGNPQLLVK KIRHMKVRYI YVSDCPEDDD AGKEEKFKYT

151 GTFDSSTNAV TPAGVEVLLS SGTDTKIAAS SDNHIYAYRI DATIRGGNVC

201 ANRTL* m247-1/a247-1 80.6% identity in 206 aa overlap

```
                                                     10        20        30
a247-1.pep                                   NNTAKLIPIAESTDIKYPGFAQARPALIFQ
                                             |:  ||||||||::|:| :| |:  |||||
m247-1         GFGCFNMSEHPATDVIPDTTQQNSPFSLKRNGIDKLIPIAESSNINYQNFFQVGSALIFQ
                80        90       100       110       120       130

                       40        50        60        70         80       89
a247-1.pep     YGIDDLDASAETVVVSSCSKIAKPGKKISTLQEAKSALQITNDDK-QNGNITRQRHVVNA
               |||||::||: |:|||||: |:||||:| ||::||: |:| ::|| |||||:||||||||
m247-1         YGIDDVNASTATTVVSSCAAISKPGKQIPTLEDAKKELKIPDQDKEQNGNIARQRHVVNA
               140       150       160       170       180       190

              90       100       110       120       130       140      149
a247-1.pep     YAVGRIAGEEGLFRFQLDDKGKWGNPQLLVKKIRHMKVRYIYVSDCPEDDDAGKEEKFKY
               ||||||| ||||||||||||||||||||||||:||||||||||| ||||||||||| |||
m247-1         YAVGRIADEEGLFRFQLDDKGKWGNPQLLVKKVRHMKVRYIYVSGCPEDDDAGKEETFKY
               200       210       220       230       240       250

             150       160       170       180       190       200
a247-1.pep     TGTFDSSTNAVTPAGVEVLLSSGTDTKIAASSDNHIYAYRIDATIRGGNVCANRTLX
               |  |||: |||||||||||||||||||||||||||||||||||||||||||||||||
m247-1         TDKFDSAQNAVTPAGVEVLLSSGTDTKIAASSDNHIYAYRIDATIRGGNVCANRTLX
               260       270       280       290       300       310
```

The following partial DNA sequence was identified in *N. gonorrhoeae* <SEQ ID 959>:

g248.seq 1 atgcgcaaac agaacacttt gacaggaatc ccgacttctg acggacagag 51 ggggtccgca ctgtttatcg tgctgatggt gatgatagtc gtggcctttt 101 tggttgtaac tgccgcccag tcctacaata ccgaacagag gatcagtgcc 151 aacgaatcag acaggaaatt ggctttgtct ttagccgagg cggctttgcg 201 ggagggcgaa tttcaggttt tggatttgga atatgctgcg gacagtaagg 251 ttacgtttag cgaaaactgt gaaaaaggtc tgtgtaccgc agtgaatgtg 301 cggacaaata ataatggtag tgaagaggct tttggcaata tcgtggtgca -continued

```
351 aggcaagccc gccgttgagg cggtgaaacg ttcttgccct gcaaagtctg

401 gcaaaaattc taccgacctg tgcattgaca ataaagggat ggaatataat

451 aaaggcgcgg caggcgtcag caaaatgccg cgctatatta tcgaatattt

501 aggcgtgaag aacggacaaa atgtttatcg ggttactgcc aaggcttggg

551 gtaagaatgc caataccgtg gtcgtccttc aatcttatgt aggcaataat

601 gatgagcaat aa
```

This corresponds to the amino acid sequence <SEQ ID 960; ORF 248.ng>:

```
g248.pep
  1 MRKQNTLTGI PTSDGQRGSA LFIVLMVMIV VAFLVVTAAQ SYNTEQRISA

 51 NESDRKLALS LAEAALREGE FQVLDLEYAA DSKVTFSENC EKGLCTAVNV

101 RTNNNGSEEA FGNIVVQGKP AVEAVKRSCP AKSGKNSTDL CIDNKGMEYN

151 KGAAGVSKMP RYIIEYLGVK NGQNVYRVTA KAWGKNANTV VVLQSYVGNN

201 DEQ*
```

The following partial DNA sequence was identified in *N. meningitidis* <SEQ ID 961>:

```
m248.seq (partial)
  1 ..GGGTTTGCAC TGTTAATCGT GCTGATGGTG ATrATCGTCG TGGCT.TywT

 51   gGwTGTAACT GCCGCGCAGT CTTACAATAC cGAGCAGCGk ATCAGTkCCA

101   ACGAATCAGA CAGGAAATTG GCTwTGTCTT TGGCCGAGkC GkCTwTGCGG

151   GAAGGCGAAC TTCAGGTTTT GGATTTGGAA TATGATACGG ACAGTAAGGT

201   TACATTTAGC GAAAACTGTG GAAAAGGTCT GTsTGCCGCA GTGAATGTGC

251   GGACAAATAA TGATAATGAA GAGGCTTTTG ACAATATCGT GGTGCAAGGC

301   AAGCCCACCG TTGAGGCGGT GAAGCGTTCT TGCCCTGCAA ATTCTACCGA

351   CCTGTGCATT GACAAGAAAG GGwTGGAATA TAAGAAAGGC ACGAGAAGCG

401   TCAc.AAAAT GCCACGTTAT ATTATCGAAT ATTTGGGCGT GwAGAACGGA

451   GAAAATGTTT ATCGGGTTAC TGCCAAGGCT TGGGGtAAGA ATGCCAATAC

501   CGTGGTCGTC CTTCAATCTT ATGTAAGCAA TAATGATGAG TAA
```

This corresponds to the amino acid sequence <SEQ ID 962; ORF 248>:

```
m248.pep (partial)
  1 ..GFALLIVLMV XIVVAFXXVT AAQSYNTEQR ISXNESDRKL AXSLAEXXXR

 51   EGELQVLDLE YDTDSKVTFS ENCGKGLXAA VNVRTNNDNE EAFDNIVVQG

101   KPTVEAVKRS CPANSTDLCI DKKGXEYKKG TRSVTKMPRY IIEYLGVXNG

151   ENVYRVTAKA WGKNANTVVV LQSYVSNNDE *
```

Computer analysis of this amino acid sequence gave the following results:

Homology with a Predicted ORF from *N. gonorrhoeae*

ORF 248 shows 81.1% identity over a 185 aa overlap with a predicted ORF (ORF 248.ng) from *N. gonorrhoeae*:

```
m248/g248

                                         10        20        30        40
m248.pep                         GFALLIVLMVXIVVAFXXVTAAQSYNTEQRISXNESDRKLAXS
                                 | ||:||||| |||||  |||||||||||||| |||||||| |
g248            MRKQNTLTGIPTSDGQRGSALFIVLMVMIVVAFLVVTAAQSYNTEQRISANESDRKLALS
                        10        20        30        40        50        60

                     50        60        70        80         90       100
m248.pep        LAEXXXREGELQVLDLEYDTDSKVTFSENCGKGLXAAVNVRTNND-NEEAFDNIVVQGKP
                |||   ||||:||||||||:|||||||||| ||| :||||||||: :|||| ||||||||
g248            LAEAALREGEFQVLDLEYAADSKVTFSENCEKGLCTAVNVRTNNNGSEEAFGNIVVQGKP
                        70        80        90       100       110       120

                    110           120       130       140       150
m248.pep        TVEAVKRSCPA----NSTDLCIDKKGXEYKKGTRSVTKMPRYIIEYLGVXNGENVYRVTA
                :||||||||||    ||||||||:|| ||:||: :|:|||||||||||| ||:|||||||
g248            AVEAVKRSCPAKSGKNSTDLCIDNKGMEYNKGAAGVSKMPRYIIEYLGVKNGQNVYRVTA
                       130       140       150       160       170       180

          160       170       180
m248.pep        KAWGKNANTVVVLQSYVSNNDEX
                |||||||||||||||||:||||
g248            KAWGKNANTVVVLQSYVGNNDEQX
                       190       200
```

The following partial DNA sequence was identified in *N. meningitidis* <SEQ ID 963>:

```
a248.seq
   1 ATGCGCAAAC AGAACACTTT GACGGGAATC CCGACTTCTG ACGGACAGAG

  51 GGGGTTTGCA CTGTTTATCG TGCTGATGGT GATGATCGTC GTGGCTTTTT

 101 TGGTTGTAAC TGCCGCGCAG TCTTACAATA CCGAGCAGCG GATCAGTGCC

 151 AACGAATCAG ACAGGAAATT GGCTTTGTCT TTGGCCGAGG CGGCTTTGCG

 201 GGAAGGCGAA CTTCAGGTTT TGGATTTGGA ATATGATACG GACAGTAAGG

 251 TTACATTTAG CGAAAACTGT GGAAAAGGTC TGTGTACCGC AGTGAATGTG

 301 CGGACAAATA ATGATAATGA AGAGGCTTTT GACAATATCG TGGTGCAAGG

 351 CAAGCCCACC GTTGAGGCGG TGAAGCGTTC TTGCACTGCA AAATCTACAG

 401 GCCTGTGCAT TGACAATAAA GGGATGGAAT ATAAGAAAGG CACGCAAAGC

 451 GTCAGCAAAA TGCCACGTTA TATTATCGAA TATTTGGGCG TGAAGAACGG

 501 AGAAAATGTT TATCGGGTTA CTGCCAAGGC TTGGGGTAAG AATGCCAATA

 551 CCGTGGTCGT CCTTCAATCT TATGTAAGCA ATAATGATGA GTAA
```

This corresponds to the amino acid sequence <SEQ ID 964; ORF 248.a>:

```
a248.pep
   1 MRKQNTLTGI PTSDGQRGFA LFIVLMVMIV VAFLVVTAAQ SYNTEQRISA

  51 NESDRKLALS LAEAALREGE LQVLDLEYDT DSKVTFSENC GKGLCTAVNV

 101 RTNNDNEEAF DNIVVQGKPT VEAVKRSCTA KSTGLCIDNK GMEYKKGTQS

 151 VSKMPRYIIE YLGVKNGENV YRVTAKAWGK NANTVVVLQS YVSNNDE*
```

m248/a248 89.4% identity in 180 aa overlap

```
                        10        20        30        40
m248.pep       GFALLIVLMVXIVVAFXXVTAAQSYNTEQRISXNESDRKLAXS
               ||||:|||||  |||||  ||||||||||||| ||||||||| |
a248    MRKQNTLTGIPTSDGQRGFALFIVLMVMIVVAFLVVTAAQSYNTEQRISANESDRKLALS
                 10        20        30        40        50        60

              50        60        70        80        90       100
m248.pep  LAEXXXREGELQVLDLEYDTDSKVTFSENCGKGLXAAVNVRTNNDNEEAFDNIVVQGKPT
          |||  ||||||||||||:||||||||||||||||| :|||||||||||||||| ||||||
a248      LAEAALREGELQVLKLEYDTDSKVTFSENCGKGLCTAVNVRTNNDNEEAFGNIVVQGKPT
                  70        80        90       100       110       120

              110       120       130       140       150       160
m248.pep  VEAVKRSCPANSTDLCIDKKGXEYKKGTRSVTKMPRYIIEYLGVXNGENVYRVTAKAWGK
          |||||||| :|| ||||:|| ||||||| :||||||||||||||| ||||||||||||||
a248      VEAVKRSCTAKSTGLCIDNKGMEYKKGTQSVSKMPRYIIEYLGVKNGENVYRVTAKAWGK
                  130       140       150       160       170       180

              170       180
m248.pep  NANTVVVLQSYVSNNDEX
          ||||||||||||| ||||
a248      NANTVVVLQSYVGNNDEX
                  190
```

The following partial DNA sequence was identified in *N. meningitidis* <SEQ ID 965>:

```
m248-1.seq
  1 ATGCGCAAAC AGAACACTTT GACGGGAATC CCGACTTCTG ACGGACAGAG
 51 GGGGTTTGCA CTGTTTATCG TGCTGATGGT GATGATCGTC GTGGCTTTTT
101 TGGTTGTAAC TGCCGCGCAG TCTTACAATA CCGAGCAGCG GATCAGTGCC
151 AACGAATCAG ACAGGAAATT GGCTTTGTCT TTGGCCGAGG CGGCTTTGCG
201 GGAAGGCGAA CTTCAGGTTT TGGATTTGGA ATATGATACG GACAGTAAGG
251 TTACATTTAG CGAAAACTGT GGAAAAGGTC TGTGTGCCGC AGTGAATGTG
301 CGGACAAATA ATGATAATGA AGAGGCTTTT GACAATATCG TGGTGCAAGG
351 CAAGCCCACC GTTGAGGCGG TGAAGCGTTC TTGCCCTGCA AATTCTACCG
401 ACCTGTGCAT TGACAAGAAA GGGATGGAAT ATAAGAAAGG CACGAGAAGC
451 GTCAGCAAAA TGCCACGTTA TATTATCGAA TATTTGGGCG TGAAGAACGG
501 AGAAAATGTT TATCGGGTTA CTGCCAAGGC TTGGGGTAAG AATGCCAATA
551 CCGTGGTCGT CCTTCAATCT TATGTAAGCA ATAATGATGA GTAA
                                                      45
```

This corresponds to the amino acid sequence <SEQ ID 966; ORF 248-1>:

```
m248-1.pep

      1 MRKQNTLTGI PTSDGQRGFA LFIVLMVMIV VAFLVVTAAQ SYNTEQRISA

     51 NESDRKLALS LAEAALREGE LQVLDLEYDT DSKVTFSENC GKGLCAAVNV

    101 RTNNDNEEAF DNIVVQGKPT VEAVKRSCPA NSTDLCIDKK GMEYKKGTRS

    151 VSKMPRYIIE YLGVKNGENV YRVTAKAWGK NANTVVVLQS YVSNNDE*
```

m248-1/g248 89.1% identity in 202 aa overlap

```
                    10        20        30        40        50        60
m248-1.pep  MRKQNTLTGIPTSDGQRGFALFIVLMVMIVVAFLVVTAAQSYNTEQRISANESDRKLALS
            |||||||||||||||||||  |||||||||||||||||||||||||||||||||||||||
g248        MRKQNTLTGIPTSDGQRGSALFIVLMVMIVVAFLVVTAAQSYNTEQRISANESDRKLALS
                    10        20        30        40        50        60
```

-continued

```
                  70        80        90       100       110       119
m248-1.pep  LAEAALREGELQVLDLEYDTDSKVTFSENCGKGLCAAVNVRTNND-NEEAFDNIVVQGKP
            ||||||||||:||||||| :|||||||||| ||||:||||||||: :|||| ||||||||
g248        LAEAALREGEFQVLDLEYAADSKVTFSENCEKGLCTAVNVRTNNNGSEEAFGNIVVQGKP
                  70        80        90       100       110       120
        120       130       140       150       160       170
m248-1.pep  TVEAVKRSCPA----NSTDLCIDKKGMEYKKGTRSVSKMPRYIIEYLGVKNGENVYRVTA
            :||||||||||    ||||||||:|||||:||: :||||||||||||||||:|||||||
g248        AVEAVKRSCPAKSGKNSTDLCIDNKGMEYNKGAAGVSKMPRYIIEYLGVKNGQNVYRVTA
                 130       140       150       160       170       180
          180       190
m248.1.pep  KAWGKNANTVVVLQSYVSNNDEX
            ||||||||||||||||:||||
g248        KAWGKNANTVVVLQSYVGNNDEQX
                 190       200
m248-1/a248 97.0% identity in 197 aa overlap

                  10        20        30        40        50        60
m248-1.pep  MRKQNTLTGIPTSDGQRGFALFIVLMVMIVVAFLVVTAAQSYNTEQRISANESDRKLALS
            ||||||||||||||||||||||||||||||||||||||||||||||||||||||||||||
a248        MRKQNTLTGIPTSDGQRGFALFIVLMVMIVVAFLVVTAAQSYNTEQRISANESDRKLALS
                  10        20        30        40        50        60
                  70        80        90       100       110       119
m248-1.pep  LAEAALREGELQVLDLEYDTDSKVTFSENCGKGLCAAVNVRTNNDNEEAFDNIVVQGKPT
            |||||||||||||||||||||||||||||||||||:||||||||||||||||||||||||
a248        LAEAALREGELQVLDLEYDTDSKVTFSENCGKGLCTAVNVRTNNDNEEAFDNIVVQGKPT
                  70        80        90       100       110       120
                 130       140       150       160       170       180
m248-1.pep  VEAVKRSCPANSTDLCIDKKGMEYKKGTRSVSKMPRYIIEYLGVKNGENVYRVTAKAWGK
            |||||||| |:|| ||||:|||||||||:||||||||||||||||||||||||||||||
a248        VEAVKRSCTAKSTGLCIDNKGMEYKKGTQSVSKMPRYIIEYLGVKNGENVYRVTAKAWGK
                 130       140       150       160       170       180
                 190
m248.1.pep  NANTVVVLQSYVSNNDEX
            |||||||||||||||||
a248        NANTVVVLQSYVSNNDEX
                 190
```

The following partial DNA sequence was identified in *N. gonorrhoeae* <SEQ ID 967>:

```
g249.seq
   1 atgaagaata atgattgctt gcgcctgaaa aatccccagt ccggtatggc

  51 gttgatagaa gtcttggtcg ctatgctcgt tctgaccatc ggtattttgg

 101 cattgctgtc cgtacagttg cggacagtcg cttccgtcag ggaggcggaa

 151 acgcaaacca tcgtcagcca aatcacgcaa aacctgatgg aaggaatgtt

 201 gatgaatccg accattgatt tggacagcaa caagaaaaac tatagtcttt

 251 acatgggaaa acagacacta tcagctgtgg atggtgagtt tatgcttgat

 301 gccgagaaaa gtaaggcgca gttggcagag gaacaattga agagatttag

 351 tcatgagctg aaaaatgcct tgccggatgc ggtagctatt cattacgccg

 401 tctgcaagga ttcgtcgggt gacgcgccga cattgtccga cagcggtgct

 451 ttttcttcaa attgcgacaa taaggcaaac ggggatactt tgattaaagt

 501 attgtgggta aatgattcgg caggggattc ggatatttcc cgtacgaatc

 551 ttgaagtgag cggcgacaat atcgtatata cctatcaggc aagggtcgga

 601 ggtcgtgaat ga
```

This corresponds to the amino acid sequence <SEQ ID 968; ORF 249.ng>:

```
g249.pep
  1 MKNNDCLRLK NPQSGMALIE VLVAMLVLTI GILALLSVQL RTVASVREAE

 51 TQTIVSQITQ NLMEGMLMNP TIDLDSNKKN YSLYMGKQTL SAVDGEFMLD

101 AEKSKAQLAE EQLKRFSHEL KNALPDAVAI HYAVCKDSSG DAPTLSDSGA

151 FSSNCDNKAN GDTLIKVLWV NDSAGDSDIS RTNLEVSGDN IVYTYQARVG

201 GRE*
```

The following partial DNA sequence was identified in *N. meningitidis* <SEQ ID 969>:

```
m249.seq
  1 ATGAAGAATA ATGATTGCTT CCGCCTGAAA GATTCCCAGT CCGGTATGGC

 51 GCTGATAGAA GTCTTGGTTG CTATGCTCGT TCTGACCATC GGTATTTTGG

101 CACTATTGTC TGTACAGTTG CGGACAGTCN NNNNNNNNNN NNNNNNNNNN

151 NNNNNNNNNN NNNNNNNNNN NNNNNNNNNN NNNTTGATGG AGGGAATGTT

201 GATGAATCCG ACCATTGATT CGGACAGCAA CAAGAAAAAC TATAATCTTT

251 ACATGGGAAA CCATACACTA TCAGCTGTGG ATGGCGATTT TGCGATTGAT

301 GCCATGAAAA CTAAGGGGCA ATTGGCAGAG GCACAATTGA AGAGATTTAG

351 TTATGAGCTG AAAAATGCCT TGCCGGATGC GGCAGCCATC CATTACGCCG

401 TCTGCAAGGA TTCGTCGGGT AACGCGCCGA CATTGTCCGG CAATGCTTTT

451 TCTTCAAATT GCGACAATAA GGCAAACGGG GATACTTTAA TTAAAGTATT

501 GTGGGTAAAT GATTCGGCAG GGGATTCGGA TATTTCCCGT ACGAATCTTG

551 AGGTGAGCGG CGACAATATC GTATATACTT ATCAGGCAAG GGTCGGAGGT

601 CGGGAATGA
```

This corresponds to the amino acid sequence <SEQ ID 970; ORF 249>:

```
m249.pep
  1 MKNNDCFRLK DSQSGMALIE VLVAMLVLTI GILALLSVQL RTVXXXXXXX

 51 XXXXXXXXXX XLMEGMLMNP TIDSDSNKKN YNLYMGNHTL SAVDGDFAID

101 AMKTKGQLAE AQLKRFSYEL KNALPDAAAI HYAVCKDSSG NAPTLSGNAF

151 SSNCDNKANG DTLIKVLWVN DSAGDSDISR TNLEVSGDNI VYTYQARVGG

201 RE*
```

Computer analysis of this amino acid sequence gave the following results:

Homology with a Predicted ORF from *N. gonorrhoeae*

ORF 249 shows 81.3% identity over a 203 aa overlap with a predicted ORF (ORF 249.ng) from *N. gonorrhoeae*:

```
m249/g249

                     10        20        30        40        50        60
m249.pep    MKNNDCFRLKDSQSGMALIEVLVAMLVLTIGILALLSVQLRTVXXXXXXXXXXXXXXXXX
            ||||||:|||: |||||||||||||||||||||||||||||||       : :     :
g249        MKNNDCLRLKNPQSGMALIEVLVAMLVLTIGILALLSVQLRTVASVREAETQTIVSQITQ
                     10        20        30        40        50        60
```

-continued

```
                      70        80        90       100       110       120
m249.pep      XLMEGMLMNPTIDSDSNKKNYNLYMGNHTLSAVDGDFAIDAMKTKGQLAEAQLKRFSYEL
               |||||||||||| |||||||:||||::|||||||:| :|| |:|:|||| ||||||:||
g249          NLMEGMLMNPTIDLDSNKKNYSLYMGKQTLSAVDGEFMLDAEKSKAQLAEEQLKRFSHEL
                      70        80        90       100       110       120

                     130       140       150       160       170      179
m249.pep      KNALPDAAAIHYAVCKDSSGNAPTLSGN-AFSSNCDNKANGDTLIKVLWVNDSAGDSDIS
              |||||||:||||||||||||:||||| : |||||||||||||||||||||||||||||||
g249          KNALPDAVAIHYAVCKDSSGDAPTLSDSGAFSSNCDNKANGDTLIKVLWVNDSAGDSDIS
                     130       140       150       160       170       180

            180       190       200
m249.pep      RTNLEVSGDNIVYTYQARVGGREX
              ||||||||||||||||||||||||
g249          RTNLEVSGDNIVYTYQARVGGREX
                     190       200
```

The following partial DNA sequence was identified in *N. meningitidis* <SEQ ID 971>:

```
a249.seq
   1 ATGAAGAATA ATGATTGCTT CCGCCTGAAA AACCCCCAGT CCGGTATGGC

  51 GCTGATAGAA GTCTTGGTCG CTATGCTCGT TCTGACCATC GGTATTTTGG

 101 CACTATTGTC TGTTCAGTTG CGGACAGTCG CTTCCGTCAG GGAGGCAGAG

 151 ACGCAAACCA TCGTCAGTCA AATCACGCAA AACCTGATGG AAGGAATGTT

 201 GATGAATCCG ACCATTGATT CGGACAGCAA CAAGAAAAAC TATAATCTTT

 251 ACATGGGAAA CCATCATGCA CTATCAGTTG TGGATGGCGA TTTTCAGGTT

 301 GATGCCATAA AAACTAAGAC GCAGTTGGCA GAGGCACAAT TGAAGAGATT

 351 TAGTTATGAG CTGAAAAATG CCTTGCCGGA TGCGGCAGCC ATCCATTACG

 401 CCGTCTGCAA GGATTCGTCG GGTGTTGCGC CGACATTGTC CGCCGGCAGT

 451 ACTTTTTCTT CAAATTGCGA TGGTAGTGCA AATGGGGATA CTTTGATTAA

 501 AGTATTGTGG GTAAATGATT CGGCAGGGGA TTCGGATATC GCCCGTACGA

 551 ATCTTGAGAC GAACGGCAAC AATATCGTAT ATACCTATCA GGCAAGGGTC

 601 GGAGGTCGGG AATGA
```

This corresponds to the amino acid sequence <SEQ ID 972; ORF 249.a>:

```
a249.pep
   1 MKNNDCFRLK NPQSGMALIE VLVAMLVLTI GILALLSVQL RTVASVREAE

  51 TQTIVSQITQ NLMEGMLMNP TIDSDSNKKN YNLYMGNHHA LSVVDGDFQV

 101 DAIKTKTQLA EAQLKRFSYE LKNALPDAAA IHYAVCKDSS GVAPTLSAGS

 151 TFSSNCDGSA NGDTLIKVLW VNDSAGDSDI ARTNLETNGN NIVYTYQARV

 201 GGRE*
```

m249/a249 81.9% identity in 204 aa overlap

```
                      10        20        30        40        50        60
m249.pep      MKNNDCFRLKDSQSGMALIEVLVAMLVLTIGILALLSVQLRTVXXXXXXXXXXXXXXXXX
              ||||||||||: ||||||||||||||||||||||||||||||||        : :     :
a249          MKNNDCFRLKNPQSGMALIEVLVAMLVLTIGILALLSVQLRTVASVREAETQTIVSQITQ
                      10        20        30        40        50        60
```

-continued

```
                 70        80        90       100       110      119
m249.pep  XLMEGMLMNPTIDSDSNKKNYNLYMGNH-TLSAVDGDFAIDAMKTKGQLAEAQLKRFSYE
           |||||||||||||||||||||||||| :||:||||| :||:||| ||||||||||||
a249      NLMEGMLMNPTIDSDSNKKNYNLYMGNHHALSVVDGDFQVDAIKTKTQLAEAQLKRFSYE
                 70        80        90       100       110       120
       120       130       140       150       160       170
m249.pep  LKNALPDAAAIHYAVCKDSSGNAPTLS-GNAFSSNCDNKANGDTLIKVLWVNDSAGDSDI
          |||||||||||||||||||| ||||| |::||||||::||||||||||||||||||||
a249      LKNALPDAAAIHYAVCKDSSGVAPTLSAGSTFSSNCDGSANGDTLIKVLWVNDSAGDSDI
                130       140       150       160       170       180
        180       190       200
m249.pep  SRTNLEVSGDNIVYTYQARVGGREX
          :|||||::|:||||||||||||||
a249      ARTNLETNGNNIVYTYQARVGGREX
                190       200
```

The following partial DNA sequence was identified in *N. meningitidis* <SEQ ID 973>:

```
m249-1.seq
  1 ATGAAGAATA ATGATTGCTT CCGCCTGAAA GATTCCCAGT CCGGTATGGC

 51 GCTGATAGAA GTCTTGGTTG CTATGCTCGT TCTGACCATC GGTATTTTGG

101 CACTATTGTC TGTACAGTTG CGGACAGTCG CTTCCGTCAG GGAGGCGGAG

151 ACACAAACCA TCGTCAGCCA AATCACGCAA AACCTGATGG AGGGAATGTT

201 GATGAATCCG ACCATTGATT CGGACAGCAA CAAGAAAAAC TATAATCTTT

251 ACATGGGAAA CCATACACTA TCAGCTGTGG ATGGCGATTT TGCGATTGAT

301 GCCATGAAAA CTAAGGGGCA ATTGGCAGAG GCACAATTGA AGAGATTTAG

351 TTATGAGCTG AAAAATGCCT TGCCGGATGC GGCAGCCATC CATTACGCCG

401 TCTGCAAGGA TTCGTCGGGT AACGCGCCGA CATTGTCCGG CAATGCTTTT

451 TCTTCAAATT GCGACAATAA GGCAAACGGG GATACTTTAA TTAAAGTATT

501 GTGGGTAAAT GATTCGGCAG GGGATTCGGA TATTTCCCGT ACGAATCTTG

551 AGGTGAGCGG CGACAATATC GTATATACTT ATCAGGCAAG GGTCGGAGGT

601 CGGGAATGA
```

This corresponds to the amino acid sequence <SEQ ID 974; ORF 249-1>:

```
m249-1.pep

  1 MKNNDCKRLK DSQSGMALIE VLVAMLVLTI GILALLSVQL RTVASVREAE

 51 TQTIVSQITQ NLMEGMLMNP TIDSDSNKKN YNLYMGNHTL SAVDGDFAID

101 AMKTKGQLAW AQLKRFSYEL KNALPDAAAI HYAVCKDSSG NAPTLSGNAF

151 SSNCDNKANG DTLIKVLWVN DSAGDSDISR TNLEVSGDNI VYTYQARVGG

201 RE*
```

```
m249-1/g249    90.1% identity in 203 aa overlap

10        20        30        40        50        60
m249-1.pep   MKNNDCFRLKDSQSGMALIWVLVAMLVLTIGILALLSVQLRTVASVREAETQTIVSQITQ
             ||||||:|||: |||||||||||||||||||||||||||||||||||||||||||||||
g249         MKNNDCLRLKNPQSGMALIWVLVAMLVLTIGILALLSVQLRTVASVREAETQTIVSQITQ
                    10        20        30        40        50        60
```

-continued

```
                   70        80        90        100       110       120
m249-1.pep    NLMEGMLMNPTIDSDSNKKNYNLYMGNHTLSAVDGDFAIDAMKTKGQLAEAQLKRFSYEL
              |||||||||||| ||||||:||||::|||||||:|  :||  |:|:||||  ||||||:||
g249          NLMEGMLMNPTIDLDSNKKNYSLYMGKQTLSAVDGEFMLDAEKSKAQLAEEQLKRFSHEL
                   70        80        90        100       110       120

                  130       140       150       160       170      179
m249-1.pep    KNALPDAAAIHYAVCKDSSGNAPTLSGN-AFSSNCDNKANGDTLIKVLWVNDSAGDSDIS
              ||||||:||||||||||||:||||||  : |||||||||||||||||||||||||||||||
g249          KNALPDAVAIHYAVCKDSSDNAPTLSDSGAFSSNCDNKANGDTLIKVLWVNDSAGDSDIS
                  130       140       150       160       170       180

          180       190       200
m249-1.pep    RTNLEVSGDNIVYTYQARVGGREX
              ||||||||||||||||||||||||
g249          RTNLEVSGDNIVYTYQARVGGREX
                  190       200
```

```
a249 (SEQ ID 972)/ L366117 (SEQ ID 4166)
gi|643582 (L36117) prepilin leader sequence requires cleavage to be active [Pseudomonas aeruginosa]
>gi|1161222 (L48934) involved in type 4 fimbrial biogenesis; contains pre-pilin like leader
sequence [Pseudomonas aeruginosa]
>gi|1246299 (L76605) reference L36117, L48934 [Pseudomonas aeruginosa] Length = 185
 Score = 50.4 bits (118), Expect = 9e-06
 Indentites - 45/183 (24%), Positives = 84/183 (45%), Gaps = 26/183 (14%)

Query: 13  QSGMALIEVLVAMLVLTIGILALLSVQLRTVASVREAETQTIVSQITQNLMEGMLMNPTI 72
            QSG ++IEVLVA+L+++IG+L ++++Q +T+    ++  +    + +  NL+E M  +P
Sbjct: 12  QSGFSMIEVLVALLLISIGVLVMIAMQGKTIQYTADSVERNKAAMLGSNLLESMRASPKA 71

Query: 73  DSDSNKKNYNLYMGNHHALSVVDGDFQVDAIKTKTQLAEA---QLKRFSYELKNALPDAA 129
              D   +     M           G     A  + T L +A   +L  ++ ++KN LP A
Sbjct: 72  LYDVKDQ-----MATQSDFFKAKGSAFPTAPSSCTPLPDAIKDRLGCWAEQNKNELPGAG 126

Query: 130 AI---HYAVCKDSSGVAPTLSAGSTFSSNCDGSANGDTL-IKVLWVNDSAGDSDIARTNL 185
              +    Y +C+ S               +CDG   G  L I++ W        + A ++
Sbjct: 127 DLLKSDYYICRSSK-----------PGDCDG--KGSMLEIRLAWRGKQGACVNAADSSA 172

Query: 186 ETN 188
            +T+
Sbjct: 173 DTS 175

m249-1/a249    90.7% identity in 204 aa overlap

10        20        30        40        50        60
m249-1.pep    MKNNDCFRLKDSQSGMALIEVLVAMLVLTIGILALLSVQLRTVASVREAETQTIVSQITQ
              ||||||||||: ||||||||||||||||||||||||||||||||||||||||||||||||
a249          MKNNDCFRLKNPQSGMALIEVLVAMLVLTIGILALLSVQLRTVASVREAETQTIVSQITQ
                   10        20        30        40        50        60

                   70        80        90        100       110      119
m249-1.pep    NLMEGMLMNPTIDSDSNKKNYNLYMGNH-TLSAVDGDFAIDAMKTKGQLAEAQLKRFSYE
              |||||||||||||||||||||||||||| :||:||||| :||:|||  |||||||||||||
a249          NLMEGMLMNPTIDSDSNKKNYNLYMGNHHALSVVDGDFQVDAIKTKTQLAEAQLKRFSYE
                   70        80        90        100       110       120

          120       130       140       150       160       170      179
m249-1.pep    LKNALPDAAAIHYAVCKDSSGNAPTLS-GNAFSSNCDNKANGDTLIKVLWVNDSAGDSDI
              ||||||||||||||||||||| ||||| |::||||||::||||||||||||||||||||
a249          LKNALPDAVAIHYAVCKDSSDVAPTLSAGSTFSSNCDGSANGDTLIKVLWVNDSAGDSDI
                  130       140       150       160       170       180

           180       190       200
m249-1.pep    SRTNLEVSGDNIVYTYQARVGGREX
              :|||||::|:||||||||||||||||
a249          SRTNLETNGNNIVYTYQARVGGREX
                  190       200
```

The following partial DNA sequence was identified in *N. gonorrhoeae* <SEQ ID 975>:

```
g250.seq
   1 atgacgcaca cagcctctcc acgtgatgaa ttcatacgcg gcataaaaga

  51 aagttcgccc atgctgattg ggcttttgcc ttgggcattg atactcggta

 101 tgcagggcgg gcaaaaaggt atgggccggc tggaaatgct gctgatgacg

 151 gggatgaact ttgccggcgg ctccgaattt gccacggtca acctgtgggc

 201 ggaacctctg ccgatactgc ttatcgccac cataaccttt atgattaatt

 251 cgcggcatat cctgatgggg ggcggcgctt gccacgcaca tgaaagaaat

 301 accgctgaaa aaagccgcgc ccgcgctgtt ttttatgtgt ga
```

This corresponds to the amino acid sequence <SEQ ID 976; ORF 250.ng>:

```
g250.pep
   1 MTHTASPRDE FIRGIKESSP MLIGLLPWAL ILGMQGGQKG MGRLEMLLMT

  51 GMNFAGGSEF ATVNLWAEPL PILLIATITF MINSRHILMG GGACHAHERN

 101 TAEKSRARAV FYV*
```

The following partial DNA sequence was identified in *N. meningitidis* <SEQ ID 977>:

```
m250.seq
   1 ATGCACACCT TCCCCGCATA ACGAATTTAT ACGCGGCATC AAAGAAAGTT

  51 CGCCTATGCT GATTGGGCTG CTGCCTTGGG CATTAATACT CGGTATGCAG

 101 GGCGGACAAA AAGGCATGAG CTGGCTGGAA ATGTTGTTGA TGACCAGTAT

 151 GAACTTCGCC GGCGGCTCCG AGTTTGCCAC GGTCAACCTG TGGGCsGAAC

 201 CTCTGCCGAT ACTGCTTATC GCCACCGTAA CCTTTATGAT TAATTCTCGG

 251 CATATCCTGA T.GGGGGCGG CGCTTGCCCC GCACCTGAAA GGAaTACCGC

 301 TGAAAAAAGC CGTGCCCGCA CTGTTTTTTA TGTGTGA
```

This corresponds to the amino acid sequence <SEQ ID 978; ORF 250>:

```
m250.pep
   1 MHTPSPHNEF IRGIKESSPM LIGLLPWALI LGMQGGQKGM SWLEMLLMTS

  51 MNFAGGSEFA TVNLWAEPLP ILLIATVTFM INSRHILMGG GACPAPERNT

 101 AEKSRARTVF YV*
```

Computer analysis of this amino acid sequence gave the following results:

Homology with a Predicted ORF from *N. gonorrhoeae*

ORF 250 shows 91.0% identity over a 111 aa overlap with a predicted ORF (ORF 250.ng) from *N. gonorrhoeae*:

```
m250/g250

                          10        20        30        40        50         59
m250.pep         MHTPSPHNEFIRGIKESSPMLIGLLPWALILGMQGGQKGMSWLEMLLMTSMNFAGGSEF
                   || ||::||||||||||||||||||||||||||||||||: |||||||:|||||||||
g250            MTHTASPRDEFIRGIKESSPMLIGLLPWALILGMQGGQKGMGRLEMLLMTGMNFAGGSEF
                         10        20        30        40        50        60

                60        70        80        90       100       110
m250.pep         ATVNLWAEPLPILLIATVTFMINSRHILMGGGACPAPERNTAEKSRARTVFYVX
                 |||||||||||||||||:|||||||||||||||| | |||||||||||:||||
g250             ATVNLWAEPLPILLIATITFMINSRHILMGGGACHAHERNTAEKSRARAVFYV
                          70        80        90       100       110
```

The following partial DNA sequence was identified in *N. meningitidis* <SEQ ID 979>:

```
a250.seq
   1 ATGACACACA TAAGCTCGCC CCGTAACGAA TTTATACGCG GCATCAAAGA

  51 AAGTTCGCCC ATGCTGATCG GGCTTTTGCC TTGGGCATTA ATACTCGGTA

 101 TGCAGGGTGG ACAAAAAGGC ATGAGCTGGC TGGAAATGTT GTTGATGACC

 151 GGTATGAACT TCGCCGGCGG CTCCGAGTTT GCCACGGTCA ACCTGTGGGC

 201 GGAACCTCTG CCGATACTGC TTATCGCCAC CGTAACCTTT ATGATTAATT
```

-continued

```
251 CTCGGCATAT CCTGATGGGG G.CGGCACTT GCCCCGCACC TGAAAGAAAT

301 ACCGCTGAAA AAAGCCGTGC CCGCACTGTT TTTTATGTGT GA
```

This corresponds to the amino acid sequence <SEQ ID 980; ORF 250.a>:

```
a250.pep
  1 MTHISSPRNE FIRGIKESSP MLIGLLPWAL ILGMQGGQKG MSWLEMLLMT

 51 GMNFAGGSEF ATVNLWAEPL PILLIATVTF MINSRHILMG XGTCPAPERN

101 TAEKSRARTV FYV*
```

m250/a250 94.6% identity in 111 aa overlap

```
                    10        20        30        40        50       59
m250.pep      MHTPSPHNEFIRGIKESSPMLIGLLPWALILGMQGGQKGMSWLEMLLMTSMNFAGGSEF
               |  ||:||||||||||||||||||||||||||||||||||||||||||:|||||||||
a250         MTHISSPRNEFIRGIKESSPMLIGLLPWALILGMQGGQKGMSWLEMLLMTGMNFAGGSEF
                    10        20        30        40        50        60
            60        70        80        90       100       110
m250.pep     ATVNLWAEPLPILLIATVTFMINSRHILMGGGACPAPERNTAEKSRARTVFYVX
             ||||||||||||||||||||||||||||||| |:||||||||||||||||||||
a250         ATVNLWAEPLPILLIATVTFMINSRHILMGTGTCPAPERNTAEKSRARTVFYVX
                    70        80        90       100       110
```

The following partial DNA sequence was identified in *N. gonorrhoeae* <SEQ ID 981>:

```
g251.seq
  1 atgcctgacc caatagggat tcttttcgct gccgtcgggg ttgatttttt

 51 tgccgttgtt ttgagggggc gttttcaacg aataggcgcg gttggcatgt

101 tgataataat aatcctgatg gcggaggtcg gaaccaaaac ggtcgtaacc

151 gaggttgacg ctcaggttgt ggcggatttt ggcggtatcg aaggattttt

201 tgaatgccgc ctgcaagagc ctgtggcttt ccccgtaaat cacgcggtcg

251 gatttgtagt aggaagacgg cttgtcggca ctcgggcggc aatatttgtc

301 cgaaccgtcg gcggaacagt gcgtctgctg aaaatgattg tccaaaccga

351 tgccctgccg gtcgtaagag aggcgggcat aatccgccca agtgtcttta

401 tcggcattgg tatagacata ttccaaaccg tagcggcttt tggtgtgcgt

451 ctcgtcgtaa aacacgcccg taccgtattc cgcgcccacc tccgcaccgt

501 tttcaccgtt ggtaatcagc ccgctgtatt tgcggccgcc cgcgtatttg

551 ccgtagcctc ttatcgatcc gtatttttta ttttcatcaa aaaccgcctt

601 ggtcaggaat gccggaaccg tcatatcgcg cgtgtcgaaa gtttgctgcg

651 tgcgttcgag tatgccgccg atgtagtgcc gtttgttttc aaaacgaaaa

701 cccgggcgga acagccacga ccggctttcg tatga
```

This corresponds to the amino acid sequence <SEQ ID 982; ORF 251.ng>:

```
g251.pep
  1 MPDPIGILFA AVGVDFFAVV LRGRFQRIGA VGMLIIIILM AEVGTKTVVT

 51 EVDAQVVADF GGIEGFFECR LQEPVAFPVN HAVGFVVGRR LVGTRAAIFV
```

-continued

```
101 RTVGGTVRLL KMIVQTDALP VVREAGIIRP SVFIGIGIDI FQTVAAFGVR

151 LVVKHARTVF RAHLRTVFTV GNQPAVFAAA RVFAVASYRS VFFIFIKNRL

201 GQECRNRHIA RVESLLRAFE YAADVVPFVF KTKTRAEQPR PAFV*
```

The following partial DNA sequence was identified in *N. meningitidis* <SEQ ID 983>:

```
m251.seq
  1 ATGCGTGCTG CGGTAGTCGT AGCGCAAGCC CGCGCCGACA TCCGCCCACC

 51 TGCCCAAACG GACATTGTCC CGAACTGCCG CGTAATAGCT TTTACCGTTG

101 ATGCTGCGCG GCGTGCAGTC CGTATAAGTA TTGTTGCCCA AGCGGCAGAT

151 TTGCCCCGTA ACGACATTTC CCCTGCCTAT GGTGACCCAA TAGGGGCTGG

201 TTTCACTGCC GTTGGGGCTG ATTTTTTTGC CGTTGTTTTG AGGGGGCGTG

251 TTCGACGAAT AGGCGCGGTT GGCATGTTGA TAATAATAAT CCTGATGGCG

301 GAGATTAGAG CCAAAGCGGT CAAACCCGAG ATTCACGCTC AGGTTGTGGC

351 GGATTTTGGC GGTATCGAAG GATTTTTTGA ATGCCGCCTG CAAGAGCCTG

401 TGGCTTTCCC CGTAAATCAC GCGATCGGAT TTGTAATAGG AAAACGGCTT

451 GTCGGCACTC GGGCGGCAAT ATTTGTCCGA ACCGTCGGCA GAACAGTGCG

501 TCTGCTGAAA ATGATTATCC AAACCGATGC CCTGCCGGTC GTAAGAGAGG

551 CGGGCATAAT CCGCCCAAGT GTCTTTATCG GCATTGGTAT AGACATATTC

601 CAAACCGTAG CGGCTTTTGG TGTGCGTCTC GTCGTAAAAC ACGCCCGTAC

651 CGTATTCCGC GCCCACCAGC GCACCGTTTT CGCCGTTGGT AAACAGTCCG

701 CCGTATTTGT GGTTGCCCGC GTATTTGCCG TTACCGGGCA AAGAACCCGC

751 CTGTTTTTTA TTTGCATCAA AAACCGCCTT GGTCAGGAAT GCCGGAACCG

801 TCATATCGCG CGTGTCGAAA GTTTGTTGCG TGTGTTCGAG TATGCCGCCG

851 ATGTAGTGCC GCTTATTCTC AAAACGAAAA CCCGGGCGGA ACAGCCACGA

901 CCGGCTTTCG TATGA
```

This corresponds to the amino acid sequence <SEQ ID 984; ORF 251>:

```
m251.pep
  1 MRAAVVVAQA RADIRPPAQT DIVPNCRVIA FTVDAARRAV RISIVAQAAD

 51 LPRNDISPAY GDPIGAGFTA VGADFFAVVL RGRVRRIGAV GMLIIIILMA

101 EIRAKAVKPE IHAQVVADFG GIEGFFECRL QEPVAFPVNH AIGFVIGKRL

151 VGTRAAIFVR TVGRTVRLLK MIIQTDALPV VREAGIIRPS VFIGIGIDIF

201 QTVAAFGVRL VVKHARTVFR AHQRTVFAVG KQSAVFVVAR VFAVTGQRTR

251 LFFICIKNRL GQECRNRHIA RVESLLRVFE YAADVVPLIL KTKTRAEQPR

301 PAFV*
```

Computer analysis of this amino acid sequence gave the following results:

Homology with a Predicted ORF from *N. gonorrhoeae*

ORF 251 shows 85.2% identity over a 243 aa overlap with a predicted ORF (ORF 251.ng) from *N. gonorrhoeae*:

```
m251/g251

                      40        50        60        70        80        90
m251.pep      TVDAARRAVRISIVAQAADLPRNDISPAYGDPIGAGFTAVGADFFAVVLRGRVRRIGAVG
                                            ||||  |:|||:|||||||||| :||||||
g251                                        MPDPIGILFAAVGVDFFAVVLRGRFQRIGAVG
                                                   10        20        30

                     100       110       120       130       140       150
m251.pep      MLIIIILMAEIRAKAVKPEIHAQVVADFGGIEGFFECRLQEPVAFPVNHAIGFVIGKRLV
              ||||||||||: :|:| ||: |||||||||||||||||||||||||||||:|||:|:||
g251          MLIIIILMAEVGTKTVVTEVDAQVVADFGGIEGFFECRLQEPVAFPVNHAVGFVVGRRLV
                     40        50        60        70        80        90

                     160       170       180       190       200       210
m251.pep      GTRAAIFVRTVGRTVRLLKMIIQTDALPVVREAGIIRPSVFIGIGIDIFQTVAAFGVRLV
              |||||||||||| ||||||||:||||||||||||||||||||||||||||||||||||||
g251          GTRAAIFVRTVGGTVRLLKMIVQTDALPVVREAGIIRPSVFIGIGIDIFQTVAAFGVRLV
                    100       110       120       130       140       150

                     220       230       240       250       260       270
m251.pep      VKHARTVFRAHQRTVFAVGKQSAVFVVARVFAVTGQRTRLFFICIKNRLGQECRNRHIAR
              ||||||||||| ||||:||:| |||::||||||:: |: :||| ||||||||||||||||
g251          VKHARTVFRAHLRTVFTVGNQSAVFAAARVFAVASQRS-VFFIFIKNRLGQECRNRHIAR
                    160       170       180       190        200       210

                     280       290       300
m251.pep      VESLLRVFEYAADVVPLILKTKTRAEQPRPAFVX
              ||||||:|||||||||: :|||||||||||||||
g251          VESLLRAFEYAADVVPFVFKTKTRAEQPRPAFVX
                    220       230       240
```

The following partial DNA sequence was identified in *N. meningitidis* <SEQ ID 985>:

```
a251.seq
   1 ATGCGTGCTG CGGTAGTCGT AGCGCAACCC CGCGCCGACA TCCGCCCACC

  51 TGCCCAAACG GACATTGTCC CGAACTGCCG CGTAATAGCT TTTGCCGTTG

 101 ATGCTGCGCG GCGTGCAGTC CGTATAAGTA TTGTTGCCCA AGCGGCAGAT

 151 TTGCCCCGTA ACCACATTTC CCCTGCCTAT GCTGACCCAA TAGGGTTGGT

 201 CCTTGCCGCC GTTGGGGTTG GCGGTTTTAG GGGGCGTTTT CGACGAATAG

 251 GCGCGGTTGG CATGTTGATA ATAATAATCC TGATGGCGGA GATTAGAGTC

 301 AAAGCGGTCA AAACCGAGAT TCACGCTCAG GTTGTGGCGG ATTTTGGCGG

 351 TATCGAAGGA TTTTTTGAAT GCCGCCTGCA AGAGCCTGTG GCTTTCCCCG

 401 TAAATCACGC GGTCGGATTT GTAGTAGGAA AACGGCTTGT CGGCACTCGG

 451 GCGGCAATAT TTGTCCGAAC CGTCGGCAGA ACAGTGCGTC TGCTGAAAAT

 501 GATTGTCCAA ACCGATGCCC TGCCGGTCGT AAGAGAGGCG GGCATAATCC

 551 ACCCAAGTGT CTTTATCGGC ATTGGTATAG ACATATTCCA AACCGTAGCG

 601 GCTTTTGGTG TGCGTCTCGT CGTAAAACAC GCCCGTACCG TATTCCGCGC

 651 CCACCAGCGC ACCGTTTTCG CCGTTGGTAA ACAGACCGCC GTATTTGTGG

 701 TCGCCCGCGT ATTTGCCGTT GCCTCTTATC GGTCCGTATT TTCTATTTTC

 751 ATCAAAAACC GCCTTGGTCA GGAATGCCGG AACCGTCATA TCGCGCGTGT

 801 CGAAAGTTTG TTGCGTGTGT TCGAGTATGC CGCCGATGTA GTGCCGTTTG

 851 TTTTCAAAAC GAAAACCCGG GCGGAACAGC CACGATCGGC TTTCGTATGA
```

This corresponds to the amino acid sequence <SEQ ID 986; ORF 251.a>:

```
a251.pep
  1 MRAAVVVAQP RADIRPPAQT DIVPNCRVIA FAVDAARRAV RISIVAQAAD

 51 LPRNHISPAY ADPIGLVLAA VGVGGFRGRF RRIGAVGMLI IIILMAEIRV

101 KAVKTEIHAQ VVADFGGIEG FFECRLQEPV AFPVNHAVGF VVGKRLVGTR

151 AAIFVRTVGR TVRLLKMIVQ TDALPVVREA GIIHPSVFIG IGIDIFQTVA

201 AFGVRLVVKH ARTVFRAHQR TVFAVGKQTA VFVVARVFAV ASYRSVFSIF

251 IKNRLGQECR NRHIARVESL LRVFEYAADV VPFVFKTKTR AEQPRSAFV*
```

m251/a251 88.5% identity in 304 aa overlap

```
                     10        20        30        40        50        60
m251.pep     MRAAVVVAQARADIRPPAQTDIVPNCRVIAFTVDAARRAVRISIVAQAADLPRNDISPAY
             ||||||||| |||||||||||||||||||||:|||||||||||||||||||||| |||||
a251         MRAAVVVAQPRADIRPPAQTDIVPNCRVIAFAVDAARRAVRISIVAQAADLPRNHISPAY
                     10        20        30        40        50        60

                     70        80         90       100       110       120
m251.pep     GDPIGAGFTAVGADFFAVVLRGRVRRIGAVGMLIIIILMAEIRAKAVKPEIHAQVVADFG
             :||||  ::|||:  |    ||| |||||||||||||||||||:|||| |||||||||||
a251         ADPIGLVLAAVGVGGF----RGRFRRIGAVGMLIIIILMAEIRVKAVKTEIHAQVVADFG
                     70              80         90       100       110

                    130       140       150       160       170       180
m251.pep     GIEGFFECRLQEPVAFPVNHAIGFVIGKRLVGTRAAIFVRTVGRTVRLLKMIIQTDALPV
             |||||||||||||||||||||:|||:|||||||||||||||||||||||:||||||||||
a251         GIEGFFECRLQEPVAFPVNHAVGFVVGKRLVGTRAAIFVRTVGRTVRLLKMIVQTDALPV
              120       130       140       150       160       170

                    190       200       210       220       230       240
m251.pep     VREAGIIRPSVFIGIGIDIFQTVAAFGVRLVVKHARTVFRAHQRTVFAVGKQSAVFVVAR
             |||||||:||||||||||||||||||||||||||||||||||||||||||||:|||||||
a251         VREAGIIHPSVFIGIGIDIFQTVAAFGVRLVVKHARTVFRAHQRTVFAVGKQTAVFVVAR
              180       190       200       210       220       230

                    250       260       270       280       290       300
m251.pep     VFAVTGQRTRLFFICIKNRLGQECRNRHIARVESLLRVFEYAADVVPLILKTKTRAEQPR
             ||||:: |: :| | ||||||||||||||||||||||||||||||||:::||||||||||
a251         VFAVASYRS-VFSIFIKNRLGQECRNRHIARVESLLRVFEYAADVVPFVFKTKTRAEQPR
              240       250       260       270       280       290

m251.pep     PAFVX
              ||||
a251         SAFVX
               300
```

The following partial DNA sequence was identified in *N. gonorrhoeae* <SEQ ID 987>:

```
g253.seq
  1 atgatcgaca gggaccgtat gttgcgggac acgttggaac gtgtgcgtgc

 51 ggggtcgttc tggttatggg tggtggtggc atcgatgatg tttaccgccg

101 gattttcagg cacttatctt ctgatggaca atcaggggct gaatttcttt

151 ttagttttgg cgggagtgtt gggcatgaat acgctgatgc tggcagtatg

201 gttggcaacg ttgttcctgc gcgtgaaagt gggacggttt ttcagcagtc

251 cggcgacgtg gtttcggggc aaaggccctg taaatcaggc ggtgttgcgg

301 ctgtatgcgg accagtggcg gcaaccttcg gtacgatgga aaataggcgc

351 aacggcgcac agcttgtggc tctgcacgct gctcggaatg ctggtgtcgg

401 tattgctgct gcttttggtg cggcaatata cgttcaactg ggaaagcacg

451 ctgttgagca atgccgcttc ggtacgcgcg gtggaaatgt tggcatggct

501 gccgtcgaaa ctcggtttcc ctgtccccga tgcgcgggcg gtcatcgaag
```

-continued

```
 551 gtcgtctgaa cggcaatatt gccgatgcgc gggcttggtc ggggctgctg

 601 gtcggcagta tcgtctgcta cggcatcctg ccgcgcctct tggcttgggt

 651 agtgtgtaaa atccttttga aaacaagcga aaacggattg gatttggaaa

 701 aaacctatta tcaggcggtc atccgccgct ggcagaacaa aatcaccgat

 751 gcggatacgc gtcgggaaac cgtgtccgcc gtttcgccga aaatcgtctt

 801 gaacgatgcg ccgaaatggg cgctcatgct ggagaccgag tggcaggacg

 851 gccaatggtt cgagggcagg ctggcgcagg aatggctgga taagggcgtt

 901 gccgccaatc gggaacaggt tgccgcgctg gagacagagc tgaagcagaa

 951 accggcgcaa ctgcttatcg gcgtacgcgc ccaaactgtg ccggaccggg

1001 gcgtgctgcg gcagattgtg cggctttcgg aagcggcgca gggcggcgcg

1051 gtggtgcagc ttttggcgga acaggggctt tcagacgacc tttcggaaaa

1101 gctggaacat tggcgtaacg cgctgaccga atgcggcgcg gcgtggcttg

1151 agcctgacag ggtggcgcag gaaggccgtt tgaaagacca ataa
```

This corresponds to the amino acid sequence <SEQ ID 988; ORF 253.ng>:

```
g253.pep
  1 MIDRDRMLRD TLERVRAGSF WLWVVVASMM FTAGFSGTYL LMDNQGLNFF

 51 LVLAGVLGMN TLMLAVWLAT LFLRVKVGRF FSSPATWFRG KGPVNQAVLR

101 LYADQWRQPS VRWKIGATAH SLWLCTLLGM LVSVLLLLLV RQYTFNWEST

151 LLSNAASVRA VEMLAWLPSK LGFPVPDARA VIEGRLNGNI ADARAWSGLL

201 VGSIVCYGIL PRLLAWVVCK ILLKTSENGL DLEKTYYQAV IRRWQNKITD

251 ADTRRETVSA VSPKIVLNDA PKWALMLETE WQDGQWFEGR LAQEWLDKGV

301 AANREQVAAL ETELKQKPAQ LLIGVRAQTV PDRGVLRQIV RLSEAAQGGA

351 VVQLLAEQGL SDDLSEKLEH WRNALTECGA AWLEPDRVAQ EGRLKDQ*
```

The following partial DNA sequence was identified in *N. meningitidis* <SEQ ID 989>:

```
m253.seq
  1 ATGATTGACA GGAACCGTAT GCTGCGGGAG ACGTTGGAAC GTGTGCGTGC

 51 GGGGTCGTTC TGGTTGTGGG TGGTGGCGGC GACGTTTGCA TTTTTTACCG

101 GTTTTTCAGT CACTTATCTT CTAATGGACA ATCAGGGTCT GAATTTCTTT

151 TTGGTTTTGG CGGGCGTGTT GGGCATGAAT ACGCTGATGC TGGCAGTATG

201 GTTGGCAATG TTGTTCCTGC GTGTGAAAGT GGGGCGTTTT TTCAGCAGTC

251 CGGCGACGTG GTTTCGGGGC AAAGACCCTG TAAATCAGGC GGTGTTGCGG

301 CTGTATGCGG ACGAGTGGCG GCAACCTTCG GTACGTTGGA AAATAGGCGC

351 AACGTCGCAC AGCCTGTGGC TCTGCACGCT GCTCGGAATG CTGGTGTCGG

401 TATTGTTGCT GCTTTTGGTG CGGCAATATA CGTTCAACTG GGAAAGCACG

451 CTGTTGAGCA ATGCCGCTTC GGTACGCGCG GTGGAAATGT TGGCATGGCT

501 GCCGTCGAAA CTCGGTTTCC CTGTCCCCGA TGCGCGGGCG GTCATCGAAG

551 GCCGTCTGAA CGGCAATATT GCCGATGCGC GGGCTTGGTC GGGGCTGCTG

601 GTCGGCAGTA TCGCCTGCTA CGGCATCCTG CCGCGCCTGC TGGCTTGGGT
```

-continued

```
 651 AGTGTGTAAA ATCCTTTTGA AAACAAGCGA AAACGGATTG GATTTGGAAA

 701 AGCCCTATTA TCAGGCGGTC ATCCGCCGCT GGCAGAACAA AATCACCGAT

 751 GCGGATACGC GTCGGGAAAC CGTGTCCGCC GTTTCACCGA AAATCATCTT

 801 GAACGATGCG CCGAAATGGG CGGTCATGCT GGAGACCGAG TGGCAGGACG

 851 GCGAATGGTT CGAGGGCAGG CTGGCGCAGG AATGGCTGGA TAAGGGCGTT

 901 GCCACCAATC GGGAACAGGT TGCCGCGCTG GAGACAGAGC TGAAGCAGAA

 951 ACCGGCGCAA CTGCTTATCG GCGTGCGCGC CCAAACTGTG CCGGACCGCG

1001 GCGTGTTGCG GCAGATTGTC CGACTCTCGG AAGCGGCGCA GGGCGGCGCG

1051 GTGGTGCAGC TTTTGGCGGA ACAGGGGCTT TCAGACGACC TTTCGGAAAA

1101 GCTGGAACAT TGGCGTAACG CGCTGGCCGA ATGCGGCGCG GCGTGGCTTG

1151 AGCCTGACAG GGCGGCGCAG GAAGGGCGTT TGAAAGACCA ATAA
```

This corresponds to the amino acid sequence <SEQ ID 990; ORF 253>:

```
m253.pep
  1 MIDRNRMLRE TLERVRAGSF WLWVVAATFA FFTGFSVTYL LMDNQGLNFF

 51 LVLAGVLGMN TLMLAVWLAM LFLRVKVGRF FSSPATWFRG KDPVNQAVLR

101 LYADEWRQPS VRWKIGATSH SLWLCTLLGM LVSVLLLLLV RQYTFNWEST

151 LLSNAASVRA VEMLAWLPSK LGFPVPDARA VIEGRLNGNI ADARAWSGLL

201 VGSIACYGIL PRLLAWVVCK ILLKTSENGL DLEKPYYQAV IRRWQNKITD

251 ADTRRETVSA VSPKIILNDA PKWAVMLETE WQDGEWFEGR LAQEWLDKGV

301 ATNREQVAAL ETELKQKPAQ LLIGVRAQTV PDRGVLRQIV RLSEAAQGGA

351 VVQLLAEQGL SDDLSEKLEH WRNALAECGA AWLEPDRAAQ EGRLKDQ*
```

Computer analysis of this amino acid sequence gave the following results:

Homology with a Predicted ORF from *N. gonorrhoeae*

ORF 253 shows 94.7% identity over a 397 aa overlap with a predicted ORF (ORF 253.ng) from *N. gonorrhoeae*:

```
m253/g253

                        10        20        30        40        50        60
m253.pep       MIDRNRMLRETLERVRAGSFWLWVVAATFAFFTGFSVTYLLMDNQGLNFFLVLAGVLGMN
               ||||:||||:|||||||||||||||:|:: | :||| |||||||||||||||||||||||
g253           MIDRDRMLRDTLERVRAGSFWLWVVVASMMFTAGFSGTYLLMDNQGLNFFLVLAGVLGMN
                        10        20        30        40        50        60

                        70        80        90       100       110       120
m253.pep       TLMLAVWLAMLFLRVKVGRFFSSPATWFRGKDPVNQAVLRLYADEWRQPSVRWKIGATSH
               ||||||||| ||||||||||||||||||||| |||||||||||||:||||||||||||:|
g253           TLMLAVWLATLFLRVKVGRFFSSPATWFRGKGPVNQAVLRLYADQWRQPSVRWKIGATAH
                        70        80        90       100       110       120

                       130       140       150       160       170       180
m253.pep       SLWLCTLLGMLVSVLLLLLVRQYTFNWESTLLSNAASVRAVEMLAWLPSKLGFPVPDARA
               ||||||||||||||||||||||||||||||||||||||||||||||||||||||||||||
g253           SLWLCTLLGMLVSVLLLLLVRQYTFNWESTLLSNAASVRAVEMLAWLPSKLGFPVPDARA
                       130       140       150       160       170       180

                       190       200       210       220       230       240
m253.pep       VIEGRLNGNIADARAWSGLLVGSIACYGILPRLLAWVVCKILLKTSENGLDLEKPYYQAV
               ||||||||||||||||||||||||:||||||||||||||||||||||||||||| |||||
g253           VIEGRLNGNIADARAWSGLLVGSIVCYGILPRLLAWVVCKILLKTSENGLDLEKTYYQAV
                       190       200       210       220       230       240

                       250       260       270       280       290       300
m253.pep       IRRWQNKITDADTRRETVSAVSPKIILNDAPKWAVMLETEWQDGEWFEGRLAQEWLDKGV
               |||||||||||||||||||||||||:||||||||:|||||||||:|||||||||||||||
g253           IRRWQNKITDADTRRETVSAVSPKIVLNDAPKWALMLETEWQDGQWFEGRLAQEWLDKGV
                       250       260       270       280       290       300
```

-continued

```
                  310       320       330       340       350       360
m253.pep    ATNREQVAALETELKQKPAQLLIGVRAQTVPDRGVLRQIVRLSEAAQGGAVVQLLAEQGL
            |:||||||||||||||||||||||||||||||||||||||||||||||||||||||||||
g253        AANREQVAALETELKQKPAQLLIGVRAQTVPDRGVLRQIVRLSEAAQGGAVVQLLAEQGL
                  310       320       330       340       350       360

                  370       380       390
m253.pep    SDDLSEKLEHWRNALAECGAAWLEPDRAAQEGRLKDQX
            |||||||||||||||:|||||||||||:||||||||||
g253        SDDLSEKLEHWRNALTECGAAWLEPDRVAQEGRLKDQX
                  370       380       390
```

The following partial DNA sequence was identified in *N. meningitidis* <SEQ ID 991>:

```
a253.seq
   1  ATGATCGACA GGAACCGTAT GCTGCGGGAG ACGTTGGAAC GTGTGCGTGC
  51  GGGGTCGTTC TGGTTGTGGG TGGCGGCGGC GACGTTTGCG TTTTTTACCG
 101  GTTTTTCAGT TACTTATCTT CTAATGGACA ATCAGGGTCT GAATTTCTTT
 151  TTGGTTTTGG CGGGCGTGTT GGGCATGAAT ACGCTGATGC TGGCAGTATG
 201  GTTGGCAATG TTGTTCCTGC GCGTGAAAGT GGGGCGTTTT TTCAGCAGTC
 251  CGGCGACGTG GTTTCGGGGC AAAGACCCTG TCAATCAGGC GGTGTTGCGG
 301  CTGTATGCGG ACGAGTGGCG GCAACCTTCG GTACGTTGGA AAATAGGCGC
 351  AACGTCGCAC AGCCTGTGGC TCTGCACGCT GCTCGGAATG CTGGTGTCGG
 401  TATTGTTGCT GCTTTTGGTG CGGCAATATA CGTTCAACTG GGAAAGCACG
 451  CTGTTGGGCG ATTCGTCTTC GGTACGGCTG GTGGAAATGT TGGCATGGCT
 501  GCCTGCGAAA CTGGGTTTTC CCGTGCCTGA TGCGCGGGCG GTCATCGAAG
 551  GTCGTCTGAA CGGCAATATT GCCGATGCGC GGGCTTGGTC GGGGCTGCTG
 601  GTCGGCAGTA TCGCCTGCTA CGGCATCCTG CCGCGCCTCT TGGCTTGGGC
 651  GGTATGCAAA ATCCTTTTGA AAACAAGCGA AAACGGCTTG GATTTGGAAA
 701  AGCCCTATTA TCAGGCGGTC ATCCGCCGCT GGCAGAACAA AATCACCGAT
 751  GCGGATACGC GTCGGGAAAC CGTGTCCGCC GTTTCGCCGA AAATCGTCTT
 801  GAACGATGCG CCGAAATGGG CGGTCATGCT GGAGACCGAA TGGCAGGACG
 851  GCGAATGGTT CGAGGGCAGG CTGGCGCAGG AATGGCTGGA TAAGGGCGTT
 901  GCCGCCAATC GGGAACAGGT TGCCGCGCTG GAGACAGAGC TGAAGCAGAA
 951  ACCGGCGCAA CTGCTTATCG GCGTGCGCGC CCAAACTGTG CCCGACCGCG
1001  GCGTGTTGCG GCAGATCGTC CGACTTTCGG AAGCGGCGCA GGGCGGCGCG
1051  GTGGTGCAGC TTTTGGCGGA ACAGGGGCTT TCAGACGACC TTTCGGAAAA
1101  GCTGGAACAT TGGCGTAACG CGCTGACCGA ATGCGGCGCG GCGTGGCTGG
1151  AACCCGACAG AGCGGCGCAG GAAGGCCGTC TGAAAACCAA CGACCGCACT
1201  TGA
```

This corresponds to the amino acid sequence <SEQ ID 992; ORF 253.a>:

```
a253.pep
  1  MIDRNRMLRE TLERVRAGSF WLWVAAATFA FFTGFSVTYL LMDNQGLNFF
 51  LVLAGVLGMN TLMLAVWLAM LFLRVKVGRF FSSPATWFRG KDPVNQAVLR
101  LYADEWRQPS VRWKIGATSH SLWLCTLLGM LVSVLLLLLV RQYTFNWEST
```

-continued

```
151 LLGDSSSVRL VEMLAWLPAK LGFPVPDARA VIEGRLNGNI ADARAWSGLL

201 VGSIACYGIL PRLLAWAVCK ILLKTSENGL DLEKPYYQAV IRRWQNKITD

251 ADTRRETVSA VSPKIVLNDA PKWAVMLETE WQDGEWFEGR LAQEWLDKGV

301 AANREQVAAL ETELKQKPAQ LLIGVRAQTV PDRGVLRQIV RLSEAAQGGA

351 VVQLLAEQGL SDDLSEKLEH WRNALTECGA AWLEPDRAAQ EGRLKTNDRT

401 *
```

m253/a253 97.2% identity in 395 aa overlap

```
                    10        20        30        40        50        60
m253.pep    MIDRNRMLRETLERVRAGSFWLWVVAATFAFFTGFSVTYLLMDNQGLNFFLVLAGVLGMN
            ||||||||||||||||||||||||:|||||||||||||||||||||||||||||||||||
a253        MIDRNRMLRETLERVRAGSFWLWVAAATFAFFTGFSVTYLLMDNQGLNFFLVLAGVLGMN
                    10        20        30        40        50        60

                    70        80        90       100       110       120
m253.pep    TLMLAVWLAMLFLRVKVGRFFSSPATWFRGKDPVNQAVLRLYADEWRQPSVRWKIGATSH
            ||||||||||||||||||||||||||||||||||||||||||||||||||||||||||||
a253        TLMLAVWLAMLFLRVKVGRFFSSPATWFRGKDPVNQAVLRLYADEWRQPSVRWKIGATSH
                    70        80        90       100       110       120

                   130       140       150       160       170       180
m253.pep    SLWLCTLLGMLVSVLLLLLVRQYTFNWESTLLSNAASVRAVEMLAWLPSKLGFPVPDARA
            ||||||||||||||||||||||||||||||||::::||| |||||||:||||||||||
a253        SLWLCTLLGMLVSVLLLLLVRQYTFNWESTLLGDSSSVRLVEMLAWLPAKLGFPVPDARA
                   130       140       150       160       170       180

                   190       200       210       220       230       240
m253.pep    VIEGRLNGNIADARAWSGLLVGSIACYGILPRLLAWVVCKILLKTSENGLDLEKPYYQAV
            |||||||||||||||||||||||||||||||||||:||||||||||||||||||||||||
a253        VIEGRLNGNIADARAWSGLLVGSIACYGILPRLLAWAVCKILLKTSENGLDLEKPYYQAV
                   190       200       210       220       230       240

                   250       260       270       280       290       300
m253.pep    IRRWQNKITDADTRRETVSAVSPKIILNDAPKWAVMLETEWQDGEWFEGRLAQEWLDKGV
            |||||||||||||||||||||||||:||||||||||||||||||||||||||||||||||
a253        IRRWQNKITDADTRRETVSAVSPKIVLNDAPKWAVMLETEWQDGEWFEGRLAQEWLDKGV
                   250       260       270       280       290       300

                   310       320       330       340       350       360
m253.pep    ATNREQVAALETELKQKPAQLLIGVRAQTVPDRGVLRQIVRLSEAAQGGAVVQLLAEQGL
            |:||||||||||||||||||||||||||||||||||||||||||||||||||||||||||
a253        AANREQVAALETELKQKPAQLLIGVRAQTVPDRGVLRQIVRLSEAAQGGAVVQLLAEQGL
                   310       320       330       340       350       360

                   370       380       390
m253.pep    SDDLSEKLEHWRNALAECGAAWLEPDRAAQEGRLKDQX
            |||||||||||||||:|||||||||||||||||||
a253        SDDLSEKLEHWRNALTECGAAWLEPDRAAQEGRLKTNDRTX
                   370       380       390       400
```

The following partial DNA sequence was identified in *N. gonorrhoeae* <SEQ ID 993>:

```
g254.seq
   1 atgtatgcag gcgaacgctt caatacttac agccatttga gcggtttgat

  51 tctggcggcg gcaggtttga tgctgatgct gctgaaaacc ataggacacg

 101 gggacggata ccgtatcttc agcgtatcgg tttacggcat cagccttctt

 151 ctgctctatt tgagttcctc gctgtaccac ggaattgcag ccggaaaact

 201 gaaaagcatt ttgaaaaaaa ccgaccactg catgatttat gtgctgattg

 251 ccggaagcta cacaccgttt gcactggttt ctttgagaaa cgggccgggc

 301 tggacggtat tttcactgtc ctggctgctg gcggctgcag gaatcgcaca

 351 agaactcacc atcggacgga aaagcgaaaa acgtctgctg tctattgcga

 401 tttatatcgt aatgggctgg atggtcttgg cggtaatgaa atccctgaca

 451 gcctcactcc cgccggcagg actggcttgg ctggcggcag gcggtatgct
```

-continued
```
501 gtacagcgtc ggcatttact ggtttgtaaa cgatgaaaaa atccgacacg

551 ggcacggaat ctggcatctg ttcgtattgg gcggcagcat aacccaattt

601 gtcagcgtgt acggttatgt aatctga
```

This corresponds to the amino acid sequence <SEQ ID 994; ORF 254.ng>:

```
g254.pep
   1 MYAGERFNTY SHLSGLILAA AGLMLMLLKT IGHGDGYRIF SVSVYGISLL

  51 LLYLSSSLYH GIAAGKLKSI LKKTDHCMIY VLIAGSYTPF ALVSLRNGPG

 101 WTVFSLSWLL AAAGIAQELT IGRKSEKRLL SIAIYIVMGW MVLAVMKSLT

 151 ASLPPAGLAW LAAGGMLYSV GIYWFVNDEK IRHGHGIWHL FVLGGSITQF

 201 VSVYGYVI*
```

The following partial DNA sequence was identified in *N. meningitidis* <SEQ ID 995>:

```
m254.seq (partial)
   1 ..GTATCGGTTT ACGGCATCAG CCTTCTTCTG CTCTATTTGA GTTCCTGGCT

  51    GTACCACGGA ATTGCAGCCG GAAAACTGAA AAGCATTTTG AAAAAAACCG

 101    ACCACTGCAT GATTTATGTG CTGATTGCCG GAAGCTACAC ACCGTTTGCA

 151    CTGGTTTCTT TGAGAAACGG GCCGGGCTGG ACGGTATTTT CACTGTCCTG

 201    GCTGCTGGCG GCTGCAGGAA TCGCACAAGA ACTCACCATC GGACGGAAAA

 251    GCGAAAAACG TCTGCTGTCT ATTGTGATTT ATGTCGTCAT GGGTTGGATG

 301    GTCTTGGCGG TAATGAAATC CCTGACAGCC TCACTCCCGT CGGCAGGACT

 351    GGCTTGGCTG GCGGCAGGCG GTATGCTGTA CAGTGTCGGC ATTTACTGGT

 401    TTGTAAACGA TGAAAAAATC CGACACGGGC ACGGAATCTG GCATCTGTTC

 451    GTATTGGGCG GCAGCATCAC CCAATTTGTC AGCGTGTACG GTTACGTAAT

 501    CTGA
```

This corresponds to the amino acid sequence <SEQ ID 996; ORF 254>:

```
m254.pep (partial)
   1 ..VSVYGISLLL LYLSSWLYHG IAAGKLKSIL KKTDHCMIYV LIAGSYTPFA

  51    LVSLRNGPGW TVFSLSWLLA AAGIAQELTI GRKSEKRLLS IVIYVVMGWM

 101    VLAVMKSLTA SLPSAGLAWL AAGGMLYSVG IYWFVNDEKI RHGHGIWHLF

 151    VLGGSITQFV SVYGYVI*
```

Computer analysis of this amino acid sequence gave the following results:
Homology with a Predicted ORF from *N. gonorrhoeae*
ORF 254 shows 97.6% identity over a 167 aa overlap with a predicted ORF (ORF 254.ng) from *N. gonorrhoeae*:

```
    m254/g254

                                          10        20        30
    m254.pep                        VSVYGISLLLLYLSSWLYHGIAAGKLKSIL
                                    |||||||||||||| |||||||||||||||
    g254         HLSGLILAAAGLMLMLLKTIGHGDGYRIFSVSVYGISLLLLYLSSSLYHGIAAGKLKSIL
                         20        30        40        50        60        70
```

-continued

```
                    40         50         60         70         80         90
m254.pep     KKTDHCMIYVLIAGSYTPFALVSLRNGPGWTVFSLSWLLAAAGIAQELTIGRKSEKRLLS
             ||||||||||||||||||||||||||||||||||||||||||||||||||||||||||||
g254         KKTDHCMIYVLIAGSYTPFALVSLRNGPGWTVFSLSWLLAAAGIAQELTIGRKSEKRLLS
                    80         90        100        110        120        130

                   100        110        120        130        140        150
m254.pep     IVIYVVMGWMVLAVMKSLTASLPSAGLAWLAAGGMLYSVGIYWFVNDEKIRHGHGIWHLF
             |:||:|||||||||||||||| ||||||||||||||||||||||||||||||||||||||
g254         IAIYIVMGWMVLAVMKSLTASLPPAGLAWLAAGGMLYSVGIYWFVNDEKIRHGHGIWHLF
                   140        150        160        170        180        190

                   160
m254.pep     VLGGSITQFVSVYGYVIX
             ||||||||||||||||||
g254         VLGGSITQFVSVYGYVIX
                   200
```

The following partial DNA sequence was identified in *N. meningitidis* <SEQ ID 997>:

```
a254.seq
   1 ATGTATACAG GCGAACGCTT CAATACTTAC AGCCATTTGA GCGGTTTGAT

  51 TCTGGCGGCG GCAGGTTTGG CGCTGATGCT GCTGAAAACC ATAGGACACG

 101 GGGACGGCTA CCGTATCTTC AGCGTATCGG TTTACGGCAT CAGCCTTCTT

 151 CTGCTCTATT TGAGTTCCTC GCTGTACCAC GGAATTGCAG CCGGAAAACT

 201 GAAAAGCATT TTGAAAAAAA CCGACCACTG CATGATTTAT GTGCTGATTG

 251 CCGGAAGCTA CACACCGTTT GCACTGGTTT CTTTGAGAAA CGGGCCGGGC

 301 TGGACGGTAT TTTCACTGTC CTGGCTGCTG GCGGCTGCAG GAATCGCACA

 351 AGAACTCACC ATTGGACGGA AAAGCGAAAA ACGACTGCTG TCTATTGCGA

 401 TTTATATCGT AATGGGCTGG ATGGTCTTGG CGGTAATGAA ATCCCTGACA

 451 GCCTCACTCC CGCCGGCAGG ACTGGCTTGG CTGGCGGCAG GCGGTATGCT

 501 GTACAGCGTC GGCATTTACT GGTTTGTAAA CGATGAAAAA ATCCGACACG

 551 GGCACGGAAT CTGGCATCTG TTCGTATTGG GCGGCAGCAT CACCCAATTT

 601 GTCAGCGTGT ACGGTTACGT AATCTGA
```

This corresponds to the amino acid sequence <SEQ ID 998; ORF 254.a>:

```
a254.pep
   1 MYTGERFNTY SHLSGLILAA AGLALMLLKT IGHGDGYRIF SVSVYGISLL

  51 LLYLSSSLYH GIAAGKLKSI LKKTDHCMIY VLIAGSYTPF ALVSLRNGPG

 101 WTVFSLSWLL AAAGIAQELT IGRKSEKRLL SIAIYIVMGW MVLAVMKSLT

 151 ASLPPAGLAW LAAGGMLYSV GIYWFVNDEK IRHGHGIWHL FVLGGSITQF

 201 VSVYGYVI*
```

m254/a254 97.6% identity in 167 aa overlap

```
                                                   10         20         30
m254.pep                                     VSVYGISLLLLYLSSWLYHGIAAGKLKSIL
                                             |||||||||||||| |||||||||||||||
a254         HLSGLILAAAGLALMLLKTIGHGDGYRIFSVSVYGISLLLLYLSSSLYHGIAAGKLKSIL
                    20         30         40         50         60         70

                    40         50         60         70         80         90
m254.pep     KKTDHCMIYVLIAGSYTPFALVSLRNGPGWTVFSLSWLLAAAGIAQELTIGRKSEKRLLS
             ||||||||||||||||||||||||||||||||||||||||||||||||||||||||||||
a254         KKTDHCMIYVLIAGSYTPFALVSLRNGPGWTVFSLSWLLAAAGIAQELTIGRKSEKRLLS
                    80         90        100        110        120        130
```

-continued

```
                100       110       120       130       140       150
m254.pep    IVIYVVMGWMVLAVMKSLTASLPSAGLAWLAAGGMLYSVGIYWFVNDEKIRHGHGIWHLF
            |:||:|||||||||||||||||| |||||||||||||||||||||||||||||||||||
a254        IAIYIVMGWMVLAVMKSLTASLPPAGLAWLAAGGMLYSVGIYWFVNDEKIRHGHGIWHLF
                140       150       160       170       180       190

                160
m254.pep    VLGGSITQFVSVYGYVIX
            ||||||||||||||||||
a254        VLGGSITQFVSVYGYVIX
               200
```

The following partial DNA sequence was identified in *N. gonorrhoeae* <SEQ ID 999>:

```
g255.seq
   1 atggttggac aggaagcctt gcggggtcag ttcgtcgccg tgttcgctgc

  51 cgcgttgcgt tacgctgtca aaacctgcgc cgatttccac gcctttgacg

 101 gcgttgatgc ccatcatcgc gtaggcgatt tcggcatcga ggcggtcgaa

 151 aacgggttcg cccaaaccga cggggacgtt ggcggcttcg atatgcagtt

 201 tcgcgccgac ggaatccaag gatttgcgca caccgtccat atagtgttcc

 251 agttcggcga tttggctttg gttggcggca aaaaaaggat tttgggaaat

 301 gtgttcgctg ccttcaaacc ggattttttt ttcgccgact tgggtaacgt

 351 aggcggtgat ttccgtgccg aatttttctt tcagccattt tttggcaacg

 401 gctccggcgg caacgcgggc tgcggtttcg cgggcggaac tcctgccgcc

 451 gccccggtag tcgcgcgtac cgtatttgtg ccaataggta tagtcggcgt

 501 gtccggggcg gaaggcggtg gcgatgtcgc cgtagtcttc gctgcgctgg

 551 tcggtgttgc ggattag
```

This corresponds to the amino acid sequence <SEQ ID 1000; ORF 255.ng>:

```
g255.pep
   1 MVGQEALRGQ FVAVFAAALR YAVKTCADFH AFDGVDAHHR VGDFGIEAVE

  51 NGFAQTDGDV GGFDMQFRAD GIQGFAHTVH IVFQFGDLAL VGGKKRILGN

 101 VFAAFKPDFF FADLGNVGGD FRAEFFFQPF FGNGSGGNAG CGFAGGTPAA

 151 APVVARTVFV PIGIVGVSGA EGGGDVAVVF AALVGVAD*
```

The following partial DNA sequence was identified in *N. meningitidis* <SEQ ID 1001>:

```
m255.seq
   1 GTGGTTGGAC AGGAAGCCTT GCGGGGTCAG TTCGTCGCCG TGTTCGCTGC

  51 CGCGTTGCGT TACGCTGTCA AAACCTGCGC CGATTTCCAC GCCTTTGACG

 101 GCGTTGATGC CCATCATCGC GTAGGCGATT TCGGCATCGA GGCGGTCAAA

 151 AACAGGTTCG CCCAAGCCGA CAGGGACATT GGCTGCTTCG ATATGCAGCT

 201 TCGCGCCGAC GGAATCCAAG GATTTGCGCA CGCTGTCCAT ATAGTTTTCC

 251 AGCTCGGCAA TTTGGCTATG GTTGGCGGCA AAAAAAGGAT TTTGGGAAAT

 301 GTGTTCGCAG CCTTCAAACC GGATTTCTTT TTCGCCGACT TGGGTAACGT

 351 AGGCGGTGAT TTCCGTGCCG AATTTTTCTT TCAACCATTT TTTGGCAACG

 401 GCTCCGGCAG CAACGCGGGC GGCGGTTTCA CGGGCGGAGC TCCTGCCGCC
```

-continued

```
451 GCCGCGGTAG TCGCGCGTGC CGTATTTGTG CCAATAGGTA TAGTCGGCGT

501 GGCCGGGGCG GAAGCTGGTG GCGATGTTGC CGTAGTCTTT GCTGCGCTGG

551 TCGGTATTGC GGATTAA
```

This corresponds to the amino acid sequence <SEQ ID 1002; ORF 255>:

```
m255.pep
   1 VVGQEALRGQ FVAVFAAALR YAVKTCADFH AFDGVDAHHR VGDFGIEAVK

  51 NRFAQADRDI GCFDMQLRAD GIQGFAHAVH IVFQLGNLAM VGGKKRILGN

 101 VFAAFKPDFF FADLGNVGGD FRAEFFFQPF FGNGSGSNAG GGFTGGAPAA

 151 AAVVARAVFV PIGIVGVAGA EAGGDVAVVF AALVGIAD*
```

Computer analysis of this amino acid sequence gave the following results:

Homology with a Predicted ORF from *N. gonorrhoeae*

ORF 255 shows 88.8% identity over a 188 aa overlap with a predicted ORF (ORF 255.ng) from *N. gonorrhoeae*:

```
m255/g255

                    10        20        30        40        50        60
m255.pep    VVGQEALRGQFVAVFAAALRYAVKTCADFHAFDGVDAHHRVGDFGIEAVKNRFAQADRDI
            :||||||||||||||||||||||||||||||||||||||||||||||||:| |||:| |:
g255        MVGQEALRGQFVAVFAAALRYAVKTCADFHAFDGVDAHHRVGDFGIEAVENGFAQTDGDV
                    10        20        30        40        50        60

                    70        80        90       100       110       120
m255.pep    GCFDMQLRADGIQGFAHAVHIVFQLGNLAMVGGKKRILGNVFAAFKPDFFFADLGNVGGD
            | ||||:||||||||||:||||||:|:||:||||||||||||||||||||||||||||||
g255        GGFDMQFRADGIQGFAHTVHIVFQFGDLALVGGKKRILGNVFAAFKPDFFFADLGNVGGD
                    70        80        90       100       110       120

                   130       140       150       160       170       180
m255.pep    FRAEFFFQPFFGNGSGSNAGGGFTGGAPAAAAVVARAVFVPIGIVGVAGAEAGGDVAVVF
            ||||||||||||||||:||| ||:||:|||| ||||:||||||||||:|||:||||||||
g255        FRAEFFFQPFFGNGSGGNAGCGFAGGTPAAAPVVARTVFVPIGIVGVSGAEGGGDVAVVF
                   130       140       150       160       170       180

                  189
m255.pep    AALVGIADX
            |||||:|||
g255        AALVGVADX
```

The following partial DNA sequence was identified in *N. meningitidis* <SEQ ID 1003>:

```
a255.seq
   1 GTGGTTGGAC AGGAAGCCTT GCGGGGTGAG TTCGTCGCCG TGTTCGCTGC

  51 CGCGTTGCGT TACGCTGTCA AAACCTGCGC CGATTTCCAC GCCTTTGACG

 101 GCGTTGATGC CCATCATGGC GTAGGCGATT TCGGCATCGA GGCGGTCGAA

 151 TACGGGTTCG CCCAAGCCGA CGGGGACGTT GGCGGCTTCA ATATGCAGCT

 201 TCGCGCCGAC GGAATCCAAG GATTTGCGCA CGCTGTCCAT ATAGTTTTCC

 251 AGCTCGGCAA TTTGGCTATG GTTGGCGGCA AAAAAAGGAT TTTGGGAAAT

 301 GTGTTCGCAG CCTTCAAACC GGATTTCTTT TTCGCCGACT TGGGTAACGT

 351 AGGCGGTGAT TTCCGTGCCG AATTTTTCTT TCAACCATTT TTTGGCAACG

 401 GCTCCGGCGG CAACGCGGGC GGCGGTTTCG CGGGCGGAAC TCCTGCCGCC

 451 GCCCCGGTAG TCGCGCGTGC CGTATTTGTG CCAATAGGTA TAGTCGGCGT
```

-continued

```
501 GGCCGGGGCG GAAGCTGGTG GCGATGTTGC CGTAGTCTTT GCTGCGCTGG

551 TCGGTATTGC GGATTAA
```

This corresponds to the amino acid sequence <SEQ ID 1004; ORF 255.a>:

```
a255.pep
   1 VVGQEALRGE FVAVFAAALR YAVKTCADFH AFDGVDAHHG VGDFGIEAVE

  51 YGFAQADGDV GGFNMQLRAD GIQGFAHAVH IVFQLGNLAM VGGKKRILGN

 101 VFAAFKPDFF FADLGNVGGD FRAEFFFQPF FGNGSGGNAG GGFAGGTPAA

 151 APVVARAVFV PIGIVGVAGA EAGGDVAVVF AALVGIAD*
```

m255/a255 93.1% identity in 188 aa overlap

```
                         10        20        30        40        50        60
m255.pep        VVGQEALRGQFVAVFAAALRYAVKTCADFHAFDGVDAHHRVGDFGIEAVKNRFAQADRDI
                |||||||||:|||||||||||||||||||||||||||||| |||||||||:  ||||| |:
a255            VVGQEALRGEFVAVFAAALRYAVKTCADFHAFDGVDAHHGVGDFGIEAVEYGFAQADGDV
                         10        20        30        40        50        60

                         70        80        90       100       110       120
m255.pep        GCFDMQLRADGIQGFAHAVHIVFQLGNLAMVGGKKRILGNVFAAFKPDFFFADLGNVGGD
                | |:||||||||||||||||||||||||||||||||||||||||||||||||||||||||
a255            GGFNMQLRADGIQGFAHAVHIVFQLGNLAMVGGKKRILGNVFAAFKPDFFFADLGNVGGD
                         70        80        90       100       110       120

                        130       140       150       160       170       180
m255.pep        FRAEFFFQPFFGNGSGSNAGGGFTGGAPAAAAVVARAVFVPIGIVGVAGAEAGGDVAVVF
                |||||||||||||||:||||||:||:|||| ||||||||||||||||||||||||||||||
a255            FRAEFFFQPFFGNGSGGNAGGGFAGGTPAAAPVVARAVFVPIGIVGVAGAEAGGDVAVVF
                        130       140       150       160       170       180

                       189
m255.pep        AALVGIADX
                |||||||||
a255            AALVGIADX
```

The following partial DNA sequence was identified in *N. gonorrhoeae* <SEQ ID 1005>:

```
g256.seq
   1 atgctcgcgg tacgcaatcg gggttggcac ggcgcagtcg tccatttccg

  51 cagctgcggc ggcgtagcga acaccgcccc ggtgttctac cacttgggtg

 101 ataccgccga aatcgccttt gctttggaca cgctcaccgc gcgttaccgt

 151 gaaatatacg ccgtcggcgt atcgctgggc ggcaacgcgc cggcaaaata

 201 tttgggcgaa cagggcaaaa aggcattgcc gcacgcctcg gccgccgtat

 251 ccgcccccgt tgatgcagag gcggcaggca gccgcttcga cagcggcatc

 301 acgcggctgc tctacacgcg ctacttcctc cgcacactga tacccaaagc

 351 acgttcgctc caaggttttc agacggcatt tgccgcaggg tgcaaaacac

 401 tgggcgagtt tgacgaccgt ttcaccgcac cgctgcacgg ctttgccgac

 451 cggcacgact actaccgcca aacttcctgc aaaccgctgc tcaaacacgt

 501 tgccaaaccg ctgctcctgc tcaatgccgc caacgacccc ttcctgccgc

 551 ccgaagccct gccccgtgca gacgaagcgt ccgaagccgt taccctgttc

 601 caacctgcac acggcgggca cgccggcttt gtcagcagca ccggcggcag

 651 gctgcacctg caatggctgc cgcagaccgt cctgtcctat tttgacagct

 701 tccgcacaaa caggcgttaa
```

This corresponds to the amino acid sequence <SEQ ID 1006; ORF 256.ng>:

```
g256.pep
   1 MLAVRNRGWH GAVVHFRSCG GVANTAPVFY HLGDTAEIAF ALDTLTARYR

  51 EIYAVGVSLG GNAPAKYLGE QGKKALPHAS AAVSAPVDAE AAGSRFDSGI

 101 TRLLYTRYFL RTLIPKARSL QGFQTAFAAG CKTLGEFDDR FTAPLHGFAD

 151 RHDYYRQTSC KPLLKHVAKP LLLLNAANDP FLPPEALPRA DEASEAVTLF

 201 QPAHGGHAGF VSSTGGRLHL QWLPQTVLSY FDSFRTNRR*
```

The following partial DNA sequence was identified in *N. meningitidis* <SEQ ID 1007>:

```
m256.seq
   1 ATGCTTGCGG TACGCGATCG GGGTTGGCAC GGCGTAGTCG TCCATTTCCG

  51 CAGCTGCGGC GGCATTGCCA ACACCGCTCC GGTGTTCTAC CA.CTtGGCG

 101 ATACCGCCGA AATCGCCTTT ACTTTGGACA CGTTCGCCGC GCGTTACCGT

 151 GAAAtATACG CCGTCGGCGT ATCGCTGGGC GGCAACGCGC TGGCAAAATA

 201 TTTGGGCGAA CAGGGCAAAA AGGCATTGCC GCAAGCCGCT GCCGTCATCT

 251 CCGCCCCCGT CGATGCAGAG GCGGCAGGCA GACGCTTCGA CAGCGGCATC

 301 ACGCGGCTGC TCTACACGCG CTACTTCCTC CGCACCCTGA TACCCAAAGC

 351 AAAATCGCTC CAAGGTTTTC AGACGGCATT TGCCGCAGGG TGCAAAACAC

 401 TGGGCGAGTT TGACGACCGC TTCACCGCAC CGCTGCACGG CTTTGCCGAC

 451 CGGCACGACT ACTACCGCCA AACTTCCTGC AAACCGCTGC TCAAACACGT

 501 TGCCAAACCG CTGCTCCTGC TCAATGCCGT CAACGACCCC TTCCTGCCGC

 551 CCGAAGCCGT GCCCCGCGCA GACGAAGTAT CCGAAGCCGT TACCCTGTTC

 601 CAGCCGGCAT ATGGTGGTCA TGTCGGCTTT GTCAGCAGCA CCGGCGGCAG

 651 GCTGCACCTG CAATGGCTGC CGCAGACCGT CCTGTCCTAT TTCGACAGCT

 701 TCCGCACAAA CAGGCGTTAA
```

This corresponds to the amino acid sequence <SEQ ID 1008; ORF 256>:

```
m256.pep
   1 MLAVRDRGWH GVVVHFRSCG GIANTAPVFY XLGDTAEIAF TLDTFAARYR

  51 EIYAVGVSLG GNALAKYLGE QGKKALPQAA AVISAPVDAE AAGRRFDSGI

 101 TRLLYTRYFL RTLIPKAKSL QGFQTAFAAG CKTLGEFDDR FTAPLHGFAD

 151 RHDYYRQTSC KPLLKHVAKP LLLLNAVNDP FLPPEALPRA DEVSEAVTLF

 201 QPAYGGHVGF VSSTGGRLHL QWLPQTVLSY FDSFRTNRR*
```

Computer analysis of this amino acid sequence gave the following results:

Homology with a Predicted ORF from *N. gonorrhoeae*

ORF 256 shows 92.9% identity over a 239 aa overlap with a predicted ORF (ORF 256.ng) from *N. gonorrhoeae*:

```
m256/g256

                       10        20        30        40        50        60
m256.pep       MLAVRDRGWHGVVVHFRSCGGIANTAPVFYHLGDTAEIAFTLDTFAARYREIYAVGVSLG
               |||||:|||||:|||||||||:||||||||||||||||||:|||::||||||||||||||
g256           MLAVRNRGWHGAVVHFRSCGGVANTAPVFYHLGDTAEIAFALDTLTARYREIYAVGVSLG
                       10        20        30        40        50        60

                       70        80        90       100       110       120
m256.pep       GNALAKYLGEQGKKALPQAAAVISAPVDAEAAGRRFDSGITRLLYTRYFLRTLIPKAKSL
               ||| |||||||||||||:|:|::|||||||||| |||||||||||||||||||||||:||
g256           GNAPAKYLGEQGKKALPHASAAVSAPVDAEAAGSRFDSGITRLLYTRYFLRTLIPKARSL
                       70        80        90       100       110       120

                      130       140       150       160       170       180
m256.pep       QGFQTAFAAGCKTLGEFDDRFTAPLHGFADRHDYYRQTSCKPLLKHVAKPLLLLNAVNDP
               ||||||||||||||||||||||||||||||||||||||||||||||||||||||||:|||
g256           QGFQTAFAAGCKTLGEFDDRFTAPLHGFADRHDYYRQTSCKPLLKHVAKPLLLLNAANDP
                      130       140       150       160       170       180

                      190       200       210       220       230       240
m256.pep       FLPPEALPRADEVSEAVTLFQPAYGGHVGFVSSTGGRLHLQWLPQTVLSYFDSFRTNRRX
               ||||||||||||:||||||||||:|||:||||||||||||||||||||||||||||||||
g256           FLPPEALPRADEASEAVTLFQPAHGGHAGFVSSTGGRLHLQWLPQTVLSYFDSFRTNRRX
                      190       200       210       220       230
```

The following partial DNA sequence was identified in *N. meningitidis* <SEQ ID 1009>:

```
a256.seq
  1 ATGCTCGCGG TACGCGATCG GGGTTGGAAC GGCGTAGTCG TCCATTTCCG

 51 CAGCTGCGGC GGCGTAGCGA ACACCGCCCC GGTGTTCTAC CACTTGGGCG

101 ATACCGCCGA AATTGCCTTT ACTTTGGACA CGCTCGCCGC GCGTTACCGT

151 GAAATATACG CCGTCGGCGT ATCGCTGGGC GGCAACGCGC TGGCAAAATA

201 TTTGGGCGAA CAGGGCGAAA ACGCGCTGCC GCAAGCCGCC GCCGTCATCT

251 CCGAAGCCGT CGATGCAGAG GCGGCAGGCA ACCGCTTCGA CAGCGGCATC

301 ACACGGCTGC TCTACACGCG CTACTTCCTC CGCACACTGA TACCCAAAGC

351 ACGGTCGCTC CAAGGTTTTC AGACGGCATT TGCCGCAGGG TGCAAAACAC

401 TGGGCGAGTT TGACGACCGT TTCACCGCAC CGCTGCACGG CTTTGCCGAT

451 CGGCACGACT ACTACCGCCA AACTTCCTGC AAACCGCTGC TCAAACACGT

501 TGCCAAACCG CTGCTCCTGC TCAATGCCGT CAACGACCCC TTCCTGCCGC

551 CCGAAGCGCT GCCCCGCGCA GACGAAGTGT CCGAAGCCGT TACCCTGTTC

601 CAGCCGACAC ACGGTGGTCA TGTCGGCTTT GTCGGCAGCA CCGGCGGCAG

651 GCTGCACCTG CAATGGTTGC CGCAGACCGT CCTGTCCTAT TTCGACAGCT

701 TCCGCACAAA CAGGCGTTAA
```

This corresponds to the amino acid sequence <SEQ ID 1010; ORF 256.a>:

```
a256.pep
  1 MLAVRDRGWN GVVVHFRSCG GVANTAPVFY HLGDTAEIAF TLDTLAARYR

 51 EIYAVGVSLG GNALAKYLGE QGENALPQAA AVISAPVDAE AAGNRFDSGI

101 TRLLYTRYFL RTLIPKARSL QGFQTAFAAG CKTLGEFDDR FTAPLHGFAD
```

-continued

```
151 RHDYYRQTSC KPLLKHVAKP LLLLNAVNDP FLPPEALPRA DEVSEAVTLF

201 QPTHGGHVGF VGSTGGRLHL QWLPQTVLSY FDSFRTNRR*
```

m256/a256 95.4% identity in 239 aa overlap

```
                    10        20        30        40        50        60
m256.pep    MLAVRDRGWHGVVVHFRSCGGIANTAPVFYXLGDTAEIAFTLDTFAARYREIYAVGVSLG
            |||||||||:|||||||||||:|||||||| |||||||||||||:|||||||||||||||
a256        MLAVRDRGWNGVVVHFRSCGGVANTAPVFYHLGDTAEIAFTLDTLAARYREIYAVGVSLG
                    10        20        30        40        50        60

                    70        80        90       100       110       120
m256.pep    GNALAKYLGEQGKKALPQAAAVISAPVDAEAAGRRFDSGITRLLYTRYFLRTLIPKAKSL
            ||||||||||||::||||||||||||||||||| |||||||||||||||||||||||:||
a256        GNALAKYLGEQGENALPQAAAVISAPVDAEAAGNRFDSGITRLLYTRYFLRTLIPKARSL
                    70        80        90       100       110       120

                   130       140       150       160       170       180
m256.pep    QGFQTAFAAGCKTLGEFDDRFTAPLHGFADRHDYYRQTSCKPLLKHVAKPLLLLNAVNDP
            ||||||||||||||||||||||||||||||||||||||||||||||||||||||||||||
a256        QGFQTAFAAGCKTLGEFDDRFTAPLHGFADRHDYYRQTSCKPLLKHVAKPLLLLNAVNDP
                   130       140       150       160       170       180

                   190       200       210       220       230       240
m256.pep    FLPPEALPRADEVSEAVTLFQPAYGGHVGFVSSTGGRLHLQWLPQTVLSYFDSFRTNRRX
            ||||||||||||||||||||||::|||||||:||||||||||||||||||||||||||||
a256        FLPPEALPRADEVSEAVTLFQPTHGGHVGFVGSTGGRLHLQWLPQTVLSYFDSFRTNRRX
                   190       200       210       220       230       240
```

The following partial DNA sequence was identified in *N. gonorrhoeae* <SEQ ID 1011>:

```
g256-1.seq
  1 ATGATTTTGA CACCGCCGGA CACGCCCTTT TTCCTCCGCA ACGGCAATGC

 51 CGACACGATT GCCGCCAAAT TCCTGCAACA CCCCGCACCC GCATACCGCC

101 GCGAGATGCT TCCCGACAGC ACGGGTAAAA CCAAAACCGC CTACGACTTT

151 TCAGCAGGCG GCATTTCGCC CGATGCGCCG CTGGTCGTGC TGTTTCACGG

201 TTTGGAAGGA AGCAGCCGCA GCCATTACGC GGTCGAACTG ATGCTCGCGG

251 TACGCAATCG GGGTTGGCAC GGCGCAGTCG TCCATTTCCG CAGCTGCGGC

301 GGCGTAGCGA ACACCGCCCC GGTGTTCTAC CACTTGGGTG ATACCGCCGA

351 AATCGCCTTT GCTTTGGACA CGCTCACCGC GCGTTACCGT GAAATATACG

401 CCGTCGGCGT ATCGCTGGGC GGCAACGCGC CGGCAAAATA TTTGGGCGAA

451 CAGGGCAAAA AGGCATTGCC GCACGCCTCG GCCGCCGTAT CCGCCCCCGT

501 TGATGCAGAG GCGGCAGGCA GCCGCTTCGA CAGCGGCATC ACGCGGCTGC

551 TCTACACGCG CTACTTCCTC CGCACACTGA TACCCAAAGC ACGTTCGCTC

601 CAAGGTTTTC AGACGGCATT TGCCGCAGGG TGCAAAACAC TGGGCGAGTT

651 TGACGACCGT TTCACCGCAC CGCTGCACGG CTTTGCCGAC CGGCACGACT

701 ACTACCGCCA AACTTCCTGC AAACCGCTGC TCAAACACGT TGCCAAACCG

751 CTGCTCCTGC TCAATGCCGC CAACGACCCC TTCCTGCCGC CCGAAGCCCT

801 GCCCCGTGCA GACGAAGCGT CCGAAGCCGT TACCCTGTTC CAACCTGCAC

851 ACGGCGGGCA CGCCGGCTTT GTCAGCAGCA CCGGCGGCAG GCTGCACCTG

901 CAATGGCTGC CGCAGACCGT CCTGTCCTAT TTTGACAGCT TCCGCACAAA

951 CAGGCGTTAA
```

This corresponds to the amino acid sequence <SEQ ID 1012; ORF 256-1.ng>:

```
g256-1.pep
   1 MILTPPDTPF FLRNGNADTI AAKFLQHPAP AYRREMLPDS TGKTKTAYDF

  51 SAGGISPDAP LVVLFHGLEG SSRSHYAVEL MLAVRNRGWH GAVVHFRSCG

 101 GVANTAPVFY HLGDTAEIAF ALDTLTARYR EIYAVGVSLG GNAPAKYLGE

 151 QGKKALPHAS AAVSAPVDAE AAGSRFDSGI TRLLYTRYFL RTLIPKARSL

 201 QGFQTAFAAG CKTLGEFDDR FTAPLHGFAD RHDYYRQTSC KPLLKHVAKP

 251 LLLLNAANDP FLPPEALPRA DEASEAVTLF QPAHGGHAGF VSSTGGRLHL

 301 QWLPQTVLSY FDSFRTNRR*
```

The following partial DNA sequence was identified in *N. meningitidis* <SEQ ID 1013>:

```
m256-1.seq
   1 ATGATTTTAA CACCGCCGGA CACGCCCTTT TTCCTCCGCA ACGGCAATGC

  51 CGACACGATT GCCGCCAAAT TCCTGCAACG CCCCGCGCCC GCATACCGCC

 101 GAGAGCTGCT TCCCGACAGC ACGGGTAAAA CCAAAGTCGC CTACGACTTT

 151 TCAGACGGCA TTTCGCCCGA TGCGCCGCTG GTCGTGCTGT TTCACGGTTT

 201 GGAAGGAAGC AGCCGCAGCC ATTACGCGGT CGAACTGATG CTTGCGGTAC

 251 GCGATCGGGG TTGGCACGGC GTAGTCGTCC ATTTCCGCAG CTGCGGCGGC

 301 ATTGCCAACA CCGCTCCGGT GTTCTACCAC TTGGGCGATA CCGCCGAAAT

 351 CGCCTTTACT TTGGACACGT TCGCCGCGCG TTACCGTGAA ATATACGCCG

 401 TCGGCGTATC GCTGGGCGGC AACGCGCTGG CAAAATATTT GGGCGAACAG

 451 GGCAAAAAGG CATTGCCGCA AGCCGCTGCC GTCATCTCCG CCCCCGTCGA

 501 TGCAGAGGCG GCAGGCAGAC GCTTCGACAG CGGCATCACG CGGCTGCTCT

 551 ACACGCGCTA CTTCCTCCGC ACCCTGATAC CCAAAGCAAA ATCGCTCCAA

 601 GGTTTTCAGA CGGCATTTGC CGCAGGGTGC AAAACACTGG GCGAGTTTGA

 651 CGACCGCTTC ACCGCACCGC TGCACGGCTT TGCCGACCGG CACGACTACT

 701 ACCGCCAAAC TTCCTGCAAA CCGCTGCTCA AACACGTTGC CAAACCGCTG

 751 CTCCTGCTCA ATGCCGTCAA CGACCCCTTC CTGCCGCCCG AAGCCCTGCC

 801 CCGCGCAGAC GAAGTATCCG AAGCCGTTAC CCTGTTCCAG CCGGCATATG

 851 GTGGTCATGT CGGCTTTGTC AGCAGCACCG GCGGCAGGCT GCACCTGCAA

 901 TGGCTGCCGC AGACCGTCCT GTCCTATTTC GACAGCTTCC GCACAAACAG

 951 GCGTTAA
```

This corresponds to the amino acid sequence <SEQ ID 1014; ORF 256-1>:

```
m256-1.pep

      1  MILTPPDTPF FLRNGNADTI AAKFLQRPAP AYRRELLPDS TGKTKVAYDF

     51  SDGISPDAPL VVLFHGLEGS SRSHYAVELM LAVRDRGWHG VVVHFRSCGG

    101  IANTAPVFYH LGDTAEIAFT LDTFAARYRE IYAVGVSLGG NALAKYLGEQ

    151  GKKALPQAAA VISAPVDAEA AGRRFDSGIT RLLYTRYFLR TLIPKAKSLQ

    201  GFQTAFAAGC KTLGEFDDRF TAPLHGFADR HDYYRQTSCK PLLKHVAKPL
```

-continued

```
251  LLLNAVNDPF LPPEALPRAD EVSEAVTLFQ PAYGGHVGFV SSTGGRLHLQ

301  WLPQTVLSYF DSFRTNRR*
```

```
m256-1/g256-1  93.1% identity in 319 aa overlap

                      10        20        30        40        50        59
m256-1.pep    MILTPPDTPFFLRNGNADTIAAKFLQRPAPAYRRELLPDSTGKTKVAYDFS-DGISPDAP
              ||||||||||||||||||||||||||:||||||||:|||||||||:|||||  |||||||
g256-1        MILTPPDTPFFLRNGNADTIAAKFLQHPAPAYRREMLPDSTGKTKTAYDFSAGGISPDAP
                      10        20        30        40        50        60

              60        70        80        90       100       110       119
m256-1.pep    LVVLFHGLEGSSRSHYAVELMLAVRDRGWHGVVVHFRSCGGIANTAPVFYHLGDTAEIAF
              ||||||||||||||||||||||||:|||||:||||||||:||||||||||||||||||||
g256-1        LVVLFHGLEGSSRSHYAVELMLAVRNRGWHGAVVHFRSCGGVANTAPVFYHLGDTAEIAF
                      70        80        90       100       110       120

             120       130       140       150       160       170       179
m256-1.pep    TLDTFAARYREIYAVGVSLGGNALAKYLGEQGKKALPQAAAVISAPVDAEAAGRRFDSGI
              :|||::||||||||||||||| |||||||||||||:|:|::|||||||||| ||||||
g256-1        ALDTLTARYREIYAVGVSLGGNAPAKYLGEQGKKALPHASAAVSAPVDAEAAGSRFDSGI
                     130       140       150       160       170       180

             180       190       200       210       220       230       239
m256-1.pep    TRLLYTRYFLRTLIPKAKSLQGFQTAFAAGCKTLGEFDDRFTAPLHGFADRHDYYRQTSC
              ||||||||||||||||:|||||||||||||||||||||||||||||||||||||||||||
g256-1        TRLLYTRYFLRTLIPKARSLQGFQTAFAAGCKTLGEFDDRFTAPLHGFADRHDYYRQTSC
                     190       200       210       220       230       240

             240       250       260       270       280       290       299
m256-1.pep    KPLLKHVAKPLLLLNAVNDPFLPPEALPRADEVSEAVTLFQPAYGGHVGFVSSTGGRLHL
              |||||||||||||||:|||||||||||||||:||||||||||:|||:|||||||||||||
g256-1        KPLLKHVAKPLLLLNAANDPFLPPEALPRADEASEAVTLFQPAHGGHAGFVSSTGGRLHL
                     250       260       270       280       290       300

             300       310       319
m256-1.pep    QWLPQTVLSYFDSFRTNRRX
              ||||||||||||||||||||
g256-1        QWLPQTVLSYFDSFRTNRRX
                     310       320
```

The following partial DNA sequence was identified in *N. meningitidis* <SEQ ID 1015>:

```
a256-1.seq
  1 ATGATTTTGA CACCGCCGGA CACACCCTTT TTCCTCCGCA ACGGCAATGC

 51 CGACACGATT GCCGCCAAAT TCCTGCAACG CTCCGCACCT GCATACCGCC

101 GCGAGCTGCT TCCCGACAGC ACGGGTAAAA CCAAAACCGC CTACGACTTT

151 TCAGACGGCA TTTCGCCCGA TGCGCCGCTG GTCGTGCTGT TTCACGGTTT

201 GGAGGGCGGC AGTGGCAGCC ATTACGCGGT CGAACTGATG CTCGCGGTAC

251 GCGATCGGGG TTGGAACGGC GTAGTCGTCC ATTTCCGCAG CTGCGGCGGC

301 GTAGCGAACA CCGCCCCGGT GTTCTACCAC TTGGGCGATA CCGCCGAAAT

351 TGCCTTTACT TTGGACACGC TCGCCGCGCG TTACCGTGAA ATATACGCCG

401 TCGGCGTATC GCTGGGCGGC AACGCGCTGG CAAAATATTT GGGCGAACAG

451 GGCGAAAACG CGCTGCCGCA AGCCGCCGCC GTCATCTCCG CACCCGTCGA

501 TGCAGAGGCG GCAGGCAACC GCTTCGACAG CGGCATCACA CGGCTGCTCT

551 ACACGCGCTA CTTCCTCCGC ACACTGATAC CCAAAGCACG GTCGCTCCAA

601 GGTTTTCAGA CGGCATTTGC CGCAGGGTGC AAAACACTGG GCGAGTTTGA

651 CGACCGTTTC ACCGCACCGC TGCACGGCTT TGCCGATCGG CACGACTACT

701 ACCGCCAAAC TTCCTGCAAA CCGCTGCTCA AACACGTTGC CAAACCGCTG

751 CTCCTGCTCA ATGCCGTCAA CGACCCCTTC CTGCCGCCCG AAGCGCTGCC

801 CCGCGCAGAC GAAGTGTCCG AAGCCGTTAC CCTGTTCCAG CCGACACACG

851 GTGGTCATGT CGGCTTTGTC GGCAGCACCG GCGGCAGGCT GCACCTGCAA
```

-continued

```
901 TGGTTGCCGC AGACCGTCCT GTCCTATTTC GACAGCTTCC GCACAAACAG

951 GCGTTAA
```

This corresponds to the amino acid sequence <SEQ ID 1016; ORF 256-1.a>:

```
a256-1.pep

  1  MILTPPDTPF FLRNGNADTI AAKFLQRSAP AYRRELLPDS TGKTKTAYDF

 51  SDGISPDAPL VVLFHGLEGG SGSHYAVELM LAVRDRGWNG VVVHFRSCGG

101  VANTAPVFYH LGDTAEIAFT LDTLAARYRE IYAVGVSLGG NALAKYLGEQ

151  GENALPQAAA VISAPVDAEA AGNRFDSGIT RLLYTRYFLR TLIPKARSLQ

201  GFQTAFAAGC KTLGEFDDRF TAPLHGFADR HDYYRQTSCK PLLKHVAKPL

251  LLLNAVNDPF LPPEALPRAD EVSEAVTLFQ PTHGGHVGFV GSTGGRLHLQ

301  WLPQTVLSYF DSFRTNRR*

a256-1/m256-1 95.6% identity in 318 aa overlap

                    10        20        30        40        50        60
a256-1.pep  MILTPPDTPFFLRNGNADTIAAKFLQRSAPAYRRELLPDSTGKTKTAYDFSDGISPDAPL
            ||||||||||||||||||||||||||| |||||||||||||||:||||||||||||||||
m256-1      MILTPPDTPFFLRNGNADTIAAKFLQRPAPAYRRELLPDSTGKAKTAYDFSDGISPDAPL
                    10        20        30        40        50        60

                    70        80        90       100       110       120
a256-1.pep  VVLFHGLEGGSGSHYAVELMLAVRDRGWNGVVVHFRSCGGVANTAPVFYHLGDTAEIAFT
            |||||||||:| ||||||||||||||||:|||||||||||:|||||||||||||||||||
m256-1      VVLFHGLEGSSRSHYAVELMLAVRDRGWHGVVVHFRSCGGIANTAPVFYHLGDTAEIAFT
                    70        80        90       100       110       120

                   130       140       150       160       170       180
a256-1.pep  LDTLAARYREIYAVGVSLGGNALAKYLGEQGENALPQAAAVISAPVDAEAAGNRFDSGIT
            |||:|||||||||||||||||||||||||||::||||||||||||||||||| |||||||
m256-1      LDTFAARYREIYAVGVSLGGNALAKYLGEQGKKALPQAAAVISAPVDAEAAGRRFDSGIT
                   130       140       150       160       170       180

                   190       200       210       220       230       240
a256-1.pep  RLLYTRYFLRTLIPKARSLQGFQTAFAAGCKTLGEFDDRFTAPLHGFADRHDYYRQTSCK
            ||||||||||||||||:|||||||||||||||||||||||||||||||||||||||||||
m256-1      RLLYTRYFLRTLIPKAKSLQGFQTAFAAGCKTLGEFDDRFTAPLHGFADRHDYYRQTSCK
                   190       200       210       220       230       240

                   250       260       270       280       290       300
a256-1.pep  PLLKHVAKPLLLLNAVNDPFLPPEALPRADEVSEAVTLFQPTHGGHVGFVGSTGGRLHLQ
            |||||||||||||||||||||||||||||||||||||||||::|||||||:|||||||||
m256-1      PLLKHVAKPLLLLNAVNDPFLPPEALPRADEVSEAVTLFQPAYGGHVGFVSSTGGRLHLQ
                   250       260       270       280       290       300

                   310      319
a256-1.pep  WLPQTVLSYFDSFRTNRRX
            |||||||||||||||||||
m256-1      WLPQTVLSYFDSFRTNRRX
                   310
```

The following partial DNA sequence was identified in *N. gonorrhoeae* <SEQ ID 1017>:

```
g257.seq
  1 atgggcaggc atttcgggcg cagacgtttt ctgacggctg ccgccgttgc

 51 tgtggccggt gcggcggttt cttttttgcc gaatcctttt gccgccggcg

101 gcgaaaaacg caacatggat aaaaaacgcg atgaaaatgt gtttttctgg

151 aaaggtgtcg cgctgggttc cggcgcggag ctgcgcctgt tcggcgtgga

201 cgacagacag gcggcggatt tggtcaataa ggttttggcg gaagtggcgc

251 gtttggaaaa aatgttcagc ctttaccgtg aagacagcct gatcagccgt

301 ctgaaccgcg acggttatct gacttcgcct ccggcggatt ttttggaact

351 gttgagcctg gccgcgatat tcacgcgctg a
```

This corresponds to the amino acid sequence <SEQ ID 1018; ORF 257.ng>:

```
g257.pep
   1 MGRHFGRRRF LTAAAVAVAG AAVSFLPNPF AAGGEKRNMD KKRDENVFFW

  51 KGVALGSGAE LRLFGVDDRQ AADLVNKVLA EVARLEKMFS LYREDSLISR

 101 LNRDGYLTSP PADFLELLSL AAIFTR*
```

The following partial DNA sequence was identified in *N. meningitidis* <SEQ ID 1019>:

```
m257.seq
   1 ATGGGCAGGC ATTTCGGGCG .CAGCGTTTT CTGACGGTTG CCGCCGTTGC

  51 GGCGGGGaC. GCGGcGGTTT CTTTCCTGCC GAATCCTTTT GCCGCCGATG

 101 ATGAAAAACG CAAcGGGGAT GAAAAACGCA ATGAAAATGT GTTTTTCTGG

 151 AAAGGTGTCG CACTGGGTTC CGGTGCGGa. CTCCGTCTGT TCGGTGTGGA

 201 CGACAGGCGT GCGGCGGATT TGGTCAACAA GGTTTTGGCG GAAGTGGCGC

 251 GTTTGGAAAA ATTGTTCAGC CTTTACCGTG AAGACAGCCT GATCAGCCGC

 301 CTGAACAGGG ACGGTTATCT GACTTCGCCG TCGGCGGATT TTTTGGAACT

 351 GkTGAGCCTG GCCGCGATAT TCACGCkCTG A
```

This corresponds to the amino acid sequence <SEQ ID 1020; ORF 257>:

```
m257.pep
   1 MGRHFGXQRF LTVAAVAAGX AAVSFLPNPF AADDEKRNGD EKRNENVFFW

  51 KGVALGSGAX LRLFGVDDRR AADLVNKVLA EVARLEKLFS LYREDSLISR

 101 LNRDGYLTSP SADFLELXSL AAIFTX*
```

Computer analysis of this amino acid sequence gave the following results:

Homology with a Predicted ORF from *N. gonorrhoeae*

ORF 257 shows 88.0% identity over a 125 aa overlap with a predicted ORF (ORF 257.ng) from *N. gonorrhoeae*:

```
m257/g257

                    10        20        30        40        50        60
m257.pep   MGRHFGRQRFLTVAAVAAGTAAVSFLPNPFAADDEKRNGDEKRNENVFFWKGVALGSGAD
           |||||||:||||:|||::  ||||||||||||  |||| |:||:|||||||||||||||:
g257       MGRHFGRRRFLTAAAVAVAGAAVSFLPNPFAAGGEKRNMDKKRDENVFFWKGVALGSGAE
                    10        20        30        40        50        60

                    70        80        90       100       110       120
m257.pep   LRLFGVDDRRAADLVNKVLAEVARLEKLFSLYREDSLISRLNRDGYLTSPSADFLELXSL
           |||||||||:|||||||||||||||||:|||||||||||||||||||||| |||||| ||
g257       LRLFGVDDRQAADLVNKVLAEVARLEKMFSLYREDSLISRLNRDGYLTSPPADFLELLSL
                    70        80        90       100       110       120

m257.pep   AAIFTXX
           ||||| |
g257       AAIFTRX
```

The following partial DNA sequence was identified in *N. meningitidis* <SEQ ID 1021>:

```
a257.seq
   1 ATGGGCAGGC ATTTCGGGCG CAGGCGTTTT TTGACAGTTG CCGCCGTTGC

  51 GGCGGCGGGC GCGGCGGTTT CTTTCCTGCC GAATCCTTTT GCCGCCGATG
```

-continued

```
101 ATGAAAAACG CAATAAAGAT GAAAAACGCA ATGAAAATGT GTTTTTCTGG

151 AAAGGTGTCG CACTGGGTTC CGGTGCGGAG CTCCGTCTGT TCGGTGTGGA

201 CGACAGGCGT GCGGCGGATT TGGTCAACAA GGTTTTGGCG GAAGTGGCGC

251 GTTTGGAAAA AATGTTCAGC CTTTACCGTG AAGACAGCCT GATCAGCCGT

301 CTGAACCGTG ACGGTTATTT GACTTCGCCG CCGGCGGATT TTTTGGAACT

351 GTTGAGCCTG GCCGTGATAT TCACGCGCTG A
```

This corresponds to the amino acid sequence <SEQ ID 1022; ORF 257.a>:

```
a257.pep
   1 MGRHFGRRRF LTVAAVAAAG AAVSFLPNPF AADDEKRNKD EKRNENVFFW

  51 KGVALGSGAE LRLFGVDDRR AADLVNKVLA EVARLEKMFS LYREDSLISR

 101 LNRDGYLTSP PADFLELLSL AVIFTR*
```

m257/a257 92.0% identity in 125 aa overlap

```
                    10        20        30        40        50        60
m257.pep   MGRHGGXQRFLTVAAVAAGXAAVSFLPNPFAADDEKRNGDEKRNENVFFWKGVALGSGAX
           |||||| :|||||||||||: ||||||||||||||||||||||||||||||||||||||| 
a257       MGRHFGRRRFLTVAAVAAAGAAVSFLPNPFAADDEKRNKDEKRNENVFFWKGVALGSGAE
                    10        20        30        40        50        60

                    70        80        90       100       110       120
m257.pep   LRLFGVDDRRAADLVNKVLAEVARLEKLFSLYREDSLISRLNRDGYLTSPSADFLELXSL
           |||||||||||||||||||||||||||:|||||||||||||||||||||| |||||| ||
a257       LRLFGVDDRRAADLVNKVLAEVARLEKMFSLYREDSLISRLNRDGYLTSPPADFLELLSL
                    70        80        90       100       110       120

m257.pep   AAIFTXX
           |:||| |
a257       AVIFTRX
```

The following partial DNA sequence was identified in *N. gonorrhoeae* <SEQ ID 1023>:

```
g258.seq
   1  atgcgccgct tcctaccgat cgcagccata tgcgccgtcg tcctgctgta

  51  cggattgacg gcggcgaccg gcagcaccag ttcgctggcg gattatttct

 101  ggtggatagt ctcgttcagc gcaatgctgc tgctggtgtt gtccgccgtt

 151  ttggcacgtt atgtcatatt gctgttgaaa gacaggcgca acggcgtgtt

 201  cggttcgcag attgccaaac gcctttccgg gatgttcacg ctggtcgccg

 251  tactgcccgg cttgttcctg ttcggcattt ccgcgcagtt tatcaacggc

 301  acgattaatt cgtggttcgg caacgacacc cacgaagccc tcgaacgcag

 351  ccttaatttg agcaagtccg cactggattt ggcggcagac aatgccgtca

 401  gcaacgccgt tcccgtacag atagacctca tcggcaccgc ctccctgtcg

 451  ggcaatatgg gcagtgtgct ggaacactac gccggcagcg gttttgccca

 501  gcttgccctg tacaatgccg caagcgggaa aatcgaaaaa agcatcaatc

 551  cgcaccaatt cgaccagccg cttcccgaca aagaacattg ggaacagatt

 601  cagcagaccg gttcggttcg gagtttggaa agcataggcg gcgtattgta

 651  cgcgcaggga tggttgtcgg caggtacgca caacgggcgc gattacgcgc

 701  tgttcttccg ccagccgatt cccgaaaatg tggcacagga tgccgttctg
```

-continued

```
 751  attgaaaagg cgcgggcgaa atatgccgaa ttgagttaca gcaaaaaagg
 801  tttgcagacc ttttttctgg taaccctgct gattgcctcg ctgctgtcga
 851  tttttcttgc gctggtaatg gcactgtatt ttgcccgccg tttcgtcgaa
 901  cccattctgt cgcttgccga gggcgcaaag gcggtggcgc agggtgattt
 951  cagccagacg cgccccgtat tgcgcaacga cgagttcgga cgtttgacca
1001  agctgttcaa ccatatgacc gagcagcttt ccatcgccaa agaagcagac
1051  gaacgcaacc gccggcgcga ggaagccgcc cgtcactacc tcgagtgcgt
1101  gttggatggg ttgactaccg gtgtggtggt ctcntacccc ctctcttgtt
1151  gccgtaccgc ggtgttttcc acttgtcatt cctcccctct ttcttatttc
1201  taa
```

This corresponds to the amino acid sequence <SEQ ID 1024; ORF 258.ng>:

```
g258.pep
  1  MRRFLPIAAI CAVVLLYGLT AATGSTSSLA DYFWWIVSFS AMLLLVLSAV
 51  LARYVILLLK DRRNGVFGSQ IAKRLSGMFT LVAVLPGLFL FGISAQFING
101  TINSWFGNDT HEALERSLNL SKSALDLAAD NAVSNAVPVQ IDLIGTASLS
151  GNMGSVLEHY AGSGFAQLAL YNAASGKIEK SINPHQFDQP LPDKEHWEQI
201  QQTGSVRSLE SIGGVLYAQG WLSAGTHNGR DYALFFRQPI PENVAQDAVL
251  IEKARAKYAE LSYSKKGLQT FFLVTLLIAS LLSIFLALVM ALYFARRFVE
301  PILSLAEGAK AVAQGDFSQT RPVLRNDEFG RLTKLFNHMT EQLSIAKEAD
351  ERNRRREEAA RHYLECVLDG LTTGVVVSYP LSCCRTAVFS TCHSSPLSYF*
```

The following partial DNA sequence was identified in *N. meningitidis* <SEQ ID 1025>:

```
m258.seq
  1  ATGCGCCGTT TTCTACCGAT CGCAGCCATA TGCGCCGTCG TCCTGTTGTA
 51  CGGACTGACG GCGGCAACCG GCAGCACCAG TTCGCTGGCG GATTATTTCT
101  GGTGGATTGT TGCGTTCAGC GCAATGCTGC TGCTGGTGTT GTCCGCCGTT
151  TTGGCACGTT ATGTCATATT GCTGTTGAAA GACAGGCGCG ACGGCGTATT
201  CGGTTCGCAG ATTGCCAAAC GCCTTTCTGG GATGTTTACG CTGGTTGCCG
251  TACTGCCCGG CGTGTTTCTG TTCGGCGTTT CCGCACAGTT CATCAACGGC
301  ACGATTAATT CGTGGTTCGG CAACGATACC CACGAGGCGC TTGAACGCAG
351  CCTCAATTTG AGCAAGTCCG CATTGAATTT GGCGGCAGAC AACGCCCTCG
401  GCAACGCCGT CCCCGTGCAG ATAGACCTCA TCGGCGCGGC TTCCCTGCCC
451  GGGGATATGG GCAGGGTGCT GGAACATTAC GCCGGCAGCG GTTTTGCCCA
501  GCTTGCCCTG TACAATGCCG CAAGCGGCAA AATCGAAAAA AGCATCAACC
551  CGCACAAGCT CGATCAGCCG TTTCCAGGTA AGGCGCGTTG GGAAAAAATC
601  CAACGGGCGG GTTCGGTCAG GGATTTGGAA AGCATAGGCG GCGTATTGTA
651  CGCGCAGGGC TGGCTGTCGG CGGGTACGCA CAACGGGCGC GATTACGCCT
701  TGTTTTTCCG TCAGCCGGTT CCCAAAGGCG TGGCAGAGGA TGCCGTCTTA
751  ATCGAAAAGG CAAGGGCGAA ATATGCTGAG TTGAGTTACA GCAAAAAAGG
```

-continued

```
 801 TTTGCAGACC TTTTTCCTGG CAACCCTGCT GATTGCCTCG CTGCTGTCGA
 851 TTTTTCTTGC ACTGGTCATG GCACTGTATT TCGCCCGCCG TTTCGTCGAA
 901 CCCGTCCTAT CGCTTGCCGA GGGGGCGAAG GCGGTGGCGC AAGGCGATTT
 951 CAGCCAGACG CGCCCCGTGT TGCGCAACGA CGAGTTCGGA CGCTTGACCA
1001 AGTTGTTCAA CCACATGACC GAGCAGCTTT CCATCGCCAA AGAAGCAGAC
1051 GAGCGCAACC GCCGGCGCGA GGAAGCCGCC AGGCATTATC TTGAATGCGT
1101 GTTGGAGGGG CTGACCACGG GCGTGGTGGT GTTTGACGAA CAAGGCTGTC
1151 TGAAAACsTT CAACAAAGCG GCGGAACAGA TTyTGGGGAT GCCGCTTACC
1201 CCCcTGTGGG GCAGCAGCCG GCACGGTTGG CACGGCGTTT CGGCGCAGCA
1251 GTCCCTGCTT GCCGAAGTGT TTGCCGCCAT CGGCGCGGCG GCAGGTACGG
1301 ACAAACCGGT CCATGTGAAA TATGCCGCGC CGGACGATGC CAAAATCCTG
1351 CTGGGCAAGG CAACCGTCCT GCCCGAAGAC AACGGCAACg GCGTGGTAAT
1401 GGTGATTGAC GACATCACCG TTTTGATACA CGCGCAAAAA GAAGCCGCGT
1451 GGGGCGAAgT GGCGaAgCGG CTGGCACACG AAATCCGCAA TCCGCTCACG
1501 CCCATCCAGC TTTCCGCCGA ACgGsTGGCG TkGAAATTGG GCGGGAAGCT
1551 GGATGAGCAG GATGCGCAAA TCCTGACGCG TTCGACCGAC ACCATCGTCA
1601 AACAGGTGGC GGCATTGAAG GAAATGGTCG AAGCATTCCG CAATTATGCG
1651 CGTTCCCCTT CGCTCAAATT GGAAAATCAG GATTTGAACG CCTTAATCGG
1701 CGATGTGTTG GCATTGTATG AAGCCGGTCC GTGCCGGTTT GCGGCGGACT
1751 TGCCGGCGAA CCGCTGA
```

This corresponds to the amino acid sequence <SEQ ID 1026; ORF 258>:

```
m258.pep
  1 MRRFLPIAAI CAVVLLYGLT AATGSTSSLA DYFWWIVAFS AMLLLVLSAV
 51 LARYVILLLK DRRDGVFGSQ IAKRLSGMFT LVAVLPGVFL FGVSAQFING
101 TINSWFGNDT HEALERSLNL SKSALNLAAD NALGNAVPVQ IDLIGAASLP
151 GDMGRVLEHY AGSGFAQLAL YNAASGKIEK SINPHKLDQP FPGKARWEKI
201 QRAGSVRDLE SIGGVLYAQG WLSAGTHNGR DYALFFRQPV PKGVAEDAVL
251 IEKARAKYAE LSYSKKGLQT FFLATLLIAS LLSIFLALVM ALYFARRFVE
301 PVLSLAEGAK AVAQGDFSQT RPVLRNDEFG RLTKLFNHMT EQLSIAKEAD
351 ERNRRREEAA RHYLECVLEG LTTGVVVFDE QGCLKTFNKA AEQILGMPLT
401 PLWGSSRHGW HGVSAQQSLL AEVFAAIGAA AGTDKPVHVK YAAPDDAKIL
451 LGKATVLPED NGNGVVMVID DITVLIHAQK EAAWGEVAKR LAHEIRNPLT
501 PIQLSAERXA XKLGGKLDEQ DAQILTRSTD TIVKQVAALK EMVEAFRNYA
551 RSPSLKLENQ DLNALIGDVL ALYEAGPCRF AADLPANR*
```

Computer analysis of this amino acid sequence gave the following results:

Homology with a Predicted ORF from *N. gonorrhoeae*

ORF 258 shows 90.9% identity over a 386 aa overlap with a predicted ORF (ORF 258.ng) from *N. gonorrhoeae*:

```
m258/g258

                            10        20        30        40        50        60
m258.pep            MRRFLPIAAICAVVLLYGLTAATGSTSSLADYFWWIVAFSAMLLLVLSAVLARYVILLLK
                    ||||||||||||||||||||||||||||||||||||||:|||||||||||||||||||||
g258                MRRFLPIAAICAVVLLYGLTAATGSTSSLADYFWWIVSFSAMLLLVLSAVLARYVILLLK
                            10        20        30        40        50        60

                            70        80        90       100       110       120
m258.pep            DRRDGVFGSQIAKRLSGMFTLVAVLPGVFLFGVSAQFINGTINSWFGNDTHEALERSLNL
                    |||:|||||||||||||||||||||||:||||:|||||||||||||||||||||||||||
g258                DRRRGVFGSQIAKRLSGMFTLVAVLPGLFLFGISAQFINGTINSWFGNDTHEALERSLNL
                            70        80        90       100       110       120

                           130       140       150       160       170       180
m258.pep            SKSALNLAADNALGNAVPVQIDLIGAASLPGDMGRVLEHYAGSGFAQLALYNAASGKIEK
                    |||||:||||||::|||||||||||:||| |:|| |||||||||||||||||||||||||
g258                SKSALDLAADNAVSNAVPVQIDLIGTASLSGNMGSVLEHYAGSGFAQLALYNAASGKIEK
                           130       140       150       160       170       180

                           190       200       210       220       230       240
m258.pep            SINPHKLDQPFPGKARWEKIQRAGSVRDLESIGGVLYAQGWLSAGTHNGRDYALFFRQPV
                    |||||::|||:| | :||:||::||||:|||||||||||||||||||||||||||||||:
g258                SINPHQFDQPLPDKEHWEQIQQTGSVRSLESIGGVLYAQGWLSAGTHNGRDYALFFRQPI
                           190       200       210       220       230       240

                           250       260       270       280       290       300
m258.pep            PKGVAEDAVLIEKARAKYAELSYSKKGLQTFFLATLLIASLLSIGLALVMALYFARRFVE
                    |::||:|||||||||||||||||||||||||||:||||||||||||||||||||||||||
g258                PENVAQDAVLIEKARAKYAELSYSKKGLQTFFLVTLLIASLLSIGLALVMALYFARRFVE
                           250       260       270       280       290       300

                           310       320       330       340       350       360
m258.pep            PVLSLAEGAKAVAQGDFSQTRPVLRNDEFGRLTKLFNHMTWQLSIAKEADERNRRREEAA
                    |:||||||||||||||||||||||||||||||||||||||||||||||||||||||||||
g258                PILSLAEGAKAVAQGDFSQTRPVLRNDEFGRLTKLFNHMTWQLSIAKEADERNRRREEAA
                           310       320       330       340       350       360

                           370       380       390       400       410       420
m258.pep            RHYLECVLEGLTTGVVVFDEQGCLKTFNKAAEQILGMPLTPLWGSSRHGWHGVSAQQSLL
                    ||||||||:||||||||    :| :|
g258                RHYLECVLDGLTTGVVVSYOKSCCRTAVFSTCHSSPLSYFX
                           370       380       390       400
```

The following partial DNA sequence was identified in *N. meningitidis* <SEQ ID 1027>:

```
a258.seq
   1  ATGCGCCGTT TTCTACCGAT CGCAGCCATA TGCGCCGTCG TCCTGTTGTA

  51  CGGACTGACG GCGGCAACCG GCAGCACCAG TTCGCTGGCG GATTATTTCT

 101  GGTGGATTGT TGCGTTCAGC GCAATGCTGC TGCTGGTGTT GTCCGCCGTT

 151  TTGGCACGTT ATGTCATATT GCTGTTGAAA GACAGGCGCG ACGGCGTATT

 201  CGGTTCGCAG ATTGCCAAAC GCCTTTCCGG GATGTTTACG CTGGTTGCCG

 251  TACTGCCCGG CGTGTTTCTG TTCGGCGTTT CCGCACAGTT TATCAACGGC

 301  ACGATTAATT CGTGGTTCGG CAACGATACC CACGAGGCGC TTGAACGCAG

 351  CCTCAATTTG AGCAAGTCCG CATTGAATCT GGCGGCAGAC AACGCCCTTG

 401  GCAACGCCAT CCCCGTGCAG ATAGACCTCA TCGGCGCGGC TTCCCTGCCC

 451  GGGGATATGG GCAGGGTGCT GGAACATTAC GCCGGCAGCG GTTTTGCCCA

 501  GCTTGCCCTG TACAATGCCG CAAGCGGCAA AATCGAAAAA AGCATCAACC

 551  CGCACAAGCT CGATCAGCCG TTTCCAGGTA AGGCGCGTTG GGAAAAAATC

 601  CAACAGGCGG GTTCGGTCAG GGATTTGGAA AGCATAGGCG GCGTATTGTA

 651  CGCGCAGGGC TGGCTGTCGG CAGGTACGCA CAACGGGCGC GATTACGCCT

 701  TGTTTTTCCG TCAGCCGGTT CCCAAAGGCG TGGCAGAGGA TGCCGTCTTA
```

-continued

```
 751  ATCGAAAAGG CAAGGGCGAA ATATGCTGAG TTGAGTTACA GCAAAAAAGG
 801  TTTGCAGACC TTTTTCCTGG CAACCCTGCT GATTGCCTCG CTGCTGTCGA
 851  TTTTTCTTGC ACTGGTCATG GCACTGTATT TCGCCCGCCG TTTCGTCGAA
 901  CCCGTCCTAT CGCTTGCCGA GGGGGCGAAG GCGGTGGCGC AAGGCGATTT
 951  CAGCCAGACG CGCCCCGTGT TGCGCAACGA CGAGTTCGGA CGCTTGACCA
1001  AGTTGTTCAA CCACATGACC GAGCAGCTTT CCATCGCCAA AGAAGCAGAC
1051  GAGCGCAACC GCCGGCGCGA GGAAGCCGCC AGACATTATC TCGAATGCGT
1101  GTTGGAGGGG CTGACCACGG GCGTGGTGGT GTTTGACGAA CAAGGCTGTC
1151  TGAAAACCTT CAACAAAGCG GCGGAACAGA TTTTGGGGAT GCCGCTTACC
1201  CCCCTGTGGG GCAGCAGCCG GCACGGTTGG CACGGCGTTT CGGCGCAGCA
1251  GTCCCTGCTT GCCGAAGTGT TTGCCGCCAT CGGCGCGGCG GCAGGTACGG
1301  ACAAACCGGT CCATGTGAAA TATGCCGCGC CGGACGATGC CAAAATCCTG
1351  CTGGGCAAGG CAACCGTCCT GCCCGAAGAC AACGGCAACG GCGTGGTAAT
1401  GGTGATTGAC GACATCACCG TTTTGATACA CGCGCAAAAA GAAGCCGCGT
1451  GGGGCGAAGT GGCAAAACGG CTGGCACACG AAATCCGCAA TCCGCTCACG
1501  CCCATCCAGC TTTCTGCCGA ACGGCTGGCG TGGAAATTGG GCGGGAAGCT
1551  GGACGAGCAG GACGCGCAAA TCCTGACACG TTCGACCGAC ACCATCATCA
1601  AACAAGTGGC GGCATTAAAA GAAATGGTCG AGGCATTCCG CAATTACGCG
1651  CGTTCCCCTT CGCTCAAATT GGAAAATCAG GATTTGAACG CCTTAATCGG
1701  CGATGTGTTG GCATTGTACG AAGCTGGTCC GTGCCGGTTT GCGGCGGAAC
1751  TTGCCGGCGA ACCGCTGATG ATGGCGGCGG ATACGACCGC CATGCGGCAG
1801  GTGCTGCACA ATATTTTCAA AAATGCCGCC GAAGCGGCGG AAGAAGCCGA
1851  TGTGCCCGAA GTCAGGGTAA AATCGGAAGC GGGGCAGGAC GGACGGATTG
1901  TCCTGACAGT TTGCGACAAC GGCAAGGGGT TCGGCAGGGA AATGCTGCAC
1951  AATGCCTTCG AGCCGTATGT AACGGACAAA CCGGCTGGAA CGGGATTGGG
2001  ACTGCCCGTG GTGAAAAAAA TCATTGAAGA ACACGGCGGC CGCATCAGCC
2051  TGAGCAATCA GGATGCGGGC GGCGCGTGTG TCAGAATCAT CTTGCCAAAA
2101  ACGGTAGAAA CTTATGCGTA G
```

This corresponds to the amino acid sequence <SEQ ID 1028; ORF 258.a>:

```
a258.pep
  1  MRRFLPIAAI CAVVLLYGLT AATGSTSSLA DYFWWIVAFS AMLLLVLSAV
 51  LARYVILLLK DRRDGVFGSQ IAKRLSGMFT LVAVLPGVFL FGVSAQFING
101  TINSWFGNDT HEALERSLNL SKSALNLAAD NALGNAIPVQ IDLIGAASLP
151  GDMGRVLEHY AGSGFAQLAL YNAASGKIEK SINPHKLDQP FPGKARWEKI
201  QQAGSVRDLE SIGGVLYAQG WLSAGTHNGR DYALFFRQPV PKGVAEDAVL
251  IEKARAKYAE LSYSKKGLQT FFLATLLIAS LLSIFLALVM ALYFARRFVE
301  PVLSLAEGAK AVAQGDFSQT RPVLRNDEFG RLTKLFNHMT EQLSIAKEAD
351  ERNRRREEAA RHYLECVLEG LTTGVVVFDE QGCLKTFNKA AEQILGMPLT
401  PLWGSSRHGW HGVSAQQSLL AEVFAAIGAA AGTDKPVHVK YAAPDDAKIL
```

-continued

```
451 LGKATVLPED NGNGVVMVID DITVLIHAQK EAAWGEVAKR LAHEIRNPLT

501 PIQLSAERLA WKLGGKLDEQ DAQILTRSTD TIIKQVAALK EMVEAFRNYA

551 RSPSLKLENQ DLNALIGDVL ALYEAGPCRF AAELAGEPLM MAADTTAMRQ

601 VLHNIFKNAA EAAEEADVPE VRVKSEAGQD GRIVLTVCDN GKGFGREMLH

651 NAFEPYVTDK PAGTGLGLPV VKKIIEEHGG RISLSNQDAG GACVRIILPK

701 TVETYA*
```

m258/a258 99.0% identity in 584 aa overlap

```
                    10        20        30        40        50        60
m258.pep    MRRFLPIAAICAVVLLYGLTAATGSTSSLADYFWWIVAFSAMLLLVLSAVLARYVILLLK
            ||||||||||||||||||||||||||||||||||||||||||||||||||||||||||||
a258        MRRFLPIAAICAVVLLYGLTAATGSTSSLADYFWWIVAFSAMLLLVLSAVLARYVILLLK
                    10        20        30        40        50        60

                    70        80        90       100       110       120
m258.pep    DRRDGVFGSQIAKRLSGMFTLVAVLPGVFLFGVSAQFINGTINSWFGNDTHEALERSLNL
            ||||||||||||||||||||||||||||||||||||||||||||||||||||||||||||
a258        DRRDGVFGSQIAKRLSGMFTLVAVLPGVFLFGVSAQFINGTINSWFGNDTHEALERSLNL
                    70        80        90       100       110       120

                   130       140       150       160       170       180
m258.pep    SKSALNLAADNALGNAVPVQIDLIGAASLPGDMGRVLEHYAGSGFAQLALYNAASGKIEK
            ||||||||||||||||:|||||||||||||||||||||||||||||||||||||||||||
a258        SKSALNLAADNALGNAIPVQIDLIGAASLPGDMGRVLEHYAGSGFAQLALYNAASGKIEK
                   130       140       150       160       170       180

                   190       200       210       220       230       240
m258.pep    SINPHKLDQPFPGKARWEKIQRAGSVRDLESIGGVLYAQGWLSAGTHNGRDYALFFRQPV
            |||||||||||||||||||||:||||||||||||||||||||||||||||||||||||||
a258        SINPHKLDQPFPGKARWEKIQQAGSVRDLESIGGVLYAQGWLSAGTHNGRDYALFFRQPV
                   190       200       210       220       230       240

                   250       260       270       280       290       300
m258.pep    PKGVAEDAVLIEKARAKYAELSYSKKGLQTFFLATLLIASLLSIFLALVMALYFARRFVE
            ||||||||||||||||||||||||||||||||||||||||||||||||||||||||||||
a258        PKGVAEDAVLIEKARAKYAELSYSKKGLQTFFLATLLIASLLSIFLALVMALYFARRFVE
                   250       260       270       280       290       300

                   310       320       330       340       350       360
m258.pep    PVLSLAEGAKAVAQGDFSQTRPVLRNDEFGRLTKLFNHMTEQLSIAKEADERNRRREEAA
            ||||||||||||||||||||||||||||||||||||||||||||||||||||||||||||
a258        PVLSLAEGAKAVAQGDFSQTRPVLRNDEFGRLTKLFNHMTEQLSIAKEADERNRRREEAA
                   310       320       330       340       350       360

                   370       380       390       400       410       420
m258.pep    RHYLECVLEGLTTGVVVFDEQGCLKTFNKAAEQILGMPLTPLWGSSRHGWHGVSAQQSLL
            ||||||||||||||||||||||||||||||||||||||||||||||||||||||||||||
a258        RHYLECVLEGLTTGVVVFDEQGCLKTFNKAAEQILGMPLTPLWGSSRHGWHGVSAQQSLL
                   370       380       390       400       410       420

                   430       440       450       460       470       480
m258.pep    AEVFAAIGAAAGTDKPVHVKYAAPDDAKILLGKATVLPEDNGNGVVMVIDDITVLIHAQK
            ||||||||||||||||||||||||||||||||||||||||||||||||||||||||||||
a258        AEVFAAIGAAAGTDKPVHVKYAAPDDAKILLGKATVLPEDNGNGVVMVIDDITVLIHAQK
                   430       440       450       460       470       480

                   490       500       510       520       530       540
m258.pep    EAAWGEVAKRLAHEIRNPLTPIQLSAERXAXKLGGKLDEQDAQILTRSTDTIVKQVAALK
            |||||||||||||||||||||||||||| | |||||||||||||||||||||:|||||||
a258        EAAWGEVAKRLAHEIRNPLTPIQLSAERLAWKLGGKLDEQDAQILTRSTDTIIKQVAALK
                   490       500       510       520       530       540

                   550       560       570       580      589
m258.pep    EMVEAFRNYARSPSLKLENQDLNALIGDVLALYEAGPCRFAADLPANRX
            ||||||||||||||||||||||||||||||||||||||||||:|
a258        EMVEAFRNYARSPSLKLENQDLNALIGDVLALYEAGPCRFAAELAGEPLMMAADTTAMRQ
                   550       560       570       580       590       600

a258        VLHNIFKNAAEAAEEADVPEVRVKSEAGQDGRIVLTVCDNGKGFGREMLHNAFEPYVTDK
                   610       620       630       640       650       660
```

The following partial DNA sequence was identified in *N. gonorrhoeae* <SEQ ID 1029>:

```
g259.seq
  1  atgatgatgc acgcttctgt ccaaagtcgt ttcgcaccga tactttatgt

 51  tttgattttc tttgccggtt ttttgaccgc gcaaatctgg ttcaatcaga
```

-continued

```
101 aagcctatac tgaagagctg cctccgcttc tgtccgcatt gtccgccgtc

151 gcgctggtgt ggctggcgtg ggcgttcgtg tcggtgcgtt caaaggctaa

201 ggcagaaaag ttctaccgcg aaaaaatgat acagaacgaa agcatacacc

251 ccgtcctgca cgcttctttg caacacttgg aacacaagcc gcaaatgctc

301 gccctgctgg tcaaaaacca cggcaaaggc atggcggaac aggtcaggtt

351 caaggcggaa gtgctgcccg acgacgaaga cgcgcgcacg attgccgccg

401 agttggcaaa aatggatatg ttcgcattgg ggacggacgc ggtcgcctcg

451 ggcgaaacct atgggcgcgt gttcgccgat attttcgagt tgtcggcggc

501 tttggaaagg cgcgcgttca aagggatact gaaactgacg gcggaatata

551 aaaaacatct tcggcgatgc ctgccgttcg gaaacggcgt tggatttggg

601 cgcgctcaat caggcgttga gggaaatctc gaaaacgccg gaaaagccta

651 a
```

This corresponds to the amino acid sequence <SEQ ID 1030; ORF 259.ng>:

```
g259.pep
  1 MMMHASVQSR FAPILYVLIF FAGFLTAQIW FNQKAYTEEL PPLLSALSAV

 51 ALVWLAWAFV SVRSKAKAEK FYREKMIQNE SIHPVLHASL QHLEHKPQML

101 ALLVKNHGKG MAEQVRFKAE VLPDDEDART IAAELAKMDM FALGTDAVAS

151 GETYGRVFAD IFELSAALER RAFKGILKLT AEYKKHLRRC LPFGNGVGFG

201 RAQSGVEGNL ENAGKA*
```

The following partial DNA sequence was identified in *N. meningitidis* <SEQ ID 1031>:

```
m259.seq (partial)
  1 ATGATGATGC ACGCTTCTGT CCAAAGCCGT TTCGCACCGA TACTTTATGT

 51 TTTGATTTTC TTTGCCGGTT TTTTGACCGC GCAAATCTGG TTCAATCAGA

101 AAGCCTATAC TGAAGAGCTG CCTCCGCTTC TGTCCGCATT GTCCGCCGTC

151 GCGCTGGTGT GGCTGGCGTG GGCGTTCGTG TCGGCGCGTT CAAAGGCCAA

201 GGCGGAAAAG TTCTACCGCG AAAAAATGAT ACAGAACGAA AGCATACACC

251 CCGTCsTGCA CGCCTCTTTG CAACACTTGG AACACAAGCC GCAAATACTC

301 GCCCTGCTGG TCAAAAACCA CGGCAAAGGG ATGGCGGAAC AGGTCAGGTT

351 CAAGGCGGAA GTGCTGCCCG ACGACGAAGA CGCGCGCACG ATTGCCGCCG

401 AGTTGGCAAA AATGGATATG TTCGCATTGG GGACkGACGC GGTCGCCTCG

451 GGCGAAACCT ATGGACGCGT GTTCGCCGAT ATTTTCGAGT TGTCGGmGGC

501 TTTGGAAGGG CGCGCGTTCA AAGGAATGTT GAAACTGACG GCGGAATATA

551 AA.AACATCT TCGGmGATGC CTGCCGTTCG GAAACGGCGT TGGAGTTGGG

601 CGCACTCAAT CAGGCGTTGC AGGAGATTTC AAAAACATCC GG..
```

This corresponds to the amino acid sequence <SEQ ID 1032; ORF 259>:

```
m259.pep (partial)
  1 MMMHASVQSR FAPILYVLIF FAGFLTAQIW FNQKAYTEEL PPLLSALSAV
```

-continued

```
 51 ALVWLAWAFV SARSKAKAEK FYREKMIQNE SIHPVXHASL QHLEHKPQIL

101 ALLVKNHGKG MAEQVRFKAE VLPDDEDART IAAELAKMDM FALGTDAVAS

151 GETYGRVFAD IFELSXALEG RAFKGMLKLT AEYKXHLRRC LPFGNGVGVG

201 RTQSGVAGDF KNIR..
```

Computer analysis of this amino acid sequence gave the following results:

Homology with a Predicted ORF from *N. gonorrhoeae*

ORF 259 shows 94.3% identity over a 212 aa overlap with a predicted ORF (ORF 259.ng) from *N. gonorrhoeae*:

```
m259/g259

                   10        20        30        40        50        60
m259.pep   MMMHASVQSRFAPILYVLIFFAGFLTAQIWFNQKAYTEELPPLLSALSAVALVWLAWAFV
           ||||||||||||||||||||||||||||||||||||||||||||||||||||||||||||
g259       MMMHASVQSRFAPILYVLIFFAGFLTAQIWFNQKAYTEELPPLLSALSAVALVWLAWAFV
                   10        20        30        40        50        60

                   70        80        90       100       110       120
m259.pep   SARSKAKAEKFYREKMIQNESIHPVXHASLQHLEHKPQILALLVKNHGKGMAEQVRFKAE
           |:||||||||||||||||||||| |||||||||||:||||||||||||||||||||||||
g259       SVRSKAKAEKFYREKMIQNESIHPVLHASLQHLEHKPQMLALLVKNHGKGMAEQVRFKAE
                   70        80        90       100       110       120

                  130       140       150       160       170       180
m259.pep   VLPDDEDARTIAAELAKMDMFALGTDAVASGETYGRVFADIFELSXALEGRAFKGMLKLT
           ||||||||||||||||||||||||||||||||||||||||||||| ||| |||||:||||
g259       VLPDDEDARTIAAELAKMDMFALGTDAVASGETYGRVFADIFELSAALERRAFKGILKLT
                  130       140       150       160       170       180

                  190       200       210
m259.pep   AEYKKHLRRCLPFGNGVGVGRTQSGVAGDFKNIR
           ||||||||||||||||| ||:|||| |:::|
g259       AEYKKHLRRCLPFGNGVGFGRAQSGVEGNLENAGKAX
                  190       200       210
```

The following partial DNA sequence was identified in *N. meningitidis* <SEQ ID 1033>:

```
a259.seq (partial)
  1 ATGATGATGC ACGCTTCTGT CCAAAGCCGT TTCGCACCGA TACTTTATGT

 51 TTTGATTTTC TTTGCCGGTT TTTTGACCGC GCAAATCTGG TTCAATCAGA

101 AAGCCTATAC TGAAGAGCTG CCTCCGCTTC TGTCCGCATT GTCCGCCGTC

151 GCGCTGGTGT GGCTGGCGTG GGCGTTCGTG TCGGCGCGTT CAAAGGCTAA

201 GGCGGAAAAG TTCTACCGCG AAAAAATGAT ACAGAACGAA AGCATACACC

251 CCGTCCTGCA CGCTTCTTTG CAACACTTGG AACACAAGCC GCAAATGCTC

301 GCCCTGCTGG TCAAAAACCA CGGCAAAGGG ATGGCGGAAC AGGTCAGGTT

351 CAAGGCGGAA GTGCTGCCCG ACGACGAAGA CGCGCGCACG ATTGCCGCCG

401 AGTTGGCAAA AATGGATATG TTTGCATTGG GGACGGACGC GGTCGCCTCG

451 GGCGAAACCT ATGGACGCGT GTTCGCCGAT ATTTTCGAGT TGTCGGCGGC

501 TTTGGAAGGG CGCGCGTTCA AAGGAATGTT GAAACTGACG GCGGAATATA

551 AAAA.CATCT TCGGCGATGC CTGCCGTTCG GAAACGGCGT TGGAGTTGGG

601 CGCGCTCAAT CAGGCGTTGC AGGAGATTTC AAAAACATCG GAAAAGTCCA

651 A
```

This corresponds to the amino acid sequence <SEQ ID 1034; ORF 259.a>:

```
a259.pep (partial)
   1 MMMHASVQSR FAPILYVLIF FAGFLTAQIW FNQKAYTEEL PPLLSALSAV

  51 ALVWLAWAFV SARSKAKAEK FYREKMIQNE SIHPVLHASL QHLEHKPQML

 101 ALLVKNHGKG MAEQVRFKAE VLPDDEDART IAAELAKMDM FALGTDAVAS

 151 GETYGRVFAD IFELSAALEG RAFKGMLKLT AEYKXHLRRC LPFGNGVGVG

 201 RAQSGVAGDF KNIGKVQ
```

m259/a259 98.1% identity in 213 aa overlap

```
                    10        20        30        40        50        60
m259.pep    MMMHASVQSRFAPILYVLIFFAGFLTAQIWFNQKAYTEELPPLLSALSAVALVWLAWAFV
            ||||||||||||||||||||||||||||||||||||||||||||||||||||||||||||
a259        MMMHASVQSRFAPILYVLIFFAGFLTAQIWFNQKAYTEELPPLLSALSAVALVWLAWAFV
                    10        20        30        40        50        60

                    70        80        90       100       110       120
m259.pep    SARSKAKAEKFYREKMIQNESIHPVXHASLQHLEHKPQILALLVKNHGKGMAEQVRFKAE
            ||||||||||||||||||||||||| ||||||||||||:|||||||||||||||||||||
a259        SARSKAKAEKFYREKMIQNESIHPVLHASLQHLEHKPQMLALLVKNHGKGMAEQVRFKAE
                    70        80        90       100       110       120

                   130       140       150       160       170       180
m259.pep    VLPDDRDARTIAAELAKMDMFALGTDAVASGETYGRVFADIFELSXALEGRAFKGMLKLT
            ||||||||||||||||||||||||||||||||||||||||||||| ||||||||||||||
a259        VLPDDRDARTIAAELAKMDMFALGTDAVASGETYGRVFADIFELSAALEGRAFKGMLKLT
                   130       140       150       160       170       180

                   190       200       210
m259.pep    AEYKXHLRRCLPFGNGVGVGRTQSGVAGDFKNIR
            |||||||||||||||||||||:|||||||||||
a259        AEYKXHLRRCLPFGNGVGVGRAQSGVAGDFKNIGKVQ
                   190       200       210
```

The following partial DNA sequence was identified in *N. gonorrhoeae* <SEQ ID 1035>:

```
g259-1.seq
   1 ATGATGATGC ACGCTTCTGT CCAAAGTCGT TTCGCACCGA TACTTTATGT

  51 TTTGATTTTC TTTGCCGGTT TTTTGACCGC GCAAATCTGG TTCAATCAGA

 101 AAGCCTATAC TGAAGAGCTG CCTCCGCTTC TGTCCGCATT GTCCGCCGTC

 151 GCGCTGGTGT GGCTGGCGTG GGCGTTCGTG TCGGTGCGTT CAAAGGCTAA

 201 GGCAGAAAAG TTCTACCGCG AAAAAATGAT ACAGAACGAA AGCATACACC

 251 CCGTCCTGCA CGCTTCTTTG CAACACTTGG AACACAAGCC GCAAATGCTC

 301 GCCCTGCTGG TCAAAAACCA CGGCAAAGGC ATGGCGGAAC AGGTCAGGTT

 351 CAAGGCGGAA GTGCTGCCCG ACGACGAAGA CGCGCGCACG ATTGCCGCCG

 401 AGTTGGCAAA AATGGATATG TTCGCATTGG GGACGGACGC GGTCGCCTCG

 451 GGCGAAACCT ATGGGCGCGT GTTCGCCGAT ATTTTCGAGT TGTCGGCGGC

 501 TTTGGAA
```

This corresponds to the amino acid sequence <SEQ ID 1036; ORF 259-1.ng>:

```
g259-1.pep
   1 MMMHASVQSR FAPILYVLIF FAGFLTAQIW FNQKAYTEEL PPLLSALSAV

  51 ALVWLAWAFV SVRSKAKAEK FYREKMIQNE SIHPVLHASL QHLEHKPQML
```

-continued

```
101 ALLVKNHGKG MAEQVRFKAE VLPDDEDART IAAELAKMDM FALGTDAVAS

151 GETYGRVFAD IFELSAALE
```

The following partial DNA sequence was identified in *N. meningitidis* <SEQ ID 1037>:

```
m259-1.seq
  1 ATGATGATGC ACGCTTCTGT CCAAAGCCGT TTCGCACCGA TACTTTATGT

 51 TTTGATTTTC TTTGCCGGTT TTTTGACCGC GCAAATCTGG TTCAATCAGA

101 AAGCCTATAC TGAAGAGCTG CCTCCGCTTC TGTCCGCATT GTCCGCCGTC

151 GCGCTGGTGT GGCTGGCGTG GGCGTTCGTG TCGGCGCGTT CAAAGGCCAA

201 GGCGGAAAAG TTCTACCGCG AAAAAATGAT ACAGAACGAA AGCATACACC

251 CCGTCCTGCA CGCCTCTTTG CAACACTTGG AACACAAGCC GCAAATACTC

301 GCCCTGCTGG TCAAAAACCA CGGCAAAGGG ATGGCGGAAC AGGTCAGGTT

351 CAAGGCGGAA GTGCTGCCCG ACGACGAAGA CGCGCGCACG ATTGCCGCCG

401 AGTTGGCAAA AATGGATATG TTCGCATTGG GGACGGACGC GGTCGCCTCG

451 GGCGAAACCT ATGGACGCGT GTTCGCCGAT ATTTTCGAGT TGTCGGCGGC

501 TTTGGAAGGG CGCGCGTTCA AAGGAATGTT GAAACTGACG GCGGAATATA

551 AAAACATCTT CGGCGATGCC TGCCGTTCGG AAACGGCGTT GGAGTTGGGC

601 GCACTCAATC AGGCGTTGCA GGAGATTTCA AAAACATCGG AAAAGTCCAA

651 ACGGATATTT TATTGA
```

This corresponds to the amino acid sequence <SEQ ID 1038; ORF 259-1>:

```
m259-1.pep

  1 MMMHASVQSR FAPILYVLIF FAGFLTAQIW FNQKAYTEEL PPLLSALSAV

 51 ALVWLAWAFV SARSKAKAEK FYREKMIQNE SIHPVLHASL QHLEHKPQIL

101 ALLVKNHGKG MAEQVRFKAE VLPDDEDART IAAELAKMDM FALGTDAVAS

151 GETYGRVFAD IFELSAALEG RAFKGMLKLT AEYKNIFGDA CRSETALELG

201 ALNQALQEIS KTSEKSKRIF Y*

g259-1/m259-1    98.8% indentity in 169 aa overlap

                     10        20        30        40        50        60
g259-1.pep    MMMHASVQSRFAPILYVLIFFAGFLTAQIWFNQKAYTEELPPLLSALSAVALVWLAWAFV
              ||||||||||||||||||||||||||||||||||||||||||||||||||||||||||||
m259-1        MMMHASVQSRFAPILYVLIFFAGFLTAQIWFNQKAYTEELPPLLSALSAVALVWLAWAFV
                     10        20        30        40        50        60

                     70        80        90       100       110       120
g259-1.pep    SVRSKAKAEKFYREKMIQNESIHPVLHASLQHLEHKPQMLALLVKNHGKGMAEQVRFKAE
              |:|||||||||||||||||||||||||||||||||||||:||||||||||||||||||||
m259-1        SARSKAKAEKFYREKMIQNESIHPVLHASLQHLEHKPQILALLVKNHGKGMAEQVRFKAE
                     70        80        90       100       110       120

                    130       140       150       160      169
g259-1.pep    VLPDDEDARTIAAELAKMDMFALGTDAVASGETYGRVFADIFELSAALE
              |||||||||||||||||||||||||||||||||||||||||||||||||
m259-1        VLPDDEDARTIAAELAKMDMFALGTDAVASGETYGRVFADIFELSAALEGRAFKGMLKLT
                    130       140       150       160       170       180
```

The following partial DNA sequence was identified in *N. meningitidis* <SEQ ID 1039>:

```
a259-1.seq
 1  ATGATGATGC ACGCTTCTGT CCAAAGCCGT TTCGCACCGA TACTTTATGT
```

-continued

```
 51 TTTGATTTTC TTTGCCGGTT TTTTGACCGC GCAAATCTGG TTCAATCAGA

101 AAGCCTATAC TGAAGAGCTG CCTCCGCTTC TGTCCGCATT GTCCGCCGTC

151 GCGCTGGTGT GGCTGGCGTG GGCGTTCGTG TCGGCGCGTT CAAAGGCTAA

201 GGCGGAAAAG TTCTACCGCG AAAAAATGAT ACAGAACGAA AGCATACACC

251 CCGTCCTGCA CGCTTCTTTG CAACACTTGG AACACAAGCC GCAAATGCTC

301 GCCCTGCTGG TCAAAAACCA CGGCAAAGGG ATGGCGGAAC AGGTCAGGTT

351 CAAGGCGGAA GTGCTGCCCG ACGACGAAGA CGCGCGCACG ATTGCCGCCG

401 AGTTGGCAAA AATGGATATG TTTGCATTGG GGACGGACGC GGTCGCCTCG

451 GGCGAAACCT ATGGACGCGT GTTCGCCGAT ATTTTCGAGT TGTCGGCGGC

501 TTTGGAAGGG CGCGCGTTCA AAGGAATGTT GAAACTGACG GCGGAATATA

551 AAAACATCTT CGGCGATGCC TGCCGTTCGG AAACGGCGTT GGAGTTGGGC

601 GCGCTCAATC AGGCGTTGCA GGAGATTTCA AAAACATCGG AAAAGTCCAA

651 ACGGATATTT TATTGA
```

This corresponds to the amino acid sequence <SEQ ID 1040; ORF 259-1.a>:

```
a259-1.pep
      1 MMMHASVQSR FAPILYVLIF FAGFLTAQIW FNQKAYTEEL PPLLSALSAV

     51 ALVWLAWAFV SARSKAKAEK FYREKMIQNE SIHPVLHASL QHLEHKPQML

    101 ALLVKNHGKG MAEQVRFKAE VLPDDEDART IAAELAKMDM FALGTDAVAS

    151 GETYGRVFAD IFELSAALEG RAFKGMLKLT AEYKNIFGDA CRSETALELG

    201 ALNQALQEIS KTSEKSKRIF Y*

g259-1/m259-1    99.5% indentity in 221 aa overlap

                   10        20        30        40        50        60
a259-1.pep   MMMHASVQSRFAPILYVLIFFAGFLTAQIWFNQKAYTEELPPLLSALSAVALVWLAWAFV
             ||||||||||||||||||||||||||||||||||||||||||||||||||||||||||||
m259-1       MMMHASVQSRFAPILYVLIFFAGFLTAQIWFNQKAYTEELPPLLSALSAVALVWLAWAFV
                   10        20        30        40        50        60

                   70        80        90       100       110       120
a259-1.pep   SARSKAKAEKFYREKMIQNESIHPVLHASLQHLEHKPQMLALLVKNHGKGMAEQVRFKAE
             |||||||||||||||||||||||||||||||||||||:||||||||||||||||||||||
m259-1       SARSKAKAEKFYREKMIQNESIHPVLHASLQHLEHKPQILALLVKNHGKGMAEQVRFKAE
                   70        80        90       100       110       120

                  130       140       150       160      169
a259-1.pep   VLPDDEDARTIAAELAKMDMFALGTDAVASGETYGRVFADIFELSAALEGRAFKGMLKLT
             ||||||||||||||||||||||||||||||||||||||||||||||||||||||||||||
m259-1       VLPDDEDARTIAAELAKMDMFALGTDAVASGETYGRVFADIFELSAALEGRAFKGMLKLT
                  130       140       150       160       170       180

                  190       200       210       220
a259-1.pep   AEYKNIFGDACRSETALELGALNQALQEISKTSEKSKRIFYX
             ||||||||||||||||||||||||||||||||||||||||||
m259-1       AEYKNIFGDACRSETALELGALNQALQEISKTSEKSKRIFYX
                  190       200       210       220
```

The following partial DNA sequence was identified in *N. gonorrhoeae* <SEQ ID 1041>:

```
g260.seq
  1 atgggtgcgg gtgtagtatt cgttgtcttt cagccgttct tcagcctgtt

 51 tcgagcgttg ttcgagggcg gagtcggtat agtcgaggga gcgcacgatg

101 ccgctgaatg cgacttcttg tccgaggaat ttacccgtat ccggatcggt

151 gatgttttta ttgattcggt aggtcagata acggcccggt tctttcaggc
```

-continued

```
201 ctttggtgta aaccctggcg cctttggtgt acagcagcct gccttccggg
251 cccgagagca ggcgcggcgc ggcagcggtt tctttgcggg aaacgatttg
301 cgggtgctgc ataaagacgc ggtagaagtt gacatcgatg gcgggaatac
351 cgtatccgga cacttcctta tccggactga ttttgacgac ggggatgccg
401 tctgtctgtt ccaagccgag gcgcggttcg ccgccaacgt agcgcaacac
451 caatacctgg cccggataaa tcaggtcggg attgtggatt tgatcccggt
501 tcgcgcccca caggggggga ccattgccac gggctgtaca ggtatttgcc
551 cgaaataccc cacagggtgt cgccctgttt ga
```

This corresponds to the amino acid sequence <SEQ ID 1042; ORF 260.ng>:

```
g260.pep
  1 MGAGVVFVVF QPFFSLFRAL FEGGVGIVEG AHDAAECDFL SEEFTRIRIG
 51 DVFIDSVGQI TARFFQAFGV NPGAFGVQQP AFRAREQARR GSGFFAGNDL
101 RVLHKDAVEV DIDGGNTVSG HFLIRTDFDD GDAVCLFQAE ARFAANVAQH
151 QYLARINQVG IVDLIPVRAP QGGTIATGCT GICPKYPTGC RPV*
```

The following partial DNA sequence was identified in *N. meningitidis* <SEQ ID 1043>:

```
m260.seq
  1 ATGGGTGCGG GTATGGTATT CGTTGTCTTT CGGCCGTTCT CCAGCCTGTT
 51 TCGAGCGTTG TTCGAGGACA GAGTCGGTAT AGTCGAGGGA GCGCACGATG
101 CCGCTGAATG CGACTTCCTG CCCGAGGAAT TTACCCGTAT CCGGATCGGT
151 GATGTTTTTA TTGATTCGGT AGGTCAGGTA GCGGCCCGGC TCTTTCAGGC
201 CTTTGGTGTA AACCCTGGTG CCTTTGGTGT ACAGCAGCCT GCCTTCCGGG
251 CCCGAGwrCA sGCGCGGyGC GGCAGCGGTT TCTTTGCGGG AAACGATTTG
301 CGGATGCCGC ATAAAGATGC GGTAGAAGTT GACATCGATG GCGGGAATAC
351 CGTATCCGGA CACTTCCTTA TCCGGACTCA TTTTGACGAC GGGGATGCCG
401 TCTGTCTGTT CCAAGCCGAG GCGCGGTTCG CCGTCAACGT GGCGCAACAC
451 CAATACCTGG TCCGGATAAA TCAGGTCGGG ATTGTGGATT TGATCCCGGT
501 TCGCGTyCCA CAG
```

This corresponds to the amino acid sequence <SEQ ID 1044; ORF 260>:

```
m260.pep
  1 MGAGMVFVVF RPFSSLFRAL FEDRVGIVEG AHDAAECDFL PEEFTRIRIG
 51 DVFIDSVGQV AARLFQAFGV NPGAFGVQQP AFRARXXARX GSGFFAGNDL
101 RMPHKDAVEV DIDGGNTVSG HFLIRTHFDD GDAVCLFQAE ARFAVNVAQH
151 QYLVRINQVG IVDLIPVRVP Q
```

Computer analysis of this amino acid sequence gave the following results:

Homology with a Predicted ORF from *N. gonorrhoeae*

ORF 260 shows 89.5% identity over a 171 aa overlap with a predicted ORF (ORF 260.ng) from *N. gonorrhoeae*:

```
m260/g260

                   10        20        30        40        50        60
m260.pep   MGAGMVFVVFRPFSSLFRALFEDRVGIVEGAHDAAECDFLPEEFTRIRIGDVFIDSVGQV
           ||||:|||||:|| ||||||||  |||||||||||||||| ||||||||||||||||||:
g260       MGAGVVFVVFQPFFSLFRALFEGGVGIVEGAHDAAECDFLSEEFTRIRIGDVFIDSVGQI
                   10        20        30        40        50        60

                   70        80        90       100       110       120
m260.pep   AARLFQAFGVNPGAFGVQQPAFRARXXARXGSGFFAGNDLRMPHKDAVEVDIDGGNTVSG
           :||:|||||||||||||||||||||  || |||||||||||: |||||||||||||||||
g260       TARFFQAFGVNPGAFGVQQPAFRAREQARXGSGFFAGNDLRVLHKDAVEVDIDGGNTVSG
                   70        80        90       100       110       120

                  130       140       150       160       170       180
m260.pep   HFLIRTHFDDGDAVCLFQAEARFAVNVAQHQYLVRINQVGIVDLIPVRVPQ
           |||||| |||||||||||||||||:||||||||:||||||||||||||:||
g260       HFLIRTDFDDGDAVCLFQAEARFAANVAQHQYLARINQVGIVDLIPVRAPQGGTIATGCT
                  130       140       150       160       170       180

g260       GICPKYPTGCRPV
                  190
```

The following partial DNA sequence was identified in *N. meningitidis* <SEQ ID 1045>:

```
a260.seq
   1 ATGGGTGCGG GTATGGTATT CGTTGTCTTT CGGCCGTTCT CCAGCCTGTT

  51 TCGAGCGTTG TTCGAGGACA GAGTCGGTAT AGTCGAGGGA GCGCACGATG

 101 CCGCTGAATG CGACTTCCTG CCCGAGGAAT TTACCCGTAT CCGGATCGGT

 151 GATGTTTTTA TTGATTCGGT AGGTCAGGTA GCGGCCCGGC TCTTTCAGGC

 201 CTTTGGTGTA AACCCTGGTG CCTTTGGTGT ACAGCAGCCT GCCTTCCGGG

 251 CCCGAGAGCA GGCGCGGCGC GGCAGCGGTT TCTTTGCGGG AAACGATTTG

 301 CGGGTGCCGC ATAAAGATGC GGTAGAAGTT GACATCGATG GCGGGAATAC

 351 CGTATCCGGA CACTTCCTTA TCCGGACTCA TTTTGACGAC GGGGATGCCG

 401 TCTGTCTGTT CCAAGCCGAG GCGCGGTTCG CCGTCAACGT GGCGCAACAC

 451 CAATACCTGG TCCAGATAAA TCAGGTCGGG ATTGTGGATT TGATCCCGGT

 501 TCGCGTCCCA CAGGCGGCC. CCATTGCCAC GGGCTGTACA GGTATTTGCC

 551 CGAAATGCCC CACAGGGTGT CGCCCTGTTT GA
```

This corresponds to the amino acid sequence <SEQ ID 1046; ORF 260.a>:

```
a260.pep
   1 MGAGMVFVVF RPFSSLFRAL FEDRVGIVEG AHDAAECDFL PEEFTRIRIG

  51 DVFIDSVGQV AARLFQAFGV NPGAFGVQQP AFRAREQARR GSGFFAGNDL

 101 RVPHKDAVEV DIDGGNTVSG HFLIRTHFDD GDAVCLFQAE ARFAVNVAQH

 151 QYLVQINQVG IVDLIPVRVP QAAXIATGCT GICPKCPTGC RPV*
```

m260/a260 97.1% identity in 171 aa overlap

```
                    10        20        30        40        50        60
m260.pep    MGAGMVFVVFRPFSSLFRALFEDRVGIVEGAHDAAECDFLPEEFTRIRIGDVFIDSVGQV
            ||||||||||||||||||||||||||||||||||||||||||||||||||||||||||||
a260        MGAGMVFVVFRPFSSLFRALFEDRVGIVEGAHDAAECDFLPEEFTRIRIGDVFIDSVGQV
                    10        20        30        40        50        60

                    70        80        90       100       110       120
m260.pep    AARLFQAFGVNPGAFGVQQPAFRARXXARXGSGFFAGNDLRMPHKDAVEVDIDGGNTVSG
            |||||||||||||||||||||||||  || |||||||||||:||||||||||||||||||
a260        AARLFQAFGVNPGAFGVQQPAFRAREQARRGSGFFAGNDLRVPHKDAVEVDIDGGNTVSG
                    70        80        90       100       110       120

                   130       140       150       160       170
m260.pep    HFLIRTHFDDGDAVCLFQAEARFAVNVAQHQYLVRINQVGIVDLIPVRVPQ
            ||||||||||||||||||||||||||||||||||:||||||||||||||||
a260        HFLIRTHFDDGDAVCLFQAEARFAVNVAQHQYLVQINQVGIVDLIPVRVPQAAXIATGCT
                   130       140       150       160       170       180

a260        GICPKCPTGCRPVX
                   190
```

The following partial DNA sequence was identified in *N. gonorrhoeae* <SEQ ID 1047>:

```
g261.seq
   1 atggagcttg ggcatatcgt attccttgtg ctttgcgcgc gttcagacgg

  51 ccttttttact ttccagacat tccgccagcc cgcgttcgcg caagatacag

 101 ctcgggcatt cgcggcagcc gccgacgata cccttgtagc aggtgtgggt

 151 ctgttcgcgg atgtagtcca acacgcccat ttcgtccgcc aacgcccacg

 201 tttgcgcctt ggtcaggtac atcagcggcg tgtggatttg aaaatcgtag

 251 tccatcgcca gattaagggt aacgttcatg gatttgacga acacgccgcg

 301 gcagtcggga tagcccgaaa aatcggtttc gcacacgccc gcgatgatgt

 351 gccggatacc ctgccctttg gcaaaaatgg cggcgtaaag caggaaaagc

 401 gcgttacgcc cgtccacaaa ggtattggga acgccgttgt cggcggtttc

 451 gatggcggcg gtttcgatgg cggcggtttc gtccatcagg gcgttgtgcg

 501 taatctgccg catcaggctc aaatcgagta cggtttgact gacacccaaa

 551 tcctgcgcga tccactctgc gcgttccagc tcgacggcat ggcgttgccc

 601 gtatcggaag gtgatggctt ggacgttttc gcgcccgtag gtttggattg

 651 cctgaatcag gcaggtggtc gaatcctgac cgcccgagaa gatgaccaag

 701 gctttttggt ttga
```

This corresponds to the amino acid sequence <SEQ ID 1048; ORF 261.ng>:

```
g261.pep
   1 MELGHIVFLV LCARSDGLFT FQTFRQPAFA QDTARAFAAA ADDTLVAGVG

  51 LFADVVQHAH FVRQRPRLRL GQVHQRRVDL KIVVHRQIKG NVHGFDEHAA

 101 AVGIARKIGF AHARDDVPDT LPFGKNGGVK QEKRVTPVHK GIGNAVVGGF

 151 DGGGFDGGGF VHQGVVRNLP HQAQIEYGLT DTQILRDPLC AFQLDGMALP

 201 VSEGDGLDVF APVGLDCLNQ AGGRILTARE DDQGFLV*
```

The following partial DNA sequence was identified in *N. meningitidis* <SEQ ID 1049>:

```
m261.seq
   1 ATGGAGCTTG GGCATATCGT ATTCCTTATG GTTTGCGCGT GTTCAGACGG

51 CCTTTTTACT TTCCAGATAT TCCGCCAGCC cGcGTTCGCG CAAGATACAG

101 CTCGGGCATT CGCGgCAGCC GCCGACGATG CCGTTATAGC AGGTGTGGGT

151 TTGCTCGCGG ATATAGTCCA GCACGCCCAT TTCGTCCGCC AACGCCCACG

201 TTTGCGCCTT GGTCAGATAC ATCAGCGGCG TGTGGATTTG AAAATCATAG

251 TCCATCGCCA AATTAAGGGT AACGTTCATC GATTTGACAA ACACGTCGCG

301 GCAGTCGGGA TAGCCGGAGA AGTCGGTTTC GCACACGCCC GCGATGATGT

351 GCCGTATCCC CTGCCCTTTG GCGTAAATCG CGGCATAGAG CAGGAAAAGC 401 gCGTTGCGGC CGTCTACAAA GGTATTCGGA ACGCCGTTTT CGGCAGTTTC

451 GATGGCGGCG GTGTCGTCCA TCAGGGCATT GTGCGTAATC TGCCGCATCA

501 GgCTcAAGTC GAGTACGGTT TGTTTGACGC CCAAATCCTG CGCAATCCAG

551 CGGGCACGTT CCAGCTCGAC GGCATGGCGT TGCCCGTATT GGAAAGTAAT

601 GGCTTGGACG TTTTCGCGCC CGTAGGTTTG GATTGCCTGA ATCAGGCAGG

651 TGGTCGAATC CTGACCGCCC GAAAAGATGA CCAAGGCTTG TTGGTTTGA
```

This corresponds to the amino acid sequence <SEQ ID 1050; ORF 261>:

```
m261.pep
   1 MELGHIVFLM VCACSDGLFT FQIFRQPAFA QDTARAFAAA ADDAVIAGVG

51 LLADIVQHAH FVRQRPRLRL GQIHQRRVDL KIIVHRQIKG NVHRFDKHVA

101 AVGIAGEVGF AHARDDVPYP LPFGVNRGIE QEKRVAAVYK GIRNAVFGSF

151 DGGGVVHQGI VRNLPHQAQV EYGLFDAQIL RNPAGTFQLD GMALPVLESN

201 GLDVFAPVGL DCLNQAGGRI LTARKDDQGL LV*
```

Computer analysis of this amino acid sequence gave the following results:

Homology with a Predicted ORF from *N. gonorrhoeae*

ORF 261 shows 79.7% identity over a 237 aa overlap with a predicted ORF (ORF 261.ng) from *N. gonorrhoeae*:

```
m261/g261

10        20        30        40        50        60
m261.pep   MELGHIVFLMVCACSDGLFTFQIFRQPAFAQDTARAFAAAADDAVIAGVGLLADIVQHAH
           |||||||||::|| |||||||| ||||||||||||||||||||:::|||||:||:|||||
g261       MELGHIVFLVLCARSDGLFTFQTFRQPAFAQDTARAFAAAADDTLVAGVGLFADVVQHAH
                    10        20        30        40        50        60

70        80        90       100       110       120
m261.pep   FVRQRPRLRLGQIHQRRVDLKIIVHRQIKGNVHRFDKHVAAVGIAGEVGFAHARDDVPYP
           ||||||||||||:|||||||||:|||||||||| ||:|:|||||| ::||||||||||
g261       FVRQRPRLRLGQVHQRRVDLKIVVHRQIKGNVHGFDEHAAAVGIARKIGFAHARDDVPDT
                    70        80        90       100       110       120

130       140       150            160       170
m261.pep   LPFGVNRGIEQEKRVAAVYKGIRVAVFGSFDGGGV-----VHQGIVRNLPHQAQVEYGLF
           |||| | |::|||||: |:||| ||| |:|||||      ||||:|||||||||:||||
g261       LPFGKNGGVKQEKRVTPVHKGIGNAVVGGFDGGGFDGGGFVHQGVVRNLPHQAQIEYGLT
                   130       140       150       160       170       180

180       190       200       210       220       230
m261.pep   DAQILRNPAGTFQLDGMALPVLESNGLDVFAPVGLDCLNQAGGRILTARKDDQGLLVX
           |:||||:|  :||||||||||:|::||||||||||||||||||||||||:||||:|||
g261       DTQILRDPLCAFQLDGMALPVSEGDGLDVFAPVGLDCLNQAGGRILTAREDDQGFLVX
                   190       200       210       220       230
```

The following partial DNA sequence was identified in *N. meningitidis* <SEQ ID 1051>:

```
a261.seq
   1 ATGGAGCTTG GGCATATCGT ATTCCTTATG GTTTGCGCGT GTTCAGACGG

  51 CCTTTTTACT TTCCAGATAT TCCGCCAGCC CGCGTTCGCG CAAGATACAG

 101 CTCGGGCATT CGCGGCAGCC GCCGACGATG CCGTTATAGC AGGTGTGGGT

 151 TTGCTCGCGG ATATAGTCCA GCGCGCCCAT TTCGTCCGCC AACGCCCAAG

 201 TTTGCGCCTT GGTCAGATAC ATCAGCGGCG TGTGGATTTG AAAATCATAG

 251 TCCATCGCCA GATTAAGGGT AACGTTCATG GATTTGACAA ACACGTCACG

 301 GCAGTCGGGA TAGCCGGAGA AGTCGGTTTC GCACACGCCC GCGATGATGT

 351 GCCGTATCCC CTGCCCTTTG GCGTAAATCG CGGCATAGAG CAGGAAAAGC

 401 GCGTTGCGGC CGTCTACAAA GGTATTCGGA ACGCCGTTTT CGGCAGTTTC

 451 GATGGCGGCG GTGTCGTCCA TCAGGGCATT GTGCGTAATC TGCCGCATCA

 501 GGCTCAAGTC GAGTACGGTT TGTTTGACGC CCAAATCCTG CGCAATCCAG

 551 CGGGCACGTT CCAGCTCGAC GGCATGGCGT TGCCCGTATT GGAAAGTAAT

 601 GGCTTGGACG TTTTCGCGCC CGTAGGTTTG GATTGCCTGA ATCAGGCAGG

 651 TGGTCGAATC CTGACCGCCC GAAAAGATGA CCAAGGCTTT TTGGTTTGA
```

This corresponds to the amino acid sequence <SEQ ID 1052; ORF 261.a>:

```
a261.pep
   1 MELGHIVFLM VCACSDGLFT FQIFRQPAFA QDTARAFAAA ADDAVIAGVG

  51 LLADIVQRAH FVRQRPSLRL GQIHQRRVDL KIIVHRQIKG NVHGFDKHVT

 101 AVGIAGEVGF AHARDDVPYP LPFGVNRGIE QEKRVAAVYK GIRNAVFGSF

 151 DGGGVVHQGI VRNLPHQAQV EYGLFDAQIL RNPAGTFQLD GMALPVLESN

 201 GLDVFAPVGL DCLNQAGGRI LTARKDDQGF LV*
```

m261/a261 97.8% identity in 232 aa overlap

```
                    10        20        30        40        50        60
m261.pep    MELGHIVFLMVCACSDGLFTFQIFRQPAFAQDTARAFAAAADDAVIAGVGLLADIVQHAH
            ||||||||||||||||||||||||||||||||||||||||||||||||||||||||||:||
a261        MELGHIVFLMVCACSDGLFTFQIFRQPAFAQDTARAFAAAADDAVIAGVGLLADIVQRAH
                    10        20        30        40        50        60

                    70        80        90       100       110       120
m261.pep    FVRQRPRLRLGQIHQRRVDLKIIVHRQIKGNVHRFDKHVAAVGIAGEVGFAHARDDVPYP
            |||||| ||||||||||||||||||||||||||| |||||:||||||||||||||||||||
a261        FVRQRPSLRLGQIHQRRVDLKIIVHRQIKGNVHGFDKHVTAVGIAGEVGFAHARDDVPYP
                    70        80        90       100       110       120

                   130       140       150       160       170       180
m261.pep    LPFGVNRGIEQEKRVAAVYKGIRNAVFGSFDGGGVVHQGIVRNLPHQAQVEYGLFDAQIL
            ||||||||||||||||||||||||||||||||||||||||||||||||||||||||||||
a261        LPFGVNRGIEQEKRVAAVYKGIRNAVFGSFDGGGVVHQGIVRNLPHQAQVEYGLFDAQIL
                   130       140       150       160       170       180

                   190       200       210       220       230
m261.pep    RNPAGTFQLDGMALPVLESNGLDVFAPVGLDCLNQAGGRILTARKDDQGLLVX
            ||||||||||||||||||||||||||||||||||||||||||||||||||:|||
a261        RNPAGTFQLDGMALPVLESNGLDVFAPVGLDCLNQAGGRILTARKDDQGFLVX
                   190       200       210       220       230
```

The following partial DNA sequence was identified in *N. gonorrhoeae* <SEQ ID 1053>:

```
g263.seq
   1 atggcacgtt taaccgtaca caccctcgaa accgcccccg aagccgccaa

  51 accgcgcgta gaggccgtac ccaaaaacaa cggctttatc cccaacctca

 101 tcggcgtatt ggcaaacgcc cccgaagctt tggcgtttta ccaagaagtc

 151 ggcaagctca acgccgccaa cagcctgacc gccggcgaag tcgaagtgat

 201 ccggatcatc gccgtccgca ccaaccaatg cagcttctgc gtggcagggc

 251 acaccaaact cgcaaccctg aaaaaactcc tgtccgagca atccctcaat

 301 gccgcccgcg ctttggcggc aggtaaatct gacgatgcca aactcggcgc

 351 gcttgccgcc ttcacccaag ccgtaatggc gaaaaaaggc gcagtatccg

 401 acgacgaact caacgccttc ctcgaagcgg gctacaaccg gcagcaggca

 451 gtcgaagtcg taatgggcgt agccttggca actttgtgca actacgccaa

 501 caacctcgcc caaaccgaaa tcaaccccaa attgcaggca tacgcctaa
```

This corresponds to the amino acid sequence <SEQ ID 1054; ORF 263.ng>:

```
g263.pep
   1 MARLTVHTLE TAPEAAKPRV EAVPKNNGFI PNLIGVLANA PEALAFYQEV

  51 GKLNAANSLT AGEVEVIRII AVRTNQCSFC VAGHTKLATL KKLLSEQSLN

 101 AARALAAGKS DDAKLGALAA FTQAVMAKKG AVSDDELNAF LEAGYNRQQA

 151 VEVVMGVALA TLCNYANNLA QTEINPKLQA YA*
```

The following partial DNA sequence was identified in *N. meningitidis* <SEQ ID 1055>:

```
m263.seq (partial)
   1 ..GCAGCAGGCG AATTTGACGA TGCCAAACTC GGCGCGCTCG CCGCCTTCAC

  51   CCAAGCCGTA ATGGCGAAAA AAGGCGCGGT ATCCGACGAG GAACTCAAAG

 101   CATTTTTCGA TGCGGGCTAC AACCAGCAGC AGGCAGTCGA AGTCGTGATG

 151   GGCGT.AsyC TgGCAACCCT GTGCAACTAC GTCAACAACC TCGGACAAAC

 201   CGAAATCAAC CCCGAATTGC AGGCTTACGC CTGA
```

This corresponds to the amino acid sequence <SEQ ID 1056; ORF 263>:

```
m263.pep (partial)
   1 ..GCAGCAGGCG AATTTGACGA TGCCAAACTC GGCGCGCTCG CCGCCTTCAC

  51   CCAAGCCGTA ATGGCGAAAA AAGGCGCGGT ATCCGACGAG GAACTCAAAG

 101   CATTTTTCGA TGCGGGCTAC AACCAGCAGC AGGCAGTCGA AGTCGTGATG

 151   GGCGT.AsyC TgGCAACCCT GTGCAACTAC GTCAACAACC TCGGACAAAC

 201   CGAAATCAAC CCCGAATTGC AGGCTTACGC CTGA
```

Computer analysis of this amino acid sequence gave the following results:

Homology with a Predicted ORF from *N. gonorrhoeae*

ORF 263 shows 85.7% identity over a 77 aa overlap with a predicted ORF (ORF 263.ng) from *N. gonorrhoeae*:

```
m263/g263

                                                       10        20        30
m263.pep                                       AAGEFDDAKLGALAAFTQAVMAKKGAVSDE
                                               |||: ||||||||||||||||||||||||:
g263       QCSFCVAGNTKLATLKKLLSEQSLNAARALAAGKSDDAKLGALAAFTQAVMAKKGAVSDD
             80        90       100       110       120       130

                  40        50        60        70
m263.pep   ELKAFFDAGYNQQQAVEVVMGVXLATLCNYVNNLGQTEINPELQAYAX
           ||:||::||||:|||||||||| |||||||:|||:||||||:||||||
g263       ELNAFLEAGYNRQQAVEVVMGVALATLCNYANNLAQTEINPKLQAYAX
             140       150       160       170       180
```

The following partial DNA sequence was identified in *N. meningitidis* <SEQ ID 1057>:

```
a263.seq
   1 ATGGCACGTT TAACCGTACA CACCCTCGAA ACCGCCCCCG AAGCCGCCAA

  51 AGCGCGCGTC GAGGCGGTAC TTCAAAACAA CGGCTTTATC CCCAACCTTA

 101 TCGGCGTATT ATCAAACGCC CCCGAAGCCT TGGCGTTTTA CCAAGAAGTC

 151 GGCAAGCTCA ACGCCGCCAA CAGCCTGACC GCCGGCGAAG TCGAAGTAAT

 201 CCAGATTATT GCCGCCCGCA CCAACCAATG CGGCTTCTGC GTGGCAGGGC

 251 ACACCAAACT CGCAACCCTG AAAAAACTCC TTTCCGAACA ATCCGTCAAA

 301 GCCGCGCGCG CTTTGGCGGC AGGCGAATTT GACGATGCTA AACTCGGCGC

 351 GCTCGCCGCC TTTACCCAAG CCGTAATGGC AAAAAAAGGC GCGGTATCCG

 401 ACGAGGAACT CAAAGCATTT TTTGATGCGG GCTACAACCA GCAGCAGGCA

 451 GTCGAAGTCG TGATGGGCGT AGCCTTGGCA ACTTTGTGCA ACTACGTCAA

 501 CAACCTCGGA CAAACCGAAA TCAACCCCGA ATTGCAGGCT TACGCCTGA
```

This corresponds to the amino acid sequence <SEQ ID 1058; ORF 263.a>:

```
a263.pep
   1 MARLTVHTLE TAPEAAKARV EAVLQNNGFI PNLIGVLSNA PEALAFYQEV

  51 GKLNAANSLT AGEVEVIQII AARTNQCGFC VAGHTKLATL KKLLSEQSVK

 101 AARALAAGEF DDAKLGALAA FTQAVMAKKG AVSDEELKAF FDAGYNQQQA

 151 VEVVMGVALA TLCNYVNNLG QTEINPELQA YA*
```

m263/a263 97.4% identity in 77 aa overlap

```
                                                       10        20        30
m263.pep                                       AAGEFDDAKLGALAAFTQAVMAKKGAVSDE
                                               ||||||||||||||||||||||||||||||
a263       QCGFCVAGHTKLATLKKLLSEQSVKAARALAAGEFDDAKLGALAAFTQAVMAKKGAVSDE
             80        90       100       110       120       130

                  40        50        60        70
m263.pep   ELKAFFDAGYNQQQAVEVVMGXXLATLCNYVNNLGQTEINPELQAYAX
           ||||||||||||||||||||| |||||||||||||||||||||||||
a263       ELKAFFDAGYNQQQAVEVVMGVALATLCNYVNNLGQTEINPELQAYAX
             140       150       160       170       180
```

The following partial DNA sequence was identified in *N. gonorrhoeae* <SEQ ID 1059>:

```
g264.seq
   1 ttgactttaa cccgaaaaac ccttttcctc ctcaccgccg cgttcggcac

  51 acactccctt cagacggcat ccgccgacgc agtggtcaag ccggaaaaac

 101 tgcacgcctc cgccaaccgc agctacaaag tcgccgaatt cacgcaaacc

 151 ggcaacgcct cgtggtacgg cggcaggttt cacgggcgca aaacttccgg

 201 cggagaccgc tacgatatga acgcctttac cgccgcccac aaaaccctgc

 251 ccatccccag ccatgtgcgc gtaaccaaca ccaaaaacgg caaaagcgtc

 301 atcgtccgcg tcaacgaccg cggccccttc cacggcaacc gcatcatcga

 351 cgtatccaaa gccgccgcgc aaaaattggg ctttgtcagc caagggacgg

 401 cacacgtcaa aatcgaacaa atcgtcccgg gccaatccgc accggttgcc

 451 gaaaacaaag acatctttat cgacttgaaa tctttcggta cggaacacga

 501 agcacaagcc tatctgaacc aagccgccca aaatttcgcc gcttcgtcat

 551 caagcccgaa cctctcggtt gaaaaacgcc gttacgaata cgttgtcaaa

 601 atgggcccgt ttgcctcgca ggaacgcgcc gccgaagccg aagcgcaggc

 651 acgcggtatg gttcgggcgg tactgacctc cggttga
```

This corresponds to the amino acid sequence <SEQ ID 1060; ORF 264.ng>:

```
g264.pep
   1 LTLTRKTLFL LTAAFGTHSL QTASADAVVK PEKLHASANR SYKVAEFTQT

  51 GNASWYGGRF HGRKTSGGDR YDMNAFTAAH KTLPIPSHVR VTNTKNGKSV

 101 IVRVNDRGPF HGNRIIDVSK AAAQKLGFVS QGTAHVKIEQ IVPGQSAPVA

 151 ENKDIFIDLK SFGTEHEAQA YLNQAAQNFA ASSSSPNLSV EKRRYEYVVK

 201 MGPFASQERA AEAEAQARGM VRAVLTSG*
```

The following partial DNA sequence was identified in *N. meningitidis* <SEQ ID 1061>:

```
m264.seq
   1 TTGACTTTAA CCCGAAAAAC CCTTTTCCTT CTCACCGCCG CATTCGGCAC

  51 ACACTCCCTT CAGACGGCAT CCGCCGACGC AGTGGTCAAG GCAGAAAAAC

 101 TGCACGCCTC CGCCAACCGC AGCTACAAAG TCGCCGGAAA ACGCTACACG

 151 CCGAAAAACC AAGTCGCCGA ATTCACGCAA ACCGGCAACG CCTCGTGGTA

 201 CGGCGGCAGG TTTCACGGGC GCAAAACTTC CGGCGGAGAA CGATACGATA

 251 TGAACGCCTT TACCGCCGCC CACAAAACCC TGCCCATCCC CAGCTATGTG

 301 CGCGTAACCA ATACCAAAAA CGGCAAAAGC GTCATCGTCC GCGTCAACGA

 351 CCGCGGCCCC TTCCACGGCA ACCGCATCAT CGACGTATCC AAAGCCGCCG

 401 CGCAAAAATT GGGCTTTGTC AACCAAGGGA CGGCACACGT CAAAATCGAA

 451 CAAATCGTCC CGGGCCAATC CGCACCGGTT GCCGAAAACA AAGACATCTT

 501 TATCGACTTG AAATCTTTCG GTACGGAACA CGAAGCACAA GCCTATCTGA

 551 ACCAAGCCGC CCAAAACTTC GCCGTTTCGT CATCGGGTAC GAACCTCTCG

 601 GTTGAAAAAC GCCGTTACGA ATACGTCGTC AAAATGGGAC CGTTTACCTC
```

-continued

```
651 GCAGGAACGC GCCGCCGAAG CCGAAGCTCA GGCGCGCGGT ATGGTTCGGG

701 CGGTATTGAC CGCCGGCTGA
```

This corresponds to the amino acid sequence <SEQ ID 1062; ORF 264>:

```
m264.pep
  1 LTLTRKTLFL LTAAFGTHSL QTASADAVVK AEKLHASANR SYKVAGKRYT

 51 PKNQVAEFTQ TGNASWYGGR FHGRKTSGGE RYDMNAFTAA HKTLPIPSYV

101 RVTNTKNGKS VIVRVNDRGP FHGNRIIDVS KAAAQKLGFV NQGTAHVKIE

151 QIVPGQSAPV AENKDIFIDL KSFGTEHEAQ AYLNQAAQNF AVSSSGTNLS

201 VEKRRYEYVV KMGPFTSQER AAEAEAQARG MVRAVLTAG*
```

Computer analysis of this amino acid sequence gave the following results:

Homology with a Predicted ORF from *N. gonorrhoeae*

ORF 264 shows 91.6% identity over a 239 aa overlap with a predicted ORF (ORF 264.ng) from *N. gonorrhoeae*:

```
m264/g264

                        10        20        30        40        50        60
m264.pep        LTLTRKTLFLLTAAFGTHSLQTASADAVVKAEKLHASANRSYKVAGKRYTPKNQVAEFTQ
                |||||||||||||||||||||||||||||| ||||||||||||||           ||||
g264            LTLTRKTLFLLTAAFGTHSLQTASADAVVKPEKLHASANRSYKVA-----------EFTQ
                        10        20        30        40

                        70        80        90       100       110       120
m264.pep        TGNASWYGGRFHGRKTSGGERYDMNAFTAAHKTLPIPSYVRVTNTKNGKSVIVRVNDRGP
                |||||||||||||||||||:||||||||||||||||||:|||||||||||||||||||||
g264            TGNASWYGGRFHGRKTSGGDRYDMNAFTAAHKTLPIPSHVRVTNTKNGKSVIVRVNDRGP
               50        60        70        80        90       100

                       130       140       150       160       170       180
m264.pep        FHGNRIIDVSKAAAQKLGFVNQGTAHVKIEQIVPGQSAPVAENKDIFIDLKSFGTEHEAQ
                ||||||||||||||||||||:|||||||||||||||||||||||||||||||||| ||||
g264            FHGNRIIDVSKAAAQKLGFVSQGTAHVKIEQIVPGQSAPVAENKDIFIDLKSFGTEGEAQ
              110       120       130       140       150       160

                       190       200       210       220       230       240
m264.pep        AYLNQAAQNFAVSSSGTNLSVEKRRYEYVVKMGPFTSQERAAEAEAQARGMVRAVLTAGX
                |||||||||||:|||: ||||||||||||||||||:|||||||||||||||||||||:||
g264            AYLNQAAQNFAASSSSPNLSVEKRRYEYVVKMGPFASQERAAEAEAQARGMVRAVLTSGX
              170       180       190       200       210       220
```

The following partial DNA sequence was identified in *N. meningitidis* <SEQ ID 1063>:

```
a264.seq
  1 TTGACTTTAA CCCGAAAAAC CCTTTTCCTC CTCACCGCCG CATTCGGCAT

 51 ACATTCCTTT CAGACGGCAT CCGCCGACGC AGTGGTCAGG GCAGAAAAAC

101 TGCACGCCTC CGCCAACCGC AGCTACAAAG TCGCCGGAAA ACGCTACACG

151 CCGAAAAACC AAGTCGCCGA ATTCACGCAA ACCGGCAACG CCTCGTGGTA

201 CGGCGGCAGG TTTCACGGGC GCAAAACTTC CGGCGGAGAA CGATACGATA

251 TGAACGCCTT TACCGCCGCC CACAAAACCC TGCCCATCCC CAGCTATGTG

301 CGCGTAACCA ATACCAAAAA CGGCAAAAGC GTCATCGTCC GCGTCAACGA

351 CCGCGGCCCC TTCCACGGCA ACCGCATCAT CGACGTATCC AAAGCCGCCG

401 CGCAAAAATT GGGCTTTGTC AACCAAGGGA CGGCGCACGT CAAAATCGAA

451 CAAATCGTCC CGGGCCAATC CGCACCGGTT GCCGAAAACA AAGACATCTT
```

-continued

```
501 CATCGACTTG AAATCTTTCG GTACGGAACA CGAAGCACAA GCCTATCTGA

551 ACCAAGCCGC CCAAAACCTG GCTTCATCGG CATCAAACCC GAACCTCTCG

601 GTTGAAAAAC GCCGTTACGA ATACGTCGTC AAAATGGGAC CGTTTGCCTC

651 GCAGGAACGC GCCGCCGAGG CCGAAGCTCA GGCGCGCGGT ATGGTTCGGG

701 CGGTATTAAC CGCCGGTTGA
```

This corresponds to the amino acid sequence <SEQ ID 1064; ORF 264.a>:

```
a264.pep
  1 LTLTRKTLFL LTAAFGIHSF QTASADAVVR AEKLHASANR SYKVAGKRYT

 51 PKNQVAEFTQ TGNASWYGGR FHGRKTSGGE RYDMNAFTAA HKTLPIPSYV

101 RVTNTKNGKS VIVRVNDRGP FHGNRIIDVS KAAAQKLGFV NQGTAHVKIE

151 QIVPGQSAPV AENKDIFIDL KSFGTEHEAQ AYLNQAAQNL ASSASNPNLS

201 VEKRRYEYVV KMGPFASQER AAEAEAQARG MVRAVLTAG*
```

m264/a264 96.2% identity in 239 aa overlap

```
                    10        20        30        40        50        60
m264.pep    LTLTRKTLFLLTAAFGTHSLQTASADAVVKAEKLHASANRSYKVAGKRYTPKNQVAEFTQ
            |||||||||||||||| ||:|||||||||:||||||||||||||||||||||||||||||
a264        LTLTRKTLFLLTAAFGTHSFQTASADAVVRAEKLHASANRSYKVAGKRYTPKNQVAEFTQ
                    10        20        30        40        50        60

                    70        80        90       100       110       120
m264.pep    TGNASWYGGRFHGRKTSGGERYDMNAFTAAHKTLPIPSYVRVTNTKNGKSVIVRVNDRGP
            ||||||||||||||||||||||||||||||||||||||||||||||||||||||||||||
a264        TGNASWYGGRFHGRKTSGGERYDMNAFTAAHKTLPIPSYVRVTNTKNGKSVIVRVNDRGP
                    70        80        90       100       110       120

                   130       140       150       160       170       180
m264.pep    FHGNRIIDVSKAAAQKLGFVNQGTAHVKIEQIVPGQSAPVAENKDIFIDLKSFGTEHEAQ
            ||||||||||||||||||||||||||||||||||||||||||||||||||||||||||||
a264        FHGNRIIDVSKAAAQKLGFVNQGTAHVKIEQIVPGQSAPVAENKDIFIDLKSFGTEGEAQ
                   130       140       150       160       170       180

                   190       200       210       220       230       240
m264.pep    AYLNQAAQNFAVSSSGTNLSVEKRRYEYVVKMGPFTSQERAAEAEAQARGMVRAVLTAGX
            |||||||||:| |:|: ||||||||||||||||||:||||||||||||||||||||||||
a264        AYLNQAAQNLASSASNPNLSVEKRRYEYVVKMGPFASQERAAEAEAQARGMVRAVLTAGX
                   190       200       210       220       230       240
```

The following partial DNA sequence was identified in *N. meningitidis* <SEQ ID 1065>:

```
m265.seq
  1 ATGTCGGTGA TTTTGCCGCC GACACGCGCC AACGCTGCTT TTTCGGCTTG

 51 GGCGCGGCTG ATGATTTTGT CTTGTTTGTT GTGTTGGTGT GCGGCGTGTC

101 CGTGGTCGTC ATCGCCGTGT CCGTCGTGGT GGGCGAGCGC GGGGGCGGAA

151 ATGCTCAGCA GTGCGGTTGC GGCGGAGGTC AAGAGAAGGT GTTTGATGTT

201 CATAT.TTTT GCCTTTGTAA ATCGTGGGTT GGAAAATGTG GATATTAATA

251 AGGTATCAAA TAACCGTCAG CCGGCGGTCA ATACCGCCCG AACCATACCG

301 CGCGCCTGAG CTTCGGCTTC GGCGGCGCGT TCCTGCGAGG TAAACGGTCC

351 CATTTTGACG ACGTATTCGT AA
```

This corresponds to the amino acid sequence <SEQ ID 1066; ORF 265>:

```
m265.pep
  1 MSVILPPTRA NAAFSAWARL MILSCLLCWC AACPWSSSPC PSWWASAGAE

 51 MLSSAVAAEV KRRCLMFIXF AFVNRGLENV DINKVSNNRQ PAVNTARTIP

101 RAXASASAAR SCEVNGPILT TYS*
```

Computer analysis of this amino acid sequence gave the following results:

Homology with a Predicted ORF from *N. gonorrhoeae*

ORF 265 shows 88.6% identity over a 123 aa overlap with a predicted ORF (ORF 265.ng) from *N. gonorrhoeae*:

```
m265/g265

                    10        20        30        40        50        60
m265.pep    MSVILPPTRANAAFSAWARLMILSCLLCWCAACPWSSSPCPSWWASAGAEMLSSAVAAEV
            ||||||||||:||||||||||||||| |||||||||||||||||||||||| :||||| |
g265        MSVILPPTRAQAAFSAWARLMILSCLPCWCAACPWSSSPCPSWWASAGAEMPNSAVAAAV
                    10        20        30        40        50        60

                    70        80        90       100       110       120
m265.pep    KRRCLMFIXFAFVNRGLENVDINKVSNNRQPAVNTARTIPRAXASASAARSCEVNGPILT
            |||||||| ||:||:||:| ||||||||||| |:||||||||| ||||||||||:||||||
g265        KRRCLMFI-FALVNQGLKNGDINKVSNNRQPEVSTARTIPRACASASAARSCEANGPILT
                       70        80        90       100       110

m265.pep    TYSX
            ||||
g265        TYSX
          120
```

The following partial DNA sequence was identified in *N. meningitidis* <SEQ ID 1067>:

```
a265.seq
  1 ATGTCGGTGA TTTTGCCGCC GACACGCGCC AACGCTGCTT TTTCGGCTTG

 51 GGCGCGGCTG ATGATTTTGT CTTGTTTGCT GTGTTGGTGT GCGGCGTGTC

101 CGTGGTCGTC ATCGCCGTGT CCGTCGTGGT GGGCGAGTGC GGGGGCGGAA

151 ATGCCCATCA GTGCGGTTGC GGCGGCGGTC AAGAGAAGGC GTTTGAAGTT

201 CATTTTTGCT CCTGCGAAGT ATCTGGT... .....GGTGT TTGAAGGACG

251 TAAAGGCGGG ACATCAACCG GCGGTTAATA CCGCCCGAAC CATACCGCGC

301 GCCTGAGCTT CGGCCTCGGC GGCGCGTTCC TGCGAGGCAA ACGGTCCCAT

351 TTTGACGACG TATTCGTAA
```

This corresponds to the amino acid sequence <SEQ ID 1068; ORF 265.a>:

```
a265.pep
  1 MSVILPPTRA NAAFSAWARL MILSCLLCWC AACPWSSSPC PSWWASAGAE

 51 MPISAVAAAV KRRRLKFIFA PAKYLX..XC LKDVKAGHQP AVNTARTIPR

101 A*ASASAARS CEANGPILTT YS*
```

m265/a265 79.7% identity in 123 aa overlap

```
                    10        20        30        40        50        60
m265.pep    MSVILPPTRANAAFSAWARLMILSCLLCWCAACPWSSSPCPSWWASAGAEMLSSAVAAEV
            |||||||||||||||||||||||||||||||||||||||||||||||||||  ||||| |
a265        MSVILPPTRANAAFSAWARLMILSCLLCWCAACPWSSSPCPSWWASAGAEMPISAVAAAV
                    10        20        30        40        50        60

                    70        80        90       100       110       120
m265.pep    KRRCLMFIXFAFVNRGLENVDINKVSNNRQPAVNTARTIPRAXASASAARSCEVNGPILT
            ||| | ||   |:        :: |: ::||||||||||||||||||||||||:||||||
a265        KRRRLKFI---FAPAKYLXXCLKDVKAGHQPAVNTARTIPRAXASASAARSCEANGPILT
                       70        80        90       100       110

m265.pep    TYSX
            ||||
a265        TYSX
            120
```

The following partial DNA sequence was identified in *N. gonorrhoeae* <SEQ ID 1069>:

```
g266.seq
   1 agttcagacg gcatcgccgc cgacaatgcc caaacagaaa gcccatcatg

  51 accgcatcca tgtacatcct tttggtcttg gcactcatct ttgccaacgc

 101 ccccttcctc acgaccagac tgttcggcgt ggccgcgctc aagcgcaaac

 151 atttcggaca ccacctgatc gagctggcgg caggtttcgc gctgaccgcc

 201 tctcttgcct acatcctcga atcccgtgcg ggagcggtac acaatcaggg

 251 ttgggagttt tacgccaccg tcgtctgcct gtacctcatt ttcgccttcc

 301 cgtgtttcgt gcggcggtat ttttggcaca cgcgcaacag ggaataa
```

This corresponds to the amino acid sequence <SEQ ID 1070; ORF 266.ng>:

```
g266.pep
   1 MQFRRHRRRQ CPNRKPIMTA SMYILLVLAL IFANAPFLTT RLFGVAALKR

  51 KHFGHHLIEL AAGFALTASL AYILESRAGA VHNQGWEFYA TVVCLYLIFA

 101 FPCFVRRYFW HTRNRE*
```

The following partial DNA sequence was identified in *N. meningitidis* <SEQ ID 1071>:

```
m266.seq
   1 ATGCCGTTCC GCAACGCGtT cAGACGGCAT CGCCGCCGAC AACGCCTAAA

  51 CAGAAAGCCC ACCATGACCG CATCCATGTA CATCCTTTTG GTCTTGGCAC

 101 TCATCTTTGC CAACGCCCCC TTCCTCACGA CCAGACTGTT CGGCGTGGCC

 151 rCACTCAAGC GCAAACATTT CGGACACCAC ATGATCGAGC TGGCGGCAGG

 201 TTTCGCGCTG ACCGCCGTTC TTGCCTACAT CCTsGAATCC CGTGCAGGAT

 251 CGGTACACGA TCAGGGTTGG GAGTTTTATG CCACAGTCGT CTGCCTGTAC

 301 CTGATTTTTG CGTTTCCATG TTTTGTGTGG CGGTATTTTT GGCACACGCG

 351 CAACAGGGAA TAG
```

This corresponds to the amino acid sequence <SEQ ID 1072; ORF 266>:

```
m266.pep
   1 MPFRNAFRRH RRRQRLNRKP TMTASMYILL VLALIFANAP FLTTRLFGVA

  51 XLKRKHFGHH MIELAAGFAL TAVLAYILES RAGSVHDQGW EFYATVVCLY

 101 LIFAFPCFVW RYFWHTRNRE *
```

Computer analysis of this amino acid sequence gave the following results:

Homology with a Predicted ORF from *N. gonorrhoeae*

ORF 266 shows 92.1% identity over a 114 aa overlap with a predicted ORF (ORF 266.ng) from *N. gonorrhoeae*:

```
m266/g266

                      10        20        30        40        50        60
m266.pep      MPFRNAFRRHRRRQRLNRKPTMTASMYILLVLALIFANAPFLTTRLFGVAXLKRKHFGHH
                    ||||||||  |||| ||||||||||||||||||||||||||||| |||||||||
g266              MQFRRHRRRQCPNRKPIMTASMYILLVLALIFANAPFLTTRLFGVAALKRKHFGHH
                          10        20        30        40        50

                      70        80        90       100       110       120
m266.pep      MIELAAGFALTAVLAYILESRAGSVHDQGWEFYATVVCLYLIFAFPCFVWRYFWHTRNREX
              :||||||||||| ||||||||||:||:|||||||||||||||||||||||| |||||||||||
g266          LIELAAGFALTASLAYILESRAGAVHNQGWEFYATVVCLYLIFAFPCFVRRYFWHTRNREX
                60        70        80        90       100       110
```

The following partial DNA sequence was identified in *N. meningitidis* <SEQ ID 1073>:

```
a266.seq
   1 ATGCCGTTCC GCAATGCGTT CAGACGGCAT CGCCGCCGAC AATGCCCAAA

  51 CAGAAAGCCC GCCATGACCG CATCCATGTA CATCCTTTTG CTGCTTGCCT

 101 TGATTTTTGC CAACGCCCCC TTCCTCACGA CCAAGCTGTT CGGCATCGTA

 151 CCGCTCAAGC GCAAACATTT CGGACACCAC CTGATCGAGC TGGCGGCAGG

 201 TTTCGCGCTG ACCGCCGTTC TTGCCTACAT CCTCGAATCC CGTGCGGGAG

 251 CGGTACACGA TCAGGGTTGG GAGTTTTACG CCACCGTCGT CTGCCTGTAC

 301 CTGATTTTTG CGTTTCCCTG TTTCGTGTGG CGGTATTTTT GGCACACGCG

 351 CAACAGGGAA TAG
```

This corresponds to the amino acid sequence <SEQ ID 1074; ORF 266.a>:

```
a266.pep
   1 MPFRNAFRRH RRRQCPNRKP AMTASMYILL LLALIFANAP FLTTKLFGIV

  51 PLKRKHFGHH LIELAAGFAL TAVLAYILES RAGAVHDQGW EFYATVVCLY

 101 LIFAFPCFVW RYFWHTRNRE *
```

m266/a266 91.7% identity in 120 aa overlap

```
                      10        20        30        40        50        60
m266.pep      MPFRNAFRRHRRRQRLNRKPTMTASMYILLVLALIFANAPFLTTRLFGVAXLKRKHFGHH
              ||||||||||||||  ||||:|||||||||:|||||||||||||:|||:: |||||||||
a266          MPFRNAFRRHRRRQCPNRKPAMTASMYILLLLALIFANAPFLTTKLFGIVPKLRKHFGHH
                      10        20        30        40        50        60
```

-continued

```
                 70        80        90        100       110       120
m266.pep  MIELAAGFALTAVLAYILESRAGSVHDQGWEFYATVVCLYLIFAFPCFVWRYFWHTRNRE
          :||||||||||||||||||||||:|||||||||||||||||||||||||||||||||||||
a266      LIELAAGFALTAVLAYILESRAGAVHDQGWEFYATVVCLYLIFAFPCFVWRYFWHTRNRE
                 70        80        90        100       110       120

m266.pep  X
          |
a266      X
```

The following partial DNA sequence was identified in *N. gonorrhoeae* <SEQ ID 1075>:

```
g267.seq
   1 atgcaagtcg cctttttct cgccgtggta ttcaaaaata tgggtttcca

  51 caatcgcatc ggtcgggcag gcctcttcgc agaaaccgca gaagatgcac

 101 ttggtcaggt cgatgtcgta acgcttggtg cggcgggtgc cgtcttcgcg

 151 ttcttccgat tcgatgttga tcgccattgc cggacacacc gcctcgcaca

 201 atttacacgc gatgcagcgt tcctctccgt tcggaaaacg gcgttgcgcg

 251 tgcagaccgc ggaaacgcac ggattgcggc gttttctctt cgggaaaata

 301 aattgtgtct ttgcgggcaa aaaagttttt gagcgttacg cccatgcctt

 351 tgaccagttc gccaagcaga aaggttttta ctaa
```

This corresponds to the amino acid sequence <SEQ ID 1076; ORF 267.ng>:

```
g267.pep
   1 MQVAFFLAVV FKNMGFHNRI GRAGLFAETA EDALGQVDVV TLGAAGAVFA

  51 FFRFDVDRHC RTHRLAQFTR DAAFLSVRKT ALRVQTAETH GLRRFLFGKI

 101 NCVFAGKKVF ERYAHAFDQF AKQKGFY*
```

The following partial DNA sequence was identified in *N. meningitidis* <SEQ ID 1077>:

```
m267.seq
   1 GTGCAAGTCG CCTTTTTTCT CGCCGTGGTA TTCAAAAATA TGGGTTTCCA

  51 CAATCGCATC AGTCGGGCAT GCCTCTTCGC AGAAACCGCA GAAGATGCAC

 101 TTGGTCAGGT CGATGTCGTA ACGCTTGGTG CGGCGCGTAC CGTCTTCACG

 151 TTCTTCCGAT TCGATGTTAA TCGCCATTGC CGGACACACT GCCTCACACA

 201 ACTTACACGC GATACACCGC TCTTCGCCGT TCGGATACCG CcGCTGCGCG

 251 TGCAGACCGC GGAAACGCAC GGATTGCGGC GTTTTCTCTT CGGGGAAATA

 301 AATTGTGTCT TTGCGGGCGA AAAAGTTTTT GAGCGTTACG CCCATACCTT

 351 TTACCAATTC GCCAAGCAGA AAGGTTTTTA CTAA
```

This corresponds to the amino acid sequence <SEQ ID 1078; ORF 267>:

```
m267.pep
   1 VQVAFFLAVV FKNMGFHNRI SRACLFAETA EDALGQVDVV TLGAARTVFT

  51 FFRFDVNRHC RTHCLTQLTR DTPLFAVRIP PLRVQTAETH GLRRFLFGEI

 101 NCVFAGEKVF ERYAHTFYQF AKQKGFY*
```

Computer analysis of this amino acid sequence gave the following results:

Homology with a Predicted ORF from *N. gonorrhoeae*

ORF 267 shows 82.7% identity over a 127 aa overlap with a predicted ORF (ORF 267.ng) from *N. gonorrhoeae*:

```
m267/g267

                    10        20        30        40        50        60
m267.pep   VQVAFFLAVVFKNMGFHNRISRACLFAETAEDALGQVDVVTLGAARTVFTFFRFDVNRHC
           :|||||||||||||||||||:|| ||||||||||||||||||||| :||:||||||:|||
g267       MQVAFFLAVVFKNMGFHNRIGRAGLFAETAEDALGQVDVVTLGAAGAVFAFFRFDVDRHC
                    10        20        30        40        50        60

                    70        80        90       100       110       120
m267.pep   RTHCLTQLTRDTPLFAVRIPPLRVQTAETHGLRRFLFGEINCVFAGEKVFERYAHTFYQF
           ||| |:|:|||: :::||   |||||||||||||||||:|||||||:||||||||:| ||
g267       RTHRLAQFTRDAAFLSVRKTALRVQTAETHGLRRFLFGKINCVFAGKKVFERYAHAFDQF
                    70        80        90       100       110       120

m267.pep   AKQKGFYX
           ||||||||
g267       AKQKGFYX
```

The following partial DNA sequence was identified in *N. meningitidis* <SEQ ID 1079>:

```
a267.seq
   1 GTGCAAGTCG CCTTTTTTCT CGCCGTGGTA TTCAAAAATA TGGGTTTCCA

  51 CAATCGCATC GGTCGGGCAG GCTTCTTCGC AGAAACCGCA GAAGATGCAC

 101 TTGGTCAGGT CGATGTCGTA ACGCTTGGTG CGGCGCGTGC CGTCTTCGCG

 151 TTCTTCCGAT TCGATGTTGA TCGCCATTGC GGGGCAAACG GCTTCACACA

 201 ATTTACACGC GATGCAGCGT TCCTCGCCGT TTGGATAACG GCGTTGCGCG

 251 TGCAGACCGC GGAAACGCAC GGATTGCGGC GTTTTCTCTT CGGGAAAATA

 301 AATCGTGTCT TTGCGGGCAA AAAAGTTTTT GAGCGTTACG CCCATACCTT

 351 TTACCAATTC GCCAAGCAGA AAGGTTTTTA CTAA
```

This corresponds to the amino acid sequence <SEQ ID 1080; ORF 267.a>:

```
a267.pep
   1 VQVAFFLAVV FKNMGFHNRI GRAGFFAETA EDALGQVDVV TLGAARAVFA

  51 FFRFDVDRHC GANGFTQFTR DAAFLAVWIT ALRVQTAETH GLRRFLFGKI

 101 NRVFAGKKVF ERYAHTFYQF AKQKGFY*
```

m267/a267 82.7% identity in 177 an overlap

```
                    10        20        30        40        50        60
m267.pep   VQVAFFLAVVFKNMGFHNRISRACLFAETAEDALGQVDVVTLGAARTVFTFFRFDVNRHC
           ||||||||||||||||||||:|| :|||||||||||||||||||||:||:||||||:|||
a267       VQVAFFLAVVFKNMGFHNRIGRAGFFAETAEDALGQVDVVTLGAARAVFAFFRFDVDRHC
                    10        20        30        40        50        60

                    70        80        90       100       110       120
m267.pep   RTHCLTQLTRDTPLFAVRIPPLRVQTAETHGLRRFLFGEINCVFAGEKVFERYAHTFYQF
            :: :||:|||: ::|| |  |||||||||||||||||:|| ||||:|||||||||||||
a267       GANGFTQFTRDAAFLAVWITALRVQTAETHGLRRFLFGKINRVFAGKKVFERYAHTFYQF
                    70        80        90       100       110       120

m267.pep   AKQKGFYX
           ||||||||
a267       AKQKGFYX
```

The following partial DNA sequence was identified in *N. gonorrhoeae* <SEQ ID 1081>:

```
G268.seq
     1  atgaaaaaaa atttacccgc actggcattg gcaagtatgc tgattttgtc
    51  gggctgcgac cgtttgggaa taggcaaccc gttttccgga aaggaaattt
   101  cctgcggaag cgaagagact aaagagattt tggtcaaact ggtccgcgac
   151  aatgtcgaag gtgaaaccgt caaaactttt gacgacgacg cattcaaaga
   201  ccaagcattt gccgatatcg gcatatcgca tatccgcaga atggtcgaac
   251  gtttgggcat aaccgtcgat gaagtccgaa ctaccgagaa aaccgacacg
   301  tccagcaaac tcaaatgtga agccgcgtta aaactggacg tgcccgacga
   351  tgttgtcgat tatgccgtcg ccgccaacca atctataggc aacagccata
   401  agaaaacgcc cgactttttt gaaccctact accgcaaaga aggcgcgtat
   451  tatgtcaaaa ctatttctta cagcgtccag ccgacagacg acaaaagcaa
   501  aatctttgcc gaactcagtc aggcacacga tatcatccat ccgctcagcg
   551  agctggtgtc tatggcactg attaaagagc cgttggacaa agcgaaacaa
   601  aggaacgaaa aacttgaagc ggcagaagcc accgcgcagg aagcgaggga
   651  ggcagaagaa gcggcggcgc aggaggcatt gggtcgggag caggaagccg
   701  cccgcgtatc cgaatgggaa gaacgctaca agctgtcgcg cagcgagttc
   751  gagcagtttt ggaaaggatt gcctcaaact gtacagaata agctgcaagc
   801  ctcgcagaaa acatggaaaa gcggtatgga caagatctgt gccaacaatg
   851  cgaaagccga aggtgaaacg ccaaacggca taaaagtcag tgagttggcg
   901  tgtaaaacgg cagaaaccga agcacgcttg gaagagctgc acaaccgtaa
   951  aaaagccctt atcgacgaaa tggtcaggga agaggacaag aaagaactgc
  1001  caaagcggct ctga
```

This corresponds to the amino acid sequence <SEQ ID 1082; ORF 268.ng>:

```
m268.pep
    1  MKKNLPALAL ASMLILSGCD RLGIGNPFSG KEISCGSEET KEILVKLVRD
   51  NVEGETVKTF DDDAFKDQAF ADIGISHIRR MVERLGITVD EVRTTEKTDT
  101  SSKLKCEAAL KLDVPDDVVD YAVAANQSIG NSHKKTPDFF EPYYRKEGAY
  151  YVKTISYSVQ PTDDKSKIFA ELSQAHDIIH PLSELVSMAL IKEPLDKAKQ
  201  RNEKLEAAEA TAQEAREAEE AAAQEALGRE QEAARVSEWE ERYKLSRSEF
  251  EQFWKGLPQT VQNKLQASQK TWKSGMDKIC ANNAKAEGET PNGIKVSELA
  301  CKTAETEARL EELHNRKKAL IDEMVREEDK KELPKRL*
```

The following partial DNA sequence was identified in *N. meningitidis* <SEQ ID 1083>:

```
m268.seq (partial)
    1  ..ATGGCACTGA TTAAAGAGCC GTTGGACAAA GTGAAACAAA GGAACGAAGA
   51    ACTTGAAGCG GCAGAAGAAG CGGCGGCGCA GGAGGCATTG GGTCGGGAGC
  101    AGGAAGCCGC CCGCGTATCC GAATGGGAAG AACGCTACAA GCTGTCGCGC
  151    AG.CAGTTCG AGCAGTTCTG GAAAGGATTG CCTCAAACCG TACAGAATAA
```

-continued

```
201   GCTGCAACCn TCACAGAAAA CATGGAAAAG CGGGATGGAT AAAATCTGTG

251   CCAACAATGC GAAAGCTGAA GGTAAAACGC CAAACGGCAT AAAATTCAGC

301   GAACTGGCAT GCAAAACGGC GAAAACCGAA GCACGCTTGG AAGAGCTGCA

351   CAACCGTAAA AAAGCCCTTA TCGACGAAAT GGyCAGGGAA GCGGACAmGA

401   AAGAACTGTC AAAGCGGCTs TGA
```

This corresponds to the amino acid sequence <SEQ ID 1084; ORF 268>.

```
m268.pep (partial)
   1 ..MALIKEPLDK VKQRNEELEA AEEAAAQEAL GREQEAARVS EWEERYKLSR

  51   XQFEQFWKGL PQTVQNKLQP SQKTWKSGMD KICANNAKAE GKTPNGIKFS

 101   ELACKTAKTE ARLEELHNRK KALIDEMXRE ADXKELSKRL *
```

Computer analysis of this amino acid sequence gave the following results:

Homology with a Predicted ORF from *N. gonorrhoeae*

ORF 268 shows 86.0% identity over a 150 aa overlap with a predicted ORF (ORF 268.ng) from *N. gonorrhoeae*:

```
m268/g268

                                                       10        20
m268.pep                                         MALIKEPLDKVKQRNEELEAAE--------
                                                 ||||||||||:|||:|||||||||||
g268        SVQPTDDKSKIFAELSQAHDIIHPLSELVSMALIKEPLDKAKQRNEKLEAAEATAQEARE
            160       170       180       190       200       210

                   30        40        50        60        70        80
m268.pep    --EAAAQEALGREQEAARVSEWEERYKLSRSQFEQFWKGLPQTVQNKLQPSQKTWKSGMD
              ||||||||||||||||||||||||||:|||||||||||||||| |||||||||
g268        AEEAAAQEALGREQEAARVSEWEERYKLSRSEFEQFWKGLPQTVQNKLQASQKTWKSGMD
            220       230       240       250       260       270

                   90       100       110       120       130       140
m268.pep    KICANNAKAEGKTPNGIKFSELACKTAKTEARLEELHNRKKALIDEMXREADXKELSKRLX
            ||||||||||:|||||| ||||||||:|||||||||||||||||| || | ||| ||||
g268        KICANNAKAEGETPNGIKVSELACKTAETEARLEELHNRKKALIDEMVREEDKKELPKRLX
            280       290       300       310       320       330
```

The following partial DNA sequence was identified in *N. meningitidis* <SEQ ID 1085>:

```
a268.seq
   1 ATGGCACTGA TTAAAGAGCC GTTGGACAAA GCGAAACAAA GGAACGAAGA

  51 ACTTGAAGCG GCAGAAGAAG CGGCGGCGCA GGAGGCATTG GGTCGGGAGC

 101 AGGAAGTCGA CCGCGTATCC GAATGGGAAG AACGCTACAA GCTGTCGCGC

 151 AGCGAGTTCG AGCAGTTCTG GAAAGGATTG CCTCAAACCG TACAGAATAA

 201 GCTGCAAGCC TCACAGAAAA CATGGAAAAG CGGGATGGAT AAAATCTGTG

 251 CCAACAATGC GAAAGCTGAA GGTGAAACGC CAAACGGCAT AAAATTCAGC

 301 GAACTGGCAT GCAAAACGGC GGAAACCGAA GCACGCTTGG AAGAGCTGCA

 351 CAACCGTAAA AAAGCCCTTC TCGACGAAAT GGCCAGGGAA GCGGACAAGA

 401 AAGAACTGCC AAAGCGGCTC TGA
```

This corresponds to the amino acid sequence <SEQ ID 1086; ORF 268.a>:

```
a268.pep
   1 MALIKEPLDK AKQRNEELEA AEEAAAQEAL GREQEVDRVS EWEERYKLSR

  51 SEFEQFWKGL PQTVQNKLQA SQKTWKSGMD KICANNAKAE GETPNGIKFS

 101 ELACKTAETE ARLEELHNRK KALLDEMARE ADKKELPKRL *
```

m268/a268 91.4% identity in 140 aa overlap

```
                   10        20        30        40        50        60
m268.pep   MALIKEPLDKVKQRNEELEAAEEAAAQEALGREQEAARVSEWEERYKLSRXQFEQFWKGL
           ||||||||||:||||||||||||||||||||||||: ||||||||||||| :||||||||
a268       MALIKEPLDKAKQRNEELEAAEEAAAQEALGREQEVDRVSEWEERYKLSRSEFEQFWKGL
                   10        20        30        40        50        60

                   70        80        90       100       110       120
m268.pep   PQTVQNKLQPSQKTWKSGMDKICANNAKAEGKTPNGIKFSELACKTAKTEARLEELHNRK
           ||||||||| |||||||||||||||||||||:|||||||||||||||:||||||||||||
a268       PQTVQNKLQASQKTWKSGMDKICANNAKAEGETPNGIKFSELACKTAETEARLEELHNRK
                   70        80        90       100       110       120

                  130       140
m268.pep   KALIDEMXREADXKELSKRLX
           |||:||| |||| ||| ||||
a268       KALLDEMAREADKKELPKRLX
                  130       140
```

The following partial DNA sequence was identified in *N. meningitidis* <SEQ ID 1087>:

```
m268-1.seq
   1 GTGCAATCCC GATATGATGG TTTGCATAAA TTTAAACATA TATGTTCCGC

  51 AGCTATGGCA CTGATTAAAG AGCCGTTGGA CAAAGTGAAA CAAAGGAACG

 101 AAGAACTTGA AGCGGCAGAA GAAGCGGCGG CGCAGGAGGC ATTGGGTCGG

 151 GAGCAGGAAG CCGCCCGCGT ATCCGAATGG GAAGAACGCT ACAAGCTGTC

 201 GCGCAGCGAG TTCGAGCAGT TCTGGAAAGG ATTGCCTCAA ACCGTACAGA

 251 ATAAGCTGCA AGCCTCACAG AAAACATGGA AAAGCGGGAT GGATAAAATC

 301 TGTGCCAACA ATGCGAAAGC TGAAGGTAAA ACGCCAAACG GCATAAAATT

 351 CAGCGAACTG GCATGCAAAA CGGCGAAAAC CGAAGCACGC TTGGAAGAGC

 401 TGCACAACCG TAAAAAAGCC CTTATCGACG AAATGGCCAG GGAAGCGGAC

 451 AAGAAAGAAC TGTCAAAGCG GCTCTGA
```

This corresponds to the amino acid sequence <SEQ ID 1088; ORF 268-1>:

```
m268-1.pep

      1   VQSRYDGLHK FKHICSAAMA LIKEPLDKVK QRNEELEAAE EAAAQEALGR

     51   EQEAARVSEW EERYKLSRSE FEQFWKGLPQ TVQNKLQASQ KTWKSGMDKI

    101   CANNAKAEGK TPNGIKFSEL ACKTAKTEAR LEELHNRKKA LIDEMAREAD

    151   KKELSKRL*

m268-1/g268 82.3% identity in 164 aa overlap

                                                10        20        30
m268-1.pep                            VQSRYDGLHKFKHICSAAMALIKEPLDKVKQRNE
                                          :| :| :::: |  ||||||||||:|||||
g268        KEGAYYVKTISYSVQPTDDKSKIFAELSQAHDIIHPLSELVS--MALIKEPLDKAKQRNE
              150       160       170       180         190       200
```

-continued

```
                    40                  50        60        70        80
m268-1.pep  ELEAAE----------EAAAQEALGREQEAARVSEWEERYKLSRSEFEQFWKGLPQTVQN
            :|||||          ||||||||||||||||||||||||||||||||||||||||||||
g268        KLEAAEATAQEAREAEEEAAAQEALGREQEAARVSEWEERYKLSRSEFEQFWKGLPQTVQN
                   210       220       230       240       250       260

                    90       100       110       120       130       140
m268-1.pep  KLQASQKTWKSGMDKICANNAKAEGKTPNGIKFSELACKTAKTEARLEELHNRKKALIDE
            |||||||||||||||||||||||||:|||||| |||||||:|||||||||||||||||||
g268        KLQASQKTWKSGMDKICANNAKAEGETPNGIKVSELACKTAETEARLEELHNRKKALIDE
                   270       280       290       300       310       320

                   150       159
m268-1.pep  MAREADKKELSKRLX
            |:|| ||||| ||||
g268        MVREEDKKELPKRLX
                   330
```

The following partial DNA sequence was identified in *N. meningitidis* <SEQ ID 1089>:

```
a268-1.seq
  1 GTGCAATCCC GATATGATGG TTTGCATAAA TTTAAACATA TATGTTCCGC

 51 AGCTATGGCA CTGATTAAAG AGCCGTTGGA CAAAGCGAAA CAAAGGAACG

101 AAGAACTTGA AGCGGCAGAA GAAGCGGCGG CGCAGGAGGC ATTGGGTCGG

151 GAGCAGGAAG TCGACCGCGT ATCCGAATGG GAAGAACGCT ACAAGCTGTC

201 GCGCAGCGAG TTCGAGCAGT TCTGGAAAGG ATTGCCTCAA ACCGTACAGA

251 ATAAGCTGCA AGCCTCACAG AAAACATGGA AAAGCGGGAT GGATAAAATC

301 TGTGCCAACA ATGCGAAAGC TGAAGGTGAA ACGCCAAACG GCATAAAATT

351 CAGCGAACTG GCATGCAAAA CGGCGGAAAC CGAAGCACGC TTGGAAGAGC

401 TGCACAACCG TAAAAAAGCC CTTCTCGACG AAATGGCCAG GGAAGCGGAC

451 AAGAAAGAAC TGCCAAAGCG GCTCTGA
```

This corresponds to the amino acid sequence <SEQ ID 1090; ORF 268-1.a>:

```
a268-1.pep

      1  VQSRYDGLHK FKHICSAAMA LIKEPLDKAK QRNEELEAAE EAAAQEALGR

     51  EQEVDRVSEW EERYKLSRSE FEQFWKGLPQ TVQNKLQASQ KTWKSGMDKI

    101  CANNAKAEGE TPNGIKFSEL ACKTAETEAR LEELHNRKKA LLDEMAREAD

    151  KKELPKRL*

a268-1/m268-1   95.6% identity in 158 aa overlap

                     10        20        30        40        50        60
a268-1.pep  VQSRYDGLHKFKHICSAAMALIKEPLDKAKQRNEELEAAEEAAAQEALGREQEVDRVSEW
            ||||||||||||||||||||||||||||:||||||||||||||||||||||||: |||||
m268-1      VQSRYDGLHKFKHICSAAMALIKEPLDKVKQRNEELEAAEEAAAQEALGREQEAARVSEW
                     10        20        30        40        50        60

                     70        80        90       100       110       120
a268-1.pep  EERYKLSRSEFEQFWKGLPQTVQNKLQASQKTWKSGMDKICANNAKAEGETPNGIKFSEL
            |||||||||||||||||||||||||||||||||||||||||||||||||:||||||||||
m268-1      EERYKLSRSEFEQFWKGLPQTVQNKLQASQKTWKSGMDKICANNAKAEGKTPNGIKFSEL
                     70        80        90       100       110       120

                    130       140       150       159
a268-1.pep  ACKTAETEARLEELHNRKKALLDEMAREADKKELPKRLX
            |||||:|||||||||||||||:|||||||||||| ||||
m268-1      ACKTAKTEARLEELHNRKKALIDEMAREADKKELSKRLX
                    130       140       150
```

The following partial DNA sequence was identified in *N. gonorrhoeae* <SEQ ID 1091>:

```
g269.seq
   1 atggtttggc gtgtgaattg cgcggcaacg gcggcgctga ttttttcgtc

  51 cagcccttgg atttgggcgg tggtgtgggt gtggtcgcgg tcggcttttt

 101 cctgcaaacc ttgcgccagc cttgacgcgt ccagtgcgcc ggcgttggcg

 151 gtttcgccgt gggactttat ccggaacacg gcttcgccca aggtgtcggc

 201 ggctttgatg cacagtttta aaaccagggc tttggggcgg ttttctgcgc

 251 cgcccgttgc cattttgctg tccaatcgcg gggttaaaaa accgttgtcg

 301 tttaagtcgc cgtccgtcca agtcgatacg agcgcgcttc tttgcctttc

 351 attgcggtct tcgtaa
```

This corresponds to the amino acid sequence <SEQ ID 1092; ORF 269.ng>:

```
g269.pep
   1 MVWRVNCAAT AALIFSSSPW IWAVVWVWSR SAFSCKPCAS LDASSAPALA

  51 VSPWDFIRNT ASPKVSAALM HSFKTRALGR FSAPPVAILL SNRGVKKPLS

 101 FKSPSVQVDT SALLCLSLRS S*
```

The following partial DNA sequence was identified in *N. meningitidis* <SEQ ID 1093>:

```
m269.seq
   1 ATGGTTTGGC GTGTGAATTG CGCGGCAACG GCGGTGCTGA TTTTTTCGTC

  51 CAGCCCTTGG ATTTGGGCGG CGGTGTGGGT GTGGTCTCGG TCGGCTTTGT

 101 CTTGCAAACC TTGCGCCaCG TGCCCGCGTC CAGCGCCTGC GTTGATGGTT

 151 TCGCCGTGGG ACTTTATCCA AAACACGGCT TCGCCCAAGG TGTCGGCGGC

 201 TTTGATGCAC AGTTTTAAAA CCAGGGCTTT GGGGCGGTTT TCGTCGCCGC

 251 CTGTCGCCAT TTTGCTGTCC GAGCGCGGGG TTAAAAAGCC GTTGTCGTTT

 301 AAATTTTCGT CCGTCCAAGT CGATACGAGC GCGCTTCTCT GCCTTTCGTT

 351 GCGGTCTTCG TAA
```

This corresponds to the amino acid sequence <SEQ ID 1094; ORF 269>:

```
m269.pep
   1 MVWRVNCAAT AVLIFSSSPW IWAAVWVWSR SALSCKPCAT CPRPAPALMV

  51 SPWDFIQNTA SPKVSAALMH SFKTRALGRF SSPPVAILLS ERGVKKPLSF

 101 KFSSVQVDTS ALLCLSLRSS *
```

Computer analysis of this amino acid sequence gave the following results:

Homology with a Predicted ORF from *N. gonorrhoeae*

ORF 269 shows 87.6% identity over a 121 aa overlap with a predicted ORF (ORF 269.ng) from *N. gonorrhoeae*:

```
m269.pep  MVWRVNCAATAVLIFSSSPWIWAAVWVWSRSALSCKPCATCP-RPAPALMVSPWDFIQNT   59
          ||||||||||:||||||||||:|||||||:||||||:     |||| |||||||:||
g269      MVWRVNCAATAALIFSSSPWIWAVVWVWSRSAFSCKPCASLDASSAPALAVSPWDFIRNT   60
```

```
m269.pep  ASPKVSAALMHSFKTRALGRFSSPPVAILLSERGVKKPLSFKFSSVQVDTSALLCLSLRS  119
          ||||||||||||||||||||||||:||||||||:||||||||||  |||||||||||||||
g269      ASPKVSAALMHSFKTRALGRFSAPPVAILLSNRGVKKPLSFKSPSVQVDTSALLCLSLRS  120

m269.pep  SX  121
          ||
g269      SX  122
```

The following partial DNA sequence was identified in *N. meningitidis* <SEQ ID 1095>:

```
a269.seq
  1 ATGGTTTGGC GTGTGAATTG CGCGGCAACG GCGGTGCTGA TTTTTTCGTC

 51 CAGCCCTTGG ATTTGGGCGG CGGTGTGGGT GTGGGCGCGG TCTGCTTTGT

101 CTTGGAGGTT TTGCGCCAGC GTGCCCGCGT CCAGCGCGCC GGCGTTGACG

151 GTTTCGCCGT GGGACTTTAT CCAGAACACG GCTTCGCCCA AGGTGTCGGC

201 GGCTTTGATG CACAGTTTTA AAACCAGGGC TTTGGGGCGG TTTTCGTCGC

251 CGCCTGTCGC CATTTTGCTG TCCGGGCGCG GGGTTAAAAA GCCGTTGTCG

301 TTTAAATTTT CGTCCGTCCA AGTCGATACG AGCGCGCTTC TCTGCCTTTC

351 GTTGTGGTCT TCGTAA
```

This corresponds to the amino acid sequence <SEQ ID 1096; ORF 269.a>:

```
a269.pep
  1 MVWRVNCAAT AVLIFSSSPW IWAAVWVWAR SALSWRFCAS VPASSAPALT

 51 VSPWDFIQNT ASPKVSAALM HSFKTRALGR FSSPPVAILL SGRGVKKPLS

101 FKFSSVQVDT SALLCLSLWS S*
```

m269/a269 90.1% identity in 121 aa overlap

```
                  10         20         30         40         50        59
m269.pep  MVWRVNCAATAVLIFSSSPWIWAAVWVWSRSALSCKPCATCP-RPAPALMVSPWDFIQNT
          |||||||||||||||||||||||||||:||||  : ||: |    ||||  |||||||||
a269      MVWRVNCAATAVLIFSSSPWIWAAVWVWARSALSWRFCASVPASSAPALTVSPWDFIQNT
                  10         20         30         40         50         60

                  60         70         80         90        100        110        119
m269.pep  ASPKVSAALMHSFKTRALGRFSSPPVAILLSERGVKKPLSFKFSSVQVDTSALLCLSLRS
          ||||||||||||||||||||||||:|||||||||||||||||| |||||||||||||||
a269      ASPKVSAALMHSFKTRALGRFSAPPVAILLSGRGVKKPLSFKSPSVQVDTSALLCLSLWS
                  70         80         90        100        110        120

                     120
m269.pep  SX
          ||
a269      SX
```

The following partial DNA sequence was identified in *N. gonorrhoeae* <SEQ ID 1097>:

```
g270.seq
  1 atgaataaaa accgcaaatt actgcttgcc gcactgctgc tgactgcctt

 51 tgccgccttc aagctcgttt tgttgcaatg gtggcaggcg cagcagccgc

101 aagccgtggc ggcgcaatgc gatttgaccg agggttgcac gctgccggac

151 ggaagccgtg tccgcgccgc cgccgtttca accaaaaaac cgtttgatat

201 ttatatcgaa cacgcgcccg ccggcacgga acaggtcagc atcagcttca
```

-continued

```
251 gtatgaaaaa tatggatatg ggtttcaacc gctatatgtt cgagcggcaa

301 ccgtcgggga cttggcaggc agcacgcatc cgcctgcccg tctgtgtcga

351 aggcaggcgc gattttacgg cggacattac aatcggcagc cggacatttc

401 agacggcatt taccgccgaa taa
```

This corresponds to the amino acid sequence <SEQ ID 1098; ORF 270.ng>:

```
g270.pep
  1 MNKNRKLLLA ALLLTAFAAF KLVLLQWWQA QQPQAVAAQC DLTEGCTLPD

 51 GSRVRAAAVS TKKPFDIYIE HAPAGTEQVS ISFSMKNMDM GFNRYMFERQ

101 PSGTWQAARI RLPVCVEGRR DFTADITIGS RTFQTAFTAE*
```

The following partial DNA sequence was identified in *N. meningitidis* <SEQ ID 1099>:

```
m270.seq
  1 ATGAATAAAA ACCGTAAATT ACTGCTTGCC GCACTGCTGC TGATTGCCTT

 51 TGCCGCCGTC AAGCTCGTTT TGTTGCAATG GTGGCAGGCG Ca.CAGCCGC

101 AAGCTGTGGC GGCGCAATGC GATTTGACCG AGGGTTGCAC GCTGCCGGAC

151 GGAAGCCGCG TCCGCGCCGC CGCcGTTTCA ACCAAAAAAC CGTTTGATAT

201 TTATATCGAA CACGCGCCCG CCGGCACGGA ACAGGTCAGC ATCAGCTTCA

251 GTATGAAAAA TATGGATATG GGTTTCaACC GCTATATGTT CGAGCGGCAA

301 cCGTCGGGGA CTTGGCAGGC AGTACGCATC CGCCTGCCCA TCTGTGTCGA

351 AGGCAGGCGC GATTTTACGG CGGACATTAC AATCGGCAGT CGGACATTTC

401 AGACGGCATT TACCGCCGAA TAA
```

This corresponds to the amino acid sequence <SEQ ID 1100; ORF 270>:

```
m270.pep
  1 MNKNRKLLLA ALLLIAFAAV KLVLLQWWQA XQPQAVAAQC DLTEGCTLPD

 51 GSRVRAAAVS TKKPFDIYIE HAPAGTEQVS ISFSMKNMDM GFNRYMFERQ

101 PSGTWQAVRI RLPICVEGRR DFTADITIGS RTFQTAFTAE *
```

Computer analysis of this amino acid sequence gave the following results:

Homology with a Predicted ORF from *N. gonorrhoeae*

ORF 270 shows 96.4% identity over a 140 aa overlap with a predicted ORF (ORF 270.ng) from *N. gonorrhoeae*:

```
m270/g270

                    10        20        30        40        50        60
m270.pep    MNKNRKLLLAALLLIAFAAVKLVLLQWWQAXQPQAVAAQCDLTEGCTLPDGSRVRAAAVS
            |||||||||||||| |||| |||||||||| |||||||||||||||||||||||||||||
g270        MNKNRKLLLAALLLTAFAAFKLVLLQWWQAQQPQAVAAQCDLTEGCTLPDGSRVRAAAVS
                    10        20        30        40        50        60

                    70        80        90       100       110       120
m270.pep    TKKPFDIYIEHAPAGTEQVSISFSMKNMDMGFNRYMFERQPSGTWQAVRIRLPICVEGRR
            |||||||||||||||||||||||||||||||||||||||||||||||:|||||:||||||
g270        TKKPFDIYIEHAPAGTEQVSISFSMKNMDMGFNRYMFERQPSGTWQAARIRLPVCVEGRR
                    70        80        90       100       110       120
```

-continued

```
                130        140
m270.pep    DFTADITIGSRTFQTAFTAEX
            ||||||||||||||||||||
g270        DFTADITIGSRTFQTAFTAEX
                130        140
```

The following partial DNA sequence was identified in *N. meningitidis* <SEQ ID 1101>:

```
a270.seq
   1 ATGAATAAAA ACCGTAAATT ACTGCTTGCC GCACTGCTGC TGATTGCCTT

  51 TGCCGCCGTC AAGCTCGTTT TGTTGCAATG GTGGCAGGCG CAGCAGCCGC

 101 AAGCTGTGGC GGCGCAATGC GATTTGACCG AGGGTTGCAC GCTGCCGGAC

 151 GGAAGCCGCG TCCGCGCCGC CGCCGTTTCA ACCAAAAAAC CGTTTGATAT

 201 TTATATCGAA CACGCGCCCG CCGGCACGGA ACAGGTCAGC ATCAGCTTCA

 251 GTATGAAAAA TATGGATATG GGTTTCAACC GCTATATGTT CGAGCGGCAA

 301 CCGTCGGGGA CTTGGCAGGC AGTACGCATC CGCCTGCCCA TCTGTGTCGA

 351 AGGCAGGCGC GATTTTACGG CGGACATTAC AATCGGCAGC CGGACATTTC

 401 AGACGGCATT TACCGCCGAA TAA
```

This corresponds to the amino acid sequence <SEQ ID 1102; ORF 270.a>:

```
a270.pep
   1 MNKNRKLLLA ALLLIAFAAV KLVLLQWWQA QQPQAVAAQC DLTEGCTLPD

  51 GSRVRAAAVS TKKPFDIYIE HAPAGTEQVS ISFSMKNMDM GFNRYMFERQ

 101 PSGTWQAVRI RLPICVEGRR DFTADITIGS RTFQTAFTAE *
```

m270/a270 99.3% identity in 140 aa overlap

```
                   10        20        30        40        50        60
m270.pep    MNKNRKLLLAALLLIAFAAVKLVLLQWWQAXQPQAVAAQCDLTEGCTLPDGSRVRAAAVS
            |||||||||||||||||||||||||||||| |||||||||||||||||||||||||||||
a270        MKKNRKLLAALLLLIAFAAVKLVLLQWWQAQQPQAVAAQCDLTEGCTLPDGSRVRAAAVS
                   10        20        30        40        50        60
                   70        80        90       100       110       120
m270.pep    TKKPFDIYIEHAPAGTEQVSISFSMKNMDMGFNRYMFERQPSGTWQAVRIRLPICVEGRR
            ||||||||||||||||||||||||||||||||||||||||||||||||||||||||||||
a270        TKKPFDIYIEHAPAGTEQVSISFSMKNMDMGFNRYMFERQPSGTWQAVRIRLPICVEGRR
                   70        80        90       100       110       120
                  130       140
m270.pep    DFTADITIGSRTFQTAFTAEX
            ||||||||||||||||||||
a270        DFTADITIGSRTFQTAFTAEX
                  130       140
```

The following partial DNA sequence was identified in *N. gonorrhoeae* <SEQ ID 1103>:

```
g271.seq
   1 atgttcagtt cgcggatggc gaggatttgg gcgacggggg taacgttgtg

  51 tatggtcagt ccgtgtccgg cgttgacgac caagcccaaa tcgccggcga

 101 aatgcgcgcc gttttggatg cgctcgaact gcctgatttg ttcggcgtgg

 151 ctttgtgcgt cggcatatgc gccggtgtgc agctcgacaa cgggcgcgcc
```

-continued

```
201 gacatcacgg gcggcttgga tttgcctgtc gtcggcatcg ataaacaagg
251 acacgcgtat gcccgcgtcg gtcaggattt tggcgaattc ggcgattttt
301 tcctgttgcg ccaatacgtc caaaccgcct tcggtcgtga tttcctgccg
351 tttttcaggc acgatgcaca cgtcttccgg catcacttta agcgcgtttt
401 cgagcatttc ttccgtcaac gccatttcaa ggttcaggcg cgtgcggatg
451 gcgtttttga cggcaaatac atccgcgtct ttgatgtggc ggcggtcttc
501 gcgcaggtgc atggtaatca ggtctgcacc gtgcgtttcg gcaaccagtg
551 ccgcctccac ggggctggga taa
```

This corresponds to the amino acid sequence <SEQ ID 1104; ORF 271.ng>:

```
g271.pep
  1 MFSSRMARIW ATGVTLCMVS PCPALTTKPK SPAKCAPFWM RSNCLICSAW
 51 LCASAYAPVC SSTTGAPTSR AAWICLSSAS INKDTRMPAS VRILANSAIF
101 SCCANTSKPP SVVISCRFSG TMHTSSGITL SAFSSISSVN AISRFRRVRM
151 AFLTANTSAS LMWRRSSRRC MVIRSAPCVS ATSAASTGLG*
```

The following partial DNA sequence was identified in *N. meningitidis* <SEQ ID 1105>:

```
m271.seq
  1 AwGTTCAGTT CGCGGATGGC GAGGATTTGG GCGATGGGGG TAACGTTGTG
 51 TATGGTCAGT CCGTGTCCGG CGTTGACGAC CAAGCCCAAA TCGCCGGCGA
101 AATGCGCGCC GTTTTGGATG CGCTCGAACT GCCTGATTTG TTCGGCGTGG
151 CTGCGCGCGT CGGCATACGC GCCTGTGTGC AGCTCGACAA CGGGCGCGCC
201 GACATCACGG GCGGCTTGGA TTTGCCTGTC GTCGGCATCG ATAAACAAAG
251 ACACGCGTAT GCCTGCGTCG GTCAGGATTT TGGTGAACCC GGCGATTTTT
301 TCCTGTTGCG CCAATACGTC CAAACCGCCT TCGGTCGTGA TTTCCTGACG
351 TTTTTCAGGC ACGATGCACA CGTCTTCCGG CATCACTTTC AAAGCGTTTT
401 CCAACATTTC TTCCGTCAAC GCCATTTCAA GGTTCAGGCG CGTGCGGATG
451 GCGTTTTTGA CGGCAAACAC GTCCGCGTCT TTGATGTGGC GGCGGTCTTC
501 GCGCAGGTGC ATGGTAATCA AATCCGCACC GTGCGTTTCG GCAACCAGTG
551 CCGCCTCCAC GGGGCTGGGA TAA
```

This corresponds to the amino acid sequence <SEQ ID 1106; ORF 271>:

```
m271.pep
  1 XFSSRMARIW AMGVTLCMVS PCPALTTKPK SPAKCAPFWM RSNCLICSAW
 51 LRASAYAPVC SSTTGAPTSR AAWICLSSAS INKDTRMPAS VRILVNPAIF
101 SCCANTSKPP SVVISXRFSG TMHTSSGITF KAFSNISSVN AISRFRRVRM
151 AFLTANTSAS LMWRRSSRRC MVIKSAPCVS ATSAASTGLG *
```

Computer analysis of this amino acid sequence gave the following results:

Homology with a Predicted ORF from *N. gonorrhoeae*

ORF 271 shows 95.2% identity over a 189 aa overlap with a predicted ORF (ORF 271.ng) from *N. gonorrhoeae*:

```
m271/g271
                    10         20         30         40         50         60
m271.pep   XFSSRMARIWAMGVTLCMVSPCPALTTKPKSPAKCAPFWMRSNCLICSAWLRASAYAPVC
            ||||||||| ||||||||||||||||||||||||||||||||||||||| |||||||| 
g271       MFSSRMARIWATGVTLCMVSPCPALTTKPKSPAKCAPFWMRSNCLICSAWLCASAYAPVC
                    10         20         30         40         50         60
                    70         80         90        100        110        120
m271.pep   SSTTGAPTSRAAWICLSSASINKDTRMPASVRILVNPAIFSCCANTSKPPSVVISXRFSG
           |||||||||||||||||||||||||||||||||:| ||||||||||||||||||| ||||
g271       SSTTGAPTSRAAWICLSSASINKDTRMPASVRILANSAIFSCCANTSKPPSVVISCRFSG
                    70         80         90        100        110        120
                   130        140        150        160        170        180
m271.pep   TMHTSSGITFKAFSNISSVNAISRFRRVRMAFLTANTSASLMWRRSSRRCMVIKSAPCVS
           |||||||||::|||:|||||||||||||||||||||||||||||||||||||:||||||
g271       TMHTSSGITLSAFSSISSVNAISRFRRVRMAFLTANTSASLMWRRSSRRCMVIRSAPCVS
                   130        140        150        160        170        180
                   190
m271.pep   ATSAASTGLGX
           |||||||||||
g271       ATSAASTGLGX
                   190
```

The following partial DNA sequence was identified in *N. meningitidis* <SEQ ID 1107>:

```
a271.seq
   1 ATGTTCAGTT CGCGGATGGC GAGGATTTGG GCGATGGGGG TAACGTTGTG

  51 TATGGTCAGT CCGTGTCCGG CGTTGACGAC CAAGCCCAAA TCGCTGGCAA

 101 AATGCGCGCC GTTTTGGATG CGCTCGAACT GCCTGATTTG TTCGGCGTGG

 151 CTGCGCGCGT CGGCATACGC GCCTGTGTGC AGCTCGACAA CGGGCGCGCC

 201 GACATCACGG GCGGCTTGGA TTTGCCTGTC GTCGGCATCG ATAAACAAGG

 251 ACACGCGTAT GCCCGCGTCG GTCAGGATTT TGGTGAATTC GGCAATTTTG

 301 TCTTGTTGCG CCAATACGTC CAAGCCGCCT TCGGTCGTGA TTTCCTGACG

 351 TTTTTCCGGC ACGATGCACA CGTCTTCCGG CATCACTTTA AGCGCGTTTT

 401 CGAGCATTTC TTCCGTCAAC GCCATTTCAA GGTTCAGGCG CGTGCGGATG

 451 GCGTTTTTGA CAGCAAACAC GTCCGCGTCT TTGATGTGGC GGCGGTCTTC

 501 GCGCAGGTGC ATGGTAATCA GGTCGGCACC GTGCGTTTCG GCAACCAGTG

 551 CCGCCTCCAC GGGGCTGGGA TAA
```

This corresponds to the amino acid sequence <SEQ ID 1108; ORF 271.a>:

```
a271.pep
   1 MFSSRMARIW AMGVTLCMVS PCPALTTKPK SLAKCAPFWM RSNCLICSAW


  51 LRASAYAPVC SSTTGAPTSR AAWICLSSAS INKDTRMPAS VRILVNSAIL


 101 SCCANTSKPP SVVIS*RFSG TMHTSSGITL SAFSSISSVN AISRFRRVRM


 151 AFLTANTSAS LMWRRSSRRC MVIRSAPCVS ATSAASTGLG *
```

m271/a271 96.3% identity in 189 aa overlap

```
                  10        20        30        40        50        60
m271.pep  XFSSRMARIWAMGVTLCMVSPCPALTTKPKSPAKCAPFWMRSNCLICSAWLRASAYAPVC
           |||||||||||||||||||||||||||| ||||||||||||||||||||||||||
a271      MFSSRMARIWAMGVTLCMVSPCPALTTKPKSLAKCAPFWMRSNCLICSAWLCASAYAPVC
                  10        20        30        40        50        60
                  70        80        90       100       110       120
m271.pep  SSTTGAPTSRAAWICLSSASINKDTRMPASVRILVNPAIFSCCANTSKPPSVVISXRFSG
          ||||||||||||||||||||||||||||||||||| ||:|||||||||||||||||||
a271      SSTTGAPTSRAAWICLSSASINKDTRMPASVRILANSAILSCCANTSKPPSVVISXRFSG
                  70        80        90       100       110       120
                 130       140       150       160       170       180
m271.pep  TMHTSSGITFKAFSNISSVNAISRFRRVRMAFLTANTSASLMWRRSSRRCMVIKSAPCVS
          |||||||||::|||:|||||||||||||||||||||||||||||||||||||:||||||
a271      TMHTSSGITLSAFSSISSVNAISRFRRVRMAFLTANTSASLMWRRSSRRCMVIRSAPCVS
                 130       140       150       160       170       180
                 190
m271.pep  ATSAASTGLGX
          |||||||||||
a271      ATSAASTGLGX
                 190
```

The following partial DNA sequence was identified in *N. gonorrhoeae* <SEQ ID 1109>:

```
g272.seq
   1 atgactgcaa aggaagaact gttcgcatgg ctgcgccata tgaacaaaaa
  51 caaaggttcc gacctgtttg tgacgaccca tttcccgccc gctatgaagc
 101 tggacggcaa aatcacccgc atcacggacg aaccgctgac ggcggaaaaa
 151 tgtatggaaa tcgccttttc gattatgagt gcgaagcagg cggaagaatt
 201 ttcatcgacc aacgagtgca atttcgccat cagcctgccg gacaccagcc
 251 gcttccgcgt caatgcgatg atacagcgcg gtgcgacggc gttggtattc
 301 cgcgcgatta ccagcaagat tcccaagttt gaaagcctga acctgccgcc
 351 ggccttgaag gatgttgcgc tgaaaaaacg cgggctggtt atttttgtcg
 401 gcggcaccgg ctcgggcaaa tcgacttcgc tcgcctcgct tatcgactac
 451 cgcaatgaaa attcgttcgg acacatcatc accatcgaag atccgatcga
 501 gtttgtccac gaacacaaaa actgcatcat tacccagcgc gaggtcggcg
 551 tggacacgga aaactggatg gcggcgttga aaaatacgct gcgtcaggcg
 601 ccggatgtga tccttatcgg cgaaatccgc gaccgtgaaa caatggacta
 651 cgccatcgcc tttgccgaaa cggggcattt gtgtatggcg acgctgcacg
 701 ccaacagcac caatcaggcg ctcgaccgca tcatcaactt cttccccgag
 751 gagcggcgcg aacaattgct gacggatttg tcgctcaacc ttcaggcgtt
 801 tatttcgcaa cgcctcgttc cgcgagacgg cggcaagggc agggtggcgg
 851 cagtcgaggt gctgctcaat tcgcccctga tttcggagtt gattcacaac
 901 ggcaacatcc atgaaatcaa agaagtgatg aaaaaatcca ctaccctggg
 951 tatgcagacc ttcgaccaac acctttacca attgtatgaa aaaggcgaga
1001 tttccttgca ggatgccttg aaaaatgccg attccgcaca tgatttgcgt
1051 ttggcggtac agttgcgcag ccgcagggca caaagttccg accccgattt
1101 ggaactgctc tga
```

This corresponds to the amino acid sequence <SEQ ID 1110; ORF 272.ng>:

```
g272.pep
   1 MTAKEELFAW LRHMNKNKGS DLFVTTHFPP AMKLDGKITR ITDEPLTAEK

  51 CMEIAFSIMS AKQAEEFSST NECNFAISLP DTSRFRVNAM IQRGATALVF

 101 RAITSKIPKF ESLNLPPALK DVALKKRGLV IFVGGTGSGK STSLASLIDY

 151 RNENSFGHII TIEDPIEFVH EHKNCIITQR EVGVDTENWM AALKNTLRQA

 201 PDVILIGEIR DRETMDYAIA FAETGHLCMA TLHANSTNQA LDRIINFFPE

 251 ERREQLLTDL SLNLQAFISQ RLVPRDGGKG RVAAVEVLLN SPLISELIHN

 301 GNIHEIKEVM KKSTTLGMQT FDQHLYQLYE KGEISLQDAL KNADSAHDLR

 351 LAVQLRSRRA QSSDPDLELL*
```

The following partial DNA sequence was identified in *N. meningitidis* <SEQ ID 1111>:

```
m272.seq
   1 ATGACCGCAA AGGAAGAACT GTTCGCATGG CTGCGCCATA TGAwCCAAAA

  51 CAAAGGTTCC GACCTGTTCG TGACAACCCA TTTCCCGCCC GCAATGAAGC

 101 TGGACGGCAA AATCACCCGC ATCACGGACG AACCGCTGAC GGCGGAAAAA

 151 TGTATGGAAA TCGCCTTTTC GATTATGAGT GCGAAGCAGG CGGAAGAATT

 201 TTCATCGACC AACGAGTGCA ACTTCGCCAT CAGCCTGCCG GACACCAGCC

 251 GCTTCCGCGT CAATGCGATG ATACAGCgCG GCGCGACGGC GTTGGTATTC

 301 CGTACGATTA CCAGCAAGAT TCCCAAGTTT GAAAGCCTGA ACCTGCCGCC

 351 AGTCTTGAAG GATGTCGCGC TGAAAAAACG CGGGCTGGTT ATTTTTGTCG

 401 GCGGCACCGG CTCGGGTAAA TCGACTTCGC TTGCCTCGCT TATCGACTAC

 451 CGCAATGAAA ATTCGTTCGG ACACATCATC ACCATCGAAG ACCCGATCGA

 501 GTTTGTCCAC GAACACAAAA ACTGCATCAT CACCCAGCGC GAGGTCGGCG

 551 TGGATACGGA AAACTGGATG GcGGCGTTGA AAAACACGCT GCGTCAGGCG

 601 CCTGATGTCA TCCTTATCGG CGAAATCCGT GACCGCGAAA CAATGGACTA

 651 CGCCATTGCC TTTGCCGAAA CGGGGCATTT GTGTATGGCG ACGCTGCACG

 701 CCAACAGCAC CAATCAGGCA CTCGACCGCA TCATCAACTT TTTCCCCGAG

 751 GAGCGGCGCG AACAATTGCT GACGGATTTG TCGCTCAACC TTCAGGCGTT

 801 TATTTCGCAA CGCCTCGTTC CGCGAGACGG CGGCAAGGGC AGGGTGGCGG

 851 CAGTCGAGGT GCTGCTCAAT TCGCCCCtGA TTTCGGAGTT GATTCACAAC

 901 GGCAACATCC ATGAAATCAA AGAAGTGATG AAAAAATCCA CTACCCTGGG

 951 TATGCAGACC TTCGATCAAC ACCTTTACCA ATTGTATGAA AAAGGCGATA

1001 TTTCCCTGCA AGAAGCATTG AAAAATGCCG ATTCCGCACA CGATTTGCGT

1051 TTGGCGGTAC AGTTGCGCAG CCGCCGCGCG CAaAGTTyCA GCCCCGATTT

1101 GGnACTGCTC TGA
```

This corresponds to the amino acid sequence <SEQ ID 1112; ORF 272>:

```
m272.pep
   1 MTAKEELFAW LRHMXQNKGS DLFVTTHFPP AMKLDGKITR ITDEPLTAEK
```

-continued

```
 51 CMEIAFSIMS AKQAEEFSST NECNFAISLP DTSRFRVNAM IQRGATALVF

101 RTITSKIPKF ESLNLPPVLK DVALKKRGLV IFVGGTGSGK STSLASLIDY

151 RNENSFGHII TIEDPIEFVH EHKNCIITQR EVGVDTENWM AALKNTLRQA

201 PDVILIGEIR DRETMDYAIA FAETGHLCMA TLHANSTNQA LDRIINFFPE

251 ERREQLLTDL SLNLQAFISQ RLVPRDGGKG RVAAVEVLLN SPLISELIHN

301 GNIHEIKEVM KKSTTLGMQT FDQHLYQLYE KGDISLQEAL KNADSAHDLR

351 LAVQLRSRRA QSXSPDLXLL *
```

Computer analysis of this amino acid sequence gave the following results:

Homology with a Predicted ORF from *N. gonorrhoeae*

ORF 272 shows 97.6% identity over a 370 aa overlap with a predicted ORF (ORF 272.ng) from *N. gonorrhoeae*:

```
m272/g272

                   10        20        30        40        50        60
m272.pep   MTAKEELFAWLRHMXQNKGSDLFVTTHFPPAMKLDGKITRITDEPLTAEKCMEIAFSIMS
           |||||||||||||| :||||||||||||||||||||||||||||||||||||||||||||
g272       MTAKEELFAWLRHMNKNKGSDLFVTTHFPPAMKLDGKITRITDEPLTAEKCMEIAFSIMS
                   10        20        30        40        50        60

                   70        80        90       100       110       120
m272.pep   AKQAEEFSSTNECNFAISLPDTSRFRVNAMIQRGATALVFRTITSKIPKFESLNLPPVLK
           ||||||||||||||||||||||||||||||||||||||||:||||||||||||||||:||
g272       AKQAEEFSSTNECNFAISLPDTSRFRVNAMIQRGATALVFRAITSKIPKFESLNLPPALK
                   70        80        90       100       110       120

                  130       140       150       160       170       180
m272.pep   DVALKKRGLVIFVGGTGSGKSTSLASLIDYRNENSFGHIITIEDPIEFVHEHKNCIITQR
           ||||||||||||||||||||||||||||||||||||||||||||||||||||||||||||
g272       DVALKKRGLVIFVGGTGSGKSTSLASLIDYRNENSFGHIITIEDPIEFVHEHKNCIITQR
                  130       140       150       160       170       180

                  190       200       210       220       230       240
m272.pep   EVGVDTENWMAALKNTLRQAPDVILIGEIRDRETMDYAIAFAETGHLCMATLHANSTNQA
           ||||||||||||||||||||||||||||||||||||||||||||||||||||||||||||
g272       EVGVDTENWMAALKNTLRQAPDVILIGEIRDRETMDYAIAFAETGHLCMATLHANSTNQA
                  190       200       210       220       230       240

                  250       260       270       280       290       300
m272.pep   LDRIINFFPEERREQLLTDLSLNLQAFISQRLVPRDGGKGRVAAVEVLLNSPLISELIHN
           ||||||||||||||||||||||||||||||||||||||||||||||||||||||||||||
g272       LDRIINFFPEERREQLLTDLSLNLQAFISQRLVPRDGGKGRVAAVEVLLNSPLISELIHN
                  250       260       270       280       290       300

                  310       320       330       340       350       360
m272.pep   GNIHEIKEVMKKSTTLGMQTFDQHLYQLYEKGDISLQEALKNADSAHDLRLAVQLRSRRA
           ||||||||||||||||||||||||||||||||:||||:||||||||||||||||||||||
g272       GNIHEIKEVMKKSTTLGMQTFDQHLYQLYEKGEISLQDALKNADSAHDLRLAVQLRSRRA
                  310       320       330       340       350       360

                  370
m272.pep   QSXSPDLXLLX
           || :||| |||
g272       QSSDPDLELLX
                  370
```

The following partial DNA sequence was identified in *N. meningitidis* <SEQ ID 1113>:

```
a272.seq
  1 ATGACCGCAA AGGAAGAACT GTTCGCATGG CTGCGCCATA TGAACAAAAA

 51 CAAAGGTTCC GACCTGTTCG TGACGACCCA TTTCCCGCCC GCAATGAAGC

101 TGGACGGCAA AATCACCCGC ATCACGGACG AACCGCTGAC GGCGGAAAAA

151 TGTATGGAAA TCGCCTTTTC GATTATGAGT GCGAAGCAGG CGGAAGAATT

201 TTCATCGACC AACGAGTGCA ACTTCGCCAT CAGTCTGCCG GACACCAGCC

251 GCTTCCGCGT CAATGCGATG ATACAGCGCG GTGCGACGGC GTTGGTATTC
```

-continued

```
 301 CGTGCGATTA CCAGCAAGAT TCCCAAGTTT GAAAGCCTGA ACCTGCCGCC

 351 GGTCTTGAAG GATGTCGCGC TGAAAAAACG CGGGCTGGTT ATTTTTGTCG

 401 GCGGCACCGG CTCGGGCAAA TCGACTTCGC TTGCCTCGCT TATCGACTAC

 451 CGCAATGAAA ATTCGTTCGG ACACATCATC ACCATCGAAG ACCCGATCGA

 501 GTTTGTCCAC GAACACAAAA ACTGCATCAT CACCCAGCGC GAGGTCGGCG

 551 TGGATACGGA AAACTGGATG GCGGCGTTGA AAAACACGCT GCGTCAGGCA

 601 CCGGATGTGA TTCTGATCGG CGAAATCCGC GACCGCGAAA CAATGGACTA

 651 CGCCATTGCT TTTGCCGAAA CGGGGCATTT GTGTATGGCG ACGCTGCACG

 701 CCAACAGCAC CAATCAGGCA CTCGACCGCA TCATCAACTT TTTCCCCGAG

 751 GAGCGGCGCG AACAATTGCT GACGGATTTG TCGCTCAACC TTCAGGCATT

 801 TATTTCGCAA CGCCTCGTTC CGCGAGACGG CGGCAAGGGC AGGGTGGCGG

 851 CAGTCGAGGT GCTGCTCAAT TCGCCCCTGA TTTCGGAGTT GATTCACAAC

 901 GGCAATATCC ATGAAATCAA AGAAGTGATG AAAAAATCCA CTACCCTGGG

 951 TATGCAGACT TTCGACCAAC ACCTTTACCA ATTGTATGAA AAAGGCGAGA

1001 TTTCCTTGCA GGATGCCTTG AAAAATGCCG ATTCCGCACA CGATTTGCGT

1051 TTGGCGGTAC AGTTGCGCAG CCGCCAGGCG CAAAGTTCCG GTCCCGATTT

1101 GGAACTGCTC TGA
```

This corresponds to the amino acid sequence <SEQ ID 1114; ORF 272.a>:

```
a272.pep
   1 MTAKEELFAW LRHMNKNKGS DLFVTTHFPP AMKLDGKITR ITDEPLTAEK

  51 CMEIAFSIMS AKQAEEFSST NECNFAISLP DTSRFRVNAM IQRGATALVF

 101 RAITSKIPKF ESLNLPPVLK DVALKKRGLV IFVGGTGSGK STSLASLIDY

 151 RNENSFGHII TIEDPIEFVH EHKNCIITQR EVGVDTENWM AALKNTLRQA

 201 PDVILIGEIR DRETMDYAIA FAETGHLCMA TLHANSTNQA LDRIINFFPE

 251 ERREQLLTDL SLNLQAFISQ RLVPRDGGKG RVAAVEVLLN SPLISELIHN

 301 GNIHEIKEVM KKSTTLGMQT FDQHLYQLYE KGEISLQDAL KNADSAHDLR

 351 LAVQLRSRQA QSSGPDLELL *
```

m272/a272 97.6% identity in 370 aa overlap

```
                    10        20        30        40        50        60
m272.pep    MTAKEELFAWLRHMXQNKGSDLFVTTHFPPAMKLDGKITRITDEPLTAEKCMEIAFSIMS
            |||||||||||||| :||||||||||||||||||||||||||||||||||||||||||||
a272        MTAKEELFAWLRHMNKNKGSDLFVTTHFPPAMKLDGKITRITDEPLTAEKCMEIAFSMIS
                    10        20        30        40        50        60

                    70        80        90       100       110       120
m272.pep    AKQAEEFSSTNECNFAISLPDTSRFRVNAMIQRGATALVFRTITSKIPKFESLNLPPVLK
            |||||||||||||||||||||||||||||||||||||||||:||||||||||||||||||
a272        AKQAEEFSSTNECNFAISLPDTSRFRVNAMIQRGATALVFRAITSKIPKFESLNLPPVLK
                    70        80        90       100       110       120

                   130       140       150       160       170       180
m272.pep    DVALKKRGLVIFVGGTGSGKSTSLASLIDYRNENSFGHIITIEDPIEFVHEHKNCIITQR
            ||||||||||||||||||||||||||||||||||||||||||||||||||||||||||||
a272        DVALKKRGLVIFVGGTGSGKSTSLASLIDYRNENSFGHIITIEDPIEFVHEHKNCIITQR
                   130       140       150       160       170       180
```

-continued

```
                190       200       210       220       230       240
m272.pep  EVGVDTENWMAALKNTLRQAPDVILIGEIRDRETMDYAIAFAETGHLCMATLHANSTNQA
          ||||||||||||||||||||||||||||||||||||||||||||||||||||||||||||
a272      EVGVTENWMAALKKNTLRQAPDVILIGEIRDRETMDYAIAFAETGHLCMATLHANSTNQA
                190       200       210       220       230       240

                250       260       270       280       290       300
m272.pep  LDRIINFFPEERREQLLTDLSLNLQAFISQRLVPRDGGKGRVAAVEVLLNSPLISELIHN
          ||||||||||||||||||||||||||||||||||||||||||||||||||||||||||||
a272      LDRIINFFPEERREQLLTDLSLNLQAFISQRLVPRDGGKGRVAAVEVLLNSPLISELIHN
                250       260       270       280       290       300

                310       320       330       340       350       360
m272.pep  GNIHEIKEVMKKSTTLGMQTFDQHLYQLYERGDISLQEALKNADSAHDLRLAVQLRSRRA
          ||||||||||||||||||||||||||||||||:||||:||||||||||||||||||||:|
a272      GNIHEIKEVMKKSTTLGMQTFDQHLYQLYEKGEISLQDALKNADSAHDLRLAVQLRSRQA
                310       320       330       340       350       360

                370
m272.pep  QSXSPDLXLLX
          || :||| |||
a272      QSSGPDLELLX
                370
```

The following partial DNA sequence was identified in *N. gonorrhoeae* <SEQ ID 1115>:

```
g273.seq
   1 atgagtcttc aggcggtatt tatataccc ccaagccgta ccgcacaata

  51 caacgaaaat caggaaaacg gcggtaaagc tcataaacag ggacaaagcg

 101 gcaaacacac cgaccgccgt caggatatag gcgtattcga ggccggaact

 151 ccattcaccg ttttcctgcc gtttcttgtc gcttttgaaa taaaggatga

 201 tgccggcaag cagcgcggca gccgcgcccg acattggcat tgtgttcatt

 251 gttgttcctt aacggttaaa aacccgcccg gccgtgcaac cgttttaagg

 301 cgggaaattg caaaatttgt ttgcgggcgc gtgccgctga aatcaaggcg

 351 gtttgagaag tgtttccnac gcgcccgccc tatgtgccga aatattattt

 401 gtcgctcacc tgcaaaatcg ccaagaacgc gctttgcgga atttccacgt

 451 tgcccacttg tttcatacgg cgtttgcctg ctttttgttt ttcaagcagt

 501 tttttcttac gcgtaa
```

This corresponds to the amino acid sequence <SEQ ID 1116; ORF 273.ng>:

```
g273.pep
  1  MSLQAVFIYP PSRTAQYNEN QENGGKAHKQ GQSGKHTDRR QDIGVFEAGT

 51  PFTVFLPFLV AFEIKDDAGK QRGSRARHWH CVHCCSLTVK NPPGRATVLR

101  REIAKFVCGR VPLKSRRFEK CFXRARPMCR NIICRSPAKS PRTRFAEFPR

151  CPLVSYGVCL LFVFQAVFSY A*
```

The following partial DNA sequence was identified in *N. meningitidis* <SEQ ID 1117>:

```
m273.seq
   1 ATGAGTCTTC AGGCGGTATT TATATACCCm CCAAGCCGTA CCGCACAATA

  51 CAACGAAAAT CAGGAAAACG GCGGTAAAGC TCAyAAACAG GGACAAAGCG

 101 GCAAACACGC CGACCGCTGT CAGGATATAG GCGTATTCAA GGCCGGAACT

 151 CCATTCCCCG TTTTCCTGCC GCTTCTTGTC GCTTTTGAAA TAAAGGATGA
```

```
-continued
201 TGCCGGCAAG CAGCGCGGCA GCCGCGCCCG ACATTAGCAT TGTGTTCATT

251 GTTGTTCCTT AATGCTTAAA AACCCGCCTG TCCGTGCAAC CGTTTTAAGG

301 CGGCAAATTG CAAAATTTGT TTGCGGGCGC GTGCCCCTGA AATCAGGGCG

351 GTTTGAGGGG TGTTCCCGAC GCGCCGCCCT GTGTGCCGGA GTTATTTGTC

401 GCTCACCTGC AAAATCGCCA AGAACGCGCT TTGCGGAATT CCACATTGC

451 CCACTTGTTT CATACGGCGT TTACCTGCCT TTTGTkTwTC AAGCAGTTTT

501 TTCTTACGCG TAA
```

This corresponds to the amino acid sequence <SEQ ID 1118; ORF 273>:

```
m273.pep
  1 MSLQAVFIYP PSRTAQYNEN QENGGKAHKQ GQSGKHADRC QDIGVFKAGT

 51 PFPVFLPLLV AFEIKDDAGK QRGSRARH*H CVHCCSLMLK NPPVRATVLR

101 RQIAKFVCGR VPLKSGRFEG CSRRAALCAG VICRSPAKSP RTRFAEFPHC

151 PLVSYGVYLP FVXQAVFSYA *
                        25
```

Computer analysis of this amino acid sequence gave the following results:
Homology with a Predicted ORF from *N. gonorrhoeae*
ORF 273 shows 86.0% identity over a 171 aa overlap with a predicted ORF (ORF 273.ng) from *N. gonorrhoeae*:

```
   m273/g273
                  10         20         30         40         50         60
   m273.pep  MSLQAVFIYPPSRTAQYNENQENGGKAHKQGQSGKHADRCQDIGVFKAGTPFPVFLPLLV
             |||||||||||||||||||||||||||||||||||:|| ||||||:||||| ||||:||
   g273      MSLQAVFIYPPSRTAQYNENQENGGKAHKQGQSGKHTDRRQDIGVFEAGTPFTVFLPFLV
                  10         20         30         40         50         60

                  70         80         90        100        110        120
   m273.pep  AFEIKDDAGKQRGSRARHXHCVHCCSLMLKNPPVRATVLRRQIAKFVCGRVPLKSGRFEG
             |||||||||||||||||| ||||||:||||  |||||||||:|||||||||||||:|||
   g273      AFEIKDDAGKQRGSRARHWHCVHCCSLTVKNPPGRATVLRREIAKFVCGRVPLKSRRFEK
                  70         80         90        100        110        120

                 130        140        150        160        170
   m273.pep  CSRRA-ALCAGVICRSPAKSPRTRFAEFPHCPLVSYGVYLPFVXQAVFSYAX
             |  || :| ::||||||||||||||||||:|||||||| | ||||||||||
   g273      CFXRARPMCRNIICRSPAKSPRTRFAEFPRCPLVSYGVCLLFVQAVFSYAX
                 130        140        150        160        170
```

The following partial DNA sequence was identified in *N. meningitidis* <SEQ ID 1119>:

```
a273.seq
  1 ATGAGTCTTC AGGCGGTATT TGTATACCCC CCAAGCCGTA CCGCACAATA

 51 CAACGAAAAT CAGGAAAACG GCGGTAAAGC TCATAAACAG GGACAAAGCG

101 GCAAACACGC CGACCGCCGT CAGGATATAG GCGTATTCCA GACCGGAACT

151 CCATTCACCG TTTTCCTGCC GCTTTTTGTC GCTTTTGAAA TAAGGATGA

201 TGCCGGCAAG CAGCGCGGCA GCCGCGCCCG ACATTAGCAT AATGTTCATT

251 GTTGTTCCTT AACGGTTAAA AACCCGCCCG TCCGTGCAAC CGTTTTTAAG

301 AGGCGGTAAA TCACAAAGTT TGTTGGCGGA CGTGCTCTCT TACAATCAGG

351 GCGGTTTAAG GGGCATGATG CACTGCCCCG TGTGCCGGAT ATTATTTGTC
```

-continued

```
401 GCTCACCTGC AAAATTGCCA AGAACGCGCT TTGCGGGATT TCCACATTGC

451 CCACTTGTTT CATACGGCGT TTGCCTGCTT TTTGTTTTTC AAGCAGTTTT

501 TTCTTACGCG TAA
```

This corresponds to the amino acid sequence <SEQ ID 1120; ORF 273.a>:

```
a273.pep
  1 MSLQAVFVYP PSRTAQYNEN QENGGKAHKQ GQSGKHADRR QDIGVFQTGT

 51 PFTVFLPLFV AFEIKDDAGK QRGSRARH*H NVHCCSLTVK NPPVRATVFK

101 RR*ITKFVGG RALLQSGRFK GHDALPRVPD IICRSPAKLP RTRFAGFPHC

151 PLVSYGVCLL FVFQAVFSYA *
```

m273/a273 80.1% identity in 171 aa overlap

```
                        10        20        30        40        50        60
m273.pep    MSLQAVFIYPPSRTAQYNENQENGGKAHKQGQSGKHADRCQDIGVFKAGTPFPVFLPLLV
            |||||||:||||||||||||||||||||||||||||||| ||||||::|||| |||||:|
a273        MSLQAVFVYPPSRTAQYNENQENGGKAHKQGQSGKHADRRQDIGVFQTGTPFTVFLPLFV
                        10        20        30        40        50        60
                        70        80        90       100       110       119
m273.pep    AFEIKDDAGKQRGSRARHXHCVHCCSLMLKNPPVRATVL-RRQIAKFVCGRVPLKSGRFE
            |||||||||||||||||||| |||||||:|||||||||: || |:||| ||: |:||||:
a273        AFEIKDDAGKQRGSRARHXHNVHCCSLTVKNPPVRATVFKRRXITKFVGGRALLQSGRFK
                        70        80        90       100       110       120
          120       130       140       150       160       170
m273.pep    GCSRRAALCAGVICRSPAKSPRTRFAEFPHCPLVSYGVYLPFVXQAVFSYAX
            | :    :   :||||||| |||||| ||||||||||| | || ||||||||
a273        GHDALPRV-PDIICRSPAKLPRTRFAGFPHCPLVSYGVCLLFVFQAVFSYAX
                       130       140       150       160       170
```

The following partial DNA sequence was identified in *N. gonorrhoeae* <SEQ ID 1121>:

```
g274.seq
  1 ATGGCGGGGC CGATTTTTGT CGTCatCGCC AgcgTCGCTA TGTTTTTTGT

 51 CGCGCAGCAG CACGCGACAG ATTTGGTTAC GGACGATTAT TATAAGGATG

101 GCAAGCATAT CGACATCCAG CTTCATCGGG ATGAAGAAGC CGTCAGACGG

151 CATATCGGGG TGCAGGTCCT CATTTCTCCC GATATGAATG CGGCAAAAGT

201 GTTTGTCGGc ggCgagtTTG ACGGCAAACA GCCTTTGAAC CTGCTGCTGA

251 TGCACCCGAC CCGCAAGGCG GACGATCAAA CCGTCGCCCT CAAGCCCGTC

301 GGCAGCGCGC AGAACGGCAG GGCGGAATAT GAGGCGGTgt tcaaAACCCT

351 TCCGCCGGCC AACCACTGGT ATGTGCGCGT GGAggacgCG GCAGGCGTGT

401 GGCGCGTCGA GAACAAATGG ATTACCAGCC AGGGCAATGC GGTCGATTTG

451 ACCCCGATGG ACAAACTTTT CAATAATGCA GGAAGCAAAT AA
```

This corresponds to the amino acid sequence <SEQ ID 1122; ORF 274.ng>:

```
g274.pep
  1 MAGPIFVVIA SVAMFFVAQQ HATDLVTDDY YKDGKHIDIQ LHRDEEAVRR

 51 HIGVQVLISP DMNAAKVFVG GEFDGKQPLN LLLMHPTRKA DDQTVALKPV
```

-continued

```
101 GSAQNGRAEY EAVFKTLPPA NHWYVRVEDA AGVWRVENKW ITSQGNAVDL

151 TPMDKLFNNA GSK*
```

The following partial DNA sequence was identified in *N. meningitidis* <SEQ ID 1123>:

```
m274.seq
  1 ATGGCGGGGC CGATTTTTGT CGTCATCGCC AGCGTCGCTA TGTTTTTTGT

 51 CGCGCAGCAG CACGCGACAG ATTTGGTTAC GGACGATTAT TATAAAGACG

101 GCAAACATAT CGACATCCAG CTTCATCGGG ATGAAGAAGC CGTCAGACGG

151 CATATCGGGG TGCAGGTTCT CATTTCCCCC GATATGAATG CGGCAAAAGT

201 GTTTGTCGGC GGCGAGTTTG ACGGCAAACA GCCTTTGAAC CTGCTGCTGA

251 TGCACCCGAC CCGCAAGGCG GACGATCAAA CCGTCGCCCT CAAGCCCGTC

301 GGCAGCGCGC AGAACGGCAG GGCGGAATAT GAGGCGGTGT TCAAAACCCT

351 TTCGCCGACC AACCACTGGT ATGTGCGCGT GGAGGACGCG GCAGGCGTGT

401 GGCGCGTCGA GAACAAATGG ATTACCAGCC AAGGCAATGC GGTCGATTTG

451 ACCCCGATGG ACAAGCTTTT CAATAATACT GAAAGCAAAT AA
```

This corresponds to the amino acid sequence <SEQ ID 1124; ORF 274>:

```
m274.pep
  1 MAGPIFVVIA SVAMFFVAQQ HATDLVTDDY YKDGKHIDIQ LHRDEEAVRR

 51 HIGVQVLISP DMNAAKVFVG GEFDGKQPLN LLLMHPTRKA DDQTVALKPV

101 GSAQNGRAEY EAVFKTLSPT NHWYVRVEDA AGVWRVENKW ITSQGNAVDL

151 TPMDKLFNNT ESK*
```

Computer analysis of this amino acid sequence gave the following results:

Homology with a Predicted ORF from *N. gonorrhoeae*

ORF 274 shows 97.5% identity over a 163 aa overlap with a predicted ORF (ORF 274.ng) from *N. gonorrhoeae*:

```
g274/m274
                   10        20        30        40        50        60
g274.pep   MAGPIFVVIASVAMFFVAQQHATDLVTDDYYKDGKHIDIQLHRDEEAVRRHIGVQVLISP
           ||||||||||||||||||||||||||||||||||||||||||||||||||||||||||||
m274       MAGPIFVVIASVAMFFVAQQHATDLVTDDYYKDGKHIDIQLHRDEEAVRRHIGVQVLISP
                   10        20        30        40        50        60

                   70        80        90       100       110       120
g274.pep   DMNAAKVFVGGEFDGKQPLNLLLMHPTRKADDQTVALKPVGSAQNGRAEYEAVFKTLPPA
           ||||||||||||||||||||||||||||||||||||||||||||||||||||||||| |:
m274       DMNAAKVFVGGEFDGKQPLNLLLMHPTRKADDQTVALKPVGSAQNGRAEYEAVFKTLSPT
                   70        80        90       100       110       120

                  130       140       150       160
g274.pep   NHWYVRVEDAAGVWRVENKWITSQGNAVDLTPMDKLFNNAGSKX
           |||||||||||||||||||||||||||||||||||||||: |||
m274       NHWYVRVEDAAGVWRVENKWITSQGNAVDLTPMDKLFNNTESKX
                  130       140       150       160
```

The following partial DNA sequence was identified in *N. meningitidis* <SEQ ID 1125>:

```
a274.seq
   1 ATGGCGGGGC CGATTTTTGT CGTCATCGCC AGCGTCGCTA TGTTTTTTGT

  51 CGCGCAGCAG CACGCGACAG ATTTGGTTAC GGACGATTAT TATAAAGACG

 101 GCAAGCATAT CGACATCCAG CTTCATCGGG ATGAAGAAGC CGTCAGACGG

 151 CATATCGGGG TGCAGGTTCT CATTTCCCCC GATATGAATG CGGCAAAAGT

 201 GTTTGTCGGC GGCGAGTTTG ACGGCAAACA GCCTTTGAAC CTGCTGCTGA

 251 TGCACCCGAC CCGCAAGGCG GACGATCAAA CCGTCGCCCT CAAGCCCGTC

 301 GGCAGCGCGC AGAACGGCAG GGCGGAATAT GAGGCGGTGT TCAAAACCCT

 351 TTCGCCGACC AACCACTGGT ATGTGCGCGT GGAGGACGCG GCAGGCGTGT

 401 GGCGCGTCGA GAACAAATGG ATTACCAGCC AAGGCAATGC GGTCGATTTG

 451 ACCCCGATGG ACAAACTTTT CAATAATACT GAAAGCAAAT AA
```

This corresponds to the amino acid sequence <SEQ ID 1126; ORF 274.a>:

```
a274.pep
   1 MAGPIFVVIA SVAMFFVAQQ HATDLVTDDY YKDGKHIDIQ LHRDEEAVRR

  51 HIGVQVLISP DMNAAKVFVG GEFDGKQPLN LLLMHPTRKA DDQTVALKPV

 101 GSAQNGRAEY EAVFKTLSPT NHWYVRVEDA AGVWRVENKW ITSQGNAVDL

 151 TPMDKLFNNT ESK*
```

m274/a274 100.0% identity in 163 aa overlap

```
                    10        20        30        40        50        60
m274.pep    MAGPIFVVIASVAMFFVAQQHATDLVTDDYYKDGKHIDIQLHRDEEAVRRHIGVQVLISP
            ||||||||||||||||||||||||||||||||||||||||||||||||||||||||||||
a274        MAGPIFVVIASVAMFFVAQQHATDLVTDDYYKDGKHIDIQLHRDEEAVRRHIGVQVLISP
                    10        20        30        40        50        60
                    70        80        90       100       110       120
m274.pep    DMNAAKVFVGGEFDGKQPLNLLLMHPTRKADDQTVALKPVGSAQNGRAEYEAVFKTLSPT
            ||||||||||||||||||||||||||||||||||||||||||||||||||||||||||||
a274        DMNAAKVFVGGEFDGKQPLNLLLMHPTRKADDQTVALKPVGSAQNGRAEYEAVFKTLSPT
                    70        80        90       100       110       120
                   130       140       150       160
m274.pep    NHWYVRVEDAAGVWRVENKWITSQGNAVDLTPMDKLFNNTESKX
            ||||||||||||||||||||||||||||||||||||||||||||
a274        NHWYVRVEDAAGVWRVENKWITSQGNAVDLTPMDKLFNNTESKX
                   130       140       150       160
```

The following partial DNA sequence was identified in *N. gonorrhoeae* <SEQ ID 1127>:

```
g276.seq
     1   atgattttgc cgccatccat gacgatgatg cggtcggcgg attcgacggt

    51   ggtcaggcgg tgggcgacga tgatgccggt gcggttttcc atcaggcgtt

   101   cgagcgcttg ttggacgagg cgttcggatt cgttgtccaa tgcgctggtg

   151   gcttcgtcca ataataatat cggcgcgtct ttcaaaatgg cgcgggcgat

   201   ggcgacgcgt tgccgctgtc cgccggataa gttgctgccg ttcgatccga

   251   tgggctggtg cagtccgagc ggggatgcgt cgatcaggct ttgcaggttg

   301   gcggcttgga gggcggacag gacttcggct tcgcccgcgt cgggacggct
```

-continued

```
351   gtatcggacg ttttcaaaca gggtgtcgtc aaacaggaat acgtcttggg

401   agacgagggc gaattgggcg cgcaggcagt cgagtttgat gtcggcgatg

451   tcgataccgt ctatgcagat gttgccggca gacggttcga caaagcgggg

501   cagaaggttg acgacggtgg atttgccgct gccggaacgt ccgaccaggg

551   cgacgcgttc gccttgtctg atgtcgaggt tgaagttgtc gagggctttg

601   atgccgtctg aacggtattc gacatcgacg ttgcggaagc tgatgcgccc

651   ttcgacacgc tgcggcgcga gcgtgccttt gtcctgttcg ggcggggtgt

701   cgagaaatgc acatacgccg tcggcggcga ggaacatcgt ctgcataggg

751   atgctgatgt tggcaaggct tttgatgggg gcgtacattt gcagcatcgc

801   gacgatgaat gccataaatt cgccgatggt ggtgtag
```

This corresponds to the amino acid sequence <SEQ ID 1128; ORF 276.ng>:

```
g276.pep
   1 MILPPSMTMM RSADSTVVRR WATMMPVRFS IRRSSACWTR RSDSLSNALV

  51 ASSNNNIGAS FKMARAMATR CRCPPDKLLP FDPMGWCSPS GDASIRLCRL

 101 AAWRADRTSA SPASGRLYRT FSNRVSSNRN TSWETRANWA RRQSSLMSAM

 151 SIPSMQMLPA DGSTKRGRRL TTVDLPLPER PTRATRSPCL MSRLKLSRAL

 201 MPSERYSTST LRKLMRPSTR CGASVPLSCS GGVSRNAHTP SAARNIVCIG

 251 MLMLARLLMG AYICSIATMN AINSPMVV*
```

The following partial DNA sequence was identified in *N. meningitidis* <SEQ ID 1129>:

```
m276.seq
   1 ATGATTTTGC CGTCGTCCAT CACGATGATG CGGTCGGCCC CTTCGATGGT

  51 GGTCAGGCGG TGGGCGACGA TGATGCCGGT GCGGTTTTCC ATCAGGCGTT

 101 CGAGCGCCTG TTGGACGAGG CGTTCGGATT CGTTGTCTAA TGCGCTGGTG

 151 GCTTCGTCCA ATAATAATAT CGGCGCGTCT TTCAAAATGG CGCGGGCAAT

 201 GGCGACGCGT TGCCGCTGTC CGCCGGATAA GTTGCTGCCG TTCGATCCGA

 251 TGGGCTGGTG CAGTCCGAGC GGGGAGCTGT CAATCAGGCT TTGCAGGTTG

 301 GCGGTTTGGA GGGCGAACAG GACTTCGGCT TCGCCCGCGT CGGGACGGCT

 351 GTATCGGACG TTTTCAAACA GGGTGTCGTC AAACAGGAAT ACGTCTTGGG

 401 AGACGAGGGC GAATTGGGCG CGCAGGCAGT CGAGTTTGAT GTCGGCGATG

 451 TCGATACCGT CTATGCAGAT GTTGCCGGCA GACGGTTCGA CAAAGCGGGG

 501 CAGCAGGTTG ACGACGGTGG ATTTGCCGCT GCCGGAACGT CCGACCAGGG

 551 CGACGCGTTC GCCTTGTCTG ATGTCGAGGT TGAAGTTGTC GAGGGCTTTG

 601 ATGCCGTCTG AACGGTATTC GACATCGACG TTGCGGAAGC TGATGCGCCC

 651 TTCGACACGC TGCGGTGCGA GCGTGCCCTT GTCCTGTTCG GGCGGGGTGT

 701 CGAGAAATGC ACATACACCG TCGGCGGCGA GGAACATCGT CTGCATAGGG

 751 ATGCTGATGT TGGCAAGGCT TTTGATGGGG GCGTACATTT GCAGCATCGC

 801 GACGATGAAT GCCATAAATT CGCCGATGGT GGTGTAG
```

This corresponds to the amino acid sequence <SEQ ID 1130; ORF 276>:

```
m276.pep
    1 MILPSSITMM RSAPSMVVRR WATMMPVRFS IRRSSACWTR RSDSLSNALV

   51 ASSNNNIGAS FKMARAMATR CRCPPDKLLP FDPMGWCSPS GELSIRLCRL

  101 AVWRANRTSA SPASGRLYRT FSNRVSSNRN TSWETRANWA RRQSSLMSAM

  151 SIPSMQMLPA DGSTKRGSRL TTVDLPLPER PTRATRSPCL MSRLKLSRAL

  201 MPSERYSTST LRKLMRPSTR CGASVPLSCS GGVSRNAHTP SAARNIVCIG

  251 MLMLARLLMG AYICSIATMN AINSPMVV*
```

Computer analysis of this amino acid sequence gave the following results:
Homology with a Predicted ORF from *N. gonorrhoeae*
ORF 276 shows 96.8% identity over a 278 aa overlap with a predicted ORF (ORF 276.ng) from *N. gonorrhoeae*:

```
m276/g276

                        10         20         30         40         50         60
     m276.pep    MILPSSITMMRSAPSMVVRRWATMMPVRFSIRRSSACWTRRSDSLSNALVASSNNNIGAS
                 ||||  |:|||||| | ||||||||||||||||||||||||||||||||||||||||||
     g276        MILPPSMTMMRSADSTVVRRWATMMPVRFSIRRSSACWTRRSDSLSNALVASSNNNIGAS
                        10         20         30         40         50         60

                        70         80         90        100        110        120
     m276.pep    FKMARAMATRCRCPPDKLLPFDPMGWCSPSGELSIRLCRLAVWRANRTSASPASGRLYRT
                 ||||||||||||||||||||||||||||||| : |||||||||:|||:|||||||||||
     g276        FKMARAMATRCRCPPDKLLPFDPMGWCSPSGDASIRLCRLAAWRADRTSASPASGRLYRT
                        70         80         90        100        110        120

                       130        140        150        160        170        180
     m276.pep    FSNRVSSNRNTSWETRANWARRQSSLMSAMSIPSMQMLPADGSTKRGSRLTTVDLPLPER
                 ||||||||||||||||||||||||||||||||||||||||||||||| ||||||||||||
     g276        FSNRVSSNRNTSWETRANWARRQSSLMSAMSIPSMQMLPADGSTKRGRRLTTVDLPLPER
                       130        140        150        160        170        180

                       190        200        210        220        230        240
     m276.pep    PTRATRSPCLMSRLKLSRALMPSERYSTSTLRKLMRPSTRCGASVPLSCSGGVSRNAHTP
                 |||||||||||||| |||||||||||||||||||||||||||||||||||||||||||||
     g276        PTRATRSPCLMSRLKPSRALMPSERYSTSTLRKLMRPSTRCGASVPLSCSGGVSRNAHTP
                       190        200        210        220        230        240

                       250        260        270    279
     m276.pep    SAARNIVCIGMLMLARLLMGAYICSIATMNAINSPMVVX
                 |||||||||||||||||||||||||||||||||||||||
     g276        SAARNIVCIGMLMLARLLMGAYICSIATMNAINSPMVVX
                       250        260        270
```

The following partial DNA sequence was identified in *N. meningitidis* <SEQ ID 1131>:

```
a276.seq
    1 ATGATTTTGC CGTCGTCCAT TACGATGATG CGGTCGGCCC CTTCGATGGT

   51 GGTCAGGCGG TGGGCGACGA TGATGCCGGT GCGGTTTTCC ATCAGGCGTT

  101 CGAGCGCCTG TTGGACGAGG CGTTCGGATT CGTTGTCCAA TGCGCTGGTG

  151 GCTTCGTCCA ATAATAATAT CGGCGCGTCT TTCAAAATGG CGCGGGCAAT

  201 GGCAACGCGT TGCCGCTGTC CGCCGGATAA GTTGCTGCCG TTCGATCCGA

  251 TGGGCTGGTG CAGTCCGAGC GGTGATGCGT CGATCAGGCT TTGCAGGTTA

  301 GCGGCTTGGA GGGCGGATAG GACTTCGGCT TCGCCCGCGT CGGGACGGCT

  351 ATATCGGACG TTTTCAAACA GGGTGTCGTC AAACAGGAAT ACGTCTTGGG

  401 AGACGAGGGC AAATTGGGCG CGCAGGCAGT CGAGTTTGAT GTCGGCGATG

  451 TCGATACCGT CTATGCAGAT GTTGCCGGCA GACGGTTCGA CAAAGCGGGG
```

-continued

```
501  CAGCAGGTTG ACGACGGTGG ATTTGCCGCT GCCGGAACGT CCGACCAGGG

551  CGACGCGTTC GCCTTGTCTG ATGTCGAGGT TGAAGCCGTC GAGGGCTTTG

601  ATGCCGTCCG AACGGTATTC GACATCGACG TTGCGGAAGC TGATGCGCCC

651  TTCGACACGC TGCGGTGCGA GCGTGCCTTT GTCCTGTTCG GGCGGGGTGT

701  CGAGAAATGC ACATACGCCG TCGGCGGCGA GGAACATCGT CTGCATAGGG

751  ATGCTAATGT TGGCAAGGCT TTTGATGGGG GCGTACATTT GCAGCATCGC

801  GACGATGAAT GCCATAAATT CGCCGATGGT GGTGTAG
```

This corresponds to the amino acid sequence <SEQ ID 1132; ORF 276.a>:

```
a276.pep
  1    MILPSSITMM RSAPSMVVRR WATMMPVRFS IRRSSACWTR RSDSLSNALV

 51    ASSNNNIGAS FKMARAMATR CRCPPDKLLP FDPMGWCSPS GDASIRLCRL

101    AAWRADRTSA SPASGRLYRT FSNRVSSNRN TSWETRANWA RRQSSLMSAM

151    SIPSMQMLPA DGSTKRGSRL TTVDLPLPER PTRATRSPCL MSRLKPSRAL

201    MPSERYSTST LRKLMRPSTR CGASVPLSCS GGVSRNAHTP SAARNIVCIG

251    MLMLARLLMG AYICSIATMN AINSPMVV*
```

m276/a276 98.2% identity in 278 aa overlap

```
                    10        20        30        40        50        60
m276.pep    MILPSSITMMRSAPSMVVRRWATMMPVRFSIRRSSACWTRRSDSLSNALVASSNNNIGAS
            ||||||||||||||||||||||||||||||||||||||||||||||||||||||||||||
a276        MILPSSITMMRSAPSMVVRRWATMMPVRFSIRRSSACWTRRSDSLSNALVASSNNNIGAS
                    10        20        30        40        50        60

                    70        80        90       100       110       120
m276.pep    FKMARAMATRCRCPPDKLLPFDPMGWCSPSGELSIRLCRLAVWRANRTSASPASGRLYRT
            ||||||||||||||||||||||||||||||||: ||||||||:|||:|||||||||||||
a276        FKMARAMATRCRCPPDKLLPFDPMGWCSPSGDASIRLCRLAAWRADRTSASPASGRLYRT
                    70        80        90       100       110       120

                   130       140       150       160       170       180
m276.pep    FSNRVSSNRNTSWETRANWARRQSSLMSAMSIPSMQMLPADGSTKRGSRLTTVDLPLPER
            ||||||||||||||||||||||||||||||||||||||||||||||||||||||||||||
a276        FSNRVSSNRNTSWETRANWARRQSSLMSAMSIPSMQMLPADGSTKRGSRLTTVDLPLPER
                   130       140       150       160       170       180

                   190       200       210       220       230       240
m276.pep    PTRATRSPCLMSRLKLSRALMPSERYSTSTLRKLMRPSTRCGASVPLSCSGGVSRNAHTP
            |||||||||||||| |||||||||||||||||||||||||||||||||||||||||||||
a276        PTRATRSPCLMSRLKPSRALMPSERYSTSTLRKLMRPSTRCGASVPLSCSGGVSRNAHTP
                   190       200       210       220       230       240

                   250       260       270      279
m276.pep    SAARNIVCIGMLMLARLLMGAYICSIATMNAINSPMVVX
            |||||||||||||||||||||||||||||||||||||||
a276        SAARNIVCIGMLMLARLLMGAYICSIATMNAINSPMVVX
                   250       260       270
```

The following partial DNA sequence was identified in *N. gonorrhoeae* <SEQ ID 1133>:

```
g277.seq (partial)
  1. . . atggtacacg tcgccgtagc ttacggtatt gccgtccggc gtttttgccc

 51      aaacgaggtc atagacgttt tccacgcctt gcaggtacat cgccaagcgt

101      tcgatgccgt aggtaatttc gccgagtacg ggcgtgcaat cgataccgcc

151      gacttgttgg aaataggtaa actgggttac ttccatgccg ttgagccaga

201      cttcccagcc caaaccccac gcaccgaggg tggggttttc ccagtcgtct
```

-continued

```
251      tcgacaaagc ggatgtcgtg gactttggga tcgatgccca attcgcgcag

301      ggagtcgaga tagaggtctt ggatattggc gggggcgggt ttgagggcga

351      cttggaattg gtaatagtgt tgcaggcggt tggggttgtc gccgtagcgg

401      ccgtctttgg ggcggcggct gggttggacg taggcggcaa accaaggctc

451      ggggccgagc gcgcgcaggc aggtggcggg atgggatgtg ccggcaccga

501      cttccatgtc gaagggttgg atgacggtgc agcctttgtc tgcccagaag

551      gtttgcagtt tgaagatgat ttgttggaag gtaagcatgg cttattgttc

601      gataaaataa aggttttatt ttactgtttc catagccgct tgaatagatt

651      tatctcgaag acagcctga
```

This corresponds to the amino acid sequence <SEQ ID 1134; ORF 277.ng>:

```
g277.pep (partial)
  1. . . MVHVAVAYGI AVRRFCPNEV IDVFHALQVH RQAFDAVGNF AEYGRAIDTA

 51      DLLEIGKLGY FHAVEPDFPA QTPRTEGGVF PVVFDKADVV DFGIDAQFAQ

101      GVEIEVLDIG GGGFEGDLEL VIVLQAVGVV AVAAVFGAAA GLDVGGKPRL

151      GAERAQAGGG MGCAGTDFHV EGLDDGAAFV CPEGLQFEDD LLEGKHGLLF

201      DKIKVLFYCF HSRLNRFISK TA*
```

The following partial DNA sequence was identified in *N. meningitidis* <SEQ ID 1135>:

```
m277.seq
    1  ATGCCCCGCT TTGAGGACAA GCTCGTAGGC AGGCAGGGCG AGGGCGGCGT

   51  TTTCTTCGGC AAGCAGGCGT TTGGCTTGCG CTTCGTAGTC GTTGAACTGG

  101  CGCAGCAGCC AGTCGGCATC GCTGTATTCG AAGTTGTAGG TGGATTGCTC

  151  GACTTCGTTT TGGTGGTACA CGTCGCCGTA GGTGACGGTG TTGCCGTCGA

  201  GCGTTTTTGC CCAAACGAGG TCGTAGACGT TTTCTACACC TTGCAAGTAC

  251  ATCGCCAAGC GTTCGATGCC GTAGGTGATT TCGCCGAGTA CGGGCGTGCA

  301  GTCGATGCCG CCGACTTGTT GGAAATAGGT AAACTGGGTT ACTTCCATGC

  351  CGTTGAGCCA GACTTCCCAG CCCAAACCCC ACGCGCCGAG GGTGGGGTTT

  401  TCCCAGTCGT CTTCGACAAA GCGGATGTCG TGGACTTTGG GATCGATGCC

  451  CAATTCGCGC AGAGAGTCGA GATAGAGGTC TTGGATATTG GCGGGAGCGG

  501  GCTTGAGGGC GACTTGGAAT TGGTAATAGT GTTGCAGGCG GTTGGGGTTG

  551  TCGCCGTAGC GGCCGTCTTT GGGGCGGCGG CTGGGTTGGA CGTAGGCGGC

  601  AAACCAAGGC TCGGGGCCGA GTGCGCGCAG GCAGGTGGCG GGATGGGATG

  651  TGCCGGCACC GACTTCCATG TCGAAGGGTT GGATGACGGT GCAGCCTTTG

  701  TCTGCCCAGA ATGTTTGCAG TTTGAAGATG ATTTGTTGGA AGGTAAGCAT

  751  GGCTTATGA
```

This corresponds to the amino acid sequence <SEQ ID 1136; ORF 277>:

```
m277.pep
   1   MPRFEDKLVG RQGEGGVFFG KQAFGLRFVV VELAQQPVGI AVFEVVGGLL
```

-continued

```
 51  DFVLVVHAV GDGVAVERFC PNEVVDVFYT LQVHRQAFDA VGDFAEYGRA

101  VDAADLLEIG KLGYFHAVEP DFPAQTPRAE GGVFPVVFDK ADVVDFGIDA

151  QFAQRVEIEV LDIGGSGLEG DLELVIVLQA VGVVAVAAVF GAAAGLDVGG

201  KPRLGAECAQ AGGGMGCAGT DFHVEGLDDG AAFVCPECLQ FEDDLLEGKH

251  GL*
```

Computer analysis of this amino acid sequence gave the following results:

Homology with a Predicted ORF from *N. gonorrhoeae*

ORF 277 shows 90.0% identity over a 221 aa overlap with a predicted ORF (ORF 277.ng) from *N. gonorrhoeae*:

```
g277/m277

                                               10        20        30
g277.pep                                 MVHVAVAYGIAVRRFCPNEVIDVFHALQVH
                                       :|||||: |:||:|||||||:|||::||||
m277      GLRFVVVELAQQPVGIAVFEVVGGLLDFVLVVHAVGDGVAVERFCPNEVVDVFYTLQVH
               30        40        50        60        70        80

                  40        50        60        70        80        90
g277.pep  RQAFDAVGNFAEYGRAIDTADLLEIGKLGYFHAVEPDFPAQTPRTEGGVFPVVFDKADVV
          ||||||||:|||||||:|:|||||||||||||||||||||||||:|||||||||||||||
m277      RQAFDAVGDFAEYGRAVDAADLLEIGKLGYFHAVEPDFPAQTPRAEGGVFPVVFDKADVV
               90       100       110       120       130       140

                 100       110       120       130       140       150
g277.pep  DFGIDAQFAQGVEIEVLDIGGGGFEGDLELVIVLQAVGVVAVAAVFGAAAGLDVGGKPRL
          |||||||||| ||||||||||:|:||||||||||||||||||||||||||||||||||||
m277      DFGIDAQFAQRVEIEVLDIGGSGLEGDLELVIVLQAVGVVAVAAVFGAAAGLDVGGKPRL
              150       160       170       180       190       200

                 160       170       180       190       200
g277.pep  GAERAQAGGGMGCAGTDFHVEGLDDGAAFVCPEGLQFEDDLLEGKHGLL
          ||| ||||||||||||||||||||||||||||| ||||||||||||||
m277      GAECAQAGGGMGCAGTDFHVEGLDDGAAFVCPECLQFEDDLLEGKHGLX
              210       220       230       240       250
```

The following partial DNA sequence was identified in *N. meningitidis* <SEQ ID 1137>:

```
a277.seq
  1  ATGCCCCGCT TTGAGGACAA GCTCGTAGGC AGGCAGGGCG AGGGCGGCGT

 51  TTTCTTCGGC AAGCAGGCGT TTGGCTTGCG CTTCGTAGTC GTTGAACTGG

101  CGCAGCAGCC AATCGGCATC GCTGTATTCG AAGTTGTAGG TGGATTGTTC

151  GACTTCGTTT TGGTGGTACA CGTCGCCGTA AGTTACTGTA TTACCGTCCA

201  GCGTTTTTGC CCAAACGAGG TCATAGACGT TTTCCACGCC TTGCAGGTAC

251  ATCGCCAAGC GTTCGATGCC GTAGGTGATT TCGCCGAGTA CGGGGGTGCA

301  GTCGATGCCG CCGACTTGTT GGAAATAGGT GAACTGGGTT ACTTCCATAC

351  CGTTGAGCCA GACTTCCCAG CCCAAACCCC ACGCGCCGAG GGTGGGGTTT

401  TCCCAGTCGT CTTCGACAAA GCGGATGTCG TGCACTTTGG GGTCGATGCC

451  CAATTCGCGC AGGGAGTCGA GATAGAGGTC TTGGATATTG GCGGGAGCGG

501  GCTTGAGGGC GACTTGGAAT TGGTAATAGT GTTGCAGGCG GTTGGGGTTG

551  TCGCCGTAGC GACCGTCTTT GGGGCGGCGG CTGGGTTGGA CGTAGGCGGC

601  AAACCAAGGC TCGGGGCCGA GTGCGCGCAG ACAGGTGGCG GGATGGGATG

651  TGCCGGCACC GACTTCCATG TCGAAGGGTT GGATGACGGT GCAGCCTTTG
```

-continued

```
701  TCTGCCCAGA ATGTTTGCAG TTTGAAGATG ATTTGTTGGA AGGTAAGCAT

751  GGCTTATGA
```

This corresponds to the amino acid sequence <SEQ ID 1138; ORF 277.a>:

```
a277.pep
   1  MPRFEDKLVG RQGEGGVFFG KQAFGLRFVV VELAQQPIGI AVFEVVGGLF

  51  DFVLVVHVAV SYCITVQRFC PNEVIDVFHA LQVHRQAFDA VGDFAEYGGA

 101  VDAADLLEIG ELGYFHTVEP DFPAQTPRAE GGVFPVVFDK ADVVHFGVDA

 151  QFAQGVEIEV LDIGGSGLEG DLELVIVLQA VGVVAVATVF GAAAGLDVGG

 201  KPRLGAECAQ TGGGMGCAGT DFHVEGLDDG AAFVCPECLQ FEDDLLEGKH

 251  GL*
```

m277/a277 92.5% identity in 252 aa overlap

```
                    10        20        30        40        50        60
m277.pep   MPRFEDKLVGRQGEGGVFFGKQAFGLRFVVVELAQQPVGIAVFEVVGGLLDFVLVVHVAV
           |||||||||||||||||||||||||||||||||||||:|||||||||||:||||||||||
a277       MPRFEDKLVGRQGEGGVFFGKQAFGLRFVVVELAQQPIGIAVFEVVGGLFDFVLVVHVAV
                    10        20        30        40        50        60
                    70        80        90       100       110       120
m277.pep   GDGVAVERFCPNEVVDVFYTLQVHRQAFDAVGDFAEYGRAVDAADDLLEIGHKLGYFHAVEP
           :  ::|:|||||||:|||:||||||||||||||||||| |||||||||||||:|||||:|||
a277       SYCITVQRFCPNEVIDVFHALQVHRQAFDAVGDFAEYGGAVDAADDLLEIGHELGYFHTVEP
                    70        80        90       100       110       120
                   130       140       150       160       170       180
m277.pep   DFPAQTPRAEGGVFPVVFDKADVVDFGIDAQFAQRVEIEVLDIGGSGLEGDLELVIVLQA
           |||||||||||||||||||||||| ||:|||||| |||||||||||||||||||||||||
a277       DFPAQTPRAEGGVFPVVFDKADVVHFGVDAQFAQGVEIEVLDIGGSGLEGDLELVIVLQA
                   130       140       150       160       170       180
                   190       200       210       220       230       240
m277.pep   VGVVAVAAVFGAAAGLDVGGKPRLGAECAQAGGGMCAGTDFHVEGLDDGAAFVCPECLQ
           |||||||:||||||||||||||||||||||:|||||||||||||||||||||||||||||
a277       VGVVAVATVFGAAAGLDVGGKPRLGAECAQTGGGMCAGTDFHVEGLDDGAAFVCPECLQ
                   190       200       210       220       230       240
                   250
m277.pep   FEDDLLEGKHGLX
           |||||||||||||
a277       FEDDLLEGKHGLX
                   250
```

The following partial DNA sequence was identified in *N. gonorrhoeae* <SEQ ID 1139>:

```
g278.seq (partial)
   1  ttgcgtgcaa tcacgcccgg tgcgattttt tcgacagggg cggtcaaagt

  51  tgtattaatc ggacctttgc cgtcgatagg ccgacccaat gcatcgacga

 101  cgcgtccgac caattcgcgt ccgaccggca cttctaaaat acggccggta

 151  caggtaaccg tgtcgccttc tttaatatgt tcgtactcgc ccaacactac

 201  ggcaccgacg gagtcgcgct ccaggttcat cgccaagcct aaagtgttac

 251  ccgggaattc gagcatctca ccttgcattg catctgacaa accatggatg

 301  cgaacgatac cgtcagttac cgaaatcacc gtaccacggg tactcacttc

 351  ggcatttaca gacagatttt cgatcttggc tttaatcaga tcgctaattt

 401  cagcaggatt aagctgcatg aaaactctcc taattcgtca tagtcgtgta
```

-continued

```
451  caaagcactc agtttgcctt gtacagacaa atccaaaacc tgatcaccca

501  cttcaacttt ta . . .
```

This corresponds to the amino acid sequence <SEQ ID 1140; ORF 278.ng>:

```
g278.pep (partial)
  1  LRAITPGAIF STGAVKVVLI GPLPSIGRPN ASTTRPTNSR PTGTSKIRPV

 51  QVTVSPSLIC SYSPNTTAPT ESRSRFIAKP KVLPGNSSIS PCIASDKPWM

101  RTIPSVTEIT VPRVLTSAFT DRFSILALIR SLISAGLSCM KTLLIRHSRV

151  QSTQFALYRQ IQNLITHFNF . . .
```

The following partial DNA sequence was identified in *N. meningitidis* <SEQ ID 1141>:

```
m278.seq . . .
  1  TTGCGCGCAA TCACGCCCGG TGCGATTTTT TCGATAGGGG CGGTCAAAGT

 51  TGTATTAATC GGGCCTTTGC CGTCGATAGG CCGACCCAAT GCATCAACGA

101  CGCGTCCGAC CAGTTCGCGT CCGACCGGCA CTTCCAAGAT ACGACCGGTA

151  CAGGTAACCG TGTCGCCTTC TTTAATGTGT TCGTACTCGC CCAACACTAC

201  GGCGCCGACG GAGTCGCGCT CCAGGTTCAT CGCCAAGCCG AAAGTGTTAC

251  CCGGGAATTC GAGCATCTCA CCTTGCATTG CATCTGACAA ACCATGGATG

301  CGAACGATAC CGTCAGTTAC CGAAATTACC GTACCACAGG TACGCACTTC

351  GGCATTTACA GACAGATTTT CGATCTTGGC TTTAATCAAA TCGCTAATTT

401  CAGCAGGATT AAGCTGCATG AAAACTCTCC TAATTCGTCA TAGTCGTGTA

451  CAAGGCACTC AATTTGCCTT GTACAGACAA ATCCAAAACC TGATCACCCA

501  CTTCAACTTT TATGCCGCCA ATCAGCTCCG GTTCGATTTC GACAGAGATT

551  TTCAGCTCGC TGTCGAAACG CTTATTCAGC ATTTGCACCA ACTCGCCGAC

601  CTGTTTGTCG GTCAACGGAT AGGCACTGTA AATGACGGCA GATTTGATAT

651  GGTTGAATGA
```

This corresponds to the amino acid sequence <SEQ ID 1142; ORF 278>:

```
m278.pep
  1  LRAITPGAIF SIGAVKVVLI GPLPSIGRPN ASTTRPTSSR PTGTSKIRPV

 51  QVTVSPSLMC SYSPNTTAPT ESRSRFIAKP KVLPGNSSIS PCIASDKPWM

101  RTIPSVTEIT VPQVRTSAFT DRFSILALIK SLISAGLSCM KTLLIRHSRV

151  QGTQFALYRQ IQNLITHFNF YAANQLRFDF DRDFQLAVET LIQHLHQLAD

201  LFVGQRIGTV NDGRFDMVE*
```

Computer analysis of this amino acid sequence gave the following results:

Homology with a Predicted ORF from *N. gonorrhoeae*

ORF 278 shows 95.9% identity over a 170 aa overlap with a predicted ORF (ORF 278.ng) from *N. gonorrhoeae*:

```
g278/m278
                   10        20        30        40        50        60
g278.pep   LRAITPGAIFSTGAVKVVLIGPLPSIGRPNASTTRPTNSRPTGTSKIRPVQVTVSPSLIC
           ||||||||||| ||||||||||||||||||||||||:|||||||||||||||||||||:|
m278       LRAITPGAIFSIGAVKVVLIGPLPSIGRPNASTTRPTSSRPTGTSKIRPVQVTVSPSLMS
                   10        20        30        40        50        60
                   70        80        90       100       110       120
g278.pep   SYSPNTTAPTESRSRFIAKPKVLPGNSSISPCIASDKPWMRTIPSVTEITVPRVLTSAFT
           ||||||||||||||||||||||||||||||||||||||||||||||||||||:| |||||
m278       SYSPNITAPTESRSRFIAKPKVLPGNSSISPCIASDKPWMRTIPSVTEITVPQVRTSAFT
                   70        80        90       100       110       120
                  130       140       150       160       170
g278.pep   DRFSILALIRSLISAGLSCMKTLLIRHSRVQSTQFALYRQIQNLITHFNF
           ||||||||||:||||||||||||||||||||:|||||||||||||||||
m278       DRFSILALIKSLISAGLSCMKTLLIRHSRVQGTQFALYRQIQNLITHFNFYAANQLRFDF
                  130       140       150       160       170       180
m278       DRDFQLAVETLIQHLHQLADLFVGQRIGTVNDGRFDMVE*
                  190       200       210
```

The following partial DNA sequence was identified in *N. meningitidis* <SEQ ID 1143>:

```
a278.seq
     1  TTGCGCGCAA TCACGCCCGG TGCGATTTTT TCGATAGGGG CGGTCAAAGT

    51  TGTATTAATC GGGCCTTTGC CGTCGATAGG CCGACCCAAT GCATCAACGA

   101  CGCGTCCGAC CAGTTCGCGT CCGACCGGCA CTTCCAAGAT ACGACCGGTA

   151  CAGGTAACCG TGTCGCCTTC TTTAATATGT TCGTGCTCGC CCAACACTAC

   201  GGCGCCGACG GAGTCGCGCT CCAGGTTCAT CGCCAAGCCG AAAGTGTTAC

   251  CCGGGAATTC GAGCATCTCA CCTTGCATTG CATCTGACAA ACCATGGATG

   301  CGAACGATAC CGTCAGTTAC CGAAATCACC GTACCACGGG TACGCACTTC

   351  GGCATTTACA GACAGATTTT CGATCTTGGC TTTAATCAAA TCGCTAATTT

   401  CAGCAGGATT AAGCTGCATG AAAACTCTCC TAATTCGTCA TAGTCGTGTA

   451  CAAGGCACTC AATTTGCCTT GTACAGACAA ATCCAAAACC TGATCACCCA

   501  CTTCAACTTT TATGCCGCCA ATCAGCTCCG GTTCGATTTC GACAGAGATT

   551  TTCAGCTCGC TGTCGAAACG CTTATTCAGC ATTTGCGCCA ACTCGCCGAC

   601  CTGTTTGTCG GTCAACGGAT AGGCACTGTA AATGACGGCA GATTTGATAT

   651  GGTTGAATGA
```

This corresponds to the amino acid sequence <SEQ ID 1144; ORF 278.a>:

```
a278.pep
     1  LRAITPGAIF SIGAVKVVLI GPLPSIGRPN ASTTRPTSSR PTGTSKIRPV

    51  QVTVSPSLIC SCSPNTTAPT ESRSRFIAKP KVLPGNSSIS PCIASDKPWM

   101  RTIPSVTEIT VPRVRTSAFT DRFSILALIK SLISAGLSCM KTLLIRHSRV

   151  QGTQFALYRQ IQNLITHFNF YAANQLRFDF DRDFQLAVET LIQHLRQLAD

   201  LFVGQRIGTV NDGRFDMVE*
```

m278/a278 98.2% identity in 219 aa overlap

```
                  10        20        30        40        50        60
m278.pep  LRAITPGAIFSIGAVKVVLIGPLPSIGRPNASTTRPTSSRPTGTSKIRPVQVTVSPSLMC
          ||||||||||||||||||||||||||||||||||||||||||||||||||||||||||:|
a278      LRAITPGAIFSIGAVKVVLIGPLPSIGRPNASTTRPTSSRPTGTSKIRPVQVTVSPSLIS
                  10        20        30        40        50        60

                  70        80        90       100       110       120
m278.pep  SYSPNTTAPTESRSRFIAKPKVLPGNSSISPCIASDKPWMRTIPSVTEITVPQVRTSAFT
          | ||||||||||||||||||||||||||||||||||||||||||||||||||:|||||||
a278      SCSPNTTAPTESRSRFIAKPKVLPGNSSISPCIASDKPWMRTIPSVTEITVPRVRTSAFT
                  70        80        90       100       110       120

                 130       140       150       160       170       180
m278.pep  DRFSILALIKSLISAGLSCMKTLLIRHSRVQGTQFALYRQIQNLITHFNFYAANQLRFDF
          ||||||||||||||||||||||||||||||||||||||||||||||||||||||||||||
a278      DRFSILALIKSLISAGLSCMKTLLIRHSRVQGTQFALYRQIQNLITHFNFYAANQLRFDF
                 130       140       150       160       170       180

                 190       200       210       220
m278.pep  DRDFQLAVETLIQHLHQLADLFVGQRIGTVNDGRFDMVEX
          |||||||||||||||:||||||||||||||||||||||||
a278      DRDFQLAVETLIQHLRQLADLFVGQRIGTVDNGRFDMVEX
                 190       200       210       220
```

The following partial DNA sequence was identified in *N. gonorrhoeae* <SEQ ID 1145>:

```
g279.seq
    1 atgacgcgga tttgcggctg cttgatttca acggttttga gtgtttcggc

   51 aagtttgtcg gcggcgggtt tcatcaggct gcaatgggaa ggaacggata

  101 ccggcagcgg cagggcgcgt ttggctccgg cttctttggc ggcagccatg

  151 gtgcgtccga cggcggcggc gttgcctgca atcacgactt gtccgggcga

  201 gttgaagttg acggcttcga ccacttcgcc ctgtgcggat tcggcacaaa

  251 tctgcctgac ctgttcatct tccaaaccca aaatggccgc cattgcgcct

  301 acgccttgcg gtacggcgga ctgcatcagt tcggcgcgca ggcggacgag

  351 tttgacggca tcggcaaaat ccaatgcttc ggcggcgaca agcgcggtgt

  401 attcgccgag gctgtgtccg gcaacggcgg caggcgtttt gccgcccact

  451 tccaaatag
```

This corresponds to the amino acid sequence <SEQ ID 1146; ORF 279.ng>:

```
g279.pep
    1 MTRICGCLIS TVLSVSASLS AAGFIRLQWE GTDTGSGRAR LAPASLAAAM

   51 VRPTAAALPA ITTCPGELKL TASTTSPCAD SAQICLTCSS SKPKMAAIAP

  101 TPCGTADCIS SARRRTSLTA SAKSNASAAT SAVYSPRLCP ATAAGVLPPT

  151 SK*
```

The following partial DNA sequence was identified in *N. meningitidis* <SEQ ID 1147>:

```
m279.seq
    1 ATAACGCGGA TTTGCGGCTG CTTGATTTCA ACGGTTTTCA GGGCTTCGGC

   51 AAGTTTGTCG GCGGCGGGTT TCATCAGGCT GCAATGGGAA GGTACGGACA

  101 CGGGCAGCGG CAGGGCGCGT TTGGCACCGG CTTCTTTGGC GGCAGCCATG

  151 GCGCGTCCGA CGGCGGCGGC GTTGCCTGCA ATCACGATTT GTCCGGGTGA
```

-continued

```
201 GTTGAAGTTG ACGGCTTCGA CCACTTCGCT TTGGGCGGCT TCGGCACAAA

251 TGGCTTTAAC CTGCTCATCT TCCAAGCCGA GAATCGCCGC CATTGCGCCC

301 ACGCCTTGCG GTACGGCGGA CTGCATCAGT TCGGCGCGCA GGCGCACGAG

351 TTTGACCGCG TCGGCAAAAT TCAATGCGCC GGCGGCAACG AGTGCGGTGT

401 ATTCGCCGAG GCTGTGTCCG GCAACGGCGG CAGGCGTTTT GCCGCCCGCT

451 TCTAAATAG
```

This corresponds to the amino acid sequence <SEQ ID 1148; ORF 279>:

```
m279.pep
  1 ITRICGCLIS TVFRASASLS AAGFIRLQWE GTDTGSGRAR LAPASLAAAM

 51 ARPTAAALPA ITICPGELKL TASTTSLWAA SAQMALTCSS SKPRIAAIAP

101 TPCGTADCIS SARRRTSLTA SAKFNAPAAT SAVYSPRLCP ATAAGVLPPA

151 SK*
```

Computer analysis of this amino acid sequence gave the following results:

Homology with a Predicted ORF from *N. gonorrhoeae*

ORF 279 shows 89.5% identity over a 152 aa overlap with a predicted ORF (ORF 279.ng) from *N. gonorrhoeae*:

```
                     10        20        30        40        50        60
m279.pep     ITRICGCLISTVFRASASLSAAGFIRLQWEGTDTGSGRARLAPASLAAAMARPTAAALPA
             :|||||||||||: :|||||||||||||||||||||||||||||||||||:|||||||||
g279         MTRICGCLISTVLSVSASLSAAGFIRLQWEGTDTGSGRARLAPASLAAAMVRPTAAALPA
                     10        20        30        40        50        60

                     70        80        90       100       110       120
m279.pep     ITICPGELKLTASTTSLWAASAQMALTCSSSKPRIAAIAPTPCGTADCISSARRRTSLTA
             || |||||||||||||  | |||: ||||||||::|||||||||||||||||||||||||
g279         ITTCPGELKLTASTTSPCADSAQICLTCSSSKPKMAAIAPTPCGTADCISSARRRTSLTA
                     70        80        90       100       110       120

                    130       140       150
m279.pep     SAKFNAPAATSAVYSPRLCPATAAGVLPPASKX
             ||| || ||||||||||||||||||||||:|||
g279         SAKSNASAATSAVYSPRLCPATAAGVLPPTSKX
                    130       140       150
```

The following partial DNA sequence was identified in *N. meningitidis* <SEQ ID 1149>:

```
a279.seq
  1 ATGACNCNGA TTTGCGGCTG CTTGATTTCA ACGGTTTNNA GGGCTTCGGC

 51 GAGTTTGTCG GCGGCGGGTT TCATGAGGCT GCAATGGGAA GGTACNGACA

101 CNGGCAGCGG CAGGGCGCGT TTGGCGCCGG CTTCTTTGGC GGCAAGCATA

151 GCGCGCTCGA CGGCGGCGGC ATTGCCTGCA ATCACGACTT GTCCGGGCGA

201 GTTGAAGTTG ACGGCTTCAA CCACTTCATC CTGTGCGGAT TCGGCGCAAA

251 TTTGTTTTAC CTGTTCATCT TCCAAGCCGA GAATCGCCGC CATTGCGCCC

301 ACGCCTTGCG GTACGGCGGA CTGCATCAGT TCGGCGCGCA NGCGCACGAG

351 TTTGACCGCG TCGGCAAAAT CCAATGCGCC GGCGGCAACN AGTGCGGTGT

401 ATTCGCCGAN GCTGTGTCCG GCAACGGCGG CAGGCGTTTT GCCGCCCGCT

451 TCCGAATAG
```

This corresponds to the amino acid sequence <SEQ ID 1150; ORF 279.a>:

```
a279.pep
    1 MTXICGCLIS TVXRASASLS AAGFMRLQWE GTDTGSGRAR LAPASLAASI

   51 ARSTAAALPA ITTCPGELKL TASTTSSCAD SAQICFTCSS SKPRIAAIAP

  101 TPCGTADCIS SARXRTSLTA SAKSNAPAAT SAVYSPXLCP ATAAGVLPPA

  151 SE*
```

m279/a279 88.2% identity in 152 aa overlap

```
                      10        20        30        40        50        60
m279.pep      ITRICGCLISTVFRASASLSAAGFIRLQWEGTDTGSGRARLAPASLAAAMARPTAAALPA
              :| ||||||||| |||||||||||:|||||||||||||||||||||||::|| |||||||
a279          MTXICGCLISTVXRASASLSAAGFMRLQWEGTDTGSGRARLAPASLAASIARSTAAALPA
                      10        20        30        40        50        60

                      70        80        90       100       110       120
m279.pep      ITICPGELKLTASTTSLWAASAQMALTCSSSKPRIAAIAPTPCGTADCISSARRRTSLTA
              || |||||||||||||  | |||: :||||||||||||||||||||||||||| ||||||
a279          ITTCPGELKLTASTTSSCADSAQICFTCSSSKPRIAAIAPTPCGTADCISSARXRTSLTA
                      70        80        90       100       110       120

                     130       140       150
m279.pep      SAKFNAPAATSAVYSPRLCPATAAGVLPPASKX
              ||| |||||||||||| ||||||||||||||:|
a279          SAKSNAPAATSAVYSPXLCPATAAGVLPPASEX
                     130       140       150
```

Expression of ORF 279

The primer described in Table 1 for ORF 279 was used to locate and clone ORF 279. ORF 279 was cloned in pET and pGex vectors and expressed in *E. coli* as above-described. The products of protein expression and purification were analyzed by SDS-PAGE. FIG. 2A shows the results of affinity purification and FIG. 2B shows the expression in *E. coli*. Purified GST-fusion protein was used to immunize mice whose sera were used for ELISA (positive result), FACS analysis (FIG. 2C), western blot (FIG. 2D). These experiments confirm that 279 is a surface-exposed protein and that it is a useful immunogen. The hydrophilicity plots, antigenic index, and amphipatic regions of ORF 279 are provided in FIG. 6. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 279 and the amino acid sequence encoded thereby is provided herein.

The following partial DNA sequence was identified in *N. gonorrhoeae* <SEQ ID 1151>:

```
g280.seq
    1 atgaaacacc tcaaacttac ccttattgcc gcattgctgg ccaccgccgc

   51 aactgccgca ccccttccgg ttgtaaccag tttcagcatt ttaggcgacg

  101 tagccaaaca aatcggcggt gagcgcgtag ccgtacaaag cctcgtcgga

  151 gccaaccaag atactcatgc ctatcacatg accagtggcg acattaaaaa

  201 aatccgcagt gcaaaactcg tcctgctcaa cggcttggga cttgaagccg

  251 ccgacatcca acgcgccgtc aaacagagca aagtatccta tgccgaagcg

  301 accaaaggca tccaacccct caaagccgaa gaagaaggcg gacaccatca

  351 cgaccaccat cacgaccacg atcatgacca cgaaggacac caccacgacc

  401 acggcgaata tgacccccac gtctggaacg accctgttct tatgtccgac

  451 tatgcccaaa acgtcgctga aaccctgata aaggccgatc ccgaaggcaa

  501 agtttattat caacaacgct tgggcaacta ccaaatgcag cttaaaaaac

  551 tgcacagcga cgcacaagcc gcatttaatg ccgtccctgc cgccaaacgc

  601 aaagtcctga ccgggcacga cgcattttcc tacatgggca accgctacaa

  651 catcagcttc atcgccccgc aaggcgtgag cagcgaagcc gagccgtccg
```

-continued

```
701 ccaaacaagt cgccgccatc atccggcaaa tcaaacgcga aggcatcaaa

751 gccgtattta ccgaaaatat caaagacacc cgcatggttg accgcatcgc

801 caaagaaacc ggcgtcaacg tcagcggcaa actgtattcc gacgcactcg

851 gcaacgcgcc cgcagacacc tacatcggca tgtaccgcca caacgtcgaa

901 gccttgacca acgcgatgaa gcaataa
```

This corresponds to the amino acid sequence <SEQ ID 1152; ORF 280.ng>:

```
g280.pep
  1 MKHLKLTLIA ALLATAATAA PLPVVTSFSI LGDVAKQIGG ERVAVQSLVG

 51 ANQDTHAYHM TSGDIKKIRS AKLVLLNGLG LEAADIQRAV KQSKVSYAEA

101 TKGIQPLKAE EEGGHHHDHH HDHDHDHEGH HHDHGEYDPH VWNDPVLMSD

151 YAQNVAETLI KADPEGKVYY QQRLGNYQMQ LKKLHSDAQA AFNAVPAAKR

201 KVLTGHDAFS YMGNRYNISF IAPQGVSSEA EPSAKQVAAI IRQIKREGIK

251 AVFTENIKDT RMVDRIAKET GVNVSGKLYS DALGNAPADT YIGMYRHNVE

301 ALTNAMKQ*
```

The following partial DNA sequence was identified in *N. meningitidis* <SEQ ID 1153>:

```
m280.seq
  1 ATGAAACACC TCAAACTCAC CCTTATTGCC GCATTGCTGA CCGCCTCCGC

 51 AACTGCCGCC CCCCTGCCGG TTGTAACCAG CTTCAGCATT TTAGGCGACG

101 TAGCCAAACA AATCGGCGGA GAGCGCGTAT CCATACAAAG TTTGGTCGGA

151 GCCAACCAAG ATACGCACGC CTATCATATG ACCAGTGGCG ACATTAAAAA

201 AATCCGCAGT GCAAAACTCG TCCTGCTCAA CGGCTTAGGA CTTGAAGCTG

251 CCGATGTGCA ACGCGCCGTC AAACAAAGCA AAGTATCCTA TACCGAAGCG

301 ACCAAAGGCA TCCAACCCCT CAAAGCCGAA GAAGAAGGCG GACACCATCA

351 CGACCACGAT CATGACCACG AAGGACACCA CCATGACCAC GGCGAATATG

401 ACCCGCACGT CTGGAACGAC CCCGTCCTTA TGTCCGCCTA TGCCCAAAAC

451 GTTGCCAAAG CCCTGATAAA GGCCGATCCC GAAGGCAAAG TTTATTATCA

501 ACAACGCTTG GGCAACTACC AAATGCAGCT CAAAAAACTG CACAGCGACG

551 CACAAGCCGC ATTTAATGCC GTCCCTGCTG CCAAACGCAA AGTCCTGACC

601 GGGCACGATG CCTTTTCCTA TATGGGCAAA CGTTACCATA TCGAATTCAT

651 CGCCCCGCAA GGCGTGAGCA GCGAAGCCGA GCCTTCGGCC AAACAAGTCG

701 CCGCCATCAT CCGACAAATC AAACGCGAAG GCATCAAAGC CGTCTTTACC

751 GAAAACATCA AGGACACCCG TATGGTTGAC CGTATCGCCA AAGAAACCGG

801 TGTCAACGTC AGCGGCAAAC TGTATTCCGA CGCACTCGGC AACGCGCCCG

851 CAGACACCTA CATCGGAATG TACCGCCACA ACATCAAAGC CTTGACCAAC

901 GCGATGAAGC AATAA
```

This corresponds to the amino acid sequence <SEQ ID 1154; ORF 280>:

```
m280.pep
  1 MKHLKLTLIA ALLTASATAA PLPVVTSFSI LGDVAKQIGG ERVSIQSLVG

 51 ANQDTHAYHM TSGDIKKIRS AKLVLLNGLG LEAADVQRAV KQSKVSYTEA

101 TKGIQPLKAE EEGGHHHDHD HDHEGHHHDH GEYDPHVWND PVLMSAYAQN

151 VAKALIKADP EGKVYYQQRL GNYQMQLKKL HSDAQAAFNA VPAAKRKVLT

201 GHDAFSYMGK RYHIEFIAPQ GVSSEAEPSA KQVAAIIRQI KREGIKAVFT

251 ENIKDTRMVD RIAKETGVNV SGKLYSDALG NAPADTYIGM YRHNIKALTN

301 AMKQ*
```

Computer analysis of this amino acid sequence gave the following results:

Homology with a Predicted ORF from *N. gonorrhoeae*

ORF 280 shows 93.8% identity over a 308 aa overlap with a predicted ORF (ORF 280.ng) from *N. gonorrhoeae*:

```
m280/g280

                        10        20        30        40        50        60
m280.pep       MKHLKLTLIAALLTASATAAPLPVVTSFSILGDVAKQIGGERVSIQSLVGANQDTHAYHM
               |||||||||||||:::|||||||||||||||||||||||||||::|||||||||||||||
g280           MKHLKLTLIAALLATAATAAPLPVVTSFSILGDVAKQIGGERVAVQSLVGANQDTHAYHM
                        10        20        30        40        50        60

                        70        80        90       100       110      119
m280.pep       TSGDIKKIRSAKLVLLNGLGLEAADVQRAVKQSKVSYTEATKGIQPLKAEEEGGHHHDH-
               |||||||||||||||||||||||||:|||||||||||:||||||||||||||||||||| 
g280           TSGDIKKIRSAKLVLLNGLGLEAADIQRAVKQSKVSYAEATKGIQPLKAEEEGGHHHDHH
                        70        80        90       100       110       120

                120       130       140       150       160       170
m280.pep       ---DHDHEGHHHDHGEYDPHVWNDPVLMSAYAQNVAKALIKADPEGKVYYQQRLGNYQMQ
                  |||||||||||||||||||||||||| ||||||::||||||||||||||||||||||
g280           HDHDHDHEGHHHDHGEYDPHVWNDPVLMSDYAQNVAETLIKADPEGKVYYQQRLGNYQMQ
                       130       140       150       160       170       180

                180       190       200       210       220       230
m280.pep       LKKLHSDAQAAFNAVPAAKRKVLTGHDAFSYMGKRYHIEFIAPQGVSSEAEPSAKQVAAI
               |||||||||||||||||||||||||||||||||:||:| |||||||||||||||||||||
g280           LKKLHSDAQAAFNAVPAAKRKVLTGHDAFSYMGNRYNISFIAPQGVSSEAEPSAKQVAAI
                       190       200       210       220       230       240

                240       250       260       270       280       290
m280.pep       IRQIKREGIKAVFTENIKDTRMVDRIAKETGVNVSGKLYSDALGNAPADTYIGMYRHNIK
               ||||||||||||||||||||||||||||||||||||||||||||||||||||||||||::
g280           IRQIKREGIKAVFTENIKDTRMVDRIAKETGVNVSGKLYSDALGNAPADTYIGMYRHNVE
                       250       260       270       280       290       300

                300
m280.pep       ALTNAMKQX
               |||||||||
g280           ALTNAMKQX
```

The following partial DNA sequence was identified in *N. meningitidis* <SEQ ID 1155>:

```
a280.seq
  1 ATGAAACACC CCAAACTCAC CCTTATCGCC GCATTGCTGA CCACTGCCGC

 51 AACTGCCGCC CCCCTGCCGG TTGTAACCAG CTTCAGCATT TTAGGCGACG

101 TAGCCAAACA AATCGGCGGA GAGCGCGTAT CCATACAAAG TTTGGTCGGA

151 GCCAACCAAG ATACGCACGC CTATCATATG ACCAGCGGCG ACATTAAAAA

201 AATCCGCAGT GCAAAACTCG TCCTGATTAA CGGCTTAGGA CTTGAAGCTG
```

-continued

```
251 CCGACATCCA ACGTGCCGTC AAACAGAGCA AAGTATCCTA TGCCGAAGCG

301 ACCAAAGGCA TCCAACCCCT CAAAGCCGAA GAAGAAGGCG GACACCATCA

351 CGACCACGAT CATGACCACG ACCATGACCA CGAAGGACAC CACCACGACC

401 ACGGCGAATA TGACCCCCAC GTCTGGAACG ACCCCGTCCT TATGTCCGCC

451 TATGCCCAAA ACGTCGCCGA AGCCCTGATA AAGGCCGACC CCGAAGGCAA

501 AGTTTATTAT CAACAACGCT TGGGCAACTA CCAAATGCAG CTCAAAAAAC

551 TGCACAGTGA CGCACAAGCC GCATTTAATG CCGTCCCTGC CGCCAAACGC

601 AAAGTCCTGA CCGGGCACGA TGCCTTTTCC TATATGGGCA AACGTTACCA

651 TATCGAATTC ATCGCCCCAC AAGGTGTGAG CAGCGAAGCC GAGCCTTCAG

701 CCAAACAAGT CGCCGCCATC ATCCGACAAA TCAAACGCGA AGGCATCAAA

751 GCCGTATTTA CCGAAAATAT CAAAGACACC CGCATGGTTG ACCGCATCGC

801 CAAAGAAACC GGTGTCAACG TCAGCGGCAA ACTGTATTCC GACGCACTCG

851 GCAACGCACC CGCAGACACC TACATCGGCA TGTACCGCCA CAACATCAAA

901 GCCTTAACCA ACGCGATGAA GCAATAA
```

This corresponds to the amino acid sequence <SEQ ID 1156; ORF 280.a>:

```
a280.pep
  1 MKHPKLTLIA ALLTTAATAA PLPVVTSFSI LGDVAKQIGG ERVSIQSLVG

 51 ANQDTHAYHM TSGDIKKIRS AKLVLINGLG LEAADIQRAV KQSKVSYAEA

101 TKGIQPLKAE EEGGHHHDHD HDHDHDHEGH HHDHGEYDPH VWNDPVLMSA

151 YAQNVAEALI KADPEGKVYY QQRLGNYQMQ LKKLHSDAQA AFNAVPAAKR

201 KVLTGHDAFS YMGKRYHIEF IAPQGVSSEA EPSAKQVAAI IRQIKREGIK

251 AVFTENIKDT RMVDRIAKET GVNVSGKLYS DALGNAPADT YIGMYRHNIK

301 ALTNAMKQ*
```

m280/a280 96.4% identity in 308 aa overlap

```
                    10        20        30        40        50        60
m280.pep    MKHLKLTLIAALLTASATAAPLPVVTSFSILGDVAKQIGGERVSIQSLVGANQDTHAYHM
            ||| ||||||||::||||||||||||||||||||||||||||||||||||||||||||||
g280        MKHLKLTLIAALLATAATAAPLPVVTSFSILGDVAKQIGGERVAVQSLVGANQDTHAYHM
                    10        20        30        40        50        60

                    70        80        90       100       110       120
m280.pep    TSGDIKKIRSAKLVLLNGLGLEAADVQRAVKQSKVSYTEATKGIQPLKAEEEGGHHHDHD
            ||||||||||||||:|||||||||:||||||||||||:||||||||||||||||||||||
g280        TSGDIKKIRSAKLVLLNGLGLEAADIQRAVKQSKVSYAEATKGIQPLKAEEEGGHHHDHD
                    70        80        90       100       110       120

                       130       140       150       160       170
m280.pep    HDH----EGHHHDHGEYDPHVWNDPVLMSAYAQNVAKALIKADPEGKVYYQQRLGNYQMQ
            |||    |||||||||||||||||||||||||||:|||||||||||||||||||||||||
g280        HDHDHDHEGHHHDHGEYDPHVWNDPVLMSDYAQNVAETLIKADPEGKVYYQQRLGNYQMQ
                   130       140       150       160       170       180

             180       190       200       210       220       230
m280.pep    LKKLHSDAQAAFNAVPAAKRKVLTGHDAFSYMGKRYHIEFIAPQGVSSEAEPSAKQVAAI
            ||||||||||||||||||||||||||||||||||||||||||||||||||||||||||||
g280        LKKLHSDAQAAFNAVPAAKRKVLTGHDAFSYMGKRYHIEFIAPQGVSSEAEPSAKQVAAI
                   190       200       210       220       230       240
```

-continued

```
              240       250       260       270       280       290
m280.pep    IRQIKREGIKAVFTENIKDTRMVDRIAKETGVNVSGKLYSDALGNAPADTYIGMYRHNIK
            ||||||||||||||||||||||||||||||||||||||||||||||||||||||||||||
g280        IRQIKREGIKAVFTENIKDTRMVDRIAKETGVNVSGKLYSDALGNAPADTYIGMYRHNIK
                  250       260       270       280       290       300

              300
m280.pep    ALTNAMKQX
            |||||||||
g280        ALTNAMKQX
```

The following partial DNA sequence was identified in *N. gonorrhoeae* <SEQ ID 1157>:

```
g281.seq
    1 atgcactacg ccctcgcatc cgtcttctgc ctgtccctca gcgccgcacc

   51 cgtcggcgta ttcctcgtca tgcgccgtat gagcctgata ggcgacgcat

  101 tgagccacgc cgtcctgccc ggtgccgccg tcggctacat gtttgccggc

  151 ttgagcctgc ccgctatggg tgtgggcggg tttgccgccg gtatgctgat

  201 ggcgctgctt gccggactcg tcagccgctt taccaccctg aaagaagatg

  251 ccaactttgc cgccttttac ctgagcagcc tcgccatcgg cgtaatcctc

  301 atcagcaaaa acggcagcag cgtcgattta ctccacctcc ttttcggatc

  351 tgtgcttgcc gtcgatattc ccgcactgca actcatcgcc gccgtctccg

  401 gcctcacgct cattaccctt gccgtcatct accgcccccct ggtgctagaa

  451 agcatagacc cccttttcct caagtccgtc aacggcaaag gcgggctttg

  501 gcacgtcatt ttcctcatcc tcgtcgttat gaacctcgta tccggcttcc

  551 aagctctcgg catcctgatg tcggtcggaa ttatgatgct gcccgccatt

  601 accgcccgtt tatgggcaag aaatatgggg acgctcattc tgttgtccgt

  651 cctcatcgcc ctttttttgcg gtttgatcgg gctgctcatt tcctaccaca

  701 tcgaaatccc ttccggcccc gccatcatcc tctgttgcag cgtcctttat

  751 ctttttttccg tcatactcgg caaagaaggc ggcatcttgc ccaaatggtt

  801 caaaaaccac cgccaccaca ccacctga
```

This corresponds to the amino acid sequence <SEQ ID 1158; ORF 281.ng>:

```
g281.pep
    1 MHYALASVFC LSLSAAPVGV FLVMRRMSLI GDALSHAVLP GAAVGYMFAG

   51 LSLPAMGVGG FAAGMLMALL AGLVSRFTTL KEDANFAAFY LSSLAIGVIL

  101 ISKNGSSVDL LHLLFGSVLA VDIPALQLIA AVSGLTLITL AVIYRPLVLE

  151 SIDPLFLKSV NGKGGLWHVI FLILVVMNLV SGFQALGILM SVGIMMLPAI

  201 TARLWARNMG TLILLSVLIA LFCGLIGLLI SYHIEIPSGP AIILCCSVLY

  251 LFSVILGKEG GILPKWFKNH RHHTT*
```

The following partial DNA sequence was identified in *N. meningitidis* <SEQ ID 1159>:

```
m281.seq (partial)
    1 ATGCGCTACG CCCTCGCATC CGTCTTCTGC CTGTCCCTCA GTGCCGCACC

   51 CGTCGGCGTA TTCCTCGTCA TGCGCCGTAT GAGCCTGATA GGCGACGCAT
```

-continued

```
101 TGAGCCACGC CGTCCTGCCC GGTGCCGCCG TCGGCTACAT GTTTGCCGGC

151 TTGAGCCTGC CCGCCATGGG TTTGGGCGGC GTAGCCGCAG GCATGCTGAT

201 GGCACTGCTT GCCGGACTCG TCAGCCGCTT CACCACCCTG AAAGAAGATG

251 CCAACTTTGC CGCCTTTTAT CTCAGCAGCC TCGCCATCGG CGTAGTCCTC

301 GTCAGCAAAA ACGGGAGCAG CGTCGATTTG CTCCACCTCC TTTTCGGCTC

351 TGTACTTGCC GTCGATATTC CTGCCCTGCA GCTCATCGCC GCCGTCTCCA

401 GCCTCACGCT CATTACCCTT GCCGTCATCT ACCGCCCGCT CGTACTCGAA

451 AGCATCGACC CCCTGTTTCT CAAATCCGTC GGCGGCAAAG GCGGGCTTTG

501 GCACGTCCTC TTTCTCGTCC TGGTCGTCAT GAACCTCGTA TCCGGCTTTC

551 AAGCCCTCGG CACACTCATG TCCGTCGGAC TCATGATGCT GCCAGCCATT

601 ACCGCCCGCC TGTGGGCGAA GCATATGGGC GCACTCATCC TCCTATCCGT

651 TCTGACAGCC CTGCTGTGCG GCTTGAGCGG ACTGCTCATT TCCTACCACA

701 TCGAAATTCC TTCCGGTCCC GCCATCATCC TCTGTTGCAG CGTCCTTTAT

751 CTCTTTTCCG TCATACTCGG CAAAGAAGGC GGCATTCTGA CC..
```

This corresponds to the amino acid sequence <SEQ ID 1160; ORF 281>:

```
m281.pep (partial)
    1 MRYALASVFC LSLSAAPVGV FLVMRRMSLI GDALSHAVLP GAAVGYMFAG

   51 LSLPAMGLGG VAAGMLMALL AGLVSRFTTL KEDANFAAFY LSSLAIGVVL

  101 VSKNGSSVDL LHLLFGSVLA VDIPALQLIA AVSSLTLITL AVIYRPLVLE

  151 SIDPLFLKSV GGKGGLWHVL FLVLVVMNLV SGFCALGILM SVGLMMLPAI

  201 TARLWAKHMG ALILLSVLTA LLCGLSGLLI SYHIEIPSGP AIILCCSVLY

  251 LFSVILGKEG GILT . . .
```

Computer analysis of this amino acid sequence gave the following results:

Homology with a Predicted ORF from *N. gonorrhoeae*

ORF 281 shows 93.5% identity over a 263 aa overlap with a predicted ORF (ORF 281.ng) from *N. gonorrhoeae*:

```
m281/g281

                      10        20        30        40        50        60
m281.pep      MRYALASVFCLSLSAAPVGVFLVMRRMSLIGDALSHAVLPGAAVGYMFAGLSLPAMGLGG
              |:|||||||||||||||||||||||||||||||||||||||||||||||||||||||:||
g281          MHYALASVFCLSLSAAPVGVFLVMRRMSLIGDALSHAVLPGAAVGYMFAGLSLPAMGVGG
                      10        20        30        40        50        60

                      70        80        90       100       110       120
m281.pep      VAAGMLMALLAGLVSRFTTLKEDANFAAFYLSSLAIGVVLVSKNGSSVDLLHLLFGSVLA
               |||||||||||||||||||||||||||||||||||||:|:|||||||||||||||||||
g281          FAAGMLMALLAGLVSRFTTLKEDANFAAFYLSSLAIGVILISKNGSSVDLLHLLFGSVLA
                      70        80        90       100       110       120

                     130       140       150       160       170       180
m281.pep      VDIPALQLIAAVSSLTLITLAVIYRPLVLESIDPLFLKSVGGKGGLWHVLFLVLVVMNLV
              |||||||||||||:||||||||||||||||||||||||||:||||||||:||:|||||||
g281          VDIPALQLIAAVSGLTLITLAVIYRPLVLESIDPLFLKSVNGKGGLWHVIFLILVVMNLV
                     130       140       150       160       170       180

                     190       200       210       220       230       240
m281.pep      SGFQALGTLMSVGLMMLPAITARLWAKHMGALILLSVLTALLCGLSGLLISYHIEIPSGP
              ||||||| |||||:||||||||||||::||:||||||| ||:||| ||||||||||||||
g281          SGFQALGILMSVGIMMLPAITARLWARNMGTLILLSVLIALFCGLIGLLISYHIEIPSGP
                     190       200       210       220       230       240
```

-continued

```
                 250       260
m281.pep   AIILCCSVLYLFSVILGKEGGILT
           |||||||||||||||||||||||
g281       AIILCCSVLYLFSVILGKEGGILPKWFKNHRHHTTX
                 250       260       270
```

The following partial DNA sequence was identified in *N. meningitidis* <SEQ ID 1161>:

```
a281.seq
    1 ATGCGCTACG CCCTCGCATC CGTCTTCTGC CTGTCCCTCA GTGCCGCACC

   51 CGTCGGCGTA TTCCTCGTCA TGCGCCGTAT GAGCCTGATA GGCGACGCAT

  101 TGAGCCACGC CGTCCTGCCC GGTGCCGCCG TCGGCTACAT GTTTGCCGGC

  151 TTAAGCCTGC CCGCCATGGG TTTGGGCGGC GTAGCCGCAG GTATGCTGAT

  201 GGCACTGCTT GCCGGACTCG TCAGCCGCTT CACCACCCTG AAAGAAGATG

  251 CCAACTTTGC CGCCTTTTAT CTCAGCAGCC TCGCCATCGG TGTAGTCCTC

  301 GTCAGCAAAA ACGGCAGCAG CGTCGATTTG CTCCACCTCC TTTTCGGCTC

  351 CGTACTTGCC GTCGATATTC CTGCCCTGCA ACTCATCGCC GCCGTATCCA

  401 CCCTCACACT GCTTACCCTT GCCGTCATCT ACCGCCCGCT CGTACTCGAA

  451 AGCATCGACC CCCTGTTTCT CAAATCTGTC GGCGGCAAAG GCGGGCTTTG

  501 GCACGTCCTC TTTCTCGTCC TGGTCGTCAT GAACCTCGTA TCCGGCTTTC

  551 AAGCCCTCGG CACACTCATG TCCGTCGGAC TTATGATGCT GCCAGCCATT

  601 ACCGCCCGCC TATGGGCGAA GCACATGGGC GCACTCATCC TCCTATCCGT

  651 TCTGACAGCC CTGCTGTGCG GCTTGAGCGG ACTGCTCATT TCCTACCACA

  701 TCGAAATTCC TTCCGGTCCC GCCATCATCC TCTGTTGCAG CGTCCTTTAT

  751 CTCTTTTCCG TCATACTCGG CAAAGAAGGC GGCATTCTGA CCAAATGGCT

  801 CAAAAACCAC CGCCACCACA CCACCTGA
```

This corresponds to the amino acid sequence <SEQ ID 1162; ORF 281.a>:

```
a281.pep
    1 MRYALASVFC LSLSAAPVGV FLVMRRMSLI GDALSHAVLP GAAVGYMFAG

   51 LSLPAMGLGG VAAGMLMALL AGLVSRFTTL KEDANFAAFY LSSLAIGVVL

  101 VSKNGSSVDL LHLLFGSVLA VDIPALQLIA AVSTLTLLTL AVIYRPLVLE

  151 SIDPLFLKSV GGKGGLWHVL FLVLVVMNLV SGFQALGTLM SVGLMMLPAI

  201 TARLWAKHMG ALILLSVLTA LLCGLSGLLI SYHIEIPSGP AIILCCSVLY

  251 LFSVILGKEG GILTKWLKNH RHHTT*
```

m281/a281 99.2% identity in 264 aa overlap

```
                   10        20        30        40        50        60
m281.pep   MRYALASVFCLSLSAAPVGVFLVMRRMSLIGDALSHAVLPGAAVGYMFAGLSLPAMGLGG
           ||||||||||||||||||||||||||||||||||||||||||||||||||||||||||||
a281       MRYALASVFCLSLSAAPVGVFLVMRRMSLIGDALSHAVLPGAAVGYMFAGLSLPAMGVGG
                   10        20        30        40        50        60

                   70        80        90       100       110       120
m281.pep   VAAGMLMALLAGLVSRFTTLKEDANFAAFYLSSLAIGVVLVSKNGSSVDLLHLLFGSVLA
           ||||||||||||||||||||||||||||||||||||||||||||||||||||||||||||
a281       VAAGMLMALLAGLVSRFTTLKEDANFAAFYLSSLAIGVVLVSKNGSSVDLLHLLFGSVLA
                   70        80        90       100       110       120
```

-continued

```
                130         140         150         160         170         180
m281.pep    VDIPALQLIAAVSSLTLITLAVIYRPLVLESIDPLFLKSVGGKGGLWHVLFLVLVVMNLV
            |||||||||||||:|||:||||||||||||||||||||||||||||||||||||||||||
a281        VDIPALQLIAAVSTLTLLTLAVIYRPLVLESIDPLFLKSVGGKGGLWHVLFLVLVVMNLV
                130         140         150         160         170         180

                190         200         210         220         230         240
m281.pep    SGFQALGTLMSVGLMMLPAITARLWAKHMGALILLSVLTALLCGLSGLLISYHIEIPSGP
            ||||||||||||||||||||||||||||||||||||||||||||||||||||||||||||
a281        SGFQALGTLMSVGLMMLPAITARLWAKHMGALILLSVLTALLCGLSGLLISYHIEIPSGP
                190         200         210         220         230         240

                250         260
m281.pep    AIILCCSVLYLFSVILGKEGGILT
            ||||||||||||||||||||||||
a281        AIILCCSVLYLFSVILGKEGGILTKWLKNHRHHTTX
                250         260         270
```

The following partial DNA sequence was identified in *N. gonorrhoeae* <SEQ ID 1163>:

```
g282.seq
    1 atgggattgg gtatggaaat cggcaagctg attgtggctc ttttggtgct

   51 gatcaatccg tttagcgcgt tgtcgcttta ccttgacctg accaacggac

  101 acagcacgaa ggagcgcagg aaggtcgcgc ggacggccgc cgtcgccgtg

  151 tttgccgtga ttgcggtatt tgcgctgatc ggcggtgcgc tattgaaggt

  201 tttgggcatc agcgtcggtt cgtttcaggt cggcggcggg attttggtgc

  251 tgctgatcgc catttcgatg atgaacggca acgacaatcc cgccaagcag

  301 aatctcggcg cgcagccgga aacggggcaa gcgcgccccg cccgcaatgc

  351 aggggcgatt gccgtcgtgc ccatcgccat accgatcacc atcggtccgg

  401 gcggtatttc gactgtgatt atttatgctt cggcagccaa aacgtacagc

  451 gatatcgcgc tgattatcgc ggccggtttg gtggtcagtg cgatttgtta

  501 tgccatttta atcgttgccg ggaaggtcag ccgcctgctg ggcgcgacgg

  551 ggctgacgat tttaaaccgc attatgggta tgatgctggc ggcggtatcg

  601 gtggagatta ttgtgtcggg actgaaaacg atattcccgc aactggcagg

  651 ttga
```

This corresponds to the amino acid sequence <SEQ ID 1164; ORF 282.ng>:

```
g282.pep
    1 MGLGMEIGKL IVALLVLINP FSALSLYLDL TNGHSTKERR KVARTAAVAV

   51 FAVIAVFALI GGALLKVLGI SVGSFQVGGG ILVLLIAISM MNGNDNPAKQ

  101 NLGAQPETGQ ARPARNAGAI AVVPIAIPIT IGPGGISTVI IYASAAKTYS

  151 DIALIIAAGL VVSAICYAIL IVAGKVSRLL GATGLTILNR IMGMMLAAVS

  201 VEIIVSGLKT IFPQLAG*
```

The following partial DNA sequence was identified in *N. meningitidis* <SEQ ID 1165>:

```
m282.seq
    1 ATGGGATTGG GCATGGAAAT CGGCAAGCTG ATTGTGGCTT TTTTGGTGCT

   51 GATTAATCCG TTTAGCGCGT TGTCGCTTTA CCTTGACCTG ACCAACGGGC

  101 ACAGCACGAA GGAGCGCAGG AAGGTCGCGC GGACGGCCGC CGTTGCCGTG
```

-continued

```
151 TTTGCCGTGA TTGCGGTATT TGCGCTGATC GGCGGTACGC TGCTGAAGGT

201 TTTGGGCATC AGCGTCGGTT CGTTTCAGGT CGGCGGCGGG ATTTTGGTGC

251 TGCTGATCGC CATTTCGATG ATGAACGGCA ACGACAATCC CGCCAAGCAG

301 AATCTCGGCG CGCAGCCGGA AACGGGGCAG GCGCGCCCCG CCCGCAATGC

351 CGGAGCGATT GCCGTCGTGC CCATCGCCAT ACCGATCACC ATCGGCCCGG

401 GCGGTATTTC GACCGTGATT ATTTACGCTT CGGCGGCTAA AACATACGGC

451 GACATCGCGT TGATTATCGC GGCCGGTTTG GTGGTCAGTG CGATTTGTTA

501 TGCCATTTTA ATCGTTGCCG GGAAGGTCAG CCGCCTGCTG GGCGCGACGG

551 GGCTGACGAT TTTAAACCGC ATTATGGGTA TGATGCTGGC GGCGGTATCG

601 GTGGAGATTA TTGTGTCGGG ACTGAAAACG ATATTCCCGC AACTGGCAGG

651 TTGA
```

This corresponds to the amino acid sequence <SEQ ID 1166; ORF 282.ng>:

```
m282.pep
  1 MGLGMEIGKL IVAFLVLINP FSALSLYLDL TNGHSTKERR KVARTAAVAV

 51 FAVIAVFALI GGTLLKVLGI SVGSFQVGGG ILVLLIAISM MNGNDNPAKQ

101 NLGAQPETGQ ARPARNAGAI AVVPIAIPIT IGPGGISTVI IYASAAKTYG

151 DIALIIAAGL VVSAICYAIL IVAGKVSRLL GATGLTILNR IMGMMLAAVS

201 VEIIVSGLKT IFPQLAG*
```

Computer analysis of this amino acid sequence gave the following results:

Homology with a Predicted ORF from *N. gonorrhoeae*

ORF 282 shows 98.6% identity over a 217 aa overlap with a predicted ORF (ORF 282.ng) from *N. gonorrhoeae*:

```
m282/g282

                   10        20        30        40        50        60
m282.pep   MGLGMEIGKLIVAFLVLINPFSALSLYLDLTNGHSTKERRKVARTAAVAVFAVIAVFALI
           ||||||||||||:|||||||||||||||||||||||||||||||||||||||||||||||
g282       MGLGMEIGKLIVALLVLINPFSALSLYLDLTNGHSTKERRKVARTAAVAVFAVIAVFALI
                   10        20        30        40        50        60

                   70        80        90       100       110       120
m282.pep   GGTLLKVLGISVGSFQVGGGILVLLIAISMMNGNDNPAKQNLGAQPETGQARPARNAGAI
           ||:|||||||||||||||||||||||||||||||||||||||||||||||||||||||||
g282       GGALLKVLGISVGSFQVGGGILVLLIAISMMNGNDNPAKQNLGAQPETGQARPARNAGAI
                   70        80        90       100       110       120

                  130       140       150       160       170       180
m282.pep   AVVPIAIPITIGPGGISTVIIYASAAKTYGDIALIIAAGLVVSAICYAILIVAGKVSRLL
           |||||||||||||||||||||||||||||:||||||||||||||||||||||||||||||
g282       AVVPIAIPITIGPGGISTVIIYASAAKTYSDIALIIAAGLVVSAICYAILIVAGKVSRLL
                  130       140       150       160       170       180

                  190       200       210
m282.pep   GATGLTILNRIMGMMLAAVSVEIIVSGLKTIFPQLAGX
           ||||||||||||||||||||||||||||||||||||||
g282       GATGLTILNRIMGMMLAAVSVEIIVSGLKTIFPQLAGX
                  190       200       210
```

The following partial DNA sequence was identified in *N. meningitidis* <SEQ ID 1167>:

```
a282.seq
  1 ATGGGATTGG GCATGGAAAT CGGCAAGCTG ATTGTGGCTT TTTTGGTGCT

 51 GATTAATCCG TTTAGCGCGT TGTCGCTTTA CCTTGACCTG ACCAACGGGC
```

-continued

```
101 ACAGCACGAA GGAGCGCAGG AAGGTCGCGC GGACGGCCGC CGTTGCCGTG

151 TTTGCCGTGA TTGCGGTATT TGCGCTGATC GGCGGTACGC TGCTGAAGGT

201 TTTGGGCATC AGCGTCGGTT CGTTTCAGGT CGGCGGCGGA ATTTTGGTGT

251 TGCTGATTGC CATTTCGATG ATGAACGGCA ACGACAATCC CGCCAAGCAG

301 AATCTCGGCG CGCAGCCGGA AACGGGGCAG GTGCGCCCCG CCCGCAATGC

351 CGGAGCGATT GCCGTCGTGC CCATCGCCAT ACCGATCACC ATCGGCCCGG

401 GCGGTATTTC GACCGTGATT ATTTACGCTT CGGCGGCTAA AACATACGGC

451 GACATCGCGT TGATTATCGC GGCCGGTTTG GTGGTCAGTG CGATTTGTTA

501 TGCCATTTTA ATCGTTGCCG GGAAGGTCAG CCGCCTGCTG GGTGCGACGG

551 GGCTGACGAT TTTAAACCGT ATCATGGGTA TGATGCTGGC GGCGGTATCG

601 GTGGAGATTA TTGTGTCGGG ACTGAAAATG ATATTCCCGC AACTGGCAGG

651 TTGA
```

This corresponds to the amino acid sequence <SEQ ID 1168; ORF 282.a>:

```
a282.pep
    1 MGLGMEIGKL IVAFLVLINP FSALSLYLDL TNGHSTKERR KVARTAAVAV

   51 FAVIAVFALI GGTLLKVLGI SVGSFQVGGG ILVLLIAISM MNGNDNPAKQ

  101 NLGAQPETGQ VRPARNAGAI AVVPIAIPIT IGPGGISTVI IYASAAKTYG

  151 DIALIIAAGL VVSAICYAIL IVAGKVSRLL GATGLTILNR IMGMMLAAVS

  201 VEIIVSGLKM IFPQLAG*
```

m282/a282 99.1% identity in 217 aa overlap

```
                     10        20        30        40        50        60
m282.pep    MGLGMEIGKLIVAFLVLINPFSALSLYLDLTNGHSTKERRKVARTAAVAVFAVIAVFALI
            ||||||||||||||||||||||||||||||||||||||||||||||||||||||||||||
a282        MGLGMEIGKLIVAFLVLINPFSALSLYLDLTNGHSTKERRKVARTAAVAVFAVIAVFALI
                     10        20        30        40        50        60

                     70        80        90       100       110       120
m282.pep    GGTLLKVLGISVGSFQVGGGILVLLIAISMMNGNDNPAKQNLGAQPETGQARPARNAGAI
            ||||||||||||||||||||||||||||||||||||||||||||||||||:|||||||||
a282        GGTLLKVLGISVGSFQVGGGILVLLIAISMMNGNDNPAKQNLGAQPETGQVRPARNAGAI
                     70        80        90       100       110       120

                    130       140       150       160       170       180
m282.pep    AVVPIAIPITIGPGGISTVIIYASAAKTYGDIALIIAAGLVVSAICYAILIVAGKVSRLL
            ||||||||||||||||||||||||||||||||||||||||||||||||||||||||||||
a282        AVVPIAIPITIGPGGISTVIIYASAAKTYGDIALIIAAGLVVSAICYAILIVAGKVSRLL
                    130       140       150       160       170       180

                    190       200       210
m282.pep    GATGLTILNRIMGMMLAAVSVEIIVSGLKTIFPQLAGX
            |||||||||||||||||||||||||||| ||||||||
a282        GATGLTILNRIMGMMLAAVSVEIIVSGLKMIFPQLAGX
                    190       200       210
```

The following partial DNA sequence was identified in *N. gonorrhoeae* <SEQ ID 1169>:

```
g283.seq
    1 atgaactttg ctttatccgt catcacattt accctcgcct ctttcctgcc

   51 cgtcccgcct gccggaaccg ccgtctttac ttggaaagac ggcggcggca

  101 acagctattc ggatgtgccg aaacagcttc atcccgacca gagccaaatc

  151 ctcaacctgc ggacgctcca aaccaaaccg gcggtcaagc ccaaacctgc
```

-continued

```
201 cgtcgatacg aatgcggaca gtgcgaagga aaacgaaaag gatatcgccg

251 agaaaaacgg gcagcttgag gaagaaaaga aaaaaattgc cgaaaccgaa

301 cggcagaaca aagaagaaaa ctgccggatt tcaaaaatga acctgaaggc

351 ggtgggaaac tcaaatgcga aaaacaagga tgatttgatc cgtaaataca

401 ataacgccgt aaacaaatac tgccgttaa
```

This corresponds to the amino acid sequence <SEQ ID 1170; ORF 283.ng>:

```
g283.pep
    1 MNFALSVITF TLASFLPVPP AGTAVFTWKD GGGNSYSDVP KQLHPDQSQI

   51 LNLRTLQTKP AVKPKPAVDT NADSAKENEK DIAEKNGQLE EEKKKIAETE

  101 RQNKEENCRI SKMNLKAVGN SNAKNKDDLI RKYNNAVNKY CR*
```

The following partial DNA sequence was identified in *N. meningitidis* <SEQ ID 1171>:

```
m283.seq
    1 ATGAACTTTG CTTTATCCGT CATTATGTTG ACCCTCGCCT CTTTCCTGCC

   51 CGTCCCGCCT GCCGGAGCCG CCGTCTTTAC TTGGAAGGAC GGCGGCGGCA

  101 ACAGCTATTC GGATGTACCG AAACAGCTTC ATCCCGACCA AAGCCAAATC

  151 TTAAACCTGC GGACGCGCCA AACCAAACCG GCGGTCAAAC CCGCCCAAGC

  201 CGACGCAGGG AAGCGCACAG ACGGCGCGGC ACAGGAAAAC AATCCCGACA

  251 CTGCCGAGAA AAACCGGCAG CTTGAGGAAG AAAAGAAAAG AATTGCCGAA

  301 ACCGAACGGC AGAACAAAGA AGAAAACTGC CGGATTTCAA AAATGAACCT

  351 GAAGGCGGTG GGAAATTCAA ATGCAAAAAA CAAGGATGAT TTGATTCGGA

  401 AATACAATAA CGCCGTAAAC AAATACTGCC GTTAA
```

This corresponds to the amino acid sequence <SEQ ID 1172; ORF 283>:

```
m283.pep
    1 MNFALSVIML TLASFLPVPP AGAAVFTWKD GGGNSYSDVP KQLHPDQSQI

   51 LNLRTRQTKP AVKPAQADAG KRTDGAAQEN NPDTAEKNRQ LEEEKKRIAE

  101 TERQNKEENC RISKMNLKAV GNSNAKNKDD LIRKYNNAVN KYCR*
```

Computer analysis of this amino acid sequence gave the following results:

Homology with a Predicted ORF from *N. gonorrhoeae*

```
m283/g283 86.1% identity in 144 aa overlap

                        10        20        30        40        50        60
m283.pep       MNFALSVIMLTLASFLPVPPAGAAVFTWKDGGGNSYSDVPKQLHPDQSQILNLRTRQTKP
               |||||||| :||||||||||||:|||||||||||||||||||||||||||||||| ||||
g283           MNFALSVITFTLASFLPVPPAGTAVFTWKDGGGNSYSDVPKQLHPDQSQILNLRTLQTKP
                        10        20        30        40        50        60

                        70        80        90       100       110       120
m283.pep       AVKPAQADAGKRTDGAAQENNPDTAEKNRQLEEEKKRIAETERQNKEENCRISKMNLKAV
               ||||  | :   :| :|:||: | |||| |||||||:|||||||||||||||||||||||
g283           AVKPKPA-VDTNAD-SAKENEKDIAEKNGQLEEEKKKIAETERQNKEENCRISKMNLKAV
                         70         80        90       100       110
```

-continued

```
              130       140
m283.pep   GNSNAKNKDDLIRKYNNAVNKYCRX
           |||||||||||||||||||||||||
g283       GNSNAKNKDDLIRKYNNAVNKYCRX
         120       130       140
```

The following partial DNA sequence was identified in *N. meningitidis* <SEQ ID 1173>:

```
a283.seq
    1 ATGAACTTTG CTTTATCCGT CATTATGTTG ACCCTCGCCT CTTTCCTGCC

   51 CGTCCCGCCT GCCGGAGCCG CCGTCTTTAC TTGGAAGGAC GGCGGCGGCA

  101 ACAGCTATTC GGATGTACCG AAACAGCTTC ATCCCGACCA AAGCCAAATC

  151 TTAAACCTGC GGACGCGCCA AACCAAACCG GCGGTCAAAC CCGCCCAAGC

  201 CGACGCAGGG AAGCGCACAG ACGGCGCGGC ACAGGAAAAC AATCCCGACA

  251 CTGCCGAGAA AAACCGGCAG CTTGAGGAAG AAAAGAAAAG AATTGCCGAA

  301 ACCGAACGGC AGAACAAAGA AGAAAACTGC CGGATTTCAA AAATGAACCT

  351 GAAAGCGGTG GGAAATTCAA ATGCAAAAAA CAAGGATGAT TTGATTCGGA

  401 AATACAATAA CGCCGTAAAC AAATACTGCC GTTAA
```

This corresponds to the amino acid sequence <SEQ ID 1174; ORF 283.a>:

```
a283.pep

       1 MNFALSVIML TLASFLPVPP AGAAVFTWKD GGGNSYSDVP KQLHPDQSQI

      51 LNLRTRQTKP AVKPAQADAG KRTDGAAQEN NPDTAEKNRQ LEEEKKRIAE

     101 TERQNKEENC RISKMNLKAV GNSNAKNKDD LIRKYNNAVN KYCR*

m283/a283   100.0% identity in 144 aa overlap

                    10        20        30        40        50        60
m283.pep    MNFALSVIMLTLASFLPVPPAGAAVFTWKDGGGNSYSDVPKQLHPDQSQILNLRTRQTKP
            ||||||||||||||||||||||||||||||||||||||||||||||||||||||||||||
a283        MNFALSVIMLTLASFLPVPPAGAAVFTWKDGGGNSYSDVPKQLHPDQSQILNLRTRQTKP

                    10        20        30        40        50        60
                    70        80        90       100       110       120
m283.pep    AVKPAQADAGKRTDGAAQENNPDTAEKNRQLEEEKKRIAETERQNKEENCRISKMNLKAV
            ||||||||||||||||||||||||||||||||||||||||||||||||||||||||||||
a283        AVKPAQADAGKRTDGAAQENNPDTAEKNRQLEEEKKRIAETERQNKEENCRISKMNLKAV

                    70        80        90       100       110       120
                   130       140
m283.pep    GNSNAKNKDDLIRKYNNAVNKYCRX
            |||||||||||||||||||||||||
a283        GNSNAKNKDDLIRKYNNAVNKYCRX

                   130       140
```

The following partial DNA sequence was identified in *N. gonorrhoeae* <SEQ ID 1175>:

```
g284.seq.
    1 atgccgtctg aaactcgaaa tcggtttcag acggcattgg tttacgcggc

   51 aggttggggc ttagcggtct ttgtaacggc attcgctttt gcctgcaaaa

  101 gagtcgccgg ctttgcgttt gcctttgaag ccttcgccgg tttttttgaa

  151 actgtctttc ttaaagcctt ctttcttgaa accttcgccg cgcgttttgc

  201 cgccgaagcc ttctttgccc ggtttatgat cgccgcgccg gccgccggat
```

-continued

```
251 ttcctatcgc cccagccgcc tttgcctttc ggcttgccgc ctgcggattt

301 gcgtttgcgg gccggctcca tgccttcgat ggtcagttcg ggcagtttgc

351 ggttaatgta tttttcgatt ttgtggactt tgacgtattc gttcacttcg

401 gcaaacgtaa tcgcaatacc cgtgcggcct gcgcggccgg tgcgcccgat

451 gcggtggacg tagtcttccg cctgtttcgg caggtcgtag tttatgacgt

501 gggtaatggt cggtacgtca ataccgcgtg cggcaacgtc ggtggcaacc

551 aaaattttgc agcggccttt acgcaaatcc gtcagcgtgc ggttgcgcca

601 gccctgcggc atatcgccgt gcaggcagtt ggcggcgaaa ccttttttcgt

651 acaattcatc cgcgatgact tcggtcatcg ctttggtgga cgtgaaaatc

701 acacattggt cgatgttggc atcgcgcagg atgtggtcga gcaggcggtt

751 tttgtggcgc atatcgtcgc agtacaacaa ctgctcttcg attttgcctt

801 ggccgtccac gcgttcgact tcgataattt cagagtcttt ggtcagtttg

851 cgcgccagtt tgccgactgc gccgtcccaa gtggcggaga acaataa
```

This corresponds to the amino acid sequence <SEQ ID 1176; ORF 284.ng>:

```
g284.pep
  1 MPSETRNRFQ TALVYAAGWG LAVFVTAFAF ACKRVAGFAF AFEAFAGFFE

 51 TVFLKAFFLE TFAARFAAEA FFARFMIAAP AAGFPIAPAA FAFRLAACGF

101 AFAGRLHAFD GQFGQFAVNV FFDFVDFDVF VHFGKRNRNT RAACAAGAPD

151 AVDVVFRLFR QVVVYDVGNG RYVNTACGNV GGNQNFAAAF TQIRQRAVAP

201 ALRHIAVQAV GGETFFVQFI RDDFGHRFGG RENHTLVDVG IAQDVVEQAV

251 FVAHIVAVQQ LLFDFALAVH AFDFDNFRVF GQFARQFADC AVPSGGEQ*
```

The following partial DNA sequence was identified in *N. meningitidis* <SEQ ID 1177>:

```
m284.seq..
  1 ATGCCGTCTG AAACTCGAAA TCGGTTTCAG ACGGCATTGG TTTATGCGGC

 51 AGGTTGGGGC TTAGCGGTCT TTGTAACGGC GTTCGCCTTT GCCTGCAAAA

101 GAATCGCCGG CTTTGCGTTT GCCTTTGAAG CCTTCGCCGG TTTTTTTGAA

151 ACCGTCTCTC TTAAAGCCTT CTTTCTTGAA ACCTTCGCCG CGCGTTTTGC

201 CGCCGAAGCC TTCTTTGCTC GGTTTATGAT CGCCGCGCCA ACCGCCGGAT

251 TTACGATCGC CCCAGCCGCC TTTGCCTTTC GGCTTGCCGC CTGCGGATTT

301 GCGTTTGCGG GTCGGTTCCA TGCCTTCGAT GGTCAGTTCG GGCAGTTTTC

351 GGTTAATGTA TTTTTCGATT TTGTGGACTT TGACGTATTC GTTCACTTCG

401 GCAAACGTAA TCGCAATACC CGTGCGGCCT GCGCGGCCGG TGCGCCCGAT

451 GCGGTGGACG TAGTCTTCCG CCTGTTTCGG CAGGTCGTAG TTGATAACGT

501 GGGTAATGGT CGGTACGTCG ATACCGCGTG CGGCAACATC GGTGGCAACC

551 AAAATTTTGC AGCGGCCTTT ACGCAAATCC ATCAGCGTGC GGTTGCGCCA

601 GCCTTGCGGC ATATCGCCGT GCAGGCAGTT TGCGGCGAAA CCTTTTTCGT

651 ACAGTTCATC CGCAATGACT TCGGTCATGG CTTTGGTGGA CGTGAAAATC

701 ACGCATTGAT CGATATTGGC ATCGCGCAAG ATATGATCGA GCAGGCGGTT
```

-continued
```
 751 TTTGTGGCGC ATATCGTCGC AGTACAGCAG TTGTTCTTCG ATTTTGCCTT

 801 GATCGTCCAC GCGTTCGACT TCGATGATTT CAGGGTCTTT GGTCAGTTTG

 851 CGCGCCAGTT TGCCGACCGC GCCGTCCCAA GTGGCGGAGA ACAACAAAGT

 901 CTGACGGTCG CTCGGCGTTG CTTCCACGAT GGTTTCGATG TCGTCGATAA

 951 AGCCCATATC CAACATACGG TCGGCTTCGT CCAAAATCAG CACTTCCAAA

1001 CGTTCAAAAT CAACTTTGCC GCTTTGCATC AGGTCCATCA GACGGCCCGG

1051 CGTGGCGACA ATCAGATCGA CCGGTTTGCT CAGGGCACGG GTTTGGTAGC

1101 CGAAAGACGC GCCGCCGACG ATGCTGACGG TGCGGAACCA ACGCATATTT

1151 TTGGCATACG CCAGCGCGTT TTTCTCGACT TGAGCCGCCA GTTCGCGGGT

1201 CGGGGTCAAC ACCAAAGCAC GCGGGCCTTT GCCCGGTTTT TCGCTGCGTT

1251 TGGTCAGTTT TTGCAAAGTC GGTAA
```

This corresponds to the amino acid sequence <SEQ ID 1178; ORF 284>:

```
m284.pep
  1 MPSETRNRFQ TALVYAAGWG LAVFVTAFAF ACKRIAGFAF AFEAFAGFFE

 51 TVSLKAFFLE TFAARFAAEA FFARFMIAAP TAGFTIAPAA FAFRLAACGF

101 AFAGRFHAFD GQFGQFSVNV FFDFVDFDVF VHFGKRNRNT RAACAAGAPD

151 AVDVVFRLFR QVVVDNVGNG RYVDTACGNI GGNQNFAAAF TQIHQRAVAP

201 ALRHIAVQAV CGETFFVQFI RNDFGHGFGG RENHALIDIG IAQDMIEQAV

251 FVAHIVAVQQ LFFDFALIVH AFDFDDFRVF GQFARQFADR AVPSGGEQQS

301 LTVARRCFHD GFDVVDKAHI QHTVGFVQNQ HFQTFKINFA ALHQVHQTAR

351 RGDNQIDRFA QGTGLVAERR AADDADGAEP THIFGIRQRV FLDLSRQFAG

401 RGQHQSTRAF ARFFAAFGQF LQSR*
```

Computer analysis of this amino acid sequence gave the following results:
Homology with a Predicted ORF from *N. gonorrhoeae*

```
    m284/g284 92.3% identity in 298 aa overlap

                 10        20        30        40        50        60
    m284.pep MPSETRNRFQTALVYAAGWGLAVFVTAFAFACKRIAGFAFAFEAFAGFFETVSLKAFFLE
             ||||||||||||||||||||||||||||||||||:||||||||||||||||||| ||||
        g284 MPSETRNRFQTALVYAAGWGLAVFVTAFAFACKRVAGFAFAFEAFAGFFETVFLKAFFLE
                 10        20        30        40        50        60

                 70        80        90       100       110       120
    m284.pep TFAARFAAEAFFARFMIAAPTAGFTIAPAAFAFRLAACGFAFAGRFHAFDGQFGQFSVNV
             |||||||||||||||||||||:|||  |||||||||||||||||||:|||||||| |||
        g284 TFAARFAAEAFFARFMIAAPAAGFPIAPAAFAFRLAACGFAFAGRLHAFDGQFGQFAVNV
                 70        80        90       100       110       120

                130       140       150       160       170       180
    m284.pep FFDFVDFDVFVHFGKRNRNTRAACAAGAPDAVDVVFRLFRQVVVDNVGNGRYVDTACGNI
             ||||||||||||||||||||||||||||||||||||||||||:||||||:||||||||:
        g284 FFDFVDFDVFVHFGKRNRNTRAACAAGAPDAVDVVFRLFRQVVVYDVGNGRYVNTACGNV
                130       140       150       160       170       180

                190       200       210       220       230       240
    m284.pep GGNQNFAAAFTQIHQRAVAPALRHIAVQAVCGETFFVQFIRNDFGHGFGGRENHALIDIG
             |||||||||||||:||||||||||||||||||||||||||||:||||:||||||:|:|:|
        g284 GGNQNFAAAFTQIRQRAVAPALRHIAVQAVGGETFFVQFIRDDFGHRFGGRENHTLVDVG
                190       200       210       220       230       240

                250       260       270       280       290       300
    m284.pep IAQDMIEQAVFVAHIVAVQQLFFDFALIVHAFDFDDFRVFGQFARQFADRAVPSGGEQQS
             ||||::||||||||||||||:|||||||||||||||:||||||||||||:||||||||
        g284 IAQDVVEQAVFVAHIVAVQQLLFDFALAVHAFDFDNFRVFGQFARQFADCAVPSGGEQX
                250       260       270       280       290
```

-continued

```
                    310        320        330        340        350        360
m284.pep  LTVARRCFHDGFDVVDKAHIQHTVGFVQNQHFQTFKINFAALHQVHQTARRGDNQIDRFA
```

The following partial DNA sequence was identified in *N. meningitidis* <SEQ ID 1179>:

```
a284.seq
   1  ATGCCGTCTG AAACTCGAAA TCGGTTTCAG ACGGCATTGG TTTATGCGGC

  51  AGGTTGGGGC TTAGCGGTCT TTGTAACGGC GTTCGCCTTT GCCTGCAAAA

 101  GAATCGCCGG CTTTGCGTTT GCCTTTGAAG CCTTCGCCGG TTTTTTTGAA

 151  ACCGTCTCTC TTAAAGCCTT CTTTCTTGAA ACCTTCGCCG CGCGTTTTGC

 201  CGCCGAAGCC TTCTTTGCTC GGTTTATGAT CGCCGCGCCA ACCGCCGGAT

 251  TTACGATCGC CCCAGCCGCC TTTGCCTTTC GGCTTGCCGC CTGCGGATTT

 301  GCGTTTGCGG GTCGGTTCCA TGCCTTCGAT GGTCAGTTCG GGCAGTTTTC

 351  GGTTAATGTA TTTTTCGATT TTGTGGACTT TGACGTATTC GTTCACTTCG

 401  GCAAACGTAA TCGCAATACC CGTGCGGCCT GCGCGGCCGG TGCGCCCGAT

 451  GCGGTGGACG TAGTCTTCCG CCTGTTTCGG CAGGTCGTAG TTGATAACGT

 501  GGGTAATGGT CGGTACGTCG ATACCGCGTG CGGCAACGTC GGTGGCAACC

 551  AAAATTTTGC AGCGGCCTTT GCGCAAATCC ATCAGCGTGC GGTTGCGCCA

 601  GCCTTGCGGC ATATCGCCGT GCAGGCAGTT GGCGGCGAAA CCTTTTTCGT

 651  ACAATTCATC CGCGATGACT TCGGTCATGG CTTTGGTGGA CGTGAAAATC

 701  ACGCATTGAT CGATGTCGGC ATCGCGCAAG ATATGATCGA GCAGGCGGTT

 751  TTTGTGGCGC ATATCGTCGC AGTACAGCAG TTGTTCTTCG ATTTTGCCTT

 801  GGTCGTCCAC GCGTTCGACT TCGATGATTT CAGGGTCTTT GGTCAGTTTG

 851  CGCGCCAGTT TGCCGACCGC GCCGTCCCAA GTGGCGGAGA ACAACAAAGT

 901  CTGACGGTCT TCCGGCGTGG CTTCGACGAT GGTTTCGATG TCGTCGATAA

 951  AGCCCATATC CAACATACGG TCGGCTTCGT CCAAAATCAG CACTTCCAAG

1001  CGGGCGAAAT CGACTTTGCC GCTTTGCATC AAGTCCATCA GACGGCCCGG

1051  CGTGGCGACA ATCAGATCGA CCGGTTTGCT CAGGGCGCGG GTTTGGTAGC

1101  CGAACGATGC ACCACCGACG ATGCTGACGG TACGGAACCA ACGCATATTT

1151  TTGGCATACG CCAGCGCGTT TTTCTCGACT TGAGCCGCCA ATTCGCGGGT

1201  CGGCGTCAAC ACCAACGCGC GCGGGCCTTT GCCCGGTTTT TCGCTGCGTT

1251  TGGTCAGTCG CTGCAAAGTC GGTAA
```

This corresponds to the amino acid sequence <SEQ ID 1180; ORF 284.a>:

```
a284.pep
      1  MPSETRNRFQ TALVYAAGWG LAVFVTAFAF ACKRIAGFAF AFEAFAGFFE

     51  TVSLKAFFLE TFAARFAAEA FFARFMIAAP TAGFTIAPAA FAFRLAACGF

    101  AFAGRFHAFD GQFGQFSVNV FFDFVDFDVF VHFGKRNRNT RAACAAGAPD

    151  AVDVVFRLFR QVVVDNVGNG RYVDTACGNV GGNQNFAAAF AQIHQRAVAP

    201  ALRHIAVQAV GGETFFVQFI RDDFGHGFGG RENHALIDVG IAQDMIEQAV

    251  FVAHIVAVQQ LFFDFALVVH AFDFDDFRVF GQFARQFADR AVPSGGEQQS
```

-continued

```
301 LTVFRRGFDD GFDVVDKAHI QHTVGFVQNQ HFQAGEIDFA ALHQVHQTAR

351 RGDNQIDRFA QGAGLVAERC TTDDADGTEP THIFGIRQRV FLDLSRQFAG

401 RRQHQRARAF ARFFAAFGQS LQSR*
```

m284/a284 94.8% identity in 424 aa overlap

```
                      10        20        30        40        50        60
m284.pep    MPSETRNRFQTALVYAAGWGLAVFVTAFAFACKRIAGFAFAFEAFAGFFETVSLKAFFLE
            ||||||||||||||||||||||||||||||||||||||||||||||||||||||||||||
a284        MPSETRNRFQTALVYAAGWGLAVFVTAFAFACKRIAGFAFAFEAFAGFFETVSLKAFFLE
                      10        20        30        40        50        60

                      70        80        90       100       110       120
m284.pep    TFAARFAAEAFFARFMIAAPTAGFTIAPAAFAFRLAACGFAFAGRFHAFDGQFGQFSVNV
            ||||||||||||||||||||||||||||||||||||||||||||||||||||||||||||
a284        TFAARFAAEAFFARFMIAAPTAGFTIAPAAFAFRLAACGFAFAGRFHAFDGQFGQFSVNV
                      70        80        90       100       110       120

                     130       140       150       160       170       180
m284.pep    FFDFVDFDVFVHFGKRNRNTRAACAAGAPDAVDVVFRLFRQVVVDNVGNGRYVDTACGNI
            |||||||||||||||||||||||||||||||||||||||||||||||||||||||||||:
a284        FFDFVDFDVFVHFGKRNRNTRAACAAGAPDAVDVVFRLFRQVVVDNVGNGRYVDTACGNV
                     130       140       150       160       170       180

                     190       200       210       220       230       240
m284.pep    GGNQNFAAAFTQIHQRAVAPALRHIAVQAVCGETFFVQFIRNDFGHGFGGRENHALIDIG
            ||||||||||:||||||||||||||||||| ||||||||||:||||||||||||||||:|
a284        GGNQNFAAAFAQIHQRAVAPALRHIAVQAVGGETFFVQFIRDDFGHGFGGRENHALIDVG
                     190       200       210       220       230       240

                     250       260       270       280       290       300
m284.pep    IAQDMIEQAVFVAHIVAVQQLFFDFALIVHAFDFDDFRVFGQFARQFADRAVPSGGEQQS
            |||||||||||||||||||||||||||:||||||||||||||||||||||||||||||||
a284        IAQDMIEQAVFVAHIVAVQQLFFDFALVVHAFDFDDFRVFGQFARQFADRAVPSGGEQQS
                     250       260       270       280       290       300

                     310       320       330       340       350       360
m284.pep    LTVARRCFHDGFDVVDKAHIQHTVGFVQNQHFQTFKINFAALHQVHQTARRGDNQIDRFA
            ||| || | ||||||||||||||||||||||||: :|:||||||||||||||||||||||
a284        LTVFRRGFDDGFDVVDKAHIQHTVGFVQNQHFQAGEIDFAALHQVHQTARRGDNQIDRFA
                     310       320       330       340       350       360

                     370       380       390       400       410       420
m284.pep    QGTGLVAERRAADDADGAEPTHIFGIRQRVFLDLSRQFAGRGQHQSTRAFARFFAAFGQF
            ||:|||||| ::|||||:||||||||||||||||||||||| ||| :|||||||||||||
a284        QGAGLVAERCTTDDADGTEPTHIFGIRQRVFLDLSRQFAGRRQHQRARAFARFFAAFGQS
                     370       380       390       400       410       420

m284.pep    LQSRX
            |||||
a284        LQSRX
```

The following partial DNA sequence was identified in *N. gonorrhoeae* <SEQ ID 1181>:

```
g285.seq
  1 atgaccgata ccacaccgac agataccgat ccgaccgaaa acggcacgcg

 51 caaaatgccg tctgaacacc gccccgcccc gccggcaaaa aaacgccgcc

101 cgctgctgaa gctgtcggcg gcactgctgt ctgtcctgat tttggcagta

151 tgtttcctcg gctggatcgc cggtacggaa gcaggtttgc gcttcgggct

201 gtaccaaatc ccgtcctggt tcggcgtaaa catttcctcc caaaacctca

251 aaggcacact gctcgacggc ttcgacggcg acaactggtc gatagaaacc

301 gagggggcag accttaaaat cagccgcttc cgcttcgcgt ggaaaccgtc

351 cgaactgatg cgccgcagcc tgcacatcac cgacatctcc gccggcgaca

401 tcgccatcgt aaccaaaccg actccgccta aagaagaacg cccgcctcaa

451 ggcctgcccg acagcataga cctgcccgcc gctgtctatc tcgaccgctt
```

-continued 501 cgagacgggc aaaatcagca tgggcaaaac ctttgacaaa caaaccgtct 551 atctcgaacg cctcaacgcg gcataccgtt acgaccgtaa agggcaccgc 601 ctcgacctga aggccgccga cacgccgtgg agcagttcgt cggggtcagc 651 ctcggtcggc ttgaaaaaac cgtttgccct cgataccgcc atttacacca 701 aaggcggatt cgaaggcgaa accatacaca gtacggcgcg gctgagcggc 751 agcctgaagg atgtgcgcgc cgaactgacg atcgacggcg gcaatatccg 801 cctctcggga aaatccgtca tccacccgtt tgccgaatca ttggataaaa 851 cattggaaga agtactggtc aaaggattca acatcaatcc gtccgccttc 901 gtgccttccc tgcccgatgc cgggctgaat ttcgacctga ccgccatccc 951 gtcgttttca gacggcatcg cgctggaagg ctcgctcgat ttggaaaaca 1001 ccaaagccgg ctttgccgac cgcaacggca tccccgtccg tcaggttttg 1051 ggcggctttg tcatccggca ggacggcacg gtgcatatcg gcaatacgtc 1101 cgccgccctg ctcggacggg gcggcatcag gctgtcgggc aaaatcgaca 1151 ccgaaaaaga catccttgat ttaaatatag gcatcaactc cgtcggcgcg 1201 gaagacgtgc tgcaaaccgc gttcaaaggc aggttggacg gcagcatcgg 1251 catcggcggc acgaccgcct cgcccaaaat ctcttggcaa ctcggcaccg 1301 gcacggcacg cacggacggc agcctcccca tcgcaagcga ccccgcaaac 1351 gaacagcgga aactggtgtt cgacaccgtc aacatctccg ccggggaagg 1401 cagcctgacc gcgcaaggct atctcgagct gtttaaagac cgcctgctca 1451 agctggacat ccgttcccgc gcattcgacc cttcgcgcat cgatccgcaa 1501 tttccggcag gcaatatcaa cggttcgatt catcttgccg gtgaactggc 1551 aaaagagaaa tttacgggca aaatgcgttt tttgcccggt acgttcaacg 1601 gcgtgccgat tgccggcagc gccgacattg tttacgagtc ccgccacctt 1651 ccgcgcgccg ccgtcgattt gcggttgggg cggaacatcg tcaaaacaga 1701 cggcggcttc ggcaaaaaag gcgaccggct taacctcaat atcaccgcac 1751 ccgatttatc ccgtttcggt ttcggactcg cggggtcttt aaatgtacgc 1801 ggacaccttt ccggcgattt ggacggcggc atccgaacct ttgaaaccga 1851 cctttccggc acggcgcgca acttacacat cggcaaagcg gcagacatcc 1901 gttcgctcga ttttaccctc aaaggctcac ccggcacaag ccgcccgatg 1951 cgcgccgata tcaagggcgg ccgcctttcc ctgtcgggcg gcgcggcggt 2001 tgtcgatacc gccggcctga cgctggaagg tacgggcgcg cagcaccgca 2051 tccgcacaca cgccgccatg acgctggacg gcaaaccgtt caaactcgat 2101 ttggacgctt caggcggcat caacagggaa cttacccgat ggaaaggcag 2151 catcggcatc ctcgacatcg gcggcgcatt caacctcaag ctgcaaaacc 2201 gtatgacgct cgaagccggt gcggaacacg tggcggcaag tgcggcaaat 2251 tggcaggcaa tgggcggcag cctcaacctg caacactttt cttgggacag 2301 gaaaaccggc atatcggcaa aaggcggcgc acgcggcctg cacatcgccg 2351 agttgcacaa tttcttcaaa ccgcccttcg aacacaatct ggttttaaac 2401 ggcgactggg atgtcgccta cgggcacaac gcgcgcggct acctcaatat 2451 cagccggcaa agcggcgatg ccgtattgcc cggcgggcag gctttgggtt 2501 tgaacgcatt ttccctgaaa acgcgctttc aaaacgaccg catcggaatc -continued

```
2551 ctgcttgacg gcggcgcgcg tttcggacgg attaacgccg atttgggcat
2601 cggcaacgcc ttcggcggca atatggcaaa tacaccgctc ggcggcagga
2651 ttacagcctc ccttcccgac ttgggcgcat tgaagccctt tctgcccgcc
2701 gccgcgcaaa acattaccgg cagcctgaat gcctccgcgc aaatcggcgg
2751 acgggtaggc tctccgtccg tcaatgccgc cgtcaacggt agcagcaact
2801 acgggaaaat caacggcaat atcaccgtcg ggcaaagccg ctccttcgat
2851 accgcacctt tgggcggcag gctcaacctg accgttgccg atgccgaagc
2901 attccgcaac ttcctaccgg tcggacaaac cgtcaaaggc agcctgaatg
2951 ccgccgtaac cctcggcggc agcatcgccg acccgcactt gggcggcagt
3001 atcaacggcg acaagctcta ttaccgcaac caaacccaag gcatcatctt
3051 ggacaacggc tcgctgcgtt cgcatattgc aggcaggaaa tgggtaatcg
3101 acagcctgaa attccggcac gaagggacgg cggaactctc cggcacggtc
3151 agcatggaaa acagcgtgcc cgatgtcgat atcggcgcgg tgttcgacaa
3201 ataccgcatc ctgtcccgcc ccaaccgccg cctgacggtt tccggcaaca
3251 cccgcctgcg ctattcgccg caaaaaggca tatccgttac cggtatgatt
3301 aaaactgatc aggggctgtt cggttcgcaa aaatcctcga tgccgtccgt
3351 cggcgacgat gtcgtcgtat tgggcgaagt caagaaagag gcggcggcat
3401 cgctccccgt caatatgaac ctgactttag acctcaatga cggcatccgc
3451 ttctccggct acggcgcgga cgttaccata ggcggcaaac tgaccctgac
3501 cgcgcaaccg ggcggaaatg tgcgtggggt gggcacggtc cgcgtcatca
3551 aagggcgtta caaagcatac gggcaggatt tagacattac caaaggcaca
3601 gtctcctttg tcggcccgct caacgacccc aacctgaaca tccgcgccga
3651 acgccgcctt tcccccgtcg gtgcgggcgt ggaaatattg ggcagcctca
3701 acagcccgcg cattacgctg acggcaaacg aaccgatgag tgaaaaagac
3751 aagctctcct ggctcatcct caaccgtgcc ggcagcggca gcagcggcga
3801 caatgccgcc ctgtccgcag ccgcaggcgc gctgcttgcc gggcaaatca
3851 acgaccgcat cgggctggtg gatgatttgg gctttaccag caagcgcagc
3901 cgcaacgcgc aaaccggcga actcaacccc gccgaacagg tgctgaccgt
3951 cggcaaacaa ctgaccggca aactctacat cggctacgaa tacggcatct
4001 ccagcgcgga acagtccgtc aaactgattt accggctgac ccgcgccata
4051 caggcggttg cccgtatcgg cagccgttcg tcgggcggcg agctgacata
4101 caccatacgt ttcgaccgcc tcttcggttc ggacaaaaaa gactccgcag
4151 gaaacggcaa agggaaataa
```

This corresponds to the amino acid sequence <SEQ ID 1182; ORF 285.ng>:

```
g285.pep
  1 MTDTTPTDTD PTENGTRKMP SEHRPAPPAK KRRPLLKLSA ALLSVLILAV
 51 CFLGWIAGTE AGLRFGLYQI PSWFGVNISS QNLKGTLLDG FDGDNWSIET
101 EGADLKISRF RFAWKPSELM RRSLHITDIS AGDIAIVTKP TPPKEERPPQ
151 GLPDSIDLPA AVYLDRFETG KISMGKTFDK QTVYLERLNA AYRYDRKGHR
```

-continued

```
 201 LDLKAADTPW SSSSGSASVG LKKPFALDTA IYTKGGFEGE TIHSTARLSG

 251 SLKDVRAELT IDGGNIRLSG KSVIHPFAES LDKTLEEVLV KGFNINPSAF

 301 VPSLPDAGLN FDLTAIPSFS DGIALEGSLD LENTKAGFAD RNGIPVRQVL

 351 GGFVIRQDGT VHIGNTSAAL LGRGGIRLSG KIDTEKDILD LNIGINSVGA

 401 EDVLQTAFKG RLDGSIGIGG TTASPKISWQ LGTGTARTDG SLPIASDPAN

 451 EQRKLVFDTV NISAGEGSLT AQGYLELFKD RLLKLDIRSR AFDPSRIDPQ

 501 FPAGNINGSI HLAGELAKEK FTGKMRFLPG TFNGVPIAGS ADIVYESRHL

 551 PRAAVDLRLG RNIVKTDGGF GKKGDRLNLN ITAPDLSRFG FGLAGSLNVR

 601 GHLSGDLDGG IRTFETDLSG TARNLHIGKA ADIRSLDFTL KGSPGTSRPM

 651 RADIKGGRLS LSGGAAVVDT AGLTLEGTGA QHRIRTHAAM TLDGKPFKLD

 701 LDASGGINRE LTRWKGSIGI LDIGGAFNLK LQNRMTLEAG AEHVAASAAN

 751 WQAMGGSLNL QHFSWDRKTG ISAKGGARGL HIAELHNFFK PPFEHNLVLN

 801 GDWDVAYGHN ARGYLNISRQ SGDAVLPGGQ ALGLNAFSLK TRFQNDRIGI

 851 LLDGGARFGR INADLGIGNA FGGNMANTPL GGRITASLPD LGALKPFLPA

 901 AAQNITGSLN ASAQIGGRVG SPSVNAAVNG SSNYGKINGN ITVGQSRSFD

 951 TAPLGGRLNL TVADAEAFRN FLPVGQTVKG SLNAAVTLGG SIADPHLGGS

1001 INGDKLYYRN QTQGIILDNG SLRSHIAGRK WVIDSLKFRH EGTAELSGTV

1051 SMENSVPDVD IGAVFDKYRI LSRPNRRLTV SGNTRLRYSP QKGISVTGMI

1101 KTDQGLFGSQ KSSMPSVGDD VVVLGEVKKE AAASLPVNMN LTLDLNDGIR

1151 FSGYGADVTI GGKLTLTAQP GGNVRGVGTV RVIKGRYKAY GQDLDITKGT

1201 VSFVGPLNDP NLNIRAERRL SPVGAGVEIL GSLNSPRITL TANEPMSEKD

1251 KLSWLILNRA GSGSSGDNAA LSAAAGALLA GQINDRIGLV DDLGFTSKRS

1301 RNAQTGELNP AEQVLTVGKQ LTGKLYIGYE YGISSAEQSV KLIYRLTRAI

1351 QAVARIGSRS SGGELTYTIR FDRLFGSDKK DSAGNGKGK*
```

The following partial DNA sequence was identified in *N. meningitidis* <SEQ ID 1183>:

```
m285.seq
   1 ATGACCGATA CCGCACCGAC AGATACCGAT CCGACCGAAA ACGGCACGCG

  51 CAAAATGCCG TCTGAACACC GCCCTACCCC GCCGGCAAAA AAACGCCGCC

 101 CGTTGCTGAA GCTGTCGGCG GCACTGCTGT CTGTCCTGAT TTTGGCAGTA

 151 TGTTTCCTCG GCTGGCTCGC CGGTACGGAA GCAGGTTTGC GCTTCGGGCT

 201 GTACCAAATC CCGTCTTGGT TCGGCGTAAA CATTTCCTCC CAAAACCTCA

 251 AAGGCACGCT GCTCGACGGC TTCGACGGCG ACAACTGGTC GATAGAAACC

 301 GAGGGGGCAG ACCTTAAAAT CAGCCGCTTC CGCTTCGCGT GGAAACCGTC

 351 CGAACTGATG CGCCGCAGCC TGCACATTAC CGAAATTTCC GCCGGCGACA

 401 TCGCCATCGT TACCAAACCG ACTCCGCCTA AAGAAGAACG CCCGCCGCTC

 451 AGCCTTCCCG ACAGCATAGA CCTGCCTGCC GCCGTCTATC TCGACCGCTT

 501 CGAGACGGGC AAAATCAGCA TGGGCAAAGC CTTTGACAAA CAAACCGTCT

 551 ATCTCGAACG GCTGGATGCT TCATACCGTT ACGACCGCAA AGGACACCGC

 601 CTTGACCTGA AGGCCGCCGA CACGCCGTGG AGCAGTTCGT CGGGGGCGGC
```

-continued

```
 651 CTCGGTCGGC TTGAAAAAAC CGTTTGCCCT CGATACCGCC ATTTACACCA
 701 AAGGCGGACT CGAAGGCAAA ACCATACACA GTACGGCTCG GCTGAGCGGC
 751 AGCCTGAAGG ATGTGCGCGC CGAACTGGCG ATCGACGGCG GCAATATCCG
 801 CCTCTCGGGA AAATCCGTCA TCCACCCGTT TGCCGAATCA TTGGATAAAA
 851 CATTGGAAGA AGTACTGGTC AAAGGGTTCA ACATCAATCC GGCCGCCTTC
 901 GTGCCTTCCC TGCCCGATGC CGGACTGAAT TTCGACCTGA CCGCCATCCC
 951 GTCGTTTTCA GACGGCATCG CGCTGGAAGG TTCGCTCGAT TTGGAAAACA
1001 CCAAAGCCGG CTTTGCCGAC CGCAACGGCA TCCCCGTCCG TCAGGTTTTA
1051 GGCGGCTTTG TCATCCGGCA GGACGGCACG GTGCATATCG GCAATACGTC
1101 CGCCGCCCTG CTCGGACGGG GCGGCATCAG GCTGTCGGGC AAAATCGACA
1151 CCGAAAAAGA CATCCTCGAT TTAAATATAG GCATCAACTC CGTCGGCGCG
1201 GAAGACGTAC TGCAAACCGC GTTCAAAGGC AGGTTGGACG GCAGCATCGG
1251 CATCGGTGGC ACGACCGCCT CGCCCAAAAT CTCTTGGCAA CTCGGCATCG
1301 GCACGGCGCG CACGGACGGC AGCCTCGCCA TTGCAAGCGA CCCAGCAAAC
1351 GGACAGCGGA AACTGGTGCT CGACACCGTC AACATCGCCG CCGGGCAAGG
1401 CAGCCTGACC GCGCAAGGCT ATCTCGAGCT GTTTAAAGAC CGCCTGCTCA
1451 AGCTGGACAT CCGTTCCCGC GCATTCGACC CTTCGCGCAT CGATCCGCAA
1501 CTTCCGGCAG GCAATATCAA CGGCTCAATA AACCTTGCCG GCGAACTGGC
1551 AAAAGAGAAA TTCACAGGCA AAATGCGGTT TTTACCCGGC ACGTTCAACG
1601 GCGTACCGAT TGCCGGCAGT GCCGACATTG TTTACGAGTC CCGCCACCTT
1651 CCGCGTGCCG CCGTCGATTT GCGGCTGGGG CGGAACATTA TTAAAACAGA
1701 CGGCGGCTTC GGCAAAAAAG GCGACCGGCT TAACCTCAAT ATCACCGCAC
1751 CCGATTTATC CCGTTTCGGT TTCGGACTCG CGGGGTCTTT AAATGTACGC
1801 GGACACCTTT CCGGTGATTT GGACGGCGGC ATCCGAACCT TTGAAACCGA
1851 CCTTTCCGGC GCGGCGCGCA ACCTGCACAT CGGCAAGGCG GCAGACATCC
1901 GTTCGCTCGA TTTCACGCTC AAAGGTTCGC CCGACACAAG CCGCCCGATA
1951 CGCGCCGACA TCAAAGGCAG CCGCCTTTCG CTGTCGGGCG GAGCGGCGGT
2001 TGTCGATACC GCCGACCTGA TGCTGGACGG CACGGGCGTG CAGCACCGCA
2051 TCCGCACACA CGCCGCCATG ACGCTGGATG GCAAACCGTT CAAATTCGAT
2101 TTGGACGCTT CAGGCGGCAT CAACAGGGAA CTTACCCGAT GGAAAGGCAG
2151 CATCGGCATC CTCGACATCG GCGGCGCATT CAACCTCAAG CTGCAAAACC
2201 GTATGACGCT CGAAGCCGGT GCGGAACGCG TGGCGGCAAG TGCGGCAAAT
2251 TGGCAGGCAA TGGGCGGCAG CCTCAACCTG CAACACTTTT CTTGGGATAA
2301 AAAAACCGGC ATATCGGCAA AAGGCGGCGC ACACGGTCTG CATATCGCCG
2351 AGTTGCACAA TTTCTTCAAA CCGCCCTTCG AACACAATCT GGTTTTAAAC
2401 GGCGACTGGG ATGTCGCCTA CGGGCGCAAC GCGCGCGGCT ACCTCAATAT
2451 CAGCCGGCAA AGCGGCGATG CCGTATTGCC CGGCGGGCAG GCTTTGGGTT
2501 TGAACGCATT TTCCCTGAAA ACGCGCTTTC AAAACGACCG CATCGGAATC
2551 CTGCTTGACG GCGGCGCGCG TTTCGGGCGG ATTAACGCCG ATTTGGGCAT
2601 CGCCAACGCC TTCGGCGGCA ATATGGCAAA TGCACCGCTC GGCGGCAGGA
```

-continued

```
2651 TTACCGCCTC CCTTCCCGAC TTGGGCGCAT TGAAGCCCTT TCTGCCCGCC
2701 GCCGCGCAAA ACATTACCGG CAGCCTGAAT GCCGCCGCGC AAATCGGCGG
2751 ACGGGTAGGC TCTCCGTCCG TCAATGCCGC CGTCAACGGC AGCAGCAACT
2801 ACGGGAAAAT CAACGGCAAC ATCACCGTCG GGCAAAGCCG CTCTTTCGAT
2851 ACCGCGCCTT TGGGCGGCAG GCTCAACCTG ACCGTTGCCG ATGCCGAAGT
2901 ATTCCGCAAC TTCCTACCGG TCGGACAAAC CGTCAAAGGC AGCCTGAATG
2951 CCGCCGTAAC CCTCGGCGGC AGCATCGCCG ATCCGCACTT GGGCGGCAGC
3001 ATCAACGGCG ACAAACTCTA TTACCGCAAC CAAACCCAAG GCATCATCTT
3051 GGACAACGGC TCGCTGCGTT CGCATATCGC GGGCAGGAAA TGGGTAATCG
3101 ACAGCCTGAA ATTCCGGCAC GAAGGGACGG CGGAACTCTC CGGTACGGTC
3151 GGTATGGAAA ACAGCGGACC CGATGTCGAT ATCGGCGCGG TGTTCGACAA
3201 ATACCGCATC CTGTCCCGCC CCAACCGCCG CCTGACGGTT TCCGGCAACA
3251 CCCGCCTGCG CTATTCGCCG CAAAAAGGCA TATCCGTTAC CGGGATGATT
3301 AAAACGGATC AGGGGCTGTT CGGTTCGCAA AAATCCTCGA TGCCGTCCGT
3351 CGGCGACGAT GTCGTCGTAT TAGGCGAAGT CAAAAAAGAG GCGGCGGCAC
3401 CGCTCCCCGT CAATATGAAC CTGACTTTAG ACCTCAATGA CGGCATCCGC
3451 TTCGCCGGCT ACGGCGCGGA CGTTACCATA GGCGGCAAAC TGACCCTGAC
3501 CGCCCAATCG GGCGGAAGCG TACGGGGCGT GGGCACGGTC CGCGTCATCA
3551 AAGGGCGTTA TAAGGCATAC GGGCAGGATT TGGACATTAC CAAAGGCACG
3601 GTCTCCTTTG TCGGCCCGCT CAACGATCCC AACCTCAACA TCCGCGCCGA
3651 ACGCCGCCTT TCCCCCGTCG GTGCGGGCGT GGAAATATTG GGCAGCCTCA
3701 ACAGCCCGCG CATTACGCTG ACGGCAAACG AACCGATGAG TGAAAAAGAC
3751 AAGCTCTCTT GGCTCATCCT CAACCGCGCC GGCAGCGGCA GCAGCGGCGA
3801 CAATGCCGCC CTGTCTGCAG CCGCAGGTGC GCTGCTTGCC GGGCAAATCA
3851 ACGACCGCAT CGGGCTGGTG GATGATTTGG GCTTTACCAG CAAGCGCAGC
3901 CGCAACGCGC AAACCGGCGA ACTCAACCCC GCCGAACAGG TGCTGACCGT
3951 CGGCAAACAA CTGACCGGCA AACTCTACAT CGGCTACGAA TACAGCATCT
4001 CCAGCGCGGA ACAGTCCGTC AAACTGATTT ACCGGCTGAC CCGCGCCATA
4051 CAGGCGGTTG CCCGTATCGG CAGCCGTTCG TCGGGCGGCG AGCTGACATA
4101 CACCATACGT TTCGACCGCT TCTCCGGTTC GGACAAAAAA GACTCCGCCG
4151 GAAACGGCAA AGGAAAATAA
```

This corresponds to the amino acid sequence <SEQ ID 1184; ORF 285>:

```
m285.pep
  1 MTDTAPTDTD PTENGTRKMP SEHRPTPPAK KRRPLLKLSA ALLSVLILAV
 51 CFLGWLAGTE AGLRFGLYQI PSWFGVNISS QNLKGTLLDG FDGDNWSIET
101 EGADLKISRF RFAWKPSELM RRSLHITEIS AGDIAIVTKP TPPKEERPPL
151 SLPDSIDLPA AVYLDRFETG KISMGKAFDK QTVYLERLDA SYRYDRKGHR
201 LDLKAADTPW SSSSGAASVG LKKPFALDTA IYTKGGLEGK TIHSTARLSG
251 SLKDVRAELA IDGGNIRLSG KSVIHPFAES LDKTLEEVLV KGFNINPAAF
```

-continued

```
 301 VPSLPDAGLN FDLTAIPSFS DGIALEGSLD LENTKAGFAD RNGIPVRQVL

 351 GGFVIRQDGT VHIGNTSAAL LGRGGIRLSG KIDTEKDILD LNIGINSVGA

 401 EDVLQTAFKG RLDGSIGIGG TTASPKISWQ LGIGTARTDG SLAIASDPAN

 451 GQRKLVLDTV NIAAGQGSLT AQGYLELFKD RLLKLDIRSR AFDPSRIDPQ

 501 LPAGNINGSI NLAGELAKEK FTGKMRFLPG TFNGVPIAGS ADIVYESRHL

 551 PRAAVDLRLG RNIIKTDGGF GKKGDRLNLN ITAPDLSRFG FGLAGSLNVR

 601 GHLSGDLDGG IRTFETDLSG AARNLHIGKA ADIRSLDFTL KGSPDTSRPI

 651 RADIKGSRLS LSGGAAVVDT ADLMLDGTGV QHRIRTHAAM TLDGKPFKFD

 701 LDASGGINRE LTRWKGSIGI LDIGGAFNLK LQNRMTLEAG AERVAASAAN

 751 WQAMGGSLNL QHFSWDKKTG ISAKGGAHGL HIAELHNFFK PPFEHNLVLN

 801 GDWDVAYGRN ARGYLNISRQ SGDAVLPGGQ ALGLNAFSLK TRFQNDRIGI

 851 LLDGGARFGR INADLGIANA FGGNMANAPL GGRITASLPD LGALKPFLPA

 901 AAQNITGSLN AAAQIGGRVG SPSVNAAVNG SSNYGKINGN ITVGQSRSFD

 951 TAPLGGRLNL TVADAEVFRN FLPVGQTVKG SLNAAVTLGG SIADPHLGGS

1001 INGDKLYYRN QTQGIILDNG SLRSHIAGRK WVIDSLKFRH EGTAELSGTV

1051 GMENSGPDVD IGAVFDKYRI LSRPNRRLTV SGNTRLRYSP QKGISVTGMI

1101 KTDQGLFGSQ KSSMPSVGDD VVVLGEVKKE AAAPLPVNMN LTLDLNDGIR

1151 FAGYGADVTI GGKLTLTAQS GGSVRGVGTV RVIKGRYKAY GQDLDITKGT

1201 VSFVGPLNDP NLNIRAERRL SPVGAGVEIL GSLNSPRITL TANEPMSEKD

1251 KLSWLILNRA GSGSSGDNAA LSAAAGALLA GQINDRIGLV DDLGFTSKRS

1301 RNAQTGELNP AEQVLTVGKQ LTGKLYIGYE YSISSAEQSV KLIYRLTRAI

1351 QAVARIGSRS SGGELTYTIR FDRFSGSDKK DSAGNGKGK*
```

Computer analysis of this amino acid sequence gave the following results:

Homology with a Predicted ORF from *N. gonorrhoeae*

```
m285/g285  96.5% identity in 1389 aa overlap

                   10        20        30        40        50        60
m285.pep   MTDTAPTDTDPTENGTRKMPSEHRPTPPAKKRRPLLKLSAALLSVLLLAVCFLGWLAGTE
           ||||:|||||||||||||||||||||:||||||||||||||||||||||||||||:||||
g285       MTDTTPTDTDPTENGTRKMPSEHRPAPPAKKRRPLLKLSAALLSVLILAVCFLGWIAGTE
                   10        20        30        40        50        60

                   70        80        90       100       110       120
m285.pep   AGLRFGLYQIPSWFGVNISSQNLKGTLLDGFDGDNWSIETEGADLKISRFRFAWKPSELM
           ||||||||||||||||||||||||||||||||||||||||||||||||||||||||||||
g285       AGLRFGLYQIPSWFGVNISSQNLKGTLLDGFDGDNWSIETEGADLKISRFRFAWKPSELM
                   70        80        90       100       110       120

                  130       140       150       160       170       180
m285.pep   RRSLHITEISAGDIAIVTKPTPPKEERPPLSLPDSIDLPAAVYLDRFETGKISMGKAFDK
           |||||||:|||||||||||||||||| :||||||||||||||||||||||||||||:|||
g285       RRSLHITDISAGDIAIVTKPTPPKEERPPLSLPDSIDLPAAVYLDRFETGKISMGKAFDK
                  130       140       150       160       170       180

                  190       200       210       220       230       240
m285.pep   QTVYLERLDASYRYDRKGHRLDLKAADTPWSWSSGAASVGLKKPFALDTAIYTKGGLEGK
           ||||||||:|:||||||||||||||||||||||||:||||||||||||||||||||:||:
g285       QTVYLERLNAAYRYDRKGHRLDLKAADTPWSSSSGSASVGLKKPFALDTAIYTKGGFEGE
                  190       200       210       220       230       240

                  250       260       270       280       290       300
m285.pep   TIHSTARLSGSLKDVRAELAIDGGNIRLSGKSVIHPFAESLDKTLEEVLVKGFNINPAAF
           |||||||||||||||||||:|||||||||||||||||||||||||||||||||||||:||
g285       TIHSTARLSGSLKDVRAELTIDGGNIRLSGKSVIHPFAESLDKTLEEVLVKGFNINPSAF
                  250       260       270       280       290       300
```

-continued

```
                310       320       330       340       350       360
m285.pep  VPSLPDAGLNFDLTAIPSFSDGIALEGSLDLENTKAGFADRNGIPVRQVLGGFVIRQDGT
          ||||||||||||||||||||||||||||||||||||||||||||||||||||||||||||
g285      VPSLPDAGLNFDLTAIPSFSDGIALEGSLDLENTKAGFADRNGIPVRQVLGGFVIRQDGT
                310       320       330       340       350       360

                370       380       390       400       410       420
m285.pep  VHIGNTSAALLGRGGIRLSGKIDTEKDILDLNIGINSVGAEDVLQTAFKGRLDGSIGIGG
          ||||||||||||||||||||||||||||||||||||||||||||||||||||||||||||
g285      VHIGNTSAALLGRGGIRLSGKIDTEKDILDLNIGINSVGAEDVLQTAFKGRLDGSIGIGG
                370       380       390       400       410       420

                430       440       450       460       470       480
m285.pep  TTASPKISWQLGIGTARTDGSLAIASDPANGQRKLVLDTVNIAAGQGSLTAQGYLELFKD
          |||||||||||| |||||||||||||||||| |||||:||||||||:||||||||||||||
g285      TTASPKISWQLGTGTARTDGSLAIASDPANEQRKLVFDTVNIAAGEGSLTAQGYLELFKD
                430       440       450       460       470       480

                490       500       510       520       530       540
m285.pep  RLLKLDIRSRAFDPSRIDPQLPAGNINGSINLAGELAKEKFTGKMRPLPGTFNGVPIAGS
          ||||||||||||||||||||:|||||||||:|||||||||||||||||||||||||||||
g285      RLLKLDIRSRAFDPSRIDPQFPAGNINGSIHLAGELAKEKFTGKMRFLPGTFNGVPIAGS
                490       500       510       520       530       540

                550       560       570       580       590       600
m285.pep  ADIVYESRHLPRAAVDLRLGRNIIKTDGGFGKKGDRLNLNITAPDLSRFGFGLAGSLNVR
          |||||||||||||||||||||||:||||||||||||||||||||||||||||||||||||
g285      ADIVYESRHLPRAAVDLRLGRNIVKTDGGFGKKGDRLNLNITAPDLSRFGFGLAGSLNVR
                550       560       570       580       590       600

                610       620       630       640       650       660
m285.pep  GHLSGDLDGGIRTFFTDLSGAARNLHIGKAADIRSLDFTLKGSPDTSRPIRADIKGSRLS
          ||||||||||||||||||||:||||||||||||||||||||||| ||||:||||||:|||
g285      GHLSGDLDGGIRTFFTDLSGTARNLHIGKAADIRSLDFTLKGSPGTSRPMRADIKGGRLS
                610       620       630       640       650       660

                670       680       690       700       710       720
m285.pep  LSGGAAVVDTADLMLDGTGVQHRIRTHAAMTLDGKPFKFDLDASGGINRELTRWKGSIGI
          ||||||||||| | |:|||:|||||||||||||||||||:||||||||||||||||||||
g285      LSGGAAVVDTAGLTLEGTGAQHRIRTHAAMTLDGKPFKLDLDASGGINRELTRWKGSIGI
                670       680       690       700       710       720

                730       740       750       760       770       780
m285.pep  LDIGGAFNLKLQNRMTLEAGAERVAASAANWQAMGGSLNLQHFSWDKKTGISAKGGAHGL
          ||||||||||||||||||||||:|||||||||||||||||||||||:||||||||||:||
g285      LDIGGAFNLKLQNRMTLEAGAEHVAASAANWQAMGGSLNLQHFSWDRKTGISAKGGARGL
                730       740       750       760       770       780

                790       800       810       820       830       840
m285.pep  HIAELHNFFKPPFEHNLVLNGDWDVAYGRNARGYLNISRQSGDAVLPGGQALGINAFSLK
          ||||||||||||||||||||||||||||:|||||||||||||||||||||||||||||||
g285      HIAELHNFFKPPFEHNLVLNGDWDVAYGHNARGYLNISRQSGDAVLPGGQALGLNAFSLK
                790       800       810       820       830       840

                850       860       870       880       890       900
m285.pep  TRFQNDRIGILLDGGARFGRINADLGIANAFGGNMANAPLGGRITASLPDLGALKPFLPA
          ||||||||||||||||||||||||| |:||||||||||||||||||||||||||||||||
a285      TRFQNDRIGILLDGGARFGRINADLDIGNAFGGNMANAPLGGRITASLPDLGALKPFLPA
                850       860       870       880       890       900

                910       920       930       940       950       960
m285.pep  AAQNITGSLNAAAQIGGRVGSPSVNAAVNGSSNYGKINGNITVGQSRSFDTAPLGGRLNL
          |||||||||||:||||||||||||||||||||||||||||||||||||||||||||||||
g285      AAQNITGSLNASAQIGGRVGSPSVNAAVNGSSNYGKINGNITVGQSRSFDTAPLGGRLNL
                910       920       930       940       950       960

                970       980       990      1000      1010      1020
m285.pep  TVADAEVFRNFLPVGQTVKGSLNAAVTLGGSIADPHLGGSINGDKLYYRNQTQGIILDNG
          ||||||:|||||||||||||||||||||||||||||||||||||||||||||||||||||
g285      TVADAEAFRNFLPVGQTVKGSLNAAVTLGGSIADPHLGGSINGDKLYYRNQTQGIILDNG
                970       980       990      1000      1010      1020

               1030      1040      1050      1060      1070      1080
m285.pep  SLRSHIAGRKWVIDSLKFRHEGTAELSGTVGMENSGPDVDIGAVFDKYRILSRPNRRLTV
          ||||||||||||||||||||||||||||||:|||||||||||||||||||||||||||||
g285      SLRSHIAGRKWVIDSLKFRHEGTAELSGTVSMENSGPDVDIGAVFDKYRILSRPNRRLTV
               1030      1040      1050      1060      1070      1080

               1090      1100      1110      1120      1130      1140
m285.pep  SGNTRLRYSPQKGISVTGMIKTDQGLFGSQKSSMPSVGDDVVVLGEVKKEAAAPLPVNMN
          ||||||||||||||||||||||||||||||||||||||||||||||||||||| ||||||
g285      SGNTRLRYSPQKGISVTGMIKTDQGLFGSQKSSMPSVGDDVVVLGEVKKEAAASLPVNMN
               1090      1100      1110      1120      1130      1140

               1150      1160      1170      1180      1190      1200
m285.pep  LTLDLNDGIRFAGYGADVTIGGKLTLTAQSGGSVRGVGTVRVIKGRYKAYGQDLDITKGT
          ||||||||||:|||||||||||||||||| ||:|||||||||||||||||||||||||||
g285      LTLDLNDGIRFAGYGADVTIGGKLTLTAQPGGNVRGVGTVRVIKGRYKAYGQDLDITKGT
               1150      1160      1170      1180      1190      1200
```

-continued

```
                1210      1220      1230      1240      1250      1260
m285.pep   VSFVGPLNDPNLNIRAERRLSPVGAGVEILGSLNSPRITLTANEPMSEKDKLSWLILNRA
           ||||||||||||||||||||||||||||||||||||||||||||||||||||||||||||
g285       VSFVGPLNDPNLNIRAERRLSPVGAGVEILGSLNSPRITLTANEPMSEKDKLSWLILNRA
                1210      1220      1230      1240      1250      1260

                1270      1280      1290      1300      1310      1320
m285.pep   GSGSSGDNAALSAAAGALLAGQINDRIGLVDDLGFTSKRSRNAQTGELNPAEQVLTVGKQ
           ||||||||||||||||||||||||||||||||||||||||||||||||||||||||||||
g285       GSGSSGDNAALSAAAGALLAGQINDRIGLVDDLGFTSKRSRNAQTGELNPAEQVLTVGKQ
                1270      1280      1290      1300      1310      1320

                1330      1340      1350      1360      1370      1380
m285.pep   LTGKLYIGYEYSISSAEQSVKLIYRLTRAIQAVARIGSRSSGGELTYTIRFDRFSGSDKK
           |||||||||||:||||||||||||||||||||||||||||||||||||||||: |||||
g285       LTGKLYIGYEYGISSAEQSVKLIYRLTRAIQAVARIGSRSSGGELTYTIRFDRLFGSDKK
                1330      1340      1350      1360      1370      1380

                1390
m285.pep   DSAGNGKGKX
           ||||||||||
g285       DSAGNGKGKX
```

The following partial DNA sequence was identified in *N. meningitidis* <SEQ ID 1185>:

```
a285.seq
   1  ATGACCGATA CCGCACCGAC AGATACCGAT CCGACCGAAA ACGGCACGCG

  51  CAAAATGCCG TCTGAACACC GCCCTACCCC GCCGGCAAAA AAACGCCGCC

 101  CGCTGCTGAA GCTGTCGGCG GCACTGCTGT CTGTTCTGAT TTTGGCAGTA

 151  TGTTTCCTCG GCTGGCTCGC CGGCACGGAA GCGGGTTTGC GCTTCGGGCT

 201  GTACCAAATC CCGTCTTGGT TCGGCGTAAA CATTTCCTCC CAAAACCTCA

 251  AAGGCACGCT GCTCGACGGC TTCGACGGCG ACAACTGGTC GATAGAAACC

 301  GAGGGGGCAG ACCTTAAAAT CAGCCGCTTC CGCTTCGCGT GGAAACCGTC

 351  CGAACTGATG CGCCGCAGCC TGCACATTAC CGAAATTTCC GCCGGCGACA

 401  TCGCCATCGT TACCAAACCG ACTCCGCCTA AAGAAGAACG CCCGCCGCTC

 451  AGCCTTCCCG ACAGCATAGA CCTGCCTGCC GCCGTCTATC TCGACCGCTT

 501  CGAGACGGGC AAAATCAGCA TGGGCAAAGC CTTTGACAAA CAAACCGTCT

 551  ATCTCGAACG GCTGGATGCT TCATACCGTT ACGACCGCAA AGGACACCGC

 601  CTCGACCTGA AGGCTGCCGA CACGCCGTGG AGCAGTTCGT CGGGGTCAGC

 651  CTCGGTCGGC TTGAAAAAAC CGTTTGCCCT CGATACCGCC ATTTACACCA

 701  AAGGCGGACT CGAAGGCAAA ACCATACACA GTACGGCTCG GCTGAGCGGC

 751  AGCCTGAAGG ATGTGCGCGC CGAACTGGCG ATCGACGGCG GCAATATCCG

 801  CCTCTCGGGA AAATCCGTCA TCCACCCGTT TGCCGAATCA TTGGATAAAA

 851  CATTGGAAGA AGTACTGGTC AAAGGGTTCA ACATCAATCC GTCCGCCTTC

 901  GTGCCTTCCC TGCCCGATGC CGGGCTGAAT TTCGACCTGA CCGCCATCCC

 951  GTCGTTTTCA GACGGCATCG CGCTGGAAGG CTCGCTCGAT TTGGAAAACA

1001  CCAAAGCCGG CTTTGCCGAC CGCAACGGCA TCCCCGTCCG TCAGGTTTTA

1051  GGCAGCTTTG TCATCCGGCA GGACGGCACG GTGCATATCG GCAATACGTC

1101  CGTCGCCCTG CTCGGACGGG GCGGCATCAG GCTGTCGGGC AAAATCGACA

1151  CCGAAAAAGA CATCCTCGAT TTAAATATAG GCATCAACTC CGTCGGCGCG

1201  GAAGACGTAC TGCAAACCGC GTTCAAAGGC AGGTTGGACG GCAGCATCGG

1251  CATCGGTGGC ACGACCGCCT CGCCCAAAAT CTCTTGGCAA CTCGGCATCG

1301  GCACGGCGCG CACGGACGGC AGCCTCGCCA TTGCAAGCGA CCCCGCAAAC
```

-continued

1351 GGACAGCGGA AACTGGTGCT CGACACCGTC AACATCGCCG CCGGGCAAGG

1401 CAGCCTGACC GCGCAAGGCT ATCTCGAGCT GTTTAAAGAC CGCCTGCTCA

1451 AGCTGGACAT CCGTTCCCGC GCATTCGACC CTTCGCGCAT CGATCCGCAA

1501 CTTCCGGCAG GCAATATCAA CGGCTCAATA AACCTTGCCG GCGAACTGGC

1551 AAAAGAGAAA TTCACAGGCA AAATGCGGTT TTTACCCGGC ACGTTCAACG

1601 GCGTACCGAT TGCCGGCAGT GCCGACATTG TTTACGAGTC CCGCCACCTT

1651 CCGCGTGCCG CCGTCGATTT GCGGCTGGGG CGGAACATTA TTAAAACAGA

1701 CGGCGGCTTC GGCAAAAAAG GCGACCGGCT TAACCTCAAT ATCACCGCAC

1751 CCGATTTATC CCGTTTCGGT TTCGGACTCG CGGGGTCTTT AAATGTACGC

1801 GGACACCTTT CCGGCGATTT GGACGGTGGC ATCCGAACCT TTGAAACCGA

1851 CCTTTCCGGC GCGGCGCGCA ACCTGCACAT CGGCAAGGCG GCAGACATCC

1901 GTTCGCTCGA TTTCACGCTC AAAGGTTCGC CCGACACAAG CCGCCCGATA

1951 CGCGCCGACA TCAAAGGCAG CCGCCTTTCG CTGTCGGGCG GAGCGGAGGT

2001 TGTCGATACC GCCGACCTGA TGCTGGACGG CACGGGCGTG CAGCACCGCA

2051 TCCGCACACA CGCCGCCATG ACGCTGGATG GCAAACCGTT CAAATTCGAT

2101 TTGGACGCTT CAGGCGGCAT CAACAGGGAA CTTACCCGAT GGAAAGGCAG

2151 CATCGGCATC CTCGACATCG GCGGCGCATT CAACCTCAAG CTGCAAAACC

2201 GTATGACGCT CGAAGCCGGT GCGGAACGCG TGGCGGCAAG TGCGGCAAAT

2251 TGGCAGGCAA TGGGCGGCAG CCTCAACCTG CAACACTTTT CTTGGGATAA

2301 AAAAACCGGC ATATCGGCAA AAGGCGGCGC ACACGGTCTG CATATCGCCG

2351 AGTTGCACAA TTTCTTCAAA CCGCCCTTCG AACACAATCT GGTTTTAAAC

2401 GGCGACTGGG ATGTCGCCTA CGGGCGAAAC GCGCGCGGCT ACCTCAATAT

2451 CAGCCGGCAA AGCGGCGATG CCGTATTGCC CGGCGGGCAG GCTTTGGGTT

2501 TGAACGCATT TTCCCTGAAA ACGCGCTTTC AAAACGACCG TATCGGAATC

2551 CTGCTTGACG GCGGCGCGCG TTTCGGGCGG ATTAACGCCG ATTTGGACAT

2601 CGGCAACGCC TTCGGCGGCA ATATGGCAAA TGCACCGCTC GGCGGCAGGA

2651 TTACCGCCTC CCTTCCCGAC TTGGGCACAT TGAAGCCCTT TCTGCCCGCC

2701 GCCGCGCAAA ACATTACCGG CAGCCTGAAT GCCGCCGCGC AAATCGGCGG

2751 ACGGGTCGGC TCTCCGTCCG TCAATGCCGC CGTCAACGGC AGCAGCAACT

2801 ACGGGAAAAT CAACGGCAAC ATCACCGTCG GGCAAAGCCG CTCTTTCGAT

2851 ACCGCGCCTT TGGGCGGCAG GCTCAACCTG ACCGTTGCCG ATGCCGAAGT

2901 ATTCCGCAAC TTCCTACCGG TCGGACAAAC CGTCAAAGGC AGCCTGAATG

2951 CCGCCGTAAC CCTCGGCGGC AGCATCGCCG ATCCGCACTT GGGCGGCAGC

3001 ATCAACGGCG ACAAACTCTA TTACCGCAAC CAAACCCAAG GCATCATCTT

3051 GGACAACGGC TCGCTGCGTT CGCATATCGC GGGCAGGAAA TGGGTAATCG

3101 ACAGCCTGAA ATTCCGGCAC GAAGGGACGG CGGAACTCTC CGGTACGGTC

3151 GGTATGGAAA ACAGCGGACC CGATGTCGAT ATCGGCGCGG TGTTCGACAA

3201 ATACCGCATC CTGTCCCGCC CCAACCGCCG CCTGACGGTT TCCGGCAACA

3251 CCCGCCTGCG CTATTCGCCG CAAAAAGGCA TATCCGTTAC CGGGATGATT

3301 AAAACGGATC AGGGGCTGTT CGGTTCGCAA AAATCCTCGA TGCCGTCCGT

-continued

```
3351 CGGCGACGAT GTCGTCGTAT TAGGCGAAGT CAAAAAAGAG GCGGCGGCAC
3401 CGCTCCCCGT CAATATGAAC CTGACTTTAG ACCTCAATGA CGGCATCCGC
3451 TTCGCCGGCT ACGGCGCGGA CGTTACCATA GGCGGCAAAC TGACCCTGAC
3501 CGCCCAATCG GGCGGAAGCG TGCGGGGCGT GGGCACGGTC CGCGTCATCA
3551 AAGGGCGTTA TAAGGCATAC GGGCAGGATT TGGACATTAC CAAAGGCACG
3601 GTCTCCTTTG TCGGCCCGCT CAACGACCCC AACCTCAACA TCCGCGCCGA
3651 ACGCCGCCTT TCCCCCGTCG GTGCGGGCGT GGAAATATTG GGCAGCCTCA
3701 ACAGTCCGCG CATTACGCTG ACGGCAAACG AACCGATGAG TGAAAAAGAC
3751 AAGCTCTCCT GGCTCATCCT CAACCGCGCC GGCAGTGGCA GCAGCGGCGA
3801 CAATGCCGCC CTGTCCGCAG CCGCCGGCGC GCTGCTTGCC GGGCAAATCA
3851 ACGACCGCAT CGGGCTGGTG GATGATTTGG GCTTTACCAG CAAGCGCAGC
3901 CGCAACGCGC AAACCGGCGA ACTCAACCCC GCCGAACAGG TGCTGACCGT
3951 CGGCAAACAA CTGACCGGCA AACTCTACAT CGGCTACGAA TACAGCATCT
4001 CCAGCGCGGA ACAGTCCGTC AAACTGATTT ACCGGCTGAC CCGCGCCATA
4051 CAGGCGGTTG CCCGTATCGG CAGCCGTTCG TCGGGCGGCG AGCTGACATA
4101 CACCATACGT TTCGACCGCT TCTCCGGTTC GGACAAAAAA GACTCCGCCG
4151 GAAACAGCAA AGGAAAATAA
```

This corresponds to the amino acid sequence <SEQ ID 1186; ORF 285.a>:

```
a285.pep
   1 MTDTAPTDTD PTENGTRKMP SEHRPTPPAK KRRPLLKLSA ALLSVLILAV
  51 CFLGWLAGTE AGLRFGLYQI PSWFGVNISS QNLKGTLLDG FDGDNWSIET
 101 EGADLKISRF RFAWKPSELM RRSLHITEIS AGDIAIVTKP TPPKEERPPL
 151 SLPDSIDLPA AVYLDRFETG KISMGKAFDK QTVYLERLDA SYRYDRYGHR
 201 LDLKAADTPW SSSSGSASVG LKKPFALDTA IYTKGGLEGK TIHSTARLSG
 251 SLKDVRAELA IDGGNIRLSG KSVIHPFAES LDKTLEEVLV KGFNINPSAF
 301 VPSLPDAGLN FDLTAIPSFS DGIALEGSLD LENTKAGFAD RNGIPVRQVL
 351 GSFVIRQDGT VHIGNTSVAL LGRGGIRLSG KIDTEKDILD LNIGINSVGA
 401 EDVLQTAFKG RLDGSIGIGG TTASPKISWQ LGIGTARTDG SLAIASDPAN
 451 GQRKLVLDTV NIAAGQGSLT AQGYLELFKD RLLKLDIRSR AFDPSRIDPQ
 501 LPAGNINGSI NLAGELAKEK FTGKMRFLPG TFNGVPIAGS ADIVYESRHL
 551 PRAAVDLRLG RNIIKTDGGF GKKGDRLNLN ITAPDLSRFG FGLAGSLNVR
 601 GHLSGDLDGG IRTFETDLSG AARNLHIGKA ADIRSLDFTL KGSPDTSRPI
 651 RADIKGSRLS LSGGAEVVDT ADLMLDGTGV QHRIRTHAAM TLDGKPFKFD
 701 LDASGGINRE LTRWKGSIGI LDIGGAFNLK LQNRMTLEAG AERVAASAAN
 751 WQAMGGSLNL QHFSWDKKTG ISAKGGAHGL HIAELHNFFK PPFEHNLVLN
 801 GDWDVAYGRN ARGYLNISRQ SGDAVLPGGQ ALGLNAFSLK TRFQNDRIGI
 851 LLDGGARFGR INADLDIGNA FGGNMANAPL GGRITASLPD LGTLKPFLPA
 901 AAQNITGSLN AAAQIGGRVG SPSVNAAVNG SSNYGKINGN ITVGQSRSFD
 951 TAPLGGRLNL TVADAEVFRN FLPVGQTVKG SLNAAVTLGG SIADPHLGGS
1001 INGDKLYYRN QTQGIILDNG SLRSHIAGRK WVIDSLKFRH EGTAELSGTV
```

-continued

```
1051  GMENSGPDVD IGAVFDKYRI LSRPNRRLTV SGNTRLRYSP QKGISVTGMI

1101  KTDQGLFGSQ KSSMPSVGDD VVVLGEVKKE AAAPLPVNMN LTLDLNDGIR

1151  FAGYGADVTI GGKLTLTAQS GGSVRGVGTV RVIKGRYKAY GQDLDITKGT

1201  VSFVGPLNDP NLNIRAERRL SPVGAGVEIL GSLNSPRITL TANEPMSEKD

1251  KLSWLILNRA GSGSSGDNAA LSAAAGALLA GQINDRIGLV DDLGFTSKRS

1301  RNAQTGELNP AEQVLTVGKQ LTGKLYIGYE YSISSAEQSV KLIYRLTRAI

1351  QAVARIGSRS SGGELTYTIR FDRFSGSDKK DSAGNSKGK*
```

m285/a285  99.4% identity in 1389 aa overlap

```
                     10        20        30        40        50        60
m285.pep     MTDTAPTDTDPTENGTRKMPSEHRPTPPAKKRRPLLKLSAALLSVLLLAVCFLGWLAGTE
             ||||||||||||||||||||||||||||||||||||||||||||||||||||||||||||
a285         MTDTAPTDTDPTENGTRKMPSEHRPTPPAKKRRPLLKLSAALLSVLILAVCFLGWLAGTE
                     10        20        30        40        50        60

                     70        80        90       100       110       120
m285.pep     AGLRFGLYQIPSWFGVNISSQNLKGTLLDGFDGDNWSIETEGADLKISRFRFAWKPSELM
             ||||||||||||||||||||||||||||||||||||||||||||||||||||||||||||
a285         AGLRFGLYQIPSWFGVNISSQNLKGTLLDGFDGDNWSIETEGADLKISRFRFAWKPSELM
                     70        80        90       100       110       120

                    130       140       150       160       170       180
m285.pep     RRSLHITEISAGDIAIVTKPTPPKEERPPLSLPDSIDLPAAVYLDRFETGKISMGKAFDK
             ||||||||||||||||||||||||||||||||||||||||||||||||||||||||||||
a285         RRSLHITEISAGDIAIVTKPTPPKEERPPLSLPDSIDLPAAVYLDRFETGKISMGKAFDK
                    130       140       150       160       170       180

                    190       200       210       220       230       240
m285.pep     QTVYLERLDASYRYDRKGHRLDLKAADTPWSWSSGAASVGLKKPFALDTAIYTKGGLEGK
             ||||||||||||||||||||||||||||||||||:|||||||||||||||||||||||||
a285         QTVYLERLDASYRYDRKGHRLDLKAADTPWSSSSGSASVGLKKPFALDTAIYTKGGLEGK
                    190       200       210       220       230       240

                    250       260       270       280       290       300
m285.pep     TIHSTARLSGSLKDVRAELAIDGGNIRLSGKSVIHPFAESLDKTLEEVLVKGFNINPAAF
             |||||||||||||||||||||||||||||||||||||||||||||||||||||||||:||
a285         TIHSTARLSGSLKDVRAELAIDGGNIRLSGKSVIHPFAESLDKTLEEVLVKGFNINPSAF
                    250       260       270       280       290       300

                    310       320       330       340       350       360
m285.pep     VPSLPDAGLNFDLTAIPSFSDGIALEGSLDLENTKAGFADRNGIPVRQVLGGFVIRQDGT
             ||||||||||||||||||||||||||||||||||||||||||||||||||||:|||||||
a285         VPSLPDAGLNFDLTAIPSFSDGIALEGSLDLENTKAGFADRNGIPVRQVLGSFVIRQDGT
                    310       320       330       340       350       360

                    370       380       390       400       410       420
m285.pep     VHIGNTSAALLGRGGIRLSGKIDTEKDILDLNIGINSVGAEDVLQTAFKGRLDGSIGIGG
             |||||||:||||||||||||||||||||||||||||||||||||||||||||||||||||
a285         VHIGNTSVALLGRGGIRLSGKIDTEKDILDLNIGINSVGAEDVLQTAFKGRLDGSIGIGG
                    370       380       390       400       410       420

                    430       440       450       460       470       480
m285.pep     TTASPKISWQLGIGTARTDGSLAIASDPANGQRKLVLDTVNIAAGQGSLTAQGYLELFKD
             ||||||||||||||||||||||||||||||||||||||||||||||||||||||||||||
a285         TTASPKISWQLGIGTARTDGSLAIASDPANGQRKLVLDTVNIAAGQGSLTAQGYLELFKD
                    430       440       450       460       470       480

                    490       500       510       520       530       540
m285.pep     RLLKLDIRSRAFDPSRIDPQLPAGNINGSINLAGELAKEKFTGKMRPLPGTFNGVPIAGS
             ||||||||||||||||||||||||||||||||||||||||||||||||||||||||||||
a285         RLLKLDIRSRAFDPSRIDPQLPAGNINGSINLAGELAKEKFTGKMRFLPGTFNGVPIAGS
                    490       500       510       520       530       540

                    550       560       570       580       590       600
m285.pep     ADIVYESRHLPRAAVDLRLGRNIIKTDGGFGKKGDRLNLNITAPDLSRFGFGLAGSLNVR
             ||||||||||||||||||||||||||||||||||||||||||||||||||||||||||||
a285         ADIVYESRHLPRAAVDLRLGRNIIKTDGGFGKKGDRLNLNITAPDLSRFGFGLAGSLNVR
                    550       560       570       580       590       600

                    610       620       630       640       650       660
m285.pep     GHLSGDLDGGIRTFFTDLSGAARNLHIGKAADIRSLDFTLKGSPDTSRPIRADIKGSRLS
             ||||||||||||||||||||||||||||||||||||||||||||||||||||||||||||
a285         GHLSGDLDGGIRTFFTDLSGAARNLHIGKAADIRSLDFTLKGSPDTSRPIRADIKGSRLS
                    610       620       630       640       650       660

                    670       680       690       700       710       720
m285.pep     LSGGAAVVDTADLMLDGTGVQHRIRTHAAMTLDGKPFKFDLDASGGINRELTRWKGSIGI
             ||||| ||||||||||||||||||||||||||||||||||||||||||||||||||||||
a285         LSGGAEVVDTADLMLDGTGVQHRIRTHAAMTLDGKPFKFDLDASGGINRELTRWKGSIGI
                    670       680       690       700       710       720

                    730       740       750       760       770       780
m285.pep     LDIGGAFNLKLQNRMTLEAGAERVAASAANWQAMGGSLNLQHFSWDKKTGISAKGGAHGL
             ||||||||||||||||||||||||||||||||||||||||||||||||||||||||||||
a285         LDIGGAFNLKLQNRMTLEAGAERVAASAANWQAMGGSLNLQHFSWDKKTGISAKGGAHGL
                    730       740       750       760       770       780
```

-continued

```
                 790       800       810       820       830       840
m285.pep  HIAELHNFFKPPFEHNLVLNGDWDVAYGRNARGYLNISRQSGDAVLPGGQALGINAFSLK
          ||||||||||||||||||||||||||||||||||||||||||||||||||||||||||||
a285      HIAELHNFFKPPFEHNLVLNGDWDVAYGRNARGYLNISRQSGDAVLPGGQALGLNAFSLK
                 790       800       810       820       830       840

                 850       860       870       880       890       900
m285.pep  TRFQNDRIGILLDGGARFGRINADLGIANAFGGNMANAPLGGRITASLPDLGALKPFLPA
          |||||||||||||||||||||||| |:||||||||||||||||||||||||:|||||||
a285      TRFQNDRIGILLDGGARFGRINADLDIGNAFGGNMANAPLGGRITASLPDLGTLKPFLPA
                 850       860       870       880       890       900

                 910       920       930       940       950       960
m285.pep  AAQNITGSLNAAAQIGGRVGSPSVNAAVNGSSNYGKINGNITVGQSRSFDTAPLGGRLNL
          ||||||||||||||||||||||||||||||||||||||||||||||||||||||||||||
a285      AAQNITGSLNAAAQIGGRVGSPSVNAAVNGSSNYGKINGNITVGQSRSFDTAPLGGRLNL
                 910       920       930       940       950       960

                 970       980       990      1000      1010      1020
m285.pep  TVADAEVFRNFLPVGQTVKGSLNAAVTLGGSIADPHLGGSINGDKLYYRNQTQGIILDNG
          ||||||||||||||||||||||||||||||||||||||||||||||||||||||||||||
a285      TVADAEVFRNFLPVGQTVKGSLNAAVTLGGSIADPHLGGSINGDKLYYRNQTQGIILDNG
                 970       980       990      1000      1010      1020

                1030      1040      1050      1060      1070      1080
m285.pep  SLRSHIAGRKWVIDSLKFRHEGTAELSGTVGMENSGPDVDIGAVFDKYRILSRPNRRLTV
          ||||||||||||||||||||||||||||||||||||||||||||||||||||||||||||
a285      SLRSHIAGRKWVIDSLKFRHEGTAELSGTVGMENSGPDVDIGAVFDKYRILSRPNRRLTV
                1030      1040      1050      1060      1070      1080

                1090      1100      1110      1120      1130      1140
m285.pep  SGNTRLRYSPQKGISVTGMIKTDQGLFGSQKSSMPSVGDDVVVLGEVKKEAAAPLPVNMN
          ||||||||||||||||||||||||||||||||||||||||||||||||||||||||||||
a285      SGNTRLRYSPQKGISVTGMIKTDQGLFGSQKSSMPSVGDDVVVLGEVKKEAAAPLPVNMN
                1090      1100      1110      1120      1130      1140

                1150      1160      1170      1180      1190      1200
m285.pep  LTLDLNDGIRFAGYGADVTIGGKLTLTAQSGGSVRGVGTVRVIKGRYKAYGQDLDITKGT
          ||||||||||||||||||||||||||||||||||||||||||||||||||||||||||||
a285      LTLDLNDGIRFAGYGADVTIGGKLTLTAQSGGSVRGVGTVRVIKGRYKAYGQDLDITKGT
                1150      1160      1170      1180      1190      1200

                1210      1220      1230      1240      1250      1260
m285.pep  VSFVGPLNDPNLNIRAERRLSPVGAGVEILGSLNSPRITLTANEPMSEKDKLSWLILNRA
          ||||||||||||||||||||||||||||||||||||||||||||||||||||||||||||
a285      VSFVGPLNDPNLNIRAERRLSPVGAGVEILGSLNSPRITLTANEPMSEKDKLSWLILNRA
                1210      1220      1230      1240      1250      1260

                1270      1280      1290      1300      1310      1320
m285.pep  GSGSSGDNAALSAAAGALLAGQINDRIGLVDDLGFTSKRSRNAQTGELNPAEQVLTVGKQ
          ||||||||||||||||||||||||||||||||||||||||||||||||||||||||||||
a285      GSGSSGDNAALSAAAGALLAGQINDRIGLVDDLGFTSKRSRNAQTGELNPAEQVLTVGKQ
                1270      1280      1290      1300      1310      1320

                1330      1340      1350      1360      1370      1380
m285.pep  LTGKLYIGYEYSISSAEQSVKLIYRLTRAIQAVARIGSRSSGGELTYTIRFDRFSGSDKK
          ||||||||||||||||||||||||||||||||||||||||||||||||||||||||||||
a285      LTGKLYIGYEYSISSAEQSVKLIYRLTRAIQAVARIGSRSSGGELTYTIRFDRFSGSDKK
                1330      1340      1350      1360      1370      1380

                1390
m285.pep  DSAGNGKGKX
          |||||:||||
a285      DSAGNSKGKX
                1390
```

The following partial DNA sequence was identified in *N. gonorrhoeae* <SEQ ID 1187>:

```
g285-1.seq
   1  CTGAAGCTGT CGGCGGCACT GCTGTCTGTC CTGATTTTGG CAGTATGTTT

  51  CCTCGGCTGG ATCGCCGGTA CGGAAGCAGG TTTGCGCTTC GGGCTGTACC

 101  AAATCCCGTC CTGGTTCGGC GTAAACATTT CCTCCCAAAA CCTCAAAGGC

 151  ACACTGCTCG ACGGCTTCGA CGGCGACAAC TGGTCGATAG AAACCGAGGG

 201  GGCAGACCTT AAAATCAGCC GCTTCCGCTT CGCGTGGAAA CCGTCCGAAC

 251  TGATGCGCCG CAGCCTGCAC ATCACCGACA TCTCCGCCGG CGACATCGCC

 301  ATCGTAACCA AACCGACTCC GCCTAAAGAA GAACGCCCGC CTCAAGGCCT

 351  GCCCGACAGC ATAGACCTGC CCGCCGCCGT CTATCTCGAC CGCTTCGAGA

 401  CGGGCAAAAT CAGCATGGGC AAAACCTTTG ACAAACAAAC CGTCTATCTC
```

-continued

```
 451 GAACGCCTCA ACGCGGCATA CCGTTACGAC CGTAAAGGGC ACCGCCTCGA
 501 CCTGAAGGCC GCCGACACGC CGTGGAGCAG TTCGTCGGGG TCAGCCTCGG
 551 TCGGCTTGAA AAAACCGTTT GCCCTCGATA CCGCCATTTA CACCAAAGGC
 601 GGATTCGAAG GCGAAACCAT ACACAGTACG GCGCGGCTGA GCGGCAGCCT
 651 GAAGGATGTG CGCGCCGAAC TGACGATCGA CGGCGGCAAT ATCCGCCTCT
 701 CGGGAAAATC CGTCATCCAC CCGTTTGCCG AATCATTGGA TAAAACATTG
 751 GAAGAAGTAC TGGTCAAAGG ATTCAACATC AATCCGTCCG CCTTCGTGCC
 801 TTCCCTGCCC GATGCCGGGC TGAATTTCGA CCTGACCGCC ATCCCGTCGT
 851 TTTCAGACGG CATCGCGCTG GAAGGCTCGC TCGATTTGGA AAACACCAAA
 901 GCCGGCTTTG CCGACCGCAA CGGCATCCCC GTCCGTCAGG TTTTGGGCGG
 951 CTTTGTCATC CGGCAGGACG GCACGGTGCA TATCGGCAAT ACGTCCGCCG
1001 CCCTGCTCGG ACGGGGCGGC ATCAGGCTGT CGGGCAAAAT CGACACCGAA
1051 AAAGACATCC TTGATTTAAA TATAGGCATC AACTCCGTCG GCGCGGAAGA
1101 CGTGCTGCAA ACCGCGTTCA AAGGCAGGTT GGACGGCAGC ATCGGCATCG
1151 GCGGCACGAC CGCCTCGCCC AAAATCTCTT GGCAACTCGG CACCGGCACG
1201 GCACGCACGG ACGGCAGCCt cgcCATCGCA AGCGAcCCCG CAAACGAACA
1251 GCGGAAACTG GTGTTCGACA CCGTCAACAT CTCCGCCGGG GAAGGCAGCC
1301 TGACCGCGCA AGGCTATCTC GAGCTGTTTA AAGACCGCCT GCTCAAGCTG
1351 GACATCCGTT CCCGCGCATT CGACCCTTCG CGCATCGATC CGCAATTTCC
1401 GGCAGGCgat atCAACGGTT CGATTCATCT TGCCGGTGAA CTGGCAAAAG
1451 AGAAATTTAC GGGCAAAATG CGTTTTTTGC CCGGTACGTT CAACGGCGTG
1501 CCGATTGCCG GCAGCGCCGA CATTGTTTAC GAGTCCCGCC ACCTTCCGCG
1551 CGCCGCCGTC GATTTGCGGT TGGGGCGGAA CATCGTCAAA ACAGACGGCG
1601 GCTTCGGCAA AAAAGGCGAC CGGCTTAACC TCAATATCAC CGCACCCGAT
1651 TTATCCCGTT TCGGTTTCGG ACTCGCGGGG TCTTTAAATG TACGCGGACA
1701 CCTTTCCGGC GATTTGGACG GCGGCATCCG AACCTTTGAA ACCGACCTTT
1751 CCGGCACGGC GCGCAACTTA CACATCGGCA AAGCGGCAGA CATCCGTTCG
1801 CTCGATTTTA CCCTCAAAGG CTCACCCGGC ACAAGCCGCC CGATGCGCGC
1851 CGATATCAAG GGCGGCCGCC TTTCCCTGTC GGGCGGCGCG GCGGTTGTCG
1901 ATACCGCCGG CCTGACGCTG GAAGGTACGG GCGCGCAGCA CCGCATCCGC
1951 ACACACGCCG CCATGACGCT GGACGGCAAA CCGTTCAAAC TCGATTTGGA
2001 CGCTTCAGGC GGCATCAACA GGGAACTTAC CCGATGGAAA GGCAGCATCG
2051 GCATCCTCGA CATCGGCGGC GCATTCAACC TCAAGCTGCA AAACCGTATG
2101 ACGCTCGAAG CCGGTGCGGA ACACGTGGCG GCAAGTGCGG CAAATTGGCA
2151 GGCAATGGGC GGCAGCCTCA ACCTGCAACA CTTTTCTTGG GACAGGAAAA
2201 CCGGCATATC GGCAAAAGGC GGCGCACGCG GCCTGCACAT CGCCGAGTTG
2251 CACAATTTCT TCAAACCGCC CTTCGAACAC AATCTGGTTT TAAACGGCGA
2301 CTGGGATGTC GCCTACGGGC ACAACGCGCG CGGCTACCTC AATATCAGCC
2351 GGCAAAGCGG CGATGCCGTA TTGCCCGGCG GGCAGGCTTT GGGTTTGAAC
2401 GCATTTTCCC TGAAAACGCG CTTTCAAAAC GACCGCATCG GAATCCTGCT
```

-continued

2451 TGACGGCGGC GCGCGTTTCG GACGGATTAA CGCCGATTTG GGCATCGGCA

2501 ACGCCTTCGG CGGCAATATG GCAAATACAC CGCTCGGCGG CAGGATTACA

2551 GCCTCCCTTC CCGACTTGGG CGCATTGAAG CCCTTTCTGC CCGCCGCCGC

2601 GCAAAACATT ACCGGCAGCC TGAATGCCTC CGCGCAAATC GGCGGACGGG

2651 TAGGCTCTCC GTCCGTCAAT GCCGCCGTCA ACGGTAGCAG CAACTACGGG

2701 AAAATCAACG GCAATATCAC CGTCGGGCAA AGCCGCTCCT TCGATACCGC

2751 ACCTTTGGGC GGCAGGCTCA ACCTGACCGT TGCCGATGCC GAAGCATTCC

2801 GCAACTTCCT ACCGGTCGGA CAAACCGTCA AAGGCAGCCT GAATGCCGCC

2851 GTAACCCTCG GCGGCAGCAT CGCCGACCCG CACTTGGGCG GCAGTATCAA

2901 CGGCGACAAG CTCTATTACC GCAACCAAAC CCAAGGCATC ATCTTGGACA

2951 ACGGCTCGCT GCGTTCGCAT ATTGCAGGCA GGAAATGGGT AATCGACAGC

3001 CTGAAATTCC GGCACGAAGG GACGGCGGAA CTCTCCGGCA CGGTCAGCAT

3051 GGAAAACAGC GTGCCCGATG TCGATATCGG CGCGGTGTTC GACAAATACC

3101 GCATCCTGTC CCGCCCCAAC CGCCGCCTGA CGGTTTCCGG CAACACCCGC

3151 CTGCGCTATT CGCCGCAAAA AGGCATATCC GTTACCGGTA TGATTAAAAC

3201 TGATCAGGGG CTGTTCGGTT CGCAAAAAATC CTCGATGCCG TCCGTCGGCG

3251 ACGATGTCGT CGTATTGGGC GAAGTCAAGA AAGAGGCGGC GGCATCGCTC

3301 CCCGTCAATA TGAACCTGAC TTTAGACCTC AATGACGGCA TCCGCTTCTC

3351 CGGCTACGGC GCGGACGTTA CCATAGGCGG CAAACTGACC CTGACCGCGC

3401 AACCGGGCGG AAATGTGCGT GGGGTGGGCA CGGTCCGCGT CATCAAAGGG

3451 CGTTACAAAG CATACGGGCA GGATTTAGAC ATTACCAAAG GCACAGTCTC

3501 CTTTGTCGGC CCGCTCAACG ACCCCAACCT GAACATCCGC GCCGAACGCC

3551 GCCTTTCCCC CGTCGGTGCG GGCGTGGAAA TATTGGGCAG CCTCAACAGC

3601 CCGCGCATTA CGCTGACGGC AAACGAACCG ATGAGTGAAA AAGACAAGCT

3651 CTCCTGGCTC ATCCTCAACC GTGCCGGCAG CGGCAGCAGC GGCGACAATG

3701 CCGCCCTGTC CGCAGCCGCA GGCGCGCTGC TTGCCGGGCA AATCAACGAC

3751 CGCATCGGGC TGGTGGATGA TTTGGGCTTT ACCAGCAAGC GCAGCCGCAA

3801 CGCGCAAACC GGCGAACTCA ACCCCGCCGA ACAGGTGCTG ACCGTCGGCA

3851 AACAACTGAC CGGCAAACTC TACATCGGCT ACGAATACGG CATCTCCAGC

3901 GCGGAACAGT CCGTCAAACT GATTTACCGG CTGACCCGCG CCATACAGGC

3951 GGTTGCCCGT ATCGGCAGCC GTTCGTCGGG CGGCGAGCTG ACATACACCA

4001 TACGTTTCGA CCGCCTCTTC GGTTCGGACA AAAAAGACTC CGCAGGAAAC

4051 GGCAAAGGGA AATAA

This corresponds to the amino acid sequence <SEQ ID 1188; ORF 285-1.ng>:

g285-1.pep

1 LKLSAALLSV LILAVCFLGW IAGTEAGLRF GLYQIPSWFG VNISSQNLKG

51 TLLDGFDGDN WSIETEGADL KISRFRFAWK PSELMRRSLH ITDISAGDIA

101 IVTKPTPPKE ERPPQGLPDS IDLPAAVYLD RFETGKISMG KTFDKQTVYL

151 ERLNAAYRYD RKGHRLDLKA ADTPWSSSSG SASVGLKKPF ALDTAIYTKG

-continued

```
 201 GFEGETIHST ARLSGSLKDV RAELTIDGGN IRLSGKSVIH PFAESLDKTL

 251 EEVLVKGFNI NPSAFVPSLP DAGLNFDLTA IPSFSDGIAL EGSLDLENTK

 301 AGFADRNGIP VRQVLGGFVI RQDGTVHIGN TSAALLGRGG IRLSGKIDTE

 351 KDILDLNIGI NSVGAEDVLQ TAFKGRLDGS IGIGGTTASP KISWQLGTGT

 401 ARTDGSLAIA SDPANEQRKL VFDTVNISAG EGSLTAQGYL ELFKDRLLKL

 451 DIRSRAFDPS RIDPQFPAGD INGSIHLAGE LAKEKFTGKM RFLPGTFNGV

 501 PIAGSADIVY ESRHLPRAAV DLRLGRNIVK TDGGFGKKGD RLNLNITAPD

 551 LSRFGFGLAG SLNVRGHLSG DLDGGIRTFE TDLSGTARNL HIGKAADIRS

 601 LDFTLKGSPG TSRPMRADIK GGRLSLSGGA AVVDTAGLTL EGTGAQHRIR

 651 THAAMTLDGK PFKLDLDASG GINRELTRWK GSIGILDIGG AFNLKLQNRM

 701 TLEAGAEHVA ASAANWQAMG GSLNLQHFSW DRKTGISAKG GARGLHIAEL

 751 HNFFKPPFEH NLVLNGDWDV AYGHNARGYL NISRQSGDAV LPGGQALGLN

 801 AFSLKTRFQN DRIGILLDGG ARFGRINADL GIGNAFGGNM ANTPLGGRIT

 851 ASLPDLGALK PFLPAAAQNI TGSLNASAQI GGRVGSPSVN AAVNGSSNYG

 901 KINGNITVGQ SRSFDTAPLG GRLNLTVADA EAFRNFLPVG QTVKGSLNAA

 951 VTLGGSIADP HLGGSINGDK LYYRNQTQGI ILDNGSLRSH IAGRKWVIDS

1001 LKFRHEGTAE LSGTVSMENS VPDVDIGAVF DKYRILSRPN RRLTVSGNTR

1051 LRYSPQKGIS VTGMIKTDQG LFGSQKSSMP SVGDDVVVLG EVKKEAAASL

1101 PVNMNLTLDL NDGIRFSGYG ADVTIGGKLT LTAQPGGNVR GVGTVRVIKG

1151 RYKAYGQDLD ITKGTVSFVG PLNDPNLNIR AERRLSPVGA GVEILGSLNS

1201 PRITLTANEP MSEKDKLSWL ILNRAGSGSS GDNAALSAAA GALLAGQIND

1251 RIGLVDDLGF TSKRSRNAQT GELNPAEQVL TVGKQLTGKL YIGYEYGISS

1301 AEQSVKLIYR LTRAIQAVAR IGSRSSGGEL TYTIRFDRLF GSDKKDSAGN

1351 GKGK*
```

The following partial DNA sequence was identified in *N. meningitidis* <SEQ ID 1189>:

```
m285-1.seq
   1  CTGAAGCTGT CGGCGGCACT GCTGTCTGTC CTGATTTTGG CAGTATGTTT

  51  CCTCGGCTGG CTCGCCGGTA CGGAAGCAGG TTTGCGCTTC GGGCTGTACC

 101  AAATCCCGTC TTGGTTCGGC GTAAACATTT CCTCCCAAAA CCTCAAAGGC

 151  ACGCTGCTCG ACGGCTTCGA CGGCGACAAC TGGTCGATAG AAACCGAGGG

 201  GGCAGACCTT AAAATCAGCC GCTTCCGCTT CGCGTGGAAA CCGTCCGAAC

 251  TGATGCGCCG CAGCCTGCAC ATTACCGAAA TTTCCGCCGG CGACATCGCC

 301  ATCGTTACCA AACCGACTCC GCCTAAAGAA GAACGCCCGC CGCTCAGCCT

 351  TCCCGACAGC ATAGACCTGC CTGCCGCCGT CTATCTCGAC CGCTTCGAGA

 401  CGGGCAAAAT CAGCATGGGC AAAGCCTTTG ACAAACAAAC CGTCTATCTC

 451  GAACGGCTGG ATGCTTCATA CCGTTACGAC CGCAAAGGAC ACCGCCTTGA

 501  CCTGAAGGCC GCCGACACGC CGTGGAGCAG TTCGTCGGGG GCGGCCTCGG

 551  TCGGCTTGAA AAAACCGTTT GCCCTCGATA CCGCCATTTA CACCAAAGGC

 601  GGACTCGAAG GCAAAACCAT ACACAGTACG GCTCGGCTGA GCGGCAGCCT
```

-continued

```
651  GAAGGATGTG CGCGCCGAAC TGGCGATCGA CGGCGGCAAT ATCCGCCTCT
701  CGGGAAAATC CGTCATCCAC CCGTTTGCCG AATCATTGGA TAAAACATTG
751  GAAGAAGTAC TGGTCAAAGG GTTCAACATC AATCCGGCCG CCTTCGTGCC
801  TTCCCTGCCC GATGCCGGAC TGAATTTCGA CCTGACCGCC ATCCCGTCGT
851  TTTCAGACGG CATCGCGCTG GAAGGTTCGC TCGATTTGGA AAACACCAAA
901  GCCGGCTTTG CCGACCGCAA CGGCATCCCC GTCCGTCAGG TTTTAGGCGG
951  CTTTGTCATC CGGCAGGACG GCACGGTGCA TATCGGCAAT ACGTCCGCCG
1001 CCCTGCTCGG ACGGGGCGGC ATCAGGCTGT CGGGCAAAAT CGACACCGAA
1051 AAAGACATCC TCGATTTAAA TATAGGCATC AACTCCGTCG GCGCGGAAGA
1101 CGTACTGCAA ACCGCGTTCA AAGGCAGGTT GGACGGCAGC ATCGGCATCG
1151 GTGGCACGAC CGCCTCGCCC AAAATCTCTT GGCAACTCGG CATCGGCACG
1201 GCGCGCACGG ACGGCAGCCT CGCCATTGCA AGCGACCCAG CAAACGGACA
1251 GCGGAAACTG GTGCTCGACA CCGTCAACAT CGCCGCCGGG CAAGGCAGCC
1301 TGACCGCGCA AGGCTATCTC GAGCTGTTTA AAGACCGCCT GCTCAAGCTG
1351 GACATCCGTT CCCGCGCATT CGACCCTTCG CGCATCGATC CGCAACTTCC
1401 GGCAGGCAAT ATCAACGGCT CAATAAACCT TGCCGGCGAA CTGGCAAAAG
1451 AGAAATTCAC AGGCAAAATG CGGTTTTTAC CCGGCACGTT CAACGGCGTA
1501 CCGATTGCCG GCAGTGCCGA CATTGTTTAC GAGTCCCGCC ACCTTCCGCG
1551 TGCCGCCGTC GATTTGCGGC TGGGGCGGAA CATTATTAAA ACAGACGGCG
1601 GCTTCGGCAA AAAAGGCGAC CGGCTTAACC TCAATATCAC CGCACCCGAT
1651 TTATCCCGTT TCGGTTTCGG ACTCGCGGGG TCTTTAAATG TACGCGGACA
1701 CCTTTCCGGT GATTTGGACG GCGGCATCCG AACCTTTGAA ACCGACCTTT
1751 CCGGCGCGGC GCGCAACCTG CACATCGGCA AGGCGGCAGA CATCCGTTCG
1801 CTCGATTTCA CGCTCAAAGG TTCGCCCGAC ACAAGCCGCC CGATACGCGC
1851 CGACATCAAA GGCAGCCGCC TTTCGCTGTC GGGCGGAGCG GCGGTTGTCG
1901 ATACCGCCGA CCTGATGCTG GACGGCACGG GCGTGCAGCA CCGCATCCGC
1951 ACACACGCCG CCATGACGCT GGATGGCAAA CCGTTCAAAT TCGATTTGGA
2001 CGCTTCAGGC GGCATCAACA GGGAACTTAC CCGATGGAAA GGCAGCATCG
2051 GCATCCTCGA CATCGGCGGC GCATTCAACC TCAAGCTGCA AAACCGTATG
2101 ACGCTCGAAG CCGGTGCGGA ACGCGTGGCG GCAAGTGCGG CAAATTGGCA
2151 GGCAATGGGC GGCAGCCTCA ACCTGCAACA CTTTTCTTGG GATAAAAAAA
2201 CCGGCATATC GGCAAAAGGC GGCGCACACG GTCTGCATAT CGCCGAGTTG
2251 CACAATTTCT TCAAACCGCC CTTCGAACAC AATCTGGTTT TAAACGGCGA
2301 CTGGGATGTC GCCTACGGGC GCAACGCGCG CGGCTACCTC AATATCAGCC
2351 GGCAAAGCGG CGATGCCGTA TTGCCCGGCG GGCAGGCTTT GGGTTTGAAC
2401 GCATTTTCCC TGAAAACGCG CTTTCAAAAC GACCGCATCG GAATCCTGCT
2451 TGACGGCGGC GCGCGTTTCG GGCGGATTAA CGCCGATTTG GGCATCGCCA
2501 ACGCCTTCGG CGGCAATATG GCAAATGCAC CGCTCGGCGG CAGGATTACC
2551 GCCTCCCTTC CCGACTTGGG CGCATTGAAG CCCTTTCTGC CCGCCGCCGC
2601 GCAAAACATT ACCGGCAGCC TGAATGCCGC CGCGCAAATC GGCGGACGGG
2651 TAGGCTCTCC GTCCGTCAAT GCCGCCGTCA ACGGCAGCAG CAACTACGGG
```

-continued

```
2701 AAAATCAACG GCAACATCAC CGTCGGGCAA AGCCGCTCTT TCGATACCGC
2751 GCCTTTGGGC GGCAGGCTCA ACCTGACCGT TGCCGATGCC GAAGTATTCC
2801 GCAACTTCCT ACCGGTCGGA CAAACCGTCA AAGGCAGCCT GAATGCCGCC
2851 GTAACCCTCG GCGGCAGCAT CGCCGATCCG CACTTGGGCG GCAGCATCAA
2901 CGGCGACAAA CTCTATTACC GCAACCAAAC CCAAGGCATC ATCTTGGACA
2951 ACGGCTCGCT GCGTTCGCAT ATCGCGGGCA GGAAATGGGT AATCGACAGC
3001 CTGAAATTCC GGCACGAAGG GACGGCGGAA CTCTCCGGTA CGGTCGGTAT
3051 GGAAAACAGC GGACCCGATG TCGATATCGG CGCGGTGTTC GACAAATACC
3101 GCATCCTGTC CCGCCCCAAC CGCCGCCTGA CGGTTTCCGG CAACACCCGC
3151 CTGCGCTATT CGCCGCAAAA AGGCATATCC GTTACCGGGA TGATTAAAAC
3201 GGATCAGGGG CTGTTCGGTT CGCAAAAATC CTCGATGCCG TCCGTCGGCG
3251 ACGATGTCGT CGTATTAGGC GAAGTCAAAA AAGAGGCGGC GGCACCGCTC
3301 CCCGTCAATA TGAACCTGAC TTTAGACCTC AATGACGGCA TCCGCTTCGC
3351 CGGCTACGGC GCGGACGTTA CCATAGGCGG CAAACTGACC CTGACCGCCC
3401 AATCGGGCGG AAGCGTACGG GGCGTGGGCA CGGTCCGCGT CATCAAAGGG
3451 CGTTATAAGG CATACGGGCA GGATTTGGAC ATTACCAAAG GCACGGTCTC
3501 CTTTGTCGGC CCGCTCAACG ATCCCAACCT CAACATCCGC GCCGAACGCC
3551 GCCTTTCCCC CGTCGGTGCG GGCGTGGAAA TATTGGGCAG CCTCAACAGC
3601 CCGCGCATTA CGCTGACGGC AAACGAACCG ATGAGTGAAA AAGACAAGCT
3651 CTCTTGGCTC ATCCTCAACC GCGCCGGCAG CGGCAGCAGC GGCGACAATG
3701 CCGCCCTGTC TGCAGCCGCA GGTGCGCTGC TTGCCGGGCA AATCAACGAC
3751 CGCATCGGGC TGGTGGATGA TTTGGGCTTT ACCAGCAAGC GCAGCCGCAA
3801 CGCGCAAACC GGCGAACTCA ACCCCGCCGA ACAGGTGCTG ACCGTCGGCA
3851 AACAACTGAC CGGCAAACTC TACATCGGCT ACGAATACAG CATCTCCAGC
3901 GCGGAACAGT CCGTCAAACT GATTTACCGG CTGACCCGCG CCATACAGGC
3951 GGTTGCCCGT ATCGGCAGCC GTTCGTCGGG CGGCGAGCTG ACATACACCA
4001 TACGTTTCGA CCGCTTCTCC GGTTCGGACA AAAAAGACTC CGCCGGAAAC
4051 GGCAAAGGAA AATAA
```

This corresponds to the amino acid sequence <SEQ ID 1190; ORF 285-1>:

m285-1.pep

```
  1 LKLSAALLSV LILAVCFLGW LAGTEAGLRF GLYQIPSWFG VNISSQNLKG
 51 TLLDGFDGDN WSIETEGADL KISRFRFAWK PSELMRRSLH ITEISAGDIA
101 IVTKPTPPKE ERPPLSLPDS IDLPAAVYLD RFETGKISMG KAFDKQTVYL
151 ERLDASYRYD RYGHRLDLKA ADTPWSSSSG AASVGLKKPF ALDTAIYTKG
201 GLEGKTIHST ARLSGSLKDV RAELAIDGGN IRLSGKSVIH PFAESLDKTL
251 EEVLVKGFNI NPAAFVPSLP DAGLNFDLTA IPSFSDGIAL EGSLDLENTK
301 AGFADRNGIP VRQVLGSFVI RQDGTVHIGN TSAALLGRGG IRLSGKIDTE
351 KDILDLNIGI NSVGAEDVLQ TAFKGRLDGS IGIGGTTASP KISWQLGIGT
401 ARTDGSLAIA SDPANGQRKL VLDTVNIAAG QGSLTAQGYL ELFKDRLLKL
```

-continued

```
 451  DIRSRAFDPS RIDPQLPAGN INGSINLAGE LAKEKFTGKM RFLPGTFNGV

 501  PIAGSADIVY ESRHLPRAAV DLRLGRNIIK TDGGFGKKGD RLNLNITAPD

 551  LSRFGFGLAG SLNVRGHLSG DLDGGIRTFE TDLSGAARNL HIGKAADIRS

 601  LDFTLKGSPD TSRPIRADIK GSRLSLSGGA AVVDTADLML DGTGVQHRIR

 651  THAAMTLDGK PFKFDLDASG GINRELTRWK GSIGILDIGG AFNLKLQNRM

 701  TLEAGAERVA ASAANWQAMG GSLNLQHFSW DKKTGISAKG GAHGLHIAEL

 751  HNFFKPPFEH NLVLNGDWDV AYGRNARGYL NISRQSGDAV LPGGQALGLN

 801  AFSLKTRFQN DRIGILLDGG ARFGRINADL DIGNAFGGNM ANAPLGGRIT

 851  ASLPDLGALK PFLPAAAQNI TGSLNAAAQI GGRVGSPSVN AAVNGSSNYG

 901  KINGNITVGQ SRSFDTAPLG GRLNLTVADA EVFRNFLPVG QTVKGSLNAA

 951  VTLGGSIADP HLGGSINGDK LYYRNQTQGI ILDNGSLRSH IAGRKWVIDS

1001  LKFRHEGTAE LSGTVGMENS GPDVDIGAVF DKYRILSRPN RRLTVSGNTR

1051  LRYSPQKGIS VTGMIKTDQG LFGSQKSSMP SVGDDVVVLG EVKKEAAAPL

1101  PVNMNLTLDL NDGIRFAGYG ADVTIGGKLT LTAQSGGSVR GVGTVRVIKG

1151  RYKAYGQDLD ITKGTVSFVG PLNDPNLNIR AERRLSPVGA GVEILGSLNS

1201  PRITLTANEP MSEKDKLSWL ILNRAGSGSS GDNAALSAAA GALLAGQIND

1251  RIGLVDDLGF TSKRSRNAQT GELNPAEQVL TVGKQLTGKL YIGYEYSISS

1301  AEQSVKLIYR LTRAIQAVAR IGSRSSGGEL TYTIRFDRFS GSDKKDSAGN

1351  GKGK*
```

g285-1/m285-1  96.5% identity in 1354 aa overlap

```
                      10        20        30        40        50        60
g285-1.pep    LKLSAALLSVLLLAVCFLGWIAGTEAGLRFGLYQIPSWFGVNISSQNLKGTLLDGFDGDN
              ||||||||||||||||||||:|||||||||||||||||||||||||||||||||||||||
m285-1        LKLSAALLSVLILAVCFLGWLAGTEAGLRFGLYQIPSWFGVNISSQNLKGTLLDGFDGDN
                      10        20        30        40        50        60

                      70        80        90       100       110       120
g285-1.pep    WSIETEGADLKISRFRFAWKPSELMRRSLHITDISAGDIAIVTKPTPPKEERPPQGLPDS
              ||||||||||||||||||||||||||||||||:||||||||||||||||||||| :||||
m285-1        WSIETEGADLKISRFRFAWKPSELMRRSLHITEISAGDIAIVTKPTPPKEERPPLSLPDS
                      70        80        90       100       110       120

                     130       140       150       160       170       180
g285-1.pep    IDLPAAVYLDRFETGKISMGKTFDKQTVYLERLNAAYRYDRKGHRLDLKAADTPWSSSSG
              |||||||||||||||||||||:|||||||||||:|:||||||||||||||||||||||||
m285-1        IDLPAAVYLDRFETGKISMGKAFDKQTVYLERLDASYRYDRKGHRLDLKAADTPWSSSSG
                     130       140       150       160       170       180

                     190       200       210       220       230       240
g285-1.pep    SASVGLKKPFALDTAIYTKGGFEGETIHSTARLSGSLKDVRAELTIDGGNIRLSGKSVIH
              :||||||||||||||||||||:||:|||||||||||||||||||:|||||||||||||||
m285-1        AASVGLKKPFALDTAIYTKGGLEGKTIHSTARLSGSLKDVRAELAIDGGNIRLSGKSVIH
                     190       200       210       220       230       240

                     250       260       270       280       290       300
g285-1.pep    PFAESLDKTLEEVLVKGFNINPSAFVPSLPDAGLNFDLTAIPSFSDGIALEGSLDLENTK
              ||||||||||||||||||||||:|||||||||||||||||||||||||||||||||||||
m285-1        PFAESLDKTLEEVLVKGFNINPAAFVPSLPDAGLNFDLTAIPSFSDGIALEGSLDLENTK
                     250       260       270       280       290       300

                     310       320       330       340       350       360
g285-1.pep    AGFADRNGIPVRQVLGGFVIRQDGTVHIGNTSAALLGRGGIRLSGKIDTEKDILDLNIGI
              ||||||||||||||||||||||||||||||||||||||||||||||||||||||||||||
m285-1        AGFADRNGIPVRQVLGSFVIRQDGTVHIGNTSAALLGRGGIRLSGKIDTEKDILDLNIGI
                     310       320       330       340       350       360

                     370       380       390       400       410       420
g285-1.pep    NSVGAEDVLQTAFKGRLDGSIGIGGTTASPKISWQLGIGTARTDGSLAIASDPANGQRKL
              ||||||||||||||||||||||||||||||||||||||||||||||||||||||||||||
m285-1        NSVGAEDVLQTAFKGRLDGSIGIGGTTASPKISWQLGIGTARTDGSLAIASDPANGQRKL
                     370       380       390       400       410       420

                     430       440       450       460       470       480
g285-1.pep    VLDTVNIAAGQGSLTAQGYLELFKDRLLKLDIRSRAFDPSRIDPQFPAGDINGSIHLAGE
              |||||||||||||||||||||||||||||||||||||||||||||:|||:|||||:||||
m285-1        VLDTVNIAAGQGSLTAQGYLELFKDRLLKLDIRSRAFDPSRIDPQLPAGNINGSINLAGE
                     430       440       450       460       470       480
```

-continued

```
                   490       500       510       520       530       540
g285-1.pep   LAKEKFTGKMRPLPGTFNGVPIAGSADIVYESRHLPRAAVDLRLGRNIVKTDGGFGKKGD
             ||||||||||||||||||||||||||||||||||||||||||||||||:|||||||||||
m285-1       LAKEKFTGKMRFLPGTFNGVPIAGSADIVYESRHLPRAAVDLRLGRNIIKTDGGFGKKGD
                   490       500       510       520       530       540

                   550       560       570       580       590       600
g285-1.pep   RLNLNITAPDLSRFGFGLAGSLNVRGHLSGDLDGGIRTFFTDLSGTARNLHIGKAADIRS
             |||||||||||||||||||||||||||||||||||||||||||||:||||||||||||||
m285-1       RLNLNITAPDLSRFGFGLAGSLNVRGHLSGDLDGGIRTFFTDLSGAARNLHIGKAADIRS
                   550       560       570       580       590       600

                   610       620       630       640       650       660
g285-1.pep   LDFTLKGSPGTSRPMRADIKGGRLSLSGGAAVVDTAGLTLEGTGAQHRIRTHAAMTLDGK
             ||||||||| ||||:||||||:|||||||||||||| | |:|||:|||||||||||||||
m285-1       LDFTLKGSPDTSRPIRADIKGSRLSLSGGAAVVDTADLMLDGTGVQHRIRTHAAMTLDGK
                   610       620       630       640       650       660

                   670       680       690       700       710       720
g285-1.pep   PFKLDLDASGGINRELTRWKGSIGILDIGGAFNLKLQNRMTLEAGAEHVAASAANWQAMG
             |||:|||||||||||||||||||||||||||||||||||||||||||||:||||||||||||
m285-1       PFKFDLDASGGINRELTRWKGSIGILDIGGAFNLKLQNRMTLEAGAERVAASAANWQAMG
                   670       680       690       700       710       720

                   730       740       750       760       770       780
g285-1.pep   GSLNLQHFSWDRKTGISAKGGARGLHIAELHNFFKPPFEHNLVLNGDWDVAYGHNARGYL
             |||||||||||:|||||||||||||||||||||||||||||||||||||||||:||||||
m285-1       GSLNLQHFSWDKKTGISAKGGAHGLHIAELHNFFKPPFEHNLVLNGDWDVAYGRNARGYL
                   730       740       750       760       770       780

                   790       800       810       820       830       840
g285-1.pep   NISRQSGDAVLPGGQALGINAFSLKTRFQNDRIGILLDGGARFGRINADLGIGNAFGGNM
             ||||||||||||||||||||||||||||||||||||||||||||||||||||:|||||||
m285-1       NISRQSGDAVLPGGQALGLNAFSLKTRFQNDRIGILLDGGARFGRINADLGIANAFGGNM
                   790       800       810       820       830       840

                 850       860       870       880       890       900
g285-1.pep   ANTPLGGRITASLPDLGALKPFLPAAAQNITGSLNASAQIGGRVGSPSVNAAVNGSSNYG
             ||:|||||||||||||||||||||||||||||||||:|||||||||||||||||||||||
m285-1       ANAPLGGRITASLPDLGALKPFLPAAAQNITGSLNAAAQIGGRVGSPSVNAAVNGSSNYG
                 850       860       870       880       890       900

                   910       920       930       940       950       960
g285-1.pep   KINGNITVGQSRSFDTAPLGGRLNLTVADAEAFRNFLPVGQTVKGSLNAAVTLGGSIADP
             |||||||||||||||||||||||||||||||:||||||||||||||||||||||||||||
m285-1       KINGNITVGQSRSFDTAPLGGRLNLTVADAEVFRNFLPVGQTVKGSLNAAVTLGGSIADP
                   910       920       930       940       950       960

                   970       980       990      1000      1010      1020
g285-1.pep   HLGGSINGDKLYYRNQTQGIILDNGSLRSHIAGRKWVIDSLKFRHEGTAELSGTVSMENS
             |||||||||||||||||||||||||||||||||||||||||||||||||||||||:||||
m285-1       HLGGSINGDKLYYRNQTQGIILDNGSLRSHIAGRKWVIDSLKFRHEGTAELSGTVGMENS
                   970       980       990      1000      1010      1020

                  1030      1040      1050      1060      1070      1080
g285-1.pep   VPDVDIGAVFDKYRILSRPNRRLTVSGNTRLRYSPQKGISVTGMIKTDQGLFGSQKSSMP
              |||||||||||||||||||||||||||||||||||||||||||||||||||||||||||
m285-1       GPDVDIGAVFDKYRILSRPNRRLTVSGNTRLRYSPQKGISVTGMIKTDQGLFGSQKSSMP
                  1030      1040      1050      1060      1070      1080

                  1090      1100      1110      1120      1130      1140
g285-1.pep   SVGDDVVVLGEVKKEAAASLPVNMNLTLDLNDGIRFSGYGADVTIGGKLTLTAQPGGNVR
             |||||||||||||||||| |||||||||||||||||:||||||||||||||||| ||:||
m285-1       SVGDDVVVLGEVKKEAAAPLPVNMNLTLDLNDGIRFAGYGADVTIGGKLTLTAQSGGSVR
                  1090      1100      1110      1120      1130      1140

                  1150      1160      1170      1180      1190      1200
g285-1.pep   GVGTVRVIKGRYKAYGQDLDITKGTVSFVGPLNDPNLNIRAERRLSPVGAGVEILGSLNS
             ||||||||||||||||||||||||||||||||||||||||||||||||||||||||||||
m285-1       GVGTVRVIKGRYKAYGQDLDITKGTVSFVGPLNDPNLNIRAERRLSPVGAGVEILGSLNS
                  1150      1160      1170      1180      1190      1200

                  1210      1220      1230      1240      1250      1260
g285-1.pep   PRITLTANEPMSEKDKLSWLILNRAGSGSSGDNAALSAAAGALLAGQINDRIGLVDDLGF
             ||||||||||||||||||||||||||||||||||||||||||||||||||||||||||||
m285-1       PRITLTANEPMSEKDKLSWLILNRAGSGSSGDNAALSAAAGALLAGQINDRIGLVDDLGF
                  1210      1220      1230      1240      1250      1260

                  1270      1280      1290      1300      1310      1320
g285-1.pep   TSKRSRNAQTGELNPAEQVLTVGKQLTGKLYIGYEYGISSAEQSVKLIYRLTRAIQAVAR
             ||||||||||||||||||||||||||||||||||||:|||||||||||||||||||||||
m285-1       TSKRSRNAQTGELNPAEQVLTVGKQLTGKLYIGYEYSISSAEQSVKLIYRLTRAIQAVAR
                  1270      1280      1290      1300      1310      1320

                  1330      1340      1350
g285-1.pep   IGSRSSGGELTYTIRFDRLFGSDKKDSAGNGKGK
             ||||||||||||||||||: ||||||||||||||
m285-1       IGSRSSGGELTYTIRFDRFSGSDKKDSAGNGKGKX
                  1330      1340      1350
```

The following partial DNA sequence was identified in *N. meningitidis* <SEQ ID 1191>:

```
a285-1.seq
   1  CTGAAGCTGT CGGCGGCACT GCTGTCTGTT CTGATTTTGG CAGTATGTTT

  51  CCTCGGCTGG CTCGCCGGCA CGGAAGCGGG TTTGCGCTTC GGGCTGTACC

 101  AAATCCCGTC TTGGTTCGGC GTAAACATTT CCTCCCAAAA CCTCAAAGGC

 151  ACGCTGCTCG ACGGCTTCGA CGGCGACAAC TGGTCGATAG AAACCGAGGG

 201  GGCAGACCTT AAAATCAGCC GCTTCCGCTT CGCGTGGAAA CCGTCCGAAC

 251  TGATGCGCCG CAGCCTGCAC ATTACCGAAA TTTCCGCCGG CGACATCGCC

 301  ATCGTTACCA AACCGACTCC GCCTAAAGAA GAACGCCCGC CGCTCAGCCT

 351  TCCCGACAGC ATAGACCTGC CTGCCGCCGT CTATCTCGAC CGCTTCGAGA

 401  CGGGCAAAAT CAGCATGGGC AAAGCCTTTG ACAAACAAAC CGTCTATCTC

 451  GAACGGCTGG ATGCTTCATA CCGTTACGAC CGCAAAGGAC ACCGCCTCGA

 501  CCTGAAGGCT GCCGACACGC CGTGGAGCAG TTCGTCGGGG TCAGCCTCGG

 551  TCGGCTTGAA AAAACCGTTT GCCCTCGATA CCGCCATTTA CACCAAAGGC

 601  GGACTCGAAG GCAAAACCAT ACACAGTACG GCTCGGCTGA GCGGCAGCCT

 651  GAAGGATGTG CGCGCCGAAC TGGCGATCGA CGGCGGCAAT ATCCGCCTCT

 701  CGGGAAAATC CGTCATCCAC CCGTTTGCCG AATCATTGGA TAAAACATTG

 751  GAAGAAGTAC TGGTCAAAGG GTTCAACATC AATCCGTCCG CCTTCGTGCC

 801  TTCCCTGCCC GATGCCGGGC TGAATTTCGA CCTGACCGCC ATCCCGTCGT

 851  TTTCAGACGG CATCGCGCTG GAAGGCTCGC TCGATTTGGA AAACACCAAA

 901  GCCGGCTTTG CCGACCGCAA CGGCATCCCC GTCCGTCAGG TTTTAGGCAG

 951  CTTTGTCATC CGGCAGGACG GCACGGTGCA TATCGGCAAT ACGTCCGTCG

1001  CCCTGCTCGG ACGGGGCGGC ATCAGGCTGT CGGGCAAAAT CGACACCGAA

1051  AAAGACATCC TCGATTTAAA TATAGGCATC AACTCCGTCG GCGCGGAAGA

1101  CGTACTGCAA ACCGCGTTCA AAGGCAGGTT GGACGGCAGC ATCGGCATCG

1151  GTGGCACGAC CGCCTCGCCC AAAATCTCTT GGCAACTCGG CATCGGCACG

1201  GCGCGCACGG ACGGCAGCCT CGCCATTGCA AGCGACCCCG CAAACGGACA

1251  GCGGAAACTG GTGCTCGACA CCGTCAACAT CGCCGCCGGG CAAGGCAGCC

1301  TGACCGCGCA AGGCTATCTC GAGCTGTTTA AAGACCGCCT GCTCAAGCTG

1351  GACATCCGTT CCCGCGCATT CGACCCTTCG CGCATCGATC CGCAACTTCC

1401  GGCAGGCAAT ATCAACGGCT CAATAAACCT TGCCGGCGAA CTGGCAAAAG

1451  AGAAATTCAC AGGCAAAATG CGGTTTTTAC CCGGCACGTT CAACGGCGTA

1501  CCGATTGCCG GCAGTGCCGA CATTGTTTAC GAGTCCCGCC ACCTTCCGCG

1551  TGCCGCCGTC GATTTGCGGC TGGGGCGGAA CATTATTAAA ACAGACGGCG

1601  GCTTCGGCAA AAAAGGCGAC CGGCTTAACC TCAATATCAC CGCACCCGAT

1651  TTATCCCGTT TCGGTTTCGG ACTCGCGGGG TCTTTAAATG TACGCGGACA

1701  CCTTTCCGGC GATTTGGACG GTGGCATCCG AACCTTTGAA ACCGACCTTT

1751  CCGGCGCGGC GCGCAACCTG CACATCGGCA AGGCGGCAGA CATCCGTTCG

1801  CTCGATTTCA CGCTCAAAGG TTCGCCCGAC ACAAGCCGCC CGATACGCGC

1851  CGACATCAAA GGCAGCCGCC TTTCGCTGTC GGGCGGAGCG GAGGTTGTCG

1901  ATACCGCCGA CCTGATGCTG GACGGCACGG GCGTGCAGCA CCGCATCCGC
```

-continued

1951 ACACACGCCG CCATGACGCT GGATGGCAAA CCGTTCAAAT TCGATTTGGA

2001 CGCTTCAGGC GGCATCAACA GGGAACTTAC CCGATGGAAA GGCAGCATCG

2051 GCATCCTCGA CATCGGCGGC GCATTCAACC TCAAGCTGCA AAACCGTATG

2101 ACGCTCGAAG CCGGTGCGGA ACGCGTGGCG GCAAGTGCGG CAAATTGGCA

2151 GGCAATGGGC GGCAGCCTCA ACCTGCAACA CTTTTCTTGG GATAAAAAAA

2201 CCGGCATATC GGCAAAAGGC GGCGCACACG GTCTGCATAT CGCCGAGTTG

2251 CACAATTTCT TCAAACCGCC CTTCGAACAC AATCTGGTTT TAAACGGCGA

2301 CTGGGATGTC GCCTACGGGC GAAACGCGCG CGGCTACCTC AATATCAGCC

2351 GGCAAAGCGG CGATGCCGTA TTGCCCGGCG GGCAGGCTTT GGGTTTGAAC

2401 GCATTTTCCC TGAAAACGCG CTTTCAAAAC GACCGTATCG GAATCCTGCT

2451 TGACGGCGGC GCGCGTTTCG GGCGGATTAA CGCCGATTTG GACATCGGCA

2501 ACGCCTTCGG CGGCAATATG GCAAATGCAC CGCTCGGCGG CAGGATTACC

2551 GCCTCCCTTC CCGACTTGGG CACATTGAAG CCCTTTCTGC CCGCCGCCGC

2601 GCAAAACATT ACCGGCAGCC TGAATGCCGC CGCGCAAATC GGCGGACGGG

2651 TCGGCTCTCC GTCCGTCAAT GCCGCCGTCA ACGGCAGCAG CAACTACGGG

2701 AAAATCAACG GCAACATCAC CGTCGGGCAA AGCCGCTCTT TCGATACCGC

2751 GCCTTTGGGC GGCAGGCTCA ACCTGACCGT TGCCGATGCC GAAGTATTCC

2801 GCAACTTCCT ACCGGTCGGA CAAACCGTCA AAGGCAGCCT GAATGCCGCC

2851 GTAACCCTCG GCGGCAGCAT CGCCGATCCG CACTTGGGCG GCAGCATCAA

2901 CGGCGACAAA CTCTATTACC GCAACCAAAC CCAAGGCATC ATCTTGGACA

2951 ACGGCTCGCT GCGTTCGCAT ATCGCGGGCA GGAAATGGGT AATCGACAGC

3001 CTGAAATTCC GGCACGAAGG GACGGCGGAA CTCTCCGGTA CGGTCGGTAT

3051 GGAAAACAGC GGACCCGATG TCGATATCGG CGCGGTGTTC GACAAATACC

3101 GCATCCTGTC CCGCCCCAAC CGCCGCCTGA CGGTTTCCGG CAACACCCGC

3151 CTGCGCTATT CGCCGCAAAA AGGCATATCC GTTACCGGGA TGATTAAAAC

3201 GGATCAGGGG CTGTTCGGTT CGCAAAAATC CTCGATGCCG TCCGTCGGCG

3251 ACGATGTCGT CGTATTAGGC GAAGTCAAAA AAGAGGCGGC GGCACCGCTC

3301 CCCGTCAATA TGAACCTGAC TTTAGACCTC AATGACGGCA TCCGCTTCGC

3351 CGGCTACGGC GCGGACGTTA CCATAGGCGG CAAACTGACC CTGACCGCCC

3401 AATCGGGCGG AAGCGTGCGG GGCGTGGGCA CGGTCCGCGT CATCAAAGGG

3451 CGTTATAAGG CATACGGGCA GGATTTGGAC ATTACCAAAG GCACGGTCTC

3501 CTTTGTCGGC CCGCTCAACG ACCCCAACCT CAACATCCGC GCCGAACGCC

3551 GCCTTTCCCC CGTCGGTGCG GGCGTGGAAA TATTGGGCAG CCTCAACAGT

3601 CCGCGCATTA CGCTGACGGC AAACGAACCG ATGAGTGAAA AAGACAAGCT

3651 CTCCTGGCTC ATCCTCAACC GCGCCGGCAG TGGCAGCAGC GGCGACAATG

3701 CCGCCCTGTC CGCAGCCGCC GGCGCGCTGC TTGCCGGGCA AATCAACGAC

3751 CGCATCGGGC TGGTGGATGA TTTGGGCTTT ACCAGCAAGC GCAGCCGCAA

3801 CGCGCAAACC GGCGAACTCA ACCCCGCCGA ACAGGTGCTG ACCGTCGGCA

3851 AACAACTGAC CGGCAAACTC TACATCGGCT ACGAATACAG CATCTCCAGC

3901 GCGGAACAGT CCGTCAAACT GATTTACCGG CTGACCCGCG CCATACAGGC

-continued

```
3951 GGTTGCCCGT ATCGGCAGCC GTTCGTCGGG CGGCGAGCTG ACATACACCA

4001 TACGTTTCGA CCGCTTCTCC GGTTCGGACA AAAAAGACTC CGCCGGAAAC

4051 AGCAAAGGAA AATAA
```

This corresponds to the amino acid sequence <SEQ ID 1192; ORF 285-1.a>:

```
a285-1.pep

   1  LKLSAALLSV LILAVCFLGW LAGTEAGLRF GLYQIPSWFG VNISSQNLKG

  51  TLLDGFDGDN WSIETEGADL KISRFRFAWK PSELMRRSLH ITEISAGDIA

 101  IVTKPTPPKE ERPPLSLPDS IDLPAAVYLD RFETGKISMG KAFDKQTVYL

 151  ERLDASYRYD RYGHRLDLKA ADTPWSSSSG SASVGLKKPF ALDTAIYTKG

 201  GLEGKTIHST ARLSGSLKDV RAELAIDGGN IRLSGKSVIH PFAESLDKTL

 251  EEVLVKGFNI NPSAFVPSLP DAGLNFDLTA IPSFSDGIAL EGSLDLENTK

 301  AGFADRNGIP VRQVLGSFVI RQDGTVHIGN TSVALLGRGG IRLSGKIDTE

 351  KDILDLNIGI NSVGAEDVLQ TAFKGRLDGS IGIGGTTASP KISWQLGIGT

 401  ARTDGSLAIA SDPANGQRKL VLDTVNIAAG QGSLTAQGYL ELFKDRLLKL

 451  DIRSRAFDPS RIDPQLPAGN INGSINLAGE LAKEKFTGKM RFLPGTFNGV

 501  PIAGSADIVY ESRHLPRAAV DLRLGRNIIK TDGGFGKKGD RLNLNITAPD

 551  LSRFGFGLAG SLNVRGHLSG DLDGGIRTFE TDLSGAARNL HIGKAADIRS

 601  LDFTLKGSPD TSRPIRADIK GSRLSLSGGA EVVDTADLML DGTGVQHRIR

 651  THAAMTLDGK PFKFDLDASG GINRELTRWK GSIGILDIGG AFNLKLQNRM

 701  TLEAGAERVA ASAANWQAMG GSLNLQHFSW DKKTGISAKG GAHGLHIAEL

 751  HNFFKPPFEH NLVLNGDWDV AYGRNARGYL NISRQSGDAV LPGGQALGLN

 801  AFSLKTRFQN DRIGILLDGG ARFGRINADL DIGNAFGGNM ANAPLGGRIT

 851  ASLPDLGTLK PFLPAAAQNI TGSLNAAAQI GGRVGSPSVN AAVNGSSNYG

 901  KINGNITVGQ SRSFDTAPLG GRLNLTVADA EVFRNFLPVG QTVKGSLNAA

 951  VTLGGSIADP HLGGSINGDK LYYRNQTQGI ILDNGSLRSH IAGRKWVIDS

1001  LKFRHEGTAE LSGTVGMENS GPDVDIGAVF DKYRILSRPN RRLTVSGNTR

1051  LRYSPQKGIS VTGMIKTDQG LFGSQKSSMP SVGDDVVVLG EVKKEAAAPL

1101  PVNMNLTLDL NDGIRFAGYG ADVTIGGKLT LTAQSGGSVR GVGTVRVIKG

1151  RYKAYGQDLD ITKGTVSFVG PLNDPNLNIR AERRLSPVGA GVEILGSLNS

1201  PRITLTANEP MSEKDKLSWL ILNRAGSGSS GDNAALSAAA GALLAGQIND

1251  RIGLVDDLGF TSKRSRNAQT GELNPAEQVL TVGKQLTGKL YIGYEYSISS

1301  AEQSVKLIYR LTRAIQAVAR IGSRSSGGEL TYTIRFDRFS GSDKKDSAGN

1351  SKGK*
```

```
a285-1/m285-1  99.3% identity in 1354 aa overlap

                       10        20        30        40        50        60
a285-1.pep     LKLSAALLSVLLLAVCFLGWLAGTEAGLRFGLYQIPSWFGVNISSQNLKGTLLDGFDGDN
               ||||||||||||||||||||||||||||||||||||||||||||||||||||||||||||
m285-1         LKLSAALLSVLILAVCFLGWLAGTEAGLRFGLYQIPSWFGVNISSQNLKGTLLDGFDGDN
                       10        20        30        40        50        60

                       70        80        90       100       110       120
a285-1.pep     WSIETEGADLKISRFRFAWKPSELMRRSLHITEISAGDIAIVTKPTPPKEERPPLSLPDS
               ||||||||||||||||||||||||||||||||||||||||||||||||||||||||||||
m285-1         WSIETEGADLKISRFRFAWKPSELMRRSLHITEISAGDIAIVTKPTPPKEERPPLSLPDS
                       70        80        90       100       110       120
```

-continued

```
                         130       140       150       160       170       180
a285-1.pep        IDLPAAVYLDRFETGKISMGKAFDKQTVYLERLDASYRYDRKGHRLDLKAADTPWSWSSG
                  ||||||||||||||||||||||||||||||||||||||||||||||||||||||||||||
m285-1            IDLPAAVYLDRFETGKISMGKAFDKQTVYLERLDASYRYDRKGHRLDLKAADTPWSWSSG
                         130       140       150       160       170       180

                         190       200       210       220       230       240
a285-1.pep        SASVGLKKPFALDTAIYTKGGLEGKTIHSTARLSGSLKDVRAELAIDGGNIRLSGKSVIH
                  :|||||||||||||||||||||||||||||||||||||||||||||||||||||||||||
m285-1            AASVGLKKPFALDTAIYTKGGLEGKTIHSTARLSGSLKDVRAELAIDGGNIRLSGKSVIH
                         190       200       210       220       230       240

                         250       260       270       280       290       300
a285-1.pep        PFAESLDKTLEEVLVKGFNINPSAFVPSLPDAGLNFDLTAIPSFSDGIALEGSLDLENTK
                  ||||||||||||||||||||||:|||||||||||||||||||||||||||||||||||||
m285-1            PFAESLDKTLEEVLVKGFNINPAAFVPSLPDAGLNFDLTAIPSFSDGIALEGSLDLENTK
                         250       260       270       280       290       300

                         310       320       330       340       350       360
a285-1.pep        AGFADRNGIPVRQVLGSFVIRQDGTVHIGNTSVALLGRGGIRLSGKIDTEKDILDLNIGI
                  ||||||||||||||||:|||||||||||||||:|||||||||||||||||||||||||||
m285-1            AGFADRNGIPVRQVLGGFVIRQDGTVHIGNTSAALLGRGGIRLSGKIDTEKDILDLNIGI
                         310       320       330       340       350       360

                         370       380       390       400       410       420
a285-1.pep        NSVGAEDVLQTAFKGRLDGSIGIGGTTASPKISWQLGIGTARTDGSLAIASDPANGQRKL
                  ||||||||||||||||||||||||||||||||||||||||||||||||||||||||||||
m285-1            NSVGAEDVLQTAFKGRLDGSIGIGGTTASPKISWQLGIGTARTDGSLAIASDPANGQRKL
                         370       380       390       400       410       420

                         430       440       450       460       470       480
a285-1.pep        VLDTVNIAAGQGSLTAQGYLELFKDRLLKLDIRSRAFDPSRIDPQLPAGNINGSINLAGE
                  ||||||||||||||||||||||||||||||||||||||||||||||||||||||||||||
m285-1            VLDTVNIAAGQGSLTAQGYLELFKDRLLKLDIRSRAFDPSRIDPQLPAGNINGSINLAGE
                         430       440       450       460       470       480

                         490       500       510       520       530       540
a285-1.pep        LAKEKFTGKMRPLPGTFNGVPIAGSADIVYESRHLPRAAVDLRLGRNIIKTDGGFGKKGD
                  ||||||||||||||||||||||||||||||||||||||||||||||||||||||||||||
m285-1            LAKEKFTGKMRFLPGTFNGVPIAGSADIVYESRHLPRAAVDLRLGRNIIKTDGGFGKKGD
                         490       500       510       520       530       540

                         550       560       570       580       590       600
a285-1.pep        RLNLNITAPDLSRFGFGLAGSLNVRGHLSGDLDGGIRTFFTDLSGAARNLHIGKAADIRS
                  ||||||||||||||||||||||||||||||||||||||||||||||||||||||||||||
m285-1            RLNLNITAPDLSRFGFGLAGSLNVRGHLSGDLDGGIRTFFTDLSGAARNLHIGKAADIRS
                         550       560       570       580       590       600

                         610       620       630       640       650       660
a285-1.pep        LDFTLKGSPDTSRPIRADIKGSRLSLSGGAEVVDTADLMLDGTGVQHRIRTHAAMTLDGK
                  |||||||||||||||||||||||||||||| |||||||||||||||||||||||||||||
m285-1            LDFTLKGSPDTSRPIRADIKGSRLSLSGGAAVVDTADLMLDGTGVQHRIRTHAAMTLDGK
                         610       620       630       640       650       660

                         670       680       690       700       710       720
a285-1.pep        PFKFDLDASGGINRELTRWKGSIGILDIGGAFNLKLQNRMTLEAGAERVAASAANWQAMG
                  ||||||||||||||||||||||||||||||||||||||||||||||||||||||||||||
m285-1            PFKFDLDASGGINRELTRWKGSIGILDIGGAFNLKLQNRMTLEAGAERVAASAANWQAMG
                         670       680       690       700       710       720

                         730       740       750       760       770       780
a285-1.pep        GSLNLQHFSWDKKTGISAKGGAHGLHIAELHNFFKPPFEHNLVLNGDWDVAYGRNARGYL
                  ||||||||||||||||||||||||||||||||||||||||||||||||||||||||||||
m285-1            GSLNLQHFSWDKKTGISAKGGAHGLHIAELHNFFKPPFEHNLVLNGDWDVAYGRNARGYL
                         730       740       750       760       770       780

                         790       800       810       820       830       840
a285-1.pep        NISRQSGDAVLPGGQALGINAFSLKTRFQNDRIGILLDGGARFGRINADLDIGNAFGGNM
                  |||||||||||||||||||||||||||||||||||||||||||||||||| |:|||||||
m285-1            NISRQSGDAVLPGGQALGLNAFSLKTRFQNDRIGILLDGGARFGRINADLGIANAFGGNM
                         790       800       810       820       830       840

                       850       860       870       880       890       900
a285-1.pep        ANAPLGGRITASLPDLGALKPFLPAAAQNITGSLNAAAQIGGRVGSPSVNAAVNGSSNYG
                  ||||||||||||||||||||||||||||||||||||||||||||||||||||||||||||
m285-1            ANAPLGGRITASLPDLGTLKPFLPAAAQNITGSLNAAAQIGGRVGSPSVNAAVNGSSNYG
                       850       860       870       880       890       900

                         910       920       930       940       950       960
a285-1.pep        KINGNITVGQSRSFDTAPLGGRLNLTVADAEVFRNFLPVGQTVKGSLNAAVTLGGSIADP
                  ||||||||||||||||||||||||||||||||||||||||||||||||||||||||||||
m285-1            KINGNITVGQSRSFDTAPLGGRLNLTVADAEVFRNFLPVGQTVKGSLNAAVTLGGSIADP
                         910       920       930       940       950       960

                         970       980       990      1000      1010      1020
a285-1.pep        HLGGSINGDKLYYRNQTQGIILDNGSLRSHIAGRKWVIDSLKFRHEGTAELSGTVGMENS
                  ||||||||||||||||||||||||||||||||||||||||||||||||||||||||||||
m285-1            HLGGSINGDKLYYRNQTQGIILDNGSLRSHIAGRKWVIDSLKFRHEGTAELSGTVGMENS
                         970       980       990      1000      1010      1020

                        1030      1040      1050      1060      1070      1080
a285-1.pep        GPDVDIGAVFDKYRILSRPNRRLTVSGNTRLRYSPQKGISVTGMIKTDQGLFGSQKSSMP
                  ||||||||||||||||||||||||||||||||||||||||||||||||||||||||||||
m285-1            GPDVDIGAVFDKYRILSRPNRRLTVSGNTRLRYSPQKGISVTGMIKTDQGLFGSQKSSMP
                        1030      1040      1050      1060      1070      1080
```

-continued

```
              1090      1100      1110      1120      1130      1140
a285-1.pep  SVGDDVVVLGEVKKEAAAPLPVNMNLTLDLNDGIRFAGYGADVTIGGKLTLTAQSGGSVR
            ||||||||||||||||||||||||||||||||||||||||||||||||||||||||||||
m285-1      SVGDDVVVLGEVKKEAAAPLPVNMNLTLDLNDGIRFAGYGADVTIGGKLTLTAQSGGSVR
              1090      1100      1110      1120      1130      1140

              1150      1160      1170      1180      1190      1200
a285-1.pep  GVGTVRVIKGRYKAYGQDLDITKGTVSFVGPLNDPNLNIRAERRLSPVGAGVEILGSLNS
            ||||||||||||||||||||||||||||||||||||||||||||||||||||||||||||
m285-1      GVGTVRVIKGRYKAYGQDLDITKGTVSFVGPLNDPNLNIRAERRLSPVGAGVEILGSLNS
              1150      1160      1170      1180      1190      1200

              1210      1220      1230      1240      1250      1260
a285-1.pep  PRITLTANEPMSEKDKLSWLILNRAGSGSSGDNAALSAAAGALLAGQINDRIGLVDDLGF
            ||||||||||||||||||||||||||||||||||||||||||||||||||||||||||||
m285-1      PRITLTANEPMSEKDKLSWLILNRAGSGSSGDNAALSAAAGALLAGQINDRIGLVDDLGF
              1210      1220      1230      1240      1250      1260

              1270      1280      1290      1300      1310      1320
a285-1.pep  TSKRSRNAQTGELNPAEQVLTVGKQLTGKLYIGYEYSISSAEQSVKLIYRLTRAIQAVAR
            ||||||||||||||||||||||||||||||||||||||||||||||||||||||||||||
m285-1      TSKRSRNAQTGELNPAEQVLTVGKQLTGKLYIGYEYSISSAEQSVKLIYRLTRAIQAVAR
              1270      1280      1290      1300      1310      1320

              1330      1340      1350
a285-1.pep  IGSRSSGGELTYTIRFDRFSGSDKKDSAGNSKGKX
            ||||||||||||||||||||||||||||||:||||
m285-1      IGSRSSGGELTYTIRFDRFSGSDKKDSAGNGKGKX
              1330      1340      1350
```

The following partial DNA sequence was identified in *N. gonorrhoeae* <SEQ ID 1193>:

```
g286.seq
   1 atgcagaaca ccggtaccat gatgatcaaa ccgaccgccc tgctcctgcc

  51 ggctttattt ttctttccgc acgcatacgc gcctgccgcc gacctttccg

 101 aaaacaaggc ggcgggtttc gcattgttca aaagcaaaag ccccgacacc

 151 gaatcagtca aattaaaacc caaattcccc gtccgcatcg acacgcagga

 201 cagtgaaatc aaagatatgg tcgaagaaca cctgccgctc atcacgcagc

 251 agcaggaaga ggttttggat aaggaacaga cgggattcct tgccgaagaa

 301 gcaccggaca acgttaaaac aatgctccgc agcaaaggct atttcagcag

 351 caaggtcagc ctgacggaaa aagacggagc ttatacggtg cacatcacac

 401 cgggcccgcg caccaaaatc gccaacgtcg gcgtcgccat cctcggcgac

 451 atcctttcag acggcaacct cgccgaatac taccgcaacg cgctggaaaa

 501 ctggcagcag ccggtaggca gcgatttcga tcaggacagt tgggaaaaca

 551 gcaaaacttc cgtcctcggc gcggtaacgc gcaaaggcta cccgcttgcc

 601 aagctcggca acacccgggc ggccgtcaac cccgataccg ccaccgccga

 651 tttgaacgtc gtcgtggaca gcggccgccc cattgccttc ggcgactttg

 701 aaatcaccgg cacacagcgt taccccgaac aaaccgtctc cggcctggcg

 751 cgcttccaac cgggcacgcc ctacgacctc gacctgctgc tcgacttcca

 801 acaggcgctc gaacaaaacg ggcattattc cggcgcgtcc gtacaagccg

 851 acttcgaccg cctcccaagg ggaccgcgtc cccgtcaaag tcagcgtaac

 901 cgaggtcaaa cgccacaaac tcgaaaccgg catccgcctc gattcggaat

 951 acggtttggg cggcaaaatc gcctacgact attacaacct cttcaacaaa

1001 ggctatatcg gctcggtcgt ctgggatatg gacaaatacg aaaccacgct

1051 tgccgccggc atcagccagc cgcgcaacta tcggggcaac tactggacaa

1101 gcaacgtttc ctacaaccgt tcgaccaccc aaaacctcga aaaacgcgcc

1151 ttctccggcg gcatctggta tgtgcgcgac cgcgcgggca tcgatgccag
```

-continued

```
1201 gctgggggcg gaatttctcg cagaaggccg gaaaatcccc ggctcggatg
1251 tcgatttggg caacagccac gccacgatgc tgaccgcctc ttggaaacgc
1301 cagctgctca acaacgtgct gcaccccgaa aacggccatt acctcgacgg
1351 caaaatcggg acgactttgg gcacattcct gtcctccacc gcgctaatcc
1401 gcacctctgc ccgcgcaggt tatttcttca cgcccgaaaa caaaaaactc
1451 ggcacgttca tcatacgcgg acaagcgggt tacaccgttg cacgcgacaa
1501 tgccgatgtc ccctcggggc tgatgttccg cagcggcggc gcgtcttccg
1551 tgcgcggtta cgaacttga
```

This corresponds to the amino acid sequence <SEQ ID 1194; ORF 286.ng>:

```
g286.pep
  1 MQNTGTMMIK PTALLLPALF FFPHAYAPAA DLSENKAAGF ALFKSKSPDT
 51 ESVKLKPKFP VRIDTQDSEI KDMVEEHLPL ITQQQEEVLD KEQTGFLAEE
101 APDNVKTMLR SKGYFSSKVS LTEKDGAYTV HITPGPRTKI ANVGVAILGD
151 ILSDGNLAEY YRNALENWQQ PVGSDFDQDS WENSKTSVLG AVTRKGYPLA
201 KLGNTRAAVN PDTATADLNV VVDSGRPIAF GDFEITGTQR YPEQTVSGLA
251 RFQPGTPYDL DLLLDFQQAL EQNGHYSGAS VQADFDRLPR GPRPRQSQRN
301 RGQTPQTRNR HPPRFGIRFG RQNRLRLLQP LQQRLYRLGR LGYGQIRNHA
351 CRRHQPAAQL SGQLLDKQRF LQPFDHPKPR KTRLLRRHLV CARPRGHRCQ
401 AGGGISRRRP ENPRLGCRFG QQPRHDADRL LETPAAQQRA APRKRPLPRR
451 QNRDDFGHIP VLHRANPHLC PRRLFLHARK QKTRHVHHTR TSGLHRCTRQ
501 CRCPLGADVP QRRRVFRARL RT*
```

The following partial DNA sequence was identified in *N. meningitidis* <SEQ ID 1195>:

```
m286.seq
  1 ATGCACGACA CCCGTACCAT GATGATCAAA CCGACCGCCC TGCTCCTGCC
 51 GGCTTTATTT TTCTTTCCGC ACGCATACGC GCCTGCCGCC GACCTTTCCG
101 AAAACAAGGC GGCGGGTTTC GCATTGTTCA AAAACAAAAG CCCCGACACC
151 GAATCAGTCA AATTAAAACC CAAATTCCCC GTCCTCATCG ACACGCAGGA
201 CAGTGAAATC AAAGATATGG TCGAAGAACA CCTGCCGCTC ATCACGCAGC
251 AGCAGGAAGA AGTATTGGAC AAGGAACAGA CGGGCTTCCT CGCCGAAGAA
301 GCGCCGGACA ACGTTAAAAC GATGCTCCGC AGCAAAGGCT ATTTCAGCAG
351 CAAAGTCAGC CTGACGGAAA AAGACGGAGC TTATACGGTA CACATCACAC
401 CGGGCCCGCG CACCAAAATC GCCAACGTCG GCGTCGCCAT CCTCGGCGAC
451 ATCCTTTCAG ACGGCAACCT CGCCGAATAC TACCGCAACG CGCTGGAAAA
501 CTGGCAGCAG CCGGTAGGCA GCGATTTCGA TCAGGACAGT TGGGAAAACA
551 GCAAAACTTC CGTCCTCGGC GCGGTAACGC GCAAAGCCTA CCCGCTTGCC
601 AAGCTCGGCA ATACGCAGGC GGCCGTCAAC CCCGATACCG CCACCGCCGA
651 TTTGAACGTC GTCGTGGACA GCGGCCGCCC CATCGCCTTC GGCGACTTTG
701 AAATCACCGG CACACAGCGT TACCCCGAAC AAATCGTCTC CGGCCTTGCG
```

-continued

```
 751 CGTTTCCAGC CCGGTATGCC GTACGACCTC GACCTGCTGC TCGACTTCCA
 801 ACAGGCGCTC GAACAAAACG GGCATTATTC CGGCGCGTCC GTACAAGCCG
 851 ACTTCGACCG CCTCCAAGGC GACCGCGTCC CCGTCAAAGT CAGCGTAACC
 901 GAGGTCAAAC GCCACAAACT CGAAACCGGC ATCCGCCTCG ATTCGGAATA
 951 CGGTTTGGGC GGCAAAATCG CCTACGACTA TTACAACCTC TTCAACAAAG
1001 GCTATATCGG TTCGGTCGTC TGGGATATGG ACAAATACGA AACCACGCTT
1051 GCCGCCGGCA TCAGCCAGCC GCGCAACTAT CGGGGCAACT ACTGGACAAG
1101 CAACGTTTCC TACAACCGTT CGACCACCCA AAACCTCGAA AAACGCGCCT
1151 TCTCCGGCGG CGTCTGGTAT GTGCGCGACC GCGCGGGCAT CGATGCCAGG
1201 CTGGGGGCGG AATTTCTCGC AGAAGGCCGG AAAATCCCCG GCTCGGCTGT
1251 CGATTTGGGC AACAGCCACG CCACGATGCT GACCGCCTCT TGGAAACGCC
1301 AGCTGCTCAA CAACGTGCTG CATCCCGAAA ACGGCCATTA CCTCGACGGC
1351 AAAATCGGTA CGACTTTGGG CACATTCCTG TCCTCCACCG CGCTGATCCG
1401 CACCTCTGCC CGTGCAGGTT ATTTCTTCAC GCCCGAAAAC AAAAAACTCG
1451 GCACGTTCAT CATACGCGGA CAAGCGGGTT ACACCGTTGC CCGCGACAAT
1501 GCCGACGTTC CTTCAGGGCT GATGTTCCGC AGCGGCGGCG CGTCTTCCGT
1551 GCGCGGTTAC GAACTCGACA GCATCGGACT TGCCGGCCCG AACGGATCGG
1601 TCCTGCCCGA ACGCGCCCTC CTGGTGGGCA GCCTGGAATA CCAACTGCCG
1651 TTTACGCGCA CCCTTTCCGG CGCGGTGTTC CACGATATGG GCGATGCCGC
1701 CGCCAATTTC AAACGTATGA AGCTGAAACA CGGTTCGGGA CTGGGCGTGC
1751 GCTGGTTCAG CCCGCTTGCG CCGTTTTCCT TCGACATCGC CTACGGGCAC
1801 AGCGATAAGA AAATCCGCTG GCACATCAGC TTGGGAACGC GCTTCTAA
```

This corresponds to the amino acid sequence <SEQ ID 1196; ORF 286>:

```
m286.pep
   1 MHDTRTMMIK PTALLLPALF FFPHAYAPAA DLSENKAAGF ALFKNKSPDT
  51 ESVKLKPKFP VLIDTQDSEI KDMVEEHLPL ITQQQEEVLD KEQTGFLAEE
 101 APDNVKTMLR SKGYFSSKVS LTEKDGAYTV HITPGPRTKI ANVGVAILGD
 151 ILSDGNLAEY YRNALENWQQ PVGSDFDQDS WENSKTSVLG AVTRKAYPLA
 201 KLGNTQAAVN PDTATADLNV VVDSGRPIAF GDFEITGTQR YPEQIVSGLA
 251 RFQPGMPYDL DLLLDFQQAL EQNGHYSGAS VQADFDRLQG DRVPVKVSVT
 301 EVKRHKLETG IRLDSEYGLG GKIAYDYYNL FNKGYIGSVV WDMDKYETTL
 351 AAGISQPRNY RGNYWTSNVS YNRSTTQNLE KRAFSGGVWY VRDRAGIDAR
 401 LGAEFLAEGR KIPGSAVDLG NSHATMLTAS WKRQLLNNVL HPENGHYLDG
 451 KIGTTLGTFL SSTALIRTSA RAGYFFTPEN KKLGTFIIRG QAGYTVARDN
 501 ADVPSGLMFR SGGASSVRGY ELDSIGLAGP NGSVLPERAL LVGSLEYQLP
 551 FTRTLSGAVF HDMGDAAANF KRMKLKHGSG LGVRWFSPLA PFSFDIAYGH
 601 SDKKIRWHIS LGTRF*
```

Computer analysis of this amino acid sequence gave the following results:

Homology with a Predicted ORF from *N. gonorrhoeae*

```
m286/g286   95.9% identity in 293 aa overlap

                    10        20        30        40        50        60
m286.pep    MHDTRTMMIKPTALLLPALFFFPHAYAPAADLSENKAAGFALFKNKSPDTESVKLKPKFP
            |::| |||||||||||||||||||||||||||||||||||||||:|||||||||||||||
g286        MQNTGTMMIKPTALLLPALFFFPHAYAPAADLSENKAAGFALFKSKSPDTESVKLKPKFP
                    10        20        30        40        50        60
                    70        80        90       100       110       120
m286.pep    VLIDTQDSEIKDMVEEHLPLITQQQEEVLDKEQTGFLAEEAPDNVKTMLRSKGYFSSKVS
            | ||||||||||||||||||||||||||||||||||||||||||||||||||||||||||
g286        VRIDTQDSEIKDMVEEHLPLITQQQEEVLDKEQTGFLAEEAPDNVKTMLRSKGYFSSKVS
                    70        80        90       100       110       120
                   130       140       150       160       170       180
m286.pep    LTEKDGAYTVHITPGPRTKIANVGVAILGDILSDGNLAEYYRNALENWQQPVGSDFDQDS
            ||||||||||||||||||||||||||||||||||||||||||||||||||||||||||||
g286        LTEKDGAYTVHITPGPRTKIANVGVAILGDILSDGNLAEYYRNALENWQQPVGSDFDQDS
                   130       140       150       160       170       180
                   190       200       210       220       230       240
m286.pep    WENSKTSVLGAVTRKAYPLAKLGNTQAAVNPDTATADLNVVVDSGRPIAFGDFEITGTQR
            |||||||||||||||:|||||||||:||||||||||||||||||||||||||||||||||
g286        WENSKTSVLGAVTRKGYPLAKLGNTRAAVNPDTATADLNVVVDSGRPIAFGDFEITGTQR
                   190       200       210       220       230       240
                   250       260       270       280       290       300
m286.pep    YPEQIVSGLARFQPGMPYDLDLLLDFQQALEQNGHYSGASVQADFDRL-QGDRVPVKVSV
            |||| |||||||||| |||||||||||||||||||||||||||||||| :| |
g286        YPEQTVSGLARFQPGTPYDLDLLLDFQQALEQNGHYSGASVQADFDRLPRGPRPRQSQRN
                   250       260       270       280       290       300
         300       310       320       330       340       350       359
m286.pep    TEVKRHKLETGIRLDSEYGLGGKIAYDYYNLFNKGYIGSVVWDMDKYETTLAAGISQPRN

g286        RGQTPQTRNRHPPRFGIRFGRQNRLRLLQPLQQRLYRLGRLGYGQIRNHACRRHQPAAQL
                   310       320       330       340       350       360
```

The following partial DNA sequence was identified in *N. meningitidis* <SEQ ID 1197>:

```
a286.seq
   1  ATGCACGACA CCCGTACCAT GATGATTAAA CCGACCGCCC TGCTCCTGCC
  51  GGCTTTATTT TTCTTTCCGC ACGCATACGC GCCTGCCGCC GACCTTTCCG
 101  AAAACAAGGC GGCGGGTTTC GCATTGTTCA AAAACAAAAG CCCCGACACC
 151  GAATCAGTTA AATTAAAACC CAAATTCCCC GTCCGCATCG ACACGCAGGA
 201  TAGTGAAATC AAAGATATGG TCGAAGAACA CCTGCCGCTC ATCACGCAGC
 251  AGCAGGAAGA AGTATTGGAC AAGGAACAGA CGGGCTTCCT CGCCGAAGAA
 301  GCACCGGACA ACGTTAAAAC AATGCTCCGC AGCAAAGGCT ATTTCAGCAG
 351  CAAAGTCAGC CTGACGGAAA AAGACGGAGC TTATACGGTA CACATCACAC
 401  CGGGCCCGCG CACCAAAATC GCCAACGTCG GCGTCGCCAT CCTCGGCGAC
 451  ATCCTTTCAG ACGGCAACCT CGCCGAATAC TACCGCAACG CGCTGGAAAA
 501  CTGGCAGCAG CCGGTAGGCA GTGATTTCGA TCAGGACAGT TGGGAAAACA
 551  GCAAAACTTC CGTCCTCGGC GCGGTAACGC GCAAAGCCTA CCCGCTTGCC
 601  AAGCTCGGCA ACACCCGGGC GGCCGTCAAC CCCGATACCG CCACCGCCGA
 651  TTTGAACGTC GTCGTGGACA GCGGCCGCCC CATCGCCTTC GGCGACTTTG
 701  AAATTACCGG CACGCAGCGT TACCCCGAAC AAATCGTCTC CGGCTTGGCG
 751  CGCTTCCAAC CGGGCACGCC CTACGACCTC GACCTGCTGC TCGACTTCCA
```

-continued

```
 801  ACAGGCGCTC GAACAAAACG GGCATTATTC CGGCGCGTCC GTACAAGCCG
 851  ACTTCGACCG CCTCCAAGGC GACCGCGTCC CCGTCAAAGT CAGCGTAACC
 901  GAGGTCAAAC GCCACAAGCT CGAAACCGGC ATCCGCCTCG ATTCGGAATA
 951  CGGTTTGGGC GGCAAAATCG CCTACGACTA TTACAACCTC TTCAACAAAG
1001  GCTATATCGG TTCGGTCGTC TGGGATATGG ACAAATACGA AACCACGCTT
1051  GCCGCCGGCA TCAGCCAGCC GCGCAACTAT CGGGGCAACT ACTGGACAAG
1101  CAACGTTTCC TACAACCGTT CGACCACCCA AAACCTCGAA AAACGCGCCT
1151  TCTCCGGCGG CATCTGGTAT GTGCGCGACC GCGCGGGCAT CGATGCCAGG
1201  CTGGGGGCGG AGTTTCTCGC AGAAGGCCGG AAAATCCCCG GCTCGGATAT
1251  CGATTTGGGC AACAGCCACG CCACGATGCT GACCGCCTCT TGGAAACGCC
1301  AGCTGCTCAA CAACGTGCTG CATCCCGAAA ACGGCCATTA CCTCGACGGC
1351  AAAATCGGTA CGACTTTGGG CGCATTCCTG TCCTCCACCG CGCTGATCCG
1401  CACCTCTGCC CGCGCAGGTT ATTTCTTCAC GCCCGAAAAC AAAAAACTCG
1451  GCACGTTCAT CATACGCGGA CAAGCGGGTT ACACCGTTGC CCGCGACAAT
1501  GCCAACGTTC CTTCAGGGCT GATGTTCCGC AGCGGCGGCG CGTCTTCCGT
1551  GCGCGGTTAC GAACTCGACA GCATCGGGCT TGCCGGCCCG AACGGATCGG
1601  TCCTGCCCGA ACGCGCCCTC TTGGTGGGCA GCCTGGAATA CCAACTGCCG
1651  TTTACGCGCA CCCTTTCCGG CGCGGTGTTC CACGATATGG GCGACGCCGC
1701  CGCCAATTTC AAACGTATGA AGCTGAAACA CGGTTCGGGA CTGGGCGTGC
1751  GCTGGTTCAG CCCGCTCGCG CCGTTTTCCT TCGACATCGC CTACGGGCAC
1801  AGCGACAAGA AAATCCGCTG GCACATCAGC TTGGGAACGC GCTTCTAA
```

This corresponds to the amino acid sequence <SEQ ID 1198; ORF 286.a>:

```
a286.pep
      1  MHDTRTMMIK PTALLLPALF FFPHAYAPAA DLSENKAAGF ALFKNKSPDT
     51  ESVKLKPKFP VRIDTQDSEI KDMVEEHLPL ITQQQEEVLD KEQTGFLAEE
    101  APDNVKTMLR SKGYFSSKVS LTEKDGAYTV HITPGPRTKI ANVGVAILGD
    151  ILSDGNLAEY YRNALENWQQ PVGSDFDQDS WENSKTSVLG AVTRKAYPLA
    201  KLGNTRAAVN PDTATADLNV VVDSGRPIAF GDFEITGTQR YPEQIVSGLA
    251  RFQPGTPYDL DLLLDFQQAL EQNGHYSGAS VQADFDRLQG DRVPVKVSVT
    301  EVKRHKLETG IRLDSEYGLG GKIAYDYYNL FNKGYIGSVV WDMDKYETTL
    351  AAGISQPRNY RGNYWTSNVS YNRSTTQNLE KRAFSGGIWY VRDRAGIDAR
    401  LGAEFLAEGR KIPGSDIDLG NSHATMLTAS WKRQLLNNVL HPENGHYLDG
    451  KIGTTLGAFL SSTALIRTSA RAGYFFTPEN KKLGTFIIRG QAGYTVARDN
    501  ANVPSGLMFR SGGASSVRGY ELDSIGLAGP NGSVLPERAL LVGSLEYQLP
    551  FTRTLSGAVF HDMGDAAANF KRMKLKHGSG LGVRWFSPLA PFSFDIAYGH
    601  SDKKIRWHIS LGTRF*

m286/a286  98.7% identity in 615 aa overlap

                     10        20        30        40        50        60
m286.pep    MHDTRTMMIKPTALLLPALFFFPHAYAPAADLSENKAAGFALFKNKSPDTESVKLKPKFP
            ||||||||||||||||||||||||||||||||||||||||||||||||||||||||||||
a286        MHDTRTMMIKPTALLLPALFFFPHAYAPAADLSENKAAGFALFKNKSPDTESVKLKPKFP
                     10        20        30        40        50        60
```

-continued

```
                    70        80        90       100       110       120
m286.pep    VLIDTQDSEIKDMVEEHLPLITQQQEEVLDKEQTGFLAEEAPDNVKTMLRSKGYFSSKVS
            | ||||||||||||||||||||||||||||||||||||||||||||||||||||||||||
a286        VRIDTQDSEIKDMVEEHLPLITQQQEEVLDKEQTGFLAEEAPDNVKTMLRSKGYFSSKVS
                    70        80        90       100       110       120

                   130       140       150       160       170       180
m286.pep    LTEKDGAYTVHITPGPRTKIANVGVAILGDILSDGNLAEYYRNALENWQQPVGSDFDQDS
            ||||||||||||||||||||||||||||||||||||||||||||||||||||||||||||
a286        LTEKDGAYTVHITPGPRTKIANVGVAILGDILSDGNLAEYYRNALENWQQPVGSDFDQDS
                   130       140       150       160       170       180

                   190       200       210       220       230       240
m286.pep    WENSKTSVLGAVTRKAYPLAKLGNTRAAVNPDTATADLNVVVDSGRPIAFGDFEITGTQR
            ||||||||||||||||||||||||||||||||||||||||||||||||||||||||||||
a286        WENSKTSVLGAVTRKAYPLAKLGNTRAAVNPDTATADLNVVVDSGRPIAFGDFEITGTQR
                   190       200       210       220       230       240

                   250       260       270       280       290       300
m286.pep    YPEQIVSGLARFQPGMPYDLDLLLDFQQALEQNGHYSGASVQADFDRLQGDRVPVKVSVT
            ||||||||||||||| ||||||||||||||||||||||||||||||||||||||||||||
a286        YPEQIVSGLARFQPGTPYDLDLLLDFQQALEQNGHYSGASVQADFDRLQGDRVPVKVSVT
                   250       260       270       280       290       300

                   310       320       330       340       350       360
m286.pep    EVKRHKLETGIRLDSEYGLGGKIAYDYYNLFNKGYIGSVVWDMDKYETTLAAGISQPRNY
            ||||||||||||||||||||||||||||||||||||||||||||||||||||||||||||
a286        EVKRHKLETGIRLDSEYGLGGKIAYDYYNLFNKGYIGSVVWDMDKYETTLAAGISQPRNY
                   310       320       330       340       350       360

                   370       380       390       400       410       420
m286.pep    RGNYWTSNVSYNRSTTQNLEKRAFSGGVWYVRDRAGIDARLGAEFLAEGRKIPGSAVDLG
            |||||||||||||||||||||||||||:||||||||||||||||||||||||||| :|||
a286        RGNYWTSNVSYNRSTTQNLEKRAFSGGIWYVRDRAGIDARLGAEFLAEGRKIPGSDIDLG
                   370       380       390       400       410       420

                   430       440       450       460       470       480
m286.pep    NSHATMLTASWKRQLLNNVLHPENGHYLDGKIGTTLGTFLSSTALIRTSARAGYFFTPEN
            |||||||||||||||||||||||||||||||||||||:||||||||||||||||||||||
a286        NSHATMLTASWKRQLLNNVLHPENGHYLDGKIGTTLGAFLSSTALIRTSARAGYFFTPEN
                   430       440       450       460       470       480

                   490       500       510       520       530       540
m286.pep    KKLGTFIIRGQAGYTVARDNADVPSGLMFRSGGASSVRGYELDSIGLAGPNGSVLPERAL
            |||||||||||||||||||||:||||||||||||||||||||||||||||||||||||||
a286        KKLGTFIIRGQAGYTVARDNANVPSGLMFRSGGASSVRGYELDSIGLAGPNGSVLPERAL
                   490       500       510       520       530       540

                   550       560       570       580       590       600
m286.pep    LVGSLEYQLPFTRTLSGAVFHDMGDAAANFKRMKLKHGSGLGVRWFSPLAPFSFDIAYGH
            ||||||||||||||||||||||||||||||||||||||||||||||||||||||||||||
a286        LVGSLEYQLPFTRTLSGAVFHDMGDAAANFKRMKLKHGSGLGVRWFSPLAPFSFDIAYGH
                   550       560       570       580       590       600

                   610
m286.pep    SDKKIRWHISLGTRFX
            |||||||||||||||
a286        SDKKIRWHISLGTRFX
                   610
```

The following partial DNA sequence was identified in *N. gonorrhoeae* <SEQ ID 1199>:

```
g287.seq
   1  atgtttaaac gcagtgtgat tgcaatggct tgtatttttc ccctttcagc

  51  ctgtgggggc ggcggtggcg gatcgcccga tgtcaagtcg gcggacacgc

 101  cgtcaaaacc ggccgccccc gttgttgctg aaaatgccgg ggaaggggtg

 151  ctgccgaaag aaaagaaaga tgaggaggca gcgggcggtg cgccgcaagc

 201  cgatacgcag gacgcaaccg ccggagaagg cagccaagat atggcggcag

 251  tttcggcaga aaatacaggc aatggcggtg cggcaacaac ggacaacccc

 301  aaaaatgaag acgcgggggc gcaaaatgat atgccgcaaa atgccgccga

 351  atccgcaaat caaacaggga acaaccaacc cgccggttct tcagattccg

 401  cccccgcgtc aaaccctgcc cctgcgaatg gcggtagcga ttttggaagg

 451  acgaacgtgg gcaattctgt tgtgattgac ggaccgtcgc aaaatataac

 501  gttgacccac tgtaaaggcg attcttgtaa tggtgataat ttattggatg
```

-continued

```
 551 aagaagcacc gtcaaaatca gaatttgaaa aattaagtga tgaagaaaaa

 601 attaagcgat ataaaaaaga cgagcaacgg gagaattttg tcggtttggt

 651 tgctgacagg gtaaaaaagg atggaactaa caaatatatc atcttctata

 701 cggacaaacc acctactcgt tctgcacggt cgaggaggtc gcttccggcc

 751 gagattccgc tgattcccgt caatcaggcc gatacgctga ttgtggatgg

 801 ggaagcggtc agcctgacgg ggcattccgg caatatcttc gcgcccgaag

 851 ggaattaccg gtatctgact tacggggcgg aaaaattgcc cggcggatcg

 901 tatgccctcc gtgtgcaagg cgaaccggca aaaggcgaaa tgcttgttgg

 951 cacggccgtg tacaacggcg aagtgctgca tttccatatg gaaaacggcc

1001 gtccgtaccc gtccggaggc aggtttgccg caaaagtcga tttcggcagc

1051 aaatctgtgg acggcattat cgacagcggc gatgatttgc atatgggtac

1101 gcaaaaattc aaagccgcca tcgatggaaa cggctttaag gggacttgga

1151 cggaaaatgg cggcggggat gtttccggaa ggttttacgg cccggccggc

1201 gaggaagtgg cgggaaaata cagctatcgc ccgacagatg ctgaaaaggg

1251 cggattcggc gtgtttgccg gcaaaaaaga tcgggattga
```

This corresponds to the amino acid sequence <SEQ ID 1200; ORF 287.ng>:

```
g287.pep
   1 MFKRSVIAMA CIFPLSACGG GGGGSPDVKS ADTPSKPAAP VVAENAGEGV

  51 LPKEKKDEEA AGGAPQADTQ DATAGEGSQD MAAVSAENTG NGGAATTDNP

 101 KNEDAGAQND MPQNAAESAN QTGNNQPAGS SDSAPASNPA PANGGSDFGR

 151 TNVGNSVVID GPSQNITLTH CKGDSCNGDN LLDEEAPSKS EFEKLSDEEK

 201 IKRYKKDEQR ENFVGLVADR VKKDGTNKYI IFYTDKPPTR SARSRRSLPA

 251 EIPLIPVNQA DTLIVDGEAV SLTGHSGNIF APEGNYRYLT YGAEKLPGGS

 301 YALRVQGEPA KGEMLVGTAV YNGEVLHFHM ENGRPYPSGG RFAAKVDFGS

 351 KSVDGIIDSG DDLHMGTQKF KAAIDGNGFK GTWTENGGGD VSGRFYGPAG

 401 EEVAGKYSYR PTDAEKGGFG VFAGKKDRD*
```

The following partial DNA sequence was identified in *N. meningitidis* <SEQ ID 1201>:

```
m287.seq.
   1 ATGTTTAAAC GCAGCGTAAT CGCAATGGCT TGTATTTTTG CCCTTTCAGC

  51 CTGCGGGGGC GGCGGTGGCG GATCGCCCGA TGTCAAGTCG GCGGACACGC

 101 TGTCAAAACC TGCCGCCCCT GTTGTTTCTG AAAAAGAGAC AGAGGCAAAG

 151 GAAGATGCGC CACAGGCAGG TTCTCAAGGA CAGGGCGCGC CATCCGCACA

 201 AGGCAGTCAA GATATGGCGG CGGTTTCGGA AGAAAATACA GGCAATGGCG

 251 GTGCGGTAAC AGCGGATAAT CCCAAAAATG AAGACGAGGT GGCACAAAAT

 301 GATATGCCGC AAAATGCCGC CGGTACAGAT AGTTCGACAC CGAATCACAC

 351 CCCGGATCCG AATATGCTTG CCGGAAATAT GGAAAATCAA GCAACGGATG

 401 CCGGGGAATC GTCTCAGCCG GCAAACCAAC CGGATATGGC AAATGCGGCG

 451 GACGGAATGC AGGGGGACGA TCCGTCGGCA GGCGGGCAAA ATGCCGGCAA
```

-continued

```
 501  TACGGCTGCC CAAGGTGCAA ATCAAGCCGG AAACAATCAA GCCGCCGGTT
 551  CTTCAGATCC CATCCCCGCG TCAAACCCTG CACCTGCGAA TGGCGGTAGC
 601  AATTTTGGAA GGGTTGATTT GGCTAATGGC GTTTTGATTG ACGGGCCGTC
 651  GCAAAATATA ACGTTGACCC ACTGTAAAGG CGATTCTTGT AGTGGCAATA
 701  ATTTCTTGGA TGAAGAAGTA CAGCTAAAAT CAGAATTTGA AAAATTAAGT
 751  GATGCAGACA AAATAAGTAA TTACAAGAAA GATGGGAAGA ATGATAAATT
 801  TGTCGGTTTG GTTGCCGATA GTGTGCAGAT GAAGGGAATC AATCAATATA
 851  TTATCTTTTA TAAACCTAAA CCCACTTCAT TTGCGCGATT TAGGCGTTCT
 901  GCACGGTCGA GGCGGTCGCT TCCGGCCGAG ATGCCGCTGA TTCCCGTCAA
 951  TCAGGCGGAT ACGCTGATTG TCGATGGGGA AGCGGTCAGC CTGACGGGGC
1001  ATTCCGGCAA TATCTTCGCG CCCGAAGGGA ATTACCGGTA TCTGACTTAC
1051  GGGGCGGAAA AATTGCCCGG CGGATCGTAT GCCCTTCGTG TTCAAGGCGA
1101  ACCGGCAAAA GGCGAAATGC TTGCGGGCGC GGCCGTGTAC AACGGCGAAG
1151  TACTGCATTT CCATACGGAA AACGGCCGTC CGTACCCGAC CAGGGGCAGG
1201  TTTGCCGCAA AAGTCGATTT CGGCAGCAAA TCTGTGGACG GCATTATCGA
1251  CAGCGGCGAT GATTTGCATA TGGGTACGCA AAAATTCAAA GCCGCCATCG
1301  ATGGAAACGG CTTTAAGGGG ACTTGGACGG AAAATGGCAG CGGGGATGTT
1351  TCCGGAAAGT TTTACGGCCC GGCCGGCGAG GAAGTGGCGG GAAAATACAG
1401  CTATCGCCCG ACAGATGCGG AAAAGGGCGG ATTCGGCGTG TTTGCCGGCA
1451  AAAAAGAGCA GGATTGA
```

This corresponds to the amino acid sequence <SEQ ID 1202; ORF 287>:

```
m287.pep
  1 MFKRSVIAMA CIFALSACGG GGGGSPDVKS ADTLSKPAAP VVSEKETEAK
 51 EDAPQAGSQG QGAPSAQGSQ DMAAVSEENT GNGGAVTADN PKNEDEVAQN
101 DMPQNAAGTD SSTPNHTPDP NMLAGNMENQ ATDAGESSQP ANQPDMANAA
151 DGMQGDDPSA GGQNAGNTAA QGANQAGNNQ AAGSSDPIPA SNPAPANGGS
201 NFGRVDLANG VLIDGPSQNI TLTHCKGDSC SGNNFLDEEV QLKSEFEKLS
251 DADKISNYKK DGKNDKFVGL VADSVQMKGI NQYIIFYKPK PTSFARFRRS
301 ARSRRSLPAE MPLIPVNQAD TLIVDGEAVS LTGHSGNIFA PEGNYRYLTY
351 GAEKLPGGSY ALRVQGEPAK GEMLAGAAVY NGEVLHFHTE NGRPYPTRGR
401 FAAKVDFGSK SVDGIIDSGD DLHMGTQKFK AAIDGNGFKG TWTENGSGDV
451 SGKFYGPAGE EVAGKYSYRP TDAEKGGFGV FAGKKEQD*
```

Computer analysis of this amino acid sequence gave the following results:

Homology with a Predicted ORF from *N. gonorrhoeae*

```
m287/g287   70.1% identity in 499 aa overlap

                    10        20        30        40                  49
m287.pep    MFKRSVIAMACIFALSACGGGGGGSPDVKSADTLSKPAAPVVSE-----------KETEA
            |||||||||||| ||||||||||||||||| ||||||||:|           |: ||
g287        MFKRSVIAMACIFPLSACGGGGGGSPDVKSADTPSKPAAPVVAENAGEGVLPKEKKDEEA
                    10        20        30        40        50        60
```

-continued

```
                  50        60        70        80        90       100       109
m287.pep  KEDAPQAGSQGQGAPSAQGSQDMAAVSEENTGNGGAVTADNPKNEDEVAQNDMPQNAAGT
             |||| :|   | :::||||||||| ||||||||:|:|||||||   |||||||||
g287      AGGAPQADTQD--ATAGEGSQDMAAVSAENTGNGGAATTDNPKNEDAGAQNDMPQNAA--
                      70          80        90       100       110

         110       120       130       140       150       160       169
m287.pep  DSSTPNHTPDPNMLAGNMENQATDAGESSQPANQPDMANAADGMQGDDPSAGGQNAGNTA

g287      ------------------------------------------------------------

         170       180       190       200       210       220       229
m287.pep  AQGANQAGNNQAAGSSDPIPASNPAPANGGSNFGRVDLANGVLIDGPSQNITLTHCKGDS
           ::|||:|||| |||||  ||||||||||||:|||::::|:|:|||||||||||||||||
g287      -ESANQTGNNQPAGSSDSAPASNPAPANGGSDFGRTNVGNSVVIDGPSQNITLTHCKGDS
            120       130       140       150       160       170

         230       240       250       260       270       280       289
m287.pep  CSGNNFLDEEVQLKSEFEKLSDADKISNYKKDGKNDKFVGLVADSVQMKGINQYIIFYKP
          |:|:|:||||:  ||||||||| :||: |||| : ::||||||| |:  | |:|||||
g287      CNGDNLLDEEAPSKSEFEKLSDEEKIKRYKKDEQRENFVGLVADRVKKDGTNKYIIFYTD
            180       190       200       210       220       230

         290       300       310       320       330       340       349
m287.pep  KPTSFARFRRSARSRRSLPAEMPLIPVNQADTLIVDGEAVSLTGHSGNIFAPEGNYRYLT
          || :     ||||||||||||:||||||||||||||||||||||||||||||||||||||
g287      KPPT-----RSARSRRSLPAEIPLIPVNQADTLIVDGEAVSLTGHSGNIFAPEGNYRYLT
                 240       250       260       270       280       290

         350       360       370       380       390       400       409
m287.pep  YGAEKLPGGSYALRVQGEPAKGEMLAGAAVYNGEVLHFHTENGRPYPTRGRFAAKVDFGS
          |||||||||||||||||||||||||:|:||||||||||| |||||||: |||||||||||
g287      YGAEKLPGGSYALRVQGEPAKGEMLVGTAVYNGEVLHFHMENGRPYPSGGRFAAKVDFGS
                 300       310       320       330       340       350

         410       420       430       440       450       460       469
m287.pep  KSVDGIIDSGDDLHMGTQKFKAAIDGNGFKGTWTENGSGDVSGKFYGPAGEEVAGKYSYR
          |||||||||||||||||||||||||||||||||||||:|||||:||||||||||||||||
g287      KSVDGIIDSGDDLHMGTQKFKAAIDGNGFKGTWTENGGGDVSGRFYGPAGEEVAGKYSYR
                 360       370       380       390       400       410

         470       480       489
m287.pep  PTDAEKGGFGVFAGKKEQDX
          ||||||||||||||||::||
g287      PTDAEKGGFGVFAGKKDRDX
                 420       430
```

The following partial DNA sequence was identified in *N. meningitidis* <SEQ ID 1203>:

```
a287.seq
   1  ATGTTTAAAC GCAGTGTGAT TGCAATGGCT TGTATTGTTG CCCTTTCAGC

  51  CTGTGGGGGC GGCGGTGGCG GATCGCCCGA TGTTAAGTCG GCGGACACGC

 101  TGTCAAAACC TGCCGCCCCT GTTGTTACTG AAGATGTCGG GGAAGAGGTG

 151  CTGCCGAAAG AAAAGAAAGA TGAGGAGGCG GTGAGTGGTG CGCCGCAAGC

 201  CGATACGCAG GACGCAACCG CCGGAAAAGG CGGTCAAGAT ATGGCGGCAG

 251  TTTCGGCAGA AAATACAGGC AATGGCGGTG CGGCAACAAC GGATAATCCC

 301  GAAAATAAAG ACGAGGGACC GCAAAATGAT ATGCCGCAAA ATGCCGCCGA

 351  TACAGATAGT TCGACACCGA ATCACACCCC TGCACCGAAT ATGCCAACCA

 401  GAGATATGGG AAACCAAGCA CCGGATGCCG GGGAATCGGC ACAACCGGCA

 451  AACCAACCGG ATATGGCAAA TGCGGCGGAC GGAATGCAGG GGGACGATCC

 501  GTCGGCAGGG GAAAATGCCG GCAATACGGC AGATCAAGCT GCAAATCAAG

 551  CTGAAAACAA TCAAGTCGGC GGCTCTCAAA ATCCTGCCTC TTCAACCAAT

 601  CCTAACGCCA CGAATGGCGG CAGCGATTTT GGAAGGATAA ATGTAGCTAA
```

-continued

```
 651 TGGCATCAAG CTTGACAGCG GTTCGGAAAA TGTAACGTTG ACACATTGTA

 701 AAGACAAAGT ATGCGATAGA GATTTCTTAG ATGAAGAAGC ACCACCAAAA

 751 TCAGAATTTG AAAAATTAAG TGATGAAGAA AAAATTAATA AATATAAAAA

 801 AGACGAGCAA CGAGAGAATT TTGTCGGTTT GGTTGCTGAC AGGGTAGAAA

 851 AGAATGGAAC TAACAAATAT GTCATCATTT ATAAAGACAA GTCCGCTTCA

 901 TCTTCATCTG CGCGATTCAG GCGTTCTGCA CGGTCGAGGC GGTCGCTTCC

 951 GGCCGAGATG CCGCTGATTC CCGTCAATCA GGCGGATACG CTGATTGTCG

1001 ATGGGGAAGC GGTCAGCCTG ACGGGGCATT CCGGCAATAT CTTCGCGCCC

1051 GAAGGGAATT ACCGGTATCT GACTTACGGG GCGGAAAAAT TGTCCGGCGG

1101 ATCGTATGCC CTCAGTGTGC AAGGCGAACC GGCAAAAGGC GAAATGCTTG

1151 CGGGCACGGC CGTGTACAAC GGCGAAGTGC TGCATTTCCA TATGGAAAAC

1201 GGCCGTCCGT CCCCGTCCGG AGGCAGGTTT GCCGCAAAAG TCGATTTCGG

1251 CAGCAAATCT GTGGACGGCA TTATCGACAG CGGCGATGAT TTGCATATGG

1301 GTACGCAAAA ATTCAAAGCC GTTATCGATG GAAACGGCTT TAAGGGGACT

1351 TGGACGGAAA ATGGCGGCGG GGATGTTTCC GGAAGGTTTT ACGGCCCGGC

1401 CGGCGAAGAA GTGGCGGGAA AATACAGCTA TCGCCCGACA GATGCGGAAA

1451 AGGGCGGATT CGGCGTGTTT GCCGGCAAAA AAGAGCAGGA TTGA
```

This corresponds to the amino acid sequence <SEQ ID 1204; ORF 287.a>:

```
a287.pep

  1 MFKRSVIAMA CIVALSACGG GGGGSPDVKS ADTLSKPAAP VVTEDVGEEV

 51 LPKEKKDEEA VSGAPQADTQ DATAGKGGQD MAAVSAENTG NGGAATTDNP

101 ENKDEGPQND MPQNAADTDS STPNHTPAPN MPTRDMGNQA PDAGESAQPA

151 NQPDMANAAD GMQGDDPSAG ENAGNTADQA ANQAENNQVG GSQNPASSTN

201 PNATNGGSDF GRINVANGIK LDSGSENVTL THCKDKVCDR DFLDEEAPPK

251 SEFEKLSDEE KINKYKKDEQ RENFVGLVAD RVEKNGTNKY VIIYKDKSAS

301 SSSARFRRSA RSRRSLPAEM PLIPVNQADT LIVDGEAVSL TGHSGNIFAP

351 EGNYRYLTYG AEKLSGGSYA LSVQGEPAKG EMLAGTAVYN GEVLHFHMEN

401 GRPSPSGGRF AAKVDFGSKS VDGIIDSGDD LHMGTQKFKA VIDGNGFKGT

451 WTENGGGDVS GRFYGPAGEE VAGKYSYRPT DAEKGGFGVF AGKKEQD*
```

m287/a287 77.2% identity in 501 aa overlap

```
                      10        20        30        40                  49
m287.pep      MFKRSVIAMACIFALSACGGGGGGSPDVKSADTLSKPAAPVVSE-----------KETEA
              |||||||||||| |||||||||||||||||||||||||||||:|           |: ||
a287          MFKRSVIAMACIVALSACGGGGGGSPDVKSADTLSKPAAPVVTEDVGEEVLPKEKKDEEA
                      10        20        30        40        50        60

             50        60        70        80        90       100      109
m287.pep      KEDAPQAGSQGQGAPSAQGSQDMAAVSEENTGNGGAVTADNPKNEDEVAQNDMPQNAAGT
                 |||| :|   | :::|:||||||| ||||||||:|:|||:|:||  ||||||||| |
a287          VSGAPQADTQ--DATAGKGGQDMAAVSAENTGNGGAATTDNPENKDEGPQNDMPQNAADT
                      70          80        90       100       110

            110       120       130       140       150       160      169
m287.pep      DSSTPNHTPDPNMLAGNMENQATDAGESSQPANQPDMANAADGMQGDDPSAGGQNAGNTA
              ||||||||| ||| : :| ||| |||||:||||||||||||||||||||||| :||||||
a287          DSSTPNHTPAPNMPTRDMGNQAPDAGESAQPANQPDMANAADGMQGDDPSAG-ENAGNTA
             120       130       140       150       160       170
```

-continued

```
               170       180       190       200       210       220      229
m287.pep       AQGANQAGNNQAAGSSDPIPASNPAPANGGSNFGRVDLANGVLIDGPSQNITLTHCKGDS
                |:|||| |||::||::|  ::||  :||||:|||:::|||: :|: |:|:||||||
a287           DQAANQAENNQVGGSQNPASSTNPNATNGGSDFGRINVANGIKLDSGSENVTLTHCKDKV
                180       190       200       210       220       230

               230       240       250       260       270       280      289
m287.pep       CSGNNFLDEEVQLKSEFEKLSDADKISNYKKDGKNDKFVGLVADSVQMKGINQYIIFYKP
               |:  :|||||:  ||||||||| :||::|||| : ::||||||| |: :| |:|:|:||
a287           CD-RDFLDEEAPPKSEFEKLSDEEKINKYKKDEQRENFVGLVADRVEKNGTNKYVIIYKD
                 240       250       260       270       280       290

               290       300         310       320       330       340
m287.pep       KP--TSFARFRRSARSRRSLPAEMPLIPVNQADTLIVDGEAVSLTGHSGNIFAPEGNYRY
               |:  :|||||:  ||||||||| :||::|||| : ::||||||| |: :| |:|:|:||
a287           KSASSSSARFRRSARSRRSLPAEMPLIPVNQADTLIVDGEAVSLTGHSGNIFAPEGNYRY
                 300       310       320       330       340       350

               350       360       370       380       390       400
m287.pep       LTYGAEKLPGGSYALRVQGEPAKGEMLAGAAVYNGEVLHFHTENGRPYPTRGRFAAKVDF
               |||||||| |||||| |||||||||||||:||||||||||| ||||| |: |||||||||
a287           LTYGAEKLSGGSYALSVQGEPAKGEMLAGTAVYNGEVLHFHMENGRPSPSGGRFAAKVDF
                 360       370       380       390       400       410

               410       420       430       440       450       460
m287.pep       GSKSVDGIIDSGDDLHMGTQKFKAAIDGNGFKGTWTENGSGDVSGKFYGPAGEEVAGKYS
               ||||||||||||||||||||||||:||||||||||||||:|||||:||||||||||||||
a287           GSKSVDGIIDSGDDLHMGTQKFKAVIDGNGFKGTWTENGGGDVSGRFYGPAGEEVAGKYS
                 420       430       440       450       460       470

               470       480       489
m287.pep       YRPTDAEKGGFGVFAGKKEQDX
               ||||||||||||||||||||||
a287           YRPTDAEKGGFGVFAGKKEQDX
                 480       490
```

The following partial DNA sequence was identified in *N. gonorrhoeae* <SEQ ID 1205>:

```
g288.seq
   1 atgcacaccg gacaggcggt aagccgggtt ctgtctcgga cagtcattcc

  51 tctaggcata ccgttgccgg tatgctcaag caacctaccc gaacgctcgg

 101 cgggcagcgt cattgcgttc tgtttggtct tgctccgaat ggggtttggc

 151 ctgccgcata ttgttaccaa atgcgcggtg cgcccttacc gcaccttttc

 201 acccttgcct gtgctgccaa agcagccatc ggcggttttg ctttctgttc

 251 cactttccgt cgcgttaccg cgcccggccg ttaaccggca ttctaccctg

 301 cggagcccgg actttcctcc ccgtatgcct tacgcgatac gcggcgactg

 351 tctgcccgtc ccgtgtgcgg cgcggattat aacacgaaac gcaaaaatgc

 401 cgtctgaaac ggtacaggtt tcagacggca tacagcctaa actacacacc

 451 ctgtttcagg ctggcttcga tgaagccgtc caagtcgccg tccaatacgg

 501 ctttgtggtt gccgacttcg tagcctgtac gcaagtcttt gatgcgtga
```

This corresponds to the amino acid sequence <SEQ ID 1206; ORF 288.ng>:

```
g288.pep
   1 MHTGQAVSRV LSRTVIPLGI PLPVCSSNLP ERSAGSVIAF CLVLLRMGFG

  51 LPHIVTKCAV RPYRTFSPLP VLPKQPSAVL LSVPLSVALP RPAVNRHSTL

 101 RSPDFPPRMP YAIRGDCLPV PCAARIITRN AKMPSETVQV SDGIQPKLHT

 151 LFQAGFDEAV QVAVQYGFVV ADFVACTQVF DA*
```

The following partial DNA sequence was identified in *N. meningitidis* <SEQ ID 1207>:

```
m288.seq
   1 ATGCACACCG GACAGGCGGT AAGCCGGGTT CTGTCTCGGA CAGTCATTCC

  51 TCTAGGCATA CCGTTACCGG TATGCTCAAG CAACCTACCC GAACGCTCGG

 101 CGGGCAGCGT CATTGCGTTC TGTTTGGTCT TGCTCCGAAT GGGGTTTGGC

 151 CTGCCGCATA TTGTTACCAA ATGCGCGGTG CGCCCTTACC GCACCTTTTC

 201 ACCCTTACCT GTGCTGCCAA AGCAGCCATC GGCGGTTTTG CTTTCTGTTC

 251 CACTTTCCGT CGCGTTACCG CGCCCGGCCG TTAACCGGCA TTCTACCCTG

 301 CGGAGCCCGG ACTTTCCTCC CCGTATGCCT TACGCGATAC GCGGCGACTG

 351 TCTGCCCGTC CCGTGTGCGG CGCGGATTAT AACACGAAAC ACAAAAATGC

 401 CGTCTGAAAC GGTACAGGTT TCAGACGGCA TACAGCCTAA ACTACACGCC

 451 CTGTTTCAGG CTGGCTTCGA TGAAGCCGTC CAAGTCGCCA TCCAATACGG

 501 CTTTGGTGTT GCCGACTTCG TAGCCTGTAC GCAAGTCTTT GATACGTGA
```

This corresponds to the amino acid sequence <SEQ ID 1208; ORF 288>:

```
m288.pep
   1 MHTGQAVSRV LSRTVIPLGI PLPVCSSNLP ERSAGSVIAF CLVLLRMGFG

  51 LPHIVTKCAV RPYRTFSPLP VLPKQPSAVL LSVPLSVALP RPAVNRHSTL

 101 RSPDFPPRMP YAIRGDCLPV PCAARIITRN TKMPSETVQV SDGIQPKLHA

 151 LFQAGFDEAV QVAIQYGFGV ADFVACTQVF DT*
```

Computer analysis of this amino acid sequence gave the following results:
Homology with a Predicted ORF from *N. gonorrhoeae*

```
m288/g288   97.8% identity in 181 aa overlap

                    10        20        30        40        50        60
m288.pep    MHTGQAVSRVLSRTVIPLGIPLPVCSSNLPERSAGSVIAFCLVLLRMGFGLPHIVTKCAV
            ||||||||||||||||||||||||||||||||||||||||||||||||||||||||||||
g288        MHTGQAVSRVLSRTVIPLGIPLPVCSSNLPERSAGSVIAFCLVLLRMGFGLPHIVTKCAV
                    10        20        30        40        50        60
                    70        80        90       100       110       120
m288.pep    RPYRTFSPLPVLPKQPSAVLLSVPLSVALPRPAVNRHSTLRSPDFPPRMPYAIRGDCLPV
            ||||||||||||||||||||||||||||||||||||||||||||||||||||||||||||
g288        RPYRTFSPLPVLPKQPSAVLLSVPLSVALPRPAVNRHSTLRSPDFPPRMPYAIRGDCLPV
                    70        80        90       100       110       120
                   130       140       150       160       170       180
m288.pep    PCAARIITRNTKMPSETVQVSDGIQPKLHALFQAGFDEAVQVAIQYGFGVADFVACTQVF
            ||||||||||:|||||||||||||||||||:|||||||||||||:|||| ||||||||||
g288        PCAARIITRNAKMPSETVQVSDGIQPKLHTLFQAGFDEAVQVAVQYGFVVADFVACTQVF
                   130       140       150       160       170       180

m288.pep    DTX
            |:|
g288        DAX
```

The following partial DNA sequence was identified in *N. meningitidis* <SEQ ID 1209>:

```
a288.seq
  1  ATGCACACCG GACAGGCGGT AAGCCGGGTT CTGTCTCGGA CAGTCATTCC
```

-continued

```
 51 TCTAGGCATA CCGTTGCCGG TATGCTCAAG CAACCTACCC GAACGCTCGG

101 CGGGCAGCGT CATTGCGTTC TGTTTGGTCT TGCTCCGAAT GGGGTTTGGC

151 CTGCCGCATA TTGTTACCAA ATGCGCGGTG CGCCCTTACC GCACCTTTTC

201 ACCCTTGCCT GTGCTGCCAA AGCAGCCATC GGCGGTTTTG CTTTCTGTTC

251 CACTTTCCGT CGCGTTACCG CGCCCGGCCG TTAACCGGCA TTCTACCCTG

301 CGGAGCCCGG ACTTTCCTCC CCGTATGCCT TACGCGATAC GCGGCGACTG

351 TCTGCCCGTC CCGTGTGCGG CGCGGATTAT AACACGAAAC GCAAAAATGC

401 CGTCTGAAAC GGTACAGGTT TCAGACGGCA TACAGCCTAA ACTACACGCC

451 CTGTTTCAGG CTGGCTTCGA TAAAGCCGTC CAAGTCGCCG TCCAATACGG

501 CTTTGGTGTT GCCGACTTCG TAGCCTGTGC GCAAGTCTTT AATGCGTGA
```

This corresponds to the amino acid sequence <SEQ ID 1210; ORF 288.a>:

```
a288.pep
      1 MHTGQAVSRV LSRTVIPLGI PLPVCSSNLP ERSAGSVIAF CLVLLRMGFG

     51 LPHIVTKCAV RPYRTFSPLP VLPKQPSAVL LSVPLSVALP RPAVNRHSTL

    101 RSPDFPPRMP YAIRGDCLPV PCAARIITRN AKMPSETVQV SDGIQPKLHA

    151 LFQAGFDKAV QVAVQYGFGV ADFVACAQVF NA*
```

```
m288/a288   97.2% identity in 181 aa overlap

                    10        20        30        40        50        60
m288.pep    MHTGQAVSRVLSRTVIPLGIPLPVCSSNLPERSAGSVIAFCLVLLRMGFGLPHIVTKCAV
            ||||||||||||||||||||||||||||||||||||||||||||||||||||||||||||
a288        MHTGQAVSRVLSRTVIPLGIPLPVCSSNLPERSAGSVIAFCLVLLRMGFGLPHIVTKCAV
                    10        20        30        40        50        60

                    70        80        90       100       110       120
m288.pep    RPYRTFSPLPVLPKQPSAVLLSVPLSVALPRPAVNRHSTLRSPDFPPRMPYAIRGDCLPV
            ||||||||||||||||||||||||||||||||||||||||||||||||||||||||||||
a288        RRYRTFSPLPVLPKQPSAVLLSVPLSVALPRPAVNRHSTLRSPDFPPRMPYAIRGDCLPV
                    70        80        90       100       110       120

                   130       140       150       160       170       180
m288.pep    PCAARIITRNTKMPSETVQVSDGIQPKLHALFQAGFDEAVQVAIQYGFGVADFVACTQVF
            ||||||||||:||||||||||||||||||||||||||:|||||:||||||||||||:|||
a288        PCAARIITRNAKMPSETVQVSDGIQPKLHALFQAGFDKAVQVAVQYGFGVADFVACAQVF
                   130       140       150       160       170       180

m288.pep    DTX
            ::
a288        NAX
```

The following partial DNA sequence was identified in *N. gonorrhoeae* <SEQ ID 1211>:

```
g290.seq
  1  atggcaaaaa tgatgaaatg ggcggctgtt gcggcggtcg cggcggcagc

 51  ggtttggggc ggatggtctt atctgaagcc cgaaccgcag gctgcttata

101  ttacggaagc ggtcaggcgc ggcgatatca gccggacggt ttccgcgacg

151  ggcgagattt cgccgtccaa cctggtatcg gtcggcgcgc aggcttcggg

201  gcagattaaa aagctttatg tcaaactcgg gcaacaggtc aaaaagggcg

251  atttgattgc ggaaatcaat tcgaccacgc agaccaacac gatcgatatg

301  gaaaaatcca aattggaaac gtatcaggcg aagctggtgt ccgcacagat

351  tgcattgggc agcgcggaaa aaaaatataa gcgtcaggcg gcgttgtgga
```

-continued

```
 401 aggatgatgc gacctctaaa gaagatttgg aaagcgcgca ggatgcgctt

 451 gccgccgcca aagccaatgt tgccgagttg aaggctttaa tcagacagag

 501 caaaatttcc atcaataccg ccgagtcgga tttgggctac acgcgcatta

 551 ccgcgacgat ggacggcacg gtggtggcga ttcccgtgga agaggggcag

 601 actgtgaacg cggcgcagtc tacgccgacg attgtccaat tggcgaatct

 651 ggatatgatg ttgaacaaaa tgcagattgc cgagggcgat attaccaagg

 701 tgaaggcggg gcaggatatt tcgtttacga ttttgtccga accggatacg

 751 ccgattaagg cgaagctcga cagcgtcgac cccgggctga ccacgatgtc

 801 gtcgggcggc tacaacagca gtacggatac ggcttccaat gcggtctatt

 851 attatgcccg ttcgtttgtg ccgaatccgg acggcaaact cgccacgggg

 901 atgacgacgc agaatacggt tgaaatcgac ggtgtgaaaa atgtgttgct

 951 tattccgtcg ctgaccgtga aaaatcgcgg cggcaaggcg ttcgtacgcg

1001 tgttgggtgc ggacggcaag gcagtggaac gcgaaatccg gaccggtatg

1051 aaagacagta tgaataccga agtgaaaagc gggttgaaag aggggacaa

1101 agtggtcatc tccgaaataa ccgccgccga gcagcaggaa agcggcgaac

1151 gcgccctagg cggcccgccg cgccgataa
```

This corresponds to the amino acid sequence <SEQ ID 1212; ORF 290.ng>:

```
g290.pep
  1 MAKMMKWAAV AAVAAAAVWG GWSYLKPEPQ AAYITEAVRR GDISRTVSAT

 51 GEISPSNLVS VGAQASGQIK KLYVKLGQQV KKGDLIAEIN STTQTNTIDM

101 EKSKLETYQA KLVSAQIALG SAEKKYKRQA ALWKDDATSK EDLESAQDAL

151 AAAKANVAEL KALIRQSKIS INTAESDLGY TRITATMDGT VVAIPVEEGQ

201 TVNAAQSTPT IVQLANLDMM LNKMQIAEGD ITKVKAGQDI SFTILSEPDT

251 PIKAKLDSVD PGLTTMSSGG YNSSTDTASN AVYYYARSFV PNPDGKLATG

301 MTTQNTVEID GVKNVLLIPS LTVKNRGGKA FVRVLGADGK AVEREIRTGM

351 KDSMNTEVKS GLKEGDKVVI SEITAAEQQE SGERALGGPP RR*
```

The following partial DNA sequence was identified in N. meningitidis <SEQ ID 1213>:

```
m290.seq (partial)
  1 ..GTATCGGTCG GCGCGCAGGC ATCGGGGCAG ATTAAGATAC TTTATGTCAA

 51   ACTCGGGCAA CAGGTTAAAA AGGGCGATTT GATTGCGGAA ATCAATTCGA

101   CCTCGCAGAC CAATACGCTC AATACGGAAA ATCCAAGTT GGAAACGTAT

151   CAGGCGAAGC TGGTGTCGGC ACAGATTGCA TTGGGCAGCG CGGAGAAGAA

201   ATATAAGCGT CAGGCGGCGT TATGGAAGGA AAACGCGACT TCCAAAGAGG

251   ATTTGGAAAG CGCGCAGGAT GCGTTTGCCG CCGCCAAAGC CAATGTTGCC

301   GAGCTGAAGG CTTTAATCAG ACAGAGCAAA ATTTCCATCA ATACCGCCGA

351   GTCGGAATTG GGCTACACGC GCATTACCGC AACGATGGAC GGCACGGTGG

401   TGGCGATTCT CGTGGAAGAG GGGCAGACTG TGAACGCGGC GCAGTCTACG

451   CCGACGATTG TCCAATTGGC GAATCTGGAT ATGATGTTGA ACAAAATGCA
```

-continued

```
 501  GATTGCCGAG GGCGATATTA CCAAGGTGAA GGCGGGGCAG GATATTTCGT

 551  TTACGATTTT GTCCGAACCG GATACGCCGA TTAAGGCGAA GCTCGACAGC

 601  GTCGACCCCG GGCTGACCAC GATGTCGTCG GGCGGTTACA ACAGCAGTAC

 651  GGATACGGCT TCCAATGCGG TCTACTATTA TGCCCGTTCG TTTGTGCCGA

 701  ATCCGGACGG CAAACTCGCC ACGGGGATGA CGACGCAGAA TACGGTTGAA

 751  ATCGACGGCG TGAAAAATGT GCTGATTATT CCGTCGCTGA CCGTGAAAAA

 801  TCGCGGCGGC AAGGCGTTTG TGCGCGTGTT GGGTGCGGAC GGCAAGGCGG

 851  CGGAACGCGA AATCCGGACC GGTATGAGAG ACAGTATGAA TACCGAAGTA

 901  AAAAGCGGGT TGAAAGAGGG GGACAAAGTG GTCATCTCCG AAATAACCGC

 951  CGCCGAGCAA CAGGAAAGCG GCGAACGCGC CCTAGGCGGC CCGCCGCGCC

1001  GATAA
```

This corresponds to the amino acid sequence <SEQ ID 1214; ORF 290>:

```
m290.pep (partial)
   1 ..VSVGAQASGQ IKILYVKLGQ QVKKGDLIAE INSTSQTNTL NTEKSKLETY

  51  QAKLVSAQIA LGSAEKKYKR QAALWKENAT SKEDLESAQD AFAAAKANVA

 101  ELKALIRQSK ISINTAESEL GYTRITATMD GTVVAILVEE GQTVNAAQST

 151  PTIVQLANLD MMLNKMQIAE GDITKVKAGQ DISFTILSEP DTPIKAKLDS

 201  VDPGLTTMSS GGYNSSTDTA SNAVYYYARS FVPNPDGKLA TGMTTQNTVE

 251  IDGVKNVLII PSLTVKNRGG KAFVRVLGAD GKAAEREIRT GMRDSMNTEV

 301  KSGLKEGDKV VISEITAAEQ QESGERALGG PPRR*
```

Computer analysis of this amino acid sequence gave the following results:

Homology with a Predicted ORF from *N. gonorrhoeae*

```
m290/g290  96.1% identity in 334 aa overlap

                                                      10        20        30
m290.pep                                      VSVGAQASGQIKILYVKLGQQVKKGDLIAE
                                              |||||||||||| |||||||||||||||||
g290            PQAAYITEAVRRGDISRTVSATGEISPSNLVSVGAQASGQIKKLYVKLGQQVKKGDLIAE
                30        40        50        60        70        80

                        40        50        60        70        80        90
m290.pep        INSTSQTNTLNTEKSKLETYQAKLVSAQIALGSAEKKYKRQAALWKENATSKEDLESAQD
                ||||:||||:: ||||||||||||||||||||||||||||||||||  ||||||||||||
g290            INSTTQTNTIDMEKSKLETYQAKLVSAQIALGSAEKKYKRQAALWKDDATSKEDLESAQD
                90        100       110       120       130       140

                       100       110       120       130       140       150
m290.pep        AFAAAKANVAELKALIRQSKISINTAESELGYTRITATMDGTVVAILVEEGQTVNAAQST
                |:||||||||||||||||||||||||||:||||||||||||||||| |||||||||||||
g290            ALAAAKANVAELKALIRQSKISINTAESDLGYTRITATMDGTVVAIPVEEGQTVNAAQST
               150       160       170       180       190       200

                       160       170       180       190       200       210
m290.pep        PTIVQLANLDMMLNKMQIAEGDITKVKAGQDISFTILSEPDTPIKAKLDSVDPGLTTMSS
                ||||||||||||||||||||||||||||||||||||||||||||||||||||||||||||
g290            PTIVQLANLDMMLNKMQIAEGDITKVKAGQDISFTILSEPDTPIKAKLDSVDPGLTTMSS
               210       220       230       240       250       260

                       220       230       240       250       260       270
m290.pep        GGYNSSTDTASNAVYYYARSFVPNPDGKLATGMTTQNTVEIDGVKNVLIIPSLTVKNRGG
                ||||||||||||||||||||||||||||||||||||||||||||||||:|||||||||||
g290            GGYNSSTDTASNAVYYYARSFVPNPDGKLATGMTTQNTVEIDGVKNVLLIPSLTVKNRGG
               270       280       290       300       310       320
```

-continued

```
                 280        290        300        310        320        330
m290.pep    KAFVRVLGADGKAAEREIRTGMRDSMNTEVKSGLKEGDKVVISEITAAEQQESGERALGG
            ||||||||||||:||||:||||||||||||||||||||||||||||||||||||||||||
g290        KAFVRVLGADGKAVEREIRTGMKDSMNTEVKSGLKEGDKVVISEITAAEQQESGERALGG
           330        340        350        360        370        380

m290.pep    PPRRX
            |||||
g290        PPRRX
           390
```

The following partial DNA sequence was identified in *N. meningitidis* <SEQ ID 1215>:

```
a290.seq
   1 ATGGCAAAAA TGATGAAATG GGCGGCTGTT GCGGCGGTCG CGGCGGCAGC

  51 GGTTTGGGGC GGATGGTCTT ATCTGAAGCC CGAGCCGCAG GCTGCTTATA

 101 TTACGGAAAC GGTCAGGCGC GGCGACATCA GCCGGACGGT TTCTGCAACA

 151 GGGGAGATTT CGCCGTCCAA CCTGGTATCG GTCGGCGCGC AGGCATCGGG

 201 GCAGATTAAG AAACTTTATG TCAAACTCGG GCAACAGGTT AAAAAGGGCG

 251 ATTTGATTGC GGAAATCAAT TCGACCTCGC AGACCAATAC GCTCAATACG

 301 GAAAAATCCA AATTGGAAAC GTATCAGGCG AAGCTGGTGT CGGCACAGAT

 351 TGCATTGGGC AGCGCGGAGA AGAAATATAA GCGTCAGGCG GCGTTGTGGA

 401 AGGATGATGC GACCGCTAAA GAAGATTTGG AAAGCGCACA GGATGCGCTT

 451 GCCGCCGCCA AAGCCAATGT TGCCGAGCTG AAGGCTCTAA TCAGACAGAG

 501 CAAAATTTCC ATCAATACCG CCGAGTCGGA ATTGGGCTAC ACGCGCATTA

 551 CCGCAACGAT GGACGGCACG GTGGTGGCGA TTCTCGTGGA AGAGGGGCAG

 601 ACTGTGAACG CGGCGCAGTC TACGCCGACG ATTGTCCAAT TGGCGAATCT

 651 GGATATGATG TTGAACAAAA TGCAGATTGC CGAGGGCGAT ATTACCAAGG

 701 TGAAGGCGGG GCAGGATATT TCGTTTACGA TTTTGTCCGA ACCGGATACG

 751 CCGATTAAGG CGAAGCTCGA CAGCGTCGAC CCCGGGCTGA CCACGATGTC

 801 GTCGGGCGGC TACAACAGCA GTACGGATAC GGCTTCCAAT GCGGTCTACT

 851 ATTATGCCCG TTCGTTTGTG CCGAATCCGG ACGGCAAACT CGCCACGGGG

 901 ATGACGACGC AGAATACGGT TGAAATCGAC GGTGTGAAAA ATGTGCTGAT

 951 TATTCCGTCG CTGACCGTGA AAAATCGCGG CGGCAGGGCG TTTGTGCGCG

1001 TGTTGGGTGC AGACGGCAAG GCGGCGGAAC GCGAAATCC GACCGGTATG

1051 AGAGACAGTA TGAATACCGA AGTAAAAAGC GGGTTGAAAG AGGGGGACAA

1101 AGTGGTCATC TCCGAAATAA CCGCCGCCGA GCAGCAGGAA AGCGGCGAAC

1151 GCGCCCTAGG CGGCCCGCCG CGCCGATAA
```

This corresponds to the amino acid sequence <SEQ ID 1216; ORF 290.a>:

```
a290.pep
      1 MAKMMKWAAV AAVAAAAVWG GWSYLKPEPQ AAYITETVRR GDISRTVSAT

     51 GEISPSNLVS VGAQASGQIK KLYVKLGQQV KKGDLIAEIN STSQTNTLNT

    101 EKSKLETYQA KLVSAQIALG SAEKKYKRQA ALWKDDATAK EDLESAQDAL

    151 AAAKANVAEL KALIRQSKIS INTAESELGY TRITATMDGT VVAILVEEGQ
```

-continued

```
201  TVNAAQSTPT IVQLANLDMM LNKMQIAEGD ITKVKAGQDI SFTILSEPDT

251  PIKAKLDSVD PGLTTMSSGG YNSSTDTASN AVYYYARSFV PNPDGKLATG

301  MTTQNTVEID GVKNVLIIPS LTVKNRGGRA FVRVLGADGK AAEREIRTGM

351  RDSMNTEVKS GLKEGDKVVI SEITAAEQQE SGERALGGPP RR*
```

m290/a290  98.2% identity in 334 aa overlap

```
                                                   10        20        30
m290.pep                                    VSVGAQASGQIKILYVKLGQQVKKGDLIAE
                                            |||||||||||| |||||||||||||||||
a290        PQAAYITETVRRGDISRTVSATGEISPSNLVSVGAQASGQIKKLYVKLGQQVKKGDLIAE
           30        40        50        60        70        80

                    40        50        60        70        80        90
m290.pep    INSTSQTNTLNTEKSKLETYQAKLVSAQIALGSAEKKYKRQAALWKENATSKEDLESAQD
            ||||||||||||||||||||||||||||||||||||||||||||||::||:|||||||||
a290        INSTSQTNTLNTEKSKLETYQAKLVSAQIALGSAEKKYKRQAALWKDDATAKEDLESAQD
           90       100       110       120       130       140

                   100       110       120       130       140       150
m290.pep    AFAAAKANVAELKALIRQSKISINTAESELGYTRITATMDGTVVAILVEEGQTVNAAQST
            |:||||||||||||||||||||||||||||||||||||||||||||||||||||||||||
a290        ALAAAKANVAELKALIRQSKISINTAESELGYTRITATMDGTVVAILVEEGQTVNAAQST
          150       160       170       180       190       200

                   160       170       180       190       200       210
m290.pep    PTIVQLANLDMMLNKMQIAEGDITKVKAGQDISFTILSEPDTPIKAKLDSVDPGLTTMSS
            ||||||||||||||||||||||||||||||||||||||||||||||||||||||||||||
a290        PTIVQLANLDMMLNKMQIAEGDITKVKAGQDISFTILSEPDTPIKAKLDSVDPGLTTMSS
          210       220       230       240       250       260

                   220       230       240       250       260       270
m290.pep    GGYNSSTDTASNAVYYYARSFVPNPDGKLATGMTTQNTVEIDGVKNVLIIPSLTVKNRGG
            ||||||||||||||||||||||||||||||||||||||||||||||||||||||||||||
a290        GGYNSSTDTASNAVYYYARSFVPNPDGKLATGMTTQNTVEIDGVKNVLIIPSLTVKNRGG
          270       280       290       300       310       320

                   280       290       300       310       320       330
m290.pep    KAFVRVLGADGKAAEREIRTGMRDSMNTEVKSGLKEGDKVVISEITAAEQQESGERALGG
            :|||||||||||||||||||||||||||||||||||||||||||||||||||||||||||
a290        RAFVRVLGADGKAAEREIRTGMKDSMNTEVKSGLKEGDKVVISEITAAEQQESGERALGG
          330       340       350       360       370       380

m290.pep    PPRRX
            |||||
a290        PPRRX
          390
```

The following partial DNA sequence was identified in *N. gonorrhoeae* <SEQ ID 1217>:

```
g292.seq
   1 atgaaaacca agttaatcaa aatcttgacc ccctttaccg tcctgccgct

  51 gctggcttgc gggcaaacgc ccgtttccaa tgccaacgcc gaatccgccg

 101 tcaaagccga atccgccggc aaatccgttg ccgcttcttt gaaagcgcgt

 151 ttggaaaaaa cctattccgc ccaagatttg aaagtgttga gcgtcagcga

 201 aacaccggtc aaaggcattt acgaagtcgt cgtcagcggc aggcagatta

 251 tctacaccga tgccgaaggc ggctatatgt tcgtcggcga actcatcaac

 301 atcgacacgc gcaaaaacct gaccgaagaa cgcgccgccg atttgaacaa

 351 aatcgacttc gcctccctgc ctttggacaa agccatcaaa gaagtacgcg

 401 gcaacggcaa gctgaaagtc gccgtcttct ccgaccccga ttgtccgttc

 451 tgcaaacgct tggaacatga gtttgaaaaa atgaccgacg tgacggttta

 501 cagctttatg atgcccattg ccggcctgca cccagatgcc gcgcgcaagg

 551 cgcaaatctt atggtgtcag cccgaccgtg ccaaagcgtg gacggattgg

 601 atgcgtaaag gcaaattccc ggtcggcggc agcatctgcg acaatcccgt

 651 cgcggaaacc acttccttgg gcgaacagtt cggcttcaac ggcacgccga
```

-continued 701 cccttcgtct tccccaacgg gcgcacccaa agcggttaca gcccgatgcc 751 ccaactggag gaaatcatcc gcaaaaacca gcagtaaacc cgcaatga This corresponds to the amino acid sequence <SEQ ID 1218; ORF 292.ng>:

g292.pep

1 MKTKLIKILT PFTVLPLLAC GQTPVSNANA ESAVKAESAG KSVAASLKAR

51 LEKTYSAQDL KVLSVSETPV KGIYEVVVSG RQIIYTDAEG GYMFVGELIN

101 IDTRKNLTEE RAADLNKIDF ASLPLDKAIK EVRGNGKLKV AVFSDPDCPF

151 CKRLEHEFEK MTDVTVYSFM MPIAGLHPDA ARKAQILWCQ PDRAKAWTDW

201 MRKGKFPVGG SICDNPVAET TSLGEQFGFN GTPTLRLPQR AHPKRLQPDA

251 PTGGNHPQKP AVNPQ*

The following partial DNA sequence was identified in *N. meningitidis* <SEQ ID 1219>:

m292.seq

1 ATGAAAACCA AGTTAATCAA AATCTTGACC CCCTTTACCG TCCTCCCGCT

51 GCTGGCTTGC GGGCAAACGC CCGTTTCCAA TGCCAACGCC GAACCCGCCG

101 TCAAAGCCGA GTCCGCCGGC AAATCCGTTG CCGCCTCTTT GAAAGCGCGT

151 TTGGAAAAAA CCTATTCCGC CCAAGATTTG AAAGTGTTGA GCGTCAGCGA

201 AACACCGGTC AAAGGCATTT ACGAAGTCGT CGTCAGCGGC AGGCAGATTA

251 TCTACACCGA TGCCGAAGGC GGCTATATGT TCGTCGGCGA ACTCATCAAC

301 ATCGACACGC GCAAAAACCT GACCGAAGAA CGCGCCGCCG ATTTGAACAA

351 AATCGACTTC GCCTCCCTGC CTTTGGACAA AGCCATCAAA GAAGTGCGCG

401 GCAACGGCAA GCTGAAAGTC GCCGTCTTCT CCGACCCCGA TTGTCCGTTC

451 TGCAAACGCT TGGAACACGA GTTTGAAAAA ATGACCGACG TGACGGTTTA

501 CAGCTTTATG ATGCCCATTG CCGGCCTGCA CCCCGATGCC GCGCGCAAGG

551 CGCAAATCTT ATGGTGTCAG CCCGACCGCG CCAAAGCGTG GACGGATTGG

601 ATGCGTAAAG GCAAATTCCC GGTCGGCGGC AGCATCTGCG ACAATCCCGT

651 CGCGGAAACC ACTTCCTTGG GCGAACAATT CGGCTTCAAC GGCACGCCGA

701 CCCTCGTCTT CCCCAACGGG CGCAGCCAAA GCGGCTACAG CCCGATGCCC

751 CAACTGGAGG AAATCATCCG CAAAAATCAA TAA

This corresponds to the amino acid sequence <SEQ ID 1220; ORF 292>:

m292.pep

1 MKTKLIKILT PFTVLPLLAC GQTPVSNANA EPAVKAESAG KSVAASLKAR

51 LEKTYSAQDL KVLSVSETPV KGIYEVVVSG RQIIYTDAEG GYMFVGELIN

101 IDTRKNLTEE RAADLNKIDF ASLPLDKAIK EVRGNGKLKV AVFSDPDCPF

151 CKRLEHEFEK MTDVTVYSFM MPIAGLHPDA ARKAQILWCQ PDRAKAWTDW

201 MRKGKFPVGG SICDNPVAET TSLGEQFGFN GTPTLVFPNG RSQSGYSPMP

251 QLEEIIRKNQ *

Computer analysis of this amino acid sequence gave the following results:
Homology with a Predicted ORF from *N. gonorrhoeae*

```
m292/g292  98.7% identity in 238 aa overlap

                   10        20        30        40        50        60
m290.pep   MKTKLIKILTPFTVLPLLACGQTPVSNANAEPAVKAESAGKSVAASLKARLEKTYSAQDL
           |||||||||||||||||||||||||||||||| |||||||||||||||||||||||||||
g290       MKTKLIKILTPFTVLPLLACGQTPVSNANAESAVKAESAGKSVAASLKARLEKTYSAQDL
                   10        20        30        40        50        60

                   70        80        90       100       110       120
m290.pep   KVLSVSETPVKGIYEVVVSGRQIIYTDAEGGYMFVGELINIDTRKNLTEERAADLNKIDF
           ||||||||||||||||||||||||||||||||||||||||||||||||||||||||||||
g290       KVLSVSETPVKGIYEVVVSGRQIIYTDAEGGYMFVGELINIDTRKNLTEERAADLNKIDF
                   70        80        90       100       110       120

                  130       140       150       160       170       180
m290.pep   ASLPLDKAIKEVRGNGKLKVAVFSDPDCPFCKRLEHEFEKMTDVTVYSFMMPIAGLHPDA
           ||||||||||||||||||||||||||||||||||||||||||||||||||||||||||||
g290       ASLPLDKAIKEVRGNGKLKVAVFSDPDCPFCKRLEHEFEKMTDVTVYSFMMPIAGLHPDA
                  130       140       150       160       170       180

                  190       200       210       220       230       240
m290.pep   ARKAQILWCQPDRAKAWTDWMRKGKFPVGGSICDNPVAETTSLGEQFGFNGTPTLVFPNG
           |||||||||||||||||||||||||||||||||||||||||||||||||||||| :|:
g290       ARKAQILWCQPDRAKAWTDWMRKGKFPVGGSICDNPVAETTSLGEQFGFNGTPTLRLPQR
                  190       200       210       220       230       240

                  250       260
m290.pep   RSQSGYSPMPQLEEIIRKNQX

g290       AHPKRLQPDAPTGGNHPQKPAVNPQX
                  250       260
```

The following partial DNA sequence was identified in *N. meningitidis* <SEQ ID 1221>:

```
a292.seq
  1 ATGAAAACCA AGTTAATCAA AATCTTGACC CCCTTTACCG TCCTCCCGCT
 51 GCTGGCTTGC GGGCAAACGC CCGTTTCCAA TGCCAACGCC GAACCCGCCG
101 TCAAAGCCGA GTCCGCCGGC AAATCCGTTG CCGCCTCTTT GAAAGCGCGT
151 TTGGAAAAAA CCTATTCCGC CCAAGATTTG AAAGTGTTGA GCGTCAGCGA
201 AACACCGGTC AAAGGCATTT ACGAAGTCGT CGTCAGCGGC AGGCAGATTA
251 TCTACACCGA TGCCGAAGGC GGCTATATGT TCGTCGGCGA ACTCATCAAC
301 ATCGACACGC GCAAAAACCT GACCGAAGAA CGCGCCGCCG ATTTGAACAA
351 AATCGACTTC GCCTCCCTGC CTTTGGACAA AGCCATCAAA GAAGTGCGCG
401 GCAACGGCAA GCTGAAAGTC GCCGTCTTCT CCGACCCCGA TTGTCCGTTC
451 TGCAAACGCT TGGAACACGA GTTTGAAAAA ATGACCGACG TGACGGTTTA
501 CAGCTTTATG ATGCCCATTG CCGGCCTGCA CCCCGATGCC GCGCGCAAGG
551 CGCAAATCTT ATGGTGTCAG CCCGACCGCG CCAAAGCGTG GACGGATTGG
601 ATGCGTAAAG GCAAATTCCC GGTCGGCGGC AGCATCTGCG ACAATCCCGT
651 CGCGGAAACC ACTTCCTTGG GCGAACAATT CGGCTTCAAC GGCACGCCGA
701 CCCTCGTCTT CCCCAACGGG CGCAGCCAAA GCGGCTACAG CCCGATGCCC
751 CAACTGGAGG AAATCATCCG CAAAAATCAA TAA
```

This corresponds to the amino acid sequence <SEQ ID 1222; ORF 292.a>:

```
a292.pep

    1  MKTKLIKILT PFTVLPLLAC GQTPVSNANA EPAVKAESAG KSVAASLKAR
```

-continued

```
 51  LEKTYSAQDL KVLSVSETPV KGIYEVVVSG RQIIYTDAEG GYMFVGELIN

101  IDTRKNLTEE RAADLNKIDF ASLPLDKAIK EVRGNGKLKV AVFSDPDCPF

151  CKRLEHEFEK MTDVTVYSFM MPIAGLHPDA ARKAQILWCQ PDRAKAWTDW

201  MRKGKFPVGG SICDNPVAET TSLGEQFGFN GTPTLVFPNG RSQSGYSPMP

251  QLEEIIRKNQ *
```

m292/a292  100.0% identity in 260 aa overlap

```
                    10        20        30        40        50        60
m292.pep    MKTKLIKILTPFTVLPLLACGQTPVSNANAEPAVKAESAGKSVAASLKARLEKTYSAQDL
            ||||||||||||||||||||||||||||||| ||||||||||||||||||||||||||||
a292        MKTKLIKILTPFTVLPLLACGQTPVSNANAESAVKAESAGKSVAASLKARLEKTYSAQDL
                    10        20        30        40        50        60

                    70        80        90       100       110       120
m292.pep    KVLSVSETPVKGIYEVVVSGRQIIYTDAEGGYMFVGELINIDTRKNLTEERAADLNKIDF
            ||||||||||||||||||||||||||||||||||||||||||||||||||||||||||||
a292        KVLSVSETPVKGIYEVVVSGRQIIYTDAEGGYMFVGELINIDTRKNLTEERAADLNKIDF
                    70        80        90       100       110       120

                   130       140       150       160       170       180
m292.pep    ASLPLDKAIKEVRGNGKLKVAVFSDPDCPFCKRLEHEFEKMTDVTVYSFMMPIAGLHPDA
            ||||||||||||||||||||||||||||||||||||||||||||||||||||||||||||
a292        ASLPLDKAIKEVRGNGKLKVAVFSDPDCPFCKRLEHEFEKMTDVTVYSFMMPIAGLHPDA
                   130       140       150       160       170       180

                   190       200       210       220       230       240
m292.pep    ARKAQILWCQPDRAKAWTDWMRKGKFPVGGSICDNPVAETTSLGEQFGFNGTPTLVFPNG
            ||||||||||||||||||||||||||||||||||||||||||||||||||||||||||||
a292        ARKAQILWCQPDRAKAWTDWMRKGKFPVGGSICDNPVAETTSLGEQFGFNGTPTLVFPNG
                   190       200       210       220       230       240

                   250       260
m292.pep    RSQSGYSPMPQLEEIIRKNQX

a292        RSQSGYSPMPQLEEIIRKNQX
                   250       260
```

The following partial DNA sequence was identified in *N. gonorrhoeae* <SEQ ID 1223>:

```
g294.seq (partial)
  1 atgcgtatta cctgtgcgcc gatgtcgctt ttgtcggcgg cagtctggtc

 51 ggttcgggct gtcagaacat catcgaaccg ctttcctgcg gcgttacgac

101 gatattcggc ttttcgacct acaatttttc cgaagcctgc cggcacgcct

151 tggcatcggg tgcggcggtt caagtcgaat cggcggacgc gtggcgtgaa

201 gccgttgaaa aaaccttatc tggcgagggg ggcggaatgc agatgcaggc

251 gcgcgtggac ggctttatcg cacaacatcg cggagcgggc gcgagaatcg

301 ccgaggcggt gcgggaagcg gtatgcggac atcgggggcg atagtgatac

351 aatccgtatc cgagttttcc ggttggagca tcgtatgagt atttatgccg

401 tcgcgcacat catccacctg tattgcgcca ccgcctttgt cggcggcgtg

451 ttttttgaag tgctggtttt gtccgtcctg catacgggac gggtgtcgcg

501 cgaggcgcgg cgcgaagtgg aaaaggcaat gtcttaccgc gccgtcaggg

551 tgatgccgtt tgcggtcgga ctgctgttcg ccaggggaac tctagagtcg

601 actgcagcag catgccctc...
```

This corresponds to the amino acid sequence <SEQ ID 1224; ORF 294.ng>:

```
g294.pep (partial)
  1 MRITCAPMSL LSAAVWSVRA VRTSSNRFPA ALRRYSAFRP TIFPKPAGTP
```

-continued

```
 51 WHRVRRFKSN RRTRGVKPLK KPYLARGAEC RCRRAWTALS HNIAERARES

101 PRRCGKRYAD IGGDSDTIRI RVFRLEHRMS IYAVAHIIHL YCATAFVGGV

151 FFEVLVLSVL HTGRVSREAR REVEKAMSYR AVRVMPFAVG LLFARGTLES

201 TAAACP....
```

The following partial DNA sequence was identified in *N. meningitidis* <SEQ ID 1225>:

```
m294.seq
  1 ATGCGTATTA CCTGTGCGCC GATGTCGCTT TTGTCGGCGG CAGTCTGGTC

 51 GATTCGGGTT GTCAGAACAT CATCGAACCG CTTTCCTGCG GCGTTCCGAC

101 GATATTCGGC TTTTCAACCT ACAATTTTTC CGAAGCCTGC CGACACGCCT

151 TGGCATCGGG TGCGGCGGTT CAAGTCGAAT CGGCGGATGC GTGGCGGGAA

201 GCCGTTGAAA AAACCTTATC GTCCGAGGGG GGGGGGATGC AGATGCAGGC

251 GCGCGTGGAC GGCTTTATCG CACAACATCG CGGAGCGGGC GCGAGAATCG

301 CCGAGGCGGT GCGGGAAGCG GTATGCGGAT ATCGGGGGCG ATAGTGATAC

351 AATCCGTATC CGAGTTTTCC GTTTGGAGCA TCGTATGAGT ATTTATGCCG

401 TCGCGCACAT CGTTCATCTG TATTGCGCTA TTGCCTTTGT CGGCGGCGTG

451 TTTTTTGAAG TGCTGGTTTT GTCCGTCCTG CATACGGGAC GGGTGTCGCG

501 CGAGGCGCGG CGCGAAGTGG AAAAGGCAAT GTCTTACCGC GCCGTCAGGG

551 TGATGCCGTT TGTGGTCGGA CTGCTGTTCG CCAGCGGCAT CGTGATGGCG

601 GCAAACCGCT ATCTTTCTAT ATTGGGCGAA CCGTTTGCCA CTTCCTTCGG

651 TACGATGCTG ACGCTGAAAA TCCTGTTGGC GTTCAGCGTA TTGGCGCACT

701 TCGCCATCGC CGTCGTCAAA ATGGCGCGTT CCACACTGAC GGTCGGTTGG

751 TCGAAATACA TACACGCCGT CGTCTTTACC CATATGcTGC TGATTGTCTT

801 TTTGGCAAAA GCGATGTTTT ATATCAGCTG GTAA
```

This corresponds to the amino acid sequence <SEQ ID 1226; ORF 294>:

```
m294.pep

  1 MRITCAPMSL LSAAVWSIRV VRTSSNRFPA AFRRYSAFQP TIFPKPADTP

 51 WHRVRRFKSN RRMRGGKPLK KPYRPRGGGC RCRRAWTALS HNIAERARES

101 PRRCGKRYAD IGGDSDTIRI RVFRLEHRMS IYAVAHIVHL YCAIAFVGGV

151 FFEVLVLSVL HTGRVSREAR REVEKAMSYR AVRVMPFVVG LLFASGIVMA

201 ANRYLSILGE PFATSFGTML TIKILLAFSV LAHFAIAVVK MARSTLTVGW

251 SKYIHAVVFT HMLLIVFLAK AMFYISW*

g294/m294  92.3% identity in 196 aa overlap

                   10        20        30        40        50        60
g294.pep  MRITCAPMSLLSAAVWSVRAVRTSSNRFPAALRRYSAFRPTIFPKPAGTPWHRVRRFKSN
          |||||||||||||||||:|:|||||||||||:||||||:|||||||| ||||||||||||
m294      MRITCAPMSLLSAAVWSIRVVRTSSNRFPAAFRRYSAFQPTIFPKPADTPWHRVRRFKSN
                   10        20        30        40        50        60

                   70        80        90       100       110       120
g294.pep  RRTRGVKPLKKPYLARGAECRCRRAWTALSHNIAERARESPRRCGKRYADIGGDSDTIRI
          || || |||||||  ||: |||||||||||||||||||||||||||||||||||||||||
m294      RRMRGGKPLKKPYRPRGGGCRCRRAWTALSHNIAERARESPRRCGKRYADIGGDSDTIRI
                   70        80        90       100       110       120
```

-continued

```
                130        140        150        160        170        180
g294.pep  RVFRLEHRMSIYAVAHIIHLYCATAFVGGVFFEVLVLSVLHTGRVSPEARREVEKAMSYR
          ||||||||||||||||:||||| |||||||||||||||||||||||||||||||||||
m294      RVFRLEHRMSIYAVAHIVHLYCAIAFVGGVFFEVLVLSVLHTGRVSREARREVEKAMSYR
                130        140        150        160        170        180

                190        200
g294.pep  AVRVMPFAVGLLFARGTLESTAAACP
          |||||||:|||||| |
m294      AVRVMPFVVGLLFASGIVMAANRYLSILGEPFATSFGTMLTLKILLAFSVLAHFAIAVVK
                190        200        210        220        230        240
```

The following partial DNA sequence was identified in *N. meningitidis* <SEQ ID 1227>:

```
a294.seq
  1 ATGCGTATTA CCTGTGCGCC GATGTCGCTT TTGTCGGCGG CAGTCTGGTC

 51 GATTCGGGCT GTCAGAACAT CATCGAACCG CTTTCCTGCG GCGTTCCGAC

101 GATATTCGGC TTTTCGACCT ACAATTTTTC CGAAGCCTGC CGGCACGCCT

151 TGGCATCGGG TGCGGCGGTT CAAGTCGAAT CGGCGGACGC GTGGCGGGAA

201 GCCGTTGAAA AAAACTTATC GTCCGAGGAG GGCGGAATGC AGATGCAGGC

251 GCGCGCGGAC GGCTTTATCG CACAACATCG CGGAGCGGGC GCGAGAATCG

301 CCGAGGCGGT ACGGGAAGCG GTATGCGGAC ATCGGGGACG ATAGTGATAC

351 AATCCGTATC CGAGTTTTCC GGTTGGAGTA CCGTATGAGT ATTTATGCCG

401 TCGCGCACAT CGTCCACCTG TATTGCGCCA TCGCCTTTGT CGGCGGCGTG

451 TTTTTTGAAG TGCTGGTTTT GTCCGTCCTG CATACGGGAC GGGTGTCGTG

501 CGAGGCGCGG CGCGAAGTGG AAAAGGCAAT GTCTTACCGC GCCGTCAGGG

551 TGATGCCGTT TGTGGTCGGA CTGCTGTTCG CCAGCGGCAT CGTGATGGCG

601 GCAAACCGCT ATCTTTCTAT ATTGGGCGAA CCGTTTGCCA CTTCCTTCGG

651 TACGATGCTG ACGCTGAAAA TCCTGTTGGC GTTCAGCGTG TTGGCGCACT

701 TCGCCATCGC CGTCGTCAAA ATGGCGCGTT CCACACTGAC CGTCGGCTGG

751 TCGAAATACA TACACACCGT CGTCTTTACC CATATGCTGC TGATTGTCTT

801 TTTGGCAAAA GCGATGTTTT ATATCAGCTG GTAA
```

This corresponds to the amino acid sequence <SEQ ID 1228; ORF 294.a>:

```
a294.pep
  1 MRITCAPMSL LSAAVWSIRA VRTSSNRFPA AFRRYSAFRP TIFPKPAGTP

 51 WHRVRRFKSN RRTRGGKPLK KTYRPRRAEC RCRRARTALS HNIAERARES

101 PRRYGKRYAD IGDDSDTIRI RVFRLEYRMS IYAVAHIVHL YCAIAFVGGV

151 FFEVLVLSVL HTGRVSCEAR REVEKAMSYR AVRVMPFVVG LLFASGIVMA

201 ANRYLSILGE PFATSFGTML TLKILLAFSV LAHFAIAVVK MARSTLTVGW

251 SKYIHTVVFT HMLLIVFLAK AMFYISW*
```

m294/a294 94.9% identity in 277 aa overlap

```
                 10         20         30         40         50         60
m294.pep  MRITCAPMSLLSAAVWSIRVVRTSSNRFPAAFRRYSAFQPTIFPKPADTPWHRVRRFKSN
          |||||||||||||||||||:|||||||||||||||||||:||||||||| |||||||||||
a294      MRITCAPMSLLSAAVWSIRAVRTSSNRFPAAFRRYSAFRPTIFPKPAGTPWHRVRRFKSN
                 10         20         30         40         50         60
```

-continued

```
                      70        80        90       100       110       120
m294.pep      RRMRGGKPLKKPYRPRGGGCRCRRAWTALSHNIAERARESPRRCGKRYADIGGDSDTIRI
              || |||||||| |||| : |||||| ||||||||||||||||| |||||||| |||||||
a294          RRTRGGKPLKKTYRPRRAECRCRRARTALSHNIAERARESPRRYGKRYADIGDDSDTIRI
                      70        80        90       100       110       120

                     130       140       150       160       170       180
m294.pep      RVFRLEHRMSIYAVAHIVHLYCAIAFVGGVFFEVLVLSVLHTGRVSREARREVEKAMSYR
              ||||||:||||||||||||||||||||||||||||||||||||||| |||||||||||||
a294          RVFRLEYRMSIYAVAHIVHLYCAIAFVGGVFFEVLVLSVLHTGRVSCEARREVEKAMSYR
                     130       140       150       160       170       180

                     190       200       210       220       230       240
m294.pep      AVRVMPFVVGLLFASGIVMAANRYLSILGEPFATSFGTMLTLKILLAFSVLAHFAIAVVK
              ||||||||||||||||||||||||||||||||||||||||||||||||||||||||||||
a294          AVRVMPFVVGLLFASGIVMAANRYLSILGEPFATSFGTMLTLKILLAFSVLAHFAIAVVK
                     190       200       210       220       230       240

                     250       260       270
m294.pep      MARSTLTVGWSKYIHAVVFTHMLLIVFLAKAMFYISWX
              |||||||||||||||:||||||||||||||||||||||
a294          MARSTLTVGWSKYIHTVVFTHMLLIVFLAKAMFYISWX
                     250       260       270
```

The following partial DNA sequence was identified in *N. gonorrhoeae* <SEQ ID 1229>:

```
g295.seq
   1 atgctcggga tggcgcggca cgacggccag cagggcatcg ccgcgatatt

  51 gttgccacgc cgccagcagt ttttccgcct cgtcttcgcc ccgataaacg

 101 cgcgtgctgc cgcacacggc aaccggccgg cctccgatgc gtttttcaaa

 151 ctgccccgcc agcgttttca tgtcttcaga cggcatcagg tcgtatttgg

 201 tattgccgca cacctgcacg gatgccgcgc ccaatttcgc caaccgcgcc

 251 gcatccgcct ccgtctgcgc cagacagccc gtcagcgaag cggctgcggg

 301 acggatcagg cggcggactt tcagataacc gttcagcgat ttttccgaca

 351 gccgcgcatt cgccaaaaac agcggcacac ccgctcgccg gcattccttc

 401 atcagattgg gccagatttc ggtttccatc aaaatgccga acatcgggcg

 451 gtgttcgcgc aaaaactgcc gtacccacgt ttttttgtca tacggaagat

 501 agcggcattg cgcatcggga aacagaactt gcgcggtttc ccgtcccgtc

 551 ggggtcatct gcgtcatcag cagcggcgca tcgggaaaac gccgccgcaa

 601 ctcgcgtatc aagggctggg cggcacgcgt ttctccgacc gaaacggcgt

 651 gtatccaaac cgcgccggta acgggattcg gatgcggctt gccgaaacgc

 701 tcgtccctat gcgcccggta tgccggggca cttccggagc gtttgtccaa

 751 ataacgccgt atccatatcg gcgcaagcag ccacaataca tcataaagcc

 801 attggaacat ctttctattt cctgcaaaac aaatgccgtc cgaacggttc

 851 ggacggcatt tcggcaacgg aatcaaatat cgtag
```

This corresponds to the amino acid sequence <SEQ ID 1230; ORF 295.ng>:

```
g295.pep
   1 MLGMARHDGQ QGIAAILLPR RQQFFRLVFA PINARAAAHG NRPASDAFFK

  51 LPRQRFHVFR RHQVVFGIAA HLHGCRAQFR QPRRIRLRLR QTARQRSGCG

 101 TDQAADFQIT VQRFFRQPRI RQKQRHTRSP AFLHQIGPDF GFHQNAEHRA

 151 VFAQKLPYPR FFVIRKIAAL RIGKQNLRGF PSRRGHLRHQ QRRIGKTPPQ
```

-continued

```
201 LAYQGLGGTR FSDRNGVYPN RAGNGIRMRL AETLVPMRPV CRGTSGAFVQ

251 ITPYPYRRKQ PQYIIKPLEH LSISCKTNAV RTVRTAFRQR NQIS*
```

The following partial DNA sequence was identified in *N. meningitidis* <SEQ ID 1231>:

```
m295.seq.
  1 ATGCTCGGGA TGGCGCGGCA CGACGACCAG CAGCGCATCG CCGCGATATT

 51 GTTGCCACGC CGCCAGCAGT TTTTCCGCCT CGTCTTCACC CCGATAAACG

101 CGCGTGCTGC CGCACACGGC AACCGGCCGG CCTCCGATGC GTTTTTCAAA

151 CTGCCCCGCC AGCGTTTTCA TCTGTTCCGA CGGTATGATG TCGTATTTGG

201 TATTGCCGCA CACCTGCACG GATGCCGCGC CCAATTTCGC CAACCGCGCC

251 GCATCCGCCT CTGTCTGCGC CAGACACCCC GTCAGCGAAG CGGCGGCAGG

301 ACGGATCAGG CGGCGGACTT TCAGATAACC GTTCAACGAT TTTTCCGACA

351 GCCGCGCATT CGCCAAAAAC AGCGGCACAC CCGCGCGCCG GCATTCCCTC

401 ATCAGGTTGG GCCAGATTTC GGTTTCCATC AAAATGCCGA ACATCGGGCG

451 GTGTTCGCGC AAAAACTGCC GTACCCACGT TTTTTTGTCA TACGGAAGAT

501 AGCGGCATTG CGCATCGGGA AACAGAACTT GCGCGGTTTC CCGCCCCGTC

551 GGGGTCATCT GCGTCATCAG CAGCGGCGCA TCGGGAAAAC GCCGCCGCAA

601 CTCGCGTATC AAGGACTGGG CGGCACGCGT TTCTCCGACC GAAACGGCGT

651 GTATCCAAAC CGCGCCGGTA ACGGGATTCG GATACGGCTT GCCGAAACGC

701 TCGTCCCGAT GCGCCCGATA TGCCGGGGCA CTTCCGGAGC GTTTGTCCAA

751 ATAACGCCGT ATCCATATCG GCGCAAGCAG CCACAATACA TCATAAAGCC

801 ATTGGAACAT CTTTCTATTT CCTGCAAAAC AAATGCCGTC TGAACGGTTC

851 AGACGGCATT TCGGCAACGG AATCAAATAT CGTAG
```

This corresponds to the amino acid sequence <SEQ ID 1232; ORF 295>:

```
m295.pep

  1 MLGMARHDDQ QRIAAILLPR RQQFFRLVFT PINARAAAHG NRPASDAFFK

 51 LPRQRFHLFR RYDVVFGIAA HLHGCRAQFR QPRRIRLCLR QTPRQRSGGR

101 TDQAADFQIT VQRFFRQPRI RQKQRHTRAP AFPHQVGPDF GFHQNAEHRA

151 VFAQKLPYPR FFVIRKIAAL RIGKQNLRGF PPRRGHLRHQ QRRIGKTPPQ

201 LAYQGLGGTR FSDRNGVYPN RAGNGIRIRL AETLVPMRPI CRGTSGAFVQ

251 ITPYPYRRKQ PQYIIKPLEH LSISCKTNAV XTVQTAFRQR NQIS*

m295/g295   93.9% identity in 294 aa overlap

                    10        20        30        40        50        60
m295.pep    MLGMARHDDQQRIAAILLPRRQQFFRLVFTPINARAAAHGNRPASDAFFKLPRQRFHLFR
            |||||||| || ||||||||||||||||:|||||||||||||||||||||||||||:||
g295        MLGMARHDGQQGIAAILLPRRQQFFRLVFAPINARAAAHGNRPASDAFFKLPRQRFHVFR
                    10        20        30        40        50        60

                    70        80        90       100       110       120
m295.pep    RYDVVFGIAAHLHGCRAQFRQPRRIRLCLRQTPRQRSGGRTDQAADFQITVQRFFRQPRI
            |::||||||||||||||||||||||| |||| |||||  ||||||||||||||||||||
g295        RHQVVFGIAAHLHGCRAQFRQPRRIRLRLRQTARQRSGCGTDQAADFQITVQRFFRQPRI
                    70        80        90       100       110       120
```

-continued

```
                 130       140       150       160       170       180
m295.pep  RQKQRHTRAPAFPHQVGPDFGFHQNAEHRAVFAQKLPYPRFFVIRKIAALRIGKQNLRGF
          ||||||||:||| ||:||||||||||||||||||||||||||||||||||||||||||||
g295      RQKQRHTRSPAFLHQIGPDFGFHQNAEHRAVFAQKLPYPRFFVIRKIAALRIGKQNLRGF
                 130       140       150       160       170       180

                 190       200       210       220       230       240
m295.pep  PPRRGHLRHQQRRIGKTPPQLAYQGLGGTRFSDRNGVYPNRAGNGIRIRLAETLVPMRPI
          | |||||||||||||||||||||||||||||||||||||||||||||:|||||||||||:
g295      PSRRGHLRHQQRRIGKTPPQLAYQGLGGTRFSDRNGVYPNRAGNGIRMRLAETLVPMRPV
                 190       200       210       220       230       240

                 250       260       270       280       290
m295.pep  CRGTSGAFVQITPYPYRRKQPQYIIKPLEHLSISCKTNAVXTVQTAFRQRNQISX
          |||||||||||||||||||||||||||||||||||||||| ||:||||||||||
g295      CRGTSGAFVQITPYPYRRKQPQYIIKPLEHLSISCKTNAVRTVRTAFRQRNQIS
                 250       260       270       280       290
```

The following partial DNA sequence was identified in *N. meningitidis* <SEQ ID 1233>:

```
a295.seq.
  1 ATGCTCGGGA TGGCGCGGCA CGACGACCAG CAGGGCATCG CCGCGATATT

 51 GTTGCCACGC CGCCAGCAGT TTTTCCGCCT CGTCTTCACC CCGATAAACG

101 CGCGTGCTGC CGCACACGGC AACCTGCCGG TCTCCGATGC GTTTTTCAAA

151 CTGCCCCGCC AGCGTTTTCA TCTGTTCCGA CGGCATCAGG TCGTATTTGG

201 TATTGCCGCA CACCTGCACG GATGCCGCGC CCAATTTCGC CAACCGCGCC

251 GCATCCGCCT CCGTCTGTGC CAGACAGCCC GTCAGCGAAG CGGCGGCAGG

301 ACGGATCAGG CTGCGGACTT TCAGATAACC GTTTAGCGAT TTTTCCGACA

351 GCCGCGCATT CGCCAAAAAC AGCGGCACAC CCGTGCGCCG GCATTCCTTC

401 ATCAGATTGG GCCAGATTTC GGTTTCCATC AAAATGCCGA ACATCGGGCG

451 GTGTTCGCGC AAAAACTGCC GTACCCACGT TTTTTTGTCA TACGGAAGAT

501 AGCGGCATTG TGCATCAGGA AACAGAACTT GCGCGGTTTC CCGTCCCGTC

551 GGGGTCATCT GCGTCATCAG CAGCGGCGCA TCGGGAAAAC GCTGCCGCAA

601 CTCGCGTATC AAAGGTTGGG CGGCACGCGT TTCCCCGACC GAAACGGCGT

651 GTATCCAAAC CGCGCCGGTA ACGGGATTCG GATACGGCTT GCCGAAACGC

701 TCGCCCCGAT GCGCCCGATA TGCAGGGGCA CTTCCGGAGC GTTTGTCCAA

751 ATAACGCCGT ATCCATATCG GCGCAAGCAG CCACAATACA TCATAAAGCC

801 ATTGGAACAT CTTTCTATTT CCTGCAAAAC AAATGCCGTC CGAACGGTTC

851 GGACGGCATT TCGGCAACGG AATCAAATAT CGTAG
```

This corresponds to the amino acid sequence <SEQ ID 1234; ORF 295.a>:

```
a295.pep
  1 MLGMARHDDQ QGIAAILLPR RQQFFRLVFT PINARAAAHG NLPVSDAFFK

 51 LPRQRFHLFR RHQVVFGIAA HLHGCRAQFR QPRRIRLRLC QTARQRSGGR

101 TDQAADFQIT V*RFFRQPRI RQKQRHTRAP AFLHQIGPDF GFHQNAEHRA

151 VFAQKLPYPR FFVIRKIAAL CIRKQNLRGF PSRRGHLRHQ QRRIGKTLPQ

201 LAYQRLGGTR FPDRNGVYPN RAGNGIRIRL AETLAPMRPI CRGTSGAFVQ

251 ITPYPYRRKQ PQYIIKPLEH LSISCKTNAV RTVRTAFRQR NQIS*
```

m295/a295 93.2% identity in 294 aa overlap

```
                    10        20        30        40        50        60
m295.pep    MLGMARHDDQQRIAAILLPRRQQFFRLVFTPINARAAAHGNRPASDAFFKLPRQRFHLFR
            ||||||||||| ||||||||||||||||||||||||||||| |:||||||||||||||||
a295        MLGMARHDDQQGIAAILLPRRQQFFRLVFTPINARAAAHGNLPVSDAFFKLPRQRFHLFR
                    10        20        30        40        50        60

                    70        80        90       100       110       120
m295.pep    RYDVVFGIAAHLHGCRAQFRQPRRIRLCLRQTPRQRSGGRTDQAADFQITVQRFFRQPRI
            |::|||||||||||||||||||||||| | || |||||||||||||||||| ||||||||
a295        RHQVVFGIAAHLHGCRAQFRQPRRIRLRLRQTARQRSGCGTDQAADFQITVQRFFRQPRI
                    70        80        90       100       110       120

                   130       140       150       160       170       180
m295.pep    RQKQRHTRAPAFPHQVGPDFGFHQNAEHRAVFAQKLPYPRFFVIRKIAALRIGKQNLRGF
            |||||||||||| ||:|||||||||||||||||||||||||||||||||| | |||||||
a295        RQKQRHTRSPAFLHQIGPDFGFHQNAEHRAVFAQKLPYPRFFVIRKIAALRIGKQNLRGF
                   130       140       150       160       170       180

                   190       200       210       220       230       240
m295.pep    PPRRGHLRHQQRRIGKTPPQLAYQGLGGTRFSDRNGVYPNRAGNGIRIRLAETLVPMRPI
            | ||||||||||||||| |||||| |||||| ||||||||||||||||||||||:|||||
a295        PSRRGHLRHQQRRIGKTPPQLAYQGLGGTRFSDRNGVYPNRAGNGIRMRLAETLVPMRPI
                   190       200       210       220       230       240

                   250       260       270       280       290
m295.pep    CRGTSGAFVQITPYPYRRKQPQYIIKPLEHLSISCKTNAVXTVQTAFRQRNQISX
            |||||||||||||||||||||||||||||||||||||||| ||:|||||||||||
a295        CRGTSGAFVQITPYPYRRKQPQYIIKPLEHLSISCKTNAVXTVQTAFRQRNQISX
                   250       260       270       280       290
```

The following partial DNA sequence was identified in *N. gonorrhoeae* <SEQ ID 1235>:

```
g297.seq.
     1  ATGGCTGTCT TCCCACTTTC GGCAAAACAT CGGAAATACG CGCTGCGCGC
    51  GCTTGCCGTT TCGATTATTC TGGTGtcgGC GGCATACATT GCttcgacag
   101  aggggaccga gcgcgtcaga ccgcAGCGCG TggaacaaAA ACTGCCGCCG
   151  CTGTCtTGGg gcggcaacgg CGTtcagacg gcaTATTGGG TGCAGGAGGC
   201  GGTGCagccg ggggactcgC TGGCGGACGT GCTGGCGCGT TCGGGTATGG
   251  CGCGGGacga gattgCCcga ATcacGGAAA aataTggcgG CGAAGCCGAT
   301  TTGCGgcatt tGCGTGCCGA CCAGTCGGTT CATGTTTTGG TCGGCGGCGA
   351  CGGCAGTGCG CGCGAAGTGC AGTTTTttaC CGACGAAGAC GGCGAGCGCA
   401  aTctGGTCGC TTTGGAAAAA AAAGGCGGCA TATGGCGGCG GTCGGCTTCT
   451  GATGCGGATA TGAAGGTTTT GCCGACACTG CGTTCGGTCG TGGTCAAAAC
   501  GTCGGCGCGC GGTTCGCTGG CGCGGGCGGA AGTGCCCGTC GAAATCCGCG
   551  AATCCTTAAG CGGGATTTTT GCCGGCCGCT TCAGCCTTGA CGGTTTGAAG
   601  GAAGGCGATG CCGTGCGCCT GCTTTACGAC AGCCTGTATT TCCACGGGCA
   651  GCAGGTGGCG GCGGGCGATA TTTTGGCGGC GGAAGTTGTC AAGGGCGGCA
   701  CAACCCATCA GGCGTTCTAT TACCGTTCGG ACAAGGAAGG CGGAGGGGGC
   751  GGCAATTATT ACGATGAAGA CGGCAGGGTG TTGCAGGAAA AAGGCGGCTT
   801  CAACATCgaG CCGCTGGTCT ATACGCGCAT TTCTTCGCCG TTCGGCTACC
   851  GTATGCACCC CATCCTGCAC ACATGGCGGC TGCACACGGG CATCGATTAT
   901  GCCGCACCGC AGGGAACGCC GGTCAGGGCT TCCGCCGACG GCGTGATTAC
   951  CTTTAAAGGC CGGAAGGGCG GATACGGCAA CGCGGTGATG ATACGCCACG
  1001  CCAACGGTGT GGAAACGCTG TACGCGCACT TGAGCGCGTT TTCGCAGGCA
```

-continued

```
1051  CAAGGCAATG TGCGCGGCGG CGAGGTCATC GGTTTTGTCG GTTCGACAGG

1101  GCGTTCGACC GGGCCGCACC TGCATTACGA GGCGCGCATC AACGGGCAGC

1151  CCGTCAATCC TGTTTCGGTC GCATTGCCGA CACCCGAATT GACGCAGGCG

1201  GACAAGGCGG CGTTTGCCGC GCAGAAACAG AAGGCGGACG CGCTGCTTGC

1251  GCGCTTGCGC GGCATACCGG TTACCGTGTC GCAATCGGAT TGA
```

This corresponds to the amino acid sequence <SEQ ID 1236; ORF 297.ng>:

```
g297.pep
  1 MAVFPLSAKH RKYALRALAV SIILVSAAYI ASTEGTERVR PQRVEQKLPP

 51 LSWGGNGVQT AYWVQEAVQP GDSLADVLAR SGMARDEIAR ITEKYGGEAD

101 LRHLRADQSV HVLVGGDGSA REVQFFTDED GERNLVALEK KGGIWRRSAS

151 DADMKVLPTL RSVVVKTSAR GSLARAEVPV EIRESLSGIF AGRFSLDGLK

201 EGDAVRLLYD SLYFHGQQVA AGDILAAEVV KGGTTHQAFY YRSDKEGGGG

251 GNYYDEDGRV LQEKGGFNIE PLVYTRISSP FGYRMHPILH TWRLHTGIDY

301 AAPQGTPVRA SADGVITFKG RKGGYGNAVM IRHANGVETL YAHLSAFSQA

351 QGNVRGGEVI GFVGSTGRST GPHLHYEARI NGQPVNPVSV ALPTPELTQA

401 DKAAFAAQKQ KADALLARLR GIPVTVSQSD *
```

The following partial DNA sequence was identified in *N. meningitidis* <SEQ ID 1237>:

```
m297.seq.
  1  ATGGCTGTCT TCCCACTTTC GGCAAAACAT CGGAAATACG CGCTGCGTGC

 51  GCTTGCCGTT TCGATTATTT TGGTGTCGGC GGCATACATT GCTTCGACAG

101  AGAGGACGGA GCGCGTCAGA CCGCAGCGCG TGGAACAAAA TCTGCCGCCG

151  CTGTCTTGGG GCGGCAGCGG CGTTCAGACG GCATATTGGG TGCAGGAGGC

201  GGTGCAGCCG GGCGACTCGC TGGCGGACGT GCTGGCGCGT TCGGGTATGG

251  CGCGGGACGA GATTGCCCGA ATCACGGAAA AATATGGCGG CGAAGCCGAT

301  TTGCGGCATT TGCGTGCCGA CCAGTCGGTT CATGTTTTGG TCGGCGGCGA

351  CGGCGGCGCG CGCGAAGTGC AGTTTTTTAC CGACGAAGAC GGCGAGCGCA

401  ATCTGGTCGC TTTGGAAAAG AAAGGCGGCA TATGGCGGCG GTCGGCTTCT

451  GAGGCGGATA TGAAGGTTTT GCCGACGCTG CGTTCGGTCG TGGTCAAAAC

501  GTCGGCGCGC GGTTCGCTGG CGCGGGCGGA AGTGCCCGTC GAAATCCGCG

551  AATCCTTAAG CGGGATTTTC GCCGGCCGCT TCAGCCTTGA CGGTTTGAAG

601  GAAGGCGATG CCGTGCGCCT GATGTACGAC AGCCTGTATT TCCACGGGCA

651  GCAGGTGGCG GCGGGCGATA TTTTGGCGGC TGAAGTCGTT AAGGGCGGCA

701  CAAGGCATCA GGCGTTCTAT TACCGTTCGG ACAAGGAAGG CGGAGGGGGC

751  GGCAATTATT ATGATGAAGA CGGCAAGGTG TTGCAGGAAA AAGGCGGCTT

801  CAACATCGAG CCGCTGGTCT ATACGCGCAT TTCTTCGCCG TTCGGCTACC

851  GTATGCACCC CATCCTGCAC ACATGGCGGC TGCACACGGG CATCGATTAT

901  GCCGCACCGC AGGGAACGCC GGTCAGGGCT TCCGCCGACG GCGTGATTAC

951  CTTTAAAGGC CGGAAGGGCG GATACGGCAA CGCGGTGATG ATACGCCACG
```

-continued

```
1001  CCAACGGTGT GGAAACGCTG TACGCGCACT TGAGCGCGTT TTCGCAGGCG

1051  GAAGGCAATG TGCGCGGCGG CGAGGTCATC GGTTTTGTCG GTTCGACCGG

1101  GCGTTCGACC GGGCCGCACC TGCATTACGA GGCGCGCATC AACGGGCAGC

1151  CCGTCAATCC TGTTTCGGTC GCATTGCCGA CACCGGAATT GACGCAGGCG

1201  GACAAGGCGG CGTTTGCCGC GCAGAAACAG AAGGCGGACG CGCTGCTTGC

1251  GCGCTTGCGC GGCATACCGG TTACCGTGTC GCAATCGGAT TGA
```

This corresponds to the amino acid sequence <SEQ ID 1238; ORF 297>:

```
m297.pep

    1  MAVFPLSAKH RKYALRALAV SIILVSAAYI ASTERTERVR PQRVEQNLPP

   51  LSWGGSGVQT AYWVQEAVQP GDSLADVLAR SGMARDEIAR ITEKYGGEAD

  101  LRHLRADQSV HVLVGGDGGA REVQFFTDED GERNLVALEK KGGIWRRSAS

  151  EADMKVLPTL RSVVVKTSAR GSLARAEVPV EIRESLSGIF AGRFSLDGLK

  201  EGDAVRLMYD SLYFHGQQVA AGDILAAEVV KGGTRHQAFY YRSDKEGGGG

  251  GNYYDEDGKV LQEKGGFNIE PLVYTRISSP FGYRMHPILH TWRLHTGIDY

  301  AARQGTPVRA SADGVITFKG RKGGYGNAVM IRHANGVETL YAHLSAFSQA

  351  EGNVRGGEVI GFVGSTGRST GPHLHYEARI NGQPVNPVSV ALPTPELTQA

  401  DKAAFAAQKQ KADALLARLR GIPVTVSQSD *

m297/g297  97.9% identity in 430 aa overlap

                  10         20         30         40         50         60
m297.pep  MAVFPLSAKHRKYALRALAVSIILVSAAYIASTERTERVRPQRVEQNLPPLSWGGSGVQT
          ||||||||||||||||||||||||||||||| ||||||||||:||||||||:||||
g297      MAVFPLSAKHRKYALRALAVSIILVSAAYIASTEGTERVRPQRVEQKLPPLSWGGNGVQT
                  10         20         30         40         50         60

                  70         80         90        100        110        120
m297.pep  AYWVQEAVQPGDSLADVLARSGMARDEIARITEKYGGEADLRHLRADQSVHVLVGGDGGA
          ||||||||||||||||||||||||||||||||||||||||||||||||||||||||||:|
g297      AYWVQEAVQPGDSLADVLARSGMARDEIARITEKYGGEADLRHLRADQSVHVLVGGDGSA
                  70         80         90        100        110        120

                 130        140        150        160        170        180
m297.pep  REVQFFTDEDGERNLVALEKKGGIWRRSASEADMKVLPTLRSVVVKTSARGSLARAEVPV
          ||||||||||||||||||||||||||||||:||||||||||||||||||||||||||||
g297      REVQFFTDEDGERNLVALEKKGGIWRRSASDADMKVLPTLRSVVVKTSARGSLARAEVPV
                 130        140        150        160        170        180

                 190        200        210        220        230        240
m297.pep  EIRESLSGIFAGRFSLDGLKEGDAVRLMYDSLYFHGQQVAAGDILAAEVVKGGTRHQAFY
          ||||||||||||||||||||||||||:|||||||||||||||||||||||||  ||||
g297      EIRESLSGIFAGRFSLDGLKEGDAVRLLYDSLYFHGQQVAAGDILAAEVVKGGTTHQAFY
                 190        200        210        220        230        240

                 250        260        270        280        290        300
m297.pep  YRSDKEGGGGGNYYDEDGKVLQEKGGFNIEPLVYTRISSPFGYRMHPILHTWRLHTGIDY
          ||||||||||||||||||:|||||||||||||||||||||||||||||||||||||||
g297      YRSDKEGGGGGNYYDEDGRVLQEKGGFNIEPLVYTRISSPFGYRMHPILHTWRLHTGIDY
                 250        260        270        280        290        300

                 310        320        330        340        350        360
m297.pep  AAPQGTPVRASADGVITFKGRKGGYGNAVMIRHANGVETLYAHLSAFSQAEGNVRGGEVI
          ||||||||||||||||||||||||||||||||||||||||||||||||||:|||||||
g297      AAPQGTPVRASADGVITFKGRKGGYGNAVMIRHANGVETLYAHLSAFSQAQGNVRGGEVI
                 310        320        330        340        350        360

                 370        380        390        400        410        420
m297.pep  GFVGSTGRSTGPHLHYEARINGQPVNPVSVALPTPELTQADKAAFAAQKQKADALLARLR
          ||||||||||||||||||||||||||||||||||||||||||||||||||||||||||
g297      GFVGSTGRSTGPHLHYEARINGQPVNPVSVALPTPELTQADKAAFAAQKQKADALLARLR
                 370        380        390        400        410        420

                 430
m297.pep  GIPVTVSQSDX
          |||||||||||
g297      GIPVTVSQSDX
                 430
```

The following partial DNA sequence was identified in *N. meningitidis* <SEQ ID 1239>:

```
a297.seq.
     1  ATGGCTGTCT TCCCACTTTC GGCAAAACAT CGGAAATACG CGCTGCGCGC
    51  GCTTGCCGTT TCGATTATTT TGGTGTCGGC GGCATACATT GCTTCGACAG
   101  AGAGGACGGA GCGCGTCAGA CCGCAGCGCG TGGAACAAAA ACTGCCGCCG
   151  CTGTCTTGGG GCGGCAGCGG TGTTCAGACG GCATATTGGG TGCAGGAGGC
   201  GGTGCAGCCA GGCGACTCGC TGGCGGACGT GCTGGCGCGT TCGGGTATGG
   251  CGCGGGACGA AATTGCCCGA ATAACGGAAA AATATGGCGG CGAAGCCGAT
   301  TTGCGGCATT TGCGTGCCGA CCAGTCGGTT CATGTTTTGG TCGGCGGCGA
   351  CGGCGGCGCG CGCGAAGTGC AGTTTTTTAC CGACGAAGAC GGCGAGCGCA
   401  ATCTGGTCGC TTTGGAAAAA AAAGGCGGCA TATGGCGGCG GTCGGCTTCT
   451  GAGGCGGATA TGAAGGTTTT GCCGACGCTG CGTTCGGTCG TGGTCAAAAC
   501  GTCGGCGCGC GGTTCGCTGG CGCGGGCGGA AGTGCCCGTC GAAATTCGCG
   551  AATCCTTAAG CGGGATTTTC GCCGGCCGCT TCAGCCTTGA TGGTTTGAAG
   601  GAAGGCGATG CCGTGCGCCT GATTTACGAC AGCCTGTATT TCCACGGGCA
   651  GCAGGTGGCG GCGGGCGATA TTCTGGCGGC GGAAGTCGTT AAGGGCGGCA
   701  CAAGGCATCA GGCGTTCTAT TACCGTTCGG ACAAGGAAGG AGGAGGGGGC
   751  GGCAATTATT ACGATGAAGA CGGCAGGGTG TTGCAGGAAA AAGGCGGCTT
   801  CAACATCGAG CCACTGGTCT ATACGCGCAT TTCTTCGCCG TTCGGCTACC
   851  GTATGCACCC CATCCTGCAC ACTTGGCGGC TGCACACGGG CATCGATTAT
   901  GCCGCACCGC AGGGAACGCC GGTCAGGGCT TCCGCCGACG GCGTGATTAC
   951  CTTTAAAGGC CGGAAGGGTG GCTACGGCAA CGCGGTGATG ATACGCCACG
  1001  CCAACGGTGT GGAAACGCTG TATGCGCACT TGAGCGCGTT TTCTCAGGCA
  1051  GAAGGCAATG TGCGCGGCGG CGAGGTCATC GGTTTTGTCG GTTCGACCGG
  1101  GCGTTCGACG GGGCCGCACC TGCATTACGA GGCGCGCATC AATGGGCAGC
  1151  CCGTCAATCC TGTTTCGGTC GCATTGCCGA CACCCGAATT GACGCAGGCG
  1201  GACAAGGCGG CGTTTGCCGC GCAGAAACAG AAGGCGGACG CGCTGCTTGC
  1251  GCGCTTGCGC GGCATACCGG TTACCGTGTC GCAATCGGAT TGA
```

This corresponds to the amino acid sequence <SEQ ID 1240; ORF 297.a>:

```
a297.pep
     1  MAVFPLSAKH RKYALRALAV SIILVSAAYI ASTERTERVR PQRVEQKLPP
    51  LSWGGSGVQT AYWVQEAVQP GDSLADVLAR SGMARDEIAR ITEKYGGEAD
   101  LRHLRADQSV HVLVGGDGGA REVQFFTDED GERNLVALEK KGGIWRRSAS
   151  EADMKVLPTL RSVVVKTSAR GSLARAEVPV EIRESLSGIF AGRFSLDGLK
   201  EGDAVRLIYD SLYFHGQQVA AGDILAAEVV KGGTRHQAFY YRSDKEGGGG
   251  GNYYDEDGRV LQEKGGFNIE PLVYTRISSP FGYRMHPILH TWRLHTGIDY
   301  AAPQGTPVRA SADGVITFKG RKGGYGNAVM IRHANGVETL YAHLSAFSQA
   351  EGNVRGGEVI GFVGSTGRST GPHLHYEARI NGQPVNPVSV ALPTPELTQA
   401  DKAAFAAQKQ KADALLARLR GIPVTVSQSD *
```

m297/a297 99.3% identity in 430 aa overlap

```
                     10        20        30        40        50        60
m297.pep   MAVFPLSAKHRKYALRALAVSIILVSAAYIASTERTERVRPQRVEQNLPPLSWGGSGVQT
           ||||||||||||||||||||||||||||||||||||||||||||||:|||||||||||||
a297       MAVFPLSAKHRKYALRALAVSIILVSAAYIASTERTERVRPQRVEQKLPPLSWGGSGVQT
                     10        20        30        40        50        60

                     70        80        90       100       110       120
m297.pep   AYWVQEAVQPGDSLADVLARSGMARDEIARITEKYGGEADLRHLRADQSVHVLVGGDGGA
           ||||||||||||||||||||||||||||||||||||||||||||||||||||||||||||
a297       AYWVQEAVQPGDSLADVLARSGMARDEIARITEKYGGEADLRHLRADQSVHVLVGGDGGA
                     70        80        90       100       110       120

                    130       140       150       160       170       180
m297.pep   REVQFFTDEDGERNLVALEKKGGIWRRSASEADMKVLPTLRSVVVKTSARGSLARAEVPV
           ||||||||||||||||||||||||||||||||||||||||||||||||||||||||||||
a297       REVQFFTDEDGERNLVALEKKGGIWRRSASEADMKVLPTLRSVVVKTSARGSLARAEVPV
                    130       140       150       160       170       180

                    190       200       210       220       230       240
m297.pep   EIRESLSGIFAGRFSLDGLKEGDAVRLMYDSLYFHGQQVAAGDILAAEVVKGGTRHQAFY
           ||||||||||||||||||||||||||:|||||||||||||||||||||||||||||||||
a297       EIRESLSGIFAGRFSLDGLKEGDAVRLLYDSLYFHGQQVAAGDILAAEVVKGGTRHQAFY
                    190       200       210       220       230       240

                    250       260       270       280       290       300
m297.pep   YRSDKEGGGGGNYYDEDGKVLQEKGGFNIEPLVYTRISSPFGYRMHPILHTWRLHTGIDY
           ||||||||||||||||||:|||||||||||||||||||||||||||||||||||||||||
a297       YRSDKEGGGGGNYYDEDGRVLQEKGGFNIEPLVYTRISSPFGYRMHPILHTWRLHTGIDY
                    250       260       270       280       290       300

                    310       320       330       340       350       360
m297.pep   AAPQGTPVRASADGVITFKGRKGGYGNAVMIRHANGVETLYAHLSAFSQAEGNVRGGEVI
           ||||||||||||||||||||||||||||||||||||||||||||||||||||||||||||
a297       AAPQGTPVRASADGVITFKGRKGGYGNAVMIRHANGVETLYAHLSAFSQAEGNVRGGEVI
                    310       320       330       340       350       360

                    370       380       390       400       410       420
m297.pep   GFVGSTGRSTGPHLHYEARINGQPVNPVSVALPTPELTQADKAAFAAQKQKADALLARLR
           ||||||||||||||||||||||||||||||||||||||||||||||||||||||||||||
a297       GFVGSTGRSTGPHLHYEARINGQPVNPVSVALPTPELTQADKAAFAAQKQKADALLARLR
                    370       380       390       400       410       420

                    430
m297.pep   GIPVTVSQSDX
           |||||||||||
a297       GIPVTVSQSDX
                    430
```

The following partial DNA sequence was identified in *N. gonorrhoeae* <SEQ ID 1241>:

```
g298.seq.
   1 ATGAAAAACT TTCTTTCCCT TTTCGCCTCC ATACTGATGT CTGCCCTGAT

  51 TGCCGTGTGG TTCAGCCAAA ACCCCATCAA CGCCTACTGG CAGCAGACCT

 101 ACCACCGCAA CAGCCCGCTC GAACCGCTTG CCGCCTACGG ATGGTGGCGG

 151 AGCGGAGCGG CGTTGCAAGA AAACGCCTAC GCCCTTTCAG ACGGCATCAA

 201 AACCTTCCTG TCCGGCGAAA cgcccccccac ggCTCAAGAC GGCGGTTCGG

 251 CAGATATGCC GCCTGAAGCC GCCGCATCCG AAGCCGCCCC GCCGGCCGGC

 301 GGAACAGAAT GGAAACAAGG CACCGAAGCC GCCGCCGTCC GCAGCGGCGA

 351 CAAAGTCTTT TTCGCCGGAG ATTCGCTGAT GCAGGGCGTT GCGCCTTTCG

 401 TGCAAAAAAG CCTGAAACAG CAATACGGCA TCGAATCCGC CAACCTCAGC

 451 AAACAAAGCA CGGGGCTTTC CTATCCCTCA TTCTTCGACT GGCCGAAAAC

 501 GATTGAAGAA ACCTTGAAAA AACATCCCGA AATCAGCGTA CTCGCCGTCT

 551 TCCTCGGCCC GAACGACCCG TGGGATTTCC CCGTCGGCAA ACGCTACCTC

 601 AAATTCGCTT CCGACGAATG GGCGCAAGAA TACCTGAAAC GCGTCGACCG

 651 CATCCTTGAA GCCGCACACA CGCACCGCGT CCAAGTCGTC TGGCTCGGCA

 701 TCCCCTACAT GAAAAAAGTC AAGCTCGACG GTCAGATGCG CTACCTCGAC
```

-continued

751 AAACTGCTTT CGGAACACTT GAAAGGCAAA ATCATCCTGA TTCCCACCGC

801 GCAAACACTG AGCGGCGGGA AAGgccGCTA CACCGATTCC GTCAACGTCA

851 ACGGCAAACC CGTCCGCTAC CGCAGTAAGG ACGGCATACA CTTTACCGCC

901 GAAGGACAAA AACTGCTGGC GGAAAAAATA ATGGAAAAAA TCGTTTTTGA

951 ACCGAGTACG CAACCATCAA GTACACAGCC ATGA

This corresponds to the amino acid sequence <SEQ ID 1242; ORF 298.ng>:

g298.pep

1 MKNFLSLFAS ILMSALIAVW FSQNPINAYW QQTYHRNSPL EPLAAYGWWR

51 SGAALQENAY ALSDGIKTFL SGETPPTAQD GGSADMPPEA AASEAAPPAG

101 GTEWKQGTEA AAVRSGDKVF FAGDSLMQGV APFVQKSLKQ QYGIESANLS

151 KQSTGLSYPS FFDWPKTIEE TLKKHPEISV LAVFLGPNDP WDFPVGKRYL

201 KFASDEWAQE YLKRVDRILE AAHTHRVQVV WLGIPYMKKV KLDGQMRYLD

251 KLLSEHLKGK IILIPTAQTL SGGKGRYTDS VNVNGKPVRY RSKDGIHFTA

301 EGQKLLAEKI MEKIVFEPST QPSSTQP*

The following partial DNA sequence was identified in *N. meningitidis* <SEQ ID 1243>:

m298.seq.

1 ATGAAAAACT TTCTTTCCCT TTTCTCCTCC ATACTGATGT CTGCCCTGAT

51 TGCCGTGTGG TTCAGCCAAA ACCCCATCAA CGCCTACTGG CAGCAGACCT

101 ACCACCGCAA CAGCCCGCTC GAACCGCTTG CCGCCTACGG ATGGTGGCGG

151 AGCGGTGCGG CGTTGCAAGA AAACGCCTAC GCCCTTTCAG ACGGCATCAA

201 AGCCTTCCTG TCCGGCGAAA CGCCGCCGAC GGCTCAAGAC GGCGGTTCGG

251 CAGATATGCC GTCTGAAGCC GCCGCATCCG AAGCCGTCCC TCAAACCGGT

301 GAAACAGAAT GGAAACAAGA CACCGAAGCC GCCGCCGTCC GCAGCGGCGA

351 CAAAGTCTTT TTTGTCGGCG ACTCGCTGAT GCAGGGCGTT GCCCCCTTCG

401 TGCAAAAAAG CCTGAAACAG CAATACGGCA TCGAATCCGT CAACCTCAGC

451 AAACAAAGCA CGGGGCTGTC CTACCCCTCA TTCTTCGACT GGCCGAAAAC

501 GATTGAAGAA ACCCTGCAAA AACATCCCGA AATCAGCGTA CTCGCCGTCT

551 TCCTCGGACC GAACGACCCG TGGGATTTCC CCGTCGGCAA ACTCTATCTC

601 AAATTCGCTT CCGACGAATG GGCGCAAGAA TACCTGAAAC GTGTCGACCG

651 CATCCTTGAA GCCGCACACA CGCACCGCGT CCAAGTCGTC TGGCTCGGCA

701 TCCCCTACAT GAAAAAAGCC AAGCTCGACG GACAGATGCG CTACCTAGAC

751 AAACTGCTTT CGGAACATTT GAAAGGCAAA ATCATCCTGA TTCCCACCAC

801 GCACACCCTG AGCGGCGGGA AAGACCGCTA CACCGACTCC GTCAACGTCA

851 ACGGCAAACC CGTCCGCTAC CGCAGCAAGG ACGGCATACA CTTTACCGCC

901 GAAGGACAAA AACTGCTGGC GGCAAAAATA ATGGAAAAAA TCGTTTTTGA

951 ACCAAGTACG CAACCATCAA GTACACAGCC ATGA

This corresponds to the amino acid sequence <SEQ ID 1244; ORF 298>:

```
m298.pep

      1  MKNFLSLFSS ILMSALIAVW FSQNPINAYW QQTYHRNSPL EPLAAYGWWR

     51  SGAALQENAY ALSDGIKAFL SGETPPTAQD GGSADMPSEA AASEAVPQTG

    101  ETEWKQDTEA AAVRSGDKVF FVGDSLMQGV APFVQKSLKQ QYGIESVNLS

    151  KQSTGLSYPS FFDWPKTIEE TLQKHPEISV LAVFLGPNDP WDFPVGKLYL

    201  KFASDEWAQE YLKRVDRILE AAHTHRVQVV WLGIPYMKKA KLDGQMRYLD

    251  KLLSEHLKGK IILIPTTHTL SGGKDRYTDS VNVNGKPVRY RSKDGIHFTA

    301  EGQKLLAAKI MEKIVFEPST QPSSTQP*
```

```
                   10        20        30        40        50        60
m298.pep   MKNFLSLFSSILMSALIAVWFSQNPINAYWQQTYHRNSPLEPLAAYGWWRSGAALQENAY
           ||||||||:|||||||||||||||||||||||||||||||||||||||||||||||||||
g298       MKNFLSLFASILMSALIAVWFSQNPINAYWQQTYHRNSPLEPLAAYGWWRSGAALQENAY
                   10        20        30        40        50        60

                   70        80        90       100       110       120
m298.pep   ALSDGIKAFLSGETPPTAQDGGSADMPSEAAASEAVPQTGETEWKQDTEAAAVRSGDKVF
           |||||||:|||||||||||||||||||| |||||||:| :| ||||| |||||||||||||
g298       ALSDGIKTFLSGETPPTAQDGGSADMPPEAAASEAAPPAGGTEWKQGTEAAAVRSGDKVF
                   70        80        90       100       110       120

                  130       140       150       160       170       180
m298.pep   FVGDSLMQGVAPFVQKSLKQQYGIESVNLSKQSTGLSYPSFFDWPKTIEETLQKHPEISV
           |:||||||||||||||||||||||||:|||||||||||||||||||||||||:|||||||
g298       FAGDSLMQGVAPFVQKSLKQQYGIESANLSKQSTGLSYPSFFDWPKTIEETLKKHPEISV
                  130       140       150       160       170       180

                  190       200       210       220       230       240
m298.pep   LAVFLGPNDPWDFPVGKLYLKFASDEWAQEYLKRVDRILEAAHTHRVQVVWLGIPYMKKA
           ||||||||||||||||| ||||||||||||||||||||||||||||||||||||||||||:
g298       LAVFLGPNDPWDFPVGKRYLKFASDEWAQEYLKRVDRILEAAHTHRVQVVWLGIPYMKKV
                  190       200       210       220       230       240

                  250       260       270       280       290       300
m298.pep   KLDGQMRYLDKLLSEHLKGKIILIPTTHTLSGGKDRYTDSVNVNGKPVRYRSKDGIHFTA
           ||||||||||||||||||||||||||::|||||| |||||||||||||||||||||||||
g298       KLDGQMRYLDKLLSEHLKGKIILIPTAQTLSGGKGRYTDSVNVNGKPVRYRSKDGIHFTA
                  250       260       270       280       290       300

                  310       320
m298.pep   EGQKLLAAKIMEKIVFEPSTQPSSTQPX
           ||||||||||||||||||||||||||||
g298       EGQKLLAEKIMEKIVFEPSTQPSSTQPX
                  310       320
```

The following partial DNA sequence was identified in *N. meningitidis* <SEQ ID 1245>:

```
a298.seq.
    1 ATGAAAAACT TTCTTTCCCT TTTCGCCTCC ATACTGATGT CTGCCCTGAT

   51 TGCCGTGTGG TTCAGCCAAA ACCCCATCAA CGCCTACTGG CAGCAGACCT

  101 ACCACCGCAA CAGCCCGCTC GAACCGCTTG CCGCCTACGG ATGGTGGCGG

  151 AGCGGTGCGG CATTGCAAGA AAACGCCTAC GCCCTTTCAG ACGGCATCAA

  201 AGCCTTCCTG TCCGGCGAAA CGCCGCCGAC GGCTCAAGAC GGCGGTTCGG

  251 CAGATATGCC GTCTGAAGCC GCCGCACCCG AAACCGCCCC TCAAACTGGC

  301 GAAACAGAAT GGAAACAAAA CACCGAAGCC GCCGCCGTCC GAACAGGGGA

  351 CAAAGTCTTT TTCGCCGGCG ACTCGCTGAT GCAGGGCGTT GCACCCTTCG

  401 TGCAAAAAAG CCTGAAACAG CAATACGGCA TCGAATCCGT CAACCTCAGC

  451 AAACAAAGCA CGGGGCTGTC CTACCCCTCA TTCTTCGACT GGCCGAAAAC

  501 GATTGAAGAA ACCCTGAAAA AACATCCCGA AATCAGCGTG CTCGCCGTCT

  551 TCCTCGGTCC GAACGACCCG TGGGATTTCC CCGTTGGCAA ACGCTACCTC
```

-continued

```
601 AAATTCGCTT CCGACGAATG GGCGCAAGAA TACCTGAAAC GCGTCGACCG

651 CATCCTTGAA GCCGCACACA CGCACTACGT CCAAGTCGTC TGGCTCGGCA

701 TCCCCTACAT GAAAAAAGCC AAGCTCGACG GACAGATGCG CTACCTAGAC

751 AAACTGCTTT CGGAATATTT GAAAGGCAAA ATCATCCTGA TTCCCACCGC

801 GCACACCCTG AGCGGCGGGA AAGACCGCTA CACCGACTCC GTCAACGTCA

851 ACGGCAAACC CGTCCGCTAC CGCAGCAAGG ACGGCATACA CTTTACCGCC

901 GAAGGACAAA AACTGCTGGC GGCAAAAATA ATGGAAAAAA TCGTTTTTGA

951 ACCAAGTACG CAACCATCAA GTACACAGCC ATGA
```

This corresponds to the amino acid sequence <SEQ ID 1246; ORF 298.a>:

```
a298.pep
  1 MKNFLSLFAS ILMSALIAVW FSQNPINAYW QQTYHRNSPL EPLAAYGWWR

 51 SGAALQENAY ALSDGIKAFL SGETPPTAQD GGSADMPSEA AAPETAPQTG

101 ETEWKQNTEA AAVRTGDKVF FAGDSLMQGV APFVQKSLKQ QYGIESVNLS

151 KQSTGLSYPS FFDWPKTIEE TLKKHPEISV LAVFLGPNDP WDFPVGKRYL

201 KFASDEWAQE YLKRVDRILE AAHTHYVQVV WLGIPYMKKA KLDGQMRYLD

251 KLLSEYLKGK IILIPTAHTL SGGKDRYTDS VNVNGKPVRY RSKDGIHFTA

301 EGQKLLAAKI MEKIVFEPST QPSSTQP*
```

m298/a298 96.3% identity in 327 aa overlap

```
                   10        20        30        40        50        60
m298.pep   MKNFLSLFSSILMSALIAVWFSQNPINAYWQQTYHRNSPLEPLAAYGWWRSGAALQENAY
           ||||||||:|||||||||||||||||||||||||||||||||||||||||||||||||||
a298       MKNFLSLFASILMSALIAVWFSQNPINAWQQTYHRNSPKLEPLAAYGWWRSGAALQENAY
                   10        20        30        40        50        60

                   70        80        90       100       110       120
m298.pep   ALSDGIKAFLSGETPPTAQDGGSADMPSEAAASEAVPQTGETEWKQDTEAAAVRSGDKVF
           |||||||||||||||||||||||||||||||| |::||||||||||:|||||||:|||||
a298       ALSDGIKAFLSGETPPTAQDGGSADMPSEAAAPETAPQTGETEWKQNTEAAAVRTGDKVF
                   70        80        90       100       110       120

                 130       140       150       160       170       180
m298.pep   FVGDSLMQGVAPFVQKSLKQQYGIESVNLSKQSTGLSYPSFFDWPKTIEETLQKHPEISV
           |:||||||||||||||||||||||||||||||||||||||||||||||||||:|||||||
a298       FAGDSLMQGVAPFVQKSLKQQYGIESVNLSKQSTGLSYPSFFDWPKTIEETLKKHPEISV
                 130       140       150       160       170       180

                 190       200       210       220       230       240
m298.pep   LAVFLGPNDPWDFPVGKLYLKFASDEWAQEYLKRVDRILEAAHTHRVQVVWLGIPYMKKA
           ||||||||||||||||| ||||||||||||||||||||||||||||| ||||||||||||||
a298       LAVFLGPNDPWDFPVGKRYLKFASDEWAQEYLKRVDRILEAAHTHYVQVVWLGIPYMKKA
                 190       200       210       220       230       240

                 250       260       270       280       290       300
m298.pep   KLDGQMRYLDKLLSEHLKGKIILIPTTHTLSGGKDRYTDSVNVNGKPVRYRSKDGIHFTA
           ||||||||||||||:|||||||||||:|||||||||||||||||||||||||||||||||
a298       KLDGQMRYLDKLLSEYLKGKIILIPTAHTLSGGKDRYTDSVNVNGKPVRYRSKDGIHFTA
                 250       260       270       280       290       300

                 310       320
m298.pep   EGQKLLAAKIMEKIVFEPSTQPSSTQPX
           ||||||||||||||||||||||||||||
a298       EGQKLLAAKIMEKIVFEPSTQPSSTQPX
                 310       320
```

The following partial DNA sequence was identified in *N. gonorrhoeae* <SEQ ID 1247>:

```
g299.seq.
   1  ATGAACCCCA AACACTTCAT CGCATTTTCC GCCCTGTTCG CCGCCACGCA
  51  GGCAGAAGCC CTGCCCGTCG CCTCCGTCAG CCCCGACACC GTTACCGTTT
 101  CCCCGTCCGC CCCCTACACC GATACAAACG GGCTGCTGAC CGACTACGGC
 151  AACGCCGCCG CCTCGCCTTG GATGAAAAAA CTCCGATCCG TCGCACAAGG
 201  CAGCGGCGAG GCCTTCCGCA TCCTGCAAAT CGGCGACTCG CATACCGCCG
 251  GCGACTTCTT TACCGACGCC CTGCGCAAAC GCCTGCAAAA AACATGGGGC
 301  GACGGCGGCA TAGGCTGGGT TTACCCCGCC AACGTCAAAG GGCAGCGCAT
 351  GGCGGCCGTC CGTCACAGCG GCAACTGGCA AAGCTTCACC AGCAGGAACA
 401  ATACCGGAGA TTTCCCGCTC GGCGGCATCC TCGCCCAAAC CGGCAGCGGC
 451  GGCGGCATGA CCCTGACCGC GTCTGACGGC AAAACCGGCA AACAGCGCGT
 501  TTCCCTGTTT GCCAAACCGC TGCTCGCCGA ACAAACCCTG ACCGTCAACG
 551  GCAACACCGT CTCCGCCAAC GGCGGCGGCT GGCAGGTACT GGATACGGGC
 601  GCGGCACTGC CCCTGGCCAT ACAGACCGAA ATGCCGTGGG ACATCGGCTT
 651  CATCAACATC GAAAATCCCG CCGGCGGCAT TACCGTTTCC GCGATGGGCA
 701  TCAACGGCGC ACAATTGACC CAGTGGTCGA AATGGCGTGC CGACCGTATG
 751  AACGACCTTG CCCAAACCGG CGCCGATTTG GTTATCCTTT CCTACGGCAC
 801  CAACGAAGCC TTCAACAACA ACATCGACAT TGCCGATACC GAACAAAAAT
 851  GGCTGGATAC CGTCCGCCAA ATCCGCGACA GCCTGCCCGC CGCCGGCATC
 901  CTCATCATCG GCGCGCCCGA ATCCCTGAAA AACACGCTCG GCGTATGCGG
 951  CACGCGCCCC GTCCTCCTGA CCGAAGTCCA ACAGATGCAG CGGCGCGTCG
1001  CCCGTCAGGG GCAGACGATG TTTTGGTCTT GGCAAAACGC AATGGGCGGC
1051  ATATGCAGCA TGAAAAACTG GCTCAACCAA GGATGGGCCG CCAAAGACGG
1101  CGTACACTTC TCCGCCCAAG GCTACCGGCG CGCGGCGGAA ATGCTTGCCG
1151  ACAGCCTCGA AGAACTCGTC CGCGCCGCCG CAATCAGGCA ATAA
```

This corresponds to the amino acid sequence <SEQ ID 1248; ORF 299.ng>:

g299.pep

1 <u>MNPKHFIAFS ALFAATQAEA</u> LPVASVSPDT VTVSPSAPYT DTNGLLTDYG

```
 51 NAAASPWMKK LRSVAQGSGE AFRILQIGDS HTAGDFFTDA LRKRLQKTWG
101 DGGIGWVYPA NVKGQRMAAV RHSGNWQSFT SRNNTGDFPL GGILAQTGSG
151 GGMTLTASDG KTGKQRVSLF AKPLLAEQTL TVNGNTVSAN GGGWQVLDTG
201 AALPLAIQTE MPWDIGFINI ENPAGGITVS AMGINGAQLT QWSKWRADRM
251 NDLAQTGADL VILSYGTNEA FNNNIDIADT EQKWLDTVRQ IRDSLPAAGI
301 LIIGAPESLK NTLGVCGTRP VLLTEVQQMQ RRVARQGQTM FWSWQNAMGG
351 ICSMKNWLNQ GWAAKDGVHF SAQGYRRAAE MLADSLEELV RAAAIRQ*
```

The following partial DNA sequence was identified in *N. meningitidis* <SEQ ID 1249>:

```
m299.seq
   1 ATGAACCCCA AACACCTCAT CGCATTTTCC GCCCTATTCG CCGCCACGCA

  51 GGCAGAAGCC CTACCTGTCG CCTCCGTCAG CCTCGACACC GTTACCGTTT

 101 CCCCGTCCGC CCCCTACACC GATACAAACG GGCTGCTGAC CGACTACGGC

 151 AACGCCTCCG CCTCGCCTTG GATGAAAAAA CTCCAATCCG TCGCACAAGG

 201 CAGCGGCGAG ACCTTCCGTA TCCTGCAAAT CGGCGACTCG CATACCGCCG

 251 GCGACTTCTT TACCGACAGC CTGCGCAAAC GCCTGCAAAA AACTTGGGGC

 301 GACGGCGGCA TAGGCTGGGT TTACCCCGCC AACGTCAAAG GGCAGCGCAT

 351 GGCGGCCGTC CGGCACAACG GTAACTGGCA AAGCCTCACC AGCAGGAACA

 401 ACACCGGAGA CTTCCCGCTC GGCGGCATCC TCGCCCACAC CGGCAGCGGC

 451 GGCAGCATGA CCCTGACCGC ATCGGACGGC ATAGCAAGCA AGCAGCGCGT

 501 TTCCCTGTTT GCCAAACCCC TGCTTGCCGA ACAAACCCTG ACCGTCAACG

 551 GCAACACCGT CTCCGCCAAC GGCGGCGGCT GGCAGGTACT GGATACGGGC

 601 GCGGCACTGC CCCTGACCAT ACACACCGAA ATGCCGTGGG ACATCGGCTT

 651 CATCAACATC GAAAATCCCG CCGGCGGCAT TACCGTTTCC GCGATGGGCA

 701 TCAACGGCGC ACAATTAACC CAGTGGTCGA AATGGCGTGC CGACCGTATG

 751 AACGACCTCG CCCAAACCGG CGCCGATTTG GTTATCCTTT CCTACGGCAC

 801 CAACGAAGCT TTCAACAACA ACATCGACAT TGCCGACACC GAACAAAAAT

 851 GGCTGGATAC CGTCCGCCAA ATCCGCGACA GCCTGCCTGC CGCCGGCATC

 901 CTCATCATCG GCGCACCCGA ATCCCTGAAA AACACGCTCG GCGTATGCGG

 951 CACACGCCCC GTCCGCCTGA CCGAAGTCCA ACAGATGCAG CGGCGCGTCG

1001 CCCGTCAGGG GCAGACGATG TTCTGGTCTT GGCAAAACGC CATGGGCGGC

1051 ATATGCAGCA TGAAAAACTG GCTCAACCAA GGATGGGCCG CCAAAGACGG

1101 CGTACACTTC TCCGCCAAAG GCTACCGGCG CGCGGCGGAA ATGCTCGCCG

1151 ACAGCCTCGA AGAACTCGTC CGCTCCGCTG CAATCAGGCA ATAA
```

This corresponds to the amino acid sequence <SEQ ID 1250; ORF 299>:

```
m299.pep

  1  MNPKHLIAFS ALFAATQAEA LPVASVSLDT VTVSPSAPYT DTNGLLTDYG

 51  NASASPWMKK LQSVAQGSGE TFRILQIGDS HTAGDFFTDS LRKRLQKTWG

101  DGGIGWVYPA NVKGQRMAAV RHNGNWQSLT SRNNTGDFPL GGILAHTGSG

151  GSMTLTASDG IASKQRVSLF AKPLLAEQTL TVNGNTVSAN GGGWQVLDTG

201  AALPLTIHTE MPWDIGFINI ENPAGGITVS AMGINGAQLT QWSKWRADRM

251  NDLAQTGADL VILSYGTNEA FNNNIDIADT EQKWLDTVRQ IRDSLPAAGI

301  LIIGAPESLK NTLGVCGTRP VRLTEVQQMQ RRVARQGQTM FWSWQNAMGG

351  ICSMKNWLNQ GWAAKDGVHF SAKGYRRAAE MLADSLEELV RSAAIRQ*

m299/g299  95.5% identity in 397 aa overlap

                   10        20        30        40        50        60
m299.pep  MNPKHLIAFSALFAATQAEALPVASVSLDTVTVSPSAPYTDTNGLLTDYGNASASPWMKK
          |||||:||||||||||||||||||||| ||||||||||||||||||||||||:|||||||
g299      MNPKHFIAFSALFAATQAEALPVASVSPDTVTVSPSAPYTDTNGLLTDYGNAAASPWMKK
                   10        20        30        40        50        60
```

-continued

```
                    70        80        90       100       110       120
m299.pep    LQSVAQGSGETFRILQIGDSHTAGDFFTDSLRKRLQKTWGDGGIGWVYPANVKGQRMAAV
            |:||||||||:||||||||||||||||||:||||||||||||||||||||||||||||||
g299        LRSVAQGSGEAFRILQIGDSHTAGDFFTDALRKRLQKTWGDGGIGWVYPANVKGQRMAAV
                    70        80        90       100       110       120

                   130       140       150       160       170       180
m299.pep    RHNGNWQSLTSRNNTGDFPLGGILAHTGSGGSMTLTASDGIASKQRVSLFAKPLLAEQTL
            ||:|||||:||||||||||||||||:|||||:|||||||| ::|||||||||||||||||
g299        RHSGNWQSFTSRNNTGDFPLGGILAQTGSGGGMTLTASDGKTGKQRVSLFAKPLLAEQTL
                   130       140       150       160       170       180

                   190       200       210       220       230       240
m299.pep    TVNGNTVSANGGGWQVLDTGAALPLTIHTEMPWDIGFINIENPAGGITVSAMGINGAQLT
            |||||||||||||||||||||||||:|:||||||||||||||||||||||||||||||||
g299        TVNGNTVSANGGGWQVLDTGAALPLAIQTEMPWDIGFINIENPAGGITVSAMGINGAQLT
                   190       200       210       220       230       240

                   250       260       270       280       290       300
m299.pep    QWSKWRADRMNDLAQTGADLVILSYGTNEAFNNNIDIADTEQKWLDTVRQIRDSLPAAGI
            ||||||||||||||||||||||||||||||||||||||||||||||||||||||||||||
g299        QWSKWRADRMNDLAQTGADLVILSYGTNEAFNNNIDIADTEQKWLDTVRQIRDSLPAAGI
                   250       260       270       280       290       300

                   310       320       330       340       350       360
m299.pep    LIIGAPESLKNTLGVCGTRPVRLTEVQQMQRRVARQGQTMFWSWQNAMGGICSMKNWLNQ
            ||||||||||||||||||||| ||||||||||||||||||||||||||||||||||||||
g299        LIIGAPESLKNTLGVCGTRPVLLTEVQQMQRRVARQGQTMFWSWQNAMGGICSMKNWLNQ
                   310       320       330       340       350       360

                   370       380       390
m299.pep    GWAAKDGVHFSAKGYRRAAEMLADSLEELVRSAAIRQX
            |||||||||||||||||||||||||||||||||||||
g299        GWAAKDGVHFSAQGYRRAAEMLADSLEELVRAAAIRQX
                   370       380       390
```

The following partial DNA sequence was identified in *N. meningitidis* <SEQ ID 1251>:

```
a299.seq
   1 ATGAACCCCA AACACCTCAT CGCATTTTCC GCCCTATTCG CCGCCACGCA

  51 GGCAGAAGCC CTACCTGTCG CCTCAGTCAG CCTCGACACC GTTACCGTTT

 101 CCCCGTCCGC CCCCTACACC GATACAAACG GGCTGCTGAC CGACTACGGC

 151 AACGCCTCCG CCTCGCCTTG GATGAAAAAA CTCCAATCCG TCGCACAAGG

 201 CAGCGGCGAG ACCTTCCGTA TCCTGCAAAT CGGCGACTCG CATACCGCCG

 251 GCGACTTCTT TACCGACAGC CTGCGCAAAC GCCTACAAAA AACTTGGGGC

 301 GACGGCGGCA TAGGCTGGGT TTACCCCGCC AACGTCAAAG GGCAGCGCAT

 351 GGCGGCCGTC CGGCACAACG GTAACTGGCA AAGCCTCACC AGCAGGAACA

 401 ACACCGGAGA CTTCCCGCTC GGCGGCATCC TCGCCCACAC CGGCAGCGGC

 451 GGCAGCATGA CCCTGACCGC ATCGGACGGC ATAGCAAGCA AGCAGCGCGT

 501 TTCCCTGTTT GCCAAACCCC TGCTTGCCGA ACAAACCCTG ACCGTCAACG

 551 GCAACACCGT CTCCGCCAAC GGCGGCGGCT GGCAGGTACT GGATACGGGC

 601 GCGGCACTGC CCCTGACCAT ACACACCGAA ATGCCGTGGG ACATCGGCTT

 651 CATCAACATC GAAAATCCCG CCGGCGGCAT TACCGTTTCC GCGATGGGCA

 701 TCAACGGCGC ACAATTAACC CAGTGGTCGA AATGGCGTGC CGACCGTATG

 751 AACGACCTTG CCCAAACCGG CGCCGATCTA GTCATCCTTG CCTACGGTAC

 801 CAACGAAGCC TTCGGCGACA ACATCGACAT TGCCGATACC GAACAGAAAT

 851 GGCTGGATAC CGTCCGCCAA ATCCGCGACA GCCTACCTGC CGCCGGCATC

 901 CTCATCATCG GCGCGCCCGA ATCCCTGAAA AACACGCTCG GCGTATGCGG

 951 CACACGCCCC GTCCGCCTGA CCGAAGTCCA ACAGATGCAG CGGCGCATCG

1001 CCCGTCAGGG GCAGACGATG TTCTGGTCTT GGCAAAACGC GATGGGCGGC
```

-continued

```
1051 GTTTGCAGCA TGAAAAACTG GCTCAACCAC GGATGGGCCG CCAAAGACGG

1101 CGTACACTTT TCCGCCAAAG GCTACCAACG GTCGGCGGAA ATGCTCGCCG

1151 ACAGCCTCGA AGAACTCGTC CGCTCCGCTG CAATCAGGCA ATAA
```

This corresponds to the amino acid sequence <SEQ ID 1252; ORF 299.a>:

```
a299.pep
   1 MNPKHLIAFS ALFAATQAEA LPVASVSLDT VTVSPSAPYT DTNGLLTDYG

  51 NASASPWMKK LQSVAQGSGE TFRILQIGDS HTAGDFFTDS LRKRLQKTWG

 101 DGGIGWVYPA NVKGQRMAAV RHNGNWQSLT SRNNTGDFPL GGILAHTGSG

 151 GSMTLTASDG IASKQRVSLF AKPLLAEQTL TVNGNTVSAN GGGWQVLDTG

 201 AALPLTIHTE MPWDIGFINI ENPAGGITVS AMGINGAQLT QWSKWRADRM

 251 NDLAQTGADL VILAYGTNEA FGDNIDIADT EQKWLDTVRQ IRDSLPAAGI

 301 LIIGAPESLK NTLGVCGTRP VRLTEVQQMQ RRIARQGQTM FWSWQNAMGG

 351 VCSMKNWLNH GWAAKDGVHF SAKGYQRSAE MLADSLEELV RSAAIRQ*
```

m299/a299 98.0% identity in 397 aa overlap

```
                    10        20        30        40        50        60
m299.pep    MNPKHLIAFSALFAATQAEALPVASVSLDTVTVSPSAPYTDTNGLLTDYGNASASPWMKK
            ||||||||||||||||||||||||||||||||||||||||||||||||||||||||||||
a299        MNPKHLIAFSALFAATQAEALPVASVSLDTVTVSPSAPYTDTNGLLTDYGNASASPWMKK
                    10        20        30        40        50        60

                    70        80        90       100       110       120
m299.pep    LQSVAQGSGETFRILQIGDSHTAGDFFTDSLRKRLQKTWGDGGIGWVYPANVKGQRMAAV
            ||||||||||||||||||||||||||||||||||||||||||||||||||||||||||||
a299        LQSVAQGSGETFRILQIGDSHTAGDFFTDSLRKRLQKTWGDGGIGWVYPANVKGQRMAAV
                    70        80        90       100       110       120

                   130       140       150       160       170       180
m299.pep    RHNGNWQSLTSRNNTGDFPLGGILAHTGSGGSMTLTASDGIASKQRVSLFAKPLLAEQTL
            ||||||||||||||||||||||||||||||||||||||||||||||||||||||||||||
a299        RHNGNWQSLTSRNNTGDFPLGGILAHTGSGGSMTLTASDGIASKQRVSLFAKPLLAEQTL
                   130       140       150       160       170       180

                   190       200       210       220       230       240
m299.pep    TVNGNTVSANGGGWQVLDTGAALPLTIHTEMPWDIGFINIENPAGGITVSAMGINGAQLT
            ||||||||||||||||||||||||||||||||||||||||||||||||||||||||||||
a299        TVNGNTVSANGGGWQVLDTGAALPLTIHTEMPWDIGFINIENPAGGITVSAMGINGAQLT
                   190       200       210       220       230       240

                   250       260       270       280       290       300
m299.pep    QWSKWRADRMNDLAQTGADLVILSYGTNEAFNNNIDIADTEQKWLDTVRQIRDSLPAAGI
            |||||||||||||||||||||||:|||||||::|||||||||||||||||||||||||||
a299        QWSKWRADRMNDLAQTGADLVILAYGTNEAFGDNIDIADTEQKWLDTVRQIRDSLPAAGI
                   250       260       270       280       290       300

                   310       320       330       340       350       360
m299.pep    LIIGAPESLKNTLGVCGTRPVRLTEVQQMQRRVARQGQTMFWSWQNAMGGICSMKNWLNQ
            ||||||||||||||||||||||||||||||||:|||||||||||||||||||:|||||||:
a299        LIIGAPESLKNTLGVCGTRPVRLTEVQQMQRRIARQGQTMFWSWQNAMGGVCSMKNWLNH
                   310       320       330       340       350       360

                   370       380       390
m299.pep    GWAAKDGVHFSAKGYRRAAEMLADSLEELVRSAAIRQX
            |||||||||||||||:|:||||||||||||||||||||
a299        GWAAKDGVHFSAKGYQRSAEMLADSLEELVRSAAIRQX
                   370       380       390
```

The following partial DNA sequence was identified in *N. gonorrhoeae* <SEQ ID 1253>:

```
g302.seq
   1 ATGCACTCAA TATATTTTTT TAAGGAGAAG CAGATGAGTC AAACCGACGC

  51 GCGTCGTAGC GGACGATTTT TACGCACAGT CGAATGGCTG GGCAATATGT

 101 TGCCGCACCC GGTTACGCTT TTTATTATTT TCATTGTGTT ATTGCTGATT

 151 GCCTCTGCCG TCGGTGCGTA TTTCGGACTA TCCGTCCCCG ATCCGCGTCC

 201 TGTTGGGGCG AAAGGACGTG CCGATGACGG TTTGATTCAC GTTGTCAGCC

 251 TGCTCGATGC CGACGGTTTG ATCAAAATCC TGACGCATAC CGTTAAAAAT

 301 TTCACCGGTT TCGCGCCGTT GGGAACGGTG TTGGTTTCTT TATTGGGCGT

 351 GGGGATTGCG GAAAAATCGG GCTTGATTTC CGCATTAATG CGCTTATTGC

 401 TCACAAAATC CCCACGCAAA CTCACTACTT TTATGGTTGT TTTTACAGGG

 451 ATTTTATCCA ATACGGCTTC TGAATTGGGC TATGTCGTCC TAATCCCTTT

 501 GTCCGCCGTC ATCTTTCATT CGCTCGGCCG CCATCCGCTT GCCGGTTTGG

 551 CTGCGGCTTT CGCCGGCGTT TCGGGCGGTT ATTCGGCCAA TCTGTTCTTA

 601 GGCACAATCG ATCCGCTCTT GGCAGGCATC ACCCAACAGG CGGCGCAAAT

 651 CATCCATCCC GACTACGTCG TAGGCCCTGA AGCCAACTGG TTTTTTATGG

 701 CAGCCAGTAC GTTTGTGATT GCTTTGATTG GTTATTTTGT TACTGAAAAA

 751 ATCGTCGAAC CGCAATTGGG CCCTTATCAA TCAGATTTGT CACAAGAAGA

 801 AAAAGACATT CGGCATTCCA ATGAAATCAC GCCTTTGGAA TATAAAGGAT

 851 TAATTTGGGC AGGCGTGGTG TTTGTTGCCT TATCCGCCCT ATTGGCTTGG

 901 AGCATCGTCC CTGCCGACGG TATTTTGCGT CATCCTGAAA CAGGATTGGT

 951 TGCCGGTTCG CCGTTTTTAA AATCGATTGT TGTTTTTATT TTCTTGTTGT

1001 TTGCGCTGCC GGGCATTGTT TATGGCCGGA TAACCCGAAG TTTGCGCGGC

1051 GAACGGGAAG TCGTTAATGC GATGGCCGAA TCGATGAGTA CTTTGGGACT

1101 TTATTTGGTC ATCATCTTTT TTGCCGCACA GTTTGTCGCA TTTTTTAATT

1151 GGACGAATAT TGGGCAATAT ATTGCCGTTA AAGGGGCGGT GTTCTTAAAA

1201 GAAGTCGGCT TGGGCGGCAG TGTGTTGTTT ATCGGTTTTA TTTTAATTTG

1251 TGCTTTTATC AATCTGATGA TAGGCTCCGC CTCCGCGCAA TGGGCGGTAA

1301 CTGCGCCGAT TTTCGTCCCT ATGCTGATGT TGGCCGGCTA CGCGCCCCAA

1351 GTCATTCAAG CCGCTTACCG CATCGGTGAT TCCGTTACCA ATATTATTAC

1401 GCCGATGATG AGTTATTTCG GGCTGATTAT GGCGACGGTA ATCAAATACA

1451 AAAAAGATGC GGGCGTAGGC ACGCTGATTT CTATGATGTT GCCGTATTCC

1501 GCTTTCTTCT TAATTGCATG GATCGCCTTA TTCTGCATTT GGGTATTTGT

1551 TTTGGGTCTG CCCGTCGGTC CCGGCACACC CACATTCTAT CCGGTGCCTT

1601 AA
```

This corresponds to the amino acid sequence <SEQ ID 1254; ORF 302.ng>:

```
g302.pep
   1 MHSIYFFKEK QMSQTDARRS GRFLRTVEWL GNMLPHPVTL FIIFIVLLLI

  51 ASAVGAYFGL SVPDPRPVGA KGRADDGLIH VVSLLDADGL IKILTHTVKN
```

-continued

```
101 FTGFAPLGTV LVSLLGVGIA EKSGLISALM RLLLTKSPRK LTTFMVVFTG

151 ILSNTASELG YVVLIPLSAV IFHSLGRHPL AGLAAAFAGV SGGYSANLFL

201 GTIDPLLAGI TQQAAQIIHP DYVVGPEANW FFMAASTFVI ALIGYFVTEK

251 IVEPQLGPYQ SDLSQEEKDI RHSNEITPLE YKGLIWAGVV FVALSALLAW

301 SIVPADGILR HPETGLVAGS PFLKSIVVFI FLLFALPGIV YGRITRSLRG

351 EREVVNAMAE SMSTLGLYLV IIFFAAQFVA FFNWTNIGQY IAVKGAVFLK

401 EVGLGGSVLF IGFILICAFI NLMIGSASAQ WAVTAPIFVP MLMLAGYAPQ

451 VIQAAYRIGD SVTNIITPMM SYFGLIMATV IKYKKDAGVG TLISMMLPYS

501 AFFLIAWIAL FCIWVFVLGL PVGPGTPTFY PVP*
```

The following partial DNA sequence was identified in *N. meningitidis* <SEQ ID 1255>:

```
m302.seq
   1 ATGCACTCAA TATATTTTTT TAAGGAGAAG CAGATGAGTC AAACCGATAC

  51 GCAACGGGAC GGACGATTTT TACGCACAGT CGAATGGCTG GGCAATATGT

 101 TGCCGCATCC GGTTACGCTT TTTATTATTT TCATTGTGTT ATTGCTGATT

 151 GCCTCTGCCG TCGGTGCGTA TTTCGGACTA TCCGTCCCCG ATCCGCGCCC

 201 TGTTGGTGCG AAAGGACGTG CCGATGACGG TTTGATTTAC ATTGTCAGCC

 251 TGCTCAATGC CGACGGTTTT ATCAAAATCC TGACGCATAC CGTTAAAAAT

 301 TTCACCGGTT TCGCGCCGTT GGGAACGGTG TTGGTTTCTT TATTGGGCGT

 351 GGGGATTGCG GAAAAATCGG GCTTGATTTC CGCATTAATG CGCTTATTGC

 401 TCACAAAATC GCCACGCAAA CTCACTACTT TTATGGTTGT TTTTACAGGG

 451 ATTTTATCTA ATACCGCTTC TGAATTGGGC TATGTCGTCC TAATCCCTTT

 501 GTCCGCCATC ATCTTTCATT CCCTCGGCCG CCATCCGCTT GCCGGTCTGG

 551 CTGCGGCTTT CGCCGGCGTT TCGGGCGGTT ATTCGGCCAA TCTGTTCTTA

 601 AGCACAATCG ATCCGCTCTT GGCATGCATC ACCCATCAGG CGGCGGTCGT

 651 AGGCCCTGAA GCCAACTGGT TTTTTATGGT AGCCAGTACG TTTGTGATTG

 701 CTTTGATTGG TTATTTTGTT ACTGAAAAAA TCGTCGAACC GCAATTGGGC

 751 CCTTATCAAT CAGATTTGTC ACAAGAAGAA AAAGACATTC GGCATTCCAA

 801 TGAAATCACG CCTTTGGAAT ATAAAGGATT AATTTGGGCT GGCGTGGTGT

 851 TTGTTGCCTT ATCCGCCCTA TTGGCTTGGA GCATCGTCCC TGCCGACGGT

 901 ATTTTGCGTC ATCCTGAAAC AGGATTGGTT TCCGGTTCGC CGTTTTTAAA

 951 ATCGATTGTT GTTTTTATTT TCTTGTTGTT TGCACTGyCG GGCmTTGTTT

1001 ATGGmCGGGT AACAGGAAGT TTGCGCGGCG AACAGGAAGT CGTTAATGCG

1051 ATGGCCGAAT CGATGAGTAC TCTGGsGCTT TmTTTGswCA kcATCTTTTT

1101 TGCCGCACAG TTTGTCGCAT TTTTTAATTG GACGAATATT GGGCAATATA

1151 TTGCCGTTAA AGGGGCGACG TTCTTAAAAG AAGTCGGCTT GGGCGGCAGC

1201 GTGTTGTTTA TCGGTTTTAT TTTAATTTGT GCTTTTATCA ATCTGATGAT

1251 AGGCTCCGCC TCCGCGCAAT GGGCGGTAAC TGCGCCGATT TTCGTCCCTA

1301 TGCTGATGTT GGCCGGCTAC GCGCCCGAAG TCATTCAAGC CGCTTACCGC

1351 ATCGGTGATT CCGTTACCAA TATTATTACG CCGATGATGA GTTATTTCGG
```

-continued

```
1401 GCTGATTATG GCGACGGTGA TCAAATACAA AAAAGATGCG GGCGTGGGTA

1451 CGCTGATTTC TATGATGTTG CCGTATTCCG CTTTCTTCTT GATTGCGTGG

1501 ATTGCCTTAT TCTGCATTTG GGTATTTGTT TTGGGCCTGC CCGTCGGTCC

1551 CGGCGCGCCC ACATTCTATC CCGCACCTTA A
```

This corresponds to the amino acid sequence <SEQ ID 1256; ORF 302>:

```
m302.pep
  1 MHSIYFFKEK QMSQTDTQRD GRFLRTVEWL GNMLPHPVTL FIIFIVLLLI

 51 ASAVGAYFGL SVPDPRPVGA KGRADDGLIY IVSLLNADGF IKILTHTVKN

101 FTGFAPLGTV LVSLLGVGIA EKSGLISALM RLLLTKSPRK LTTFMVVFTG

151 ILSNTASELG YVVLIPLSAI IFHSLGRHPL AGLAAAFAGV SGGYSANLFL

201 STIDPLLACI THQAAVVGPE ANWFFMVAST FVIALIGYFV TEKIVEPQLG

251 PYQSDLSQEE KDIRHSNEIT PLEYKGLIWA GVVFVALSAL LAWSIVPADG

301 ILRHPETGLV SGSPFLKSIV VFIFLLFALX GXVYGRVTRS LRGEQEVVNA

351 MAESMSTLXL XLXXIFFAAQ FVAFFNWTNI GQYIAVKGAT FLKEVGLGGS

401 VLFIGFILIC AFINLMIGSA SAQWAVTAPI FVPMLMLAGY APEVIQAAYR

451 IGDSVTNIIT PMMSYFGLIM ATVIKYKKDA GVGTLISMML PYSAFFLIAW

501 IALFCIWVFV LGLPVGPGAP TFYPAP*
```

Computer analysis of this amino acid sequence gave the following results:

Homology with a Predicted ORF from *N. gonorrhoeae*

ORF 302 shows 94.0% identity over a 533 aa overlap with a predicted ORF (ORF 302.ng) from *N. gonorrhoeae*:

```
m302/g302

                     10        20        30        40        50        60
m302.pep     MHSIYFEKEKQMSQTDTQRDGRFLRTVEWLGNMLPHPVTLFIIFIVLLLIASAVGAYFGL
             ||||||||||||||||::|:||||||||||||||||||||||||||||||||||||||||
g302         MHSIYFFKEKQMSQTDARRSGRFLRTVEWLGNMLPHPVTLFIIFIVLLLIASAVGAYFGL
                     10        20        30        40        50        60

                     70        80        90       100       110       120
m302.pep     SVPDPRPVGAKGRADDGLIYIVSLLNADGFIKILTHTVKNFTGFAPLGTVLVSLLGVGIA
             |||||||||||||||||||::||||:|||:||||||||||||||||||||||||||||||
g302         SVPDPRPVGAKGRADDGLIHVVSLLDADGLIKILTHTVKNFTGFAPLGTVLVSLLGVGIA
                     70        80        90       100       110       120

                    130       140       150       160       170       180
m302.pep     EKSGLISALMRLLLTKSPRKLTTFMVVFTGILSNTASELGYVVLIPLSAIIFHSLGRHPL
             |||||||||||||||||||||||||||||||||||||||||||||||||:||||||||||
g302         EKSGLISALMRLLLTKSPRKLTTFMVVFTGILSNTASELGYVVLIPLSAVIFHSLGRHPL
                    130       140       150       160       170       180

                    190       200       210              220       230
m302.pep     AGLAAAFAGVSGGYSANLFLSTIDPLLACITHQAA-------VVGPEANWFFMVASTFVI
             ||||||||||||||||||||:||||||| ||:|||       |||||||||||:||||||
g302         AGLAAAFAGVSGGYSANLFLGTIDPLLAGITQQAAQIIHPDYVVGPEANWFFMAASTFVI
                    190       200       210       220       230       240

                240       250       260       270       280       290
m302.pep     ALIGYFVTEKIVEPQLGPYQSDLSQEEKDIRHSNEITPLEYKGLIWAGVVFVALSALLAW
             ||||||||||||||||||||||||||||||||||||||||||||||||||||||||||||
g302         ALIGYFVTECIVEPQLGPYQSDLSQEEKDIRHSNEITPLEYKGLIWAGVVFVALSALLAW
                    250       260       270       280       290       300

                300       310       320       330       340       350
m302.pep     SIVPADGILRHPETGLVSGSPFLKSIVVFIFLLFALXGXVYGRVTRSLRGEQEVVNAMAE
             |||||||||||||||||:|||||||||||||||||| | ||||:|||||||:||||||||
g302         SIVPADGILRHPETGLVAGSPFLKSIVVFIFLLFALPGIVYGRITRSLRGEREVVNAMAE
                    310       320       330       340       350       360
```

-continued

```
                360       370       380       390       400       410
m302.pep    SMSTLXLXLXXIFFAAQFVAFFNWTNIGQYIAVKGATFLKEVGLGGSVLFIGFILICAFI
            ||||| | |  |||||||||||||||||||||||||:|||||||||||||||||||||||
g302        SMSTLGLYLVIIFFAAQFVAFFNWTNIGQYIAVKGAVFLKEVGLGGSVLFIGFILICAFI
                   370       380       390       400       410       420

                420       430       440       450       460       470
m302.pep    NLMIGSASAQWAVTAPIFVPMLMLAGYAPEVIQAAYRIGDSVTNIITPMMSYFGLIMATV
            |||||||||||||||||||||||||||||:||||||||||||||||||||||||||||||
g302        NLMIGSASAQWAVTAPIFVPMLMLAGYAPQVIQAAYRIGDSVTNIITPMMSYFGLIMATV
                   430       440       450       460       470       480

                480       490       500       510       520
m302.pep    IKYKKDAGVGTLISMMLPYSAFFLIAWIALFCIWVFVLGLPVGPGAPTFYPAPX
            |||||||||||||||||||||||||||||||||||||||||||||:|||||:||
g302        IKYKKDAGVGTLISMMLPYSAFFLIAWIALFCIWVFVLGLPVGPGTPTFYPVPX
                   490       500       510       520       530
```

The following partial DNA sequence was identified in *N. meningitidis* <SEQ ID 1257>:

```
a302.seq
   1 ATGCACTCAA TATATTTTTT TAAGGAGAAG CAGATGAGTC AAACCGATAC

  51 GCAACGGGAC GGACGATTTT TACGCACAGT CGAATGGCTG GGCAATATGT

 101 TGCCGCACCC GGTTACGCTT TTTATTATTT TCATTGTGTT ATTGCTGATT

 151 GCCTCTGCCG CCGGTGCGTA TTTCGGACTA TCCGTCCCCG ATCCGCGCCC

 201 TGTTGGTGCG AAAGGACGTG CCGATGACGG TTTGATTCAC GTTGTCAGCC

 251 TGCTCGATGC TGACGGTTTG ATCAAAATCC TGACGCATAC CGTTAAAAAT

 301 TTCACCGGTT TCGCGCCGTT GGGAACGGTG TTGGTTTCTT TATTGGGCGT

 351 GGGGATTGCG GAAAAATCGG GCTTGATTTC CGCATTAATG CGCTTATTGC

 401 TCACAAAATC TCCACGCAAA CTCACTACTT TTATGGTTGT TTTTACAGGG

 451 ATTTTATCTA ATACCGCTTC TGAATTGGGC TATGTCGTCC TAATCCCTTT

 501 GTCCGCCATC ATCTTTCATT CCCTCGGCCG CCATCCGCTT GCCGGTCTGG

 551 CTGCGGCTTT CGCCGGCGTT TCGGGCGGTT ATTCGGCCAA TCTGTTCTTA

 601 GGCACAATCG ATCCGCTCTT GGCAGGCATC ACCCAACAGG CGGCGCAAAT

 651 CATCCATCCC GACTACGTCG TAGGCCCTGA AGCCAACTGG TTTTTTATGG

 701 TAGCCAGTAC GTTTGTGATT GCTTTGATTG GTTATTTTGT TACTGAAAAA

 751 ATCGTCGAAC CGCAATTGGG CCCTTATCAA TCAGATTTGT CACAAGAAGA

 801 AAAAGACATT CGACATTCCA ATGAAATCAC GCCTTTGGAA TATAAAGGAT

 851 TAATTTGGGC TGGCGTGGTG TTTGTTGCCT TATCCGCCCT ATTGGCTTGG

 901 AGCATCGTCC CTGCCGACGG TATTTTGCGT CATCCTGAAA CAGGATTGGT

 951 TTCCGGTTCG CCGTTTTTAA AATCAATTGT TGTTTTTATT TTCTTGTTGT

1001 TTGCACTGCC GGGCATTGTT TATGGCCGGG TAACCCGAAG TTTGCGCGGC

1051 GAACAGGAAG TCGTTAATGC GATGGCCGAA TCGATGAGTA CTCTGGGGCT

1101 TTATTTGGTC ATCATCTTTT TTGCCGCACA GTTTGTCGCA TTTTTTAATT

1151 GGACGAATAT TGGGCAATAT ATTGCCGTTA AAGGGGCGAC GTTCTTAAAA

1201 GAAGTCGGCT TGGGCGGCAG CGTGTTGTTT ATCGGTTTTA TTTTAATTTG

1251 TGCTTTTATC AATCTGATGA TAGGCTCCGC CTCCGCGCAA TGGGCGGTAA

1301 CTGCGCCGAT TTTCGTCCCT ATGCTGATGT TGGCCGGCTA CGCGCCCGAA

1351 GTCATTCAAG CCGCTTACCG CATCGGTGAT TCCGTTACCA ATATTATTAC

1401 GCCGATGATG AGTTATTTCG GGCTGATTAT GGCGACGGTG ATCAAATACA
```

-continued

```
1451 AAAAAGATGC GGGCGTGGGT ACGCTGATTT CTATGATGTT GCCGTATTCC

1501 GCTTTCTTCT TGATTGCGTG GATTGCCTTA TTCTGCATTT GGGTATTTGT

1551 TTTGGGCCTG CCCGTCGGTC CCGGCGCGCC CACATTCTAT CCCGCACCTT

1601 AA
```

This corresponds to the amino acid sequence <SEQ ID 1258; ORF 302.a>:

```
a302.pep
   1 MHSIYFFKEK QMSQTDTQRD GRFLRTVEWL GNMLPHPVTL FIIFIVLLLI

  51 ASAAGAYFGL SVPDPRPVGA KGRADDGLIH VVSLLDADGL IKILTHTVKN

 101 FTGFAPLGTV LVSLLGVGIA EKSGLISALM RLLLTKSPRK LTTFMVVFTG

 151 ILSNTASELG YVVLIPLSAI IFHSLGRHPL AGLAAAFAGV SGGYSANLFL

 201 GTIDPLLAGI TQQAAQIIHP DYVVGPEANW FFMVASTFVI ALIGYFVTEK

 251 IVEPQLGPYQ SDLSQEEKDI RHSNEITPLE YKGLIWAGVV FVALSALLAW

 301 SIVPADGILR HPETGLVSGS PFLKSIVVFI FLLFALPGIV YGRVTRSLRG

 351 EQEVVNAMAE SMSTLGLYLV IIFFAAQFVA FFNWTNIGQY IAVKGATFLK

 401 EVGLGGSVLF IGFILICAFI NLMIGSASAQ WAVTAPIFVP MLMLAGYAPE

 451 VIQAAYRIGD SVTNIITPMM SYFGLIMATV IKYKKDAGVG TLISMMLPYS

 501 AFFLIAWIAL FCIWVFVLGL PVGPGAPTFY PAP*
```

m302/a302 96.1% identity in 533 aa overlap

```
                      10        20        30        40        50        60
m302.pep      MHSIYFEKEKQMSQTDTQRDGRFLRTVEWLGNMLPHPVTLFIIFIVLLLIASAVGAYFGL
              |||||||||||||||||||||||||||||||||||||||||||||||||||||:||||||
a302          MHSIYFFKEKQMSQTDQRRDGRFLRTVEWLGNMLPHPVTLFIIFIVLLLIASAAGAYFGL
                      10        20        30        40        50        60

                      70        80        90       100       110       120
m302.pep      SVPDPRPVGAKGRADDGLIYIVSLLNADGFIKILTHTVKNFTGFAPLGTVLVSLLGVGIA
              |||||||||||||||||||::||||:|||:||||||||||||||||||||||||||||||
a302          SVPDPRPVGAKGRADDGLIHVVSLLDADGLIKILTHTVKNFTGFAPLGTVLVSLLGVGIA
                      70        80        90       100       110       120

                     130       140       150       160       170       180
m302.pep      EKSGLISALMRLLLTKSPRKLTTFMVVFTGILSNTASELGYVVLIPLSAIIFHSLGRHPL
              ||||||||||||||||||||||||||||||||||||||||||||||||||||||||||||
a302          EKSGLISALMRLLLTKSPRKLTTFMVVFTGILSNTASELGYVVLIPLSAIIFHSLGRHPL
                     130       140       150       160       170       180

                     190       200       210              220       230
m302.pep      AGLAAAFAGVSGGYSANLFLSTIDPLLACITHQAA-------VVGPEANWFFMVASTFVI
              ||||||||||||||||||||:||||||| ||:|||       ||||||||||||||||||
a302          AGLAAAFAGVSGGYSANLFLGTIDPLLAGITQQAAQIIHPDYVVGPEANWFFMVASTFVI
                     190       200       210       220       230       240

                  240       250       260       270       280       290
m302.pep      ALIGYFVTEKIVEPQLGPYQSDLSQEEKDIRHSNEITPLEYKGLIWAGVVFVALSALLAW
              ||||||||||||||||||||||||||||||||||||||||||||||||||||||||||||
a302          ALIGYFVTECIVEPQLGPYQSDLSQEEKDIRHSNEITPLEYKGLIWAGVVFVALSALLAW
                     250       260       270       280       290       300

                  300       310       320       330       340       350
m302.pep      SIVPADGILRHPETGLVSGSPFLKSIVVFIFLLFALXGXVYGRVTRSLRGEQEVVNAMAE
              |||||||||||||||||||||||||||||||||||| | |||||||||||||||||||||
a302          SIVPADGILRHPETGLVSGSPFLKSIVVFIFLLFALPGIVYGRVTRSLRGEQEVVNAMAE
                     310       320       330       340       350       360

                  360       370       380       390       400       410
m302.pep      SMSTLXLXLXXIFFAAQFVAFFNWTNIGQYIAVKGATFLKEVGLGGSVLFIGFILICAFI
              ||||| | |  |||||||||||||||||||||||||||||||||||||||||||||||||
a302          SMSTLGLYLVIIFFAAQFVAFFNWTNIGQYIAVKGATFLKEVGLGGSVLFIGFILICAFI
                     370       380       390       400       410       420
```

-continued

```
                420       430       440       450       460       470
m302.pep  NLMIGSASAQWAVTAPIFVPMLMLAGYAPEVIQAAYRIGDSVTNIITPMMSYFGLIMATV
          ||||||||||||||||||||||||||||||||||||||||||||||||||||||||||||
a302      NLMIGSASAQWAVTAPIFVPMLMLAGYAPEVIQAAYRIGDSVTNIITPMMSYFGLIMATV
                   430       440       450       460       470       480

                480       490       500       510       520
m302.pep  IKYKKDAGVGTLISMMLPYSAFFLIAWIALFCIWVFVLGLPVGPGAPTFYPAPX
          ||||||||||||||||||||||||||||||||||||||||||||| ||||| | 
a302      IKYKKDAGVGTLISMMLPYSAFFLIAWIALFCIWVFVLGLPVGPGTPTFYPVPX
                   490       500       510       520       530
```

The following partial DNA sequence was identified in *N. gonorrhoeae* <SEQ ID 1259>:

```
g305.seq
   1 ATGGATTTTT TGATTGTCCT GAAAGCCCTG ATGATGGGCT TGGTAGAAGG

  51 TTTTACCGAA TTTTTACCGA TTTCCAGCAC CGGACATTTG ATTGTGTTCG

 101 GCAATCTGAT TGGTTTTCAC AGCAATCACA AGGTTTTTGA AATTGCCATC

 151 CAGCTCGGTG CGGTTTTGGC GGTAGTGTTT GAATACCGGC AGCGTTTCAG

 201 CAATGTGTTG CATGGCGTGG GAAAAGACCG GAAAGCCAAC CGTTTCGTCC

 251 TCAATCTTGC CATTGCTTTT ATACCTGCCG CCGTGATGGG GCTGTTGTTC

 301 GACAAACAAA TCAAAGAGTA TCTGTTTAAC CCCTTGAGTG TTGCAGTCAT

 351 GCTGGTTTTG GGCGGTTTTT TTATTTTGTG GGTGGAGAAA CGCCAAAGCC

 401 GAGCAGAGCC TAAAATTGCC GATGTTGATG CATTGCGTCC GATTGATGCG

 451 TTGATGATCG GTGTTGCCCA AGTGTTTGCA CTGGTTCCGG GTACGTCCCG

 501 TTCGGGCAGT ACGGTTATGG GCGGGATGCT TTGGGGAATC GAGCGGAAAA

 551 CGGCAACGGA GTTTTCATTT TTCTTGGCCG TTCCGATGAT GGTTGCAGCA

 601 ACGGCTTATG ATGTCCTGAA ACATTACCGA TTTTTCACCC TGCATGATGT

 651 CGGTTTGATT TTGATAGGCT TTATTGCCGC TTTTGTTTCC GGTTTGGTAG

 701 CGGTTAAAGC ACTGCTGAAG TTTGTTTCCA AGAAAAACTA TATCCCGTTT

 751 GCCTATTACC GCATTGTTTT CGGCATTGTC ATCATAAATAT TGTGGTTGTC

 801 GGGCTGGATA AGTTGGGAAT GA
```

This corresponds to the amino acid sequence <SEQ ID 1260; ORF 305.ng>:

```
g305.pep
   1 MDFLIVLKAL MMGLVEGFTE FLPISSTGHL IVFGNLIGFH SNHKVFEIAI

  51 QLGAVLAVVF EYRQRFSNVL HGVGKDRKAN RFVLNLAIAF IPAAVMGLLF

 101 DKQIKEYLFN PLSVAVMLVL GGFFILWVEK RQSRAEPKIA DVDALRPIDA

 151 LMIGVAQVFA LVPGTSRSGS TVMGGMLWGI ERKTATEFSF FLAVPMMVAA

 201 TAYDVLKHYR FFTLHDVGLI LIGFIAAFVS GLVAVKALLK FVSKKNYIPF

 251 AYYRIVFGIV IIILWLSGWI SWE*
```

The following partial DNA sequence was identified in *N. meningitidis* <SEQ ID 1261>:

```
m305.seq (partial)
   1 AtGGATTTTC TGATTGTCCT GAAAGCCCTG ATGATGGGCT TGGTAGAAGG

  51 TTTTACCGAA TTTTTACCGA TTTCCAGCAC CGGACATTTG ATTGTGTTCG
```

-continued

```
101 GCAATCTGAT TGGTTTTCAC AGCAATCACA AGGTTTTTGA AATTGCCATC

151 CAGCTCGGTG CAGTTTTGGC GGTAGTGTTT GAATACCGGC AACGTTTCAG

201 CAATGTGTTG CACGGCTTGG GAAAAGACCG GAAAGCCAAC CGCTTCGTCC

251 TTAATCTTGC CATTGCTTTT ATACCTGCCG CCGTGATGGG GCTGTTGTTC

301 GGCAwACAAA TCAAAGAGyA TCTGTTTAAC CCCTTGAGTG TTGCAGTCAT

351 GCTGGTTyTG GrCGGTTTTT yTATTTTGTG GGTGGAGAAA CGCCAAAGCC

401 GAGCAGAGCC TAAAATTGCC GATGTTGATG CATTGCGTCC GATTGATGCC

451 TTGATGATCG GCGTTGCCCA AGTGTTTGCA CTGGTTCCGG GTACGTCCCG

501 TTCGGGCAGT ACGATTATGG GCGGGATGCT TTGGGGCATC GAACGGAAAA

551 CTGCGACAGA ATTCTCGTTT TTCTTGGCTG TGCCGATGAT GGTTGCCGCA

601 ACGGCTTATG ATGTCCTGAA ACATTACCGA TTTTTCACCC TGCATGATGT

651 CGGTTTGATT CTGATAGGCT TTATTGCTGC CTTTGTTTCA GGCTTGGTAG

701 CGGTAAAAGC GTTGCTGAGG TTTGTTTCGG GTAC...
```

This corresponds to the amino acid sequence <SEQ ID 1262; ORF 305>:

```
m305.pep (partial)
  1 MDFLIVLKAL MMGLVEGFTE FLPISSTGHL IVFGNLIGFH SNHKVFEIAI

 51 QLGAVLAVVF EYRQRFSNVL HGLGKDRKAN RFVLNLAIAF IPAAVMGLLF

101 GXQIKEXLFN PLSVAVMLVL XGFXILWVEK RQSRAEPKIA DVDALRPIDA

151 LMIGVAQVFA LVPGTSRSGS TIMGGMLWGI ERKTATEFSF FLAVPMMVAA

201 TAYDVLKHYR FFTLHDVGLI LIGFIAAFVS GLVAVKALLR FVSG...
```

Computer analysis of this amino acid sequence gave the following results:

Homology with a Predicted ORF from *N. gonorrhoeae*

ORF 305 shows 96.7% identity over a 243 aa overlap with a predicted ORF (ORF 305.ng) from *N. gonorrhoeae*:

```
g305/m305

                   10        20        30        40        50        60
g305.pep   MDFLIVLKALMMGLVEGFTEFLPISSTGHLIVFGNLIGFHSNHKVFEIAIQLGAVLAVVF
           ||||||||||||||||||||||||||||||||||||||||||||||||||||||||||||
m305       MDFLIVLKALMMGLVEGFTEFLPISSTGHLIVFGNLIGFHSNHKVFEIAIQLGAVLAVVF
                   10        20        30        40        50        60

                   70        80        90       100       110       120
g305.pep   EYRQRFSNVLHGVGKDRKANRFVLNLAIAFIPAAVMGLLFDKQIKEYLFNPLSVAVMLVL
           ||||||||||||:||||||||||||||||||||||||||||  |||| ||||||||||||
m305       EYRQRFSNVLHGLGKDRKANRFVLNLAIAFIPAAVMGLLFGXQIKEXLFNPLSVAVMLVL
                   70        80        90       100       110       120

                  130       140       150       160       170       180
g305.pep   GGFFILWVEKRQSRAEPKIADVDALRPIDALMIGVAQVFALVPGTSRSGSTVMGGMLWGI
            || |||||||||||||||||||||||||||||||||||||||||||||||:|||||||
m305       XGFXILWVEKRQSRAEPKIADVDALRPIDALMIGVAQVFALVPGTSRSGSTIMGGMLWGI
                  130       140       150       160       170       180

                  190       200       210       220       230       240
g305.pep   ERKTATEFSFFLAVPMMVAATAYDVLKHYRFFTLHDVGLILIGFIAAFVSGLVAVKALLK
           |||||||||||||||||||||||||||||||||||||||||||||||||||||||||||:
m305       ERKTATEFSFFLAVPMMVAATAYDVLKHYRFFTLHDVGLILIGFIAAFVSGLVAVKALLR
                  190       200       210       220       230       240
```

-continued

```
                 250       260       270
g305.pep   FVSKKNYIPFAYYRIVFGIVIIILWLSGWISWEX
           |||
m305       FVSG
```

The following partial DNA sequence was identified in *N. meningitidis* <SEQ ID 1263>:

```
a305.seq
  1 ATGGATTTTC TGATTGTCCT GAAAGCCCTG ATGATGGGCT TGGTAGAAGG
 51 TTTTACCGAA TTTTTACCGA TTTCCAGCAC CGGACATTTG ATTGTGTTCG
101 GCAATCTGAT TGATTTTCAC AGCAATCACA AGGTTTTTGA AATTACCATC
151 CAGCTCGGTG CGGTTTTGGC GGTAGTGTTT GAATACCGGC AGCGTTTCAG
201 CAATGTGTTG CATGGCGTGG GAAAAGACCG GAAAGCCAAC CGTTTCGTCC
251 TTAATCTTGC CATTGCTTTT ATACCTGCCG CCGTGATGGG GCTGTTGTTC
301 GGCAAACAAA TCAAAGAGTA TCTGTTTAAC CCCTTGAGTG TTGCAGTCAT
351 GCTGGTTTTG GGCGGTTTTT TTATTTTGTG GGTGGAGAAA CGCCAAAGCC
401 GAGCAGAGCC TAAAATTGTC GATGTTGATG CATTGCGTCC GATTGATGCG
451 TTGATGATCG GCGTTGCCCA AGTGTTTGCA CTGGTTCCAG GTACGTCCCG
501 TTCGGGCAGT ACGATTATGG GCGGGATGCT TGGGGAATC GAGCGGAAAA
551 CGGCAACGGA GTTTTCATTT TTCTTGGCCG TTCCGATGAT GGTTGCAGCA
601 ACGGCTTATG ATGTCCTGAA GCATTACCGG TTTTTCACCC TGCATGATGT
651 CGGTTTGATT TTGATTGGCT TTGTTGCTGC CTTTGTTTCA GGCTTGGTGG
701 CGGTCAAAGC GTTGCTGAGG TTTGTTTCCA AGAAAAATTA TATTCCTTTT
751 GCCTATTACC GCATTGTTTT TGGTATTGCC ATCATTATAT TGTGGCTGTC
801 AGGCTGGATA AGTTGGGAAT GA
```

This corresponds to the amino acid sequence <SEQ ID 1264; ORF 305.a>:

```
a305.pep
  1 MDFLIVLKAL MMGLVEGFTE FLPISSTGHL IVFGNLIDFH SNHKVFEITI
 51 QLGAVLAVVF EYRQRFSNVL HGVGKDRKAN RFVLNLAIAF IPAAVMGLLF
101 GKQIKEYLFN PLSVAVMLVL GGFFILWVEK RQSRAEPKIV DVDALRPIDA
151 LMIGVAQVFA LVPGTSRSGS TIMGGMLWGI ERKTATEFSF FLAVPMMVAA
201 TAYDVLKHYR FFTLHDVGLI LIGFVAAFVS GLVAVKALLR FVSKKNYIPF
251 AYYRIVFGIA IIILWLSGWI SWE*
```

m305/a305 96.3% identity in 243 aa overlap

```
                     10        20        30        40        50        60
m305.pep   MDFLIVLKALMMGLVEGFTEFLPISSTGHLIVFGNLIGFHSNHKVFEIAIQLGAVLAVVF
           |||||||||||||||||||||||||||||||||||||| ||||||||||:|||||||||||
a305       MDFLIVLKALMMGLVEGFTEFLPISSTGHLIVFGNLIDFHSNHKVFEITIQLGAVLAVVF
                     10        20        30        40        50        60
```

-continued

```
                 70        80        90       100       110       120
m305.pep  EYRQRFSNVLHGLGKDRKANRFVLNLAIAFIPAAVMGLLFGXQIKEXLFNPLSVAVMLVL
          ||||||||||||:|||||||||||||||||||||||||||| |||| |||||||||||||
a305      EYRQRFSNVLHGVGKDRKANRFVLNLAIAFIPAAVMGLLFGKQIKEYLFNPLSVAVMLVL
                 70        80        90       100       110       120

                130       140       150       160       170       180
m305.pep  XGFXILWVEKRQSRAEPKIADVDALRPIDALMIGVAQVFALVPGTSRSGSTIMGGMLWGI
           || |||||||||||||||:||||||||||||||||||||||||||||||||||||||||
a305      GGFFILWVEKRQSRAEPKIADVDALRPIDALMIGVAQVFALVPGTSRSGSTVMGGMLWGI
                130       140       150       160       170       180

                190       200       210       220       230       240
m305.pep  ERKTATEFSFFLAVPMMVAATAYDVLKHYRFFTLHDVGLILIGFIAAFVSGLVAVKALLR
          ||||||||||||||||||||||||||||||||||||||||||||:|||||||||||||||
a305      ERKTATEFSFFLAVPMMVAATAYDVLKHYRFFTLHDVGLILIGFVAAFVSGLVAVKALLR
                190       200       210       220       230       240

m305.pep  FVSG
          |||
a305      FVSKKNYIPFAYYRIVFGIAIIILWLSGWISWEX
                250       260       270
```

The following partial DNA sequence was identified in *N. gonorrhoeae* <SEQ ID 1265>:

```
g306.seq
   1 ATGTTTATGA ACAAATTTTC CCAATCCGGA AAAGGTCTGT CCGGTTTCTT

  51 CTTCGGTTTG ATACTGGCAA CGGTCATTAT TGCCGGTATT TTGCTTTATC

 101 TGAACCAGGG CGGTCAAAAT GCGTTCAAAA TCCCGGCTCC GTCGAAGCAG

 151 CCTGCAGAAA CGGAAATCCT GAAACTGAAA AACCAGCCTA AGGAAGACAT

 201 CCAACCTGAA CCGGCCGATC AAAACGCCTT GTCCGAACCG GATGTTGCGA

 251 AAGAGGCAGA GCAGTCGGAT GCGGAAAAAG CTGCCGACAA GCAGCCCGTT

 301 GCCGACAAAG CCGACGAGGT TGAAGAAAAG GCGGGCGAGC CGGAACGGGA

 351 AGAGCCGGAC GGACAGGCAG TGCGCAAGAA AGCACTGACT GAAGAGCGTG

 401 AACAAACCGT CAGGGAAAAA GCGCAGAAGA AAGATGCCGA AACGGTTAAA

 451 AAAAAAGCGG TAAAACCGTC TAAAGAAACA GAGAAAAAAG CTTCAAAAGA

 501 AGAGAAAAAG GCGGCGAAAG AAAAAGTTGC ACCCAAACCG ACCCCGGAAC

 551 AAATCCTCAA CAGCCGCAGT ATCGAAAAAG CGCGTAGTGC CGCTGCCAAA

 601 GAAGTGCAGA AAATGAAAAA CTTTGGGCAA GGCGGAAGCC AACGCATTAT

 651 CTGCAAATGG GCGCGTATGC CGAACCCCGG AGCGCGGAAG GGCAGCGTGC

 701 CAAACTGGCA ATCTTGGGCA TATCTTCCGA AGTGGTCGGC TATCAGGCGG

 751 GACATAAAAC GCTTTACCGC GTGCAAAGCG GCAATATGTC CGCCGATGCG

 801 GTGA
```

This corresponds to the amino acid sequence <SEQ ID 1266; ORF 306.ng>:

```
g306.pep
   1 MFMNKFSQSG KGLSGFFFGL ILATVIIAGI LLYLNQGGQN AFKIPAPSKQ

  51 PAETEILKLK NQPKEDIQPE PADQNALSEP DVAKEAEQSD AEKAADKQPV

 101 ADKADEVEEK AGEPEREEPD GQAVRKKALT EEREQTVREK AQKKDAETVK

 151 KKAVKPSKET EKKASKEEKK AAKEKVAPKP TPEQILNSRS IEKARSAAAK
```

-continued

```
201 EVQKMKNFGQ GGSQRIICKW ARMPNPGARK GSVPNWQSWA YLPKWSAIRR

251 DIKRFTACKA AICPPMR*
```

The following partial DNA sequence was identified in *N. meningitidis* <SEQ ID 1267>:

```
m306.seq (partial)
   1 ..GGTTTGTTCT TCGGTTTGAT ACTGGCGACG GTCATTATTG CCGGTATTTT

  51   GTTTTATCTG AACCAGAGCG GTCAAAATGC GTTCAAAATC CCGGCTTCGT

 101   CGAAGCAGCC TGCAGAAACG GAAATCCTGA AACCGmAwAA CCAGCyTAAG

 151   GAAGACATCC AACCTGAwCC GGCCGATCAA AACGCCTTGT CCGAACCGGA

 201   TGCTGCGACA GAGGCAGAGC AGTCGGATGC GGAAAAwGCT GCCGACAAGC

 251   AGCCCGTTGC CGATAAAGCC GACGAGGTTG AAGAAAAGGC GGGCGAGCCG

 301   GAACGGGAAG AGCCGGACGG ACAGGCAGTG CGTAAGAAAG CGCTGACGGA

 351   AGAGCGTGAA CAAACCGTCA GGGAAAAAGC GCAGAAGAAA GATGCCGAAA

 401   CGGTTAAAAw ACAAGCGGTA AAACCGTCTA AAGAAACAGA GAAAAAAGCT

 451   TCAAAAGAAG AGAAAAAGGC GGCGAAGGAA AAAGTTGCAC CCAAACCAAC

 501   CCCGGAACAA ATCCTCAACA GCGGCAGCAT CGAAAAAGCG CGCAGTGCCG

 551   CCGCCAAAGA AGTGCAGAAA ATGAAAACGC CGACAAGGCG GAAGCAACGC

 601   ATTATCTGCA AATGGGCGCG TATGCCGACC GTCAGAGCGC GGAAGGGCAG

 651   CGTGCCAAAC TGGCAATCTT GGGCATATCT TCCAAGGTGG TCGGTTATCA

 701   GGCGGGACAT AAAACGCTTT ACCGGGTGCA AAGCGGCAAT ATGTCTGCCG

 751   ATGCGGTGA
```

This corresponds to the amino acid sequence <SEQ ID 1268; ORF 306>:

```
m306.pep (partial)
   1 ..GLFFGLILAT VIIAGILFYL NQSGQNAFKI PASSKQPAET EILKPXNQXK

  51   EDIQPXPADQ NALSEPDAAT EAEQSDAEXA ADKQPVADKA DEVEEKAGEP

 101   EREEPDGQAV RKKALTEERE QTVREKAQKK DAETVKXQAV KPSKETEKKA

 151   SKEEKKAAKE KVAPKPTPEQ ILNSGSIEKA RSAAAKEVQK MKTPTRRKQR

 201   IICKWARMPT VRARKGSVPN WQSWAYLPRW SVIRRDIKRF TGCKAAICLP

 251   MR*
```

Computer analysis of this amino acid sequence gave the following results:

Homology with a Predicted ORF from *N. gonorrhoeae*

ORF 306 shows 88.9% identity over a 253 aa overlap with a predicted ORF (ORF 306.ng) from *N. gonorrhoeae*:

```
m306/g306

                                  10        20        30        40
m306.pep                  GLFFGLILATVIIAGILFYLNQSGQNAFKIPASSKQPAETEILKPX
                          |:|||||||||||||||:||||:||||||||| ||||||||||
g306      MFMNKFSQSGKGLSGFFFGLILATVIIAGILLYLNQGGQNAFKIPAPSKQPAETEILKLK
                  10        20        30        40        50        60
```

-continued

```
               50        60        70        80        90       100
m306.pep  NQXKEDIQPXPADQNALSEPDAATEAEQSDAEXAADKQPVADKADEVEEKAGEPEREEPD
          || |||||| |||||||||||:| |||||||| |||||||||||||||||||||||||||
g306      NQPKEDIQPEPADQNALSEPDVAKEAEQSDAEKAADKQPVADKADEVEEKAGEPEREEPD
                  70        80        90       100       110       120

              110       120       130       140       150       160
m306.pep  GQAVRKKALTEEREQTVREKAQKKDAETVKXQAVKPSKETEKKASKEEKKAAKEKVAPKP
          |||||||||||||||||||||||||||||| :||||||||||||||||||||||||||||
g306      CQAVRKKALTEEREQTVREKAQKKDAETVKKKAVKPSKETEKKASKEEKKAAKEKVAPKP
                 130       140       150       160       170       180

              170       180       190        200       210       220
m306.pep  TPEQILNSGSIEKARSAAAKEVQKMKTPTRR-KQRIICKWARMPTVRARKGSVPNWQSWA
          |||||||| |||||||||||||||||:  :  :|||||||||||:  |||||||||||||
g306      TPEQILNSRSIEKARSAAAKEVQKMKNFGQGGSQRIICKWARMPNPGARKGSVPNWQSWA
                 190       200       210       220       230       240

              230        240       250
m306.pep  YLPRWSVIRRDIKRFTGCKAAICLPMRX
          |||:||:|||||||||:|||||| ||||
g306      YLPKWSAIRRDIKRFTACKAAICPPMRX
                 250       260
```

The following partial DNA sequence was identified in *N. meningitidis* <SEQ ID 1269>:

```
a306.seq
   1 ATGTTTATGA ACAAATTTTC CCAATCCGGA AAAGGTCTGT CCGGTTTTTT

  51 CTTCGGTTTG ATACTGGCGA CGGTCATTAT TGCCGGTATT TTGTTTTATC

 101 TGAACCAGAG CGGTCAAAAT GCGTTCAAAA TCCCGGTTCC GTCGAAGCAG

 151 CCTGCAGAAA CGGAAATCCT GAAACCGAAA AACCAGCCTA AGGAAGACAT

 201 CCAACCTGAA CCGGCCGATC AAAACGCCTT GTCCGAACCG GATGCTGCGA

 251 AAGAGGCAGA GCAGTCGGAT GCGGAAAAAG CTGCCGACAA GCAGCCCGTT

 301 GCCGACAAAG CCGACGAGGT TGAGGAAAAG GCGGACGAGC CGGAGCGGGA

 351 AAAGTCGGAC GGACAGGCAG TGCGCAAGAA AGCACTGACG GAAGAGCGTG

 401 AACAAACCGT CGGGGAAAAA GCGCAGAAGA AAGATGCCGA AACGGTTAAA

 451 AAACAAGCGG TAAAACCATC TAAAGAAACA GAGAAAAAAG CTTCAAAAGA

 501 AGAGAAAAAG GCGGAGAAGG AAAAAGTTGC ACCCAAACCG ACCCCGGAAC

 551 AAATCCTCAA CAGCGGCAGC ATCGAAAAAG CGCGCAGTGC CGCTGCCAAA

 601 GAAGTGCAGA AAATGAAAAC GCCGACAAGG CGGAAGCAAC GCATTATCTG

 651 CAAATGGGCG CGTATGCCGA CCGCCGGAGC GCGGAAGGGC AGCGTGCCAA

 701 ACTGGCAATC TTGGGCATAT CTTCCAAGGT GGTCGGTTAT CAGGCGGGAC

 751 ATAAAACGCT TTACCGGGTG CAAAGCGGCA ATATGTCTGC CGATGCGGTG

 801 A
```

This corresponds to the amino acid sequence <SEQ ID 1270; ORF 306.a>:

a306.pep

1 MFMNKFSQSG KGLSG<u>FFFGL ILATVIIAGI LF</u>YLNQSGQN AFKIPVPSKQ

```
  51 PAETEILKPK NQPKEDIQPE PADQNALSEP DAAKEAEQSD AEKAADKQPV

 101 ADKADEVEEK ADEPEREKSD GQAVRKKALT EEREQTVGEK AQKKDAETVK

 151 KQAVKPSKET EKKASKEEKK AEKEKVAPKP TPEQILNSGS IEKARSAAAK

 201 EVQKMKTPTR RKQRIICKWA RMPTAGARKG SVPNWQSWAY LPRWSVIRRD

 251 IKRFTGCKAA ICLPMR*
```

m306/a306 93.7% identity in 252 aa overlap

```
                                 10        20        30        40
m306.pep                  GLFFGLILATVIIAGILFYLNQSGQNAFKIPASSKQPAETEILKPX
                          |:|||||||||||||||||||||||||||||: ||||||||||||
a306        MFMNKFSQSGKGLSGFFFGLILATVIIAGILLYLNQSGQNAFKIPVPSKQPAETEILKPK
                    10        20        30        40        50        60

              50        60        70        80        90       100
m306.pep    NQXKEDIQPXPADQNALSEPDAATEAEQSDAEXAADKQPVADKADEVEEKAGEPEREEPD
            || |||||| ||||||||||||| |||||||| |||||||||||||||||| |||||: |
a306        NQPKEDIAPEPADQNALSEPDAAKEAEQSDAEKAADKQPVADKADEVEEKADEPEREKSD
                    70        80        90       100       110       120

             110       120       130       140       150       160
m306.pep    GQAVRKKALTEEREQTVREKAQKKDAETVKXQAVKPSKETEKKASKEEKKAAKEKVAPKP
            ||||||||||||||||| |||||||||||| ||||||||||||||||||| |||||||||
a306        CQAVRKKALTEEREQTVGEKAQKKDAETVKKQAVKPSKETEKKASKEEKKAEKEKVAPKP
                   130       140       150       160       170       180

             170       180       190       200       210       220
m306.pep    TPEQILNSGSIEKARSAAAKEVQKMKTPTRRKQRIICKWARMPTVRATKGSVPNWQSWAY
            ||||||||||||||||||||||||||||||||||||||||||||: ||||||||||||||
a306        TPEQILNSGSIEKARSAAAKEVQKMKTPTRRKQRIICKWARMPTAGARKGSVPNWQSWAY
                   190       200       210       220       230       240

             230       240       250
m306.pep    LPRWSVIRRDIKRFTGCKAAICLPMRX
            ||||||||||||||||||||||||||
a306        LPRWSVIRRDIKRFTGCKAAICLPMRX
                   250       260
```

The following partial DNA sequence was identified in *N. gonorrhoeae* <SEQ ID 1271>:

```
g307.seq
   1 atgaaaacct tcttcaaaac cctttcgacc gcgtcactcg cgctcatcct

  51 cgcagcctgc ggcggtcaaa aagacagcgc gcccgcagcc tctgccgccg

 101 ccccttctgc cgataacggc gcggcgaaaa aagaaatcgt cttcggcacg

 151 accgtgggcg acttcggcga tatggtcaaa gaacaaatcc aagccgagct

 201 ggagaaaaaa ggctacaccg tcaaattggt cgaatttacc gactatgtgc

 251 gcccgaatct ggcattggcg gagggcgagt tggacatcaa cgtcttccaa

 301 cacaaaccct atcttgacga tttcaaaaaa gaacacaacc tggacatcac

 351 cgaagccttc caagtgccga ccgcgccttt gggactgtat ccgggcaaac

 401 tgaaatcgct ggaagaagtc aaagacggca gcaccgtatc cgcgcccaac

 451 gacccgtcca acttcgcacg cgccttggtg atgctgaacg aactgggttg

 501 gatcaaactc aaagacggca tcaatccgct gaccgcatcc aaagccgaca

 551 tcgcggaaaa cctgaaaaac atcaaaatcg tcgagcttga agccgcacaa

 601 ctgccgcgca gccgcgccga cgtggatttt gccgtcgtca acggcaacta

 651 cgccataagc agcggcatga agctgaccga agccctgttc caagagccga

 701 gctttgccta tgtcaactgg tctgccgtca aaaccgccga caaagacagc

 751 caatggctta aagacgtaac cgaggcctat aactccgacg cgttcaaagc

 801 ctacgcgcac aaacgcttcg agggctacaa ataccctgcc gcatggaatg

 851 aaggcgcagc caaataa
```

This corresponds to the amino acid sequence <SEQ ID 1272; ORF 307.ng>:

```
g307.pep
  1  MKTFFKTLST ASLALILAAC GGQKDSAPAA SAAAPSADNG AAKKEIVFGT
```

-continued

```
 51 TVGDFGDMVK EQIQAELEKK GYTVKLVEFT DYVRPNLALA EGELDINVFQ

101 HKPYLDDFKK EHNLDITEAF QVPTAPLGLY PGKLKSLEEV KDGSTVSAPN

151 DPSNFARALV MLNELGWIKL KDGINPLTAS KADIAENLKN IKIVELEAAQ

201 LPRSRADVDF AVVNGNYAIS SGMKLTEALF QEPSFAYVNW SAVKTADKDS

251 QWLKDVTEAY NSDAFKAYAH KRFEGYKYPA AWNEGAAK*
```

The following partial DNA sequence was identified in *N. meningitidis* <SEQ ID 1273>:

```
m307.seq(partial)
  1 ..CAATGGCTTA AAGACGTAAC CGAGGCCTAT AACTCCGACG CGTTCAAAGC

 51   CTACGCGCAC AAACGCTTCG AGGGCTACAA ATCCCCTGCC GCATGGAATG

101   AAGGCGCAGC CAAATAA
```

This corresponds to the amino acid sequence <SEQ ID 1274; ORF 307>:

```
m307.pep (partial)
1 ..QWLKDVTEAY NSDAFKAYAH KRFEGYKSPA AWNEGAAK*
```

Computer analysis of this amino acid sequence gave the following results:

Homology with a Predicted ORF from *N. gonorrhoeae*

ORF 307 shows 97.4% identity over a 38 aa overlap with a predicted ORF (ORF 307.ng) from *N. gonorrhoeae*:

```
m307/g307

                                            10        20        30
m307.pep                                QWLKDVTEAYNSDAFKAYAHKRFEGYKSPA
                                        |||||||||||||||||||||||||||| ||
g307      SGMKLTEALFQEPSFAYVNWSAVKTADKDSQWLKDVTEAYNSDAFKAYAHKRFEGYKYPA
                  230       240       250       260       270       280

                  39
m307.pep  AWNEGAAKX
          |||||||||
g307      AWNEGAAKX
```

The following partial DNA sequence was identified in *N. meningitidis* <SEQ ID 1275>:

```
a307.seq
  1 ATGAAAACCT TCTTCAAAAC CCTTTCCGCC GCCGCACTCG CGCTCATCCT

 51 CGCCGCCTGC GGCGGTCAAA AAGATAGCGC GCCCGCCGCA TCCGCTTCTG

101 CCGCCGCCGA CAACGGCGCG GCGAAAAAAG NAATCGTCTT CGGCACGACC

151 GTCGGCGACT TCGGCGATAT GGTCAAAGAA CAAATCCAAC CCGAGCTGGA

201 GAAAAAAGGC TACACCGTCA AACTGGTCGA GTTTACCGAC TATGTGCGCC

251 CGAATCTGGC ATTGGCTGAG GGCGAGTNGG ACATCAACGT CTTCCAACAC

301 AAACCCTATC TTGACGACTT CAAAAAAGAA CACAATCTGG ACATCACCGA

351 AGTCTTCCAA GTGCCGACCG CGCCTTTGGG ACTGTACCCG GGCAAGCTGA

401 AATCGCTGGA AGAAGTCAAA GACGGCAGCA CCGTATCCGC GCCCAACGAC

451 CCGTCCAACT TCGCCCGCGT CTTGGTGATG CTCGACGAAC TGGGTTGGAT

501 CAAACTCAAA GANGGCATCA ATCCGCTGAC CGCATCCAAA GCGGACATTG
```

-continued

```
551 CCGAAAACCT GAAAAACATC AAAATCGTCG AGCTTGAAGC CGCGCAACTG

601 CCGCGTAGCC GCGCCGACGT GGATTTTGNC GTCGTCAACG GCAANTACGC

651 CATAAGCAGC GGCATGAAGC TGACCGAAGC CCTGTTCCAA GAACCGAGCT

701 TTGCCTATGT CAACTGGTCT GCCGTCAAAA CCGCCGACAA AGACAGCCAA

751 TGGCTTAAAG ACGTAACCGA GGCCTATAAC TCCGACGCGT TCAAAGCCTA

801 CGCGCACAAA CGCTTCGAGG GCTACAAATC CCCTGCCGCA TGGAATGAAG

851 GCGCAGCCAA ATAA
```

This corresponds to the amino acid sequence <SEQ ID 1276; ORF 307.a>:

```
a307.pep
  1 MKTFFKTLSA AALALILAAC GGQKDSAPAA SASAAADNGA AKKXIVFGTT

 51 VGDFGDMVKE QIQPELEKKG YTVKLVEFTD YVRPNLALAE GEXDINVFQH

101 KPYLDDFKKE HNLDITEVFQ VPTAPLGLYP GKLKSLEEVK DGSTVSAPND

151 PSNFARVLVM LDELGWIKLK XGINPLTASK ADIAENLKNI KIVELEAAQL

201 PRSRADVDFX VVNGXYAISS GMKLTEALFQ EPSFAYVNWS AVKTADKDSQ

251 WLKDVTEAYN SDAFKAYAHK RFEGYKSPAA WNEGAAK*
```

m307/a307 100.0% identity in 38 aa overlap

```
                                                 10        20        30
m307.pep                                     QWLKDVTEAYNSDAFKAYAHKRFEGYKSPA
                                             ||||||||||||||||||||||||||||||
a307         SGMKLTEALFQEPSFAYVNWSAVKTADKDSQWLKDVTEAYNSDAFKAYAHKRFEGYKSPA
           220       230       240       250       260       270

                     39
m307.pep     AWNEGAAKX
             |||||||||
a307         AWNEGAAKX
           280
```

The following partial DNA sequence was identified in *N. gonorrhoeae* <SEQ ID 1277>:

```
g308.seq
  1 ATGTTAAATC GGGTATTTTA TCGGATATTG GGTGTTGCCG ACAATTTGTA

 51 TCCGTGTTTA TCGGATTTCT GTTTTTTCAC TATAATAGCC GGTTTGCCGT

101 TGCAGGCGGT TTTATGGGAA AGGCGGATGA TGGTACGGCG TTTGATAATC

151 GGCATCAGCG GGGCGAGCGG TTTCCAATAC GGCGTGAAGG CTTTGGAACT

201 TTTGCGCGCG CAAGATGTCG AAACGCACCT TGTGGTATCG AAAGGCGCGG

251 AGATGGCGCG CGCTTCGGAA ACGGATTATA CGAAAGACGA AGTATATGCC

301 TTGGCTGATT TCGTCCATCC GATCGGCAAT ATCGGGGCGT GCATTGCCAG

351 CGGTACGTTT AAAACGGACG GGATGCTGGT CGCACCCTGT TCGATGCGGA

401 CGCTTGCCTC TGTCGCGCAC GGCTTCGGCG ACAACCTCTT GACGCGTGCG

451 GCGGATGTGG TTTTGAAGGA AAGGCGGCGG CTGGTGCTGA TGGTGCGCGA

501 AACGCCGCTG AACCTTGCCC ATTTGGACAA TATGAAGCGG GTAACGGAAA

551 TGGGCGGCGT GGTGTTTCCC CCTGTTCCTG CGATGTACCG CAAGCCGCAG
```

-continued

```
601 ACGGCGGACG ACATAGTGGC GCACAGTATC GCACACACGC TGTCGCTGTT

651 CGGAATCGAT ACGCCGGATT TGGCGGAATG GCAGGGAATG GCGGATTAA
```

This corresponds to the amino acid sequence <SEQ ID 1278; ORF 308.ng>:

```
g308.pep
  1 MLNRVFYRIL GVADNLYPCL SDFCFFTIIA GLPLQAVLWE RRMMVRRLII

 51 GISGASGFQY GVKALELLRA QDVETHLVVS KGAEMARASE TDYTKDEVYA

101 LADFVHPIGN IGACIASGTF KTDGMLVAPC SMRTLASVAH GFGDNLLTRA

151 ADVVLKERRR LVLMVRETPL NLAHLDNMKR VTEMGGVVFP PVPAMYRKPQ

201 TADDIVAHSI AHTLSLFGID TPDLAEWQGM AD*
```

The following partial DNA sequence was identified in *N. meningitidis* <SEQ ID 1279>:

```
m308.seq (partial)
  1 ATGTTAAATC GGGTATTTTA TCGGATATTG GGTGTTGCCG ACAATTTGTA

 51 TCCGCGTTTA TCGGATTTCT GTTTTTTCAC TATAATAGCC GGTTTGCCGT

101 TGCAGGCGGT TTTATGGGAA AGGCGGATGA TGGTACGGCG TTTGATAATC

151 GGCATCAGCG GGGCGAGCGG TTTCCAATAC GGCGTGAAGG CTTTGGAACT

201 TTTGCGCGCG CAAGATGTCG AAACGCACCT TGTGGTATCG AAAGGTGCGG

251 AGATGGCGCG CGCTTCGGAA ACGGCTTATG CGAGAGACGA GGTATATGCC

301 TTGGCGGACT TCGTGCATCC GATCGGCAAT ATCGGGGCGT GCATTGCCAG

351 CGGTACGTTT AAAACGGATG GGATGCTGGT CGCCCCCTGT TCGATGCGGA

401 CGCTTGCCTC TGTCGCGCAC GGCTTCGGCG ACAATCTGcT GACGCgTGCG

451 GCGGATGTGG TTTTGAAGGA AAGGCGGCGG CTGGTGCTGA TGGTGCGCGA

501 AACGCCGCTG AACCTTGCCC ATTTGGACAA TATGAAGCGG GwAACGGAAA

551 TGGGCGGCGT GGTGTTTCCC CCTGTTCCTG CGATGTACCG CAAACCGCAG

601 ACGGCGGACG ACATAGTGGC GCACAGTGTT GCACACGCtT TGTCGCTGTT

651 CGGAATCGAT ACGCCGGATT CGGCGGAATG GCArGGAATG gcG . . .
```

This corresponds to the amino acid sequence <SEQ ID 1280; ORF 308>:

```
m308.pep (partial)
  1 MLNRVFYRIL GVADNLYPRL SDFCFFTIIA GLPLQAVLWE RRMMVRRLII

 51 GISGASGFQY GVKALELLRA QDVETHLVVS KGAEMARASE TAYARDEVYA

101 LADFVHPIGN IGACIASGTF KTDGMLVAPC SMRTLASVAH GFGDNLLTRA

151 ADVVLKERRR LVLMVRETPL NLAHLDNMKR XTEMGGVVFP PVPAMYRKPQ

201 TADDIVAHSV AHALSLFGID TPDSAEWQGM A..
```

Computer analysis of this amino acid sequence gave the following results:

Homology with a Predicted ORF from *N. gonorrhoeae*

ORF 308 shows 96.5% identity over a 231 aa overlap with a predicted ORF (ORF 308.ng) from *N. gonorrhoeae*:

```
m308/g308

                    10        20        30        40        50        60
m308.pep    MLNRVFYRILGVADNLYPRLSDFCFFTIIAGLPLQAVLWERRMMVRRLIIGISGASGFQY
            ||||||||||||||||||||||||||||||||||||||||||||||||||||||||||||
g308        MLNRVFYRILGVADNLYPRLSDFCFFTIIAGLPLQAVLWERRMMVRRLIIGISGASGFQY
                    10        20        30        40        50        60

                    70        80        90       100       110       120
m308.pep    GVKALELLRAQDVETHLVVSKGAEMARASETAYARDEVYALADFVHPIGNIGACIASGTF
            ||||||||||||||||||||||||||||||||||::||||||||||||||||||||||||
g308        GVKALELLRAQDVETHLVVSKGAEMARASETAYTKDEVYALADFVHPIGNIGACIASGTF
                    70        80        90       100       110       120

                   130       140       150       160       170       180
m308.pep    KTDGMLVAPCSMRTLASVAHGFGDNLLTRAADVVLKERRRLVLMVRETPLNLAHLDNMKR
            ||||||||||||||||||||||||||||||||||||||||||||||||||||||||||||
g308        KTDGMLVAPCSMRTLASVAHGFGDNLLTRAADVVLKERRRLVLMVRETPLNLAHLDNMKR
                   130       140       150       160       170       180

                   190       200       210       220       230
m308.pep    XTEMGGVVFPPVPAMYRKPQTADDIVAHSVAHALSLFGIDTPDSAEWQGMA
            ||||||||||||||||||||||||||||:||:|||||||||||||||||||
g308        XTEMGGVVFPPVPAMYRKPQTADDIVAHSIAHTLSLFGIDTPDSAEWQGMADX
                   190       200       210       220       230
```

The following partial DNA sequence was identified in *N. meningitidis* <SEQ ID 1281>:

```
a308.seq
  1 ATGTTAAATC GGATATTTTA TCGGATATTG GGTGTTGCCG ACAATTTGTA
 51 TCCGTATTTA TCGGATTTCT GTTTTTTCAC TATAATAGCC GGTTTGCCGT
101 TGCAGGCGGT TTTATGGGAA AGGCGGATGA TGGTACGGCG TTTGATAATC
151 GGCATCAGTG GGGCGAGCGG TTTCCAATAC GGCGTGAAGG CTTTGGANCT
201 TTTACGCGCG CAAGATATCG AAACGCACCT TGTGGTATCG AAAGGTGCGG
251 AGATGGCGCG CGCTTCGGAA ACGGNTTATG CGAGAGACGA NGTATATGCC
301 TTGGCGGACT TNGTGCATCC GATCGGCAAT ATCGGGGCGT GCATTGCCAG
351 CGGTACGTTT AAAACGGACG GGATGCTGGT CGCCCCCTGT TCGATGCGGA
401 CGCTTGCCTC GGTCGTGCAC GGCTTCGGCG ACAACCTCTT GACGCGTGCG
451 GCGGATGTGG TTTTGAAGGA AAGGCGGCGG CTGGTGCTGA TGGTGCGCGA
501 AACGCCGCTG AACCTTGCCC ATTTGGACAA TATGAANCGG GTAACGGAAA
551 TGGGCGGCGT GGTGTTTCCC CCTGTTCCTG CGATGTACCG CAAACCGCAG
601 ACGGCGGACG ACATAGTGGC GCACAGTGTT GCACACGCTT TGTCGCTGTT
651 CGGAATCGAT ACGCCGGATT CGGCGGAATG GCAGGGAATG GCGGATTAA
```

This corresponds to the amino acid sequence <SEQ ID 1282; ORF 308.a>:

```
a308.pep
  1 MLNRIFYRIL GVADNLYPYL SDFCFFTIIA GLPLQAVLWE RRMMVRRLII
 51 GISGASGFQY GVKALXLLRA QDIETHLVVS KGAEMARASE TXYARDXVYA
101 LADXVHPIGN IGACIASGTF KTDGMLVAPC SMRTLASVVH GFGDNLLTRA
151 ADVVLKERRR LVLMVRETPL NLAHLDNMXR VTEMGGVVFP PVPAMYRKPQ
201 TADDIVAHSV AHALSLFGID TPDSAEWQGM AD*
```

m308/a308 95.7% identity in 231 aa overlap

```
                 10        20        30        40        50        60
m308.pep MLNRVFYRILGVADNLYPRLSDFCFFTIIAGLPLQAVLWERRMMVRRLIIGISGASGFQY
         ||||:||||||||||||| |||||||||||||||||||||||||||||||||||||||||
a308     MLNRIFYRILGVADNLYPYLSDFCFFTIIAGLPLQAVLWERRMMVRRLIIGISGASGFQY
                 10        20        30        40        50        60
                 70        80        90       100       110       120
m308.pep GVKALELLRAQDVETHLVVSKGAEMARASETAYARDEVYALADFVHPIGNIGACIASGTF
         ||||| ||||||:|||||||||||||||||| |||| |||||| ||||||||||||||||
a308     GVKALXLLRAQDIETHLVVSKGAEMARASETXYARDXVYALADXVHPIGNIGACIASGTF
                 70        80        90       100       110       120
                130       140       150       160       170       180
m308.pep KTDGMLVAPCSMRTLASVAHGFGDNLLTRAADVVLKERRRLVLMVRETPLNLAHLDNMKR
         ||||||||||||||||||:||||||||||||||||||||||||||||||||||||||| |
a308     KTDGMLVAPCSMRTLASVVHGFGDNLLTRAADVVLKERRRLVLMVRETPLNLAHLDNMXR
                130       140       150       160       170       180
                190       200       210       220       230
m308.pep XTEMGGVVFPPVPAMYRKPQTADDIVAHSVAHALSLFGIDTPDSAEWQGMA
         |||||||||||||||||||||||||||||||||||||||||||||||||||
a308     VTEMGGVVFPPVPAMYRKPQTADDIVAHSVAHALSLFGIDTPDSAEWQGMADX
                190       200       210       220       230
```

The following partial DNA sequence was identified in *N. gonorrhoeae* <SEQ ID 1283>:

```
g308-1.seq
  1 ATGTTAAATC GGGTATTTTA TCGGATATTG GGTGTTGCCG ACAATTTGTA

 51 TCCGTGTTTA TCGGATTTCT GTTTTTTCAC TATAATAGCC GGTTTGCCGT

101 TGCAGGCGGT TTTATGGGAA AGGCGGATGA TGGTACGGCG TTTGATAATC

151 GGCATCAGCG GGGCGAGCGG TTTCCAATAC GGCGTGAAGG CTTTGGAACT

201 TTTGCGCGCG CAAGATGTCG AAACGCACCT TGTGGTATCG AAAGGCGCGG

251 AGATGGCGCG CGCTTCGGAA ACGGATTATA CGAAAGACGA AGTATATGCC

301 TTGGCTGATT TCGTCCATCC GATCGGCAAT ATCGGGGCGT GCATTGCCAG

351 CGGTACGTTT AAAACGGACG GGATGCTGGT CGCACCCTGT TCGATGCGGA

401 CGCTTGCCTC TGTCGCGCAC GGCTTCGGCG ACAACCTCTT GACGCGTGCG

451 GCGGATGTGG TTTTGAAGGA AAGGCGGCGG CTGGTGCTGA TGGTGCGCGA

501 AACGCCGCTG AACCTTGCCC ATTTGGACAA TATGAAGCGG GTAACGGAAA

551 TGGGCGGCGT GGTGTTTCCC CCTGTTCCTG CGATGTACCG CAAGCCGCAG

601 ACGGCGGACG ACATAGTGGC GCACAGTATC GCACACACGC TGTCGCTGTT

651 CGGAATCGAT ACGCCGGATT TGGCGGAATG GCAGGGAATG GCGGATTAA
```

This corresponds to the amino acid sequence <SEQ ID 1284; ORF 308-1.ng>:

```
g308-1.pep
  1 MLNRVFYRIL GVADNLYPCL SDFCFFTIIA GLPLQAVLWE RRMMVRRLII

 51 GISGASGFQY GVKALELLRA QDVETHLVVS KGAEMARASE TDYTKDEVYA

101 LADFVHPIGN IGACIASGTF KTDGMLVAPC SMRTLASVAH GFGDNLLTRA

151 ADVVLKERRR LVLMVRETPL NLAHLDNMKR VTEMGGVVFP PVPAMYRKPQ

201 TADDIVAHSI AHTLSLFGID TPDLAEWQGM AD*
```

The following partial DNA sequence was identified in *N. meningitidis* <SEQ ID 1285>:

```
m308-1.seq
  1 ATGTTAAATC GGGTATTTTA TCGGATATTG GGTGTTGCCG ACAATTTGTA

 51 TCCGCGTTTA TCGGATTTCT GTTTTTTCAC TATAATAGCC GGTTTGCCGT

101 TGCAGGCGGT TTTATGGGAA AGGCGGATGA TGGTACGGCG TTTGATAATC

151 GGCATCAGCG GGGCGAGCGG TTTCCAATAC GGCGTGAAGG CTTTGGAACT

201 TTTGCGCGCG CAAGATGTCG AAACGCACCT TGTGGTATCG AAAGGTGCGG

251 AGATGGCGCG CGCTTCGGAA ACGGCTTATG CGAGAGACGA GGTATATGCC

301 TTGGCGGACT TCGTGCATCC GATCGGCAAT ATCGGGGCGT GCATTGCCAG

351 CGGTACGTTT AAAACGGATG GGATGCTGGT CGCCCCCTGT TCGATGCGGA

401 CGCTTGCCTC TGTCGCGCAC GGCTTCGGCG ACAATCTGCT GACGCGTGCG

451 GCGGATGTGG TTTTGAAGGA AAGGCGGCGG CTGGTGCTGA TGGTGCGCGA

501 AACGCCGCTG AACCTTGCCC ATTTGGACAA TATGAAGCGG GTAACGGAAA

551 TGGGCGGCGT GGTGTTTCCC CCTGTTCCTG CGATGTACCG CAAACCGCAG

601 ACGGCGGACG ACATAGTGGC GCACAGTGTT GCACACGCTT TGTCGCTGTT

651 CGGAATCGAT ACGCCGGATT CGGCGGAATG GCAGGGAATG GCGGATTAA
```

This corresponds to the amino acid sequence <SEQ ID 1286; ORF 308-1>:

```
m308-1.pep

      1 MLNRVFYRIL GVADNLYPRL SDFCFFTIIA GLPLQAVLWE RRMMVRRLII

     51 GISGASGFQY GVKALELLRA QDVETHLVVS KGAEMARASE TAYARDEVYA

    101 LADFVHPIGN IGACIASGTF KTDGMLVAPC SMRTLASVAH GFGDNLLTRA

    151 ADVVLKERRR LVLMVRETPL NLAHLDNMKR VTEMGGVVFP PVPAMYRKPQ

    201 TADDIVAHSV AHALSLFGID TPDSAEWQGM AD*

m308-1/g308-1 97.0% identity in 232 aa overlap

                    10        20        30        40        50        60
m308-1.pep  MLNRVFYRILGVADNLYPRLSDFCFFTIIAGLPLQAVLWERRMMVRRLIIGISGASGFQY
            ||||||||||||||||| ||||||||||||||||||||||||||||||||||||||||||
g308-1      MLNRVFYRILGVADNLYPCLSDFCFFTIIAGLPLQAVLWERRMMVRRLIIGISGASGFQY
                    10        20        30        40        50        60

                    70        80        90       100       110       120
m308-1.pep  GVKALELLRAQDVETHLVVSKGAEMARASETAYARDEVYALADFVHPIGNIGACIASGTF
            ||||| ||||||||||||||||||||||||| |::|||||||||||||||||||||||||
g308-1      GVKALXLLRAQDVETHLVVSKGAEMARASETDYKRDEVYALADFVHPIGNIGACIASGTF
                    70        80        90       100       110       120

                   130       140       150       160       170       180
m308-1.pep  KTDGMLVAPCSMRTLASVAHGFGDNLLTRAADVVLKERRRLVLMVRETPLNLAHLDNMKR
            ||||||||||||||||||||||||||||||||||||||||||||||||||||||||||||
g308-1      KTDGMLVAPCSMRTLASVAHGFGDNLLTRAADVVLKERRRLVLMVRETPLNLAHLDNMKR
                   130       140       150       160       170       180

                   190       200       210       220       230
m308.pep    VTEMGGVVFPPVPAMYRKPQTADDIVAHSVAHALSLFGIDTPDSAEWQGMADX
            |||||||||||||||||||||||||||||:||:|||||||||| |||||||||
g308        VTEMGGVVFPPVPAMYRKPQTADDIVAHSIAHTLSLFGIDTPDLAEWQGMADX
                   190       200       210       220       230
```

The following partial DNA sequence was identified in *N. meningitidis* <SEQ ID 1287>:

```
a308-1.seq
  1 ATGTTAAATC GGATATTTTA TCGGATATTG GGTGTTGCCG ACAATTTGTA
```

-continued

```
 51 TCCGTATTTA TCGGATTTCT GTTTTTTCAC TATAATAGCC GGTTTGCCGT

101 TGCAGGCGGT TTTATGGGAA AGGCGGATGA TGGTACGGCG TTTGATAATC

151 GGCATCAGTG GGGCGAGCGG TTTCCAATAC GGCGTGAAGG CTTTGGANCT

201 TTTACGCGCG CAAGATATCG AAACGCACCT TGTGGTATCG AAAGGTGCGG

251 AGATGGCGCG CGCTTCGGAA ACGGNTTATG CGAGAGACGA NGTATATGCC

301 TTGGCGGACT TNGTGCATCC GATCGGCAAT ATCGGGGCGT GCATTGCCAG

351 CGGTACGTTT AAAACGGACG GGATGCTGGT CGCCCCCTGT TCGATGCGGA

401 CGCTTGCCTC GGTCGTGCAC GGCTTCGGCG ACAACCTCTT GACGCGTGCG

451 GCGGATGTGG TTTTGAAGGA AAGGCGGCGG CTGGTGCTGA TGGTGCGCGA

501 AACGCCGCTG AACCTTGCCC ATTTGGACAA TATGAANCGG GTAACGGAAA

551 TGGGCGGCGT GGTGTTTCCC CCTGTTCCTG CGATGTACCG CAAACCGCAG

601 ACGGCGGACG ACATAGTGGC GCACAGTGTT GCACACGCTT TGTCGCTGTT

651 CGGAATCGAT ACGCCGGATT CGGCGGAATG GCAGGGAATG GCGGATTAA
```

This corresponds to the amino acid sequence <SEQ ID 1288; ORF 308-1.a>:

```
a308-1.pep

  1 MLNRVFYRIL GVADNLYPRL SDFCFFTIIA GLPLQAVLWE RRMMVRRLII

 51 GISGASGFQY GVKALELLRA QDVETHLVVS KGAEMARASE TAYARDEVYA

101 LADFVHPIGN IGACIASGTF KTDGMLVAPC SMRTLASVAH GFGDNLLTRA

151 ADVVLKERRR LVLMVRETPL NLAHLDNMKR VTEMGGVVFP PVPAMYRKPQ

201 TADDIVAHSV AHALSLFGID TPDSAEWQGM AD*

a308-1/m308-1 96.1% identity in 232 aa overlap

               10        20        30        40        50        60
a308-1 MLNRIFYRILGVADNLYPYLSDFCFFTIIAGLPLQAVLWERRMMVRRLIIGISGASGFQY
       ||||:||||||||||||| |||||||||||||||||||||||||||||||||||||||||
m308-1 MLNRVFYRILGVADNLYPRLSDFCFFTIIAGLPLQAVLWERRMMVRRLIIGISGASGFQY
               10        20        30        40        50        60

               70        80        90       100       110       120
a308-1 GVKALXLLRAQDIETHLVVSKGAEMARASETXYARDXVYALADXVHPIGNIGACIASGTF
       ||||| ||||||:|||||||||||||||||| |||| |||||| ||||||||||||||||
m308-1 GVKALELLRAQDVETHLVVSKGAEMARASETAYARDEVYALADFVHPIGNIGACIASGTF
               70        80        90       100       110       120

              130       140       150       160       170       180
a308-1 KTDGMLVAPCSMRTLASVVHGFGDNLLTRAADVVLKERRRLVLMVRETPLNLAHLDNMXR
       ||||||||||||||||||:||||||||||||||||||||||||||||||||||||||| |
m308-1 KTDGMLVAPCSMRTLASVAHGFGDNLLTRAADVVLKERRRLVLMVRETPLNLAHLDNMKR
              130       140       150       160       170       180

              190       200       210       220       230
a308-1 VTEMGGVVFPPVPAMYRKPQTADDIVAHSVAHALSLFGIDTPDSAEWQGMADX
       ||||||||||||||||||||||||||||||||||||||||||||||||||||
m308-1 VTEMGGVVFPPVPAMYRKPQTADDIVAHSVAHALSLFGIDTPDSAEWQGMADX
              190       200       210       220       230
```

The following partial DNA sequence was identified in *N. gonorrhoeae* <SEQ ID 1289>:

```
g311.seq
  1 atgttcagtt tcggctgggc gtttgaccgc ccgcagtatg agttgggttc

 51 gctgtcgcct gttgcggcac ttgcgtgccg gcgcgctttg gggtgtttgg

101 gtttggaaac gcaaatcaag tggccaaacg atttggtcgt cggacgcgac

151 aaattgggcg gcattctgat tgaaacagtc agggcgggcg gtaaaacggt
```

-continued

```
 201 tgccgtggtc ggtatcggca tcaatttcgt gctgcccaag gaagtggaaa
 251 acgccgcttc cgtgcagtcg ctgtttcaga cggcatcgcg gcggggcaat
 301 gccgatgccg ccgtattgct ggaaacattg cttgcggaac tgggcgcggt
 351 gttggaacaa tatgcggaag aagggttcgc gccatttttta aatgagtatg
 401 aaacggccaa ccgcgaccac ggcaaggcgg tattgctgtt gcgcgacggc
 451 gaaaccgtgt gcgaaggcac ggttaaaggc gtggacggac gaggcgttct
 501 gcacttggaa acggcagaag gcgaacagac ggtcgtcagc ggcgaaatca
 551 gcctgcggcc cgacaacagg tcggtttccg tgccgaagcg gccggattcg
 601 gaacgttttt tgctgttgga aggcgggaac agccggctca agtgggcgtg
 651 ggtggaaaac ggcacgttcg caaccgtggg cagcgcgccg taccgcgatt
 701 tgtcgccttt gggcgcggag tgggcggaaa aggcggatgg aaatgtccgc
 751 atcgtcggtt gcgccgtgtg cggagaatcc aaaaaggcac aagtgaagga
 801 acagctcgcc cgaaaaatcg agtggctgcc gtcttccgca caggctttgg
 851 gcatacgcaa ccactaccgc caccccgaag aacacggttc cgaccgttgg
 901 ttcaacgcct tgggcagccg ccgcttcagc cgcaacgcct gcgtcgtcgt
 951 cagttgcggc acggcggtaa cggttgacgc gctcaccgat gacggacatt
1001 atctcggcgg aaccatcatg cccggcttcc acctgatgaa agaatcgctc
1051 gccgtccgaa ccgccaacct caaccgcccc gccggcaaac gttacccttt
1101 cccgaccaca acgggcaacg ccgtcgcaag cggcatgatg gacgcggttt
1151 gcggctcgat aatgatgatg cacggccgtt tgaaagaaaa aaacggcgcg
1201 ggcaagcctg tcgatgtcat cattaccggc ggcggcgcgg cgaaagtcgc
1251 cgaagccctg ccgcctgcat ttttggcgga aaataccgtg cgcgtggcgg
1301 acaacctcgt catccacggg ctgctgaacc tgattgccgc cgaaggcggg
1351 gaatcggaac acgcttaa
```

This corresponds to the amino acid sequence <SEQ ID 1290; ORF 311.ng>:

```
g311.pep
   1 MFSFGWAFDR PQYELGSLSP VAALACRRAL GCLGLETQIK WPNDLVVGRD
  51 KLGGILIETV RAGGKTVAVV GIGINFVLPK EVENAASVQS LFQTASRRGN
 101 ADAAVLLETL LAELGAVLEQ YAEEGFAPFL NEYETANRDH GKAVLLLRDG
 151 ETVCEGTVKG VDGRGVLHLE TAEGEQTVVS GEISLRPDNR SVSVPKRPDS
 201 ERFLLLEGGN SRLKWAWVEN GTFATVGSAP YRDLSPLGAE WAEKADGNVR
 251 IVGCAVCGES KKAQVKEQLA RKIEWLPSSA QALGIRNHYR HPEEHGSDRW
 301 FNALGSRRFS RNACVVVSCG TAVTVDALTD DGHYLGGTIM PGFHLMKESL
 351 AVRTANLNRP AGKRYPFPTT TGNAVASGMM DAVCGSIMMM HGRLKEKNGA
 401 GKPVDVIITG GGAAKVAEAL PPAFLAENTV RVADNLVIHG LLNLIAAEGG
 451 ESEHA*
```

The following partial DNA sequence was identified in *N. meningitidis* <SEQ ID 1291>:

```
m311.seq (partial)
     1  ATGTTCAGTT TTGGCTGGGT GTTTGACCGG CCGCAGTATG AGTTGGGTTC
    51  GCTGTCGCCT GTTGCGGCAG TGGCGTGTCG GCGCGCCTTG TCGCGTTTAG
   101  GTTTGGATGT GCArATTAAG TGGCCCAATG ATTTGGTTGT CGGACGCGAC
   151  AAATTGGGCG GCATTCTGAT TGAAACGGTC AGGACGGGCG GCAAAACGGT
   201  TGCCGTGGTC GGTATCGGCA TCAATTTTGT CCTGCCCAAn GAAGTAGAAA
   251  ATGCCGCTTC CGTGCAATCG CTGTTTCAGA CGGCATCGCG GCGGGGCAAT
   301  GCCGATGCCG CCGTGCTGCT nnnnnnnnnn nnnnnnnnnn nnnnGGAAAT
   351  CAGCCTGCGG TCCGACnACA GGCCGGTTTC CGTGnCGAAG CGGCGGGATT
   401  CGGAACGTTT TCTGCTGTTG GACGGCGGCA ACAGCCGGCT CAAGTGGgCG
   451  TGGGTGGAAA ACGGCACGTT CGCAACCGTC GGTAGCGCGC CGTACCgCGA
   501  TTTGTCGCCT TTGGGCGCGG AGTGGGCGGA AAAGGCGGAT GGAAATGTCC
   551  GCATCGTCGG TTGCGCTGTG TGCGGAGAAT TCAAAAAGGC ACAAGTGCAG
   601  GAACAGCTCG CCCGAAAAAT CGAGTGGCTG CCGTCTTCCG CACAGGCTTT
   651  GTTTGGCATA CGCAACCACT ACCGCCACCC CGAAGAACAC GGTTCCGACC
   701  GCTGGTTCAA CGCCTTGGGC AGCCGCCGCT TCAGCCGCAA CGCyTGCGTC
   751  GTCGTCAGTT GCGGCACGGC GGTAACGGTT GACGCGCTCA CCGATGACGG
   801  ACATTATCTC GGrgGAACCA TCATGCCCGG TTTCCACCTG ATGAAAGAAT
   851  CGCTCGCCGT CCGAACCGCC AACCTCAACC GGCACGCCGG TAAGCGTTAT
   901  CCTTTCCCGA CCACAACGGG CAATGCCGTC GCCAGCGGCA TGATGGATGC
   951  GGTTTGCGGC TCGGTTATGA TGATGCACGG GCGTTTGAAA GAAAAAACCG
  1001  GGGCGGGCAA GCCTGTCGAT GTCATCATTA CCGGCGGCGG CGCGGCAAAA
  1051  GTTGCCGAAG CCCTGCCGCC TGCATTTTTG GCGGAAAATA CCGTGCGCGT
  1101  GGCGGACAAC CTCGTCATTT ACGGGTTGTT GAACATGATT GCCGCCGAAG
  1151  GCAGGGAATA TGAACAT....
```

This corresponds to the amino acid sequence <SEQ ID 1292; ORF 311>:

```
m311.pep (partial)
    1 MFSFGWVFDR PQYELGSLSP VAAVACRRAL SRLGLDVQIK WPNDLVVGRD
   51 KLGGILIETV RTGGKTVAVV GIGINFVLPX EVENAASVQS LFQTASRRGN
  101 ADAAVLLXXX XXXXXEISLR SDXRPVSVXK RRDSERFLLL DGGNSRLKWA
  151 WVENGTFATV GSAPYRDLSP LGAEWAEKAD GNVRIVGCAV CGEFKKAQVQ
  201 EQLARKIEWL PSSAQALFGI RNHYRHPEEH GSDRWFNALG SRRFSRNACV
  251 VVSCGTAVTV DALTDDGHYL GGTIMPGFHL MKESLAVRTA NLNRHAGKRY
  301 PFPTTTGNAV ASGMMDAVCG SVMMMHGRLK EKTGAGKPVD VIITGGGAAK
  351 VAEALPPAFL AENTVRVADN LVIYGLLNMI AAEGREYEH....
```

Computer analysis of this amino acid sequence gave the following results:

Homology with a Predicted ORF from *N. gonorrhoeae*

ORF 311 shows 78.5% identity over a 455 aa overlap with a predicted ORF (ORF 311.ng) from *N. gonorrhoeae*:

```
m311/g311

                      10        20        30        40        50        60
m311.pep      MFSFGWVFDRPQYELGSLSPVAAVACRRALSRLGLDVQIKWPNDLVVGRDKLGGILIETV
              ||||||:||||||||||||||||:||||||: |||::|||||||||||||||||||||||
g311          MFSFGWAFDRPQYELGSLSPVAALACRRALGCLGLETQIKWPNDLVVGRDKLGGILIETV
                      10        20        30        40        50        60

                      70        80        90       100       110
m311.pep      RTGGKTVAVVGIGINFVLPXEVENAASVQSLFQTASRRGNADAAVLLXXX----------
              |:||||||||||||||||| ||||||||||||||||||||||||||| :
g311          RAGGKTVAVVGIGINFVLPKEVENAASVQSLFQTASRRGNADAAVLLETLLAELGAVLEQ
                      70        80        90       100       110       120

m311.pep      --------------------------------------------------------XXXX
                                                                      :
g311          YAEEGFAPFLNEYETANRDHGKAVLLLRDGETVCEGTVKGVDGRGVLHLETAEGEQTVVS
                     130       140       150       160       170       180

                120       130       140       150       160       170
m311.pep      XEISLRSDXRPVSVXKRRDSERFLLLDGGNSRLKWAWVENGTFATVGSAPYRDLSPLGAE
               ||||| | | ||| || ||||||||:|||||||||||||||||||||||||||||||||
g311          GEISLRPDNRSVSVPKRPDSERFLLLEGGNSRLKWAWVEMGTFATVGSAPYRDLSPLGAE
                     190       200       210       220       230       240

                180       190       200       210       220       230
m311.pep      WAEKADGNVRIVGCAVCGEFKKAQVQEQLARKIEWLPSSAQALFGIRNHYRHPEEHGSDR
              ||||||||||||||||||| |||||:||||||||||||||||| ||||||||||||||||
g311          WAEKADGNVRIVGCAVCGESKKAQVKEQLARKIEWLPSSAQAL-GIRNHYRHPEEHGSDR
                     250       260       270       280       290

                240       250       260       270       280       290
m311.pep      WFNALGSRRFSRNACVVVSCGTAVTVDALTDDGHYLGGTIMPGFHLMKESLAVRTANLNR
              ||||||||||||||||||||||||||||||||||||||||||||||||||||||||||||
g311          WFNALGSRRFSRNACVVVSCGTAVTVDALTDDGHYLGGTIMPGFHLMKESLAVRTANLNR
            300       310       320       330       340       350

                300       310       320       330       340       350
m311.pep      HAGKRYPFPTTTGNAVASGMMDAVCGSVMMMHGRLKEKTGAGKPVDVIITGGGAAKVAEA
               ||||||||||||||||||||||||||:||||||||||:|||||||||||||||||||||
g311          PAGKRYPFPTTTGNAVASGMMDAVCGSIMMMHGRLKEKNGAGKPVDVIITGGGAAKVAEA
            360       370       380       390       400       410

                360       370       380      389
m311.pep      LPPAFLAENTVRVADNLVIYGLLNMIAAEGREYEH
              |||||||||||||||||||:||||:||||| | ||
g311          LPPAFLAENTVRVADNLVIHGLLNLIAAEGGESEHAX
            420       430       440       450
```

The following partial DNA sequence was identified in *N. meningitidis* <SEQ ID 1293>:

```
a311.seq
   1  ATGTTCAGTT TTGGCTGGGT GTTTGACCGG CCGCAGTATG AGTTGGGTTC

  51  GCTGTCGCCT GTTGCGGCAG TGGCGTGCCG GCGCGCCTTG TCGCGTTTGG

 101  GTTTGAAAAC GCAAATCAAG TGGCCAAACG ATTTGGTCGT CGGACGCGAC

 151  AAATTGGGCG GCATTCTGAT TGAAACGGTC AGGACGGGCG GCAAAACGGT

 201  TGCCGTGGTC GGTATCGGCA TCAATTTCGT GCTGCCCAAG GAAGTGGAAA

 251  ACGCCGCTTC CGTGCAATCG CTGTTTCAGA CGGCATCGCG GCGGGGAAAT

 301  GCCGATGCCG CCGTGTTGCT GGAAACGCTG TTGGCGGAAC TTGATGCGGT

 351  GTTGTTGCAA TATGCGCGGG ACGGATTTGC GCCTTTTGTG GCGGAATATC

 401  AGGCTGCCAA CCGCGACCAC GGCAAGGCGG TATTGCTGTT GCGCGACGGC

 451  GAAACCGTGT TCGAAGGCAC GGTTAAAGGC GTGGACGGAC AAGGCGTTCT

 501  GCACTTGGAA ACGGCAGAGG GCAAACAGAC GGTCGTCAGC GGCGAAATCA

 551  GCCTGCGGTC CGACGACAGG CCGGTTTCCG TGCCGAAGCG GCGGGATTCG
```

-continued

```
 601  GAACGTTTTC TGCTGTTGGA CGGCGGCAAC AGCCGGCTCA AGTGGGCGTG

 651  GGTGGAAAAC GGCACGTTCG CAACCGTCGG TAGCGCGCCG TACCGCGATT

 701  TGTCGCCTTT GGGCGCGGAG TGGGCGGAAA AGGTGGATGG AAATGTCCGC

 751  ATCGTCGGTT GCGCCGTGTG CGGAGAATTC AAAAAGGCAC AAGTGCAGGA

 801  ACAGCTCGCC CGAAAAATCG AGTGGCTGCC GTCTTCCGCA CAGGCTTTGG

 851  GCATACGCAA CCACTACCGC CACCCCGAAG AACACGGTTC CGACCGCTGG

 901  TTCAACGCCT TGGGCAGCCG CCGCTTCAGC CGCAACGCCT GCGTCGTCGT

 951  CAGTTGCGGC ACGGCGGTAA CGGTTGACGC GCTCACCGAT GACGGACATT

1001  ATCTCGGGGG AACCATCATG CCCGGTTTCC ACCTGATGAA AGAATCGCTC

1051  GCCGTCCGAA CCGCCAACCT CAACCGGCAC GCCGGTAAGC GTTATCCTTT

1101  CCCGACCACA ACGGGCAATG CCGTCGCCAG CGGCATGATG GATGCGGTTT

1151  GCGGCTCGGT TATGATGATG CACGGGCGTT TGAAAGAAAA AACCGGGGCG

1201  GGCAAGCCTG TCGATGTCAT CATTACCGGC GGCGGCGCGG CAAAAGTTGC

1251  CGAAGCCCTG CCGCCTGCAT TTTTGGCGGA AAATACCGTG CGCGTGGCGG

1301  ACAACCTCGT CATTCACGGG CTGCTGAACC TGATTGCCGC CGAAGGCGGG

1351  GAATCGGAAC ATACTTAA
```

This corresponds to the amino acid sequence <SEQ ID 1294; ORF 311.a>:

```
a311.pep
   1 MFSFGWVFDR PQYELGSLSP VAAVACRRAL SRLGLKTQIK WPNDLVVGRD

  51 KLGGILIETV RTGGKTVAVV GIGINFVLPK EVENAASVQS LFQTASRRGN

 101 ADAAVLLETL LAELDAVLLQ YARDGFAPFV AEYQAANRDH GKAVLLLRDG

 151 ETVFEGTVKG VDGQGVLHLE TAEGKQTVVS GEISLRSDDR PVSVPKRRDS

 201 ERFLLLDGGN SRLKWAWVEN GTFATVGSAP YRDLSPLGAE WAEKVDGNVR

 251 IVGCAVCGEF KKAQVQEQLA RKIEWLPSSA QALGIRNHYR HPEEHGSDRW

 301 FNALGSRRFS RNACVVVSCG TAVTVDALTD DGHYLGGTIM PGFHLMKESL

 351 AVRTANLNRH AGKRYPFPTT TGNAVASGMM DAVCGSVMMM HGRLKEKTGA

 401 GKPVDVIITG GGAAKVAEAL PPAFLAENTV RVADNLVIHG LLNLIAAEGG

 451 ESEHT*
```

m311/a311 81.3% identity in 455 aa overlap

```
                    10        20        30        40        50        60
m311.pep    MFSFGWVFDRPQYELGSLSPVAAVACRRALSRLGLDVQIKWPNDLVVGRDKLGGILIETV
            ||||||||||||||||||||||||||||||||||| :|||||||||||||||||||||||
a311        MFSFGWVFDRPQYELGSLSPVAAVACRRALSRLGLKTQIKWPNDLVVGRDKLGGILIETV
                    10        20        30        40        50        60

                    70        80        90       100       110
m311.pep    RTGGKTVAVVGIGINFVLPXEVENAASVQSLFQTASRRGNADAAVLLXXXXXXXX-----
            ||||||||||||||||||| ||||||||||||||||||||||||||| :
a311        RTGGKTVAVVGIGINFVLPKEVENAASVQSLFQTASRRGNADAAVLLETLLAELDAVLLQ
                    70        80        90       100       110       120

m311.pep    ------------------------------------------------------------

a311        YARDGFAPFVAEYQAANRDHGKAVLLLRDGETVFEGTVKGVDGQGVLHLETAEGKQTVVS
                   130       140       150       160       170       180
```

-continued

```
               120       130       140       150       160       170
m311.pep    -EISLRSDXRPVSVXKRRDSERFLLLDGGNSRLKWAWVENGTFATVGSAPYRDLSPLGAE
             ||||||| |||||  |||||||||||||||||||||||||||||||||||||||||||||
a311        GEISLRSDDRPVSVPKRRDSERFLLLDGGNSRLKWAWVENGTFATVGSAPYRDLSPLGAE
                   190       200       210       220       230       240

               180       190       200       210       220       230
m311.pep    WAEKADGNVRIVGCAVCGEFKKAQVQEQLARKIEWLPSSAQALFGIRNHYRHPEEHGSDR
            ||||:|||||||||||||||||||||||||||||||||||||| ||||||||||||||||
a311        WAEKVDGNVRIVGCAVCGEFKKAQVQEQLARKIEWLPSSAQAL-GIRNHYRHPEEHGSDR
                   250       260       270      280         290

               240       250       260       270       280       290
m311.pep    WFNALGSRRFSRNACVVVSCGTAVTVDALTDDGHYLGGTIMPGFHLMKESLAVRTANLNR
            ||||||||||||||||||||||||||||||||||||||||||||||||||||||||||||
a311        WFNALGSRRFSRNACVVVSCGTAVTVDALTDDGHYLGGTIMPGFHLMKESLAVRTANLNR
         300       310       320       330       340       350

               300       310       320       330       340       350
m311.pep    HAGKRYPFPTTTGNAVASGMMDAVCGSVMMMHGRLKEKTGAGKPVDVIITGGGAAKVAEA
            ||||||||||||||||||||||||||||||||||||||||||||||||||||||||||||
a311        HAGKRYPFPTTTGNAVASGMMDAVCGSVMMMHGRLKEKTGAGKPVDVIITGGGAAKVAEA
         360       370       380       390       400       410

               360       370       380      389
m311.pep    LPPAFLAENTVRVADNLVIYGLLNMIAAEGREYEH
            |||||||||||||||||||:||||:||||| | ||
a311        LPPAFLAENTVRVADNLVIHGLLNLIAAEGGESEHTX
          420       430       440       450
```

The following partial DNA sequence was identified in *N. gonorrhoeae* <SEQ ID 1295>:

```
g311-1.seq
   1 ATGACGGTTT TGAAGCCTTC GCATTGGCGG GTGTTGGCGG AGCTTGCCGA

  51 CGGTTTGCCG CAACACGTAT CGCAATTGGC GCGTGAGGCG GACATGAAGC

 101 CGCAGCAGCT CAACGGTTTT TGGCAGCAGA TGCCGGCGCA TATACGCGGG

 151 CTGTTGCGCC AACACGACGG CTATTGGCGG CTGGTGCGCC CCTTGGCGGT

 201 TTTCGATGCC GAAGGTTTGC GCGATCTGGG GGAAAGGTCG GGTTTTCAGA

 251 CGGCATTGAA GCACGAGTGC GCGTCCAGCA ACGACGAGAT ACTGGAATTG

 301 GCGCGGATTG CGCCGGACAA GGCGCACAAA ACCATATGCG TGACCCACCT

 351 GCAAAGTAAG GGCAGGGGGC GGCAGGGGCG GAAGTGGTCG CACCGTTTGG

 401 GCGAGTGCCT GATGTTCAGT TTCGGCTGGG CGTTTGACCG GCCGCAGTAT

 451 GAGTTGGGTT CGCTGTCGCC TGTTGCGGCA CTTGCGTGCC GGCGCGCTTT

 501 GGGGTGTTTG GGTTTGGAAA CGCAAATCAA GTGGCCAAAC GATTTGGTCG

 551 TCGGACGCGA CAAATTGGGC GGCATTCTGA TTGAAACAGT CAGGGCGGGC

 601 GGTAAAACGG TTGCCGTGGT CGGTATCGGC ATCAATTTCG TGCTGCCCAA

 651 GGAAGTGGAA AACGCCGCTT CCGTGCAGTC GCTGTTTCAG ACGGCATCGC

 701 GGCGGGGCAA TGCCGATGCC GCCGTATTGC TGGAAACATT GCTTGCGGAA

 751 CTGGGCGCGG TGTTGGAACA ATATGCGGAA GAAGGGTTCG CGCCATTTTT

 801 AAATGAGTAT GAAACGGCCA ACCGCGACCA CGGCAAGGCG GTATTGCTGT

 851 TGCGCGACGG CGAAACCGTG TGCGAAGGCA CGGTTAAAGG CGTGGACGGA

 901 CGAGGCGTTC TGCACTTGGA AACGGCAGaa ggCGAACAGa cggtcGtcag

 951 cggcGaaaTC AGccTGCGGc CCGacaacag gtcggtttcc GTgccgaagc

1001 gGccggatTC GgaacgtttTT tTGCTgttgg aaggcgggaa cagccggctc

1051 aAGTGGgcgt gGGTggAAAA Cggcacgttc gcaaccgtgg gcAGCGCgCC
```

-continued

```
1101 gtaCCGCGAT TTGTCGCCTT TGGGCGCGGA GTGGGCGGAA AAGGCGGATG

1151 GAAATGTCCG CATCGTCGGT TGCGCCGTGT GCGGAGAATC CAAAAAGGCA

1201 CAAGTGAAGG AACAGCTCGC CCGAAAAATC GAGTGGCTGC CGTCTTCCGC

1251 ACAGGCTTTG GGCATACGCA ACCACTACCG CCACCCCGAA GAACACGGTT

1301 CCGACCGTTG GTTCAACGCC TTGGGCAGCC GCCGCTTCAG CCGCAACGCC

1351 TGCGTCGTCG TCAGTTGCGG CACGGCGGTA ACGGTTGACG CGCTCACCGA

1401 TGACGGACAT TATCTCGGCG GAACCATCAT GCCCGGCTTC CACCTGATGA

1451 AAGAATCGCT CGCCGTCCGA ACCGCCAACC TCAACCGCCC CGCCGGCAAA

1501 CGTTACCCTT TCCCGACCAC AACGGGCAAC GCCGTCGCAA GCGGCATGAT

1551 GGACGCGGTT TGCGGCTCGA TAATGATGAT GCACGGCCGT TTGAAAGAAA

1601 AAAACGGCGC GGGCAAGCCT GTCGATGTCA TCATTACCGG CGGCGGCGCG

1651 GCGAAAGTCG CCGAAGCCCT GCCGCCTGCA TTTTTGGCGG AAAATACCGT

1701 GCGCGTGGCG GACAACCTCG TCATCCACGG GCTGCTGAAC CTGATTGCCG

1751 CCGAAGGCGG GGAATCGGAA CACGCTTAA
```

This corresponds to the amino acid sequence <SEQ ID 1296; ORF 311-1.ng>:

```
g311-1.pep
  1 MTVLKPSHWR VLAELADGLP QHVSQLAREA DMKPQQLNGF WQQMPAHIRG

 51 LLRQHDGYWR LVRPLAVFDA EGLRDLGERS GFQTALKHEC ASSNDEILEL

101 ARIAPDKAHK TICVTHLQSK GRGRQGRKWS HRLGECLMFS FGWAFDRPQY

151 ELGSLSPVAA LACRRALGCL GLETQIKWPN DLVVGRDKLG GILIETVRAG

201 GKTVAVVGIG INFVLPKEVE NAASVQSLFQ TASRRGNADA AVLLETLLAE

251 LGAVLEQYAE EGFAPFLNEY ETANRDHGKA VLLLRDGETV CEGTVKGVDG

301 RGVLHLETAE GEQTVVSGEI SLRPDNRSVS VPKRPDSERF LLLEGGNSRL

351 KWAWVENGTF ATVGSAPYRD LSPLGAEWAE KADGNVRIVG CAVCGESKKA

401 QVKEQLARKI EWLPSSAQAL GIRNHYRHPE EHGSDRWFNA LGSRRFSRNA

451 CVVVSCGTAV TVDALTDDGH YLGGTIMPGF HLMKESLAVR TANLNRPAGK

501 RYPFPTTTGN AVASGMMDAV CGSIMMMHGR LKEKNGAGKP VDVIITGGGA

551 AKVAEALPPA FLAENTVRVA DNLVIHGLLN LIAAEGGESE HA*
```

The following partial DNA sequence was identified in *N. meningitidis* <SEQ ID 1297>:

```
m311-1.seq
  1 ATGACGGTTT TGAAGCTTTC GCACTGGCGG GTGTTGGCGG AGCTTGCCGA

 51 CGGTTTGCCG CAACACGTCT CGCAACTGGC GCGTATGGCG GATATGAAGC

101 CGCAGCAGCT CAACGGTTTT TGGCAGCAGA TGCCGGCGCA CATACGCGGG

151 CTGTTGCGCC AACACGACGG CTATTGGCGG CTGGTGCGCC CATTGGCGGT

201 TTTCGATGCC GAAGGTTTGC GCGAGCTGGG GGAAAGGTCG GGTTTTCAGA

251 CGGCATTGAA GCACGAGTGC GCGTCCAGCA ACGACGAGAT ACTGGAATTG

301 GCGCGGATTG CGCCGGACAA GGCGCACAAA ACCATATGCG TGACCCACCT

351 GCAAAGTAAG GGCAGGGGGC GGCAGGGGCG GAAGTGGTCG CACCGTTTGG
```

-continued

```
 401 GCGAGTGTCT GATGTTCAGT TTTGGCTGGG TGTTTGACCG GCCGCAGTAT
 451 GAGTTGGGTT CGCTGTCGCC TGTTGCGGCA GTGGCGTGTC GGCGCGCCTT
 501 GTCGCGTTTA GGTTTGGATG TGCAGATTAA GTGGCCCAAT GATTTGGTTG
 551 TCGGACGCGA CAAATTGGGC GGCATTCTGA TTGAAACGGT CAGGACGGGC
 601 GGCAAAACGG TTGCCGTGGT CGGTATCGGC ATCAATTTTG TCCTGCCCAA
 651 GGAAGTAGAA AATGCCGCTT CCGTGCAATC GCTGTTTCAG ACGGCATCGC
 701 GGCGGGGCAA TGCCGATGCC GCCGTGCTGC TGGAAACGCT GTTGGTGGAA
 751 CTGGACGCGG TGTTGTTGCA ATATGCGCGG GACGGATTTG CGCCTTTTGT
 801 GGCGGAATAT CAGGCTGCCA ACCGCGACCA CGGCAAGGCG GTATTGCTGT
 851 TGCGCGACGG CGAAACCGTG TTCGAAGGCA CGGTTAAAGG CGTGGACGGA
 901 CAAGGCGTTT TGCACTTGGA AACGGCAGAG GGCAAACAGA CGGTCGTCAG
 951 CGGCGAAATC AGCCTGCGGT CCGACGACAG GCCGGTTTCC GTGCCGAAGC
1001 GGCGGGATTC GGAACGTTTT CTGCTGTTGG ACGGCGGCAA CAGCCGGCTC
1051 AAGTGGGCGT GGGTGGAAAA CGGCACGTTC GCAACCGTCG GTAGCGCGCC
1101 GTACCGCGAT TTGTCGCCTT TGGGCGCGGA GTGGGCGGAA AAGGCGGATG
1151 GAAATGTCCG CATCGTCGGT TGCGCTGTGT GCGGAGAATT CAAAAAGGCA
1201 CAAGTGCAGG AACAGCTCGC CCGAAAAATC GAGTGGCTGC CGTCTTCCGC
1251 ACAGGCTTTG GGCATACGCA ACCACTACCG CCACCCCGAA GAACACGGTT
1301 CCGACCGCTG GTTCAACGCC TTGGGCAGCC GCCGCTTCAG CCGCAACGCC
1351 TGCGTCGTCG TCAGTTGCGG CACGGCGGTA ACGGTTGACG CGCTCACCGA
1401 TGACGGACAT TATCTCGGGG GAACCATCAT GCCCGGTTTC CACCTGATGA
1451 AAGAATCGCT CGCCGTCCGA ACCGCCAACC TCAACCGGCA CGCCGGTAAG
1501 CGTTATCCTT TCCCGACCAC AACGGGCAAT GCCGTCGCCA GCGGCATGAT
1551 GGATGCGGTT TGCGGCTCGG TTATGATGAT GCACGGGCGT TTGAAAGAAA
1601 AAACCGGGGC GGGCAAGCCT GTCGATGTCA TCATTACCGG CGGCGGCGCG
1651 GCAAAAGTTG CCGAAGCCCT GCCGCCTGCA TTTTTGGCGG AAAATACCGT
1701 GCGCGTGGCG GACAACCTCG TCATTTACGG GTTGTTGAAC ATGATTGCCG
1751 CCGAAGGCAG GGAATATGAA CATATTTAA
```

This corresponds to the amino acid sequence <SEQ ID 1298; ORF 311-1>:

```
m311-1.pep
  1 MTVLKLSHWR VLAELADGLP QHVSQLARMA DMKPQQLNGF WQQMPAHIRG
 51 LLRQHDGYWR LVRPLAVFDA EGLRELGERS GRQTALKHEC ASSNDEILEL
101 ARIAPDKAHK TICVTHLQSK GRGRQGRKWS HRLGECLMFS FGWVFDRPQY
151 ELGSLSPVAA VACRRALSRL GLDVQIKWPN DLVVGRDKLG GILIETVRTG
201 GKTVAVVGIG INFVLPKEVE NAASVQSLFQ TASRRGNADA AVLLETLLVE
251 LDAVLLQYAR DGFAPFVAEY QAANRDHGKA VLLLRDGETV FEGTVKGVDG
301 QGVLHLETAE GKQTVVSGEI SLRSDDRPVS VPKRRDSERF LLLDGGNSRL
351 KWAWVENGTF ATVGSAPYRD LSPLGAEWAE KADGNVRIVG CAVCGEFKKA
401 QVQEQLARKI EWLPSSAQAL GIRNHYRHPE EHGSDRWFNA LGSRRFSRNA
```

-continued

```
451  CVVVSCGTAV TVDALTDDGH YLGGTIMPGF HLMKESLAVR TANLNRHAGK

501  RYPFPTTTGN AVASGMMDAV CGSVMMMHGR LKEKTGAGKP VDVIITGGGA

551  AKVAEALPPA FLAENTVRVA DNLVIYGLLN MIAAEGREYE HI*
```

```
m311-1/g311-1  93.9% identity in 591 aa overlap

                          10        20        30        40        50        60
m311-1.pep      MTVLKLSHWRVLAELADGLPQHVSQLARMADMKPQQLNGFWQQMPAHIRGLLRQHDGYWR
                |||||||||||||||||||||||||||| |||||||||||||||||||||||||||||||
g311-1          MTVLKLSHWRVLAELADGLPQHVSQLAREADMKPQQLNGFWQQMPAHIRGLLRQHDGYWR
                          10        20        30        40        50        60

                          70        80        90       100       110       120
m311-1.pep      LVRPLAVFDAEGLRELGERSGFQTALKHECASSNDEILELARIAPDKAHKTICVTHLQSK
                |||||||||||||:||||||||||||||||||||||||||||||||||||||||||||||
g311-1          LVRPLAVFDAEGLRDLGERSGFQTALKHECASSNDEILELARIAPDKAHKTICVTHLQSK
                          70        80        90       100       110       120

                         130       140       150       160       170       180
m311-1.pep      GRGRQGRKWSHRLGECLMFSFGWVFDRPQYELGSLSPVAAVACRRALSRLGLDVQIKWPN
                |||||||||||||||||||||||:||||||||||||||||:||||||: |||::||||||
g311-1          GRGRQGRKWSHRLGECLMFSFGWAFDRPQYELGSLSPVAALACRRALGCLGLETQIKWPN
                         130       140       150       160       170       180

                         190       200       210       220       230       240
m311-1.pep      DLVVGRDKLGGILIETVRTGGKTVAVVGIGINFVLPKEVENAASVQSLFQTASRRGNADA
                ||||||||||||||||||:|||||||||||||||||||||||||||||||||||||||||
g311-1          DLVVGRDKLGGILIETVRAGGKTVAVVGIGINFVLPKEVENAASVQSLFQTASRRGNADA
                         190       200       210       220       230       240

                         250       260       270       280       290       300
m311-1.pep      AVLLETLLVELDAVLLQYARDGFAPFVAEYQAANRDHGKAVLLLRDGETVFEGTVKGVDG
                ||||||||:|| ||| |||::|||||: ||::|||||||||||||||||| |||||||||
g311-1          AVLLETLLAELGAVLEQYAEEGFAPFLNEYETANRDHGKAVLLLRDGETVCEGTVKGVDG
                         250       260       270       280       290       300

                         310       320       330       340       350       360
m311-1.pep      QGVLHLETAEGKQTVVSGEISLRSDDRPVSVPKRRDSERFLLLDGGNSRLKWAWVENGTF
                :||||||||||:||||||||||| |:| |||||| ||||||||:||||||||||||||||
g311-1          RGVLHLETAEGEQTVVSGEISLRPDNRSVSVPKRPDSERFLLLEGGNSRLKWAWVENGTF
                         310       320       330       340       350       360

                         370       380       390       400       410       420
m311-1.pep      ATVGSAPYRDLSPLGAEWAEKADGNVRIVGCAVCGEFKKAQVQEQLARKIEWLPSSAQAL
                |||||||||||||||||||||||||||||||||||| |||||:|||||||||||||||||
g311-1          ATVGSAPYRDLSPLGAEWAEKADGNVRIVGCAVCGESKKAQVKEQLARKIEWLPSSAQAL
                         370       380       390       400       410       420

                         430       440       450       460       470       480
m311-1.pep      GIRNHYRHPEEHGSDRWFNALGSRRFSRNACVVVSCGTAVTVDALTDDGHYLGGTIMPGF
                |||||||||||||||||||||||:||||||||||||||||:||||||: |||::||||||
g311-1          GIRNHYRHPEEHGSDRWFNALGSRRFSRNACVVVSCGTAVTVDALTDDGHYLGGTIMPGF
                         430       440       450       460       470       480

                         490       500       510       520       530       540
m311-1.pep      HLMKESLAVRTANLNRHAGKRYPFPTTTGNAVASGMMDAVCGSVMMMHGRLKEKTGAGKP
                |||||||||||||||| ||||||||||||||||||||||||||:||||||||||:|||||
g311-1          HLMKESLAVRTANLNRPAGKRYPFPTTTGNAVASGMMDAVCGSIMMMHGRLKEKNGAGKP
                         490       500       510       520       530       540

                         550       560       570       580       590
m311-1.pep      VDVIITGGGAAKVAEALPPAFLAENTVRVADNLVIYGLLNMIAAEGREYEHIX
                |||||||||||||||||||||||||||||||||||:||||:||||| | ||
g311-1          VDVIITGGGAAKVAEALPPAFLAENTVRVADNLVIHGLLNLIAAEGGESEHAX
                         550       560       570       580       590
```

The following partial DNA sequence was identified in *N. meningitidis* <SEQ ID 1299>:

```
a311-1.seq
    1  ATGACGGTTT TGAAGCCTTC GCACTGGCGG GTGTTGGCGG AGCTTGCCGA

   51  CGGTTTGCCG CAACACGTCT CGCAACTGGC GCGTATGGCG GATATGAAGC

  101  CGCAGCAGCT CAACGGTTTT TGGCAGCAGA TGCCGGCGCA CATACGCGGG
```

-continued

```
151 CTGTTGCGCC AACACGACGG CTATTGGCGG CTGGTGCGCC CATTGGCGGT
201 TTTCGATGCC GAAGGTTTGC GCGAGCTGGG GGAAAGGTCG GGTTTTCAGA
251 CGGCATTGAA GCACGAGTGC GCGTCCAGCA ACGACGAGAT ACTGGAATTG
301 GCGCGGATTG CGCCGGACAA GGCGCACAAA ACCATATGTG TGACCCACCT
351 GCAAAGTAAG GGCAGGGGGC GGCAGGGGCG GAAGTGGTCG CACCGTTTGG
401 GCGAGTGTCT GATGTTCAGT TTTGGCTGGG TGTTTGACCG GCCGCAGTAT
451 GAGTTGGGTT CGCTGTCGCC TGTTGCGGCA GTGGCGTGCC GGCGCGCCTT
501 GTCGCGTTTG GGTTTGAAAA CGCAAATCAA GTGGCCAAAC GATTTGGTCG
551 TCGGACGCGA CAAATTGGGC GGCATTCTGA TTGAAACGGT CAGGACGGGC
601 GGCAAAACGG TTGCCGTGGT CGGTATCGGC ATCAATTTCG TGCTGCCCAA
651 GGAAGTGGAA AACGCCGCTT CCGTGCAATC GCTGTTTCAG ACGGCATCGC
701 GGCGGGGAAA TGCCGATGCC GCCGTGTTGC TGGAAACGCT GTTGGCGGAA
751 CTTGATGCGG TGTTGTTGCA ATATGCGCGG GACGGATTTG CGCCTTTTGT
801 GGCGGAATAT CAGGCTGCCA ACCGCGACCA CGGCAAGGCG GTATTGCTGT
851 TGCGCGACGG CGAAACCGTG TTCGAAGGCA CGGTTAAAGG CGTGGACGGA
901 CAAGGCGTTC TGCACTTGGA AACGGCAGAG GGCAAACAGA CGGTCGTCAG
951 CGGCGAAATC AGCCTGCGGT CCGACGACAG GCCGGTTTCC GTGCCGAAGC
1001 GGCGGGATTC GGAACGTTTT CTGCTGTTGG ACGGCGGCAA CAGCCGGCTC
1051 AAGTGGGCGT GGGTGGAAAA CGGCACGTTC GCAACCGTCG GTAGCGCGCC
1101 GTACCGCGAT TTGTCGCCTT TGGGCGCGGA GTGGGCGGAA AAGGTGGATG
1151 GAAATGTCCG CATCGTCGGT TGCGCCGTGT GCGGAGAATT CAAAAAGGCA
1201 CAAGTGCAGG AACAGCTCGC CCGAAAAATC GAGTGGCTGC CGTCTTCCGC
1251 ACAGGCTTTG GGCATACGCA ACCACTACCG CCACCCCGAA GAACACGGTT
1301 CCGACCGCTG GTTCAACGCC TTGGGCAGCC GCCGCTTCAG CCGCAACGCC
1351 TGCGTCGTCG TCAGTTGCGG CACGGCGGTA ACGGTTGACG CGCTCACCGA
1401 TGACGGACAT TATCTCGGGG GAACCATCAT GCCCGGTTTC CACCTGATGA
1451 AAGAATCGCT CGCCGTCCGA ACCGCCAACC TCAACCGGCA CGCCGGTAAG
1501 CGTTATCCTT TCCCGACCAC AACGGGCAAT GCCGTCGCCA GCGGCATGAT
1551 GGATGCGGTT TGCGGCTCGG TTATGATGAT GCACGGGCGT TTGAAAGAAA
1601 AAACCGGGGC GGGCAAGCCT GTCGATGTCA TCATTACCGG CGGCGGCGCG
1651 GCAAAAGTTG CCGAAGCCCT GCCGCCTGCA TTTTTGGCGG AAAATACCGT
1701 GCGCGTGGCG GACAACCTCG TCATTCACGG GCTGCTGAAC CTGATTGCCG
1751 CCGAAGGCGG GGAATCGGAA CATACTTAA
```

This corresponds to the amino acid sequence <SEQ ID 1300; ORF 311-1.a>:

```
a311-1.pep

  1 MTVLKPSHWR VLAELADGLP QHVSQLARMA DMKPQQLNGF WQQMPAHIRG
 51 LLRQHDGYWR LVRPLAVFDA EGLRELGERS GFQTALKHEC ASSNDEILEL
101 ARIAPDKAHK TICVTHLQSK GRGRQGRKWS HRLGECLMFS FGWVFDRPQY
```

-continued

```
151  ELGSLSPVAA  VACRRALSRL  GLKTQIKWPN  DLVVGRDKLG  GILIETVRTG

201  GKTVAVVGIG  INFVLPKEVE  NAASVQSLFQ  TASRRGNADA  AVLLETLLAE

251  LDAVLLQYAR  DGFAPFVAEY  QAANRDHGKA  VLLLRDGETV  FEGTVKGVDG

301  QCFLHLETAE  GKQTVVSGEI  SLRSDDRPVS  VPKRRDSERF  LLLDGGNSRL

351  KWAWVENGTF  ATVGSAPYRD  LSPLGAEWAE  KVDGNVRIVG  CAVCGEFKKA

401  QVQEQLARKI  EWLPSSAQAL  GIRNHYRHPE  EHGSDRWFNA  LGSRRFSRNA

451  CVVVSCGTAV  TVDALTDDGH  YLGGTIMPGF  HLMKESLAVR  TANLNRHAGK

501  RYPFPTTTGN  AVASGMMDAV  CGSVMMMHGR  LKEKTGAGKP  VDVIITGGGA

551  AKVAEALPPA  FLAENTVRVA  DNLVIHGLLN  LIAAEGGESE  HT*
```

a311-1/m311-1 98.5% identity in 591 aa overlap

```
                      10        20        30        40        50        60
a311-1.pep    MTVLKPSHWRVLAELADGLPQHVSQLARMADMKPQQLNGFWQQMPAHIRGLLRQHDGYWR
              ||||| ||||||||||||||||||||||||||||||||||||||||||||||||||||||
m311-1        MTVLKLSHWRVLAELADGLPQHVSQLARMADMKPQQLNGFWQQMPAHIRGLLRQHDGYWR
                      10        20        30        40        50        60

                      70        80        90       100       110       120
a311-1.pep    LVRPLAVFDAEGLRELGERSGFQTALKHECASSNDEILELARIAPDKAHKTICVTHLQSK
              ||||||||||||||||||||||||||||||||||||||||||||||||||||||||||||
m311-1        LVRPLAVFDAEGLRELGERSGFQTALKHECASSNDEILELARIAPDKAHKTICVTHLQSK
                      70        80        90       100       110       120

                     130       140       150       160       170       180
a311-1.pep    GRGRQGRKWSHRLGECLMFSFGWVFDRPQYELGSLSPVAAVACRRALSRLGLKTQIKWPN
              |||||||||||||||||||||||||||||||||||||||||||||||||||| :||||||
m311-1        GRGRQGRKWSHRLGECLMFSFGWVFDRPQYELGSLSPVAAVACRRALSRLGLDVQIKWPN
                     130       140       150       160       170       180

                     190       200       210       220       230       240
a311-1.pep    DLVVGRDKLGGILIETVRTGGKTVAVVGIGINFVLPKEVENAASVQSLFQTASRRGNADA
              ||||||||||||||||||||||||||||||||||||||||||||||||||||||||||||
m311-1        DLVVGRDKLGGILIETVRTGGKTVAVVGIGINFVLPKEVENAASVQSLFQTASRRGNADA
                     190       200       210       220       230       240

                     250       260       270       280       290       300
a311-1.pep    AVLLETLLAELDAVLLQYARDGFAPFVAEYQAANRDHGKAVLLLRDGETVFEGTVKGVDG
              ||||||||:|||||||||||||||||||||||||||||||||||||||||||||||||||
m311-1        AVLLETLLVELDAVLLQYARDGFAPFVAEYQAANRDHGKAVLLLRDGETVFEGTVKGVDG
                     250       260       270       280       290       300

                     310       320       330       340       350       360
a311-1.pep    QGVLHLETAEGKQTVVSGEISLRSDDRPVSVPKRRDSERFLLLDGGNSRLKWAWVENGTF
              |||||||||||||||||||||||||||||||||| |||||||||||||||||||||||||
m311-1        QGVLHLETAEGKQTVVSGEISLRSDDRPVSVPKRPDSERFLLLDGGNSRLKWAWVENGTF
                     310       320       330       340       350       360

                     370       380       390       400       410       420
a311-1.pep    ATVGSAPYRDLSPLGAEWAEKVDGNVRIVGCAVCGEFKKAQVQEQLARKIEWLPSSAQAL
              |||||||||||||||||||||:||||||||||||||||||||||||||||||||||||||
m311-1        ATVGSAPYRDLSPLGAEWAEKADGNVRIVGCAVCGEFKKAQVQEQLARKIEWLPSSAQAL
                     370       380       390       400       410       420

                     430       440       450       460       470       480
a311-1.pep    GIRNHYRHPEEHGSDRWFNALGSRRFSRNACVVVSCGTAVTVDALTDDGHYLGGTIMPGF
              ||||||||||||||||||||||||||||||||||||||||||||||||||||||||||||
m311-1        GIRNHYRHPEEHGSDRWFNALGSRRFSRNACVVVSCGTAVTVDALTDDGHYLGGTIMPGF
                     430       440       450       460       470       480

                     490       500       510       520       530       540
a311-1.pep    HLMKESLAVRTANLNRHAGKRYPFPTTTGNAVASGMMDAVCGSVMMMHGRLKEKTGAGKP
              |||||||||||||||||||||||||||||||||||||||| |||||||||| |||||
m311-1        HLMKESLAVRTANLNRHAGKRYPFPTTTGNAVASGMMDAVCGSVMMMHGRLKEKTGAGKP
                     490       500       510       520       530       540

                     550       560       570       580       590
a311-1.pep    VDVIITGGGAAKVAEALPPAFLAENTVRVADNLVIHGLLNLIAAEGGESEHTX
              |||||||||||||||||||||||||||||||||||:||||:||||| | ||
m311-1        VDVIITGGGAAKVAEALPPAFLAENTVRVADNLVIYGLLNMIAAEGREYEHIX
                     550       560       570       580       590
```

The following partial DNA sequence was identified in *N. gonorrhoeae* <SEQ ID 1301>:

```
g312.seq
   1  atgaGtatCc aatCcGgcga AATTTtagaa accgtCAAAA TGGTTGCCGA
  51  ccggaATttt gAtgtccgCA CCATTAccat cggcaTTgaT ttgcacgact
 101  gcatcagcac cgacatcgac gtgttaAACC AAAACATtta caaCAaaaTc
 151  accacggtcg gcaaagactT GGTGGCAacg Gcgaaacacc tTTccgcCAA
 201  ATACGGCGTG CCGATTGTGA ATCAGCGCAT TTCCGTTACG CCGAttgccc
 251  AaatcGCGGC GGcgaccaAa gccgaCAGTT AtgtcAGCgt ggcgcAGact
 301  tTGGACAAGG CAGCCAAAGC CATCGGCGTG TCCTTTATCG GcggCTTTTC
 351  CGCGCTGGTG CAAAAAGGTA TGTCGCCTTC GGATGAGGTG TTGATCCGTT
 401  CCGTTCCCGA AGCGATGAAA ACTACCGATA TCGTGTGCAG CTCCATCAAT
 451  ATCGGCAGCA CGCGTGCCGG TATCAATATG GATGCGGTCA AGCTGGCAGG
 501  CGAAACCATC AAACGCACGG CTGAAATCAC ACCCGAAGGT TTCGGCTGCG
 551  CCAAAATCGT CGTGTTCTGC AACGCGGTGG AAGACAATCC GTTTATGGCG
 601  GGTGCGTTCC ACGGCTCGGG CGAAGCGGAT GCTGTGATTA ATGTCGGCGT
 651  ATCCGGTCCA GGCGTGGTCA AAGCCGCGCT GGAAAATTCG GACGCGGTCA
 701  GCCTGACCGA GGTCGCCGAA GTCGTGAAGA AAACCGCTTT CAAAATCACC
 751  CGCGTGGGCG AACTCATCGG TCGCGAAGCC TCAAAAATGC TGAATATCCC
 801  GTTCGGCATT CTCGATTTGT CGCTGGCACC GACCGCCGTC GTCGGCGACT
 851  CGGTGGCGCG CATTCTTGAA GAAATGGGCT TGAGCGTCTG CGGTACGCAC
 901  GGCACAACAG CAGCTTTGGC ATTGCTGAAC GATGCCGTGA AAAAGGGCGG
 951  CATGATGGCT TCCAGCGCGG TCGGCGGTTT GAGCGGCGCG TTTATCCCCG
1001  TTTCCGAAGA CGAAGGTATG ATTGCCGCCG CCGAGGCAGG CGTGTTGACG
1051  CTGGACAAAC TCGAAGCCAT GACCGCCGTC TGCTCCGTTG GTTTGGACAT
1101  GATTGCCGTT CCCGGCGACA CGCCCGCGCA CACCATTTCC GGCATCATCG
1151  CCGACGAAGC CGCCATCGGC ATGATCAACA GCAAAACCAC CGCCGTGCGC
1201  ATTATTCCGG TAACGGGCAA AACCGTCGGC GACAGCGTCG AGTTCGGCGG
1251  TCTGTTGGGC TACGCGCCTG TAATGCCGGC AAAAGAAGGT TCGTGCGAAG
1301  TGTTCGTCAA CCGGGGCGGC AGGATTCCCG CACCGGTTCA ATCGATGAAA
1351  AACTGA
```

This corresponds to the amino acid sequence <SEQ ID 1302; ORF 312.ng>:

```
g312.pep
  1 MSIQSGEILE TVKMVADRNF DVRTITIGID LHDCISTDID VLNQNIYNKI
 51 TTVGKDLVAT AKHLSAKYGV PIVNQRISVT PIAQIAAATK ADSYVSVAQT
101 LDKAAKAIGV SFIGGFSALV QKGMSPSDEV LIRSVPEAMK TTDIVCSSIN
151 IGSTRAGINM DAVKLAGETI KRTAEITPEG FGCAKIVVFC NAVEDNPFMA
201 GAFHGSGEAD AVINVGVSGP GVVKAALENS DAVSLTEVAE VVKKTAFKIT
251 RVGELIGREA SKMLNIPFGI LDLSLAPTPA VGDSVARILE EMGLSVCGTH
301 GTTAALALLN DAVKKGGMMA SSAVGGLSGA FIPVSEDEGM IAAAEAGVLT
```

-continued

351 LDKLEAMTAV CSVGLDMIAV PGDTPAHTIS GIIADEAAIG MINSKTTAVR

401 IIPVTGKTVG DSVEFGGLLG YAPVMPAKEG SCEVFVNRGG RIPAPVQSMK

451 N*

The following partial DNA sequence was identified in *N. meningitidis* <SEQ ID 1303>:

m312.seq

1 ATGAGTATCC AATCCGGCGA AATTTTAGAA ACCGTCAAAA TGGTTGCCGA

51 CCAGAATTTT GATGTCCGCA CCATTACCAT CGGCATTGAT TTGCACGACT

101 GCATCAGCAG CGATATCAAT GTGTTGAACC AAAATATTTA CAATAAAATT

151 ACCACAGTCG GCAAAGACTT GGTCACTACG GCAAAATATC TGTCTGCCAA

201 ATACGGCGTA CCGATTGTGA ATCAGCGCAT TTCCGTTACG CCGATTGCCC

251 AAATCGCGGC GGCCACCCAT GCTGATTCTT ACGTCAGCGT GGCGCAAACT

301 TTGGATAAAG CTGCCAAAGC CATCGGTGTG TCTTTTATCG GCGGTTTTTC

351 CGCGTTGGTG CAAAAAGGGA TGTCGCcTTC GGATGAGGTG TTAATCCGCT

401 CCATTCCCGA AGCGATGAAG ACTACCGATA TTGTGTGCwG CTCCATCAAT

451 ATCGGCAGTA CGCGTGCCGG TATCAATATG GATGCGGTCA AGCTGGCGGG

501 CGAAACcGTc AAACGCACGG CGGAAATCAC GCCCGAAGGT TTCGGCTGCG

551 CTAAAATTGT CGTGTTCTGC AACGCGGTGG AAGACAACCC GTTTwTGGCG

601 GGCGCGTTTC ATGGTTCGGG CGATGCCGTT ATCAATGTCG GCGTATCCGG

651 CCCAGGTGTC GTAAAAGCCG CGTTGGAAAA TTCAGATGCA ACGACATTGA

701 CCGAAGTTGC GGAAGTAGTG AAGAAAACTG CTTTCAAAAT TACCCGCGTG

751 GGCGAACTCA TCGGCCGCGA AGCcTCAAAA ATGCTGAATA TCCCGTTTGG

801 TATTCTCGAC TTGTCGCCGA CCCCGCCCGT CGGCGACTCA GTGGCACGCA

851 TTCTTGAAGA AATGGGCTTG AGCGTCTGCG GTACGCACGG CACAACAGCA

901 GCTTTGGCAT TGCTGAACGA TGCCGTGAAA AAAGGCGGCA TGATGGCTTC

951 CAGCGCGGTC GGGGGTTTGA GTGGCGCGTT TATCCCCGTT TCCGAAGACG

1001 AAGGTATGAT yGmCgCcGCC GAAGCAGGCG TGCTGACGCT GGACAAACTC

1051 GAAGCCATGA CCGCCGTTTG TTCGGTCGGC TTGGATATGA TTGCCGTTCC

1101 CGGCGACACG CCCGCGCACA CCATTTCCGG CATCATTGCC GACGAAGCCG

1151 CCATCGGCAt GATCAACAGC AAAACCACTG CCGTGCGCAT TATTCCGGTA

1201 ACCGGTAAAA CCGTCGGCGA CAcGGTCGAG TTCGGCGGCT TGTTGGgCTA

1251 CGCGCCTGTG ATGCCGGTCA AAGAAGGTTC GTGCGAAGTA TTCGTCAACC

1301 GAGGCGGCAG AATTCCGGCT CCGGTTCAAT CGATGAAAAA CTGA

This corresponds to the amino acid sequence <SEQ ID 1304; ORF 312>:

m312.pep

1 MSIQSGEILE TVKMVADQNF DVRTITIGID LHDCISSDIN VLNQNIYNKI

51 TTVGKDLVTT AKYLSAKYGV PIVNQRISVT PIAQIAAATH ADSYVSVAQT

101 LDKAAKAIGV SFIGGFSALV QKGMSPSDEV LIRSIPEAMK TTDIVCXSIN

151 IGSTRAGINM DAVKLAGETV KRTAEITPEG FGCAKIVVFC NAVEDNPFXA

-continued

```
201 GAFHGSGDAV INVGVSGPGV VKAALENSDA TTLTEVAEVV KKTAFKITRV

251 GELIGREASK MLNIPFGILD LSPTPPVGDS VARILEEMGL SVCGTHGTTA

301 ALALLNDAVK KGGMMASSAV GGLSGAFIPV SEDEGMIXAA EAGVLTLDKL

351 EAMTAVCSVG LDMIAVPGDT PAHTISGIIA DEAAIGMINS KTTAVRIIPV

401 TGKTVGDTVE FGGLLGYAPV MPVKEGSCEV FVNRGGRIPA PVQSMKN*
```

Computer analysis of this amino acid sequence gave the following results:

Homology with a Predicted ORF from *N. gonorrhoeae*

ORF 312 shows 95.6% identity over a 451 aa overlap with a predicted ORF (ORF 312.ng) from *N. gonorrhoeae*:

```
m312/g312

                      10        20        30        40        50        60
m312.pep      MSIQSGEILETVKMVADQNFDVRTITIGIDLHDCISSDINVLNQNIYNKITTVGKDLVTT
              |||||||||||||||||:||||||||||||||||||:||:||||||||||||||||||:|
g312          MSIQSGEILETVKMVADRNFDVRTITIGIDLHDCISTDIDVLNQNIYNKITTVGKDLVAT
                      10        20        30        40        50        60
                      70        80        90       100       110       120
m312.pep      AKYLSAKYGVPIVNQRISVTPIAQIAAATHADSYVSVAQTLDKAAKAIGVSFIGGFSALV
              ||:||||||||||||||||||||||||||:||||||||||||||||||||||||||||||
g312          AKHLSAKYGVPIVNQRISVTPIAQIAAATKADSYVSVAQTLDKAAKAIGVSFIGGFSALV
                      70        80        90       100       110       120
                     130       140       150       160       170       180
m312.pep      QKGMSPSDEVLIRSIPEAMKTTDIVCXSINIGSTRAGINMDAVKLAGETVKRTAEITPEG
              ||||||||||||||:||||||||||| |||||||||||||||||||||||:|||||||||
g312          QKGMSPSDEVLIRSVPEAMKTTDIVCSSINIGSTRAGINMDAVKLAGETIKRTAEITPEG
                     130       140       150       160       170       180
                     190       200         210       220       230
m312.pep      FGCAKIVVFCNAVEDNPFXAGAFHGSG--DAVINVGVSGPGVVKAALENSDATTLTEVAE
              |||||||||||||||||| ||||||||  |||||||||||||||||||||||::||||||
g312          FGCAKIVVFCNAVEDNPFMAGAFHGSGEADAVINVGVSGPGVVKAALENSDAVSLTEVAE
                     190       200       210       220       230       240
             240       250       260       270         280       290
m312.pep      VVKKTAFKITRVGELIGREASKMLNIPFGILDLS--PTPPVGDSVARILEEMGLSVCGTH
              ||||||||||||||||||||||||||||||||||  ||| ||||||||||||||||||||
g312          VVKKTAFKITRVGELIGREASKMLNIPFGILDLSLAPTPAVGDSVARILEEMGLSVCGTH
                     250       260       270       280       290       300
               300       310       320       330       340       350
m312.pep      GTTAALALLNDAVKKGGMMASSAVGGLSGAFIPVSEDEGMIXAAEAGVLTLDKLEAMTAV
              ||||||||||||||||||||||||||||||||||||||||| ||||||||||||||||||
g312          GTTAALALLNDAVKKGGMMASSAVGGLSGAFIPVSEDEGMIAAAEAGVLTLDKLEAMTAV
                     310       320       330       340       350       360
               360       370       380       390       400       410
m312.pep      CSVGLDMIAVPGDTPAHTISGIIADEAAIGMINSKTTAVRIIPVTGKTVGDTVEFGGLLG
              |||||||||||||||||||||||||||||||||||||||||||||||||||:||||||||
g312          CSVGLDMIAVPGDTPAHTISGIIADEAAIGMINSKTTAVRIIPVTGKTVGDSVEFGGLLG
                     370       380       390       400       410       420
               420       430       440
m312.pep      YAPVMPVKEGSCEVFVNRGGRIPAPVQSMKNX
              ||||||:|||||||||||||||||||||||||
g312          YAPVMPAKEGSCEVFVNRGGRIPAPVQSMKNX
                     430       440       450
```

The following partial DNA sequence was identified in *N. meningitidis* <SEQ ID 1305>:

```
a312.seq
  1 ATGAGTATCC AATCCGGCGA AATTTTAGAA ACCGTCAAAA TGGTTGCCGA

 51 CCAGAATTTC GATGTCCGCA CCATTACCAT CGGCATTGAT TTGCACGACT

101 GCATCAGCAC CGACATCGAC GTGTTGAACC AAAATATTTA CAACAAAATT

151 ACCACGGTCG GCAAAGACTT GGTGGCGACA GCAAAATATC TGTCTGCCAA
```

-continued

```
 201 ATACGGCGTG CCGATTGTGA ATCAGCGCAT TTCTGTCACG CCGATTGCCC
 251 AAATCGCGGC GGCCACCCAT GCTGATTCTT ACGTCAGCGT GGCGCAAACT
 301 TTGGATAAGG CTGCCAAAGC CATCGGCGTG TCTTTTATTG GCGGCTTTTC
 351 CGCGCTGGTG CAAAAAGGTA TGTCGCCTTC TGACGAGGTG TTAATCCGTT
 401 CCATTCCCGA AGCGATGAAG ACTACTGATA TCGTGTGCAG CTCCATCAAT
 451 ATCGGCAGTA CGCGCGCCGG TATCAATATG GACGCGGTCA GACTGGCGGG
 501 CGAAACCATC AAACGCACGG CTGAAATCAC ACTAGAAGGT TTCGGCTGCG
 551 CCAAAATCGT CGTGTTCTGC AACGCGGTGG AAGACAACCC GTTTATGGCG
 601 GGCGCGTTTC ACGGCTCAGG CGAAGCGGAT GCTGTGATTA ATGTCGGCGT
 651 ATCCGGCCCG GGTGTCGTAA AAGCCGCGTT GGAAAATTCG GATGCAACGA
 701 CATTGACCGA AGTTGCCGAA GTTGTGAAGA AAACCGCCTT CAAAATTACC
 751 CGCGTGGGCG AACTCATCGG CCGCGAAGCC TCAAAAATGC TGAATATCCC
 801 GTTTGGTATT CTCGACTTGT CGCTGGCACC GACCCCTGCC GTCGGCGACT
 851 CGGTGGCGCG CATTCTTGAA GAAATGGGTT TGAGCGTCTG CGGTACGCAC
 901 GGCACAACAG CAGCTTTGGC ATTGCTGAAC GATGCCGTGA AAAAGGGCGG
 951 CATGATGGCT TCGAGCGCGG TTGGCGGTTT GAGTGGCGCG TTTATCCCCG
1001 TTTCCGAAGA CGAAGGTATG ATTGCCGCCG CCGAAGCAGG CGTGCTGACG
1051 TTGGATAAAC TCGAAGCGAT GACCGCCGTT TGTTCGGTCG GCTTGGATAT
1101 GATTGCCGTT CCCGGCGACA CACCCGCGCA CACCATTTCC GGCATCATTG
1151 CCGACGAAGC CGCCATCGGC ATGATCAACA GCAAAACCAC TGCCGTGCGC
1201 ATTATTCCGG TAACCGGTAA AACCGTCGGC GACAGCGTCG AGTTCGGCGG
1251 CCTGTTGGGC TACGCGCCTG TAATGCCGGT AAAAGAAGGC TCATGCGAAG
1301 TGTTCGTCAA CCGGGGCGGC AGGATTCCCG CACCGGTTCA ATCGATGAAA
1351 AACTGA
```

This corresponds to the amino acid sequence <SEQ ID 1306; ORF 312.a>:

```
a312.pep
  1 MSIQSGEILE TVKMVADQNF DVRTITIGID LHDCISTDID VLNQNIYNKI
 51 TTVGKDLVAT AKYLSAKYGV PIVNQRISVT PIAQIAAATH ADSYVSVAQT
101 LDKAAKAIGV SFIGGFSALV QKGMSPSDEV LIRSIPEAMK TTDIVCSSIN
151 IGSTRAGINM DAVRLAGETI KRTAEITLEG FGCAKIVVFC NAVEDNPFMA
201 GAFHGSGEAD AVINVGVSGP GVVKAALENS DATTLTEVAE VVKKTAFKIT
251 RVGELIGREA SKMLNIPFGI LDLSLAPTPA VGDSVARILE EMGLSVCGTH
301 GTTAALALLN DAVKKGGMMA SSAVGGLSGA FIPVSEDEGM IAAAEAGVLT
351 LDKLEAMTAV CSVGLDMIAV PGDTPAHTIS GIIADEAAIG MINSKTTAVR
401 IIPVTGKTVG DSVEFGGLLG YAPVMPVKEG SCEVFVNRGG RIPAPVQSMK
451 N*
```

m312/a312 96.7% identity in 451 aa overlap

```
                    10        20        30        40        50        60
m312.pep    MSIQSGEILETVKMVADQNFDVRTITIGIDLHDCISSDINVLNQNIYNKITTVGKDLVTT
            |||||||||||||||||||||||||||||||||||:||:|||||||||||||||||||:|
a312        MSIQSGEILETVKMVADRNFDVRTITIGIDLHDCISTDIDVLNQNIYNKITTVGKDLVAT
                    10        20        30        40        50        60

                    70        80        90       100       110       120
m312.pep    AKYLSAKYGVPIVNQRISVTPIAQIAAATHADSYVSVAQTLDKAAKAIGVSFIGGFSALV
            ||||||||||||||||||||||||||||||||||||||||||||||||||||||||||||
a312        AKYLSAKYGVPIVNQRISVTPIAQIAAATHADSYVSVAQTLDKAAKAIGVSFIGGFSALV
                    70        80        90       100       110       120

                   130       140       150       160       170       180
m312.pep    QKGMSPSDEVLIRSIPEAMKTTDIVCXSINIGSTRAGINMDAVKLAGETVKRTAEITPEG
            |||||||||||||||||||||||||| ||||||||||||||||:|||||:||||||| ||
a312        QKGMSPSDEVLIRSIPEAMKTTDIVCSSINIGSTRAGINMDAVRLAGETIKRTAEITLEG
                   130       140       150       160       170       180

                   190       200         210       220       230
m312.pep    FGCAKIVVFCNAVEDNPFXAGAFHGSG--DAVINVGVSGPGVVKAALENSDATTLTEVAE
            |||||||||||||||||| ||||||||  |||||||||||||||||||| |  ||||||
a312        FGCAKIVVFCNAVEDNPFMAGAFHGSGEADAVINVGVSGPGVVKAALENSDATTLTEVAE
                   190       200       210       220       230       240

          240       250       260       270         280       290
m312.pep    VVKKTAFKITRVGELIGREASKMLNIPFGILDLS--PTPPVGDSVARILEEMGLSVCGTH
            ||||||||||||||||||||||||||||||||||  ||| |||||||||||||||||||
a312        VVKKTAFKITRVGELIGREASKMLNIPFGILDLSLAPTPAVGDSVARILEEMGLSVCGTH
                   250       260       270       280       290       300

           300       310       320       330       340       350
m312.pep    GTTAALALLNDAVKKGGMMASSAVGGLSGAFIPVSEDEGMIXAAEAGVLTLDKLEAMTAV
            ||||||||||||||||||||||||||||||||||||||||| ||||||||||||||||||
a312        GTTAALALLNDAVKKGGMMASSAVGGLSGAFIPVSEDEGMIAAAEAGVLTLDKLEAMTAV
                   310       320       330       340       350       360

           360       370       380       390       400       410
m312.pep    CSVGLDMIAVPGDTPAHTISGIIADEAAIGMINSKTTAVRIIPVTGKTVGDTVEFGGLLG
            ||||||||||||||||||||||||||||||||||||||||||||||||||:|||||||||
a312        CSVGLDMIAVPGDTPAHTISGIIADEAAIGMINSKTTAVRIIPVTGKTVGDSVEFGGLLG
                   370       380       390       400       410       420

           420       430       440
m312.pep    YAPVMPVKEGSCEVFVNRGGRIPAPVQSMKNX
            ||||||||||||||||||||||||||||||||
a312        YAPVMPVKEGSCEVFVNRGGRIPAPVQSMKNX
                   430       440       450
```

The following partial DNA sequence was identified in *N. gonorrhoeae* <SEQ ID 1307>:

```
g313.seq
   1 atggacgacc cgcgcaccta cggatcgggc aatcccggcg cgaccaatgt

  51 tttacgcagc ggcaaaaaaa aggcggccgc gctgacgctc ttgggcgatg

 101 ccgccaaagg tttggttgcc gttttgcttg cacgcgtgct tcaagaaccg

 151 ctcggtttat ccgacagcgc aatcgccgcc gtcgcactcg ccgcgctggt

 201 cgggcatatg tggccggtgt ttttcggatt taagggcggc aaaggcgtgg

 251 caacggcatt gggcgtgctt ctggcactct ctcctgcaac tgccttggtc

 301 tgcgcgttga tttggcttgt gatggcattc ggcttcaaag tatcctccct

 351 tgccgcgctg gtcgccacaa ccgccgcccc ccttgccgca ctgtttttta

 401 tgccgcatac ttcttggatt ttcgcaaccc tcgcaatcgc catattggtg

 451 ttgctccgcc ataagagcaa catcctcaac ctgattaaag gcaaagaaag

 501 caaaatcggc gaaaaacgct ga
```

This corresponds to the amino acid sequence <SEQ ID 1308; ORF 313.ng>:

```
g313.pep
   1 MDDPRTYGSG NPGATNVLRS GKKKAAALTL LGDAAKGLVA VLLARVLQEP

  51 LGLSDSAIAA VALAALVGHM WPVFFGFKGG KGVATALGVL LALSPATALV

 101 CALIWLVMAF GFKVSSLAAL VATTAAPLAA LFFMPHTSWI FATLAIAILV

 151 LLRHKSNILN LIKGKESKIG EKR*
```

The following partial DNA sequence was identified in *N. meningitidis* <SEQ ID 1309>:

```
m313.seq
   1 ATGGACGACC CGCGCACCTA CGGATCGGGC AATCCGGGGG CAACCAATGT

  51 TTTACGCAGC GGCAAAAAAA AGGCGGCCGC GCTGACGCTC TTGGGCGATG

 101 CCGCCAAAGG TTTAGTTGCC GTTTTGCTTG CACGCGTGCT TCAAGAACCG

 151 CTCGGTTTAT CCGACAGCGC AATCGCGGCC GTCGCACTCG CCGCGCTGGT

 201 CGGGCATATG TGGCCGGTGT TTTTCGGATT TAAAGGCGGC AAAGGCGTGG

 251 CAACGGCATT GGGCGTGCTT CTGGCACTCT CTCCCGCAAC TGCCTTGGTC

 301 TGCGCGTTGA TTTGGCTTGT TATGGCATTC GGCTTCAAGG TGTCCTCCCT

 351 TGCCGCATTA ACCGCCACAA TCGCCGCACC GGTCGCCGCA TCCTTCTTTA

 401 TGCCGCACGT CTCGTGGGTT TGGGCGACCG TCGCCATTGC TTTGCTGGTG

 451 TTGTTCCGCC ACAAAAGTAA TATCGTCAAG CTGCTCGAAG GCAGAGAAAG

 501 CAAAATCGGC GGCAGCCGCT GA
```

This corresponds to the amino acid sequence <SEQ ID 1310; ORF 313>:

```
m313.pep
   1 MDDPRTYGSG NPGATNVLRS GKKKAAALTL LGDAAKGLVA VLLARVLQEP

  51 LGLSDSAIAA VALAALVGHM WPVFFGFKGG KGVATALGVL LALSPATALV

 101 CALIWLVMAF GFKVSSLAAL TATIAAPVAA SFFMPHVSWV WATVAIALLV

 151 LFRHKSNIVK LLEGRESKIG GSR*
```

Computer analysis of this amino acid sequence gave the following results:

Homology with a Predicted ORF from *N. gonorrhoeae*

ORF 313 shows 90.2% identity over a 173 aa overlap with a predicted ORF (ORF 313.ng) from *N. gonorrhoeae*:

```
m313/g313

                   10        20        30        40        50        60
m313.pep   MDDPRTYGSGNPGATNVLRSGKKKAAALTLLGDAAKGLVAVLLARVLQEPLGLSDSAIAA
           ||||||||||||||||||||||||||||||||||||||||||||||||||||||||||||
g313       MDDPRTYGSGNPGATNVLRSGKKKAAALTLLGDAAKGLVAVLLARVLQEPLGLSDSAIAA
                   10        20        30        40        50        60

                   70        80        90       100       110       120
m313.pep   VALAALVGHMWPVFFGFKGGKGVATALGVLLALSPATALVCALIWLVMAFGFKVSSLAAL
           ||||||||||||||||||||||||||||||||||||||||||||||||||||||||||||
g313       VALAALVGHMWPVFFGFKGGKGVATALGVLLALSPATALVCALIWLVMAFGFKVSSLAAL
                   70        80        90       100       110       120
```

-continued

```
                  130        140        150        160        170
m313.pep TATIAAPVAASFFMPHVSWVWATVAIALLVLFRHKSNIVKLLEGRESKIGGSRX
         :|| |||:|| |||||:||::||:|||:|||:||||||::|::|:||||| :||
g313     VATTAAPLAALFFMPHTSWIFATLAIAILVLLRHKSNILNLIKGKESKIGEKRX
                  130        140        150        160        170
```

The following partial DNA sequence was identified in *N. meningitidis* <SEQ ID 1311>:

```
a313.seq
  1 ATGGACGACC CGCGCACCTA CGGATCGGGC AATCCGGGGG CAACCAATGT

 51 TTTACGCAGC GGCAAAAAAA AGGCGGCCGC GCTGACGCTC TTGGGCGATG

101 CCGCCAAAGG TTTGGTTGCC GTTTTGCTTG CACGCGTGCT TCAAGAACCG

151 CTCGGTTTAT CCGACAGCGC AATCGCGGCC GTCGCACTCG CCGCGCTGGT

201 CGGGCATATG TGGCCGGTGT TTTTCGGATT TAAAGGCGGC AAAGGCGTGG

251 CAACGGCATT GGGCGTGCTT CTGGCACTCT CTCCCACAAC TGCCTTGGTC

301 TGCGCGTTGA TTTGGCTTGT GATGGCATTC GGCTTCAAGG TGTCCTCCCT

351 TGCCGCATTA ACCGCCACAA TCGCCGCCCC CCTTGCCGCA CTGTTTTTTA

401 TGCCGCATAC TTCTTGGATT TTCGCAACCC TCGCAATCGC CATATTGGTG

451 TTGCTCCGCC ATAAGAGCAA CATCCTCAAC CTGATTAAAG GCAAAGAAAG

501 CAAAATCGGC GAAAAACGCT GA
```

This corresponds to the amino acid sequence <SEQ ID 1312; ORF 313.a>:

```
a313.pep
  1 MDDPRTYGSG NPGATNVLRS GKKKAAALTL LGDAAKGLVA VLLARVLQEP

 51 LGLSDSAIAA VALAALVGHM WPVFFGFKGG KGVATALGVL LALSPTTALV

101 CALIWLVMAF GFKVSSLAAL TATIAAPLAA LFFMPHTSWI FATLAIAILV

151 LLRHKSNILN LIKGKESKIG EKR*
```

m313/a313 90.8% identity in 173 aa overlap

```
                   10        20        30        40        50        60
m313.pep  MDDPRTYGSGNPGATNVLRSGKKKAAALTLLGDAAKGLVAVLLARVLQEPLGLGLSDSAIAA
          |||||||||||||||||||||||||||||||||| :||||||||||||||||||||||||
a313      MDDPRTYGSGNPGATNVLRSGKKKAAALTLLGDAAKGLVAVLLARVLQEPLGLGLSDSAIAA
                   10        20        30        40        50        60

                   70        80        90       100       110       120
m313.pep  VALAALVGHMWPVFFGFKGGKGVATALGVLLALSPATALVCALIWLVMAFGFKVSSLAAL
          |||||||||||||||||||||||||||||||||||:||||||||||||||||||||||||
a313      VALAALVGHMWPVFFGFKGGKGVATALGVLLALSPTTALVCALIWLVMAFGFKVSSLAAL
                   70        80        90       100       110       120

                  130       140       150       160       170
m313.pep  TATIAAPVAASFFMPHVSWVWATVAIALLVLFRHKSNIVKLLEGRESKIGGSRX
          |||||||:|| |||||:||::||:|||:|||:||||||::|::|:||||| :||
a313      TATIAAPLAALFFMPHTSWIFATLAIAILVLLRHKSNILNLIKGKESKIGEKRX
                  130       140       150       160       170
```

The following partial DNA sequence was identified in *N. gonorrhoeae* <SEQ ID 1313>:

```
g401.seq
 1  atgaaattac aacaattggc tgaagaaaaa atcggcgttc tgattgtgtt
```

-continued

```
 51 cacgctgctt gtagtcagtg tcggtctgtt gattgaagtt gtgcccttgg

101 cctttaccaa ggcggcaaca cagccggcgc cgggcgtgaa gccttacaat

151 gccctgcagg ttgccggacg cgatatttac atccgtgagg gctgttacaa

201 ctgccactct caaatgattc gtccgttccg tgcggaaacc gagcgttacg

251 gtcattactc tgttgccgga gagtcggttt acgaccatcc gttccaatgg

301 ggttccaaac gtaccggtcc tgatttggca cgtgtgggcg gccgctattc

351 cgacgaatgg caccgcatcc acctgctgaa tccccgtgat gtcgtgcctg

401 agtccaatat gccggcattc ccgtggcttg cacgcaataa agtcgatgtc

451 gatgcaaccg ttgccaacat gaaggctttg cgtaaagtag gtactcctta

501 cagtgatgag gaaattgcga aagcgcctga ggctttggca aacaaatccg

551 agctggatgc tgtagtcgcc tatctgcaag gattgggtct ggctttgaaa

601 aacgtaaggt aa
```

This corresponds to the amino acid sequence <SEQ ID 1314; ORF 401.ng>:

```
g401.pep
  1 MKLQQLAEEK IGVLIVFTLL VVSVGLLIEV VPLAFTKAAT QPAPGVKPYN

 51 ALQVAGRDIY IREGCYNCHS QMIRPFRAET ERYGHYSVAG ESVYDHPFQW

101 GSKRTGPDLA RVGGRYSDEW HRIHLLNPRD VVPESNMPAF PWLARNKVDV

151 DATVANMKAL RKVGTPYSDE EIAKAPEALA NKSELDAVVA YLQGLGLALK

201 NVR*
```

The following partial DNA sequence was identified in *N. meningitidis* <SEQ ID 1315>:

```
m401.seq
  1 ATGAAATTAC AaCAATTGGC TGAAGAAAAA ATCGGCGTTC TGATTGTGTT

 51 CACGCTGCTT GTAGTCAGTG TCGGTCTGTT GATTGAAGTT GTGCCCTTGG

101 CCTTTACCAA GGCGGCAACA CAGCCGGCGC CGGGCGTGAA GCCTTACAAT

151 GCCCTGCAGG TTGCCGGACG CGATATTTAC ATCCGTGAGG GCTGTTACAA

201 CTGCCACTCG CAAATGATTC GTCCGTTCCG TGCGGAAACC GAGCGTTACG

251 GTCATTACTC TGTTGCCGGA GAGTCGGTTT ACGACCATCC GTTCCAATGG

301 GGTTCCAAAC GTACCGGTCC TGATTTGGCA CGTGTGGGCG GTCGCTATTC

351 CGACGAATGG CACCGTATCC ACCTGCTGAA TCCCCGTGAT GTCGTGCCTG

401 AGTCCAATAT GCCGGCATTC CCGTGGCTTG CACGCAATAA AGTCGATGTC

451 GATGCAACCG TTGCCAACAT GAAGGCTTTG CGTAAAGTAG GTACTCCTTA

501 CAGTGATGAG GAAATTGCGA AAGCACCTGA GGCTTTGGCA AACAAATCCG

551 AGCTGGATGC TGTAGTCGCC TATCTGCAAG GATTGGGTCT GGCTTTGAAA

601 AACGTAAGGT AA
```

This corresponds to the amino acid sequence <SEQ ID 1316; ORF 401>:

```
m401.pep
 1  MKLQQLAEEK IGVLIVFTLL VVSVGLLIEV VPLAFTKAAT QPAPGVKPYN
```

-continued

```
 51 ALQVAGRDIY IREGCYNCHS QMIRPFRAET ERYGHYSVAG ESVYDHPFQW

101 GSKRTGPDLA RVGGRYSDEW HRIHLLNPRD VVPESNMPAF PWLARNKVDV

151 DATVANMKAL RKVGTPYSDE EIAKAPEALA NKSELDAVVA YLQGLGLALK

201 NVR*
```

Computer analysis of this amino acid sequence gave the following results:

Homology with a Predicted ORF from *N. gonorrhoeae*

ORF 401 shows 100.0% identity over a 203 aa overlap with a predicted ORF (ORF 401.ng) from *N. gonorrhoeae*:

```
m401/g401

                    10        20        30        40        50        60
m401.pep    MKLQQLAEEKIGVLIVFTLLVVSVGLLIEVVPLAFTKAATQPAPGVKPYNALQVAGRDIY
            ||||||||||||||||||||||||||||||||||||||||||||||||||||||||||||
g401        MKLQQLAEEKIGVLIVFTLLVVSVGLLIEVVPLAFTKAATQPAPGVKPYNALQVAGRDIY
                    10        20        30        40        50        60
                    70        80        90       100       110       120
m401.pep    IREGCYNCHSQMIRPFRAETERYGHYSVAGESVYDHPFQWGSKRTGPDLARVGGRYSDEW
            ||||||||||||||||||||||||||||||||||||||||||||||||||||||||||||
g401        IREGCYNCHSQMIRPFRAETERYGHYSVAGESVYDHPFQWGSKRTGPDLARVGGRYSDEW
                    70        80        90       100       110       120
                   130       140       150       160       170       180
m401.pep    HRIHLLNPRDVVPESNMPAFPWLARNKVDVDATVANMKALRKVGTPYSDEEIAKAPEALA
            ||||||||||||||||||||||||||||||||||||||||||||||||||||||||||||
g401        HRIHLLNPRDVVPESNMPAFPWLARNKVDVDATVANMKALRKVGTPYSDEEIAKAPEALA
                   130       140       150       160       170       180
                   190       200
m401.pep    NKSELDAVVAYLQGLGLALKNVRX
            |||||||||||||||||||||||
g401        NKSELDAVVAYLQGLGLALKNVRX
                   190       200
```

The following partial DNA sequence was identified in *N. meningitidis* <SEQ ID 1317>:

```
a401.seq
  1 ATGAAATTAC AACAATTGGC TGAAGAAAAA ATCGGCGTTC TGATTGTGTT

 51 CACGCTGCTT GTAGTCAGTG TCGGTCTGTT GATTGAAGTT GTGCCCTTGG

101 CCTTTACCAA GGCGGCAACA CAGCCGGCGT CGGGCGTGAA GCCTTACAAT

151 GCCCTGCAGG TTGCCGGACG CGATATTTAC ATCCGTGAGG GCTGTTACAA

201 CTGCCACTCG CAAATGATTC GTCCGTTCCG TGCGGAAACC GAGCGTTACG

251 GTCATTACTC TGTTGCCGGA GAGTCGGTTT ACGACCATCC GTTCCAATGG

301 GGTTCCAAAC GTACCGGTCC TGATTTGGCA CGTGTGGGCG GTCGCTATTC

351 CGACGAATGG CACCGTATCC ACCTGCTGAA TCCCCGTGAT GTCGTGCCTG

401 AGTCCAATAT GCCGGCATTC CCGTGGCTTG CACGCAATAA AGTCGATGTC

451 GATGCAACCG TTGCCAACAT GAAGGCTTTG CGTAAAGTAG GTACTCCTTA

501 CAGTGATGAG GAAATTGCGA AAGCGCCTGA GGCTTTGGCA AACAAATCCG

551 AGCTGGATGC TGTAGTCGCC TATCTGCAAG GATTGGGTCT GGCTTTGAAA

601 AACGTAAGGT AA
```

This corresponds to the amino acid sequence <SEQ ID 1318; ORF 401.a>:

```
a401.pep
   1 MKLQQLAEEK IGVLIVFTLL VVSVGLLIEV VPLAFTKAAT QPASGVKPYN

  51 ALQVAGRDIY IREGCYNCHS QMIRPFRAET ERYGHYSVAG ESVYDHPFQW

 101 GSKRTGPDLA RVGGRYSDEW HRIHLLNPRD VVPESNMPAF PWLARNKVDV

 151 DATVANMKAL RKVGTPYSDE EIAKAPEALA NKSELDAVVA YLQGLGLALK

 201 NVR*
```

m401/a401 99.5% identity in 203 aa overlap

```
                     10        20        30        40        50        60
m401.pep    MKLQQLAEEKIGVLIVFTLLVVSVGLLIEVVPLAFTKAATQPAPGVKPYNALQVAGRDIY
            |||||||||||||||||||||||||||||||||||||||||| |||||||||||||||||
a401        MKLQQLAEEKIGVLIVFTLLVVSVGLLIEVVPLAFTKAATQPASGVKPYNALQVAGRDIY
                     10        20        30        40        50        60
                     70        80        90       100       110       120
m401.pep    IREGCYNCHSQMIRPFRAETERYGHYSVAGESVYDHPFQWGSKRTGPDLARVGGRYSDEW
            ||||||||||||||||||||||||||||||||||||||||||||||||||||||||||||
a401        IREGCYNCHSQMIRPFRAETERYGHYSVAGESVYDHPFQWGSKRTGPDLARVGGRYSDEW
                     70        80        90       100       110       120
                    130       140       150       160       170       180
m401.pep    HRIHLLNPRDVVPESNMPAFPWLARNKVDVDATVANMKALRKVGTPYSDEEIAKAPEALA
            ||||||||||||||||||||||||||||||||||||||||||||||||||||||||||||
a401        HRIHLLNPRDVVPESNMPAFPWLARNKVDVDATVANMKALRKVGTPYSDEEIAKAPEALA
                    130       140       150       160       170       180
                    190       200
m401.pep    NKSELDAVVAYLQGLGLALKNVRX
            ||||||||||||||||||||||||
a401        NKSELDAVVAYLQGLGLALKNVRX
                    190       200
```

The following partial DNA sequence was identified in *N. gonorrhoeae* <SEQ ID 1319>:

```
g402.seq
   1  ATGGATATGG TGAACACTAA Accgaatact agtgtgatta atatgctttc

  51  tttccttacc ggatTATTGA GCTTGGGTat agaagtCtTg tGGGTAAGGA

 101  TGttttcgTT CGCagcAcag tccgtgcctc aggCATTTTC atttattctt

 151  gcctGttttc tgACCGgtat cgccgtcggc gCgTATTTTG GCAAACGGAT

 201  TTGCCGCAGC CGCTTTGTTG ATATTCCctT TATCGGGCAG TgcttcttgT

 251  GGGCGGGTAT TgccgaTttt ttgatTTTGG GTGCTGCGTG GTTGTTGACG

 301  GGTTTTTccg gtttcGTCCA CCACGCCGGT AtttTCATTA CCCTgtctgc

 351  CGtcGTCAGG GGGTTGATTT TCCCACTTGT ACACCATgtg GGTACGGATG

 401  GCAACAAATC CGGACGACAG GTTTCCAATG TTTATTTCGC CAACGTTGCC

 451  GGCAGTGCAT TGGGTCCGGT CCTTATCGGC TTTGTGATAC TTGATttgtt

 501  gTCCACCCAA CAGATTtacc tgctcatCTG TTTGATTTCT GCTGCtgtcc

 551  cTTTGTTTTg tacaCTGtTC CAAAAAAGTC TCCGACTGAA TGCAGTGTCG

 601  GTAGCAGTTT CCCTAATGTT CGGCATCCTC ATGTTCCTAC TGCCGGATTC

 651  TGTCTTTCAA AATATTGCTG GCCGTCCGGA TAGGTTGATT GAAAACAAAC

 701  ACGGCATTGT TGCGGTTTAC CATAGAGATG GTGATAAGGT TGTTTATGGG

 751  GCGAATGTAT ACGACGGCGC ATACAATACC GATATATTCA ATAGTGTCAA
```

-continued

801 CGGCATCGAA CGTGCCTATC TGCTACCCTC CCTGAAGTCC GGCATACGCC

851 GCATTTTCGT CGTTGGATTG AGTACAGGTT CGTGGGCGCG CGTCTTGTCT

901 GCCATTCCGG AAATGCAGTC GATGATCGTT GCGGAAATCA ATCCGGCATA

951 CCGTAGCCTT ATCGCGGAcg agccgcAAAT CGCACCGCTT TTGCAGGACA

1001 AACGTGTTGA AATTGTATTG GATGACGGTA GGAAATGGCT GCGTCGCCAT

1051 CCTGATGAAA AATTCGACCT GATTTTGATG AATTCGACTT GGTACTGGCG

1101 TGCCTATTCC ACTAACCTGT TGAGTGCGGA ATTTTTAAAA CAGGTGCAAA

1151 GCCACCTTAC CCCGGATGGT ATTGTAATGT TTAATACCAC GCACAGCCCG

1201 CATgctTTTG CTACCGCCGT ACACAGTATT CCCTATGCAT ACCGCTACGG

1251 GCATATGGTA GTCGGCTCGG CAACCCCGGT AGTTTTCcct AATAAAGAAC

1301 TGCTCaagca aCGCCTTTcc cgGTTGATTT GGCCGGAAAG CGGCAGgcac 1351 gtATTTGACA GCAGCACCGT GGATGCTGCA GCACAAAAGG TTGtctctCG 1401 TATGCTGATT CGGATGACGG AAcctTCGGC TGGGGCGGAA GTCATTACTG

1451 ACGATAATAT GATTGTAGAA TACAAATACG GCAGAGGGAT TTAA

This corresponds to the amino acid sequence <SEQ ID 1320; ORF 402.ng>:

g402.pep

1 MDMVNTKPNT SVINMLSFLT GLLSLGIEVL WVRMFSFAAQ SVPQAFSFIL

51 ACFLTGIAVG AYFGKRICRS RFVDIPFIGQ CFLWAGIADF LILGAAWLLT

101 GFSGFVHHAG IFITLSAVVR GLIFPLVHHV GTDGNKSGRQ VSNVYFANVA

151 GSALGPVLIG FVILDLLSTQ QIYLLICLIS AAVPLFCTLF QKSLRLNAVS

201 VAVSLMFGIL MFLLPDSVFQ NIAGRPDRLI ENKHGIVAVY HRDGDKVVYG

251 ANVYDGAYNT DIFNSVNGIE RAYLLPSLKS GIRRIFVVGL STGSWARVLS

301 AIPEMQSMIV AEINPAYRSL IADEPQIAPL LQDKRVEIVL DDGRKWLRRH

351 PDEKFDLILM NSTWYWRAYS TNLLSAEFLK QVQSHLTPDG IVMFNTTHSP

401 HAFATAVHSI PYAYRYGHMV VGSATPVVFP NKELLKQRLS RLIWPESGRH

451 VFDSSTVDAA AQKVVSRMLI RMTEPSAGAE VITDDNMIVE YKYGRGI*

The following partial DNA sequence was identified in *N. meningitidis* <SEQ ID 1321>:

m402.seq

1 ATGGATATAG TGAACACTAA ACCGAATACT AGTTTGATTT ATATGCnTTC

51 TTTCCTTAGC GGCTTATTGA GCTTGGGTAT AGAAGTCTTG TGGGTGAGGA

101 TGTTTTCGTT CGCAGCACAG TCCGTGCCTC AGGCATTTTC ATTTACCCTT

151 GCCTGTTTTC TGACCGGTAT CGCCGTCGGC GCGTATTTTG GCAAACGGAT

201 TTGCCGCAGC CGCTTTGTTG ATATTCCCTT TATCGGGCAG TGCTTCTTGT

251 GGGCGGGTAT TGCCGACTTT TTGATTTTGG GTGCTGCGTG GTTGTTGACG

301 GGTTTTTCCG GCTTCGTCCA CCACGCCGGT ATCTTCATTA CCCTGTCTGC

351 CGTCGTCAsA sGGTTGATTT TCCCGCTCGT ACACCATGTG GGTACGGATG

401 GCAACAAATC CGGACGACAG GTTTCCAATG TTTATTTCGC CAmCGTTGCC

451 GGCAGTGCAT TGGGTCCGGT CCTTATCGGC TTTGTGATAC TTGATTTCTT

-continued

```
 501 GTCCACCCAA CAGATTTACC TGCTCATCTG TwTGATTTCT GCTGCTGTCC

 551 CTTTGTTTTG TACACTGTTC CAAAAAAGTC TCCGACTGAA TGCAGTGTCG

 601 GTAGCAGTTT CCCTAATGTT CGGCATCCTC ATGTTCyTAC TGCCGGATTC

 651 TGTCTTTCAA AATATTGCTG ACCGTCCGGA TAgGCTGATT GAAAACAAAC

 701 ACGGCATTGT TGCGGTTTAC CATAGAGATG GTGATAAGGT TGTTTATGGG

 751 GCGAATGTAT ACGACGGCGC ATACAATACC GATGTATTCA ATAGTGTCAA

 801 CGGCATCGAA CGTGCCTATC TGCTACCCTC CCTGAAGTCT GGCATACGCC

 851 GCATTTTCGT CGTTGGACTG AGTACAGGTT CGTGGGCGCG CGTCTTGTCT

 901 GCCATTCCGG AAATGCAGTC GATGATCGTT GCGGAAATCA ATCCGGCATA

 951 CCGTAGCCTT ATCGCGGACG AGCCGCAAAT CGCCCCGCTT TTGCAGGACA

1001 AACGTGTTGA AATTGTATTG GATGACGGTA GGAAATGGCT GCGTCGCCAT

1051 CCTGATGAAA AATTCGACCT GATTTTGATG AATACGACTT GGTACTGGCG

1101 TGCCTATTCC ACCAACCTGT TGAGTGCGGA ATTTTTAAAA CAGGTGCAAA

1151 GCCACCTTAC CCCGGATGGT ATTGTAATGT TTAATACCAC GCACAGCCCG

1201 CATGCTTTTG CTACCGCCGT ACACAGTATT CCCTATGCAT ACCGCTATGG

1251 GCATATGGTA GTCGGCTCGG CAACCCCGGT AGTTTTCCCT AATAAAGAAC

1301 TGCTCAAGCA ACGTCTCTCC CGGTTGATTT GGCCGGAAAG CGGCAGGCAC

1351 GTATTTGACA GCAGCACCGT GGATGCTGCA GCACAAAAGG TTGTCTCTCG

1401 TATGCTGATT CAGATGACGG aAcCTTCGGC TGGGGCGGAA GTTATTACCG

1451 ACGATAATAT GATTGTAGAA TACAAATACG GCAGAGGGAT TTAA
```

This corresponds to the amino acid sequence <SEQ ID 1322; ORF 402>:

```
m402.pep
  1 MDIVNTKPNT SLIYMXSFLS GLLSLGIEVL WVRMFSFAAQ SVPQAFSFTL

 51 ACFLTGIAVG AYFGKRICRS RFVDIPFIGQ CFLWAGIADF LILGAAWLLT

101 GFSGFVHHAG IFITLSAVVX XLIFPLVHHV GTDGNKSGRQ VSNVYFAXVA

151 GSALGPVLIG FVILDFLSTQ QIYLLICXIS AAVPLFCTLF QKSLRLNAVS

201 VAVSLMFGIL MFLLPDSVFQ NIADRPDRLI ENKHGIVAVY HRDGDKVVYG

251 ANVYDGAYNT DVFNSVNGIE RAYLLPSLKS GIRRIFVVGL STGSWARVLS

301 AIPEMQSMIV AEINPAYRSL IADEPQIAPL LQDKRVEIVL DDGRKWLRRH

351 PDEKFDLILM NTTWYWRAYS TNLLSAEFLK QVQSHLTPDG IVMFNTTHSP

401 HAFATAVHSI PYAYRYGHMV VGSATPVVFP NKELLKQRLS RLIWPESGRH

451 VFDSSTVDAA AQKVVSRMLI QMTEPSAGAE VITDDNMIVE YKYGRGI*
```

Computer analysis of this amino acid sequence gave the following results:

Homology with a Predicted ORF from *N. gonorrhoeae*

ORF 402 shows 97.0% identity over a 497 aa overlap with a predicted ORF (ORF 402.ng) from *N. gonorrhoeae*:

```
m402/g402

                    10        20        30        40        50        60
m402.pep    MDIVNTKPNTSLIYMXSFLSGLLSLGIEVLWVRMFSFAAQSVPQAFSFTLACFLTGIAVG
            ||:||||||||:| | |||:||||||||||||||||||||||||||||| ||||||||||
g402        MDMVNTKPNTSVINMLSFLTGLLSLGIEVLWVRMFSFAAQSVPQAFSFILACFLTGIAVG
                    10        20        30        40        50        60

                    70        80        90       100       110       120
m402.pep    AYFGKRICRSRFVDIPFIGQCFLWAGIADFLILGAAWLLTGFSGFVHHAGIFITLSAVVX
            |||||||||||||||||||||||||||||||||||||||||||||||||||||||||||
g402        AYFGKRICRSRFVDIPFIGQCFLWAGIADFLILGAAWLLTGFSGFVHHAGIFITLSAVVR
                    70        80        90       100       110       120

                   130       140       150       160       170       180
m402.pep    XLIFPLVHHVGTDGNKSGRQVSNVYFAXVAGSALGPVLIGFVILDFLSTQQIYLLICXIS
             |||||||||||||||||||||||||| |||||||||||||||||:||||||||||| ||
g402        GLIFPLVHHVGTDGNKSGRQVSNVYFANVAGSALGPVLIGFVILDLLSTQQIYLLICLIS
                   130       140       150       160       170       180

                   190       200       210       220       230       240
m402.pep    AAVPLFCTLFQKSLRLNAVSVAVSLMFGILMFLLPDSVFQNIADRPDRLIENKHGIVAVY
            ||||||||||||||||||||||||||||||||||||||||||||| ||||||||||||||
g402        AAVPLFCTLFQKSLRLNAVSVAVSLMFGILMFLLPDSVFQNIAGRPDRLIENKHGIVAVY
                   190       200       210       220       230       240

                   250       260       270       280       290       300
m402.pep    HRDGDKVVYGANVYDGAYNTDVFNSVNGIERAYLLPSLKSGIRRIFVVGLSTGSWARVLS
            |||||||||||||||||||||:||||||||||||||||||||||||||||||||||||||
g402        HRDGDKVVYGANVYDGAYNTDIFNSVNGIERAYLLPSLKSGIRRIFVVGLSTGSWARVLS
                   250       260       270       280       290       300

                   310       320       330       340       350       360
m402.pep    AIPEMQSMIVAEINPAYRSLIADEPQIAPLLQDKRVEIVLDDGRKWLRRHPDEKFDLILM
            |||||||||||||||||||||||||| |||||||||||||||||||||||||||||||||
g402        AIPEMQSMIVAEINPAYRSLIADEPQIAPLLQDKRVEIVLDDGRKWLRRHPDEKFDLILM
                   310       320       330       340       350       360

                   370       380       390       400       410       420
m402.pep    NTTWYWRAYSTNLLSAEFLKQVQSHLTPDGIVMFNTTHSPHAFATAVHSIPYAYRYGHMV
            |:||||||||||||||||||||||||||||||||||||||||||||||||||||||||||
g402        NSTWYWRAYSTNLLSAEFLKQVQSHLTPDGIVMFNTTHSPHAFATAVHSIPYAYRYGHMV
                   370       380       390       400       410       420

                   430       440       450       460       470       480
m402.pep    VGSATPVVFPNKELLKQRLSRLIWPESGRHVFDSSTVDAAAQKVVSRMLIQMTEPSAGAE
            ||||||||||||||||||||||||||||||||||||||||||||||||||:|||||||||
g402        VGSATPVVFPNKELLKQRLSRLIWPESGRHVFDSSTVDAAAQKVVSRMLIRMTEPSAGAE
                   430       440       450       460       470       480

                   490
m402.pep    VITDDNMIVEYKYGRGIX
            |||||||||||||||||
g402        VITDDNMIVEYKYGRGI
                   490
```

The following partial DNA sequence was identified in *N. meningitidis* <SEQ ID 1323>:

```
a402.seq
     1  ATGGATATAG TGAACACTAA ACCGAATACT AGTTTGATTT ATATGCTTTC

    51  TTTCCTTAGC GGCTTATTGA GCTTGGGTAT AGAAGTCTTG TGGGTAAGGA

   101  TGTTTTCGTT CGCAGCACAG TCCGTGCCTC AGGCATTTTC ATTTACTCTT

   151  GCCTGTTTTC TGACCGGTAT CGCCGTCGGC GCGTATTTTG GCAAACGGAT

   201  TTGCCGCAGC CGCTTTGTTG ATATTCCCTT TATCGGGCAG TGCTTCTTGT
```

-continued

```
 251 GGGCGGGTAT TGCCGACTTT TTGATTTTGG GTGCTGCGTG GTTGTTGACG

 301 GGTTTTTCCG GCTTCGTCCA CCACGCCGGT ATCTTCATTA CCCTGTCTGC

 351 CGTCGTCAGA GGGTTGATTT TCCCGCTCGT ACACCATGTG GGTACGGATG

 401 GCAACAAATC CGGACGACAG GTTTCCAATG TTTATTTCGC CAACGTTGCC

 451 GGCAGTGCAT TGGGTCCGGT CCTTATCGGC TTTGTGATAC TTGATTTCTT

 501 GTCCACCCAA CAGATTTACC TGCTCATCTG TTTGATTTCT GCTGCTGTCC

 551 CTTTGTTTTG TACACTGTTC CAAAAAAGTC TCCGACTGAA TGCAGTGTCG

 601 GTAGCAGTTT CCCTAATGTT CGGCATCCTC ATGTTCCTAC TGCCGGATTC

 651 TGTCTTTCAA AATATTGCTG ACCGTCCGGA TAGGCTGATT GAAAACAAAC

 701 ACGGCATTGT TGCGGTTTAC CATAGAGATG GTGATAAGGT TGTTTATGGG

 751 GCGAATGTAT ACGACGGCGC ATACAATACC GATGTATTCA ATAGTGTCAA

 801 CGGCATCGAA CGTGCCTATC TGCTACCCTC CCTGAAGTCT GGCATACGCC

 851 GCATTTTCGT CGTTGGATTG AGTACAGGTT CGTGGGCGCG CGTCTTGTCT

 901 GCCATTCCGG AAATGCAGTC GATGATCGTT GCGGAAATCA ATCCGGCATA

 951 CCGTAGCCTT ATCGCGGACG AGCCGCAAAT CGCCCCGCTT TTGCAGGACA

1001 AACGTGTTGA AATTGTATTG GATGACGGTA GGAAATGGCT GCGTCGCCAT

1051 CCTGATGAAA AATTCGACCT GATTTTGATG AATACGACTT GGTACTGGCG

1101 TGCCTATTCC ACCAACCTGT TGAGTGCGGA ATTTTTAAAA CAGGTGCAAA

1151 GCCACCTTAC CCCGGATGGT ATTGTAATGT TTAATACCAC GCACAGCCCG

1201 CATGCTTTTG CTACCGCCGT ACACAGTATT CCCTATGCAT ACCGCTATGG

1251 GCATATGGTA GTCGGCTCGG CAACCCCGGT AGTTTTCCCT AATAAAGAAC

1301 TGCTCAAGCA ACGTCTCTCC CGGTTGATTT GGCCGGAAAG CGGCAGGCAC

1351 GTATTTGACA GCAGCACCGT GGATGCTGCA GCACAAAAGG TTGTCTCTCG

1401 TATGCTGATT CAGATGACGG AACCTTCGGC TGGTGCGGAA GTCATTACCG

1451 ACGATAATAT GATTGTAGAA TACAAATACG GCAGAGGGAT TTAA
```

This corresponds to the amino acid sequence <SEQ ID 1324; ORF 402.a>:

```
a402.pep
  1 MDIVNTKPNT SLIYMLSFLS GLLSLGIEVL WVRMFSFAAQ SVPQAFSFTL

 51 ACFLTGIAVG AYFGKRICRS RFVDIPFIGQ CFLWAGIADF LILGAAWLLT

101 GFSGFVHHAG IFITLSAVVR GLIFPLVHHV GTDGNKSGRQ VSNVYFANVA

151 GSALGPVLIG FVILDFLSTQ QIYLLICLIS AAVPLFCTLF QKSLRLNAVS

201 VAVSLMFGIL MFLLPDSVFQ NIADRPDRLI ENKHGIVAVY HRDGDKVVYG

251 ANVYDGAYNT DVFNSVNGIE RAYLLPSLKS GIRRIFVVGL STGSWARVLS

301 AIPEMQSMIV AEINPAYRSL IADEPQIAPL LQDKRVEIVL DDGRKWLRRH

351 PDEKFDLILM NTTWYWRAYS TNLLSAEFLK QVQSHLTPDG IVMFNTTHSP

401 HAFATAVHSI PYAYRYGHMV VGSATPVVFP NKELLKQRLS RLIWPESGRH

451 VFDSSTVDAA AQKVVSRMLI QMTEPSAGAE VITDDNMIVE YKYGRGI*
```

m402/a402 99.0% identity in 497 aa overlap

```
                 10        20        30        40        50        60
m402.pep MDIVNTKPNTSLIYMXSFLSGLLSLGIEVLWVRMFSFAAQSVPQAFSFTLACFLTGIAVG
         |||||||||||||| |||||||||||||||||||||||||||||||||||||||||||||
a402     MDDPRTYGSGNPGATLVLRSGKKKAAALTLLGDAAKGLVAVLLARVLQEPLGLSDSAIAA
                 10        20        30        40        50        60

                 70        80        90       100       110       120
m402.pep AYFGKRICRSRFVDIPFIGQCFLWAGIADFLILGAAWLLTGFSGFVHHAGIFITLSAVVX
         ||||||||||||||||||||||||||||||||||||||||||||||||||||||||||| 
a402     AYFGKRICRSRFVDIPFIGQCFLWAGIADFLILGAAWLLTGFSGFVHHAGIFITLSAVVR
                 70        80        90       100       110       120

                130       140       150       160       170       180
m402.pep XLIFPLVHHVGTDGNKSGRQVSNVYFAXVAGSALGPVLIGFVILDFLSTQQIYLLICXIS
          |||||||||||||||||||||||||| ||||||||||||||||||||||||||||| ||
a402     GLIFPLVHHVGTDGNKSGRQVSNVYFANVAGSALGPVLIGFVILDFLSTQQIYLLICLIS
                130       140       150       160       170       180

                190       200       210       220       230       240
m402.pep AAVPLFCTLFQKSLRLNAVSVAVSLMFGILMFLLPDSVFQNIADRPDRLIENKHGIVAVY
         ||||||||||||||||||||||||||||||||||||||||||||||||||||||||||||
a402     AAVPLFCTLFQKSLRLNAVSVAVSLMFGILMFLLPDSVFQNIADRPDRLIENKHGIVAVY
                190       200       210       220       230       240

                250       260       270       280       290       300
m402.pep HRDGDKVVYGANVYDGAYNTDVFNSVNGIERAYLLPSLKSGIRRIFVVGLSTGSWARVLS
         ||||||||||||||||||||||||||||||||||||||||||||||||||||||||||||
a402     HRDGDKVVYGANVYDGAYNTDVFNSVNGIERAYLLPSLKSGIRRIFVVGLSTGSWARVLS
                250       260       270       280       290       300

                310       320       330       340       350       360
m402.pep AIPEMQSMIVAEINPAYRSLIADEPQIAPLLQDKRVEIVLDDGRKWLRRHPDEKGDLILM
         ||||||||||||||||||||||||||||||||||||||||||||||||||||||||||||
a402     AIPEMQSMIVAEINPAYRSLIADEPQIAPLLQDKRVEIVLDDGRKWLRRHPDEKGDLILM
                310       320       330       340       350       360

                370       380       390       400       410       420
m402.pep NTTWYWRAYSTNLLSAEFLKQVQSHLTPDGIVMFNTTHSPHAFATAVHSIPYAYRYGHMV
         ||||||||||||||||||||||||||||||||||||||||||||||||||||||||||||
a402     NTTWYWRAYSTNLLSAEFLKQVQSHLTPDGIVMFNTTHSPHAFATAVHSIPYAYRYGHMV
                370       380       390       400       410       420

                430       440       450       460       470       480
m402.pep VGSATPVVFPNKELLKQRLSRLIWPESGRHVFDSSTVDAAAQKVVSRMLIQMTEPSAGAE
         ||||||||||||||||||||||||||||||||||||||||||||||||||||||||||||
a402     VGSATPVVFPNKELLKQRLSRLIWPESGRHVFDSSTVDAAAQKVVSRMLIQMTEPSAGAE
                430       440       450       460       470       480

                490
m402.pep VITDDNMIVEYKYGRGIX
         |||||||||||||||||
a402     VITDDNMIVEYKYGRGIX
                490
```

The following partial DNA sequence was identified in *N. gonorrhoeae* <SEQ ID 1325>:

```
g406.seq
   1 ATGCGGGCAC GGCTGCTGAT ACCTATTCTT TTTTCAGTTT TTATTTTATC

  51 CGCCTGCGGG ACACTGACAG GTATTCCATC GCATGGCGGA GGCAAACGCT

 101 TCGCGGTCGA ACAAGAACTT GTGGCCGCTT CTGCCAGAGC TGCCGTTAAA

 151 GACATGGATT TACAGGCATT ACACGGACGA AAAGTTGCAT TGTACATTGC

 201 AACTATGGGC GACCAAGGTT CAGGCAGTTT GACAGGGGGT CGCTACTCCA

 251 TTGATGCACT GATTCGCGGC GAATACATAA ACAGCCCTGC CGTCCGCACC

 301 GATTACACCT ATCCGCGTTA CGAAACCACC GCTGAAACAA CATCAGGCGG

 351 TTTGACGGGT TTAACCACTT CTTTATCTAC ACTTAATGCC CCTGCACTCT

 401 CGCGCACCCA ATCAGACGGT AGCGGAAGTA GGAGCAGTCT GGGCTTAAAT

 451 ATTGGCGGGA TGGGGGATTA TCGAAATGAA ACCTTGACGA CCAACCCGCG

 501 CGACACTGCC TTTCTTTCCC ACTTGGTGCA GACCGTATTT TTCCTGCGCG

 551 GCATAGACGT TGTTTCTCCT GCCAATGCCG ATACAGATGT GTTTATTAAC

 601 ATCGACGTAT TCGGAACGAT ACGCAACAGA ACCGAAATGC ACCTATACAA
```

-continued

```
651 TGCCGAAACA CTGAAAGCCC AAACAAAACT GGAATATTTC GCAGTAGACA
701 GAACCAATAA AAAATTGCTC ATCAAACCCA AAACCAATGC GTTTGAAGCT
751 GCCTATAAAG AAAATTACGC ATTGTGGATG GGGCCGTATA AAGTAAGCAA
801 AGGAATCAAA CCGACGGAAG GATTGATGGT CGATTTCTCC GATATCCAAC
851 CATACGGCAA TCATACGGGT AACTCCGCCC CATCCGTAGA GGCTGATAAC
901 AGTCATGAGG GGTATGGATA CAGCGATGAA GCAGTGCGAC AACATAGACA
951 AGGGCAACCT TGA
```

This corresponds to the amino acid sequence <SEQ ID 1326; ORF 406>:

```
g406.pep
  1 MRARLLIPIL FSVFILSACG TLTGIPSHGG GKRFAVEQEL VAASARAAVK
 51 DMDLQALHGR KVALYIATMG DQGSGSLTGG RYSIDALIRG EYINSPAVRT
101 DYTYPRYETT AETTSGGLTG LTTSLSTLNA PALSRTQSDG SGSRSSLGLN
151 IGGMGDYRNE TLTTNPRDTA FLSHLVQTVF FLRGIDVVSP ANADTDVFIN
201 IDVFGTIRNR TEMHLYNAET LKAQTKLEYF AVDRTNKKLL IKPKTNAFEA
251 AYKENYALWM GPYKVSKGIK PTEGLMVDFS DIQPYGNHTG NSAPSVEADN
301 SHEGYGYSDE AVRQHRQGQP *
```

The following partial DNA sequence was identified in *N. meningitidis* <SEQ ID 1327>:

```
m406.seq
  1 ATGCAAGCAC GGCTGCTGAT ACCTATTCTT TTTTCAGTTT TTATTTTATC
 51 CGCCTGCGGG ACACTGACAG GTATTCCATC GCATGGCGGA GGTAAACGCT
101 TTGCGGTCGA ACAAGAACTT GTGGCCGCTT CTGCCAGAGC TGCCGTTAAA
151 GACATGGATT TACAGGCATT ACACGGACGA AAAGTTGCAT TGTACATTGC
201 CACTATGGGC GACCAAGGTT CAGGCAGTTT GACAGGGGGT CGCTACTCCA
251 TTGATGCACT GATTCGTGGC GAATACATAA ACAGCCCTGC CGTCCGTACC
301 GATTACACCT ATCCACGTTA CGAAACCACC GCTGAAACAA CATCAGGCGG
351 TTTGACAGGT TTAACCACTT CTTTATCTAC ACTTAATGCC CCTGCACTCT
401 CTCGCACCCA ATCAGACGGT AGCGGAAGTA AAAGCAGTCT GGGCTTAAAT
451 ATTGGCGGGA TGGGGGATTA TCGAAATGAA ACCTTGACGA CTAACCCGCG
501 CGACACTGCC TTTCTTTCCC ACTTGGTACA GACCGTATTT TTCCTGCGCG
551 GCATAGACGT TGTTTCTCCT GCCAATGCCG ATACAGATGT GTTTATTAAC
601 ATCGACGTAT TCGGAACGAT ACGCAACAGA ACCGAAATGC ACCTATACAA
651 TGCCGAAACA CTGAAAGCCC AAACAAAACT GGAATATTTC GCAGTAGACA
701 GAACCAATAA AAAATTGCTC ATCAAACCAA AAACCAATGC GTTTGAAGCT
751 GCCTATAAAG AAAATTACGC ATTGTGGATG GGGCCGTATA AAGTAAGCAA
801 AGGAATTAAA CCGACGGAAG GATTAATGGT CGATTTCTCC GATATCCGAC
851 CATACGGCAA TCATACGGGT AACTCCGCCC CATCCGTAGA GGCTGATAAC
901 AGTCATGAGG GGTATGGATA CAGCGATGAA GTAGTGCGAC AACATAGACA
951 AGGACAACCT TGA
```

This corresponds to the amino acid sequence <SEQ ID 1328; ORF 406>:

```
m406.pep
    1 MQARLLIPIL FSVFILSACG TLTGIPSHGG GKRFAVEQEL VAASARAAVK

   51 DMDLQALHGR KVALYIATMG DQGSGSLTGG RYSIDALIRG EYINSPAVRT

  101 DYTYPRYETT AETTSGGLTG LTTSLSTLNA PALSRTQSDG SGSKSSLGLN

  151 IGGMGDYRNE TLTTNPRDTA FLSHLVQTVF FLRGIDVVSP ANADTDVFIN

  201 IDVFGTIRNR TEMHLYNAET LKAQTKLEYF AVDRTNKKLL IKPKTNAFEA

  251 AYKENYALWM GPYKVSKGIK PTEGLMVDFS DIRPYGNHTG NSAPSVEADN

  301 SHEGYGYSDE VVRQHRQGQP *
```

Computer analysis of the amino acid sequences gave the following results:

Homology with a Predicted ORF from *N. meningitidis* menA with menB ORF 406 shows 98.8% identity over a 320 aa overlap with a predicted ORF (ORF406.a) from *N. gonorrhoeae*:

```
g406/m406

                    10        20        30        40        50        60
g406.pep    MRARLLIPILFSVFILSACGTLTGIPSHGGGKRFAVEQELVAASARAAVKDMDLQALHGR
            |:||||||||||||||||||||||||||||||||||||||||||||||||||||||||||
m406        MQARLLIPILFSVFILSACGTLTGIPSHGGGKRFAVEQELVAASARAAVKDMDLQALHGR
                    10        20        30        40        50        60

                    70        80        90       100       110       120
g406.pep    KVALYIATMGDQGSGSLTGGRYSIDALIRGEYINSPAVRTDYTYPRYETTAETTSGGLTG
            ||||||||||||||||||||||||||||||||||||||||||||||||||||||||||||
m406        KVALYIATMGDQGSGSLTGGRYSIDALIRGEYINSPAVRTDYTYPRYETTAETTSGGLTG
                    70        80        90       100       110       120

                   130       140       150       160       170       180
g406.pep    LTTSLSTLNAPALSRTQSDGSGSRSSLGLNIGGMGDYRNETLTTNPRDTAFLSHLVQTVF
            |||||||||||||||||||||||:||||||||||||||||||||||||||||||||||||
m406        LTTSLSTLNAPALSRTQSDGSGSKSSLGLNIGGMGDYRNETLTTNPRDTAFLSHLVQTVF
                   130       140       150       160       170       180

                   190       200       210       220       230       240
g406.pep    FLRGIDVVSPANADTDVFINIDVFGTIRNRTEMHLYNAETLKAQTKLEYFAVDRTNKKLL
            ||||||||||||||||||||||||||||||||||||||||||||||||||||||||||||
m406        FLRGIDVVSPANADTDVFINIDVFGTIRNRTEMHLYNAETLKAQTKLEYFAVDRTNKKLL
                   190       200       210       220       230       240

                   250       260       270       280       290       300
g406.pep    IKPKTNAFEAAYKENYALWMGPYKVSKGIKPTEGLMVDFSDIQPYGNHTGNSAPSVEADN
            ||||||||||||||||||||||||||||||||||||||||||:|||||||||||||||||
m406        IKPKTNAFEAAYKENYALWMGPYKVSKGIKPTEGLMVDFSDIRPYGNHTGNSAPSVEADN
                   250       260       270       280       290       300

                   310       320
g406.pep    SHEGYGYSDEAVRQHRQGQPX
            ||||||||||:|||||||||
m406        SHEGYGYSDEVVRQHRQGQPX
                   310       320
```

The following partial DNA sequence was identified in *N. meningitidis* <SEQ ID 1329>:

```
a406.seq
    1 ATGCAAGCAC GGCTGCTGAT ACCTATTCTT TTTTCAGTTT TTATTTTATC

   51 CGCCTGCGGG ACACTGACAG GTATTCCATC GCATGGCGGA GGTAAACGCT

  101 TCGCGGTCGA ACAAGAACTT GTGGCCGCTT CTGCCAGAGC TGCCGTTAAA
```

-continued

```
151 GACATGGATT TACAGGCATT ACACGGACGA AAAGTTGCAT TGTACATTGC

201 AACTATGGGC GACCAAGGTT CAGGCAGTTT GACAGGGGGT CGCTACTCCA

251 TTGATGCACT GATTCGTGGC GAATACATAA ACAGCCCTGC CGTCCGTACC

301 GATTACACCT ATCCACGTTA CGAAACCACC GCTGAAACAA CATCAGGCGG

351 TTTGACAGGT TTAACCACTT CTTTATCTAC ACTTAATGCC CCTGCACTCT

401 CGCGCACCCA ATCAGACGGT AGCGGAAGTA AAAGCAGTCT GGGCTTAAAT

451 ATTGGCGGGA TGGGGGATTA TCGAAATGAA ACCTTGACGA CTAACCCGCG

501 CGACACTGCC TTTCTTTCCC ACTTGGTACA GACCGTATTT TTCCTGCGCG

551 GCATAGACGT TGTTTCTCCT GCCAATGCCG ATACGGATGT GTTTATTAAC

601 ATCGACGTAT TCGGAACGAT ACGCAACAGA ACCGAAATGC ACCTATACAA

651 TGCCGAAACA CTGAAAGCCC AAACAAAACT GGAATATTTC GCAGTAGACA

701 GAACCAATAA AAAATTGCTC ATCAAACCAA AAACCAATGC GTTTGAAGCT

751 GCCTATAAAG AAAATTACGC ATTGTGGATG GGACCGTATA AAGTAAGCAA

801 AGGAATTAAA CCGACAGAAG GATTAATGGT CGATTTCTCC GATATCCAAC

851 CATACGGCAA TCATATGGGT AACTCTGCCC CATCCGTAGA GGCTGATAAC

901 AGTCATGAGG GGTATGGATA CAGCGATGAA GCAGTGCGAC GACATAGACA

951 AGGGCAACCT TGA
```

This corresponds to the amino acid sequence <SEQ ID 1330; ORF 406.a>:

```
a406.pep

  1  MQARLLIPIL  FSVFILSACG  TLTGIPSHGG  GKRFAVEQEL  VAASARAAVK

 51  DMDLQALHGR  KVALYIATMG  DQGSGSLTGG  RYSIDALIRG  EYINSPAVRT

101  DYTYPRYETT  AETTSGGLTG  LTTSLSTLNA  PALSRTQSDG  SGSKSSLGLN

151  IGGMGDYRNE  TLTTNPRDTA  FLSHLVQTVF  FLRGIDVVSP  ANADTDVFIN

201  IDVFGTIRNR  TEMHLYNAET  LKAQTKLEYF  AVDRTNKKLL  IKPKTNAFEA

251  AYKENYALWM  GPYKVSKGIK  PTEGLMVDFS  DIQPYGNHMG  NSAPSVEADN

301  SHEGYGYSDE  AVRRHRQGQP  *

m406/a406  98.8% identity in 320 aa overlap

                   10        20        30        40        50        60
m406.pep   MQARLLIPILFSVFILSACGTLTGIPSHGGGKRFAVEQELVAASARAAVKDMDLQALHGR
           ||||||||||||||||||||||||||||||||||||||||||||||||||||||||||||
a406       MQARLLIPILFSVFILSACGTLTGIPSHGGGKRFAVEQELVAASARAAVKDMDLQALHGR
                   10        20        30        40        50        60

                   70        80        90       100       110       120
m406.pep   KVALYIATMGDQGSGSLTGGRYSIDALIRGEYINSPAVRTDYTYPRYETTAETTSGGLTG
           ||||||||||||||||||||||||||||||||||||||||||||||||||||||||||||
a406       KVALYIATMGDQGSGSLTGGRYSIDALIRGEYINSPAVRTDYTYPRYETTAETTSGGLTG
                   70        80        90       100       110       120

                  130       140       150       160       170       180
m406.pep   LTTSLSTLNAPALSRTQSDGSGSKSSLGLNIGGMGDYRNETLTTNPRDTAFLSHLVQTVF
           ||||||||||||||||||||||||||||||||||||||||||||||||||||||||||||
a406       LTTSLSTLNAPALSRTQSDGSGSKSSLGLNIGGMGDYRNETLTTNPRDTAFLSHLVQTVF
                  130       140       150       160       170       180

                  190       200       210       220       230       240
m406.pep   FLRGIDVVSPANADTDVFINIDVFGTIRNRTEMHLYNAETLKAQTKLEYFAVDRTNKKLL
           ||||||||||||||||||||||||||||||||||||||||||||||||||||||||||||
a406       FLRGIDVVSPANADTDVFINIDVFGTIRNRTEMHLYNAETLKAQTKLEYFAVDRTNKKLL
                  190       200       210       220       230       240
```

-continued

```
                 250        260        270        280        290        300
m406.pep   IKPKTNAFEAAYKENYALWMGPYKVSKGIKPTEGLMVDFSDIRPTGNHTGNSAPSVEADN
           ||||||||||||||||||||||||||||||||||||||||||:||||| |||||||||||
a406       IKPKTNAFEAAYKENYALWMGPYKVSKGIKPTEGLMVDFSDIQPYGNHMGNSAPSVEADN
                 250        260        270        280        290        300

                 310        320
m406.pep   SHEGYGYSDEVVRQHRQGQPX
           ||||||||||:||:|||||||
a406       SHEGYGYSDEAVRRHRQGQPX
                 310        320
```

The following partial DNA sequence was identified in *N. gonorrhoeae* <SEQ ID 1331>:

```
g501.seq
     1 atggtcggac ggaccttgac cgcagatacc gacatatttg ttctgcttgc,
    51 ggcaggcgga gatggcaaga tgcagcatca ctttgacggc agggttgcgt
   101 tcgtcaaacg attcggacac caagccgctg tctcggtcga ggccgagggt
   151 cagctgggtc atgtcgttcg agccgatgga gaagccgtcg aagtattgca
   201 ggaattgttc cgccaatacc gcgttgctcg gcagctcgca catcataatc
   251 aggcgcaggc cgtttttgcc gcgttccaag ccgttttctt tcaatgcctt
   301 aaccactgct tcggcttcgc ccaaagtgcg gacgaacgga atcatgattt
   351 cgacgttggt cagacccatt tcgtcacgaa cgcgtttcaa ggctttgcat
   401 tccaaggcga aacagtcttt gaagctctcg gcaacataac gcgccgcacc
   451 acggaagccc aacatcgggt tttcttcatg cggttcgtat acgctgccgc
   501 cgaccaggtt ggcgtattcg ttggatttga agtcggacat acggacgatg
   551 gttttacgcg gataaaccga tgcggcaagc gttgccacgc cttcggcgat
   601 tttatcgacg tagaagtcga caggggatgc gtaaccggcg atgcggcgga
   651 taatttccgc tttcagttcg tcgtcttgtt tgtcaaattc caacaaggct
   701 ttcgggtgga tgccgatttg gcggttgatg ataaattcca tacgcgccaa
   751 gccgatgcct tcgctgggca gattggcgaa gctgaatgcg agttcgggat
   801 tgccgacgtt catcatgact ttgacgggtg cttttggcat attgtccaag
   851 gcgacatcgg taatttgtac gtccagcagg ccggcataga taaagccggt
   901 atcgccttcg gcacaggata cggtaacttc ctgaccgttt tccaagagtt
   951 cggtcgcatt gccgcagccg acgacggcag gaatacccag ttcgcgcgcg
  1001 atgatggcgg cgtggcaggt gcgtccgccg cggttggtca cgatggcgga
  1051 agcacgtttc atcacgggtt cccaatccgg atcggtcatg tcggtaacca
  1101 gtacgtcgcc ggcttcgacg gaatccatct cggaagcatc tttaatcagg
  1151 cgcaccttgc cctgaccgac tttttgaccg atggcacgac cttcgcacaa
  1201 gacggttttt tcgccgttga tggcgtagcg gcgcaggttg cggctgcctt
  1251 cttcttggga tttgacggtt tcggggcggg cttgcaggat gtagagtttg
  1301 ccgtccaggc cgtcgcgtcc ccattcgata tccatcgggc ggccgtagtg
  1351 tttttcgatg gtcagcgcgt agtgtgccaa ctcggtgatt tcttcgtcgg
  1401 taatggagaa gcggttgcgg tcttcttcgg ggacttcgac gttggttacc
  1451 gatttgccgg cttcggcttt gtcggtgaaa atcattttga tgtgtttcga
```

-continued

```
1501 acccatggtc ttgcgcagga tggcgggttt gcctgctttg agcgtgggtt

1551 tgaacacata aaattcgtcc gggttgaccg cgccttgtac gacgttttcg

1601 cccagaccgt aagaggaggt aacaaagacg acttggttgt agccggattc

1651 ggtgtcgagg gtgaacatca cacctga
```

This corresponds to the amino acid sequence <SEQ ID 1332; ORF 501.ng>:

```
g501.pep
   1 MVGRTLTADT DIFVLLAAGG DGKMQHHFDG RVAFVKRFGH QAAVSVEAEG

  51 QLGHVVRADG EAVEVLQELF RQYRVARQLA HHNQAQAVFA AFQAVFFQCL

 101 NHCFGFAQSA DERNHDFDVG QTHFVTNAFQ GFAFQGETVF EALGNITRRT

 151 TEAQHRVFFM RFVYAAADQV GVFVGFEVGH TDDGFTRINR CGKRCHAFGD

 201 FIDVEVDRGC VTGDAADNFR FQFVVLFVKF QQGFRVDADL AVDDKFHTRQ

 251 ADAFAGQIGE AECEFGIADV HHDFDGCFWH IVQGDIGNLY VQQAGIDKAG

 301 IAFGTGYGNF LTVFQEFGRI AAADDGRNTQ FARDDGGVAG ASAAVGHDGG

 351 STFHHGFPIR IGHVGNQYVA GFDGIHLGSI FNQAHLALTD FLTDGTTFAQ

 401 DGFFAVDGVA AQVAAAFFLG FDGFGAGLQD VEFAVQAVAS PFDIHRAAVV

 451 FFDGQRVVCQ LGDFFVGNGE AVAVFFGDFD VGYRFAGFGF VGENHFDVFR

 501 THGLAQDGGF ACFERGFEHI KFVRVDRALY DVFAQTVRGG NKDDLVVAGF

 551 GVEGEHHT*
```

The following partial DNA sequence was identified in *N. meningitidis* <SEQ ID 1333>:

```
m501.seq
   1 atggtcggac sggccttgac cgcagatgcc gacatatttg ttctgcttgc

  51 ggcaggcgga gatggcaagg tgcagcatca ctttgacggc agggttgcgt

 101 tcgtcaaacg attcggatac caagccgctg tcgcggtcga gaccgagggt

 151 cagttgggtc atgtcgttcg agccgatgga gaagccgtcg aagtattgca

 201 ggaattgttc cgccaatacc gcgttgctcg gcagctcgca catcataatc

 251 aggcgcaggc cgtttttgcc gcgttccaag ccgttttctt tcagggcttt

 301 gacaacggmt tcggcttcgc ccaaagtgcg gacgaacgga atcatgattt

 351 caacgttggy caaccccatt tcatcgcgga cgcgtttcaa ggctttgcat

 401 tccaaggcga aacagtcttt gaagttgtcg gcgacataac gcgccgcacc

 451 acggaagccc aacatcgggt tttcttcatg cggttcgtat acgttgccgc

 501 cgaccaggtt ggcgtattcg ttggatttga agtcggacat acggacgatg

 551 gttttacgcg gataaaccga tgcggccaat gtcgccacgc cttcggcgat

 601 tttatcgacg tagaagtcga caggggacgc gtaaccggcg atacggcggg

 651 taatttccgc ttttaattcg tcgtcttgtt tgtcaaattc caacaargct

 701 ttggggtgga taccgatttg gcggttgatg ataaattcca tacgcgccaa

 751 gccgatgcct tcgctgggca ggttggcgaa gctgaatgcg agttcgggat

 801 tgccgacgtt catcatgact tttacaggtg ctttaggcat attgtctaag

 851 gcgacatcgg taatctgtac gtccaacaga ccggcataga taaagccggt
```

-continued

```
 901 atcgccttcg gcacaggata cggtaacttc ttgaccgttt ttcagcaatt

 951 cggttgcatt gccgcagccg acaacggcag gaatgcccaa ttcacgcgcg

1001 atgatggcgg cgtggcaggt acggccgccg cggttggtaa cgatggcaga

1051 agcacgtttc atcacgggtt cccaatccgg atcggtcatg tcggtaacga

1101 gtacgtcgcc ggcttcgacg gaatccatct cggaagcatc tttaatcagg

1151 cgcaccttgc cctgaccgac tttctgaccg atggcgcggc cttcgcataa

1201 tacggttttg tcgccgttga tggcgaagcg gcgcaggttg cggttgccct

1251 cttcttggga ttttacggtt tcgggacggg cttgcaggat gtagagtttg

1301 ccgtccaagc cgtcgcgtcc ccattcgata tccatcgggc ggccgtagtg

1351 tttttcgatg gtcagtgcgt aatgcgccaa ctcagtaatt tcttcgtcgg

1401 taatggagaa gcggttgcgg tcttcctcgg ggacatcgac gttggttacg

1451 gatttaccgg cttctgcttt gtcggtaaaa atcattttga tgtgttttga

1501 acccatggtt ttacgcagga tggcgggctt gcccgytttg agcgtgggtt

1551 tgaacacatr aaattcgtcc gggttgaccg caccttgtac gacgttttcg

1601 cccagaccgt aagaggaggt aacaaagacg acytgatcgt akccggattc

1651 ggtgtcgagg gtgaacatca cacctga
```

This corresponds to the amino acid sequence <SEQ ID 1334; ORF 501>:

```
m501.pep
  1 MVGXALTADA DIFVLLAAGG DGKVQHHFDG RVAFVKRFGY QAAVAVETEG

 51 QLGHVVRADG EAVEVLQELF RQYRVARQLA HHNQAQAVFA AFQAVFFQGF

101 DNGFGFAQSA DERNHDFNVG QPHFIADAFQ GFAFQGETVF EVVGDITRRT

151 TEAQHRVFFM RFVYVAADQV GVFVGFEVGH TDDGFTRINR CGQCRHAFGD

201 FIDVEVDRGR VTGDTAGNFR FXFVVLFVKF QQXFGVDTDL AVDDKFHTRQ

251 ADAFAGQVGE AECEFGIADV HHDFYRCFRH IVXGDIGNLY VQQTGIDKAG

301 IAFGTGYGNF LTVFQQFGCI AAADNGRNAQ FTRDDGGVAG TAAAVGNDGR

351 STFHHGFPIR IGHVGNEYVA GFDGIHLGSI FNQAHLALTD FLTDGAAFAX

401 YGFVAVDGEA AQVAVALFLG FYGFGTGLQD VEFAVQAVAS PFDIHRAAVV

451 FFDGQCVMRQ LSNFFVGNGE AVAVFLGDID VGYGFTGFCF VGKNHFDVFX

501 THGFTQDGGL ARFERGFEHX KFVRVDRTLY DVFAQTVRGG NKDDLIVXGF

551 GVEGEHHT*
```

Computer analysis of this amino acid sequence gave the following results:

Homology with a Predicted ORF from *N. gonorrhoeae*

ORF 501 shows 86.2% identity over a 558 aa overlap with a predicted ORF (ORF 501.ng) from *N. gonorrhoeae*:

```
m501/g501

                   10        20        30        40        50        60
m501.pep  MVGXALTADADIFVLLAAGGDGKVQHHFDGRVAFVKRFGYQAAVAVETEGQLGHVVRADG
          |||  :||||:||||||||||||:||||||||||||||:||||:||:||||||||||||
g501      MVGRTLTADTDIFVLLAAGGDGKMQHHFDGRVAFVKRGFHQAAVSVEAEGQLGHVVRADG
                   10        20        30        40        50        60
```

-continued

```
                 70        80        90       100       110       120
m501.pep EAVEVLQELFRQYRVARQLAHHNQAQAVFAAFQAVFFQGFDNGFGFAQSADERNHDFNVG
         |||||||||||||||||||||||||||||||||||||| ::: ||||||||||||||:||
g501     EAVEVLQELFRQYRVARQLAHHNQAQAVFAAFQAVFFQCLNHCFGFAQSADERNHDFDVG
                 70        80        90       100       110       120

                130       140       150       160       170       180
m501.pep QPHFIADAFQGFAFQGETVFEVVGDITRRTTEAQHRVFFMRFVYVAADQVGVFVGFEVGH
         | ||:::||||||||||||||::|:|||||||||||||||||||:|||||||||||||||
g501     QTHFVTNAFQGFAFQGETVFEALGNITRRTTEAQHRVFFMRFVYAAADQVGVFVGFEVGH
                130       140       150       160       170       180

                190       200       210       220       230       240
m501.pep TDDGFRTINRCGQCRHAFGDFIDVEVDRGRVTGDTAGNFRFXFVVLFVKFQQXFGVDTDL
         ||||||||||||:  |||||||||||||| ||||:| |||| |||||||||| | ||:||
g501     TDDGFRTINRCGKRCHAFGDFIDVEVDRGCVTGDAADNFRFQFVVLFVKFQQGFRVDADL
                190       200       210       220       230       240

                250       260       270       280       290       300
m501.pep AVDDKFHTRQADAFAGQVGEAECEFGIADVHHDFYRCFRHIVXGDIGNLYVQQTGIDKAG
         |||||||||||||||||:||||||||||||||||  || ||| ||||||||||:||||||
g501     AVDDKFHTRQADAFAGQIGEAECEFGIADVHHDFDGCFWHIVQGDIGNLYVQQAGIDKAG
                250       260       270       280       290       300

                310       320       330       340       350       360
m501.pep IAFGTGYGNFLTVFQQFGCIAAADNGRNAQFTRDDGGVAGTAAAVGNDGRSTFHHGFPIR
         |||||||||||||||:|| |||||:|||:||:||||||||::||||:|| ||||||||||
g501     IAFGTGYGNFLTVFQEFGRIAAADDGRNTQFARDDGGVAGASAAVGHDGGSTFHHGFPIR
                310       320       330       340       350       360

                370       380       390       400       410       420
m501.pep IGHVGNEYVAGFDGIHLGSIFNQAHLALTDFLTDGAAFAXYGFVAVDGEAAQVAVALFLG
         ||||||:||||||||||||||||||||||||||||::||  || |||| |||||:|:|||
g501     IGHVGNQYVAGFDGIHLGSIFNQAHLALTDFLTDGTTFAQDGFFAVDGVAAQVAAAFFLG
                370       380       390       400       410       420

                430       440       450       460       470       480
m501.pep FYGFGTGLQDVEFAVQAVASPFDIHRAAVVFFDGQCVMRQLSNFFVGNGEAVAVFLGDID
         | |||:||||||||||||||||||||||||||||| |: ||::||||||||||||:||:|
g501     FDGFGAGLQDVEFAVQAVASPFDIHRAAVVFFDGQRVVCQLGDFFVGNGEAVAVFFGDFD
                430       440       450       460       470       480

                490       500       510       520       530       540
m501.pep VGYGFTGFCFVGKNHFDVFXTHGFTQDGGLARFERGREHXKFVRVDRTLYDVFAQTRVGG
         |||||:|| |||:|||||| |||::||||:| ||||||| |||||||:||||||||||||
g501     VGYGFAGFGFVGENHFDVFRTHGLAQDGGFACFERGREHIKFVRVDRALYDVFAQTRVGG
                490       500       510       520       530       540

                550
m501.pep NKDDLIVXGFGVEGEHHT
         |||||:| ||||||||||
g501     NKDDLVVAGFGVEGEHHT
                550
```

550

The following partial DNA sequence was identified in *N. meningitidis* <SEQ ID 1335>:

```
a501.seq (partial)
   1  ATGGTCGGAC GGGCCTTGAC CGCAGATGCC GACATATTTG TTCTGCTTGC

  51  GGCAGGCGGA GATGGCAAGG TGCAGCATCA CTTTGACGGC AGGGTTGCGT

 101  TCGTCAAACG ATTCGGATAC CAAGCCGCTG TCGCGGTCGA GACCGAGGGT

 151  CAGTTGGGTC ATGTCGTTCG AGCCGATGGA GAAGCCGTCG AAGTATTGCA

 201  GGAATTGTTC CGCCAATACC GCGTTGCTCG GCAGCTCGCA CATCATAATC

 251  AGGCGCAGGC CGTTTTTGCC GCGTTCCAAG CCGTTTTCTT TCAGGGCTTT

 301  GACAACGGCT TCGGCTTCGC CCAAAGTGCG GACGAACGGA ATCATGATTT

 351  CAACGTTGGT CAACCCCATT TCATCGCGGA CGCGTTTCAA GGCTTTGCAT

 401  TCCAAGGCGA AACAGTCTTT GAAGTTGTCG GCGACATAAC GCGCCGCACC

 451  ACGGAAGCCC AACATCGGGT TTTCTTCATG CGGTTCGTAT ACGTTGCCGC

 501  CGACCAGGTT GGCGTATTCG TTGGATTTGA AGTCGGACAT ACGGACGATG

 551  GTTTTACGCG GATAAACCGA TGCGGCCAAT GTCGCCACGC CTTCGGCGAT

 601  TTTATCGACG TAGAAGTCGA CAGGGGACGC GTAACCGGCG ATACGGCGGG
```

-continued

```
 651 TAATTTCCGC TTTTAATTCG TCGTCTTGTT TGTCAAATTC CAACAAGGCT
 701 TTGGGGTGGA TACCGATTTG GCGGTTGATG ATAAATTCCA TACGCGCCAA
 751 GCCGATGCCT TCGCTGGGCA GGTTGGCGAA GCTGAATGCG AGTTCGGGAT
 801 TGCCGACGTT CATCATGACT TTTACAGGTG CTTTAGGCAT GTTGTCCAAA
 851 GCAACATCGG TAATTTGTAC GTCCAGCAGG CCGGAGTAGA TGAAGCCGGT
 901 ATCGCCTTCG GCACAGGATA CGGTAACTTC TTGACCGTTT TTCAGCAATT
 951 CGGTTGCATT GCCGCAGCCG ACAACGGCAG GAATACCCAG TTCGCGCGCG
1001 ATGATGGCGG CGTGGCAGGT ACGTCCGCCC CTGTTGGTCA CGATGGCGGA
1051 AGCGCGTTTC ATCACCGGTT CCCAATCTGG GTCGGTCATG TCGGTAACCA
1101 GTACGTCGCC GGCTTCGACG GAATCCATCT CGGAAGCATC TTTAATCAGG
1151 CGTACCTTGC CCTGACCGAC TTTCTGACCG ATGGCGCGGC CTTCGCACAA
1201 GACGGTTTTT TCGCCGTTGA TAGAAAAGCG GCGCAGGTTG CGGCTGCCTT
1251 CTTCCTGGGA TTTGACGGTT TCGGGACGGG CTTGCAGGAT GTAGAGTTTG
1301 CCGTCCAAGC CGTCGCGTCC CCATTCGATG TCCATCGGGC GGCCGTAGTG
1351 TTTTTCGATG GTCAGTGCGT AATGCGCCAA CTCGGTGATT TCTTCGTCGG
1401 TAATGGAGAA GCGGTTGCGG TCTTCTTCGG GGACATCGAC GTTGGTTACC
1451 GATTTGCCGG CTTCTGCTTT GTCGGTAAAA ATCATTTTGA TGTGTTTTGA
1501 GCCCATGGTT TTGCGCAGGA TGGCAGGTTT GCCTGCTTTC AGCGTGGGTT
1551 TGAACACATA GAATTCGTCG GGATTGACTG CGCCTTGTAC GACGTTTTCG
1601 CCCAGACCGT AGGATGAAGT GACAAAGACG ACTTGGTCGT AACCGGATTC
1651 GGTATCGAGG GTGAACATCA C
```

This corresponds to the amino acid sequence <SEQ ID 1336; ORF 501.a>:

```
a501.pep
   1 MVGRALTADA DIFVLLAAGG DGKVQHHFDG RVAFVKRFGY QAAVAVETEG
  51 QLGHVVRADG EAVEVLQELF RQYRVARQLA HHNQAQAVFA AFQAVFFQGF
 101 DNGFGFAQSA DERNHDFNVG QPHFIADAFQ GFAFQGETVF EVVGDITRRT
 151 TEAQHRVFFM RFVYVAADQV GVFVGFEVGH TDDGFTRINR CGQCRHAFGD
 201 FIDVEVDRGR VTGDTAGNFR F*FVVLFVKF QQGFGVDTDL AVDDKFHTRQ
 251 ADAFAGQVGE AECEFGIADV HHDFYRCFRH VVQSNIGNLY VQQAGVDEAG
 301 IAFGTGYGNF LTVFQQFGCI AAADNGRNTQ FARDDGGVAG TSAPVGHDGG
 351 SAFHHRFPIW VGHVGNQYVA GFDGIHLGSI FNQAYLALTD FLTDGAAFAQ
 401 DGFFAVDRKA AQVAAAFFLG FDGFGTGLQD VEFAVQAVAS PFDVHRAAVV
 451 FFDGQCVMRQ LGDFFVGNGE AVAVFFGDID VGYRFAGFCF VGKNHFDVF*
 501 AHGFAQDGRF ACFQRGFEHI EFVGIDCALY DVFAQTVG*S DKDDLVVTGF
 551 GIEGEHH
```

m501/a501 90.3% identity in 557 aa overlap

```
                        10        20        30        40        50        60
m501.pep    MVGXALTADADIFVLLAAGGDGKVQHHFDGRVAFVKRFGYQAAVAVETEGQLGHVVRADG
            ||| ||||||||||||||||||||||||||||||||||||||||||||||||||||||||
a501        MVGRALTADADIFVLLAAGGDGKVQHHFDGRVAFVKRFGYQAAVAVETEGQLGHVVRADG
                        10        20        30        40        50        60

                        70        80        90       100       110       120
m501.pep    EAVEVLQELFRQYRVARQLAHHNQAQAVFAAFQAVFFQGFDNGFGFAQSADERNHDFNVG
            ||||||||||||||||||||||||||||||||||||||||||||||||||||||||||||
a501        EAVEVLQELFRQYRVARQLAHHNQAQAVFAAFQAVFFQGFDNGFGFAQSADERNHDFNVG
                        70        80        90       100       110       120

                       130       140       150       160       170       180
m501.pep    QPHFIADAFQGFAFQGETVFEVVGDITRRTTEAQHRVFFMRFVYVAADQVGVFVGFEVGH
            ||||||||||||||||||||||||||||||||||||||||||||||||||||||||||||
a501        QPHFIADAFQGFAFQGETVFEVVGDITRRTTEAQHRVFFMRFVYVAADQVGVFVGFEVGH
                       130       140       150       160       170       180

                       190       200       210       220       230       240
m501.pep    TDDGFTRINRCGQCRHAFGDFIDVEVDRGRVTGDTAGNFREXFVVLFVKFQQXFGVDTDL
            |||||||||||||||||||||||||||||||||||||||||||||||||||| |||||||
a501        TDDGFTRINRCGQCRHAFGDFIDVEVDRGRVTGDTAGNFREXFVVLFVKFQQGFGVDTDL
                       190       200       210       220       230       240

                       250       260       270       280       290       300
m501.pep    AVDDKFHTRQADAFAGQVGEAECEFGIADVHHDFYRCFRHIVXGDIGNLYVQQTGIDKAG
            ||||||||||||||||||||||||||||||||||||||||:| ::||||||||:|:|:||
a501        AVDDKFHTRQADAFAGQVGEAECEFGIADVHHDFYRCFRHVVQSNIGNLYVQQAGVDEAG
                       250       260       270       280       290       300

                        310       320       330       340       350       360
m501.pep    IAFGTGYGNFLTVFQQFGCIAAADNGRNAQFTRDDGGVAGTAAAVGNDGRSTFHHGFPIR
            ||||||||||||||||||||||||||||:||:|||||||||:| ||:|| |:||| ||| 
a501        IAFGTGYGNFLTVFQQFGCIAAADNGRNTQFARDDGGVAGTSAPVGHDGGSAFHHRFPIW

                        310       320       330       340       350       360
                       370       380       390       400       410       420
m501.pep    IGHVGNEYVAGFDGIHLGSIFNQAHLALTDFLTDGAAFAXYGFVAVDGEAAQVAVALFLG
            :|||||:|||||||||||||||||:||||||||||||||  || |||  :|||||:|:|||
a501        VGHVGNQYVAGFDGIHLGSIFNQAYLALTDFLTDGAAFAQDGFFAVDRKAAQVAAAFFLG
                       370       380       390       400       410       420

                       430       440       450       460       470       480
m501.pep    FYGFGTGLQDVEFAVQAVASPFDIHRAAVVFFDGQCVMRQLSNFFVGNGEAVAVFLGDID
            | |||||||||||||||||||||:|||||||||||||||||::||||||||||||:||||
a501        FDGFGTGLQDVEFAVQAVASPFDVHRAAVVFFDGQCVMRQLGDFFVGNGEAVAVFFGDID
                       430       440       450       460       470       480

                       490       500       510       520       530       540
m501.pep    VGYGFTGFCFVGKNHFDVFXTHGFTQDGGLARFERGFEHXKFVRVDRTLYDVFAQTVRGG
            ||| |:||||||||||||||:|||:||| :| |:|||||  :|| :| :|||||||||  :
a501        VGYRFAGFCFVGKNHFDVFXAHGFAQDGRFACFQRGFEHIEFVGIDCALYDVFAQTVGXS
                       490       500       510       520       530       540

                       550      559
m501.pep    NKDDLIVXGFGVEGEHHTX
            :||||:|:|||:|||||
a501        DKDDLVVTGFGIEGEHH
                       550
```

The following partial DNA sequence was identified in *N. gonorrhoeae* <SEQ ID 1337>:

```
g502.seq
   1 atgatgaaac cgcacaacct gttccaattc ctcgccgttt gctccctgac

  51 cgtcgccgtc gcttccgcac aggcgggcgc ggtggacgcg ctcaagcaat

 101 tcaacaacga tgccgacggt atcagcggca gcttcaccca aaccgtccaa

 151 agcaaaaaga aaacccaaac cgcgcacggc acgttcaaaa tcctgcgccc

 201 gggcctcttc aaatgggaat acactttgcc ctacagacag actattgtcg
```

-continued

```
251 gcgacggtca aaccgtttgg ctctacgatg ttgatttggc acaagtgacc

301 aagtcgtccc aagaccaggc catcggcggc agccccgccg ccatcctgtc

351 gaacaaaacc gccctcgaaa gcagttacac gctgaaagag gacggttcgt

401 ccaacggcat cgattatgtg cggggcaacg cccaaacgca acaacgccgg

451 ctaccaatac atccgcatcg gcttcaaagg cggcaacctc gccgccatgc

501 agcttaa
```

This corresponds to the amino acid sequence <SEQ ID 1338; ORF 502.ng>:

```
g502.pep
   1 MMKPHNLFQF LAVCSLTVAV ASAQAGAVDA LKQFNNDADG ISGSFTQTVQ

  51 SKKKTQTAHG TFKILRPGLF KWEYTLPYRQ TIVGDGQTVW LYDVDLAQVT

 101 KSSQDQAIGG SPAAILSNKT ALESSYTLKE DGSSNGIDYV RGNAQTQQRR

 151 LPIHPHRLQR RQPRRHAA*
```

The following partial DNA sequence was identified in *N. meningitidis* <SEQ ID 1339>:

```
m502.seq
   1 atgatgaaac cgcacaacct gttccaattc ctcgccgttt gctccctgac

  51 cgtcgccgtc gcttccgcac aggcgggcgc ggtagacgcg cttaagcaat

 101 tcaacaacga tgccgacggt atcagcggca gcttcaccca amccgtccaa

 151 wgcaaaaaga aaacccaaac cgcgcacggc acgttcaaaa tcctgcgacc

 201 gggccttttc aaatgggaat acaccaaact t.acaggcaa accatcgtcg

 251 gcgacggtca aacygtttgg ctmtacgatg tygatctggc acaagtgacc

 301 aagtcgtccc aagaccaggc cataggcgsc agccccgccg ccatcctgtc

 351 gaacaaarcc gccctcgaaa gcagctacac gctgaaagag gacggttcgt

 401 ccaacggcat cgattatgtg ggcaacgccc aaacgcaaca acgccggcta

 451 ccaatacatc cgcatcggct tcaaaggcgg caacctcgcc gccatgcagc

 501 tyaa
```

This corresponds to the amino acid sequence <SEQ ID 1340; ORF 502.ng>:

```
m502.pep
   1 MMKPHNLFQF LAVCSLTVAV ASAQAGAVDA LKQFNNDADG ISGSFTQXVQ

  51 XKKKTQTAHG TFKILRPGLF KWEYTKLYRQ TIVGDGQTVW LYDVDLAQVT

 101 KSSQDQAIGX SPAAILSNKX ALESSYTLKE DGSSNGIDYV GNAQTQQRRL

 151 PIHPHRLQRR QPRRHAAX
```

Computer analysis of this amino acid sequence gave the following results:

Homology with a Predicted ORF from *N. gonorrhoeae*

ORF 502 shows 95.8% identity over a 168 aa overlap with a predicted ORF (ORF 502.ng) from *N. gonorrhoeae*:

```
m502/g502

                    10        20        30        40        50        60
m502.pep    MMKPHNLFQFLAVCSLTVAVASAQAGAVDALKQFNNDADGISGSFTQXVQXKKKTQTAHG
            |||||||||||||| ||||||||||||||||||||||||||||||||:|| |||||||||
g502        MMKPHNLFQFLAVCSLTVAVASAQAGAVDALKQFNNDADGISGSFTQTVQSKKKTQTAHG
                    10        20        30        40        50        60

                    70        80        90       100       110       120
m502.pep    TFKILRPGLFKWEYTKLYRQTIVGDGQTVWLYDVDLAQVTKSSQDQAIGXSPAAILSNKX
            |||||||||||||| |||||||||||||||||||||||||||||||||| |||||||||:
g502        TFKILRPGLFKWEYTLPYRQTIVGDGQTVWLYDVDLAQVTKSSQDQAIGGSPAAILSNKT
                    70        80        90       100       110       120

                   130       140       150       160
m502.pep    ALESSYTLKEDGSSNGIDYV-GNAQTQQRRLPIHPHRLQRRQPRRHAA
            |||||||||||||||||||| |||||||||||||||||||||||||||
g502        ALESSYTLKEDGSSNGIDYVRGNAQTQQRRLPIHPHRLQRRQPRRHAA
                   130       140       150       160
```

The following partial DNA sequence was identified in *N. meningitidis* <SEQ ID 1341>:

```
a502.seq
   1 ATGATGAAAC CGCACAACCT GTTCCAATTC CTCGCCGTTT GCTCCCTGAC

  51 CGTCTCCGTC GCTTCCGCAC AGGCGGGCGC GGTGGACGCG CTCAAGCAAT

 101 TCAACAACGA TGCCGACGGT ATCAGCGGCA GCTTCACCCA AACCGTCCAA

 151 AGCAAAAAGA AAACCCAAAC CGCGCACGGC ACGTTCAAAA TCCTGCGCCC

 201 GGGCCTCTTT AAATGGGAAT ACACTTCGCC TTACAAACAG ACTATTGTCG

 251 GCGACGGTCA AACCGTTTGG CTCTACGATG TCGATTTGGC ACAAGTGACC

 301 AAGTCGTCCC AAGACCAGGC CATAGGCGGC AGCCCCGCCG CCATCCTGTC

 351 GAACAAAACC GCCCTCGAAA GCAGCTACAC GCTGAAAGAG GACGGTTCGT

 401 CCAACGGCAT CGATTATGTG GGCAACGCCC AAACGCAACA ACGCCGGCTA

 451 CCAATACATC CGCATCGGCT TCAAAGGCGG CAACCTCGCC GCCATGCAGC

 501 TTAA
```

This corresponds to the amino acid sequence <SEQ ID 1342; 502 217.a>:

```
a502.pep
   1 MMKPHNLFQF LAVCSLTVSV ASAQAGAVDA LKQFNNDADG ISGSFTQTVQ

  51 SKKKTQTAHG TFKILRPGLF KWEYTSPYKQ TIVGDGQTVW LYDVDLAQVT

 101 KSSQDQAIGG SPAAILSNKT ALESSYTLKE DGSSNGIDYV GNAQTQQRRL

 151 PIHPHRLQRR QPRRHAA*
```

m502/a502 95.2% identity in 167 aa overlap

```
                    10        20        30        40        50        60
m502.pep    MMKPHNLFQFLAVCSLTVAVASAQAGAVDALKQFNNDADGISGSFTQXVQXKKKTQTAHG
            |||||||||||||||||||:|||||||||||||||||||||||||||:|| |||||||||
a502        MMKPHNLFQFLAVCSLTVSVASAQAGAVDALKQFNNDADGISGSFTQTVQSKKKTQTAHG
                    10        20        30        40        50        60
```

-continued

```
              70        80        90        100       110       120
m502.pep TFKILRPGLFKWEYTKLYRQTIVGDGQTVWLYDVDLAQVTKSSQDQAIGXSPAAILSNKX
         ||||||||||||||: |:|||||||||||||||||||||||||||||| ||||||||:
a502     TFKILRPGLFKWEYTSPYKQTIVGDGQTVWLYDVDLAQVTKSSQDQAIGGSPAAILSNKT
              70        80        90        100       110       120

              130       140       150       160
m502.pep ALESSYTLKEDGSSNGIDYVGNAQTQQRRLPIHPHRLQRRQPRRRHAAX
         |||||||||||||||||||||||||||||||||||||||||||||||||
a502     ALESSYTLKEDGSSNGIDYVGNAQTQQRRLPIHPHRLQRRQPRRRHAAX
              130       140       150       160
```

The following partial DNA sequence was identified in *N. gonorrhoeae* <SEQ ID 1343>:

```
g502-1.seq
    1 ATGatGAAAc cgcaCaacct gttccaaTTc CTCGCCGTTT GCTCCCTGAC

   51 CGTCGCCGTC GCTTCCGCAC AGGCGGGCGC GGTGGACGCG CTCAAGCAAT

  101 TCAACAACGA TGCCGACGGT ATCAGCGGCA GCTTCACCCA AACCGTCCAA

  151 AGCAAAAAGA AAACCCAAAC CGCGCACGGC ACGTTCAAAA TCCTGCGCCC

  201 GGGCCTCTTC AAATGGGAAT ACACTTTGCC CTACAGACAG ACTATTGTCG

  251 GCGACGGTCA AACCGTTTGG CTCTACGATG TTGATTTGGC ACAAGTGACC

  301 AAGTCGTCCC AAGACCAGGC CATCGGCGGC AGCCCCGCCG CCATCCTGTC

  351 GAACAAAACC GCCCTCGAAA GCAGTTACAC GCTGAAAGAG GACGGTTCGT

  401 CCAACGGCAT CGATTATGTG CGGGCAACGC CCAAACGCAA CAACGCCGGC

  451 TACCAATACA TCCGCATCGG CTTCAAAGGC GGCAACCTCG CCGCCATGCA

  501 GCTTAAAGAC AGCTTCGGCA ACCAAACCTC CATCAGTTTC GGCGGTTTGA

  551 ATACCAATCC CCAACTCTCG CGCGGCGCGT TCAAGTTTAC CCCGCCCAAA

  601 GGCGTGGACG TGTTGAGCAA CTGA
```

This corresponds to the amino acid sequence <SEQ ID 1344; ORF 502-1.ng>:

```
g502-1.pep
    1 MMKPHNLFQF LAVCSLTVAV ASAQAGAVDA LKQFNNDADG ISGSFTQTVQ

   51 SKKKTQTAHG TFKILRPGLF KWEYTLPYRQ TIVGDGQTVW LYDVDLAQVT

  101 KSSQDQAIGG SPAAILSNKT ALESSYTLKE DGSSNGIDYV RATPKRNNAG

  151 YQYIRIGFKG GNLAAMQLKD SFGNQTSISF GGLNTNPQLS RGAFKFTPPK

  201 GVDVLSN*
```

The following partial DNA sequence was identified in *N. meningitidis* <SEQ ID 1345>:

```
m502-1.seq
    1 ATGATGAAAC CGCACAACCT GTTCCAATTC CTCGCCGTTT GCTCCCTGAC

   51 CGTCGCCGTC GCTTCCGCAC AGGCGGGCGC GGTAGACGCG CTTAAGCAAT

  101 TCAACAACGA TGCCGACGGT ATCAGCGGCA GCTTCACCCA AACCGTCCAA

  151 AGCAAAAAGA AAACCCAAAC CGCGCACGGC ACGTTCAAAA TCCTGCGACC

  201 GGGCCTTTTC AAATGGGAAT ACACCAAACC TTACAGGCAA ACCATCGTCG

  251 GCGACGGTCA AACCGTTTGG CTCTACGATG TTGATCTGGC ACAAGTGACC

  301 AAGTCGTCCC AAGACCAGGC CATAGGCGGC AGCCCCGCCG CCATCCTGTC
```

-continued

```
351 GAACAAAACC GCCCTCGAAA GCAGCTACAC GCTGAAAGAG GACGGTTCGT

401 CCAACGGCAT CGATTATGTG CTGGCAACGC CCAAACGCAA CAACGCCGGC

451 TACCAATACA TCCGCATCGG CTTCAAAGGC GGCAACCTCG CCGCCATGCA

501 GCTTAAAGAC AGCTTCGGCA ACCAAACCTC CATCAGTTTC GGCGGTTTGA

551 ATACCAATCC CCAACTCTCG CGCGGCGCGT TCAAGTTTAC CCCGCCCAAA

601 GGCGTGGACG TGTTGAGCAA CTGA
```

This corresponds to the amino acid sequence <SEQ ID 1346; ORF 502-1>:

```
m502-1.pep
      1 MMKPHNLFQF LAVCSLTVAV ASAQAGAVDA LKQFNNDADG ISGSFTQTVQ

     51 SKKKTQTAHG TFKILRPGLF KWEYTKPYRQ TIVGDGQTVW LYDVDLAQVT

    101 KSSQDQAIGG SPAAILSNKT ALESSYTLKE DGSSNGIDYV LATPKRNNAG

    151 YQYIRIGFKG GNLAAMQLKD SFGNQTSISF GGLNTNPQLS RGAFKFTPPK

    201 GVDVLSN*

m502-1/g502-1 99.0% identity in 207 aa overlap

                    10        20        30        40        50        60
m502-1.pep  MMKPHNLFQFLAVCSLTVAVASAQAGAVDALKQFNNDADGISGSFTQTVQSKKKTQTAHG
            ||||||||||||||||||||||||||||||||||||||||||||||||||||||||||||
g502-1      MMKPHNLFQFLAVCSLTVAVASAQAGAVDALKQFNNDADGISGSFTQTVQSKKKTQTAHG
                    10        20        30        40        50        60

                    70        80        90       100       110       120
m502-1.pep  TFKILRPGLFKWEYTKPYRQTIVGDGQTVWLYDVDLAQVTKSSQDQAIGGSPAAILSNKT
            |||||||||||||| |||||||||||||||||||||||||||||||||||||||||||||
g502-1      TFKILRPGLFKWEYTLPYRQTIVGDGQTVWLYDVDLAQVTKSSQDQAIGGSPAAILSNKT
                    70        80        90       100       110       120

                   130       140       150       160       170       180
m502-1.pep  ALESSYTLKEDGSSNGIDYVLATPKRNNAGYQYIRIGFKGGNLAAMQLKDSFGNQTSISF
            |||||||||||||| |||||||||||||||||||||||||||||||||||||||||||||
g502-1      ALESSYTLKEDGSSNGIDYVLATPKRNNAGYQYIRIGFKGGNLAAMQLKDSFGNQTSISF
                   130       140       150       160       170       180

                   190       200
m502-1.pep  GGLNTNPQLSRGAFKFTPPKGVDVLSNX
            ||||||||||||||||||||||||||||
g502-1      GGLNTNPQLSRGAFKFTPPKGVDVLSNX
                   190       200
```

The following partial DNA sequence was identified in *N. meningitidis* <SEQ ID 1347>:

```
a502-1.seq
  1 ATGATGAAAC CGCACAACCT GTTCCAATTC CTCGCCGTTT GCTCCCTGAC

 51 CGTCTCCGTC GCTTCCGCAC AGGCGGGCGC GGTGGACGCG CTCAAGCAAT

101 TCAACAACGA TGCCGACGGT ATCAGCGGCA GCTTCACCCA AACCGTCCAA

151 AGCAAAAAGA AAACCCAAAC CGCGCACGGC ACGTTCAAAA TCCTGCGCCC

201 GGGCCTCTTT AAATGGGAAT ACACTTCGCC TTACAAACAG ACTATTGTCG

251 GCGACGGTCA AACCGTTTGG CTCTACGATG TCGATTTGGC ACAAGTGACC

301 AAGTCGTCCC AAGACCAGGC CATAGGCGGC AGCCCCGCCG CCATCCTGTC

351 GAACAAAACC GCCCTCGAAA GCAGCTACAC GCTGAAAGAG GACGGTTCGT

401 CCAACGGCAT CGATTATGTG CTGGCAACGC CCAAACGCAA CAACGCCGGC

451 TACCAATACA TCCGCATCGG CTTCAAAGGC GGCAACCTCG CCGCCATGCA

501 GCTTAAAGAC AGCTTCGGCA ATCAAACCTC CATCAGTTTC GGCGGTTTGA
```

-continued

```
551 ATACCAATCC CCAACTCTCG CGCGGCGCGT TCAAGTTTAC CCCGCCCAAA

601 GGCGTGGACG TGTTGAGCAA CTGA
```

This corresponds to the amino acid sequence <SEQ ID 1348; ORF 502-1.a>:

```
a502-1.pep

     1  MMKPHNLFQF  LAVCSLTVSV  ASAQAGAVDA  LKQFNNDADG  ISGSFTQTVQ

    51  SKKKTQTAHG  TFKILRPGLF  KWEYTSPYKQ  TIVGDGQTVW  LYDVDLAQVT

   101  KSSQDQAIGG  SPAAILSNKT  ALESSYTLKE  DGSSNGIDYV  LATPKRNNAG

   151  YQYIRIGFKG  GNLAAMQLKD  SFGNQTSISF  GGLNTNPQLS  RGAFKFTPPK

   201  GVDVLSN*

a502-1/m502-1  98.6% identity in 207 aa overlap

                       10        20        30        40        50        60
a502-1.pep     MMKPHNLFQFLAVCSLTVSVASAQAGAVDALKQFNNDADGISGSFTQTVQSKKKTQTAHG
               |||||||||||||||||:||||||||||||||||||||||||||||||||||||||||||
m502-1         MMKPHNLFQFLAVCSLTVAVASAQAGAVDALKQFNNDADGISGSFTQTVQSKKKTQTAHG
                       10        20        30        40        50        60

                       70        80        90       100       110       120
a502-1.pep     TFKILRPGLFKWEYTSPYKQTIVGDGQTVWLYDVDLAQVTKSSQDQAIGGSPAAILSNKT
               ||||||||||||||:||:||||||||||||||||||||||||||||||||||||||||||
m502-1         TFKILRPGLFKWEYTKPYRQTIVGDGQTVWLYDVDLAQVTKSSQDQAIGGSPAAILSNKT
                       70        80        90       100       110       120

                      130       140       150       160       170       180
a502-1.pep     ALESSYTLKEDGSSNGIDYVLATPKRNNAGYQYIRIGFKGGNLAAMQLKDSFGNQTSISF
               ||||||||||||||||||||||||||||||||||||||||||||||||||||||||||||
m502-1         ALESSYTLKEDGSSNGIDYVLATPKRNNAGYQYIRIGFKGGNLAAMQLKDSFGNQTSISF
                      130       140       150       160       170       180

                      190       200
a502-1.pep     GGLNTNPQLSRGAFKFTPPKGVDVLSNX
               ||||||||||||||||||||||||||||
m502-1         GGLNTNPQLSRGAFKFTPPKGVDVLSNX
                      190       200
```

The following partial DNA sequence was identified in *N. gonorrhoeae* <SEQ ID 1349>:

```
g503.seq
   1 atgtccgcgc cgtcggcatc ggtaatcatt ttgttccatg ccgcttcgat

  51 ttcggcatcg agctgttcgg ggaagggcgt gtccaaaatc cattggcgga

 101 tttctttgcc gacgcgtgcc agttcggaaa cgtcttcgac atccaatttt

 151 gccagagcgg cggaaatgcg ttcgttcaga ccgttgtgtg cgagaaatgc

 201 gcggtag
```

This corresponds to the amino acid sequence <SEQ ID 1350; ORF 503.ng>:

```
g503.pep
   1  MSAPSASVII LFHAASISAS SCSGKGVSKI HWRISLPTRA SSETSSTSNF

  51  ARAAEMRSFR PLCARNAR*
```

The following partial DNA sequence was identified in *N. meningitidis* <SEQ ID 1351>:

```
m503.seq
   1 atgtccgcac cgccggcatc ggcaaccatt ttgttccatg ccgcttcgat

  51 ttcggcatcg agctgttcgg ggaaaggcgt atccaaaatc cattggcgga

 101 tttctttgcc gacgcgtgcc agttcggcaa cgtcttcgac atccaatttt

 151 gccagtgcgg cggaaatgcg ttcgctcaga ccgttgtgtg cgaggaatgc

 201 gcggtag
```

This corresponds to the amino acid sequence <SEQ ID 1352; ORF 503>:

```
m503.pep
   1 MSAPPASATI LFHAASISAS SCSGKGVSKI HWRISLPTRA SSATSSTSNF

  51 ASAAEMRSLR PLCARNAR*
```

Computer analysis of this amino acid sequence gave the following results:

Homology with a Predicted ORF from *N. gonorrhoeae*

ORF 503 shows 91.2% identity over a 68 aa overlap with a predicted ORF (ORF 503.ng) from *N. gonorrhoeae*:

```
m503/g503

                   10        20        30        40        50        60
m503.pep  MSAPPASATILFHAASISASSCSGKGVSKIHWRISLPTRASSATSSTSNFASAAEMRSLR
          |||| ||: ||||||||||||||||||||||||||||||||| |||||||| ||||||:|
g503      MSAPSASVIILFHAASISASSCSGKGVSKIHWRISLPTRASSETSSTSNFARAAEMRSFR
                   10        20        30        40        50        60
                 69
m503.pep  PLCARNAR
          ||||||||
g503      PLCARNAR
```

The following partial DNA sequence was identified in *N. meningitidis* <SEQ ID 1353>:

```
a503.seq
   1 ATGTCCGCGC CGCCGGCATC GGCAACCATT TTGTTCCATG CCGCTTCGAT

  51 TTCGGCATCG AGCTGTTCGG GGAAGGGCGT GTCCAAAATC CATTGGCGGA

 101 TTTCTTTGCC GACGCGTGCC AGTTCGGCAA CGTCTTCGAC ATCTAATTTT

 151 GCCAGTGCGG CGGAAATGCG TTCGCTCAGA CCGTTGTGTG CGAGGAATGC

 201 GCGGTAG
```

This corresponds to the amino acid sequence <SEQ ID 1354; ORF 503.a>:

```
a503.pep
   1 MSAPPASATI LFHAASISAS SCSGKGVSKI HWRISLPTRA SSATSSTSNF

  51 ASAAEMRSLR PLCARNAR*
```

m503/a503 100.0% identity in 68 aa overlap

```
                    10        20        30        40        50        60
m503.pep    MSAPPASATILFHAASISASSCSGKGVSKIHWRISLPTRASSATSSTSNFASAAEMRSLR
            ||||||||||||||||||||||||||||||||||||||||||||||||||||||||||||
a503        MSAPPASATILFHAASISASSCSGKGVSKIHWRISLPTRASSATSSTSNFASAAEMRSLR
                    10        20        30        40        50        60
                   69
m503.pep    PLCARNARX
            |||||||||
a503        PLCARNARX
```

The following partial DNA sequence was identified in *N. gonorrhoeae* <SEQ ID 1355>:

```
g503-1.seq
  1 ATGGCGCGGT CGTTGTACAG GGAGGCGAAA ACGTGGCGCA TCGCTTTTTT

 51 AACGTTATCC AAGCCATTGA TATTCAGGAA GGTTTCCTGT TGGCCGGCAA

101 ATGATGCGTC GGGCAGGTCT TCGGCGGTTG CGGAAGAGCG TACGGCAACG

151 GAAATGTCCG CGCCGTCGGC ATCGGTAATC ATTTTGTTCC ATGCCGCTTC

201 GATTTCGGCA TCGAGCTGTT CGGGGAAGGG CGTGTCCAAA ATCCATTGGC

251 GGATTTCTTT GCCGACGCGT GCCAGTTCGG AAACGTCTTC GACATCCAAT

301 TTTGCCAGAG CGGCGGAAAT GCGTTCGTTC AGACCGTTGT GTGCGAGAAA

351 TGCGCGGTAG
```

This corresponds to the amino acid sequence <SEQ ID 1356; ORF 214.ng>:

```
g503-1.pep
  1 MARSLYREAK TWRIAFLTLS KPLIFRKVSC WPANDASGRS SAVAEERTAT

 51 EMSAPSASVI ILFHAASISA SSCSGKGVSK IHWRISLPTR ASSETSSTSN

101 FARAAEMRSF RPLCARNAR*
```

The following partial DNA sequence was identified in *N. meningitidis* <SEQ ID 1357>:

```
m503-1.seq
  1 ATGGCACGGT CGTTATACAG GGAAGCGAAT ACATGGTGCA TCGCTTCTTT

 51 AACGTTATCC AAGCCGTTGA TGTTCAAGAA GGTTTCCTGT TGTCCAGCGA

101 ATGATGCGTC CGGCAGGTCT TCGGCAGTTG CGGAAGAACG TACGGCAACG

151 GAAATGTCCG CACCGCCGGC ATCGGCAACC ATTTTGTTCC ATGCCGCTTC

201 GATTTCGGCA TCGAGCTGTT CGGGGAAAGG CGTATCCAAA ATCCATTGGC

251 GGATTTCTTT GCCGACGCGT GCCAGTTCGG CAACGTCTTC GACATCCAAT

301 TTTGCCAGTG CGGCGGAAAT GCGTTCGCTC AGACCGTTGT GTGCGAGGAA

351 TGCGCGGTAG
```

This corresponds to the amino acid sequence <SEQ ID 1358; ORF 503-1>:

```
m503-1.pep

      1  MARSLYREAN TWCIASLTLS KPLMFKKVSC CPANDASGRS SAVAEERTAT

     51  EMSAPPASAT ILFHAASISA SSCSGKGVSK IHWRISLPTR ASSATSSTSN
```

-continued

```
     101  FASAAEMRSL RPLCARNAR*

g503-1 / m503-1 89.9% identity in 119 aa overlap

                      10        20        30        40        50        60
g503-1.pep    MARSLYREAKTWRIAFLTLSKPLIFRKVSCWPANDASGRSSAVAEERTATEMSAPSASVI
              |||||||||:|| || |||||||:|:|||| |||||||||||||||||||||||| ||:
m503-1        MARSLYREANTWCIASLTLSKPLMFKKVSCCPANDASGRSSAVAEERTATEMSAPPASAT
                      10        20        30        40        50        60

                      70        80        90       100       110       120
g503-1.pep    ILFHAASISASSCSGKGVSKIHWRISLPTRASSETSSTSNFARAAEMRSFRPLCARNARX
              ||||||||||||||||||||||||||||||||| |||||||| ||||||:||||||||||
m503-1        ILFHAASISASSCSGKGVSKIHWRISLPTRASSATSSTSNFASAAEMRSFRPLCARNARX
                      70        80        90       100       110       120
```

The following partial DNA sequence was identified in *N. meningitidis* <SEQ ID 1359>:

```
a503-1.seq
   1 ATGGCGCGGT CGTTGTACAG GGAGGCGAAT ACATGGCGCA TCGCTTCTTT

  51 AACGTTTTCC AAGCCGTTGA TATTCAGGAA GGTTTCCTGT TGGCCGGCAA

 101 ATGATGCGTC GGGCAGGTCT TCGGCGGTTG CGGAAGAGCG TACGGCAACG

 151 GAAATGTCCG CGCCGCCGGC ATCGGCAACC ATTTTGTTCC ATGCCGCTTC

 201 GATTTCGGCA TCGAGCTGTT CGGGGAAGGG CGTGTCCAAA ATCCATTGGC

 251 GGATTTCTTT GCCGACGCGT GCCAGTTCGG CAACGTCTTC GACATCTAAT

 301 TTTGCCAGTG CGGCGGAAAT GCGTTCGCTC AGACCGTTGT GTGCGAGGAA

 351 TGCGCGGTAG
```

This corresponds to the amino acid sequence <SEQ ID 1360; ORF 503-1.a>:

```
a503-1.pep

       1  MARSLYREAN TWRIASLTFS KPLIFRKVSC WPANDASGRS SAVAEERTAT

      51  EMSAPPASAT ILFHAASISA SSCSGKGVSK IHWRISLPTR ASSATSSTSN

     101  FASAAEMRSL RPLCARNAR*

a501-1/m503-1 95.8% identity in 119 aa overlap
                  10        20        30        40        50        60
a503-1.pep  MARSLYREANTWRIASLTFSKPLIFRKVSCWPANDASGRSSAVAEERTATEMSAPPASAT
            |||||||||||| |||||:||||:|:|||| |||||||||||||||||||||||||||||
m503-1      MARSLYREANTWCIASLTLSKPLMFKKVSCCPANDASGRSSAVAEERTATEMSAPPASAT
                  10        20        30        40        50        60
                  70        80        90       100       110       120
a503-1.pep  ILFHAASISASSCSGKGVSKIHWRISLPTRASSATSSTSNFASAAEMRSLRPLCARNARX
            ||||||||||||||||||||||||||||||||||||||||||||||||||||||||||||
m503-1      ILFHAASISASSCSGKGVSKIHWRISLPTRASSATSSTSNFASAAEMRSLRPLCARNARX
                  70        80        90       100       110       120
```

The following partial DNA sequence was identified in *N. gonorrhoeae* <SEQ ID 1361>:

```
g504.seq
    1  atgttggttc aggacttgcc ttttgaagtc aaactgaaaa aattccatat

   51  cgatttttac aatacgggta tgccgcgcga ttttgccagc gatattgaag

  101  taacggacaa ggcaaccggt gagaaactcg agcgcaccat ccgcgtgaac

  151  catcctttga ccttgcacgg catcacgatt tatcaggcga gttttgccga

  201  cggcggttcg gatttgacat tcaaggcgtg gaatttgagg gatgcttcgc
```

-continued

```
 251 gcgaacctgt cgtgttgaag gcaacctcca tacaccagtt tccgttggaa
 301 atcggcaaac acaaatatcg tcttgagttc gatcagttca cttctatgaa
 351 tgtggaggac atgagcgagg gtgcggaacg ggaaaaaagc ctgaaatcca
 401 ctctgaacga tgtccgcgcc gttactcagg aaggtaaaaa atacaccaat
 451 atcggccctt ccatcgtgta ccgcatccgt gatgcggcag ggcaggcggt
 501 cgaatataaa aactatatgc tgccgatttt gcaggacaaa gattattttt
 551 ggctgaccgg cacgcgcagc ggcttgcagc agcaataccg ctggctgcgt
 601 atccccttgg acaagcagtt gaaagcggac acctttatgg cattgcgtga
 651 gtttttgaaa gatggggaag ggcgcaaacg tctggttgcc gacgcaacca
 701 aagacgcacc tgccgaaatc cgcgaacaat tcatgctggc tgcggaaaac
 751 acgctgaata tctttgcgca aaaaggctat ttgggattgg acgaatttat
 801 tacgtccaat atcccgaaag ggcagcagga taagatgcag ggctatttct
 851 acgaaatgct ttacggcgtg atgaacgctg ctttggatga aaccatacgc
 901 cggtacggct tgcccgaatg gcagcaggat gaagcgcgga accgtttcct
 951 gctgcacagt atggatgcct atacggggct gacggaatat cccgcgccta
1001 tgctgctcca gcttgacggg ttttccgagg tgcgttcctc aggtttgcag
1051 atgacccgtt cgccgggtgc gcttttggtc tatctcggct cggtattgtt
1101 ggttttgggt acagtattta tgttttatgt gcccaaaaaa cgggcgtggg
1151 tattgttttc aaacdgcaaa atccgttttg ctatgtcttc ggcccgcagc
1201 gaacgggatt tgcagaagga atttccaaaa cacgtcgaga gcctgcaacg
1251 gctcggcaag gacttgaatc atgactga
```

This corresponds to the amino acid sequence <SEQ ID 1362; ORF 504.ng>:

```
g504.pep
  1 MLVQDLPFEV KLKKFHIDFY NTGMPRDFAS DIEVTDKATG EKLERTIRVN
 51 HPLTLHGITI YQASFADGGS DLTFKAWNLR DASREPVVLK ATSIHQFPLE
101 IGKHKYRLEF DQFTSMNVED MSEGAEREKS LKSTLNDVRA VTQEGKKYTN
151 IGPSIVYRIR DAAGQAVEYK NYMLPILQDK DYFWLTGTRS GLQQQYRWLR
201 IPLDKQLKAD TFMALREFLK DGEGRKRLVA DATKDAPAEI REQFMLAAEN
251 TLNIFAQKGY LGLDEFITSN IPKGQQDKMQ GYFYEMLYGV MNAALDETIR
301 RYGLPEWQQD EARNRFLLHS MDAYTGLTEY PAPMLLQLDG FSEVRSSGLQ
351 MTRSPGALLV YLGSVLLVLG TVFMFYVPKK RAWVLFSNKI RFAMSSARSE
401 RDLQKEFPKH VESLQRLGKD LNHD*
```

The following partial DNA sequence was identified in *N. meningitidis* <SEQ ID 1363>:

```
m504.seq..
  1 atattggttc aggacttgcc ttttgaagtc aaactgaaaa aattccatat
 51 cgatttttac aatacgggta tgccgcgtga tttcgccagc gatattgaag
101 tgacggacaa ggcaaccggt gagaaactcg agcgcaccat ccgcgtgaac
151 catcctttga ccttgcacgg catcacgatt tatcaggcga gttttgccga
```

-continued

```
 201 cggcggttcg gatttgacat tcaaggcgtg gaatttgggt gatgcttcgc
 251 gcgagcctgt cgtgttgaag gcaacatcca tacaccagtt tccgttggaa
 301 attggcaaac acaaatatcg tcttgagttc gatcagttca cttctatgaa
 351 tgtggaggac atgagcgagg gcgcggaacg ggaaaaaagc ctgaaatcca
 401 cgctgmmcga tgtccgcgcc gttactcagg aaggtaaaaa atacaccaat
 451 atcggccctt ccattgttta ccgtatccgt gatgcggcag ggcaggcggt
 501 cgaatataaa aactatatgc tgccggtttt gcaggaacag gattattttt
 551 ggattaccgg cacgcgcagc ggcttgcagc agcaataccg ctggctgcgt
 601 atccccttgg acaagcagtt gaaagcggac acctttatgg cattgcgtga
 651 gtttttgaaa gatggggaag ggcgcaaacg tctggttgcc gacgcaacca
 701 aaggcgcacc tgccgaaatc cgcgaacaat tcatgctggc tgcggaaaac
 751 acgctgaaca tctttgcaca aaaaggctat ttgggattgg acgaatttat
 801 tacgtccaat atcccgaaag agcagcagga taagatgcag ggctatttct
 851 acgaaatgct ttacggcgtg atgaacgctg ctttggatga aaccatacgc
 901 cggtacggct tgcccgaatg gcagcaggat gaagcgcgga atcgtttcct
 951 gctgcacagt atggatgcgt acacgggttt gaccgaatat cccgcgccta
1001 tgctgctgca acttgatggg ttttccgagg tgcgttcgtc gggtttgcag
1051 atgacccgtt ccccgggtgc gcttttggtc tatctcggct cggtgctgtt
1101 ggtattgggt acggtattga tgttttatgt gcgcgaaaaa cgggcgtggg
1151 tattgttttc agacggcaaa atccgttttg ccatgtcttc ggcccgcagc
1201 gaacgggatt tgcagaagga atttccaaaa cacgtcgaga gtctgcaacg
1251 gctcggcaag gacttgaatc atga
```

This corresponds to the amino acid sequence <SEQ ID 1364; ORF 504>:

```
m504.pep..
  1 ILVQDLPFEV KLKKFHIDFY NTGMPRDFAS DIEVTDKATG EKLERTIRVN
 51 HPLTLHGITI YQASFADGGS DLTFKAWNLG DASREPVVLK ATSIHQFPLE
101 IGKHKYRLEF DQFTSMNVED MSEGAEREKS LKSTLXDVRA VTQEGKKYTN
151 IGPSIVYRIR DAAGQAVEYK NYMLPVLQEQ DYFWITGTRS GLQQQYRWLR
201 IPLDKQLKAD TFMALREFLK DGEGRKRLVA DATKGAPAEI REQFMLAAEN
251 TLNIFAQKGY LGLDEFITSN IPKEQQDKMQ GYFYEMLYGV MNAALDETIR
301 RYGLPEWQQD EARNRFLLHS MDAYTGLTEY PAPMLLQLDG FSEVRSSGLQ
351 MTRSPGALLV YLGSVLLVLG TVLMFYVREK RAWVLFSDGK IRFAMSSARS
401 ERDLQKEFPK HVESLQRLGK DLNHD*
```

Computer analysis of this amino acid sequence gave the following results:

Homology with a Predicted ORF from *N. gonorrhoeae*

ORF 504 shows 96.7% identity over a 425 aa overlap with a predicted ORF (ORF 504.ng) from *N. gonorrhoeae*:

```
m504/g504

                    10        20        30        40        50        60
m504.pep    ILVQDLPFEVKLKKFHIDFYNTGMPRDFASDIEVTDKATGEKLERTIRVNHPLTLHGITI
            :|||||||||||||||||||||||||||||||||||||||||||||||||||||||||||
g504        MLVQDLPFEVKLKKFHIDFYNTGMPRDFASDIEVTDKATGEKLERTIRVNHPLTLHGITI
                    10        20        30        40        50        60

                    70        80        90       100       110       120
m504.pep    YQASFADGGSDLTFKAWNLGDASREPVVLKATSIHQFPLEIGKHKYRLEFDQFTSMNVED
            |||||||||||||||||| |||||||||||||||||||||||||||||||||||||||||
g504        YQASFADGGSDLTFKAWNLRDASREPVVLKATSIHQFPLEIGKHKYRLEFDQFTSMNVED
                    70        80        90       100       110       120

                   130       140       150       160       170       180
m504.pep    MSEGAEREKSLKSTLXDVRAVTQEGKKYTNIGPSIVYRIRDAAGQAVEYKNYMLPVLQEQ
            ||||||||||||||| ||||||||||||||||||||||||||||||||||||||:||::
g504        MSEGAEREKSLKSTLNDVRAVTQEGKKYTNIGPSIVYRIRDAAGQAVEYKNYMLPILQDK
                   130       140       150       160       170       180

                   190       200       210       220       230       240
m504.pep    DYFWITGTRSGLQQQYRWLRIPLDKQLKADTFMALREFLKDGEGRKRLVADATKGAPAEI
            ||||:||||||||||||||||||||||||||||||||||||||||||||||||| |||||
g504        DYFWLTGTRSGLQQQYRWLRIPLDKQLKADTFMALREFLKDGEGRKRLVADATKDAPAEI
                   190       200       210       220       230       240

                   250       260       270       280       290       300
m504.pep    REQFMLAAENTLNIFAQKGYLGLDEFITSNIPKEQQDKMQGYFYEMLYGVMNAALDETIR
            |||||||||||||||||||||||||||||||| |||||||||||||||||||||||||||
g504        REQFMLAAENTLNIFAQKGYLGLDEFITSNIPKGQQDKMQGYFYEMLYGVMNAALDETIR
                   250       260       270       280       290       300

                   310       320       330       340       350       360
m504.pep    RYGLPEWQQDEARNRFLLHSMDAYTGLTEYPAPMLLQLDGFSEVRSSGLQMTRSPGALLV
            ||||||||||||||||||||||||||||||||||||||||||||||||||||||||||||
g504        RYGLPEWQQDEARNRFLLHSMDAYTGLTEYPAPMLLQLDGFSEVRSSGLQMTRSPGALLV
                   310       320       330       340       350       360

                   370       380       390       400       410       420
m504.pep    YLGSVLLVLGTVLMFYVREKRAWVLFSDGKIRFAMSSARSERDLQKEFPKHVESLQRLGK
            ||||||||||||:||||  :||||||||: ||||||||||||||||||||||||||||||
g504        YLGSVLLVLGTVFMFYVPKKRAWVLFSN-KIRFAMSSARSERDLQKEFPKHVESLQRLGK
                   370       380        390       400       410

m504.pep    DLNHD
            |||||
g504        DLNHD
          420
```

The following partial DNA sequence was identified in *N. meningitidis* <SEQ ID 1365>:

```
a504.seq
   1  ATATTGGTTC AGGACTTGCC TTTTGAAGTC AAACTGAAAA AATTCCATAT

  51  CGATTTTTAC AATACGGGTA TGCCGCGCGA TTTTGCCAGT GATATTGAAG

 101  TAACGGATAA GGCAACCGGT GAGAAACTCG AGCGCACCAT CCGCGTGAAC

 151  CATCCTTTGA CCTTGCACGG CATCACGATT TATCAGGCGA GTTTTGCCGA

 201  CGGCGGTTCG GATTTGACAT TCAAGGCGTG GAATTTGGGT GATGCTTCGC

 251  GCGAGCCTGT CGTGTTGAAG GCAACATCCA TACACCAGTT TCCGTTGGAA

 301  ATTGGCAAAC ACAAATATCG TCTTGAGTTC GATCAGTTTA CTTCTATGAA

 351  TGTGGAGGAC ATGAGCGAGG GCGCGGAACG GGAAAAAAGC CTGAAATCCA

 401  CGCTGAACGA TGTCCGCGCC GTTACTCAGG AAGGTAAAAA ATACACCAAT

 451  ATCGGCCCTT CCATTGTTTA CCGTATCCGT GATGCGGCAG GGCAGGCGGT
```

-continued

```
 501 CGAATATAAA AACTATATGC TGCCGGTTTT GCAGGAACAG GATTATTTTT

 551 GGATTACCGG CACGCGCAGC GGCTTGCAGC AGCAATACCG CTGGCTGCGT

 601 ATCCCCTTGG ACAAGCAGTT GAAAGCGGAC ACCTTTATGG CATTGCGTGA

 651 GTTTTTGAAA GATGGGGAAG GGCGCAAACG TCTGGTTGCC GACGCAACCA

 701 AAGGCGCACC TGCCGAAATC CGCGAACAAT TCATGCTGGC TGCGGAAAAC

 751 ACGCTGAACA TCTTTGCACA AAAAGGCTAT TTGGGATTGG ACGAATTTAT

 801 TACGTCCAAT ATCCCGAAAG AGCAGCAGGA TAAGATGCAG GGCTATTTCT

 851 ACGAAATGCT TTACGGCGTG ATGAACGCTG CTTTGGATGA AACCATACGC

 901 CGGTACGGCT TGCCCGAATG GCAGCAGGAT GAAGCGCGGA ATCGTTTCCT

 951 GCTGCACAGT ATGGATGCGT ACACGGGTTT GACCGAATAT CCCGCGCCTA

1001 TGCTGCTGCA ACTTGATGGG TTTTCCGAGG TGCGTTCGTC GGGTTTGCAG

1051 ATGACCCGTT CCCCGGGTGC GCTTTTGGTC TATCTCGGCT CGGTGCTGTT

1101 GGTATTGGGT ACGGTATTGA TGTTTTATGT GCGCGAAAAA CGGGCGTGGG

1151 TATTGTTTTC AGACGGCAAA ATCCGTTTTG CCATGTCTTC GGCTTGCAGC

1201 GAACGGGATT TGCAGAAGGA ATTTCCAAAA CACGTCGAGA GTCTGCAACG

1251 GCTCGGCAAG GACTTGAATC ATGACTGA
```

This corresponds to the amino acid sequence <SEQ ID 1366; ORF 504.a>:

```
a504.pep
  1 ILVQDLPFEV KLKKFHIDFY NTGMPRDFAS DIEVTDKATG EKLERTIRVN

 51 HPLTLHGITI YQASFADGGS DLTFKAWNLG DASREPVVLK ATSIHQFPLE

101 IGKHKYRLEF DQFTSMNVED MSEGAEREKS LKSTLNDVRA VTQEGKKYTN

151 IGPSIVYRIR DAAGQAVEYK NYMLPVLQEQ DYFWITGTRS GLQQQYRWLR

201 IPLDKQLKAD TFMALREFLK DGEGRKRLVA DATKGAPAEI REQFMLAAEN

251 TLNIFAQKGY LGLDEFITSN IPKEQQDKMQ GYFYEMLYGV MNAALDETIR

301 RYGLPEWQQD EARNRFLLHS MDAYTGLTEY PAPMLLQLDG FSEVRSSGLQ

351 MTRSPGALLV YLGSVLLVLG TVLMFYVREK RAWVLFSDGK IRFAMSSARS

401 ERDLQKEFPK HVESLQRLGK DLNHD*
```

m504/a504 99.8% identity in 425 aa overlap

```
                   10        20        30        40        50        60
m504.pep   ILVQDLPFEVKLKKFHIDFYNTGMPRDFASDIEVTDKATGEKLERTIRVNHPLTLHGITI
           ||||||||||||||||||||||||||||||||||||||||||||||||||||||||||||
a504        ILVQDLPFEVKLKKFHIDFYNTGMPRDFASDIEVTDKATGEKLERTIRVNHPLTLHGITI
                 10        20        30        40        50        60

                   70        80        90       100       110       120
m504.pep   YQASFADGGSDLTFKAWNLGDASREPVVLKATSIHQFPLEIGKHKYRLEFDQFTSMNVED
           ||||||||||||||||||||||||||||||||||||||||||||||||||||||||||||
a504       YQASFADGGSDLTFKAWNLGDASREPVVLKATSIHQFPLEIGKHKYRLEFDQFTSMNVED
                   70        80        90       100       110       120

                  130       140       150       160       170       180
m504.pep   MSEGAEREKSLKSTLXDVRAVTQEGKKYTNIGPSIVYRIRDAAGQAVEYKNYMLPVLQEQ
           ||||||||||||||||||||||||||||||||||||||||||||||||||||||||||||
a504       MSEGAEREKSLKSTLXDVRAVTQEGKKYTNIGPSIVYRIRDAAGQAVEYKNYMLPVLQEQ
                  130       140       150       160       170       180
```

-continued

```
                190       200       210       220       230       240
m504.pep  DYFWITGTRSGLQQQYRWLRIPLDKQLKADTFMALREFLKDGEGRKRLVADATKGAPAEI
          ||||||||||||||||||||||||||||||||||||||||||||||||||||||||||||
a504      DYFWITGTRSGLQQQYRWLRIPLDKQLKADTFMALREFLKDGEGRKRLVADATKGAPAEI
                190       200       210       220       230       240

                250       260       270       280       290       300
m504.pep  REQFMLAAENTLNIFAQKGYLGLDEFITSNIPKEQQDKMQGYFYEMLYGVMNAALDETIR
          ||||||||||||||||||||||||||||||||||||||||||||||||||||||||||||
a504      REQFMLAAENTLNIFAQKGYLGLDEFITSNIPKEQQDKMQGYFYEMLYGVMNAALDETIR
                250       260       270       280       290       300

                310       320       330       340       350       360
m504.pep  RYGLPEWQQDEARNRFLLHSMDAYTGLTEYPAPMLLQLDGFSEVRSSGLQMTRSPGALLV
          ||||||||||||||||||||||||||||||||||||||||||||||||||||||||||||
a504      RYGLPEWQQDEARNRFLLHSMDAYTGLTEYPAPMLLQLDGFSEVRSSGLQMTRSPGALLV
                310       320       330       340       350       360

                370       380       390       400       410       420
m504.pep  YLGSVLLVLGTVLMFYVREKRAWVLFSDGKIRFAMSSARSERDLQKEFPKHVESLQRLGK
          ||||||||||||||||||||||||||||||||||||||||||||||||||||||||||||
a504      YLGSVLLVLGTVLMFYVREKRAWVLFSDGKIRFAMSSARSERDLQKEFPKHVESLQRLGK
                370       380       390       400       410       420

m504.pep  DLNHDX
          ||||||
a504      DLNHDX
```

The following partial DNA sequence was identified in *N. gonorrhoeae* <SEQ ID 1367>:

```
g505.seq
   1 atgtttcgtt tacaattcag gctgtttccc cctttgcgaa ccgccatgca

  51 catcctgttg accgccctgc tcaaatgcct ctccctgctg tcgctttcct

 101 gtctgcacac gctgggaaac cggctcggac atctggcgtt ttacctttta

 151 aaggaagacc gcgcgcgcat cgtcgccaat atgcggcagg cgggtttgaa

 201 ccccgacacg cagacggtca aagccgtttt tgcggaaacg gcaaaatgcg

 251 gtttggaact tgcccccgcg tttttcaaaa aaccggaaga catcgaaaca

 301 atgttcaaag cggtacacgg ctgggaacac gtgcagcagg ctttggacaa

 351 gggcgaaggg ctgctgttca tcacgccgca catcggcagc tacgatttgg

 401 gcggacgcta catcagccag cagcttccgt tccacctgac cgccatgtac

 451 aagccgccga aaatcaaagc gatagacaaa atcatgcagg cgggcagggt

 501 gcgcggcaaa ggcaaaaccg cgcccaccgg catacaaggg gtcaaacaaa

 551 tcatcaaggc cctgcgcgcg ggcgaggcaa ccatcatcct gcccgaccac

 601 gtcccttctc cgcaggaagg cggcggcgtg tgggcggatt ttttcggcaa

 651 acctgcatac accatgacac tggcggcaaa attggcacac gtcaaaggcg

 701 tgaaaaccct gtttttctgc tgcgaacgcc tgcccgacgg acaaggcttc

 751 gtgttgcaca tccgccccgt ccaaggggaa ttgaacggca acaaagccca

 801 cgatgccgcc gtgttcaacc gcaataccga atattggata cgccgttttc

 851 cgacgcagta tctgtttatg tacaaccgct ataaaacgcc gtaa
```

This corresponds to the amino acid sequence <SEQ ID 1368; ORF 505.ng>:

```
g505.pep
   1 MFRLQFRLFP PLRTAMHILL TALLKCLSLL SLSCLHTLGN RLGHLAFYLL

  51 KEDRARIVAN MRQAGLNPDT QTVKAVFAET AKCGLELAPA FFKKPEDIET

 101 MFKAVHGWEH VQQALDKGEG LLFITPHIGS YDLGGRYISQ QLPFHLTAMY

 151 KPPKIKAIDK IMQAGRVRGK GKTAPTGIQG VKQIIKALRA GEATIILPDH
```

-continued

```
201 VPSPQEGGGV WADFFGKPAY TMTLAAKLAH VKGVKTLFFC CERLPDGQGF

251 VLHIRPVQGE LNGNKAHDAA VFNRNTEYWI RRFPTQYLFM YNRYKTP*
```

The following partial DNA sequence was identified in *N. meningitidis* <SEQ ID 1369>:

```
m505.seq (partial)
  1 GGCATGTTTC GTTTACAATT CAGGCTGTTT CCCCCTTTGC GAACCGCCAT

 51 GCACATCCTG TTGACCGCCC TGCTCAAATG CCTCTCCCTG CTGCCGCTTT

101 CCTGTCTGCA CACGCTGGGA AACCGGCTCG GACATCTGGC GTTTTACCTT

151 TTAAAGGAAG ACCGCGCGCG CATCGTCGCC AATATGCGGC AGGCGGGTTT

201 GAACCCCGAC CCCAAAACGG TCAAAGCCGT TTTTGCGGAA ACGGCAAAAG

251 GCGGTTTGGA ACTTGCCCCC GCGTTTTTCA GAAAACCGGA AGACATAGAA

301 ACAATGTTCA AAGCGGTACA CGGCTGGGAA CATGTGCAGC AGGCTTTGGA

351 CAAACACGAA GGGCTGCTAT TCATCACGCC GCACATCGGC AGCTACGATT

401 TGGGCGGACG CTACATCAGC CAGCAGCTTC CGTTCCCGCT GACCGCCATG

451 TACAAACCGC CGAAAATCAA AGCGATAGAC AAAATCATGC AGGCGGGCAG

501 GGTTCGCGGC AAAGGAAAAA CCGCGCCTAC CAGCATACAA GGGGTCAAAC

551 AAATCATCAA AGCCCTGCGT TCGGGCGAgC AACCATCGTC CTGCCCGACC

601 ACGTCCCCTC CCCTCAAGAA GGCGGGGAAG GCGTATGGGT GGATTTCTTC

651 GGCAAACCTG CCTATACCAT GACGCTGGCG GCAArATTGG CACACGTCAA

701 AGGCGTGAAA ACCCTGTTTT TCTGCTGCGA ACGCCTGCCT GGCGGACAAG

751 GTTTCGATTT GCACATCCGC CCCGTCCAAG GGGAATTGAA CGGCGACAAA

801 GCCCATGATG CCGCCGTGTT CAACCGCAAT GCCGAATATT GGATACGCCG

851 TTTTCCGACG CAtATC....
```

This corresponds to the amino acid sequence <SEQ ID 1370; ORF 505>:

```
m505.pep (partial)
  1 MFRLQFRLFP PLRTAMHILL TALLKCLSLL PLSCLHTLGN RLGHLAFYLL

 51 KEDRARIVAN MRQAGLNPDP KTVKAVFAET AKGGLELAPA FFRKPEDIET

101 MFKAVHGWEH VQQALDKHEG LLFITPHIGS YDLGGRYISQ QLPFPLTAMY

151 KPPKIKAIDK IMQAGRVRGK GKTAPTSIQG VKQIIKALRS GEATIVLPDH

201 VPSPQEGGEG VWVDFFGKPA YTMTLAAXLA HVKGVKTLFF CCERLPGGQG

251 FDLHIRPVQG ELNGDKAHDA AVFNRNAEYW IRRFPTHI...
```

Computer analysis of this amino acid sequence gave the following results:

Homology with a Predicted ORF from *N. gonorrhoeae*

ORF 505 shows 93.7% identity over a 287 aa overlap with a predicted ORF (ORF 505.ng) from *N. gonorrhoeae*:

```
m505/g505

                        10        20        30        40        50        60
m505.pep     MFRLQFRLFPPLRTAMHILLTALLKCLSLLPLSCLHTLGNRLGHLAFYLLKEDRARIVAN
             |||||||||||||||||||||||||||||| |||||||||||||||||||||||||||||
g505         MFRLQFRLFPPLRTAMHILLTALLKCLSLLSLSCLHTLGNRLGHLAFYLLKEDRARIVAN
                        10        20        30        40        50        60

                        70        80        90       100       110       120
m505.pep     MRQAGLNPDPKTVKAVFAETAKGGLELAPAFFRKPEDIETMFKAVHGWEHVQQALDKHEG
             ||||||||| :||||||||||| |||||||||:|||||||||||||||||||||||| ||
g505         MRQAGLNPDTQTVKAVFAETAKCGLELAPAFFKKPEDIETMFKAVHGWEHVQQALDKGEG
                        70        80        90       100       110       120

                       130       140       150       160       170       180
m505.pep     LLFITPHIGSYDLGGRYISQQLPFPLTAMYKPPKIKAIDKIMQAGRVRGKGKTAPTSIQG
             |||||||||||||||||||||||| |||||||||||||||||||||||||||||||:|||
g505         LLFITPHIGSYDLGGRYISQQLPFHLTAMYKPPKIKAIDKIMQAGRVRGKGKTAPTGIQG
                       130       140       150       160       170       180
                       190       200       210       220       230       240
m505.pep     VKQIIKALRSGEATIVLPDHVPSPQEGGEGVWVDFFGKPAYTMTLAAXLAHVKGVKTLFF
             |||||||||:|||||:|||||||||||| |||:|||||||||||||| ||||||||||||
g505         VKQIIKALRAGEATIILPDHVPSPQEGG-GVWADFFGKPAYTMTLAAKLAHVKGVKTLFF
                       190       200        210       220       230
                       250       260       270       280      289
m505.pep     CCERLPGGQGFDLHIRPVQGELNGDKAHDAAVFNRNAEYWIRRFPTHI
             |||||| |||| ||||||||||||:|||||||||||:|||||||||:
g505         CCERLPDGQGFVLHIRPVQGELNGNKAHDAAVFNRNTEYWIRRFPTQYLFMYNRYKTP
           240       250       260       270       280       290
```

The following partial DNA sequence was identified in *N. meningitidis* <SEQ ID 1371>:

```
a505.seq
   1 ATGTTTCGTT TACAATTCAG GCTGTTTCCC CCTTTGCGAA CCGCCATGCA

  51 CATCCTGTTG ACCGCCCTGC TCAAATGCCT CTCCCTGCTG CCGCTTTCCT

 101 GTCTGCACAC GCTGGGAAAC CGGCTCGGAC ATCTGGCGTT TTACCTTTTA

 151 AAGGAAGACC GCGCGCGCAT CGTCGCCAAT ATGCGTCAGG CAGGCATGAA

 201 TCCCGACCCC AAAACGGTCA AAGCCGTTTT TGCGGAAACG GCAAAAGGCG

 251 GTTTGGAACT TGCCCCCGCG TTTTTCAGAA AACCGGAAGA CATAGAAACA

 301 ATGTTCAAAG CGGTACACGG CTGGGAACAT GTGCAGCAGG CTTTGGACAA

 351 ACACGAAGGG CTGCTATTCA TCACGCCGCA CATCGGCAGC TACGATTTGG

 401 GCGGACGCTA CATCAGCCAG CAGCTTCCGT TCCCGCTGAC CGCCATGTAC

 451 AAACCGCCGA AAATCAAAGC GATAGACAAA ATCATGCAGG CGGGCAGGGT

 501 TCGCGGCAAA GGAAAAACCG CGCCTACCAG CATACAAGGG GTCAAACAAA

 551 TCATCAAAGC CCTGCGTTCG GGCGAAGCAA CCATCGTCCT GCCCGACCAC

 601 GTCCCCTCCC CTCAAGAAGG CGGGGAAGGC GTATGGGTGG ATTTCTTCGG

 651 CAAACCTGCC TATACCATGA CGCTGGCGGC AAAATTGGCA CACGTCAAAG

 701 GCGTGAAAAC CCTGTTTTTC TGCTGCGAAC GCCTGCCTGG CGGACAAGGT

 751 TTCGATTTGC ACATCCGCCC CGTCCAAGGG GAATTGAACG GCGACAAAGC

 801 CCATGATGCC GCCGTGTTCA ACCGCAATGC CGAATATTGG ATACGCCGTT

 851 TTCCGACGCA GTATCTGTTT ATGTACAACC GCTACAAAAT GCCGTAA
```

This corresponds to the amino acid sequence <SEQ ID 1372; ORF 505.a>:

```
a505.pep
   1 MFRLQFRLFP PLRTAMHILL TALLKCLSLL PLSCLHTLGN RLGHLAFYLL

  51 KEDRARIVAN MRQAGMNPDP KTVKAVFAET AKGGLELAPA FFRKPEDIET

 101 MFKAVHGWEH VQQALDKHEG LLFITPHIGS YDLGGRYISQ QLPFPLTAMY

 151 KPPKIKAIDK IMQAGRVRGK GKTAPTSIQG VKQIIKALRS GEATIVLPDH

 201 VPSPQEGGEG VWVDFFGKPA YTMTLAAKLA HVKGVKTLFF CCERLPGGQG

 251 FDLHIRPVQG ELNGDKAHDA AVFNRNAEYW IRRFPTQYLF MYNRYKMP*
```

m505/a505 99.0% identity in 287 aa overlap

```
                      10        20        30        40        50        60
m505.pep      MFRLQFRLFPPLRTAMHILLTALLKCLSLLPLSCLHTLGNRLGHLAFYLLKEDRARIVAN
              ||||||||||||||||||||||||||||||||||||||||||||||||||||||||||||
a505          MFRLQFRLFPPLRTAMHILLTALLKCLSLLPLSCLHTLGNRLGHLAFYLLKEDRARIVAN
                      10        20        30        40        50        60
                      70        80        90       100       110       120
m505.pep      MRQAGLNPDPKTVKAVFAETAKGGLELAPAFFRKPEDIETMFKAVHGWEHVQQALDKHEG
              |||||:||||||||||||||||||||||||||||||||||||||||||||||||||||||
a505          MRQAGMNPDPKTVKAVFAETAKGGLELAPAFFRKPEDIETMFKAVHGWEHVQQALDKHEG
                      70        80        90       100       110       120
                     130       140       150       160       170       180
m505.pep      LLFITPHIGSYDLGGRYISQQLPFPLTAMYKPPKIKAIDKIMQAGRVRGKGKTAPTSIQG
              ||||||||||||||||||||||||||||||||||||||||||||||||||||||||||||
a505          LLFITPHIGSYDLGGRYISQQLPFPLTAMYKPPKIKAIDKIMQAGRVRGKGKTAPTSIQG
                     130       140       150       160       170       180
                     190       200       210       220       230       240
m505.pep      VKQIIKALRSGEATIVLPDHVPSPQEGGEGVWVDFFGKPAYTMTLAAXLAHVKGVKTLFF
              ||||||||||||||||||||||||||||||||||||||||||||||| ||||||||||||
a505          VKQIIKALRSGEATIVLPDHVPSPQEGGEGVWVDFFGKPAYTMTLAAKLAHVKGVKTLFF
                     190       200       210       220       230       240
                     250       260       270       280
m505.pep      CCERLPGGQGFDLHIRPVQGELNGDKAHDAAVFNRNAEYWIRRFPTHI
              ||||||||||||||||||||||||||||||||||||||||||||||:
a505          CCERLPGGQGFDLHIRPVQGELNGDKAHDAAVFNRNAEYWIRRFPTQYLFMYNRYKMPX
                     250       260       270       280       290
```

The following partial DNA sequence was identified in *N. meningitidis* <SEQ ID 1373>:

```
m505-1.seq
   1 ATGTTTCGTT TACAATTCAG GCTGTTTCCC CCTTTGCGAA CCGCCATGCA

  51 CATCCTGTTG ACCGCCCTGC TCAAATGCCT CTCCCTGCTG CCGCTTTCCT

 101 GTCTGCACAC GCTGGGAAAC CGGCTCGGAC ATCTGGCGTT TTACCTTTTA

 151 AAGGAAGACC GCGCGCGCAT CGTCGCCAAT ATGCGGCAGG CGGGTTTGAA

 201 CCCCGACCCC AAAACGGTCA AAGCCGTTTT TGCGGAAACG GCAAAAGGCG

 251 GTTTGGAACT TGCCCCCGCG TTTTTCAGAA AACCGGAAGA CATAGAAACA

 301 ATGTTCAAAG CGGTACACGG CTGGGAACAT GTGCAGCAGG CTTTGGACAA

 351 ACACGAAGGG CTGCTATTCA TCACGCCGCA CATCGGCAGC TACGATTTGG

 401 GCGGACGCTA CATCAGCCAG CAGCTTCCGT TCCCGCTGAC CGCCATGTAC

 451 AAACCGCCGA AAATCAAAGC GATAGACAAA ATCATGCAGG CGGGCAGGGT

 501 TCGCGGCAAA GGAAAAACCG CGCCTACCAG CATACAAGGG GTCAAACAAA

 551 TCATCAAAGC CCTGCGTTCG GGCGAAGCAA CCATCGTCCT GCCCGACCAC
```

-continued

```
601 GTCCCCTCCC CTCAAGAAGG CGGGGAAGGC GTATGGGTGG ATTTCTTCGG

651 CAAACCTGCC TATACCATGA CGCTGGCGGC AAAATTGGCA CACGTCAAAG

701 GCGTGAAAAC CCTGTTTTTC TGCTGCGAAC GCCTGCCTGG CGGACAAGGT

751 TTCGATTTGC ACATCCGCCC CGTCCAAGGG GAATTGAACG GCGACAAAGC

801 CCATGATGCC GCCGTGTTCA ACCGCAATGC CGAATATTGG ATACGCCGTT

851 TTCCGACGCA GTATCTGTTT ATGTACAACC GCTACAAAAT GCCGTAA
```

This corresponds to the amino acid sequence <SEQ ID 1374; ORF 505-1>:

```
m505-1.pep

      1  MFRLQFRLFP PLRTAMHILL TALLKCLSLL PLSCLHTLGN RLGHLAFYLL

     51  KEDRARIVAN MRQAGLNPDP KTVKAVFAET AKGGLELAPA FFRKPEDIET

    101  MFKAVHGWEH VQQALDKHEG LLFITPHIGS YDLGGRYISQ QLPFPLTAMY

    151  KPPKIKAIDK IMQAGRVRGK GKTAPTSIQG VKQIIKALRS GEATIVLPDH

    201  VPSPQEGGEG VWVDFFGKPA YTMTLAAKLA HVKGVKTLFF CCERLPGGQG

    251  FDLHIRPVQG ELNGDKAHDA AVFNRNAEYW IRRFPTQYLF MYNRYKMP*

m505-1/g505    94.3% identity in 298 aa overlap

                        10        20        30        40        50        60
m505-1.pep     MFRLQFRLFPPLRTAMHILLTALLKCLSLLPLSCLHTLGNRLGHLAFYLLKEDRARIVAN
               |||||||||||||||||||||||||||||| |||||||||||||||||||||||||||||
g505           MFRLQFRLFPPLRTAMHILLTALLKCLSLLSLSCLHTLGNRLGHLAFYLLKEDRARIVAN
                        10        20        30        40        50        60

                        70        80        90       100       110       120
m505-1.pep     MRQAGLNPDPKTVKAVFAETAKGGLELAPAFFRKPEDIETMFKAVHGWEHVQQALDKHEG
               ||||||||| :||||||||||| |||||||||:|||||||||||||||||||||||| ||
g505           MRQAGLNPDTQTVKAVFAETAKCGLELAPAFFKKPEDIETMFKAVHGWEHVQQALDKGEG
                        70        80        90       100       110       120

                       130       140       150       160       170       180
m505-1.pep     LLFITPHIGSYDLGGRYISQQLPFPLTAMYKPPKIKAIDKIMQAGRVRGKGKTAPTSIQG
               |||||||||||||||||||||||| |||||||||||||||||||||||||||||||:|||
g505           LLFITPHIGSYDLGGRYISQQLPFHLTAMYKPPKIKAIDKIMQAGRVRGKGKTAPTGIQG
                       130       140       150       160       170       180

                       190       200       210       220       230       240
m505-1.pep     VKQIIKALRSGEATIVLPDHVPSPQEGGEGVWVDFFGKPAYTMTLAAKLAHVKGVKTLFF
               |||||||||:|||||:|||||||||||| |||:|||||||||||||||||||||||||||
g505           VKQIIKALRAGEATIILPDHVPSPQEGG-GVWADFFGKPAYTMTLAAKLAHVKGVKTLFF
                       190       200        210       220       230

                       250       260       270       280       290      299
m505-1.pep     CCERLPGGQGFDLHIRPVQGELNGDKAHDAAVFNRNAEYWIRRFPTQYLFMYNRYKMPX
               |||||| |||| ||||||||||||:|||||||||||:||||||||||||||||||| ||
g505           CCERLPDGQGFVLHIRPVQGELNGNKAHDAAVFNRNTEYWIRRFPTQYLFMYNRYKTPX
             240       250       260       270       280       290

m505-1/a505    99.7% identity in 298 aa overlap

                        10        20        30        40        50        60
m505-1.pep     MFRLQFRLFPPLRTAMHILLTALLKCLSLLPLSCLHTLGNRLGHLAFYLLKEDRARIVAN
               ||||||||||||||||||||||||||||||||||||||||||||||||||||||||||||
a505           MFRLQFRLFPPLRTAMHILLTALLKCLSLLPLSCLHTLGNRLGHLAFYLLKEDRARIVAN
                        10        20        30        40        50        60

                        70        80        90       100       110       120
m505-1.pep     MRQAGLNPDPKTVKAVFAETAKGGLELAPAFFRKPEDIETMFKAVHGWEHVQQALDKHEG
               |||||:||||||||||||||||||||||||||||||||||||||||||||||||||||||
a505           MRQAGMNPDPKTVKAVFAETAKGGLELAPAFFRKPEDIETMFKAVHGWEHVQQALDKHEG
                        70        80        90       100       110       120

                       130       140       150       160       170       180
m505-1.pep     LLFITPHIGSYDLGGRYISQQLPFPLTAMYKPPKIKAIDKIMQAGRVRGKGKTAPTSIQG
               ||||||||||||||||||||||||||||||||||||||||||||||||||||||||||||
a505           LLFITPHIGSYDLGGRYISQQLPFPLTAMYKPPKIKAIDKIMQAGRVRGKGKTAPTSIQG
                       130       140       150       160       170       180
```

-continued

```
                    190        200        210        220        230        240
m505-1.pep    VKQIIKALRSGEATIVLPDHVPSPQEGGEGVWVDFFGKPAYTMTLAAXLAHVKGVKTLFF
              |||||||||||||||||||||||||||||||||||||||||||||||| |||||||||||
a505          VKQIIKALRSGEATIVLPDHVPSPQEGGEGVWVDFFGKPAYTMTLAAKLAHVKGVKTLFF
                    190        200        210        220        230        240

                    250        260        270        280        290       299
m505-1.pep    CCERLPGGQGFDLHIRPVQGELNGDKAHDAAVFNRNAEYWIRRFPTQYLFMYNRYKMPX
              |||||||||||||||||||||||||||||||||||||||||||||||||||||||||||
a505          CCERLPGGQGFDLHIRPVQGELNGDKAHDAAVFNRNAEYWIRRFPTQYLFMYNRYKMPX
                    250        260        270        280        290
```

The following partial DNA sequence was identified in *N. gonorrhoeae* <SEQ ID 1375>:

```
g506.seq
   1  ATGGCGGTAT TTGATGAAGT CGGGCGCATC GCCCATGGCT GCGGCGGTGT
  51  TGTCAAACAA AGCCTGTTTC TGCGCGTCGT TCATCAGGTT GAACAAGGCG
 101  CGCGGTTGGC TGAAGTAGTC GTCATCGTCT TGGCGGTAGT CCCAGTGTGC
 151  CGCGTCGCCG TTGATTTTCA AAGGCGGTTC GGCGAAGTCG GGTTGTTGCT
 201  GCCATTGGCC GAAGCTGTTG GGTTCGTAGT GCGGCAGGCT GCCGTAGTTG
 251  CCGTCGGCGC GGCCTTGTCC GTCGCGCTGG TTGCTGTGAA CAGGGCAACG
 301  CGGACGATTG ACGGGGATTT GGCGGAAGTT CACACCCAAG CGGTAACGTT
 351  GCGCGTCGGC GTAATTGAAC AAACGGGCTT GCAACATTTT ATCCGGGCTC
 401  GCGCCGATAC CGGGAACGAG GTTGCTCGGT GCGAAGGCGG ATTGTTCCAC
 451  ATCGGCGAAG AAGTTTTCGG GATTGCGGTT CAACTCGAAT TTGCCGACTT
 501  CAATCAGCGG ATAGTCTTTT TTCGGCCAAA CTTTGGTCAA GTCAAACGGA
 551  TGATAAGGCA CTTTTTCGGC ATCGGCTTCA GGCATGACTT GGATGTACAT
 601  CGTCCATTTC GGGAACTCGC CGCGCTCGAT GGCTTCGTAC AGGTCGCGCT
 651  GATGGCTTTC GCGGTCGTCG GCGATGATTT TTGCAGCTTC TTCGTTGGTC
 701  AGGTTTTTAA TCCCTTGCTG GCTGCGGAAA TGGAATTTCA CCCAAAAACG
 751  TTCGCCCGCT TCGTTCCAGA AGCTGTAGGT ATGCGAACCG AAGCCGTGCA
 801  TATGGCGGTA GCTGGCGGGA ATACCGCGGT CGCTCATCAC GATGGTAACT
 851  TGGTGCAGGG CTTCGGGCAG CAGCGTCCAG AAGTCCCAGT TGTTTGTGGC
 901  GGAACGCATA TTGGTGCGCG GATCGCGTTT GACGGCTTTG TTCAGGTCGG
 951  GGAATTTGCG CGGGTCGCGC AGGAAGAACA CGGGCGTGTT GTTGCCGACC
1001  ACATCCCAGT TGCCTTCTTC GGTATAGAAT TTCAACGCAA AACCGCGGAT
1051  GTCGCGTTCC GCATCGGCTG CGCCGCGCTC GCCTGCCACG GTGGTGAAAC
1101  GGGCGAACAT CTCGGTTTTT TTGCCGACTT CGCTGAAAAT TTTGGCGCGG
1151  GTGTATTTGG TGATGTCGTG TGTTACGGTA AACGTACCGA ACGCGCCCGA
1201  ACCTTTGGCG TGCATACGGC GTTCGGGGAT GACTTCGCGC ACGAAGTCGG
1251  CGAGTTTTTC ATTCAGCCAC AAATCTTGCG TCAGCAGGGG GCCGCGCGGG
1301  CCGGCGGTCA GGCTGTTTTG ATTGTCGGCA ACGGGCGCGC CGTTGTTCAT
1351  GGTCAGATGG GTTACGGGGC ATTTGGAGGT AGTCATCGCT CTTGTTCCTT
1401  TTCTCAGGTT GGTCAAATGG GGGGCAAACG GCTTACAGTA CGATTTGGCG
1451  GAAAGCGTAT TCGTAACCGG TTTCTTGATT GTAATAAATT TCTTGAATCG
1501  ACATTTTATT TTCCTTTTGC AAAAACTATG GATGCGATTA TACGCCAAGA
```

-continued

```
1551  TTTTCGTTAT TAA
```

This corresponds to the amino acid sequence <SEQ ID 1376; ORF 506.ng>:

```
g506.pep
   1 MAVFDEVGRI AHGCGGVVKQ SLFLRVVHQV EQGARLAEVV VIVLAVVPVC

  51 RVAVDFQRRF GEVGLLLPLA EAVGFVVRQA AVVAVGAALS VALVAVNRAT

 101 RTIDGDLAEV HTQAVTLRVG VIEQTGLQHF IRARADTGNE VARCEGGLFH

 151 IGEEVFGIAV QLEFAHFNQR IVFFRPNFGQ VKRMIRHFFG IGFRHDLDVH

 201 RPFRELAALD GFVQVALMAF AVVGDDFCSF FVGQVFNPLL AAEMEFHPKT

 251 FARFVPEAVG MRTEAVHMAV AGGNTAVAHH DGNLVQGFGQ QRPEVPVVCG

 301 GTHIGARIAF DGFVQVGEFA RVAQEEHGRV VADHIPVAFF GIEFQRKTAD

 351 VAFRIGCAAL ACHGGETGEH LGFFADFAEN FGAGVFGDVV CYGKRTERAR

 401 TFGVHTAFGD DFAHEVGEFF IQPQILRQQG AARAGGQAVL IVGNGRAVVH

 451 GQMGYGAFGG SHRSCSFSQV GQMGGKRLTV RFGGKRIRNR FLDCNKFLES

 501 TFYFPFAKTM DAIIRQDFRY *
```

The following partial DNA sequence was identified in *N. meningitidis* <SEQ ID 1377>:

```
m506.seq
    1  ATGGCGGTAT TTGATGAAGT CGGGCGCGTC GCCCATTGCG GCGGCGGTGT

   51  TGCCGAACAA TGCCTGTTTC TGCGCGTCGT TCATCAGGTT GAACAGGGCG

  101  CGCGGTTGGC TGAAATAGTC GTCATCGTCT TGGCGGTAGT CCCAGTGTGC

  151  CGCGTCGCCG TTGATTTTCA AAGGCGGTTC GGCGAAtCGg GGTTGTTGCT

  201  GCCATTGGCC GAAGCTGTyG GGTTCGTAGT GCGGCAGGCT GCCGyAGTTG

  251  CCGTCGGCGC GGCCTTGCCC GTyGCGsTgr TTgCTGTgAA CAsGGCAACG

  301  CGGACGATTG ACGGGAATTT GGCGGAAGTT TACGCCCAAA CGGTAGCGTT

  351  GTGCGTCGGC GTAATTGAAC AAACGCGCTT GCAGCATTTT ATCTsGGCTG

  401  GCGCCGACAC CGGGAACGAG GTTGCTCGGT GCGAAGGCGG ATTGTTCCAC

  451  ATCGGCGAAG AAGTTTTCGG GATTGCGGTT CTCAAACGGA TGATAAGGTA

  501  CTTTTTCCGC GTCTGCTTCA GGCATGACTT GGATGTACAT CGTCCATTTC

  551  GGAAACTCGC CGCGTTCGAT GGCTTCsTAT AAGTCGCGCT GATGGCTTTC

  601  GCGGTCGTCG GCGATGATTT TGGCGGCTTC TTCGTTGGTC AGGTTTTTAA

  651  TGCCTTGTTG GGTGCGGAAA TGGAATTTCA CCCAAAAACG CTCGCCTGCT

  701  TCGTTCCAGA AGCTGTAGGT ATGCGAACCG AAGCCGTGCA TATGGCGGTA

  751  GCCGGCGGGG ATGCCGCGGT CGCTCATCAC GATGGTAACT TGGTGCAGTG

  801  CTTCGGGCAG CAGCGTCCAG AAGTCCCAGT TGTTTGTGGC AGAGCGCATA

  851  TTGGTGCGCG GGTCGCGTTT GACGGCTTTG TTCAGGTCGG GGAACTTACG

  901  CGGGTCGCGC AGGAAGAACA CGGGCGTGTT GTTGCCGACC ACATCCCAGT

  951  TGCCTTCTTC GGTATAAAAT TTCAAGGCAA AACCGCGGAT GTCGCGTTCT

 1001  GCATCGGCTG CGCCGCGTTC GCCTGCCACG GTGGTGAAAC GGGCGAACAT

 1051  CTCGGTTTTT TTGCCGACTT CGCTGAAGAT TCCTTTGGCG TGCATACGGC
```

-continued

```
1101  GTTCGGGGAT GACTTCGCGC ACGAAGTCGG CGAGTTTTTC AGTCATCGCT

1151  CTTGTTCCTT TTCTCAGGTT GGTCAAATGG GGGTAAACGG CTTACAGTAC

1201  GATTTGGCGG AAAGCGTATT CGTAACCGGT TTCTTGATTG CAATAAATTT

1251  CTTGAATCGA CATTTTATTT CCCTTTTGTA AAAACTATGG ATGCGACTAT

1301  ACGCCAAGAT TTTCGCTATT AA
```

This corresponds to the amino acid sequence <SEQ ID 1378; ORF 506>:

```
m506.pep
   1 MAVFDEVGRV AHCGGGVAEQ CLFLRVVHQV EQGARLAEIV VIVLAVVPVC

  51 RVAVDFQRRF GESGLLLPLA EAVGFVVRQA AXVAVGAALP VAXXAVNXAT

 101 RTIDGNLAEV YAQTVALCVG VIEQTRLQHF IXAGADTGNE VARCEGGLFH

 151 IGEEVFGIAV QLEFAHFNQR IVFFRPNFGQ VKRMIRYFFR VCFRHDLDVH

 201 RPFRKLAAFD GFXXVALMAF AVVGDDFGGF FVGQVFNALL GAEMEFHPKT

 251 LACFVPEAVG MRTEAVHMAV AGGDAAVAHH DGNLVQCFGQ QRPEVPVVCG

 301 RAHIGARVAF DGFVQVGELT RVAQEEHGRV VADHIPVAFF GIKFQGKTAD

 351 VAFCIGCAAF ACHGGETGEH LGFFADFAED FGAGVFGDVV RYGKRTERAR

 401 TFGVHTAFGD DFAHEVGEFF IQPQILRQQR AARTGGQAVL IVGNRRAVVH

 451 GQMGYRAFGG SHRSCSFSQV GQMGGKRLTV RFGGKRIRNR FLDCNKFLES

 501 TFYFPFVKTM DATIRQDFRY *
```

Computer analysis of this amino acid sequence gave the following results:

Homology with a Predicted ORF from *N. gonorrhoeae*

ORF 506 shows 89.2% identity over a 520 aa overlap with a predicted ORF (ORF 506.ng) from *N. gonorrhoeae*:

```
m506/g506

                     10        20        30        40        50        60
m506.pep    MAVFDEVGRVAHCGGGVAEQCLFLRVVHQVEQGARLAEIVVIVLAVVPVCRVAVDFQRRF
            |||||||||:||  |||::| |||||||||||||||||:|||||||||||||||||||||
g506        MAVFDEVGRIAHGCGVAVKCSLFLRVVHQVEQGARLAEVVVIVLAVVPVCRVAVDFQRRF
                     10        20        30        40        50        60

                     70        80        90       100       110       120
m506.pep    GESGLLLPLAEAVGFVVRQAAXVAVGAALPVAXXAVNXATRTIDGNLAEVYAQTVALCVG
            || |||||||||||||||||| ||||||| ||  ||| |||||||:||||::|:|:| ||
g506        GEVGLLLPLAEAVGFVVRQAAVVAVGAALSVALVAVNRATRTIDGDLAEVHTQAVTLRVG
                     70        80        90       100       110       120

                    130       140       150       160       170       180
m506.pep    VIEQTRLQHFIXAGADTGNEVARCEGGLFHIGEEVFGIAVQLEFAHFNQRIVFFRPNFGQ
            ||||| ||||| | ||||||||||||||||||||||||||||||||||||||||||||||
g506        VIEQTGLQHFIRARADTGNEVARCEGGLFHIGEEVFGIAVQLEFAHFNQRIVFFRPNFGQ
                    130       140       150       160       170       180

                    190       200       210       220       230       240
m506.pep    VKRMIRYFFRVCFRHDLDVHRPFRKLAAFDGFXXVALMAFAVVGDDFGGFFVGQVFNALL
            ||||||:|| : ||||||||||||:|||:|||  ||||||||||||| :|||||||||||
g506        VKRMIRHFFGIGFRHDLDVHRPFRELAALDGFVQVALMAFAVVGDDFCSFFVGQVFNALL
                    190       200       210       220       230       240

                    250       260       270       280       290       300
m506.pep    GAEMEFHPKTLACFVPEAVGMRTEAVHMAVAGGDAAVAHHDGNLVQCFGQQRPEVPVVCG
            :|||||||||:| ||||||||||||||||||||::||||||||||| |||||||||||||
g506        AAEMEFHPKTFARFVPEAVGMRTEAVHMAVAGGNTAVAHHDGNLVQGFGQQRPEVPVVCG
                    250       260       270       280       290       300
```

-continued

```
                      310       320       330       340       350       360
m506.pep       RAHIGARVAFDGFVQVGELTRVAQEEHGRVVADHIPVAFFGIKFQGKTADVAFCIGCAAF
                :|||||:||||||||||::||||||||||||||||||||||:|| ||||||| |||||:
g506           GTHIGARIAFDGFVQVGEFARVAQEEHGRVVADHIPVAFFGIEFQRKTADVAFRIGCAA:
                      310       320       330       340       350       360

                      370       380       390       400       410       420
m506.pep       ACHGGETGEHLGFFADFAEDFGAGVFGDVVRYGKRTERARTFGVHTAFGDDFAHEVGEFF
               |||||||||||||||||||:|||||||||| |||||||||||||||||||||||||||||
g506           ACHGGETGEHLGFFADFAENFGAGVFGDVVCYGKRTERARTFGVHTAFGDDFAHEVGEFF
                      370       380       390       400       410       420

                      430       440       450       460       470       480
m506.pep       IQPQILRQQRAARTGGQAVLIVGNRRAVVHGQMGYRAFGGSHRSCSFSQVGQMGGKRLTV
               ||||||||| |||:|||||||||| |||||||||| ||||||||||||||||||||||||
g506           IQPQILRQQGAARAGGQAVLIVGNGRAVVHGQMGYGAFGGSHRSCSFSQVGQMGGKRLTV
                      430       440       450       460       470       480

                      490       500       510       520
m506.pep       RFGGKRIRNRFLDCNKFLESTFYFPFVKTMDATIRQDFRY
               ||||||||||||||||||||||||||:||||| |||||||
g506           RFGGKRIRNRFLDCNKFLESTFYFPFAKTMDAIIRQDFRY
                      490       500       510       520
```

The following partial DNA sequence was identified in *N. meningitidis* <SEQ ID 1379>:

```
a506.seq
   1  ATGGCGGTAT TTGATGAAGT CGGGCGCGTC GCCCATTGCG GCGGCGGTGT
  51  TGCCGAACAA TGCCTGTTTC TGCGCGTCGT TCATCAGGTT GAACAGGGCG
 101  CGCGGTTGGC TGAAATAGTC GTCATCGTCT TGGCGGTAGT CCCAGTGCGC
 151  CGCGTCGCCG TTGATTTTCA AAGGCGGTTC GGCGAAGTCG GGCTGCTGCT
 201  GCCATTGGCC GAAGCTGTTG GGTTCGTAGT GCGGCAGGCT GCCGTAGTTG
 251  CCGTCGGCGC GTCCTTGTCC GTCGCGCTGG TTGCTGTGAA CAGGGCAACG
 301  CGGACGGTTG ACAGGGATTT GGCGGAAGTT CACGCCCAAG CGGTAGCGTT
 351  GCGCGTCGGC GTAATTGAAC AAACGCGCCT GCAACATTTT ATCTGGGCTG
 401  GCGCCGACAC CGGGAACGAG GTTGCTCGGT GCGAAGGCGG ATTGTTCCAC
 451  ATCGGCGAAG AAGTTTTCGG GATTGCGGTT CAACTCGAAT TCGCCCACTT
 501  CAATCAGCGG ATAGTCTTTT TTCGGCCAAA CTTTGGTCAA GTCAAACGGA
 551  TGATACGGCA CTTTTTCCGC ATCGGCTTCA GGCATGACTT GGATGTACAT
 601  CGTCCATTTC GGAAACTCGC CGCGCTCGAT GGCTTCGTAC AGGTCGCGCT
 651  GATGGCTTTC ACGGTCGTCG GCGATGATTT TGGCGGCTTC TTCGTTGGTC
 701  AGGTTTTTAA TGCCTTGTTG GGTGCGGAAA TGGAATTTCA CCCAAAAACG
 751  CTCGCCTGCT TCGTTCCAGA AGCTGTAGGT ATGCGAACCG AAGCCGTGCA
 801  TATGGCGGTA GCCGGCGGGG ATGCCGCGGT CGCTCATCAC GATGGTAACT
 851  TGGTGCAGTG CTTCGGGCAG CAGCGTCCAG AAGTCCCAGT TGTTTGTGGC
 901  AGAGCGCATA TTGGTGCGCG GGTCGCGTTT GACGGCTTTG TTCAGGTCGG
 951  GGAACTTACG CGGGTCGCGC AGGAAGAACA CGGGCGTGTT GTTGCCGACC
1001  ACATCCCAGT TGCCTTCTTC GGTATAGAAC TTCAACGCAA AACCGCGGAT
1051  GTCGCGTTCT GCATCGGCTG CGCCGCGTTC GCCTGCCACG GTGGTGAAAC
1101  GGGCGAACAT CTCGGTTTTT TTGCCGACTT CGCTGAAGAT TTTGGCGCGG
1151  GTGTATTTGG TGATGTCGTG CGTTACGGTA AACGTACCGA ACGCGCCCGA
1201  ACCTTTGGCG TGCATACGGC GTTCGGGGAT GACTTCGCGC ACGAAGTCGG
```

-continued

```
1251 CGAGTTTTTC ATTCAGCCAC AAATCCTGCG CCAGCAGAGG GCCGCGAGGA

1301 CCGGCGGTCA GGCTGTTTTG ATTGTCGGCA ACAGGCGCGC CGTTGTTCAT

1351 GGTCAGATGG GTTACAGGGC ATTTGGAGGT ANTCATCGCT CTTGTTCCTT

1401 TTCTCAGGTT GGTCAAAT.G GGGGTAAACG GCTTACAGTA CGATTTGGCG

1451 GAAAGCGTAT TCGTAACCGG TTTCTTGATT GCAATAAATT TCTTGAATCG

1501 ACATTTTATT TCCCTTTTGT AAAAACTATG GATGCGACTA TACGCCAAGA

1551 TTTTCGCTAT TAA
```

This corresponds to the amino acid sequence <SEQ ID 1380; ORF 506.a>:

```
a506.pep
   1 MAVFDEVGRV AHCGGGVAEQ CLFLRVVHQV EQGARLAEIV VIVLAVVPVR

  51 RVAVDFQRRF GEVGLLLPLA EAVGFVVRQA AVVAVGASLS VALVAVNRAT

 101 RTVDRDLAEV HAQAVALRVG VIEQTRLQHF IWAGADTGNE VARCEGGLFH

 151 IGEEVFGIAV QLEFAHFNQR IVFFRPNFGQ VKRMIRHFFR IGFRHDLDVH

 201 RPFRKLAALD GFVQVALMAF TVVGDDFGGF FVGQVFNALL GAEMEFHPKT

 251 LACFVPEAVG MRTEAVHMAV AGGDAAVAHH DGNLVQCFGQ QRPEVPVVCG

 301 RAHIGARVAF DGFVQVGELT RVAQEEHGRV VADHIPVAFF GIELQRKTAD

 351 VAFCIGCAAF ACHGGETGEH LGFFADFAED FGAGVFGDVV RYGKRTERAR

 401 TFGVHTAFGD DFAHEVGEFF IQPQILRQQR AARTGGQAVL IVGNRRAVVH

 451 GQMGYRAFGG XHRSCSFSQV GQXGGKRLTV RFGGKRIRNR FLDCNKFLES

 501 TFYFPFVKTM DATIRQDFRY *
```

m506/a506 94.8% identity in 520 aa overlap

```
                    10        20        30        40        50        60
m506.pep    MAVFDEVGRVAHCGGGVAEQCLFLRVVHQVEQGARLAEIVVIVLAVVPVCRVAVDFQRRF
            |||||||||||||||||||||||||||||||||||||||||||||||||| ||||||||||
a506        MAVFDEVGRIAHGCGVAVKCSLFLRVVHQVEQGARLAEVVVIVLAVVPVRRVAVDFQRRF
                    10        20        30        40        50        60

                    70        80        90       100       110       120
m506.pep    GESGLLLPLAEAVGFVVRQAAXVAVGAALPVAXXAVNXATRTIDGNLAEVYAQTVALCVG
            || |||||||||||||||| |||||:| ||  ||| ||||:|  :||||:||:||| ||
a506        GEVGLLLPLAEAVGFVVRQAAVVAVGASLSVALVAVNRATRTVDRDLAEVHAQAVALRVG
                    70        80        90       100       110       120

                   130       140       150       160       170       180
m506.pep    VIEQTRLQHFIXAGADTGNEVARCEGGLFHIGEEVFGIAVQLEFAHFNQRIVFFRPNFGQ
            ||||||||||| ||||||||||||||||||||||||||||||||||||||||||||||||
a506        VIEQTRLQHFIWAGADTGNEVARCEGGLFHIGEEVFGIAVQLEFAHFNQRIVFFRPNFGQ
                   130       140       150       160       170       180

                   190       200       210       220       230       240
m506.pep    VKRMIRYFFRVCFRHDLDVHRPFRKLAAFDGFXXVALMAFAVVGDDFGGFFVGQVFNALL
            ||||||:|||: ||||||||||||||||:|||  ||||||:||||||||||||||||||
a506        VKRMIRHFFRIGFRHDLDVHRPFRKLAALDGFVQVALMAFTVVGDDFGGFFVGQVFNALL
                   190       200       210       220       230       240

                   250       260       270       280       290       300
m506.pep    GAEMEFHPKTLACFVPEAVGMRTEAVHMAVAGGDAAVAHHDGNLVQCFGQQRPEVPVVCG
            ||||||||||||||||||||||||||||||||||||||||||||||||||||||||||||
a506        GAEMEFHPKTLACFVPEAVGMRTEAVHMAVAGGDAAVAHHDGNLVQCFGQQRPEVPVVCG
                   250       260       270       280       290       300
```

-continued

```
                        310       320       330       340       350       360
m506.pep        RAHIGARVAFDGFVQVGELTRVAQEEHGRVVADHIPVAFFGIKFQGKTADVAFCIGCAAF
                ||||||||||||||||||||||||||||||||||||||||||::| ||||||||||||||
a506            RAHIGARVAFDGFVQVGELTRVAQEEHGRVVADHIPVAFFGIELQRKTADVAFCIGCAAF
                        310       320       330       340       350       360

                        370       380       390       400       410       420
m506.pep        ACHGGETGEHLGFFADFAEDFGAGVFGDVVRYGKRTERARTFGVHTAFGDDFAHEVGEFF
                ||||||||||||||||||||||||||||||||||||||||||||||||||||||||||||
a506            ACHGGETGEHLGFFADFAEDFGAGVFGDVVRYGKRTERARTFGVHTAFGDDFAHEVGEFF
                        370       380       390       400       410       420

                        430       440       450       460       470       480
m506.pep        IQPQILRQQRAARTGGQAVLIVGNRRAVVHGQMGYRAFGGSHRSCSFSQVGQMGGKRLTV
                |||||||||||||||||||||||||||||||||||||||| ||||||||||| |||||||
a506            IQPQILRQQRAARTGGQAVLIVGNRRAVVHGQMGYRAFGGXHRSCSFSQVGQXGGKRLTV
                        430       440       450       460       470       480

                        490       500       510       520
m506.pep        RFGGKRIRNRFLDCNKFLESTFYFPFVKTMDATIRQDFRYX
                ||||||||||||||||||||||||||||||||||||||||
a506            RFGGKRIRNRFLDCNKFLESTFYFPFVKTMDATIRQDFRYX
                        490       500       510       520
```

The following partial DNA sequence was identified in *N. gonorrhoeae* <SEQ ID 1381>:

```
g507.seq
   1 ATGCTCTTGC CGGCTTTGCA ACAAGGCGGC GGCTTCCTGA GCGGCGGCGG

  51 TTTCGGCCTC GTCGGGCAGG TTCAGGGCTT GGTTTTCCTG CTTCAGACGG

 101 CCTTTGCGCT CTTCGTGCTT GGCAACGGTT TGTTCGGCAT GGGCAAGCTG

 151 CTGCTGCTTC AACGCCAGTT CGCGGCGGAT GCGGTTTGCC TCGTCCTGCT

 201 GGGTTTGGAA GGCAGCGTTG AGCGTGGCTT GGACTTCTTC CAATTCGGGC

 251 AGACGCTCTT CGTGTTCGGC AACCTGCATC GCCCATTCCG CCAATTCGGT

 301 TTGCTTTTCT TCGACCTGCA ACTCGTTTTC CTCAAGCTGC ACGCGGATTT

 351 GCTGCTGCTC CTGCCGGATG CGTTGCAACT GCGCCTGCGC TGCCTGCTTG

 401 TCGCGTTCGA TGCGTTGGTG CAGGTTTTGC CGGTGGCGGA TTTGTTCTTC

 451 CAAACGGGCA ATCTGCTCGC GCAACACGCC GCGTTTGTTG CTCAATTCGT

 501 GTACTGCCTG CTGCTGCGAC TGTTCGGCAG TCTGCAAGGC GTGTACTTCG

 551 TTATTTAA
```

This corresponds to the amino acid sequence <SEQ ID 1382; ORF 507.ng>:

```
g507.pep
   1 MLLPALQQGG GFLSGGGFGL VGQVQGLVFL LQTAFALFVL GNGLFGMGKL

  51 LLLQRQFAAD AVCLVLLGLE GSVERGLDFF QFGQTLFVFG NLHRPFRQFG

 101 LLFFDLQLVF LKLHADLLLL LPDALQLRLR CLLVAFDALV QVLPVADLFF

 151 QTGNLLAQHA AFVACFVYCL LLRLFGSLQG VYFVI*
```

The following partial DNA sequence was identified in *N. meningitidis* <SEQ ID 1383>:

```
m507.seq
   1 ATGCTCTTGC TGACTTTGCA ACAAGGCGGC TGCTTCCTGC GCGGCGGCGG

  51 TTTCGGCTTC GTCGGGCAGG TTTAAGGCTT GGTTTTCCTG TTTCAGACGA

 101 CCTTTGCGCT CTTCGTGCTT GGCAATCGTT TGTTCGGCAT GGGCAAGCTG
```

-continued

```
151 CTGCTGCTTC AACGCCAGTT CGCGGCGGAT GCGGTTTGCC TCGTCCTGCT

201 GGGTTTGGAA GGCGGCGTTG AGCGTGGCTT GGGCTTCTTC CAATTCGGGC

251 AGACGCTCCT CGTGTTCGGC AACCTGCATC GCCCATTCCG CCAGCTCGGT

301 TTGTTTTTCT TCGACCTGCA ACTCGTTTTC TTCAAGCTGC ACGCGGATTT

351 GCTGCTGCTC TTGATGAATG CGTTGTAACT GCGCCTGCGC TGCCTGCTTG

401 TCGCGTTCGA TGCGTTGGTG CAGGTTTTGC TGATGGCGGA TTTGTTCTTC

451 CAAACGGGCA ATCTGCTCGC GCAACACGCC GCGCTTGTTG CTCAATTCAT

501 GCACTGCCTG CTGCTGCGAC TGTTCGGCAG TCTGCAAGGC GTGTACTTCG

551 TCGTTTAA
```

This corresponds to the amino acid sequence <SEQ ID 1384; ORF 507>:

```
m507.pep
  1 MLLLTLQQGG CFLRGGGFGF VGQVXGLVFL FQTTFALFVL GNRLFGMGKL

 51 LLLQRQFAAD AVCLVLLGLE GGVERGLGFF QFGQTLLVFG NLHRPFRQLG

101 LFFFDLQLVF FKLHADLLLL LMNALXLRLR CLLVAFDALV QVLLMADLFF

151 QTGNLLAQHA ALVAQFMHCL LLRLFGSLQG VYFVV*
```

Computer analysis of this amino acid sequence gave the following results:

Homology with a Predicted ORF from *N. gonorrhoeae*

ORF 507 shows 87.0% identity over a 185 aa overlap with a predicted ORF (ORF 507.ng) from *N. gonorrhoeae*:

```
m507/g507
                    10        20        30        40        50        60
m507.pep   MLLLTLQQGGCFLRGGGFGFVGQVXGLVFLFQTTFALFVLGNRLFGMGKLLLLQRQFAAD
           ||| :||||| || |||||:|||| |||||:||:|||||||| |||||||||||||||||
g507       MLLPALQQGGGFLSGGGFGLVGQVQGLVFLLQTAFALFVLGNGLFGMGKLLLLQRQFAAD
                    10        20        30        40        50        60

                    70        80        90       100       110       120
m507.pep   AVCLVLLGLEGGVERGLGFFQGFQTLLVFGNLHRPFRQLGLFFFDLQLVFFKLHADLLLL
           |||||||||||:||||| ||||||||:|||||||||||:||:||||||||:|||||||||
g507       AVCLVLLGLEGSVERGLDFFQGFQTLFVFGNLHRPFRQFGLLFFDLQLVFLKLHADLLLL
                   70        80        90       100       110       120

                   130       140       150       160       170       180
m507.pep   LMNALXLRLRCLLVAFDALVQVLLMADLFFQTGNLLAQHAALVAQFMHCLLLRLFGSLQG
           | :|| ||||||||||||||||| :||||||||||||||||:||||::||||||||||||
g507       LPDALQLRLRCLLVAFDALVQVLPVADLFFQTGNLLAQHAAFVAQFVYCLLLRLFGSLQG
                   130       140       150       160       170       180

m507.pep   VYFVV
           ||||:
g507       VYFVI
```

The following partial DNA sequence was identified in *N. meningitidis* <SEQ ID 1385>:

```
a507.seq
  1 ATGCTCTTGC TGGCTTTGCA ACAAGGCGGC AGCTTCCTGC GCGGCGGCGG

 51 TTTCGGCTTC GTCAGGCAGA TTCAGGGCTT GGTTTTCCTG TTTCAGACGA

101 CCTTTGCGCT CTTCGTGCTT GGCAACGGTT TGTTCGGCAT GGGCAAGCTG

151 CTGCTGCTTC AACGCCAGTT CGCGGCGGAT GCGGTTTGCC TCGTCCTGCT

201 GGGTTTGGAA GGCGGCATTG AGTGTGGCTT GGGTTTCTTC CAATTCGGGC

251 AGACGCTCTT CGTGTTCGGC AACCTGCATC GCCCATTCCG CCAATTCGGT
```

-continued

```
301 TTGCTTTTCT TCCGCCTGCA ACTCGTTTTC TTCAAGCTGC ACGCGGATTT

351 GCTGCTGCTC CTGATGGATG CGCTGCATCT GCGCCTGCGC CGCCTGCTTG

401 TCGCGTTCGA TGCGTTGGTG CAGGTTTTGC TGATGGCGGA TTTGTTCTTC

451 CAAACGGGCA ATCTGTTCGC GCAACACGCC GCGTTTGTTG CCCAATTCGT

501 GCACCGCCTG CTGCTGCGAC TGTTCGGCAG TCTGCAAGGC GTGTACTTCG

551 TCGTTTAA
```

This corresponds to the amino acid sequence <SEQ ID 1386; ORF 507.a>:

```
a507.pep
  1 MLLLALQQGG SFLRGGGFGF VRQIQGLVFL FQTTFALFVL GNGLFGMGKL

 51 LLLQRQFAAD AVCLVLLGLE GGIECGLGFF QFGQTLFVFG NLHRPFRQFG

101 LLFFRLQLVF FKLHADLLLL LMDALHLRLR RLLVAFDALV QVLLMADLFF

151 QTGNLFAQHA AFVAQFVHRL LLRLFGSLQG VYFVV*
```

m507/a507 89.7% identity in 185 aa overlap

```
                     10        20        30        40        50        60
m507.pep     MLLLTLQQGGCFLRGGGFGFVGQVXGLVFLFQTTFALFVLGNRLFGMGKLLLLQRQFAAD
             ||||:||||| |||||||||| |: ||||||||||||||||| |||||| ||||||||||
a507         MLLLALQQGGSFLRGGGFGFVRQIQGLVFLFQTTFALFVLGNGLFGMGKLLLLQRQFAAD
                     10        20        30        40        50        60

                     70        80        90       100       110       120
m507.pep     AVCLVLLGLEGGVERGLGFFQFGQTLLVFGNLHRPFRQLGLFFFDLQLVFFKLHADLLLL
             ||||||||||||:| ||||||||||||:|||||||||||:||:|| ||||||||||||||
a507         AVCLVLLGLEGGIECGLGFFQFGQTLFVFGNLHRPFRQFGLLFFRLQLVFFKLHADLLLL
                     70        80        90       100       110       120

                    130       140       150       160       170       180
m507.pep     LMNALXLRLRCLLVAFDALVQVLLMADLFFQTGNLLAQHAALVAQFMHCLLLRLFGSLQG
             ||:|| |||| ||||||||||||||||||||||||:|||||:||||:| |||||||||||
a507         LMDALHLRLRRLLVAFDALVQVLLMADLFFQTGNLFAQHAAFVAQFVHRLLLRLFGSLQG
                    130       140       150       160       170       180

m507.pep     VYFVVX
             ||||||
a507         VYFVVX
```

The following partial DNA sequence was identified in *N. gonorrhoeae* <SEQ ID 1387>:

```
g508.seq
  1 ATGGTAGCGT TTGGCGTTGA TCAGGGCCTC CTGCTGCTGC AACAGGGCGG

 51 TTTGGGTGGC GGCCTGAAGC TGCGGCAGCT TGGTTTGCAG GGTTTGTACG

101 CGGGCGTATT GCTCCCTGCC CTGTTCCTGA ATCTGCGCGA GTTTTTCCTG

151 CACGGCGATG TATTCTTCGT CCAGCGTGTG TACGGTTTCG GTCAACTCGT

201 CGAGCTTGAT GTGCTGCTCG TCGTTTTGGA ACTCGGTTTC ATAGGCGAGG

251 GCAAGCTCTT GCCGGCGTTC CTGCCAGTCC AGGGTTTGCT GTTCGAGCCG

301 GGCGATTTGC TGCCGGTAGT TTTGTTTTTG CGGGTTGAGT TTGTGGACGG

351 CGACTTCGGC AAGCCCGTAT TGGCGGTTGG CTTCCAACAG GGCAAGCTGC

401 GCCTGTTTCA GACGGCCTTG CTGCTCTTGG CGGCTGTGCG CGGTGGTTTG
```

-continued

```
451 CTGCTGGTGT TCGAGTTCGG CGGCGGCTTC CTGCAAAGTA GCGATGTCGT

501 CTGA
```

This corresponds to the amino acid sequence <SEQ ID 1388; ORF 508.ng>:

```
g508.pep
  1 MVAFGVDQGL LLLQQGGLGG GLKLRQLGLQ GLYAGVLLPA LFLNLREFFL

 51 HGDVFFVQRV YGFGQLVELD VLLVVLELGF IGEGKLLPAF LPVQGLLFEP

101 GDLLPVVLFL RVEFVDGDFG KPVLAVGFQQ GKLRLFQTAL LLLAAVRGGL

151 LLVFEFGGGF LQSSDVV
```

The following partial DNA sequence was identified in *N. meningitidis* <SEQ ID 1389>:

```
m508.seq
  1 ATGGTAGCGT TTGGCGTTGA TCAGGGCTTC CTGCTGCTGC AACAAGGCGG

 51 TTTGGGTGGC GGCCTGAAGC TGCGGCAGCT TGGTTTGCAG GGTTTGCACT

101 TTAGCGTATT GCTCCCTGCC CTGTTCCTGA ATCTGCGCGA GTTTCTCTTG

151 CACAACAATA TATTCTTCGT CCAAGGTCTG TACGGCTTCG CTTAATTCTT

201 CAAGCTTGAT GTGCTGCTCG TCGTTTTGGA ACTCGGTTTC ATAGGCGAGG

251 GCAAGCTCTT GCTGGCGTTC CTGCCAGTCG AGGGTTTGCT GTTCAAGCTG

301 GGCGATTTGC TGCCGGTAGT TTTGTTTTTG CTGGTTGAGT TTGTGGACGG

351 CGACTTCGGC AAGCCCGTAT TGGCGGTTGG CTTCCAACAG GGCAAGCTGC

401 GCCTGTTTCA GACGGCCTTG CTGCTCTTGG CGGCTGTGCG CGGTGGTTTG

451 CTGCTGGTGT TCGAGTTCGG CGGCGGCTTC CTGCAAGGTA ACGATGTCGT

501 CTGA
```

This corresponds to the amino acid sequence <SEQ ID 1390; ORF 508.ng>:

```
m508.pep
  1 MVAFGVDQGF LLLQQGGLGG GLKLRQLGLQ GLHFSVLLPA LFLNLREFLL

 51 HNNIFFVQGL YGFAXFFKLD VLLVVLELGF IGEGKLLLAF LPVEGLLFKL

101 GDLLPVVLFL LVEFVDGDFG KPVLAVGFQQ GKLRLFQTAL LLLAAVRGGL

151 LLVFEFGGGF LQGNDVV*
```

Computer analysis of this amino acid sequence gave the following results:

Homology with a Predicted ORF from *N. gonorrhoeae*

ORF 508 shows 86.8% identity over a 167 aa overlap with a predicted ORF (ORF 508.ng) from *N. gonorrhoeae*:

```
m508/g508

                     10        20        30        40        50        60
m508.pep    MVAFGVDQGFLLLQQGGLGGGLKLRQLGLQGLHFSVLLPALFLNLREFLLHNNIFFVQGL
            |||||||||:||||||||||||||||||||||: :|||||||||||||:||:::|||| :
g508        MVAFGVDQGLLLLQQGGLGGGLKLRQLGLQGLYAGVLLPALFLNLREFFLHGDVFFVQRV
                     10        20        30        40        50        60
```

-continued

```
                       70        80        90       100       110       120
m508.pep       YGFAXFFKLDVLLVVLELGFIGEGKLLLAFLPVEGLLFKLGDLLPVVLFLLVEFVDGDFG
               |||: : :||||||||||||||||||| |||||:||||: |||||||||| |||||||||
g508           YGFGQLVELDVLLVVLELGFIGEGKLLPAFLPVQGLLFEPGDLLPVVLFLRVEFVDGDFG
                       70        80        90       100       110       120

                      130       140       150       160
m508.pep       KPVLAVGFQQGKLRLFQTALLLLAAVRGGLLLVFEFGGGFLQGNDVV
               |||||||||||||||||||||||||||||||||||||||||::|||
g508           KPVLAVGFQQGKLRLFQTALLLLAAVRGGLLLVFEFGGGFLQSSDVV
                      130       140       150       160
```

The following partial DNA sequence was identified in *N. meningitidis* <SEQ ID 1391>:

```
a508.seq
   1 ATGGTAGCGT TTGGCGTTGA TCAGGGCTTC CTGCTGCTGC AACAGGGCGG

  51 TTTGGGTGGC GGCCTGAAGC TGCGGCAGCT TGGTTTGCAG GGTTTGTACG

 101 CGGGCGTATT GTTCCCTACC CTGCTCCTGA ATCTGCGCGA GTTTCTCCTG

 151 TACGACAATA TATTCTTCGT CCAAACTCTG TACGGCTTCG CTCAACTCTT

 201 CGAGCTTGAT GTGCTGCTCG TCGTTTTGGA ACTCGGTTTC ATAGGCGAGG

 251 GCAAGCTCTT GCTGGCGTTC CTGCCAATCG AAGGTTTGTT GTTCAAGCTG

 301 GGCAATTTGC TGTTGGTAGT TTTGTTTTTG CTGGTTGAGC TTGTGGACGG

 351 CGACTTCGGC AAGCCCGTAT TGGCGGTTGG CTTCCAACAG GGCAAGCTGC

 401 GCCTGTTTCA GACGACCTTG CTGCTCTTGG CGGCTGTGCG CGGCGGTTTG

 451 CTGCTGGTGT TCGAGTTCGG CGGCGGCTTC CTGCAAAATG GCGATGTCGT

 501 CTGA
```

This corresponds to the amino acid sequence <SEQ ID 1392; ORF 508.a>:

```
a508.pep
   1 MVAFGVDQGF LLLQQGGLGG GLKLRQLGLQ GLYAGVLFPT LLLNLREFLL

  51 YDNIFFVQTL YGFAQLFELD VLLVVLELGF IGEGKLLLAF LPIEGLLFKL

 101 GNLLLVVLFL LVELVDGDFG KPVLAVGFQQ GKLRLFQTTL LLLAAVRGGL

 151 LLVFEFGGGF LQNGDVV*
```

m508/a508 88.6% identity in 167 aa overlap

```
                       10        20        30        40        50        60
m508.pep       MVAFGVDQGFLLLQQGGLGGGLKLRQLGLQGLHFSVLLPALFLNLREFLLHNNIFFVQGL
               ||||||||||||||||||||||||||||||||: :||:|:|:||||||||::|||||| |
a508           MVAFGVDQGFLLLQQGGLGGGLKLRQLGLQGLYAGVLFPTLLLNLREFLLYDNIFFVQTL
                       10        20        30        40        50        60

                       70        80        90       100       110       120
m508.pep       YGFAXFFKLDVLLVVLELGFIGEGKLLLAFLPVEGLLFKLGDLLPVVLFLLVEFVDGDFG
               |||| :|:||||||||||||||||||||||||:||||||||:|| ||||||||:||||||
a508           YGFAQLFELDVLLVVLELGFIGEGKLLLAFLPIEGLLFKLGNLLLVVLFLLVELVDGDFG
                       70        80        90       100       110       120

                      130       140       150       160
m508.pep       KPVLAVGFQQGKLRLFQTALLLLAAVRGGLLLVFEFGGGFLQGNDVVX
               ||||||||||||||||||:||||||||||||||||||||||::||||
a508           KPVLAVGFQQGKLRLFQTTLLLLAAVRGGLLLVFEFGGGFLQNGDVVX
                      130       140       150       160
```

The following partial DNA sequence was identified in *N. gonorrhoeae* <SEQ ID 1393>:

```
g509.seq
   1 atggtcgctg tatgtgatga acgggctgta cagcggacgt tggtggccca
  51 attcgcgcaa caaggcggct tgtttttgct cttcgttcag gctgttgtag
 101 tcttccaagc ctgcgtgttg gaaaagctcg gcaaccacat cggcgtgttt
 151 gcctgcgtgt tggcgcaggt cgagcggcat catgtggaag ccgaacacgg
 201 acacggaacg gatgaggtct gccaaacggc cttcggcaag caggcggctg
 251 ccgttgtcga taagggaacg ttgcaatttt ttcaaatcat cgagaaattt
 301 ttgggccgaa gcataaggct cgagaaagcc gaatttgcag cccatgccca
 351 aaccgagcga gcgcgctttg cccatagcgc gcgccataat gtaggcaatg
 401 gcgcggcggt aaggttcttc ggtgcgggcg atttcttcgt caggcgagag
 451 ggctgccagt gccattacgt cgtcgttgac tttgacgcgg cggatggaaa
 501 gcggcagttc gcggtaaagt ttgtcgagtt cgctgcggta aaaacggaac
 551 acggcatcgg cgtggcggcg gaaggcaaag cgcagggttt cgccagaaac
 601 aaacggattg ccgtcgcggt cgccgccgat ccagccgccg attttaagga
 651 tattcggaac gcggacatcg ggataggccg tctgaaagtc gtgttccatc
 701 ttgcggtaga gtttgggcag ggcttcaaaa aagctcatcg ggaagatgga
 751 cacgccgttg ttgatttcgt cgttgacgct gagtttgtgg cggcgcgttt
 801 cgctggtctg ccacaagccc agaagcacgg tgtcgatttc gcggcgcagc
 851 cgtgccagcg cgtcggcatt ggtgcagcgt tcgcgttgcg gcagcagcgc
 901 gcggatgcgg cggttgaaat tcaaaacggt ttggcgttgc acttcggtcg
 951 ggtgcgcggt caaaacggcg gtaacggacg tattgtccaa ctgccgctgc
1001 accgatttgc cgtcggcttt ccccgctttg agcctgcgga cggtttccgt
1051 caggctgcct tctgctgcgt tgtggccggc atcttcgtgg atttggcggc
1101 ggcgttcgtg gtgcacgtct tcggcgatat tcagaatctg ggcgaacagc
1151 ccgcaggcaa gcgtcagatc gtaggtctgc cgttcgtcca attgcggcaa
1201 tactttttca atcaatgccg cgctgtcgtc ggaagtggac aagagtttga
1251 ccgtttcgac aaccaacggc gaggcttctt cgtgcaggag gttgaacagg
1301 gactgtttca aaaattccgc gtccgccgcc aaagccgcgt ccttcggatt
1351 gttcaggata tgcagttgca tgattttcct ctcattgccg taaatactgt
1401 aaatgtacct caaatgccgc atccgtgcca aaccgttcac actttaacca
1451 ctcatgtccc gaaatgccgt ctgaagttga acgccgcccg acggcggcgt
1501 tacaatcgcc cgcaactgtt tttttccgaa catcatcatg accgcgaccg
1551 aacacgacaa cgacgacgca ctcctgctgc ggtacagccg ccacatcctc
1601 ttggacgaaa tcggcatcga agggcagcag aagctttccg ccgcgcatat
1651 tttggtcgtc ggctgcggcg gattgggcgc cgccgcccct gccctatctc
1701 gccgcctcgg gggtcggcac gctga
```

This corresponds to the amino acid sequence <SEQ ID 1394; ORF 509.ng>:

```
g509.pep
   1 MVAVCDERAV QRTLVAQFAQ QGGLFLLFVQ AVVVFQACVL EKLGNHIGVF

  51 ACVLAQVERH HVEAEHGHGT DEVCQTAFGK QAAAVVDKGT LQFFQIIEKF

 101 LGRSIRLEKA EFAAHAQTER ARFAHSARHN VGNGAAVRFF GAGDFFVRRE

 151 GCQCHYVVVD FDAADGKRQF AVKFVEFAAV KTEHGIGVAA EGKAQGFARN

 201 KRIAVAVAAD PAADFKDIRN ADIGIGRLKV VFHLAVEFGQ GFKKAHREDG

 251 HAVVDFVVDA EFVAARFAGL PQAQKHGVDF AAQPCQRVGI GAAFALRQQR

 301 ADAAVEIQNG LALHFGRVRG QNGGNGRIVQ LPLHRFAVGF PRFEPADGFR

 351 QAAFCCVVAG IFVDLAAAFV VHVFGDIQNL GEQPAGKRQI VGLPFVQLRQ

 401 YFFNQCRAVV GSGQEFDRFD NQRRGFFVQE VEQGLFQKFR VRRQSRVLRI

 451 VQDMQLHDFP LIAVNTVNVP QMPHPCQTVH TLTTHVPKCR LKLNAARRRR

 501 YNRPQLFFSE HHHDRDRTRQ RRRTPAAVQP PHPLGRNRHR RAAEAFRRAY

 551 FGRRLRRIGR RRPCPISPPR GSAR*
```

The following partial DNA sequence was identified in *N. meningitidis* <SEQ ID 1395>:

```
m509.seq
   1 ATGGTCGCTG TATGTGATAA ACGGGCTGTA CAGAGGACGT TGATGGCTCA

  51 ATTCGCGCAA CAGGGCGGTT TGTTTTTGCT CTTCGTTCAG GCGGTTGTAG

 101 TCTTCCAAGC CTGCGTGTTG GAAAAGCTCG GCAACCACAT CGGCGTGTTT

 151 GCCTGCGTGT TGGCGCAAGT CGAGCGGCAT CATGTGAAAG CCGAACACGG

 201 ATACGGAACG GATGAGGTCT GCCAAACGGC CTTCGGCAAG CAGACGGCTG

 251 CCGTTGTCGA TAAGGGAACG TTGCAATTTT TTCAAATCAT CCAGAAACTC

 301 TTGTGCCGAA GCATAAGGCT CGAGAAAGCC GAATTTGCAG CCCATACCCA

 351 AACCGAGCGC GCGCGCTTTG CCCATAGCGC GCGCCATAAT GTAGGCGATG

 401 GCGCGGCGGT AGGGTTCTTC GGCGCGGGCG ATTTCTTCGT CGGGCGATTT

 451 GTCGGACAAC GCCGTTACAT CGCCGTTGAC TTTGACGCGG CGGATGGAGA

 501 GCGGCAGTTC GCGGTAGAGT TTGTCGAGTT CGCCGCGATA GAAGCGGAAC

 551 ACGGCATCGG CGTGGCGGCG GAAGGCAAAG CGCAGGGTTT CGGCAGAAAC

 601 AAACGGATTG CCGTCGCGGT CGCCGCCGAT CCAGCCGCCG ATTTTGAGGA

 651 TGTCCGGAAC GCGGACGCCG GGATAGGCCG TCTGAAAGTC GTGTTCCATC

 701 TTGCGGTAGA GCTTGGGCAG GGCTTCGAAA AAGCTCATCG GGAAGATGGA

 751 CACGCCGTTG TTGATTTCGT CGTTGACGCT GAGTTTGTGG CGGCGCGTTT

 801 CGCTGGTCTG CCACAAGCCC AGCAGGATAG TGTCGATTtC GCgGCGCAGC

 851 CGTGCCAGCG CGTCGGCATT GGTGCAGCGT TCgCGTTGCG GCAACAGTGC

 901 GCGGATGCGG CGGTTGAAGC TTAAGACGGT TTGGCGTTGC ACTTCGGTCG

 951 GGTGCGCGGT CAAAACGGCG GTAACGGACG TATTGTCCAA CTGCCGCTGC

1001 ACCGATTTGC CGTCGGCTTT CCCCGCTTTG AGCCTGCGGA CGGTTTCCGT

1051 CAGGCTGCCT TCCGCGCCGC CGCGTCCGGC TTCTTCGTGG ATTTGGCGGC

1101 GGCGTTCGTG GTGCACGTCT TCGGCGATGT TCAAAATCTG GGCGAACAGG
```

-continued

```
1151 CCGCAGGCCA AGGTTAAATC GTGGGTTTGT TGTTCGTCCA ATTGCGGCAA

1201 TACTTTTTCA ATCAATGCCG CGCTGTCGTC GGAAGTGGAC AAGAGTTTGA

1251 CTGTTTCGAC AACCAACGGC GAGGCTTCTT CGTGCAGGAG GTTGAACAGG

1301 GATTGTTTCA GAAATTCCGC GTCCGCCGCC AAAGCCGCGT CCTTTGGATT

1351 GTTCAGAATA TGCAGTTGCA TGATTTTTCT CTCTCGTCTG CCGTAAATAT

1401 TGTAAATGTA CCCCAAATGC CGCATCCGTG CCAAACCGTT CACACTTTAA

1451 CCGCCCGTGT CCCGAAATGC CGTCTGAAGT TGAACGCCGC CCGACGGCAG

1501 CGTTACAATC GCCCGCAACT GTTTTtTTCC GAACATCATC ATGACCACGA

1551 CCGAACACGA CAACGACGAT GCATTCCTGC TGCGGTACAG CCGCCACATC

1601 CTCTTGGACG AAATCGGCAT CGAAGGGCAG CAGAAACTTT CCGCCGCGCA

1651 TATTTTGGTC GTCGGCTGCG GCGGTTTGGG TGCCGCCGCA CT.GCCCTAC

1701 CTTGCCGCTT CGGGTGTCGG CACGCTGA
```

This corresponds to the amino acid sequence <SEQ ID 1396; ORF 509>:

```
m509.pep
   1 MVAVCDKRAV QRTLMAQFAQ QGGLFLLFVQ AVVVFQACVL EKLGNHIGVF

  51 ACVLAQVERH HVKAEHGYGT DEVCQTAFGK QTAAVVDKGT LQFFQIIQKL

 101 LCRSIRLEKA EFAAHTQTER ARFAHSARHN VGDGAAVGFF GAGDFFVGRF

 151 VGQRRYIAVD FDAADGERQF AVEFVEFAAI EAEHGIGVAA EGKAQGFGRN

 201 KRIAVAVAAD PAADFEDVRN ADAGIGRLKV VFHLAVELGQ GFEKAHREDG

 251 HAVVDFVVDA EFVAARFAGL PQAQQDSVDF AAQPCQRVGI GAAFALRQQC

 301 ADAAVEAXDG LALHFGRVRG QNGGNGRIVQ LPLHRFAVGF PRFEPADGFR

 351 QAAFRAAASG FFVDLAAAFV VHVFGDVQNL GEQAAGQGXI VGLLFVQLRQ

 401 YFFNQCRAVV GSGQEFDCFD NQRRGFFVQE VEQGLFQKFR VRRQSRVLWI

 451 VQNMQLHDFS LSSAVNIVNV PQMPHPCQTV HTLTARVPKC RLKLNAARRQ

 501 RYNRPQLFFS EHHHDHDRTR QRRCIPAAVQ PPHPLGRNRH RRAAETFRRA

 551 YFGRRLRRFG CRRTXPTLPL RVSAR*
```

Computer analysis of this amino acid sequence gave the following results:

Homology with a Predicted ORF from *N. gonorrhoeae*

ORF 509 shows 87.8% identity over a 575 aa overlap with a predicted ORF (ORF 509.ng) from *N. gonorrhoeae*:

```
m509/g509
                          10         20         30         40         50         60
        m509.pep  MVAVCDKRAVQRTLMAQFAQQGGLFLLFVQAVVVFQACVLEKLGNHIGVFACVLAQVERH
                  ||||||:|||||||:|||||||||||||||||||||||||||||||||||||||||||||
            g509  MVAVCDERAVQRTLVAQFAQQGGLFLLFVQAVVVFQACVLEKLGNHIGVFACVLAQVERH
                          10         20         30         40         50         60

                          70         80         90        100        110        120
        m509.pep  HVKAEHGYGTDEVCQTAFGKQTAAVVDKGTLQFFQIIQKLLCRSIRLEKAEFAAHTQTER
                  ||:||||:|||||||||||||:|||||||||||||||:|:||||||||||||||:||||
            g509  HVEAEHGHGTDEVCQTAFGKQAAAVVDKGTLQFFQIIEKFLGRSIRLEKAEFAAHAQTER
                          70         80         90        100        110        120
```

-continued

```
                           130       140       150       160       170       180
m509.pep            ARFAHSARHNVGDGAAVGFFGAGDFFVGRFVGQRRYIAVDFDAADGERQFAVEFVEFAAI
                    ||||||||||||:|||| ||||||||| |   | :|::||||||||:|||||:||||||:
g509                ARFAHSARHNVGNGAAVRFFGAGDFFVRREGCQCHYVVVDFDAADGKRQFAVKFVEFAAV
                           130       140       150       160       170       180

                           190       200       210       220       230       240
m509.pep            EAEHGIGVAAEGKAQGFGRNKRIAVAVAADPAADFEDVRNADAGIGRLKVVFHLAVELGQ
                    ::|||||||||||||||:|||||||||||||||||:|:|||| ||||||||||||||:||
g509                KTEHGIGVAAEGKAQGFARNKRIAVAVAADPAADFKDIRNADIGIGRLKVVFHLAVEFGQ
                           190       200       210       220       230       240

                           250       260       270       280       290       300
m509.pep            GFEKAHREDGHAVVDFVVDAEFVAARFAGLPQAQQDSVDFAAQPCQRVGIGAAFALRQQC
                    ||:|||||||||||||||||||||||||||||||: :||||||||||||||||||||||
g509                GFKKAHREDGHAVVDFVVDAEFVAARFAGLPQAQKHGVDFAAQPCQRVGIGAAFALRQQR
                           250       260       270       280       290       300

                           310       320       330       340       350       360
m509.pep            ADAAVEAXDGLALHFGRVRGQNGGNGRIVQLPLHRFAVGFPRFEPADGFRQAAFRAAASG
                    ||||||  :|||||||||||||||||||||||||||||||||||||||||  :::|
g509                ADAAVEIQNGLALHFGRVRGQNGGNGRIVQLPLHRFAVGFPRFEPADGFRQAAFCCVVAG
                           310       320       330       340       350       360

                           370       380       390       400       410       420
m509.pep            FFVDLAAAFVVHVFGDVQNLGEQAAGQGXIVGLLFVQLRQYFFNQCRAVVGSGQEFDCFD
                    :|||||||||||||||:|||||| ||:  |||| ||||||||||||||||||||||| ||
g509                IFVDLAAAFVVHVFGDIQNLGEQPAGKRQIVGLPFVQLRQYFFNQCRAVVGSGQEFDRFD
                           370       380       390       400       410       420

                           430       440       450       460       470       480
m509.pep            NQRRGFFVQEVEQGLFQKFRVRRQSRVLWIVQNMQLHDFSLSSAVNIVNVPQMPHPCQTV
                    |||||||||||||||||||||||||||| |||:|||||| |  ||| |||||||||||||
g509                NQRRGFFVQEVEQGLFQKFRVRRQSRVLRIVQDMQLHDFPLI-AVNTVNVPQMPHPCQTV
                           430       440       450       460        470

                           490       500       510       520       530       540
m509.pep            HTLTARVPKCRLKLNAARRQRYNRPQLFFSEHHHDHDRTRQRRCIPAAVQPPHPLGRNRH
                    ||||::|||||||||||||:|||||||||||||||:|||||||  |||||||||||||||
g509                HTLTTHVPKCRLKLNAARRRRYNRPQLFFSEHHHDRDRTRQRRRTPAAVQPPHPLGRNRH
                 480       490       500       510       520       530

                           550       560       570
m509.pep            RRAAETFRRAYFGRRLRRFGCRRTCPTLPLRVSAR
                    |||||:||||||||||||:| || ||  | | |||
g509                RRAAEAFRRAYFGRRLRRIGRRRPCPISPPRGSAR
                 540       550       560       570
```

The following partial DNA sequence was identified in *N. meningitidis* <SEQ ID 1397>:

```
a509.seq
   1  ATGGTCGCTG TATGTGATGA ACGGACTGTA CAGTGGACGT TGATGGCTCA

  51  ATTCGCGCAA CAGGGCGGCT TGTTTTTGCT CTTCGTTGAG GCTGTTGTAG

 101  TCTTCCAAGC CTGCGTGTTG GAAAAGCTCG GCAACCACAT CGGCGTGTTT

 151  GCCTGCGTGT TGGCGCAGGT CGAGCGGCAT CATGTGGAAG CCGAACACGG

 201  ATACGGAACG GATGAGGTCT GCCAAACGGC CTTCGGCAAG CAGGCGGCTG

 251  CCGTTGTCGA TAAGGGAATG TTGCAATTTT TTCAAATCAT CGAGAAATTC

 301  TTGTGCCGAA GCATAAGGCT CGAGAAAGCC GAATTTGCAG CCCATACCCA

 351  AACCGAGCGC GCGCGCTTTG CCCATAGCGC GCGCCATAAT GTAGGCAATG

 401  GCGCGACGGT AGGGTTCTTC GGCGCGGGCG GTTTCTTCGT CGGGCGATTT

 451  GTCGGACAAC GCCATCACAT CGCCGTTGAC TTTGACGCGG CGGATGGAGA

 501  GCGGCAGTTC GCGGTAGAGT TTGTCGAGTT CGCCACGGTA AAAACGGAAC

 551  ACGGCATCGG CGTGGCGGCG GAAGGCAAAA CGCAAGGTTT CGGCAGAAAC

 601  GAACGGATTG CCGTCGCGGT CGCCGCCGAT CCAGCCGCCG ATTTGAGGA
```

-continued

```
 651 TGTCCGGAAC GCGGACATCG GGATAGGCCG TCTGAAAGTC GTGTTCCATC
 701 TTGCGGTAGA GCTTGGGCAG GGCTTCAAAA AAGCTCATCG GAAAGATGGA
 751 CACGCCGTTG TTGATTTCGT CGTTGACGCT GAGTTTGTGG CGGCGCGTTT
 801 CGCTGGTCTG CCACAAGCCC AGCAGGATAG TGTCGATTTC GCGGCGCAGC
 851 CGTGCCAGCG CGTCGGCATT GGTACAGCGT TCGCGTTGCG GCAGCAGCGC
 901 GCGGATGCGG CGGTTGAAAT TCAAGACGGT CTGGCGTTGC ACTTCGGTCG
 951 GGTGCGCGGT CAAAACGGCG GTAACGGACG TATTGTCCAA CTGCCGCTGC
1001 ACCGATTTGC CGTCGGCTTT CCCCGCTTTG AGCCTGCGGA CGGTTTCCGT
1051 CAGGCTGCCT TCCGCGCCGC CGCGTCCGGC TTCTTCGTGG ATTTGGCGGC
1101 GGCGTTCGTG GTGCACGTCT TCGGCGATGT TCAAAATCTG GGCGAACAGG
1151 CCGCAGGCCA AGGTTAAATC GTGGGTTTGT TGTTCGTCCA ATTGCGGCAA
1201 TACTTTTTCA ATCAATGCCG CGCTGTCGTC GGAAGTGGAC AAGAGTTTGA
1251 CCGTTTCGAC AACCAACGGC GAGGCTTCTT CGTGCAGGAG GTTGAACAGG
1301 GATTGTTTCA GAAATTCCGC GTCCGCCGCC AAAGCCGCGT CCTTTGGATT
1351 GTTCAGAATA TGCAGTTGCA TGATTTTTCT CTCATTGCCG TAAATACTGT
1401 AAATGTACCT CAAATGCCGC ATCCGTGCCA AACCGTTCAC ACTTTAACCG
1451 CCCGTGTCCC GAAATGCCGT CTGAAGTTGA ACGCCGCCCG ACGGCAGCGT
1501 TACAATCGCC CACAACTGTT TTT.TCCGAA CATCATCATG ACCACGACCG
1551 AACACGACAA CGACGATGCA TTCCTGCTGC GGTACAGCCG CCACATCCTC
1601 TTGGACGAAA TTGGCATCGA AGGGCAGCAG AAACTTTCCG CCGCGCATAT
1651 TTTGGTCGTC GGCTGCGGCG GTTTGGGTGC CGCCGCCGAT GCCCTATCTC
1701 GCCGCTTCCG GCATCGGCAC GCTGA
```

This corresponds to the amino acid sequence <SEQ ID 1398; ORF 509.a>:

```
a509.pep
   1 MVAVCDERTV QWTLMAQFAQ QGGLFLLFVE AVVVFQACVL EKLGNHIGVF
  51 ACVLAQVERH HVEAEHGYGT DEVCQTAFGK QAAAVVDKGM LQFFQIIEKF
 101 LCRSIRLEKA EFAAHTQTER ARFAHSARHN VGNGATVGFF GAGGFFVGRF
 151 VGQRHHIAVD FDAADGERQF AVEFVEFATV KTEHGIGVAA EGKTQGFGRN
 201 ERIAVAVAAD PAADFEDVRN ADIGIGRLKV VFHLAVELGQ GFKKAHRKDG
 251 HAVVDFVVDA EFVAARFAGL PQAQQDSVDF AAQPCQRVGI GTAFALRQQR
 301 ADAAVEIQDG LALHFGRVRG QNGGNGRIVQ LPLHRFAVGF PRFEPADGFR
 351 QAAFRAAASG FFVDLAAAFV VHVFGDVQNL GEQAAGQG*I VGLLFVQLRQ
 401 YFFNQCRAVV GSGQEFDRFD NQRRGFFVQE VEQGLFQKFR VRRQSRVLWI
 451 VQNMQLHDFS LIAVNTVNVP QMPHPCQTVH TLTARVPKCR LKLNAARRQR
 501 YNRPQLFXSE HHHDHDRTRQ RRCIPAAVQP PHPLGRNWHR RAAETFRRAY
 551 FGRRLRRFGC RXPCPISPLP ASAR*
```

m509/a509 93.0% identity in 575 aa overlap

```
                      10        20        30        40        50        60
m509.pep      MVAVCDKRAVQRTLMAQFAQQGGLFLLFVQAVVVFQACVLEKLGNHIGVFACVLAQVERH
              ||||||:|:|| |||||||||||||||||:||||||||||||||||||||||||||||||
a509          MVAVCDERTVQWTLMAQFAQQGGLFLLFVEAVVVFQACVLEKLGNHIGVFACVLAQVERH
                      10        20        30        40        50        60

                      70        80        90       100       110       120
m509.pep      HVKAEHGYGTDEVCQTAFGKQTAAVVDKGTLQFFQIIQKLLCRSIRLEKAEFAAHTQTER
              ||:||||||||||||||||||:||||||| |||||||:|:||||||||||||||||||||
a509          HVEAEHGYGTDEVCQTAFGKQAAAVVDKGMLQFFQIIEKFLCRSIRLEKAEFAAHTQTER
                      70        80        90       100       110       120

                     130       140       150       160       170       180
m509.pep      ARFAHSARHNVGDGAAVGFFGAGDFFVGRFVGQRRYIAVDFDAADGERQFAVEFVEFAAI
              ||||||||||||:||:||||||| ||||||||||::||||||||||||||||||||||::
a509          ARFAHSARHNVGNGATVGFFGAGGFFVGRFVGQRHHIAVDFDAADGERQFAVEFVEFATV
                     130       140       150       160       170       180

                     190       200       210       220       230       240
m509.pep      EAEHGIGVAAEGKAQGFGRNKRIAVAVAADPAADFEDVRNADAGIGRLKVVFHLAVELGQ
              ::|||||||||||:||||||:||||||||||||||||||||| |||||||||||||||||
a509          KTEHGIGVAAEGKTQGFGRNERIAVAVAADPAADFEDVRNADIGIGRLKVVFHLAVELGQ
                     190       200       210       220       230       240

                     250       260       270       280       290       300
m509.pep      GFEKAHREDGHAVVDFVVDAEFVAARFAGLPQAQQDSVDFAAQPCQRVGIGAAFALRQQC
              ||:||||:|||||||||||||||||||||||||||||||||||||||||||:||||||| 
a509          GFKKAHRKDGHAVVDFVVDAEFVAARFAGLPQAQQDSVDFAAQPCQRVGIGTAFALRQQR
                     250       260       270       280       290       300

                     310       320       330       340       350       360
m509.pep      ADAAVEAXDGLALHFGRVRGQNGGNGRIVQLPLHRFAVGFPRFEPADGFRQAAFRAAASG
              ||||||  ||||||||||||||||||||||||||||||||||||||||||||||||||||
a509          ADAAVEIQDGLALHFGRVRGQNGGNGRIVQLPLHRFAVGFPRFEPADGFRQAAFRAAASG
                     310       320       330       340       350       360

                     370       380       390       400       410       420
m509.pep      FFVDLAAAFVVHVFGDVQNLGEQAAGQGXIVGLLFVQLRQYFFNQCRAVVGSGQEFDCFD
              ||||||||||||||||||||||||||||||||||||||||||||||||||||||||| ||
a509          FFVDLAAAFVVHVFGDVQNLGEQAAGQGXIVGLLFVQLRQYFFNQCRAVVGSGQEFDRFD
                     370       380       390       400       410       420

                     430       440       450       460       470       480
m509.pep      NQRRGFFVQEVEQGLFQKFRVRRQSRVLWIVQNMQLHDFSLSSAVNIVNVPQMPHPCQTV
              |||||||||||||||||||||||||||||||||||||||||  ||| |||||||||||||
a509          NQRRGFFVQEVEQGLFQKFRVRRQSRVLWIVQNMQLHDFSLI-AVNTVNVPQMPHPCQTV
                     430       440       450       460       470

                     490       500       510       520       530       540
m509.pep      HTLTARVPKCRLKLNAARRQRYNRPQLFFSEHHHDHDRTRQRRCIPAAVQPPHPLGRNRH
              |||||||||||||||||||||||||||| ||||||||||||||||||||||||||||| |
a509          HTLTARVPKCRLKLNAARRQRYNRPQLFXSEHHHDHDRTRQRRCIPAAVQPPHPLGRNWH
            480       490       500       510       520       530

                     550       560       570
m509.pep      RRAAETFRRAYFGRRLRRFGCRRTXPTLPLRVSARX
              ||||||||||||||||||||||   |  || :||||
a509          RRAAETFRRAYFGRRLRRFGCRXPCPISPLPASARX
            540       550       560       570
```

The following partial DNA sequence was identified in *N. gonorrhoeae* <SEQ ID 1399>:

```
g510.seq
   1 atgccttcgc ggacaccgca gggaaaaagg ggttattcct gccccaagcg

  51 ggatagtgcc ttttggcagg cgttgtccat atcggttatt ttacgcgcaa

 101 aatcgccgat tgccaaatcg ccgccgttca gggaggtttt caataggtcg

 151 tggacgacgt tgagcgcggc cataatgacg attttttcgc tgtccgcgac

 201 gcggccgcct tcgcggatgg cttcggcttt gccgttgagc attccgactg

 251 cctgcaacag tgtgtctttt tcttctgccg gcgtgttgac agtcagccgg

 301 ggcgtgcatg acttcgatgt agacttgttc gatgttcatc ctttaatcct

 351 tattgctgcg tttcctgccg ttgggggagg cgcgctgcca gtgcgctga
```

This corresponds to the amino acid sequence <SEQ ID 1400; ORF 510.ng>:

```
g510.pep
   1 MPSRTPQGKR GYSCPKRDSA FWQALSISVI LRAKSPIAKS PPFREVFNRS

  51 WTTLSAAIMT IFSLSATRPP SRMASALPLS IPTACNSVSF SSAGVLTVSR

 101 GVHDFDVDLF DVHPLILIAA FPAVGGGALP VR*
```

The following partial DNA sequence was identified in *N. meningitidis* <SEQ ID 1401>:

```
m510.seq
   1 ATGCCTTCGC GGACACCGCA GGGnAAAAGG GGTTATTCCT GCGCCAAGCG

  51 GGATAGTGCT TTTTGGCAGG CGTTGTCCAT ATCGGCTATT TTACGCGCAA

 101 AATCGCCGAT TGCCAAATCG CCGCCGTTCA GGGAGGTTTT CAACAGGTCG

 151 TGGACGACGT TGAGCGCGGC CATAATGACG ATTTTTTCGC TGTCCGCGAC

 201 GCGTCCGCCT TCGCGGATGG CTTCGGCTTT GCCGTTGAGC ATTCCGACTG

 251 CCTGCAACAG TGTGTCTTTT TCTTCTGCCG GCGTGTTGAC GGTCAGCCGG

 301 GGCGTGCAwG ACTTCsAtGT GGACTTGTTC GATGTTCATC CTTTAATCCT

 351 TATTGCTGCG TTTCCTGCCA TTGGGGGAGG CGCGCTGCCA GTGCGCTGA
```

This corresponds to the amino acid sequence <SEQ ID 1402; ORF 510>:

```
m510.pep
   1 MPSRTPQGKR GYSCAKRDSA FWQALSISAI LRAKSPIAKS PPFREVFNRS

  51 WTTLSAAIMT IFSLSATRPP SRMASALPLS IPTACNSVSF SSAGVLTVSR

 101 GVXDFXVDLF DVHPLILIAA FPAIGGGALP VR*
```

Computer analysis of this amino acid sequence gave the following results:

Homology with a Predicted ORF from *N. gonorrhoeae*

ORF 510 shows 96.2% identity over a 132 aa overlap with a predicted ORF (ORF 510.ng) from *N. gonorrhoeae*:

```
m510/g510
                    10        20        30        40        50        60
m510.pep   MPSRTPQGKRGYSCAKRDSAFWQALSISAILRAKSPIAKSPPFREVFNRSWTTLSAAIMT
           ||||||||||||| ||||||||||||:|||||||||||||||||||||||||||||||||
g510       MPSRTPQGKRGYSCPKRDSAFWQALSISVILRAKSPIAKSPPFREVFNRSWTTLSAAIMT
                    10        20        30        40        50        60

                    70        80        90       100       110       120
m510.pep   IFSLSATRPPSRMASALPLSIPTACNSVSFSSAGVLTVSRGVXDFXVDLFDVHPLILIAA
           |||||||||||||||||||||||||||||||||||||||||| || ||||||||||||||
g510       IFSLSATRPPSRMASALPLSIPTACNSVSFSSAGVLTVSRGVHDFDVDLFDVHPLILIAA
                    70        80        90       100       110       120

                   130
m510.pep   FPAIGGGALPVRX
           |||:|||||||||
g510       FPAVGGGALPVRX
                   130
```

The following partial DNA sequence was identified in *N. meningitidis* <SEQ ID 1403>:

```
a510.seq
  1 ATGCCTTCGC GGACACCGCA GGGAAAAAGG GGTTATTCCT GCGCCAAGCG

 51 GGATAGTGCT TTTTGGCAGG CGTTGTCCAT ATCGGCTATT TTACGCGCAA
```

-continued

```
101 AATCGCCGAT TGCCAAATCG CCGCCGTTCA GGGAGGTTTT CAACAGGTCG

151 TGGACGACGT TGAGCGCGGC CATAATGACG ATTTTTTCGC TGTCCGCGAC

201 GCGTCCGCCT TCGCGGATGG CTTCGGCTTT GCCGTTGAGC ATTCCGACTG

251 CCTGCAACAG TGTGTCTTTT TCTTCTGCCG GCGTGTTGAC GGTCAGCCGG

301 G.CGTGCATG ACTTCGATGT GGACTTGTTC GATGTTCATC CTTTAATCCT

351 TATTGCTGCG TTTCCTGCCG TTGGGGGAGG CGCGCTGCCA GTGCGCTGA
```

This corresponds to the amino acid sequence <SEQ ID 1404; ORF 510.a>:

```
a510.pep
   1 MPSRTPQGKR GYSCAKRDSA FWQALSISAI LRAKSPIAKS PPFREVFNRS

  51 WTTLSAAIMT IFSLSATRPP SRMASALPLS IPTACNSVSF SSAGVLTVSR

 101 XVHDFDVDLF DVHPLILIAA FPAVGGGALP VR*
```

m510/a510 97.0% identity in 132 aa overlap

```
                    10        20        30        40        50        60
m510.pep    MPSRTPQGKRGYSCAKRDSAFWQALSISAILRAKSPIAKSPPFREVFNRSWTTLSAAIMT
            ||||||||||||||||||||||||||||||||||||||||||||||||||||||||||||
a510        MPSRTPQGKRGYSCAKRDSAFWQALSISAILRAKSPIAKSPPFREVFNRSWTTLSAAIMT
                    10        20        30        40        50        60

                    70        80        90       100       110       120
m510.pep    IFSLSATRPPSRMASALPLSIPTACNSVSFSSAGVLTVSRGVXDFXVDLFDVHPLILIAA
            |||||||||||||||||||||||||||||||||||||||| | || ||||||||||||||
a510        IFSLSATRPPSRMASALPLSIPTACNSVSFSSAGVLTVSRXVHDFDVDLFDVHPLILIAA
                    70        80        90       100       110       120

                   130
m510.pep    FPAIGGGALPVRX
            |||:|||||||||
a510        FPAVGGGALPVRX
                   130
```

The following partial DNA sequence was identified in *N. gonorrhoeae* <SEQ ID 1405>:

```
g512.seq
   1 atgaaagtgc ttgttttagg tgcgggtgtt gccggcgtat cctccgtgtg

  51 gtatctggca gaggccggac atgaagtaac ggtcatcgac cgcaccgagg

 101 gtgtggcgat ggaaaccagt tttgccaatg caggccagct ttcttacggc

 151 tataccacgc cttgggctgc acccggtatt ccgaccaaag cactgaaacg

 201 gctgtttaaa agccatccgc ctttactgtt ccgccctgac ggcggcctgt

 251 atcaaatcga atggctgtgg cggatgctgc aaaactgcac ggcaacgcgc

 301 tatcaaatca ataaagagcg catggtcagg atttccgaat acagccgtga

 351 aatgttccgc cgttttgaag cgcaaaccga catgaatttt gagggacgca

 401 aaaaagggac gttgcagatt ttccgccaaa ccgaagaagt cgaagcggca

 451 aaacaagaca ttgccgtttt ggaacgctac ggcgtgccgt accgccgtct

 501 gaagcccgaa gaatgcgcag aattcgagcc tgcgctggca cgcgttaccg

 551 ccaaaattgt cggcggtctg cacctgcctg cggatgcgac cggcgactgc

 601 cgcctcttca ccgaaaacct gtacaaattg tgtcaagaga agggggtacg

 651 gttctacttc aaccaaacca tcagccgcat cgaccacaac gggctgcgca
```

-continued

```
701 tcaaagccgt tgaaacgaaa cagggcggtt tgaaacagat gccgttgtct

751 gcgcgctcgg ctgcttcagc aggactgtgt tggcgcagtt ggatctcaat

801 ctgcccattt atcccgtcaa aggctattcc ttga
```

This corresponds to the amino acid sequence <SEQ ID 1406; ORF 512.ng>:

```
g512.pep
  1 MKVLVLGAGV AGVSSVWYLA EAGHEVTVID RTEGVAMETS FANAGQLSYG

 51 YTTPWAAPGI PTKALKRLFK SHPPLLFRPD GGLYQIEWLW RMLQNCTATR

101 YQINKERMVR ISEYSREMFR RFEAQTDMNF EGRKKGTLQI FRQTEEVEAA

151 KQDIAVLERY GVPYRRLKPE ECAEFEPALA RVTAKIVGGL HLPADATGDC

201 RLFTENLYKL CQEKGVRFYF NQTISRIDHN GLRIKAVETK QGGLKQMPLS

251 ARSAASAGLC WRSWISICPF IPSKAIP*
```

The following partial DNA sequence was identified in *N. meningitidis* <SEQ ID 1407>:

```
m512.seq (partial)
  1 ..GTTTTGGAAC GCTACGGCGT GCCGTACCGC CGTCTGAAAC CCGAAGAATG

 51   TGCAGAATTT GAGCCTGCGC TGGCACGCGT TACCGCCAAA ATTGCCGGCG

101   GCCTGCACCT GCCTGCAGAT GCGACCGGCG ACTggCGCCT CTTCACTGAA

151   AACCTATACA AATTGTGTCA GGAAAAGGGC GTACGGTTTC ATTTCAACCA

201   AAACATCAGC CGCATCGACC ACAACGGGCT GCGCATCAAA ACCGTTGAAA

251   CCAAACAGGG CGGTTTGAAG CAGATGCCGT TGTCTGCGCG CTCGGTTGCT

301   TCAGCAGGAC GGTTTTGGCG CAGTTGGATC TCAATCTGCC CATTTATCCC

351   GTCAAAGGCT ATTCCTTGA
```

This corresponds to the amino acid sequence <SEQ ID 1408; ORF 512>:

```
m512.pep (partial)
  1 ..VLERYGVPYR RLKPEECAEF EPALARVTAK IAGGLHLPAD ATGDWRLFTE

 51   NLYKLCQEKG VRFHFNQNIS RIDHNGLRIK TVETKQGGLK QMPLSARSVA

101   SAGRFWRSWI SICPFIPSKA IP*
```

Computer analysis of this amino acid sequence gave the following results:

Homology with a Predicted ORF from *N. gonorrhoeae*

ORF 512 shows 93.4% identity over a 122 aa overlap with a predicted ORF (ORF 512.ng) from *N. gonorrhoeae*:

```
m512/g512
                                                    10        20        30
m512.pep                                  VLERYGVPYRRLKPEECAEFEPALARVTAK
                                          ||||||||||||||||||||||||||||||
g512      TDMNFEGRKKGTLQIFRQTEEVEAAKQDIAVLERYGVPYRRLKPEECAEFEPALARVTAK
            130       140       150       160       170       180

                  40        50        60        70        80        90
m512.pep  IAGGLHLPADATGDWRLFTENLYKLCQEKGVRFHFNQNISRIDHNGLRIKTVETKQGGLK
          |:||||||||||| ||||||||||||||||||:|||:|||||||||||||:|||||||||
g512      IVGGLHLPADATGDCRLFTENLYKLCQEKGVRFYFNQTISRIDHNGLRIKAVETKQGGLK
            190       200       210       220       230       240
```

-continued

```
                       100        110        120
m512.pep   QMPLSARSVASAGRFWRSWISICPFIPSKAIP
           ||||||||:||||  ||||||||||||||||
g512       QMPLSARSAASAGLCWRSWISICPFIPSKAIP
                  250        260        270
```

The following partial DNA sequence was identified in *N. meningitidis* <SEQ ID 1409>:

```
a512.seq
   1 ATGAAAGTGC TTGTTTTAGG TGCTGGTGTT GCCGGCGTAT CTTCCGCGTG

  51 GTATCTGGCA GAGGCAGGAC ATGAAGTAAC GGTCATCGAC CGCGCCGAGG

 101 GCGTGGCGAT GGAAACCAGT TTTGCCAACG CAGGCCAGCT TTCTTACGGC

 151 TATACCACGC CTTGGGCTGC ACCCGGTATT CCGACCAAAG CACTGAAATG

 201 GCTGTTTAAA AGCCATCCGC CTTTGCTGTT TCGCCCCGAC GGCAGCCTGT

 251 ATCAAATCGA ATGGCTGTGG CAGATGCTGC AACACTGCAC GGCAGCGCGC

 301 TATCAAATCA ATAAAGAGCG CATGGTCAGG ATGTCCGAAT ACAGCCGTGA

 351 AATGTTCCGC CGTTTTGAAG CGCAAACCGG CATGAATTTT GAGGGACGCA

 401 AAAAAGGGAC GTTGCAGATT TTCCGCCAAA CCAAAGAAGT CGAAGCGGCA

 451 AAACAAGACA TTGCCGTTTT GGAACGCTAC GGCGTGCCGT ACCGCCGTCT

 501 GAAGCCCGAA GAATGCGCAG AATTCGAGCC TGCGCTGGCA CGCGTTACCG

 551 CCAAAATTGC CGGCGGCCTG CACCTGCCCG CAGACGCGAC CGGCGACTGC

 601 CGCCTCTTCA CTGAAAACCT GTACAAATTG TGTCAGGAAA AGGGCGTACG

 651 GTTTCATTTC AACCAAACCA TCAGCCGCAT CGACCACAAC GGGCTGCGCA

 701 TCAAAACCGT TGAAACGAAA CAGGGCGGTT TGAAGCAGAT GCCGTTGTCT

 751 GCGCGCTCGG CTGCTTCAGC AGGACGGTTT TGGCGCAAGT GGATCTCAAT

 801 CTGCCGATTT ATCCCGTCAA AGGCTATTCC TTGA
```

This corresponds to the amino acid sequence <SEQ ID 1410; ORF 512.a>:

```
a512.pep
   1 MKVLVLGAGV AGVSSAWYLA EAGHEVTVID RAEGVAMETS FANAGQLSYG

  51 YTTPWAAPGI PTKALKWLFK SHPPLLFRPD GSLYQIEWLW QMLQHCTAAR

 101 YQINKERMVR MSEYSREMFR RFEAQTGMNF EGRKKGTLQI FRQTKEVEAA

 151 KQDIAVLERY GVPYRRLKPE ECAEFEPALA RVTAKIAGGL HLPADATGDC

 201 RLFTENLYKL CQEKGVRFHF NQTISRIDHN GLRIKTVETK QGGLKQMPLS

 251 ARSAASAGRF WRKWISICRF IPSKAIP*
```

m512/a512 95.9% identity in 122 aa overlap

```
                                          10         20         30
m512.pep                         VLERYGVPYRRLKPEECAEFEPALARVTAK
                                 |||||||||||||||||||||||||||||
a512        TGMNFEGRKKGTLQIFRQTEEVEAAKQDIAVLERYGVPYRRLKPEECAEFEPALARVTAK
                  130        140        150        160        170        180

                  40         50         60         70         80         90
m512.pep   IAGGLHLPADATGDWRLFTENLYKLCQEKGVRFHFNQNISRIDHNGLRIKTVETKQGGLK
           |||||||||||||||| |||||||||||||||||||:|||||||||||||||||||||||
a512       IAGGLHLPADATGDCRLFTENLYKLCQEKGVRHHFNQTISRIDHNGLRIKTVETKQGGLK
                  190        200        210        220        230        240
```

-continued

```
                    100        110        120
m512.pep    QMPLSARSVASAGRFWRSWISICPFIPSKAIP
            ||||||||:||||||||:||||| ||||||||
a512        QMPLSARSAASAGRFWRKWISICRFIPSKAIP
              250        260        270
```

The following partial DNA sequence was identified in *N. gonorrhoeae* <SEQ ID 1411>:

```
g513.seq
   1 ATGGGTTCCG CGCCGAACGC CGCCGCCGCC GCCGAAGTGA AACACCCTGT
  51 TTCGCAAGGT ATGATTCAAA TGCTGGGCGT GTTTGTCGAT ACCATCATCG
 101 TTTGTTCTTG CACCGCCTTC ATCATCTTGA TTTACCAACA GCCTTATGGC
 151 GATTTGAGCG GTGCGGCGCT GAcgcAGGCG GCGATTGTCA GCCAAGTGGG
 201 GCAATGGGGC GCGGGTTTCC TCGCCGTCAT CCTGTTTATG TTTGCCTTTT
 251 CCACCGTTAT CGGCAACTAT GCCTATGCCG AGTCCAACGT CCAATTCATC
 301 AAAAGCCATT GGCTGATTAC CGCCGTTTTC CGTATGCTGG TTTTGGCGTG
 351 GGTCTATTTC GGCGCGGTTG CCAATGTGCC TTTGGTCTGG GATATGGCGG
 401 ATATGGCGAT GGGCATCATG GCGTGGATCA ACCTCGTCGC CATCCTGCTG
 451 CTCTCGCCat TGGCGTTTAT GCTGCTGCGC GATTACACCG CCAAGCTGAA
 501 AATGGGCAAA GACCCCGAGT TCAAACTTTc cgAACATCCG GGCCTGAAAC
 551 GCCGCATCAA ATCCGATGTT TGGTAA
```

This corresponds to the amino acid sequence <SEQ ID 1412; ORF 513.ng>:

```
g513.pep
   1 MGSAPNAAAA AEVKHPVSQG MIQMLGVFVD TIIVCSCTAF IILIYQQPYG
  51 DLSGAALTQA AIVSQVGQWG AGFLAVILFM FAFSTVIGNY AYAESNVQFI
 101 KSHWLITAVF RMLVLAWVYF GAVANVPLVW DMADMAMGIM AWINLVAILL
 151 LSPLAFMLLR DYTAKLKMGK DPEFKLSEHP GLKRRIKSDV W*
```

The following partial DNA sequence was identified in *N. meningitidis* <SEQ ID 1413>:

```
m513.seq
   1 ATGGGTTCCG CGCCGAACGC CGCCGCCGCC GCCGAAGTGA AACACCCTGT
  51 TTCGCAAGGT ATGATTCAAA TGCTGGGCGT GTTTGTCGAT ACCATCATCG
 101 TTTGTTCTTG CACCGCCTTC ATCATCTTGA TTTACCAACA GCCTTATGGC
 151 GATTTGAGCG GTGCGGCGCT GAcgcAGGCG GCGATTGTCA GCCAAGTGGG
 201 GCAATGGGGC GCGGGTTTCC TCGCCGTCAT CCTGTTTATG TTTGCCTTTT
 251 CCACCGTTAT CGGCAACTAT GCCTATGCCG AGTCCAACGT CCAATTCATC
 301 AAAAGCCATT GGCTGATTAC CGCCGTTTTC CGTATGCTGG TTTTGGCGTG
 351 GGTCTATTTC GGCGCGGTTG CCAATGTGCC TTTGGTCTGG GATATGGCGG
 401 ATATGGCGAT GGGCATCATG GCGTGGATCA ACCTCGTCGC CATCCTGCTG
 451 CTCTCGCCat TGGCGTTTAT GCTGCTGCGC GATTACACCG CCAAGCTGAA
 501 AATGGGCAAA GACCCCGAGT TCAAACTTTc cgAACATCCG GGCCTGAAAC
 551 GCCGCATCAA ATCCGATGTT TGGTAA
```

This corresponds to the amino acid sequence <SEQ ID 1414; ORF 513>:

```
m513.pep
   1 MGSAPNAAAA AEVKHPVSQG MIQMLGVFVD TIIVCSCTAF IILIYQQPYG

  51 DLSGAALTQA AIVSQVGQWG AGFLAVILFM FAFSTVIGNY AYAESNVQFI

 101 KSHWLITAVF RMLVLAWVYF GAVANVPLVW DMADMAMGIM AWINLVAILL

 151 LSPLAFMLLR DYTAKLKMGK DPEFKLSEHP GLKRRIKSDV W*
```

Computer analysis of this amino acid sequence gave the following results:

Homology with a Predicted ORF from *N. gonorrhoeae*

ORF 513 shows 99.5% identity over a 191 aa overlap with a predicted ORF (ORF 513.ng) from *N. gonorrhoeae*:

```
m513/g513
                    10        20        30        40        50        60
m513.pep    MGSAPNAAAAAEVKHPVSQGMIQMLGVFVDTIIVCSCTAFIILIYQQPYGDLSGAALTQA
            ||||||||||||||||||||||||||||||||||||||||||||||||||||||||||||
g513        MGSAPNAAAAAEVKHPVSQGMIQMLGVFVDTIIVCSCTAFIILIYQQPYGDLSGAALTQA
                    10        20        30        40        50        60

                    70        80        90       100       110       120
m513.pep    AIVSQVGQWGAGFLAVILFMFAFSTVIGNYAYAESNVQFIKSHWLITAVFRMLVLAWVYF
            ||||||||||||||||||||||||||||||||||||||||||||||||||||||||||||
g513        AIVSQVGQWGAGFLAVILFMFAFSTVIGNYAYAESNVQFIKSHWLITAVFRMLVLAWVYF
                    70        80        90       100       110       120

                   130       140       150       160       170       180
m513.pep    GAVANVPLVWDMADMAMGIMAWINLVAILLLSPLAFMXLRDYTAKLKMGKDPEFKLSEHP
            ||||||||||||||||||||||||||||||||||||| ||||||||||||||||||||||
g513        GAVANVPLVWDMADMAMGIMAWINLVAILLLSPLAFMLLRDYTAKLKMGKDPEFKLSEHP
                   130       140       150       160       170       180

                   190
m513.pep    GLKRRIKSDVW
            |||||||||||
g513        GLKRRIKSDVW
                   190
```

The following partial DNA sequence was identified in *N. meningitidis* <SEQ ID 1415>:

```
a513.seq
   1  ATGAACGAGA ACTTTACCGA ATGGCTGCAC GGCTGGGTCG GCGCCATCAA

  51  CGATCCGATG TGGTCATACT TGGTTTATNT GCTTTTGGGT ACGGGGCTTT

 101  TCTTCACCGT AACCACGGGC TTTGTCCAAT TCCGCCTGTT CGGGCGCAGC

 151  ATCAAAGAAA TGCTCGGCGG CCGCAAACAG GGGGACGACC CTCACGGCAT

 201  CACGCCGTTT CAGGCATTTG TAACCGGCCT TGCCAGCCGC GTGGGCGTGG

 251  GCAATATCGC GGGCGTGGCC ATCGCCATCA AAGTCGGCGG ACCGGGCGCG

 301  GTGTTTTGGA TGTGGGTAAC CGCCTTAATC GGTATGAGTT CGGCGTTTGT

 351  CGAATCTTCG CTGGCGCAGC TCTTTAAAGT CCGCGACTAC GACAACCACC

 401  ATTTCCGGGG CGGCCCTGCC TACTACATCA CTCAAGGGCT GGGGCAGAAA

 451  TGGCTGGGCG TGTTGTTCGC CCTGAGCCTG ATTTTCTGTT TCGGCTTTGT

 501  GTTTGAAGCG GTTCAGACCA ATACCATTGC CGATACCGTC AAAGCGGCGT

 551  GGGGTTGGGA GCCTCATTAT GTCGGCGTCG CCCTGGTGAT TTTAACCGCG

 601  CCGATTATCT TCGGCGGCAT CAGGCGCATA TCTAAAGCGG CGGAAATCGT

 651  CGTCCCCCTG ATGGCGGTTT TGTACCTCTT TATCGCGCTT TTCATCATTT

 701  TGACCAATAT TCCGATGATT CCGGACGTGT TCGGTCAGAT TTTTTCGGGC
```

-continued

```
 751 GCGTTCAAAT TCGACGCGGC AGCAGGCGGC TTACTCGGCG GTCTGATTTC

 801 GCAAACGATG ATGATGGGCA TCAAACGCGG CCTGTATTCC AACGAGGCGG

 851 GTATGGGTTC CGCGCCGAAC GCCGCCGCCG CCGCCGAAGT GAAACACCCT

 901 GTTTCGCAAG GTATGATTCA AATGCTGGGC GTGTTTGTCG ATACCATCAT

 951 CGTTTGTTCT TGCACCGCCT TCATCATCTT GATTTACCAA CAGCCTTACG

1001 GCGATTTGAG CGGTGCGGCG CTGACGCAGG CGGCGATTGT CAGCCAAGTG

1051 GGGCAATGGG GCGCGGGCTT CCTCGCCGTC ATCCTGTTTA TGTTTGCCTT

1101 TTCCACCGTT ATCGGCAACT ATGCCTATGC CGAGTCCAAC GTCCAATTCA

1151 TCAAAAGCCA TTGGCTGATT ACCGCCGTTT TCCGTATGCT GGTTTTGGCG

1201 TGGGTCTATT TCGGCGCGGT TGCCAATGTG CCTTTGGTCT GGGATATGGC

1251 GGATATGGCG ATGGGCATTA TGGCGTGGAT CAACCTTGTC GCCATCCTGC

1301 TGCTCTCGCC CTTGGCGTTT ATGCTGCTGC GCGATTACAC CGCCAAGCTG

1351 AAAATGGGCA AAGACCCCGA GTTCAAACTT TCCGAACATC CGGGCCTGAA

1401 ACGCCGTATC AAATCCGACG TTTGGTAA
```

This corresponds to the amino acid sequence <SEQ ID 1416; ORF 513.a>:

```
a513.pep
  1 MNENFTEWLH GWVGAINDPM WSYLVYXLLG TGLFFTVTTG FVQFRLFGRS

 51 IKEMLGGRKQ GDDPHGITPF QAFVTGLASR VGVGNIAGVA IAIKVGGPGA

101 VFWMWVTALI GMSSAFVESS LAQLFKVRDY DNHHFRGGPA YYITQGLGQK

151 WLGVLFALSL IFCFGFVFEA VQTNTIADTV KAAWGWEPHY VGVALVILTA

201 PIIFGGIRRI SKAAEIVVPL MAVLYLFIAL FIILTNIPMI PDVFGQIFSG

251 AFKFDAAAGG LLGGLISQTM MMGIKRGLYS NEAGMGSAPN AAAAAEVKHP

301 VSQGMIQMLG VFVDTIIVCS CTAFIILIYQ QPYGDLSGAA LTQAAIVSQV

351 GQWGAGFLAV ILFMFAFSTV IGNYAYAESN VQFIKSHWLI TAVFRMLVLA

401 WVYFGAVANV PLVWDMADMA MGIMAWINLV AILLLSPLAF MLLRDYTAKL

451 KMGKDPEFKL SEHPGLKRRI KSDVW*
```

m513/a513 100.0% identity in 191 aa overlap

```
                                            10        20        30
m513.pep                                    MGSAPNAAAAAEVKHPVSQGMIQMLGVFVD
                                            ||||||||||||||||||||||||||||||
a513        DAAAGGLLGGLISQTMMMGIKRGLYSNEAGMGSAPNAAAAAEVKHPVSQGMIQMLGVFVD
                260       270       280       290       300       310

                    40        50        60        70        80        90
m513.pep    TIIVCSCTAFIILIYQQPYGDLSGAALTQAAIVSQCGQWGAGFLAVILFMFAFSTVIGNY
            ||||||||||||||||||||||||||||||||||||||||||||||||||||||||||||
a513        TIIVCSCTAFIILIYQQPYGDLSGAALTQAAIVSQCGQWGAGFLAVILFMFAFSTVIGNY
                320       330       340       350       360       370

                   100       110       120       130       140       150
m513.pep    AYAESNVQFIKSHWLITAVFRMLVLAWVYFGAVANVPLVWDMADMAMGIMAWINLVAILL
            ||||||||||||||||||||||||||||||||||||||||||||||||||||||||||||
a513        AYAESNVQFIKSHWLITAVFRMLVLAWVYFGAVANVPLVWDMADMAMGIMAWINLVAILL
                380       390       400       410       420       430

                   160       170       180       190
m513.pep    LSPLAFMLLRDYTAKLKMGKDPEFKLSEHPGLKRRIKSDVWX
            ||||||||||||||||||||||||||||||||||||||||||
a513        LSPLAFMLLRDYTAKLKMGKDPEFKLSEHPGLKRRIKSDVWX
                440       450       460       470
```

The following partial DNA sequence was identified in *N. gonorrhoeae* <SEQ ID 1417>:

```
g515.seq
     1 atggttcaaa tacaggttgt gcgcgccgcc ggcgttgccc gtggtctgca

    51 ttccgagttt gcgcgcgctg taactgccga ggaaatagcc ttcgacaatg

   101 ccgttttgaa tcacgaagcg cggcgcggtg gcaacacctt ccgcatcaaa

   151 atagctgctg cggaaagagc gggggatgtg cggttcttcg cgcaggttga

   201 ggaaatcggg caggactttt ttgccgatgc tgtcgatcag gaaactgctt

   251 tggcggtaga gcgcgccgcc ggagagtgtg ccgacgaggt gtccgatcag

   301 cccgcccgaa acggtggtat cgaagaggac ggggtagctg cctgtcggga

   351 tgctgcggct gccgagtcgg cgcaaagtgc ggcgggcggc ggtttgaccg

   401 atggtttcgg ggctgtccat atccggatgg cggcaggcgg aatcgtacca

   451 gtagtcgcgc tgcattccgt tttcgtcggc ggcgacgacg ctgcaggaaa

   501 tgctgtggtg cgtgctttgc cggtgtgcgg caaaaccgtg ggtgttgccg

   551 taaacgtatt ggtactgtcc ggtttgcacc gccgcgcctt cggagttttc

   601 gatgcggctg tccgtgtcca acgctgcctg ttcgcattgt tttgccaagc

   651 cgacggcggc ttccgtatcc aaatcccatt cgtggtaaag gtcggggtcg

   701 ccgatgtgtt gcgccatcaa ctcggggtcg gcaagtccgg cgcaaccgtc

   751 ttcggcggtg tggcgggcga tgtcggcggc ggcgcggacg gtgtcgcgca

   801 gggcttgttc ggagaagtcg gcggtgccgg cgcggccttt gcgtttgccg

   851 acgtaaacgg taatgtccag cgatttgtcc tgctggaact cgatttgttc

   901 gatttcgccc aagcgcacgc tgacgctttg tccgagcgat tcgctgaagt

   951 cggcttcggc ggcggtcgcg cccgctgctt ttgccaagtc gagcgtgcgg

  1001 cggcagaggt cgaggagttc ggaagcggtg tggttgaaca gcataacaat

  1051 ctttcttggt ggagcgttgt ggcattttaa
```

This corresponds to the amino acid sequence <SEQ ID 1418; ORF 515.ng>:

```
g515.pep
   1 MVQIQVVRAA GVARGLHSEF ARAVTAEEIA FDNAVLNHEA RRGGNTFRIK

  51 IAAAERAGDV RFFAQVEEIG QDFFADAVDQ ETALAVERAA GECADEVSDQ

 101 PARNGGIEED GVAACRDAAA AESAQSAAGG GLTDGFGAVH IRMAAGGIVP

 151 VVALHSVFVG GDDAAGNAVV RALPVCGKTV GVAVNVLVLS GLHRRAFGVF

 201 DAAVRVQRCL FALFCQADGG FRIQIPFVVK VGVADVLRHQ LGVGKSGATV

 251 FGGVAGDVGG GADGVAQGLF GEVGGAGAAF AFADVNGNVQ RFVLLELDLF

 301 DFAQAHADAL SERFAEVGFG GGRARCFCQV ERAAAEVEEF GSGVVEQHNN

 351 LSWWSVVAF*
```

The following partial DNA sequence was identified in *N. meningitidis* <SEQ ID 1419>:

```
m515.seq (partial)
  1  ..GGAAAGAGCG GGGGATGTGC GTTCTTCGCG CAGGTTGAGG AAATCGGGCA

 51    GGACTTTTCT GCCGATGCTG TCGATCAGGA AACTGCTTTG GCGGTAGAGC
```

-continued

```
101  GCGCCGCCGG AGAGTGCGCC GACGAGGTGT CCGATAAGAC CGCCCGAAAC

151  GGTGGTATCG AAGAGGACGG GGTAGCTGCC TGTCGGGATG CTGCGGCTGC

201  CGAGTCGGCG CAAAGTGCGG CGGGCGGCGG TTTGACCGAT GGTTTCGGGG

251  CTGTCCATAT CCGGATGGCG GCAGGCGGAA TCGTACCAGT AGTCGCGCTG

301  CATGCCGTTT TCGTCGGCGG CAACGACGCT GCAGGAAATG CTGTGGTGCG

351  TGCCTTGCCG GTGTGCGGCA AAACCGTGGG TGTTGCCGTA AACGTATTGG

401  TAATGGCCGG TTTGCACCGC CGCGCCTTCG GAGTTTTCGA TGCGCTCATC

451  CTCGTTCAGG GCGGCTTGTT CGCATTGTTT TGCCAAGCCG ACGGCGGCTk

501  CCGTATCCAA ATCCCATTCG TGGTAAAGGT CGGGGTCGCC GATGTGTTTT

551  GCCATCAGAC AGGCATCGGC AAGTCCGGCG CAACCGTCTT CGGCGGTGTG

601  GCGGGCGATG TCGATGGCGG CTTTGACGGT GTCTTGCAGG GCTTTTTCGG

651  AGAAGTCGGC AGTACTGGCG CGGCCTTTGC GTTTGCCGAC GTAAACGGTA

701  ATGTCCAGCG ACTTGTCCTG CTGGAACTCG ATTTGTTsGA TTTsGCCCAG

751  CCGCACGCTG ACGCTTTGTC CCAATGATTC GCTGAAATCG GCTTCGGCGG

801  CGGTTGCGCC CGTCGCTTTT GCCAAGTCGA GCGTGCGGCG GCAGAGGTCG

851  AGGAGTTCGG AAGCGGTGTG GTTgAACAGC ATAGAAATCT TTCTTGATGA

901  TGCTTTGCGG CATTTTAA
```

This corresponds to the amino acid sequence <SEQ ID 1420; ORF 515>:

```
m515.pep (partial)
  1 ..GKSGGCAFFA QVEEIGQDFS ADAVDQETAL AVERAAGECA DEVSDKTARN

 51   GGIEEDGVAA CRDAAAAESA QSAAGGGLTD GFGAVHIRMA AGGIVPVVAL

101   HAVFVGGNDA AGNAVVRALP VCGKTVGVAV NVLVMAGLHR RAFGVFDALI

151   LVQGGLFALF CQADGGXRIQ IPFVVKVGVA DVFCHQTGIG KSGATVFGGV

201   AGDVDGGFDG VLQGFFGEVG STGAAFAFAD VNGNVQRLVL LELDLXDXAQ

251   PHADALSQXF AEIGFGGGCA RRFCQVERAA AEVEEFGSGV VEQHRNLSXX

301   CFAAF*
```

Computer analysis of this amino acid sequence gave the following results:

Homology with a Predicted ORF from *N. gonorrhoeae*

ORF 515 shows 85.9% identity over a 304 aa overlap with a predicted ORF (ORF 515.ng) from *N. gonorrhoeae*:

```
m515/g515

                                                     10        20        30
m515.pep                                   GKSGGCAFFAQVEEIGQDFSADAVDQETALA
                                           ::|   |||||||||||| ||||||||||
g515         AEEIAFDNAVLNHEARRGGNTFRIKIAAAERAGDVRFFAQVEEIGQDFFADAVDQETALA
                30        40        50        60        70        80

                     40        50        60        70        80        90
m515.pep     VERAAGECADEVSDKTARNGGIEEDGVAACRDAAAAESAQSAAGGGLTDGFGAVHIRMAA
             ||||||||||||||: |||||||||||||||||||||||||||||||||||||||||||
g515         VERAAGECADEVSDQPARNGGIEEDGVAACRDAAAAESAQSAAGGGLTDGFGAVHIRMAA
                90       100       110       120       130       140
```

-continued

```
                      100       110       120       130       140       150
m515.pep        GGIVPVVALHAVFVGGNDAAGNAVVRALPVCGKTVGVAVNVLVMAGLHRRAFGVFDALIL
                ||||||||||:|||||:||||||||||||||||||||||||||::||||||||||||| : 
g515            GGIVPVVALHSVFVGGDDAAGNAVVRALPVCGKTVGVAVNVLVLSGLHRRAFGVFDAAVR
                  150       160       170       180       190       200

                      160       170       180       190       200       210
m515.pep        VQGGLFALFCQADGGXRIQIPFVVKVGVADVFCHQTGIGKSGATVFGGVAGDVDGGFDGV
                ||  ||||||||||| |||||||||||||||: || |:||||||||||||||| || |||
g515            VQRCLFALFCQADGGFRIQIPFVVKVGVADVLRHQLGVGKSGATVFGGVAGDVGGGADGV
                  210       220       230       240       250       260

                      220       230       240       250       260       270
m515.pep        LQGFFGEVGSTGAAFAFADVNGNVQRLVLLELDLXDXAQPHADALSQXFAEIGFGGGCAR
                 ||:|||||::|||||||||||||||:||||||| | || ||||||: |||:||||| ||
g515            AQGLFGEVGGAGAAFAFADVNGNVQRFVLLELDLXDFAQAHADALSERFAEVGFGGGRAR
                  270       280       290       300       310       320

                      280       290       300
m515.pep        RFCQVERAAAEVEEFGSGVVEQHRNLSXXCFAAF
                 |||||||||||||||||||||| |||    :||
g515            CFCQVERAAAEVEEFGSGVVEQHNNLSWWSVVAF
                  330       340       350
```

The following partial DNA sequence was identified in *N. meningitidis* <SEQ ID 1421>:

```
a515.seq
   1 ATGGTTCAAA TAAAGGTTGT GCGCGCCGCC GGCGTTGCCC GTGGTCTGCA

  51 TTCCGAGTTT GCGCGCGCTG TAACTGCTGA GGAAATAGCC TTCGACAATG

 101 CCGTTTTGAA TCACGAAGCG CGGTGCGGTG GCAACGCCTT CCGCATCAAA

 151 ATAGCTGCTG CGGAAAGAGC GGGGGATGTG CGGTTCTTCG CGCAGGTTGA

 201 GGAAATCGGG CAGGACTTTT TTGCCGATGC TGTCGATCAG GAAACTGCTT

 251 TGGCGGTAGA GCGCTCCGCC GGAGAGTGCG CCGACGAGGT GTCCGATAAG

 301 ACCGCCCGAA ACGGTGGTAT CGAAGAGGAC GGGGTAGTTG CCTGTCGGGA

 351 TGCTGCGGCT GCCGAGTCGG CGCAAAGTGC GGCGGGCGGC GGTTTGACCG

 401 ATGGTTTCGG GGCTGTCCAT ATCCGGATGG CGGCAGGCGG AATCGTACCA

 451 GTAGTCGCGC TGCATGCCGT TTTCGTCGGC GGCAACGACG CTGCAGGAAA

 501 TGCTGTGGTG CGTGCTTTGC CGGTGTGCGG CAAAACCGTA GGTGTTGCCG

 551 TAAACGTATT GGTAATGGCC GGTTTGCACC GCCGCGCCTT CGGAGTTTTC

 601 GATGCGCTCA TCCTCGTTCA GGGCGGCTTG TTCGCATTGT TTTGCCAAGC

 651 CGACGGCGGC TTCCGTATCC AAATCCCATT CGTGGTAAAG GTCGGGGTCG

 701 CCGATGTGTT GCGCCATCAA CTCGGGGTCG GCAAGTCCGG CGCAACCGTC

 751 TTCGGCGGTG TGGCGGGCGA TGTCNNNNGC GGCGCGGACG GTGTCGCGCA

 801 GGGCTTGTTC GGAGAAATCG GCGGTGCCGG CGCGGCCTTT GCGTTTGCCG

 851 ACGTAAACGG TAATGTCCAG CGACTTGTCC TGCTGAAACT CGATTTGTTC

 901 GATTTCGCCC AGCCGCACGC TGACGCTTTG TCCCAATGAT TCGCTGAAAT

 951 CGGCTTCGGC GGCGGTTGCG CCCGTCGCTT TTGCCAAGTC GAGCGTGCGG

1001 CGGCAGAGGT CGAGGAGTTC GGAAGCGGTG TGGTTGAACA GCATAGAAAT

1051 CTTTCTTGAT GATGCTTTGC GGCATTTTAA
```

This corresponds to the amino acid sequence <SEQ ID 1422; ORF 515.a>:

```
a515.pep
  1 MVQIKVVRAA GVARGLHSEF ARAVTAEEIA FDNAVLNHEA RCGGNAFRIK

 51 IAAAERAGDV RFFAQVEEIG QDFFADAVDQ ETALAVERSA GECADEVSDK

101 TARNGGIEED GVVACRDAAA AESAQSAAGG GLTDGFGAVH IRMAAGGIVP

151 VVALHAVFVG GNDAAGNAVV RALPVCGKTV GVAVNVLVMA GLHRRAFGVF

201 DALILVQGGL FALFCQADGG FRIQIPFVVK VGVADVLRHQ LGVGKSGATV

251 FGGVAGDVXX GADGVAQGLF GEIGGAGAAF AFADVNGNVQ RLVLLKLDLF

301 DFAQPHADAL SQ*FAEIGFG GGCARRFCQV ERAAAEVEEF GSGVVEQHRN

351 LS**CFAAF*
```

m515/a515 92.1% identity in 304 aa overlap

```
                                                     10        20        30
m515.pep                                     GKSGGCAFFAQVEEIGQDFSADAVDQETALA
                                              ::|   |||||||||||| |||||||||||
a515            AEEIAFDNAVLNHEARCGGNTFRIKIAAAERAGDVRFFAQVEEIGQDFFADAVDQETALA
                   30        40        50        60        70        80

                        40        50        60        70        80        90
m515.pep        VERAAGECADEVSDKTARNGGIEEDGVAACRDAAAAESAQSAAGGGLTDGFGAVHIRMAA
                |||:|||||||||||||||||||||||:||||||||||||||||||||||||||||||||
a515            VERSAGECADEVSDKTARNGGIEEDGVVACRDAAAAESAQSAAGGGLTDGFGAVHIRMAA
                   90       100       110       120       130       140

                       100       110       120       130       140       150
m515.pep        GGIVPVVALHAVFVGGNDAAGNAVVRALPVCGKTVGVAVNVLVMAGLHRRAFGVFDALIL
                ||||||||||||||||||||||||||||||||||||||||||||||||||||||||||||
a515            GGIVPVVALHAVFVGGNDAAGNAVVRALPVCGKTVGVAVNVLVMAGLHRRAFGVFDALIL
                  150       160       170       180       190       200

                       160       170       180       190       200       210
m515.pep        VQGGLFALFCQADGGXRIQIPFVVKVGVADVFCHQTGIGKSGATVFGGVAGDVDGGFDGV
                ||||||||||||||| |||||||||||||||: || |:|||||||||||||||  | |||
a515            VQGGLFALFCQADGGFRIQIPFVVKVGVADVLRHQLGVGKSGATVFGGVAGDVXXGADGV
                  210       220       230       240       250       260

                       220       230       240       250       260       270
m515.pep        LQGFFGEVGSTGAAFAFADVNGNVQRLVLLELDLXDXAQPHADALSQXFAEIGFGGGCAR
                 ||:|||:|::|||||||||||||||||||:||| | |||||||||||||||||||||||
a515            AQGLFGEVGGAGAAFAFADVNGNVQRLVLLELDLFDFAQPHADALSQXFAEIGFGGGCAR
                  270       280       290       300       310       320

                       280       290       300
m515.pep        RFCQVERAAAEVEEFGSGVVEQHRNLSXXCFAAFX
                ||||||||||||||||||||||||||||||||||
a515            RFCQVERAAAEVEEFGSGVVEQHRNLSXXCFAAFX
                  330       340       350       350
```

The following partial DNA sequence was identified in *N. gonorrhoeae* <SEQ ID 1423>:

```
g515-1.seq
  1  ATGGTTCAAA TACAGGTTGT GCGCGCCGCC GGCGTTGCCC GTGGTCTGCA

 51  TTCCGAGTTT GCGCGCGCTG TAACTGCCGA GGAAATAGCC TTCGACAATG

101  CCGTTTTGAA TCACGAAGCG CGGCGCGGTG GCAACACCTT CCGCATCAAA

151  ATAGCTGCTG CGGAAAGAGC GGGGGATGTG CGGTTCTTCG CGCAGGTTGA

201  GGAAATCGGG CAGGACTTTT TTGCCGATGC TGTCGATCAG GAAACTGCTT

251  TGGCGGTAGA GCGCGCCGCC GGAGAGTGTG CCGACGAGGT GTCCGATCAG

301  CCCGCCCGAA ACGGTGGTAT CGAAGAGGAC GGGGTAGCTG CCTGTCGGGA
```

-continued

```
 351 TGCTGCGGCT GCCGAGTCGG CGCAAAGTGC GGCGGGCGGC GGTTTGACCG

 401 ATGGTTTCGG GGCTGTCCAT ATCCGGATGG CGGCAGGCGG AATCGTACCA

 451 GTAGTCGCGC TGCATTCCGT TTTCGTCGGC GGCAACGACG CTGCAGGAAA

 501 TGCTGTGGTG CGTGCTTTGC CGGTGTGCGG CAAAACCGTG GGTGTTGCCG

 551 TAAACGTATT GGTAGTGTCC GGTTTGCACC GCCGCGCCTT CGGAGTTTTC

 601 GATGCGGCTG TCCGTGTCCA ACGCTGCCTG TTCGCATTGT TTTGCCAAGC

 651 CGACGGCGGC TTCCGTATCC AAATCCCATT CGTGGTAAAG GTCGGGGTCG

 701 CCGATGTGTT GCGCCATCAA CTCGGGGTCG GCAAGTCCGG CGCAACCGTC

 751 TTCGGCGGTG TGGCGGGCGA TGTCGGCGGC GGCGCGGACG GTGTCGCGCA

 801 GGGCTTGTTC GGAGAAGTCG GCGGTGCCGG CGCGGCCTTT GCGTTTGCCG

 851 ACGTAAACGG TAATGTCCAG CGATTTGTCC TGCTGGAACT CGATTTGTTC

 901 GATTTCGCCC AAGCGCACGC TGACGCTTTG TCCGAGCGAT TCGCTGAAGT

 951 CGGCTTCGGC GGCGGTCGCG CCCGCTGCTT TTGCCAAGTC GAGCGTGCGG

1001 CGGCAGAGGT CGAGGAGTTC GGAAGCGGTG TGGTTGAACA GCATAACAAT

1051 CTTTCTTGGT GGAGCGTTGT GGCATTTTAA
```

This corresponds to the amino acid sequence <SEQ ID 1424; ORF 515-1.ng>:

```
g515-1.pep
   1 MVQIQVVRAA GVARGLHSEF ARAVTAEEIA FDNAVLNHEA RRGGNTFRIK

  51 IAAAERAGDV RFFAQVEEIG QDFFADAVDQ ETALAVERAA GECADEVSDQ

 101 PARNGGIEED GVAACRDAAA AESAQSAAGG GLTDGFGAVH IRMAAGGIVP

 151 VVALHSVFVG GNDAAGNAVV RALPVCGKTV GVAVNVLVVS GLHRRAFGVF

 201 DAAVRVQRCL FALFCQADGG FRIQIPFVVK VGVADVLRHQ LGVGKSGATV

 251 FGGVAGDVGG GADGVAQGLF GEVGGAGAAF AFADVNGNVQ RFVLLELDLF

 301 DFAQAHADAL SERFAEVGFG GGRARCFCQV ERAAAEVEEF GSGVVEQHNN

 351 LSWWSVVAF*
```

The following partial DNA sequence was identified in *N. meningitidis* <SEQ ID 1425>:

```
m515-1.seq
   1 ATGGTTCAAA TACAGGTTGT GCGCGCCGCC GGCGTTGCCC GTGGTCTGCA

  51 TACCGAGTTT GCGCGCGCTG TAACTGCTGA GGAAATAGCC TTCGACAATG

 101 CCGTTTTGAA TCACGAAGCG CGGTGCGGTG GCAACGCCTT CCGCATCAAA

 151 ATAGCTGCTG CGGAAAGAGC GGGGGATGTG CGGTTCTTCG CGCAGGTTGA

 201 GGAAATCGGG CAGGACTTTT TTGCCGATGC TGTCGATCAG GAAACTGCTT

 251 TGGCGGTAGA GCGCGCCGCC GGAGAGTGCG CCGACGAGGT GTCCGATAAG

 301 ACCGCCCGAA ACGGTGGTAT CGAAGAGGAC GGGGTAGCTG CCTGTCGGGA

 351 TGCTGCGGCT GCCGAGTCGG CGCAAAGTGC GGCGGGCGGC GGTTTGACCG

 401 ATGGTTTCGG GGCTGTCCAT ATCCGGATGG CGGCAGGCGG AATCGTACCA

 451 GTAGTCGCGC TGCATGCCGT TTTCGTCGGC GGCAACGACG CTGCAGGAAA

 501 TGCTGTGGTG CGTGCCTTGC CGGTGTGCGG CAAAACCGTG GGTGTTGCCG
```

-continued

```
551 TAAACGTATT GGTAATGGCC GGTTTGCACC GCCGCGCCTT CGGAGTTTTC

601 GATGCGCTCA TCCTCGTTCA GGGCGGCTTG TTCGCATTGT TTTGCCAAGC

651 CGACGGCGGC TTCCGTATCC AAATCCCATT CGTGGTAAAG GTCGGGGTCG

701 CCGATGTGTT TTGCCATCAG ACAGGCATCG GCAAGTCCGG CGCAACCGTC

751 TTCGGCGGTG TGGCGGGCGA TGTCGATGGC GGCTTTGACG GTGTCTTGCA

801 GGGCTTTTTC GGAGAAGTCG GCAGTACTGG CGCGGCCTTT GCGTTTGCCG

851 ACGTAAACGG TAATGTCCAG CGACTTGTCC TGCTGGAACT CGATTTGTTC

901 GATTTCGCCC AGCCGCACGC TGACGCTTTG TCCCAATGA
```

This corresponds to the amino acid sequence <SEQ ID 1426; ORF 515-1>:

```
m515-1.pep

  1  MVQIQVVRAA GCARGLHTEF ARAVTAEEIA FDNAVLNHEA RCGGNAFRIK

 51  IAAAERAGDV RFFAQVEEIG QDFFADAVDQ ETALAVERAA GECADEVSDK

101  TARNGGIEED GVAACRDAAA AESAQSAAGG GLTDGFGAVH IRMAAGGIVP

151  VVALHAVFVG GNDAAGNAVV RALPVCGKTV GVAVNVLVMA GLHRRAFGVF

201  DALILVQGGL FALFCQADGG FRIQIPFVVK VGVADVFCHQ TGIGKSGATV

251  FGGVAGDVDG GFDGVLQGFF GEVGSTGAAF AFADVNGNVQ RLVLLELDLF

301  DFAQPHADAL SQ*
```

```
m515-1/g515-1  91.7% identity in 312 aa overlap

                        10        20        30        40        50        60
g515-1.pep      MVQIQVVRAAGVARGLHSEFARACTAEEIAFDNAVLNHEARRGGNTFRIKIAAAERAGDV
                |||||||||||||||||:||||||||||||||||||||||| |||:||||||||||||||
m515-1          MVQIQVVRAAGVARGLHTEFARACTAEEIAFDNAVLNHEARCGGNAFRIKIAAAERAGDV
                        10        20        30        40        50        60

                        70        80        90       100       110       120
g515-1.pep      RFFAQVEEIGQDFFADAVDQETALAVERAAGECADEVSDQPARNGGIEEDGVAACRDAAA
                ||||||||||||||||||||||||||||||||||||||||: ||||||||||||||||||
m515-1          RFFAQVEEIGQDFFADAVDQETALAVERAAGECADEVSDKTARNGGIEEDGVAACRDAAA
                        70        80        90       100       110       120

                       130       140       150       160       170       180
g515-1.pep      AESAQSAAGGGLTDGFGAVHIRMAAGGIVPVVALHSVFVGGNDAAGNAVVRALPVCGKTV
                |||||||||||||||||||||||||||||||||||:||||||||||||||||||||||||
m515-1          AESAQSAAGGGLTDGFGAVHIRMAAGGIVPVVALHAVFVGGNDAAGNAVVRALPVCGKTV
                       130       140       150       160       170       180

                       190       200       210       220       230       240
g515-1.pep      GVAVNVLVVSGLHRRAFGVFDAAVRVQRCLFALFCQADGGFRIQIPFVVKVGVADVLRHQ
                ||||||||::|||||||||||| : ||  |||||||||||||||||||||||||||: ||
m515-1          GVAVNVLVMAGLHRRAFGVFDALILVQGGLFALFCQADGGFRIQIPFVVKVGVADVFCHQ
                       190       200       210       220       230       240

                       250       260       270       280       290       300
g515-1.pep      LGVGKSGATVFGGVAGDVGGGADGVAQGLFGECGGAGAAFAFADVNGNVQRFVLLELDLF
                 |:||||||||||||||| || ||| ||:|||||::|||||||||||||||:||||||||
m515-1          TGIGKSGATVFGGVAGDVDGGFDGVLQGFFGECGSTGAAFAFADVNGNVQRLVLLELDLF
                       250       260       270       280       290       300

                       310       320       330       340       350       360
g515-1.pep      DFAQAHADALSERFAECGFGGGRARCFCQVERAAAEVEEFGSGVVEQHNNLSWWSVVAFX
                |||| ||||||:
m515-1          DFAQPHADALSQX
                       310
```

The following partial DNA sequence was identified in *N. meningitidis* <SEQ ID 1427>:

```
a515-1.seq
  1  ATGGTTCAAA TAAAGGTTGT GCGCGCCGCC GGCGTTGCCC GTGGTCTGCA

 51  TTCCGAGTTT GCGCGCGCTG TAACTGCTGA GGAAATAGCC TTCGACAATG
```

-continued

```
101 CCGTTTTGAA TCACGAAGCG CGGTGCGGTG GCAACGCCTT CCGCATCAAA

151 ATAGCTGCTG CGGAAAGAGC GGGGGATGTG CGGTTCTTCG CGCAGGTTGA

201 GGAAATCGGG CAGGACTTTT TTGCCGATGC TGTCGATCAG GAAACTGCTT

251 TGGCGGTAGA GCGCTCCGCC GGAGAGTGCG CCGACGAGGT GTCCGATAAG

301 ACCGCCCGAA ACGGTGGTAT CGAAGAGGAC GGGGTAGTTG CCTGTCGGGA

351 TGCTGCGGCT GCCGAGTCGG CGCAAAGTGC GGCGGGCGGC GGTTTGACCG

401 ATGGTTTCGG GGCTGTCCAT ATCCGGATGG CGGCAGGCGG AATCGTACCA

451 GTAGTCGCGC TGCATGCCGT TTTCGTCGGC GGCAACGACG CTGCAGGAAA

501 TGCTGTGGTG CGTGCTTTGC CGGTGTGCGG CAAAACCGTA GGTGTTGCCG

551 TAAACGTATT GGTAATGGCC GGTTTGCACC GCCGCGCCTT CGGAGTTTTC

601 GATGCGCTCA TCCTCGTTCA GGGCGGCTTG TTCGCATTGT TTTGCCAAGC

651 CGACGGCGGC TTCCGTATCC AAATCCCATT CGTGGTAAAG GTCGGGGTCG

701 CCGATGTGTT GCGCCATCAA CTCGGGGTCG GCAAGTCCGG CGCAACCGTC

751 TTCGGCGGTG TGGCGGGCGA TGTCGGCGGC GGCGCGGACG GTGTCGCGCA

801 GGGCTTGTTC GGAGAAATCG GCGGTGCCGG CGCGGCCTTT GCGTTTGCCG

851 ACGTAAACGG TAATGTCCAG CGACTTGTCC TGCTGAAACT CGATTTGTTC

901 GATTTCGCCC AGCCGCACGC TGACGCTTTG TCCCAATGA
```

This corresponds to the amino acid sequence <SEQ ID 1428; ORF 515-1.a>:

```
a515-1.pep

      1  MVQIQVVRAA GCARGLHTEF ARAVTAEEIA FDNAVLNHEA RCGGNAFRIK

     51  IAAAERAGDV RFFAQVEEIG QDFFADAVDQ ETALAVERAA GECADEVSDK

    101  TARNGGIEED GVAACRDAAA AESAQSAAGG GLTDGFGAVH IRMAAGGIVP

    151  VVALHAVFVG GNDAAGNAVV RALPVCGKTV GVAVNVLVMA GLHRRAFGVF

    201  DALILVQGGL FALFCQADGG FRIQIPFVVK VGVADVFCHQ TGIGKSGATV

    251  FGGVAGDVDG GFDGVLQGFF GEVGSTGAAF AFADVNGNVQ RLVLLELDLF

    301  DFAQPHADAL SQ*

m515-1/a515-1  94.9% identity in 312 aa overlap

                    10        20        30        40        50        60
a515-1.pep  MVQIKVVRAAGVARGLHSEFARACTAEEIAFDNAVLNHEARRGGNTFRIKIAAAERAGDV
            ||||:||||||||||||:||||||||||||||||||||||||||||||||||||||||||||
m515-1      MVQIQVVRAAGVARGLHTEFARACTAEEIAFDNAVLNHEARRGGNTFRIKIAAAERAGDV
                  10        20        30        40        50        60

                    70        80        90       100       110       120
a515-1.pep  RFFAQVEEIGQDFFADAVDQETALAVERSAGECADEVSDQPARNGGIEEDGVVACRDAAA
            ||||||||||||||||||||||||||||:|||||||||||||||||||||||:|||||||
m515-1      RFFAQVEEIGQDFFADAVDQETALAVERAAGECADEVSDQPARNGGIEEDGVAACRDAAA
                    70        80        90       100       110       120

                   130       140       150       160       170       180
a515-1.pep  AESAQSAAGGGLTDGFGAVHIRMAAGGIVPVVALHAVFVGGNDAAGNAVVRALPVCGKTV
            ||||||||||||||||||||||||||||||||||||||||||||||||||||||||||||
m515-1      AESAQSAAGGGLTDGFGAVHIRMAAGGIVPVVALHAVFVGGNDAAGNAVVRALPVCGKTV
                   130       140       150       160       170       180

                   190       200       210       220       230       240
a515-1.pep  GVAVNVLVMAGLHRRAFGVFDALILVQGGLFALFCQADGGFRIQIPFVVKVGVADVLRHQ
            ||||||||||||||||||||||||||||||||||||||||||||||||||||||||: ||
m515-1      GVAVNVLVMAGLHRRAFGVFDALILVQGGLFALFCQADGGFRIQIPFVVKVGVADVFCHQ
                   190       200       210       220       230       240
```

-continued

```
                    250       260       270       280       290       300
a515-1.pep  LGVGKSGATVFGGVAGDVGGGADGVAQGLFGEIGGAGAAFAFADVNGNVQRLVLLKLDLF
             |:||||||||||||||| || ||| ||:|||:|::|||||||||||||||||||:||||
m515-1      TGIGKSGATVFGGVAGDVDGGFDGVLQGFFGEVGSTGAAFAFADVNGNVQRLVLLELDLF
                    250       260       270       280       290       300

                    310
a515-1.pep  DFAQPHADALSQX
            |||||||||||||
m515-1      DFAQPHADALSQX
                    310
```

The following partial DNA sequence was identified in *N. gonorrhoeae* <SEQ ID 1429>:

```
g516.seq
   1 atgttgttcc gtaaaacgac cgccgccgtt ttggcggcaa ccttgatact

  51 gaacggctgt acgatgatgt tgcgggggat gaacaacccg gtcagccaaa

 101 caatcacccg caaacacgtt gacaaagacc aaatccgcgc cttcggtgtg

 151 gttgccgaag acaatgccca attggaaaag ggcagcctgg tgatgatggg

 201 cgggaaatac tggttcgccg tcaatcccga agattcggcg aagctgacgg

 251 gccttttgaa ggccgggttg gacaagccct tccaaatagt tgaggatacc

 301 ccgagctatg cccgccacca agccctgccg gtcaaattcg aagcgcccgg

 351 cagccagaat ttcagtaccg gaggtctttg cctgcgctat gataccggca

 401 gacctgacga catcgccaag ctgaaacagc ttgagtttaa agcggtcaaa

 451 ctcgacaatc ggaccattta cacgcgctgc gtatccgcca aaggcaaata

 501 ctacgccacg ccgcaaaaac tgaacgccga ttatcatttt gagcaaagtg

 551 tgcccgccga tatttattat acggttactg aaaaacatac cgacaaatcc

 601 aagctgtttg gaaatatctt atatacgccc cccttgttga tattggatgc

 651 ggcggccgcg gtgctggtct tgcctatggc tctgattgca gccgcgaatt

 701 cctcagacaa atga
```

This corresponds to the amino acid sequence <SEQ ID 1430; ORF 516.ng>:

```
g516.pep
   1 MLFRKTTAAV LAATLILNGC TMMLRGMNNP VSQTITRKHV DKDQIRAFGV

  51 VAEDNAQLEK GSLVMMGGKY WFAVNPEDSA KLTGLLKAGL DKPFQIVEDT

 101 PSYARHQALP VKFEAPGSQN FSTGGLCLRY DTGRPDDIAK LKQLEFKAVK

 151 LDNRTIYTRC VSAKGKYYAT PQKLNADYHF EQSVPADIYY TVTEKHTDKS

 201 KLFGNILYTP PLLILDAAAA VLVLPMALIA AANSSDK*
```

The following partial DNA sequence was identified in *N. meningitidis* <SEQ ID 1431>:

```
m516.seq
   1 ATGTTGTTCC GTAAAACGAC CGCCGCCGTT TTGGCGGCAA CCTTGATGCT

  51 GAACGGCTGT ACGTTGATGT TGTGGGGAAT GAACAACCCG GTCAGCGAAA

 101 CAATCACCCG CAAACACGTT GACAAAGACC AAATCCGCGC CTTCGGTGTG

 151 GTTGCCGAAG ACAATGCCCA ATTGGAAAAG GGCAGCCTGG TGATGATGGG

 201 CGGAAAATAC TGGTTCGTCG TCAATCCCGA AGATTCGGCG AAGCTGACGG
```

-continued

```
251 GCATTTTGAA GGCAGGGCTG GACAAACCCT TCCAAATAGT TGAGGATACC

301 CCGAGCTATG CTCGCCACCA AGCCCTGCCG GTCAAACTCG AATCGCCTGG

351 CAGCCAGAAT TTCAGTACCG AAGGCCTTTG CCTGCGCTAC GATACCGACA

401 AGCCTGCCGA CATCGCCAAG CTGAAACAGC TCGGGTTTGA AGCGGTCAAA

451 CTCGACAATC GGACCATTTA CACGCGCTGC GTATCCGCCA AAGGCAAATA

501 CTACGCCACA CCGCAAAAAC TGAACGCCGA TTACCATTTT GAGCAAAGTG

551 TGCCTGCCGA TATTTATTAC ACGGTTACTG AAGAACATAC CGACAAATCC

601 AAGCTGTTTG CAAATATCTT ATATACGCCC CCCTTTTTGA TACTGGATGC

651 GGCGGGCGCG GTACTGGCCT TGCCTGCGGC GGCTCTGGGT GCGGTCGTGG

701 ATGCCGCCCG CAAATGA
```

This corresponds to the amino acid sequence <SEQ ID 1432; ORF 516>:

```
m516.pep
  1 MLFRKTTAAV LAATLMLNGC TLMLWGMNNP VSETITRKHV DKDQIRAFGV

 51 VAEDNAQLEK GSLVMMGGKY WFVVNPEDSA KLTGILKAGL DKPFQIVEDT

101 PSYARHQALP VKLESPGSQN FSTEGLCLRY DTDKPADIAK LKQLGFEAVK

151 LDNRTIYTRC VSAKGKYYAT PQKLNADYHF EQSVPADIYY TVTEEHTDKS

201 KLFANILYTP PFLILDAAGA VLALPAAALG AVVDAARK*
```

Computer analysis of this amino acid sequence gave the following results:

Homology with a Predicted ORF from *N. gonorrhoeae*

ORF 516 shows 90.0% identity over a 231 aa overlap with a predicted ORF (ORF 516.ng) from *N. gonorrhoeae*:

```
m516/g516
                     10        20        30        40        50        60
m516.pep    MLFRKTTAAVLAATLMLNGCTLMLWGMNNPVSETITRKHVDKDQIRAFGVVAEDNAQLEK
            |||||||||||||||:|||||:|| |||||||:|||||||||||||||||||||||||||
g516        MLFRKTTAAVLAATLILNGCTMMLRGMNNPVSQTITRKHVDKDQIRAFGVVAEDNAQLEK
                     10        20        30        40        50        60

                     70        80        90       100       110       120
m516.pep    GSLVMMGGKYWFVVNPEDSADLTGILKAGLDKPFQIVEDTPSYARHQALPVKLESPGSQN
            ||||||||||||:||||||||||||:||||||||||||||||||||||||||:|:|||||
g516        GSLVMMGGKYWFAVNPEDSADLTGLLKAGLDKPFQIVEDTPSYARHQALPVKKEAPGSQN
                     70        80        90       100       110       120

                    130       140       150       160       170       180
m516.pep    FSTEGLCLRYDTDKPADIAKLKQLGFEAVKLDNRTIYTRCVSAKGKYYATPQKLNADYHF
            ||| |||||||| :| |||||||| |:|||||||||||||||||||||||||||||||||
g516        FSTGGLCLRYDTGRPDDIAKLKQLEFKAVKLDNRTIYTRCVSAKGKYYATPQKLNADYHF
                    130       140       150       160       170       180

                    190       200       210       220       230      239
m516.pep    EQSVPADIYYTVTEEHTDKSKLFANILYTPPFLILDAAGAVLALPAAALGAVVDAARK
            ||||||||||||||:||||||||:|||||||:||||||:|||:|| | ::|:
g516        EQSVPADIYYTVTEKHTDKSKLFGNILYTPPLLILDAAAAVLVLPMALIAAANSSDK
                    190       200       210       220       230
```

The following partial DNA sequence was identified in *N. meningitidis* <SEQ ID 1433>:

```
a516.seq
  1 ATGTTGTTCC GTAAAACGAC CGCCGCCGTT TTGGCGGCAA CCTTGATGTT

 51 GAACGGCTGT ACGGTAATGA TGTGGGGTAT GAACAGCCCG TTCAGCGAAA

101 CGACCGCCCG CAAACACGTT GACAAGGACC AAATCCGCGC CTTCGGTGTG
```

-continued

```
151 GTTGCCGAAG ACAATGCCCA ATTGGAAAAG GGCAGCCTGG TGATGATGGG

201 CGGGAAATAC TGGTTCGTCG TCAATCCTGA AGATTCGGCG AAGCTGACGG

251 GCATTTTGAA GGCCGGGTTG GACAAGCAGT TTCAAATGGT TGAGCCCAAC

301 CCGCGCTTTG CCTACCAAGC CCTGCCGGTC AAACTCGAAT CGCCCGCCAG

351 CCAGAATTTC AGTACCGAAG GCCTTTGCCT GCGCTACGAT ACCGACAGAC

401 CTGCCGACAT CGCCAAGCTG AAACAGCTTG AGTTTGAAGC GGTCGAACTC

451 GACAATCGGA CCATTTACAC GCGCTGCGTC TCCGCCAAAG GCAAATACTA

501 CGCCACACCG CAAAAACTGA ACGCCGATTA TCATTTTGAG CAAAGTGTGC

551 CTGCCGATAT TTATTACACG GTTACGAAAA AACATACCGA CAAATCCAAG

601 TTGTTTGAAA ATATTGCATA TACGCCCACC ACGTTGATAC TGGATGCGGT

651 GGGCGCGGTG CTGGCCTTGC CTGTCGCGGC GTTGATTGCA GCCACGAATT

701 CCTCAGACAA ATGA
```

This corresponds to the amino acid sequence <SEQ ID 1434; ORF 516.a>:

```
a516.pep
  1 MLFRKTTAAV LAATLMLNGC TVMMWGMNSP FSETTARKHV DKDQIRAFGV

 51 VAEDNAQLEK GSLVMMGGKY WFVVNPEDSA KLTGILKAGL DKQFQMVEPN

101 PRFAYQALPV KLESPASQNF STEGLCLRYD TDRPADIAKL KQLEFEAVEL

151 DNRTIYTRCV SAKGKYYATP QKLNADYHFE QSVPADIYYT VTKKHTDKSK

201 LFENIAYTPT TLILDAVGAV LALPVAALIA ATNSSDK*
```

m516/a516 86.1% identity in 238 aa overlap

```
                  10        20        30        40        50        60
m516.pep  MLFRKTTAAVLAATLMLNGCTLMLWGMNNPVSETITRKHVDKDQIRAFGVVAEDNAQLEK
          |||||||||||||||||||||:|:||||:| ||| :||||||||||||||||||||||||
a516      MLFRKTTAAVLAATLMLNGCTVMMWGMNSPFSETTARKHVDKDQIRAFGVVAEDNAQLEK
                  10        20        30        40        50        60

                  70        80        90       100       110       120
m516.pep  GSLVMMGGKYWFVVNPEDSAKLTGILKAGLDKPFQIVEDTPSYARHQALPVKLESPGSQN
          |||||||||||||||||||||||||||||||| ||:|| :| :| :||||||||||:|||
a516      GSLVMMGGKYWFVVNPEDSAKLTGILKAGLDKQFQMVEPNPRFA-YQALPVKLESPASQN
                  70        80        90       100       110       120

                 130       140       150       160       170       180
m516.pep  FSTEGLCLRYDTDKPADIAKLKQLGFEAVKLDNRTIYTRCVSAKGKYYATPQKLNADYHF
          |||||||||||||:|||||||||| ||||:||||||||||||||||||||||||||||||
a516      FSTEGLCLRYDTDRPADIAKLKQLEFEAVELDNRTIYTRCVSAKGKYYATPQKLNADYHF
       120        130       140       150       160       170

                 190       200       210       220       230      239
m516.pep  EQSVPADIYYTVTEEHTDKSKLFANILYTPPFLILDAAGAVLALPAAALGAVVDAARKX
          |||||||||||||::|||||||| || |||  |||||:|||||||:||| |::::: ||
a516      EQSVPADIYYTVTKKHTDKSKLFENIAYTPTTLILDAVGAVLALPVAALIAATNSSDKX
       180        190       200       210       220       230
```

The following partial DNA sequence was identified in *N. gonorrhoeae* <SEQ ID 1435>:

```
g517.seq
  1 atgcatcggg tttcagacgg cattggagtg tcagtcgtgt tctgccgatt

 51 cgtaggcttc gacgattttt tgcaccagag gatgccggac aacgtcttcg

101 ccggtgaagg tatggaaata cagtcctgcc acgccgtgca gtttctcacg

151 tgcgtctttc aatcccgatt tgatgttttt gggcaggtcg atttggctgg
```

-continued

```
201 tgtcgccggt aatgacggct ttcgcgccga agccgatgcg ggtcaggaac

251 attttcattt gttcgggcgt ggtgttttgc gcttcgtcga ggatgatgta

301 tgcgccgttg agcgtcctgc cgcgcatata ggcgagcggg gcgatttcaa

351 tcaggccttt ttcaatcagc ttggttacac ggtcaaagcc catcaggtca

401 tagagggcat cataaagcgg acggaggtag gggtcgactt tttgggtcag

451 gtctccgggc aggaagccca gtttctcacc ggcttcgacg gcaggccgaa

501 ctaa
```

This corresponds to the amino acid sequence <SEQ ID 1436; ORF 517.ng>:

```
g517.pep
  1 MHRVSDGIGV SVVFCRFVGF DDFLHQRMPD NVFAGEGMEI QSCHAVQFLT

 51 CVFQSRFDVF GQVDLAGVAG NDGFRAEADA GQEHFHLFGR GVLRFVEDDV

101 CAVERPAAHI GERGDFNQAF FNQLGYTVKA HQVIEGIIKR TEVGVDFLGQ

151 VSGQEAQFLT GFDGRPN*
```

The following partial DNA sequence was identified in *N. meningitidis* <SEQ ID 1437>:

```
m517.seq
  1 ATGCATCGGG TTTCAGACGG CATTGGAATG TCAGTCGTGT TCTGCCGATT

 51 CGTAGGCTTC GACGATTTTT TGCACCAAAG GATGCCGGAC AACGTCTTCG

101 CCGGTAAAGG TGTGGAAATA CAGCCCTTCC ACGTTGTGCA GTTTCTCACG

151 CGCATCTTTT AATCCCGATT TGATGTTTTT GGGCAGGTCG ATTTGGCTGG

201 TGTCGCCGGT AATGACGGCT TTCGCGCCGA AGCCGATGCG GGTCAGGAAC

251 ATTTTCATTT GTTCGGGCGT GGTGTTTTGC GCTTCGTCGA GGATGATGTA

301 TGCGCCGTTG AGCGTCCTGC CGCGCATATA GGCGAGCGGG GCGATTTCAA

351 TCAGGCCTTT TTCAATCAGC TTGGTTACAC GGTCAAAGCC CATCAGGTCA

401 TAGAGGGCAT CATAAAGCGG ACGAAGGTAG GGATCGACTT TCTGGGTCAG

451 GTCTCCGGGC AGGAAGCCCA GTTTCTCGCC GGCTTCGACG GCTGgGCGCA

501 CTAA
```

This corresponds to the amino acid sequence <SEQ ID 1438; ORF 517>:

```
m517.pep
  1 MHRVSDGIGM SVVFCRFVGF DDFLHQRMPD NVFAGKGVEI QPFHVVQFLT

 51 RIFXSRFDVF GQVDLAGVAG NDGFRAEADA GQEHFHLFGR GVLRFVEDDV

101 CAVERPAAHI GERGDFNQAF FNQLGYTVKA HQVIEGIIKR TKVGIDFLGQ

151 VSGQEAQFLA GFDGWAH*
```

Computer analysis of this amino acid sequence gave the following results:

Homology with a Predicted ORF from *N. gonorrhoeae*

ORF 517 shows 92.7% identity over a 164 aa overlap with a predicted ORF (ORF 517.ng) from *N. gonorrhoeae*:

```
m517/g517

                    10         20         30         40         50         60
m517.pep     MHRVSDGIGMSVVFCRFVGFDDFLHQRMPDNVFAGKGVEIQPFHVVQFLTRIFXSRFDVF
             ||||||||:|||||||||||||||||||||||||:|:|||  |:||||| :| ||||||
g517         MHRVSDGIGVSVVFCRFVGFDDFLHQRMPDNVFAGEGMEIQSCHAVQFLTCVFQSRFDVF
                    10         20         30         40         50         60

                    70         80         90        100        110        120
m517.pep     GQVDLAGVAGNDGFRAEADAGQEHFHLFGRGVLRFVEDDVCAVERPAAHIGERGDFNQAF
             ||||||||||||||||||||||||||||||||||||||||||||||||||||||||||||
g517         GQVDLAGVAGNDGFRAEADAGQEHFHLFGRGVLRFVEDDVCAVERPAAHIGERGDFNQAF
                    70         80         90        100        110        120

                   130        140        150        160
m517.pep     FNQLGYTVKAHQVIEGIIKRTKVGIDFLGQVSGQEAQFLAGFDGWAH
             ||||||||||||||||||||:||:||||||||||||||:||||
g517         FNQLGYTVKAHQVIEGIIKRTEVGVDFLGQVSGQEAQFLTGFDGRPN
                   130        140        150        160
```

The following partial DNA sequence was identified in *N. meningitidis* <SEQ ID 1439>:

```
a517.seq
   1 ATGCATCGGG TTTCAGACGG CATTGGAATG TCAGTCGTGT TCTGCCGATT

  51 CGTAGGCTTC GACGATTTTT TGCACCAAAG GATGCCGGAC AACGTCTTCG

 101 CCGGTAAAGG TGTGGAAATA CAGCCCTTCC ACGCCGTGCA GTTTCTCACG

 151 CGCATCTTTT AATCCCGATT TGATGTTTTT GGGCAGGTCG ATTTGGCTGG

 201 TGTCGCCGGT AATGACGGCT TTCGCGCCGA AGCCGATGCG GGTCAGGAAC

 251 ATTTTCATTT GTTCGGGCGT GGTGTTTTGC GCTTCGTCGA GGATGATGTA

 301 TGCGCCGTTG AGCGTCCTGC CGCGCATATA GGCGAGCGGG GCAATCTCAA

 351 TCAGACCTTT TTCAATCAGC TTGGTGACAC GGTCGAAGCC CATCAGGTCA

 401 TAGAGGGCAT CATAAAGCGG ACGAAGGTAG GGATCGACTT TCTGGGTCAG

 451 GTCACCGGGC AGAAAACCCA GTTTCTCGCC GGCTTCGACG GCAGGCCGCA

 501 CTAA
```

This corresponds to the amino acid sequence <SEQ ID 1440; ORF 517.a>:

```
a517.pep

      1 MHRVSDGIGM SVVFCRFVGF DDFLHQRMPD NVFAGKGVEI QPFHAVQFLT

     51 RAF*SRFDVF GQVDLAGVAG NDGFRAEADA GQEHFHLFGR GVLRFVEDDV

    101 CAVERPAAHI GERGNLNQTF FNQLGDTVEA HQVIEGIIKR TKVGIDFLGQ

    151 VTGQKTQFLA GFDGRPH*

m517/a517   93.4% identity in 167 aa overlap

                    10         20         30         40         50         60
m517.pep     MHRVSDGIGMSVVFCRFVGFDDFLHQRMPDNVFAGKGVEIQPFHVVQFLTRIFXSRFDVF
             ||||||||||||||||||||||||||||||||||||||||||||:|||||||||||||||
a517         MHRVSDGIGMSVVFCRFVGFDDFLHQRMPDNVFAGKGVEIQPFHAVQFLTRIFXSRFDVF
                    10         20         30         40         50         60

                    70         80         90        100        110        120
m517.pep     GQVDLAGVAGNDGFRAEADAGQEHFHLFGRGVLRFVEDDVCAVERPAAHIGERGDFNQAF
             ||||||||||||||||||||||||||||||||||||||||||||||||||||||::||:|
a517         GQVDLAGVAGNDGFRAEADAGQEHFHLFGRGVLRFVEDDVCAVERPAAHIGERGNLNQTF
                    70         80         90        100        110        120
```

-continued

```
                   130       140       150       160
m517.pep    FNQLGYTVKAHQVIEGIIKRTKVGIDFLGQVSGQEAQFLAGFDGWAHX
            ||||| ||:||||||||||||||||||||||:||::||||||||  ||
a517        FNQLGDTVEAHQVIEGIIKRTKVGIDFLGQVTGQKTQFLAGFDGRPHX
                   130       140       150       160
```

The following partial DNA sequence was identified in *N. gonorrhoeae* <SEQ ID 1441>:

```
g518.seq
   1 atgacgtttt cggcggcaaa gctcaacatt tcggcactga tgttgtgtct

  51 ttcggcagga atgaccgttt tactttccgc ttttttactg ctccgaccgg

 101 aaggcagcat cttattcaac catttttca gcataaatat tctgacccga

 151 agagcggcat ctccacgggc aaccgtgttc agactgcatc aggcggtacg

 201 attccacaag atgccgaaaa ccataagcaa aatgcgtaga aactacgccg

 251 tccgaatcac gccgcctcct cgggcggcaa cgcttcatta taacagattg

 301 cccttaaaa aatcagaccc tgcttttgtg gcggagtctg aaatttga
```

This corresponds to the amino acid sequence <SEQ ID 1442; ORF 518.ng>:

```
g518.pep
   1 MTFSAAKLNI SALMLCLSAG MTVLLSAFLL LRPEGSILFN HFFSINILTR

  51 RAASPRATVF RLHQAVRFHK MPKTISKMRR NYAVRITPPP RAATLHYNRL

 101 PLKKSDPAFV AESEI*
```

The following partial DNA sequence was identified in *N. meningitidis* <SEQ ID 1443>:

```
m518.seq
   1 ATGACGTTTT CGGCGGCAAA GCTCAACATT TCGGCACGGA TGTTGTGTCT

  51 TTCGGCAGGA ATGACCGTTT TACTTTCCGC TTTTTTACTG CTCCGACCGG

 101 AAGGCAGCAT CTTATTCAAC CATTTTTTCA GCATAAATAT TCTGACCCGA

 151 AGAGCGGCAT CTCCACAGGC AACCGTGTTC AGACGGCATC AGGCGCGGTT

 201 TGCAAGATGC CGTACCATAA ACAAAAGGCG TAGAAACTAC GCCGTCCGAA

 251 TCACGCCGCC CTCGCG.GCG GCAACGCGTC ATTATAACAG ATTGCCCTCC

 301 GCGGCAGGCT TAGTGCGGCG GGAGCGCCGC CGTTGCGCAG TAATATTGTC

 351 TAACGGGAGG AAAAAATCAG ACCCTGCTTT TGTGGCAGAG TCTGAAATTT

 401 GA
```

This corresponds to the amino acid sequence <SEQ ID 1444; ORF 518>:

```
m518.pep
   1 MTFSAAKLNI SARMLCLSAG MTVLLSAFLL LRPEGSILFN HFFSINILTR

  51 RAASPQATVF RRHQARFARC RTINKRRRNY AVRITPPSXA ATRHYNRLPS

 101 AAGLVRRERR RCAVILSNGR KKSDPAFVAE SEI*
```

Computer analysis of this amino acid sequence gave the following results:

Homology with a Predicted ORF from *N. gonorrhoeae*

ORF 518 shows 74.1% identity over a 135 aa overlap with a predicted ORF (ORF 518.ng) from *N. gonorrhoeae*:

```
m518/g518

m518.pep    MTFSAAKLNISARMLCLSAGMTVLLSAFLLLRPEGSILFNHFFSINILTRRAASPQATVF
            ||||||||||| |||||||||||||||||||||||||||||||||||||||||||:||||
g518        MTFSAAKLNISALMLCLSAGMTVLLSAFLLLRPEGSILFNHFFSINILTRRAASPRATVF
                    10        20        30        40        50        60

                     70        80        90       100       110
m518.pep    RRHQA-RFARC-RTINKRRRNYAVRITPPSXAATRHYNRLPSAAGLVRRERRRCAVILSN
            | ||| ||  :   :||:| || ||||||||||  ||| ||||||
g518        RLHQAVRFHKMPKTISKMRRNYAVRITPPPRAATLHYNRLPL-----------------
                    70        80        90       100

              120       130
m518.pep      GRKKSDPAFVAESEI
                |||||||||||||
g518          --KKSDPAFVAESEI
                     110
```

The following partial DNA sequence was identified in *N. meningitidis* <SEQ ID 1445>:

```
a518.seq
  1 ATGACGTTTT CGGCGGCAAA GCTCAACATT TCGGCACGGA TGTTGTGTCT

 51 TTCGGCAGGA ATGACCGTTT TACTTTCCGC TTTTTTACTG CTCCGACCGG

101 AAGGCAGCAT CTTATTCAAC CATTTTTTCA GCATAAATAT TCTAACCCGA

151 AGAGCGGCAT CTCCACGGGC AACCGTGTTC AGACGGCATC AGGCGGTACG

201 ATTCCGCAAG ATGCCGACCA TAAACAAAAG GCGTAGAAAC TACGCCGTCC

251 GAATCACGCC GTCCTCG.CG GCGGCAACGC GTCATTATAA CAGATTGCCC

301 TCC....... .......... .......... .......... ..........

351 .......... ...AAAAAAT CAGACCCTGC TTTTGTGGCA GAGTCTGAAA

401 TTTGA
```

This corresponds to the amino acid sequence <SEQ ID 1446; ORF 518.a>:

```
a518.pep

      1 MTFSAAKLNI SARMLCLSAG MTVLLSAFLL LRPEGSILFN HFFSINILTR

     51 RAASPRATVF RRHQAVRFRK MPTINKRRRN YAVRITPSSX AATRHYNRLP

    101 S......... .......... .KKSDPAFVA ESEI*

m518/a518   79.9% identity in 134 aa overlap

                    10        20        30        40        50        60
m518.pep    MTFSAAKLNISARMLCLSAGMTVLLSAFLLLRPEGSILFNHFFSINILTRRAASPQATVF
            |||||||||||||||||||||||||||||||||||||||||||||||||||||||:||||
a518        MTFSAAKLNISARMLCLSAGMTVLLSAFLLLRPEGSILFNHFFSINILTRRAASPRATVF
                    10        20        30        40        50        60

                     70        80        90       100                  119
m518.pep    RRHQA-RFARCRTINKRRRNYAVRITPPSXAATRHYNRLPSAAGLVRRERRRCAVILSNG
            ||||| ||  :  ||||||||||||||| ||||||||||||
a518        RRHQAVRFRKMPTINKRRRNYAVRITPSSXAATRHYNRLPS------------------
                    70        80        90       100

            120       130
m518.pep      RKKSDPAFVAESEIX
               ||||||||||||||
a518          -KKSDPAFVAESEIX
                     110
```

The following partial DNA sequence was identified in *N. gonorrhoeae* <SEQ ID 1447>:

```
g519.seq
   1 atggaatttt tcattatctt gttggcagcc gtcgccgttt tcggcttcaa

  51 atcctttgtc gtcatccccc agcaggaagt ccacgttgtc gaaaggctcg

 101 ggcgtttcca tcgcgccctg acggccggtt tgaatatttt gattcccttt

 151 atcgaccgcg tcgcctaccg ccattcgctg aaagaaatcc ctttagacgt

 201 acccagccag gtctgcatca cgcgcgataa tacgcaattg actgttgacg

 251 gcatcatcta tttccaagta accgatccca aactcgcctc atacggttcg

 301 agcaactaca ttatggcaat tacccagctt gcccaaacga cgctgcgttc

 351 cgttatcggg cgtatggagt tggacaaaac gtttgaagaa cgcgacgaaa

 401 tcaacagtac cgtcgtctcc gccctcgatg aagccgccgg ggcttggggt

 451 gtgaaagtcc tccgttacga aatcaaggat ttggttccgc cgcaagaaat

 501 ccttcgcgca atgcaggcac aaattaccgc cgaacgcgaa aaacgcgccc

 551 gtattgccga atccgaaggc cgtaaaatcg aacaaatcaa ccttgccagt

 601 ggtcagcgtg aagccgaaat ccaacaatcc gaaggcgagg ctcaggctgc

 651 ggtcaatgcg tccaatgccg agaaaatcgc ccgcatcaac cgcgccaaag

 701 gcgaagcgga atccctgcgc cttgttgccg aagccaatgc cgaagccaac

 751 cgtcaaattg ccgccgccct tcaaacccaa agcggggcgg atgcggtcaa

 801 tctgaagatt gcgggacaat acgttaccgc gttcaaaaat cttgccaaag

 851 aagacaatac gcggattaag cccgccaagg ttgccgaaat cgggaaccct

 901 aattttcggc ggcatgaaaa attttcgcca gaagcaaaaa cggccaaata

 951 a
```

This corresponds to the amino acid sequence <SEQ ID 1448; ORF 519.ng>:

```
g519.pep
   1 MEFFIILLAA VAVFGFKSFV VIPQQEVHVV ERLGRFHRAL TAGLNILIPF

  51 IDRVAYRHSL KEIPLDVPSQ VCITRDNTQL TVDGIIYFQV TDPKLASYGS

 101 SNYIMAITQL AQTTLRSVIG RMELDKTFEE RDEINSTVVS ALDEAAGAWG

 151 VKVLRYEIKD LVPPQEILRA MQAQITAERE KRARIAESEG RKIEQINLAS

 201 GQREAEIQQS EGEAQAAVNA SNAEKIARIN RAKGEAESLR LVAEANAEAN

 251 RQIAAALQTQ SGADAVNLKI AGQYVTAFKN LAKEDNTRIK PAKVAEIGNP

 301 NFRRHEKFSP EAKTAK*
```

The following partial DNA sequence was identified in *N. meningitidis* <SEQ ID 1449>:

```
m519.seq (partial)
   1 ..TCCGTTATCG GGCGTATGGA GTTGGACAAA ACGTTTGAAG AACGCGACGA

  51   AATCAACAGT ACTGTTGTTG CGGCTTTGGA CGAGGCGGCC GGGgCTTgGG

 101   GTGTGAAGGT TTTGCGTTAT GAGATTAAAG ACTTGGTTCC GCCGCAAGAA

 151   ATCCTTCGCT CAATGCAGGC GCAAATTACT GCCGAACGCG AAAAACGCGC

 201   CCGTATCGCC GAATCCGAAG GTCGTAAAAT CGAACAAATC AACCTTGCCA
```

-continued

```
251   GTGGTCAGCG CGAAGCCGAA ATCCAACAAT CCGAAGGCGA GGCTCAGGCT

301   GCGGTCAATG CGTCAAATGC CGAGAAAATC GCCCGCATCA ACCGCGCCAA

351   AGGTGAAGCG GAATCCTTGC GCCTTGTTGC CGAAGCCAAT GCCGAAGCCA

401   TCCGTCAAAT TGCCGCCGCC CTTCAAACCC AAGGCGGTGC GGATGCGGTC

451   AATCTGAAGA TTGCGGAACA ATACGTCGCT GCGTTCAACA ATCTTGCCAA

501   AGAAAGCAAT ACGCTGATTA TGCCCGCCAA TGTTGCCGAC ATCGGCAGCC

551   TGATTTCTGC CGGTATGAAA ATTATCGACA GCAGCAAAAC CGCCAAaTAA
```

This corresponds to the amino acid sequence <SEQ ID 1450; ORF 519>:

```
m519.pep (partial)
   1 ..SVIGRMELDK TFEERDEINS TVVAALDEAA GAWGVKVLRY EIKDLVPPQE

  51   ILRSMQAQIT AEREKRARIA ESEGRKIEQI NLASGQREAE IQQSEGEAQA

 101   AVNASNAEKI ARINRAKGEA ESLRLVAEAN AEAIRQIAAA LQTQGGADAV

 151   NLKIAEQYVA AFNNLAKESN TLIMPANVAD IGSLISAGMK IIDSSKTAK*
```

Computer analysis of this amino acid sequence gave the following results:

Homology with a Predicted ORF from *N. gonorrhoeae*

ORF 519 shows 87.5% identity over a 200 aa overlap with a predicted ORF (ORF 519.ng) from *N. gonorrhoeae*:

```
m519/g519

                                                        10        20        30
m519.pep                                      SVIGRMELDKTFEERDEINSTVVAALDEAA
                                              ||||||||||||||||||||||||||||||
g519            YFQVTDPKLASYGSSNYIMAITQLAQTTLRSVIGRMELDKTFEERDEINSTVVSALDEAA
                  90       100       110       120       130       140
                        40        50        60        70        80        90
m519.pep        GAWGVKVLRYEIKDLVPPQEILRSMQAQITAEREKRARIAESEGRKIEQINLASGQREAE
                |||||||||||||||||||||||:||||||||||||||||||||||||||||||||||||
g519            GAWGVKVLRYEIKDLVPPQEILRAMQAQITAEREKRARIAESEGRKIEQINLASGQREAE
                 150       160       170       180       190       200
                       100       110       120       130       140       150
m519.pep        IQQSEGEAQAAVNASNAEKIARINRAKGEAESLRLVAEANAEAIRQIAAALQTQGGADAV
                ||||||||||||||||||||||||||||||||||||||||||| ||||||||||:|||||
g519            IQQSEGEAQAAVNASNAEKIARINRAKGEAESLRLVAEANAEANRQIAAALQTQSGADAV
                 210       220       230       240       250       260
                       160       170       180        190       200
m519.pep        NLKIAEQYVAAFNNLAKESNTLIMPANVADIGSL-ISAGMKIIDSSKTAK
                ||||| |||:||:|||||:|| | ||:||:||:  :    |:   :||||
g519            NLKIAGQYVTAFKNLAKEDNTRIKPAKVAEIGNPNFRRHEKFSPEAKTAK
                 270       280       290       300       310
```

The following partial DNA sequence was identified in *N. meningitidis* <SEQ ID 1451>:

```
a519.seq
   1 ATGGAATTTT TCATTATCTT GCTGGCAGCC GTCGTTGTTT TCGGCTTCAA

  51 ATCCTTTGTT GTCATCCCAC AGCAGGAAGT CCACGTTGTC GAAAGGCTCG

 101 GGCGTTTCCA TCGCGCCCTG ACGGCCGGTT TGAATATTTT GATTCCCTTT

 151 ATCGACCGCG TCGCCTACCG CCATTCGCTG AAAGAAATCC CTTTAGACGT

 201 ACCCAGCCAG GTCTGCATCA CGCGCGACAA TACGCAGCTG ACTGTTGACG
```

```
-continued
251 GTATCATCTA TTTCCAAGTA ACCGACCCCA AACTCGCCTC ATACGGTTCG

301 AGCAACTACA TTATGGCGAT TACCCAGCTT GCCCAAACGA CGCTGCGTTC

351 CGTTATCGGG CGTATGGAAT TGGACAAAAC GTTTGAAGAA CGCGACGAAA

401 TCAACAGCAC CGTCGTCTCC GCCCTCGATG AAGCCGCCGG AGCTTGGGGT

451 GTGAAGGTTT TGCGTTATGA GATTAAAGAC TTGGTTCCGC CGCAAGAAAT

501 CCTTCGCTCA ATGCAGGCGC AAATTACTGC TGAACGCGAA AAACGCGCCC

551 GTATCGCCGA ATCCGAAGGT CGTAAAATCG AACAAATCAA CCTTGCCAGT

601 GGTCAGCGCG AAGCCGAAAT CCAACAATCC GAAGGCGAGG CTCAGGCTGC

651 GGTCAATGCG TCAAATGCCG AGAAAATCGC CCGCATCAAC CGCGCCAAAG

701 GTGAAGCGGA ATCCTTGCGC CTTGTTGCCG AAGCCAATGC CGAAGCCATC

751 CGTCAAATTG CCGCCGCCCT TCAAACCCAA GGCGGTGCGG ATGCGGTCAA

801 TCTGAAGATT GCGGAACAAT ACGTCGCCGC GTTCAACAAT CTTGCCAAAG

851 AAAGCAATAC GCTGATTATG CCCGCCAATG TTGCCGACAT CGGCAGCCTG

901 ATTTCTGCCG GTATGAAAAT TATCGACAGC AGCAAAACCG CCAAATAA
```

This corresponds to the amino acid sequence <SEQ ID 1452; ORF 519.a>:

```
a519.pep

     1 MEFFIILLAA VVVFGFKSFV VIPQQEVHVV ERLGRFHRAL TAGLNILIPF

    51 IDRVAYRHSL KEIPLDVPSQ VCITRDNTQL TVDGIIYFQV TDPKLASYGS

   101 SNYIMAITQL AQYYLRSVIG RMELDKTFEE RDEINSTVVS ALDEAAGAWG

   151 VKVLRYEIKD LVPPQEILRS MQAQITAERE KRARIAESEG RKIEQINLAS

   201 GQREAEIQQS EGEAQAAVNA SNAEKIARIN RAKGEAESLR LVAEANAEAI

   251 RQIAAALQTQ GGADAVNLKI AEQYVAAFNN LAKESNTLIM PANVADIGSL

   301 ISAGMKIIDS SKTAK*

m519/a519    99.5% identity in 199 aa overlap
                                            10        20        30
m519.pep                            SVIGRMELDKTFEERDEINSTVVAALDEAA
                                    ||||||||||||||||||||||||:||||||
a519        YFQVTDPKLASYGSSNYIMAITQLAQTTLRSVIGRMELDKTFEERDEINSTVVSAALDEA
              90       100       110       120       130       140

                40        50        60        70        80        90
m519.pep    GAWGVKVLRYEIKDLVPPQEILRSMQAQITAEREKRARIAESEGRKIEQINLASGQREAE
            ||||||||||||||||||||||||||||||||||||||||||||||||||||||||||||
a519        GAWGVKVLRYEIKDLVPPQEILRSMQAQITAEREKRARIAESEGRKIEQINLASGQREAE
             150       160       170       180       190       200

               100       110       120       130       140       150
m519.pep    IQQSEGEAQAAVNASNAEKIARINRAKGEAESLRLVAEANAEAIRQIAAALQTQGGADAV
            ||||||||||||||||||||||||||||||||||||||||||||||||||||||||||||
a519        IQQSEGEAQAAVNASNAEKIARINRAKGEAESLRLVAEANAEAIRQIAAALQTQGGADAV
             210       220       230       240       250       260

               160       170       180       190       200
m519.pep    NLKIAEQYVAAFNNLAKESNTLIMPANVADIGSLISAGMKIIDSSKTAKX
            |||||||||||||||||||||||||||||||||||||||||||||||||
a519        NLKIAEQYVAAFNNLAKESNTLIMPANVADIGSLISAGMKIIDSSKTAKX
             270       280       290       300       310
```

The following partial DNA sequence was identified in *N. gonorrhoeae* <SEQ ID 1453>:

```
g519-1.seq
   1 ATGGAATTTT TCATTATCTT GTTGGCAGCC GTCGCCGTTT TCGGCTTCAA
```

-continued

```
 51 ATCCTTTGTC GTCATCCCCC AGCAGGAAGT CCACGTTGTC GAAAGGCTCG

101 GGCGTTTCCA TCGCGCCCTG ACGGCCGGTT TGAATATTTT GATTCCCTTT

151 ATCGACCGCG TCGCCTACCG CCATTCGCTG AAAGAAATCC CTTTAGACGT

201 ACCCAGCCAG GTCTGCATCA CGCGCGATAA TACGCAATTG ACTGTTGACG

251 GCATCATCTA TTTCCAAGTA ACCGATCCCA AACTCGCCTC ATACGGTTCG

301 AGCAACTACA TTATGGCAAT TACCCAGCTT GCCCAAACGA CGCTGCGTTC

351 CGTTATCGGG CGTATGGAGT TGGACAAAAC GTTTGAAGAA CGCGACGAAA

401 TCAACAGTAC CGTCGTCTCC GCCCTCGATG AAGCCGCCGG GGCTTGGGGT

451 GTGAAAGTCC TCCGTTACGA AATCAAGGAT TTGGTTCCGC CGCAAGAAAT

501 CCTTCGCGCA ATGCAGGCAC AAATTACCGC CGAACGCGAA AAACGCGCCC

551 GTATTGCCGA ATCCGAAGGC CGTAAAATCG AACAAATCAA CCTTGCCAGT

601 GGTCAGCGTG AAGCCGAAAT CCAACAATCC GAAGGCGAGG CTCAGGCTGC

651 GGTCAATGCG TCCAATGCCG AGAAAATCGC CCGCATCAAC CGCGCCAAAG

701 GCGAAGCGGA ATCCCTGCGC CTTGTTGCCG AAGCCAATGC CGAAGCCATC

751 CGTCAAATTG CCGCCGCCCT TCAAACCCAA GGCGGGGCGG ATGCGGTCAA

801 TCTGAAGATT GCGGAACAAT ACGTAGCCGC GTTCAACAAT CTTGCCAAAG

851 AAAGCAATAC GCTGATTATG CCCGCCAATG TTGCCGACAT CGGCAGCCTG

901 ATTTCTGCCG GCATGAAAAT TATCGACAGC AGCAAAACCG CCAAATAA
```

This corresponds to the amino acid sequence <SEQ ID 1454; ORF 519-1.ng>:

```
g519-1.pep
  1 MEFFIILLAA VAVFGFKSFV VIPQQEVHVV ERLGRFHRAL TAGLNILIPF

 51 IDRVAYRHSL KEIPLDVPSQ VCITRDNTQL TVDGIIYFQV TDPKLASYGS

101 SNYIMAITQL AQTTLRSVIG RMELDKTFEE RDEINSTVVS ALDEAAGAWG

151 VKVLRYEIKD LVPPQEILRA MQAQITAERE KRARIAESEG RKIEQINLAS

201 GQREAEIQQS EGEAQAAVNA SNAEKIARIN RAKGEAESLR LVAEANAEAI

251 RQIAAALQTQ GGADAVNLKI AEQYVAAFNN LAKESNTLIM PANVADIGSL

301 ISAGMKIIDS SKTAK*
```

The following partial DNA sequence was identified in *N. meningitidis* <SEQ ID 1455>:

```
m519-1.seq
  1 ATGGAATTTT TCATTATCTT GTTGGTAGCC GTCGCCGTTT TCGGTTTCAA

 51 ATCCTTTGTT GTCATCCCAC AACAGGAAGT CCACGTTGTC GAAAGGCTGG

101 GGCGTTTCCA TCGCGCCCTG ACGGcCGGTT TGAATATTTT GATTCCCTTT

151 ATCGACCGCG TCGCCTACCG CCATTCGCTG AAAGAAATCC CTTTAGACGT

201 ACCCAGCCAG GTCTGCATCA CGCGCGACAA TACGCAGCTG ACTGTTGACG

251 GCATCATCTA TTTCCAAGTA ACCGACCCCA AACTCGCCTC ATACGGTTCG

301 AGCAACTACA TTATGGCGAT TACCCAGCTT GCCCAAACGA CGCTGCGTTC

351 CGTTATCGGG CGTATGGAGT TGGACAAAAC GTTTGAAGAA CGCGACGAAA

401 TCAACAGTAC TGTTGTTGCG GCTTTGGACG AGGCGGCCGG GGCTTGGGGT
```

-continued

```
451 GTGAAGGTTT TGCGTTATGA GATTAAAGAC TTGGTTCCGC CGCAAGAAAT

501 CCTTCGCTCA ATGCAGGCGC AAATTACTGC CGAACGCGAA AAACGCGCCC

551 GTATCGCCGA ATCCGAAGGT CGTAAAATCG AACAAATCAA CCTTGCCAGT

601 GGTCAGCGCG AAGCCGAAAT CCAACAATCC GAAGGCGAGG CTCAGGCTGC

651 GGTCAATGCG TCAAATGCCG AGAAAATCGC CCGCATCAAC CGCGCCAAAG

701 GTGAAGCGGA ATCCTTGCGC CTTGTTGCCG AAGCCAATGC CGAAGCCATC

751 CGTCAAATTG CCGCCGCCCT TCAAACCCAA GGCGGTGCGG ATGCGGTCAA

801 TCTGAAGATT GCGGAACAAT ACGTCGCTGC GTTCAACAAT CTTGCCAAAG

851 AAAGCAATAC GCTGATTATG CCCGCCAATG TTGCCGACAT CGGCAGCCTG

901 ATTTCTGCCG GTATGAAAAT TATCGACAGC AGCAAAACCG CCAAATAA
```

This corresponds to the amino acid sequence <SEQ ID 1456; ORF 519-1>:

```
m519-1.

  1 MEFFIILLVA VAVFGFKSFV VIPQQEVHVV ERLGRFHRAL TAGLNILIPF

 51 IDRVAYRHSL KEIPLDVPSQ VCITRDNTQL TVDGIIYFQV TDPKLASYGS

101 SNYIMAITQL AQTTLRSVIG RMELDKTFEE RDEINETVVA ALDEAAGAWG

151 VKVLRYEIKD LVPPQEILRS MQAQITAERE KRARIAESEG RKIEQINLAS

201 GQREAEIQQS EGEAQAAVNA SNAEKIARIN RAKGEAESLR LVAEANAEAI

251 RQIAAALQTQ GGADAVNLKI AEQYVAAFNN LAKESNTLIM PANVADIGSL

301 ISAGMKIIDS SKTAK*
```

```
m519-1/g519-1 99.0% identity in 315 aa overlap

             10        20        30        40        50        60
g519-1.pep   MEFFIILLAAVAVFGFKSFVVIPQQEVHVVERLGRFHRALTAGLNILIPFIDRVAYRHSL
             ||||||||:|||||||||||||||||||||||||||||||||||||||||||||||||||
m519-1       MEFFIILLVAVAVFGFKSFVVIPQQEVHVVERLGRFHRALTAGLNILIPFIDRVAYRHSL
                     10        20        30        40        50        60

             70        80        90       100       110       120
g519-1.pep   KEIPLDVPSQVCITRDNTQLTVDGIIYFQVTDPKLASYGSSNYIMAITQLAQTTLRSVIG
             ||||||||||||||||||||||||||||||||||||||||||||||||||||||||||||
m519-1       KEIPLDVPSQVCITRDNTQLTVDGIIYFQVTDPKLASYGSSNYIMAITQLAQTTLRSVIG
                     70        80        90       100       110       120

            130       140       150       160       170       180
g519-1.pep   RMELDKTFEERDEINSTVVSALDEAAGAWGVKVLRYEIKDLVPPQEILRAMQAQITAERE
             ||||||||||||||||||:||||||||||||||||||||||||||||||:||||||||||
m519-1       RMELDKTFEERDEINSTVVAALDEAAGAWGVKVLRYEIKDLVPPQEILRSMQAQITAERE
                    130       140       150       160       170       180

            190       200       210       220       230       240
g519-1.pep   KRARIAESEGRKIEQINLASGQREAEIQQSEGEAQAAVNASNAEKIARINRAKGEAESLR
             ||||||||||||||||||||||||||||||||||||||||||||||||||||||||||||
m519-1       KRARIAESEGRKIEQINLASGQREAEIQQSEGEAQAAVNASNAEKIARINRAKGEAESLR
                    190       200       210       220       230       240

            250       260       270       280       290       300
g519-1.pep   LVAEANAEAIRQIAAALQTQGGADAVNLKIAEQYVAAFNNLAKESNTLIMPANVADIGSL
             ||||||||||||||||||||||||||||||||||||||||||||||||||||||||||||
m519-1       LVAEANAEAIRQIAAALQTQGGADAVNLKIAEQYVAAFNNLAKESNTLIMPANVADIGSL
                    250       260       270       280       290       300

            310
g519-1.pep   ISAGMKIIDSSKTAKX
             ||||||||||||||||
m519-1       ISAGMKIIDSSKTAKX
                    310
```

The following partial DNA sequence was identified in *N. meningitidis* <SEQ ID 1457>:

```
a519-1.seq
   1 ATGGAATTTT TCATTATCTT GCTGGCAGCC GTCGTTGTTT TCGGCTTCAA

  51 ATCCTTTGTT GTCATCCCAC AGCAGGAAGT CCACGTTGTC GAAAGGCTCG

 101 GGCGTTTCCA TCGCGCCCTG ACGGCCGGTT TGAATATTTT GATTCCCTTT

 151 ATCGACCGCG TCGCCTACCG CCATTCGCTG AAAGAAATCC CTTTAGACGT

 201 ACCCAGCCAG GTCTGCATCA CGCGCGACAA TACGCAGCTG ACTGTTGACG

 251 GTATCATCTA TTTCCAAGTA ACCGACCCCA AACTCGCCTC ATACGGTTCG

 301 AGCAACTACA TTATGGCGAT TACCCAGCTT GCCCAAACGA CGCTGCGTTC

 351 CGTTATCGGG CGTATGGAAT TGGACAAAAC GTTTGAAGAA CGCGACGAAA

 401 TCAACAGCAC CGTCGTCTCC GCCCTCGATG AAGCCGCCGG AGCTTGGGGT

 451 GTGAAGGTTT TGCGTTATGA GATTAAAGAC TTGGTTCCGC CGCAAGAAAT

 501 CCTTCGCTCA ATGCAGGCGC AAATTACTGC TGAACGCGAA AAACGCGCCC

 551 GTATCGCCGA ATCCGAAGGT CGTAAAATCG AACAAATCAA CCTTGCCAGT

 601 GGTCAGCGCG AAGCCGAAAT CCAACAATCC GAAGGCGAGG CTCAGGCTGC

 651 GGTCAATGCG TCAAATGCCG AGAAAATCGC CCGCATCAAC CGCGCCAAAG

 701 GTGAAGCGGA ATCCTTGCGC CTTGTTGCCG AAGCCAATGC CGAAGCCATC

 751 CGTCAAATTG CCGCCGCCCT TCAAACCCAA GGCGGTGCGG ATGCGGTCAA

 801 TCTGAAGATT GCGGAACAAT ACGTCGCCGC GTTCAACAAT CTTGCCAAAG

 851 AAAGCAATAC GCTGATTATG CCCGCCAATG TTGCCGACAT CGGCAGCCTG

 901 ATTTCTGCCG GTATGAAAAT TATCGACAGC AGCAAAACCG CCAAATAA
```

This corresponds to the amino acid sequence <SEQ ID 1458; ORF 519-1.a>:

```
m519-1.pep.

       1 MEFFIILLVA VVVFGFKSFV VIPQQEVHVV ERLGRFHRAL TAGLNILIPF

      51 IDRVAYRHSL KEIPLDVPSQ VCITRDNTQL TVDGIIYFQV TDPKLASYGS

     101 SNYIMAITQL AQTTLRSVIG RMELDKTFEE RDEINETVVS ALDEAAGAWG

     151 VKVLRYEIKD LVPPQEILRS MQAQITAERE KRARIAESEG RKIEQINLAS

     201 GQREAEIQQS EGEAQAAVNA SNAEKIARIN RAKGEAESLR LVAEANAEAI

     251 RQIAAALQTQ GGADAVNLKI AEQTVAAFNN LAKESNTLIM PANVADIGSL

     301 ISAGMKIIDS SKTAK*

m519-1/a519-1 99.0% identity in 315 aa overlap

10        20        30        40        50        60
a519-1.pep  MEFFIILLAAVVVFGFKSFVVIPQQEVHVVERLGRFHRALTAGLNILIPFIDRVAYRHSL
            ||||||||:||:||||||||||||||||||||||||||||||||||||||||||||||||
m519-1      MEFFIILLVAVAVFGFKSFVVIPQQEVHVVERLGRFHRALTAGLNILIPFIDRVAYRHSL
                    10        20        30        40        50        60

70        80        90        100       110       120
a519-1.pep  KEIPLDVPSQVCITRDNTQLTVDGIIYFQVTDPKLASYGSSNYIMAITQLAQTTLRSVIG
            ||||||||||||||||||||||||||||||||||||||||||||||||||||||||||||
m519-1      KEIPLDVPSQVCITRDNTQLTVDGIIYFQVTDPKLASYGSSNYIMAITQLAQTTLRSVIG
                    70        80        90        100       110       120

130       140       150       160       170       180
a519-1.pep  RMELDKTFEERDEINSTVVSALDEAAGAWGVKVLRYEIKDLVPPQEILRSMQAQITAERE
            |||||||||||||||||||:||||||||||||||||||||||||||||||||||||||||
m519-1      RMELDKTFEERDEINSTVVAALDEAAGAWGVKVLRYEIKDLVPPQEILRSMQAQITAERE
                   130       140       150       160       170       180
```

-continued

```
190       200       210       220       230       240
a519-1.pep  KRARIAESEGRKIEQINLASGQREAEIQQSEGEAQAAVNASNAEKIARINRAKGEAESLR
            ||||||||||||||||||||||||||||||||||||||||||||||||||||||||||||
m519-1      KRARIAESEGRKIEQINLASGQREAEIQQSEGEAQAAVNASNAEKIARINRAKGEAESLR
                    190       200       210       220       230       240

250       260       270       280       290       300
a519-1.pep  LVAEANAEAIRQIAAALQTQGGADAVNLKIAEQYVAAFNNLAKESNTLIMPANVADIGSL
            ||||||||||||||||||||||||||||||||||||||||||||||||||||||||||||
m519-1      LVAEANAEAIRQIAAALQTQGGADAVNLKIAEQYVAAFNNLAKESNTLIMPANVADIGSL
                    250       260       270       280       290       300

310
a519-1.pep  ISAGMKIIDSSKTAKX
            ||||||||||||||||
m519-1      ISAGMKIIDSSKTAKX
                    310
```

Expression of ORF 519

The primer described in Table 1 for ORF 519 was used to locate and clone ORF 519. ORF 519 was cloned in pET and pGex vectors and expressed in *E. coli* as above described. The products of protein expression and purification were analyzed by SDS-PAGE. FIG. 4A shows the results of affinity purification, and FIG. 4B shows the expression in *E. coli*. Purified Nis-fusion protein was used to immunize mice whose sera were used for ELISA (positive result), FACS analysis (FIG. 4C), western blot (FIG. 1E), and a bactericidal assay (FIG. 4D). These experiments confirm that 519 is a surface-exposed protein and that it is a useful immunogen. The hydrophilicity plots, antigenic index, and amphipatic regions of ORF 519 are provided in FIG. 8. The AMPHI program is used to predict putative T-cell epitopes (Gao et al 1989, *J. Immunol* 143: 3007; Roberts et al. 1996, *AIDS Res Human Retroviruses* 12:593; Quakyi et al. 1992, *Scand J Immunol Suppl* 11:9). The nucleic acid sequence of ORF 519 and the amino acid sequence encoded thereby as provided herein.

The following partial DNA sequence was identified in *N. gonorrhoeae* <SEQ ID 1459>:

```
g520.seq
  1 atgcctgcgc ttctttcaat acgtcgggca aacgcgctgc ctttttcgcg

 51 catttcggaa aggatgaagt tgctggtgcc gttaataatg ccggcgatgg

101 atttaatcct gtttgccgcc aaaccttcgc gcacggcttt gatgattggg

151 ataccgcccg ctactgccgc ttcaaattgg acgatgacgt tttgtttttc

201 cgccagcggg aagatttcgt tgccgtattc ggcgagcagt tttttgttgg

251 cggtaacgat gtgtttgccg ttttcaatgg ctttcaacac cgcttctttg

301 gcaatgcccg tgccgccgaa caattcgacc aagacatcga cgtctttacg

351 cgcgaacagt tcgaacggat cttttgacaa gggcgggcga cgggccgatt

401 ttggcgggct ttttcttcgc ttaagtcgca catggcagaa atacggattt

451 cgcgccccaa gcggcgggaa atttcctctg cgttgtcccg caacacggca

501 gccgcaccgc cgccgaccgt acctaagcct aaaagaccga tgtttactgg

551 cttcattgtg tctccttgta agccgactga aatgtaaata ttga
```

This corresponds to the amino acid sequence <SEQ ID 1460; ORF 520.ng>:

```
g520.pep
  1 MPALLSIRRA NALPFSRISE RMKLLVPLIM PAMDLILFAA KPSRTALMIG

 51 IPPATAASNW TMTFCFSASG KISLPYSASS FLLAVTMCLP FSMAFNTASL

101 AMPVPPNNST KTSTSLRANS SNGSFDKGGR RADFGGLFLR LSRTWQKYGF

151 RAPSGGKFPL RCPATRQPHR RRPYLSLKDR CLLASLCLLV SRLKCKY*
```

The following partial DNA sequence was identified in *N. meningitidis* <SEQ ID 1461>:

```
m520.seq
  1  ATGCCTGCGC TTCTTTCAGT ACATCG.GCA AACGCGCTGC CTTTTTCGCG
```

-continued

```
 51 CATTTCGGrk AGGATGAAGT TGCTGGTGCC GTTAATAATG CCGGCGATGG

101 ATTTAATCCT GTTTGCCGCC AAACCTTCGC GCAGGGCTTT GATGATTGGG

151 ATACCGCCCG CTACTGCCGC TTCAAATTGG ACGATGACGT TTTGTTTTTC

201 CGCCAGCGGG AAGATTTCGT TGCCGTATTC GGCGAGCAGT TTTTTGTTGG

251 CGGTAACGAT GTGTTTGCCG TTTTCAATGG CTTTCAACAC CGCATCTTTG

301 GCAATGCCGG TACCGCCGaA CAATTCGACG ACGACATCGA CGTCTTCACG

351 TGCGACCAGT TCGAACGGAT CTTTGACAAA GGCTGc.CGG ACGGGCAGGT

401 TTGTCGGGCT TTTTCTTCAC TCAAATCGCA CACGGCAGAA ATACGGATTT

451 CGCGCCCCAA GCGACGGGAA ATTTCCTCCG CGTTGTCsCG CAACACGGCA

501 GCCGTACCGC CGCCGACCGT ACCCAAACCT AAAAGACCGA TGTTTACTGG

551 CTTCATTGTG TCTCCTTGTA AGCCGACTGA AATGTAAATA TTGA
```

This corresponds to the amino acid sequence <SEQ ID 1462; ORF 520>:

```
m520.pep
  1 MPALLSVHXA NALPFSRISX RMKLLVPLIM PAMDLILFAA KPSRRALMIG

 51 IPPATAASNW TMTFCFSASG KISLPYSASS FLLAVTMCLP FSMAFNTASL

101 AMPVPPNNST TTSTSSRATS SNGSLTKAXR TGRFVGLFLH SNRTRQKYGF

151 RAPSDGKFPP RCXATRQPYR RRPYPNLKDR CLLASLCLLV SRLKCKY*
```

Computer analysis of this amino acid sequence gave the following results:

Homology with a Predicted ORF from *N. gonorrhoeae*

ORF 520 shows 87.3% identity over a 197 aa overlap with a predicted ORF (ORF 520.ng) from *N. gonorrhoeae*:

```
m520/g520
                    10        20        30        40        50        60
m520.pep    MPALLSVHRANALPFSRISXRMKLLVPLIMPAMDLILFAAKPSRRALMIGIPPATAASNW
            ||||||::||||||||||| |||||||||||||||||||||||| |||||||||||||||
g520        MPALLSIRRANALPFSRISERMKLLVPLIMPAMDLILFAAKPSRTALMIGIPPATAASNW
                    10        20        30        40        50        60

                    70        80        90       100       110       120
m520.pep    TMTFCFSASGKISLPYSASSFLLAVTMCLPFSMAFNTASLAMPVPPNNSTTTSTSSRATS
            |||||||||||||||||||||||||||||||||||||||||||||||||| |||| ||:|
g520        TMTFCFSASGKISLPYSASSFLLAVTMCLPFSMAFNTASLAMPVPPNNSTKTSTSLRANS
                    70        80        90       100       110       120

                   130       140       150       160       170       180
m520.pep    SNGSLTKAARTGRFVGLFLHSNRTRQKYGFRAPSDGKFPPRCXATRQPYRRRPYPNLKDR
            ||||: |::| : | ||||: :|| ||||||||| |||| || |||||:||||| :||||
g520        SNGSFDKGGRRADFGGLFLRLSRTWQKYGFRAPSGGKFPLRCPATRQPHRRRPYLSLKDR
                   130       140       150       160       170       180

                   190
m520.pep    CLLASLCLLVSRLKCKY
            ||||||||||||||||
g520        CLLASLCLLVSRLKCKY
                   190
```

The following partial DNA sequence was identified in *N. meningitidis* <SEQ ID 1463>:

```
a520.seq
  1 ATGCCTGCGC TTCTTTCAGT ACATCGG.CA AACGCGCTGC CTTTTTCGCG

 51 CATTTCGGAG AGGATGAAGT TGCTGGTGCC GTTAATAATG CCGGCGATGG
```

-continued

```
101 ATTTAATCCT GTTTGCCGCC AAACCTTCGC GCAGGGCTTT GATGATTGGG

151 ATACCGCCCG CTACTGCCGC TTCAAATTGG ACGATGACGT TTTGTTTTTC

201 CGCCAGCGGG AAGATTTCGT TGCCGTATTC GGCGAGCAGT TTTTTGTTGG

251 CGGTAACGAT GTGTTTGCCG TTTTCAATGG CTTTCAACAC CGCATCTTTG

301 GCAATGCCGG TACCGCCGAA CAATTCGACG ACGACATCGA CGTCTTCACG

351 TGCGACCAGT TCGAACGGAT CTTTGACAAA GGCTG..CGG ACGGGCAGGT

401 TTGTCGGGCT TTTTCTTCAC TCAAATCGCA CACGGCAGAA ATACGGATTT

451 CGCGCCCCAA GCGACGGGAA ATTTCCTCCG CGTTGTCCCG CAACACGGCA

501 GCCGTACCGC CGCCGACCGT ACCCAAACCT AAAAGACCGA TGTTTACTGG

551 CTTCATTGTG TCTCCTTGTA AGCCGACTGA AATGTAAATA TTGA
```

This corresponds to the amino acid sequence <SEQ ID 1464; ORF 520.a>:

```
a520.pep
  1 MPALLSVHRX NALPFSRISE RMKLLVPLIM PAMDLILFAA KPSRRALMIG

 51 IPPATAASNW TMTFCFSASG KISLPYSASS FLLAVTMCLP FSMAFNTASL

101 AMPVPPNNST TTSTSSRATS SNGSLTKAXR TGRFVGLFLH SNRTRQKYGF

151 RAPSDGKFPP RCPATRQPYR RRPYPNLKDR CLLASLCLLV SRLKCKY*
```

m520/a520 98.0% identity in 197 aa overlap

```
             10        20        30        40        50        60
m520.pep     MPALLSVHXANALPFSRISXRMKLLVPLIMPAMDLILFAAKPSRRALMIGIPPATAASNW
             |||||||| ||||||||| ||||||||||||||||||||||||||||||||||||||||
a520         MPALLSVHRXNALPFSRISERMKLLVPLIMPAMDLILFAAKPSRRALMIGIPPATAASNW
                     10        20        30        40        50        60

             70        80        90        100       110       120
m520.pep     TMTFCFSASGKISLPYSASSFLLAVTMCLPFSMAFNTASLAMPVPPNNSTTTSTSSRATS
             ||||||||||||||||||||||||||||||||||||||||||||||||||||||||||||
a520         TMTFCFSASGKISLPYSASSFLLAVTMCLPFSMAFNTASLAMPVPPNNSTTTSTSSRATS
                     70        80        90        100       110       120

             130       140       150       160       170       180
m520.pep     SNGSLTKAXRTGRFVGLFLHSNRTRQKYGFRAPSDGKFPPRCXATRQPYRRRPYPNLKDR
             |||||||||||||||||||||||||||||||||||||||||| |||||||||||||||||
a520         SNGSLTKAXRTGRFVGLFLHSNRTRQKYGFRAPSDGKFPPRCPATRQPYRRRPYPNLKDR
                     130       140       150       160       170       180

             190
m520.pep     CLLASLCLLVSRLKCKYX
             ||||||||||||||||||
a520         CLLASLCLLVSRLKCKYX
                     190
```

The following partial DNA sequence was identified in *N. gonorrhoeae* <SEQ ID 1465>:

```
g520-1.seq
  1 ATGAAGTTGC TGGTGCCGTT AATAATGCCG GCGATGGATT TAATCCTGTT

 51 TGCCGCCAAA CCTTCGCGCA GGGCTTTGAT GATTGGGATA CCGCCCGCTA

101 CTGCCGCTTC AAATTGGACG ATGACGTTTT GTTTTTCCGC CAGCGGGAAG

151 ATTTCGTTGC CGTATTCGGC GAGCAGTTTT TTGTTGGCGG TAACGATGTG

201 TTTGCCGTTT TCAATGGCTT TCAACACCGC TTCTTTGGCA ATGCCCGTGC

251 CGccgAACAA TTCGACGACG ACATCGACGT CTTTACGCGC GACCAGTtCG

301 AACGGATCTT TGACAAAGGC GGCGGACGGG CAGATTTGGC GGGCTTTTTC
```

-continued

```
351 TTCGCTTAAG TCGCACATGG CAGAAATACG GATTTCGCGC CCCAAGCGGC

401 GGGAAATTTC CTCTGCGTTG TCCCGCAACA CGGCAGCCGC ACCGCCGCCG

451 ACCgTACCTA AGCCTAAAAG ACCGATGTTT ACTGGCTTCA TTGTGTCTCC

501 TTGTAAGCCG ACTGAAATGT AA
```

This corresponds to the amino acid sequence <SEQ ID 1466; ORF 520-1.ng>:

```
g520-1.pep
  1 MKLLVPLIMP AMDLILFAAK PSRRALMIGI PPATAASNWT MTFCFSASGK

 51 ISLPYSASSF LLAVTMCLPF SMAFNTASLA MPVPPNNSTT TSTSLRATSS

101 NGSLTKAADG QIWRAFSSLK SHMAEIRISR PKRREISSAL SRNTAAAPPP

151 TVPKPKRPMF TGFIVSPCKP TEM*
```

The following partial DNA sequence was identified in *N. meningitidis* <SEQ ID 1467>:

```
m520-1.seq
  1 ATGAAGTTGC TGGTGCCGTT AATAATGCCG GCGATGGATT TAATCCTGTT

 51 TGCCGCCAAA CCTTCGCGCA GGGCTTTGAT GATTGGGATA CCGCCCGCTA

101 CTGCCGCTTC AAATTGGACG ATGACGTTTT GTTTTTCCGC CAGCGGGAAG

151 ATTTCGTTGC CGTATTCGGC GAGCAGTTTT TTGTTGGCGG TAACGATGTG

201 TTTGCCGTTT TCAATGGCTT TCAACACCGC ATCTTTGGCA ATGCCGGTAC

251 CGCCGAACAA TTCGACGACG ACATCGACGT CTTCACGTGC GACCAGTTCG

301 AACGGATCTT TGACAAAGGC TGCGGACGGG CAGGTTTGTC GGGCTTTTTC

351 TTCACTCAAA TCGCACACGG CAGAAATACG GATTTCGCGC CCCAAGCGAC

401 GGGAAATTTC CTCCGCGTTG TCCCGCAACA CGGCAGCCGT ACCGCCGCCG

451 ACCGTACCCA AACCTAAAAG ACCGATGTTT ACTGGCTTCA TTGTGTCTCC

501 TTGTAAGCCG ACTGAAATGT AA
```

This corresponds to the amino acid sequence <SEQ ID 1468; ORF 520-1>:

```
m520-1.pep

  1 MKLLVPLIMP AMDLILFAAK PSRRALMIGI PPATAASNWT MTFCFSASGK

 51 ISLPYSASSF LLAVTMCLPF SMAFNTASLA MPVPPNNSTT TSTSSRATSS

101 NGSLTKAADG QVCRAFSSLK SHTAEIRISR PKRREISSAL SRNTAAVPPP

151 TVPKPKRPMF TGFIVSPCKP TEM*
```

g520-1/m520-1 97.1% identity in 173 aa overlap

```
            10        20        30        40        50        60
g520-1.pep  MKLLVPLIMPAMDLILFAAKPSRRALMIGIPPATAASNWTMTFCFSASGKISLPYSASSF
            ||||||||||||||||||||||||||||||||||||||||||||||||||||||||||||
m520-1      MKLLVPLIMPAMDLILFAAKPSRRALMIGIPPATAASNWTMTFCFSASGKISLPYSASSF
                    10        20        30        40        50        60

            70        80        90       100       110       120
g520-1.pep  LLAVTMCLPFSMAFNTASLAMPVPPNNSTTTSTSLRATSSNGSLTKAADGQIWRAFSSLK
            |||||||||||||||||||||||||||||||||| ||||||||||||||||: |||||||
m520-1      LLAVTMCLPFSMAFNTASLAMPVPPNNSTTTSTSSRATSSNGSLTKAADGQVCRAFSSLK
                    70        80        90       100       110       120
```

-continued

```
130        140        150        160        170
g520-1.pep  SHMAEIRISRPKRREISSALSRNTAAAPPPTVPKPKRPMFTGFIVSPCKPTEMX
            || |||||||||||||||||||||||:||||||||||||||||||||||||||
m520-1      SHTAEIRISRPKRREISSALSRNTAAVPPPTVPKPKRPMFTGFIVSPCKPTEMX
                   130        140        150        160        170
```

The following partial DNA sequence was identified in *N. meningitidis* <SEQ ID 1469>:

```
a520-1.seq
   1 ATGAAGTTGC TGGTGCCGTT AATAATGCCG GCGATGGATT TAATCCTGTT

  51 TGCCGCCAAA CCTTCGCGCA GGGCTTTGAT GATTGGGATA CCGCCCGCTA

 101 CTGCCGCTTC AAATTGGACG ATGACGTTTT GTTTTTCCGC CAGCGGGAAG

 151 ATTTCGTTGC CGTATTCGGC GAGCAGTTTT TTGTTGGCGG TAACGATGTG

 201 TTTGCCGTTT TCAATGGCTT TCAACACCGC ATCTTTGGCA ATGCCGGTAC

 251 CGCCGAACAA TTCGACGACG ACATCGACGT CTTCACGTGC GACCAGTTCG

 301 AACGGATCTT TGACAAAGGC TGCGGACGGG CAGGTTTGTC GGGCTTTTTC

 351 TTCACTCAAA TCGCACACGG CAGAAATACG GATTTCGCGC CCCAAGCGAC

 401 GGGAAATTTC CTCCGCGTTG TCCCGCAACA CGGCAGCCGT ACCGCCGCCG

 451 ACCGTACCCA AACCTAAAAG ACCGATGTTT ACTGGCTTCA TTGTGTCTCC

 501 TTGTAAGCCG ACTGAAATGT AA
```

This corresponds to the amino acid sequence <SEQ ID 1470; ORF 520-1.a>:

```
a520-1.pep

      1 MKLLVPLIMP AMDLILFAAK PSRRALMIGI PPATAASNWT MTFCFSASGK

     51 ISLPYSASSF LLAVTMCLPF SMAFNTASLA MPVPPNNSTT TSTSSRATSS

    101 NGSLTKAADG QVCRAFSSLK SHTAEIRISR PKRREISSAL SRNTAAVPPP

    151 TVPKPKRPMF TGFIVSPCKP TEM*
```

```
m520-1/a520-1 100.0% identity in 173 aa overlap

                    10         20         30         40         50         60
a520-1.pep    MKLLVPLIMPAMDLILFAAKPSRRALMIGIPPATAASNWTMTFCFSASGKISLPYSASSF
              ||||||||||||||||||||||||||||||||||||||||||||||||||||||||||||
m520-1        MKLLVPLIMPAMDLILFAAKPSRRALMIGIPPATAASNWTMTFCFSASGKISLPYSASSF
                    10         20         30         40         50         60

                    70         80         90        100        110        120
a520-1.pep    LLAVTMCLPFSMAFNTASLAMPVPPNNSTTTSTSSRATSSNGSLTKAADGQVCRAFSSLK
              ||||||||||||||||||||||||||||||||||||||||||||||||||||||||||||
m520-1        LLAVTMCLPFSMAFNTASLAMPVPPNNSTTTSTSSRATSSNGSLTKAADGQVCRAFSSLK
                    70         80         90        100        110        120

                   130        140        150        160        170
a520-1.pep    SHTAEIRISRPKRREISSALSRNTAAVPPPTVPKPKRPMFTGFIVSPCKPTEMX
              ||||||||||||||||||||||||||||||||||||||||||||||||||||||
m520-1        SHTAEIRISRPKRREISSALSRNTAAVPPPTVPKPKRPMFTGFIVSPCKPTEMX
                   130        140        150        160        170
```

The following partial DNA sequence was identified in *N. gonorrhoeae* <SEQ ID 1471>:

```
g521.seq
   1 ATGAAATCAA AACTCCCCTT AATCCTAATC AACCTTTCCC TGATTTCAAG

  51 CCCATTGGGT GCGAATGCGG CCAAAATCTA TACCTGCACA ATCAACGGAG

 101 AAACCGTTTA CACCACCAAG CCGTCTAAAA GCTGCCACTC AACCGATTTG
```

-continued

```
151 CCCCCAATCG GCAACTACAG CAGCGAACGC TATATCCTGC CCCAAACTCC

201 CGAACCGGCA CCATCACCGT CAAACGGCGG ACAGGCTGTC AAATATAAAG

251 CCCCGGTCAA AACAGTATCC AAGCCGGCAA AATCCAATAC GCCGCCTCAA

301 CAAGCACCTG TAAATAACAG CAGACGCTCC ATTCTcgaag caGaattaag

351 cAatgaacgc aaagccctGa ctGaAGCCCA AAAAATGTTA TCACAagcac

401 gtCtGGCAAA AGGCGgcaAC AtcaaCCatc aaaAaatcaa cgcattgtaa

451 AGCAATGTTt tggacAGACA GCAAAATaTC Caagcactgc aaaGAgAATt

501 GGGACGTATG TAA
```

This corresponds to the amino acid sequence <SEQ ID 1472; ORF 521.ng>:

```
g521n.pep
  1 MKSKLPLILI NLSLISSPLG ANAAKIYTCT INGETVYTTK PSKSCHSTDL

 51 PPIGNYSSER YILPQTPEPA PSPSNGGQAV KYKAPVKTVS KPAKSNTPPQ

101 QAPVNNSRRS ILEAELSNER KALTEAQKML SQARLAKGGN INHQKINAL*

151 SNVLDRQQNI QALQRELGRM *
```

The following partial DNA sequence was identified in *N. meningitidis* <SEQ ID 1473>:

```
m521.seq
  1 ATGAAATCAA AACTCCTCTT AATCCTAATC AACTTTTCCC TGATTTCAAG

 51 CCCATTGGGT GCGAATGCGG CCAAAATCTA sACCTGCACA ATCAACGGAG

101 AAACCGTTTA CACCAsCAAG CCGTCCAAAA GCTGCCACTC AACCGATTTG

151 CCCCCAATCG GCAACTACAG CAGCGAACGC TATATCCCGC CCCAAACGCC

201 CGAACCGGTA TCATCACCGT CAAACGGCGG ACwGGTTGTC AAATATAAAG

251 CCCCGGTCAA AACAGTATCC AAGCCGGCAA AATCCArTAC GCCGCCGCCG

301 CAACAAGCAC CCTCAAACAA CAGCAGACGC TCCATTCTCG AAACAGAATT

351 GAGCAACGAA CGCAAAGCAT TGGTTGAAGC CCAAAAAATG TTATCACAAG

401 CACGTCTGGC AAAGGGCGGC AACATCAACC ATCAAGAAAT AAATGCATTA

451 CAAAGCAATG TATTGGACAG GCAGCAAAAT ATTCAAGCCC TGCAAAGGGA

501 ACTGGGGCGT ATGTAA
```

This corresponds to the amino acid sequence <SEQ ID 1474; ORF 521>:

```
m521.pep
  1 MKSKLLLILI NFSLISSPLG ANAAKIXTCT INGETVYTXK PSKSCHSTDL

 51 PPIGNYSSER YIPPQTPEPV SSPSNGGXVV KYKAPVKTVS KPAKSXTPPP

101 QQAPSNNSRR SILETELSNE RKALVEAQKM LSQARLAKGG NINHQEINAL

151 QSNVLDRQQN IQALQRELGR M*
```

Computer analysis of this amino acid sequence gave the following results:

Homology with a Predicted ORF from *N. gonorrhoeae*

ORF 521 shows 90.6% identity over a 171 aa overlap with a predicted ORF (ORF 521.ng) from *N. gonorrhoeae*:

```
m521/g521
                    10        20        30        40        50        60
m521.pep    MKSKLLLILINFSLISSPLGANAAKIXTCTINGETVYTXKPSKSCHSTDLPPIGNYSSER
            ||||| |||||:|||||||||||||| |||||||||||:|||||||||||||||||||||
g521        MKSKLPLILINLSLISSPLGANAAKIYTCTINGETVYTTKPSKSCHSTDLPPIGNYSSER
                    10        20        30        40        50        60

                    70        80        90       100       110       120
m521.pep    YIPPQTPEPVSSPSNGGXVVKYKAPVKTVSKPAKSXTPPPQQAPSNNSRRSILETELSNE
            || ||||||: |||||| :|||||||||||||||| ||| |||| |||||||||:|||||
g521        YILPQTPEPAPSPSNGGQAVKYKAPVKTVSKPAKSNTPP-QQAPVNNSRRSILEAELSNE
                    70        80        90       100       110       120

                   130       140       150       160       170
m521.pep    RKALVEAQKMLSQARLAKGGNINHQEINALQSNVLDRQQNIQALQRELGRMX
            ||||:||||||||||||||||||||:|||| ||||||||||||||||||||
g521        RKALTEAQKMLSQARLAKGGNINHQKINALXSNVLDRQQNIQALQRELGRMX
         120       130       140       150       160       170
```

The following partial DNA sequence was identified in *N. meningitidis* <SEQ ID 1475>:

```
a521.seq
   1 ATGAAATCAA AACTCCCCTT AATCCTAATC AACTTTTCCC TGATTTCAAG

  51 CCCATTGGGT GCGAATGCGG CCAAAATCTA CACCTGCACA ATCAACGGAG

 101 AAACCGTTTA CACCACCAAG CCGTCCAAAA GCTGCCTCTC AACCGATTTG

 151 CCCCCAATCG GCAACTACAG CAGCGAACGC TATATCCCGC CCCAAACATC

 201 CGAACCGACA CCATCACCGT CAAACGGCGG ACAGGCTGTC AAATATAAAG

 251 CCCCGGTCAA AACAGTATCC AAGCCGGCAA AATCCAATAC GCCGCCGCCG

 301 CAACAAGCAC CCTCAAACAA CAGCAGACGC TCCATTCTCG AAACAGAATT

 351 GAGCAACGAA CGCAAAGCAT TGGTTGAAGC CCAAAAAATG TTATCACAAG

 401 CACGTCTGGC AAAAGGCGGC AACATCAACC ATCAAGAAAT CAACGCATTG

 451 CAAAGCAATG TATTGGACAG GCAGCAAAAT ATCCAAGCAC TGCAAAGAGA

 501 ATTGGGACGT ATGTAA
```

This corresponds to the amino acid sequence <SEQ ID 1476; ORF 521.a>:

```
a521.pep
   1 MKSKLPLILI NFSLISSPLG ANAAKIYTCT INGETVYTTK PSKSCLSTDL

  51 PPIGNYSSER YIPPQTSEPT PSPSNGGQAV KYKAPVKTVS KPAKSNTPPP

 101 QQAPSNNSRR SILETELSNE RKALVEAQKM LSQARLAKGG NINHQEINAL

 151 QSVLDRQQN IQALQRELGR M*
```

m521/a521 94.2% identity in 171 aa overlap

```
                    10        20        30        40        50        60
m521.pep    MKSKLLLILINFSLISSPLGANAAKIXTCTINGETVYTXKPSKSCHSTDLPPIGNYSSER
            ||||| |||||||||||||||||||| |||||||||||:|||||| ||||||||||||||
a521        MKSKLPLILINFSLISSPLGANAAKIYTCTINGETVYTTKPSKSCLSTDLPPIGNYSSER
                    10        20        30        40        50        60
```

-continued

```
                    70        80        90        100       110       120
m521.pep   YIPPQTPEPVSSPSNGGXVVKYKAPVKTVSKPAKSXTPPPQQAPSNNSRRSILETELSNE
           |||||| ||: ||||||  :|||||||||||||||| ||||||||||||||||||||||||
a521       YIPPQTSEPTPSPSNGGQAVKYKAPVKTVSKPAKSNTPP-QQAPVNNSRRSILEAELSNE
                    70        80        90        100       110       120

                   130       140       150       160       170
m521.pep   RKALVEAQKMLSQARLAKGGNINHQEINALQSNVLDRQQNIQALQRELGRMX
           ||||||||||||||||||||||||||||||||||||||||||||||||||||
a521       RKALVEAQKMLSQARLAKGGNINHQEINALQSNVLDRQQNIQALQRELGRMX
                   130       140       150       160       170
```

The following partial DNA sequence was identified in *N. gonorrhoeae* <SEQ ID 1477>:

```
g522.seq
   1 atgactgagc cgaaacacga aacgccgacg gaagagcagg ttgccgcgcg

  51 caaaaaagca aaagccaaaa tccgcaccat ccgcatttgg gcgtgggtca

 101 ttttggcgtt gctcgcttca accgccctgc tctcccaatg cgcgatgtcc

 151 aaaccgcagg caaaacagaa aattgtcgag tcttgcatga aaaatattcc

 201 gtttgctgaa aaatggcaga acgatttgaa agcgcgcggc ttggatgcgg

 251 acaatacccg tctcgccgtc gactactgca aatgtatgtg ggagcagcct

 301 ttggacggat tgagcgagaa acagatcagc tccttcggca aactcggtgc

 351 acaagaacag cttgacctgc tcggcggcgc aaacgcgttt gaaactcgag

 401 acaaacaatg tgtcgcggat ttgaaagccg attga
```

This corresponds to the amino acid sequence <SEQ ID 1478; ORF 522.ng>:

```
g522.pep
   1 MTEPKHETPT EEQVAARKKA KAKIRTIRIW AWVILALLAS TALLSQCAMS

  51 KPQAKQKIVE SCMKNIPFAE KWQNDLKARG LDADNTRLAV DYCKCMWEQP

 101 LDGLSEKQIS SFGKLGAQEQ LDLLGGANAF ETRDKQCVAD LKAD*
```

The following partial DNA sequence was identified in *N. meningitidis* <SEQ ID 1479>:

```
m522.seq
   1 ATGACTGAGC CGAAACACGA AATGCTGACG AAAGAGCAGG TTGCCGCGCG

  51 CAAAAAAGCA AAAGCCAAAA TCCGCACCAT CCGCATTTGG GCGTGGGTCA

 101 TTTTGGCGTT GCTCGCTTTA ACCGCCCTGC TCTCCCAATG CGCGATGTCC

 151 AAACCGCAGG CAAAACAGAA AATTGTCGAG TCTTGCGTGA AGAATATTCC

 201 GTTTGCCGAA AAATGGCAAA ACGATTTGCG GGCCCGCGGT TTAGATTCAA

 251 ACAATACCCG CCTCGCCGTC GACTACTGCA AATGTATGTG GGAGCAGCCT

 301 TTGGACAGAT TGAGCGAGAA ACAGATTAGA TCCTTCGGCA AACTCGGCGC

 351 ACAAGAACAG CTTGACCTGC TCGGCGGCGC AAATGCCTTT GAAGCACGTG

 401 ACAAGCAGTG TGTTGCCGAT TTGAAATCAG AATAA
```

This corresponds to the amino acid sequence <SEQ ID 1480; ORF 522>:

```
m522.pep
  1  MTEPKHEMLT KEQVAARKKA KAKIRTIRIW AWVILALLAL TALLSQCAMS
```

-continued

```
 51 KPQAKQKIVE SCVKNIPFAE KWQNDLRARG LDSNNTRLAV DYCKCMWEQP

101 LDRLSEKQIR SFGKLGAQEQ LDLLGGANAF EARDKQCVAD LKSE*
```

Computer analysis of this amino acid sequence gave the following results:

Homology with a Predicted ORF from *N. gonorrhoeae*

ORF 522 shows 91.0% identity over a 144 aa overlap with a predicted ORF (ORF 522.ng) from *N. gonorrhoeae*:

```
m522/g522

                    10        20        30        40        50        60
m522.pep    MTEPKHEMLTKEQVAARKKAKAKIRTIRIWAWVILALLALTALLSQCAMSKPQAKQKIVE
            |||||||  |:|||||||||||||||||||||||||||| ||||||||||||||||||||
g522        MTEPKHETPTEEQVAARKKAKAKIRTIRIWAWVILALLASTALLSQCAMSKPQAKQKIVE
                    10        20        30        40        50        60

                    70        80        90       100       110       120
m522.pep    SCVKNIPFAEKWQNDLRARGLDSNNTRLAVDYCKCMWEQPLDRLSEKQIRSFGKLGAQEQ
            ||:|||||||||||||:|||||::|||||||||||||||||| |||||| ||||||||||
g522        SCMKNIPFAEKWQNDLKARGLDADNTRLAVDYCKCMWEQPLDGLSEKQISSFGKLGAQEQ
                    70        80        90       100       110       120

                   130       140
m522.pep    LDLLGGANAFEARDKQCVADLKSEX
            |||||||||||:||||||||||::
g522        LDLLGGANAFETRDKQCVADLKAD
                   130       140
```

The following partial DNA sequence was identified in *N. meningitidis* <SEQ ID 1481>:

```
a522.seq
  1 ATGACTGAGC CGAAACACGA AATGCCGACG GAAGAGCAGG TTGCCGCGCG

 51 CAAAAAAGCA AAAGCCAAAA TCCGCACCAT CCGCATTTGG GCATGGGTCA

101 TTTTGGCGTT GCTCGCTTCA ACCGCCCTGC TCTCCCAATG CGCGATGTCC

151 AAACCGCAGG CAAAACAGAA AATTGTCGAG TCTTGCGTGA AGAATATTCC

201 GTTTGCCGAA AAATGGCAAA ACGATTTGCG GGCCCGCGGT TTAGATTCAA

251 ACAATACCCG CCTTACCGTC GACTACTGCA AATGTATGTG GGAGCAGCCT

301 TTGGACAGAT TGAGCGAGAA ACAGATTAGT TCCTTCGGCA AACTCGGCGC

351 ACAAGAACAG CTTGACCTGC TCGGCGGCGC AAATGCCTTT GAAACGCGAG

401 ACAAGCAGTG TGTTGCCGAT TTGAAATCAG AATAA
```

This corresponds to the amino acid sequence <SEQ ID 1482; ORF 522.a>:

```
a522.pep
  1 MTEPKHEMPT EEQVAARKKA KAKIRTIRIW AWVILALLAS TALLSQCAMS

 51 KPQAKQKIVE SCVKNIPFAE KWQNDLRARG LDSNNTRLTV DYCKCMWEQP

101 LDRLSEKQIS SFGKLGAQEQ LDLLGGANAF ETRDKQCVAD LKSE*
```

m522/a522 95.8% identity in 144 aa overlap

```
                    10        20        30        40        50        60
m522.pep    MTEPKHEMLTKEQVAARKKAKAKIRTIRIWAWVILALLALTALLSQCAMSKPQAKQKIVE
            |||||||| |:||||||||||||||||||||||||| |||||||||||||||||||||||
a522        MTEPKHEMPTEEQVAARKKAKAKIRTIRIWAWVILASLASTALLSQCAMSKPQAKQKIVE
                    10        20        30        40        50        60
```

```
                  70         80         90        100        110        120
m522.pep  SCVKNIPFAEKWQNDLRARGLDSNNTRLAVDYCKCMWEQPLDRLSEKQIRSFGKLGAQEQ
          ||||||||||||||||||||||||||||||:|||||||||||||||||| ||||||||||
a522      SCVKNIPFAEKWQNDLRARGLDSNNTRLTVDYCKCMWEQPLDGLSEKQISSFGKLGAQEQ
                  70         80         90        100        110        120
                 130        140
m522.pep  LDLLGGANAFEARDKQCVADLKSEX
          ||||||||||||:||||||||||||
a522      LDLLGGANAFETRDKQCVADLKSEX
                 130        140
```

The following partial DNA sequence was identified in *N. gonorrhoeae* <SEQ ID 1483>:

```
g523.seq
   1 atgactgtat ggtttgttgc cgctgttgcc gtcttaatca tcgaattatt

  51 gacgggaacg gtttatcttt tggttgtcag cgcggctttg gcgggttcgg

 101 gcattgccta cgggctgact ggcagcacgc ctgccgccgt cttgaccgcc

 151 gcactgcttt ccgcgctggg catttggttc gtacatgcca aaaccgccgt

 201 gggaaaagtt gaaacggatt catatcagga tttggatacc ggaaaatatg

 251 ccgaaatcct ccgatacaca ggcggcaacc gttacgaagt tttttatcgc

 301 ggtacgcact ggcaggcgca aaatacgggg caggaagtgt ttgaaccggg

 351 aacgcgcgcc ctcatcgtcc gcaaagaagg taaccttctt atcatcgcaa

 401 acccttaa
```

This corresponds to the amino acid sequence <SEQ ID 1484; ORF 523.ng>:

```
g523.pep
   1 MTVWFVAAVA VLIIELLTGT VYLLVVSAAL AGSGIAYGLT GSTPAAVLTA

  51 ALLSALGIWF VHAKTAVGKV ETDSYQDLDT GKYAEILRYT GGNRYEVFYR

 101 GTHWQAQNTG QEVFEPGTRA LIVRKEGNLL IIANP*
```

The following partial DNA sequence was identified in *N. meningitidis* <SEQ ID 1485>:

```
m523.seq (partial)
   1 ..GCCGTCTTAA TCATCGAATT ATTGACGGGA ACGGTTTATC TTTTGGTTGT

  51   nAGCGCGGCT TTGGCGGGTT CGGGCATTGC TTACGGGCTG ACCGGCAGTA

 101   CGCCTGCCGC CGTCTTGACC GnCGCTCTGC TTTCCGCGCT GGGTATTTnG

 151   TTCGTACACG CCAAAACCGC CGTTAGAAAA GTTGAAACGG ATTCATATCA

 201   GGATTTGGAT GCCGGACAAT ATGTCGAAAT CCTCCGACAC ACAGGCGGCA

 251   ACCGTTACGA AGTTTTtTAT CGCGGTACGc ACTGGCAGGC TCAAAATACG

 301   GGGCAAGAAG AGCTTGAACC AGGAACTCGC GCCCTCATTG TCCGCAAGGA

 351   AGGCAACCTT CTTATTATCA CACACCCTTAA
```

This corresponds to the amino acid sequence <SEQ ID 1486; ORF 523>:

```
m523.pep (partial)
   1 ..AVLIIELLTG TVYLLVVSAA LAGSGIAYGL TGSTPAAVLT XALLSALGIX

  51   FVHAKTAVRK VETDSYQDLD AGQYVEILRH TGGNRYEVFY RGTHWQAQNT
```

-continued

```
101   GQEELEPGTR ALIVRKEGNL LIITHP*
```

Computer analysis of this amino acid sequence gave the following results:

Homology with a Predicted ORF from *N. gonorrhoeae*

ORF523 shows 91.3% identity over a 126 aa overlap with a predicted ORF (ORF 523.ng) from *N. gonorrhoeae*:

```
m523/g523

                           10        20        30        40        50
m523.pep            AVLIIELLTGTVYLLVVSAALAGSGIAYGLTGSTPAAVLTXALLSALGIXF
                    |||||||||||||||||||||||||||||||||||||| |||||||| |
g523       MTVWFVAAVAVLIIELLTGTVYLLVVSAALAGSGIAYGLTGSTPAAVLTAALLSALGIWF
                   10        20        30        40        50        60

                 60        70        80        90       100       110
m523.pep   VHAKTAVRKVETDSYQDLDAGQYVEILRHTGGNRYEVFYRGTHWQAQNTGQEELEPGTRA
           ||||||| ||||||||||||:|:|:||||:||||||||||||||||||||||| :||||||
g523       VHAKTAVGKVETDSYQDLDTGKYAEILRYTGGNRYEVFYRGTHWQAQNTGQEVFEPGTRA
                   70        80        90       100       110       120

                120
m523.pep   LIVRKEGNLLIITHP
           ||||||||||||::|
g523       LIVRKEGNLLIIANPX
                  130
```

The following partial DNA sequence was identified in *N. meningitidis* <SEQ ID 1487>:

```
a523.seq
   1 ATGACTGTAT GGTTTGTTGC CGCTGTTGCC GTCTTAATCA TCGAATTATT

  51 GACGGGAACG GTTTATCTTT TGGTTGTCAG CGCGGCTTTG GCGGGTTCGG

 101 GCATTGCTTA CGGGCTGACC GGCAGCACGC CTGCCGCCGT CTTGACCGCC

 151 GCTCTGCTTT CCGCGCTGGG TATTTGGTTC GTACACGCCA AAACCGCCGT

 201 GGGAAAAGTT GAAACGGATT CATATCAGGA TTTGGATGCC GGGCAATATG

 251 CCGAAATCCT CCGGCACGCA GGCGGCAACC GTTACGAAGT TTTTTATCGC

 301 GGTACGCACT GGCAGGCTCA AAATACGGGG CAAGAAGAGC TTGAACCAGG

 351 AACGCGCGCC CTAATCGTCC GCAAGGAAGG CAACCTTCTT ATCATCGCAA

 401 AACCTTAA
```

This corresponds to the amino acid sequence <SEQ ID 1488; ORF 523.a>:

```
a523.pep
   1 MTVWFVAAVA VLIIELLTGT VYLLVVSAAL AGSGIAYGLT GSTPAAVLTA

  51 ALLSALGIWF VHAKTAVGKV ETDSYQDLDA GQYAEILRHA GGNRYEVFYR

 101 GTHWQAQNTG QEELEPGTRA LIVRKEGNLL IIAKP*
```

m523/a523 94.4% identity in 126 aa overlap

```
                           10        20        30        40        50
m523.pep            AVLIIELLTGTVYLLVVSAALAGSGIAYGLTGSTPAAVLTXALLSALGIXF
                    |||||||||||||||||||||||||||||||||||||| |||||||| |
a523       MTVWFVAAVAVLIIELLTGTVYLLVVSAALAGSGIAYGLTGSTPAAVLTAALLSALGIWF
                   10        20        30        40        50        60
```

-continued

```
                 60        70        80        90       100       110
m523.pep    VHAKTAVRKVETDSYQDLDAGQYVEILRHTGGNRYEVFYRGTHWQAQNTGQEELEPGTRA
            ||||||| ||||||||||||||||:|||||:|||||||||||||||||||||||||||||
a523        VHAKTAVGKVETDSYQDLDAGQYAEILRHAGGNRYEVFYRGTHWQAQNTGQEVFEPGTRA
                   70        80        90       100       110       120

                120
m523.pep    LIVRKEGNLLIITHPX
            ||||||||||||::||
a523        LIVRKEGNLLIIAKPX
                   130
```

The following partial DNA sequence was identified in *N. gonorrhoeae* <SEQ ID 1489>:

```
g525.seq
   1 atgaagtacg tccggttatt tttcctcggc acggcactcg ccggcactca

  51 agcggcggct gccgaaatgg ttcaaatcga aggcggcagc taccgcccgc

 101 tttatctgaa aaaagatacc ggcctgatta aagtcaaacc gttcaaactg

 151 gataaatatc ccgttaccaa tgccgagttt gccgaatttg tcaacagcca

 201 cccccaatgg caaaaaggca ggatcggttc caaacaggca gaacccgctt

 251 acctgaagca ttggatgaaa aacggcagcc gcagctatgc gccgaaggcg

 301 ggcgaattga aacagccggt taccaatatt tcctggtttg ccgccaacgc

 351 ctattgcgcc gcacaaggca aacgcctgcc gaccatcgac gaatgggaat

 401 ttgccggact tgcttccgcc acgcagaaaa aacggctcaa acgaacccgg

 451 ctacaaccgc actattctcg attggtatgc cgacggcgga cggaaaggcc

 501 tgcacgatgt cggcaaagca ccgcccgaac tactggggtg tttatgatat

 551 gcacgggctg a
```

This corresponds to the amino acid sequence <SEQ ID 1490; ORF 525.ng>:

```
g525.pep
   1 MKYVRLFFLG TALAGTQAAA AEMVQIEGGS YRPLYLKKDT GLIKVKPFKL

  51 DKYPVTNAEF AEFVNSHPQW QKGRIGSKQA EPAYLKHWMK NGSRSYAPKA

 101 GELKQPVTNI SWFAANAYCA AQGKRLPTID EWEFAGLASA TQKKRLKRTR

 151 LQPHYSRLVC RRRTERPARC RQSTARTTGV FMICTG *
```

The following partial DNA sequence was identified in *N. meningitidis* <SEQ ID 1491>:

```
m525.seq
   1 ATGAAGTATG TCCGGTTATT TTwCCTCGGC GCGGCACTCG cCrrCACTCA

  51 ArCGGCGGCT GcCGAAATGG TTCAAATCGA AGGCGGCAgC TACCGCCCrC

 101 TTTATCTGAA AAAAGATACC GGCCTGATTA AAGTCAAACC GTTCAAACTG

 151 GATAAATATC CCGTTACCAA TGCCGAGTTT GCCGAATTTG TCAACAGCCA

 201 CCCCCAATGG CAAAAAGGCA GGATCGGTTC CAAACAGGCA GAACCCGCTT

 251 ACCTGAAGCA TTGGATGAAA AACGGCAGCC GCAGCTATGc GCCGAAGgCG

 301 GgCGAATTAA AACAACCGGT AACCAATGTT TCCTGGwTTG CCGCCAAcGC

 351 CTAtTGCGCC GCACAAGGCA AACGCCTGCC GACCATTGAC GAATGGGAAT

 401 TTGCCGGACT TGCTTCCGCC ACGCAGAAAA A.CGGCTCAA ACGAACCCGG
```

-continued

```
451 CTACAACCGC ACTATTCTCG ATTGGTATGC CGACGGCGGA CGGAAAGGCC

501 TGCACGATGT CGGCA.AAGG CCGCCCGAAC TACTGGGGCG TTTATGATAT

551 GCACGGGCTG A
```

This corresponds to the amino acid sequence <SEQ ID 1492; ORF 525>:

```
m525.pep
   1 MKYVRLFXLG AALAXTQXAA AEMVQIEGGS YRPLYLKKDT GLIKVKPFKL

  51 DKYPVTNAEF AEFVNSHPQW QKGRIGSKQA EPAYLKHWMK NGSRSYAPKA

 101 GELKQPVTNV SWXAANAYCA AQGKRLPTID EWEFAGLASA TQKXRLKRTR

 151 LQPHYSRLVC RRRTERPARC RXKAARTTGA FMICTG*
```

Computer analysis of this amino acid sequence gave the following results:

Homology with a Predicted ORF from *N. gonorrhoeae*

ORF 525 shows 94.1% identity over a 186 aa overlap with a predicted ORF (ORF 525.ng) from *N. gonorrhoeae*:

```
m525/g525

                     10        20        30        40        50        60
m525.pep    MKYVRLFXLGAALAXTQXAAAEMVQIEGGSYRPLYLKKDTGLIKVKPFKLDKYPVTNAEF
            ||||||| ||:||| || ||||||||||||||||||||||||||||||||||||||||||
g525        MKYVRLFFLGTALAGTQAAAAEMVQIEGGSYRPLYLKKDTGLIKVKPFKLDKYPVTNAEF
                     10        20        30        40        50        60

                     70        80        90       100       110       120
m525.pep    AEFVNSHPQWQKGRIGSKQAEPAYLKHWMKNGSRSYAPKAGELKQPVTNVSWXAANAYCA
            ||||||||||||||||||||||||||||||||||||||||||||||||||:|| ||||||
g525        AEFVNSHPQWQKGRIGSKQAEPAYLKHWMKNGSRSYAPKAGELKQPVTNISWFAANAYCA
                     70        80        90       100       110       120

                    130       140       150       160       170       180
m525.pep    AQGKRLPTIDEWEFAGLASATQKXRLKRTRLQPHYSRLVCRRRTERPARCRXKAARTTGA
            |||||||||||||||||||||| ||||||||||||||||||||||||||| ::|||||:
g525        AQGKRLPTIDEWEFAGLASATQKKRLKRTRLQPHYSRLVCRRRTERPARCRQSTARTTGV
                    130       140       150       160       170       180

m525.pep    FMICTGX
            |||||||
g525        FMICTGX
```

The following partial DNA sequence was identified in *N. meningitidis* <SEQ ID 1493>:

```
a525.seq
   1 ATGAAGTTTA CCCGGTTACT CTTTCTCTGT GCGGCACTCG CCGGCACTCA

  51 AGCGGCAGCT GCCGAAATGG TTCAAATCGA AGGCGGCAGC TACCGCCCGC

 101 TTTATCTGAA AAAAGATACC GGCCTGATTA AAGTCAAACC GTTCAAACTG

 151 GATAAATATC CCGTTACCAA TGCCGAGTTT GCCGAATTTG TCAACAGCCA

 201 CCCCCAATGG CAAAAAGGCA GGATCGGTTC CAAACAGGCA GAACCCGCTT

 251 ACCTGAAGCA TTGGATGAAA AACGGCAGCC GCAGCTATGC GCCGAAGGCG

 301 GGCGATTTAA AACAACCGGT AACCAATGTT TCCTGGTTCG CCGCCAACGC

 351 CTATTGCGCC GCACAAGGCA AACGCCTGCC GACCATTGAC GAATGGGAAT

 401 TTGCCGGACT TGCCTCCGCC ACGCAG.AAA AACGGCTCAA ACGAACCCGG

 451 CTACAACCGC ACTATTCTCG ACTGGTATGC GGATGGCGAC CGGAAAGACC

 501 TGCACGATGT CGGCAAAG.G TCGCCCGAAC TACTGGGGCG TTTATGATAT

 551 GCACGGTCTG A
```

This corresponds to the amino acid sequence <SEQ ID 1494; ORF 525.a>:

```
a525.pep
   1 MKFTRLLFLC AALAGTQAAA AEMVQIEGGS YRPLYLKKDT GLIKVKPFKL

  51 DKYPVTNAEF AEFVNSHPQW QKGRIGSKQA EPAYLKHWMK NGSRSYAPKA

 101 GDLKQPVTNV SWFAANAYCA AQGKRLPTID EWEFAGLASA TQXKRLKRTR

 151 LQPHYSRLVC GWRPERPARC RQXVARTTGA FMICTV*
```

m525/a525 90.8% identity in 185 aa overlap

```
                           10        20        30        40        50        60
m525.pep           MKYVRLFXLGAALAXTQXAAAEMVQIEGGSYRPLYLKKDTGLIKVKPFKLDKYPVTNAEF
                   ||::||: | |||| || ||||||||||||||||||||||||||||||||||||||||||
a525               MKFTRLLFLCAALAGTQAAAAEMVQIEGGSYRPLYLKKDTGLIKVKPFKLDKYPVTNAEF
                           10        20        30        40        50        60

       70        80        90       100       110       120
m525.pep           AEFVNSHPQWQKGRIGSKQAEPAYLKHWMKNGSRSYAPKAGELKQPVTNVSWXAANAYCA
                   |||||||||||||||||||||||||||||||||||||||||:|||||||||| |||||||
a525               AEFVNSHPQWQKGRIGSKQAEPAYLKHWMKNGSRSYAPKAGDLKQPVTNVSWFAANAYCA
                           70        80        90       100       110       120

      130       140       150       160       170       180
m525.pep           AQGKRLPTIDEWEFAGLASATQKXRLKRTRLQPHYSRLVCRRRTERPARCRXKAARTTGA
                   ||||||||||||||||||||||  ||||||||||||||||  | |||||||  :||||||
a525               AQGKRLPTIDEWEFAGLASATQXKRLKRTRLQPHYSRLVCGWRPERPARCRQXVARTTGA
                          130       140       150       160       170       180

m525.pep           FMICTGX
                   |||||
a525               FMICTVX
```

The following partial DNA sequence was identified in *N. gonorrhoeae* <SEQ ID 1495>:

```
g525-1.seq
   1 ATGAAGTACG TCCGGTTATT TTTCCTCGGC ACGGCACTCG CCGGCACTCA

  51 AGCGGCGGCT GCCGAAATGG TTCAAATCGA AGGCGGCAGC TACCGCCCGC

 101 TTTATCTGAA AAAAGATACC GGCCTGATTA AAGTCAAACC GTTCAAACTG

 151 GATAAATATC CCGTTACCAA TGCCGAGTTT GCCGAATTTG TCAACAGCCA

 201 CCCCCAATGG CAAAAAGGCA GGATCGGTTC CAAACAGGCA GAACCCGCTT

 251 ACCTGAAGCA TTGGATGAAA AACGGCAGCC GCAGCTATGC GCCGAAGGCG

 301 GGCGAATTGA AACAGCCGGT TACCAATATT TCCTGGTTTG CCGCCAACGC

 351 CTATTGCGCC GCACAAGGCA AACGCCTGCC GACCATCGAC GAATGGGAAT

 401 TTGCCGGACT TGCTTCCGCC ACGCAGAAAA ACGGCTCAAA CGAACCCGGC

 451 TACAACCGCA CTATTCTCGA TTGGTATGCC GACGGCGGAC GGAAAGGCCT

 501 GCACGATGTC GGCAAAGACC GCCCGAACTA CTGGGGTGTT TATGATATGC

 551 ACGGGCTGAT TTGGGAATGG ACGGAAGATT TCAACAGCAG CCTGCTTTCT

 601 TCCGGCAATG CCAACGCGCA AATGTTTTGC AGCGGCGCAT CTGTCGGGGC

 651 GAGCGACTCG TCCAACTATG CCGCCTTCCT CCGCTACGGC ATCCGCACCA

 701 GCCTGCAATC CAAATACGTC CTGCACAACT TGGGCTTCCG CTGCGCAAGC

 751 CGATAA
```

This corresponds to the amino acid sequence <SEQ ID 1496; ORF 525-1.ng>:

```
g525-1.pep
   1 MKYVRLFFLG TALAGTQAAA AEMVQIEGGS YRPLYLKKDT GLIKVKPFKL

  51 DKYPVTNAEF AEFVNSHPQW QKGRIGSKQA EPAYLKHWMK NGSRSYAPKA

 101 GELKQPVTNI SWFAANAYCA AQGKRLPTID EWEFAGLASA TQKNGSNEPG

 151 YNRTILDWYA DGGRKGLHDV GKDRPNYWGV YDMHGLIWEW TEDFNSSLLS

 201 SGNANAQMFC SGASVGASDS SNYAAFLRYG IRTSLQSKYV LHNLGFRCAS

 251 R*
```

The following partial DNA sequence was identified in *N. meningitidis* <SEQ ID 1497>:

```
m525-1.seq
   1 ATGAAGTATG TCCGGTTATT TTTCCTCGGC GCGGCACTCG CCGGCACTCA

  51 AGCGGCGGCT GCCGAAATGG TTCAAATCGA AGGCGGCAGC TACCGCCCGC

 101 TTTATCTGAA AAAAGATACC GGCCTGATTA AAGTCAAACC GTTCAAACTG

 151 GATAAATATC CCGTTACCAA TGCCGAGTTT GCCGAATTTG TCAACAGCCA

 201 CCCCCAATGG CAAAAAGGCA GGATCGGTTC CAAACAGGCA GAACCCGCTT

 251 ACCTGAAGCA TTGGATGAAA AACGGCAGCC GCAGCTATGC GCCGAAGGCG

 301 GGCGAATTAA AACAACCGGT AACCAATGTT TCCTGGTTTG CCGCCAACGC

 351 CTATTGCGCC GCACAAGGCA AACGCCTGCC GACCATTGAC GAATGGGAAT

 401 TTGCCGGACT TGCTTCCGCC ACGCAGAAAA ACGGCTCAAA CGAACCCGGC

 451 TACAACCGCA CTATTCTCGA TTGGTATGCC GACGGCGGAC GGAAAGGCCT

 501 GCACGATGTC GGCAAAGGCC GCCCGAACTA CTGGGGCGTT TATGATATGC

 551 ACGGGCTGAT TTGGGAATGG ACGGAAGATT TCAACAGCAG CCTGCTTTCT

 601 TCCGGCAATG CCAACGCGCA AATGTTTTGC AGCGGCGCGT CTATCGGGTC

 651 GAGCGACTCG TCCAACTATG CCGCCTTCCT CCGCTACGGC ATCCGTACCA

 701 GCCTGCAATC CAAATATGTC TTGCACAACT TGGGCTTCCG TTGCACAAGC

 751 CGATAA
```

This corresponds to the amino acid sequence <SEQ ID 1498; ORF 525-1>:

```
m525-1.pep
       1 MKYVRLFFLG AALAGTQAAA AEMVQIEGGS YRPLYLKKDT GLIKVKPFKL

      51 DKYPVTNAEF AEFVNSHPQW QKGRIGSKQA EPAYLKHWMK NGSRSYAPKA

     101 GELKQPVTNV SWFAANAYCA AQGKRLPTID EWEFAGLASA TQKNGSNEPG

     151 YNRTILDWYA DGGRKGLHDV GKGRPNYWGV TDMHGLIWEW TEDFNSSLLS

     201 SGNANAQMFC SGASIGSSDS SNYAAFLRYG IRTSLQSKYV LHNLGFRCTS

     251 R*

m525-1/g525-1 97.6% identity in 251 aa overlap

                10        20        30        40        50        60
m525-1.pep  MKYVRLFFLGAALAGTQAAAAEMVQIEGGSYRPLYLKKDTGLIKVKPFKLDKYPVTNAEF
            ||||||||||:|||||||||||||||||||||||||||||||||||||||||||||||||
g525-1      MKYVRLFFLGTALAGTQAAAAEMVQIEGGSYRPLYLKKDTGLIKVKPFKLDKYPVTNAEF
                10        20        30        40        50        60
```

-continued

```
70        80        90        100       110       120
m525-1.pep  AEFVNSHPQWQKGRIGSKQAEPAYLKHWMKNGSRSYAPKAGELKQPVTNVSWFAANAYCA
            |||||||||||||||||||||||||||||||||||||||||||||||||:||||||||||
g525-1      AEFVNSHPQWQKGRIGSKQAEPAYLKHWMKNGSRSYAPKAGELKQPVTNISWFAANAYCA
                    70        80        90        100       110       120

130       140       150       160       170       180
m525-1.pep  AQGKRLPTIDEWEFAGLASATWKNGSNEPGYNRTILDWYADGGRKGLHDVGKGRPNYWGV
            |||||||||||||||||||||||||||||||||||||||||||||||||||| |||||||
g525-1      AQGKRLPTIDEWEFAGLASATWKNGSNEPGYNRTILDWYADGGRKGLHDVGKDRPNYWGV
                    130       140       150       160       170       180

190       200       210       220       230       240
m525-1.pep  YDMHGLIWEWTEDFNSSLLSSGNANAQMFCSGASIGSSDSSNYAAFLRYGIRTSLQSKYV
            ||||||||||||||||||||||||||||||||||:|:|||||||||||||||||||||||
g525-1      YDMHGLIWEWTEDFNSSLLSSGNANAQMFCSGASVGASDSSNYAAFLRYGIRTSLQSKYV
                    190       200       210       220       230       240

250
m525-1.pep  LHNLGFRCTSRX
            ||||||||:|||
g525-1      LHNLGFRCASRX
                    250
```

The following partial DNA sequence was identified in *N. meningitidis* <SEQ ID 1499>:

```
a525-1.seq
   1 ATGAAGTTTA CCCGGTTACT CTTTCTCTGT GCGGCACTCG CCGGCACTCA

  51 AGCGGCAGCT GCCGAAATGG TTCAAATCGA AGGCGGCAGC TACCGCCCGC

 101 TTTATCTGAA AAAAGATACC GGCCTGATTA AAGTCAAACC GTTCAAACTG

 151 GATAAATATC CCGTTACCAA TGCCGAGTTT GCCGAATTTG TCAACAGCCA

 201 CCCCCAATGG CAAAAAGGCA GGATCGGTTC CAAACAGGCA GAACCCGCTT

 251 ACCTGAAGCA TTGGATGAAA AACGGCAGCC GCAGCTATGC GCCGAAGGCG

 301 GGCGATTTAA AACAACCGGT AACCAATGTT TCCTGGTTCG CCGCCAACGC

 351 CTATTGCGCC GCACAAGGCA AACGCCTGCC GACCATTGAC GAATGGGAAT

 401 TTGCCGGACT TGCCTCCGCC ACGCAGAAAA ACGGCTCAAA CGAACCCGGC

 451 TACAACCGCA CTATTCTCGA CTGGTATGCG GATGGCGACC GGAAAGACCT

 501 GCACGATGTC GGCAAAGGTC GCCCGAACTA CTGGGGCGTT TATGATATGC

 551 ACGGTCTGAT TTGGGAATGG ACGGAAGATT TCAACAGCAG CCTGCTTTCT

 601 TCCGGCAATG CCAACGCGCA AATGTTTTGC AGCGGCGCGT CTATCGGGTC

 651 GAGCGACTCG TCCAACTATG CCGCCTTCCT CCGCTACGGC ATCCGCACCA

 701 GCCTGCAATC CAAATATGTC TTGCACAACT TGGGCTTCCG TTGCACAAGC

 751 CGATAA
```

This corresponds to the amino acid sequence <SEQ ID 1500; ORF 525-1.a>:

```
a525-1.pep

      1 MKFTRLLFLC AALAGTQAAA AEMVQIEGGS YRPLYLKKDT GLIKVKPFKL

     51 DKYPVTNAEF AEFVNSHPQW QKGRIGSKQA EPAYLKHWMK NGSRSYAPKA

    101 GDLKQPVTNV SWFAANAYCA AQGKRLPTID EWEFAGLASA TQKNGSNEPG

    151 YNRTILDWYA DGDRKDLHDV GKGRPNYWGV YDMHGLIWEW TEDFNSSLLS

    201 SGNANAQMFC SGASIGSSDS SNYAAFLRYG IRTSLQSKYV LHNLGFRCTS

    251 R*
```

m525-1/a525-1 97.2% identity in 251 aa overlap

-continued

```
10        20        30        40        50        60
m525-1.pep  MKYVRLFFLGAALAGTQAAAAEMVQIEGGSYRPLYLKKDTGLIKVKPFKLDKYPVTNAEF
            ||::||:|| |||||||||||||||||||||||||||||||||||||||||||||||||||
a525-1      MKFTRLLFLCTALAGTQAAAAEMVQIEGGSYRPLYLKKDTGLIKVKPFKLDKYPVTNAEF
                    10        20        30        40        50        60

70        80        90        100       110       120
m525-1.pep  AEFVNSHPQWQKGRIGSKQAEPAYLKHWMKNGSRSYAPKAGELKQPVTNVSWFAANAYCA
            ||||||||||||||||||||||||||||||||||||||||||:|||||||||||||||||
a525-1      AEFVNSHPQWQKGRIGSKQAEPAYLKHWMKNGSRSYAPKAGDLKQPVTNVSWFAANAYCA
                    70        80        90        100       110       120

130       140       150       160       170       180
m525-1.pep  AQGKRLPTIDEWEFAGLASATQKNGSNEPGYNRTILDWYADGGRKGLHDVGKGRPNYWGV
            |||||||||||||||||||||||||||||||||||||||||| || ||||||| ||||||
a525-1      AQGKRLPTIDEWEFAGLASATQKNGSNEPGYNRTILDWYADGDRKDLHDVGKDRPNYWGV
                    130       140       150       160       170       180

190       200       210       220       230       240
m525-1.pep  YDMHGLIWEWTEDFNSSLLSSGNANAQMFCSGASIGSSDSSNYAAFLRYGIRTSLQSKYV
            ||||||||||||||||||||||||||||||||||||||||||||||||||||||||||||
a525-1      YDMHGLIWEWTEDFNSSLLSSGNANAQMFCSGASIGSSDSSNYAAFLRYGIRTSLQSKYV
                    190       200       210       220       230       240

250
m525-1.pep  LHNLGFRCTSRX
            ||||||||||||
a525-1      LHNLGFRCTSRX
                    250
```

The following partial DNA sequence was identified in *N. gonorrhoeae* <SEQ ID 1501>:

```
g527.seq
   1 atggttttac cagtctcctt ttttcagcct gtccagttgg cggcggtcgc

  51 gcttggtcgg tctgccgtcg ggatgggcgg aagtgatgcg gctgaattgg

 101 tcgagctgtt tgcactcttc cctcaatgct gccgttttcg cgtcttcttc

 151 atacagaagc cgcgcctcgg gtgccgggcg gcgttggtgg ttcaaacctt

 201 taaccttgat tttatgggga agggaattga gcgtcaggtc gataatatcg

 251 ccgatgtcta tggttttact gtttttgact ttcgagccgt ttacttgaac

 301 cctacccagt tcgatatgct tttgcgcaag ggaacgggtc ttgaaaaaac

 351 gtgccgccca aagccatttg tccagccgca tggcggaaga atcgtgcttg

 401 tctttcatac gattttgttt gaaataattg aatttgtttc gagtttagca

 451 taa
```

This corresponds to the amino acid sequence <SEQ ID 1502; ORF 527.ng>:

```
g527.pep
   1 MVLPVSFFQP VQLAAVALGR SAVGMGGSDA AELVELFALF PQCCRFRVFF

  51 IQKPRLGCRA ALVVQTFNLD FMGKGIERQV DNIADVYGFT VFDFRAVYLN

 101 PTQFDMLLRK GTGLEKTCRP KPFVQPHGGR IVLVFHTILF EIIEFVSSLA

 151 *
```

The following partial DNA sequence was identified in *N. meningitidis* <SEQ ID 1503>:

```
m527.seq
   1 ATGGTTTTAC CAGTCTCCTT TTTTCAGCCT GTCCAGTTGG CGGCGGTCGC

  51 GCTTGGTCGG TCTGCCGTCG GGATAGGCGG AAGTGATGCG GCTGAATTGG

 101 TCGAGCTGTT TGCGCTCTTC CCTCAATGTT GCCGTTwTCG CGTCCTCTTC
```

-continued

```
151 ATACAGAAGC CGCGCyTCGG ATGCCGGGCG GCGTTGGTGG TTCAAACCTT

201 TAACCkTGAT TTTATAGGGA AGGG.AATTk AgCkTCaGTy GrTwATaTCG

251 CsGATGTmTA TGGTTTTACT GTTTTTGACC TTCGAGCCGT TTACTTGAAC

301 CCTACCCAGT TCGATGTGCT TTTGCGCAAG GGAACGGGTC TTGAAAAAAC

351 GTGCCGCCCA AAGCCATTTG TCCAGCCGCA TGGCGGAAGA ATCGTGCTTG

401 TCTTTCATAC GATTTTGTTT GAAATAATTG AATTTGTTTC GAGTTTAGCA

451 TAA
```

This corresponds to the amino acid sequence <SEQ ID 1504; ORF 527>:

```
m527pep
  1 MVLPVSFFQP VQLAAVALGR SAVGIGGSDA AELVELFALF PQCCRXRVLF

 51 IQKPRXGCRA ALVVQTFNXD FIGKXNXASV XXIADVYGFT VFDLRAVYLN

101 PTQFDVLLRK GTGLEKTCRP KPFVQPHGGR IVLVFHTILF EIIEFVSSLA

151 *
```

Computer analysis of this amino acid sequence gave the following results:

Homology with a Predicted ORF from *N. gonorrhoeae*

ORF 527 shows 90.0% identity over a 150 aa overlap with a predicted ORF (ORF 527.ng) from *N. gonorrhoeae*:

```
m527/g527

                      10        20        30        40        50        60
m527.pep     MVLPVSFFQPVQLAAVALGRSAVGIGGSDAAELVELFALFPQCCRXRVLFIQKPRXGCRA
             ||||||||||||||||||||||||:|||||||||||||||||||| ||:|||||| ||||
g527         MVLPVSFFQPVQLAAVALGRSAVGMGGSDAAELVELFALFPQCCRFRVFFIQKPRLGCRA
                      10        20        30        40        50        60

                      70        80        90       100       110       120
m527.pep     ALVVQTFNXDFIGKXNXASVXXIADVYGFTVFDLRAVYLNPTQFDVLLRKGTGLEKTCRP
             |||||||| ||:||    :|  ||||||||||:|||||||||||:|||||||||||||||
g527         ALVVQTFNLDFMGKGIERQVDNIADVYGFTVFDFRAVYLNPTQFDMLLRKGTGLEKTCRP
                      70        80        90       100       110       120

                     130       140       150
m527.pep     KPFVQPHGGRIVLVFHTILFEIIEFVSSLA
             ||||||||||||||||||||||||||||||
g527         KPFVQPHGGRIVLVFHTILFEIIEFVSSLA
                     130       140       150
```

The following partial DNA sequence was identified in *N. meningitidis* <SEQ ID 1505>:

```
a527.seq
  1 ATGGTTTTAC CAGTCTCCTT TTTTCAGCCT GTCCAGTTGG CGGCGGTCGC

 51 GCTTGGTCGG TCTGCCGTCG GGATAGGCGG AAGTGATGCG GCTGAATTGG

101 TCGAGCTGTT TGCGCTCTTC CCTCAATGTT GCCGTTTTCG CGTCCTCTTC

151 ATACAGAAGC CGCGCCTCGG ATGCCGGGCG GCGTTGGTGG TTCAAACCTT

201 TAACCTTGAT TTTATAGGGA AGGGAATTGA GCGTCAGGTC GATAATATCG

251 CCGATGTCTA TGGTTTTACT GTTTTTGACC TTCGAGCCGT TTACTTGAAC

301 CCTACCCAGT TCGATGTGCT TTTGCGCAAG GGAACGGGTC TTGAAAAAAC

351 GTGCCGCCCA AAGCCATTTG TCCAGCCGCA TGGCGGAAGA ATCGTGCTTG
```

-continued

```
401 TCTTTCATAC GATTTTGTTT GAAATAATTG AATTTGTTTC GAGTTTAGCA

451 TAA
```

This corresponds to the amino acid sequence <SEQ ID 1506; ORF 527.a>:

```
a527.pep
  1 MVLPVSFFQP VQLAAVALGR SAVGIGGSDA AELVELFALF PQCCRFRVLF

 51 IQKPRLGCRA ALVVQTFNLD FIGKGIERQV DNIADVYGFT VFDLRAVYLN

101 PTQFDVLLRK GTGLEKTCRP KPFVQPHGGR IVLVFHTILF EIIEFVSSLA

151 *
```

m527/a527 93.3% identity in 150 aa overlap

```
                    10        20        30        40        50        60
m527.pep    MVLPVSFFQPVQLAAVALGRSAVGIGGSDAAELVELFALFPQCCRXRVLFIQKPRXGCRA
            |||||||||||||||||||||||||||||||||||||||||||||| |||||||| ||||
a527        MVLPVSFFQPVQLAAVALGRSAVGIGGSDAAELVELFALFPQCCRFRVLFIQKPRLGCRA
                    10        20        30        40        50        60

                    70        80        90       100       110       120
m527.pep    ALVVQTFNXDFIGKXNXASVXXIADVYGFTVFDLRAVYLNPTQFDVLLRKGTGLEKTCRP
            |||||||| |||||    :|  ||||||||||||||||||||||||||||||||||||||
a527        ALVVQTFNLDFIGKGIERQVDNIADVYGFTVFDLRAVYLNPTQFDVLLRKGTGLEKTCRP
                    70        80        90       100       110       120

                   130       140       150
m527.pep    KPFVQPHGGRIVLVFHTILFEIIEFVSSLAX
            |||||||||||||||||||||||||||||||
a527        KPFVQPHGGRIVLVFHTILFEIIEFVSSLAX
                   130       140       150
```

The following partial DNA sequence was identified in *N. gonorrhoeae* <SEQ ID 1507>:

```
g528.seq
  1 atggaaattc gggtaataaa atatacggca acggctgcgt tgtttgcatt

 51 tacggttgca ggctgccggc tggcggggtg gtatgagtgt ttgtccttgt

101 ccggctggtg taagccgaga aaacctgccg ccatcgattt ttgggatatt

151 ggcggcgaga gtccgctgtc tttagaggac tacgagatac cgctttcaga

201 cggcaatcgt tccgtcaggg caaacgaata tgaatccgcg caaaaatctt

251 acttttatag gaaaataggg aagtttgaag cctgcgggtt ggattggcgt

301 acgcgtgacg gcaaaccttt ggttgagagg ttcaaacagg aaggtttcga

351 ctgtttggaa aagcaggggt tgcggcgcaa cggcctgtcc gagcgcgtcc

401 gatggtaa
```

This corresponds to the amino acid sequence <SEQ ID 1508; ORF 528.ng>:

```
g528.pep
  1 MEIRVIKYTA TAALFAFTVA GCRLAGWYEC LSLSGWCKPR KPAAIDFWDI

 51 GGESPLSLED YEIPLSDGNR SVRANEYESA QKSYFYRKIG KFEACGLDWR

101 TRDGKPLVER FKQEGFDCLE KQGLRRNGLS ERVRW*
```

The following partial DNA sequence was identified in *N. meningitidis* <SEQ ID 1509>:

```
m528.seq (partial)
   1 ATGGAAATTC GGGCAATAAA ATATACGGCA ATGGCTGCGT TGCTTGCATT

  51 TACGGTTGCA GGCTGCCGGC TGGCGGGGTG GTATGAGTGT TCGTCCCTCA

 101 CCGGCTGGTG TAAGCCGAGA AAACCGGCTG CCATCGATTT TTGGGATATT

 151 GGCGGCGAGA GTCCGCCGTC TTTAGGGGAC TACGAGATAC CGCTTTCAGA

 201 CGGCAATAGT TCCGTCAGGG CAAACGAATA TGAATCCGCA CAACAATCTT

 251 ACTTTTACAG GAAAATAGGG AAGTTTGAAG C.TGCGGGCT GGATTGGCGT

 301 ACGCGTGACG GCAAACCTTT GATTGAGACG TTCAAACAGG GAGGATTTGA

 351 CTGCTTGGAA AAG....
```

This corresponds to the amino acid sequence <SEQ ID 1510; ORF 528>:

```
m528.pep (partial)
   1 MEIRAIKYTA MAALLAFTVA GCRLAGWYEC SSLTGWCKPR KPAAIDFWDI

  51 GGESPPSLGD YEIPLSDGNS SVRANEYESA QQSYFYRKIG KFEXCGLDWR

 101 TRDGKPLIET FKQGGFDCLE K....
```

Computer analysis of this amino acid sequence gave the following results:

Homology with a Predicted ORF from *N. gonorrhoeae*

ORF 528 shows 89.3% identity over a 121 aa overlap with a predicted ORF (ORF 528.ng) from *N. gonorrhoeae*:

```
m528/g528

                            10        20        30        40        50        60
m528.pep           MEIRAIKYTAMAALLAFTVAGCRLAGWYECSSLTGWCKPRKPAAIDFWDIGGESPPSLGD
                   ||||:||||| |||:||||||||||||||| ||:||||||||||||||||||||| || |
g528               MEIRVIKYTATAALFAFTVAGCRLAGWYECLSLSGWCKPRKPAAIDFWDIGGESPLSLED
                            10        20        30        40        50        60

                            70        80        90       100       110       120
m528.pep           YEIPLSDGNSSVRANEYESAQQSYFYRKIGKFEXCGLDWRTRDGKPLIETFKQGGFDCLE
                   ||||||||| |||||||||||:||||||||||| |||||||||||||:| ||| ||||||
g528               YEIPLSDGNRSVRANEYESAQKSYFYRKIGKFEACGLDWRTRDGKPLVERFKQEGFDCLE
                            70        80        90       100       110       120


m528.pep           K
                   |
g528               KQGLRRNGLSERVRW
```

The following partial DNA sequence was identified in *N. meningitidis* <SEQ ID 1511>:

```
a528.seq
   1 ATGGAAATTC GGGCAATAAA ATATACGGCA ATGGCTGCGT TGCTTGCATT

  51 TACGGTTGCA GGCTGCCGGT TGGCAGGTTG GTATGAGTGT TCGTCCCTGT

 101 CCGGCTGGTG TAAGCCGAGA AAACCTGCCG CCATCGATTT TTGGGATATT

 151 GGCGGCGAGA GTCCTCCGTC TTTAGAGGAC TACGAGATAC CGCTTTCAGA

 201 CGGCAATCGT TCCGTCAGGG CAAACGAATA TGAATCCGCA CAACAATCTT

 251 ACTTTTACAG GAAAATAGGG AAGTTTGAAG CCTGCGGGTT GGATTGGCGT

 301 ACGCGTGACG GCAAACCTTT GATTGAGACG TTCAAACAGG AAGGTTTTGA
```

-continued

```
351 TTGTTTGAAA AAGCAGGGGT TGCGGCGCAA CGGTCTGTCC GAGCGCGTCC

401 GATGGTAA
```

This corresponds to the amino acid sequence <SEQ ID 1512; ORF 528.a>:

```
a528.pep
   1 MEIRAIKYTA MAALLAFTVA GCRLAGWYEC SSLSGWCKPR KPAAIDFWDI

  51 GGESPPSLED YEIPLSDGNR SVRANEYESA QQSYFYRKIG KFEACGLDWR

 101 TRDGKPLIET FKQEGFDCLK KQGLRRNGLS ERVRW*
```

m528/a528 95.0% identity in 121 aa overlap

```
                       10        20        30        40        50        60
m528.pep        MEIRAIKYTAMAALLAFTVAGCRLAGWYECSSLTGWCKPRKPAAIDFWDIGGESPPSLGD
                ||||||||||||||||||||||||||||||||:||||||||||||||||||||||||| |
a528            MEIRAIKYTAMAALLAFTVAGCRLAGWYECSSLSGWCKPRKPAAIDFWDIGGESPPSLED
                       10        20        30        40        50        60

                       70        80        90       100       110       120
m528.pep        YEIPLSDGNSSVRANEYESAQQSYFYRKIGKFEXCGLDWRTRDGKPLIETFKQGGFDCLE
                ||||||||| |||||||||||||||||||||||| ||||||||||||||||||| |||||:
a528            YEIPLSDGNRSVRANEYESAQQSYFYRKIGKFEACGLDWRTRDGKPLIETFKQEGFDCLK
                       70        80        90       100       110       120

m528.pep        K
                |
a528            KQGLRRNGLSERVRWX
                      130
```

The following partial DNA sequence was identified in *N. gonorrhoeae* <SEQ ID 1513>:

```
g528-1.seq
   1 ATGGAAATTC GGGTAATAAA ATATACGGCA ACGGCTGCGT TGTTTGCATT

  51 TACGGTTGCA GGCTGCCGGC TGGCGGGGTG GTATGAGTGT TCGTCCTTGT

 101 CCGGCTGGTG TAAGCCGAGA AAACCTGCCG CCATCGATTT TTGGGATATT

 151 GGCGGCGAGA GTCCGCTGTC TTTAGAGGAC TACGAGATAC CGCTTTCAGA

 201 CGGCAATCGT TCCGTCAGGG CAAACGAATA TGAATCCGCG CAAAAATCTT

 251 ACTTTTATAG GAAAATAGGG AAGTTTGAAG CCTGCGGGTT GGATTGGCGT

 301 ACGCGTGACG GCAAACCTTT GGTTGAGAGG TTCAAACAGG AAGGTTTCGA

 351 CTGTTTGGAA AAGCAGGGGT TGCGGCGCAA CGGCCTGTCC GAGCGCGTCC

 401 GATGGTAA
```

This corresponds to the amino acid sequence <SEQ ID 1514; ORF 528-1.ng>:

```
g528-1.pep
   1 MEIRVIKYTA TAALFAFTVA GCRLAGWYEC SSLSGWCKPR KPAAIDFWDI

  51 GGESPLSLED YEIPLSDGNR SVRANEYESA QKSYFYRKIG KFEACGLDWR

 101 TRDGKPLVER FKQEGFDCLE KQGLRRNGLS ERVRW*
```

The following partial DNA sequence was identified in *N. meningitidis* <SEQ ID 1515>:

```
m528-1.seq
   1 ATGGAAATTC GGGCAATAAA ATATACGGCA ATGGCTGCGT TGCTTGCATT

  51 TACGGTTGCA GGCTGCCGGC TGGCGGGGTG GTATGAGTGT TCGTCCCTCA

 101 CCGGCTGGTG TAAGCCGAGA AAACCGGCTG CCATCGATTT TTGGGATATT

 151 GGCGGCGAGA GTCCGCCGTC TTTAGGGGAC TACGAGATAC CGCTTTCAGA

 201 CGGCAATCGT TCCGTCAGGG CAAACGAATA TGAATCCGCA CAACAATCTT

 251 ACTTTTACAG GAAAATAGGG AAGTTTGAAG CCTGCGGGCT GGATTGGCGT

 301 ACGCGTGACG GCAAACCTTT GATTGAGACG TTCAAACAGG GAGGATTTGA

 351 CTGCTTGGAA AAGCAGGGGT TGCGGCGCAA CGGTCTGTCC GAGCGCGTCC

 401 GATGGTAA
```

This corresponds to the amino acid sequence <SEQ ID 1516; ORF 528-1>:

```
m528-1.pep..

      1  MEIRAIKYTA MAALLAFTVA GCRLAGWYEC SSLTGWCKPR KPAAIDFWDI

     51  GGESPPSLGD YEIPLSDGNR SVRANEYESA QQSYFYRKIG KFEACGLDWR

    101  TRDGKPLIET FKQGGFDCLE KQGLRRNGLS ERVRW*

g528-1/m528-1  92.6% identity in 135 aa overlap

                       10        20        30        40        50        60
g528-1.pep    MEIRVIKYTATAALFAFTVAGCRLAGWYECSSLSGWCKPRKPAAIDFWDIGGESPLSLED
              ||||:||||| |||:||||||||||||||||||:||||||||||||||||||||| || |
m528-1        MEIRAIKYTAMAALLAFTVAGCRLAGWYECSSLTGWCKPRKPAAIDFWDIGGESPPSLGD
                       10        20        30        40        50        60

                       70        80        90       100       110       120
g528-1.pep    YEIPLSDGNRSVRANEYESAQKSYFYRKIGKFEACGLDWRTRDGKPLVERFKQEGFDCLE
              |||||||||||||||||||||:|||||||||||||||||||||||||:| ||| ||||||
m528-1        YEIPLSDGNRSVRANEYESAQQSYFYRKIGKFEACGLDWRTRDGKPLIETFKQGGFDCLE
                       70        80        90       100       110       120

                      130
g528-1.pep    KQGLRRNGLSERVRWX
              ||||||||||||||||
m528-1        KQGLRRNGLSERVRWX
                      130
```

The following partial DNA sequence was identified in *N. meningitidis* <SEQ ID 1517>:

```
a528-1.seq
   1 ATGGAAATTC GGGCAATAAA ATATACGGCA ATGGCTGCGT TGCTTGCATT

  51 TACGGTTGCA GGCTGCCGGT TGGCAGGTTG GTATGAGTGT TCGTCCCTGT

 101 CCGGCTGGTG TAAGCCGAGA AAACCTGCCG CCATCGATTT TTGGGATATT

 151 GGCGGCGAGA GTCCTCCGTC TTTAGAGGAC TACGAGATAC CGCTTTCAGA

 201 CGGCAATCGT TCCGTCAGGG CAAACGAATA TGAATCCGCA CAACAATCTT

 251 ACTTTTACAG GAAAATAGGG AAGTTTGAAG CCTGCGGGTT GGATTGGCGT

 301 ACGCGTGACG GCAAACCTTT GATTGAGACG TTCAAACAGG AAGGTTTTGA

 351 TTGTTTGAAA AAGCAGGGGT TGCGGCGCAA CGGTCTGTCC GAGCGCGTCC

 401 GATGGTAA
```

This corresponds to the amino acid sequence <SEQ ID 1518; ORF 528-1.a>:

```
a528-1.pep

     1  MEIRAIKYTA MAALLAFTVA GCRLAGWYEC SSLSGWCKPR KPAAIDFWDI

    51  GGESPPSLED YEIPLSDGNR SVRANEYESA QQSYFYRKIG KFEACGLDWR

   101  TRDGKPLIET FKQEGFDCLK KQGLRRNGLS ERVRW*

a528-1/m528-1  97.0% identity in 135 aa overlap

                     10        20        30        40        50        60
a528-1.pep      MEIRAIKYTAMAALLAFTVAGCRLAGWYECSSLSGWCKPRKPAAIDFWDIGGESPPSLED
                |||||||||||||||||||||||||||||||||:|||||||||||||||||||||||| |
m528-1          MEIRAIKYTAMAALLAFTVAGCRLAGWYECSSLTGWCKPRKPAAIDFWDIGGESPPSLGD
                     10        20        30        40        50        60

                     70        80        90       100       110       120
a528-1.pep      YEIPLSDGNRSVRANEYESAQQSYFYRKIGKFEACGLDWRTRDGKPLIETFKQEGFDCLK
                |||||||||||||||||||||||||||||||||||||||||||||||||||| |||||:
m528-1          YEIPLSDGNRSVRANEYESAQQSYFYRKIGKFEACGLDWRTRDGKPLIETFKQGGFDCLE
                     70        80        90       100       110       120

                    130
a528-1.pep      KQGLRRNGLSERVRWX
                ||||||||||||||||
m528-1          KQGLRRNGLSERVRWX
                    130
```

The following partial DNA sequence was identified in *N. gonorrhoeae* <SEQ ID 1519>:

```
g529.seq (partial)
   1 atgacccata tcaaacccgt cattgccgcg ctcgcactca tcgggcttgc

  51 cgcctgctcc ggcagcaaaa ccgaacagcc caagctcgac taccaaagcc

 101 ggtcgcaccg cctgatcaaa ctcgaagtcc cgcctgattt gaacaacccc

 151 gaccaaggca acctctaccg cctgcctgcc ggttcgggag ccgtccgcgc

 201 cggggatttg gaaaaacgcc gcacacccgc cgtccaacag ccagcggatg

 251 ccggaagtat tgaaaagcgt caaaggcgtc cgcttcgagc ggcgacggca

 301 gccaacgcct ggcttgtcgt tgacggcaaa tcccccgccg aaatctccgc

 351 cgctttctg.
```

This corresponds to the amino acid sequence <SEQ ID 1520; ORF 529.ng>:

```
g529.pep (partial)
   1 MTHIKPVIAA LALIGLAACS GSKTEQPKLD YQSRSHRLIK LEVPPDLNNP

  51 DQGNLYRLPA GSGAVRAGDL EKRRTPAVQQ PADAGSIEKR QRRPLRAATA

 101 ANAWLVVDGK SPAEISAAF..
```

The following partial DNA sequence was identified in *N. meningitidis* <SEQ ID 1521>:

```
m529.seq
    1  ATGACCCATA TCAAACCCGT CATTGCCGCG CTCGCACTCA TCGGGCTTGC

   51  CGCCTGCTCC GGCAGCAAAA CCGAACAGCC CAAGCTCGAC TACCAAAGCC

  101  GGTCGCACCG CCTGATCAAA CTTGAAGTCC CACCTGATTT GAAAAACGCC

  151  GACCAAGGCA ACCTCTACCG CCTGCCTGCC GGTTCGGGCG CCGTCCGCGC
```

-continued

```
 201 CAGCGATTTG GAAAAACGCC GCACACCCGC CGTCCAACAG CCTGCCGATG

 251 CCGAAGTATT GAAAAGCGTC AAAGGTGTCC GCCTCGAGCG CGACGGCAGC

 301 CAACGCTGGC TCGTTGTCGA CGGCAAGTCT CCTGCCGAAA TCTGGCCGCT

 351 CCTGAAAGCC TTTTGGCAGG AAAACGGCTT CGACATCAAA TCCGAAGAAC

 401 CCGCCATCGG ACAAATGGAA ACCGAGTGGG CGGAAAACCG CGCCAAAATC

 451 CCCCAAGACA GCTTGCGCCG CCTCTTCGAC AAAGTCGGCT TGGGCGGCAT

 501 CTACTCCACC GGCGAGCGCG ACAAATTCAT CGTCCGTATC GAACAGGGCA

 551 AAAACGGCGT TTCCGACATC TTCTTCGCCC ACAAAGCCAT GAAAGAAGTG

 601 TACGGCGGCA AAGACAAAGA CACGACCGTA TGGCAGCCCT CCCCGTCCGA

 651 TCCCAACCTC GAAGCCGCTT TCCTGACGCG CTTTATGCAA TATTTGGGCG

 701 TTGACGGACA GCAGGCGGAA AACGCATCGG CAAAAAAACC TACCCTTCCC

 751 GCCGCCAACG AAATGGCGCG TATCGAAGGC AAAAGCCTGA TTGTCTTTGG

 801 CGACTACGGC AGAAACTGGC GGCGCACCGT GCTCGCCCTC GACCGCATCG

 851 GGCTGACCGT CGTCGGTCAA AACACCGAAC GCCACGCCTT CCTGGTTCAA

 901 AAAGCCCCGA ACGAAAGCAA TGCAGTTACC GAACAAAAAC CCGGCCTGTT

 951 CAAACGCCTG CTGGGCAAAG GCAAAGCGGA GAAACCTGCC GAACAGCCGG

1001 AACTGATTGT CTATGCAGAA CCTGTCGCCA ACGGCTCGCG CATCGTCCTG

1051 CTCAACAAAG ACGGCAGCGC ATATGCCGGC AAAGACGCAT CCGCATTATT

1101 GGGCAAACTC CATTCCGAAC TGCGTTAA
```

This corresponds to the amino acid sequence <SEQ ID 1522; ORF 529>:

```
m529.pep
   1 MTHIKPVIAA LALIGLAACS GSKTEQPKLD YQSRSHRLIK LEVPPDLNNP

  51 DQGNLYRLPA GSGAVRASDL EKRRTPAVQQ PADAEVLKSV KGVRLERDGS

 101 QRWLVVDGKS PAEIWPLLKA FWQENGFDIK SEEPAIGQME TEWAENRAKI

 151 PQDSLRRLFD KVGLGGIYST GERDKFIVRI EQGKNGVSDI FFAHKAMKEV

 201 YGGKDKDTTV WQPSPSDPNL EAAFLTRFMQ YLGVDGQQAE NASAKKPTLP

 251 AANEMARIEG KSLIVFGDYG RNWRRTVLAL DRIGLTVVGQ NTERHAFLVQ

 301 KAPNESNAVT EQKPGLFKRL LGKGKAEKPA EQPELIVYAE PVANGSRIVL

 351 LNKDGSAYAG KDASALLGKL HSELR*
```

Computer analysis of this amino acid sequence gave the following results:

Homology with a Predicted ORF from *N. gonorrhoeae*

ORF 529 shows 83.5% identity over a 115 aa overlap with a predicted ORF (ORF 529.ng) from *N. gonorrhoeae*:

```
g529/m529

                     10        20        30        40        50        60
g529.pep     MTHIKPVIAALALIGLAACSGSKTEQPKLDYQSRSHRLIKLEVPPDLNNPDQGNLYRLPA
             ||||||||||||||||||||||||||||||||||||||||||||||||||||||||||||
m529         MTHIKPVIAALALIGLAACSGSKTEQPKLDYQSRSHRLIKLEVPPDLNNPDQGNLYRLPA
                     10        20        30        40        50        60
```

-continued

```
                            70        80        90       100       110       120
g529.pep            GSGAVRAGDLEKRRTPAVQQPADAGSIEKRQRRPLRAATAANAWLVVDGKSPAEISAAFX
                    |||||||:||||||||||||||||  ::: :   |:    ::: ||||||||||||
m529                GSGAVRASDLEKRRTPAVQQPADAEVLKSVKGVRLER-DGSQRWLVVDGKSPAEIWPLLK
                            70        80        90        100       110 m529                AFWQENGFDIKSEEPAIGQMETEWAENRAKIPQDSLRRLFDKVGLGGIYSTGERDKFIVR
                  120       130       140       150       160       170
```

The following partial DNA sequence was identified in *N. meningitidis* <SEQ ID 1523>:

```
a529.seq
   1  ATGACCCATA TCAAACCCGT CATTGCCGCG CTCGCACTCA TCGGGCTTGC
  51  CGCCTGCTCC GGCAGCAAAA CCGAACAGCC CAAGCTCGAC TACCAAAGCC
 101  GGTCGCACCG CCTGATCAAA CTCGAAGTCC CACCTGATTT GAAAAACGCC
 151  GACCAAGGCA ACCTCTACCG CCTGCCTGCC GGTTCGGGCG CCGTCCGCGC
 201  CAGCGATTTG GAAAAACGCC GCACACCCGC CGTCCAACAG CCTGCCGATG
 251  CCGAAGTATT GAAAAGCGTC AAAGGTGTCC GCCTCGAGCG CGACGGCAGC
 301  CAACGCTGGC TCGTTGTCGA CGGCAAGTCT CATGCCGAAA TCTGGCCGCT
 351  CCTGAAAGCC TTTTGGCAGG AAAACGGCTT CGACATCAAA TCCGAAGAAC
 401  CCGCCATCGG ACAAATGGAA ACCGAGTGGG CGGAAAACCG TGCCAAAATC
 451  CCCCAAGACA GCTTGCGCCG CCTATTCGAC ACAGTCGGTT TGGGCGGCAT
 501  CTACTCCACC GGCGAGCGCG ACAAATTCAT CGTCCGTATC GAACAGGGCA
 551  AAAACGGCGT TTCCGACATC TTCTTCGCCC ACAAAGCCAT GAAAGAAGTG
 601  TACGGCGGCA AAGACAAAGA CACGACCGTA TGGCAGCCCT CCCCGTCCGA
 651  TCCCAACCTC GAAGCCGCTT TCCTGACGCG CTTTATGCAA TATTTGGGCG
 701  TTGACGGACA GCAGGCGGAA AACGCATCGG CAAAAAAACC TACCCTTCCC
 751  GCCGCCAACG AAATGGCGCG TATCGAAGGC AAAAGCCTGA TTGTCTTTGG
 801  CGACTACGGC AGAAACTGGC GGCGCACCGC GCTCGCCCTC GACCGCATCG
 851  GGCTGACCGT CGTCGGTCAA AACACCGAAC GCCACGCTTT CCTGGTTCAA
 901  AAAGCCCCGA ACGAAAGCAA TGCAGTTACC GAACAAAAAC CCGGCCTGTT
 951  CAAACGCCTG CTGGGCAAAG GCAAAGCGGA GAAACCTGCC GAACAGCCGG
1001  AACTGATTGT CTATGCCGAG CCTGTCGCCA ACGGCTCGCG CATCGTCCTG
1051  CTCAACAAAG ACGGCAGCGC ATATGCCGGC AAAGACGCAT CCGCATTATT
1101  GGGCAAACTC CATTCCGAAC TGCGTTAA
```

This corresponds to the amino acid sequence <SEQ ID 1524; ORF 529.a>:

```
a529.pep
  1 MTHIKPVIAA LALIGLAACS GSKTEQPKLD YQSRSHRLIK LEVPPDLNNP
 51 DQGNLYRLPA GSGAVRASDL EKRRTPAVQQ PADAEVLKSV KGVRLERDGS
101 QRWLVVDGKS HAEIWPLLKA FWQENGFDIK SEEPAIGQME TEWAENRAKI
151 PQDSLRRLFD TVGLGGIYST GERDKFIVRI EQGKNGVSDI FFAHKAMKEV
201 YGGKDKDTTV WQPSPSDPNL EAAFLTRFMQ YLGVDGQQAE NASAKKPTLP
```

-continued

```
251 AANEMARIEG KSLIVFGDYG RNWRRTALAL DRIGLTVVGQ NTERHAFLVQ

301 KAPNESNAVT EQKPGLFKRL LGKGKAEKPA EQPELIVYAE PVANGSRIVL

351 LNKDGSAYAG KDASALLGKL HSELR*
```

m529/a529 99.2% identity in 375 aa overlap

```
                    10        20        30        40        50        60
m529.pep    MTHIKPVIAALALIGLAACSGSKTEQPKLDYQSRSHRLIKLEVPPDLNNPDQGNLYRLPA
            ||||||||||||||||||||||||||||||||||||||||||||||||||||||||||||
a529        MTHIKPVIAALALIGLAACSGSKTEQPKLDYQSRSHRLIKLEVPPDLNNPDQGNLYRLPA
                    10        20        30        40        50        60

70        80        90       100       110       120
m529.pep    GSGAVRASDLEKRRTPAVQQPADAEVLKSVKGVRLERDGSQRWLVVDGKSPAEIWPLLKA
            |||||||||||||||||||||||||||||||||||||||||||||||||| |||||||||
a529        GSGAVRASDLEKRRTPAVQQPADAEVLKSVKGVRLERDGSQRWLVVDGKSHAEIWPLLKA
                    70        80        90       100       110       120

130       140       150       160       170       180
m529.pep    FWQENGFDIKSEEPAIGQMETEWAENRAKIPQDSLRRLFDKVGLGGIYSTGERDKFIVRI
            |||||||||||||||||||||||||||||||||||||||| |||||||||||||||||||
a529        FWQENGFDIKSEEPAIGQMETEWAENRAKIPQDSLRRLFDTVGLGGIYSTGERDKFIVRI
                   130       140       150       160       170       180

190       200       210       220       230       240
m529.pep    EQGKNGVSDIFFAHKAMKEVYGGKDKDTTVWQPSPSDPNLEAAFLTRFMQYLGVDGQQAE
            ||||||||||||||||||||||||||||||||||||||||||||||||||||||||||||
a529        EQGKNGVSDIFFAHKAMKEVYGGKDKDTTVWQPSPSDPNLEAAFLTRFMQYLGVDGQQAE
                   190       200       210       220       230       240

250       260       270       280       290       300
m529.pep    NASAKKPTLPAANEMARIEGKSLIVFGDYGRNWRRYVLALDRIGLTVVGQNTERHAFLVQ
            ||||||||||||||||||||||||||||||||||||:|||||||||||||||||||||||
a529        NASAKKPTLPAANEMARIEGKSLIVFGDYGRNWRRYALALDRIGLTVVGQNTERHAFLVQ
                   250       260       270       280       290       300

310       320       330       340       350       360
m529.pep    KAPNESNAVTEQKPGLFKRLLGKGKAEKPAEQPELIVYAEPVANGSRIVLLNKDGSAYAG
            ||||||||||||||||||||||||||||||||||||||||||||||||||||||||||||
a529        KAPNESNAVTEQKPGLFKRLLGKGKAEKPAEQPELIVYAEPVANGSRIVLLNKDGSAYAG
                   310       320       330       340       350       360

370
m529.pep    KDASALLGKLHSELRX
            |||||||||||||||
a529        KDASALLGKLHSELRX
                   370
```

The following partial DNA sequence was identified in *N. gonorrhoeae* <SEQ ID 1525>:

```
g530.seq
  1 atgagtgcga gcgcggcaat gacgggtttg atatgggtca tcgtgtcatc

 51 ctgtgtgatg gatattaaag tgtttgtcat gttatgccgt ccgaacggtt

101 cagacggcat ggctatattt aaagttgtcc tgaggctttc agggcggcgc

151 ggacttttgc ctgtccgcct tccgtcagcg gaacgagcgg caggcgcacg

201 tgcggtccgc atccgcccaa ggcggatacc gcccatttcg gtgcggcggg

251 actgggttcg cagaacatgg tgtcgtaaat cggaatcagc cggtcgttga
```

This corresponds to the amino acid sequence <SEQ ID 1526; ORF 530.ng>:

```
g530.pep
  1 MSASAAMTGL IWVIVSSCVM DIKVFVMLCR PNGSDGMAIF KVVLRLSGRR

 51 GLLPVRLPSA ERAAGARAVR IRPRRIPPIS VRRDWVRRTW CRKSESAGR*
```

The following partial DNA sequence was identified in *N. meningitidis* <SEQ ID 1527>:

```
m530.seq
   1 wTGAGTGCGA GCGCGGCAAT GACGGGTyTG ATATGGGTCA TCGTGTCATC

  51 sTGTGTGATG GATATTAAAG TGTyTGTTGC GwTATGCCGT CCGAACGGTT

 101 CGGACGGCAT GGmTATATTT AAAGTTGTCC TGAGGCTTTC AGGGCGGCGC

 151 GGACTkTTGC wTGTCCGTTT yCCGTCAGCG GAACGAGCGG CAGGCGGACG

 201 TGCGGTTCGC ATCTGCCCAg GGCGGATACC GCCCATTTCG GTGCGGCGGG

 251 GCTGGGTTCG CAGAACATGG TGTCGTAAAT CGGAATCAGT CGGTCGTTGA
```

This corresponds to the amino acid sequence <SEQ ID 1528; ORF 530>:

```
m530.pep
   1 XSASAAMTGL IWVIVSSCVM DIKVXVAXCR PNGSDGMXIF KVVLRLSGRR

  51 GLLXVRFPSA ERAAGGRAVR ICPGRIPPIS VRRGWVRRTW CRKSESVGR*
```

Computer analysis of this amino acid sequence gave the following results:

Homology with a Predicted ORF from *N. gonorrhoeae*

ORF 530 shows 88.8% identity over a 98 aa overlap with a predicted ORF (ORF 530.ng) from *N. gonorrhoeae*:

```
m530/g530

m530.pep    XSASAAMTGLIWVIVSSCVMDIKVXVAXCRPNGSDGMXIFKVVLRLSGRRGLLXVRFPSA   60
             ||||||||||||||||||||||| |  ||||||||| ||||||||||||||| ||:|||
g530        MSASAAMTGLIWVIVSSCVMDIKVFVMLCRPNGSDGMAIFKVVLRLSGRRGLLPVRLPSA   60
                     10        20        30        40        50        60

m530.pep    ERAAGGRAVRICPGRIPPISVRRGWVRRTWCRKSESVGR   99
            |||||:||||| | ||||||||| ||||||||||||:||
g530        ERAAGARAVRIRPRRIPPISVRRDWVRRTWCRKSESAGR   99
```

The following partial DNA sequence was identified in *N. meningitidis* <SEQ ID 1529>:

```
a530.seq
   1 ATGAGTGCGA GCGCGGCAAT GACGGGTTTG ATATGGGTCA TCGTGTCATC

  51 CTGTGTGATG GATATTAAAG TGTTTGTTGC GTTATGCCGT CCGAACGGTT

 101 CGGACGGCAT GGCTATATTT AAAGTTGTCC TGAGGCTTTC AGGGCGGCGC

 151 GGACTTTTGC CTGTCCGCCT TCCGTCAGCG GAACGAGCGG CAGGCGGACG

 201 TGCGGTTCGC ATCTGCCCAG GGCGGATACC GCCCATTTCG GTGCGGCGGG

 251 GCTGGGTTCG CAGAACATGG TGTCGTAAAT CGGAATCAGC CGGTCGTTGA
```

This corresponds to the amino acid sequence <SEQ ID 1530; ORF 530.a>:

```
a530.pep
   1 MSASAAMTGL IWVIVSSCVM DIKVFVALCR PNGSDGMAIF KVVLRLSGRR

  51 GLLPVRLPSA ERAAGGRAVR ICPGRIPPIS VRRGWVRRTW CRKSESAGR*
```

m530/a530 93.9% identity in 98 aa overlap

```
                        10        20        30        40        50        60
m530.pep        XSASAAMTGLIWVIVSSCVMDIKVXVAXCRPNGSDGMXIFKVVLRLSGRRGLLXVRFPSA
                 ||||||||||||||||||||||| || ||||||||| ||||||||||||||| ||:|||
a530            MSASAAMTGLIWVIVSSCVMDIKVFVALCRPNGSDGMAIFKVVLRLSGRRGLLPVRLPSA
                        10        20        30        40        50        60

                        70        80        90       100
m530.pep        ERAAGGRAVRICPGRIPPISVRRGWVRRTWCRKSESVGRX
                ||||||||||||||||||||||||||||||||||||:|||
a530            ERAAGGRAVRICPGRIPPISVRRGWVRRTWCRKSESAGRX
                        70        80        90       100
```

The following partial DNA sequence was identified in *N. gonorrhoeae* <SEQ ID 1531>:

```
g531.seq
   1 ATGACCGCCC TACTCGTCAT CCTCGCCCTC GCCCTGATAG CCGTCGGCAC

  51 GGCAGGCATC GTCTATCCCG CCCTGCCCGG CTTGGCATTG ATGTTTGCCG

 101 GAACATGGCT GCTTGCCTAT GCCGGCGGCT ATCAAATCTA CGGCGCAGGC

 151 ATCTTGTGGA CGGTCGGACT CATCAGCCTT GGCGGCATAC TGGCGGACTA

 201 TATGGCAGGC ATGTTGGGGG TAAAATACAC TGGGGCAGGC AAACTCGCCG

 251 TCCGAGGTGC ATTGGCCGGC AGCATCATCG GCATATTTTT CTCCCTTCCC

 301 GGACTAATAC TCGGCCCCTT TATCGGCGCG GCGGCAGGCG AACTGATCGA

 351 TCGGCGCAAT ATGCTTCAGG CAGGTAAAGC GGGCTTGGGT ACGCTGTTGG

 401 GGCTTGTCGT CGGCACGGCG TTCAAAATCG GCTGCGCCGT ATCCATCTTG

 451 TTTATCCTGT TGGTGAAATA CATCGCATAC CTGTTTTAA
```

This corresponds to the amino acid sequence <SEQ ID 1532; ORF 531.ng>:

```
g531.pep
   1 MTALLVILAL ALIAVGTAGI VYPALPGLAL MFAGTWLLAY AGGYQIYGAG

  51 ILWTVGLISL GGILADYMAG MLGVKYTGAG KLAVRGALAG SIIGIFFSLP

 101 GLILGPFIGA AAGELIDRRN MLQAGKAGLG TLLGLVVGTA FKIGCAVSIL

 151 FILLVKYIAY LF
```

The following partial DNA sequence was identified in *N. meningitidis* <SEQ ID 1533>:

```
m531.seq
   1 ATGACCGTAC TGACCGTCAT CCTCGCCCTC GCCCTGATAG CCGTCGGCAC

  51 GGCGGGCATC GTTTaCCCCG CCCTGCCCGG ATTGGCATTG ATGTTTGCCG

 101 GAACATGGCT GCTTGCCTAT GCCGGCGGCT ACCAAATCTA CGGCGCGGGC

 151 GTTTTGTGGA CGGTCGGACT CATCAGCCTT GCCGGCATAC TGGCGGACTA

 201 TGTGGCAGGC ATATGGGGGA CAAAATATAC CGGAGCGGGC AAGCTCGCCG

 251 TTCGCGGCGC ATTGGCCGGC AGCATCATCG GCATATTTTT CTCCCTTCCC

 301 GGACTAATAC TCGGTCCCTT TATCGGCGCG GCGGCAGGCG AACTGATCGA

 351 ACGGCGCAAT ATGCTTCAGG CAGGTAAAGC GGGCTTGGGT ACGCTGTTGG
```

-continued

```
401 GGCTTGTCGT CGGCACGGCG TTCAAAATCG GCTGCGCnGT ATCCATCTTG

451 TTTATCCTGT TGGTGAaATA CATCGCCTAC CTGTTTTAA
```

This corresponds to the amino acid sequence <SEQ ID 1534; ORF 531>:

```
m531.pep
  1 MTVLTVILAL ALIAVGTAGI VYPALPGLAL MFAGTWLLAY AGGYQIYGAG

 51 VLWTVGLISL AGILADYVAG IWGTKYTGAG KLAVRGALAG SIIGIFFSLP

101 GLILGPFIGA AAGELIERRN MLQAGKAGLG TLLGLVVGTA FKIGCAVSIL

151 FILLVKYIAY LF*
```

Computer analysis of this amino acid sequence gave the following results:

Homology with a Predicted ORF from *N. gonorrhoeae*

ORF 531 shows 94.4% identity over a 162 aa overlap with a predicted ORF (ORF 531.ng) from *N. gonorrhoeae*:

```
m531/g531

                   10        20        30        40        50        60
m531.pep    MTVLTVILALALIAVGTAGIVYPALPGLALMFAGTWLLAYAGGYQIYGAGVLWTVGLISL
            ||:| |||||||||||||||||||||||||||||||||||||||||||||:|||||||||
g531        MTALLVILALALIAVGTAGIVYPALPGLALMFAGTWLLAYAGGYQIYGAGILWTVGLISL
                   10        20        30        40        50        60

                   70        80        90       100       110       120
m531.pep    AGILADYVAGIWGTKYTGAGKLAVRGALAGSIIGIFFSLPGLILGPFIGAAAGELIERRN
            :||||||:||: |:||||||||||||||||||||||||||||||||||||||||||:|||
g531        GGILADYMAGMLGVKYTGAGKLAVRGALAGSIIGIFFSLPGLILGPFIGAAAGELIDRRN
                   70        80        90       100       110       120

                  130       140       150       160
m531.pep    MLQAGKAGLGTLLGLVVGTAFKIGCAVSILFILLVKYIAYLF
            |||||||||||||||||||||||||||||||||||||||||
g531        MLQAGKAGLGTLLGLVVGTAFKIGCAVSILFILLVKYIAYLF
                  130       140       150       160
```

The following partial DNA sequence was identified in *N. meningitidis* <SEQ ID 1535>:

```
a531.seq
  1 ATGACCGCCT TGCTCGTCAT CCTCGCCCTC GCCCTGATAG CCGCCGGTAC

 51 GGCGGGCATC GTTTACCCCG CCCTGCCCGG ATTGGCATTG ATGTTTGCCG

101 GAACCTGGCT GCTCGCCTAC TCCGGCGGCT ACCAAATCTA CGGCGCGGGC

151 GTTTTGTGGA CGGTCGGACT CATCAGCCTT GCCGGCATAC TGGCGGACTA

201 TGTGGCAGGC ATATGGGGGA CAAAATATAC CGGAGCGGGC AAGCTCGCCG

251 TTCGCGGCGC ATTGGCCGGC AGCATCATCG GCATATTTTT CTCCCTTCCC

301 GGACTAATAC TCGGTCCCTT TATCGGCGCG GCGGCAGGCG AACTGATCGA

351 ACGGCGCAAT ATGCTTCAGG CAGGTAAAGC GGGCTTGGGT ACGCTGTTGG

401 GGCTTATCGT CGGTACGGCG TTCAAAATCG GCTGCGCCGT ATCCATCTTG

451 TTTATCCTGT TGGTGAAATA CATCGCCTAC CTGTTTTAA
```

This corresponds to the amino acid sequence <SEQ ID 1536; ORF 531.a>:

```
a531.pep
  1 MTALLVILAL ALIAAGTAGI VYPALPGLAL MFAGTWLLAY SGGYQIYGAG
```

-continued

```
 51 VLWTVGLISL AGILADYVAG IWGTKYTGAG KLAVRGALAG SIIGIFFSLP

101 GLILGPFIGA AAGELIERRN MLQAGKAGLG TLLGLIVGTA FKIGCAVSIL

151 FILLVKYIAY LF*
```

m531/a531 96.9% identity in 162 aa overlap

```
                       10        20        30        40        50        60
m531.pep       MTVLTVILALALIAVGTAGIVYPALPGLALMFAGTWLLAYAGGYQIYGAGVLWTVGLISL
               ||:| |||||||||:|||||||||||||||||||||||||:||||||||||||||||||
a531           MTALLVILALALIAAGTAGIVYPALPGLALMFAGTWLLAYSGGYQIYGAGVLWTVGLISL
                       10        20        30        40        50        60

                       70        80        90       100       110       120
m531.pep       AGILADYVAGIWGTKYTGAGKLAVRGALAGSIIGIFFSLPGLILGPFIGAAAGELIERRN
               ||||||||||||||||||||||||||||||||||||||||||||||||||||||||||||
a531           AGILADYVAGIWGTKYTGAGKLAVRGALAGSIIGIFFSLPGLILGPFIGAAAGELIERRN
                       70        80        90       100       110       120

                      130       140       150       160
m531.pep       MLQAGKAGLGTLLGLVVGTAFKIGCAVSILFILLVKYIAYLFX
               |||||||||||||||:|||||||||||||||||||||||||||
a531           MLQAGKAGLGTLLGLIVGTAFKIGCAVSILFILLVKYIAYLFX
                      130       140       150       160
```

The following partial DNA sequence was identified in *N. gonorrhoeae* <SEQ ID 1537>:

```
g532.seq (partial)
  1 atggctgaaa caatgaaaaa acaggcggat tcgcctgatt tggtgtacgg

 51 tttggaagac aggccgccgt tcggtaatgc gctcttgagc gcggttaccc

101 atcttttggc gattttcgtg ccgatgatta cgcccgcgct gattgtgggc

151 ggcgcgctgg aattgccggt ggagatgacg gcgtatctgg tgtcgatggc

201 gatggttgcg tcgggtgtcg gcacttattt gcaggtcaac cgcttcgggt

251 cggtcggctc ggggatgctg tccatccagc gttaccgtca tgattgcgct

301 cggcgcgggg atgaaagagg gcggtttgag ...
```

This corresponds to the amino acid sequence <SEQ ID 1538; ORF 532.ng>:

```
g532.pep (partial)
  1 MAETMKKQAD SPDLVYGLED RPPFGNALLS AVTHLLAIFV PMITPALIVG

 51 GALELPVEMT AYLVSMAMVA SGVGTYLQVN RFGSVGSGML SIQRYRHDCA

101 RRGDERGRFE ...
```

The following partial DNA sequence was identified in *N. meningitidis* <SEQ ID 1539>:

```
m532.seq
  1  ATGAGCGGTC AGTTGGGCAA AGGTGCGGAT GCGCCTGATT TGGTGTACGG

 51  TTTGGAAGAC AGGCCGCCGT TCGGTAATGC GCTCTTGAGC GCGGTTACCC

101  ATCTTTTGGC GATTTTTGTG CCGATGATTA CGCCCGCGCT GATTGTGGGC

151  GGCGCGCTGG AATTGCCGGT GGAGATGACG GCGTATCTCG TGTCGATGGC

201  GATGGTTGCG TCGGGTGTCG GCACTTATTT GCAGGTCAAC CGCTTCGGGC

251  CGGTCGGTTC GGGGATGCTG TCCATCCAGT CGGTGAATTT TTCGTTCGTT

301  ACCGTGATGA TTGCGCTGGG CGCGGGGATG AAAGAGGGCG GTTTGACTAA
```

-continued

```
 351 GGATGCGATG ATTTCGACGC TCTTGGGCGT ATCGTTTGTC GGCGCGTTTT

 401 TGGTGTGTTT CTCGGCGTGG CTTCTGCCGT ATTTGAAAAA AGTGATTACG

 451 CCGACGGTCA GCGGCGTGGT CGTGATGCTC ATTGGTTTGA GTTTGGTACA

 501 CGTCGGCATT ACCGATTTCG GCGGCGGCTT CGGCGCGAAG GCGGACGGCA

 551 CGTTCGGCTC GATGGAAAAC TTGGGGCTGG CATCGCTGGT GTTGCTGATT

 601 GTGTTGGTGT TCAACTGCAT GAAAAACCCG CTGTTGCGCA TGAGCGGCAT

 651 TGCGGTCGGG CTGATTGCCG GCTATATCGT CGCGCTGTTT TTGGGCAAGG

 701 TGGATTTTTC CGCGCTGCAA AACCTGCCGC TGGTTACGCT GCCCGTACCG

 751 TTTAAATACG GTTTTGCTTT CGACTGGCAC GCGTTTATTG TGGCGGGCGC

 801 GATTTTCTTG TTGAGCGTGT TTGAGGCGGT CGGCGATTTA ACCGCGACGG

 851 CAATGGTGTC CGACCAGCCG ATTGAAGGCG AGGAATACAC CAAACGCCTG

 901 CGCGGCGGCG TGTTGGCTGA CGGCTTGGTG TCGGTGATTG CGACGGCTTT

 951 GGGTTCGCTG CCGCTGACGA CGTTTGCGCA AAACAACGGC GTGATTCAGA

1001 TGACCGGCGT GGCTTCGCGC CATGTGGGCA AATATATTGC CGTGATTTTG

1051 GTGCTGTTGG GTCTGTTCCC CGTTGTCGGT CGCGCGTTTA CGACGATTCC

1101 GAGTCCGGTG TTGGGCGGCG CGATGGTTTT GATGTTCGGC TTAATTGCGA

1151 TTGCGGGCGT GCGGATTTTG GTCAGTCACG GCATCCGCAG GCGCGAAGCG

1201 GTGATTGCGG CAACGTCGGT CGGTTTGGGC TTGGGTGTCG CGTTTGAGCC

1251 GGAAGTGTTT AAAAACCTGC CCGTCTTGTT CCAAAACTCT ATTTCCGCCG

1301 GCGGCATTAC GGCAGTCTTG CTGAATTTGG TCTTGCCCGA AGATAAAACC

1351 GAGGCGGCGG TCAAGTTTGA TACCGACCAC TTGGAACACT GA
```

This corresponds to the amino acid sequence <SEQ ID 1540; ORF 532>.

```
m532.pep
  1 MSGQLGKGAD APDLVYGLED RPPFGNALLS AVTHLLAIFV PMITPALIVG

 51 GALELPVEMT AYLVSMAMVA SGVGTYLQVN RFGPVGSGML SIQSVNFSFV

101 TVMIALGAGM KEGGLTKDAM ISTLLGVSFV GAFLVCFSAW LLPYLKKVIT

151 PTVSGVVVML IGLSLVHVGI TDFGGGFGAK ADGTFGSMEN LGLASLVLLI

201 VLVFNCMKNP LLRMSGIAVG LIAGYIVALF LGKVDFSALQ NLPLVTLPVP

251 FKYGFAFDWH AFIVAGAIFL LSVFEAVGDL TATAMVSDQP IEGEEYTKRL

301 RGGVLADGLV SVIATALGSL PLTTFAQNNG VIQMTGVASR HVGKYIAVIL

351 VLLGLFPVVG RAFTTIPSPV LGGAMVLMFG LIAIAGVRIL VSHGIRRREA

401 VIAATSVGLG LGVAFEPEVF KNLPVLFQNS ISAGGITAVL LNLVLPEDKT

451 EAAVKFDTDH LEH*
```

Computer analysis of this amino acid sequence gave the following results:

Homology with a Predicted ORF from *N. gonorrhoeae*

ORF532 shows 91.4% identity over a 93 aa overlap with a predicted ORF (ORF 532.ng) from *N. gonorrhoeae*:

```
g532/m532
                      10        20        30        40        50        60
g532.pep    MAETMKKQADSPDLVYGLEDRPPFGNALLSAVTHLLAIFVPMITPALIVGGALELPVEMT
            |:  : | ||:|||||||||||||||||||||||||||||||||||||||||||||||||
m532        MSGQLGKGADAPDLVYGLEDRPPFGNALLSAVTHLLAIFVPMITPALIVGGALELPVEMT
                      10        20        30        40        50        60

70        80        90       100       110
g532.pep    AYKVSMAMVASGVGTYLQVNRFGSVGSGMLSIQRYRHDCARRGDERGRFEX
            ||||||||||||||||||||||| |||||||||
m532        AYKVSMAMVASGVGTYLQVNRFGPVGSGMLSIQSVNFSFVTVMIALGAGMKEGGLTKDAM
                      70        80        90       100       110       120
```

The following partial DNA sequence was identified in *N. meningitidis* <SEQ ID 1541>:

```
a532.seq
   1  ATGAGCGGTC AGTTGGGCAA AGGTGCGGAT GCGCCTGATT TGGTGTACGG

  51  TTTGGAGGAT AGGCCGCCGT TCGGTAATGC GCTCTTGAGC GCGGTTACCC

 101  ATCTTTTGGC GATTTTTGTG CCGATGATTA CGCCCGCGCT GATTGTGGGC

 151  GGCGCGCTGG AATTGCCGGT GGAGATGACG GCGTATCTCG TGTCGATGGC

 201  GATGGTTGCG TCGGGTGTCG GCACTTATTT GCAGGTCAAC CGCTTCGGGC

 251  CGGTCGGTTC GGGGATGCTG TCCATCCAGT CGGTGAATTT CTCGTTCGTT

 301  ACCGTCATGA TTGCGCTCGG CGCGGGGATG AAAGAGGGCG GTTTGACTAA

 351  GGATGCGATG ATTTCGACGC TCTTGGGCGT ATCGTTTGTC GGCGCGTTTT

 401  TGGTGTGTTT TTCGGCGTGG CTTCTGCCGT ATTTGAAAAA AGTGATTACG

 451  CCGACGGTCA GCGGTGTGGT GGTGATGCTG ATCGGCTTGA GTTTGGTACA

 501  CGTCGGTATT ACCGATTTCG GCGGCGGCTT CGGCGCAAAG GCGGACGGCA

 551  CGTTCGGCTC GATGGAAAAC TTGGGGCTGG CATCGCTGGT GCTGCTGATT

 601  GTGCTGGTGT TCAATTGCAT GAAAAACCCG CTGCTGCGGA TGAGCGGCAT

 651  TGCGGTCGGT CTGATTGCCG GCTATATCGT CGCGCTGTTT TTGGGCAAGG

 701  TGGATTTTTC GGCACTGCAA AACCTGCCGC TGGTTACGCT GCCCGTACCG

 751  TTTAAATATG GTTTTGCTTT TGACTGGCAC GCATTTATTG TGGCGGGTGC

 801  GATTTTCTTG TTGAGCGTGT TTGAGGCGGT CGGCGATTTG ACGGCGACGG

 851  CAATGGTGTC CGACCAGCCG ATTGAAGGCG AGGAATACAC CAAACGCTTG

 901  CGCGGCGGCG TGTTGGCGGA CGGCTTGGTG TCGGTGATTG CGACGGCTTT

 951  GGGTTCGCTG CCGCTGACGA CGTTTGCACA AAACAACGGC GTGATTCAGA

1001  TGACCGGCGT GGCTTCGCGC CATGTGGGCA AATATATTGC CGTGATTTTG

1051  GTGCTGTTGG GTCTGTTCCC CGTTGTCGGA CGCGCGTTTA CGACGATTCC

1101  GAGTCCGGTG TTGGGCGGCG CGATGGTTTT GATGTTCGGC TTGATTGCGA

1151  TTGCGGGCGT GCGGATTTTG GTCAGCCACG GCATCCGCAG GCGCGAAGCG

1201  GTAATTGCGG CAACGTCGGT CGGTTTGGGC TTGGGTGTCG CGTTTGAGCC

1251  GGAAGTGTTT AAAAACCTGC CCGTCTTGTT CCAAAACTCT ATTTCCGCCG

1301  GCGGCATTAC GGCAGTCTTG CTGAATTTGG TCTTGCCCGA AGATAAAACC

1351  GAGGCGGCGG TCAAGTTTGA TACCGACCAC TTGGAACACT GA
```

This corresponds to the amino acid sequence <SEQ ID 1542; ORF 532.a>:

```
a532.pep
   1 MSGQLGKGAD APDLVYGLED RPPFGNALLS AVTHLLAIFV PMITPALIVG

  51 GALELPVEMT AYLVSMAMVA SGVGTYLQVN RFGPVGSGML SIQSVNFSFV

 101 TVMIALGAGM KEGGLTKDAM ISTLLGVSFV GAFLVCFSAW LLPYLKKVIT

 151 PTVSGVVVML IGLSLVHVGI TDFGGGFGAK ADGTFGSMEN LGLASLVLLI

 201 VLVFNCMKNP LLRMSGIAVG LIAGYIVALF LGKVDFSALQ NLPLVTLPVP

 251 FKYGFAFDWH AFIVAGAIFL LSVFEAVGDL TATAMVSDQP IEGEEYTKRL

 301 RGGVLADGLV SVIATALGSL PLTTFAQNNG VIQMTGVASR HVGKYIAVIL

 351 VLLGLFPVVG RAFTTIPSPV LGGAMVLMFG LIAIAGVRIL VSHGIRRREA

 401 VIAATSVGLG LGVAFEPEVF KNLPVLFQNS ISAGGITAVL LNLVLPEDKT

 451 EAAVKFDTDH LEH*
```

m532/a532 100.0% identity in 463 aa overlap

```
                     10         20         30         40         50         60
    m532.pep  MSGQLGKGADAPDLVYGLEDRPPFGNALLSAVTHLLAIFVPMITPALIVGGALELPVEMT
              ||||||||||||||||||||||||||||||||||||||||||||||||||||||||||||
    a532      MSGQLGKGADAPDLVYGLEDRPPFGNALLSAVTHLLAIFVPMITPALIVGGALELPVEMT
                     10         20         30         40         50         60
        70         80         90        100        110        120
    m532.pep  AYLVSMAMVASGVGTYLQVNRFGPVGSGMLSIQSVNFSFVTVMIALGAGMKEGGLTKDAM
              ||||||||||||||||||||||||||||||||||||||||||||||||||||||||||||
    a532      AYLVSMAMVASGVGTYLQVNRFGPVGSGMLSIQSVNFSFVTVMIALGAGMKEGGLTKDAM
                     70         80         90        100        110        120
       130        140        150        160        170        180
    m532.pep  ISTLLGVSFVGAFLVCFSAWLLPYLKKVITPTVSGVVVMLIGLSLVHVGITDFGGGFGAK
              ||||||||||||||||||||||||||||||||||||||||||||||||||||||||||||
    a532      ISTLLGVSFVGAFLVCFSAWLLPYLKKVITPTVSGVVVMLIGLSLVHVGITDFGGGFGAK
                    130        140        150        160        170        180
       190        200        210        220        230        240
    m532.pep  ADGTFGSMENLGLASLVLLIVLVFNCMKNPLLRMSGIAVGLIAGYIVALFLGKVDFSALQ
              ||||||||||||||||||||||||||||||||||||||||||||||||||||||||||||
    a532      ADGTFGSMENLGLASLVLLIVLVFNCMKNPLLRMSGIAVGLIAGYIVALFLGKVDFSALQ
                    190        200        210        220        230        240
       250        260        270        280        290        300
    m532.pep  NLPLVTLPCPFKTGFAFDEHAFIVAGAIFLLSVFEAVGDLTATAMVSDQPIEGEEYRKRL
              ||||||||||||||||||||||||||||||||||||||||||||||||||||||||||||
    a532      NLPLVTLPCPFKTGFAFDEHAFIVAGAIFLLSVFEAVGDLTATAMVSDQPIEGEEYRKRL
                    250        260        270        280        290        300
       310        320        330        340        350        360
    m532.pep  RGGVLADGLVSVIATALGSLPLTTFAQNNGVIQMTGVASRHVGKYIAVILVLLGLFPVVG
              ||||||||||||||||||||||||||||||||||||||||||||||||||||||||||||
    a532      RGGVLADGLVSVIATALGSLPLTTFAQNNGVIQMTGVASRHVGKYIAVILVLLGLFPVVG
                    310        320        330        340        350        360
       370        380        390        400        410        420
    m532.pep  RAFTTIPSPVLGGAMVLMFGLIAIAGVRILVSHGIRRREAVIAATSVGLGLGVAFEPEVE
              ||||||||||||||||||||||||||||||||||||||||||||||||||||||||||||
    a532      RAFTTIPSPVLGGAMVLMFGLIAIAGVRILVSHGIRRREAVIAATSVGLGLGVAFEPEVE
                    370        380        390        400        410        420
       430        440        450        460
    m532.pep  KNLPVLFQNSISAGGITAVLLNLVLPEDKTEAAVKFDTDHLEHX
              |||||||||||||||||||||||||||||||||||||||||||
    a532      KNLPVLFQNSISAGGITAVLLNLVLPEDKTEAAVKFDTDHLEHX
                    430        440        450        460
```

The following partial DNA sequence was identified in *N. gonorrhoeae* <SEQ ID 1543>:

```
g535.seq
   1 atgccctttc ccgttttcag acaantattt gcttngtcct tgctacggtt

  51 ttttgccgta ggtcggattc tcgaatccga catttccaac agcggttttt
```

-continued

```
101 cggaaacgat aaacgcgtca aatgtttttt ttgtcggata cgaatatccg

151 gcctgcattt caaatttaca tcgcttccaa tttcgcaaac ttggtatcca

201 gttctttcac gccctgtttg ccgaagttga tggtcagtcg ggcggattcg

251 cctttgtctg cggcatcgat aatcacgccg gtgccgaatt tggcgtgacg

301 gacgttttgt ccgatgcgga agcctgcgta ggtttgcggc tgtttgaagt

351 catcgatgat tttgtcccgt tgtacggtgg tttggcgcgt gttgccgtag

401 ctgtcgaagg cgggtttttt gacggacagg tagtgcaata cttctggcgg

451 gatttcttcg acgaagcggg atgcgatgcc gaattgggtt tgtccgtgca

501 gcatgcgttg ctgtgccatg gtgatgtaga ggcgtttgcg ggcgcgggtg

551 atggcgacgt acatgaggcg gcgttcttct tcgaggccgc cgcgctcggc

601 aaggctcatt tcgctgggga aacgcccctc ttccataccg gtgaggaaga

651 cggcgttgaa ttccaagcct ttggcggcgt ggacggtcat cagttggacg

701 gctttttcgc ctgcccctgc ttggttttcg ccggattcga gggcggcgtt

751 gctcaagaag gcgaggatgg ggaaggcggg atcgtctga
```

This corresponds to the amino acid sequence <SEQ ID 1544; ORF 535.ng>:

```
g535.pep
   1 MPFPVFRQXF AXSLLRFFAV GRILESDISN SGFSETINAS NVFFVGYEYP

  51 ACISNLHRFQ FRKLGIQFFH ALFAEVDGQS GGFAFVCGID NHAGAEFGVT

 101 DVLSDAEACV GLRLFEVIDD FVPLYGGLAR VAVAVEGGFF DGQVVQYFWR

 151 DFFDEAGCDA ELGLSVQHAL LCHGDVEAFA GAGDGDVHEA AFFFEAAALG

 201 KAHFAGETPL FHTGEEDGVE FQAFGGVDGH QLDGFFACPC LVFAGFEGGV

 251 AQEGEDGEGG IV*
```

The following partial DNA sequence was identified in *N. meningitidis* <SEQ ID 1545>:

```
m535.seq
   1 aTGCCCTTtC CCGTTTTCAG ACGGCCTTTT GCTTTGTCCT TACTtACGTT

  51 TTTTGCCGTA AGTCAGATTC TTGTATCCGA CATTTCCAAC AGCGGTGTTT

 101 CGGAAACAAT AGACGCGTCA AATGTTTTTG TCGGATACGA ATATCCGACC

 151 TACATTTCAA ATTTACATCT CTTCCAATTT CGCAAACTTG GTGTCCAACT

 201 CTTTCACGCC CTGTTTGCCG AAATTGATGG TCAGTCGGGC GGATTCGCCT

 251 TTATCTGCGG CATCGATAAT CACGCCGGTG CCGAATTTGG CGTGGCGGAC

 301 GTTTTGTCCG ATACGGAAAC CTGCGTAGGT TTGGGGCTGT TTGTAGTCGT

 351 CGATGATTTT ATCTTTGGAT GCGGCGGTTT GGCGCGTGTT GCCGTAACTG

 401 TCGTAGGCAG GCTTTTTGAC GGACAGGTAG TGCAATACTT CGGGTGGGAT

 451 CTCTTCGACG AAGCGGGAGA CGATGCCGAA TTGGGTTTGT CCGTGCAGCA

 501 TGCGTTGTTG CGCCATGGTG ATGTAGAGGC GTTTGCGGGC GCGGGTGATG

 551 GCGACGTACA TGAGGCGGCG TTCTTCTTCG AGGCCGCCGC GTTCGGCAAG

 601 GCTCATTTCG CTGGGGAAGC GGCCTTCTTC CATGCCGGTG AGGAAGACGG

 651 CGTTAAATTC CAAGCCTTTG GCGGCGTGGA CGGTCATGAG TTGGACGGCC
```

-continued

```
701 TTTTCGCCTG CGCCTGCCTG GTTTTCACCG GATTCGAGGG CGGCATTGCT

751 TAGGAAGGCG AGAATGGGGA AGGCGGGGTC GTCTGA
```

This corresponds to the amino acid sequence <SEQ ID 1546; ORF 535>:

```
m535.pep
  1 MPFPVFRRPF ALSLLTFFAV SQILVSDISN SGVSETIDAS NVFVGYEYPT

 51 YISNLHLFQF RKLGVQLFHA LFAEIDGQSG GFAFICGIDN HAGAEFGVAD

101 VLSDTETCVG LGLFVVVDDF IFGCGGLARV AVTVVGRLFD GQVVQYFGWD

151 LFDEAGDDAE LGLSVQHALL RHGDVEAFAG AGDGDVHEAA FFFEAAAFGK

201 AHFAGEAAFF HAGEEDGVKF QAFGGVDGHE LDGLFACACL VFTGFEGGIA

251 XEGENGEGGV V*
```

Computer analysis of this amino acid sequence gave the following results:

Homology with a Predicted ORF from *N. gonorrhoeae*

ORF 535 shows 80.9% identity over a 262 aa overlap with a predicted ORF (ORF 535.ng) from *N. gonorrhoeae*:

```
m535/g535

                              10        20        30        40        50        59
m535.pep              MPFPVFRRPFALSLLTFFAVSQILVSDISNSGVSETIDASNVF-VGYEYPTYISNLHLFQ
                      |||||||: || ||| ||||::|| ||||||| ||||:||||| ||||||: ||||| ||
g535                  MPFPVFRQXFAXSLLRFFAVGRILESDISNSGFSETINASNVFFVGYEYPACISNLHRFQ
                              10        20        30        40        50        60

                     60        70        80        90       100       110       119
m535.pep              FRKLGVQLFHALFAEIDGQSGGFAFICGIDNHAGAEFGVADVLSDTETCVGLGLFVVVDD
                      |||||:|:|||||||:|||||||||:|||||||||||||:|||||:|:|||| || |:||
g535                  FRKLGIQFFHALFAEVDGQSGGFAFVCGIDNHAGAEFGVTDVLSDAEACVGLRLFEVIDD
                              70        80        90       100       110       120

                    120       130       140       150       160       170       179
m535.pep              FIFGCGGLARVAVTVVGRLFDGQVVQYFGWDLFDEAGDDAELGLSVQHALLRHGDVEAFA
                      |:   ||||||||:| | :|||||||||  |:||||| ||||||||||||| ||||||||
g535                  FVPLYGGLARVAVAVEGGFFDGQVVQYFWRDFFDEAGCDAELGLSVQHALLCHGDVEAFA
                             130       140       150       160       170       180

                    180       190       200       210       220       230       239
m535.pep              GAGDGDVHEAAFFFEAAAFGKAHFAGEAAFFHAGEEDGVKFQAFGGVDGHELDGLFACAC
                      ||||||||||||||||||:||||||||: :||:||||||:||||||||||:|||:||| |
g535                  GAGDGDVHEAAFFFEAAALGKAHFAGETPLFHTGEEDGVEFQAFGGVDGHQLDGFFACPC
                             190       200       210       220       230       240

                    240       250       260
m535.pep              LVFTGFEGGIAXEGENGEGGVV
                      |||:|||||:| |||:||||:|
g535                  LVFAGFEGGVAQEGEDGEGGIV
                             250       260
```

The following partial DNA sequence was identified in *N. meningitidis* <SEQ ID 1547>:

```
a535.seq (partial)
  1 TTCAGACGGC CTTTTGCCTT GTCCTTGCTA CAGTTTTTTG CCATAGGTCG

 51 GATTCTCGAA TCCGACATTT CCAACAGCGG TTTTTCGGAA ACGATAGACG

101 CGTCAAATAT TTTTGTCGGA TACGAGTATC CAGCCTGCAT TTCAAATTTA

151 CATCGCTTCC AATTTCGCAA ACTTGGTGTC CAACTCTTTC ACGCCCTGTT

201 TGCCGAAATT GATGGTCAGT CGGGCGGATT CGCCTTTATC TGCGGCATCG

251 ATAATCACGC CGGTGCCGAA TTTGGCGTGG CGGACGTTTT GTCCGATACG

301 GAAACCTGCG TAGGTTTGGG GCTGTTTGTA GTCGTCGATG ATTTTGTCTT
```

-continued

```
351 TGGGCGCGGC GGTTTGGCGC GTGTTGCCAT AGCGGTCGTA GGCGGGTTTT

401 TTGACGGACA GGTAGTGCAA TACTTCGGGC GGGATTTCTT CGACGAAGCG

451 GGAGACGATG CCGAATTGGG TTTGTCCGTG CAGCATGCGT TGTTGCGCCA

501 TGGTGATGTA GAGGCGTTTG CGGGCGCGGG TGATGGCGAC GTACATCAGG

551 CGGCGTTCTT CTTCGAGGCC GCCGCGTTCG GCAAGGCTCA TTTCGCTGGG

601 GAAGCGGCCT TCTTCCATGC CGGTGAGGAA TACGGCGTTA AATTCCAAGC

651 CTTTGGCGGC GTGCACGGTC ATGAGTTGTA CGGCTTTTTC GCCCGCGCCT

701 GCTTGGTTTT CGCCGGATTC GAGAGCAGCA TTGCTTAGGA AAGCGAGGAT

751 GGGGAAGGCG GGGTCGTCTG A
```

This corresponds to the amino acid sequence <SEQ ID 1548; ORF 535.a>:

```
a535.pep (partial)
  1 FRRPFALSLL QFFAIGRILE SDISNSGFSE TIDASNIFVG YEYPACISNL

 51 HRFQFRKLGV QLFHALFAEI DGQSGGFAFI CGIDNHAGAE FGVADVLSDT

101 ETCVGLGLFV VVDDFVFGRG GLARVAIAVV GGFFDGQVVQ YFGRDFFDEA

151 GDDAELGLSV QHALLRHGDV EAFAGAGDGD VHQAAFFFEA AAFGKAHFAG

201 EAAFFHAGEE YGVKFQAFGG VHGHELYGFF ARACLVFAGF ESSIA*ESED

251 GEGGVV*
```

m535/a535 88.7% identity in 256 aa overlap

```
                       10        20        30        40        50        60
m535.pep       MPFPVFRRPFALSLLTFFAVSQILVSDISNSGVSETIDASNVFVGYEYPTYISNLHLFQF
                    |||||||||| |||:::|| ||||||| ||||||||:||||||||: ||||| |||
a535                FRRPFALSLLQFFAIGRILESDISNSGFSETIDASNIFVGYEYPACISNLHRFQF
                            10        20        30        40        50

                       70        80        90       100       110       120
m535.pep       RKLGVQLFHALFAEIDGQSGGFAFICGIDNHAGAEFGVADVLSDTETCVGLGLFVVVDDF
               ||||||||||||||||||||||||||||||||||||||||||||||||||||||||||||
a535           RKLGVQLFHALFAEIDGQSGGFAFICGIDNHAGAEFGVADVLSDTETCVGLGLFVVVDDF
                  60        70        80        90       100       110

                      130       140       150       160       170       180
m535.pep       IFGCGGLARVAVTVVGRLFDGQVVQYFGWDLFDEAGDDAELGLSVQHALLRHGDVEAFAG
               :|| ||||||::||| :||||||||||| |:|||||||||||||||||||||||||||||
a535           VFGRGGLARVAIAVVGGFFDGQVVQYFGRDFFDEAGDDAELGLSVQHALLRHGDVEAFAG
                 120       130       140       150       160       170

                      190       200       210       220       230       240
m535.pep       AGDGDVHEAAFFFEAAAFGKAHFAGEAAFFHAGEEDGVKFQAFGGVDGHELDGLFACACL
               |||||||:||||||||||||||||||||||||||| |||||||||| |||| |:|| |||
a535           AGDGDVHQAAFFFEAAAFGKAHFAGEAAFFHAGEEYGVKFQAFGGVHGHELYGFFARACL
                 180       190       200       210       220       230

                      250       260
m535.pep       VFTGFEGGIAXEGENGEGGVVX
               ||:|||::||||:|:|||||||
a535           VFAGFESSIAXESEDGEGGVVX
                 240       250
```

The following partial DNA sequence was identified in *N. gonorrhoeae* <SEQ ID 1549>:

```
g537.seq
   1  atgaaatccc tttttatttg gctgcttcta ttgggctcgg cggcaggcgt

  51  tttctaccat acccaaaacc aatccctgcc cgcgggcgaa cttgtctatc

 101  cgtccgcacc gcaaatcagg gacggcggcg atgcgctgca ctacctcaac

 151  cgcatccgca cacaaatcgg tttgcacgcg ctggcacacg cgccggtttt
```

-continued

```
 201 ggaaaattcc gcccgcaggc acgcacgcta tctcacgctc aatcccgaag
 251 acggacacgg cgaacaccat cccgacaatc cgcactacac cgcacaaaag
 301 ctgaccgaac gcacacgcct tgccgggtat ctctacaacg gcgtgcatga
 351 aaacatcagc acggaagagg aagccgccga atcgtccgac agcgacatcc
 401 gcacgcagca acgccaagtg gacgctttga tgagcgcaat ctaccaccgc
 451 ctttcgctgc ttgaccgcca taccgacgaa gcaggtgcgg catttgtgcg
 501 cgaaaacggc aaaaccgtcc tcgtattcaa tcagggcaac ggcagcttcg
 551 agcgcgcctg tgcaaaagga aggcggcagc cggaagcagg acggaaatat
 601 taccgcaacg cttgccacaa cggtgcggcc gtttatgctg acgaagccat
 651 gcccgtaacg gaattgcttt ataccgccta tccggttggc ggcggcgcgc
 701 tgccttattt ttacggggaa cgtcccgacc ccgtgccgga atatgaaatc
 751 acaggcaatc ctgccagcat tgatttttcc gaggcggcag gcaaaattgc
 801 gatgaaaagt ttcaagctgt atcagggtaa aaacgaaatc cgccccgtca
 851 gggttttaac cgccggcaac gaccctaacg gcaggctgac cgcgcaccaa
 901 ttcgcccttt tcccgctcaa acctttggaa tacggcacgc tttatacggc
 951 ggtattcgac tatgtccgca acggacggca cgcgcaggcg aaatggcagt
1001 ttagaacccg aaaacccgat tacccttatt ttgaggtaaa cggcggcgag
1051 acacttgcgg ttagaaaagg cgaaaaatat ttcatccact ggcgcggacg
1101 ctggtgtctg gaagcgtgta cccgttatac ctaccggcgg cagttcggca
1151 acagcctgtc catactccgg cacgaagcgg gcggcattgt cttcagcgtc
1201 agcggaatgg cgggaagccg catcaggctt actccggaag acagcccgga
1251 acgcggtgta accctttatt tgcaggattg a
```

This corresponds to the amino acid sequence <SEQ ID 1550; ORF 537.ng>:

```
g537.pep
  1 MKSLFIWLLL LGSAAGVFYH TQNQSLPAGE LVYPSAPQIR DGGDALHYLN
 51 RIRTQIGLHA LAHAPVLENS ARRHARYLTL NPEDGHGEHH PDNPHYTAQK
101 LTERTRLAGY LYNGVHENIS TEEEAAESSD SDIRTQQRQV DALMSAIYHR
151 LSLLDRHTDE AGAAFVRENG KTVLVFNQGN GSFERACAKG RRQPEAGRKY
201 YRNACHNGAA VYADEAMPVT ELLYTAYPVG GGALPYFYGE RPDPVPEYEI
251 TGNPASIDFS EAAGKIAMKS FKLYQGKNEI RPVRVLTAGN DPNGRLTAHQ
301 FALFPLKPLE YGTLYTAVFD YVRNGRHAQA KWQFRTRKPD YPYFEVNGGE
351 TLAVRKGEKY FIHWRGRWCL EACTRYTYRR QFGNSLSILR HEAGGIVFSV
401 SGMAGSRIRL TPEDSPERGV TLYLQD *
```

The following partial DNA sequence was identified in *N. meningitidis* <SEQ ID 1551>:

```
m537.seq (partial)
  1 ATGAAATCCC TTTTTATTCG GCTGCTCCTG TTGGGTTCGG CGGCAGGCGT
 51 TTTCTACCAT ACCCAAAmCC AATCCCTGCC CGCGGGCGAA CTTGTCTATC
101 CGTCCGCACC GCAAATCAGG GACGGCGGCG ATGCGCTGCA CTACCTCAAC
```

-continued

```
151 CGCATCCGAG CCCAAATCGG TTTGCACAAG CTGGCACACG CGCCGGTTTT

201 GGAAAACTCC GCCCGCAgGC ACGCAAGCTA CCTCACGCTC AATCCCGAAG

251 ACGGACACGG CGAACACCAT CCCGACAATC CGCACTACAC CGCACAAAAG

301 CTGACCGAAC GCACACGCCT TGCCGGGTAT CTCTACAACG GCGTGCATGA

351 AAACATCAGC ACGGAAGAAG AAGCCGCCGA ATCGTCCGAC AGCGACATCC

401 GCACGCAGCA ACGCCAAGTG GACGGATTAA TGAGCGCAAT CTACCACCGC

451 CTTTCCCTAC TTGACCGCCA TACGGATGAG TCAGGAGCGG CATT...
```

This corresponds to the amino acid sequence <SEQ ID 1552; ORF 537>:

```
m537.pep (partial)
  1 MKSLFIRLLL LGSAAGVFYH TQXQSLPAGE LVYPSAPQIR DGGDALHYLN

 51 RIRAQIGLHK LAHAPVLENS ARRHASYLTL NPEDGHGEHH PDNPHYTAQK

101 LTERTRLAGY LYNGVHENIS TEEEAAESSD SDIRTQQRQV DGLMSAIYHR

151 LSLLDRHTDE SGAA...
```

Computer analysis of this amino acid sequence gave the following results:

Homology with a Predicted ORF from *N. gonorrhoeae*

ORF 537 shows 95.7% identity over a 164 aa overlap with a predicted ORF (ORF 537.ng) from *N. gonorrhoeae*:

```
m537/g537

                  10        20        30        40        50        60
m537.pep    MKSLFIRLLLLGSAAGVFYHTQXQSLPAGELVYPSAPQIRDGGDALHYLNRIRAQIGLHK
            |||||| ||||||||||||||| ||||||||||||||||||||||||||||||:|||||
g537        MKSLFIWLLLLGSAAGVFYHTQNQSLPAGELVYPSAPQIRDGGDALHYLNRIRTQIGLHA
                  10        20        30        40        50        60

70        80        90       100       110       120
m537.pep    LAHAPVLENSARRHASYLTLNPEDGHGEHHPDNPHYTAQKLTERTRLAGYLYNGVHENIS
            |||||||||||||| ||||||||||||||||||||||||||||||||||||||||||||
g537        LAHAPVLENSARRHARYLTLNPEDGHGEHHPDNPHYTAQKLTERTRLAGYLYNGVHENIS
                  70        80        90       100       110       120

130       140       150       160       170       180
m537.pep    TEEEAAESSDSDIRTQQRQVDGLMSAIYHRLSLLDRHTDESGAA
            ||||||||||||||||||||:|||||||||||||||||:|||
g537        TEEEAAESSDSDIRTQQRQVDALMSAIYHRLSLLDRHTDEAGAAFVRENGKTVLVFNQGN
                 130       140       150       160       170       180

g537        GSFERACAKGRRQPEAGRKYYRNACHNGAAVYADEAMPVTELLYTAYPVGGGALPYFYGE
                 190       200       210       220       230       240
```

The following partial DNA sequence was identified in *N. meningitidis* <SEQ ID 1553>:

```
a537.seq
  1 ATGAAATCCC TTTTTATTCG GCTGCTCCTG TTGGGTTCGG CGGCCGGCGT

 51 TTTCTATCAT ACCCAAAACC AATCCCTGCC CGCGGGCGAA CTTGTCTATC

101 CGTCCGCACC GCAAATCAGG GACGGCGGCG ATGCGCTGCA CTACCTCAAC

151 CGCATCCGCG CCCAAATCGG TTTGCACAAG CTGGCACACG CGCCGGTTTT

201 GGAAAATTCC GCCCGCAGGC ACGCACGCTA TCTCACGCTC AATCCCGAAG

251 ACGGACACGG CGAACACCAT CCCGACAATC CGCACTACAC CGCACAAAAG

301 CTGACCGAAC GCACACGCCT TGCCGGGTAT CTCTACAACG GCGTGCATGA

351 AAACATCAGC ACGGAAGAGG AAGCCGCCGA ATCGTCCGAC AGCGACATCC
```

-continued

```
 401 GCACGCAGCA ACGCCAAGTG GACGGATTAA TGAGCGCAAT CTACCACCGC

 451 CTTTCCCTAC TTGACCGCCA TACGGATGAG GCAGGAGCGG CATTTGTGCG

 501 CGAAAACGGT AAAACCGTTC TCGTATTCAA TCAGGGCAAC GGCAGGTTTG

 551 AGCGGCATTG CGCCCAAGGC AGAAATCAGC CGGAAGCAGG ACGGAAATAT

 601 TACCGCAACG CCTGCCATAA CGGTGCGGTC GTGTACACCG ACGAAGCCAT

 651 GCCCGCACAG GAGCTGCTCT ATACAGCCTA TCCCGTCGGC AACGGCGCAC

 701 TGCCTTATTT CCACGGCGAG CGTCCAGACC CCGTGCCGGA ATATGAAATC

 751 ACGGGCAATC CTGCCAGCAT TGATTTTTCC GAGGCGGCAG GCAAAATTAC

 801 GATGAAAAGT TTCAAGCTGT ATCAGGGTAA AAACGAAATC CGCCCCGTCA

 851 GGGTTTTAAC CGCCGGCAAC GACCCCAACG GCAGGCTGAC CGCGTACCAA

 901 TTCGCGCTTT TCCCGCTCAA GCCTTTGGAA TACGGTACGC TTTATACGGC

 951 GGTATTCGAC TATGTCCGCA ACGGACGGCG CGCGCAGGCG AAATGGCAGT

1001 TTAGAACCCG AAAACCCGAT TACCCTTATT TTGAGGTAAA CGGCGGCGAG

1051 ACACTTGCGG TTAGAAAAGG CGAAAAATAT TTCATCCACT GGCGCGGACG

1101 CTGGTGTTTG GAAGCGTGTA CCCGTTATAC CTACCGGCAG CGACCCGGCA

1151 GCCGCCTGTC CATAGGAAGG CACAAGGCGG GCGGCATCGT CTTCAGCGTT

1201 GACGGAATGG CGGGCAGCCG CATCACGCTT GCACCGGAAG GAGAAACGGA

1251 ACGAGGCGTA ACCCTTTATT TACAGGATTG A
```

This corresponds to the amino acid sequence <SEQ ID 1554; ORF 537.a>:

```
a537.pep
  1 MKSLFIRLLL LGSAAGVFYH TQNQSLPAGE LVYPSAPQIR DGGDALHYLN

 51 RIRAQIGLHK LAHAPVLENS ARRHARYLTL NPEDGHGEHH PDNPHYTAQK

101 LTERTRLAGY LYNGVHENIS TEEEAAESSD SDIRTQQRQV DGLMSAIYHR

151 LSLLDRHTDE AGAAFVRENG KTVLVFNQGN GRFERHCAQG RNQPEAGRKY

201 YRNACHNGAV VYTDEAMPAQ ELLYTAYPVG NGALPYFHGE RPDPVPEYEI

251 TGNPASIDFS EAAGKITMKS FKLYQGKNEI RPVRVLTAGN DPNGRLTAYQ

301 FALFPLKPLE YGTLYTAVFD YVRNGRRAQA KWQFRTRKPD YPYFEVNGGE

351 TLAVRKGEKY FIHWRGRWCL EACTRYTYRQ RPGSRLSIGR HKAGGIVFSV

401 DGMAGSRITL APEGETERGV TLYLQD*
```

m537/a537 98.2% identity in 164 aa overlap

```
                    10        20        30        40        50        60
m537.pep    MKSLFIRLLLLGSAAGVFYHTQXQSLPAGELVYPSAPQIRDGGDALHYLNRIRAQIGLHK
            |||||||||||||||||||||| |||||||||||||||||||||||||||||||||||||
a537        MKSLFIRLLLLGSAAGVFYHTQNQSLPAGELVYPSAPQIRDGGDALHYLNRIRAQIGLHA
                    10        20        30        40        50        60

70        80        90       100       110       120
m537.pep    LAHAPVLENSARRHASYLTLNPEDGHGEHHPDNPHYTAQKLTERTRLAGYLYNGVHENIS
            ||||||||||||||| ||||||||||||||||||||||||||||||||||||||||||||
a537        LAHAPVLENSARRHARYLTLNPEDGHGEHHPDNPHYTAQKLTERTRLAGYLYNGVHENIS
                    70        80        90       100       110       120

130       140       150       160       170       180
m537.pep    TEEEAAESSDSDIRTQQRQVDGLMSAIYHRLSLLDRHTDESGAA
            ||||||||||||||||||||||||||||||||||||||||:|||
a537        TEEEAAESSDSDIRTQQRQVDGLMSAIYHRLSLLDRHTDEAGAAFVRENGKTVLVFNQGN
                   130       140       150       160       170       180
```

-continued

```
a537       GRFERACAQGRNQPEAGRKYYRNACHNGAVVYADEAMPAQELLTYAYPVGNGALPYFHGE
                 190       200       210       220       230       240
```

The following partial DNA sequence was identified in *N. gonorrhoeae* <SEQ ID 1555>:

```
g538.seq
   1 atgtcaggta gaacaggacg gaacagtgcc actcaggcgc aaccggaacg

  51 cgtcatgctg gtgggcgtaa tgttggataa agatgatacg ggcagcaatg

 101 ccgcccgtct gaacggtttt cagacggcat tggcggaagc cgtcgagctg

 151 gtcaaagcgg cgggcggcga ttccgtacgc gtggagactg ccaaacgcga

 201 ccgcccgcac actgcgctgt ttgtcggcac gggcaaggcg gcggagctgt

 251 cggaagcagt tgccgcagac ggcattgatt tggtcgtatt caaccacgaa

 301 cttactccca cgcaggaacg caatttggaa aaaatcctcc aatgccgcgt

 351 attggacaga gtggggctga ttctggcgat tttcgcccgc cgcgcccgca

 401 cgcaggaagg caggctgcaa gtcgagttgg cgcaattgag ccatttggcg

 451 ggacgcttga tacgcggtta cggacatttg caaagccagc gcggcggtat

 501 cggcatgaaa gggccgggcg aaaccaaact ggaaaccgac cgccgattaa

 551 ccgcccatcg gatcaacgcc ttgaaaaaac agcttgccaa cctcaaaaaa

 601 cagcgcgccc tgcgccgcaa gtcccgcgag tcgggcagaa tcaaaacgtt

 651 tgcgctggtc ggctatacca atgtcggcaa atccagcctg ttcaaccggc

 701 tgaccaagtc gggcatatat gcgaaagacc agcttttcgc cactctcgac

 751 acgacggcgc ggcggctgta catcagtccc gcatgcagca ttatcctgac

 801 cgataccgtc ggattcgtca gcgatctgcc gcacaaactg atttccgcct

 851 tttccgccac cttggaagaa accgtgcaag ccgatgtgct gctgcacgtc

 901 gtcgatgctg ccgcccggaa cagcgggcag cagattgaag acgtggaaaa

 951 cgtactgcaa gaaatccatg cccacgatat tccgtgcatc aaggtgtaca

1001 acaaaaccga cctgctgccg tctgaagaac aaaacacggg catatggcgc

1051 gacgctgcgg gaaaaattgc cgccgtccgc atttccgttg ctgaaaatac
```

This corresponds to the amino acid sequence <SEQ ID 1556; ORF 538.ng>:

```
g538.pep
   1 MSGRTGRNSA TQAQPERVML VGVMLDKDDT GSNAARLNGF QTALAEAVEL

  51 VKAAGGDSVR VETAKRDRPH TALFVGTGKA AELSEAVAAD GIDLVVFNHE

 101 LTPTQERNLE KILQCRVLDR VGLILAIFAR RARTQEGRLQ VELAQLSHLA

 151 GRLIRGYGHL QSQRGGIGMK GPGETKLETD RRLTAHRINA LKKQLANLKK

 201 QRALRRKSRE SGRIKTFALV GYTNVGKSSL FNRLTKSGIY AKDQLFATLD

 251 TTARRLYISP ACSIILTDTV GFVSDLPHKL ISAFSATLEE TVQADVLLHV

 301 VDAAARNSGQ QIEDVENVLQ EIHAHDIPCI KVYNKTDLLP SEEQNTGIWR

 351 DAAGKIAAVR ISVAENTGID ALREAIAEYC AAAPNTDETE MP*
```

The following partial DNA sequence was identified in *N. meningitidis* <SEQ ID 1557>:

```
m538.seq
   1 ATGACAGGCA GAACAGGCGG CAACGGCAGT ACCCAAGCGC AACCCGAACG
  51 CGTCATGCTG GTGGGCGTAA TGTTGGACAA AGATGGTACG GGCAGTAGTG
 101 CCGCCCGTCT GAACGGTTTT CAGACGGCAT TGGCGGAAGC TGTCGAGCTG
 151 GTCAAAGCGG CGGGCGGCGA TTCCGTGCGC GTGGAGACTG CCAAACGCGA
 201 CCGTCCGCAC ACCGCGCTGT TTGTCGGCAC GGGCAAGGCG GCGGAGCTGT
 251 CAGAAGCAGT TGCCGCAGAC GGCATCGATT TGGTCGTATT CAACCACGAA
 301 CTCACGCCCA CGCAGGAACG CAACCTTGAA AAAGAACTsA AATGCCGCGT
 351 ATTGGACAGG GTAGGGCTGA TTCTGGCGAT TTTCGCTCGC CGCGCCCGCA
 401 CGCAGGAAGG CAGGCTGCAA GTCGAGTTGG CGCAATTGAG CCATTTGGCG
 451 GGACGCTTGA TACGCGGTTA CGGCCATCTG CAGAGCCAGC GCGGCGGTAT
 501 CGGCATGAAA GGCCCCGGCG AAACCAAACT GGAAACCGAC CGCCGATTGA
 551 TCGCCCATCG GATCAATGCC TTGATAAAAC AGCTTGCCAA CCTCAAAAAA
 601 CAGCGCGCCC TGCGCCGCAA GTCnCGCGAA TCGGGCACAA TCAAAACGTT
 651 TGCGCTGGTC GGCTATACAA ATGTCGGAAA ATCCAGCCTG TTCAACCGGC
 701 TGACAAAGTC GGGCATATAT GCAAAGGACA AGCTTAGTCC CGAATGCAGC
 751 ATTATCCTGA CCGATACCGT CGGATTCGTn AGCGATCTGC CGCAcAAACT
 801 GATTTCCGCC TTTTCgCC.A CGCTGGAAGA AACCGCGCAA GCCGATGTGC
 851 TGCTGCACGT CGTCGATGCC GCCGCTCCGA ACAGCGGACA GCAGATTGAA
 901 GACGTGGAAA ACGTACTGCA AGAAATCCAT GCCGGCGATA TTCCGTGCAT
 951 cAAGGTGTAC AACAAAACCG ACCTGCTGCC GTCTGAAGAA CAAAACACGG
1001 GCATATGGCG CGACGCTGCG GGAAAAATTG CCGCCGTCCG CATTTCCGTT
1051 GCTGAAAATA CCGGTATAGA CGCACTGCGC GAAGCcATTG CCGAGTCTTG
1101 TGCCGCCGCA CCAAACACAG ACGAAACCGA AATGCCATGA
```

This corresponds to the amino acid sequence <SEQ ID 1558; ORF 538>:

```
m538.pep
  1 MTGRTGGNGS TQAQPERVML VGVMLDKDGT GSSAARLNGF QTALAEAVEL
 51 VKAAGGDSVR VETAKRDRPH TALFVGTGKA AELSEAVAAD GIDLVVFNHE
101 LTPTQERNLE KELKCRVLDR VGLILAIFAR RARTQEGRLQ VELAQLSHLA
151 GRLIRGYGHL QSQRGGIGMK GPGETKLETD RRLIAHRINA LIKQLANLKK
201 QRALRRKSRE SGTIKTFALV GYTNVGKSSL FNRLTKSGIY AKDKLSPECS
251 IILTDTVGFV SDLPHKLISA FSXTLEETAQ ADVLLHVVDA AAPNSGQQIE
301 DVENVLQEIH AGDIPCIKVY NKTDLLPSEE QNTGIWRDAA GKIAAVRISV
351 AENTGIDALR EAIAESCAAA PNTDETEMP*
```

Computer analysis of this amino acid sequence gave the following results:

Homology with a Predicted ORF from *N. gonorrhoeae*

ORF 538 shows 92.1% identity over a 392 aa overlap with a predicted ORF (ORF 538.ng) from *N. gonorrhoeae*:

```
m538/g538

                        10        20        30        40        50        60
m538.pep        MTGRTGGNGSTQAQPERVMLVGVMLDKDGTGSSAARLNGFQTALAEAVELVKAAGGDSVR
                |:|||| |::|||||||||||||||||| |||:|||||||||||||||||||||||||||
g538            MSGRTGRNSATQAQPERVMLVGVMLDKDDTGSNAARLNGFQTALAEAVELVKAAGGDSVR
                        10        20        30        40        50        60

                        70        80        90       100       110       120
m538.pep        VETAKRDRPHTALFVGTGKAAELSEAVAADGIDLVVFNHELTPTQERNLEKELKCRVLDR
                ||||||||||||||||||||||||||||||||||||||||||||||||||| |:||||||
g538            VETAKRDRPHTALFVGTGKAAELSEAVAADGIDLVVFNHELTPTQERNLEKILQCRVLDR
                        70        80        90       100       110       120

                       130       140       150       160       170       180
m538.pep        VGLILAIFARRARTQEGRLQVELAQLSHLAGRLIRGYGHLQSQRGGIGMKGPGETKLETD
                ||||||||||||||||||||||||||||||||||||||||||||||||||||||||||||
g538            VGLILAIFARRARTQEGRLQVELAQLSHLAGRLIRGYGHLQSQRGGIGMKGPGETKLETD
                       130       140       150       160       170       180

                       190       200       210       220       230       240
m538.pep        RRLIAHRINALIKQLANLKKQRALRRKSRESGTIKTFALVGYTNVGKSSLFNRLTKSGIY
                ||| ||||||| ||||||||||||||||||||| ||||||||||||||||||||||||||
g538            RRLTAHRINALKKQLANLKKQRALRRKSRESGRIKTFALVGYTNVGKSSLFNRLTKSGIY
                       190       200       210       220       230       240

                                    250       260       270       280
m538.pep        AKDKL-------------SPECSIILTDTVGFVSDLPHKLISAFSXTLEETAQADVLLHV
                |||:|             || |||||||||||||||||||||||| |||||:||||||||
g538            AKDQLFATLDTTARRLYISPACSIILTDTVGFVSDLPHKLISAFSATLEETVQADVLLHV
                       250       260       270       280       290       300

                290       300       310       320       330       340
m538.pep        VDAAAPNSGQQIEDVENVLQEIHAGDIPCIKVYNKTDLLPSEEQNTGIWRDAAGKIAAVR
                ||||| |||||||||||||||||| |||||||||||||||||||||||||||||||||||
g538            VDAAARNSGQQIEDVENVLQEIHAHDIPCIKVYNKTDLLPSEEQNTGIWRDAAGKIAAVR
                       310       320       330       340       350       360

                350       360       370       380
m538.pep        ISVAENTGIDALREAIAESCAAAPNTDETEMPX
                |||||||||||||||||| ||||||||||||||
g538            ISVAENTGIDALREAIAEYCAAAPNTDETEMPX
```

The following partial DNA sequence was identified in *N. meningitidis* <SEQ ID 1559>:

```
a538.seq
    1 ATGACAGGCA GAACAGGCCG CAACGGCAGT ACCCAAGCGC AACCCGAACG

   51 CGTCATGCTG GTGGGCGTAA TGTTGGACAA AGATGGTACG GGCAGCAGTG

  101 CCACCCGTCT GAACGGTTTT CAGACGGCAT TGGCGGAAGC TGTCGAGCTG

  151 GTCAAAGCGG CGGGCGGCGA TTCCGTGCGC GTGGAGACTG CCAAACGCGA

  201 CCGTCCGCAC ACCGCGCTGT TTGTCGGCAC GGGCAAGGCG GCGGAGCTGT

  251 CGGAAGCAGT TGCCGCAGAC GGCATCGATT TGGTCGTATT CAACCACGAA

  301 CTTACGCCCA CGCAGGAACG CAATTTGGAA AAAATCCTCC AATGCCGCGT

  351 ATTGGACAGA GTGGGGCTGA TTCTGGCGAT TTTCGCCCGC CGCGCCCGCA

  401 CGCAGGAAGG CAGGCTGCAA GTCGAGTTGG CACAATTGAG CCATTTGGCG

  451 GGACGCTTGA TACGCGGTTA CGGCCATCTG CAGAGCCAGC GCGGCGGTAT

  501 CGGCATGAAA GGCCCCGGCG AAACCAAACT GGAAACCGAC CGCCGATTGA

  551 TCGCCCATCG GATCAATGCC TTGAAAAAAC AGCTTGCCAA CCTCAAAAAA

  601 CAGCGCGCCC TGCGCCGCAA GTCCCGCGAA TCGGGCACAA TCAAAACGTT

  651 TGCGCTGGTC GGCTATACCA ATGTCGGCAA ATCCAGTCTG TTCAACCGGC

  701 TGACCAAGTC GGGCATATAT GCGAAAGACC AGCTTTTCGC CACACTCGAC
```

-continued

```
 751 ACGACGGCGC GGCGGCTGTA CATCAGTCCC GAATGCAGCA TTATCCTGAC

 801 CGATACCGTC GGATTCGTCA GCGATCTGCC GCACAAACTG ATTTCCGCCT

 851 TTTCCGCCAC GCTGGAAGAA ACCGCGCAAG CCGATGTGCT GCTGCACGTC

 901 GTCGATGCCG CCGCTCCGAA CAGCGGACAG CAGATTGAAG ACGTGGAAAA

 951 CGTACTGCAA GAAATCCATG CCGGCGATAT TCCGTGCATC AAGGTGTACA

1001 ACAAAACCGA CCTGCTGCCG TCTGAAGAAC AAAACACGGG CATATGGCGC

1051 GACGCTGCGG GAAAAATTGC CGCCGTCCGC ATTTCCGTTG CTGAAAATAC

1101 CGGTATAGAC GCACTGCGCG AAGCCATTGC CGAGTATTGT GCCGCCGCAC

1151 CAAACACAGA CGAAACCGAA ATGCCATGA
```

This corresponds to the amino acid sequence <SEQ ID 1560; ORF 538.a>:

```
a538.pep
  1 MTGRTGRNGS TQAQPERVML VGVMLDKDGT GSSATRLNGF QTALAEAVEL

 51 VKAAGGDSVR VETAKRDRPH TALFVGTGKA AELSEAVAAD GIDLVVFNHE

101 LTPTQERNLE KILQCRVLDR VGLILAIFAR RARTQEGRLQ VELAQLSHLA

151 GRLIRGYGHL QSQRGGIGMK GPGETKLETD RRLIAHRINA LKKQLANLKK

201 QRALRRKSRE SGTIKTFALV GYTNVGKSSL FNRLTKSGIY AKDQLFATLD

251 TTARRLYISP ECSIILTDTV GFVSDLPHKL ISAFSATLEE TAQADVLLHV

301 VDAAAPNSGQ QIEDVENVLQ EIHAGDIPCI KVYNKTDLLP SEEQNTGIWR

351 DAAGKIAAVR ISVAENTGID ALREAIAEYC AAAPNTDETE MP*
```

m538/a538 94.6% identity in 392 aa overlap

```
                      10        20        30        40        50        60
m538.pep       MTGRTGGNGSTQAQPERVMLVGVMLDKDGTGSSAARLNGFQTALAEAVELVKAAGGDSVR
               |||||| |||||||||||||||||||||||||||:|||||||||||||||||||||||||
a538           MTGRTGRNGSTQAQPERVMLVGVMLDKDGTGSSATRLNGFQTALAEAVELVKAAGGDSVR
                      10        20        30        40        50        60

70          80        90       100       110       120
m538.pep       VETAKRDRPHTALFVGTGKAAELSEAVAADGIDLVVFNHELTPTQERNLEKELKCRVKDR
               ||||||||||||||||||||||||||||||||||||||||||||||||||| |:||||||
a538           VETAKRDRPHTALFVGTGKAAELSEAVAADGIDLVVFNHELTPTQERNLEKILQCRVKDR
                      70        80        90       100       110       120

130        140       150       160       170       180
m538.pep       VGLILAIFARRARTWEGRLQVELAQLSHLAGRLIRGYGHLQSQRGGIGMKGPGETKLETD
||||||||||||||||||||||||||||||||||||||||||||||||||||||||||||
a538           VGLILAIFARRARTWEGRLQVELAQLSHLAGRLIRGYGHLQSQRGGIGMKGPGETKLETD
                     130       140       150       160       170       180

190        200       210       220       230       240
m538.pep       RRLIAHRINALIKQLANLKKQRALRRKSRESGTIKTFALVGYTNVGKEELFNRLTKSGIY
               ||||||||||| ||||||||||||||||||||||||||||||||||||||||||||||||
a538           RRLIAHRINALKKQLANLKKQRALRRKSRESGTIKTFALVGYTNVGKEELFNRLTKSGIY
                     190       200       210       220       230       240

250        260       270       280
m538.pep       AKDKL-------------SPECSIILTDTVGFVSDLPHKLISAFSXTLEETAQADVLLHV
               |||:|             ||||||||||||||||||||||||||| ||||||||||||||
a538           AKDQLFATLDTTARRLYISPECSIILTDTVGFVSDLPHKLISAFSATLEETAQADVLLHV
                     250       260       270       280       290       300

290        300       310       320       330       340
m538.pep       VDAAAPNSGQQIEDVENVLQEIHAGDIPCIKVYNKTDLLPSEEQNTGIWRDAAGKIAAVR
               ||||||||||||||||||||||||||||||||||||||||||||||||||||||||||||
a538           VDAAAPNSGQQIEDVENVLQEIHAGDIPCIKVYNKTDLLPSEEQNTGIWRDAAGKIAAVR
                     310       320       330       340       350       360
```

-continued

```
350       360       370       380
m538.pep    ISVAENTGIDALREAIAESCAAAPNTDETEMPX
            |||||||||||||||||| ||||||||||||||
a538        ISVAENTGIDALREAIAEYCAAAPNTDETEMPX
                   370       380       390
```

The following partial DNA sequence was identified in *N. gonorrhoeae* <SEQ ID 1561>:

```
g539.seq
   1 atggaggatc tgcaggaaat cgggttcgat gtcgccgccg taaaggtagg

  51 tcggcagcgc gaacatcatc gtctgcatca tacccagtcc ggcaacggca

 101 aggcggacga tgtattgttt gcgttctttt tggttggcgg cttcgatttt

 151 ttgcgcgtca tagggtgcgg cggtgtagcc tgtctgccgg attttcaaca

 201 gaatgtcgga gaggcggatt ttgccgtcgt cccagacgac gcggcagcgg

 251 tgcgtgctgt aattgaggtc gatgcggacg atgccgtctg tgcgcaaaag

 301 ctgctgttcg atcagccaga cgcaggcggc gcaggtaatg ccgctgagca

 351 tcagcactgc ttcgtgcgtg ccattatggg tttccacaaa gtcggattgg

 401 acttcgggca ggtcgtacag gcggatttgg tcgaggattt cttggggcgg

 451 cagttcggtt tttttcgcgt cggcggtgcg tcgtttgtaa taactgccca

 501 agccggaatc gatgatgctt tgtgcgactg cctgacagcc gacgcagcag

 551 gtttcgcggt cttcgccttc gtagcggacg gtcagatgca ggttttcggg

 601 aacgtccagc ccgcagtgga aacaggtttt tttcatggca tttcggtttc

 651 gtctgtgttt ggtgcggcgg cacaatactc ggcaatggct tcgcgcagtg

 701 cgtctatacc ggtattttca gcaacggaaa tgcggacggc ggcaattttt

 751 cccgcagcgt cgcgccatat gcccgtgttt tgttcttcag acggcagcag

 801 gtcggttttg ttgtacacct tgatgcacgg aatatcgtgg gcatggattt

 851 cttgcagtac gttttccacg tcttcaatct gctgcccgct gttccgggcg

 901 gcagcatcga cgacgtgcag cagcacatcg gcttgcacgg tttcttccaa

 951 ggtggcggaa aaggcggaaa tcagtttgtg cggcagatcg ctgacgaatc

1001 cgacggtatc ggtcaggata atgctgcatg cgggactgat gtacagccgc

1051 cgcgccgtcg tgtcgagagt ggcgaaaagc tggtctttcg catatatgcc

1101 cgacttggtc agccggttga acaggctgga tttgccgaca ttggtatag
```

This corresponds to the amino acid sequence <SEQ ID 1562; ORF 539.ng>:

```
g539.pep
   1 MEDLQEIGFD VAAVKVGRQR EHHRLHHTQS GNGKADDVLF AFFLVGGFDF

  51 LRVIGCGGVA CLPDFQQNVG EADFAVVPDD AAAVRAVIEV DADDAVCAQK

 101 LLFDQPDAGG AGNAAEHQHC FVRAIMGFHK VGLDFGQVVQ ADLVEDFLGR

 151 QFGFFRVGGA SFVITAQAGI DDALCDCLTA DAAGFAVFAF VADGQMQVFG

 201 NVQPAVETGF FHGISVSSVF GAAAQYSAMA SRSASIPVFS ATEMRTAAIF

 251 PAASRHMPVF CSSDGSRSVL LYTLMHGISW AWISCSTFST SSICCPLFRA

 301 AASTTCSSTS ACTVSSKVAE KAEISLCGRS LTNPTVSVRI MLHAGLMYSR

 351 RAVVSRVAKS WSFAYMPDLV SRLNRLDLPT LV*
```

The following partial DNA sequence was identified in *N. meningitidis* <SEQ ID 1563>:

```
m539.seq (partial)
   1 ATGGAGGATT TGCAGGAAAT CGGGTTCGAT GTCGCCGCCG TAAAGGTAGG
  51 TCGGCAGCGC GAACATCATC GTCTGCATCA TCCCCAGCCC GGCAACGGCG
 101 AGGCGGACGA TGTATTGTTT GCGTTCTTTT TGGTTGGCGG CTTCGATTTT
 151 TTGCGCGTCA TAGGGTGCGG CGGTGTAGCC TATCTGCCTG ATTTTCAACA
 201 GAATGTCGGA AAGGCGGATT TTGCCGTCGT CCCAGACGAc GCGGCaGCgG
 251 TGCGTGCTGT AATTGAGGTC GATGCGGACG ATGCCGTCTG TACGCAAAAG
 301 CTGCTGTTCG ATCAGCCAGA CGCAGGCGGC GCAGGTGATG CCGCCGAGCA
 351 TTAAAACCGC CTCGCGCGTG CCGCCGTGGG TTTCCACAAA GTCGGACTGG
 401 ACTTCGGGCA GGTCGTACAG GCGGATTTGG TCGAGGATTT CTTGGGGCGG
 451 CAgCTCGGTT TTTTGCGCGT CGGCGGTGCG TTGTTTGTAA TAACTGCCCA
 501 AGCCCGCGTC AATAATGCTT TGTGCGACCG CCTGACAGCC GGCGCaCAgG
 551 GTTTCGCGGT CTTCGTTTTC GTAACGGACA GTCAGGTGGA GGTGTTCGGG
 601 AACATCCAGA CCGCAGTGGA AACAGGTTTT TTTCATGGCA TTTCGGTTTC
 651 GTCTGTGTTT GGTGCGGCGG CACAAGACTC GGCAATgGCT TCGCGCAGTG
 701 CGTCTATACC GGTATTTTCA GCAACGGAAA TGCGGACGGC GGCAATTTTT
 751 CCCGCAGCGT CGCGCCATAT GTCTGTGTTT TGTTCTTCAG ACGGCAGCAG
 801 GTCGGTTTTG TTGTACACCT TgATGCACGG AATATCGCCG GCATGGATTT
 851 CTTGCAGTAC GTTTTCCACG TCTTCAATCT GCTGTCCGCT GTTCGGAGCG
 901 GCGGCATCGA CGACGTGCAG CAGCACATCG GCTTGCGCGG TTTCTTCCAG
 951 CGTGGcG.AA AAGGCGGAAA TCAGTTTgTG CGGCAGATCG CTnACGAATC
1001 CGACGGTATC GGTCAGGATA ATGCTGCATT CGGGAC...
```

This corresponds to the amino acid sequence <SEQ ID 1564; ORF 539>:

```
m539.pep (partial)
   1 MEDLQEIGFD VAAVKVGRQR EHHRLHHPQP GNGEADDVLF AFFLVGGFDF
  51 LRVIGCGGVA YLPDFQQNVG KADFAVVPDD AAAVRAVIEV DADDAVCTQK
 101 LLFDQPDAGG AGDAAEH*NR LARAAVGFHK VGLDFGQVVQ ADLVEDFLGR
 151 QLGFLRVGGA LFVITAQARV NNALCDRLTA GAQGFAVFVF VTDSQVEVFG
 201 NIQTAVETGF FHGISVSSVF GAAAQDSAMA SRSASIPVFS ATEMRTAAIF
 251 PAASRHMPVF CSSDGSRSVL LYTLMHGISP AWISCSTFST SSICCPLFGA
 301 AASTTCSSTS ACAVSSSVAX KAEISLCGRS LTNPTVSVRI MLHSG....
```

Computer analysis of this amino acid sequence gave the following results:

Homology with a Predicted ORF from *N. gonorrhoeae*

ORF 539 shows 89% identity over a 345 aa overlap with a predicted ORF (ORF 539.ng) from *N. gonorrhoeae*:

```
m539/g539

                        10        20        30        40        50        60
m539.pep        MEDLQEIGFDVAAVKVGRQREHHRLHHPQPGNGEADDVLFAFFLVGGFDFLRVIGCGGVA
                ||||||||||||||||||||||||||| | |||:||||||||||||||||||||||||||
g539            MEDLQEIGFDVAAVKVGRQREHHRLHHTQSGNGKADDVLFAFFLVGGFDFLRVIGCGGVA
                        10        20        30        40        50        60

                        70        80        90       100       110       120
m539.pep        YLPDFQQNVGKADFAVVPDDAAAVRAVIEVDADDAVCTQKLLFDQPDAGGAGDAAEHXNR
                 |||||||||:||||||||||||||||||||||||||:||||||||||||||:|||| : 
g539            CLPDFQQNVGEADFAVVPDDAAAVRAVIEVDADDAVCAQKLLFDQPDAGGAGNAAEHQHC
                        70        80        90       100       110       120

                       130       140       150       160       170       180
m539.pep        LARAAVGFHKVGLDFGQVVQADLVEDFLGRQLGFLRVGGALFVITAQARVNNALCDRLTA
                ::|| :|||||||||||||||||||||||||:||:||||| ||||||| :::|||| |||
g539            FVRAIMGFHKVGLDFGQVVQADLVEDFLGRQFGFFRVGGASFVITAQAGIDDALCDCLTA
                       130       140       150       160       170       180

                       190       200       210       220       230       240
m539.pep        GAQGFAVFVFVTDSQVEVFGNIQTAVETGFFHGISVSSVFGAAAQDSAMASRSASIPVFS
                 | |||||:||:|:|::||||:| ||||||||||||||||||||| ||||||||||||||
g539            DAAGFAVFAFVADGQMQVFGNVQPAVETGFFHGISVSSVFGAAAQYSAMASRSASIPVFS
                       190       200       210       220       230       240

                       250       260       270       280       290       300
m539.pep        ATEMRTAAIFPAASRHMPVFCSSDGSRSVLLYTLMHGISPAWISCSTFSTSSICCPLFGA
                ||||||||||||||||||||||||||||||||||||||| |||||||||||||||||| |
g539            ATEMRTAAIFPAASRHMPVFCSSDGSRSVLLYTLMHGISWAWISCSTFSTSSICCPLFRA
                       250       260       270       280       290       300

                       310       320       330       340
m539.pep        AASTTCSSTSACAVSSSVAXKAEISLCGRSLTNPTVSVRIMLHSG
                ||||||||||||:|||:|| |||||||||||||||||||||||:|
g539            AASTTCSSTSACTVSSKVAEKAEISLCGRSLTNPTVSVRIMLHAGLMYSRRAVVSRVAKS
                       310       320       330       340       350       360


g539            WSFAYMPDLVSRLNRLDLPTLV
                       370       380
```

The following partial DNA sequence was identified in *N. meningitidis* <SEQ ID 1565>:

```
a539.seq
   1 ATGGAGGATT TGCAGGAAAT CGGGTTCGAT GTCGCCGCCG TAAAGGTAGG

  51 TCGGCAGCGC GAACATCATC GTCTGCATCA TCCCCAGCCC GGCAACGGCG

 101 AGGCGGACGA TGTATTGTTT GCGTTCTTTT TGGTTGGCGG CTTCGATTTT

 151 TTGCGCGTCA TAGGGTGCGG CGGTGTAGCC TATCTGCCTG ATTTTCAACA

 201 GAATGTCGGA AAGGCGGATT TTGCCGTCGT CCCAGACGAC GCGGCAGCGG

 251 TGCGTGCTGT AATTGAGGTC GATGCGGACG ATGCCGTCTG TACGCAAAAG

 301 CTGCTGTTCG ATCAGCCAGA CGCAGGCGGC GCAGGTGATG CCGCCGAGCA

 351 TTAAAACCGC CTCGCGCGTG CCGCCGTGGG TTTCCACAAA GTCGGACTGG

 401 ACTTCGGGCA GGTCGTACAG GCGGATTTGG TCGAGGATTT CTTGGGGCGG

 451 CAGCTCGGTT TTTTGCGCGT CGGCGGTGCG TTGTTTGTAA TAACTGCCCA

 501 AGCCCGCGTC AATAATGCTT TGTGCGACTG CCTGACAACC GGCGCAGCAG

 551 GTTTCGCGGT CTTCGTTTTC GTAACGGACG GTCAGATGCA GGTTTTCGGG

 601 AACGTCCAGC CCGCAGTGGA AACAGGTTTT TTTCATGGCA TTTCGGTTTC

 651 GTCTGTGTTT GGTGCGGCGG CACAATACTC GGCAATGGCT TCGCGCAGTG

 701 CGTCTATACC GGTATTTTCA GCAACGGAAA TGCGGACGGC GGCAATTTTT
```

-continued

```
 751 CCCGCAGCGT CGCGCCATAT GCCCGTGTTT TGTTCTTCAG ACGGCAGCAG

 801 GTCGGTTTTG TTGTACACCT TGATGCACGG AATATCGCCG GCATGGATTT

 851 CTTGCAGTAC GTTTTCCACG TCTTCAATCT GCTGTCCGCT GTTCGGAGCG

 901 GCGGCATCGA CGACGTGCAG CAGCACATCG GCTTGCGCGG TTTCTTCCAG

 951 CGTGGCGGAA AAGGCGGAAA TCAGTTTGTG CGGCAGATCG CTGACGAATC

1001 CGACGGTATC GGTCAGGATA ATGCTGCATT CGGGACTGAT GTACAGCCGC

1051 CGCGCCGTCG TGTCGAGTGT GGCGAAAAGC TGGTCTTTCG CATATATGCC

1101 CGACTTGGTC AGCCGGTTGA ACAGACTGGA TTTGCCGACA TTGGTATAG
```

This corresponds to the amino acid sequence <SEQ ID 1566; ORF 539.a>:

```
a539.pep
  1 MEDLQEIGFD VAAVKVGRQR EHHRLHHPQP GNGEADDVLF AFFLVGGFDF

 51 LRVIGCGGVA YLPDFQQNVG KADFAVVPDD AAAVRAVIEV DADDAVCTQK

101 LLFDQPDAGG AGDAAEH*NR LARAAVGFHK VGLDFGQVVQ ADLVEDFLGR

151 QLGFLRVGGA LFVITAQARV NNALCDCLTT GAAGFAVFVF VTDGQMQVFG

201 NVQPAVETGF FHGISVSSVF GAAAQYSAMA SRSASIPVFS ATEMRTAAIF

251 PAASRHMPVF CSSDGSRSVL LYTLMHGISP AWISCSTFST SSICCPLFGA

301 AASTTCSSTS ACAVSSSVAE KAEISLCGRS LTNPTVSVRI MLHSGLMYSR

351 RAVVSSVAKS WSFAYMPDLV SRLNRLDLPT LV*
```

m539/a539 97.1% identity in 345 aa overlap

```
                    10        20        30        40        50        60
m539.pep    MEDLQEIGFDVAAVKVGRQREHHRLHHPQPGNGEADDVLFAFFLVGGFDFLRVIGCGGVA
            ||||||||||||||||||||||||||||||||||||||||||||||||||||||||||||
a539        MEDLQEIGFDVAAVKVGRQREHHRLHHPQPGNGEADDVLFAFFLVGGFDFLRVIGCGGVA
                    10        20        30        40        50        60

                    70        80        90       100       110       120
m539.pep    YLPDFQQNVGKADFAVVPDDAAAVRAVIEVDADDAVCTQKLLFDQPDAGGAGDAAEHXNR
            ||||||||||||||||||||||||||||||||||||||||||||||||||||||||||||
a539        YLPDFQQNVGKADFAVVPDDAAAVRAVIEVDADDAVCTQKLLFDQPDAGGAGDAAEHXNR
                    70        80        90       100       110       120

                   130       140       150       160       170       180
m539.pep    LARAAVGFHKVGLDFGQVVQADLVEDFLGRQLGFLRVGGALFVITAQARVNNALCDRLTA
            ||||||||||||||||||||||||||||||||||||||||||||||||||||||||||||
a539        LARAAVGFHKVGLDFGQVVQADLVEDFLGRQLGFLRVGGALFVITAQARVNNALCDRLTA
                   130       140       150       160       170       180

                   190       200       210       220       230       240
m539.pep    GAQGFAVFVFVTDSQVEVFGNIQTAVETGFFHGISVSSVFGAAAQDSAMASRSASIPVFS
            || |||||||||:|::||||:| |||||||||||||||||||||| ||||||||||||||
a539        GAAGFAVFVFVTDGQMQVFGNVQPAVETGFFHGISVSSVFGAAAQYSAMASRSASIPVFS
                   190       200       210       220       230       240

                   250       260       270       280       290       300
m539.pep    ATEMRTAAIFPAASRHMPVFCSSDGSRSVLLYTLMHGISPAWISCSTFSTSSICCPLFGA
            ||||||||||||||||||||||||||||||||||||||||||||||||||||||||||||
a539        ATEMRTAAIFPAASRHMPVFCSSDGSRSVLLYTLMHGISPAWISCSTFSTSSICCPLFGA
                   250       260       270       280       290       300

                   310       320       330       340
m539.pep    AASTTCSSTSACAVSSSVAXKAEISLCGRSLTNPTVSVRIMLHSG
            |||||||||||||||||| ||||||||||||||||||||||||||
a539        AASTTCSSTSACAVSSSVAEKAEISLCGRSLTNPTVSVRIMLHSGLMYSRRAVVSSVAKS
                   310       320       330       340       350       360

a539        WSFAYMPDLVSRLNRLDLPTLVX
                   370       380
```

The following partial DNA sequence was identified in *N. gonorrhoeae* <SEQ ID 1567>:

g540.seq
1 atgccgccct cccgacgcgg caacggggtg ttttatcaaa acggcaaact 51 tgccaatgcg gtttccgctt gccgattgcc aaaccggcaa acctttcccg 101 tgccggtgcc gaacccgatg ccgtctgaac cttcagacgg catcgggtgt 151 ttatttgtcc actcggacgg gtgcaggttc gtattgtgtc gattcgtcgc 201 cgtaatacag cacgccgagt ttgacgggga tgcgtccctg cgatttgcgg 251 tgggcgttgg aatcgcgcaa ggaatacgcg cagccgcagt attcctgctg 301 gtagaagttt tcgcgtttgc tgatttcaat catacgcgcg ccgccgccgc 351 ctttgcgcca gttgaagtcc caataggcca catcatcgta aggcgcggcg 401 gcacggtgtc cgcagtcgtt gatttgcgcc atatttttcc agcgtga This corresponds to the amino acid sequence <SEQ ID 1568; ORF 540.ng>:

g540.pep
1 MPPSRRGNGV FYQNGKLANA VSACRLPNRQ TFPVPVPNPM PSEPSDGIGC

51 LFVHSDGCRF VLCRFVAVIQ HAEFDGDASL RFAVGVGIAQ GIRAAAVFLL

101 VEVFAFADFN HTRAAAAFAP VEVPIGHIIV RRGGTVSAVV DLRHIFPA *

The following partial DNA sequence was identified in *N. meningitidis* <SEQ ID 1569>:

m540.seq (partial)
1 ..CCGAACCCGA TGCCGTCTGA ACCTTCAGAC GGCATCGGGT GTTTATTTGT

51 CCACCCGGAT GGGGGCAGGT TCGTATTGTG TCGATTCGTC GCCGTAATAC

101 AGCACGCCGA GTTTGATGGG GATTCTGCCC TGTGATTTGC GGTGGGCATT

151 GGAATCCCTC AGGGAATAGG CACAACCGCA ATATTCCTGC TGGTAGAAGT

201 TTTCACGTTT GCTGATTTCA ATCATGCGCG CGCTGCCGCC GCCTTTGCGC

251 CAGTTGAAAT CCCAATACAC CACATCATCG TAAGGCGCGG CGGCGCGGTG

301 TCCGCAGTCG TTGATTTGCG CCATATTTTT CCAGCGTGA

This corresponds to the amino acid sequence <SEQ ID 1570; ORF 540>:

m540.pep (partial)
1 ..PNPMPSEPSD GIGCLFVHPD GGRFVLCRFV AVIQHAEFDG DSAL*FAVGI

51 GIPQGIGTTA IFLLVEVFTF ADFNHARAAA AFAPVEIPIH HIIVRRGGAV

101 SAVVDLRHIF PA*

Computer analysis of this amino acid sequence gave the following results:

Homology with a Predicted ORF from *N. gonorrhoeae*

ORF 540 shows 85.7% identity over a 112 aa overlap with a predicted ORF (ORF 540.ng) from *N. gonorrhoeae*:

```
m540/g540

                                               10        20        30
m540.pep                               PNPMPSEPSDGIGCLFVHPDGGRFVLCRFV
                                       |||||||||||||||||| || ||||||||
g540     GNGVFYQNGKLANAVSACRLPNRQTFPVPVPNPMPSEPSDGIGCLFVHSDGCRFVLCRFV
           10        20        30        40        50        60

                 40        50        60        70        80        90
m540.pep AVIQHAEFDGDSALXFAVGIGIPQGIGTTAIFLLVEVFTFADFNHARAAAAFAPVEIPIH
         |||||||||||::| ||||:|| ||| ::|:|||||||:||||||:||||||||||:|| 
g540     AVIQHAEFDGDASLRFAVGVGIAQGIRAAAVFLLVEVFAFADFNHTRAAAAFAPVEVPIG
           70        80        90       100       110       120

                100       110
m540.pep HIIVRRGGAVSAVVDLRHIFPAX
         ||||||||:||||||||||||||
g540     HIIVRRGGTVSAVVDLRHIFPAX
          130       140

L' estremita' N-terminale di meningococco e' assente perche' interviene la fine del contig
```

The following partial DNA sequence was identified in *N. meningitidis* <SEQ ID 1571>:

```
a540.seq
   1 ATGCCGTCCT CCCGACGCGG CAACGGGGTG TTTTATCAAA ACGGCAAACT

  51 TGCCAATGCG GTTTCCGATT GCAGATTGCC AAACCGGCAA ACCTTTCCCG

 101 TGCCGATGCC GAACCCGATG CCGTCTGAAC CTTCAGACGG CATCGGGTGT

 151 TTATTTGTCC ACCCGGATGG GTGCAGGTTC GTATTGTGTC GATTCGTCGC

 201 CGTAATACAG CACGCCGAGT TTGATGGGGA TTCTGCCCTG TGATTTGCGG

 251 TGGGCGTTGG AATCCCTCAG GGAATAGGCA CAACCGCAAT ATTCCTGCTG

 301 GTAGAAGTTT TCACGTTTGC TGATTTCAAT CATACGCGCG CTGCCGCCGC

 351 CTTTGCGCCA GTTGAAATCC CAATACACCA CATCATCGTA AGGCGCGGCG

 401 GCGCGGCGGC CGCAGTCGTT AATCTGGTTC ATGTTTTTCC A
```

This corresponds to the amino acid sequence <SEQ ID 1572; ORF 540.a>:

```
a540.pep (partial)
   1 MPSSRRGNGV FYQNGKLANA VSDCRLPNRQ TFPVPMPNPM PSEPSDGIGC

  51 LFVHPDGCRF VLCRFVAVIQ HAEFDGDSAL *FAVGVGIPQ GIGTTAIFLL

 101 VEFTFADFN HTRAAAAFAP VEIPIHHIIV RRGGAAAAVV NLVHVFP
```

m540/a540 92.8% identity in 111 aa overlap

```
                                               10        20        30
m540.pep                               PNPMPSEPSDGIGCLFVHPDGGRFVLCRFV
                                       ||||||||||||||||||||| ||||||||
a540     GNGVFYQNGKLANAVSDCRLPNRQTFPVPMPNPMPSEPSDGIGCLFVHPDGCRFVLCRFV
           10        20        30        40        50        60

                 40        50        60        70        80        90
m540.pep AVIQHAEFDGDSALXFAVGIGIPQGIGTTAIFLLVEVFTFADFNHARAAAAFAPVEIPIH
         |||||||||||||||||||:|||||||||||||||||||||||||:||||||||||||||
a540     AVIQHAEFDGDSALXFAVGVGIPQGIGTTAIFLLVEVFTFADFNHTRAAAAFAPVEIPIH
           70        80        90       100       110       120
```

-continued

```
                100       110
m540.pep HIIVRRGGAVSAVVDLRHIFPAX
         ||||||||::|||:| |:||
a540     HIIVRRGGAAAAVVNLVHVFP
          130       140
```

The following partial DNA sequence was identified in *N. gonorrhoeae* <SEQ ID 1573>:

```
g542.seq
  1 atgccgaaat ggtcgcgcat acggcgttgc agcgtccttt cgctgatgtt

 51 cagcgcggct gtcagccggt tgacttggtg tgcgccgccg tcgaacgcgg

101 cattcagggt gcggctgaag tcttcagacg gcatagcgtc tgcttccgcc

151 gtttgccccg ccgccggctc gatgccgtct gaaaccgtgt cccacaaatc

201 cgacagcagc cgcaacacgt ccgcctcgcg gcgcaatgtt tcgcccaaat

251 gcccctttgg gacggtttgc aggcaggatg ccgccaagcc gcgcaggttt

301 gggggcaaat cccatatcct gaccggttcg cggtaa
```

This corresponds to the amino acid sequence <SEQ ID 1574; ORF 542.ng>:

```
g542.pep
  1 MPKWSRIRRC SVLSLMFSAA VSRLTWCAPP SNAAFRVRLK SSDGIASASA

 51 VCPAAGSMPS ETVSHKSDSS RNTSASRRNV SPKCPFGTVC RQDAAKPRRF

101 GGKSHILTGS R*
```

The following partial DNA sequence was identified in *N. meningitidis* <SEQ ID 1575>:

```
m542.seq
  1 ATGCCGAAAT GGTCGCGCAT ACGGCGTTGC AGCGTCCTTT CACTGATGTT

 51 CAGCGCGTCT GTCAGCCGGT TGACTTGGTG TGCGCCGTCG GCAAACGCGG

101 CATTTAGGGT GCGGCTGAAG TCTTCAGACG GCATAGCGTC TGCTTCCGCC

151 GTTTGCCCCG CCGCCGGCCC GATGCCGTCT GAAACCGTGT CCCACAAGTC

201 CGACAGCAGC CGCAACACGT CCGCCTCGCG .CGCAATGTT TCGCCCAAAT

251 GCCCCTTTGG GACGGCTTTC AGGCAGGATG CCGCCAAGCC GCGCAGGTTC

301 GGGGGCAAAT CCCATATCCT GACCGGTTCG CGGTAA
```

This corresponds to the amino acid sequence <SEQ ID 1576; ORF 542>:

```
m542.pep
  1 MPKWSRIRRC SVLSLMFSAS VSRLTWCAPS ANAAFRVRLK SSDGIASASA

 51 VCPAAGPMPS ETVSHKSDSS RNTSASRAMF RPNAPLGRNV SPKCPFGTAF

101 RQDAAKPRRF GGKSHILTGS R*
```

Computer analysis of this amino acid sequence gave the following results:

Homology with a Predicted ORF from *N. gonorrhoeae*

ORF 542 shows 93.7% identity over a 111 aa overlap with a predicted ORF (ORF 542.ng) from *N. gonorrhoeae*:

```
m542/g542

         10        20        30        40        50        60
m542.pep MPKWSRIRRCSVLSLMFSASVSRLTWCAPSANAAFRVRLKSSDGIASASAVCPAAGPMPS
         |||||||||||||||||||:||||||||| :||||||||||||||||||||||||| |||
g542     MPKWSRIRRCSVLSLMFSAAVSRLTWCAPPSNAAFRVRLKSSDGIASASAVCPAAGSMPS
                 10        20        30        40        50        60
                 70        80        90       100       110
m542.pep ETVSHKSDSSRNTSASXRNVSPKCPFGTAFRQDAAKPRRFGGKSHILTGSRX
         |||||||||||||||| |||||||||||: ||||||||||||||||||||||
g542     ETVSHKSDSSRNTSASRRNVSPKCPFGTVCRQDAAKPRRFGGKSHILTGSRX
                 70        80        90       100       110
```

The following partial DNA sequence was identified in *N. meningitidis* <SEQ ID 1577>:

```
a542.seq
  1 ATGCCGAAAT GGTCGCGCAT ACGGCGTTGC AGCGTCCTTT CGCTGATGTT

 51 CAGCGTGTCT GCCAGCCGGT TGACTTGATG TGCGCCGCCG GCAAACGCGG

101 CATTCAGGAT GCGGCTGAAG TCTTCAGACG GCATAGCGTC TGCTTCCGCC

151 GTTTGCCCCG CCGCCGGCCC GATGCCGTCT GAAACCGTGT CCCACAAGTC

201 CGACAGCAGC CGCAACACGT CCGCCTCGCG GCGCAATGTT TCGCCCAAAT

251 GCCCCTTTGG GACGGCTTTC AGGCAGGATG CCGCCAAGCC GCGCAGGTTC

301 GGGGGCAAAT CCCATATCCT GACCGGTTCG CGGTAA
```

This corresponds to the amino acid sequence <SEQ ID 1578; ORF 542.a>:

```
a542.pep
  1 MPKWSRIRRC SVLSLMFSVS ASRLT*CAPP ANAAFRMRLK SSDGIASASA

 51 VCPAAGPMPS ETVSHKSDSS RNTSASRRNV SPKCPFGTAF RQDAAKPRRF

101 GGKSHILTGS R*
```

m542/a542 94.6% identity in 111 aa overlap

```
                 10        20        30        40        50        60
m542.pep MPKWSRIRRCSVLSLMFSASVSRLTWCAPSANAAFRVRLKSSDGIASASAVCPAAGPMPS
         ||||||||||||||||||:|:|||| ||| ||||||:|||||||||||||||||||||||
a542     MPKWSRIRRCSVLSLMFSVSASRLTXCAPPANAAFRMRLKSSDGIASASAVCPAAGPMPS
                 10        20        30        40        50        60
                 70        80        90       100       110
m542.pep ETVSHKSDSSRNTSASXRNVSPKCPFGTAFRQDAAKPRRFGGKSHILTGSRX
         |||||||||||||||| |||||||||||||||||||||||||||||||||||
a542     ETVSHKSDSSRNTSASRRNVSPKCPFGTAFRQDAAKPRRFGGKSHILTGSRX
                 70        80        90       100       110
```

The following partial DNA sequence was identified in *N. gonorrhoeae* <SEQ ID 1579>:

```
g543.seq
   1  atggtttgtc ggttatttgc cgccgttttt ggctttcaac tcggcaatca

  51  gcccgtcgat gcctttggct ttgatgattt cgccgaattg gttgcggtac

 101  acggtaacca ggctcgtgcc ttcgatggcg acgttgtagg tacggtattt
```

-continued

```
 151 gccgccgctt tggtaggtgg taaagtccat attgacgggc ttctgaccgg
 201 ggatgccgac ttcggcacgg acgacgattt ccttgccgcc cttattgacg
 251 atgggattgt ctttgacgtt gacggtcgcg tttttgaatt tcagcatcgt
 301 gccggaatag gtgcggatca gcagggtttg aaattctttg gccaacgctt
 351 gtttttgcgc gtcggacgcg gtacgccaag ggttgccgac cgccaatgcg
 401 gtcatacgtt ggaaatcgaa atagggaacc gcataggctt cggcttttgg
 451 gcgtgcagaa gccgcgtcgc cgcttttgag gatggtcaaa acctgtgtgg
 501 cgtttggcg gatttgtccc actgcgtcgg ccggggaggc aaatgccatg
 551 ccgatgctca aaataccgat gcccaatgcg ctgatgaagg aggatttttt
 601 cacgatgtct ttcctgaaaa tggatgtgta tgtttattct gcggcttttt
 651 ccgcattgcc gccctcagcg tttttctcgg cgaagctggt catgaattta
 701 ccgatcaggt tttccagaac cattgcagaa ctggttacgg agatggtgtc
 751 gccggcagca aggttttccg tatcgccgcc ctgctgcagc ccgatgtact
 801 gttcgcccaa aagtcccgaa gtcaggattt gcgcggaaac gtcactgctg
 851 aactgatact tgccgtccaa atcaaggcgc accctcgcct gataggattt
 901 cgggtcaagc ccgatagcgc cgacgcgccc gaccaatacg cctgcggatt
 951 tgacgggggc attgaccttc aaaccgccga tgtcgccgaa atcggcataa
1001 acggcgtaag ttttgtccga accgccgaac gccgcgccgc ccgccacgcg
1051 gaaagcgaga aaggcaaccg ccgccgcgcc gatcaagacg aacagtccga
1101 cccaaaattc caatatgttc tttttcatta a
```

This corresponds to the amino acid sequence <SEQ ID 1580; ORF 543.ng>:

```
g543.pep
  1 MVCRLFAAVF GFQLGNQPVD AFGFDDFAEL VAVHGNQARA FDGDVVGTVF
 51 AAALVGGKVH IDGLLTGDAD FGTDDDFLAA LIDDGIVFDV DGRVFEFQHR
101 AGIGADQQGL KFFGQRLFLR VGRGTPRVAD RQCGHTLEIE IGNRIGFGFW
151 ACRSRVAAFE DGQNLCGVLA DLSHCVGRGG KCHADAQNTD AQCADEGGFF
201 HDVFPENGCV CLFCGFFRIA ALSVFLGEAG HEFTDQVFQN HCRTGYGDGV
251 AGSKVFRIAA LLQPDVLFAQ KSRSQDLRGN VTAELILAVQ IKAHPRLIGF
301 RVKPDSADAP DQYACGFDGG IDLQTADVAE IGINGVSFVR TAERRAARHA
351 ESEKGNRRRA DQDEQSDPKF QYVLFH*
```

The following partial DNA sequence was identified in *N. meningitidis* <SEQ ID 1581>:

```
m543.seq
  1 ATGGTTTGTC GGTTATTTGC CGCCGTTTTT GGCTTTCAAC TCGGCAATCA
 51 GTCCGTCCAC GCCTTTCGCT TTGATAATTT CGCCGAATTG GTTGCGGTAC
101 ACGGTAACCA GGCTCGCGCC TTCGATGGCG ACGTTGTAGG TACGGTATTT
151 ACCGCCGCTT TGGTAGGTGG TGAAGTCCAT GTTGACGGGT TTTTGCCCGG
201 GTACGCCGAC TTCGGCGCGG ACGATGATTT CTTTGCCGCC TTTATTGACG
251 ATGGGATTGT CTTTGACGTT GACGTTGGCG TTTTTTAATT TCAGCATCGT
```

```
301 GCCGGAATAG GTGCGGATCA GCAGGGTTTG AAATTCTTTG GCCAACGCTT

351 GTTTTTGCGC GTCGGACGCG GTGCGCCAAG GGTTGCCGAC CGCCAATGCG

401 GTCATACGTT GGAAATCGAA ATAGGGAATC GCATAGGCTT CGGCTTTTTG

451 GCGAGCGGTG TTGGCATCGC CGTTTTTTAA GATGCTCAAT ACTTGAGTGG

501 CGTTTTGACG GATTTGGCTT ACCGCGTCGG CAGGGCGGC AAATGCCATG

551 CCGATGCTCA AAATACCGAT GCCCAATGCG CTGATGAGGG AGGATTTTTT

601 CATGATTAAG TGTCCTAGTT TGAATATGAT GGCATACGTT TATTCGGCGG

651 CTTTTTCCGC ATTGCCGCCG TCGGCATTTT TCTCGGCAAA ACTCGTCATG

701 AATTTGCCGA TAAGGTTTTC CAGAACCATT GCAGAACTGG TTACGGAGAT

751 GGTGTCGCCG GCAGCAAGGT TTTCCGTGTC GCCGCCCTGC TGCAGCCCGA

801 TGTACTGCTC GCCCAAAAGT CCCGAAGTCA GGATTTGCGC GGAAACGTCG

851 CTGCTGAACT GATACTTGCC GTCCAAATCG AGGCGCACCC TCGCCTGATA

901 GGATTTCGGG TCAAGTCCGA TAGCGCCGAC GCGCCCGACC AATACGCCTG

951 CGGATTTGAC GGGGGCATTG ACCTTCAAAC CGCCGATGTC GCCGAAATCG

1001 GCATAAACGG CGTAAGTTTT GTCCGAACCG CCGAACGCCG CACCGCCGGC

1051 CACGCGGAAA GCGAGAAAGG CAACCGCCGC CGCGCCAATC AGGACGAACA

1101 GTCCGACCCA AAATTCCAAT ATGTTCTTCT TCATTAA
```

This corresponds to the amino acid sequence <SEQ ID 1582; ORF 543>:

```
m543.pep
   1 MVCRLFAAVF GFQLGNQSVH AFRFDNFAEL VAVHGNQARA FDGDVVGTVF

  51 TAALVGGEVH VDGFLPGYAD FGADDDFFAA FIDDGIVFDV DVGVFXFQHR

 101 AGIGADQQGL KFFGQRLFLR VGRGAPRVAD RQCGHTLEIE IGNRIGFGFL

 151 ASGVGIAVFX DAQYLSGVLT DLAYRVGRGG KCHADAQNTD AQCADEGGFF

 201 HDXVSXFEYD GIRLFGGFFR IAAVGIFLGK TRHEFADKVF QNHCRTGYGD

 251 GVAGSKVFRV AALLQPDVLL AQKSRSQDLR GNVAAELILA VQIEAHPRLI

 301 GFRVKSDSAD APDQYACGFD GGIDLQTADV AEIGINGVSF VRTAERRTAG

 351 HAESEKGNRR RANQDEQSDP KFQYVLLH*
```

Computer analysis of this amino acid sequence gave the following results:
Homology with a Predicted ORF from *N. gonorrhoeae*
ORF 543 shows 84.2% identity over a 379 aa overlap with a predicted ORF (ORF 543.ng) from *N. gonorrhoeae*:

```
m543/g543
                  10         20         30         40         50         60
   m543.pep   MVCRLFAAVFGFQLGNQSVHAFRFDNFAELVAVHGNQARAFDGDVVGTVFTAALVGGEVH
              |||||||||||||||| || ||:|||||||||||||||||||||||||||:||||| ||
       a543   MVCRLFAAVFGFQLGNQPVDAFGFDDFAELVAVHGNQARAFDGDVVGTVFAAALVGGKVH
                  10         20         30         40         50         60

                  70         80         90        100        110        120
   m543.pep   VDGFLPGYADFGADDDFFAAFIDDGIVFDVDVGVFXFQHRAGIGADQQGLKFFGQRLFLR
              :||:| | ||||:||||:|:|||||||||| || ||||||||||||||||||||||||||
       a543   IDGLLTGDADFGTDDDFLAALIDDGIVFDVDGRVFEFQHRAGIGADQQGLKFFGQRLFLR
                  70         80         90        100        110        120
```

-continued

```
                  130       140       150       160       170       180
m543.pep   VGRGAPRVADRQCGHTLEIEIGNRIGFGFLASGVGIAVFXDAQYLSGVLTDLAYRVGRGG
           ||||:|||||||||||||||||||||||| |    :|:| |:| | |||:||:: |||||
a543       VGRGTPRVADRQCGHTLEIEIGNRIGFGFWACRSRVAAFEDGQNLCGVLADLSHCVGRGG
                  130       140       150       160       170       180

                  190       200       210       220       230       239
m543.pep   KCHADAQNTDAQCADEGGFFHDXVSXFEYDG-IRLFGGFFRIAAVGIFLGKTRHEFADKV
           ||||||||||||||||||||||    |  :| : || |||||||:::|||:: |||:|:|
a543       KCHADAQNTDAQCADEGGFFHDV---FPENGCVCLFCGFFRIAALSVFLGEAGHEFTDQV
                  190       200       210       220      230

           240       250       260       270       280       290       299
m543.pep     FQNHCRTGYGDGVAGSKVFRVAALLQPDVLLAQKSRSQDLRGNVAAELILAVQIEAHPRL
             ||||||||||||||||||||:|||||||||:|||||||||||||:|||||||||:|||||
a543         FQNHCRTGYGDGVAGSKVFRIAALLQPDVLFAQKSRSQDLRGNVTAELILAVQIKAHPRL
             240       250       260       270       280       290

           300       310       320       330       340       350       359
m543.pep     IGFRVKSDSADAPDQYACGFDGGIDLQTADVAEIGINGVSFVRTAERRTAGHAESEKGNR
             |||||| |||||||||||||||||||||||||||||||||||||||||| : |||||||||
a543         IGFRVKPDSADAPDQYACGFDGGIDLQTADVAEIGINGVSFVRTAERRAARHAESEKGNR
             300       310       320       330       340       350

           360 370 379
m543.pep     RRANQDEQSDPKFQYVLLHX
             |||:|||||||||||||:||
a543         RRADQDEQSDPKFQYVLFHX
             360       370
```

The following partial DNA sequence was identified in *N. meningitidis* <SEQ ID 1583>:

```
a543.seq
   1  ATGGCTTATG GATTACTTGC TGCCGTTTNT AGCCTTCAAC TCGNCAATCA

  51  GTCCGTCCAC GCCTTTCGCT TTGATAATTT CGCCGAATTG GTTGCGGTAC

 101  ACGGTAACCA GGCTCGCGCC TTCGATGGCG ACGTTGTAGG TACGGTATTT

 151  ACCGCCGCTT TGGTAGGTGG TGAAGTCCAT GTTGACGGGT TTTTGCCCGG

 201  NNACGCCGAC TTCGGCGCGG ACGATGATTT CTTTGCCGCC TTTATTGACG

 251  ATNGGATTGT CTTTGACGTT GACGTTGGCG TTTTTTAATT TCAGCATCGT

 301  GCCGGAATAG GTGCGGATCA GCAGGGTTTG AAATTCTTTG GCCAACGCTT

 351  GTTTTTGCGC GTCGGACGCG GTGCGCCAAG GGTTGCCGAC CGCCAATGCG

 401  GTCATACGTT GGAAATCGAA ATAGGGAATC GCATAGGCTT CGGCTTTTTG

 451  GCGGGCGGTG TTGGCATCAC CGCTTTTTAA GATGCTCAAT ACTTGAGTGG

 501  CGTTTTGACG GATTTGGTTT ACCGCGTCGG CAGGGGCGGC AAATGCCATG

 551  CCGATGCTCA AAATACCGAT GCCCAATGCG CTGATGAAGG AGGATTTTTT

 601  CATGATTAAG TGTCCTAGTT TGAATATGAT GGCATACGTT TATTCGGCGG

 651  CTTTTTCCGC ATTGCCGCCG TCGGCATTTT TCTCGGCAAA ACTCGTCATG

 701  AATTTGCCGA TAAGGTTTTC CAGAACCATT GCAGAACTGG TTACGGAGAT

 751  GGTGTCGCCG GCAGCAAGGT TTTCCGTGTC GCCGCCCTGC TGCAGCCCGA

 801  TGTACTGCTC GCCCAAAAGT CCCGAAGTCA GGATTTGCGC GGAAACGTCG

 851  CTGCTGAACT GATACTTGCC GTCCAAATCG AGGCGCACCC TCGCCTGATA

 901  GGATTTCGGG TCAAGTCCGA TAGCGCCGAC GCGCCCGACC AATACGCCTG

 951  CGGATTTGAC GGGGGCATTG ACCTTCAAAC CGCCGATGTC GCCGAAATCG

1001  GCATAAACGG CGTAAGTTTT GTCCGAACCG CCGAACGCCG CACCGCCGGC

1051  CACGCGGAAA GCGAGAAAGG CAACCGCCGC CGCGCCAATC AGGACGAACA

1101  GTCCGACCCA AAATTCCAAT ATGTTCTTTT TCATTAA
```

This corresponds to the amino acid sequence <SEQ ID 1584; ORF 543.a>:

```
a543.pep
   1 MAYGLLAAVX SLQLXNQSVH AFRFDNFAEL VAVHGNQARA FDGDVVGTVF

  51 TAALVGGEVH VDGFLPGXAD FGADDDFFAA FIDDXIVFDV DVGVF*FQHR

 101 AGIGADQQGL KFFGQRLFLR VGRGAPRVAD RQCGHTLEIE IGNRIGFGFL

 151 AGGVGITAF* DAQYLSGVLT DLVYRVGRGG KCHADAQNTD AQCADEGGFF

 201 HD*VS*FEYD GIRLFGGFFR IAAVGIFLGK TRHEFADKVF QNHCRTGYGD

 251 GVAGSKVFRV AALLQPDVLL AQKSRSQDLR GNVAAELILA VQIEAHPRLI

 301 GFRVKSDSAD APDQYACGFD GGIDLQTADV AEIGINGVSF VRTAERRTAG

 351 HAESEKGNRR RANQDEQSDP KFQYVLFH*
```

m543/a543 96.0% identity in 378 aa overlap

```
                   10        20        30        40        50        60
m543.pep  MVCRLFAAVFGFQLGNQSVHAFRFDNFAELVAVHGNQARAFDGDVVGTVFTAALVGGEVH
          |:  |:|||  ::|| ||||||||||||||||||||||||||||||||||||||||||||
a543      MAYGLLAAVXSLQLXNQSVHAFRFDNFAELVAVHGNQARAFDGDVVGTVFTAALVGGEVH
                   10        20        30        40        50        60

                   70        80        90       100       110       120
m543.pep  VDGFLPGYADFGADDDFFAAFIDDGIVFDVDVGVFXFQHRAGIGADQQGLKFFGQRLFLR
          ||||||| |||||||||||||||| |||||||||||||||||||||||||||||||||||
a543      VDGFLPGXADFGADDDFFAAFIDDXIVFDVDVGVFXFQHRAGIGADQQGLKFFGQRLFLR
                   70        80        90       100       110       120

                  130       140       150       160       170       180
m543.pep  VGRGAPRVADRQCGHTLEIEIGNRIGFGFLASGVGIAVFXDAQYLSGVLTDLAYRVGRGG
          ||||||||||||||||||||||||||||||:||||::|||||||||||||||:|||||||
a543      VGRGAPRVADRQCGHTLEIEIGNRIGFGFLAGGVGITAFXDAQYLSGVLTDLVYRVGRGG
                  130       140       150       160       170       180

                  190       200       210       220       230       240
m543.pep  KCHADAQNTDAQCADEGGFFHDXVSXFEYDGIRLFGGFFRIAAVGIFLGKTRHEFADKVF
          ||||||||||||||||||||||||||||||||||||||||||||||||||||||||||||
a543      KCHADAQNTDAQCADEGGFFHDXVSXFEYDGIRLFGGFFRIAAVGIFLGKTRHEFADKVF
                  190       200       210       220       230       240

                  250       260       270       280       290       300
m543.pep  QNHCRTGYGDGVAGSKVFRVAALLQPDVLLAQKSRSQDLRGNVAAELILAVQIEAHPRLI
          ||||||||||||||||||||||||||||||||||||||||||||||||||||||||||||
a543      QNHCRTGYGDGVAGSKVFRVAALLQPDVLLAQKSRSQDLRGNVAAELILAVQIEAHPRLI
                  250       260       270       280       290       300

                  310       320       330       340       350       360
m543.pep  GFRVKSDSADAPDQYACGFDGGIDLQTADVAEIGINGVSFVRTAERRTAGHAESEKGNRR
          ||||||||||||||||||||||||||||||||||||||||||||||||||||||||||||
a543      GFRVKSDSADAPDQYACGFDGGIDLQTADVAEIGINGVSFVRTAERRTAGHAESEKGNRR
                  310       320       330       340       350       360

                  370      379
m543.pep  RANQDEQSDPKFQYVLLHX
          ||||||||||||||||:||
a543      RANQDEQSDPKFQYVLFHX
                  370
```

The following partial DNA sequence was identified in *N. gonorrhoeae* <SEQ ID 1585>:

```
g544.seq
   1 atgaaaaaaa tactcaccgc cgccgccgtc gcactgatcg gcatcctcct

  51 cgccaccgtc ctcatccccg acagtaaaac cgcgcccgcc ttctccctgc

 101 ccgacctgca cggaaaaacc gtttccaacg ccgacctgca aggcaaagtc

 151 accctgatta atttttggtt tccctcctgt ccgggttgtg tgagcgaaat

 201 gcccaaagtc accaaaacgg caaacgacta caaaaataaa gatttccaag

 251 tcctcgccgt tgcccagccc atcgatccga tagaaagcgt ccgccaatac

 301 gtcaaagact acggactgcc gtttaccgtc atttatgatg cggacaaagc
```

-continued

```
351 cgtcggacag gcattcggca cacaggttta tccgacttcc gtccttatcg

401 gcaaaaaagg cgaaatcctc aaaacttatg tcggcgaacc cgatttcggc

451 aaactctacc aagaaatcga taccgcgctg gcgcaatag
```

This corresponds to the amino acid sequence <SEQ ID 1586; ORF 544.ng>:

```
g544.pep
   1 MKKILTAAAV ALIGILLATV LIPDSKTAPA FSLPDLHGKT VSNADLQGKV

  51 TLINFWFPSC PGCVSEMPKV TKTANDYKNK DFQVLAVAQP IDPIESVRQY

 101 VKDYGLPFTV IYDADKAVGQ AFGTQVYPTS VLIGKKGEIL KTYVGEPDFG

 151 KLYQEIDTAL AQ*
```

The following partial DNA sequence was identified in *N. meningitidis* <SEQ ID 1587>:

```
m544.seq
   1 ATGAwAAAAA TACTCACCGC CGCCGTCGTC GCACTGATCG GCATCCTCCT

  51 TGCCATCGTC CTCmTCCCCG ACAGCAAAAC CGCGCCCGCC TTCTCCmTGC

 101 CCGACCTGCA CGGAAAAACC GTTTCCAACG CCGACCTGCA AGGCAAAGTA

 151 ACCCTGATTA ATTTTTGGTT TCCCTCCTGT CCGGGTTGTG TGAGCGAwAT

 201 GCCCAAAATC ATTAAAACGG CAAATGACTA TAAAAwCAAA AACTTCCAAG

 251 TACTTGCCGT CGCCCAGCCC ATCGATCCGA TAGAAAGCGT CCGCCAATAT

 301 GTCAAAGACT ACGGTTTGCC GTTTACCGTC ATGTATGATG CGGACAAAGC

 351 TGTCGGACAG GCGTTCGGCA CACAGGTTTA TCCGACTTCC GTCCTTATCG

 401 GCAAATAAGG CGAAATCTTC AAAACCTACG TCGGCGAACC CGATTTCGGC

 451 AAACTCTACC AAGAAATCGA TACGCGCGTG GCGCAATAG
```

This corresponds to the amino acid sequence <SEQ ID 1588; ORF 544>:

```
m544.pep
   1 MXKILTAAVV ALIGILLAIV LXPDSKTAPA FSXPDLHGKT VSNADLQGKV

  51 TLINFWFPSC PGCVSXMPKI IKTANDYKXK NFQVLAVAQP IDPIESVRQY

 101 VKDYGLPFTV MYDADKAVGQ AFGTQVYPTS VLIGK*GEIF KTYVGEPDFG

 151 KLYQEIDTRV AQ*
```

Computer analysis of this amino acid sequence gave the following results:

Homology with a Predicted ORF from *N. gonorrhoeae*

ORF 544 shows 90.7% identity over a 162 aa overlap with a predicted ORF (ORF 544.ng) from *N. gonorrhoeae*:

```
m544/g544

                    10        20        30        40        50        60
m544.pep    MXKILTAAVVALIGILLAIVLXPDSKTAPAFSXPDLHGKTVSNADLQGKVTLINFWFPSC
            | ||||||:||||||||| || |||||||||| |||||||||||||||||||||||||||
g544        MKKILTAAAVALIGILLATVLIPDSKTAPAFSLPDLHGKTVSNADLQGKVTLINFWFPSC
                    10        20        30        40        50        60
```

-continued

```
                  70        80        90       100       110       120
m544.pep PGCVSXMPKIIKTANDYKXKNFQVLAVAQPIDPIESVRQYVKDYGLPFTVMYDADKAVGQ
         ||||| |||: ||||||| |:|||||||||||||||||||||||||||||:|||||||||
g544     PGCVSEMPKVTKTANDYKNKDFQVLAVAQPIDPIESVRQYVKDYGLPFTVIYDADKAVGQ
                  70        80        90       100       110       120

                 130       140       150       160
m544.pep AFGTQVYPTSVLIGKXGEIFKTYVGEPDFGKLYQEIDTRVAQX
         |||||||||||||| |||:||||||||||||||||| :|||
g544     AFGTQVYPTSVLIGKKGEILKTYVGEPDFGKLYQEIDTALAQX
                 130       140       150       160
```

The following partial DNA sequence was identified in *N. meningitidis* <SEQ ID 1589>:

```
a544.seq
    1 ATGAAAAAAA TACTCACCGC CGCCGTCGTC GCACTGATCG GCATCCTCCT

   51 TGCCATCGTC CTCATCCCCG ACAGCAAAAC CGCGCCCGCT TTCTCCCTGT

  101 CCGANCTGCA CGGAAAAANC GTTTNCAACG CCGACCTGCA AGGCNAAGTT

  151 ANCCTGATTA ANTTTTGGTT TCCCTCCTGT CCGGGTTGTG TGAGCGAAAT

  201 GNCCANAATC ATTAAAACGG CAAATGACTA TAAAAACAAA AACTTCCAAG

  251 TCCTTGCCGT CGCCCAGCCC ATCGATCCGA TAGAAAGCGT CCGCCAATAT

  301 GTCAAAGACT ACGGTTTGCC GTTTACCGTC ATGTATGATG CGGACAAAGC

  351 TGTCGGACAG GCGTTCGGCA CACAGGTTTA TCCGACTTCC GTCCTTATCG

  401 GCAAAAAAGG CGAAATCCTC AAAACTTATG TCGGCGAACC CGATTTCGGC

  451 AAACTCTACC AAGAAATCGA TACCGCGCTG GCACAATAG
```

This corresponds to the amino acid sequence <SEQ ID 1590; ORF 544.a>:

```
a544.pep
    1 MKKILTAAVV ALIGILLAIV LIPDSKTAPA FSLSXLHGKX VXNADLQGXV

   51 XLIXFWFPSC PGCVSEMXXI IKTANDYKNK NFQVLAVAQP IDPIESVRQY

  101 VKDYGLPFTV MYDADKAVGQ AFGTQVYPTS VLIGKKGEIL KTYVGEPDFG

  151 KLYQEIDTAL AQ*
```

m544/a544 88.9% identity in 162 aa overlap

```
                  10        20        30        40        50        60
m544.pep MXKILTAAVVALIGILLAIVLXPDSKTAPAFSXPDLHGKTVSNADLQGKVTLINFWFPSC
         | |||||||||||||||||| ||||||||||    ||||:| |||||| |:|| ||||||
a544     MKKILTAAVVALIGILLAIVLIPDSKTAPAFSLSXLHGKXVXNADLQGXVXLIXFWFPSC
                  10        20        30        40        50        60
                  70        80        90       100       110       120
m544.pep PGCVSXMPKIIKTANDYKXKNFQVLAVAQPIDPIESVRQYVKDYGLPFTVMYDADKAVGQ
         ||||| |  ||||||||| |||||||||||||||||||||||||||||||||||||||||
a544     PGCVSEMXXIIKTANDYKNKNFQVLAVAQPIDPIESVRQYVKDYGLPFTVMYDADKAVGQ
                  70        80        90       100       110       120
                 130       140       150       160
m544.pep AFGTQVYPTSVLIGKXGEIFKTYVGEPDFGKLYQEIDTRVAQX
         |||||||||||||| |||:||||||||||||||||| :|||
a544     AFGTQVYPTSVLIGKKGEILKTYVGEPDFGKLYQEIDTALAQX
                 130       140       150       160
```

The following partial DNA sequence was identified in *N. gonorrhoeae* <SEQ ID 1591>:

```
g547.seq
  1  atgttcgtag ataacggatt taataaaacg gtagcgagtt ttgcccaaat
```

-continued

```
 51 cgtcgaaact ttcgacgtat tcttctttag gaacgattgc gccttttta

101 cgcagatgaa acagcggtgc ggttgggtct gctcgttggt atatctcgtt

151 gatatattta caagatgcgg cttcgagatt ccgaaccgct cctttaaaga

201 gcttgggctt ttgatacaga taagtctgtc ggaacgtttt aggactaatg

251 ccgaagtcga gatggatgcc cattacttcc ccttactcag aaaatattta

301 aaatttataa tgttacatat agttacaaat attagagttt tttgtgtgtg

351 cgtcaaggaa ttgttgacaa ttttagttaa aaatttgtct ccaaacggaa

401 aaaagcggtt tgtttttgt tgttaa
```

This corresponds to the amino acid sequence <SEQ ID 1592; ORF 547.ng>:

```
g547.pep
  1 MFVDNGFNKT VASFAQIVET FDVFFFRNDC AFFTQMKQRC GWVCSLVYLV

 51 DIFTRCGFEI PNRSFKELGL LIQISLSERF RTNAEVEMDA HYFPLLRKYL

101 KFIMLHIVTN IRVFCVCVKE LLTILVKNLS PNGKKRFVFC C*
```

The following partial DNA sequence was identified in *N. meningitidis* <SEQ ID 1593>:

```
m547.seq.
  1 ATGTTCGTAG ATAACGGATT TAATAAAACG GTAGCGAGTT TTGCCCAAAT

 51 CGTCGAAACT TTCGACGTAT TCTTCTTTAG GAACGATTGC GCCTTTTTTA

101 CGCAGATGAA ACAGCGGTGC GGTTGGGTCT GCTCGTTGGT ATATCTCGTT

151 GATATCTTTC CAAGATGCGG ATTCGAGATT CCGAACCGCT CCTTTAAAGA

201 GCTTGGGCTT TTGATACAGA TAAGTCTGTC GGAACGTTTT AGGACTAATG

251 CCGAAGTCGA GATGGATGCT CATTACTTCC CCTTACTCAG AAAATATTTA

301 AAATTTATAA TGTTACATAT ATTTACAAAT ATTAAAGTTT TTTwTTGTGT

351 GTGCGTCAAG GAATTGTTGA CAATTTTAGT TAAAAATTTG TCTCCAAACG

401 GAAAAAAGCG GTTTGTTTTT TGTTGTTAA
```

This corresponds to the amino acid sequence <SEQ ID 1594; ORF 547>:

```
m547.pep
  1 MFVDNGFNKT VASFAQIVET FDVFFFRNDC AFFTQMKQRC GWVCSLVYLV

 51 DIFPRCGFEI PNRSFKELGL LIQISLSERF RTNAEVEMDA HYFPLLRKYL

101 KFIMLHIFTN IKVFXCVCVK ELLTILVKNL SPNGKKRFVF CC*
```

Computer analysis of this amino acid sequence gave the following results:
Homology with a Predicted ORF from *N. gonorrhoeae*
ORF 547 shows 97.2% identity over a 142 aa overlap with a predicted ORF (ORF 547.ng) from *N. gonorrhoeae*:

```
m547/g547
                  10         20         30         40         50         60
   m547.pep   MFVDNGFNKTVASFAQIVETFDVFFFRNDCAFFTQMKQRCGWVCSLVYLVDIFPRCGFEI
              ||||||||||||||||||||||||||||||||||||||||||||||||||||| ||||||
   g547       MFVDNGFNKTVASFAQIVETFDVFFFRNDCAFFTQMKQRCGWVCSLVYLVDIFTRCGFEI
                  10         20         30         40         50         60
                  70         80         90        100        110        120
   m547.pep   PNRSFKELGLLIQISLSERFRTNAEVEMDAHYFPLLRKYLKFIMLHIFTNIKVFXCVCVK
              |||||||||||||||||||||||||||||||||||||||||||||||||||:|| |||||
   g547       PNRSFKELGLLIQISLSERFRTNAEVEMDAHYFPLLRKYLKFIMLHIVTNIRVF-CVCVK
                  70         80         90        100        110
                 130        140
   m547.pep   ELLTILVKNLSPNGKKRFVFCCX
              |||||||||||||||||||||||
   g547       ELLTILVKNLSPNGKKRFVFCCX
                 120        130        140
```

The following partial DNA sequence was identified in *N. meningitidis* <SEQ ID 1595>:

```
a547.seq
   1 ATGTTCGTAG ATAACGGATT TAATAAAACG GTAGCGAGTT TTGCCCAAAT

  51 CGTCGAAACT TTCGACGTAT TCTTCTTTAG GAACAATTGC ACCTTTTTTA

 101 CGCAGATGAA ACAGCGGTGC GGTTGGGTCT GCTCGTTGGT ATATCTCGTT

 151 GATATCTTTC CAAGATGCGG CTTCGAGATT CCGAACCGCT CCTTTAAAGA

 201 GCTTGGGCTT TTGATACAGA TAAGTCTGTC GGAACGTTTT AGGACTAATG

 251 CCGAAGTCGA GATAGATGCT CATTACTTCC CCTTACTCAG AAAATATTTA

 301 AAATTTATAA TGTTACATAT ATTTACAAAT ATTAAAGTTT TTTT.TGTGT

 351 GTGCGTCAAG GAATTGTTGA CAATTTTAGT T
```

This corresponds to the amino acid sequence <SEQ ID 1596; ORF 547.a>:

```
a547.pep
   1 MFVDNGFNKT VASFAQIVET FDVFFFRNNC TFFTQMKQRC GWVCSLVYLV

  51 DIFPRCGFEI PNRSFKELGL LIQISLSERF RTNAEVEIDA HYFPLLRKYL

 101 KFIMLHIFTN IKVFXCVCVK ELLTILV
```

m547/a547 97.6% identity in 127 aa overlap

```
                  10         20         30         40         50         60
   m547.pep   MFVDNGFNKTVASFAQIVETFDVFFFRNDCAFFTQMKQRCGWVCSLVYLVDIFPRCGFEI
              |||||||||||||||||||||||||||||:|:||||||||||||||||||||||||||||
   a547       MFVDNGFNKTVASFAQIVETFDVFFFRNNCTFFTQMKQRCGWVCSLVYLVDIFPRCGFEI
                  10         20         30         40         50         60
                  70         80         90        100        110        120
   m547.pep   PNRSFKELGLLIQISLSERFRTNAEVEMDAHYFPLLRKYLKFIMLHIFTNIKVFXCVCVK
              |||||||||||||||||||||||||||||:||||||||||||||||||||||||||||||
   a547       PNRSFKELGLLIQISLSERFRTNAEVEIDAHYFPLLRKYLKFIMLHIFTNIKVFXCVCVK
                  70         80         90        100        110        120
                 130        140
   m547.pep   ELLTILVKNLSPNGKKRFVFCCX
              |||||||
   a547       ELLTILV
```

The following partial DNA sequence was identified in *N. gonorrhoeae* <SEQ ID 1597>:

```
g548.seq
    1 atgttttccg taccgcgttc cttttttgccg ggcgttttcg tacttgccgc

   51 gcttgccgcc tgcaaacctc aagacaacag tgcggcgcaa gccgcttctt

  101 caagtgcatc cgcgccggct gcggaaaatg cggcaaagcc gcaaacgcgc

  151 ggtacggata tgcgtaagga agacatcggc ggcgatttca cactgaccga

  201 cggcgaaggc aagcctttca gcctgagcga tttgaaaggc aaggtcgtga

  251 ttctgtcttt cggctttacg cactgtcccg atgtctgccc gacagggctt

  301 ttgacgtaca gcgacacttt gaagcagttg ggcgggcagg ctaaggacgt

  351 gaaagtggtg ttcgtcagca tcgatccgga acgcgacacg cctgaaatca

  401 tcggcaagta tgccaaacag ttcaatccgg actttatcgg tctgacggca

  451 acgggcggcc aaaacctgcc ggtcatcaag cagcaatacc gcgtggtttc

  501 tgccaaaatc aatcaaaaag acgacagcga aaactatttg gtcgaccact

  551 cttccggtgc gtatcttatc gataaaaacg gtgaggttgc cattttctcg

  601 ccttacggaa gcgagccgga aacgattgct gccgatgtaa ggaccctgct

  651 ctga
```

This corresponds to the amino acid sequence <SEQ ID 1598; ORF 548.ng>:

```
g548.pep
    1 MFSVPRSFLP GVFVLAALAA CKPQDNSAAQ AASSSASAPA AENAAKPQTR

   51 GTDMRKEDIG GDFTLTDGEG KPFSLSDLKG KVVILSFGFT HCPDVCPTGL

  101 LTYSDTLKQL GGQAKDVKVV FVSIDPERDT PEIIGKYAKQ FNPDFIGLTA

  151 TGGQNLPVIK QQYRVVSAKI NQKDDSENYL VDHSSGAYLI DKNGEVAIFS

  201 PYGSEPETIA ADVRTLL*
                                                           40
```

The following partial DNA sequence was identified in *N. meningitidis* <SEQ ID 1599>:

```
m548.seq
    1 ATGTTTTCCG TACCGCGTTC CTTTTTGCCG GGCGTTTTCG TACTTGCCGC

   51 GCTTGCCGCC TGCAAACCTC AAGACAACAG TGCGGCGCAA GTCGCTTCTT

  101 CAAGTGCATC CGCGTCGGCT GCGGAAAATG CGGCAAAGCA AnACACGCGC

  151 GGTACGGATA TGCGTAAGGA AGACATCGGC GGCGATTTCA CGCTGACCGA

  201 CGGCGAAGGC AAGCCTTTCA ACCTGAGCGA TTTGAAAGGC AAGGTCGTGA

  251 TTCTGTCTTT CGGCTTTACG CACTGTCCCG ATGTCTGCCC GACAGAGCTT

  301 TTGACGTACA GCGACACGTT GAAGCAGTTG GGCGGGCAGG CTAAGGACGT

  351 GAAAGTGGTG TTCGTCAGCA TCGATCCGGA ACGCGACACG CCTGAAATCA

  401 TCGGCAAGTA TGCCAAACAG TTCAATCCGG ACTTTATCGs TCTGACGGCA

  451 ACGGGCGGCC AAAACCTGCC GGTCATCAAG CAGCAATACc GCGTGGTTTC

  501 TGCCAAAGTC AATCAAAmG ACGACAGCGA AAACTATTTG GTCGACCACT

  551 CTTCCGGTGC GTATCTCATC GACAAAAACG GTGAGGTTGC CATTTTCTCG
```

-continued

```
601 CCTTACGGAA GCGAGCCGGA AACGATTGCT GCCGATGTAA GGACCCTGCT

651 CTGA
```

This corresponds to the amino acid sequence <SEQ ID 1600; ORF 548>.

```
m548.pep
   1 MFSVPRSFLP GVFVLAALAA CKPQDNSAAQ VASSSASASA AENAAKQXTR

  51 GTDMRKEDIG GDFTLTDGEG KPFNLSDLKG KVVILSFGFT HCPDVCPTEL

 101 LTYSDTLKQL GGQAKDVKVV FVSIDPERDT PEIIGKYAKQ FNPDFIXLTA

 151 TGGQNLPVIK QQYRVVSAKV NQXDDSENYL VDHSSGAYLI DKNGEVAIFS

 201 PYGSEPETIA ADVRTLL*
```

Computer analysis of this amino acid sequence gave the following results:

Homology with a Predicted ORF from *N. gonorrhoeae*

ORF 548 shows 95.9% identity over a 217 aa overlap with a predicted ORF (ORF 548.ng) from *N. gonorrhoeae*:

```
m548/g548

                    10        20        30        40        50        60
m548.pep    MFSVPRSFLPGVFVLAALAACKPQDNSAAQVASSSASASAAENAAKQXTRGTDMRKEDIG
            ||||||||||||||||||||||||||||||:||||||| ||||||| ||||||||||||
g548        MFSVPRSFLPGVFVLAALAACKPQDNSAAQAASSSASAPAAENAAKPQTRGTDMRKEDIG
                    10        20        30        40        50        60

                    70        80        90       100       110       120
m548.pep    GDFTLTDGEGKPFNLSDLKGKVVILSFGFTHCPDVCPTELLTYSDTLKQLGGQAKDVKVV
            ||||||||||||:||||||||||||||||||||||||| ||||||||||||||||||||
g548        GDFTLTDGEGKPFSLSDLKGKVVILSFGFTHCPDVCPTGLLTYSDTLKQLGGQAKDVKVV
                    70        80        90       100       110       120

                   130       140       150       160       170       180
m548.pep    FVSIDPERDTPEIIGKYAKQFNPDFIXLTATGGQNLPVIKQQYRVVSAKVNQXDDSENYL
            |||||||||||||||||||||||||| |||||||||||||||||||||:|| |||||||
g548        FVSIDPERDTPEIIGKYAKQFNPDFIGLTATGGQNLPVIKQQYRVVSAKINQKDDSENYL
                   130       140       150       160       170       180

                   190       200       210
m548.pep    VDHSSGAYLIDKNGEVAIFSPYGSEPETIAADVRTLLX
            ||||||||||||||||||||||||||||||||||||||
g548        VDHSSGAYLIDKNGEVAIFSPYGSEPETIAADVRTLLX
                   190       200       210
```

The following partial DNA sequence was identified in *N. meningitidis* <SEQ ID 1601>:

```
a548.seq
   1 ATGTTTTCCG TACCGCGTTC CTTTTTGCCG GGCGTTTTCG TACTTGCCGC

  51 GCTTGCCGCC TGCAAACCTC AAGACAACAG TGCGGCGCAA GTCGCTTCTT

 101 CAAGTGCATC CGCGTCGGCT GCGGAAAATG CGGCAAAGCC GCAAACGCGC

 151 GGTACGGATA TGCGTAAGGA AGACATCGGC GGCGATTTCA CGCTGACCGA

 201 CGGCGAAGGC AAGCCTTTCA ACCTGAGCGA TTTGAAAGGC AAGGTCGTGA

 251 TTCTGTCTTT CGGCTTTACG CACTGTCCCG ATGTCTGCCC GACAGAGCTT

 301 TTGACGTACA GCGACACGTT GAAGCAGTTG GGCGGGCAGG CTAAGGACGT

 351 GAAAGTGGTG TTCGTCAGCA TCGATCCGGA ACGCGACACG CCTGAAATCA

 401 TCGGCAAGTA TGCCAAACAG TTCAATCCGG ACTTTATCGG TCTGACGGCA
```

-continued

```
451 ACGGGCGACC AAAACCTGCC GGTCATCAAG CAGCAATACC GCGTGGTTTC

501 TGCCAAAGTC AATCAAAAAG ACGACAGCGA AAACTATTTG GTCGACCACT

551 CTTCCGGTGC GTATCTCATC GACAAAAACG GTGAGGTTGC CATTTTCTCG

601 CCTTACGGAA GCGAGCCGGA AACGATTGCT GCCGATGTAA GGACCCTGCT

651 CTGA
```

This corresponds to the amino acid sequence <SEQ ID 1602; ORF 548.a>:

```
a548.pep
  1 MFSVPRSFLP GVFVLAALAA CKPQDNSAAQ VASSSASASA AENAAKPQTR

 51 GTDMRKEDIG GDFTLTDGEG KPFNLSDLKG KVVILSFGFT HCPDVCPTEL

101 LTYSDTLKQL GGQAKDVKVV FVSIDPERDT PEIIGKYAKQ FNPDFIGLTA

151 TGDQNLPVIK QQYRVVSAKV NQKDDSENYL VDHSSGAYLI DKNGEVAIFS

201 PYGSEPETIA ADVRTLL*
```

m548/a548 97.7% identity in 217 aa overlap

```
                 10        20        30        40        50        60
m548.pep MFSVPRSFLPGVFVLAALAACKPQDNSAAQVASSSASASAAENAAKQXTRGTDMRKEDIG
         ||||||||||||||||||||||||||||||||||||||||||||||||  ||||||||||
a548     MFSVPRSFLPGVFVLAALAACKPQDNSAAQVASSSASASAAENAAKPQTRGTDMRKEDIG
                 10        20        30        40        50        60

                 70        80        90       100       110       120
m548.pep GDFTLTDGEGKPFNLSDLKGKVVILSFGFTHCPDVCPTELLTYSDTLKQLGGQAKDVKVV
         ||||||||||||||||||||||||||||||||||||||||||||||||||||||||||||
a548     GDFTLTDGEGKPFNLSDLKGKVVILSFGFTHCPDVCPTELLTYSDTLKQLGGQAKDVKVV
                 70        80        90       100       110       120

                130       140       150       160       170       180
m548.pep FVSIDPERDTPEIIGKYAKQFNPDFIXLTATGGQNLPVIKQQYRVVSAKVNQXDDSENYL
         |||||||||||||||||||||||||| ||||| ||||||||||||||||||| |||||||
a548     FVSIDPERDTPEIIGKYAKQFNPDFIGLTATGDQNLPVIKQQYRVVSAKVNQKDDSENYL
                130       140       150       160       170       180

                190       200       210
m548.pep VDHSSGAYLIDKNGEVAIFSPYGSEPETIAADVRTLLX
         |||||||||||||||||||||||||||||||||||||
a548     VDHSSGAYLIDKNGEVAIFSPYGSEPETIAADVRTLLX
                190       200       210
```

The following partial DNA sequence was identified in *N. gonorrhoeae* <SEQ ID 1603>:

```
g550.seq
  1 atgataacgg acaggtttca tctctttcat tttccagtat ctttcattta

 51 tcaatctgac aacaaaatgc cgcctgaaaa cagttcagac ggcattttaa

101 ccacaaacgg cttacagctt ccattcgccc aacttggcag cgtaagcttc

151 caaatctgca atcggacggg ttgccacgcc gctttccatc gctgctttgg

201 cggcagccgt agcgacgcga ggcagcaggc gggaatcgaa cggagtagga

251 atcaggtatt ccgcgccgaa ttcgaatttc ttaccgtaag cggcaaccac

301 ttcttcggtt acttcttcca tcgccaaatc tgccaaagca tacacgcagg

351 cgcgtttcat ttcttcgttg atggtggttg cgccgacatc caacgcgccc

401 cggaagatga acgggaagca caatacgttg ttcacttggt tcgggaagtc

451 ggagcggccg gtaccgataa ccacgtccgg acgggtttct ttcgccagcg

501 gcggcaggat ttccggattc gggttggcca tggcgaacac gatgggtttt
```

-continued

```
551 tcgttcatcg tgttcaacat ttcaggcgtc agcaggtttg cgccggagag

601 gcccaagaag atgtctttgc ctttaaccgc atcggcaagt acgcgccggc

651 cgttgtcttc aacggcgtag aattttttgg attcgtccat gcggtctttg

701 tcttcgcggg tttggtaaat cacgcctttg gagttgcaaa cggttacgtt

751 ttcacgtttc aagcccaaat ccagcagttg gttcaggcag gcaatcgcgg

801 cggcacctgc gccggagcac accaaagtcg cttcttcgat tttacggccg

851 gtataacgca gggcgttcaa tacggcggcg gcggtaatga tggccgtgcc

901 gtgctggtca tcatgaaata cggggatttt gcagcgtttg cgtaa
```

This corresponds to the amino acid sequence <SEQ ID 1604; ORF 550.ng>:

```
g550.pep
   1 MITDRFHLFH FPVSFIYQSD NKMPPENSSD GILTTNGLQL PFAQLGSVSF

  51 QICNRTGCHA AFHRCFGGSR SDARQQAGIE RSRNQVFRAE FEFLTVSGNH

 101 FFGYFFHRQI CQSIHAGAFH FFVDGGCADI QRAPEDEREA QYVVHLVREV

 151 GAAGTDNHVR TGFFRQRRQD FRIRVGHGEH DGFFVHRVQH FRRQQVCAGE

 201 AQEDVFAFNR IGKYAPAVVF NGVEFFGFVH AVFVFAGLVN HAFGVANGYV

 251 FTFQAQIQQL VQAGNRGGTC AGAHQSRFFD FTAGITQGVQ YGGGGNDGRA

 301 VLVIMKYGDF AAFA*
```

The following partial DNA sequence was identified in *N. meningitidis* <SEQ ID 1605>:

```
m550.seq (partial)
   1 ..GACGGCATCG GCAAGCACGC GCTGGCCGTT GTCTTCAATG GCGTAGAACT

  51   GTTTGGACTC GTCCATACGG TCTTTGTCTT CGCGGGTTTG GTAAATCACG

 101   CCTTTGGAGT CGCAAACGGT CACGTTTTCG CGTTTCAAGC CCAAATCCAG

 151   CAATTGGwTC AAGCAGGCAA TCGCGGCCGC ACCTGCGCCG GAACACACCA

 201   AAGTCGCTTC TTCGATTTTA CGGCCGGTAA AACGCAkGGC GTTCAATACG

 251   GCGGCGGCGG TAATGATGGC CGTGCCGTGC TGGTCGTCGT GGAATACGGG

 301   GATTTTGCAG CGTTTGCGTA A
```

This corresponds to the amino acid sequence <SEQ ID 1606; ORF 550>:

```
m550.pep (partial)
   1 ..DGIGKHALAV VFNGVELFGL VHTVFVFAGL VNHAFGVANG HVFAFQAQIQ

  51   QLXQAGNRGR TCAGTHQSRF FDFTAGKTXG VQYGGGGNDG RAVLVVVEYG

 101   DFAAFA*
```

Computer analysis of this amino acid sequence gave the following results:

Homology with a Predicted ORF from *N. gonorrhoeae*

ORF 550 shows % identity over a aa overlap with a predicted ORF (ORF 550.ng) from *N. gonorrhoeae*:

```
m550/g550

                                           10        20        30
m550.pep                             DGIGKHALAVVFNGVELFGLVHTVFVFAGLVN
                                         |||:| ||||||||:||:||:|||||||||
g550     DGFFVHRVQHFRRQQVCCAGEAQEDVFAFNRIGKYAPAVVFNGVEFFGFVHAVFVFAGLVN
                190       200       210       220       230       240

                40        50        60        70        80        90
m550.pep HAFGVANGHVFAFQAQIQQLXQAGNRGRTCAGTHQSRFFDFTAGKTXGVQYGGGGNDGRA
         ||||||||:||:|||||||| |||||| ||||:|||||||||||| | ||||||||||||
g550     HAFGVANGYVFTFQAQIQQLVQAGNRGGTCAGAHQSRFFDFTAGITQGVQYGGGGNDGRA
                250       260       270       280       290       300

               100
m550.pep VLVVVEYGDFAAFAX
         |||:::|||||||||
g550     VLVIMKYGDFAAFAX
                310
```

The following partial DNA sequence was identified in *N. meningitidis* <SEQ ID 1607>:

```
a550.seq
  1    CTATATCAAT CTGACAGCAA AATGCCGCCT GAAAACAGTT CAGACGGCAT

 51    TTTAACCGCA AACGGCTTAC AGCTTCCATT CGCTCAGCTT GGCAGCGTAA

101    GCTTCCAAAT CTGCAATCGG ACGGGTTGCC ACGCCGCTTT CCATCGCTGC

151    TTTGGCGGCA GCCGTAGCAA CGCGCGGCAG CAGGCGGGAA TCGAACGGAG

201    TCGGAATCAG GTATTCCGCG CCGAATTCAA ATTTCTTACC GTAAGCGGCA

251    ACCACTTCTT CGGTTACCTC TTCCATCGCC AAATCCGCCA AAGCATACAC

301    GCAGGCGCGT TTCATTTCTT CGTTGATGGT CGTCGCGCCG ACATCCAACG

351    CACCGCGGAA GATGAACGGG AAGCACAATA CATTGTTCAC TTGGTTCGGG

401    AAGTCGGAGC GGCCGGTACC GATAACCACG TCCGGACGGG TTTCTTTCGC

451    CAGCGGCGGC AGGATTTCCG GATTCGGGTT GGCCATAGCG AACACGATGG

501    GTTTTTCGTT CATGGTGTTC AGTATTTCAG GCGTCAGCAG GTTCGCGCCG

551    GAGAGGCCCA AGAAGATGTC TTTGCCTTTG ACGGCATCGG CAAGCACGCG

601    CTGGCCGTTG TCTTCAATGG CGTAGAACTG TTTGGACTCG TCCATACGGT

651    CTTTGTCTTC GCGGGTTTGG TAAATCACGC CTTTGGAGTC GCAAACGGTC

701    ACGTTTTCGC GTTTCAAGCC CAAATCCAGC AATTGGTTCA AGCAGGCAAT

751    CGCGGCCGCA CCTGCGCCGG AACACACCAA AGTCGCTTCT TCGATTTTAC

801    GGCCGGTAAA ACGCAGGGCG TTCAATACGG CAGCGGCGGT AATGATGGCC

851    GTGCCGTGCT GGTCGTCGTG GAATACGGGG ATTTTGCAGC GTTTGCGTAA
```

This corresponds to the amino acid sequence <SEQ ID 1608; ORF 550.a>:

```
a550.pep
  1 LYQSDSKMPP ENSSDGILTA NGLQLPFAQL GSVSFQICNR TGCHAAFHRC

 51 FGGSRSNARQ QAGIERSRNQ VFRAEFKFLT VSGNHFFGYL FHRQIRQSIH

101 AGAFHFFVDG RRADIQRTAE DEREAQYIVH LVREVGAAGT DNHVRTGFFR

151 QRRQDFRIRV GHSEHDGFFV HGVQYFRRQQ VRAGEAQEDV FAFDGIGKHA
```

-continued

```
201 LAVVFNGVEL FGLVHTVFVF AGLVNHAFGV ANGHVFAFQA QIQQLVQAGN

251 RGRTCAGTHQ SRFFDFTAGK TQGVQYGSGG NDGRAVLVVV EYGDFAAFA*
```

m550/a550 97.2% identity in 106 aa overlap

```
                                                 10        20        30
m550.pep                              DGIGKHALAVVFNGVELFGLVHTVFVFAGL
                                      ||||||||||||||||||||||||||||||
a550      EHDGFFVHGVQYFRRQQVRAGEAQEDVFAFDGIGKHALAVVFNGVELFGLVHTVFVFAGL
              170       180       190       200       210       220

                    40        50        60        70        80        90
m550.pep  VNHAFGVANGHVFAFQAQIQQLXQAGNRGRTCAGTHQSRFFDFTAGKTXGVQYGGGGNDG
          ||||||||||||||||||||| |||||||||||||||||||||||||| ||||:||||||
a550      VNHAFGVANGHVFAFQAQIQQLVQAGNRGRTCAGTHQSRFFDFTAGKTQGVQYGSGGNDG
              230       240       250       260       270       280

                   100
m550.pep  RAVLVVVEYGDFAAFX
          ||||||||||||||||
a550      RAVLVVVEYGDFAAFX
              290       300
```

The following partial DNA sequence was identified in *N. gonorrhoeae* <SEQ ID 1609>:

```
g552.seq
  1 atgaagctga aaaccttgtt attgcccttc gccgcactgg cattgtgtgc

 51 caacgcattt gccgccccgc ccggcgacgc gtcgttggca cgttggctgg

101 atacgcagaa tttcgaccgg gatatagaaa aaaatatgat tgaaggcttt

151 aatgccggat ttaaaccgta tgcggacaaa gcccttgccg aaatgccgga

201 agcgaaaaaa gatcaggcgg cagaagcctt taatcgttat cgtgagaatg

251 ttttgaaaga tttgattacg cccgaagtga aacaggctgt ccgcaatacc

301 ttattgaaga atgcccgtga aatatacacg caagaagaaa ttgacggcat

351 gattgccttt tacggttcgc ctgtcggtca gtccgtcgtt gccaaaaatc

401 cgcgcttaat caagaaatcg atgagtgaaa tagcggtatc ttggactgca

451 ttgtcaggga aaatcgcgcg acatcatctg cccgagttta cggaagagtt

501 acggcgcatc atctgcggcg gtatagtgga ttaa
```

This corresponds to the amino acid sequence <SEQ ID 1610; ORF552.ng>:

```
g552.pep
  1 MKLKTLLLPF AALALCANAF AAPPGDASLA RWLDTQNFDR DIEKNMIEGF

 51 NAGFKPYADK ALAEMPEAKK DQAAEAFNRY RENVLKDLIT PEVKQAVRNT

101 LLKNAREIYT QEEIDGMIAF YGSPVGQSVV AKNPRLIKKS MSEIAVSWTA

151 LSGKIARHHL PEFTEELRRI ICGGIVD*
```

The following partial DNA sequence was identified in *N. meningitidis* <SEQ ID 1611>:

```
m552.seq (partial)
  1 ..ATTAAACTGA AAACCTTGTT ATTGCCCTTC GCCACGCTGG CATTGTGCAC

 51   CAATGCTTTT GCCGCCCCGC CCAGCGACGC GTCGTTGGCG CGTTGGCTGG

101   ATACGCAGAA TTTTGACCGG GATATAGAAA AAAATATGAT TGAGGGCTTT
```

-continued

```
151  AATGCCGGAT TTAAACCGTA TGCGGACAAA GCCCTTGCCG AAATGCCGGA

201  AGCGAAAAAA GATCAGGCGG CAGAAGCCTT TAACCGTTAT CGTGAGAATG

251  TTTTGAAAGA TTTGATTACG CCCGAAGTGA AACAGGCTGT CCGCAATACT

301  TTATTGAAGA ATGCCCGTGA GATATACACG CAAGAAGAAA TTGACGGCAT

351  GATTGCCTTT TACGGTTCGC CTGTCGGTCA GTCCGTCGTT GCCAAAAATC

401  CGCGCTTAAT CAAGAAATCG ATGAGTGAAA TAGCGGTATC TTGGACTGCA

451  TTGTCAGGGA AAATCGCGCA ACATCATCTG CCCGAGTTTA CGGAAGAGTT

501  GCGGCGCATC ATCTGCGGCG GTAAAAATCC CGATGCGGGC TGTAAACAAG

551  CCGGACAGGT TGGGAAAAGG CATCAGAAAT AA
```

This corresponds to the amino acid sequence <SEQ ID 1612; ORF 552>:

```
m552.pep (partial)
   1 ..IKLKTLLLPF ATLALCTNAF AAPPSDASLA RWLDTQNFDR DIEKNMIEGF

  51   NAGFKPYADK ALAEMPEAKK DQAAEAFNRY RENVLKDLIT PEVKQAVRNT

 101   LLKNAREIYT QEEIDGMIAF YGSPVGQSVV AKNPRLIKKS MSEIAVSWTA

 151   LSGKIAQHHL PEFTEELRRI ICGGKNPDAG CKQAGQVGKR HQK*
```

Computer analysis of this amino acid sequence gave the following results:

Homology with a Predicted ORF from *N. gonorrhoeae*

ORF 552 shows 97.1% identity over a 174 aa overlap with a predicted ORF (ORF 552.ng) from *N. gonorrhoeae*:

```
m552/g552

                 10        20        30        40        50        60
m552.pep IKLKTLLLPFATLALCTNAFAAPPSDASLARWLDTQNFDRDIEKNMIEGFNAGFKPYADK
         :||||||||||:||||:|||||||:|||||||||||||||||||||||||||||||||||
g552     MKLKTLLLPFAALALCANAFAAPPGDASLARWLDTQNFDRDIEKNMIEGFNAGFKPYADK
                 10        20        30        40        50        60

                 70        80        90       100       110       120
m552.pep ALAEMPEAKKDQAAEAFNRYRENVLKDLITPEVKQAVRNTLLKNAREIYTQEEIDGMIAF
         ||||||||||||||||||||||||||||||||||||||||||||||||||||||||||||
g552     ALAEMPEAKKDQAAEAFNRYRENVLKDLITPEVKQAVRNTLLKNAREIYTQEEIDGMIAF
                 70        80        90       100       110       120

                130       140       150       160       170       180
m552.pep YGSPVGQSVVAKNPRLIKKSMSEIAVSWTALSGKIAQHHLPEFTEELRRIICGGKNPDAG
         ||||||||||||||||||||||||||||||||||||:|||||||||||||||||
g552     YGSPVGQSVVAKNPRLIKKSMSEIAVSWTALSGKIARHHLPEFTEELRRIICGGIVDX
                130       140       150       160       170

                190
m552.pep CKQAGQVGKRHQKX
```

The following partial DNA sequence was identified in *N. meningitidis* <SEQ ID 1613>:

```
a552.seq
   1 ATTAAACTGA AAACCTTGTT ATTGCCCTTC GCCACGCTGG CATTGTGCAC

  51 CAATGCTTTT GCCGCCCCGC CCAGCGACGC GTCGTTGGCG CGTTGGCTGG

 101 ATACGCAGAA TTTTGACCGG GATATAGAAA AAAATATGAT TGAGGGCTTT

 151 AATGCCGGAT TTAAACCGTA TGCGGACAAA GCCCTTGCCG AAATGCCGGA

 201 AGCGAAAAAA GATCAGGCGG CAGAAGCCTT TAACCGTTAT CGTGAGAATG

 251 TTTTGAAAGA TTTGATTACG CCCGAAGTGA AACAGGCTGT CCGCAATACT
```

-continued

```
301 TTATTGAAGA ATGCCCGTGA GATATACACG CAAGAAGAAA TTGACGGCAT

351 GATTGCCTTT TACGGTTCGC CTGTCGGTCA GTCCGTCGTT GCCAAAAATC

401 CGCGCTTAAT CAAGAAATCG ATGAGTGAAA TAGCGGTATC TTGGACTGCA

451 TTGTCAGGGA AAATCGCGCA ACATCATCTG CCCGAGTTTA CGGAAGAGTT

501 GCGGCGCATC ATCTGCGGCG GTAAAAATCC CGATGCGGGC TGTAAACAAG

551 CCGGACAGGT TGGGAAAAGG CATCAGAAAT AA
```

This corresponds to the amino acid sequence <SEQ ID 1614; ORF 552.a>:

```
a552.pep
   1 IKLKTLLLPF ATLALCTNAF AAPPSDASLA RWLDTQNFDR DIEKNMIEGF

  51 NAGFKPYADK ALAEMPEAKK DQAAEAFNRY RENVLKDLIT PEVKQAVRNT

 101 LLKNAREIYT QEEIDGMIAF YGSPVGQSVV AKNPRLIKKS MSEIAVSWTA

 151 LSGKIAQHHL PEFTEELRRI ICGGKNPDAG CKQAGQVGKR HQK*
```

m552/a552 100.0% identity in 193 aa overlap

```
                    10        20        30        40        50        60
    m552.pep IKLKTLLLPFATLALCTNAFAAPPSDASLARWLDTQNFDRDIEKNMIEGFNAGFKPYADK
             ||||||||||||||||||||||||||||||||||||||||||||||||||||||||||||
        a552 IKLKTLLLPFATLALCTNAFAAPPSDASLARWLDTQNFDRDIEKNMIEGFNAGFKPYADK
                    10        20        30        40        50        60

                    70        80        90       100       110       120
    m552.pep ALAEMPEAKKDQAAEAFNRYRENVLKDLITPEVKQAVRNTLLKNAREIYTQEEIDGMIAF
             ||||||||||||||||||||||||||||||||||||||||||||||||||||||||||||
        a552 ALAEMPEAKKDQAAEAFNRYRENVLKDLITPEVKQAVRNTLLKNAREIYTQEEIDGMIAF
                    70        80        90       100       110       120

                   130       140       150       160       170       180
    m552.pep YGSPVGQSVVAKNPRLIKKSMSEIAVSWTALSGKIAQHHLPEFTEELRRIICGGKNPDAG
             ||||||||||||||||||||||||||||||||||||||||||||||||||||||||||||
        a552 YGSPVGQSVVAKNPRLIKKSMSEIAVSWTALSGKIAQHHLPEFTEELRRIICGGKNPDAG
                   130       140       150       160       170       180

                   190
    m552.pep CKQAGQVGKRHQKX
             ||||||||||||||
        a552 CKQAGQVGKRHQKX
                   190
```

The following partial DNA sequence was identified in *N. meningitidis* <SEQ ID 1615>:

```
m552-1.seq
   1 TTGAATATTA AACTGAAAAC CTTGTTATTG CCCTTCGCCA CGCTGGCATT

  51 GTGCACCAAT GCTTTTGCCG CCCCGCCCAG CGACGCGTCG TTGGCGCGTT

 101 GGCTGGATAC GCAGAATTTT GACCGGGATA TAGAAAAAAA TATGATTGAG

 151 GGCTTTAATG CCGGATTTAA ACCGTATGCG GACAAAGCCC TTGCCGAAAT

 201 GCCGGAAGCG AAAAAAGATC AGGCGGCAGA AGCCTTTAAC CGTTATCGTG

 251 AGAATGTTTT GAAAGATTTG ATTACGCCCG AAGTGAAACA GGCTGTCCGC

 301 AATACTTTAT TGAAGAATGC CCGTGAGATA TACACGCAAG AAGAAATTGA

 351 CGGCATGATT GCCTTTTACG GTTCGCCTGT CGGTCAGTCC GTCGTTGCCA

 401 AAAATCCGCG CTTAATCAAG AAATCGATGA GTGAAATAGC GGTATCTTGG

 451 ACTGCATTGT CAGGGAAAAT CGCGCAACAT CATCTGCCCG AGTTTACGGA
```

-continued

```
501 AGAGTTGCGG CGCATCATCT GCGGCGGTAA AAATCCCGAT GCGGGCTGTA

551 AACAAGCCGG ACAGGTTGGG AAAAGGCATC AGAAATAA
```

This corresponds to the amino acid sequence <SEQ ID 1616; ORF 552-1>:

```
m552-1.pep
  1 LNIKLKTLLL PFATLALCTN AFAAPPSDAS LARWLDTQNF DRDIEKNMIE

 51 GFNAGFKPYA DKALAEMPEA KKDQAAEAFN RYRENVLKDL ITPEVKQAVR

101 NTLLKNAREI YTQEEIDGMI AFYGSPVGQS VVAKNPRLIK KSMSEIAVSW

151 TALSGKIAQH HLPEFTEELR RIICGGKNPD AGCKQAGQVG KRHQK*
```

The following partial DNA sequence was identified in *N. meningitidis* <SEQ ID 1617>:

```
a552-1.seq
  1 TTGAATATTA AACTGAAAAC CTTGTTATTG CCCTTCGCCA CGCTGGCATT

 51 GTGCACCAAT GCTTTTGCCG CCCCGCCCAG CGACGCGTCG TTGGCGCGTT

101 GGCTGGATAC GCAGAATTTT GACCGGGATA TAGAAAAAAA TATGATTGAG

151 GGCTTTAATG CCGGATTTAA ACCGTATGCG GACAAAGCCC TTGCCGAAAT

201 GCCGGAAGCG AAAAAAGATC AGGCGGCAGA AGCCTTTAAC CGTTATCGTG

251 AGAATGTTTT GAAAGATTTG ATTACGCCCG AAGTGAAACA GGCTGTCCGC

301 AATACTTTAT TGAAGAATGC CCGTGAGATA TACACGCAAG AAGAAATTGA

351 CGGCATGATT GCCTTTTACG GTTCGCCTGT CGGTCAGTCC GTCGTTGCCA

401 AAAATCCGCG CTTAATCAAG AAATCGATGA GTGAAATAGC GGTATCTTGG

451 ACTGCATTGT CAGGGAAAAT CGCGCAACAT CATCTGCCCG AGTTTACGGA

501 AGAGTTGCGG CGCATCATCT GCGGCGGTAA AAATCCCGAT GCGGGCTGTA

551 AACAAGCCGG ACAGGTTGGG AAAAGGCATC AGAAATAA
```

This corresponds to the amino acid sequence <SEQ ID 1618; ORF 552-1.a>:

```
a552-1.pep

  1 LNIKLKTLLL PFATLALCTN AFAAPPSDAS LARWLDTQNF DRDIEKNMIE

 51 GFNAGFKPYA DKALAEMPEA KKDQAAEAFN RYRENVLKDL ITPEVKQAVR

101 NTLLKNAREI YTQEEIDGMI AFYGSPVGQS VVAKNPRLIK KSMSEIAVSW

151 TALSGKIAQH HLPEFTEELR RIICGGKNPD AGCKQAGQVG KRHQK*

a552-1/m552-1 100.0% identity in 195 aa overlap

                    10        20        30        40        50        60
a552-1.pep  LNIKLKTLLLPFATLALCTNAFAAPPSDASLARWLDTQNFDRDIEKNMIEGFNAGFKPYA
            ||||||||||||||||||||||||||||||||||||||||||||||||||||||||||||
   m552-1   LNIKLKTLLLPFATLALCTNAFAAPPSDASLARWLDTQNFDRDIEKNMIEGFNAGFKPYA
                    10        20        30        40        50        60

                    70        80        90       100       110       120
a552-1.pep  DKALAEMPEAKKDQAAEAFNRYRENVLKDLITPEVKQAVRNTLLKNAREIYTQEEIDGMI
            ||||||||||||||||||||||||||||||||||||||||||||||||||||||||||||
   m552-1   DKALAEMPEAKKDQAAEAFNRYRENVLKDLITPEVKQAVRNTLLKNAREIYTQEEIDGMI
                    70        80        90       100       110       120

                   130       140       150       160       170       180
a552-1.pep  AFYGSPVGQSVVAKNPRLIKKSMSEIAVSWTALSGKIAQHHLPEFTEELRRIICGGKNPD
            ||||||||||||||||||||||||||||||||||||||||||||||||||||||||||||
   m552-1   AFYGSPVGQSVVAKNPRLIKKSMSEIAVSWTALSGKIAQHHLPEFTEELRRIICGGKNPD
                   130       140       150       160       170       180
```

```
                         190
    a552-1.pep  AGCKQAGQVGKRHQKX
                |||||||||||||||
       m552-1   AGCKQAGQVGKRHQKX
                         190
```

The following partial DNA sequence was identified in *N. gonorrhoeae* <SEQ ID 1619>:

```
g553.seq
    1 atggattatc tgcaaaacct gtctttgggc ttgacaaaaa agctgcccgt

   51 tatactgcaa acagaagtag cggagtgtgg cttggcatgt ctagcggctg

  101 tggccggatt ttatggtttc tatacggatt tgcgcgcact gcgttcaaaa

  151 tactgtctgt cacttaaggg tgagaatttg gcagatattg ttcgttttgc

  201 tgatgatatg gggctgacgg gacgggcgtt gaggctggat ttagacgaat

  251 tgggcagttt gcgcctgccc tgtattctac attgggattt gaatcatttt

  301 gtggtgctgg aatcggtatc ttcggacggg gctgccgtca tggatccggc

  351 ttcgggacga cgcaaagtca agacggagga aatatcgcgc aagtttacgg

  401 gaattgcttt ggaactgtgg ccaaacacgc gtttcgaggc aggggaagaa

  451 aagcaggaaa tccgcatcct acccatgttg cgcgggattt ctgggctggg

  501 gcggacattg tttcagcttt tggctttggc agcagcaatg gaagtgtttg

  551 cttttttaca aaacgtcagc ttcaagatcg gacgtggtga atcgcttgcg

  601 ttaatcggac gatcgggctg cggtaaatcg acacttttgg atattttaag

  651 cggcaatcta cctcccgaat caggcaaagt catgataaat gggcacgaca

  701 tttacagctt accgccacct tttattccgc aatttgagtg cgatggtcaa

  751 ggcaggacga tgttttatag tggattaaat ttaaaccggt ag
```

This corresponds to the amino acid sequence <SEQ ID 1620; ORF 553.ng>:

```
g553.pep
    1 MDYLQNLSLG LTKKLPVILQ TEVAECGLAC LAAVAGFYGF YTDLRALRSK

   51 YCLSLKGENL ADIVRFADDM GLTGRALRLD LDELGSLRLP CILHWDLNHF

  101 VVLESVSSDG AAVMDPASGR RKVKTEEISR KFTGIALELW PNTRFEAGEE

  151 KQEIRILPML RGISGLGRTL FQLLALAAAM EVFAFLQNVS FKIGRGESLA

  201 LIGRSGCGKS TLLDILSGNL PPESGKVMIN GHDIYSLPPP FIPQFECDGQ

  251 GRTMFYSGLN LNR*
```

The following partial DNA sequence was identified in *N. meningitidis* <SEQ ID 1621>:

```
m553.seq (partial)
    1 ATGGATTATT TATCAAGACT GTCCTTTGGA TTTAACAAAA AGCTACCTGT

   51 CATTCTGCAA ACAGAAGTTG CTGAATGTGG TTTAGCATGC CTGACATCCA

  101 TCTTGTCCTA TTATGGCTTT CACACTGATT TAAGAACGTT ACGCCAAAAA

  151 TACACCCTGT CATTAAAGGG CGCAAATCTT GCAGACATCA TGAGATTTGG

  201 CAATGAAATG AATTTAACGC CACGAGCTTT GCGTTTAGAG TTAGATGAGC

  251 TGTCAAATTT ACAACTACCC TGCATTCTCC ATTGGAACTT AAACCATTTT
```

-continued

```
301 GTTGTACTTT GTTCCATTTC CAAAGACAGT ATCGTCATTA TGGACCCTGC

351 TGTCGGTATG CGAAAAATCA AAATGGACGA AGTTTCACAA AAATTCACAG

401 GGATTGCCCT AGAATTATTC CCCAATACCC ATTTTGAAGA GAAAAAAGAA

451 ACAAAGAAAA TCAAAATATT ATCTCTATTA AGGGGGGG.T CAGGCTTAAA

501 ACGCTCTTTA ATTCAAATGC TTATATTAGC TATTTCTTTG GAAGTCTTTG

551 CATTG...
```

This corresponds to the amino acid sequence <SEQ ID 1622; ORF 553>:

```
m553.pep (partial)
  1 MDYLSRLSFG FNKKLPVILQ TEVAECGLAC LTSILSYYGF HTDLRTLRQK

 51 YTLSLKGANL ADIMRFGNEM NLTPRALRLE LDELSNLQLP CILHWNLNHF

101 VVLCSISKDS IVIMDPAVGM RKIKMDEVSQ KFTGIALELF PNTHFEEKKE

151 TKKIKILSLL RGXSGLKRSL IQMLILAISL EVFAL...
```

Computer analysis of this amino acid sequence gave the following results:

Homology with a Predicted ORF from *N. gonorrhoeae*

ORF 553 shows 65.5% identity over a 185 aa overlap with a predicted ORF (ORF 553.ng) from *N. gonorrhoeae*:

```
m553/g553

                   10        20        30        40        50        60
g553.pep MDYLQNLSLGLTKKLPVILQTEVAECGLACLAAVAGFYGFYTDLRALRSKYCLSLKGENL
         ||||: ||:|::|||||||||||||||||||::: ::|||:||||:||:|| ||||| ||
    m553 MDYLSRLSFGFNKKLPVILQTEVAECGLACLTSILSYYGFHTDLRTLRQKYTLSLKGANL
                   10        20        30        40        50        60

                   70        80        90       100       110       120
g553.pep ADIVRFADDMGLTGRALRLDLDELGSLRLPCILHWDLNHFVVLESVSSDGAAVMDPASGR
         |||:||:::|:|| |||||:||||::|:|||||||:||||||| |:|:|: ::|||| |
    m553 ADIMRFGNEMNLTPRALRLELDELSNLQLPCILHWNLNHFVVLCSISKDSIVIMDPAVGM
                   70        80        90       100       110       120

                  130       140       150       160       170       180
g553.pep RKVKTEEISRKFTGIALELWPNTRFEAGEEKQEIRILPMLRGISGLGRTLFQLLALAAAM
         ||:| :|:|:|||||||||:|||:||   :|  ::|:|| :||| ||| |:|:|:| || ::
    m553 RKIKMDEVSQKFTGIALELFPNRHFEEKKETKKIKILSLLRGXSGLKRSLIQMLILAISL
                  130       140       150       160       170       180

                  180       190       200       210       220       240
g553.pep EVFAFLQNVSFKIGRGESLALIGRSGCGKSTLLDILSGNLPPESGKVMINGHDIYSLPPP
         ||||:
    m553 EVFAL
```

The following partial DNA sequence was identified in *N. meningitidis* <SEQ ID 1623>:

```
a553.seq
  1 ATGCCCCATC TGCAAAACCT GTCTTTGGGC TTAAAGAAAA AGCTGCCTGT


 51 TATCCTGCAA ACAGAAATAT CAGAATGCGG CTTGGCATGT CTGGCGGCTG


101 TGGCGGGATT TCATGGTTTC CATACGAATT TACGCGCACT GCGTTCAAAA


151 TAC
```

This corresponds to the amino acid sequence <SEQ ID 1624; ORF 553.a>:

```
a553.pep
   1  MPHLQNLSLG LKKKLPVILQ TEISECGLAC LAAVAGFHGF HTNLRALRSK

  51  Y
```

m553/a553 62.7% identity in 51 aa overlap

```
                    10        20        30        40        50        60
m553.pep MDYLSRLSFGFNKKLPVILQTEVAECGLACLTSILSYYGFHTDLRTLRQKYTLSLKGANL
         | :|:  ||:|::|||||||||::|||||||:::  :::||||:||:||:||
    a553 MPHLQNLSLGLKKKLPVILQTEISECGLACLAAVAGFHGFHTNLRALRSKY
                    10        20        30        40        50
                    70        80        90       100       110       120
m553.pep ADIMRFGNEMNLTPRALRLELDELSNLQLPCILHWNLNHFVVLCSISKDSIVIMDPAVGM
```

The following partial DNA sequence was identified in *N. gonorrhoeae* <SEQ ID 1625>:

```
g554.seq..
     1  atgacagcac ataaaatcct gcccgtcctt cttcccatca tcttaggcgt

    51  ttctcacgca acggctgcat cgcccgcgcc caacagaccg acggtacacg

   101  ccgcccccac gctccaaaca cccgaaaccc tcacggcggc acacatcgtt

   151  atcgaccttc aaagcaggca gactttatcc gccaaaaaca ccaatacccc

   201  tgtcgaaccg gcggcactaa cccaactgat gaccgcatat ttggttttca

   251  aaaacatgaa atcgggaaat atccaatctg aagaaaactt aaaaataccc

   301  gaatccgcat gggcttcaga aggaagcaga atgtttgtac gtcccggcga

   351  tacggtcagc accgacaaac tcttaaaagg catgattgcc ctatgcgcaa

   401  acgatgccgc cctaaccctt gccgaccggc tgggcaacgg ctcgattgaa

   451  aattttgtgc aacaaatgaa caaagaagcc cgacgcttgg gcatgaagaa

   501  caccgtattc aaaaacccga caggcttggg tagagaagga caggtttcca

   551  ccgccaaaga cctctccctg ctgtctgaag cattgatgcg cgactttccg

   601  gaatattacc cgctgttttc catcaaatcg ttcaagtttg aaaacataga

   651  acaaaacaac cgcaatatcc ttttatatag ggacaacaat gtaaacggcc

   701  tgaaagccgg gcacacagaa agcggcggct acaaccttgc cgtgtcatac

   751  tccggcaacg gcaggcacat ccttgtcatc acactaggtt cggaatcggc

   801  ggaaacccgc gcatcggaca acagcaagct gctgaaccgg gcattgcagg

   851  ccttcgatac gcccaaaata tatccgaaag gcaaaaccgt tgcccaaatc

   901  caaatttccg gaggcagcaa aaaaaccgtc cgcgcaggct tcctcaaaga

   951  agcctacatc actctgccac ataaagaagc gaaaatggca gaacagattt

  1001  tggaaaccat acagccgatt cccgccccgg taaaaaaagg gcagatttta

  1051  ggaaaaatca aaatcaggca aaacggacat accattgccg aaaaagaaat

  1101  cgtcgcactg gaaaacgtag aaaaaagaag ccggtggcaa aggctttgga

  1151  cgcgtctgac agggcagtaa
```

This corresponds to the amino acid sequence <SEQ ID 1626; ORF 554.ng>:

```
g554.pep..
   1 MTAHKILPVL LPIILGVSHA TAASPAPNRP TVHAAPTLQT PETLTAAHIV

  51 IDLQSRQTLS AKNTNTPVEP AALTQLMTAY LVFKNMKSGN IQSEENLKIP

 101 ESAWASEGSR MFVRPGDTVS TDKLLKGMIA LCANDAALTL ADRLGNGSIE

 151 NFVQQMNKEA RRLGMKNTVF KNPTGLGREG QVSTAKDLSL LSEALMRDFP

 201 EYYPLFSIKS FKFENIEQNN RNILLYRDNN VNGLKAGHTE SGGYNLAVSY

 251 SGNGRHILVI TLGSESAETR ASDNSKLLNR ALQAFDTPKI YPKGKTVAQI

 301 QISGGSKKTV RAGFLKEAYI TLPHKEAKMA EQILETIQPI PAPVKKGQIL

 351 GKIKIRQNGH TIAEKEIVAL ENVEKRSRWQ RLWTRLTGQ*
```

The following partial DNA sequence was identified in *N. meningitidis* <SEQ ID 1627>:

```
m554.seq..
     1 ATGACAGCAC ATAAAATCCT GCCCGTCCTG CTTTCCATCA TCTTAGGCGT

    51 TTCTCACGCA ACGGCTGCAT CGCCCGCGCC CAACAGACCG ACGGTACACG

   101 CCGCCCCCAC GTTCCAAACA CCCGAAACCC TCACAGCGGC ACACATCGTT

   151 ATCGACCTTC AAAGCAAACA GATTTTATCC GCCAAAAACA TCAATACCCC

   201 TGTTGAACCG GCGGCACTAA CCCAACTGAT GACCGCATAT CTGGTTTTCA

   251 AAAACATGAA ATCGGGCAAT ATCCAATCTG AAGAAAACTT AAAAATACCC

   301 GAATCCGCAT GGGCTTCAGA AGGAAGCAGA ATGTTTGTAC GTCCCGGCGA

   351 TACGGTCAGC ACCGACAAAC TCTTAAAAGG CATGATTGCA CTATCCGCAA

   401 ACGATGCCGC CCTAACCCTT GCCGGCCGGC TGGGCAACGG CTCGATTGAA

   451 AATTTTGTGC AACAAATGAA CAAAGAAGCC CGACGCTTGG GCATGAAGAA

   501 CACTGTATTC AAAAACCCGA CAGGCTTGAG TAGAGAAGGA CAGGTTTCCA

   551 CCGCCAAAGA CGTCGCACTG CTGTCTGAAG CATTGATGCG CGACTTTCCG

   601 GAATATTACC CGCTGTTTTC CATCAAATCT TTCAAATTCA AAAATATAGA

   651 ACAAAACAAC CGCAATATCC TTTTATATAG GGACAACAAT GTAAACGGTC

   701 TGAAAGCCGG ACACACAGAA AGCGGCGGCT ACAACCTTGC CGTGTCATAC

   751 TCCGGCAACG GCAGGCACAT CCTTGTCATC ACATTGGGTT CGGAATCGGC

   801 GGAAACACGC GCATCAGACA ACAGCAAGCT GCTGAACTGG GCATTGCAGG

   851 CCTTCGATAC GCCCAAAATA TATCCGAAAG GCAAAACCGT TGCCCAAATC

   901 CAAATTTCCG GAGGCAGCAA AAAAACCGTC CGCGCAGGCT TCCTCAAAGA

   951 AGCCTACATC ACTCTGCCAC ATAAGGAAGC GAAAATGGCA GAACAAATTC

  1001 TAGAAACCAT ACAGCCGATT CCCGCCCCAG TAAAAAAAGG GCAAATTTTA

  1051 GGAAAAATCA AAATCAGACA AAACGGATAC ACCATTGCCG AAAAAGAAAT

  1101 CGTCGCACTG GAAAATGTAA AAAAAAGAAG CCGGTGGCAA AGGCTTTGGG

  1151 CGTGTCTGAC AGGGCAGTAA
```

This corresponds to the amino acid sequence <SEQ ID 1628; ORF 554>:

```
m554.pep..
   1 MTAHKILPVL LSIILGVSHA TAASPAPNRP TVHAAPTFQT PETLTAAHIV

  51 IDLQSKQILS AKNINTPVEP AALTQLMTAY LVFKNMKSGN IQSEENLKIP

 101 ESAWASEGSR MFVRPGDTVS TDKLLKGMIA LSANDAALTL AGRLGNGSIE

 151 NFVQQMNKEA RRLGMKNTVF KNPTGLSREG QVSTAKDLAL LSEALMRDFP

 201 EYYPLFSIKS FKFKNIEQNN RNILLYRDNN VNGLKAGHTE SGGYNLAVSY

 251 SGNGRHILVI TLGSESAETR ASDNSKLLNW ALQAFDTPKI YPKGKTVAQI

 301 QISGGSKKTV RAGFLKEAYI TLPHKEAKMA EQILETIQPI PAPVKKGQIL

 351 GKIKIRQNGY TIAEKEIVAL ENVKKRSRWQ RLWACLTGQ*
```

Computer analysis of this amino acid sequence gave the following results:

Homology with a Predicted ORF from *N. gonorrhoeae*

ORF 554 shows 96.1% identity over a 389 aa overlap with a predicted ORF (ORF 554.ng) from *N. gonorrhoeae*:

```
m554/g554

                 10        20        30        40        50        60
m554.pep MTAHKILPVLLSIILGVSHATAASPAPNRPTVHAAPTFQTPETLTAAHIVIDLQSKQILS
         ||||||||||| |||||||||||||||||||||||||:||||||||||||||||:| ||
    g554 MTAHKILPVLLPIILGVSHATAASPAPNRPTVHAAPTLQTPETLTAAHIVIDLQSRQTLS
                 10        20        30        40        50        60

                 70        80        90       100       110       120
m554.pep AKNINTPVEPAALTQLMTAYLVFKNMKSGNIQSEENLKIPESAWASEGSRMFVRPGDTVS
         ||| ||||||||||||||||||||||||||||||||||||||||||||||||||||||||
    g554 AKNTNTPVEPAALTQLMTAYLVFKNMKSGNIQSEENLKIPESAWASEGSRMFVRPGDTVS
                 70        80        90       100       110       120

                130       140       150       160       170       180
m554.pep TDKLLKGMIALSANDAALTLAGRLGNGSIENFVQQMNKEARRLGMKNTVFKNPTGLSREG
         ||||||||||| ||||||||| ||||||||||||||||||||||||||||||||||:|||
    g554 TDKLLKGMIALCANDAALTLADRLGNGSIENFVQQMNKEARRLGMKNTVFKNPTGLGREG
                130       140       150       160       170       180

                190       200       210       220       230       240
m554.pep QVSTAKDLALLSEALMRDFPEYYPLFSIKSFKFKNIEQNNRNILLYRDNNVNGLKAGHTE
         ||||||||:|||||||||||||||||||||||:|||||||||||||||||||||||||||
    g554 QVSTAKDLSLLSEALMRDFPEYYPLFSIKSFKEKNIEQNNRNILLYRDNNVNGLKAGHTE
                190       200       210       220       230       240

                250       260       270       280       290       300
m554.pep SGGYNLAVSYSGNGRHILVITLGSESAETRASDNSKLLNWALQAFDTPKIYPKGKTVAQI
         ||||||||||||||||||||||||||||||||||||||| ||||||||||||||||||||
    g554 SGGYNLAVSYSGNGRHILVITLGSESAETRASDNSKLLNRALQAFDTPKIYPKGKTVAQI
                250       260       270       280       290       300

                310       320       330       340       350       360
m554.pep QISGGSKKTVRAGFLKEAYITLPHKEAKMAEQILETIQPIPAPVKKGQILGKIKIRQNGY
         |||||||||||||||||||||||||||||||||||||||||||||||||||||||||||:
    g554 QISGGSKKTVRAGFLKEAYITLPHKEAKMAEQILETIQPIPAPVKKGQILGKIKIRQNGH
                310       320       330       340       350       360

                370       380       390
m554.pep TIAEKEIVALENVKKRSRWQRLWACLTGQX
         ||||||||||||:||||||||||: |||||
    g554 TIAEKEIVALENEKKRSRWQRLWTRLTGQX
                370       380       390
```

The following partial DNA sequence was identified in *N. meningitidis* <SEQ ID 1629>:

```
a554.seq
   1  ATGACAGCAC ATAAAATCCT GCCCGTCCTG CTTTCCATCA TCTTAGGCGT

  51  TTCTCACGCA ACGGCTGCAT CGCCCGCGCC CAACAGACCG ACGGCACACG

 101  CCGCCCCCAC GTTCCAAACA CCCGAAACCC TCACAGCGGC ACACATCGTT
```

-continued

```
 151 ATCGACCTTC AAAGCAAACA GATTTTATCC GCCAAAAACA TCAATACCCC

 201 TGTCGAACCG GCGGCACTAA CCCAACTGAT GACCGCATAT CTGGTTTTCA

 251 AAAACATGAA ATCGGGAAAT ATCCGATCTG AAGAAAACTT AAAAATACCC

 301 GAATCCGCAT GGGCTTCAGA AGGAAGCAGA ATGTTTGTAC GTCCCGGCGA

 351 TACGGTCAGC ACCGACAAAC TCTTAAAAGG CATGATTGCA CTATCCGCAA

 401 ACGATGCCGC CCTAACCCTT GCCGGCCGGC TGGGCAACGG CTCGATTGAA

 451 AATTTTGTGC AACAAATGAA CAAAGAAGCC CGACGCTTGG GCATGAAGAA

 501 CACTGTATTC AAAAATCCGA CAGGCTTGAG TAGAGAAGGA CAGGTTTCCA

 551 CCGCCAAAGA CCTCGCCCAG CTGTCTGAAG CATTGATGCG CGACTTTCCG

 601 GAATATTACC CGCTGTTTTC CATCAAATCT TTCAAATTCA AAAATATAGA

 651 GCAAAACAAC CGCAATATCC TTTTATATAG GGACAACAAT GTAAACGGTC

 701 TGAAAGCCGG ACACACAGAA AGCGGCGGCT ACAACCTTGC CGTGTCATAC

 751 TCCGGCAACG GCAGGCACAT CCTTGTCATC ACATTGGGTT CGGAATCGGC

 801 GGAAACACGC GCATCAGACA ACAGCAAGCT GCTGAACTGG GCATTGCAAG

 851 CCTTCGATAC GCCCAAAATA TATCCGAAAG GCAAAACCGT TGCCCAAATC

 901 CAAATTTCCG GAGGCAGCAA AAAAACCGTC CGCGCAGGCT TCCTCAAAGA

 951 AGCCTACATC ACTCTGCCAC ATAAGGAAGC GAAAATGGCA GAACAAATTC

1001 TAGAAACCAT ACAGCCGATT CCCGCCCCAG TAAAAAAAGG GCAAATTTTA

1051 GGAAAAATCA AATCAGACA AAACGGATAC ACCATTGCCG AAAAAGAAAT

1101 CGTCGCACTG GAAAATGTAA AAAAAAGAAG CCGGTGGCAA AGGCTTTGGG

1151 CGTGTCTGAC AGGGCAGTAA
```

This corresponds to the amino acid sequence <SEQ ID 1630; ORF 554.a>:

```
a554.pep
   1 MTAHKILPVL LSIILGVSHA TAASPAPNRP TAHAAPTFQT PETLTAAHIV

  51 IDLQSKQILS AKNINTPVEP AALTQLMTAY LVFKNMKSGN IRSEENLKIP

 101 ESAWASEGSR MFVRPGDTVS TDKLLKGMIA LSANDAALTL AGRLGNGSIE

 151 NFVQQMNKEA RRLGMKNTVF KNPTGLSREG QVSTAKDLAQ LSEALMRDFP

 201 EYYPLFSIKS FKFKNIEQNN RNILLYRDNN VNGLKAGHTE SGGYNLAVSY

 251 SGNGRHILVI TLGSESAETR ASDNSKLLNW ALQAFDTPKI YPKGKTVAQI

 301 QISGGSKKTV RAGFLKEAYI TLPHKEAKMA EQILETIQPI PAPVKKGQIL

 351 GKIKIRQNGY TIAEKEIVAL ENVKKRSRWQ RLWACLTGQ*
```

m554/a554 99.2% identity in 389 aa overlap

```
                    10        20        30        40        50        60
m554.pep    MTAHKILPVLLSIILGVSHATAASPAPNRPTVHAAPTFQTPETLTAAHIVIDLQSKQILS
            ||||||||||||||||||||||||||||||:|||||||||||||||||||||||||||||
a554        MTAHKILPVLLSIILGVSHATAASPAPNRPTAHAAPTFQTPETLTAAHIVIDLQSKQILS
                    10        20        30        40        50        60

                    70        80        90       100       110       120
m554.pep    AKNINTPVEPAALTQLMTAYLVFKNMKSGNIQSEENLKIPESAWASEGSRMFVRPGDTVS
            ||||||||||||||||||||||||||||||:|||||||||||||||||||||||||||||
a554        AKNINTPVEPAALTQLMTAYLVFKNMKSGNIRSEENLKIPESAWASEGSRMFVRPGDTVS
                    70        80        90       100       110       120
```

```
                      130        140        150        160        170        180
   m554.pep  TDKLLKGMIALSANDAALTLAGRLGNGSIENFVQQMNKEARRLGMKNTVFKNPTGLSREG
             ||||||||||||||||||||||||||||||||||||||||||||||||||||||||||||
   a554      TDKLLKGMIALSANDAALTLAGRLGNGSIENFVQQMNKEARRLGMKNTVFKNPTGLSREG
                      130        140        150        160        170        180

                      190        200        210        220        230        240
   m554.pep  QVSTAKDLALLSEALMRDFPEYYPLFSIKSFKFKNIEQNNRNILLYRDNNVNGLKAGHTE
             ||||||||| ||||||||||||||||||||||||||||||||||||||||||||||||||
   a554      QVSTAKDLAQLSEALMRDFPEYYPLFSIKSFKFKNIEQNNRNILLYRDNNVNGLKAGHTE
                      190        200        210        220        230        240

                      250        260        270        280        290        300
   m554.pep  SGGYNLAVSYSGNGRHILVITLGSESAETRASDNSKLLNWALQAFDTPKIYPKGKTVAQI
             ||||||||||||||||||||||||||||||||||||||||||||||||||||||||||||
   a554      SGGYNLAVSYSGNGRHILVITLGSESAETRASDNSKLLNWALQAFDTPKIYPKGKTVAQI
                      250        260        270        280        290        300

                      310        320        330        340        350        360
   m554.pep  QISGGSKKTVRAGFLKEAYITLPHKEAKMAEQILETIQPIPAPVKKGQILGKIKIRQNGY
             ||||||||||||||||||||||||||||||||||||||||||||||||||||||||||||
   a554      QISGGSKKTVRAGFLKEAYITLPHKEAKMAEQILETIQPIPAPVKKGQILGKIKIRQNGY
                      310        320        330        340        350        360

                      370        380        390
   m554.pep  TIAEKEIVALENVKKRSRWQRLWACLTGQX
             |||||||||||||||||||||||||||||
   a554      TIAEKEIVALENVKKRSRWQRLWACLTGQX
                      370        380        390
```

The following partial DNA sequence was identified in *N. gonorrhoeae* <SEQ ID 1631>:

```
g556.seq..
   1 atggacaata agaccaaact gcgcttgggc ggcctgattt tactgaccac

  51 cgccgtttta agcctcatta tcgtattgat tgtcgattcc tggccgcttg

 101 ccatcctgct tgccgccgtc atcgtcgccg ccgctgcggg cggctttgtt

 151 tggacatccc gccgacagca acgccagttt atcgaacgtc tgaaaaaatt

 201 cgacatcgat cccgaaaaag gcagaatcaa cgaggcaaac ctgcgccgta

 251 tgtaccacag cggcggacaa caccagaaag atgcgattac cctgatctgc

 301 ctgtcgcaaa aatgttcggt ggacgaggcg cacgctatgt tcaaaaaacg

 351 cccgacacgt caggaaatca atcaaatggc ggcaaaacag tcgcgcggtc

 401 agaaacgtcc gcaccgttaa
```

This corresponds to the amino acid sequence <SEQ ID 1632; ORF 556.ng>:

```
g556.pep..
   1 MDNKTKLRLG GLILLTTAVL SLIIVLIVDS WPLAILLAAV IVAAAAGGFV

  51 WTSRRQQRQF IERLKKFDID PEKGRINEAN LRRMYHSGGQ HQKDAITLIC

 101 LSQKCSVDEA HAMFKKRPTR QEINQMAAKQ SRGQKRPHR*
```

The following partial DNA sequence was identified in *N. meningitidis* <SEQ ID 1633>:

```
m556.seq..
   1 ATGGACAATA AGACCAAACT GCGCTTGGGC GGCCTGATTT TACTGACCAC

  51 CGCCGTTTTA AGCCTCATTA TCGTATTGAT TGTCGATTCC TGGCCGCTTG

 101 CCATCCTGCT TGCAGCCGTC ATTGTCGCTG CCGCTGCGGG CGGTTTTGTT
```

-continued

```
151 TGGACATCCC GCCGACAGCA ACGCCAGTTT ATCGAACGCC TGAAAAAATT

201 CGACATCGAT CCCGAAAAAG GCAGAATCAA CGAGGCAAAC CTGCGCCGTA

251 TGTACCACAG CGGCGGACAA CACCAGAAAG ATGCGATTAC CCTGATCTGC

301 CTGTCGCAAA AATGTTCGGT GGACGAGGCG CACGCTATGT TCAAAAAACG

351 CCCGACACGT CAGGAAATCA ATCAAATGGC GGCAAAACAG TCGCGCGGTC

401 AGAAACGTCC GCACCGTTAA
```

This corresponds to the amino acid sequence <SEQ ID 1634; ORF 556>:

```
m556.pep..
  1 MDNKTKLRLG GLILLTTAVL SLIIVLIVDS WPLAILLAAV IVAAAAGGFV

 51 WTSRRQQRQF IERLKKFDID PEKGRINEAN LRRMYHSGGQ HQKDAITLIC

101 LSQKCSVDEA HAMFKKRPTR QEINQMAAKQ SRGQKRPHR*
```

Computer analysis of this amino acid sequence gave the following results:

Homology with a Predicted ORF from *N. gonorrhoeae*

ORF 556 shows 100.0% identity over a 139 aa overlap with a predicted ORF (ORF 556.ng) from *N. gonorrhoeae*:

```
m556/g556

                 10        20        30        40        50        60
m556.pep MDNKTKLRLGGLILLTTAVLSLIIVLIVDSWPLAILLAAVIVAAAAGGFVWTSRRQQRQF
         ||||||||||||||||||||||||||||||||||||||||||||||||||||||||||||
    g556 MDNKTKLRLGGLILLTTAVLSLIIVLIVDSWPLAILLAAVIVAAAAGGFVWTSRRQQRQF
                 10        20        30        40        50        60
                 70        80        90       100       110       120
m556.pep IERLKKFDIDPEKGRINEANLRRMYHSGGQHQKDAITLICLSQKCSVDEAHAMFKKRPTR
         ||||||||||||||||||||||||||||||||||||||||||||||||||||||||||||
    g556 IERLKKFDIDPEKGRINEANLRRMYHSGGQHQKDAITLICLSQKCSVDEAHAMFKKRPTR
                 70        80        90       100       110       120
                130       140
m556.pep QEINQMAAKQSRGQKRPHRX
         ||||||||||||||||||||
    g556 QEINQMAAKQSRGQKRPHRX
                130       140
```

The following partial DNA sequence was identified in *N. meningitidis* <SEQ ID 1635>:

```
a556.seq
  1 ATGGACAATA AGACCAAACT GCGCTTGGGC GGCCTGATTT TACTGACCAC

 51 CGCCGTTTTA AGCCTCATTA TCGTATTGAT TGTCGATTCC TGGCCGCTTG

101 CCATCCTGCT TGCCGCCGTC ATCGTCGCCG CCGCTGCGGG CGGCTTTGTT

151 TGGACATCCC GCCGACAGCA ACGCCAGTTT ATCGAACGTC TGAAAAAATT

201 CGACATCGAT CCCGAAAAAG GCAGAATCAA CGAGGCAAAC CTGCGCCGTA

251 TGTACCACAG CGGCGGACAA CACCAAAAAG ATGCGATTAC CCTGATCTGC

301 CTGTCGCAAA AATGTTCGGT GGACGAGGCG CACGCTATGT TCAAAAAACG

351 CCCGACACGT CAGGAAATCA ATCAAATGGC GGCAAAACAG TCGCGCGGTC

401 AGAAACGTCC GCACCGTTAA
```

This corresponds to the amino acid sequence <SEQ ID 1636; ORF 556.a>:

```
a556.pep
   1 MDNKTKLRLG GLILLTTAVL SLIIVLIVDS WPLAILLAAV IVAAAAGGFV

  51 WTSRRQQRQF IERLKKFDID PEKGRINEAN LRRMYHSGGQ HQKDAITLIC

 101 LSQKCSVDEA HAMFKKRPTR QEINQMAAKQ SRGQKRPHR*
```

m556/a556 100.0% identity in 139 aa overlap

```
                   10        20        30        40        50        60
    m556.pep MDNKTKLRLGGLILLTTAVLSLIIVLIVDSWPLAILLAAVIVAAAAGGFVWTSRRQQRQF
             ||||||||||||||||||||||||||||||||||||||||||||||||||||||||||||
        a556 MDNKTKLRLGGLILLTTAVLSLIIVLIVDSWPLAILLAAVIVAAAAGGFVWTSRRQQRQF
                   10        20        30        40        50        60

                   70        80        90       100       110       120
    m556.pep IERLKKFDIDPEKGRINEANLRRMYHSGGQHQKDAITLICLSQKCSVDEAHAMFKKRPTR
             ||||||||||||||||||||||||||||||||||||||||||||||||||||||||||||
        a556 IERLKKFDIDPEKGRINEANLRRMYHSGGQHQKDAITLICLSQKCSVDEAHAMFKKRPTR
                   70        80        90       100       110       120

                  130       140
    m556.pep QEINQMAAKQSRGQKRPHRX
             ||||||||||||||||||||
        a556 QEINQMAAKQSRGQKRPHRX
                  130       140
```

The following partial DNA sequence was identified in *N. gonorrhoeae* <SEQ ID 1637>:

```
g557.seq
   1 atgaacaaaa tattccttac tgccgcagcc ttggtgctgg gcgcgtgcgg

  51 tttccacctg aaaggtgcag acggcatttc tccgccgctg acctaccgga

 101 gctggcacat cgaaggcgga caggcattgc aatttccttt ggaaaccgcg

 151 ctgtatcagg cttcgggcag ggtggacgat gctgccggcg cgcagatgac

 201 cctgcgtata gacagcgttt cccaaaacaa ggaaacctat accgttaccc

 251 gtgcggcagt catcaacgaa tatcttttga tattgacggt tgaagcgcag

 301 gtattgaaac gcggcgagcc ggtcggcaaa ccgatgaccg tgtccgtccg

 351 ccgcattttg gattatgccg acaacgaaat tttgggcaaa caggaagaag

 401 aagaaaccct gtgggcggaa atgcggcagg atgttgccga acagattgtc

 451 cgccgcctga cctttctgaa ggcggaatga
```

This corresponds to the amino acid sequence <SEQ ID 1638; ORF 557.ng>:

```
g557.pep..
   1 MNKIFLTAAA LVLGACGFHL KGADGISPPL TYRSWHIEGG QALQFPLETA

  51 LYQASGRVDD AAGAQMTLRI DSVSQNKETY TVTRAAVINE YLLILTVEAQ

 101 VLKRGEPVGK PMTVSVRRIL DYADNEILGK QEEEETLWAE MRQDVAEQIV

 151 RRLTFLKAE*
```

The following partial DNA sequence was identified in *N. meningitidis* <SEQ ID 1639>:

```
m557.seq..
  1  ATGAACAAAC TGTTTCTTAC TGCCGCAGTG CTGATGCTGG GCGCGTGCGG
```

-continued

```
 51 TTTCCACCTG AAAGGTGCAG ACGGCATTTC TCCGCCGCTG ACCTACCGGA

101 GCTGGCACAT CGAAGGCGGA CAGGCATTGC GGTTTCCTTT GGAAACCGCG

151 CTGTATCAGG CTTCGGGCAG GGTGGACGAT GCTGCCGGCG CGCAGATGAC

201 CCTGCGTATA GACAGCGTTT CCCAAAACAA GGAAACCTAC ACCGTTACCC

251 GTGCGGCAGT CATCAACGAA TATCTTTTGA TATTGACGGT TGAAGCGCAG

301 GTATTGAAAC GCGGCGAGCC GGTCGGTAAA CCGATGACCG TGTCCGTCCG

351 CCGCGTCCTT GCTTATGCCG ACAACGAGAT CTTGGGCAAA CAGGAAGAGG

401 AAGCGGCATT GTGGGCGGAA ATGCGGCAGG ATGCCGCCGA ACAGATTGTC

451 CGCCGCCTGA CCTTTCTGAA GGCGGAATGA
```

This corresponds to the amino acid sequence <SEQ ID 1640; ORF 557>:

```
m557.pep..
  1 MNKLFLTAAV LMLGACGFHL KGADGISPPL TYRSWHIEGG QALRFPLETA

 51 LYQASGRVDD AAGAQMTLRI DSVSQNKETY TVTRAAVINE YLLILTVEAQ

101 VLKRGEPVGK PMTVSVRRVL AYADNEILGK QEEEAALWAE MRQDAAEQIV

151 RRLTFLKAE*
```

Computer analysis of this amino acid sequence gave the following results:

Homology with a Predicted ORF from *N. gonorrhoeae*

ORF 557 shows 94.3% identity over a 159 aa overlap with a predicted ORF (ORF 557.ng) from *N. gonorrhoeae*:

```
m557/g557

                 10        20        30        40        50        60
m557.pep MNKLFLTAAVLMLGACGFHLKGADGISPPLTYRSWHIEGGQALRFPLETALYQASGRVDD
         |||:|||||:|:|||||||||||||||||||||||||||||||:||||||||||||||||
    g557 MNKIFLTAAALVLGACGFHLKGADGISPPLTYRSWHIEGGQALQFPLETALYQASGRVDD
                 10        20        30        40        50        60

                 70        80        90       100       110       120
m557.pep AAGAQMTLRIDSVSQNKETYTVTRAAVINEYLLILTVEAQVLKRGEPVGKPMTVSVRRVL
         ||||||||||||||||||||||||||||||||||||||||||||||||||||||||||||
    g557 AAGAQMTLRIDSVSQNKETYTVTRAAVINEYLLILTVEAQVLKRGEPVGKPMTVSVRRIL
                 70        80        90       100       110       120

                130       140       150       160
m557.pep AYADNEILGKQEEEAALWAEMRQDAAEQIVRRLTFLKAEX
          ||||||||||||| :||||||||:|||||||||||||||
    g557 DYADNEILGKQEEEETLWAEMRQDVAEQIVRRLTFLKAEX
                130       140       150       160
```

The following partial DNA sequence was identified in *N. meningitidis* <SEQ ID 1641>:

```
a557.seq
  1 ATGAACAAAC TGTTTCTTAC TGCCGCAGTG CTGATGCTGG GCGCGTGCGG

 51 TTTCCACCTG AAAGGTGCAG ACGGCATTTC TCCGCCGCTG ACCTACCGGA

101 GCTGGCACAT CGAAGGCGGA CAGGCATTGC AGTTTCCTTT GGAAACCGCG

151 CTGTATCAGG CTTCGGGTAG GGTGGACGAT GCTGCCGGCG CGCAGATGAC

201 CCTGCGTATA GACAGCGTTT CCCAAAACAA GGAAACCTAC ACCGTTACCC

251 GTGCGGCAGT CATCAACGAA TATCTTTTGA TATTGACGGT TGAAGCGCAG

301 GTATTGAAAC GCGGCGAGCC GGTCGGCAAA CCGATGACCG TGTCCGTCCG
```

-continued

```
351 CCGCGTCCTT GCTTATGCCG ACAACGAGAT CTTGGGCAAA CAGGAAGAGG

401 AAGCGGCATT GTGGGCGGAA ATGCGGCAGG ATGCCGCCGA ACAGATTGTC

451 CGCCGCCTGA CCTTTCTGAA GGCGGAATGA
```

This corresponds to the amino acid sequence <SEQ ID 1642; ORF 557.a>:

```
a557.pep
  1 MNKLFLTAAV LMLGACGFHL KGADGISPPL TYRSWHIEGG QALQFPLETA

 51 LYQASGRVDD AAGAQMTLRI DSVSQNKETY TVTRAAVINE YLLILTVEAQ

101 VLKRGEPVGK PMTVSVRRVL AYADNEILGK QEEEAALWAE MRQDAAEQIV

151 RRLTFLKAE*
```

m557/a557 99.4% identity in 159 aa overlap

```
                   10        20        30        40        50        60
m557.pep   MNKLFLTAAVLMLGACGFHLKGADGISPPLTYRSWHIEGGQALRFPLETALYQASGRVDD
           |||||||||||||||||||||||||||||||||||||||||||:||||||||||||||||
a557       MNKLFLTAAVLMLGACGFHLKGADGISPPLTYRSWHIEGGQALQFPLETALYQASGRVDD
                   10        20        30        40        50        60

                   70        80        90       100       110       120
m557.pep   AAGAQMTLRIDSVSQNKETYTVTRAAVINEYLLILTVEAQVLKRGEPVGKPMTVSVRRVL
           ||||||||||||||||||||||||||||||||||||||||||||||||||||||||||||
a557       AAGAQMTLRIDSVSQNKETYTVTRAAVINEYLLILTVEAQVLKRGEPVGKPMTVSVRRVL
                   70        80        90       100       110       120

                  130       140       150       160
m557.pep   AYADNEILGKQEEEAALWAEMRQDAAEQIVRRLTFLKAEX
           ||||||||||||||||||||||||||||||||||||||||
a557       AYADNEILGKQEEEAALWAEMRQDAAEQIVRRLTFLKAEX
                  130       140       150       160
```

The following partial DNA sequence was identified in *N. gonorrhoeae* <SEQ ID 1643>:

```
g558.seq..
  1 ATGGATGCTT GTTTTTTCGT CATTCCCGCA CAGGCGGGAA TTCGGAGATT

 51 CGGGATTGTT TTCAAACGTT CGGGTCGGAT TCTTGCCGGT GCGGGAATGA

101 TGCCCTTATA TACTTTCTCC GAGCTTTATA TGCTTCAACA GGGGACGGCA

151 CATCAAGCAC CGCACTGCGT GTTGCCCGAA CGAGGCTGCC CTCCGATTAG

201 ATTCTATCGC TATAAACAGA CGGGTTTCAA CCGAAAAGGA ATGGGGATAA

251 AGTCCATTTC CGACACCTCT CGGGCGATGC CGTCTGAAAA CCAATCTCCA

301 CTTTCAGACG GCATTGTTTA G
```

This corresponds to the amino acid sequence <SEQ ID 1644; ORF 558.ng>:

```
g558.pep..
  1 MDACFFVIPA QAGIRRFGIV FKRSGRILAG AGMMPLYTFS ELYMLQQGTA

 51 HQAPHCVLPE RGCPPIRFYR YKQTGFNRKG MGIKSISDTS RAMPSENQSP

101 LSDGIV*
```

The following partial DNA sequence was identified in *N. meningitidis* <SEQ ID 1645>:

```
m558.seq..
   1 ATGAATGCTT GTTTTTTCGT CATTCCCACA CAGGCGGGAA TTCGGAGATT

51 CGGGATTGTT TTCAAACGTT CGGGTCGGAT TCTTGCCGGT GCAGGAATGA

101 TGCCCTTATA TACTTTCTCC GAGCTTTATA TGTTTCAACA GGGGACGGCA

151 CATCAAGCAC CGCACTGCGT GTTGCCCGAA CGAGACTACC CTCCGATTAG

201 ATTCTATCGC CATAAACAGA CGGGTTTCAA CCGAAAAGGA ATGGGGATAA

251 AGTCCATTTC CGACATCTsT CGGGCGATGC CGTCTGAAAA CCAATCTCCA

301 CTTTCAGACG GCATTGTTTA G
```

This corresponds to the amino acid sequence <SEQ ID 1646; ORF 558>:

```
m558.pep..
   1 MNACFFVIPT QAGIRRFGIV FKRSGRILAG AGMMPLYTFS ELYMFQQGTA

51 HQAPHCVLPE RDYPPIRFYR HKQTGFNRKG MGIKSISDIX RAMPSENQSP

101 LSDGIV*
```

Computer analysis of this amino acid sequence gave the following results:

Homology with a Predicted ORF from *N. gonorrhoeae*

ORF 558 shows 92.5% identity over a 106 aa overlap with a predicted ORF (ORF 558.ng) from *N. gonorrhoeae*:

```
m558/g558

10        20        30        40        50        60
m558.pep MNACFFVIPTQAGIRRFGIVFKRSGRILAGAGMMPLYTFSELYMFQQGTAHQAPHCVLPE
         |:|||||||:|||||||||||||||||||||||||||||||||||:||| |||||||||||
    g558 MDACFFVIPAQAGIRRFGIVFKRSGRILAGAGMMPLYTFSELYMLQQGRAHQAPHCVLPE
                  10        20        30        40        50        60

70        80        90       100
m558.pep RDYPPIRFYRHKQTGFNRKGMGIKSISDIXRAMPSENQSPLSDGIVX
         |  |||||||:|||||||||||||||||  |||||||||||||||||
    g558 RGCPPIRFYRYKQTGFNRKGMGIKSISDTSRAMPSENQSPLSDGIVX
                  70        80        90       100
```

The following partial DNA sequence was identified in *N. meningitidis* <SEQ ID 1647>:

```
a558.seq
   1 ATGAATGCTT GTTTTTTCGT CATTCCCACA CAGGCGGGAA TTCGGAGATT

51 CGGGATTGTT TTCAAACGTT CGGGTCGGAT TCTTGCCGGT GCGGGAATGA

101 TGCCCTTATA TATAGTGGAT TAAATTTAAA TCAGGACAAG GCGACGAAGC

151 CGCAGACAGT ACAAATAGTA CGGCAAGGCG AGGCAACGCC GTACTGGTTT

201 AAATTTAATC CACTATACTT TCTCCGAGCT TTATATGTTT CAACAGAGGA

251 CGGCACATCA AGCACCGCAC TGCGTGTTGC CCGAACGAGA CTGCCCTCCG

301 ATTAGATTCT ATCGCTATAA ACAGACGGGT TTCAACCGAA AAGGAATGGG

351 AATGAAGTCC GTTTCCGACA CCTCTCGGGC GATGCCGTCT GAAAACCAAT

401 CTCCACTTTC AGACGGCATT GTTTAG
```

This corresponds to the amino acid sequence <SEQ ID 1648; ORF 558.a>:

```
a558.pep
   1 MNACFFVIPT QAGIRRFGIV FKRSGRILAG AGMMPLYIVD *I*IRTRRRS

  51 RRQYK*YGKA RQRRTGLNLI HYTFSELYMF QQRTAHQAPH CVLPERDCPP

 101 IRFYRYKQTG FNRKGMGMKS VSDTSRAMPS ENQSPLSDGI V*
```

m558/a558 70.2% identity in 141 aa overlap

```
                  10        20        30        40        50        60
m558.pep MNACFFVIPTQAGIRRFGIVFKRSGRILAGAGMMPLY-----------------------
         |:|||||||:|||||||||||||||||||||||||||
    a558 MNACFFVIPTQAGIRRFGIVFKRSGRILAGAGMMPLYIVDXIXIRTRRRSRRQYKXYGKA
                  10        20        30        40        50        60

                       40        50        60        70        80
m558.pep ------------TFSELYMFQQGTAHQAPHCVLPERDYPPIRFYRHKQTGFNRKGMGIKS
                     |||||||||| |||||||||||||| |||||||:|||||||||||:||
    a558 RQRRTGLNLIHYTFSELYMFQQRTAHQAPHCVLPERDCPPIRFYRYKQTGFNRKGMGMKS
                  70        80        90       100       110       120

             90       100
m558.pep ISDIXRAMPSENQSPLSDGIVX
         :||  |||||||||||||||||
    a558 VSDTSRAMPSENQSPLSDGIVX
                 130       140
```

The following partial DNA sequence was identified in *N. gonorrhoeae* <SEQ ID 1649>:

```
g560.seq
   1 atgctcatca tccgcaacct gatttactgg ctgatactct gttccagcct

  51 gattttcctc tttcccttta tgctgctcgc ctcgcctttc cgggacgggg

 101 cgcacaagat ggcgcgggtc tgggtcggca tcctcaactg gtcgctcaaa

 151 cacatcgtcg ggctcaaata ccgcatcatc ggcgcggaac acattccgga

 201 ccgcccctcc gtcatctgcg ccaaacacca aagcggctgg gaaacgctcg

 251 cgctccaaga gatttttccg ccgcaggttt acgttgccaa gcgcgagttg

 301 ttcaaaatcc cctttttcgg ctggggcttg aaactggtca aaaccatagg

 351 catagaccgc aacaaccgcc gcgaagccaa cgaacagctc ataaaacagg

 401 gtttggcgcg caaaaaacgaa ggttattgga ttaccatttt ccccgaaggc

 451 acgcgccttg cgcccggaaa acgcggcaaa tacaaactcg gcggcgcgcg

 501 catggcgaaa atgtttgaga tggacatcgt ccccgtcgcc ctcaacagcg

 551 gcgaattttg gccgaaaaat tcctttctga aatatccggg ggaaatcacc

 601 gtcatcatct gtccgaccat cccgcacgca agcggcagcg aagccgaatt

 651 gatggaaaaa tgcgaacacc tcattgaaac gcaacaaccg cttatttccg

 701 gcgcaggccc gtttgccgcc gaaatgccgt ctgaaaccgc atga
```

This corresponds to the amino acid sequence <SEQ ID 1650; ORF 560.ng>:

```
g560.pep..
   1 MLIIRNLIYW LILCSSLIFL FPFMLLASPF RDGAHKMARV WVGILNWSLK

  51 HIVGLKYRII GAEHIPDRPS VICAKHQSGW ETLALQEIFP PQVYVAKREL

 101 FKIPFFGWGL KLVKTIGIDR NNRREANEQL IKQGLARKNE GYWITIFPEG
```

-continued

```
151 TRLAPGKRGK YKLGGARMAK MFEMDIVPVA LNSGEFWPKN SFLKYPGEIT

201 VIICPTIPHA SGSEAELMEK CEHLIETQQP LISGAGPFAA EMPSET*
```

The following partial DNA sequence was identified in *N. meningitidis* <SEQ ID 1651>:

```
m560.seq
  1 ATGCTCATCA TCCGCAACCT GATTTACTGG CTGATACTCT GTTCCACCCT

 51 GATTTTCCTC TTTCCCTTTA TGCTGCTCGC CTCGCCTTTC CGGGACGGGG

101 CGCACAAGAT GGCGCGGGTC TGGGTCGGCA TTCTCAACTG GTCGCTCAAA

151 CACATCGTCG GGCTCAAATA CCGCATCATC GGCGCGGAAA ACATCCCCGA

201 CCGCCCCGCC GTCATCTGCG CCAAACACCA AAGCGGCTGG GAAACGCTCG

251 CCCTTCAGGA CATTTTTCCG CCGCAGGTTT ACGTTGCCAA ACGCGAGTTG

301 TTCAAAATCC CCTTTTTCGG CTGGGGCTTG AAACTGGTCA AAACCATAGG

351 CATAGACCGC AACAACCGCC GCGAAGCCAA CGAGCAGCTC ATAAAACAGG

401 GGTTGGTGCG CAAAAACGAA GGCTATTGGA TTACCATTTT CCCCGAAGGC

451 ACGCGCCTTG CGCCCGGAAA ACGCGGCAAA TACAAACTCG GCGGCGCGCG

501 CATGGCGAAA ATGTTTGAGA TGGACATCGT CCCCGTCGCC CTCAACAGCG

551 GCGAATTTTG GCCGAAAAAC TCCTTTCTGA AATATCCGGG GGAAATCACC

601 GTCGTCATCT GTCCGACCAT CCCGCACGCA AGCGGCAGCG AAGCCGAATT

651 GATGGAAAAA TGCGAACATC TCATCGAAAC GCAACAACCG CTTATTTCCG

701 GCGCAGGCCC GTTTGCCGCC AAAATGCCGT CTGAAACCGC ATGA
```

This corresponds to the amino acid sequence <SEQ ID 1652; ORF 560>:

```
m560.pep
  1 MLIIRNLIYW LILCSTLIFL FPFMLLASPF RDGAHKMARV WVGILNWSLK

 51 HIVGLKYRII GAENIPDRPA VICAKHQSGW ETLALQDIFP PQVYVAKREL

101 FKIPFFGWGL KLVKTIGIDR NNRREANEQL IKQGLVRKNE GYWITIFPEG

151 TRLAPGKRGK YKLGGARMAK MFEMDIVPVA LNSGEFWPKN SFLKYPGEIT

201 VVICPTIPHA SGSEAELMEK CEHLIETQQP LISGAGPFAA KMPSETA*
```

Computer analysis of this amino acid sequence gave the following results:

Homology with a Predicted ORF from *N. gonorrhoeae*

ORF 560 shows 97.2% identity over a 246 aa overlap with a predicted ORF (ORF 560.ng) from *N. gonorrhoeae*:

```
m560/g560

                   10        20        30        40        50        60
m560.pep MLIIRNLIYWLILCSTLIFLFPFMLLASPFRDGAHKMARVWVGILNWSLKHIVGLKYRII
         ||||||||||||||:|||||||||||||||||||||||||||||||||||||||||||||
    g560 MLIIRNLIYWLILCSSLIFLFPFMLLASPFRDGAHKMARVWVGILNWSLKHIVGLKYRII
                   10        20        30        40        50        60

                   70        80        90       100       110       120
m560.pep GAENIPDRPAVICAKHQSGWETLALQDIFPPQVYVAKRELFKIPFFGWGLKLVKTIGIDR
         |||:|||||:|||||||||||||||:||||||||||||||||||||||||||||||||||
    g560 GAEHIPDRPSVICAKHQSGWETLALQEIFPPQVYVAKRELFKIPFFGWGLKLVKTIGIDR
                   70        80        90       100       110       120
```

-continued

```
                  130       140       150       160       170       180
m560.pep NNRREANEQLIKQGLVRKNEGYWITIFPEGTRLAPGKRGKYKLGGARMAKMFEMDIVPVA
         |||||||||||||||:||||||||||||||||||||||||||||||||||||||||||||
    g560 NNRREANEQLIKQGLARKNEGYWITIFPEGTRLAPGKRGKYKLGGARMAKMFEMDIVPVA
                  130       140       150       160       170       180

                  190       200       210       220       230       240
m560.pep LNSGEFWPKNSFLKYPGEITVVICPTIPHASGSEAELMEKCEHLIETQQPLISGAGPFAA
         |||||||||||||||||||||:||||||||||||||||||||||||||||||||||||||
    g560 LNSGEFWPKNSFLKYPGEITVIICPTIPHASGSEAELMEKCEHLIETQQPLISGAGPFAA
                  190       200       210       220       230       240

m560.pep KMPSETAX
         :|||||
    g560 EMPSETX
```

The following partial DNA sequence was identified in *N. meningitidis* <SEQ ID 1653>:

```
a560.seq
   1 ATGCTCATCA TCCGCAACCT GATTTACTGG CTGATACTCT GTTCCACCCT

  51 GATTTTCCTC TTTCCCTTTA TGCTGCTCGC CTCGCCTTTC CGAGACGGGG

 101 CGCACAAGAT GGCGCGGGTC TGGGTCAAAA TCCTCAACCT CTCGCTCAAA

 151 CACATCGTCG GGCTCAAATA CCGCATCATC GGCGCGGAAA ACATCCCCGA

 201 CCGCCCCGCC GTCATCTGCG CCAAACACCA AAGCGGCTGG GAAACGCTCG

 251 CCCTTCAGGA CATTTTTCCG CCGCAGGTTT ACGTTGCCAA ACGCGAGTTG

 301 TTCAAAATCC CCTTTTTCGG CTGGGGCTTG AAACTGGTCA AAACCATAGG

 351 CATAGACCGC AACAACCGCC GCGAAGCCAA CGAGCAGCTC ATAAAACAGG

 401 GGTTGGCGCG CAAAAACGAA GGCTATTGGA TTACCATTTT CCCCGAAGGC

 451 ACACGCCTTG CGCCCGGAAA ACGCGGCAAA TACAAACTCG GCGGCGCGCG

 501 CATGGCGAAA ATGTTTGAGA TGGACATCGT CCCCGTCGCC CTCAACAGCG

 551 GCGAATTTTG GCCGAAAAAC TCCTTTCTGA AATATCCGGG GGAAATCACC

 601 GTCGTCATCT GTCCGACCAT CCCGCACGCA AGCGGCAGCG AAGCCGAATT

 651 GATGGGAAAA TGCGAACACC TCATCGAAAC GCAGCAGCCG CTCATTTCCG

 701 GCGCAGGCCC GTTTGCCGCC AAAATGCCGT CTGAAACCGC ATGA
```

This corresponds to the amino acid sequence <SEQ ID 1654; ORF 560.a>:

```
a560.pep
   1 MLIIRNLIYW LILCSTLIFL FPFMLLASPF RDGAHKMARV WVKILNLSLK

  51 HIVGLKYRII GAENIPDRPA VICAKHQSGW ETLALQDIFP PQVYVAKREL

 101 FKIPFFGWGL KLVKTIGIDR NNRREANEQL IKQGLARKNE GYWITIFPEG

 151 TRLAPGKRGK YKLGGARMAK MFEMDIVPVA LNSGEFWPKN SFLKYPGEIT

 201 VVICPTIPHA SGSEAELMGK CEHLIETQQP LISGAGPFAA KMPSETA*
```

m560/a560 98.4% identity in 247 aa overlap

```
                  10        20        30        40        50        60
m560.pep MLIIRNLIYWLILCSTLIFLFPFMLLASPFRDGAHKMARVWVGILNWSLKHIVGLKYRII
         ||||||||||||||||||||||||||||||||||||||||||||||||||||||||||||
    a560 MLIIRNLIYWLILCSTLIFLFPFMLLASPFRDGAHKMARVWVGILNWSLKHIVGLKYRII
                  10        20        30        40        50        60
```

-continued

```
                  70         80         90        100        110        120
m560.pep GAENIPDRPAVICAKHQSGWETLALQDIFPPQVYVAKRELFKIPFFGWGLKLVKTIGIDR
         ||||||||||||||||||||||||||||||||||||||||||||||||||||||||||||
    a560 GAENIPDRPAVICAKHQSGWETLALQDIFPPQVYVAKRELFKIPFFGWGLKLVKTIGIDR
                  70         80         90        100        110        120

                 130        140        150        160        170        180
m560.pep NNRREANEQLIKQGLVRKNEGYWITIFPEGTRLAPGKRGKYKLGGARMAKMFEMDIVPVA
         |||||||||||||||:||||||||||||||||||||||||||||||||||||||||||||
    a560 NNRREANEQLIKQGLARKNEGYWITIFPEGTRLAPGKRGKYKLGGARMAKMFEMDIVPVA
                 130        140        150        160        170        180

                 190        200        210        220        230        240
m560.pep LNSGEFWPKNSFLKYPGEITVVICPTIPHASGSEAELMEKCEHLIETQQPLISGAGPFAA
         ||||||||||||||||||||||||||||||||||||||||||||||||||||||||||||
    a560 LNSGEFWPKNSFLKYPGEITVVICPTIPHASGSEAELMEKCEHLIETQQPLISGAGPFAA
                 190        200        210        220        230        240

m560.pep KMPSETAX
         ||||||||
    a560 KMPSETAX
```

The following partial DNA sequence was identified in *N. meningitidis* <SEQ ID 1655>:

```
Nm561.seq.
   1 ATGATACTGC CAGCCCGTTT TTCAGACGGC ATCAGCCTTT CCCTGCGCCT

  51 GAAACTCCTG ACCGGACTGT GGGTCGGGTT GGCGGCATTG TCTGTCGTTT

 101 TGACACTGCT GCTCTCTTTG CGTCTGGAAA ACGCGGCCTC CGTCATCGAA

 151 GAGGCGGGCA ACTTGAGAAT GCAGGCATAC CGTCTGGCAT ACATGGCGGG

 201 TGAAGGCTCG CCCCGTGCGC AAATTGACAA TCAGGTTGCC GAATTTGAAA

 251 AAAGTTTAAA ACGCATTGCC CAAAGCGATG CCATCCATCC GCTGATTCCT

 301 TCGGACACCC CTCTTGCTTA TGATTTGATA CAATCCATGC TGATTATAGA

 351 TTGGCAGGCA CACATCCTCC CCCCGCTCCA GTCCTACCGG CGACCGACTC

 401 AGGTCGATCT CTACCGCTTT GCCGGAAACA TCGAACTGTT TTTGCAGGCA

 451 TTGGAAAATG CCAACGAAAA AAACACATGG TGGCTCAGGC GTTTTCAATG

 501 GGCAATTATG TTGATGACGC TGGTGTCGTC TGTACTGATG CTGTTTTGGC

 551 ACCAGATTTG GGTTATCCGG CCGCTGCAGG CGTTAAGGGA AGGTGCGGAA

 601 CGCATCGGAC GGAGGTGTTT CGATATTCCG GTTCCCGAAG GCGGTACGCC

 651 GGAATTCAAA CAGGTCGGGC GTTGTTTCAA TCAAATGGGC GGCAGGTTGA

 701 AAATTTTATA TGATGATTTG GAAGGACAAG TCGCCGAGCA GACACGCAGT

 751 CTCGAAAAAC AAAATCAAAA CCTGACCCTG CTGTACCAAA CTACACGGGA

 801 CCTGCACCAA TCCTACATAC CGCAACAGGC TGCAGAACAT TTTCTAAACC

 851 GTATCCTGCC CGCCGTAGGA GCAGATTCCG GCAGAGTTTG TTTGGACGGC

 901 GGATCCGATG TTTATGTTTC CATTCATCAT GCGGATTGCG GCACAGCAGC

 951 TTCGGATTTG GGGAAGTACC ATGAGGAAAT CTTCCCCATT GAGTACCAGA

1001 ACGAAACATT GGGCAGGCTG TTGCTCAGCT TTCCAAACGG CATTTCTCTT

1051 GATGAAGACG ACCGCATCCT GCTTCAAACA CTAGGCAGGC AATTGGGCGT

1101 ATCGCTTGCC GGCGCAAAAC AGGAGGAAGA AAAACGCCTG CTTGCAGTAT

1151 TGCAGGAACG CAACCTGATT GCGCAAGGAT TACATGACAG CATCGCACAA

1201 GCATTAACGT TCCTAAACCT ACAGGTACAG ATGCTGGAAA CCGCCTTTGC

1251 CGAAAACAAA CGGGAGGAAG CCGCAGAAAA CATCAGCTTT ATCAAAACAG

1301 GCGTGCAGGA ATGTTATGAA GATGTCCGCG AACTGCTGCT CAACTTCCGT
```

-continued

```
1351 ACCAAAATCA GCAATAAAGA ATTTCCCGAA GCCGTTGCCG ACCTATTCGC

1401 CCGCTTTACG CAACAAACCG GGATAACGGT CGAAACCGCC TGGGAAAACG

1451 GTTCGTTCCT GCCGCCTCAG GAAGCGCAGC TCCAAATGAT TTTTATCCTG

1501 CAGGAAAGCC TGTCCAACAT CCGCAAACAC GCCCGCGCCA CCCATGTAAA

1551 ATTCACCCTT TCCGAACACG GCGGACGCTT TACCATGACC ATCCAAGACA

1601 ACGGACAAGG TTTCGACACG GAGAAAATAG GAGAACCCAC GGGCAGCCAT

1651 GTCGGACTGC ACATCATGCA GGAGCGTGCC AAACGCATCC ATGCCGTTTT

1701 AGAAATCCGT TCCCAAGCTC AACAGGGAAC CACCGTCTCA TTGACGGTTG

1751 CATCTGAAGA AAGCTTGAAA TGA
```

This corresponds to the amino acid sequence <SEQ ID 1656; ORF 561>:

```
m561.pep
  1 MILPARFSDG ISLSLRLKLL TGLWVGLAAL SVVLTLLLSL RLENAASVIE

 51 EAGNLRMQAY RLAYMAGEGS PRAQIDNQVA EFEKSLKRIA QSDAIHPLIP

101 SDTPLAYDLI QSMLIIDWQA HILPPLQSYR RPTQVDLYRF AGNIELFLQA

151 LENANEKNTW WLRRFQWAIM LMTLVSSVLM LFWHQIWVIR PLQALREGAE

201 RIGRRCFDIP VPEGGTPEFK QVGRCFNQMG GRLKILYDDL EGQVAEQTRS

251 LEKQNQNLTL LYQTTRDLHQ SYIPQQAAEH FLNRILPAVG ADSGRVCLDG

301 GSDVYVSIHH ADCGTAASDL GKYHEEIFPI EYQNETLGRL LLSFPNGISL

351 DEDDRILLQT LGRQLGVSLA GAKQEEEKRL LAVLQERNLI AQGLHDSIAQ

401 ALTFLNLQVQ MLETAFAENK REEAAENISF IKTGVQECYE DVRELLLNFR

451 TKISNKEFPE AVADLFARFT QQTGITVETA WENGSFLPPQ EAQLQMIFIL

501 QESLSNIRKH ARATHVKFTL SEHGGRFTMT IQDNGQGFDT EKIGEPTGSH

551 VGLHIMQERA KRIHAVLEIR SQAQQGTTVS LTVASEESLK *
```

Computer analysis of this amino acid sequence gave the following results:

Homology with a Predicted ORF from *N. gonorrhoeae*

```
m561/g561  89.7% identity in 223 aa overlap

                   10        20        30        40        50        60
m561.pep   MILPARFSDGISLSLRLKLLTGLWVGLAALSVVLTLLLSLRLENAASVIEEAGNLRMQAY
           ||||:|||||| |||||||||||||||||||||||||||:||||||||||||||||:|||
g561       MILPTRFSDGIPLSLRLKLLTGLWVGLAALSVVLTLLLSFRLENAASVIEEAGNLKMQAY
                   10        20        30        40        50        60

                   70        80        90       100       110       120
m561.pep   RLAYMAGEGSPRAQIDNQVAEFEKSLKRIAQSDAIHPLIPSDTPLAYDLIQSMLIIDWQA
           ||||||||||||||||||:||||||||||:||||||||||||:|||||||||||||||||
g561       RLAYMAGEGSPRAQIDNQIAEFEKSLKRISQSDAIHPLIPSDNPLAYDLIQSMLIIDWQA
                   70        80        90       100       110       120

                  130       140       150       160       170       180
m561.pep   HILPPLQSYRRPTQVDLYRFAGNIELFLQALENANEKNTWWLRRFQWAIMLMTLVSSVLM
           :||||||:||||||::||||||||||||||||||:||||||||||||:||||||||||||
g561       NILPPLQAYRRPTQIELYRFAGNIELFLQALENAGEKNTWWLRRFQWVIMLMTLVSSVLM
                  130       140       150       160       170       180
```

-continued

```
                190       200       210       220       230       240
m561.pep   LFWHQIWVIRPLQALREGAERIGRRCFDIPVPEGGTPEFKQVGRCFNQMGGRLKILYDDL
           ||||||||||||||||||||||:| |||||||    |: :: |
g561       LFWHQIWVIRPLQALREGAERIGQRHFDIPVPEDVRPNSNRSGGVSTKWRSGX
                190       200       210       220       230

250       260       270       280       290       300
m561.pep   EGQVAEQTRSLEKQNQNLTLLYQTTRDLHQSYIPQQAAEHFLNRILPAVGADSGRVCLDG
```

The following partial DNA sequence was identified in *N. meningitidis* <SEQ ID 1657>:

```
a561.seq
   1 ATGATACTGC CAGCCCGTTT TTCAGACGGC ATCAGCCTTT CCCTGCGCCT
  51 GAAACTCCTG ACCGGACTGT GGGTCGGGTT GGCGGCATTG TCTGTCGTTT
 101 TGACACTGCT GCTCTCTTTG CGTCTGGAAA ACGCGGCCTC CGTCATCGAA
 151 GAGGCGGGCA ACTTGAGAAT GCAGGCATAC CGTCTGGCAT ACATGGCGGG
 201 TGAAGGCTCG CCCCGTGCGC AAATTGACAA TCAGGTTGCC GAATTTGAAA
 251 AAAGTTTAAA ACGCATTGCC CAAAGCGATG CCATCCATCC GCTGATTCCT
 301 TCGGACACCC CTCTTGCTTA TGATTTGATA CAATCCATGC TGATTATAGA
 351 TTGGCAGGCA CACATCCTCC CCCCGCTCCA GTCCTACCGG CGACCGACTC
 401 AGGTCGATCT CTACCGCTTT GCCGGAAACA TCGAACTGTT TTTGCAGGCA
 451 TTGGAAAATG CCAACGAAAA AAACACATGG TGGCTCAGGC GTTTTCAATG
 501 GGCAATTATG TTGATGACGC TGGTGTCGTC TGTACTGATG CTGTTTTGGC
 551 ACCAGATTTG GGTTATCCGG CCGCTGCAGG CGTTAAGGGA AGGTGCGGAA
 601 CGCATCGGAC GGAGGTGTTT CGATATTCCG GTTCCCGAAG GCGGTACGCC
 651 GGAATTCAAA CAGGTCGGGC GTTGTTTCAA TCAAATGGGC GGCAGGTTGA
 701 AAATTTTATA TGATGATTTG GAAGGACAAG TCGCCGAGCA GACACGCAGT
 751 CTCGAAAAAC AAAATCAAAA CCTGACCCTG CTGTACCAAA CTACACGGGA
 801 TCTGCACCAA TCCTACATAC CGCAACAGGC TGCAGAACAT TTTCTAAACC
 851 GTATCCTGCC CGCCGTAGGA GCAGATTCCG GCAGAGTTTG TTTGGACGGC
 901 GGATCCGATG TTTATGTTTC CATTCATCAT GCGGATTGCG GCACAGCAGC
 951 TTCGGATTTG GGGAAGTACC ATGAGGAAAT CTTCCCCATT GAGTACCAGA
1001 ACGAAACATT GGGCAGGCTG TTGCTCAGCT TTCCAAACGG CATTTCTCTT
1051 GATGAAGACG ACCGCATCCT GCTTCAAACA CTAGGCAGGC AATTGGGCGT
1101 ATCGCTTGCC GGCGCAAAAC AGGAGGAAGA AAAACGCCTG CTTGCAGTAT
1151 TGCAGGAACG CAACCTGATT GCGCAAGGAT TACATGACAG CATCGCACAA
1201 GCATTAACGT TCCTAAACCT ACAGGTACAG ATGCTGGAAA CCGCCTTTGC
1251 CGAAAACAAA CGGGAGGAAG CCGCAGAAAA CATCGGCTTC ATCAAAACAG
1301 GCGTGCAGGA ATGTTATGAA GATGTCCGCG AACTGCTGCT CAACTTCCGT
1351 ACCAAAATCA GTAATAAAGA ATTTCCCGAA GCCGTTGCCG ACCTATTCTC
1401 GCGCTTTACG CAACAGACCG GCACGACTGT CGAAACCGCT TGGGAAAACG
1451 GCACGCACCT GCCTACACAG GACGAGCAGC TCCAAATGAT TTTCATCCTG
1501 CAAGAAAGCT TGTCCAACAT CCGAAAACAT GCCCACGCCA CCCATATCAA
1551 ATTCAGACTG CTCAAACAGG ATGGAAGTTT TACAATGACC ATTCAAGACA
```

-continued

```
1601 ACGGACAGGG TTTTGACACG GAAAACATTG GAGAACCATC GGGCAGCCAT

1651 GTCGGACTGC ATATCATGCA GGAGCGTGCC AAACGCATCC ATGCCGTTTT

1701 AGAAATCCGT TCCCAAGCTC AACAGGGAAC CACCGTCTCA TTGACGGTTG

1751 CATCTGAAGA AAGCTTGAAA TGA
```

This corresponds to the amino acid sequence <SEQ ID 1658; ORF 561.a>:

```
a561.pep

  1 MILPARFSDG ISLSLRLKLL TGLWVGLAAL SVVLTLLLSL RLENAASVIE
 51 EAGNLRMQAY RLAYMAGEGS PRAQIDNQVA EFEKSLKRIA QSDAIHPLIP
101 SDTPLAYDLI QSMLIIDWQA HILPPLQSYR RPTQVDLYRF AGNIELFLQA
151 LENANEKNTW WLRRFQWAIM LMTLVSSVLM LFWHQIWVIR PLQALREGAE
201 RIGRRCFDIP VPEGGTPEFK QVGRCFNQMG GRLKILYDDL EGQVAEQTRS
251 LEKQNQNLTL LYQTTRDLHQ SYIPQQAAEH FLNRILPAVG ADSGRVCLDG
301 GSDVYVSIHH ADCGTAASDL GKYHEEIFPI EYQNETLGRL LLSFPNGISL
351 DEDDRILLQT LGRQLGVSLA GAKQEEEKRL LAVLQERNLI AQGLHDSIAQ
401 ALTFLNLQVQ MLETAFAENK REEAAENIGF IKTGVQECYE DVRELLLNFR
451 TKISNKEFPE AVADLFSRFT QQTGTTVETA WENGTHLPTQ DEQLQMIFIL
501 QESLSNIRKH AHATHIKFRL LKQDGSFTMT IQDNGQGFDT ENIGEPSGSH
551 VGLHIMQERA KRIHAVLEIR SQAQQGTTVS LTVASEESLK *

m561/a561 96.9% identity in 590 aa overlap

                   10        20        30        40        50        60
m561.pep    MILPARFSDGISLSLRLKLLTGLWVGLAALSVVLTLLLSLRLENAASVIEEAGNLRMQAY
            ||||||||||||||||||||||||||||||||||||||||||||||||||||||||||||
a561        MILPARFSDGISLSLRLKLLTGLWVGLAALSVVLTLLLSLRLENAASVIEEAGNLRMQAY
                   10        20        30        40        50        60

                   70        80        90       100       110       120
m561.pep    RLAYMAGEGSPRAQIDNQVAEFEKSLKRIAQSDAIHPLIPSDTPLAYDLIQSMLIIDWQA
            ||||||||||||||||||||||||||||||||||||||||||||||||||||||||||||
a561        RLAYMAGEGSPRAQIDNQVAEFEKSLKRIAQSDAIHPLIPSDTPLAYDLIQSMLIIDWQA
                   70        80        90       100       110       120

                  130       140       150       160       170       180
m561.pep    HILPPLQSYRRPTQVDLYRFAGNIELFLQALENANEKNTWWLRRFQWAIMLMTLVSSVLM
            ||||||||||||||||||||||||||||||||||||||||||||||||||||||||||||
a561        HILPPLQSYRRPTQVDLYRFAGNIELFLQALENANEKNTWWLRRFQWAIMLMTLVSSVLM
                  130       140       150       160       170       180

                  190       200       210       220       230       240
m561.pep    LFWHQIWVIRPLQALREGAERIGRRCFDIPVPEGGTPEFKQVGRCFNQMGGRLKILYDDL
            ||||||||||||||||||||||||||||||||||||||||||||||||||||||||||||
a561        LFWHQIWVIRPLQALREGAERIGRRCFDIPVPEGGTPEFKQVGRCFNQMGGRLKILYDDL
                  190       200       210       220       230       240

                  250       260       270       280       290       300
m561.pep    EGQVAEQTRSLEKQNQNLTLLYQTTRDLHQSYIPQQAAEHFLNRILPAVGADSGRVCLDG
            ||||||||||||||||||||||||||||||||||||||||||||||||||||||||||||
a561        EGQVAEQTRSLEKQNQNLTLLYQTTRDLHQSYIPQQAAEHFLNRILPAVGADSGRVCLDG
                  250       260       270       280       290       300

                  310       320       330       340       350       360
m561.pep    GSDVYVSIHHADCGTAASDLGKYHEEIFPIEYQNETLGRLLLSFPNGISLDEDDRILLQT
            ||||||||||||||||||||||||||||||||||||||||||||||||||||||||||||
a561        GSDVYVSIHHADCGTAASDLGKYHEEIFPIEYQNETLGRLLLSFPNGISLDEDDRILLQT
                  310       320       330       340       350       360

                  370       380       390       400       410       420
m561.pep    LGRQLGVSLAGAKQEEEKRLLAVLQERNLIAQGLHDSIAQALTFLNLQVQMLETAFAENK
            ||||||||||||||||||||||||||||||||||||||||||||||||||||||||||||
a561        LGRQLGVSLAGAKQEEEKRLLAVLQERNLIAQGLHDSIAQALTFLNLQVQMLETAFAENK
                  370       380       390       400       410       420
```

-continued

```
                   430       440       450       460       470       480
m561.pep    REEAAENISFIKTGVQECYEDVRELLLNFRTKISNKEFPEAVADLFARFTQQTGITVETA
            ||||||||:|||||||||||||||||||||||||||||||||||||:||||||| |||||
a561        REEAAENIGFIKTGVQECYEDVRELLLNFRTKISNKEFPEAVADLFSRFTQQTGTTVETA
                   430       440       450       460       470       480

                   490       500       510       520       530       540
m561.pep    WENGSFLPPQEAQLQMIFILQESLSNIRKHARATHVKFTLSEHGGRFTMTIQDNGQGFDT
            ||||: || |: |||||||||||||||||||:|||:|| | :: | ||||||||||||||
a561        WENGTHLPTQDEQLQMIFILQESLSNIRKHAHATHIKFRLLKQDGSFTMTIQDNGQGFDT
                   490       500       510       520       530       540

                   550       560       570       580       590
m561.pep    EKIGEPTGSHVGLHIMQERAKRIHAVLEIRSQAQQGTTVSLTVASEESLKX
            |:||||:||||||||||||||||||||||||||||||||||||||||||||
a561        ENIGEPSGSHVGLHIMQERAKRIHAVLEIRSQAQQGTTVSLTVASEESLKX
                   550       560       570       580       590
```

The following partial DNA sequence was identified in *N. gonorrhoeae* <SEQ ID 1659>:

```
g562.seq..
   1 atggcaagcc cgtcgagtct gcctttcaat tcgggcaaga ccaaaccgac

  51 ggcttttgcc gcgccggttt tggtcggaat catgttttcc acgccgctgc

 101 gggcgcggcg caggtctttg tggcgcacgt cggtaacggt ttggtcgttg

 151 gtcagtgcgt ggatggtggt cattgcgcct ttgacgatgc cgacgctttc

 201 gctcaacact ttggcaaccg gcgagaggca gttggtggtg caggaagcgt

 251 tggaaacgac ggtcatgtcg gcggtcagga cgctgtcgtt cacgccgtac

 301 acgacggttg catcgacatc gtcgccgccc ggtgcggaaa tgaggacttt

 351 tttcgcgccg ctttcgaggt ggattttggc tttttctttg ctggtgaacg

 401 cgccggtgca ttccatgacc aaatcgacac cgagttcttt ccacggcagt

 451 tcggcagggt tgcgggtcga gaagaagggg attttgtcgc cgttgacgat

 501 gaggttgccg ccgtcgtggg atacgtcggc ttcaaagcgt ccgtgtacgg

 551 tgtcgaattt ggtcagatgg gcgttggttt caaggctgcc gctggcgttg

 601 acggcgacga tttggagttg gtcttga
```

This corresponds to the amino acid sequence <SEQ ID 1660; ORF 562.ng>:

```
g562.pep
   1 MASPSSLPFN SGKTKPTAFA APVLVGIMFS TPLRARRRSL WRTSVTVWSL

  51 VSAWMVVIAP LTMPTLSLNT LATGERQLVV QEALETTVMS AVRTLSFTPY

 101 TTVASTSSPP GAEMRTFFAP LSRWILAFSL LVNAPVHSMT KSTPSSFHGS

 151 SAGLRVEKKG ILSPLTMRLP PSWDTSASKR PCTVSNLVRW ALVSRLPLAL

 201 TATIWSWS*
```

The following partial DNA sequence was identified in *N. meningitidis* <SEQ ID 1661>:

```
m562.seq
   1 ATGGCAAGCC CGTCGAGCCT GCCTTTCAAT TCGGGCAGTA CCAAACCGAC

  51 GGCTTTTGCC GCGCCGGTTT TGGTCGGAAT CATGTTTTCC ACGCCGCTGC

 101 GGGCGCGGCG CAGGTCTTTG TGGCGCACGT CGGTAACGGT TTGGTCGTTG
```

-continued

```
151 GTCAGCGCGT GGATGGTGGT CATCGCGCCT TTGACGATGC CGACGCTTTC

201 GCTCAACACT TTGGCAACCG GCGAGAGGCA GTTGGTGGTG CAGGAAGCGT

251 TGGAAACGAC GGTCATGTCG GCGGTCAGGA CGCTGTCGTT CACGCCGTAC

301 ACGACGGTTG CATCGACATC GTCGCCGCCC GGTGCGGAAA TGAGGACTTT

351 TTTCGCGCCG CTTTCGAGGT GGATTTTGGC TTTTTCTTTG CTGGTGAACG

401 CGCCGGTGCA TTCCATGACC AAATCGACAC CGAGTTCTTT CCACGGCAGT

451 TCGGCAGGGT TGCGGGTCGA GAAGAAGGGG ATTTTGTCGC CGTTGACGAT

501 GAGGTTGCCG CCGTCGTGGG ATACGTCGGC TTCAAAGCGT CCGTGCACGG

551 TGTCGAATTT GGTCAGATGG GCGTTGGTTT CAAGGCTGCC GCTGGCGTTG

601 ACGGCGACGA GTTGGAGTTG GTCTTGA
```

This corresponds to the amino acid sequence <SEQ ID 1662; ORF 562>:

```
m562.pep
   1 MASPSSLPFN SGSTKPTAFA APVLVGIMFS TPLRARRRSL WRTSVTVWSL

  51 VSAWMVVIAP LTMPTLSLNT LATGERQLVV QEALETTVMS AVRTLSFTPY

 101 TTVASTSSPP GAEMRTFFAP LSRWILAFSL LVNAPVHSMT KSTPSSFHGS

 151 SAGLRVEKKG ILSPLTMRLP PSWDTSASKR PCTVSNLVRW ALVSRLPLAL

 201 TATSWSWS*
```

Computer analysis of this amino acid sequence gave the following results:
Homology with a Predicted ORF from *N. gonorrhoeae*

```
m562/g562  99.0% identity in 208 aa overlap

                   10        20        30        40        50        60
m562.pep   MASPSSLPFNSGSTKPTAFAAPVLVGIMFSTPLRARRRSLWRTSVTVWSLVSAWMVVIAP
           ||||||||||||:|||||||||||||||||||||||||||||||||||||||||||||||
g562       MASPSSLPFNSGKTKPTAFAAPVLVGIMFSTPLRARRRSLWRTSVTVWSLVSAWMVVIAP
                   10        20        30        40        50        60

                   70        80        90       100       110       120
m562.pep   LTMPTLSLNTLATGERQLVVQEALETTVMSAVRTLSFTPYTTVASTSSPPGAEMRTFFAP
           ||||||||||||||||||||||||||||||||||||||||||||||||||||||||||||
g562       LTMPTLSLNTLATGERQLVVQEALETTVMSAVRTLSFTPYTTVASTSSPPGAEMRTFFAP
                   70        80        90       100       110       120

                  130       140       150       160       170       180
m562.pep   LSRWILAFSLLVNAPVHSMTKSTPSSFHGSSAGLRVEKKGILSPLTMRLPPSWDTSASKR
           ||||||||||||||||||||||||||||||||||||||||||||||||||||||||||||
g562       LSRWILAFSLLVNAPVHSMTKSTPSSFHGSSAGLRVEKKGILSPLTMRLPPSWDTSASKR
                  130       140       150       160       170       180

                  190       200       210       220       230       240
m562.pep   PCTVSNLVRWALVSRLPLALTATSWSWSX
           |||||||||||||||||||||| |||||
g562       PCTVSNLVRWALVSRLPLALTATIWSWSX
```

The following partial DNA sequence was identified in *N. meningitidis* <SEQ ID 1663>:

```
a562.seq
   1 ATGGCAAGCC CGTCGAGTTT GTCTTTCAAT TCGGGCAGTA CCAAACCGAC

  51 GGCTTTTGCC GCGCCAGTTT TGGTCGGAAT CATGTTTTCC ACGCCGCTGC

 101 GGGCGCGGCG CAGGTCTTTG TGGCGCACGT CGGTAACGGT TTGGTCGTTG
```

-continued

```
151 GTCAGCGCGT GGATGGTGGT CATCGCGCCT TTGACGATGC CGACGCTTTC

201 GCTCAACACT TTGGCAACCG GCGAGAGGCA GTTGGTGGTG CAGGAAGCGT

251 TGGAAACGAC GGTCATGTCG GCGGTCAGGA TGCTGTCGTT CACGCCGTAC

301 ACGACGGTTG CATCGACATC GTCGCCGCCC GGTGCGGAAA TGAGGACTTT

351 TTTCGCGCCG CTTTCCAGAT GAACTTTGGC TTTTTCTTTG CTGGTGAACG

401 CGCCGGTGCA TTCCATGACC AAATCGACAC CGAGTTCTTT CCACGGCAGT

451 TCGGCAGGGT TGCGGGTCNA GAAGAANGGG ATTTTGTCGC CGTTGACGAT

501 GAGGTTGCCG CCGTCGTGGG ATACGTCGGC TTCAAAGCGT CCGTGCACGG

551 TGTCGAATTT GGTGAGGTGG GCGTTGGTTT CAAGGCTGCC GCTGGCGTTG

601 ACGGCGACGA TTTGGAGTTG GTCTTGA
```

This corresponds to the amino acid sequence <SEQ ID 1664; ORF 562.a>:

```
a562.pep
      1  MASPSSLSFN SGSTKPTAFA APVLVGIMFS TPLRARRRSL WRTSVTVWSL
     51  VSAWMVVIAP LTMPTLSLNT LATGERQLVV QEALETTVMS AVRMLSFTPY
    101  TTVASTSSPP GAEMRTFFAP LSR*TLAFSL LVNAPVHSMT KSTPSSFHGS
    151  SAGLRVXKXG ILSPLTMRLP PSWDTSASKR PCTVSNLVRW ALVSRLPLAL
    201  TATIWSWS*
```

```
m562/a562  96.6% identity in 208 aa overlap
                   10        20        30        40        50        60
m562.pep   MASPSSLPFNSGSTKPTAFAAPVLVGIMFSTPLRARRRSLWRTSVTVWSLVSAWMVVIAP
           ||||||| ||||||||||||||||||||||||||||||||||||||||||||||||||||
a562       MASPSSLSFNSGSTKPTAFAAPVLVGIMFSTPLRARRRSLWRTSVTVWSLVSAWMVVIAP
                   10        20        30        40        50        60

                   70        80        90       100       110       120
m562.pep   LTMPTLSLNTLATGERQLVVQEALETTVMSAVRTLSFTPYTTVASTSSPPGAEMRTFFAP
           |||||||||||||||||||||||||||||||||| |||||||||||||||||||||||||
a562       LTMPTLSLNTLATGERQLVVQEALETTVMSAVRMLSFTPYTTVASTSSPPGAEMRTFFAP
                   70        80        90       100       110       120

                  130       140       150       160       170       180
m562.pep   LSRWILAFSLLVNAPVHSMTKSTPSSFHGSSAGLRVEKKGILSPLTMRLPPSWDTSASKR
           |||  ||||||||||||||||||||||||||||||| | ||||||||||||||||||||
a562       LSRXTLAFSLLVNAPVHSMTKSTPSSFHGSSAGLRVXKXGILSPLTMRLPPSWDTSASKR
                  130       140       150       160       170       180

                  190       200      209
m562.pep   PCTVSNLVRWALVSRLPLALTATSWSWSX
           ||||||||||||||||||||||| |||||
a562       PCTVSNLVRWALVSRLPLALTATIWSWSX
                  190       200
```

The following partial DNA sequence was identified in *N. gonorrhoeae* <SEQ ID 1665>:

```
g563.seq
    1  ATGAACAAAA CCCTCTATCG TGTGATTTTC AACCGCAAAC GCGGTGCTGT

   51  GGTAGCTGTT GCCGAAACCA CCAAGCGCGA AGGTAAAAGC TGTGCCGATA

  101  GTGGTTCGGG CAGCGTTTAT GTGAAATCCG TTTCTTTCAT TCCTACTCAT

  151  TCCAAAGCCT TTTGTTTTTC TGCATTAGGC TTTTCTTTAT GTTTGGCTTT

  201  GGGTACGGTC AATATTGCTT TTGCTGACGG CATTATTACT GATAAAGCTG
```

-continued

251 CTCCTAAAAC CCAACAAGCC ACGATTCTGC AAACAGGTAA CGGCATACCG

301 CAAGTCAATA TTCAAACCcc tACTTCGGCa ggGGTTTCTG TTAATCAATA

351 TGCCCAGTTT GATGTGGGTA ATcgcGGGGC GATTTTAAAC AACAGTCGCA

401 GCAACACCCA AACACAGCTA GGCGGTTGGA TTCAAGGCAA TCCTTGGTTG

451 ACAAGGGGCG AAGCACGTGT GGTTGTAAAC CAAATCAACA GCAGCCATCC

501 TTCACAACTG AATGGCTATA TTGAAGTGGG TGGACGACGT GCAGAAGTCG

551 TTATTGCCAA TCCGGCAGGG ATTGCAGTCA ATGGTGGTGG TTTTATCAAT

601 GCTTCCCGTG CCACTTTGAC GACAGGCCAA CCGCAATATC AAGCAGGAGA

651 CTTTAGCGGC TTTAAGATAA GGCAAGGCAA TGCTGTAATC GCCGGACACG

701 GTTTGGATGC CCGTGATACC GATTTCACAC GTATTCTTTT GTATGCCAAC

751 AAAATCACCT TGATCAGTAC GGCCGAACAA GCAGGCATTC GTAATCAAGG

801 GCAGTTGTTT GCTTCTTCCG GTAATGTGGC GATTGATGCA AATGGCCGTT

851 TGGTCAATAG TGGCACGATG GCTGCCGCCA ATGTGCAAGA TATGAATAAT

901 ACAGCGGAAC ACAAAGTCAA TATCCGCAGT CAAGCCTTTG AAAACAGCGG

951 TACGGCGGTA TCGCAACAAG GCACTCAAAT TCACAGTCAA TCGATTCAAA

1001 ACACTGGCAA ATTATTGTCG GCAGGAACAG AGGATTTAGC CGTTTCAGGC

1051 AGCCTGAACA ATCAAAATGG CGAAATAGCG ACCAATCAAC AACTGATTAT

1101 TCACGATGGT CAGCAATCTA CCGTTGTCAT TGATAATACG AATGGCACGA

1151 TACAATCAGG CCGTGATGTT GCCATTCAGG CAAAATCGTT ATCCAACAAC

1201 GGCACACTTG CCGCTGATAA TAAACTGGAT ATTGCGTTAC AAGATGATTT

1251 TTATGTAGAA CGCAAGATCG TGGCGGGCAA TGAATTGTCG CTCAGTACAC

1301 GAGGCAGCCT GAAAAATTCA CATACCTTGC AAGCAGGAAA ACGCATTCGG

1351 ATTAAAGCAA ATAACCTTGA TAATGCAGTA CAAGGCAACA TTCAATCCGG

1401 CGGTACGACA GACATTGGCA CGCAGCACAA TTTAACCAAT AGAGGCTTGA

1451 TTGACGGACA ACAAACCAAA ATCCAAGCCG GGCAAATGAA TAATATCGGT

1501 ACAGGTCGGA TTTATGGCGA CAATATCGCT ATTGCGGCTA CCCGCTTAGA

1551 CAATCAAGAT GAAAACGGTA CAGGTGCCGC CATTGCGGCA CGCGAAAACC

1601 TGAATTTAGG CATTGAACAA TTAAATAACC GTGAAAACAG TCTGATTTAC

1651 AGCGGTAACG ATATGGCGGT TGGCGGCGCA TTAGATACCA ATGACCAAGC

1701 CACAGGCAAA GCCCAAAGGA TACACAATGC CGGCGCAATC ATTGAAGCTG

1751 CAGGCAAAAT GCGTTTAGGT GTAGAAAAGC TGCACAATAC CAATGAGCAT

1801 TTGAAAACGC AGTTGGTAGA AACAGGGCGC GAGCGTATTG TTGATTACGA

1851 AGCATTTGGA CGACACGAAT TATTGCGAGA AGGCACGCAA CATGAATTAG

1901 GCTGGTTTGT CTACAACAAT GAATCAGACC ACTTACGCAC CCCTGATGGA

1951 GTGGCGCATG AAAATTGGCA TAAATACGAT TATGAAAAAG TAACGCAAGA

2001 AACTCAAGTA ACCGGAACTG CGCCTGCTAA AATCATTGCA GGTAGCGATT

2051 TGATTATTGA TAGCAAAGCA GTCTTCAACA GCGACAGCCG AATCATTGCC

2101 GGCGGCCAAT TGCTTGTGCA AACAGAAAAA GACGGTTTGC ATAACGAGCA

2151 AACCTTTGGC GAGAAGAAAG TCTTCAGCGA AAATGGTAAG TTGCACAACT

2201 ACTGGCGTGC GCGTCGTAAA GGACATGATG AAACAGGGCA TCGTGAACAA

2251 AATTATACTT TGCCGGAGGA AATCACACGC GACATTTCAC TGGGTTCATT

-continued

2301 TGCCTATGAA TCGCATAGCA AAGCATTAAG CCGTCATGCG CCCAGCCAAG

2351 GCACTGAGTT GCCACAAAGT AACCGGGATA ATATCCGTAC TGCGAAAAGC

2401 AACGGTATTT CGCTACCCTA TACGCCCAAT TCTTTTACCC CATTACCCGG

2451 CAGCAGCTTA TACATTATCA ATCCTGCCAA TAAAGGCTAT CTTGTTGAAA

2501 CCGATCCACG CTTTGCCAAC TACCGTCAAT GGTTGGGTAG TGACTATATG

2551 CTGGGCAGCC TCAAACTAGA CCCAAACAAT TTACATAAAC GTTTGGGTGA

2601 TGGTTATTAC GAGCAACGTT TAATCAATGA ACAAATCGCA GAGCTGACAG

2651 GGCATCGTCG TTTAGACGGT TATCAAAACG ACGAAGAACA ATTTAAAGCC

2701 TTAATGGATA ATGGCGCGAC TGCGGCACGT TCGATGAATC TCAGCGTTGG

2751 CATTGCATTA AGTGCCGAGC AAGCAGCGCA ACTGACCAGC GATATTGTTT

2801 GGTTGGTACA AAAAGAAGTT AAACTTCCTG ATGGCGGCAC ACAAACCGTA

2851 TTGATGCCAC AGGTTTATGT ACGCGTTAAA AATGGCGGCA TAGACGGTAA

2901 AGGTGCATTG TTGTCAGGCA GCAATACACA AATCAATGTT TCAGGCAGCC

2951 TGAAAAACTC AGGCACGATT GCAGGGCGCA ATGCGCTTAT TATCAATACC

3001 GATACGCTAG ACAATATCGG TGGGCGTATT CATGCGCAAA AATCAGCGGT

3051 TACGGCCACA CAAGACATCA ATAATATTGG CGGCATTCTT TCTGCCGAAC

3101 AGACATTATT GCTCAATGCG GGTAACAACA TCAACAACCA AAGCACGGCC

3151 AAGAGCAGTC AAAATGCACA AGGTAGCAGC ACCTACCTAG ACCGAATGGC

3201 AGGTATTTAT ATCACAGGCA AAGAAAAAGG TGTTTTAGCA GCGCAGGCAG

3251 GCAAAGACAT CAACATCATT GCCGGTCAAA TCAGCAATCA ATCAGATCAA

3301 GGGCAAACCC GGCTGCAGGC AGGACGCGAC ATTAACCTGG ATACGGTACA

3351 AACCGGCAAA TATCAAGAAA TCCATTTTGA TGCCGATAAC CATACCATCC

3401 GAGGTTCAAC GAACGAAGTC GGCAGCAGCA TTCAAACAAA AGGCGATGTT

3451 ACCCtatTGT CAGGGAATAA TCTCAATGCC AAAGCTGCCG AAGTCGGCAG

3501 CGCAAAAGGC ACACTTGCCG TGTATGCTAA AAATGACATT ACTATCAGCT

3551 CAGGCATCCA TGCCGGCCAA GTTGATGATG CGTCCAAACA TACAGGCAGA

3601 AGCGGCGGCG GTAATAAATT AGTCATTACC GATAAAGCCC AAAGTCATCA

3651 CGAAACTGCT CAAAGCAGCA CCTTTGAAGG CAAGCAAGTT GTATTGCAGG

3701 CAGGAAACGA TGCCAACATC CTTGGCAGTA ATGTTATTTC CGATAATGGC

3751 ACCCGGATTC AAGCAGGCAA TCATGTTCGC ATTGGTACAA CCCAAACTCA

3801 AAGCCAAAGC GAAACCTATC ATCAAACCCA AAAATCAGGA TTGATGAGTG

3851 CAGGTATCGG CTTCACTATT GGCAGCAAGA CAAACACACA AGAAAACCAA

3901 TCCCAAAGCA ACGAACATAC AGGCAGTACC GTAGGCAGCC TGAAAGGCGA

3951 TACCACCATT GTTGCAAGCA AACACTACGA ACAAACCGGC AGCAACGTTT

4001 CCAGCCCTGA GGGCAACAAC CTTATCAGCA CGCAAAGTAT GGATATTGGC

4051 GCAGCACAAA ACCAATTAAA CAGCAAAACC ACCCAAACCT ACGAACAAAA

4101 AGGCTTAACG GTGGGCATTC AGTTCGCCCG TTACCGATTT GGCACAACAA

4151 GCGATTGCCG TAGCACACAA AGCAGCAAAC AAGTCGGACA AAGCAAAAAC

4201 GACCGCGTTA ATGCCATGGC GGCTGCCAAT GCAGGTTGGC AGGCCTATCA

4251 AACAGGCAAA GGCGCACAAA ACTTAGCCAA TGGTACAACC AATGCCAAAC

-continued

```
4301 AAGTCAGCAT CTCCATAACC TACGGCGAAC AGCAAAACCG ACAAACCACC
4351 CAAGTTCAAG CCAATCAAGC CCAAGCGAGT CAAATTCAAG CAGGCGGCAA
4401 AACTACCCTT TATTGCCGAA GGTGCGGCGA ACAATCCAAT ATCAACATCA
4451 CAGGCTCAGG TGTTTCAGGC AGAGCAGGAA CCGGCCTGAT TGCCGATAAG
4501 CAAATCCATC TGCAATCAGC CGAGCAAAGC AATACCGAAC GCAGCCAAAA
4551 CAAATCAGCA GGCTGGAACG CAGGTGCTGC CGTATCATTC GGACAAGGAG
4601 GCTGGTCATT AGGCGTTGCC GCAGGCGGCA ATGTCGGCAA AGGCTACGGC
4651 TATGGCGATA GCGTAACCCA CCGCCATAGC CATATTGGCG ACAAAGGCAG
4701 CCAAACCCTT ATCCAAAGTG GTGGCGATAC CATCATCAAA GGCGCGCAAG
4751 TACGCGGCAA AGGCGTACAA GTCAATGCCA AAAACCTAAG CATTCAAAGT
4801 GTACAAGATA GAGAAACTTA TCAAAGCAAA CAACAAAACG CCGGTGCACA
4851 AGTTACCGTA GGTTATGGCT TCAGTGCCAG TGGCGATTAC AGCCAAAGCA
4901 AAATCCGAGC CGACCATGCT TCGGTAACCG AGCAAAGCGG TATTTATGCC
4951 GGAGAAGACG GCTATCAAAT CAAGGTCGGA AACCATACAG GCCTCAAAGG
5001 CGGCATCATC ACCAGCAGCC AAAGCGCAAA AGACAAGGGT AAAAACCGAT
5051 TCAGCACAGG CACACTCGCC GGCAGTGATA TTCAAAATTA CAGCCAATAC
5101 GAAGGAAAAA GTTTTGGATT GGGTGCCAGC GTTGCCGTAA GCGGCAAAAC
5151 ACTGGGACAG GGCGCAAAAA ATAAACCTCA AGACAAACAC CTGACAAGCA
5201 TAGCCGATAA AAACGGCGCA AGTTCATCAG TAGGGTACGG CAGCGACAGC
5251 GACAGTCAAA GCAGCATCAC AAAAAGCGGC ATCAATACCC CCAAAAACAT
5301 TCAAATCACA GACGAAGCCG CACAAATCAG GCTGACAGGC AAAATAGCGG
5351 CACAAACCAA AGCCGATATT GATACAAACG TAACCACAGA CACCGCCGAA
5401 CGACATTCGG GCAGCCTGAA AAACATATTT GACAAAGATA GAGTGCAAAG
5451 TGAACTGGAT TTACAAAgaA CCGTCAGCCA AGATTTTAGT AAAAATGTTC
5501 AACAAACCAA TACCGAGATT AACCAACATT TAGACAAACT CAAAGCAGAC
5551 AAAGAAGCAG CCGAAACAGC AGCAGCCGAG GCATTAGCCA ATGGCGATAT
5601 GGAAACTGCC AAACGCAAAG CCCATGAAGC TCAAGATGCG GCAGCAAAAG
5651 CAGATAATTG GCAACAAGGC AAAGTCATTC TCAACATGTT AGCCTCAGGT
5701 TTAGCTGAGC CGACCCAAAG CGGAGCgggc ATCGCTGCGG CTACCGCATC
5751 GCCagaCGTA TCGTATGCGA TTGGACAGCA CTTTAAagaT TTAGCCGGTC
5801 AAAACGCGAA TGGCAAACTA ACCGCCAGTC AagaAACCGC TCACGTTCTT
5851 GCCCACGCGG TATTAGGAGC AGCGGTTGCC GCAGCATGAG GCAACAATGC
5901 CCCGGCAGGA GCATTGGGTG CGGGCGGGTc ggAagcggCC GCCCCAATCA
5951 TCGGCAAATG GCTGTACGGC AAAGGAGAcg gcggcagccT GAATgcggag
6001 gaaaAAGaga CCGTTTCGGC GATTACAAGG ATGCTGggta cGgctGCCGG
6051 AGCAGCTGAG GGAAACTCGT CCGCCGATGC TGTGTGGGGT TGTTTTcaaa
6101 cggctTCaga TTTCGCTTCC TCTTTTTCAT ATCCTATAAA CATGTGA
```

This corresponds to the amino acid sequence <SEQ ID 1666; ORF 563.ng>:

```
g563.pep..
     1 MNKTLYRVIF NRKRGAVVAV AETTKREGKS CADSGSGSVY VKSVSFIPTH

    51 SKAFCFSALG FSLCLALGTV NIAFADGIIT DKAAPKTQQA TILQTGNGIP

   101 QVNIQTPTSA GVSVNQYAQF DVGNRGAILN NSRSNTQTQL GGWIQGNPWL

   151 TRGEARVVVN QINSSHPSQL NGYIEVGGRR AEVVIANPAG IAVNGGGFIN

   201 ASRATLTTGQ PQYQAGDFSG FKIRQGNAVI AGHGLDARDT DFTRILLYAN

   251 KITLISTAEQ AGIRNQGQLF ASSGNVAIDA NGRLVNSGTM AAANVQDMNN

   301 TAEHKVNIRS QAFENSGTAV SQQGTQIHSQ SIQNTGKLLS AGTEDLAVSG

   351 SLNNQNGEIA TNQQLIIHDG QQSTVVIDNT NGTIQSGRDV AIQAKSLSNN

   401 GTLAADNKLD IALQDDFYVE RKIVAGNELS LSTRGSLKNS HTLQAGKRIR

   451 IKANNLDNAV QGNIQSGGTT DIGTQHNLTN RGLIDGQQTK IQAGQMNNIG

   501 TGRIYGDNIA IAATRLDNQD ENGTGAAIAA RENLNLGIEQ LNNRENSLIY

   551 SGNDMAVGGA LDTNDQATGK AQRIHNAGAI IEAAGKMRLG VEKLHNTNEH

   601 LKTQLVETGR ERIVDYEAFG RHELLREGTQ HELGWFVYNN ESDHLRTPDG

   651 VAHENWHKYD YEKVTQETQV TGTAPAKIIA GSDLIIDSKA VFNSDSRIIA

   701 GGQLLVQTEK DGLHNEQTFG EKKVFSENGK LHNYWRARRK GHDETGHREQ

   751 NYTLPEEITR DISLGSFAYE SHSKALSRHA PSQGTELPQS NRDNIRTAKS

   801 NGISLPYTPN SFTPLPGSSL YIINPANKGY LVETDPRFAN YRQWLGSDYM

   851 LGSLKLDPNN LHKRLGDGYY EQRLINEQIA ELTGHRRLDG YQNDEEQFKA

   901 LMDNGATAAR SMNLSVGIAL SAEQAAQLTS DIVWLVQKEV KLPDGGTQTV

   951 LMPQVYVRVK NGGIDGKGAL LSGSNTQINV SGSLKNSGTI AGRNALIINT

  1001 DTLDNIGGRI HAQKSAVTAT QDINNIGGIL SAEQTLLLNA GNNINNQSTA

  1051 KSSQNAQGSS TYLDRMAGIY ITGKEKGVLA AQAGKDINII AGQISNQSDQ

  1101 GQTRLQAGRD INLDTVQTGK YQEIHFDADN HTIRGSTNEV GSSIQTKGDV

  1151 TLLSGNNLNA KAAEVGSAKG TLAVYAKNDI TISSGIHAGQ VDDASKHTGR

  1201 SGGGNKLVIT DKAQSHHETA QSSTFEGKQV VLQAGNDANI LGSNVISDNG

  1251 TRIQAGNHVR IGTTQTQSQS ETYHQTQKSG LMSAGIGFTI GSKTNTQENQ

  1301 SQSNEHTGST VGSLKGDTTI VASKHYEQTG SNVSSPEGNN LISTQSMDIG

  1351 AAQNQLNSKT TQTYEQKGLT VGIQFARYRF GTTSDCRSTQ SSKQVGQSKN

  1401 DRVNAMAAAN AGWQAYQTGK GAQNLANGTT NAKQVSISIT YGEQQNRQTT

  1451 QVQANQAQAS QIQAGGKTTL YCRRCGEQSN INITGSGVSG RAGTGLIADK

  1501 QIHLQSAEQS NTERSQNKSA GWNAGAAVSF GQGGWSLGVA AGGNVGKGYG

  1551 YGDSVTHRHS HIGDKGSQTL IQSGGDTIIK GAQVRGKGVQ VNAKNLSIQS

  1601 VQDRETYQSK QQNAGAQVTV GYGFSASGDY SQSKIRADHA SVTEQSGIYA

  1651 GEDGYQIKVG NHTGLKGGII TSSQSAKDKG KNRFSTGTLA GSDIQNYSQY

  1701 EGKSFGLGAS VAVSGKTLGQ GAKNKPQDKH LTSIADKNGA SSSVGYGSDS

  1751 DSQSSITKSG INTPKNIQIT DEAAQIRLTG KIAAQTKADI DTNVTTDTAE

  1801 RHSGSLKNIF DKDRVQSELD LQRTVSQDFS KNVQQTNTEI NQHLDKLKAD

  1851 KEAAETAAAE ALANGDMETA KRKAHEAQDA AAKADNWQQG KVILNMLASG

  1901 LAEPTQSGAG IAAATASPDV SYAIGQHFKD LAGQNANGKL TASQETAHVL
```

-continued

```
1951 AHAVLGAAVA AAXGNNAPAG ALGAGGSEAA APIIGKWLYG KGDGGSLNAE

2001 EKETVSAITR MLGTAAGAAE GNSSADAVWG CFQTASDFAS SFSYPINM*
```

The following partial DNA sequence was identified in *N. meningitidis* <SEQ ID 1667>:

```
m563.seq..
   1 ATGAATAAAA CTCTCTATCG TGTAATTTTC AACCGCAAAC GTGGGGCTGT
  51 GGTAGCCGTT GCTGAAACTA CCAAGCGCGA AGGTAAAAGC TGTGCCGATA
 101 GTGATTCAGG CAGCGCTCAT GTGAAATCTG TTCCTTTTGG TACTACTCAT
 151 GCACCTGTTT GTCGTTCAAA TATCTTTTCT TTTTCTTTAT TGGGCTTTTC
 201 TTTATGTTTG GCTGTAGGTA CGGCCAATAT TGCTTTTGCT GATGGCATTA
 251 TTGCTGATAA AGCTGCTCCT AAAACTCAAC AAGCCACGAT TCTGCAAACA
 301 GGTAACGGCA TACCGCAAGT CAATATTCAA ACCCCTACTT CGGCAGGGGT
 351 TTCTGTTAAT CAATACGCCC AGTTTGATGT GGGTAATCGC GGGGCGATTT
 401 TAAACAACAG CCGCAGCAAC ACCCAAACAC AGCTAGGCGG TTGGATTCAA
 451 GGTAATCCTT GGTTGGCAAG GGGCGAAGCA CGTGTGGTTG TAAACCAAAT
 501 CAACAGCAGC CATTCTTCAC AAATGAATGG CTATATTGAA GTGGGCGGAC
 551 GACGTGCAGA AGTCGTTATT GCCAATCCGG CAGGGATTGC AGTCAATGGT
 601 GGTGGTTTTA TCAATGCTTC CCGTGCCACT TTGACGACAG GCCAACCGCA
 651 ATATCAAGCA GGAGACCTTA GCGGCTTTAA GATAAGGCAA GGCAATGTTG
 701 TAATCGCCGG ACACGGTTTG GATGCCCGTG ATACCGATTT CACACGTATT
 751 CTCAGTTATC ATTCCAAAAT TGATGCACCC GTATGGGGAC AAGATGTTCG
 801 TGTCGTCGCG GGACAAAACG ATGTGGTCGC AACAGGTAAT GCACATTCGC
 851 CTATTCTCAA TAATGCTGCT GCCAATACGT CAAACAATAC AGCCAACAAC
 901 GGCACACATA TCCCTTTATT TGCGATTGAT ACAGGCAAAT TAGGAGGTAT
 951 GTATGCCAAC AAAATCACCT TGATCAGTAC GGCCGAGCAA GCAGGCATTC
1001 GTAATCAAGG GCAGTTGTTT GCTTCTTCCG GTAATGTGGC GATTGATGCA
1051 AATGGCCGTT TAGTCAATAG TGGCACGATG GCTGCCGCCA ATGCGAAAGA
1101 TACGGATAAT ACAGCGGAAC ACAAAGTCAA TATCCGCAGT CAGGGCGTTG
1151 AAAACAGCGG TACGGCGGTA TCGCAACAAG GCACTCAAAT TCACAGTCAG
1201 TCGATTCAAA ACACTGGCAC ATTATTGTCC TCAGGCGAAA TATTGATTCA
1251 CAATTCGGGC AGCCTGAAAA ATGAAACATC AGGCACCATT GAAGCCGCTC
1301 GTTTGGCTAT TGATACCGAC ACACTTAATA ATCAAGGCAA ACTCTCTCAA
1351 ACAGGTTCAC AAAAACTCCA TATTGATGCA CAAGGCAAAA TGGATAACCG
1401 TGGCCGCATG GGTTTACAAG ATACCGCACC AACCGCGTCA AATGGTTCAA
1451 GCAATCAAAC CGGCAATAGT TACAATGCAT CTTTCCATTC ATCCACTACC
1501 ACACCAACAA CGGCAACAGG TACGGGTACT GCAACCGTTT CTATATCAAA
1551 CATAACTGCG CCTACCTTTG CTGATGGGAC AATTCGCACT CATGGTGCAC
1601 TGGATAATTC AGGCAGTATT ATTGCCAATG GTCAAACAGA TGTTAGTGCG
1651 CAACAAGGTT TAAATAATGC AGGACAAATA GACATTCATC AGTTAAATGC
1701 AAAAGGTTCG GCGTTTGACA ATCACAATGG AACAATTATC AGTGATGCGG
```

-continued

1751 TCCACATTCA AGCCGGCAGC CTGAATAATC AAAATGGCAA CATCACAACA

1801 CGCCAACAGT TAGAGATTGA AACCGATCAA CTGGATAACG CTCATGGCAA

1851 GTTATTATCA GCAGAAATAG CGGATTTAGC CGTTTCAGGC AGCCTGAACA

1901 ATCAAAATGG CGAAATAGCG ACCAATCAAC AACTGATTAT TCACGATGGT

1951 CAGCAATCTA CCGCTGTCAT TGATAATACG AATGGCACGA TACAATCAGG

2001 CCGTGATGTT GCTATTCAGG CAAAATCGTT ATCCAACAAC GGCACACTTG

2051 CCGCTGATAA TAAACTGGAT ATTGCGTTAC AAGATGATTT TTATGTAGAA

2101 CGCAATATCG TGGCGGGCAA TGAATTGTCG CTCAGTACAC GAGGCAGCCT

2151 GAAAAATTCA CATACTTTGC AAGCAGGAAA ACGCATTCGG ATTAAAGCAA

2201 ATAACCTTGA TAATGCAGCA CAAGGCAACA TTCAATCCGG CGGTACGACA

2251 GACATTGGCA CGCAGCACAA TTTAACCAAT AGAGGCTTGA TTGACGGACA

2301 ACAAACCAAA ATCCAAGCCG GGCAAATGAA TAATATCGGT ACAGGTCGGA

2351 TTTATGGCGA CAATATCGCT ATTGCGGCTA CCCGCTTAGA CAATCAAGAT

2401 GAAAACGGTA CAGGTGCCGC CATTGCGGCA CGTGAAAACC TGAATTTAGG

2451 CATCGGACAA TTAAACAACC GTGAAAACAG TCTGATTTAC AGCGGTAACG

2501 ATATGGCGGT TGGCGGCGCA TTAGATACCA ATGGCCAAGC CACAGGCAAA

2551 GCCCAAAGGA TACACAATGC CGGCGCAACC ATTGAAGCTG CAGGCAAAAT

2601 GCGTTTAGGT GTAGAAAAGC TGCACAATAC CAATGAGCAT TTGAAAACGC

2651 AGTTGGTAGA AACAGGGCGC GAGCATATTG TTGATTACGA AGCATTTGGA

2701 CGACACGAAT TATTGCGAGA AGGCACGCAA CATGAATTAG GCTGGTCTGT

2751 CTATAACGAT GAATCAGACC ACTTACGCAC CCCTGATGGA GCGGCGCATG

2801 AAAATTGGCA TAAATACGAT TATGAAAAAG TCACCCAAAA AACCCAAGTT

2851 ACCCAAACTG CGCCAGCCAA AATCATTTCA GGTAATGATT TAACCATTGA

2901 TGGTAAAGAA GTATTTAATA CCGATAGCCA AATCATTGCT GGTGGCAATC

2951 TCATTGTACA AACAGAAAAA GACGGTTTGC ATAACGAGCA AACCTTTGGC

3001 GAAAAGAAAG TATTCAGTGA AAATGGCAAA TTACACAGCT ATTGGCGTGA

3051 GAAACATAAA GGACGAGACT CAACGGGACA TAGCGAACAA AATTACACTT

3101 TGCCGGAGGA AATCACACGC AACATTTCAC TGGGTTCATT TGCCTATGAA

3151 TCGCATCGCA AAGCATTAAG CCATCATGCG CCCAGCCAAG GCACTGAGTT

3201 GCCGCAAAGC AACGGTATTT CGCTACCCTA TACGTCCAAT TCTTTTACCC

3251 CATTACCCAG CAGCAGCTTA TACATTATCA ATCCTGTCAA TAAAGGCTAT

3301 CTTGTTGAAA CCGATCCACG CTTTGCCAAC TACCGTCAAT GGTTGGGTAG

3351 TGACTATATG CTGGACAGCC TCAAACTAGA CCCAAACAAT TTACATAAAC

3401 GTTTGGGTGA TGGTTATTAC GAGCAACGTT TAATCAATGA ACAAATCGCA

3451 GAGCTGACAG GGCATCGTCG TTTAGACGGT TATCAAAACG ACGAAGAACA

3501 ATTTAAAGCC TTAATGGATA ATGGCGCGAC TGCGGCACGT TCGATGAATC

3551 TCAGCGTTGG CATTGCATTA AGTGCCGAGC AAGTAGCGCA ACTGACCAGC

3601 GATATTGTTT GGTTGGTACA AAAAGAAGTT AAGCTTCCTG ATGGCGGCAC

3651 ACAAACCGTA TTGGTGCCAC AGGTTTATGT ACGCGTTAAA AATGGCGACA

3701 TAGACGGTAA AGGTGCATTG TTGTCAGGCA GCAATACACA AATCAATGTT

-continued

```
3751 TCAGGCAGCC TGAAAAACTC AGGCACGATT GCAGGGCGCA ATGCGCTTAT

3801 TATCAATACC GATACGCTAG ACAATATCGG TGGGCGTATT CATGCGCAAA

3851 AATCAGCGGT TACGGCCACA CAAGACATCA ATAATATTGG CGGCATGCTT

3901 TCTGCCGAAC AGACATTATT GCTCAACGCA GGCAACAACA TCAACAGCCA

3951 AAGCACCACC GCCAGCAGTC AAAATACACA AGGCAGCAGC ACCTACCTAG

4001 ACCGAATGGC AGGTATTTAT ATCACAGGCA AAGAAAAAGG TGTTTTAGCA

4051 GCGCAGGCAG GAAAAGACAT CAACATCATT GCCGGTCAAA TCAGCAATCA

4101 ATCAGAGCAA GGGCAAACCC GGCTGCAAGC AGGGCGCGAC ATTAACCTAG

4151 ATACGGTACA AACCAGCAAA CATCAAGCAA CCCATTTTGA TGCCGATAAC

4201 CATGTTATTC GCGGTTCAAC GAACGAAGTC GGCAGCAGCA TTCAAACAAA

4251 AGGCGATGTT ACCCTATTGT CAGGGAATAA CCTCAATGCC AAAGCTGCCG

4301 AAGTCAGCAG CGCAAACGGT ACACTCGCTG TGTCTGCCAA AAATGACATC

4351 AACATCAGCG CAGGCATCAA CACGACCCAT GTTGATGATG CGTCCAAACA

4401 CACAGGCAGA AGCGGTGGTG GCAATAAATT AGTCATTACC GATAAAGCCC

4451 AAAGTCATCA CGAAACCGCC CAAAGCAGCA CCTTTGAAGG CAAGCAAGTT

4501 GTATTGCAGG CAGGAAACGA TGCCAACATC CTTGGCAGCA ATGTTATTTC

4551 CGATAATGGC ACCCAGATTC AAGCAGGCAA TCATGTTCGC ATTGGTACAA

4601 CCCAAACTCA AAGCCAAAGC GAAACCTATC ATCAAACCCA GAAATCAGGA

4651 TTGATGAGTG CAGGTATCGG CTTCACTATT GGCAGCAAGA CAAACACACA

4701 AGAAAACCAA TCCCAAAGCA ACGAACATAC AGGCAGTACC GTAGGCAGCT

4751 TGAAAGGCGA TACCACCATT GTTGCAGGCA AACACTACGA ACAAATCGGC

4801 AGTACCGTTT CCAGCCCGGA AGGCAACAAT ACCATCTATG CCCAAAGCAT

4851 AGACATTCAA GCGGCACACA ACAAATTAAA CAGTAATACC ACCCAAACCT

4901 ATGAACAAAA AGGCCTAACG GTGGCATTCA GTTCGCCCGT TACCGATTTG

4951 GCACAACAAG CGATTGCCGT AGCACAAAGC AGCAAACAAG TCGGACAAAG

5001 CAAAAACGAC CGCGTTAATG CCATGGCGGC TGCCAATGCA GGCTGGCAAG

5051 CCTATCAAAC AGGTAAGAGT GCACAAAACT TAGCCAATGG TACAACCAAT

5101 GCCAAACAAG TCAGCATCTC CATAACCTAC GGCGAACAGC AAAACCGACA

5151 AACCACCCAA GTTCAAGCCA ATCAAGCCCA AGCGAGTCAA ATTCAAGCAG

5201 GTGGTAAAAC CACATTAATC GCCACAGGCG CAGCAGAACA ATCCAATATC

5251 AACATCGCAG GCTCAGATGT TGCCGGCAAA GCAGGCACAA TCCTGATTGC

5301 CGATAACGAC ATCACACTCC AATCAGCCGA GCAAAGCAAT ACCGAACGCG

5351 GCCAAAACAA ATCGGCAGGC TGGAACGCAG GTGCTGCCGT ATCATTCGGA

5401 CAAGGAGGCT GGTCATTAGG CGTTACCGCA GGCGGCAATG TCGGCAAAGG

5451 CTACGGCAAT GGCGACAGCA TCACCCACCG CCATAGCCAT ATCGGCGACA

5501 AAGGCAGCCA AACCCTTATC CAAAGCGGTG GCGACACTAC CATCAAAGGC

5551 GCGCAAGTAC GCGGCAAAGG CGTACAAGTC AATGCCAAAA ACCTAAGTAT

5601 TCAAAGCGTA CAAGATAGAG AAACCTATCA AAGCAAACAA CAAAACGCCA

5651 GTGCACAAGT TACCGTAGGT TATGGCTTCA GTGCCGGTGG CGATTACAGC

5701 CAAAGCAAAA TCCGAGCCGA CCATGTTTCA GTAACCGAGC AAAGCGGTAT

5751 TTATGCCGGA GAAGACGGCT ATCAAATCAA GGTCGGAAAC CATACAGACC
```

-continued

```
5801  TCAAAGGCGG CATCATCACC AGTACCCAAA GCGCAGAAGA CAAGGGTAAA
5851  AACCGCTTTC AGACGGCCAC CCTCACCCAT AGCGACATCA AAAACCACAG
5901  CCAATACAAA GGCGAAAGTT TTGGATTGGG CGCAAGTGCG TCCATAAGCG
5951  GCAAAACACT GGGACAGGGC GCACAAAATA AACCTCAAAA CAAACACCTG
6001  ACAAGCGTAG CCGATAAAAA CAGCGCAAGT TCATCAGTGG GTTATGGCAG
6051  CGACAGCGAC AGTCAAAGCA GCATCACAAA AAGCGGCATC AACACCCGCA
6101  ACATTCAAAT CACCGACGAA GCCGCACAAA TCCGGCTGAC AGGCAAAACA
6151  GCGGCACAAA CCAAAGCCGA TATTGATACA AACGTAACCA CAGACACCGC
6201  CGAACGACAT TCGGGCAGCT TGAAGAACAC CTTCAACAAA GAAGCGGTGC
6251  AAAGTGAACT GGATTTACAA AGAACCGTCA GCCAAGATTT TAGTAAAAAT
6301  GTTCAACAAG CCAATACCGA GATTAACCAA CATTTAGACA AACTCAAAGC
6351  AGACAAAGAA GCAGCCGAAA CAGCAGCAGC CGAGGCATTA GCCAATGGCG
6401  ATATGGAAAC TGCCAAACGC AAAGCCCATG AAGCTCAAGA TGCGGCAGCA
6451  AAAGCAGATA ATTGGCAACA AGGCAAAGTC ATTCTCAACA TGTTAGCCTC
6501  AGGTTTAGCT GCGCCGACCC AAAGCGGAGC GGGCATCGCT GCGGCTACCG
6551  CATCGCCAGC CGTATCGTAT GCGATTGGAC AGCACTTTAA AGATTTAGCC
6601  GGTCAAAACG CGAATGGTAA ACTAACCGCC AGTCAAGAAA CCGCACACGT
6651  TCTTGCCCAC GCGGTATTAG GAGCAGCGGT TGCCGCAGTA GGAGACAACA
6701  ATGCTCTAGC AGGAGCATTG AGTGCGGGCG GGTCGGAAGC GGCTGCGCCT
6751  TACATCAGCA AATGGTTATA CGGCAAAGAA AAAGGAAGCG ACTTAACGGC
6801  GGAAGAGAAA GAGACTGTAA CAGCGATTAC AAATGTATTG GGTACGGCTA
6851  CGGGTGCGGC AGTCGGCAAC AGCGCAACAG ATGCAGCGCA AGGCAGCCTG
6901  AATGCGCAAA GTGCGGTGGA GAATAATGAT ACTGTAGAGC AAGTGAAATT
6951  TGCTCTTAGG CACCCTAGAA TTGCTATTGC AATTGGATCT GTACATAAAG
7001  ATCCTGGCTC TACATTAGAG CCTAATATTT CAACAATTGC TTCAACTTTT
7051  CAATTAAATT TATTTCCTAA TAGTGAATTT GGTGGTGAAG GTGGAGTTGG
7101  CAATGCATTC AGGCACGTTT TATGGCAAGC AACCATCACA CGAGAATTTG
7151  GCAAAGATAT TGCTGTTAAA GTAGGAAATA GTCATGAAAG TGGGGAAAAA
7201  ATTAATTATT CTATAAGACG TAATCTTTCA TTAGATAAAG CAGATGAAAT
7251  GATTGATCAA CTAAATAACG AAATAGGAAG AGAAATAGCA TTAAATACCA
7301  ATAGGTTAAA CACAAAAGAG TTAGTTGGAT TAATTCTGGA AACTTATAAA
7351  AATAATGGTT TTTATCAAGC AGAAAGAAAC AGTAATGGAA ATTATGATGT
7401  TGTAAGAAAA AGATTATCTG AAAAAGATTA CCAGAATACA AGCAATATAT
7451  TGATTCACTT AGATAATACT GGTGCCGGAT TTAAAATTCA GCAGAGGAGA
7501  AAACAAATCA GAGCACAAAT TTCAGCCAGA CAATGGAGAA GATAA
```

Thic corresponds to the amino acid sequence <SEQ ID 1668; ORF 561>:

```
m563.pep..
   1  MNKTLYRVIF NRKRGAVVAV AETTKREGKS CADSDSGSAH VKSVPFGTTH

  51  APVCRSNIFS FSLLGFSLCL AVGTANIAFA DGIIADKAAP KTQQATILQT
```

-continued

101 GNGIPQVNIQ TPTSAGVSVN QYAQFDVGNR GAILNNSRSN TQTQLGGWIQ

151 GNPWLARGEA RVVVNQINSS HSSQMNGYIE VGGRRAEVVI ANPAGIAVNG

201 GGFINASRAT LTTGQPQYQA GDLSGFKIRQ GNVVIAGHGL DARDTDFTRI

251 LSYHSKIDAP VWGQDVRVVA GQNDVVATGN AHSPILNNAA ANTSNNTANN

301 GTHIPLFAID TGKLGGMYAN KITLISTAEQ AGIRNQGQLF ASSGNVAIDA

351 NGRLVNSGTM AAANAKDTDN TAEHKVNIRS QGVENSGTAV SQQGTQIHSQ

401 SIQNTGTLLS SGEILIHNSG SLKNETSGTI EAARLAIDTD TLNNQGKLSQ

451 TGSQKLHIDA QGKMDNRGRM GLQDTAPTAS NGSSNQTGNS YNASFHSSTT

501 TPTTATGTGT ATVSISNITA PTFADGTIRT HGALDNSGSI IANGQTDVSA

551 QQGLNNAGQI DIHQLNAKGS AFDNHNGTII SDAVHIQAGS LNNQNGNITT

601 RQQLEIETDQ LDNAHGKLLS AEIADLAVSG SLNNQNGEIA TNQQLIIHDG

651 QQSTAVIDNT NGTIQSGRDV AIQAKSLSNN GTLAADNKLD IALQDDFYVE

701 RNIVAGNELS LSTRGSLKNS HTLQAGKRIR IKANNLDNAA QGNIQSGGTT

751 DIGTQHNLTN RGLIDGQQTK IQAGQMNNIG TGRIYGDNIA IAATRLDNQD

801 ENGTGAAIAA RENLNLGIGQ LNNRENSLIY SGNDMAVGGA LDTNGQATGK

851 AQRIHNAGAT IEAAGKMRLG VEKLHNTNEH LKTQLVETGR EHIVDYEAFG

901 RHELLREGTQ HELGWSVYND ESDHLRTPDG AAHENWHKYD YEKVTQKTQV

951 TQTAPAKIIS GNDLTIDGKE VFNTDSQIIA GGNLIVQTEK DGLHNEQTFG

1001 EKKVFSENGK LHSYWREKHK GRDSTGHSEQ NYTLPEEITR NISLGSFAYE

1051 SHRKALSHHA PSQGTELPQS NGISLPYTSN SFTPLPSSSL YIINPVNKGY

1101 LVETDPRFAN YRQWLGSDYM LDSLKLDPNN LHKRLGDGYY EQRLINEQIA

1151 ELTGHRRLDG YQNDEEQFKA LMDNGATAAR SMNLSVGIAL SAEQVAQLTS

1201 DIVWLVQKEV KLPDGGTQTV LVPQVYVRVK NGDIDGKGAL LSGSNTQINV

1251 SGSLKNSGTI AGRNALIINT DTLDNIGGRI HAQKSAVTAT QDINNIGGML

1301 SAEQTLLLNA GNNINSQSTT ASSQNTQGSS TYLDRMAGIY ITGKEKGVLA

1351 AQAGKDINII AGQISNQSEQ GQTRLQAGRD INLDTVQTSK HQATHFDADN

1401 HVIRGSTNEV GSSIQTKGDV TLLSGNNLNA KAAEVSSANG TLAVSAKNDI

1451 NISAGINTTH VDDASKHTGR SGGGNKLVIT DKAQSHHETA QSSTFEGKQV

1501 VLQAGNDANI LGSNVISDNG TQIQAGNHVR IGTTQTQSQS ETYHQTQKSG

1551 LMSAGIGFTI GSKTNTQENQ SQSNEHTGST VGSLKGDTTI VAGKHYEQIG

1601 STVSSPEGNN TIYAQSIDIQ AAHNKLNSNT TQTYEQKGLT VAFSSPVTDL

1651 AQQAIAVAQS SKQVGQSKND RVNAMAAANA GWQAYQTGKS AQNLANGTTN

1701 AKQVSISITY GEQQNRQTTQ VQANQAQASQ IQAGGKTTLI ATGAAEQSNI

1751 NIAGSDVAGK AGTILIADND ITLQSAEQSN TERGQNKSAG WNAGAAVSFG

1801 QGGWSLGVTA GGNVGKGYGN GDSITHRHSH IGDKGSQTLI QSGGDTTIKG

1851 AQVRGKGVQV NAKNLSIQSV QDRETYQSKQ QNASAQVTVG YGFSAGGDYS

1901 QSKIRADHVS VTEQSGIYAG EDGYQIKVGN HTDLKGGIIT STQSAEDKGK

1951 NRFQTATLTH SDIKNHSQYK GESFGLGASA SISGKTLGQG AQNKPQNKHL

2001 TSVADKNSAS SSVGYGSDSD SQSSITKSGI NTRNIQITDE AAQIRLTGKT

2051 AAQTKADIDT NVTTDTAERH SGSLKNTFNK EAVQSELDLQ RTVSQDFSKN

-continued

```
2101 VQQANTEINQ HLDKLKADKE AAETAAAEAL ANGDMETAKR KAHEAQDAAA

2151 KADNWQQGKV ILNMLASGLA APTQSGAGIA AATASPAVSY AIGQHFKDLA

2201 GQNANGKLTA SQETAHVLAH AVLGAAVAAV GDNNALAGAL SAGGSEAAAP

2251 YISKWLYGKE KGSDLTAEEK ETVTAITNVL GTATGAAVGN SATDAAQGSL

2301 NAQSAVENND TVEQVKFALR HPRIAIAIGS VHKDPGSTLE PNISTIASTF

2351 QLNLFPNSEF GGEGGVGNAF RHVLWQATIT REFGKDIAVK VGNSHESGEK

2401 INYSIRRNLS LDKADEMIDQ LNNEIGREIA LNTNRLNTKE LVGLILETYK

2451 NNGFYQAERN SNGNYDVVRK RLSEKDYQNT SNILIHLDNT GAGFKIQQRR

2501 KQIRAQISAR QWRR*
```

Computer analysis of this amino acid sequence gave the following results:

Homology with a Predicted ORF from *N. gonorrhoeae*

ORF 563 shows 79.1% identity over a 2316 aa overlap with a predicted ORF (ORF 563.ng) from *N. gonorrhoeae*:

```
m563/g563

    -
                    10        20        30        40        50
g563.pep   MNKTLYRVIFNRKRGAVVAVAETTKREGKSCADSGSGSVYVKSVSFIPTH-----SKAFC
           |||||||||||||||||||||||||||||||||| |||::|||| | ||     |: |
m563.pep   MNKTLYRVIFNRKRGAVVAVAETTKREGKSCADSDSGSAHVKSVPFGTTHAPVCRSNIFS
                    10        20        30        40        50        60

              60        70        80        90       100       110
g563.pep   FSALGFSLCLALGTVNIAFADGIITDKAAPKTQQATILQTGNGIPQVNIQTPTSAGVSVN
           || ||||||||:||:|||||||||:|||||||||||||||||||||||||||||||||||
m563.pep   FSLLGFSLCLAVGTANIAFADGIIADKAAPKTQQATILQTGNGIPQVNIQTPTSAGVSVN
                    70        80        90       100       110       120

             120       130       140       150       160       170
g563.pep   QYAQFDVGNRGAILNNSRSNTQTQLGGWIQGNPWLTRGEARVVVNQINSSHPSQLNGYIE
           |||||||||||||||||||||||||||||||||||:||||||||||||||| ||:|||||
m563.pep   QYAQFDVGNRGAILNNSRSNTQTQLGGWIQGNPWLARGEARVVVNQINSSHSSQMNGYIE
                   130       140       150       160       170       180

             180       190       200       210       220       230
g563.pep   VGGRRAEVVIANPAGIAVNGGGFINASRATLTTGQPQYQAGDFSGFKIRQGNAVIAGHGL
           ||||||||||||||||||||||||||||||||||||||||||:|||||||||:|||||||
m563.pep   VGGRRAEVVIANPAGIAVNGGGFINASRATLTTGQPQYQAGDLSGFKIRQGNVVIAGHGL
                   190       200       210       220       230       240

             240
g563.pep   DARDTDFTRIL-------------------------------------------------
           |||||||||||
m563.pep   DARDTDFTRILSYHSKIDAPVWGQDVRVVAGQNDVVATGNAHSPILNNAAANTSNNTANN
                   250       260       270       280       290       300

                             250       260       270       280       290
g563.pep   ----------------LYANKITLISTAEQAGIRNQGQLFASSGNVAIDANGRLVNSGTM
                           :|||||||||||||||||||||||||||||||||||||||||||
m563.pep   GTHIPLFAIDTGKLGGMYANKITLISTAEQAGIRNQGQLFASSGNVAIDANGRLVNSGTM
                   310       320       330       340       350       360

                   300       310       320       330       340
g563.pep   AAANVQDMNNTAEHKVNIRSQAFENSGTAVSQQGTQIHSQSIQNTGKLLSAGT-------
           ||||::| :||||||||||||: ||||||||||||||||||||||| |||:||
m563.pep   AAANAKDTDNTAEHKVNIRSQGVENSGTAVSQQGTQIHSQSIQNTGTLLSSGEILIHNSG
                   370       380       390       400       410       420

g563.pep   ------------------------------------------------------------
m563.pep   SLKNETSGTIEAARLAIDTDTLNNQGKLSQTGSQKLHIDAQGKMDNRGRMGLQDTAPTAS
                  430       440       450       460       470       480

g563.pep   ------------------------------------------------------------
m563.pep   NGSSNQTGNSYNASFHSSTTTPTTATGTGTATVSISNITAPTFADGTIRTHGALDNSGSI
                  490       500       510       520       530       540
```

-continued

```
g563.pep   ------------------------------------------------------------
m563.pep   IANGQTDVSAQQGLNNAGQIDIHQLNAKGSAFDNHNGTIISDAVHIQAGSLNNQNGNITT
                   550       560       570       580       590       600

                                     350       360       370       380
g563.pep   -----------------------EDLAVSGSLNNQNGEIATNQQLIIHDGQQSTVVIDNT
                                   ||||||||||||||||||||||||||||||:|||||
m563.pep   RQQLEIETDQLDNAHGKLLSAEIADLAVSGSLNNQNGEIATNQQLIIHDGQQSTAVIDNT
                   610       620       630       640       650       660

                   390       400       410       420       430       440
g563.pep   NGTIQSGRDVAIQAKSLSNNGTLAADNKLDIALQDDFYVERKIVAGNELSLSTRGSLKNS
           |||||||||||||||||||||||||||||||||||||||||:||||||||||||||||||
m563.pep   NGTIQSGRDVAIQAKSLSNNGTLAADNKLDIALQDDFYVERNIVAGNELSLSTRGSLKNS
                   670       680       690       700       710       720

                   450       460       470       480       490       500
g563.pep   HTLQAGKRIRIKANNLDNAVQGNIQSGGTTDIGTQHNLTNRGLIDGQQTKIQAGQMNNIG
           |||||||||||||||||||:||||||||||||||||||||||||||||||||||||||||
m563.pep   HTLQAGKRIRIKANNLDNAAQGNIQSGGTTDIGTQHNLTNRGLIDGQQTKIQAGQMNNIG
                   730       740       750       760       770       780

                   510       520       530       540       550       560
g563.pep   TGRIYGDNIAIAATRLDNQDENGTGAAIAARENLNLGIEQLNNRENSLIYSGNDMAVGGA
           |||||||||||||||||||||||||||||||||||||| |||||||||||||||||||||
m563.pep    TGRIYGDNIAIAATRLDNQDENGTGAAIAARENLNLGIGQLNNRENSLIYSGNDMAVGGA
                   790       800       810       820       830       840

                   570       580       590       600       610       620
g563.pep   LDTNDQATGKAQRIHNAGAIIEAAGKMRLGVEKLHNTNEHLKTQLVETGRERIVDYEAFG
           |||| ||||||||||||||| ||||||||||||||||||||||||||||||:||||||||
m563.pep    LDTNGQATGKAQRIHNAGATIEAAGKMRLGVEKLHNTNEHLKTQLVETGREHIVDYEAFG
                   850       860       870       880       890       900

                   630       640       650       660       670       680
g563.pep   RHELLREGTQHELGWFVYNNESDHLRTPDGVAHENWHKYDYEKVTQETQVTGTAPAKIIA
           ||||||||||||||| |||:||||||||||:|||||||||||||||:|||| |||||||:
m563.pep   RHELLREGTQHELGWSVYNDESDHLRTPDGAAHENWHKYDYEKVTQKTQVTQTAPAKIIS
                   910       920       930       940       950       960

                      690       700       710       720       730       740
g563.pep      GSDLIIDSKAVFNSDSRIIAGGQLLVQTEKDGLHNEQTFGEKKVFSENGKLHNYWRARRK
              |:|| ||:| |||:||:|||||:|:|||||||||||||||||||||||||||:||| ::|
m563.pep      GNDLTIDGKEVFNTDSQIIAGGNLIVQTEKDGLHNEQTFGEKKVFSENGKLHSYWREKHK
                      970       980       990      1000      1010      1020

                      750       760       770       780       790       800
g563.pep      GHDETGHREQNYTLPEEITRDISLGSFAYESHSKALSRHAPSQGTELPQSNRDNIRTAKS
              |:| ||| ||||||||||||:||||||||||| ||||:|||||||||||||
m563.pep      GRDSTGHSEQNYTLPEEITRNISLGSFAYESHRKALSHHAPSQGTELPQSN---------
                     1030      1040      1050      1060      1070

                      810       820       830       840       850       860
g563.pep      NGISLPYTPNSFTPLPGSSLYIINPANKGYLVETDPRFANYRQWLGSDYMLGSLKLDPNN
               ||||||| |||||||:||||||||:||||||||||||||||||||||||| ||||||||
m563.pep      -GISLPYTSNSFTPLPSSSLYIINPVNKGYLVETDPRFANYRQWLGSDYMLDSLKLDPNN
                     1080      1090      1100      1110      1120      1130

                      870       880       890       900       910       920
g563.pep      LHKRLGDGYYEQRLINEQIAELTGHRRLDGYQNDEEQFKALMDNGATAARSMNLSVGIAL
              ||||||||||||||||||||||||||||||||||||||||||||||||||||||||||||
m563.pep      LHKRLGDGYYEQRLINEQIAELTGHRRLDGYQNDEEQFKALMDNGATAARSMNLSVGIAL
                     1140      1150      1160      1170      1180      1190

                      930       940       950       960       970       980
g563.pep      SAEQAAQLTSDIVWLVQKEVKLPDGGTQTVLMPQVYVRVKNGGIDGKGALLSGSNTQINV
              ||||:||||||||||||||||||||||||||:|||||||||| |||||||||||||||||
m563.pep      SAEQVAQLTSDIVWLVQKEVKLPDGGTQTVLVPQVYVRVKNGDIDGKGALLSGSNTQINV
                     1200      1210      1220      1230      1240      1250

                      990      1000      1010      1020      1030      1040
g563.pep      SGSLKNSGTIAGRNALIINTDTLDNIGGRIHAQKSAVTATQDINNIGGILSAEQTLLLNA
              ||||||||||||||||||||||||||||||||||||||||||||||||:|||||||||||
m563.pep      SGSLKNSGTIAGRNALIINTDTLDNIGGRIHAQKSAVTATQDINNIGGMLSAEQTLLLNA
                     1260      1270      1280      1290      1300      1310
```

-continued

```
                  1050      1060      1070      1080      1090      1100
g563.pep   GNNINNQSTAKSSQNAQGSSTYLDRMAGIYITGKEKGVLAAQAGKDINIIAGQISNQSDQ
           |||||:|||: ||||:||||||||||||||||||||||||||||||||||||||||||:|
m563.pep   GNNINSQSTTASSQNTQGSSTYLDRMAGIYITGKEKGVLAAQAGKDINIIAGQISNQSEQ
                  1320      1330      1340      1350      1360      1370

                  1110      1120      1130      1140      1150      1160
g563.pep   GQTRLQAGRDINLDTVQTGKYQEIHFDADNHTIRGSTNEVGSSIQTKGDVTLLSGNNLNA
           ||||||||||||||||||:|:|  |||||||:||||||||||||||||||||||||||||
m563.pep   GQTRLQAGRDINLDTVQTSKHQATHFDADNHVIRGSTNEVGSSIQTKGDVTLLSGNNLNA
                  1380      1390      1400      1410      1420      1430

                  1170      1180      1190      1200      1210      1220
g563.pep   KAAEVGSAKGTLAVYAKNDITISSGIHAGQVDDASKHTGRSGGGNKLVITDKAQSHHETA
           |||||:||:||||| |||||:||:||:: :||||||||||||||||||||||||||||||
m563.pep   KAAEVSSANGTLAVSAKNDINISAGINTTHVDDASKHTGRSGGGNKLVITDKAQSHHETA
                  1440      1450      1460      1470      1480      1490

                  1230      1240      1250      1260      1270      1280
g563.pep   QSSTFEGKQVVLQAGNDANILGSNVISDNGTRIQAGNHVRIGTTQTQSQSETYHQTQKSG
           |||||||||||||||||||||||||||||||:||||||||||||||||||||||||||||
m563.pep   QSSTFEGKQVVLQAGNDANILGSNVISDNGTQIQAGNHVRIGTTQTQSQSETYHQTQKSG
                  1500      1510      1520      1530      1540      1550

                  1290      1300      1310      1320      1330      1340
g563.pep   LMSAGIGFTIGSKTNTQENQSQSNEHTGSTVGSLKGDTTIVASKHYEQTGSNVSSPEGNN
           ||||||||||||||||||||||||||||||||||||||||||:||||| ||:||||||||
m563.pep   LMSAGIGFTIGSKTNTQENQSQSNEHTGSTVGSLKGDTTIVAGKHYEQIGSTVSSPEGNN
                  1560      1570      1580      1590      1600      1610

                  1350      1360      1370      1380      1390      1400
g563.pep   LISTQSMDIGAAQNQLNSKTTQTYEQKGLTVGIQFARYRFGTTSDCRSTQSSKQVGQSKN
            | :||:|| ||:|:|||:||||||||||||:::      ::  :     :|||||||||||
m563.pep   TIYAQSIDIQAAHNKLNSNTTQTYEQKGLTVAFSSPVTDLAQQA-IAVAQSSKQVGQSKN
                  1620      1630      1640      1650      1660

                  1410      1420      1430      1440      1450      1460
g563.pep   DRVNAMAAANAGWQAYQTGKGAQNLANGTTNAKQVSISITYGEQQNRQTTQVQANQAQAS
           ||||||||||||||||||||:|||||||||||||||||||||||||||||||||||||||
m563.pep   DRVNAMAAANAGWQAYQTGKSAQNLANGTTNAKQVSISITYGEQQNRQTTQVQANQAQAS
       1670      1680      1690      1700      1710      1720

                  1470      1480      1490      1500      1510      1520
g563.pep   QIQAGGKTTLYCRRCGEQSNINITGSGVSGRAGTGLIADKQIHLQSAEQSNTERSQNKSA
           ||||||||||      :||||||:|| |:|:||| ||||::| |||||||||||:|||||
m563.pep    QIQAGGKTTLIATGAAEQSNINIAGSDVAGKAGTILIADNDITLQSAEQSNTERGQNKSA
       1730      1740      1750      1760      1770      1780

                  1530      1540      1550      1560      1570      1580
g563.pep   GWNAGAAVSFGQGGWSLGVAAGGNVGKGYGYGDSVTHRHSHIGDKGSQTLIQSGGDTIIK
           |||||||||||||||||||:|||||||||| |||:|||||||||||||||||||||| ||
m563.pep   GWNAGAAVSFGQGGWSLGVTAGGNVGKGYGNGDSITHRHSHIGDKGSQTLIQSGGDTTIK
       1790      1800      1810      1820      1830      1840

                  1590      1600      1610      1620      1630      1640
g563.pep   GAQVRGKGVQVNAKNLSIQSVQDRETYQSKQQNAGAQVTVGYGFSASGDYSQSKIRADHA
           ||||||||||||||||||||||||||||||||||:|||||||||||:||||||||||||:
m563.pep   GAQVRGKGVQVNAKNLSIQSVQDRETYQSKQQNASAQVTVGYGFSAGGDYSQSKIRADHV
       1850      1860      1870      1880      1890      1900

                 1650      1660      1670      1680      1690      1700
g563.pep  SVTEQSGIYAGEDGYQIKVGNHTGLKGGIITSSQSAKDKGKNRFSTGTLAGSDIQNYSQY
          ||||||||||||||||||||||| ||||||||:|||:|||||||:|:||: |||:|:|||
m563.pep  SVTEQSGIYAGEDGYQIKVGNHTDLKGGIITSTQSAEDKGKNRFQTATLTHSDIKNHSQY
      1910      1920      1930      1940      1950      1960

                 1710      1720      1730      1740      1750      1760
g563.pep  EGKSFGLGASVAVSGKTLGQGAKNKPQDKHLTSIADKNGASSSVGYGSDSDSQSSITKSG
          :|:|||||||:::|||||||||:||||:|||||:||||:|||||||||||||||||||||
m563.pep   KGESFGLGASASISGKTLGQGAQNKPQNKHLTSVADKNSASSSVGYGSDSDSQSSITKSG
      1970      1980      1990      2000      2010      2020

                 1770      1780      1790      1800      1810      1820
g563.pep  INTPKNIQITDEAAQIRLTGKIAAQTKADIDTNVTTDTAERHSGSLKNIFDKDRVQSELD
          ||| :|||||||||||||||| |||||||||||||||||||||||||| |:|: ||||||
m563.pep  INT-RNIQITDEAAQIRLTGKTAAQTKADIDTNVTTDTAERHSGSLKNTFNKEAVQSELD
      2030      2040      2050      2060      2070      2080
```

-continued

```
                   1830      1840      1850      1860      1870      1880
g563.pep    LQRTVSQDFSKNVQQTNTEINQHLDKLKADKEAAETAAAEALANGDMETAKRKAHEAQDA
            ||||||||||||||:|||||||||||||||||||||||||||||||||||||||||||||
m563.pep    LQRTVSQDFSKNVQQANTEINQHLDKLKADKEAAETAAAEALANGDMETAKRKAHEAQDA
           2090      2100      2110      2120      2130      2140

                   1890      1900      1910      1920      1930      1940
g563.pep    AAKADNWQQGKVILNMLASGLAEPTQSGAGIAAATASPDVSYAIGQHFKDLAGQNANGKL
            |||||||||||||||||||||| ||||||||||||||| |||||||||||||||||||||
m563.pep    AAKADNWQQGKVILNMLASGLAAPTQSGAGIAAATASPAVSYAIGQHFKDLAGQNANGKL
           2150      2160      2170      2180      2190      2200

                   1950      1960      1970      1980      1990      2000
g563.pep    TASQETAHVLAHAVLGAAVAAAXGNNAPAGALGAGGSEAAAPIIGKWLYGKGDGGSLNAE
            |||||||||||||||||||||:  ||| ||||:||||||||| |:||||||  |::|:||
m563.pep    TASQETAHVLAHAVLGAAVAAVGDNNALAGALSAGGSEAAAPYISKWLYGKEKGSDLTAE
           2210      2220      2230      2240      2250      2260

                   2010      2020      2030      2040     2049
g563.pep    EKETVSAITRMLGTAAGAAEGNSSADAVWGCFQTASDFASSFSYPINMX
            |||||:||| :||||:||| |||::||: | ::: |
m563.pep    EKETVTAITNVLGTATGAAVGNSATDAAQGSLNAQSAVENNDTVEQVKFALRHPRIAIAI
           2270      2280      2290      2300      2310      2320

m563.pep    GSVHKDPGSTLEPNISTIASTFQLNLFPNSEFGGEGGVGNAFRHVLWQATITREFGKDIA
                   2330      2340      2350      2360      2370      2380
```

The following partial DNA sequence was identified in *N. meningitidis* <SEQ ID 1669>:

```
m564.seq
     1  ATGAACCGCA CCCTGTACAA AGTTGTATTT AACAAACATC GAAACTGCAT

    51  GATAGCCGTT GCTGAAAATG CCAAACGCGA GGGCAAAAAC ACAGCCGACA

   101  CCCAAGCTGT AGGTATTTTG CCAAATGATA TTGCGGGCTT TGCGGGTTTT

   151  ATCCATTCTA TCTCTGTTAT CTCATTCTCC CTTTCATTAC TGCTCGGTTC

   201  TGCCCTTATC CTGACTTCTT CTTCTGCTAC TGCCCAAGGT ATCGTTGCCG

   251  ACAAATCCGC ACCTGCACAG CAACAGCCTA CCATCCTGCA AACAGGTAAC

   301  GGCATACCGC AAGTCAATAT TCAAACCCCT ACTTCGGCAG GGGTTTCTGT

   351  TAATCAATAC GCCCAGTTTG ATGTGGGTAA TCGCGGGGCG ATTTTAAACA

   401  ACAGTCGCAG CAACACCCAA ACACAGCTAG GCGGTTGGAT TCAAGGCAAT

   451  CCTTGGTTGG CAAGGGGCGA AGCACGTGTG GTTGTAAACC AAATCAACAG

   501  CAGCCATTCT TCACAACTGA ATGGCTATAT TGAAGTGGGC GGACGACGTG

   551  CAGAAGTCGT TATTGCCAAT CCGGCAGGGA TTGCAGTCAA TGGTGGTGGT

   601  TTTATCAATG CTTCCCGTGC CACTTTGACG ACAGCCCAAC CGCAATATCA

   651  AGCAGGAGAC CTTAGCGGCT TTAAGATAAG GCAAGGCAAT GTTGTAATCG

   701  CCGGACACGG TTTGGATGCA CGTGATACCG ATTACACACG TATTCTCAGT

   751  TATCATTCCA AAATTGATGC ACCCGTATGG GGACAAGATG TTCGTGTCGT

   801  CGCGGGACAA AACGATGTGG CCGCAACAGG TGATGCACAT TCGCCTATTC

   851  TCAATAATGC TGCTGCCAAT ACGTCAAACA ATACAGCCAA CAACGGCACA

   901  CATATCCCTT TATTTGCGAT TGATACAGGC AAATTAGGAG GTATGTATGC

   951  CAACAAAATC ACCTTGATCA GTACGGTCGA GCAAGCAGGC ATTCGTAATC

  1001  AAGGGCAATG GTTTGCCTCA GCCGGCAATG TGGCAGTGAA TGCTGAGGGT

  1051  AAACTGGTCA ACACGGGCAT GATTGCAGCG ACGGGAGAAA ATCATGCGGT

  1101  TTCACTTCAT GCCGGCAATG TTCATAATAG CGGTACGGTT GCCTCACAGG
```

-continued

1151 ATGATGCCAA TATTCACAGC CAGACGCTGG ACAATTCAGG TACGGTCTTA

1201 TCCTCAGGTC GATTGACTGT TCGTAATTTA GGCCGTCTGA AAAACCAAAA

1251 CAACGGTACG ATCCAGGCTG CCCGCTTAGA TATGTCAACA GGTGGTTTGG

1301 ATAACACAGG TAATATTACT CAAACAGGTT CACAAGCATT GGATTTGGTA

1351 TCTGCCGGCA AATTCGATAA CAGTGGCAAG ATTGGTGTAA GTGACGTTCC

1401 ACAGACCGGT TTGAATCCCA ATCCATCAGT CATACCACAG ATTCCGAGTA

1451 CTGCAACAGG TTCAGGCAGC AGCACTGTCT CGGTATCTAA GCCTGGTTCA

1501 AACAATCCCG TTTCACCTAC AGCACCTGCA AAAAACTACG CCGTAGGACG

1551 CATTCAAACA ACAGGAGCAT TTGACAATGC AGGATCAATT AATGCGGGTG

1601 GGCAAATTGA CATTGCCGCC CAAAACGGTT TGGGAAATTC GGGTAGTCTG

1651 AATGCGGCTA AACTACGAGT ATCAGGCGAT TCATTTAACA ATACGGTAAA

1701 AGGCAAACTC CAGGCACACG ATCTGGCTGT TAACACTCAA ACTGCTAAAA

1751 ACAGCGGTCA CTTATTAACT CAAACCGGCA AGATTGATAA CCGTGAACTG

1801 CATAATGCCG GAGAAATTGC CGCCAACAAT CTGACACTCA TTCATTCGGG

1851 CCGCTTGAGC AATGATAAAA AAGGCAATAT TCGAGCTGCA CATTTACAGC

1901 TTGATACCGC CGGTTTACAT AATGCAGGTA ACATTCTTGC CGATAGTGGA

1951 ACCGTTACCA CCAAGAATAA TCTTCGCAAT ACAGGAAAAG TTTCTGTTGC

2001 ACGACTGAAT ACCGAAGGTC AGACTCTAGA TAATACGCGC GGACGTATAG

2051 AGGCTGAAAC GGTTAACATC CAAAGTCAGC AACTGACTAA CCAAAGCGGC

2101 CATATTACTG CTACCGAACA ACTGACTATC AATAGTCGAA ATGTAGACAA

2151 CCAAAACGGC AAACTCCTAT CTGCAAACCA AGCACAATTA GCTGTTTCAG

2201 ACGGCCTATA CAACCAACAT GGTGAAATTG CCACCAACCG GCAGTTGTCT

2251 ATTCACGATA AAAATCAAAA CACTTTGGCG TTAAACAATG CGGATGGCAC

2301 GATTCAATCT GCCGGTAATG TATCGCTACA AGCCAAATCA CTCGCCAACA

2351 ATGGCACATT AACAGCCGGT AACAAACTGG ATATTGCTTT GACGGACGAT

2401 TTCGTCGTAG AGCGCGACCT CACTGCAGGC AAACAATTAA ATCTAAGCAT

2451 AAAAGGCCGT CTGAAAAATA CCCATACCCT ACAAGCAGGC CATACGCTCA

2501 AACTCAATGC CGGCAATATA GATAACCAAG TTACAGGCAA AATTATTGGT

2551 GGAGAACAAA CGGACATCAC ATCCGAACAG CATGTTGACA ACAGGGGCTT

2601 GATCAACAGC GACGGTTTGA CCCACATCGG TGCAGGTCAA ACCCTGACCA

2651 ACACCGGGAC AGGCAAAATC TATGGCAACC ATATTGCCCT GGACGCGCAA

2701 ATACTGCTTA ACCGGGAAGA AACGACGGAA GGCAGTACCA AAGCGGGGGC

2751 AATAGCTGCA AGGAAACGTT TGGATATTGG AGCGAAAGAG ATTCATAACC

2801 AAGAAGGTGC CCTACTATCC AGCGAAGGTA TTTTTGCCGT AgGTAATCGA

2851 CTGGATGAAC AACATCATGC GGCAGGCATG GCCGATACCT TTGTTAATGG

2901 CAGTGCCGGT TTGGAAGTAC AAGGTGATGC ATTGATGTCC GTTCGGAATA

2951 TGCAGAATAT CAATAATCAC TTTAAAACAG AGACATACTT AGCCAAAGCG

3001 GAAAAGCAAG TCCGCGACTA CACCGTACTG GGGCAAAATA CCTACTATCA

3051 GGCGGGAAAA GACGGTTTAT TCGACAACTC GCAAGGACAA AAAGACCAAA

3101 CTACTGCTAC GTTCCATTTA AAAAATGGTT CTCGTATTGA GGCCAACCAA

3151 TGGCATGTCC GAGACTACCA CATCGAGACT TATAAAGAAC GCATCATCGA

-continued

3201 AAACCGGCCG GCACACATTA CTGTGGGCGG TGATTTGACT GCCTCAGGTC

3251 AAAATTGGCT GAACAAAGAC AGCCGGATTG TAGTAGGCGG GCGTATTATC

3301 ACTGATGATT TAAACCAGAA AGAAATTACC AATCAAAGTA CAACAGGCAA

3351 AGGTCGCACA GATGCTGTCG GCACACAGTG GGATTCAGTT ACAAAAAAAG

3401 GATGGTACAG CGGTAGAAAA AGACAACGCC GTACTGAAAG AAACCATACT

3451 CCTTACCATG ATACCCAACT ATTTACCCAC GACTTCGACA CGCCTGTATC

3501 CGTCATCCAA CAGAATGCCG CCTCCCCTTC CTTTCAACCC GCCGCATCTG

3551 CAATCAAACT GATTGACGGA GTATCCACGG CAGCCGTCAA TGGTCAGCGC

3601 ATCCATACCG GTAATGTGGT CTCGTTAAAT AACGCTACTG TTACTCTGCC

3651 TAACAGCAGC CTCTATACCA CCCATCCTGA CAATAAAGGC TGGTTGGTTG

3701 AAACCGATCC TCAATTTGCA GACTACCGCC GCTGGTTGGG CAGCGACTAC

3751 ATGTTGCAAC AACTGCAATT GGACACCAAT CATCTACACA AACGGCTTGG

3801 CGACGGCTAC TACGAACAAA AACTTGTTAA TGAACAAATC CATCAGTTAA

3851 CAGGCTACCG CCGACTCGAC GGCTACAGGA GTGATGAAGA ACAATTCAAA

3901 GCTCTGATGG ACAACGGCCT TACTGCTGCC AAAACATTCG GTCTCACCCC

3951 AGGTATCGCC TTGAGTGCAG AGCAAGTTGC CCGCTTAACT TCAGATATCG

4001 TTTGGATGGA AAATCAAACC GTCACCCTGT CTGACGGTTC GACTCAAACC

4051 GTACTGGTTC CTAAAGTCTA TGCCCTGGCG CGCAAAGGTG ATCTCAATAC

4101 CTCCGGTGGC CTGATTAGTG CCGAACAAGT CTTACTTAAA CTGCAAAACG

4151 GCAACCTGAC TAACAGCGGT ACCATTGCGG GGCGACAGGC CGTACTCATC

4201 CAGGCACGGA ATATTAACAG CAACGGTAAC ATTCAAGCCG ACCAAATCGG

4251 CTTAAAAGCT GAAAAAAGTA TCAATATCGA CGGCGGGCAG GTACAAGCAG

4301 GCAGACTGCT GACTGCCCAA GCGCAAAATA TCAACCTTAA CGGTACAACC

4351 CAAACTTCCG GTAATGAACG TAACGGCAAT ACCGCCATCG ATCGTATGGC

4401 CGGCATTAAC GTGGTCGGAA GCCATACTGA ACAAGTAGAT AACAGAACTT

4451 CAGACGGCAT CCTATCCCTG CATGCCAGCA ACGATATCAA CCTCAATGCG

4501 GCCACCGTCT CTAACCAAGT TAAAGACGGC ACTACCCAAA TTACCGCCGG

4551 CAATAATCTC AACCTCGGCA CCATCCGTAC CGAACATCGC GAAGCCTATG

4601 GTACATTAGA TGACGAGAAC CATCGCCATG TCCGCCAAAG TACCGAAGTC

4651 GGCAGCAGTA TCCGCACGCA AAACGGCGCA CTGCTTAGAG CCGGTAACGA

4701 CTTAAAAATC CGCCAAGGCG AACTGGAGGC CGAAGAAGGC AAAACCGTCC

4751 TTGCCGCAGG ACGTGATGTC ACTATCAGCG AAGGACGCCA AATAACCGAA

4801 CTGGATACCT CGGTAAGCGG AAAAAGCAAA GGCATCCTTT CCAGTACCAA

4851 AACACACGAC CGCTACCGCT TCAGTCATGA TGAAGCAGTC GGCAGCAACA

4901 TCGGCGGCGG CAAAATGATT GTTGCAGCCG GGCAGGATAT CAATGTACGC

4951 GGCAGCAACC TTATTTCTGA TAAGGGCATT GTTTTAAAAG CAGGACACGA

5001 CATCGATATT TCTACTGCCC ATAATCGCTA TACCGGCAAT GAATACCACG

5051 AGAGCAAAAA ATCAGGCGTC ATGGGTACTG GCGGATTGGG CTTTACTATC

5101 GGTAACCGGA AAACTACCGA TGACACTGAT CGTACCAATA TTGTCCATAC

5151 AGGCAGCATT ATAGGCAGCC TGAATGGAGA CACCGTTACA GTTGCAGGAA

-continued

5201 ACCGCTACCG ACAAACCGGC AGTACCGTCT CCAGCCCCGA GGGGCGCAAT

5251 ACCGTCACAG CCAAAAGCAT AGATGTAGAG TTCGCAAACA ACCGGTATGC

5301 CACTGACTAC GCCCATACCC AGGAACAAAA AGGCCTTACC GTCGCCCTCA

5351 ATGTCCCGGT TGTCCAAGCT GCACAAAACT TCATACAAGC AGCCCAAAAT

5401 GTGGGCAAAA GTAAAAATAA ACGCGTTAAT GCCATGGCTG CAGCCAATGC

5451 TGCATGGCAG AGTTATCAAG CAAAACAACA AATGCAACAA TTTGCTCCAA

5501 GCAGCAGTGC GGGACAAGGT CAAAACAACA ATCAAAGCCC CAGTATCAGT

5551 GTGTCCATTA CCTACGGCGA ACAGAAAAGT CGTAACGAGC AAAAAAGACA

5601 TTACACCGAA GCGGCAGCAA GTCAAATTAT CGGCAAAGGG CAAACCACAC

5651 TTGCGGCAAC AGGAAGTGGG GAGCAGTCCA ATATCAATAT TACAGGTTCC

5701 GATGTCATCG GCCATGCAGG TACTGCCCTC ATTGCCGACA ACCATATCAG

5751 ACTCCAATCT GCCAAACAGG ACGGCAGCGA GCAAAGCAAA AACAAAAGCA

5801 GTGGTTGGAA TGCAGGCGTA GCCGTCAAAA TAGGCAACGG CATCAGGTTT

5851 GGAATTACCG CCGGAGGAAA TATCGGTAAA GGTAAAGAGC AAGGGGGAAG

5901 TACTACCCAC CGCCACACCC ATGTCGGCAG CACAACCGGC AAAACTACCA

5951 TCCGAAGCGG CGGGGATACC ACCCTCAAAG GTGTGCAGCT CATCGGCAAA

6001 GGCATACAGG CAGATACGCG CAACCTGCAT ATAGAAAGTG TTCAAGATAC

6051 TGAAACCTAT CAGAGCAAAC AGCAAAACGG CAATGTCCAA GTTACTGTCG

6101 GTTACGGATT CAGTGCAAGC GGCAGTTACC GCCAAAGCAA AGTCAAAGCA

6151 GACCATGCCT CCGTAACCGG GCAAAGCGGT ATTTATGCCG GAGAAGACGG

6201 CTATCAAATC AAAGTCAGAG ACAACACAGA CCTCAAGGGC GGTATCATCA

6251 CGTCTAGCCA AAGCGCAGAA GATAAGGGCA AAAACCTTTT TCAGACGGCC

6301 ACCCTTACTG CCAGCGACAT TCAAAACCAC AGCCGCTACG AAGGCAGAAG

6351 CTTCGGCATA GGCGGCAGTT TCGACCTGAA CGGCGGCTGG GACGGCACGG

6401 TTACCGACAA ACAAGGCAGG CCTACCGACA GGATAAGCCC GGCAGCCGGC

6451 TACGGCAGCG ACGGAGACAG CAAAAACAGC ACCACCCGCA GCGGCGTCAA

6501 CACCCACAAC ATACACATCA CCGACGAAGC GGGACAACTT GCCCGAACAG

6551 GCAGGACTGC AAAAGAAACC GAAGCGCGTA TCTACACCGG CATCGACACC

6601 GAAACTGCGG ATCAACACTC AGGCCATCTG AAAAACAGCT TCGACAAAGA

6651 CGCGGTCGCC AAAGAGATCA ACCTGCAAAG GGAAGTAACG AAGGAGTTCG

6701 GCAGAAACGC CGCCCAAGCC GTAGCGGCCG TTGCCGACAA ACTCGGCAAT

6751 ACCCAAAGTT ACGAACGGTA TCAGGAAGCC CGAACCCTGC TGGAGGCCGA

6801 ACTGCAAAAC ACGGACAGCG AAGCCGAAAA AGCCGCCTTC CGCGCATCCC

6851 TCGGCCAAGT AAACGCCTAT CTTGCCGAAA ACCAAAGCCG CTACGACACC

6901 TGGAAAGAAG GCGGCATAGG CAGGAGCATA CTGCACGGGG CGGCAGGCGG

6951 ACTGACGACC GGCAGCCTCG GCGGCATACT GGCCGGCGGC GGCACTTCCC

7001 TTGCCGCACC GTATTTGGAC AAAGCGGCGG AAAACCTCGG TCCGGCGGGC

7051 AAAGCGGCGG TCAACGCACT GGGCGGTGCG GCCATCGGCT ATGCAACTGG

7101 TGGTAGTGGT GGTGCTGTGG TGGGTGCGAA TGTAGATTGG AACAATAGGC

7151 AGCTGCATCC GAAAGAAATG GCGTTGGCCG ACAAATATGC CGAAGCCCTC

7201 AAGCGCGAAG TTGAAAAACG CGAAGGCAGA AAAATCAGCA GCCAAGAAGC

-continued

```
7251 GGCAATGAGA ATCCGCAGGC AGATACTGCG TTGGGTGGAC AAAGGTTCCC

7301 AAGACGGCTA TACCGACCAA AGCGTCATAT CCCTTATCGG AATGAAAGGC

7351 GAAGACAAAG CCTTGGGTTA TACTTGGGAC TACCGCGACT ACGGCGCAAG

7401 AAATCCGCAA ACCTACAACG ATCCGAAGCT GTTTGAGGAA TACCGCCGAC

7451 AGGACAAACC CGAATACCGC AACCTGACCT GGCTGCACAG CGGGACGAAA

7501 GACACCAAAA TCAGGCAGGG AGAGCGGAAA AACGAAGAGT TTGCACTGAA

7551 CGTTGCCGAA GGACTGACGA GCCTTGTCAA CCCCAATCCG AGGATAAAAG

7601 TCCCGATTCT TGCAGGCATC CGCAACCTGA AAAACATCAA GCCGACAGTT

7651 ACCGGCAGCG ATCCCTTATT GGCGGGTGCG GGGAATATCC GTATCCCTGC

7701 AAACGGCAAT GTTGCGAAGG GGGACAGGAT TCCGGATACG GCATTGGCTA

7751 GCAAGGGAAT CAAACATAAA GATCGTAAAG ATCAACTGGA GAAAAAATAA
```

This corresponds to the amino acid sequence <SEQ ID 1670; ORF 564>:

```
m564.pep
   1 MNRTLYKVVF NKHRNCMIAV AENAKREGKN TADTQAVGIL PNDIAGFAGF

  51 IHSISVISFS LSLLLGSALI LTSSSATAQG IVADKSAPAQ QQPTILQTGN

 101 GIPQVNIQTP TSAGVSVNQY AQFDVGNRGA ILNNSRSNTQ TQLGGWIQGN

 151 PWLARGEARV VVNQINSSHS SQLNGYIEVG GRRAEVVIAN PAGIAVNGGG

 201 FINASRATLT TAQPQYQAGD LSGFKIRQGN VVIAGHGLDA RDTDYTRILS

 251 YHSKIDAPVW GQDVRVVAGQ NDVAATGDAH SPILNNAAAN TSNNTANNGT

 301 HIPLFAIDTG KLGGMYANKI TLISTVEQAG IRNQGQWFAS AGNVAVNAEG

 351 KLVNTGMIAA TGENHAVSLH ARNVHNSGTV ASQDDANIHS QTLDNSGTVL

 401 SSGRLTVRNL GRLKNQNNGT IQAARLDMST GGLDNTGNIT QTGSQALDLV

 451 SAGKFDNSGK IGVSDVPQTG LNPNPSVIPQ IPSTATGSGS STVSVSKPGS

 501 NNPVSPTAPA KNYAVGRIQT TGAFDNAGSI NAGGQIDIAA QNGLGNSGSL

 551 NAAKLRVSGD SFNNTVKGKL QAHDLAVNTQ TAKNSGHLLT QTGKIDNREL

 601 HNAGEIAANN LTLIHSGRLS NDKKGNIRAA HLQLDTAGLH NAGNILADSG

 651 TVTTKNNLRN TGKVSVARLN TEGQTLDNTR GRIEAETVNI QSQQLTNQSG

 701 HITATEQLTI NSRNVDNQNG KLLSANQAQL AVSDGLYNQH GEIATNRQLS

 751 IHDKNQNTLA LNNADGTIQS AGNVSLQAKS LANNGTLTAG NKLDIALTDD

 801 FVVERDLTAG KQLNLSIKGR LKNTHTLQAG HTLKLNAGNI DNQVTGKIIG

 851 GEQTDITSEQ HVDNRGLINS DGLTHIGAGQ TLTNTGTGKI YGNHIALDAQ

 901 ILLNREETTE GSTKAGAIAA RKRLDIGAKE IHNQEGALLS SEGIFAVGNR

 951 LDEQHHAAGM ADTFVNGSAG LEVQGDALMS VRNMQNINNH FKTETYLAKA

1001 EKQVRDYTVL GQNTYYQAGK DGLFDNSQGQ KDQTTATFHL KNGSRIEANQ

1051 WHVRDYHIET YKERIIENRP AHITVGGDLT ASGQNWLNKD SRIVVGGRII

1101 TDDLNQKEIT NQSTTGKGRT DAVGTQWDSV TKKGWYSGRK RQRRTERNHT

1151 PYHDTQLFTH DFDTPVSVIQ QNAASPSFQP AASAIKLIDG VSTAAVNGQR

1201 IHTGNVVSLN NATVTLPNSS LYTTHPDNKG WLVETDPQFA DYRRWLGSDY

1251 MLQQLQLDTN HLHKRLGDGY YEQKLVNEQI HQLTGYRRLD GYRSDEEQFK
```

-continued

```
1301 ALMDNGLTAA KTFGLTPGIA LSAEQVARLT SDIVWMENQT VTLSDGSTQT
1351 VLVPKVYALA RKGDLNTSGG LISAEQVLLK LQNGNLTNSG TIAGRQAVLI
1401 QARNINSNGN IQADQIGLKA EKSINIDGGQ VQAGRLLTAQ AQNINLNGTT
1451 QTSGNERNGN TAIDRMAGIN VVGSHTEQVD NRTSDGILSL HASNDINLNA
1501 ATVSNQVKDG TTQITAGNNL NLGTIRTEHR EAYGTLDDEN HRHVRQSTEV
1551 GSSIRTQNGA LLRAGNDLKI RQGELEAEEG KTVLAAGRDV TISEGRQITE
1601 LDTSVSGKSK GILSSTKTHD RYRFSHDEAV GSNIGGGKMI VAAGQDINVR
1651 GSNLISDKGI VLKAGHDIDI STAHNRYTGN EYHESKKSGV MGTGGLGFTI
1701 GNRKTTDDTD RTNIVHTGSI IGSLNGDTVT VAGNRYRQTG STVSSPEGRN
1751 TVTAKSIDVE FANNRYATDY AHTQEQKGLT VALNVPVVQA AQNFIQAAQN
1801 VGKSKNKRVN AMAAANAAWQ SYQATQQMQQ FAPSSSAGQG QNNNQSPSIS
1851 VSITYGEQKS RNEQKRHYTE AAASQIIGKG QTTLAATGSG EQSNINITGS
1901 DVIGHAGTAL IADNHIRLQS AKQDGSEQSK NKSSGWNAGV AVKIGNGIRF
1951 GITAGGNIGK GKEQGGSTTH RHTHVGSTTG KTTIRSGGDT TLKGVQLIGK
2001 GIQADTRNLH IESVQDTETY QSKQQNGNVQ VTVGYGFSAS GSYRQSKVKA
2051 DHASVTGQSG IYAGEDGYQI KVRDNTDLKG GIITSSQSAE DKGKNLFQTA
2101 TLTASDIQNH SRYEGRSFGI GGSFDLNGGW DGTVTDKQGR PTDRISPAAG
2151 YGSDGDSKNS TTRSGVNTHN IHITDEAGQL ARTGRTAKET EARIYTGIDT
2201 ETADQHSGHL KNSFDKDAVA KEINLQREVT KEFGRNAAQA VAAVADKLGN
2251 TQSYERYQEA RTLLEAELQN TDSEAEKAAF RASLGQVNAY LAENQSRYDT
2301 WKEGGIGRSI LHGAAGGLTT GSLGGILAGG GTSLAAPYLD KAAENLGPAG
2351 KAAVNALGGA AIGYATGGSG GAVVGANVDW NNRQLHPKEM ALADKYAEAL
2401 KREVEKREGR KISSQEAAMR IRRQILRWVD KGSQDGYTDQ SVISLIGMKG
2451 EDKALGYTWD YRDYGARNPQ TYNDPKLFEE YRRQDKPEYR NLTWLHSGTK
2501 DTKIRQGERK NEEFALNVAE GLTSLVNPNP RIKVPILAGI RNLKNIKPTV
2551 TGSDPLLAGA GNIRIPANGN VAKGDRIPDT ALASKGIKHK DRKDQLEKK*
```

Computer analysis of this amino acid sequence gave the following results:

Homology with a Predicted ORF from *N. gonorrhoeae*

```
m564/fha
ID          FHAB_BORPE STANDARD; PRT; 3591 AA.
AC          P12255;
DT          01-OCT-1989 (REL. 12, CREATED)
DT          01-FEB-1996 (REL. 33, LAST SEQUENCE UPDATE)
DT          01-FEB-1996 (REL. 33, LAST ANNOTATION UPDATE)
DE          FILAMENTOUS HEMAGGLUTININ...
SCORES      Initl: 190 Initn: 524 Opt: 594
Smith-
Waterman
score:      866; 21.7% identity in 2427 aa overlap
```

-continued

```
                          10        20        30        40        50        60
m564.pep         MNRTLYKVVFNKHRNCMIAVAENAKREGKNTADTQAVGILPNDIAGFAGFIHSISVISFS
                 || :||::||:: |: :: |:|:     | ||    :: |    :  :|  :    |::  :::
fhab_borpe       MNTNLYRLVFSHVRGMLVPVSEHCTV-G-NTFCGRTRG---QARSGARATSLSVAPNALA
                          10        20          30          40        50

                           70        80        90       100       110       119
m564.pep         LSLLLG-SALILTSSSATAQGIVADKSAPAQQQPTILQTGNGIPQVNIQTPTSAGVSVNQ
                  :|:|: ::| |::     |||:|      | |  |   :|| || :| |||   |:|:||| |:
fhab_borpe       WALMLACTGLPLVTH---AQGLV-----P-QGQTQVLQGGNKVPVVNIADPNSGGVSHNK
                     60        70                   80        90       100

               120       130       140       150       160       170       179
m564.pep         YAQFDVGNRGAILNNSRSNTQTQLGGWIQGNPWLARGEARVVVNQINSSHSSQLNGYIEV
                 : ||:|:| |:::||: ::  :::|| :   ||  |:| :|  ::: :::::   |:|  | :||
fhab_borpe       FQQFNVANPGVVFNNGLTDGVSRIGGALTKNPNLTR-QASAILAEVTDTSPSRLAGTLEV
                   110       120       130       140        150       160

               180       190       200       210       220       230       239
m564.pep         GGRRAEVVIANPAGIAVNGGGFINASRATLTTAQPQYQAGDLSGFKIRQGNVVIAGHGLD
                  |: |:::|||| ||:||| : :||| ||||::|: ::|  : |: ::||:|:|    |::
fhab_borpe       YGKGADLIIANPNGISVNGLSTLNASNLTLTTGRPSVNGGRI-GLDVQQGTVTIERGGVN
                    170       180       190       200        210       220

               240       250            260       270       280       290
m564.pep         ARDTDYTRILSYHSKIDAPV---WGQ---DVRVVAGQNDVAATGDAHSPILNNAAANTSN
                 |    |   :::   |::: |      |:    |: |||| |      :     :||     ||:: :
fhab_borpe       ATGLGYFDVVARLVKLQGAVSSKQGKPLADIAVVAGANRYDHATRRATPI----AAGARG
                    230       240       250       260       270           280

                     300       310       320       330       340       350
m564.pep         NTANNGTHIPLFAIDTGKLGGMYANKITLISTVEQAGIRNQGQWFASAGNVAVNAEGKLV
                  :|:         :|||     |:||:::|||:|:      |:|: |: ::|  : ::|:::|:::
fhab_borpe       AAAGA------YAIDGTAAGAMYGKHITLVSSDSGLGVRQLGS-LSSPSAITVSSQGEIA
                                 290       300       310       320       330

                     360       370       380       390       400       410
m564.pep         NTGMIAATGENHAVSLHARNVHNSGTVASQDDANIHSQTLDNSGTVLSSGRLTVRNLGRL
                     :   || :     :||:: :| ::| :||           :: ::|:|   :     :: ::| |
fhab_borpe       ---LGDATVQRGPLSLKGAGVVSAGKLASGGGAV----NVAGGGAVKIA---SASSVGNL
                        340       350       360            370            380

                     420       430       440       450       460       470
m564.pep         KNQNNGTIQAARLDMSTGGLDNTGNITQTGSQALDLVSAGKFDNSGKIGVSDVPQTGLNP
                  |::| :||: |: :            |:: :|  ||::| :|:: :   :   : : :     |:
fhab_borpe       AVQGGGKVQATLLNAG-------GTLLVSGRQAVQLGAASSRQALSVNAGGALKADKLSA
                     390              400       410       420       430

                      480       490       500       510       520        530
m564.pep         NPSV-IPQIPSTATGSGSSTVSVSKPGSNNPVSPTAPAKNYAVGRIQTTGAFD-NAGSIN
                 :  | :    ::| ||:||::    : |:          :|  |:||::: |     : ||:
fhab_borpe       TRRVDVDGKQAVALGSASSNALSVRAGGA-----LKAGKLSATGRLDVDGKQAVTLGSVA
                   440       450       460            470       480       490

                       540       550       55    560             570       579
m564.pep         AGGQIDIAAQNGLGNSGSLNAAKLRVSG------DSFNNT------VKGKLQAHDLAVNT
                 : | ::::| ::|  :  :::|:|:| |        |: :::          : | | |::|   :
fhab_borpe       SDGALSVSAGGNLRANELVSSAQLEVRGQREVALDDASSARGMTVVAAGALAARNLQSKG
                       500       510       520       530       540       550

               580       590       600       610       620       630
m564.pep         QTAKNSGHLLTQTGKIDNRELH--NAGEIAANNLTLIHSGRLSNDKKGNIRAAHLQLDTA
                   : ::|: :: ::   :: ||:   :  |::  ::|:  ::: :|:: :  ||   |: : |:
fhab_borpe       AIGVQGGEAVSVANANSDAELRVRGRGQVDLHDLSAARGADISGEGRVNIGRARSDSDVK
                       560       570       580       590       600       610

                 640       650       660       670       680       690
m564.pep         GLHNAGNILADSGTVTTKNNLRNTGKVSVARLNTEGQTLDNTRGRIEAETVNIQSQQLTN
                  :    | :   || |:       :::   |:||:  : ::| :   :   |       :||: : |
fhab_borpe       -VSAHGALSIDSMTALGAIGVQAGGSVSAKDMRSRGAVTVSGGG-----AVNLGDVQ---
                        620       630       640       650              660
```

-continued

```
                700       710       720       730       740       750
m564.pep        QSGHITATEQLTINSRNVDNQNGKLLSANQAQLAVSDGLYNQHGEIATNRQLSIHDKNQN
                ::|:: ||   ::: |:|          |  |:||:: |    | | : :   :::: ::
fhab_borpe      SDGQVRATSAGAMTVRDV---------AAAADLALQAGDALQAGFLKSAGAMTVNGRDAV
                   670       680                  690       700       710

                760       770       780       790       800       810
m564.pep        TLALNNADGTIQSAGNVSLQAKSLANNGTLTAGNKLDIALTDDFVVERDLTAGKQL-NLS
                 |      ||: :::|:: ::: :  |   |:|:| ::| :: :     :|   :|    |:| |:|
fhab_borpe      RL-----DGA-HAGGQLRVSSDGQAALGSLAAKGELTVSAARAATVA-EL---KSLDNIS
                          720       730       740       750         760

                 820       830       840       850       860       870
m564.pep        IKGRLK-NTHTLQAGHTLKLNA-GNIDNQVTGKIIGGEQTDITSEQHVDNRGLINSDGLT
                : |   : :::::::  : ::| | :|    :||:  : :: |   |     : | :::|:|
fhab_borpe      VTGGERVSVQSVNSASRVAISAHGALD---VGKV--SAKSGIGLE----GWGAVGADSL-
                   770       780       790            800         810

                   880       890       900       910       920       930
m564.pep        HIGAGQTLTNTGTGKIYGNHIALDAQILLNREETTEGSTKAGAIAARKRLDI-GAKEIHN
                 |:  ::: :|   :  ::      |:| |:     :||::  ||: |    :|: |:: :
fhab_borpe      --GSDGAISVSGRDAVRVDQARSLADISLG----AEGGATLGAVEAAGSIDVRGGSTV--
                    820       830       840           850       860

                   940       950       960       970       980       990
m564.pep        QEGALLSSEGIFAVGNRLDEQHHAAGMADTFVNGSAGLEVQGDALMSVRNMQNINNHFKT
                 ::| ::: : :  |:  |   : :|: :    :: |:| :::    |::: |:    :::    :
fhab_borpe      AANSLHANRDVRVSGK--DAVRVTAATSGGGLHVSSGRQLDLGAVQA-RGALALDGGAGV
                  870       880         890       900       910         920

                  1000       1010      1020      1030      1040      1050
m564.pep        ETYLAKAEK--QVRDYTVLGQNTYYQAGKDGLFDNSQGQKDQTTATFHLKNGSRIEANQ-
                    |||     :|:     |   :|    :|    :      :|   |   :|  :      |: ::|::
fhab_borpe      ALQSAKASGTLHVQGGEHLDLGTLAAVGAVDV----NGTGDVRVAKLVSDAGADLQAGRS
                    930       940       950            960       970

                        1060      1070      1080      1090      1100
m564.pep        --WHVRDYHIETYKERIIENRPAHITVGGDLTASGQNWLNKDSRIVVGGRIITDDLNQKE
                    :  |    :    :    : : : :     | |  |:: :  |:  :    |:|:  ::    :|
fhab_borpe      MTLGIVDTTGDLQARAQQKLELGSVKSDGGLQAAAGGALSLAAAEVAGALELS---GQGV
               980       990       1000      1010      1020      1030

               1110      1120      1130        1140      1150      1160
m564.pep        ITNQSTTGKGRTDAVGTQWDSVTKKGWY--SGRKRQRRTERNHTPYHDTQLFTHDFDTPV
                 ::::::::| |::|:    ::  | |      :: :| ||: |                 :|| ||
fhab_borpe      TVDRASASRARIDSTGSVGIGALKAGAVEAASPRRARRALR------------QDFFTPG
                 1040      1050      1060      1070                     1080

                   1170      1180      1190      1200      1210      1220
m564.pep        SVI---QQNAASPSFQPAASAIKLIDGVSTAAVNGQRIHTGNVVSLNNATVTLPNSSLYT
                ||:    |  |::     :|   :::      |  :    |    :|    :     |   :  :|:|||:   :|
fhab_borpe      SVVVRAQGNVTVGRGDPHQGVLAQGDIIMDA--KGGTLLLRNDALTENGTVTISADSAVL
                   1090      1100      1110        1120      1130      1140

                   1230      1240      1250      1260      1270      1280
m564.pep        THPDNKGWLVETD-PQFADYRRWLGSDYMLQQLQLDTNHLHKRLGDGYYEQKLVNEQIHQ
                 |     :: :  ::       :|  :     |    : ::|  |   |     : ::|:   :: :  ::||
fhab_borpe      EHSTIESKISQSVLAAKGDKGKPAVSVKVAKKLFL--NGTLRAVNDN--NETMSGRQIDV
                    1150      1160      1170        1180      1190

                    1290      1300      1310      1320      1330      1340
m564.pep        LTGYRRLDGYRSDEEQFKALMDNGLTAAKTFGLTPG-IALSAEQVARLTSDIVWMENQTV
                : |   ::     :|     :|   |::::  ::       | |:: | :::   :: |     :|:
fhab_borpe      VDGRPQI----TDAVTGEARKDESVVSDAALVADGGPIVVEAGELVSHAGGIGNGRNK--
               1200          1210      1220      1230      1240      1250

                    1350      1360      1370      1380      1390      1400
m564.pep        TLSDGSTQTVLVPKVYALARKGDLNTSGGLISAEQVLLKLQNGNLTNSGTIAGRQAVLIQ
                  :|:: || :           |:|  ::| : :::| :|:: :| |||     ::: :    |:
fhab_borpe      --ENGASVTVRTT--------GNLVNKGYISAGKQGVLEV-GGALTNEFLVGSDGTQRIE
                     1260                 1270      1280       1290      1300

                    1410             1420      1430      1440           1450
m564.pep        ARNINSNGNIQ-------ADQIGLKAEKSINIDGGQVQAGRLLTAQ----AQNINLNGTT
                |: |:: |::|          |  : :|| ::|  || ::   |::  |         : ::: :: :
fhab_borpe      AQRIENRGTFQSQAPAGTAGALVVKAAEAIVHDGVMATKGEMQIAGKGGGSPTVTAGAKA
                    1310      1320      1330      1340      1350      1360
```

-continued

```
                  1460      1470      1480      1490      1500
m564.pep      QTSGNERNGNTAI-DRMAGINVV-GSHTEQVDNRTSD-GILSLHASNDINLNAATVSNQV
               ||:|: : ::|  |  :::::  |:     | :| :: | :|::::  :: :| ::: ||
fhab_borpe    TTSANKLSVDVASWDNAGSLDIKKGGAQVTVAGRYAEHGEVSIQGDYTVSADAIALAAQV
                    1370      1380      1390      1400      1410      1420

               1510      1520       1530      1540                1550
m564.pep      --KDGTTQITAGNNLNLGT-IRTE---HREAYGTLDDENHRHVRQST---------EVGS
                : |::::|: ::  ::: ||      : :| | ::: :: :||:::          |:|:
fhab_borpe    TQRGGAANLTSRHDTRFSNKIRLMGPLQVNAGGPVSNTGNLKVREGVTVTAASFDNETGA
                    1430      1440      1450      1460      1470      1480

                  1560      1570      1580      1590        1600
m564.pep      SIRTQNGALLRAGNDLKIRQGELEAEEGKTVLAAGRDV--TISEGRQITELDTS---VSG
               : :::::|  :|   :    |::::|: |::||: :    |:: |::||  : :     |
fhab_borpe    EVMAKSATLTTSGAARN--AGKMQVKEAATIVAASVSNPGTFTAGKDITVTSRGGFDNEG
                    1490        1500      1510      1520      1530

                1610      1620         1630      1640      1650      1660
m564.pep      K---SKGILSSTKTHDRYRF---SHDEAV-GSNIGGGKMIVAAGQDINVRGSNLISDKGI
              |    :|  |: :|:  :  |       :|| :| :|: : : :  : ||:|::|::: :   |::
fhab_borpe    KMESNKDIVIKTEQFSNGRVLDAKHDLTVTASGQADNRGSLKAGHDFTVQAQRI--DNSG
             1540      1550      1560      1570      1580      1590

                  1670     16     1680      1690      1700      1710
m564.pep      VLKAGHDIDISTAHNRYTG-----NEYHESKKSGVMGTGGLGFTIGNRKTTDDTDRTNIV
              :: ||||  ::: | | ||       :: |  ::: : :|| :     |   :  | :| ||
fhab_borpe    TMAAGHDATLKAPHLRNTGQVVAGHDIHIINSAKLENTGRV--DARNDIALDVADFTN--
              1600      1610      1620      1630        1640      1650

               1720      1730     1    1740      1750      1760      1770
m564.pep      HTGSIIGSLNGDTVTVAGNRYRQT----GSTVSSPEGRNTVTAKSIDVEFANNRYATDYA
               |||: :  :: |:|:| :  |:          :   ||    | |||: :|: ::  ::  |
fhab_borpe    -TGSLYAEHDA-TLTLAQGTQRDLVVDQDHILPVAEGTLRVKAKSLTTEIETGNPGSLIA
                  1660      1670      1680      1690      1700      1710

                   1780      1790      1800      1810      1820      1830
m564.pep      HTQEQKGLTVALNVPVVQAAQNFIQAAQNVGKSKNKRVNAMAAANAA-WQSYQATQQMQQ
              ::||        |:   ||     | :::::  |  : : |:     |||  | : : | : |:
fhab_borpe    EVQE--------NIDNKQA----IVVGKDLTLS-SAHGNVANEANALLWAAGELTVKAQN
                          1720          1730        1740      1750

                  1840      1850      1860      1870      1880      1890
m564.pep      FAPSSSAGQGQNNNQSPSISVSITYGEQKSRNEQKRHYTEAAASQIIGKGQTTLAATGSG
              :: : :|     ::|    : :|::       : |   :   |       | :|      ::|   :|
fhab_borpe    ITNKRAALIEAGGNARLTAAVALLNKLGRIRAGEDMHLD---APRI----ENTAKLSGEV
             1760      1770      1780      1790          1800         1810

                  1900      1910      1920      1930      1940      1950
m564.pep      EQSNINITGSDVIGHAGTALIADNHIRLQSAKQDGSEQSKNKSSGWNAGVAVKIGNGIRF
              ::::: :|:     |: :     ::  :|   ::|: |:        :: |  :|   :    : |:
fhab_borpe    QRKGVQDVGGGEHGRWSGIGYVNYWLRAGNGKKAGT-----IAAPWYGGDLTAEQSLIEV
                  1820      1830      1840                1850      1860

                  1960      1970      1980      1990      2000      2010
m564.pep      GITAGGNIGKGKEQGGSTTHRHTHVGSTTGKTTIRSGGDTTLKGVQLIGKGIQADTRNLH
              |      | |  |::      |||        :: :|::||    : |          ::|:|::
fhab_borpe    GKDLYLNAGARKDE-----HRHL-----LNEGVIQAGGHGHIGG--------DVDNRSV-
               1870           1880           1890                1900

                  2020      2030      2040      2050              2060
m564.pep      IESVQDTETYQSKQQNGNVQVTVGYGFSASGSYRQSKVKA-----DHASVTGQSGIYAGE
              :::|:  | :::     : : :     |:| :     ||  :         |:          |:|
fhab_borpe    VRTVSAMEYFKTPLPVSLTALDNRAGLSPATWNFQSTYELLDYLLDQNRYEYIWGLYPTY
              1910      1920      1930      1940      1950      1960

               2070      2080      2090      2100      2110        2120
m564.pep      DGYQIKVRDNTDLKGGIITSSQSAEDKGKNLFQTATLTASDIQNHS--RYEGRSFGIGGS
                :::::  | || |       : :|     |             |:::|:     |||:: :|
fhab_borpe    TEWSVNTLKNLDL-GYQAKPAPTAPPMPKA-------PELDLRGHTLESAEGRKI-FGEY
              1970      1980      1990                2000      2010

                 2130          2140      2150      2160      2170
m564.pep      FDLNGGWDGT-----VTDKQGRPTDRISPAAGYGSDGDSKNSTTRSGVNTHNIHITDEAG
                  |:|  :: :       :::  |: | |:     |           :: : : :|::::: ::
fhab_borpe    KKLQGEYEKAKMAVQAVEAYGEATRRVHDQLG------QRYGKALGGMDAETKEVDGIIQ
             2020      2030      2040                2050      2060      2070
```

-continued

```
            2180      2190      2200      2210      2220      2230
m564.pep      QLARTGRTAKETEARIYTGIDTETADQHSGHLKNSFDKDAVAKEINLQREVTKEFGRNAA
              ::|   ||:   :|   | ||:|| |: : : |:::|  ||  :     :||  :::  :
fhab_borpe    EFAADLRTVYAKQADQAT-IDAET-DKVAQRYKSQID--AVRLQAIQPGRVT--LAKALS
                   2080       2090       2100        2110        2120

            2240      2250      2260       2270      2280      2290
m564.pep      QAVAAVADKLGNTQSYERYQEARTLLE-AELQNTDSEAEKAAFRASLGQVNAYL------
               |::|    ||::| ::|::: ::  : ||:    :|    |  |:|   |: :
fhab_borpe    AALGADWRALGHSQLMQRWKDFKAGKRGAEIAFYPKEQTVLAAGAGLTLSNGAIHNGENA
               2130      2140      2150      2160      2170      2180

                   2300      2310      2320      2330      2340      2350
m564.pep      AENQSRYDTWKEGGIGRSILHGAAGGLTTGSLGGILAGGGTSLAAPYLDKAAENLGPAGK
              |:|::| :  | |: : : : |:  :|
fhab_borpe    AQNRGRPEGLKIGAHSATSVSGSFDALRDVGLEKRLDIDDALAAVLVNPHIFTRIGAAQT
               2190      2200      2210      2220      2230      2240
```

The following partial DNA sequence was identified in *N. gonorrhoeae* <SEQ ID 1671>:

```
g565.seq
   1 atggacagca cattgtctaa aacgtgttgc gtttcgtgca tattgttgag

  51 cgtaaccacc accattttcg cccgtcccag accggcggct tccaatactt

 101 ccctgcgttt cgcatcgccg aacgacaccg gctcgcctgc acttctggct

 151 acctgcacgc gtgcgatgtc caagtcgagc gcgaaatacg gaatatcctc

 201 tttgggcgaa gacgcgtccg accgtctgcc cgcccctgcc gaagccgaca

 251 atcagcacat gatcagactt gctcatcgct tccaccaaca tgctgtgcag

 301 atcgagcgac ttcatgtccc agcttga
```

This corresponds to the amino acid sequence <SEQ ID 1672; ORF 565.ng>:

```
g565.pep
   1 MDSTLSKTCC VSCILLSVTT TIFARPRPAA SNTSLRFASP NDTGSPALLA

  51 TCTRAMSKSS AKYGISSLGE DASDRLPAPA EADNQHMIRL AHRFHQHAVQ

 101 IERLHVPA*
```

The following partial DNA sequence was identified in *N. meningitidis* <SEQ ID 1673>:

```
m565.seq
   1 ATGGACAGCA CATTGTCTAA AACGTGTTGC GTTTCGTGCA TATTGTTGAG

  51 CGTAACCACC ACCATTTTCG CCCGTCCCAG ACCGGCGGCT TCCAATACTT

 101 CCCTGCGTTT CGCATCGCCG AACGACACCG GTTCGCCCGC ACTTCTGGCA

 151 ACCTGCACCC GCGCAATGTC CAAGTCGAGC GCGAAATACG GAATATCCTC

 201 TTGGGCAAGG ACGCGTCCGA CCGTCTGCCC GCCCCTGCCG AAGCCGACAA

 251 TCAGCACATG GTCGGACTTG CTCATGGTTT CTACCAGCAT ACTGTGCAGA

 301 TCGAGCGACT TCATGTCCCA GCTTGACTTG ACCAAACGCC CGACCAGCGC

 351 ATCGCTGCCG CCCAAGAGGA AGGGCGCGAT AATCATCGAC AGCAGAACCG

 401 CCGCCGTCGC CGCCTGTTCC CATTCTGGCG AAACCATATC AAGCTGCCCG

 451 GCAATGGCCA GCATCACGAA GCCGAACTCG CCGCCCTGCG CGAGATACAA

 501 AGCCGTTTTG AGGCTGTCGC CGACCGAATG TTTCATTTTG AAGGCAATGG
```

-continued

```
551 CAAACACAAC CAGTGCCTTC AACACCAGCA GCATTGCCAA CAGCATCAAT

601 ACCTGCCGCC AGCCGCCGAT CAATGCCTGA
```

This corresponds to the amino acid sequence <SEQ ID 1674; ORF 565>:

```
m565.pep
  1 MDSTLSKTCC VSCILLSVTT TIFARPRPAA SNTSLRFASP NDTGSPALLA

 51 TCTRAMSKSS AKYGISSWAR TRPTVCPPLP KPTISTWSDL LMVSTSILCR

101 SSDFMSQLDL TKRPTSASLP PKRKGAIIID SRTAAVAACS HSGETISSCP

151 AMASITKPNS PPCARYKAVL RLSPTECFIL KAMANTTSAF NTSSIANSIN

201 TCRQPPINA*
```

Computer analysis of this amino acid sequence gave the following results:

Homology with a Predicted ORF from *N. gonorrhoeae*

```
m565/g565 100.0% identity in 67 aa overlap

                  10        20        30        40        50        60
m565.pep MDSTLSKTCCVSCILLSVTTTIFARPRPAASNTSLRFASPNDTGSPALLATCTRAMSKSS
         ||||||||||||||||||||||||||||||||||||||||||||||||||||||||||||
    g565 MDSTLSKTCCVSCILLSVTTTIFARPRPAASNTSLRFASPNDTGSPALLATCTRAMSKSS
                  10        20        30        40        50        60
                  70        80        90       100       110       120
m565.pep AKYGISSWARTRPTVCPPLPKPTISTWSDLLMVSTSILCRSSDFMSQLDLTKRPRSASLP
         |||||||
    g565 AKYGISSLGEDASDRLPAPAEADNQHMIRLAHRFHQHAVQIERLHVPAX
```

The following partial DNA sequence was identified in *N. meningitidis* <SEQ ID 1675>:

```
a565.seq
  1 ATGGACAGCA CATTGTCTAA AACGTGTTGC GTTTCGTGCA TATTGTTGAG

 51 CGTAACCACC ACCATTTTCG CCCGTCCCAG ACCGGCGGCT TCCAATACTT

101 CCCTGCGTTT CGCATCGCCG AACGACACCG GTTCGCCCGC ACTTCTGGCA

151 ACCTGCACCC GCGCAATGTC CAAGTCGAGC GCGAAATACG GAATATCCTC

201 TTGGGCAAGG ACGCGTCCGA CCGTCTGCCC GCCCCTGCCG AAGCCGACAA

251 TCAGCACATG GTCGGACTTG CTCATGGTTT CTACCAGCAT ACTGTGCAGA

301 TCGAGCGACT TCATGTCCCA GCTTGACTTG ACCAAACGCC CGACCAGTGC

351 ATCGCTGCCG CCCAAGAGGA AGGGCGCGAT AATCATCGAC AGCAGAACCG

401 CCGCCGTCGC CGCCTGTTCC CATTCTAGCG AAACCATATC AAGCTGCCCG

451 GCAATGGCCA GCATCACGAA GCCGAACTCG CCGCCCTGCG CGAGATACAA

501 AGCCGTTTTG AGGCTGTCGC CGACCGAATG TTTCATTTTG AAGGCAATGG

551 CAAACACAAC CAGTGCCTTC AACACCAGCA GCATTGCCAA CAGCATCAAT

601 ACCTGCCGCC AGCCGCCGAT TAATGCCTGA
```

This corresponds to the amino acid sequence <SEQ ID 1676; ORF 565.a>:

```
a565.pep
      1  MDSTLSKTCC VSCILLSVTT TIFARPRPAA SNTSLRFASP NDTGSPALLA

     51  TCTRAMSKSS AKYGISSWAR TRPTVCPPLP KPTISTWSDL LMVSTSILCR

    101  SSDFMSQLDL TKRPTSASLP PKRKGAIIID SRTAAVAACS HSSETISSCP

    151  AMASITKPNS PPCARYKAVL RLSPTECFIL KAMANTTSAF NTSSIANSIN

    201  TCRQPPINA*

m565/a565  99.5% identity in 209 aa overlap

                   10        20        30        40        50        60
m565.pep   MDSTLSKTCCVSCILLSVTTTIFARPRPAASNTSLRFASPNDTGSPALLATCTRAMSKSS
           ||||||||||||||||||||||||||||||||||||||||||||||||||||||||||||
a565       MDSTLSKTCCVSCILLSVTTTIFARPRPAASNTSLRFASPNDTGSPALLATCTRAMSKSS
                   10        20        30        40        50        60

                   70        80        90       100       110       120
m565.pep   AKYGISSWARTRPTVCPPLPKPTISTWSDLLMVSTSILCRSSDFMSQLDLTKRPTSASLP
           ||||||||||||||||||||||||||||||||||||||||||||||||||||||||||||
a565       AKYGISSWARTRPTVCPPLPKPTISTWSDLLMVSTSILCRSSDFMSQLDLTKRPTSASLP
                   70        80        90       100       110       120

                  130       140       150       160       170       180
m565.pep   PKRKGAIIIDSRTAAVAACSHSGETISSCPAMASITKPNSPPCARYKAVLRLSPTECFIL
           ||||||||||||||||||||||:|||||||||||||||||||||||||||||||||||||
a565       PKRKGAIIIDSRTAAVAACSHSSETISSCPAMASITKPNSPPCARYKAVLRLSPTECFIL
                  130       140       150       160       170       180

                  190       200       210
m565.pep   KAMANTTSAFNTSSIANSINTCRQPPINAX
           ||||||||||||||||||||||||||||||
a565       KAMANTTSAFNTSSIANSINTCRQPPINAX
                  190       200       210
```

The following partial DNA sequence was identified in *N. gonorrhoeae* <SEQ ID 1677>:

```
g566.seq..
   1 atgccgtctg aacaatatct tttcagacgg cattttgtat gggggttaac

  51 ggttgttcag cccgagtacg tcctgcatat cgtacaaacc cgttttgccg

 101 tttacccaaa ctgcggcgcg gacggcaccg gcggcaaagg tcatgcggct

 151 gccggctttg tgggtgattt ccacgcgttc gccgtcggtg gcgaagaggg

 201 cggtgtggtc gccgactatg tcgcctgcgc ggacggtggc aaagccgatg

 251 gtggaaggat cgcgcggacc agtgtggcct tcgcggccgt aaacggcgca

 301 ttgtttgagg tcgcggccga gcgcgccggc gatgacttcg cccattcgta

 351 a
```

This corresponds to the amino acid sequence <SEQ ID 1678; ORF 566.ng>:

```
g566.pep..
   1 MPSEQYLFRR HFVWGLTVVQ PEYVLHIVQT RFAVYPNCGA DGTGGKGHAA

  51 AGFVGDFHAF AVGGEEGGVV ADYVACADGG KADGGRIART SVAFAAVNGA

 101 LFEVAAERAG DDFAHS*
```

The following partial DNA sequence was identified in *N. meningitidis* <SEQ ID 1679>:

```
m566.seq..
    1 ATGCCGTCTG AACAATATCT TTTCAGACGG CATTTTGTAT GGGGGTTAAC

   51 GGTTGTTCAG CCCGAGTACG TCCTGCATAT CGTACAAACC CGTTTTGCCG

  101 TTGACCCAAA CTGCGGCGCG GACGGCACCG GCGGCAAAGG TCATGCGGCT

  151 GCTGGCCTTG TGGGTGATTT CCACGCGCTC GCCGTCGGTG GCGAAGAGGG

  201 CGGTGTGGTC GCCGACGATG TCGCCTGCGC GGACGGTGGC AAAGCCGATG

  251 GTCGACGGAT CGCGCGGACC GGTGTGGCCT TCGCGGCCGT AAACGGCGCA

  301 TTGTTTGAGG TCTCTGCCGA GCGCGCCGGC GATGACTTCG CCCATGCGTA

  351 A
```

This corresponds to the amino acid sequence <SEQ ID 1680; ORF 566>:

```
m566.pep..
    1 MPSEQYLFRR HFVWGLTVVQ PEYVLHIVQT RFAVDPNCGA DGTGGKGHAA

   51 AGLVGDFHAL AVGGEEGGVV ADDVACADGG KADGRRIART GVAFAAVNGA

  101 LFEVSAERAG DDFAHA*
```

Computer analysis of this amino acid sequence gave the following results:

Homology with a Predicted ORF from *N. gonorrhoeae*

```
m566/g566 93.1% identity in 116 aa overlap

                  10        20        30        40        50        60
m566.pep  MPSEQYLFRRHFVWGLTVVQPEYVLHIVQTRFAVDPNCGADGTGGKGHAAAGLVFDFHAL
          |||||||||||||||||||||||||||||||||| ||||||||||||||||||:|||||:
    g566  MPSEQYLFRRHFVWGLTVVQPEYVLHIVQTRFAVYPNCGADGTGGKGHAAAGFVFDFHAF
                  10        20        30        40        50        60

                  70        80        90       100       110
m566.pep  AVGGEEGGVVADDVACADGGKADGRRIARTGVAFAAVNGALFEVSAERAGDDFAHAX
          |||||||||||| ||||||||||| |||||:|||||||||||||:|||||||||||:|
    g566  AVGGEEGGVVADYVACADGGKADGGRIARTSVAFAAVNGALFEVAAERAGDDFAHSX
                  70        80        90       100       110
```

The following partial DNA sequence was identified in *N. meningitidis* <SEQ ID 1681>:

```
a566.seq
    1 ATGCCGTCTG AACAATATCT TTTCAGACGG CATTTTGTAT GGGGGTTAAC

   51 GGTTGTTCAG CCCGAGTACG TCCTGCATAT CGTACAAACC CGTTTTACCG

  101 TTTACCCAAA CTGCGGCGCG GACGGCGCCG GCGGCAAAGG TCATGCGGCT

  151 GCTTGCCTTG TGGGTGATTT CCACGCGCTC GCCGTCGGTG GCGAAGAGGG

  201 CGGTGTGGTC GCCGACGATG TCGCCCGCGC GGACGGTGGC AAAGCCGATG

  251 GTGGACGGAT CGCGCGGGCC GGTGTGGCCT TCGCGGCCGT AAACGGCGCA

  301 TTGTTTGAGG TCTCTGCCGA GCGCGCCGGC GATGACTTCG CCCATGCGTA

  351 A
```

This corresponds to the amino acid sequence <SEQ ID 1682; ORF 566.a>:

```
a556.pep

      1 MPSEQYLFRR HFVWGLTVVQ PEYVLHIVQT RFTVYPNCGA DGAGGKGHAA

     51 ACLVGDFHAL AVGGEEGGVV ADDVARADGG KADGGRIARI GVAFAAVNGA

    101 LFEVSAERAG DDFAHA*

m566/a566 94.0% identity in 116 aa overlap

                    10        20        30        40        50        60
  m566.pep MPSEQYLFRRHFVWGLTVVQPEYVLHIVQTRFAVDPNCGADGTGGKGHAAAGLVGDFHAL
           |||||||||||||||||||||||||||||||:|||||||||:|||||||| ||||||||
      a566 MPSEQYLFRRHFVWGLTVVQPEYVLHIVQTRFTVDPNCGADGAGGKGHAAACLVGDFHAL
                    10        20        30        40        50        60

                    70        80        90       100       110
m566.pep AVGGEEGGVVADDVACADGGKADGRRIARTGVAFAAVNGALFEVSAERAGDDRAGAX
           |||||||||||||| |||||||| ||||:|||||||||||||||||||||||||||
    a566 AVGGEEGGVVADDVARADGGKADGGRIARAGVAFAAVNGALFEVSAERAGDDRAGAX
                    70        80        90       100       110
```

The following partial DNA sequence was identified in *N. gonorrhoeae* <SEQ ID 1683>:

```
g567.seq..
   1 atgcgacgac gggcagcggc atcgacaagg cgggtttgca gtccggcgtt

  51 tatcaggtct tattgggcga tgcggacgtg cagtcggcgg cggtacgcag

 101 caaagagggc ggatacggcg tgttgggtgc gaacgcgcgc gcttgccggc

 151 gcggaaatcg agctggtgca ggaaatcgcc cgggaagtgc gtttgaaaaa

 201 cgcgctcaag gcagtggcgg aagattacga ctttatcctg atcgactgtc

 251 cgccttcgct gacgctgttg acgcttaacg gcttggtggc ggcgggcggc

 301 gtgattgtgc cgatgttgtg cgaatattac gcgctggaag ggatttccga

 351 tttgattgcg accgtgcgca aaatccgtca ggcggtcaat cccgatttgg

 401 acatcacggg catcgtgcgt acgatgtacg acagccgcag caggctggtt

 451 gccgaagtca gcgaacagtt gcgcagccat ttcggggatt tgctttttga

 501 aaccgccatc ccgcgcaata tccgccttgc ggaagcgccg agccacggta

 551 tgccggtgat ggcttacgac gcgcaggcaa agggtgccaa ggcgtatctt

 601 gccttggcgg acgaactggc ggcgagggtg tcggggaaat ag
```

This corresponds to the amino acid sequence <SEQ ID 1684; ORF 567.ng>:

```
g567.pep
   1 MRRRAAASTR RVCSPAFIRS YWAMRTCSRR RYAAKRADTA CWVRTRALAG

  51 AEIELVQEIA REVRLKNALK AVAEDYDFIL IDCPPSLTLL TLNGLVAAGG

 101 VIVPMLCEYY ALEGISDLIA TVRKIRQAVN PDLDITGIVR TMYDSRSRLV

 151 AEVSEQLRSH FGDLLFETAI PRNIRLAEAP SHGMPVMAYD AQAKGAKAYL

 201 ALADELAARV SGK*
```

The following partial DNA sequence was identified in *N. meningitidis* <SEQ ID 1685>:

```
m567.seq..
  1  ATGAGTGCGA ACATCCTTGC CATCGCCAAT CAGAAGGGCG GTGTGGGCAA
```

-continued

```
 51 AACGACGACG ACGGTAAATT TGGCGGCTTC GCTGGCATCG CGCGGCAAAC

101 GCGTGCTGGT GGTCGATTTG GATCCGCAGG GCAATGCGAC GACGGGCAGC

151 GGCATCGACA AGGCGGGTTT GCAGTCCGGC GTTTATCAGG TCTTATTGGG

201 CGATGCGGAC GTGCAGTCGG CGGCGGTACG CAGCAAAGAG GGCGGATACG

251 CTGTGTTGGG TGCGAACCGC GCGCTGGCCG GCGCGGAAAT CGAACTGGTG

301 CAGGAAATCG CCCGGGAAGT GCGTTTGAAA AACGCGCTCA AGGCAGTGGA

351 AGAAGATTAC GACTTTATCC TGATCGACTG CCCGCCTTCG CTGACGCTGT

401 TGACGCTTAA CGGGCTGGTG GCGGCGGGCG GCGTGATTGT GCCGATGTTG

451 TGCGAATATT ACGCGCTGGA AGGGATTTCC GATTTGATTG CGACCGTGCG

501 CAAAATCCGT CAGGCGGTCA ATCCCGATTT GGACATCACG GGCATCGTGC

551 GCACGATGTA CGACAGCCGC AGCAGGCTGG TTGCCGAAGT CAGCGAACAG

601 TTGCGCAGCC ATTTCGGGGA TTTGCTTTTT GAAACCGTCA TCCCGCGCAA

651 TATCCGCCTT GCGGAAGCGC CGAGCCACGG TATGCCGGTG ATGGCTTACG

701 ACGCGCAGGC AAAGGGTACC AAGGCGTATC TTGCCTTGGC GGACGAGCTG

751 GCGGCGAGGG TGTCGGGGAA ATAG
```

This corresponds to the amino acid sequence <SEQ ID 1686; ORF 567>:

```
m567.pep..
  1 MSANILAIAN QKGGVGKTTT TVNLAASLAS RGKRVLVVDL DPQGNATTGS

 51 GIDKAGLQSG VYQVLLGDAD VQSAAVRSKE GGYAVLGANR ALAGAEIELV

101 QEIAREVRLK NALKAVEEDY DFILIDCPPS LTLLTLNGLV AAGGVIVPML

151 CEYYALEGIS DLIATVRKIR QAVNPDLDIT GIVRTMYDSR SRLVAEVSEQ

201 LRSHFGDLLF ETVIPRNIRL AEAPSHGMPV MAYDAQAKGT KAYLALADEL

251 AARVSGK*
```

Computer analysis of this amino acid sequence gave the following results:

Homology with a Predicted ORF from *N. gonorrhoeae*

```
m567/g567  98.2% identity in 168 aa overlap

                60        70        80        90       100       110       119
m567.pep    GVYQVLLGDADVQSAAVRSKEGGYAVLGANRALAGAEIELVQEIAREVRLKNALKAVEED
                                          |||||||||||||||||||||||||||| ||
g567        AFIRSYWAMRTCSRRRYAAKRADTACWVRTRALAGAEIELVQEIAREVRLKNALKAVAED
                    20        30        40        50        60        70

               120       130       140       150       160       170       179
m567.pep    YDFILIDCPPSLTLLTLNGLVAAGGVIVPMLCEYYALEGISDLIATVRKIRQAVNPDLDI
            ||||||||||||||||||||||||||||||||||||||||||||||||||||||||||||
g567        YDFILIDCPPSLTLLTLNGLVAAGGVIVPMLCEYYALEGISDLIATVRKIRQAVNPDLDI
                    80        90       100       110       120       130

               180       190       200       210       220       230       239
m567.pep    TGIVRTMYDSRSRLVAEVSEQLRSHFGDLLFETVIPRNIRLAEAPSHGMPVMAYDAQAKG
            |||||||||||||||||||||||||||||||||:||||||||||||||||||||||||||
g567        TGIVRTMYDSRSRLVAEVSEQLRSHFGDLLFETAIPRNIRLAEAPSHGMPVMAYDAQAKG
                  140       150       160       170       180       190

              240       250
m567.pep    TKAYLALADELAARVSGKX
            :||||||||||||||||||
g567        AKAYLALADELAARVSGKX
              200       210
```

The following partial DNA sequence was identified in *N. meningitidis* <SEQ ID 1687>:

```
a567.seq
   1 ATGAGTGCGA ACATCCTTGC CATCGCCAAT CAGAAGGGCG GTGTGGGCAA

  51 AACGACGACG ACGGTAAATT TGGCGGCTTC GCTGGCATCG CGCGGCAAAC

 101 GCGTGCTGGT GGTCGATTTG GATCCGCAGG GCAATGCGAC GACGGGCAGC

 151 GGCATCGACA AGGCGAGTTT GCAGTCCGGC GTTTATCAGG TCTTATTGGG

 201 CGATGCGGAC GTGAAATCGG CGGCGGTACG CAGCAAAGAG GGCGGATACG

 251 GCGTGTTGGG TGCGAACCGC GCGCTGGCCG GCGCGGAAAT CGAGCTGGTG

 301 CAGGAAATCG CCCGGGAAGT GCGTTTGAAA AACGCGCTCA AGGCAGTGGC

 351 GGAAGATTAC GACTTTATCC TGATCGACTG CCCGCCTTCG CTGACGCTGT

 401 TGACGCTTAA CGGCTTGGTG GCGGCAGGCG GCGTGATTGT GCCGATGTTG

 451 TGCGAATATT ACGCGCTGGA AGGGATTTCC GATTTGATTG CGACCGTGCG

 501 CAAAATCCGT CAGGCGGTCA ATCCCGATTT GGATATCACG GGCATCGTGC

 551 GTACGATGTA CGACAGCCGC AGCAGGCTAG TTGCCGAAGT CAGCGAACAG

 601 TTGCGCAGCC ATTTCGGGGA TTTGCTGTTT GAAACCGTCA TCCCGCGCAA

 651 TATCCGCCTT GCGGAAGCGC CGAGCCACGG TATGCCGGTG ATGGCTTATG

 701 ATGCGCAGGC AAAGGGTGCC AAGGCGTATC TTGCCTTGGC GGACGAGCTG

 751 ATGGCGAGGG TGTCGGGGAA ATAG
```

This corresponds to the amino acid sequence <SEQ ID 1688; ORF 567.a>:

```
a567.pep

      1  MSANILAIAN QKGGVGKTTT TVNLAASLAS RGKRVLVVDL DPQGNATTGS

     51  GIDKASLQSG VYQVLLGDAD VKSAAVRSKE GGYGVLGANR ALAGAEIELV

    101  QEIAREVRLK NALKAVAEDY DFILIDCPPS LTLLTLNGLV AAGGVIVPML

    151  CEYYALEGIS DLIATVRKIR QAVNPDLDIT GIVRTMYDSR SRLVAEVSEQ

    201  LRSHFGDLLF ETVIPRNIRL AEAPSHGMPV MAYDAQAKGA KAYLALADEL

    251  MARVSGK*
```

```
m567/a567  97.7% identity in 257 aa overlap

                    10        20        30        40        50        60
m567.pep    MSANILAIANQKGGVGKTTTTVNLAASLASRGKRVLVVDLDPQGNATTGSGIDKAGLQSG
            |||||||||||||||||||||||||||||||||||||||||||||||||||||||:||||
a567        MSANILAIANQKGGVGKTTTTVNLAASLASRGKRVLVVDLDPQGNATTGSGIDKASLQSG
                    10        20        30        40        50        60

                    70        80        90       100       110       120
m567.pep    VYQVLLGDADVQSAAVRSKEGGYAVLGANRALAGAEIELVQEIAREVRLKNALKAVEEDY
            |||||||||||:|||||||||||:|||||||||||||||||||||||||||||||| |||
a567        VYQVLLGDADVKSAAVRSKEGGYGVLGANRALAGAEIELVQEIAREVRLKNALKAVAEDY
                    70        80        90       100       110       120

                   130       140       150       160       170       180
m567.pep    DFILIDCPPSLTLLTLNGLVAAGGVIVPMLCEYYALEGISDLIATVRKIRQAVNPDLDIT
            ||||||||||||||||||||||||||||||||||||||||||||||||||||||||||||
a567        DFILIDCPPSLTLLTLNGLVAAGGVIVPMLCEYYALEGISDLIATVRKIRQAVNPDLDIT
                   130       140       150       160       170       180

                   190       200       210       220       230       240
m567.pep    GIVRTMYDSRSRLVAEVSEQLRSHFGDLLFETVIPRNIRLAEAPSHGMPVMAYDAQAKGT
            |||||||||||||||||||||||||||||||||||||||||||||||||||||||||||:
a567        GIVRTMYDSRSRLVAEVSEQLRSHFGDLLFETVIPRNIRLAEAPSHGMPVMAYDAQAKGA
                   190       200       210       220       230       240
```

-continued

```
                250
m567.pep    KAYLALADELAARVSGKX
            |||||||||| |||||||
a567        KAYLALADELMARVSGKX
                250
```

The following partial DNA sequence was identified in *N. gonorrhoeae* <SEQ ID 1689>:

```
g568.seq
   1 atgctcaggg tcagaccggt attatttgcc gtcaaggctt ccgcctcttc

  51 gataccttgc agaatctgcc gattaaagcg ttcgcggctg cccaatattt

 101 tcaggcgcat attgttttcg tgcaggcggc gtacctgttt ttgcaaagcc

 151 tgtaaaaaca gccccatcag gaacgaaact tcgtcttcgg ggcgacgcca

 201 gttttcggtt gaaaaggcaa acacggtcag atattgcacg cccagtttgg

 251 cgcaatgctt caccatattt tccaacgcgt ccaagccgcg tttgtgtccc

 301 attatacgcg ggagaaaacg ttttttcgcc caacggccgt tgccgtccat

 351 aattacggcg atgtgcctcg ggatggcggt gtgttccaaa atggtctgcg

 401 tgctgctctt catatctgcc tttcgcggtt cggcgttcaa atgccgtctg

 451 aacgccgcgc cgtga
```

This corresponds to the amino acid sequence <SEQ ID 1690; ORF 568.ng>:

```
g568.pep
   1 MLRVRPVLFA VKASASSIPC RICRLKRSRL PNIFRRILFS CRRRTCFCKA

  51 CKNSPIRNET SSSGRRQFSV EKANTVRYCT PSLAQCFTIF SNASKPRLCP

 101 IIRGRKRFFA QRPLPSIITA MCLGMAVCSK MVCVLLFISA FRGSAFKCRL

 151 NAAP*
```

The following partial DNA sequence was identified in *N. meningitidis* <SEQ ID 1691>:

```
m568.seq
   1 ATGCTCAGGG TCAGGCCGGT ATTGTTTGCC GTCAACGCTT CCGCCTCTTC

  51 GATGCCTTGC AGAATCTGCC GGTTGAAGCG TTCGCGGCTG CCCAATATCT

 101 TCAGGCGCAT ATTGTTTTCG TGCAGGCGGC GTACCTGTTT TTGCAAAGCC

 151 TGTAAAAACA GCCCCATCAG GAACGAAACT TCGTCTTCGG GGCGGCGCCA

 201 GTTTTCGGTT GAAAAGGCAA ACACGGTCAG ATATTGCACA CCCAGTTTGG

 251 CGCAATGCTT CACCATATTT TCCAATGCGT CCAAACCGCG TTTGTGTCCC

 301 ATTATGCGCG GGAGGAAACG TTTTTTCGCC CAACGGCCGT TGCCGTCCAT

 351 AATCACGGCG ATATGCTTGG GAATGGCGGT GTGTTCCAAA ACGGCCTGCG

 401 TGCTGCTTTT CATGTCTGCC TTTCGCGGTT CGGCATTCAA ATGCCGTCTG

 451 AACGCCGAAC CGTGCAGGTT AAATTGCCAT CAAATCTTCT TCTTTGGCAG

 501 TCAGGAGTTT GTCGGCTTCG GTAATGTATT TGTCGGTCAG TTTTTGAACC

 551 GCTTCTTCGC CGCGACGTGC CTCGTCTTCG GAAATTTCTT TGTCTTTGAG

 601 GAGTTTTTTG ATGTGGTCGT TGGCATCGCG GCGCACGTTG CGGATAGAGA

 651 CGCGGCCTTC TTCCGCTTCG CCGCGTACGA CTTTAATCAG GTCTTTGCGG
```

-continued

```
701 CGTTCCTCGG TCAGCATGGG CATCGGCACG CGGATCAGGT CGCCGACAGC

751 TGCCGGGTTC AGTCCCAAGT TTGA
```

This corresponds to the amino acid sequence <SEQ ID 1692; ORF 568>:

```
m568.pep..
  1 MLRVRPVLFA VNASASSMPC RICRLKRSRL PNIFRRILFS CRRRTCFCKA

 51 CKNSPIRNET SSSGRRQFSV EKANTVRYCT PSLAQCFTIF SNASKPRLCP

101 IMRGRKRFFA QRPLPSIITA ICLGMAVCSK TACVLLFMSA FRGSAFKCRL

151 NAEPCRLNCH QIFFFGSQEF VGFGNVFVGQ FLNRFFAATC LVFGNFFVFE

201 EFFDVVVGIA AHVADRDAAF FRFAAYDFNQ VFAAFLGQHG HRHADQVADS

251 CRVQSQV*
```

Computer analysis of this amino acid sequence gave the following results:

Homology with a Predicted ORF from *N. gonorrhoeae*

```
m568/g568 94.8% identity in 154 aa overlap

                   10        20        30        40        50        60
m568.pep   MLRVRPVLFAVNASASSMPCRICRLKRSRLPNIFRRILFSCRRRTCFCKACKNSPIRNET
           |||||||||||:|||||:||||||||||||||||||||||||||||||||||||||||||
g568       MLRVRPVLFAVKASASSIPCRICRLKRSRLPNIFRRILFSCRRRTCFCKACKNSPIRNET
                   10        20        30        40        50        60

                   70        80        90       100       110       120
m568.pep   SSSGRRQFSVEKANTVRYCTPSLAQCFTIFSNASKPRLCPIMRGRKRFFAQRPLPSIITA
           |||||||||||||||||||||||||||||||||||||||||:||||||||||||||||||
g568       SSSGRRQFSVEKANTVRYCTPSLAQCFTIFSNASKPRLCPIIRGRKRFFAQRPLPSIITA
                   70        80        90       100       110       120

                  130       140       150       160       170       180
m568.pep   ICLGMAVCSKTACVLLFMSAFRGSAFKCRLNAEPCRLNCHQIFFFGSQEFVGFGNVFVGQ
           :||||||||| :|||||:|||||||||||||| |
g568       MCLGMAVCSKMVCVLLFISAFRGSAFKCRLNAAPX
                  130       140       150

                  190       200       210       220       230       240
m568.pep   FLNRFFAATCLVFGNFFVFEEFFDVVVGIAAHVADRDAAFFRFAAYDFNQVFAAFLGQHG
```

The following partial DNA sequence was identified in *N. meningitidis* <SEQ ID 1693>:

```
a568.seq
  1 ATGCTCAGGG TCAGGCCGGT ATTGTTTGCC GTCAAGGCTT CCGCCTCTTC

 51 GATGCCCTTC AGGATTTGAC GGTTGAAGCG TTCGCGGCTG CCCAGTATTT

101 TCAGGCGCAT ATTGTTTTCG TGCAGGCGGC GTACCTGTTT TTGCAAAGCC

151 TGTAAAAACA GCCCCATCAG GAACGAAACT TCGTCTTCGG GGCGGCGCCA

201 GTTTTCGGTT GAAAAGGCAA ACACGGTCAG ATATTGCACA CCCAGTTTGG

251 CGCAATGCTT CACCATATTT TCCAATGCGT CCAAACCGCG TTTGTGTCCC

301 ATTATGCGCG GGAGGAAACG TTTTTTCGCC CAACGGCCGT TGCCGTCCAT

351 AATCACGGCG ATATGCTTGG GAATGGCGGT GTGTTCCAAA ACGGCCTGCG

401 TGCTGCTTTT CATGTCTGCC TTTCGCGGTT CGGCATTCAA ATGCCGTCTG

451 AACGCCGAAC CGTGCAGGTT AAATTGCCAT CAAATCTTCT TCTTTGGCAG

501 TCAGGAGTTT GTCGGCTTCG GTAATGTATT TGTCGGTCAG TTTTTGAACC

551 GCTTCTTCGC CGCGACGTGC CTCGTCTTCG GAAATTTCTT TGTCTTTGAG
```

-continued

```
601 GAGTTTTTTG ATGTGGTCGT TGGCATCGCG GCGCACGTTG CGGATGGAGA

651 CGCGGCCTTC TTCCGCTTCG CCGCGTACGA CTTTAATCAG GTCTTTGCGG

701 CGTTCCTCGG TCAGCATGGG CATCGGCACG CGGATCAGGT CGCCGACAGC

751 TGCCGGGTTC AGTCCCAAGT TTGA
```

This corresponds to the amino acid sequence <SEQ ID 1694; ORF 568.a>:

```
a568.pep

  1   MLRVRPVLFA VKASASSMPF RI*RLKRSRL PSIFRRILFS CRRRTCFCKA

 51   CKNSPIRNET SSSGRRQFSV EKANTVRYCT PSLAQCFTIF SNASKPRLCP

101   IMRGRKRFFA QRPLPSIITA ICLGMAVCSK TACVLLFMSA FRGSAFKCRL

151   NAEPCRLNCH QIFFFGSQEF VGFGNVFVGQ FLNRFFAATC LVFGNFFVFE

201   EFFDVVVGIA AHVADGDAAF FRFAAYDFNQ VFAAFLGQHG HRHADQVADS

251   CRVQSQV*
```

```
m568/a568  98.1% identity in 257 aa overlap

                   10        20        30        40        50        60
m568.pep   MLRVRPVLFAVNASASSMPCRICRLKRSRLPNIFRRILFSCRRRTCFCKACKNSPIRNET
           |||||||||||:|||||||| || ||||||||:|||||||||||||||||||||||||||
a568       MLRVRPVLFAVKASASSMPFRIXRLKRSRLPSIFRRILFSCRRRTCFCKACKNSPIRNET
                   10        20        30        40        50        60

                   70        80        90       100       110       120
m568.pep   SSSGRRQFSVEKANTVRYCTPSLAQCFTIFSNASKPRLCPIMRGRKRFFAQRPLPSIITA
           ||||||||||||||||||||||||||||||||||||||||||||||||||||||||||||
a568       SSSGRRQFSVEKANTVRYCTPSLAQCFTIFSNASKPRLCPIMRGRKRFFAQRPLPSIITA
                   70        80        90       100       110       120

                  130       140       150       160       170       180
m568.pep   ICLGMAVCSKTACVLLFMSAFRGSAFKCRLNAEPCRLNCHQIFFFGSQEFVGFGNVFVGQ
           ||||||||||||||||||||||||||||||||||||||||||||||||||||||||||||
a568       ICLGMAVCSKTACVLLFMSAFRGSAFKCRLNAEPCRLNCHQIFFFGSQEFVGFGNVFVGQ
                  130       140       150       160       170       180

                  190       200       210       220       230       240
m568.pep   FLNRFFAATCLVFGNFFVFEEFFDVVVGIAAHVADRDAAFFRFAAYDFNQVFAAFLGQHG
           |||||||||||||||||||||||||||||||||||| |||||||||||||||||||||||
a568       FLNRFFAATCLVFGNFFVFEEFFDVVVGIAAHVADGDAAFFRFAAYDFNQVFAAFLGQHG
                  190       200       210       220       230       240

                  250
m568.pep   HRHADQVADSCRVQSQVX
           ||||||||||||||||||
a568       HRHADQVADSCRVQSQVX
                  250
```

The following partial DNA sequence was identified in *N. gonorrhoeae* <SEQ ID 1695>:

```
g569.seq..
  1 atgctgaaac aacgggtaat aaccgctatg tggctgctgc cgctgatgct

 51 gggcatgctg ttttacgcgc cgcaatggct gtgggctgca ttttgcgggc

101 tgattgccct gaccgccttg tgggagtatg cccgtatggc cggtttgtgc

151 aaaaccgaaa ccaaccatta cctcgccgca accttggttt tcggcgtagt

201 tgcctatgcg ggcggctgga tgctgcctaa tttggtttgg tatgttgttt

251 tggcattttg gctcgccgtt atgcctttgt ggttgagatt caaatggagg

301 ctcaacggcg gttggcaggt ttatgccgtc ggctggcttt tgctcatgcc

351 gttttggttc gcgctcgtat ccctggcgcc cgcatcccga tga
```

This corresponds to the amino acid sequence <SEQ ID 1696; ORF 569.ng>:

```
g569.pep
   1 MLKQRVITAM WLLPLMLGML FYAPQWLWAA FCGLIALTAL WEYARMAGLC

  51 KTETNHYLAA TLVFGVVAYA GGWMLPNLVW YVVLAFWLAV MPLWLRFKWR

 101 LNGGWQVYAV GWLLLMPFWF ALVSLAPASR *
```

The following partial DNA sequence was identified in *N. meningitidis* <SEQ ID 1697>:

```
m569.seq..
   1 ATGCTGAAAC AACGGGTAAT AACCGCCATG TGGCTGCTGC CGCTGATGCT

  51 GGGCATGCTG TTTTACGCGC CGCAATGGTT GTGGGCTGCA TTTTGCGGAC

 101 TGATTGCCCT GATTGCCTTG TGGGAATATG CCCGTATGGG CGGTTTGTGC

 151 AAAATTAAAA CCAACCATTA CCTCGCCGCA ACCTTGGTTT TCGGCGTGGT

 201 TGCCTATGCG GGCGGCTGGA TGCTGCCTAA TTTGGTTTGG TATGTTGTTT

 251 TGGCATTTTG GCTCGCCGTT ATGCCTTTAT GGTTGAGATT CAAATGGAGG

 301 CTCAACGGCG GTTGGCAGGT TTATGCCGTC GGCTGGCTTC TGGTCATGCC

 351 GTTTTGGTTC GCGCTCGTAT CCCTGCGCCC GCATCCCGAT GATGCCCTGC

 401 CGCTGCTCGC CGTGATGGGT TTGGTGTGGG TTGCCGATAT TTGCGCGTAT

 451 TTCAGCGGCA AGGCGTTCGG CAAACACAAA ATCGCGCCGG CAATCAGCCC

 501 CGGCAAAAGC TGGGAAGGTG CAATCGGCGG CGCGGTTTGC GTGGCAGTGT

 551 ACATGACCGC CGTACGAAGT GCCGGCTGGC TGGCATTCGA TACAGGCTGG

 601 TTCGATACCG TGTTAATCGG TTTGGTGCTG ACCGTTGTCA GCGTATGCGG

 651 CGACCTTTTG GAAAGCTGGC TCAAGCGCGC GGCAGGCATC AAAGACAGCA

 701 GCAAGCTGCT GCCCGGACAC GGCGGCGTGT TCGACCGTAC CGACAGCCTG

 751 ATTGCCGTTA TCAGCGTCTA TGCAGCGATG ATGTCGGTTT TAAATTGA
```

This corresponds to the amino acid sequence <SEQ ID 1698; ORF 569>:

```
m569.pep..

       1  MLKQRVITAM WLLPLMLGML FYAPQWLWAA FCGLIALIAL WEYARMGGLC

      51  KIKTNHYLAA TLVFGVVAYA GGWMLPNLVW YVVLAFWLAV MPLWLRFKWR

     101  LNGGWQVYAV GWLLVMPFWF ALVSLRPHPD DALPLLAVMG LVWVADICAY

     151  FSGKAFGKHK IAPAISPGKS WEGAIGGAVC VAVYMTAVRS AGWLAFDTGW

     201  FDTVLIGLVL TVVSVCGDLL ESWLKRAAGI KDSSKLLPGH GGVFDRTDSL

     251  IAVISVYAAM MSVLN*

m569/g569  95.3% identity in 127 aa overlap

                   10        20        30        40        50        60
m569.pep    MLKQRVITAMWLLPLMLGMLFYAPQWLWAAFCGLIALIALWEYARMGGLCKIKTNHYLAA
            |||||||||||||||||||||||||||||||||||||| ||||||||:|||| :||||||
g569        MLKQRVITAMWLLPLMLGMLFYAPQWLWAAFCGLIALTALWEYARMAGLCKTETNHYLAA
                   10        20        30        40        50        60

                   70        80        90       100       110       120
m569.pep    TLVFGVVAYAGGWMLPNLVWYVVLAFWLAVMPLWLRFKWRLNGGWQVYAVGWLLVMPFWF
            ||||||||||||||||||||||||||||||||||||||||||||||||||||||:|||||
g569        TLVFGVVAYAGGWMLPNLVWYVVLAFWLAVMPLWLRFKWRLNGGWQVYAVGWLLLMPFWF
                   70        80        90       100       110       120
```

-continued

```
                130       140       150       160       170       180
m569.pep    ALVSLRPHPDDALPLLAVMGLVWVADICAYFSGKAFGKHKIAPAISPGKSWEGAIGGAVC
            ||||| |
g569        ALVSLAPASRX
                130
```

The following partial DNA sequence was identified in *N. meningitidis* <SEQ ID 1699>:

```
a569.seq
   1 ATGCTGAAAC AACGGGTGAT AACCGCCATG TGGCTGCTGC CGCTGATGCT

  51 GGGCATGCTG TTTTACGCGC CGCAATGGTT GTGGGCTGCA TTTTGCGGAC

 101 TGATTGCCCT GATTGCCTTG TGGGAATATG CCCGTATGGG CGGTTTGTGC

 151 AAAATTAAAA CCAACCATTA CCTCGCCGCA ACCTTGGTTT TCGGCGTGGT

 201 TGCCTATGCG GGCGGCTGGA TGCTGCCTAA TTTGGTTTGG TATGTTGTTT

 251 TGGCATTTTG GCTCGCCGTT ATGCCTTTAT GGTTGAGATT CAAATGGAGG

 301 CTCAACGGCG GTTGGCAGGT TTATGCCGTC GGCTGGCTTC TGGTCATGCC

 351 GTTTTGGTTC GCGCTCGTAT CCCTGCGCCC GCATCCCGAT GATGCCCTGC

 401 CGCTGCTCGC CGTGATGGGT TTGGTGTGGG TTGCCGATAT TTGCGCGTAT

 451 TTCAGCGGCA AGGCGTTCGG CAAACACAAA ATCGCACCGG CAATCAGCCC

 501 CGGCAAAAGC TGGGAAGGTG CAATCGGCGG CGCGGTTTGC GTGGCCGTGT

 551 ACATGACCGC CGTACGAAGT GCCGGCTGGC TGGCATTCGA TACAGGCTGG

 601 TTCGATACCG TGTTAATCGG TTTGGTGTTG ACCGTTGTCA GCGTATGCGG

 651 CGACCTTTTG GAAAGCTGGC TCAAGCGCGC GGCAGGCATC AAAGACAGCA

 701 GCAACCTGCT GCCCGGACAC GGCGGCGTGT TCGACCGCAC CGACAGCCTG

 751 ATTGCCGTTA TCAGCGTCTA TGCAGCGATG ATGTCGGTTT TAAATTGA
```

This corresponds to the amino acid sequence <SEQ ID 1700; ORF 569.a>:

```
a569.pep

      1 MLKQRVITAM WLLPLMLGML FYAPQWLWAA FCGLIALIAL WEYARMGGLC

     51 KIKTNHYLAA TLVFGVVAYA GGWMLPNLVW YVVLAFWLAV MPLWLRFKWR

    101 LNGGWQVYAV GWLLVMPFWF ALVSLRPHPD DALPLLAVMG LVWVADICAY

    151 FSGKAFGKHK IAPAISPGKS WEGAIGGAVC VAVYMTAVRS AGWLAFDTGW

    201 FDTVLIGLVL TVVSVCGDLL ESWLKRAAGI KDSSNLLPGH GGVFDRTDSL

    251 IAVISVYAAM MSVLN*

m569/a569  99.6% identity in 265 aa overlap

                 10        20        30        40        50        60
m569.pep    MLKQRVITAMWLLPLMLGMLFYAPQWLWAAFCGLIALIALWEYARMGGLCKIKTNHYLAA
            ||||||||||||||||||||||||||||||||||||||||||||||||||||||||||||
a569        MLKQRVITAMWLLPLMLGMLFYAPQWLWAAFCGLIALIALWEYARMGGLCKIKTNHYLAA
                 10        20        30        40        50        60

                 70        80        90       100       110       120
m569.pep    TLVFGVVAYAGGWMLPNLVWYVVLAFWLAVMPLWLRFKWRLNGGWQVYAVGWLLVMPFWF
            ||||||||||||||||||||||||||||||||||||||||||||||||||||||||||||
a569        TLVFGVVAYAGGWMLPNLVWYVVLAFWLAVMPLWLRFKWRLNGGWQVYAVGWLLVMPFWF
                 70        80        90       100       110       120

                130       140       150       160       170       180
m569.pep    ALVSLRPHPDDALPLLAVMGLVWVADICAYFSGKAFGKHKIAPAISPGKSWEGAIGGAVC
            ||||||||||||||||||||||||||||||||||||||||||||||||||||||||||||
a569        ALVSLRPHPDDALPLLAVMGLVWVADICAYFSGKAFGKHKIAPAISPGKSWEGAIGGAVC
                130       140       150       160       170       180
```

-continued

```
                190        200        210        220        230        240
m569.pep   VAVYMTAVRSAGWLAFDTGWFDTVLIGLVLTVVSVCGDLLESWLKRAAGIKDSSKLLPGH
           |||||||||||||||||||||||||||||||||||||||||||||||||||||:|||||
a569       VAVYMTAVRSAGWLAFDTGWFDTVLIGLVLTVVSVCGDLLESWLKRAAGIKDSSNLLPGH
                190        200        210        220        230        240

                250        260
m569.pep   GGVFDRTDSLIAVISVYAAMMSVLNX
           ||||||||||||||||||||||||||
a569       GGVFDRTDSLIAVISVYAAMMSVLNX
                250        260
```

The following partial DNA sequence was identified in *N. gonorrhoeae* <SEQ ID 1701>:

```
g570.seq..
  1 atgatccgtt tgacccgcgc gtttgccgcc gccctgatcg gtttatgctg

 51 caccacaggc gcgcacgccg acaccttcca aaaaatcggc tttatcaaca

101 ccgagcgcat ctacctcgaa tccaagcagg cgcgcaacat ccaaaaaacg

151 ctggacggcg aattttccgc ccgtcaggac gaattgcaaa aactgcaacg

201 cgaaggcttg gatttggaaa ggcagctcgc cggcggcaaa cttaaggacg

251 caaaaaaggc gcaagccgaa gaaaaatggc gcgggctggt cgaagcgttc

301 cgcaaaaaac aggcgcagtt tgaagaagac tacaacctcc gccgcaacga

351 agagtttgcc tccctccagc aaaacgccaa ccgcgtcatc gtcaaaatcg

401 ccaaacagga aggttacgat gtcattttgc aggacgtgat ttacgtcaac

451 acccaatacg acgttaccga cagcgtcatt aaagaaatga acgcccgctg

501 a
```

This corresponds to the amino acid sequence <SEQ ID 1702; ORF 570.ng>:

```
g570.pep..
  1 MIRLTRAFAA ALIGLCCTTG AHADTFQKIG FINTERIYLE SKQARNIQKT

 51 LDGEFSARQD ELQKLQREGL DLERQLAGGK LKDAKKAQAE EKWRGLVEAF

101 RKKQAQFEED YNLRRNEEFA SLQQNANRVI VKIAKQEGYD VILQDVIYVN

151 TQYDVTDSVI KEMNAR*
```

The following partial DNA sequence was identified in *N. meningitidis* <SEQ ID 1703>:

```
m570.seq..
  1 ATGACCCGTT TGACCCGCGC GTTTGCCGCG GCTCTGATCG GTTTGTGCTG

 51 CACCGCAGGC GCGCACGCCG ACACCTTCCA AAAAATCGGC TTTATCAACA

101 CCGAGCGCAT CTACCTCGAA TCCAAGCAGG CGCGCAAGAT TCAAAAAACG

151 CTGGACAGCG AATTTTCCGC TCGTCAGGAC GAATTGCAAA AACTGCAACG

201 CGAAGGTCTG GATTTGGAAA GGCAGCTTGC CGAAGGCAAA CTCAGAAACG

251 CAAAAAAGGC GCAAGCCGAA GAAAAATGGC GCGGGCTGGT CGCAGCGTTC

301 CGCAAAAAAC AGGCGCAGTT TGAAGAAGAC TACAACCTCC GCCGCAACGA

351 AGAGTTTGCC TCCCTCCAGC AAAACGCCAA CCGCGTCATC GTCAAAATCG

401 CCAAACAGGA AGGTTACGAT GTCATTTTGC AGAACGTGAT TTACGTCAAC
```

-continued

```
451 ACCCAATACG ACGTTACCGA CAGCGTCATT AAAGAAATGA ACGCCCGCTG

501 A
```

This corresponds to the amino acid sequence <SEQ ID 1704; ORF 570>:

```
m570.pep

      1    MTRLTRAFAA ALIGLCCTAG AHADTFQKIG FINTERIYLE SKQARKIQKT

     51    LDSEFSARQD ELQKLQREGL DLERQLAEGK LRNAKKAQAE EKWRGLVAAF

    101    RKKQAQFEED YNLRRNEEFA SLQQNANRVI VKIAKQEGYD VILQNVIYVN

    151    TQYDVTDSVI KEMNAR*

m570/g570  94.6% identity in 166 aa overlap

                   10        20        30        40        50        60
m570.pep    MTRLTRAFAAALIGLCCTAGAHADTFQKIGFINTERIYLESKQARKIQKTLDSEFSARQD
            | ||||||||||||||||:|||||||||||||||||||||||||||:||||||:|||||||
g570        MIRLTRAFAAALIGLCCTTGAHADTFQKIGFINTERIYLESKQARNIQKTLDGEFSARQD
                   10        20        30        40        50        60

                   70        80        90       100       110       120
m570.pep    ELQKLQREGLDLERQLAEGKLRNAKKAQAEEKWRGLVAAFRKKQAQFEEDYNLRRNEEFA
            |||||||||||||||| |||::|||||||||||||| |||||||||||||||||||||||
g570        ELQKLQREGLDLERQLAGGKLKDAKKAQAEEKWRGLVEAFRKKQAQFEEDYNLRRNEEFA
                   70        80        90       100       110       120

                  130       140       150       160
m570.pep    SLQQNANRVIVKIAKQEGYDVILQNVIYVNTQYDVTDSVIKEMNARX
            ||||||||||||||||||||||||:|||||||||||||||||||||||
g570        SLQQNANRVIVKIAKQEGYDVILQDVIYVNTQYDVTDSVIKEMNARX
                  130       140       150       160
```

The following partial DNA sequence was identified in *N. meningitidis* <SEQ ID 1705>:

```
a570.seq
  1 ATGACCCGTT TGACCCGCGC GTTTGCCGCG GCTCTGATCG GTTTGTGCTG

 51 CACCGCAGGC GCGCACGCCG ACACCTTCCA AAAAATCGGC TTTATCAACA

101 CCGAGCGCAT CTACCTCGAA TCCAAGCAGG CGCGCAAGAT TCAAAAAACG

151 CTGGACAGCG AATTTTCCGC CCGCCAGGAC GAATTGCAAA AACTGCAACG

201 CGAAGGTCTG GATTTGGAAA GGCAGCTTGC CGAAGGCAAA CTCAAAGACG

251 CAAAAAAGGC GCAAGCCGAA GAAAAATGGT GCGGGCTGGT CGCAGCGTTC

301 CGCAAAAAAC AGGCGCAGTT TGAAGAAGAC TACAACCTCC GCCGCAACGA

351 AGAGTTTGCC TCCCTCCAGC AAAACGCCAA CCGCGTCATC GTCAAAATCG

401 CCAAACAGGA AGGTTACGAT GTCATTTTGC AGGACGTGAT TTACGTCAAC

451 ACCCAATACG ACGTTACCGA CAGCGTCATT AAAGAAATGA ACGCCCGCTG

501 A
```

This corresponds to the amino acid sequence <SEQ ID 1706; ORF 570.a>:

```
a570.pep

      1    MTRLTRAFAA ALIGLCCTAG AHADTFQKIG FINTERIYLE SKQARKIQKT

     51    LDSEFSARQD ELQKLQREGL DLERQLAEGK LKDAKKAQAE EKWCGLVAAF

    101    RKKQAQFEED YNLRRNEEFA SLQQNANRVI VKIAKQEGYD VILQDVIYVN

    151    TQYDVTDSVI KEMNAR*
```

-continued

```
m570/a570 97.6% identity in 166 aa overlap

                 10        20        30        40        50        60
   m570.pep  MTRLTRAFAAALIGLCCTAGAHADTFQKIGFINTERIYLESKQARKIQKTLDSEFSARQD
             ||||||||||||||||||||||||||||||||||||||||||||||||||||||||||||
       a570  MTRLTRAFAAALIGLCCTAGAHADTFQKIGFINTERIYLESKQARKIQKTLDSEFSARQD
                 10        20        30        40        50        60

                 70        80        90       100       110       120
   m570.pep  ELQKLQREGLDLERQLAEGKLRNAKKAQAEEKWRGLVAAFRKKQAQFEEDYNLRRNEEFA
             |||||||||||||||||||||||::|||||||||| |||||||||||||||||||||||
       a570  ELQKLQREGLDLERQLAEGKLKDAKKAQAEEKWCGLVAAFRKKQAQFEEDYNLRRNEEFA
                 70        80        90       100       110       120

                130       140       150       160
   m570.pep  SLQQNANRVIVKIAKQEGYDVILQNVIYVNTQYDVTDSVIKEMNARX
             |||||||||||||||||||||||||:|||||||||||||||||||||
       a570  SLQQNANRVIVKIAKQEGYDVILQDVIYVNTQYDVTDSVIKEMNARX
                130       140       150       160
```

The following partial DNA sequence was identified in *N. gonorrhoeae* <SEQ ID 1707>:

```
g571.seq (partial)
   1 atgcgcgttt tccgagtaaa ccgatttgtt gttaccgttt tcggcggcgg

  51 tataggttct gccgtcccac acgctgcctg cgtcggcaaa caggctcagg

 101 cggacggtgc gtgcgtcttt cgcaccgggc atcgggaaga gcagctcggc

 151 ggagacgttg gcttttttgt tgccgccgta gctgattttt tcgccgtatt

 201 cgtcatacac tttcgggccg agcgtgccgc tttcgtagcc gcgcaccgaa

 251 cccaggccgc cgccgtagaa gttttcaaag aaggggattt ctttggttct

 301 gccgtagccg cccgcaatgc cgacttcgcc gccgagcatc agcgtgaagg

 351 ttttgct...
```

This corresponds to the amino acid sequence <SEQ ID 1708; ORF 571.ng>:

```
g571.pep (partial)
   1 MRVFRVNRFV VTVFGGGIGS AVPHAACVGK QAQADGACVF RTGHREEQLG

  51 GDVGFFVAAV ADFFAVFVIH FRAERAAFVA AHRTQAAAVE VFKEGDFFGS

 101 AVAARNADFA AEHQREGFA...
```

The following partial DNA sequence was identified in *N. meningitidis* <SEQ ID 1709>:

```
m571.seq
   1 ATGGGTATTG CCGGCGCCGT AAATGTTTTG AACCCTGCCG CCGGTCGCGG

  51 AACTGCTGTT GTCGTCGTAG GTTTTGCCGT CCCACACGCT GCCTGCGTCG

 101 GCAAACAGGC TCAGGCGGAC GGTGCGCGCG TCTTTCGCGC CGGGCATCGG

 151 GAAGAGCAGC TCGGCGGAGA CGTTGGCTTT TTTGTTGCCG CCGTAGCTGA

 201 TTTTTTCGCC GTATTCGTCA TAGACTTTCG GACCGAGCGT GCCGCTTTCG

 251 TATCCGCGCA CCGAACCCAG GCCGCCGCCG TAGAAGTTTT CAAAGAAGGG

 301 GATTTCTTTG GTTCTGCCGT AGCCGCCCGC AATGCCGACT TCGCCGCCGA

 351 GCATCAGCGT GAAGGTTTTG CTCAGGGGGA AGAACCAGGT TTGGTTGTGG

 401 GTGGCGGAGT AGTATTGCAG TTTGCTGCCA GGCAGGGCGA TTTCGGCGTT

 451 CACGCCCGTC AGGTAGCCGC GCGTCGGCCA TAA
```

This corresponds to the amino acid sequence <SEQ ID 1710; ORF 571>:

```
a571.pep

     1    MGIAGAVNVL NPAAGRGTAV VVVGFAVPHA ACVGKQAQAD GARVFRAGHR

    51    EEQLGGDVGF FVAAVADFFA VFVIDFRTER AAFVSAHRTQ AAAVEVFKEG

   101    DFFGSAVAAR NADFAAEHQR EGFAQGEEPG LVVGGGVVLQ FAARQGDFGV

   151    HARQVAARRP *
```

```
m571/g571 93.1% identity in 102 aa overlap

                  10        20        30        40        50        60
m571.pep  MGIAGAVNVLNPAAGRGTAVVVVGFAVPHAACVGKQAQADGARVFRAGHREEQLGGDVGF
                              :| |||||||||||||||| |||:|||||||||||||
g571            MRVFRVNRFVVTFGGGIGSAVPHAACVGKQAQADGACVFRTGHREEQLGGDVGF
                        10        20        30        40        50

                  70        80        90       100       110       120
m571.pep  FVAAVADFFAVFVIDFRTERAAFVSAHRTQAAAVEVFKEGDFFGSAVAARNADFAAEHQR
          |||||||||||||| ||:||||||:|||||||||||||||||||||||||||||||||||
g571      FVAAVADFFAVFVIHFRAERAAFVAAHRTQAAAVEVFKEGDFFGSAVAARNADFAAEHQR
            60        70        80        90       100       110

                 130       140       150       160
m571.pep  EGFAQGEEPGLVVGGGVVLQFAARQGDFGVHARQVAARRPX
          ||||
g571      EGFA
           119
```

The following partial DNA sequence was identified in *N. meningitidis* <SEQ ID 1711>:

```
a571.seq
  1 ATGGGTATTG CCGGCGCCGT AAATGTTTTG AACCCTGCCG CCGGTCGCGG

 51 AACTGCTGTT GTCGTCGTAG GTTTTGCCGT CCCACACGCT GCCTGCGTCG

101 GCAAACAGGC TCAGGCGGAC GGTGCGCGCG TCTTTCGCGC CGGGCATCGG

151 GAAGAGCAGC TCGGCGGAGA CGTTGGCTTT TTTGTTGCCG CCGTAGCTGA

201 TTTTTTCGCC GTATTCGTCA TACACTTTCG GACCGAGCGT GCCGCTTTCG

251 TATCCGCGCA CCGAACCCAG GCCGCCGCCG TAGAAGTTTT CAAAGAAGGG

301 GATTTCTTTG GTTCTGCCGT AGCCGCCCGC AATGCCGACT TCGCCGCCGA

351 GCATCAGCGT GAAGGTTTTG CTTAAGGGGA AGAACCAGGT TTGGTTGTGG

401 GTGGCGGAGT AGTATTGCAG TTTGCTGCCG GGCAGGGCGA TTTCGGCGTT

451 CACGCCCGTC AGGTAGCCGC GCGTCGGCCA TAA
```

This corresponds to the amino acid sequence <SEQ ID 1712; ORF 571.a>:

```
a571.pep

      1    MGIAGAVNVL NPAAGRGTAV VVVGFAVPHA ACVGKQAQAD GARVFRAGHR

     51    EEQLGGDVGF FVAAVADFFA VFVIHFRTER AAFVSAHRTQ AAAVEVFKEG

    101    DFFGSAVAAR NADFAAEHQR EGFA*GEEPG LVVGGGVVLQ FAAGQGDFGV

    151    HARQVAARRP *

m571/a571    98.1% identity in 160 aa overlap

                   10        20        30        40        50        60
m571.pep   MGIAGAVNVLNPAAGRGTAVVVVGFAVPHAACVGKQAQADGARVFRAGHREEQLGGDVGF
           ||||||||||||||||||||||||||||||||||||||||||||||||||||||||||||
a571       MGIAGAVNVLNPAAGRGTAVVVVGFAVPHAACVGKQAQADGARVFRAGHREEQLGGDVGF
                   10        20        30        40        50        60
```

-continued

```
                   70         80         90        100        110        120
m571.pep    FVAAVADFFAVFVIDFRTERAAFVSAHRTQAAAVEVFKEGDFFGSAVAARNADFAAEHQR
            |||||||||||||| |||||||||||||||||||||||||||||||||||||||||||||
a571        FVAAVADFFAVFVIHFRTERAAFVSAHRTQAAAVEVFKEGDFFGSAVAARNADFAAEHQR
                   70         80         90        100        110        120

                  130        140        150        160
m571.pep    EGFAQGEEPGLVVGGGVVLQFAARQGDFGVHARQVAARRPX
            |||| |||||||||||||||||| |||||||||||||||||
a571        EGFAXGEEPGLVVGGGVVLQFAAGQGDFGVHARQVAARRPX
                  130        140        150        160
```

The following partial DNA sequence was identified in *N. gonorrhoeae* <SEQ ID 1713>:

```
g572.seq..
   1 atgtgcgcca tcgtcggggc ggcggggctg ccttccgcgc tcgcagcggc

  51 gcaaaaaggc aaaaccattt atctggcaaa caaagaaacg ctggtggttt

 101 ccggcgcgtt gtttatggaa accgcccgcg caaacggcgc ggcagtgttg

 151 cccgtcgaca gcgaacacaa cgccattttc caagttttgc cgcgcgatta

 201 cacagaccgt ctgaacgaac acggcatcga ttcgattatc ctgaccgctt

 251 ccggcggccc gtttttaaca accgatttaa gcacgttcga cagcattacg

 301 cccgagcagg cggtcaaaca ccccaattgg cgtatggggc gcaaaatctc

 351 cgtcgattca gccactatgg caaacaaggg cttggaactg attgaagcgc

 401 attggctgtt caactgtccg cccgacaaac tcgaagtcgt catccatccc

 451 caatccgtga tacacagtat ggtgcgctac cgcgacggct ccgtgctggc

 501 gcaactgggc aatcccgata tgcgaacgcc catcgcctat tgtttgggct

 551 tgcccgagcg catcgattcg ggtgtcggca aactcgattt cggcgcattg

 601 tccgcgctga ccttccaaaa gcccgacttc ggccgcttcc cctgcctgaa

 651 gttcgcctat gaaaccataa acgcaggcgg agccgcgccc tgcgtattga

 701 acgccgccaa cgaaaccgcc gtcgccgcct ttttggacgg acagattaag

 751 tttaccgaca ttgccaaaac cgtcgcccac tgtcttgcac aagacttttc

 801 aaacggcatg ggcgatatag aaggactgtt ggcgcaagat gcccggacac

 851 gcgcacaagc gcgggcattt atcggcacac tgcgctga
```

This corresponds to the amino acid sequence <SEQ ID 1714; ORF 572.ng>:

```
g572.pep..
   1 MCAIVGAAGL PSALAAAQKG KTIYLANKET LVVSGALFME TARANGAAVL

  51 PVDSEHNAIF QVLPRDYTDR LNEHGIDSII LTASGGPFLT TDLSTFDSIT

 101 PEQAVKHPNW RMGRKISVDS ATMANKGLEL IEAHWLFNCP PDKLEVVIHP

 151 QSVIHSMVRY RDGSVLAQLG NPDMRTPIAY CLGLPERIDS GVGKLDFGAL

 201 SALTFQKPDF GRFPCLKFAY ETINAGGAAP CVLNAANETA VAAFLDGQIK
```

The following partial DNA sequence was identified in *N. meningitidis* <SEQ ID 1715>:

```
m572.seq..
   1 ATGTGCGCCA TCGTCGGGGC GGTGGGGCTG CCTTCCGCGC TCGCAGCGGC

  51 GCAAAAAGGC AAAACCATTT ATCTGGCAAA CAAAGAAACG CTGGTGGTTT
```

-continued

```
101 CCGGCGCGTT GTTTATGGAA ACCGCCCGTG CAAACGGCGC GGCAGTGCTG

151 CCCGTCGACA GCGAACACAA CGCCGTTTTC CAAGTTTTGC CGCGCGATTA

201 CGCCGGCCGT CTGAACGAAC ACGGCATCGC TTCGATTATC CTGACCGCTT

251 CCGGCGGCCC GTTTCTGACC GCCGATTTAA ACACGTTCGA CCGCATTACG

301 CCCGCCCAAG CGGTCAAACA CCCCAATTGG CGTATGGGAC GCAAAATCTC

351 CGTCGATTCC GCCACCATGA TGAACAAAGG TTTGGAGCTG ATTGAAGCGC

401 ATTGGCTGTT CAACTGTCCG CCCGACAAAC TCGAAGTCGT CATCCATCCG

451 CAATCCGTGA TACACAGCAT GGTGCGCTAC CGCGACGGCT CCGTGCTGGC

501 GCAACTGGGC AATCCCGATA TGCGAACGCC CATCGCTTAT TGTTTGGGTT

551 TGCCCGAGCG CATCGATTCG GGTGTCGGCG ACCTGGATTT CGACGCATTG

601 TCCGCGCTGA CCTTCCAAAA GCCCGACTTT GACCGCTTCC CCTGCCTGAG

651 GCTCGCCTAT GAAGCCATGA ACGCAGGCGG AGCCGCGCCC TGCGTATTGA

701 ACGCCGCCAA CGAAGCCGCC GTCGCCGCCT TTTTGGACGG ACAGATTAAG

751 TTTACCGACA TTGCCAAAAC CGTCGCCCAC TGTCTTGCAC AAGACTTTTC

801 AGACGGCATA GGCGATATAG GGGGGCTCTT GGCGCAAGAT GCCCGGACAC

851 GCGCACAAGC GCGAGCATTT ATCGGCACAC TGCGCTGA
```

This corresponds to the amino acid sequence <SEQ ID 1716; ORF 572>:

```
m572.pep..

      1    MCAIVGAVGL PSALAAAQKG KTIYLANKET LVVSGALFME TARANGAAVL

     51    PVDSEHNAVF QVLPRDYAGR LNEHGIASII LTASGGPFLT ADLNTFDRIT

    101    PAQAVKHPNW RMGRKISVDS ATMMNKGLEL IEAHWLFNCP PDKLEVVIHP

    151    QSVIHSMVRY RDGSVLAQLG NPDMRTPIAY CLGLPERIDS GVGDLDFDAL

    201    SALTFQKPDF DRFPCLRLAY EAMNAGGAAP CVLNAANEAA VAAFLDGQIK

    251    FTDIAKTVAH CLAQDFSDGI GDIGGLLAQD ARTRAQARAF IGTLR*

m572/g572  92.9% identity in 295 aa overlap

                   10        20        30        40        50        60
m572.pep   MCAIVGAVGLPSALAAAQKGKTIYLANKETLVVSGALFMETARANGAAVLPVDSEHNAVF
           |||||||:||||||||||||||||||||||||||||||||||||||||||||||||||:|
g572       MCAIVGAAGLPSALAAAQKGKTIYLANKETLVVSGALFMETARANGAAVLPVDSEHNAIF
                   10        20        30        40        50        60

                   70        80        90       100       110       120
m572.pep   QVLPRDYAGRLNEHGIASIILTASGGPFLTADLNTFDRITPAQAVKHPNWRMGRKISVDS
           |||||||: ||||||| |||||||||||||:||:||| ||| ||||||||||||||||||
g572       QVLPRDYTDRLNEHGIDSIILTASGGPFLTTDLSTFDSITPEQAVKHPNWRMGRKISVDS
                   70        80        90       100       110       120

                  130       140       150       160       170       180
m572.pep   ATMMNKGLELIEAHWLFNCPPDKLEVVIHPQSVIHSMVRYRDGSVLAQLGNPDMRTPIAY
           ||| ||||||||||||||||||||||||||||||||||||||||||||||||||||||||
g572       ATMANKGLELIEAHWLFNCPPDKLEVVIHPQSVIHSMVRYRDGSVLAQLGNPDMRTPIAY
                  130       140       150       160       170       180

                  190       200       210       220       230       240
m572.pep   CLGLPERIDSGVGDLDFDALSALTFQKPDFDRFPCLRLAYEAMNAGGAAPCVLNAANEAA
           ||||||||||||| |||| |||||||||||| |||||::|||::||||||||||||||:|
g572       CLGLPERIDSGVGKLDFGALSALTFQKPDFGRFPCLKFAYETINAGGAAPCVLNAANETA
                  190       200       210       220       230       240

                  250       260       270       280       290
m572.pep   VAAFLDGQIKFTDIAKTVAHCLAQDFSDGIGDIGGLLAQDARTRAQARAFIGTLRX
           |||||||||||||||||||||||||||:|:||| ||||||||||||||||||||||
g572       VAAFLDGQIKFTDIAKTVAHCLAQDFSNGMGDIEGLLAQDARTRAQARAFIGTLRX
                  250       260       270       280       290
```

The following partial DNA sequence was identified in *N. meningitidis* <SEQ ID 1717>:

```
a572.seq
   1 ATGTGCGCCA TCGTCGGGGC GGTGGGGCTG CCTTCCGCGC TCGCAGCGGC

  51 GCAAAAAGGC AAAACCATTT ATCTGGCGAA CAAAGAGACG CTGGTGGTTT

 101 CCGGCGCGTT GTTTATGGAA ACCGCCCGTG CAAACGGCGC GGCAGTGCTG

 151 CCCGTCGACA GCGAACACAA CGCCGTTTTC CAAGTTTTGC CGCGCGATTA

 201 CACAGGTCGC CTGAACGAAC ACGGCATCGC TTCGATTATC CTGACCGCTT

 251 CCGGCGGCCC GTTTCTGACC GCCGATTTAA ACACGTTCGA CAGCATTACG

 301 CCCGACCAAG CGGTCAAACA CCCCAATTGG CGTATGGGAC GCAAAATCTC

 351 CGTCGATTCC GCCACCATGA TGAACAAAGG TTTGGAGCTG ATTGAAGCGC

 401 ATTGGCTGTT CAACTGTCCG CCCGACAAAC TCGAAGTCGT CATCCATCCG

 451 CAATCTGTGA TACACAGCAT GGTGCGCTAC CGCGACGGCT CCGTGTTGGC

 501 GCAACTGGGC AATCCCGATA TGCGAACGCC TATCGCTTAT TGTTTGGGTT

 551 TGCCCGAGCG CATCGATTCG GGTGTCGGCG ACCTGGATTT CGACGCATTG

 601 TCCGCGCTGA CCTTCCAAAA GCCCGACTTT GACCGCTTCC CCTGCCTGAA

 651 GCTCGCCTAT GAAGCCATGA ACGCAGGCGG AGCCGCGCCC TGCGTATTGA

 701 ACGCCGCCAA CGAAGCCGCC GTCGCCGCCT TTTTGGACGG ACAGATTAAG

 751 TTTACCGACA TTGCCAAAAC CGTCGCCCAT TGTCTTTCAC AAGACTTTTC

 801 AGACGGCATA GGCGACATAG GGGGGCTCTT GGCGCAAGAT GCCCGGACAC

 851 GCGCACAAGC GCGGGCATTT ATCGGCACAC TGCGCTGA
```

This corresponds to the amino acid sequence <SEQ ID 1718; ORF 572.a>:

```
a572.pep

       1    MCAIVGAVGL PSALAAAQKG KTIYLANKET LVVSGALFME TARANGAAVL

      51    PVDSEHNAVF QVLPRDYTGR LNEHGIASII LTASGGPFLT ADLNTFDSIT

     101    PDQAVKHPNW RMGRKISVDS ATMMNKGLEL IEAHWLFNCP PDKLEVVIHP

     151    QSVIHSMVRY RDGSVLAQLG NPDMRTPIAY CLGLPERIDS GVGDLDFDAL

     201    SALTFQKPDF DRFPCLKLAY EAMNAGGAAP CVLNAANEAA VAAFLDGQIK

     251    FTDIAKTVAH CLSQDFSDGI GDIGGLLAQD ARTRAQARAF IGTLR*

m572/a572   98.3% identity in 295 aa overlap

                     10        20        30        40        50        60
m572.pep    MCAIVGAVGLPSALAAAQKGKTIYLANKETLVVSGALFMETARANGAAVLPVDSEHNAVF
            ||||||||||||||||||||||||||||||||||||||||||||||||||||||||||||
a572        MCAIVGAVGLPSALAAAQKGKTIYLANKETLVVSGALFMETARANGAAVLPVDSEHNAVF
                     10        20        30        40        50        60

                     70        80        90       100       110       120
m572.pep    QVLPRDYAGRLNEHGIASIILTASGGPFLTADLNTFDRITPAQAVKHPNWRMGRKISVDS
            |||||||:||||||||||||||||||||||||||||| ||| ||||||||||||||||||
a572        QVLPRDYTGRLNEHGIASIILTASGGPFLTADLNTFDSITPDQAVKHPNWRMGRKISVDS
                     70        80        90       100       110       120

                    130       140       150       160       170       180
m572.pep    ATMMNKGLELIEAHWLFNCPPDKLEVVIHPQSVIHSMVRYRDGSVLAQLGNPDMRTPIAY
            ||||||||||||||||||||||||||||||||||||||||||||||||||||||||||||
a572        ATMMNKGLELIEAHWLFNCPPDKLEVVIHPQSVIHSMVRYRDGSVLAQLGNPDMRTPIAY
                    130       140       150       160       170       180
```

-continued

```
                    190        200        210        220        230        240
m572.pep    CLGLPERIDSGVGDLDFDALSALTFQKPDFDRFPCLRLAYEAMNAGGAAPCVLNAANEAA
            ||||||||||||||||||||||||||||||||||||||:|||||||||||||||||||||
a572        CLGLPERIDSGVGDLDFDALSALTFQKPDFDRFPCLKLAYEAMNAGGAAPCVLNAANEAA
                    190        200        210        220        230        240

                    250        260        270        280        290
m572.pep    VAAFLDGQIKFTDIAKTVAHCLAQDFSDGIGDIGGLLAQDARTRAQARAFIGTLRX
            |||||||||||||||||||||:||||||||||||||||||||||||||||||||||
a572        VAAFLDGQIKFTDIAKTVAHCLSQDGSDGIGDIGGLLAQDARTRAQARAFIGTLRX
                    250        260        270        280        290
```

The following partial DNA sequence was identified in *N. gonorrhoeae* <SEQ ID 1719>:

```
g573.seq..
     1  atgccctgtt tgtgccgcct taatcgcaat atcggcagtt tccaaatcac
    51  gaatctcacc gaccataatg atgtccgggt cctgacgcag gaaagacttc
   101  aaagcagcgg caaaagtcag accctgctta tcattgacgt taacctgatt
   151  gatgcccggc aggttaatct cggcagggtc ttccgccgtt gcaatattta
   201  ccgactccgt attcaaaata ttcaaacagg tatagagcga caccgtctta
   251  cccgaacccg tcggaccggt taccagcacc atcccgtaag gacggtgaat
   301  cgcttccaac aacaattttt tctggaacgg ctcaaaaccg agctggtcga
   351  tgttcaaaga cgcggcatcg gaattcaaaa tccgcatcac gacctttttcg
   401  ccaaacagcg tcggcaatgt gctgacacgg aaatcgacag gcttgccgcc
   451  cttttgaaag gtcagctgca tcctaccgtc ctgcggtatc cgtttttcgg
   501  aaatgtccaa acgcgacatt accttaatcc gggaagcaag ctgccccctt
   551  accgcaatgg gcggctgaac cacctcgcgg agctgcccgt ccacacggaa
   601  acggatacgc gcattgtgtt cgtaaaactc gaaatggatg tcggatgccc
   651  cgctacgcaa ggcatccgac aaagttttat ggataaacct cggaacaggg
   701  ccgtcttctg cctcctcgtc gtcgatatac agggtgtggc tttcctcttc
   751  ctcttgcccc tccccaagct cctgaagcag cgatgtcgaa cgcgaaccca
   801  cccaatcgag caaacccgcc aactggtcat cctcgacaat gaccaactca
   851  accgcaatcc ctgcggcaga aaccgttttc tgaatttgcg gcatctgggt
   901  cggatcggaa accgcaaaaa atactttgtc gcccccacgg aaaaccggca
   951  cacagtggaa ctccaccatc tgctcctccg tcaacacccc catcagcacc
  1001  ctgtggcgcg gataatgacg caaatcaaga atcgaataac tgaacaccct
  1051  cgcaatcaat gccgcaagcg acttgggcga aatgacaccg tctga
```

This corresponds to the amino acid sequence <SEQ ID 1720; ORF 573.ng>:

```
g573.pep..
    1 MPCLCRLNRN IGSFQITNLT DHNDVRVLTQ ERLQSSGKSQ TLLIIDVNLI
   51 DARQVNLGRV FRRCNIYRLR IQNIQTGIER HRLTRTRRTG YQHHPVRTVN
  101 RFQQQFFLER LKTELVDVQR RGIGIQNPHH DLFAKQRRQC ADTEIDRLAA
  151 LLKGQLHPTV LRYPFFGNVQ TRHYLNPGSK LPPYRNGRLN HLAELPVHTE
  201 TDTRIVFVKL EMDVGCPATQ GIRQSFMDKP RNRAVFCLLV VDIQGVAFLF
  251 LLPLPKLLKQ RCRTRTHPIE QTRQLVILDN DQLNRNPCGR NRFLNLRHLG
```

-continued

```
301 RIGNRKKYFV APTENRHTVE LHHLLLRQHP HQHPVARIMT QIKNRITEHP

351 RNQCRKRLGR NDTV*
```

The following partial DNA sequence was identified in *N. meningitidis* <SEQ ID 1721>:

```
m573.seq..
   1 ATGCCCTGTT TGTGCCGCCT TAATCGCAAT ATCGGCAGTT TCCAAATCAC

  51 GAATCTCACC GACCATAATG ATGTCCGGGT CCTGACGCAG GAAAGACTTC

 101 AAAGCAGCGG CAAAAGTCAG GCCCTGCTTA TCATTGACGT TAACCTGATT

 151 GATGCCCGGC AGGTTAATCT CGGCAGGGTC TTCCGCCGTT GCAATATTTA

 201 CCGACTCCGT ATTCAAAATA TTCAAACAGG TATAGAGCGA CACCGTCTTA

 251 CCCGAACCCG TCGGACCGGT TACCAGCACC ATCCCGTAGG GACGGTGAAT

 301 CGCTACCAAC aCaw.TTTTT TCTGAAACGG CTCAAAACCG AGCTGGTCGA

 351 TGTTCAAAGA CGCGGCATCG GAATTCAAAA TCCGCATCAC GACCTTTTCG

 401 CCAAACAGCG TCGGCAATGT GCTGACACGG AAATCGACAG GCTTGCCGCC

 451 CTTTTGAAAG GTCAGCTGCA TCCTGCCGTC CTGCGGTATC CGTTTTTCGG

 501 AAATGTCCAA ACGCGACATT ACCTTAATCC GTGAAGCAAG CTGCCCCCTT

 551 ACCGCAATGG GCGGCTGAAC CACCTCGCGG AGCTGCCCGT CCACACGGAA

 601 ACGGATACGG GCATTGTGTT CGTAAAACTC GAAATGGATG TCCGATGCCC

 651 CGCTGCGCAA GGCATCCGAC AAAGTCTTAT GGATAAACCT CGGAACAGGG

 701 CCGTCTTCTG CCTCCTCGTT GTCGATATAC AGGGTGTGGC TTTCCTCTTC

 751 CTCCTGCCCC TCCCCAAGCT CCTGAAGCAG CGATGTCGAA CGCGAACCCA

 801 CCCAATCGAG CAAACCCGCC AACTGGTCAT CCTCGACAAT GACCAACTCA

 851 ACCTCAATCC CTGCGGCAGA AACGGTTTTC TGAATTTGCG GCATCTGTGT

 901 CGGATCGGAA ACCGCAAAAA ATACTTTGTC GCCCCGACGG AAAACCGGCA

 951 CACAGTGGAA CTCCACCATC TGCTCCTCCG TCAACACCCC CATCAGCACC

1001 CTGTGGCGCG GATAATGACG CAAATCAAGA ATCGAATAAC TGAACACCCT

1051 CGCAATCAAT GCCGCAAGCG ACTTGGGCGA AATGACACCG TCTGA
```

This corresponds to the amino acid sequence <SEQ ID 1722; ORF 573>:

```
m573.pep..

  1   MPCLCRLNRN IGSFQITNLT DHNDVRVLTQ ERLQSSGKSQ ALLIIDVNLI

 51   DARQVNLGRV FRRCNIYRLR IQNIQTGIER HRLTRTRRTG YQHHPVGTVN

101   RYQHXFFLKR LKTELVDVQR RGIGIQNPHH DLFAKQRRQC ADTEIDRLAA

151   LLKGQLHPAV LRYPFFGNVQ TRHYLNP*SK LPPYRNGRLN HLAELPVHTE

201   TDTGIVFVKL EMDVRCPAAQ GIRQSLMDKP RNRAVFCLLV VDIQGVAFLF

251   LLPLPKLLKQ RCRTRTHPIE QTRQLVILDN DQLNLNPCGR NGFLNLRHLC

301   RIGNRKKYFV APTENRHTVE LHHLLLRQHP HQHPVARIMT QIKNRITEHP

351   RNQCRKRLGR NDTV*
```

-continued

```
m573/g573 95.9% identity in 364 aa overlap

                    10        20        30        40        50        60
m573.pep    MPCLCRLNRNIGSFQITNLTDHNDVRVLTQERLQSSGKSQALLIIDVNLIDARQVNLGRV
            ||||||||||||||||||||||||||||||||||||||||:|||||||||||||||||||
g573        MPCLCRLNRNIGSFQITNLTDHNDVRVLTQERLQSSGKSQTLLIIDVNLIDARQVNLGRV
                    10        20        30        40        50        60

                    70        80        90       100       110       120
m573.pep    FRRCNIYRLRIQNIQTGIERHRLTRTRRTGYQHHPVGTVNRYQHXFFLKRLKTELVDVQR
            |||||||||||||||||||||||||||||||||||| ||||:|: |||:|||||||||||
g573        FRRCNIYRLRIQNIQTGIERHRLTRTRRTGYQHHPVRTVNRFQQQFFLERLKTELVDVQR
                    70        80        90       100       110       120

                   130       140       150       160       170       180
m573.pep    RGIGIQNPHHDLFAKQRRQCADTEIDRLAALLKGQLHPAVLRYPFFGNVQTRHYLNPXSK
            |||||||||||||||||||||||||||||||||||||||:||||||||||||||||| ||
g573        RGIGIQNPHHDLFAKQRRQCADTEIDRLAALLKGQLHPTVLRYPFFGNVQTRHYLNPGSK
                   130       140       150       160       170       180

                   190       200       210       220       230       240
m573.pep    LPPYRNGRLNHLAELPVHTETDTGIVFVKLEMDVRCPAAQGIRQSLMDKPPNRAVFCLLV
            ||||||||||||||||||||||| |||||||||| |||:||||||:||||||||||||||
g573        LPPYRNGRLNHLAELPVHTETDTRIVFVKLEMDVGCPATQGIRQSFMDKPPNRAVFCLLV
                   190       200       210       220       230       240

                   250       260       270       280       290       300
m573.pep    VDIQGVAFLFLLPLPKLLKQRCRTRTHPIEQTRQLVILDNDQLNLNPCGRNGFLNLRHLC
            ||||||||||||||||||||||||||||||||||||||||||||| |||||| |||||||
g573        VDIQGVAFLFLLPLPKLLKQRCRTRTHPIEQTRQLVILDNDQLNRNPCGRNRFLNLRHLC
                   250       260       270       280       290       300

                   310       320       330       340       350       360
m573.pep    RIGNRKKYFVAPTENRHTVELHHLLLRQHPHQHPVARIMTQIKNRITEHPRNQCRKRLGR
            ||||||||||||||||||||||||||||||||||||||||||||||||||||||||||||
g573        RIGNRKKYFVAPTENRHTVELHHLLLRQHPHQHPVARIMTQIKNRITEHPRNQCRKRLGR
                   310       320       330       340       350       360

m573.pep    NDTVX
            |||||
g573        NDTVX
```

The following partial DNA sequence was identified in *N. meningitidis* <SEQ ID 1723>:

```
a573.seq
   1  ATGCCCTGTT TGTGCCGCCT TAATCGCAAT ATCGGCAGTT TCCAAATCAC

  51  GAATCTCACC GACCATAATG ATGTCCGGGT CCTGACGCAG GAAAGACTTC

 101  AAAGCAGCGG CAAAAGTCAG ACCCTGCTTA TCATTGACGT TAACCTGATT

 151  GATGCCCGGC AGGTTAATCT CGGCAGGGTC TTCCGCCGTT GCAATATTTA

 201  CCGACTCCGT ATTCAAAATA TTCAAACAGG TATAGAGCGA CACCGTCTTA

 251  CCCGAACCCG TCGGACCGGT TACCAGCACC ATCCCGTAGG GACGGTGAAT

 301  CGCTTCCAAC AACAATTTTT TCTGAAACGG CTCAAAACCG AGCTGGTCGA

 351  TGTTCAAAGA CGCGGCATCG GAATTCAAAA TCCGCATCAC GACCTTTTCG

 401  CCAAACAGCG TCGGCAATGT GCTGACACGG AAATCGACAG GCTTGCCGCC

 451  CTTTTGAAAG GTCAGCTGCA TCCTGCCGTC CTGCGGTATC CGTTTTTCGG

 501  AAATGTCCAA ACGCGACATT ACCTTAATCC GGGAAGCAAG CTGCCCCCTT

 551  ACCGCAATGG GCGGCTGAAC CACCTCGCGG AGCTGCCCGT CCACACGGAA

 601  ACGGATACGG GCATTGTGTT CGTAAAACTC GAAATGGATG TCCGATGCCC

 651  CGCTGCGCAA GGCATCCGAC AAAGTCTTAT GGATAAACCT CGGAACAGGG

 701  CCGTCTTCTG CCTCCTCGTT GTCGATATAC AGGGTGTGGC TTTCCTCTTC

 751  CTCCTGCCCC TCCCCAAGCT CCTGAAGCAG CGATGTCGAA CGCGAACCCA

 801  CCCAATCGAG CAAACCCGCC AACTGGTCAT CCTCGACAAT GACCAACTCA

 851  ACCTCAATCC CTGCGGCAGA AACGGTTTTC TGAATTTGCG GCATCTGTGT

 901  CGGATCGGAA ACCGCAAAAA ATACTTTGTC GCCCCGACGG AAAACCGGCA
```

-continued

```
 951  CACAGTGGAA CTCCACCATC TGCTCCTCCG TCAACACCCC CATCAGCACC

1001  CTGTGGCGCG GATAATGACG CAAATCAAGA ATCGAATAAC TGAACACCCT

1051  CGCAATCAAT GCCGCAAGCG ACTTGGGCGA AATGACACCG TCTGA
```

This corresponds to the amino acid sequence <SEQ ID 1724; ORF 573.a>:

```
a573.pep

      1   MPCLCRLNRN IGSFQITNLT DHNDVRVLTQ ERLQSSGKSQ TLLIIDVNLI

     51   DARQVNLGRV FRRCNIYRLR IQNIQTGIER HRLTRTRRTG YQHHPVGTVN

    101   RFQQQFFLKR LKTELVDVQR RGIGIQNPHH DLFAKQRRQC ADTEIDRLAA

    151   LLKGQLHPAV LRYPFFGNVQ TRHYLNPGSK LPPYRNGRLN HLAELPVHTE

    201   TDTGIVFVKL EMDVRCPAAQ GIRQSLMDKP RNRAVFCLLV VDIQGVAFLF

    251   LLPLPKLLKQ RCRTRTHPIE QTRQLVILDN DQLNLNPCGR NGFLNLRHLC

    301   RIGNRKKYFV APTENRHTVE LHHLLLRQHP HQHPVARIMT QIKNRITEHP

    351   RNQCRKRLGR NDTV*

m573/a573   98.6% identity in 364 aa overlap

                   10        20        30        40        50        60
m573.pep    MPCLCRLNRNIGSFQITNLTDHNDVRVLTQERLQSSGKSQALLIIDVNLIDARQVNLGRV
            ||||||||||||||||||||||||||||||||||||||||:|||||||||||||||||||
a573        MPCLCRLNRNIGSFQITNLTDHNDVRVLTQERLQSSGKSQTLLIIDVNLIDARQVNLGRV
                   10        20        30        40        50        60

                   70        80        90       100       110       120
m573.pep    FRRCNIYRLRIQNIQTGIERHRLTRTRRTGYQHHPVGTVNRYQHXFFLKRLKTELVDVQR
            |||||||||||||||||||||||||||||||||||||||||:|: ||||||||||||||
a573        FRRCNIYRLRIQNIQTGIERHRLTRTRRTGYQHHPVGTVNRFQQQFFLKRLKTELVDVQR
                   70        80        90       100       110       120

                  130       140       150       160       170       180
m573.pep    RGIGIQNPHHDLFAKQRRQCADTEIDRLAALLKGQLHPAVLRYPFFGNVQTRHYLNPXSK
            ||||||||||||||||||||||||||||||||||||||||||||||||||||||||| ||
a573        RGIGIQNPHHDLFAKQRRQCADTEIDRLAALLKGQLHPAVLRYPFFGNVQTRHYLNPGSK

                  130       140       150       160       170       180

                  190       200       210       220       230       240
m573.pep    LPPYRNGRLNHLAELPVHTETDTGIVFVKLEMDVRCPAAQGIRQSLMDKPRNRAVFCLLV
            ||||||||||||||||||||||||||||||||||||||||||||||||||||||||||||
a573        LPPYRNGRLNHLAELPVHTETDTGIVFVKLEMDVRCPAAQGIRQSLMDKPRNRAVFCLLV

                  190       200       210       220       230       240

                  250       260       270       280       290       300
m573.pep    VDIQGVAFLFLLPLPKLLKQRCRTRTHPIEQTRQLVILDNDQLNLNPCGRNGFLNLRHLC
            ||||||||||||||||||||||||||||||||||||||||||||||||||||||||||||
a573        VDIQGVAFLFLLPLPKLLKQRCRTRTHPIEQTRQLVILDNDQLNLNPCGRNGFLNLRHLC

                  250       260       270       280       290       300

                  310       320       330       340       350       360
m573.pep    RIGNRKKYFVAPTENRHTVELHHLLLRQHPHQHPVARIMTQIKNRITEHPRNQCRKRLGR
            ||||||||||||||||||||||||||||||||||||||||||||||||||||||||||||
a573        RIGNRKKYFVAPTENRHTVELHHLLLRQHPHQHPVARIMTQIKNRITEHPRNQCRKRLGR
                  310       320       330       340       350       360

m573.pep    NDTVX
            |||||
a573        NDTVX
```

The following partial DNA sequence was identified in *N. gonorrhoeae* <SEQ ID 1725>:

```
g574.seq
   1  atgctgccga atctgccaaa cagccttaag aaagccgata tggacaacga

  51  attgtggatt atcctgctgc cgattatcct tttgcccgtc ttcttcacga

 101  tgggctggtt tgccgcccgc gtggatatga aaaccgtatt gaagcaggca
```

-continued

```
 151 aaaagcatcc cttcgggatt ttataaaagc ctggacgctt tggtcgaccg

 201 caacagcggg cgcgcggcaa gggagttggc ggaagtcgtc gacggccggc

 251 cgcaatcgta tgatttgaac cttaccctcg gcaaacttta ccgtcagcgc

 301 ggcgaaaacg acaaagccat caacatacac cggacaatgc tcgattctcc

 351 cgatacggtc ggcgaaaagc gcgcgcgcgt cctgtttgaa ttggcgcaaa

 401 actaccaaag cgcgggtttg gtcgatcgtg ccgaacagat ttttttgggg

 451 ctgcaagacg gtgaaatggc gcgtgaagcc agacagcacc tgctcaatat

 501 ctaccagcag gacagggatt gggaaaaagc ggttgaaacc gcccaacttc

 551 ttagtcacga cgaacagaca tatcagtttg agattgcaca gttttattgc

 601 gaacttgccc aagccgcgct gttcaagtcc aatttcgatg ccgcgcgttt

 651 caatgtcggc aaggcactcg aagccaacaa aaaatgcacc cgcgccaaca

 701 tgattttggg cgacattgaa caccgacaag gcaatttccc tgccgccgtc

 751 gaagcctatg ccgccatcga gcagcaaaac catgcatact tgagcatggt

 801 cggcgagaag ctttacgaag cctatgccgc gcagggaaaa cctgaagaag

 851 gcttgaaccg tctgacagga tatatgcaga cgtttcccga acttgacctg

 901 atcaatgtcg tgtacgagaa atccctgctg cttaagggcg agaaagaagc

 951 cgcgcaaacc gccgtcgagc ttgtccgccg caagcccgac cttaacggcg

1001 tgtaccgcct gctcggtttg aaactcagcg atttggatcc ggcttggaaa

1051 gccgatgccg acatgatgcg ttcggttatc ggacggcagc tccagcgcag

1101 cgtgatgtac cgttgccgca actgccactt caaatcccaa gtctttttct

1151 ggcactgtcc cgcctgcaac aaatggcaga cgtttacgcc gaataaaatc

1201 gaagtttaa
```

This corresponds to the amino acid sequence <SEQ ID 1726; ORF 574.ng>:

```
g574.pep..
   1 MLPNLPNSLK KADMDNELWI ILLPIILLPV FFTMGWFAAR VDMKTVLKQA

  51 KSIPSGFYKS LDALVDRNSG RAARELAEVV DGRPQSYDLN LTLGKLYRQR

 101 GENDKAINIH RTMLDSPDTV GEKRARVLFE LAQNYQSAGL VDRAEQIFLG

 151 LQDGEMAREA RQHLLNIYQQ DRDWEKAVET AQLLSHDEQT YQFEIAQFYC

 201 ELAQAALFKS NFDAARFNVG KALEANKKCT RANMILGDIE HRQGNFPAAV

 251 EAYAAIEQQN HAYLSMVGEK LYEAYAAQGK PEEGLNRLTG YMQTFPELDL

 301 INVVYEKSLL LKGEKEAAQT AVELVRRKPD LNGVYRLLGL KLSDLDPAWK

 351 ADADMMRSVI GRQLQRSVMY RCRNCHFKSQ VFFWHCPACN KWQTFTPNKI

 401 EV*
```

The following partial DNA sequence was identified in *N. meningitidis* <SEQ ID 1727>:

```
m574.seq..
   1  ATGCGCCCGA ATCTACCAAA CAGCCTTAAG AAAGCCGATA TGGACAACGA

  51  ATTGTGGATT ATCCTGCTGC CGATTATCCT TTTGCCCGTC TTCTTCGCGA

 101  TGGGCTGGTT TGCCGCCCGC GTGGATATGA AAACCGTATT GAAGCAGGCA
```

-continued

```
 151 AAAAGCATCC CTTCGGGATT TTATAAAAGC TTGGACGCTT TGGTCGACCG

 201 CAACAGCGGG CGCGCGGCAA GGGAGTTGGC GGAAGTCGTC GACGGCCGGC

 251 CGCAATCGTA TGATTTGAAC CTCACCCTCG GCAAACTTTA CCGCCAGCGT

 301 GGCGAAAACG ACAAAGCCAT CAACATACAC CGGACAATGC TCGATTCTCC

 351 CGATACGGTC GGCGAAAAGC GCGCGCGCGT CCTGTTTGAA TTGGCGCAAA

 401 ACTACCAAAG TGCGGGGTTG GTCGATCGTG CCGAACAGAT TTTTTTGGGG

 451 CTGCAAGACG GTAAAATGGC GCGTGAAGCC AGACAGCACC TGCTCAATAT

 501 CTACCAACAG GACAGGGATT GGGAAAAAGC GGTTGAAACC GCCCGGCTGC

 551 TCAGCCATGA CGATCAGACC TATCAGTTTG AAATCGCCCA GTTTTATTGC

 601 GAACTTGCCC AAGCCGCGCT GTTCAAGTCC AATTTCGATG TCGCGCGTTT

 651 CAATGTCGGC AAGGCACTCG AAGCCAACAA AAAATGCACC CGCGCCAACA

 701 TGATTTTGGG CGACATCGAA CACCGACAAG GCAATTTCCC TGCCGCCGTC

 751 GAAGCCTATG CCGCCATCGA GCAGCAAAAC CATGCATACT TGAGCATGGT

 801 CGGCGAGAAG CTTTACGAAG CCTATGCCGC GCAGGGAAAA CCTGAAGAAG

 851 GCTTGAACCG TCTGACAGGA TATATGCAGA CGTTTCCCGA ACTTGACCTG

 901 ATCAATGTCG TGTACGAGAA ATCCCTGCTG CTTAAGTGCG AGAAAGAAGC

 951 CGCGCAAACC GCCGTCGAGC TTGTCCGCCG CAAGCCCGAC CTTAACGGCG

1001 TGTACCGCCT GCTCGGTTTG AAACTCAGCG ATATGAATCC GGCTTGGAAA

1051 GCCGATGCCG ACATGATGCG TTCGGTTATC GGACGGCAGC TACAGCGCAG

1101 CGTGATGTAC CGTTGCCGCA ACTGCCACTT CAAATCCCAA GTCTTTTTCT

1151 GGCACTGCCC CGCCTGCAAC AAATGGCAGA CGTTTACCCC GAATAAAATC

1201 GAAGTTTAA
```

This corresponds to the amino acid sequence <SEQ ID 1728; ORF 574>:

```
m574.pep..

      1     MRPNLPNSLK KADMDNELWI ILLPIILLPV FFAMGWFAAR VDMKTVLKQA

     51     KSIPSGFYKS LDALVDRNSG RAARELAEVV DGRPQSYDLN LTLGKLYRQR

    101     GENDKAINIH RTMLDSPDTV GEKRARVLFE LAQNYQSAGL VDRAEQIFLG

    151     LQDGKMAREA RQHLLNIYQQ DRDWEKAVET ARLLSHDDQT YQFEIAQFYC

    201     ELAQAALFKS NFDVARFNVG KALEANKKCT RANMILGDIE HRQGNFPAAV

    251     EAYAAIEQQN HAYLSMVGEK LYEAYAAQGK PEEGLNRLTG YMQTFPELDL

    301     INVVYEKSLL LKCEKEAAQT AVELVRRKPD LNGVYRLLGL KLSDMNPAWK

    351     ADADMMRSVI GRQLQRSVMY RCRNCHFKSQ VFFWHCPACN KWQTFTPNKI

    401     EV*

m573/g573 97.8% identity in 402 aa overlap

                    10        20        30        40        50        60
m574.pep  MRPNLPNSLKKADMDNELWIILLPIILLPVFFAMGWFAARVDMKTVLKQAKSIPSGFYKS
          | |||||||||||||||||||||||||||||||:||||||||||||||||||||||||||
g574      MLPNLPNSLKKADMDNELWIILLPIILLPVFFTMGWFAARVDMKTVLKQAKSIPSGFYKS
                    10        20        30        40        50        60

                    70        80        90       100       110       120
m574.pep  LDALVDRNSGRAARELAEVVDGRPQSYDLNLTLGKLYRQRGENDKAINIHRTMLDSPDTV
          ||||||||||||||||||||||||||||||||||||||||||||||||||||||||||||
g574      LDALVDRNSGRAARELAEVVDGRPQSYDLNLTLGKLYRQRGENDKAINIHRTMLDSPDTV
                    70        80        90       100       110       120
```

-continued

```
               130        140        150        160        170        180
m574.pep  GEKRARVLFELAQNYQSAGLVDRAEQIFLGLQDGKMAREARQHLLNIYQQDRDWEKAVET
          |||||||||||||||||||||||||||||||||||:||||||||||||||||||||||||
g574      GEKRARVLFELAQNYQSAGLVDRAEQIFLGLQDGEMAREARQHLLNIYQQDRDWEKAVET
               130        140        150        160        170        180

               190        200        210        220        230        240
m574.pep  ARLLSHDDQTYQFEIAQFYCELAQAALFKSNFDVARFNVGKALEANKKCTRANMILGDIE
          |:|||||:||||||||||||||||||||||||||:|||||||||||||||||||||||||
g574      AQLLSHDEQTYQFEIAQFYCELAQAALFKSNFDAARFNVGKALEANKKCTRANMILGDIE
               190        200        210        220        230        240

               250        260        270        280        290        300
m574.pep  HRQGNFPAAVEAYAAIEQQNHAYLSMVGEKLYEAYAAQGKPEEGLNRLTGYMQTFPELDL
          ||||||||||||||||||||||||||||||||||||||||||||||||||||||||||||
g574      HRQGNFPAAVEAYAAIEQQNHAYLSMVGEKLYEAYAAQGKPEEGLNRLTGYMQTFPELDL
               250        260        270        280        290        300

               310        320        330        340        350        360
m574.pep  INVVYEKSLLLKCEKEAAQTAVELVRRKPDLNGVYRLLGLKLSDMNPAWKADADMMRSVI
          ||||||||||| ||||||||||||||||||||||||||||||||::||||||||||||||
g574      INVVYEKSLLLKGEKEAAQTAVELVRRKPDLNGVYRLLGLKLSDLDPAWKADADMMRSVI
               310        320        330        340        350        360

               370        380        390        400
m574.pep  GRQLQRSVMYRCRNCHFKSQVFFWHCPACNKWQTFTPNKIEVX
          |||||||||||||||||||||||||||||||||||||||||||
g574      GRQLQRSVMYRCRNCHFKSQVFFWHCPACNKWQTFTPNKIEVX
               370        380        390        400
```

The following partial DNA sequence was identified in *N. meningitidis* <SEQ ID 1729>:

```
a574.seq
     1  ATGCGCCCGA ATCTGCCAAA CAGCCTTGAG AAAGCCGATA TGGACAATGA

    51  ATTGTGGATT ATCCTGCTGC CGATTATCCT TTTGCCCGTT TTCTTCGCGA

   101  TGGGCTGGTT TGCCGCCCGC GTGGATATGA AGACTGTATT AAAGCAGGCA

   151  AAAAGCATAC CGTCGGGATT TTATAAAAGT CTGGATGCCT TGGTTGACCG

   201  CAACAGCGGG CGCGCGGCAA GGGAGTTGGC GGAAGTCGTC GACGGCCGGC

   251  CGCAATCGTA TGATTTGAAC CTCACCCTCG GCAAACTTTA CCGCCAGCGT

   301  GGCGAAAACG ACAAAGCCAT CAATATGCAC CAAACATTGC TTGACTCTCC

   351  CGATACAACC GGAGCCAAGC GCGCGCGCGT CCTGTTTGAA TTGGCGCAAA

   401  ACTACCAAAG TGCGGGGTTG GTCGATCGTG CCGAACAGAT TTTTTTGGGG

   451  CTGCAAGACG GTGAAATGGC GCGTGAAGCC AGACAGCACC TGCTCAATAT

   501  CTACCAACAG GACAGGGATT GGGAAAAAGC GGTTGAAACC GCCCGGCTGC

   551  TCAGCCATGA CGATCAGACC TATCAGTTTG AAATCGCCCA GTTTTATTGC

   601  GAACTTGCCC AAGCCGCGCT GTTCAAGTCC AATTTCGATG CCGCGCGTTT

   651  CAATGTCGGC AAGGCACTCG AAGCCAACAA AAAATGCACC CGCGCCAACA

   701  TGATTTTGGG CGACATCGAA CACCGACAAG GCAATTTCCC TGCCGCCGTC

   751  GAAGCCTATG CCGCCATCGA GCAGCAAAAC CATGCATACT TGAGTATGGT

   801  CGGCGAGAAG CTTTACGAAG CCTATGCCGC GCAGGGAAAA CCTGAAGAAG

   851  GCTTGAACCG TCTGACAGGA TATATGCAGA CGTTTCCCGA ACTTGACCTG

   901  ATCAATGTCG TGTACGAGAA ATCCCTGCTG CTTAAGTGCG AGAAAGAAGC

   951  CGCGCAAACC GCCGTCGAGC TTGTCCGCCG CAAGCCCGAC CTCAACGGCG

  1001  TGTACCGCCT GCTTGGTTTG AAACTCAGCG ATTTGGATCC GGCTTGGAAA

  1051  GCCGATGCCG ATATGATGCG TTCGGTTATC GGACGGCAGC TACAGCGCAG

  1101  CGTGATGTAC CGGTGCCGAA ACTGCCACTT CAAATCACAA GTCTTTTTCT
```

-continued

```
1151  GGCATTGTCC TGCCTGCAAC AAATGGCAGA CGTTTACGCC AAACAAAATC

1201  GAAGTTTAA
```

This corresponds to the amino acid sequence <SEQ ID 1730; ORF 574.a>:

```
a574.pep

      1    MRPNLPNSLE KADMDNELWI ILLPIILLPV FFAMGWFAAR VDMKTVLKQA

     51    KSIPSGFYKS LDALVDRNSG RAARELAEVV DGRPQSYDLN LTLGKLYRQR

    101    GENDKAINMH QTLLDSPDTT GAKRARVLFE LAQNYQSAGL VDRAEQIFLG

    151    LQDGEMAREA RQHLLNIYQQ DRDWEKAVET ARLLSHDDQT YQFEIAQFYC

    201    ELAQAALFKS NFDAARFNVG KALEANKKCT RANMILGDIE HRQGNFPAAV

    251    EAYAAIEQQN HAYLSMVGEK LYEAYAAQGK PEEGLNRLTG YMQTFPELDL

    301    INVVYEKSLL LKCEKEAAQT AVELVRRKPD LNGVYRLLGL KLSDLDPAWK

    351    ADADMMRSVI GRQLQRSVMY RCRNCHFKSQ VFFWHCPACN KWQTFTPNKI

    401    EV*

m574/a574   97.5% identity in 402 aa overlap

                   10        20        30        40        50        60
m574.pep    MRPNLPNSLKKADMDNELWIILLPIILLPVFFAMGWFAARVDMKTVLKQAKSIPSGFYKS
            |||||||||:||||||||||||||||||||||||||||||||||||||||||||||||||
a574        MRPNLPNSLEKADMDNELWIILLPIILLPVFFAMGWFAARVDMKTVLKQAKSIPSGFYKS
                   10        20        30        40        50        60

                   70        80        90       100       110       120
m574.pep    LDALVDRNSGRAARELAEVVDGRPQSYDLNLTLGKLYRQRGENDKAINIHRTMLDSPDTV
            ||||||||||||||||||||||||||||||||||||||||||||||||:|:|:||||||:
a574        LDALVDRNSGRAARELAEVVDGRPQSYDLNLTLGKLYRQRGENDKAINMHQTLLDSPDTT
                   70        80        90       100       110       120

                  130       140       150       160       170       180
m574.pep    GEKRARVLFELAQNYQSAGLVDRAEQIFLGLQDGKMAREARQHLLNIYQQDRDWEKAVET
            | ||||||||||||||||||||||||||||||||:|||||||||||||||||||||||||
a574        GAKRARVLFELAQNYQSAGLVDRAEQIFLGLQDGEMAREARQHLLNIYQQDRDWEKAVET

                  130       140       150       160       170       180

                  190       200       210       220       230       240
m574.pep    ARLLSHDDQTYQFEIAQFYCELAQAALFKSNFDVARFNVGKALEANKKCTRANMILGDIE
            |||||||||||||||||||||||||||||||||:||||||||||||||||||||||||||
a574        ARLLSHDDQTYQFEIAQFYCELAQAALFKSNFDAARFNVGKALEANKKCTRANMILGDIE

                  190       200       210       220       230       240
                  250       260       270       280       290       300
m574.pep    HRQGNFPAAVEAYAAIEQQNHAYLSMVGEKLYEAYAAQGKPEEGLNRLTGYMQTFPELDL
            ||||||||||||||||||||||||||||||||||||||||||||||||||||||||||||
a574        HRQGNFPAAVEAYAAIEQQNHAYLSMVGEKLYEAYAAQGKPEEGLNRLTGYMQTFPELDL

                  250       260       270       280       290       300
                  310       320       330       340       350       360
m574.pep    INVVYEKSLLLKCEKEAAQTAVELVRRKPDLNGVYRLLGLKLSDMNPAWKADADMMRSVI
            ||||||||||||||||||||||||||||||||||||||||||||::||||||||||||||
a574        INVVYEKSLLLKCEKEAAQTAVELVRRKPDLNGVYRLLGLKLSDLDPAWKADADMMRSVI

                  310       320       330       340       350       360
                  370       380       390       400
m574.pep    GRQLQRSVMYRCRNCHFKSQVFFWHCPACNKWQTFTPNKIEVX
            |||||||||||||||||||||||||||||||||||||||||||
a574        GRQLQRSVMYRCRNCHFKSQVFFWHCPACNKWQTFTPNKIEVX

                  370       380       390       400
```

The following partial DNA sequence was identified in *N. gonorrhoeae* <SEQ ID 1731>:

```
g575.seq (partial)
   1 ..atgccgtgcc tccgccggca agcagcaagg tgtacgaacc gccgaacaga

  51   ccgtcaaaca gtccgctttc ggtttcttct tcggcagaaa cctgttcgac

 101   aggttcggca acgggttcgg cggcaacttc actggctgtt tccgcaacag
```

-continued

```
151   gttcggaaac ggtgttaccg gtttcgtcgg tcggcgtgtc gatggcagaa
201   gcggcggctt cttggggggg cggattcggc agcggtttcc gatgcggcag
251   tatttgcagc gggtacaggt ccgggttggc gttctgtcgc cgaagccgga
301   gtttcggaca ctgcgggttt gggttcgggt cgaacggccg gtttttccgc
351   ttttgcttcg ggcgcggcaa cttttgcttc aggtttttca accggttttt
401   cgacaggttt ctctatcggt ttctccacag ttgcctgttt ggacggttca
451   gacggcatgg atgcagtttc ggctttgggt ttcgccgttt gcggtttggg
501   ttgttccgct ttgatttttt tgggtgctgc cgctttgatc ctgttcagat
551   tcggaatgtg a*
```

This corresponds to the amino acid sequence <SEQ ID 1732; ORF 575.ng>:

```
g575.pep (partial)
  1 ..MPCLRRQAAR CTNRRTDRQT VRFRFLLRQK PVRQVRQRVR RQLHWLFPQQ
 51   VRKRCYRFRR SACRWQKRRL LGGADSAAVS DAAVFAAGTG PGWRSVAEAG
101   VSDTAGLGSG RTAGFSAFAS GAATFASGFS TGFSTGFSIG FSTVACLDGS
151   DGMDAVSALG FAVCGLGCSA LIFLGAAALI LFRFGM*
```

The following partial DNA sequence was identified in *N. meningitidis* <SEQ ID 1733>:

```
m575.seq..
   1 ATGGTTTCGG GCGAGGAAGC CTTCAGGAAG CCTGCCAGTC CGGAGGGTGA
  51 GGCAGGTTTT GCGGAAGCTG TTTCTTCTGT GCCGATATGG TTGTTTGAGG
 101 GCAGGTTGTC GGAGAAATCG GTATCGACGG TTTCCGGTTT GTTTTCGGCA
 151 GTTTGGGCGA CAGATTCCGG TTCGGGCGTG TCGATGACGA TTTCGACAGG
 201 GTTGTACGGG TTGAAGGTCT CGGGCTCGTA CACGCTGTCT GTGGATTCGA
 251 TGGCGTTCCA ATCGGCATCC GCGCGTTTTT GGGTTTCTTC ATCCTGCGTA
 301 AGTGCGCCGG ATAAAATGCC GTTTTGCGCG GCTGCCAGGC TGTCGAAATC
 351 CAAGTCGATG CGGTTGGAAG GCGTATCGGT TTCGACATCG AACGTTTGTT
 401 TTGCCGATAA CTCTTCTTCA GATTCCCCAT CTAAGGCAAG TGTGTCGTTT
 451 ACATCGTTTT TCGGAGCGGG TTCGGGCGTT GCCGGAGTTT CGACTTCGGC
 501 AAAGGTGATT TCTATGCCGT CGTCTGCCGC GTCGTCAAGG TCAGGCTCTT
 551 CCTCAGGGAC GGATTCTTCG GTACGGCGCG CGCGTTTGGA TTGGGCAAGG
 601 CGCAAAAGCA GCAGCAGGGC GATTAATGCC GCGCCTCCGC CGGCAAGCAG
 651 CAAGGTGTAC GAACCGCCGA ACAGACCGTC AAACAGTCCG CTTTCGGTTT
 701 CTTCTTCGGC AGAAACCTGT TCGACAGGTT CGGAAACGGC GTTACCGGTT
 751 TCGTCGGTCG GCGTGTCGAT GGCAGAAGCG GCGGCTTCTT GGGGGGCGGA
 801 TTCGGCAGCG GTTTCCGATG CGGCAGTATT TGCAGCGGGT ACAGGTTCGG
 851 GTCGAACGGC CGGTTTTTCC GCTTTTGCTT CGGGCGCGGC AACTTTTGCT
 901 TCAGGTTTTT CAACCGGTTT CTCTACCGTT GCCTGTTTGG ACGGTTCGGA
 951 CGGCATGGAT GCGGTTTCGG CTTTGGGTTT CGCCGTTTGC GGTTTGGGTT
1001 GTTCCGCTTT GATCCTGTTC AGATTCGGAA TGTGA
```

This corresponds to the amino acid sequence <SEQ ID 1734; ORF 575>:

```
m575.pep

       1    MVSGEEAFRK PASPEGEAGF AEAVSSVPIW LFEGRLSEKS VSTVSGLFSA

      51    VWATDSGSGV SMTISTGLYG LKVSGSYTLS VDSMAFQSAS ARFWVSSSCV

     101    SAPDKMPFCA AARLSKSKSM RLEGVSVSTS NVCFADNSSS DSPSKASVSF

     151    TSFFGAGSGV AGVSTSAKVI SMPSSAASSR SGSSSGTDSS VRRARLDWAR

     201    RKSSSRAINA APPPASSKVY EPPNRPSNSP LSVSSSAETC STGSETALPV

     251    SSVGVSMAEA AASWGADSAA VSDAAVFAAG TGSGRTAGFS AFASGAATFA

     301    SGFSTGFSTV ACLDGSDGMD AVSALGFAVC GLGCSALILF RFGM*

m575/g575   70.2% identity in 114 aa overlap

               240       250       260       270       280
m575.pep    SSAETCSTGSETALPVSSVGVSMAEAAASWGADSAAVSDAAVFAAGTG------------
                                            ||||||||||||||||
g575        LHWLFPQQVRKRCYRFRRSACRWQKRRLLGGADSAAVSDAAVFAAGTGPGWRSVAEAGVS
                    50        60        70        80        90       100

                       290       300      309       310       320
m575.pep    ------SGRTAGFSAFASGAATFASGFSTGFST--------VACLDGSDGMDAVSALGFA
                  |||||||||||||||||||||||||        ||||||||||||||||||
g575        DTAGLGSGRTAGFSAFASGAATFASGFSTGFSTGFSIGFSTVACLDGSDGMDAVSALGFA
                   110       120       130       140       150      160

           330       340
m575.pep    VCGLGCSALI--------LFRFGMX
            ||||||||||        ||||||
g575        VCGLGCSALIFLGAAALILFRFGMX
                   170       180
```

The following partial DNA sequence was identified in *N. meningitidis* <SEQ ID 1735>:

```
a575.seq
   1  ATGGTTTCGG GCGAGGAAGC CTTCAGGAAG CCTGCCAGTC CGGAGGGTGA

  51  GGCAGGTTTT GCGGAAGCTG TTTCTTCTGT GCCGATATGG TTGTTTGAGG

 101  GCAGGTTGTC GGAGAAATCG GTATCGACGG TTTCCGGTTT GTTTTCGGCA

 151  GTTTGGGCGA CAGATTCCGG TTCGGGCGTG TCGATGACGA TTTCGACAGG

 201  GTTGTACGGG TTGAAGGTCT CGGGCTCGTA CACGCTGTCT GTGGATTCGA

 251  TGGCGTTCCA ATCGGCATCC GCGCGTTTTT GGGTTTCTTC ATCCTGCGTA

 301  AGTGCGCCGG ATAAAATGCC GTTTTGCGCG GCTGCCAGGC TGTCGAAATC

 351  CAAGTCGATG CGGTTGGAAG GCGTATCGGT TTCGACATCG AACGTTTGTT

 401  TTGCCGACAA CTCTTCTTCA GATTCCCCAT CTAAGGCAAG TGTGTCGTTT

 451  ACATCGTTTT TCGGAGCGGG TTCGGGCGTT GCCGGAGTTT CGACTTCGGC

 501  AAAGGTGATT TCTATGCCGT CGTCTGCCGC GTCGTCAAGG TCAGGCTCTT

 551  CCTCAGGGAC GGATTCTTCG GTACGGCGCG CGCGTTTGGA TTGGGCAAGG

 601  CGCAAAAGCA GCAGCAGGGC GATCAATGCC GCGCCTCCGC CGGCAAGCAG

 651  CAAGGTGTAC GAACCGCCGA ACAGTCCGCT TTCGGTTTCT TCTTCGGCAG

 701  AAACCTGTTC GACAGGTTCG GAAACGGCGT TACCGGTTTC GTCGGTCGGC

 751  GTGTCGATGG CAGAAGCGGC GGCTTCTTGG GGGGCGGATT CGGCAGCGGT

 801  TTCCGATGCG GCAGTATTTG CAGCGGGTAC AGGTTCGGGT CGAACGGCCG

 851  GTTTTTCCGC TTTTGCTTCG GGCGCGGCAA CTTTTGCTTC AGGTTTTTCA

 901  ACCGGTTTCT CTACCGTTGC CTGTTTGGAC GGTTCGGACG GCATGGATGC
```

-continued

```
 951  GGTTTCGGCT TTGGGTTTCG CCGTTTGCGG TTTGGGTTGT TCCGCTTTGA

1001  TCCTGTTCAG ATTCGGAATG TGA
```

This corresponds to the amino acid sequence <SEQ ID 1736; ORF 575.a>:

```
a575.pep

      1    MVSGEEAFRK PASPEGEAGF AEAVSSVPIW LFEGRLSEKS VSTVSGLFSA

     51    VWATDSGSGV SMTISTGLYG LKVSGSYTLS VDSMAFQSAS ARFWVSSSCV

    101    SAPDKMPFCA AARLSKSKSM RLEGVSVSTS NVCFADNSSS DSPSKASVSF

    151    TSFFGAGSGV AGVSTSAKVI SMPSSAASSR SGSSSGTDSS VRRARLDWAR

    201    RKSSSRAINA APPPASSKVY EPPNSPLSVS SSAETCSTGS ETALPVSSVG

    251    VSMAEAAASW GADSAAVSDA AVFAAGTGSG RTAGFSAFAS GAATFASGFS

    301    TFGSTVACLD GSDGMDAVSA LGFAVCGLGC SALILFRFGM *

m575/a575  98.8% identity in 344 aa overlap

                   10        20        30        40        50        60
m575.pep   MVSGEEAFRKPASPEGEAGFAEAVSSVPIWLFEGRLSEKSVSTVSGLFSAVWATDSGSGV
           ||||||||||||||||||||||||||||||||||||||||||||||||||||||||||||
a575       MVSGEEAFRKPASPEGEAGFAEAVSSVPIWLFEGRLSEKSVSTVSGLFSAVWATDSGSGV
                   10        20        30        40        50        60

                   70        80        90       100       110       120
m575.pep   SMTISTGLYGLKVSGSYTLSVDSMAFQSASARFWVSSSCVSAPDKMPFCAAARLSKSKSM
           ||||||||||||||||||||||||||||||||||||||||||||||||||||||||||||
a575       SMTISTGLYGLKVSGSYTLSVDSMAFQSASARFWVSSSCVSAPDKMPFCAAARLSKSKSM
                   70        80        90       100       110       120

                  130       140       150       160       170       180
m575.pep   RLEGVSVSTSNVCFADNSSSDSPSKASVSFTSFFGAGSGVAGVSTSAKVISMPSSAASSR
           ||||||||||||||||||||||||||||||||||||||||||||||||||||||||||||
a575       RLEGVSVSTSNVCFADNSSSDSPSKASVSFTSFFGAGSGVAGVSTSAKVISMPSSAASSR
                  130       140       150       160       170       180

                  190       200       210       220       230       240
m575.pep   SGSSSGTDSSVRRARLDWARRKSSSRAINAAPPPASSKVYEPPNRPSNSPLSVSSSAETC
           ||||||||||||||||||||||||||||||||||||||||||||    ||||||||||||
a575       SGSSSGTDSSVRRARLDWARRKSSSRAINAAPPPASSKVYEPPN----SPLSVSSSAETC
                  190       200       210       220           230

                  250       260       270       280       290       300
m575.pep   STGSETALPVSSVGVSMAEAAASWGADSAAVSDAAVFAAGTGSGRTAGFSAFASGAATFA
           ||||||||||||||||||||||||||||||||||||||||||||||||||||||||||||
a575       STGSETALPVSSVGVSMAEAAASWGADSAAVSDAAVFAAGTGSGRTAGFSAFASGAATFA
           240       250       260       270       280       290

                  310       320       330       340
m575.pep   SGFSTGFSTVACLDGSDGMDAVSALGFAVCGLGCSALILFRFGMX
           ||||||||||||||||||||||||||||||||||||||||||||
a575       SGFSTGFSTVACLDGSDGMDAVSALGFAVCGLGCSALILFRFGMX
            300       310       320       330       340
```

The following partial DNA sequence was identified in *N. gonorrhoeae* <SEQ ID 1737>:

```
g576.seq..(partial)
  1 ..atgggcgtgg acatcggacg ctccctgaaa caaatgaagg aacagggcgc

 51   ggaaatcgat ttgaaagtct ttaccgatgc catgcaggca gtgtatgacg

101   gcaaagaaat caaaatgacc gaagagcagg cccaggaagt gatgatgaaa

151   ttcctgcagg agcagcaggc taaagccgta gaaaaacaca aggcggatgc

201   gaaggccaac aaagaaaaag gcgaagcctt cctgaaggaa aatgccgccg

251   aagacggcgt gaagaccact gcttccggtc tgcagtacaa aatcaccaaa

301   cagggtgaag gcaaacagcc gacaaaagac gacatcgtta ccgtggaata
```

-continued

```
351   cgaaggccgc ctgattgacg gtaccgtatt cgacagcagc aaagccaacg

401   gcggcccggc caccttccct ttgagccaag tgattccggg ttggaccgaa

451   ggcgtacggc ttctgaaaga aggcggcgaa gccacgttct acatcccgtc

501   caaccttgcc taccgcgaac agggtgcggg cgaaaaaatc ggtccgaacg

551   ccactttggt atttgacgtg aaactggtca aaatcggcgc acccgaaaac

601   gcgcccgcca agcagccgga tcaagtcgac atcaaaaaag taaattaa
```

This corresponds to the amino acid sequence <SEQ ID 1738; ORF 576.ng>:

```
g576.pep..(partial)
   1 ..MGVDIGRSLK QMKEQGAEID LKVFTDAMQA VYDGKEIKMT EEQAQEVMMK

  51   FLQEQQAKAV EKHKADAKAN KEKGEAFLKE NAAEDGVKTT ASGLQYKITK

 101   QGEGKQPTKD DIVTVEYEGR LIDGTVFDSS KANGGPATFP LSQVIPGWTE

 151   GVRLLKEGGE ATFYIPSNLA YREQGAGEKI GPNATLVFDV KLVKIGAPEN

 201   APAKQPDQVD IKKVN*
```

The following partial DNA sequence was identified in *N. meningitidis* <SEQ ID 1739>:

```
m576.seq.. (partial)
   1 ..ATGCAGCAGG CAAGCTATGC GATGGGCGTG GACATCGGAC GCTCCCTGAA

  51   GCAAATGAAG GAACAGGGCG CGGAAATCGA TTTGAAAGTC TTTACCGAAG

 101   CCATGCAGGC AGTGTATGAC GGCAAAGAAA TCAAAATGAC CGAAGAGCAG

 151   GCTCAGGAAG TCATGATGAA ATTCCTTCAG GAACAACAGG CTAAAGCCGT

 201   AGAAAAACAC AAGGCGGACG CGAAGGCCAA TAAAGAAAAA GGCGAAGCCT

 251   TTCTGAAAGA AAATGCCGCC AAAGACGGCG TGAAGACCAC TGCTTCCGGC

 301   CTGCAATACA AAATCACCAA ACAGGGCGAA GGCAAACAGC CGACCAAAGA

 351   CGACATCGTT ACCGTGGAAT ACGAAGGCCG CCTGATTGAC GGTACGGTAT

 401   TCGACAGCAG CAAAGCCAAC GGCGGCCCGG TCACCTTCCC TTTGAGCCAA

 451   GTGATTCCGG GTTGGACCGA AGgCGTACAG CTTCTGAAAG AAGGCGGCGA

 501   AGCCACGTTC TACATCCCGT CCAACCTTGC CTACCGCGAA CAGGGTGCGG

 551   GCGACAAAAT CGGTCCGAAC GCCACTTTGG TATTTGATGT GAAACTGGTC

 601   AAAATCGGCG CACCCGAAAA CGCGCCCGCC AAGCAGCCGG CTCAAGTCGA

 651   CATCAAAAAA GTAAATTAA
```

This corresponds to the amino acid sequence <SEQ ID 1740; ORF 576>:

```
m576.pep.. (partial)
   1 ..MQQASYAMGV DIGRSLKQMK EQGAEIDLKV FTEAMQAVYD GKEIKMTEEQ

  51   AQEVMMKFLQ EQQAKAVEKH KADAKANKEK GEAFLKENAA KDGVKTTASG

 101   LQYKITKQGE GKQPTKDDIV TVEYEGRLID GTVFDSSKAN GGPVTFPLSQ

 151   VIPGWTEGVQ LLKEGGEATF YIPSNLAYRE QGAGDKIGPN ATLVFDVKLV

 201   KIGAPENAPA KQPAQVDIKK VN*
```

Computer analysis of this amino acid sequence gave the following results:

Homology with a Predicted ORF from *N. gonorrhoeae*

```
m576/g576 97.2% identity in 215 aa overlap

                    10        20        30        40        50        60
m576.pep   MQQASYAMGVDIGRSLKQMKEQGAEIDLKVFTEAMQAVYDGKEIKMTEEQAQEVMMKFLQ
                     ||||||||||||||||||||||:|||||||||||||||||||||||||||
g576                 MGVDIGRSLKQMKEQGAEIDLKVFTDAMQAVYDGKEIKMTEEQAQEVMMKFLQ
                             10        20        30        40        50

                    70        80        90       100       110       120
m576.pep   EQQAKAVEKHKADAKANKEKGEAFLKENAAKDGVKTTASGLQYKITKQGEGKQPTKDDIV
           ||||||||||||||||||||||||||||||:|||||||||||||||||||||||||||||
g576       EQQAKAVEKHKADAKANKEKGEAFLKENAAEDGVKTTASGLQYKITKQGEGKQPTKDDIV
                 60        70        80        90       100       110

                   130       140       150       160       170       180
m576.pep   TVEYEGRLIDGTVFDSSKANGGPVTFPLSQVIPGWTEGVQLLKEGGEATFYIPSNLAYRE
           |||||||||||||||||||||||:|||||||||||||||:||||||||||||||||||||
g576       TVEYEGRLIDGTVFDSSKANGGPATFPLSQVIPGWTEGVRLLKEGGEATFYIPSNLAYRE
                120       130       140       150       160       170

                   190       200       210       220
m576.pep   QGAGDKIGPNATLVFDVKLVKIGAPENAPAKQPAQVDIKKVNX
           ||||:|||||||||||||||||||||||||||| |||||||||
g576       QGAGEKIGPNATLVFDVKLVKIGAPENAPAKQPDQVDIKKVNX
                180       190       200       210
```

The following partial DNA sequence was identified in *N. meningitidis* <SEQ ID 1741>:

```
a576.seq
  1 ATGAACACCA TTTTCAAAAT CAGCGCACTG ACCCTTTCCG CCGCTTTGGC

 51 ACTTTCCGCC TGCGGCAAAA AAGAAGCCGC CCCCGCATCT GCATCCGAAC

101 CTGCCGCCGC TTCTTCCGCG CAGGGCGACA CCTCTTCGAT CGGCAGCACG

151 ATGCAGCAGG CAAGCTATGC GATGGGCGTG GACATCGGAC GCTCCCTGAA

201 GCAAATGAAG GAACAGGGCG CGGAAATCGA TTTGAAAGTC TTTACCGAAG

251 CCATGCAGGC AGTGTATGAC GGCAAAGAAA TCAAAATGAC CGAAGAGCAG

301 GCTCAGGAAG TCATGATGAA ATTCCTTCAG GAACAACAGG CTAAAGCCGT

351 AGAAAAACAC AAGGCGGACG CGAAGGCCAA TAAAGAAAAA GGCGAAGCCT

401 TTCTGAAAGA AAATGCCGCC AAAGACGGCG TGAAGACCAC TGCTTCCGGC

451 CTGCAATACA AAATCACCAA ACAGGGCGAA GGCAAACAGC CGACCAAAGA

501 CGACATCGTT ACCGTGGAAT ACGAAGGCCG CCTGATTGAC GGTACGGTAT

551 TCGACAGCAG CAAAGCCAAC GGCGGCCCGG TCACCTTCCC TTTGAGCCAA

601 GTGATTCTGG GTTGGACCGA AGGCGTACAG CTTCTGAAAG AAGGCGGCGA

651 AGCCACGTTC TACATCCCGT CCAACCTTGC CTACCGCGAA CAGGGTGCGG

701 GCGACAAAAT CGGCCCGAAC GCCACTTTGG TATTTGATGT GAAACTGGTC

751 AAAATCGGCG CACCCGAAAA CGCGCCCGCC AAGCAGCCGG CTCAAGTCGA

801 CATCAAAAAA GTAAATTAA
```

This corresponds to the amino acid sequence <SEQ ID 1742; ORF 576.a>:

```
a576.pep

      1    MNTIFKISAL TLSAALALSA CGKKEAAPAS ASEPAAASSA QGDTSSIGST

     51    MQQASYAMGV DIGRSLKQMK EQGAEIDLKV FTEAMQAVYD GKEIKMTEEQ

    101    AQEVMMKFLQ EQQAKAVEKH KADAKANKEK GEAFLKENAA KDGVKTTASG
```

-continued

```
151     LQYKITKQGE GKQPTKDDIV TVEYEGRLID GTVFDSSKAN GGPVTFPLSQ

201     VILGWTEGVQ LLKEGGEATF YIPSNLAYRE QGAGDKIGPN ATLVFDVKLN

251     KIGAPENAPA KQPAQVDIKK VN*

m576/a576   99.5% identity in 222 aa overlap

                                                   10        20        30
m576.pep                                   MQQASYAMGVDIGRSLKQMKEQGAEIDLKV
                                           ||||||||||||||||||||||||||||||
a576        CGKKEAAPASASEPAAASSAQGDTSSIGSTMQQASYAMGVDIGRSLKQMKEQGAEIDLKV
                    30        40        50        60        70        80

                    40        50        60        70        80        90
m576.pep    FTEAMQAVYDGKEIKMTEEQAQEVMMKFLQEQQAKAVEKHKADAKANKEKGEAFLKENAA
            ||||||||||||||||||||||||||||||||||||||||||||||||||||||||||||
a576        FTEAMQAVYDGKEIKMTEEQAQEVMMKFLQEQQAKAVEKHKADAKANKEKGEAFLKENAA
                    90       100       110       120       130       140

                   100       110       120       130       140       150
m576.pep    KDGVKTTASGLQYKITKQGEGKQPTKDDIVTVEYEGRLIDGTVFDSSKANGGPVTFPLSQ
            ||||||||||||||||||||||||||||||||||||||||||||||||||||||||||||
a576        KDGVKTTASGLQYKITKQGEGKQPTKDDIVTVEYEGRLIDGTVFDSSKANGGPVTFPLSQ
                   150       160       170       180       190       200

                     160       170       180       190       200       210
m576.pep    VIPGWTEGVQLLKEGGEATFYIPSNLAYREQGAGDKIGPNATLVFDVKLVKIGAPENAPA
            || ||||||||||||||||||||||||||||||||||||||||| ||||||||||||||||
a576        VILGWTEGVQLLKEGGEATFYIPSNLAYREQGAGDKIGPNATLVGDVKLVKIGAPENAPA
                   210       220       230       240       250       260

                   220
m576.pep    KQPAQVDIKKVNX
            |||||||||||||
a576        KQPAQVDIKKVNX
                   270
```

The following partial DNA sequence was identified in *N. gonorrhoeae* <SEQ ID 1743>:

```
g576-1.seq
  1 ATGAACACCA TTTTCAAAAT CAGCGCACTG ACCCTTTCCG CCGCTTTGGC

 51 ACTTTCCGCC TGCGGCAAAA AAGAAGCCGC CCCCGCATCT GCATCCGAAC

101 CTGCCGCCGC TTCTGCCGCG CAGGGCGACA CCTCTTCAAT CGGCAGCACG

151 ATGCAGCAGG CAAGCTATGC AATGGGCGTG GACATCGGAC GCTCCCTGAA

201 ACAAATGAAG GAACAGGGCG CGGAAATCGA TTTGAAAGTC TTTACCGATG

251 CCATGCAGGC AGTGTATGAC GGCAAAGAAA TCAAAATGAC CGAAGAGCAG

301 GCCCAGGAAG TGATGATGAA ATTCCTGCAG GAGCAGCAGG CTAAAGCCGT

351 AGAAAAACAC AAGGCGGATG CGAAGGCCAA CAAAGAAAAA GGCGAAGCCT

401 TCCTGAAGGA AAATGCCGCC AAAGACGGCG TGAAGACCAC TGCTTCCGGT

451 CTGCAGTACA AAATCACCAA ACAGGGTGAA GGCAAACAGC CGACAAAAGA

501 CGACATCGTT ACCGTGGAAT ACGAAGGCCG CCTGATTGAC GGTACCGTAT

551 TCGACAGCAG CAAAGCCAAC GGCGGCCCGG CCACCTTCCC TTTGAGCCAA

601 GTGATTCCGG GTTGGACCGA AGGCGTACGG CTTCTGAAAG AAGGCGGCGA

651 AGCCACGTTC TACATCCCGT CCAACCTTGC CTACCGCGAA CAGGGTGCGG

701 GCGAAAAAAT CGGTCCGAAC GCCACTTTGG TATTTGACGT GAAACTGGTC

751 AAAATCGGCG CACCCGAAAA CGCGCCCGCC AAGCAGCCGG ATCAAGTCGA

801 CATCAAAAAA GTAAATTAA
```

This corresponds to the amino acid sequence <SEQ ID 1744; ORF 576-1.ng>:

```
g576-1.pep
   1 MNTIFKISAL TLSAALALSA CGKKEAAPAS ASEPAAASAA QGDTSSIGST
  51 MQQASYAMGV DIGRSLKQMK EQGAEIDLKV FTDAMQAVYD GKEIKMTEEQ
 101 AQEVMMKFLQ EQQAKAVEKH KADAKANKEK GEAFLKENAA KDGVKTTASG
 151 LQYKITKQGE GKQPTKDDIV TVEYEGRLID GTVFDSSKAN GGPATFPLSQ
 201 VIPGWTEGVR LLKEGGEATF YIPSNLAYRE QGAGEKIGPN ATLVFDVKLV
 251 KIGAPENAPA KQPDQVDIKK VN*
```

The following partial DNA sequence was identified in *N. meningitidis* <SEQ ID 1745>:

```
m576-1.seq
   1 ATGAACACCA TTTTCAAAAT CAGCGCACTG ACCCTTTCCG CCGCTTTGGC
  51 ACTTTCCGCC TGCGGCAAAA AAGAAGCCGC CCCCGCATCT GCATCCGAAC
 101 CTGCCGCCGC TTCTTCCGCG CAGGGCGACA CCTCTTCGAT CGGCAGCACG
 151 ATGCAGCAGG CAAGCTATGC GATGGGCGTG GACATCGGAC GCTCCCTGAA
 201 GCAAATGAAG GAACAGGGCG CGGAAATCGA TTTGAAAGTC TTTACCGAAG
 251 CCATGCAGGC AGTGTATGAC GGCAAAGAAA TCAAAATGAC CGAAGAGCAG
 301 GCTCAGGAAG TCATGATGAA ATTCCTTCAG GAACAACAGG CTAAAGCCGT
 351 AGAAAAACAC AAGGCGGACG CGAAGGCCAA TAAAGAAAAA GGCGAAGCCT
 401 TTCTGAAAGA AAATGCCGCC AAAGACGGCG TGAAGACCAC TGCTTCCGGC
 451 CTGCAATACA AAATCACCAA ACAGGGCGAA GGCAAACAGC CGACCAAAGA
 501 CGACATCGTT ACCGTGGAAT ACGAAGGCCG CCTGATTGAC GGTACGGTAT
 551 TCGACAGCAG CAAAGCCAAC GGCGGCCCGG TCACCTTCCC TTTGAGCCAA
 601 GTGATTCCGG GTTGGACCGA AGGCGTACAG CTTCTGAAAG AAGGCGGCGA
 651 AGCCACGTTC TACATCCCGT CCAACCTTGC CTACCGCGAA CAGGGTGCGG
 701 GCGACAAAAT CGGTCCGAAC GCCACTTTGG TATTTGATGT GAAACTGGTC
 751 AAAATCGGCG CACCCGAAAA CGCGCCCGCC AAGCAGCCGG CTCAAGTCGA
 801 CATCAAAAAA GTAAATTAA
```

This corresponds to the amino acid sequence <SEQ ID 1746; ORF 576-1>:

```
m576-1.pep
   1     MNTIFKISAL TLSAALALSA CGKKEAAPAS ASEPAAASSA QGDTSSIGST
  51     MQQASYAMGV DIGRSLKQMK EQGAEIDLKV FTEAMQAVYD GKEIKMTEEQ
 101     AQEVMMKFLQ EQQAKAVEKH KADAKANKEK GEAFLKENAA KDGVKTTASG
 151     LQYKITKQGE GKQPTKDDIV TVEYEGRLID GTVFDSSKAN GGPVTFPLSQ
 201     VIPGWTEGVQ LLKEGGEATF YIPSNLAYRE QGAGDKIGPN ATLVFDVKLV
 251     KIGAPENAPA KQPAQVDIKK VN*
```

-continued

```
g576-1/m576-1 97.8% identity in 272 aa overlap

                    10        20        30        40        50        60
g576-1.pep  MNTIFKISALTLSAALALSACGKKEAAPASASEPAAASAAQGDTSSIGSTMQQASYAMGV
            ||||||||||||||||||||||||||||||||||||||:|||||||||||||||||||||
m576-1      MNTIFKISALTLSAALALSACGKKEAAPASASEPAAASSAQGDTSSIGSTMQQASYAMGV
                    10        20        30        40        50        60

                    70        80        90       100       110       120
g576-1.pep  DIGRSLKQMKEQGAEIDLKVFTDAMQAVYDGKEIKMTEEQAQEVMMKFLQEQQAKAVEKH
            ||||||||||||||||||||||:|||||||||||||||||||||||||||||||||||||
m576-1      DIGRSLKQMKEQGAEIDLKVFTEAMQAVYDGKEIKMTEEQAQEVMMKFLQEQQAKAVEKH
                    70        80        90       100       110       120

                   130       140       150       160       170       180
g576-1.pep  KADAKANKEKGEAFLKENAAKDGVKTTASGLQYKITKQGEGKQPTKDDIVTVEYEGRLID
            ||||||||||||||||||||||||||||||||||||||||||||||||||||||||||||
m576-1      KADAKANKEKGEAFLKENAAKDGVKTTASGLQYKITKQGEGKQPTKDDIVTVEYEGRLID
                   130       140       150       160       170       180

                   190       200       210       220       230       240
g576-1.pep  GTVFDSSKANGGPATFPLSQVIPGWTEGVRLLKEGGEATFYIPSNLAYREQGAGEKIGPN
            |||||||||||||:|||||||||||||||:||||||||||||||||||||||||||:|||||
m576-1      GTVFDSSKANGGPVTFPLSQVIPGWTEGVQLLKEGGEATFYIPSNLAYREQGAGDKIGPN
                   190       200       210       220       230       240

                   250       260       270
g576-1.pep  ATLVFDVKLVKIGAPENAPAKQPDQVDIKKVNX
            ||||||||||||||||||||||| |||||||||
m576-1      ATLVFDVKLVKIGAPENAPAKQPAQVDIKKVNX
                   250       260       270
```

The following partial DNA sequence was identified in *N. meningitidis* <SEQ ID 1747>:

```
a576-1.seq
   1 ATGAACACCA TTTTCAAAAT CAGCGCACTG ACCCTTTCCG CCGCTTTGGC

  51 ACTTTCCGCC TGCGGCAAAA AAGAAGCCGC CCCCGCATCT GCATCCGAAC

 101 CTGCCGCCGC TTCTTCCGCG CAGGGCGACA CCTCTTCGAT CGGCAGCACG

 151 ATGCAGCAGG CAAGCTATGC GATGGGCGTG GACATCGGAC GCTCCCTGAA

 201 GCAAATGAAG GAACAGGGCG CGGAAATCGA TTTGAAAGTC TTTACCGAAG

 251 CCATGCAGGC AGTGTATGAC GGCAAAGAAA TCAAAATGAC CGAAGAGCAG

 301 GCTCAGGAAG TCATGATGAA ATTCCTTCAG GAACAACAGG CTAAAGCCGT

 351 AGAAAAACAC AAGGCGGACG CGAAGGCCAA TAAAGAAAAA GGCGAAGCCT

 401 TTCTGAAAGA AAATGCCGCC AAAGACGGCG TGAAGACCAC TGCTTCCGGC

 451 CTGCAATACA AAATCACCAA ACAGGGCGAA GGCAAACAGC CGACCAAAGA

 501 CGACATCGTT ACCGTGGAAT ACGAAGGCCG CCTGATTGAC GGTACGGTAT

 551 TCGACAGCAG CAAAGCCAAC GGCGGCCCGG TCACCTTCCC TTTGAGCCAA

 601 GTGATTCTGG GTTGGACCGA AGGCGTACAG CTTCTGAAAG AAGGCGGCGA

 651 AGCCACGTTC TACATCCCGT CCAACCTTGC CTACCGCGAA CAGGGTGCGG

 701 GCGACAAAAT CGGCCCGAAC GCCACTTTGG TATTTGATGT GAAACTGGTC

 751 AAAATCGGCG CACCCGAAAA CGCGCCCGCC AAGCAGCCGG CTCAAGTCGA

 801 CATCAAAAAA GTAAATTAA
```

This corresponds to the amino acid sequence <SEQ ID 1748; ORF 576-1.a>:

```
m576-1.pep

     1      MNTIFKISAL TLSAALALSA CGKKEAAPAS ASEPAAASSA QGDTSSIGST

    51      MQQASYAMGV DIGRSLKQMK EQGAEIDLKV FTEAMQAVYD GKEIKMTEEQ
```

-continued

```
101     AQEVMMKFLQ EQQAKAVEKH KADAKANKEK GEAFLKENAA KDGVKTTASG

151     LQYKITKQGE GKQPTKDDIV TVEYEGRLID GTVFDSSKAN GGPVTFPLSQ

201     VILGWTEGVQ LLKEGGEATF YIPSNLAYRE QGAGDKIGPN ATLVFDVKLV

251     KIGAPENAPA KQPAQVDIKK VN*
```

```
a576-1/m576-1 99.6% identity in 272 aa overlap

                   10        20        30        40        50        60
a576-1.pep  MNTIFKISALTLSAALALSACGKKEAAPASASEPAAASSAQGDTSSIGSTMQQASYAMGV
            ||||||||||||||||||||||||||||||||||||||||||||||||||||||||||||
m576-1      MNTIFKISALTLSAALALSACGKKEAAPASASEPAAASSAQGDTSSIGSTMQQASYAMGV
                   10        20        30        40        50        60

                   70        80        90       100       110       120
a576-1.pep  DIGRSLKQMKEQGAEIDLKVFTEAMQAVYDGKEIKMTEEQAQEVMMKFLQEQQAKAVEKH
            ||||||||||||||||||||||||||||||||||||||||||||||||||||||||||||
m576-1      DIGRSLKQMKEQGAEIDLKVFTEAMQAVYDGKEIKMTEEQAQEVMMKFLQEQQAKAVEKH
                   70        80        90       100       110       120

                  130       140       150       160       170       180
a576-1.pep  KADAKANKEKGEAFLKENAAKDGVKTTASGLQYKITKQGEGKQPTKDDIVTVEYEGRLID
            ||||||||||||||||||||||||||||||||||||||||||||||||||||||||||||
m576-1      KADAKANKEKGEAFLKENAAKDGVKTTASGLQYKITKQGEGKQPTKDDIVTVEYEGRLID
                  130       140       150       160       170       180

                  190       200       210       220       230       240
a576-1.pep  GTVFDSSKANGGPVTFPLSQVILGWTEGVQLLKEGGEATFYIPSNLAYREQGAGDKIGPN
            ||||||||||||||||||||| ||||||||||||||||||||||||||||||||||||||
m576-1      GTVFDSSKANGGPVTFPLSQVIPGWTEGVQLLKEGGEATFYIPSNLAYREQGAGDKIGPN
                  190       200       210       220       230       240

                  250       260       270
a576-1.pep  ATLVFDVKLVKIGAPENAPAKQPAQVDIKKVNX
            ||||||||||||||||||||||||||||||||
m576-1      ATLVFDVKLVKIGAPENAPAKQPAQVDIKKVNX
                  250       260       270
```

Expression of ORF 576

The primer described in Table 1 for ORF 576 was used to locate and clone ORF 576. ORF 576 was cloned in pET and pGex vectors and expressed in *E. coli* as above described. The products of protein expression and purification were analyzed by SDS-PAGE. FIG. 3A shows the results of affinity purification and FIG. 3B shows the expression in *E. coli*. Purified His-fusion protein was used to immunize mice, whose sera were used for ELISA (positive result), FACS analysis (FIG. 3C), western blot (FIG. 3D). These experiments confirm that ORF 576 is a surface-exposed protein and that it is a useful immunogen. The hydrophilicity plots, antigenic index, and amphipatic regions of ORF 576 are provided in FIG. 7. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 576 and the amino acid sequence encoded thereby is provided in Example 1.

The following partial DNA sequence was identified in *N. gonorrhoeae* <SEQ ID 1749>:

```
g577.seq..
  1 atggaaagga gcggtgtatt tggtaaaatt gtcggcaatc gcatactccg

 51 tatgccgtcc gaacacgctg ccgcattcta tccgaaaccg tgcaaatcgt

101 ttaaactaac gcaatcttgg ttcagagtgc gaagctgtcc gtgcggcgtt

151 tttatttacg gagcaaacat gaaacttatc tataccgtca tcaaaatcat

201 tatcctgctg ctcttcctgc tgcttgccgt cattaatatg gatgccgtta

251 ccttttccta tcttccgggg cagagtgtca atctgccgct gattgtcgta

301 ttgttcggcg cgtttgtcgt cggcatcgtg ttcggaatgt ttgccctgtt

351 cgggcggctg ctgtccttgc gcggcgaaaa cagccgcctg cgtgcggaag

401 tgaagaaaag tgcgcgcttg agcggacaga aattgactgc accgccgata

451 caaaatgctg ccgaatctgc caaacagcct taa
```

This corresponds to the amino acid sequence <SEQ ID 1750; ORF 577.ng>:

```
g577.pep
   1 MERSGVFGKI VGNRILRMPS EHAAAFYPKP CKSFKLTQSW FRVRSCPCGV

  51 FIYGANMKLI YTVIKIIILL LFLLLAVINM DAVTFSYLPG QSVNLPLIVV

 101 LFGAFVVGIV FGMFALFGRL LSLRGENSRL RAEVKKSARL SGQKLTAPPI

 151 QNAAESAKQP *
```

The following partial DNA sequence was identified in *N. meningitidis* <SEQ ID 1751>:

```
m577.seq..
   1 ATGGAAAGGA ACGGTGTATT TGGTAAAATT GTCGGCAATC GCATACTCCG

  51 TATGTCGTCC GAACACGCTG CCGCATCCTA TCCGAAACCG TGCAAATCGT

 101 TTAAACTAGC GCAATCTTGG TTCAGAGTGC GAAGCTGTCT GGGCGGCGTT

 151 TTTATTTACG GAGCAAACAT GAAACTTATC TATACCGTCA TCAAAATCAT

 201 TATCCTGCTG CTCTTCCTGC TGCTTGCCGT CATTAATACG GATGCCGTTA

 251 CCTTTTCCTA CCTGCCGGGG CAAAAATTCG ATTTGCCGCT GATTGTCGTA

 301 TTGTTCGGCG CATTTGTAGT CGGTATTATT TTTGGAATGT TTGCCTTGTT

 351 CGGACGGTTG TTGTCGTTAC GTGGCGAGAA CGGCAGGTTG CGTGCCGAAG

 401 TAAAGAAAAA TGCGCGTTTG ACGGGGAAGG AGCTGACCGC ACCACCGGCG

 451 CAAAATGCGC CCGAATCTAC CAAACAGCCT TAA
```

This corresponds to the amino acid sequence <SEQ ID 1752; ORF 577>:

```
m577.pep..
   1 MERNGVFGKI VGNRILRMSS EHAAASYPKP CKSFKLAQSW FRVRSCLGGV

  51 FIYGANMKLI YTVIKIIILL LFLLLAVINT DAVTFSYLPG QKFDLPLIVV

 101 LFGAFVVGII FGMFALFGRL LSLRGENGRL RAEVKKNARL TGKELTAPPA

 151 QNAPESTKQP *
```

Computer analysis of this amino acid sequence gave the following results:
Homology with a Predicted ORF from *N. gonorrhoeae*

```
m577/g577    88.1% identity in 160 aa overlap

                     10        20        30        40        50        60
m577.pep     MERNGVFGKIVGNRILRMSSEHAAASYPKPCKSFKLAQSWFRVRSCLGGVFIYGANMKLI
             |||:|||||||||||||| |||||| ||||||||||:|||||||||  ||||||||||||
g577         MERSGVFGKIVGNRILRMPSEHAAAFYPKPCKSFKLTQSWFRVRSCPCGVFIYGANMKLI
                     10        20        30        40        50        60

                     70        80        90       100       110       120
m577.pep     YTVIKIIILLLFLLLAVINTDAVTFSYLPGQKFDLPLIVVLFGAFVVGIIGFMFALFGRL
             ||||||||||||||||||| |||||||||||:  :||||||||||||||:||||||||||
g577         YTVIKIIILLLFLLLAVINMDAVTFSYLPGQSVNLPLIVVLFGAFVVGIVFGMFALFGRL
                     70        80        90       100       110       120

                    130       140       150       160
m577.pep     LSLRGENGRLRAEVKKNARLTGKELTAPPAQNAPESTKQPX
             |||||||:||||||||:|||:|::||||| ||| ||:||||
g577         LSLRGENSRLRAEVKKSARLSGQKLTAPPIQNAAESAKQPX
                    130       140       150       160
```

The following partial DNA sequence was identified in *N. meningitidis* <SEQ ID 1753>:

```
a577.seq
   1 ATGGAAAGGA ACGGTGTATT TGGTAAAATT GTCGGCAATC GCATACTCCG

  51 TATGTCGTCC GAACACGCTG CCGCATCCTA TCCGAAACCG TGCAAATCGT

 101 TTAAACTAGC GCAATCTTGG TTCAGAGTGC GAAGCTGTCC GGGCGGCGTT

 151 TTTATTTACG GAGCAAACAT GAAACTTATC TATACCGTCA TCAAAATCAT

 201 TATCCTGCTG CTCTTCCTGC TGCTTGCTGT CATTAATACG GATGCCGTTA

 251 CCTTTTCCTA CCTGCCGGGG CAAAAATTCG ATTTGCCGCT GATTGTCGTA

 301 TTGTTCGGCG CGTTTGTCGT CGGCATCGTG TTCGGAATGT TTGCCTTGTT

 351 CGGACGGTTG TTGTCGTTAC GTGGCGAGAA CGGCAGGTTG CGTGCCGAAG

 401 TAAAGAAAAA TGCGCGTTTG ACGGGGAAGG AGCTGACCGC ACCACCGGCG

 451 CAAAATGCGC CCGAATCTGC CAAACAGCCT TGA
```

This corresponds to the amino acid sequence <SEQ ID 1754; ORF 577.a>:

```
a577.pep

     1   MERNGVFGKI VGNRILRMSS EHAAASYPKP CKSFKLAQSW FRVRSCPGGV

    51   FIYGANMKLI YTVIKIIILL LFLLLAVINT DAVTFSYLPG QKFDLPLIVV

   101   LFGAFVVGIV FGMFALFGRL LSLRGENGRL RAEVKKNARL TGKELTAPPA

   151   QNAPESAKQP *

m577/a577 98.1% identity in 160 aa overlap
                   10        20        30        40        50        60
m577.pep  MERNGVFGKIVGNRILRMSSEHAAASYPKPCKSFKLAQSWFRVRSCLGGVFIYGANMKLI
          |||||||||||||||||||||||||||||||||||||||||||||| |||||||||||||
a577      MERNGVFGKIVGNRILRMSSEHAAASYPKPCKSFKLAQSWFRVRSCPGGVFIYGANMKLI
                   10        20        30        40        50        60

                   70        80        90       100       110       120
m577.pep  YTVIKIIILLLFLLLAVINTDAVTFSYLPGQKFDLPLIVVLFGAFVVGIIFGMFALFGRL
          |||||||||||||||||||||||||||||||||||||||||||||||||:||||||||||
a577      YTVIKIIILLLFLLLAVINTDAVTFSYLPGQKFDLPLIVVLFGAFVVGIVFGMFALFGRL
                   70        80        90       100       110       120

                  130       140       150       160
m577.pep  LSLRGENGRLRAEVKKNARLTGKELTAPPAQNAPESTKQPX
          ||||||||||||||||||||||||||||||||||||:||||
a577      LSLRGENGRLRAEVKKNARLTGKELTAPPAQNAPESAKQPX
                  130       140       150       160
```

The following partial DNA sequence was identified in *N. gonorrhoeae* <SEQ ID 1755>:

```
g578.seq..
   1 atgggaaagc tcgacatcgg gatattgttt gccgatttct tcaaagattt

  51 cgcgccacag ttcggtggtt tccaaaacgt tggctttgcc tacggagcag

 101 acttttttgc tgcgtttttg ggcggattgg aaggccacgt gggcgatgcg

 151 gcggatttcg ctttcgctgt atttcatggt gttgtagcct tcgtgttcgc

 201 cgttttccaa aacacggatg ccgcgcggtt cgccgaaata aatatcgccg

 251 gtaagttcgc gcacaatcaa aatatccaaa ccggcaacga tttcaggctt

 301 gagcgtggag gcgttggcta a
```

This corresponds to the amino acid sequence <SEQ ID 1756; ORF 578.ng>:

```
g578.pep
   1 MGKLDIGILF ADFFKDFAPQ FGGFQNVGFA YGADFFAAFL GGLEGHVGDA

  51 ADFAFAVFHG VVAFVFAVFQ NTDAARFAEI NIAGKFAHNQ NIQTGNDFRL

 101 ERGGVG*
```

The following partial DNA sequence was identified in *N. meningitidis* <SEQ ID 1757>:

```
m578.seq..
   1 ATGGGAAAGC TCGACATCAG GGTACTCTTT GCCGATTTCT TCAAAGATTT

  51 CGCGCCACAA TTCGGTGGTT TCCAAAACGT TGGCTTTGCC TACGGAACAG

 101 ACTTTTTTGC TGCGTTTTTG GGCGGATTGG AAGGCAACAT GGGCAATACG

 151 GCGGATTTCG CTTTCGCTGT ATTTCATGGT GTTGTAGCCT TCGCGTTCGC

 201 CGTTTTCCAG AACGCGGATG CCGCGCGGTT CGCCGAAATA GATGTCGCCG

 251 GTGAGTTCGC GCACAATCAA AATATCCAAA CCGGCAACGA TTTCAGGCTT
```

This corresponds to the amino acid sequence <SEQ ID 1758; ORF 578>:

```
m578.pep..
      1  MGKLDIRVLF ADFFKDFAPQ FGGFQNVGFA YGTDFFAAFL GGLEGNMGNT

     51  ADFAFAVFHG VVAFAFAVFQ NADAARFAEI DVAGEFAHNQ NIQTGNDFRL

    101  QRGGVG*

m578/g578    87.7% identity in 106 aa overlap

                      10        20        30        40        50        60
m578.pep     MGKLDIRVLFADFFKDFAPQFGGFQNVGFAYGTDFFAAFLGGLEGNMGNTADFAFAVFHG
             |||||| :||||||||||||||||||||||||:||||||||||||::|::||||||||||
g578         MGKLDIGILFADFFKDFAPQFGGFQNVGFAYGADFFAAFLGGLEGHVGDAADFAFAVFHG
                      10        20        30        40        50        60

                      70        80        90       100
m578.pep     VVAFAFAVFQNADAARFAEIDVAGEFAHNQNIQTGNDFRLQRGGVGX
             ||||:||||||:||||||||::||:|||||||||||||||:||||||
g578         VVAFVFAVFQNTDAARFAEINIAGKFAHNQNIQTGNDFRLERGGVGX
                      70        80        90       100
```

The following partial DNA sequence was identified in *N. meningitidis* <SEQ ID 1759>:

```
a578.seq
   1 ATGGGAAAGC TCGACATCAG GGTATTCTTT GCCGATTTCT TCAAAGATTT

  51 CGCGCCACAA TTCGGTGGTT TCCAAAACGT TGGCTTTGCC TACGGAGCAG

 101 ACTTTTTTGC TGCGTTTTTG GGCGGATTGG AAGGCGACGT GGGCAATACG

 151 GCGGATTTCG CTTTCGCTGT ATTTCATGGT GTTGTAGCCT TCGCGTTCGC

 201 CGTTTTCCAG AACACGGATG CCGCGCGGTT CGCCGAAATA AATATCGCCG

 251 GTGAGTTCGC GCACAATCAA AATATCCAAA CCCGCAACGA TTTCAGACTT

 301 GAGCGTGGAG GCGTTGGCTA G
```

This corresponds to the amino acid sequence <SEQ ID 1760; ORF 578.a>:

```
a578.pep

      1  MGKLDIRVFF ADFFKDFAPQ FGGFQNVGFA YGADFFAAFL GGLEGDVGNT

     51  ADFAFAVFHG VVAFAFAVFQ NTDAARFAEI NIAGEFAHNQ NIQTRNDFRL

    101  ERGGVG*

m578/a578    91.5% identity in 106 aa overlap

                     10        20        30        40        50        60
m578.pep     MGKLDIRVLFADFFKDFAPQFGGFQNVGFAYGTDFFAAFLGGLEGNMGNTADFAFAVFHG
             ||||||||:||||||||||||||||||||||:||||||||||||::||||||||||||||
a578         MGKLDIRVFFADFFKDFAPQFGGFQNVGFAYGADGGAAFLGGLEGDVGNTADFAFAVFHG
                     10        20        30        40        50        60

                     70        80        90       100
m578.pep     VVAFAFAVFQNADAARFAEIDVAGEFAHNQNIQTGNDFRLQRGGVGX
             ||||||||||:|||||||::|||||||||||| |||||:||||||
a578         VVAFAFAVFQNTDAARFAEINIAGEFAHNQNIQTRNDFRLERGGVGX
                     70        80        90       100
```

The following partial DNA sequence was identified in *N. gonorrhoeae* <SEQ ID 1761>:

```
g579.seq..
  1 ATGAGGGCGG CGATGACGCG CGCGCAGGTC GATGCCACGC TGATTAGTTT

 51 TTTGTGTAAT GTTGCCAATA TCGGCTTATT GATTTTGGTG ATTATTGCCG

101 CATTGGGACG GTTGGGCGTT TCCACAACAT CCGTAACCGC CTTAATCGGC

151 GGCGCGGGTT TGGCGGTGGC GTTGTCCTTA AAAGACCAGC TGTCCAATTT

201 TGCCGCCGGC GCGCTGATTA TCCTGTTCCG CCCGTTCAAA GTCGGCGACT

251 TTATCCGTGT CGGCGGTTTT GAAGGATATG TCCGGGAAAT CAAAATGGTG

301 CAGACTTCTT TGCGGACGAC CGACAACGAA GAAGTCGTGC TGCCCAACAG

351 CGTGGTGATG GGCAACAGCA TCGTCAACCG TTCCAGCCTG CCGCTTTGCC

401 GCGCCCAAGT GATAGTCGGC GTCGATTACA ACTGCGATTT GAAAGTGGCG

451 AAAGAGGCGG TGTTGAAAGC CGCCGCCGAA CACCCCTTGA GCGTTCAAAA

501 CGAAGAGCGG CAGCCCGCCG CCTACATCAC CGCCTTGGGC GACAATGCCA

551 TCGAAATCAC ATTATGGGCT TGGGCAAACG AAGCAGACCG CTGGACGCTG

601 CAATGCGACT TGAACGAACA AGTGGTCGAA AACCTCCGCA AAGTCAATAT

651 CAACATCCCG TTCCCGCAAC GCGACATACA CATCATCAAT TCTTAA
```

This corresponds to the amino acid sequence <SEQ ID 1762; ORF 579.ng>:

```
g579.pep..
  1 MRAAMTRAQV DATLISFLCN VANIGLLILV IIAALGRLGV STTSVTALIG

 51 GAGLAVALSL KDQLSNFAAG ALIILFRPFK VGDFIRVGGF EGYVREIKMV

101 QTSLRTTDNE EVVLPNSVVM GNSIVNRSSL PLCRAQVIVG VDYNCDLKVA

151 KEAVLKAAAE HPLSVQNEER QPAAYITALG DNAIEITLWA WANEADRWTL

201 QCDLNEQVVE NLRKVNINIP FPQRDIHIIN S*
```

The following partial DNA sequence was identified in *N. meningitidis* <SEQ ID 1763>:

```
m579.seq..
   1 ATGAGGGCGG CGATGACGCG CGCGCAGGTC GATGCCACGC TGATTAGTTT

  51 TTTGTGTAAT GTTGCCAATA TCGGCTTATT GATTTTGGTG ATTATTGCCG

 101 CATTGGGCAG ATTGGGCGTT TCCACAACAT CCGTAACCGC CTTAATCGGC

 151 GGCGCGGGTT TGGCGGTGGC GTTGTCCCTG AAAGACCAGC TGTCCAATTT

 201 TGCCGCCGGC GCACTGATTA TCCTGTTCCG CCCGTTCAAA GTCGGCGATT

 251 TTATCCGCGT CGGCGGTTTT GAAGGATATG TCCGAGAGAT TAAAATGGTG

 301 CAGACTTCTT TGCGGACGAC CGACAACGAA GAAGTCGTGC TGCCCAACAG

 351 CGTGGTGATG GGCAACAGCA TCGTCAACCG TTCCACACTG CCGCTGTGCC

 401 GCGCCCAAGT GATAGTCGGC GTCGATTACA ACTGCGATTT GAAAGTGGCG

 451 AAAGAGGCGG TGTTGAAAGC CGCCGTCGAA CACCCCTTGA GCGTTCAAAA

 501 CGAAGAGCGG CAGGCTGCCG CCTACATCAC CGCCTTGGGC GACAATGCCA

 551 TCGAAATCAC ATTATGGGCT TGGGCAAACG AAGCAGACCG CTGGACGCTG

 601 CAATGCGACT TGAACGAACA AGTGGTCGAA AACCTCCGCA AAGTCAATAT

 651 CAACATCCCG TTCCCGCAAC GCGACATACA CATCATCAAT TCTTAA
```

This corresponds to the amino acid sequence <SEQ ID 1764; ORF 579>:

```
m579.pep..
   1 MRAAMTRAQV DATLISFLCN VANIGLLILV IIAALGRLGV STTSVTALIG

  51 GAGLAVALSL KDQLSNFAAG ALIILFRPFK VGDFIRVGGF EGYVREIKMV

 101 QTSLRTTDNE EVVLPNSVVM GNSIVNRSTL PLCRAQVIVG VDYNCDLKVA

 151 KEAVLKAAVE HPLSVQNEER QAAAYITALG DNAIEITLWA WANEADRWTL

 201 QCDLNEQVVE NLRKVNINIP FPQRDIHIIN S*
```

Computer analysis of this amino acid sequence gave the following results:

Homology with a Predicted ORF from *N. gonorrhoeae*

```
m579/g576   98.7% identity in 231 aa overlap

                    10        20        30        40        50        60
m579.pep    MRAAMTRAQVDATLISFLCNVANIGLLILVIIAALGRLGVSTTSVTALIGGAGLAVALSL
            ||||||||||||||||||||||||||||||||||||||||||||||||||||||||||||
g579        MRAAMTRAQVDATLISFLCNVANIGLLILVIIAALGRLGVSTTSVTALIGGAGLAVALSL
                    10        20        30        40        50        60

                    70        80        90       100       110       120
m579.pep    KDQLSNFAAGALIILFRPFKVGDFIRVGGFEGYVREIKMVQTSLRTTDNEEVVLPNSVVM
            ||||||||||||||||||||||||||||||||||||||||||||||||||||||||||||
g579        KDQLSNFAAGALIILFRPFKVGDFIRVGGFEGYVREIMKVQTSLRTTDNEEVVLPNSVVM
                    70        80        90       100       110       120

                   130       140       150       160       170       180
m579.pep    GNSIVNRSTLPLCRAQVIVGVDYNCDLKVAKEAVLKAAVEHPLSVQNEERQAAAYITALG
            ||||||||:|||||||||||||||||||||||||||||:|||||||||||| ||||||||
g579        GNSIVNRSSLPLCRAQVIVGVDYNCDLKVAKEAVLKAAAEHPLSVQNEERQPAAYITALG
                   130       140       150       160       170       180

                   190       200       210       220       230
m579.pep    DNAIEITLWAWANEADRWTLQCDLNEQVVENLRKVNINIPFPQRDIHIINSX
            |||||||||||||||||||||||||||||||||||||||||||||||||||
g579        DNAIEITLWAWANEADRWTLQCDLNEQVVENLRKVNINIPFPQRDIHIINSX
                   190       200       210       220       230
```

The following partial DNA sequence was identified in *N. meningitidis* <SEQ ID 1765>:

```
a579.seq
   1 ATGAGGGCGG CGATGACGCG CGCGCAGGTC GATGCCACGC TGATTAGTTT

  51 TTTGTGTAAT GTTGCCAATA TCGGCTTATT GATTTTGGTG ATTATTGCCG

 101 CATTGGGCAG ATTGGGCGTT TCCACAACAT CCGTAACCGC CTTAATCGGC

 151 GGCGCGGGTT TGGCGGTGGC GTTGTCCTTG AAAGACCAGC TGTCCAATTT

 201 TGCCGCCGGC GCGCTGATTA TCCTGTTCCG CCCGTTCAAA GTCGGCGATT

 251 TTATCCGCGT CGGCGGTTTT GAAGGATATG TCCGAGAGAT TAAAATGGTG

 301 CAGACTTCTT TGCGGACGAC CGACAACGAA GAAGTCGTGC TGCCCAACAG

 351 CGTGGTGATG GGCAACAGCA TCGTCAACCG TTCCACACTG CCGCTGTGCC

 401 GCGCCCAAGT GATAGTCGGC GTCGATTACA ACTGCGATTT GAAAGTGGCG

 451 AAAGAGGCGG TGTTGAAAGC CGCCGTCGAA CACCCCTTGA GCGTTCAAAA

 501 CGAAGAGCGG CAGGCCGCCG CCTACATCAC CGCCTTGGGC GACAATGCCA

 551 TCGAAATCAC ATTATGGGCT TGGGCAAACG AAGCAGACCG CTGGACGCTG

 601 CAATGCGACT TGAACGAACA AGTGGTCGAA AACCTCCGCA AAGTCAATAT

 651 CAACATCCCG TTCCCGCAAC GCGACATACA CATCATCAAT TCTTAA
```

This corresponds to the amino acid sequence <SEQ ID 1766; ORF 579.a>:

```
a579.pep

       1    MRAAMTRAQV DATLISFLCN VANIGLLILV IIAALGRLGV STTSVTALIG

      51    GAGLAVALSL KDQLSNFAAQ ALIILFRPKF VGDFIRVGGF EGYVREIKMV

     101    QTSLRTTDNE EVVLPNSVVM GNSIVNRSTL PLCRAQVIVG VDYNCDLKVA

     151    KEAVLKAAVE HPLSVQNEER QAAAYITALG DNAIEITLWA WANEADRWTL

     201    QCDLNEQVVE NLRKVNINIP FPQRDIHIIN S*

m579/a579   100.0% identity in 231 aa overlap

                    10        20        30        40        50        60
m579.pep    MRAAMTRAQVDATLISFLCNVANIGLLILVIIAALGRLGVSTTSVTALIGGAGLAVALSL
            ||||||||||||||||||||||||||||||||||||||||||||||||||||||||||||
a579        MRAAMTRAQVDATLISFLCNVANIGLLILVIIAALGRLGVSTTSVTALIGGAGLAVALSL
                    10        20        30        40        50        60

                    70        80        90       100       110       120
m579.pep    KDQLSNFAAGALIILFRPFKVGDFIRVGGFEGYVREIKMVQTSLRTTDNEEVVLPNSVVM
            ||||||||||||||||||||||||||||||||||||||||||||||||||||||||||||
a579        KDQLSNFAAGALIILFRPFKVGDFIRVGGFEGYVREIKMVQTSLRTTDNEEVVLPNSVVM
                    70        80        90       100       110       120

                   130       140       150       160       170       180
m579.pep    GNSIVNRSTLPLCRAQVIVGVDYNCDLKVAKEAVLKAAVEHPLSVQNEERQAAAYITALG
            ||||||||||||||||||||||||||||||||||||||||||||||||||||||||||||
a579        GNSIVNRSTLPLCRAQVIVGVDYNCDLKVAKEAVLKAAVEHPLSVQNEERQAAAYITALG
                   130       140       150       160       170       180

                   190       200       210       220       230
m579.pep    DNAIEITLWAWANEADRWTLQCDLNEQVVENLRKVNINIPFPQRDIHIINSX
            ||||||||||||||||||||||||||||||||||||||||||||||||||||
a579        DNAIEITLWAWANEADRWTLQCDLNEQVVENLRKVNINIPFPQRDIHIINSX
                   190       200       210       220       230
```

The following partial DNA sequence was identified in *N. gonorrhoeae* <SEQ ID 1767>:

```
g579-1.seq
  1  ATGGACTTCA AACAATTTGA TTTTTTACAC CTGATCAGTG TTTCCGGTTG
```

-continued

```
 51 GGGGCATCTG GCTGAAAAGG CGTGGGCGTT CGGGCTGAAC CTTGCCGCCG

101 CGCTGCTTAT TTTCTTGGTC GGGAAATGGG CGGCGAAACG CATTGTCGCC

151 GTAATGAGGG CGGCGATGAC GCGCGCGCAG GTCGATGCCA CGCTGATTAG

201 TTTTTTGTGT AATGTTGCCA ATATCGGCTT ATTGATTTTG GTGATTATTG

251 CCGCATTGGG ACGGTTGGGC GTTTCCACAA CATCCGTAAC CGCCTTAATC

301 GGCGGCGCGG GTTTGGCGGT GGCGTTGTCC TTAAAAGACC AGCTGTCCAA

351 TTTTGCCGCC GGCGCGCTGA TTATCCTGTT CCGCCCGTTC AAAGTCGGCG

401 ACTTTATCCG TGTCGGCGGT TTTGAAGGAT ATGTCCGGGA AATCAAAATG

451 GTGCAGACTT CTTTGCGGAC GACCGACAAC GAAGAAGTCG TGCTGCCCAA

501 CAGCGTGGTG ATGGGCAACA GCATCGTCAA CCGTTCCAGC CTGCCGCTTT

551 GCCGCGCCCA AGTGATAGTC GGCGTCGATT ACAACTGCGA TTTGAAAGTG

601 GCGAAAGAGG CGGTGTTGAA AGCCGCCGCC GAACACCCCT TGAGCGTTCA

651 AAACGAAGAG CGGCAGCCCG CCGCCTACAT CACCGCCTTG GGCGACAATG

701 CCATCGAAAT CACATTATGG GCTTGGGCAA ACGAAGCAGA CCGCTGGACG

751 CTGCAATGCG ACTTGAACGA ACAAGTGGTC GAAAACCTCC GCAAAGTCAA

801 TATCAACATC CCGTTCCCGC AACGCGACAT ACACATCATC AATTCTTAA
```

This corresponds to the amino acid sequence <SEQ ID 1768; ORF 008.ng>:

```
g579-1.pep
  1 MDFKQFDFLH LISVSGWGHL AEKAWAFGLN LAAALLIFLV GKWAAKRIVA

 51 VMRAAMTRAQ VDATLISFLC NVANIGLLIL VIIAALGRLG VSTTSVTALI

101 GGAGLAVALS LKDQLSNFAA GALIILFRPF KVGDFIRVGG FEGYVREIKM

151 VQTSLRTTDN EEVVLPNSVV MGNSIVNRSS LPLCRAQVIV GVDYNCDLKV

201 AKEAVLKAAA EHPLSVQNEE RQPAAYITAL GDNAIEITLW AWANEADRWT

251 LQCDLNEQVV ENLRKVNINI PFPQRDIHII NS*
```

The following partial DNA sequence was identified in *N. meningitidis* <SEQ ID 1769>:

```
m579-1.seq
  1 ATGGACTTCA AACAATTTGA TTTTTTACAC CTGATCAGTG TTTCCGGTTG

 51 GGAGCATCTG GCTGAAAAGG CGTGGGCGTT CGGGCTGAAC CTTGCCGCCG

101 CGCTGCTTAT TTTTTTGGTC GGAAAATGGG CGGCGAAACG CATTGTCGCT

151 GTGATGAGGG CGGCGATGAC GCGCGCGCAG GTCGATGCCA CGCTGATTAG

201 TTTTTTGTGT AATGTTGCCA ATATCGGCTT ATTGATTTTG GTGATTATTG

251 CCGCATTGGG CAGATTGGGC GTTTCCACAA CATCCGTAAC CGCCTTAATC

301 GGCGGCGCGG GTTTGGCGGT GGCGTTGTCC CTGAAAGACC AGCTGTCCAA

351 TTTTGCCGCC GGCGCACTGA TTATCCTGTT CCGCCCGTTC AAAGTCGGCG

401 ATTTTATCCG CGTCGGCGGT TTTGAAGGAT ATGTCCGAGA GATTAAAATG

451 GTGCAGACTT CTTTGCGGAC GACCGACAAC GAAGAAGTCG TGCTGCCCAA

501 CAGCGTGGTG ATGGGCAACA GCATCGTCAA CCGTTCCACA CTGCCGCTGT

551 GCCGCGCCCA AGTGATAGTC GGCGTCGATT ACAACTGCGA TTTGAAAGTG
```

-continued

```
601 GCGAAAGAGG CGGTGTTGAA AGCCGCCGTC GAACACCCCT TGAGCGTTCA

651 AAACGAAGAG CGGCAGGCTG CCGCCTACAT CACCGCCTTG GGCGACAATG

701 CCATCGAAAT CACATTATGG GCTTGGGCAA ACGAAGCAGA CCGCTGGACG

751 CTGCAATGCG ACTTGAACGA ACAAGTGGTC GAAAACCTCC GCAAAGTCAA

801 TATCAACATC CCGTTCCCGC AACGCGACAT ACACATCATC AATTCTTAA
```

This corresponds to the amino acid sequence <SEQ ID 1770; ORF 579-1>:

```
a579-1.pep
  1   MDFKQFDFLH LISVSGWEHL AEKAWAFGLN LAAALLIFLV GKWAAKRIVA
 51   VMRAAMTRAQ VDATLISFLC NVANIGLLIL VIIAALGRLG VSTTSVTALI
101   GGAGLAVALS LKDQLSNFAA GALIILFRPF KVGDFIRVGG FEGYVREIKM
151   VQTSLRTTDN EEVVLPNSVV MGNSIVNRST LPLCRAQVIV GVDYNCDLKV
201   AKEAVLKAAV EHPLSVQNEE RQAAAYITAL GDNAIEITLW AWANEADRWT
251   LQCDLNEQVV ENLRKVNINI PFPQRDIHII NS*
```

```
m579-1/g579-1  98.6% identity in 282 aa overlap

                      10        20        30        40        50        60
m579-1.pep    MDFKQFDFLHLISVSGWEHLAEKAWAFGLNLAAALLIFLVGKWAAKRIVAVMRAAMTRAQ
              ||||||||||||||||| ||||||||||||||||||||||||||||||||||||||||||
g579-1        MDFKQFDFLHLISVSGWGHLAEKAWAFGLNLAAALLIFLVGKWAAKRIVAVMRAAMTRAQ
                      10        20        30        40        50        60

                      70        80        90       100       110       120
m579-1.pep    VDATLISFLCNVANIGLLILVIIAALGRLGVSTTSVTALIGGAGLAVALSLKDQLSNFAA
              ||||||||||||||||||||||||||||||||||||||||||||||||||||||||||||
g579-1        VDATLISFLCNVANIGLLILVIIAALGRLGVSTTSVTALIGGAGLAVALSLKDQLSNFAA
                      70        80        90       100       110       120

                     130       140       150       160       170       180
m579-1.pep    GALIILFRPFKVGDFIRVGGFEGYVREIKMVQTSLRTTDNEEVVLPNSVVMGNSIVNRST
              |||||||||||||||||||||||||||||||||||||||||||||||||||||||||||:
g579-1        GALIILFRPFKVGDFIRVGGFEGYVREIKMVQTSLRTTDNEEVVLPNSVVMGNSIVNRSS
                     130       140       150       160       170       180

                     190       200       210       220       230       240
m579-1.pep    LPLCRAQVIVGVDYNCDLKVAKEAVLKAAVEHPLSVQNEERQAAAYITALGDNAIEITLW
              |||||||||||||||||||||||||||||:|||||||||||| |||||||||||||||||
g579-1        LPLCRAQVIVGVDYNCDLKVAKEAVLKAAAEHPLSVQNEERQPAAYITALGDNAIEITLW
                     190       200       210       220       230       240

                     250       260       270       280
m579-1.pep    AWANEADRWTLQCDLNEQVVENLRKVNINIPFPQRDIHIINSX
              ||||||||||||||||||||||||||||||||||||||||||
g579-1        AWANEADRWTLQCDLNEQVVENLRKVNINIPFPQRDIHIINSX
                     250       260       270       280
```

The following partial DNA sequence was identified in *N. meningitidis* <SEQ ID 1771>:

```
a579-1.seq
  1 ATGGACTTCA AACAATTTGA TTTTTTACAC CTGATAAGTG CTTCCGGCTG

 51 GGAGCATCTG GCTGAAAAGG CGTGGGCGTT CGGGCTGAAC CTTGCCGCCG

101 CGCTGCTTAT TTTTTTGGTC GGAAAATGGG CGGCGAAACG CATTGTCGCC

151 GTGATGAGGG CGGCGATGAC GCGCGCGCAG GTCGATGCCA CGCTGATTAG

201 TTTTTTGTGT AATGTTGCCA ATATCGGCTT ATTGATTTTG GTGATTATTG

251 CCGCATTGGG CAGATTGGGC GTTTCCACAA CATCCGTAAC CGCCTTAATC

301 GGCGGCGCGG GTTTGGCGGT GGCGTTGTCC TTGAAAGACC AGCTGTCCAA

351 TTTTGCCGCC GGCGCGCTGA TTATCCTGTT CCGCCCGTTC AAAGTCGGCG
```

-continued

```
401 ATTTTATCCG CGTCGGCGGT TTTGAAGGAT ATGTCCGAGA GATTAAAATG

451 GTGCAGACTT CTTTGCGGAC GACCGACAAC GAAGAAGTCG TGCTGCCCAA

501 CAGCGTGGTG ATGGGCAACA GCATCGTCAA CCGTTCCACA CTGCCGCTGT

551 GCCGCGCCCA AGTGATAGTC GGCGTCGATT ACAACTGCGA TTTGAAAGTG

601 GCGAAAGAGG CGGTGTTGAA AGCCGCCGTC GAACACCCCT TGAGCGTTCA

651 AAACGAAGAG CGGCAGGCCG CCGCCTACAT CACCGCCTTG GGCGACAATG

701 CCATCGAAAT CACATTATGG GCTTGGGCAA ACGAAGCAGA CCGCTGGACG

751 CTGCAATGCG ACTTGAACGA ACAAGTGGTC GAAAACCTCC GCAAAGTCAA

801 TATCAACATC CCGTTCCCGC AACGCGACAT ACACATCATC AATTCTTAA
```

This corresponds to the amino acid sequence <SEQ ID 1772; ORF 579-1.a>:

```
a579-1.pep

    1 MDFKQFDFLH LISASGWEHL AEKAWAFGLN LAAALLIFLV GKWAAKRIVA

   51 VMRAAMTRAQ VDATLISFLC NVANIGLLIL VIIAALGRLG VSTTSVTALI

  101 GGAGLAVALS LKDQLSNFAA GALIILFRPF KVGDFIRVGG FEGYVREIKM

  151 VQTSLRTTDN EEVVLPNSVV MGNSIVNRST LPLCRAQVIV GVDYNCDLKV

  201 AKEAVLKAAV EHPLSVQNEE RQAAAYITAL GDNAIEITLW AWANEADRWT

  251 LQCDLNEQVV ENLRKVNINI PFPQRDIHII NS*

a579-1/m579-1 99.6% identity in 282 aa overlap

                   10         20         30         40         50         60
a579-1.pep MDFKQFDFLHLISASGWEHLAEKAWAFGLNLAAALLIFLVGKWAAKRIVAVMRAAMTRAQ
           ||||||||||||:|||||||||||||||||||||||||||||||||||||||||||||||
m579-1     MDFKQFDFLHLISVSGWEHLAEKAWAFGLNLAAALLIFLVGKWAAKRIVAVMRAAMTRAQ
                   10         20         30         40         50         60

                   70         80         90        100        110        120
a579-1.pep VDATLISFLCNVANIGLLILVIIAALGRLGVSTTSVTALIGGAGLAVALSLKDQLSNFAA
           ||||||||||||||||||||||||||||||||||||||||||||||||||||||||||||
m579-1     VDATLISFLCNVANIGLLILVIIAALGRLGVSTTSVTALIGGAGLAVALSLKDQLSNFAA
                   70         80         90        100        110        120

                  130        140        150        160        170        180
a579-1.pep GALIILFRPFKVGDFIRVGGFEGYVREIKMVQTSLRTTDNEEVVLPNSVVMGNSIVNRST
           ||||||||||||||||||||||||||||||||||||||||||||||||||||||||||||
m579-1     GALIILFRPFKVGDFIRVGGFEGYVREIKMVQTSLRTTDNEEVVLPNSVVMGNSIVNRST
                  130        140        150        160        170        180

                  190        200        210        220        230        240
a579-1.pep LPLCRAQVIVGVDYNCDLKVAKEAVLKAAVEHPLSVQNEERQAAAYITALGDNAIEITLW
           ||||||||||||||||||||||||||||||||||||||||||||||||||||||||||||
m579-1     LPLCRAQVIVGVDYNCDLKVAKEAVLKAAVEHPLSVQNEERQAAAYITALGDNAIEITLW
                  190        200        210        220        230        240

                  250        260        270        280
a579-1.pep AWANEADRWTLQCDLNEQVVENLRKVNINIPFPQRDIHIINSX
           ||||||||||||||||||||||||||||||||||||||||||
m579-1     AWANEADRWTLQCDLNEQVVENLRKVNINIPFPQRDIHIINSX
                  250        260        270        280
```

The following partial DNA sequence was identified in *N. gonorrhoeae* <SEQ ID 1773>:

```
g580.seq
    1 atggattcgc ccaaggtcgg gtgcgggtgg atggttttgc cgatgtctgc

   51 cgcgtcgcag cccatttcga tggcaaggca gacttcgccg atcatgtcgc

  101 caccgttcgg accgacaatg ccgccgccga tgatgcggcc ggtttcggca

  151 tcgaaaatca gcttggtaaa gccgttgtcg caaccgttgg caatcgcacg
```

-continued

```
201 accggaagcc gcccatggga agttggcttt ggtaattttg cggcctgatg

251 ctttggcaga caattcggtt tcaccgaccc atgccacttc gggggaagtg

301 tag
```

This corresponds to the amino acid sequence <SEQ ID 1774; ORF 580.ng>:

```
g580.pep..
   1 MDSPKVGCGW MVLPMSAASQ PISMARQTSP IMSPPFGPTM PPPMMRPVSA

  51 SKISLVKPLS QPLAIARPEA AHGKLALVIL RPDALADNSV SPTHATSGEV

 101 *
```

The following partial DNA sequence was identified in *N. meningitidis* <SEQ ID 1775>:

```
m580.seq..
   1 ATGGATTCGC CCAAGGTCGG GTGCGGGTGG ATGGTTTTGC CGATGTCTGC

  51 CGCGTCGCAG CCCATTTCGA TGGCAAGGCA GACTTCGCCG ATCATATCGC

 101 CACCGTTCGG ACCGACAATG CCGCCGCCGA TGATGCGGCC GGTTTCGGCA

 151 TCAAAAATCA GCTTGGTAAA GCCGTTGTCG CAACCGTTGG CAATCGCACG

 201 GCCGGAAGCC GCCCACGGGA AGTTGGCTTT GGTGATTTTG CGGCCGGAGG

 251 CTTTGGCGGA CAGTTCGGTT TCGCCCACCC ACGCCACTTC GGGGGAAGTG

 301 TAG
```

This corresponds to the amino acid sequence <SEQ ID 1776; ORF 580>:

```
m580.pep..
      1  MDSPKVGCGW MVLPMSAASQ PISMARQTSP IISPPFGPTM PPPMMRPVSA

     51  SKISLVKPLS QPLAIARPEA AHGKLALVIL RPEALADSSV SPTHATSGEV

    101  *

m580/g580    97.0% identity in 100 aa overlap

                     10        20        30        40        50        60
m580.pep     MDSPKVGCGWMVLPMSAASQPISMARQTSPIISPPFGPTMPPPMMRPVSASKISLVKPLS
             ||||||||||||||||||||||||||||||:|||||||||||||||||||||||||||||
g580         MDSPKVGCGWMVLPMSAASQPISMARQTSPIMSPPFGPTMPPPMMRPVSASKISLVKPLS
                     10        20        30        40        50        60

                     70        80        90       100
m580.pep     QPLAIARPEAAHGKLALVILRPEALADSSVSPTHATSGEVX
             |||||||||||||||||||||:||||:||||||||||||||
g580         QPLAIARPEAAHGKLALVILRPDALADNSVSPTHATSGEVX
                     70        80        90       100
```

The following partial DNA sequence was identified in *N. meningitidis* <SEQ ID 1777>:

```
a580.seq
   1 ATGGATTCGC CCAAGGTCGG GTGCGGGTGG ATGGTTTTGC CGATGTCTGC

  51 CGCGTCGCAG CCCATTTCGA TGGCAAGGCA GACTTCGCCG ATCATGTCGC

 101 CACCGTTCGG ACCGACAATG CCGCCGCCGA TGATGCGGCC GGTTTCAGCA

 151 TCAAAAATCA GCTTGGTGAA ACCATTGTCG CAACCGTTGG CAATCGCACG

 201 GCCGGAAGCA GCCCATGGGA AGTTGGCTTT GGTGATTTTG CGGCCGGAGG
```

-continued

```
251 CTTTGGCAGA CAATTCGGTT TCGCCCACCC ATGCCACTTC AGGAGAAGTG

301 TAA
```

This corresponds to the amino acid sequence <SEQ ID 1778; ORF 580.a>:

```
a580.pep

      1  MDSPKVGCGW MVLPMSAASQ PISMARQTSP IMSPPFGPTM PPPMMRPVSA

     51  SKISLVKPLS QPLAIARPEA AHGKLALVIL RPEALADNSV SPTHATSGEV

    101  *

m580/a580    98.0% identity in 100 aa overlap

                     10        20        30        40        50        60
m580.pep     MDSPKVGCGWMVLPMSAASQPISMARQTSPIISPPFGPTMPPPMMRPVSASKISLVKPLS
             |||||||||||||||||||||||||||||||:||||||||||||||||||||||||||||
a580         MDSPKVGCGWMVLPMSAASQPISMARQTSPIMSPPFGPTMPPPMMRPVSASKISLVKPLS
                     10        20        30        40        50        60

                     70        80        90       100
m580.pep     QPLAIARPEAAHGKLALVILRPEALADSSVSPTHATSGEVX
             |||||||||||||||||||||||||||:|||||||||||||
a580         QPLAIARPEAAHGKLALVILRPEALADNSVSPTHATSGEVX
                     70        80        90       100
```

The following partial DNA sequence was identified in *N. gonorrhoeae* <SEQ ID 1779>:

```
g581.seq..
  1 atgcacttcg cccagcttgt gggtcaaacc ggtatagaac aaaatacgtt

 51 ctgtcgtcgt ggttttaccc gcatcgatat gggcggaaat accgatgttg

101 cggtacaggc tgatcggggt cttacgagcc attttattag cctttcaaaa

151 ttagaaacgg aagtgagaga atgctttgtt ggcttcagcc atacggtgta

201 cttcttcacg ttttttcaac gcaccgccac ggccttcgga cgcatcaatc

251 aactcgcctg ccaaacgcag atccatggat ttctcaccac gtttgcgggc

301 cgcgtcgcga acccaacgca ttgccaaagc cagacggcgt ga
```

This corresponds to the amino acid sequence <SEQ ID 1780; ORF 581.ng>:

```
g581.pep..
  1 MHFAQLVGQT GIEQNTFCRR GFTRIDMGGN TDVAVQADRG LTSHFISLSK

 51 LETEVRECFV GFSHTVYFFT FFQRTATAFG RINQLACQTQ IHGFLTTFAG

101 RVANPTHCQS QTA*
```

The following partial DNA sequence was identified in *N. meningitidis* <SEQ ID 1781>:

```
m581.seq..
  1 ATGCACTTCG CCCAGCTTGT GGGTCAAACC GGTATAGAAC AAAATACGTT

 51 CTGTCGTCGT GGTTTTACCC GCGTCAATAT GGGCGGAAAT ACCGATGTTA

101 CGGTACAGGC TGATCGGGGT CTTACGAGCC ATTTTATTAG CCTTTCAAAA

151 TTAGAAACGG AAGTGAGAGA ATGCTTTGTT GGCTTCAGCC ATACGGTGTA

201 CTTCTTCACG TTTTTTCAAC GCACCGCCAC GGCCTTCGGA CGCATCAATC
```

-continued

```
251 AATTCGCCTG CCAAACGCAG GTCCATGGAT TTCTCACCAC GTTTGCGGGC

301 CGCATCGCGA ACCCAGCGCA TTGCCAAAGC CAAACGGCGT GA
```

This corresponds to the amino acid sequence <SEQ ID 1782; ORF 581>:

```
m581.pep..

      1  MHFAQLVGQT GIEQNTFCRR GFTRVNMGGN TDVTVQADRG LTSHFISLSK

     51  LETEVRECFV GFSHTVYFFT FFQRTATAFG RINQFACQTQ VHGFLTTFAG

    101  RIANPAHCQS QTA*

m581/g581    93.8% identity in 113 aa overlap

                    10        20        30        40        50        60
m581.pep     MHFAQLVGQTGIEQNTFCRRGFTRVNMGGNTDVTVQADRGLTSHFISLSKLETEVRECFV
             ||||||||||||||||||||||||::||||||:|||||||||||||||||||||||||||
g581         MHFAQLVGQTGIEQNTFCRRGFTRIDMGGNTDVAVQADRGLTSHFISLSKLETEVRECFV
                    10        20        30        40        50        60

                    70        80        90       100       110
m581.pep     GFSHTVYFFTFFQRTATAFGRINQFACQTQVHGFLTTFAGRIANPAHCQSQTAX
             ||||||||||||||||||||||||:|||||:||||||||||:|||:||||||||
g581         GFSHTVYFFTFFQRTATAFGRINQLACQTQIHGFLTTFAGRVANPTHCQSQTAX
                    70        80        90       100       110
```

The following partial DNA sequence was identified in *N. meningitidis* <SEQ ID 1783>:

```
a581.seq
   1 ATGCACTTCG CCCAGCTTGT GGGTCAAACC GGTATAGAAC AAAATACGTT

  51 CTGTCGTCGT GGTTTTACCC GCATCGATAT GGGCGGAAAT ACCGATGTTA

 101 CGGTACAGGC TGATCGGGGT CTTACGAGCC ATTTTATTAG CCTTTCAAAA

 151 TTAGAAACGG AAGTGAGAGA ATGCTTTGTT GGCTTCAGCC ATACGGTGTA

 201 CTTCTTCACG TTTTTTCAAC GCACCGCCAC GGCCTTCGGA CGCATCAATC

 251 AATTCGCCTG CCAAACGCAG GTCCATGGAT TTCTCACCAC GTTTGCGGGC

 301 CGCATCGCGA ACCCAGCGCA TTGCCAAAGC CAAACGGCGT GA
```

This corresponds to the amino acid sequence <SEQ ID 1784; ORF 581.a>:

```
a581.pep

      1  MHFAQLVGQT GIEQNTFCRR GFTRIDMGGN TDVTVQADRG LTSHFISLSK

     51  LETEVRECFV GFSHTVYFFT FFQRTATAFG RINQFACQTQ VHGFLTTFAG

    101  RINPAHCQS QTA*

m581/a581    98.2% identity in 113 aa overlap

                    10        20        30        40        50        60
m581.pep     MHFAQLVGQTGIEQNTFCRRGFTRVNMGGNTDVTVQADRGLTSHFISLSKLETEVRECFV
             ||||||||||||||||||||||||::||||||||||||||||||||||||||||||||||
a581         MHFAQLVGQTGIEQNTFCRRGFTRIDMGGNTDVTVQADRGLTSHFISLSKLETEVRECFV
                    10        20        30        40        50        60

                    70        80        90       100       110
m581.pep     GFSHTVYFFTFFQRTATAFGRINQFACQTQVHGFLTTFAGRIANPAHCQSQTAX
             ||||||||||||||||||||||||||||||||||||||||||||||||||||||
a581         GFSHTVYFFTFFQRTATAFGRINQFACQTQVHGFLTTFAGRIANPAHCQSQTAX
                    70        80        90       100       110
```

The following partial DNA sequence was identified in *N. gonorrhoeae* <SEQ ID 1785>:

```
g582.seq..
    1 atgcgctata ttcttttgac aggactgttg ccgacggcat ccgcttttgg

   51 agagaccgcg ctgcaatgcg ccgctttgac ggacaatgtt acgcgtttgg

  101 cgtgttacga caggatttit gcggcacagc ttccgtcttc ggcagggcag

  151 gaagggcagg agtcgaaagc cgtactcaat ctgacggaaa ccgtccgcag

  201 cagcttggat aagggcgagg cggtcattgt tgttgaaaaa ggcggggatg

  251 cgcttcctgc cgacagtgcg ggcgaaaccg ccgatatcta tacgcctttg

  301 agcctgatgt acgacttgga caaaaacgat ttgcgcgggc tgttgggcgt

  351 acgcgaacac aatccgatgt accttatgcc gttttggtat aacaattcgc

  401 ccaactatgc cccgagttcg ccgacgcgcg gtacgactgt acaggaaaaa

  451 ttcggacagc agaaacgtgc ggaaaccaaa ttgcaggttt cgttcaaaag

  501 caaaattgcc gaaatttgt ttaaaacccg cgcggatctg tggttcggct

  551 acacccaaag atccgattgg cagatttaca accaaggcag gaaatccgcg

  601 ccgttccgca atacggatta caaacctgaa attttcctga cccagcctgt

  651 gaaggcggat ttgccgttcg gcggcaggct gcgtatgctc ggtgcgggtt

  701 ttgtccacca gtccaacgga cagagccgtc ccgaatcgcg ttcgtggaac

  751 aggatttatg ccatggcagg catggaatgg ggcaaattga cggtgattcc

  801 gcgcgtgtgg gtgcgtgcgt tcgatcagag cggcgataaa aacgacaatc

  851 ccgatattgc cgactatatg gggtatggcg acgtgaagct gcagtaccgc

  901 ctgaacgaca ggcagaatgt gtattccgta ttgcgctaca accccaaaac

  951 gggctacggc gcgattgaag ccgcctacac gtttccgatt aagggcaaac

 1001 tcaaaggcgt ggtacgcgga ttccacggtt acggcgagag cctgatcgac

 1051 tacaaccaca agcagaacgg tatcggtatc gggttgatgt tcaacgactg

 1101 ggacggcatc tga
```

This corresponds to the amino acid sequence <SEQ ID 1786; ORF 582.ng>:

```
g582.pep ..
    1 MRYILLTGLL PTASAFGETA LQCAALTDNV TRLACYDRIF AAQLPSSAGQ

   51 EGQESKAVLN LTETVRSSLD KGEAVIVVEK GGDALPADSA GETADIYTPL

  101 SLMYDLDKND LRGLLGVREH NPMYLMPFWY NNSPNYAPSS PTRGTTVQEK

  151 FGQQKRAETK LQVSFKSKIA ENLFKTRADL WFGYTQRSDW QIYNQGRKSA

  201 PFRNTDYKPE IFLTQPVKAD LPFGGRLRML GAGFVHQSNG QSRPESRSWN

  251 RIYAMAGMEW GKLTVIPRVW VRAFDQSGDK NDNPDIADYM GYGDVKLQYR

  301 LNDRQNVYSV LRYNPKTGYG AIEAAYTFPI KGKLKGVVRG FHGYGESLID

  351 YNHKQNGIGI GLMFNDWDGI *
```

The following partial DNA sequence was identified in *N. meningitidis* <SEQ ID 1787>:

```
m582.seq ..
    1   ATGCGCTATA TTCTTTTGAC AGGACTGTTG CCGATGGCAT CCGCTTTTGG
```

-continued

```
  51 AGAGACCGCG CTGCAATGCG CCGCTTTGAC GGACAATGTT ACGCGTTTGG

 101 CGTGTTACGA CAGGATTTTT GCGGCACAGC TTCCGTCTTC GGCAGGGCAG

 151 GAAGGGCAGG AGTCGAAAGC CGTACTCAAT CTGACGGAAA CCGTCCGCAG

 201 CAGCCTGGAT AAGGGCGAGG CGGTCATTGT TGTTGAAAAA GGCGGGGATG

 251 CGCTTCCTGC CGACAGTGCG GGCGAAACCG CCGACATCTA TACGCCTTTG

 301 AGCCTGATGT ACGACTTGGA CAAAAACGAT TTGCGCGGGC TGTTGGGCGT

 351 ACGCGAACAC AATCCGATGT ACCTTATGCC GCTCTGGTAC AACAATTCGC

 401 CCAACTATGC CCCGGGTTCG CCGACGCGCG GTACGACTGT ACAGGAAAAA

 451 TTCGGACAGC AGAAACGTGC GGAAACCAAA TTGCAGGTTT CGTTCAAAAG

 501 CAAAATTGCC GAAGATTTGT TTAAAACCCG CGCGGATCTG TGGTTCGGCT

 551 ACACCCAAAG ATCCGATTGG CAGATTTACA ACCAAGGCAG GAAATCCGCG

 601 CCGTTCCGCA ATACGGATTA CAAACCTGAA ATTTTCCTGA CCCAGCCTGT

 651 GAAGGCGGAT TTGCCGTTCG GCGGCAGGCT GCGTATGCTC GGTGCGGGTT

 701 TTGTCCACCA GTCCAACGGA CAGAGCCGTC CCGAATCGCG TTCGTGGAAC

 751 AGGATTTACG CCATGGCAGG CATGGAATGG GGCAAATTGA CGGTGATTCC

 801 GCGCGTGTGG GTGCGTGCGT TCGATCAGAG CGGCGATAAA AACGACAATC

 851 CCGATATTGC CGACTATATG GGGTATGGCG ACGTGAAGCT GCAGTACCGC

 901 CTGAACGACA GGCAGAATGT GTATTCCGTA TTGCGCTACA ACCCCAAAAC

 951 GGGCTACGGC GCGATTGAAG CCGCCTACAC GTTTCCGATT AAGGGCAAAC

1001 TCAAAGGCGT GGTACGCGGA TTCCACGGTT ACGGCGAGAG CCTGATCGAC

1051 TACAACCACA AGCAGAACGG TATCGGTATC GGGTTGATGT TCAACGACTT

1101 GGACGGCATC TGA
```

This corresponds to the amino acid sequence <SEQ ID 1788; ORF 582>:

```
m582.pep

      1   MRYILLTGLL PMASAFGETA LQCAALTDNV TRLACYDRIF AAQLPSSAGO

     51   EGQESKAVLN LTETVRSSLD KGEAVIVVEK GGDALPADSA GETADIYTPL

    101   SLMYDLDKND LRGLLGVREH NPMYLMPLWY NNSPNYAPGS PTRGTTVQEK

    151   FGQQKRAETK LQVSFKSKIA EDLFKTRADL WFGYTQRSDW QIYNQGRKSA

    201   PFRBTDTJOE UFKTQOVJAD KOFGGRKRNK GAGFVGQSBG QSROESRSWN

    251   RIYANAGMEW GKLTVIPRVW VRAFDQSGDK NDNPDIADYM GYGDVKLQYR

    301   LNDRQNVYSV LRYNPKTGYG AIEAAYTFPI KGKLKGVVRG FHGYGESLID

    351   YNHKQNGIGI GLMFNDLDGI *

m582/g582    98.6% identity in 370 aa overlap

                  10         20         30         40         50         60
    m582.pep  MRYILLTGLLPMASAFGETALQCAALTDNVTRLACYDRIFAAQLPSSAGQEGQESKAVLN
              ||||||||||| ||||||||||||||||||||||||||||||||| |||||||||||||
    g582      MRYILLTGLLPTASAFGETALQCAALTDNVTRLACYDRIFAAQLPSAAGQEGQESKAVLN
                  10         20         30         40         50         60

                  70         80         90        100        110        120
    m582.pep  LTETVRSSLDKGEAVIVVEKGGDALPADSAGETADIYTPLSLMYDLDKNDLRGLLGVREH
              ||||||||||||||||||||||||||||||||||||||||||||||||||||||||||||
    g582      LTETVRSSLDKGEAVIVVEKGGDALPADSAGETADIYTPLSLMYDLDKNDLRGLLGVREH
                  70         80         90        100        110        120
```

-continued

```
                    130       140       150       160       170       180
m582.pep     NPMYLMPLWYNNSPNYAPGSPTRGTTVQEKFGQQKRAETKLQVSFKSKIAEDLFKTRADL
             |||||||:||||||||:||||||||||||||||||||||||||||||||||:||||||||
g582         NPMYLMPFWYNNSPNYAPSSPTRGTTVQEKFGQQKRAETKLQVSFKSKIAENLFKTRADL
                    130       140       150       160       170       180

                    190       200       210       220       230       240
m582.pep     WFGYTQRSDWQIYNQGRKSAPFRNTDYKPEIFLTQPVKADLPFGGRLRMLGAGFVHQSNG
             ||||||||||||||||||||||||||||||||||||||||||||||||||||||||||||
g582         WFGYTQRSDWQIYNQGRKSAPFRNTDYKPEIFLTQPVKADLPFGGRLRMLGAGFVHQSNG
                    190       200       210       220       230       240

                    250       260       270       280       290       300
m582.pep     QSRPESRSWNRIYAMAGMEWGKLTVIPRVWVRAFDQSGDKNDNPDIADYMGYGDVKLQYR
             ||||||||||||||||||||||||||||||||||||||||||||||||||||||||||||
g582         QSRPESRSWNRIYAMAGMEWGKLTVIPRVWVRAFDQSGDKNDNPDIADYMGYGDVKLQYR
                    250       260       270       280       290       300

                    310       320       330       340       350       360
m582.pep     LNDRQNVYSVLRYNPKTGYGAIEAAYTFPIKGKLKGVVRGFHGYGESLIDYNHKQNGIGI
             ||||||||||||||||||||||||||||||||||||||||||||||||||||||||||||
g582         LNDRQNVYSVLRYNPKTGYGAIEAAYTFPIKGKLKGVVRGFHGYGESLIDYNHKQNGIGI
                    310       320       330       340       350       360

                    370
m582.pep     GLMFNDLDGIX
             |||||| ||||
g582         GLMFNDWDGIX
```

370

The following partial DNA sequence was identified in *N. meningitidis* <SEQ ID 1789>:

```
a582.seq
   1 ATGCGCTATA TTCTTTTGAC AGGACTGTTG CCGATGGCAT CCGCTTTTGG

  51 AGAGACCGCG CTGCAATGCG CCGCTTTGAC GGACAATGTT ACGCGTTTGG

 101 CGTGTTACGA CAGGATTTTT GCGGCACAGC TTCCGTCTTC GGCAGGGCAG

 151 GAAGGGCAGG AGTCGAAAGC CGTACTCAAT CTGACGGAAA CCGTCCGCAG

 201 CAGCCTGGAT AAGGGCGAGG CGGTCATTGT TGTTGAAAAA GGCGGGGATG

 251 CGCTTCCTGC CGACAGTGCG GGCGAAACCG CCGACATCTA TACGCCTTTG

 301 AGCCTGATGT ACGACTTGGA CAAAAACGAT TTGCGCGGGC TGTTGGGCGT

 351 ACGCGAACAC AATCCGATGT ACCTTATGCC GCTCTGGTAC AACAATTCGC

 401 CCAACTATGC CCCGGGTTCG CCGACGCGCG GTACGACTGT ACAGGAAAAA

 451 TTCGGACAGC AGAAACGTGC GGAAACCAAA TTGCAGGTTT CGTTCAAAAG

 501 CAAAATTGCC GAAGATTTGT TTAAAACCCG CGCGGATCTG TGGTTCGGCT

 551 ACACCCAAAG ATCCGATTGG CAGATTTACA ACCAAGGCAG GAAATCCGCG

 601 CCGTTCCGCA ATACGGATTA CAAACCTGAA ATTTTCCTGA CCCAGCCTGT

 651 GAAGGCGGAT TTGCCGTTCG GCGGCAGGCT GCGTATGCTC GGTGCGGGTT

 701 TTGTCCACCA GTCCAACGGA CAGAGCCGTC CCGAATCGCG TTCGTGGAAC

 751 AGGATTTACG CCATGGCAGG CATGGAATGG GGCAAATTGA CGGTGATTCC

 801 GCGCGTGTGG GTGCGTGCGT TCGATCAGAG CGGCGATAAA AACGACAATC

 851 CCGATATTGC CGACTATATG GGGTATGGCG ACGTGAAGCT GCAGTACCGC

 901 CTGAACGACA GGCAGAATGT GTATTCCGTA TTGCGCTACA ATCCCAAAAC

 951 GGGCTACGGC GCGATTGAAG CCGCCTACAC GTTTCCGATT AAGGGCAAAC

1001 TCAAAGGCGT GGTACGCGGA TTCCACGGTT ACGGCGAGAG CCTGATCGAC

1051 TACAACCACA AGCAGAACGG TATCGGTATC GGGTTGATGT TCAACGACTT

1101 GGACGGCATC TGA
```

This corresponds to the amino acid sequence <SEQ ID 1790; ORF 582.a>:

```
a582.pep

      1 MRYILLTGLL PMASAFGETA LQCAALTDNV TRLACYDRIF AAQLPSSAGQ

     51 EGQESKAVLN LTETVRSSLD KGEAVIVVEK GGDALPADSA GETADIYTPL

    101 SLMYDLDKND LRGLLGVREH NPMYLMPLWY NNSPNYAPGS PTRGTTVQEK

    151 FGQQKRAETK LQVSFKSKIA EDLFKTRADL WFGYTQRSDW QIYNQGRKSA

    201 PFRNTDYKPE IFLTQPVKAD LPFGGRLRML GAGFVHQSNG QSRPESRSWN

    251 RIYAMAGMEW GKLTVIPRVW VRAFDQSGDK NDNPDIADYM GYGDVKLQYR

    301 LNDRQNVYSV LRYNPKTGYG AIEAAYTFPI KGKLKGVVRG FHGYGESLID

    351 YNHKQNGIGI GLMFNDLDGI *
```

```
m582/a582 100.0% identity in 370 aa overlap

                   10        20        30        40        50        60
m582.pep MRYILLTGLLPMASAFGETALQCAALTDNVTRLACYDRIFAAQLPSSAGQEGQESKAVLN
         ||||||||||||||||||||||||||||||||||||||||||||||||||||||||||||
a582     MRYILLTGLLPMASAFGETALQCAALTDNVTRLACYDRIFAAQLPSSAGQEGQESKAVLN
                   10        20        30        40        50        60

                   70        80        90       100       110       120
m582.pep LTETVRSSLDKGEAVIVVEKGGDALPADSAGETADIYTPLSLMYDLDKNDLRGLLGVREH
         ||||||||||||||||||||||||||||||||||||||||||||||||||||||||||||
a582     LTETVRSSLDKGEAVIVVEKGGDALPADSAGETADIYTPLSLMYDLDKNDLRGLLGVREH
                   70        80        90       100       110       120

                  130       140       150       160       170       180
m582.pep NPMYLMPLWYNNSPNYAPGSPTRGTTVQEKFGQQKRAETKLQVSFKSKIAEDLFKTRADL
         ||||||||||||||||||||||||||||||||||||||||||||||||||||||||||||
a582     NPMYLMPLWYNNSPNYAPGSPTRGTTVQEKFGQQKRAETKLQVSFKSKIAEDLFKTRADL
                  130       140       150       160       170       180

                  190       200       210       220       230       240
m582.pep WFGYTQRSDWQIYNQGRKSAPFRNTDYKPEIFLTQPVKADLPFGGRLRMLGAGFVHQSNG
         ||||||||||||||||||||||||||||||||||||||||||||||||||||||||||||
a582     WFGYTQRSDWQIYNQGRKSAPFRNTDYKPEIFLTQPVKADLPFGGRLRMLGAGFVHQSNG
                  190       200       210       220       230       240

                  250       260       270       280       290       300
m582.pep QSRPESRSWNRIYAMAGMEWGKLTVIPRVWVRAFDQSGDKNDNPDIADYMGYGDVKLQYR
         ||||||||||||||||||||||||||||||||||||||||||||||||||||||||||||
a582     QSRPESRSWNRIYAMAGMEWGKLTVIPRVWVRAFDQSGDKNDNPDIADYMGYGDVKLQYR
                  250       260       270       280       290       300

                  310       320       330       340       350       360
m582.pep LNDRQNVYSVLRYNPKTGYGAIEAAYTFPIKGKLKGVVRGFHGYGESLIDYNHKQNGIGI
         ||||||||||||||||||||||||||||||||||||||||||||||||||||||||||||
a582     LNDRQNVYSVLRYNPKTGYGAIEAAYTFPIKGKLKGVVRGFHGYGESLIDYNHKQNGIGI
                  310       320       330       340       350       360

                  370
m582.pep GLMFNDLDGIX
         |||||||||||
a582     GLMFNDLDGIX
                  370
```

The following partial DNA sequence was identified in *N. gonorrhoeae* <SEQ ID 1791>:

```
g583.seq..
  1 atgataattg accaaagcca aatatttacc catcttgcct tctgtgcctt

 51 ttgcgggatt ggagccgtaa ctgccggcaa tcgactgcat aatcggatgt

101 ataatgccgc cgccgcgcgc ggtattggaa ggggtaacgg gagccagcag

151 cagttcggaa agagcgagac tgtaaccgat gcccagcgtt tttcttccaa

201 aaacggcgat aaacaaatat ccgatacgca tccccagccc tgttttgagc

251 aaaccgcgcg aaatcataac tgcgatggca atcagccaaa tcaacggatt

301 ggcgaacgca ctcaacgcat cgctcatcgc cgcgcccggt ttgtcggcgg

351 ttacgccggt tactgcgacc aacccgacgg caataatcga cagcgcgccc
```

-continued

```
401 aacggcataa ccttgccgat aatggcggca atcacaccga caaacatagc

451 cagcagcgtc caagcctgag gcttgacccc gtcgggtacg ggcagtgcca

501 aaaccagggc gcacaatact gcggcaatgg cgaggggtat cggtttgaaa

551 cccaatttca tcatattgac ctccgtaaaa aagaccgtcc cgaaaaatcg

601 gaaaaataa
```

This corresponds to the amino acid sequence <SEQ ID 1792; ORF 583.ng>:

```
g583.pep..
   1 MIIDQSQIFT HLAFCAFCGI GAVTAGNRLH NRMYNAAAAR GIGRGNGSQQ

  51 QFGKSETVTD AQRFSSKNGD KQISDTHPQP CFEQTARNHN CDGNQPNQRI

 101 GERTQRIAHR RARFVGGYAG YCDQPDGNNR QRAQRHNLAD NGGNHTDKHS

 151 QQRPSLRLDP VGYGQCQNQG AQYCGNGEGY RFETQFHHID LRKKDRPEKS

 201 EK*
```

The following partial DNA sequence was identified in *N. meningitidis* <SEQ ID 1793>:

```
m583.seq..
   1 ATGATAGTTG ACCAAAGCCA AATATTTACC CATCTTGCCT TCTGTGCCTT

  51 TTGCGGGATT GGAGCCGTAA CTGCCGGCAA TCGACTGCAT AATCGGATGT

 101 ATAATGCCGC CGCCGCGCGC GGTATTGGAA GGGGTAACGG GAGCCAGCAG

 151 CAGTTCGGAA AGAGCGAGAC TGTAACCGAT GCCCAGCGTT TTTCTTCCAA

 201 AAACGGCGAT AAACAAATAT CCGATACGCA TCCCCAGCCC TGTTTTGAGC

 251 AAACCGCGCG AAATCATAAC TGCGATGGCA ATCAGCCAAA TCAACGGATT

 301 GGCGAACGCA CTCAACGCAT CGCTCATCGC CGCGCCCGGT TTGTCGGCGG

 351 TTACGCCGGT TACTGCGACC AACCCGACGG CAATAATCGA CAGCGCGCCC

 401 AACGGCATGG CCTTGCCGAT AATGGCGGCA ATCACACCGA CAAACATGGC

 451 CAGCAGCGTC CAAGCCTGAG GCTTGACCCC GTCGGGTACG GGCAGTGCCA

 501 AAACCAGGGC GCACAATACT GCGGCAATGG CGAGGGGTAT CGGTTTGAAA

 551 CCCAATTTCA TCATATTGAC CTCCGTAAAA AAGACCGTCC CGAAAAATCG

 601 GAAAAATAA
```

This corresponds to the amino acid sequence <SEQ ID 1794; ORF 583>:

```
a583.pep..

   1  MIVDQSQIFT HLAFCAFCGI GAVTAGNRLH NRMYNAAAAR GIGRGNGSQQ

  51  QFGKSETVTD AQRFSSKNGD KQISDTHPQP CFEQTARNHN CDGNQPNQRI

 101  GERTQRIAHR RARFVGGYAG YCDQPDGNNR QRAQRHGLAD NGGNHTDKHG

 151  QQRPSLRLDP VGYGQCQNQG AQYCGNGEGY RFETQFHHID LRKKDRPEKS

 201  EK*

m583/g583 98.5% identity in 202 aa overlap
```

-continued

```
                10        20        30        40        50        60
m583.pep MIVDQSQIFTHLAFCAFCGIGAVTAGNRLHNRMYNAAAARGIGRGNGSQQQFGKSETVTD
         ||:|||||||||||||||||||||||||||||||||||||||||||||||||||||||||
g583     MIIDQSQIFTHLAFCAFCGIGAVTAGNRLHNRMYNAAAARGIGRGNGSQQQFGKSETVTD
                10        20        30        40        50        60

                70        80        90       100       110       120
m583.pep AQRFSSKNGDKQISDTHPQPCFEQTARNHNCDGNQPNQRIGERTQRIAHRRARFVGGYAG
         ||||||||||||||||||||||||||||||||||||||||||||||||||||||||||||
g583     AQRFSSKNGDKQISDTHPQPCFEQTARNHNCDGNQPNQRIGERTQRIAHRRARFVGGYAG
                70        80        90       100       110       120

               130       140       150       160       170       180
m583.pep YCDQPDGNNRQRAQRHGLADNGGNHTDKHGQQRPSLRLDPVGYGQCQNQGAQYCGNGEGY
         ||||||||||||||||:||||||||||||:||||||||||||||||||||||||||||||
g583     YCDQPDGNNRQRAQRHNLADNGGNHTDKHSQQRPSLRLDPVGYGQCQNQGAQYCGNGEGY
               130       140       150       160       170       180

               190       200
m583.pep RFETQFHHIDLRKKDRPEKSEKX
         ||||||||||||||||||||||
a583     RFETQFHHIDLRKKDRPEKSEKX
               190       200
```

The following partial DNA sequence was identified in *N. meningitidis* <SEQ ID 1795>:

```
a583.seq
   1 ATGATAGTTG ACCAAAGCCA AATATTTACC CATCTTGCCT TCTGTGCCTT

  51 TTGCGGGATT GGAGCCGTAA CTGCCGGCAA TCGACTGCAT AATCGGATGT

 101 ATAATGCCGC CGCCGCGCGC GGTATTGGAA GGGGTAACGG GAGCCAGCAG

 151 CAGTTCGGAA AGAGCGAGAC TGTAACCGAT GCCCAGCGTT TTTCTTCCAA

 201 AAACGGCGAT AAACAAATAT CCGATACGCA TCCCCAGCCC TGTTTTGAGC

 251 AAACCGCGCG AAATCATAAC TGCGATGGCA ATCAGCCAAA TCAACGGATT

 301 GGCGAACGCA CTCAACGCAT CGCTCATCGC CGCACCCGGT TTGTCGGCGG

 351 TTACGCCGGT TACTGCGACC AACCCGACGG CAATAATCGA CAGCGCACCC

 401 AACGGCATGG CCTTGCCGAT AATGGCGGCA ATCACACCGA TAAACATGGC

 451 CAGCAGCGTC CAAGCCTGAG GCTTGACCCC GTCGGGTACG GGCAGTGCCA

 501 AAACCAAGGC GCACAATACT GCGGCAATGG CGAGGGGTAT CGGTTTGAAA

 551 CCCAATTTCA TCATATTGAC CTCCGTAAAA AAGACCGTCC CGAAAAATCG

 601 GAAAAATAA
```

This corresponds to the amino acid sequence <SEQ ID 1796; ORF 583.a>:

```
a583.pep

      1  MIVDQSQIFT HLAFCAFCGI GAVTAGNRLH NRMYNAAAAR GIGRGNGSQQ

     51  QFGKSETVTD AQRFSSKNGD KQISDTHPQP CFEQTARNHN CDGNQPNQRI

    101  GERTQRIAHR RTRFVGGYAG YCDQPDGNNR QRTQRHGLAD NGGNHTDKHG

    151  QQRPSLRLDP VGYGQCQNQG AQYCGNGEGY RFETQFHHID LRKKDRPEKS

    201  EK*

m583/a583 99.0% identity in 202 aa overlap

                10        20        30        40        50        60
m583.pep MIVDQSQIFTHLAFCAFCGIGAVTAGNRLHNRMYNAAAARGIGRGNGSQQQFGKSETVTD
         ||||||||||||||||||||||||||||||||||||||||||||||||||||||||||||
a583     MIVDQSQIFTHLAFCAFCGIGAVTAGNRLHNRMYNAAAARGIGRGNGSQQQFGKSETVTD
                10        20        30        40        50        60
```

-continued

```
                 70        80        90        100       110       120
m583.pep AQRFSSKNGDKQISDTHPQPCFEQTARNHNCDGNQPNQRIGERTQRIAHRRARFVGGYAG
         |||||||||||||||||||||||||||||||||||||||||||||||||||:||||||||
a583     AQRFSSKNGDKQISDTHPQPCFEQTARNHNCDGNQPNQRIGERTQRIAHRRTRFVGGYAG
                 70        80        90        100       110       120

                 130       140       150       160       170       180
m583.pep YCDQPDGNNRQRAQRHGLADNGGNHTDKHGQQRPSLRLDPVGYGQCQNQGAQYCGNGEGY
         |||||||||||:||||||||||||||||||||||||||||||||||||||||||||||||
a583     YCDQPDGNNRQRTQRHGLADNGGNHTDKHGQQRPSLRLDPVGYGQCQNQGAQYCGNGEGY
                 130       140       150       160       170       180

                 190       200
m583.pep RFETQFHHIDLRKKDRPEKSEKX
         |||||||||||||||||||||||
a583     RFETQFHHIDLRKKDRPEKSEKX
                 190       200
```

The following partial DNA sequence was identified in *N. gonorrhoeae* <SEQ ID 1797>:

```
g584.seq..
   1 atgctgcgtt ctattttggc ggcttccctg ctggcggtat cttttccggc

  51 ggcggctgag gcattgaatt acaatattgt cgaattttcc gaatcggcgg

 101 gtatcgaggt ggctcaggat acaatgtccg cgcgtttcca ggtggcggcg

 151 gaaggacggg acaaaaatgc cgtcaatgcc gagtttgtta aaaaattcaa

 201 caatttcacc agaaaatcga aaaatggtag ctttaaaacc gaattggtat

 251 cgcgcagtgc gatgccgcgc tatcaatata ccaacggcag acgcattcaa

 301 acaggctggg aggagcgtgc ggaatttaag gcggagggca gggattttga

 351 tgctttaaac cgttttattg ctgatgttca gacggatgct tcgcttgaag

 401 ataccgattt cagcgtgtcg cgcgaacgcc gaaacgaggt catcgatcag

 451 gtcagcaagg atgccgtttt gcgtttcaag gcgcgtgccg aaaaactggc

 501 gggcgttctg ggtgcgtccg gttataaaat cgtcaaattg aattttgggc

 551 aaatcggcag ccatattgcg ggcgatgggg ctgttcgggc aaaaatgctg

 601 cgcgcgatgc cgatggcggc aagcgtcaat atgaagggta cggattcagc

 651 cgcaccgggt gtggaggaaa tcagcatcag catcaatggg acggttcagt

 701 tctaa
```

This corresponds to the amino acid sequence <SEQ ID 1798; ORF 584.ng>:

```
g584.pep Length: ..
   1 MLRSILAASL LAVSFPAAAE ALNYNIVEFS ESAGIEVAQD TMSARFQVAA

  51 EGRDKNAVNA EFVKKFNNFT RKSKNGSFKT ELVSRSAMPR YQYTNGRRIQ

 101 TGWEERAEFK AEGRDFDALN RFIADVQTDA SLEDTDFSVS RERRNEVIDQ

 151 VSKDAVLRFK ARAEKLAGVL GASGYKIVKL NFGQIGSHIA GDGAVRAKML

 201 RAMPMAASVN MKGTDSAAPG VEEISISING TVQF*
```

The following partial DNA sequence was identified in *N. meningitidis* <SEQ ID 1799>:

```
m584.seq..
   1 ATGTTGCGTC TTGTTTTGGC GGCTTCGCTG TCGGCGGTAT CTTTTCCGGC

  51 AGCGGCTGAA GCATTGAATT ACAATATTGT CGAATTTTCC GAATCGGCGG

 101 GTGTCGAGGT GGCTCAGGAT ACAATGTCCG CACGTTTCCA AGTGACGGCG
```

-continued

```
151 GAAGGACGGG ACAAAAATGC CGTCAATGCT GAGTTTGTTA AAAAATTCAA

201 CAAGTTCATC AGAAAATCGA AAAATGGTAG CTTTAAAACC GAATTGGTAT

251 CGCGCAGTGC GATGCCGCGC TATCAATATA CCAACGGCAG ACGCATTCAA

301 ACAGGCTGGG AGGAGCGTGC GGAATTTAAG GTCGAAGGTA GAGATTTTGA

351 TGAGTTAAAC CGTTTTATTG CCGATATTCA AGCAGATGCC GCGTTGGmAT

401 ATACGGATTT CCATGTGTCG CGCGAACGCC GCAACGAGGT CATCkATCAG

451 GTCAGCAAGG ATGCCGTTTT GCGTTTCAAG GCGCGTGCCG AAAAGTTGGC

501 GGGCGTTTTG GGTGCGTCCG GTTATAAAAT CGTCAAATTG AATTTGGGAC

551 ACATCGGCAG CCATATCGCG GGAGGGGGAG CTGCTCAGGC AAAAATGCTT

601 CGTGCCATGC CGATGGCGGC AAGCGTCAAT ATGGAGGGTG CGGATTCCGC

651 CGCGCCTGGT GTGGAGGAAA TCAGCATCAG CGTCAATGGG ACGGTTCAGT

701 TCTGA
```

This corresponds to the amino acid sequence <SEQ ID 1800; ORF 584>:

```
a584.pep..

      1  MLRLVLAASL SAVSFPAAAE ALNYNIVEFS ESAGVEVAQD TMSARFQVTA

     51  EGRDKNAVNA EFVKKFNKFI RKSKNGSFKT ELVSRSAMPR YQYTNGRRIQ

    101  TGWEERAEFK VEGRDFDELN RFIADIQADA ALXYTDFHVS RERRNEVIXQ

    151  VSKDAVLRFK ARAEKLAGVL GASGYKIVKL NLGHIGSHIA GGGAAQAKML

    201  RAMPMAASVN MEGADSAAPG VEEISISVNG TVQF*
```

m584/g584 89.7% identity in 234 aa overlap

```
                 10        20        30        40        50        60
m584.pep MLRLVLAASLSAVSFPAAAEALNYNIVEFSESAGVEVAQDTMSARFQVTAEGRDKNAVNA
         ||| :||||| |||||||||||||||||||||||:||||||||||||||:||||||||||
g584     MLRSILAASLLAVSFPAAAEALNYNIVEFSESAGIEVAQDTMSARFQVAAEGRDKNAVNA
                 10        20        30        40        50        60

                 70        80        90       100       110       120
m584.pep EFVKKFNKFIRKSKNGSFKTELVSRSAMPRYQYTNGRRIQTGWEERAEFKVEGRDFDELN
         |||||||:| ||||||||||||||||||||||||||||||||||||||||:|||||| ||
g584     EFVKKFNNFTRKSKNGSFKTELVSRSAMPRYQYTNGRRIQTGWEERAEFKAEGRDFDALN
                 70        80        90       100       110       120

                130       140       150       160       170       180
m584.pep RFIADIQADAALXYTDFHVSRERRNEVIXQVSKDAVLRFKARAEKLAGVLGASGYKIVKL
         |||||:|:||:|  ||| |||||||||| |||||||||||||||||||||||||||||||
g584     RFIADVQTDASLEDTDFSVSRERRNEVIDQVSKDAVLRFKARAEKLAGVLGASGYKIVKL
                130       140       150       160       170       180

                190       200       210       220       230
m584.pep NLGHIGSHIAGGGAAQAKMLRAMPMAASVNMEGADSAAPGVEEISISVNGTVQFX
         |:|:||||||| ||::|||||||||||||||:|:|||||||||||||:|||||||
g584     NFGQIGSHIAGDGAVRAKMLRAMPMAASVNMKGTDSAAPGVEEISISINGTVQFX
                190       200       210       220       230
```

The following partial DNA sequence was identified in *N. meningitidis* <SEQ ID 1801>:

```
a584.seq
  1 ATGTTGCGTT CTATTTTGGC GGCTTCCCTG CTG....... ..........

 51 .......... .......... .....ATTGT CGAATTTTCT GAATCGGCGG

101 GTGTCGAGGC GGTTCAGGAT ACAATGTCCG CACGTTTCCA AGTGACGGCG

151 GAAGGACGGG ACAAAAATGC CGTCAATGCC GAGTTTGTTA AAAAATTCAA

201 CAATTTCACC AGAAAATCAA AAAATGGTAG CTTTAAAACC GAATTGGTAT
```

-continued

```
251 CGCGCAGTGC GATGCCGCGC TATCAATATA CCAACGGCAG ACGCATTCAA

301 ACAGGTTGGG AGGAGCGTGC GGAATTTAAG GTCGAGGGTA GGAATTTTGA

351 TGCGTTGAAC CGTTTTATTG CCGATGTTCA GGCAGATGCC GCGTTGGAAT

401 ATACGGATTT CCATGTGTCG CGCGAACGCC GCAACGAGGT CATCGATCAG

451 GTCAGCAAGG ATGCCGTTTT GCGTTTCAAG GCGCGTGCCG AAAAGTTGGC

501 GGGCGTTTTG GGTGCGTCCG GTTATAAAAT CGTCAAATTG AATTTGGGAC

551 ACATCGGCAG CCATATCGCG GGAGGGGGAG CTGCTCAGGC AAAAATGCTT

601 CGTGCCATGC CGATGGCGGC AAGCGTCAAT ATGGAGGGTG CGGATTCCGC

651 CGCGCCTGGT GTGGAGGAAA TCAGCATCAG CGTCAATGGG ACGGTTCAGT

701 TCTGA
```

This corresponds to the amino acid sequence <SEQ ID 1802; ORF 584.a>:

```
a584.pep

     1  MLRSILAASL L......... .....IVEFS ESAGVEAVQD TMSARFQVTA

    51  EGRDKNAVNA EFVKKFNNFT RKSKNGSFKT ELVSRSAMPR YQYTNGRRIQ

   101  TGWEERAEFK VEGRNFDALN RFIADVQADA ALEYTDFHVS RERRNEVIDQ

   151  VSKDAVLRFK ARAEKLAGVL GASGYKIVKL NLGHIGSHIA GGGAAQAKML

   201  RAMPMAASVN MEGADSAAPG VEEISISVNG TVQF*

m584/a584 88.9% identity in 234 aa overlap

                 10        20        30        40        50        60
m584.pep MLRLVLAASLSAVSFPAAAEALNYNIVEFSESAGVEVAQDTMSARFQVTAEGRDKNAVNA
         ||| :|||||               |||||||||||::||||||||||||||||||||||
a584     MLRSILAASLL--------------IVEFSESAGVEAVQDTMSARFQVTAEGRDKNAVNA
                 10                      20        30        40

                 70        80        90       100       110       120
m584.pep EFVKKFNKFIRKSKNGSFKTELVSRSAMPRYQYTNGRRIQTGWEERAEFKVEGRDFDELN
         |||||||:| ||||||||||||||||||||||||||||||||||||||||||||:|| ||
a584     EFVKKFNNFTRKSKNGSFKTELVSRSAMPRYQYTNGRRIQTGWEERAEFKVEGRNFDALN
           50        60        70        80        90       100

                130       140       150       160       170       180
m584.pep RFIADIQADAALXYTDFHVSRERRNEVIXQVSKDAVLRFKARAEKLAGVLGASGYKIVKL
         |||||:|||||| ||||||||||||||| |||||||||||||||||||||||||||||||
a584     RFIADVQADAALEYTDFHVSRERRNEVIDQVSKDAVLRFKARAEKLAGVLGASGYKIVKL
          110       120       130       140       150       160

                190       200       210       220       230
m584.pep NLGHIGSHIAGGGAAQAKMLRAMPMAASVNMEGADSAAPGVEEISISVNGTVQFX
         |||||||||||||||||||||||||||||||||||||||||||||||||||
a584     NLGHIGSHIAGGGAAQAKMLRAMPMAASVNMEGADSAAPGVEEISISVNGTVQFX
          170       180       190       200       210        220
```

The following partial DNA sequence was identified in *N. gonorrhoeae* <SEQ ID 1803>:

```
g585.seq..
  1 atgaaactgt tccaacgcat tttcgccaca ttttgcgcgg ttatcgtctg

 51 cgcaatcttt gtggcgagtt tttctttttg gctggtgcag aacacccttg

101 ccgaaaacca attcaaccaa cgccgcacca tcgaaaccac attgatgggc

151 agcattattt ccgcattcaa gacacggggc gacaacggcg cgcgcgaaat

201 cctgaccgaa tggaaaaaca gccccgtctc atccgccgtt tacgtcatac

251 agggcgacga gaaaaaagac atcttaaacc gctatatcga caattacacc

301 atagaacgcg cccggctgtt tgccgccaac aacccccatt ccaaccttgt
```

-continued

```
351 ccgcatcgaa tacgaccgtt tcggcgaaga atacctgttc ttcattaaag

401 gctgggacaa ccaccaggca caacgcctgc ccagcccgct gtttatcccg

451 ggcctgccgc ttgccccgat ttggcacgaa ttcatcatcc tctccttcat

501 catcattgtc ggactgctga tggcatatat ccttgccggc aacattgcca

551 aacccatcag aatcttaggc aacggcatgg acagggtggc agaacgagaa

601 cttgaagacc gcgtttgcca acaggttcgc gaccgcgacg acgaattggc

651 cgatgttgcc atgcaattcg acacaatggt ggaaaaactg gaataa
```

This corresponds to the amino acid sequence <SEQ ID 1804; ORF 585.ng>:

```
g585.pep..
  1 MKLFQRIFAT FCAVIVCAIF VASFSFWLVQ NTLAENQFNQ RRTIETTLMG

 51 SIISAFKTRG DNGAREILTE WKNSPVSSAV YVIQGDEKKD ILNRYIDNYT

101 IERARLFAAN NPHSNLVRIE YDRFGEEYLF FIKGWDNHQA QRLPSPLFIP

151 GLPLAPIWHE FIILSFIIIV GLLMAYILAG NIAKPIRILG NGMDRVAERE

201 LEDRVCQQVR DRDDELADVA MQFDTMVEKL E*
```

The following partial DNA sequence was identified in *N. meningitidis* <SEQ ID 1805>:

```
m585.seq..
   1 ATGAAACTGT TCCAACGCAT TTTCGCCACA TTTTGCGCGG TTATCGTCTG

  51 TGCAATCTTT GTGGCGAGTT TTTCTTTCTG GCTGGTGCAG AACACCCTTG

 101 CCGAAAACCA GTTCAACCAA CGCCGCACCA TCGAAACCAC TTTGATGGGC

 151 AGCATCATTT CCGCATTCCG GGCACGCGGG GACGCGGGTG CGCGCGAAAT

 201 CCTGACGGAA TGGAAAGACA GCCCCGTCTC ATCGGGCGTG TACGTTATAC

 251 AGGGCGACGA GAAAAAAGAT ATCCTGAACC GGTATATCGA CAGCTATACC

 301 ATCGAACGCG CCCGGCTTTT CGCCGCCGGA CACCCGCATT CCAACCTCGT

 351 CCATATCGAA TACGACCGCT TCGGCGAAGA ATACCTGTTC TTCACCAAAG

 401 ACTGGGACAA ACTCCAAGCC CGCCGCCTGC CCAGCCCCCT GTTGATCCCC

 451 GGCCTGCCGC TCGCCCCGAT TTGGCACGAA CTCATCATAT TGTCCTTCAT

 501 CATCATCGTC GGACTGCTGA TGGCATATAT CCTCGCCGGC AACATTGCCA

 551 AACCCATCAG AATCTTAGGC AACGGCATGG ACAGGGTGGC AAACGGAGAA

 601 CTTGAAACCC GTATCTCCCA ACAGGTCGAC GACCGCGACG ACGAATTGTC

 651 CCATCTTGCC ATCCAATTCG ACAAAATGGT GGAAAAACTC GAAAAACTCG

 701 TTGCCAAAGA ACGCCACCTG CTCCATCACG TCTCCCATGA AATGCGTTCT

 751 CCCCTTGCGC GCATGCAGGC AATTGTCGGA CTGATTCAGG CGCAGCCCCA

 801 AAAACAGGAG CAATATCTCA AACGGCTGGA AGGCGAACTG ACCCGCATGG

 851 ATACGCTGGC CGGGGAACTG TTAACCCTGT CCCGTCTCGA AACTTCCAAT

 901 ATGGCTTTGG AAAAAGAAAG CCTGAAACTC CTGCCCTTCC TGGGCAACCT

 951 GGTAGAAGAC AATCAAAGCA TTGCCCAGAA AAACGGACAA ACGGTTACCC

1001 TGTCTGCCGA CGGAAAAATC CCCGAAAACA CAACCATCCT TGCCAACGAA

1051 AGCTACCTGT ACCGCGCCTT CGACAACGTC ATCCGCAACG CCGTCAACTA
```

```
1101 CAGTCCCGAA GGCAGCACCA TCCTGATCAA CATCGGACAA GACCACAAAC

1151 ACTGGATAAT CGACGTTACC GACAACGGCC CCGGCGTGGA CGAAATGCAG

1201 CTCCCGCACA TCTTCACCGC TTTCTACCGT GCAGACTCCA GTGCCAACAA

1251 ACCCGGAACA GGACTGGGGC TTGCATTGAC CCAACATATT ATTGAACAGC

1301 ACTGCGGCAA AATCATCGCC GAAAACATCA AACCGAACGG TCTGCGGATG

1351 CGCTTTATCC TGCCCAAGAA AAAACCGGT TCCAAACAG AAAAAGTGC

1401 GAACTGA
```

This corresponds to the amino acid sequence <SEQ ID 1806; ORF 585>:

```
m585.pep..

    1  MKLFQRIFAT FCAVIVCAIF VASFSFWLVQ NTLAENQFNQ RRTIETTLMG
   51  SIISAFRARG DAGAREILTE WKDSPVSSGV YVIQGDEKKD ILNRYIDSYT
  101  IERARLFAAG HPHSNLVHIE YDRFGEEYLF FTKDWDKLQA RRLPSPLLIP
  151  GLPLAPIWHE LIILSFIIIV GLLMAYILAG NIAKPIRILG NGMDRVANGE
  201  LETRISQQVD DRDDELSHLA IQFDKMVEKL EKLVAKERHL LHHVSHEMRS
  251  PLARMQAIVG LIQAQPQKQE QYLKRLEGEL TRMDTLAGEL LTLSRLETSN
  301  MALEKESLKL LPFLGNLVED NQSIAQKNGQ TVTLSADGKI PENTTILANE
  351  SYLYRAFDNV IRNAVNYSPE GSTILINIGQ DHKHWIIDVT DNGPGVDEMQ
  401  LPHIFTAFYR ADSSANKPGT GLGLALTQHI IEQHCGKIIA ENIKPNGLRM
  451  RFILPKKKTG SKTEKSAN*

m585/g585 88.3% identity in 231 aa overlap
                   10         20         30         40         50         60
m585.pep  MKLFQRIFATFCAVIVCAIFVASFSFWLVQNTLAENQFNQRRTIETTLMGSIISAFRARG
          ||||||||||||||||||||||||||||||||||||||||||||||||||||||||::||
g585      MKLFQRIFATFCAVIVCAIFVASFSFWLVQNTLAENQFNQRRTIETTLMGSIISAFKTRG
                   10         20         30         40         50         60

                   70         80         90        100        110        120
m585.pep  DAGAREILTEWKDSPVSSGVYVIQGDEKKDILNRYIDSYTIERARLFAAGHPHSNLVHIE
          | |||||||||:||||:||||||||||||||||||:||||||||||||::||||||:||
g585      DNGAREILTEWKNSPVSSAVYVIQGDEKKDILNRYIDNYTIERARLFAANNPHSNLVRIE
                   70         80         90        100        110        120

                  130        140        150        160        170        180
m585.pep  YDRFGEEYLFFTKDWDKLQARRLPSPLLIPGLPLAPIWHELIILSFIIIVGLLMAYILAG
          ||||||||||| ||: ||:||||||:||||||||||||:|||||||||||||||||||
g585      YDRFGEEYLFFIKGWDNHQARLPSPLFIPGLPLAPIWHEFIILSFIIIVGLLMAYILAG
                   130        140        150        160        170        180

                  190        200        210        220        230        240
m585.pep  NIAKPIRILGNGMDRVANGELETRISQQVDDRDDELSHLAIQFDKMVEKLEKLVAKERHL
          |||||||||||||||||:  |||  |:  ||| ||||||:  :|:||| ||||||
g585      NIAKPIRILGNGMDRVAERELEDRVCQQVRDRDDELADVAMQFDTMVEKLEX
                   190        200        210        220        230

                  250        260        270        280        290        300
m585.pep  LHHVSHEMRSPLARMQAIVGLIQAQPQKQEQYLKRLEGELTRMDTLAGELLTLSRLETSN
```

The following partial DNA sequence was identified in *N. meningitidis* <SEQ ID 1807>:

```
a585.seq
    1  ATGAAACTGT TCCAACGCAT CTTCGCCACA TTTTGCGCGG TTATCGTCTG

   51  TGCAATCTTT GTGGCGAGTT TTTCTTTCTG GCTGGTGCAG AACACCCTTG

  101  CCGAAAACCA GTTCAACCAA CGCCGCACCA TCGAAACCAC TTTGATGGGC

  151  AGCATCATTT CCGCATTCCG GGCACGCGGG GACGCGGGTG CGCGCGAAAT
```

-continued

```
 201 CCTGACGGAA TGGAAAGACA GCCCCGTCTC ATCGGGCGTG TACGTTATAC
 251 AGGGCGACGA GAAAAAAGAT ATCCTGCACC GGTATATCGA CAGCTACACC
 301 ATCGAACGCG CCCGGCTTTT CGCCGCCGGA CACCCGCATT CCAACCTCGT
 351 CCATATCGAA TACGACCGCT TCGGCGAAGA ATACCTGTTC TTCACCAAAG
 401 ACTGGGACAA ACTCCAAGCC CGCCGCCTGC CCAGCCCCCT GTTGATCCCC
 451 GGCCTGCCGC TCGCCCCGAT TTGGCACGAA CTCATCATAT TGTCCTTCAT
 501 CATCATCGTC GGACTGCTGA TGGCGTACAT CCTCGCCGGC AACATTGCCA
 551 AACCCATCAG AATCTTAGGC AACGGCATGG ACAGGGTGGC AAACGGAGAA
 601 CTTGAAACCC GTATCTCCCA ACAGGTCGAC GACCGCGACG ACGAATTGTC
 651 CCATCTTGCC ATCCAATTCG ACAAAATGGT GGAAAAACTC GAAAAACTCG
 701 TTGCCAAAGA ACGCCACCTG CTCCATCACG TCTCCCATGA AATGCGTTCT
 751 CCCCTTGCGC GCATGCAGGC AATTGTCGGA CTGATTCAGG CGCAGCCCCA
 801 AAAACAGGAG CAATATCTCA AACGGCTGGA AGGCGAACTG AACGGCATGG
 851 ATACGCTGGC CGGGGAACTG TTAACCCTGT CCCGTCTCGA AACTTCCAAT
 901 ATGGCTTTGG AAAAAGAAAG CCTGAAACTC CTGCCCTTCC TGGGCAACCT
 951 GGTAGAAGAC AATCAAAGCA TTGCCCAGAA AAACGGACAA ACGGTTACCC
1001 TGTCTGCCGA CGGAAAAATC CCCGAAAACA CAACCATCCT TGCCAACGAA
1051 AGCTACCTGT ACCGCGCCTT CGACAACGTC ATCCGCAACG CCGTCAACTA
1101 CAGTCCCGAA GGCAGCACCA TCCTGATCAA CATCGGACAA GACCACAAAC
1151 ACTGGATAAT CGACGTTACC GACAACGGCC CCGGCGTGGA CGAAATGCAG
1201 CTCCCGCACA TCTTCACCGC TTTCTACCGT GCAGACTCCA GTGCCAACAA
1251 ACCCGGAACA GGACTGGGGC TTGCATTGAC CCAACATATT ATTGAACAGC
1301 ACTGCGGCAA AATCATCGCC GAAAACATCA AACCGAACGG TCTGCGGATG
1351 CGCTTTATCC TGCCCAAGAA AAAAACCGGT TCCAAAACAG AAAAAAGTGC
1401 GAACTGA
```

This corresponds to the amino acid sequence <SEQ ID 1808; ORF 585.a>:

```
a585.pep
      1 MKLFQRIFAT FCAVIVCAIF VASFSFWLVQ NTLAENQFNQ RRTIETTLMG
     51 SIISAFRARG DAGAREILTE WKDSPVSSGV YVIQGDEKKD ILHRYIDSYT
    101 IERARLFAAG HPHSNLVHIE YDRFGEEYLF FTKDWDKLQA RRLPSPLLIP
    151 GLPLAPIWHE LIILSFIIIV GLLMAYILAG NIAKPIRILG NGMDRVANGE
    201 LETRISQQVD DRDDELSHLA IQFDKMVEKL EKLVAKERHL LHHVSHEMRS
    251 PLARMQAIVG LIQAQPQKQE QYLKRLEGEL TRMDTLAGEL LTLSRLETSN
    301 MALEKESLKL LPFLGNLVED NQSIAQKNGQ TVTLSADGKI PENTTILANE
    351 SYLYRAFDNV IRNAVNYSPE GSTILINIGQ DHKHWIIDVT DNGPGVDEMQ
    401 LPHIFTAFYR ADSSANKPGT GLGLALTQHI IEQHCGKIIA ENIKPNGLRM
    451 RFILPKKKTG SKTEKSAN*
```

m585/a585 99.8% identity in 468 aa overlap

-continued

```
                    10        20        30        40        50        60
m585.pep MKLFQRIFATFCAVIVCAIFVASFSFWLVQNTLAENQFNQRRTIETTLMGSIISAFRARG
         ||||||||||||||||||||||||||||||||||||||||||||||||||||||||||||
a585     MKLFQRIFATFCAVIVCAIFVASFSFWLVQNTLAENQFNQRRTIETTLMGSIISAFRARG
                    10        20        30        40        50        60

                    70        80        90       100       110       120
m585.pep DAGAREILTEWKDSPVSSGVYVIQGDEKKDILNRYIDSYTIERARLFAAGHPHSNLVHIE
         ||||||||||||||||||||||||||||||||:|||||||||||||||||||||||||||
a585     DAGAREILTEWKDSPVSSGVYVIQGDEKKDILHRYIDSYTIERARLFAAGHPHSNLVHIE
                    70        80        90       100       110       120

                   130       140       150       160       170       180
m585.pep YDRFGEEYLFFTKDWDKLQARRLPSPLLIPGLPLAPIWHELIILSFIIIVGLLMAYILAG
         ||||||||||||||||||||||||||||||||||||||||||||||||||||||||||||
a585     YDRFGEEYLFFTKDWDKLQARRLPSPLLIPGLPLAPIWHELIILSFIIIVGLLMAYILAG
                   130       140       150       160       170       180

                   190       200       210       220       230       240
m585.pep NIAKPIRILGNGMDRVANGELETRISQQVDDRDDELSHLAIQFDKMVEKLEKLVAKERHL
         ||||||||||||||||||||||||||||||||||||||||||||||||||||||||||||
a585     NIAKPIRILGNGMDRVANGELETRISQQVDDRDDELSHLAIQFDKMVEKLEKLVAKERHL
                   190       200       210       220       230       240

                   250       260       270       280       290       300
m585.pep LHHVSHEMRSPLARMQAIVGLIQAQPQKQEQYLKRLEGELTRMDTLAGELLTLSRLETSN
         ||||||||||||||||||||||||||||||||||||||||||||||||||||||||||||
a585     LHHVSHEMRSPLARMQAIVGLIQAQPQKQEQYLKRLEGELTRMDTLAGELLTLSRLETSN
                   250       260       270       280       290       300

                   310       320       330       340       350       360
m585.pep MALEKESLKLLPFLGNLVEDNQSIAQKNGQTVTLSADGKIPENTTILANESYLYRAFDNV
         ||||||||||||||||||||||||||||||||||||||||||||||||||||||||||||
a585     MALEKESLKLLPFLGNLVEDNQSIAQKNGQTVTLSADGKIPENTTILANESYLYRAFDNV
                   310       320       330       340       350       360

                   370       380       390       400       410       420
m585.pep IRNAVNYSPEGSTILINIGQDHKHWIIDVTDNGPGVDEMQLPHIFTAFYRADSSANKPGT
         ||||||||||||||||||||||||||||||||||||||||||||||||||||||||||||
a585     IRNAVNYSPEGSTILINIGQDHKHWIIDVTDNGPGVDEMQLPHIFTAFYRADSSANKPGT
                   370       380       390       400       410       420

                   430       440       450       460      469
m585.pep GLGLALTQHIIEQHCGKIIAENIKPNGLRMRFILPKKKTGSKTEKSANX
         |||||||||||||||||||||||||||||||||||||||||||||||||
a585     GLGLALTQHIIEQHCGKIIAENIKPNGLRMRFILPKKKTGSKTEKSANX
                   430       440       450       460
```

The following partial DNA sequence was identified in *N. gonorrhoeae* <SEQ ID 1809>:

```
g586.seq..
   1 atggcagccc atctcgaaga acaacaagag ttagacaact ttaaatattt

  51 ttggaaaacc acgggcaaat ggctgtttgc cctgctgatt ttggcggcac

 101 tcggctactt gggatacacg gtttaccaaa accgtgcggc ttcccaaaat

 151 caggaagcgg cggcggtgct ggcaaacatc gtggaaaagg cgcaaaacaa

 201 agccccgcaa agcgaaatca atgccgaact gtccaaactc caacaaagct

 251 acccccattc catttccgcc gcccaagcca cgctgatggc ggcggcaacc

 301 gaatttgacg cgcagcgtta cgatgttgcc gaaggtcatt tgaaatgggt

 351 gttgtccaac caaaaagaca gcctgattca ggcgttggcg gcgcagcgtc

 401 tgggcgttgt gttgttgcaa caaaaaaaat acgatgccgc gcttgccgca

 451 ctcgacacgc cggttgaggc ggacttcgcc cccctgctga tggaaactaa

 501 aggcgatgtt tatgccgcac aggaaaaaag ccaggaagcc ttaaaaaact

 551 acggacaggc tttggaaaaa atgcctcaag attctgtcgg tcgcgaattg

 601 cttcaaatga aactcgattc gctgaaataa
```

This corresponds to the amino acid sequence <SEQ ID 1810; ORF 586.ng>:

```
g586.pep..
  1 MAAHLEEQQE LDNFKYFWKT TGKWLFALLI LAALGYLGYT VYQNRAASQN

 51 QEAAAVLANI VEKAQNKAPQ SEINAELSKL QQSYPHSISA AQATLMAAAT

101 EFDAQRYDVA EGHLKWVLSN QKDSLIQALA AQRLGVVLLQ QKKYDAALAA

151 LDTPVEADFA PLLMETKGDV YAAQEKSQEA LKNYGQALEK MPQDSVGREL

201 LQMKLDSLK*
```

The following partial DNA sequence was identified in *N. meningitidis* <SEQ ID 1811>:

```
m586.seq
  1 ATGGCAGCCC ATCTCGAAGA ACAACAAGAG TTAGACAACT TTAAATATTT

 51 TTGGAAAACC ACGGGCAAAT GGCTGTTTGC CTTGCTGATT TTGGCGGCAC

101 TCGGCTACTT GGGATACACG GTTTACCAAA ACCGTAAAGT TTCCCAAAAT

151 CAGGAAGCGG CGGCGGTGCT GGCAAACATC GTAGAAAAGG CGCAAAGCAA

201 AGCCCCGCAA AGCGAAATCA ATGCCGAATT GACCAAACTC CAACAAAGCT

251 ACCCGCATTC CATTTCCGCC GCCCAAGCCA CACTGATGGC GGCGGCAACC

301 GAATTTGACG CGCAGCGTTA CGATGTTGCC GAAGGCCATT TGAAATGGGT

351 GTTGTCCAAC CAAAAAGACA GCCTGATTCA AGCGTTGGCG GCGCAGCGTC

401 TGGGCGTTGT GTTGTTGCAA CAAAAAAAAT ACGATGCCGC GCTTGCCGCG

451 CTCGATACGC CGGTTGAAGC GGACTTCGCC CCCCTGCTGA TGGAAACCAA

501 AGGCGATGTC TATGCCGCAC AGGGAAAAAG CCAGGAAGCC TTAAAAAACT

551 ACGGACAGGC TTTAGAAAAA ATGCCTCAAG ATTCTGTCGG TCGCGAATTG

601 GTTCAAATGA AACTTGATTC GCTGAAATAA
```

This corresponds to the amino acid sequence <SEQ ID 1812; ORF 586>:

```
m586.pep

      1  MAAHLEEQQE LDNFKYFWKT TGKWLFALLI LAALGYLGYT VYQNRKVSQN

     51  QEAAAVLANI VEKAQSKAPQ SEINAELTKL QQSYPHSISA AQATLMAAAT

    101  EFDAQRYDVA EGHLKWVLSN QKDSLIQALA AQRLGVVLLQ QKKYDAALAA

    151  LDTPVEADFA PLLMETKGDV YAAQGKSQEA LKNYGQALEK MPQDSVGREL

    201  VQMKLDSLK*

m586/g586    97.1% identity in 209 aa overlap

                    10        20        30        40        50        60
m586.pep    MAAHLEEQQELDNFKYFWKTTGKWLFALLILAALGYLGYTVYQNRKVSQNQEAAAVLANI
            |||||||||||||||||||||||||||||||||||||||||||||  :||||||||||||
g586        MAAHLEEQQELDNFKYFWKTTGKWLFALLILAALGYLGYTVYQNRAASQNQEAAAVLANI
                    10        20        30        40        50        60

                    70        80        90       100       110       120
m586.pep    VEKAQSKAPQSEINAELTKLQQSYPHSISAAQATLMAAATEFDAQRYDVAEGHLKWVLSN
            |||||:|||||||||||:||||||||||||||||||||||||||||||||||||||||||
g586        VEKAQNKAPQSEINAELSKLQQSYPHSISAAQATLMAAATEFDAQRYDVAEGHLKWVLSN
                    70        80        90       100       110       120

                   130       140       150       160       170       180
m586.pep    QKDSLIQALAAQRLGVVLLQQKKYDAALAALDTPVEADFAPLLMETKGDVYAAQGKSQEA
            |||||||||||||||||||||||||||||||||||||||||||||||||||||| |||||
g586        QKDSLIQALAAQRLGVVLLQQKKYDAALAALDTPVEADFAPLLMETKGDVYAAQEKSQEA
                   130       140       150       160       170       180
```

-continued

```
                    190        200        210
m586.pep     LKNYGQALEKMPQDSVGRELVQMKLDSLKX
             |||||||||||||||||||:|||||||||
g586         LKNYGQALEKMPQDSVGRELLQMKLDSLKX
                    190        200        210
```

The following partial DNA sequence was identified in *N. meningitidis* <SEQ ID 1813>:

```
a586.seq
   1 ATGGCAGCCC ATTTGGAAGA ACAACAAGAG TTGGACAACT TTAAATATTT

  51 TTGGAAAACC ACGGGCAAAT GGCTGTTTGC CGTGCTGATT TTGGCGGCAC

 101 TCGGCTACTT GGGATACACG GTTTACCAAA ACCGTGCGGC TTCCCAAAAT

 151 CAGGAAGCGG CGGCGGTGCT GGCAAACATC GTGGAAAAGG CGCAAAACAA

 201 AGCCCCGCAA AGCGAAATCA ATGCCGAATT GGCCAAGCTC CAACAAAGCT

 251 ACCCCCATTC CATTTCCGCC GCCCAAGCCA CGCTGATGGC GGCAGCAACC

 301 GAATTTGACG CGCAGCGTTA CGATGTTGCC GAAGGCCATT TGAAATGGGT

 351 ATTGTCCAAC CAAAAAGACA GCCTGATCCA GGCGTTGGCG GCGCAGCGTC

 401 TGGGCGTTGT GTTGTTGCAA CAAAAAAAAT ACGATGCCGC GCTTGCCGCA

 451 CTCGACACGC CGGTTGAAGC GGACTTCGCC CCCCTGCTGA TGGAAACCAA

 501 AGGCGATGTC TATGCCGCAC AGGGAAAAAG CCAGGAAGCC TTAAAAAACT

 551 ACGGACAGGC TTTAGAAAAA ATGCCTCAAG ATTCTGTCGG TCGCGAATTG

 601 GTTCAAATGA AACTTGATTC GCTGAAATAA
```

This corresponds to the amino acid sequence <SEQ ID 1814; ORF 586.a>:

```
a586.pep

      1  MAAHLEEQQE LDNFKYFWKT TGKWLFAVLI LAALGYLGYT VYQNRAASQN

     51  QEAAAVLANI VEKAQNKAPQ SEINAELAKL QQSYPHSISA AQATLMAAAT

    101  EFDAQRYDVA EGHLKWVLSN QKDSLIQALA AQRLGVVLLQ QKKYDAALAA

    151  LDTPVEADFA PLLMETKGDV YAAQGKSQEA LKNYGQALEK MPQDSVGREL

    201  VQMKLDSLK*

m586/a586    97.6% identity in 209 aa overlap

                    10         20         30         40         50         60
m586.pep     MAAHLEEQQELDNFKYFWKTTGKWLFALLILAALGYLGYTVYQNRKVSQNQEAAAVLANI
             ||||||||||||||||||||||||||||:||||||||||||||||  :||||||||||||
a586         MAAHLEEQQELDNFKYFWKTTGKWLFAVLILAALGYLGYTVYQNRAASQNQEAAAVLANI
                    10         20         30         40         50         60

                    70         80         90        100        110        120
m586.pep     VEKAQSKAPQSEINAELTKLQQSYPHSISAAQATLMAAATEFDAQRYDVAEGHLKWVLSN
             |||||:|||||||||||:||||||||||||||||||||||||||||||||||||||||||
a586         VEKAQNKAPQSEINAELAKLQQSYPHSISAAQATLMAAATEFDAQRYDVAEGHLKWVLSN
                    70         80         90        100        110        120

                   130        140        150        160        170        180
m586.pep     QKDSLIQALAAQRLGVVLLQQKKYDAALAALDTPVEADFAPLLMETKGDVYAAQGKSQEA
             ||||||||||||||||||||||||||||||||||||||||||||||||||||||| |||||
a586         QKDSLIQALAAQRLGVVLLQQKKYDAALAALDTPVEADFAPLLMETKGDVYAAQEKSQEA
                   130        140        150        160        170        180

                   190        200        210
m586.pep     LKNYGQALEKMPQDSVGRELVQMKLDSLKX
             ||||||||||||||||||||||||||||||
a586         LKNYGQALEKMPQDSVGRELVQMKLDSLKX
                   190        200        210
```

The following partial DNA sequence was identified in *N. gonorrhoeae* <SEQ ID 1815>:

```
g587.seq..
  1atgaaacgta tctttttgcc cgccttgccc gccatcctgc ctttatccgc

 51ttatgccgac ctgcccttga cgattgaaga cataatgacc gacaagggaa

101aatggaaact ggaaacttcc cttacctatc tgaatagcga aaacagccgc

151gccgcacttg ccgcaccggt ttacattcaa accggcgcaa cctcgtttat

201ccccattccg accgaaattc aagaaaacgg cagcaatacc gatatgctcg

251ccggcacgct cggtttgcgc tacggactga ccggcaatac cgacatttac

301ggcagcggca gctatctgtg gcacgaagaa cgcaaactcg acggcaacgg

351caaaacccgc aacaaacgga tgtccgacat atccgccggc atcagccaca

401ccttccttaa agacggcaaa aaccccgccc taatcagctt tcttgaaagc

451acggtttacg aaaaatcgcg caacaaagcc tcgttaatca aaaaaagggg

501gctttgcccc ttttataact taaggataaa ttatgaatat taa
```

This corresponds to the amino acid sequence <SEQ ID 1816; ORF 587.ng>:

```
g587.pep..
   1 MKRIFLPALP AILPLSAYAD LPLTIEDIMT DKGKWKLETS LTYLNSENSR

  51 AALAAPVYIQ TGATSFIPIP TEIQENGSNT DMLAGTLGLR YGLTGNTDIY

 101 GSGSYLWHEE RKLDGNGKTR NKRMSDISAG ISHTFLKDGK NPALISFLES

 151 TVYEKSRNKA SLIKKRGLCP FYNLRINYEY *
```

The following partial DNA sequence was identified in *N. meningitidis* <SEQ ID 1817>:

```
m587.seq..
   1 ATGAAGCGCA TCTTTTTGCC CGCCTTGCCC GCCATCCTGC CTTTATCCAC

  51 TTATGCCGAC CTGCCCTTGA CGATTGAAGA CATAATGACC GACAAGGGAA

 101 AATGGAAACT GGAAACTTCC CTTACCTACC TGAACAGCGA AAACAACCGC

 151 GCCGAACTTG CCGCACCGGT TTACATTCAA ACCGGCGCAA CCTCGTTTAT

 201 CCCCATTCCG ACCGAAATCC AAGAAAACGG CAGCAATACC GATATGCTCG

 251 TCGGCACGCT CGGTTTGCGC TACGGACTGA CCGGGAATAC CGACATTTAC

 301 GGCAGCGGCA GCTATCTGTG GCACGAAGAA CGCAAACTCG ACGGCAACAG

 351 CAAAACCCGC AACAAACGGA TGTCCGACGT ATCCCTCGGC ATCAGCCACA

 401 CTTTCCTTAA AGACGACAAA AACCCCGCCC TAATCAGCTT TCTTGAAAGC

 451 ACGGTTTACG AAAAATCGCG CAACAAAGCC TCGTCGGGAA AATCCTGGCT

 501 CATCGGCGCC ACCACCTACA AAGCCATAGA TCCGATTGTC CTTTCCTTCA

 551 CCGCCGCCTA CCGCATCAAC GGCAGCAAAA CCCTTTCAGA CGGCATCCGC

 601 TACAAATCGG GCAACTACCT GCTGCTCAAC CCCAACATCT CATTTGCTGC

 651 CAACGACAGA ATCAGCCTGA CCGGAGGCAT CCAATGGCTG GGCAGGCAGC

 701 CCGACCGGAC GGACGGCAAA CGGGAATCCT CCAGAAACAC ATCCACCTAC

 751 GCCCATTTCG GCGCAGGTTT CGGTTTCACC AAAACCACGG CTTTAAACGC
```

-continued

```
801 ATCCGCACGT TTCAACGTTT CAGGGCAAAG CAGTTCCGAA CTGAAATTTG

851 GCGTACAGCA TACATTTTAA
```

This corresponds to the amino acid sequence <SEQ ID 1818; ORF 587>:

```
m587.pep..
  1 MKRIFLPALP AILPLSTYAD LPLTIEDIMT DKGKWKLETS LTYLNSENNR

 51 AELAAPVYIQ TGATSFIPIP TEIQENGSNT DMLVGTLGLR YGLTGNTDIY

101 GSGSYLWHEE RKLDGNSKTR NKRMSDVSLG ISHTFLKDDK NPALISFLES

151 TVYEKSRNKA SSGKSWLIGA TTYKAIDPIV LSLTAAYRIN GSKTLSDGIR

201 YKSGNYLLLN PNISFAANDR ISLTGGIQWL GRQPDRTDGK RESSRNTSTY

251 AHFGAGFGFT KTTALNASAR FNVSGQSSSE LKFGVQHTF*
```

Computer analysis of this amino acid sequence gave the following results:

Homology with a Predicted ORF from *N. gonorrhoeae*

```
m587/g587   95.0% identity in 161 aa overlap

                    10        20        30        40        50        60
m587.pep    MKRIFLPALPAILPLSTYADLPLTIEDIMTDKGKWKLETSLTYLNSENNRAELAAPVYIQ
            |||||||||||||||:||||||||||||||||||||||||||||||||:|| |||||||
g587        MKRIFLPALPAILPLSAYADLPLTIEDIMTDKGKWKLETSLTYLNSENSRAALAAPVYIQ
                    10        20        30        40        50        60

                    70        80        90       100       110       120
m587.pep    TGATSFIPIPTEIQENGSNTDMLVGTLGLRYGLTGNTDIYGSGSYLWHEERKLDGNSKTR
            ||||||||||||||||||||||:||||||||||||||||||||||||||||||||||:|||
g587        TGATSFIPIPTEIQENGSNTDMLAGTLGLRYGLTGNTDIYGSGSYLWHEERKLDGNGKTR
                    70        80        90       100       110       120

                   130       140       150       160       170       180
m587.pep    NKRMSDVSLGISHTFLKDDKNPALISFLESTVYEKSRNKASSGKSWLIGATTYKAIDPIV
            ||||||:| ||||||||| |||||||||||||||||||||
g587        NKRMSDISAGISHTFLKDGKNPALISFLESTVYEKSRNKASLIKKRGLCPFYNLRINYEY
                   130       140       150       160       170       180

                   190       200       210       220       230       240
m587.pep    LSLTAAYRINGSKTLSDGIRYKSGNYLLLNPNISFAANDRISLTGGIQWLGRQPDRTDGK

g587        X
```

The following partial DNA sequence was identified in *N. meningitidis* <SEQ ID 1819>:

```
a587.seq
  1 ATGAAGCGCA TCTTTTTGCC CGCCTTGCCC GCCATCCTGC CTTTATCCGC

 51 TTATGCCGAC CTGCCCTTGA CGATTGAAGA CATAATGACC GACAAGGGCA

101 AATGGAAACT GGAAACTTCC CTTACCTACC TGAACAGCGA AAACAACCGC

151 GCCGAACTTG CCGCACCGGT TTACATCCAA ACCGGCGCAA CCTCGTTTAT

201 CCCCATTCCG ACCGAAATCC AAGAAAACGG CAGCAATACC GATATGCTCG

251 TTGGCACGCT CGGTTTGCGC TACGGACTGA CCGGGAATAC CGACATTTAC

301 GGCAGCGGCA GCTATCTGTG GCACGAAGAA CGCAAACTCG ACGGCAACGG

351 CAAAACCCGA AACAAACGGA TGTCCGACGT ATCCCTCGGC ATCAGCCACA

401 CCTTCCTTAA AGACGACAAA AACCCCGCCC TAATCAGCTT TCTTGAAAGC

451 ACGGTTTACG AAAAATCGCG CAACAAAGCC TCGTCGGGAA AATCCTGGCT

501 CATCGGCGCC ACCACCTACA AAGCCATCGA CCCCGTCGTC CTCTCATTGA
```

-continued

```
551 CCGCTGCCTA CCGTATCAAC GGCAGCAAAA CCCTTTCAAG CAACACCAAA

601 TACAAAGCAG GCAATTACTG GATGCTGAAT CCCAATATAT CCTTCGCCGC

651 CAACGACAGA ATCAGCCTCA CGGGCGGCAT CCAATGGCTG GGCAAGCAGC

701 CCGACCGTCT GGACGGCAAA AAAGAATCCG CAAGAAACAC ATCCACCTAT

751 GCCCATTTCG GCGCAGGTTT CGGTTTCACC AAAACCACGG CTTTAAACGC

801 ATCCGCACGT TTCAACGTTT CAGGGCAAAG CAGTTCCGAA CTGAAATTTG

851 GCGTACAGCA TACGTTTTAA
```

This corresponds to the amino acid sequence <SEQ ID 1820; ORF 587.a>:

```
a587.pep

  1  MKRIFLPALP AILPLSAYAD LPLTIEDIMT DKGKWKLETS LTYLNSENNR

 51  AELAAPVYIQ TGATSFIPIP TEIQENGSNT DMLVGTLGLR YGLTGNTDIY

101  GSGSYLWHEE RKLDGNGKTR NKRMSDVSLG ISHTLFKDDK NPALISFLES

151  TVYEKSRNKA SSGKSWLIGA TTYKAIDPVV LSLTAAYRIN GSKTLSSNTK

201  YKAGNYWMLN PNISFAANDR ISLTGGIQWL GKQPDRLDGK KESARNTSTY

251  AHFGAGFGFT KTTALNASAR FNVSGQSSSE LKFGVQHTF*

m587/a587    95.2% identity in 289 aa overlap

                       10        20        30        40        50        60
m587.pep       MKRIFLPALPAILPLSTYADLPLTIEDIMTDKGKWKLETSLTYLNSENNRAELAAPVYIQ
               |||||||||||||||:||||||||||||||||||||||||||||||||||||||||||||
a587           MKRIFLPALPAILPLSAYADLPLTIEDIMTDKGKWKLETSLTYLNSENNRAELAAPVYIQ
                       10        20        30        40        50        60

                       70        80        90       100       110       120
m587.pep       TGATSFIPIPTEIQENGSNTDMLVGTLGLRYGLTGNTDIYGSGSYLWHEERKLDGNSKTR
               ||||||||||||||||||||||||||||||||||||||||||||||||||||||||:|||
a587           TGATSFIPIPTEIQENGSNTDMLVGTLGLRYGLTGNTDIYGSGSYLWHEERKLDGNGKTR
                       70        80        90       100       110       120

                      130       140       150       160       170       180
m587.pep       NKRMSDVSLGISHTFLKDDKNPALISFLESTVYEKSRNKASSGKSWLIGATTYKAIDPIV
               ||||||||||||||||||||||||||||||||||||||||||||||||||||||||||:|
a587           NKRMSDVSLGISHTFLKDDKNPALISFLESTVYEKSRNKASSGKSWLIGATTYKAIDPVV
                      130       140       150       160       170       180

                      190       200       210       220       230       240
m587.pep       LSLTAAYRINGSKTLSDGIRYKSGNYLLLNPNISFAANDRISLTGGIQWLGRQPDRTDGK
               ||||||||||||||||:: :||:||| :|||||||||||||||||||||||:|||| |||
a587           LSLTAAYRINGSKTLSSNTKYKAGNYWMLNPNISFAANDRISLTGGIQWLGKQPDRLDGK
                      190       200       210       220       230       240

                      250       260       270       280       290
m587.pep       RESSRNTSTYAHFGAGFGFTKTTALNASARFNVSGQSSSELKFGVQHTFX
               :||:||||||||||||||||||||||||||||||||||||||||||||||
a587           KESARNTSTYAHFGAGFGFTKTTALNASARFNVSGQSSSELKFGVQHTFX
                      190       200       210       220       230
```

The following partial DNA sequence was identified in *N. gonorrhoeae* <SEQ ID 1821>:

```
g588.seq
  1 atgcttaaac atctcgcatt cctactgccc gccatgatgt tcgccctccc

 51 cgcccagacc gccgtcctaa gcccctatca ggaaaccggc tgcacctacg

101 aaggcgggat cggaaaagac gggcttcctt caggcaaagg catatggcgt

151 tgccgggatg ggcgcggtta taccggttca ttcaaaaacg gcaaattcga

201 cgggcaaggc gtttataccg ttgccgccgg ccgcgaagta tttctcgagc

251 cgttcaattc cgacagtacc aaattccgca atatggcatt gtcgggcacg
```

-continued

```
301 ttcaaacaag gcttggcaca cggcaggttc gccgcctcgc aaaacggcga

351 aaccctcttt tattatgaaa tgcgaacacg gcatgattaa
```

This corresponds to the amino acid sequence <SEQ ID 1822; ORF 588.ng>:

```
g588.pep..
  1 MLKHLAFLLP AMMFALPAQT AVLSPYQETG CTYEGGIGKD GLPSGKGIWR

 51 CRDGRGYTGS FKNGKFDGQG VYTVAAGREV FLEPFNSDST KFRNMALSGT

101 FKQGLAHGRF AASQNGETLF YYEMRTRHD*
```

The following partial DNA sequence was identified in *N. meningitidis* <SEQ ID 1823>:

```
m588.seq..
  1 ATGCTTAAAC ATCTCGCATT CCTACTGCCC GCCATGATGT TCGCCCTCCC

 51 CACTTCGGCC GCCGTCCTGA CTTCCTATCA AGAACCAGGC TGCACCTACG

101 ACGGCAATGT CGGCAAAGAC GGTAAACCCG CCGGCAAAGG CACATGGCGC

151 TGCCAAGACG GGCGCAACTA TACCGGTTCG TTTAAAAACG GCAAATTCGA

201 CGGGCAAGGC GTTTATACCG TTGCCGCCAA CCGCGAAATA TTTATCGAAC

251 CGTTCAATTC CGACAGTACC AAATTCCGCA ACATGGTACT CTCGGGCACG

301 TTCAAAAAAG GCTTGGCACA CGGCAGATTT ACCGTCTCGC AAAACGGCGA

351 AACCCTCTTC ATTATGAAAT GCGAAAACGG CATGATTAAA GAAGTGAAAC

401 TGCCCAAAAA CAAATAA
```

This corresponds to the amino acid sequence <SEQ ID 1824; ORF 588>:

```
m588.pep..
  1 MLKHLAFLLP AMMFALPTSA AVLTSYQEPG CTYDGNVGKD GKPAGKGTWR

 51 CQDGRNYTGS FKNGKFDGQG VYTVAANREI FIEPFNSDST KFRNMVLSGT

101 FKKGLAHGRF TVSQNGETLF IMKCENGMIK EVKLPKNK*
```

Computer analysis of this amino acid sequence gave the following results:

Homology with a Predicted ORF from *N. gonorrhoeae*

```
m588/g588     82.5% identity in 120 aa overlap

                        10        20        30        40        50        60
m588.pep      MLKHLAFLLPAMMFALPTSAAVLTSYQEPGCTYDGNVGKDGKPAGKGTWRCQDGRNYTGS
              ||||||||||||||||:::|||: ||| ||||:|::|||| |:||| |||:|||:||||
g588          MLKHLAFLLPAMMFALPAQTAVLSPYQETGCTYEGGIGKDGLPSGKGIWRCRDGRGYTGS
                        10        20        30        40        50        60

                        70        80        90       100       110       120
m588.pep      FKNGKFDGQGVYTVAANREIFIEPFNSDSTKFRNMVLSGTFKKGLAHGRFTVSQNGETLF
              |||||||||||||||:||:|||||||||||||||:||||||:|||||||::||||||||
g588          FKNGKFDGQGVYTVAAGREVFLEPFNSDSTKFRNMALSGTFKQGLAHGRFAASQNGETLF
                        70        80        90       100       110       120

                       130       139
m588.pep      IMKCENGMIKEVKLPKNKX

g588          YYEMRTRHDX
                       130
```

The following partial DNA sequence was identified in *N. meningitidis* <SEQ ID 1825>:

```
a588.seq
   1 ATGCTTAAAC ATCTCGCATT CCTACTGCCC GCCATGATGT TCGCCCTCCC

  51 CGCCGCGTCC GCCGTTCTGA CTTCCTATCA AGAACCCGGC TGCACCTACG

 101 AAGGCGATGT CGGCAAAGAC GGTAAACCCG CCGGCAAAGG CACATGGCGC

 151 TGCCAAGACG GGCGCAACTA TACCGGTTCG TTTAAAAATG GCAAATTCGA

 201 CGGACAAGGC GTTTATACCG TTGCCGCCAA CCGCGAAATA TTTATCGAAC

 251 CGTTCAATTC CGACAGTACC AAATTCCGCA ACATGGTACT CTCGGGCACA

 301 TTCAAAAAAG GCTTGGCACA CGGCAGATTT ACCGTCTCGC AAAACGGCGA

 351 AACCCTCTTC ATTATGAAAT GCGAAAACGG CATGATTAAA GAAGTGAAGC

 401 TGCCCAAAAA CAAATAA
```

This corresponds to the amino acid sequence <SEQ ID 1826; ORF 588.a>:

```
a588.pep

      1  MLKHLAFLLP AMMFALPAAS AVLTSYQEPG CTYEGDVGKD GKPAGKGTWR

     51  CQDGRNYTGS FKNGKFDGQG VYTVAANREI FIEPFNSDST KFRNMVLSGT

    101  FKKGLAHGRF TVSQNGETLF IMKCENGMIK EVKLPKNK*

m588/a588    96.4% identity in 138 aa overlap

                     10        20        30        40        50        60
m588.pep     MLKHLAFLLPAMMFALPTSAAVLTSYQEPGCTYDGNVGKDGKPAGKGTWRCQDGRNYTGS
             |||||||||||||||||:::||||||||||||:|:|||||||||||||||||||||||||
a588         MLKHLAFLLPAMMFALPAASAVLTSYQEPGCTYEGDVGKDGKPAGKGTWRCQDGRNYTGS
                     10        20        30        40        50        60

                     70        80        90       100       110       120
m588.pep     FKNGKFDGQGVYTVAANREIFIEPFNSDSTKFRNMVLSGTFKKGLAHGRFTVSQNGETLF
             ||||||||||||||||||||||||||||||||||||||||||||||||||||||||||||
a588         FKNGKFDGQGVYTVAANREIFLEPFNSDSTKFRNMVLSGTFKKGLAHGRFTVSQNGETLF
                     70        80        90       100       110       120

                    130      139
m588.pep     IMKCENGMIKEVKLPKNKX
             |||||||||||||||||||
a588         IMKCENGMIKEVKLPKNKX
                    130
```

The following partial DNA sequence was identified in *N. gonorrhoeae* <SEQ ID 1827>:

```
g589.seq..
   1  atgcaacaaa aaatccgttt ccaaatcgag gcgatgacct gtcaggcatg

  51  tgcttcgcgc attgaaaaag tgttgaacaa aaaagatttt gtcgaatcgg

 101  cgggagtgaa ctttgccagt gaggaagcgc aggttacgtt tgacggcagc

 151  aaaacctcgg ttgccgacat tgccaaaatc attgagaaaa ccggttacgg

 201  cgcgaaggaa aaaacggaag atacattgcc gcaacctgaa gcagaacacc

 251  atatcggctg gcggttgtgg cttttgctga ccatcaatat cccgttcctt

 301  atcggtatgg tagggatgat gctaaaaggg ctgaattgga cacggcacga

 351  ttggatgatt ccgcctgtat ggcagtttgt actggcaagc atagtgcaac

 401  tttggctggc aatcccgttt tacaaaagcg cgtgggcaag cattaaaggc

 451  gggctggcga atatggacgt actcgttacc atcggcacgg tgtcgattta
```

-continued

```
 501 cctgtattcc gtttatatgc tgtttttcag ttcgcatgcg gcgcacggta
 551 tggcgcatgt gtattttgaa gcgggcgtga tggtgatcgg ttttgtgtcg
 601 ctgggtaagt ttttggaaca ccgcaccaaa aaatccagcc tgaacagctt
 651 gggcttactg ctaaaactca cgccgaccca agtcaacgtg caacgcaacg
 701 gcgaatggaa acaactgccc atcgaccaag tgcaaatcgg cgaccttatc
 751 cgcaccaacc acggcgaacg catcgctgcc gacggcatta tcgaaagcgg
 801 cagcggttgg gcggacgaaa gccaccttac cggcgaatcc aatcccgaag
 851 agaaaaaggc gggcggcaaa gtgttggcgg gcgcgctgat gaccgaaggc
 901 agcgtggtgt accgcgccgc gcagctcggc agccaaaccc tgctcggcga
 951 catgatgaac gcgctctctg aagcacaagg cagtaaagca ccgattgcgc
1001 gcgtggccga taaagcggcg gcggtatttg tgccaactgt cgtgggcatc
1051 gcgcttctga cttttatcgt tgcttggctg attaagggcg attggacggt
1101 cgcactgatg cacgccgttg ccgttttggt gattgcctgc ccgtgcgcgc
1151 tcggtctggc gacccctgcc gcgattatgg tcggcatggg caaagcggtg
1201 aaacacggca tttggtttaa agacgcggcg gcaatggagg aagcagccca
1251 cgtcgatgcc gtcgtattgg acaaaaccgg tacgctgacc gaaggcaggc
1301 cgcaggttgc cgccgtttat tacgttcccg acagcggctt tgacgaagac
1351 gctttgtacc gcatcgccgc cgccgtcgag caaaacgccg cccacccgct
1401 cgcccgcgcc atcgtctccg ccgcacaagc gcgcggtttg gagattcccg
1451 ctgcacaaaa tgcgcaaacc gttgtcggag caggcattac cgccgaagtg
1501 gaaggcgtgg gtttggtgaa atcaggcaaa gccgaatttg ccgaactgac
1551 cttgccgaag ttttcagacg gcgtttggga aatcgccagt gcggttaccg
1601 tatctgtaaa cggcaaaccg atcggcgcat tcgcactctc cgacgcgttg
1651 aaagccgata ccgccgaagc cataggccgt ctgaaaaaac acaatatcga
1701 tgtctatatt atgagcggcg ataaccaaag tacggtcgaa tacgtcgcca
1751 aacaactggg catcgcacac gccttcggta atatgagtcc gtgcgacaaa
1801 gccgccgaag tgcagaaact caaagccgcc ggcaaaaccg tggcgatggt
1851 cggcgacggc atcaacgacg cgcccgcgct tgccgccgcc aacgtcagct
1901 tcgccatgaa aggcggtgcg gacgttgccg aacacaccgc ctccgccacg
1951 ctgatgcagc attcggtcaa tcagctcgcc gatgccctgc tgatatcgca
2001 ggcaacgttg gaaaacatca agcaaaacct atttttcgcc ttcttctaca
2051 atatattggg cattccgctc gccgcgctcg gctttttaaa tcccgtcata
2101 gcaggcgcgg caatggcggc aagctcggtt tcggtattgg gcaatgccct
2151 gcgcctgaaa tgggtaaaaa tcgattga
```

This corresponds to the amino acid sequence <SEQ ID 1828; ORF 589.ng>:

```
g589.pep..
  1 MQQKIRFQIE AMTCQACASR IEKVLNKKDF VESAGVNFAS EEAQVTFDGS
 51 KTSVADIAKI IEKTGYGAKE KTEDTLPQPE AEHHIGWRLW LLLTINIPFL
101 IGMVGMMLKG LNWTRHDWMI PPVWQFVLAS IVQLWLAIPF YKSAWASIKG
```

-continued

```
151 GLANMDVLVT IGTVSIYLYS VYMLFFSSHA AHGMAHVYFE AGVMVIGFVS

201 LGKFLEHRTK KSSLNSLGLL LKLTPTQVNV QRNGEWKQLP IDQVQIGDLI

251 RTNHGERIAA DGIIESGSGW ADESHLTGES NPEEKKAGGK VLAGALMTEG

301 SVVYRAAQLG SQTLLGDMMN ALSEAQGSKA PIARVADKAA AVFVPTVVGI

351 ALLTFIVAWL IKGDWTVALM HAVAVLVIAC PCALGLATPA AIMVGMGKAV

401 KHGIWFKDAA AMEEAAHVDA VVLDKTGTLT EGRPQVAAVY YVPDSGFDED

451 ALYRIAAAVE QNAAHPLARA IVSAAQARGL EIPAAQNAQT VVGAGITAEV

501 EGVGLVKSGK AEFAELTLPK FSDGVWEIAS AVTVSVNGKP IGAFALSDAL

551 KADTAEAIGR LKKHNIDVYI MSGDNQSTVE YVAKQLGIAH AFGNMSPCDK

601 AAEVQKLKAA GKTVAMVGDG INDAPALAAA NVSFAMKGGA DVAEHTASAT

651 LMQHSVNQLA DALLISQATL ENIKQNLFFA FFYNILGIPL AALGFLNPVI

701 AGAAMAASSV SVLGNALRLK WVKID*
```

The following partial DNA sequence was identified in *N. meningitidis* <SEQ ID 1829>:

```
m589.seq..
   1 ATGCAACAAA AAATCCGTTT CCAAATCGAA GGCATGACCT GCCAGGCCTG

  51 CGCTTCGCGC ATTGAAAAAG TGTTGAACAA AAAAGATTTT GTCGAATCGG

 101 CGGGGGTAAA CTTCGCCAGC GAAGAGGCGC AGGTAGTGTT TGACGACAGC

 151 AAAACCTCAG TAGCCGACAT TGCCAAAATC ATTGAGAAAA CCGGTTACGG

 201 CGCGAAGGAA AAAACGGAAG ATACATTGCC GCAACCCGAA GCAGAACACC

 251 ATATCGGCTG GCGGCTGTGG CTGCTGTTCA CCATCAACGT CCCGTTCCTT

 301 ATCGGCATGG CGGGGATGAT GATCGGCAGA CACGATTGGA TGATTCCGCC

 351 GTTGTGGCAG TTCGCATTGG CAAGCGTGGT GCAGCTTTGG CTGGCAATCC

 401 CGTTTTACAA AAGCGCGTGG GCGAGCATTA AGGGCGGACT GGCGAATATG

 451 GACGTGCTGG TTACCATCGG CACGGTCTCG ATTTACCTGT ATTCCGTCTA

 501 TATGCTGTTT TTCAGCCCGC ACGCGGCGTA CGGTATGGCG CATGTGTATT

 551 TTGAAGTGGG CGTGATGGTG ATCGGTTTTG TGTCACTGGG TAAATTTTTG

 601 GAACACCGTA CCAAAAAATC CAGCCTCAAC AGCTTGGGCT TGCTGCTCAA

 651 ACTTACACCA ACCCAAGTCA ACGTGCAACG CAACGGCGAA TGGAAACAGC

 701 TTCCCATCGA CCAAGTGCAA ATCGGCGACC TTATCCGCGC CAACCACGGC

 751 GAACGCATTG CCGCAGACGG CATCATTGAA AGCGGCAGCG GTTGGGCGGA

 801 CGAGAGCCAT CTTACCGGCG AATCCAATCC TGAAGAAAAA AAGGCGGGCG

 851 GCAAAGTGTT GGCGGGCGCG TTAATGACCG AAGGCAGTGT GGTGTACCGC

 901 GCCACGCAGC TCGGCAGCCA AACCCAGCTC GGCGACATGA TGAACGCGCT

 951 CTCTGAAGCA CAAGGCAGTA AAGCACCGAT TGCGCGCGTA GCCGATAAAG

1001 CGGCTGCGGT ATTCGTGCCT GCCGTCGTGG GCATTGCGTT GTTGACTTTT

1051 ATTGTTACTT GGCTGATTAA GGGCGATTGG ACGGTTGCGC TGATGCACGC

1101 CGTCGCCGTT TTGGTGATTG CCTGCCCGTG CGCGCTGGGT CTGGCAACCC

1151 CTGCCGCGAT TATGGTCGGT ATGGGCAAAG CGGTTAAACA CGGTATTTGG

1201 TTTAAAGACG CGGCAGCAAT GGAGGAAGCC GCCCACGTCG ATGCCGTCGT
```

-continued

```
1251 GTTGGACAAA ACCGGTACGC TGACCGAAGG CAGCCCGCAG GTTGCCGCCG

1301 TTTATTGCGT TCCCGACAGC GGCTTTGACG AAGACGCTTT GTACCGCATC

1351 GCCGCCGCCG TCGAACAAAA CGCCGCCCAT CCGCTCGCCC GTGCCATCGT

1401 CTCCGCCGCC CAAGCGCGCG GTTTGGACAT TCCCGCCGCA CAAAACGCAC

1451 AAACCGTTGT CGGCGCAGGC ATTACCGCCG AAGTGGAAGG CGTGGGTTTG

1501 GTGAAAGCAG GCAAAGCCGA ATTTGCCGAA CTGGCCTTGC CGAAGTTTTT

1551 AGACGGCGTT TGGGATATTG CAAGCATTGT TGCGGTCTCA GTCGATAACA

1601 AACCCATCGG CGCATTCGCA CTTGCCGACG CGTTGAAAGC CGATACCGCC

1651 GAAGCCATAG GCCGTCTGAA AAAACACAAT ATCGATGTCT ATATTATGAG

1701 CGGCGACAAC CAAGGCACGG TCGAATACGT CGCCAAACAA CTGGGCATCG

1751 CACACGCCTT CGGCAACATG AGTCCGCGCG ATAAAGCTGC CGAAGTGCAA

1801 AAACTCAAAG CCGCCGGCAA AACCGTGGCG ATGGTCGGCG ACGGCATCAA

1851 CGACGCGCCC GCGCTTGCCG CCGCTAACGT CAGCTTCGCC ATGAAAGGCG

1901 GAGCGGACGT TGCCGAACAT ACCGCATCCG CCACGCTGAT GCAGCATTCG

1951 GTCAACCAAC TCGCCGATGC TCTGCTGGTG TCGCAAGCCA CTTTGAAAAA

2001 CATCAAGCAA AACCTGTTTT TCGCCTTCTT CTACAATATT TTGGGCATTC

2051 CTCTCGCCGC GCTTGGCTTT TTAAATCCCG TCATCGCTGG CGCGGCAATG

2101 GCGGCAAGCT CGGTTTCCGT GTTGAGCAAT GCCTTGCGCC TGAAACGGGT

2151 AAAAATCGAT TAG
```

This corresponds to the amino acid sequence <SEQ ID 1830; ORF 589>:

```
m589.pep..
  1 MQQKIRFQIE GMTCQACASR IEKVLNKKDF VESAGVNFAS EEAQVVFDDS

 51 KTSVADIAKI IEKTGYGAKE KTEDTLPQPE AEHHIGWRLW LLFTINVPFL

101 IGMAGMMIGR HDWMIPPLWQ FALASVVQLW LAIPFYKSAW ASIKGGLANM

151 DVLVTIGTVS IYLYSVYMLF FSPHAAYGMA HVYFEVGVMV IGFVSLGKFL

201 EHRTKKSSLN SLGLLLKLTP TQVNVQRNGE WKQLPIDQVQ IGDLIRANHG

251 ERIAADGIIE SGSGWADESH LTGESNPEEK KAGGKVLAGA LMTEGSVVYR

301 ATQLGSQTQL GDMMNALSEA QGSKAPIARV ADKAAAVFVP AVVGIALLTF

351 IVTWLIKGDW TVALMHAVAV LVIACPCALG LATPAAIMVG MGKAVKHGIW

401 FKDAAAMEEA AHVDAVVLDK TGTLTEGSPQ VAAVYCVPDS GFDEDALYRI

451 AAAVEQNAAH PLARAIVSAA QARGLDIPAA QNAQTVVGAG ITAEVEGVGL

501 VKAGKAEFAE LALPKFLDGV WDIASIVAVS VDNKPIGAFA LADALKADTA

551 EAIGRLKKHN IDVYIMSGDN QGTVEYVAKQ LGIAHAFGNM SPRDKAAEVQ

601 KLKAAGKTVA MVGDGINDAP ALAAANVSFA MKGGADVAEH TASATLMQHS

651 VNQLADALLV SQATLKNIKQ NLFFAFFYNI LGIPLAALGF LNPVIAGAAM

701 AASSVSVLSN ALRLKRVKID *
```

Computer analysis of this amino acid sequence gave the following results:

Homology with a Predicted ORF from *N. gonorrhoeae*

```
m589/g589 94.2% identity in 725 aa overlap

                 10        20        30        40        50        60
m589.pep MQQKIRFQIEGMTCQACASRIEKVLNKKDFVESAGVNFASEEAQVVFDDSKTSVADIAKI
         ||||||||||:||||||||||||||||||||||||||||||||||:|| |||||||||||
g589     MQQKIRFQIEAMTCQACASRIEKVLNKKDFVESAGVNFASEEAQVTFDGSKTSVADIAKI
                 10        20        30        40        50        60

                 70        80        90       100       1      110
m589.pep IEKTGYGAKEKTEDTLPQPEAEHHIGWRLWLLFTINVPFLIGMAGMMIG-----RHDWMI
         ||||||||||||||||||||||||||||||||:|||:||||||:|||:     ||||||
g589     IEKTGYGAKEKTEDTLPQPEAEHHIGWRLWLLLTINIPFLIGMVGMMLKGLNWTRHDWMI
                 70        80        90       100       110       120

           120       130       140       150       160       170
m589.pep PPLWQFALASVVQLWLAIPFYKSAWASIKGGLANMDVLVTIGTVSIYLYSVYMLFFSPHA
         ||:|||:|||:|||||||||||||||||||||||||||||||||||||||||||||| ||
g589     PPVWQFVLASIVQLWLAIPFYKSAWASIKGGLANMDVLVTIGTVSIYLYSVYMLFFSSHA
                130       140       150       160       170       180

            180       190       200       210       220       230
m589.pep AYGMAHVYFEVGVMVIGFVSLGKFLEHRTKKSSLNSLGLLLKLTPTQVNVQRNGEWKQLP
         |:||||||||:|||||||||||||||||||||||||||||||||||||||||||||||||
g589     AHGMAHVYFEAGVMVIGFVSLGKFLEHRTKKSSLNSLGLLLKLTPTQVNVQRNGEWKQLP
                190       200       210       220       230       240

            240       250       260       270       280       290
m589.pep IDQVQIGDLIRANHGERIAADGIIESGSGWADESHLTGESNPEEKKAGGKVLAGALMTEG
         |||||||||||:||||||||||||||||||||||||||||||||||||||||||||||||
g589     IDQVQIGDLIRTNHGERIAADGIIESGSGWADESHLTGESNPEEKKAGGKVLAGALMTEG
                250       260       270       280       290       300

            300       310       320       330       340       350
m589.pep SVVYRATQLGSQTQLGDMMNALSEAQGSKAPIARVADKAAAVFVPAVVGIALLTFIVTWL
         ||||||:||||||| ||||||||||||||||||||||||||||||:|||||||||||:||
g589     SVVYRAAQLGSQTLLGDMMNALSEAQGSKAPIARVADKAAAVFVPTVVGIALLTFIVAWL
                310       320       330       340       350       360

            360       370       380       390       400       410
m589.pep IKGDWTVALMHAVAVLVIACPCALGLATPAAIMVGMGKAVKHGIWFKDAAAMEEAAHVDA
         ||||||||||||||||||||||||||||||||||||||||||||||||||||||||||||
g589     IKGDWTVALMHAVAVLVIACPCALGLATPAAIMVGMGKAVKHGIWFKDAAAMEEAAHVDA
                370       380       390       400       410       420

            420       430       440       450       460       470
m589.pep VVLDKTGTLTEGSPQVAAVYCVPDSGFDEDALYRIAAAVEQNAAHPLARAIVSAAQARGL
         |||||||||||| ||||||| |||||||||||||||||||||||||||||||||||||||
g589     VVLDKTGTLTEGRPQVAAVYYVPDSGFDEDALYRIAAAVEQNAAHPLARAIVSAAQARGL
                430       440       450       460       470       480

            480       490       500       510       520       530
m589.pep DIPAAQNAQTVVGAGITAEVEGVGLVKAGKAEFAELALPKFLDGVWDIASIVAVSVDNKP
         :||||||||||||||||||||||||||:||||||||:|||| ||||:||| |:|||::||
g589     EIPAAQNAQTVVGAGITAEVEGVGLVKSGKAEFAELTLPKFSDGVWEIASAVTVSVNGKP
                490       500       510       520       530       540

            540       550       560       570       580       590
m589.pep IGAFALADALKADTAEAIGRLKKHNIDVYIMSGDNQGTVEYVAKQLGIAHAFGNMSPRDK
         ||||||:|||||||||||||||||||||||||||||:|||||||||||||||||||| ||
g589     IGAFALSDALKADTAEAIGRLKKHNIDVYIMSGDNQSTVEYVAKQLGIAHAFGNMSPCDK
                550       560       570       580       590       600

            600       610       620       630       640       650
m589.pep AAEVQKLKAAGKTVAMVGDGINDAPALAAANVSFAMKGGADVAEHTASATLMQHSVNQLA
         ||||||||||||||||||||||||||||||||||||||||||||||||||||||||||||
g589     AAEVQKLKAAGKTVAMVGDGINDAPALAAANVSFAMKGGADVAEHTASATLMQHSVNQLA
                610       620       630       640       650       660

            660       670       680       690       700       710
m589.pep DALLVSQATLKNIKQNLFFAFFYNILGIPLAALGFLNPVIAGAAMAASSVSVLSNALRLK
         ||||:|||||:||||||||||||||||||||||||||||||||||||||||||:||||||
g589     DALLISQATLENIKQNLFFAFFYNILGIPLAALGFLNPVIAGAAMAASSVSVLGNALRLK
                670       680       690       700       710       720

            720
m589.pep RVKIDX
          |||||
g589     WVKIDX
```

The following partial DNA sequence was identified in *N. meningitidis* <SEQ ID 1831>:

```
a589.seq
   1   ATGCAACAAA AAGTCCGTTT CCAAATCGAA GGCATGACCT GCCAGGCATG
```

-continued

```
  51 TGCTTCGCGC ATTGAAAAAG TGTTGAACAA AAAAGATTTT GTCGAATCGG
 101 CGGGGGTAAA CTTCGCCAGC GAAGAGGCTC AGGTAGTGTT TGACGACAGC
 151 AAAACCTCAG TAGCCGACAT TGCCAAAATC ATTGAGAAAA CCGGTTACGG
 201 CGCGAAGGAA AAAACGGAAG ATACATTGCC GCAACCCGAA GCAGAACACC
 251 ATATCGGCTG GAGGTTGTGG CTTTTGCTGG CCATCAATAT CCCGTTCCTT
 301 ATCGGTATGG TAGGGATGAT GCTAAAAGGG CTGAATTGGA CACGGCATGA
 351 TTGGATGTTG TCGCCCTTGT TGCAGTTTGC ATTGGCGAGT GTGGTGCAGC
 401 TTTGGCTGGC GGTGCCATTT TACAAAAGCG CGTGGGCGAG CATTAAAGGC
 451 GGGCTGGCGA ATATGGACGT ACTCGTTACC ATCGGCACGG TCTCGATTTA
 501 CCTGTATTCC GTCTATATGC TGTTTTTCAG CCCGCACGCG GCGTACGGTA
 551 TGGCGCATGT GTATTTTGAA GTAGGCATAA TGGTGATTGG TTTTGTGTCA
 601 CTGGGTAAAT TTTTGGAACA CCGCACCAAA AAATCCAGCC TGAACAGCTT
 651 GGGCTTGCTG CTCAAACTCA CGCCAACCCA AGTCAACGTG CAACGCGATG
 701 GCGAATGGCG GCAGCTACCC ATCGACCAAG TGCAAATCGG CGACCTAATC
 751 CGCGCCAATC ACGGCGAACG CATTGCCGCC GACGGCATCA TAGAAAGCGG
 801 CAGCGGCTGG GCGGACGAAA GCCATCTTAC CGGCGAATCC AATCCCGAAG
 851 AGAAAAAGGC AGGCGGCAAA GTATTGGCGG GCGCGCTGAT GACTGAAGGC
 901 AGCGTGGTGT ACCGCGCCGC GCAGCTCGGC AGCCAAACCC TGCTCGGCGA
 951 CATGATGAAC GCGCTCTCCG AAGCGCAAGG CAGTAAAGCA CCGATTGCGC
1001 GTGTGGCGGA CAAGGCGGCG GCGGTATTCG TGCCTGCCGT TGTGGGCATC
1051 GCACTTTTGA CTTTTATCGC TACTTGGCTG ATTAAGGGCG ATTGGACGCT
1101 CGCATTGATG CACGCCGTCG CCGTTTTGGT GATTGCCTGC CCGTGTGCAC
1151 TCGGTTTGGC AACCCCTGCT GCGATTATGG TCGGTATGGG CAAAGCGGTT
1201 AAACACGGTA TTTGGTTTAA AGACGCGGCA GCAATGGAAG AAGCCGCCCA
1251 CGTTGATGCC GTCGTGCTGG ACAAAACCGG CACGCTGACC GAAGGCAAGC
1301 CGCAGGTTGC CGCCGTTTAT TGTGTTCCCG ACAGCGGCTT TGACGAAGAC
1351 GCTTTGTACC GCATCGCCGC CGCCGTCGAA CAAAACGCCG CCCATCCGCT
1401 CGCCCGTGCC ATCGTCTCCG CCGCCCAGGC GCGCGGTTTG GAGATTCCCA
1451 CCGCACAAAA TGCCCAAACC ATTGTCGGCG CGGGCATTAC CGCCGAAGTA
1501 AAAGGCGCGG GTTTGGTAAA AGCAGGCAAA GCCGAATTTG CCGAACTGAC
1551 CTTGCCGAAG TTTTCAGACG GCGTTTGGGA AATCGCCAGT GTGGTTGCCG
1601 TATCTGTAAA CGGCAAACCT ATCGGCGCAT TCGCACTCGC CGACGCGTTG
1651 AAAGCCGATA CCGCCGAAGC CATAGGCCGT CTGAAAAAAC ACAATATCGA
1701 TGTCTATATT ATGAGCGGCG ATAACCAAGG CACGGTCGAG TACGTCGCCA
1751 AACAACTGGG CATCGCACAC GCCTTCGGTA ATATGAGTCC GCGCGACAAA
1801 GCCGCCGAAG TGCAGAAACT CAAAGCCGCC GGCAAAACCG TGGCGATGGT
1851 CGGCGACGGC ATCAACGACG CGCCCGCGCT CGCCGCCGCC AACGTCAGCT
1901 TCGCCATGAA AGGCGGTGCA GACGTTGCCG AACACACCGC ATCCGCCACA
1951 CTGATGCAGC ATTCGGTCAA CCAGCTCGCC GATGCGCTAT CGGTATCGCG
2001 AGCGACGTTG AAAAACATCA AGCAAAACCT GTTTTTCGCC TTCTTCTACA
```

-continued

```
2051 ATATTTTGGG CATTCCGCTC GCCGCGCTCG GCTTTTTAAA CCCCGTCATC

2101 GCAGGCGCGG CAATGGCGGC AAGCTCGGTT TCCGTGTTGA GCAACGCCTT

2151 GCGCCTGAAA CGGGTAAAAA TCGATTGA
```

This corresponds to the amino acid sequence <SEQ ID 1832; ORF 589.a>:

```
a589.pep

  1 MQQKVRFQIE GMTCQACASR IEKVLNKKDF VESAGVNFAS EEAQVVFDDS

 51 KTSVADIAKI IEKTGYGAKE KTEDTLPQPE AEHHIGWRLW LLLAINIPFL

101 IGMVGMMLKG LNWTRHDWML SPLLQFALAS VVQLWLAVPF YKSAWASIKG

151 GLANMDVLVT IGTVSIYLYS VYMLFFSPHA AYGMAHVYFE VGIMVIGFVS

201 LGKFLEHRTK KSSLNSLGLL LKLTPTQVNV QRDGEWRQLP IDQVQIGDLI

251 RANHGERIAA DGIIESGSGW ADESHLTGES NPEEKKAGGK VLAGALMTEG

301 SVVYRAAQLG SQTLLGDMMN ALSEAQGSKA PIARVADKAA AVFVPAVVGI

351 ALLTFIATWL IKGDWTLALM HAVAVLVIAC PCALGLATPA AIMVGMGKAV

401 KHGIWFKDAA AMEEAAHVDA VVLDKTGTLT EGKPQVAAVY CVPDSGFDED

451 ALYRIAAAVE QNAAHPLARA IVSAAQARGL EIPTAQNAQT IVGAGITAEV

501 KGAGLVKAGK AEFAELTLPK FSDGVWEIAS VVAVSVNGKP IGAFALADAL

551 KADTAEAIGR LKKHNIDVYI MSGDNQGTVE YVAKQLGIAH AFGNMSPRDK

601 AAEVQKLKAA GKTVAMVGDG INDAPALAAA NVSFAMKGGA DVAEHTASAT

651 LMQHSVNQLA DALSVSRATL KNIKQNLFFA FFYNILGIPL AALGFLNPVI

701 AGAAMAASSV SVLSNALRLK RVKID*
```

```
m589/a589 94.9% identity in 725 aa overlap

                   10        20        30        40        50        60
m589.pep   MQQKIRFQIEGMTCQACASRIEKVLNKKDFVESAGVNFASEEAQVVFDDSKTSVADIAKI
           ||||:|||||||||||||||||||||||||||||||||||||||||||||||||||||||
a589       MQQKVRFQIEGMTCQACASRIEKVLNKKDFVESAGVNFASEEAQVVFDDSKTSVADIAKI
                   10        20        30        40        50        60

                   70        80        90       100      1     110
m589.pep   IEKTGYGAKEKTEDTLPQPEAEHHIGWRLWLLFTINVPFLIGMAGMMIG-----RHDWMI
           ||||||||||||||||||||||||||||||||::||:||||||:|||:      |||||:
a589       IEKTGYGAKEKTEDTLPQPEAEHHIGWRLWLLLAINIPFLIGMVGMMLKGLNWTRHDWML
                   70        80        90       100       110       120

              120       130       140       150       160       170
m589.pep   PPLWQFALASVVQLWLAIPFYKSAWASIKGGLANMDVLVTIGTVSIYLYSVYMLFFSPHA
            || |||||||||||||:||||||||||||||||||||||||||||||||||||||||||
a589       SPLLQFALASVVQLWLAVPFYKSAWASIKGGLANMDVLVTIGTVSIYLYSVYMLFFSPHA
                  130       140       150       160       170       180

              180       190       200       210       220       230
m589.pep   AYGMAHVYFEVGVMVIGFVSLGKFLEHRTKKSSLNSLGLLLKLTPTQVNVQRNGEWKQLP
           |||||||||||:||||||||||||||||||||||||||||||||||||||||:|||:|||
a589       AYGMAHVYFEVGIMVIGFVSLGKFLEHRTKKSSLNSLGLLLKLTPTQVNVQRDGEWRQLP
                  190       200       210       220       230       240

              240       250       260       270       280       290
m589.pep   IDQVQIGDLIRANHGERIAADGIIESGSGWADESHLTGESNPEEKKAGGKVLAGALMTEG
           ||||||||||||||||||||||||||||||||||||||||||||||||||||||||||||
a589       IDQVQIGDLIRANHGERIAADGIIESGSGWADESHLTGESNPEEKKAGGKVLAGALMTEG
                  250       260       270       280       290       300

              300       310       320       330       340       350
m589.pep   SVVYRATQLGSQTQLGDMMNALSEAQGSKAPIARVADKAAAVFVPAVVGIALLTFIVTWL
           ||||||:|||||| ||||||||||||||||||||||||||||||||||||||||||:|||
a589       SVVYRAAQLGSQTLLGDMMNALSEAQGSKAPIARVADKAAAVFVPAVVGIALLTFIATWL
                  310       320       330       340       350       360

              360       370       380       390       400       410
m589.pep   IKGDWTVALMHAVAVLVIACPCALGLATPAAIMVGMGKAVKHGIWFKDAAAMEEAAHVDA
           ||||||:|||||||||||||||||||||||||||||||||||||||||||||||||||||
a589       IKGDWTLALMHAVAVLVIACPCALGLATPAAIMVGMGKAVKHGIWFKDAAAMEEAAHVDA
                  370       380       390       400       410       420
```

-continued

```
                420        430        440        450        460        470
m589.pep  VVLDKTGTLTEGSPQVAAVYCVPDSGFDEDALYRIAAAVEQNAAHPLARAIVSAAQARGL
          ||||||||||||:|||||||||||||||||||||||||||||||||||||||||||||||
a589      VVLDKTGTLTEGKPQVAAVYCVPDSGFDEDALYRIAAAVEQNAAHPLARAIVSAAQARGL
                     430        440        450        460        470        480

                480        490        500        510        520        530
m589.pep  DIPAAQNAQTVVGAGITAEVEGVGLVKAGKAEFAELALPKFLDGVWDIASIVAVSVDNKP
          :||:||||||:|||||||||:|:|||||||||||||:|||| ||||:|||:|||||::||
a589      EIPTAQNAQTIVGAGITAEVKGAGLVKAGKAEFAELTLPKFSDGVWEIASVVAVSVNGKP
                     490        500        510        520        530        540

                540        550        560        570        580        590
m589.pep  IGAFALADALKADTAEAIGRLKKHNIDVYIMSGDNQGTVEYVAKQLGIAHAFGNMSPRDK
          ||||||||||||||||||||||||||||||||||||||||||||||||||||||||||||
a589      IGAFALADALKADTAEAIGRLKKHNIDVYIMSGDNQGTVEYVAKQLGIAHAFGNMSPRDK
                     550        560        570        580        590        600

                600        610        620        630        640        650
m589.pep  AAEVQKLKAAGKTVAMVGDGINDAPALAAANVSFAMKGGADVAEHTASATLMQHSVNQLA
          ||||||||||||||||||||||||||||||||||||||||||||||||||||||||||||
a589      AAEVQKLKAAGKTVAMVGDGINDAPALAAANVSFAMKGGADVAEHTASATLMQHSVNQLA
                     610        620        630        640        650        660

                660        670        680        690        700        710
m589.pep  DALLVSQATLKNIKQNLFFAFFYNILGIPLAALGFLNPVIAGAAMAASSVSVLSNALRLK
          ||| ||:|||||||||||||||||||||||||||||||||||||||||||||||||||||
a589      DALSVSRATLKNIKQNLFFAFFYNILGIPLAALGFLNPVIAGAAMAASSVSVLSNALRLK
                     670        680        690        700        710        720

                720
m589.pep  RVKIDX
          ||||||
a589      RVKIDX
```

The following partial DNA sequence was identified in *N. gonorrhoeae* <SEQ ID 1833>:

```
g590.seq..
   1 atgaaaaaac ctttgatttc agttgcggca gtattgctcg gcgttgcttt

  51 gggtacacct tattatttgg gtgtcaaagc agaagaaagt ctgacgcagc

 101 agcaaaaaat attgcagaaa acgggctttt tgaccgtcga atcgcaccag

 151 tatgatcgag gctggtttac ctctacggaa acgacggtca tccgtctgaa

 201 acccgagttg ctgcataatg cgcagaaata cctgccggat aacttgaaaa

 251 tagtgttgga acagccggtt acgctggtaa accatatcac gcacggccct

 301 ttcgccggcg gattcggcac gcaggcgcac attgaaaccg agttcaaata

 351 cgcgcctgaa acggaaaaag ttttggaacg ctttttgggg aaacaagttc

 401 cggtttccct tgccaatacc gtttatttca acggcagcgg taaaatggaa

 451 gtcagtgttc ccgctttcga ttatgaagaa ctgtcgggca tcaggctgca

 501 ctgggaaggc ctgacggggg aaacggttta tcaaaaaggt ttcaaaagct

 551 accgcaacag ctatgatgcg cccttgttca aaatcaagct ggcagacaaa

 601 ggcgatgccg cgtttgaaaa agcgcatttc gattcggaaa cttcagacgg

 651 catcaatccg cttgctttgg gcagcagcaa tctgactttg gaaaaatttt

 701 cgctcgaatg gaaagagggt gtcgattaca acgtcaaatt gaacgaactg

 751 gtcaacctcg ttaccgattt gcagatcggc gcgtttatca atcccaacgg

 801 cagcatcgca ccttccaaaa tcgaagtcgg caagctggct ttttcaacca

 851 agaccgggga atcgggcgcg tttatcgaca gcgaagggcg gttccgtttc

 901 gatacgttgg tgtacggcga tgaaaaatac ggcccgctgg acatccatat

 951 cgctgccgaa cacctcgatg cttctgcctt aaccgtattg aaacgcaagt

1001 ttgcacaaat ttctgccaaa aaaatgactg aggaacaaat ccgcaatgat

1051 ttgattgcgg cagtcaaagg cgatgcttcc ggattattta cccatgaccc
```

-continued

```
1101 ggtactaaat atcaaaattt tccgtttcac cctgcctcag ggaaaaattg

1151 atgtgggcgg aaaaatcatg tttaaaggca tgaagaagga agatttgaac

1201 caattgggac tgatgttaaa gaaaaccgag gcaaacatca gaatgagtat

1251 tcctcaaaaa atgttggaag atttggcggt aagtcaggct ggaaatattt

1301 tcagtgtaaa tgccgaagat gaggcggaag ccagagcaag cattgccgat

1351 attaatgaaa cattgcgcct gatggtggac agtacggtcc aaagtatggc

1401 aagggaaaaa tatcttactt tagacggtaa tcagattgat acggtcattt

1451 cccttaaaaa caacgccctg aagttaaacg ggaaaacgct gcaaaatgaa

1501 cccgatcctg attttgacga gggagatatg gtttccggcc agccgcatta

1551 a
```

This corresponds to the amino acid sequence <SEQ ID 1834; ORF 590.ng>:

```
g590.pep..
   1 MKKPLISVAA VLLGVALGTP YYLGVKAEES LTQQQKILQK TGFLTVESHQ

  51 YDRGWFTSTE TTVIRLKPEL LHNAQKYLPD NLKIVLEQPV TLVNHITHGP

 101 FAGGFGTQAH IETEFKYAPE TEKVLERFFG KQVPVSLANT VYFNGSGKME

 151 VSVPAFDYEE LSGIRLHWEG LTGETVYQKG FKSYRNSYDA PLFKIKLADK

 201 GDAAFEKAHF DSETSDGINP LALGSSNLTL EKFSLEWKEG VDYNVKLNEL

 251 VNLVTDLQIG AFINPNGSIA PSKIEVGKLA FSTKTGESGA FIDSEGRFRF

 301 DTLVYGDEKY GPLDIHIAAE HLDASALTVL KRKFAQISAK KMTEEQIRND

 351 LIAAVKGDAS GLFTHDPVLN IKIFRFTLPQ GKIDVGGKIM FKGMKKEDLN

 401 QLGLMLKKTE ANIRMSIPQK MLEDLAVSQA GNIFSVNAED EAEARASIAD

 451 INETLRLMVD STVQSMAREK YLTLDGNQID TVISLKNNAL KLNGKTLQNE

 501 PDPDFDEGDM VSGQPH*
```

The following partial DNA sequence was identified in *N. meningitidis* <SEQ ID 1835>:

```
m590.seq (partial) ..
   1 ..TGGTTTACCT CTATGGAAAC GACGGTCATC CGTCTGAAAC CCGAGTTGCT

  51   GAATAATGCC CGAAAATACC TGCCGGATAA CCTGAAAACA GTGTTGGAAC

 101   AGCCGGTTAC GCTGGTTAAC CATATCACGC ACGGCCCTTT CGCCGGCGGA

 151   TTCGGCACGC AGGCGTACAT TGAAACCGAG TTCAAATACG CGCCTGAAAC

 201   GGAAAAAGTT CTGGAACGCT TTTTGGAAA ACAAGTCCCG GCTTCCCTTG

 251   CCAATACCGT TTATTTTAAC GGCAGCGGTA AAATGGAAGT CAGTGTTCCC

 301   GCCTTCGATT ATGAAGAGCT GTCGGGCATc AG.CTGCACT GGGAAkGCCT

 351   GACGGGAGAA ACGGTTTATC AAAAAGGTTT CAAAAGCTAC CGGAACGGCT

 401   ATGATGCCCC CTTGTTTAAA ATCAAGCTGG CAGACAAAGG CGATGCCGCG

 451   TTTGAAAAAG TGCATTTCGA TTCGGAAACT TCAGACGGCA TCAATCCGCT

 501   TGCTTTGGGC AGCAGCAATC TGACCTTGGA AAAATTCTCC CTAGAATGGA

 551   AAGAGGGTGT CGATTACAAC GTCAAGTTAA ACGAACTGGT CAATCTTGTT

 601   ACCGATTTGC AGATTGGCGC GTTTATCAAT CCCAACGGCA GCATCGCACC
```

-continued

```
 651  TTCCAAAATC GAAGTCGGCA AACTGGCTTT TTCAACCAAG ACCGGGGAAT

 701  CAGGCGCGTT TATCAACAGT GAAGGGCAGT TCCGTTTCGA TACACTGGTG

 751  TACGGCGATG AAAAATACGG CCCGCTGGAC ATCCATATCG CTGCCGAACA

 801  CCTCGATGCT TCTGCCTTAA CCGTATTGAA ACGCAAGTTT GCACAAATTT

 851  CCGCCAAAAA AATGACCGAG GAACAAATCC GCAATGATTT GATTGCCGCC

 901  GTCAAAGGAG AGGCTTCCGG ACTGTTCACC AACAATCCCG TATTGGACAT

 951  TAAAACTTTC CGATTCACGC TGCCATCGGG AAAAATCGAT GTGGGCGGAA

1001  AAATCATGTT TAAAGACATG AAGAAGGAAG ATTTGAATCA ATTGGGTTTG

1051  ATGCTGAAGA AAACCGAAGC CGACATCAGA ATGAGTATTC CCCAAAAAAT

1101  GCTGGAAGAC TTGGCGGTCA GTCAAGCAGG CAATATTTTC AGCGTCAATG

1151  CCGAAGATGA GGCGGAAGGC AGGGCAAGTC TTGACGACAT CAACGAGACC

1201  TTGCGCCTGA TGGTGGACAG TACGGTTCAG AGTATGGCAA GGGAAAAATA

1251  TCTGACTTTG AACGGCGACC AGATTGATAC TGCCATTTCT CTGAAAAACA

1301  ATCAGTTGAA ATTGAACGGT AAAACGTTGC AAAACGAACC GGAGCCGGAT

1351  TTTGATGAAG GCGGTATGGT TTCAGAGCCG CAGCAGTAA
```

This corresponds to the amino acid sequence <SEQ ID 1836; ORF 590>:

```
m590.pep..(partial)

     1 ..WFTSMETTVI RLKPELLNNA RKYLPDNLKT VLEQPVTLVN HITHGPFAGG

    51   FGTQAYIETE FKYAPETEKV LERFFGKQVP ASLANTVYFN GSGKMEVSVP

   101   AFDYEELSGI XLHWEXLTGE TVYQKGFKSY RNGYDAPLFK IKLADKGDAA

   151   FEKVHFDSET SDGINPLALG SSNLTLEKFS LEWKEGVDYN VKLNELVNLV

   201   TDLQIGAFIN PNGSIAPSKI EVGKLAFSTK TGESGAFINS EGQFRFDTLV

   251   YGDEKYGPLD IHIAAEHLDA SALTVLKRKF AQISAKKMTE EQIRNDLIAA

   301   VKGEASGLFT NNPVLDIKTF RFTLPSGKID VGGKIMFKDM KKEDLNQLGL

   351   MLKKTEADIR MISPQKMLED LAVSQAGNIF SVNAEDEAEG RASLDDINET

   401   LRLMVDSTVQ SMAREKYLTL NGDQIDTAIS LKNNQLKLNG KTLQNEPEPD

   451   FDEGGMVSEP QQ*
```

```
m590/g590 93.1% identity in 462 aa overlap

                                                10        20        30
m590.pep                                 WFTSMETTVIRLKPELLNNARKYLPDNLKT
                                         |||| ||||||||||||:||:|||||||| 
g590      VKAEESLTQQQKILQKTGFLTVESHQYDRGWFTSTETTVIRLKPELLHNAQKYLPDNLKI
              30        40        50        60        70        80

                  40        50        60        70        80        90
m590.pep  VLEQPVTLVNHITHGPFAGGFGTQAYIETEFKYAPETEKVLERFFGKQVPASLANTVYFN
          |||||||||||||||||||||||||:||||||||||||||||||||||||:|||||||||
g590      VLEQPVTLVNHITHGPFAGGFGTQAHIETEFKYAPETEKVLERFFGKQVPVSLANTVYFN
              90       100       110       120       130       140

                 100       110       120       130       140       150
m590.pep  GSGKMEVSVPAFDYEELSGIXLHWEXLTGETVYQKGFKSYRNGYDAPLFKIKLADKGDAA
          |||||||||||||||||||| |||| ||||||||||||||||:|||||||||||||||||
g590      GSGKMEVSVPAFDYEELSGIRLHWEGLTGETVYQKGFKSYRNSYDAPLFKIKLADKGDAA
             150       160       170       180       190       200

                 160       170       180       190       200       210
m590.pep  FEKVHFDSETSDGINPLALGSSNLTLEKFSLEWKEGVDYNVKLNELVNLVTDLQIGAFIN
          |||:||||||||||||||||||||||||||||||||||||||||||||||||||||||||
g590      FEKAHFDSETSDGINPLALGSSNLTLEKFSLEWKEGVDYNVKLNELVNLVTDLQIGAFIN
             210       220       230       240       250       260
```

-continued

```
                220       230       240       250       260       270
m590.pep PNGSIAPSKIEVGKLAFSTKTGESGAFINSEGQFRFDTLVYGDEKYGPLDIHIAAEHLDA
         ||||||||||||||||||||||||||||:|||:|||||||||||||||||||||||||||
g590     PNGSIAPSKIEVGKLAFSTKTGESGAFIDSEGRFRFDTLVYGDEKYGPLDIHIAAEHLDA
            270       280       290       300       310       320

                280       290       300       310       320       330
m590.pep SALTVLKRKFAQISAKKMTEEQIRNDLIAAVKGEASGLFTNNPVLDIKTFRFTLPSGKID
         |||||||||||||||||||||||||||||||||:||||||::|||:|| ||||||:||||
g590     SALTVLKRKFAQISAKKMTEEQIRNDLIAAVKGDASGLFTHDPVLNIKIFRFTLPQGKID
            330       340       350       360       370       380

                340       350       360       370       380       390
m590.pep VGGKIMFKDMKKEDLNQLGLMLKKTEADIRMSIPQKMLEDLAVSQAGNIFSVNAEDEAEG
         |||||||| ||||||||||||||||||:|||||||||||||||||||||||||||||||:
g590     VGGKIMFKGMKKEDLNQLGLMLKKTEANIRMSIPQKMLEDLAVSQAGNIFSVNAEDEAEA
            390       400       410       420       430       440

                400       410       420       430       440       450
m590.pep RASLDDINETLRLMVDSTVQSMAREKYLTLNGDQIDTAISLKNNQLKLNGKTLQNEPEPD
         |||: |||||||||||||||||||||||||:|:||||:|||||| ||||||||||||:||
g590     RASIADINETLRLMVDSTVQSMAREKYLTLDGNQIDTVISLKNNALKLNGKTLQNEPDPD
            450       460       470       480       490       500

                 460
m590.pep FDEGGMVS-EPQQX
         |||| ||| :|:
g590     FDEGDMVSGQPHX
            510
```

The following partial DNA sequence was identified in *N. meningitidis* <SEQ ID 1837>:

```
a590.seq
   1 ATGAAAAAAC CTTTGATTTC GGTTGCGGCA GCATTGCTCG GCGTTGCTTT

  51 GGGCACGCCT TATTATTTGG GTGTCAAAGC CGAAGAAAGC TTGACGCAGC

 101 AGCAAAAAAT ATTGCAGGAA GCGGGCTTCT TGACCGTCGA ATCGCACCAA

 151 TATGAGCGCG GCTGGTTTAC CTCTACGGAA ACGACGGTCA TCCGCTTGAA

 201 ACCCGAGTTG CTGCATAATG CGCAGAAATA CCTGCCGGAT AACCTGAAAA

 251 CAGTGTTGGA ACAGCCGGTT ACGCTGGTAA ACCATATCAC GCACGGTCCT

 301 TTTGCCGGCG GATTCGGCAC GCAGGCGTAC ATTGAAACCG AGTTCAAATA

 351 CGCGCCTGAA ACGGAAAAAG TTCTGGAACG CTTTTTTGGA AAACAAGTCC

 401 CGGTTTCCCT TGCCAATACC GTTTATTTTA ACGGCAGCGG TAAAATGGAA

 451 GTCAGTGTTC CCGCCTTCGA TTATGAAGAG CTGTCGGGCA TCAGGCTGCA

 501 CTGGGAAGGC CTGACGGGAG AAACGGTTTA TCAAAAAGGT TTCAAAAGCT

 551 ACCGGAACGG CTATGATGCC CCCTTGTTTA AAATCAAGCT GGCAGACAAA

 601 GGCGATGCCG CGTTTGAAAA AGTGCATTTC GATTCGGAAA CTTCAGACGG

 651 CATCAACCCG CTTGCTTTGG GCAGCAGCAA TCTGACCTTG GAAAAATTTT

 701 CCTTAGAATG GAAAGAGGGT GTCGATTACA ACGTCAAGTT AAACGAACTG

 751 GTCAATCTTG TTACCGATTT GCAGATTGGC GCGTTTATCA ATCCCAACGG

 801 CAGCATCGCA CCTTCCAAAA TCGAAGTCGG CAAGCTGGCT TTTTCAACCA

 851 AGACCGGGGA ATCGGGCGCG TTTATCGATA GCGAAGGGCA GTTCCGTTTT

 901 GGCACGCTGG TTTACGGCGA TGAAAAATAC GGCCCTCTGG ACATCCATAT

 951 CGCTGCCGAA CACCTCGATG CTTCTGCCTT AACCGTATTG AAACGCAAGT

1001 TTGCACGAAT TTCTGCCAAA AAAATGACTG AAGAACAAAT CCGCAATGAT

1051 TTGATTGCGG CAGTCAAAGG CGAGGCTTCC GGATTATTTA CCCATAACCC

1101 AGTATTGGAC ATTAAAACTT TCCGATTCAC GCTGCCATCG GGAAAAATCG

1151 ATGTGGGCGG AAAAATCATG TTTAAAGACA TGAAGAAGGA AGATTTGAAC
```

-continued

```
1201 CAATTGGGTT TGATGCTGAA GAAAACCGAA GCCGACATCA GAATGAGTAT

1251 TCCCCAAAAA ATGCTGGAAG ACTTGGCGGT CAGTCAAGCA GGCAATATTT

1301 TCAGCGTCAA TGCCGAAGAT GAGGCGGAAG GCAGGGCAAG TCTTGACGAC

1351 ATCAACGAGA CCTTGCGCCT GATGGTGGAC AGTACGGTTC AGAGTATGGC

1401 AAGGGAAAAA TATCTGACTT TGAACGGCGA CCAGATTGAT ACTGCCATTT

1451 CTCTGAAAAA CAATCAGTTG AAATTGAACG GTAAAACGTT GCAAAACGAA

1501 CCGGAGCCGG ATTTTGATGA AGGCGGTATG GTTTCAGAGC CGCAGCAGTA

1551 A
```

This corresponds to the amino acid sequence <SEQ ID 1838; ORF 590.a>:

```
a590.pep

  1 MKKPLISVAA ALLGVALGTP YYLGVKAEES LTQQQKILQE AGFLTVESHQ

 51 YERGWFTSTE TTVIRLKPEL LHNAQKYLPD NLKTVLEQPV TLVNHITHGP

101 FAGGFGTQAY IETEFKYAPE TEKVLERFFG KQVPVSLANT VYFNGSGKME

151 VSVPAFDYEE LSGIRLHWEG LTGETVYQKG FKSYRNGYDA PLFKIKLADK

201 GDAAFEKVHF DSETSDGINP LALGSSNLTL EKFSLEWKEG VDYNVKLNEL

251 VNLVTDLQIG AFINPNGSIA PSKIEVGKLA FSTKTGESGA FIDSEGQFRF

301 GTLVYGDEKY GPLDIHIAAE HLDASALTVL KRKFARISAK KMTEEQIRND

351 LIAAVKGEAS GLFTHNPVLD IKTFRFTLPS GKIDVGGKIM FKDMKKEDLN

401 QLGLMLKKTE ADIRMSIPQK MLEDLAVSQA GNIFSVNAED EAEGRASLDD

451 INETLRLMVD STVQSMAREK YLTLNGDQID TAISLKNNQL KLNGKTLQNE

501 PEPDFDEGGM VSEPQQ*
```

```
m590/a590 97.8% identity in 462 aa overlap

                                                10        20        30
m590.pep                                WFTSMETTVIRLKPELLNNARKYLPDNLKT
                                        |||| ||||||||||||:||:|||||||||
a590     VKAEESLTQQQKILQEAGFLTVESHQYERGWFTSTETTVIRLKPELLHNAQKYLPDNLKT
             30        40        50        60        70        80

                 40        50        60        70        80        90
m590.pep VLEQPVTLVNHITHGPFAGGFGTQAYIETEFKYAPETEKVLERFFGKQVPASLANTVYFN
         ||||||||||||||||||||||||||||||||||||||||||||||||||:|||||||||
a590     VLEQPVTLVNHITHGPFAGGFGTQAYIETEFKYAPETEKVLERFFGKQVPVSLANTVYFN
             90       100       110       120       130       140

                100       110       120       130       140       150
m590.pep GSGKMEVSVPAFDYEELSGIXLHWEXLTGETVYQKGFKSYRNGYDAPLFKIKLADKGDAA
         |||||||||||||||||||| |||| ||||||||||||||||||||||||||||||||||
a590     GSGKMEVSVPAFDYEELSGIRLHWEGLTGETVYQKGFKSYRNGYDAPLFKIKLADKGDAA
            150       160       170       180       190       200

                160       170       180       190       200       210
m590.pep FEKVHFDSETSDGINPLALGSSNLTLEKFSLEWKEGVDYNVKLNELVNLVTDLQIGAFIN
         ||||||||||||||||||||:|||||:|||||||||||||||||||||||||||||||||
a590     FEKVHFDSETSDGINPLALGSSNLTLEKFSLEWKEGVDYNVKLNELVNLVTDLQIGAFIN
            210       220       230       240       250       260

                220       230       240       250       260       270
m590.pep PNGSIAPSKIEVGKLAFSTKTGESGAFINSEGQFRFDTLVYGDEKYGPLDIHIAAEHLDA
         ||||||||||||||||||||||||||||:||||||| |||||||||||||||||||||||
a590     PNGSIAPSKIEVGKLAFSTKTGESGAFIDSEGQFRFGTLVYGDEKYGPLDIHIAAEHLDA
            270       280       290       300       310       320

                280       290       300       310       320       330
m590.pep SALTVLKRKFAQISAKKMTEEQIRNDLIAAVKGEASGLFTNNPVLDIKTFRFTLPSGKID
         |||||||||||:||||||||||||||||||||||||||||:|||||||||||||||||||
a590     SALTVLKRKFARISAKKMTEEQIRNDLIAAVKGEASGLFTHNPVLDIKTFRFTLPSGKID
            330       340       350       360       370       380
```

-continued

```
                 340        350        360        370        380        390
m590.pep VGGKIMFKDMKKEDLNQLGLMLKKTEADIRMSIPQKMLEDLAVSQAGNIFSVNAEDEAEG
         ||||||||||||||||||||||||||||||||||||||||||||||||||||||||||||
a590     VGGKIMFKDMKKEDLNQLGLMLKKTEADIRMSIPQKMLEDLAVSQAGNIFSVNAEDEAEG
             390        400        410        420        430        440

                 400        410        420        430        440        450
m590.pep RASLDDINETLRLMVDSTVQSMAREKYLTLNGDQIDTAISLKNNQLKLNGKTLQNEPEPD
         ||||||||||||||||||||||||||||||||||||||||||||||||||||||||||||
a590     RASLDDINETLRLMVDSTVQSMAREKYLTLNGDQIDTAISLKNNQLKLNGKTLQNEPEPD
             450        460        470        480        490        500

                 460
m590.pep FDEGGMVSEPQQX
         |||||||||||||
g590     FDEGGMVSEPQQX
             510
```

The following partial DNA sequence was identified in *N. meningitidis* <SEQ ID 1839>:

```
m590-1.seq
   1 ATGAAAAAAC CTTTGATTTC GGTTGCGGCA GCATTGCTCG GCGTTGCTTT

  51 GGGCACGCCT TATTATTTGG GTGTCAAAGC CGAAGAAAGC TTGACGCAGC

 101 AGCAAAAAAT ATTGCAGGAA ACGGGCTTCT TGACCGTCGA ATCGCACCAA

 151 TATGAGCGCG GCTGGTTTAC CTCTATGGAA ACGACGGTCA TCCGTCTGAA

 201 ACCCGAGTTG CTGAATAATG CCCGAAAATA CCTGCCGGAT AACCTGAAAA

 251 CAGTGTTGGA ACAGCCGGTT ACGCTGGTTA ACCATATCAC GCACGGCCCT

 301 TTCGCCGGCG GATTCGGCAC GCAGGCGTAC ATTGAAACCG AGTTCAAATA

 351 CGCGCCTGAA ACGGAAAAAG TTCTGGAACG CTTTTTTGGA AAACAAGTCC

 401 CGGCTTCCCT TGCCAATACC GTTTATTTTA ACGGCAGCGG TAAAATGGAA

 451 GTCAGTGTTC CCGCCTTCGA TTATGAAGAG CTGTCGGGCA TCAGGCTGCA

 501 CTGGGAAGGC CTGACGGGAG AAACGGTTTA TCAAAAAGGT TTCAAAAGCT

 551 ACCGGAACGG CTATGATGCC CCCTTGTTTA AAATCAAGCT GGCAGACAAA

 601 GGCGATGCCG CGTTTGAAAA AGTGCATTTC GATTCGGAAA CTTCAGACGG

 651 CATCAATCCG CTTGCTTTGG GCAGCAGCAA TCTGACCTTG GAAAAATTCT

 701 CCCTAGAATG GAAAGAGGGT GTCGATTACA ACGTCAAGTT AAACGAACTG

 751 GTCAATCTTG TTACCGATTT GCAGATTGGC GCGTTTATCA ATCCCAACGG

 801 CAGCATCGCA CCTTCCAAAA TCGAAGTCGG CAAACTGGCT TTTTCAACCA

 851 AGACCGGGGA ATCAGGCGCG TTTATCAACA GTGAAGGGCA GTTCCGTTTC

 901 GATACACTGG TGTACGGCGA TGAAAAATAC GGCCCGCTGG ACATCCATAT

 951 CGCTGCCGAA CACCTCGATG CTTCTGCCTT AACCGTATTG AAACGCAAGT

1001 TTGCACAAAT TTCCGCCAAA AAAATGACCG AGGAACAAAT CCGCAATGAT

1051 TTGATTGCCG CCGTCAAAGG AGAGGCTTCC GGACTGTTCA CCAACAATCC

1101 CGTATTGGAC ATTAAAACTT TCCGATTCAC GCTGCCATCG GGAAAAATCG

1151 ATGTGGGCGG AAAAATCATG TTTAAAGACA TGAAGAAGGA AGATTTGAAT

1201 CAATTGGGTT TGATGCTGAA GAAAACCGAA GCCGACATCA GAATGAGTAT

1251 TCCCCAAAAA ATGCTGGAAG ACTTGGCGGT CAGTCAAGCA GGCAATATTT

1301 TCAGCGTCAA TGCCGAAGAT GAGGCGGAAG GCAGGGCAAG TCTTGACGAC

1351 ATCAACGAGA CCTTGCGCCT GATGGTGGAC AGTACGGTTC AGAGTATGGC

1401 AAGGGAAAAA TATCTGACTT TGAACGGCGA CCAGATTGAT ACTGCCATTT
```

-continued

```
1451 CTCTGAAAAA CAATCAGTTG AAATTGAACG GTAAAACGTT GCAAAACGAA

1501 CCGGAGCCGG ATTTTGATGA AGGCGGTATG GTTTCAGAGC CGCAGCAGTA

1551 A
```

This corresponds to the amino acid sequence <SEQ ID 1840; ORF 590-1>:

```
m590-1.pep

  1  MKKPLISVAA ALLGVALGTP YYLGVKAEES LTQQQKILQE TGFLTVESHQ

 51  YERGWFTSME TTVIRLKPEL LNNARKYLPD NLKTVLEQPV TLVNHITHGP

101  FAGGFGTQAY IETEFKYAPE TEKVLERFFG KQVPASLANT VYFNGSGKME

151  VSVPAFDYEE LSGIRLHWEG LTGETVYQKG FKSYRNGYDA PLFKIKLADK

201  GDAAFEKVHF DSETSDGINP LALGSSNLTL EKFSLEWKEG VDYNVKLNEL

251  VNLVTDLQIG AFINPNGSIA PSKIEVGKLA FSTKTGESGA FINSEGQFRF

301  DTLVYGDEKY GPLDIHIAAE HLDASALTVL KRKFAQISAK KMTEEQIRND

351  LIAAVKGEAS GLFTNNPVLD IKTFRFTLPS GKIDVGGKIM FKDMKKEDLN

401  QLGLMLKKTE ADIRMSIPQK MLEDLAVSQA GNIFSVNAED EAEGRASLDD

451  INETLRLMVD STVQSMAREK YLTLNGDQID TAISLKNNQL KLNGKTLQNE

501  PEPDFDEGGM VSEPQQ*

m590-1/g590    93.6% identity in 516 aa overlap

                      10        20        30        40        50        60
m590-1.pep    MKKPLISVAAALLGVALGTPYYLGVKAEESLTQQQKILQETGFLTVESHQYERGWFTSME
              ||||||||||:|||||||||||||||||||||||||||||:|||||||||||:|||||| |
g590          MKKPLISVAAVLLGVALGTPYYLGVKAEESLTQQQKILQKTGFLTVESHQYDRGWFTSTE
                      10        20        30        40        50        60

                      70        80        90       100       110       120
m590-1.pep    TTVIRLKPELLNNARKYLPDNLKTVLEQPVTLVNHITHGPFAGGFGTQAYIETEFKYAPE
              |||||||||||:||:|||||||| ||||||||||||||||||||||||||:||||||||||
g590          TTVIRLKPELLHNAQKYLPDNLKIVLEQPVTLVNHITHGPFAGGFGTQAHIETEFKYAPE
                      70        80        90       100       110       120

                     130       140       150       160       170       180
m590-1.pep    TEKVLERFFGKQVPASLANTVYFNGSGKMEVSVPAFDYEELSGIRLHWEGLTGETVYQKG
              ||||||||||||||:|||||||||||||||||||||||||||||||||||||||||||||
g590          TEKVLERFFGKQVPVSLANTVYFNGSGKMEVSVPAFDYEELSGIRLHWEGLTGETVYQKG
                     130       140       150       160       170       180

                     190       200       210       220       230       240
m590-1.pep    FKSYRNGYDAPLFKIKLADKGDAAFEKVHFDSETSDGINPLALGSSNLTLEKFSLEWKEG
              ||||||:||||||||||||||||||||:||||||||||||||||||||||||||||||||
g590          FKSYRNSYDAPLFKIKLADKGDAAFEKAHFDSETSDGINPLALGSSNLTLEKFSLEWKEG
                     190       200       210       220       230       240

                     250       260       270       280       290       300
m590-1.pep    VDYNVKLNELVNLVTDLQIGAFINPNGSIAPSKIEVGKLAFSTKTGESGAFINSEGQFRF
              |||||||||||||||||||||||||||||||||||||||||||||||||||:|||:||||
g590          VDYNVKLNELVNLVTDLQIGAFINPNGSIAPSKIEVGKLAFSTKTGESGAFIDSEGRFRF
                     250       260       270       280       290       300

                     310       320       330       340       350       360
m590-1.pep    DTLVYGDEKYGPLDIHIAAEHLDASALTVLKRKFAQISAKKMTEEQIRNDLIAAVKGEAS
              ||||||||||||||||||||||||||||||||||||||||||||||||||||||||:|||
g590          DTLVYGDEKYGPLDIHIAAEHLDASALTVLKRKFAQISAKKMTEEQIRNDLIAAVKGDAS
                     310       320       330       340       350       360

                     370       380       390       400       410       420
m590-1.pep    GLFTNNPVLDIKTFRFTLPSGKIDVGGKIMFKDMKKEDLNQLGLMLKKTEADIRMSIPQK
              ||||::|||:|| ||||||:||||||||||||| ||||||||||||||||||:|||||||
g590          GLFTHDPVLNIKIFRFTLPQGKIDVGGKIMFKGMKKEDLNQLGLMLKKTEANIRMSIPQK
                     370       380       390       400       410       420

                     430       440       450       460       470       480
m590-1.pep    MLEDLAVSQAGNIFSVNAEDEAEGRASLDDINETLRLMVDSTVQSMAREKYLTLNGDQID
              |||||||||||||||||||||||:||||: |||||||||||||||||||||||||:|:|||
g590          MLEDLAVSQAGNIFSVNAEDEAEARASIADINETLRLMVDSTVQSMAREKYLTLDGNQID
                     430       440       450       460       470       480
```

-continued

```
                 490        500        510
m590-1.pep    TAISLKNNQLKLNGKTLQNEPEPDFDEGGMVS-EPQQX
              |:|||||| |||||||||||:|||||| ||| :|:
g590          TVISLKNNALKLNGKTLQNEPDPDFDEGDMVSGQPHX
                 490        500        510

a590/m590-1   98.3% identity in 516 aa overlap

                  10         20         30         40         50         60
a590.pep      MKKPLISVAAALLGVALGTPYYLGVKAEESLTQQQKILQEAGFLTVESHQYERGWFTSTE
              ||||||||||||||||||||||||||||||||||||||||:|||||||||||||||||| |
m590-1        MKKPLISVAAALLGVALGTPYYLGVKAEESLTQQQKILQETGFLTVESHQYERGWFTSME
                  10         20         30         40         50         60

                  70         80         90        100        110        120
a590.pep      TTVIRLKPELLHNAQKYLPDNLKTVLEQPVTLVNHITHGPFAGGFGTQAYIETEFKYAPE
              |||||||||||:||:|||||||||||||||||||||||||||||||||||||||||||||
m590-1        TTVIRLKPELLNNARKYLPDNLKTVLEQPVTLVNHITHGPFAGGFGTQAYIETEFKYAPE
                  70         80         90        100        110        120

                 130        140        150        160        170        180
a590.pep      TEKVLERFFGKQVPVSLANTVYFNGSGKMEVSVPAFDYEELSGIRLHWEGLTGETVYQKG
              ||||||||||||||:|||||||||||||||||||||||||||||||||||||||||||||
m590-1        TEKVLERFFGKQVPASLANTVYFNGSGKMEVSVPAFDYEELSGIRLHWEGLTGETVYQKG
                 130        140        150        160        170        180

                 190        200        210        220        230        240
a590.pep      FKSYRNGYDAPLFKIKLADKGDAAFEKVHFDSETSDGINPLALGSSNLTLEKFSLEWKEG
              ||||||||||||||||||||||||||||||||||||||||||||||||||||||||||||
m590-1        FKSYRNGYDAPLFKIKLADKGDAAFEKVHFDSETSDGINPLALGSSNLTLEKFSLEWKEG
                 190        200        210        220        230        240

                 250        260        270        280        290        300
a590.pep      VDYNVKLNELVNLVTDLQIGAFINPNGSIAPSKIEVGKLAFSTKTGESGAFIDSEGQFRF
              |||||||||||||||||||||||||||||||||||||||||||||||||||:||||||||
m590-1        VDYNVKLNELVNLVTDLQIGAFINPNGSIAPSKIEVGKLAFSTKTGESGAFINSEGQFRF
                 250        260        270        280        290        300

                 310        320        330        340        350        360
a590.pep      GTLVYGDEKYGPLDIHIAAEHLDASALTVLKRKFARISAKKMTEEQIRNDLIAAVKGEAS
               |||||||||||||||||||||||||||||||||:||||||||||||||||||||||||||
m590-1        DTLVYGDEKYGPLDIHIAAEHLDASALTVLKRKFAQISAKKMTEEQIRNDLIAAVKGEAS
                 310        320        330        340        350        360

                 370        380        390        400        410        420
a590.pep      GLFTHNPVLDIKTFRFTLPSGKIDVGGKIMFKDMKKEDLNQLGLMLKKTEADIRMSIPQK
              ||||:|||||||||||||||||||||||||||||||||||||||||||||||||||||||
m590-1        GLFTNNPVLDIKTFRFTLPSGKIDVGGKIMFKDMKKEDLNQLGLMLKKTEADIRMSIPQK
                 370        380        390        400        410        420

                 430        440        450        460        470        480
a590.pep      MLEDLAVSQAGNIFSVNAEDEAEGRASLDDINETLRLMVDSTVQSMAREKYLTLNGDQID
              ||||||||||||||||||||||||||||||||||||||||||||||||||||||||||||
m590-1        MLEDLAVSQAGNIFSVNAEDEAEGRASLDDINETLRLMVDSTVQSMAREKYLTLNGDQID
                 430        440        450        460        470        480

                 490        500        510
a590.pep      TAISLKNNQLKLNGKTLQNEPEPDFDEGGMVSEPQQX
              |||||||||||||||||||||||||||||||||||||
m590-1        TAISLKNNQLKLNGKTLQNEPEPDFDEGGMVSEPQQX
                 490        500        510
```

The following partial DNA sequence was identified in *N. gonorrhoeae* <SEQ ID 1841>:

```
g591.seq
   1 TTGCAAACCC TTCTAGCTTT TATCTTCGCC ATCCTGATTT TGGTCAGCCT

  51 GCACGAATTC GGACACTACA TCGTCGCCAG GTTGTGCGGC GTCAAGGTTG

 101 TGCGTTTTTC CGTCGGCTTC GGCAAACCGT TTTTCACCCG AAAGCGCGGC

 151 GACACCGAAT GGTGCCTCGC CCCGATTCCG TTGGGCGGCT ACGTCAAAAT

 201 GGTCGATACG CGCGAAGGCG AAGTATCAGA AGCCGATTTA CCCTACGCTT

 251 TTGACAAACA ACACCCCGCC AAGCGCATCG CCATCGTCGC CGCCGGTCCG

 301 CTGACCAACC TCGCActggc ggTTTTGCTG TACGGACTGa gctTttcctt

 351 cggcgtaaCC GAACTGCGGC CCtatgtcgg cacagtcgaA cccgacaccg

 401 ttgccgCCCG CACCGGCTTC caaagcggcg acaaAATACa atccgtcaac

 451 ggcgtTtccg tCCAAGACTG GAGCAGCGCG CAAACCGAAA TCGTcctcAA
```

-continued

501 CCTCGAAGCC Ggcaaagtcg ccgtcggcgT TCAGACGGCA TCGGGCGCGC

551 AAACCGTCCG CACCAtcgAT GCCGCAGGCA CGCCGGAAGC CGGTAAAATC

601 GCAAAAAACC AAGGCTACAT CGGACTGATG CCCTTTAAAA TCACAACCGT

651 TGCCGGCGGC GTGGAAAAAG GCAGCCCCGC CGAAAAAGCA GGCCTGAAAC

701 CGGGCGACAG GCTGACTGCC GCCGACGGCA AACCCATCGc ctcaTGGCAG

751 GAATGggcaa acctgACccg cCAAAGCCCg ggcAAAAAAA Tcaccctgac 801 ctacgAaCGC GCcggacaaa cccaTAccgc CGACATCCGC CccgATactg 851 TCGAAcagcc cgACCACACC CTGATCgggc gcgTCGGCCT CCGtccgcaG

901 CCGGACAGGG CGTGGGACGC GCAAATCCGC CGCAGCTACC GTCCGTCTGT

951 TGTCCGCGCA TTCGGCATGG GCTGGGAAAA AACCGTTTCC CACTCGTGGA

1001 CAACCCTCAA ATTTTTCGGC AAACTAATCA GCGGCAACGC CTCTGTCAGC

1051 CATATTTCCG GGCCGCTGAC CATTGCCGAC ATTGCCGGAC AGTCCGCCGA

1101 ACTCGGCTTG CAAAGTTATT TGGAATTTTT AGCGTTGGTC AGCATCAGCC

1151 TCGGCGTGCT GAACCTGCTG CCCGTCCCCG TTTTGGACGG CGGGCACCTC

1201 GTGTTTTATA CTGTCGAATG GATACGCGGC AAACCTTTGG GCGAACGTGT

1251 CCAAAACATC GGTTTGCGCT TCGGGCTCGC CCTGATGATG CTGATGATGG

1301 CGGCCGCCTT CTTCAACGAC GTTACCCGGC TGATCGGTTA G

This corresponds to the amino acid sequence <SEQ ID 1842; ORF 591.ng>:

g591.pep..

1 LQTLLAFIFA ILILVSLHEF GHYIVARLCG VKVVRFSVGF GKPFFTRKRG

51 DTEWCLAPIP LGGYVKMVDT REGEVSEADL PYAFDKQHPA KRIAIVAAGP

101 LTNLALAVLL YGLSFSFGVT ELRPYVGTVE PDTVAARTGF QSGDKIQSVN

151 GVSVQDWSSA QTEIVLNLEA GKVAVGVQTA SGAQTVRTID AAGTPEAGKI

201 AKNQGYIGLM PFKITTVAGG VEKGSPAEKA GLKPGDRLTA ADGKPIASWQ

251 EWANLTRQSP GKKITLTYER AGQTHTADIR PDTVEQPDHT LIGRVGLRPQ

301 PDRAWDAQIR RSYRPSVVRA FGMGWEKTVS HSWTTLKFFG KLISGNASVS

351 HISGPLTIAD IAGQSAELGL QSYLEFLALV SISLGVLNLL PVPVLDGGHL

401 VFYTVEWIRG KPLGERVQNI GLRFGLALMM LMMAAAFFND VTRLIG*

The following partial DNA sequence was identified in *N. meningitidis* <SEQ ID 1843>:

m591.seq

1 TTGCACACCC TTCTAGCTTT TATCTTCGCC ATCCTGATTT TGGTCAGCCT

51 GCACGAGTTC GGACACTACA TCGTTGCCAG ATTGTGCGGC GTCAAAGTCG

101 TACGCTTTTC CGTCGGCTTC GGCAAACCGT TTTTCACCCG AAAGCGCGGC

151 GACACCGAAT GGTGCCTCGC CCCGATTCCG TTGGGCGGTT ACGTCAAAAT

201 GGTCGATACG CGCGAAGGCG AAGTATCAGA AGCCGATTTA CCCTACGCTT

251 TTGACAAACA ACACCCCGCC AAGCGCATCG CCATCGTCGC CGCCGGCCCA

301 CTGACCAACC TCGCACTGGC GGTTTTGCTG TACGGACTGA GCTTTTCCTT

351 CGGCGTAACC GAACTGCGCC CCTACGTCGG CACAGTCGAA CCCGACACCA

-continued

```
401 TTGCCGCCCG CGCCGGCTTC CAAAGCGGCG ACAAAATACA ATCCGTCAAC
451 GGCACACCCG TTGCAGATTG GGGCAGCGCG CAAACCGAAA TCGTCCTCAA
501 CCTCGAAGCC GGCAAAGTCG CCGTCGGCGT TCAGACGGCA TCGGGCGCGC
551 AAACCGTCCG CACCATCGAT GCCGCAGGCA CGCCGGAAGC CGGTAAAATC
601 GCAAAAAACC AAGGCTACAT CGGACTGATG CCCTTTAAAA TCACAACCGT
651 TGCCGGCGGC GTGGAAAAAG GCAGCCCCGC CGAAAAAGCA GGCCTGAAAC
701 CGGGCGACAG GCTGACTGCC GCCGACGGCA AACCCATCGC CTCATGGCAA
751 GAATGGGCAA ACCTGACCCG CCAAAGCCCC GGCAAAAAAA TCACCCTGAA
801 CTACGAACGC GCCGGACAAA CCCATACCGC CGACATCCGC CCCGATACTG
851 TCGAACAGTC CGACCACACC CTGATCGGGC GCGTCGGCCT CCGTCCGCAG
901 CCGGACAGGG CGTGGGACGC GCAAATCCGC CGCAGCTACC GTCCGTCTGT
951 TGTCCGCGCA TTCGGCATGG GCTGGGAAAA AACCGTTTCC CACTCGTGGA
1001 CAACCCTCAA ATTTTTCGGC AAACTAATCA GCGGCAACGC CTCCGTCAGC
1051 CATATTTCCG GGCCGCTGAC CATTGCCGAC ATTGCCGGAC AGTCCGCCGA
1101 ACTCGGCTTG CAAAGTTATT TGGAATTTTT AGCACTGGTC AGCATCAGCC
1151 TCGGCGTGCT GAACCTACTG CCCGTCCCTG TTTTGGACGG CGGGCACCTC
1201 GTGTTTTATA CTGCCGAATG GATACGCGGC AAACCTTTGG GCGAACGCGT
1251 CCAAAACATC GGTTTGCGCT TCGGGCTCGC CCTCATGATG CTGATGATGG
1301 CGGTCGCCTT CTTCAACGAC GTTACCCGGC TGCTCGGTTA G
```

This corresponds to the amino acid sequence <SEQ ID 1844; ORF 591>:

```
m591.pep..
  1 LHTLLAFIFA ILILVSLHEF GHYIVARLCG VKVVRFSVGF GKPFFTRKRG
 51 DTEWCLAPIP LGGYVKMVDT REGEVSEADL PYAFDKQHPA KRIAIVAAGP
101 LTNLALAVLL YGLSFSFGVT ELRPYVGTVE PDTIAARAGF QSGDKIQSVN
151 GTPVADWGSA QTEIVLNLEA GKVAVGVQTA SGAQTVRTID AAGTPEAGKI
201 AKNQGYIGLM PFKITTVAGG VEKGSPAEKA GLKPGDRLTA ADGKPIASWQ
251 EWANLTRQSP GKKITLNYER AGQTHTADIR PDTVEQSDHT LIGRVGLRPQ
301 PDRAWDAQIR RSYRPSVVRA FGMGWEKTVS HSWTTLKFFG KLISGNASVS
351 HISGPLTIAD IAGQSAELGL QSYLEFLALV SISLGVLNLL PVPVLDGGHL
401 VFYTAEWIRG KPLGERVQNI GLRFGLALMM LMMAVAFFND VTRLLG*
```

Computer analysis of this amino acid sequence gave the following results:

Homology with a Predicted ORF from *N. gonorrhoeae*

```
m591/g591  97.3% identity in 446 aa overlap

                    10        20        30        40        50        60
m591.pep    LHTLLAFIFAILILVSLHEFGHYIVARLCGVKVVRFSVGFGKPFFTRKRGDTEWCLAPIP
            |:||||||||||||||||||||||||||||||||||||||||||||||||||||||||||
g591        LQTLLAFIFAILILVSLHEFGHYIVARLCGVKVVRFSVGFGKPFFTRKRGDTEWCLAPIP
                    10        20        30        40        50        60
```

-continued

```
                   70        80        90       100       110       120
m591.pep   LGGYVKMVDTREGEVSEADLPYAFDKQHPAKRIAIVAAGPLTNLALAVLLYGLSFSFGVT
           ||||||||||||||||||||||||||||||||||||||||||||||||||||||||||||
g591       LGGYVKMVDTREGEVSEADLPYAFDKQHPAKRIAIVAAGPLTNLALAVLLYGLSFSFGVT
                   70        80        90       100       110       120

                  130       140       150       160       170       180
m591.pep   ELRPYVGTVEPDTIAARAGFQSGDKIQSVNGTPVADWGSAQTEIVLNLEAGKVAVGVQTA
           ||||||||||||:|||:|||||||||||||: | ||:||||||||||||||||||||||
g591       ELRPYVGTVEPDTVAARTGFQSGDKIQSVNGVSVQDWSSAQTEIVLNLEAGKVAVGVQTA
                  130       140       150       160       170       180

                  190       200       210       220       230       240
m591.pep   SGAQTVRTIDAAGTPEAGKIAKNQGYIGLMPFKITTVAGGVEKGSPAEKAGLKPGDRLTA
           ||||||||||||||||||||||||||||||||||||||||||||||||||||||||||||
g591       SGAQTVRTIDAAGTPEAGKIAKNQGYIGLMPFKITTVAGGVEKGSPAEKAGLKPGDRLTA
                  190       200       210       220       230       240

                  250       260       270       280       290       300
m591.pep   ADGKPIASWQEWANLTRQSPGKKITLNYERAGQTHTADIRPDTVEQSDHTLIGRVGLRPQ
           |||||||||||||||||||||||||:|||||||||||||||||||| |||||||||||||
g591       ADGKPIASWQEWANLTRQSPGKKITLTYERAGQTHTADIRPDTVEQPDHTLIGRVGLRPQ
                  250       260       270       280       290       300

                  310       320       330       340       350       360
m591.pep   PDRAWDAQIRRSYRPSVVRAFGMGWEKTVSHSWTTLKFFGKLISGNASVSHISGPLTIAD
           ||||||||||||||||||||||||||||||||||||||||||||||||||||||||||||
g591       PDRAWDAQIRRSYRPSVVRAFGMGWEKTVSHSWTTLKFFGKLISGNASVSHISGPLTIAD
                  310       320       330       340       350       360

                  370       380       390       400       410       420
m591.pep   IAGQSAELGLQSYLEFLALVSISLGVLNLLPVPVLDGGHLVFYTAEWIRGKPLGERVQNI
           ||||||||||||||||||||||||||||||||||||||||||||:|||||||||||||||
g591       IAGQSAELGLQSYLEFLALVSISLGVLNLLPVPVLDGGHLVFYTVEWIRGKPLGERVQNI
                  370       380       390       400       410       420

                  430       440
m591.pep   GLRFGLALMMLMMAVAFFNDVTRLLGX
           ||||||||||||||:|||||||||:||
g591       GLRFGLALMMLMMAAAFFNDVTRLIGX
                  430       440
```

The following partial DNA sequence was identified in *N. meningitidis* <SEQ ID 1845>:

```
a591.seq
  1 TTGCACACCC TTCTAGCTTT TATCTTCGCC ATCCTGATTT TGGTCAGCCT

 51 GCACGAATTC GGACACTACA TCGTCGCCAG ATTGTGCGGC GTCAAGGTTG

101 TGCGTTTTTC CGTCGGCTTC GGCAAACCGT TTTTCACCCG AAAGCGCGGC

151 GACACCGAAT GGTGCCTCGC CCCGATTCCG TTGGGCGGTT ACGTCAAAAT

201 GGTCGACACG CGCGAAGGCG AAGTATCAGA AGCCGATTTA CCCTACGCTT

251 TTGACAAACA ACACCCCGCC AAGCGCATCG CCATCGTCGC CGCCGGCCCG

301 CTGACCAACC TCGCACTGGC GGTTTTGCTG TACGGACTGA GCTTTTCCTT

351 CGGCGTTACC GAACTGCGCC CCTATGTCGG CACAGTCGAA CCCGACACCA

401 TTGCCGCCCG CGCCGGCTTC CAAAGCGGCG ACAAAATACA ATCCGTCAAC

451 GGCACACCCG TTGCAGATTG GGGCAGCGCG CAAACCGAAA TCGTCCTCAA

501 CCTCGAAGCC GGCAAAGTCG CCGTCGGCGT TCAGACGGCA TCGGGCGCGC

551 AAACCGTCCG CACCATCGAT GCCGCAGGCA CGCCGGAAGC CGGTAAAATC

601 GCAAAAAACC AAGGCTACAT CGGACTGATG CCCTTTAAAA TCACAACCGT

651 TGCCGGCGGC GTGGAAAAAG GCAGCCCCGC CGAAAAAGCA GGCCTGAAAC

701 CGGGCGACAG GCTGACTGCC GCCGACGGCA AACCCATCGC CTCATGGCAA

751 GAATGGGCAA ACCTGACCCG CCAAAGCCCC GGCAAAAAAA TCACCCTGAC

801 CTACGAACGC GCCGGACAAA CCCATACCGC CGACATCCGC CCCGATACTG

851 TCGAACAGCC CGACCACACC CTGATCGGGC GCGTCGGCCT CCGTCCGCAG

901 CCGGACAGGG CGTGGGACGC GCAAATCCGC CGCAGCTACC GTCCGTCTGT
```

-continued

```
 951 TGTCCGCGCA TTCGGCATGG GCTGGGAAAA AACCGTTTCC CACTCGTGGA

1001 CAACCCTCAA ATTTTTCGGC AAACTAATCA GCGGCAACGC CTCCGTCAGC

1051 CATATTTCCG GTCCGCTGAC CATTGCCGAT ATTGCCGGAC AGTCCGCCGA

1101 ACTCGGCTTG CAAAGTTATT TGGAATTTTT GGCACTGGTC AGCATCAGCC

1151 TCGGCGTGCT GAACCTGCTG CCCGTCCCCG TTTTGGACGG CGGCCACCTC

1201 GTGTTTTATA CTGCCGAATG GATACGCGGC AAACCTTTGG GCGAACGCGT

1251 CCAAAACATC GGTTTGCGCT TCGGGCTTGC CCTCATGATG CTGATGATGG

1301 CGGTCGCCTT CTTCAACGAC GTTACCCGGC TGCTCGGTTA G
```

This corresponds to the amino acid sequence <SEQ ID 1846; ORF 591.a>:

```
a591.pep

      1 LHTLLAFIFA ILILVSLHEF GHYIVARLCG VKVVRFSVGF GKPFFTRKRG

     51 DTEWCLAPIP LGGYVKMVDT REGEVSEADL PYAFDKQHPA KRIAIVAAGP

    101 LTNLALAVLL YGLSFSFGVT ELRPYVGTVE PDTIAARAGF QSGDKIQSVN

    151 GTPVADWGSA QTEIVLNLEA GKVAVGVQTA SGAQTVRTID AAGTPEAGKI

    201 AKNQGYIGLM PFKITTVAGG VEKGSPAEKA GLKPGDRLTA ADGKPIASWQ

    251 EWANLTRQSP GKKITLTYER AGQTHTADIR PDTVEQPDHT LIGRVGLRPQ

    301 PDRAWDAQIR RSYRPSVVRA FGMGWEKTVS HSWTTLKFFG KLISGNASVS

    351 HISGPLTIAD IAGQSAELGL QSYLEFLALV SISLGVLNLL PVPVLDGGHL

    401 VFYTAEWIRG KPLGERVQNI GLRFGLALMM LMMAVAFFND VTRLLG*
```

```
m591/a591  99.6% identity in 446 aa overlap

                    10        20        30        40        50        60
m591.pep    LHTLLAFIFAILILVSLHEFGHYIVARLCGVKVVRFSVGFGKPFFTRKRGDTEWCLAPIP
            ||||||||||||||||||||||||||||||||||||||||||||||||||||||||||||
a591        LHTLLAFIFAILILVSLHEFGHYIVARLCGVKVVRFSVGFGKPFFTRKRGDTEWCLAPIP
                    10        20        30        40        50        60

                    70        80        90       100       110       120
m591.pep    LGGYVKMVDTREGEVSEADLPYAFDKQHPAKRIAIVAAGPLTNLALAVLLYGLSFSFGVT
            ||||||||||||||||||||||||||||||||||||||||||||||||||||||||||||
a591        LGGYVKMVDTREGEVSEADLPYAFDKQHPAKRIAIVAAGPLTNLALAVLLYGLSFSFGVT
                    70        80        90       100       110       120

                   130       140       150       160       170       180
m591.pep    ELRPYVGTVEPDTIAARAGFQSGDKIQSVNGTPVADWGSAQTEIVLNLEAGKVAVGVQTA
            ||||||||||||||||||||||||||||||||||||||||||||||||||||||||||||
a591        ELRPYVGTVEPDTIAARAGFQSGDKIQSVNGTPVADWGSAQTEIVLNLEAGKVAVGVQTA
                   130       140       150       160       170       180

                   190       200       210       220       230       240
m591.pep    SGAQTVRTIDAAGTPEAGKIAKNQGYIGLMPFKITTVAGGVEKGSPAEKAGLKPGDRLTA
            ||||||||||||||||||||||||||||||||||||||||||||||||||||||||||||
a591        SGAQTVRTIDAAGTPEAGKIAKNQGYIGLMPFKITTVAGGVEKGSPAEKAGLKPGDRLTA
                   190       200       210       220       230       240

                   250       260       270       280       290       300
m591.pep    ADGKPIASWQEWANLTRQSPGKKITLNYERAGQTHTADIRPDTVEQSDHTLIGRVGLRPQ
            ||||||||||||||||||||||||||:|||||||||||||||||||| ||||||||||||
a591        ADGKPIASWQEWANLTRQSPGKKITLTYERAGQTHTADIRPDTVEQPDHTLIGRVGLRPQ
                   250       260       270       280       290       300

                   310       320       330       340       350       360
m591.pep    PDRAWDAQIRRSYRPSVVRAFGMGWEKTVSHSWTTLKFFGKLISGNASVSHISGPLTIAD
            ||||||||||||||||||||||||||||||||||||||||||||||||||||||||||||
a591        PDRAWDAQIRRSYRPSVVRAFGMGWEKTVSHSWTTLKFFGKLISGNASVSHISGPLTIAD
                   310       320       330       340       350       360

                   370       380       390       400       410       420
m591.pep    IAGQSAELGLQSYLEFLALVSISLGVLNLLPVPVLDGGHLVFYTAEWIRGKPLGERVQNI
            ||||||||||||||||||||||||||||||||||||||||||||||||||||||||||||
a591        IAGQSAELGLQSYLEFLALVSISLGVLNLLPVPVLDGGHLVFYTAEWIRGKPLGERVQNI
                   370       380       390       400       410       420
```

-continued

```
               430       440
m591.pep   GLRFGLALMMLMMAVAFFNDVTRLLGX
           ||||||||||||||||||||||||||||
a591       GLRFGLALMMLMMAVAFFNDVTRLLGX
               430       440
```

The following partial DNA sequence was identified in *N. gonorrhoeae* <SEQ ID 1847>:

```
g592.seq..
  1 atgattccgg acgtgttcgg tcagattttt tcgggcgcgt tcaaattcga

 51 cgcggcagca ggcggcttac tcggcggtct gatttcgcaa acgatgatga

101 tgggcatcaa acgcggcctg tattccaacg aggcgggtat gggttccgcg

151 ccgaacgccg ccgccgccgc cgaagtgaaa caccctgttt cgcaaggtat

201 gattcaaatg ctgggcgtgt ttgtcgatac catcatcgtt tgttcttgca

251 ccgccttcat catcttgatt taccaacagc cttatggcga tttgagcggt

301 gcggcgctga cgcaggcggc gattgtcagc caagtggggc aatggggcgc

351 gggtttcctc gccgtcatcc tgtttatgtt tgccttttcc accgttatcg

401 gcaactatgc ctatgccgag tccaacgtcc aattcatcaa aagccattgg

451 ctgattaccg ccgttttccg tatgctggtt ttggcgtggg tctatttcgg

501 cgcggttgcc aatgtgcctt tggtctggga tatggcggat atggcgatgg

551 gcatcatggc gtggatcaac ctcgtcgcca tcctgctgct ctcgccattg

601 gcgtttatgc tgctgcgcga ttacaccgcc aagctgaaaa tgggcaaaga

651 ccccgagttc aaactttccg aacatccggg cctgaaacgc cgcatcaaat

701 ccgatgtttg gtaa
```

This corresponds to the amino acid sequence <SEQ ID 1848; ORF 592.ng>:

```
g592.pep ..
  1 MIPDVFGQIF SGAFKFDAAA GGLLGGLISQ TMMMGIKRGL YSNEAGMGSA

 51 PNAAAAAEVK HPVSQGMIQM LGVFVDTIIV CSCTAFIILI YQQPYGDLSG

101 AALTQAAIVS QVGQWGAGFL AVILFMFAFS TVIGNYAYAE SNVQFIKSHW

151 LITAVFRMLV LAWVYFGAVA NVPLVWDMAD MAMGIMAWIN LVAILLLSPL

201 AFMLLRDYTA KLKMGKDPEF KLSEHPGLKR RIKSDVW*
```

The following partial DNA sequence was identified in *N. meningitidis* <SEQ ID 1849>:

```
m592.seq ..
  1 ATGATTCCGG ACGTGTTCGG TCAGATTTTT TCGGGCGCGT TCAAATTCGA

 51 CGCGGCAGCA GGCGGCTTAC TCGGCGGTCT GATTTCGCAA ACGATGATGA

101 TGGGCATCAA ACGCGGCCTG TATTCCAACG AGGCGGGTAT GGGTTCCGCG

151 CCGAACGCCG CCGCCGCCGC CGAAGTGAAA CACCCTGTTT CGCAAGGTAT

201 GATTCAAATG CTGGGCGTGT TTGTCGATAC CATCATCGTT TGTTCTTGCA

251 CCGCCTTCAT CATCTTGATT TACCAACAGC CTTACGGCGA TTTGAGCGGT

301 GCGGCGCTGA CGCAGGCGGC GATTGTCAGC CAAGTGGGGC AATGGGGCGC

351 GGGCTTCCTC GCCGTCATCC TGTTTATGTT TGCCTTTTCC ACCGTTATCG
```

```
401 GCAACTATGC CTATGCCGAG TCCAACGTCC AATTCATCAA AAGCCATTGG

451 CTGATTACCG CCGTTTTCCG TATGCTGGTT TTGGCGTGGG TCTATTTCGG

501 CGCGGTTGCC AATGTGCCTT TGGTCTGGGA TATGGCGGAT ATGGCGATGG

551 GCATTATGGC GTGGATCAAC CTTGTCGCCA TCCTGCTGCT CTCGCCCTTG

601 GCGTTTATGC TGCTGCGCGA TTACACCGCC AAGCTGAAAA TGGGCAAAGA

651 CCCCGAGTTC AAACTTTCCG AACATCCGGG CCTGAAACGC CGTATCAAAT

701 CCGACGTTTG GTAA
```

This corresponds to the amino acid sequence <SEQ ID 1850; ORF 592>:

```
m592.pep..
         1  MIPDVFGQIF SGAFKFDAAA GGLLGGLISQ TMMMGIKRGL YSNEAGMGSA
        51  PNAAAAAEVK HPVSQGMIQM LGVFVDTIIV CSCTAFIILI YQQPYGDLSG
       101  AALTQAAIVS QVGWQGAGFL AVILFMFAFS TVIGNYAYAE SNVQFIKSHW
       151  LITAVFRMLV LAWVYFGAVA NVPLVWDMAD MAMGIMAWIN LVAILLLSPL
       201  AFMLLRDYTA KLKMGKDPEF KLSEHPGLKR RIKSDVW*

m592/g592    100.0% identity in 237 aa overlap

                    10         20         30         40         50         60
    m592.pep   MIPDVFGQIFSGAFKFDAAAGGLLGGLISQTMMMGIKRGLYSNEAGMGSAPNAAAAAEVK
               ||||||||||||||||||||||||||||||||||||||||||||||||||||||||||||
        g592   MIPDVFGQIFSGAFKFDAAAGGLLGGLISQTMMMGIKRGLYSNEAGMGSAPNAAAAAEVK
                    10         20         30         40         50         60

                    70         80         90        100        110        120
    m592.pep   HPVSQGMIQMLGVFVDTIIVCSCTAFIILIYQQPYGDLSGAALTQAAIVSQVGQWGAGFL
               ||||||||||||||||||||||||||||||||||||||||||||||||||||||||||||
        g592   HPVSQGMIQMLGVFVDTIIVCSCTAFIILIYQQPYGDLSGAALTQAAIVSQVGQWGAGFL
                    70         80         90        100        110        120

                   130        140        150        160        170        180
    m592.pep   AVILFMFAFSTVIGNYAYAESNVQFIKSHWLITAVFRMLVLAWVYFGAVANVPLVWDMAD
               ||||||||||||||||||||||||||||||||||||||||||||||||||||||||||||
        g592   AVILFMFAFSTVIGNYAYAESNVQFIKSHWLITAVFRMLVLAWVYFGAVANVPLVWDMAD
                   130        140        150        160        170        180

                   190        200        210        220        230
    m592.pep   MAMGIMAWINLVAILLLSPLAFMLLRDYTAKLKMGKDPEFKLSEHPGLKRRIKSDVWX
               |||||||||||||||||||||||||||||||||||||||||||||||||||||||||
        g592   MAMGIMAWINLVAILLLSPLAFMLLRDYTAKLKMGKDPEFKLSEHPGLKRRIKSDVWX
                   190        200        210        220        230
```

The following partial DNA sequence was identified in *N. meningitides* <SEQ ID 1851>:

```
a592.seq
   1 ATGATTCCGG ACGTGTTCGG TCAGATTTTT TCGGGCGCGT TCAAATTCGA

  51 CGCGGCAGCA GGCGGCTTAC TCGGCGGTCT GATTTCGCAA ACGATGATGA

 101 TGGGCATCAA ACGCGGCCTG TATTCCAACG AGGCGGGTAT GGGTTCCGCG

 151 CCGAACGCCG CCGCCGCCGC CGAAGTGAAA CACCCTGTTT CGCAAGGTAT

 201 GATTCAAATG CTGGGCGTGT TTGTCGATAC CATCATCGTT TGTTCTTGCA

 251 CCGCCTTCAT CATCTTGATT TACCAACAGC CTTACGGCGA TTTGAGCGGT

 301 GCGGCGCTGA CGCAGGCGGC GATTGTCAGC CAAGTGGGGC AATGGGGCGC

 351 GGGCTTCCTC GCCGTCATCC TGTTTATGTT TGCCTTTTCC ACCGTTATCG

 401 GCAACTATGC CTATGCCGAG TCCAACGTCC AATTCATCAA AAGCCATTGG

 451 CTGATTACCG CCGTTTTCCG TATGCTGGTT TTGGCGTGGG TCTATTTCGG
```

-continued

```
501 CGCGGTTGCC AATGTGCCTT TGGTCTGGGA TATGGCGGAT ATGGCGATGG

551 GCATTATGGC GTGGATCAAC CTTGTCGCCA TCCTGCTGCT CTCGCCCTTG

601 GCGTTTATGC TGCTGCGCGA TTACACCGCC AAGCTGAAAA TGGGCAAAGA

651 CCCCGAGTTC AAACTTTCCG AACATCCGGG CCTGAAACGC CGTATCAAAT

701 CCGACGTTTG GTAA
```

This corresponds to the amino acid sequence <SEQ ID 1852; ORF 592.a>:

```
a592.pep

  1 MIPDVFGQIF SGAFKFDAAA GGLLGGLISQ TMMMGIKRGL YSNEAGMGSA

 51 PNAAAAAEVK HPVSQGMIQM LGVFVDTIIV CSCTAFIILI YQQPYGDLSG

101 AALTQAAIVS QVGQWGAGFL AVILFMFAFS TVIGNYAYAE SNVQFIKSHW

151 LITAVFRMLV LAWVYFGAVA NVPLVWDMAD MAMGIMAWIN LVAILLLSPL

201 AFMLLRDYTA KLKMGKDPEF KLSEHPGLKR RIKSDVW*

m592/a592  100.0% identity in 237 aa overlap

                   10        20        30        40        50        60
m592.pep    MIPDVFGQIFSGAFKFDAAAGGLLGGLISQTMMMGIKRGLYSNEAGMGSAPNAAAAAEVK
            ||||||||||||||||||||||||||||||||||||||||||||||||||||||||||||
a592        MIPDVFGQIFSGAFKFDAAAGGLLGGLISQTMMMGIKRGLYSNEAGMGSAPNAAAAAEVK
                   10        20        30        40        50        60

                   70        80        90       100       110       120
m592.pep    HPVSQGMIQMLGVFVDTIIVCSCTAFIILIYQQPYGDLSGAALTQAAIVSQVGQWGAGFL
            ||||||||||||||||||||||||||||||||||||||||||||||||||||||||||||
a592        HPVSQGMIQMLGVFVDTIIVCSCTAFIILIYQQPYGDLSGAALTQAAIVSQVGQWGAGFL
                   70        80        90       100       110       120

                  130       140       150       160       170       180
m592.pep    AVILFMFAFSTVIGNYAYAESNVQFIKSHWLITAVFRMLVLAWVYFGAVANVPLVWDMAD
            ||||||||||||||||||||||||||||||||||||||||||||||||||||||||||||
a592        AVILFMFAFSTVIGNYAYAESNVQFIKSHWLITAVFRMLVLAWVYFGAVANVPLVWDMAD
                  130       140       150       160       170       180

                  190       200       210       220       230
m592.pep    MAMGIMAWINLVAILLLSPLAFMLLRDYTAKLKMGKDPEFKLSEHPGLKRRIKSDVWX
            ||||||||||||||||||||||||||||||||||||||||||||||||||||||||||
a592        MAMGIMAWINLVAILLLSPLAFMLLRDYTAKLKMGKDPEFKLSEHPGLKRRIKSDVWX
                  190       200       210       220       230
```

The following partial DNA sequence was identified in *N. gonorrhoeae* <SEQ ID 1853>:

```
g593.seq..
  1 atgcttgaac tgaacggact ctgcaaatgc ttcggcggca aaacggtcgc

 51 cgacaacatc tgcctgactg tcgggcgcgg caaaatactc gccgtactgg

101 ggcggtcggg ctgcggcaaa tccaccctgc tgaatatgat tgcgggcatc

151 gtccggccgg acggcggcga aattcggctg aacggggaaa acattacctg

201 tatgccgccc gaaaaacgcc gtatctcgct gatgtttcaa gattacgcgc

251 tgtttcccca tatgagtgcg ctggaaaata cggcattcgg tttgaaaatg

301 caaaaaaatgc cgaaagccga agccgaacgc ctcgccttgt cggcacttgc

351 cgaagtcggg ctggaaaacg aggcgcaccg caagcctgaa aaactttccg

401 gaggcgagaa gcaacggttg gcactggcgc gcgctttggt tgtccgccct

451 tccctgctgt tgctggatga atcgttttcc agtttggaca cgcatttgcg

501 cgaccggctg cgccgtatga ccgccgaacg catccgcaag ggcggcatcc

551 ctgccgtttt ggtaacgcat tcgcccgaag aggcctgcac ggcggcggac
```

-continued

```
601 gaaatcgccg tcatgcacga ggggaaaatc cttcaatgcg gtacgcccga

651 aaccttgatt caaacgcctg ccggcgtgca ggtcgcccgt ctgatggggc

701 tgcccaatac cgacgatgac cgccatattc cgcaaaatgc cgtgtgcttg

751 gacaatcatg gaacggaatg ccgtctgctg tccctcgtcc gcctgcccga

801 ctcgctccgg ctttccgccg tccatcccga acacggcgag ctgaccttaa

851 acctgactgt cggacaacat acggacggta tttccggaaa cggtacggtc

901 cgcatccgcg tcgatgaagg gcgtatcgtc cgtttccgat ga
```

This corresponds to the amino acid sequence <SEQ ID 1854; ORF 593.ng>:

```
g593.pep..
  1 MLELNGLCKC FGGKTVADNI CLTVGRGKIL AVLGRSGCGK STLLNMIAGI

 51 VRPDGGEIRL NGENITCMPP EKRRISLMFQ DYALFPHMSA LENTAFGLKM

101 QKMPKAEAER LALSALAEVG LENEAHRKPE KLSGGEKQRL ALARALVVRP

151 SLLLLDESFS SLDTHLRDRL RRMTAERIRK GGIPAVLVTH SPEEACTAAD

201 EIAVMHEGKI LQCGTPETLI QTPAGVQVAR LMGLPNTDDD RHIPQNAVCL

251 DNHGTECRLL SLVRLPDSLR LSAVHPEHGE LTLNLTVGQH TDGISGNGTV

301 RIRVDEGRIV RFR*
```

The following partial DNA sequence was identified in *N. meningitidis* <SEQ ID 1855>:

```
m593.seq
  1 ATGCTTGAAC TGAACGGACT CTGCAAACGC TTCGGCAATA AAACCGTCGC

 51 CGACAACATC TGCCTGACTG TCGGGCGCGG CAAAATACTC GCCGTTTTGG

101 GGCGGTCGGG CTGCGGAAAA TCCACCCTGC TGAATATAAT TGCGGGGATT

151 GTCCGGCCGG ACGGCGGGGA AATATGGCTG AACGGAGAAA ACATTACCCG

201 TATGCCGCCC GAAAAACGCC GTATCTCGCT GATGTTTCAA GATTACGCGC

251 TGTTTCCCCA TATGAGTGCG CTGGAAAATG CGGCATTCGG TTTGAAAATG

301 CAAAAAATGC CGAAAGCCGA AGCCGAACGC CTCGCCATGG CGGCACTTGC

351 CGAAGTCGGA CTGGAAAACG AGGCGCACCG CAAGCCTGAA AAACTTTCCG

401 GAGGCGAGAA GCAACGGCTG GCGTTGGCGC GCGCTTTGGT TGTCCGCCCT

451 TCCCTGCTGC TGTTGGACGA ATCGTTTTCC AGTTTGGACA CGCATTTGCG

501 CGGCACGCTG CGCCGTATGA CTGCCGAACG TATCCGAAAC GGCGGCATCC

551 CTGCCGTTTT GGTAACGCAT TCGCCCGAAG AAGCCTGTAC GACGGCAGAC

601 GAAATCGCCG TGATGCATAA AGGGAGGATT CTACAATACG GTACGCCCGA

651 AACATTGGTC AAAACACCAT CCTGCGTGCA GGTCGCCCGA CTGATGGGTT

701 TGCCCAATAC CGACGATAAC CGCCATATTC CGCAACATGC GGTGCGTTTC

751 GACCAAGACG GCATGGAGTG CCGCGTATTA TCCCGTACCT GTTTGCCCGA

801 ATCGTTCAGC CTGTCCGTCC TCCATCCGGA ACACGGCATC CTGTGGCTGA

851 ACCTCGATAT GCGGCACGCC GGGGCGGTAT CGGGCAAGGA TACGGTACGC

901 ATCCATATCG AAGAACGGGA AATCGTCCGC TTCCGCTGA
```

This corresponds to the amino acid sequence <SEQ ID 1856; ORF 593>:

```
m593.pep ..
    1 MLELNGLCKR FGNKTVADNI CLTVGRGKIL AVLGRSGCGK STLLNIIAGI

   51 VRPDGGEIWL NGENITRMPP EKRRISLMFQ DYALFPHMSA LENAAFGLKM

  101 QKMPKAEAER LAMAALAEVG LENEAHRKPE KLSGGEKQRL ALARALVVRP

  151 SLLLLDESFS SLDTHLRGTL RRMTAERIRN GGIPAVLVTH SPEEACTTAD

  201 EIAVMHKGRI LQYGTPETLV KTPSCVQVAR LMGLPNTDDN RHIPQHAVRF

  251 DQDGMECRVL SRTCLPESFS LSVLHPEHGI LWLNLDMRHA GAVSGKDTVR

  301 IHIEEREIVR FR*
```

Computer analysis of this amino acid sequence gave the following results:
Homology with a Predicted ORF from *N. gonorrhoeae*

```
m593/g593   83.4% identity in 313 aa overlap

                        10        20        30        40        50        60
m593.pep        MLELNGLCKRFGNKTVADNICLTVGRGKILAVLGRSGCGKSTLLNIIAGIVRPDGGEIWL
                ||||||||| ||:||||||||||||||||||||||||||||||||:|||||||||||| |
g593            MLELNGLCKCFGGKTVADNICLTVGRGKILAVLGRSGCGKSTLLNMIAGIVRPDGGEIRL
                        10        20        30        40        50        60

                        70        80        90       100       110       120
m593.pep        NGENITRMPPEKRRISLMFQDYALFPHMSALENAAFGLKMQKMPKAEAERLAMAALAEVG
                |||||| ||||||||||||||||||||||||||:||||||||||||||||||::||||||
g593            NGENITCMPPEKRRISLMFQDYALFPHMSALENTAFGLKMQKMPKAEAERLALSALAEVG
                        70        80        90       100       110       120

                       130       140       150       160       170       180
m593.pep        LENEAHRKPEKLSGGEKQRLALARALVVRPSLLLLDESFSSLDTHLRGTLRRMTAERIRN
                ||||||||||||||||||||||||||||||||||||||||||||||  |||||||||||:
g593            LENEAHRKPEKLSGGEKQRLALARALVVRPSLLLLDESFSSLDTHLRDRLRRMTAERIRK
                       130       140       150       160       170       180

                       190       200       210       220       230       240
m593.pep        GGIPAVLVTHSPEEACTTADEIAVMHKGRILQYGTPETLVKTPSCVQVARLMGLPNTDDN
                |||||||||||||||||:||||||||:|:||| ||||||::||: ||||||||||||||:
g593            GGIPAVLVTHSPEEACTAADEIAVMHEGKILQCGTPETLIQTPAGVQVARLMGLPNTDDD
                       190       200       210       220       230       240

                       250       260       270       280        290      299
m593.pep        RHIPQHAVRFDQDGMECRVLSRTCLPESFSLSVLHPEHGILWLNLDM-RHAGAVSGKDTV
                |||||:|| :|: | |||:|| : ||:|: ||::||||| | ||| : :|: ::||: ||
g593            RHIPQNAVCLDNHGTECRLLSLVRLPDSLRLSAVHPEHGELTLNLTVGQHTDGISGNGTV
                       250       260       270       280       290       300

             300       310
m593.pep        RIHIEEREIVRFRX
                ||:::| :||||||
g593            RIRVDEGRIVRFRX
                       310
```

The following partial DNA sequence was identified in *N. meningitidis* <SEQ ID 1857>:

```
a593.seq
    1 ATGCTTGAAC TGAACGGACT CTGCAAACGC TTCGGCGGCA AAACGGTTGC

   51 CGACGATATC TGCCTGACTG TCGGGCGCGG CAAAATACTC GCCGTTTTGG

  101 GGCGGTCGGG CTGCGGCAAA TCCACCCTGC TGAATATGAT TGCGGGCATC

  151 GTCCGGCCGG ACGGCGGGGA AATATGGCTG AATGGGGAAA ACATTACCCG

  201 TATGCCGCCC GAAAAACGCC GTATTTCGCT GATGTTTCAA GATTACGCGC

  251 TGTTTCCCCA TATGAGTGCA CTGGAAAATG CGGCATTCGG TTTGAAAATG

  301 CAAAAAATGC CGAAAGCCGA AGCCGAAAGC CTCGCCATGG CGGCACTTGC

  351 CGAAGTCGGA CTGGAAAACG AGGCGCACCG CAAGCCTGAN AAACTTTCCG
```

-continued

```
401 GAGGCGAAAA GCAACGGTTG GCACTGGCGC GCGCTTTGGT TGTCCGCCCT

451 TCCCTGCTGC TGTTGGACGA ATCGTTTTCC AGTTTGGACA CGCATTTGCG

501 CGACCGGCTG CGCCGCATGA CTGCCGAACG TATCCGCAAG GGCGGCATCC

551 CTGCCGTTTT GGTAACGCAT TCGCCCGAAG AGGCCTGCAC GGCGGCAGAC

601 GAAATCGCCG TCATGCACGA GGGGAAAATC CTTCAATGCG GTACGCCCGA

651 AACCTTGGTT CAAACGCCTG CCGGCGTGCA GGTCGCCCAT CTGATGGGGC

701 TGCCCAATAC CGACGATGAC CGCCATATTC CGCAACATGC GGTGCGTTTC

751 GACCAAGACG GCATGGAGTG CCGCGTATTA TCCCGTACCT GTTTGCCCGA

801 ATCGTTCAGC CTGTCCGTCC TCCATCCGGA ACACGGCATC CTGTGGCTGA

851 ACCTCGATAT GCCGCACGCC GGTGAAATAT CGGGAAACGA TACGGTACGC

901 ATCCATATCG AAGACAGGGA AATCGTCCGC TTCCGCTGA
```

This corresponds to the amino acid sequence <SEQ ID 1858; ORF 593.a>:

```
a593.pep

      1 MLELNGLCKR FGGKTVADDI CLTVGRGKIL AVLGRSGCGK STLLNMIAGI

     51 VRPDGGEIWL NGENITRMPP EKRRISLMFQ DYALFPHMSA LENAAFGLKM

    101 QKMPKAEAES LAMAALAEVG LENEAHRKPX KLSGGEKQRL ALARALVVRP

    151 SLLLLDESFS SLDTHLRDRL RRMTAERIRK GGIPAVLVTH SPEEACTAAD

    201 EIAVMHEGKI LQCGTPETLV QTPAGVQVAH LMGLPNTDDD RHIPQHAVRF

    251 DQDGMECRVL SRTCLPESFS LSVLHPEHGI LWLNLDMPHA GEISGNDTVR

    301 IHIEDREIVR FR*

m593/a593 92.9% identity in 312 aa overlap

                   10        20        30        40        50        60
m593.pep   MLELNGLCKRFGNKTVADNICLTVGRGKILAVLGRSGCGKSTLLNIIAGIVRPDGGEIWL
           |||||||||||:||||||:|||||||||||||||||||||||||||:|||||||||||||
a593       MLELNGLCKRFGGKTVADDICLTVGRGKILAVLGRSGCGKSTLLNMIAGIVRPDGGEIWL
                   10        20        30        40        50        60

                   70        80        90       100       110       120
m593.pep   NGENITRMPPEKRRISLMFQDYALFPHMSALENAAFGLKMQKMPKAEAERLAMAALAEVG
           ||||||||||||||||||||||||||||||||||||||||||||||||| ||||||||||
a593       NGENITRMPPEKRRISLMFQDYALFPHMSALENAAFGLKMQKMPKAEAESLAMAALAEVG
                   70        80        90       100       110       120

                  130       140       150       160       170       180
m593.pep   LENEAHRKPEKLSGGEKQRLALARALVVRPSLLLLDESFSSLDTHLRGTLRRMTAERIRN
           ||||||||| ||||||||||||||||||||||||||||||||||||||  |||||||||:
a593       LENEAHRKPXKLSGGEKQRLALARALVVRPSLLLLDESFSSLDTHLRDRLRRMTAERIRK
                  130       140       150       160       170       180

                  190       200       210       220       230       240
m593.pep   GGIPAVLVTHSPEEACTTADEIAVMHKGRILQYGTPETLVKTPSCVQVARLMGLPNTDDN
           |||||||||||||||||:||||||||:|:||| |||||||:||: ||||:|||||||||:
a593       GGIPAVLVTHSPEEACTAADEIAVMHEGKILQCGTPETLVQTPAGVQVAHLMGLPNTDDD
                  190       200       210       220       230       240

                  250       260       270       280       290       300
m593.pep   RHIPQHAVRFDQDGMECRVLSRTCLPESFSLSVLHPEHGILWLNLDMRHAGAVSGKDTVR
           ||||||||||||||||||||||||||||||||||||||||||||||| ||| :||:||||
a593       RHIPQHAVRFDQDGMECRVLSRTCLPESFSLSVLHPEHGILWLNLDMPHAGEISGNDTVR
                  250       260       270       280       290       300

                  310
m593.pep   IHIEEREIVRFRX
           ||||:||||||||
a593       IHIEDREIVRFRX
                  310
```

The following partial DNA sequence was identified in *N. gonorrhoeae* <SEQ ID 1859>:

```
g594.seq..
   1 atgggtgcag ataccgatgg cgacaaggat gttcggctta atcgaacggg

  51 tctcgttttt agcatactcc ggctgctgtt ccgcatcgga attgggatcg

 101 gtaagttcgc cgttcaggcc tttcaggtct ttaagctgct gatctgtacg

 151 gttgagcacc caaatcggtt tgccttgcca ctcggcggtc agcagctgac

 201 ccgcttcgat tttactgaca tccacctcga cggcagcacc ggaggccttg

 251 gctttttccg aagggaaaaa actggccaca aacggcgttg ccacacccaa

 301 tgctgccact ccgcccgcgc cgcaggtcgc aagtgtcagg aaacggcggc

 351 ggccgttgtt gatttcttga ttatccatta ttcagtcgtc ctaatatttt

 401 gggaatgccg agccattaaa cattgcaatt ttacccagtt tgcagtgata

 451 ctcaaagcat tatttaaaat aaggtaa
```

This corresponds to the amino acid sequence <SEQ ID 1860; ORF 594.ng>:

```
g594.pep
   1 MGADTDGDKD VRLNRTGLVF SILRLLFRIG IGIGKFAVQA FQVFKLLICT

  51 VEHPNRFALP LGGQQLTRFD FTDIHLDGST GGLGFFRREK TGHKRRCHTQ

 101 CCHSARAAGR KCQETAAAVV DFLIIHYSVV LIFWECRAIK HCNFTQFAVI

 151 LKALFKIR*
```

The following partial DNA sequence was identified in *N. meningitidis* <SEQ ID 1861>:

```
m594.seq
   1 ATGGGTGCAG ATACCGATGG CGACAAGGAT GTTCGGCTTA ATCGAACGGG

  51 TCTCGTTTTT AGCATACTCC GGCTGCTGTT CCGCATCGGA ATTGGGATCG

 101 GTAAGTTCGC CGTTCAGGCC TTTCAGGTCT TTAAGCTGCT GATCTGTACG

 151 GTTGAGCACC CAAATCGGTT TGCCTTGCCA CTCGGCGGTC AGCAGCTGAC

 201 CCGCTTCGAT TTTACTGACA TCCACCTCGA CGGCAGCACC GGCGGCCTTG

 251 GCTTTTTCCG AAGGGAAAAA ACTGGCCACA AACGGCGTTG CCACACCCAA

 301 TGCTGCCACT CCGCCCGCGC CGCAGGTCGC GAGTGTCAGG AAACGGCGGC

 351 GGCCGTTGTT GATTTCTTGA TTATCCATTA TTCAGTCGTC CTAATATTTT

 401 GGGAATACCG AGCCATTAAA CGTTGCAATT TTACCCAGTT TGCAGTGATA

 451 CTCAAAGCAT TATTTAAAAT AAGGTAA
```

This corresponds to the amino acid sequence <SEQ ID 1862; ORF 594>:

```
m594.pep
   1 MGADTDGDKD VRLNRTGLVF SILRLLFRIG IGIGKFAVQA FQVFKLLICT

  51 VEHPNRFALP LGGQQLTRFD FTDIHLDGST GGLGFFRREK TGHKRRCHTQ

 101 CCHSARAAGR ECQETAAAVV DFLIIHYSVV LIFWEYRAIK RCNFTQFAVI

 151 LKALFKIR*
```

Computer analysis of this amino acid sequence gave the following results:

Homology with a Predicted ORF from *N. gonorrhoeae*

```
m594/g594    98.1% identity in 158 aa overlap

                      10        20        30        40        50        60
m594.pep     MGADTDGDKDVRLNRTGLVFSILRLLFRIGIGIGKFAVQAFQVFKLLICTVEHPNRFALP
             ||||||||||||||||||||||||||||||||||||||||||||||||||||||||||||
g594         MGADTDGDKDVRLNRTGLVFSILRLLFRIGIGIGKFAVQAFQVFKLLICTVEHPNRFALP
                      10        20        30        40        50        60

                      70        80        90       100       110       120
m594.pep     LGGQQLTRFDFTDIHLDGSTGGLGFFRREKTGHKRRCHTQCCHSARAAGRECQETAAAVV
             |||||||||||||||||||||||||||||||||||||||||||||||||||:||||||||
g594         LGGQQLTRFDFTDIHLDGSTGGLGFFRREKTGHKRRCHTQCCHSARAAGRKCQETAAAVV
                      70        80        90       100       110       120

                     130       140       150       159
m594.pep     DFLIIHYSVVLIFWEYRAIKRCNFTQFAVILKALFKIRX
             |||||||||||||| ||||:|||||||||||||||||||
g594         DFLIIHYSVVLIFWECRAIKHCNFTQFAVILKALFKIRX
                     130       140       150
```

The following partial DNA sequence was identified in *N. meningitidis* <SEQ ID 1863>:

```
a594.seq
   1 ATGGGTGCAG ATACCGATGG CGACAAGGAT GTTCGGCTTA ATCGAACGGG

  51 TCTCGTTTTT AGCATACTCC GGCTGCTGTT CCGCATCGGA ATTGGGATCG

 101 GTAAGTTCGC CGTTCAGGCC TTTCAGGTCT TTAAGCTGCT GATCTGTACG

 151 GTTGAGCACC CAAATCGGTT TGCCTTGCCA CTCGGCGGTC AGCAACTGAC

 201 CCGCTTCGAT TTTACTGACA TCCACCTCGA CGGCAGCACC GGCGGCCTTG

 251 GCTTTTTCCG AAGGGAAAAA ACTGGCCACA AACGGCGTTG CCACACCCAA

 301 TGCTGCCACT CCGCCCGCGC CGCAGGTCGC GAGTGTCAGG AAACGGCGGC

 351 GGCCGTTGTT GATTTCTTGA TTATCCATTA TTCAGTCGTC CTAATATTTT

 401 GGGAATACCG AGCCATTAAA CGTTGCAATT TTACCCAGTT TGCAGTGATA

 451 CTCAAAGCAT TATTTAAAAT AAGGTAA
```

This corresponds to the amino acid sequence <SEQ ID 1864; ORF 594.a>:

```
a594.pep

      1 MGADTDGDKD VRLNRTGLVF SILRLLFRIG IGIGKFAVQA FQVFKLLICT

     51 VEHPNRFALP LGGQQLTRFD FTDIHLDGST GGLGFFRREK TGHKRRCHTQ

    101 CCHSARAAGR ECQETAAAVV DFLIIHYSVV LIFWEYRAIK RCNFTQFAVI

    151 LKALFKIR*

m594/a594  100.0% identity in 158 aa overlap

                   10        20        30        40        50        60
m594.pep   MGADTDGDKDVRLNRTGLVFSILRLLFRIGIGIGKFAVQAFQVFKLLICTVEHPNRFALP
           ||||||||||||||||||||||||||||||||||||||||||||||||||||||||||||
a594       MGADTDGDKDVRLNRTGLVFSILRLLFRIGIGIGKFAVQAFQVFKLLICTVEHPNRFALP
                   10        20        30        40        50        60

                   70        80        90       100       110       120
m594.pep   LGGQQLTRFDFTDIHLDGSTGGLGFFRREKTGHKRRCHTQCCHSARAAGRECQETAAAVV
           ||||||||||||||||||||||||||||||||||||||||||||||||||||||||||||
a594       LGGQQLTRFDFTDIHLDGSTGGLGFFRREKTGHKRRCHTQCCHSARAAGRECQETAAAVV
                   70        80        90       100       110       120
```

```
                        130        140        150    159
m594.pep     DFLIIHYSVVLIFWEYRAIKRCNFTQFAVILKALFKIRX
             ||||||||||||||||||||||||||||||||||||||
a594         DFLIIHYSVVLIFWEYRAIKRCNFTQFAVILKALFKIRX
                        130        140        150
```

The following partial DNA sequence was identified in *N. gonorrhoeae* <SEQ ID 1865>:

```
g595.seq..
   1 atgagaaaat tcaatttgac cgcattgtcc gtgatgcttg ccttgggttt
  51 gaccgcgtgc cagccgccgg aggcggagaa agccgcgccg gccgcgtccg
 101 gtgagaccca atccgccaac gaaggcggtt cggtcggtat cgccgtcaac
 151 gacaatgcct gcgaaccgat gaatctgacc gtgccgagcg gacaggttgt
 201 gttcaatatt aaaaacaaca gcggccgcaa gctcgaatgg gaaatcctga
 251 agggcgtgat ggtggtggac gaacgcgaaa atatcgcccc ggggctttcc
 301 gacaaaatga accgtaacct gctgccgggc gaatacgaaa tgacctgcgg
 351 ccttttgacc aatccgcgcg gcaagctggt ggtagccgac agcggcttta
 401 aagacaccgc caacgaagcg gatttggaaa aactgccca accgctcgcc
 451 gactataaag cctacgttca aggcgaggtt aaagagctgg cggcgaaaac
 501 caaaaccttt accgaagccg tcaaagcagg cgacattgaa aaggcgaaat
 551 ccctgtttgc cgccacccgc gtccattacg aacgcatcga accgattgcc
 601 gagcttttca gcgaactcga ccccgtcatc gatgcgtgtg aagacgactt
 651 caaagacggt gcgaaagatg ccgggtttac cggcttccac cgtatcgaac
 701 acgccctttg ggtggaaaaa gacgtatccg gcgtgaagga aaccgcggcc
 751 aaactgatga ccgatgtcga agccctgcaa aaagaaatcg acgcattggc
 801 gttccctccg ggcaaagtgg tcggcggcgc gtccgaactg attgaagaag
 851 cggcgggcag taaaatcagc ggcgaagaag accgttacag ccacaccgat
 901 ttgagcgact tccaagctaa tgcggacgga tctaaaaaaa tcgtcgattt
 951 gttccgtccg ttgattgagg ccaaaaacaa agccttgttg gaaaaaaccg
1001 ataccaactt caaacaggtc aacgaaattc tggcgaaata ccgcaccaaa
1051 gacggttttg aaacctacga caagctgagc gaagccgacc gcaaagcatt
1101 acaggctcct attaacgcgc ttgccgaaga ccttgcccaa cttcgcggca
1151 tactcggctt gaaataa
```

This corresponds to the amino acid sequence <SEQ ID 1866; ORF 595.ng>:

```
g595.pep ..
   1 MRKFNLTALS VMLALGLTAC QPPEAEKAAP AASGETQSAN EGGSVGIAVN
  51 DNACEPMNLT VPSGQVVFNI KNNSGRKLEW EILKGVMVVD ERENIAPGLS
 101 DKMNRNLLPG EYEMTCGLLT NPRGKLVVAD SGFKDTANEA DLEKLPQPLA
 151 DYKAYVQGEV KELAAKTKTF TEAVKAGDIE KAKSLFAATR VHYERIEPIA
 201 ELFSELDPVI DACEDDFKDG AKDAGFTGFH RIEHALWVEK DVSGVKETAA
 251 KLMTDVEALQ KEIDALAFPP GKVVGGASEL IEEAAGSKIS GEEDRYSHTD
```

-continued

```
301 LSDFQANADG SKKIVDLFRP LIEAKNKALL EKTDTNFKQV NEILAKYRTK

351 DGFETYDKLS EADRKALQAP INALAEDLAQ LRGILGLK*
```

The following partial DNA sequence was identified in *N. meningitidis* <SEQ ID 1867>:

```
m595.seq
     1 ATGAGAAAAT TCAATTTGAC CGCATTGTCC GTGATGCTTG CCTTAGGTTT

    51 GACCGCGTGC CAGCCGCCGG AGGCGGAGAA AGCTGCGCCG GCAGCGTCCG

   101 GTGAGGCGCA AACCGCCAAC GAGGGCGGTT CGGTCAGTAT CGCCGTCAAC

   151 GACAATGCCT GCGAACCGAT GGAACTGACC GTGCCGAGCG GACAGGTTGT

   201 GTTCAATATT AAAAACAACA GCGGCCGCAA GCTCGAATGG GAAATCCTGA

   251 AAGGCGTGAT GGTGGTGGAC GAGCGCGAAA ACATCGCCCC CGGACTTTCC

   301 GATAAAATGA CCGTCACCCT GTTGCCGGGC GAATACGAAA TGACTTGCGG

   351 TCTTTTGACC AATCCGCGCG GCAAGCTGGT GGTAACCGAC AGCGGCTTTA

   401 AAGACACCGC CAACGAAGCG GATTTGGAAA AACTGTCCCA ACCGCTCGCC

   451 GACTATAAAG CCTACGTTCA AGGCGAGGTT AAAGAGCTGG TGGCGAAAAC

   501 CAAAACTTTT ACCGAAGCCG TCAAAGCAGG CGACATTGAA AAGGCGAAAT

   551 CCCTGTTTGC CGACACCCGC GTCCATTACG AACGCATCGA ACCGATTGCC

   601 GAGCTTTTCA GCGAACTCGA CCCCGTCATC GATGCGCGTG AAGACGACTT

   651 CAAAGACGGC GCGAAAGATG CCGGATTTAC CGGCTTTCAC CGTATCGAAT

   701 ACGCCCTTTG GGTGGAAAAA GACGTGTCCG GCGTGAAGGA AATTGCAGCG

   751 AAACTGATGA CCGATGTCGA AGCCCTGCAA AAAGAAATCG ACGCATTGGC

   801 GTTTCCTCCG GGCAAGGTGG TCGGCGGCGC GTCCGAACTG ATTGAAGAAG

   851 TGGCGGGCAG TAAAATCAGC GGCGAAGAAG ACCGGTACAG CCACACCGAT

   901 TTGAGCGACT TCCAAGCCAA TGTGGACGGA TCTAAAAAAA TCGTCGATTT

   951 GTTCCGTCCG CTGATCGAGG CCAAAAACAA AGCCTTGTTG GAAAAAACCG

  1001 ATACCAACTT CAAACAGGTC AACGAAATTC TGGCGAAATA CCGGACTAAA

  1051 GACGGTTTTG AAACCTACGA CAAGCTGGGC GAAGCCGACC GCAAAGCGTT

  1101 ACAGGCCTCT ATTAACGCGC TTGCCGAAGA CCTTGCCCAA CTTCGCGGCA

  1151 TACTCGGCTT GAAATAA
```

This corresponds to the amino acid sequence <SEQ ID 1868; ORF 595>:

```
m595.pep
   1 MRKFNLTALS VMLALGLTAC QPPEAEKAAP AASGEAQTAN EGGSVSIAVN

  51 DNACEPMELT VPSGQVVFNI KNNSGRKLEW EILKGVMVVD ERENIAPGLS

 101 DKMTVTLLPG EYEMTCGLLT NPRGKLVVTD SGFKDTANEA DLEKLSQPLA

 151 DYKAYVQGEV KELVAKTKTF TEAVKAGDIE KAKSLFADTR VHYERIEPIA

 201 ELFSELDPVI DAREDDFKDG AKDAGFTGFH RIEYALWVEK DVSGVKEIAA

 251 KLMTDVEALQ KEIDALAFPP GKVVGGASEL IEEVAGSKIS GEEDRYSHTD

 301 LSDFQANVDG SKKIVDLFRP LIEAKNKALL EKTDTNFKQV NEILAKYRTK

 351 DGFETYDKLG EADRKALQAS INALAEDLAQ LRGILGLK*
```

Computer analysis of this amino acid sequence gave the following results:
Homology with a Predicted ORF from *N. gonorrhoeae*

```
    m595/g595  95.4% identity in 388 aa overlap

                  10        20        30        40        50        60
    m595.pep  MRKFNLTALSVMLALGLTACQPPEAEKAAPAASGEAQTANEGGSVSIAVNDNACEPMELT
              ||||||||||||||||||||||||||||||||||:|:||||||:|||||||||||||:||
    g595      MRKFNLTALSVMLALGLTACQPPEAEKAAPAASGETQSANEGGSVGIAVNDNACEPMNLT
                  10        20        30        40        50        60

                  70        80        90       100       110       120
    m595.pep  VPSGQVVFNIKNNSGRKLEWEILKGVMVVDERENIAPGLSDKMTVTLLPGEYEMTCGLLT
              |||||||||||||||||||||||||||||||||||||||||:|:|||||||||||||||
    g595      VPSGQVVFNIKNNSGRKLEWEILKGVMVVDERENIAPGLSDKMNRNLLPGEYEMTCGLLT
                  70        80        90       100       110       120

                 130       140       150       160       170       180
    m595.pep  NPRGKLVVTDSGFKDTANEADLEKLSQPLADYKAYVQGEVKELVAKTKTFTEAVKAGDIE
              ||||||||:|||||||||||||||:|||||||||||||||||:|||||||||||||||||
    g595      NPRGKLVVADSGFKDTANEADLEKLPQPLADYKAYVQGEVKELAAKTKTFTEAVKAGDIE
                 130       140       150       160       170       180

                 190       200       210       220       230       240
    m595.pep  KAKSLFADTRVHYERIEPIAELFSELDPVIDAREDDFKDGAKDAGFTGFHRIEYALWVEK
              ||||||| ||||||||||||||||||||||| ||||||||||||||||||||:||||||
    g595      KAKSLFAATRVHYERIEPIAELFSELDPVIDACEDDFKDGAKDAGFTGFHRIEHALWVEK
                 190       200       210       220       230       240

                 250       260       270       280       290       300
    m595.pep  DVSGVKEIAAKLMTDVEALQKEIDALAFPPGKVVGGASELIEEVAGSKISGEEDRYSHTD
              |||||||:||||||||||||||||||||||||||||||||||||:|||||||||||||||
    g595      DVSGVKETAAKLMTDVEALQKEIDALAFPPGKVVGGASELIEEAAGSKISGEEDRYSHTD
                 250       260       270       280       290       300

                 310       320       330       340       350       360
    m595.pep  LSDFQANVDGSKKIVDLFRPLIEAKNKALLEKTDTNFKQVNEILAKYRTKDGFETYDKLG
              ||||||| :|||||||||||||||||||||||||||||||||||||||||||||||||:
    g595      LSDFQANADGSKKIVDLFRPLIEAKNKALLEKTDTNFKQVNEILAKYRTKDGFETYDKLS
                 310       320       330       340       350       360

                 370       380    389
    m595.pep  EADRKALQASINALAEDLAQLRGILGLKX
              ||||||||| |||||||||||||||||||
    g595      EADRKALQAPINALAEDLAQLRGILGLKX
                 370       380
```

The following partial DNA sequence was identified in *N. meningitidis* <SEQ ID 1869>:

```
a595.seq
    1 ATGAGAAAAT TCAATTTGAC CGCATTGTCC GTGATGCTTG CCTTAGGTTT

   51 GACCGCGTGC CAGCCGCCGG AGGCGGAGAA AGCTGCGCCG GCAGCGTCCG

  101 GTGAGGCGCA AACCGCCAAC GAGGGCGGTT CGGTCAGTAT CGCCGTCAAC

  151 GACAATGCCT GCGAACCGAT GGAACTGACC GTGCCGAGCG GACAGGTTGT

  201 GTTCAATATT AAAAACAACA GCGGCCGCAA GCTCGAATGG GAAATCCTGA

  251 AAGGCGTGAT GGTGGTGGAC GAGCGCGAAA ACATCGCCCC CGGACTTTCC

  301 GATAAAATGA CCGTCACCCT GTTGCCGGGC GAATACGAAA TGACTTGCGG

  351 TCTTTTGACC AATCCGCGCG GCAAGCTGGT GGTAACCGAC AGCGGCTTTA

  401 AAGACACCGC CAACGAAGCG GATTTGGAAA AACTGTCCCA ACCGCTCGCC

  451 GACTATAAAG CCTATGTTCA AGGCGAAGTC AAAGAGCTGG TGGCGAAAAC

  501 CAAAACCTTT ACCGAAGCCG TCAAAGCAGG CGACATTGAA AAGGCGAAAT

  551 CCCTGTTTGC CGACACCCGC GTCCATTACG AACGCATCGA ACCGATTGCC

  601 GAGCTTTTCA GCGAACTCGA CCCCGTCATC GATGCGCGTG AAGACGACTT

  651 CAAAGACGGC GCGAAAGATG CCGGATTTAC CGGCTTCCAC CGTATCGAAT

  701 ACGCCCTTTG GGTGGAAAAA GACGTGTCCG GCGTGAAGGA AATTGCAGCG
```

-continued

```
 751 AAACTGATGA CCGATGTCGA AGCCCTGCAA AAAGAAATCG ACGCATTGGC

 801 GTTTCCTCCG GGCAAGGTGG TCGGCGGCGC GTCCGAACTG ATTGAAGAAG

 851 TGGCGGGCAG TAAAATCAGC GGCGAAGAAG ACCGGTACAG CCACACCGAT

 901 TTGAGCGACT TCCAAGCCAA TGTGGACGGA TCGAAAAAAA TCGTCGATTT

 951 GTTCCGTCCG TTGATCGAGA CCAAAAACAA AGCCTTGTTG GAAAAAACCG

1001 ATACCAACTT CAAACAGGTC AACGAAATTC TGGCGAAATA CCGGACTAAA

1051 GACGGTTTTG AAACCTACGA CAAGCTGGGC GAAGCCGACC GCAAAGCGTT

1101 ACAGGCCTCT ATTAACGCGC TTGCCGAAGA CCTTGCCCAA CTTCGCGGCA

1151 TACTCGGCTT GAAATAA
```

This corresponds to the amino acid sequence <SEQ ID 1870; ORF 595.a>:

```
a595.pep

      1  MRKFNLTALS VMLALGLTAC QPPEAEKAAP AASGEAQTAN EGGSVSIAVN

     51  DNACEPMELT VPSGQVVFNI KNNSGRKLEW EILKGVMVVD ERENIAPGLS

    101  DKMTVTLLPG EYEMTCGLLT NPRGKLVVTD SGFKDTANEA DLEKLSQPLA

    151  DYKAYVQGEV KELVAKTKTF TEAVKAGDIE KAKSLFADTR VHYERIEPIA

    201  ELFSELDPVI DAREDDFKDG AKDAGFTGFH RIEYALWVEK DVSGVKEIAA

    251  KLMTDVEALQ KEIDALAFPP GKVVGGASEL IEEVAGSKIS GEEDRYSHTD

    301  LSDFQANVDG SKKIVDLFRP LIETKNKALL EKTDTNFKQV NEILAKYRTK

    351  DGFETYDKLG EADRKALQAS INALAEDLAQ LRGILGLK*

m595/a595  99.7% identity in 388 aa overlap

                   10        20        30        40        50        60
m595.pep   MRKFNLTALSVMLALGLTACQPPEAEKAAPAASGEAQTANEGGSVSIAVNDNACEPMELT
           ||||||||||||||||||||||||||||||||||||||||||||||||||||||||||||
a595       MRKFNLTALSVMLALGLTACQPPEAEKAAPAASGEAQTANEGGSVSIAVNDNACEPMELT
                   10        20        30        40        50        60

                   70        80        90       100       110       120
m595.pep   VPSGQVVFNIKNNSGRKLEWEILKGVMVVDERENIAPGLSDKMTVTLLPGEYEMTCGLLT
           ||||||||||||||||||||||||||||||||||||||||||||||||||||||||||||
a595       VPSGQVVFNIKNNSGRKLEWEILKGVMVVDERENIAPGLSDKMTVTLLPGEYEMTCGLLT
                   70        80        90       100       110       120

                  130       140       150       160       170       180
m595.pep   NPRGKLVVTDSGFKDTANEADLEKLSQPLADYKAYVQGEVKELVAKTKTFTEAVKAGDIE
           ||||||||||||||||||||||||||||||||||||||||||||||||||||||||||||
a595       NPRGKLVVTDSGFKDTANEADLEKLSQPLADYKAYVQGEVKELVAKTKTFTEAVKAGDIE
                  130       140       150       160       170       180

                  190       200       210       220       230       240
m595.pep   KAKSLFADTRVHYERIEPIAELFSELDPVIDAREDDFKDGAKDAGFTGFHRIEYALWVEK
           ||||||||||||||||||||||||||||||||||||||||||||||||||||||||||||
a595       KAKSLFADTRVHYERIEPIAELFSELDPVIDAREDDFKDGAKDAGFTGFHRIEYALWVEK
                  190       200       210       220       230       240

                  250       260       270       280       290       300
m595.pep   DVSGVKEIAAKLMTDVEALQKEIDALAFPPGKVVGGASELIEEVAGSKISGEEDRYSHTD
           ||||||||||||||||||||||||||||||||||||||||||||||||||||||||||||
a595       DVSGVKEIAAKLMTDVEALQKEIDALAFPPGKVVGGASELIEEVAGSKISGEEDRYSHTD
                  250       260       270       280       290       300

                  310       320       330       340       350       360
m595.pep   LSDFQANVDGSKKIVDLFRPLIEAKNKALLEKTDTNFKQVNEILAKYRTKDGFETYDKLG
           |||||||||||||||||||||||:||||||||||||||||||||||||||||||||||||
a595       LSDFQANVDGSKKIVDLFRPLIETKNKALLEKTDTNFKQVNEILAKYRTKDGFETYDKLG
                  310       320       330       340       350       360

                  370       380      389
m595.pep   EADRKALQASINALAEDLAQLRGILGLKX
           |||||||||||||||||||||||||||||
a595       EADRKALQASINALAEDLAQLRGILGLKX
                  370       380
```

The following partial DNA sequence was identified in *N. gonorrhoeae* <SEQ ID 1871>:

```
g596.seq.(partial).
   1 ..atgctgctct tggacgagcc gaccaaccac ttggatgcgg aatcggtgga
  51   atggctggag caattcctcg tgcgcttccc cggcacagtg gtcgcggtaa
 101   cgcacgaccg ctacttcctc gacaacgccg ccgaatggat tttggaactc
 151   gaccgcggac acggcattcc gtggaaaggc aattactcgt cttggctgga
 201   gcagaaagaa aaacgcttgg aaaacgaggc gaaatccgaa gccgcgcgcg
 251   tgaaggcgat gaagcaggaa ttggaatggg tgcgccaaaa tgccaaaggc
 301   cgccaagcca agcccaaagc gcgtttggcg cgttttgaag aaatgagcaa
 351   ctacgaatac caaaaacgca acgaaactca ggaaatcttt atccctgttg
 401   ccgagcgttt gggtaacgaa gtgattgaat ttgtgaatgt ttccaaatcg
 451   ttcggcgata aagtgctgat tgacggtttg agcttcaaag tgccggcggg
 501   cgcgattgtc ggcatcatcg gcccgaacgg cgcgggtaaa tcgacgctgt
 551   tcaaaatgat tgcgggcaaa gagcagcccg attcgggcga agtgaaaatc
 601   gggcaaaccg tgaaaatgag cttgattgac caaagccgcg aaggtttgca
 651   aaacgacaaa accgtgttcg acaacattgc cgaaggtcgc gatattttgc
 701   aggtcggaca gtttgaaatc cccgcccgcc aatatttggg acgcttcaac
 751   tttaaaggca gcgaccaaag caaaatcgca aggcagcttt ccggcggcga
 801   acgcggccgt ctgcacttgg caaaaacctt gttgggcggc ggcaatgtgt
 851   tgctgctgga cgaaccgtcc aacgatctcg acgtggaaac cctgcgcgcg
 901   ttggaagacg cattgttgga atttgccggc agcgtgatgg tgatttcgca
 951   cgaccgctgg tttctcgacc gcatagccac gcatatcttg gcgtgtgaag
1001   gcgactccaa atgggtgttc ttcgacggca actatcaaga atacgaagcc
1051   gacaagaaac gccgactcgg caaagaaggc gcgaaaccga aacgcatcaa
1101   atacaaaccg gtaacgcgtt aa
```

This corresponds to the amino acid sequence <SEQ ID 1872; ORF 596.ng>:

```
g596.pep (partial).
   1 ..MLLLDEPTNH LDAESVEWLE QFLVRFPGTV VAVTHDRYFL DNAAEWILEL
  51   DRGHGIPWKG NYSSWLEQKE KRLENEAKSE AARVKAMKQE LEWVRQNAKG
 101   RQAKPKARLA RFEEMSNYEY QKRNETQEIF IPVAERLGNE VIEFVNVSKS
 151   FGDKVLIDGL SFKVPAGAIV GIIGPNGAGK STLFKMIAGK EQPDSGEVKI
 201   GQTVKMSLID QSREGLQNDK TVFDNIAEGR DILQVGQFEI PARQYLGRFN
 251   FKGSDQSKIA RQLSGGERGR LHLAKTLLGG GNVLLLDEPS NDLDVETLRA
 301   LEDALLEFAG SVMVISHDRW FLDRIATHIL ACEGDSKWVF FDGNYQEYEA
 351   DKKRRLGKEG AKPKRIKYKP VTR*
```

The following partial DNA sequence was identified in *N. meningitidis* <SEQ ID 1873>:

```
m596.seq..
   1   ATGTCCCAAC AATACGTCTA TTCTATGCTG CGCGTGAGCA AGGTTGTGCC
```

-continued

```
  51 GCCGCAGAAA ACCATCATTA AAGATATTTC CCTTTCTTTC TTCCCCGGCG

 101 CGAAAATCGG CCTGCTCGGT TTGAACGGCG CGGGCAAGTC CACCGTGCTG

 151 CGGATTATGG CGGGCGTGGA TAAGGAATTT GAGGGCGAAG CCGTGCCGAT

 201 GGGCGGCATC AAAATCGGCT ACCTGCCGCA AGAGCCTGAG CTTGATCCGG

 251 AAAAAACCGT GCGCGAGGAA GTGGAAAGCG GTTTGGGCGA AGTGGCTGCC

 301 GCGCAGAAAC GTTTGGAAGA AGTGTATGCC GAGTACGCCA ATCCTGATGC

 351 GGATTTTGAC GCGTTGGCAG AAGAGCAGGG CCGCTTGGAA GCGATTATTG

 401 CGGCAGGTTC GTCCACGGGC GGCGGTGCGG AACACGAATT GGAAATCGCC

 451 GCCGACGCGC TGCGCCTGCC GGAATGGGAT GCCAAAATCG ATAATTTGTC

 501 CGGCGGTGAA AAACGCCGCG TTGCCTTGTG CAAACTCTTG TTGAGCAAGC

 551 CCGATATGCT TTTGCTGGAC GAGCCGACCA ACCACTTGGA TGCGGAATCG

 601 GTCGAGTGGC TGGAGCAATT TCTCGTGCGC TTCCCCGGCA CAGTCGTTGC

 651 GGTAACGCAC GACCGCTACT TCCTCGACAA CGCCGCCGAA TGGATTTTGG

 701 AACTCGACCG CGGCCATGGT ATTCCGTGGA AAGGCAATTA CTCGTCTTGG

 751 CTGGAGCAGA AAGAAAAACG CTTGGAAAAC GAGGCAAAAT CCGAAGCCGC

 801 GCGCGTGAAG GCGATGAAGC AGGAATTGGA ATGGGTGCGC CAAAATGCCA

 851 AAGGCCGCCA AGCCAAGTCC AAAGCGCGTT TGGCTCGTTT TGAAGAAATG

 901 AGCAACTACG AATACCAAAA ACGCAATGAA ACGCAGGAAA TCTTTATTCC

 951 CGTTGCCGAG CGTTTGGGTA ACGAAGTGAT TGAATTTGTA AATGTTTCCA

1001 AATCGTTCGG CGATAAAGTG CTGATTGACG ATTTGAGCTT CAAAGTGCCT

1051 GCGGGCGCGA TTGTCGGCAT CATCGGCCCG AACGGCGCGG GTAAATCTAC

1101 GCTGTTCAAA ATGATTTCGG GCAAAGAGCA GCCTGATTCC GGCGAGGTGA

1151 AAATCGGACA AACCGTGAAA ATGAGCTTGA TTGACCAAAG CCGCGAAGGT

1201 TTGCAAAACG ACAAAACCGT GTTCGACAAC ATTGCCGAAG GCCGCGACAT

1251 TTTGCAGGTT GGTCAGTTTG AAATTCCCGC CCGCCAATAT TTGGGGCGTT

1301 TCAACTTCAA AGGCAGCGAC CAAAGCAAAA TTGCAGGTCA ATTGTCTGGC

1351 GGCGAACGCG GTCGTCTGCA CTTGGCAAAA ACCTTGTTGA GCGGCGGCAA

1401 TGTATTGCTG CTGGATGAAC CGTCTAACGA CCTTGACGTG GAAACCCTGC

1451 GCGCGTTGGA AGACGCATTG TTGGAATTTG CCGGCAGCGT GATGGTGATT

1501 TCGCACGACC GTTGGTTCCT CGACCGCATC GCCACGCATA TCTTGGCGTG

1551 TGAAGGCGAC TCTAAATGGG TGTTCTTCGA CGGCAACTAT CAGGAATACG

1601 AAGCCGACAA GAAACGCCGT TTGGGCGAAG AAGGCGCGAA ACCGAAACGC

1651 ATCAAATACA AACCGGTAAC GCGTTAA
```

This corresponds to the amino acid sequence <SEQ ID 1874; ORF 596>:

```
m596.pep..
  1 MSQQYVYSML RVSKVVPPQK TIIKDISLSF FPGAKIGLLG LNGAGKSTVL

 51 RIMAGVDKEF EGEAVPMGGI KIGYLPQEPE LDPEKTVREE VESGLGEVAA

101 AQKRLEEVYA EYANPDADFD ALAEEQGRLE AIIAAGSSTG GGAEHELEIA

151 ADALRLPEWD AKIDNLSGGE KRRVALCKLL LSKPDMLLLD EPTNHLDAES
```

-continued

```
201 VEWLEQFLVR FPGTVVAVTH DRYFLDNAAE WILELDRGHG IPWKGNYSSW

251 LEQKEKRLEN EAKSEAARVK AMKQELEWVR QNAKGRQAKS KARLARFEEM

301 SNYEYQKRNE TQEIFIPVAE RLGNEVIEFV NVSKSFGDKV LIDDLSFKVP

351 AGAIVGIIGP NGAGKSTLFK MISGKEQPDS GEVKIGQTVK MSLIDQSREG

401 LQNDKTVFDN IAEGRDILQV GQFEIPARQY LGRFNFKGSD QSKIAGQLSG

451 GERGRLHLAK TLLSGGNVLL LDEPSNDLDV ETLRALEDAL LEFAGSVMVI

501 SHDRWFLDRI ATHILACEGD SKWVFFDGNY QEYEADKKRR LGEEGAKPKR

551 IKYKPVTR*
```

Computer analysis of this amino acid sequence gave the following results:

Homology with a Predicted ORF from *N. gonorrhoeae*

```
m596 g596   98.4% identity in 373 aa overlap

                  160       170       180       190       200       210
m596.pep   LPEWDAKIDNLSGGEKRRVALCKLLLSKPDMLLLDEPTNHLDAESVEWLEQFLVRFPGTV
                                         ||||||||||||||||||||||||||||||
g596                                     MLLLDEPTNHLDAESVEWLEQFLVRFPGTV
                                                 10        20        30

                  220       230       240       250       260       270
m596.pep   VAVTHDRYFLDNAAEWILELDRGHGIPWKGNYSSWLEQKEKRLENEAKSEAARVKAMKQE
           ||||||||||||||||||||||||||||||||||||||||||||||||||||||||||||
g596       VAVTHDRYFLDNAAEWILELDRGHGIPWKGNYSSWLEQKEKRLENEAKSEAARVKAMKQE
                   40        50        60        70        80        90

                  280       290       300       310       320       330
m596.pep   LEWVRQNAKGRQAKSKARLARFEEMSNYEYQKRNETQEIFIPVAERLGNEVIEFVNVSKS
           |||||||||||||| |||||||||||||||||||||||||||||||||||||||||||||
g596       LEWVRQNAKGRQAKPKARLARFEEMSNYEYQKRNETQEIFIPVAERLGNEVIEFVNVSKS
                  100       110       120       130       140       150

                  340       350       360       370       380       390
m596.pep   FGDKVLIDDLSFKVPAGAIVGIIGPNGAGKSTLFKMISGKEQPDSGEVKIGQTVKMSLID
           |||||||| ||||||||||||||||||||||||||||:||||||||||||||||||||||
g596       FGDKVLIDGLSFKVPAGAIVGIIGPNGAGKSTLFKMIAGKEQPDSGEVKIGQTVKMSLID
                  160       170       180       190       200       210

                  400       410       420       430       440       450
m596.pep   QSREGLQNDKTVFDNIAEGRDILQVGQFEIPARQYLGRFNFKGSDQSKIAGQLSGGERGR
           |||||||||||||||||||||||||||||||||||||||||||||||||| |||||||||
g596       QSREGLQNDKTVFDNIAEGRDILQVGQFEIPARQYLGRFNFKGSDQSKIARQLSGGERGR
                  220       230       240       250       260       270

                  460       470       480       490       500       510
m596.pep   LHLAKTLLSGGNVLLLDEPSNDLDVETLRALEDALLEFAGSVMVISHDRWFLDRIATHIL
           ||||||||:|||||||||||||||||||||||||||||||||||||||||||||||||||
g596       LHLAKTLLGGGNVLLLDEPSNDLDVETLRALEDALLEFAGSVMVISHDRWFLDRIATHIL
                  280       290       300       310       320       330

                  520       530       540       550       559
m596.pep   ACEGDSKWVFFDGNYQEYEADKKRRLGEEGAKPKRIKYKPVTRX
           |||||||||||||||||||||||||||:||||||||||||||||
g596       ACEGDSKWVFFDGNYQEYEADKKRRLGKEGAKPKRIKYKPVTRX
                  340       350       360       370
```

The following partial DNA sequence was identified in *N. meningitidis* <SEQ ID 1875>:

```
a596.seq
   1  ATGTCCCAAC AATACGTCTA TTCTATGCTG CGCGTGAGCA AGGTTGTGCC

  51  GCCGCAGAAA ACCATCATTA AAGATATTTC CCTTTCTTTC TTCCCCGGCG

 101  CGAAAATCGG TTTGCTCGGT TTGAACGGCG CGGGCAAGTC CACCGTGCTG

 151  CGGATTATGG CGGGCGTGGA TAAAGAATTT GAGGGCGAAG CCGTGCCGAT

 201  GGGCGGTATT AAAATCGGCT ACCTGCCGCA AGAGCCTGAG CTTGATCCGG

 251  AAAAAACCGT GCGTGAGGAA GTGGAAAGCG GTTTGGGCGA AGTGGCTGCC
```

-continued

```
 301 GCGCAGAAAC GTTTGGAGGA AGTGTATGCC GAGTACGCCA ATCCCGATGC
 351 GGATTTTGAC GCGTTGGCGG AAGAGCAGGG GCGTTTGGAA GCGATTATTG
 401 CGGCGGGTTC GTCCACGGGC GGCGGTGCGG AACACGAATT GGAAATCGCT
 451 GCCGACGCGC TGCGCCTGCC GGAATGGGAT GCCAAAATCG ATAATTTGTC
 501 CGGCGGTGAA AAACGCCGCG TCGCTTTGTG CAAACTCTTG TTGAGCAAGC
 551 CCGATATGCT TTTGCTGGAC GAGCCGACCA ACCACTTGGA TGCGGAATCG
 601 GTCGAGTGGC TGGAGCAATT TCTCGTGCGC TTCCCCGGTA CAGTCGTTGC
 651 CGTAACACAC GACCGCTACT TCCTCGACAA CGCCGCCGAA TGGATTTTGG
 701 AACTCGACCG CGGGCACGGT ATTCCGTGGA AAGGAAATTA CTCGTCTTGG
 751 TTGGAGCAGA AAGAAAAACG TTTGGAAAAC GAGGCGAAAT CCGAAGCCGC
 801 GCGCGTGAAA GCGATGAAGC AGGAATTGGA ATGGGTGCGC CAAAATGCCA
 851 AAGGCCGTCA AGCCAAGTCC AAAGCGCGTT TGGCGCGTTT TGAAGAAATG
 901 AGCAACTATG AATACCAAAA ACGCAATGAA ACGCAGGAAA TCTTCATTCC
 951 CGTCGCCGAG CGTTTGGGTA ACGAAGTGAT TGAATTTGTG AATGTTTCCA
1001 AATCGTTCGG CGACAAAGTG CTGATTGACG ATTTGAGCTT CAAAGTGCCT
1051 GCGGGCGCGA TTGTCGGCAT CATCGGTCCG AACGGCGCGG GTAAATCGAC
1101 ACTGTTTAAA ATGATTGCGG GCAAAGAGCA GCCCGATTCC GGTGAAGTGA
1151 AAATCGGGCA AACCGTGAAA ATGAGCTTGA TTGACCAAAG CCGCGAAGGT
1201 TTGCAAAACG ACAAAACCGT GTTCGACAAC ATTGCCGAAG GTCGCGATAT
1251 TTTACAGGTC GGGCAGTTTG AAATCCCCGC CCGCCAATAT TTGGGACGCT
1301 TCAATTTCAA AGGCAGCGAC CAAAGCAAAA TCACGGGGCA GCTTTCCGGC
1351 GGCGAACGCG GACGTTTGCA CTTGGCAAAA ACCTTGTTGG GCGGTGGCAA
1401 TGTGTTGCTG CTGGACGAAC CGTCCAACGA CCTCGACGTG GAAACCCTGC
1451 GCGCGTTGGA AGACGCATTG CTGGAATTTG CCGGCAGCGT GATGGTGATT
1501 TCGCACGACC GCTGGTTCCT CGACCGTATT GCTACGCATA TCTTGGCTTG
1551 CGAAGGCGAC TCCAAATGGG TGTTCTTTGA CGGCAACTAT CAGGAATACG
1601 AAGCCGACAA GAAACGCCGA CTCGGCGAAG AAGGCACGAA ACCGAAACGC
1651 ATCAAATACA AACCGGTAAC GCGTTAA
```

This corresponds to the amino acid sequence <SEQ ID 1876; ORF 596.a>:

```
a596.pep

  1 MSQQYVYSML RVSKVVPPQK TIIKDISLSF FPGAKIGLLG LNGAGKSTVL
 51 RIMAGVDKEF EGEAVPMGGI KIGYLPQEPE LDPEKTVREE VESGLGEVAA
101 AQKRLEEVYA EYANPDADFD ALAEEQGRLE AIIAAGSSTG GGAEHELEIA
151 ADALRLPEWD AKIDNLSGGE KRRVALCKLL LSKPDMLLLD EPTNHLDAES
201 VEWLEQFLVR FPGTVVAVTH DRYFLDNAAE WILELDRGHG IPWKGNYSSW
251 LEQKEKRLEN EAKSEAARVK AMKQELEWVR QNAKGRQAKS KARLARFEEM
301 SNYEYQKRNE TQEIFIPVAE RLGNEVIEFV NVSKSFGDKV LIDDLSFKVP
351 AGAIVGIIGP NGAGKSTLFK MIAGKEQPDS GEVKIGQTVK MSLIDQSREG
401 LQNDKTVFDN IAEGRDILQV GQFEIPARQY LGRFNFKGSD QSKITGQLSG
```

-continued

```
451 GERGRLHLAK TLLGGGNVLL LDEPSNDLDV ETLRALEDAL LEFAGSVMVI

501 SHDRWFLDRI ATHILACEGD SKWVFFDGNY QEYEADKKRR LGEEGTKPKR

551 IKYKPVTR*
```

```
m596/a596  99.3% identity in 558 aa overlap

                   10        20        30        40        50        60
m596.pep    MSQQYVYSMLRVSKVVPPQKTIIKDISLSFFPGAKIGLLGLNGAGKSTVLRIMAGVDKEF
            ||||||||||||||||||||||||||||||||||||||||||||||||||||||||||||
a596        MSQQYVYSMLRVSKVVPPQKTIIKDISLSFFPGAKIGLLGLNGAGKSTVLRIMAGVDKEF
                   10        20        30        40        50        60

                   70        80        90       100       110       120
m596.pep    EGEAVPMGGIKIGYLPQEPELDPEKTVREEVESGLGEVAAAQKRLEEVYAEYANPDADFD
            ||||||||||||||||||||||||||||||||||||||||||||||||||||||||||||
a596        EGEAVPMGGIKIGYLPQEPELDPEKTVREEVESGLGEVAAAQKRLEEVYAEYANPDADFD
                   70        80        90       100       110       120

                  130       140       150       160       170       180
m596.pep    ALAEEQGRLEAIIAAGSSTGGGAEHELEIAADALRLPEWDAKIDNLSGGEKRRVALCKLL
            ||||||||||||||||||||||||||||||||||||||||||||||||||||||||||||
a596        ALAEEQGRLEAIIAAGSSTGGGAEHELEIAADALRLPEWDAKIDNLSGGEKRRVALCKLL
                  130       140       150       160       170       180

                  190       200       210       220       230       240
m596.pep    LSKPDMLLLDEPTNHLDAESVEWLEQFLVRFPGTVVAVTHDRYFLDNAAEWILELDRGHG
            ||||||||||||||||||||||||||||||||||||||||||||||||||||||||||||
a596        LSKPDMLLLDEPTNHLDAESVEWLEQFLVRFPGTVVAVTHDRYFLDNAAEWILELDRGHG
                  190       200       210       220       230       240

                  250       260       270       280       290       300
m596.pep    IPWKGNYSSWLEQKEKRLENEAKSEAARVKAMKQELEWVRQNAKGRQAKSKARLARFEEM
            ||||||||||||||||||||||||||||||||||||||||||||||||||||||||||||
a596        IPWKGNYSSWLEQKEKRLENEAKSEAARVKAMKQELEWVRQNAKGRQAKSKARLARFEEM
                  250       260       270       280       290       300

                  310       320       330       340       350       360
m596.pep    SNYEYQKRNETQEIFIPVAERLGNEVIEFVNVSKSFGDKVLIDDLSFKVPAGAIVGIIGP
            ||||||||||||||||||||||||||||||||||||||||||||||||||||||||||||
a596        SNYEYQKRNETQEIFIPVAERLGNEVIEFVNVSKSFGDKVLIDDLSFKVPAGAIVGIIGP
                  310       320       330       340       350       360

                  370       380       390       400       410       420
m596.pep    NGAGKSTLFKMISGKEQPDSGEVKIGQTVKMSLIDQSREGLQNDKTVFDNIAEGRDILQV
            |||||||||||:||||||||||||||||||||||||||||||||||||||||||||||||
a596        NGAGKSTLFKMIAGKEQPDSGEVKIGQTVKMSLIDQSREGLQNDKTVFDNIAEGRDILQV
                  370       380       390       400       410       420

                  430       440       450       460       470       480
m596.pep    GQFEIPARQYLGRFNFKGSDQSKIAGQLSGGERGRLHLAKTLLSGGNVLLLDEPSNDLDV
            ||||||||||||||||||||||||:|||||||||||||||||||:|||||||||||||||
a596        GQFEIPARQYLGRFNFKGSDQSKITGQLSGGERGRLHLAKTLLGGGNVLLLDEPSNDLDV
                  430       440       450       460       470       480

                  490       500       510       520       530       540
m596.pep    ETLRALEDALLEFAGSVMVISHDRWFLDRIATHILACEGDSKWVFFDGNYQEYEADKKRR
            ||||||||||||||||||||||||||||||||||||||||||||||||||||||||||||
a596        ETLRALEDALLEFAGSVMVISHDRWFLDRIATHILACEGDSKWVFFDGNYQEYEADKKRR
                  490       500       510       520       530       540

                  550      559
m596.pep    LGEEGAKPKRIKYKPVTRX
            |||||:|||||||||||||
a596        LGEEGTKPKRIKYKPVTRX
                  550
```

The following partial DNA sequence was identified in *N. gonorrhoeae* <SEQ ID 1877>

```
g597.seq
     1  ATGCTGCTTC ATGTCAGCAA TTCCCTCAAA CAGCTTCAGG AAGAGCGTAT

    51  CCGCCAAGAA CGTATCCGCC AAGAGCGTAT CCGTCAGGCG CGCGGCAACC

   101  TTGCTTCCGT CAACCGCAAA CAGCGCGAGG CTTGGGACAA ATTCCAAAAA

   151  CTCAATACCG AGCTGAACCG TTTGAAAACG GAAGTCGCCG CTACGAAAGC

   201  GCAGATTTCC CGTTTCGTAT CGGGGAACTA TAAAAACAGC CGGCCGAATG

   251  CGGTTGCCCT GTTCCTGAAA AACGCCGAAC CGGGTCAGAA AAACCGCTTT

   301  TTGCGTTATA CGCGTTATGT AAACGCCTCC AATCGGGAAG TTGTCAAGGA
```

-continued

```
 351 TTTGGAAAAA CAGCAGAAGG CTTTGGCGGT ACAAGAGCAG AAAATCAACA

 401 ATGAGCTTGC CCGTTTGAAG AAAATTCAGG CAAACGTGCA ATCCCTGCTG

 451 AAAAAACAGG GTGTAACCGA TGCGGCGGAA CAGACGGAAA GCCGCAGACA

 501 GAATGCCAAA ATCTCCAAAG ATGCCCGAAA ACTGCTGGAA CAGAAAGGGA

 551 ACGAGCAGCA GCTGAACAAG CTCTTGAGCA ATTTGgagaa aaAAAaagcc

 601 gaacaccgCA TTcaggAtgc ggAagcaaAA agaAAATTGG CTGAagcCaa

 651 actGgcggca gccgAAAAAG CCAGAAAAGA AGCGGCGCAG CAGAAGGCTG

 701 AAGCGCGACG TGCGGAAATG TCCAACCTGA CCGCCGAAGA CAGGAACATC

 751 CAAGCGCCTT CGGTTATGGG TATCGGCAGT GCCGACGgTT TCAGCCGCAT

 801 GCAGGGACGT TTGAAAAAAC CGGTTGACGG TGTGCCGACC GGGCTTTTCG

 851 GGCAGAACCG GAGCGGcggC GATGTTTGGA AAGGCGTGTT CTATTCCACT

 901 GCGCCTGCAA CGGTTGAAAG CATTGCGCcg gGAACggtaa GCTATGCGGA

 951 cgaGTTGGAC GGCTACGGCA AAGTGGTCGT GATCGATCAC GGCGAGAACT

1001 ACATCAGCAT CTATGCCGGT TTGAGCGAAA TTTCCGCCGG CAAGGGTTAT

1051 ACGGTCGCGG CAGGAAGCAA AATCGGCACG AGCGGGTCGC TGCCGGACGG

1101 GGAAGAGGGG CTTTACCTGC AAATACGTTA TCGAGGTCAG GTGTTGAACC

1151 CTTCGGGCTG GATACGTTGA
```

This corresponds to the amino acid sequence <SEQ ID 1878; ORF 597>:

```
g597.pep
   1 MLLHVSNSLK QLQEERIRQE RIRQERIRQA RGNLASVNRK QREAWDKFQK

  51 LNTELNRLKT EVAATKAQIS RFVSGNYKNS RPNAVALFLK NAEPGQKNRF

 101 LRYTRYVNAS NREVVKDLEK QQKALAVQEQ KINNELARLK KIQANVQSLL

 151 KKQGVTDAAE QTESRRQNAK ISKDARKLLE QKGNEQQLNK LLSNLEKKKA

 201 EHRIQDAEAK RKLAEAKLAA AEKARKEAAQ QKAEARRAEM SNLTAEDRNI

 251 QAPSVMGIGS ADGFSRMQGR LKKPVDGVPT GLFGQNRSGG DVWKGVFYST

 301 APATVESIAP GTVSYADELD GYGKVVVIDH GENYISIYAG LSEISAGKGY

 351 TVAAGSKIGT SGSLPDGEEG LYLQIRYRGQ VLNPSGWIR*
```

The following partial DNA sequence was identified in *N. meningitidis* <SEQ ID 1879>:

```
m597.seq
   1 ATGCTGCTTC ATGTCAGCAA TTCCCTCAAA CAGCTTCAGG AAGAGCGTAT

  51 CCGCCAAGAG CGTATCCGTC AGGCGCGCGG CAACCTTGCT TCCGTCAACC

 101 GCAAACAGCG CGAGGCTTGG GACAAGTTCC AAAAACTCAA TACCGAGCTG

 151 AACCGTTTGA AAACGGAAGT CGCCGCTACG AAAGCGCAGA TTTCCCGTTT

 201 CGTATCGGGG AACTATAAAA ACAGCCAGCC GAATGCGGTT GCCCTGTTCC

 251 TGAAAAACGC CGAACCGGGT CAGAAAAACC GCTTTTTGCG TTATACGCGT

 301 TATGTAAACG CCTCCAATCG GGAAGTTGTC AAGGATTTGG AAAAACAGCA

 351 GAAGGCTTTG GCGGTACAAG AGCAGAAAAT CAACAATGAG CTTGCCCGTT

 401 TGAAGAAAAT TCAGGCAAAC GTGCAATCTC TGCTGAAAAA ACAGGGTGTA
```

-continued

```
 451 ACCGATGCGG CGGAACAGAC GGAAAGCCGC AGACAGAATG CCAAAATCGC

 501 CAAAGATGCC CGAAAACTGC TGGAACAGAA AGGGAACGAG CAGCAGCTGA

 551 ACAAGCTCTT GAGCAATTTG GAGAAGAAAA AGGCCGAACA CCGCATTCAG

 601 GATGCGGAAG CAAAAAGAAA ATTGGCTGAA GCCAGACTGG CGGCAGCCGA

 651 AAAAGCCAGA AAAGAAGCGG CGCAGCAGAA GGCTGAAGCA CGACGTGCGG

 701 AAATGTCCAA CCTGACCGCC GAAGACAGGA ACATCCAAGC GCCTTCGGTT

 751 ATGGGTATCG GCAGTGCCGA CGGTTTCAGC CGCATGCAAG GACGTTTGAA

 801 AAAACCGGTT GACGGTGTGC CGACCGGACT TTTCGGGCAG AACCGGAGCG

 851 GCGGCGATAT TTGGAAAGGC GTGTTCTATT CCACTGCACC GGCAACGGTT

 901 GAAAGCATTG CGCCGGGAAC GGTAAGCTAT GCGGACGAGT TGGACGGCTA

 951 CGGCAAAGTG GTCGTGGTCG ATCACGGCGA GAACTACATC AGCATCTATG

1001 CCGGTTTGAG CGAAATTTCC GTCGGCAAGG GTTATATGGT CGCGGCAGGA

1051 AGCAAAATCG GCTCGAGCGG GTCGCTGCCG GACGGGGAAG AGGGGCTTTA

1101 CCTGCAAATA CGTTATCAAG GTCAGGTATT GAACCCTTCG AGCTGGATAC

1151 GTTGA
```

This corresponds to the amino acid sequence <SEQ ID 1880; ORF 597>:

```
m597.pep
  1 MLLHVSNSLK QLQEERIRQE RIRQARGNLA SVNRKQREAW DKFQKLNTEL

 51 NRLKTEVAAT KAQISRFVSG NYKNSQPNAV ALFLKNAEPG QKNRFLRYTR

101 YVNASNREVV KDLEKQQKAL AVQEQKINNE LARLKKIQAN VQSLLKKQGV

151 TDAAEQTESR RQNAKIAKDA RKLLEQKGNE QQLNKLLSNL EKKKAEHRIQ

201 DAEAKRKLAE ARLAAAEKAR KEAAQQKAEA RRAEMSNLTA EDRNIQAPSV

251 MGIGSADGFS RMQGRLKKPV DGVPTGLFGQ NRSGGDIWKG VFYSTAPATV

301 ESIAPGTVSY ADELDGYGKV VVVDHGENYI SIYAGLSEIS VGKGYMVAAG

351 SKIGSSGSLP DGEEGLYLQI RYQGQVLNPS SWIR*
```

Computer analysis of this amino acid sequence gave the following results:

Homology with a Predicted ORF from *N. gonorrhoeae*

ORF 597 shows 96.1% identity over a 389 aa overlap with a predicted ORF (ORF 597) from *N. gonorrhoeae*:

```
m597/g597  96.1% identity in 389 aa overlap

                    10        20        30        40        50        60
g597.pep   MLLHVSNSLKQLQEERIRQERIRQERIRQARGNLASVNRKQREAWDKFQKLNTELNRLKT
           ||||||||||||||||||||||     ||||||||||||||||||||||||||||||||
m597       MLLHVSNSLKQLQEERIRQERIRQ-----ARGNLASVNRKQREAWDKFQKLNTELNRLKT
                    10        20             30        40        50

                    70        80        90       100       110       120
g597.pep   EVAATKAQISRFVSGNYKNSRPNAVALFLKNAEPGQKNRFLRYTRYVNASNREVVKDLEK
           ||||||||||||||||||||:|||||||||||||||||||||||||||||||||||||||
m597       EVAATKAQISRFVSGNYKNSQPNAVALFLKNAEPGQKNRFLRYTRYVNASNREVVKDLEK
               60        70        80        80       100       110

                   130       140       150       160       170       180
g597.pep   QQKALAVQEQKINNELARLKKIQANVQSLLKKQGVTDAAEQTESRRQNAKISKDARKLLE
           ||||||||||||||||||||||||||||||||||||||||||||||||||||:|||||||
m597       QQKALAVQEQKINNELARLKKIQANVQSLLKKQGVTDAAEQTESRRQNAKIAKDARKLLE
              120       130       140       150       160       170
```

-continued

```
                190       200       210       220       230       240
g597.pep   QKGNEQQLNKLLSNLEKKKAEHRIQDAEAKRKLAEAKLAAAEKARKEAAQQKAEARRAEM
           ||||||||||||||||||||||||||||||||||||:|||||||||||||||||||||||
m597       QKGNEQQLNKLLSNLEKKKAEHRIQDAEAKRKLAEARLAAAEKARKEAAQQKAEARRAEM
             180       190       200       210       220       230

                250       260       270       280       290       300
g597.pep   SNLTAEDRNIQAPSVMGIGSADGFSRMQGRLKKPVDGVPTGLFGQNRSGGDVWKGVFYST
           ||||||||||||||||||||||||||||||||||||||||||||||||||||:|||||||
m597       SNLTAEDRNIQAPSVMGIGSADGFSRMQGRLKKPVDGVPTGLFGQNRSGGDIWKGVFYST
             240       250       260       270       280       290

                310       320       330       340       350       360
g597.pep   APATVESIAPGTVSYADELDGYGKVVVIDHGENYISIYAGLSEISAGKGYTVAAGSKIGT
           |||||||||||||||||||||||||||:||||||||||||||||||||||||||||||||
m597       APATVESIAPGTVSYADELDGYGKVVVVDHGENYISIYAGLSEISAGKGYTVAAGSKIGT
             300       310       320       330       340       350

                370       380       390
g597.pep   SGSLPDGEEGLYLQIRYRGQVLNPSGWIRX
           ||||||||||||||||:|||||||:|||||
m597       SGSLPDGEEGLYLQIRYQGQVLNPSSWIRX
             360       370       380
```

The following partial DNA sequence was identified in *N. meningitidis* <SEQ ID 1881>

```
a597.seq
   1  ATGCTGCTTC ATGTCAGCAA TTCCCTCAAG CAGCTTCAGG AAGAGCGTAT
  51  CCGCCAAGAA CGTATCCGCC AAGAGCGTAT CCGTCAGGCG CGCGGCAACC
 101  TTGCTTCCGT CAACCGCAAA CAGCGCGAGG CTTGGGACAA GTTCCAAAAA
 151  CTCAATACCG AGCTGAACCG TTTGAAAACG GAAGTCGCCG CTACGAAAGC
 201  GCAGATTTCC CGTTTCGTAT CGGGGAACTA TAAAAACAGC CAGCCGAATG
 251  CGGTTGCCCT GTTCCTGAAA AACGCCGAAC CGGGTCAGAA AAACCGCTTT
 301  TTGCGTTATA CGCGTTATGT AAACGCCTCC AATCGGGAAG TTGTCAAGGA
 351  TTTGGAAAAA CAGCAGAAGG CTTTGGCGGT ACAAGAGCAG AAAATCAACA
 401  ATGAGCTTGC CCGTTTGAAG AAAATTCAGG CAAACGTGCA ATCCCTGCTG
 451  AAAAAACAGG GTGTAACCGA TGCGGCGGAA CAGACGGAAA GCCGCAGACA
 501  GAATGCCAAA ATCGCCAAAG ATGCCCGAAA ACTGCTGGAA CAGAAAGGGA
 551  ACGAGCAGCA GCTGAACAAG CTCTTGAGCA ATTTGGAGAA GAAAAAGGCC
 601  GAACACCGCA TTCAGGATGC GGAAGCAAAA AGAAAATTGG CTGAAGCCAG
 651  ACTGGCGGCA GCCGAAAAAG CCAGAAAAGA AGCGGCGCAG CAGAAGGCTG
 701  AAGCACGACG TGCGGAAATG TCCAACCTGA CCGCCGAAGA CAGGAACATC
 751  CAAGCGCCTT CGGTTATGGG TATCGGCAGT GCCGACGGTT TCAGCCGCAT
 801  GCAAGGACGT TTGAAAAAAC CGGTTGACGG TGTGCCGACC GGACTTTTCG
 851  GGCAGAACCG GAGCGGCGGC GATGTTTGGA AAGGCGTGTT CTATTCCACT
 901  GCACCGGCAA CGGTTGAAAG CATTGCGCCG GGAACGGTAA GCTATGCGGA
 951  CGAGTTGGAC GGCTACGGCA AAGTGGTCGT GGTCGATCAC GGCGAGAACT
1001  ACATCAGCAT CTATGCCGGT TTGAGCGAAA TTTCCGTCGG CAAGGGTTAT
1051  ATGGTCGCGG CAGGAAGCAA AATCGGCTCG AGCGGGTCGC TGCCGGACGG
1101  GGAAGAGGGG CTTTACCTGC AAATACGTTA TCAAGGTCAG GTATTGAACC
1151  CTTCGAGCTG GATACGTTGA
```

This corresponds to the amino acid sequence <SEQ ID 1882; ORF 597.a>:

```
a597.pep
   1 MLLHVSNSLK QLQEERIRQE RIRQERIRQA RGNLASVNRK QREAWDKFQK

  51 LNTELNRLKT EVAATKAQIS RFVSGNYKNS QPNAVALFLK NAEPGQKNRF

 101 LRYTRYVNAS NREVVKDLEK QQKALAVQEQ KINNELARLK KIQANVQSLL

 151 KKQGVTDAAE QTESRRQNAK IAKDARKLLE QKGNEQQLNK LLSNLEKKKA

 201 EHRIQDAEAK RKLAEARLAA AEKARKEAAQ QKAEARRAEM SNLTAEDRNI

 251 QAPSVMGIGS ADGFSRMQGR LKKPVDGVPT GLFGQNRSGG DVWKGVFYST

 301 APATVESIAP GTVSYADELD GYGKVVVVDH GENYISIYAG LSEISVGKGY

 351 MVAAGSKIGS SGSLPDGEEG LYLQIRYQGQ VLNPSSWIR*
```

Computer analysis of this amino acid sequence gave the following results:

Homology with a Predicted ORF from *N. meningitidis*

ORF 597 shows 98.5% identity over a 389 aa overlap with a predicted ORF (ORF 597) from *N. meningitidis*

```
m597/a597   98.5% identity in 389 aa overlap

                    10        20        30        40        50        60
a597.pep    MLLHVSNSLKQLQEERIRQERIRQERIRQARGNLASVNRKQREAWDKFQKLNTELNRLKT
            ||||||||||||||||||||||||     |||||||||||||||||||||||||||||||
m597        MLLHVSNSLKQLQEERIRQERIRQ-----ARGNLASVNRKQREAWDKFQKLNTELNRLKT
                    10        20             30        40        50

                    70        80        90       100       110       120
a597.pep    EVAATKAQISRFVSGNYKNSQPNAVALFLKNAEPGQKNRFLRYTRYVNASNREVVKDLEK
            ||||||||||||||||||||||||||||||||||||||||||||||||||||||||||||
m597        EVAATKAQISRFVSGNYKNSQPNAVALFLKNAEPGQKNRFLRYTRYVNASNREVVKDLEK
               60        70        80        90       100       110

                   130       140       150       160       170       180
a597.pep    QQKALAVQEQKINNELARLKKIQANVQSLLKKQGVTDAAEQTESRRQNAKIAKDARKLLE
            ||||||||||||||||||||||||||||||||||||||||||||||||||||||||||||
m597        QQKALAVQEQKINNELARLKKIQANVQSLLKKQGVTDAAEQTESRRQNAKIAKDARKLLE
              120       130       140       150       160       170

                   190       200       210       220       230       240
a597.pep    QKGNEQQLNKLLSNLEKKKAEHRIQDAEAKRKLAEARLAAAEKARKEAAQQKAEARRAEM
            ||||||||||||||||||||||||||||||||||||||||||||||||||||||||||||
m597        QKGNEQQLNKLLSNLEKKKAEHRIQDAEAKRKLAEARLAAAEKARKEAAQQKAEARRAEM
              180       190       200       210       220       230

                   250       260       270       280       290       300
a597.pep    SNLTAEDRNIQAPSVMGIGSADGFSRMQGRLKKPVDGVPTGLFGQNRSGGDVWKGVFYST
            |||||||||||||||||||||||||||||||||||||||||||||||||||:||||||||
m597        SNLTAEDRNIQAPSVMGIGSADGFSRMQGRLKKPVDGVPTGLFGQNRSGGDIWKGVFYST
              240       250       260       270       280       290

                   310       320       330       340       350       360
a597.pep    APATVESIAPGTVSYADELDGYGKVVVVDHGENYISIYAGLSEISVGKGYMVAAGSKIGS
            ||||||||||||||||||||||||||||||||||||||||||||||||||||||||||||
m597        APATVESIAPGTVSYADELDGYGKVVVVDHGENYISIYAGLSEISVGKGYMVAAGSKIGS
              300       310       320       330       340       350

                   370       380       390
a597.pep    SGSLPDGEEGLYLQIRYQGQVLNPSSWIRX
            |||||||||||||||||||||||||||||
m597        SGSLPDGEEGLYLQIRYQGQVLNPSSWIRX
              360       370       380
```

The following partial DNA sequence was identified in *N. gonorrhoeae* <SEQ ID 1883>:

```
g601.seq
   1 ATGTTCCCAA CCGGCAATTT GGTCGACGAA ATTGATGTGC CGAATATAGG

  51 TCGTCTGAAA GCCACGCTCA TCAACGCGGG CATTCCGACC GTTTTCCTGA

 101 ACGCCGCCGA CTTGGGCTAC ACGGGCAAAG AGTTGCAGGA CGACATCAAC
```

-continued

```
151 AACGATGCCG CCGCGCTGGA AAAATTTGAA ACCATCCGCG CATATGGCGC

201 GCTGAAAATG GGTTTGATCA GCGACGTATC CGAAGCCGCC GCCCGCGCGC

251 GCACGCCGAA ACCCGCCTTC GTCGCGCCCG CCGCCGATTA CACCGCCTCC

301 AGCGGCAAAA CCGTAAACGC CGCCGACATC GATTTGCCGG TACGCGCCCT

351 GAGCATGGGC AAACTGCACC ACGCTATGAT GGGCATCGCC TCGGTCGCCA

401 TCGCCGCCGC CGTGCTCGGT ACGCTGGTCA ACCTTGCCGC AGGCGGCGGA

451 ACGCGTAAAG AAGTGCGCTT CGGGCATCCG TCAGGTACGC TGCGTGTCGG

501 TGCTGCCGCC GAATGTCAGG ACGGACAATG GACGGCCGCc aaagcggtca

551 tgaGCCGCAG CGCACgcgtg attatggaaa gttgGGTGCg cgttcccgat

601 gattGTTTTT GA
```

This corresponds to the amino acid sequence <SEQ ID 1884; ORF 601.ng>:

```
g601.pep
   1 MFPTGNLVDE IDVPNIGRLK ATLINAGIPT VFLNAADLGY TGKELQDDIN

  51 NDAAALEKFE TIRAYGALKM GLISDVSEAA ARARTPKPAF VAPAADYTAS

 101 SGKTVNAADI DLPVRALSMG KLHHAMMGIA SVAIAAAVLG TLVNLAAGGG

 151 TRKEVRFGHP SGTLRVGAAA ECQDGQWTAA KAVMSRSARV IMESWVRVPD

 201 DCF*
```

The following partial DNA sequence was identified in *N. meningitidis* <SEQ ID 1885>:

```
m601.seq
   1 ATGTTCCCAA CCGGCAATTT GGTCGATGAA ATTGATGTGC CGAATATAGG

  51 CCGTTTGAAA GCCACGCTCA TCAACGCGGG CATTCCGACC GTTTTCTTGA

 101 ATGCCGCCGA CTTGGGCTAC ACAGGCAAAG AGTTGCAAGA CGACATCAAC

 151 AACGATGCCG CGGCTTTGGA AAAATTCGAG AAAATCCGCG CTTACGGTGC

 201 GCTGAAAATG GGTCTGATCA GCGACGTATC CGAAGCTGCC GCTCGCGCGC

 251 ACACGCCGAA AGTCGCCTTC GTCGCGCCCG CCGCCGATTA CACCGCCTCC

 301 AGTGGCAAAA CCGTGAACGC CGCCGACATC GATTTGCTGG TACGCGCCCT

 351 GAGCATGGGC AAACTGCACC ACGCGATGAT GGGTACCGCC TCTGTTGCCA

 401 TTGCGACCGC CGCCGCCGTA CCCGGTACGC TGGTCAACCT TGCCGCAGGC

 451 GGCGGAACGC GTAAAGAAGT GCGCTTCGGG CATCCTTCCG GCACATTGCG

 501 CGTCGGTGCA GCCGCCGAAT GTCAGGACGG ACAATGGACG GCCACCAAAG

 551 CGGTCATGAG CCGTAGCGCA CGCGTGATGA TGGAAGGTTG GGTCAGGGTG

 601 CCTGAGGATT GTTTTTAA
```

This corresponds to the amino acid sequence <SEQ ID 1886; ORF 601>:

```
m601.pep
   1 MFPTGNLVDE IDVPNIGRLK ATLINAGIPT VFLNAADLGY TGKELQDDIN

  51 NDAAALEKFE KIRAYGALKM GLISDVSEAA ARAHTPKVAF VAPAADYTAS

 101 SGKTVNAADI DLLVRALSMG KLHHAMMGTA SVAIATAAAV PGTLVNLAAG
```

-continued

```
151 GGTRKEVRFG HPSGTLRVGA AAECQDGQWT ATKAVMSRSA RVMMEGWVRV

201 PEDCF*
```

Computer analysis of this amino acid sequence gave the following results:

Homology with a Predicted ORF from *N. gonorrhoeae*

ORF 601 shows 94.1% identity over a 205 aa overlap with a predicted ORF (ORF 601.ng) from *N. gonorrhoeae*:

```
m601/g601

                    10        20        30        40        50        60
m601.pep    MFPTGNLVDEIDVPNIGRLKATLINAGIPTVFLNAADLGYTGKELQDDINNDAAALEKFE
            ||||||||||||||||||||||||||||||||||||||||||||||||||||||||||||
g601        MFPTGNLVDEIDVPNIGRLKATLINAGIPTVFLNAADLGYTGKELQDDINNDAAALEKFE
                    10        20        30        40        50        60

                    70        80        90       100       110       120
m601.pep    KIRAYGALKMGLISDVSEAAARAHTPKVAFVAPAADYTASSGKTVNAADIDLLVRALSMG
             ||||||||||||||||||||||:||| |||||||||||||||||||||||| |||||||
g601        TIRAYGALKMGLISDVSEAAARARTPKPAFVAPAADYTASSGKTVNAADIDLPVRALSMG
                    70        80        90       100       110       120

                   130       140       150       160       170       180
m601.pep    KLHHAMMGTASVAIATAAAVPGTLVNLAAGGGTRKEVRFGHPSGTLRVGAAAECQDGQWT
            |||||||| |||||  |||| |||||||||||||||||||||||||||||||||||||||
g601        KLHHAMMGIASVAI--AAAVLGTLVNLAAGGGTRKEVRFGHPSGTLRVGAAAECQDGQWT
                   130         140       150       160       170

                   190       200
m601.pep    ATKAVMSRSARVMMEGWVRVPEDCFX
            |:||||||||||:||:|||||:||||
g601        AAKAVMSRSARVIMESWVRVPDDCFX
          180       190       200
```

The following partial DNA sequence was identified in *N. meningitidis* <SEQ ID 1887>:

```
a601.seq
  1 ATGTTCCCAA CCGGCAATTT GGTCGATGAA ATTGATGTGC CGAATATAGG

 51 CCGTTTGAAA GCCACGCTCA TCAACGCGGG CATTCCGACC GTTTTCCTGA

101 ATGCCGCCGA CTTGGGCTAC ACGGGCAAAG AGTTGCAAGA CGACATCAAC

151 AACGATGCCG CAGCTTTGGA AAAATTCGAG AAAATCCGCG CTTACGGTGC

201 GCTGAAAATG GGTCTGATCA GCGACGTATC CGAAGCTGCC GCCCGCGCGC

251 ACACGCCGAA AGTCGCCTTC GTCGCGCCCG CCGCCGATTA CACCGCCTCC

301 AGTGGCAAAA CCGTGAATGC CGCCGACATC GATTTGCTGG TACGCGCCCT

351 GAGCATGGGC AAATTGCACC ACGCGATGAT GGGTACCGCC TCTGTTGCCA

401 TTGCGACCGC CGCCGCCGTG CCCGGTACGC TGGTCAACCT TGCCGCAGGC

451 GGCGGAACGC GTAAAGAAGT GCGCTTCGGG CATCCTTCCG GCACATTGCG

501 CGTCGGTGCA GCCGCCGAAT GTCAGGACGG ACAATGGACG GCCACCAAAG

551 CGGTTATGAG CCGCAGCGCA CGCGTGATGA TGGAAGGTTG GGTCAGGGTG

601 CCGGAAGATT GTTTTTAA
```

This corresponds to the amino acid sequence <SEQ ID 1888; ORF 601.a>:

```
a601.pep
  1 MFPTGNLVDE IDVPNIGRLK ATLINAGIPT VFLNAADLGY TGKELQDDIN

 51 NDAAALEKFE KIRAYGALKM GLISDVSEAA ARAHTPKVAF VAPAADYTAS

101 SGKTVNAADI DLLVRALSMG KLHHAMMGTA SVAIATAAAV PGTLVNLAAG
```

-continued

```
151 GGTRKEVRFG HPSGTLRVGA AAECQDGQWT ATKAVMSRSA RVMMEGWVRV

201 PEDCF*
```

m601/a601 100.0% identity in 205 aa overlap

```
                    10        20        30        40        50        60
m601.pep    MFPTGNLVDEIDVPNIGRLKATLINAGIPTVFLNAADLGYTGKELQDDINNDAAALEKFE
            ||||||||||||||||||||||||||||||||||||||||||||||||||||||||||||
a601        MFPTGNLVDEIDVPNIGRLKATLINAGIPTVFLNAADLGYTGKELQDDINNDAAALEKFE
                    10        20        30        40        50        60

                    70        80        90       100       110       120
m601.pep    KIRAYGALKMGLISDVSEAAARAHTPKVAFVAPAADYTASSGKTVNAADIDLLVRALSMG
            ||||||||||||||||||||||||||||||||||||||||||||||||||||||||||||
a601        KIRAYGALKMGLISDVSEAAARAHTPKVAFVAPAADYTASSGKTVNAADIDLLVRALSMG
                    70        80        90       100       110       120

                   130       140       150       160       170       180
m601.pep    KLHHAMMGTASVAIATAAAVPGTLVNLAAGGGTRKEVRFGHPSGTLRVGAAAECQDGQWT
            ||||||||||||||||||||||||||||||||||||||||||||||||||||||||||||
a601        KLHHAMMGTASVAIATAAAVPGTLVNLAAGGGTRKEVRFGHPSGTLRVGAAAECQDGQWT
                   130       140       150       160       170       180

                   190       200
m601.pep    ATKAVMSRSARVMMEGWVRVPEDCFX
            ||||||||||||||||||||||||||
a601        ATKAVMSRSARVMMEGWVRVPEDCFX
                   190       200
```

The following partial DNA sequence was identified in *N. gonorrhoeae* <SEQ ID 1889>:

```
g602.seq
   1 ATGTTGCTCC ATCAATGCGA CAAAGCGCGA CATATGCGTC CCTTTCTGCT

  51 CGGCGGGCAG ATAAACCGTC ATCGTCAGGC GAGCAACCGT GGATTGTGTT

 101 CCTTCGGCGG TTTTCAGGGT AATCGGGAAG CGCAGGTCTT TAATGCCGAC

 151 CTGATTGATC GGCAGGTTGC GCAAATCTCT GCTGGATTGC ACGTCTGCAA

 201 TGGCGTTCAT GCGTTGTTTG TCCTTAATAT TCAGATAATT ATTGAGATGT

 251 GTGTATTGTA TGGCAGGcag atgccgtctg aAAAAacgct gtcggCCGCC

 301 TGCCTGCAAA TgcgagattA TATCACTTGC TTTtggcgGC TGCATTGA
```

This corresponds to the amino acid sequence <SEQ ID 1890; ORF 602.ng>:

```
g602.pep
   1 MLLHQCDKAR HMRPFLLGGQ INRHRQASNR GLCSFGGFQG NREAQVFNAD

  51 LIDRQVAQIS AGLHVCNGVH ALFVLNIQII IEMCVLYGRQ MPSEKTLSAA

 101 CLQMRDYITC FWRLH*
```

The following partial DNA sequence was identified in *N. meningitidis* <SEQ ID 1891>:

```
m602.seq
   1 ATGTTGCTCC ATCAATGCGA CAAAACGCGA CATATGCGTC CCCTTCTGCT

  51 CAGCAGGCAG GTAAACCGTC ATGGTCAGAC GGGCAATGGT GGACTGGATG

 101 CCTTCTGCAG TTTGCAGGGT AATCGGAAAG CGCAGGTCTT TGATACCGAC

 151 CTGATTGATC GGCAGATTGC GCAAATCTCG GCTGGATTGC ACGTCTGCAA

 201 TAGTGTTCAT GAGTTGTTTT TCCTTAATAT TCATGTAATT GTTGAGATGT
```

-continued

```
251 GTGCATGGTA TGGCGTTTCC GCCGGGGAAT ATACCGTCAA TCTGCAAATG

301 CGAGATTATA TCACTCGCTT TTAGCAGCTG CATTGA
```

This corresponds to the amino acid sequence <SEQ ID 1892; ORF 602>:

```
m602.pep

      1   MLLHQCDKTR HMRPLLLSRQ VNRHGQTGNG GLDAFCSLQG NRKAQVFDTD

     51   LIDRQIAQIS AGLHVCNSVH ELFFLNIHVI VEMCAWYGVS AGEYTVNLQM

    101   RDYITRF*QL H*
m595/a595  65.2% identity in 115 aa overlap

                   10        20        30        40        50        60
m602.pep   MLLHQCDKTRHMRPLLLSRQVNRHGQTGNGGLDAFCSLQGNRKAQVFDTDLIDRQIAQIS
           ||||||||:|||||:||:  |:||| |::| || :|  ::||||:||||::||||||:||||
           MLLHQCDKARHMRPFLLGGQINRHRQASNRGLCSFGGFQGNREAQVFNADLIDRQVAQIS
                   10        20        30        40        50        60

                   70        80        90           100       110
m602.pep   AGLHVCNSVHELFFLNIHVIVEMCAWYGVSA-GEYTVN---LQMRDYITRFXQLHX
           |||||||:|| || |||::|:|||: ||   : :| |::   |||||||| | :|||
           AGLHVCNGVHALFVLNIQIIIEMCVLYGRQMPSEKTLSAACLQMRDYITCFWRLHX
                   70        80        90       100       110
```

The following partial DNA sequence was identified in *N. meningitidis* <SEQ ID 1893>:

```
a602.seq
  1 ATGTTGCTCC ATCAATGCGA CAAAGCGCGA CATATGCGTA CCCTTCTGCT

 51 CGGCAGGCAG GTAAACCGTC ATGGTCAGAC GGGCAACTGT GGACTGGATG

101 CCTTCTGCAG TTTGCAGGGT AATCGGAAAG CGCAGGTCTT TGATACCGAC

151 CTGATTGATC GGCAGATTGC GCAAATCTCG GCTGGATTGC ACGTCTGCAA

201 TAGTGTTCAT GAGTTGTTTT TCCTTAATAT TCATGTAATT GTTGAGATGT

251 GTGCATGGTA TGGCGTTTCC ACCGGGGAAT ATACCGTCAA TCTGCAAATG

301 CGAGATTATA TCACTCGCTT TTAGCAGCTG CATTGA
```

This corresponds to the amino acid sequence <SEQ ID 1894; ORF 602.a>:

```
m602.pep

      1   MLLHQCDKAR HMRTLLLGRQ VNRHGQTGNC GLDAFCSLQG NRKAQVFDTD

     51   LIDRQIAQIS AGLHVCNSVH ELFFLNIHVI VEMCAWYGVS TGEYTVNLQM

    101   RDYITRF*QL H*

m602/a602  95.5% identity in 111 aa overlap

                   10        20        30        40        50        60
m602.pep   MLLHQCDKTRHMRPLLLSRQVNRHGQTGNGGLDAFCSLQGNRKAQVFDTDLIDRQIAQIS
           ||||||||:|||| |||:||||||||||| |||||||||||||||||||||||||||||
a602       MLLHQCDKARHMRTLLLGRQVNRHGQTGNCGLDAFCSLQGNRKAQVFDTDLIDRQIAQIS
                   10        20        30        40        50        60

                   70        80        90       100       110
m602.pep   AGLHVCNSVHELFFLNIHVIVEMCAWYGVSAGEYTVNLQMRDYITRFXQLHX
           ||||||||||||||||||||||||||||||:|||||||||||||||||||||
a602       AGLHVCNSVHELFFLNIHVIVEMCAWYGVSTGEYTVNLQMRDYITRFXQLHX
                   70        80        90       100       110
```

The following partial DNA sequence was identified in *N. gonorrhoeae* <SEQ ID 1895>:

```
g603.seq
     1  ATGGATTCCC GCCTGCGTGG GAATGACGCT AGGAAATACG GCATACGCTT
    51  TGCCCAAAGA GGCCGTCTGA AACACACTCC GCCCAACGCC CATCCTTTTT
   101  CAGACGGCCC CGCACCAAAA AAACAACCAC AAACTACAAG GAGAAACATC
   151  ATGTCCGACC AACTCATTCT TGTCCTGAAC TGCGTCAGTT CATCGCTCAA
   201  AGGCGCCGTT ATCGACCGCA AAAGCGGCAG CGTCGTCCTA AGCTGCCTCG
   251  GGGAACGCCT GACTACGCCC GAAGCCGTCA TTACCTTCAA CAAAGACGGC
   301  AACAAACGCC AAGTTCCCCT GAGCGGCCGC AACTGCCACG CCGGCGCGGT
   351  GGGTATGCTG TTGAACGAAC TGGAAAAACA CGGACTGCAC GACCGCATCA
   401  AAGCCATCGG CCGCCGCATC GCCCACGGCG GCGAAAAATA TCACGAGTCC
   451  GTCCTCATCG ACCAAGACGT CCTTGACGAA CTGAAAGCCT GCATCCCGTT
   501  CGCCCCGCTG CACAACCCCG CCAACATCAG CGGCATCCTC GCCGCGCAGG
   551  AACACTTTCC CGGCCTGCCC AACGTCGGCG TGATGGACAC CTCGTTCCAC
   601  CAAACCATGC CGGAGCGGGC CTACACTTAT GCCGTGCCGC GCGAATTGCG
   651  CAAAAAATAC GCCTTCCGCC GCTACGGTTT CCACGGTACC GGTATGCGTT
   701  ACGTCGCCCC TGAAGCCGCA CGCATCTTGG GCAAACCTct ggaaGACATC
   751  CGCATGATTA TTGCCCACTT AGGCAACGGC GCATCTATTA CCGCCGTCAA
   801  AAACGGCAAA TCCGTCGATA CCGGTATGGG TTTCACGCCG ATCGAAGGTT
   851  TGGTAATGGG TACACGTTGC GGCGACACCG ATCCGGGCGT ATACAGCTAT
   901  CCGACTTTCC ACGCAGGGAT GGATGTTGCC CAAGTTGATG AAATGCTGAA
   951  CGAAAAATCA GGTTTCCCCG GTATTTCcgA actTCCCAAC GACTGCCGCA
  1001  CCCTCGAAAT CGCCGCCGAC GAAGGCCGCG AAGGCGCGCG CCTCGCCCTc
  1051  gaAGTCATGA CCTGCCGCCT CGCCAAATAC ATCGCTTCGA TGGCTGTGGC
  1101  CTGCGGCAGT GTTGACGCAC TCGTGTTCAC CGGCGGTATC GGCGAAAACT
  1151  CGCGTAATAT CCGTGCCAAA ACCGTTTCCT ATCTTGATTT CTTGGGTCTG
  1201  CACATCGACA CCAAAGCCAA TATGGAAAAA CGCTACGGCA ATTCGGGCAT
  1251  TATCAGCCCG ACCGATTCTT CTCCGGCTGT TTTGGTCGTC CCGACCAATG
  1301  AAGAACTGAT GATTGCCTGC GACACTGCCG AACTTGCCGG CATCTTGTAG
```

This corresponds to the amino acid sequence <SEQ ID 1896; ORF 603.ng>:

```
g603.pep
     1  MDSRLRGNDA RKYGIRFAQR GRLKHTPPNA HPFSDGPAPK KQPQTTRRNI
    51  MSDQLILVLN CVSSSLKGAV IDRKSGSVVL SCLGERLTTP EAVITFNKDG
   101  NKRQVPLSGR NCHAGAVGML LNELEKHGLH DRIKAIGRRI AHGGEKYHES
   151  VLIDQDVLDE LKACIPFAPL HNPANISGIL AAQEHFPGLP NVGVMDTSFH
   201  QTMPERAYTY AVPRELRKKY AFRRYGFHGT GMRYVAPEAA RILGKPLEDI
   251  RMIIAHLGNG ASITAVKNGK SVDTGMGFTP IEGLVMGTRC GDTDPGVYSY
   301  PTFHAGMDVA QVDEMLNEKS GFPGISELPN DCRTLEIAAD EGREGARLAL
```

-continued

351 EVMTCRLAKY IASMAVACGS VDALVFTGGI GENSRNIRAK TVSYLDFLGL

401 HIDTKANMEK RYGNSGIISP TDSSPAVLVV PTNEELMIAC DTAELAGIL*

The following partial DNA sequence was identified in *N. meningitidis* <SEQ ID 1897>:

```
m603.seq
     1  CTGTCCTCGC GTAGGCGGGG ACGGAATAAC GATAGAAAAT GCGGCATACG
    51  CTTTGCCCAA AGAGGCCGTC TGAAACACCT TGCGCCTGAT GTCTGC.CTT
   101  TTTCAGACGA CCCCACACTA AAAAAACAAC CACAAACTAC AAGGAGAAAC
   151  ATCATGTCCG ACCAACTCAT CCTCGTTCTG AACTGCGGCA GTTCATCGCT
   201  CAAAGGCGCC GTTATCGACC GAmAAAGCGG CAGCGTCGTC CTAAGCTGCC
   251  TCGGCGAACG cCtGACCACG CCCGAAGCCG TCATTACGTT CAACAAAGAC
   301  GGCAACAAAC GCCAAGTTCC CCTGAGCGGC CGAAATTGCC ACGCCGGCGC
   351  GGTGGGTATG CTTTTGAACG AACTGGAAAA ACACGGTCTG CACGACCGCA
   401  TCAAAGCCAT CGGCCACCGC ATCGCCCACG GCGGCGAAAA ATACAGCGAG
   451  TCTGTTTTGA TCGACCAGGC CGTAATGGAC GAACTCAATG CCTGCATTCC
   501  GCTTGCGCCG CTGCACAACC CCGCCAACAT CAGCGGCATC CTTGCCGCAC
   551  AGGAACATTT CCCCGGTCTG CCCAATGTCG GCGTGATGGA TACTTCGTTC
   601  CACCAAACCA TGCCGGAGCG TGCCTACACT TATGCCGTGC CGCGCGAGTT
   651  GCGTAAAAAA TACGCTTTCC GCCGCTACGG TTTCCACGGC ACCAGTATGC
   701  GTTACGTTGC CCCTGAAGCC GCACGCATCT TGGGCAAACC TCTGGAAGAC
   751  ATCCGCATGA TTATTGCCCA CTTAGGCAAC GGCGCATCCA TTACCGCCAT
   801  CAAAAACGGC AAATCCGTCG ATACCAGTAT GGGTTTCACG CCGATCGAAG
   851  GTTTGGTAAT GGGTACACGT TGCGGCGACA TCGATCCGGG CGTATACAGC
   901  TATCTGACTT CCCACGCCGG GATGGATGTT GCCCAAGTGG ATGAAATGCT
   951  GAACAAAAAA TCAGGTTTGC TCGGTATTTC CGAACTTTCC AACGACTGCC
  1001  GCACCCTCGA AATCGCCGCC GACGAAGGCC ACGAAGGCGC GCGCCTCGCC
  1051  CTCGAAGTCA TGACCTACCG CCTCGCCAAA TACATCGCTT CGATGGCTGT
  1101  GGGCTGCGGC GGCGTTGACG CACTCGTGTT CACCGGCGGT ATCGGCGAAA
  1151  ACTCGCGTAA TATCCGTGCC AAAACCGTTT CCTATCTTGA TTTCTTGGGT
  1201  CTGCACATCG ACACCAAAGC CAATATGGAA AAACGCTACG GCAATTCGGG
  1251  CATTATCAGC CCGACCGATT CTTCTCCGGC TGTTTTGGTT GTCCCGACCA
  1301  ATGAAGAACT GATGATTGCC TGCGACACTG CCGAACTTGC CGGCATCTTG
  1351  TAG
```

This corresponds to the amino acid sequence <SEQ ID 1898; ORF 603>:

```
m603.pep
    1 LSSRRRGRNN DRKCGIRFAQ RGRLKHLAPD VCXFSDDPTL KKQPQTTRRN
   51 IMSDQLILVL NCGSSSLKGA VIDRXSGSVV LSCLGERLTT PEAVITFNKD
  101 GNKRQVPLSG RNCHAGAVGM LLNELEKHGL HDRIKAIGHR IAHGGEKYSE
  151 SVLIDQAVMD ELNACIPLAP LHNPANISGI LAAQEHFPGL PNVGVMDTSF
```

-continued

```
201 HQTMPERAYT YAVPRELRKK YAFRRYGFHG TSMRYVAPEA ARILGKPLED

251 IRMIIAHLGN GASITAIKNG KSVDTSMGFT PIEGLVMGTR CGDIDPGVYS

301 YLTSHAGMDV AQVDEMLNKK SGLLGISELS NDCRTLEIAA DEGHEGARLA

351 LEVMTYRLAK YIASMAVGCG GVDALVFTGG IGENSRNIRA KTVSYLDFLG

401 LHIDTKANME KRYGNSGIIS PTDSSPAVLV VPTNEELMIA CDTAELAGIL

451 *
```

Computer analysis of this amino acid sequence gave the following results:

Homology with a Predicted ORF from *N. gonorrhoeae*

ORF 603 shows 91.6% identity over a 450 aa overlap with a predicted ORF (ORF 603.ng) from *N. gonorrhoeae*:

```
m603/g603

                    10        20        30        40        50        60
m603.pep    LSSRRRGRNNDRKCGIRFAQRGRLKHLAPDVCXFSDDPTLKKQPQTTRRNIMSDQLILVL
            ::|| || |: || ||||||||||||  |::  ||| |: ||||||||||||||||||||
g603        MDSRLRG-NDARKYGIRFAQRGRLKHTPPNAHPFSDGPAPKKQPQTTRRNIMSDQLILVL
                     10        20        30        40        50

                    70        80        90       100       110       120
m603.pep    NCGSSSLKGAVIDRXSGSVVLSCLGERLTTPEAVITFNKDGNKRQVPLSGRNCHAGAVGM
            || |||||||||| ||||||||||||||||||||||||||||||||||||||||||||||
g603        NCVSSSLKGAVIDRKSGSVVLSCLGERLTTPEAVITFNKDGNKRQVPLSGRNCHAGAVGM
          60        70        80        90       100       110

                   130       140       150       160       170       180
m603.pep    LLNELEKHGLHDRIKAIGHRIAHGGEKYSESVLIDQAVMDELNACIPLAPLHNPANISGI
            |||||||||||||||||:|||||||||| ||||||| |:|||:||||:||||||||||||
g603        LLNELEKHGLHDRIKAIGRRIAHGGEKYHESVLIDQDVLDELKACIPFAPLHNPANISGI
         120       130       140       150       160       170

                   190       200       210       220       230       240
m603.pep    LAAQEHFPGLPNVGVMDTSFHQTMPERAYTYAVPRELRKKYAFRRYGFHGTSMRYVAPEA
            ||||||||||||||||||||||||||||||||||||||||||||||||||:|||||||||
g603        LAAQEHFPGLPNVGVMDTSFHQTMPERAYTYAVPRELRKKYAFRRYGFHGTGMRYVAPEA
         180       190       200       210       220       230

                   250       260       270       280       290       300
m603.pep    ARILGKPLEDIRMIIAHLGNGASITAIKNGKSVDTSMGFTPIEGLVMGTRCGDIDPGVYS
            ||||||||||||||||||||||||||:||||||||:|||||||||||||||||| ||||||
g603        ARILGKPLEDIRMIIAHLGNGASITAVKNGKSVDTGMGFTPIEGLVMGTRCGDTDPGVYS
         240       250       260       270       280       290

                   310       320       330       340       350       360
m603.pep    YLTSHAGMDVAQVDEMLNKKSGLLGISELSNDCRTLEIAADEGHEGARLALEVMTYRLAK
            | | ||||||||||||||:|||: ||||| ||||||||||||||:|||||||||| ||||
g603        YPTFHAGMDVAQVDEMLNEKSGFPGISELPNDCRTLEIAADEGREGARLALEVMTCRLAK
         300       310       320       330       340       350

                   370       380       390       400       410       420
m603.pep    YIASMAVGCGGVDALVFTGGIGENSRNIRAKTVSYLDFLGLHIDTKANMEKRYGNSGIIS
            ||||||:||:||||||||||||||||||||||||||||||||||||||||||||||||||
g603        YIASMAVACGSVDALVFTGGIGENSRNIRAKTVSYLDFLGLHIDTKANMEKRYGNSCIIS
         360       370       380       390       400       410

                   430       440       450
m603.pep    PTDSSPAVLVVPTNEELMIACDTAELAGILX
            |||||||||||||||||||||||||||||||
g603        PTDSSPAVLVVPTNEELMIACDTAELAGILX
         420       430       440       450
```

The following partial DNA sequence was identified in *N. meningitidis* <SEQ ID 1899>:

```
a603.seq
   1  CTGTCCTCGC GTAGGCGGGG ACGGAATAAC GATAGAAAAT GCGGCATACG

  51  CTTTGCCCAA AGAGGCCGTC TGAAACACAC TCCGCCCAAC GCCCATCCTT

 101  TTTCAGACGA CCCCACACC. AAAAAACAAC CACAAACTAC AAGGAGAAAC

 151  ATCATGTCCG ACCAACTCAT TCTTGTTCTG AACTGCGGCA GTTCATCGCT

 201  CAAAGGTGCC GTTATCGACC GCAAAAGCGG CAGCGTCGTC CTAAGCTGCC
```

-continued

```
 251 TCGGCGAACG CCTGACCACG CCCGAAGCCG TCATTACGTT CAGCAAAGAC
 301 GGCAACAAAC GCCAAGTTCC CCTGAGCGGC CGGAACTGCC ACGCCGGCGC
 351 GGTGGGTATG CTGTTGAACG AACTGGAAAA ACACGAACTG CACGACCGCA
 401 TTCAAGCCGT CGGCCACCGC ATCGCCCACG GCGGCGAAAA ATACAGCGAG
 451 TCTGTTTTGA TCGACCAGGC CGTAATGGAC GAACTCAATG CCTGCATTCC
 501 GCTTGCGCCG CTGCACAACC CCGCCAACAT CAGCGGCATC CTCGCCGCAC
 551 AGGAACATTT CCCCGGTCTG CCCAATGTCG GCGTGATGGA TACTTCGTTC
 601 CACCAAACCA TGCCGGAGCG TGCCTACACT TATGCCGTGC CGCGCGAGTT
 651 GCGTAAAAAA TACGCTTTCC GCCGCTACGG TTTCCACGGC ACCAGTATGC
 701 GTTACGTTGC CCCTGAAGCC GCATGCATCT TGGGCAAACC TCTGGAAGAC
 751 ATCCGCATGA TTATTGCCCA CTTAGGCAAC GGCGCATCCA TTACCGCCAT
 801 CAAAAACGGC AAATCCGTCG ATACCAGTAT GGGTTTCACG CCGATCGAAG
 851 GTTTGGTAAT GGGTACGCGC TGCGGCGATA TCGACCCGGG CGTATACAGC
 901 TATCTGACTT CACACGCCGG TTTGGATGTT GCACAAGTTG ATGAAATGCT
 951 GAATAAAAAA TCAGGCTTGC TCGGTATTTC CGAACTCTCC AACGACTGCC
1001 GCACCCTCGA AATCGCCGCC GACGAAGGCC ACGAAGGCGC GCGCCTCGCC
1051 CTCGAAGTTA TGACCTACCG CCTCGCCAAA TACATCGCTT CGATGGCTGT
1101 GGGCTGCGGC GGCGTTGACG CACTCGTGTT CACCGGCGGT ATCGGCGAAA
1151 ACTCGCGTAA TATCCGTGCC AAAACCGTTT CCTATCTTGA TTTCTTGGGT
1201 CTGCACATCG ACACCAAAGC CAATATGGAA AAACGCTACG GCAATTCGGG
1251 TATTATCAGC CCGACCGATT CTTCTCCGGC TGTTTTGGTT GTCCCGACCA
1301 ATGAAGAACT GATGATTGCC TGCGACACTG CCGAACTTGT CGGCATCTTG
1351 TAG
```

This corresponds to the amino acid sequence <SEQ ID 1900; *ORF* 603.a>:

```
a603.pep
   1 LSSRRRGRNN DRKCGIRFAQ RGRLKHTPPN AHPFSDDPTX KKQPQTTRRN

  51 IMSDQLILVL NCGSSSLKGA VIDRKSGSVV LSCLGERLTT PEAVITFSKD

 101 GNKRQVPLSG RNCHAGAVGM LLNELEKHEL HDRIQAVGHR IAHGGEKYSE

 151 SVLIDQAVMD ELNACIPLAP LHNPANISGI LAAQEHFPGL PNVGVMDTSF

 201 HQTMPERAYT YAVPRELRKK YAFRRYGFHG TSMRYVAPEA ACILGKPLED

 251 IRMIIAHLGN GASITAIKNG KSVDTSMGFT PIEGLVMGTR CGDIDPGVYS

 301 YLTSHAGLDV AQVDEMLNKK SGLLGISELS NDCRTLEIAA DEGHEGARLA

 351 LEVMTYRLAK YIASMAVGCG GVDALVFTGG IGENSRNIRA KTVSYLDFLG

 401 LHIDTKANME KRYGNSGIIS PTDSSPAVLV VPTNEELMIA CDTAELVGIL

 451 *
```

m603/a603 96.7% identity in 450 aa overlap

```
                    10        20        30        40        50        60
m603.pep    LSSRRRGRNNDRKCGIRFAQRGRLKHLAPDVCXFSDDPTLKKQPQTTRRNIMSDQLILVL
            ||||||||||||||||||||||||||  |::  |||||| |||||||||||||||||||
a603        LSSRRRGRNNDRKCGIRFAQRGRLKHTPPNAHPCXFSDDXTLKKQPQTTRRNIMSDQLILVL
                    10        20        30        40        50        60

                    70        80        90       100       110       120
m603.pep    NCGSSSLKGAVIDRXSGSVVLSCLGERLTTPEAVITFNKDGNKRQVPLSGRNCHAGAVGM
            |||||||||||||| ||||||||||||||||||||||:||||||||||||||||||||||
a603        NCGSSSLKGAVIDRKSGSVVLSCLGERLTTPEAVITFSKDGNKRQVPLSGRNCHAGAVGM
                    70        80        90       100       110       120

                   130       140       150       160       170       180
m603.pep    LLNELEKHGLHDRIKAIGHRIAHGGEKYSESVLIDQAVMDELNACIPLAPLHNPANISGI
            ||||||||||||||:|||||||||||||||||||||||||||||||||||||||||||||
a603        LLNELEKHGLHDRIVAIGHRIAHGGEKYSESVLIDQAVMDELNACIPLAPLHNPANISGI
                   130       140       150       160       170       180

                   190       200       210       220       230       240
m603.pep    LAAQEHFPGLPNVGVMDTSFHQTMPERAYTYAVPRELRKKYAFRRYGFHGTSMRYVAPEA
            ||||||||||||||||||||||||||||||||||||||||||||||||||||||||||||
a603        LAAQEHFPGLPNVGVMDTSFHQTMPERAYTYAVPRELRKKYAFRRYGFHGTSMRYVAPEA
                   190       200       210       220       230       240

                   250       260       270       280       290       300
m603.pep    ARILGKPLEDIRMIIAHLGNGASITAIKNGKSVDTSMGFTPIEGLVMGTRCGDIDPGVYS
            | ||||||||||||||||||||||||||||||||||||||||||||||||||||||||||
a603        ACILGKPLEDIRMIIAHLGNGASITAIKNGKSVDTSMGFTPIEGLVMGTRCGDIDPGVYS
                   250       260       270       280       290       300

                   310       320       330       340       350       360
m603.pep    YLTSHAGMDVAQVDEMLNKKSGLLGISELSNDCRTLEIAADEGHEGARLALEVMTYRLAK
            |||||||:||||||||||||||||||||||||||||||||||||||||||||||||||||
a603        YLTSHAGLDVAQVDEMLNKKSGLLGISELSNDCRTLEIAADEGHEGARLALEVMTYRLAK
                   310       320       330       340       350       360

                   370       380       390       400       410       420
m603.pep    YIASMAVGCGGVDALVFTGGIGENSRNIRAKTVSYLDFLGLHIDTKANMEKRYGNSGIIS
            ||||||||||||||||||||||||||||||||||||||||||||||||||||||||||||
a603        YIASMAVGCGGVDALVFTGGIGENSRNIRAKTVSYLDFLGLHIDTKANMEKRYGNSGIIS
                   370       380       390       400       410       420

                   430       440       450
m603.pep    PTDSSPAVLVVPTNEELMIACDTAELAGILX
            ||||||||||||||||||||||||||:||||
a603        PTDSSPAVLVVPTNEELMIACDTAELVGILX
                   430       440       450
```

The following partial DNA sequence was identified in *N. gonorrhoeae* <SEQ ID 1901>:

```
g604.seq
   1 ATGCCCGAAG CGCACTTCTT TACGCGTTCC GCCGCCTGCG GCAAGGTTGA

  51 CCAGCGTACC GAGCACGGCG GCGGCGATGG CGACCGAGGC GATGCCCATC

 101 ATAGCGTGGT GCAGTTTGCC CATGCTCAGG GCGCGTACCG GCAAATCGAT

 151 GTCGGCGGCG TTTACGGTTT TGCCGCTGGA GGCGGTGTAA TCGGCGGCGG

 201 GCGCGACGAA GGCGGGTTTC GGCGTGCGCG CGCGGGCGGC GGCTTCGGAT

 251 ACGTCGCTGA TCAAACCCAT TTTCAGCGCG CCATATGCGC GGATGGTTTC

 301 AAATTTTTCC AGCGCGGCGG CATCGTTGTT GATGTCGTCC TGCAACTCTT

 351 TGCCCGTGTA GCCCAAGTCG GCGGCGTTCA GGAAAACGGT CGGAATGCCC

 401 GCGTTGATGA GCGTGGCTTT CAGACGACCT ATATTCGGCA CATCAATTTC

 451 GTCGACCAAA TTGCCGGTTG GGAACATACT GCCTTcgcCG TCGGCTGGAT

 501 CTAA
```

This corresponds to the amino acid sequence <SEQ ID 1902; *ORF* 604.ng>:

```
g604.pep
   1 MPEAHFFTRS AACGKVDQRT EHGGGDGDRG DAHHSVVQFA HAQGAYRQID

  51 VGGVYGFAAG GGVIGGGRDE GGFRRARAGG GFGYVADQTH FQRAICADGF
```

-continued

```
101 KFFQRGGIVV DVVLQLFARV AQVGGVQENG RNARVDERGF QTTYIRHINF

151 VDQIAGWEHT AFAVGWI*
```

The following partial DNA sequence was identified in *N. meningitidis* <SEQ ID 1903>:

```
m604.seq
  1 ATGCCCGAAG CGCACTTCTT TACGCGTTCC GCCGCCTGCG GCAAGGTTGA

 51 CCAGCGTACC GGGTACGGCG GCGGCGGTCG CAATGGCAAC AGAGGCGGTA

101 CCCATCATCG CGTGGTGCAG TTTGCCCATG CTCAGGGCGC GTACCAGCAA

151 ATCGATGTCG GCGGCGTTCA CGGTTTTGCC ACTGGAGGCG GTGTAATCGG

201 CGGCGGGCGC GACGAAGGCG ACTTTCGGCG TGTGCGCGCG AGCGGCAGCT

251 TCGGATACGT CGCTGATCAG ACCCATTTTC AGCGCACCGT AAGCGCGGAT

301 TTTCTCGAAT TTTTCCAAAG CCGCGGCATC GTTGTTGATG TCGTCTTGCA

351 ACTCTTTGCC TGTGTAGCCC AAGTCGGCGG CATTCAAGAA AACGGTCGGA

401 ATGCCCGCGT TGATGAGCGT GGCTTTCAAA CGGCCTATAT TCGGCACATC

451 AATTTCATCG ACCAAATTGC CGGTTGGGAA CATACTGCCT TCGCCGTCGG

501 CTGGATC
```

This corresponds to the amino acid sequence <SEQ ID 1904; *ORF* 604>:

```
m604.pep
  1 MPEAHFFTRS AACGKVDQRT GYGGGGRNGN RGGTHHRVVQ FAHAQGAYQQ

 51 IDVGGVHGFA TGGGVIGGGR DEGDFRRVRA SGSFGYVADQ THFQRTVSAD

101 FLEFFQSRGI VVDVVLQLFA CVAQVGGIQE NGRNARVDER GFQTAYIRHI

151 NFIDQIAGWE HTAFAVGWI
```

Computer analysis of this amino acid sequence gave the following results:

Homology with a Predicted ORF from *N. gonorrhoeae*

ORF 604 shows 83.4% identity over a 169 aa overlap with a predicted ORF (ORF 604.ng) from *N. gonorrhoeae*:

```
m604/g604

                    10        20        30        40        50        60
m604.pep    MPEAHFFTRSAACGKVDQRTGYGGGGRNGNRGGTHHRVVQFAHAQGAYQQIDVGGVHGFA
            |||||||||||||||||||||:|||  :|:|| :|| |||||||||||:|||||||:|||
g604        MPEAHFFTRSAACGKVDQRTGHGGG--DGDRGDAHHSVVQFAHAQGAYRQIDVGGVYGFA
                    10        20          30        40        50

                    70        80        90       100       110       120
m604.pep    TGGGVIGGGRDEGDFRRVRASGSFGYVADQTHFQRTVSADFLEFFQSRGIVVDVVLQLFA
            :|||||||||||| |||:||:|:||||||||||||:: || ::|||  ||||||||||||
g604        AGGGVIGGGRDEGGFRRARAGGGFGYVADQTHFQRAICADGFKFFQRGGIVVDVVLQLFA
            60        70        80        90       100       110

                   130       140       150       160      169
m604.pep    CVAQVGGIQENGRNARVDERGFQTAYIRHINFIDQIAGWEHTAFAVGWI
             ||||||:||||||||||||||||:|||||||:||||||||||||||||
g604        RVAQVGGVQENGRNARVDERGFQTTYIRHINFVDQIAGWEHTAFAVGWIX
           120       130       140       150       160
```

The following partial DNA sequence was identified in *N. meningitidis* <SEQ ID 1905>:

```
a604.seq
   1 ATGCCCGAAG CGCACTTCTT TACGCGTTCC GCCGCCTGCG GCAAGGTTGA

  51 CCAGCGTACC GGGCACGGCG GCGGCGGTCG CAATGGCAAC AGAGGCGGTA

 101 CCCATCATCG CGTGGTGCAA TTTGCCCATG CTCAGGGCGC GTACCAGCAA

 151 ATCGATGTCG GCGGCATTCA CGGTTTTGCC ACTGGAGGCG GTGTAATCGG

 201 CGGCGGGCGC GACGAAGGCG ACTTTCGGCG TGTGCGCGCG GGCGGCAGCT

 251 TCGGATACGT CGCTGATCAG ACCCATTTTC AGCGCACCGT AAGCGCGGAT

 301 TTTCTCGAAT TTTTCCAAAG CTGCGGCATC GTTGTTGATG TCGTCTTGCA

 351 ACTCTTTGCC CGTGTAGCCC AAGTCGGCGG CATTCAGGAA AACGGTCGGA

 401 ATGCCCGCGT TGATGAGCGT GGCTTTCAAA CGGCCTATAT TCGGCACATC

 451 AATTTCATCG ACCAAATTGC CGGTTGGGAA CATACTGCCT TCGCCGTCGG

 501 CTGGATCAAG AAATTCGATT TGTACTTCGG CTGCCGGGAA CGTTACGCCG

 551 TCGAGCTCAA AATCGCCTGT TTCCAAAACT GCGCCGTTTT GCATCGGTAC

 601 ATGGGCAATA ATGGTTTTGC CGATGTTTTT CTGCCAGATT TTGACTGTGC

 651 AGATGCCGTC TGA
```

This corresponds to the amino acid sequence <SEQ ID 1906; *ORF* 604.a>:

```
a604.pep
   1 MPEAHFFTRS AACGKVDQRT GHGGGGRNGN RGGTHHRVVQ FAHAQGAYQQ

  51 IDVGGIHGFA TGGGVIGGGR DEGDFRRVRA GGSFGYVADQ THFQRTVSAD

 101 FLEFFQSCGI VVDVVLQLFA RVAQVGGIQE NGRNARVDER GFQTAYIRHI

 151 NFIDQIAGWE HTAFAVGWIK KFDLYFGCRE RYAVELKIAC FQNCAVLHRY

 201 MGNNGFADVF LPDFDCADAV *
```

m604/a604 97.0% identity in 169 aa overlap

```
                    10        20        30        40        50        60
m604.pep   MPEAHFFTRSAACGKVDQRTGYGGGGRNGNRGGTHHRVVQFAHAQGAYQQIDVGGVHGFA
           ||||||||||||||||||||:|||||||||||||||||||||||||||||||||||:||||
           MPEAHFFTRSAACGKVDQRTGHGGGGRNGNRGGTHHRVVQFAHAQGAYQQIDVGGIHGFA
                    10        20        30        40        50        60

                    70        80        90       100       110       120
m604.pep   TGGGVIGGGRDEGDFRRVRASGSFGYVADQTHFQRTVSADFLEFFQSRGIVVDVVLQLFA
           ||||||||||||||||||||:|||||||||||||||||||||||||||| |||||||||||
           TGGGVIGGGRDEGDFRRVRAGGSFGYVADQTHFQRTVSADFLEFFQSCGIVVDVVLQLFA
                    70        80        80       100       110       120

                   130       140       150       160      169
m604.pep   CVAQVGGIQENGRNARVDERGFQTAYIRHINFIDQIAGWEHTAFAVGWI
            ||||||||||||||||||||||||||||||||||||||||||||||||
           RVAQVGGIQENGRNARVDERGFQTAYIRHINFIDQIAGWEHTAFAVGWIKKFDLYFGCRE
                   130       140       150       160       170       180

a604       RYAVELKIACFQNCAVLHRYMGNNGFADVFLPDFDCADAVX
                   190       200       210       220
```

The following partial DNA sequence was identified in *N. gonorrhoeae* <SEQ ID 1907>:

```
g605.seq
    1   ATGATGACCG AAATGCAACA ACGCGCCCAA CTGCACCGCC AAATTTGGAA

   51   AATCGCCGAC GAAGTACGCG GCGCGGTGGA TGGCTGGGAC TTTAAACAAT
```

-continued

```
101  ACGTTCTCGG CACACTTTTC TACCGCTTTA TCAGCGAAAA CTTCACCGAC
151  TATATGCAGG CCGGCGACAG CAGCATTGAT TACGCCGCta tGCCGGACAG
201  CATCATCACG CCCGAAATCA AAGACGATgc cgtcaaagtc aaAGGCTATT
251  TCATCtacCc cgGCCAGCTT TTTTgcaata ttgccgccga agcCCATCAA
301  AACGAAGAGC TCAACACCAA GCTGAAAGAa atCTTTACCG CGATTGAAAG
351  CTCCGCCTCC GGCTAcccgT CCGAACAAGG CATCAAAGGC TTGTTTGACG
401  ACTTCgACAC CACCAGCAGC CGGCTCGGCA GCACCGTTGC CGACAAAAAC
451  AAACGCCTTG CCGCCGTCCT TAAAGGCGTG GCGGAACTCG ATTTCGGCAA
501  TTTTGAAGAC CACCGCATCG ACCTTTTCGG TGATGCCTAC GAATACCTGA
551  TTTCCAACTA CGCcgcCAAC GCAGGCAAAT CCGGCGGCGA ATTTTTCACC
601  CCGCAAAGCG TCTCCAAGCT GATTGCGCGG CTGGCGGTGC ACGGGCAGGA
651  GAAAGTCAAC AAAATCTACG ACCCCGCCTG CGGCTCGGGC AGCCTGCTCT
701  TGCAGGCGAA AAAACAGTTT GACGAACACA TCATCGAAGA AGGCTTCTTC
751  GGGCAGGAAA TCAACCACAC CACCTACAAC CTCGCCCGCA TGAATATGTT
801  TCTGCACAAC GTCAATTACA ACAAATTCCA CATCGAATTG GGCGACACGC
851  TGACCAACCC CAAACTCAAA GACAGCAAAC CCTTTGATGC CGTCGTCTCC
901  AATCCGCCCT ATTCCATCGA CTGGATAGGC AGCGACGACC CCACCTtgaT
951  CAACGACGAC CGCTTTGCCC CCGCAGGCGT ACTCGCACCG AAATCCAAAG
1001 CCGATTTTGC CTTCATCCTG CACGCACTGA ACTACCTTTC CGGCAGAGGC
1051 CGCGCCGCTA TCGTCTCATT CCCCGGCATT TTCTATCGCG GCGGCGCAGA
1101 GCAGAAAATc CGCCAATATC TGGTGGAGGG CAACTATGTG GAAACCGTGA
1151 TTGCCCTTGC GCCCAATCTC TTTTACGGCA CCTGCATCGC CGTCAATATC
1201 CTGGTTTTGT CCAAACACAA AGACAATACC GACATCCAAT TCATCGACGC
1251 AAGCGGCTTC TTTAAAAAAG AAACCAACAA CAACGTCTTA ACCGAAGAAC
1301 ACATTGCCGA AATCGTCAAA CTCTTCGCCG ACAAAGCCGA TGTGCCGCAT
1351 ATCGCCCAAA ACGCCGCCCA GCAAACCGTC AAAGACAACG GCTACAACCT
1401 CGCCGTCAGC AGCTATGTCG AAGCCGAAGA CACCCGCGAG GTCATCGACA
1451 TCAGACAGCT CAACGCCGAA ATCAGCGAAA CCgtcgCcaa AATCGAACGG
1501 CTGCGGCGTG AAATTGACGA AGTGATTGCA GAGATTGAAA CCTAG
```

This corresponds to the amino acid sequence <SEQ ID 1908; *ORF* 605.ng>:

```
g605.pep
  1 MMTEMQQRAQ LHRQIWKIAD EVRGAVDGWD FKQYVLGTLF YRFISENFTD
 51 YMQAGDSSID YAAMPDSIIT PEIKDDAVKV KGYFIYPGQL FCNIAAEAHQ
101 NEELNTKLKE IFTAIESSAS GYPSEQGIKG LFDDFDTTSS RLGSTVADKN
151 KRLAAVLKGV AELDFGNFED HRIDLFGDAY EYLISNYAAN AGKSGGEFFT
201 PQSVSKLIAR LAVHGQEKVN KIYDPACGSG SLLLQAKKQF DEHIIEEGFF
251 GQEINHTTYN LARMNMFLHN VNYNKFHIEL GDTLTNPKLK DSKPFDAVVS
301 NPPYSIDWIG SDDPTLINDD RFAPAGVLAP KSKADFAFIL HALNYLSGRG
351 RAAIVSFPGI FYRGGAEQKI RQYLVEGNYV ETVIALAPNL FYGTCIAVNI
```

-continued

```
401 LVLSKHKDNT DIQFIDASGF FKKETNNNVL TEEHIAEIVK LFADKADVPH

451 IAQNAAQQTV KDNGYNLAVS SYVEAEDTRE VIDIRQLNAE ISETVAKIER

501 LRREIDEVIA EIET*
```

The following partial DNA sequence was identified in *N. meningitidis* <SEQ ID 1909>:

```
m605.seq
   1 ATGATGACCG AAATGCAACA ACGCGCCCAA CTGCACCGCC AAATTTGGAA

  51 AATTGCCGAC GAAGTACGCG GCGCGGTGGA TGGCTGGGAC TTTAAACAAT

 101 ACGTTCTCGG CACACTTTTC TACCGCTTTA TCAGCGAAAA CTTCACCGAC

 151 TATATGCAGG CAGGCGACAG CAGTATTGAT TACGCCGCTA TGCCGGACAG

 201 CATCATCACG CCCGAAATCA AAGACGATGC CGTCAAAGTT AAAGGCTATT

 251 TCATCTACCC CGGCCAGCTT TTTTGCAATA TTGCCGCCGA AGCCCATCAA

 301 AACGAAGAGC TCAACACCAA GCTGAAAGAA ATTTTTACCG CGATTGAAAG

 351 CTCCGCCTCC GGCTATCCGT CCGAACAGGA CATCAAAGGC CTGTTTGACG

 401 ACTTCGACAC CACCAGCAGC CGGCTCGGCA GCACTGTTGC CGACAAGAAC

 451 AAACGCCTTG CCGCCGTCCT CAAAGGCGTG GCGGAACTCG ATTTCGGCAA

 501 TTTTGAAAAC CACCACATCG ACCTTTTCGG CGATGCCTAC GAATACCTGA

 551 TTTCCAACTA CGCTGCCAAC GCAGGCAAAT CCGGCGGCGA ATTTTTCACC

 601 CCGCAAAGCG TATCCAAGCT GATTGCGCGG CTGGCGGTGC ACGGACAGGA

 651 GAAAGTCAAC AAAATCTACG ACCCAGCTTG CGGCTCGGGC AGTCTGCTCT

 701 TGCAGGCGAA AAAACAGTTT GACGAGCACA TCATCGAAGA AGGCTTCTTC

 751 GGGCAGGAAA TCAACCACAC CACCTACAAC CTCGCCCGCA TGAACATGTT

 801 CCTGCACAAC GTCAATTACA ACCAATTCCA CATCGAATTG GGCGACACAC

 851 TGACCAACCC AAAGCTCAAA GACAGCAAAC CCTTTGATGC CATCGTTTCC

 901 AATCCGCCTT ATTCCATCAA CTGGATAGGC AGCGACGACC CCACCTTAAT

 951 CAACGACGAC CGCTTTGCCC CCGCAGGCGT ACTTGCCCCG AAATCCAAAG

1001 CCGATTTTGC CTTCATCCTG CACGCACTGA ACTACCTTTC CGGCAGAGGC

1051 CGCGCCGCCA TCGTCTCATT CCCCGGCATT TTCTATCGCG GCGGCGCAGA

1101 ACAGAAAATC CGCCAATATC TGGTGGAGGG CAACTACGTG GAAACCGTGA

1151 TTGCCCTTGC GCCCAATCTC TTTTACGGCA CCGGCATCGC CGTCAATATC

1201 CTGGTTTTGT CCAAACACAA AGACAATACC GACATCCAAT TCATCGACGC

1251 AAGCGGCTTC TTTAAAAAAG AAACCAACAA CAACGTCTTA ATCGAAGAAC

1301 ACATTGCTGA AATCGTCAAA CTCTTCGCCG ATAAAGCCGA TGTGCCGCAT

1351 ATCGCCCAAA ACGCTGCCCA GCAAACCGTC AAAGACAACG GCTACAACCT

1401 CGCCGTCAGC AGCTATGTCG AAGCCGAAGA CACACGCGAA ATTATCGACA

1451 TCAAACAGCT CAACGCCGAA ATCGGCGAAA CCGTCGCCAA AATCGAACGG

1501 CTGCGGCGTG AAATTGACGA AGTGATTGCA GAGATTGAAG CATGA
```

This corresponds to the amino acid sequence <SEQ ID 1910; *ORF* 605>:

```
m605.pep
   1 MMTEMQQRAQ LHRQIWKIAD EVRGAVDGWD FKQYVLGTLF YRFISENFTD

  51 YMQAGDSSID YAAMPDSIIT PEIKDDAVKV KGYFIYPGQL FCNIAAEAHQ

 101 NEELNTKLKE IFTAIESSAS GYPSEQDIKG LFDDFDTTSS RLGSTVADKN

 151 KRLAAVLKGV AELDFGNFEN HHIDLFGDAY EYLISNYAAN AGKSGGEFFT

 201 PQSVSKLIAR LAVHGQEKVN KIYDPACGSG SLLLQAKKQF DEHIIEEGFF

 251 GQEINHTTYN LARMNMFLHN VNYNQFHIEL GDTLTNPKLK DSKPFDAIVS

 301 NPPYSINWIG SDDPTLINDD RFAPAGVLAP KSKADFAFIL HALNYLSGRG

 351 RAAIVSFPGI FYRGGAEQKI RQYLVEGNYV ETVIALAPNL FYGTGIAVNI

 401 LVLSKHKDNT DIQFIDASGF FKKETNNNVL IEEHIAEIVK LFADKADVPH

 451 IAQNAAQQTV KDNGYNLAVS SYVEAEDTRE IIDIKQLNAE IGETVAKIER

 501 LRREIDEVIA EIEA*
```

Computer analysis of this amino acid sequence gave the following results:

Homology with a Predicted ORF from *N. gonorrhoeae*

ORF 605 shows 97.9% identity over a 513 aa overlap with a predicted ORF (ORF 605.ng) from *N. gonorrhoeae*:

```
m605/g605

                      10        20        30        40        50        60
m605.pep      MMTEMQQRAQLHRQIWKIADEVRGAVDGWDFKQYVLGTLFYRFISENFTDYMQAGDSSID
              ||||||||||||||||||||||||||||||||||||||||||||||||||||||||||||
g605          MMTEMQQRAQLHRQIWKIADEVRGAVDGWDFKQYVLGTLFYRFISENFTDYMQAGDSSID
                      10        20        30        40        50        60

                      70        80        90       100       110       120
m605.pep      YAAMPDSIITPEIKDDAVKVKGYFIYPGQLFCNIAAEAHQNEELNTKLKEIFTAIESSAS
              ||||||||||||||||||||||||||||||||||||||||||||||||||||||||||||
g605          YAAMPDSIITPEIKDDAVKVKGYFIYPGQLFCNIAAEAHQNEELNTKLKEIFTAIESSAS
                      70        80        90       100       110       120

                     130       140       150       160       170       180
m605.pep      GYPSEQDIKGLFDDFDTTSSRLGSTVADKNKRLAAVLKGVAELDFGNFENHHIDLFGDAY
              |||||| ||||||||||||||||||||||||||||||||||||||||||||:|:||||||
g605          GYPSEQGIKGLFDDFDTTSSRLGSTVADKNKRLAAVLKGVAELDFGNFEDHRIDLFGDAY
                     130       140       150       160       170       180

                     190       200       210       220       230       240
m605.pep      EYLISNYAANAGKSGGEFFTPQSVSKLIARLAVHGQEKVNKIYDPACGSGSLLLQAKKQF
              ||||||||||||||||||||||||||||||||||||||||||||||||||||||||||||
g605          EYLISNYAANAGKSGGEFFTPQSVSKLIARLAVHGQEKVNKIYDPACGSGSLLLQAKKQF
                     190       200       210       220       230       240

                     250       260       270       280       290       300
m605.pep      DEHIIEEGFFGQEINHTTYNLARMNMFLHNVNYNQFHIELGDTLTNPKLKDSKPFDAIVS
              ||||||||||||||||||||||||||||||||||:||||||||||||||||||||||:||
g605          DEHIIEEGFFGQEINHTTYNLARMNMFLHNVNYNKFHIELGDTLTNPKLKDSKPFDAVVS
                     250       260       270       280       290       300

                     310       320       330       340       350       360
m605.pep      NPPYSINWIGSDDPTLINDDRFAPAGVLAPKSKADFAFILHALNYLSGRGRAAIVSFPGI
              ||||||:|||||||||||||||||||||||||||||||||||||||||||||||||||||
g605          NPPYSIDWIGSDDPTLINDDRFAPAGVLAPKSKADFAFILHALNYLSGRGRAAIVSFPGI
                     310       320       330       340       350       360

                     370       380       390       400       410       420
m605.pep      FYRGGAEQKIRQYLVEGNYVETVIALAPNLFYGTGIAVNILVLSKHKDNTDIQFIDASGF
              |||||||||||||||||||||||||||||||||| |||||||||||||||||||||||||
g605          FYRGGAEQKIRQYLVEGNYVETVIALAPNLFYGTCIAVNILVLSKHKDNTDIQFIDASGF
                     370       380       390       400       410       420

                     430       440       450       460       470       480
m605.pep      FKKETNNNVLIEEHIAEIVKLFADKADVPHIAQNAAQQTVKDNGYNLAVSSYVEAEDTRE
              |||||||||| |||||||||||||||||||||||||||||||||||||||||||||||||
g605          FKKETNNNVLTEEHIAEIVKLFADKADVPHIAQNAAQQTVKDNGYNLAVSSYVEAEDTRE
                     430       440       450       460       470       480
```

-continued

```
                490       500       510
m605.pep   IIDIKQLNAEIGETVAKIERLRREIDEVIAEIEAX
           :|||:||||||:|||||||||||||||||||||:
g605       VIDIRQLNAEISETVAKIERLRREIDEVIAEIETX
                490       500       510
```

The following partial DNA sequence was identified in *N. meningitidis* <SEQ ID 1911>:

```
a605.seq
   1 ATGATGACCG AAATACAACA ACGCGCCCAA CTGCACCGCC AAATTTGGAA
  51 AATTGCCGAC GAAGTACGCG GCGCGGTGGA TGGCTGGGAC TTCAAACAAT
 101 ACGTTCTCGG CACACTTTTC TACCGCTTTA TCAGCGAAAA CTTTACCGAC
 151 TATATGCAGG CAGGCGACAG CAGTATTGAT TACGCCGCTA TGCCGGACAG
 201 CATCATCACG CCCGAAATCA AAGACGATGC CGTCAAAGTC AAAGGCTATT
 251 TCATCTACCC CGGCCAGCTT TTTTGCAATA TTGCCGCCGA AGCCCATCAA
 301 AACGAAGAGC TCAACACCAA GCTGAAAGAA ATTTTTACCG CGATTGAAAG
 351 CTCCGCCTCC GGCTATCCGT CCGAACAAGA CATTAAAGGC CTGTTTGACG
 401 ACTTCGACAC CACCAGCAGC CGGCTCGGCA GCACCGTTGC CGACAAGAAC
 451 AAACGCCTTG CCGCCGTCCT AAAAGGCGTG GCGGAACTCG ATTTCGGCAG
 501 TTTTGAAGAC CACCACATCG ACCTTTTCGG CGATGCCTAC GAATACCTGA
 551 TTTCCAACTA CGCTGCCAAC GCAGGCAAAT CCGGCGGCGA ATTTTTCACC
 601 CCGCAAAGCG TATCCAAGCT GATTGCGCGG CTGGCGGTGC ACGGGCAGGA
 651 GAAAGTAAAC AAAATCTACG ACCCAGCTTG CGGCTCGGGC AGCCTGCTCT
 701 TGCAGGCGAA AAAACAGTTT GACGAGCACA TCATCGAAGA AGGCTTCTTC
 751 GGGCAGGAAA TCAACCACAC CACCTACAAC CTCGCCCGCA TGAATATGTT
 801 TCTGCACAAC GTCAATTACA ACAAATTCCA CATCGAATTG GGCGACACAC
 851 TGACCAATCC CAAACTCAAA GACAGCAAAC CCTTTGATGC CGTCGTTTCC
 901 AATCCGCCCT ATTCCATCAA CTGGATAGGC AGCGGCGACC CCACCTTAAT
 951 CAACGACGAC CGCTTTGCCC CTGCAGGCGT ACTCGCCCCG AAATCCAAAG
1001 CCGATTTTGC CTTCATTCTG CACGCACTGA ACTACCTTTC CGGCAGAGGC
1051 CGCGCCGCCA TCGTCTCATT CCCCGGCATT TTCTATCGCG GCGGCGCAGA
1101 GCAGAAAATC CGCCAATATC TGGTGGAGGG CAACTACGTG GAAACCGTCA
1151 TCGCCCTTGC GCCCAATCTC TTTTACGGCA CCGGCATCGC CGTCAATATA
1201 CTGGTTTTGT CCAAACACAA AGACAATACC GACATCCAAT TCATCGACGC
1251 AGGCGGCTTC TTTAAAAAAG AAACCAACAA CAACGTCTTA ACCGAAGAAC
1301 ACATTGCCGA AATCGTCAAA CTCTTCGCCG ATAAAGCCGA TGTGCCGCAT
1351 ATCGCCCAAA ACGCCGCCCA GCAAACCGTC AAAGACAACG GCTACAACCT
1401 CGCCGTCAGC AGCTATGTTG AACCCGAAGA CACCCGCGAA ATTATCGACA
1451 TCAAACAGCT TAACGCCGAA ATCAGCGAAA CCGTTGCCAA AATCGAACGG
1501 CTGCGGCGTG AAATTGACGA AGTGATTGCA GAGATTGAAG CATGA
```

This corresponds to the amino acid sequence <SEQ ID 1912; *ORF* 605.a>:

```
a605.pep
   1 MMTEIQQRAQ LHRQIWKIAD EVRGAVDGWD FKQYVLGTLF YRFISENFTD

  51 YMQAGDSSID YAAMPDSIIT PEIKDDAVKV KGYFIYPGQL FCNIAAEAHQ

 101 NEELNTKLKE IFTAIESSAS GYPSEQDIKG LFDDFDTTSS RLGSTVADKN

 151 KRLAAVLKGV AELDFGSFED HHIDLFGDAY EYLISNYAAN AGKSGGEFFT

 201 PQSVSKLIAR LAVHGQEKVN KIYDPACGSG SLLLQAKKQF DEHIIEEGFF

 251 GQEINHTTYN LARMNMFLHN VNYNKFHIEL GDTLTNPKLK DSKPFDAVVS

 301 NPPYSINWIG SGDPTLINDD RFAPAGVLAP KSKADFAFIL HALNYLSGRG

 351 RAAIVSFPGI FYRGGAEQKI RQYLVEGNYV ETVIALAPNL FYGTGIAVNI

 401 LVLSKHKDNT DIQFIDAGGF FKKETNNNVL TEEHIAEIVK LFADKADVPH

 451 IAQNAAQQTV KDNGYNLAVS SYVEPEDTRE IIDIKQLNAE ISETVAKIER

 501 LRREIDEVIA EIEA*
```

m605/a605 98.1% identity in 514 aa overlap

```
                      10        20        30        40        50        60
m605.pep      MMTEMQQRAQLHRQIWKIADEVRGAVDGWDFKQYVLGTLFYRFISENFTDYMQAGDSSID
              ||||:|||||||||||||||||||||||||||||||||||||||||||||||||||||||
a605          MMTEIQQRAQLHRQIWKIADEVRGAVDGWDFKQYVLGTLFYRFISENFTDYMQAGDSSID
                      10        20        30        40        50        60

                      70        80        90       100       110       120
m605.pep      YAAMPDSIITPEIKDDAVKVKGYFIYPGQLFCNIAAEAHQNEELNTKLKEIFTAIESSAS
              ||||||||||||||||||||||||||||||||||||||||||||||||||||||||||||
a605          YAAMPDSIITPEIKDDAVKVKGYFIYPGQLFCNIAAEAHQNEELNTKLKEIFTAIESSAS
                      70        80        90       100       110       120

                     130       140       150       160       170       180
m605.pep      GYPSEQDIKGLFDDFDTTSSRLGSTVADKNKRLAAVLKGVAELDFGNFENHHIDLFGDAY
              ||||||||||||||||||||||||||||||||||||||||||||||:||:||||||||||
a605          GYPSEQDIKGLFDDFDTTSSRLGSTVADKNKRLAAVLKGVAELDFGSFEDHHIDLFGDAY
                     130       140       150       160       170       180

                     190       200       210       220       230       240
m605.pep      EYLISNYAANAGKSGGEFFTPQSVSKLIARLAVHGQEKVNKIYDPACGSGSLLLQAKKQF
              ||||||||||||||||||||||||||||||||||||||||||||||||||||||||||||
a605          EYLISNYAANAGKSGGEFFTPQSVSKLIARLAVHGQEKVNKIYDPACGSGSLLLQAKKQF
                     190       200       210       220       230       240

                     250       260       270       280       290       300
m605.pep      DEHIIEEGFFGQEINHTTYNLARMNMFLHNVNYNQFHIELGDTLTNPKLKDSKPFDAIVS
              ||||||||||||||||||||||||||||||||||:||||||||||||||||||||||:||
a605          DEHIIEEGFFGQEINHTTYNLARMNMFLHNVNYNKFHIELGDTLTNPKLKDSKPFDAVVS
                     250       260       270       280       290       300

                     310       320       330       340       350       360
m605.pep      NPPYSINWIGSDDPTLINDDRFAPAGVLAPKSKADFAFILHALNYLSGRGRAAIVSFPGI
              ||||||||||| ||||||||||||||||||||||||||||||||||||||||||||||||
a605          NPPYSINWIGSGDPTLINDDRFAPAGVLAPKSKADFAFILHALNYLSGRGRAAIVSFPGI
                     310       320       330       340       350       360

                     370       380       390       400       410       420
m605.pep      FYRGGAEQKIRQYLVEGNYVETVIALAPNLFYGTGIAVNILVLSKHKDNTDIQFIDASGF
              |||||||||||||||||||||||||||||||||||||||||||||||||||||||||:||
a605          FYRGGAEQKIRQYLVEGNYVETVIALAPNLFYGTGIAVNILVLSKHKDNTDIQFIDAGGF
                     370       380       390       400       410       420

                     430       440       450       460       470       480
m605.pep      FKKETNNNVLIEEHIAEIVKLFADKADVPHIAQNAAQQTVKDNGYNLAVSSYVEAEDTRE
              |||||||||| ||||||||||||||||||||||||||||||||||||||||||| |||||
a605          FKKETNNNVLTEEHIAEIVKLFADKADVPHIAQNAAQQTVKDNGYNLAVSSYVEPEDTRE
                     430       440       450       460       470       480

                     490       500       510
m605.pep      IIDIKQLNAEIGETVAKIERLRREIDEVIAEIEAX
              |||||||||||:|||||||||||||||||||||||
a605          IIDIKQLNAEISETVAKIERLRREIDEVIAEIEAX
                     490       500       510
```

The following partial DNA sequence was identified in *N. gonorrhoeae* <SEQ ID 1913>:

```
g606.seq
  1 ATGTCCAAAT TTATCGCCAA ACAATCGGTC GGTGCGGAAG TCATCGACAC

 51 GCCGcgCACC GAAGAAGAAG CCTGGCTTCT GAACACTGTC GAAGCCCAAg

101 cgcGGCAATG GAATCTGAAA ACGCCAGAAG TCGCCATCTA CCACTCCCCC

151 GAACCCAATG CCTTTGCCAC GGGCGCATCG AGAAACAGCT CCCTGATCGC

201 CGTCAGCacc ggtttgctcg accaTAtgaC GCGCGACgaa gtggaagccg

251 tgTTGGCGCA CGAAATGGCG CACGTCGGCA ACGGCGACAT GGTTACGCTG

301 ACGCTGAtTC AAGGCGTGGT CAATACCTTT GTCGTGTTCC TGTCGCGCAT

351 TATTGCCAAC CTGATTGCCC GAAACAACGA CGGCAGCCAG TCCCAGGGAA

401 CTTATTTCCT AGTCAGCATG GTATTCCAAA TCCTGTTCGG CTTCCTTGCC

451 AGCCTGATTG TCATGTGGTT CAGCCGCCAA CGCGAATACC GCGCCGAcgc

501 gggCGcggCA AAACTGGTCG GCGCACCGAA AATGATTTCC GCCCTGCAAA

551 GGCTTAAAGG CAACCCGGTC GATTTGCCCG AAGAAATGAA CGCAATGGGC

601 ATCGCCGGAG ATACGCGCGA CTCCCTGCTC AGCACCCACC CTTCGCTGGA

651 CAACCGAATC GCCCGCCTCA AATCGCTTTA A
```

This corresponds to the amino acid sequence <SEQ ID 1914; *ORF*606.ng>:

```
g606.pep
  1 MSKFIAKQSV GAEVIDTPRT EEEAWLLNTV EAQARQWNLK TPEVAIYHSP

 51 EPNAFATGAS RNSSLIAVST GLLDHMTRDE VEAVLAHEMA HVGNGDMVTL

101 TLIQGVVNTF VVFLSRIIAN LIARNNDGSQ SQGTYFLVSM VFQILFGFLA

151 SLIVMWFSRQ REYRADAGAA KLVGAPKMIS ALQRLKGNPV DLPEEMNAMG

201 IAGDTRDSLL STHPSLDNRI ARLKSL*
```

The following partial DNA sequence was identified in *N. meningitidis* <SEQ ID 1915>:

```
m606.seq
  1 ATGTCCAAAT TTATCGCCAA ACAATCGGTC GGCGCGGAAG TTATCGACAC

 51 GCCGCGCACC GAAGAAGAAG CCTGGCTTTT GAACACTGTC GAAGCCCAAG

101 CGCGGCAATG GAACCTGAAA ACGCCCGAAG TCGCCATCTA CCACTCCCCC

151 GAACCCAATG CCTTTGCCAC GGGCGCATCG AGAAACAGCT CCCTGATCGC

201 CGTCAGCACC GGTTTGCTCG ACCATATGAC GCGTGACGAA GTGGAAGCCG

251 TATTGGCGCA CGAAATGGCA CACGTCGGCA ACGGCGATAT GGTTACGCTG

301 ACGCTGATTC AAGGCGTGGT CAATACCTTT GTCGTGTTCC TGTCGCGCAT

351 TATTGCCAAC CTGATTGCCC GAAACAACGA CGGCAGCCAG TCCCAGGGAA

401 CTTATTTCCT GGTCAGCATG GTATTCCAAA TCCTGTTCGG CTTCCTTGCC

451 AGCTTAATTG TCATGTGGTT CAGCCGACAA CGCGAATACC GCGCCGATGC

501 GGGCGCGGCA AAACTGGTCG GCGCGCCGAA AATGATTTCC GCCCTGCAAA

551 GGCTCAAAGG CAACCCGGTC GATTTGCCCG AAGAAATGAA CGCAATGGGC
```

-continued

```
601 ATCGCCGGAG ATACGCGCGA CTCCCTGCTC AGCACCCACC CTTCGCTGGA

651 CAACCGTATC GCCCGCCTCA AATCGCTTTA A
```

This corresponds to the amino acid sequence <SEQ ID 1916; *ORF* 606>:

```
m606.pep
   1 MSKFIAKQSV GAEVIDTPRT EEEAWLLNTV EAQARQWNLK TPEVAIYHSP

  51 EPNAFATGAS RNSSLIAVST GLLDHMTRDE VEAVLAHEMA HVGNGDMVTL

 101 TLIQGVVNTF VVFLSRIIAN LIARNNDGSQ SQGTYFLVSM VFQILFGFLA

 151 SLIVMWFSRQ REYRADAGAA KLVGAPKMIS ALQRLKGNPV DLPEEMNAMG

 201 IAGDTRDSLL STHPSLDNRI ARLKSL*
```

Computer analysis of this amino acid sequence gave the following results:

Homology with a Predicted ORF from *N. gonorrhoeae*

ORF 606 shows 100.0% identity over a 225 aa overlap with a predicted ORF (ORF 606.ng) from *N. gonorrhoeae*:

```
m606.g606

                   10        20        30        40        50        60
m606.pep   MSKFIAKQSVGAEVIDTPRTEEEAWLLNTVEAQARQWNLKTPEVAIYHSPEPNAFATGAS
           ||||||||||||||||||||||||||||||||||||||||||||||||||||||||||||
g606       MSKFIAKQSVGAEVIDTPRTEEEAWLLNTVEAQARQWNLKTPEVAIYHSPEPNAFATGAS
                   10        20        30        40        50        60

                   70        80        90       100       110       120
m606.pep   RNSSLIAVSTGLLDHMTRDEVEAVLAHEMAHVGNGDMVTLTLIQGVVNTFVVFLSRIIAN
           ||||||||||||||||||||||||||||||||||||||||||||||||||||||||||||
g606       RNSSLIAVSTGLLDHMTRDEVEAVLAHEMAHVGNGDMVTLTLIQGVVNTFVVFLSRIIAN
                   70        80        80       100       110       120

                  130       140       150       160       170       170
m606.pep   LIARNNDGSQSQGTYFLVSMVFQILFGFLASLIVMWFSRQREYRADAGAAKLVGAPKMIS
           ||||||||||||||||||||||||||||||||||||||||||||||||||||||||||||
g606       LIARNNDGSQSQGTYFLVSMVFQILFGFLASLIVMWFSRQREYRADAGAAKLVGAPKMIS
                  130       140       150       160       170       180

                  190       200       210       220
m606.pep   ALQRLKGNPVDLPEEMNAMGIAGDTRDSLLSTHPSLDNRIARLKSLX
           |||||||||||||||||||||||||||||||||||||||||||||||
g606       ALQRLKGNPVDLPEEMNAMGIAGDTRDSLLSTHPSLDNRIARLKSLX
                  190       200       210       220
```

The following partial DNA sequence was identified in *N. meningitidis* <SEQ ID 1917>:

```
a606.seq
   1 ATGTCCAAAT TCATCGCCAA ACAATCGGTC GGCGCGGAAG TTATCGACAC

  51 GCCGCGCACC GAAGAAGAAG CCTGGCTTTT GAACACTGTC GAAGCCCAAG

 101 CGCGGCAATG GAACCTGAAA ACGCCCGAAG TCGCCATCTA CCACTCCCCC

 151 GAACCCAATG CCTTTGCCAC GGGCGCATCG AGAAACAGCT CCCTGATCGC

 201 CGTCAGCACC GGTTTGCTCG ACCATATGAC GCGTGACGAA GTGGAAGCCG

 251 TATTGGCGCA CGAAATGGCA CACGTCGGCA ACGGCGATAT GGTTACGCTG

 301 ACGCTGATTC AAGGCGTGGT CAATACCTTT GTCGTGTTCC TGTCGCGCAT

 351 TATTGCCAAC CTGATTGCCC GAAACAACGA CGGCAGCCAG TCCCAGGGAA

 401 CTTATTTCCT GGTCAGCATG GTATTCCAAA TCCTGTTCGG CTTCCTTGCC

 451 AGCTTAATTG TCATGTGGTT CAGCCGACAA CGCGAATACC GCGCCGACGC

 501 GGGCGCGGCA AAACTGGTCG GCGCGCCGAA AATGATTTCC GCCCTGCAAA
```

-continued

```
551 GGCTTAAAGG CAACCCGGTC GATTTGCCCG AAGAAATGAA CGCAATGGGC

601 ATCGCCGGAG ATACGCGCGA CTCCCTGCTC AGCACCCACC CTTCGCTGGA

651 CAACCGAATC GCCCGCCTCA AATCGCTTTA A
```

This corresponds to the amino acid sequence <SEQ ID 1918; *ORF* 606.a>:

```
a606.pep
  1 MSKFIAKQSV GAEVIDTPRT EEEAWLLNTV EAQARQWNLK TPEVAIYHSP

 51 EPNAFATGAS RNSSLIAVST GLLDHMTRDE VEAVLAHEMA HVGNGDMVTL

101 TLIQGVVNTF VVFLSRIIAN LIARNNDGSQ SQGTYFLVSM VFQILFGFLA

151 SLIVMWFSRQ REYRADAGAA KLVGAPKMIS ALQRLKGNPV DLPEEMNAMG

201 IAGDTRDSLL STHPSLDNRI ARLKSL*
```

m606/a606 100.0% identity in 226 aa overlap

```
                   10        20        30        40        50        60
m606.pep   MSKFIAKQSVGAEVIDTPRTEEEAWLLNTVEAQARQWNLKTPEVAIYHSPEPNAFATGAS
           ||||||||||||||||||||||||||||||||||||||||||||||||||||||||||||
a606       MSKFIAKQSVGAEVIDTPRTEEEAWLLNTVEAQARQWNLKTPEVAIYHSPEPNAFATGAS
                   10        20        30        40        50        60

                   70        80        90       100       110       120
m606.pep   RNSSLIAVSTGLLDHMTRDEVEAVLAHEMAHVGNGDMVTLTLIQGVVNTFVVFLSRIIAN
           ||||||||||||||||||||||||||||||||||||||||||||||||||||||||||||
a606       RNSSLIAVSTGLLDHMTRDEVEAVLAHEMAHVGNGDMVTLTLIQGVVNTFVVFLSRIIAN
                   70        80        90       100       110       120

                  130       140       150       160       170       180
m606.pep   LIARNNDGSQSQGTYFLVSMVFQILFGFLASLIVMWFSRQREYRADAGAAKLVGAPKMIS
           ||||||||||||||||||||||||||||||||||||||||||||||||||||||||||||
a606       LIARNNDGSQSQGTYFLVSMVFQILFGFLASLIVMWFSRQREYRADAGAAKLVGAPKMIS
                  130       140       150       160       170       180

                  190       200       210       220
m606.pep   ALQRLKGNPVDLPEEMNAMGIAGDTRDSLLSTHPSLDNRIARLKSLX
           |||||||||||||||||||||||||||||||||||||||||||||||
a606       ALQRLKGNPVDLPEEMNAMGIAGDTRDSLLSTHPSLDNRIARLKSLX
                  190       200       210       220
```

The following partial DNA sequence was identified in *N. gonorrhoeae* <SEQ ID 1919>:

```
g607.seq
  1 ATGCTGCTCG accTcgaCCG CTTTTCCTtt tccGTCTTCC TGAAAGAAAT

 51 CCGCCTGCTG ACCGCCCTTG CCCTGCCCAT GCTGTTGGCG CAGGTCGCGC

101 AGGTGGGCAT CGGTTTCGTC GATACCGTGA TGGCGGGCGG TGCGGGCAAG

151 GAAGATTTGG CGGCGGTGGC TTTGGGCAGC AGCGCGTTTG CCACGGTTTA

201 TATTACCTTT ATGGGCATTA TGGCGGCGCT GAACCCGATG ATTGCCCAGC

251 TTTACGGCGC GGGTAAAACC GgtgAAGCAG GCGAAACGGG GCGGCAGGGG

301 ATTTGGTTCG GCTGATTTTT GGGGATTTTC GGCATGATTT TGATGTGGGC

351 GGCGATTACG CCGTTCCGCA ACTGGCTGAC TTTGAGCGAT TATGTGGAAG

401 gcacAAtggc gcAGTATATG CTGTTCACCA GCTTGGCGAT GCCGGCGGCA

451 ATGGTACACC GCGCACTGCA CGCCTACGCT TCCAGCCTGA ACCGCCCGCG

501 CCTGATTATG TTGGTCAGCT TTGCGGCGTT TGTGTTGAAC GTGCCGCTGA

551 ACTATATTTT CGTTTACGGC AAATTCGGTA TGCCCGCTTT GGGTGGCGCA

601 GGTTGCGGCG TGGCGACAAT GGCGGTGTTT TGGTTCAGCG CGCTGGCATT
```

-continued

```
 651 GTGGATTTAT ATCGCCAAGG AAAAATTCTT CCGCCCGTTC GGACTGACAG

 701 CGAAATTCGg caaACCGGat tGGgcGGTGT TCAAACAGAT TtGGAAAATC

 751 gGcgcgCCCA TCGGGCTGTC TTATTTTTTG GAAgccaGcg cGTTTTCGTT

 801 TATCGTGTTT TTGATTGCGC CTttcggCGA GGATTATGTG GCGGCGCAGC

 851 AGGTCGGCAT CAGTTTGTCG GGGATTCTCT ATATGATTCC GCAAAGCGTC

 901 GGCTCGGCAG GGACGGTGCG CATCGGCTTT TCGCTTGGGC GGCGCGAATT

 951 TTCGCGGGCG CGTTATATTT CAGGAGTGTC GCTGGTGTCG GGCTGGGTGC

1001 TCGCCGTGAT TACCGTGCTT TCCTTGGTAT TATTCCGTTC GCCGCTGGCA

1051 AGCATGTACA ACGATGaTCC GGCAGTTTTA AGCATCGCCT CCACCGTCCT

1101 GCTGTTCGCC GGCCTGTtcc aACCGGCAGA CTTCACCCAA TGTATCGCGT

1151 CCTATGCCCT GCGCGGCTAC AAAGTCACCA AGGTGCCGAT GTTCATCCAC

1201 GCCGCCGCCT TCTGGGGCTG CGGCCTGCTG CCGGGCTATC TGCTCGCCTA

1251 CCGTTTCGAT ATGGGCATTT ACGGCTTCTG GACGGCATTG ATTGCCTCGC

1301 TCACCATCGC AGCCGTCGCC TTGGTGTGGT GCTTGGAAAA ATACAGTATG

1351 GAGTTGGTCA AATCACACAA GGCCGTCTGA
```

This corresponds to the amino acid sequence <SEQ ID 1920; *ORF* 607.ng>:

```
g607.pep
  1 MLLDLDRFSF SVFLKEIRLL TALALPMLLA QVAQVGIGFV DTVMAGGAGK

 51 EDLAAVALGS SAFATVYITF MGIMAALNPM IAQLYGAGKT GEAGETGRQG

101 IWFGLILGIF GMILMWAAIT PFRNWLTLSD YVEGTMAQYM LFTSLAMPAA

151 MVHRALHAYA SSLNRPRLIM LVSFAAFVLN VPLNYIFVYG KFGMPALGGA

201 GCGVATMAVF WFSALALWIY IAKEKFFRPF GLTAKFGKPD WAVFKQIWKI

251 GAPIGLSYFL EASAFSFIVF LIAPFGEDYV AAQQVGISLS GILYMIPQSV

301 GSAGTVRIGF SLGRREFSRA RYISGVSLVS GWVLAVITVL SLVLFRSPLA

351 SMYNDDPAVL SIASTVLLFA GLFQPADFTQ CIASYALRGY KVTKVPMFIH

401 AAAFWGCGLL PGYLLAYRFD MGIYGFWTAL IASLTIAAVA LVWCLEKYSM

451 ELVKSHKAV*
```

The following partial DNA sequence was identified in *N. meningitidis* <SEQ ID 1921>:

```
m607.seq
  1 ATGCTGCTCG ACCTCAACCG CTTTTCCTTT CCCGTCTTCC TGAAAGAAGT

 51 CCGCCTGCTG ACCACTCTTG CCCTGCCCAT GCTGTTGGCG CAGGTCGCGC

101 AGGTGGGCAT CGGTTTTGTC GATACTGTGA TGGCGGGCGG TGCGGGCAAG

151 GAAGACTTGG CGGCGGTGGC TTTGGGCAGC AGCGCGTTTG CCACGGTTTA

201 TATTACCTTT ATGGGCATTA TGGCGGCGCT GAACCCGATG ATTGCCCAGC

251 TTTACGGCGC GGGTAAAACC GACGAAGTGG GCGAAACGGG GCGGCAGGGG

301 ATTTGGTTCG GGCTGTTTTT GGGCGTGTTC GGCATGGTCT TGATGTGGGC

351 GGCGATTACG CCGTTCCGCA ACTGGCTGAC CTTGAGCGAT TATGTGGAAG

401 GCACGATGGC GCAGTATATG TTGTTCACCA GCTTGGCGAT GCCGGCGGCA
```

-continued

```
 451  ATGGTACACC GCGCGCTGCA CGCCTACACT TCCAGCCTGA ACCGCCCGCG

 501  CCTGATTATG TTGGTCAGCT TTGCGGCGTT TGTGTTGAAC GTGCCGCTGA

 551  ACTATATTTT CGTTTACGGC AAATTCGGTA TGCCCGCTTT GGGCGGCGCA

 601  GGCTGCGGAC TGGCGACGAT GGCGGTGTTT TGGTTCAGCG CGCTGGCATT

 651  GTGGATTTAT ATCGCCAAGG AAAATTTCTT CCGCCCATTC GGACTGACGG

 701  CGAAATTCGG CAAACCGGAT TGGGCGGTGT TCAAACAGAT TTGGAAAATC

 751  GGCGCACCCA TCGGGCTGTC TTATTTTTTG GAAGCCAGCG CGTTTTCGTT

 801  TATCGTGTTT TTGATTGCGC CTTTCGGCGA GGATTATGTG GCGGCGCAGC

 851  AGGTCGGCAT CAGTTTGTCG GGGATTCTCT ATATGATTCC GCAAAGCGTC

 901  GGCTCGGCGG GGACGGTGCG CATCGGCTTT TCGCTTGGGC GGCGCGAATT

 951  TTCGCGGGCG CGTTATATTT CGGGCGTGTC ACTGGTGTTA GGATGGATGC

1001  TCGCCGTGAT TACCGTGCTT TCCTTGGTAT TATTCCGTTC GCCGCTGGTA

1051  AGTATGTACA ACAATGATCC GGCGGTTTTA AGCATCGCCG CCACCGTCTT

1101  ACTGTTCGCC GGCTTGTTCC AACCGGCAGA CTTCACCCAA TGTATCGCCT

1151  CCTACGCCTT GCGCGGCTAC AAAGTTACAA AGGTGCCGAT GTTCATCCAC

1201  GCCGCCGCCT TTTGGGGCTG CGGCCTGCTG CCGGGCTATC TGCTCGCCTA

1251  CCGTTTCAAT ATGGGCATTT ACGGCTTCTG GACGGCATTG ATTGCCTCGC

1301  TCACCATCGC CGCCATCGCC TTGGTGTGGT GCTTGGAATT GTGCAGTAGG

1351  GAGATGGTCA GATCGCATAA GGCCGTCTGA
```

This corresponds to the amino acid sequence <SEQ ID 1922; *ORF* 607>:

```
m607.pep
  1 MLLDLNRFSF PVFLKEVRLL TTLALPMLLA QVAQVGIGFV DTVMAGGAGK

 51 EDLAAVALGS SAFATVYITF MGIMAALNPM IAQLYGAGKT DEVGETGRQG

101 IWFGLFLGVF GMVLMWAAIT PFRNWLTLSD YVEGTMAQYM LFTSLAMPAA

151 MVHRALHAYT SSLNRPRLIM LVSFAAFVLN VPLNYIFVYG KFGMPALGGA

201 GCGLATMAVF WFSALALWIY IAKENFFRPF GLTAKFGKPD WAVFKQIWKI

251 GAPIGLSYFL EASAFSFIVF LIAPFGEDYV AAQQVGISLS GILYMIPQSV

301 GSAGTVRIGF SLGRREFSRA RYISGVSLVL GWMLAVITVL SLVLFRSPLV

351 SMYNNDPAVL SIAATVLLFA GLFQPADFTQ CIASYALRGY KVTKVPMFIH

401 AAAFWGCGLL PGYLLAYRFN MGIYGFWTAL IASLTIAAIA LVWCLELCSR

451 EMVRSHKAV*
```

Computer analysis of this amino acid sequence gave the following results:

Homology with a Predicted ORF from *N. gonorrhoeae*

ORF 607 shows 94.8% identity over a 459 aa overlap with a predicted ORF (ORF 607.ng) from *N. gonorrhoeae*:

```
m607/g607

                     10        20        30        40        50        60
m607.pep    MLLDLNRFSFPVFLKEVRLLTTLALPMLLAQVAQVGIGFVDTVMAGGAGKEDLAAVALGS
            |||||:|||| |||||:||||:||||||||||||||||||||||||||||||||||||||
g607        MLLDLDRFSFSVFLKEIRLLTALALPMLLAQVAQVGIGFVDTVMAGGAGKEDLAAVALGS
                     10        20        30        40        50        60
```

-continued

```
                     70        80        90       100       110       120
m607.pep     SAFATVYITFMGIMAALNPMIAQLYGAGKTDEVGETGRQGIWFGLFLGVFGMVLMWAAIT
             |||||||||||||||||||||||||||||| |:||||||||||||:||:|||:|||||||
g607         SAFATVYITFMGIMAALNPMIAQLYGAGKTGEAGETGRQGIWFGLILGIFGMILMWAAIT
                     70        80        90       100       110       120

                    130       140       150       160       170       180
m607.pep     PFRNWLTLSDYVEGTMAQYMLFTSLAMPAAMVHRALHAYTSSLNRPRLIMLVSFAAFVLN
             |||||||||||||||||||||||||||||||||||||||:||||||||||||||||||||
g607         PFRNWLTLSDYVEGTMAQYMLFTSLAMPAAMVHRALHAYASSLNRPRLIMLVSFAAFVLN
                    130       140       150       160       170       180

                    190       200       210       220       230       240
m607.pep     VPLNYIFVYGKFGMPALGGAGCGLATMAVFWFSALALWIYIAKENFFRPFGLTAKFGKPD
             |||||||||||||||||||||||:||||||||||||||||||||:|||||||||||||||
g607         VPLNYIFVYGKFGMPALGGAGCGVATMAVFWFSALALWIYIAKEKFFRPFGLTAKFGKPD
                    190       200       210       220       230       240

                    250       260       270       280       290       300
m607.pep     WAVFKQIWKIGAPIGLSYFLEASAFSFIVFLIAPFGEDYVAAQQVGISLSGILYMIPQSV
             ||||||||||||||||||||||||||||||||||||||||||||||||||||||||||||
g607         WAVFKQIWKIGAPIGLSYFLEASAFSFIVFLIAPFGEDYVAAQQVGISLSGILYMIPQSV
                    250       260       270       280       290       300

                    310       320       330       340       350       360
m607.pep     GSAGTVRIGFSLGRREFSRARYISGVSLVLGWMLAVITVLSLVLFRSPLVSMYNNDPAVL
             ||||||||||||||||||||||||||||| ||:||||||||||||||||:||||:|||||
g607         GSAGTVRIGFSLGRREFSRARYISGVSLVSGWVLAVITVLSLVLFRSPLASMYNDDPAVL
                    310       320       330       340       350       360

                    370       380       390       400       410       420
m607.pep     SIAATVLLFAGLFQPADFTQCIASYALRGYKVTKVPMFIHAAAFWGCGLLPGYLLAYRFN
             |||:|||||||||||||||||||||||||||||||||||||||||||||||||||||||:
g607         SIASTVLLFAGLFQPADFTQCIASYALRGYKVTKVPMFIHAAAFWGCGLLPGYLLAYRFD
                    370       380       390       400       410       420

                    430       440       450       460
m607.pep     MGIYGFWTALIASLTIAAIALVWCLELCSREMVRSHKAVX
             ||||||||||||||||||:||||||  | |:|:||||||
g607         MGIYGFWTALIASLTIAAVALVWCLEKYSMELVKSHKAVX
                    430       440       450       460
```

The following partial DNA sequence was identified in *N. meningitidis* <SEQ ID 1923>:

```
a607.seq
   1  ATGCTGCTCG ACCTCAACCG CTTTTCCTTT TCCGTCTTCC TGAAAGAAGT

  51  CCGCCTGCTG ACCGCTCTTG CCCTGCCCAT GCTGTTGGCG CAGGTCGCGC

 101  AGGTGGGCAT CGGTTTTGTC GATACCGTGA TGGCGGGCGG TGCGGGCAAG

 151  GAAGACTTGG CGGCGGTGGC TTTGGGCAGC AGCGCGTTTG CCACGGTTTA

 201  TATTACCTTT ATGGGCATTA TGGCGGCGCT GAACCCGATG ATTGCCCAGC

 251  TTTACGGCGC GGGTAAAACC GACGAAGTGG GCGAAACGGG ACGGCAGGGG

 301  ATTTGGTTCG GGCTGTTTTT GGGCGTGTTC GGCATGGTCT TGATGTGGGC

 351  GGCGATTACG CCGTTCCGCA ACTGGCTGAC CTTGAGCGAT TATGTGGAAG

 401  GCACAATGGC GCAGTATATG CTGTTCACCA GCTTGGCGAT GCCGGCGGCA

 451  ATGGTACACC GCGCACTGCA CGCCTACGCC TCCAGCCTGA ACCGCCCGCG

 501  CCTGATTATG TTGGTCAGCT TTGCGGCGTT TGTGTTGAAC GTGCCGCTGA

 551  ACTATATTTT CGTTTACGGC AAATTCGGTA TGCCCGCTTT GGGCGGCGCA

 601  GGCTGCGGAC TGGCGACGAT GGCGGTGTTT TGGTTCAGCG CGCTGGCATT

 651  GTGGATTTAT ATCGCCAAGG AAAATTTCTT CCGCCCATTC GGACTGACGG

 701  CGAAATTCGG CAAACCGGAT TGGGCGGTGT TCAAACAGAT TTGGAAAATC

 751  GGCGCACCCA TCGGGCTGTC TTATTTTTTG GAAGCCAGCG CGTTTTCGTT

 801  TATCGTGTTT TTGATTGCGC CTTTCGGCGA GGATTATGTG GCGGCGCAGC

 851  AGGTCGGCAT CAGTTTGTCG GGGATTCTCT ATATGATTCC GCAAAGCGTC

 901  GGCTCGGCGG GGACGGTGCG CATCGGCTTT TCGCTTGGGC GGCGCGAATT
```

-continued

```
 951  TTCGCGGGCG CGTTATATTT CGGGCGTGTC ACTGGTGTCA GGATGGATGC

1001  TCGCCGTGAT TACCGTGCTT TCCTTGGTAT TATTCCGTTC GCCGCTGGTA

1051  AGTATGTACA ACAATGATCC GGCGGTTTTA AGCATCGCCG CCACCGTCTT

1101  ACTGTTCGCC GGCTTGTTCC AACCGGCAGA CTTCACCCAA TGTATCGCCT

1151  CCTACGCCTT GCGCGGCTAC AAAGTTACAA AGGTGCCGAT GTTCATCCAC

1201  GCCGCCGCCT TTTGGGGCTG CGGTCTGCTG CCGGGCTACC TGCTCGCCTA

1251  CCGTTTCGAT ATGGGCATTT ACGGCTTCTG GACGGCATTG ATTGCCTCGC

1301  TCACCATCGC CGCCATCGCC TTGGTGTGGT GCTTGGAATT GTGCAGTAGG

1351  GAGATGGTCA GATCGCATAA GGCTGTCTGA
```

This corresponds to the amino acid sequence <SEQ ID 1924; *ORF* 607.a>:

```
a607.pep
  1 MLLDLNRFSF SVFLKEVRLL TALALPMLLA QVAQVGIGFV DTVMAGGAGK

 51 EDLAAVALGS SAFATVYITF MGIMAALNPM IAQLYGAGKT DEVGETGRQG

101 IWFGLFLGVF GMVLMWAAIT PFRNWLTLSD YVEGTMAQYM LFTSLAMPAA

151 MVHRALHAYA SSLNRPRLIM LVSFAAFVLN VPLNYIFVYG KFGMPALGGA

201 GCGLATMAVF WFSALALWIY IAKENFFRPF GLTAKFGKPD WAVFKQIWKI

251 GAPIGLSYFL EASAFSFIVF LIAPFGEDYV AAQQVGISLS GILYMIPQSV

301 GSAGTVRIGF SLGRREFSRA RYISGVSLVS GWMLAVITVL SLVLFRSPLV

351 SMYNNDPAVL SIAATVLLFA GLFQPADFTQ CIASYALRGY KVTKVPMFIH

401 AAAFWGCGLL PGYLLAYRFD MGIYGFWTAL IASLTIAAIA LVWCLELCSR

451 EMVRSHKAV*
```

m607/a607 98.9% identity in 459 aa overlap

```
                      10        20        30        40        50        60
m607.pep      MLLDLNRFSFPVFLKEVRLLTTLALPMLLAQVAQVGIGFVDTVMAGGAGKEDLAAVALGS
              |||||||||| ||||||||||||:||||||||||||||||||||||||||||||||||||
a607          MLLDLNRFSFSVFLKEVRLLTALALPMLLAQVAQVGIGFVDTVMAGGAGKEDLAAVALGS
                      10        20        30        40        50        60

                      70        80        90       100       110       120
m607.pep      SAFATVYITFMGIMAALNPMIAQLYGAGKTDEVGETGRQGIWFGLFLGVFGMVLMWAAIT
              ||||||||||||||||||||||||||||||||||||||||||||||||||||||||||||
a607          SAFATVYITFMGIMAALNPMIAQLYGAGKTDEVGETGRQGIWFGLFLGVFGMVLMWAAIT
                      70        80        90       100       110       120

                     130       140       150       160       170       180
m607.pep      PFRNWLTLSDYVEGTMAQYMLFTSLAMPAAMVHRALHAYTSSLNRPRLIMLVSFAAFVLN
              |||||||||||||||||||||||||||||||||||||||:||||||||||||||||||||
a607          PFRNWLTLSDYVEGTMAQYMLFTSLAMPAAMVHRALHAYASSLNRPRLIMLVSFAAFVLN
                     130       140       150       160       170       180

                     190       200       210       220       230       240
m607.pep      VPLNYIFVYGKFGMPALGGAGCGLATMAVFWFSALALWIYIAKENFFRPFGLTAKFGKPD
              ||||||||||||||||||||||||||||||||||||||||||||||||||||||||||||
a607          VPLNYIFVYGKFGMPALGGAGCGLATMAVFWFSALALWIYIAKENFFRPFGLTAKFGKPD
                     190       200       210       220       230       240

                     250       260       270       280       290       300
m607.pep      WAVFKQIWKIGAPIGLSYFLEASAFSFIVFLIAPFGEDYVAAQQVGISLSGILYMIPQSV
              ||||||||||||||||||||||||||||||||||||||||||||||||||||||||||||
a607          WAVFKQIWKIGAPIGLSYFLEASAFSFIVFLIAPFGEDYVAAQQVGISLSGILYMIPQSV
                     250       260       270       280       290       300

                     310       320       330       340       350       360
m607.pep      GSAGTVRIGFSLGRREFSRARYISGVSLVLGWMLAVITVLSLVLFRSPLVSMYNNDPAVL
              ||||||||||||||||||||||||||||| ||||||||||||||||||||||||||||||
a607          GSAGTVRIGFSLGRREFSRARYISGVSLVSGWMLAVITVLSLVLFRSPLVSMYNNDPAVL
                     310       320       330       340       350       360
```

-continued

```
                 370       380       390       400       410       420
m607.pep   SIAATVLLFAGLFQPADFTQCIASYALRGYKVTKVPMFIHAAAFWGCGLLPGYLLAYRFN
           |||||||||||||||||||||||||||||||||||||||||||||||||||||||||||:
a607       SIAATVLLFAGLFQPADFTQCIASYALRGYKVTKVPMFIHAAAFWGCGLLPGYLLAYRFD
                 370       380       390       400       410       420

                 430       440       450       460
m607.pep   MGIYGFWTALIASLTIAAIALVWCLELCSREMVRSHKAVX
           ||||||||||||||||||||||||||||||||||||||||
a607       MGIYGFWTALIASLTIAAIALVWCLELCSREMVRSHKAVX
                 430       440       450       460
```

The following partial DNA sequence was identified in *N. gonorrhoeae* <SEQ ID 1925>:

```
g608.seq
  1 ATGTCCGCCC TCCTCCCCAT CATCAACCGC CTGATTCTGC AAAGCCCGGA

 51 CAGCCGCTCG GAACTTACCT CCTTTGCAGG CAAAACACTG ACCCTGAACA

101 TTGCCGGGCT GAAACTGGCG GGACGCATCA CAGAAGACGG TTTGCTCTCG

151 GCGGGAAACG GCTTTGCAGA CACCGAAATT ACCTTCCGCA ACAGCGCGAT

201 ACGGAAAATC CTCCAAGGCG GCGAACCCGG GGCTGGCGAC ATCAGGCTCG

251 AAGGCGACCT CATCCTCGGC ATcGCGGTAC TGTCCCTGCT CGGCAGCCTG

301 CGTTCCCGCG CATCGGacgA ATTGGCACGG ATTTTCGGCA CGCAGGCAGg

351 catcggcagc CGTGCCACCG ACATCGGACA CGGCaTCaaa cAAATCGGCA

401 GGAACATCGC CGAACAAATC GGCGGATTTT CCCGCGAACC CGAGTCcgCa

451 aacaccggca acgaagccct tgccgactgc ctCGACGAAA TAAGCAGACT

501 GCGCGACGGC GTGGAACGCC TCAACGAACG CCTCGACAGG CTCGAACGCG

551 ACATTTGGAT AGACTAA
```

This corresponds to the amino acid sequence <SEQ ID 1926; ORF 608.ng>:

```
g608.pep
  1 MSALLPIINR LILQSPDSRS ELTSFAGKTL TLNIAGLKLA GRITEDGLLS

 51 AGNGFADTEI TFRNSAIRKI LQGGEPGAGD IRLEGDLILG IAVLSLLGSL

101 RSRASDELAR IFGTQAGIGS RATDIGHGIK QIGRNIAEQI GGFSREPESA

151 NTGNEALADC LDEISRLRDG VERLNERLDR LERDIWID*
```

The following partial DNA sequence was identified in *N. meningitidis* <SEQ ID 1927>:

```
m608.seq
  1 ATGTCCGCCC TCCTCCCCAT CATCAACCGC CTGATTCTGC AAAGCCCGGA

 51 CAGCCGCTCG GAACTTGCCG CCTTTGCAGG CAAAACACTG ACCCTGAACA

101 TTGCCGGGCT GAAACTGGCG GGACGCATCA CGGAAGACGG TTTGCTCTCG

151 GCGGGAAACG GCTTTGCAGA CACCGAAATT ACCTTCCGCA ACAGCGCGGT

201 ACAGAAAATC CTCCAAGGAG GCGAACCCGG GGCGGGCGAC ATCGGGCTCG

251 AAGGCGACCT CATCCTCGGC ATCGCGGTAC TGTCCCTGCT CGGCAGCCTG

301 CGTTCCCGCG CATCGGACGA ATTGGCACGG ATTTTCGGCA CGCAGGCAGA

351 CATCGGCAGC CGTGCCGCCG ACATCGGACA CGGCATCAAA CAAATCGGCA

401 GGAACATCGC CGAACAAATC GGCGGATTTT CCCGCGAATC CGAGTCCGCA
```

```
451 AACATCGGCA ACGAAGCCCT TGCCGACTGC CTCGACGAAA TAAGCAGACT

501 GCGCGACGGC GTGGAACGCC TCAACGAACG CCTCGACCGG CTCGAACGCG

551 ACATTTGGAT AGACTAA
```

This corresponds to the amino acid sequence <SEQ ID 1928; ORF 608>:

```
m608.pep
   1 MSALLPIINR LILQSPDSRS ELAAFAGKTL TLNIAGLKLA GRITEDGLLS

  51 AGNGFADTEI TFRNSAVQKI LQGGEPGAGD IGLEGDLILG IAVLSLLGSL

 101 RSRASDELAR IFGTQADIGS RAADIGHGIK QIGRNIAEQI GGFSRESESA

 151 NIGNEALADC LDEISRLRDG VERLNERLDR LERDIWID*
```

Computer analysis of this amino acid sequence gave the following results:
Homology with a Predicted ORF from *N. gonorrhoeae*
ORF 608 shows 95.2% identity over a 188 aa overlap with a predicted ORF (ORF 608.ng) from *N. gonorrhoeae*:

```
m608/g608
                        10         20         30         40         50         60
    m608.pep  MSALLPIINRLILQSPDSRSELAAFAGKTLTLNIAGLKLAGRITEDGLLSAGNGFADTEI
              ||||||||||||||||||||::|||||||||||||||||||||||||||||||||||||
    g608      MSALLPIINRLILQSPDSRSELTSFAGKTLTLNIAGLKLAGRITEDGLLSAGNGFADTEI
                        10         20         30         40         50         60

                        70         80         90        100        110        120
    m608.pep  TFRNSAVQKILQGGEPGAGDIGLEGDLILGIAVLSLLGSLRSRASDELARIFGTQADIGS
              ||||||::|||||||||||||| ||||||||||||||||||||||||||||||||| |||
    g608      TFRNSAIRKILQGGEPGAGDIRLEGDLILGIAVLSLLGSLRSRASDELARIFGTQAGIGS
                        70         80         80        100        110        120

                       130        140        150        160        170        180
    m608.pep  RAADIGHGIKQIGRNIAEQIGGFSRESESANIGNEALADCLDEISRLRDGVERLNERLDR
              ||:||||||||||||||||||||||||| |||| ||||||||||||||||||||||||||
    g608      RATDIGHGIKQIGRNIAEQIGGFSREPESANTGNEALADCLDEISRLRDGVERLNERLDR
                       130        140        150        160        170        180

                       189
    m608.pep  LERDIWIDX
              |||||||||
    g608      LERDIWIDX
```

The following partial DNA sequence was identified in *N. meningitidis* <SEQ ID 1929>:

```
a608.seq
   1 ATGTCCGCCC TCCTCCCCAT CATCAACCGC CTGATTCTGC AAAGCCCGGA

  51 CAGCCGCTCG GAACTTGCCG CCTTCGCAGG CAAAACACTG ACCCTGAACA

 101 TTGCCGGGTT GAAACTGGCG GGACGCATCA CGGAAGACGG TTTGCTCTCG

 151 GCGGGAAACG GCTTTGCAGA CACCGAAATC ACCTTCCGCA ACAGCGCGGT

 201 ACAGAAAATC CTCCAAGGCG GCGAACCCGG GGCGGGCGAC ATCGGGCTCG

 251 AAGGCGACCT CATCCTCGGC ATCGCGGTAC TGTCCCTGCT CGGCAGCCTG

 301 CGTTCCCGCG CATCGGACGA ATTGGCACGG ATTTTCGGCA CGCAGGCAGA

 351 CATCGGCAGC CGTGCCGCCG ACATCGGACA CGGCATCAAA CAAATCGGCA

 401 GGAACATCGC CGAACAAATC GGCAGATTTT CCCGCGAACC CGAGTCCGCA

 451 AACATCGGCA ACGAAGCCCT TGCCGACTGC CTCGACGAAA TAAGCAGACT
```

-continued

```
501 GCGCGACGGC GTGGAACGCC TCAACGAACG CCTCGACCGG CTCGAACGCG

551 ACATTTGGAT AGACTAA
```

This corresponds to the amino acid sequence <SEQ ID 1930; *ORF* 608.a>:

```
a608.pep
   1 MSALLPIINR LILQSPDSRS ELAAFAGKTL TLNIAGLKLA GRITEDGLLS

  51 AGNGFADTEI TFRNSAVQKI LQGGEPGAGD IGLEGDLILG IAVLSLLGSL

 101 RSRASDELAR IFGTQADIGS RAADIGHGIK QIGRNIAEQI GRFSREPESA

 151 NIGNEALADC LDEISRLRDG VERLNERLDR LERDIWID*
```

m608/a608 98.9% identity in 188 aa overlap

```
                  10        20        30        40        50        60
m608.pep   MSALLPIINRLILQSPDSRSELAAFAGKTLTLNIAGLKLAGRITEDGLLSAGNGFADTEI
           ||||||||||||||||||||||||||||||||||||||||||||||||||||||||||||
a608       MSALLPIINRLILQSPDSRSELAAFAGKTLTLNIAGLKLAGRITEDGLLSAGNGFADTEI
                  10        20        30        40        50        60

                  70        80        90       100       110       120
m608.pep   TFRNSAVQKILQGGEPGAGDIGLEGDLILGIAVLSLLGSLRSRASDELARIFGTQADIGS
           ||||||||||||||||||||||||||||||||||||||||||||||||||||||||||||
a608       TFRNSAVQKILQGGEPGAGDIGLEGDLILGIAVLSLLGSLRSRASDELARIFGTQADIGS
                  70        80        80       100       110       120

                 130       140       150       160       170       180
m608.pep   RAADIGHGIKQIGRNIAEQIGGFSRESESANIGNEALADCLDEISRLRDGVERLNERLDR
           |||||||||||||||||||| |||| |||||||||||||||||||||||||||||||||||
a608       RAADIGHGIKQIGRNIAEQIGRFSREPESANIGNEALADCLDEISRLRDGVERLNERLDR
                 130       140       150       160       170       180

                 189
m608.pep   LERDIWIDX
           |||||||||
a608       LERDIWIDX
```

The following partial DNA sequence was identified in *N. gonorrhoeae* <SEQ ID 1931>:

```
g609.seq
   1 ATGGTTGTGG ATAGACTCGA AATTCTCGCT CTCGACGACG AAACTCTTGA

  51 TGCGTTTGTC GGCAATCAGC GAAGTAGCGA CATCGCGCAC CATATCTTCC

 101 ACGAATTTCG GGTTTTCGTA GGCCTTTTCG GTAACGTATT TTTCATCGGG

 151 GCGTTTGAGC AGGCCGTAGA GTTGGCAGCT CGCCTGCGTT TCCACATAAT

 201 CGATAACTTC CTCGATACCG ACTTCGGCAT CGGAAGTCAG GCTGACGGTA

 251 ACGTGCGAAC GCTGATTATG CGCGCCATAT TGGGAAATTT CTTTGGAACA

 301 CGGGCAAAGC GAGGTTACGG GAATCATGAC CTTCATACTG TGGCCGTATG

 351 CCCCGTCTTT CATTTCACCC GTGAGGCTGA CATCATAATC CAGtaa
```

This corresponds to the amino acid sequence <SEQ ID 1932; *ORF* 609.ng>:

```
g609.pep
   1 MVVDRLEILA LDDETLDAFV GNQRSSDIAH HIFHEFRVFV GLFGNVFFIG

  51 AFEQAVELAA RLRFHIIDNF LDTDFGIGSQ ADGNVRTLIM RAILGNFFGT

 101 RAKRGYGNHD LHTVAVCPVF HFTREADIII Q*
```

The following partial DNA sequence was identified in *N. meningitidis* <SEQ ID 1933>:

```
m609.seq
  1 ATGGTTGTGG ATAGACTCGA AATTCTCGCT CTCGACGACG AAACTCTTGA

 51 TGCGTTTGTC GGCAATCAGC GAAGTAGCGA CATCGCGCAC CATATCTTCC

101 ACGAATTTCG GGTTTTCGTA GGCTTTTTCG GTAACGTATT TTTCATCGGG

151 GCGTTTGAGC AGGCCGTAGA GTTGGCAGCT CGCCTGCGCC TCCACATAAT

201 CGATGACTTC CTCGATACCG ACTTCGGCAT CGGCAGTCAG GCTGACGGTA

251 ACGTGCGAAC GCTGGTTGTG CGCGCCGTAT TGGGAAATTT CTTTGGAACA

301 CGGGCAAAGC GAGGTTACGG GAATCATGAC CTTCATACTG TGGCCGTATG

351 CCCCGTCTTT GATTTCGCCC GTGAGACAGA CATCATAATC CAGTAA
```

This corresponds to the amino acid sequence <SEQ ID 1934; *ORF* 609>:

```
m609.pep

      1   MVVDRLEILA LDDETLDAFV GNQRSSDIAH HIFHEFRVFV GFFGNVFFIG

     51   AFEQAVELAA RLRLHIIDDF LDTDFGIGSQ ADGNVRTLVV RAVLGNFFGT

    101   RAKRGYGNHD LHTVAVCPVF DFARETDIII Q*

m609/g609 93.1% identity in 131 aa overlap

                   10        20        30        40        50        60
m609.pep   MVVDRLEILALDDETLDAFVGNQRSSDIAHHIFHEFRVFVGFFGNVFFIGAFEQAVELAA
           ||||||||||||||||||||||||||||||||||||||||||:|||||||||||||||||
g609       MVVDRLEILALDDETLDAFVGNQRSSDIAHHIFHEFRVFVGLFGNVFFIGAFEQAVELAA
                   10        20        30        40        50        60

                   70        80        90       100       110       120
m609.pep   RLRLHIIDDFLDTDFGIGSQADGNVRTLVVRAVLGNFFGTRAKRGYGNHDLHTVAVCPVF
           |||:||||:||||||||||||||||||||::||:||||||||||||||||||||||||||
g609       RLRFHIIDNFLDTDFGIGSQADGNVRTLIMRAILGNFFGTRAKRGYGNHDLHTVAVCPVF
                   70        80        90       100       110       120

                  130
m609.pep   DFARETDIIIQX
            |:||:||||||
g609       HFTREADIIIQX
                  130
```

The following partial DNA sequence was identified in *N. meningitidis* <SEQ ID 1935>:

```
a609.seq
  1 ATGGTTGTGG ATAGACTCGA AATTCTCGCT CTCGACGACG AAACTCTTGA

 51 TGCGTTTGTC GGCAATCAGC GAAGTAGCGA CATCGCGCAC CATATCTTCC

101 ACGAATTTCG GGTTTTCGTA GGCTTTTTCG GTAACGTATT TTTCATCGGG

151 GCGTTTGAGC AGGCCGTAGA GTTGGCAGCT CGCCTGCGCC TCCACATAAT

201 CGATGACTTC CTCGATACCG ACTTCGGCAT CGGCAGTCAG GCTGACGGTA

251 ACGTGCGAAC GCTGGTTGTG CGCGCCATAT TGGGAAATTT CTTTGGAACA

301 CGGGCAAAGC GAGGTTACGG GAATCATGAC CTTCATACTG TGGCCGTATG

351 CACCGTCTTT CATTTCGCCC GTGAGGCTGA CATCATAATC CAGTAA
```

This corresponds to the amino acid sequence <SEQ ID 1936; *ORF* 609.a>:

```
m609.pep

      1   MVVDRLEILA LDDETLDAFV GNQRSSDIAH HIFHEFRVFV GFFGNVFFIG

     51   AFEQAVELAA RLRLHIIDDF LDTDFGIGSQ ADGNVRTLVV RAVLGNFFGT

    101   RAKRGYGNHD LHTVAVCPVF DFARETDIII Q*

m609/g609  93.1% identity in 131 aa overlap

                 10        20        30        40        50        60
m609.pep  MVVDRLEILALDDETLDAFVGNQRSSDIAHHIFHEFRVFVGFFGNVFFIGAFEQAVELAA
          ||||||||||||||||||||||||||||||||||||||||:|||||||||||||||||||
g609      MVVDRLEILALDDETLDAFVGNQRSSDIAHHIFHEFRVFVGLFGNVFFIGAFEQAVELAA
                 10        20        30        40        50        60

                 70        80        90       100       110       120
m609.pep  RLRLHIIDDFLDTDFGIGSQADGNVRTLVVRAVLGNFFGTRAKRGYGNHDLHTVAVCPVF
          |||:||||:|||||||||||||||||||::||:|||||||||||||||||||||||||||
g609      RLRFHIIDNFLDTDFGIGSQADGNVRTLIMRAILGNFFGTRAKRGYGNHDLHTVAVCPVF
                 70        80        90       100       110       120

                130
m609.pep  DFARETDIIIQX
           |:||:||||||
g609      HFTREADIIIQX
                130
```

130

The following partial DNA sequence was identified in *N. gonorrhoeae* <SEQ ID 1937>:

```
g610.seq
     1  ATGATTGGAG GGCTTATGCA ATTTCCTTAC CGCAATGTTC CGGCTTCGCG

    51  TATGCGCCGT ATGCGCAGGG ATGATTTTTC ACGCCGCCTG ATGCGCGAGC

   101  ATATGCTGAC CGCCGATGAT TTGATTTATC CGGTGTTCGT ATTGGAGGGG

   151  GCGGCGCGCG AGGAGGATGT GCCTTCTATG CCGGGCGTGA AGCGTCAGAG

   201  TTTGGACAGG CTGCTGTTTA CGGCGGAAGA GGCGGTGAAG CTCGGTATTC

   251  CGATGTTGGC ACTCTTTCCC GTGGTTACGG CAAACAAAAC CGGGCGTGCG

   301  CAGGAGGCGT ACAATCCCGA AGGACTCGTG CCGTCAACTG tccgagccTT

   351  GCGCGAGAGG TttcCcgaac tggggattat gacggatgtc gcgctcgAtc

   401  cttatacggt gcacGGTCAG GACGGACTGA CGGACgaaaa cggttaCGTG

   451  ATGAatgATg aaaCCGTAGA AGTCTTGGTG AAACAGGCTT TATGTCATGC

   501  AGAGGCGGGC ACGCAGGTCG TTGCTCCTTC CGATATGATG GACGGGCGTA

   551  TCGGCGCCAT CCGCGAGGCT TTGGAGGATG CCGGACATAT CCATACGCGG

   601  ATTATGGCAT ATTCCGCCAA ATATGCTTCT GCATTCTACG GCCCTTTCCG

   651  TGATGCGGTA GGCAGTTCGG GCAATTTGGG AAAGGCAGAT AAAAAGACCT

   701  ATCAGATGGA TCCTGCAAAT ACCGATGAGG CGCTGCATGA AGTGGCGCTC

   751  GATATTCAGG AAGGTGCGGA TATGGTGATG GTGAAGCCCG GTTTGCCGTA

   801  TTTGGACGTT GTCCGCCGCG TGAAGGACGA GTTCGGCGTA CCGACTTATG

   851  CCTATCAGGT TTCGGGCGAA TATGCGATGT TGCAGGCGGC GGTTGCCAAC

   901  GGCTGGCTGG ACGGCGGCAA AGTGGTTTTG GAAAGCCTGC TGGCATTCAA

   951  ACGTGCGGGT GCGGACGGGA TTTTGACCTA TTACGCCATT GAGGCGGCAA

  1001  AGATGCTGAA GCGTTGA
```

This corresponds to the amino acid sequence <SEQ ID 1938; *ORF* 610.ng>:

```
g610.pep
  1 MIGGLMQFPY RNVPASRMRR MRRDDFSRRL MREHMLTADD LIYPVFVLEG
 51 AAREEDVPSM PGVKRQSLDR LLFTAEEAVK LGIPMLALFP VVTANKTGRA
101 QEAYNPEGLV PSTVRALRER FPELGIMTDV ALDPYTVHGQ DGLTDENGYV
151 MNDETVEVLV KQALCHAEAG TQVVAPSDMM DGRIGAIREA LEDAGHIHTR
201 IMAYSAKYAS AFYGPFRDAV GSSGNLGKAD KKTYQMDPAN TDEALHEVAL
251 DIQEGADMVM VKPGLPYLDV VRRVKDEFGV PTYAYQVSGE YAMLQAAVAN
301 GWLDGGKVVL ESLLAFKRAG ADGILTYYAI EAAKMLKR*
```

The following partial DNA sequence was identified in *N. meningitidis* <SEQ ID 1939>:

```
m610.seq
   1 ATGATTGGAG GGCTTATGCA GTTTCCTTAC CGCAATGTTC CGGCTTCGCG
  51 TATGCGCCGT ATGCGCAGGG ACGATTTTTC ACGCCGCCTG ATGCGCGAAC
 101 ACACGCTGAC CGCCGATGAT TTGATTTATC CGGTGTTCGT ATTGGAGGGG
 151 TCGGCGCGCG AGGAGGATGT GCCTTCTATG CCGGGTGTGA AGCGTCAAAG
 201 TTTGGACAGG CTGCTGTTTA CGGCGGAAGA GGCGGTAAAG CTCGGTATTC
 251 CGATGTTGGC ACTGTTCCCC GTGGTTACGG CAAACAAAAC CGAGCGTGCG
 301 CAGGAGGCGT ACAATCCCGA AGGACTCGTG CCGTCAACTG TCCGCGCCTT
 351 GCGCGAGAGG TTTCCCGAAC TGGGCATTAT GACGGATGTC GCGCTCGATC
 401 CTTATACGGT TCACGGTCAG GACGGGCTGA CGGACGAAAA CGGTTATGTG
 451 ATGAACGATG AAACCGTAGA GGTTTTGGTC AAGCAGGCTT TGTGCCACGC
 501 TGAAGCGGGC GCGCAGGTGG TTGCCCCTTC CGATATGATG GACGGGCGTA
 551 TCGGTGCGAT TCGCGAGGCG TTGGAGGATG CCGGGCATAT CCATACGCGG
 601 ATTATGGCGT ATTCCGCCAA ATATGCTTCT GCATTTTACG GCCCTTTCCG
 651 TGATGCGGTA GGCAGTTCGG GCAATTTGGG CAAGGCAGAT AAAAAGACCT
 701 ACCAGATGGA TCCGGCAAAT ACCGATGAGG CGTTGCACGA AGTGGCGTTG
 751 GACATTCAGG AAGGTGCGGA TATGGTAATG GTCAAGCCCG GTTTGCCGTA
 801 TTTGGACGTT GTCCGCCGCG TAAAGGACGA GTTCGGTGTG CCGACTTATG
 851 CCTATCAGGT TTCGGGAGAA TACGCGATGT TGCAGGCAGC GATTGCCAAC
 901 GGCTGGCTGG ACGGCGGCAA AGTGGTTTTG GAAAGCCTGC TGGCATTCAA
 951 ACGTGCGGGT GCGGACGGGA TTTTGACCTA TTACGCTATT GAGGCGGCAA
1001 AGATGTTGAA GCGTTGA
```

This corresponds to the amino acid sequence <SEQ ID 1940; ORF 610>:

```
m610.pep
  1 MIGGLMQFPY RNVPASRMRR MRRDDFSRRL MREHTLTADD LIYPVFVLEG
 51 SAREEDVPSM PGVKRQSLDR LLFTAEEAVK LGIPMLALFP VVTANKTERA
101 QEAYNPEGLV PSTVRALRER FPELGIMTDV ALDPYTVHGQ DGLTDENGYV
151 MNDETVEVLV KQALCHAEAG AQVVAPSDMM DGRIGAIREA LEDAGHIHTR
```

-continued

```
201 IMAYSAKYAS AFYGPFRDAV GSSGNLGKAD KKTYQMDPAN TDEALHEVAL

251 DIQEGADMVM VKPGLPYLDV VRRVKDEFGV PTYAYQVSGE YAMLQAAIAN

301 GWLDGGKVVL ESLLAFKRAG ADGILTYYAI EAAKMLKR*
```

m610/g610 98.5% identity in 338 aa overlap

```
                   10        20        30        40        50        60
m610.pep   MIGGLMQFPYRNVPASRMRRMRRDDFSRRLMREHTLTADDLIYPVFVLEGSAREEDVPSM
           |||||||||||||||||||||||||||||||||| |||||||||||||||:|||||||||
g610       MIGGLMQFPYRNVPASRMRRMRRDDFSRRLMREHMLTADDLIYPVFVLEGAAREEDVPSM
                   10        20        30        40        50        60

                   70        80        90       100       110       120
m610.pep   PGVKRQSLDRLLFTAEEAVKLGIPMLALFPVVTANKTERAQEAYNPEGLVPSTVRALRER
           ||||||||||||||||||||||||||||||||||||| ||||||||||||||||||||||
g610       PGVKRQSLDRLLFTAEEAVKLGIPMLALFPVVTANKTGRAQEAYNPEGLVPSTVRALRER
                   70        80        90       100       110       120

                  130       140       150       160       170       180
m610.pep   FPELGIMTDVALDPYTVHGQDGLTDENGYVMNDETVEVLVKQALCHAEAGAQVVAPSDMM
           ||||||||||||||||||||||||||||||||||||||||||||||||||:|||||||||
g610       FPELGIMTDVALDPYTVHGQDGLTDENGYVMNDETVEVLVKQALCHAEAGTQVVAPSDMM
                  130       140       150       160       170       180

                  190       200       210       220       230       240
m610.pep   DGRIGAIREALEDAGHIHTRIMAYSAKYASAFYGPFRDAVGSSGNLGKADKKTYQMDPAN
           ||||||||||||||||||||||||||||||||||||||||||||||||||||||||||||
g610       DGRIGAIREALEDAGHIHTRIMAYSAKYASAFYGPFRDAVGSSGNLGKADKKTYQMDPAN
                  190       200       210       220       230       240

                  250       260       270       280       290       300
m610.pep   TDEALHEVALDIQEGADMVMVKPGLPYLDVVRRVKDEFGVPTYAYQVSGEYAMLQAAIAN
           |||||||||||||||||||||||||||||||||||||||||||||||||||||||||:||
g610       TDEALHEVALDIQEGADMVMVKPGLPYLDVVRRVKDEFGVPTYAYQVSGEYAMLQAAVAN
                  250       260       270       280       290       300

                  310       320       330      339
m610.pep   GWLDGGKVVLESLLAFKRAGADGILTYYAIEAAKMLKRX
           ||||||||||||||||||||||||||||||||||||||
g610       GWLDGGKVVLESLLAFKRAGADGILTYYAIEAAKMLKRX
                  310       320       330
```

The following partial DNA sequence was identified in *N. meningitidis* <SEQ ID 1941>:

```
a610.seq
    1  ATGATTGGAG GGCTTATGCA GTTTCCTTAC CGCAATGTTT CGGCTTCGCG

   51  TATGCGCCGT ATGCGCAGGG ACGATTTTTC ACGCCGCCTG ATGCGCGAGC

  101  ATACGCTGAC TGCCGATGAT TTGATTTATC CGGTGTTCGT ATTGGAGGGG

  151  TCGGCGCGCG AGGAGGATGT GCCTTCTATG CCGGGCGTGA AGCGTCAGAG

  201  TTTGGACAGG CTGCTGTTTA CGGCGGAAGA GGCGGTAAAG CTCGGTATTC

  251  CGATGTTGGC ACTGTTCCCC GTGGTTACGG CAAACAAAAC CGAGCGTGCG

  301  CAGGAGGCGT ACAATCCCGA AGGACTCGTG CCGTCAACTG TCCGCGCCTT

  351  GCGCGAGAGG TTTCCCGAAC TGGGCATTAT GACGGATGTC GCGCTCGATC

  401  CTTATACGGT GCACGGTCAG GACGGGCTGA CGGACGAAAA CGGTTATGTG

  451  ATGAACGATG AAACCGTAGA GGTTTTGGTC AAGCAGGCTT TGTGTCATGC

  501  AGAGGCAGGC GCACAGGTCG TTGCTCCTTC CGATATGATG GATGGGCGTA

  551  TCGGTGCGAT TCGCGAGGCG TTGGAGGATG CCGGGCATAT CCATACGCGG

  601  ATTATGGCGT ATTCCGCCAA ATATGCTTCT GCATTTTACG GCCCTTTCCG

  651  TGATGCGGTA GGCAGTTCGG GCAATTTGGG CAAGGCAGAT AAAAAGACCT

  701  ACCAGATGGA TCCGGCAAAT ACCGATGAGG CGTTGCACGA AGTGGCGTTG

  751  GACATTCAGG AAGGTGCGGA TATGGTGATG GTCAAGCCCG GTTTGCCGTA

  801  TTTGGACGTT GTCCGCCGCG TGAAGGACGA GTTCGGCGTG CCGACTTATG

  851  CCTATCAGGT TTCGGGAGAA TACGCGATGC TGCAGGCGGC GGTTGCCAAC
```

-continued

```
 901  GGCTGGCTGG ACGGCGGCAA AGTGGTTTTG GAAAGCCTGC TGGCATTCAA

 951  ACGTGCGGGT GCGGATGGGA TTTTGACCTA TTACGCCATT GAGGCGGCAA

1001  AGATGCTGAA GCGTTGA
```

This corresponds to the amino acid sequence <SEQ ID 1942; *ORF* 610.a>:

```
a610.pep

      1   MIGGLMQFPY RNVSASRMRR MRRDDFSRRL MREHTLTADD LIYPVFVLEG

     51   SAREEDVPSM PGVKRQSLDR LLFTAEEAVK LGIPMLALFP VVTANKTERA

    101   QEAYNPEGLV PSTVRALRER FPELGIMTDV ALDPYTVHGQ DGLTDENGYV

    151   MNDETVEVLV KQALCHAEAG AQVVAPSDMM DGRIGAIREA LEDAGHIHTR

    201   IMAYSAKYAS AFYGPFRDAV GSSGNLGKAD KKTYQMDPAN TDEALHEVAL

    251   DIQEGADMVM VKPGLPYLDV VRRVKDEFGV PTYAYQVSGE YAMLQAAVAN

    301   GWLDGGKVVL ESLLAFKRAG ADGILTYYAI EAAKMLKR*

m610/a610  99.4% identity in 388 aa overlap

                    10        20        30        40        50        60
m610.pep   MIGGLMQFPYRNVPASRMRRMRRDDFSRRLMREHTLTADDLIYPVFVLEGSAREEDVPSM
           |||||||||||| |||||||||||||||||||||||||||||||||||||||||||||||
a610       MIGGLMQFPYRNVSASRMRRMRRDDFSRRLMREHTLTADDLIYPVFVLEGSAREEDVPSM
                    10        20        30        40        50        60

                    70        80        90       100       110       120
m610.pep   PGVKRQSLDRLLFTAEEAVKLGIPMLALFPVVTANKTERAQEAYNPEGLVPSTVRALRER
           ||||||||||||||||||||||||||||||||||||||||||||||||||||||||||||
a610       PGVKRQSLDRLLFTAEEAVKLGIPMLALFPVVTANKTERAQEAYNPEGLVPSTVRALRER
                    70        80        90       100       110       120

                   130       140       150       160       170       180
m610.pep   FPELGIMTDVALDPYTVHGQDGLTDENGYVMNDETVEVLVKQALCHAEAGAQVVAPSDMM
           ||||||||||||||||||||||||||||||||||||||||||||||||||||||||||||
a610       FPELGIMTDVALDPYTVHGQDGLTDENGYVMNDETVEVLVKQALCHAEAGAQVVAPSDMM
                   130       140       150       160       170       180

                   190       200       210       220       230       240
m610.pep   DGRIGAIREALEDAGHIHTRIMAYSAKYASAFYGPFRDAVGSSGNLGKADKKTYQMDPAN
           ||||||||||||||||||||||||||||||||||||||||||||||||||||||||||||
a610       DGRIGAIREALEDAGHIHTRIMAYSAKYASAFYGPFRDAVGSSGNLGKADKKTYQMDPAN
                   190       200       210       220       230       240

                   250       260       270       280       290       300
m610.pep   TDEALHEVALDIQEGADMVMVKPGLPYLDVVRRVKDEFGVPTYAYQVSGEYAMLQAAIAN
           |||||||||||||||||||||||||||||||||||||||||||||||||||||||||:||
a610       TDEALHEVALDIQEGADMVMVKPGLPYLDVVRRVKDEFGVPTYAYQVSGEYAMLQAAVAN
                   250       260       270       280       290       300

                   310       320       330      339
m610.pep   GWLDGGKVVLESLLAFKRAGADGILTYYAIEAAKMLKRX
           ||||||||||||||||||||||||||||||||||||||
a610       GWLDGGKVVLESLLAFKRAGADGILTYYAIEAAKMLKRX
                   310       320       330
```

The following partial DNA sequence was identified in *N. gonorrhoeae* <SEQ ID 1943>:

```
g611.seq
   1 ATGCCGTCTG AAAACGGGAT GGGAAAACGG CAGCTTGCGG GCTGCCGTTT

  51 GTTCGGGAAG TTAAGCCTTG TTTTCAGGCT GCTGCCCGGA CTCTGTCGAG

 101 GCGGTGTCTG CCGGGGCAGG TGCTTCGGTT TTTTCCCGAG TCGGAGCGTG

 151 CGGCGCGTTA TCTTCCGCCG CGTCCGCATT Ctcgcgcagg ttgtGGCtgt

 201 tatcctTGGG CGGGCTGggt tgtttgcccg ccataaTTtc cagtacctgA

 251 TcgcgGTCta tggtttcCCa ttCcatcagg gctttgcaca TCGTTTCCAT

 301 cttgTCGCGG TTTTcatcga ggaTTTTGTA ggcaacCTGA TACTgctcgt
```

-continued

```
351 ccaaaAtccg Gcggatttcc gcgtcgAtgt cctgctgggt tTTCTCGGAA

401 ATGTTTTGCG AACGGgttac gctGCGCCCC AAGAAGACTT CGCCTTCGTT

451 TTCCGCATAA ACCATCACGC CCATTTTGtc gCTCAtgcCG TAGCGCGTTA

501 CCATTTCGCG TGCCATTTGG GTTGCGCGTT CAAAGTCGTT TGA
```

This corresponds to the amino acid sequence <SEQ ID 1944; *ORF* 611.ng>:

```
g611.pep
  1 MPSENGMGKR QLAGCRLFGK LSLVFRLLPG LCRGGVCRGR CFGFFPSRSV

 51 RRVIFRRVRI LAQVVAVILG RAGLFARHNF QYLIAVYGFP FHQGFAHRFH

101 LVAVFIEDFV GNLILLVQNP ADFRVDVLLG FLGNVLRTGY AAPQEDFAFV

151 FRINHHAHFV AHAVARYHFA CHLGCAFKVV *
```

The following partial DNA sequence was identified in *N. meningitidis* <SEQ ID 1945>:

```
m611.seq
  1 ATGCCGTCTG AAAACGGGAT GGGAAAACGG CAGCTTGCGG GCTGCCGTTT

 51 GTTCGGGAAG TTAAGCCTTG TTTTCAGGCT GCTGCTCGGA CTCTGTCGAA

101 GCGGTGTCTG CCGGGGCAGG TGCTTCGGTT TCTTCCCGAG TCGGAGCGTG

151 CGGCGCGTTA TCTTCCGCCG CGTCCGCATT CTCGCGCAGG TTGTGGCTGT

201 AATCTTTGGG CGGGCTGGGT TGTTTGCCCG CCATGATTTC CAGTACCTGA

251 TCGCGGTCGA TGGTTTCCCA TTCCATCAGG GCTTTGCACA TCGTTTCCAT

301 CTTGTCGCGG TTTTCATCGA GGATTTTGTA GGCAACCTGA TATTGCTCGT

351 CCAAAATCCG GCGGATTTCC GCGTCGATGT CCTGCTGGGT TTTCTCGGAA

401 ATGTTTTGCG AACGGGTTAC GCTGCGTCCC AAGAAGACTT CGCCTTCGTT

451 TTCCGCATAA ACCATCACGC CCATTTTGTC GCTCATGCCG TAGCGCGTTA

501 CCATTTCGCG CGCCATTTGG GTTGCGCGTT CAAAGTCGTT TGA
```

This corresponds to the amino acid sequence <SEQ ID 1946; *ORF* 611>:

```
m611.pep

      1   MPSENGMGKR QLAGCRLFGK LSLVFRLLLG LCRSGVCRGR CFGRRPSRSV

     51   RRVIFRRVRI LAQVVAVIFG RAGLFARHDF QYLIAVDGFP FHQGFAHRFH

    101   LVAVFIEDFV GNLILLVQNP ADFRVDVLLG FLGNVLRTGY AASQEDFAFV

    151   FRINHHAHFV AHAVARYHFA RHLGCAFKVV *

m611/g611 96.1% identity in 180 aa overlap

                    10        20        30        40        50        60
m611.pep    MPSENGMGKRQLAGCRLFGKLSLVFRLLLGLCRSGVCRGRCFGFFPSRSVRRVIFRRVRI
            |||||||||||||||||||||||||||| ||||:||||||||||||||||||||||||||
g611        MPSENGMGKRQLAGCRLFGKLSLVFRLLPGLCRGGVCRGRCFGFFPSRSVRRVIFRRVRI
                    10        20        30        40        50        60

                    70        80        90       100       110       120
m611.pep    LAQVVAVUFGRAGKFARGDFQYKIAVDGFPFHQGFAHRFHLVAVFIEDFVGNLILLVQNP
            ||||||||:|||||||||:||||||| |||||||||||||||||||||||||||||||||
g611        LAQVVAVULGRAGKFARGNFQYKIAVYGFPFHQGFAHRFHLVAVFIEDFVGNLILLVQNP
                    70        80        90       100       110       120
```

-continued

```
                130       140       150       160       170       180
m611.pep  ADFRVDVLLGFLGNVLRTGYAASQEDFAFVFRINHHAHFVAHAVARYHFARHLGCAFKVV
          |||||||||||||||||||||| ||||||||||||||||||||||||||| |||||||||
g611      ADFRVDVLLGFLGNVLRTGYAAPQEDFAFVFRINHHAHFVAHAVARYHFACHLGCAFKVV
                130       140       150       160       170       180

m611.pep  X
          |
g611      X
```

The following partial DNA sequence was identified in *N. meningitidis* <SEQ ID 1947>:

```
a611.seq
  1 ATGCCGTCTG AAAACAGGAT GGGAAAACGG CAGCTTGCGG GCTGCCGTTT

 51 GTTCGGGAAG TTAAGCCTTG TTTTCAGGCT GCTGCTCGGA CTCTGTCGAA

101 GCGGTGTCTG CCGGGGCAGG TGCTTCGGTT TCTTCCCGAG TCGGAGCGTG

151 CGGCGCGTTA TCTTCCGCCG CGTCCGCATT CTCGCGCAGG TTGTGGCTGT

201 AATCTTTGGG CGGGCTGGGT TGTTTGCCCG CCATGATTTC CAGTACCTGA

251 TCGCGGTCGA TGGTTTCCCA TTCCATCAGG GCTTTGCACA TCGTTTCCAT

301 CTTGTCGCGG TTTTCATCGA GGATTTTGTA GGCAACCTGA TACTGCTCGT

351 CCAAAATCCG GCGGATTTCC GCATCGATGT CCTGCTGGGT TTTCTCGGAA

401 ATGTTTTGCG AACGGGTTAC GCTGCGTCCC AAGAAGACTT CGCCTTCGTT

451 TTCCGCATAA ACCATCACGC CCATTTTGTC GCTCATGCCG TAGCGCGTTA

501 CCATTTCGCG CGCCATTTGG GTTGCGCGTT CAAAGTCGTT TGA
```

This corresponds to the amino acid sequence <SEQ ID 1948; *ORF* 611.a>:

```
a611.pep

      1 MPSENRMGKR GLAGCRLFGK LSLVFRLLLG LCRSGVCRGR CFGFFPSRSV

     51 RRVIFRRVRI LAQVVAVIFG RAGLFARHDF QYLIAVDGFP FHQGFAHRFH

    101 LVAVFIEDFV GNLILLVQNP ADFRIDVLLG FLGNVLRTGY AASQEDFAFV

    151 FRINHHAHFV AHAVARYHFA RHLGCAFKVV *

m611/a611  98.9% identity in 180 aa overlap

                10        20        30        40        50        60
m611.pep  MPSENGMGKRQLAGCRLFGKLSLVFRLLLGLCRSGVCRGRCFGFFPSRSVRRVIFRRVRI
          ||||| ||||||||||||||||||||||||||||||||||||||||||||||||||||||
a611      MPSENRMGKRQLAGCRLFGKLSLVFRLLLGLCRSGVCRGRCFGFFPSRSVRRVIFRRVRI
                10        20        30        40        50        60
                70        80        90       100       110       120
m611.pep  LAQVVAVIFGRAGLFARHDFQYLIAVDGFPFHQGFAHRFHLVAVFIEDFVGNLILLVQNP
          ||||||||||||||||||||||||||||||||||||||||||||||||||||||||||||
a611      LAQVVAVIFGRAGLFARHDFQYLIAVDGFPFHQGFAHRFHLVAVFIEDFVGNLILLVQNP
                70        80        90       100       110       120
               130       140       150       160       170       180
m611.pep  ADFRVDVLLGFLGNVLRTGYAASQEDFAFVFRINHHAHFVAHAVARYHFARHLGCAFKVV
          ||||:|||||||||||||||||||||||||||||||||||||||||||||||||||||||
a611      ADFRIDVLLGFLGNVLRTGYAASQEDFAFVFRINHHAHFVAHAVARYHFARHLGCAFKVV
               130       140       150       160       170       180

m611.pep  X
          |
a611      X
```

The following partial DNA sequence was identified in *N. gonorrhoeae* <SEQ ID 1949>:

```
g612.seq
    1 ATGGgcttcg gcggcaatat tgcAAAAAAG CTGGCcggGg taGATGAAAT

   51 AGCCTttgac tttgacggcA TCGTCTTTGA TTTCGGGCGT GATGATGCTG

  101 TCCGGCataG CGGCGTAATC AATGCTGCTG TCGCCGGCCT GCATATAGTC

  151 GGTGAAGTTT TCGCTGATAA AGCGGTAGAA AAGTGTGCCG AGAACGTATT

  201 GTTTAAAGTC CCAGCCATCC ACCGCGCCGC GTACTTCGTC GGCGATTTTC

  251 CAAATTTGGC GGTGCAGTTG GGCGCGTTGT TGCATTTCGG TCATCATCGA

  301 AATCCATATA TAAAGTTAAA CAAATCAAAA TCGCCTGATA TTTTCAGACG

  351 ATTTTTTTAC GGGCATTCAA ATTAA
```

This corresponds to the amino acid sequence <SEQ ID 1950; ORF 612.ng>:

```
g612.pep
    1 MGFGGNIAKK LAGVDEIAFD FDGIVFDFGR DDAVRHSGVI NAAVAGLHIV

   51 GEVFADKAVE KCAENVLFKV PAIHRAAYFV GDFPNLAVQL GALLHFGHHR

  101 NPYIKLNKSK SPDIFRRFFY GHSN*
```

The following partial DNA sequence was identified in *N. meningitidis* <SEQ ID 1951>:

```
m612.seq
    1 ATGGGCTTCG GCGGCAATAT TGCAAAAAAG CTGGCCGGGG TAGATGAAAT

   51 AGCCTTTAAC TTTGACGGCA TCGTCTTTGA TTTCGGGCGT GATGATGCTG

  101 TCCGGCATAG CGGCGTAATC AATACTGCTG TCGCCTGCCT GCATATAGTC

  151 GGTGAAGTTT TCGCTGATAA AGCGGTAGAA AAGTGTGCCG AGAACGTATT

  201 GTTTAAAGTC CCAGCCATCC ACCGCGCCGC GTACTTCGTC GGCAATTTTC

  251 CAAATTTGGC GGTGCAGTTG GGCGCGTTGT TGCATTTCGG TCATCATCGA

  301 AATCCATATA .AAAGTTAAA CAAATCAAAA TCGCCTGATA TTTTCAGACG

  351 ATTTTTTTAC GGGCATTCAA ATTAA
```

This corresponds to the amino acid sequence <SEQ ID 1952; *ORF* 612>:

```
m612.pep

    1 MGFGGNIAKK LAGVDEIAFN FDGIVFDFGR DDAVRHSGVI NTAVACLHIV

   51 GEVFADKAVE KCAENVLFKV PAIHRAAYFV GNFPNLAVQL GALLHFGHHR

  101 NPYXKLNKSK SPDIFRRFFY GHSN*

m612/g612 96.0% identity in 124 aa overlap

                    10        20        30        40        50        60
m612.pep   MGFGGNIAKKLAGVDEIAFNFDGIVFDFGRDDAVRHSGVINTAVACLHIVGEVFADKAVE
           |||||||||||||||||||:|||||||||||||||||||||:||| ||||||||||||||
g612       MGFGGNIAKKLAGVDEIAFDFDGIVFDFGRDDAVRHSGVINAAVAGLHIVGEVFADKAVE
                    10        20        30        40        50        60

                    70        80        90       100       110       120
m612.pep   KCAENVLFKVPAIHRAAYFVGNFPNLAVQLGALLHFGHHRNPYXKLNKSKSPDIFRRFFY
           |||||||||||||||||||||:||||||||||||||||||||| ||||||||||||||||
g612       KCAENVLFKVPAIHRAAYFVGDFPNLAVQLGALLHFGHHRNPYIKLNKSKSPDIFRRFFY
                    70        80        90       100       110       120
```

-continued

```
m612.pep   GHSNX
           |||||
g612       GHSNX
```

The following partial DNA sequence was identified in *N. meningitidis* <SEQ ID 1953>:

```
a612.seq
   1 ATGGGCTTCG GCGGCAATAT TGCAAAAAAG CTGGCCGGGG TAGATGAAAT

  51 AGCCTTTGAC TTTGACGGCA TCGTCTTTGA TTTCGGGCGT GATGATGCTG

 101 TCCGGCATAG CGGCGTAATC AATACTGCTG TCGCCTGCCT GCATATAGTC

 151 GGTAAAGTTT TCGCTGATAA AGCGGTAGAA AAGTGTGCCG AGAACGTATT

 201 GTTTGAAGTC CCAGCCATCC ACCGCGCCGC GTACTTCGTC GGCAATTTTC

 251 CAAATTTGGC GGTGCAGTTG GGCGCGTTGT TGTATTTCGG TCATCATCGA

 301 AATCCATAT. AAAAGTTAAA CAAATCAAAA TCGCCTGATA TTTTCAGACG

 351 ATTTTTT.AC GGGCATTCAA ATTAA
```

This corresponds to the amino acid sequence <SEQ ID 1954; *ORF* 612.a>:

```
a612.pep

      1  MGFGGNIAKK LAGVDEIAFD FDGIVFDFGR DDAVRHSGVI NTAVACLHIV

     51  GKVFADKAVE KCAENVLFEV PAIHRAAYFV GNFPNLAVQL GALLYFGHHR

    101  NPYXKLNKSK SPDIFRRFFX GHSN*

m612/a612  96.0% identity in 124 aa overlap

                   10        20        30        40        50        60
m612.pep   MGFGGNIAKKLAGVDEIAFNFDGIVFDFGRDDAVRHSGVINTAVACLHIVGEVFADKAVE
           |||||||||||||||||||:|||||||||||||||||||||||||||||||:||||||||
a612       MGFGGNIAKKLAGVDEIAFDFDGIVFDFGRDDAVRHSGVINTAVACLHIVGKVFADKAVE
                   10        20        30        40        50        60
                   70        80        90       100       110       120
m612.pep   KCAENVLFKVPAIHRAAYFVGNFPNLAVQLGALLHFGHHRNPYXKLNKSKSPDIFRRFFY
           ||||||||:|||||||||||||||||||||||||:|||||||||||||||||||||||||
a612       KCAENVLFEVPAIHRAAYFVGNFPNLAVQLGALLYFGHHRNPYXKLNKSKSPDIFRRFFY
                   70        80        90       100       110       120
m612.pep   GHSNX
           |||||
a612       GHSNX
```

The following partial DNA sequence was identified in *N. gonorrhoeae* <SEQ ID 1955>:

```
g613.seq
   1ATGTCGCGTT CGAGCCTGTC GAGGCGTTCG TTGAGGCGTT CCACGCCGTC

  51GCGCAGTCTG CTTATTTCGT CGaggcagtc ggcaagggct tcgttgccgg

 101tgtttGcgGA CTCGGGTTCG CGGGAAAATC CGCCGATTTG TTCGGCGATG

 151TTCCTGCCGA TTTgtttGAt GCCGTGTCCG ATGTCGGTGG CACGgctgcc

 201gatgcCTGCC TGCGTGCCGA AAATCCGTGC CAATTcgtCC GATGCGCGGG

 251AACGCAGGCT GCCGAGCAGG GACAGTACCG CgATGCCGAG GATGAGGTCG
```

-continued

```
301CCTTCGAGCC TGATGTCGCC AGCCCCGGGT TCGCCGCCTT GGAGGATTTT

351CCGTATCGCG CTGTTGCGGA AGGTAATTTC GGTGTCTGCA AAGCCGTTTC

401CCGCCGAGAG CAAACCGTCT TCTGTGATGC GTCCCGCCAG TTTCAGCCCG

451GCAATGTTCA GGGTCAGTGT TTTGCCTGCA AAGGAGGTAA GTTCCGAGCG

501GCTGTCCGGG CTTTGCAGAA TCAGGCGGTT GATGATGGGG AGGAGGGCGG

551ACATATTTTC TGATTGGGGC GGAGAATGCC TGTTGTTGCT GTTGCCGCTT

601ATTTTACAGG CTTAA
```

This corresponds to the amino acid sequence <SEQ ID 1956; *ORF* 613.ng>:

```
g613.pep
   1 MSRSSLSRRS LRRSTPSRSL LISSRQSARA SLPVFADSGS RENPPICSAM

  51 FLPICLMPCP MSVARLPMPA CVPKIRANSS DARERRLPSR DSTAMPRMRS

 101 PSSLMSPAPG SPPWRIFRIA LLRKVISVSA KPFPAESKPS SVMRPASFSP

 151 AMFRVSVLPA KEVSSERLSG LCRIRRLMMG RRADIFSDWG GECLLLLLPL

 201 ILQA*
```

The following partial DNA sequence was identified in *N. meningitidis* <SEQ ID 1957>:

```
m613.seq
   1 ATGTCGCGTT CGAGCCGGTC GAGGCGTTCG TTGAGGCGTT CCACGCCGTC

  51 GCGCAGTCTG CTTATTTCGT CGAGGCAGTC GGCAAGGGCT TCGTTGCCGA

 101 TGTTTGCGGA CTCGGATTCG CGGGAAAATC CGCCGATTTG TTCGGCGATG

 151 TTCCTGCCGA TTTGTTTGAT GCCGTGTCCG ATGTCGGCGG CACGGCTGCC

 201 GATGTCTGCC TGCGTGCCGA AAATCCGTGC CAATTCGTCC GATGCGCGGG

 251 AACGCAGGCT GCCGAGCAGG GACAGTACCG CGATGCCGAG GATGAGGTCG

 301 CCTTCGAGCC CGATGTCGCC CGCCCCGGGT TCGCCTCCTT GGAGGATTTT

 351 CTGTACCGCG CTGTTGCGGA AGGTAATTTC GGTGTCTGCA AAGCCGTTTC

 401 CCGCCGAGAG CAAACCGTCT TCCGTGATGC GTCCCGCCAG TTTCAGCCCG

 451 GCAATGTTCA GGGTCAGTGT TTTGCCTGCA AAGGCGGCAA GTTCCGAGCG

 501 GCTGTCCGGG CTTTGCAGAA TCAGGCGGTT GATGATGGGG AGGAGGGCGG

 551 ACATATTTTC TGATCGGGGC GGAGAATGCC TGTTGTTGCT GTTGCCGCTT

 601 ATTTTACAGG CTTAA
```

This corresponds to the amino acid sequence <SEQ ID 1958; *ORF* 613>:

```
m613.pep
   1 MSRSSRSRRS LRRSTPSRSL LISSRQSARA SLPMFADSDS RENPPICSAM

  51 FLPICLMPCP MSAARLPMSA CVPKIRANSS DARERRLPSR DSTAMPRMRS

 101 PSSPMSPAPG SPPWRIFCTA LLRKVISVSA KPFPAESKPS SVMRPASFSP

 151 AMFRVSVLPA KAASSERLSG LCRIRRLMMG RRADIFSDRG GECLLLLLPL

 201 ILQA*
```

Computer analysis of this amino acid sequence gave the following results:
Homology with a Predicted ORF from *N. gonorrhoeae*

```
m613/g613 94.6% identity in 204 aa overlap

                 10        20        30        40        50        60
m613.pep  MSRSSRSRRSLRRSTPSRSLLISSRQSARASLPMFADSDSRENPPICSAMFLPICLMPCP
          |||||  ||||||||||||||||||||||||||||:||| ||||||||||||||||||||
g613      MSRSSLSRRSLRRSTPSRSLLISSRQSARASLPVFADSGSRENPPICSAMFLPICLMPCP
                 10        20        30        40        50        60

                 70        80        90       100       110       120
m613.pep  MSAARLPMSACVPKIRANSSDARERRLPSRDSTAMPRMRSPSSPMSPAPGSPPWRIFCTA
          ||:|||| ||||||||||||||||||||||||||||||||||  |||||||||||| |
g613      MSVARLPMPACVPKIRANSSDARERRLPSRDSTAMPRMRSPSSLMSPAPGSPPWRIFRIA
                 70        80        90       100       110       120

                130       140       150       160       170       180
m613.pep  LLRKVISVSAKPFPAESKPSSVMRPASFSPAMFRVSVLPAKAASSERLSGLCRIRRLMMG
          ||||||||||||||||||||||||||||||||||||||||: ||||||||||||||||||
g613      LLRKVISVSAKPFPAESKPSSVMRPASFSPAMFRVSVLPAKEVSSERLSGLCRIRRLMMG
                130       140       150       160       170       180

                190       200
m613.pep  RRADIFSDRGGECLLLLLPLILQAX
          |||||||| ||||||||||||||||
g613      RRADIFSDWGGECLLLLLPLILQAX
                190       200
```

The following partial DNA sequence was identified in *N. meningitidis* <SEQ ID 1959>:

```
a613.seq
  1 ATGTCGCGTT CGAGCCGGTC GAGGCGTTCG TTGAGGCGTT CCACGCCGTC

 51 GCGCAGTCTG CTTATTTCGT CGAGGCAGTC GGCAAGGGCT TCGTTGCCGA

101 TGTTTGCGGA CTCGGGTTCG CGGGAAAATC TGCCGATTTG TTCGGCGATG

151 TTCCTGCCGA TTTGTTTGAT GCCGTGTCCG ATGTCGGCGG CACGGCTGCC

201 GATGTCTGCC TGCGTGCCGA AAATCCGTGC CAATTCGTCC GATGCGCGGG

251 AACGCAGGCT GCCGAGCAGG GACAGTACCG CGATGCCGAG GATGAGGTCG

301 CCTTCGAGCC CGATGTCGCC CGCCCCGGGT TCGCCGCCTT GGAGGATTTT

351 CTGTACCGCG CTGTTGCGGA AGGTGATTTC GGTGTCTGCA AAGCCGTTTC

401 CCGCCGAGAG CAAACCGTCT TCCGTGATGC GTCCCGCCAG TTTCAACCCG

451 GCAATGTTCA GGGTCAGTGT TTTGCCTGCG AAGGCGGCAA GTTCCGAGCG

501 GCTGTCCGGG CTTTGCAGAA TCAGGCGGTT GATGATGGGG AGGAGGGCGG

551 ACATATTTTC TGATCGGGGC GGAGAATGCC TGTTGTTGCT GTTGACGCTT

601 ATTTTACAGG CTTAA
```

This corresponds to the amino acid sequence <SEQ ID 1960; *ORF* 613.a>:

```
a613.pep

  1 MSRSSRSRRS LRRSTPSRSL LISSRQSARA SLPMFADSGS RENLPICSAM

 51 FLPICLMPCP MSAARLPMSA CVPKIRANSS DARERRLPSR DSTAMPRMRS

101 PSSPMSPAPG SPPWRIFCTA LLRKVISVSA KPFPAESKPS SVMPASFNP

151 AMFRVSVLPA KAASSERLSG LCRIRRLMMG RRADIFSDRG GECLLLLLTL

201 ILQA*

m613/a613 98.0% identity in 204 aa overlap
```

-continued

```
                   10         20         30         40         50         60
m613.pep    MSRSSRSRRSLRRSTPSRSLLISSRQSARASLPMFADSDSRENPPICSAMFLPICLMPCP
            |||||||||||||||||||||||||||||||||||||| |||| ||||||||||||||||
a613        MSRSSRSRRSLRRSTPSRSLLISSRQSARASLPMFADSGSRENLPICSAMFLPICLMPCP
                   10         20         30         40         50         60
                   70         80         90        100        110        120
m613.pep    MSAARLPMSACVPKIRANSSDARERRLPSRDSTAMPRMRSPSSPMSPAPGSPPWRIFCTA
            ||||||||||||||||||||||||||||||||||||||||||||||||||||||||||||
a613        MSAARLPMSACVPKIRANSSDARERRLPSRDSTAMPRMRSPSSPMSPAPGSPPWRIFCTA
                   70         80         90        100        110        120
                  130        140        150        160        170        180
m613.pep    LLRKVISVSAKPFPAESKPSSVMRPASFSPAMFRVSVLPAKAASSERLSGLCRIRRLMMG
            |||||||||||||||||||||||||||||:||||||||||||||||||||||||||||||
a613        LLRKVISVSAKPFPAESKPSSVMRPASFNPAMFRVSVLPAKAASSERLSGLCRIRRLMMG
                  130        140        150        160        170        180
                  190        200
m613.pep    RRADIFSDRGGECLLLLLPLILQAX
            |||||||||||||||||| ||||||
a613        RRADIFSDRGGECLLLLLTLILQAX
                  190        200
```

The following partial DNA sequence was identified in *N. gonorrhoeae* <SEQ ID 1961>:

```
g614.seq
   1 AtggcTgcgt tcAacgcttt ggacggcaaa aaagaagaca acgggcaaat
  51 cgaaTATTCT CAGTTCATCC GACAGGTCAA CAACGGCGAA GTATCCGGCG
 101 TCAACATCGA AGGATCCGTC GTCAGCGGTT ACCTGATTAA AGGCGAGCGC
 151 ACCGACAAAA GCACCTTCTT CACCAACGCG CCCTTGGATG ACAACCTGAT
 201 TCAAACCCTT TTGAACAAAA ACGTCCGCGT AAAAGTAACG CCGGAAGAAA
 251 AACCGAGCGC GCTGACTGCC CTGTTTTACA GCCTGCTGCC CGTCCTGCTG
 301 CTGATTGGCG CATGGTTCTA CTTTATGCGT ATGCAGGCGG GCGGCGGCGG
 351 AAAAGGCGGC GCATTCTCCT TCGGCAAAAG CCGCGCCCGC CTGCTGGACA
 401 AAGATGCCAA CAAAGTTACC TTTGCCGATG TCGCCGGCTG CGACGAAGCC
 451 AAAGAAGAAG TGCAGGAAAT CGTCGATTAC CTCAAAGCAC CGAACCGCta
 501 tcaAAGcctc ggcggccgtg ttcCGCGCGG CATCCtgCtg gcgGgcagcc
 551 CGGGAaccgg taaAACACTC TTGGCGAAAG CCATTGCAGG CGAGGCCGGC
 601 GTGCCGTTCT TCAGCATTTC CGGTTCCGAT TTTGTCGAAA TGTTCGTCGG
 651 TGTCGGTGCA AGCCGCGTCC GCGATATGTT CGAGCAGGCA AAGAAAAACG
 701 CCCCATGCAT TATCTTTATC GACGAGATTG ACGCGGTAGG CCGCCAACGC
 751 GGCGCAGgTT TGGGCGGCGG CAATGATGAG CGCGAGCAAA CATTAAACCA
 801 ATTATTGGTT GAAATGGACG GTTTTGAGAG CAATCAGACT GTAATTGTGA
 851 TTGCGGCAAC CAACCGCCCC GACGTACTCG ATCCTGCGCT GCAACGCCCC
 901 GGCCGCTTCG ACCGCCAAGT CGTCGTCCCC CTGCCGGACA TCCGGGGGCG
 951 CGAACAGatn ttGAACGTCC ATTCtaaAAA AGTGCcttTG gacgaATCTg
1001 tggaTTTATT GTCCCTCGCG CGCGGCACGC ccggtttTTc cggcgcggat
1051 tTggcgaaac tggtcaacga agcccccctg tttgccggcc gccgcaacaa
```

-continued

```
1101 agtgaaagtc gatcaaagcg attTGAAGAC GCCAAAGACA AAATCTATAT

1151 GGGTCCGGAA CGCCGCAGTA TGGTGA
```

This corresponds to the amino acid sequence <SEQ ID 1962; *ORF* 614.ng>:

```
g614.pep
   1 MAAFNALDGK KEDNGQIEYS QFIRQVNNGE VSGVNIEGSV VSGYLIKGER

  51 TDKSTFFTNA PLDDNLIQTL LNKNVRVKVT PEEKPSALTA LFYSLLPVLL

 101 LIGAWFYFMR MQAGGGGKGG AFSFGKSRAR LLDKDANKVT FADVAGCDEA

 151 KEEVQEIVDY LKAPNRYQSL GGRVPRGILL AGSPGTGKTL LAKAIAGEAG

 201 VPFFSISGSD FVEMFVGVGA SRVRDMFEQA KKNAPCIIFI DEIDAVGRQR

 251 GAGLGGGNDE REQTLNQLLV EMDGFESNQT VIVIAATNRP DVLDPALQRP

 301 GRFDRQVVVP LPDIRGREQX LNVHSKKVPL DESVDLLSLA RGTPGFSGAD

 351 LAKLVNEAPL FAGRRNKVKV DQSDLKTPKT KSIWVRNAAV W*
```

The following partial DNA sequence was identified in *N. meningitidis* <SEQ ID 1963>:

```
m614.seq
     1 ATGGCTGCGT TCAACGCTTT AGACGGTAAA AAAGAAGACA ACGGGCAAAT

    51 CGAATACTCT CAGTTCATCC AACAGGTCAA CAACGGCGAA GTATCCGGCG

   101 TCAACATCGA AGGATCCGTC GTCAGCGGCT ACCTGATTAA GGGCGAGCGC

   151 ACCGACAAAA GCACTTTCTT CACCAACGCG CCTTTGGACG ACAACCTAAT

   201 TAAAACACTG CTCGACAAAA ACGTCCGCGT AAAAGTAACG CCGGAAGAAA

   251 AACCGAGCGC GCTGGCTGCC CTGTTTTACA GCCTGCTGCC CGTCCTGCTG

   301 CTGATTGGCG CATGGTTCTA CTTCATGCGT ATGCAGACGG GCGGCGGCGG

   351 AAAAGGCGGC GCATTCTCAT TCGGTAAAAG CCGCGCCCGC CTGCTGGACA

   401 AAGATGCCAA CAAAGTGACC TTTGCCGATG TCGCCGGCTG CGACGAAGCC

   451 AAAGAAGAAG TACAGGAAAT CGTCGATTAC CTCAAAGCGC CGAACCGCTA

   501 TCAAAGCCTG GGCGGGCGCG TGCCGCGCGG CATCCTGCTG GCGGGCAGCC

   551 CGGGTACGGG TAAGACGCTT TTGGCGAAAG CGATTGCAGG CGAAGCCGGC

   601 GTGCCGTTCT TCAGCATTTC AGGTTCCGAC TTTGTCGAAA TGTTCGTCGG

   651 TGTCGGTGCG AGCCGCGTCC GCGATATGTT CGAGCAGGCG AAGAAAAACG

   701 CCCCCTGCAT CATCTTTATC GACGAGATTG ACGCAGTCGG CCGCCAACGC

   751 GGCGCAGGTT TGGGCGGCGG CAATGATGAG CGCGAGCAAA CATTAAACCA

   801 ATTGTTGGTT GAAATGGACG GTTTTGAGAG CAATCAGACT GTAATTGTGA

   851 TTGCGGCAAC CAACCGCCCC GACGTACTCG ATCCTGCGCT GCAACGCCCC

   901 GGCCGTTTCG ACCGCCAAGT GGTTGTCCCC CTGCCGGACA TCCGAGGGCG

   951 CGAACAGATT TTGAACGTCC ATTCTAAAAA AGTGCCTTTG GACGAATCTG

  1001 TGGATTTATT GTCCCTCGCG CGCGGCACGC CGGGTTTTTC CGGCGCGGAT

  1051 TTGGCGAACT TGGTCAACGA AGCCGCCCTG TTTGCCGGCC GCCGCAATAA

  1101 AGTCAAAGTC GATCAGAGCG ATTTGAAGAC GCCAAAGACA AAATCTATAT

  1151 GGGTCCGGAA CGCCGCAGTA TGGTGA
```

This corresponds to the amino acid sequence <SEQ ID 1964; ORF 614>:

```
m614.pep
   1 MAAFNALDGK KEDNGQIEYS QFIQQVNNGE VSGVNIEGSV VSGYLIKGER

  51 TDKSTFFTNA PLDDNLIKTL LDKNVRVKVT PEEKPSALAA LFYSLLPVLL

 101 LIGAWFYFMR MQTGGGGKGG AFSFGKSRAR LLDKDANKVT FADVAGCDEA

 151 KEEVQEIVDY LKAPNRYQSL GGRVPRGILL AGSPGTGKTL LAKAIAGEAG

 201 VPFFSISGSD FVEMFVGVGA SRVRDMFEQA KKNAPCIIFI DEIDAVGRQR

 251 GAGLGGGNDE REQTLNQLLV EMDGFESNQT VIVIAATNRP DVLDPALQRP

 301 GRFDRQVVVP LPDIRGREQI LNVHSKKVPL DESVDLLSLA RGTPGFSGAD

 351 LANLVNEAAL FAGRRNKVKV DQSDLKTPKT KSIWVRNAAV W*
```

Computer analysis of this amino acid sequence gave the following results:

Homology with a Predicted ORF from *N. gonorrhoeae*

```
m614/g614  98.0% identity in 391 aa overlap

                   10        20        30        40        50        60
m614.pep   MAAFNALDGKKEDNGQIEYSQFIQQVNNGEVSGVNIEGSVVSGYLIKGERTDKSTFFTNA
           ||||| ||||||||||||||||:|||||||||||||||||||||||||||||||||||||
g614       MAAFNALDGKKEDNGQIEYSQFIRQVNNGEVSGVNIEGSVVSGYLIKGERTDKSTFFTNA
                   10        20        30        40        50        60

                   70        80        90       100       110       120
m614.pep   PLDDNLIKTLLDKNVRVKVTPEEKPSALAALFYSLLPVLLLIGAWFYFMRMQTGGGGKGG
           |||||||:|||:|||||||||||||||:|||||||||||||||||||||||:||||||||
g614       PLDDNLIQTLLNKNVRVKVTPEEKPSALTALFYSLLPVLLLIGAWFYFMRMQAGGGGKGG
                   70        80        90       100       110       120

                  130       140       150       160       170       180
m614.pep   AFSFGKSRARLLDKDANKVTFADVAGCDEAKEEVQEIVDYLKAPNRYQSLGGRVPRGILL
           ||||||||||||||||||||||||||||||||||||||||||||||||||||||||||||
g614       AFSFGKSRARLLDKDANKVTFADVAGCDEAKEEVQEIVDYLKAPNRYQSLGGRVPRGILL
                  130       140       150       160       170       180

                  190       200       210       220       230       240
m614.pep   AGSPGTGKTLIAKAIAGEAGVPFFSISGSDFVEMFVGVGASRVRDMFEQAKKNAPCIIFI
           ||||||||||||||||||||||||||||||||||||||||||||||||||||||||||||
g614       AGSPGTGKTLIAKAIAGEAGVPFFSISGSDFVEMFVGVGASRVRDMFEQAKKNAPCIIFI
                  190       200       210       220       230       240

                  250       260       270       280       290       300
m614.pep   DEIDAVGRQRGAGLGGGNDEREQTLNQLLVEMDGFESNQTVIVIAATNRPDVLDPALQRP
           ||||||||||||||||||||||||||||||||||||||||||||||||||||||||||||
g614       DEIDAVGRQRGAGLGGGNDEREQTLNQLLVEMDGFESNQTVIVIAATNRPDVLDPALQRP
                  250       260       270       280       290       300

                  310       320       330       340       350       360
m614.pep   GRFDRQVVVPLPDIRGREQILNVHSKKVPLDESVDLLSLARGTPGFSGADLANLVNEAAL
           |||||||||||||||||| |||||||||||||||||||||||||||||||:||||| |
g614       GRFDRQVVVPLPDIRGREQXLNVHSKKVPLDESVDLLSLARGTPGFSGADLAKLVNEAPL
                  310       320       330       340       350       360

                  370       380       390
m614.pep   FAGRRNKVKVDQSDLKTPKTKSIWVRNAAVWX
           |||||||||||||||||| ||||||||||||
g614       FAGRRNKVKVDQSDLKTPKTKSIWVRNAAVWX
                  370       380       390
```

The following partial DNA sequence was identified in *N. meningitidis* <SEQ ID 1965>:

```
a614.seq
     1  ATGGCTGCGT TCAACGCTTT AGACGGTAAA AAAGAAGACA ACGGGCAAAT
    51  CGAATATTCT CAGTTCATCC AACAGGTCAA CAACGGCGAA GTATCCGGCG
   101  TCAACATCGA AGGATCCGTC GTCAGCGGCT ACCTGATTAA GGGCGAGCGC
   151  ACCGACAAAA GCACCTTCTT CACCAACGCG CCTTTGGACG ACAACCTGAT
   201  TAAAACACTG CTCGACAAAA ACGTCCGTGT AAAAGTAACG CCGGAAGAAA
   251  AACCGAGCGC GCTGGCTGCC CTGTTTTACA GCCTGCTGCC CGTCCTGCTG
   301  CTGATTGGCG CGTGGTTCTA CTTTATGCGT ATGCAGACGG GCGGCGGCGG
   351  AAAAGGCGGC GCATTCTCAT TCGGCAAAAG CCGCGCCCGC CTACTGGACA
   401  AAGATGCCAA CAAAGTTACC TTTGCCGATG TCGCCGGCTG CGACGAAGCC
   451  AAAGAAGAAG TGCAGGAAAT CGTCGATTAC CTCAAAGCGC CGAACCGCTA
   501  TCAAAGCCTG GGCGGGCGCG TGCCGCGCGG CATCCTGCTG GCGGGCAGCC
   551  CGGGTACGGG TAAGACGCTT TTGGCGAAAG CGATTGCAGG CGAAGCCGGC
   601  GTGCCGTTCT TCAGCATTTC AGGTTCCGAC TTTGTCGAAA TGTTCGTCGG
   651  TGTCGGTGCA AGCCGCGTCC GCGATATGTT CGAGCAGGCG AAGAAAAACG
   701  CCCCCTGCAT CATCTTTATC GACGAGATTG ACGCAGTCGG CCGCCAACGC
   751  GGCGCAGGTT TGGGCGGCGG TAATGATGAG CGCGAGCAAA CATTAAACCA
   801  ATTGTTGGTT GAAATGGACG GTTTTGAGAG CAATCAGACT GTAATTGTGA
   851  TTGCGGCAAC CAACCGCCCC GACGTACTCG ATCCTGCGCT GCAACGCCCC
   901  GGCCGTTTCG ACCGCCAAGT GGTTGTCCCC CTGCCGGACA TCCGGGGGCG
   951  CGAACAGATT TTGAACGTCC ACTCTAAAAA AGTGCCTTTG GACAAATCTG
  1001  TGGATTTATT GTCCCTCGCG CGCGGCACGC CGGGTTTTTC CGGCGCGGAT
  1051  TTGGCGAACT TGGTCAACGA AGCCGCCCTG TTTGCCGGCC GCCGCAATAA
  1101  AGTCAAAGTC GATCAGAGCG ATTTGAAGAC GCCAAAGACA AAATCTATAT
  1151  GGGTCCGGAA CGCCGCAGTA TGGTGA
```

This corresponds to the amino acid sequence <SEQ ID 1966; *ORF* 614.a>:

```
a614.pep
      1 MAAFNALDGK KEDNGQIEYS QFIQQVNNGE VSGVNIEGSV VSGYLIKGER
     51 TDKSTFFTNA PLDDNLIKTL LDKNVRVKVT PEEKPSALAA LFYSLLPVLL
    101 LIGAWFYFMR MQTGGGGKGG AFSFGKSRAR LLDKDANKVT FADVAGCDEA
    151 KEEVQEIVDY LKAPNRYQSL GGRVPRGILL AGSPGTGKTL LAKAIAGEAG
    201 VPFFSISGSD FVEMFVGVGA SRVRDMFEQA KKNAPCIIFI DEIDAVGRQR
    251 GAGLGGGNDE REQTLNQLLV EMDGFESNQT VIVIAATNRP DVLDPALQRP
    301 GRFDRQVVVP LPDIRGREQI LNVHSKKVPL DKSVDLLSLA RGTPGFSGAD
    351 LANLVNEAAL FAGRRNKVKV DQSDLKTPKT KSIWVRNAAV W*
```

```
m614/a614 99.7% identity in 391 aa overlap

                    10        20        30        40        50        60
m614.pep    MAAFNALDGKKEDNGQIEYSQFIQQVNNGEVSGVNIEGSVVSGYLIKGERTDKSTFFTNA
            ||||||||||||||||||||||||||||||||||||||||||||||||||||||||||||
a614        MAAFNALDGKKEDNGQIEYSQFIQQVNNGEVSGVNIEGSVVSGYLIKGERTDKSTFFTNA
                    10        20        30        40        50        60
```

-continued

```
                70        80        90       100       110       120
m614.pep   PLDDNLIKTLLDKNVRVKVTPEEKPSALAALFYSLLPVLLLIGAWFYFMRMQTGGGGKGG
           ||||||||||||||||||||||||||||||||||||||||||||||||||||||||||||
a614       PLDDNLIKTLLDKNVRVKVTPEEKPSALAALFYSLLPVLLLIGAWFYFMRMQTGGGGKGG
                70        80        90       100       110       120

               130       140       150       160       170       180
m614.pep   AFSFGKSRARLLDKDANKVTFADVAGCDEAKEEVQEIVDYLKAPNRYQSLGGRVPRGILL
           ||||||||||||||||||||||||||||||||||||||||||||||||||||||||||||
a614       AFSFGKSRARLLDKDANKVTFADVAGCDEAKEEVQEIVDYLKAPNRYQSLGGRVPRGILL
               130       140       150       160       170       180

               190       200       210       220       230       240
m614.pep   AGSPGTGKTLLAKAIAGEAGVPFFSISGSDFVEMFVGVGASRVRDMFEQAKKNAPCIIFI
           ||||||||||||||||||||||||||||||||||||||||||||||||||||||||||||
a614       AGSPGTGKTLLAKAIAGEAGVPFFSISGSDFVEMFVGVGASRVRDMFEQAKKNAPCIIFI
               190       200       210       220       230       240

               250       260       270       280       290       300
m614.pep   DEIDAVGRQRGAGLGGGNDEREQTLNQLLVEMDGFESNQTVIVIAATNRPDVLDPALQRP
           ||||||||||||||||||||||||||||||||||||||||||||||||||||||||||||
a614       DEIDAVGRQRGAGLGGGNDEREQTLNQLLVEMDGFESNQTVIVIAATNRPDVLDPALQRP
               250       260       270       280       290       300

               310       320       330       340       350       360
m614.pep   GRFDRQVVVPLPDIRGREQILNVHSKKVPLDESVDLLSLARGTPGFSGADLANLVNEAAL
           |||||||||||||||||||||||||||||||:||||||||||||||||||||||||||||
a614       GRFDRQVVVPLPDIRGREQILNVHSKKVPLDKSVDLLSLARGTPGFSGADLANLVNEAAL
               310       320       330       340       350       360

               370       380       390
m614.pep   FAGRRNKVKVDQSDLKTPKTKSIWVRNAAVWX
           ||||||||||||||||||||||||||||||||
a614       FAGRRNKVKVDQSDLKTPKTKSIWVRNAAVWX
               370       380       390
```

The following partial DNA sequence was identified in *N. gonorrhoeae* <SEQ ID 1967>:

```
g615.seq
   1  ATGTGGAAAC GGCGGCGGCG CGGTGtcggC AGCTTtgaag agcagcGaAT

  51  agatgCCGCC GGCAAACCAC AATGCGGAAa gcaggCtgaa gcGGTTgcgC

 101  GGCagcTTca tGCCGCCTCC TcGTCCaGCC ACGtttGgca gattttggac

 151  aggcgcAGga ATTTGCcgCc gcgtgcggCA agtatgtcgc gcCAttgtgc

 201  cacttcttcg gcggacggTG cttcgtcgaT gctgCATTCG TACagcagga

 251  aatcgagggt ttcttcgatg acggGgatgg AttccgTTTG GataAgCTgc

 301  ttgagttcgt tcatgactGt TCgGATAcgg aaatcgggaa aatgccgtct

 351  gAaagggctt CAGACGGCat tggATTATTT GCTGTGCAGG AAgcgcgttg

 401  cctcttccca tttgcCGGAA AtgATGTCGg gtacggcctg cAGGGATttg

 451  gCGACGGcat cgtcgatttg ccgGcggtgc ttCcgcgctc ggtttGTTca

 501  agacgtagcc gaCGACGagg ttgcggtcGC CGGGGtggcC GATGCCGAGG

 551  CGCAGGCGGt aatagtctgC CGTGCCGAGT TTTGCctgAA TGTCTTTCAA

 601  GCCGTTGTGT CcgcCGttgc cgcCGCCGAG TTTGAATTTg ATCCGTCCGC

 651  AAGGGATGTC GAGTTCGTCG TGGACGACGA GGATTTCTTC GGGTTTGATT

 701  TTGTAGAACT GTGCAAGCGC GGCAACCGCC TGTCCGGAAC GGTTCATGAA

 751  CGTGGCCGGT TTGAGCAGCC AAACATCGCC GTCGGGCAGG GCGGCGCGGG

 801  CAACTTCGCC GAAGAATTTT TTTTCTTCTT TAAACGAAGC CTTCCATTTC

 851  CACGCCAGTT CGTCGAGGAA CCAAAAGCCC GCATTGTGGC GGGTCTGTTC

 901  GTATTCTTTG CCCGGGTTGC CCAAGCCGAC AACCATTTTG ATTGTGttcg

 951  acatgataTT TtccgtgTTT CTgTCGaatg cggtCtgaAG GCTTCAGacg

1001  gcatggTtaT TCTTCTTgaT TTtgaACgcg tgtgcggCGC GCTTCTTTGG
```

-continued

```
1051 GGTCGATCAA CAGCGGGCGG TACACTTCGA TGCGGTCGCC GTCGCGCAGC

1101 GGCGTGTCGT CTTTGA
```

This corresponds to the amino acid sequence <SEQ ID 1968; ORF 615.ng>:

```
g615.pep
   1 MWKRRRRGVG SFEEQRIDAA GKPQCGKQAE AVARQLHAAS SSSHVWQILD

  51 RRRNLPPRAA SMSRHCATSS ADGASSMLHS YSRKSRVSSM TGMDSVWISC

 101 LSSFMTVRIR KSGKCRLKGL QTALDYLLCR KRVASSHLPE MMSGTACRDL

 151 ATASSICRRC FRARFVQDVA DDEVAVAGVA DAEAQAVIVC RAEFCLNVFQ

 201 AVVSAVAAAE FEFDPSARDV EFVVDDEDFF GFDFVELCKR GNRLSGTVHE

 251 RGRFEQPNIA VGQGGAGNFA EEFFFFFKRS LPFPRQFVEE PKARIVAGLF

 301 VFFARVAQAD NHFDCVRHDI FRVSVECGLK ASDGMVILLD FERVCGALLW

 351 GRSTAGGTLR CGRRRAAACR L*
```

The following partial DNA sequence was identified in *N. meningitidis* <SEQ ID 1969>:

```
m615.seq Length: 1116
     1 ATGCGGAAAA GGCGGTGGCG CGGTTTCGGC AGCTTTGAAA AGCAGTGAGT

    51 AAATGCTGCC TGCAAACCAC AATGCCGAGA GCAGGATAAA GCGGTTGCGT

   101 GGCAGATTCA TGCTTGTTCC TCTTCAAGCC ATGTCTGGCA TAGTTTGGAT

   151 AGGCGCAGGA ATTTTCCGCC GCGTGCGGCC AGCATATCGC GCCAAACGGC

   201 AATTTCTTCG GCGGAGGGGG CATCGTCTAT GCTGCATTCG TAGAGCAGGA

   251 AATCGAGGGT TTCTTCGATG ACGGGGATGG ATTCGGTTTG GATAAGCTGC

   301 TTGAGTTCGG TCATGACTGT TCGGATATGG AAATCGGGAA CATGCCGTCT

   351 GAAAGGGCTT CAGACGGCAT CGGGTCATTT GCTGTGCAGG AAGCGGGTTG

   401 CTTCTTCCCA TTTGCCGGCA AGGATGTCGG GTATGGCTTG CAGGGATTTG

   451 GCGACGGCAT CGTCAATCTG TCGGCGGTGT .TCCGTACTG GGTTTGTTCA

   501 GGACATAGCC GACGACGAGG TTGCGGTCGC CCGGGTGGCC GATGCCGAGG

   551 CGCAGGCGGT AATAGTCTGC CGTGCCGAGT TTTGCCTGAA TGTCTTTCAA

   601 GCCGTTGTGT CCGCCGTTGC CGCCGCCGAG TTTGAATTTG ATCCGTCCGC

   651 AGGGAATGTC GAGTTCGTCG TGGACGACGA GGATTTCTTC GGGTTTGATT

   701 TTGTAGAACT GTGCAAGCGC GGCAACTGCC TGTCCGGAAC GGTTCATGAA

   751 CGTGGCAGGT TTGAGCAGCC AAACGTCGCC GTCGGGCAGG GCGGCACGGG

   801 CGACTTCGCC GAAGAATTTT TTTTCTTCTT TAAATGAAGC CTTCCATTTC

   851 CACGCCAGTT CGTCGAGGAA CCAAAAACCC GCATTGTGGC GTGTCTGTTC

   901 GTATTCTTTG CCCGGGTTGC CCAAGCCGAC AACCATTTTG ATTGTGTTTG

   951 ACATGATATT TTCCGTGTTT CTGTCGAATG CTGTCTGAAG GCTTCAGACG

  1001 GCATGGTTAT TCTTCTTGAT TTTGAACGCG TTTGCGGCGC GCTTCTTTGG

  1051 GGTCGATCAA CAGCGGGCGG TACACTTCGA TGCGGTCGCC GTCGCGCAGC

  1101 GGCGTGTCGT CTTTGA
```

This corresponds to the amino acid sequence <SEQ ID 1970; *ORF* 615>:

```
m615.pep Length: 372
   1 MRKRRWRGFG SFEKQXVNAA CKPQCREQDK AVAWQIHACS SSSHVWHSLD

  51 RRRNFPPRAA SISRQTAISS AEGASSMLHS XSRKSRVSSM TGMDSVWISC

 101 LSSVMTVRIW KSGTCRLKGL QTASGHLLCR KRVASSHLPA RMSGMACRDL

 151 ATASSICRRC XRTGFVQDIA DDEVAVARVA DAEAQAVIVC RAEFCLNVFQ

 201 AVVSAVAAAE FEFDPSAGNV EFVVDDEDFF GFDFVELCKR GNCLSGTVHE

 251 RGRFEQPNVA VGQGGTGDFA EEFFFFFKXS LPFPRQFVEE PKTRIVACLF

 301 VFFARVAQAD NHFDCVXHDI FRVSVECCLK ASDGMVILLD FERVCGALLW

 351 GRSTAGGTLR CGRRRAAACR L*
```

Computer analysis of this amino acid sequence gave the following results:

Homology with a Predicted ORF from *N. gonorrhoeae*

```
m615/g615 86.8% identity in 371 aa overlap

                    10        20        30        40        50        60
m615.pep    MRKRRWRGFGSFEKQXVNAACKPQCREQDKAVAWQIHACSSSSHVWHSLDRRRNFPPRAA
            | ||| || ||||:| ::|| |||| :| :||| |:|| |||||||: ||||||:|||||
g615        MWKRRRRGVGSFEEQRIDAAGKPQCGKQAEAVARQLHAASSSSHVWQILDRRRNLPPRAA
                    10        20        30        40        50        60

                    70        80        90       100       110       120
m615.pep    SISRQTAISSAEGASSMLHSXSRKSRVSSMTGMDSVWISCLSSVMTVRIWKSGTCRLXGL
            |:||: | |||:|||||||| ||||||||||||||||||||| ||||| ||| ||||||
g615        SMSRHCATSSADGASSMLHSYSRKSRVSSMTGMDSVWISCLSSFMTVRIRKSGKCRLKGL
                    70        80        90       100       110       120

                   130       140       150       160       170       180
m615.pep    QTASGHLLCRKRVASSHLPARMSGMACRDLATASSICRRCXRTGFVQDIADDEVAVARVA
            |||  :||||||||||||  ||| ||||||||||||||| |: ||||:|||||||| ||
g615        QTALDYLLCRKRVASSHLPEMMSGTACRDLATASSICRRCFRARFVQDVADDEVAVAGVA
                   130       140       150       160       170       180

                   190       200       210       220       230       240
m615.pep    DAEAQAVIVCRAEFCLNVFQAVVSAVAAAEFEFDPSAGNVEFVVDDEDFFGFDFVELCKR
            |||||||||||||||||||||||||||||||||||| :||||||||||||||||||||||
g615        DAEAQAVIVCRAEFCLNVFQAVVSAVAAAEFEFDPSARDVEFVVDDEDFFGFDFVELCKR
                   190       200       210       220       230       240

                   250       260       270       280       290       300
m615.pep    GNCLSGTVHERGRFEQPNVAVGQGGTGDFAEEFFFFFKXSLPFPRQFVEEPKTRIVACLF
            || |||||||||||||||:||||||:|:|||||||||| |||||||||||||:|||| ||
g615        GNRLSGTVHERGRFEQPNIAVGQGGAGNFAEEFFFFFKRSLPFPRQFVEEPKARIVAGLF
                   250       260       270       280       290       300

                   310       320       330       340       350       360
m615.pep    VFFARVAQADNHFDCVXHDIFRVSVECCLKASDGMVILLDFERVCGALLWGRSTAGGTLR
            |||||||||||||||| |||||||||| |||||||||||||||||||||||||||||||||
g615        VFFARVAQADNHFDCVRHDIFRVSVECGLKASDGMVILLDFERVCGALLWGRSTAGGTLR
                   310       320       330       340       350       360

                   370
m615.pep    CGRRRAAACRLX
            ||||||||||||
g615        CGRRRAAACRLX
                   370
```

The following partial DNA sequence was identified in *N. meningitidis* <SEQ ID 1971>:

```
a615.seq
   1  ATGCGGAAAC GGCGGCGGCG CGGTGTCGGC AGCTTTGAAG AGCAGCGAAT

  51  AGATGCCGCC GGCAAACCAC AATGCGGAAA GCAGGCTGAA GCGGTTGCGC

 101  GGCAGCTTCA TGCCGCCTCC TCGTCCAGCC ACGTTTGGCA GATTTTGGAC

 151  AGGCGCAGGA ATTTGCCGCC GCGTGCGGCA AGTATGTCGC GCCATTGTGC

 201  CACTTCTTCG GCGGATGGTG CGTCGTCGAT GCTGCATTCG TACAGCAGGA
```

-continued

```
 251  AATCGAGGGT TTCTTCGATG ACGGGGATGG ATTCGGTTTG GATAAGCTGC

 301  TTGAGTTCGG TCATGACTGT TCGGATATGG AAATCGGGAA CATGCCGTCT

 351  GAAAGGGCTT CAGACGGCAT CGGGTCATTT GCTGTGCAGG AAGCGGGTTG

 401  CCTCTTCACA TTTGCCGGCA AGGATGTCGG GTATGGCTTG CAGGGATTTG

 451  GCGACGGCAT CGTCAATCTG TCGGCGGTG. TTCCGTACTG GGTTTGTTCA

 501  GGACATAGCC GACGACGAGG TTGCGGTCGC CCGGGTGGCC GATGCCGAGG

 551  CGCAGGCGGT AATAGTCTGC CGTGCCGAGT TTTGCCTGAA TGTCTTTCAA

 601  GCCGTTGTGT CCACCGTTGC CGCCGCCGAG TTTGAATTTG ATCCGTCCGC

 651  AGGGAATGTC GAGTTCGTCG TGGACGACGA GGATTTCTTC GGGTTTGATT

 701  TTATAAAACT GCGCAAGGGC GGCAACTGCC TGTCCGGAAC GGTTCATGAA

 751  CGTGGTCGGC TTGAGCAGCC AGACATCGCC GTCGGGCAGG GTAGCACGGG

 801  CGACTTCGCC GAAGAATTTT TTTTCTTCTT TAAATGAAGC CTTCCATTTC

 851  CACGCCAGTT CGTCGAGGAA CCAAAAACCC GCATTGTGGC GTGTCTGTTC

 901  GTATTCTTTG CCCGGGTTGC CCAAGCCGAC AACCATTTTG ATTGTGTTTG

 951  ACATGATATT TTCCGTGTTT CTGCCGAATG CCGTCTGAAG GCTTCAGACG

1001  GCATGGTTAT TCTTCTTGAT TTTGAACGCG TTTGCGGCGC GCTTCTTTGG

1051  GGTCGATCAA CAGCGGGCGG TACACTTCGA TGCGGTCGCC GTCGCGCAGC

1101  GGCGTGTCGT CTTTGA
```

This corresponds to the amino acid sequence <SEQ ID 1972; *ORF* 615.a>:

```
a614.pep

      1  MRKRRRRGVG SFEEQRIDAA GKPQCGKQAE AVARQLHAAS SSSHVWQILD

     51  RRRNLPPRAA SMSRHCATSS ADGASSMLHS YSRKSRVSSM TGMDSVWIGC

    101  LSSVMTVRIW KSGTCRLKGL QTASGHLLCR KRVASSHLPA RMSGMACRDL

    151  ATAGGICRRX FRTGFVQDIA DDEVAVARVA DAEAQAVIVC RAEFCLNVFQ

    201  AVVSTVAAAE FEFDPSAGNV EFVVDDEDFF GFDFIKLRKG GNCLSGTVHE

    251  RGRLEQPDIA VGQGSTGDFA EEFFFFFK*S LPFPRQFVEE PKTRIVACLF

    301  VFFARVAQAD NHFDCV*HDI FRVSAECRLK ASDGMVILLD FERVCGALLW

    351  GRSTAGGTLR CGRRRAAACR L*
```

```
m615/a615 90.3% identity in 371 aa overlap

                       10        20        30        40        50        60
m615.pep   MRKRRWRGFGSFEKQXVNAACKPQCREQDKAVAWQIHACSSSSHVWHSLDRRRNFPPRAA
           ||||| || ||||:| ::|| |||| :| :||| |:|| |||||||: ||||||:|||||
a615       MRKRRRRGVGSFEEQRIDAAGKPQCGKQAEAVARQLHAASSSSHVWQILDRRRNLPPRAA
                       10        20        30        40        50        60

                       70        80        90       100       110       120
m615.pep   SISRQTAISSAEGASSMLHSXSRKSRVSSMTGMDSVWISCLSSVMTVRIWKSGTCRLKGL
           |:||: | |||:|||||||| |||||||||||||||||||||||||||||||||||||||
a615       SMSRHCATSSADGASSMLHSYSRKSRVSSMTGMDSVWISCLSSVMTVRIWKSGTCRLKGL
                       70        80        90       100       110       120

                      130       140       150       160       170       180
m615.pep   QTASGHLLCRKRVASSHLPARMSGMACRDLATASSICRRCXRTGFVQDIADDEVAVARVA
           |||||||||||||||||||||||||||||||||||||||  |||||||||||||||||||
a615       QTASGHLLCRKRVASSHLPARMSGMACRDLATASSICRRXFRTGFVQDIADDEVAVARVA
                      130       140       150       160       170       180

                      190       200       210       220       230       240
m615.pep   DAEAQAVIVCRAEFCLNVFQAVVSAVAAAEFEFDPSAGNVEFVVDDEDFFGFDFVELCKR
           ||||||||||||||||||||||||:|||||||||||||||||||||||||||||::| | 
a615       DAEAQAVIVCRAEFCLNVFQAVVSTVAAAEFEFDPSAGNVEFVVDDEDFFGFDFIKLRKG
                      190       200       210       220       230       240
```

-continued

```
              250       260       270       280       290       300
m615.pep    GNCLSGTVHERGRFEQPNVAVGQGGTGDFAEEFFFFFKXSLPFPRQFVEEPKTRIVACLF
            ||||||||||||:|||::|||||:||||||||||||||||||||||||||||||||||||
a615        GNCLSGTVHERGRLEQPDIAVGQGSTGDFAEEFFFFFKXSLPFPRQFVEEPKTRIVACLF
              250       260       270       280       290       300

              310       320       330       340       350       360
m615.pep    VFFARVAQADNHFDCVXHDIFRVSVECCLKASDGMVILLDFERVCGALLWGRSTAGGTLR
            |||||||||||||||||||||||||:|| |||||||||||||||||||||||||||||||
a615        VFFARVAQADNHFDCVXHDIFRVSAECRLKASDGMVILLDFERVCGALLWGRSTAGGTLR
              310       320       330       340       350       360

              370
m615.pep    CGRRRAAACRLX
            ||||||||||||
a615        CGRRRAAACRLX
              370
```

The following partial DNA sequence was identified in *N. gonorrhoeae* <SEQ ID 1973>:

```
g616.seq
     1  atgtcgaaCA CAATCAAAAT GGTTGTCGGC TTGGGCAACC CGGGCAAAGA

    51  ATACGAACAG ACCCGCCACA ATGCGGGCTT TTGGTTCCTC GACGAACTGG

   101  CGTGGAAATG GAAGGCTTCG TTTAAAGAAG AAAAAAAATT CTTCGGCGAA

   151  GTTGCCCGCG CCGCCCTGCC CGACGGCGAT GTTTGGCTGC TCAAACCGGC

   201  CACGTTCATG AACCGTTCCG GACAGGCGGT TGCCGCGCTT GCACAGTTCT

   251  ACAAAATCAA ACCCGAAGAA ATCCTCGTCG TCCACGACGA ACTCGACATC

   301  CCTTGCGGAC GGATcAAATT CAAACTCGGC GgcggcaaCG gcgGACACAA

   351  CGGCTTGAAA GACATTcagG CAAAACTCGG CACGGcagac tattaCCGCC

   401  TGCGCCTCGG CATCGgccaC CCCGGCgacc gcaacctCGT CGtcggctac

   451  gtcttgAACa aaccgagcgc gGaagcaccg Ccggcaaatc gacgatgCCG

   501  TCGccaaATC CCTgcaggcc gtacccGACA TcaTTTCCGg caaatgggaa

   551  gaggcaacgc gcTTCCTGCA CAGCAAATAA TccaatGCCG TCTGaagccc

   601  ttTcagacgg cattttcccg atttccgTAT CcGAaCagtc atgaacgaac

   651  tcaagcAGcT tatCCAAAcg gaaTccatcC ccgtcatcga agaaaccctc

   701  gatttcctgc tGTACGAATG cagcAtcgac gaagCAccgt ccgccgaaga

   751  agtggcacaa TGgcgcgaca tactTGccgc acgcgGcgGC AAATtcCTgc

   801  gcctgtccaa aatctgcCaa aCGTGGCtGG ACgAGGAGGC GGCatgAAgc

   851  tGCCGcgcAA CCgcttcaGc ctgctTTCCG CATTGTGGTT TGCCGGCGGc

   901  atctATtCgc tgctcttcaA AGCTGccgaC ACCGCGCCGC CGCCGTTTCC

   951  ACATTtcgaC AAAGCAGCAC ACCTTGCCCT GTTTTTCGCA CAaatCTTgt

  1001  tTctGGCCAA AGCATTCAAA ACCGGAAAAC TTCCCATCCC CTACCGCAGC

  1051  CTGATTGCGT TCGCCTTCTG TTTTGCCGTC GGCAGCGAAT GCGCGCAGGC

  1101  ATGGTTTACC GCAACGCGAA CCGGCAGTTT GGGCGATGTC CTTGCCgACC

  1151  TGACGGGCGC AGCCCTTGCC CTCTTTGCCG CGCGTTCTGC CTGCCGcccg

  1201  gactaa
```

This corresponds to the amino acid sequence <SEQ ID 1974; *ORF* 616.ng>:

```
g616.pep
  1  MSNTIKMVVG LGNPGKEYEQ TRHNAGFWFL DELAWKWKAS FKEEKKFFGE
```

-continued

```
 51 VARAALPDGD VWLLKPATFM NRSGQAVAAL AQFYKIKPEE ILVVHDELDI

101 PCGRIKFKLG GGNGGHNGLK DIQAKLGTAD YYRLRLGIGH PGDRNLVVGY

151 VLNKPSAEAP PANRRCRRQI PAGRTRHHFR QMGRGNALPA QQIIQCRLKP

201 FQTAFSRFPY PNSHERTQAA YPNGIHPRHR RNPRFPAVRM QHRRSTVRRR

251 SGTMARHTCR TRRQIPAPVQ NLPNVAGRGG GMKLPRNRFS LLSALWFAGG

301 IYSLLFKAAD TAPPPFPHFD KAAHLALFFA QILFLAKAFK TGKLPIPYRS

351 LIAFAFCFAV GSECAQAWFT ATRTGSLGDV LADLTGAALA LFAARSACRP

401 D*
```

The following partial DNA sequence was identified in *N. meningitidis* <SEQ ID 1975>:

```
m616.seq
   1 ATGTCAAACA CAATCAAAAT GGTTGTCGGC TTGGGCAACC CGGGCAAAGA

  51 ATACGAACAG ACACGCCACA ATGCGGGTTT TTGGTTCCTC GACGAACTGG

 101 CGTGGAAATG GAAGGCTTCA TTTAAAGAAG AAAAAAAATT CTTCGGCGAA

 151 GTCGCCCGTG CCGCCCTGCC CGACGGCGAC GTTTGGCTGC TCAAACCTGC

 201 CACGTTCATG AACCGTTCCG GACAGGCAGT TGCCGCGCTT GCACAGTTCT

 251 ACAAAATCAA ACCCGAAGAA ATCCTCGTCG TCCACGACGA ACTCGACATT

 301 CCCTGCGGAC GGATCAAATT CAAACTCGGC GGCGGCAACG GCGGACACAA

 351 CGGCTTGAAA GACATTCAGG CAAAACTCGG CACGGCAGAC TATTACCGCC

 401 TGCGCCTCGG CATCGGCCAC CCGGGCGACC GCAACCTCGT CGTCGGCTAT

 451 GTCCTGAACA AACCCAGTAC GGAACA.CCG CCGACAGATT GACGATGCCG

 501 TCGCCAAATC CCTGCAAGCC ATACCCGACA TCCTTGCCGG CAAATGGGAA

 551 GAAGCAACCC GCTTCCTGCA CAGCAAATGA CCCGATGCCG TCTGAAGCCC

 601 TTTCAGACGG CATGTTCCCG ATTTCCATAT CCGAACAGTC ATGACCGAAC

 651 TCAAGCAGCT TATCCAAACC GAATCCATCC CCGTCATCGA AGAAACCCTC

 701 GATTTCCTGC TCTACGAATG CAGCATAGAC GATGCCCCCT CCGCCGAAGA

 751 AATTGCCGTT TGGCGCGATA TGCTGGCCGC ACGCGGCGGA AAATTCCTGC

 801 GCCTATCCAA ACTATGCCAG ACATGGCTTG AAGAGGAACA AGCATGAATC

 851 TGCCACGCAA CCGCTTTATC CTGCTCTCGG CATTGTGGTT TGCAGGCAGC

 901 ATTTACTCAC TGCTTTTCAA AGCTGCCGAA ACCGCGCCAC CGCCTTTTCC

 951 GCATTTTGAC AAAGTGGCGC ACCTCGCCCT GTTTTTCGCA CAAATCTGGC

1001 TTCTGACCAA AGCATTCAGA ACCGACAACC GCCCCATCCC CTATCGCAGC

1051 CTGATGGTCT TTGCCCTCTG TTTCGCCCTC TTCAGCGAAT GCGCGCAGGC

1101 ATGGTTTACC GCAACGAGAA CCGGCAGTTT GGGCGATGTC CTTGCCGACC

1151 TGACGGGCGC AGCCCTTGCC CTCTTTACCG CGCGAGCTGC CTGCCGCCCG

1201 GACTAA
```

This corresponds to the amino acid sequence <SEQ ID 1976; *ORF* 616>:

```
a616.pep

  1 MSNTIKMVVG LGNPGKEYEQ TRHNAGFWFL DELAWKWKAS FKEEKKFFGE

 51 VARAALPDGD VWLLKPATFM NRSGQAVAAL AQFYKIKPEE ILVVHDELDI

101 PCGRIKFKLG GGNGGHNGLK DIQAKLGTAD VYRLRLGIGH PGDRNLVVGY

151 VLNKPSTEXP PTDXRCRRQI PASHTRHPCR QMGRSNPLPA QQMTRCRLKP

201 FQTACSRFPY PNSHDRTQAA YPNRIHPRHR RNPRFPALRM QHRRCPLRRR

251 NCRLARYAGR TRRKIPAPIQ TMPDMAXRGT SMNLPRNRFI LLSALWFAGS

301 IYSLLFKAAE TAPPPFPHFD KVAHLALFFA QIWLLTKAFR TCNRPIPYRS

351 LMVFALCFAL FSECAQAWFT ATRTGGLGDV LACLTGAALA LFTARAACRP

401 D*
```

m616/g616 86.0% identity in 401 aa overlap

```
                   10        20        30        40        50        60
m616.pep   MSNTIKMVVGLGNPGKEYEQTRHNAGFWFLDELAWKWKASFKEEKKFFGEVARAALPDGD
           ||||||||||||||||||||||||||||||||||||||||||||||||||||||||||||
g616       MSNTIKMVVGLGNPGKEYEQTRHNAGFWFLDELAWKWKASFKEEKKFFGEVARAALPDGD
                   10        20        30        40        50        60

                   70        80        90       100       110       120
m616.pep   VWLLKPATFMNRSGQAVAALAQFYKIKPEEILVVHDELDIPCGRIKFKLGGGNGGHNGLK
           ||||||||||||||||||||||||||||||||||||||||||||||||||||||||||||
g616       VWLLKPATFMNRSGQAVAALAQFYKIKPEEILVVHDELDIPCGRIKFKLGGGNGGHNGLK
                   70        80        90       100       110       120

                  130       140       150       160       170       180
m616.pep   DIQAKLGTADYYRLRLGIGHPGDRNLVVGYVLNKPSTEXPPTDXRCRRQIPASHTRHPCR
           ||||||||||||||||||||||||||||||||||||:| ||:: ||||||||::|||  |
g616       DIQAKLGTADYYRLRLGIGHPGDRNLVVGYVLNKPSAEAPPANRRCRRQIPAGRTRHHFR
                  130       140       150       160       170       180

                  190       200       210       220       230       240
m616.pep   QMGRSNPLPAQQMTRCRLKPFQTACSRFPYPNSHDRTQAAYPNRIHPRHRRNPRFPALRM
           ||||:| |||||: :||||||||| |||||||||:|||||||| |||||||||||||:||
g616       QMGRGNALPAQQIIQCRLKPFQTAFSRFPYPNSHERTQAAYPNGIHPRHRRNPRFPAVRM
                  190       200       210       220       230       240

                  250       260       270       280       290       300
m616.pep   QHRRCPLRRRNCRLARYAGRTRRKIPAPIQTMPDMAXRGTSMNLPRNRFILLSALWFAGS
           ||||  :|||:  :||:: ||||:||||:|::|::| ||  :|:|||||| |||||||||:
g616       QHRRSTVRRRSGTMARHTCRTRRQIPAPVQNLPNVAGRGGGMKLPRNRFSLLSALWFAGG
                  250       260       270       280       290       300

                  310       320       330       340       350       360
m616.pep   IYSLLFKAAETAPPPFPHFDKVAHLALFFAQIWLLTKAFRTDNRPIPYRSLMVFALCFAL
           |||||||||:|||||||||||:|||||||||| :|:|||:| : |||||||::||:|||:
g616       IYSLLFKAADTAPPPFPHFDKAAHLALFFAQILFLAKAFKTGKLPIPYRSLIAFAFCFAV
                  310       320       330       340       350       360

                  370       380       390       400
m616.pep   FSECAQAWFTATRTGSLGDVLADLTGAALALFTARAACRPDX
            |||||||||||||||||||||||||||||||:||:||||||
g616       GSECAQAWFTATRTGSLGDVLADLTGAALALFAARSACRPDX
                  370       380       390      400
```

The following partial DNA sequence was identified in *N. meningitidis* <SEQ ID 1977>:

```
a616.seq
  1   ATGTCAAACA CAATCAAAAT GGTTGTCGGC TTGGGCAACC CGGGCAAAGA

 51   ATACGAACAG ACACGCCACA ATGCGGGTTT TTGGTTCCTC GACGAACTGG

101   CGTGGAAATG GAAGGCTTCA TTTAAAGAAG AAAAAAAATT CTTCGGCGAA

151   GTCGCCCGTG CTACCCTGCC CGACGGCGAT GTCTGGCTGC TCAAGCCGAC

201   CACGTTCATG AACCGTTCCG GACAGGCAGT TGCCGCCCTT GCGCAGTTTT

251   ATAAAATCAA ACCCGAAGAA ATCCTCGTCG TCCACGACGA ACTCGACATT

301   CCCTGCGGAC GGATCAAATT CAAACTCGGC GGCGGCAACG GTGGACACAA
```

-continued

```
 351 CGGCTTGAAA GACATTCAGG CAAAACTCGG CACGGCAGAC TATTACCGCC

 401 TGCGCCTCGG CATCGGCCAC CCGGGCGACC GCAACCTCGT CGTCGGCTAT

 451 GTCCTGAACA AACCCAGTAC GGAA.CACCG CCGACAGATT GACGATGCCG

 501 TCGCCAAATC CCTGCAAGCC ATACCCGACA TCCTTGCCGG CAAATGTGAA

 551 GAGGCAACCC GCTTCCTGCA CAGCAAATGA CCCGATGCCG TCTGAAGCCC

 601 TTTCAGACGG CATGTTCCCG ATTTCCATAT CCGAACAGTC ATGACCGAAC

 651 TCAAGCAGCT TATCCAAACC GAATCCATCC CCGTCATCGA AGAAACCCTC

 701 GATTTCCTGC TGTACGAATG CAGCATCGAC GACGCACCAT CCGCCGAAGA

 751 AGTGGCACAA TGGCGCGACA TACTTGCCGC ACGCGGCGGC AAATTCCTGC

 801 GCCTGTCCAA AATCTGCCAA ACGTGGCTGG ACGAGGAGGC GGCATGAAGC

 851 TGCCGCGCAA CCGCTTCAGC CTGCTTTCCG CATTGTGGTT TGCCGGCGGC

 901 ATCTATTCGC TGCTCTTCAA AGCTGCCGAC ACCGCGCCGC CGCCGTTTCC

 951 GCATTTCGAC AAAGCAGCAC ACCTTGCCCT GTTTTTCGCA CAAATCTGGC

1001 TTTTGACCAA AGCATTCAAA ACCGGAAAAC TTCCCATCCC CTACCGCAGC

1051 CTGATGGTCT TTGCCCTCTG TTTCGCCCTC TTCAGCGAAT GCGCGCAGGC

1101 ATGATTTACC GCAACGAGAA CCGGCAGTTT GGGCGATGTT CTTGCCGATA

1151 TGGCAGGTAC GGTTCTCGCA CTCTTTGCCG CCCGCGCCGC CGACCGCCCG

1201 GACTGA
```

This corresponds to the amino acid sequence <SEQ ID 1978; *ORF* 616.a>:

```
a616.pep

  1 MSNTIKMVVG LGNPGKEYEQ TRHNAGFWFL DELAWKWKAS FKEEKKFFGE

 51 VARATLPDGD VWLLKPTTFM NRSGQAVAAL AQFYKIKPEE ILVVHDELDI

101 PCGRIKFKLG GGNGGHNGLK DIQAKLGTAD YYRLRLGIFH PGDRNLVVGY

151 VLNKPSTEXP PTD*RCRRQI PASHTRHPCR QM*RGNPLPA QQMTRCRLKP

201 FQTACSRFPY PNSHDRTQAA YPNRIHPRHR RNPRFPAVRM QHRRRTIRRR

251 SGTMARHTCR TRRQIPAPVQ NLPNVAGRGG GMKLPNRNFS LLSALWFAGG

301 IYSLLFKAAD TAPPPFPHFD KAAHLALFFA QIWLLTKARK TGKLPIPYRS

351 LMVFALCFAL FSECAQA*FT ATRTGSLGDV LADMAGTVLA LFAARAADRP

401 D*
```

```
m616/a616  90.0% identity in 401 aa overlap

                   10        20        30        40        50        60
m616.pep   MSNTIKMVVGLGNPGKEYEQTRHNAGFWFLDELAWKWKASFKEEKKFFGEVARAALPDGD
           ||||||||||||||||||||||||||||||||||||||||||||||||||||||:|||||
a616       MSNTIKMVVGLGNPGKEYEQTRHNAGFWFLDELAWKWKASFKEEKKFFGEVARATLPDGD
                   10        20        30        40        50        60

                   70        80        90       100       110       120
m616.pep   VWLLKPATFMNRSGQAVVALAQFYKIKPEEILVVHDELDIPCGRIKFKLGGGNGGHNGLK
           ||||||:|||||||||||||||||||||||||||||||||||||||||||||||||||||
a616       VWLLKPTTFMNRSGQAVAALAQFYKIKPEEILVVHDELDIPCGRIKFDLGGGNGGHNGLK
                   70        80        90       100       110       120

                  130       140       150       160       170       180
m616.pep   DIQAKLGTADYYRLRLGIGHPGDRNLVVGYVLNKPSTEXPPTDXRCRRQIPASHTRHPCR
           ||||||||||||||||||||||||||||||||||||||||||||||||||||||||||||
a616       DIQAKLGTADYYRLRLGIGHPGDRNLVVGYVLNKPSTEXPPTDXRCRRQIPASHTRHPCR
                  130       140       150       160       170       180
```

-continued

```
                 190        200        210        220        230        240
m616.pep  QMGRSNPLPAQQMTRCRLKPFQTACSRFPYPNSHDRTQAAYPNRIHPRHRRNPRFPALRM
          || |:||||||||||||||||||||||||||||||||||||||||||||||||||||:||
a616      QMXRGNPLPAQQMTRCRLKPFQTACSRFPYPNSHDRTQAAYPNRIHPRHRRNPRFPAVRM
                 190        200        210        220        230        240

                 250        260        270        280        290        300
m616.pep  QHRRCPLRRRNCRLARYAGRTRRKIPAPIQTMPDMAXRGTSMNLPRNRFILLSALWFAGS
          ||||  :|||:  :||:: ||||:||||:|::|::| || :|:|||||| |||||||||:
a616      QHRRRTIRRRSGTMARHTCRTRRQIPAPVQNLPNVAGRGGGMKLPRNRFSLLSALWFAGG
                 250        260        270        280        290        300

                 310        320        330        340        350        360
m616.pep  IYSLLFKAAETAPPPFPHFDKVAHLALFFAQIWLLTKAFRTDNRPIPYRSLMVFALCFAL
          |||||||||:|||||||||||:|||||||||||||||||:| |:||||||||||||||||
a616      IYSLLFKAADTAPPPFPHFDKAAHLALFFAQIWLLTKAFKTGKLPIPYRSLMVFALCFAL
                 310        320        330        340        350        360

                 370        380        390        400
m616.pep  FSECAQAWFTATRTGSLGDVLADLTGAALALFTARAACRPDX
          ||||||| |||||||||||||||::|::||||:|||| ||||
a616      FSECAQAXFTATRTGSLGDVLADMAGTVLALFAARAADRPDX
                 370        380        390        400
```

The following partial DNA sequence was identified in *N. gonorrhoeae* <SEQ ID 1979>:

```
g619.seq
  1 ATGCCGTCTG AAAAAAATAT CGGTTTTATG GCAGGAAGCA GCCGTCCGTT

 51 GCGGGTCGCC TTTGCGCTGT TGCTGGTTTC CTGCATCCTG TTTATGACGC

101 TCAACGTCAA AGGAGATTGG GACTTTGTCT TGCACCTGCG CCTGACCAAG

151 CTTGCCGCGC TGCTGATGGT CGCCTATGCG GTCGGCGTGT CCACTCAACT

201 CTTCCAAACG CTGACCAACA ACCCGATTCT GACCCCTTCG ATTTTGGGTT

251 TCGATTCGCT GTATGTGTTT TTGCAGACCT TGCTGgtGTT TACGTtcgGC

301 GGCGTGGGCT ATAcatccct gccgttgacg gGCAAATTCG GCTTTGAACT

351 GGTTGTTATG ATGGGCGGCT CGCTGCTGCT GTTTTACACG CTCATCCGTC

401 AGGGCGGGCG CGATTTGCCG CACATGATTT TAATCGGCGT GATTTTCGGG

451 ATTTTGTTCC GCAGCCTTTC CTCGCTGCTT TCGCGCATGA TAGACCCCGA

501 AGAATTTACC GCCGCGCAGG CGAATATGTT TGCCGGATTC AATACCGTCC

551 GCAGCGAGCT TTTAGGCATA GGCGCGCTGG TCCTGCTCGT CAGCGCGGCG

601 GTCGTTTGGC ACGAACGCTA CCGCTCGGAC GTACACCTTT TGGGGCGCGA

651 CCAAGCCGTC AATTTGGGCA TCAGCTACAC GCGCAACACC TTATGGATAC

701 TGCTTTGGAT TGCCGCATTG GTGGCGACGG CGACCGCCGT TGTCGGCCCG

751 GTGAGCTTTT TCGGGCTTCT CGCCGCCTCG CTTGCCAACC ACTTTTCCCc

801 gtCCGTGCGC CATTCCGTCC GCCTGCcgat gacggtttGC gtcgGcggCA

851 TCCTCTTGgt cggCggacaA ACCGTATTCG AACACTTCTT GGGCATGAag

901 gCggTATTAA GCGTGGTGGt cgAATTTGCG ggcggactcG TTTTCCTCTA

951 TCTCGTTTTA AAACACAAAA AATGA
```

This corresponds to the amino acid sequence <SEQ ID 1980; ORF 619.a>:

```
g619.pep
  1 MPSEKNIGFM AGSSRPLRVA FALLLVSCIL FMTLNVKGDW DFVLHLRLTK

 51 LAALLMVAYA VGVSTQLFQT LTNNPILTPS ILGFDSLYVF LQTLLVFTFG

101 GVGYTSLPLT GKFGFELVVM MGGSLLLFYT LIRQGGRDLP HMILIGVIFG
```

-continued

```
151 ILFRSLSSLL SRMIDPEEFT AAQANMFAGF NTVRSELLGI GALVLLVSAA

201 VVWHERYRSD VHLLGRDQAV NLGISYTRNT LWILLWIAAL VATATAVVGP

251 VSFFGLLAAS LANHFSPSVR HSVRLPMTVC VGGILLVGGQ TVFEHFLGMK

301 AVLSVVVEFA GGLVFLYLVL KHKK*
```

The following partial DNA sequence was identified in *N. meningitidis* <SEQ ID 1981>:

```
m619.seq
  1 ATGCCGTCTG AAAAAAATAT CGGTTTTATG GCAGGAAGCA GCCGCCCGTT

 51 GTGGGTCGCC TTTGCGCTGT TGCTGGTTTC CTGCGTCCTG TTTATGACGC

101 TCAACGTCAA AGGCGATTGG GATTTTGTTT TGCAACTGCG GCTGACCAAA

151 CTTGCCGCGC TGCTGATGGT CGCCTATGCG GTCGGCGTGT CCACGCAACT

201 CTTCCAAACG CTGACCAATA ATCCGATTCT GACCCCTTCA ATTTTGGGTT

251 TCGATTCGCT GTATGTGTTT TTGCAGACCT TGCTGGTGTT TACGTTCGGC

301 GGCGTGGGCT ATGCTTCCCT GCCGTTGACG GGCAAATTCG GCTTTGAACT

351 GGTCGTCATG ATGGGCGGCT CGCTGCTGCT GTTCTACACG CTCATCAAAC

401 AGGGCGGACG CGATTTGTCG CGCATGATTT TAATCGGCGT GATTTTCGGG

451 ATTTTGTTCC GCAGCCTGTC GTCGCTGCTT TCGCGCATGA TCGATCCCGA

501 AGAATTTACC GCCGCGCAGG CGAATATGTT TGCCGGATTC AATACCGTCC

551 ACAGCGAGCT TTTGGGCATA GGCGCGCTGA TTCTGCTCGT CAGCGCGGCG

601 GTCGTTTGGC GCGAACGCTA CCGCTTGGAC GTTTACCTTT TGGGGCGTGA

651 CCAAGCCGTC AATTTGGGCA TCAGCTACAC GCGCAACACC TTATGGATAC

701 TGCTTTGGAT TGCCGCATTG GTGGCGACGG CGACCGCCGT GGTCGGCCCC

751 GTAAGCTTTT TCGGGCTTCT CGCCGCCTCG CTTGCCAACC ACTTTTCCCC

801 GTCGGTCAAA CATTCCGTCC GCCTGCCGAT GACGGTTTGT ATCGGCGGCA

851 TCCTCTTGGT CGGCGGACAG ACCGTGTTCG AACACCTGCT CGGTATGCAG

901 GCAGTGTTGA GCGTAGTAGT AGAATTTGCC GGCGGACTCG TTTTCCTCTA

951 TCTCGTTTTA AAACACAAAA AATGA
```

This corresponds to the amino acid sequence <SEQ ID 1982; ORF 619>:

```
m619.pep

  1 MPSEKNIGFM AGSSRPLWVA FALLLVSCVL FMTLNVKGDW DRVLQLRLTK

 51 LAALLMVAYA VGVSTQLFQT LTNNPILTPS ILGRDSLYVF LQTLLVFTFG

101 GVGYASLPLT GKFGFELVVM MGGSLLLFYT LIKQGGRDLS RMILIGVIFG

151 ILFRSLSSLL SRMIDPEEFT AAQANMFAGF NTVHSELLGI GALILLVSAA

201 VVWRERYRLD VYLLGRDQAV NLGISYTRNT LWILLWIAAL VATATAVVGP

251 VSFFGLLAAS LANHFSPSVK HSVRLPMTVC IGGILLVGGQ TVFEHLLGMQ

301 AVLSVVVEFA GGLVFLYLVL KHKK*
```

-continued

```
m619/g619  95.1% identity in 324 aa overlap

                   10        20        30        40        50        60
m619.pep   MPSEKNIGFMAGSSRPLWVAFALLLVSCVLFMTLNVKGDWDFVLQLRLTKLAALLMVAYA
           ||||||||||||||||| ||||||||||:|||||||||||||||:|||||||||||||||
g619       MPSEKNIGFMAGSSRPLRVAFALLLVSCILFMTLNVKGDWDFVLHLRLTKLAALLMVAYA
                   10        20        30        40        50        60

                   70        80        90       100       110       120
m619.pep   VGVSTQLFQTLTNNPILTPSILGFDSLYVFLQTLLVFTFGGVGYASLPLTGKFGRELVVM
           |||||||||||||||||||||||||||||||||||||||||||:||||||||||||||||
g619       VGVSTQLFQTLTNNPILTPSILGRDSLYVFLQTLLVFTFGGVGYTSLPLTGKFGRELVVM
                   70        80        90       100       110       120

                  130       140       150       160       170       180
m619.pep   MGGSLLLFYTLIKQGGRDLSRMILIGVIFGILFRSLSSLLSRMIDPEEFTAAQANMFAGF
           ||||||||||||:|||||| :||||||||||||||||||||||||||||||||||||||
g619       MGGSLLLFYTLIRQGGRDLPHMILIGVIFGILFRSLSSLLSRMIDPEEFTAAQANMFAGR
                  130       140       150       160       170       180

                  190       200       210       220       230       240
m619.pep   NTVHSELLGIGALILLVSAAVVWRERYRLDVYLLGRDQAVNLGISYTRNTLWILLWIAAL
           |||:|||||||||:|||||||||:|||| ||:||||||||||||||||||||||||||||
g619       NTVRSELLGIFALVLLVSAAVVWHERYRSDVHLLGRDQAVNLGISYTRNTLWILLWIAAL
                  190       200       210       220       230       240

                  250       260       270       280       290       300
m619.pep   VATATAVVGPVSFFGLLAASLANHFSPSVKHSVRLPMTVCIGGILLVGGQTVFEHLLGMQ
           |||||||||||||||||||||||||||||:||||||||||:||||||||||||||:|||:
g619       VATATAVVGPVSFFGLLAASLANHFSPSVRHSVRLPMTVCVGGILLVGGQTVFEHFLGMK
                  250       260       270       280       290       300

                  310       320
m619.pep   AVLSVVVEFAGGLVFLYLVLKHKKX
           ||||||||||||||||||||||||
g619       AVLSVVVEFAGGLVFLYLVLKHKKX
                  310       320
```

The following partial DNA sequence was identified in *N. meningitidis* <SEQ ID 1983>:

```
a619.seq
     1 ATGCCGTCTG AAAAAAATAT CGGTTTTATG GCAGGAAGCA GCCGTCCGTT

    51 GTGGGTTGCC TTTGCGCTGT TGCTGGTTTC CTGCATCCTG TTTATGACGC

   101 TCAACGTCAA AGGCGATTGG GATTTTGTTT TGCACCTGCG CCTGACCAAG

   151 CTTGCCGCGC TGCTGATGGT CGCCTATGCG GTCGGCGTTT CGACCCAGCT

   201 TTTTCAAACG CTGACCAACA ATCCGATTCT GACCCCTTCG ATTTTGGGTT

   251 TCGATTCGCT GTATGTGTTT TTGCAGACCT TGCTGGTGTT TACGTTCGGC

   301 GGCGTGGGCT ATGCTTCCCT GCCGTTGACG GGCAAATTCG GCTTTGAACT

   351 GGTCGTTATG ATGGGCGGCT CGCTGCTGCT GTTTTACACG CTCATCAAAC

   401 AGGGCGGGCG CGATTTGCCG CGTATGATTT TAATCGGCGT GATTTTCGGG

   451 ATTTTGTTCC GCAGCCTGTC GTCGCTGCTT TCGCGCATGA TCGACCCCGA

   501 AGAATTTACG GCGGCGCAGG CGAATATGTT TGCCGGATTC AATACCGTCC

   551 ACAGCGAGCT TTTAGGCATA GGCGCGCTGA TTCTGCTCGT CAGCGCGGCG

   601 GTCGTTTGGC GCGAACGCTA CCGCTTGGAC GTACACCTTT TGGGGCGCGA

   651 CCAAGCCATA AATTTGGGCA TCAGCTACAC GCGCAACACC TTATGGATAC

   701 TGCTTTGGAT TGCCGCGCTG GTGGCGACGG CGACCGCCGT TGTCGGCCCG

   751 GTAAGCTTTT TCGGGCTTCT CGCCGCCTCG CTTGCCAACC ACTTTTCCCC

   801 GTCGGTCAAA CATTCCGTCC GCCTGCCGAT GACGGTTTGT GTCGGCGGCA

   851 TCCTCTTGGT CGGCGGACAG ACCGTATTCG AACACTTCTT GGGCATGAAG

   901 GCGGTATTAA GCGTGGTGGT CGAATTTGCG GGCGGACTCG TTTTCCTCTA

   951 TCTCGTTTTA AGACACAAAA AATGA
```

This corresponds to the amino acid sequence <SEQ ID 1984; ORF 619.a>:

```
a619.pep
      1 MPSEKNIGFM AGSSRPLWVA FALLLVSCIL FMTLNVKGDW DFVLGLRLTK
     51 LAALLMVAYA VGSVTQLFQT LTNNPILTPS ILGFDSLYVF LQTLLVFTFG
    101 GVGYASLPLT GKFGFELVVM MGGSLLLFYT LIKQGGRDLP RMILIGVIFG
    151 ILFRSLSSLL SRMIDPEEFT AAQANMFAGF NTVHSELLGI GALILLVSAA
    201 VVWRERYRLD VHLLGRDQAI NLGISYTRNT LWILLWIAAL VATATAVVGP
    251 VSFFGLLAAS LANHFSPSVK HSVRLPMTVC VGGILLVGGQ TVFEHFLGMK
    301 AVLSVVVEFA GGLVFLYLVL RHKK*
```

```
m619/a619  97.2% identity in 324 aa overlap

                    10        20        30        40        50        60
m619.pep    MPSEKNIGFMAGSSRPLWVAFALLLVSCVLFMTLNVKGDWDFVLQLRLTKLAALLMVAYA
            ||||||||||||||||||||||||||||:||||||||||||||:||||||||||||||||
a619        MPSEKNIGFMAGSSRPLWVAFALLLVSCILFMTLNVKGDWDFVLHLRLTKLAALLMVAYA
                    10        20        30        40        50        60

                    70        80        90       100       110       120
m619.pep    VGVSTQLFQTLTNNPILTPSILGFDSLYVFLQTLLVFTFGGVGYASLPLTGKFGFELVVM
            ||||||||||||||||||||||||||||||||||||||||||||||||||||||||||||
a619        VGVSTQLFQTLTNNPILTPSILGRDSLYVFLQTLLVFTFGGVGYASLPLTGKFGFELVVM
                    70        80        90       100       110       120

                   130       140       150       160       170       180
m619.pep    MGGSLLLFYTLIKQGGRDLSRMILIGVIFGILFRSLSSLLSRMIDPEEFTAAQANMFAGF
            ||||||||||||||||||| ||||||||||||||||||||||||||||||||||||||||
a619        MGGSLLLFYTLIKQGGRDLPRMILIGVIFGILFRSLSSLLSRMIDPEEFTAAQANMFAGF
                   130       140       150       160       170       180

                   190       200       210       220       230       240
m619.pep    NTVHSELLGIGALILLVSAAVVWRERYRLDVYLLGRDQAVNLGISYTRNTLWILLWIAAL
            |||||||||||||||||||||||||||||||:|||||||:||||||||||||||||||||
a619        NTVHSELLGIGALILLVSAAVVWRERYRLDVHLLGRDQAINLGISYTRNTLWILLWIAAL
                   190       200       210       220       230       240

                   250       260       270       280       290       300
m619.pep    VATATAVVGPVSFFGLLAASLANHFSPSVKHSVRLPMTVCIGGILLVGGQTVFEHLLGMQ
            ||||||||||||||||||||||||||||||||||||||||:|||||||||||||:||||:
a619        VATATAVVGPVSFFGLLAASLANHFSPSVKHSVRLPMTVCVGGILLVGGQTVFEHFLGMK
                   250       260       270       280       290       300

                   310       320
m619.pep    AVLSVVVEFAGGLVFLYLVLKHKKX
            ||||||||||||||||||||:||||
a619        AVLSVVVEFAGGLVFLYLVLRHKKX
                   310       320
```

The following partial DNA sequence was identified in *N. gonorrhoeae* <SEQ ID 1985>:

```
g620.seq
  1 ATGAAGAAAA CCCTGTTGGc AATTGTTGCC gtTTTCGCCT TAAGTGCCTG
 51 CCGGCaggcg gaAGaggcac cgccgCCTTT ACCCCGGCAG AtTAGCGacc
101 gttcggtcgg aCACTAttgC Agtatgaacc tgaccgaaca caacggcccc
151 aaagcccaga ttttttgaa cGGCAAACCC GATCAGCCCG TTTGGTTCTC
201 CACCGTcaag cagatgttcg GCTATACCAA GCTGCCCGAA GAGCCCAAAG
251 GCATCCGCGT GATTTACGTT ACCGATATGG GCAATGTTAC CGATTGGACG
301 AATCCTAATG CCGACACGGA GTGGATAGAT GCGAAAAAAG CCTTTTACGT
351 CATCGACAGC GGCTTTATCG GCGGTATGGG CGCGGAAGAC GCGCTGCCGT
401 TCGGCAACAA GGAGCAGGCT GAAAAATTTG CAAAGGATAA AGGCGGCAAG
451 GTCGTCGGTT TTGACGATAT GCCCGATGCT TACATTTTCA AGTAA
```

This corresponds to the amino acid sequence <SEQ ID 1986; *ORF* 620.ng>:

```
g620.pep
   1 MKKTLLAIVA VFALSACRQA EEAPPPLPRQ ISDRSVGHYC SMNLTEHNGP

  51 KAQIFLNGKP DQPVWFSTVK QMFGYTKLPE EPKGIRVIYV TDMGNVTDWT

 101 NPNADTEWID AKKAFYVIDS GFIGGMGAED ALPFGNKEQA EKFAKDKGGK

 151 VVGFDDMPDA YIFK*
```

The following partial DNA sequence was identified in *N. meningitidis* <SEQ ID 1987>:

```
m620.seq
   1 ATGAAAAAAA CCCTGTTGGC AATTGTTGCC GTTTCCGCCT TAAGTGCCTG

  51 CCGGCAGGCG GAAGAGGGAC CGCCGCCTTT ACCCCGGCAG ATTAGCGACC

 101 GTTCGGTCGG ACACTATTGC AGTATGAACC TGACCGAACA CAACGGCCCC

 151 AAAGCCCAGA TTTTCTTGAA CGGCAAACCC GATCAGCCCG TTTGGTTCTC

 201 CACCATCAAG CAGATGTTCG GCTATACCAA GCTGCCCGAA GAGCCTAAAG

 251 GCATCCGCGT GATTTACGTT ACCGATATGG GCAATGTTAC CGATTGGACG

 301 AATCCCAATG CCGACACGGA GTGGATGGAT GCGAAAAAAG CCTTTTACGT

 351 CATCGACAGC GGCTTTATCG GCGGTATGGG TGCGGAAGAC GCGCTGCCGT

 401 TCGGCAACAA AGAGCAGGCT GAGAAATTTG CAAAGGATAA AGGCGGTAAG

 451 GTTGTCGGTT TCGACGATAT GCCTGATACC TATATTTTCA AATAA
```

This corresponds to the amino acid sequence <SEQ ID 1088; ORF 670>:

```
m620.pep

     1 MKKTLLAIVA VSALSACRQA EEGPPPLPRQ ISDRSVGHYC SMNLTEHNGP

    51 KAQIFLNGKP DQPVWFSTIK QMFGYTKLPE EPKGIRVIYV TDMGNVTDWT

   101 NPNADTEWMD AKKAFYVIDS GFIGGMGAED ALPFGNKEQA EKFAKDKGGK

   151 VVGFDDMPDT YIFK*

m620/g620  97.0% identity in 164 aa overlap

                   10        20        30        40        50        60
m620.pep   MKKTLLAIVAVSALSACRQAEEGPPPLPRQISDRSVGHYCSMNLTEHNGPKAQIFLNGKP
           |||||||||| ||||||||||:||||||||||||||||||||||||||||||||||||||
g620       MKKTLLAIVAVFALSACRQAEEAPPPLPRQISDRSVGHYCSMNLTEHNGPKAQIFLNGKP
                   10        20        30        40        50        60

                   70        80        90       100       110       120
m620.pep   DQPVWFSTIKQMFGYTKLPEEPKGIRVIYVTDMGNVTDWTNPNADTEWMDAKKAFYVIDS
           ||||||||:|||||||||||||||||||||||||||||||||||||||:|||||||||||
g620       DQPVWFSTVKQMFGYTKLPEEPKGIRVIYVTDMGNVTDWTNPNADTEWIDAKKAFYVIDS
                   70        80        90       100       110       120

                  130       140       150       160
m620.pep   GRIFFMGAEDALPFGNKEQAEKFAKDKGGKVVGFDDMPDTYIFKX
           |||||||||||||||||||||||||||||||||||||||:|||||
g620       GFIGGMGAEDALPFGNKEQAEKFAKDKGGKVVGFDDMPDAYIFKX
                  130       140       150       160
```

The following partial DNA sequence was identified in *N. meningitidis* <SEQ ID 1989>:

```
a620.seq
  1 ATGAAAAAAA CCCTGTTGGC AATTGTTGCC GTTTCCGCCT TAAGTGCCTG

 51 CCGGCAGGCG GAAGAGGGAC CGCCGCCTTT ACCCCGGCAG ATTAGCGACC
```

-continued

```
101 GTTCGGTCGG ACACTATTGC AGTATGAACC TGACCGAACA CAACGGCCCC

151 AAAGCCCAGA TTTTCTTGAA CGGCAAACCC GATCAGCCCG TTTGGTTCTC

201 CACCATCAAG CAGATGTTCG GCTATACCAA GCTGCCCGAA GAGCCTAAAG

251 GCATCCGCGT GATTTACGTT ACCGATATGG GCAATGTTAC CGATTGGACG

301 AATCCCAATG CCGACACGGA GTGGATGGAT GCGAAAAAAG CCTTTTACGT

351 CATCGACAGC GGCTTTATCG GCGGTATGGG TGCGGAAGAC GCGCTGCCGT

401 TCGGCAACAA AGAGCAGGCT GAGAAATTTG CAAAGGATAA AGGCGGTAAG

451 GTTGTCGGTT TCGACGATAT GCCTGATACC TATATTTTCA AATAA
```

This corresponds to the amino acid sequence <SEQ ID 1990; *ORF* 620.a>:

```
a620.pep
      1 MKKTLLAIVA VSALSACRQA EEGPPPLPRQ ISDRSVGHYC SMNLTEHNGP

     51 KAQIFLNGKP DQPVWFSTIK QMFGYTKLPE EPKGIRVIYV TDMGNVTDWT

    101 NPNADTEWMD AKKAFYVIDS GFIGGMGAED ALPFGNKEQA EKFAKDKGGK

    151 VVGFDDMPDT YIFK*

m620/a620  100.0% identity in 164 aa overlap

                   10        20        30        40        50        60
m620.pep   MKKTLLAIVAVSALSACRQAEEGPPPLPRQISDRSVGHYCSMNLTEHNGPKAQIFLNGKP
           ||||||||||||||||||||||||||||||||||||||||||||||||||||||||||||
a620       MKKTLLAIVAVSALSACRQAEEGPPPLPRQISDRSVGHYCSMNLTEHNGPKAQIFLNGKP
                   10        20        30        40        50        60
                   70        80        90       100       110       120
m620.pep   DQPVWFSTIKQMFGYTKLPEEPKGIRVIYVTDMGNVTDWTNPNADTEWMDAKKAFYVIDS
           ||||||||||||||||||||||||||||||||||||||||||||||||||||||||||||
a620       DQPVWFSTIKQMFGYTKLPEEPKGIRVIYVTDMGNVTDWTNPNADTEWMDAKKAFYVIDS
                   70        80        90       100       110       120
                  130       140       150       160
m620.pep   GFIGGMGAEDALPFGNKEQAEKFAKDKGGKVVGFDDMPDTYIFKX
           |||||||||||||||||||||||||||||||||||||||||||||
a620       GFIGGMGAEDALPFGNKEQAEKFAKDKGGKVVGFDDMPDTYIFKX
                  130       140       150       160
```

The following partial DNA sequence was identified in *N. gonorrhoeae* <SEQ ID 1991>:

```
g622.seq
   1  ATGCAactta ccgctgtcgg ACTCAATCAT CAAACCGCAC CTTTAAGCAT

  51  ACGGGAAAag ctggCGTTTG CCGCCGCCGC CCTGCCAGAA gccgTccgCA

 101  ATCTTGCCCG AAGCAATGCG GCAACGGAGG CGGTAATCCT TTCTACCTGC

 151  AACCGCACCG AGCTTTACTG CGTCGGCGAT TCGGAAgaaa TCATCCGATG

 201  GCTTGCCGAT TACCACAGTT TGCCGATTGA AGAAATCCGT CCGTATCTGT

 251  ACACGCTGGA TATGCAGGAA ACCGTGCGCC ACGCCTTCCG CGTTGCCTGC

 301  GGCTTGGATT CGATGGTTTT GGGCGAGCCG CAGATTTTGG GGCAGATTAA

 351  AGATGCGGTG CGTGCGGCTC AAGAACAGGA AAGTATGGGG GCAAAACTCA

 401  ATGCCCTGTT CCAAAAAACC TTTTCCGTTG CTAAAGAAGT CCGTACCGAT

 451  ACCGCTGTCG GCGAAAATTC GGTTTCGATG GCTTCCGCGT CCGTCAAGTT
```

-continued

```
 501 GGCGGAACAG ATTTTTCCCG ACATCGGCGA TTTGAACGTA TTGTTTATCG

 551 GCGCAGGCGA AATGATTGAG CTGGTTGCCA CTTATTTTGC CGCCAAAAAT

 601 CCCCGGCTGA TGACGGTTGC CAACCGGACG CTGGCGCGTG CACAGGAGTT

 651 GTGCGACAAG CTCGGTGTTA ACGCCGAACC GTGCCTGCTG TCCGATCTGC

 701 CTGCCATTCT GCACGATTAC GACGTGGTGG TTTCTTCAAC GGCGAGCCAG

 751 CTTCCGATAG TCGGCAAAGG CATGGTCGAA CGCGCATTGA AACAGCGTCA

 801 GAGTATGCCG TTGTTCATGC TTGACTTGGC CGTGCCGCGC GATATTGAAG

 851 CGGAAGTCGG CGATTTGAAC GATGCGTATC TTTATACGGT GGACGATATG

 901 GTCAACATCG TCCAAAGCGg caaggaggca aggcagaaag ccgccgcCgc

 951 cgccgaaacg ctggTGTCCG AAAAGGTTGC CGAATTTGTC AGGCAGCAGC

1001 AGGGCAGGCA GagcgttcCG CTGATTAAGG CCTTGCGGGA CGAGGGCGAG

1051 AAAGCGCGCA AGCAGGTGTT GGAAAATGCG ATGAAACAGC TTGCCAAAGG

1101 CGcaaCGGCG GAAGaggttt TGgaacggct gtccgtcCAA CTGACCAACA

1151 AGCTGCTGCA TTCGCCAACT CAAACCTTGA ATAAGGCGGG GGAAGAAGAT

1201 AAAGatttGG TTCATGCCgt cGCGCAGATt tatcatttGG ACAAATAA
```

This corresponds to the amino acid sequence <SEQ ID 1992; ORF 622.ng>:

```
g622.pep
   1 MQLTAVGLNH QTAPLSIREK LAFAAAALPE AVRNLARSNA ATEAVILSTC

  51 NRTELYCVGD SEEIIRWLAD YHSLPIEEIR PYLYTLDMQE TVRHAFRVAC

 101 GLDSMVLGEP QILGQIKDAV RAAQEQESMG AKLNALFQKT FSVAKEVRTD

 151 TAVGENSVSM ASASVKLAEQ IFPDIGDLNV LFIGAGEMIE LVATYFAAKN

 201 PRLMTVANRT LARAQELCDK LGVNAEPCLL SDLPAILHDY DVVVSSTASQ

 251 LPIVGKGMVE RALKQRQSMP LFMLDLAVPR DIEAEVGDLN DAYLYTVDDM

 301 VNIVQSGKEA RQKAAAAAET LVSEKVAEFV RQQQGRQSVP LIKALRDEGE

 351 KARKQVLENA MKQLAKGATA EEVLERLSVQ LTNKLLHSPT QTLNKAGEED

 401 KDLVHAVAQI YHLDK*
```

The following partial DNA sequence was identified in *N. meningitidis* <SEQ ID 1993>:

```
m622.seq
   1 ATGCAACTTA CCGCTGTCGG ACTCAATCAT CAAACCGCAC CTTTAAGCAT

  51 ACGGGAAAAG CTGGCGTTTG CCGCCGCCGC CCTGCCTAAA GCCGTCCGCA

 101 ATCTTGCCCG AAGCAATGCG GCAACGGAGG CGGTAATCCT TTCTACCTGC

 151 AACCGCACCG AGCTTTACTG CGTCGGTGAT TCGGAAGAAA TCATCCGATG

 201 GCTTGCCGAT TACCACAGTT TGCCGATTGA AGAAATCCGT CCGTATCTGT

 251 ACGCGCTGGA TATGCAGGAG ACTGTGCGCC ATGCTTTCCG CGTCGCCTGC

 301 GGGCTGGATT CGATGGTGTT GGGCGAGCCG CAGATTTTAG GACAGATTAA

 351 GGATGCCGTT AGGGTTGCTC AAGAGCAGGA AAGTATGGGT AAGAAACTCA

 401 ATGCCCTGTT CCAAAAAACC TTTTCCGTTG CTAAAGAGGT CCGTACCGAT

 451 ACTGCCGTCG GCGAAAACTC GGTTTCCATG GCTTCCGCTT CCGTCAAATT
```

-continued

```
 501 GGCGGAACAG ATTTTTCCCG ACATCGGCGA TTTGAATGTC TTGTTTATCG

 551 GCGCAGGCGA AATGATTGAG CTGGTTGCCA CTTATTTTGC CGCCAAAAGT

 601 CCCCGGCTGA TGACGGTTGC CAACCGGACG CTGGCGCGTG CACAGGAGTT

 651 GTGCGACAAG CTCGGTGTCA ACGCCGAACC GTGCCTGCTG TCCGATCTGC

 701 CTGCCATTCT GCACGATTAC GACGTAGTGG TTTCTTCAAC GGCAAGCCAG

 751 TTGCCCATTG TCGGCAAAGG CATGGTGGAG CGTGCATTGA AACAAAGGCA

 801 GAGTATGCCG TTGTTCATGC TTGATTTGGC AGTGCCGCGT GACATTGAAG

 851 CGGAAGTCGG CGATTTGAAT GATGCCTATC TTTATACGGT GGACGATATG

 901 GTCAATATCG TCCAAAGCGG CAAGGAGGCA AGGCAGAAGG CCGCCGCCGC

 951 CGCCGAAACG CTGGTGTCCG AGAAAGTTGC CGAATTTGTC AGGCAGCAGC

1001 AGGGCAGGCA GAGTGTCCCC TTGATTAAGG CGTTGCGGGA CGAGGGCGAG

1051 AAAGCGCGCA AACAGGTGTT GGAAAATGCC ATGAAACAGC TTGCCAAAGG

1101 CGCAACGGCA GAAGAGGTTT TGGAACGGCT GTCCGTCCAA CTGACCAACA

1151 AGCTGCTGCA TTCGCCGACC CAAACCTTGA ATAAGGCGGG GGAAGAAGAT

1201 AAAGATTTGG TTCATGCCGT CGCGCAGATT TATCATTTGG ACAAATAA
```

This corresponds to the amino acid sequence <SEQ ID 1994; *ORF* 622>:

```
m622.pep

  1 MQLTAVGLNH QTAPLSIREK LAFAAAALPK AVRNLARSNA ATEAVILSTC

 51 NRTELYCVGD SEEIIRWLAD YHSLPIEEIR PYLYALDMQE TVRHAFRVAC

101 GLDSMVLGEP QILGQIKDAV RVAQEQESMG KKLNALFQKT FSVAKEVRTD

151 TAVGENSVSM ASASVKLAEQ IFPDIGDLNV LFIGAGEMIE LVATYFAAKS

201 PRLMTVANRT LARAQELCDK LGVNAEPCLL SDLPAILHDY DVVVSSTASQ

251 LPIVGKGMVE RALKQRQSMP LFMLDLAVPR DIEAEVGDLN DAYLYTVDDM

301 VNIVQSGKEA RQKAAAAAET LVSEKVAEFV RQQQGRQSVP LIKALRDEGE

351 KARKQVLENA MKQLAKGATA EEVLERLSVQ LTNKLLHSPT QTLNKAGEED

401 KDLVHAVAQI YHLDK*
```

m622/g622 98.8% identity in 415 aa overlap

```
                   10        20        30        40        50        60
m622.pep   MQLTAVGLNHQTAPLSIREKLAFAAAALPKAVRNLARSNAATEAVILSTCNRTELYCVGD
           |||||||||||||||||||||||||||||||:||||||||||||||||||||||||||||
g622       MQLTAVGLNHQTAPLSIREKLAFAAAALPEAVRNLARSNAATEAVILSTCNRTELYCVGD
                   10        20        30        40        50        60

                   70        80        90       100       110       120
m622.pep   SEEIIRWLADYHSLPIEEIRPYLYALDMQETVRHAFRVACGLDSMVLGEPQILGQIKDAV
           |||||||||||||||||||||||:||||||||||||||||||||||||||||||||||||
g622       SEEIIRWLADYHSLPIEEIRPYLYTLDMQETVRHAFRVACGLDSMVLGEPQILGQIKDAV
                   70        80        90       100       110       120

                  130       140       150       160       170       180
m622.pep   RVAQEQESMGKKLNALFQKTFSVAKEVRTDTAVGENSVSMASASVKLAEQIFPDIGDLNV
           |:|||||||| |||||||||||||||||||||||||||||||||||||||||||||||||
g622       RAAQEQESMGAKLNALFQKTFSVAKEVRTDTAVGENSVSMASASVKLAEQIFPDIGDLNV
                  130       140       150       160       170       180

                  190       200       210       220       230       240
m622.pep   LFIGAGEMIELVATYFAAKSPRLMTVANRTLARAQELCDKLGVNAEPCLLSDLPAILHDY
           |||||||||||||||||||:||||||||||||||||||||||||||||||||||||||||
g622       LFIGAGEMIELVATYFAAKNPRLMTVANRTLARAQELCDKLGVNAEPCLLSDLPAILHDY
                  190       200       210       220       230       240
```

-continued

```
                 250        260        270        280        290        300
m622.pep  DVVVSSTASQLPIVGKGMVERALKQRQSMPLFMLDLAVPRDIEAEVGDLNDAYLYTVDDM
          ||||||||||||||||||||||||||||||||||||||||||||||||||||||||||||
g622      DVVVSSTASQLPIVGKGMVERALKQRQSMPLFMLDLAVPRDIEAEVGDLNDAYLYTVDDM
                 250        260        270        280        290        300

                 310        320        330        340        350        360
m622.pep  VNIVQSGKEARQKAAAAAETLVSEKVAEFVRQQQGRQSVPLIKALRDEGEKARKQVLENA
          ||||||||||||||||||||||||||||||||||||||||||||||||||||||||||||
g622      VNIVQSGKEARQKAAAAAETLVSEKVAEFVRQQQGRQSVPLIKALRDEGEKARKQVLENA
                 310        320        330        340        350        360

                 370        380        390        400        410
m622.pep  MKQLAKGATAEEVLERLSVQLTNKLLHSPTQTLNKAGEEDKDLVHAVAQIYHLDKX
          ||||||||||||||||||||||||||||||||||||||||||||||||||||||||
g622      MKQLAKGATAEEVLERLSVQLTNKLLHSPTQTLNKAGEEDKDLVHAVAQIYHLDKX
                 370        380        390        400        410
```

The following partial DNA sequence was identified in *N. meningitidis* <SEQ ID 1995>:

```
a622.seq
   1 ATGCAACTTA CCGCTGTCGG ACTCAATCAT CAAACCGCAC CTTTAAGCAT

  51 ACGGGAAAAG CTGGCGTTTG CCGCGGCCTG CCTGCCCGAA GCCGTCCGCA

 101 ATCTTGCCCG AAGCAATGCG GCAACGGAGG CGGTAATCCT TTCTACCTGC

 151 AACCGTACCG AGCTTTACTG TGTAGGTGAT TCGGAAGAAA TCATCCGTTG

 201 GCTCGCAGAC TATCACAGCC TTCCCATAGA AGAAATCAGC CCCTACCTTT

 251 ATACTTTGGG GATGCAGGAG ACTGTGCGCC ATGCTTTCCG CGTCGCCTGC

 301 GGCTTGGATT CGATGGTGTT GGGCGAGCCG CAGATTTTAG GACAGATTAA

 351 GGATGCGGTC AGGGTTGCTC AAGAGCAGGA AAGTATGGGT AAGAAACTCA

 401 ATGCCCTGTT CCAAAAAACC TTTTCTGTTG CTAAAGAGGT CCGTACCGAT

 451 ACTGCCGTCG GCGAAAACTC GGTTTCCATG GCTTCCGCTT CCGTCAAGTT

 501 GGCAGAGCAG ATTTTCCCCG ACATCGGCGA TTTGAATGTC TTGTTTATCG

 551 GTGCGGGTGA GATGATTGAG CTGGTTGCCA CTTATTTTGC CGCCAAAAGT

 601 CCCCGGCTGA TGACGGTTGC CAACCGGACG CTGGCGCGTG CACAGGAGTT

 651 GTGCGACAAG CTCGGTGTCA ACGCCGAACC GTGCCTGCTG TCCGATCTGC

 701 CTGCCATTTT GCATGAGTAC GACGTGGTGG TTTCTTCAAC GGCAAGCCAG

 751 TTGCCCATTG TCGGCAAAGG TATGGTGGAG CGCGCATTGA AACAAAGGCA

 801 GAGTATGCCG TTGTTTATGC TTGACTTGGC CGTGCCGCGA GACATTGAGG

 851 CGGAAGTCGG AGATTTGAAC GATGCCTATC TTTATACGGT GGACGATATG

 901 GTCAATATCG TCCAAAGCGG CAAGGAGGCA AGGCAGAAGG CCGCCGCCGC

 951 CGCCGAAACG CTGGTGTCCG AGAAGGTTGC CGAATTTGTC AGGCAGCAGC

1001 AGGGCAGGCA GAGTGTCCCG TTAATCAGGG CATTGAGGGA TGAGGGAGAG

1051 AAAGCGCGCA AACAGGTCTT GGAAAATGCG ATGAAACAGC TTGCCAAAGG

1101 CGCAACGGCA GAAGAGGTTT TGGAAAGGCT GTCGATCCAA CTGACCAACA

1151 AGCTGCTGCA TTCGCCGACC CAAACCTTGA ATAAGGCGGG GGAAGAAGAT

1201 AAAGATTTGG TTCACGCCGT CGCGCAGATT TATCATTTGG ACAAATAA
```

This corresponds to the amino acid sequence <SEQ ID 1996; *ORF* 622.a>:

```
a622.pep

      1 MQLTAVGLNH QTAPLSIREK LAFAAACLPE AVRNLARSNA ATEAVILSTC

     51 NRTELYCVGD SEEIIRWLAD YHSLPIEEIS PYLYTLGMQE TVRHAFRVAC

    101 GLDSMVLGEP QILGQIKDAV RVAQEQESMG KKLNALFQKT FSVAKEVRTD

    151 TAVGENSVSM ASASVKLAEQ IFPDIGDLNV LFIGAGEMIE LVATYFAAKS

    201 PRLMTVANRT LARAQELCDK LGVNAEPCLL SDLPAILHEY DVVVSSTASQ

    251 LPIVGKGMVE RALKQRQSMP LFMLDLAVPR DIEAEVGDLN DAYLYTVDDM

    301 VNIVQSGKEA RQKAAAAAET LVSEKVAEFV RQQQGRQSVP LIRALRDEGE

    351 KARKQVLENA MKQLAKGATA EEVLERLSIQ LTNKLLHSPT QTLNKAGEED

    401 KDLVHAVAQI YHLDK*
```

```
m622/a622  98.1% identity in 415 aa overlap

                   10        20        30        40        50        60
m622.pep   MQLTAVGLNHQTAPLSIREKLAFAAAALPKAVRNLARSNAATEAVILSTCNRTELYCVGD
           |||||||||||||||||||||||||| ||:||||||||||||||||||||||||||||||
a622       MQLTAVGLNHQTAPLSIREKLAFAAACLPEAVRNLARSNAATEAVILSTCNRTELYCVGD
                   10        20        30        40        50        60

                   70        80        90       100       110       120
m622.pep   SEEIIRWLADYHSLPIEEIRPYLYALDMQETVRHAFRVACGLDSMVLGEPQILGQIKDAV
           ||||||||||||||||||| ||||:| |||||||||||||||||||||||||||||||||
a622       SEEIIRWLADYHSLPIEEISPYLYTLGMQETVRHAFRVACGLDSMVLGEPQILGQIKDAV
                   70        80        90       100       110       120

                  130       140       150       160       170       180
m622.pep   RVAQEQESMGKKLNALFQKTFSVAKEVRTDTAVGENSVSMASASVKLAEQIFPDIGDLNV
           ||||||||||||||||||||||||||||||||||||||||||||||||||||||||||||
a622       RVAQEQESMGKKLNALFQKTFSVAKEVRTDTAVGENSVSMASASVKLAEQIFPDIGDLNV
                  130       140       150       160       170       180

                  190       200       210       220       230       240
m622.pep   LFIGAGEMIELVATYFAAKSPRLMTVANRTLARAQELCDKLGVNAEPCLLSDLPAILHDY
           ||||||||||||||||||||||||||||||||||||||||||||||||||||||||||:|
a622       LFIGAGEMIELVATYFAAKSPRLMTVANRTLARAQELCDKLGVNAEPCLLSDLPAILHEY
                  190       200       210       220       230       240

                  250       260       270       280       290       300
m622.pep   DVVVSSTASQLPIVGKGMVERALKQRQSMPLFMLDLAVPRDIEAEVGDLNDAYLYTVDDM
           ||||||||||||||||||||||||||||||||||||||||||||||||||||||||||||
a622       DVVVSSTASQLPIVGKGMVERALKQRQSMPLFMLDLAVPRDIEAEVGDLNDAYLYTVDDM
                  250       260       270       280       290       300

                  310       320       330       340       350       360
m622.pep   VNIVQSGKEARQKAAAAAETLVSEKVAEFVRQQQGRQSVPLIKALRDEGEKARKQVLENA
           ||||||||||||||||||||||||||||||||||||||||||:|||||||||||||||||
a622       VNIVQSGKEARQKAAAAAETLVSEKVAEFVRQQQGRQSVPLIRALRDEGEKARKQVLENA
                  310       320       330       340       350       360

                  370       380       390       400       410
m622.pep   MKQLAKGATAEEVLERLSVQLTNKLLHSPTQTLNKAGEEDKDLVHAVAQIYHLDKX
           ||||||||||||||||||:||||||||||||||||||||||||||||||||||||
a622       MKQLAKGATAEEVLERLSIQLTNKLLHSPTQTLNKAGEEDKDLVHAVAQIYHLDKX
                  370       380       390       400       410
```

The following partial DNA sequence was identified in *N. gonorrhoeae* <SEQ ID 1997>:

```
g624.seq
   1 ATGATCCGTT ATCTTTTAAT TGCCTGCGGC GGCATCTCCC TGCTGTTGGG

  51 GATAATCGGC ATTTTTTTGC CGCTGTTGCC GACCACGCCG TTCGTACTAC

 101 TCTCCGCCGC CTGCTGGGCA AAGGCAtccc cgcgcTTTCa ccgCTGGCTG

 151 CACcgGCacc gCTATTTCGG CCCGATGGTT CATAACTGGG AACAAAACGG

 201 CGCAGTGCCG CGCAAAGCCA AGATTTTCGC CATCAGCATG AtaaccgcAt

 251 cctgcctcat gatctTTtgg CattTTCccc aacnctggtg ggtcGGGGCG
```

-continued

```
301 GTTTCATCGG TTTTTTGTTC CCTTGTcacC ATacggatgt gGcacAGacC

351 cgaatCTTGA
```

This corresponds to the amino acid sequence <SEQ ID 1998; *ORF* 624.ng>:

```
g624.pep
   1 MIRYLLIACG GISLLLGIIG IFLPLLPTTP FVLLSAACWA KASPRFHRWL

  51 HRHRYFGPMV HNWEQNGAVP RKAKIFAISM ITASCLMIFW HFPQXWWVGA

 101 VSSVFCSLVT IRMWHRPES*
```

The following partial DNA sequence was identified in *N. meningitidis* <SEQ ID 1999>:

```
m624.seq
   1 ATGATACGTT ATCTTTTAAT TGCCTGCGGC TGCATTTCCC TACTGTTGGG

  51 TATCATCGGC ATTTTTTTGC CGCTGTTGCC GACCACGCCG TTCGTACTGC

 101 TCTCCGCCGC CTGCTGGGCA AAGGCATCCC CGCGCTTTTA CCGCTGGCTG

 151 CACCGGCACC GCTATTTCGG CCCGATGGTT CATAACTGGG AACAAAACGG

 201 CGCAGTGCCG CGCAAAGCCA AAATATTCGC CATCAGTATG ATGACCGCAT

 251 CCTGCCTGAT AATGTTTTGG CAGTTTCCCC AACGCTGGTG GGTCGGGGCG

 301 GTTTCATCGG TTTTTTGTTC CCTTGTCGCC ATATGGATGT GGCGCAGGCC

 351 CGAATCTTGA
```

This corresponds to the amino acid sequence <SEQ ID 2000; ORF 624>:

```
m624.pep
       1 MIRYLLIACG CISLLLGIIG IFLPLLPTTP FVLLSAACWA KASPRFYRWL
      51 HRHRYFGPMV HNWEQNGAVP RKAKIFAISM MTASCLIMFW QFPQRWWVGA
     101 VSSVFCSLVA IWMWRRPES*
m624/g624  91.6% identity in 119 aa overlap

                    10        20        30        40        50        60
m624.pep   MIRYLLIACGCISLLLGIIGIFLPLLPTTPFVLLSAACWAKASPRFYRWLHRHRYFGPMV
           |||||||||| ||||||||||||||||||||||||||||||||||| :|||||||||||||
g624       MIRYLLIACGGISLLLGIIGIFLPLLPTTPFVLLSAACWAKASPRFHRWLHRHRYFGPMV
                    10        20        30        40        50        60
                    70        80        90       100       110       120
m624.pep   HNWEQNGAVPRKAKIFAISMMTASCLIMFWQFPQRWWVGAVSSVFCSLVAIWMWRRPESX
           ||||||||||||||||||||:|||||::||:||| ||||||||||||||:| ||:|||||
g624       HNWEQNGAVPRKAKIFAISMITASCLMIFWHFPQXWWVGAVSSVFCSLVTIRMWHRPESX
                    70        80        90       100       110       120
```

The following partial DNA sequence was identified in *N. meningitidis* <SEQ ID 2001>:

```
a624.seq
   1 ATGATACGTT ATCTTTTAAT TGCCTGCGGC TGCATTTCCC TGCTGTTGGG

  51 TATCATCGGC ATTTTTTTGC CGCTGTTGCC GACCACGCCG TTCGTACTGC

 101 TCTCCGCCGC CTGCTGGGCA AAGGCATCCC CGCGCTTTCA CCGCTGGCTG

 151 CACCGGCACC GCTATTTCGG TCCGATGGTT CATAACTGGG AACAAAACGG
```

-continued

```
201 CGCAGTGCCG CGCAAAGCCA AAATATTCGC CATCAGTATG ATGACCGCAT

251 CCTGCCTGAT AATGTTTTGG CAGTTTCCCC AACGCTGGTG GGTCGGGGCG

301 GTTTCATCGG TTTTTTGTTC CCTTGTCGCC ATATGGATGT GGCGCAGGCC

351 CGAATCTTGA
```

This corresponds to the amino acid sequence <SEQ ID 2002; *ORF* 624.a>:

```
a624.pep
       1 MIRYLLIACG CISLLLGIIG IFLPLLPTTP FVLLSAACWA KASPRFHRWL
      51 HRHRYFGPMV HNWEQNGAVP RKAKIFAISM MTASCLIMFW QFPQRWWVGA
     101 VSSVFCSLVA IWMWRRPES*
m624/a624  99.2% identity in 119 aa overlap

                   10        20        30        40        50        60
m624.pep   MIRYLLIACGCISLLLGIIGIFLPLLPTTPFVLLSAACWAKASPRFYRWLHRHRYFGPMV
           ||||||||||||||||||||||||||||||||||||||||||||||:|||||||||||||
a624       MIRYLLIACGCISLLLGIIGIFLPLLPTTPFVLLSAACWAKASPRFHRWLHRHRYFGPMV
                   10        20        30        40        50        60
                   70        80        90       100       110       120
m624.pep   HNWEQNGAVPRKAKIFAISMMTASCLIMFWQFPQRWWVGAVSSVFCSLVAIWMWRRPESX
           ||||||||||||||||||||||||||||||||||||||||||||||||||||||||||||
a624       HNWEQNGAVPRKAKIFAISMMTASCLIMFWQFPQRWWVGAVSSVFCSLVAIWMWRRPESX
                   70        80        90       100       110       120
```

The following partial DNA sequence was identified in *N. meningitidis* <SEQ ID 2003>:

```
a625.seq
  1 ATGTTTGCAA CCAGGAAAAT GAAGAAGATG ACGATGTGCA CGCGGCGGGT

 51 ACGGTTTTGG TTGGCTTTCA GCAGCGGACG AATCATCAGC ATTGCTGCGC

101 CGGTCGTTCC CATGATAGAG GCAAGTGCCG TACCGACGGC AAGCAGGGCG

151 GTGTTGAGCT TGGGTGTGCC GTTCAAGTCG CCCCAAACCA AAATGCCGCC

201 TGAAATGGTG TACAGGGCAA GCAGCAGCAG GATGAAAGGG ATGTATTCTT

251 CAACGAGTGC GTGTGCGACG GTATGGATAC CGGCGGACGC GCCAAAAACC

301 AAACTGAACG GGATGAGGAA GAGCAATGTC CAAAAGGCGG TAATTTTGCC

351 GTAA
```

The following partial DNA sequence was identified in *N. gonorrhoeae* <SEQ ID 2004>:

```
g625.seq
  1 atGTTTGCAA CCAGGAAAAT GAAGAAGATG ACGATGTGCA CGCGGCGGGT

 51 ACGGtcTTGG TTGGCTTTCA GCAGCGGACG AATCATCAGC AttgCCGCGC

101 CGGtcgttcC CATGATAGAG GCAAGTGCCG TACCGACGGC AAGCAGGGCG

151 GTGTTGAGCT TGGGTGTGCC GTTCAAGTCG CCCCAAACCA AAATGCCGCC

201 TGAAATGGTG TACAGGGCAA GCAGCAGCAG GATGAAGGGG ATATATTCTT

251 CAACGAGTGC GTGTGCGACG GTATGGATAC CGGCGGACGC GCCAAAAACC

301 AAACTGAACG GGATGAGGAA GAGCAATGTC CAAAAGGCGG TGATTTTGCc

351 gtAA
```

This corresponds to the amino acid sequence <SEQ ID 2005; *ORF* 625.ng>:

```
g625.pep
   1 MFATRKMKKM TMCTRRVRSW LAFSSGRIIS IAAPVVPMIE ASAVPTASRA

  51 VLSLGVPFKS PQTKMPPEMV YRASSSRMKG IYSSTSACAT VWIPADAPKT

 101 KLNGMRKSNV QKAVILP*
```

The following partial DNA sequence was identified in *N. meningitidis* <SEQ ID 2006>:

```
m625.seq
   1 ATGTTTGCAA CCAGGAAAAT GAAGAAGATG ACGATGTGCA CGCGGCGGGT

  51 ACGGTTTTGG TTGGCTTTCA GCAGCGGACG AATCATCAGC ATTGCTGCGC

 101 CGGTCGTTCC CATGATAGAG GCAAGTGCCG TACCGACGGC AAGCAGGGCG

 151 GTGTTGAGCT TGGGTGTGCC GTTCAAGTCG CCCCAAACCA AAATGCCGCC

 201 TGAAATGGTG TACAGGGCAA GCAGCAGCAG GATGAAAGGG ATGTATTCTT

 251 CAACGAGTGC GTGTGCGACG GTATGGATAC CGGCGGACGC GCCAAAAACC

 301 AAACTGAACG GGATGAGGAA GAGCAATGTC CAAAAGGCGG TAATTTTGCC

 351 GTAA
```

This corresponds to the amino acid sequence <SEQ ID 2007; ORF 625>:

```
m625.pep
      1 MFATRKMKKM TMCTRRVRFW LAFSSGRIIS IAAPVVPMIE ASAVPTASRA
     51 VLSLGVPFKS PQTKMPPEMV YRASSSRMKG MYSSTSACAT VWIPADAPKT
    101 KLNGMRKSNV QKAVILP*
m625/g625  98.3% identity in 117 aa overlap

                   10        20        30        40        50        60
m625.pep   MFATRKMKKMTMCTRRVRFWLAFSSGRIISIAAPVVPMIEASAVPTASRAVLSLGVPFKS
           ||||||||||||||||||| ||||||||||||||||||||||||||||||||||||||||
g625       MFATRKMKKMTMCTRRVRSWLAFSSGRIISIAAPVVPMIEASAVPTASRAVLSLGVPFKS
                   10        20        30        40        50        60
                   70        80        90       100       110
m625.pep   PQTKMPPEMVYRASSSRMKGMYSSTSACATVWIPADAPKTKLNGMRKSNVQKAVILPX
           ||||||||||||||||||||:|||||||||||||||||||||||||||||||||||||
g625       PQTKMPPEMVYRASSSRMKGIYSSTSACATVWIPADAPKTKLNGMRKSNVQKAVILPX
                   70        80        90       100       110
```

This corresponds to the amino acid sequence <SEQ ID 2008; ORF 625.a>:

```
a625.pep
      1 MFATRKMKKM TMCTRRVRFW LAFSSGRIIS IAAPVVPMIE ASAVPTASRA
     51 VLSLGVPFKS PQTKMPPEMV YRASSSRMKG MYSSTSACAT VWIPADAPKT
    101 KLNGMRKSNV QKAVILP*
m625/a625  100.0% identity in 117 aa overlap

                   10        20        30        40        50        60
m625.pep   MFATRKMKKMTMCTRRVRFWLAFSSGRIISIAAPVVPMIEASAVPTASRAVLSLGVPFKS
           ||||||||||||||||||||||||||||||||||||||||||||||||||||||||||||
a625       MFATRKMKKMTMCTRRVRFWLAFSSGRIISIAAPVVPMIEASAVPTASRAVLSLGVPFKS
                   10        20        30        40        50        60
```

-continued

```
                     70        80        90       100       110
m625.pep  PQTKMPPEMVYRASSSRMKGMYSSTSACATVWIPADAPKTKLNGMRKSNVQKAVILPX
          ||||||||||||||||||||||||||||||||||||||||||||||||||||||||||
a625      PQTKMPPEMVYRASSSRMKGMYSSTSACATVWIPADAPKTKLNGMRKSNVQKAVILPX
                     70        80        90       100       110
```

The following partial DNA sequence was identified in *N. gonorrhoeae* <SEQ ID 2009>:

```
g627.seq
   1 ATGTCCGGCC TTTGGAAACC CGAACACCCG GGATTTGAAA TCCTCGGCAG
  51 CCGTTACGCC CTGCAAAACC TTGTCCGCGA TGTCATCCTG ATTACATTGA
 101 CCGCCGTATC TATGGCAATC ACGCCCAAAC AAGTCCGCGC AGGCAACGAA
 151 TTCAACTTTG AACCCATCGC CGAAGTGGGC AAACTCTTCC TCGGCATCTT
 201 CATCACCATC TTCCCCGTCC TGAGCATTCT GAAAGCAGGC GAGGCAGGCG
 251 CGCTGGGCGG GGTGGTATCG CTGGTTCACG ATACGGCAGG TCATCCGATT
 301 AATACGATGT ATTTCTGGAT GAGCGGCATA TTGTCGGCAT TCTTGGATAA
 351 CGCGCCCACT TATCTCGTGT TTTTCAATAT GGCGGGCGGC GATGCCCAAG
 401 CCTTAATGAC GGGTCCCCTG TTTCATTcgc TGCTGGCGGT TTCTAtgggT
 451 tCGGTATTCA TGGGCGCACT GaccTACATc gGCAAcgcac cgaactTCAT
 501 GGTcaaggcc aTTGCCGaaC agcgcgGCgt accgaTGCcg actTTCTTcc
 551 ggtaTAtgat gtggtcggtc gcCTTCCTGa caCCCGTCTT CAtcgTACAT
 601 ACCCTcgtCT TTTTcgTTtt cAAACTACTg taa
```

This corresponds to the amino acid sequence <SEQ ID 2010; *ORF* 627.ng>:

```
g627.pep
   1 MSGLWKPEHP GFEILGSRYA LQNLVRDVIL ITLTAVSMAI TPKQVRAGNE
  51 FNFEPIAEVG KLFLGIFITI FPVLSILKAG EAGALGGVVS LVHDTAGHPI
 101 NTMYFWMSGI LSAFLDNAPT YLVFFNMAGG DAQALMTGPL FHSLLAVSMG
 151 SVFMGALTYI GNAPNFMVKA IAEQRGVPMP TFFRYMMWSV AFLTPVFIVH
 201 TLVFFVFKLL *
```

The following partial DNA sequence was identified in *N. meningitidis* <SEQ ID 2011>:

```
m627.seq
   1 ATGTCCGGCC TTTGGAAACC CGAACACCCG GGATTTGAAA TCCTCGGCAG
  51 CCGTTACGCC CTGCAAAACC TCGTCCGCGA TGTCATCCTG ATTGCATTGA
 101 CCGCCGTATC TATGGCAATC ACGCCCAAAC AAGTCCGCGC AGGCAACGAA
 151 TTCAACTTTG AACCCATCGC CGAAGTGGGC AAACTCTTCC TCGGCATCTT
 201 CATCACCATC TTTCCCGTCC TGAGCATTCT GAAAGCAGGC GAGGCAGGCG
 251 CGCTGGGCGG GGTGGTATCG CTGGTTCACG ATACGGCAGG TCATCCGATT
 301 AATGTGATGT ATTTTTGGAT GAGCGGCATA TTGTCGGCAT TCTTGGATAA
 351 CGCGCCCACT TATCTCGTTT TTTTCAATAT GGCGGGCGGC GATGCCCAAG
 401 CCTTGATGAC GGGTACCCTG TTTCATTCGC TGCTGGCGGT TTCTATGGGT
```

-continued

```
451 TCGGTATTCA TGGGCGCACT GACCTACATC GGCAACGCAC CGAACTTCAT

501 GGTCAAGGCC ATTGCCGAAC AGCGCGGCGT ACCGATGCCG ACTTTCTTCG

551 GCTATATGAT GTGGTCGGTC GCCTTCCTGA CACCCGTCTT CATCGTACAT

601 ACCCTTATCT TTTTCGTTTT CAAACTGCTG TAA
```

This corresponds to the amino acid sequence <SEQ ID 2012; *ORF* 627>:

```
m627.pep
  1 MSGLWKPEHP GFEILGSRYA LQNLVRDVIL IALTAVSMAI TPKQVRAGNE

 51 FNFEPIAEVG KLFLGIFITI FPVLSILKAG EAGALGGVVS LVHDTAGHPI

101 NVMYFWMSGI LSAFLDNAPT YLVFFNMAGG DAQALMTGTL FHSLLAVSMG

151 SVFMGALTYI GNAPNFMVKA IAEQRGVPMP TFFGYMMWSV AFLTPVFIVH

201 TLIFFVFKLL *
```

Computer analysis of this amino acid sequence gave the following results:

Homology with a Predicted ORF from *N. gonorrhoeae*

```
m627/g627  97.6% identity in 210 aa overlap

                    10        20        30        40        50        60
m627.pep   MSGLWKPEHPGFEILGSRYALQNLVRDVILIALTAVSMAITPKQVRAGNEFNEEPIAEVG
           |||||||||||||||||||||||||||||||:||||||||||||||||||||||||||||
g627       MSGLWKPEHPGFEILGSRYALQNLVRDVILITLTAVSMAITPKQVRAGNEFNFEPIAEVG
                    10        20        30        40        50        60

                    70        80        90       100       110       120
m627.pep   KLFLGIFITIFPVLSILKAGEAGALGGVVSLVHDTAGHPINVMYFWMSGILSAFLDNAPT
           ||||||||||||||||||||||||||||||||||||||||||:|||||||||||||||||
g627       KLFLGIFITIFPVLSILKAGEAGALGGVVSLVHDTAGHPINTMYFWMSGILSAFLDNAPT
                    70        80        90       100       110       120

                   130       140       150       160       170       180
m627.pep   YLVFFNMAGGDAQALMTGTLFHSLLAVSMGSVFMGALTYIGNAPNFMVKAIAEQRGVPMP
           |||||||||||||||||| |||||||||||||||||||||||||||||||||||||||||
g627       YLVFFNMAGGDAQALMTGPLFHSLLAVSMGSVFMGALTYIGNAPNFMVKAIAEQRGVPMP
                   130       140       150       160       170       180

                   190       200       210
m627.pep   TFFGYMMWSVAFLTPVFIVHTLIFFVFKLLX
           ||| ||||||||||||||||||:||||||||
g627       TFFRYMMWSVAFLTPVFIVHTLVFFVFKLLX
                   190       200       210
```

The following partial DNA sequence was identified in *N. meningitidis* <SEQ ID 2013>:

```
a627.seq
  1 ATGTCCGGCC TTTGGAAACC CGAACACCCG GGATTTGAAA TCCTCGGCAG

 51 CCGTTACGCC CTGCAAAACC TCGTCCGCGA TGTCATCCTG ATTGCATTGA

101 CCGCCGTATC TATGGCAATC ACGCCCAAAC AAGTCCGCGC AGGCAACGAA

151 TTCAACTTTG AACCCATCGC CGAAGTGGGC AAACTCTTCC TCGGCATCTT

201 CATCACCATC TTTCCCGTCC TGAGCATTCT GAAAGCAGGC GAGGCAGGCG

251 CGCTGGGCGG GGTGGTATCG CTGGTTCACG ATACGGCAGG TCATCCGATT

301 AATGTGATGT ATTTTTGGAT GAGCGGCATA TTGTCGGCAT TCTTGGATAA

351 CGCGCCCACT TATCTCGTTT TTTTCAATAT GGCGGGCGGC GATGCCCAAG

401 CCTTGATGAC GGGTTCCCTG TTTCATTCGC TGCTGGCGGT TTCTATGGGT

451 TCGGTATTCA TGGGCGCACT GACCTACATC GGCAACGCAC CGAACTTCAT
```

-continued

```
501 GGTCAAGGCC ATTGCCGAAC AGCGCGGCGT ACCGATGCCG ACTTTCTTCG

551 GCTATATGAT GTGGTCGGTC GCCTTCCTGA CACCCGTCTT CATCGTACAT

601 ACCCTTATCT TTTTCGTTTT CAAACTGCTG TAA
```

This corresponds to the amino acid sequence <SEQ ID 2014; *ORF* 627.a>:

```
a627.pep

      1 MSGLWKPEHP GFEILGSRYA LQNLVRDVIL IALTAVSMAI TPKQVRAGNE

     51 FNFEPIAEVG KLFLGIFITI RPVLSILKAG EAGALGGVVS LVHDTAGHPI

    101 NVMYFWMSGI LSAFLDNAPT YLVFFNMAGG DAQALMTGSL FHSLLAVSMG

    151 SVFMGALTYI GNAPNFMVKA IAEQRGVPMP TFFGYMMWSV AFLTPVFIVH

    201 TLIFFVFKLL *

m627/a627  99.5% identity in 210 aa overlap

                    10        20        30        40        50        60
m627.pep    MSGLWKPEHPGFEILGSRYALQNLVRDVILIALTAVSMAITPKQVRAGNEFNFEPIAEVG
            ||||||||||||||||||||||||||||||||||||||||||||||||||||||||||||
a627        MSGLWKPEHPGFEILGSRYALQNLVRDVILIALTAVSMAITPKQVRAGNEFNFEPIAEVG
                    10        20        30        40        50        60

                    70        80        90       100       110       120
m627.pep    KLFLGIFITIFPVLSILKAGEAGALGGVVSLVHDTAGHPINVMYFWMSGILSAFLDNAPT
            ||||||||||||||||||||||||||||||||||||||||||||||||||||||||||||
a627        KLFLGIFITIFPVLSILKAGEAGALGGVVSLVHDTAGHPINVMYFWMSGILSAFLDNAPT
                    70        80        90       100       110       120

                   130       140       150       160       170       180
m627.pep    YLVFFNMAGGDAQALMTGTLFHSLLAVSMGSVFMGALTYIGNAPNFMVKAIAEQRGVPMP
            ||||||||||||||||||:|||||||||||||||||||||||||||||||||||||||||
a627        YLVFFNMAGGDAQALMTGSLFHSLLAVSMGSVFMGALTYIGNAPNFMVKAIAEQRGVPMP
                   130       140       150       160       170       180

                   190       200       210
m627.pep    TFFGYMMWSVAFLTPVFIVHTLIFFVFKLLX
            |||||||||||||||||||||||||||||||
a627        TFFGYMMWSVAFLTPVFIVHTLIFFVFKLLX
                   190       200       210
```

The following partial DNA sequence was identified in *N. gonorrhoeae* <SEQ ID 2015>:

```
g628.seq
  1 ATGTGCGTGC CACTCAAGCC GGCAGGATGC GGGCCGCCAA ATTCATGTGT

 51 TTCGATATTG GCAGCATTTT CAGACGGCAC GTCTGCGCCT GCTGCTTTAC

101 ACACATGGAT TTTACGTTCG GTCAGGCGGC TCAATACCAA CAGGCCGCGT

151 TTGAAGTCTT CGGCGGCTTC TTTGATGATG ACCGTAGGGT CGGCAGCCAG

201 CGGATTGGTG TCCATCGCAT TGACGAAGAT GGCGAACGGC TCGGCATCTA

251 CGGCAGGGAT TTTGCTGAAC GGACGGGTGC GAAGCGCAGT CCATAAGCCT

301 GATTGAATCA GGTTGCGGCG CACTTTTTCG CTGCTCAATT TTGCCAGCGC

351 TTCAGGTacg TAG
```

This corresponds to the amino acid sequence <SEQ ID 2016; *ORF* 628.ng>:

```
g628.pep

1  MCVPLKPAGC GPPNSCVSIL AAFSDGTSAP AALHTWILRS VRRLNTNRPR
```

-continued

```
 51 LKSSAASLMM TVGSAASGLV SIALTKMANG SASTAGILLN GRVRSAVHKP

101 D*IRLRRTFS LLNFASASGT *
```

The following partial DNA sequence was identified in *N. meningitidis* <SEQ ID 2017>:

```
m628.seq
  1 ATGTGCGTGC CACTCAAACC GGCAGGATGC GGGCCGCCGA ATTCATGTGT

 51 TTCGATGTTG GCAGCATTTT CAGACGGCAC GTCTGCGCCA GCTGCCTTAC

101 AAACATGGAT TTTGCGTTCG GTCAAACGGC TCAATACCAA CAGGCCGCGT

151 TTGAAATCCT CGGCGGCTTC TTTGATAATG ACCGTAGGGT CGGCAGCCAG

201 CGGATTGGTG TCCATCGCAT TGACGAAGAT GGCGAACGGC TCGGCATCGA

251 CGGCAGGAAT TTTGCTGAAC GGACGGGTGC GCAGCGCAGT CCACAAACCG

301 GATTGGATCA GGTTGCGGCG CACTTCTTCG CCGCTTAAGT TTGCCAGCGC

351 TTCAGGTGCG TAG
```

This corresponds to the amino acid sequence <SEQ ID 2018; *ORF* 628>:

```
m628.pep
  1 MCVPLKPAGC GPPNSCVSML AAFSDGTSAP AALQTWILRS VKRLNTNRPR

 51 LKSSAASLIM TVGSAASGLV SIALTKMANG SASTAGILLN GRVRSAVHKP

101 DWIRLRRTSS PLKFASASGA *
```

Computer analysis of this amino acid sequence gave the following results:

Homology with a Predicted ORF from *N. gonorrhoeae*

```
m628/a628  93.3% identity in 119 aa overlap

                   10        20        30        40        50        60
m628.pep   MCVPLKPAGCGPPNSCVSMLAAFSDGTSAPAALQTWILRSVKRLNTNPRPLKSSAASLIM
           |||||||||||||||||:|||||||||||||||:|||||||:||||||||||||||||:|
g628       MCVPLKPAGCGPPNSCVSILAAFSDGTSAPAALHTWILRSVRRLNTNRPRLKSSAASLMM
                   10        20        30        40        50        60

                   70        80        90       100       110       120
m628.pep   TVGSAASGLVSIALTKMANGSASTAGILLNGRVRSAVHKPDWIRLRRTSSPLKFASASGA
           ||||||||||||||||||||||||||||||||||||||||| |||||| | |:||||||:
g628       TVGSAASGLVSIALTKMANGSASTAGILLNGRVRSAVHKPDXIRLRRTFSLLNFASASGT
                   70        80        90       100       110       120

m628.pep   X

g628       X
```

The following partial DNA sequence was identified in *N. meningitidis* <SEQ ID 2019>:

```
a628.seq
  1 ATGTGCGTGC CACTCAAACC GGCCGGATGC GGGCCGCCGA ATTCATGTGT

 51 TTCGATGTTG GCAGCATTTT CAGACGGCAC GTCTGCGCCA GCTGCCTTAC

101 ACACATGGAT TTTACGCTCG GTCAAACGGC TCAATACCAG CAAACCTCGT

151 CTGAAATCCT CGGCGGCTTC TTTGATCACA ACCACAGGGT CTGCCGCCAG

201 CGGATTGGTG TCCATCGCAT TGACGAAGAT GGCGAACGGC TCGGCATCGA

251 CGGCAGGGAT TTTGCTGAAC GGACGGGTAC GCAGCGCAGT CCACAAACCG
```

-continued

```
301 GATTGGATCA GATTGCGGCG CACTTCTTCG CCGCTTAAGT TTGCCAACGC

351 TTCGGGCGCG TAG
```

This corresponds to the amino acid sequence <SEQ ID 2020; ORF 628.a>:

```
a628.pep
      1 MCVPLKPAGC GPPNSCVSML AAFSDGTSAP AALHTWILRS VKRLNTSKPR
     51 LKSSAASLIT TTGSAASGLV SIALTKMANG SASTAGILLN GRVRSAVHKP
    101 DWIRLRRTSS PLKFANASGA *
m628/a628  95.0% identity in 120 aa overlap
                   10        20        30        40        50        60
m628.pep   MCVPLKPAGCGPPNSCVSMLAAFSDGTSAPAALQTWILRSVKRLNTNRRRLKSSAASLIM
           |||||||||||||||||||||||||||||||||:||||||||||||::||||||||||||
a628       MCVPLKPAGCGPPNSCVSMLAAFSDGTSAPAALHTWILRSVKRLNTSKRRLKSSAASLIM
                   10        20        30        40        50        60
                   70        80        90       100       110       120
m628.pep   TVGSAASGLVSIALTKMANGSASTAGILLNGRVRSAVHKPDWIRLRRTSSPLKFASASGA
           |:||||||||||||||||||||||||||||||||||||||||||||||||||||:||||
a628       TTGSAASGLVSIALTKMANGSASTAGILLNGRVRSAVHKPDWIRLRRTSSPLKFANASGA
                   70        80        90       100       110       120
m628.pep   X
           |
a628       X
```

The following partial DNA sequence was identified in *N. gonorrhoeae* <SEQ ID 2021>:

```
g629.seq
  1 ATGACTGCca aacCTTTTTC CCTCAACCTG GCcaaCCTCC TGCTGCCggc

 51 ggtatTGTTT GCCGTCAGcc tGtcggTCGG cattgccgaT TTCCGCTGGT

101 CGGATGTGTT TTCGCTGTCC GACAGCCAGC AAGTGATGTT CATCAGCCGC

151 CTGCCGCGCA CGTTTGcgaT TGTGTTGACG GGCgcgtcga tagcgGtggc

201 gGGGAtgatt atgcagATTC TGATGCGCAA CcgtTTTGTC GAGCCTtcta

251 tggcgGGTGC GGGCCAAAGt gcgGCTTTGG GTttgcttct gAtgtccctg

301 ctgctgcctg CcgcGccgct gccggtcaAA ATGTCGGtag Ccgccgttgc

351 CGCGCTGATC GGGATGTTGG tctTtatgct gctaatccgC Cgcctgccac

401 cgacggcgca gctgatgGTg ccgCTGGTGG Gg.ttATTTT CGGCGGCGTG

451 GttgaGGCGG TGGCGACGTT TGTCGCGTAT GAGTTTGAGA TGCTGCAAAT

501 GTTGGGCGTG TGGCAGCAGG GCGACTTTTC AAGCGTGCTG CTGGGGCGGT

551 ACGAGCTGCT TTGGATTACG GGCGGTTTGG CGGTGTTTGC CTACCTGATT

601 GCCGACCGGC TGACGATTTT GGGGCTGGGC GAGACGGTGA GCGTGAATTT

651 GGGTTTGAAC CGGACGGCGG TGTTGTGGTC GGGTTTGATT ATTGTGGCAC

701 TGATTACATC GCTGGTCATT GTAACGGTCG GCAATATTCC GTTTATCGGG

751 CTGGTCGTGC CGAATATCGT CAGCCGCCTG ATGGGCGACA GGCTGCGCCA

801 AAGCCTGCCT GCGGTCGCCC TCTTGGGCGC GTCTTTGGTT TTATTGTGCG

851 ACATTATCGG ACGCATGATT GTGTTTCCGT TTGAAATTCC GGTCTCCACG
```

-continued

```
901 GTTTTTGGTG TGTTGGGTAC GGCTTTGTTT TTGTGGCTTT TGTTGAGGAA

951 ACCCGCCTAT GCCGTCTGA
```

This corresponds to the amino acid sequence <SEQ ID 2022; *ORF* 629.ng>:

```
g629.pep
  1 MTAKPFSLNL ANLLLPAVLF AVSLSVGIAD FRWSDVFSLS DSQQVMFISR

 51 LPRTFAIVLT GASIAVAGMI MQILMRNRFV EPSMAGAGQS AALGLLLMSL

101 LLPAAPLPVK MSVAAVAALI GMLVFMLLIR RLPPTAQLMV PLVGXIFGGV

151 VEAVATFVAY EFEMLQMLGV WQQGDFSSVL LGRYELLWIT GGLAVFAYLI

201 ADRLTILGLG ETVSVNLGLN RTAVLWSGLI IVALITSLVI VTVGNIPFIG

251 LVVPNIVSRL MGDRLRQSLP AVALLGASLV LLCDIIGRMI VFPFEIPVST

301 VFGVLGTALF LWLLLRKPAY AV*
```

The following partial DNA sequence was identified in *N. meningitidis* <SEQ ID 2023>:

```
m629.seq
  1 ATGACTGCCA AACCTTTTTC CCTCAACCTG ACCAACCTGC TGCTGCTGGC

 51 GGTGTTGTTT GCCGTCAGCC TGTCGGTGGG CGTTGCCGAT TTCCGCTGGT

101 CTGATGTGTT TTCACTGTCC GACAGCCAGC AGGTCATGTT CATCAGCCGC

151 CTGCCGCGCA CGTTTGCGAT TGTGCTGACG GGCGCGTCGA TGGCGGTGGC

201 CGGCATGATT ATGCAGATTT TGATGCGCAA CCGTTTTGTC GAACCGTCGA

251 TGGTGGGCGC AAGCCAAAGC GCGGCTTTAG GTTTGCTGCT GATGACCCTG

301 CTGCTGCCGG CCGCGCCGCT GCCGGCGAAA ATGTCGGTTG CCGCCGTTGC

351 CGCGCTGATC GGGATGTTGG TCTTTATGCT GCTGATCCGC CGCCTGCCGC

401 CGACCGCGCA ACTGATGGTG CCTTTGGTCG GGATTATTTT CGGCGGTGTG

451 ATTGAGGCGG TAGCCACCTT TATCGCGTAT GAAAACGAAA TGCTGCAAAT

501 GCTCGGCGTG TGGCAGCAGG GCGATTTTTC GAGCGTGCTG CTGGGGCGGT

551 ACGAGCTGCT TTGGATTACG GGCGGTTTGG CGGTGTTTGC CTATCTGATT

601 GCCGACCGGC TGACGATTTT GGGGCTGGGC GAAACGGTAA GCGTGAATTT

651 GGGTTTGAAC CGGACGGCGG TGTTGTGGTC GGGTTTGATT ATTGTGGCTT

701 TGATTACGTC GCTGGTTATC GTTACGGTCG GCAATATTCC GTTTATCGGG

751 CTGGTCGTGC CGAACATCAT CAGCCGCCTG ATGGGCGACA GGTTGCGCCA

801 AAGCCTGCCT GCGGTGGCCT TGCTGGGCGC ATCTTTGGTG TTGCTGTGCG

851 ACATTATCGG ACGCGTGATT GTGTTTCCGT TTGAAATTCC GGTCTCTACG

901 GTTTTTGGTG TATTGGGTAC GGCTTTGTTT TTGTGGCTTT TGTTGAGGAA

951 ACCCGCCTAT GCCGTCTGA
```

This corresponds to the amino acid sequence <SEQ ID 2024; *ORF* 629>:

```
m629.pep
  1 MTAKPFSLNL TNLLLLAVLF AVSLSVGVAD FRWSDVFSLS DSQQVMFISR

 51 LPRTFAIVLT GASMAVAGMI MQILMRNRFV EPSMVGASQS AALGLLLMTL
```

-continued

```
101 LLPAAPLPAK MSVAAVAALI GMLVFMLLIR RLPPTAQLMV PLVGIIFGGV

151 IEAVATFIAY ENEMLQMLGV WQQGDFSSVL LGRYELLWIT GGLAVFAYLI

201 ADRLTILGLG ETVSVNLGLN RTAVLWSGLI IVALITSLVI VTVGNIPFIG

251 LVVPNIISRL MGDRLRQSLP AVALLGASLV LLCDIIGRVI VFPFEIPVST

301 VFGVLGTALF LWLLLRKPAY AV*
```

Computer analysis of this amino acid sequence gave the following results:

Homology with a Predicted ORF from *N. gonorrhoeae*

```
m629/g629  95.7% identity in 322 aa overlap

                    10        20        30        40        50        60
m629.pep    MTAKPFSLNLTNLLLLAVLFAVSLSVGVADFRWSDVFSLSDSQQVMFISRLPRTFAIVLT
            ||||||||||:|||| |||||||||||:||||||||||||||||||||||||||||||||
g629        MTAKPFSLNLANLLLPAVLFAVSLSVGIADFRWSDVFSLSDSQQVMFISRLPRTFAIVLT
                    10        20        30        40        50        60

                    70        80        90       100       110       120
m629.pep    GASMAVAGMIMQILMRNRFVEPSMVGASQSAALGLLLMTLLLPAAPLPAKMSVAAVAALI
            |||:||||||||||||||||||||:||:||||||||||:|||||||||:|||||||||||
g629        GASIAVAGMIMQILMRNRFVEPSMAGAGQSAALGLLLMSLLLPAAPLPVKMSVAAVAALI
                    70        80        90       100       110       120

                   130       140       150       160       170       180
m629.pep    GMLVFMLLIRRLPPTAQLMVPLVGIIFGGVIEAVATFIAYENEMLQMLGVWQQGDFSSVL
            |||||||||||||||||||||||| |||||:||||||:||| ||||||||||||||||||
g629        GMLVFMLLIRRLPPTAQLMVPLVGXIFGGVVEAVATFVAYEFEMLQMLGVWQQGDFSSVL
                   130       140       150       160       170       180

                   190       200       210       220       230       240
m629.pep    LGRYELLWITGGLAVFAYLIADRLTILGLGETVSVNLGLNRTAVLWSGLIIVALITSLVI
            ||||||||||||||||||||||||||||||||||||||||||||||||||||||||||||
g629        LGRYELLWITGGLAVFAYLIADRLTILGLGETVSVNLGLNRTAVLWSGLIIVALITSLVI
                   190       200       210       220       230       240

                   250       260       270       280       290       300
m629.pep    VTVGNIPFIGLVVPNIISRLMGDRLRWSLPAVALLGASLVLLCDIIGRVIVFPFEIPVST
            ||||||||||||||||:|||||||||||||||||||||||||||||||:|||||||||||
g629        VTVGNIPFIGLVVPNIVSRLMGDRLRWSLPAVALLGASLVLLCDIIGRMIVFPFEIPVST
                   250       260       270       280       290       300

                   310       320
m629.pep    VFGVLGTALFLWLLLRKPAYAVX
            |||||||||||||||||||||||
g629        VFGVLGTALFLWLLLRKPAYAVX
                   310       320
```

The following partial DNA sequence was identified in *N. meningitidis* <SEQ ID 2025>:

```
a629.seq
  1 ATGACTGCCA AACCTTTTTC CCTCAACCTG ACTAACCTCC TGCTGCTGGC

 51 GGTGTTGTTT GCCGTCAGCC TGTCGGTGGG CGTTGCCGAT TTCCGCTGGT

101 CGGATGTGTT TTCGCTGTCG GACAGCCAGC AGGTTATGTT CATCAGCCGC

151 CTGCCGCGCA CGTTTGCGAT TGTGTTGACG GGCGCGTCGA TGGCGGTGGC

201 GGGGATGATT ATGCAGATTC TGATGCGTAA CCGTTTTGTC GAGCCTTCTA

251 TGGCGGGCGC GGGTCAGAGT GCGGCTTTGG GTTTGCTTCT GATGTCCCTG

301 CTGCTGCCTG CCGCGCCGCT GCCGGTCAAA ATGTCGGTTG CCGCCGTTGC

351 CGCGTTAATC GGGATGTTGG TGTTTATGAT GCTTATCCGC CGCCTGCCGC

401 CGACGGCGCA ACTGATGGTG CCTTTGGTCG GGATTATTTT CGGCGGCGTG

451 GTTGAGGCGG TGGCCACCTT TATTGCGTAT GAAAACGAAA TGCTGCAAAT

501 GCTGGGCGTG TGGCAACAGG GCGATTTTTC CGGCGTGTTG CTCGGACGGT

551 ATGAACTGTT GTGGGCAACG GGGATTTTGG CTTTGTTTGC CTATTTGATT
```

-continued

```
601 GCCGACCAGC TGACGATTTT GGGTTTGGGC GAAACGGTAA GCGTGAACTT

651 GGGGCTGAAC CGGACGGCGA TTCTGTGGTC GGGGCTGATT ATTGTGGCTT

701 TGATTACGTC GCTGGTTATC GTTACGGTCG GCAATATTCC GTTTATCGGG

751 CTGGTCGTGC CGAACATCAT CAGCCGCCTG ATAGGCGACA GGCTGCGCCA

801 AAGCCTGCCT GCGGTGGCTT TGCTGGGTGC GTCTTTGGTT TTATTGTGCG

851 ACATTATCGG ACGAGTGATT GTGTTTCCGT TTGAAATTCC GGTATCGACC

901 GTCTTCGGCG TATTGGGTAC GGCGTTGTTT TTATGGCTTT TGTTAAGGAA

951 ACCTGCTCAT GCCGTCTGA
```

This corresponds to the amino acid sequence <SEQ ID 2026; *ORF* 629.a>:

```
a629.pep
      1 MTAKPFSLNL TNLLLLAVLF AVSLSVGVAD FRWSDVFSLS DSQQVMFISR

     51 LPRTFAIVLT GASMAVAGMI MQILMRNRFV EPSMAGAGQS AALGLLLMSL

    101 LLPAAPLPVK MSVAAVAALI GMLVFMMLIR RLPPTAQLMV PLVGIIFGGV

    151 VEAVATFIAY ENEMLQMLGV WQQGDFSGVL LGRYELLWAT GILALFAYLI

    201 ADQLTILGLG ETVSVNLGLN RTAILWSGLI IVALITSLVI VTVGNIPFIG

    251 LVVPNIISRL IGDRLRQSLP AVALLGASLV LLCDIIGRVI VFPFEIPVST

    301 VFGVLGTALF LWLLLRKPAH AV*

m629/a629  95.7% identity in 322 aa overlap

                   10        20        30        40        50        60
m629.pep   MTAKPFSLNLTNLLLLAVLFAVSLSVGVADFRWSDVFSLSDSQQVMFISRLPRTFAIVLT
           ||||||||||||||||||||||||||||||||||||||||||||||||||||||||||||
a629       MTAKPFSLNLTNLLLLAVLFAVSLSVGVADFRWSDVFSLSDSQQVMFISRLPRTFAIVLT
                   10        20        30        40        50        60

                   70        80        90       100       110       120
m629.pep   GASMAVAGMIMQILMRNRFVEPSMVGASQSAALGLLLMTLLLPAAPLPAKMSVAAVAALI
           ||||||||||||||||||||||||:||:||||||||||:||||||||||:||||||||||
a629       GASMAVAGMIMQILMRNRFVEPSMAGAGQSAALGLLLMSLLLPAAPLPVKMSVAAVAALI
                   70        80        90       100       110       120

                  130       140       150       160       170       180
m629.pep   GMLVFMLLIRRLPPTAQLMVPLVGIIFGGVIEAVATFIAYENEMLQMLGVWQQGDFSSVL
           ||||||:|||||||||||||||||||||||:||||||||||||||||||||||||||:||
a629       GMLVFMMLIRRLPPTAQLMVPLVGIIFGGVVEAVATFIAYENEMLQMLGVWQQGDFSGVL
                  130       140       150       160       170       180

                  190       200       210       220       230       240
m629.pep   LGRYELLWITGGLAVFAYLIADRLTILGLGETVSVNLGLNRTAVLWSGLIIVALITSLVI
           |||||||| || ||:|||||||:||||||||||||||||||||:||||||||||||||||
a629       LGRYELLWATGILALFAYLIADQLTILGLFETVSVNLGLNRTAILWSGLIIVALITSLVI
                  190       200       210       220       230       240

                  250       260       270       280       290       300
m629.pep   VTVGNIPFIGLVVPNIISRLMGDRLRQSLPAVALLGASLVLLCDITGRVIVFPFEIPVST
           ||||||||||||||||||||:|||||||||||||||||||||||||||||||||||||||
a629       VTVGNIPFIGLVVPNIISRLIGDRLRQSLPAVALLGASLVLLCDIIGRVIVFPFEIPVST
                  250       260       270       280       290       300

                  310       320
m629.pep   VFGVLGTALFLWLLLRKPAYAVX
           |||||||||||||||||||:|||
a629       VFGVLGTALFLWLLLRKPAHAVX
                  310       320
```

The following partial DNA sequence was identified in *N. gonorrhoeae* <SEQ ID 2027>:

```
g630.seq (partial)
  1 aTgatGATTT TGGTGTGGCT ggctttgttt ccccccatgt tttacggcat

 51 gtacaacgtc GGCGCACAGG CATTCGGTGC CTTAACGCCC GAtttgctgc
```

-continued

```
101 aacaaagcat cgcccacgac ggcaattacg ccctcgccaa cgctttgggc

151 atcaatatgt cccccgaaGc gggcgtgtTg ggcaaaatgc tgttcgGCGC

201 GATttacttc ctgccgattt acgcgaccgt aTTTATTGTG GGcggcttct

251 ggGaagtCTT GTTCGCATCc gtACGCAAAC ACGAAATCAA CGAAGGTTTC

301 TTCGTTACTT CGATTCTGTT TGCCTTAATC GTTCCGCCCA CGCTGCCGCT

351 GTGGCAGGCG GCTTTGGGTA TTTCTTTCGG CGTTGTGGTT GCGAAAGAAG

401 TATTCGGCGG TACAGGTAAA AACTTCATGA ACCCTGCGCT GGCAGGCCGC

451 GCCTTCCTGT TCTTCGCCTA CCCCGCCAAC TTGAGCGGCG ATGCGGTTTG

501 GACGGCGGTT GACGGCTATT CCGGCGCAAC CGCGCTGGCG CAATGGGCGG

551 CACACGGTGC AGACGGCCTG AAAAACGCCG TAACCGGTCA AACCATCACT

601 TGGATGGACG CGTTTATCGG CAAACTGCCC GGCTCCATCG GCGAAGTCTC

651 CACTTTGGCA CTCTTAATCG GCGGCGCGTT TATCGTGTTT GCCCGCATCG

701 CTtcttgGCG CATTATTGCc ggCGTGATGA TCGGTatGat tGcgatgTCT

751 tcgctgatta acttcatCGg ttctgacacc aaagctatgt ttgctatgca

801 cttggtacat ggcacttggt GGAaagatGa ttAtcactca ctgtacatta

851 aa.....
```

This corresponds to the amino acid sequence <SEQ ID 2028; ORF 630.ng>:

```
g630.pep
  1 MMILVWLALF PPMFYGMYNV GAQAFGALTP DLLQQSIAHD GNYALANALG

 51 INMSPEAGVL GKMLFGAIYF LPIYATVFIV GGFWEVLFAS VRKHEINEGF

101 FVTSILFALI VPPTLPLWQA ALGISFGVVV AKEVFGGTGK NFMNPALAGR

151 AFLFFAYPAN LSGDAVWTAV DGYSGATALA QWAAHGADGL KNAVTGQTIT

201 WMDAFIGKLP GSIGEVSTLA LLIGGAFIVF ARIASWRIIA GVMIGMIAMS

251 SLINFIGSDT KAMFAMHLVH GTWWKDDYHS LYIK....
```

The following partial DNA sequence was identified in *N. meningitidis* <SEQ ID 2029>:

```
m630.seq
   1  ATGATGATTT TGGTGTGGCT GGCTTTGTTC CCTGCCATGT TCTACGGTAT

  51  GTACAACGTC GGCGCGCAGG CATTCGGTGC GTTAACGCCT GATTTGCTGC

 101  AACAAAACAT CGCCAACGAC TGGCATTACG CCTTTGCCAA CGCTTTGGGC

 151  ATCAATATGT CGTCTGAAGC GGGCGTGTCG GACAAAATGC TGTTTGGCGC

 201  GATTTACTTC CTGCCGATTT ACGCGACTGT ATTTGTTGTG GGCGGTTTCT

 251  GGGAAGTTTT GTTCGCCACC GTGCGCAAAC ACGAAATCAA CGAAGGTTTC

 301  TTCGTTACTT CGATTCTGTT TGCCTTAATC GTTCCGCCCA CGCTGCCGCT

 351  GTGGCAGGCG GCTTTGGGTA TTTCTTTCGG CGTTGTGGTT GCGAAAGAAG

 401  TATTCGGCGG TACAGGTAAA AACTTCATGA ACCCTGCGCT GGCAGGCCGT

 451  GCTTTCCTGT TCTTCGCCTA CCCTGCCAAC TTGAGCGGCG ATGCGGTTTG

 501  GACGGCGGTT GACGGCTATT CCGGCGCAAC CGCACTGGCG CAATGGGCGG

 551  CACACGGTGC AGACGGCCTG AAAAACGCCG TAACCGGTCA AACCATCACT
```

-continued

```
 601 TGGATGGACG CGTTTATCGG CAAACTGCCC GGCTCCATTG GCGAAGTCTC
 651 CACTTTGGCA CTCTTAATCG GCGGCGCGTT TATCGTGTTT GCCCGCATCG
 701 CTTCTTGGCG CATTATTGCC GGCGTGATGA TCGGTATGAT TGCGATGTCT
 751 TCGCTGTTCA ACTTCATCGG TTCGGACACC AACGCTATGT TTGCTATGCC
 801 TTGGTACTGG CACTTGGTGG TCGGCGGCTT CGCCATCGGT ATGCTGTTTA
 851 TGGCGACCGA CCCTGTTTCC GCTTCCTTTA CCAATGTCGG CAAATGGTGG
 901 TACGGCGCAC TGATCGGTGT GATGTGCGTA TTAATCCGCG TGGTCAATCC
 951 GGCTTACCCC GAAGGCATGA TGTTGGCGAT TCTGTTTGCC AACCTGTTTG
1001 CCCCGATTTT CGACTATTTC GTCGCACAAG CGAACATCAA ACGCAGAAAG
1051 GCGCGCAGCA ATGGCTAA
```

This corresponds to the amino acid sequence <SEQ ID 2030; *ORF* 630>:

```
m630.pep
      1 MMILVWLALF PAMFYGMYNV GAQAFGALTP DLLQQNIAND WHYAFANALG
     51 INMSSEAGVS DKMLFGAIYF LPIYATVFVV GGFWEVLFAT VRKHEINEGF
    101 FVTSILFALI VPPTLPLWQA ALGISFGVVV AKEVFGGTGK NFMNPALAGR
    151 AFLFFAYPAN LSGDAVWTAV DGYSGATALA QWAAHGADGL KNAVTGQTIT
    201 WMDAFIGKLP GSIGEVSTLA LLIGGAFIVF ARIASWRIIA GVMIGMIAMS
    251 SLFNFIGSDT NAMFAMPWYW HLVVGGFAIG MLFMATDPVS ASFTNVGKWW
    301 YGALIGVMCV LIRVVNPAYP EGMMLAILFA NLFAPIFDYF VAQANIKRRK
    351 ARSNG*

m630/g630 93.5% identity in 275 aa overlap

                   10        20        30        40        50        60
m630.pep   MMILVWLALFPAMFYGMYNVGAQAFGALTPDLLQQNIANDWHYAFANALGINMSSEAGVS
           |||||||||| ||||||||||||||||||||||:||:|  :||:|||||||| |||||
g630       MMILVWLALFPPMFYGMYNVGAQAFGALTPDLLQQSIAHDGNYALANALGINMSPEAGVS
                   10        20        30        40        50        60

                   70        80        90       100       110       120
m630.pep   DKMLFGAIYFLPIYATVFVVGGFWEVLFATVRKHEINEGFFVTSILFALIVPPTLPLWQA
            ||||||||||||||||:||||||||||:|||||||||||||||||||||||||||||
g630       GKMLFGAIYFLPIYATVFIVGGFWEVLFASVRKHEINEGFFVTSILFALIVPPTLPLWQA
                   70        80        90       100       110       120

                  130       140       150       160       170       180
m630.pep   ALGISFGVVVAKEVFGGTGKNFMNPALAGRAFLFFAYPANLSGDAVWTAVDGYSGATALA
           ||||||||||||||||||||||||||||||||||||||||||||||||||||||||||||
g630       ALGISFGVVVAKEVFGGTGKNFMNPALAGRAFLFFAYPANLSGDAVWTAVDGYSGATALA
                  130       140       150       160       170       180

                  190       200       210       220       230       240
m630.pep   QWAAHGADGLKNAVTGQTITWMDAFIGKLPGSIGEVSTLALLIGGAFIVFARIASWRIIA
           ||||||||||||||||||||||||||||||||||||||||||||||||||||||||||||
g630       QWAAHGADGLKNAVTGQTITWMDAFIGKLPGSIGEVSTLALLIGGAFIVFARIASWRIIA
                  190       200       210       220       230       240

                  250       260       270       280       290       300
m630.pep   GVMIGMIAMSSLFNFIGSDTNAMFAMPWYWHLVVGGFAIGMLFMATDPVSASFTNVGKWW
           |||||||||||:|||||||:|||||    ||| |
g630       GVMIGMIAMSSLINFIGSDTKAMFAM----HLVHGTWWKDDYHSLYIK•
                  250       260       270       280

                  310       320       330       340       350
m630.pep   YGALIGVMCVLIRVVNPAYPEGMMLAILFANLFAPIFDYFVAQANIKRRKARSNGX
```

The following partial DNA sequence was identified in *N. meningitidis* <SEQ ID 2031>:

```
a630.seq
     1 ATGATGATTT TGGTGTGGCT GGCTTTGTTC CCTGCCATGT TCTACGGTAT

51 GTACAACGTC GGCGCACAGG CATTCGGTGC GTTAACGCCC GATTTGCTGC

101 AACAAAGCAT CGCCAACGAC TGGCATTACG CCCTTGCCAA CGCTTTGGGC

151 ATCAATATGT CGTCTGAAGC GGGCGTGTTG GGCAAAATGC TGTTCGGCGC

201 GATTTACTTC CTGCCGATTT ACGCGACCGT ATTTATTGTC GGCGGTTTCT

251 GGGAAGTTTT GTTCGCCACC GTGCGCAAAC ATGAAATCAA CGAAGGTTTC

301 TTTGTTACCT CGATTCTGTT TGCCTTAATC GTTCCGCCCA CGCTGCCGCT

351 GTGGCAGGCA GCTTTGGGTA TTTCTTTCGG CGTTGTGGTT GCGAAAGAAG

401 TATTCGGCGG TACAGGTAAA AACTTCATGA ACCCTGCGCT GGCAGGCCGT

451 GCCTTCCTGT TCTTCGCCTA CCCTGCCAAC TTGAGCGGCG ATGCGGTTTG

501 GACGGCGGTT GACGGCTATT CCGGCGCAAC CGCGCTGGCG CAATGGGCGG

551 CACACGGTGC AGACGGCCTG AAAAACGCCA TAACCGGTCA AACCATCACT

601 TGGATGGATG CGTTTATCGG CAAACTGCCC GGCTCCATCG GCGAAGTCTC

651 CACTTTGGCA CTCTTAATCG GCGGCGCGTT TATCGTGTTT GCCCGCATCG

701 CTTCTTGGCG CATTATTGCC GGCGTGATGA TCGGTATGAT TGCCATGTCT

751 TCGCTGTTCA ACTTCATCGG TTCGGACACC AACGCTATGT TTGCTATGCC

801 TTGGTACTGG CATTTGGTCG TCGGCGGCTT CGCCATCGGT ATGCTGTTTA

851 TGGCGACCGA CCCCGTTTCC GCTTCCTTTA CCAATGTCGG CAAATGGTGG

901 TACGGCGCAC TGATCGGTGT GATGTGCGTA TTAATCCGCG TGGTCAATCC

951 GGCTTACCCC GAAGGCATGA TGTTGGCGAT TCTGTTTGCC AACCTGTTTG

1001 CCCCGATTTT CGACTATTTC GTCGCACAAG CGAACATCAA ACGCAGAAAG

1051 GCGCGCAGCA ATGGCTAA
```

This corresponds to the amino acid sequence <SEQ ID 2032; ORF 630.a>:

```
a630.pep

1 MMILVWLALF PAMFYGMYNV GAQAFGALTP DLLQQSIAND WHYALANALG

51 INMSSEAGVL GKMLFGAIYF LPIYATVFIV GGFWEVLFAT VRKHEINEGF

101 FVTSILFALI VPPTLPLWQA ALGISFGVVV AKEVFGGTGK NFMNPALAGR

151 AFLFFAYPAN LSGDAVWTAV DGYSGATALA QWAAHGADGL KNAITGQTIT

201 WMDAFIGKLP GSIGEVSTLA LLIGGAFIVF ARIASWRIIA GVMIGMIAMS

251 SLFNFIGSDT NAMFAMPWYW HLVVGGFAIG MLFMATDPVS ASFTNVGKWW

301 YGALIGVMCV LIRVVNPAYP EGMMLAILFA NLFAPIFDYF VAQANIKRRK

351 ARSNG*
```

```
m630/a630  98.3% identity in 355 aa overlap 10        20        30        40        50        60
m630.pep   MMILVWLALFPAMFYGMYNVGAQAFGALTPDLLQQNIANDWHYAFANALGINMSSEAGVS
           |||||||||||||||||||||||||||||||||||:||||||||:|||||||||||||| 
a630       MMILVWLALFPAMFYGMYNVGAQAFGALTPDLLQQSIANDWHYALANALGINMSSEAGVL
                   10        20        30        40        50        60
```

-continued

```
                70         80         90        100        110        120
m630.pep  DKMLFGAIYFLPIYATVFVVGGFWEVLFATVRKHEINEGRRVTSILFALIVPPTLPLWQA
           |||||||||||||||||:|||||||||||||||||||||||||||||||||||||||||
a630      GKMLFGAIYFLPIYATVFIVGGFWEVLFATVRKHEINEGRRVTSILFALIVPPTLPLWQA
                70         80         90        100        110        120

               130        140        150        160        170        180
m630.pep  ALGISFGVVVAKEVFGGTGKNFMNPALAGRAFLFFAYPANLSGDAVWTAVDGYSGATALA
          ||||||||||||||||||||||||||||||||||||||||||||||||||||||||||||
a630      ALGISFGVVVAKEVFGGTGKNFMNPALAGRAFLFFAYPANLSGDAVWTAVDGYSGATALA
               130        140        150        160        170        180

               190        200        210        220        230        240
m630.pep  QWAAHGADGLKNAVTGQTITWMDAFIGKLPGSIGEVSTLALLIGGAFIVFARIASWRITA
          |||||||||||||:|||||||||||||||||||||||||||||||||||||||||||| |
a630      QWAAHGADGLKNAITGQTITWMDAFIGKLPGSIGEVSTLALLIGGAFIVFARIASWRIIA
               190        200        210        220        230        240

               250        260        270        280        290        300
m630.pep  GVMIGMIAMSSLFNFIGSDTNAMFAMPWYWHLVVGGFAIGMLFMATDPVSASFTNVGKWW
          ||||||||||||||||||||||||||||||||||||||||||||||||||||||||||||
a630      GVMIGMIAMSSLFNFIGSDTNAMFAMPWYWHLVVGGFAIGMLFMATDPVSASFTNVGKWW
               250        260        270        280        290        300

               310        320        330        340        350
m630.pep  YGALIGVMCVLIRVVNPAYPEGMMLAILFANLFAPIFDYFVAQANIKRRKARSNGX
          |||||||||||||||||||||||||||||||||||||||||||||||||||||||
a630      YGALIGVMCVLIRVVNPAYPEGMMLAILFANLFAPIFDYFVAQANIKRRKARSNGX
               310        320        330        340        350
```

The following partial DNA sequence was identified in *N. gonorrhoeae* <SEQ ID 2033>:

```
g635.seq
  1 ATGACCCGGC GACGGGTCGG CAAGCAAAAC CGTATTGCCA TCCACTCCGC

 51 GCAATACCGA AAAATGGTCG TCTTTGCGGT ATTTCAGATA CACGATGACG

101 GGGATTTTCA ACTGCGCGAG CTGTTCGAAA GACAGGGCAT AGCCTTTCGC

151 CTCAAAACCC AAATCGGGCA TAATGCGCCG CATATCCTCA AACGACGCGC

201 GCATCTGTTC CTTACCCAGT TTTTCCAACA CTTCTTCTTC CGTCAGCTTT

251 TGCCCGTAAA AATTGTTCAA AAGCGTCGCC ACCGAAGCCG CCCCGCAGGA

301 AAAATCCAAA TCCTGCTTTA CAATATTGAA ATCCCGCCGC GCTTTCCAAC

351 TCTGCAATTT GATTTTTCCG TAAACAACAG GATTATCGTT AAACATCGGT

401 GCAGCATTCA AACGATAAGA CAAGGGTCTG TACCAGATTA G
```

This corresponds to the amino acid sequence <SEQ ID 2034; ORF 635.ng>:

```
g635.pep
  1 MTRRRVGKQN RIAIHSAQYR KMVVFAVFQI HDDGDFQLRE LFERQGIAFR

 51 LKTQIGHNAP HILKRRAHLF LTQFFQHFFF RQLLPVKIVQ KRRHRSRPAG

101 KIQILLYNIE IPPRFPTLQF DFSVNNRIIV KHRCSIQTIR QGSVPD*
```

The following partial DNA sequence was identified in *N. meningitidis* <SEQ ID 2035>:

```
m635.seq
  1 ATGACCCAGC GACGGGTCGG CAAGCAAAAC CGTATTGCCG TCTATACCGC

 51 GCAATACCGA GAAATGATCA TCCTTGCGGT ATTTCAGATA CACGATGACG

101 GGGATTTGCA ACTGTGCAAG CTGCTCGAAA GACAGGGCAT AGCCTTTCGC

151 TTCAAAACCC AAATCAGGCA TAATGCGCCG CATATCCTCA AACGACGCGG

201 GCATCTGCTC CTTATCCAGT TTTTTAACA CGTCCTCTTC CGTCAGCTTT
```

-continued

```
251 TGCCCGTAAA AATTGTTCAA AAGCGTCACC ACCGAAGCCG CCCCGCAGGA

301 AAAATCCAAA TCCTGCTTTA CAATATTGAA ATCGCGCCTT TCTTTCCAAC

351 TCTGCACTTT GATTTTTCCA TAAGCAACAG GATTATAGTG GATTAA
```

This corresponds to the amino acid sequence <SEQ ID 2036; ORF 635>:

```
m635.pep
      1 MTQRRVGKQN RIAVYTAQYR EMIILAVFQI HDDGDLQLCK LLERQGIAFR

     51 FKTQIRHNAP HILKRRGHLL LIQFF*HVLF RQLLPVKIVQ KRHHRSRPAG

    101 KIQILLYNIE IAPFFPTLHF DFSISNRIIV D*
m635/g635  80.0% identity in 130 aa overlap

                    10        20        30        40        50        60
m635.pep   MTQRRVGKQNRIAVYTAQYREMIILAVFQIHDDGDLQLCKLLERQGIAFRFKTQIRHNAP
           ||:||||||||||:::||||:|:::||||||||||:|| :|:||||||||:|||| ||||
g635       MTRRRVGKQNRIAIHSAQYRKMVVFAVFQIHDDGDFQLRELFERQGIAFRLKTQIGHNAP
                    10        20        30        40        50        60
                    70        80        90       100       110       120
m635.pep   HILKRRGHLLLIQFFXHVLFRQLLPVKIVQKRHHRSRPAGKIQILLYNIEIAPFFPTLHF
           ||||||:||:| ||| | :|||||||||||||:|||||||||||||||||| | ||||:|
g635       HILKRRAHLFLTQFFQHFFFRQLLPVKIVQKRRHRSRPAGKIQILLYNIEIPPRFPTLQF
                    70        80        90       100       110       120
                   130
m635.pep   DFSISNRIIVDX
           |||::|||||
g635       DFSVNNRIIVKHRCSIQTIRQGSVPDX
                   130       140
```

The following partial DNA sequence was identified in *N. meningitidis* <SEQ ID 2037>:

```
a635.seq
  1 ATGACCCAGC GACGGGTCGG CAAGCAAAAC CGTATTGCCG TCTATACCGC

 51 GCAATACCGA GAAATGATCA TCCTTGCGGT ATTTCAGATA CACGATGACG

101 GGGATTTGCA ACTGTGCAAG CTGCTCGAAA GACAGGGCAT AGCCTTTCGC

151 CTCAAAACCC AAATCAGGCA TGATGCGCCG CATATCCTCA AACGACGCGC

201 GCATCTGCTC CTTATCCAGC TTTTTCAACA CGTCCTCTTC CGTCAGCTTT

251 TGCCCGTGAA AATTGTTCAA AAGCGTCGCC ACCGAAGCCG CCCCGCAGGA

301 AAAATCCAAA TCCTGCTTTA CAATATTGAA ATCGCGCCTT TCTTTCCAAC

351 TCTGCACTTT GATTTTTCCA TAAGCAACAG GATTATAGTG GATTAA
```

This corresponds to the amino acid sequence <SEQ ID 2038; *ORF* 635.a>:

```
a635.pep

      1 MTQRRVGKQN RIAVYTAQYR EMIILAVFQI HDDGDLQLCK LLERQGIAFR

     51 LKTQIRHDAP HILKRRAHLL LIQLFQHVLF RQLLPVKIVQ KRRHRSRPAG

    101 KIQILLYNIE IAPFFPTLHF DFSISNRIIV D*

m635/a635  95.4% identity in 131 aa overlap
```

-continued

```
                10        20        30        40        50        60
m635.pep  MTQRRVGKQNRIAVYTAQYREMIILAVFQIHDDGDLQLCKLLERQGIAFRFKTQIRHNAP
          ||||||||||||||||||||||||||||||||||||||||||||||||||:||||||:||
a635      MTQRRVGKQNRIAVYTAQYREMIILAVFQIHDDGDLQLCKLLERQGIAFRLKTQIRHDAP
                10        20        30        40        50        60

                70        80        90       100       110       120
m635.pep  HILKRRGHLLLIQFFXHVLFRQLLPVKIVQKRHHRSRPAGKIQILLYNIEIAPFFPTLHF
          ||||||:||||||:| |||||||||||||||:||||||||||||||||||||||||||||
a635      HILKRRAHLLLIQLFQHVLFRQLLPVKIVQKRRHRSRPAGKIQILLYNIEIAPFFPTLHF
                70        80        90       100       110       120

               130
m635.pep  DFSISNRIIVDX
          ||||||||||||
a635      DFSISNRIIVDX
               130
```

The following partial DNA sequence was identified in *N. gonorrhoeae* <SEQ ID 2039>:

```
g638.seq
   1 ATGATTGGCG GACAGTTTAT CGTAGttgGc atTGTAGGCA AAAACGCACT

  51 TGCCCGCTTT GTTGATAATA ttgtcGTGAA TAtcGGAATA GTTGACATAG

 101 TTGAGCATGA TGCCCTAATC GCGGCTGCCG ACGGCGATAT TGTCGAACAC

 151 TTTGAGCCGT TCGGAAAACA TCAGCACATA GCCCATATTG TtgcCCACGG

 201 AAATATTGCC GCTGacttcg ctgtcgTTGG TGTACATATA GTGGACGGCG

 251 AAACGCAGGT CGCTGAAGCG GTTGTTTTTA TAGGTGTTGT GCGTGCTGGT

 301 ATTGGAAAAA ATGCCGTCCC GCCCTTTGGA AATGTCGTTG ccgACGACCT

 351 GCGCgccggg CgcgtTCCAA ACGGTAACGC CATTGCCGCG CTCATTCACG

 401 CGCAAGGTcg catcgCCGAC GATTTTATTC TCGCGCACCA TCGCATCGGC

 451 AGAACCATGA AGGTATACGC CGAACGAATT ATCAAAAATA TTGTTGTGTT

 501 CAACCAGGGC GCGCGGGGCG GCTTTTTCGA GATAAATACC GGCATCCATT

 551 GCTGGCAGGC TCATACCGGA ACGGGTAACG GTCAGGTTGC GGAGCGTTAC

 601 GTCCGGCGCG TGTACGGCTA TGGTACGCCC GCTCTTGTCC CCTTCGATGG

 651 TTGCGGAACG GTCGGCAGGC CCTTCAATCG TAATCGGTTT GTCGATATAA

 701 AGTTTGGTTT GATATACGCC GGAAGCCAGT TTGATCGTAT CGCCCGCCCG

 751 GGCGCGGGCA AAAATTTCGG CAAGGTTGTC TTGCGGGGAA ACGTGGACGA

 801 CGGCTGCCGA TGCCGTCTGA AAAATGCTGC CGGCGGCAAG TATCAGCACG

 851 GCCTTCAGCC ATATACGGAG CGCGGATGTG TGCATAGTGT CCCTCTGTTT

 901 CGTTCGGTAT GGCCGAACAA AATAAAGCAT CATTCAAATG TGCCTGTTTT

 951 TATAGCGAAA CCGCCTGAAA CGGTACGGCA AGCGGTTTGG CTATAA
```

This corresponds to the amino acid sequence <SEQ ID 2040; *ORF* 638.ng>:

```
g638.pep
   1 MIGGQFIVVG IVGKNALARF VDNIVVNIGI VDIVEHDALI AAADGDIVEH

  51 FEPFGKHQHI AHIVAHGNIA ADFAVVGVHI VDGETQVAEA VVFIGVVRAG

 101 IGKNAVPPFG NVVADDLRAG RVPNGNAIAA LIHAQGRIAD DFILAHHRIG
```

-continued

```
151 RTMKVYAERI IKNIVVFNQG ARGGFFEINT GIHCWQAHTG TGNGQVAERY

201 VRRVYGYGTP ALVPFDGCGT VGRPFNRNRF VDIKFGLIYA GSQFDRIARP

251 GAGKNFGKVV LRGNVDDGCR CRLKNAAGGK YQHGLQPYTE RGCVHSVPLF

301 RSVWPNKIKH HSNVPVFIAK PPETVRQAVW L*
```

The following partial DNA sequence was identified in *N. meningitidis* <SEQ ID 2041>:

```
m638.seq
  1 ATGATTGGCG AAAAGTTTAT CGTAGTTGGC ATTATAGGCA AATACGCACT

51 TGCCTGCCTT GTTGATAATG TTGTCGTGAA TATCGGAATA GTTGACATAG

101 TTGAGCATAA TGCCCTGATC GCGGCTGCCG ACGGCGATAT TGTCGAATAC

151 TTTGAGCCGC TCGGAAAACA TCAGCACATA GCCCATATTG TTGCCCACGG

201 AAATATTGCC GCTGATTTCG CTGTCGTTGG TGTACATATA GTGGACGGCG

251 AAACGCAAAT CGCTGAAGCG GTTGTTTTTG TAGGTGTTGT GCGTGCTGGT

301 ATTGGAAAAA ATGCCGTCCC GCCCTTTGGA AATGTCGTTG CCGACGACCT

351 GCGCACCGGG TGCGTTCCAA ACGGTAACGC CGTTGCCGCG CTCGTTCACG

401 CGCAAAGTCG CGTCGCCGAC GATTTTATTC TCGCGCACCA TCGCATCGGC

451 AGAACCATGC AGATATACGC CGACCGAATT ATCCAAAATA TTGTTGTGTT

501 CAATCAGGGC GCGCGGGGCA GTTTCTTCGA GATAAATACC GGCATCCATT

551 GCGGGCAGGC TCATACCGGA ACGGGTAACG GTCAGGTTGC GGAGCGTTAC

601 GTCCGGCGCG TGTACGGCTA TGGTACGCCC GCTCCTGTCG CCTTCGATGG

651 TTGCGGAACG GTCGGCAGGC CCTTCAATCG TAATCGGTTT GTCAATGTGA

701 AGTTTGGTTT TATATACGCC GGAAGCCAGT TTGAGCGTAT CGCCCGCCCG

751 GGCGCGGGCA AATGCGGGAT ACCGATCAGC ATAATCGGTT CGTGA
```

This corresponds to the amino acid sequence <SEQ ID 2042; *ORF* 638>:

```
m638.pep
      1 MIGEKFIVVG IIGKYALACL VDNVVVNIGI VDIVEHNALI AAADGDIVEY

51 FEPLGKHQHI AHIVAHGNIA ADFAVVGVHI VDGETQIAEA VVFVGVVRAG

101 IGKNAVPPFG NVVADDLRTG CVPNGNAVAA LVHAQSRVAD DFILAHHRIG

151 RTMQIYADRI IQNIVVFNQG ARGSFFEINT GIHCGQAHTG TGNGQVAERY

201 VRRVYGYGTP APVAFDGCGT VGRPFNRNRF VNVKFGFIYA GSQFERIARP

251 GAGKCGIPIS IIGS* m638/g638  88.2% identity in 254 aa overlap 10        20        30        40        50        60
m638.pep   MIGEKFIVVGIIGKYALACLVDNVVVNIGIVDIVEHNALIAAADGDIVEYFEPLGKHQHI
           ||| :||||||:|| ||| :|||:||||||||||||:||||||||||||:|||:||||||
g638       MIGGQFIVVGIVGKNALARFVDNIVVNIGIVDIVEHDALIAAADGDIVEHFEPFGKHQHI
                   10        20        30        40        50        60

70        80        90       100       110       120
m638.pep   AHIVAHGNIAADFAVVGVHIVDGETQIAEAVVFVGVVRAGIGKNAVPPFGNVVADDLRTG
           ||||||||||||||||||||||||||:||||||:||||||||||||||||||||||||:|
g638       AHIVAHGNIAADFAVVGVHIVDGETQVAEAVVFIGVVRAGIGKNAVPPFGNVVADDLRAG
                   70        80        90       100       110       120
```

-continued

```
                130        140        150        160        170        180
m638.pep   CVPNGNAVAALVHAQSRVADDFILAHHRIGRTMQIYADRIIQNIVVFNQGARGSFFEINT
            |||||:|||:|||:|:|||||||||||||||::||:|||:|||||||||||:||||||
g638       RVPNGNAIAALIHAQGRIADDFILAHHRIGRTMKVYAERIIKNIVVFNQGARGGFFEINT
                130        140        150        160        170        180
                190        200        210        220        230        240
m638.pep   GIHCGQAHTGTGNGQVAERYVRRVYGYGTPAPVAFDGCGTVGRPFNRNRFVNVKFGFIYA
           |||| |||||||||||||||||||||||||| | |||||||||||||||||::|||:|||
g638       GIHCWQAHTGTGNGQVAERYVRRVYGYGTPALVPFDGCGTVGRPFNRNRFVDIKFGLIYA
                190        200        210        220        230        240
                250        260
m638.pep   GSQFERIARPGAGKCGIPISIIGSX
           ||||:|||||||||
g638       GSQFDRIARPGAGKNFGKVVLRGNVDDGCRCRLKNAAGGKYQHGLQPYTERGCVHSVPLF
                250        260        270        280        290        300
```

The following partial DNA sequence was identified in *N. meningitidis* <SEQ ID 2043>:

```
a638.seq
   1 ATGATTGGCG GACAGTTTAT CGTAGTTGGC ATTGTAGGCA AAAACGCACT

  51 TGCCCGCTTT GTTGATAATG TTGTCGTGAA TATCGGAATA GTTGACATAG

 101 TTGAGCATGA TGCCTTGGTC GCGGCTGCCG ACGGCGATAT TGTCAAACAC

 151 TTTGAGCCGC TCGGAAAACA TCAGCACATA GCCCATATTG TTGCCCACGG

 201 AAATATTGCC GCTGATTTCG CTGTCGTTGG TGTACATATA GTGGACGGCG

 251 AAACGCAAAT CGCTGAAGCG GTTGTTTTTA TAGGTGTTGT GCGTGCTGGT

 301 ATTGGAAAAA ATGCCGTCCC GCCCTTTGGA AATATCGTTG CCGACGACCT

 351 GCGCGCCGGG CGCGTTCCAA ACGGTAACGC CATTGCCGCG CTCGTTCACG

 401 CGCAAAGTCG CGTCGCCGAC GATTTTATTC TCCCGCACCA TCGCATCGGC

 451 AGAACCATGC AGATAGACGC CGACCGAATT ATCCAAAATA TTATTGTGTT

 501 CAATCAGGGC GCGCGGGGCA GTTTCTTCGA GATAAATACC GGCATCCATT

 551 GCGGGCAGGC TCATACCGGA ACGGGTAACG GTCAGGTTGC GGAGCGTTAC

 601 GTCCGGCGCG TGTACGGCTA TGGTACGCCC GCTCCTGTCT CCTTCGATGG

 651 TTGCAGAACG GTCGGCAGGC CCTTCAATCG TAATCGGTTT GTCGATGTGA

 701 AGTTTGGTTT GATATACGCC GGAAGCCAGT TTGAGCGTAT CGCCCGCCCG

 751 GGCGCGGGCA AATGCGGGAT ACCGATCAGC ATAATCGACT CATGGTGA
```

This corresponds to the amino acid sequence <SEQ ID 2044; *ORF* 638.a>:

```
m638.pep

      1 MIGGQFIVVG IVGKNALARF VDNVVVNIGI VDIVEHDALV AAADGDIVKH

     51 FEPLGKHQHI AHIVAHGNIA ADFAVVGVHI VDGETQIAEA VVFIGVVRAG

    101 IGKNAVPPFG NIVADDLRAG RVPNGNAIAA LVHAQSRVAD DFILPHHRIG

    151 RTMQIDADRI IQNIIVFNQG ARGSFFEINT GIHCGQAHTG TGNGQVAERY

    201 VRRVYGYGTP APVSFDGCRT VGRPFNRNRF VDVKFGLIYA GSQFERIARP

    251 GAGKCGIPIS IIDSW*

m638/a638  91.3%% identity in 264 aa overlap
```

-continued

```
                   10        20        30        40        50        60
m638.pep   MIGEKFIVVGIIGKYALACLVDNVVVNIGIVDIVEHNALIAAADGDIVEYFEPLGKHQHI
           ||| :||||||:|| ||| :||||||||||||||||:||:||||||||::||||||||||
a638       MIGGQFIVVGIVGKNALARFVDNVVVNIGIVDIVEHDALVAAADGDIVKHFEPLGKHQHI
                   10        20        30        40        50        60
                   70        80        90       100       110       120
m638.pep   AHIVAHGNIAADFAVVGVHIVDGETQIAEAVVFVGVVRAGIGKNAVPPFGNVVADDLRTG
           |||||||||||||||||||||||||||||||||:||||||||||||||||||:|||||:|
a638       AHIVAHGNIAADFAVVGVHIVDGETQIAEAVVFIGVVRAGIGKNAVPPFGNIVADDLRAG
                   70        80        90       100       110       120
                  130       140       150       160       170       180
m638.pep   CVPNGNAVAALVHAQSRVADDFILAHHRIGRTMQIYADRIIQNIVVFNQGARGSFFEINT
            ||||||:|||||||||||||||| |||||||||| ||||||||:|||||||||||||||
a638       RVPNGNAIAALVHAQSRVADDFILPHHRIGRTMQIDADRIIQNIIVFNQGARGSFFEINT
                  130       140       150       160       170       180
                  190       200       210       220       230       240
m638.pep   GIHCGQAHTGTGNGQVAERYVRRVYGYGTPAPVAFDGCGTVGRPFNRNRFVNVKFGFIYA
           |||||||||||||||||||||||||||||||||:|||| ||||||||||||:||||:|||
a638       GIHCGQAHTGTGNGQVAERYVRRVYGYGTPAPVSFDGCRTVGRPFNRNRFVDVKFGLIYA
                  190       200       210       220       230       240
                  250       260
m638.pep   GSQFERIARPGAGKCGIPISIIGSX
           |||||||||||||||||||||| |
a638       GSQFERIARPGAGKCGIPISIIDSWX
                  250       260
```

The following partial DNA sequence was identified in *N. gonorrhoeae* <SEQ ID 2045>:

```
g639-1.seq
  1  ATGAGCCTGC CAGCAATGGA TGCCGGTATT TATCTCGAAA AAGCCGCCCC
 51  GCGCGCCCTG GTTGAACACA ACAATATTTT TGATAATTCG TTCGGCGTAT
101  ACCTTCATGG TTCTGCCGAT GCGATGGTGC GCGAGAATAA AATCGTCGGC
151  GATGCGACCT TGCGCGTGAA TGAGCGCGGC AATGGCGTTA CCGTTTGGAA
201  CGCGCCCGGC GCGCAGGTCG TCGGCAACGA CATTTCCAAA GGGCGGGACG
251  GCATTTTTTC CAATACCAGC ACGCACAACA CCTATAAAAA CAACCGCTTC
301  AGCGACCTGC GTTTCGCCGT CCACTATATG TACACCAACG ACAGCGAAGT
351  CAGCGGCAAT ATTTCCGTGG GCAACAATAT GGGCTATGTG CTGATGTTTT
401  CCGAACGGCT CAAAGTGTTC GACAATATCG CCGTCGGCAG CCGCGATTAG
451  GGCATCATGC TCAACTATGT CAACTATTCC GATATTCACG ACAATATTAT
501  CAACAAAGCG GGCAAGTGCG TTTTTGCCTA CAATGCCAAC TACGATAAAC
551  TGTCCGCCAA TCATTTTGAA AACTGCCAAA TCGGCATGCA CTTTACCGCC
601  GCCATCGAAG GCACGTCCCT GCACGACAAT TCCTTTATCA ACAACGGAAG
651  CCAGGTCAAA TATGTCAGTA CGCGCTTTCT CGACTGGAGC GAGGGCGGAC
701  ACGGCAACTA CTGGAGCGAC AACAGCCCGT TCGATTTGAA CGGCGACGGC
751  TTCGGAGACA GCGCGTACCG TCCCGACGGC ATCATCGACC AAATCATCTG
801  GCGCGCGCCC GTATCGCGCC TCTTGATGAA CAGTCCCGCA ATCAGCATCG
851  TCAAATGGGC GCAGGCGCAG TTTCCCGCCG TTCTGCCCGG CGGCGTGGTG
901  GACAGCAAAC CGCTGATGAA GCCTTATGCC CCCAAAATTC AAACCCGTTA
```

-continued

```
 951 TCAGGCGATG AAGGACGAGT TGCTCAAAGA AGCCGAAACG CGGCAGTCGG

1001 AACGGGGCAG GGCGGAAAAC GGTTCTTTGA ACTAG
```

This corresponds to the amino acid sequence <SEQ ID 2046; *ORF* 639-1.ng>:

```
g639-1.pep
  1 MSLPAMDAGI YLEKAAPRAL VEHNNIFDNS FGVYLHGSAD AMVRENKIVG

 51 DATLRVNERG NGVTVWNAPG AQVVGNDISK GRDGIFSNTS THNTYKNNRF

101 SDLRFAVHYM YTNDSEVSGN ISVGNNMGYV LMFSERLKVF DNIAVGSRD*

151 GIMLNYVNYS DIHDNIINKA GKCVFAYNAN YDKLSANHFE NCQIGMHFTA

201 AIEGTSLHDN SFINNGSQVK YVSTRFLDWS EGGHGNYWSD NSPFDLNGDG

251 FGDSAYRPDG IIDQIIWRAP VSRLLMNSPA ISIVKWAQAQ FPAVLPGGVV

301 DSKPLMKPYA PKIQTRYQAM KDELLKEAET RQSERGRAEN GSLN*
```

The following partial DNA sequence was identified in *N. meningitidis* <SEQ ID 2047>:

```
m639-1.seq
   1 ATGAGCCTGC CCGCAATGGA TGCCGGTATT TATCTCGAAG AAACTGCCCC

  51 GCGCGCCCTG ATTGAACACA ACAATATTTT GGATAATTCG GTCGGCGTAT

 101 ATCTGCATGG TTCTGCCGAT GCGATGGTGC GCGAGAATAA AATCGTCGGC

 151 GACGCGACTT TGCGCGTGAA CGAGCGCGGC AACGGCGTTA CCGTTTGGAA

 201 CGCACCCGGT GCGCAGGTCG TCGGCAACGA CATTTCCAAA GGGCGGGACG

 251 GCATTTTTTC CAATACCAGC ACGCACAACA CCTACAAAAA CAACCGCTTC

 301 AGCGATTTGC GTTTCGCCGT CCACTATATG TACACCAACG ACAGCGAAAT

 351 CAGCGGCAAT ATTTCCGTGG GCAACAATAT GGGCTATGTG CTGATGTTTT

 401 CCGAGCGGCT CAAAGTATTC GACAATATCG CCGTCGGCAG CCGCGATCAG

 451 GGCATTATGC TCAACTATGT CAACTATTCC GATATTCACG ACAACATTAT

 501 CAACAAGGCA GGCAAGTGCG TATTTGCCTA TAATGCCAAC TACGATAAAC

 551 TTTTCGCCAA TCATTTTGAA AACTGTCAAA TCGGCATACA CTTTACCGCC

 601 GCCATCGAAG GCACGTCCTT GCATGACAAT TCCTTTATCA ACAACGAAAG

 651 CCAGGTCAAA TACGTCAGCA CGCGCTTTCT CGATTGGAGC GAGGGCGGAC

 701 ACGGCAACTA TTGGAGCGAC AACAGCGCGT TCGATTTGAA CGGCGACGGC

 751 TTCGGAGACA GCGCGTACCG CCCCAACGGC ATCATCGACC AAATCATCTG

 801 GCGCGCGCCC GTATCGCGCC TTTTGATGAA CAGTCCCGCA ATCAGCATCG

 851 TCAAATGGGC GCAGGCGCAG TTTCCCGCCG TTCTGCCTGG CGGCGTGGTG

 901 GACAGCAAAC CGCTGATGAA GCCTTATGCC CCCAAAATTC AAACCCGTTA

 951 TCAGGCGATG AAGGACGAGC TACTCAAAGA AGTCGAAACG CGGCAGTCGG

1001 AATGGGGCAG GGCGGAAAAC GGTTCTTTGA ACTAG
```

This corresponds to the amino acid sequence <SEQ ID 2048; *ORF* 639-1>:

```
m639-1.pep

      1 MSLPAMDAGI YLEETAPRAL IEHNNILDNS VGVYLHGSAD AMVRENKIVG

     51 DATLRVNERG NGVTVWNAPG AQVVGNDISK GRDGIFSNTS THNTYKNNRF

    101 SDLRFAVHYM YTNDSEISGN ISVGNNMGYV LMFSERLKVF DNIAVGSRDQ

    151 GIMLNYVNYS DIHDNIINKA GKCVFAYNAN YDKLFANHFE NCQIGIFHTA

    201 AIEGTSLHDN SFINNESQVK YVSTRFLDWS EGGHGNYWSD NSAFDLNGDG

    251 FGDSAYRPNG IIDQIIWRAP VSRLLMNSPA ISIVKWAQAQ FPAVLPGGVV

    301 DSKPLMKPYA PKIQTRYQAM KDELLKEVET RQSEWGRAEN GSLN*

g639-1/m639-1  95.9% identity in 344 aa overlap

                    10        20        30        40        50        60
g639-1.pep  MSLPAMDAGIYLEKAAPRALVEHNNIFDNSFGVYLHGSADAMVRENKIVGDATLRVNERG
            ||||||||||||::|||||:|||||:||| |||||||||||||||||||||||||||||
m639-1      MSLPAMDAGIYLEETAPRALIEHNNILDNSVGVYLHGSADAMVRENKIVGDATLRVNERG
                    10        20        30        40        50        60

                    70        80        90       100       110       120
g639-1.pep  NGVTVWNAPGAQVVGNDISKGRDGIFSNTSTHNTYKNNRFSDLRFAVHYMYTNDSEVSGN
            ||||||||||||||||||||||||||||||||||||||||||||||||||||||||:|||
m639-1      NGVTVWNAPGAQVVGNDISKGRDGIFSNTSTHNTYKNNRFSDLRFAVHYMYTNDSEISGN
                    70        80        90       100       110       120

                   130       140       150       160       170       180
g639-1.pep  ISVGNNMGYVLMFSERLKVFDNIAVGSRDXGIMLNYVNYSDIHDNIINKAGKCVFAYNAN
            ||||||||||||||||||||||||||||||||||||||||||||||||||||||||||||
m639-1      ISVGNNMGYVLMFSERLKVFDNIAVGSRDQGIMLNYVNYSDIHDNIINKAGKCVFAYNAN
                   130       140       150       160       170       180

                   190       200       210       220       230       240
g639-1.pep  YDKLSANHFENCQIGMHFTAAIEGTSLHDNSFINNGSQVKYVSTRFLDWSEGGHGNYWSD
            |||| |||||||||||:|||||||||||||||||| ||||||||||||||||||||||||||||
m639-1      YDKLFANHFENCQIGIHFTAAIEGTSLHDNSFINNESQVKYVSTRFLDWSEGGHGNYWSD
                   190       200       210       220       230       240

                   250       260       270       280       290       300
g639-1.pep  NSPFDLNGDGFGDSAYRPDGIIDQIIWRAPVSRLLMNSPAISIVKWAQAQFPAVLPGGVV
            || ||||||||||||||:||||||||||||||||||||||||||||||||||||||||||
m639-1      NSAFDLNGDGFGDSAYRPNGIIDQIIWRAPVSRLLMNSPAISIVKWAQAQFPAVLPGGVV
                   250       260       270       280       290       300

                   310       320       330       340
g639-1.pep  DSKPLMKPYAPKIQTRYQAMKDELLKEAETRQSERGRAENGSLNX
            |||||||||||||||||||||||||||:|||||| ||||||||||
m639-1      DSKPLMKPYAPKIQTRYQAMKDELLKEVETRQSEWGRAENGSLNX
                   310       320       330       340
```

The following partial DNA sequence was identified in *N. meningitidis* <SEQ ID 2049>:

```
a639-1.seq
   1  ATGAGCCTGC CCGCAATGGA TGCCGGTATT TATCTCGAAG AAACTGCCCC

  51  GCGCGCCCTG ATTGAACACA ATAATATTTT GGATAATTCG GTCGGCGTCT

 101  ATCTGCATGG TTCTGCCGAT GCGATGGTGC GGGAGAATAA AATCGTCGGC

 151  GACGCGACTT TGCGCGTGAA CGAGCGCGGC AATGGCGTTA CCGTTTGGAA

 201  CGCGCCCGGC GCGCAGGTCG TCGGCAACGA TATTTCCAAA GGGCGGGACG

 251  GCATTTTTTC CAATACCAGC ACGCACAACA CCTATAAAAA CAACCGCTTC

 301  AGCGATTTGC GTTTCGCCGT CCACTATATG TACACCAACG ACAGCGAAAT

 351  CAGCGGCAAT ATTTCCGTGG GCAACAATAT GGGCTATGTG CTGATGTTTT

 401  CCGAGCGGCT CAAAGTGTTT GACAATATCG CCGTCGGCAG CCGCGACCAA

 451  GGCATCATGC TCAACTATGT CAACTATTCC GATATTCACG ACAACATTAT

 501  CAACAAAGCG GGCAAGTGCG TTTTTGCCTA CAATGCCAAC TACGATAAAC

 551  TGTCCGCCAA TCATTTTGAA AACTGCCAAA TCGGCATACA CTTTACCGCC
```

-continued

```
 601  GCCATCGAAG GCACGTCCCT GCACGACAAT TCCTTTATCA ACAACGAAAG

 651  CCAGGTCAAA TACGTCAGCA CGCGCTTTCT CGACTGGAGC GAGGGCGGAC

 701  ACGGCAACTA TTGGAGCGAC AACAGCGCGT TCGATTTGAA CGGCGACGGC

 751  TTCGGAGACA GCGCGTACCG TCCCAACGGC ATCATCGACC AAATCATCTG

 801  GCGCGCACCC GTATCGCGCC TCTTGATGAA CAGTCCCGCA ATCAGCATCG

 851  TCAAATGGGC GCAGGCGCAA TTTCCCGCCG TTTTGCCTGG CGGCGTGGTG

 901  GACAGCAAAC CGCTGATGAA GCCTTATGCC CCCAAAATTC AAACCCGTTA

 951  TCAGGCGATG AAGGACGGGC TGCTCAAAAA AGTCGAAACG CGGCAGTTGG

1001  AATGGGGCAG GGCGGAAAAC GGTTCTTTGA ACTAG
```

This corresponds to the amino acid sequence <SEQ ID 2050; *ORF* 639-1.a>:

```
a639-1.pep

      1 MSLPAMDAGI YLEETAPRAL IEHNNILDNS VGVYLHGSAD AMVRENKIVG

     51 DATLRVNERG NGVTVWNAPG AQVVGNDISK GRDGIFSNTS THNTYKNNRF

    101 SDLRFAVHYM YTNDSEISGN ISVGNNMGYV LMFSERLKVF DNIAVGSRDQ

    151 GIMLNYVNYS DIHDNIINKA GKCVFAYNAN YDKLSANHFE NCQIGIHFTA

    201 AIEGTSLHDN SFINNESQVK YVSTRFLDWS EGGHGNYWSD NSAFDLNGDG

    251 FGDSAYRPNG IIDQIIWRAP VSRLLMNSPA ISIVKWAQAQ FPAVLPGGVV

    301 DSKPLMKPYA PKIQTRYQAM KDGLLKKVET RQLEWGRAEN GSLN*

a639-1/m639-1 98.8% identity in 344 aa overlap

                    10        20        30        40        50        60
a639-1.pep  MSLPAMDAGIYLEETAPRALIEHNNILDNSVGVYLHGSADAMVRENKIVGDATLRVNERG
            ||||||||||||||||||||||||||||||||||||||||||||||||||||||||||||
m639-1      MSLPAMDAGIYLEETAPRALIEHNNILDNSVGVYLHGSADAMVRENKIVGDATLRVNERG
                    10        20        30        40        50        60

                    70        80        90       100       110       120
a639-1.pep  NGVTVWNAPGAQVVGNDISKGRDGIFSNTSTHNTYKNNRFSDLRFAVHYMYTNDSEISGN
            ||||||||||||||||||||||||||||||||||||||||||||||||||||||||||||
m639-1      NGVTVWNAPGAQVVGNDISKGRDGIFSNTSTHNTYKNNRFSDLRFAVHYMYTNDSEISGN
                    70        80        90       100       110       120

                   130       140       150       160       170       180
a639-1.pep  ISVGNNMGYVLMFSERLKVFDNIAVGSRDQGIMLNYVNYSDIHDNIINKAGKCVFAYNAN
            ||||||||||||||||||||||||||||||||||||||||||||||||||||||||||||
m639-1      ISVGNNMGYVLMFSERLKVFDNIAVGSRDQGIMLNYVNYSDIHDNIINKAGKCVFAYNAN
                   130       140       150       160       170       180

                   190       200       210       220       230       240
a639-1.pep  YDKLSANHFENCQIGIHFTAAIEGTSLHDNSFINNESQVKYVSTRFLDWSEGGHGNYWSD
            ||||||||||||||||||||||||||||||||||||||||||||||||||||||||||||
m639-1      YDKLSANHFENCQIGIHFTAAIEGTSLHDNSFINNESQVKYVSTRFLDWSEGGHGNYWSD
                   190       200       210       220       230       240

                   250       260       270       280       290       300
a639-1.pep  NSAFDLNGDGFGDSAYRPNGIIDQIIWRAPVSRLLMNSPAISIVKWAQAQFPAVLPGGVV
            ||||||||||||||||||||||||||||||||||||||||||||||||||||||||||||
m639-1      NSAFDLNGDGFGDSAYRPNGIIDQIIWRAPVSRLLMNSPAISIVKWAQAQFPAVLPGGVV
                   250       260       270       280       290       300

                   310       320       330       340
a639-1.pep  DSKPLMKPYAPKIQTRYQAMKDGLLKKVETRQLEWGRAENGSLNX
            |||||||||||||||||||||||||||||||||||||||||||||
m639-1      DSKPLMKPYAPKIQTRYQAMKDGLLKKVETRQLEWGRAENGSLNX
                   310       320       330       340
```

The following partial DNA sequence was identified in *N. gonorrhoeae* <SEQ ID 2051>:

```
g640.seq
   1 ATGATTCATA TAATATCAAT ATTAAAGAGT ATCGGTATAT CGGGGATAGC
  51 TATGTCCTGT TTTTCAATCC GGCGTATGTC TGCGTTTCGG GCGCGGATAA
 101 CGGCGTTTTT TACCGCCTTT GTCTTTTTGA CGGcggcACT GCCCGCTTAT
 151 GcggAgcgTc tgcctGATTT TCTGgcgAAA ATacAgcctT CGGAAATTTT
 201 TCCGGGTGCG GATCGTTACG GCAAGCCGGA aggcAAGCCT AtggtTGCCC
 251 GCgtttACAA AGgcgATGAG CAGCTCGGTT TGGTTTATAT CACGACCGAT
 301 GCGGTCAATA CGCGCGGTTA TTCGAGCAAA CCGATCGATA CGCTGATGGC
 351 TTTGGCAAAC GACGGCACGA TAGCCGGGGC GAAACTGGTC GATCATCACG
 401 AACCGATTAT GCTGATCGGT ATCCCGCAAT CGCGTGTCGA TAAGTTCATC
 451 GACAAATATA TCGGTCTGAA TTTTATTAAA AATCCGCCGA CCCCGAGCGT
 501 GGCGCCGGGC GACATCATCA GcggtGCGAC TgttaCACTG ATGGTGGTTA
 551 ACGACAGCAT CCAGCGTTCG TACAAGGTCA TTGCCAACCA ATACCGTCTG
 601 GGTTCGGACA AGGCCCTTCA GACGGCATCC GCTTCCGATG TTCGGGAAGC
 651 CGCGCCTGCG TCAGAAACCC GTCCGCGCCG TATGGCAAAT CCCGACAAGC
 701 AGGATATTTT GTCTTGGGAC GAACTTTTGA AACAAAAGGC CGTCGGCCAT
 751 CTGCATATCA CGCTCGATCA AATCAACAAA CTGTTTGAGA AAGGCGGCAA
 801 GGCCGGCGTG GCCGATCACG CCGAACAGGG CGATCCTGAC GATACCTTTA
 851 TTGATTTGTA TGTTGCCTTG GTCAGCCAGC CTTCCATCGG TAAAAGCCTG
 901 CTGGGTGAGG ACGGCTGGGC GCATCTGCAA AAACGGCTGA AACCCGGGCA
 951 GCAGGCGGTT TTGGTTGCCG GAGAGGGCCG TTATTCTTGG AAAGGTTCGG
1001 GCTATGTGCG CGGCGGTATT TTCGACCGTA TCGAGATGAT TCAGGGGGAG
1051 AACAGCTTCC GTTTTACCGA TGCCCAACAC GAACGCGTCG TCGAGCTGTC
1101 TGCCGCCGAT GCGCCGCGTT TTAAAGAAGT TTCTTGGTTT ACCATCCCTG
1151 AAGGCGTAGC GTTTGACGGT GCGGAGCCGT GGCGGCTGTA A
```

This corresponds to the amino acid sequence <SEQ ID 2052; *ORF* 640.ng>:

```
g640.pep
  1 MIHIISILKS IGISGIAMSC FSIRRMSAFR ARITAFFTAF VFLTAALPAY
 51 AERLPDFLAK IQPSEIFPGA DRYGKPEGKP MVARVYKGDE QLGLVYITTD
101 AVNTRGYSSK PIDTLMALAN DGTIAGAKLV DHHEPIMLIG IPQSRVDKFI
151 DKYIGLNFIK NPPTPSVAPG DIISGATVTL MVVNDSIQRS YKVIANQYRL
201 GSDKALQTAS ASDVREAAPA SETRPRRMAN PDKQDILSWD ELLKQKAVGH
251 LHITLDQINK LFEKGGKAGV ADHAEQGDPD DTFIDLYVAL VSQPSIGKSL
301 LGEDGWAHLQ KRLKPGQQAV LVAGEGRYSW KGSGYVRGGI FDRIEMIQGE
351 NSFRFTDAQH ERVVELSAAD APRFKEVSWF TIPEGVAFDG AEPWRL*
```

The following partial DNA sequence was identified in *N. meningitidis* <SEQ ID 2053>:

```
m640.seq (partial)
   1 ATGATTCATA TAATATCAAT ATTAAAGAGT ATCGGTATAT CGGGGATAGT

  51 CATGTCCTGT TTTTCAATCA AACGTATGTC CGCGTTTCGG GCGCGGATAA

 101 CGGCGTTTTT TGCCGCCTTT GTCTTTTTGA CGGCGGCACT GCCCGCTTAT

 151 GCGGAGCGTC TGCCTGATTT TCTGGCGAAA ATACAGCCTT CGGAAATTTT

 201 TCCGGGTGCG GACCGTTACG GCAAGCCGGA AGGTAAGCCT ATGGTTGCCC

 251 GCGTTTACAA AGGCGATGAG CAGTTGGGCT TGGTCTATAT CACGACCGAT

 301 GCGGTCAATA CGCGCGGTTA TTCGAGCAAA CCGATTGATA CGCTGATGGT

 351 GTTGGCAAAC GACGGCACGA TAGCCGGGGC GAAACTGGTC GACCATCACG

 401 AACCGATTAT GCTGATCGGT ATCCCGCAT...
```

This corresponds to the amino acid sequence <SEQ ID 2054; ORF 640>:

```
m640.pep (partial)
   1 MIHIISILKS IGISGIVMSC FSIKRMSAFR ARITAFFAAF VFLTAALPAY

  51 AERLPDFLAK IQPSEIFPGA DRYGKPEGKP MVARVYKGDE QLGLVYITTD

 101 AVNTRGYSSK PIDTLMVLAN DGTIAGAKLV DHHEPIMLIG IPH...
```

m640/g640 96.5% identity in 143 aa overlap

```
                    10        20        30        40        50        60
m640.pep    MIHIISILKSIGISGIVMSCFSIKRMSAFRARITAFFAAFVFLTAALPAYAERLPDFLAK
            ||||||||||||||||:||||||:||||||||||||:|||||||||||||||||||||||
g640        MIHIISILKSIGISGIAMSCFSIRRMSAFRARITAFFTAFVFLTAALPAYAERLPDFLAK
                    10        20        30        40        50        60

                    70        80        90       100       110       120
m640.pep    IQPSEIFPGADRYGKPEGKPMVARVYKGDEQLGLVYITTDAVNTRGYSSKPIDTLMVLAN
            ||||||||||||||||||||||||||||||||||||||||||||||||||||||||:|||
g640        IQPSEIFPGADRYGKPEGKPMVARVYKGDEQLGLVYITTDAVNTRGYSSKPIDTLMALAN
                    70        80        90       100       110       120

                   130       140
m640.pep    DGTIAGAKLVDHHEPIMLIGIPH
            ||||||||||||||||||||||:
g640        DGTIAGAKLVDHHEPIMLIGIPQSRVDKFIDKYIGLNFIKNPPTPSVAPGDIISGATVTL
                   130       140       150       160       170       180
```

The following partial DNA sequence was identified in *N. meningitidis* <SEQ ID 2055>:

```
a640.seq (partial)
   1 ATGATTCATA TAATATCAAT ATTAAAGAGT ATCGGTATAT CGGGGATAGT

  51 CATGTCCTGT TTTTCAATCA AACGTATGTC CGCGTTTCGG GCGCGGATAA

 101 CGGCGTTTTT TGCCGCCTTT GTCTTTTTGA CGGCGGCACT GCCCGCTTAT

 151 GCGGAGCGTC TGCCTGATTT TCTGGCGAAA ATACAGCCTT CGGAAATTGT

 201 TCCGGGTGCG GACCGTTACA GCAAGCCGGA AGGTAAGCCT ATGGTTGCCC

 251 GCGTTTACAA AGGCGATGAG CAGTTGGGCT TGGTCTATAT CACGACCGAT

 301 GCGGTCAATA CGCGCGGTTA TTCGAGCAAA CCGATTGATA CGCTGATGGC

 351 GTTGGCTAAA GACGGTACGA TAGCCGGAGC GAAATTGGTT GATCACCATG

 401 AGTCGATTAT GCTGATCGGT ATCCCGCAT...
```

This corresponds to the amino acid sequence <SEQ ID 2056; *ORF* 640.a>:

```
a640.pep (partial) Length: 143
   1 MIHIISILKS IGISGIVMSC FSIKRMSAFR ARITAFFAAF VFLTAALPAY

  51 AERLPDFLAK IQPSEIVPGA DRYSKPEGKP MVARVYKGDE QLGLVYITTD

 101 AVNTRGYSSK PIDTLMALAK DGTIAGAKLV DHHESIMLIG IPH...
```

m640/a640 96.5% identity in 143 aa overlap

```
                    10        20        30        40        50        60
m640.pep    MIHIISILKSIGISGIVMSCFSIKRMSAFRARITAFFAAFVFLTAALPAYAERLPDFLAK
            ||||||||||||||||||||||||||||||||||||||||||||||||||||||||||||
a640        MIHIISILKSIGISGIVMSCFSIKRMSAFRARITAFFAAFVFLTAALPAYAERLPDFLAK
                    10        20        30        40        50        60

                    70        80        90       100       110       120
m640.pep    IQPSEIFPGADRYGKPEGKPMVARVYKGDEQLGLVYITTDAVNTRGYSSKPIDTLMVLAN
            |||||| ||||||:|||||||||||||||||||||||||||||||||||||||||:||:
a640        IQPSEIVPGADRYSKPEGKPMVARVYKGDEQLGLVYITTDAVNTRGYSSKPIDTLMALAK
                    70        80        90       100       110       120

                   130       140
m640.pep    DGTIAGAKLVDHHEPIMLIGIPH
            |||||||||||||| ||||||||
a640        DGTIAGAKLVDHHESIMLIGIPH
                   130       140
```

The following partial DNA sequence was identified in *N. gonorrhoeae* <SEQ ID 2057>:

```
g642.seq
     1 ATGCGGTATC CGCCGCAATC GGCGGTTTTG CAGAATGCCG CGCGTTGCCT

    51 TTTGCGCCGC CCGAAATCTG CCTGCCGCCG TATTTGCCCG CTATCCGCAA

   101 TATCGGCAGT CCAATATATC TTTGCGGATG TCGTTCAGCA GGAAGGCTGT

   151 GGTGTCTTCG TGTTCCTCCT GTACGAAGAC AAAAAGTCGG GCGATGATTT

   201 TGCCGATGAA GACTTTTTGC AGGGCGCAGG CGTCGGTCAG GGTGTGTTCC

   251 TGCAGGAAGC TGCGGATGTC TTCGGGCAAA GCGTAgtCgc gGGCAACGGC

   301 GGcaaagcgG ACatcggtTT Gcacggcgtc gagCAGGGtt tggtTTTTGT

   351 CCAACTTAAT GCCTGCTTCT TTTTCTTCGG CGGTGGCGCG GACGAACTGG

   401 TCGTAAATTT CGGCATAAAG CATATCGTTC GGGCCTTCAA AAATCGTGAA

   451 GGGGCGGATA TCGATGGCGA TATTGCCGGC TGGGTGTCCG CGTTCAAAAC

   501 CCTTCGCGCC CAAGAGTTTT TGCAACATTT GCGCGGCGGc gTAAGTGTAT

   551 TCCGTGGCGa ggGTTTTGAc gatgTTCGCC TCCATCAATT GATGGGCGAc

   601 ggGCGcgacg ggCGAAACGG AATGGCAGAC GTAGCGGTAA AGGATTTCGG

   651 AAACCTGATG GCGGCGTTGG ATTTCGCGGC GTTCGTAATC GACGAATCTG

   701 ATATCGTTGC GGACATATCG GTTCAGGTTG TCAAGGATGT ATTCCATAAT

   751 GCCGTGCGTC ATGCCGATCA GTTGCAGGCG GCTGCGGATA AAGATGTTTT

   801 GGAACGCGCG CAAACCGGCA GCGTCGCCCC GGGAGAGTTT CATCACGGCG

   851 GTTGCAGGCA TTTCGGCATC GATGCGGTTG ACGGCGTAAC GGACGGCGCG

   901 CAGGCCTTCG GATGCGAGGG TTTCGCAGCG GATGTATGTT TTGGGGACGA

   951 GCAGCAGGTC GATGactttg gcgagtttgC Cgtttttgcg ctctttggcg

  1001 gcaacgaggA GGAAGTCGCT TTGCGAATTG CCCTGCCAGT ATTTCGCGGC
```

-continued

```
1051 GttgACGTAA ATGGTTtgtt cgtcggtata ttcgtagcag gactgcaTTT

1101 CGCGTGCAAt cgCcgcgccg gaggtTtcgg gttcggtaAc gcccaaacgg

1151 cggctttcgc ctTTGAAAAT CATGTCCAAA CCTTGTGCGA CTTGCgcttc

1201 gccgccgaac tCTTGCAGAG GCTGCAACAC CAGCGCGCCT TCGATGCCGG

1251 TACGCAGCGT AACGGGCACG CCGTAATGCC CCGCAATCCT TAG
```

This corresponds to the amino acid sequence <SEQ ID 2058; *ORF* 642.ng>:

```
g642.pep
  1 MRYPPQSAVL QNAARCLLRR PKSACRRICP LSAISAVQYI FADVVQQEGC

 51 GVFVFLLYED KKSGDDFADE DFLQGAGVGQ GVFLQEAADV FGQSVVAGNG

101 GKADIGLHGV EQGLVFVQLN ACFFFFGGGA DELVVNFGIK HIVRAFKNRE

151 GADIDGDIAG WVSAFKTLRA QEFLQHLRGG VSVFRGEGFD DVRLHQLMGD

201 GRDGRNGMAD VAVKDFGNLM AALDFAAFVI DESDIVADIS VQVVKDVFHN

251 AVRHADQLQA AADKDVLERA QTGSVAPGEF HHGGCRHFGI DAVDGVTDGA

301 QAFGCEGFAA DVCFGDEQQV DDFGEFAVFA LFGGNEEEVA LRIALPVFRG

351 VDVNGLFVGI FVAGLHFACN RRAGGFGFGN AQTAAFAFEN HVQTLCDLRF

401 AAELLQRLQH QRAFDAGTQR NGHAVMPRNP *
```

The following partial DNA sequence was identified in *N. meningitidis* <SEQ ID 2059>:

```
m642.seq (partial)
  1 GCCTGCCGCC GTATTTGCCC GCTACCCGCA ATATCGGCAG TCCAATATAT

 51 CTTTGCGGAT GTCGTTCAGC AGGAAGGCTG CGGTGTCTTC GTGTTTCGCC

101 TGTACGAAGA CAAAGAGTCG GGCGATGATT TTGCCGATAA AGACTTTTTG

151 CAGGGCGCAG GCATCGGTCA GGGTGTGTTC CTGCAGGAAG CTGCGGATGT

201 CTTCAGGCAA AGTGTAGTCG CGGGCGACGG CGGCAAAGCG GGCATCGGTT

251 TGCAGGCGGT CGAGCAGGGT TTGGTTTTTG TCCAACTTCA TGCCTGCTTC

301 TTTTTCTTCG GCGGTGGCGC GGACAAACTG GTCGTAAATT TCGGCATAAA

351 GCATATCGTT CGGGCCTTCA AAAATCGTGA AGGGGCGGAT GTCGATAGCG

401 ATATTGCCGG CGGTGTGTCC GCGTTCAAAA CCCTTCGCAC CCAAGAGTTT

451 TTGCAACATT TGCGCGGCGG CGTAAGTGTA TTCCGTGGCG AGGGTTTTGA

501 CGATGTTCGC CTCCATCAGC TGATGGGCGA CGGGGGCAAC AGGCGAAACG

551 GAATGGCAGA CGTAGCGGTA AAGAATCTCG GAAACCTGAT GGCGGCGCCG

601 GATTTCGCGG CGTTCGTAAT CGACGAATTT GATGTCGTTG CGGACGTATC

651 GTTCCAGATT TTCAAGGATG TATTCCATAA TGCCGTGCGT CATGCCGATC

701 AGTTGCAGGC GGCTGCGGAT AAAGATGTTT TGGAACGCGC GCAAACCGGC

751 AGCGTCGCTC TGGGAGAGTT TCATCACGGC GGTTGCAGGC ATTTCGGCAT

801 CGATGCGGTT GACGGCGTAA CGGACGGCGC GCAAGCCTTC GGATGCGAGG

851 GTTTCGCAGC GGATGTATGT TTTGGGGACG AGCAGCAGGT CGATGACTTT

901 GGCGAGTTTG CCGTTTTTGC GCTCTTTGGC GGCAACGAGG AGGAAGTCGC

951 TTTGCGAGTT GCCCTGCCAG TATTTCGCGG CGTTGACGTA AATGGTTTGT
```

-continued

```
1001  CCGTCGATAT ATTCGTAGTA GGACTGCATT TCGCGTGCAA TCGCCGCGCC

1051  GGAGGTTTCG GGTTCGGTAA CACCCAAACC GCCGCCCTCG CCTTTGAAAA

1101  TCATCTCCAA ACCTTGCGCG ACTTGCGCTT CATCGCCGAA CTCTTGCAGT

1151  GGCTGCAACA CCAGCGCGCC TTCGATGCCG GTACGCAGCG TAACGGGCAC

1201  GCCGTAATGC CCCGCAATCC G
```

This corresponds to the amino acid sequence <SEQ ID 2060; *ORF* 642>:

```
m642.pep (partial)
  1 ACRRICPLPA ISAVQYIFAD VVQQEGCGVF VFRLYEDKES GDDFADKDFL

 51 QGAGIGQGVF LQEAADVFRQ SVVAGDGGKA GIGLQAVEQG LVFVQLHACF

101 FFFGGGADKL VVNFGIKHIV RAFKNREGAD VDSDIAGGVS AFKTLRTQEF

151 LQHLRGGVSV FRGEGFDDVR LHQLMGDGGN RRNGMADVAV KNLGNLMAAP

201 DFAAFVIDEF DVVADVSFQI FKDVFHNAVR HADQLQAAAD KDVLERAQTG

251 SVALGEFHHG GCRHFGIDAV DGVTDGAQAF GCEGFAADVC FGDEQQVDDF

301 GEFAVFALFG GNEEEVALRV ALPVFRGVDV NGLSVDIFVV GLHFACNRRA

351 GGFGFGNTQT AALAFENHLQ TLRDLRFIAE LLQWLQHQRA FDAGTQRNGH

401 AVMPRNP
```

m642/g642 90.4% identity in 407 aa overlap

```
                                           10        20        30
m642.pep                             ACRRICPLPAISAVQYIFADVVQQEGCGVFVFRLYED
                                     |||||||| ||||||||||||||||||||||| ||||
g642         MRYPPQSAVLQNAARCLLRRPKSACRRICPLSAISAVQYIFADVVQQEGCGVFVFLLYED
                     10        20        30        40        50        60

              40        50        60        70        80        90
m642.pep     KESGDDFADKDFLQGAGIGQGVFLQEAADVFRQSVVAGDGGKAGIGLQAVEQGLVFVQLH
             |:|||||||:|||||||:||||||||||||| ||||||:|||| |||::||||||||||:
g642         KKSGDDFADEDFLQGAGVGQGVFLQEAADVFGQSVVAGNGGKADIGLHGVEQGLVFVQLN
                     70        80        90       100       110       120

             100       110       120       130       140       150
m642.pep     ACFFFFGGGADKLVVNFGIKHIVRAFKNREGADVDSDIAGGVSAFKTLRTQEFLQHLRGG
             |||||||||||:|||||||||||||||||||||:|:|||| ||||||||:||||||||||
g642         ACFFFFGGGADELVVNFGIKHIVRAFKNREGADIDGDIAGWVSAFKTLRAQEFLQHLRGG
                    130       140       150       160       170       180

             160       170       180       190       200       210
m642.pep     VSVFRGEGFDDVRLHQLMGDGGNRRNGMADVAVKNLGNLMAAPDFAAFVIDEFDVVADVS
             ||||||||||||||||||||| : ||||||||||::|||||| ||||||||| |:|||:|
g642         VSVFRGEGFDDVRLHQLMGDGRDGRNGMADVAVKDFGNLMAALDFAAFVIDESDIVADIS
                    190       200       210       220       230       240

             220       230       240       250       260       270
m642.pep     FQIFKDVFHNAVRHADQLQAAADKDVLERAQTGSVALGEFHHGGCRHFGIDAVDGVTDGA
              |: |||||||||||||||||||||||||||||||| |||||||||||||||||||||||
g642         VQVVKDVFHNAVRHADQLQAAADKDVLERAQTGSVAPGEFHHGGCRHFGIDAVDGVTDGA
                    250       260       270       280       290       300

             280       290       300       310       320       330
m642.pep     QAFGCEGFAADVCFGDEQQVDDFGEFAVFALFGGNEEEVALRVALPVFRGVDVNGLSVDI
             ||||||||||||||||||||||||||||||||||||||||||:||||||||||||| | |
g642         QAFGCEGFAADVCFGDEQQVDDFGEFAVFALFGGNEEEVALRIALPVFRGVDVNGLFVGI
                    310       320       330       340       350       360

             340       350       360       370       380       390
m642.pep     FVVGLHFACNRRAGGFGFGNTQTAALAFENHLQTLRDLRFIAELLQWLQHQRAFDAGTQR
             ||:|||||||||||||||||:||||:|||||:||| |||| ||||| |||||||||||||
g642         FVAGLHFACNRRAGGFGFGNAQTAAFAFENHVQTLCDLRFAAELLQRLQHQRAFDAGTQR
                    370       380       390       400       410       420

             400
m642.pep     NGHAVMPRNP
             ||||||||||
g642         NGHAVMPRNPX
                    430
```

The following partial DNA sequence was identified in *N. meningitidis* <SEQ ID 2061>:

```
a642.seq (partial)
     1  GCCTGCCGCC GTATTTGCCC GCTATCCGCA ATATCGGCAG TCCAATATGT
    51  CTTTGCGGAT GTCGTTCAGC AGGAAGGCTG CGGTGTCTTC GTGTTCCGCC
   101  TGTACGAAGA CAAAGAGTCG GGCGATGATT TTGCCGATAA AGACTTTTTG
   151  CAGGGCGCAG GCATCGGTCA GGGTGTGTTC CTGCAGGAAG CTGCGGATGT
   201  CTTCGGGCAA AGTGTAGTCG CGGGCGACGG CGGCAAAGCG GGCATCGGTT
   251  TGCAGGCGGT CGAGCAGGGT TTGGTTTTTG TCCAACTTCA TGCCTGCTTC
   301  TTTTTCTTCG GCGGTGGCGC GGACAAACTG GTCGTAAATT TCGGCATAAA
   351  GCATATCGTT CGGGCCTTCA AAAATCGTGA AGGGGCGGAT GTCGATAGCG
   401  ATATTGCCGG CGGTGTGTCC GCGTTCAAAA CCCTTCGCGC CCAAGAGTTT
   451  TTGCAACATT TGCGCGGCGG CGTAAGTGTA TTCCGTGGCG AGGGTTTTGA
   501  CGATGTTCGC CTCCATCAGT TGATGGGCGA CGGGTGCAAC GGGCGAAACG
   551  GAATGGCAGA CGTAGCGGTA AAGAATCTCG GAAACCTGAT GGCGGCGCCG
   601  GATTTCGCGG CGTTCGTAAT CGACGAATCT GATGTCGTTG CGGACGTATC
   651  GTTCCAGGTT TTCAAGGGTG TATTCCATAA TGCCGTGCGT CATGCCGATC
   701  AGTTGCAGGC GGCTGCGGAT AAAGATGTTT TGGAACGCGC GCAAACCGGC
   751  AGCGTCGCTC TGGGAGAGTT TCATCACGGC GGTTGCAGGC ATTTCGGCAT
   801  CGATGCGGTT GACGGCGTAA CGGACGGCGC GCAAGCCTTC GGATGCGAGG
   851  GTTTCGCAGC GGATGTATGT TTTGGGGACG AGCAGCAGGT CGATGACTTT
   901  GGCGAGTTTG CCGTTTTTGC GCTCTTTGGC GGCAACGAGG AGGAAGTCGC
   951  TTTGCGAGTT GCCCTGCCAG TATTTCGCGG CGTTGACGTA AATGGTTTGT
  1001  CCGTCGGTAT ATTCGTAGTA AGACTGCATT TCTCGGGCAA TCGCCGCGCC
  1051  GGAGGTTTCG GGTTCGGTAA CGCCTAAACC GCCGCCCTCG CCTTTGAAAA
  1101  CCATGTCCAA ACCCTGTGCG ATTTGCGCTT CATCGCCGAA CTCTTGCAGT
  1151  GGCTGCAACA CCAGCGCGCC TTCGATGCCG GTACGCAGCG TAACGGGCAC
  1201  GCCGTAATGC CCCGCAATCC G
```

This corresponds to the amino acid sequence <SEQ ID 2062; *ORF* 642.a>:

```
a642.pep Length: 407
  1ACRRICPLSA ISAVQYVFAD VVQQEGCGVF VFRLYEDKES GDDFADKDFL
 51QGAGIGQGVF LQEAADVFGQ SVVAGDGGKA GIGLQAVEQG LVFVQLHACF
101FFFGGGADKL VVNFGIKHIV RAFKNREGAD VDSDIAGGVS AFKTLRAQEF
151LQHLRGGVSV FRGEGFDDVR LHQLMGDGCN GRNGMADVAV KNLGNLMAAP
201DFAAFVIDES DVVADVSFQV FKGVFHNAVR HADQLQAAAD KDVLERAQTG
251SVALGEFHHG GCRHFGIDAV DGVTDGAQAF GCEGFAADVC FGDEQQVDDF
301GEFAVFALFG GNEEEVALRV ALPVFRGVDV NGLSVGIFVV RLHFSGNRRA
351GGFGFGNA*T AALAFENHVQ TLCDLRFIAE LLQWLQHQRA FDAGTQRNGH
401AVMPRNP
```

m642/a642 95.8% identity in 407 aa overlap

```
                   10        20        30        40        50        60
m642.pep   ACRRICPLPAISAVQYIFADVVQQEGCGVFVFRLYEDKESGDDFADKDFLQGAGIGQGVF
           |||||||| |||||||:|||||||||||||||||||||||||||||||||||||||||||
a642       ACRRICPLSAISAVQYVFADVVQQEGCGVFVFRLYEDKESGDDFADKDFLQCAGIGQGVF
                   10        20        30        40        50        60

                   70        80        90       100       110       120
m642.pep   LQEAADVFRQSVVAGDGGKAGIGLQAVEQGLVFVQLHACFFFFGGGADKLVVNFGIKHIV
           |||||||| |||||||||||||||||||||||||||||||||||||||||||||||||||
a642       LQEAADVFGQSVVAGDGGKAGIGLQAVEQGLVFVQLHACFFFFGGGADKLVVNFGIKHIV
                   70        80        90       100       110       120

                  130       140       150       160       170       180
m642.pep   RAFKNREGADVDSDIAGGVSAFKTLRTQEFLQHLRGGVSVFRGEGFDDVRLHQLMGDGGN
           ||||||||||||||||||||||||||:||||||||||||||||||||||||||||||| |
a642       RAFKNREGADVDSDIAGGVSAFKTLRAQEFLQHLRGGVSVFRGEGFDDVRLHQLMGDGCN
                  130       140       150       160       170       180

                  190       200       210       220       230       240
m642.pep   RRNGMADVAVKNLGNLMAAPDFAAFVIDEFDVVADVSFQIFKDVFHNAVRHADQLQAAAD
           ||||||||||||||||||||||||||||| ||||||| |:|| |||||||||||||||||
a642       GRNGMADVAVKNLGNLMAAPDFAAFVIDESDVVADVSGQVFKGVFHNAVRHADQLQAAAD
                  190       200       210       220       230       240

                  250       260       270       280       290       300
m642.pep   RRNGMADVAVKNLGNLMAAPDFAAFVIDEFDVVADVSFQIFKDVFHNAVRHADQLQAAAD
           ||||||||||||||||||||||||||||||||||||||||||||||||||||||||||||
a642       GRNGMADVAVKNLGNLMAAPDFAAFVIDESDVVADVSGQVFKGVFHNAVRHADQLQAAAD
                  250       260       270       280       290       300

                  310       320       330       340       350       360
m642.pep   GEFAVFALFGGNEEEVALRVALPVFRGVDVNGLSVDIFVVGLHFACNRRAGGFGFGNTQT
           ||||||||||||||||||||||||||||||||||| |||| |||: |||||||||||: |
a642       GEFAVFALFGGNEEEVALRVALPVFRGVDVNGLSVGIFVVRLHFSGNRRAGGFGFGNAXT
                  310       320       330       340       350       360

                  370       380       390       400
m642.pep   AALAFENHLQTLRDLRFIAELLQWLQHQRAFDAGTQRNGHAVMPRNP
           ||||||||:||| ||||||||||||||||||||||||||||||||||
a642       AALAFENHVQTLCDLRFIAELLQELQHQRAFDAGTQRNGHAVMPRNP
                  370       380       330       400
```

The following partial DNA sequence was identified in *N. gonorrhoeae* <SEQ ID 2063>:

```
g643.seq
   1 ATGGTGTTGC CTTTGATGTT GTTGGCGACA ATCAGgTcgg CTACGCTGAc

  51 gttgtancGt TTGGcaATGt tGaaCAgggt gtcgccTTCT ACAACGCGGT

 101 GGATGCTGGC ATGGagcGGG GAGGTTTCGG CTTCGCCGTC GGCAGCTTTG

 151 GCTACGCGCG TTTCCAAACG TGCCCGGCGT TtgCCGTCGG CGGCAACGGT

 201 ATGTTGCGGA GATGAGGAAA TGTTGTGTTC GGCAACTGTG TCAGGCGTGC

 251 CGATGACGGC GGagaTGGTT TCTTCAGCCT GCCGGCGCag gTTGTTTCGG

 301 GCAACAAGCT GCATGAGTTC GTCTGCCGCC TGCATGTCGT TTGGGGGGAt

 351 GACCTGCGCg aGTGtTGCGG TTTGGGTTTC agacgGCATG GCAGTCTGTT

 401 TTTcggTTTG a
```

This corresponds to the amino acid sequence <SEQ ID 2064; *ORF* 643>:

```
g643.pep
   1 MVLPLMLLAT IRSATLTLXR LAMLNRVSPS TTRWMLAWSG EVSASPSAAL

  51 ATRVSKRARR LPSAATVCCG DEEMLCSATV SGVPMTAEMV SSACRRRLFR

 101 ATSCMSSSAA CMSFGGMTCA SVAVWVSDGM AVCFSV*
```

The following partial DNA sequence was identified in *N. meningitidis* <SEQ ID 2065>:

```
m643.seq
   1 ATGGTGTTGC CTTTGATGTT GTTGGCGACA ATCAGGTCGG CTACACTGAC

  51 GTTGTAGCGT TTGGCAATGT TGAACAGGGT GTCGCCTTCT ACAACGCGGT

 101 GGATGCTGGC ATGGAGCGGG GAGATTTCGG CTTCGCCGTC GGCAGCTTTG

 151 GCTACGCGCG TTTCCAAACG TACCCGGCGT TTGCCGTCGG CGGCAGCGGT

 201 ATGTTGCGGA GATGCGGAAA TTTTGTGTTC GGCAACTGTG TCAGGCGTGC

 251 CGATGACGGC GGAGATGGTT TCTTCAGCCT GTCGGCGCAG GTTGTTTCGG

 301 GCAACAAGCT GCATGAGTTC GTCTGCCGCC TGCATGTCGT TTTGGGGGAT

 351 GATCTGCGCG AGTGTTGCGG TTTGGGTTTC AGACGGCATG GCGGTCTGTT

 401 TTTCGGTTTG A
```

This corresponds to the amino acid sequence <SEQ ID 2066; *ORF* 643>:

```
m643.pep
   1 MVLPLMLLAT IRSATLTL*R LAMLNRVSPS TTRWMLAWSG EISASPSAAL

  51 ATRVSKRTRR LPSAAAVCCG DAEILCSATV SGVPMTAEMV SSACRRRLFR

 101 ATSCMSSSAA CMSFWGMICA SVAVWVSDGM AVCFSV*
```

Computer analysis of the amino acid sequences gave the following results:

Homology with a Predicted ORF from *N. meningitidis* menA with menB ORF 643 shows 94.9% identity over a 136 aa overlap with a predicted ORF (ORF643.a) from *N. gonorrhoeae*:

```
  m643/g643

                      10        20        30        40        50        60
  m643.pep    MVLPLMLLATIRSATLTLZRLAMLNRVSPSTTRWMLAWSGEISASPSAALATRVSKRTRR
              |||||||||||||||||||||||||||||||||||||||||:|||||||||||||||:||
  g643        MVLPLMLLATIRSATLTLXRLAMLNRVSPSTTRWMLAWSGEVSASPSAALATRVSKRARR
                      10        20        30        40        50        60

                      70        80        90       100       110       120
  m643.pep    LPSAAAVCCGDAEILCSATVSGVPMTAEMVSSACRRRLFRATSCMSSSAACMSFWGMICA
              |||||:||||| |:||||||||||||||||||||||||||||||||||||||||| || ||
  g643        LPSAATVCCGDEEMLCSATVSGVPMTAEMVSSACRRRLFRATSCMSSSAACMSFGGMTCA
                      70        80        90       100       110       120

                     130
  m643.pep    SVAVWVSDGMAVCFSVX
              |||||||||||||||||
  g643        SVAVWVSDGMAVCFSVX
                     130
```

The following partial DNA sequence was identified in *N. meningitidis* <SEQ ID 2067>:

```
a643.seq
   1 ATGGTGTTGC CTTTGATGTT GTTGGCGACA ATCAGGTCGG CTACACTGAC

  51 GTTGTAGCGT TTGGCAATGT TGAACAGGGT GTCGCCTTCT ACAACGCGGT

 101 GGATGCTGGC ATGGAGCGGG GAGATTTCGG CTTCGCCGTC GGCAGCTTTG

 151 GCTACGCGCG TTTCCAAACG TACCCGGCGT TTGCCGTCGG CGGCAACGGT

 201 ATGTTGCGGA GATGAGGAAA TGTTGTGTTC GGCAACTGTG TCAGGCGTGC
```

-continued

```
251 CGATGACGGC AGAGATGGTT TCTTCAGCCT GTCGGCGCAG GTTGTTTCGG

301 GCAACAAGCT GCATGAGTTC GTCTGCCGCC TGCATGTCGT TTTGGGGGAC

351 GATCTGCGCG AGTGTTGCGG TTTGGGTTTC AGACGGCATG GCGGTCTGTT

401 TTTCGGTTTG A
```

This corresponds to the amino acid sequence <SEQ ID 2068; *ORF* 643.a>:

```
a643.pep

      1    MVLPLMLLAT IRSATLTL*R LAMLNRVSPS TTRWMLAWSG EISASPSAAL

     51    ATRVSKRTRR LPSAATVCCG DEEMLCSATV SGVPMTAEMV SSACRRRLFR

    101    ATSCMSSSAA CMSFWGTICA SVAVWVSDGM AVCFSV*

m643/a643  97.1% identity in 136 aa overlap

                   10        20        30        40        50        60
m643.pep   MVLPLMLLATIRSATLTLZRLAMLNRVSPSTTRWMLAWSGEISASPSAALATRVSKRTRR
           ||||||||||||||||||||||||||||||||||||||||||||||||||||||||||||
a643       MVLPLMLLATIRSATLTLXRLAMLNRVSPSTTRWMLAWSGEVSASPSAALATRVSKRTRR
                   10        20        30        40        50        60

                   70        80        90       100       110       120
m643.pep   LPSAAAVCCGDAEILCSATVSGVPMTAEMVSSACRRRLFRATSCMSSSAACMSFWGMICA
           |||||:|||||  |:|||||||||||||||||||||||||||||||||||||||| ||||
a643       LPSAATVCCGDEEMLCSATVSGVPMTAEMVSSACRRRLFRATSCMSSSAACMSFWGTICA
                   70        80        90       100       110       120

                  130
m643.pep   SVAVWVSDGMAVCFSVX
           ||||||||||||||||
a643       SVAVWVSDGMAVCFSVX
                  130
```

The following partial DNA sequence was identified in *N. gonorrhoeae* <SEQ ID 2069>:

```
g644.seq
   1  ATGCCGTCTG AAAGGccgGC GGATTGTTGC CCGGTGCACT TTGTGGTAAA

  51  GTTTAGAAAA TTAACTCTAA ACTGTGGCAG GCGGTTTGAC CGGCCGCCGA

 101  TTAATGGGAA CCGACAGAGG AAGCCGATGA TACACACCGA ACCGAGCGCG

 151  CAGCCGTCAA CCATGGACAC GGCTGCTTTT TTAAagcaca tcgaatCCGC

 201  ATTcCCCCGC ATTTTTTCAG ACGGCATCGA CCTGATGCGA TACCTGCCCG

 251  AAGACAAATG GCTTGCCTTG AAGCAGGCGG GTTTGCTGTT GCCCTTCCTC

 301  GACAAAAAAC ACGGCGGGCG CAAGGGCAGT CAGTTTGAAA TCCAAGAAGT

 351  CCTAAGGATT GCGGGGCATT ACGGCGTGCC CGTTACGCTG CGTACCGGCA

 401  TCGAAGGCGC GCTGGTGTTG CAGCCTCTGC AAGagttcgg cggcgaagcG

 451  CAAGTCGCAC AAGGTTTGGA CATGATTTTC AAaggcgaaa gccgccgttt

 501  gggcgTtacc gaacccgaAa cctccggcgc gGcgaTTGCA CGCGAAAtgc

 551  agtcctgcta cgaatatacc gacgaacaAA CCATTTACGT caaCGCCGCG

 601  AAATACTGGC AGGGCAATTC GCAAAGCGAC TTCCTcctcg ttgccgccaa

 651  agagcgcaaa aacGGcaaac tcgccaaagt CATCGACCTG CTGCTCGTCC

 701  CCAAAACATA CATCCGCTGC GAAACCCTCG CATCCGAAGG CCTGCGCGCC

 751  GTCCGTTACG CCGTCAACCG CATCGATGCC GAAATGCCTG CAACCGCCGT

 801  GATGAAACTC TCCCGGGGCG ACGCTGCCGG TTTGCGCGCG TTCCAAAACA
```

-continued

```
 851 TCTTTATCCG CAGCCGCCTG CAACTGATCG GCATGACGCA CGGCATTATG

 901 GAATACATCC TTGACAACCT GAACCGATAT GTCCGCAACG ATATCAGATT

 951 CGTCGATTAC GAACGCCGCG AAATCCAACG CCGCCATCAG GTTTCCGAAA

1001 TCCTTTACCG CTACGTCTGC CATTCCGTTT CGcccgtcgC GCccgTCGCC

1051 CATCAATTGA TGGAGGCGAA catcgTCAAA ACcctCGCCA CGGAATACAC

1101 TTAcgcCGCC GCGCAAATGT TGCAAAAACT CTTGGGCGCG AAGGGTTTTG

1151 AACGCGGACA CCCAGCCGGC AATATCGCCA TCGATATCCG CCCCTTCACG

1201 ATTTTTGAAG GCCCGAACGA TATGCTTTAT GCCGAAATTT ACGACCAGTT

1251 CGTCCGCGCC ACCGCCGAAG AAAAAGAAGC AGGCATTAAG TTGGACAAAA

1301 accaaaCCCT Gctcgacgcc gtgCAAaccg atGTCcgctt tgCCGCCGTT

1351 GCCcgcGacT ACGCTTTGCC CGAAGACATC CGCAGCTTCC TGCAGGAACA

1401 CACCCTGACC GACGCCTGCG CCCTGCAAAA AGTCTTCATC GGCAAAATCA

1451 TCGCCCGACT TTTTGTCTTC GTACAGGAGG AACACGAAGA CACCACAGCC

1501 TTCCTGCTGA ACGACATCCG CAAAGATATA TTGGACTGCC GATATTGCGG

1551 ATAG
```

This corresponds to the amino acid sequence <SEQ ID 2070; *ORF* 644.ng>:

```
g644.pep
  1 MPSERPADCC PVHFVVKFRK LTLNCGRRFD RPPINGNRQR KPMIHTEPSA

 51 QPSTMDTAAF LKHIESAFPR IFSDGIDLMR YLPEDKWLAL KQAGLLLPFL

101 DKKHGGRKGS QFEIQEVLRI AGHYGVPVTL RTGIEGALVL QPLQEFGGEA

151 QVAQGLDMIF KGESRRLGVT EPETSGAAIA REMQSCYEYT DEQTIYVNAA

201 KYWQGNSQSD FLLVAAKERK NGKLAKVIDL LLVPKTYIRC ETLASEGLRA

251 VRYAVNRIDA EMPATAVMKL SRGDAAGLRA FQNIFIRSRL QLIGMTHGIM

301 EYILDNLNRY VRNDIRFVDY ERREIQRRHQ VSEILYRYVC HSVSPVAPVA

351 HQLMEANIVK TLATEYTYAA AQMLQKLLGA KGFERGHPAG NIAIDIRPFT

401 IFEGPNDMLY AEIYDQFVRA TAEEKEAGIK LDKNQTLLDA VQTDVRFAAV

451 ARDYALPEDI RSFLQEHTLT DACALQKVFI GKIIARLFVF VQEEHEDTTA

501 FLLNDIRKDI LDCRYCG*
```

The following partial DNA sequence was identified in *N. meningitidis* <SEQ ID 2071>:

```
m644.seq
  1 ATGCCGTCTG AAAGGTCGGC GGATTGTTGC CCGGCGCACT TTGTGGTAAA

 51 GTTTAGAAAA TCAACTCTAA ACTGTGGCAG GCGGTTTGAC CGGCCGCCGA

101 TTAATGGGAA CCGACAGAGG AAGCCGATGA TACACACCGA ACCGAGCGCG

151 CAGCCGTCAA CTATGGACAC GGCTGCTTTT TTAAAGCACA TCGAATCCGC

201 ATTCCGCCGC ATTTTTTCAG ACGGTATCGA CCTGATGCGA TACCTGCCCG

251 AAGACAAATG GCTTGCCTTG AAGCAGGCGG GTTTGCTGTT GCCCTTCCTC

301 GACAAAAAAT ACGGCGGGCG CAAGGGCAGC CAGTTTGAAA TCCAAGAAGT

351 CcTGCGGATT GCGGGGCATT ACGGCGTGCC CGTTACGCTG CGTACCGGCA
```

-continued

```
401 TCGAAGGCGC GCTGGTGTTG CAGCCACTGC AAGAGTTCGG CGATGAAGCG
451 CAAGTCGCGC AAGGTTTGGA GATGATTTTC AAAGGCGAGG GCGGCGGTTT
501 GGGTGTTACC GAACCCGAAA CCTCCGGCGC GGCGATTGCA CGCGAAATGC
551 AGTCCTACTA CGAATATATC GACGGACAAA CCATTTACGT CAACGCCGCG
601 AAATACTGGC AGGGCAACTC GCAAAGCGAC TTCCTCCTCG TTGCCGCCAA
651 AGAGCGCAAA AACGGCAAAC TCGCCAAAGT CATCGACCTG CTGCTCGTCC
701 CCAAAACATA CATCCGCTGC GAAACCCTCG CATCCGAAGG CTTGCGCGCC
751 GTCCGTTACG CCGTCAACCG CATCGATGCC GAAATGCCTG CAACCGCCGT
801 GATGAAACTC TCCCAGAGCG ACGCTGCCGG TTTGCGCGCG TTCCAAAACA
851 TCTTTATCCG CAGCCGCCTG CAACTGATCG GCATGACGCA CGGCATTATG
901 GAATACATCC TTGAAAATCT GGAACGATAC GTCCGCAACG ACATCAAATT
951 CGTCGATTAC GAACGCCGCG AAATCCGGCG CCGCCATCAG GTTTCCGAGA
1001 TTCTTTACCG CTACGTCTGC CATTCCGTTT CGCCTGTTGC CCCCGTCGCC
1051 CATCAGCTGA TGGAGGCGAA CATCGTCAAA ACCCTCGCCA CGGAATACAC
1101 TTACGCCGCC GCGCAAATGT TGCAAAAACT CTTGGGTGCG AAGGGTTTTG
1151 AACGCGGACA CACCGCCGGC AATATCGCTA TCGACATCCG CCCCTTCACG
1201 ATTTTTGAAG GCCCGAACGA TATGCTTTAT GCCGAAATTT ACGACCAGTT
1251 TGTCCGCGCC ACCGCCGAAG AAAAAGAAGC AGGCATGAAG TTGGACAAAA
1301 ACCAAACCCT GCTCGACCGC CTGCAAACCG ATGCCCGCTT TGCCGCCGTC
1351 GCCCGCGACT ACACTTTGCC TGAAGACATC CGCAGCTTCC TGCAGGAACA
1401 CACCCTGACC GATGCCTGCG CCCTGCAAAA AGTCTTTATC GGCAAAATCA
1451 TCGCCCGACT CTTTGTCTTC GTACAGGCGA AACACGAAGA CACCGCAGCC
1501 TTCCTGCTGA ACGACATCCG CAAAGATATA TTGGACTGCC GATATTGCGG
1551 GTAG
```

This corresponds to the amino acid sequence <SEQ ID 2072; *ORF* 644>:

```
m644.pep

  1 MPSERSADCC PAHFVVKFRK STLNCGRRFD RPPINGNRQR KPMIHTEPSA
 51 QPSTMDTAAF LKHIESAFRR IFSDGIDLMR YLPEDKWLAL KQAGLLLPFL
101 DKKYGGRKGS QFEIQEVLRI AGHYGVPVTL RTGIEGALVL QPLQEFGDEA
151 QVAQGLEMIF KGEGGGLGVT EPETSGAAIA REMQSYYEYI DGQTIYVNAA
201 KYWQGNSQSD FLLVAAKERK NGKLAKVIDL LLVPKTYIRC ETLASEGLRA
251 VRYAVNRIDA EMPATAVMKL SQSDAAGLRA FQNIFIRSRL QLIGMTHGIM
301 EYILENLERY VRNDIKFVDY ERREIRRRHQ VSEILYRYVC HSVSPVAPVA
351 HQLMEANIVK TLATEYTYAA AQMLQKLLGA KGFERGHTAG NIAIDIRPFT
401 IFEGPNDMLY AEIYDQFVRA TAEKKEAGMK LDKNQTLLDR LQTDARFAAV
451 ARDYTLPEDI RSFLQEHTLT DACALQKVFI GKIIARLFVF VQAKHEDTAA
501 FLLNDIRKDI LDCRYCG*
```

-continued

```
m644/g644 94.6% identity in 517 aa overlap

                    10        20        30        40        50        60
m644.pep    MPSERSADCCPAHFVVKFRKSTLNCGRRFDRPPINGNRQRKPMIHTEPSAQPSTMDTAAF
            ||||| |||||:||||||| ||||||||||||||||||||||||||||||||||||||||
g644        MPSERPADCCPVHFVVKFRKLTLNCGRRFDRPPINGNRQRKPMIHTEPSAQPSTMDTAAF
                    10        20        30        40        50        60

                    70        80        90       100       110       120
m644.pep    LKHIESAFRRIFSDGIDLMRYLPEDKWLALKQAGLLLPFLDKKYGGRKGSQFEIQEVLRI
            |||||||| |||||||||||||||||||||||||||||||||:|||||||||||||||||
g644        LKHIESAFPRIFSDGIDLMRYLPEDKWLALKQAGLLLPFLDKKHGGRKGSQFEIQEVLRI
                    70        80        90       100       110       120

                   130       140       150       160       170       180
m644.pep    AGHYGVPVTLRTGIEGALVLQPLQEFGDEAQVAQGLEMIFKGEGGGLGVTEPETSGAAIA
            |||||||||||||||||||||||||| ||||||||:||||||:  |||||||||||||||
g644        AGHYGVPVTLRTGIEGALVLQPLQEFGGEAQVAQGLDMIFKGESRRLGVTEPETSGAAIA
                   130       140       150       160       170       180

                   190       200       210       220       230       240
m644.pep    REMQSYYEYIDGQTIYVNAAKYWQGNSQSDFLLVAAKERKNGKLAKVIDLLLVPKTYIRC
            ||||| ||| | ||||||||||||||||||||||||||||||||||||||||||||||||
g644        REMQSCYEYTDEQTIYVNAAKYWQGNSQSDFLLVAAKERKNGKLAKVIDLLLVPKTYIRC
                   190       200       210       220       230       240

                   250       260       270       280       290       300
m644.pep    ETLASEGLRAVRYAVNRIDAEMPATAVMKLSQSDAAGLRAFQNIFIRSRLQLIGMTHGIM
            |||||||||||||||||||||||||||||||::|||||||||||||||||||||||||||
g644        ETLASEGLRAVRYAVNRIDAEMPATAVMKLSRGDAAGLRAFQNIFIRSRLQLIGMTHGIM
                   250       260       270       280       290       300

                   310       320       330       340       350       360
m644.pep    EYILENLERYVRNDIKFVDYERREIRRRHQVSEILYRYVCHSVSPVAPVAHQLMEANIVK
            ||||:||:|||||||:||||||||:|||||||||||||||||||||||||||||||||||
g644        EYILDNLNRYVRNDIRFVDYERREIQRRHQVSEILYRYVCHSVSPVAPVAHQLMEANIVK
                   310       320       330       340       350       360

                   370       380       390       400       410       420
m644.pep    TLATEYTYAAAQMLQKLLGAKGFERGHTAGNIAIDIRPFTIFEGPNDMLYAEIYDQFVRA
            ||||||||||||||||||||||||||| ||||||||||||||||||||||||||||||||
g644        TLATEYTYAAAQMLQKLLGAKGFERGHPAGNIAIDIRPFTIFEGPNDMLYAEIYDQFVRA
                   370       380       390       400       410       420

                   430       440       450       460       470       480
m644.pep    TAEEKEAGMKLDKNQTLLDRLQTDARFAAVARDYTLPEDIRSFLQEHTLTDACALQKVFI
            ||||||||:||||||||||| :|||:||||||||:|||||||||||||||||||||||||
g644        TAEEKEAGIKLDKNQTLLDAVQTDVRFAAVARDYALPEDIRSFLQEHTLTDACALQKVFI
                   430       440       450       460       470       480

                   490       500       510
m644.pep    GKIIARLFVFVQAKHEDTAAFLLNDIRKDILDCRYCGX
            |||||||||||| :||||:|||||||||||||||||||
g644        GKIIARLFVFVQEEHEDTTAFLLNDIRKDILDCRYCGX
                   490       500       510
```

The following partial DNA sequence was identified in *N. meningitidis* <SEQ ID 2073>:

```
a644.seq
     1  ATGCCGTCTG AAAGGTCGGC GGATTGTTGC CCGGCGCACT TTGTGGTAAA

    51  GTTTAGAAAA TCAACTCTAA ACTGTGGCAG GCGGTTTGAC CGGCCGCCGA

   101  TTAATGGGAA CCGACAGAGG AAGCCGATGA TACACACCGA ACCGAGCGCG

   151  CAGCCGTCAA CTATGGACAC GGCTGCTTTT TTAAAGCACA TCGAATCCGC

   201  ATTCCGCCGC ATTTTTGCAG ACGGTATCGA CCTGATGCGA TACCTGCCCG

   251  AAGACAAATG GCTTGCCTTG AAGCAGGCGG GTTTGCTGTT GCCCTTCCTC

   301  GACAAAAAAT ACGGCGGGCG CAAGGGCAGC CAGTTTGAAA TTCAGGAAGT

   351  CTTGCGGATT GCGGGGCATT ACGGCGTGCC CGTTANNNNN NNNNNNNNNN

   401  NNGAAGGCGC GCTGGTGTTG CAGCCACTGC AAGAGTTCGG CGATGAAGCG

   451  CAAATCGCAC AGGGTTTGGA CATGGTTTTC AAAGGCGAGG GCGGCGGTTT

   501  AGGCGTTACC GAACCCGAAA CCTCCGGCGC GGCGATTGCC CGAGAAATGC

   551  AGTCTTACTA CGAATATACC GACGGACAAA CCATTTACGT CAACGCCGCG
```

-continued

```
 601 AAATACTGGC AGGGCAACTC GCAAAGCGAC TTCCTCCTCG TTGCCGCCAA

 651 AGAGCGCAAA AACGGCAAAC TCGCCAAAGT CATCGACCTG CTGCTCGTCC

 701 CCAAAACATA CATCCGCTGC GAAACCCTCG CATCCGAAGG CTTGCGCGCC

 751 GTCCGTTACG CCGTCAACCG CATCGATGCC GAAATGCCTG CAACCGCCGT

 801 GATGAAACTC TCCCAGAGCG ACGCTGCCGG TTTGCGCGCG TTCCAAAACA

 851 TCTTTATCCG CAGCCGCCTG CAACTGATCG GCATGACGCA CGGCATTATG

 901 GAATACACCC TTGAAAACCT GGAACGATAC GTCCGCAACG ACATCAGATT

 951 CGTCGATTAC GAACGCCGCG AAATCCGGCG CCGCCATCAG GTTTCCGAGA

1001 TTCTTTACCG CTACGTCTGC CATTCCGTTT CGCCCGTTGC ACCCGTCGCC

1051 CATCAACTGA TGGAGGCGAA CATCGTCAAA ACCCTCGCCA CGGAATACAC

1101 TTACGCCGCC GCGCAAATGT TGCAAAAACT CTTGGGCGCG AAGGGTTTTG

1151 AACGCGGACA CACCGCCGGC AATATCGCTA TCGACATCCG CCCCTTCACG

1201 ATTTTTGAAG GCCCGAACGA TATGCTTTAT GCCGAAATTT ACGACCAGTT

1251 TGTCCGCGCC ACCGCCGAAG AAAAAGAAGC AGGCATGAAG TTGGACAAAA

1301 ACCAAACCCT GCTCGACCGC CTGCAAACCG ATGCCCGCTT TGCCGCCGTC

1351 GCCCGCGACT ACACTTTGCC CGAAGACATC CGCAGCTTCC TGCAGGAACA

1401 CACCCTGACC GATGCCTGCG CCCTGCAAAA AGTCTTTATC GGCAAAATCA

1451 TCGCCCGACT CTTTGTCTTC GTACAGGCGG AACACGAAGA CACCGCAGCC

1501 TTCCTGCTGA ACGACATCCG CAAAGACATA TTGGACTGCC GATATTGCGG

1551 ATAG
```

This corresponds to the amino acid sequence <SEQ ID 2074; *ORF* 644.a>:

```
a644.pep

      1 MPSERSADCC PAHFVVKFRK STLNCGRRFD RPPINGNRQR KPMIHTEPSA

     51 QPSTMDTAAF LKHIESAFRR IFADGIDLMR YLPEDKWLAL KQAGLLLPFL

    101 DKKYGGRKGS QFEIQEVLRI AGHYGVPVXX XXXXEGALVL QPLQEFGDEA

    151 QIAQGLDMVF KGEGGGLGVT EPETSGAAIA REMQSYYEYT DGQTIYVNAA

    201 KYWQGNSQSD FLLVAAKERK NGKLAKVIDL LLVPKTYIRC ETLASEGLRA

    251 VRYAVNRIDA EMPATAVMKL SQSDAAGLRA FQNIFIRSRL QLIGMTHGIM

    301 EYTLENLERY VRNDIRFVDY ERREIRRRHQ VSEILYRYVC HSVSPVAPVA

    351 HQLMEANIVK TLATEYTYAA AQMLQKLLGA KGFERGHTAG NIAIDIRPFT

    401 IFEGPNDMLY AEIYDQFVRA TAEEKEAGMK LDKNQTLLDR LQTDARFAAV

    451 ARDYTLPEDI RSFLQEHTLT DACALQKVFI GKIIARLFVF VQAEHEDTAA

    501 FLLNDIRKDI LDCRYCG*
```

```
m644/a644 97.3% identity in 517 aa overlap

                    10        20        30        40        50        60
m644.pep    MPSERSADCCPAHFVVKFRKSTLNCGRRFDRPPINGNRQRKPMIHTEPSAQPSTMDTAAF
            ||||||||||||||||||||||||||||||||||||||||||||||||||||||||||||
a644        MPSERSADCCPAHFVVKFRKSTLNCGRRFDRPPINGNRQRKPMIHTEPSAQPSTMDTAAF
                    10        20        30        40        50        60

                    70        80        90       100       110       120
m644.pep    LKHIESAFRRIFSDGIDLMRYLPEDKWLALKQAGLLLPFLDKKYGGRKGSQFEIQEVLRI
            ||||||||||:|||||||||||||||||||||||||||||||||||||||||||||||||
a644        LKHIESAFPRIFADGIDLMRYLPEDKWLALKQAGLLLPFLDKKHGGRKGSQFEIQEVLRI
                    70        80        90       100       110       120
```

-continued

```
                   130       140       150       160       170       180
m644.pep    AGHYGVPVTLRTGIEGALVLQPLQEFGDEAQVAQGLEMIFKGEGGGLGVTEPETSGAAIA
            ||||||||:  :  |||||||||||||||||:||||:|:|||||||||||||||||||||
a644        AGHYGVPVXXXXXXEGALVLQPLQEFGDEAQIAQGLDMVFKGEGGGLGVTEPETSGAAIA
                   130       140       150       160       170       180

                   190       200       210       220       230       240
m644.pep    REMQSYYEYIDGQTIYVNAAKYWQGNSQSDFLLVAAKERKNGKLAKVIDLLLVPKTYIRC
            ||||||||| ||||||||||||||||||||||||||||||||||||||||||||||||||
a644        REMQSYYEYTDGQTIYVNAAKYWQGNSQSDFLLVAAKERKNGKLAKVIDLLLVPKTYIRC
                   190       200       210       220       230       240

                   250       260       270       280       290       300
m644.pep    ETLASEGLRAVRYAVNRIDAEMPATAVMKLSQSDAAGLRAFQNIFIRSRLQLIGMTHGIM
            ||||||||||||||||||||||||||||||||||||||||||||||||||||||||||||
a644        ETLASEGLRAVRYAVNRIDAEMPATAVMKLSQSDAAGLRAFQNIFIRSRLQLIGMTHGIM
                   250       260       270       280       290       300

                   310       320       330       340       350       360
m644.pep    EYILENLERYVRNDIKFVDYERREIRRRHQVSEILYRYVCHSVSPVAPVAHQLMEANIVK
            || |||||||||||:|||||||||||||||||||||||||||||||||||||||||||||
a644        EYTLENLERYVRNDIRFVDYERREIRRRHQVSEILYRYVCHSVSPVAPVAHQLMEANIVK
                   310       320       330       340       350       360

                   370       380       390       400       410       420
m644.pep    TLATEYTYAAAQMLQKLLGAKGFERGHTAGNIAIDIRPFTIFEGPNDMLYAEIYDQFVRA
            ||||||||||||||||||||||||||||||||||||||||||||||||||||||||||||
a644        TLATEYTYAAAQMLQKLLGAKGFERGHTAGNIAIDIRPFTIFEGPNDMLYAEIYDQFVRA
                   370       380       390       400       410       420

                   430       440       450       460       470       480
m644.pep    TAEEKEAGMKLDKNQTLLDRLQTDARFAAVARDYTLPEDIRSFLQEHTLTDACALQKVFI
            ||||||||||||||||||||||||||||||||||||||||||||||||||||||||||||
a644        TAEEKEAGMKLDKNQTLLDRLQTDARFAAVARDYTLPEDIRSFLQEHTLTDACALQKVFI
                   430       440       450       460       470       480

                   490       500       510
m644.pep    GKIIARLFVFVQAKHEDTAAFLLNDIRKDILDCRYCGX
            |||||||||||||:||||||||||||||||||||||||
a644        GKIIARLFVFVQAEHEDTAAFLLNDIRKDILDCRYCGX
                   490       500       510
```

The following partial DNA sequence was identified in *N. gonorrhoeae* <SEQ ID 2075>:

```
g645.seq
   1 ATGATGATGG TGTTGGCGTT GGGGATGTCG ATGCCGGTTT CGATGATGGT

  51 GGAACAGAGC AACACATTGA ATCTTTGCTG CAAAAAGTCG CGCATGACTT

 101 GTTCCAGCTC GCGCTCACGC AGTTGTCCGT GCGCCACGCC GATACGGGCT

 151 TCGGGCAGCA GGGTTTCCAG CCGCTCGCGC ATATTCTCAA TCGTATCTAC

 201 TTCATTGTGC AGGAAAAata cCTGTCCTCC GCGTTTGAGT TCGCGCAACA

 251 CGGCTTCGCG CACGCTGCCT TCGCTGAACG GTTTGACAAA GGTTTTCACG

 301 GCGAGGCGGC GGCTCGGTGC AGTGGTAATC AGCGAGAAGT CGCGCAGACC

 351 TTCGAGCGCC ATGCTGAGGG TGCGCGGAAT CGGCGTGGCG GTCATGGTTA

 401 GGATGTCGAC ATTGGCGCGC AGGCGTTTGA GCTGCTCTTT CTGTCGCACG

 451 CCGAAGCGGT GTTCTTCATC GATAATCAAT AAACCTAAGT TTTTGAATTT

 501 TATGTCGTCC TGCACCAATT TGTGCGTACC GATAACGATA TCGACAGTAC

 551 CGTCCGCCAT GCCTTCGAGC GTGGCTTTGG TGGCTTTGCT GTTGTTGAAA

 601 CGCGAAAGGC TGGCGACTTT CACGGGGAAA TCGGCGAAAC GGTCGGCGAA

 651 GTTTTGCGCG TGCTGCTCGA CCAGAAGCGT GGTCGGGGCG AGTACGGCGA

 701 CCTGTTTGCC GCCCATCACC GCCACAAACG CGGCGCGAAG GGCGACTTCG

 751 GTTTTGCCGA AACCGACATC GCCGCACACA AGTCGGTCCA TCGGCTTCGC

 801 CTGCGTCAAA TCTTTAATCA CGGcggcgat ggcggcggcC TGGTCTTCGG

 851 TTTCCTCGTA G
```

This corresponds to the amino acid sequence <SEQ ID 2076; *ORF* 645.ng>:

```
g645.pep
   1 MMMVLALGMS MPVSMMVEQS NTLNLCCKKS RMTCSSSRSR SCPCATPIRA

  51 SGSRVSSRSR IFSIVSTSLC RKNTCPPRLS SRNTASRTLP SLNGLTKVFT

 101 ARRRLGAVVI SEKSRRPSSA MLRVRGIGVA VMVRMSTLAR RRLSCSFCRT

 151 PKRCSSSIIN KPKFLNFMSS CTNLCVPITI STVPSAMPSS VALVALLLLK

 201 RERLATFTGK SAKRSAKFCA CCSTRSVVGA STATCLPPIT ATNAARRATS

 251 VLPKPTSPHT SRSIGFACVK SLITAAMAAA WSSVSS*
```

The following partial DNA sequence was identified in *N. meningitidis* <SEQ ID 2077>:

```
m645.seq
   1 ATGATGATGG TGTTGGCGTT GGGGATATCG ATACCGGTTT CGATGATGGT

  51 GGAACAGAGC AACACGTTAA ATCGTTGCTG CAAAAAGTCG CGCATGACTT

 101 GTTCCAGCTC GCGCTCGCGC AGTTGTCCGT GCGCCACGCC GATGCGGGCT

 151 TCGGGCAGCA GGGTTTCCAG CCGCTCGCGC ATATTTTCAA TCGTATCTAC

 201 TTCATTGTGC AGGAAAAATA CCTGTCCTCC GCGTTTGAGT TCGCGCAACA

 251 CGGCTTCGCG CACGCTGCCT TCGCTAAAGG GTTTGACAAA GGTTTTGACG

 301 GCGAGGCGGC GGCTGGGCGC GGTGGTAATC AGCGAGAAGT CGCGCAGTCC

 351 TTCCAACGCC ATACTTAAAG TACGCGGAAT CGGCGTGGCG GTCATGGTAA

 401 GGATATCAAC ATTGGCGCGC AGGCGTTTGA GCTGCTCTTT CTGACGCACG

 451 CCGAAGCGGT GTTCTTCGTC GATAATCACT AAACCTAAGT TTTTGAATTT

 501 GATGTCGTCC TGCACCAGTT TGTGCGTACC GATAACAATA TCGACCGTGC

 551 CGTCTGCCAT GCCTTCCAGC GCGGCTTTGG TGGCTTTGCT GTTGTTGAAA

 601 CGCGAAAGGC TGGCGACTTT CACGGGGAAA TCGGCGAAAC GGTCGGCGAA

 651 GTTTTGCGCG TGCTGCTCGA CCAAAAGCGT GGTCGGAGCA AGTACGGCGA

 701 CCTGTTTGCC GCCCATCACC GCCACAAACG CGGCGCGCAG GGCGACTTCG

 751 GTTTTGCCGA AGCCGACATC GCCGCACACA AGGCGATCCA TCGGCTTCGC

 801 TTGCGTCAAA TCTTTAATCA CGGCGGCGAT GGCGGCGGCC TGGTCTTCGG

 851 TTTCCTCGTA G
```

This corresponds to the amino acid sequence <SEQ ID 2078; ORF 645>:

```
m645.pep

    1   MMMVLALGIS IPVSMMVEQS NTLNRCCKKS RMTCSSSRSR SCPCATPMRA

   51   SGSRVSSRSR IFSIVSTSLC RKNTCPPRLS SRNTASRTLP SLKGLTKVLT

  101   ARRRLGAVVI SEKSRSPSNA ILKVRGIGVA VMVRISTLAR RRLSCSF*RT

  151   PKRCSSSIIT KPKFLNLMSS CTSLCVPITI STVPSAMPSS AALVALLLLK

  201   RERLATFTGK SAKRSAKFCA CCSTKSVVGA STATCLPPIT ATNAARRATS

  251   VLPKPTSPHT RRSIGFACVK SLITAAMAAA WSSVSS*

m645/g645   93.7% identity in 286 aa overlap
```

-continued

```
                  10         20         30         40         50         60
m645.pep   MMMVLALGISIPVSMMVEQSNTLNRCCKKSRMTCSSSRSRSCPCATPMRASGSRVSSRSR
           ||||||||:|:||||||||||||| ||||||||||||||||||||||:||||||||||||
g645       MMMVLALGMSMPVSMMVEQSNTLNLCCKKSRMTCSSSRSRSCPCATPIRASGSRVSSRSR
                  10         20         30         40         50         60

                  70         80         90        100        110        120
m645.pep   IFSIVSTSLCRKNTCPPRLSSRNTASRTLPSLKGLTKVLTARRRLGAVVISEKSRSPSNA
           ||||||||||||||||||||||||||||||||:|||||:|||||||||||||||| ||:|
g645       IFSIVSTSLCRKNTCPPRLSSRNTASRTLPSLNGLTKVFTARRRLGAVVISEKSRRPSSA
                  70         80         90        100        110        120

                 130        140        150        160        170        180
m645.pep   ILKVRGIGVAVMVRISTLARRRLSCSFXRTPKRCSSSIITKPKFLNLMSSCTSLCVPITI
           :|:|||||||||||:|||||||||||| |||||||||||:||||||:|||||:|||||||
g645       MLRVRGIGVAVMVRMSTLARRRLSCSFCRTPKRCSSSIINKPKFLNFMSSCTNLCVPITI
                 130        140        150        160        170        180

                 190        200        210        220        230        240
m645.pep   STVPSAMPSSAALVALLLLKRERLATFTGKSAKRSAKFCACCSTKSVVGASTATCLPPIT
           ||||||||||:|||||||||||||||||||||||||||||||||:|||||||||||||||
g645       STVPSAMPSSVALVALLLLKRERLATFTGKSAKRSAKFCACCSTRSVVGASTATCLPPIT
                 190        200        210        220        230        240

                 250        260        270        280
m645.pep   ATNAARRATSVLPKPTSPHTRRSIGFACVKSLITAAMAAAWSSVSSX
           |||||||||||||||||||| ||||||||||||||||||||||||||
g645       ATNAARRATSVLPKPTSPHTSRSIGFACVKSLITAAMAAAWSSVSSX
                 250        260        270        280
```

The following partial DNA sequence was identified in *N. meningitidis* <SEQ ID 2079>:

```
a645.seq
   1 ATGATGATGG TGTTGGCGTT GGGAATGTCG ATACCGGTTT CGATGATGGT

  51 GGAACAGAGC AACACGTTAA ATCGTTGCTG CAAAAAGTCG CGCATGACTT

 101 GTTCCAGCTC GCGCTCGCGC AGTTGTCCGT GCGCCACGCC GATGCGGGCT

 151 TCGGGCAGCA GGGTTTCCAG CCGCTCACGC ATGTTTTCGA TGGTATCCAC

 201 TTCATTGTGC AGGAAAAATA CTTGCCCGCC GCGTTTGAGT TCGCGCAATA

 251 CGGCTTCGCG CACGCTGCCT TCGCTGAACG GTTTGACAAA GGTTTTGACG

 301 GCGAGGCGGC GGCTGGGCGC AGTGGTAATC AGCGAGAAGT CGCGCAGTCC

 351 TTCCAGCGCC ATACTTAAAG TACGCGGAAT CGGCGTAGCG GTCATGGTAA

 401 GGATGTCGAC ATTGGCGCGC AGGCGTTTGA GCTGCTCTTT CTGACGCACG

 451 CCGAAGCGGT GTTCTTCGTC GATAATCACT AAACCTACGT TTTGAATTT

 501 TATGTCGTCC TGCACCAGTT TGTGCGTACC GATAACAATA TCGACCGTGC

 551 CGTCCGCCAT GCCTTCCAGC GCGGCTTTGG TGGCTTTGCT GTTGTTGAAA

 601 CGCGAAAGGC TGGCGACTTT CACGGGGAAA TCGGCGAAGC GGTCGGCAAA

 651 ATTTTGCGCG TGCTGCTCGA CCAGAAGCGT GGTCGGTGCG AGTACGGCAA

 701 CTTGTTTGCC ACCCATTACC GCCACAAACG CGGCGCGCAG GGCGACTTCG

 751 GTTTTGCCGA AACCGACATC GCCGCACACG AGGCGGTCCA TCGGCTTCGC

 801 CTGCGTCAAA TCTTTAATCA CGGCGGCGAT GGCGGCTGCC TGGTCTTCGG

 851 TTTCTTCGTA G
```

This corresponds to the amino acid sequence <SEQ ID 2080; *ORF* 645.a>:

```
m645.pep

    1   MMMVLALGMS IPVSMMVEQS NTLNRCCKKS RMTCSSSRSR SCPCATPMRA
```

-continued

```
 51    SGSRVSSRSR MFSMVSTSLC RKNTCPPRLS SRNTASRTLP SLNGLTKVLT

101    ARRRLGAVVI SEKSRSPSSA ILKVRGIGVA VMVRMSTLAR RRLSCSF*RT

151    PKRCSSSIIT KPTFLNFMSS CTSLCVPITI STVPSAMPSS AALVALLLLK

201    RERLATFTGK SAKRSAKFCA CCSTRSVVGA STATCLPPIT ATNAARRATS

251    VLPKPTSPHT RRSIGFACVK SLITAAMAAA WSSVSS*

m645/a645    96.9% identity in 286 aa overlap

                     10        20        30        40        50        60
m645.pep    MMMVLALGISIPVSMMVEQSNTLNRCCKKSRMTCSSSRSRSCPCATPMRASGSRVSSRSR
            ||||||||:|||||||||||||||||||||||||||||||||||||||||||||||||||
a645        MMMVLALGMSMPVSMMVEQSNTLNLCCKKSRMTCSSSRSRSCPCATPIRASGSRVSSRSR
                     10        20        30        40        50        60

                     70        80        90       100       110       120
m645.pep    IFSIVSTSLCRKNTCPPRLSSRNTASRTLPSLKGLTKVLTARRRLGAVVISEKSRSPSNA
            :||:||||||||||||||||||||||||||||:|||||||||||||||||||||||||:|
a645        MFSMVSTSLCRKNTCPPRLSSRNTASRTLPSLNGLTKVLTARRRLGAVVISEKSRSPSSA
                     70        80        90       100       110       120

                    130       140       150       160       170       180
m645.pep    ILKVRGIGVAVMVRISTLARRRLSCSFXRTPKRCSSSIITKPKFLNLMSSCTSLCVPITI
            ||||||||||||||:||||||||||||||||||||||||||| |||:|||||||||||||
a645        ILKVRGIGVAVMVRMSTLARRRLSCSFXRTPKRCSSSIITKPTFLNFMSSCTSLCVPITI
                    130       140       150       160       170       180

                    190       200       210       220       230       240
m645.pep    STVPSAMPSSAALVALLLLKRERLATFTGKSAKRSAKFCACCSTKSVVGASTATCLPPIT
            ||||||||||||||||||||||||||||||||||||||||||||:|||||||||||||||
a645        STVPSAMPSSAALVALLLLKRERLATFTGKSAKRSAKFCACCSTRSVVGASTATCLPPIT
                    190       200       210       220       230       240

                    250       260       270       280
m645.pep    ATNAARRATSVLPKPTSPHTRRSIGFACVKSLITAAMAAAWSSVSSX
            |||||||||||||||||||||||||||||||||||||||||||||||
a645        ATNAARRATSVLPKPTSPHTRRSIGFACVKSLITAAMAAAWSSVSSX
                    250       260       270       280
```

The following partial DNA sequence was identified in *N. gonorrhoeae* <SEQ ID 2081>:

```
g647.seq
  1 ATGCAAAGGC TCGCCGCAGA CGGCATCCAA ATCTTTTTTG TAGGTGTCGA

 51 TGGGCAGTTT GCCTTGCGAA TAAACGGTTT GGTTAAAGAG CGTGCACGCT

101 CCGTATTCTT TGGCAAGGTT TGCCGATGCT TTGAGCAGGT AATACTGTAT

151 GGCTTCAAAG GTACGGTGGG TCAGACCGAG CGCGGAACCG TCGCTGTAGC

201 GGACACCGTT TTTCGCCAGA TAGTAGGCGT AGTTGATGAC ACCGATGCCG

251 AGCGAACGGC GGTCCATAGT AGAGGTACGC GCGGCTTCTA CCGGATATCC

301 CTGATAATCT AA
```

This corresponds to the amino acid sequence <SEQ ID 2082; ORF 647.ng>:

```
g647.pep
  1 MQRLAADGIQ IFFVGVDGQF ALRINGLVKE RARSVFFGKV CRCFEQVILY

 51 GFKGTVGQTE RGTVAVADTV FRQIVGVVDD TDAERTAVHS RGTRGFYRIS

101 LII*
```

The following partial DNA sequence was identified in *N. meningitidis* <SEQ ID 2083>:

```
m647.seq
  1 ATGCAAAGGC TCGCCGCAGA CGGCATCCAA ATCTTTTTTG TAAGTGTCGA

 51 TGGGCAGTTT GCCTTGCGAA TAAACGGTTT GGTTAAAGAG CGTGCACGCA
```

-continued

```
101 CCGTATTCTT TGGCAAGGTT TGCCGATGCT TTGAGCAGGT AATACTGTAT

151 GGCTTCAAAG GTACGGTGGG TCAGACCGAG CGCGGAACCG TCGCTGTAGC

201 GGACACCGTT TTTCGCCAGA TAATAAGCAT AGTTAATCAC GCCGATGCCG

251 AGCGAACGGC GGCCCATAGT AGAGGTACGC GCGGCTTCTA CCGGATATCC

301 CTGATAATCT AA
```

This corresponds to the amino acid sequence <SEQ ID 2084; *ORF* 647>:

```
m647.pep

       1     MQRLAADGIQ IFFVSVDGQF ALRINGLVKE RARTVFFGKV CRCFEQVILY

      51     GFKGTVGQTE RGTVAVADTV FRQIISIVNH ADAERTAAHS RGTRGFYRIS

     101     LII*

m647/g647    91.3% identity in 103 aa overlap

                      10        20        30        40        50        60
m647.pep     MQRLAADGIQIFFVSVDGQFALRINGLVKERARTVFFGKVCRCFEQVILYGFKGTVGQTE
             |||||||||||||:|||||||||||||||||||:||||||||||||||||||||||||||
g647         MQRLAADGIQIFFVGVDGQFALRINGLVKERARSVFFGKVCRCFEQVILYGFKGTVGQTE
                      10        20        30        40        50        60

                      70        80        90       100
m647.pep     RGTVAVADTVFRQIISIVNHADAERTAAHSRGTRGFYRISLIIX
             ||||||||||||||:::|:  :||||||:|||||||||||||||
g647         RGTVAVADTVFRQIVGVVDDTDAERTAVHSRGTRGFYRISLIIX
                      70        80        90       100
```

The following partial DNA sequence was identified in *N. meningitidis* <SEQ ID 2085>:

```
a647.seq
   1 GTGCAAAGGC TCGTTACACA CAGCGTCCAA GTCTTTTTTG TAGGTGTCGA

  51 TGGGCAGTTT GCCTTGCGAA TAAACGGTTT GGTTAAAGAG CGTGCACGCA

 101 CCGTATTCTT TGGCAAGGTT TGCCGATGCT TTGAGCAGGT AATACTGTAT

 151 GGCTTCAAAG GTACGGTGGG TCAGACCGAG CGCGGAGCCG TCGCTGTAGC

 201 GGACACCGTT TTTCGCCAAA TAATACGCAT AGTTGATCAC GCCGATACCG

 251 AGCGAACGGC GGCCCATAGT GGAGGTACGC GCGGCTTCTA CCGGATATCC

 301 CTGATAATCT AA
```

This corresponds to the amino acid sequence <SEQ ID 2086; *ORF* 647.a>:

```
m647.pep

       1     VQRLVTHSVQ VFFVGVDGQF ALRINGLVKE RARTVFFGKV CRCFEQVILY

      51     GFKGTVGQTE RGAVAVADTV FRQIIRIVDH ADTERTAAHS GGTRGFYRIS

     101     LII*

m647/a647    87.4% identity in 103 aa overlap

                      10        20        30        40        50        60
m647.pep     MQRLAADGIQIFFVSVDGQFALRINGLVKERARTVFFGKVCRCFEQVILYGFKGTVGQTE
             :|||::  ::|:|||:||||||||||||||||||||||||||||||||||||||||||||
a647         VQRLVTHSVQVFFVGVDGQFALRINGLVKERARTVFFGKVCRCFEQVILYGFKGTVGQTE
                      10        20        30        40        50        60
```

-continued

```
                   70         80         90        100
m647.pep    RGTVAVADTVFRQIISIVNHADAERTAAHSRGTRGFYRISLIIX
            ||:||||||||||||| ||:|||:||||||| |||||||||||||
a647        RGAVAVADTVFRQIIRIVDHADTERTAAHSGGTRGFYRISLIIX
                   70         80         90        100
```

The following partial DNA sequence was identified in *N. gonorrhoeae* <SEQ ID 2087>:

```
g648.seq
   1 ATGAACAGGC GCAACGCGCG GATCGAACGG GCTGTGCGTA TTGCAGTGAT

  51 CGACGTTTTG AATGTAGATG CGCCCGGTCC CGGCACGCTC CTGCATCAGC

 101 GTGGAAAACA GGTCGGCAGC CGGAATGATA CGCTTGCGTA TGTTCGGGTC

 151 TTGCTCGTAT TTCGTATAGA GCCGCTCAAA TTCGTCTTGG TCGGCAAAAA

 201 ACGCTTCGTA CAACCCCGAA ACCTCGTTGG GCGAAAACAG CGTAATGTTG

 251 CCGCCCTTAA TCAGGCGGGT GTACAGCAGG CGGTTGATTT GCACGCCATA

 301 ATCAAGCTGG CGGATACGGT TGTCTTCCAC GCCCCGGTTG TTTTTCAACA

 351 CCAGCAGGCT TTCGGCTTCA ATATGCCACA AGGGGTAGAA CAAGGTTGCC

 401 GCGCCGCCGC GCACGCCACC TTGCGAACAA GATTTGACCG CCGCCTGAAA

 451 CATCTTAAAG AAGGGAATGC AGCCGGTATG CCGGGCTTCA CCGCCCCGGA

 501 TTTCGCTGTC CAGCCCGCGG ATACGTCCGG CATTGATGCC GATGCCCGCG

 551 CGTTGGGAAA CGTATTTCAC AATCGCGCTG GTAGTGGCAT TGATGGAATC

 601 CAAACTATCG TCGCATTCAA TCAGCACACA GCTTGA
```

This corresponds to the amino acid sequence <SEQ ID 2088; *ORF* 648.ng>:

```
g648.pep
   1 MNRRNARIER AVRIAVIDVL NVDAPGPGTL LHQRGKQVGS RNDTLAYVRV

  51 LLVFRIEPLK FVLVGKKRFV QPRNLVGRKQ RNVAALNQAG VQQAVDLHAI

 101 IKLADTVVFH APVVFQHQQA FGFNMPQGVE QGCRAAAHAT LRTRFDRRLK

 151 HLKEGNAAGM PGFTAPDFAV QPADTSGIDA DARALGNVFH NRAGSGIDGI

 201 QTIVAFNQHT A*
```

The following partial DNA sequence was identified in *N. meningitidis* <SEQ ID 2089>:

```
m648.seq
   1 ATGAACAGGC GCGACGCGCG GATCGAACGG GCTGTGCGTA TTGCAGTGAT

  51 CGACGTTTTG AATGTAGATG CGCCCGGTTC CGGCACGCTC CTGCATCAGC

 101 GTGGAAAACA GGTCGGCAGC CGGAATGATG CGCTTGCGGA TATCAGGGTC

 151 TTGCTCGTAT TTCGTATAGA GCCGCTCAAA TTCGTCTTGG TCGGCAAAAA

 201 ACGCTTCGTA CAATCCCGGA ACCTCGTTGG GCGAAAACAG CGTAATGTTG

 251 CCGCCCTTAA TCAGGCGGGT GTACAGCAGG CGGTTGATTT GCACGCCGTA

 301 ATCAAGCTGA CGGATACGGT TGTCTTCCAC ACCGCGGTTG TTTTTCAACA

 351 CCAGCAGGCT TTCGGCTTCG ATATGCCACA AGGGGTAGAA CAAGGTTGCC

 401 GCGCCGCCGC GCACGCCGCC TTGCGAACAG GATTTGACCG CCGCCTGAAA
```

-continued

```
451 CATTTTAAAG AAGGGAATGC AGCCGGTATG CCGCGCTTCG CCGCCCCGGA

501 TTTCGCTGTC CAAACCGCGG ATACGTCCGG CATTGATGCC GATGCCCGCA

551 CGCTGGGAAA CGTATTTCAC AATCGCGCTG GTAGTGGCAT TGATGGAATC

601 CAAACTATCG TCGCATTCAA TCAGCACACA GCTTGA
```

This corresponds to the amino acid sequence <SEQ ID 2090; *ORF* 648>:

```
m648.pep

      1    MNRRDARIER AVRIAVIDVL NVDAPGSGTL LHQRGKQVGS RNDALADIRV

     51    LLVFRIEPLK FVLVGKKRFV QSRNLVGRKQ RNVAALNQAG VQQAVDLHAV

    101    IKLTDTVVFH TAVVFQHQQA FGFDMPQGVE QGCRAAAHAA LRTGFDRRLK

    151    HFKEGNAAGM PRFAAPDFAV QTADTSGIDA DARTLGNVFH NRAGSGIDGI

    201    QTIVAFNQHT A*

m648/g648  91.5% identity in 211 aa overlap

                   10        20        30        40        50        60
m648.pep   MNRRDARIERAVRIAVIDVLNVDAPGSGTLLHQRGKQVGSRNDALADIRVLLVFRIEPLK
           ||||:|||||||||||||||||||| |||||||||||||||:|| :||||||||||||
g648       MNRRNARIERAVRIAVIDVLNVDAPGPGTLLHQRGKQVGSRNDTLAYVRVLLVFRIEPLK
                   10        20        30        40        50        60

                   70        80        90       100       110       120
m648.pep   FVLVGKKRFVQSRNLVGRKQRNVAALNQAGVQQAVDLHAVIKLTDTVVFHTAVVFQHQQA
           |||||||||| |||||||||||||||||||||||||:|||:||||||: |||||||
g648       FVLVGKKRFVQPRNLVGRKQRNVAALNQAGVQQAVDLHAIIKLADTVVFHAPVVGQHQQA
                   70        80        90       100       110       120

                  130       140       150       160       170       180
m648.pep   FGFDMPQGVEQGCRAAAHAALRTGFDRRLKHFKEGNAAGMPRFAAPDFAVQTADTSGIDA
           |||:||||||||||||||:||| ||||||:|||||||||| |:||||||| ||||||||
g648       FGFNMPQGVEQGCRAAAHATLRTRFDRRLKHLKEGNAAGMPGFTAPDFAVQPADTSGIDA
                  130       140       150       160       170       180

                  190       200       210
m648.pep   DARTLGNVFHNRAGSGIDGIQTIVAFNQHTAX
           |||:||||||||||||||||||||||||||||
g648       DARALGNVFHNRAGSGIDGIQTIVAFNQHTAX
                  190       200       210
```

The following partial DNA sequence was identified in *N. meningitidis* <SEQ ID 2091>:

```
a648.seq
  1 ATGAACAGGC GCAACGCGCG GATCGAACGG GCTGTGCGTA TTGCAGTGAT

 51 CGACGTTTTG AATGTAGATG CGCCCGGTTC CGGCACGCTC CTGCATCAGC

101 GTGGAAAACA GGTCGGCAGC CGGAATGATG CGCTTGCGGA TATCAGGGTC

151 TTGCTCGTAT TTCGTATAGA GCCGCTCAAA TTCGTCTTGG TCGGCAAAAA

201 ACGCTTCGTA CAATCCCGGA ACCTCGTTGG GCGAAAACAG CGTAATGTTG

251 CCGCCCTTAA TCAGGCGGGT GTACAGCAGG CGGTTGATTT GCACGCCGTA

301 ATCAAGCTGA CGGATACGGT TGTCTTCCAC GCCCCGGTTG TTTTTCAACA

351 CCAGCAGGCT TTCGGCTTCG ATATGCCACA AGGGGTAGAA CAAGGTTGCC

401 GCGCCGCCGC GCACGCCACC TTGCGAACAG GATTTGACTG CCGCCTGAAA

451 CATTTTAAAG AAGGGAATGC AGCCGGTATG CCGTGCTTCG CCGCCCCGGA

501 TTTCGCTGTC CAGTCCGCGG ATACGTCCGG CATTGATGCC GATGCCCGCA

551 CGCTGGGAAA CGTATTTCAC AATCGCGCTG GTAGTGGCGT TGATGGAATC

601 CAGGCTGTCG TCGCATTCGA TCAATACGCA GCTTGA
```

This corresponds to the amino acid sequence <SEQ ID 2092; *ORF* 648.a>:

```
a648.pep

      1     MNRRDARIER AVRIAVIDVL NVDAPGSGTL LHQRGKQVGS RNDALADIRV

     51     LLVFRIEPLK FVLVGKKRFV QSRNLVGRKQ RNVAALNQAG VQQAVDLHAV

    101     IKLTDTVVFH APVVGQHQQA FGFDMPQGVE QGCRAAAHAT LRTGFDCRLK

    151     HFKEGNAAGM PCFAAPDFAV QSADTSGIDA DARTLGNVFH NRAGSGVDGI

    201     QAVVAFDQYA A*

m648/a648   93.8% identity in 211 aa overlap

                    10        20        30        40        50        60
m648.pep    MNRRDARIERAVRIAVIDVLNVDAPGSGTLLHQRGKQVGSRNDALADIRVLLVFRIEPLK
            ||||:|||||||||||||||||||||||||||||||||||||||||||||||||||||||
a648        MNRRNARIERAVRIAVIDVLNVDAPGPGTLLHQRGKQVGSRNDALADIRVLLVFRIEPLK
                    10        20        30        40        50        60

                    70        80        90       100       110       120
m648.pep    FVLVGKKRFVQSRNLVGRKQRNVAALNQAGVQQAVDLHAVIKLTDTVVFHTAVVFQHQQA
            ||||||||||||||||||||||||||||||||||||||||||||||||||: |||||||
a648        FVLVGKKRFVQSRNLVGRKQRNVAALNQAGVQQAVDLHAVIKLTDTVVFHAPVVFQHQQA
                    70        80        90       100       110       120

                   130       140       150       160       170       180
m648.pep    FGFDMPQGVEQGCRAAAHAALRTGFDRRLKHFKEGNAAGMPRFAAPDFAVQTADTSGIDA
            ||||||||||||||||||:|||||| |||||||||||||| ||||||||:||||||||
a648        FGFNMPQGVEQGCRAAAHATLRTRFDCRLKHLKEGNAAGMPCFTAPDFAVQSADTSGIDA
                   130       140       150       160       170       180

                   190       200       210
m648.pep    DARTLGNVFHNRAGSGIDGIQTIVAFNQHTAX
            ||||||||||||||||:||||::|||:|::||
a648        DARTLGNVFHNRAGSGVDGIQAVVAFDQYAAX
                   190       200       210
```

The following partial DNA sequence was identified in *N. gonorrhoeae* <SEQ ID 2093>:

```
g649.seq
   1 ATGCTTGCCA TACTGTTGTC TGCAATACTG GGACTGGTAT CAACAACTGC

  51 CGCTGCCGGT ACGTCAGAAC CCGCCCACCG ACATACCAAA CATATCAGCA

 101 AGGCAAACAA GCAGATGCTG CACCCCGAAT GCAGGAAATA TTTGGAACGC

 151 CGTGCCGCGT GGTACCGATC GCAAGGCAAC GTGCAGGAAT TGCGCGAAAA

 201 CAAAAAGGCG CGCAAAGCAT TCCGCACCCT GCCTTATGCG GAACAGAAAA

 251 TCCAATGCCG GGCGGCTTAT GAGGCTTTCG ATGATTTCGA CGGCGGCAGG

 301 TTCCGCCGTT AA
```

This corresponds to the amino acid sequence <SEQ ID 2094; ORF 649.ng>:

```
g649.pep
   1 MLAILLSAIL GLVSTTAAAG TSEPAHRHTK HISKANKQML HPECRKYLER

  51 RAAWYRSQGN VQELRENKKA RKAFRTLPYA EQKIQCRAAY EAFDDFDGGR

 101 FRR*
```

The following partial DNA sequence was identified in *N. meningitidis* <SEQ ID 2095>:

```
m649.seq
   1 ATGCTTGCCA TACTGTTGTC TGCAATATTG GGACTGGTAT CGACAACTGC

  51 CGCTGCCGGT ACGTCAGAAC CCGCCCACCG CGATACCAAA CATATCCGCA
```

-continued

```
101 AGGCAAACAA GCAGATGCTG CACCCCGAAT GCAGGAAATA TTTGGAACGC

151 CGTGCCGCGT GGTACCGATC GCAAGGCAAC GTGCAGGAAT TGCGCGAAAA

201 CAAAAAGGCG CGCAAAGCAT TCCGCTCCCT GCCTTATGCG GAACAGAAAA

251 TCCAATGCCG GGCGGCTTAT GAGGCTTTCG ATGATTTCGA CGGCGGCAGT

301 TTCCGCCGTT AA
```

This corresponds to the amino acid sequence <SEQ ID 2096; *ORF* 649>:

```
m649.pep

      1     MLAILLSAIL GLVSTTAAAG TSEPAHRDTK HIRKANKQML HPECRKYLER

     51     RAAWYRSQGN VQELRENKKA RKAFRSLPYA EQKIQCRAAY EAFDDFDGGS

    101     FRR*

m649/g649   96.1% identity in 103 aa overlap

                    10        20        30        40        50        60
m649.pep    MLAILLSAILGLVSTTAAAGTSEPAHRDTKHIRKANKQMLHPECRKYLERRAAWYRSQGN
            |||||||||||||||||||||||||| |||| |||||||||||||||||||||||||||||
g649        MLAILLSAILGLVSTTAAAGTSEPAHRHTKHISKANKQMLHPECRKYLERRAAWYRSQGN
                    10        20        30        40        50        60

                    70        80        90       100
m649.pep    VQELRENKKARKAFRSLPYAEQKIQCRAAYEAFDDFDGGSFRRX
            ||||||||||||||:||||||||||||||||||||||| ||||
g649        VQELRENKKARKAFRTLPYAEQKIQCRAAYEAFDDFDGGRFRRX
                    70        80        90       100
```

The following partial DNA sequence was identified in *N. meningitidis* <SEQ ID 2097>:

```
a649.seq
  1 ATGCTTGCCA TACTGTTGTC TGCAATATTG GGACTGGTAT CGACAACTGC

 51 CGCTGCCGGT ACGTCAGAAC CCGCCCACCG CGATACCAAA CATATCCGCA

101 AGGCAAACAA GCAGATGCTG CACCCCGAAT GCAGGAAATA TTTGGAACGC

151 CGTGCCGCGT GGTACCGATC GCAAGGCAAC GTGCAGGAAT TGCGCGAAAA

201 CAAAAAGGCG CGCAAAGCAT TCCGCTCCCT GCCTTATAAG GAACAGAAAA

251 CCCAATGCCG GGCGGCTTAT GAGGCTTTCG ATGATTTCGA CGGCAGCAGG

301 TTCCGCCGTT AA
```

This corresponds to the amino acid sequence <SEQ ID 2098; *ORF* 649.a>:

```
a649.pep

      1 MLAILLSAIL GLVSTTAAAG TSEPAHRDTK HIRKANKQML HPECRKYLER

     51 RAAWYRSQGN VQELRENKKA RKAFRSLPYK EQKTQCRAAY EAFDDFDGSR

    101 FRR*

m649/a649  96.1% identity in 103 aa overlap

                    10        20        30        40        50        60
m649.pep    MLAILLSAILGLVSTTAAAGTSEPAHRDTKHIRKANKQMLHPECRKYLERRAAWYRSQGN
            ||||||||||||||||||||||||||||||||||||||||||||||||||||||||||||
a649        MLAILLSAILGLVSTTAAAGTSEPAHRDTKHIRKANKQMLHPECRKYLERRAAWYRSQGN
                    10        20        30        40        50        60
```

-continued

```
                70        80        90        100
m649.pep    VQELRENKKARKAFRSLPYAEQKIQCRAAYEAFDDFDGGSFRRX
            |||||||||||||||||| ||| ||||||||||||||: ||||
a649        VQELRENKKARKAFRSLPYKEQKEQCRAAYEAFDDFDGSRFRRX
                70        80        90        100
```

The following partial DNA sequence was identified in *N. gonorrhoeae* <SEQ ID 2099>:

```
g650.seq
   1 ATGTCCAAAC TCAAAACCAT CGCCCTGACC GCATCAGGTC TGTCCGTTTG

  51 TCCGGGTTTC CTATATGCCC AAAACACCTC ATCACACCAA GTCGGTTTAG

 101 CGATTATGCG GTTAAACTCT TCAATACTCG ACCTGCCACC GACAAAACAA

 151 TATTTCCAAT CCGGCAGCCT GTGGGACGAG CTGCGCCAAG GCTTCCGGAT

 201 GGGCGAAGTC AATCCCGAAC TGGTACGCCG CCACGAAAGC AAATTCATCG

 251 CAAGCCGCAG CTATTTCGAC AGGGTCGTCA ACCGGAGCCG ACCCTATATG

 301 TACCATATCG CCAACGAAGT CAAAAAACGC AATATGCCCG CCGAAGCCGC

 351 CCTGCTTCCC TTCATCGAAA GCGCGTTCGT CACCAAAGCC AAATCACACG

 401 TCGGCGCATC GGGCCTGTGG CAGTTCATGC CCGCTACCGG CAGGCATTAC

 451 GGCTTGGAAA AAACaccgGT TTACGacggc aggcacGacg TTtacgcaGc

 501 taccgatgcc gcacTCAACT AtctGcAATA TCTCTAtggA CTGTTCGGCG

 551 ACTGGCCGCT CGCCTTTGCC GCCTACAACT GGGGTGAAGG CAACGTCGGA

 601 CGCGCCGTCA ACCGCGCCCG CGACCAAGGG CTCGAACCGA CCTACGAAAA

 651 CCTGCGTATG CCCAACGAAA CGCGCAACTA TGTCCCCAAG CTGCTCGCCG

 701 TGCGCAACAT TATTGCCACC CCCCAATCTT TCGGCATGAA TATCAGCGAC

 751 ATAGACAACA AACCCTATTT TCAGGCAGTC GAACCGGGCC GTCCGCTCGA

 801 caacGAagcC ATCGCCCGGC TTGCCGGCAT CACGCAAAGC GAGCTGCTCG

 851 CCCTGAATCC TGCATTCAAC GTCCCCGCgt tcatCCCCAA AAAcaaacgc

 901 aaacTGCTGC TTCCTGTCGC GTCCGTCCAA ACCTTccaaa gcaACTACCT

 951 CAACGCCGCA CCCGACAGCC TGTTTTCATG GGAAGTCTAT ACGCCTGCCG

1001 CCAAAACCAG CCTGTCCGAC ATCTCGACGG CAACCGGCAT GAGCATTGCC

1051 GACATCAAAC GCCTCAACAA CCTGAACGGC AACCTTGTCA ACGCAGGACG

1101 CAGCATCCTT GTCGCCAAGA ACGGCAAGAC CCTTCATACG GCATCGGAat

1151 ccGTCGTTTC CATCGACATC GACAATACGC CcgacacCTa ccgttccaaT

1201 ATGCcggcag gcaCGGTGAA CGTCAGCATt gccCgaatcc aacCCgccgc

1251 cgcaCAGACA gcggacatta ccgtcgcacc tttgccgcaa gaaaccgtcc

1301 gtacgggaac ccgatcccct tgtccgcaTt accgaacccg ccctTGCGAC

1351 AGCCGCAGCg CaacctCAAA ccgAAAAACA GACTGCCATG CcgtctGA
```

This corresponds to the amino acid sequence <SEQ ID 2100; ORF 650.ng>:

g650.pep

```
  1 MSKLKTIALT ASGLSVCPGF LYAQNTSSHQ VGLAIMRLNS SILDLPPTKQ

 51 YFQSGSLWDE LRQGFRMGEV NPELVRRHES KFIASRSYFD RVVNRSRPYM

101 YHIANEVKKR NMPAEAALLP FIESAFVTKA KSHVGASGLW QFMPATGRHY
```

-continued

```
151 GLEKTPVYDG RHDVYAATDA ALNYLQYLYG LFGDWPLAFA AYNWGEGNVG

201 RAVNRARDQG LEPTYENLRM PNETRNYVPK LLAVRNIIAT PQSFGMNISD

251 IDNKPYFQAV EPGRPLDNEA IARLAGITQS ELLALNPAFN VPAFIPKNKR

301 KLLLPVASVQ TFQSNYLNAA PDSLFSWEVY TPAAKTSLSD ISTATGMSIA

351 DIKRLNNLNG NLVNAGRSIL VAKNGKTLHT ASESVVSIDI DNTPDTYRSN

401 MPAGTVNVSI ARIQPAAAQT ADITVAPLPQ ETVRTGTRSP CPHYRTRPCD

451 SRSATSNRKT DCHAV*
```

The following partial DNA sequence was identified in *N. meningitidis* <SEQ ID 2101>:

```
m650.seq
   1 ATGTCCAAAC TCAAAACCAT CGCTCTGACC GCATCAGGTC TGTCCGTTTG

  51 TCCGGGTTTC CTATACGCCC AAAACACCTC ATCACACCAA ATCGGTTTGG

 101 CGATTATGCG CTTAAACTCT TCAATACTCG ACCTGCCCCC GACAAAACAA

 151 TATTTCCAAT CCGGCAGCCT GTGGGGCGAG CTGCGCCAAG GCTTCCGGAT

 201 GGGCGAAGTC AATCCCGAAC TGGTACGCCG CCACGAAAGC AAATTCATCG

 251 CAAGCCACAG CTATTTCAAC AGGGTCATCA ACCGGAGTAG ACCCTATATG

 301 TACCATATCG CCAACGAAGT CAAAAAACGC AATATGCCCG CCGAAGCCGC

 351 CCTGCTTCCC TTCATCGAAA GCGCGTTCGT CACCAAAGCC AAATCACACG

 401 TCGGCGCATC AGGATTATGG CAGTTTATGC CCGCTACCGG CAGGCATTAC

 451 GGCCTGGAAA AAACACCGGT TTACGACGGC AGGCACGACG TTTACGCCGC

 501 CACCGATGCC GCACTCAACT ATCTGCAATA CCTCTATGGA CTGTTCGGCG

 551 ACTGGCCGCT TGCCTTTGCC GCCTACAACT GGGGTGAAGG CAACGTCGGA

 601 CGCGCCATCA ACCGCGCCCG CGCCCAAGGG CTCGAACCGA CCTACGAAAA

 651 CCTGCGTATG CCCAACGAAA CGCGCAACTA TGTCCCCAAG CTGCTCGCCG

 701 TGCGCAACAT TATTGCCACT CCCCAATCTT TCGGCATGAA TATCAGCGAC

 751 ATAGACAACA AACCCTATTT TCAGGCAGTC GAACCGGATC GTCCGCTCGA

 801 CAACGAAGCC ATCGCCCGGC TTGCCGGCAT CACGCAAAGC GAGCTGCTCG

 851 CCCTAAACCC CGCATTCAAC GTCCCCGCGT TTATCCCCAA AAGCAAACGC

 901 AAACTGCTGC TTCCTGTCGC GTCCGTACAA ACCTTCCAAA GCAACTACCT

 951 CAACGCCGCA CCCGACAGCC TGTTTTCATG GGAAGTCTAT ACGCCTGCCG

1001 CCAAAACCAG CCTGTCCGAC ATCTCGACGG CAACCGGCAT GAGCATTGCC

1051 GACATCAAAC GCCTCAACAA CCTGAACGGC AACCTTGTCA ACGCAGGACG

1101 CAGCATCCTT GTCGCCAAGA ACGGCAAAAC CCTTCAGACG GCATCGGAAT

1151 CCGTCGTTTC CATCGACATC GACAATACGC CCGACACCTA CCGTTCCAAT

1201 ATGCCGGCAG GCACGGTGAA CGTCGGCATT GCCCGAATCC GACCCGCCGC

1251 CGCACAGACA GCGGACATTA CCGTCGCACC TTTGCCGCAG AAAACCGTCC

1301 GTACGG.AAC CCGATCCCCT TGTCCGTATT GCCGAACCTG CCCTTGCGAC

1351 AGCCGCAGCG CAACCTCAAA CCGAAAAACA GACCGCCATG CCGTCTGA
```

This corresponds to the amino acid sequence <SEQ ID 2102; ORF 650>:

```
m650.pep

      1 MSKLKTIALT ASGLSVCPGF LYAQNTSSHQ IGLAIMRLNS SILDLPPTKQ

     51 YFQSGSLWGE LRQGFRMGEV NPELVRRHES KFIASHSYFN RVINRSRPYM

    101 YHIANEVKKR NMPAEAALLP FIESAFVTKA KSHVGASGLW QFMPATGRHY

    151 GLEKTPVYDG RHDVYAATDA ALNYLQYLYG LFGDWPLAFA AYNWGEGNVG

    201 RAINRARAQG LEPTYENLRM PNETRNYVPK LLAVRNIIAT PQSFGMNISD

    251 IDNKPYFQAV EPDRPLDNEA IARLAGITQS ELLALNPAFN VPAFIPKSKR

    301 KLLLPVASVQ TFQSNYLNAA PDSLFSWEVY TPAAKTSLSD ISTATGMSIA

    351 DIKRLNNLNG NLVNAGRSIL VAKNGKTLQT ASESVVSIDI DNTPDTYRSN

    401 MPAGTVNVGI ARIRPAAAQT ADITVAPLPQ KTVRTXTRSP CPYCRTCPCD

    451 SRSATSNRKT DRHAV*
```

```
m650/g650 96.1% identity in 465 aa overlap

                    10        20        30        40        50        60
m650.pep    MSKLKTIALTASGLSVCPGFLYAQNTSSHQIGLAIMRLNSSILDLPPTKQYFQSGSLWGE
            ||||||||||||||||||||||||||||||:||||||||||||||||||||||||||| |
g650        MSKLKTIALTASGLSVCPGFLYAQNTSSHQVGLAIMRLNSSILDLPPTKQYFQSGSLWDE
                    10        20        30        40        50        60

                    70        80        90       100       110       120
m650.pep    LRQGFRMGEVNPELVRRHESKFIASHSYFNRVINRSRPYMYHIANEVKKRNMPAEAALLP
            |||||||||||||||||||||||||:|||:||:|||||||||||||||||||||||||||
g650        LRQGFRMGEVNPELVRRHESKFIASRSYFDRVVNRSRPYMYHIANEVKKRNMPAEAALLP
                    70        80        90       100       110       120

                   130       140       150       160       170       180
m650.pep    FIESAFVTKAKSHVGASGLWQFMPATGRHYGLEKTPVYDGRHDVYAATDAALNYLQYLYG
            ||||||||||||||||||||||||||||||||||||||||||||||||||||||||||||
g650        FIESAFVTKAKSHVGASGLWQFMPATGRHYGLEKTPVYDGRHDVYAATDAALNYLQYLYG
                   130       140       150       160       170       180

                   190       200       210       220       230       240
m650.pep    LFGDWPLAFAAYNWGEGNVGRAINRARAQGLEPTYENLRMPNETRNYVPKLLAVRNIIAT
            ||||||||||||||||||||||:|||| ||||||||||||||||||||||||||||||||
g650        LFGDWPLAFAAYNWGEGNVGRAVNRARDQGLEPTYENLRMPNETRNYVPKLLAVRNIIAT
                   190       200       210       220       230       240

                   250       260       270       280       290       300
m650.pep    PQSFGMNISDIDNKPYFQAVEPDRPLDNEAIARLAGITQSELLALNPAFNVPAFIPKSKR
            |||||||||||||||||||||| |||||||||||||||||||||||||||||||||||:||
g650        PQSFGMNISDIDNKPYFQAVEPGRPLDNEAIARLAGITQSELLALNPAFNVPAFIPKNKR
                   250       260       270       280       290       300

                   310       320       330       340       350       360
m650.pep    KLLLPVASVQTFQSNYLNAAPDSLFSWEVYTPAAKTSLSDISTATGMSIADIKRLNNLNG
            ||||||||||||||||||||||||||||||||||||||||||||||||||||||||||||
g650        KLLLPVASVQTFQSNYLNAAPDSLFSWEVYTPAAKTSLSDISTATGMSIADIKRLNNLNG
                   310       320       330       340       350       360

                   370       380       390       400       410       420
m650.pep    NLVNAGRSILVAKNGKTLQTASESVVSIDIDNTPDTYRSNMPAGTVNVGIARIRPAAAQT
            ||||||||||||||||||:|||||||||||||||||||||||||||||:||||:||||||
g650        NLVNAGRSILVAKNGKTLHTASESVVSIDIDNTPDTYRSNMPAGTVNVSIARIQPAAAQT
                   370       380       390       400       410       420

                   430       440       450       460
m650.pep    ADITVAPLPQKTVRTXTRSPCPYCRTCPCDSRSATSNRKTDRHAVX
            ||||||||||:|||| ||||||: || |||||||||||||| ||||
g650        ADITVAPLPQETVRTGTRSPCPHYRTRPCDSRSATSNRKTDCHAVX
                   430       440       450       460
```

The following partial DNA sequence was identified in *N. meningitidis* <SEQ ID 2103>:

```
a650.seq
     1  ATGTCCAAAC TCAAAACCAT CGCCCTGACC GCGTCAGGTC TGTCCGTTTG

    51  TCCGGGTTTC CTATACGCCC AAAACACCTC ATCACACCAA ATCGGTTTGG

   101  CGATTATGCG CTTAAACTCT TCAATACTCG ACCTGCCACC GACAAAACAA
```

-continued

```
 151 TATTTCCAAT CCGGCAGCCT GTGGAGCGAG CTGCGCCAAG GCTTCCGGAT
 201 GGGCGAAGTC AATCCCGAAC TGGTACGCCG CCACGAAAGC AAATTCATCG
 251 CAAGCCACAG CTATTTCAAC AGGGTCATCA ACCGGAGTAG ACCCTATATG
 301 TACCATATCG CCAACGAAGT CAAAAAACGC AATATGCCCG CCGAAGCCGC
 351 CCTGCTTCCC TTCATCGAAA GCGCGTTCGT CACCAAAGCC AAATCACACG
 401 TCGGCGCATC GGGCCTGTGG CAGTTCATGC CCGCTACCGG CAGGCATTAC
 451 GGCCTGGAAA AAACACCGGT TTACGACGGC AGGCACGACA TTTACGCCGC
 501 CACCGATGCC GCACTCAACT ATCTGCAATA CCTCTATGGA CTGTTCGGCG
 551 ACTGGCCGCT CGCCTTTGCC GCCTACAACT GGGGTGAAGG CAACGTCGGA
 601 CGCGCCATCA ACCGCGCCCG CGCCCAAGGG CTCGAACCGA CCTACGAAAA
 651 CCTGCGTATG CCCAACGAAA CGCGCAACTA TGTTCCCAAG CTGCTCGCCG
 701 TGCGCAACAT CATTGCCGCC CCCCAATCTT TCGGCATGAA TATCAGCGAC
 751 ATAGACAACA AACCGTATTT TCAGGCAGTC GAACCGGACC GTCCGCTCGA
 801 CAACGAAGCC ATCGCCCGGC TTGCCGGCAT CACGCAAAGC GAGCTGCTCG
 851 CCCTAAACCC CGCATTCAAC GTCCCCGCGT TCATCCCCAA AAGCAAACGC
 901 AAACTGCTGC TTCCTGTCGC GTCCGTACAA ACCTTCCAAA GCAACTACCT
 951 CAACGCCGCA CCCGACAGCC TGTTTTCATG GGAAGTCTAT ACGCCTGCCG
1001 CCAAAACCAG CTTGTCCGAC ATCTCGACGG CAACCGGCAT GAGCATTGCC
1051 GACATCAAAC GCCTCAACAA CCTGAACGGC AACCTTGTCA ACGCAGGACG
1101 CAGCATCCTT GTCGCCAAGA ACGGCAAAAC CCTTCAGACG GCATCGGAAT
1151 CCGTCGTTTC CATCGACATC GACAATACGC CCAACACCTA CCGTTCCAAT
1201 ATGCCGGCAG GCACGGTGAA CGTCGGCATT GCCCGAATCC GACCCGCCGC
1251 CGCACAGACA GCGGACATTA CCGTCGCACC TTTGCCGCAG AAAACCGTCC
1301 GTACGG.AAC CCGATCCCCT TGTCCGTATT GCCGAACCTG CCCTTGCGAC
1351 AGCCGCAGCG CAACCTCAAA CCGAAAAACA GACCGCCATG CCGTCTGA
```

This corresponds to the amino acid sequence <SEQ ID 2104; ORF 650.a>:

```
a650.pep

  1 MSKLKTIALT ASGLSVCPGF LYAQNTSSHQ IGLAIMRLNS SILDLPPTKQ
 51 YFQSGSLWSE LRQGFRMGEV NPELVRRHES KFIASHSYFN RVINRSRPYM
101 YHIANEVKKR NMPAEAALLP FIESAFVTKA KSHVGASGLW QFMPATGRHY
151 GLEKTPVYDG RHDIYAATDA ALNYLQYLYG LFGDWPLAFA AYNWGEGNVG
201 RAINRARAQG LEPTYENLRM PNETRNYVPK LLAVRNIIAA PQSFGMNISD
251 IDNKPYFQAV EPDRPLDNEA IARLAGITQS ELLALNPAFN VPAFIPKSKR
301 KLLLPVASVQ TFQSNYLNAA PDSLFSWEVY TPAAKTSLSD ISTATGMSIA
351 DIKRLNNLNG NLVNAGFSIL VAKNGKTLQT ASESVVSIDI DNTPNTYRSN
401 MPAGTVNVGI ARIRPAAAQT ADITVAPLPQ KTVRTXTRSP CPYCRTCPCD
451 SRSATSNRKT DRHAV*
```

-continued

```
m650/a650 99.1% identity in 465 aa overlap

                    10        20        30        40        50        60
m650.pep    MSKLKTIALTASGLSVCPGFLYAQNTSSHQIGLAIMRLNSSILDLPPTKQYFQSGSLWGE
            ||||||||||||||||||||||||||||||||||||||||||||||||||||||||||:|
a650        MSKLKTIALTASGLSVCPGFLYAQNTSSHQIGLAIMRLNSSILDLPPTKQYFQSGSLWSE
                    10        20        30        40        50        60

                    70        80        90       100       110       120
m650.pep    LRQGFRMGEVNPELVRRHESKFIASHSYFNRVINRSRPYMYHIANEVKKRNMPAEAALLP
            ||||||||||||||||||||||||||||||||||||||||||||||||||||||||||||
a650        LRQGFRMGEVNPELVRRHESKFIASHSYFNRVINRSRPYMYHIANEVKKRNMPAEAALLP
                    70        80        90       100       110       120

                   130       140       150       160       170       180
m650.pep    FIESAFVTKAKSHVGASGLWQFMPATGRHYGLEKTPVYDGRHDVYAATDAALNYLQYLYG
            |||||||||||||||||||||||||||||||||||||||||||:||||||||||||||||
a650        FIESAFVTKAKSHVGASGLWQFMPATGRHYGLEKTPVYDGRHDIYAATDAALNYLQYLYG
                   130       140       150       160       170       180

                   190       200       210       220       230       240
m650.pep    LFGDWPLAFAAYNWGEGNVGRAINRARAQGLEPTYENLRMPNETRNYVPKLLAVRNIIAT
            |||||||||||||||||||||||||||||||||||||||||||||||||||||||||||:
a650        LFGDWPLAFAAYNWGEGNVGRAINRARAQGLEPTYENLRMPNETRNYVPKLLAVRNIIAA
                   190       200       210       220       230       240

                   250       260       270       280       290       300
m650.pep    PQSFGMNISDIDNKPYFQAVEPDRPLDNEAIARLAGITQSELLALNPAFNVPAFIPKSKR
            ||||||||||||||||||||||||||||||||||||||||||||||||||||||||||||
a650        PQSFGMNISDIDNKPYFQAVEPDRPLDNEAIARLAGITQSELLALNPAFNVPAFIPKSKR
                   250       260       270       280       290       300

                   310       320       330       340       350       360
m650.pep    KLLLPVASVQTFQSNYLNAAPDSLFSWEVYTPAAKTSLSDISTATGMSIADIKRLNNLNG
            ||||||||||||||||||||||||||||||||||||||||||||||||||||||||||||
a650        KLLLPVASVQTFQSNYLNAAPDSLFSWEVYTPAAKTSLSDISTATGMSIADIKRLNNLNG
                   310       320       330       340       350       360

                   370       380       390       400       410       420
m650.pep    NLVNAGRSILVAKNGKTLQTASESVVSIDIDNTPDTYRSNMPAGTVNVGIARIRPAAAQT
            ||||||||||||||||||||||||||||||||||:|||||||||||||||||||||||||
a650        NLVNAGRSILVAKNGKTLQTASESVVSIDIDNTPNTYRSNMPAGTVNVGIARIRPAAAQT
                   370       380       390       400       410       420

                   430       440       450       460
m650.pep    ADITVAPLPQKTVRTXTRSPCPYCRTCPCDSRSATSNRKTDRHAVX
            ||||||||||||||||||||||||||||||||||||||||||||||
a650        ADITVAPLPQKTVRTXTRSPCPYCRTCPCDSRSATSNRKTDRHAVX
                   430       440       450       460
```

The following partial DNA sequence was identified in *N. gonorrhoeae* <SEQ ID 2105>:

```
g652.seq
  1  ATGATCGAAT TGGACGGTAC TGAAAACAAA GGCAATTTGG GTGCGAATGC

 51  GACTTTGGCG GTCTCTATGG CGGTTGCACG CGCCGCTGCC GAAGACTCAG

101  GCCTGCCGCT TTACCGCTAC TTGGGGGGCG CAGGTCCGAT GTCCCTGCCC

151  GTACCGATGA TGAACGTCAT CAACGGCGGC GAACACGCCA ACAACAGCCT

201  GAACATCCAA GAGTTTATGA TTATGCCCGT CGGCGCAAAA TCTTTCCGCG

251  AAGCGTTGCG CTGCGGTGCG GAAATTTTCC ACGCCTTGAA AAAACTGTGC

301  GACAGTAAAG GCTTCCCGAC CACAGTCGGC GACGAAGGCG GTTTCGCCCC

351  CAACCTGAAC AGCCACAAAG AAGCCCTGCA ACTGATGGTC GAAGCGGCCG

401  AAGCCGCCGG CTACAAGGCG GGCGAAGACG TATTATTCGC ATTGGACTGC

451  GCGTCCAGCG AGTTCTACAA AGACGGCAAA TACCACTTGG AAGCCGAAGG

501  CCGCTCCTAC ACCAACGCGG AATTTGCCGA ATACTTGGAA GGCTTGGTTA

551  ACGAATTCCC GATTATTTCC ATTGAAGACG GGATGGACGA AAACGACTGG

601  GAAGGCTGGA AACTGCTGAC CGAAAAATTG GGCAAAAAAG TTCAATTGGT

651  CGGCGACGAC TTGTTCGTAA CCAATCCGAA AATTCTTGCC GAAGGCATCG

701  AAAAAGGCGT AGCAAACGCA TTGCTGGTCA AAGTCAACCA AATCGGTACT
```

-continued

```
 751 TTAAGCGAAA CCCTGAAAGc cgtcgatctg gCAAAATGCA accgctacGc

 801 cagCGTGATG AGCCAccgct ccggCGAAAC CGAAGACAGT Accattgccg

 851 ACTTGGCAGT CGCCACCAAC TGTATGCAGA TTAAAAccgG TTCTTTGAGc

 901 cgTTCCGACC GCATGGCGAA ATACAACCAa ctGCTGCGTA TCGAGGAAGA

 951 ATTGGCGGAA GCcgcctACT ACCCCGGCAA AGCCGCATTC TACCAACTGG

1001 GCAAATAA
```

This corresponds to the amino acid sequence <SEQ ID 2106; ORF 652.ng>:

```
g652.pep
  1 MIELDGTENK GNLGANATLA VSMAVARAAA EDSGLPLYRY LGGAGPMSLP

 51 VPMMNVINGG EHANNSLNIQ EFMIMPVGAK SFREALRCGA EIFHALKKLC

101 DSKGFPTTVG DEGGFAPNLN SHKEALQLMV EAAEAAGYKA GEDVLFALDC

151 ASSEFYKDGK YHLEAEGRSY TNAEFAEYLE GLVNEFPIIS IEDGMDENDW

201 EGWKLLTEKL GKKVQLVGDD LFVTNPKILA EGIEKGVANA LLVKVNQIGT

251 LSETLKAVDL AKCNRYASVM SHRSGETEDS TIADLAVATN CMQIKTGSLS

301 RSDRMAKYNQ LLRIEEELAE AAYYPGKAAF YQLGK*
```

The following partial DNA sequence was identified in *N. meningitidis* <SEQ ID 2107>:

```
m652.seq
   1 ATGATCGAAT TGGACGGTAC TGAAAACAAA GGCAATTTGG GTGCGAATGC

  51 GACTTTGGCG GTTTCTATGG CGGTTGCACG CGCCGCTGCC GAAGACTCAG

 101 GCCTGCCGCT TTACCGCTAC TTGGGCGGCG CAGGCCCGAT GTCCCTGCCC

 151 GTACCGATGA TGAACGTCAT CAACGGCGGC GAACACGCCA ACAACAGCCT

 201 GAACATCCAA GAGTTTATGA TTATGCCCGT CGGCGCAAAA TCTTTCCGCG

 251 AAGCGTTGCG CTGCGGTGCG GAAATTTTCC ACGCCTTGAA AAAACTGTGC

 301 GACAGCAAAG GCTTCCCGAC CACAGTCGGC GACGAAGGCG GTTTCGCCCC

 351 CAACCTGAAC AGCCACAAAG AAGCCCTGCA ACTGATGGTC GAGGCGACCG

 401 AAGCCGCCGG CTACAAAGCG GGCGAAGACG TATTATTCGC ATTGGACTGC

 451 GCCTCCAGCG AGTTCTACAA AGACGGCAAA TACCACTTGG AAGCCGAAGG

 501 CCGCTCCTAC ACCAACGCGG AATTTGCCGA ATATCTGGAA GGCCTGGTCA

 551 ACGAGTTCCC CATCATCTCC ATCGAAGACG GCATGGATGA AAACGACTGG

 601 GAAGGCTGGA AACTGCTGAC CGAAAAACTG GGCGGTAGAG TTCAATTGGT

 651 TGGCGACGAC TTGTTCGTAA CCAATCCAAA AATCTTGGCC GAAGGCATCG

 701 AAAAAGGCGT AGCAAACGCA TTGCTGGTCA AAGTCAATCA AATCGGTACT

 751 TTGAGCGAGA CCCTGAAAGC CGTCGACTTA GCCAAACGCA ACCGCTACGC

 801 CAGCGTAATG AGCCACCGCT CCGGCGAAAC CGAAGACAGC ACCATTGCCG

 851 ACTTGGCAGT CGCCACCAAC TGTATGCAGA TCAAAACCGG TTCTTTGAGC

 901 CGTTCCGACC GCATGGCGAA ATACAACCAA CTGCTGCGTA TCGAGGAAGA

 951 ATTGGCGGAA GCCGCCGACT ACCCCAGCAA AGCCGCATTC TACCAACTGG

1001 GCAAATAA
```

This corresponds to the amino acid sequence <SEQ ID 2108; ORF 652>:

```
m652.pep

      1 MIELDGTENK GNLGANATLA VSMAVARAAA EDSGLPLYRY LGGAGPMSLP

     51 VPMMNVINGG EHANNSLNIQ EFMIMPVGAK SFREALRCGA EIFHALKKLC

    101 DSKGFPTTVG DEGGFAPNLN SHKEALQLMV EATEAAGYKA GEDVLFALDC

    151 ASSEFYKDGK YHLEAEGRSY TNAEFAEYLE GLVNEFPIIS IEDGMDENDW

    201 EGWKLLTEKL GGRVQLVGDD LFVTNPKILA EGIEKGVANA LLVKVNQIGT

    251 LSETLKAVDL AKRNRYASVM SHRSGETEDS TIADLAVATN CMQIKTGSLS

    301 RSDRMAKYNQ LLRIEEELAE AADYPSKAAF YQLGK*
```

```
m652/g652 98.2% identity in 335 aa overlap

                      10        20        30        40        50        60
m652.pep    MIELDGTENKGNLGANATLAVSMAVARAAAEDSGLPLYRYLGGAGPMSLPVPMMNVINGG
            ||||||||||||||||||||||||||||||||||||||||||||||||||||||||||||
g652        MIELDGTENKGNLGANATLAVSMAVARAAAEDSGLPLYRYLGGAGPMSLPVPMMNVINGG
                      10        20        30        40        50        60

                      70        80        90       100       110       120
m652.pep    EHANNSLNIQEFMIMPVGAKSFREALRCGAEIFHALKKLCDSKGFPTTVGDEGGFAPNLN
            ||||||||||||||||||||||||||||||||||||||||||||||||||||||||||||
g652        EHANNSLNIQEFMIMPVGAKSFREALRCGAEIFHALKKLCDSKGFPTTVGDEGGFAPNLN
                      70        80        90       100       110       120

                     130       140       150       160       170       180
m652.pep    SHKEALQLMVEATEAAGYKAGEDVLFALDCASSEFYKDGKYHLEAEGRSYTNAEFAEYLE
            ||||||||||||:||||||||||||||||||||||||||||||:||||||||||||||||
g652        SHKEALQLMVEAAEAAGYKAGEDVLFALDCASSEFYKDGKYHLEAEGRSYTNAEFAEYLE
                     130       140       150       160       170       180

                     190       200       210       220       230       240
m652.pep    GLVNEFPIISIEDGMDENDWEGWKLLTEKLGGRVQLVGDDLFVTNPKILAEGIEKGVANA
            ||||||||||||||||||||||||||||||| :|||||||||||||||||||||||||||
g652        GLVNEFPIISIEDGMDENDWEGWKLLTEKLGKKVQLVGDDLFVTNPKILAEGIEKGVANA
                     190       200       210       220       230       240

                     250       260       270       280       290       300
m652.pep    LLVKVNQIGTLSETLKAVDLAKRNRYASVMSHRSGETEDSTIADLAVATNCMQIKTGSLS
            |||||||||||||||||||||| |||||||||||||||||||||||||||||||||||||
g652        LLVKVNQIGTLSETLKAVDLAKCNRYASVMSHRSGETEDSTIADLAVATNCMQIKTGSLS
                     250       260       270       280       290       300

                     310       320       330
m652.pep    RSDRMAKYNQLLRIEEELAEAADYPSKAAFYQLGKX
            ||||||||||||||||||||||||||||||||||||
g652        RSDRMAKYNQLLRIEEELAEAADYPSKAAFYQLGKX
                     310       320       330
```

The following partial DNA sequence was identified in *N. meningitidis* <SEQ ID 2109>:

```
a652.seq
    1  ATGATCGAAT TGGACGGTAC TGAAAACAAA GGCAATTTGG GTGCGAATGC

   51  GACTTTGGCG GTTTCTATGG CGGTTGCACG CGCCGCTGCC GAAGACTCAG

  101  GCCTGCCGCT TTACCGCTAC TTGGGCGGCG CAGGCCCGAT GTCCCTGCCC

  151  GTACCGATGA TGAACGTCAT CAACGGCGGC GAACACGCCA ACAACAGCCT

  201  GAACATCCAA GAGTTTATGA TTATGCCCGT CGGCGCAAAA TCTTTCCGCG

  251  AAGCGTTGCG CTGCGGTGCG GAAATTTTCC ACGCCTTGAA AAAACTGTGC

  301  GACAGCAAAG GCTTCCCGAC CACAGTCGGC GACGAAGGCG GTTTCGCCCC

  351  CAACCTGAAC AGCCACAAAG AAGCCCTGCA ACTGATGGTC GAGGCGACCG

  401  AAGCCGCCGG CTACAAAGCG GGCGAAGACG TATTATTCGC ATTGGACTGC

  451  GCGTCCAGCG AGTTCTACAA AGACGGCAAA TACCACTTGG AAGCCGAAGG

  501  CCGCTCCTAC ACCAACGCGG AATTTGCCGA ATATCTGGAA GGCCTGGTCA
```

-continued

```
 551 ACGAGTTCCC CATCATCTCC ATCGAAGACG GGATGGATGA AAACGACTGG

 601 GAAGGCTGGA AACTGCTGAC CGAAAAACTG GGCGGCAAAG TCCAACTCGT

 651 TGGCGACGAC CTCTTCGTTA CCAACCCGAA AATCCTTGCC GAAGGCATTG

 701 AAAAAGGCGT GGCAAACGCA CTATTGGTCA AAGTCAACCA AATCGGTACT

 751 TTGAGTGAAA CCCTGAAAGC CGTCGACTTA GCCAAACGCA ACCGCTACGC

 801 CAGCGTAATG AGCCACCGCT CCGGCGAAAC CGAAGACAGC ACCATTGCCG

 851 ACTTGGCAGT CGCCACCAAC TGTATGCAGA TCAAAACCGG TTCTTTGAGC

 901 CGTTCCGACC GCATGGCGAA ATACAACCAA CTGCTGCGTA TCGAGGAAGA

 951 ATTGGCGGAA GCCGCCGACT ACCCCAGCAA AGCCGCATTC TACCAACTGG

1001 GCAAATAA
```

This corresponds to the amino acid sequence <SEQ ID 2110; ORF 652.a>:

```
a652.pep

      1 MIELDGTENK GNLGANATLA VSMAVARAAA EDSGLPLYRY LGGAGPMSLP

     51 VPMMNVINGG EHANNSLNIQ EFMIMPVGAK SFREALRCGA EIFHALKKLC

    101 DSKGFPTTVG DEGGFAPNLN SHKEALQLMV EATEAAGYKA GEDVLFALDC

    151 ASSEFYKDGK YHLEAEGRSY TNAEFAEYLE GLVNEFPIIS IEDGMDENDW

    201 EGWKLLTEKL GGKVQLVGDD LFVTNPKILA EGIEKGVANA LLVKVNQIGT

    251 LSETLKAVDL AKRNRYASVM SHRSGETEDS TIADLAVATN CMQIKTGSLS

    301 RSDRMAKYNQ LLRIEEELAE AADYPSKAAF YQLGK*

m652/a652 99.7% identity in 335 aa overlap

                    10        20        30        40        50        60
m652.pep    MIELDGTENKGNLGANATLAVSMAVARAAAEDSGLPLYRYLGGAGPMSLPVPMMNVINGG
            ||||||||||||||||||||||||||||||||||||||||||||||||||||||||||||
a652        MIELDGTENKGNLGANATLAVSMAVARAAAEDSGLPLYRYLGGAGPMSLPVPMMNVINGG
                    10        20        30        40        50        60

                    70        80        90       100       110       120
m652.pep    EHANNSLNIQEFMIMPVGAKSFREALRCGAEIFHALKKLCDSKGFPTTVGDEGGFAPNLN
            ||||||||||||||||||||||||||||||||||||||||||||||||||||||||||||
a652        EHANNSLNIQEFMIMPVGAKSFREALRCGAEIFHALKKLCDSKGFPTTVGDEGGFAPNLN
                    70        80        90       100       110       120

                   130       140       150       160       170       180
m652.pep    SHKEALQLMVEATEAAGYKAGEDVLFALDCASSEFYKDGKYHLEAEGRSYTNAEFAEYLE
            ||||||||||||||||||||||||||||||||||||||||||||||||||||||||||||
a652        SHKEALQLMVEATEAAGYKAGEDVLFALDCASSEFYKDGKYHLEAEGRSYTNAEFAEYLE
                   130       140       150       160       170       180

                   190       200       210       220       230       240
m652.pep    GLVNEFPIISIEDGMDENDWEGWKLLTEKLGGRVQLVGDDLFVTNPKILAEGIEKGVANA
            ||||||||||||||||||||||||||||||||:|||||||||||||||||||||||||||
a652        GLVNEFPIISIEDGMDENDWEGWKLLTEKLGGKVQLVGDDLFVTNPKILAEGIEKGVANA
                   190       200       210       220       230       240

                   250       260       270       280       290       300
m652.pep    LLVKVNQIGTLSETLKAVDLAKRNRYASVMSHRSGETEDSTIADLAVATNCMQIKTGSLS
            |||||||||||||||||||||| |||||||||||||||||||||||||||||||||||||
a652        LLVKVNQIGTLSETLKAVDLAKCNRYASVMSHRSGETEDSTIADLAVATNCMQIKTGSLS
                   250       260       270       280       290       300

                   310       320       330
m652.pep    RSDRMAKYNQLLRIEEELAEAADYPSKAAFYQLGKX
            ||||||||||||||||||||||||||||||||||||
a652        RSDRMAKYNQLLRIEEELAEAADYPSKAAFYQLGKX
                   310       320       330
```

The following partial DNA sequence was identified in *N. gonorrhoeae* <SEQ ID 2111>:

```
g652-1.seq
     1  ATGAGCGCAA TCGTTGATAT TTTCGCCCGC GAAATTTTGG ACTCACGCGG
    51  CAACCCCACA GTCGAGTGTG ATGTATTGCT CGAATCCGGC GTAATGGGAC
   101  GTGCGGCCGT ACCGAGCGGC GCATCCACCG GTCAGAAAGA AGCTTTGGAA
   151  CTTCGCGACG GCGACAAATC CCGCTATTCC GGCAAAGGCG TATTGAAGGC
   201  CGTCGAACAC GTCAACAACC AAATCGCCCA AGCCCTCATC GGTATCGATG
   251  CCAACGAGCA ATCTTATATC GACCAAATCA TGATCGAATT GGACGGTACT
   301  GAAAACAAAG GCAATTTGGG TGCGAATGCG ACTTTGGCGG TCTCTATGGC
   351  GGTTGCACGC GCCGCTGCCG AAGACTCAGG CCTGCCGCTT TACCGCTACT
   401  TGGGGGGCGC AGGTCCGATG TCCCTGCCCG TACCGATGAT GAACGTCATC
   451  AACGGCGGCG AACACGCCAA CAACAGCCTG AACATCCAAG AGTTTATGAT
   501  TATGCCCGTC GGCGCAAAAT CTTTCCGCGA AGCGTTGCGC TGCGGTGCGG
   551  AAATTTTCCA CGCCTTGAAA AAACTGTGCG ACAGTAAAGG CTTCCCGACC
   601  ACAGTCGGCG ACGAAGGCGG TTTCGCCCCC AACCTGAACA GCCACAAAGA
   651  AGCCCTGCAA CTGATGGTCG AAGCGGCCGA AGCCGCCGGC TACAAGGCGG
   701  GCGAAGACGT ATTATTCGCA TTGGACTGCG CGTCCAGCGA GTTCTACAAA
   751  GACGGCAAAT ACCACTTGGA AGCCGAAGGC CGCTCCTACA CCAACGCGGA
   801  ATTTGCCGAA TACTTGGAAG GCTTGGTTAA CGAATTCCCG ATTATTTCCA
   851  TTGAAGACGG GATGGACGAA AACGACTGGG AAGGCTGGAA ACTGCTGACC
   901  GAAAAATTGG GCAAAAAAGT TCAATTGGTC GGCGACGACT TGTTCGTAAC
   951  CAATCCGAAA ATTCTTGCCG AAGGCATCGA AAAAGGCGTA GCAAACGCAT
  1001  TGCTGGTCAA AGTCAACCAA ATCGGTACTT TAAGCGAAAC CCTGAAAGCC
  1051  GTCGATCTGG CAAAATGCAA CCGCTACGCC AGCGTGATGA GCCACCGCTC
  1101  CGGCGAAACC GAAGACAGTA CCATTGCCGA CTTGGCAGTC GCCACCAACT
  1151  GTATGCAGAT TAAAACCGGT TCTTTGAGCC GTTCCGACCG CATGGCGAAA
  1201  TACAACCAAC TGCTGCGTAT CGAGGAAGAA TTGGCGGAAG CCGCCTACTA
  1251  CCCCGGCAAA GCCGCATTCT ACCAACTGGG CAAATAA
```

This corresponds to the amino acid sequence <SEQ ID 2112; ORF 652-1.ng>:

```
g652-1.pep
   1  MSAIVDIFAR EILDSRGNPT VECDVLLESG VMGRAAVPSG ASTGQKEALE
  51  LRDGDKSRYS GKGVLKAVEH VNNQIAQALI GIDANEQSYI DQIMIELDGT
 101  ENKGNLGANA TLAVSMAVAR AAAEDSGLPL YRYLGGAGPM SLPVPMMNVI
 151  NGGEHANNSL NIQEFMIMPV GAKSFREALR CGAEIFHALK KLCDSKGFPT
 201  TVGDEGGFAP NLNSHKEALQ LMVEAAEAAG YKAGEDVLFA LDCASSEFYK
 251  DGKYHLEAEG RSYTNAEFAE YLEGLVNEFP IISIEDGMDE NDWEGWKLLT
 301  EKLGKKVQLV GDDLFVTNPK ILAEGIEKGV ANALLVKVNQ IGTLSETLKA
 351  VDLAKCNRYA SVMSHRSGET EDSTIADLAV ATNCMQIKTG SLSRSDRMAK
 401  YNQLLRIEEE LAEAAYYPGK AAFYQLGK*
```

The following partial DNA sequence was identified in *N. meningitidis* <SEQ ID 2113>:

```
m652-1.seq
   1  ATGAGCGCAA TCGTTGATAT TTTCGCCCGC GAAATTTTGG ACTCACGCGG
  51  CAACCCCACA GTCGAGTGTG ATGTATTGCT CGAATCCGGC GTAATGGGAC
 101  GCGCAGCCGT ACCGAGCGGC GCGTCCACCG GTCAAAAAGA GGCTTTGGAA
 151  CTTCGCGACG GCGACAAATC CCGTTATTCG GGCAAGGGCG TATTGAAGGC
 201  GGTCGAACAC GTCAACAACC AAATCGCCCA AGCCCTCATT GGTATCGATG
 251  CCAACGAGCA ATCTTATATC GACCAAATCA TGATCGAATT GGACGGTACT
 301  GAAAACAAAG GCAATTTGGG TGCGAATGCG ACTTTGGCGG TTTCTATGGC
 351  GGTTGCACGC GCCGCTGCCG AAGACTCAGG CCTGCCGCTT TACCGCTACT
 401  TGGGCGGCGC AGGCCCGATG TCCCTGCCCG TACCGATGAT GAACGTCATC
 451  AACGGCGGCG AACACGCCAA CAACAGCCTG AACATCCAAG AGTTTATGAT
 501  TATGCCCGTC GGCGCAAAAT CTTTCCGCGA AGCGTTGCGC TGCGGTGCGG
 551  AAATTTTCCA CGCCTTGAAA AAACTGTGCG ACAGCAAAGG CTTCCCGACC
 601  ACAGTCGGCG ACGAAGGCGG TTTCGCCCCC AACCTGAACA GCCACAAAGA
 651  AGCCCTGCAA CTGATGGTCG AGGCGACCGA AGCCGCCGGC TACAAAGCGG
 701  GCGAAGACGT ATTATTCGCA TTGGACTGCG CCTCCAGCGA GTTCTACAAA
 751  GACGGCAAAT ACCACTTGGA AGCCGAAGGC CGCTCCTACA CCAACGCGGA
 801  ATTTGCCGAA TATCTGGAAG GCCTGGTCAA CGAGTTCCCC ATCATCTCCA
 851  TCGAAGACGG CATGGATGAA AACGACTGGG AAGGCTGGAA ACTGCTGACC
 901  GAAAAACTGG GCGGTAGAGT TCAATTGGTT GGCGACGACT TGTTCGTAAC
 951  CAATCCAAAA ATCTTGGCCG AAGGCATCGA AAAAGGCGTA GCAAACGCAT
1001  TGCTGGTCAA AGTCAATCAA ATCGGTACTT TGAGCGAGAC CCTGAAAGCC
1051  GTCGACTTAG CCAAACGCAA CCGCTACGCC AGCGTAATGA GCCACCGCTC
1101  CGGCGAAACC GAAGACAGCA CCATTGCCGA CTTGGCAGTC GCCACCAACT
1151  GTATGCAGAT CAAAACCGGT TCTTTGAGCC GTTCCGACCG CATGGCGAAA
1201  TACAACCAAC TGCTGCGTAT CGAGGAAGAA TTGGCGGAAG CCGCCGACTA
1251  CCCCAGCAAA GCCGCATTCT ACCAACTGGG CAAATAA
```

This corresponds to the amino acid sequence <SEQ ID 2114; ORF 652-1>:

```
m652-1.pep
   1  MSAIVDIFAR EILDSRGNPT VECDVLLESG VMGRAAVPSG ASTGOKEALE
  51  LRDGDKSRYS GKGVLKAVEH VNNQIAQALI GIDANEQSYI DQIMIELDGT
 101  ENKGNLGANA TLAVSMAVAR AAAEDSGLPL YRYLGGAGPM SLPVPMMNVI
 151  NGGEHANNSL NIQEFMIMPV GAKSFREALR CGAEIFHALK KLCDSKGFPT
 201  TVGDEGGFAP NLNSHKEALQ LMVEATEAAG YKAGEDVLFA LDCASSEFYK
 251  DGKYHLEAEG RSYTNAEFAE YLEGLVNEFP IISIEDGMDE NDWEGWKLLT
 301  EKLGGRVQLV GDDLFVTNPK ILAEGIEKGV ANALLVKVNQ IGTLSETLKA
 351  VDLAKRNRYA SVMSHRSGET EDSTIADLAV ATNCMQIKTG SLSRSDRMAK
 401  YNQLLRIEEE LAEAADYPSK AAFYQLGK*
```

-continued

```
m652-1/g652-1  98.6% identity in 428 aa overlap

                    10        20        30        40        50        60
m652-1      MSAIVDIFAREILDSRGNPTVECDVLLESGVMGRAAVPSGASTGQKEALELRDGDKSRYS
            ||||||||||||||||||||||||||||||||||||||||||||||||||||||||||||
g652-1      MSAIVDIFAREILDSRGNPTVECDVLLESGVMGRAAVPSGASTGQKEALELRDGDKSRYS
                    10        20        30        40        50        60

                    70        80        90       100       110       120
m652-1      GKGVLKAVEHVNNQIAQALIGIDANEQSYIDQIMIELDGTENKGNLGANATLAVSMAVAR
            ||||||||||||||||||||||||||||||||||||||||||||||||||||||||||||
g652-1      GKGVLKAVEHVNNQIAQALIGIDANEQSYIDQIMIELDGTENKGNLGANATLAVSMAVAR
                    70        80        90       100       110       120

                   130       140       150       160       170       180
m652-1      AAAEDSGLPLYRYLGGAGPMSLPVPMMNVINGGEHANNSLNIQEFMIMPVGAKSFREALR
            ||||||||||||||||||||||||||||||||||||||||||||||||||||||||||||
g652-1      AAAEDSGLPLYRYLGGAGPMSLPVPMMNVINGGEHANNSLNIQEFMIMPVGAKSFREALR
                   130       140       150       160       170       180

                   190       200       210       220       230       240
m652-1      CGAEIFHALKKLCDSKGFPTTVGDEGGFAPNLNSHKEALQLMVEATEAAGYKAGEDVLFA
            |||||||||||||||||||||||||||||||||||||||||||||:||||||||||||||
g652-1      CGAEIFHALKKLCDSKGFPTTVGDEGGFAPNLNSHKEALQLMVEAAEAAGYKAGEDVLFA
                   190       200       210       220       230       240

                   250       260       270       280       290       300
m652-1      LDCASSEFYKDGKYHLEAEGRSYTNAEFAEYLEGLVNEFPIISIEDGMDENDWEGWKLLT
            ||||||||||||||||||||||||||||||||||||||||||||||||||||||||||||
g652-1      LDCASSEFYKDGKYHLEAEGRSYTNAEFAEYLEGLVNEFPIISIEDGMDENDWEGWKLLT
                   250       260       270       280       290       300

                   310       320       330       340       350       360
m652-1      EKLGGRVQLVGDDLFVTNPKILAEGIEKGVANALLVKVNQIGTLSETLKAVDLAKRNRYA
            |||| :||||||||||||||||||||||||||||||||||||||||||||||||| ||||
g652-1      EKLGKKVQLVGDDLFVTNPKILAEGIEKGVANALLVKVNQIGTLSETLKAVDLAKCNRYA
                   310       320       330       340       350       360

                   370       380       390       400       410       420
m652-1      SVMSHRSGETEDSTIADLAVATNCMQIKTGSLSRSDRMAKYNQLLRIEEELAEAADYPSK
            ||||||||||||||||||||||||||||||||||||||||||||||||||||||| ||:|
g652-1      SVMSHRSGETEDSTIADLAVATNCMQIKTGSLSRSDRMAKYNQLLRIEEELAEAAYYPGK
                   370       380       390       400       410       420

                  429
m652-1      AAFYQLGKX
            |||||||||
g652-1      AAFYQLGKX
```

The following partial DNA sequence was identified in *N. meningitidis* <SEQ ID 2115>:

```
a652-1.seq
   1  ATGAGCGCAA TCGTTGATAT TTTCGCCCGC GAAATTTTGG ACTCACGCGG
  51  CAACCCCACA GTCGAGTGTG ATGTATTGCT CGAATCCGGC GTAATGGGAC
 101  GCGCAGCCGT ACCGAGCGGC GCGTCCACCG GTCAAAAAGA GGCTTTGGAA
 151  CTTCGCGACG GCGACAAATC CCGTTATTCG GGCAAGGGCG TATTGAAGGC
 201  GGTCGAACAC GTCAACAACC AAATCGCCCA AGCCCTCATT GGTATCGATG
 251  CCAACGAGCA ATCTTATATC GACCAAATCA TGATCGAATT GGACGGTACT
 301  GAAAACAAAG GCAATTTGGG TGCGAATGCG ACTTTGGCGG TTTCTATGGC
 351  GGTTGCACGC GCCGCTGCCG AAGACTCAGG CCTGCCGCTT TACCGCTACT
 401  TGGGCGGCGC AGGCCCGATG TCCCTGCCCG TACCGATGAT GAACGTCATC
 451  AACGGCGGCG AACACGCCAA CAACAGCCTG AACATCCAAG AGTTTATGAT
 501  TATGCCCGTC GGCGCAAAAT CTTTCCGCGA AGCGTTGCGC TGCGGTGCGG
 551  AAATTTTCCA CGCCTTGAAA AAACTGTGCG ACAGCAAAGG CTTCCCGACC
 601  ACAGTCGGCG ACGAAGGCGG TTTCGCCCCC AACCTGAACA GCCACAAAGA
 651  AGCCCTGCAA CTGATGGTCG AGGCGACCGA AGCCGCCGGC TACAAAGCGG
```

-continued

```
 701 GCGAAGACGT ATTATTCGCA TTGGACTGCG CGTCCAGCGA GTTCTACAAA

 751 GACGGCAAAT ACCACTTGGA AGCCGAAGGC CGCTCCTACA CCAACGCGGA

 801 ATTTGCCGAA TATCTGGAAG GCCTGGTCAA CGAGTTCCCC ATCATCTCCA

 851 TCGAAGACGG GATGGATGAA AACGACTGGG AAGGCTGGAA ACTGCTGACC

 901 GAAAAACTGG GCGGCAAAGT CCAACTCGTT GGCGACGACC TCTTCGTTAC

 951 CAACCCGAAA ATCCTTGCCG AAGGCATTGA AAAAGGCGTG GCAAACGCAC

1001 TATTGGTCAA AGTCAACCAA ATCGGTACTT TGAGTGAAAC CCTGAAAGCC

1051 GTCGACTTAG CCAAACGCAA CCGCTACGCC AGCGTAATGA GCCACCGCTC

1101 CGGCGAAACC GAAGACAGCA CCATTGCCGA CTTGGCAGTC GCCACCAACT

1151 GTATGCAGAT CAAAACCGGT TCTTTGAGCC GTTCCGACCG CATGGCGAAA

1201 TACAACCAAC TGCTGCGTAT CGAGGAAGAA TTGGCGGAAG CCGCCGACTA

1251 CCCCAGCAAA GCCGCATTCT ACCAACTGGG CAAATAA
```

This corresponds to the amino acid sequence <SEQ ID 2116; ORF 652-1.a>:

```
a652-1.pep

      1 MSAIVDIFAR EILDSRGNPT VECDVLLESG VMGRAAVPSG ASTGQKEALE

     51 LRDGDKSRYS GKGVLKAVEH VNNQIAQALI GIDANEQSYI DQIMIELDGT

    101 ENKGNLGANA TLAVSMAVAR AAAEDSGLPL YRYLGGAGPM SLPVPMMNVI

    151 NGGEHANNSL NIQEFMIMPV GAKSFREALR CGAEIFHALK KLCDSKGFPT

    201 TVGDEGGFAP NLNSHKEALQ LMVEATEAAG YKAGEDVLFA LDCASSEFYK

    251 DGKYHLEAEG RSYTNAEFAE YLEGLVNEFP IISIEDGMDE NDWEGWKLLT

    301 EKLGGKVQLV GDDLFVTNPK ILAEGIEKGV ANALLVKVNQ IGTLSETLKA

    351 VDLAKRNRYA SVMSHRSGET EDSTIADLAV ATNCMQIKTG SLSRSDRMAK

    401 YNQLLRIEEE LAEAADYPSK AAFYQLGK*

m652-1/a652-1 99.8% identity in 428 aa overlap

                   10        20        30        40        50        60
m652-1      MSAIVDIFAREILDSRGNPTVECDVLLESGVMGRAAVPSGASTGQKEALELRDGDKSRYS
            ||||||||||||||||||||||||||||||||||||||||||||||||||||||||||||
a652-1      MSAIVDIFAREILDSRGNPTVECDVLLESGVMGRAAVPSGASTGQKEALELRDGDKSRYS
                   10        20        30        40        50        60

                   70        80        90       100       110       120
m652-1      GKGVLKAVEHVNNQIAQALIGIDANEQSYIDQIMIELDGTENKGNLGANATLAVSMAVAR
            ||||||||||||||||||||||||||||||||||||||||||||||||||||||||||||
a652-1      GKGVLKAVEHVNNQIAQALIGIDANEQSYIDQIMIELDGTENKGNLGANATLAVSMAVAR
                   70        80        90       100       110       120

                  130       140       150       160       170       180
m652-1      AAAEDSGLPLYRYLGGAGPMSLPVPMMNVINGGEHANNSLNIQEFMIMPVGAKSFREALR
            ||||||||||||||||||||||||||||||||||||||||||||||||||||||||||||
a652-1      AAAEDSGLPLYRYLGGAGPMSLPVPMMNVINGGEHANNSLNIQEFMIMPVGAKSFREALR
                  130       140       150       160       170       180

                  190       200       210       220       230       240
m652-1      CGAEIFHALKKLCDSKGFPTTVGDEGGFAPNLNSHKEALQLMVEATEAAGYKAGEDVLFA
            ||||||||||||||||||||||||||||||||||||||||||||||||||||||||||||
a652-1      CGAEIFHALKKLCDSKGFPTTVGDEGGFAPNLNSHKEALQLMVEATEAAGYKAGEDVLFA
                  190       200       210       220       230       240

                  250       260       270       280       290       300
m652-1      LDCASSEFYKDGKYHLEAEGRSYTNAEFAEYLEGLVNEFPIISIEDGMDENDWEGWKLLT
            ||||||||||||||||||||| ||||||||||||||||||||||||||||||||||||||
a652-1      LDCASSEFYKDGKYHLEAEGRSYTNAEFAEYLEGLVNEFPIISIEDGMDENDWEGWKLLT
                  250       260       270       280       290       300

                  310       320       330       340       350       360
m652-1      EKLGGRVQLVGDDLFVTNPKILAEGIEKGVANALLVKVNQIGTLSETLKAVDLAKRNRYA
            |||||:||||||||||||||||||||||||||||||||||||||||||||||||||||||
a652-1      EKLGGKVQLVGDDLFVTNPKILAEGIEKGVANALLVKVNQIGTLSETLKAVDLAKRNRYA
                  310       320       330       340       350       360
```

-continued

```
                370       380       390       400       410       420
m652-1    SVMSHRSGETEDSTIADLAVATNCMQIKTGSLSRSDRMAKYNQLLRIEEELAEAADYPSK
          ||||||||||||||||||||||||||||||||||||||||||||||||||||||||||||
a652-1    SVMSHRSGETEDSTIADLAVATNCMQIKTGSLSRSDRMAKYNQLLRIEEELAEAADYPSK
                370       380       390       400       410       420

                429
m652-1    AAFYQLGKX
          |||||||||
a652-1    AAFYQLGKX
```

The following partial DNA sequence was identified in *N. gonorrhoeae* <SEQ ID 2117>:

```
g653.seq
   1 ATGGCGGcgg aaccgatgcg gAtgccggag gtaAcgtaCG GTTTTTCCGG

  51 ATCGTTCGGG ATGGCGTTTT TGTtgacggT GATGTGCGCt ttgcccaAAG

 101 CGGCTtcggc ggctttgcCg gtgaTTTTCA TCGGTTGCAG GtcgacgaGG

 151 AAaacgTGGC TTTCGGTGCG GCCGGAAacg atgcgCaaac cgCGTttaac

 201 caactcttcc gcCATGACGG CAGCATTGAT TTTCACTTGT TTTGCGTATT

 251 GTTTGAactC GGGTTGcaac gcttctTTAA acgctACGGC TttgGCGGCG

 301 ATAACGTgca tcaACGGAcc gCCTTGCAGG CTTGGGAAGA TGGAAGAGTT

 351 CAGCGCTTTT TCGTGGGTAT TGTCACGGCA CAAAATCACA CCGCCGCGAG

 401 GGCCGCGTAG GGTTTTGTGG GTGGTAGTGg ttACgaaGTc GCAGAatggc

 451 ACGGGgttag gatattcgcc gccGGCAACC AgtccgGCAT Ag
```

This corresponds to the amino acid sequence <SEQ ID 2118; ORF 653.ng>:

```
g653.pep
   1 MAAEPMRMPE VTYGFSGSFG MAFLLTVMCA LPKAASAALP VIFIGCRSTR

  51 KTWLSVRPET MRKPRLTNSS AMTAALIFTC FAYCLNSGCN ASLNATALAA

 101 ITCINGPPCR LGKMEEFSAF SWVLSRHKIT PPRGPRRVLW VVVVTKSQNG

 151 TGLGYSPPAT SPA*
```

The following partial DNA sequence was identified in *N. meningitidis* <SEQ ID 2119>:

```
m653.seq
   1 ATGGCAGCGG AGCCGATGCG GATGCCGGAG GTAACGAAGG GTTTTTCCGG

  51 ATCGTTCGGA ATGGCGTTTT TGTTGACGGT GATGTGCGCT TTGCCCAAAG

 101 CGGCTTCGGC GGCTTTGCCG GTAATTTTCA TCGGTTGCAG GTCAACGAGG

 151 AAAACGTGGC TTTCGGTGCG GCCGGAAACG ATGCGCAAAC CGCGTTTAAC

 201 CAACTCTTCC GCCATGGCGG CTGCATTGAT TTTCACTTGT TTTGCGTATT

 251 GTTTGAACTC GGGTTGCAAT GCTTCTTTAA ACGCCACGGC TTTGGCGGCG

 301 ATAACGTGCA TCAGCGGACC GCCTTGCAGG CTTGGGAAGA TGGAAGAGTT

 351 CAACGCTTTT TCGTGGGTAT TGTCGCGGCA CAAAATTACG CCGCCGCGAG

 401 GACCGCGCAG GGTTTTGTGG GTGGTGGTGG TCACGAAGTC GCAGAACGGC

 451 ACCGGGTTGG GATATTCGCC GCCGGCAACC AGACCGGCAT AG
```

This corresponds to the amino acid sequence <SEQ ID 2120; ORF 653>:

```
m653.pep

     1 MAAEPMRMPE VTKGFSGSFG MAFLLTVMCA LPKAASAALP VIFIGCRSTR

    51 KTWLSVRPET MRKPRLTNSS AMAAALIFTC FAYCLNSGCN ASLNATALAA

   101 ITCISGPPCR LGKMEEFNAF SWVLSRHKIT PPRGPRRVLW VVVVTKSQNG

   151 TGLGYSPPAT RPA*

m653/g653 96.9% identity in 163 aa overlap

                    10        20        30        40        50        60
m653.pep    MAAEPMRMPEVTKGFSGSFGMAFLLTVMCALPKAASAALPVIFIGCRSTRKTWLSVRPET
            ||||||||||||||||||||||||||||||||||||||||||||||||||||||||||||
g653        MAAEPMRMPEVTKGFSGSFGMAFLLTVMCALPKAASAALPVIFIGCRSTRKTWLSVRPET
                    10        20        30        40        50        60

                    70        80        90       100       110       120
m653.pep    MRKPRLTNSSAMAAALIFTCFAYCLNSGCNASLNATALAAITCISGPPCRLGKMEEFNAF
            ||||||||||||:|||||||||||||||||||||||||||||||:|||||||||||||:||
g653        MRKPRLTNSSAMTAALIFTCFAYCLNSGCNASLNATALAAITCINGPPCRLGKMEEFSAF
                    70        80        90       100       110       120

                   130       140       150       160
m653.pep    SWVLSRHKITPPRGPRRVLWVVVVTKSQNGTGLGYSPPATRPAX
            ||||||||||||||||||||||||||||||||||||||||| |||
g653        SWVLSRHKITPPRGPRRVLWVVVVTKSQNGTGLGYSPPATSPAX
                   130       140       150       160
```

The following partial DNA sequence was identified in *N. meningitidis* <SEQ ID 2121>:

```
a653.seq
   1 ATGGCGGCGG AACCGATGCG GATGCCGGAG GTAACGAAGG GTTTTTCCGG

  51 ATCATTCGGG ATGGCGTTTT TGTTGACAGT GATGTGCGCT TTGCCCAAAG

 101 CAGCTTCGGC GGCTTTGCCG GTAATTTTCA TCGGTTGCAG GTCAACGAGG

 151 AAAACGTGGC TTTCGGTGCG GCCGGAAACG ATGCGCAAAC CGCGTTTAAC

 201 CAACTCTTCC GCCATGGCGG CTGCATTGAT TTTCACTTGT TTTGCGTATT

 251 GTTTGAACTC GGGTTGCAAT GCTTCTTTAA ACGCCACGGC TTTGGCGGCG

 301 ATAACGTGCA TCAGCGGGCC ACCTTGCAGG CTTGGGAAGA TGGAAGAGTT

 351 CAACGCTTTT TCGTGGGTAT TGTCGCGGCA CAAAATTACG CCGCCGCGAG

 401 GACCGCGCAG GGTTTTGTGG GTGGTGGTGG TAACGAAGTC GCAGAACGGC

 451 ACGGGATTGG GATATTCGCC GCCGGCAACC AGACCGGCAT AG
```

This corresponds to the amino acid sequence <SEQ ID 2122; ORF 653.a>:

```
a653.pep

     1    MAAEPMRMPE VTKGFSGSFG MAFLLTVMCA LPKAASAALP VIFIGCRSTR

    51    KTWLSVRPET MRKPRLTNSS AMAAALIFTC FAYCLNSGCN ASLNATALAA

   101    ITCISGPPCR LGKMEEFNAF SWVLSRHKIT PPRGPRRVLW VVVVTKSQNG

   151    TGLGYSPPAT RPA*

m653/a653    100.0% identity in 163 aa overlap

                    10        20        30        40        50        60
m653.pep    MAAEPMRMPEVTKGFSGSFGMAFLLTVMCALPKAASAALPVIFIGCRSTRKTWLSVRPET
            ||||||||||||||||||||||||||||||||||||||||||||||||||||||||||||
a653        MAAEPMRMPEVTKGFSGSFGMAFLLTVMCALPKAASAALPVIFIGCRSTRKTWLSVRPET
                    10        20        30        40        50        60
```

-continued

```
                 70         80         90        100        110       120
m653.pep   MRKPRLTNSSAMAAALIFTCFAYCLNSGCNASLNATALAAITCISGPPCRLGKMEEFNAF
           ||||||||||||||||||||||||||||||||||||||||||||||||||||||||||||
a653       MRKPRLTNSSAMAAALIFTCFAYCLNSGCNASLNATALAAITCISGPPCRLGKMEEFNAF
                 70         80         90        100        110       120

                130        140        150        160
m653.pep   SWVLSRHKITPPRGPRRVLWVVVVTKSQNGTGLGYSPPATRPAX
           ||||||||||||||||||||||||||||||||||||||||||||
a653       SWVLSRHKITPPRGPRRVLWVVVVTKSQNGTGLGYSPPATRPAX
                130        140        150        160
```

The following partial DNA sequence was identified in *N. gonorrhoeae* <SEQ ID 2123>:

```
g656.seq
   1 ATGCCGCGTT TCTCCGGTTC GATTTCTTCG ATGATTTCCA TCGCGCGGAC

  51 TTTtggcGCG CCGGAGAGTG TGCcggcagg gAAGGTGGCG GCGAGGATGT

 101 CCATATTGGT AACGCCCTCT TTCAAACAGc ctTCGACGTT GGAAACGATG

 151 TGCATCACAT GGGAGTATTT TTCAATCACC ATTTTGTCGG TGACTTTGAC

 201 TTCGCCTGTT TTGCTGATGC GTCCGACATC GTTGCGCCCC AAATCGATAA

 251 GCATAACGTG TTCGGCgatt TCTTTGGCGT CGCTTAACAA ATCTTGTTCG

 301 TTGGCAAGGT CTTCGGCGGG GGTTTTGCCG CGCAGGCGCG TGCCGGCGAT

 351 GGGGCGGACG ATGACGTcat CGCGTTCGCG GCGGACGAGG ATTTCGGGCG

 401 AGGAACCGAC GATGTGGAAA TCGCCGAAAT CGTAG
```

This corresponds to the amino acid sequence <SEQ ID 2124; ORF 656.ng>:

```
g656.pep
   1 MPRFSGSISS MISIARTFGA PESVPAGKVA ARMSILVTPS FKQPSTLETM

  51 CITWEYFSIT ILSVTLTSPV LLMRPTSLRP KSISITCSAI SLASLNKSCS

 101 LARSSAGVLP RRRVPAMGRT MTSSRSRRTR ISGEEPTMWK
     SPKS*
```

The following partial DNA sequence was identified in *N. meningitidis* <SEQ ID 2125>:

```
m656.seq
   1 ATGCCGCGTT TGCTCGGTTC GACTTCTTCG ATGATTTCCA TGGCGCGGAC

  51 TTTGGGTGCG CCGGAGAGTG TGCCGGCAGG GAAGGTAGCG GCGAGGATGT

 101 CCATGTTGGT CATGCCGTCT TTCAGACGGC CTTCGACGTT GGAAACGATG

 151 TGCATTACAT GGGAGTATTT TTCAATCACC ATTTTGTCGG TAACTTTGAC

 201 TTCGCCGGTT TTACTGATGC GGCCGACGTC GTTGCGTCCT AAGTCAATCA

 251 ACATGACGTG TTCGGCGATT TCTTTGGCAT CGCTTAACAA ATCTTGTTCG

 301 TTGGCAAGGT CTTCGGCGGG GGTTTTGCCG CGCAGGCGCG TGCCGGCGAT

 351 GGGGCGGACG ATAACGTCGT TGCGTTCGCG TCGGACGAGG ATTTCGGGCG

 401 AGGAGCCGAC GATGTGGAAA TCGCCGAAAT CGTAG
```

This corresponds to the amino acid sequence <SEQ ID 2126; ORF 656>:

```
m656.pep
   1 MPRLLGSTSS MISMARTLGA PESVPAGKVA ARMSMLVMPS FRRPSTLETM

  51 CITWEYFSIT ILSVTLTSPV LLMRPTSLRP KSINMTCSAI SLASLNKSCS

 101 LARSSAGVLP RRRVPAMGRT ITSLRSRRTR ISGEEPTMWK SPKS*
```

Computer analysis of this amino acid sequence gave the following results:

Homology with a Predicted ORF from *N. gonorrhoeae*

```
m656/g656   91.0% identity in 144 aa overlap

                    10        20        30        40        50        60
m656.pep    MPRLLGSTSSMISMARTLGAPESVPAGKVAARMSMLVMPSFRRPSTLETMCITWEYFSIT
            |||: || |||||:|||:|||||||||||||||:|| |||::||||||||||||||||||
g656        MPRFSGSISSMISIARTFGAPESVPAGKVAARMSILVTPSFKQPSTLETMCITWEYFSIT
                    10        20        30        40        50        60

                    70        80        90       100       110       120
m656.pep    ILSVTLTSPVLLMRPTSLRPKSINMTCSAISLASLNKSCSLARSSAGVLPRRRVPAMGRT
            ||||||||||||||||||||||::||||||||||||||||||||||||||||||||||||
g656        ILSVTLTSPVLLMRPTSLRPKSISITCSAISLASLNKSCSLARSSAGVLPRRRVPAMGRT
                    70        80        90       100       110       120

                   130       140
m656.pep    ITSLRSRRTRISGEEPTMWKSPKSX
            :|| ||||||||||||||||||||
g656        MTSSRSRRTRISGEEPTMWKSPKSX
                   130       140
```

The following partial DNA sequence was identified in *N. meningitidis* <SEQ ID 2127>:

```
a656.seq
   1 ATGCCGCGTT TGCTCGGTTC GACTTCTTCG ATGATTTCCA TGGCGCGGAC

  51 TTTGGGTGCG CCGGAGAGTG TGCCGGCAGG GAAGGTAGCG GCGAGGATGT

 101 CCATGTTGGT CATGCCGTCT TTCAGACGGC CTTCGACGTT GGAAACGATG

 151 TGCATTACAT GGGAGTATTT TTCAATCACC ATTTTGTCGG TAACTTTGAC

 201 TTCGCCGGTT TTACTGATGC GGCCGACGTC GTTGCGTCCT AAGTCAATCA

 251 ACATGACGTG TTCGGCGATT TCTTTGGCAT CGCTTAACAA ATCTTGTTCG

 301 TTGGCAAGGT CTTCGGCGGG GGTTTTGCCG CGCAGGCGCG TGCCGGCGAT

 351 GGGGCGGACG ATGACATCGT CGCGTTCGCG GCGGACGAGG ATTTCGGGCG

 401 AGGAGCCGAC GATGTGGAAA TCGCCGAAAT CGTAG
```

This corresponds to the amino acid sequence <SEQ ID 2128; ORF 656.a>:

```
a656.pep

   1 MPRLLGSTSS MISMARTLGA PESVPAGKVA ARMSMLVMPS FRRPSTLETM

  51 CITWEYFSIT ILSVTLTSPV LLMRPTSLRP KSINMTCSAI SLASLNKSCS

 101 LARSSAGVLP RRRVPAMGRT MTSSRSRRTR ISGEEPTMWK SPKS*
```

-continued

```
m656/a656 98.6% identity in 144 aa overlap

                   10        20        30        40        50        60
m656.pep   MPRLLGSTSSMISMARTLGAPESVPAGKVAARMSMLVMPSFRRPSTLETMCITWEYFSIT
           ||||||||||||||||||||||||||||||||||||||||||||||||||||||||||||
a656       MPRLLGSTSSMISMARTLGAPESVPAGKVAARMSMLVMPSFRRPSTLETMCITWEYFSIT
                   10        20        30        40        50        60

                   70        80        90       100       110       120
m656.pep   ILSVTLTSPVLLMRPTSLRPKSINMTCSAISLASLNKSCSLARSSAGVLPRRRVPAMGRT
           ||||||||||||||||||||||||||||||||||||||||||||||||||||||||||||
a656       ILSVTLTSPVLLMRPTSLRPKSINMTCSAISLASLNKSCSLARSSAGVLPRRRVPAMGRT
                   70        80        90       100       110       120

                  130       140
m656.pep   ITSLRSRRTRISGEEPTMWKSPKSX
           :|| |||||||||||||||||||||
a656       MTSSRSRRTRISGEEPTMWKSPKSX
                  130       140
```

The following partial DNA sequence was identified in *N. gonorrhoeae* <SEQ ID 2129>:

```
g657.seq
   1  ATGAACACAC CCCCCATCCT TCCTCCCGCC ATGCTCGGCA TCCTCGGCGG

  51  CGGACAATTa ggcagAATGT TTGCCGTTGC CGCTAAAACC ATGGGCTACA

 101  AAGTAACCGT TCTCGATCCC GACCCGAATG CGCCGGCGGC GGAATTTGCC

 151  GACCGCCATT TGTGCGCGCC GTTTGACGAC CGGGCCGCGT TGGACGAATT

 201  GGCAAAATGC GCGGCGGTta cgACCGAATT TGAAAacgtc aaTGCCGACG

 251  CGATGCGCTC TCTGGCAAAG CATACCAACG TTTCCCCCAG CGGCGACTGC

 301  GTGTCCATTG CACAAAACCG CATTCAGGAA AAAGCGTGGA TACGCAAAGC

 351  AGGCTTGCAA ACCGCGCCGT ATCAGGCGGT TTGCAAGGCC GAAGACATTA

 401  CTGAAGCAAG CGCGCAATTT TTGCCCGGCA TCCTGAAAAC GGCTACGTTG

 451  GGCTACGACG GCAAAGGTCA AATCCGCGTC AAAACGTTGG ACGAACTCAA

 501  AGCCGCGTTT GCCGAACACG GCGGCGTGGA TTGCGTTTTG GAAAAAATGG

 551  TGGACTTGCG CGGCGAGATT TCCGTGATCG TATGCCGTCT GAACGATGAA

 601  AACGTGCAAA CCTTCGACCC CGCCGAAAAC ATCCACGAAA ACGGCATCTT

 651  GGCTTattcC ATCGTCcccg CGCGGCTGAG TGCCGACGTG CAGCAACAGG

 701  CGCGGCAGAC GGCGCAACgc tTGGCGGACG AATTGGATTA TGTCGGCgta

 751  TTGGCGGTAG AAATGTTTGT TGTCGGCGAC ACACATGAAT TGCTCGTCAA

 801  TGAAACCGCC CCGCGCACGC ACAATTCCGG CCACCATACG ATAGATGCCT

 851  GCGCCGCAGA CCAGTTCCAA CAGCAGGTAC GCATTATGTG CAAcctGCCG

 901  cccGccgACA CCAAATTATT aTCCCCttgC TGTATGGCGA ATATTTTGGg

 951  CGACGTTTGG CAGGAAGATG GCGGCGAACC GGATTGGCTG CCGTTGCAAA

1001  GCCGGCCGAA TGCACACCTG CACCTATACG GAAAAAAAAC CGCACAGAAA

1051  GGTCGGAAAA TGGGACACTT TaccgTTTTG ACCACCGATT CGGACaccgC

1101  ATTTCAAGAA GCAAAAAAAC TGCATCAGTC CCTATAA
```

This corresponds to the amino acid sequence <SEQ ID 2130; ORF 657.ng>:

```
g657.pep
  1  MNTPPILPPA MLGILGGGQL GRMFAVAAKT MGYKVTVLDP DPNAPAAEFA
```

-continued

```
 51 DRHLCAPFDD RAALDELAKC AAVTTEFENV NADAMRSLAK HTNVSPSGDC

101 VSIAQNRIQE KAWIRKAGLQ TAPYQAVCKA EDITEASAQF LPGILKTATL

151 GYDGKGQIRV KTLDELKAAF AEHGGVDCVL EKMVDLRGEI SVIVCRLNDE

201 NVQTFDPAEN IHENGILAYS IVPARLSADV QQQARQTAQR LADELDYVGV

251 LAVEMFVVGD THELLVNETA PRTHNSGHHT IDACAADQFQ QQVRIMCNLP

301 PADTKLLSPC CMANILGDVW QEDGGEPDWL PLQSRPNAHL HLYGKKTAQK

351 GRKMGHFTVL TTDSDTAFQE AKKLHQSL*
```

The following partial DNA sequence was identified in *N. meningitidis* <SEQ ID 2131>:

```
m657.seq
   1 ATGAAAAACA TATCTCTTTC TCCGCCCGCC ATGCTTGGCA TCCTCGGCGG

  51 CGGACAATTA GGCAGAATGT TTACCGTTGC CGCCAAAACC ATGGGCTACA

 101 AAGTAACCGT TCTCGACCCC GATCCGGACG CGCCGGCAGC AGAATTTGCC

 151 GACCGCCATT TGTGCGCGCC GTTTAACGAC CAAGCTGCTT TGGACGAATT

 201 GGCAAAATGC GCGGCGGTGA CCACTGAATT TGAAAACGTC AATGCCGATG

 251 CGATGCGCTT TTTGGCAAAA CATACCAATG TTTCCCCTAG CGGCGATTGT

 301 GTGGCGATTG CACAAAACCG CATTCAGGAA AAGGCATGGA TACGCAAAGC

 351 GGGATTGCAA ACCGCGCCGT ATCAAGTGGT TTGTAAGGCT GAAGACATCA

 401 CTGAAGCAAG CGCGCAATTT TTGCCCGGCA TCCTGAAAAC GGCTACGTTG

 451 GGCTACGACG GCAAAGGTCA AATCCGCGTA AAAACATTGG ATGAACTCAA

 501 AGCCGCGTTT GCCGAACACG GCGGCGTGGA TTGCGTTTTG GAAAAAATGG

 551 TGGATTTGCG CAGTGAAATT TCCGTAATCG TATGCCGTTT GAACAATGAC

 601 AACGTGCAAA CTTTCGACCC TGCCGAAAAC ATCCACGAAA ACGGCATCTT

 651 GGCTTATTCC ATCGTCCCCG CGCGACTGAG TGCCGACGTG CAGCAACAGG

 701 CGCGGCAGAT GGCGCAACGC TTGGCGGACG AATTGGATTA TGTCGGCGTA

 751 TTGGCGGTAG AAATGTTTGT TGTCGGTGAC ACGCATGAAT TGGTCGTCAA

 801 CGAAATCGCC CCGCGCCCGC ACAATTCCGG ACACCATACG ATAGATGCCT

 851 GCGCAGCAGA CCAGTTCCAG CAGCAGGTAC GCATTATGTG CAACCTGCCG

 901 CCTGCCGATA CCAAATTACT GAGTTCTTGC TGTATGGCAA ATATTTTGGG

 951 CGACGTTTGG CAGGAAGACG GCGGCGAACC GGATTGGCTG CCCTTGCAAA

1001 GCCATCCGAA TGCACACCTG CACCTTTACG GCAAAAAAAC CGCGCACAAA

1051 GGGCGGAAAA TGGGACACTT TACCGTTTTA ACCACCGATT CGGACACCGC

1101 ATTTCAAGAA GCAAAAAAAC TGCATCAGTC CCTATAA
```

This corresponds to the amino acid sequence <SEQ ID 2132; ORF 657>:

```
m657.pep
  1 MKNISLSPPA MLGILGGGQL GRMFTVAAKT MGYKVTVLDP DPDAPAAEFA

 51 DRHLCAPFND QAALDELAKC AAVTTEFENV NADAMRFLAK HTNVSPSGDC

101 VAIAQNRIQE KAWIRKAGLQ TAPYQVVCKA EDITEASAQF LPGILKTATL

151 GYDGKGQIRV KTLDELKAAF AEHGGVDCVL EKMVDLRSEI SVIVCRLNND
```

-continued

```
201 NVQTFDPAEN IHENGILAYS IVPARLSADV QQQARQMAQR LADELDYVGV

251 LAVEMFVVGD THELVVNEIA PRPHNSGHHT IDACAADQFQ QQVRIMCNLP

301 PADTKLLSSC CMANILGDVW QEDGGEPDWL PLQSHPNAHL HLYGKKTAHK

351 GRKMGHFTVL TTDSDTAFQE AKKLHQSL*
```

Computer analysis of this amino acid sequence gave the following results:

Homology with a Predicted ORF from *N. gonorrhoeae*

```
m657/g657 93.9% identity in 378 aa overlap

                   10        20        30        40        50        60
m657.pep   MKNISLSPPAMLGILGGGQLGRMFTVAAKTMGYKVTVLDPDPDAPAAEFADRHLCAPFND
           |::  : ||||||||||||||||:||||||||||||||||:||||||||||||||:|
g657       MNTPPILPPAMLGILGGGQLGRMFAVAAKTMGYKVTVLDPDPNAPAAEFADRHLCAPFDD
                   10        20        30        40        50        60

                   70        80        90       100       110       120
m657.pep   QAALDELAKCAAVTTEFENVNADAMRFLAKHTNVSPSGDCVAIAQNRIQEKAWIRKAGLQ
           :||||||||||||||||||||||||| |||||||||||||:||||||||||||||||||
g657       RAALDELAKCAAVTTEFENVNADAMRSLAKHTNVSPSGDCVSIAQNRIQEKAWIRKAGLQ
                   70        80        90       100       110       120

                  130       140       150       160       170       180
m657.pep   TAPYQVVCKAEDITEASAQFLPGILKTATLGYDGKGQIRVKTLDELKAAFAEHGGVDCVL
           |||||:||||||||||||||||||||||||||||||||||||||||||||||||||||||
g657       TAPYQAVCKAEDITEASAQFLPGILKTATLGYDGKGQIRVKTLDELKAAFAEHGGVDCVL
                  130       140       150       160       170       180

                  190       200       210       220       230       240
m657.pep   EKMVDLRSEISVIVCRLNNDNVQTFDPAENIHENGILAYSIVPARLSADVQQQARQMAQR
           ||||||:||||||||||::|||||||||||||||||||||||||||||||||||| |||
g657       EKMVDLRGEISVIVCRLNDENVQTFDPAENIHENGILAYSIVPARLSADVQQQARQTAQR
                  190       200       210       220       230       240

                  250       260       270       280       290       300
m657.pep   LADELDYVGVLAVEMFVVGDTHELVVNEIAPRPHNSGHHTIDACAADQFQQQVRIMCNLP
           ||||||||||||||||||||||||:||| ||| ||||||||||||||||||||||||||
g657       LADELDYVGVLAVEMFVVGDTHELLVNETAPRTHNSGHHTIDACAADQFQQQVRIMCNLP
                  250       260       270       280       290       300

                  310       320       330       340       350       360
m657.pep   PADTKLLSSCCMANILGDVWQEDGGEPDWLPLQSHPNAHLHLYGKKTAHKGRKMHGFTVL
           |||||||| ||||||||||||||||||||||||:|||||||||||||:||||||||||||
g657       PADTKLLSPCCMANILGDVWQEDGGEPDWLPLQSRPNAHLHLYGKKTAQKGRKMHGFTVL
                  310       320       330       340       350       360

                  370      379
m657.pep   TTDSDTAFQEAKKLHQSLX
           ||||||||||||||||||
g657       TTDSDTAFQEAKKLHQSLX
                  370
```

The following partial DNA sequence was identified in *N. meningitidis* <SEQ ID 2133>:

```
a657.seq
  1  ATGAAAAACA TATCTCTTTC TCCGCCCGCC ATGCTCGGCA TTCTTGGCGG

 51  CGGACAATTA GGCAGAATGT TTACTGTTGC TGCCAAAACC ATGGGCTACA

101  AAGTAACCGT ACTCGATCCC AACCCGAATG CGCCGGCAGC GGAATTTGCC

151  GACCGCCATT TGTGTGCGCC GTTTGACAAC CAAACCGCTT TGGAAGAATT

201  GGCAAAATGT GCGGCTGTTA CGACCGAGTT CGAAAACGTC AATGCCGATG

251  CGATGCGTTT TCTCGCCAAA CATACCAATG TTTCCCCCAG CGGCGACTGC

301  GTTGCCATCG CGCAAAACCG CATTCAGGAA AAGGCATGGA TACGCAAAGC

351  AGGCCTGCAA ACCGCGCCGT ATCAAGCAAT TTGCAAAGCC GAAGACATCA

401  CTGAAGAAAG CATACAATTT CTGCCCGGCA TCCTGAAAAC CGCTACATTG

451  GGCTATGACG GCAAAGGCCA AATCCGCGTC AAAACGGTGG ATGAACTCAA
```

-continued

```
 501 AGCCGCGTTT GCCGAACACC GCGGCGTGGA TTGCGTTTTG GAAAAAATGG

 551 TGGACTTGCG CGGCGAAATT TCCGTTATCG TATGCCGTCT GAACAATGAC

 601 AACGTGCAAA CTTTCGATCC TGCCGAAAAC ATTCACGAAA ACGGTATCCT

 651 CGCCTACTCC ATCGTCCCAG CCCGACTGAG TGCCGACATT CAGCAACAGG

 701 CGCGACAAAT GGCGCAGCGT TTGGCCGATG AATTGAACTA CGTCGGCGTA

 751 TTGGCGGTAG AAATGTTTGT TGTCGGCGAC ACGCATGAAT TGGTCGTCAA

 801 CGAAATCGCG CCGCGTCCGC ACAATTCCGG CCACCATACC GTCGACGCCT

 851 GCGCGGCAGA CCAATTCCAG CAACAGGTCC GCCTGATGTG CAACCTGCCA

 901 CCTGCTGACA CCAAATTGCT GAGTTCTTGC TGTATGGCGA ATATTTTGGG

 951 CGACGTTTGG CAGGAAGACG GCGGCGAACC GGATTGGTTT CCCCTGCAAA

1001 GCCGGCCGGA CGCGCACCTG CACCTTTACG GCAAAAAAAC CGCGCACAAA

1051 GGGCGGAAAA TGGGACACTT TACCATTTTA AGCACCGATT CGGACACCGC

1101 ATTTCAAGAA GCAAAAAAAC TGCATCAGTC CCTATAA
```

This corresponds to the amino acid sequence <SEQ ID 2134; ORF 657.a>:

```
a657.pep

  1 MKNISLSPPA MLGILGGGQL GRMFTVAAKT MGYKVTVLDP NPNAPAAEFA

 51 DRHLCAPFDN QTALEELAKC AAVTTEFENV NADAMRFLAK HTNVSPSGDC

101 VAIAQNRIQE KAWIRKAGLQ TAPYQAICKA EDITEESIQF LPGILKTATL

151 GYDGKGQIRV KTVDELKAAF AEHRGVDCVL EKMVDLRGEI SVIVCRLNND

201 NVQTFDPAEN IHENGILAYS IVPARLSADI QQQARQMAQR LADELNYVGV

251 LAVEMFVVGD THELVVNEIA PRPHNSGHHT VDACAADQFQ QQVRLMCNLP

301 PADTKLLSSC CMANILGDVW QEDGGEPDWF PLQSRPDAHL HLYGKKTAHK

351 GRKMGHFTIL STDSDTAFQE AKKLHQSL*
```

m657/a657 94.2% identity in 378 aa overlap

```
                   10        20        30        40        50        60
m657.pep   MKNISLSPPAMLGILGGGQLGRMFTVAAKTMGYKVTVLDPDPDAPAAEFADRHLCAPFND
           |||||||||||||||||||||||||||||||||||||||||:|:||||||||||||||::
a657       MKNISLSPPAMLGILGGGQLGRMFTVAAKTMGYKVTVLDPNPNAPAAEFADRHLCAPFDN
                   10        20        30        40        50        60

                   70        80        90       100       110       120
m657.pep   QAALDELAKCAAVTTEFENVNADAMRFLAKHTNVSPSGDCVAIAQNRIQEKAWIRKAGLQ
           |:||:|||||||||||||||||||||||||||||||||||||||||||||||||||||||
a657       QTALEELAKCAAVTTEFENVNADAMRFLAKHTNVSPSGDCVAIAQNRIQEKAWIRKAGLQ
                   70        80        90       100       110       120

                  130       140       150       160       170       180
m657.pep   TAPYQVVCKAEDITEASAQFLPGILKTATLGYDGKGQIRVKTLDELKAAFAEHGGVDCVL
           |||||::|||||||| | ||||||||||||||||||||||||:|||||||||| ||||||
a657       TAPYQAICKAEDITEESIQFLPGILKTATLGYDGKGQIRVKTVDELKAAFAEHRGVDCVL
                  130       140       150       160       170       180

                  190       200       210       220       230       240
m657.pep   EKMVDLRSEISVIVCRLNNDNVQTFDPAENIHENGILAYSIVPARLSADVQQQARQMAQR
           |||||||:|||||||||||||||||||||||||||||||||||||||||:||||||||||
a657       EKMVDLRGEISVIVCRLNNDNVQTFDPAENIHENGILAYSIVPARLSADIQQQARQMAQR
                  190       200       210       220       230       240

                  250       260       270       280       290       300
m657.pep   LADELDYVGVLAVEMFVVGDTHELVVNEIAPRPHNSGHHTIDACAADQFQQQVRIMCNLP
           |||||:||||||||||||||||||||||||||||||||||:|||||||||||||:|||||
a657       LADELNYVGVLAVEMFVVGDTHELVVNEIAPRPHNSGHHTVDACAADQFQQQVRLMCNLP
                  250       260       270       280       290       300

                  310       320       330       340       350       360
m657.pep   PADTKLLSSCCMANILGDVWQEDGGEPDWLPLQSHPNAHLHLYGKKTAHKGRKMGHFTVL
           |||||||||||||||||||||||||||||:||||:|:|||||||||||||||||||||:|
a657       PADTKLLSSCCMANILGDVWQEDGGEPDWFPLQSRPDAHLHLYGKKTAHKGRKMGHFTIL
                  310       320       330       340       350       360
```

-continued

```
                   370       379
m657.pep  TTDSDTAFQEAKKLHQSLX
          :||||||||||||||||||
a657      STDSDTAFQEAKKLHQSLX
                   370
```

The following partial DNA sequence was identified in *N. gonorrhoeae* <SEQ ID 2135>:

```
g658.seq
   1 ATGGTGGCCG GAATTGTGCG TGCGCGGGGC GGTTTCATTG ACGAGCAATT

  51 CATGTGTGTC GCCGACAACA AACATTTCTA CCGCCAAtac GCCGACATAA

 101 TCCAATTCGT CCGCCAagcG TTGCGCCGTC TGCCGCGCCT GTTGCTGCAC

 151 GTCGGCACTC AGCCGCGcgg gGACGATGga atAAGCCAAG ATGCCGTTTT

 201 CGTGGATGTT TTCGGCGGGG TCGAAGGTTT GCACGTTTTC ATCGTTCAGA

 251 CGGCATACGA TCACGGAAAT CTCGCCGCGC AAGTCCACCA TTTTTTCCAA

 301 AACGCAATCC ACGCCGCCGT GTTCGGCAAA CGCGGCTTTG AGTTCGTCCA

 351 ACGTTTTGAC GCGGATTTGA CCTTTGCCGT CGTAGCCCAA CGTAGCCGTT

 401 TTCAGGATGC CGGGCAAAAA TTGCGCGCTT GCTTCAGTAA TGTCTTCGGC

 451 CTTGCAAACC GCCTGATACG GCGCGGTTTG CAAGCCTGCT TTGCGTATCC

 501 ACGCTTTTTC CTGAATGCGG TTTTGTGCAA TGGACACGCA GTCGCCGCTG

 551 GGGGAAACGT TGGTATGCTT TGCCAGAGAG CGCATCGCGT CGGCAttgac

 601 gtTTTCAAAT TCGGTcgtaA CCGCCGCGCA TTTTGCCAAT TCGTCCAACG

 651 CGGCCCGGTC GTCAAACGGC GCGCACAAAT GGCGGTCGGC AAATTCCGCC

 701 GCCGGCGCAT TCGGGTCGGG ATCGAGAACG GTTACTTTGT AGCCCATGGT

 751 TTTAGCGGCA ACGGCAAACA TTctgcctAA
```

This corresponds to the amino acid sequence <SEQ ID 2136; ORF 658.ng>:

```
g658.pep
   1 MVAGIVRARG GFIDEQFMCV ADNKHFYRQY ADIIQFVRQA LRRLPRLLLH

  51 VGTQPRGDDG ISQDAVFVDV FGGVEGLHVF IVQTAYDHGN LAAQVHHFFQ

 101 NAIHAAVFGK RGFEFVQRFD ADLTFAVVAQ RSRFQDAGQK LRACFSNVFG

 151 LANRLIRRGL QACFAYPRFF LNAVLCNGHA VAAGGNVGML CQRAHRVGID

 201 VFKFGRNRRA FCQFVQRGPV VKRRAQMAVG KFRRRRIRVG IENGYFVAHG

 251 FSGNGKHSA*
```

The following partial DNA sequence was identified in *N. meningitidis* <SEQ ID 2137>:

```
m658.seq
   1 ATGGTGTCCG GAATTGTGCG GGCGCGGGGC GATTTCGTTG ACGACCAATT

  51 CATGCGTGTC ACCGACAACA AACATTTCTA CCGCCAATAC GCCGACATAA

 101 TCCAATTCGT CCGCCAAGCG TTGCGCCATC TGCCGCGCCT GTTGCTGCAC

 151 GTCGGCACTC AGTCGCGCGG GGACGATGGA ATAAGCCAAG ATGCCGTTTT

 201 CGTGGATGTT TTCGGCAGGG TCGAAAGTTT GCACGTTGTC ATTGTTCAAA

 251 CGGCATACGA TTACGGAAAT TTCACTGCGC AAATCCACCA TTTTTTCCAA
```

-continued

```
301 AACGCAATCC ACGCCGCCGT GTTCGGCAAA CGCGGCTTTG AGTTCATCCA

351 ATGTTTTTAC GCGGATTTGA CCTTTGCCGT CGTAGCCCAA CGTAGCCGTT

401 TTCAGGATGC CGGGCAAAAA TTGCGCGCTT GCTTCAGTGA TGTCTTCAGC

451 CTTACAAACC ACTTGATACG GCGCGGTTTG CAATCCCGCT TTGCGTATCC

501 ATGCCTTTTC CTGAATGCGG TTTTGTGCAA TCGCCACACA ATCGCCGCTA

551 GGGGAAACAT TGGTATGTTT TGCCAAAAAG CGCATCGCAT CGGCATTGAC

601 GTTTTCAAAT TCAGTGGTCA CCGCCGCGCA TTTTGCCAAT TCGTCCAAAG

651 CAGCTTGGTC GTTAAACGGC GCGCACAAAT GGCGGTCGGC AAATTCTGCT

701 GCCGGCGCGT CCGGATCGGG GTCGAGAACG GTTACTTTGT AGCCCATGGT

751 TTTGGCGGCA ACGGTAAACA TTCTGCCTAA
```

This corresponds to the amino acid sequence <SEQ ID 2138; ORF 658>:

```
m658.pep
  1 MVSGIVRARG DFVDDQFMRV TDNKHFYRQY ADIIQFVRQA LRHLPRLLLH

 51 VGTQSRGDDG ISQDAVFVDV FGRVESLHVV IVQTAYDYGN FTAQIHHFFQ

101 NAIHAAVFGK RGFEFIQCFY ADLTFAVVAQ RSRFQDAGQK LRACFSDVFS

151 LTNHLIRRGL QSRFAYPCLF LNAVLCNRHT IAARGNIGMF CQKAHRIGID

201 VFKFSGHRRA FCQFVQSSLV VKRRAQMAVG KFCCRRVRIG VENGYFVAHG

251 FGGNGKHSA*
```

Computer analysis of this amino acid sequence gave the following results:

Homology with a Predicted ORF from *N. gonorrhoeae*

```
m658/g658 82.2% identity in 259 aa overlap

                   10        20        30        40        50        60
m658.pep  MVSGIVRARGDFVDDQFMRVTDNKHFYRQYADIIQFVRQALRHLPRLLLHVGTQSRGDDG
          ||:||||||| |:|:||| |:|||||||||||||||||||||:||||||||||| |||||
g658      MVAGIVRARGGFIDEQFMCVADNKHFYRQYADIIQFVRQALRRLPRLLLHVGTQPRGDDG
                   10        20        30        40        50        60

                   70        80        90       100       110       120
m658.pep  ISQDAVFVDVFGRVESLHVVIVQTAYDYGNFTAQIHHFFQNAIHAAVFGKRGFEFIQCFY
          |||||||||||| ||:||| |||||||:||::||:||||||||||||||||||||:| |
g658      ISQDAVFVDVFGGVEGLHVFIVQTAYDHGNLAAQVHHFFQNAIHAAVFGKRGFEFVQRFD
                   70        80        90       100       110       120

                  130       140       150       160       170       180
m658.pep  ADLTFAVVAQRSRFQDAGQKLRACFSDVFSLTNHLIRRGLQSRFAYPCLFLNAVLCNRHT
          ||||||||||||||||||||||||||:||:|:|:|||||||: |||| :|||||||| |:
g658      ADLTFAVVAQRSRFQDAGQKLRACFSNVFGLANRLIRRGLQACFAYPRFFLNAVLCNGHA
                  130       140       150       160       170       180

                  190       200       210       220       230       240
m658.pep  IAARGNIGMFCQKAHRIGIDVFKFSGHRRAFCQFVQSSLVVKRRAQMAVGKFCCRRVRIG
          :|| ||:||:||:|||:|||||||: :||||||||| : |||||||||||||  ||:|:|
g658      VAAGGNVGMLCQRAHRVGIDVFKFGRNRRAFCQFVQRGPVVKRRAQMAVGKFRRRRIRVG
                  190       200       210       220       230       240

                  250       260
m658.pep  VENGYFVAHGFGGNGKHSAX
          :||||||||||:||||||||
g658      IENGYFVAHGFSGNGKHSAX
                  250       260
```

The following partial DNA sequence was identified in *N. meningitidis* <SEQ ID 2139>:

```
a658.seq
   1 ATGGTGGCCG GAATTGTGCG GACGCGGCGC GATTTCGTTG ACGACCAATT

  51 CATGCGTGTC GCCGACAACA AACATTTCTA CCGCCAATAC GCCGACGTAG

 101 TTCAATTCAT CGGCCAAACG CTGCGCCATT TGTCGCGCCT GTTGCTGAAT

 151 GTCGGCACTC AGTCGGGCTG GGACGATGGA GTAGGCGAGG ATACCGTTTT

 201 CGTGAATGTT TTCGGCAGGA TCGAAAGTTT GCACGTTGTC ATTGTTCAGA

 251 CGGCATACGA TAACGGAAAT TTCGCCGCGC AAGTCCACCA TTTTTTCCAA

 301 AACGCAATCC ACGCCGCGGT GTTCGGCAAA CGCGGCTTTG AGTTCATCCA

 351 CCGTTTTGAC GCGGATTTGG CCTTTGCCGT CATAGCCCAA TGTAGCGGTT

 401 TTCAGGATGC CGGGCAGAAA TTGTATGCTT TCTTCAGTGA TGTCTTCGGC

 451 TTTGCAAATT GCTTGATACG GCGCGGTTTG CAGGCCTGCT TTGCGTATCC

 501 ATGCCTTTTC CTGAATGCGG TTTTGCGCGA TGGCAACGCA GTCGCCGCTG

 551 GGGGAAACAT TGGTATGTTT GGCGAGAAAA CGCATCGCAT CGGCATTGAC

 601 GTTTTCGAAC TCGGTCGTAA CAGCCGCACA TTTTGCCAAT TCTTCCAAAG

 651 CGGTTTGGTT GTCAAACGGC GCACACAAAT GGCGGTCGGC AAATTCCGCT

 701 GCCGGCGCAT TCGGGTTGGG ATCGAGTACG GTTACTTTGT AGCCCATGGT

 751 TTTGGCAGCA ACAGTAAACA TTCTGCCTAA
```

This corresponds to the amino acid sequence <SEQ ID 2140; ORF 658.a>:

```
a658.pep

      1 MVAGIVRTRR DFVDDQFMRV ADNKHFYRQY ADVVQFIGQT LRHLSRLLLN

     51 VGTQSGWDDG VGEDTVFVNV FGRIESLHVV IVQTAYDNGN FAAQVHHFFQ

    101 NAIHAAVFGK RGFEFIHRFD ADLAFAVIAQ CSGFQDAGQK LYAFFSDVFG

    151 FANCLIRRGL QACFAYPCLF LNAVLRDGNA VAAGGNIGMF GEKTHRIGID

    201 VFELGRNSRT FCQFFQSGLV VKRRTQMAVG KFRCRRIRVG IEYGYFVAHG

    251 FGSNSKHSA*

m658/a658 75.3% identity in 259 aa overlap

                 10        20        30        40        50        60
m658.pep MVSGIVRARGDFVDDQFMRVTDNKHFYRQYADIIQFVRQALRHLPRLLLHVGTQSRGDDG
         ||:||||:| ||||||||||:|||||||||||::||: |:|||| ||||:|||||  |||
a658     MVAGIVRTRRDFVDDQFMRVADNKHFYRQYADVVQFIGQTLRHLSRLLLNVGTQSGWDDG
                 10        20        30        40        50        60

                 70        80        90       100       110       120
m658.pep ISQDAVFVDVFGRVESLHVVIVQTAYDYGNFTAQIHHFFQNAIHAAVFGKRGFEFIQCFY
         :::|:|||:||||:||||||||||||| |||:||:|||||||||||||||||||||: | 
a658     VGEDTVFVNVFGRIESLHVVIVQTAYDNGNFAAQVHHFFQNAIHAAVFGKRGFEFIHRFD
                 70        80        90       100       110       120

                130       140       150       160       170       180
m658.pep ADLTFAVVAQRSRFQDAGQKLRACFSDVFSLTNHLIRRGLQSRFAYPCLFLNAVLCNRHT
         |||:|||:|| | |||||||| | |||||:::| |||||||: |||||||||||| : ::
a658     ADLAFAVIAQCSGFQDAGQKLYAFFSDVFGFANCLIRRGLQACFAYPCLFLNAVLRDGNA
                130       140       150       160       170       180

                190       200       210       220       230       240
m658.pep IAARGNIGMFCQKAHRIGIDVFKFSGHRRAFCQFVQSSLVVKRRAQMAVGKFCCRRVRIG
         :|| |||||| :|:||||||||::: : |:|||| ||:||||||:||||||| |||:|:|
a658     VAAGGNIGMFGEKTHRIGIDVFELGRNSRTFCQFFQSGLVVKRRTQMAVGKFRCRRIRVG
                190       200       210       220       230       240
```

-continued

```
                 250       260
m658.pep VENGYFVAHGFGGNGKHSAX
         :| |||||||||:|:|||||
a658     IEYGYFVAHGFGSNSKHSAX
                 250       260
```

The following partial DNA sequence was identified in *N. gonorrhoeae* <SEQ ID 2141>:

```
g661.seq
   1 ATGCACATCG GCGGTTATTT TATCGACAAC CCCATCGCAC TTGCGCCGAT

  51 GGCGGGCATT GCCGACAAAC CCTTCCGCCG CCTCTGTCGG GCGTTTGGCG

 101 CAGGTTGGGC GGTGTGCGAA ATGCTGGCCA GCGATCCGAC GCTCAGGAAT

 151 ACCGGAAAAA CCCtgcaccg cagtgaTTTt gccgatgaag gCGGCATCGT

 201 TGCCGTGCAG ATTGCCGGCA GCGACCccga acaGATGGCG Gatgcggcgc

 251 gttacAACGT CGGACTCGGG GCGCAGGTCA TCGACATcaa TATGGGCTGC

 301 cccgccaaGA AAGTGTGCAA CGTCCAAGCC GGTAGCGCgc tGATGCAGGA

 351 CGAGccgctg gttgcCgcca tTTtggaggc ggtggtcAAG GCGGCGGgcg

 401 TACCCGTTAC cctCAAAACc cgtTtgggtt ggcacgacga cgatcaaaac

 451 ctgcCcgccg tcgccaaaat cgccgaagat tgcggcattg ccgcccCttgc

 501 cgttccacgg gcgCGCgcgC ACGCAAATGT ACAAAGGCGA GGCgcGTTAC

 551 Gaactcatcg CCGAGACCAA AAGccgTCTG AACATCCCGG cctGggtCAA

 601 CGGCGACATC actTCgccgc AAAAAGCCGC CGccgTCCTC AAACAAACCG

 651 CCGCCGACGG CATCATGATA GGGCGCGGCG CGCAAGGCAG GCCGTGGTTT

 701 TTCCGCGATT TGAAGCATTA TGCCGAACAC GGCGTTTTAC CGCCTGCCTT

 751 GAGTTTGGCA GAATGCAGAG CCGCCATTTT GAACCACATC CGCGCCATGC

 801 ACGCGTTTTA TGGTGAGACC GTCGGTGTGC GCATCGCACG CAAACACATA

 851 GGCTGGTACA TCGGCGAAAT GCCCGACGGC GAACAGGCGC GGCGTGA
```

This corresponds to the amino acid sequence <SEQ ID 2142; ORF 661.ng>:

```
g661.pep
   1 MHIGGYFIDN PIALAPMAGI ADKPFRRLCR AFGAGWAVCE MLASDPTLRN

  51 TGKTLHRSDF ADEGGIVAVQ IAGSDPEQMA DAARYNVGLG AQVIDINMGC

 101 PAKKVCNVQA GSALMQDEPL VAAILEAVVK AAGVPVTLKT RLGWHDDDQN

 151 LPAVAKIAED CGIAALAVPR ARAHANVQRR GALRTHRRDQ KPSEHPGLGQ

 201 RRHHFAAKSR RRPQTNRRRR HHDRARRARQ AVVFPRFEAL CRTRRFTACL

 251 EFGRMQSRHF EPHPRHARVL WXDRRCAHRT QTHRLVHRRN ARRRTGAA*
```

The following partial DNA sequence was identified in *N. meningitidis* <SEQ ID 2143>:

```
m661.seq
   1 ATGCACATCG GCGGCTATTT TATCGACAAC CCCATCGCAC TTGCGCCGAT

  51 GGCGGGCATT ACCGACAAAC CGTTCCGCCG ACTTTGCCGA GATTTTGGCG

 101 CAGGTTGGGC GGTGTGCGAA ATGCTGACCA GCGACCCGAC GCTCAGAAAT

 151 ACTAGAAAAA CCTTGCACCG CAGCGATTTT GCCGATGAAG GCGGCATTGT
```

-continued

```
201 TGCCGTGCAG ATTGCCGGAA GCGATCCGCA GCAGATGGCG GATGCCGCGC

251 GTTACAACGT CAGCCTTGGG GCGCAGCTTA TCGACATCAA CATGGGCTGT

301 CCCGCTAAAA AAGTCTGCAA TGTCCAAGCC GGTAGCGCGC TGATGCAGAA

351 CGAGCCGCTG GTTGCCGCCA TTTTGGAAGC CGTCGTCCGT GCGGCAGGCG

401 TACCCGTTAC CCTCAAAACC CGTTTGGGTT GGCACGACGA CCATCAAAAC

451 CTGCCCGTCA TCGCCAAAAT CGCCGAAGAT TGCGGCATCG CCGCCCTTGC

501 CGTCC.ACGG ACGCACGCGT ACGCAAATGT ACAAAGGCGA AGCGCGTTAC

551 GAACTCATCG CCGAAACCAA ATGCCGTCTG AACATCCCGG TCTGGGTCAA

601 CGGCGACATT ACTTCGCCGC AAAAAGCCCA AGCCGTCCTC AAACAAACCG

651 CCGCCGACGG CATTATGATA GGGCGCGGCG CGCAAGGCAG GCCGTGGTTC

701 TTCCGCGATT TGAAACATTA TGCCGAACAC GGTGTTTTGC CGCCTGCCTT

751 GAGTTTGGCA GAATGCGCCG CCGCTATTTT GAACCACATC CGCGCCATAC

801 ACGCGTTTTA CGGCGACACC GCCGGTGTGC GCATCGCACG CAAACACATA

851 GGCTGGTACA TCGACGAAAT GCCCGACGGC GAACAGACAC GTCGTGA
```

This corresponds to the amino acid sequence <SEQ ID 2144; ORF 661>:

```
m661.pep
  1 MHIGGYFIDN PIALAPMAGI TDKPFRRLCR DFGAGWAVCE MLTSDPTLRN

 51 TRKTLHRSDF ADEGGIVAVQ IAGSDPQQMA DAARYNVSLG AQLIDINMGC

101 PAKKVCNVQA GSALMQNEPL VAAILEAVVR AAGVPVTLKT RLGWHDDHQN

151 LPVIAKIAED CGIAALAVXR THAYANVQRR SALRTHRRNQ MPSEHPGLGQ

201 RRHYFAAKSP SRPQTNRRRR HYDRARRARQ AVVLPRFETL CRTRCFAACL

251 EFGRMRRRYF EPHPRHTRVL RRHRRCAHRT QTHRLVHRRN ARRRTDTS*
```

Computer analysis of this amino acid sequence gave the following results:
Homology with a Predicted ORF from *N. gonorrhoeae*

```
m661/g661  88.5% identity in 295 aa overlap
                    10        20        30        40        50        60
m661.pep   MHIGGYFIDNPIALAPMAGITDKPFRRLCRDFGAGWAVCEMLTSDPTLRNTRKTLHRSDF
           |||||||||||||||||||:||||||||| |||||||||||:||||||| |||||||
g661       MHIGGYFIDNPIALAPMAGIADKPFRRLCRAFGAGWAVCEMLASDPTLRNTGKTLHRSDF
                    10                  30        40        50        60

                    70        80        90       100       110       120
m661.pep   ADEGGIVAVQIAGSDPQQMADAARYNVSLGAQLIDINMGCPAKKVCNVQAGSALMQNEPL
           |||||||||||||||:||||||||||:||||:||||||||||||||||||||||:|||
g661       ADEGGIVAVQIAGSDPEQMADAARYNVGLGAQVIDINMGCPAKKVCNVQAGSALMQDEPL
                    70        80        90       100       110       120

                   130       140       150       160       170       180
m661.pep   VAAILEAVVRAAGVPVTLKTRLGWHDDHQNLPVIAKIAEDCGIAALAVXRTHAYANVQRR
           ||||||||:|||||||||||||||| ||||::||||||||||||| |::|:||||||
g661       VAAILEAVVKAAGVPVTLKTRLGWHDDDQNLPAVAKIAEDCGIAALAVPRARAHANVQRR
                   130       140       150       160       170       180

                   190       200       210       220       230       240
m661.pep   SALRTHRRNQMPSEHPGLGQRRHYFAAKSPSRPQTNRRRRHYDRARRARQAVVLPRFETL
           :|||||||:| |||||||||||:|||||  |||||||||:|||||||||||:||||:|
g661       GALRTHRRDQKPSEHPGLGQRRHHFAAKSRRRPQTNRRRRHHDRARRARQAVVFPRFEAL
                   190       200       210       220       230       240
```

-continued

```
                250        260          270       280        290         299
m661.pep   CRTRCFAACLEFGRMRRRYFEPHPRHTRVLRRHRRCAHRTQTHRLVHRRNARRRTDTSX
           |||| |:||||||||: |:|||||||:|||   |||||||||||||||||||||||
g661       CRTRRFTACLEFGRMQSRHGEPHPRHARVLWXDRRCAHRTQTHRLVHRRNARRRTGAAX
                250        260          270       280        290
```

The following partial DNA sequence was identified in *N. meningitidis* <SEQ ID 2145>:

```
a661.seq
   1 ATGCACATCG GCGGCTATTT TATCGACAAC CCCATCGCAC TTGCGCCGAT
  51 GGCGGGCATT ACCGACAAAC CGTTCCGCCG ACTTTGCCGA GATTTTGGCG
 101 CAGGTTGGGC GGTGTGCGAA ATGCTGACCA GCGACCCGAC GCTCAGAAAT
 151 ACTAGAAAAA CCTTGCACCG CAGCGATTTT GCCGATGAAG GCGGCATTGT
 201 TGCCGTGCAG ATTGCCGGAA GCGATCCGCA GCAGATGGCG GATGCCGCGC
 251 GTTACAACGT CAGCCTTGGG GCGCAGCTTA TCGACATCAA CATGGGCTGT
 301 CCCGCTAAAA AAGTCTGCAA TGTCCAAGCC GGTAGCGCGC TGATGCAGAA
 351 CGAGCCGCTG GTTGCCGCCA TTTTGGAGGC GGTGGTCAAA GCGGCGGGCG
 401 TACCCGTTAC CCTCAAAACC CGTTTGGGTT GGCACGACGA CCATCAAAAC
 451 CTGCCCGTCA TCGCCAAAAT CGCCGAAGAT TGCGGCATTG CCGCCCTTGC
 501 CG.TCCACGG ACGCACGCGC ACGCAAATGT ACAAAGGCGA AGCGGCTTAC
 551 GACCTGATTG CCGAAACCAA ATGCCGTCTG AACATCCCGG TCTGGGTCAA
 601 CGGCGACATT ACCTCGCCGC AAAAAGCCCA AGCCGTCCTC AAACAAACCG
 651 CCGCAGACGG CATTATGATA GGGCGCGGCG CGCAAGGCAG ACCGTGGTTC
 701 TTCCGCGATT TGAAACATTA CGCCGAACAC GGTGTTTTAC CGCCTGCCTT
 751 GAGTTTGGCA GAATGTACCG CCACTATTTT GAACCACATC CGAGCCATGC
 801 ACGCGTTTTA CGGCGACACC GCCGGTGTGC GCATCGCACG CAAACACATA
 851 GGCTGGTACA TCGACGAAAT GCCCGACGGC GAACAGACAC GTCGTGA
```

This corresponds to the amino acid sequence <SEQ ID 2146; ORF 661.a>:

```
a661.pep
      1 MHIGGYFIDN PIALAPMAGI TDKPFRRLCR DFGAGWAVCE MLTSDPTLRN
     51 TRKTLHRSDF ADEGGIVAVQ IAGSDPQQMA DAARYNVSLG AQLIDINMGC
    101 PAKKVCNVQA GSALMQNEPL VAAILEAVVK AAGVPVTLKT RLGWHDDHQN
    151 LPVIAKIAED CGIAALAXPR THAHANVQRR SGLRPDCRNQ MPSEHPGLGQ
    201 RRHYLAAKSP SRPQTNRRRR HYDRARRARQ TVVLPRFETL RRTRCFTACL
    251 EFGRMYRHYF EPHPSHARVL RRHRRCAHRT QTHRLVHRRN ARRRTDTS*
```

```
m661/a661  94.6% identity in 298 aa overlap
                10         20         30         40         50         60
m661.pep   MHIGGYFIDNPIALAPMAGITDKPFRRLCRDFGAGWAVCEMLTSDPTLRNTRKTLHRSDF
           ||||||||||||||||||||||||||||||||||||||||||||||||||||||||||||
a661       MHIGGYFIDNPIALAPMAGITDKPFRRLCRAFGAGWAVCEMLTSDPTLRNTRKTLHRSDF
                10         20         30         40         50         60

                70         80         90        100        110        120
m661.pep   ADEGGIVAVQIAGSDPQQMADAARYNVSLGAQLIDINMGCPAKKVCNVQAGSALMQNEPL
           ||||||||||||||||||||||||||||||||||||||||||||||||||||||||||||
a661       ADEGGIVAVQIAGSDPQQMADAARYNVSLGAQLIDINMGCPAKKVCNVQAGSALMQNEPL
                70         80         90        100        110        120
```

-continued

```
                 130       140       150       160       170       180
m661.pep  VAAILEAVVRAAGVPVTLKTRLGWHDDHQNLPVIAKIAEDCGIAALAVXRTHAYANVQRR
          |||||||||:|||||||||||||||||||||||||||||||||||||  ||||:||||||
a661      VAAILEAVVKAAGVPVTLKTRLGWHDDHQNLPVIAKIAEDCGIAALAXPRTHAHANVQRR
                 130       140       150       160       170       180

                 190       200       210       220       230       240
m661.pep  SALRTHRRNQMPSEHPGLGQRRHYFAAKSPSRPQTNRRRRHYDRARRARQAVVLPRFETL
          |:||   |||||||||||||||||:|||||||||||||||||||||||||:|||||||||
a661      SGLRPDCRNQMPSEHPGLGQRRHYLAAKSPSRPQTNRRRRHYDRARRARQTVVLPRFETL
                 190       200       210       220       230       240

                 250       260       270       280       290      299
m661.pep  CRTRCFAACLEFGRMRRRYFEPHPRHTRVLRRHRRCAHRTQTHRLVHRRNARRRTDTSX
           |||||:|||||||| |:|||||| |:||||||||||||||||||||||||||||||||
a661      RRTRCFTACLEFGRMYRHYFEPHPSHARVLRRHRRCAHRTQTHRLVHRRNARRRTDTSX
                 250       260       270       280       290
```

The following partial DNA sequence was identified in *N. gonorrhoeae* <SEQ ID 2147>:

```
g663.seq
  1 ATGTGTACCG AGATGAAATT TATATTTTTT GTACTGTATG TTTTGCAGTT

 51 TCTGCCGTTT GCGCTGCTGC ACAAGATTGC CGGCCTGATC GGTTCGCTTG

101 CCTACCTTCT GGTCAAACCG CGCCGCCGTA TCGGCGAAAT CAATTTGGCA

151 AAATGTTTTC CCGAATGGGA CGAAGAAAAG CGTAAAACCG TGTTGAAACA

201 GCATTTCAAA CACATGGCAA AACTGATGCT CGAATACGGC TTATATTGGT

251 ACGCGtctGC CAAATGCCTG AAATCGCTGG TGCGCTACCG CAATAAGCAT

301 TATTTGGACG ACGCGCTGGC GGCGGGGGAA AAAGTCATCA TCCTGTACCC

351 GCACTTTACC GCGTTCGAGA TGGCGGTGTA CGCGCTTAAT CAGGATGTCC

401 CGCTGATCAG TATGTATTCC CACCAAAAAA ACAAGATATT GGACGAACAG

451 ATTTTGAAAg gccgcaACCG CTATCACAAC GTCTTCCTTA TCGGGCGCAC

501 CGAagggctg cgCGCCCtcg TCAAACAGTT CCGCAAAAGC AGTGCGCCGT

551 TCCTGTATCT GCCCGATCAG GATTTCGGAC GCAACAATTC GGTTTTTGTG

601 GATTTTTTCG GCATtcagaC GGCAACGATT ACCGGCTTGA GCCGCATTGC

651 CGCGCTTGCA AATGCAAAAG TGATACCCGC CATTCCCGTC CGCGAGGCGG

701 ACAATACGGT TACATTGCAA TTCTATCCCG CTTGGAAATC CTTTCCGAGT

751 GAAGACGCGC AAGCCGACGC GCAACGTATG AACCGCTTTA TCGAAGAACG

801 CGTGCGCGAA CACCCGGAAC AATATTTCTG GCTGCACAAG CGTTTCAAAA

851 CCCGTCCGGA AGGCAGCCCC GATTTTTACT GA
```

This corresponds to the amino acid sequence <SEQ ID 2148; ORF 663.ng>:

```
g663.pep
  1 MCTEMKFIFF VLYVLQFLPF ALLHKIAGLI GSLAYLLVKP RRRIGEINLA

 51 KCFPEWDEEK RKTVLKQHFK HMAKLMLEYG LYWYASAKCL KSLVRYRNKH

101 YLDDALAAGE KVIILYPHFT AFEMAVYALN QDVPLISMYS HQKNKILDEQ

151 ILKGRNRYHN VFLIGRTEGL RALVKQFRKS SAPFLYLPDQ DFGRNNSVFV

201 DFFGIQTATI TGLSRIAALA NAKVIPAIPV READNTVTLQ FYPAWKSFPS

251 EDAQADAQRM NRFIEERVRE HPEQYFWLHK RFKTRPEGSP DFY*
```

The following partial DNA sequence was identified in *N. meningitidis* <SEQ ID 2149>:

```
m663.seq
   1 ATGTGTATCG AGATGAAATT TATATTTTTT GTACTGTATG TTTTGCAGTT

  51 TCTGCCGTTT GCGCTGCTGC ACAAGATTGC CGACCTGACG GGTTTGCTTG

 101 CCTACCTTCT GGTCAAACCG CGCCGCCGTA TCGGCGAAAT CAATTTGGCA

 151 AAATGTTTTT CCGAATGGAG TGAGGAAAAG CGTAAAACCG TGTTGAAACA

 201 GCATTTCAAA CACATGGCGA AACTGATGTT GGAATACGGT TTATATTGGT

 251 ACGCGCCTGC CGGACGTTTG AAATCGCTGG TGCGCTACCG CAATAAGCAT

 301 TATTTGGACG ACGCGCTGGC GGCGGGGGAA AAAGTCATCA TCCTGTATCC

 351 GCACTTCACC GCGTTCGAGA TGGCGGTGTA CGCGCTTAAT CAGGATATCC

 401 CGCTGATCAG TATGTATTCC CATCAAAAAA ACAAGATATT GGACGAACAG

 451 ATTTTGAAAG GCCGCAACCG CTATCACAAC GTCTTCCTTA TCGGGCGCAC

 501 CGAAGGGCTG CGCGCCCTCG TCAAACAGTT CCGCAAAAGC AGCGCGCCGT

 551 TTCTGTATCT GCCCGATCAG GATTTCGGAC GCAACGATTC GGTTTTTGTG

 601 GATTTTTTCG GTATTCAGAC GGCAACGATT ACCGGATTGA GCCGCATTGC

 651 CGCGCTTGCA AATGCAAAAG TGATACCCGC CATTCCCGTC CGCGAGGCAG

 701 ACAATACGGT TACATTGCAT TTCTACCCTG CTTGGAAATC CTTTCCGGGT

 751 GAAGACGCGA AAGCCGACGC GCAGCGCATG AACCGTTTTA TCGAAGACAG

 801 GGTGCGCGAA CATCCGGAAC AATATTTTTG GCTGCACAAG CGTTTTAAAA

 851 CCCGTCCGGA AGGCAGCCCC GATTTTTACT GA
```

This corresponds to the amino acid sequence <SEQ ID 2150; ORF 663>:

```
m663.pep
   1 MCIEMKFIFF VLYVLQFLPF ALLHKIADLT GLLAYLLVKP RRRIGEINLA

  51 KCFSEWSEEK RKTVLKQHFK HMAKLMLEYG LYWYAPAGRL KSLVRYRNKH

 101 YLDDALAAGE KVIILYPHFT AFEMAVYALN QDIPLISMYS HQKNKILDEQ

 151 ILKGRNRYHN VFLIGRTEGL RALVKQFRKS SAPFLYLPDQ DFGRNDSVFV

 201 DFFGIQTATI TGLSRIAALA NAKVIPAIPV READNTVTLH FYPAWKSFPG

 251 EDAKADAQRM NRFIEDRVRE HPEQYFWLHK RFKTRPEGSP DFY*
```

Computer analysis of this amino acid sequence gave the following results:
Homology with a Predicted ORF from *N. gonorrhoeae*

```
m663/g663 94.9% identity in 293 aa overlap

                   10        20        30        40        50        60
m663.pep  MCIEMKFIFFVLYVLQFLPFALLHKIADLTGLLAYLLVKPRRRIGEINLAKCFSEWSEEK
          || |||||||||||||||||||||| | | |||||||||||||||||||| ||:|||
g663      MCTEMKFIFFVLYVLQFLPFALLHKIAGLIGSLAYLLVKPRRRIGEINLAKCFPEWDEEK
                   10        20        30        40        50        60

                   70        80        90       100       110       120
m663.pep  RKTVLKQHFKHMAKLMLEYGLYWYAPAGRLKSLVRYRNKHYLDDALAAGEKVIILYPHFT
          ||||||||||||||||||||||| |  |||||||||||||||||||||||||||||||
g663      RKTVLKQHFKHMAKLMLEYGLYWYASAKCLKSLVRYRNKHYLDDALAAGEKVIILYPHFT
                   70        80        90       100       110       120
```

-continued

```
                 130       140       150       160       170       180
m663.pep AFEMAVYALNQDIPLISMYSHQKNKILDEQILKGRNRYHNVFLIGRTEGLRALVKQFRKS
         ||||||||||||:|||||||||||||||||||||||||||||||||||||||||||||||
g663     AFEMAVYALNQDVPLISMYSHQKNKILDEQILKGRNRYHNVFLIGRTEGLRALVKQFRKS
                 130       140       150       160       170       180

                 190       200       210       220       230       240
m663.pep SAPFLYLPDQDFGRNDSVFVDFFGIQTATITGLSRIAALANAKVIPAIPVREADNTVTLH
         |||||||||||||||:||||||||||||||||||||||||||||||||||||||||||||:
g663     SAPFLYLPDQDFGRNNSVFVDFFGIQTATITGLSRIAALANAKVIPAIPVREADNTVTLQ
                 190       200       210       220       230       240

                 250       260       270       280       290
m663.pep FYPAWKSFPGEDAKADAQRMNRFIEDRVREHPEQYFWLHKRFKTRPEGSPDFYX
         |||||||||:|||:|||||||||||:||||||||||||||||||||||||||||
g663     FYPAWKSFPSEDAQADAQRMNRFIEERVREHPEQYFWLHKRFKTRPEGSPDFYX
                 250       260       270       280       290
```

The following partial DNA sequence was identified in *N. meningitidis* <SEQ ID 2151>:

```
a663.seq
    1 ATGTGTATCG AGATGAAATT TATATTTTTT GTACTGTATG TTTTGCAGTT

   51 TCTGCCGTTT GCGCTGCTGC ACAAACTTGC TGATCTGACA GGCTTGCTCG

  101 CCTACCTTTT GGTCAAACCC CGCCGCCGTA TCGGCGAAAT CAATTTGGCA

  151 AAATGCTTTC CCGAGTGGGA CGGAAAAAAG CGTAAAACCG TGTTGAAACA

  201 GCATTTCAAA CATATGGCGA AACTGATGTT GGAATACGGT TTATATTGGT

  251 ACGCGCCCGC CGGGCGTTTG AAATCACTGG TGCGCTACCG CAACAAACAT

  301 TATTTGGACG ACGCTCTGGC GGCAGGGGAA AAAGTCATCA TCCTGTATCC

  351 GCACTTCACC GCGTTCGAGA TGGCGGTGTA CGCGCTCAAT CAGGATGTTC

  401 CGCTGATCAG TATGTATTCC CACCAAAAAA ACAAGATATT GGACGAACAG

  451 ATTTTGAAAG GCCGCAACCG CTATCACAAC GTTTTCCTTA TCGGGCGCAC

  501 CGAAGGGCTG CGCGCCCTCG TCAAACAGTT CCGCAAAAGC AGCGCGCCGT

  551 TTCTGTATCT GCCCGATCAG GATTTCGGAC GCAACGATTC GGTTTTTGTC

  601 GATTTCTTCG GTATTCGGAC GGCAACGATT ACCGGCTTGA GCCGCATTGC

  651 CGCGCTTGCA AATGCAAAAG TGATACCCGC CATCCCTGTC CGCGAGGCGG

  701 ACAATACGGT TACATTGCAT TTCTACCCTG CTTGGGAATC CTTTCCGAGT

  751 GAAGATGCGC AGGCCGACGC GCAGCGCATG AACCGTTTTA TCGAGGAACG

  801 CGTGCGCGAA CATCCCGAGC AGTATTTTTG GCTGCACAAG CGTTTCAAAA

  851 CCCGTCCGGA AGGCAGCCCC GATTTTTACT GA
```

This corresponds to the amino acid sequence <SEQ ID 2152; ORF 663.a>:

```
a663.pep

      1 MCIEMKFIFF VLYVLQFLPF ALLHKLADLT GLLAYLLVKP RRRIGEINLA

     51 KCFPEWDGKK RKTVLKQHFK HMAKLMLEYG LYWYAPAGRL KSLVRYRNKH

    101 YLDDALAAGE KVIILYPHFT AFEMAVYALN QDVPLISMYS HQKNKILDEQ

    151 ILKGRNRYHN VFLIGRTEGL RALVKQFRKS SAPFLYLPDQ DFGRNDSVFV

    201 DFFGIRTATI TGLSRIAALA NAKVIPAIPV READNTVTLH FYPAWESFPS

    251 EDAQADAQRM NRFIEERVRE HPEQYFWLHK RFKTRPEGSP DFY*

m663/a663 96.2% identity in 293 aa overlap
```

-continued

```
                  10        20        30        40        50        60
m663.pep  MCIEMKFIFFVLYVLQFLPFALLHKIADLTGLLAYLLVKPRRRIGEINLAKCFSEWSEEK
          ||||||||||||||||||||||||:|||||||||||||||||||||||||||| ||: :|
a663      MCIEMKFIFFVLYVLQFLPFALLHKLADLTGLLAYLLVKPRRRIGEINLAKCFPEWDGKK
                  10        20        30        40        50        60

                  70        80        90       100       110       120
m663.pep  RKTVLKQHFKHMAKLMLEYGLYWYAPAGRLKSLVRYRNKHYLDDALAAGEKVIILYPHFT
          ||||||||||||||||||||||||||||||||||||||||||||||||||||||||||||
a663      RKTVLKQHFKHMAKLMLEYGLYWYAPAGRLKSLVRYRNKHYLDDALAAGEKVIILYPHFT
                  70        80        90       100       110       120

                 130       140       150       160       170       180
m663.pep  AFEMAVYALNQDIPLISMYSHQKNKILDEQILKGRNRYHNVFLIGRTEGLRALVKQFRKS
          ||||||||||||:|||||||||||||||||||||||||||||||||||||||||||||||
a663      AFEMAVYALNQDVPLISMYSHQKNKILDEQILKGRNRYHNVFLIGRTEGLRALVKQFRKS
                 130       140       150       160       170       180

                 190       200       210       220       230       240
m663.pep  SAPFLYLPDQDFGRNDSVFVDFFGIQTATITGLSRIAALANAKVIPAIPVREADNTVTLH
          ||||||||||||||||||||||||||:|||||||||||||||||||||||||||||||||
a663      SAPFLYLPDQDFGRNDSVFVDFFGIRTATITGLSRIAALANAKVIPAIPVREADNTVTLH
                 190       200       210       220       230       240

                 250       260       270       280       290
m663.pep  FYPAWKSFPGEDAKADAQRMNRFIEDRVREHPEQYFWLHKRFKTRPEGSPDFYX
          |||||:|||:|||:|||||||||||:||||||||||||||||||||||||||||
a663      FYPAWESFPSEDAQADAQRMNRFIEERVREHPEQYFWLHKRFKTRPEGSPDFYX
                 250       260       270       280       290
```

The following partial DNA sequence was identified in *N. gonorrhoeae* <SEQ ID 2153>:

```
g664.seq
     1  ATGATACATC CGCACCACTT CCGCGCCTTT TTCATAAACG GTCATGGTGT

    51  AGAAATTGTT CATCTCCTCA TAGCTGAcgg gGCGCACCGG ATGGGCGGTC

   101  GGGCCTGCGT CTTCGGGGAA CTGGTTCTGG CGCAGCAGGC GGATGTTCTC

   151  GATGCGGCGC ACGGCGCGGC CGGCGCGGTC GCCGGAAAAC TCTTGGTCGC

   201  GGAACACGGT CAGCCCTTCC TTCAGCGAAA GCTGGAACCA GTCGCGGCAG

   251  GTTACGCGGT TGCCCGTCCA GTTGTGGAAA TATTCGTGTC CGACCACGGA

   301  TTCAATGCCT TCGAAATCGG TATCGGTGGC GGTGCGGCTG TCGGCGAGGA

   351  CGAACTTGGT GTTAAAAATG TTCAAACCCT TGTTTTCCAT CGCGCCCATA

   401  TTGAAATCGC CTACGGCGAC GACCATGAaa atatccaagt cataTTCcaa

   451  cCcgaagcgc gtttcgtcCc acttcatcgC gtTTTTTCAA cgaTTCCACG

   501  GCAAAGCCGA CCTTGGGTTT GTCCGCTTCG GTGGTGTAAA ACTCGATTTT

   551  GA
```

This corresponds to the amino acid sequence <SEQ ID 2154; ORF 664.ng>:

```
g664.pep
     1  MIHPHHFRAF FINGHGVEIV HLLIADGAHR MGGRACVFGE LVLAQQADVL

    51  DAAHGAAGAV AGKLLVAEHG QPFLQRKLEP VAAGYAVARP VVEIFVSDHG

   101  FNAFEIGIGG GAAVGEDELG VKNVQTLVFH RAHIEIAYGD DHENIQVIFQ

   151  PEARFVPLHR VFSTIPRQSR PWVCPLRWCK TRF*
```

The following partial DNA sequence was identified in *N. meningitidis* <SEQ ID 2155>:

```
m664.seq
   1  GTGATACATC CGCACTACTT CCGCGCCTTT TTCATAAACG GTCATGGTGT
```

-continued

```
 51 AGAAATTGTT CATCTCCTCA TAGCTGGCGG GGCGCACCGG ATGGGCGGTC

101 GGGCCTGCGT CTTCGGGGAA CTGGTGCTGG CGCAGCAGGC GGATGTTTTC

151 GATGCGGCGC ACGGCGCGGC TGGCGCGGTC GCCGGAAAAT TCTTGGTCGC

201 GGAACACGGT CAGCCCTTCC TTCAGCGAAA GCTGGAACCA GTCGCGGCAG

251 GTTACGCGGT TGCCCGTCCA GTTGTGGAAA TACTCGTGTC CGACCACGGA

301 TTCGATGCCT TCGAAATCGG TATCGGTGGC GGTGCGGCTG TCGGCAAGGA

351 CGAACTTGGT GTTAAAGATG TTCAAACCCT TGTTTTCCAT CGCGCCCATA

401 TTGAAATCGC CCACGGCGAC GACCATGAAA ATATCCAAGT CGTATTCCAA

451 ACCGAAGCGC GTTTCGTCCC ATTTCATCGC GTTTTT.CAA CGATTCCACG

501 GCAAAGCCGA CCTTGGGCTT GTCCGCTTCG GTGGTGTAAA ACTCGATTTT

551 GA
```

This corresponds to the amino acid sequence <SEQ ID 2156; ORF 664>:

```
m664.pep
  1 VIHPHYFRAF FINGHGVEIV HLLIAGGAHR MGGRACVFGE LVLAQQADVF

 51 DAAHGAAGAV AGKFLVAEHG QPFLQRKLEP VAAGYAVARP VVEILVSDHG

101 FDAFEIGIGG GAAVGKDELG VKDVQTLVFH RAHIEIAHGD DHENIQVVFQ

151 TEARFVPFHR VFXTIPRQSR PWACPLRWCK TRF*
```

Computer analysis of this amino acid sequence gave the following results:

Homology with a Predicted ORF from *N. gonorrhoeae*

```
m664/g664 91.8% identity in 183 aa overlap

                   10        20        30        40        50        60
m664.pep  VIHPHYFRAFFINGHGVEIVHLLIAGGAHRMGGRACVFGELVLAQQADVFDAAHGAAGAV
          :||||:||||||||||||||||||| ||||| ||||||||||||||||||:||||||||||
g664      MIHPHHFRAFFINGHGVEIVHLLIADGAHRMGGRACVFGELVLAQQADVLDAAHGAAGAV
                   10        20        30        40        50        60

                   70        80        90       100       110       120
m664.pep  AGKFLVAEHGQPFLQRKLEPVAAGYAVARPVVEILVSDHGFDAFEIGIGGGAAVGKDELG
          |||:||||||||||||||||||||||||||||||:||||||:||||||||||||||:||||
g664      AGKLLVAEHGQPFLQRKLEPVAAGYAVARPVVEIFVSDHGFNAFEIGIGGGAAVGEDELG
                   70        80        90       100       110       120

                  130       140       150       160       170       180
m664.pep  VKDVQTLVFHRAHIEIAHGDDHENIQVVFQTEARFVPFHRVFXTIPRQSRPWACPLRWCK
          ||:||||||||||||||:|||||||||:|| ||||||:|||| |||||||||:|||||||
g664      VKNVQTLVFHRAHIEIAYGDDHENIQVIFQPEARFVPLHRVFSRIPRQSRPWVCPLRWCK
                  130       140       150       160       170       180

m664.pep  TRFX
          ||||
g664      TRFX
```

The following partial DNA sequence was identified in *N. meningitidis* <SEQ ID 2157>:

```
a664.seq
  1 GTGATACATC CGCACCACTT CCGCGCCTTT TTCATAAACG GTCATGGTGT

 51 AGAAATTGTT CATCTCCTCA TATCGGGCGG GGCGCACCGG ATGTGCGGTC

101 GGACCTGCGT CTTCGGGGAA CTGGTGCTGG CGCAGCAGGC GGATGTTTTC

151 GATACGGCGC ACGGCGCGGC TGGCGCGGTC GCCGGAAAAT TCTTGGTCGC

201 GGAACACGGT CAACCCTTCC TTCAGCGAAA GCTGGAACCA GTCGCGGCAG
```

-continued

```
251 GTCACGCGGT TGCCCGTCCA GTTGTGGAAA TATTCGTGTC CGACCACGGA

301 TTCGATGCCT TCAAAATCGG TATCGGTGGC GGTACGGCTG TCGGCAAGGA

351 CGAACTTGGT GTTAAAGATG TTCAAACCCT TGTTTTCCAT CGCACCCATA

401 TTGAAATCGC CCACGGCGAC GACCATGAAA ATATCCAAGT CGTATTCCAA

451 ACCGAAGCGC GTTTCGTCCC ACTTCATTGC GTTTTT.CAG CGATTCCACG

501 GCAAAGCCGA CCTTGGGCTT GTCCGCTTCG GTGGTGTAAA ACTCGATTTT

551 GA
```

This corresponds to the amino acid sequence <SEQ ID 2158; ORF 664.a>:

```
a664.pep

      1 VIHPHHFRAF FINGHGVEIV HLLISGGAHR MCGRTCVFGE LVLAQQADVF

     51 DTAHGAAGAV AGKFLVAEHG QPFLQRKLEP VAAGHAVARP VVEIFVSDHG

    101 FDAFKIGIGG GTAVGKDELG VKDVQTLVFH RTHIEIAHGD DHENIQVVFQ

    151 TEARFVPLHC VFXAIPRQSR PWACPLRWCK TRF*

 m664/a664 92.9% identity in 183 aa overlap

                   10        20        30        40        50        60
m664.pep  VIHPHYFRAFFINGHGVEIVHLLIAGGAHRMGGRACVFGELVLAQQADVFDAAHGAAGAV
          |||||:|||||||||||||||||:|||||| ||:|||||||||||||||:||||||||
a664      VIHPHHFRAFFINGHGVEIVHLLISGGAHRMCGRTCVFGELVLAQQADVFDTAHGAAGAV
                   10        20        30        40        50        60

                   70        80        90       100       110       120
m664.pep  AGKFLVAEHGQPFLQRKLEPVAAGYAVARPVVEILVSDHGFDAFEIGIGGGAAVGKDELG
          ||||||||||||||||||||||||:|||||||||:|||||||||:||||||:||||||||
a664      AGKFLVAEHGQPFLQRKLEPVAAGHAVARPVVEIFVSDHGFDAFKIGIGGGTAVGKDELG
                   70        80        90       100       110       120

                  130       140       150       160       170       180
m664.pep  VKDVQTLVFHRAHIEIAHGDDHENIQVVFQTEARFVPFHRVFXTIPRQSRPWACPLRWCK
          ||||||||||:||||||||||||||||||||||||:| |||:||||||||||||||||
a664      VKDVQTLVFHRTHIEIAHGDDHENIQVVFQTEARFVPLHCVFXAIPRQSRPWACPLRWCK
                  130       140       150       160       170       180

m664.pep  TRFX
          ||||
a664      TRFX
```

The following partial DNA sequence was identified in *N. gonorrhoeae* <SEQ ID 2159>:

```
g665.seq
    1   atgaagtgGg acgaaacgcg cttcgGgttg GAAtatgact tggatatttT

   51   CATGGTCGTC GCCGTAGGCG ATTTCAATAT GGGCGCGATG GAAAACAAGG

  101   GTTTGAACAT TTTTAACACC AAGTTCGTCC TCGCCGACAG CCGCACCGCC

  151   ACCGATACCG ATTTCGAAGG CATTGAATCC GTGGTCGGAC ACGAATATTT

  201   CCACAACTGG ACGGGCAACC GCGTAACCTG CCGCGACTGG TTCCAGCTTT

  251   CGCTGAAGGA AGGGCTGACC GTGTTCCGCG ACCAAGAGTT TTCCGGCGAC

  301   CGCGCCGGCC GCGCCGTGCG CCGCATCGAG AACATCCGCC TGCTGCGCCA

  351   GAACCAGTTC CCCGAAGACG CAGGCCCGAC CGCCCATCCG GTGCGCcccg

  401   TCAGCTATGA GGAGATGAAC AATTTCTACA CCATGACCGT TTATGAAAAA

  451   GGCGCGGAAG TGGTGCGGAT GTATCATACC CTGCTCGGCG AAGAGGGCTT

  501   CCAAAAAGGC ATGAAGCTAT ATTTCcaacg CCACGACGGA CAGGCAGTGA
```

-continued

```
 551 CCTGCGACGA TTTCCGCGCG GCGatggcgg ATGCGAACGG CATCAATCTC

 601 GACCAGTTCG CCTTGTGGTA CAGCCAGGCG GGCACGCCCG TTTTGGAAGC

 651 CGAAGGCCGT CTGAAAAACA ATGTTTTCGA GTTAACCATT AAACAAACCG

 701 TGCCGCCCAC GCCCGATATG GCGGACAAAC AGCCGATGAT GATTCCCGTC

 751 AAAGTCGGGC TTCTGAACCG CAACGGCGAA GCGGTGGCAT TCGATTATCA

 801 GGGCAAACGC GCAACCGAAG CCGTGTTGCT GATGACCGAA GCCGAACagg

 851 CCTTCCCGCT CGAAGGTGTA ACCGAAGCCG TCGTTCCCTC GCTGCTGCGC

 901 GGGTTCAGCG CGCCAGTGTA TCTGAACTAT CCGTACAGCG ACGACGACCT

 951 GCTGCTCCTG CTCGCCCACG ACAGCGACGC TTTCACGTGC TGGGAAGCCG

1001 CCCAAACGCT CTACCGTCGC GCCGTCGCCG CCAACCTTGC CGCGCTTTCA

1051 GACGGCATCG GGTTGCCGAA ACACGAAAAA CTGCTTGCCG CCGTCGAAAA

1101 AGTCATTTCA GACGACCTCT TGGACAACGC CTTCAAAGCC CTGCTTTTGG

1151 GCGTGCCGTC CGAAGCCGAa ctGTGGGACG GCACGGAAAA CATcgaCCCG

1201 CTGCGCTACC ATCAGGCGCG CGAAGCCTTG TTGGATACGC TTGCCGtcCG

1251 CttcctgcCG AAATGGCACG AATTGGaccg tcaggcggcg aagCAggaaa

1301 accaaagtTA CGAATACAGC CCCGAAACCG CCGACTGGCG CACGCTGCGC

1351 AACGTCTGCC GCGCCTtcgt cctGCGCGCC GACCCCGCGC acatcgAAAC

1401 TGTTGCCGAA Aaatacggcg AAATGGCGCA AAACATGACC CACGAATGGG

1451 GCATCCTGTC CGCCGTCAAC GGCAACGAAA GCGATACGCG CAACTGCCTG

1501 CTGGCGCAGT TTGCCGAcaa gTtttcAGAC GACGCGCTGG TGATGGACAA

1551 ATATTTCGCC CTTATCGGCT CAAGccgccg cagCGACACC CTGCAACAGG

1601 TTCAAACCGC CTTGCAGCAT CCGAAATTCA GTCTCGAAAA CCCCAACAAA

1651 GCCCGTTCGC TCATCGGCAG CTTCAGCCGC AACGTCCCGC ATTTTCACGC

1701 ACAAGACGGC AGCGGCTACC GCTTCATCGC CGACAAAGTC ATCGAAATCG

1751 ACCGCTTCAA cCCGCAggtc gccGCCCGCC TGGTGCAGGC GTTCAACCTC

1801 TGCAACAAGC TCGAGCCGCA CCGCAAAAAC TTgGTGAAAC AAGAATTGCA

1851 GTGCATTCGG GCGCAGGAAG GATTGTCGAA AGacGTGGGC GAaatcgtCG

1901 GCAAGATTTT GGGTTGA
```

This corresponds to the amino acid sequence <SEQ ID 2160; ORF 665.ng>:

```
g665.pep
   1 MKWDETRFGL EYDLDIFMVV AVGDFNMGAM ENKGLNIFNT KFVLADSRTA

  51 TDTDFEGIES VVGHEYFHNW TGNRVTCRDW FQLSLKEGLT VFRDQEFSGD

 101 RAGRAVRRIE NIRLLRQNQF PEDAGPTAHP VRPVSYEEMN NFYTMTVYEK

 151 GAEVVRMYHT LLGEEGFQKG MKLYFQRHDG QAVTCDDFRA AMADANGINL

 201 DQFALWYSQA GTPVLEAEGR LKNNVFELTI KQTVPPTPDM ADKQPMMIPV

 251 KVGLLNRNGE AVAFDYQGKR ATEAVLLMTE AEQAFPLEGV TEAVVPSLLR

 301 GFSAPVYLNY PYSDDDLLLL LAHDSDAFTC WEAAQTLYRR AVAANLAALS

 351 DGIGLPKHEK LLAAVEKVIS DDLLDNAFKA LLLGVPSEAE LWDGTENIDP

 401 LRYHQAREAL LDTLAVRFLP KWHELDRQAA KQENQSYEYS PETADWRTLR
```

-continued

```
451 NVCRAFVLRA DPAHIETVAE KYGEMAQNMT HEWGILSAVN GNESDTRNCL

501 LAQFADKFSD DALVMDKYFA LIGSSRRSDT LQQVQTALQH PKFSLENPNK

551 ARSLIGSFSR NVPHFHAQDG SGYRFIADKV IEIDRFNPQV AARLVQAFNL

601 CNKLEPHRKN LVKQELQCIR AQEGLSKDVG EIVGKILG*
```

The following partial DNA sequence was identified in *N. meningitidis* <SEQ ID 2161>:

```
m665.seq
   1 ATGAAATGGG ACGAAACGCG CTTCGGTTTG GAATACGACT TGGATATTTT

  51 CATGGTCGTC GCCGTGGGCG ATTTCAATAT GGGCGCGATG GAAAACAAGG

 101 GTTTGAACAT CTTTAACACC AAGTTCGTCC TTGCCGACAG CCGCACCGCC

 151 ACCGATACCG ATTTCGAAGG CATCGAATCC GTGGTCGGAC ACGAGTATTT

 201 CCACAACTGG ACGGGCAACC GCGTAACCTG CCGCGACTGG TTCCAGCTTT

 251 CGCTGAAGGA AGGGCTGACC GTGTTCCGCG ACCAAGAATT TTCCGGCGAC

 301 CGCGCCAGCC GCGCCGTGCG CCGCATCGAA AACATCCGCC TGCTGCGCCA

 351 GCACCAGTTC CCCGAAGACG CAGGCCCGAC CGCCCATCCG GTGCGCCCCG

 401 CCAGCTATGA GGAGATGAAC AATTTCTACA CCATGACCGT TTATGAAAAA

 451 GGCGCGGAAG TAGTGCGGAT GTATCACACC CTGCTCGGCG AAGAGGGCTT

 501 CCAGAAAGGC ATGAAGCTCT ATTTCCAACG CCACGACGGA CAGGCCGTTA

 551 CCTGCGACGA TTTCCGCGCG GCGATGGCGG ACGCGAACGG CATCAATCTC

 601 GACCAGTTCG CCTTGTGGTA CAGCCAGGCG GGCACGCCCG TTTTGGAAGC

 651 GGAAGGTCGT CTGAAAAACA ATATTTTCGA GTTGACCGTC AAACAAACCG

 701 TGCCGCCCAC GCCCGATATG ACGGATAAAC AGCCGATGAT GATTCCCGTC

 751 AAGGTCGGGC TGCTGAACCG CAACGGCGAA GCGGTGGCAT TCGACTATCA

 801 GGGCAAACGC GCGACCGAAG CCGTGTTGCT GCTGACCGAA GCCGAACAGA

 851 CCTTCCTGCT CGAAGGCGTA ACCGAAGCCG TCGTTCCCTC GCTGCTGCGC

 901 GGGTTCAGCG CGCCGGTGCA TCTGAACTAT CCGTACAGCG ACGACGACCT

 951 GCTGCTCCTG CTCGCCCATG ACAGCGACGC CTTCACGCGC TGGGAAGCCG

1001 CCCAAACGCT CTACCGCCGC GCCGTCGCCG CCAACCTTGC CACGCTTTCA

1051 GACGGCGTTG AGCTGCCGAA ACACGAAAAA CTGCTTGCCG CCGTCGAAAA

1101 AGTCATTTCA GACGACCTCT TAGACAACGC CTTCAAAGCC CTGCTTTTGG

1151 GCGTGCCATC CGAAGCCGAG CTGTGGGACG GCGCAGAAAA CATCGACCCG

1201 CTGCGCTACC ATCAGGCGCG CGAAGCCTTG TTGGATACGC TTGCCGTCCA

1251 CTTCCTGCCG AAATGGCACG AATTGAACCG TCAGGCGGCG AAGCAGGAAA

1301 ACCAAAGCTA CGAATACAGC CCCGAAGCCG CCGGCTGGCG CACGCTGCGC

1351 AACGTCTGCC GCGCCTTTGT CCTGCGCGCC GACCCCGCGC ACATCGAAAC

1401 CGTTGCCGAA AAATACGGCG AAATGGCGCA AAACATGACC CACGAATGGG

1451 GCATCCTGTC CGCCGTCAAC GGCAACGAAA GCGATACGCG CAACCGCCTG

1501 CTGGCGCAGT TTGCCGACAA GTTTTCAGAC GACGCGCTGG TGATGGACAA

1551 ATATTTTGCC CTCGTCGGCT CAAGCCGCCG CAGCGACACC CTGCAACAGG

1601 TTCGAACCGC CTTGCAGCAT CCGAAATTCA GCCTCGAAAA CCCCAACAAA
```

-continued

```
1651 GCCCGTTCGC TCATCGGCAG CTTCAGCCGC AACGTCCCGC ATTTCCACGC

1701 AGAAGACGGC AGCGGCTACC GCTTCATCGC CGACAAAGTC ATCGAAATCG

1751 ACCGCTTCAA CCCGCAGGTC GCCGCCCGCT TAGTGCAGGC GTTCAACCTC

1801 TGCAACAAGC TCGAGCCGCA CCGCAAAAAC TTGGTGAAAC AAGCATTGCA

1851 GCGCATTCGG GCGCAGGAAG GATTGTCGAA AGACGTGGGC GAAATCGTCG

1901 GCAAAATTTT GGATTGA
```

This corresponds to the amino acid sequence <SEQ ID 2162; ORF 665>:

```
m665.pep
  1 MKWDETRFGL EYDLDIFMVV AVGDFNMGAM ENKGLNIFNT KFVLADSRTA

 51 TDTDFEGIES VVGHEYFHNW TGNRVTCRDW FQLSLKEGLT VFRDQEFSGD

101 RASRAVRRIE NIRLLRQHQF PEDAGPTAHP VRPASYEEMN NFYTMTVYEK

151 GAEVVRMYHT LLGEEGFQKG MKLYFQRHDG QAVTCDDFRA AMADANGINL

201 DQFALWYSQA GTPVLEAEGR LKNNIFELTV KQTVPPTPDM TDKQPMMIPV

251 KVGLLNRNGE AVAFDYQGKR ATEAVLLLTE AEQTFLLEGV TEAVVPSLLR

301 GFSAPVHLNY PYSDDDLLLL LAHDSDAFTR WEAAQTLYRR AVAANLATLS

351 DGVELPKHEK LLAAVEKVIS DDLLDNAFKA LLLGVPSEAE LWDGAENIDP

401 LRYHQAREAL LDTLAVHFLP KWHELNRQAA KQENQSYEYS PEAAGWRTLR

451 NVCRAFVLRA DPAHIETVAE KYGEMAQNMT HEWGILSAVN GNESDTRNRL

501 LAQFADKFSD DALVMDKYFA LVGSSRRSDT LQQVRTALQH PKFSLENPNK

551 ARSLIGSFSR NVPHFHAEDG SGYRFIADKV IEIDRFNPQV AARLVQAFNL

601 CNKLEPHRKN LVKQALQRIR AQEGLSKDVG EIVGKILD*
```

Computer analysis of this amino acid sequence gave the following results:

Homology with a Predicted ORF from *N. gonorrhoeae*

```
m665/g665 96.1% identity in 637 aa overlap

                    10        20        30        40        50        60
m665.pep   MKWDETRFGLEYDLDIFMVVAVGDFNMGAMENKGLNIFNTKFVLADSRTATDTDFEGIES
           ||||||||||||||||||||||||||||||||||||||||||||||||||||||||||||
g665       MKWDETRFGLEYDLDIFMVVAVGDFNMGAMENKGLNIFNTKFVLADSRTATDTDFEGIES
                    10        20        30        40        50        60

                    70        80        90       100       110       120
m665.pep   VVGHEYFHNWTGNRVTCRDWFQLSLKEGLTVFRDQEFSGDRASRAVRRIENIRLLRQHQF
           ||||||||||||||||||||||||||||||||||||||||||:||||||||||||||:||
g665       VVGHEYFHNWTGNRVTCRDWFQLSLKEGLTVFRDQEFSGDRAGRAVRRIENIRLLRQNQF
                    70        80        90       100       110       120

                   130       140       150       160       170       180
m665.pep   PEDAGPTAHPVRPASYEEMNNFYTMTVYEKGAEVVRMYHTLLGEEGFQKGMKLYFQRHDG
           |||||||||||||:||||||||||||||||||||||||||||||||||||||||||||||
g665       PEDAGPTAHPVRPVSYEEMNNFYTMTVYEKGAEVVRMYHTLLGEEGFQKGMKLYFQRHDG
                   130       140       150       160       170       180

                   190       200       210       220       230       240
m665.pep   QAVTCDDFRAAMADANGINLDQFALWYSQAGTPVLEAEGRLKNNIFELTVKQTVPPTPDM
           ||||||||||||||||||||||||||||||||||||||||||||:||||:||||||||||
g665       QAVTCDDFRAAMADANGINLDQFALWYSQAGTPVLEAEGRLKNNVFELTIKQTVPPTPDM
                   190       200       210       220       230       240

                   250       260       270       280       290       300
m665.pep   TDKQPMMIPVKVGLLNRNGEAVAFDYQGKRATEAVLLLTEAEQTFLLEGVTEAVVPSLLR
           :||||||||||||||||||||||||||||||||||||:|||||:| ||||||||||||||
g665       ADKQPMMIPVKVGLLNRNGEAVAFDYQGKRATEAVLLMTEAEQAFPLEGVTEAVVPSLLR
                   250       260       270       280       290       300
```

-continued

```
                310       320       330       340       350       360
m665.pep GFSAPVHLNYPYSDDDLLLLLAHDSDAFTRWEAAQTLYRRAVAANLATLSDGVELPKHEK
         ||||||:|||||||||||||||||||||| |||||||||||||||||:||||: ||||||
g665     GFSAPVYLNYPYSDDDLLLLLAHDSDAFTCWEAAQTLYRRAVAANLAALSDGIGLPKHEK
                310       320       330       340       350       360

                370       380       390       400       410       420
m665.pep LLAAVEKVISDDLLDNAFKALLLGVPSEAELWDGAENIDPLRYHQAREALLDTLAVHFLP
         ||||||||||||||||||||||||||||||||||:|||||||||||||||||||||:|||
g665     LLAAVEKVISDDLLDNAFKALLLGVPSEAELWDGTENIDPLRYHQAREALLDTLAVRFLP
                370       380       390       400       410       420

                430       440       450       460       470       480
m665.pep KWHELNRQAAKQENQSYEYSPEAAGWRTLRNVCRAFVLRADPAHIETVAEKYGEMAQNMT
         |||||:||||||||||||||||:| |||||||||||||||||||||||||||||||||||
g665     KWHELDRQAAKQENQSYEYSPETADWRTLRNVCRAFVLRADPAHIETVAEKYGEMAQNMT
                430       440       450       460       470       480

                490       500       510       520       530       540
m665.pep HEWGILSAVNGNESDTRNRLLAQFADKFSDDALVMDKYFALVGSSRRSDTLQQVRTALQH
         |||||||||||||||||| ||||||||||||||||||||||:||||||||||||:|||||
g665     HEWGILSAVNGNESDTRNCLLAQFADKFSDDALVMDKYFALIGSSRRSDTLQQVQTALQH
                490       500       510       520       530       540

                550       560       570       580       590       600
m665.pep PKFSLENPNKARSLIGSFSRNVPHFHAEDGSGYRFIADKVIEIDRFNPQVAARLVQAFNL
         |||||||||||||||||||||||||||:||||||||||||||||||||||||||||||||
g665     PKFSLENPNKARSLIGSFSRNVPHFHAQDGSGYRFIADKVIEIDRFNPQVAARLVQAFNL
                550       560       570       580       590       600

                610       620       630      639
m665.pep CNKLEPHRKNLVKQALQRIRAQEGLSKDVGEIVGKILDX
         |||||||||||||| || |||||||||||||||||||
g665     CNKLEPHRKNLVKQELQCIRAQEGLSKDVGEIVGKILGX
                610       620       630
```

The following partial DNA sequence was identified in *N. meningitidis* <SEQ ID 2163>:

```
a665.seq
   1  ATGAAGTGGG ACGAAACGCG CTTCGGTTTG GAATACGACT TGGATATTTT

  51  CATGGTCGTC GCCGTGGGCG ATTTCAATAT GGGTGCGATG GAAAACAAGG

 101  GTTTGAACAT CTTTAACACC AAGTTCGTCC TTGCCGACAG CCGTACCGCC

 151  ACCGATACCG ATTTTGAAGG CATCGAATCC GTGGTCGGAC ACGAATATTT

 201  CCACAACTGG ACGGGCAACC GCGTGACCTG CCGCGACTGG TTCCAGCTTT

 251  CGCTGAAGGA AGGGTTGACC GTGTTCCGCG ACCAAGAATT TTCCGGCGAC

 301  CGCGCCAGCC GCGCCGTGCG CCGTATCGAA AACATCCGCC TGCTGCGCCA

 351  GCACCAGTTC CCCGAAGACG CAGGTCCGAC CGCACATCCG GTGCGCCCCG

 401  CCCGATATGA GGAGATGAAC AATTTCTACA CCATGACCGT TTATGAAAAA

 451  GGCGCGGAAG TGGTGCGGAT GTATCACACC TTGCTCGGCG AAGAGGGCTT

 501  CCAAAAAGGT ATGAAGCTCT ATTTCCAACG CCACGACGGA CAGGCTGTTA

 551  CCTGCGACGA TTTCCGCGCG GCGATGGTGG ACGCGAACGG CATCAACCTC

 601  GACCAATTCG CCTTGTGGTA CAGCCAAGCA GGTACGCCGG TTTTAGATGC

 651  TCAAGGGCGT CTGAAAAACA ATGTGTTCGA GTTAACCATC AAACAAACCG

 701  TGCCGCCCAC GCCCGATATG GCGGACAAAC AGCCGATGAT GATTCCCGTC

 751  AAAATCGGGC TGCTGAACTG CAACGGCGAA GCGGTGGCAT TTGATTATCA

 801  GGGCAAACGC GCGACCGAAG CCGTGTTGCT GCTGACCGAA GCCGAACAGA

 851  CCTTCCAGTT CGAAAGCGTA ACCGAAGCCG TCGTTCCCTC GCTGCTGCGC

 901  GGGTTCAGCG CGCCGGTGCA TCTGAACTAT CCGTACAGCG ACGACGACCT

 951  GCTGCTTCTG CTCGCCCATG ACAGCGACGC CTTCACGCGC TGGGAAGCCG

1001  CACAAACGCT CTACCGCCGT GCCGTCGCCG CCAACCTTGC CGCGCTTTCA
```

-continued

```
1051 GACGGCGTCG AGTTGCCGAA ACACGAAAAA CTGCTTGCCG CCGTCGAAAA

1101 AGTCATTTCA GACGACCTCT TAGACAACGC TTTCAAAGCC CTGCTTTTGG

1151 GTGTGCCGTC TGAAGCCGAG CTGTGGGACG GCGCGGAAAA CATCGACCCG

1201 CTGCGCTACC ATCAGGCGCG CGAAGCCTTG TTGGATATAC TTGCCGTCCG

1251 CTTTCTGCCG AAATGGCACG AATTGAACCG TCAGGCGGCG AAGCAGGAAA

1301 ACCAAAGCTA CGAGTACAGC CCCGAAGCCG CCGGTTGGCG CACGCTGCGC

1351 AATGTCTGCC GCGCCTTCGT CCTGCGCGCC GATCCCGCGC ACATCGAAAC

1401 CGTTGCCGAG AAATACGCCG AAATGGCGCA AAACATGACC CACGAATGGG

1451 GCATCCTGTC CGCCGTCAAC GGCAACGAAA GCGATACGCG CAACCGCCTG

1501 CTGGCGCAGT TTGCCGACAA GTTTTCAGAC GACGCGCTGG TGATGGACAA

1551 ATATTTCGCC CTCGTCGGCT CAAGCCGCCG CAGCGACACC CTGCAACAGG

1601 TTCAAACCGC CTTGCAGCAT CCGAAGTTCA GCCTCGAAAA TCCCAACAAA

1651 GCCCGCTCGC TCATCGGCAG CTTCAGCCGC AACGTCCCGC ATTTCCACGC

1701 AGAAGACGGC AGCGGCTACC GCTTCATCGC CGACAAAGTC ATCGAAATCG

1751 ACCGCTTTAA CCCGCAGGTC GCCGCCCGCC TGGTGCAGGC GTTCAACCTC

1801 TGCAACAAGC TCGAGCCGCA CCGCAAAAAC TTGGTGAAAC AAGCATTGCA

1851 GCGCATTCGG GCGCAGGAAG GATTGTCGAA AGACGTGGGC GAAATCGTCG

1901 GCAAAATTTT GGATTGA
```

This corresponds to the amino acid sequence <SEQ ID 2164; ORF 665.a>:

```
a665.pep

      1 MKWDETRFGL EYDLDIFMVV AVGDFNMGAM ENKGLNIFNT KFVLADSRTA

     51 TDTDFEGIES VVGHEYFHNW TGNRVTCRDW FQLSLKEGLT VFRDQEFSGD

    101 RASRAVRRIE NIRLLRQHQF PEDAGPTAHP VRPARYEEMN NFYTMTVYEK

    151 GAEVVRMYHT LLGEEGFQKG MKLYFQRHDG QAVTCDDFRA AMVDANGINL

    201 DQFALWYSQA GTPVLDAQGR LKNNVFELTI KQTVPPTPDM ADKQPMMIPV

    251 KIGLLNCNGE AVAFDYQGKR ATEAVLLLTE AEQTFQFESV TEAVVPSLLR

    301 GFSAPVHLNY PYSDDDLLLL LAHDSDAFTR WEAAQTLYRR AVAANLAALS

    351 DGVELPKHEK LLAAVEKVIS DDLLDNAFKA LLLGVPSEAE LWDGAENIDP

    401 LRYHQAREAL LDILAVRFLP KWHELNRQAA KQENQSYEYS PEAAGWRTLR

    451 NVCRAFVLRA DPAHIETVAE KYAEMAQNMT HEWGILSAVN GNESDTRNRL

    501 LAQFADKFSD DALVMDKYFA LVGSSRRSDT LQQVQTALQH PKFSLENPNK

    551 ARSLIGSFSR NVPHFHAEDG SGYRFIADKV IEIDRFNPQV AARLVQAFNL

    601 CNKLEPHRKN LVKQALQRIR AQEGLSKDVG EIVGKILD*

m665/a665 97.3% identity in 638 aa overlap

                  10        20        30        40        50        60
m665.pep  MKWDETRFGLEYDLDIFMVVAVGDFNMGAMENKGLNIFNTKFVLADSRTATDTDFEGIES
          ||||||||||||||||||||||||||||||||||||||||||||||||||||||||||||
a665      MKWDETRFGLEYDLDIFMVVAVGDFNMGAMENKGLNIFNTKFVLADSRTATDTDFEGIES
                  10        20        30        40        50        60

                  70        80        90       100       110       120
m665.pep  VVGHEYFHNWTGNRVTCRDWFQLSLKEGLTVFRDQEFSGDRASRAVRRIENIRLLRQHQF
          ||||||||||||||||||||||||||||||||||||||||||||||||||||||||||||
a665      VVGHEYFHNWTGNRVTCRDWFQLSLKEGLTVFRDQEFSGDRASRAVRRIENIRLLRQHQF
                  70        80        90       100       110       120
```

-continued

```
                130       140       150       160       170       180
m665.pep PEDAGPTAHPVRPASYEEMNNFYTMTVYEKGAEVVRMYHTLLGEEGFQKGMKLYFQRHDG
         ||||||||||||| ||||||||||||||||||||||||||||||||||||||||||||||
a665     PEDAGPTAHPVRPARYEEMNNFYTMTVYEKGAEVVRMYHTLLGEEGFQKGMKLYFQRHDG
                130       140       150       160       170       180

                190       200       210       220       230       240
m665.pep QAVTCDDFRAAMADANGINLDQFALWYSQAGTPVLEAEGRLKNNIFELTVKQTVPPTPDM
         ||||||||||||:|||||||||||||||||||||||:|:||||||:||||:|||||||||
a665     QAVTCDDFRAAMVDANGINLDQFALWYSQAGTPVLDAQGRLKNNVFELTIKQTVPPTPDM
                190       200       210       220       230       240

                250       260       270       280       290       300
m665.pep TDKQPMMIPVKVGLLNRNGEAVAFDYQGKRATEAVLLLTEAEQTFLLEGVTEAVVPSLLR
         :|||||||||:|||| |||||||||||||||||||||||||||| :|:||||||||||||
a665     ADKQPMMIPVKIGLLNCNGEAVAFDYQGKRATEAVLLLTEAEQTFQFESVTEAVVPSLLR
                250       260       270       280       290       300

                310       320       330       340       350       360
m665.pep GFSAPVHLNYPYSDDDLLLLLAHDSDAFTRWEAAQTLYRRAVAANLATLSDGVELPKHEK
         ||||||||||||||||||||||||||||||||||||||||||||||:|||||||||||||
a665     GFSAPVHLNYPYSDDDLLLLLAHDSDAFTRWEAAQTLYRRAVAANLAALSDGVELPKHEK
                310       320       330       340       350       360

                370       380       390       400       410       420
m665.pep LLAAVEKVISDDLLDNAFKALLLGVPSEAELWDGAENIDPLRYHQAREALLDTLAVHFLP
         |||||||||||||||||||||||||||||||||||||||||||||||||||| |||:|||
a665     LLAAVEKVISDDLLDNAFKALLLGVPSEAELWDGAENIDPLRYHQAREALLDILAVRFLP
                370       380       390       400       410       420

                430       440       450       460       470       480
m665.pep KWHELNRQAAKQENQSYEYSPEAAGWRTLRNVCRAFVLRADPAHIETVAEKYGEMAQNMT
         |||||||||||||||||||||||||||||||||||||||||||||||||||:||||||||
a665     KWHELNRQAAKQENQSYEYSPEAAGWRTLRNVCRAFVLRADPAHIETVAEKYAEMAQNMT
                430       440       450       460       470       480

                490       500       510       520       530       540
m665.pep HEWGILSAVNGNESDTRNRLLAQFADKFSDDALVMDKYFALVGSSRRSDTLQQVRTALQH
         ||||||||||||||||||||||||||||||||||||||||||||||||||||||:|||||
a665     HEWGILSAVNGNESDTRNRLLAQFADKFSDDALVMDKYFALVGSSRRSDTLQQVQTALQH
                490       500       510       520       530       540

                550       560       570       580       590       600
m665.pep PKFSLENPNKARSLIGSFSRNVPHFHAEDGSGYRFIADKVIEIDRFNPQVAARLVQAFNL
         ||||||||||||||||||||||||||||||||||||||||||||||||||||||||||||
a665     PKFSLENPNKARSLIGSFSRNVPHFHAEDGSGYRFIADKVIEIDRFNPQVAARLVQAFNL
                550       560       570       580       590       600

                610       620       630      639
m665.pep CNKLEPHRKNLVKQALQRIRAQEGLSKDVGEIVGKILDX
         |||||||||||||||||||||||||||||||||||||||
a665     CNKLEPHRKNLVKQALQRIRAQEGLSKDVGEIVGKILDX
                610       620       630
```

The following partial DNA sequence was identified in *N. gonorrhoeae* <SEQ ID 2165>:

```
g665-1.seq
  1  ATGAGCAAAA CCGTCCGTTA TCTGAAAGAT TACCAAACGC CTGCCTACCG

 51  CATTCTTGAA ACCGAACTGC ATTTCGACAT TGCCGAACCG CAAACCGTCG

101  TGAAGTCGCG TTTGACGGTC GAGCCGCAGA GGGCGGGCGA GCCGCTGGTG

151  TTGGACGGTT CGGCAAAACT CTTGTCCGTC AAAATCAACG GCGCGGCGGC

201  GGATTATGTG TTGGAAGGCG AGACGCTGAC GATTGCAGAC GTACCGTCCG

251  AACGCTTCAC CGTCGAAGTG GAAACCGAAA TCCTGCCGGC GGAAAACAAA

301  TCGCTGATGG GGCTGTATGC TTCCGGCGGC AATCTGTTTA CCCAGTGCGA

351  GCCGGAGGGC TTCCGCAAAA TCACGTTCTA CATCGACCGT CCGGATGTGA

401  TGTCCAAGTT CACGACCACC ATCGTCGCGG ACAAAAAACG CTATCCCGTT

451  TTGCTTTCCA ACGGCAACAA AATCGACGGC GGCGAGTTTT CAGACGGCCG

501  CCATTGGGTG AAATGGGAAG ACCCGTTTGC CAAACCGAGT TATCTGTTTG

551  CTTTGGTCGC GGGCGATTTG GCGGTAACGG AAGACCGTTT CACCACCATG

601  AGCGGCAGAA ACGTCAAAAT CGAGTTTTAC ACCACCGAAG CGGACAAACC

651  CAAGGTCGGC TTTGCCGTGG AATCGTTGAA AAACGCGATG AAGTGGGACG
```

-continued

```
 701 AAACGCGCTT CGGGTTGGAA TATGACTTGG ATATTTTCAT GGTCGTCGCC

 751 GTAGGCGATT TCAATATGGG CGCGATGGAA AACAAGGGTT TGAACATTTT

 801 TAACACCAAG TTCGTCCTCG CCGACAGCCG CACCGCCACC GATACCGATT

 851 TCGAAGGCAT TGAATCCGTG GTCGGACACG AATATTTCCA CAACTGGACG

 901 GGCAACCGCG TAACCTGCCG CGACTGGTTC CAGCTTTCGC TGAAGGAAGG

 951 GCTGACCGTG TTCCGCGACC AAGAGTTTTC CGGCGACCGC GCCGGCCGCG

1001 CCGTGCGCCG CATCGAGAAC ATCCGCCTGC TGCGCCAGAA CCAGTTCCCC

1051 GAAGACGCAG GCCCGACCGC CCATCCGGTG CGCCCCGTCA GCTATGAGGA

1101 GATGAACAAT TTCTACACCA TGACCGTTTA TGAAAAAGGC GCGGAAGTGG

1151 TGCGGATGTA TCATACCCTG CTCGGCGAAG AGGGCTTCCA AAAAGGCATG

1201 AAGCTATATT TCCAACGCCA CGACGGACAG GCAGTGACCT GCGACGATTT

1251 CCGCGCGGCG ATGGCGGATG CGAACGGCAT CAATCTCGAC CAGTTCGCCT

1301 TGTGGTACAG CCAGGCGGGC ACGCCCGTTT TGGAAGCCGA AGGCCGTCTG

1351 AAAAACAATG TTTTCGAGTT AACCATTAAA CAAACCGTGC CGCCCACGCC

1401 CGATATGGCG GACAAACAGC CGATGATGAT TCCCGTCAAA GTCGGGCTTC

1451 TGAACCGCAA CGGCGAAGCG GTGGCATTCG ATTATCAGGG CAAACGCGCA

1501 ACCGAAGCCG TGTTGCTGAT GACCGAAGCC GAACAGGCCT TCCCGCTCGA

1551 AGGTGTAACC GAAGCCGTCG TTCCCTCGCT GCTGCGCGGG TTCAGCGCGC

1601 CAGTGTATCT GAACTATCCG TACAGCGACG ACGACCTGCT GCTCCTGCTC

1651 GCCCACGACA GCGACGCTTT CACGTGCTGG GAAGCCGCCC AAACGCTCTA

1701 CCGTCGCGCC GTCGCCGCCA ACCTTGCCGC GCTTTCAGAC GGCATCGGGT

1751 TGCCGAAACA CGAAAAACTG CTTGCCGCCG TCGAAAAAGT CATTTCAGAC

1801 GACCTCTTGG ACAACGCCTT CAAAGCCCTG CTTTTGGGCG TGCCGTCCGA

1851 AGCCGAACTG TGGGACGGCA CGGAAAACAT CGACCCGCTG CGCTACCATC

1901 AGGCGCGCGA AGCCTTGTTG GATACGCTTG CCGTCCGCTT CCTGCCGAAA

1951 TGGCACGAAT TGGACCGTCA GGCGGCGAAG CAGGAAAACC AAAGTTACGA

2001 ATACAGCCCC GAAACCGCCG ACTGGCGCAC GCTGCGCAAC GTCTGCCGCG

2051 CCTTCGTCCT GCGCGCCGAC CCCGCGCACA TCGAAACTGT TGCCGAAAAA

2101 TACGGCGAAA TGGCGCAAAA CATGACCCAC GAATGGGGCA TCCTGTCCGC

2151 CGTCAACGGC AACGAAAGCG ATACGCGCAA CTGCCTGCTG GCGCAGTTTG

2201 CCGACAAGTT TTCAGACGAC GCGCTGGTGA TGGACAAATA TTTCGCCCTT

2251 ATCGGCTCAA GCCGCCGCAG CGACACCCTG CAACAGGTTC AAACCGCCTT

2301 GCAGCATCCG AAATTCAGTC TCGAAAACCC CAACAAAGCC CGTTCGCTCA

2351 TCGGCAGCTT CAGCCGCAAC GTCCCGCATT TTCACGCACA AGACGGCAGC

2401 GGCTACCGCT TCATCGCCGA CAAAGTCATC GAAATCGACC GCTTCAACCC

2451 GCAGGTCGCC GCCCGCCTGG TGCAGGCGTT CAACCTCTGC AACAAGCTCG

2501 AGCCGCACCG CAAAAACTTG GTGAAACAAG AATTGCAGTG CATTCGGGCG

2551 CAGGAAGGAT TGTCGAAAGA CGTGGGCGAA ATCGTCGGCA AGATTTTGGG

2601 TTGA
```

This corresponds to the amino acid sequence <SEQ ID 2166; ORF 665-1.ng>:

```
g665-1.pep
   1 MSKTVRYLKD YQTPAYRILE TELHFDIAEP QTVVKSRLTV EPQRAGEPLV

  51 LDGSAKLLSV KINGAAADYV LEGETLTIAD VPSERFTVEV ETEILPAENK

 101 SLMGLYASGG NLFTQCEPEG FRKITFYIDR PDVMSKFTTT IVADKKRYPV

 151 LLSNGNKIDG GEFSDGRHWV KWEDPFAKPS YLFALVAGDL AVTEDRFTTM

 201 SGRNVKIEFY TTEADKPKVG FAVESLKNAM KWDETRFGLE YDLDIFMVVA

 251 VGDFNMGAME NKGLNIFNTK FVLADSRTAT DTDFEGIESV VGHEYFHNWT

 301 GNRVTCRDWF QLSLKEGLTV FRDQEFSGDR AGRAVRRIEN IRLLRQNQFP

 351 EDAGPTAHPV RPVSYEEMNN FYTMTVYEKG AEVVRMYHTL LGEEGFQKGM

 401 KLYFQRHDGQ AVTCDDFRAA MADANGINLD QFALWYSQAG TPVLEAEGRL

 451 KNNVFELTIK QTVPPTPDMA DKQPMMIPVK VGLLNRNGEA VAFDYQGKRA

 501 TEAVLLMTEA EQAFPLEGVT EAVVPSLLRG FSAPVYLNYP YSDDDLLLLL

 551 AHDSDAFTCW EAAQTLYRRA VAANLAALSD GIGLPKHEKL LAAVEKVISD

 601 DLLDNAFKAL LLGVPSEAEL WDGTENIDPL RYHQAREALL DTLAVRFLPK

 651 WHELDRQAAK QENQSYEYSP ETADWRTLRN VCRAFVLRAD PAHIETVAEK

 701 YGEMAQNMTH EWGILSAVNG NESDTRNCLL AQFADKFSDD ALVMDKYFAL

 751 IGSSRRSDTL QQVQTALQHP KFSLENPNKA RSLIGSFSRN VPHFHAQDGS

 801 GYRFIADKVI EIDRFNPQVA ARLVQAFNLC NKLEPHRKNL VKQELQCIRA

 851 QEGLSKDVGE IVGKILG*
```

The following partial DNA sequence was identified in *N. meningitidis* <SEQ ID 2167>:

```
m665-1.seq
    1  ATGAGCAAAA CCGTGCATTA TCTCAAAGAC TATCAAACGC CCGCCTACCA

   51  TATTCTCAAA ACCGATTTAC ATTTTGATAT TAATGAACCG CAAACCGTCG

  101  TGAAGTCGCG TTTGACGGTT GAGCCGCAGA GGGTAGGGGA GCCGCTGGTG

  151  TTGGACGGTT CGGCGAAACT CTTGTCCGTC AAAATCAACG GGGCGGCGGC

  201  GGATTATGTG TTGGAAGGAG AGACGCTGAC GATTGCGGGC GTGCCGTCCG

  251  AACGCTTCAC CGTCGAAGTG GAAACCGAAA TCCTGCCGGC GGAAAACAAA

  301  TCGCTGATGG GGCTGTATGC TTCCGGCGGC AATTTGTTTA CCCAGTGCGA

  351  GCCGGAGGGC TTCCGCAAAA TCACATTTTA CATCGACCGT CCGGATGTGA

  401  TGTCCAAGTT CACCACCACC ATCGTCGCCG ACAAAAAACG CTATCCCGTT

  451  TTGCTTTCCA ACGGCAACAA AATCGACGGC GGCGAGTTTT CAGACGGCCG

  501  CCATTGGGTG AAATGGGAAG ACCCGTTTTC CAAACCGAGC TATCTGTTTG

  551  CTTTGGTCGC GGGCGATTTG GCGGTAACGG AAGACTATTT CACCACCATG

  601  AGCGGCAGAA ACGTCAAAAT CGAGTTTTAC ACCACCGAAG CGGACAAGCC

  651  CAAGGTCGGC TTTGCCGTGG AATCGTTGAA AAACGCGATG AAATGGGACG

  701  AAACGCGCTT CGGTTTGGAA TACGACTTGG ATATTTTCAT GGTCGTCGCC

  751  GTGGGCGATT TCAATATGGG CGCGATGGAA AACAAGGGTT TGAACATCTT

  801  TAACACCAAG TTCGTCCTTG CCGACAGCCG CACCGCCACC GATACCGATT
```

-continued

851 TCGAAGGCAT CGAATCCGTG GTCGGACACG AGTATTTCCA CAACTGGACG

901 GGCAACCGCG TAACCTGCCG CGACTGGTTC CAGCTTTCGC TGAAGGAAGG

951 GCTGACCGTG TTCCGCGACC AAGAATTTTC CGGCGACCGC GCCAGCCGCG

1001 CCGTGCGCCG CATCGAAAAC ATCCGCCTGC TGCGCCAGCA CCAGTTCCCC

1051 GAAGACGCAG GCCCGACCGC CCATCCGGTG CGCCCCGCCA GCTATGAGGA

1101 GATGAACAAT TTCTACACCA TGACCGTTTA TGAAAAAGGC GCGGAAGTAG

1151 TGCGGATGTA TCACACCCTG CTCGGCGAAG AGGGCTTCCA GAAAGGCATG

1201 AAGCTCTATT TCCAACGCCA CGACGGACAG GCCGTTACCT GCGACGATTT

1251 CCGCGCGGCG ATGGCGGACG CGAACGGCAT CAATCTCGAC CAGTTCGCCT

1301 TGTGGTACAG CCAGGCGGGC ACGCCCGTTT TGGAAGCGGA AGGTCGTCTG

1351 AAAAACAATA TTTTCGAGTT GACCGTCAAA CAAACCGTGC CGCCCACGCC

1401 CGATATGACG GATAAACAGC CGATGATGAT TCCCGTCAAG GTCGGGCTGC

1451 TGAACCGCAA CGGCGAAGCG GTGGCATTCG ACTATCAGGG CAAACGCGCG

1501 ACCGAAGCCG TGTTGCTGCT GACCGAAGCC GAACAGACCT TCCTGCTCGA

1551 AGGCGTAACC GAAGCCGTCG TTCCCTCGCT GCTGCGCGGG TTCAGCGCGC

1601 CGGTGCATCT GAACTATCCG TACAGCGACG ACGACCTGCT GCTCCTGCTC

1651 GCCCATGACA GCGACGCCTT CACGCGCTGG GAAGCCGCCC AAACGCTCTA

1701 CCGCCGCGCC GTCGCCGCCA ACCTTGCCAC GCTTTCAGAC GGCGTTGAGC

1751 TGCCGAAACA CGAAAAACTG CTTGCCGCCG TCGAAAAAGT CATTTCAGAC

1801 GACCTCTTAG ACAACGCCTT CAAAGCCCTG CTTTTGGGCG TGCCATCCGA

1851 AGCCGAGCTG TGGGACGGCG CAGAAAACAT CGACCCGCTG CGCTACCATC

1901 AGGCGCGCGA AGCCTTGTTG GATACGCTTG CCGTCCACTT CCTGCCGAAA

1951 TGGCACGAAT TGAACCGTCA GGCGGCGAAG CAGGAAAACC AAAGCTACGA

2001 ATACAGCCCC GAAGCCGCCG GCTGGCGCAC GCTGCGCAAC GTCTGCCGCG

2051 CCTTTGTCCT GCGCGCCGAC CCCGCGCACA TCGAAACCGT TGCCGAAAAA

2101 TACGGCGAAA TGGCGCAAAA CATGACCCAC GAATGGGGCA TCCTGTCCGC

2151 CGTCAACGGC AACGAAAGCG ATACGCGCAA CCGCCTGCTG GCGCAGTTTG

2201 CCGACAAGTT TTCAGACGAC GCGCTGGTGA TGGACAAATA TTTTGCCCTC

2251 GTCGGCTCAA GCCGCCGCAG CGACACCCTG CAACAGGTTC GAACCGCCTT

2301 GCAGCATCCG AAATTCAGCC TCGAAAACCC CAACAAAGCC CGTTCGCTCA

2351 TCGGCAGCTT CAGCCGCAAC GTCCCGCATT TCCACGCAGA AGACGGCAGC

2401 GGCTACCGCT TCATCGCCGA CAAAGTCATC GAAATCGACC GCTTCAACCC

2451 GCAGGTCGCC GCCCGCTTAG TGCAGGCGTT CAACCTCTGC AACAAGCTCG

2501 AGCCGCACCG CAAAAACTTG GTGAAACAAG CATTGCAGCG CATTCGGGCG

2551 CAGGAAGGAT TGTCGAAAGA CGTGGGCGAA ATCGTCGGCA AAATTTTGGA

2601 TTGA

This corresponds to the amino acid sequence <SEQ ID 2168; ORF 665-1>:

m665-1.pep

1 MSKTVHYLKD YQTPAYHILK TDLHFDINEP QTVVKSRLTV EPQRVGEPLV

-continued

```
 51 LDGSAKLLSV KINGAAADYV LEGETLTIAG VPSERFTVEV ETEILPAENK

101 SLMGLYASGG NLFTQCEPEG FRKITFYIDR PDVMSKETTT IVADKKRYPV

151 LLSNGNKIDG GEFSDGRHWV KWEDPFSKPS YLFALVAGDL AVTEDYFTTM

201 SGRNVKIEFY TTEADKPKVG FAVESLKNAM KWDETRFGLE YDLDIFMVVA

251 VGDFNMGAME NKGLNIFNTK FVLADSRTAT DTDFEGIESV VGHEYFHNWT

301 GNRVTCRDWF QLSLKEGLTV FRDQEFSGDR ASRAVRRIEN IRLLRQHQFP

351 EDAGPTAHPV RPASYEEMNN FYTMTVYEKG AEVVRMYHTL LGEEGFQKGM

401 KLYFQRHDGQ AVTCDDFRAA MADANGINLD QFALWYSQAG TPVLEAEGRL

451 KNNIFELTVK QTVPPTPDMT DKQPMMIPVK VGLLNRNGEA VAFDYQGKRA

501 TEAVLLLTEA EQTFLLEGVT EAVVPSLLRG FSAPVHLNYP YSDDDLLLLL

551 AHDSDAFTRW EAAQTLYRRA VAANLATLSD GVELPKHEKL LAAVEKVISD

601 DLLDNAFKAL LLGVPSEAEL WDGAENIDPL RYHQEREALL DTLAVHFLPK

651 WHELNRQAAK QENQSYEYSP EAAGWRTLRN VCRAFVLRAD PAHIETVAEK

701 YGEMAQNMTH EWGILSAVNG NESDTRNRLL AQFADKFSDD ALVMDKYFAL

751 VGSSRRSDTL QQVRTALQHP KFSLENPNKA RSLIGSFSRN VPHFHAEDGS

801 GYRFIADKVI EIDRFNPQVA ARLVQAFNLC NKLEPHRKNL VKQALQRIRA

851 QEGLSKDVGE IVGKILD*
```

m665-1/g665-1 96.1% identity in 866 aa overlap

```
                   10        20        30        40        50        60
m665-1.pep MSKTVHYLKDYQTPAYHILKTDLHFDINEPQTVVKSRLTVEPQRVGEPLVLDGSAKLLSV
           |||||:||||||||||:||:|:||||| ||||||||||||||||:|||||||||||||||
g665-1     MSKTVRYLKDYQTPAYRILETELHFDIAEPQTVVKSRLTVEPQRAGEPLVLDGSAKLLSV
                   10        20        30        40        50        60

                   70        80        90       100       110       120
m665-1.pep KINGAAADYVLEGETLTIAGVPSERFTVEVETEILPAENKSLMGLYASGGNLFTQCEPEG
           ||||||||||||||||||| ||||||||||||||||||||||||||||||||||||||||
g665-1     KINGAAADYVLEGETLTIADVPSERFTVEVETEILPAENKSLMGLYASGGNLFTQCEPEG
                   70        80        90       100       110       120

                  130       140       150       160       170       180
m665-1.pep FRKITFYIDRPDVMSKFTTTIVADKKRYPVLLSNGNKIDGGEFSDGRHWVKWEDPFSKPS
           ||||||||||||||||||||||||||||||||||||||||||||||||||||||||:|||
g665-1     FRKITFYIDRPDVMSKFTTTIVADKKRYPVLLSNGNKIDGGEFSDGRHWVKWEDPFAKPS
                  130       140       150       160       170       180

                  190       200       210       220       230       240
m665-1.pep YLFALVAGDLAVTEDYFTTMSGRNVKIEFYTTEADKPKVGFAVESLKNAMKWDETRFGLE
           ||||||||||||||| ||||||||||||||||||||||||||||||||||||||||||||
g665-1     YLFALVAGDLAVTEDRFTTMSGRNVKIEFYTTEADKPKVGFAVESLKNAMKWDETRFGLE
                  190       200       210       220       230       240

                  250       260       270       280       290       300
m665-1.pep YDLDIFMVVAVGDFNMGAMENKGLNIFNTKFVLADSRTATDTDFEGIESVVGHEYFHNWT
           ||||||||||||||||||||||||||||||||||||||||||||||||||||||||||||
g665-1     YDLDIFMVVAVGDFNMGAMENKGLNIFNTKFVLADSRTATDTDFEGIESVVGHEYFHNWT
                  250       260       270       280       290       300

                  310       320       330       340       350       360
m665-1.pep GNRVTCRDWFQLSLKEGLTVFRDQEFSGDRASRAVRRIENIRLLRQHQFPEDAGPTAHPV
           |||||||||||||||||||||||||||||||:||||||||||||||:|||||||||||||
g665-1     GNRVTCRDWFQLSLKEGLTVFRDQEFSGDRAGRAVRRIENIRLLRQNQFPEDAGPTAHPV
                  310       320       330       340       350       360

                  370       380       390       400       410       420
m665-1.pep RPASYEEMNNFYTMTVYEKGAEVVRMYHTLLGEEGFQKGMKLYFQRHDGQAVTCDDFRAA
           ||:|||||||||||||||||||||||||||||||||||||||||||||||||||||||||
g665-1     RPVSYEEMNNFYTMTVYEKGAEVVRMYHTLLGEEGFQKGMKLYFQRHDGQAVTCDDFRAA
                  370       380       390       400       410       420

                  430       440       450       460       470       480
m665-1.pep MADANGINLDQFALWYSQAGTPVLEAEGRLKNNIFELTVKQTVPPTPDMTDKQPMMIPVK
           |||||||||||||||||||||||||||||||||:||||:||||||||||:||||||||||
g665-1     MADANGINLDQFALWYSQAGTPVLEAEGRLKNNVFELTIKQTVPPTPDMADKQPMMIPVK
                  430       440       450       460       470       480

                  490       500       510       520       530       540
m665-1.pep VGLLNRNGEAVAFDYQGKRATEAVLLLTEAEQTFLLEGVTEAVVPSLLRGFSAPVHLNYP
           ||||||||||||||||||||||||||:|||||:| ||||||||||||||||||||:||||
g665-1     VGLLNRNGEAVAFDYQGKRATEAVLLMTEAEQAFPLEGVTEAVVPSLLRGFSAPVYLNYP
                  490       500       510       520       530       540
```

-continued

```
                 550       560       570       580       590       600
m665-1.pep YSDDDLLLLLAHDSDAFTRWEAAQTLYRRAVAANLATLSDGVELPKHEKLLAAVEKVISD
           |||||||||||||||| ||||||||||||||||:||||: ||||||||||||||||
g665-1     YSDDDLLLLLAHDSDAFTCWEAAQTLYRRAVAANLAALSDGIGLPKHEKLLAAVEKVISD
                 550       560       570       580       590       600

                 610       620       630       640       650       660
m665-1.pep DLLDNAFKALLLGVPSEAELWDGAENIDPLRYHQAREALLDTLAVHFLPKWHELNRQAAK
           ||||||||||||||||||||||:|||||||||||||||||||||:||||||||:|||||
g665-1     DLLDNAFKALLLGVPSEAELWDGTENIDPLRYHQAREALLDTLAVRFLPKWHELDRQAAK
                 610       620       630       640       650       660

                 670       680       690       700       710       720
m665-1.pep QENQSYEYSPEAAGWRTLRNVCRAFVLRADPAHIETVAEKYGEMAQNMTHEWGILSAVNG
           |||||||||||:| ||||||||||||||||||||||||||||||||||||||||||||||
g665-1     QENQSYEYSPETADWRTLRNVCRAFVLRADPAHIETVAEKYGEMAQNMTHEWGILSAVNG
                 670       680       690       700       710       720

                 730       740       750       760       770       780
m665-1.pep NESDTRNRLLAQFADKFSDDALVMDKYFALVGSSRRSDTLQQVRTALQHPKFSLENPNKA
           ||||||| |||||||||||||||||||||:|||||||||||||:||||||||||||||||
g665-1     NESDTRNCLLAQFADKFSDDALVMDKYFALIGSSRRSDTLQQVQTALQHPKFSLENPNKA
                 730       740       750       760       770       780

                 790       800       810       820       830       840
m665-1.pep RSLIGSFSRNVPHFHAEDGSGYRFIADKVIEIDRFNPQVAARLVQAFNLCNKLEPHRKNL
           ||||||||||||||||:|||||||||||||||||||||||||||||||||||||||||||
g665-1     RSLIGSFSRNVPHFHAQDGSGYRFIADKVIEIDRFNPQVAARLVQAFNLCNKLEPHRKNL
                 790       800       810       820       830       840

                 850       860
m665-1.pep VKQALQRIRAQEGLSKDVGEIVGKILDX
           ||| || |||||||||||||||||||
g665-1     VKQELQCIRAQEGLSKDVGEIVGKILGX
                 850       860
```

The following partial DNA sequence was identified in *N. meningitidis* <SEQ ID 2169>:

```
a665-1.seq
   1  ATGAGCAAAA CCGTGCATTA TCTCAAAGAC TATCAAACGC CCGCCTACCA

  51  TATTCTCAAA ACCGATTTAC ATTTTGATAT TAACGAACCG CAAACCATTG

 101  TGAAGTCGCG TTTGACGGTC GAGCCGAAGA GGGTGGGAGA GCCGCTGGTG

 151  TTGGACGGTT CGGCGAAACT CTTGTCCGTC AAAATCAACG GCGTGGCGGC

 201  GGATTATGTG TTGGAAGGCG AGACGCTGAC GATTGCGGAC GTGCCGTCCG

 251  AACGCTTCAC CGTCGAAGTG GAAACCGAAA TCCTGCCGGC GGAAAACAAA

 301  TCGCTGATGG GGCTGTATGC GTCCGCCGGT AACCTGTTTA CCCAGTGCGA

 351  GCCGGAGGGC TTCCGCAAAA TCACGTTCTA TATCGACCGT CCGGATGTCA

 401  TGTCCAAGTT CACGACCACC ATCGTCGCGG ACAAAAAACG CTATCCCGTT

 451  TTGCTCTCCA ACGGCAACAA AATCGACGGC GGCGAGTATT CAGACGGCCG

 501  CCATTGGGTG AAATGGGAAG ACCCGTTTGC CAAACCGAGT TATCTGTTTG

 551  CTTTGGTCGC GGGCGATTTG GCGGTCACGG AAGACTATTT CACCACCATG

 601  AGCGGCAGAA ACGTCAAAAT CGAGTTTTAC ACCACCGAAG CGGACAAGCC

 651  CAAGGTCGGC TTTGCCGTGG AATCGCTGAA AAACGCAATG AAGTGGGACG

 701  AAACGCGCTT CGGTTTGGAA TACGACTTGG ATATTTTCAT GGTCGTCGCC

 751  GTGGGCGATT TCAATATGGG TGCGATGGAA AACAAGGGTT TGAACATCTT

 801  TAACACCAAG TTCGTCCTTG CCGACAGCCG TACCGCCACC GATACCGATT

 851  TTGAAGGCAT CGAATCCGTG GTCGGACACG AATATTTCCA CAACTGGACG

 901  GGCAACCGCG TGACCTGCCG CGACTGGTTC CAGCTTTCGC TGAAGGAAGG

 951  GTTGACCGTG TTCCGCGACC AAGAATTTTC CGGCGACCGC GCCAGCCGCG

1001  CCGTGCGCCG TATCGAAAAC ATCCGCCTGC TGCGCCAGCA CCAGTTCCCC
```

-continued

```
1051 GAAGACGCAG GTCCGACCGC ACATCCGGTG CGCCCCGCCC GATATGAGGA
1101 GATGAACAAT TTCTACACCA TGACCGTTTA TGAAAAAGGC GCGGAAGTGG
1151 TGCGGATGTA TCACACCTTG CTCGGCGAAG AGGGCTTCCA AAAAGGTATG
1201 AAGCTCTATT TCCAACGCCA CGACGGACAG GCTGTTACCT GCGACGATTT
1251 CCGCGCGGCG ATGGTGGACG CGAACGGCAT CAACCTCGAC CAATTCGCCT
1301 TGTGGTACAG CCAAGCAGGT ACGCCGGTTT TAGATGCTCA AGGGCGTCTG
1351 AAAAACAATG TGTTCGAGTT AACCATCAAA CAAACCGTGC CGCCCACGCC
1401 CGATATGGCG GACAAACAGC CGATGATGAT TCCCGTCAAA ATCGGGCTGC
1451 TGAACTGCAA CGGCGAAGCG GTGGCATTTG ATTATCAGGG CAAACGCGCG
1501 ACCGAAGCCG TGTTGCTGCT GACCGAAGCC GAACAGACCT TCCAGTTCGA
1551 AAGCGTAACC GAAGCCGTCG TTCCCTCGCT GCTGCGCGGG TTCAGCGCGC
1601 CGGTGCATCT GAACTATCCG TACAGCGACG ACGACCTGCT GCTTCTGCTC
1651 GCCCATGACA GCGACGCCTT CACGCGCTGG GAAGCCGCAC AAACGCTCTA
1701 CCGCCGTGCC GTCGCCGCCA ACCTTGCCGC GCTTTCAGAC GGCGTCGAGT
1751 TGCCGAAACA CGAAAAACTG CTTGCCGCCG TCGAAAAAGT CATTTCAGAC
1801 GACCTCTTAG ACAACGCTTT CAAAGCCCTG CTTTTGGGTG TGCCGTCTGA
1851 AGCCGAGCTG TGGGACGGCG CGGAAAACAT CGACCCGCTG CGCTACCATC
1901 AGGCGCGCGA AGCCTTGTTG GATATACTTG CCGTCCGCTT TCTGCCGAAA
1951 TGGCACGAAT TGAACCGTCA GGCGGCGAAG CAGGAAAACC AAAGCTACGA
2001 GTACAGCCCC GAAGCCGCCG GTTGGCGCAC GCTGCGCAAT GTCTGCCGCG
2051 CCTTCGTCCT GCGCGCCGAT CCCGCGCACA TCGAAACCGT TGCCGAGAAA
2101 TACGCCGAAA TGGCGCAAAA CATGACCCAC GAATGGGGCA TCCTGTCCGC
2151 CGTCAACGGC AACGAAAGCG ATACGCGCAA CCGCCTGCTG GCGCAGTTTG
2201 CCGACAAGTT TTCAGACGAC GCGCTGGTGA TGGACAAATA TTTCGCCCTC
2251 GTCGGCTCAA GCCGCCGCAG CGACACCCTG CAACAGGTTC AAACCGCCTT
2301 GCAGCATCCG AAGTTCAGCC TCGAAAATCC CAACAAAGCC CGCTCGCTCA
2351 TCGGCAGCTT CAGCCGCAAC GTCCCGCATT TCCACGCAGA AGACGGCAGC
2401 GGCTACCGCT TCATCGCCGA CAAAGTCATC GAAATCGACC GCTTTAACCC
2451 GCAGGTCGCC GCCCGCCTGG TGCAGGCGTT CAACCTCTGC AACAAGCTCG
2501 AGCCGCACCG CAAAAACTTG GTGAAACAAG CATTGCAGCG CATTCGGGCG
2551 CAGGAAGGAT TGTCGAAAGA CGTGGGCGAA ATCGTCGGCA AAATTTTGGA
2601 TTGA
```

This corresponds to the amino acid sequence <SEQ ID 2170; ORF 665-1.a>:

```
a665-1.pep

  1 MSKTVHYLKD YQTPAYHILK TDLHFDINEP QTIVKSRLTV EPKRVGEPLV
 51 LDGSAKLLSV KINGVAADYV LEGETLTIAD VPSERFTVEV ETEILPAENK
101 SLMGLYASAG NLFTQCEPEG FRKITFYIDR PDVMSKFTTT IVADKKRYPV
151 LLSNGNKIDG GEYSDGRHWV KWEDPFAKPS YLFALVAGDL AVTEDYFTTM
201 SGRNVKIEFY TTEADKPKVG FAVESLKNAM KWDETRFGLE YDLDIFMVVA
```

-continued

```
251 VGDFNMGAME NKGLNIFNTK FVLADSRTAT DTDFEGIESV VGHEYFHNWT

301 GNRVTCRDWF QLSLKEGLTV FRDQEFSGDR ASRAVRRIEN IRLLRQHQFP

351 EDAGPTAHPV RPARYEEMNN FYTMTVYEKG AEVVPMYHTL LGEEGFQKGM

401 KLYFQRHDGQ AVTCDDFRAA MADANGINLD QFALWYSQAG TPVLDAQGRL

451 KNNVFELTIK QTVPPTPDMA DKQPMMIPVK IGLLNCNGEA VAFDYQGKRA

501 TEAVLLLTEA EQTFQFESVT EAVVPSLLRG FSAPVHLNYP YSDDDLLLLL

551 AHDSDAFTRW EAAQTLYRRA VAANLAALSD GVELPKHEKL LAAVEKVISD

601 DLLDNAFKAL LLGVPSEAEL WDGAENIDPL RYHQAREALL DILAVRFLPK

651 WHELNRQAAK QENQSYEYSP EAAGWRTLRN VCRAFVLRAD PAHIETVAEK

701 YAEMAQNMTH EWGILSAVNG NESDTRNRLL AQFADKFSDD ALVMDKYFAL

751 VGSSRRSDTL QQVQTALQHP KFSLENPNKA RSLIGSFSRN VPHFHAEDGS

801 GYRFIADKVI EIDRFNPQVA ARLVQAFNLC NKLEPHRKNL VKQALQRIRA

851 QEGLSKDVGE IVGKILD*
```

a665-1/m665-1 97.2% identity in 867 aa overlap

```
                    10        20        30        40        50        60
a665-1.pep  MSKTVHYLKDYQTPAYHILKTDLHFDINEPQTIVKSRLTVEPKRVGEPLVLDGSAKLLSV
            ||||||||||||||||||||||||||||||||:|||||||||:|||||||||||||||||
m665-1      MSKTVHYLKDYQTPAYHILKTDLHFDINEPQTVVKSRLTVEPQRVGEPLVLDGSAKLLSV
                    10        20        30        40        50        60

                    70        80        90       100       110       120
a665-1.pep  KINGVAADYVLEGETLTIADVPSERFTVEVETEILPAENKSLMGLYASAGNLFTQCEPEG
            ||||:|||||||||||||| |||||||||||||||||||||||||||||:||||||||||
m665-1      KINGAAADYVLEGETLTIAGVPSERFTVEVETEILPAENKSLMGLYASGGNLFTQCEPEG
                    70        80        90       100       110       120

                   130       140       150       160       170       180
a665-1.pep  FRKITFYIDRPDVMSKFTTTIVADKKRYPVLLSNGNKIDGGEYSDGRHWVKWEDPFAKPS
            ||||||||||||||||||||||||||||||||||||||||||:|||||||||||||:|||
m665-1      FRKITFYIDRPDVMSKFTTTIVADKKRYPVLLSNGNKIDGGEFSDGRHWVKWEDPFSKPS
                   130       140       150       160       170       180

                   190       200       210       220       230       240
a665-1.pep  YLFALVAGDLAVTEDYFTTMSGRNVKIEFYTTEADKPKVGFAVESLKNAMKWDETRFGLE
            ||||||||||||||||||||||||||||||||||||||||||||||||||||||||||||
m665-1      YLFALVAGDLAVTEDYFTTMSGRNVKIEFYTTEADKPKVGFAVESLKNAMKWDETRFGLE
                   190       200       210       220       230       240

                   250       260       270       280       290       300
a665-1.pep  YDLDIFMVVAVGDFNMGAMENKGLNIFNTKFVLADSRTATDTDFEGIESVVGHEYFHNWT
            ||||||||||||||||||||||||||||||||||||||||||||||||||||||||||||
m665-1      YDLDIFMVVAVGDFNMGAMENKGLNIFNTKFVLADSRTATDTDFEGIESVVGHEYFHNWT
                   250       260       270       280       290       300

                   310       320       330       340       350       360
a665-1.pep  GNRVTCRDWFQLSLKEGLTVFRDQEFSGDRASRAVRRIENIRLLRQHQFPEDAGPTAHPV
            ||||||||||||||||||||||||||||||||||||||||||||||||||||||||||||
m665-1      GNRVTCRDWFQLSLKEGLTVFRDQEFSGDRASRAVRRIENIRLLRQHQFPEDAGPTAHPV
                   310       320       330       340       350       360

                   370       380       390       400       410       420
a665-1.pep  RPARYEEMNNFYTMTVYEKGAEVVRMYHTLLGEEGFQKGMKLYFQRHDGQAVTCDDFRAA
            ||| ||||||||||||||||||||||||||||||||||||||||||||||||||||||||
m665-1      RPASYEEMNNFYTMTVYEKGAEVVRMYHTLLGEEGFQKGMKLYFQRHDGQAVTCDDFRAA
                   370       380       390       400       410       420

                   430       440       450       460       470       480
a665-1.pep  MVDANGINLDQFALWYSQAGTPVLDAQGRLKNNVFELTIKQTVPPTPDMADKQPMMIPVK
            |:||||||||||||||||||||||:|:|||||||:||||:||||||||||:|||||||||
m665-1      MADANGINLDQFALWYSQAGTPVLEAEGRLKNNIFELTVKQTVPPTPDMTDKQPMMIPVK
                   430       440       450       460       470       480

                   490       500       510       520       530       540
a665-1.pep  IGLLNCNGEAVAFDYQGKRATEAVLLLTEAEQTFQFESVTEAVVPSLLRGFSAPVHLNYP
            :|||| |||||||||||||||||||||||||||| :|:||||||||||||||||||||||
m665-1      VGLLNRNGEAVAFDYQGKRATEAVLLLTEAEQTFLLEGVTEAVVPSLLRGFSAPVHLNYP
                   490       500       510       520       530       540

                   550       560       570       580       590       600
a665-1.pep  YSDDDLLLLLAHDSDAFTRWEAAQTLYRRAVAANLAALSDGVELPKHEKLLAAVEKVISD
            ||||||||||||||||||||||||||||||||||||:|||||||||||||||||||||||
m665-1      YSDDDLLLLLAHDSDAFTRWEAAQTLYRRAVAANLATLSDGVELPKHEKLLAAVEKVISD
                   550       560       570       580       590       600
```

-continued

```
                 610       620       630       640       650       660
a665-1.pep DLLDNAFKALLLGVPSEAELWDGAENIDPLRYHQAREALLDILAVRFLPKWHELNRQAAK
           ||||||||||||||||||||||||||||||||||||||||| |||:|||||||||||||||
m665-1     DLLDNAFKALLLGVPSEAELWDGAENIDPLRYHQAREALLDTLAVHFLPKWHELNRQAAK
                 610       620       630       640       650       660

                 670       680       690       700       710       720
a665-1.pep QENQSYEYSPEAAGWRTLRNVCRAFVLRADPAHIETVAEKYAEMAQNMTHEWGILSAVNG
           ||||||||||||||||||||||||||||||||||||||||:|||||||||||||||||||
m665-1     QENQSYEYSPEAAGWRTLRNVCRAFVLRADPAHIETVAEKYGEMAQNMTHEWGILSAVNG
                 670       680       690       700       710       720

                 730       740       750       760       770       780
a665-1.pep NESDTRNRLLAQFADKFSDDALVMDKYFALVGSSRRSDTLQQVQTALQHPKFSLENPNKA
           ||||||||||||||||||||||||||||||||||||||||||:|||||||||||||||||
m665-1     NESDTRNRLLAQFADKFSDDALVMDKYFALVGSSRRSDTLQQVRTALQHPKFSLENPNKA
                 730       740       750       760       770       780

                 790       800       810       820       830       840
a665-1.pep RSLIGSFSRNVPHFHAEDGSGYRFIADKVIEIDRFNPQVAARLVQAFNLCNKLEPHRKNL
           ||||||||||||||||||||||||||||||||||||||||||||||||||||||||||||
m665-1     RSLIGSFSRNVPHFHAEDGSGYRFIADKVIEIDRFNPQVAARLVQAFNLCNKLEPHRKNL
                 790       800       810       820       830       840

                 850       860
a665-1.pep VKQALQRIRAQEGLSKDVGEIVGKILDX
           ||||||||||||||||||||||||||||
m665-1     VKQALQRIRAQEGLSKDVGEIVGKILDX
                 850       860
```

The following partial DNA sequence was identified in *N. gonorrhoeae* <SEQ ID 2171>:

```
g666.seq
  1 ATGCTTTGTA TGAATTATCA ATCAAACTCA GGCGAAGGAG TGCTTGTAGC

 51 TAAAACATAT TTATTGACTG CATTGATAAT GTCTATGGTA ATCTCCGGAT

101 GTCAAGTCAT CCATGCCAAT CAAGGTAAGG TTAATACTAA TTCTGCTGTC

151 ATCGCAGGTG CAGACGCTCA CACGCCTGAA CATGTAACGG GACTGACCGA

201 ACAAAAGCAG GTGATTGCAA GTGATTTTAT AGTAGCGTCA GCCAATCCAT

251 TAGCAACACA AGCTGGCTAT GATATCTTAA AGCAAGGCGG TAGCGCTGCA

301 GATGCGATGG TGGCGGTGCA GACGACACTA AGCTTGGTAG AGCCACAGTC

351 GTCAGGCTTG GGCGGTGGTG CATTTGTGTT GTATTGGGAC AATACCGCCA

401 AAACATTGAC CACATTTGAT GGGCGTGAGA CGGCACCGAT GCGTGCGACG

451 CCAGAATTAT TTTTGGATAA AGATGGTTAA CCATTGAAAT TTATGGAAGC

501 GGTGGTCGCT CGGTAGGTAC GCCTGCTATC CCTAAACTGA
```

This corresponds to the amino acid sequence <SEQ ID 2172; ORF 666.ng>:

```
g666.pep
  1 MLCMNYQSNS GEGVLVAKTY LLTALIMSMV ISGCQVIHAN QGKVNTNSAV

 51 IAGADAHTPE HVTGLTEQKQ VIASDFIVAS ANPLATQAGY DILKQGGSAA

101 DAMVAVQTTL SLVEPQSSGL GGGAFVLYWD NTAKTLTTFD GRETAPMRAT

151 PELFLDKDGX PLKFMEAVVA RXVRLLSLN*
```

The following partial DNA sequence was identified in *N. meningitidis* <SEQ ID 2173>:

```
m666.seq
  1 ATGCCTTGTA TGAATCATCA ATCAAACTCA GGCGAAGGAG TGCTTGTGGC

 51 TAAAACATAT TTATTGACTG CATTGATAAT GTCTATGACA ATCTCTGGAT
```

-continued

```
101 GTCAAGTCAT CCATGCCAAT CAAGGTAAGG TTAATACTCA TTCTGCTGTC

151 ATCACAGGTG CAGACGCTCA CACGCCTGAA CATGCAACGG GACTGACCGA

201 ACAAAAGCAG GTGATTGCAA GTGATTTTAT GGTAGCGTCA GCCAATCCAT

251 TAGCAACACA AGCTGGCTAT GATATCTTAA AGCAAGGCGG TAGCGCTGCA

301 GATGCGATGG TGGCGGTGCA GACGACACTA AGCTTGGTAG AGCCACAGTC

351 GTCAGGCTTG GGCGGTGGTG CATTTGTGTT GTATTGGGAT AATACCGCCA

401 AAACATTGAC CACATTTGAT GGGCGTGAGA CGGCACCGAT GCGTGCGACG

451 CCGGAATTAT TTTTGGATAA AGATGGTCAA CCATTGAAAT TTATGGAAGC

501 GGTGGTCGTG GTCGCTCGGT GGGTACGCCT GCTATCCCTA AACTGA
```

This corresponds to the amino acid sequence <SEQ ID 2174; ORF 666>:

```
m666.pep
  1 MPCMNHQSNS GEGVLVAKTY LLTALIMSMT ISGCQVIHAN QGKVNTHSAV

 51 ITGADAHTPE HATGLTEQKQ VIASDFMVAS ANPLATQAGY DILKQGGSAA

101 DAMVAVQTTL SLVEPQSSGL GGGAFVLYWD NTAKTLTTFD GRETAPMRAT

151 PELFLDKDGQ PLKFMEAVVV VARWVRLLSL N*
```

Computer analysis of this amino acid sequence gave the following results:

Homology with a Predicted ORF from *N. gonorrhoeae*

```
m666/g666 93.9% identity in 181 aa overlap

                    10        20        30        40        50        60
m666.pep    MPCMNHQSNSGEGVLVAKTYLLTALIMSMTISGCQVIHANQGKVNTHSAVITGADAHTPE
            | |||:|||||||||||||||||||||||:||||||||||||||||:||||:||||||||
g666        MLCMNYQSNSGEGVLVAKTYLLTALIMSMVISGCQVIHANQGKVNTNSAVIAGADAHTPE
                    10        20        30        40        50        60

                    70        80        90       100       110       120
m666.pep    HATGLTEQKQVIASDFMVASANPLATQAGYDILKQGGSAADAMVAVQTTLSLVEPQSSGL
            |:||||||||||||||:|||||||||||||||||||||||||||||||||||||||||||
g666        HVTGLTEQKQVIASDFIVASANPLATQAGYDILKQGGSAADAMVAVQTTLSLVEPQSSGL
                    70        80        90       100       110       120

                   130       140       150       160       170       180
m666.pep    GGGAFVLYWDNTAKTLTTFDGRETAPMRATPELFLDKDGQPLKFMEAVVVVARWVRLLSL
            ||||||||||||||||||||||||||||||||||||||| |||||||||  || ||||||
g666        GGGAFVLYWDNTAKTLTTFDGRETAPMRATPELFLDKDGXPLKFMEAVV--ARXVRLLSL
                   130       140       150       160         170

m666.pep    NX
            ||
g666        NX
           180
```

The following partial DNA sequence was identified in *N. meningitidis* <SEQ ID 2175>:

```
a666.seq
  1 ATGCCTTGTA TGAATCATCA ATCAAACTCA GGCGAAGGAG TGCTTGTGGC

 51 TAAAACATAT TTATTGACTG CATTGATAAT GTCTATGACA ATCTCTGGAT

101 GTCAAGTCAT CCATGCCAAT CAAGGTAAGG TTAATACTCA TTCTGCTGTC

151 ATCACAGGTG CAGACGCTCA CACGCCTGAA CATGCAACGG GACTGACCGA

201 ACAAAAGCAG GTGATTGCAA GTGATTTTAT GGTAGCGTCA GCCAATCCAT

251 TAGCAACACA AGCTGGCTAT GATATCTTAA AGCAAGGCGG TAGCGCTGCA
```

-continued

```
301 GATGCGATGG TGGCGGTGCA GACGACACTA AGCTTGGTAG AGCCACAGTC

351 GTCAGGCTTG GGCGGTGGTG CATTTGTGTT GTATTGGGAT AATACCGCCA

401 AAACATTGAC CACATTTGAT GGGCGTGAGA CGGCACCGAT GCGTGCGACG

451 CCGGAATTAT TTTTGGATAA AGATGGTCAA CCATTGAAAT TTATGGAAGC

501 GGTGGTCGTG GTCGCTCGGT GGGTACGCCT GCTATCCCTA AACTGA
```

This corresponds to the amino acid sequence <SEQ ID 2176; ORF 666.a>:

```
a666.pep

      1  MPCMNHQSNS GEGVLVAKTY LLTALIMSMT ISGCQVIHAN QGKVNTHSAV

     51  ITGADAHTPE HATGLTEQKQ VIASDFMVAS ANPLATQAGY DILKQGGSAA

    101  DAMVAVQTTL SLVEPQSSGL GGGAFVLYWD NTAKTLTTFD GRETAPMRAT

    151  PELFLDKDGQ PLKFMEAVVV VARWVRLLSL N*

m666/a666  100.0% identity in 181 aa overlap
                   10         20         30         40         50         60
m666.pep   MPCMNHQSNSGEGVLVAKTYLLTALIMSMTISGCQVIHANQGKVNTHSAVITGADAHTPE
           ||||||||||||||||||||||||||||||||||||||||||||||||||||||||||||
a666       MPCMNHQSNSGEGVLVAKTYLLTALIMSMTISGCQVIHANQGKVNTHSAVITGADAHTPE
                   10         20                    40         50         60
                   70         80         90        100        110        120
m666.pep   HATGLTEQKQVIASDFMVASANPLATQAGYDILKQGGSAADAMVAVQTTLSLVEPQSSGL
           ||||||||||||||||||||||||||||||||||||||||||||||||||||||||||||
a666       HATGLTEQKQVIASDFMVASANPLATQAGYDILKQGGSAADAMVAVQTTLSLVEPQSSGL
                   70         80         90        100        110        120
                  130        140        150        160        170        180
m666.pep   GGGAFVLYWDNTAKTLTTFDGRETAPMRATPELFLDKDGQPLKFMEAVVVVARWVRLLSL
           ||||||||||||||||||||||||||||||||||||||||||||||||||||||||||||
a666       GGGAFVLYWDNTAKTLTTFDGRETAPMRATPELFLDKDGQPLKFMEAVVVVARWVRLLSL
                  130        140        150        160        170        180
m666.pep   NX
           ||
a666       NX
```

The following partial DNA sequence was identified in *N. gonorrhoeae* <SEQ ID 2177>:

```
g667.seq
  1 atgcggtttg tcttctgttt gggcgGAGAG ATAGtttctg atccgtgtga

 51 tttccAtttg gtattcgtcc gcgtcgaatc tgccgctgAc CAGAcagaaa

101 cgCAGataca tCaaatacgt attcacggca tcggtttcgc aatAAttgcg

151 GAtttccttc agcgtgcccg cgtgGAacgc ttcccacact ttgctgccgt

201 ccataCCCAg ctTGCCCGGA AAGCCGCACA GTTTcgcCat atcgtccagC

251 GGCACATTcg ccctcggctG GTAAAGCGCG AGCAAATCCA TCAAATCGCA

301 GTGGCGTTGG TGATAACGGC TGATGTAGTT GTTCCActtg AAATCGCGGC

351 tgtcgccgAA ATCGccgTCG CCCGTATCCC AATAGCGCGC GGCGTTGATG

401 CCGTATATCA GGGAGCGGTA ATGCAGTACG GGCAGGTCGA AACCGCCGCC

451 GTTCCAGCTG ACCAGTTGCG GCGTATGTTT TTCAACCAAT TCGAAAAACT

501 TGGCAATCAC GACTTCTTCG CCATCGTCCA TCTCGCCGAT GGTGCCGACA

551 TGAACCTTGT CCTGCCCCCA GCGCATACAG CAGGAAACCG CCACAACCTG

601 ATGGAGGTGG TGCTGCATAA AATCGCCGCC GGTCTGTGCG CGGCGTTTCT

651 GCTGCGCGAA CAGCACCACT TCGTCATCCG GCAGGGAAGA CGGCAAGTCA
```

-continued

```
701 TACAACGTAC GGATACCCTG CACATCGGGT ACGGTTTCAA TATCGAAAGC

751 CAAAATCGTA TTCATGGCAg tACCTTGCAT tcaAAAACAG ACtTGCGCCT

801 ATTgTgtcaT TAA
```

This corresponds to the amino acid sequence <SEQ ID 2178; ORF 667.ng>:

```
g667.pep
  1 MRFVFCLGGE IVSDPCDFHL VFVRVESAAD QTETQIHQIR IHGIGFAIIA

 51 DFLQRARVER FPHFAAVHTQ LARKAAQFRH IVQRHIRPRL VKREQIHQIA

101 VALVITADVV VPLEIAAVAE IAVARIPIAR GVDAVYQGAV MQYGQVETAA

151 VPADQLRRMF FNQFEKLGNH DFFAIVHLAD GADMNLVLPP AHTAGNRHNL

201 MEVVLHKIAA GLCAAFLLRE QHHFVIRQGR RQVIQRTDTL HIGYGFNIES

251 QNRIHGSTLH SKTDLRLLCH *
```

The following partial DNA sequence was identified in *N. meningitidis* <SEQ ID 2179>:

```
m667.seq (PARTIAL)
  1 ATGCGGCTTT TCCCCGGCTT GTGCGGACAG GTAATTCCGC ATCCGTTTGA

 51 TTTCCATTTC GTATTCGTCC GCATCCAGCC TGCCGCTGAC CAGACAGAAA

101 CGCAGGTACA TCAGATAAGT GTTTGCCGCG TCGGTTTCGC AATAATTGCG

151 GATTTCCTTC AGCCTGCCCG TATGGAATGC CTCCCAAACC TTGCTGCCGT

201 CCATACCCAG CTTGCCCGGA AAACCGCACA GTTTCGCCAT ATCGTCCAGC

251 GGCACGTTTG CCCTCGGCTG GTAAAGCGCG AGCAAATCCA TCAAATCGCA

301 GTGGCGTTGG TGATAACGGC TGATGTAGTT GTTCCACTTG AAATCGCGGC

351 TGTCGCCGAA ATCGCCGTCG CCCATATCCC AATAGCGCGC GGCGTTGATG

401 CCGTATATCA GGGAGCGGTA ATGCAGTACG GGCAGATCGA AACCGCCGCC

451 GTTCCAACTG ACCAGTTGCG GCGTATGTTT TTCAATCAAT TCGAAAAATT

501 TAGCAATGAC CACTTCCTCG CCGTCATCCA TCTCGCCGAT GGTGCCGACA

551 TGTACTTTAT CCTGCCCCCA ACGCATGCAG CACGAAATCG CCACAACCTG

601 ATGAAGATGA TGCTGCATAA AATCGCCGCC CGTCTGAGCA CGGCGTTTGT

651 GCTGGGCAAT CAGCACCACT TG...
```

This corresponds to the amino acid sequence <SEQ ID 2180; ORF 667>:

```
m667.pep (partial)
  1 MRLFPGLCGQ VIPHPFDFHF VFVRIQPAAD QTETQVHQIS VCRVGFAIIA

 51 DFLQPARMEC LPNLAAVHTQ LARKTAQFRH IVQRHVCPRL VKREQIHQIA

101 VALVITADVV VPLEIAAVAE IAVAHIPIAR GVDAVYQGAV MQYGQIETAA

151 VPTDQLRRMF FNQFEKFSND HFLAVIHLAD GADMYFILPP THAARNRHNL

201 MKMMLHKIAA RLSTAFVLGN QHHL...
```

Computer analysis of this amino acid sequence gave the following results:
Homology with a Predicted ORF from *N. gonorrhoeae*

```
m667/g667 75.0% identity in 224 aa overlap

                  10        20        30        40        50        60
m667.pep  MRLFPGLCGQVIPHPFDFHFVFVRIQPAADQTETQVHQISVCRVGFAIIADFLQPARMEC
          ||:   | |:::  | |||:||||:: ||||||||:||| :  :|||||||||| ||:| 
g667      MRFVFCLGGEIVSDPCDFHLVFVRVESAADQTETQIHQIRIHGIGFAIIADFLQRARVER
                  10        20        30        40        50        60

                  70        80        90       100       110       120
m667.pep  LPNLAAVHTQLARKTAQFRHIVQRHVCPRLVKREQIHQIAVALVITADVVVPLEIAAVAE
          :|::||||||||||:||||||||||: |||||||||||||||||||||||||||||||||
g667      FPHFAAVHTQLARKAAQFRHIVQRHIRPRLVKREQIHQIAVALVITADVVVPLEIAAVAE
                  70        80        90       100       110       120

                 130       140       150       160       170       180
m667.pep  IAVAHIPIARGVDAVYQGAVMQYGQIETAAVPTDQLRRMFFNQFEKFSNDHFLAVIHLAD
          ||||:||||||||||||||||||||:||||||:|||||||||||||::|  |:|::||||
g667      IAVARIPIARGVDAVYQGAVMQYGQVETAAVPADQLRRMFFNQFEKLGNHDFFAIVHLAD
                 130       140       150       160       170       180

                 190       200       210       220
m667.pep  GADMYFILPPTHAARNRHNLMKMMLHKIAARLSTAFVLGNQHHL
          |||| ::|||:|:| ||||||:::|||||| | :||:| :|||:
g667      GADMNLVLPPAHTAGNRHNLMEVVLHKIAAGLCAAFLLREQHHFVIRQGRRQVIQRTDTL
                 190       200       210       220       230       240

g667      HIGYGFNIESQNRIHGSTLHSKTDLRLLCHX
                 250       260       270
```

The following partial DNA sequence was identified in *N. meningitidis* <SEQ ID 2181>:

```
a667.seq
   1 ATGCGGTTTG TCTTCTGTTT GGGCGGAGAG ATAGTTTCTG ATCCGCTTGA

  51 TTTCCATTTC GTATTCGTCT GCGTCGAATC TGCCGCTGAC CAGACAGAAA

 101 CGCAGATACA TCAGATAGGT ATTTACCGCA TCGGTTTCGC AATAATTGCG

 151 GATTTCCTTC AGCCTGCCCG CGTGGAACGC CTCCCACACC TTGCTGCCGT

 201 CCATACCCAG CTTGCCCGGA AAACCGCACA GTTTCGCCAT ATCGTCCAAC

 251 GGCACATTCG CCCTCGGCTG GTAAAGCGCG AGCAAATCCA TCAAATCGCA

 301 ATGACGTTGG TGGTAGCGGC TGATGTAGTT GTTCCACTTG AAATCGCGGC

 351 TGTCGCCGAA ATCGCCGTCG CCCATATCCC AATAGCGCGC GGCGTTGATG

 401 CCGTGTAGCA GCGAACGGTA ATGCAGAACC GGCAGGTCGA AACCGCCGCC

 451 GTTCCAACTG ACCAGTTGCG GCGTATGTTT TTCAATCAAC TCGAAAAATT

 501 TGGCGATAAC CACTTCCTCG CCGTCATCCA TCTCGCCGAT TGTACCGACA

 551 TGGACTTTAT CCTGCCCCCA ACGCATGCAG CACGAAATCG CCACAATCTG

 601 ATGAAGATGA TGCTGCATAA AATCCCCACC CGTCTGAGCA CGGCGTTTTT

 651 GCTGGGCAAA CAGCACCACT TCATCGTCGG GCAGCGAGGA CGGCAAGTCA

 701 TACAGCGTAC GGATACACTG CACATCGGGT ACGGTTTCAA TATCGAAAGC

 751 CAAAATCGTG GTCATGACAG CACCTTGTAT TTAAAA.CAG ACTTGCGCCT

 801 ATTGTGTCAT TAA
```

This corresponds to the amino acid sequence <SEQ ID 2182; ORF 667.a>:

```
a667.pep

      1 MRFVFCLGGE IVSDPLDFHF VFVCVESAAD QTETQIHQIG IYRIGFAIIA

     51 DFLQPARVER LPHLAAVHTQ LARKTAQFRH IVQRHIRPRL VKREQIHQIA

    101 MTLVVAADVV VPLEIAAVAE IAVAHIPIAR GVDAV*QRTV MQNRQVETAA
```

-continued

```
151 VPTDQLRRMF FNQLEKFGDN HFLAVIHLAD CTDMDFILPP THAARNRHNL

201 MKMMLHKIPT RLSTAFLLGK QHHFIVGQRG RQVIQRTDTL HIGYGFNIES

251 QNRGHDSTLY LKXDLRLLCH *
```

m667/a667 79.0% identity in 224 aa overlap

```
                    10        20        30        40        50        60
m667.pep    MRLFPGLCGQVIPHPFDFHFVFVRIQPAADQTETQVHQISVCRVGFAIIADFLQPARMEC
            ||:   | |:::  |:||||||| :: ||||||||:|||:: |:|||||||||||||:|
a667        MRFVFCLGGEIVSDPLDFHFVFVCVESAADQTETQIHQIGIYRIGFAIIADFLQPARVER
                    10        20        30        40        50        60

                    70        80        90       100       110       120
m667.pep    LPNLAAVHTQLARKTAQFRHIVQRHVCPRLVKREQIHQIAVALVITADVVVPLEIAAVAE
            ||:||||||||||||||||||||||: |||||||||||||::||::||||||||||||||
a667        LPHLAAVHTQLARKTAQFRHIVQRHIRPRLVKREQIHQIAMTLVVAADVVVPLEIAAVAE
                    70        80        90       100       110       120
```

-continued

```
                 130       140       150       160       170       180
m667.pep IAVAHIPIARGVDAVYQGAVMQYGQIETAAVPTDQLRRMFFNQFEKFSNDHFLAVIHLAD
         ||||||||||||||| | :|||  |:|||||||||||||||||:|||:::||||||||||
a667     IAVAHIPIARGVDAVXQRTVMQNRQVETAAVPTDQLRRMFFNQLEKFGDNHFLAVIHLAD
                 130       140       150       160       170       180

                 190      2000       210       220
m667.pep GADMYFILPPTHAARNRHNLMKMMLHKIAARLSTAFVLGNQHHL
          :|| ||||||||||||||||||||||| :||||||:||:|||:
a667     CTDMDFILPPTHAARNRHNLMKMMLHKIPTRLSTAFLLGKQHHFIVGQRGRQVIQRTDTL
                 190       200       210       220       230       240

a667     HIGYGFNIESQNRGHDSTLYLKXDLRLLCHX
                 250       260       270
```

The following partial DNA sequence was identified in *N. gonorrhoeae* <SEQ ID 2183>:

```
g669.seq
    1 ATGCGCCGCA TCGTTAAAAA ACACCAGCCC GTAAACGCGC CACATATCGT

   51 TTTGGAAATT CGGATAATGA AACTGCATCG CGCGTTTGTC TTCCTTGGGC

  101 GGAAACGTCC CCATCATCAT GACCGCAGCC TTCGGCGGCA ACACGGGATC

  151 GAAGGGATGG GTTTCGATTT CAAGCAGATT TTCAGACACG TTCAATCCTC

  201 CAACAGGCAA AGCGGCAGAC AGCCGGTTTG CACCAAACCG CCAAACACGG

  251 CAAGCCTTCA AACAGCATTA TCACGCCCTG CCGTTTTCGG TTACAATGCC

  301 GACATCAAAC GGATACTGTA A
```

This corresponds to the amino acid sequence <SEQ ID 2184; ORF 669.ng>:

```
g669.pep
    1 MRRIVKKHQP VNAPHIVLEI RIMKLHRAFV FLGRKRPHHH DRSLRRQHGI

   51 EGMGFDFKQI FRHVQSSNRQ SGRQPVCTKP PNTASLQTAL SRPAVFGYNA

  101 DIKRIL*
```

The following partial DNA sequence was identified in *N. meningitidis* <SEQ ID 2185>:

```
m669.seq
    1 ATGCGCCGCA TCATTAAAAA ACACCAGCCC ATAAACGCGC CACATATCGT

   51 TTTGGAAATT CGGATAATGA AACTGCATCG CGCGTTTGTC TTCCTTGGGC

  101 GGAAACGTCC CCATCATCAT GACAGCAGCC TTCGGCGGCA ACACGGGATC

  151 GAAGGGATGG GTTTCGATTT CAAGCAGATT TTCAGACACG TTCAATCCTC

  201 CAACAGGCAA AACGGCAGAC AGCCGGTTTG CACCAAACCG CCAAACACGG

  251 CAAGCCTTCA AACAGCATTA TCACGCCCTG CCGTTTTCGG TTACAATGCC

  301 GACATCAAAC GGATACTGTA A
```

This corresponds to the amino acid sequence <SEQ ID 2186; ORF 669>:

```
m669.pep
    1 MRRIIKKHQP INAPHIVLEI RIMKLHRAFV FLGRKRPHHH DSSLRRQHGI

   51 EGMGFDFKQI FRHVQSSNRQ NGRQPVCTKP PNTASLQTAL SRPAVFGYNA

  101 DIKRIL*
```

Computer analysis of this amino acid sequence gave the following results:
Homology with a Predicted ORF from *N. gonorrhoeae*

```
m669/g669  96.2% identity in 106 aa overlap

                    10        20        30        40        50        60
m669.pep    MRRIIKKHQPINAPHIVLEIRIMKLGRAFVFLGRKRPHHHDSSLRRQHGIEGMGFDFKQI
            ||||:|||||:|||||||||||||||||||||||||||||| ||||||||||||||||||
g669        MRRIVKKHQPVNAPHIVLEIRIMKLHRAFVFLGRKRPHHHDRSLRRQHGIEGMGFDFKQI
                    10        20        30        40        50        60

                    70        80        90       100
m669.pep    FRHVQSSNRQNGRQPVCTKPPNTASLQTALSRPAVFGYNADIKRILX
            ||||||||||:||||||||||||||||||||||||||||||||||||
g669        FRHVQSSNRQSGRQPVCTKPPNTASLQTALSRPAVFGYNADIKRILX
                    70        80        90       100
```

The following partial DNA sequence was identified in *N. meningitidis* <SEQ ID 2187>:

```
a669.seq
   1 ATGCGCCGCA TCATTAAAAA ACACCAGCCC GTAAACGCGC CACATATCGT

  51 TTTGGAAATT CGGATAATGA AACTGCATCG CGCGTTTGTC TTCCTTGGGC

 101 GGAAACGTCC CCATCATCAT GACCGCAGCC TTCGGCGGCA ACACGGAATC

 151 GAAGGGATGG GTTTCGATTT CAAGCAGATT TTCAGACACG TTCAATCCTC

 201 CAACAGGCAA AACGGCAGAC AGCCGGTTTG CACCAAACCG CCAAACACGG

 251 CAAGCCTTCA AACAGCATTA TCACGCCCTG CCGTTTTCGG TTACAATGCC

 301 GACATCAAAC GGATACTGTA A
```

This corresponds to the amino acid sequence <SEQ ID 2188; ORF 669.a>:

```
a669.pep

      1  MRRIIKKHQP VNAPHIVLEI RIMKLHRAFV FLGRKRPHHH DRSLRRQHGI

     51  EGMGFDFKQI FRHVQSSNRQ NGRQPVCTKP PNTASLQTAL SRPAVFGYNA

    101  DIKRIL*

m669/a669  98.1% identity in 106 aa overlap
                    10        20        30        40        50        60
m669.pep    MRRIIKKHQPINAPHIVLEIRIMKLHRAFVFLGRKRPHHHDSSLRRQHGIEGMGFDFKQI
            ||||||||||:|||||||||||||||||||||||||||||| ||||||||||||||||||
a669        MRRIIKKHQPVNAPHIVLEIRIMKLHRAFVFLGRKRPHHHDRSLRRQHGIEGMGFDFKQI
                    10        20        30        40        50        60

                    70        80        90       100
m669.pep    FRHVQSSNRQNGRQPVCTKPPNTASLQTALSRPAVFGYNADIKRILX
            |||||||||||||||||||||||||||||||||||||||||||||||
a669        FRHVQSSNRQNGRQPVCTKPPNTASLQTALSRPAVFGYNADIKRILX
                    70        80        90       100
```

The following partial DNA sequence was identified in *N. gonorrhoeae* <SEQ ID 2189>:

```
g670.seq
   1 ATGACTTGTT GCAGGAACTG CTTGGCGCGT TCGTGTTTCG GGTTGGTGAA

  51 AAACGCTTCC GGCGTTTCGT CTTCAAGGAT TTGCCCTTTA TCGACGAAAA

 101 TCACGCGGTC GGCAACTTCG CGGGCAAACC CCATTTCGTG GGTTACGCAC

 151 ATCATCGTCA TGCCGCTTTC CGCCAAGTCT TTCATCACTT TCAACACTTC
```

-continued

```
201 GCCGACCATT TCGGGGTCGA GTGCGGAAGT CGGCTCGTCA AACAGCATCA

251 CGCGCGGCTC CATCGCCAGC CCGCGCGCAA TCGCCACGCG TTGCTGCTGG

301 CCGCCGGAAA GTTGGGAAGG GAAGGCGTCT TTTTTGTGTG CCAGTCCGAC

351 GCGTTCCAAA AGCTCCATTG CCTTTTTCTC CGCCTGTTCC GCATTTTGCC

401 CCTTAACCTT CATCGGTGCG AGGGTGATGT TGTCCAACAC GGTCAGGTGC

451 GGGTAG
```

This corresponds to the amino acid sequence <SEQ ID 2190; ORF 670.ng>:

```
g670.pep
  1 MTCCRNCLAR SCFGLVKNAS GVSSSRICPL STKITRSATS RANPISWVTH

 51 IIVMPLSAKS FITFNTSPTI SGSSAEVGSS NSITRGSIAS PRAIATRCCW

101 PPESWEGKAS FLCASPTRSK SSIAFFSACS AFCPLTFIGA RVMLSNTVRC

151 G*
```

The following partial DNA sequence was identified in *N. meningitidis* <SEQ ID 2191>:

```
m670.seq
  1 ATGACCTGTT GCAGGAACTG CTTGGCGCGT TCGTGTTTCG GGTTGGTAAA

 51 AAACGCTTCG GGCGTTTCGT CTTCGAGGAT TTGCCCTTTA TCGACGAAAA

101 TCACGCGGTC GGCAACTTCG CGGGCAAACC CCATTTCGTG GGTTACGCAC

151 ATCATCGTCA TGCCGCTTTC TGCCAAGTCT TTCATCACTT TCAACACTTC

201 GCCGACCATT TCGGGGTCGA GTGCGGAGGT CGGTTCGTCA AACAACATTA

251 CGCGCGGTTC CATCGCCAAA CCGCGTGCAA TCGCCACGCG TTGCTGCTGG

301 CCGCCGGAAA GTTGGGAAGG GAAGGCGTCT TTTTTGTGTG CCAGTCCGAC

351 GCGTTCCAAA AGCTCCATTG CCTTTTTCTC CGCCTGTTCC GCATTTTGCC

401 CCTTAACCTT CATCGGTGCG AGGGTAATGT TTTCCAACAC GGTCAGGTGC

451 GGGTAG
```

This corresponds to the amino acid sequence <SEQ ID 2192; ORF 670>:

```
m670.pep
  1 MTCCRNCLAR SCFGLVKNAS GVSSSRICPL STKITRSATS RANPISWVTH

 51 IIVMPLSAKS FITFNTSPTI SGSSAEVGSS NNITRGSIAK PRAIATRCCW

101 PPESWEGKAS FLCASPTRSK SSIAFFSACS AFCPLTFIGA RVMFSNTVRC

151 G*
```

Computer analysis of this amino acid sequence gave the following results:
Homology with a Predicted ORF from *N. gonorrhoeae*

```
m670/g670  98.0% identity in 151 aa overlap
                     10        20        30        40        50        60
m670.pep   MTCCRNCLARSCFGLVKNASGVSSSRICPLSTKITRSATSRANPISWVTHIIVMPLSAKS
           ||||||||||||||||||||||||||||||||||||||||||||||||||||||||||||
g670       MTCCRNCLARSCFGLVKNASGVSSSRICPLSTKITRSATSRANPISWVTHIIVMPLSAKS
                     10        20        30        40        50        60
```

-continued

```
                  70         80         90        100        110        120
m670.pep   FITFNTSPTISGSSAEVGSSNNITRGSIAKPRAIATRCCWPPESEWGKASFLCASPTRSK
           |
g670       FITFNTSPTISGSSAEVGSSNSITRGSIASPRAIATRCCWPPESWEGKASFLCASPTRSK
                  70         80         90        100        110        120

                 130        140        150
m670.pep   SSIAFFSACSAFCPLTFIGARVMFSNTVRCGX
           |
g670       SSIAFFSACSAFCPLTFIGARVMLSNTVRCGX
                 130        140        150
```

The following partial DNA sequence was identified in *N. meningitidis* <SEQ ID 2193>:

```
a670.seq
   1 ATGACCTGTT GCAGGAACTG CTTGGCGCGT TCGTGTTTCG GGTTGGTAAA

  51 AAACGCTTCC GGCGTTTCGT CTTCGAGGAT TTGCCCTTTA TCGACGAAAA

 101 TCACGCGGTC GGCAACTTCG CGGGCAAACC CCATTTCGTG GGTTACGCAC

 151 ATCATGGTCA TACCGCTTTC CGCCAAGTCT TTCATCACTT TCAACACTTC

 201 GCCGACCATT TCGGGGTCGA GTGCGGAGGT CGGTTCGTCA AACAACATTA

 251 CGCGCGGTTC CATCGCCAAA CCGCGTGCAA TCGCCACGCG TTGCTGCTGG

 301 CCGCCGGAAA GTTGGGAAGG GAAGGCGTCT TTTTTGTGTG CCAGTCCGAC

 351 GCGTTCCAAA AGTTCCATCG CTTTTTTCTC TGCCTGTTCC GCATTTTGAC

 401 CTTTAACCTT CATCGGTGCG AGGGTAATGT TTTCCAACAC GGTCAGGTGC

 451 GGGTAG
```

This corresponds to the amino acid sequence <SEQ ID 2194; ORF 670.a>:

```
a670.pep

      1  MTCCRNCLAR SCFGLVKNAS GVSSSRICPL STKITRSATS RANPISWVTH

     51  IMVIPLSAKS FITFNTSPTI SGSSAEVGSS NNITRGSIAK PRAIATRCCW

    101  PPESWEGKAS FLCASPTRSK SSIAFFSACS AF*PLTFIGA RVMFSNTVRC

    151  G*

m670/a670  98.0% identity in 151 aa overlap
                  10         20         30         40         50         60
m670.pep   MTCCRNCLARSCFGLVKNASGVSSSRICPLSTKITRSATSRANPISWVTHIIVMPLSAKS
           ||||||||||||||||||||||||||||||||||||||||||||||||||:|:||||||
a670       MTCCRNCLARSCFGLVKNASGVSSSRICPLSTKITRSATSRANPISWVTHIMVIPLSAKS
                  10         20         30         40         50         60

                  70         80         90        100        110        120
m670.pep   FITFNTSPTISGSSAEVGSSNNITRGSIAKPRAIATRCCWPPESWEGKASFLCASPTRSK
           ||||||||||||||||||||||||||||||||||||||||||||||||||||||||||||
a670       FITFNTSPTISGSSAEVGSSNNITRGSIAKPRAIATRCCWPPESWEGKASFLCASPTRSK
                  70         80         90        100        110        120

                 130        140        150
m670.pep   SSIAFFSACSAFCPLTFIGARVMFSNTVRCGX
           |||||||||||| ||||||||||||||||||
a670       SSIAFFSACSAFXPLTFIGARVMFSNTVRCGX
                 130        140        150
```

The following partial DNA sequence was identified in *N. gonorrhoeae* <SEQ ID 2195>:

```
g671.seq
   1  ATGATCAGCA GGGTAACAAT CAAAACGCCT TTCAATGCAC CGAATACACC
```

-continued

```
 51 GCCCAAAATG CGGTTGGCAA AGCCCAGACC GACCGCCGAA ACTGCGCCGG

101 TCAGCAGCGA ACGGAGCATT TTCTGGATCA GACAGGCAAT GACGAACAGG

151 GAAATGAATG ACAGagccaa TGCAAACAgg cggggTTGGA ACGaggCAAA

201 GGCGAGGTcg gcgaaggGTG CGGCaaAGAG TTTggcaaAA AAGAaggAAA

251 ccacccATGC cACCATCgaa ccTGCTTCCG CAATCACGCC GCGCATCGTG

301 GAAATGACGA TGCAGGCGGC GATGACGGcg gAGGCGAGGA GGTCGGCAAT

351 GGGGAGGCTA TTCATTCGTT ACCTGGCCGG CGATGCCGTG CACGCGCAGT

401 TTGTTCAAAT CGCGTTCGGC ATCCCTTGCG TTTTTATAGT TGCTTGA
```

This corresponds to the amino acid sequence <SEQ ID 2196; ORF 671.ng>:

```
g671.pep
  1 MISRVTIKTP FNAPNTPPKM RLAKPRPTAE TAPVSSERSI FWIRQAMTNR

 51 EMNDRANANR RGWNEAKARS AKGAAKSLAK KKETTHATIE PASAITPRIV

101 EMTMQAAMTA EARRSAMGRL FIRYLAGDAV HAQFVQIAFG IPCVFIVA*
```

The following partial DNA sequence was identified in *N. meningitidis* <SEQ ID 2197>:

```
m671.seq
  1 ATGACCAGCA GGGTAACAAT CAAAACGCCT TTCAATGCAC CGAATACGCC

 51 GCCCAAAATG CGGTTGGCAA AGCCCAAACC GACCGCCGAA ACTGCGCTGG

101 TCAGCAGCGA ACGGAGCATT TTCTGGATCA GACAGGCAAT GACGAACAGG

151 GAAATGAACG ACAGAGCCAA TGCAAACAGG CGGGGTTGGA ACGAGGCAAA

201 GGCGAGGTCG GCGAAGGAGG CGGCAAAGAG TTTGGCGAAA AAGAAGGAAA

251 CCACCCATGC CGCCATTGAG CCTGCCTCCG CAATCACGCC GCGCATCGCG

301 GATAGCACGA TGCAGGCGGC GATGACGGCG GAGACGAGGA GGTCGGCAAT

351 GGGGAGGCTA TTCATTCGTT ACCTGACCGG CGATACCGTG TACGCGCAAT

401 TTGTTCAAAT CGCGTTCGGC ATCCCTTGCG TTTTTATAGT TGCTTGA
```

This corresponds to the amino acid sequence <SEQ ID 2198; ORF 671>:

```
m671.pep
  1 MTSRVTIKTP FNAPNTPPKM RLAKPKPTAE TALVSSERSI FWIRQAMTNR

 51 EMNDRANANR RGWNEAKARS AKEAAKSLAK KKETTHAAIE PASAITPRIA

101 DSTMQAAMTA ETRRSAMGRL FIRYLTGDTV YAQFVQIAFG IPCVFIVA*
```

Computer analysis of this amino acid sequence gave the following results:

Homology with a Predicted ORF from *N. gonorrhoeae*

```
m671/g671  91.9% identity in 148 aa overlap
                   10        20        30        40        50        60
m671.pep   MTSRVTIKTPFNAPNTPPKMRLAKPKPTAETALVSSERSIFWIRQAMTNREMNDRANANR
           | ||||||||||||||||||||||:|||||| |||||||||||||||||||||||||||
g671       MISRVTIKTPFNAPNTPPKMRLAKPRPTAETAPVSSERSIFWIRQAMTNREMNDRANANR
                   10        20        30        40        50        60
```

-continued

```
                    70        80        90       100       110       120
m671.pep    RGWNEAKARSAKEAAKSLAKKKETTHAAIEPASAITPRIADSTMQAAMTAETRRSAMGRL
            |||||||||||| ||||||||||||||:|||||||||||:: |||||||||:||||||||
g671        RGWNEAKARSAKGAAKSLAKKKETTHATIEPASAITPRIVEMTMQAAMTAEARRSAMGRL
                    70        80        90       100       110       120

                   130       140      149
m671.pep    FIRYLTGDTVYAQFVQIAFGIPCVFIVAX
            |||||:||:|:||||||||||||||||||
g671        FIRYLAGDAVHAQFVQIAFGIPCVFIVAX
                   130       140
```

The following partial DNA sequence was identified in *N. meningitidis* <SEQ ID 2199>:

```
a671.seq
   1  ATGACCAGCA GGGTAATAAT CAAAATGCCT TTCAATGCAC CGAATACGCC

  51  GCCCAAAATG CGGTTGGCAA AGCCCAAACC GACCGCCGAA ACTGCCCCGG

 101  TCAGCAGCGA GCGGAGTATT TTCTGGATCA GACAGGCAAT GACGAATAGG

 151  GAAATGAACG ACAGAGCCAA TGCAAACAGG CGGGGTTGGA ACGATGCAAA

 201  GGCGATGTCG GCGAAGGGTG CGGCAAAGAG TTTGGCGAAA AAAAAGGCAA

 251  CCACCCATGC CGCCATTGAG CCAGCCTCCG CAATCACGCC GCGCATCGCG

 301  GATAGCACGA TGCAGGCGGC GATGATGGCG GAGACGAGGA GGTCGGCAAC

 351  GGGGAGGTTA TTCATTCGTT ACCTGACCGG CGATACCGTG TACGCGCAAT

 401  TTGTTCAAAT CGCGTTCGGC ATCCCTTGCG TTTTTATAGT TGCTTGA
```

This corresponds to the amino acid sequence <SEQ ID 2200; ORF 671.a>:

```
a671.pep

      1  MTSRVIIKMP FNAPNTPPKM RLAKPKPTAE TAPVSSERSI FWIRQAMTNR

     51  EMNDRANANR RGWNDAKAMS AKGAAKSLAK KKATTHAAIE PASAITPRIA

    101  DSTMQAAMMA ETRRSATGRL FIRYLTGDTV YAQFVQIAFG IPCVFIVA*
```

```
 m671/a671 93.9% identity in 148 aa overlap

                    10        20        30        40        50        60
m671.pep    MTSRVTIKTPFNAPNTPPKMRLAKPKPTAETALVSSERSIFWIRQAMTNREMNDRANANR
            ||||| || |||||||||||||||||||||| ||||||||||||||||||||||||||||
a671        MTSRVIIKMPFNAPNTPPKMRLAKPKPTAETAPVSSERSIFWIRQAMTNREMNDRANANR
                    10        20        30        40        50        60

                    70        80        90       100       110       120
m671.pep    RGWNEAKARSAKEAAKSLAKKKETTHAAIEPASAITPRIADSTMQAAMTAETRRSAMGRL
            ||||:||| ||| ||||||||| |||||||||||||||||||||||||| ||||||| |||
a671        RGWNDAKAMSAKGAAKSLAKKKATTHAAIEPASAITPRIADSTMQAAMMAETRRSATGRL
                    70        80        90       100       110       120

                   130       140      149
m671.pep    FIRYLTGDTVYAQFVQIAFGIPCVFIVAX
            |||||||||||||||||||||||||||||
a671        FIRYLTGDTVYAQFVQIAFGIPCVFIVAX
                   130       140
```

The following partial DNA sequence was identified in *N. gonorrhoeae* <SEQ ID 2201>:

```
g672.seq
   1  ATGAGGAAAA TCCGCACCAA AATCTGCGGC ATCACCACAC CGGAAGACGC

  51  ACTGTATGCC GCCCACGCCG GCGCAGACGC ATTGGGACTG GTTTTTTACC
```

-continued

```
101 CCCAAAGCCC CCGCGCTATC GACATCATTA AAGCACAAAA AATCGCCGCC

151 GCACTGCCGC CGTTTGTCAG CGTTGTCGCC CTTTTCGTCA ACGAAAGCGC

201 GCAAAACATC CGCCGCATCC TTGCCGAAGT GCCGATACAC ATCATCCAAT

251 TCCACGGCGA CGAAGACGAT GCATTCTGCC GGCAGTTCGA CCGCCCCTAT

301 ATTAAAGCCA TTCGTGTTCA GACGGCATCA GACATCCGAA ACGCCGCCAC

351 GCGCTTCCCC AACGCTCAGG CACTGCTGTT CGATGCCTAT CACCCTTCGG

401 AATACGGCGG CACCGGACAC CGCTTCGact GGacgctgtt ggcggAATAT

451 TCGGGCAAGC CGTGGGTGCT TGCCGGCGGG CTGACCCCTG AAAACGTCGG

501 CGAAGCCGTC CGCATCACCG GAGCGGAAGC GGTCGACGTA TCCGGCGGCG

551 TGGAAGCGTC TAAAGGCAAA AAAGACCCCG CCAAAGTCGC CGCCTTTATC

601 GCAACCGCCA ACCGCCTATC CCGTTAA
```

This corresponds to the amino acid sequence <SEQ ID 2202; ORF 672.ng>:

```
g672.pep
  1 MRKIRTKICG ITTPEDALYA AHAGADALGL VFYPQSPRAI DIIKAQKIAA

 51 ALPPFVSVVA LFVNESAQNI RRILAEVPIH IIQFHGDEDD AFCRQFDRPY

101 IKAIRVQTAS DIRNAATRFP NAQALLFDAY HPSEYGGTGH RFDWTLLAEY

151 SGKPWVLAGG LTPENVGEAV RITGAEAVDV SGGVEASKGK KDPAKVAAFI

201 ATANRLSR*
```

The following partial DNA sequence was identified in *N. meningitidis* <SEQ ID 2203>:

```
m672.seq
  1 ATGAGGAAAA TCCGCACCAA AATCTGCGGC ATCACCACAC CGGAAGACGC

 51 AGCTGCCGCC GCAGCGGCAG GTGCGGATGC CGTCGGGCTG GTCTTTTTCC

101 AAGGCAGCAG CCGGGCCGTC GATATTGCCC GCGCCAAAAA AATCACCGCC

151 GCACTGCCGC CGTTTGTCAG CGTTGTCGCC CTTTTCGTCA ACGAAAGCGC

201 GCAAAACATC CGCCGCATCC TTGCCGAAGT GCCGATACAC ATCATCCAAT

251 TCCACGGCGA CGAAGACGAC GCATTCTGCC GCCAGTTCCA CCGCCCCTAT

301 ATCAAAGCCA TTCGTGTTCA GACGGCATCA GACATCCGAA ACGCCGCCAC

351 GCGCTTCCCC GACGCTCAGG CACTGCTGTT CGATGCCTAC CATCCTTCGG

401 AATACGGCGG CACCGGAAAC CGCTTCGACT GGACGCTGCT GGCGGAATAT

451 TCGGGCAAAC CGTGGGTGCT TGCCGGCGGG CTGACCCCTG AAAACGTCGG

501 CGAAGCCGTC CGCATCACCG GAGCGGAATC GGTCGATGTA TCCGGCGGTG

551 TGGAAGCGTC TAAAGGCAAA AAAGATGCCG CCAAAGTCGC CGCCTTTATC

601 GCAACCGCCA ACCGCCTATC CCGTTAA
```

This corresponds to the amino acid sequence <SEQ ID 2204; ORF 672>:

```
m672.pep
  1 MRKIRTKICG ITTPEDAAAA AAAGADAVGL VFFQGSSRAV DIARAKKITA

 51 ALPPFVSVVA LFVNESAQNI RRILAEVPIH IIQFHGDEDD AFCRQFHRPY
```

-continued

```
101 IKAIRVQTAS DIRNAATRFP DAQALLFDAY HPSEYGGTGN RFDWTLLAEY

151 SGKPWVLAGG LTPENVGEAV RITGAESVDV SGGVEASKGK KDAAKVAAFI

201 ATANRLSR*
```

Computer analysis of this amino acid sequence gave the following results:

Homology with a Predicted ORF from *N. gonorrhoeae*

```
m672/g672 91.3% identity in 208 aa overlap

                   10        20        30        40        50        60
m672.pep   MRKIRTKICGITTPEDAAAAAAAGADAVGLVFFQGSSRAVDIARAKKITAALPPFVSVVA
           ||||||||||||||||  || |||||:||||:  | ||:|| :|:||:||||||||||
g672       MRKIRTKICGITTPEDALYAAHAGADALGLVFYPQSPRAIDIIKAQKIAAALPPFVSVVA
                   10        20        30        40        50        60

                   70        80        90       100       110       120
m672.pep   LFVNESAQNIRRILAEVPIHIIQFHGDEDDAFCRQFHRPYIKAIRVQTASDIRNAATRFP
           |||||||||||||||||||||||||||||||||||| |||||||||||||||||||||||
g672       LFVNESAQNIRRILAEVPIHIIQFHGDEDDAFCRQFDRPYIKAIRVQTASDIRNAATRFP
                   70        80        90       100       110       120

                  130       140       150       160       170       180
m672.pep   DAQALLFDAYHPSEYGGTGNRFDWTLLAEYSGKPWVLAGGLTPENVGEAVRITGAESVDV
           :||||||||||||||||||:||||||||||||||||||||||||||||||||||||:|||
g672       NAQALLFDAYHPSEYGGTGHRFDWTLLAEYSGKPWVLAGGLTPENVGEAVRITGAEAVDV
                  130       140       150       160       170       180

                  190       200       209
m672.pep   SGGVEASKGKKDAAKVAAFIATANRLSRX
           ||||||||||| |||||||||||||||
g672       SGGVEASKGKKDPAKVAAFIATANRLSRX
                  190       200
```

The following partial DNA sequence was identified in *N. meningitidis* <SEQ ID 2205>:

```
a672.seq
  1 ATGAGGAAAA TCCGCACCAA AATCTGCGGC ATCACCACAC CGGAAGACGC

 51 ACTGTATGCC GCCCACGCCG GCGCAGACGC ATTGGGACTG GTTTTTTACC

101 CCCAAAGCCC CCGCGCTGTC GACATCATTA AAGCACAAAA AATCACCGCC

151 GCACTGCCGC CGTTTGTCAG CGTTGTCGCC CTTTTCGTCA ACGAAAGCGC

201 GCAAAACATC CGCCGCATCC TTGCCGAAGT ACCGATACAC ATCATCCAAT

251 TCCACGGCGA CGAAGACGAC GCATTCTGCC GCCAGTTCCA CCGCCCCTAT

301 ATCAAGGCCA TTCGTGTTCA GACGGCATCA GACATCCGAA ACGCCGCCGA

351 CCGCTTCCCC GACGCTCAGG CACTGCTGTT CGATGCCTAC CATCCTTCGG

401 AATACGGCGG CACCGGACAC CGCTTCGACT GGACGCTGTT GGCGGAATAT

451 TCGGGCAAAC CGTGGGTGCT TGCCGGCGGG CTGACCCCTG AAAACGTCGA

501 CGAAGCCATC CGCATCACCG GAGCGGAAGC GGTCGATGTA TCCGGCGGCG

551 TGGAAGCGTC TAAAGGCAAA AAAGACCCAG CCAAAGTTGC CGCCTTTATC

601 GCAACCGCCA ACCGCCTATC CCGTTAA
```

This corresponds to the amino acid sequence <SEQ ID 2206; ORF 672.a>:

```
a672.pep

     1 MRKIRTKICG ITTPEDALYA AHAGADALGL VFYPQSPRAV DIIKAQKITA
```

-continued

```
 51 ALPPFVSVVA LFVNESAQNI RRILAEVPIH IIQFHGDEDD AFCRQFHRPY

101 IKAIRVQTAS DIRNAADRFP DAQALLFDAY HPSEYGGTGH RFDWTLLAEY

151 SGKPWVLAGG LTPENVDEAI RITGAEAVDV SGGVEASKGK KDPAKVAAFI

201 ATANRLSR*
```

m672/a672 91.8% identity in 208 aa overlap

```
                  10        20        30        40        50        60
m672.pep  MRKIRTKICGITTPEDAAAAAAAGADAVGLVFFQGSSRAVDIARAKKITAALPPFVSVVA
          ||||||||||||||||  || |||||:||||:  | |||||  :|:||||||||||||||
a672      MRKIRTKICGITTPEDALYAAHAGADALGLVFYPQSPRAVDIIKAQKITAALPPFVSVVA
                  10        20        30        40        50        60

                  70        80        90       100       110       120
m672.pep  LFVNESAQNIRRILAEVPIHIIQFHGDEDDAFCRQFHRPYIKAIRVQTASDIRNAATRFP
          |||||||||||||||||||||||||||||||||||||||||||||||||||||||| |||
a672      LFVNESAQNIRRILAEVPIHIIQFHGDEDDAFCRQFHRPYIKAIRVQTASDIRNAADRFP
                  70        80        90       100       110       120

                 130       140       150       160       170       180
m672.pep  DAQALLFDAYHPSEYGGTGNRFDWTLLAEYSGKPWVLAGGLTPENVGEAVRITGAESVDV
          |||||||||||||||||||:|||||||||||||||||||||||||| ||:||||||:|||
a672      DAQALLFDAYHPSEYGGTGHRFDWTLLAEYSGKPWVLAGGLTPENVDEAIRITGAEAVDV
                 130       140       150       160       170       180

                 190       200      209
m672.pep  SGGVEASKGKKDAAKVAAFIATANRLSRX
          |||||||||||| ||||||||||||||||
a672      SGGVEASKGKKDPAKVAAFIATANRLSRX
                 190       200
```

The following partial DNA sequence was identified in *N. gonorrhoeae* <SEQ ID 2207>:

```
g673.seq
  1 ATGGATATTG AAACCTTCCT TGCAGGGGAA CGCGCCGCCG GCGGATACCG

 51 TTGCGGCTTC GTGGCGATTG TCGGTCGTCC GAACGTGGGC AAATCAACGC

101 TGATGAACCA TCTCATCGGT CAGAAAATCA GTATTACCAG CAAAAAGGCG

151 CAGACGACGC GCAACCGCGT AACGGGGATT TATACCGACG ATACCGCGCA

201 GTTCGTGTTT GTCGATACGC CGGGCTTTCA AACCGACCAC CGCAACGCGC

251 TCAACGACAG GCTGAATCAA AATGTTACCG AGGCGCTCGG CGGTGTGGAT

301 GTGGTGGTTT TCGTCGTGGA GGCGATGCGC CTTACCGATG CCGACCGCGT

351 CGTGTTGAAA CAACTGCCCA AGCACACGCC GGTCATTTTA GTGATCAACA

401 AAATCGACAA GGACAAGGCG AAAGACCGTT ACGCGCTGGA GGCGTTTGTT

451 GCCCAAGTGC GCGCCGAATT TGAATTTGCG GCGGCGGAGG CGGTCAGTGC

501 GAAACACGGT TTGCGGATTG CCAACCTGTT GGAGCTGCTC AAGCCGTATC

551 TGCCCGAAAG CGTACCGATG TATCCCGAAG ACATGGTTAC GGACAAATCG

601 GCGCGTTTTT TGGCGATGGA AATCGTGCGT GAAAAACTCT TCCGCTATTT

651 GGGCGAGGAG CTGCCTTATG CGATGAACGT CGAAGTGGAG CAGTTTGAAG

701 AGGGAGACGG TTTGAACCGC ATCTACAtcg cCGTTTTGGT CGACAAAGAA

751 AGCCAAAAGG CGATTTTGAT CGGTAAAGGC GGGGAGCGTT TGAAAAAAAT

801 TTCCACCGAA GCGCGGCTGG ATATGGAAAA ACTGTTTGAT AACAAAGTAT

851 TTTTGAAGGT CTGGGTCAAA GTCAAATCCG GTTGGGCAGA CGACATTCGC

901 TTCCTGCGCG AGCTGGGTTT GTAG
```

This corresponds to the amino acid sequence <SEQ ID 2208; ORF 673.ng>:

g673.pep
```
  1 MDIETFLAGE RAAGGYRCGF VAIVGRPNVG KSTLMNHLIG QKISITSKKA

 51 QTTRNRVTGI YTDDTAQFVF VDTPGFQTDH RNALNDRLNQ NVTEALGGVD

101 VVVFVVEAMR LTDADRVVLK QLPKHTPVIL VINKIDKDKA KDRYALEAFV

151 AQVRAEFEFA AAEAVSAKHG LRIANLLELL KPYLPESVPM YPEDMVTDKS

201 ARFLAMEIVR EKLFRYLGEE LPYAMNVEVE QFEEGDGLNR IYIAVLVDKE

251 SQKAILIGKG GERLKKISTE ARLDMEKLFD NKVFLKVWVK VKSGWADDIR

301 FLRELGL*
```

The following partial DNA sequence was identified in *N. meningitidis* <SEQ ID 2209>:

m673.seq
```
  1 ATGGATATTG AAACCTTCCT TGCAGGGGAA CGCGCCGCCG GCGGATACCG

 51 TTGCGGCTTC GTAGCGATTG TCGGCCGTCC GAACGTGGGC AAATCAACGC

101 TGATGAACCA TCTCATCGGT CAGAAAATCA GTATTACCAG CAAAAAGGCG

151 CAGACGACGC GCAACCGCGT AACGGGGATT TATACCGACG ATACCGCGCA

201 GTTCGTGTTT GTCGATACGC CCGGCTTTCA AACCGACCAC CGCAACGCGC

251 TCAACGACAG GCTGAATCAA AATGTTACCG AGGCGCTCGG CGGCGTGGAT

301 GTGGTGGTTT TCGTCGTGGA GGCGATGCGC TTTACCGATG CCGACCGCGT

351 CGTGTTGAAA CAACTGCCCA AGCACACGCC GGTCATTTTA GTGGTCAACA

401 AAATCGACAA GGACAAGGCG AAAGACCGTT ACGCGCTGGA GGCGTTTGTT

451 GCCCAAGTGC GCGCCGAATT TGAATTTGCG GCGGCGGAGG CGGTCAGCGC

501 GAAACACGGA TTGCGGATTG CCAACCTGTT GGAGCTGATT AAGCCGTATC

551 TGCCCGAAAG CGTGCCGATG TATCCCGAAG ATATGGTTAC GGACAAATCG

601 GCGCGTTTTT TGGCGATGGA AATCGTGCGT GAAAAATTGT TCCGCTATTT

651 GGGCGAGGAA TTGCCTTATG CGATGAACGT CGAAGTGGAG CAGTTTGAAG

701 AGGAAGACGG TTTGAACCGC ATCTATATCG CCGTTTTGGT CGATAAGGAA

751 AGCCAAAAGG CAATTTTAAT CGGTAAAGGC GGAGAACGTT TGAAGAAAAT

801 TTCCACCGAA GCGCGGTTGG ATATGGAAAA ACTGTTTGAT ACCAAAGTAT

851 TTTTGAAGGT CTGGGTCAAA GTCAAATCCG GTTGGGCGGA CGACATCCGC

901 TTCCTGCGCG AGCTGGGTTT GTAG
```

This corresponds to the amino acid sequence <SEQ ID 2210; ORF 673>:

m673.pep
```
  1 MDIETFLAGE RAAGGYRCGF VAIVGRPNVG KSTLMNHLIG QKISITSKKA

 51 QTTRNRVTGI YTDDTAQFVF VDTPGFQTDH RNALNDRLNQ NVTEALGGVD

101 VVVFVVEAMR FTDADRVVLK QLPKHTPVIL VVNKIDKDKA KDRYALEAFV

151 AQVRAEFEFA AAEAVSAKHG LRIANLLELI KPYLPESVPM YPEDMVTDKS

201 ARFLAMEIVR EKLFRYLGEE LPYAMNVEVE QFEEEDGLNR IYIAVLVDKE

251 SQKAILIGKG GERLKKISTE ARLDMEKLFD TKVFLKVWVK VKSGWADDIR

301 FLRELGL*
```

Computer analysis of this amino acid sequence gave the following results:
Homology with a Predicted ORF from *N. gonorrhoeae*

```
m673/g673  98.4% identity in 307 aa overlap
                   10        20        30        40        50        60
m673.pep   MDIETFLAGERAAGGYRCGFVAIVGRPNVGKSTLMNHLIGQKISITSKKAQTTRNRVTGI
           ||||||||||||||||||||||||||||||||||||||||||||||||||||||||||||
g673       MDIETFLAGERAAGGYRCGFVAIVGRPNVGKSTLMNHLIGQKISITSKKAQTTRNRVTGI
                   10        20        30        40        50        60

                   70        80        90       100       110       120
m673.pep   YTDDTAQFVFVDTPGFQTDHRNALNDRLNQNVTEALGGVDVVVFVVEAMRFTDADRVVLK
           |||||||||||||||||||||||||||||||||||||||||||||||||||:||||||||
g673       YTDDTAQFVFVDTPGFQTDHRNALNDRLNQNVTEALGGVDVVVFVVEAMRLTDADRVVLK
                   70        80        90       100       110       120

                  130       140       150       160       170       180
m673.pep   QLPKHTPVILVVNKIDKDKAKDRYALEAFVAQVRAEFEFAAAEAVSAKHGLRIANLLELI
           |||||||||||:|||||||||||||||||||||||||||||||||||||||||||||||:
g673       QLPKHTPVILVINKIDKDKAKDRYALEAFVAQVRAEFEFAAAEAVSAKHGLRIANLLELL
                  130       140       150       160       170       180

                  190       200       210       220       230       240
m673.pep   KPYLPESVPMYPEDMVTDKSARFLAMEIVREKLFRYLGEELPYAMNVEVEQFEEEDGLNR
           |||||||||||||||||||||||||||||||||||||||||||||||||||||| |||||
g673       KPYLPESVPMYPEDMVTKDSARFLAMEIVREKLFRYLGEELPYAMNVEVEQFEEGDGLNR
                  190       200       210                 230       240

                  250       260       270       280       290       300
m673.pep   IYIAVLVDKESQKAILIGKGGERLKKISTEARLDMEKLFDTKVFLKVWVKVKSGWADDIR
           |||||||||||||||||||||||||||||||||||||||:||||||||||||||||||||
g673       IYIAVLVDKESQKAILIGKGGERLKKISTEARLDMEKLFDNKVFLKVWVKVKSGWADDIR
                  250       260       270       280       290       300

m673.pep   FLRELGLX
           ||||||||
g673       FLRELGLX
```

The following partial DNA sequence was identified in *N. meningitidis* <SEQ ID 2211>:

```
673.seq
    1  ATGGATATTG AAACCTTCCT TGCAGGGGAA CGCGCCGCCG ACGGATACCG
   51  TTGCGGCTTC GTAGCGATTG TCGGCCGTCC GAACGTGGGC AAATCAACGC
  101  TGATGAATCA TCTCATCGGT CAGAAAATCA GTATTACCAG CAAAAAGGCG
  151  CAGACGACGC GCAACCGCGT AACGGGGATT TATACCGACG ATACCGCGCA
  201  GTTTGTGTTT GTCGATACGC CCGGTTTTCA AACCGACCAC CGCAACGCGC
  251  TCAACGACCG TTTGAATCAA AACGTTACCG AGGCACTCGG CGGCGTGGAT
  301  GTGGTGGTTT TCGTCGTGGA AGCGATGCGT TTTACCGATG CCGACCGCGT
  351  CGTGTTGAAA CAACTGCCCA AGCACACGCC GGTCATTTTA GTGGTCAACA
  401  AAATCGATAA GGACAAGGCG AAAGACCGTT ACGCGCTGGA GGCGTTTGTT
  451  GCCCAGGTGC GCGCCGAATT TGAATTTGCG GCGGCGGAGG CGGTCAGCGC
  501  GAAACACGGA TTGCGGATTG CCAACCTGTT GGAGCTGATT AAGCCGTATC
  551  TGCCCGAAAG CGTGCCGATG TATCCCGAAG ATATGGTTAC GGACAAATCG
  601  GCGCGTTTTT TAGCGATGGA AATCGTGCGT GAAAAATTGT TCCGCTATTT
  651  GGGCGAGGAA TTGCCTTATG CGATGAACGT CGAAGTGGAG CAGTTTGAAG
  701  AGGAAGACGG TTTGAACCGC ATCTATATCG CCGTTTTGGT CGATAAGGAA
  751  AGCCAAAAGG CGATTTTAAT CGGCAAAGGC GGGGAGCGTT TGAAGAAAAT
  801  TTCCACCGAA GCGCGGTTGG ATATGGAAAA ACTGTTTGAT ACCAAAGTAT
  851  TTTTGAAGGT CTGGGTCAAA GTCAAATCCG GTTGGGCGGA CGACATCCGC
  901  TTCCTGCGCG AGCTGGGTTT GTAG
```

This corresponds to the amino acid sequence <SEQ ID 2212; ORF 673.a>:

```
a673.pep

      1  MDIETFLAGE RAADGYRCGF VAIVGRPNVG KSTLMNHLIG QKISITSKKA

     51  QTTRNRVTGI YTDDTAQFVF VDTPGFQTDH RNALNDRLNQ NVTEALGGVD

    101  VVVFVVEAMF FTDADRVVLK QLPKHTPVIL VVNKIDKDKA KDRYALEAFV

    151  AQVRAEFEFA AAEAVSAKHG LRIANLLELI KPYLPESVPM YPEDMVTDKS

    201  ARFLAMEIVR EKLFRYLGEE LPYAMNVEVE QFEEEDGLNR IYIAVLVDKE

    251  SQKAILIGKG GERLKKISTE ARLDMEKLFD TKVFLKVWVK VKSGWADDIR

    301  FLREIGL*

m673/a673  99.7% identity in 307 aa overlap
                    10        20        30        40        50        60
m673.pep   MDIETFLAGERAAGGYRCGFVAIVGRPNVGKSTLMNHLIGQKISITSKKAQTTRNRVTGI
           ||||||||||||| ||||||||||||||||||||||||||||||||||||||||||||||
a673       MDIETFLAGERAADGYRCGFVAIVGRPNVGKSTLMNHLIGQKISITSKKAQTTRNRVTGI
                    10        20        30        40        50        60

                    70        80        90       100       110       120
m673.pep   YTDDTAQFVFVDTPGFQTDHRNALNDRLNQNVTEALGGVDVVVFVVEAMRFTDADRVVLK
           ||||||||||||||||||||||||||||||||||||||||||||||||||||||||||||
a673       YTDDTAQFVFVDTPGFQTDHRNALNDRLNQNVTEALGGVDVVVFVVEAMRFTDADRVVLK
                    70        80        90       100       110       120

                   130       140       150       160       170       180
m673.pep   QLPKHTPVILVVNKIDKDKAKDRYALEAFVAQVRAEFEFAAAEAVSAKHGLRIANLLELI
           ||||||||||||||||||||||||||||||||||||||||||||||||||||||||||||
a673       QLPKHTPVILVVNKIDKDKAKDRYALEAFVAQVRAEFEFAAAEAVSAKHGLRIANLLELI
                   130       140       150       160       170       180

                   190       200       210       220       230       240
m673.pep   KPYLPESVPMYPEDMVTDKSARFLAMEIVREKLFRYLGEELPYAMNVEVEQFEEEDGLNR
           ||||||||||||||||||||||||||||||||||||||||||||||||||||||||||||
a673       KPYLPESVPMYPEDMVTDKSARFLAMEIVREKLFRYLGEELPYAMNVEVEQFEEEDGLNR
                   190       200       210       220       230       240

                   250       260       270       280       290       300
m673.pep   IYIAVLVDKESQKAILIGKGGERLKKISTEARLDMEKLFDTKVFLKVWVKVKSGWADDIR
           ||||||||||||||||||||||||||||||||||||||||||||||||||||||||||||
a673       IYIAVLVDKESQKAILIGKGGERLKKISTEARLDMEKLFDTKVFLKVWVKVKSGWADDIR
                   250       260       270       280       290       300

m673.pep   FLRELGLX
           ||||||||
a673       FLRELGLX
```

The following partial DNA sequence was identified in *N. gonorrhoeae* <SEQ ID 2213>:

```
g674.seq
   1 ATGAAAACAG CCCGCCGCCG TTCCCGCGAG CTTGCCGTAC AAGCCGTTTA

  51 CCAATCCCTT ATCAACCGCA CCGCCGCGCC CGAAATTGCT AAAAACATCC

 101 GCGAAATGTC CGACTTTGCC AAAGCGGACG AAGAATTGTT CAACAAACTC

 151 TTCTTCGGCA CACAAACCAA TGCAGCGGAC TACATCCAAA AAATCCGCCC

 201 GCTGCTCGAC AGGGACGAAA AAGACCTCAA CCCCATCGAA CGCGCCGTTT

 251 TGCTGACCGC CTGCCACGAG CTTTCCGCTA TGCCCGAAAC GCCCTACCCC

 301 GTCATTATCA ACGAAGCCAT CGAAGTTACC AAAACCTTCG GCGGCACGGA

 351 CGGGCACAAA TTCGTCAACG GCATCCTCGA CAAACTCGCC GCCCAAATCC

 401 GCCCAGACGA GCCCAAACGC CGTTGA
```

This corresponds to the amino acid sequence <SEQ ID 2214; ORF 674.ng>:

```
g674.pep
    1 MKTARRRSRE LAVQAVYQSL INRTAAPEIA KNIREMSDFA KADEELFNKL

   51 FFGTQTNAAD YIQKIRPLLD RDEKDLNPIE RAVLLTACHE LSAMPETPYP

  101 VIINEAIEVT KTFGGTDGHK FVNGILDKLA AQIRPDEPKR R*
```

The following partial DNA sequence was identified in *N. meningitidis* <SEQ ID 2215>:

```
m674.seq
    1 ATGAAAACAG CCCGCCGCCG TTCCCGCGAG CTTGCCGTAC AAGCCGTTTA

   51 CCAATCCCTT ATCAACCGCA CCGCCGCGCC CGAAATTGCT AAAAACATCC

  101 GCGAAATGTC CGACTTTGCC AAGGCAGACG AAGAATTGTT CAACAAACTT

  151 TTCTTCGGCA CGCAAACCAA TGCGGCAGAG TATATCCGAC AAATCCGCCC

  201 GCTACTTGAC AGGGACGAAA AAGACCTCAA CCCCATCGAA CGCGCCGTTT

  251 TGCTGACCGC CTGCCACGAG CTGTCCGCCA TGCCCGAAAC GCCCTACCCC

  301 GTCATTATCA ACGAAGCCAT CGAAGTTACC AAAACCTTCG GCGGCACGGA

  351 CGGGCACAAA TTCGTCAACG GCATCCTCGA CAAACTCGCC GCCCAAATCC

  401 GCCCCGACGA GCCCAAACGC CGTTGA
```

This corresponds to the amino acid sequence <SEQ ID 2216; ORF 674>:

```
m674.pep
    1 MKTARRRSRE LAVQAVYQSL INRTAAPEIA KNIREMSDFA KADEELFNKL

   51 FFGTQTNAAE YIRQIRPLLD RDEKDLNPIE RAVLLTACHE LSAMPETPYP

  101 VIINEAIEVT KTFGGTDGHK FVNGILDKLA AQIRPDEPKR R*
```

Computer analysis of this amino acid sequence gave the following results:

Homology with a Predicted ORF from *N. gonorrhoeae*

```
m674/g674  97.9% identity in 141 aa overlap
                   10        20        30        40        50        60
m674.pep   MKTARRRSRELAVQAVYQSLINRTAAPEIAKNIREMSDFAKADEELFNKLFFGTQTNAAE
           |||||||||||||||||||||||||||||||||||||||||||||||||||||||||||:
g674       MKTARRRSRELAVQAVYQSLINRTAAPEIAKNIREMSDFAKADEELFNKLFFGTQTNAAD
                   10        20        30        40        50        60

                   70        80        90       100       110       120
m674.pep   YIRQIRPLLDRDEKDLNPIERAVLLTACHELSAMPETPYPVIINEAIEVTKTFGGTDGHK
           ||::||||||||||||||||||||||||||||||||||||||||||||||||||||||||
g674       YIQKIRPLLDRDEKDLNPIERAVLLTACHELSAMPETPYPVIINEAIEVTKTFGGTDGHK
                   70        80        90       100       110       120

                  130       140
m674.pep   FVNGILDKLAAQIRPDEPKRRX
           ||||||||||||||||||||||
g674       FVNGILDKLAAQIRPDEPKRRX
                  130       140
```

The following partial DNA sequence was identified in *N. meningitidis* <SEQ ID 2217>:

```
a674.seq
    1 ATGAAAACAG CCCGCCGCCG TTCCCGCGAG CTTGCCGTAC AAGCCGTTTA

   51 CCAATCCCTT ATCAACCGCA CCGCCGCGCC CGAGATTGCT AAAAACATCC

  101 GCGAAATGCC CGACTTTGCC AAGGCAGACG AAGAATTGTT CAACAAACTT
```

```
151 TTCTTCGGCA CGCAAACCAA TGCGGCAGAG TACATCCGAC AAATCCGCCC

201 CCTGCTCGAC CGCGACGAAA AAGACCTCAA CCCCATCGAA CGCGCCGTCC

251 TGCTGACCGC CTGCCACGAG CTGTCCGCCA TGCCCGAAAC GCCCTACCCC

301 GTCATCATCA ACGAAGCCAT CGAAGTAACC AAAACCTTCG GCGGCACGGA

351 CGGGCACAAA TTCGTCAACG GCATCCTCGA CAAACTCGCC GCCCAAATCC

401 GTCCCGACGA GCCCAAACGC CGTTGA
```

This corresponds to the amino acid sequence <SEQ ID 2218; ORF 674.a>:

```
a674.pep
      1  MKTARRRSRE LAVQAVYQSL INRTAAPEIA KNIREMPDFA KADEELFNKL

     51  FFGTQTNAAE YIRQIRPLLD RDEKDLNPIE RAVLLTACHE LSAMPETPYP

    101  VIINEAIEVT KTFGGTDGHK FVNGILDKLA AQIRPDEPKR R*

m674/a674  99.3% identity in 141 aa overlap
                   10        20        30        40        50        60
m674.pep   MKTARRRSRELAVQAVYQSLINRTAAPEIAKNIREMSDFAKADEELFNKLFFGTQTNAAE
           |||||||||||||||||||||||||||||||||||| |||||||||||||||||||||||
a674       MKTARRRSRELAVQAVYQSLINRTAAPEIAKNIREMPDFAKADEELFNKLFFGTQTNAAE
                   10        20        30        40        50        60

                   70        80        90       100       110       120
m674.pep   YIRQIRPLLDRDEKDLNPIERAVLLTACHELSAMPETPYPVIINEAIEVTKTFGGTDGHK
           ||||||||||||||||||||||||||||||||||||||||||||||||||||||||||||
a674       YIRQIRPLLDRDEKDLNPIERAVLLTACHELSAMPETPYPVIINEAIEVTKTFGGTDGHK
                   70        80        90       100       110       120

                  130       140
m674.pep   FVNGILDKLAAQIRPDEPKRRX
           ||||||||||||||||||||||
a674       FVNGILDKLAAQIRPDEPKRRX
                  130       140
```

The following partial DNA sequence was identified in *N. gonorrhoeae* <SEQ ID 2219>:

```
g675.seq
  1 ATGAACACCA TCGCCCCcaa cctcgacgGC AAACACCTCC GCATCGGCAT

 51 CGTACAGGCA CGCTTCACCA ACGAAATCGG CAGCCAAATG CTCAAAGTCT

101 GCTGCCGCAC CCTCCAAGAA TTGGGCGTAG CAGACGAAAa catcaccgtc

151 gCCACCGTAC CCGGCGCGCT TGAAATCCCC ATCGCGCTGA TGAACTTTGC

201 CTCTTCCGAA AAATTTGACG CACTGATTGC CATCGGCGTC GTCATCCGTG

251 GCGAAACCTA CCATTTCGAG CTGGTTGCCA ACGAATCCGG CGCAGGGATC

301 GGCCGCGTCG CACTCGACTA CAACATCCCG ATTGCCAACG CCGTCCTGAC

351 CACCGAAAAC GACGCGCAGG CAATTGAACG GATTGGAGAA AAAGCCTCGG

401 ATGCCGCCAA AGTCGCCGTA GAATGCGCCA ACCTCGTCAA CCTTCTGCTC

451 GAAGAACAGT TTGAAGACGA AGAATAA
```

This corresponds to the amino acid sequence <SEQ ID 2220; ORF 675.ng>:

```
g675.pep
  1 MNTIAPNLDG KHLRIGIVQA RFTNEIGSQM LKVCCRTLQE LGVADENITV

 51 ATVPGALEIP IALMNFASSE KFDALIAIGV VIRGETYHFE LVANESGAGI
```

```
101 GRVALDYNIP IANAVLTTEN DAQAIERIGE KASDAAKVAV ECANLVNLLL

151 EEQFEDEE*
```

The following partial DNA sequence was identified in *N. meningitidis* <SEQ ID 2221>:

```
m675.seq
   1 ATGAACACCA TCGCCCCCAA CCTCGACGGC AAACACCTCC GCATCGGCAT

  51 CGTACAGGCA CGCTTCACCA ACGAAATCGG CAGCGAAATG CTCAAAGTCT

 101 GCTGCCGCAC CCTCCAAGAA TTGGGCGTGG CAGACGAAAA CATTACCGTC

 151 GCCACCGTAC CCGGCGCGCT TGAAATCCCC ATCGCGCTGA TGAACTTTGC

 201 CTCTTCCGAA AAGTTTGACG CACTGATTGC CATCGGCGTC GTCATCCGTG

 251 GCGAAACCTA CCATTTCGAG CTGGTTTCCA ACGAATCCGG AGCAGGCGTC

 301 AGCCGCGTCG CACTCGACTA CAATATCCCG ATTGCCAATG CCGTCCTAAC

 351 CACCGAAAAC GACGCGCAGG CAATCGAACG GATTGAAGAA AAAGCCTCGG

 401 ATGCCGCCAA AGTCGCCGTC GAATGCGCCA ACCTCGTCAA CCTGCTGCTC

 451 GAAGAACAGT TTGAAGACGA AGAATAA
```

This corresponds to the amino acid sequence <SEQ ID 2222; ORF 675>:

```
m675.pep
   1 MNTIAPNLDG KHLRIGIVQA RFTNEIGSEM LKVCCRTLQE LGVADENITV

  51 ATVPGALEIP IALMNFASSE KFDALIAIGV VIRGETYHFE LVSNESGAGV

 101 SRVALDYNIP IANAVLTTEN DAQAIERIEE KASDAAKVAV ECANLVNLLL

 151 EEQFEDEE*
```

Computer analysis of this amino acid sequence gave the following results:
Homology with a Predicted ORF from *N. gonorrhoeae*

```
    m675/g675  96.8% identity in 158 aa overlap
                    10         20         30         40         50         60
       m675.pep  MNTIAPNLDGKHLRIGIVQARFTNEIGSEMLKVCCRTLQELGVADENITVATVPGALEIP
                 |||||||||||||||||||||||||||||:||||||||||||||||||||||||||||||
       g675      MNTIAPNLDGKHLRIGIVQARFTNEIGSQMLKVCCRTLQELGVADENITVATVPGALEIP
                    10         20         30         40         50         60

                    70         80         90        100        110        120
       m675.pep  IALMNFASSEKFDALIAIGVVIRGETYHFELVSNESGAGVSRVADKYNIPIANAVLTTEN
                 |||||||||||||||||||||||||||||||||:||||::||||||||||||||||||||
       g675      IALMNFASSEKFDALIAIGVVIRGETYHFELVANESGAGIGRVALDYNIPIANAVLTTEN
                    70         80         90        100        110        120

                   130        140        150    159
       m675.pep  DAQAIERIEEKASDAAKVAVECANLVNLLLEEQFEDEEX
                 ||||||||  ||||||||||||||||||||||||||||
       g675      DAQAIERIGEKASDAAKVAVECANLVNLLLEEQFEDEEX
                   130        140       150
```

The following partial DNA sequence was identified in *N. meningitidis* <SEQ ID 2223>:

```
a675.seq
   1 ATGAACACCA TCGCCCCCAA CCTCGACGGC AAACACCTCC GCATCGGCAT

  51 CGTACAGGCA CGCTTCACCA ACGAAATCGG CAGCGAAATG CTCAAAGTCT
```

-continued

```
101 GCTGCCGCAC CCTCCAAGAA TTGGGCGTGG CAGACGAAAA CATTACCGTC

151 GCCACCGTAC CCGGCGCGCT TGAAATCCCC ATCGCGCTGA TGAACTTTGC

201 CTCTTCTGAA AAATTTGACG CACTGATTGC CATCGGCGTC GTTATCCGTG

251 GCGAAACCTA CCATTTCGAG CTGGTTTCCA ACGAATCCGG AGCAGGGGTC

301 AGCCGCGTCG CACTCGACTA CAACATCCCG ATTGCCAATG CCGTCCTGAC

351 CACGGAAAAC GACGCACAGG CAATCGAACG GATTGAAGAA AAAGCCTCGG

401 ATGCCGCCAA AGTCGCCGTA GAATGCGCCA ACCTCGTCAA CCTCCTGCTC

451 GAAGAACAGT TTGAAGACGA AGAATAA
```

This corresponds to the amino acid sequence <SEQ ID 2224; ORF 675.a>:

```
a675.pep
      1  MNTIAPNLDQ KHLRIGIVQA RFTNEIGSEM LKVCCRTLQE LGVADENITV
     51  ATVPGALEIP IALMNFASSE KFDALIAIGV VIRGETYHFE LVSNESGAGV
    101  SRVALDYNIP IANAVLTTEN DAQAIERIEE KASDAAKVAV ECANLVNLLL
    151  EEQFEDDEE*

m675/a675  100.0% identity in 158 aa overlap
                   10        20        30        40        50        60
m675.pep   MNTIAPNLDGKHLRIGIVQARFTNEIGSEMLKVCCRTLQELGVADENITVATVPGALEIP
           ||||||||||||||||||||||||||||||||||||||||||||||||||||||||||||
a675       MNTIAPNLDGKHLRIGIVQARFTNEIGSEMLKVCCRTLQELGVADENITVATVPGALEIP
                   10        20        30        40        50        60

                   70        80        90       100       110       120
m675.pep   IALMNFASSEKFDALIAIGVVIRGETYHFELVSNESGAGVSRVALDYNIPIANAVLTTEN
           ||||||||||||||||||||||||||||||||||||||||||||||||||||||||||||
a675       IALMNFASSEKFDALIAIGVVIRGETYHFELVSNESGAGVSRVALDYNIPIANAVLTTEN
                   70        80        90       100       110       120

                  130       140       150      159
m675.pep   DAQAIERIEEKASDAAKVAVECANLVNLLLEEQFEDEEX
           |||||||||||||||||||||||||||||||||||||||
a675       DAQAIERIEEKASDAAKVAVECANLVNLLLEEQFEDEEX
                  130       140       150
```

The following partial DNA sequence was identified in *N. gonorrhoeae* <SEQ ID 2225>:

```
g677.seq
  1 ATGCCGCAGA TTTTGGTGCG GATTTTCCTC ATTCGGTATT CCTTTATTtg

 51 ggAAACGGTG CGCTTGTGCC GTTTCAGACG GCATTCCCGA TCAGTCGATT

101 TTGATGTATT CGACAGAAAG GATTTCAATT TCCTCACGGC CTTCCGGCGT

151 GTTCAAAACC ACTTCGTCGC CTTCGCGCGC TTTAATCAGG CAACGCGCCA

201 ACGGCGAAAT CCAAGAAATT TTGTTTTGCG CGGTATCGAT TTCATCGACG

251 CCGACGATTT TGACGGTTTG CTCGCGCCCG TCGCCGCGCA ACAGACCGAC

301 GGTCGCGCCG AAAAATACTT GGTCGGTCGC TTCGCGCAAT TCGGGATCGA

351 CGACGACGGC AGCCTCCAAA CGTTTGGTCA GGAAACGGAT GCGGCGGTCG

401 ATTTCGCGCA TACGGCGTTT GCCGTAAAGA TAGTCGCCGT TTTCGCTGCG

451 GTCGCCGTTG CCTGCCGCCC AGTTGACGAT TTGGACGATT TCGGGGCGTT

501 CTTTATTGAC CAGTTGATAA AGCTCGTCTT TCAATGCCTG CCATCCGGCG

551 GGCGTAATGT AGTTTTTGGT TTCGGTACTC ATATTGTGTG CGGATGA
```

This corresponds to the amino acid sequence <SEQ ID 2226; ORF 677.ng>:

```
g677.pep
   1 MPQILVRIFL IRYSFIWETV RLCRFRRHSR SVDFDVFDRK DFNFLTAFRR

  51 VQNHFVAFAR FNQATRQRRN PRNFVLRGID FIDADDFDGL LAPVAAQQTD

 101 GRAEKYLVGR FAQFGIDDDG SLQTFGQETD AAVDFAHTAF AVKIVAVFAA

 151 VAVACRPVDD LDDFGAFFID QLIKLVFQCL PSGGRNVVFG FGTHIVCG*
```

The following partial DNA sequence was identified in *N. meningitidis* <SEQ ID 2227>:

```
m677.seq
   1 ATGCCGCAGA TTTTGGTGCG GATTTTCCTC ATTCGGTATT CCTTTATTTG

  51 GGAAACGGCG CGCTTTTGCC GTTTCAGACG GCATTCCCGA TCAGTCGATT

 101 TTGATGTATT CGACAGAAAG GATTTCAATT TCCTCACGCC CTTCCGGCGT

 151 GTTCAAAACC ACTTCGTCGC CTTCGCGCGC TTTAATCAGA CAACGAGCCA

 201 GCGGCGAAAT CCAAGAAATT TTGTTTTGCG CGGTATCGAT TTCATCGATG

 251 CCGACGATTT TGACGGTTTG CTCGCGCCCG TCGTCGCGCA ACAGTCCGAC

 301 CGTCGCGCCG AAAAACACTT GGTCGGTCGC TTCGCGCAAT TCGGGATCGA

 351 CGACGACGGC AGCCTCCAAA CGTTTGGTCA GGAAACGGAT GCGGCGGTCG

 401 ATTTCGCGCA TACGGCGTTT GCCGTAAAGA TAGTCGCCGT TTTCGCTGCG

 451 GTCGCCGTTG CCTGCCGCCC AGTTGACGAT TTGGACGATT TCGGGGCGTT

 501 CTTTGTTGAC CAGTTGATAA AGCTCGTCTT TCAATGCCTG CCATCCGGCG

 551 GGCGTAATGT AGTTTTTGGT TTCGGTACTC ATATTGTGTG CGGATGA
```

This corresponds to the amino acid sequence <SEQ ID 2228; ORF 677>:

```
m677.pep
   1 MPQILVRIFL IRYSFIWETA RFCRFRRHSR SVDFDVFDRK DFNFLTPFRR

  51 VQNHFVAFAR FNQTTSQRRN PRNFVLRGID FIDADDFDGL LAPVVAQQSD

 101 RRAEKHLVGR FAQFGIDDDG SLQTFGQETD AAVDFAHTAF AVKIVAVFAA

 151 VAVACRPVDD LDDFGAFFVD QLIKLVFQCL PSGGRNVVFG FGTHIVCG*
```

Computer analysis of this amino acid sequence gave the following results:

Homology with a Predicted ORF from *N. gonorrhoeae*

```
m677/g677  94.9% identity in 198 aa overlap
                   10        20        30        40        50        60
m677.pep   MPQILVRIFLIRYSFIWETARFCRFRRHSRSVDFDVFDRKDFNFLTPFRRVQNHFVAFAR
           |||||||||||||||||||:|:||||||||||||||||||||||||| ||||||||||||
g677       MPQILVRIFLIRYSFIWETVRLCRFRRHSRSVDFDVFDRKDFNFLTAFRRVQNHFVAFAR
                   10        20        30        40        50        60

                   70        80        90       100       110       120
m677.pep   FNQTTSQRRNPRNFVLRGIDFIDADDFDGLLAPVVAQQSDRRAEKHLVGRFAQFGIDDDG
           |||:| ||||||||||||||||||||||||||||:|||:| ||||:||||||||||||||
g677       FNQATRQRRNPRNFVLRGIDFIDADDFDGLLAPVAAQQTDGRAEKYLVGRFAQFGIDDDG
                   70        80        90       100       110       120

                  130       140       150       160       170       180
m677.pep   SLQTFGQETDAAVDFAHTAFAVKIVAVFAAVAVACRPVDDLDDFGAFFVDQLIKLVFQCL
           ||||||||||||||||||||||||||||||||||||||||||||||||:|||||||||||
g677       SLQTFGQETDAAVDFAHTAFAVKIVAVFAAVAVACRPVDDLDDFGAFFIDQLIKLVFQCL
                  130       140       150       160       170       180
```

-continued

```
                190       199
m677.pep   PSGGRNVVFGFGTHIVCGX
           ||||||||||||||||||
g677       PSGGRNVVFGFGTHIVCGX
                190
```

The following partial DNA sequence was identified in *N. meningitidis* <SEQ ID 2229>:

```
a677.seq
   1 ATGCCGCAGA TTTTGGTGCG GATTTTCCTC ATTCGGTATT CCTTTATTTG

  51 GGAAACGGCG CGTTTGTGCC GTTTCAGACG GCATTCCCGA TCAGTCGATT

 101 TTGATGTATT CGACAGAAAG GATTTCAATT TCCTCACGCC CTTCCGGCGT

 151 GTTTAAAACC ACTTCGTCGC CTTCACGCGC TTTAATCAGA CAACGAGCCA

 201 GCGGCGAAAT CCAAGAAATT TTGTTTTGCG CGGTATCGAT TTCATCGATG

 251 CCGACGATTT TGACGGTTTG CTCGCGCCCG TCGCCGCGCA ACAGACCGAC

 301 GGTCGCGCCG AAAAACACTT GGTCGGTCGC TTCGCGCAAT TCGGGATCAA

 351 CGACGACGGC GGCTTCCAAA CGCTTGGTCA GGAAACGGAT GCGGCGGTCG

 401 ATTTCGCGCA TACGGCGTTT GCCGTAAAGG TAGTCGCCGT TTTCGCTGCG

 451 GTCGCCGTTG CCTGCCGCCC AGTTGACGAT TTGGACGATT TCGGGGCGTT

 501 CTTTATTAAC CAGTTGATAA AGCTCGTCTT TCAATGCCTG CCATCCGGCG

 551 GGCGTAATGT AGTTTTTGGT TTCGGTACTC ATATTGTGTG CGGATGA
```

This corresponds to the amino acid sequence <SEQ ID 2230; ORF 677.a>:

```
a677.pep

      1 MPQILVRIFL IRYSFIWETA RLCRFRRHSR SVDFDVFDRK DFNFLTPFRR

     51 V*NHFVAFTR FNQTTSQRRN PRNFVLRGID FIDADDFDGL LAPVAAQQTD

    101 GRAEKHLVGR FAQFGINDDG GFQTLGQETD AAVDFAHTAF AVKVVAVFAA

    151 VAVACRPVDD LDDFGAFFIN QLIKLVFQCL PSGGRNVVFG FGTHIVCG*
```

```
 m677/a677 93.4% identity in 198 aa overlap

                    10        20        30        40        50        60
m677.pep   MPQILVRIFLIRYSFIWETARFCRFRRHSRSVDFDVFDRKDFNFLTPFRRVQNHFVAFAR
           |||||||||||||||||||||:||||||||||||||||||||||||||||| ||||||:|
a677       MPQILVRIFLIRYSFIWETARLCRFRRHSRSVDFDVFDRKDFNFLTPFRRVXNHFVAFTR
                    10        20        30        40        50        60

                    70        80        90       100       110       120
m677.pep   FNQTTSQRRNPRNFVLRGIDFIDADDFDGLLAPVVAQQSDRRAEKHLVGRFAQFGIDDDG
           ||||||||||||||||||||||||||||||||||:|||:| |||||||||||||||:|||
a677       FNQTTSQRRNPRNFVLRGIDFIDADDFDGLLAPVAAQQTDGRAEKHLVGRFAQFGINDDG
                    70        80        90       100       110       120

                   130       140       150       160       170       180
m677.pep   SLQTFGQETDAAVDFAHTAFAVKIVAVFAAVAVACRPVDDLDDFGAFFVDQLIKLVFQCL
           ::||:|||||||||||||||||||:|||||||||||||||||||||||||::||||||||||
a677       GFQTLGQETDAAVDFAHTAFAVKVVAVFAAVAVACRPVDDLDDFGAFFINQLIKLVFQCL
                   130       140       150       160       170       180

                   190       199
m677.pep   PSGGRNVVFGFGTHIVCGX
           ||||||||||||||||||
a677       PSGGRNVVFGFGTHIVCGX
                   190
```

The following partial DNA sequence was identified in *N. gonorrhoeae* <SEQ ID 2231>:

```
g678.seq
    1 ATGAATAGCC TCCCCATTGC CGACCTCCTC GCCTccgCCG TCATCGCCGC

   51 CTGCATCGTC ATTTCCACGA TGCGCGGCGT GATTGCGGAA GCAggttcGA

  101 TGGTgGCATG ggtggTTTcc tTCTTTTttg ccAAACTCTt tGCCGCACcc

  151 ttcgccgACC TCGCCTTTGc ctCGTTCCAA ccccgccTGT TTGCAttggc

  201 tCTGTCATTC ATTTCCCTGT TCGTCATTGC CTGTCTGATC CAGAAAATGC

  251 TCCGTTCGCT GCTGACCGGC GCAGTTTCGG CGGTCGGTCT GGGCTTTGCC

  301 AACCGCATTT TGGGCGGTGT ATTCGGTGCA TTGAAAGGCG TTTTGATTGT

  351 TACCCTGCTG ATCATGCTTG CTTCAAAAAC CGACCTGCCC GATACCGAAG

  401 AATGGCAACA GTCCTATACC GTACCGTTTT TCGTATCGCT TTCCGAAGCG

  451 GTGTTAAACC atacggaCAA CGCacccgaa tCCCtcgacg acgactaa
```

This corresponds to the amino acid sequence <SEQ ID 2232; ORF 678.ng>:

```
g678.pep
    1 MNSLPIADLL ASAVIAACIV ISTMRGVIAE AGSMVAWVVS FFFAKLFAAP

   51 FADLAFASFQ PRLFALALSF ISLFVIACLI QKMLRSLLTG AVSAVGLGFA

  101 NRILGGVFGA LKGVLIVTLL IMLASKTDLP DTEEWQQSYT VPFFVSLSEA

  151 VLNHTDNAPE SLDDD*
```

The following partial DNA sequence was identified in *N. meningitidis* <SEQ ID 2233>:

```
m678.seq
    1 ATGAATAGCC TCCCCATTGC CGACCTCCTC GTCTCCGCCG TCATCGCCGC

   51 CTGCATCGTG CTATCCGCGA TGCGCGGCGT GATTGCGGAG GCAGGCTCAA

  101 TGGCGGCATG GGTGGTTTCC TTCTTTTTCG CCAAACTCTT TGCCGCCTCC

  151 TTCGCCGACC TCGCCTTTGC CTCGTTCCAA CCCCGCCTGT TTGCATTGGC

  201 TCTGTCGTTC ATTTCCCTGT TCGTCATTGC CTGTCTGATC CAGAAAATGC

  251 TCCGTTCGCT GCTGACCAGC GCAGTTTCGG CGGTCGGTTT GGGCTTTGCC

  301 AACCGCATTT TGGGCGGCGT ATTCGGTGCA TTGAAAGGCG TTTTGATTGT

  351 TACCCTGCTG GTCATGCTTG CTTCAAAAAC CGACCTGCCC GATACCGAAG

  401 AATGGCGGCA ATCTTACACA CTGCCGTTTT TCGTATCGCT TTCCGAAGCC

  451 GTGTTGAACC ATAGCGGCGG CACGGCGGAA ACTCCGGAAG ACGATTGA
```

This corresponds to the amino acid sequence <SEQ ID 2234; ORF 678>:

```
m678.pep
    1 MNSLPIADLL VSAVIAACIV LSAMRGVIAE AGSMAAWVVS FFFAKLFAAS

   51 FADLAFASFQ PRLFALALSF ISLFVIACLI QKMLRSLLTS AVSAVGLGFA

  101 NRILGGVFGA LKGVLIVTLL VMLASKTDLP DTEEWRQSYT LPFFVSLSEA

  151 VLNHSGGTAE TPEDD*
```

Computer analysis of this amino acid sequence gave the following results:

Homology with a Predicted ORF from *N. gonorrhoeae*

```
m678/g678  89.7% identity in 165 aa overlap

                   10        20        30        40        50        60
m678.pep   MNSLPIADLLVSAVIAACIVLSAMRGVIAEAGSMAAWVVSFFFAKLFAASFADLAFASFQ
           ||||||||||:|||||||||:|:|||||||||||:||||||||||||||| |||||||||
g678       MNSLPIADLLASAVIAACIVISTMRGVIAEAGSMVAWVVSFFFAKLFAAPFADLAFASFQ
                   10        20        30        40        50        60
                   70        80        90       100       110       120
m678.pep   PRLFALALSFISLFVIACLIQKMLRSLLTSAVSAVGLGFANRILGGVFGALKGVLIVTLL
           |||||||||||||||||||||||||||||:||||||||||||||||||||||||||||||
g678       PRLFALALSFISLFVIACLIQKMLRSLLTGAVSAVGLGFANRILGGVFGALKGVLIVTLL
                   70        80        90       100       110       120
                  130       140       150       160
m678.pep   VMLASKTDLPDTEEWRQSYTLPFFVSLSEAVLNHSGGTAETPEDDX
           :||||||||||||||:||||:|||||||||||||: :: |: :|||
g678       IMLASKTDLPDTEEWQQSYTVPFFVSLSEAVLNHTDNAPESLDDDX
                  130       140       150       160
```

The following partial DNA sequence was identified in *N. meningitidis* <SEQ ID 2235>:

```
a678.seq
   1 ATGAATAACC TCCCCGTTGC CGACCTCCTC GTCTCCGCCA TCATCGCCGC

  51 CTGCATCGTG CTATCCGCGA TGCGCGGCGT GATTGCGGAG GCTGGCTCAA

 101 TGGCGGCATG GGTGGTTGCC TTTTTTTTCG CCAAACTCTT TGCCGCACCC

 151 TTCGCCGACA TCGCCTTTGC ATCGTTCCAA CCCCGCCTGT TTGCATTGGC

 201 TCTGTCGTTC ATTTCCCTAT TCGTCATTGC CTGTCTGATC CAGAAAATAC

 251 TCCGCTCGCT GCTGACCGGG GCAGTTTCGG CGGTCGGTTT GGGCTTTGCC

 301 AACCGCATTT TGGGCGGCGT ATTCGGTGCA TTGAAAGGCA TTTTGATTAT

 351 TACCCTGCTG GTCATGCTCG CTTCAAAAAC CGACCTGCCC GATACCGAAG

 401 AATGGCGGCA ATCTTACACA CTGCCGTTTT TCGTATCGCT TTCCGAAGCC

 451 GTGTTGAACC ATAGCGGCGG CACGGCGGAA ACTCCGGAAG ACGATTGA
```

This corresponds to the amino acid sequence <SEQ ID 2236; ORF 678.a>:

```
a678.pep

      1 MNNLPVADLL VSAIIAACIV LSAMRGVIAE AGSMAAWVVA FFFAKLFAAP

     51 FADIAFASFQ PRLFALALSF ISLFVIACLI QKILRSLLTG AVSAVGLGFA

    101 NRILGGVFGA LKGILIITLL VMLASKTDLP DTEEWRQSYT LPFFVSLSEA

    151 VLNHSGGTAE TPEDD*
```

```
m678/a678 93.9% identity in 165 aa overlap

                  10        20        30        40        50        60
m678.pep  MNSLPIADLLVSAVIAACIVLSAMRGVIAEAGSMAAWVVSFFFAKLFAASFADLAFASFQ
          ||:||:|||||||:|||||||||||||||||||||||||:|||||||||| |||:|||||
a678      MNNLPVADLLVSAIIAACIVLSAMRGVIAEAGSMAAWVVAFFFAKLFAAPFADIAFASFQ
                  10        20        30        40        50        60
                  70        80        90       100       110       120
m678.pep  PRLFALALSFISLFVIACLIQKMLRSLLTSAVSAVGLGFANRILGGVFGALKGVLIVTLL
          ||||||||||||||||||||||:||||||:|||||||||| ||||||||||||:||:|||
a678      PRLFALALSFISLFVIACLIQKILRSLLTGAVSAVGLGFANRILGGVFGALKGILIITLL
                  70        80        90       100       110       120
                 130       140       150       160
m678.pep  VMLASKTDLPDTEEWRQSYTLPFFVSLSEAVLNHSGGTAETPEDDX
          ||||||||||||||||||||||||||||||||||||||||||||||
a678      VMLASKTDLPDTEEWRQSYTLPFFVSLSEAVLNHSGGTAETPEDDX
                 130       140       150       160
```

The following partial DNA sequence was identified in *N. gonorrhoeae* <SEQ ID 2237>:

```
g680.seq
   1 ATGACGAAGG GCAGTTCGGC GATGTCCAGC CCACGCGCGG CGATATCGGT
  51 GGCGACGAGG ACGCGCAGGC TGCCGTCTTT GAAGGCGTTG AGTGTTTCGA
 101 GCCTGCTTTG TTGGGAACGG TCGCCGTGTA TCGCCTGTGC GGACAGGTTG
 151 CGGCGCACCA GTTCGCGCGT TACGCGGTCG ACGCTTTGTT TGGTtttgCA
 201 AAAGACGATA ACTTGGTTCA TATGCAGATC GACAATCAGC CGTTCGAGCA
 251 GGTTGCGCTT TTGGAAGGTA TCGACGGCGA TGATGTgttg ttcGACGTTG
 301 GCGTTGGTGG TGTTTTGGGC GGCAACCTCG ACGGTTTCGG GCGCGTTCAT
 351 GAAGTCTTGC GCCAGTTTGC GTATCGGTGC GGAGAAGGTG GCGGAAAAGA
 401 GCAGGGTTTG GCGTTGGCGG GGCAGCATCT GCATGATTTT GCGGATGTCG
 451 TCGATAAACC CCATATCCAA CATGCGGTCT GCTTCGTCCA GAACGACGAT
 501 TTCGGCTTTG TTTAAACTGA TGTTTTTCTG TTTCACATGG TCGAGCAGCC
 551 GTCCGACGGT GGCGACGACT ATTTCGCAGC CGGCACGCAG GTCGGCGGTT
 601 TGTTTGTCCA TGTTGACACC GCCGAAGAGG ACGGTATGCC GCAGCGGCAG
 651 GTTTTTAATg tag
```

This corresponds to the amino acid sequence <SEQ ID 2238; ORF 680.ng>:

```
g680.pep
   1 MTKGSSAMSS PRAAISVATR TRRLPSLKAL SVSSLLCWER SPCIACADRL
  51 RRTSSRVTRS TLCLVLQKTI TWFICRSTIS RSSRLRFWKV STAMMCCSTL
 101 ALVVFWAATS TVSGAFMKSC ASLRIGAEKV AEKSRVWRWR GSICMILRMS
 151 SINPISNMRS ASSRTTISAL FKLMFFCFTW SSSRPTVATT ISQPARRSAV
 201 CLSMLTPPKR TVCRSGRFLM *
```

The following partial DNA sequence was identified in *N. meningitidis* <SEQ ID 2239>:

```
m680.seq
   1 ATGACGAAGG GCAGTTCGGC AATGTCCAGC CCGCGCGCGG CGATGTCGGT
  51 GGCGACGAGG ACGCGCAGGT TGCCGTCTTT GAAGGCGTTG AGTGTTTCGA
 101 GCCGGCTTTG TTGGGAACGG TCGCCGTGTA TCGCCTGTGC GGACAGGTTG
 151 CGGCGCACCA GTTCGCGCGT TACGCGGTCG ACGCTTTGTT TGGTTTTGCA
 201 GAACACGATG ACCTGGTTCA TATGCAAATC GACAATCAGC CGTTCGAGCA
 251 GGTTGCGCTT CTGAATGGTA TCGACGGCGA TGATGTGCTG CTCGACGTTG
 301 GCGTTGGTGG TGTTTTGCGC GGCGACTTCG ACGGTTTCGG GCGCGTTCAT
 351 GAAGTCTTGC GCCAGTTTGC GTATCGGGGC GGAGAAGGTG GCGGAAAAGA
 401 GCAGGGTTTG GCGTTGGCGG GGCAGCATCT GCATGATTTT GCGGATGTCG
 451 TCGATAAAAC CCATATCCAG CATACGGTCG GCTTCGTCCA AAACGACGAT
 501 TTCGACTTTG TTCAAATGGA TGTTTTTCTG TTTCACGTGG TCGAGCAGCC
 551 GTCCGACGGT GGCGACGACG ATTTCGCAGC CGGCACGCAG GTCGGCGGTC
 601 TGTTTGTCCA TATTCATACC GCCGAACAAG ACGGTGTGGC GCAGCGGCAG
```

-continued

```
651 GTTTTTGATG TAG
```

This corresponds to the amino acid sequence <SEQ ID 2240; ORF 680>:

```
m680.pep
   1 MTKGSSAMSS PRAAMSVATR TRRLPSLKAL SVSSRLCWER SPCIACADRL

  51 RRTSSRVTRS TLCLVLQNTM TWFICKSTIS RSSRLRF*MV STAMMCCSTL

 101 ALVVFCAATS TVSGAFMKSC ASLRIGAEKV AEKSRVWRWR GSICMILRMS

 151 SIKPISSIRS ASSKTTISTL FKWMFFCFTW SSSRPTVATT ISQPARRSAV

 201 CLSIFIPPNK TVWRSGRFLM *
```

Computer analysis of this amino acid sequence gave the following results:

Homology with a Predicted ORF from *N. gonorrhoeae*

```
m680/g680 90.9% identity in 220 aa overlap

                   10        20        30        40        50        60
m680.pep   MTKGSSAMSSPRAAMSVATRIRRLPSLKALSVSSRLCWERSPCIACADRLRRTSSRVTRS
           |||||||||||||:|||||||||||||||||||| |||||||||||||||||||||||||
g680       MTKGSSAMSSPRAAISVATRIRRLPSLKALSVSSLLCWERSPCIACADRLRRTSSRVTRS
                   10        20        30        40        50        60

                   70        80        90       100       110       120
m680.pep   TLCLVLQNTMTWFICKSTISRSSRLRFXMVSTAMMCCSTLALVVFCAATSTVSGAFMKSC
           |||||||:|:|||||:|||||||||||  ||||||||||||||| ||||||||||||||
g680       TLCLVLQKTITWFICRSTISRSSRLRFWKVSTAMMCCSTLALVVFWAATSTVSGAFMKSC
                   70        80        90       100       110       120

                  130       140       150       160       170       180
m680.pep   ASLRIGAEKVAEKSRVWRWRGSICMILRMSSIKPISSIRSASSKTTISTLFKWMFFCFTW
           ||||||||||||||||||||||||||||||||:|||::|||||:||||:||| |||||||
g680       ASLRIGAEKVAEKSRVWRWRGSICMILRMSSINPISNMRSASSRTTISALFKLMFFCFTW
                  130       140       150       160       170       180

                  190       200       210       220
m680.pep   SSSRPTVATTISQPARRSAVCLSIFIPPNKTVWRSGRFLMX
           ||||||||||||||||||||||::  ||::|| |||||||
g680       SSSRPTVATTISQPARRSAVCLSMLTPPKRTVCRSGRFLMX
                  190       200       210       220
```

The following partial DNA sequence was identified in *N. meningitidis* <SEQ ID 2241>:

```
a680.seq
   1 ATGACGAAGG GCAGTTCGGC AATATCCAGC CCCCGCGCGG CGATATCGGT

  51 GGCGACGAGG ACGCGCAGGT TGCCGTCTTT GAAGGCGTTG AGTGTTTCGA

 101 GCCGGCTTTG TTGGGAACGG TCGCCGTGTA TCGCCTGTGC GGACAGGTTG

 151 CGGCGCACCA GTTCGCGCGT TACGCGGTCG ACGCTTTGTT TGGTTTTGCA

 201 GAACACGATG ACCTGGTTCA TATGCAAATC GACAATCAGC CGTTCGAGCA

 251 GGTTGCGCTT CTGAATGGTA TCGACGGCGA TGATGTGCTG CTCGACGTTG

 301 GCGTTGGTGG TGTCTTGCGC GGCGACTTCG ACGGTTTCGG GCGCGTTCAT

 351 GAAGTCTTGC GCCAGTTTGC GTATCGGGGC GGAGAAGGTG GCGGAAAAGA

 401 GCAGGGTTTG GCGTTGGCGG GGCAGCATCT GCATGATTTT GCGGATGTCG

 451 TCGATAAAAC CCATATCCAG CATACGGTCG GCTTCGTCCA AAACGACGAT

 501 TTCGACTTTG TTCAAATGGA TGTTTTTCTG TTTCACGTGG TCGAGCAGCC

 551 GTCCGACGGT GGCGACGACG ATTTCGCAGC CGGCACGCAG GTCGGCGGTC
```

-continued

```
601 TGTTTGTCCA TATTCATACC GCCGAACAAG ACGGTGTGGC GCAGCGGCAG

651 GTTTTTGATG TAG
```

This corresponds to the amino acid sequence <SEQ ID 2242; ORF 680.a>:

```
a680.pep
      1 MTKGSSAISS PRAAISVATR TRRLPSLKAL SVSSRLCWER SPCIACADRL

     51 RRTSSRVTRS TLCLVLQNTM TWFICKSTIS RSSRLRF*MV STAMMCCSTL

    101 ALVVSCAATS TVSGAFMKSC ASLRIGAEKV AEKSRVWRWR GSICMILRMS

    151 SIKPISSIRS ASSKTTISTL FKWMFFCFTW SSSRPTVATT ISQPARRSAV

    201 CLSIFIPPNK TVWRSGRFLM *
```

```
m680/a680 98.6% identity in 220 aa overlap

                  10        20        30        40        50        60
m680.pep MTKGSSAMSSPRAAMSVATRTRRLPSLKALSVSSRLCWERSPCIACADRLRRTSSRVTRS
         |||||||:||||||:|||||||||||||||||||||||||||||||||||||||||||||
a672     MTKGSSAISSPRAAISVATRTRRLPSLKALSVSSRLCWERSPCIACADRLRRTSSRVTRS
                  10        20        30        40        50        60

                  70        80        90       100       110       120
m680.pep TLCLVLQNTMTWFICKSTISRSSRLRFXMVSTAMMCCSTLALVVFCAATSTVSGAFMKSC
         |||||||||||||||||||||||||||||||||||||||||||||| |||||||||||||
a680     TLCLVLQNTMTWFICKSTISRSSRLRFXMVSTAMMCCSTLALVVSCAATSTVSGAFMKSC
                  70        80        90       100       110       120

                 130       140       150       160       170       180
m680.pep ASLRIGAEKVAEKSRVWRWRGSICMILRMSSIKPISSIRSASSKTTISTLFKWMFFCFTW
         ||||||||||||||||||||||||||||||||||||||||||||||||||||||||||||
a680     ASLRIGAEKVAEKSRVWRWRGSICMILRMSSIKPISSIRSASSKTTISTLFKWMFFCFTW
                 130       140       150       160       170       180

                 190       200       210       220
m680.pep SSSRPTVATTISQPARRSAVCLSIFIPPNKTVWRSGRFLMX
         ||||||||||||||||||||||||||||||||||||||||
a680     SSSRPTVATTISQPARRSAVCLSIFIPPNKTVWRSGRFLMX
                 190       200       210       220
```

The following partial DNA sequence was identified in *N. gonorrhoeae* <SEQ ID 2243>:

```
g681.seq
  1 ATGACGACGC CGATGGCAAT CAGTGCGTCA AATTTTTCGG AAGAGGCAAA

 51 GTTCATCAGC GCGATGGGGA TTTCAAGCGC GCCGGGTACG GTGGcgacgg

101 tgatgtTTTC GTCTGCTACG CCCAATTCTT GGAGGGTGCG GCAGCAGACT

151 TTGAGCATTT GGCTGCCGAT TTCGTTGGTG AAGCGTGCCT GTACGATGCC

201 GATGCGGAGG TGTTTGCcgt cgaggttgGG GGCGATGGTG TTCATTGGGT

251 GTCCTTTGGT ATTCGGGGTT TCGGAATGCC GTCTGAAGGT TTCAGTCTTG

301 CGGCTGCCAG TCGGCAACGG TTTGGAATGT GCCGTCTTCG GCAAGCTCCC

351 ACGCGCTGCC TTCGGGTTGG GAAAGCAGTG CGGCGGTTTC AGGGTTGGTT

401 TTGGTGATGT CGGCGAGGCT GACGATGCTG AAGTTGTCGG GGTCGTCGGT

451 GTATTCGTCG GTTTCGTCGC CGCTGAAGAA ACGCCAGCCG CTGTCGTTTT

501 CAAAAACGGG GGCTTCGCGG TAAAGGAAGC CGACGGGCCG GTTTTGTTTG

551 GCGACGGTGT TGGTGGCGAT GCAGCGGTCG AGTGCCGAGG AAAGTGCTTG

601 TGCAAATGCG TTCATTGCGG GAATACGTTG GGGGGGGGGA AACTTGCGGA

651 TTTTACCACG ATTCCCGCGT TGTCGGCAGA CGGCGGCGGT TTGGTGGTAC
```

-continued

```
701 AATGTGCGCC GTTTGCAGCC TTAAGGTGTT TCTGTATTTT TGGAGTATGG

751 AAACGCATTC GGGCTGTTTT TTGCGGAAGA CGGTAA
```

This corresponds to the amino acid sequence <SEQ ID 2244; ORF 681>:

```
g681.pep
  1 MTTPMAISAS NFSEEAKFIS AMGISSAPGT VATVMFSSAT PNSWRVRQQT

 51 LSIWLPISLV KRACTMPMRR CLPSRLGAMV FIGCPLVFGV SECRLKVSVL

101 RLPVGNGLEC AVFGKLPRAA FGLGKQCGGF RVGFGDVGEA DDAEVVGVVG

151 VFVGFVAAEE TPAAVVFKNG GFAVKEADGP VLFGDGVGGD AAVECRGKCL

201 CKCVHCGNTL GGGKLADFTT IPALSADGGG LVVQCAPFAA LRCFCIFGVW

251 KRIRAVFCGR R*
```

The following partial DNA sequence was identified in *N. meningitidis* <SEQ ID 2245>:

```
m681.seq
  1 ATGACGACGC CGATGGCAAT CAGTGCGTCA AACTTTTCGG AAGAGGCAAA

 51 GTTCATCAGC GCGATGGGGA TTTCAAGCGC GCCGGGTACG GTGGCGACGG

101 TAATGTTTTC GTCTGCCACG CCCAATTCTT GGAGGGTGCG GCAGCAGACT

151 TTGAGCATTT CGCTGCCGAT TTCGTTGGTG AAGCGTGCCT GTACGATGCC

201 GATGCGGAGG TGTTTGCCGT CGAGGTTGGG GGCGATGGTG TTCATTGGGT

251 GTCCTTTGGT ATTCGGAGTT TCGGAATGCC GTCTGAAGGT TTCAGTCTTG

301 CGGCTGCCAG TCGGCGACGG TTTGGAATGT GCCGTCTTCG GCAAGCTCCC

351 ATGCGCTGCC TTCGGGTTGG GAGAGCAGTG CGGCGGTTTC AGGGTTGGTT

401 TTGGCGATGT CGGCGAGGCT GACGATGCTG AAGTTGTCCG GATCGTCGGT

451 GTATTCGTCG GTCTCGTCGC CGCTGAAGAA ACGCCAGCCG CTGTCGTTTT

501 CAAAAACGGG GGCTTCGCGG TAGAGGAAGC CGACGGGCCG GTTTTGTTTG

551 GCGACGGTGT TGGTGGCGAT ACAGCGGTCG AGTGCCGAGG AAAGTGCTTG

601 TGCAAATGCG TTCATTACGG GAATACGTTG GGGG.AAAAC TTACGGATTT

651 TACCACGATT CGTGCGTTGT CGGCAGACGG CGGCGGTTTG GTGGTACAAT

701 GTGCGCCGTT TGCAGCCTTA AGGTGTTTCT GTATTTTTGG AGTATGGAAA

751 CGCATTCGGG CTGTTTTTTG CGGAAGACGG TAA
```

This corresponds to the amino acid sequence <SEQ ID 2246; ORF 681>:

```
m681.pep
  1 MTTPMAISAS NFSEEAKFIS AMGISSAPGT VATVMFSSAT PNSWRVRQQT

 51 LSISLPISLV KRACTMPMRR CLPSRLGAMV FIGCPLVFGV SECRLKVSVL

101 RLPVGDGLEC AVFGKLPCAA FGLGEQCGGF RVGFGDVGEA DDAEVVRIVG

151 VFVGLVAAEE TPAAVVFKNG GFAVEEADGP VLFGDGVGGD TAVECRGKCL

201 CKCVHYGNTL GXKLTDFTTI RALSADGGGL VVQCAPFAAL RCFCIFGVWK

251 RIRAVFCGRR *
```

Computer analysis of the amino acid sequences gave the following results:

Homology with a Predicted ORF from *N. meningitidis* menA with menB ORF 681 shows 94.6% identity over a 261 aa overlap with a predicted ORF (ORF681.a) from *N. gonorrhoeae*:

```
m681/g681

                     10        20        30        40        50        60
m681.pep    MTTPMAISASNFSEEAKFISAMGISSAPGTVATVMFSSATPNSWRVRQQTLSISLPISLV
            |||||||||||||||||||||||||||||||||||||||||||||||||||| |||||||
g681        MTTPMAISASNFSEEAKFISAMGISSAPGTVATVMFSSATPNSWRVRQQTLWISLPISLV
                     10        20        30        40        50        60

                     70        80        90       100       110       120
m681.pep    KRACTMPMRRCLPSRLGAMVFIGCPLVFGVSECRLKVSVLRLPVGDGLECAVFGKLPCAA
            |||||||||||||||||||||||||||||||||||||||||||||:|||||||||||| ||
g681        KRACTMPMRRCLPSRLGAMVFIGCPLVFGVSECRLKVSVLRLPVGNGLECAVFGKLPRAA
                     70        80        90       100       110       120

                    130       140       150       160       170       180
m681.pep    FGLGEQCGGFRVGFGDVGEADDAEVVRIVGVFVGLVAAEETPAAVVFKNGGFAVEEADGP
            ||||:||||||||||||||||||||| :|||||:||||||||||||||||||||:|||||
g681        FGLGKQCGGFRVGFGDVGEADDAEVVGVVGVFVGFVAAEETPAAVVFKNGGFAVKEADGP
                    130       140       150       160       170       180

                    190       200       210        220       230      239
m681.pep    VLFGDGVGGDTAVECRGKCLCKCVHYGNTLGX-KLTDFTTIRALSADGGGLVVQCAPFAA
            ||||||||||:|||||||||||||| |||||  ||:||||| ||||||||||||||||||
g681        VLFGDGVGGDAAVECRGKCLCKCVHCGNTLGGGKLADFTTIPALSADGGGLVVQCAPFAA
                    190       200       210       220       230       240

                240       250       260
m681.pep    LRCFCIFGVWKRIRAVFCGRRX
            ||||||||||||||||||||||
g681        LRCFCIFGVWKRIRAVFCGRRX
                    250       260
```

The following partial DNA sequence was identified in *N. meningitidis* <SEQ ID 2247>:

```
a681.seq
   1 ATAACGACGC CGATGGCAAT CAGTGCGTCA AATTTTTCAG AAGAGGCAAA

  51 GTTCATCAGC GCGATGGGGA TTTCAAGCGC GCCGGGTACG GTGGCGACGG

 101 TAATGTTTTC GTCTGCCACG CCCAATTCTT GGAGGGTGCG GCAGCAGACT

 151 TTGAGCATTT CGCTGCCGAT TTCGTTGGTG AAGCGTGCCT GTACGATGCC

 201 GATGCGGAGG TGTTTGCCGT CGAGGTTGGG GGCGATGGTG TTCATTGAGT

 251 GTCCTTTGGT ATTCGGAGGT TTCGGAATGC CGTCTGAAGG GTCAGTCCTT

 301 AGGTTGCCAG TCGGCGACGG TTTGGAATGT GCCGTCTTCT GCCAATTCCC

 351 ACGCGCTGCC TTCAGGTTGG GAGAGCAGTG CGGCGGTTTC AGGGTTGGTT

 401 TTGGTGATAT CGGCGAGGCT GACGATGCTG AAGTTGTCCG GGTCGTCGGT

 451 GTATTCGTCG GTCTCGTCGC CGCTGAAGAA ACGCCAGCCG CTGTCGTTTT

 501 CAAAAACGGG GGCTTCGCGG TAGAGGAAGC CGACGGGCTG GTTTTGTTTG

 551 GCGACGGTGT TGGTGGCGAT GCAGCGGTCG AGTGCCGAGG AAAGTGCTTG

 601 TGCAAATGCG TTCATTGCGG GAATACGTT. GGGGGAAAAC TTGCGGATTT

 651 TACCACGATT CTTGCGTTGT CGGCAGACGG CGGCGGTTTG GTGGTACAAT

 701 GTGCGCCGTT TGCAGCCTTA AGGTGTTTCT GTATTTTTGG AGTATGGAAA

 751 CGCATTCGGG CTGTTTTTTG CGGAAGACGG TAA
```

This corresponds to the amino acid sequence <SEQ ID 2248; ORF 681.a>:

```
a681.pep

      1  ITTPMAISAS NFSEEAKFIS AMGISSAPGT VATVMFSSAT PNSWRVRQQT

     51  LSISLPISLV KRACTMPMRR CLPSRLGAMV FIECPLVFGG FGMPSEGSVL

    101  RLPVGDGLEC AVFCQFPRAA FRLGEQCGGF RVGFGDIGEA DDAEVVRVVG

    151  VFVGLVAAEE TPAAVVFKNG GFAVEEADGL VLFGDGVGGD AAVECRGKCL

    201  CKCVHCGNTX GGKLADFTTI LALSADGGGL VVQCAPFAAL RCFCIFGVWK

    251  RIRAVFCGRR *

m681/a681  90.8% identity in 260 aa overlap

                   10        20        30        40        50        60
m681.pep   MTTPMAISASNFSEEAKFISAMGISSAPGTVATVMFSSATPNSWRVRQQTLSISLPISLV
           :|||||||||||||||||||||||||||||||||||||||||||||||||||||||||||
a681       ITTPMAISASNFSEEAKFISAMGISSAPGTVATVMFSSATPNSWRVRQQTLSISLPISLV
                   10        20        30        40        50        60

                   70        80        90       100       110       120
m681.pep   KRACTMPMRRCLPSRLGAMVFIGCPLVFGVSECRLKVSVLRLPVGDGLECAVFGKLPCAA
           |||||||||||||||||||||| ||||||     : ||||||||||||||||| ::| ||
a681       KRACTMPMRRCLPSRLGAMVFIECPLVFGGFGMPSEGSVLRLPVGDGLECAVFCQFPRAA
                   70        80        90       100       110       120

                  130       140       150       160       170       180
m681.pep   FGLGEQCGGFRVGFGDVGEADDAEVVRIVGVFVGLVAAEETPAAVVFKNGGFAVEEADGP
           | |||||||||||||||:||||||||||:||||||||||||||||||||||||||||||
a681       FRLGEQCGGFRVGFGDIGEADDAEVVRVVGVFVGLVAAEETPAAVVFKNGGFAVEEADGL
                  130       140       150       160       170       180

                  190       200       210       220       230       240
m681.pep   VLFGDGVGGDTAVECRGKCLCKCVHYGNTLGXKLTDFTTIRALSADGGGLVVQCAPFAAL
           ||||||||||:|||||||||||||||| ||| | ||:||||| ||||||||||||||||||
a681       VLFGDGVGGDAAVECRGKCLCKCVHCGNTXGGKLADFTTILALSADGGGLVVQCAPFAAL
                  190       200       210       220       230       240

                  250       260
m681.pep   RCFCIFGVWKRIRAVFCGRRX
           ||||||||||||||||||||
a681       RCFCIFGVWKRIRAVFCGRRX
                  250       260
```

The following partial DNA sequence was identified in *N. gonorrhoeae* <SEQ ID 2249>:

```
g682.seq
   1 ATGCGCGATT TCGCCGTATG GGTGCCTTAC GGGGAACGGC GGAAAAATTG

  51 GGACATAAGG TATTGCCTCC CGCACCTTAT TCGCCTGAGC CCAACCCGAT

 101 TGAGAAAGTG TGGGCGAATA TTAAGCGGTA TCTGCGAACC GTTTTGTCTG

 151 ATTACGCCCG ATTTGACGAT GCACTACTGT CCTATTTTGA TTTTAATTGA

 201 CTATATTTGT GTGAATGATG AAATAAAAAT GCCGTCTGAA CCCGATTGGA

 251 TTCAGACGGC ATTTTGTATG GCAGGATTTA TTCGCTTTCC AACTGACCGA

 301 CCTATTTTGA CAAGGCAGTC AGGCGTTGTT CGGATTTCGC CACGAACGGG

 351 TTTTCGGTAT CCCACGCGTA GCCTGCCAAA ATCGAAGAAA GCATACGGCT

 401 GA
```

This corresponds to the amino acid sequence <SEQ ID 2250; ORF 682>:

```
g682.pep
   1 MRDFAVWVPY GERRKNWDIR YCLPHLIRLS PTRLRKCGRI LSGICEPFCL

  51 ITPDLTMHYC PILILIDYIC VNDEIKMPSE PDWIQTAFCM AGFIRFPTDR

 101 PILTRQSGVV RISPRTGFRY PTRSLPKSKK AYG*
```

The following partial DNA sequence was identified in *N. meningitidis* <SEQ ID 2251>:

```
m682.seq
  1 ATGCGTGATT TCACCGTATG GGTGTCTTAC GGGAAATGGC GGAAAAATTG

 51 GGACATAAGG TATTGCCTCT TGCACCTTAT TCACCTGAGC TCAACCCGAT

101 TGAGAAAGTG TGGGCGAATA TTAAGCGGTA TCTGCGAACC GTTTTGTCTG

151 ATTACGCCCG ATTTGACGAT GCACTACTGT CCTATTTTGA TTTTAATTGA

201 CTAT...... ......GAAA TGGCAATGCC GTCTGAACCC GATTGGATTC

251 AGACGGCATT TTGTATGGCG TACGGATTTA TTCGGTTTCC AACTGACCGA

301 CCCATTCGGA CAAGGCAGTC AGGCGTTGTT CGGATTTCGC CACGAACGGG

351 TTTTCGGTAT CCCACGCGTA GCCTGCCAAA ATCGAAGAAA GCATACGGCT

401 GA
```

This corresponds to the amino acid sequence <SEQ ID 2252; ORF 682>:

```
m682.pep
  1 MRDFTVWVSY GKWRKNWDIR YCLLHLIHLS STRLRKCGRI LSGICEPFCL

 51 ITPDLTMHYC PILILIDY.. ..EMAMPSEP DWIQTAFCMA YGFIRFPTDR

101 PIRTRQSGVV RISPRTGFRY PTRSLPKSKK AYG*
```

Computer analysis of the amino acid sequences gave the following results:

Homology with a Predicted ORF from *N. meningitidis* menA with menB ORF 682 shows 88.1% identity over a 134 aa overlap with a predicted ORF (ORF682.a) from *N. gonorrhoeae*:

```
m682/g682

                    10        20        30        40        50        60
m682.pep   MRDFTVWVSYGKWRKNWDIRYCLLHLIHLSSTRLRKCGRILSGICEPFCLITPDLTMHYC
           ||||:||| ||: |||||||||| |||:|| |||||||||||||||||||||||||||||
g682       MRDFAVWVPYGERRKNWDIRYCLPHPIRLSPTRLRKCGRILSGICEPFCLITPDLTMHYC
                    10        20        30        40        50        60

                         70        80        90       100       110
m682.pep   PILILIDY-----EMAMPSEPDWIQTAFCMAYGFIRFPTDRPIRTRQSGVVRISPRTGFER
           ||||||||     |: ||||||||||||||| ||||||||||| |||||||||||||||||
g682       PILILIDYICVNDEIKMPSEPDWIQTAFCMA-GFIRFPTDRPILTRQSGVVRISPRTGFER
                    70        80        90       100       110

             120       130
m682.pep   YPTRSLPKSKKAYGX
           |||||||||||||||
g682       YPTRSLPKSKKAYGX
         120       130
```

The following partial DNA sequence was identified in *N. meningitidis* <SEQ ID 2253>:

```
a682.seq
  1 ATGCGCGATT TTACCGTATG GGTGTCTTAC GGGAAATGGC GGAAAAATTG

 51 GGACATAAGG TATTGCCTCT TGCACCTTAT TCACCTGAGC TCAACCCGAT

101 TGAGAAAGTG TGGGCGAATA TTAAGCGGTA TCTGCGAACC GTTTTGTCTG

151 ATTACGCCCG ATTTGACGAT GCACTACTGT CCTATTTTGA TTTTAATTGA

201 ATAT...... .......... .......... .......... ..........
```

-continued

```
251 .......... .......... ......TATA TTCGGTTTCC AACTGACCGA

301 CCCATTCTGA CAAGGCCGAC AGGCGTTGTT CGGATTTCGC CACGAACGGG

351 TTTTCGGTAT CCCACGCGTA GCCTGCCAAA ATCGAAGAAA GCATACGGCT

401 GA
```

This corresponds to the amino acid sequence <SEQ ID 2254; ORF 682.a>:

```
a682.pep

      1 MRDFTVWVSY GKWRKNWDIR YCLLHLIHLS STRLRKCGRI LSGICEPFCL

     51 ITPDLTMHYC PILILIEY.. .......... .......... ..YIRFPTDR

    101 PILTRPTGVV RISPRTGFRY PTRSLPKSKK AYG*

m682/a682 80.6% identity in 129 aa overlap

                  10        20        30        40        50        60
m682.pep MRDFTVWVSYGKWRKNWDIRYCLLHLIHLSSTRLRKCGRILSGICEPFCLITPDLTMHYC
         ||||||||||||||||||||||||||||||||||||||||||||||||||||||||||||
a682     MRDFTVWVSYGKWRKNWDIRYCLLHLIHLSSTRLRKCGRILSGICEPFCLITPDLTMHYC
                  10        20        30        40        50        60

                  70        80        90       100       110       120
m682.pep PILILIDYEMAMPSEPDWIQTAFCMAYGFIRFPTDRPIRTRQSGVVRISPRTGFRYPTRS
         ||||||:|                    :|||||||| || :||||||||||||||||
a682     PILILIEY--------------------YIRFPTDRPILTRPTGVVRISPRTGFRYPTRS
                                     70        80        90       100

                 130
m682.pep LPKSKKAYGX
         ||||||||||
a682     LPKSKKAYGX
                 110
```

The following partial DNA sequence was identified in *N. gonorrhoeae* <SEQ ID 2255>

```
g683.seq
  1 ATGATTAAGG AAACCCTAAT GCGCCCAATC TTCCTATCTT TCGTTTTACT

 51 CCCTATTTTG ATAACCGCCT GCAGCACACC GGACAAGTCT GCCCGATGGG

101 AAAATATCGG CACAATCTCA AACGGCAATA TTCATACATA TATTAATAAA

151 GACAGTGTGA GAAAAAACGG AAATCTGATG ATTTTCCAAG ATAAAAAAGT

201 TGTTACCAAT CTGAAACAAG AACGTTTTGC CAACACCCCC GCATACAAGA

251 CTGCCATTGC CGAGTGGGAA ATCCACTGCA ACAACAAAAC ATACCGCTTA

301 AGTTCGCTAC AGTTATTTGA TACAAAAAAC ACGGAAATTT CCACACAAAA

351 CTACACAGCC TCTTCCCTCC GCCCGATGAG CATCCTGTCC GGGACATTAA

401 CTGAAAAACA ATATGAAACC GTATGCGGGA AAAAACTCTG A
```

This corresponds to the amino acid sequence <SEQ ID 2256; ORF 683>:

```
g683.pep
  1 MIKETLMRPI FLSFVLLPIL ITACSTPDKS ARWENIGTIS NGNIHTYINK

 51 DSVRKNGNLM IFQDKKVVTN LKQERFANTP AYKTAIAEWE IHCNNKTYRL

101 SSLQLFDTKN TEISTQNYTA SSLRPMSILS GTLTEKQYET VCGKKL*
```

The following partial DNA sequence was identified in *N. meningitidis* <SEQ ID 2257>:

```
m683.seq..
   1 ATGATTAAGG AAACCCTAAT GCGCCCAATC TTCCTATCTT TCGTTTTATT

  51 CCCTATTTTG ATAACCGCCT GCAGCACACC GGACAAGTCT GCCCGATGGG

 101 AAAATATCGG CACAATCTCA AACGGCAATA TTCATACATA TATCAATAAA

 151 GACAGCGTGA GAAAAAACGG AAATCTGATG ATTTTCCAAG ATAAAAAAGT

 201 TGTTACCAAT CTAAAACAAG AACGTTTTGC CAACACCCCC GCATACAAGA

 251 CTGCCATTGC CGAGTGGGAA ATCCACTGCA ACAACAAAAC ATACCGCTTA

 301 AGTTCGCTAC AGTTGTTTGA TACAAAAAAC ACGGAAATTT CCACACAAAA

 351 CTACACAGCC TCTTCCCTCC GCCCGATGAG CATCCTGTCC GGGACATTAA

 401 CCGAAAAACA ATATGAAACC GTATGCGGAA AAAAACTCTG A
```

This corresponds to the amino acid sequence <SEQ ID 2258; ORF 683>:

```
m683.pep..
   1 MIKETLMRPI FLSFVLFPIL ITACSTPDKS ARWENIGTIS NGNIHTYINK

  51 DSVRKNGNLM IFQDKKVVTN LKQERFANTP AYKTAIAEWE IHCNNKTYRL

 101 SSLQLFDTKN TEISTQNYTA SSLRPMSILS GTLTEKQYET VCGKKL*
```

Computer analysis of this amino acid sequence gave the following results:

Homology with a Predicted ORF from *N. gonorrhoeae*

ORF 683 shows 99.3% identity over a 146 aa overlap with a predicted ORF (ORF 683) from *N. gonorrhoeae*:

```
m683/g683  99.3% identity in 146 aa overlap

                   10        20        30        40        50        60
m683.pep   MIKETLMRPIFLSFVLFPILITACSTPDKSARWENIGTISNGNIHTYINKDSVRKNGNLM
           ||||||||||||||||:|||||||||||||||||||||||||||||||||||||||||||
g683       MIKETLMRPIFLSFVLLPILITACSTPDKSARWENIGTISNGNIHTYINKDSVRKNGNLM
                   10        20        30        40        50        60

                   70        80        90       100       110       120
m683.pep   IFQDKKVVTNLKQERFANTPAYKTAIAEWEIHCNNKTYRLSSLQLFDTKNTEISTQNYTA
           ||||||||||||||||||||||||||||||||||||||||||||||||||||||||||||
g683       IFQDKKVVTNLKQERFANTPAYKTAIAEWEIHCNNKTYRLSSLQLFDTKNTEISTQNYTA
                   70        80        90       100       110       120

                  130       140
m683.pep   SSLRPMSILSGTLTEKQYETVCGKKLX
           |||||||||||||||||||||||||||
g683       SSLRPMSILSGTLTEKQYETVCGKKLX
                  130       140
```

The following partial DNA sequence was identified in *N. meningitidis* <SEQ ID 2259>

```
a683.seq
   1 ATGATTAAGG AAACCCTAAT GCGCCCAATC TTCCTATCTT TCGTTTTATT

  51 CCCTATTTTG ATAACCGCCT GCAGCACACC GGACAAGTCT GCCCGATGGG

 101 AAAATATCGG CACAATCTCA AACGGCAATA TTCATACATA TATCAATAAA

 151 GACAGCGTGA GAAAAAACGG AAATCTGATG ATTTTCCNAG ATAAAAAAGT

 201 TGTTACCAAT CTAAAACAAG AACGTTTTGC CNACACCCCC GCATACAAGA

 251 CTGCCATTGC CGAGTGGGAA ATCCACTGCA ACAACAAAAC ATACCGCTTA

 301 AGTTCGCTAC AATTGTTTGA TACAAAAAAC ACGGAAATTT CCACACAAAA
```

-continued

```
351 NTACACAGCC TCTTCCCTCC GCCCGATGAG CATCCTGTCC GGGACATTAA

401 CCGAAAAACA ATATGAAACC GTATGCGGAA AAAAACTCTG A
```

This corresponds to the amino acid sequence <SEQ ID 2260; ORF 683.a>:

```
a683.pep
   1 MIKETLMRPI FLSFVLFPIL ITACSTPDKS ARWENIGTIS NGNIHTYINK

  51 DSVRKNGNLM IFXDKKVVTN LKQERFAXTP AYKTAIAEWE IHCNNKTYRL

 101 SSLQLFDTKN TEISTQXYTA SSLRPMSILS GTLTEKQYET VCGKKL*
```

Computer analysis of this amino acid sequence gave the following results:

Homology with a Predicted ORF from *N. meningitidis*

ORF 683 shows 97.9% identity over a 146 aa overlap with a predicted ORF (ORF 683) from *N. meningitidis*:

```
m683/a683 97.9% identity in 146 aa overlap

                 10        20        30        40        50        60
m683.pep MIKETLMRPIFLSFVLFPILITACSTPDKSARWENIGTISNGNIHTYINKDSVRKNGNLM
         ||||||||||||||||||||||||||||||||||||||||||||||||||||||||||||
a683     MIKETLMRPIFLSFVLFPILITACSTPDKSARWENIGTISNGNIHTYINKDSVRKNGNLM
                 10        20        30        40        50        60

                 70        80        90       100       110       120
m683.pep IFQDKKVVTNLKQERFANTPAYKTAIAEWEIHCNNKTYRLSSLQLFDTKNTEISTQNYTA
         || ||||||||||||| |||||||||||||||||||||||||||||||||||||| |||
a683     IFXDKKVVTNLKQERFAXTPAYKTAIAEWEIHCNNKTYRLSSLQLFDTKNTEISTQXYTA
                 70        80        90       100       110       120

                130       140
m683.pep SSLRPMSILSGTLTEKQYETVCGKKLX
         |||||||||||||||||||||||||||
a683     SSLRPMSILSGTLTEKQYETVCGKKLX
                130       140
```

The following partial DNA sequence was identified in *N. gonorrhoeae* <SEQ ID 2261>

```
g684.seq
   1 ATGCGCCTTT TCCCCATCGC CGCCGCCCTG ACGCTTGCCG CCTGCGGTAC

  51 TGTGCAAAGC ACACAATATT TCGTGTTGCC CGACAGCCGC TACATCCGTC

 101 CTGCAACGCA AGGCGGCGAA ACCGCCGTCG AAGTCCGTCT TGCCGAACCG

 151 CTCAAACGCG GCGGACTGGT CTATCAAACC GACCCCTACC GCATCAACAC

 201 CGCACAAAAC CATGTTTGGG CAGACACCTT GGACGATATG CTCGAAGCGG

 251 CGTTGAGCAA TGCATTCAAC CGTTTGGACA GCACACGCAC CTTTGTTCCT

 301 GCCTCACGCA GCGGCAGTAC CGACAAATGG ACGGTCTATA TCGACGCATT

 351 CCAAGGCAGC TACACGGGCA AAACCCTCAT CAGCGGCTAC GCCGTCCTAC

 401 CCGACGGTAC GAACAGACCC TTCCATATCG AAACCGAACA GCAGGGTGAC

 451 GGCTACGCCG CCATGACCGC CGCACTCGAA CAGGGACTGA AACAGGCGGC

 501 GCAACAGATG GTCGAGTAA
```

This corresponds to the amino acid sequence <SEQ ID 2262; ORF 684>:

```
g684.pep
```

-continued

```
  1 MRLFPIAAAL TLAACGTVQS TQYFVLPDSR YIRPATQGGE TAVEVRLAEP

 51 LKRGGLVYQT DPYRLNTAQN HVWADTLDDM LEAALSNAFN RLDSTRIFVP

101 ASRSGSTDKW TVYIDAFQGS YTGKTLISGY AVLPDGTNRP FHIETEQQGD

151 GYAAMTAALE QGLKQAAQQM VE*
```

The following partial DNA sequence was identified in *N. meningitidis* <SEQ ID 2263>:

```
m684.seq
  1 ATGCGCCTTT TCCCGATTGC CGCCGCCCTG TCGCTTGCCG CCTGCGGTAC

 51 TGTGCAAAGC ACACAATATT TCGTGTTGCC CGACAGCCGC TACATCCGTC

101 CTGCAACGCA AGGCGGCGAA ACTGCCGTCG AAGTCCGTCT TGCCGAACCG

151 CTCAAACGCG GCGGACTGGT CTATCAAACC GACCCCTACC GCCTCAACAC

201 CGCACAAAAC CACGTCTGGG CAGACACCTT GGACGATATG CTCGAAGCGG

251 CGTTGAGCAA TGCATTCAAC CGTTTGGACA GCACACGCAT CTTTGTTCCT

301 GCCTCACGCA GCGGCAGTAC CGAAAAATGG ACGGTCTATA TCGACGCATT

351 CCAAGGCAGC TACACGGGCA AAACCCTCAT CAGCGGCTAC GCCGTCCTAC

401 CCGACGGTAC GAACAGACCC TTCCATATCG AAACCGAACA GCAGGGTGAC

451 GGCTACGCCG CGATGACCGC CGCACTCGAA CAGGGACTGA AACAGGCGGC

501 GCAACAGATG GTCGAGTAA
```

This corresponds to the amino acid sequence <SEQ ID 2264; ORF 684>:

```
m684.pep
  1 MRLFPIAAAL SLAACGTVQS TQYFVLPDSR YIRPATQGGE TAVEVRLAEP

 51 LKRGGLVYQT DPYRLNTAQN HVWADTLDDM LEAALSNAFN RLDSTRIFVP

101 ASRSGSTEKW TVYIDAFQGS YTGKTLISGY AVLPDGTNRP FHIETEQQGD

151 GYAAMTAALE QGLKQAAQQM VE*
```

Computer analysis of this amino acid sequence gave the following results:

Homology with a Predicted ORF from *N. gonorrhoeae*

ORF 684 shows 97.7% identity over a 172 aa overlap with a predicted ORF (ORF 684) from *N. gonorrhoeae*:

```
m684/g684 97.7% identity in 172 aa overlap

                 10        20        30        40        50        60
m684.pep MRLFPIAAALSLAACGTVQSTQYFVLPDSRYIRPATQGGETAVEVRLAEPLKRGGLVYQT
         ||||||||||:|||||||||||||||||||||||||||||||||||||||||||||||||
g684     MRLFPIAAALTLAACGTVQSTQYFVLPDSRYIRPATQGGETAVEVRLAEPLKRGGLVYQT
                 10        20        30        40        50        60

                 70        80        90       100       110       120
m684.pep DPYRLNTAQNHVWADTLDDMLEAALSNAFNRLDSTRIFVPASRSGSTEKWTVYIDAFQGS
         ||||:||||||||||||||||||||||||||||||| ||||||||||:||||||||||||
g684     DPYRINTAQNHVWADTLDDMLEAALSNAFNRLDSTRTFVPASRSGSTDKWTVYIDAFQGS
                 70        80        90       100       110       120

                130       140       150       160       170
m684.pep YTGKTLISGYAVLPDGTNRPFHIETEQQGDGYAAMTAALEQGLKQAAQQMVEX
         |||||||||||||||||||||||||||||||||||||||||||||||||||||
g684     YTGKTLISGYAVLPDGTNRPFHIETEQQGDGYAAMTAALEQGLKQAAQQMVEX
                130       140       150       160       170
```

The following partial DNA sequence was identified in *N. meningitidis* <SEQ ID 2265>

```
a684.seq
   1 ATGCGCCTCT TCCCGATTGC CGCCGCCCTG ACGCTTGCCG CCTGCGGTAC

  51 TGTGCAAAGC ACACAATATT TCGTGTTGCC CGACAGCCGC TACATCCGTC

 101 CTGCAACGCA AGGCGGCGAA ACTGCCGTCG AAGTCCGTCT TGCCGAACCG

 151 CTCAAACGCG GCGGACTGGT CTATCAAACC GACCCCTACC GCCTCAACAC

 201 CGCACAAAAC CACGTCTGGG CAGACACCTT GGACGATATG CTCGAAGCGG

 251 CGTTGAGCAA TGCATTCAAC CGTTTGGACA GCACACGCAT CTTTGTTCCT

 301 GCCTCACGCA GCGGCAGTAC CGAAAAATGG ACGGTCTATA TCGACGCATT

 351 CCAAGGCAGC TACACGGGCA AAACCCTCAT CAGCGGCTAC GCCGTCCTAC

 401 CCGACGGTAC GAACAGACCC TTCCATATCG AAACCGAACA GCAGGGTGAC

 451 GGCTACGCCG CCATGACCGC CGCACTCGAA CAGGGACTGA AACAGGCGGC

 501 GCAACAGATG GTCGAGTAA
```

This corresponds to the amino acid sequence <SEQ ID 2266; ORF 684.a>:

```
a684.pep
   1 MRLFPIAAAL TLAACGTVQS TQYFVLPDSR YIRPATQGGE TAVEVRLAEP

  51 LKRGGLVYQT DPYRLNTAQN HVWADTLDDM LEAALSNAFN RLDSTRIFVP

 101 ASRSGSTEKW TVYIDAFQGS YTGKTLISGY AVLPDGTNRP FHIETEQQGD

 151 GYAAMTAALE QGLKQAAQQM VE*
```

Computer analysis of this amino acid sequence gave the following results:

Homology with a Predicted ORF from *N. meningitidis*

ORF 684 shows 99.4% identity over a 172 aa overlap with a predicted ORF (ORF 684) from *N. meningitidis*

```
m684/a684  99.4% identity in 172 aa overlap

                  10        20        30        40        50        60
m684.pep   MRLFPIAAALSLAACGTVQSTQYFVLPDSRYIRPATQGGETAVEVRLAEPLKRGGLVYQT
           |||||||||:||||||||||||||||||||||||||||||||||||||||||||||||||
a684       MRLFPIAAALTLAACGTVQSTQYFVLPDSRYIRPATQGGETAVEVRLAEPLKRGGLVYQT
                  10        20        30        40        50        60

                  70        80        90       100       110       120
m684.pep   DPYRLNTAQNHVWADTLDDMLEAALSNAFNRLDSTRIFVPASRSGSTEKWTVYIDAFQGS
           ||||||||||||||||||||||||||||||||||||||||||||||||||||||||||||
a684       DPYRLNTAQNHVWADTLDDMLEAALSNAFNRLDSTRIFVPASRSGSTEKWTVYIDAFQGS
                  70        80        90       100       110       120

                 130       140       150       160       170
m684.pep   YTGKTLISGYAVLPDGTNRPFHIETEQQGDGYAAMTAALEQGLKQAAQQMVEX
           |||||||||||||||||||||||||||||||||||||||||||||||||||||
a684       YTGKTLISGYAVLPDGTNRPFHIETEQQGDGYAAMTAALEQGLKQAAQQMVEX
                 130       140       150       160       170
```

The following partial DNA sequence was identified in *N. gonorrhoeae* <SEQ ID 2267>

```
g685.seq
   1  TTGTTTTGCC GTATCGGGAA TTTTGCGTTT TGCGGCGTGG TTTCTGCAGG

  51  TTGTTTGCTT AATAATAAAC ATTCTTATTC GTATGCAAAG GAACCGCACA

 101  CCGTGAAACC GCGTTTTTAT TGGGCAGcct GCGCCGTCCT GCCGGCCGCC
```

-continued

```
 151 TGTTCGCCCG AACCTGCCGC CGAAAAAACT GTATccgCCG CATCCCAAGC
 201 CGCATCCACA CCTGTCGCCA CGCTGACCGT GCCGACCGCG CGGGGCGATG
 251 CCGTTGTGCC GAAGAATCCC GAACgcgtcg ccgtgtAcga CtggGCGGCG
 301 TtggaTACGC TGACCGAGCC GGGCGTGAAT GTGGGCGCAA CCACCGCGCC
 351 GGTGCGCGTG GACTATTTGC AGCCTGCATT TGACAAGGCG GCAACGGTGG
 401 GGACGCTGTT TGAGCCCGAT TGCGAATCCC TGCACCGCCA CAATCCGCAG
 451 TTTGTCATTA CCGGCGGGCC GGGTGCGGAA GCGTATGAAC AGTTGGCGAA
 501 AAACGCGACC ACCATAGATT TGACGGTGGA CAACGGCAAT ATCCGCACCA
 551 GCGGCGAGAA GCAGATGGAG ACCCTGTCGC GGATTTTCGG TAAGGAAGCG
 601 CGCGTGGCGG AATTGAATGC GCAGATTGAC GCGCTGTTCG CCCAAAAGCG
 651 CGAAGCCGCC AAAGGCAAAG GACGCGGGCT GGTGCTGTCG GTTACAGGCA
 701 ACAAGGTGTC CGCCTTCGGC ACGCAATCGC GGTTGGCAAG TTGGATACAC
 751 GGCGACATCG GCCTGCCGCC CGTGGACGAA TCTTTACGCA ACGAAGGGCA
 801 CGGGCAGCCC GTTTCCTTCG AATACATCAA AGAGAAAAAC CCCGGCTGGA
 851 TTTTCATCAT CGACCGCACC GCCGCCATCG GGCAGGAAGG GCCGGCTGCC
 901 GTGGAAGTGT TGGATAACGC GCTGGTATGC GGCACGAACG CTTGGAAGCG
 951 CAAGCAAATC ATCGTCATGC CTGCCGCGAA CTACATTGTC GCGGGCGGCG
1001 CGCGGCAGTT GATACAGGCG GCGGAACAGT TGAAGGCGGC GTTTGAAAAG
1051 GCAGAACCCG TTGCGGCGCA GTAG
```

This corresponds to the amino acid sequence <SEQ ID 2268; ORF 685>:

```
g685.pep
  1 LFCRIGNFAF CGVVSAGCLL NNKHSYSYAK EPHTVKPRFY WAACAVLPAA
 51 CSPEPAAEKT VSAASQAAST PVATLTVPTA RGDAVVPKNP ERVAVYDWAA
101 LDTLTEPGVN VGATTAPVRV DYLQPAFDKA ATVGTLFEPD CESLHRHNPQ
151 FVITGGPGAE AYEQLAKNAT TIDLTVDNGN IRTSGEKQME TLSRIFGKEA
201 RVAELNAQID ALFAQKREAA KGKGRGLVLS VTGNKVSAFG TQSRLASWIH
251 GDIGLPPVDE SLRNEGHGQP VSFEYIKEKN PGWIFIIDRT AAIGQEGPAA
301 VEVLDNALVC GTNAWKRKQI IVMPAANYIV AGGARQLIQA AEQLKAAFEK
351 AEPVAAQ*
```

The following partial DNA sequence was identified in *N. meningitidis* <SEQ ID 2269>:

```
m685.seq
  1 TTGTTTTGCC GTATCGGGAA TTTTGCGTTT TGCGGCGTGG TTTCTGCAGG
 51 TTGTTTGCTT AATAATAAAC ATTCTTATTC GTATGCAAAG GAACCGCACA
101 CCGTGAAACC GCGTTTTTAT TGGGCAGCCT GCGCCGTCCT GCTGACCGCC
151 TGTTCGCCCG AACCTGCCGC CGAAAAAACT GTATCCGCCG CATCCGCATC
201 TGCCGCCACG CTGACCGTGC CGACCGCGCG GGGCGATGCC GTTGTGCCGA
251 AGAATCCCGA ACGCGTCGCC GTGTACGACT GGGCGGCGTT GGATACGCTG
301 ACCGAATTGG GCGTGAATGT GGGCGCAACC ACCGCGCCGG TGCGCGTGGA
```

```
 351 TTATTTGCAG CCTGCATTTG ACAAGGCGGC AACGGTGGGG ACGCTGTTCG

 401 AGCCCGATTA CGAAGCCCTG CACCGCTACA ATCCTCAGCT TGTCATTACC

 451 GGCGGGCCGG GCGCGGAAGC GTATGAACAG TTAGCGAAAA ACGCGACCAC

 501 CATAGATCTG ACGGTGGACA ACGGCAATAT CCGCACCAGC GGCGAAAAGC

 551 AGATGGAGAC CTTGGCGCGG ATTTTCGGCA AGGAAGCGCG CGCGGCGGAA

 601 TTGAAGGCGC AGATTGACGC GCTGTTCGCC CAAACGCGCG AAGCCGCCAA

 651 AGGCAAAGGA CGCGGGCTGG TGCTGTCGGT TACGGGCAAC AAGGTGTCCG

 701 CCTTCGGCAC GCAGTCGCGG TTGGCAAGTT GGATACACGG CGACATCGGC

 751 CTACCGCCTG TAGACGAATC TTTACGCAAC GAGGGGCACG GGCAGCCTGT

 801 TTCCTTCGAA TACATCAAAG AGAAAAACCC CGATTGGATT TTCATCATCG

 851 ACCGTACCGC CGCCATCGGG CAGGAAGGGC CGGCGGCTGT CGAAGTATTG

 901 GATAACGCGC TGGTACGCGG CACGAACGCT TGGAAGCGCA AGCAAATCAT

 951 CGTCATGCCT GCCGCGAACT ACATTGTCGC GGGCGGCGCG CGGCAGTTGA

1001 TTCAGGCGGC GGAGCAGTTG AAGGCGGCGT TTAAAAAGGC AGAACCCGTT

1051 GCGGCGGGGA AAAGTAG
```

This corresponds to the amino acid sequence <SEQ ID 2270; ORF 685>:

```
m685.pep
   1 LFCRIGNFAF CGVVSAGCLL NNKHSYSYAK EPHTVKPRFY WAACAVLLTA

  51 CSPEPAAEKT VSAASASAAT LTVPTARGDA VVPKNPERVA VYDWAALDTL

 101 TELGVNVGAT TAPVRVDYLQ PAFDKAATVG TLFEPDYEAL HRYNPQLVIT

 151 GGPGAEAYEQ LAKNATTIDL TVDNGNIRTS GEKQMETLAR IFGKEARAAE

 201 LKAQIDALFA QTREAAKGKG RGLVLSVTGN KVSAFGTQSR LASWIHGDIG

 251 LPPVDESLRN EGHGQPVSFE YIKEKNPDWI FIIDRTAAIG QEGPAAVEVL

 301 DNALVRGTNA WKRKQIIVMP AANYIVAGGA RQLIQAAEQL KAAFKKAEPV

 351 AAGKK*
```

Computer analysis of this amino acid sequence gave the following results:
Homology with a Predicted ORF from *N. gonorrhoeae*
ORF 685 shows 94.4% identity over a 356 aa overlap with a predicted ORF (ORF 685) from *N. gonorrhoeae*:

```
   m685/g685 94.4% identity in 356 aa overlap

                   10         20         30         40         50         60
       m685.pep LFCRIGNFAFCGVVSAGCLLNNKHSYSYAKEPHTVKPRFYWAACAVLLTACSPEPAAEKT
                ||||||||||||||||||||||||||||||||||||||||||||||| :||||||||||
       g685     LFCRIGNFAFCGVVSAGCLLNNKHSYSYAKEPHTVKPRFYWAACACLPAACSPEPAAEKT
                   10         20         30         40         50         60

                         70         80         90        100        110
       m685.pep VSAASASA----ATLTVPTARGDAVVPKNPERVAVYDWAALDTLTELGVNVGATTAPVRV
                ||||| :|    ||||||||||||||||||||||||||||||||||:|||||||||||| 
       g685     VSAASQAASTPVATLTVPTARGDAVVPKNPERVAVYDWAALDTLTEPGVNVGATTAPVRV
                         70         80         90        100        110        120

                      120        130        140        150        160        170
       m685.pep DYLQPAFDKAATVGTLFEPDYEALHRYNPQLVITGGPGAEAYEQLAKNATTIDLTVDNGN
                |||||||||||||||||||| |:|||:|||:|||||||||||||||||||||||||||||
       g685     DYLQPAFDKAATVGTLFEPDCESLHRHNPQFVITGGPGAEAYEQLAKNATTIDLTVDNGN
                      130        140        150        160        170        180
```

-continued

```
             180       190       200       210       220       230
m685.pep IRTSGEKQMETLARIFGKEARAAELKAQIDALFAQTREAAKGKGRGLVLSVTGNKVSAFG
         ||||||||||||:||||||||:|||:||||||||| |||||||||||||||||||||||
g685     IRTSGEKQMETLSRIFGKEARVAELNAQIDALFAQKREAAKGKGRGLVLSVTGNKVSAFG
                   190       200       210       220       230       240

             240       250       260       270       280       290
m685.pep TQSRLASWIHGDIGLPPVDESLRNEGHGQPVSFEYIKEKNPDWIFIIDRTAAIGQEGPAA
         |||||||||||||||||||||||||||||||||||||||| ||||||||||||||||||
g685     TQSRLASWIHGDIGLPPVDESLRNEGHGQPVSFEYIKEKNPGWIFIIDRTAAIGQEGPAA
                   250       260       270       280       290       300

             300       310       320       330       340       350
m685.pep VEVLDNALVRGTNAWKRKQIIVMPAANYIVAGGARQLIQAAEQLKAAFKKAEPVAAGKKX
         ||||||||| |||||||||||||||||||||||||||||||||||||:|||||||
g685     VEVLDNALVCGTNAWKRKQIIVMPAANYIVAGGARQLIQAAEQLKAAFEKAEPVAAQX
                   310       320       330       340       350
```

The following partial DNA sequence was identified in *N. meningitidis* <SEQ ID 2271>

```
a685.seq
     1  TTGTTTTGCC GTATCGGGAA TTTTGCGTTT TGCGGCGTGG TTTCTGCAGG

    51  TTGTTTGCTT AATAATAAAC ATTCTTATTC GTATGCAAAG GAACCGCACA

   101  CCGTGAAACC GCGTTTTTAT TGGGCAGCCT GCGCCGTCCT GCTGACCGCC

   151  TGTTCGCCCG AACCTGCCGC CGAAAAAACT GTATCCGCCG CATCCGCATC

   201  TGCCGCCACA CTGACCGTGC CGACCGCGCG GGGCGATGCC GTTGTGCCGA

   251  AGAATCCCGA ACGCGTCGCC GTGTACGACT GGGCGGCGTT GGATACGCTG

   301  ACCGAATTGG GTGTGAATGT GGGCGCAACC ACCGCGCCGG TGCGCGTGGA

   351  TTATTTGCAG CCTGCATTTG ACAAGGCGGC AACGGTGGGG ACGCTGTTCG

   401  AGCCCGATTA CGAAGCCCTG CACCGCTACA ATCCTCAGCT TGTCATTACC

   451  GGCGGGCCGG GCGCGGAAGC GTATGAACAG TTGGCGAAAA ACGCGACCAC

   501  CATAGATCTG ACGGTGGACA ACGGCAATAT CCGCACCAGC GGCGAAAAGC

   551  AGATGGAGAC CTTGGCGCGG ATTTTCGGCA AGGAAGCGCG CGCGGCGGAA

   601  TTGAAGGCGC AGATTGACGC GCTGTTCGCC CAAACGCGCG AAGCCGCCAA

   651  AGGCAAAGGA CGCGGGCTGG TGCTGTCGGT TACGGGCAAC AAGGTGTCCG

   701  CCTTCGGCAC GCAGTCGCGG TTGGCAAGTT GGATACACGG CGACATCGGC

   751  CTACCGCCTG TAGACGAATC TTTACGCAAC GAGGGGCACG GGCAGCCTGT

   801  TTCCTTCGAA TACATCAAAG AGAAAAACCC CGATTGGATT TTCATCATCG

   851  ACCGTACCGC CGCCATCGGG CAGGAAGGGC CGGCGGCTGT CGAAGTATTG

   901  GATAACGCGC TGGTACGCGG CACGAACGCT TGGAAGCGCA AGCAAATCAT

   951  CGTCATGCCT GCCGCGAACT ACATTGTCGC GGGCGGCTCG CGGCAGTTGA

  1001  TTCAGGCGGC GGAGCAGTTG AAGGAGGCGT TTGAAAAGGC AGAACCCGTT

  1051  GCGGCGGGGA AAGAGTAG
```

This corresponds to the amino acid sequence <SEQ ID 2272; ORF 685.a>:

```
a685.pep
    1  LFCRIGNFAF CGVVSAGCLL NNKHSYSYAK EPHTVKPRFY WAACAVLLTA

   51  CSPEPAAEKT VSAASASAAT LTVPTARGDA VVPKNPERVA VYDWAALDTL

  101  TELGVNVGAT TAPVRVDYLQ PAFDKAATVG TLFEPDYEAL HRYNPQLVIT
```

-continued

```
151 GGPGAEAYEQ LAKNATTIDL TVDNGNIRTS GEKQMETLAR IFGKEARAAE

201 LKAQIDALFA QTREAAKGKG RGLVLSVTGN KVSAFGTQSR LASWIHGDIG

251 LPPVDESLRN EGHGQPVSFE YIKEKNPDWI FIIDRTAAIG QEGPAAVEVL

301 DNALVRGTNA WKRKQIIVMP AANYIVAGGS RQLIQAAEQL KEAFEKAEPV

351 AAGKE*
```

Computer analysis of this amino acid sequence gave the following results:

Homology with a Predicted ORF from *N. meningitidis*

ORF 685 shows 98.9% identity over a 355 aa overlap with a predicted ORF (ORF 685) from *N. meningitidis*:

```
m685/a685  98.9% identity in 355 aa overlap

                    10        20        30        40        50        60
m685.pep    LFCRIGNFAFCGVVSAGCLLNNKHSYSYAKEPHTVKPRFYWAACAVLLTACSPEPAAEKT
            ||||||||||||||||||||||||||||||||||||||||||||||||||||||||||||
a685        LFCRIGNFAFCGVVSAGCLLNNKHSYSYAKEPHTVKPRFYWAACAVLLTACSPEPAAEKT
                    10        20        30        40        50        60

                    70        80        90       100       110       120
m685.pep    VSAASASAATLTVPTARGDAVVPKNPERVAVYDWAALDTLTELGVNVGATTAPVRVDYLQ
            ||||||||||||||||||||||||||||||||||||||||||||||||||||||||||||
a685        VSAASASAATLTVPTARGDAVVPKNPERVAVYDWAALDTLTELGVNVGATTAPVRVDYLQ
                    70        80        90       100       110       120

                   130       140       150       160       170       180
m685.pep    PAFDKAATVGTLFEPDYEALHRYNPQLVITGGPGAEAYEQLAKNATTIDLTVDNGNIRTS
            ||||||||||||||||||||||||||||||||||||||||||||||||||||||||||||
a685        PAFDKAATVGTLFEPDYEALHRYNPQLVITGGPGAEAYEQLAKNATTIDLTVDNGNIRTS
                   130       140       150       160       170       180

                   190       200       210       220       230       240
m685.pep    GEKQMETLARIFGKEARAAELKAQIDALFAQTREAAKGKGRGLVLSVTGNKVSAFGTQSR
            ||||||||||||||||||||||||||||||||||||||||||||||||||||||||||||
a685        GEKQMETLARIFGKEARAAELKAQIDALFAQTREAAKGKGRGLVLSVTGNKVSAFGTQSR
                   190       200       210       220       230       240

                   250       260       270       280       290       300
m685.pep    LASWIHGDIGLPPVDESLRNEGHGQPVSFEYIKEKNPDWIFIIDRTAAIGQEGPAAVEVL
            ||||||||||||||||||||||||||||||||||||||||||||||||||||||||||||
a685        LASWIHGDIGLPPVDESLRNEGHGQPVSFEYIKEKNPDWIFIIDRTAAIGQEGPAAVEVL
                   250       260       270       280       290       300

                   310       320       330       340       350
m685.pep    DNALVRGTNAWKRKQIIVMPAANYIVAGGARQLIQAAEQLKAAFKKAEPVAAGKKX
            |||||||||||||||||||||||||||||:||||||||||| ||:|||||||||:|
a685        DNALVRGTNAWKRKQIIVMPAANYIVAGGSRQLIQAAEQLKEAFEKAEPVAAGKEX
                   310       320       330       340       350
```

The following partial DNA sequence was identified in *N. gonorrhoeae* <SEQ ID 2273>

```
g686.seq (partial)
  1 ..AATTTCTCCT GCCGCGCCGA TGATGTTTTT GACGATATCT GCAGTGCCGT

 51   TGAAGGCTTC ggcgGCATTG CCCGATCTGT CCAGCTCGGG GCTGTATCGG

101   GTGGCGCGTT TGAATCCGTC GCCTACTCCT TGCGTCAGCA TAGCGCCGGC

151   ATTGTGGAAA CGGTCGGCAA GCCGTTGTCC GGTGCTGCGG TTGTCGGTCA

201   GGTTGAGGCG GATATTTTGG GCAACGCCTT TTATGTCGTA GCTGTATATA

251   TCCCTCGCGC CTTTGGGAGC GGGATAGCCG CCGCCCTGTG GCCCGTCATA

301   GCCGTCGGCG GGATGGTGTT CGTATCCGTC CCAATGGATG CGGTAAAGGC

351   TGAATCCGTC AACGGGACTA CCGGCTTCGT CAGAATCGGA ATGTGA
```

This corresponds to the amino acid sequence <SEQ ID 2274; ORF 686>:

```
g686.pep (partial)
   1 ..NFSCRADDVF DDICSAVEGF GGIARSVQLG AVSGGAFESV AYSLRQHSAG

  51   IVETVGKPLS GAAVVGQVEA DILGNAFYVV AVYIPRAFGS GIAAALWPVI

 101   AVGGMVFVSV PMDAVKAESV NGTTGFVRIG M*
```

The following partial DNA sequence was identified in *N. meningitidis* <SEQ ID 2275>:

```
m686.seq..
   1 ATGATGTTGA AAAAATTCGT ACTCGGCGGT ATTGCCGCAT TGGTTTTGGC

  51 GGCCTGCGGC GGTTCGGAAG GCGGCAGCGG AGCGNNNNNN NNNNNNAATT

 101 TCTCCTGCAG CGCCGATGAT GTTTTTAACG ATATCTGCAG TGCCGTTGAA

 151 GGCTTCGGCG GCATTGCCCG ATCTGTCCAG CTCGGGGCTG TATCGGGTGG

 201 CGCGTTTGAA TCCGTCGCCT ACTCCTTGCG TCAGCATACT ACCGGCATTG

 251 TGGAAACGGT CGGCAAGCCG TTGTCCGGTG CTGCGGTTGT CGGTCAGGTT

 301 GAGGCGGATA TTTTGGGCAA CGCCTTTTAT GTCGTAGCTG TATATATCCC

 351 TCGCGCCTTT GGGAGCGGGA TAGCCGCCGC CCTGTGGCCC GTCATAGCCG

 401 TCGGCGGGAT GGTGTTCGTA TCCGTCCCAA TGGATGCGGT AAAGGCTAAA

 451 TCCGTCAACG GGACTACCGG CTTCATCAGA ATCGGAATGT GA
```

This corresponds to the amino acid sequence <SEQ ID 2276; ORF 686>:

```
m686.pep
   1 MMLKKFVLGG IAALVLAACG GSEGGSGAXX XXNFSCSADD VFNDICSAVE

  51 GFGGIARSVQ LGAVSGGAFE SVAYSLRQHT TGIVETVGKP LSGAAVVGQV

 101 EADILGNAFY VVAVYIPRAF GSGIAAALWP VIAVGGMVFV SVPMDAVKAK

 151 SVNGTTGFIR IGM*
```

Computer analysis of this amino acid sequence gave the following results:

Homology with a Predicted ORF from *N. gonorrhoeae*

ORF 686 shows 95.4% identity over a 131 aa overlap with a predicted ORF (ORF 686) from *N. gonorrhoeae*

```
g686/m686  95.4% identity in 131 aa overlap

                                                      10        20        30
g686.pep                                      NFSCRADDVFDDICSAVEGFGGIARSVQLG
                                              |||| |||||:|||||||||||||||||||
m686          LKKFVLGGIAALVLAACGGSEGGSGAXXXXNFSCSADDVFNDICSAVEGFGGIARSVQLG
                      10        20        30        40        50        60

                      40        50        60        70        80        90
g686.pep      AVSGGAFESVAYSLRQHSAGIVETVGKPLSGAAVVGQVEADILGNAFYVVAVYIPRAFGS
              ||||||||||||||||::||||||||||||||||||||||||||||||||||||||||||
m686          AVSGGAFESVAYSLRQHTTGIVETVGKPLSGAAVVGQVEADILGNAFYVVAVYIPRAFGS
                      70        80        90       100       110       120

                     100       110       120       130
g686.pep      GIAAALWPVIAVGGMVFVSVPMDAVKAESVNGTTGFVRIGMX
              ||||||||||||||||||||||||||:||||||||:|||||
m686          GIAAALWPVIAVGGMVFVSVPMDAVKAKSVNGTTGFIRIGMX
                     130       140       150       160
```

The following partial DNA sequence was identified in *N. meningitidis* <SEQ ID 2277>

```
a686.seq (partial)
   1 ..AATTTCTCCT GCCGCGCCGA TGATGTTTTT GACGATATCT GCAGTGCCGT

  51   TGAAAGCTTC GGCGGCATTG CCCGATCTGT CCAGCTCGGG GCTGTATCGG

 101   GTGGCGCGTT TGAATCCGTC GCCTACTCCT TGCGTCAGCA TACTACCGGT

 151   ATTGTGGAAA CGGTCGACAA GCCGTTGTCC GGTGCTGCGG TTGTCGGTCA

 201   GGTTGAGGCG GATATTTTGG GCAACGCCTT TTATGTCGTA GCTGTATATA

 251   TCCCTCGCGC CTTTGGGAGC GGGATAGCCG CCGCCCTGTG GCCCGTCATA

 301   GCCGTCGGCG GGATGGTGTT CGTATCCGTC CCAATGGATG CGGTAAAGGC

 351   TGAATCCGTC AACGGGACTA CCGGCTTCAT CAGAATCGGA ATGTGA
```

This corresponds to the amino acid sequence <SEQ ID 2278; ORF 686.a>:

```
a686.pep (partial)
   1 ..NFSCRADDVF DDICSAVESF GGIARSVQLG AVSGGAFESV AYSLRQHTTG

  51   IVETVDKPLS GAAVVGQVEA DILGNAFYVV AVYIPRAFGS GIAAALWPVI

 101   AVGGMVFVSV PMDAVKAESV NGTTGFIRIG M*
```

Computer analysis of this amino acid sequence gave the following results:

Homology with a Predicted ORF from *N. meningitidis*

ORF 686 shows 96.2% identity over a 131 aa overlap with a predicted ORF (ORF 686) from *N. meningitidis*:

```
m686/a686  96.2%  identity in 131 aa overlap

                   10        20        30        40        50        60
M686.pep   LKKFVLGGIAALVLAACGGSEGGSGAXXXXNFSCSADDVFNDICSAVEGFGGIARSVQLG
                                         |||| |||||:|||||||:|||||||||||
a686                                     NFSCRADDVFDDICSAVESFGGIARSVQLG
                                                 10        20        30

                   70        80        90       100       110       120
m686.pep   AVSGGAFESVAYSLRQHTTGIVETVGKPLSGAAVVGQVEADILGNAFYVVAVYIPRAFGS
           |||||||||||||||||||||||| |||||||||||||||||||||||||||||||||||
a686       AVSGGAFESVAYSLRQHTTGIVETVDKPLSGAAVVGQVEADILGNAFYVVAVYIPRAFGS
                     40        50        60        70        80        90

                  130       140       150       160
m686.pep   GIAAALWPVIAVGGMVFVSVPMDAVKAKSVNGTTGFIRIGMX
           |||||||||||||||||||||||||||:||||||||||||||
a686       GIAAALWPVIAVGGMVFVSVPMDAVKAESVNGTTGFIRIGMX
                    100       110       120       130
```

The following partial DNA sequence was identified in *N. gonorrhoeae* <SEQ ID 2279>

```
g687.seq
   1 ATGAAATCCA GACACCTCGC CCTCGCCCTC GGCGTTGCCG CCCTGTTCGC

  51 CCTTGCCGCG TGCGACAGCA AAGTCCAAAC CAGCGTCCCC GCCGACAGCG

 101 CGCCTGCCGC TTCGGCAGCC GCCGCCCCGG CAGGACTGGT CGAAGGGCAA

 151 AACTACACCG TCCTTGCCAA CCCGATTCCC CAACAGCAGG CAGGCAAGGT

 201 TGAAGTGCTT GAGTTTTTCG GCTATTTTTG TCCGCACTGC GCCCGCCTcg

 251 AACCTGTTTT GAGCAAACAC GCCAAGTCTT TTAAAGACGA TATGTACCTG

 301 CGTACCGAAC ACGTCGTCTG GCAGAAAGAA ATGCTGCCGC TGGCACGCct

 351 cGCCGCCGCC GTCGATATGG CTGCCGCCGA AAGCAAAGAT GTGGCGAACA
```

-continued

```
401 GCCATATTTT CGATGCGATG GTCAACCAAA AAATCAAGCT GCAAGAGCCG

451 GAAGTCCTCA AAAAATGGCT GGGCGAACAa ACcgcctTTG ACGGCAAAAA

501 AGTCCTTGCC GCCTACGAAT CCCCCGAAAG TCAGGCGCGC GCcggcAAAA

551 TGCAGGAGCT GACCGAAACC TTCCAAATCG ACGGTACGCC CACGGTTATC

601 GTCGGCGGCA AATATAAAGT CGAATTTGCC GACTGGGAGT CCGGTATGAA

651 CACCATCGAC CTTTTGGCGG ACAAAGTACG TGAAGAACAA AAAGCCGCGC

701 AGTAG
```

This corresponds to the amino acid sequence <2280 ID 724; ORF 687>:

```
g687.pep
  1 MKSRHLALAL GVAALFALAA CDSKVQTSVP ADSAPAASAA AAPAGLVEGQ

 51 NYTVLANPIP QQQAGKVEVL EFFGYFCPHC ARLEPVLSKH AKSFKDDMYL

101 RTEHVVWQKE MLPLARLAAA VDMAAAESKD VANSHIFDAM VNQKIKLQEP

151 EVLKKWLGEQ TAFDGKKVLA AYESPESQAR AGKMQELTET FQIDGTPTVI

201 VGGKYKVEFA DWESGMNTID LLADKVREEQ KAAQ*
```

The following partial DNA sequence was identified in *N. meningitidis* <SEQ ID 2281>:

```
m687.seq
  1 ATGAAATCCA GACACCTTGC CCTCgGCGTT GCCGCCCTGT TCGCCCTTGC

 51 CGCGTGCGAC AGCAAAGTCC AAACCAGCGT CCCCGCCGAC AGCGCGCCTG

101 CCGCTTCGGC AGCCGCCGCC CCGGCAGGGC TGGTCGAAGG GCAAAACTAT

151 ACCGTCCTTG CCAACCCGAT TCCCCAACAG CAGGCAGGCA AAGTCGAAGT

201 CCTTGAGTTT TTCGGCTATT TCTGTCCGCA CTGCGCCCAC CTCGAACCTG

251 TTTTAAGCAA ACACGCCAAG TCTTTTAAAG ACGATATGTA CCTGCGTACC

301 GAACACGTCG TCTGGCAGAA AGAAATGCTG ACGCTGGCAC GCCTCGCCGC

351 CGCCGTCGAT ATGGCTGCCG CCGACAGCAA AGATGTGGCG AACAGCCATA

401 TTTTCGATGC GATGGTCAAC CAAAAAATCA AGCTGCAAAA TCCGGAAGTC

451 CTCAAAAAAT GGCTGGGCGA ACAAACCGCC TTTGACGGCA AAAAAGTCCT

501 TGCCGCCTAC GAGTCCCCCG AAAGCCAGGC GCGCGCCGAC AAAATGCAGG

551 AGCTGACCGA AACCTTCCAA ATCGACGGTA CGCCCACGGT TATCGTCGGC

601 GGTAAATATA AAGTTGAATT TGCCGACTGG GAGTCCGGTA TGAACACCAT

651 CGACCTTTTG GCGGACAAAG TACGCGAAGA ACAAAAAGCC GCGCAGTAA
```

This corresponds to the amino acid sequence <SEQ ID 2282; ORF 687>:

```
m687.pep
  1 MKSRHLALGV AALFALAACD SKVQTSVPAD SAPAASAAAA PAGLVEGQNY

 51 TVLANPIPQQ QAGKVEVLEF FGYFCPHCAH LEPVLSKHAK SFKDDMYLRT

101 EHVVWQKEML TLARLAAAVD MAAADSKDVA NSHIFDAMVN QKIKLQNPEV

151 LKKWLGEQTA FDGKKVLAAY ESPESQARAD KMQELTETFQ IDGTPTVIVG

201 GKYKVEFADW ESGMNTIDLL ADKVREEQKA AQ*
```

Computer analysis of this amino acid sequence gave the following results:

Homology with a Predicted ORF from *N. gonorrhoeae*

ORF 687 shows 97.0% identity over a 234 aa overlap with a predicted ORF (ORF 687) from *N. gonorrhoeae*:

```
m687/g687  97.0%  identity in 234 aa overlap

                    10        20        30        40        50
m687.pep  MKSRHLAL--GVAALFALAACDSKVQTSVPADSAPAASAAAAPAGLVEGQNYTVLANPIP
          ||||||||  ||||||||||||||||||||||||||||||||||||||||||||||||||
g687      MKSRHLALALGVAALFALAACDSKVQTSVPADSAPAASAAAAPAGLVEGQNYTVLANPIP
                  10        20        30        40        50        60

          60        70        80        90       100       110
m687.pep  QQQAGKVEVLEFFGYFCPHCAHLEPVLSKHAKSFKDDMYLRTEHVVWQKEMLTLARLAAA
          ||||||||||||||||||||:|||||||||||||||||||||||||||||||| ||||||
g687      QQQAGKVEVLEFFGYFCPHCARLEPVLSKHAKSFKDDMYLRTEHVVWQKEMLPLARLAAA
                  70        80        90       100       110       120

        120       130       140       150       160       170
m687.pep  VDMAAADSKDVANSHIFDAMVNQKIKLQNPEVLKKWLGEQTAFDGKKVLAAYESPESQAR
          ||||||:|||||||||||||||||||||:|||||||||||||||||||||||||||||||
g687      VDMAAAESKDVANSHIFDAMVNQKIKLQEPEVLKKWLGEQTAFDGKKVLAAYESPESQAR
                 130       140       150       160       170       180

         180       190       200       210       220       230
m687.pep  ADKMQELTETFQIDGTPTVIVGGKYKVEFADWESGMNTIDLLADKVREEQKAAQX
          | |||||||||||||||||||||||||||||||||||||||||||||||||||||
g687      AGKMQELTETFQIDGTPTVIVGGKYKVEFADWESGMNTIDLLADKVREEQKAAQX
                190       200       210       220       230
```

The following partial DNA sequence was identified in *N. meningitidis* <SEQ ID 2283>

```
a687.seq
   1 ATGAAATCCA AACACCTCGC CCTCGGCGTT GCCGCCCTGT TCGCACTTGC
  51 CGCGTGCGAC AGCAAAGTCC AAACCAGCGT CCCCGCCGAC AGCGCGCCTG
 101 CCGCTTCGGC AGCCGCCGCC CCGGCAGGGC TGGTCGAAGG GCAAAACTAT
 151 ACTGTCCTTG CCAACCCGAT TCCCCAACAG CAGGCAGGCA AAGTCGAAGT
 201 CCTTGAGTTT TTCGGCTATT TCTGTCCGCA CTGCGCCCAC CTCGAACCTG
 251 TTTTAAGCAA ACACGCCAAG TCTTTTAAAG ACGATATGTA CCTGCGTACC
 301 GAACACGTCG TCTGGCAGAA AGAAATGCTG ACGCTCGCAC GCCTCGCCGC
 351 CGCCGTCGAT ATGGCTGCCG CCGACAGCAA AGATGTGGCG AACAGCCATA
 401 TTTTCGATGC GATGGTCAAC CAAAAAATCA AGCTGCAAGA GCCGGAAGTC
 451 CTCAAAAAAT GGCTGGGCGA ACAAACCGCC TTTGACGGCA AAAAAGTCCT
 501 TGCCGCTTAC GAATCTCCCG AAAGCCAGGC GCGCGCCGAC AAAATGCAGG
 551 AGCTGACCGA AACCTTCCAA ATCGACGGTA CGCCCACGGT TATCGTCGGC
 601 GGCAAATATA AAGTCGAATT TGCCGACTGG GAGTCCGGTA TGAACACCAT
 651 CGACCTTTTG GCGGACAAAG TACGCGAAGA ACAAAAAGCC GCGCACTAA
```

This corresponds to the amino acid sequence <SEQ ID 2284; ORF 687.a>:

```
a687.pep
   1 MKSKHLALGV AALFALAACD SKVQTSVPAD SAPAASAAAA PAGLVEGQNY
  51 TVLANPIPQQ QAGKVEVLEF FGYFCPHCAH LEPVLSKHAK SFKDDMYLRT
 101 EHVVWQKEML TLARLAAAVD MAAADSKDVA NSHIFDAMVN QKIKLQEPEV
 151 LKKWLGEQTA FDGKKVLAAY ESPESQARAD KMQELTETFQ IDGTPTVIVG
```

-continued

```
201 GKYKVEFADW ESGMNTIDLL ADKVREEQKA AH*
```

Computer analysis of this amino acid sequence gave the following results:

Homology with a Predicted ORF from *N. meningitidis*

ORF 687 shows 98.7% identity over a 232 aa overlap with a predicted ORF (ORF 687) from *N. meningitidis*:

```
m687/a687  98.7%  identity in 232 aa overlap

                    10        20        30        40        50        60
m687.pep   MKSRHLALGVAALFALAACDSKVQTSVPADSAPAASAAAAPAGLVEGQNYTVLANPIPQQ
           |||:||||||||||||||||||||||||||||||||||||||||||||||||||||||||
a687       MKSKHLALGVAALFALAACDSKVQTSVPADSAPAASAAAAPAGLVEGQNYTVLANPIPQQ
                    10        20        30        40        50        60

                    70        80        90       100       110       120
m687.pep   QAGKVEVLEFFGYFCPHCAHLEPVLSKHAKSFKDDMYLRTEHVVWQKEMLTLARLAAAVD
           ||||||||||||||||||||||||||||||||||||||||||||||||||||||||||||
a687       QAGKVEVLEFFGYFCPHCAHLEPVLSKHAKSFKDDMYLRTEHVVWQKEMLTLARLAAAVD
                    70        80        90       100       110       120

                   130       140       150       160       170       180
m687.pep   MAAADSKDVANSHIFDAMVNQKIKLQNPEVLKKWLGEQTAFDGKKVLAAYESPESQARAD
           ||||||||||||||||||||||||:|||||||||||||||||||||||||||||||||||
a687       MAAADSKDVANSHIFDAMVNQKIKLQEPEVLKKWLGEQTAFDGKKVLAAYESPESQARAD
                   130       140       150       160       170       180

                   190       200       210       220       230
m687.pep   KMQELTETFQIDGTPTVIVGGKYKVEFADWESGMNTIDLLADKVREEQKAAQX
           |||||||||||||||||||||||||||||||||||||||||||||||||||:|
a687       KMQELTETFQIDGTPTVIVGGKYKVEFADWESGMNTIDLLADKVREEQKAAHX
                   190       200       210       220       230
```

The following partial DNA sequence was identified in *N. gonorrhoeae* <SEQ ID 2285>

```
g688.seq
  1 GTGCTACACT AGACATCCCG ATTTGCACAG AAAGGTTCTC CCGTGAACAA

 51 AACCCTCATC CTCGCCCTTT CCGCCCTGTT CAGCCTGACC GCGTGCAGCG

101 TCGAACGCGT CTCGCTGTTT CCCTCCTACA AACTCAAAAT CATCCAAGGC

151 AACGAACTCG AACCGCGCGC CGTTGCCGCC CTGCGCCCCG GCATGACCAA

201 AGACCAAGTC CTGCTCCTGC TCGGCAGCCC CATACTGCGC GACGCTTTCC

251 ATACCGACCG CTGGGACTAT ACCTTCAACA CCTCCCGCAA CGGCATCATC

301 AAAGAACGCA GCAACCTGAC CGTCTATTTT GAAAACGGCG TACTCGTCCG

351 CACCGAAGGC GACGCCCTCC AAAATGCCGC CGAAGCCCTC CGCGCGAAAC

401 AAAACGCAGA CAAACAATAA
```

This corresponds to the amino acid sequence <SEQ ID 2286; ORF 688>:

```
g688.pep
  1 VLH*TSRFAQ KGSPVNKTLI LALSALFSLT ACSVERVSLF PSYKLKIIQG

 51 NELEPRAVAA LRPGMTKDQV LLLLGSPILR DAFHTDRWDY TFNTSRNGII

101 KERSNLTVYF ENGVLVRTEG DALQNAAEAL RAKQNADKQ*
```

The following partial DNA sequence was identified in *N. meningitidis* <SEQ ID 2287>:

```
m688.seq
  1  GTGTTACACT ACCCATCCCG ATTTGCACAG AAAGGCATTT CCGTGAACAA
```

-continued

```
 51 AACCCTCATC CTCGCCCTTT CCGCCCTCCT CGGCCTTGCC GCGTGCAGTG

101 CCGAACGCGT TTCACTGTTC CCCTCGTACA AACTCAAAAT CATACAGGGC

151 AACGAACTCG AACCGCGCGC CGTTGCCGCC CTCCGCCCCG GCATGACCAA

201 AGACCAAGTC CTGCTCCTGC TCGGCAGCCC CATACTGCGC GACGCATTCC

251 ATACCGACCG CTGGGACTAT ACCTTCAACA CCTCCCGCAA CGGCATCATC

301 AAAGAACGCA GCAATCTGAC CGTCTATTTT GAAAACGGCG TACTCGTCCG

351 CACCGAAGGC GACGTCCTGC AAAACGCTGC CGAAGCCCTC AAAGACCGCC

401 AAAACACAGA CAAACCATAA
```

This corresponds to the amino acid sequence <SEQ ID 2288; ORF 688>:

```
m688.pep
  1 VLHYPSRFAQ KGISVNKTLI LALSALLGLA ACSAERVSLF PSYKLKIIQG

 51 NELEPRAVAA LRPGMTKDQV LLLLGSPILR DAFHTDRWDY TFNTSRNGII

101 KERSNLTVYF ENGVLVRTEG DVLQNAAEAL KDRQNTDKP*
```

Computer analysis of this amino acid sequence gave the following results:

Homology with a Predicted ORF from *N. gonorrhoeae*

ORF 688 shows 90.6% identity over a 138 aa overlap with a predicted ORF (ORF 688) from *N. gonorrhoeae*:

```
m688/g688  90.6%  identity in 138 aa overlap

                   10        20        30        40        50        60
m688.pep   VLHYPSRFAQKGISVNKTLILALSALLGLAACSAERVSLFPSYKLKIIQGNELEPRAVAA
           |||  |||||||  ||||||||||||::|:|||:|||||||||||||||||||||||||
g688       VLHXYSRFAQKGSPVNKTLILALSALFSLTACSVERVSLFPSYKLKIIQGNELEPRAVAA
                   10        20        30        40        50        60

                   70        80        90       100       110       120
m688.pep   LRPGMTKDQVLLLLGSPILRDAFHTDRWDYTFNTSRNGIIKERSNLTVYFENGVLVRTEG
           ||||||||||||||||||||||||||||||||||||||||||||||||||||||||||||
g688       LRPGMTKDQVLLLLGSPILRDAFHTDRWDYTFNTSRNGIIKERSNLTVYFENGVLVRTEG
                   70        80        90       100       110       120

                  130       140
m688.pep   DVLQNAAEALKDRQNTDKPX
           |:||||||||:  :||:||
g688       DALQNAAEALRAKQNADKQX
                  130       140
```

The following partial DNA sequence was identified in *N. meningitidis* <SEQ ID 2289>

```
a688.seq
  1 GTGTTACACT ACCCATCCCG ATTTGCACAG AAAGGCATTT CCGTGAACAA

 51 AACCCTCATC CTCGCCCTTT CCGCCCTCCT CGGCCTTGCC GCGTGCAGCG

101 TCGAACGCGT TTCACTGTTC CCCTCGTACA AACTCAAAAT CATACAGGGC

151 AACGAACTCG AACCTCGCGC CGTCGCCTCC CTCCGCCCCG GTATGACCAA

201 AGACCAAGTC CTGCTCCTGC TCGGCAGCCC CATACTGCGC GACGCATTCC

251 ATACCGACCG CTGGGACTAT ACCTTCAACA CCTCCCGCAA CGGCATCATC

301 AAAGACCGAA GCAATCTGAC CGTCTATTTT GAAAACGGCG TGCTCGTCCG

351 CACCGAAGGC AACGCCCTGC AAAATGCCGC CGAAGCCCTC CGCGTAAAAC

401 AAAACGCAGA CAAACAATAA
```

This corresponds to the amino acid sequence <SEQ ID 2290; ORF 688.a>:

```
a688.pep
   1 VLHYPSRFAQ KGISVNKTLI LALSALLGLA ACSVERVSLF PSYKLKIIQG

  51 NELEPRAVAS LRPGMTKDQV LLLLGSPILR DAFHTDRWDY TFNTSRNGII

 101 KDRSNLTVYF ENGVLVRTEG NALQNAAEAL RVKQNADKQ*
```

Computer analysis of this amino acid sequence gave the following results:

Homology with a Predicted ORF from *N. meningitidis*

ORF 688 shows 93.5% identity over a 138 aa overlap with a predicted ORF (ORF 688) from *N. meningitidis*

```
m688/g688 93.5% identity in 138 aa overlap

                  10        20        30        40        50        60
m688.pep VLHYPSRFAQKGISVNKTLILALSALLGLAACSAERVSLFPSYKLKIIQGNELEPRAVAA
         ||||||||||||||||||||||||||||||||:||||||||||||||||||||||||||:
a688     VLHYPSRFAQKGISVNKTLILALSALLGLAACSVERVSLFPSYKLKIIQGNELEPRAVAS
                  10        20        30        40        50        60

                  70        80        90       100       110       120
m688.pep LRPGMTKDQVLLLLGSPILRDAFHTDRWDYTFNTSRNGIIKERSNLTVYFENGVLVRTEG
         ||||||||||||||||||||||||||||||||||||||||:|||||||||||||||||||
a688     LRPGMTKDQVLLLLGSPILRDAFHTDRWDYTFNTSRNGIIKDRSNLTVYFENGVLVRTEG
                  70        80        90       100       110       120

                 130       140
m688.pep DVLQNAAEALKDRQNTDKPX
         ::||||||||: :||:||
a688     NALQNAAEALRVKQNADKQX
                 130       140
```

The following partial DNA sequence was identified in *N. gonorrhoeae* <SEQ ID 2291>

```
g689.seq (partial)
   1  ..TCTCCGCCCC TTCCTCCGAT GAGCGGAAAA CTGATGGCGG TTTTGATGGC

  51    GGTACTGGTC GCGCTGATGC CGTTTTCCAT CGATGCCTAC CTGCCCGCGA

 101    TTCCCGAAAT GGCGCAGCCG CTGAACGCGG ATATCCACCG TATCGAATAG

 151    AGTCTGAGTT TGTTTATGTT CGGCACGGCG TTCGGGCAAG TGGCCGGCGG

 201    CGCGGTGTCC GACATCAAAG GGCGCAAACC CGTCGCCCTG ACCGGTTTGA

 251    TTGTATATTG CCTTGCCGTT GCCGCCATCG TATTTGCTTC GAGTACCGAA

 301    CAGCTCCTTA ACCTGCGTGC GGTACAGGCG TTCGGCGCAG GCATGGCTGT

 351    AGTCATCGTc ggtgcgatgg tgcgcgatTA TTATTCCGGA CGCAAAGCCG

 401    cgcAGATGTT TGCCCTTATC GGCATCATTC TGATGGTTGT GCCGCTGGCC

 451    GCACCCATGG TCGGCGCATT GTTGCAGGGA TTGGGCGGAT GGCGGGCGAT

 501    TTTCGTTTTC ttggcGgcgT ATTCGCCGGT GCTGCCCGGT TTGGTACAGT

 551    ATTTCCTGCC CAATCCCGCC GTCGGCGGCA AAATCGGCAG GGATGTGTTC

 601    GGGCTGGTGG CGGGGCGGTT CAAGCGCGTA TTGAAAACCC GTGCCGCGAT

 651    GGGTtatCTG TTTTTTCAGG CATTCAGCTT CGGTTCGATG TTCGCCTTTC

 701    TGACCGAATC TTCCTTCGTG TACCGGCAGC TCTACCACGT TACGCCGCAC

 751    CGGTACGCAT GGGTGTTTGC ACTCAACATC ATCACGATGA TGTTTTTCAG

 801    CCGCGTTACC GCGTGGCGGC TTAAAACCGG CGCGCATCCG CAAAGCATCC

 851    TGCTGCGGGG GATTGTCGTC CAATTTGCCG CCAACCCGTC CCAACTCGCC
```

-continued

```
 901  GCCGTGCTGT TTTTCGGGTT GCCCCCGTTT TGGCTGCCGG TCGCGTGCGT
 951  GATGTTTTCC GTCGGTACGC AGGGCCTGGT CGGTGCGGAC ACGCAGGCAT
1001  GCTTTATGTC TTATTTCAAA GAAGAGGGCG GCAGCGCGAA CGCCGTGTCG
1051  GGTGTATTCC GGTCCTTAAT CGGCGCGGGC GTGGTCATGG CGGCAACCGT
1101  GATGGCGGCA ACCATGACCG CGTCCGCCTC TTGCGGCATT GCGCTTTTGT
1151  GGCTCTGCTC GCACAAGGCG TGGAAGGAAA ACGAAAAAAA GCGAATACTT
```

This corresponds to the amino acid sequence <SEQ ID 2292; ORF 689>:

```
g689.pep (partial)
  1 ..SPPLPPMSGK LMAVLMAVLV ALMPFSIDAY LPAIPEMAQP LNADIHRIE*
 51   SLSLFMFGTA FGQVAGGAVS DIKGRKPVAL TGLIVYCLAV AAIVFASSTE
101   QLLNLRAVQA FGAGMAVVIV GAMVRDYYSG RKAAQMFALI GIILMVVPLA
151   APMVGALLQG LGGWRAIFVF LAAYSPVLPG LVQYFLPNPA VGGKIGRDVF
201   GLVAGRFKRV LKTRAAMGYL FFQAFSFGSM FAFLTESSFV YRQLYHVTPH
251   RYAWVFALNI ITMMFFSRVT AWRLKTGAHP QSILLRGIVV QFAANPSQLA
301   AVLFFGLPPF WLPVACVMFS VGTQGLVGAD TQACFMSYFK EEGGSANAVS
351   GVFRSLIGAG VVMAATVMAA TMTASASCGI ALLWLCSHKA WKENEKKRIL
```

The following partial DNA sequence was identified in *N. meningitidis* <SEQ ID 2293>:

```
m689.seq
  1  TTGTTAATCC ACTATATCGT TCCGGTTCGT CCGGTTTTGC CGGGGCTTTT
 51  GTTGCCGCCT GTTTGTGCCG GTGTGTTAAA ATTTTCCGTT TCCGCGTATT
101  GTGTTTTCCG CCGCCGGGCG GTTTGTTTGC GAATCGGACG AGAATTTATG
151  CCTTCTGCCC ATTATCCTGA AATGAGCGAA AAACTGATGG CGGTTTTGAT
201  GGCGATGCTG GTTACGCTGA TGCCGTTTTC CATCGATGCC TACCTGCCCG
251  CGATTCCCGA AATGGCGCAA TCGCTGAACG CGGATGTTCA CCGCATCGAA
301  CAGAGTTTGA GTTTGTTTAT GTTCGGCACG GCGTTCGGAC AGGTGGTCGG
351  CGGTTCGGTG TCCGACATCA AAGGGCGCAA ACCCGTCGCC CTGACCGGTT
401  TGATTGTATA TTGCCTTGCC GTTGCCGCCA TCGTATTTGT TTCGAGTGCC
451  GAACAGCTCC TCAACCTGCG CGTCGTGCAG GCATTCGGTG CGGGCATGAC
501  TGTGGTCATC GTCGGCGCAA TGGTGCGCGA TTATTATTCC GGACGCAAAG
551  CCGCCCAGAT GTTTGCCCTT ATCGGCATCA TTTTGATGGT TGTGCCGCTG
601  GTCGCACCCA TGGTCGGCGC ATTGTTGCAG GGCTTGGGTG GCTGGCAGGC
651  GATTTTTGTT TTTCTGGCGG CGTATTCGCT GGTGCTGCTC GGTTTGGTAC
701  AGTATTTCCT GCCCAAGCCC GCCGTCGGCG GCAAAATCGG ACGGGACGTG
751  TTCGGGCTGG TGGCGGGGCG GTTCAAGCGC GTATTGAAAA CCCGTGCTGC
801  GATGGGTTAT CTGTTTTTTC AGGCATTCAG CTTCGGTTCG ATGTTCGCCT
851  TTCTGACCGA ATCTTCCTTC GTGTACCAGC AGCTCTACCG TGTTACGCCT
901  CATCAATACG CTTGGGCGTT TGCACTCAAC ATCATCACGA TGATGTTTTT
951  CAACCGCGTT ACCGCGTGGC GGCTCAAAAC CGGCGTGCAT CCGCAAAGCA
```

-continued

```
1001  TCCTGCTGTG GGGGATTGTC GTCCAGTTTG CCGCCAACCT GTCCCAACTC

1051  GCCGCCGTGC TGTTTTTCGG GTTGCCCCCG TTTTGGCTGC TGGTCGCGTG

1101  CGTGATGTTT TCCGTCGGTA CGCAGGGCTT GGTCGGTGCA AACACGCAGG

1151  CGTGTTTTAT GTCCTATTTC AAAGAAGAGG GCGGCAGCGC AAACGCCGTA

1201  TTGGGTGTAT TCCAATCTTT AATCGGCGCG GGGGTGGGTA TGGCGGCGAC

1251  CTTCTTGCAC GACGGTTCGG CAACCGTGAT GGCGGCAACG ATGACCGCGT

1301  CCACCTCTTG CGGCATTGCG CTTCTGTGGC TCTGCTCGCA TCGTGCGTGG

1351  AAAGAAAACG GGCAAAGCGA ATACCTTTAA
```

This corresponds to the amino acid sequence <SEQ ID 2294; ORF 689>:

```
m689.pep
  1 LLIHYIVPVR PVLPGLLLPP VCAGVLKFSV SAYCVFRRRA VCLRIGREFM

 51 PSAHYPEMSE KLMAVLMAML VTLMPFSIDA YLPAIPEMAQ SLNADVHRIE

101 QSLSLFMFGT AFGQVVGGSV SDIKGRKPVA LTGLIVYCLA VAAIVFVSSA

151 EQLLNLRVVQ AFGAGMTVVI VGAMVRDYYS GRKAAQMFAL IGIILMVVPL

201 VAPMVGALLQ GLGGWQAIFV FLAAYSLVLL GLVQYFLPKP AVGGKIGRDV

251 FGLVAGRFKR VLKTRAAMGY LFFQAFSFGS MFAFLTESSF VYQQLYRVTP

301 HQYAWAFALN IITMMFFNRV TAWRLKTGVH PQSILLWGIV VQFAANLSQL

351 AAVLFFGLPP FWLLVACVMF SVGTQGLVGA NTQACFMSYF KEEGGSANAV

401 LGVFQSLIGA GVGMAATFLH DGSATVMAAT MTASTSCGIA LLWLCSHRAW

451 KENGQSEYL*
```

Computer analysis of this amino acid sequence gave the following results:

Homology with a Predicted ORF from *N. gonorrhoeae*

ORF 689 shows 88.0% identity over a 408 aa overlap with a predicted ORF (ORF 689) from *N. gonorrhoeae*:

```
m689/a689 88.0% identity in 408 aa overlap

                  30        40        50        60        70        80
m689.pep  CAGVLKFSVSAYCVFRRRAVCLRIGREFMPSAHYPEMSEKLMAVLMAMLVTLMPFSIDAY
                                        |   | || ||||||||:||:|||||||||
g689                                    SPPLPPMSGKLMAVLMAVLVALMPFSIDAY
                                                10        20        30

                  90       100       110       120       130       140
m689.pep  LPAIPEMAQSLNADVHRIEQSLSLFMFGTAFGQVVGGSVSDIKGRKPVALTGLIVYCLAV
          ||||||||| ||||:|||| ||||||||||||||:||:||||||||||||||||||||||
g689      LPAIPEMAQPLNADIHRIEXSLSLFMFGTAFGQVAGGAVSDIKGRKPVALTGLIVYCLAV
                  40        50        60        70        80        90

                 150       160       170       180       190       200
m689.pep  AAIVFVSSAEQLLNLRVVQAFGAGMTVVIVGAMVRDYYSGRKAAQMFALIGIILMVVPLV
          |||||:||:|||||||:||||||||:|||||||||||||||||||||||||||||||||:
g689      AAIVFASSTEQLLNLRAVQAFGAGMAVVIVGAMVRDYYSGRKAAQMFALIGIILMVVPLA
                 100       110       120       130       140       150

                 210       220       230       240       250       260
m689.pep  APMVGALLQGLGGWQAIFVFLAAYSLVLLGLVQYFLPKPAVGGKIGRDVFGLVAGRFKRV
          ||||||||||||||:|||||||||| || ||||||||:||||||||||||||||||||||
g689      APMVGALLQGLGGWRAIFVFLAAYSPVLPGLVQYFLPNPAVGGKIGRDVFGLVAGRFKRV
                 160       170       180       190       200       210

                 270       280       290       300       310       320
m689.pep  LKTRAAMGYLFFQAFSFGSMFAFLTESSFVYQQLYRVTPHQYAWAFALNIITMMFFNRVT
          |||||||||||||||||||||||||||||||:|||:||||:|||:|||||||||||:|||
g689      LKTRAAMGYLFFQAFSFGSMFAFLTESSFVYRQLYHVTPHRYAWVFALNIITMMFFSRVT
                 220       230       240       250       260       270
```

-continued

```
              330       340       350       360       370       380
m689.pep  AWRLKTGVHPQSILLWGIVVQFAANLSQLAAVLFFGLPPFWLLVACVMFSVGTQGLVGAN
          |||||||:||||||| ||||||||| |||||||||||||||| ||||||||||||||||:
g689      AWRLKTGAHPQSILLRGIVVQFAANPSQLAAVLFFGLPPFWLPVACVMFSVGTQGLVGAD
               280       290       300       310       320       330

              390       400       410       420       430       440
m689.pep  TQACFMSYFKEEGGSANAVLGVFQSLIGAGVGMAATFLHDGSATVMAATMTASTSCGIAL
          |||||||||||||||||| |||:||||||| ||||        ||||||||||||||||
g689      TQACFMSYFKEEGGSANAVSGVFRSLIGAGVVMAAT--------VMAATMTASASCGIAL
               340       350       360                 370       380

              450       460
m689.pep  LWLCSHRAWKENGQSEYLX
          ||||||:||||| ::: |
g689      LWLCSHKAWKENEKKRIL
             390       400
```

The following partial DNA sequence was identified in *N. meningitidis* <SEQ ID 2295>

```
a689.seq
   1  TTGTTAATCC ACTATATCGT TCCGGTTCGT CCGGTTTTGC CGGGGCTTTT

  51  GTTGCCGCCT GTTTGTGCCG GTGTGTTAAA ATTTTCCGTT TCCGCGTATT

 101  GTGTTTTCCG CCGCCGGGCG GTTTGTTTGC GAATCGGACG AGAATTTATG

 151  CCTTCTGCCC ATTATCCTGA AATGAGCGAA AAACTGATGG CGGTTTTGAT

 201  GGCGATGCTG GTTACGCTGA TGCCGTTTTC CATCGATGCC TACCTGCCCG

 251  CGATTCCCGA AATGGCGCAG TCGCTGAACG CGGATGTCCA CCGCATCGAA

 301  CAGAGCCTGA GTTTGTTTAT GTTCGGCACG GCGTTCGGAC AGGTGGTCGG

 351  CGGTTCGGTG TCCGACATCA AAGGGCGCAA ACCCGTCGCG CTGACCGGAC

 401  TGGCCGTCTA CTGCCTTGCC GTTGCCGCCA TCGTATTTGC TTCGAGTGCC

 451  GAACAGCTCC TCAACCTGCG CGTCGTGCAG GCATTCGGTG CGGGCATGAC

 501  TGTGGTCATC GTCGGCGCAA TGGTGCGCGA TTATTATTCC GGACGCAAAG

 551  CCGCCCAGAT GTTTGCCCTT ATCGGCATCA TTTTGATGGT TGTGCCGCTG

 601  GTCGCACCCA TGGTCGGCGC ATTGTTGCAG GGCTTGGGTG GCTGGCAGGC

 651  GATTTTTGTT TTTCTGGCGG CGTATTCGCT GGTGCTGCTC GGTTTGGTAC

 701  AGTATTTCCT GCCCAAGCCC GCCGTCGGCG GCAAAATCGG CAGGGATGTG

 751  TTCGGGCTGG TGGCTGGGCG GTTCAAACGC GTATTGAAAA CCCGTGCCGC

 801  GATGGGTTAT CTGTTTTTTC AGGCATTCAG CTTCGGTTCG ATGTTCGCCT

 851  TTCTGACCGA ATCTTCCTTC GTGTACCAGC AGCTCTACCA CGTTACGCCG

 901  CACCAGTACG CTTGGGCGTT TGCACTCAAC ATCATCACGA TGATGTTTTT

 951  CAACCGTATT ACCGCGTGGC GGCTCAAAAC CGGCGTGCAT CCGCAAAGCA

1001  TCCTGCTGTG GGGGATTGTC GTCCAGTTTG CCGCCAACCT GTCCCAACTC

1051  GCCGCCGTGC TGTTTTTCGG GTTGCCCCCG TTTTGGCTGC TGGTCGCGTG

1101  CGTGATGTTT TCCGTCGGTA CGCAGGGCTT GGTCGGTGCA AACACGCAGG

1151  CGTGTTTTAT GTCCTATTTC AAAGAAGAGG GCGGCAGCGC AAACGCCGTA

1201  TTGGGTGTAT TCCAATCTTT AATCGGCGCG GGGGTGGGTA TGGCGGCGAC

1251  CTTCTTGCAC GACGGTTCGG CAACCGTGAT GGCGGCAACC ATGACCGCGT

1301  CTACCTCTTG CGGCATTGCG CTTTTGTGGC TCTGCTCGCA TCGTGCGTGG

1351  AAAGAAAACG GCAAAGCGA ATACCTTTAA
```

This corresponds to the amino acid sequence <SEQ ID 2296; ORF 689.a>:

```
a689.pep
   1 LLIHYIVPVR PVLPGLLLPP VCAGVLKFSV SAYCVFRRRA VCLRIGREFM

  51 PSAHYPEMSE KLMAVLMAML VTLMPFSIDA YLPAIPEMAQ SLNADVHRIE

 101 QSLSLFMFGT AFGQVVGGSV SDIKGRKPVA LTGLAVYCLA VAAIVFASSA

 151 EQLLNLRVVQ AFGAGMTVVI VGAMVRDYYS GRKAAQMFAL IGIILMVVPL

 201 VAPMVGALLQ GLGGWQAIFV FLAAYSLVLL GLVQYFLPKP AVGGKIGRDV

 251 FGLVAGRFKR VLKTRAAMGY LFFQAFSFGS MFAFLTESSF VYQQLYHVTP

 301 HQYAWAFALN IITMMFFNRI TAWRLKTGVH PQSILLWGIV VQFAANLSQL

 351 AAVLFFGLPP FWLLVACVMF SVGTQGLVGA NTQACFMSYF KEEGGSANAV

 401 LGVFQSLIGA GVGMAATFLH DGSATVMAAT MTASTSCGIA LLWLCSHRAW

 451 KENGQSEYL*
```

Computer analysis of this amino acid sequence gave the following results:

Homology with a Predicted ORF from *N. meningitidis*

ORF 689 shows 99.1% identity over a 459 aa overlap with a predicted ORF (ORF 689) from *N. meningitidis*:

```
m689/a689 99.1% identity in 459 aa overlap

                   10        20        30        40        50        60
m689.pep   LLIHYIVPVRPVLPGLLLPPVCAGVLKFSVSAYCVFRRRAVCLRIGREFMPSAHYPEMSE
           ||||||||||||||||||||||||||||||||||||||||||||||||||||||||||||
a689       LLIHYIVPVRPVLPGLLLPPVCAGVLKFSVSAYCVFRRRAVCLRIGREFMPSAHYPEMSE
                   10        20        30        40        50        60

                   70        80        90       100       110       120
m689.pep   KLMAVLMAMLVTLMPFSIDAYLPAIPEMAQSLNADVHRIEQSLSLFMFGTAFGQVVGGSV
           ||||||||||||||||||||||||||||||||||||||||||||||||||||||||||||
a689       KLMAVLMAMLVTLMPFSIDAYLPAIPEMAQSLNADVHRIEQSLSLFMFGTAFGQVVGGSV
                   70        80        90       100       110       120

                  130       140       150       160       170       180
m689.pep   SDIKGRKPVALTGLIVYCLAVAAIVFVSSAEQLLNLRVVQAFGAGMTVVIVGAMVRDYYS
           ||||||||||||||||||||||||||:||||||||||||||||||||||| ||||||||
a689       SDIKGRKPVALTGLIVYCLAVAAIVFASSAEQLLNLRVVQAFGAGMTVVIVGAMVRDYYS
                  130       140       150       160       170       180

                  190       200       210       220       230       240
m689.pep   GRKAAQMFALIGIILMVVPLVAPMVGALLQGLGGWQAIFVFLAAYSLVLLGLVQYFLPKP
           ||||||||||||||||||||||||||||||||||||||||||||||||||||||||||||
a689       GRKAAQMFALIGIILMVVPLVAPMVGALLQGLGGWQAIFVFLAAYSLVLLGLVQYFLPKP
                  190       200       210       220       230       240

                  250       260       270       280       290       300
m689.pep   AVGGKIGRDVFGLVAGRFKRVLKTRAAMGYLFFQAFSFGSMFAFLTESSFVYQQLYRVTP
           ||||||||||||||||||||||||||||||||||||||||||||||||||||||||:|||
a689       AVGGKIGRDVFGLVAGRFKRVLKTRAAMGYLFFQAFSFGSMFAFLTESSFVYQQLYHVTP
                  250       260       270       280       290       300

                  310       320       330       340       350       360
m689.pep   HQYAWAFALNIITMMFFNRVTAWRLKTGVHPQSILLWGIVVQFAANLSQLAAVLFFGLPP
           |||||||||||||||||||:||||||||||||||||||||||||||||||||||||||||
a689       HQYAWAFALNIITMMFFNRITAWRLKTGVHPQSILLWGIVVQFAANLSQLAAVLFFGLPP
                  310       320       330       340       350       360

                  370       380       390       400       410       420
m689.pep   FWLLVACVMFSVGTQGLVGANTQACFMSYFKEEGGSANAVLGVFQSLIGAGVGMAATFLH
           ||||||||||||||||||||||||||||||||||||||||||||||||||||||||||||
a689       FWLLVACVMFSVGTQGLVGANTQACFMSYFKEEGGSANAVLGVFQSLIGAGVGMAATFLH
                  370       380       390       400       410       420

                  430       440       450       460
m689.pep   DGSATVMAATMTASTSCGIALLWLCSHRAWKENGQSEYLX
           ||||||||||||||||||||||||||||||||||||||||
a689       DGSATVMAATMTASTSCGIALLWLCSHRAWKENGQSEYLX
                  430       440       450       460
```

The following partial DNA sequence was identified in *N. gonorrhoeae* <SEQ ID 2297>

```
g690.seq (partial)
   1 ATGAAAAACA AAACGTCATC ACTTCCCTTA TGGCTTGCCG CAATCATGCT

  51 GGCCGCGCGT TCCCCGAGCA AAGAAGATAA AACGAAAGAA AACGGCGCAT

 101 CCGCCGCTTC GTCTTCCGCG TCATCGGCTT CTTCCCAAAC CGATTTGCAA

 151 CCGGCCGCAT CCGCCCCTGA TAACGTCAAG CAGGCAGAAA GCGCGCCACT

 201 GTGAAATTGC ACCGGCCTGC ACCCCGCCGC CGGCATTGGC GATCTCATAC

 251 AGCAAATCGC CGAACACATC GACTCGGACT GTCTGTTTGC CCTTTCCCAT

 301 AACGAACTGG AAACCCGTTT CGGCTTACCC GGCGGCGGCT ATGACAACAT

 351 ACAGCGGctG CTgtttCCCG ACATCCGCCC TGAAGATCCC GACTACCATC

 401 AGAAAATCAT GCTGGCAATC GAAGACTTGC GTTACGGAAC GCGCACCATC

 451 AGccgGCAGG CACAAGATGC CATAATGGAA CAGGAACGCC gcctccGaGa

 501 agCGACGCTG ATGCTGACAC AGGGCAGTCA AAAAACCCGC GGaCAAGGCG

 551 AGGAACCGAA ACGCGCACGT TATTTTGAAG TTTCGGCAAC ATCtgCCtaT

 601 TTgaaccggC ACAAcaacGG ACTTggcgGC AATTTCCAAT ACATCGGCCA

 651 ATTGCCCGGC TATCTGAAAA TGCACGGAGA AATGCTTGAA AACCAATCAC

 701 TCTTCCGGCT GTCCAACCGT GAACGCAATC CCGACAAACC GTTTTTAGAC

 751 ATCCATTTTG ACGAAAATGG CAAAATCACG CGTATTGTCG TTTACGAAAA

 801 AAATATCTAT...
```

This corresponds to the amino acid sequence <SEQ ID 2298; ORF 690>:

```
g690.pep (partial)
   1 MKNKTSSLPL WLAAIMLAAR SPSKEDKTKE NGASAASSSA SSASSQTDLQ

  51 PAASAPDNVK QAESAPL*NC TGLHPAAGIG DLIQQIAEHI DSDCLFALSH

 101 NELETRFGLP GGGYDNIQRL LFPDIRPEDP DYHQKIMLAI EDLRYGTRTI

 151 SRQAQDAIME QERRLREATL MLTQGSQKTR GQGEEPKRAR YFEVSATSAY

 201 LNRHNNGLGG NFQYIGQLPG YLKMHGEMLE NQSLFRLSNR ERNPDKPFLD

 251 IHFDENGKIT RIVVYEKNIY ...
```

The following partial DNA sequence was identified in *N. meningitidis* <SEQ ID 2299>:

```
m690.seq..
   1 ATGAAAAACA AAACCTCATC ACTTCTCTTA TGGCTTACCG CAATCATGCT

  51 GACCGCGTGT TCTCCGAGCA AAGACGATAA AACCAAAGAA GTCGGTGCAT

 101 CCGCTGCTTC GTCCTCCGCG TCATCAGCTC CTTCCCAAAC CGATTTGCAA

 151 CCGACCGCAT CCGCCCCTGA TAACGTCAAG CAGGCAGAAA GCGCGCCGCC

 201 GTCAAATTGC ACCAGCCTGC ACCCCGCCAC CGGCATTGAC GATCTCATGC

 251 AGCAAATCGC CGAACACATT GACTCGGACT GTCTGTTTGC CCTTTCCCAT

 301 CACGAACTGG AAACCCGTTT CGGCTTACCC GACGGTGGCT ATGACAACAT

 351 ACAGCGGCTG CTGTTTCCCG ACATCCGCCC TGAAGATCCC GACTACCATC

 401 AGAAAATCAT ACTGGCAATT GAAGACTTGC GTTACGGAAA GCGCACGATC

 451 AGCCGGCAGG CACAAAATGC CTTGATGGAA CAGGAACGCC GCCTCCGAGA

 501 AGCGACGCTG TTGCTGATAC AGGGCAGTCA AGAAACCCGC GGACAAGGCG
```

-continued

```
551 AGGAGCCGAA ACGCACGCGT TATTTTGAAG TTTCGGCAAC CCCTGCCTAT

601 TCGAGCCGGC ACAACAACGG ACTTGGCGGC AATTTCCAAT ACATCAGCCA

651 ATTGCCCGGC TATCTGAAAA TACACGGAGA AATGCTTGAA AACCAATCAC

701 TCTTCCGGCT GTCCAACCGT GAACGCAATC CCGACAAACC GTTTTTAGAC

751 ATCCATTTTG ACGAAAATGG CAAAATCACG CGTATTGTCG TTTACGAAAA

801 AAACATCTAC TTCAATCCAA ACACGGGGCG AATATAA
```

This corresponds to the amino acid sequence <SEQ ID 2300; ORF 690>:

```
m690.pep
  1 MKNKTSSLLL WLTAIMLTAC SPSKDDKTKE VGASAASSSA SSAPSQTDLQ

 51 PTASAPDNVK QAESAPPSNC TSLHPATGID DLMQQIAEHI DSDCLFALSH

101 HELETRFGLP DGGYDNIQRL LFPDIRPEDP DYHQKIILAI EDLRYGKRTI

151 SRQAQNALME QERRLREATL LLIQGSQETR GQGEEPKRTR YFEVSATPAY

201 SSRHNNGLGG NFQYISQLPG YLKIHGEMLE NQSLFRLSNR ERNPDKPFLD

251 IHFDENGKIT RIVVYEKNIY FNPNTGRI*
```

Computer analysis of this amino acid sequence gave the following results:

Homology with a Predicted ORF from *N. gonorrhoeae*

ORF 690 shows 89.3% identity over a 408 aa overlap with a predicted ORF (ORF 690) from *N. gonorrhoeae*:

```
m690/g690 89.3% identity in 408 aa overlap

                   10        20        30        40        50        60
m690.pep  MKNKTSSLLLWLTAIMLTACSPSKDDKTKEVGASAASSSASSAPSQTDLQPTASAPDNVK
          |||||||| |||:||||:| ||||:||||| |||||||||||| |||||||:||||||||
g690      MKNKTSSLPLWLAAIMLAARSPSKEDKTKENGASAASSSASSASSQTDLQPAASAPDNVK
                   10        20        30        40        50        60

                   70        80        90       100       110       120
m690.pep  QAESAPPSNCTSLHPATGIDDLMQQIAEHIDSDCLFALSHHELETRFGLPDGGYDNIQRL
          ||||||  |||:||||:|| ||:|||||||||||||||||:||||||||| |||||||||
g690      QAESAPLXNCTGLHPAAGIGDLIQQIAEHIDSDCLFALSHNELETRFGLPGGGYDNIQRL
                   70        80        90       100       110       120

                  130       140       150       160       170       180
m690.pep  LFPDIRPEDPDYHQKIILAIEDLRYGKRTISRQAQNALMEQERRLREATLLLIQGSQETR
          ||||||||||||||||:||||||||| ||||||||:|:||||||||||||:| ||||:||
g690      LFPDIRPEDPDYHQKIMLAIEDLRYGTRTISRQAQDAIMEQERRLREATLMLTQGSQKTR
                  130       140       150       160       170       180

                  190       200       210       220       230       240
m690.pep  GQGEEPKRTRYFEVSATPAYSSRHNNGLGGNFQYISQLPGYLKIHGEMLENQSLFRLSNR
          ||||||||:|||||||| || :|||||||||||||:|||||||:||||||||||||||||
g690      GQGEEPKRARYFEVSATSAYLNRHNNGLGGNFQYIGQLPGYLKMHGEMLENQSLFRLSNR
                  190       200       210       220       230       240

                  250       260       270      279
m690.pep  ERNPDKPFLDIHFDENGKITRIVVYEKNIYFNPNTGRIX
          ||||||||||||||||||||||||||||||
g690      ERNPDKPFLDIHFDENGKITRIVVYEKNIY
                  250       260       270
```

The following partial DNA sequence was identified in *N. meningitidis* <SEQ ID 2301>

```
a690.seq
  1 ATGAAAAACA AAACCTCATC ACTTCTCTTA TGGCTTGCCG CAATGATGCT

 51 GACCGCGTGT TCCCCGAGCA AAGAAGATAA AACGAAAGAA AACGGCGCAT

101 CCGCCGCCTC GTCCACGGCA TCCGCCGCTT CGTCTTCCGC GCCCCAAACC
```

-continued

```
151 GATTTGCAAC CGGCCGCATC CGCCCCTGAT AACGTCAAGC AGGCAGAAAG

201 CGTGCCGCCG TCAAATTGCA CCGACCTGCA CCCCGCCACC GGCATTGACG

251 ATCTCATGCA GCAAATCGCC GAACACATTG ACTCGGACTG TCTGTTTGCC

301 CTTTCCCATC ACGAACTGGA AACCCGTTTC GGCTTACCCG GCGGCGGCTA

351 TGACAACATA CAGCGGCTGC TGTTTCCCGA CATCCGCCCT GAAGATCCCG

401 ACTACCATCA GAAAATCATA CTGGCAATTG AAGACTTGCG TTACGGAAAG

451 CGCACGATCA GCCGGCAGGC ACAAGATGCC TTGATGGAAC AGGAACGCCG

501 CCTCCGAGAA GCGACGCTGT TGCTGATACA GGGCAGTCAA GAAACCCGCG

551 GACAAGGCGA GGAGCCGAAA CGCACGCGTT ATTTTGAAGT TTCGGCAACC

601 CCTGCCTATT CGAGCCGGCA CAACAACGGA CTTGGCGGCA ATTTCCAATA

651 CATCGGCCAA TTGCCCGGCT ATCTGAAAAT ACACGGAGAA ATGCTTGAAA

701 ACCAATCACT CTTCCGGCTG TCCAACCGTG AACGCAATCC CGACAAACCG

751 TTTTTAGACA TCCATTTTGA CGAAAATGGC AAAATCACGC GTATTGTCGT

801 TTACGAAAAA AACATCTACT TCAATCCAAA CTTGGGGCGA AGATAA
```

This corresponds to the amino acid sequence <SEQ ID 2302; ORF 690.a>:

```
a690.pep
  1 MKNKTSSLLL WLAAMMLTAC SPSKEDKTKE NGASAASSTA SAASSSAPQT

 51 DLQPAASAPD NVKQAESVPP SNCTDLHPAT GIDDLMQQIA EHIDSDCLFA

101 LSHHELETRF GLPGGGYDNI QRLLFPDIRP EDPDYHQKII LAIEDLRYGK

151 RTISRQAQDA LMEQERRLRE ATLLLIQGSQ ETRGQGEEPK RTRYFEVSAT

201 PAYSSRHNNG LGGNFQYIGQ LPGYLKIHGE MLENQSLFRL SNRERNPDKP

251 FLDIHFDENG KITRIVVYEK NIYFNPNLGR R*
```

Computer analysis of this amino acid sequence gave the following results:

Homology with a Predicted ORF from *N. meningitidis*

ORF 690 shows 93.9% identity over a 280 aa overlap with a predicted ORF (ORF 690) from *N. meningitidis*:

```
m690/a690 93.9% identity in 280 aa overlap

                      10        20        30        40           50
m690.pep     MKNKTSSLLLWLTAIMLTACSPSKDDKTKEVGASAASSSASSAPS---QTDLQPTASAPD
             |||||||| |||:|:|||||||||:||||| |||||||:||:| |   ||||||:|||||
a690         MKNKTSSLPLWLAAMMLTACSPSKEDKTKENGASAASSTASAASSSAPQTDLQRAASAPD
                      10        20        30        40        50        60

               60        70        80        90       100       110
m690.pep     NVKQAESAPPSNCTSLHPATGIDDLMQQIAEHIDSDCLFALSHHELETRFGLPDGGYDNI
             |||||||:||||||:|||||||||||||||||||||||||||||||||||||| ||||||
a690         NVKQAESVPPSNCTDLHPATGIDDLMQQIAEHIDSDCLFALSHHELETRPGLPGGGYDNI
                      70        80        90       100       110       120

              120       130       140       150       160       170
m690.pep     QRLLFPDIRPEDPDYHQKIILAIEDLRYGKRTISRQAQNALMEQERRLREATLLLIQGSQ
             ||||||||||||||||||||||||||||||||||||||:|||||||||||||||||||||
a690         QRLLFPDIRPEDPDYHQKIILAIEDLRYGKRTISRQAQDALMEQERRLREATLLLIQGSQ
                     130       140       150       160       170       180

              180       190       200       210       220       230
m690.pep     ETRGQGEEPKRTRYFEVSATPAYSSRHNNGLGGNFQYISQLPGYLKIHGEMLENQSLFRL
             ||||||||||||||||||||||||||||||||||||||:|||||||||||||||||||||
a690         ETRGQGEEPKRTRYFEVSATPAYSSRHNNGLGGNFQYIGQLPGYLKIHGEMLENQSLFRL
                     190       200       210       220       230       240
```

-continued

```
             240        250        260        270       279
m690.pep     SNRERNPDKPFLDIHFDENGKITRIVVYEKNIYFNPNTGRIX
             |||||||||||||||||||||||||||||||||||||| ||
a690         SNRERNPDKPFLDIHFDENGKITRIVVYEKNIYFNPNLGRRX
                    250        260        270       280
```

The following partial DNA sequence was identified in *N. gonorrhoeae* <SEQ ID 2303>

```
g691.seq
   1 GTGCCGCTGC CTGCTCCCTG CCGTTTTGCC AAACCTGCCG CCTCTTTTTT

  51 AAGTATGGCT TTGCTTTCCT GCCAGCTTTC CCACGCCGCC ACGGCTTATA

 101 TCCCCCCGAA CGATTTTCAA CCGAACTGCG ACATACGCCG GCTCGGGCTG

 151 ACACAGGGTC AGCACAATGA GCTGCGTAAA ATCCGCGCCG CCTTCAAAAT

 201 GGCGGGCGAC AGGGCGCGTT TGAAGGTTAT GCATTCCGAA CACAGCCGCC

 251 GCCGCTCTGT CGTCGAAATC ATTTCTTCGG ATGTTTTTAA TCGGAACGAG

 301 GCGCGCGATT ATGTCGAAAG CCGCTACCAC TCCAGCATGG ATTTTGCGGT

 351 GGACGAATTG GAAATCCAAC ACCGCTTCTT CCATATTCTC ACACCGCAAC

 401 AGCAGCAAAT GTGGCTTTCT TCCTGCCTCA AATAA
```

This corresponds to the amino acid sequence <SEQ ID 2304; ORF 691>:

```
g691.pep
   1 VPLPAPCRFA KPAASFLSMA LLSCQLSHAA TAYIPPNDFQ PNCDIRRLGL

  51 TQGQHNELRK IRAAFKMAGD RARLKVMHSE HSRRRSVVEI ISSDVFNRNE

 101 ARDYVESRYH SSMDFAVDEL EIQHRFFHIL TPQQQQMWLS SCLK*
```

The following partial DNA sequence was identified in *N. meningitidis* <SEQ ID 2305>:

```
m691.seq
   1 GTGCCACTGC CTGCTCCCTG CCGTTTTGCC AAACCTGCCG CCTCTTTTTT

  51 AAGTATGGCT TTGCTTTCCT GTCAGCTTTC CCACGCCGCC ACGGCTTATA

 101 TCCCCCCGAA CGATTTTCAA CCGAACTGCG ACATACGCCG ACTCGGGCTG

 151 ACCCAAAGTC AGCACAATGA GCTGCGTAAA ATCCGCACCG CCTTCAAAAT

 201 GGCGGGCGAC AGGGCGCGTT TGAAGGTTAT GCATTCCGAA CACAGCCGCC

 251 GCCGGTCTGT CGTCGAAATC ATTTCCTCGG ATGTTTTTAA TCGGAACGAG

 301 GCGCGCGATT ATGTCGAAAG CCGCTATTTG TCCGGTATGG ATTTTGCGGT

 351 GGACGAATTG GAAATCCAAC ACCGGTTCTT CCATATCCTC ACACCGCAAC

 401 AGCAGCAAAT GTGGCTTTCT TCCTGCCTCA AATAA
```

This corresponds to the amino acid sequence <SEQ ID 2306; ORF 691>:

```
m691.pep
   1 VPLPAPCRFA KPAASFLSMA LLSCQLSHAA TAYIPPNDFQ PNCDIRRLGL

  51 TQSQHNELRK IRTAFKMAGD RARLKVMHSE HSRRRSVVEI ISSDVFNRNE

 101 ARDYVESRYL SGMDFAVDEL EIQHRFFHIL TPQQQQMWLS SCLK*
```

Computer analysis of this amino acid sequence gave the following results:

Homology with a Predicted ORF from *N. gonorrhoeae*

ORF 691 shows 97.2% identity over a 144 aa overlap with a predicted ORF (ORF 691) from *N. gonorrhoeae*:

```
m691/g691 97.2% identity in 144 aa overlap

                  10        20        30        40        50        60
m691.pep  VPLPAPCRFAKPAASFLSMALLSCQLSHAATAYIPPNDFQPNCDIRRLGLTQSQHNELRK
          ||||||||||||||||||||||||||||||||||||||||||||||||||||:|||||||
g691      VPLPAPCRFAKPAASFLSMALLSCQLSHAATAYIPPNDFQPNCDIRRLGLTQGQHNELRK
                  10        20        30        40        50        60

                  70        80        90       100       110       120
m691.pep  IRTAFKMAGDRARLKVMHSEHSRRRSVVEIISSDVFNRNEARDYVESRYLSGMDFAVDEL
          ||:||||||||||||||||||||||||||||||||||||||||||||||||| |:||||||||
g691      IRAAFKMAGDRARLKVMHSEHSRRRSVVEIISSDVFNRNEARDYVESRYHSSMDFAVDEL
                  70        80        90       100       110       120

                 130       140
m691.pep  EIQHRFFHILTPQQQQMWLSSCLKX
          ||||||||||||||||||||||||
g691      EIQHRFFHILTPQQQQMWLSSCLKX
                 130       140
```

The following partial DNA sequence was identified in *N. meningitidis* <SEQ ID 2307>

```
a691.seq
  1 GTGCCACTGC NTGCTCCCTG CCGTTTTGCC AAACCTGCCG CCTCTTTTTT

 51 AAGTATGGCT TTGCTTTCCT GCCAGCTTTC CCACGCCGCC ACGGCTTATA

101 TCCCCCTGAA CGATTTTCAA CCGAACTGCG ACATACGCCG GCTCGGACTG

151 ACACAGGGTC AGCACAATGA ACTGCGTAAA ATCCGCGCCG CCTTCAAAAT

201 GGCGGGCGAC AGGGCGCGTT TGAAGGTTAT GCATTCCGAA CACAGCCGCC

251 GTCGGTCTGT CGTCGAAATC ATTTCCTCGG ATGTTTTTAA TCGGAACGAG

301 GCGCGCGATT ATGTCGAAAG CCGCTATTTG TCCGGTATGG ATTTTGCGGT

351 GGACGAATTG GAAATCCAAC ACCGGTTCTT CCATATCCTC ACACCGCAAC

401 AGCAGCAAAT GTGGCTTTCT TCCTGCCTCA AATAA
```

This corresponds to the amino acid sequence <SEQ ID 2308; ORF 691.a>:

```
a691.pep
  1 VPLXAPCRFA KPAASFLSMA LLSCQLSHAA TAYIPLNDFQ PNCDIRRLGL

 51 TQGQHNELRK IRAAFKMAGD RARLKVMHSE HSRRRSVVEI ISSDVFNRNE

101 ARDYVESRYL SGMDFAVDEL EIQHRFFHIL TPQQQQMWLS SCLK*
```

Computer analysis of this amino acid sequence gave the following results:

Homology with a Predicted ORF from *N. meningitidis*

ORF 691 shows 97.2% identity over a 144 aa overlap with a predicted ORF (ORF 691) from *N. meningitidis*:

```
m691/a691  97.2%  identity in 144 aa overlap

                  10        20        30        40        50        60
m691.pep  VPLPAPCRFAKPAASFLSMALLSCQLSHAATAYIPPNDFQPNCDIRRLGLTQSQHNELRK
          ||| ||||||||||||||||||||||||||||||| ||||||||||||||||:|||||||
a691      VPLXAPCRFAKPAASFLSMALLSCQLSHAATAYIPLNDFQPNCDIRRLGLTQGQHNELRK
                  10        20        30        40        50        60
```

-continued

```
                70         80         90        100        110        120
m691.pep  IRTAFKMAGDRARLKVMHSEHSRRRSVVEIISSDVFNRNEARDYVESRYLSGMDFAVDEL
          ||:|||||||||||||||||||||||||||||||||||||||||||||||||||||||||
a691      IRAAFKMAGDRARLKVMHSEHSRRRSVVEIISSDVFNRNEARDYVESRYLSGMDFAVDEL
                70         80         90        100        110        120

               130        140
m691.pep  EIQHRFFHILTPQQQQMWLSSCLKX
          ||||||||||||||||||||||||
a691      EIQHRFFHILTPQQQQMWLSSCLKX
               130        140
```

The following partial DNA sequence was identified in *N. gonorrhoeae* <SEQ ID 2309>

```
g692.seq
     1  GTATCGCACA CACGCTGTCG CTGTTCGGAA TCGAtacGCC GGATTTGGCG

    51  GAATGGCAGG GAATGGCGGA TTAAAGGACA AAAATGCCGT CTGAACACGG

   101  ATGCGGTTCA GACGGCATCA TTTTATACGA CTGCCTTATT TGGCTGCGCC

   151  TTCATTCCAT GCGGCAGGGT ATTTGTAGCC CTCGAAGCGT TTGTGCGCGT

   201  AGGCTTTGAA CGCGTCGGAG TTATAGGCCT CGGTTACGTC TTTAAGCCAT

   251  TGGCTGTCTT TGTCGGCGGT TTTgacGGCA GACCAGTTGA CATAGGCAAA

   301  GCTCGGCTCT TGGAACAGGG CTTCGGTCAG CTTCATGCCG CTGCTTATGG

   351  CGTAGTTGCC GTTGACGACG GCAAAATCCA CGTCGGCGCG GCTGCGCGGC

   401  AGTTGTGCGG CTTCAAGCTC GACGATTTTG ATGTTTTTCA GGTTTTCCGC

   451  GATGTCGGCT TTGGATGCGG TCAGCGGATT GATGCCGTCT TTGAGTTTGA

   501  TCCAACCCAG TTCGTTCAGC ATCACCAAGG CGCGTGCGAA GTTGGAcggG

   551  TcgtTGGGCG CGGATACGGT GCTGCCGTCT TTGACTTCTT CCAGCGATTT

   601  CAGTTTGCCC GGATACAGTC CCAAAGGCGC GGTCGGCACT TGGAAGGCTT

   651  CGGTGATGTC CAGGTTGTGT TCTTTTTTGA AATCGTCAAG ATAGGGTTTG

   701  TGTTGGAAGA CGTTGATGTC CAACTCGCCC TCCGCCAATG CCAGATTCGG

   751  GCGCACATAG TCggTAAATT cgaccaatTT gacgGTGTag cCTTTTTTCT

   801  CCAGCTCGgc tTGGATTTGT TCTTTGACCA TATcgccgaa gtcgcccacg

   851  gTCGTGCCGA agacgaTTTC TTTTTTCGCc GcgcCGTTAT CGGCAGAAGG

   901  GGCGGCGgca gaggctgcGG GCGCGCTGTC TTTTtgaccG ccgCAGGCTG

   951  CGAGGATGAG CGCGAGtgcg gcggcggaaa ggGTTTTGAA GAAGGTTTTc

  1001  atATTTTCTc ctga
```

This corresponds to the amino acid sequence <SEQ ID 2310; ORF 692>:

g692.pep
    1 VSHTRCRCSE SIRRIWRNGR EWRIKGQKCR LNTDAVQTAS FYTT<u>ALFGCA</u>

51 <u>FIPCGRVFVA L</u>EAFVRVGFE <u>RVGVIGLGYV FKPLAVFV</u>GG FDGRPVDIGK

101 ARLLEQGFGQ LHAAAYGVVA VDDGKIHVGA AARQLCGFKL DDFDVFQVFR

151 DVGFGCGQRI DAVFEFDPTQ FVQHHQGACE VGRVVGRGYG AAVFDFFQRF

201 QFARIQSQRR GRHLEGFG<u>DV QVVFFFEIVK IGFVL</u>EDVDV QLALRQCQIR

251 AHIVGKFDQF DGVAFFLQLG LDLFFDHIAE VAHGRAEDDF FFRRAVIGRR

301 GGGRGCGRAV FLTAAGCEDE RECGGGKGFE EGFHIFS*

The following partial DNA sequence was identified in *N. meningitidis* <SEQ ID 2311>:

```
m692.seq
     1  GTGTTGCACA CGCTTTGTCG CTGTTCGGAA TCGATACGCC GGATTCGGCG

    51  GAATGGCAGG GAATGGCGGA TTAAAGGACA AAAATGCCGT CTGAACACGG

   101  ATACAGTTCA GACGGCATCA TTTTATACGA CTGCCTTATT TGGCTGCGCC

   151  TTCATTCCAT GCGGCAGGGG ATTTGTAGCC CTCGAAGCGT TTGTGCGCGT

   201  AGGCTTTGAA CGCGTCGGAG TTATAGGCCT CGGTTACGTC TTTAAGCCAT

   251  TGGCTGTCTT TGTCGGCGGT TTTGACGGCA GACCAGTTGA CATAGGCAAA

   301  GCTCGGTTCT TGGAACAGGG CTTCGGTCAG CTTCATGCCG CTGCTTATGG

   351  CGTAGTTGCC GTTGACGACG GCAAAATCCA CGTCGGCGCG GCTACGCGGC

   401  AGTTGCGCGG CTTCAAGCTC GACGATTTTG ATGTTTTTCA GGTTCTCGGC

   451  GATGTCCGCT TTGGATGCGG TCAACGGATT GATGCCGTCT TTGAGTTTGA

   501  TCCAACCCAG TTCGTCGAGC ATCACCAAGA CGCGGGCGAA GTTGGACGGG

   551  TCGTTGGGCG CGGATACGGT GCTGCCGTCT TTGACTTCTT CCAGCGATTT

   601  CAGCTTGCCC GGGTACAGTC CCAAAGGCGC GGTCGGCACT TGGAAGACTT

   651  CGGTGATGTC CAGATTGTGT TCTTTTTTGA AGTCGTCAAG ATAGGGTTTG

   701  TGTTGGAAGA CGTTGATGTC CAACTCGCCC TCAGCCAATG CCAGATTCGG

   751  GCGTACATAG TCGGTAAACT CGACCAGTTT GACGGTGTAG CCTTTTTTCT

   801  CCAGCTCGGC TTGGATTTGT TCTTTGACCA TATCGCCGAA GTCGCCGACG

   851  GTCGTGCCGA AGACGATTTC TTTTTTCGCC GCGCCGTTGT CGGCGGCGGC

   901  AGAAGCGGAT GCGGCGGGCG CGCTGTCTTT TTGACCGCCG CAGGCGGCGA

   951  GGATGAGCGC GAGTGCGGCG GCGGAAAGGG TTTTGAAGAA GGTTTTCATA

  1001  TTTTCTCCTG A
```

This corresponds to the amino acid sequence <SEQ ID 2312; ORF 692>:

```
m692.pep
    1 VLHTLCRCSE SIRRIRRNGR EWRIKGQKCR LNTDTVQTAS FYTTALFGCA

   51 FIPCGRGFVA LEAFVRVGFE RVGVIGLGYV FKPLAVFVGG FDGRPVDIGK

  101 ARFLEQGFGQ LHAAAYGVVA VDDGKIHVGA ATRQLRGFKL DDFDVFQVLG

  151 DVRFGCGQRI DAVFEFDPTQ FVEHHQDAGE VGRVVGRGYG AAVFDFFQRF

  201 QLARVQSQRR GRHLEDFGDV QIVFFFEVVK IGFVLEDVDV QLALSQCQIR

  251 AYIVGKLDQF DGVAFFLQLG LDLFFDHIAE VADGRAEDDF FFRRAVVGGG

  301 RSGCGGRAVF LTAAGGEDER ECGGGKGFEE GFHIFS*
```

Computer analysis of this amino acid sequence gave the following results:

Homology with a Predicted ORF from *N. gonorrhoeae*

ORF 692 shows 91.1% identity over a 338 aa overlap with a predicted ORF (ORF 692) from *N. gonorrhoeae*:

```
m692/g692 91.1% identity in 338 aa overlap
```

-continued

```
                 10         20         30         40         50         60
m692.pep   VLHTLCRCSESIRRIRRNGREWRIKGQKCRLNTDTVQTASFYTTALFGCAFIPCGRGFVA
           | || ||||||||| |||||||||||||||||:|||||||||||||||||||| |||
g692       VSHTRCRCSESIRRIWRNGREWRIKGQKCRLNTDAVQTASFYTTALFGCAFIPCGRVFVA
                 10         20         30         40         50         60

                 70         80         90        100        110        120
m692.pep   LEAFVRVGFERVGVIGLGYVFKPLAVFVGGFDGRPVDIGKARFLEQGFGQLHAAAYGVVA
           ||||||||||||||||||||||||||||||||||||||||||:|||||||||||||||||
g692       LEAFVRVGFERVGVIGLGYVFKPLAVFVGGFDGRPVDIGKARLLEQGFGQLHAAAYGVVA
                 70         80         90        100        110        120

                130        140        150        160        170        180
m692.pep   VDDGKIHVGAATRQLRGFKLDDFDVFQVLGDVRFGCGQRIDAVFEFDPTQFVEHHQDAGE
           ||||||||||:||| |||||||||||: || ||||||||||||||||||:||| | |
g692       VDDGKIHVGAAARQLCGFKLDDFDVFQVFRDVGFGCGQRIDAVFEFDPTQFVQHHQGACE
                130        140        150        160        170        180

                190        200        210        220        230        240
m692.pep   VGRVVGRGYGAAVFDFFQRFQLARVQSQRRGRHLEDFGDVQIVFFFEVVKIGFVLEDVDV
           ||||||||||||||||||||:||:|||||||||| |||||:|||||:||||||||||||
a692       VGRVVGRGYGAAVFDFFQRFQFARIQSQRRGRHLEGFGDVQVVFFFEIVKIGFVLEDVDV
                190        200        210        220        230        240

                250        260        270        280        290
m692.pep   QLALSQCQIRAYIVGKLDQFDGVAFFLQLGLDLFFDHIAEVADGRAEDDFFFRRAVVG--
           |||| ||||||:||||:||||||||||||||||||||||||| ||||||||||||||:|
g692       QLALRQCQIRAHIVGKFDQFDGVAFFLQLGLDLFFDHIAEVAHGRAEDDFFFRRAVVGRR
                250        260        270        280        290        300

             300        310        320        330
m692.pep   GGRSGCGGRAVFLTAAGGEDERECGGGKGFEEGFHIFSX
           ||  ||| ||||||||| ||||||||||||||||||||
g692       GGGRGCG-RAVFLTAAGCEDERECGGGKGFEEGFHIFSX
                310        320        330
```

The following partial DNA sequence was identified in *N. meningitidis* <SEQ ID 2313>

```
a692.seq
   1  GTGTTGCACA CGCTTTGTCG CTGTTCGGAA TCGATACGCC GGATTCGGCG

  51  GAATGGCAGG GAATGGCGGA TTAAAGGACA AAAATGCCGT CTGAACACGG

 101  ATACGGTTCA GACGGCATCA TTTTATACGA CTGCCTTATT TGGCTGCGCC

 151  TTCATTCCAT GCGGCAGGGG ATTTGTAGCC CTCGAAGCGT TTGTGCGCGT

 201  AGGCTTTGAA CGCGTCGGAG TTATAGGCCT CGGTTACGTC TTTAAGCCAT

 251  TGGCTGTCTT TGTCGGCGGT TTTGACGGCA GACCAGTTGA CATAGGCAAA

 301  GCTCGGTTCT TGGAACAGGG CTTCGGTCAG CTTCATGCCG CTGCTTATGG

 351  CGTAGTTGCC GTTGACGACG GCAAAATCCA CGTCGGCGCG GCTACGCGGC

 401  AGTTGCGCGG CTTCAAGCTC GACGATTTTG ATGTTTTTCA GGTTTTCGGC

 451  AATGTCCGCT TTGGATGCGG TCAGCGGATT GATGCCGTCT TTGAGTTTGA

 501  TCCAACCCAG TTCGTCGAGC ATCACCAAGA CGCGGGCGAA GTTGGACGGG

 551  TCGTTGGGCG CGGATACGGT GCTGCCGTCT TTGACTTCTT CCAGCGATTT

 601  CAGCTTGCCC GGGTACAGTC CCAAAGGCGC GGTCGGCACT TGGAAGACTT

 651  CGGTGATGTC CAGATTGTGT TCTTTTTTGA AGTCGTCAAG ATAGGGTTTG

 701  TGTTGGAAGA CGTTGATGTC CAACTCGCCC TCAGCCAATG CCAGATTCGG

 751  GCGCACATAG TCGGTAAACT CGACCAGTTT GACGGTGTAG CCTTTTTTCT

 801  CCAGCTCGGG TTGGATTTGT TCTTTGACCA TATCGCCGAA GTCGCCGACG

 851  GTCGTGCCGA AGACGATTTC TTTTTTCGCC GCGCCGTTGT CGGCGGCGGC

 901  AGAAGCGGAT GCGGCGGGCG CGCTATCTTT TTGACCGCCG CAGGCGGCGA

 951  GGATGAGCGC GAGTGCGGCG GCGGAAAGGG TTTTGAAGAA GGTTTTCATA

1001  TTTTCTCCTG A
```

This corresponds to the amino acid sequence <SEQ ID 2314; ORF 692.a>:

```
a692.pep
   1 VLHTLCRCSE SIRRIRRNGR EWRIKGQKCR LNTDTVQTAS FYTTALFGCA

  51 FIPCGRGFVA LEAFVRVGFE RVGVIGLGYV FKPLAVFVGG FDGRPVDIGK

 101 ARFLEQGFGQ LHAAAYGVVA VDDGKIHVGA ATRQLRGFKL DDFDVFQVFG

 151 NVRFGCGQRI DAVFEFDPTQ FVEHHQDAGE VGRVVGRGYG AAVFDFFQRF

 201 QLARVQSQRR GRHLEDFGDV QIVFFFEVVK IGFVLEDVDV QLALSQCQIR

 251 AHIVGKLDQF DGVAFFLQLG LDLFFDHIAE VADGRAEDDF FFRRAVVGGG

 301 RSGCGGRAIF LTAAGGEDER ECGGGKGFEE GFHIFS*
```

Computer analysis of this amino acid sequence gave the following results:

Homology with a Predicted ORF from *N. meningitidis*

ORF 692 shows 98.8% identity over a 336 aa overlap with a predicted ORF (ORF 692) from *N. meningitidis*:

```
m692/a692 98.8% identity in 336 aa overlap

                    10        20        30        40        50        60
m692.pep  VLHTLCRCSESIRRIRRNGREWRIKGQKCRLNTDTVQTASFYTTALFGCAFIPCGRGFVA
          ||||||||||||||||||||||||||||||||||||||||||||||||||||||||||||
a692      VLHTLCRCSESIRRIRRNGREWRIKGQKCRLNTDTVQTASFYTTALFGCAFIPCGRGFVA
                    10        20        30        40        50        60

                    70        80        90       100       110       120
m692.pep  LEAFVRVGFERVGVIGLGYVFKPLAVFVGGFDGRPVDIGKARFLEQGFGQLHAAAYGVVA
          ||||||||||||||||||||||||||||||||||||||||||||||||||||||||||||
a692      LEAFVRVGFERVGVIGLGYVFKPLAVFVGGFDGRPVDIGKARFLEQGFGQLHAAAYGVVA
                    70        80        90       100       110       120

                   130       140       150       160       170       180
m692.pep  VDDGKIHVGAATRQLRGFKLDDFDVFQVLGDVRFGCGQRIDAVFEFDPTQFVEHHQDAGE
          ||||||||||||||||||||||||||||:|:|||||||||||||||||||||||||||||
a692      VDDGKIHVGAATRQLRGFKLDDFDVFQVFGNVRFGCGQRIDAVFEFDPTQFVEHHQDAGE
                   130       140       150       160       170       180

                   190       200       210       220       230       240
m692.pep  VGRVVGRGYGAAVFDFFQRFQLARVQSQRRGRHLEDFGDVQIVFFFEVVKIGFVLEDVDV
          ||||||||||||||||||||||||||||||||||||||||||||||||||||||||||||
a692      VGRVVGRGYGAAVFDFFQRFQLARVQSQRRGRHLEDFGDVQIVFFFEVVKIGFVLEDVDV
                   190       200       210       220       230       240

                   250       260       270       280       290       300
m692.pep  QLALSQCQIRAYIVGKLDQFDGVAFFLQLGLDLFFDHIAEVADGRAEDDFFFRRAVVGGG
          ||||||||||:|||||||||||||||||||||||||||||||||||||||||||||||||
a692      QLALSQCQIRAHIVGKLDQFDGVAFFLQLGLDLFFDHIAEVADGRAEDDFFFRRAVVGGG
                   250       260       270       280       290       300

                   310       320       330
m692.pep  RSGCGGRAVFLTAAGGEDERECGGGKGFEEGFHIFSX
          |||||||||||||||||||||||||||||||||||||
a692      RSGCGGRAIGLTAAGGEDERECGGGKGFEEGFHIFSX
                   310       320       330
```

The following partial DNA sequence was identified in *N. gonorrhoeae* <SEQ ID 2315>:

```
g694.seq
   1  TCGGCATTTG TGTTGCCCAA ACATCCGATG CCTGCGTTAA CGCCTGCGTC

  51  AACGTTTGCA CAAATCGGGT TTGGTTTCGC CCTCGCGGCG CAGCTCCTTG

 101  GGCAGGACGA ACACGATGCT TTCTTCCGCG CCCCCCCCTT CGCGCACGGT

 151  TTCATGCCCC CATCCGCGTA TGGTTGCCAA TACTTCCCGC ACCAACACTT

 201  CGGGCGCGGA CGCGCCTGCC GTTACGCCGA CTTTGCTTTT GCCTTCAAAC

 251  CACGTGCGTT GCaggTAGGA CGCGTTGTCC ACCATATACG CATCGATTCC

 301  GCGCGATGCC GCCACTTCGC GCAGGCGGTT GCTGTTGGAC GAATTGGGCG
```

-continued

```
 351  AACCGACCAC AATCACGATG TCGCACTGTT CCGCCAGCTC TTTGACGGCG

 401  GTTTGCCGGT TGGTCGTCGC ATAGCAGATG TCTTCCTTGT GCGGATTGCG

 451  GATATTGGGG AAACGCGCGT TCAGCGCGGC GATGATGTCT TTGGTTTCAT

 501  CGACCGAGAG CGTGGTTTGG CTGACATAGG CGAGTTTGTC GGGGTTTCTG

 551  ACTTCGAGTT TTGCCACATC TCCGACCGTT TCGACCAAAA GCATTTTGCC

 601  CGGTGCAAGC TGCCCCATCG TGCCTTCGAC CTCGGCGTGC CCCTTATGCC

 651  CGATCATGAT GATTTCACAG TCTTGGGCAT CCAGTCGGGC GACTTCCTTA

 701  TGCACTTTCG TCACCAGCGG GCAAGTCGCA TCAAATACCC GGAAACCGCG

 751  CTCCGCCGCT TCCTGCTGCA CCGCCTTCGA TACGCCGTGT GCCGAATAAA

 801  CCAGTGTCGC GCCCGGCGGC ACTTCCGCCA AGTCTTCGAT AAACACCGCG

 851  CCTTTTTCGC GCAGGTTGTC CACGACGAAT TTGTTGTGGA CGACTTCGTG

 901  GCGCACATAA ACCGGCGCGC CGAATTCTTC CAAAGCACGT TCGACAATAC

 951  TGATTGCCCG ATCCACACCG GCGCAGAAGC CGCGCGGATT GGCAAGGATG

1001  ATGGTTTTTC CGTTCATAAG TTTTGCATTC CGTGTTCAGA CGGCATTCAC

1051  GTTTTTTTGC TNNATCTTTG CGATGGACGA TATTGTCAAG CACCGCCAAC

1101  ACCGCACCGA CGCAGATAA
```

This corresponds to the amino acid sequence <SEQ ID 2316; ORF 694>:

```
g694.pep (partial)
  1 SAFVLPKHPM PALTPASTFA QIGFGFALAA QLLGQDEHDA FFRAPPFAHG

 51 FMPPSAYGCQ YFPHQHFGRG RACRYADFAF AFKPRALQVG RVVHHIRIDS

101 ARCRHFAQAV AVGRIGRTDH NHDVALFRQL FDGGLPVGRR IADVFLVRIA

151 DIGETRVQRG DDVFGFIDRE RGLADIGEFV GVSDFEFCHI SDRFDQKHFA

201 RCKLPHRAFD LGVPLMPDHD DFTVLGIQSG DFLMHFRHQR ASRIKYPETA

251 LRRFLLHRLR YAVCRINQCR ARRHFRQVFD KHRAFFAQVV HDEFVVDDFV

301 AHINRRAEFF QSTFDNTDCP IHTGAEAARI GKDDGFSVHK FCIPCSDGIH

351 VFLLXLCDGR YCQAPPTPHR RR*
```

The following partial DNA sequence was identified in *N. meningitidis* <SEQ ID 2317>:

```
m694.seq
  1  TTGGTTTCCG CATCCGGCAC ACGGCAAAAA TGCCGTCTGA AGCCTGTTCA

 51  GACGGCATTT GTGTTGCCCA AACATTCAAC GCCTGCGTCA ACGTTTGCAC

101  AAATCGGGTT TGGTTTCGCC CTCGCGGCGC AACTCTTTGG GCAGGACGAA

151  CACAATGCTT TCTTCCGCAC CCTCGCCTTC GCGTACGGTT TCGTGCCCCC

201  ATCCGCGTAT GGTTGCCAGT ACTTCCCGCA CCAACACTTC GGGCGCGGAC

251  GCGCCTGCCG TTACGCCGAC TTTGTTTTTG CCCTCAAACC ATGCGCGTTG

301  CAGGTAGCCT GCATTATCCA CCATATACGC ATCGATTCCG CGCGATGCCG

351  CCACTTCGCG CAAGCGGTTG CTGTTGGACG AATTGGGCGA ACCGACCACA

401  ATCACGATGT CGCACTGTTC TGCCAACTCT TTGACGGCGG TTTGCCGGTT

451  GGTCGTCGCA TAGCAGATAT CTTCCTTGTG CGGATTGCGG ATATTGGGGA
```

-continued

```
 501 AACGCGCGTT CAGCGCGGCG ATGATGTCTT TGGTTTCATC GACCGAGAGC

 551 GTGGTTTGGC TGACATAGGC GAGTTTGTCG GGGTTTCTGA CTTCGAGTTT

 601 TGCCACATCT CCGACCGTTT CGACCAAAAG CATTTTGCCC GGCGCAAGCT

 651 GCCCCATCGT TCCTTCGACC TCGACGTGCC CCTTATGCCC GATCATGATG

 701 ATTTCACAGT CTTGGGCATC CAGTCGGGCG ACTTCCTTAT GCACTTTCGT

 751 CACCAGCGGG CAAGTCGCAT CAAACACGCG GAAACCGCgC TCCGCCGCTT

 801 CTTGCCGCAC CGCCTTCGAT ACGCCGTGTG CCGAATAAAC CAGTGTCGCG

 851 CCCGGCGGCA CTTCCGCCAA GTCTTCAATA AACACCGCAC CTTTTTCACG

 901 CAGGTTGTCC ACGACGAATT TGTTGTGAAC GACTTCGTGG CGCACATAAA

 951 TCGGCGCGCC GAACTCTTCC AAAGCACGTT CGACAATACT GATT GCCCGA

1001 TCCACACCAG CGCAGAAGCC GCGCGGATTG GCAAGGATGA TGGTTTTCTC

1051 GTTCATAAGC CCGGTATTTC GTTTTCAGAC GGCATCAATA TTTTTCTTCT

1101 TGGGTTTTAC GGTGGACGAT GTTGTCCAAC ACCGCCAACA CCGCACCGAC

1151 GCAGATAA
```

This corresponds to the amino acid sequence <SEQ ID 2318; ORF 694>:

```
m694.pep
  1 LVSASGTRQK CRLKPVQTAF VLPKHSTPAS TFAQIGFGFA LAAQLFGQDE

 51 HNAFFRTLAF AYGFVPPSAY GCQYFPHQHF GRGRACRYAD FVFALKPCAL

101 QVACIIHHIR IDSARCRHFA QAVAVGRIGR TDHNHDVALF CQLFDGGLPV

151 GRRIADIFLV RIADIGETRV QRGDDVFGFI DRERGLADIG EFVGVSDFEF

201 CHISDRFDQK HFARRKLPHR SFDLDVPLMP DHDDFTVLGI QSGDFLMHFR

251 HQRASRIKHA ETALRRFLPH RLRYAVCRIN QCRARRHFRQ VFNKHRTFFT

301 QVVHDEFVVN DFVAHINRRA ELFQSTFDNT DCPIHTSAEA ARIGKDDGFL

351 VHKPGISFSD GINIFLLGFY GGRCCPTPPT PHRRR*
```

Computer analysis of this amino acid sequence gave the following results:

Homology with a Predicted ORF from *N. gonorrhoeae*

ORF 694 shows 86.8% identity over a 372 aa overlap with a predicted ORF (ORF 694) from *N. gonorrhoeae*:

```
m694/g694 86.8% identity in 372 aa overlap

                      10        20        30        40        50
m694.pep      LVSASGTRQKCRLKPVQTAFVLPKHS----TPASTFAQIGFGFALAAQLFGQDEHNAFFR
              |||||||||||||||||:|||||||     |||||||||||||||||||:|||||:||||
g694                           SAFVLPKHPMPALTPASTFAQIGFGFALAAQLLGQDEHDAFFR
                                       10        20        30        40

                60        70        80        90       100       110
m694.pep      TLAFAYGFVPPSAYGCQYFPHQHFGRGRACRYADFVFALKPCALQVACIIHHIRIDSARC
              :  ||:||:||||||||||||||||||||||||||:||:|| ||||: ::||||||||||
g694          APPFAHGFMPPSAYGCQYFPHQHFGRGRACRYADFAFAFKPRALQVGRVVHHIRIDSARC
                   50        60        70        80        90       100

               120       130       140       150       160       170
m694.pep      RHFAQAVAVGRIGRTDHNHDVALFCQLFDGGLPVGRRIADIFLVRIADIGETRVQRGDDV
              |||||||||||||||||||||||| |||||||||||||||:|||||||||||||||||||
g694          RHFAQAVAVGRIGRTDHNHDVALFRQLFDGGLPVGRRIADVFLVRIADIGETRVQRGDDV
                  110       120       130       140       150       160
```

-continued

```
            180       190       200       210       220       230
m694.pep  FGFIDRERGLADIGEFVGVSDFEFCHISDRFDQKHFARRKLPHRSFDLDVPLMPDHDDFT
          |||||||||||||||||||||||||||||||||||||| |||||:||| |||||||||||
g694      FGFIDRERGLADIGEFVGVSDFEFCHISDRFDQKHFARCKLPHRAFDLGVPLMPDHDDFT
               170       180       190       200       210       220

            240       250       260       270       280       290
m694.pep  VLGIQSGDFLMHFRHQRASRIKHAETALRRFLPHRLRYAVCRINQCRARRHFRQVFNKHR
          |||||||||||||||||||||| :|||||||| |||||||||||||||||||||||:|||
g694      VLGIQSGDFLMHFRHQRASRIKYPETALRRFLLHRLRYAVCRINQCRARRHFRQVFDKHR
               230       240       250       260       270       280

            300       310       320       330       340       350
m694.pep  TFFTQVVHDEFVVNDFVAHINRRAELFQSTFDNTDCPIHTSAEAARIGKDDGFLVHKPGI
          :||:|||||||||:|||||||||||:||||||||||||||:|||||||||||| |||  |
g694      AFFAQVVHDEFVVDDFVAHINRRAEFFQSTFDNTDCPIHTGAEAARIGKDDGFSVHKFCI
               290       300       310       320       330       340

            360       370       380
m694.pep  SFSDGINIFLLGFYGGRCCPTPPTPHRRRX
            ||||::||  :  || | :|||||||||
g694      PCSDGIHVFLXXLCDGRYCQAPPTPHRRRX
               350       360       370
```

The following partial DNA sequence was identified in *N. meningitidis* <SEQ ID 2319>:

```
a694.seq
   1  TTGGTTTCCG CATCCGGCAC ACGGCAAAAA TGCCGTCTGA AGCCTGTTCA

  51  GACGGCATTT GTGTTGCCCA AACATTCAAC GCCTGCGTCA ACGTTTGCAC

 101  AAATCGGGTT TGGTTTCGCC CTCGCGGCGC AACTCTTTGG GCAGGACGAA

 151  CACAATGCTT TCTTCCGCAC CCTCGCCTTC GCGTACGGTT TCGTGCCCCC

 201  ATCCGCGTAT GGTTGCCAGT ACTTCCCGCA CCAACACTTC GGGCGCGGAC

 251  GCGCCTGCCG TTACGCCGAC TTTGTTTTTG CCCTCAAACC ATGCGCGTTG

 301  CAGGTAGCCT GCATTATCCA CCATATACGC ATCGATTCCG CGCGATGCCG

 351  CCACTTCGCG CAAGCGGTTG CTGTTGGACG AATTGGGCGA ACCGACCACA

 401  ATCACGATGT CGCACTGTTC TGCCAACTCT TTGACGGCGG TTTGCCGGTT

 451  GGTCGTCGCA TAGCAGATAT CTTCCTTGTG CGGATTGCGG ATATTGGGGA

 501  AACGCGCGTT CAGCGCGGCG ATGATGTCTT TGGTTTCATC GACCGAGAGC

 551  GTGGTTTGGC TGACATAGGC GAGTTTGTCG GGGTTTCTGA CTTCGAGTTT

 601  TGCCACATCT CCGACCGTTT CGACCAAAAG CATTTTGCCC GGCGCAAGCT

 651  GCCCCATCGT TCCTTCGACC TCGACGTGCC CCTTATGCCC GATCATGATG

 701  ATTTCACAGT CTTGGGCATC CAGTCGGGCG ACTTCCTTAT GCACTTTCGT

 751  CACCAGCGGG CAAGTCGCAT CAAACACGCG GAAACCGCGC TCCGCCGCTT

 801  CTTGCCGCAC CGCCTTCGAT ACGCCGTGTG CCGAATAAAC CAGTGTCGCG

 851  CCCGGCGGCA CTTCCGCCAA GTCTTCAATA AACACCGCAC CTTTTTCACG

 901  CAGGTTGTCC ACGACGAATT TGTTGTGAAC GACTTCGTGG CGCACATAAA

 951  TCGGCGCGCC GAACTCTTCC AAAGCACGTT CGACAATACT GATTGCCCGA

1001  TCCACACCAG CGCAGAAGCC GCGCGGATTG GCAAGGATGA TGGTTTTCTC

1051  GTTCATAAGC CCGGTATTTC GTTTTCAGAC GGCATCAATA TTTTTCTTCT

1101  TGGGTTTTAC GGTGGACGAT GTTGTCCAAC ACCGCCAACA CCGCACCGAC

1151  GCAGATAA
```

This corresponds to the amino acid sequence <SEQ ID 2320; ORF 694.a>:

```
a694.pep
   1 LVSASGTRQK CRLKPVQTAF VLPKHSTPAS TFAQIGFGFA LAAQLFGQDE

  51 HNAFFRTLAF AYGFVPPSAY GCQYFPHQHF GRGRACRYAD FVFALKPCAL

 101 QVACIIHHIR IDSARCRHFA QAVAVGRIGR TDHNHDVALF CQLFDGGLPV

 151 GRRIADIFLV RIADIGETRV QRGDDVFGFI DRERGLADIG EFVGVSDFEF

 201 CHISDRFDQK HFARRKLPHR SFDLDVPLMP DHDDFTVLGI QSGDFLMHFR

 251 HQRASRIKHA ETALRRFLPH RLRYAVCRIN QCRARRHFRQ VFNKHRTFFT

 301 QVVHDEFVVN DFVAHINRRA ELFQSTFDNT DCPIHTSAEA ARIGKDDGFL

 351 VHKPGISFSD GINIFLLGFY GGRCCPTPPT PHRRR*
```

Computer analysis of this amino acid sequence gave the following results:

Homology with a Predicted ORF from *N. meningitidis*

ORF 694 shows 100% identity over a 385 aa overlap with a predicted ORF (ORF 694) from *N. meningitidis*:

```
m694/a694 100.0% identity in 385 aa overlap

                    10        20        30        40        50        60
m694.pep  LVSASGTRQKCRLKPVQTAFVLPKHSTPASTFAQIGFGFALAAQLFGQDEHNAFFRTLAF
          ||||||||||||||||||||||||||||||||||||||||||||||||||||||||||||
a694      LVSASGTRQKCRLKPVQTAFVLPKHSTPASTFAQIGFGFALAAQLFGQDEHNAFFRTLAF
                    10        20        30        40        50        60

                    70        80        90       100       110       120
m694.pep  AYGFVPPSAYGCQYFPHQHFGRGRACRYADFVFALKPCALQVACIIHHIRIDSARCRHFA
          ||||||||||||||||||||||||||||||||||||||||||||||||||||||||||||
a694      AYGFVPPSAYGCQYFPHQHFGFGFACRYADFVFALKPCALQVACIIHHIRIDSARCRHFA
                    70        80        90       100       110       120

                   130       140       150       160       170       180
m694.pep  QAVAVGRIGRTDHNHDVALFCQLFDGGLPVGRRIADIFLVRIADIGETRVQRGDDVFGFI
          ||||||||||||||||||||||||||||||||||||||||||||||||||||||||||||
a694      QAVAVGRIGRTDHNHDVALFCQLFDGGLPVGRRIADIFLVRIADIGETRVQRGDDVFGFI
                   130       140       150       160       170       180

                   190       200       210       220       230       240
m694.pep  DRERGLADIGEFVGVSDFEFCHISDRFDQKHFARRKLPHRSFDLDVPLMPDHDDFTVLGI
          ||||||||||||||||||||||||||||||||||||||||||||||||||||||||||||
a694      DRERGLADIGEFVGVSDFEFCHISDRFDQKHFARRKLPHRSFDLDVPLMPDHDDFTVLGI
                   190       200       210       220       230       240

                   250       260       270       280       290       300
m694.pep  QSGDFLMHFRHQRASRIKHAETALRRFLPHRLRYAVCRINQCRARRHFRQVFNKHRTFFT
          ||||||||||||||||||||||||||||||||||||||||||||||||||||||||||||
a694      QSGDFLMHFRHQRASRIKHAETALRRFLPHRLRYAVCRINQCRARRHFRQVFNKHRTFFT
                   250       260       270       280       290       300

                   310       320       330       340       350       360
m694.pep  QVVHDEFVVNDFVAHINRRAELFQSTFDNTDCPIHTSAEAARIGKDDGFLVHKPGISFSD
          ||||||||||||||||||||||||||||||||||||||||||||||||||||||||||||
a694      QVVHDEFVVNDFVAHINRRAELFQSTFDNTDCPIHTSAEAARIGKDDGFLVHKPGISFSD
                   310       320       330       340       350       360

                   370       380
m694.pep  GINIFLLGFYGGRCCPTPPTPHRRRX
          ||||||||||||||||||||||||||
a694      GINIFLLGFYGGRCCPTPPTPHRRRX
                   370       380
```

The following partial DNA sequence was identified in *N. gonorrhoeae* <SEQ ID 2321>:

```
g695.seq
   1 TTGCCTCAAA CTCGTCCGGC AAGGCGGCAT CATCGCCATC GACAATATTT

  51 TGTTGAACGG AAGGGTGATG CGCGAAGCGG CTTTTGATGC GCCGCCCAGT

 101 GTCAAAATTC TCAAAGATTT CAATCAAAAC CTGCCGAACG ATACGCGGAT

 151 TGTCCCCATC ACCCTGCCCG TCGGCGACGG TTTGACCCTG CTTCTGAAAA

 201 AATAATGAAG ACCAAATTAC CGCTTTTTAT CATTTGGCTG TCTGTGTCTG
```

-continued

```
251 CCTCCTGTGC TTCCGTTTTA CCCGTTCCGG AGGGCAGCCG AACCGAAATG

301 CCGACACAGG AAAATGCTTC AGACGGCATT CCCTATCCCG TTCCCACTCT

351 GCAAGACCGT TTGGACTATC TGGAAGGCAA AATCGTCCGG CTGTCGAACG

401 AAGTGGAAAT GTTAAACGGG AAAGTCAAAG CATTGGAGCA TACGAAAATA

451 CACCCTTCCG GCAGGACATA CGTCCAAAAA CTCGACGACC GCAAATTGAA

501 AGAGCATTAC CTCAATACCG AAGGCGGCAG CGCATCCGCA CATACCGTCG

551 AAACCGCACA AAACCTCTAC AATCAGGCAC TCAAACACTA TCAAAACGGC

601 AGGTTTTCTG CCGCAGCCGC CTTGTTGAAG GGGGCGGACG GCGGAGACGG

651 CGGCAGCATC GCGCAACGCA GTATGTACCT GTTGCTGCAA AGCAGGGCGC

701 GTATGGGGAA CTGTGAATCT GTCATCGAAA TCGGAGGGCG TTACGCCAAC

751 CGTTTCAAAG ACAGCCCAAC CGCGCCCGAA GTCATATTCA AAATCGGCGA

801 ATGCCAATAC AGGCTTCAGC AAAAAGACAT TGCAAGGGCG ACTTGGCGCA

851 GCCTGATACA GACCTATCCC GGCAGCCCGG CGGCAAAACG CGCCGCCGCA

901 GCCGTACGCA AACGATAG
```

This corresponds to the amino acid sequence <SEQ ID 2322; ORF 695>:

```
g695.pep
  1 LPQTRPARRH HRHRQYFVER KGDARSGF*C AAQCQNSQRF QSKPAERYAD

 51 CPHHPARRRR FDPASEKIMK TKLPLFIIWL SVSASCASVL PVPEGSRTEM

101 PTQENASDGI PYPVPTLQDR LDYLEGKIVR LSNEVEMLNG KVKALEHTKI

151 HPSGRTYVQK LDDRKLKEHY LNTEGGSASA HTVETAQNLY NQALKHYQNG

201 RFSAAAALLK GADGGDGGSI AQRSMYLLLQ SRARMGNCES VIEIGGRYAN

251 RFKDSPTAPE VIFKIGECQY RLQQKDIARA TWRSLIQTYP GSPAAKRAAA

301 AVRKR*
```

The following partial DNA sequence was identified in *N. meningitidis* <SEQ ID 2323>:

```
m695.seq
  1 TTGCCTCAAA CTCGTCCGTC AAGGCGGCAT CATCGCCATC GACAATATTT

 51 TGCTGAACGG AAGGGTGATG CGCGAAGCGG CTTCCGATGC GCCGCCCAGC

101 GTCGGCATCC TCAAAGATTT CAATCAAAAC CTGCCGAACG ACCCGCGCAT

151 CGTCCCCATC ACCCTGCCCG TCGGCGACGG CTTGACCCTG CTTCTGAAAA

201 AATAATGAAG ATCAAATTAC CGCTTTTTAT CATTTGGCTG TCTGTGTCCG

251 CCTCCTGTGC TTCCGTTTCA CCCGTTCCGG CAGGCAGCCA AACCGAAATG

301 TCGACACGGG AAAATGCTTC AGACGGCATT CCCTATCCCG TTCCGACCTT

351 GCAAGACCGT TTGGACTATC TGGAAGGCAA AATCGTCCGG CTGTCGAACG

401 AAGTGGAAAC CTTAAACGGC AAAGTCAAAG CACTGGAACA CGCAAAAACA

451 CATTCTTCCG GCAGGGCATA CGTCCAAAAA CTCGACGACC GCAAGTTGAA

501 AGAGCATTAC CTCAATACCG AAGGCGGCAG CGCATCCGCA CATACTGTCG

551 AAACCGCACA AAACCTCTAC AATCAGGCAC TCAAACACTA TAAAAGCGGC

601 AAGTTTTCTG CCGCTGCCTC CCTGTTGAAA GGCGCGGACG GAGGCGACGG
```

-continued

```
651 CGGCAGCATC GCGCAACGCA GTATGTACCT GTTGCTGCAA AGCAGGGCGC

701 GTATGGGCAA CTGCGAATCC GTCATCGAAA TCGGAGGGCG TTACGCCAAC

751 CGTTTCAAAG ACAGCCCAAC CGCGCCTGAA GCCATGTTCA AAATCGGCGA

801 ATGCCAATAC AGGCTTCAGC AAAAAGACAT TGCAAGGGCG ACTTGGCGCA

851 GCCTGATACA GACCTATCCC GGCAGCCCGG CGGCAAAACG CGCCGCCGCA

901 GCCGTGCGCA AACGATAG
```

This corresponds to the amino acid sequence <SEQ ID 2324; ORF 695>:

```
m695.pep
  1 LPQTRPSRRH HRHRQYFAER KGDARSGFRC AAQRRHPQRF QSKPAERPAH

 51 RPHHPARRRR LDPASEKIMK IKLPLFIIWL SVSASCASVS PVPAGSQTEM

101 STRENASDGI PYPVPTLQDR LDYLEGKIVR LSNEVETLNG KVKALEHAKT

151 HSSGRAYVQK LDDRKLKEHY LNTEGGSASA HTVETAQNLY NQALKHYKSG

201 KFSAAASLLK GADGGDGGSI AQRSMYLLLQ SRARMGNCES VIEIGGRYAN

251 RFKDSPTAPE AMFKIGECQY RLQQKDIARA TWRSLIQTYP GSPAAKRAAA

301 AVRKR*
```

Computer analysis of this amino acid sequence gave the following results:

Homology with a Predicted ORF from *N. gonorrhoeae*

ORF 694 shows 90.8% identity over a 305 aa overlap with a predicted ORF (ORF 695) from *N. gonorrhoeae*:

```
m695/g695 90.8% identity in 305 aa overlap

                    10        20        30        40        50        60
m695.pep   LPQTRPSRRHHRHRQYFAERKGDARSGFRCAAQRRHPQRFQSKPAERPAHRPHHRARRRR
           ||||||:||||||||||:|||||||||| |||| :: |||||||||| |  |||||||||
g695       LPQTRPARRHHRHRQYFVERKGDARSGFXCAAQCQNSQRFQSKPAERYADCPHHRARRRR
                    10        20        30        40        50        60

                    70        80        90       100       110       120
m695.pep   LDPASEKIMKIKLPLFIIWLSVSASCASVSPVPAGSQTEMSTRENASDGIPYPVPTLQDR
           :||||||||| |||||||||||||||||| ||| ||:||| |:|||||||||||||||||
g695       FDPASEKIMKTKLPLFIIWLSVSASCASVLPVPEGSRTEMPTQENASDGIPYPVPTLQDR
                    70        80        90       100       110       120

                   130       140       150       160       170       180
m695.pep   LDYLEGKIVRLSNEVETLNGKVKALEHAKTHSSGRAYVQKLDDRKLKEHYLNTEGGSASA
           |||||||||||||||| ||||||||||:| | |||:||||||||||||||||||||||||
g695       LDYLEGKIVRLSNEVEMLNGKVKALEHTKIHPSGRTYVQKLDDRKLKEHYLNTEGGSASA
                   130       140       150       160       170       180

                   190       200       210       220       230       240
m695.pep   HTVETAQNLYNQALKHYKSGKFSAAASLLKGADGGDGGSIAQRSMYLLLQSRARMGNCES
           |||||||||||||||||::|||||||:|||||||||||||||||||||||||||||||||
g694       HTVETAQNLYNQALKHYQNGRFSAAAALLKGADGGDGGSIAQRSMYLLLQSRARMGNCES
                   190       200       210       220       230       240

                   250       260       270       280       290       300
m695.pep   VIEIGGRYANRFKDSPTAPEAMFKIGECQYRLQQKDIARATWRSLIQTYPGSPAAKRAAA
           ||||||||||||||||||||||::||||||||||||||||||||||||||||||||||||
g695       VIEIGGRYANRFKDSPTAPEVIFKIGECQYRLQQKDIARATWRSLIQTYPGSPAAKRAAA
                   250       260       270       280       290       300

m695.pep   AVRKRX
           ||||||
g695       AVRKRX
```

The following partial DNA sequence was identified in *N. meningitidis* <SEQ ID 2325>:

```
a695.seq
    1 TTGCCTCAAG CTTGTCCGGC AAGGCGGCAT CATTGCCATC GACAATATTT

   51 TGTTGAACGG AAGGGTGATG CGCGAAGCGG CTTCCGATGC GCCGCCCAGC

  101 GTCGGCATCC TCAAAGATTT TAATCAAAAC CTGCCGAACG ATACGCGGAT

  151 TGTCCCCATC ACCCTGCCCG TCGGCGACGG TTTGACCCTG CTTCTGAAAA

  201 AATAATGAAG ACCAAATTAC CGCTTTTTAT CATTTGGCTG TCCGTATCCG

  251 CCGCCTGTTC TTCCCCTGTT TCCCGCAATA TTCAGGATAT GCGGCTCGAA

  301 CCGCAGGCAG AGGCAGGTAG TTCGGACGCT ATTCCCTATC CCGTTCCCAC

  351 TCTGCAAGAC CGTTTGGATT ATCTGGAAGG CACACTCGTC CGCCTGTCGA

  401 ACGAAGTGGA AACCTTAAAC GGCAAAGTCA AAGCACTGGA GCATGCGAAA

  451 ACACACCCTT CCAGCAGGGC ATACGTCCAA AAACTCGACG ACCGCAAGTT

  501 GAAAGAGCAT TACCTCAATA CCGAAGGCGG CAGCGCATCC GCACATACCG

  551 TCGAAACCGC ACAAAACCTC TACAATCAGG CACTCAAACA CTATAAAAGC

  601 GGCAGGTTTT CTGCCGCTGC CTCCCTGTTG AAAGGCGCGG ACGGAGGCGA

  651 CGGCGGCAGC ATCGCGCAAC GCAGTATGTA CCTGTTGCTG CAAAGCAGGG

  701 CGCGTATGGG CAACTGCGAA TCCGTCATCG AAATCGGAGG GCGTTACGCC

  751 AACCGTTTCA AAGACAGCCC AACCGCGCCT GAAGCCATGT TCAAAATCGG

  801 CGAATGCCAA TACAGGCTTC AGCAAAAAGA CATTGCAAGG GCGACTTGGC

  851 GCAGCCTGAT ACAGACCTAT CCCGGCAGCC CGGCGGCAAA ACGCGCCGCC

  901 GCAGCCGTGC GCAAACGATA G
```

This corresponds to the amino acid sequence <SEQ ID 2326; ORF 695.a>:

```
a695.pep
    1 LPQACPARRH HCHRQYFVER KGDARSGFRC AAQRRHPQRF *SKPAERYAD

   51 CPHHPARRRR FDPASEKIMK TKLPLFIIWL SVSAACSSPV SRNIQDMRLE

  101 PQAEAGSSDA IPYPVPTLQD RLDYLEGTLV RLSNEVETLN GKVKALEHAK

  151 THPSSRAYVQ KLDDRKLKEH YLNTEGGSAS AHTVETAQNL YNQALKHYKS

  201 GRFSAAASLL KGADGGDGGS IAQRSMYLLL QSRARMGNCE SVIEIGGRYA

  251 NRFKDSPTAP EAMFKIGECQ YRLQQKDIAR ATWRSLIQTY PGSPAAKRAA

  301 AAVRKR*
```

Computer analysis of this amino acid sequence gave the following results:

Homology with a Predicted ORF from *N. meningitidis*

ORF 695 shows 88.3% identity over a 308 aa overlap with a predicted ORF (ORF 695) from *N. meningitidis*:

```
m695/a695 88.3.8% identity in 308 aa overlap

                    10        20        30        40        50        60
m695.pep    LPQTRPSRRHHRHRQYFAERKGDARSGFRCAAQRRHPQRFQSKPAERPAHRPHHRARRRR
            |||:  |:|||| |||||:|||||||||||||||||||| |||||| |   |||||||||
a695        LPQACPARRHHCHRQYFVERKGDARSGFRCAAQRRHPQRFXSKPAERYADCPHHPARRRR
                    10        20        30        40        50        60

                    70        80        90       100       110
m695.pep    LDPASEKIMKIKLPLFIIWLSVSASCASVSPVPAGSQT---EMSTRENASDGIPYPVPTL
            :|||||||| |||||||||||||:|:|   ||   : |      |  ::: ::||:|||||||
a695        FDPASEKIMKTKLPLFIIWLSVSAACSS--PVSRNIQDMRLEPQAEAGSSDAIPYPVPTL
                    70        80          90       100       110
```

-continued

```
             120       130       140       150       160       170
m695.pep     QDRLDYLEGKIVRLSNEVETLNGKVKALEHAKTHSSGRAYVQKLDDRKLKEHYLNTEGGS
             ||||||||| :||||||||||||||||||||||| |:|||||||||||||||||||||||
a695         QDRLDYLEGTLVRLSNEVETLNGKVKALEHAKTHPSSRAYVQKLDDRKLKEHYLNTEGGS
            120       130       140       150       160       170

             180       190       200       210       220       230
m695.pep     ASAHTVETAQNLYNQALKHYKSGKFSAAASLLKGADGGDGGSIAQRSMYLLLQSRARMGN
             |||||||||||||||||||||||:||||||||||||||||||||||||||||||||||||
a694         ASAHTVETAQNLYNQALKHYKSGRFSAAAALLKGADGGDGGSIAQRSMYLLLQSRARMGN
            180       190       200       210       220       230

             240       250       260       270       280       290
m695.pep     CESVIEIGGRYANRFKDSPTAPEAMFKIGECQYRLQQKDIARATWRSLIQTYPGSPAAKR
             ||||||||||||||||||||||||||||||||||||||||||||||||||||||||||||
a695         CESVIEIGGRYANRFKDSPTAPEAMFKIGECQYRLQQKDIARATWRSLIQTYPGSPAAKR
            240       250       260       270       280       290

             300
m695.pep     AAAAVRKRX
             |||||||||
a695         AAAAVRKRX
            300
```

The following partial DNA sequence was identified in *N. gonorrhoeae* g696.seq: not found

This corresponds to the amino acid sequence <ORF 696.ng>:

g696.pep: not found

The following partial DNA sequence was identified in *N. meningitidis* <SEQ ID 2327>:

```
m696.seq
     1 TTGGGTTGCC GGCAGGCGGC ATCCCATCAT TTTTGCCAAG GCAACAAATT

    51 ATTTGGCGGC ATCTTTCATT TTGTCTGCCG CTTCCTGAGT CGCGTCGGCA

   101 GCTTTGTTCA AAGTATCTTT AGCTGCTTCA GTTACAGCTT CTTTGGCTTC

   151 AGTTACAGCT TCCTCGGCAC TTGCCTTTGC ATCAGCCGCA GCATCTTTGA

   201 CTTGGTCTTT CGCTTCTTCG ACGGCAGAAG CGGCAGACTC GGCGGCAGAA

   251 GCCGCAGTGT CTTTAACATC GGACTCAACG GCTTGAACCG CTTCCTTAAC

   301 CTCCTGTTTG GCTTCTTGCG AACAAGCTGC CAAGGCAGCC GCCATCATTG

   351 CGGCAATCAA TAA
```

This corresponds to the amino acid sequence <SEQ ID 2328; ORF 696>:

```
m696.pep
     1 LGCRQAASHH FCQGNKLFGG IFHFVCRFLS RVGSFVQSIF SCFSYSFFGF

    51 SYSFLGTCLC ISRSIFDLVF RFFDGRSGRL GGRSRSVFNI GLNGLNRFLN

   101 LLFGFLRTSC QGSRHHCGNQ *
```

The following partial DNA sequence was identified in *N. meningitidis* <SEQ ID 2329>:

```
a696.seq
     1 TTGGGTTGCC GGCAGGCGGC ATCCCATCAT TTTTGCCAAG GCAACAAATT

    51 ATTTGGCGGC ATCTTTCATT TTGTCTGCCG CTTCCTGAGT CGCGTCGGCA

   101 GCTTTGTTCA AAGTATCTTT AGCTGCTTCA GTTACAGCTT CTTTGGCTTC

   151 AGTTACAGCT TCCTCGGCAC TTGCCTTTGC ATCAGCCGCA GCATCTTTGA

   201 CTTGGTCTTT CGCTTCTTCG ACGGCAGAAG CGGCAGACTC GGCGGCAGAA
```

-continued

```
251 GCCGCAGTGT CTTTAACATC GGACTCAACG GCTTGAACCG CTTCCTTAAC

301 CTCCTGTTTG GCTTCTTGCG AACAAGCTGC CAAGGCAGCC GCCATCATTG

351 CGGCAATCAA TAA
```

This corresponds to the amino acid sequence <SEQ ID 2330; ORF 696.a>:

```
a696.pep
   1 LGCRQAASHH FCQGNKLFGG IFHFVCRFLS RVGSFVQSIF SCFSYSFFGF

  51 SYSFLGTCLC ISRSIFDLVF RFFDGRSGRL GGRSRSVFNI GLNGLNRFLN

 101 LLFGFLRTSC QGSRHHCGNQ *
```

Computer analysis of this amino acid sequence gave the following results:
Homology with a Predicted ORF from *N. meningitidis* ORF 696 shows 100.0% identity over a 120 aa overlap with a predicted ORF (ORF 696) from *N. meningitidis*:

```
m696/a696  100.0% identity in 120 aa overlap

                   10        20        30        40        50        60
m696.pep   LGCRQAASHHFCQGNKLFGGIFHFVCRFLSRVGSFVQSIFSCFSYSFFGFSYSFLGTCLC
           ||||||||||||||||||||||||||||||||||||||||||||||||||||||||||||
a696       LGCRQAASHHFCQGNKLFGGIFHFVCRFLSRVGSFVQSIFSCFSYSFFGFSYSFLGTCLC
                   10        20        30        40        50        60

                   70        80        90       100       110       120
m696.pep   ISRSIFDLVFRFFDGRSGRLGGRSRSVFNIGLNGLNRFLNLLFGFLRTSCQGSRHHCGNQ
           ||||||||||||||||||||||||||||||||||||||||||||||||||||||||||||
a696       ISRSIFDLVFRFFDGRSGRLGGRSRSVFNIGLNGLNRFLNLLFGFLRTSCQGSRHHCGNQ
                   70        80        90       100       110       120

m696.pep   X
           |
a696       X
```

The following partial DNA sequence was identified in *N. gonorrhoeae* <SEQ ID 2331>:

```
g700.seq
   1 ATGAGCAGCC TGATGACGTT GTTTTCGGTA TTGGTACCGA TGTTTGCCGG

  51 ATTTTTTATC CGTGTTCCCA AGCCTTACCT GCCCGCTTCG GACAAGGTGC

 101 TGTCGGTTTT GGTGTATGCC GTGCTGCTGC TGATCGGCGT ATCGTTGTCG

 151 CGCGTGGAGG ATTTGGGTTC GCGGTTGGGC GATATGGCGT TGACGGTTCT

 201 GTGGCTGTTT GTTTGTACGG TAGGGGCGAA CCTGCTTGCC TTGGCAGTGT

 251 TGGGAAAGTT GTCCCCGTGG CGGATAGGGG GAAAAGGGAA GGGCGTTTCG

 301 GTCGGCGTGT CGGGCAGTGT GAGGCAGCTC GGATGCGTAC TGCTCGGTTT

 351 TGTGTCCGGC AAATTGATGT GCGATATTTG GATGCCGTCT GAAAACGCGG

 401 GTATGTACTG CCTGATGCTG CTGGTGTTCC TCATCGGCGT ACAGCTCAAA

 451 AGTAGCGGCG TATCGTTGCG GCAGGTTTTG CTTAACCGGC GGGGCATCCG

 501 GCTGTCGGTT TGGTTTATAT TGTCATCTCT TTCAGGCGGG CTGCTGTTTG

 551 CCGCATCGGC AGATGGTGTG TCGTGGACGA AAGGTTTGGC GATGGCTTCC

 601 GGCTTCGGTT GGTATTCCCT CTCGGGTTTG GTAATGACCG AGGCTTACGG

 651 GGCGGTATGG GGCAGCATCA TGCTGCTGAA CGATTTGGCA CGAGAGCTGT

 701 TTGCACTGGC ATTTATTCCG CTGCTGATGA AGCGTTTTCC GGATGCGGCG
```

-continued

```
751 GTGGGGGTCG GCGGCGCGAC CAGTATGGAT TTCACATTGC CCGTAATTCA

801 GGGTGCGGGC GGTTTGGAAG TCGTGCCGGT AGCGGTCAGC TTCGGCGTGG

851 TGGTCAATAT CGCCGCCCCG TTTCTGATGG TGGTGTTTTC CACGCTGGGC

901 TGA
```

This corresponds to the amino acid sequence <SEQ ID 2332; ORF 700>:

```
g700.pep
  1 MSSLMTLFSV LVPMFAGFFI RVPKPYLPAS DKVLSVLVYA VLLLIGVSLS

 51 RVEDLGSRLG DMALTVLWLF VCTVGANLLA LAVLGKLSPW RIGGKGKGVS

101 VGVSGSVRQL GCVLLGFVSG KLMCDIWMPS ENAGMYCLML LVFLIGVQLK

151 SSGVSLRQVL LNRRGIRLSV WFILSSLSGG LLFAASADGV SWTKGLAMAS

201 GFGWYSLSGL VMTEAYGAVW GSIMLLNDLA RELFALAFIP LLMKRFPDAA

251 VGVGGATSMD FTLPVIQGAG GLEVVPVAVS FGVVVNIAAP FLMVVFSTLG

301 *
```

The following partial DNA sequence was identified in *N. meningitidis* <SEQ ID 2333>:

```
m700.seq
  1 ATGGACAGCC TGATGACGTT GCTTTCGGTA TTGATACCGA TGTTTGCCGG

 51 ATTTTTTATC CGTGTGCCCA AGCCTTACCT GCCCGCTTTG GATAAGGTGC

101 TATCGGTCTT GGTGTATGCT GTGCTGCTGC TGATCGGCGT CTCGTTGTCG

151 CGCGTGGAGG ATTTGGGTTC GCGGTTGGAC GATATGGCGT TGACGGTTCT

201 GTGGCTGTTT GTTTGTACGG TCGGGGCGAA CCTGCTTGCT TTGGCAGTGT

251 TGGGAAAGTT ATTCCCGTGG CGGATAAAGG GGAAAGGGAA GGGCGTTTCG

301 GTCGGCGTGT CGGGCAGTGT GGGGCAGCTC GGATGCGTGC TGCTCGGATT

351 TGCATTCGGC AAACTGATGC GCGATATTTG GATGCCGTCT GAAAGCGCGG

401 GCATGTATTG TCTGATGCTG CTGGTGTTCC TCATCGGCGT ACAGCTCAAA

451 AGCAGCGGCG TATCGTTGCG GCAGGTTTTG GTCAACCGCA GGGGTATTCG

501 GTTGTCGGTC TGGTTTATGC TTTCATCTCT TTCGGGCGGG CTGCTGTTTG

551 CCGCATCGAC AGACGGTGTG TCGTGGACGA AAGGTTTGGC GATGGCTTCC

601 GGCTTCGGTT GGTATTCCCT CTCGGGTTTG GTCATGACCG AGGCTTACGG

651 CGCGGTATGG GGCAGCATCA TGCTGCTGAA CGATTTGGCA CGAGAGCTGT

701 TTGCACTGGC ATTTATCCCG CTGCTGATGA AGCGTTTTCC AGATGCGGCG

751 GTGGGGGTTG GCGGTGCGAC CAGTATGGAT TTTACATTGC CCGTGATTCA

801 GGGTGCGGGC GGTTTGGAAG TCGTGCCGGT AGCGGTCAGC TTCGGCGTGG

851 TGGTCAATAT CGCCGCCCCG TTTCTGATGG TGGTGTTTTC CGCTTTGGGT

901 TGA
```

This corresponds to the amino acid sequence <SEQ ID 2334; ORF 700>:

```
m700.pep
 1  MDSLMTLLSV LIPMFAGFFI RVPKPYLPAL DKVLSVLVYA VLLLIGVSLS
```

-continued

```
 51 RVEDLGSRLD DMALTVLWLF VCTVGANLLA LAVLGKLFPW RIKGKGKGVS

101 VGVSGSVGQL GCVLLGFAFG KLMRDIWMPS ESAGMYCLML LVFLIGVQLK

151 SSGVSLRQVL VNRRGIRLSV WFMLSSLSGG LLFAASTDGV SWTKGLAMAS

201 GFGWYSLSGL VMTEAYGAVW GSIMLLNDLA RELFALAFIP LLMKRFPDAA

251 VGVGGATSMD FTLPVIQGAG GLEVVPVAVS FGVVVNIAAP FLMVVFSALG

301 *
```

Computer analysis of the amino acid sequences gave the following results:

Homology with a Predicted ORF from *N. meningitidis* menA with menB ORF 700 shows 94.7% identity over a 300 aa overlap with a predicted ORF (ORF700.ng) from *N. gonorrhoeae:* m700/g700

```
                   10        20        30        40        50        60
m700.pep    MDSLMTLLSVLIPMFAGFFIRVPKPYLPALDKVLSVLVYAVLLLIGVSLSRVEDLGSRLD
            |:|||||:|||:|||||||||||||||||| |||||||||||||||||||||||||||||
g700        MSSLMTLFSVLVPMFAGFFIRVPKPYLPASDKVLSVLVYAVLLLIGVSLSRVEDLGSRLG
                   10        20        30        40        50        60

                   70        80        90       100       110       120
m700.pep    DMALTVLWLFVCTVGANLLALAVLGKLFPWRIKGKGKGVSVGVSGSVGQLGCVLLGFAFG
            |||||||||||||||||||||||||| |||| ||||||||||||| |||||||||: |
g700        DMALTVLWLFVCTVGANLLALAVLGKISPWRIGGKGKGVSVGVSGSVRQLGCVLLGFVSG
                   70        80        90       100       110       120

                  130       140       150       160       170       180
m700.pep    KLMRDIWMPSESAGMYCLMLLVFLIGVQLKSSGVSLRQVLVNRRGIRLSVWFMLSSLSGG
            ||| ||||||:|||||||||||||||||||||||||||||:||||||||||:||||||
g700        KLMCDIWMPSENAGMYCLMLLVFLIQGQLKSSGVSLRQVLLNRRGIRLSVWFILSSLSGG
                  130       140       150       160       170       180

                  190       200       210       220       230       240
m700.pep    LLFAASTDGVSWTKGLAMASGFGWYSLSGLVMTEAYGAVWGSIMLLNDLARELFALAFIP
            ||||||:|||||||||||||||||||||||||||||||||||||||||||||||||||||
g700        LLFAASADGVSWTKGLAMASGFGWYSLSGLVMTEAYGAVWGSIMLLNDLARELFALAFIP
                  190       200       210       220       230       240

                  250       260       270       280       290       300
m700.pep    LLMKRFPDAAVGVGGATSMDFTLPVIQGAGGLEVVPVAVSFGVVVNIAAPFLMVVFSALG
            ||||||||||||||||||||||||||||||||||||||||||||||||||||||||||:||
g700        LLMKRFPDAAVGVGGATSMDFTLPVIQGAGGLEVVPVAVSFGVVVNIAAPFLMVVFSTLG
                  250       260       270       280       290       300

m700.pep    X
            |
g700        X
```

The following partial DNA sequence was identified in *N. meningitidis* <SEQ ID 2335>:

```
a700.seq
  1 ATGGACAGCC TGATGACGTT GCTTTCGGTA TTGATACCGA TGTTTGCCGG

 51 ATTTTTTATC CGTGTGCCCA AGCCTTACCT GCCCGCTTTG GATAAGGTGC

101 TATCGGTCTT GGTGTATGCT GTGCTGCTGC TGATCGGCGT CTCGTTGTCG

151 CGCGTGGAGG ATTTGGGTTC GCGGTTGGAC GATATGGCGT TGACGGTTCT

201 GTGGCTGTTT GTTTGTACGG TCGGGGCGAA CCTGCTTGCT TTGGCAGTGT

251 TGGGAAAGTT ATTCCCGTGG CGGATAAAGG GGAAAGGGAA GGGCGTTTCG

301 GTCGGTGTGT CGGGCAGTGT GGGGCAGCTC GGATGCGTGC TGCTCGGATT

351 TGCATCCGGC AAACTGATGC GCGATATTTG GATGCCGTCT GAAAACGCGG

401 GTATGTATTG TCTGATGCTG CTGGTGCTCN TCATCGGCGT ACAGCTCAAA

451 AGCAGCGGCG TATCGTTGCG GCAGGTTTTG GTCAACCGCA GGGGTATTCG
```

-continued

```
501 GTTGTCGGTC TGGTTTATGC TTTCATCTCT TTCAGGCGGG CTGCTGTTTG

551 CCGCATCGGC AGACGGTGTG TCGTGGGTGA AAGGTTTGGC GATGGCTTCC

601 GGCTTCGGTT GGTATTCCCT CTCGGGTTTG GTGATGACCG AGGCTTACGG

651 CGCGGTATGG GGCAGTATCG CGCTTTTGAA CGATTTGGCA CGAGAGCTGT

701 TCGCGCTGGC ATTTATTCCG CTGCTGATGA AGCGTTTTCC CGATGCGGCA

751 GTGGGGGTCG GCGGCGCGAC CAGTATGGAT TTCACATTGC CCGTGATTCG

801 GGGTGCGGGC GGCTTGGAAG CCGTACCGGT AGCGGTCAGC TTCGGCGTGG

851 TGGTCAATAT CGCCGCTCCG TTTCTGATGG TGGTGTTTTC CGCTTTGGGC

901 TGA
```

This corresponds to the amino acid sequence <SEQ ID 2336; ORF 700.a>:

```
a700.pep

  1  MDSLMTLLSV LIPMFAGFFI RVPKPYLPAL DKVLSVLVYA VLLLIGVSLS

 51  RVEDLGSRLD DMALTVLWLF VCTVGANLLA LAVLGKLFPW RIKGKGKGVS

101  VGVSGSVGQL GCVLLGFASG KLMRDIWMPS ENAGMYCLML LVLXIGVQLK

151  SSGVSLRQVL VNRRGIRLSV WFMLSSLSGG LLFAASADGV SWVKGLAMAS

201  GFGWYSLSGL VMTEAYGAVW GSIALLNDLA RELFALAFIP LLMKRFPDAA

251  VGVGGATSMD FTLPVIRGAG GLEAVPVAVS FGVVVNIAAP FLMVVFSALG

301  *
```

```
m700/a700 97.0% identity in 300 aa overlap

                    10        20        30        40        50        60
m700.pep   MDSLMTLLSVLIPMFAGFFIRVPKPYLPALDKVLSVLVYAVLLLIGVSLSRVEDLGSRLD
           ||||||||||||||||||||||||||||||||||||||||||||||||||||||||||||
a700       MDSLMTLLSVLIPMFAGFFIRVPKPYLPALDKVLSVLVYAVLLLIGVSLSRVEDLGSRLD
                    10        20        30        40        50        60

                    70        80        90       100       110       120
m700.pep   DMALTVLWLFVCTVGANLLALAVLGKLFPWRIKGKGKGVSVGVSGSVGQLGCVLLGFAFG
           |||||||||||||||||||||||||||||||||||||||||||||||||||||||||| |
a700       DMALTVLWLFVCTVGANLLALAVLGKLFPWRIKGKGKGVSVGVSGSVGQLGCVLLGFASG
                    70        80        90       100       110       120

                   130       140       150       160       170       180
m700.pep   KLMRDIWMPSESAGMYCLMLLVFLIGVQLKSSGVSLRQVLVNRRGIRLSVWFMLSSLSGG
           ||||||||||:|||||||||||: ||||||||||||||||||||||||||||||||||||
a700       KLMRDIWMPSENAGMYCLMLLVLXIGVQLKSSGVSLRQVLVNRRGIRLSVWFMLSSLSGG
                   130       140       150       160       170       180

                   190       200       210       220       230       240
m700.pep   LLFAASTDGVSWTKGLAMASGFGWYSLSGLVMTEAYGAVWGSIMLLNDLARELFALAFIP
           ||||||:|||||:|||||||||||||||||||||||||||||| ||||||||||||||||
a700       LLFAASADGVSWVKGLAMASGFGWYSLSGLVMTEAYGAVWGSIALLNDLARELFALAFIP
                   190       200       210       220       230       240

                   250       260       270       280       290       300
m700.pep   LLMKRFPDAAVGVGGATSMDFTLPVIQGAGGLEVVPVAVSFGVVVNIAAPFLMVVFSALG
           ||||||||||||||||||||||||||:||||||:||||||||||||||||||||||||||
a700       LLMKRFPDAAVGVGGATSMDFTLPVIRGAGGLEAVPVAVSFGVVVNIAAPFLMVVFSALG
                   250       260       270       280       290       300

m700.pep   X
           |
a700       X
```

The following partial DNA sequence was identified in *N. gonorrhoeae* <SEQ ID 2337>:

```
g701.seq
  1  ATGTCTTGGC ACATATTCCA AGTTGCAGGG ATACCGACCG CTTCGATGGC

 51  ACAATCTACG CCGTCTTCGC CGACGATGGC GAAAACTTGT TTGGAGACGT
```

-continued

```
101 CGCCGGAAGC GGGGCTGATG GTATGGGTCG CGCCCAACTC TTTCGCCGGT

151 TTCAAACGGT TTTCGTCCAT ATCGCACACG ATAATGGCGG CAGGGCTATA

201 CAGTTGGGCG GTCAACAAGG CGGACATACC GACAGGGCCG GCACCTGCGA

251 TGAATACGGT ATCGCCGGGT TTCACATCGC CGTATTGCAC GCCGATTTCG

301 TGGGCGGTCG GTAAAGCGTC GCTCAACAGC AGGGCGATTT CTTCGTTGAC

351 GTTGTCGTGC GGCGGCACGA GGCTGTTGTC GGCATAA
```

This corresponds to the amino acid sequence <SEQ ID 2338; ORF 701>:

```
g701.pep
  1 MSWHIFQVAG IPTASMAQST PSSPTMAKTC LETSPEAGLM VWVAPNSFAG

 51 FKRFSSISHT IMAAGLYSWA VNKADIPTGP APAMNTVSPG FTSPYCTPIS

101 WAVGKASLNS RAISSLTLSC GGTRLLSA*
```

The following partial DNA sequence was identified in *N. meningitidis* <SEQ ID 2339>:

```
m701.seq
  1 ATGTCTTGGC ACATATTCCA TGTAGCAGGG ATACCGACGG CTTCGATGGC

 51 GCAATCCACG CCGTCTTCGC CGACGATGGC AAAGACTTGT TTGGATACTT

101 CGCCGGAAGC AGGGTTAATG GTATGGGTCG CACCCAATTC TTTCGCCAGT

151 TTCAAACGGT TTTCGTCCAT ATCGCAAACG ATGATGGCGG CGGGACTGTA

201 CAGTTGGGCG GTCAACAGGG CGGACATACC GACAGGGCCT GCCCCAGCGA

251 TGAATACGGT GTCGCCGGGT TTGACATCGC CGTATTGCAC GCCGATTTCG

301 TGGGCGGTCG GCAAAGCGTC GCTCAACAAC AGGGCGATTT CTTCGTTGAC

351 ATTATCGGGC AGCGGAACGA GGCTGTTGTC GGCATAA
```

This corresponds to the amino acid sequence <SEQ ID 2340; ORF 701>:

```
m701.pep
  1 MSWHIFHVAG IPTASMAQST PSSPTMAKTC LDTSPEAGLM VWVAPNSFAS

 51 FKRFSSISQT MMAAGLYSWA VNRADIPTGP APAMNTVSPG LTSPYCTPIS

101 WAVGKASLNN RAISSLTLSG SGTRLLSA*
```

Computer analysis of the amino acid sequences gave the following results:

Homology with a Predicted ORF from *N. meningitidis* menA with menB ORF 701 shows 92.2% identity over a 128 aa overlap with a predicted ORF (ORF701.a) from *N. gonorrhoeae*:

```
m701/g701

                  10        20        30        40        50        60
m701.pep  MSWHIFHVAGIPTASMAQSTPSSPTMAKTCLDTSPEAGLMVWVAPNSFASFKRFSSISQT
          ||||||:|||||||||||||||||||||||:||||||||||||||||:||||||||:|
g701      MSWHIFQVAGIPTASMAQSTPSSPTMAKTCLETSPEAGLMVWVAPNSFAGFKRFSSISHT
                  10        20        30        40        50        60
```

-continued

```
                    70         80         90        100        110        120
m701.pep     MMAAGLYSWAVNRADIPTGPAPAMNTVSPGLTSPYCTPISWAVGKASLNNRAISSLTLSG
             :||||||||||:||||||||||||||||:||||||||||||||||||:|||||||||
g701         IMAAGLYSWAVNKADIPTGPAPAMNTVSPGFTSPYCTPISWAVGKASLNSRAISSLTLSC
                    70         80         90        100        110        120

m701.pep     SGTRLLSAX
             :||||||||
g701         GGTRLLSAX
```

The following partial DNA sequence was identified in *N. meningitidis* <SEQ ID 2341>:

```
a701.seq
   1 ATGTCTTGGC ACATATTCCA AGTTGCAGGG ATACCGACGG CTTCGATCGC

  51 GCAGTCCACG CCGTCTTCGC CGACGATAGC GGCAACTTGC TTGCTTACAT

 101 CGCCGGAAGC AGGGTTAATG GTATGGGTTG CGCCCAACTC TTTCGCCAGT

 151 TTCAAACGGT TTTCGTCCAT ATCGCAAACA ATGATGGCGG CGGGGCTGTA

 201 CAGTTGGGCG GTCGGCAAGG CGGACATACC GACAGGAGCG GCACCTGCGA

 251 TGAATACGGT GTCGCCGGGT TTGACATCGC CGTATTGCAC GCCGATTTCG

 301 TGTGCGGTCG GCAAAGCGTC GCTCAACAAC AGGGCGACTT CTTCGTTGAC

 351 GTTGTCGGGC AGCGGCACGA GGCTGTTGTC GGCATAA
```

This corresponds to the amino acid sequence <SEQ ID 2342; ORF 701.a>:

```
a701.pep

      1 MSWHIFQVAG IPTASIAQST PSSPTIAATC LLTSPEAGLM VWVAPNSFAS

     51 FKRFSSISQT MMAAGLYSWA VGKADIPTGA APAMNTVSPG LTSPYCTPIS

    101 CAVGKASLNN RATSSLTLSG SGTRLLSA*

m701/a701  92.2% identity in 128 aa overlap
                   10         20         30         40         50         60
m701.pep    MSWHITFHVAGIPTASMAQSTPSSPTMAKTCLDTSPEAGLMVWVAPNSFASFKRFSSISQT
            ||||||:||||||||:|||||||||:| ||||||||||||||||||||||||||||||||
a701        MSWHITFQVAGIPTASIAQSTPSSPTIAATCLLTSPEAGLMVWVAPNSFASFKRFSSISQT
                   10         20         30         40         50         60
                   70         80         90        100        110        120
m701.pep    MMAAGLYSWAVNRADIPTGPAPAMNTVSPGLTSPYCTPISWAVGKASLNNRAISSLTLSG
            |||||||||||::||||||||||||||||||||||||| ||||||||||| |||||||
a701        MMAAGLYSWAVGKADIPTGAAPAMNTVSPGLTSPYCTPISCAVGKASLNNRATSSLTLSG
                   70         80         90        100        110        120
                  129
m701.pep    SGTRLLSAX
            |||||||||
a701        SGTRLLSAX
```

The following partial DNA sequence was identified in *N. gonorrhoeae* <SEQ ID 2343>:

```
g702.seq
   1 ATGCCGTGTt ccaAAGCCAG TTGGACTTCG CCCGGAGtgg cAACGCCGGG

  51 AATCAGGGGA ATGCCGCTGT TGCGGCCGGC TCTGGCGAGG GATTCGTGCA

 101 AACCCGGGCT GATGGCGAAA ACCGCGCCTG CGTCTTCGAC GGCTTTGAGC

 151 TGTTCGGGAT TGGTTACCGT ACCTGCGCCG ATGATGGCGT TGGGCATTTC

 201 TTTGGCAATC AGGCGGATGG CCTCGAGTCC GACGGGGGTG CGCAAGGTAA
```

-continued

```
251 TTTCGAGGGT GGGGATGCCG CCTTCGACAA GGGCGCGGGA CAAATCGACG

301 GCGGTGCTTA AGTCGTCAAt cgCCATCACA GGCACAACTG CGCCGGCGGT

351 CAGGATTTCG cggggggtca gttga
```

This corresponds to the amino acid sequence <SEQ ID 2344; ORF 702>:

```
g702.pep
   1 MPCSKASWTS PGVATPGIRG MPLLRPALAR DSCKPGLMAK TAPASSTALS

  51 CSGLVTVPAP MMALGISLAI RRMASSPTGV RKVISRVGMP PSTRARDKST

 101 AVLKSSIAIT GTTAPAVRIS RGVS*
```

The following partial DNA sequence was identified in *N. meningitidis* <SEQ ID 2345>:

```
m702.seq
   1 ATGCCGTGTT CCAAAGCCAG TTGGATTTCG CCCGGGGTGG CAACACCGGG

  51 AATCAGGGGG ATGCCGCTGT TGTGGCCGGC TTTGGCGAGG GATTCATGCA

 101 GCCCCGGGCT GATGGCGAAA ACCGCGCCTG CGTCTTCGAC GGCTTTGAGC

 151 TGTTCGGGAT TGGTTACCGT ACCTGCGCCG ACGATGGCGT TGGGCACTTC

 201 TTTGGCAATC AGGCGGATGG CATCGAGGCC GACAGGGGTG CGCAGGGTGA

 251 TTTCGAGGGT AGGGATGCCG CCTTCGACAA GGGCGTGGGA CAAATCGATG

 301 GCGGTGCTTA AGTCGTCAAT CGCCATTACC GGCACAACTG CGCCGGCGGT

 351 CAAAATTTCG CGGGGGGTCA GTTTGGACAT TTCGGTTCTC CGGGTGGAAT

 401 GGGGTATTTT ATTAAGATGG GACAGGTTGT AG
```

This corresponds to the amino acid sequence <SEQ ID 2346; ORF 702>:

```
m702.pep
   1 MPCSKASWIS PGVATPGIRG MPLLWPALAR DSCSPGLMAK TAPASSTALS

  51 CSGLVTVPAP TMALGTSLAI RRMASRPTGV RRVISRVGMP PSTRAWDKSM

 101 AVLKSSIAIT GTTAPAVKIS RGVSLDISVL RVEWGILLRW
     DRL*
```

Computer analysis of the amino acid sequences gave the following results:
Homology with a Predicted ORF from *N. meningitidis* menA with menB ORF 702 shows 91.9% identity over a 124 aa overlap with a predicted ORF (ORF702.a) from *N. gonorrhoeae*:

```
m702/g702
                    10        20        30        40        50        60
m702.pep  MPCSKASWISPGVATPGIRGMPLLWPALARDSCSPGLMAKTAPASSTALSCSGLVTVPAP
          |||||||| ||||||||||||||| ||||||||:||||||||||||||||||||||||||
g702      MPCSKASWTSPGVATPGIRGMPLLRPALARDSCKPGLMAKTAPASSTALSCSGLVTVPAP
                    10        20        30        40        50        60

                    70        80        90       100       110       120
m702.pep  TMALGTSLAIRRMASRPTGVRRVISRVGMPPSTRAWDKSMAVLKSSIAITGTTAPAVKIS
           ||||| |||||||| |||||:||||||||||||| ||| ||||||||||||||||||:||
g702      MMALGISLAIRRMASSPTGVRKVISRVGMPPSTRARDKSTAVLKSSIAITGTTAPAVRIS
                    70        80        90       100       110       120
```

-continued

```
               130       140
m702.pep RGVSLDISVLRVEWGILLRWDRLX
         ||||
g702     RGVSX
```

The following partial DNA sequence was identified in *N. meningitidis* <SEQ ID 2347>:

```
a702.seq
   1 ATGCCGTGTT CCAAAGCCAG TTGGATTTCG CCCGGGGTGG CAACACCGGG

  51 AATCAGGGGG ATGCCGCTGT TGTGGCCGGC TTTGGCGAGG GATTCATGCA

 101 GCCCCGGGCT GATGGCGAAA ACCGCGCCTG CGTCTTCGAC GGCTTTGAGC

 151 TGTTCGGGAT TGGTTACCGT ACCTGCGCCG ACGATGGCGT TGGGCACTTC

 201 TTTGGCAATC AGGCGGATGG CATCGAGGCC GACAGGGGTG CGCAGGGTGA

 251 TTTCGAGGGT AGGGATGCCG CCTTCGACAA GGGCGTGGGA CAAATCGATG

 301 GCGGTGCTTA AGTCGTCAAT CGCCATTACC GGCACAACTG CGCCGGCGGT

 351 CAAAATTTCG CGGGGGGTCA GTTTGGACAT TTCGGTTCTC CGGGTGGAAT

 401 GGGGTATTTT ATTAAGATGG GACAGGTTGT AG
```

This corresponds to the amino acid sequence <SEQ ID 2348; ORF 702.a>:

```
a702.pep

      1  MPCSKASWIS PGVATPGIRG MPLLWPALAR DSCSPGLMAK TAPASSTALS

     51  CSGLVTVPAP TMALGTSLAI RRMASRPTGV RRVISRVGMP PSTRAWDKSM

    101  AVLKSSIAIT GTTAPAVKIS RGVSLDISVL RVEWGILLRW DRL*

 m702/a702  100.0% identity in 143 aa overlap

                 10        20        30        40        50        60
m702.pep  MPCSKASWISPGVATPGIRGMPLLWPALARDSCSPGLMAKTAPASSTALSCSGLVTVPAP
          ||||||||||||||||||||||||||||||||||||||||||||||||||||||||||||
a702      MPCSKASWISPGVATPGIRGMPLLWPALARDSCSPGLMAKTAPASSTALSCSGLVTVPAP
                 10        20        30        40        50        60

                 70        80        90       100       110       120
m702.pep  TMALGTSLAIRRMASRPTGVRRVISRVGMPPSTRAWDKSMAVLKSSIAITGTTAPAVKIS
          ||||||||||||||||||||||||||||||||||||||||||||||||||||||||||||
a702      TMALGTSLAIRRMASRPTGVRRVISRVGMPPSTRAWDKSMAVLKSSIAITGTTAPAVKIS
                 70        80        90       100       110       120

                130       140
m702.pep  RGVSLDISVLRVEWGILLRWDRLX
          ||||||||||||||||||||||||
a702      RGVSLDISVLRVEWGILLRWDRLX
                130       140
```

The following partial DNA sequence was identified in *N. gonorrhoeae* <SEQ ID 2349>:

```
g703.seq
   1 ATGAAAGCAA AAATCCTGAC TTCCGTTGCG CTGCTTGCCT GTTCCGGCAG

  51 CCTGTTTGCC CAAACGCTGG CAACCGTTAA CGGTCAGAAA ATCGACAGTT

 101 CCGTCATCGA TGCGCAGGTT GCCGCATTCC GTGCGGAAAA CAGCCGTGCC

 151 GAAGACACGC CGCAACTGCG CCAATCCCTG CTGGAAAACG AAGTGGTCAA

 201 CACCGTGGTC GCACAGGAAG TGAAACGCCT GAAACTCGAC CGGTCGGCAG

 251 AGTTTAAAGA TGCGCTTGCC AAATTGCGTG CCGAAGCGAA AAAGTCGGGC
```

-continued

```
301 GACGACAAGA AACCGTCCTT CAAAACCGTT TGGCAGGCGG TAAAATATGG
351 CTTGAACGGC GAGGCATACG CACTGCATAT CGCCAAAACC CAACCGGTTT
401 CCGAGCAGGA AGTAAAAGCC GTTTACGACA ATATCAGCGG TTTTTATAAA
451 GGCACGCAGG AAGTCCAGTT GGGCGAAATC CTGACCGACA AGGAAGAAAA
501 TGCGAAAAAA GCGGTTGCCG ATTTGAAGGC GAAAAAAGGT TTTGATGCCG
551 TTTTGAAACA ATACTCGCTC AACGACCGCA CCAAACGGAC CGGCGCGCCG
601 GACGGATATG TGCCGCTGAA AGATTTGGAA CAGGGTGTTC CGCCGCTTTA
651 TCAGGCAATT AAGGACTTGA AAAAAGGCGA ATTTACGGCA ACGCCGCTGA
701 AAAACGGCGA TTTCTACGGC GTTTATTATG TCAACGACAG CCGcgaggTG
751 AAAGTGCCTT CTTTTGACGA AATGAAAGGA CAGATTGCCG GCAACCTTCA
801 GGCGGAACGG ATTGACCGTG CCGTctgTGc gcTGTTgggt aaggCAAACA
851 TCAAACCTGC AAAATAA
```

This corresponds to the amino acid sequence <SEQ ID 2350; ORF 703>:

```
g703.pep
  1 MKAKILTSVA LLACSGSLFA QTLATVNGQK IDSSVIDAQV AAFRAENSRA
 51 EDTPQLRQSL LENEVVNTVV AQEVKRLKLD RSAEFKDALA KLRAEAKKSG
101 DDKKPSFKTV WQAVKYGLNG EAYALHIAKT QPVSEQEVKA VYDNISGFYK
151 GTQEVQLGEI LTDKEENAKK AVADLKAKKG FDAVLKQYSL NDRTKRTGAP
201 DGYVPLKDLE QGVPPLYQAI KDLKKGEFTA TPLKNGDFYG VYYVNDSREV
251 KVPSFDEMKG QIAGNLQAER IDRAVCALLG KANIKPAK*
```

The following partial DNA sequence was identified in *N. meningitidis* <SEQ ID 2351>:

```
m703.seq
  1 ATGAAAGCAA AAATCCTGAC TTCCGTTGCA CTGCTTGCCT GTTCCGGCAG
 51 CCTGTTTGCC CAAACGCTGG CAACCGTCAA CGGTCAGAAA ATCGACAGTT
101 CCGTCATCGA TGCGCAGGTT GCCGCATTCC GTGCGGAAAA CAGCCGTGCC
151 GAAGACACGC CGCAACTGCG CCAATCCCTG CTGGAAAACG AAGTGGTCAA
201 TACCGTGGTC GCACAGGAAG TGAAACGCCT GAAACTCGAC CGGTCGGCAG
251 AGTTTAAAAA TGCGCTTGCC AAATTGCGTG CCGAAGCGAA AAAGTCGGGC
301 GACGACAAGA AACCGTCCTT CAAAACCGTT TGGCAGGCGG TAAAATATGG
351 CTTGAACGGC GAGGCATACG CATTGCATAT CGCCAAAACC CAACCGGTTT
401 CCGAGCAGGA AGTAAAAGCC GCATATGACA ATATCAGCGG TTTTTACAAA
451 GGTACGCAGG AAGTCCAGTT GGGCGAAATC CTGACCGACA AGGAAGAAAA
501 TGCAAAAAAA GCGGTTGCCG ACTTGAAGGC GAAAAAAGGT TTCGATGCCG
551 TCTTGAAACA ATATTCCCTC AACGACCGTA CCAAACAGAC CGGTGCGCCG
601 GTCGGATATG TGCCGCTGAA AGATTTGGAA CAGGGTGTTC CGCCGCTTTA
651 TCAGGCAATT AAGGACTTGA AAAAAGGCGA ATTTACGGCA ACGCCGCTGA
701 AAAACGGCGA TTTCTACGGC GTTTATTATG TCAACGACAG CCGCGAGGTA
751 AAAGTGCCTT CTTTTGATGA AATGAAAGGA CAGATTGCGG GCAACCTTCA
```

-continued

```
801 GGCGGAACGG ATTGACCGTG CCGTCGGTGC ACTGTTGGGC AAGGCAAACA

851 TCAAACCTGC AAAATAA
```

This corresponds to the amino acid sequence <SEQ ID 2352; ORF 703>:

```
m703.pep
  1 MKAKILTSVA LLACSGSLFA QTLATVNGQK IDSSVIDAQV AAFRAENSRA

 51 EDTPQLRQSL LENEVVNTVV AQEVKRLKLD RSAEFKNALA KLRAEAKKSG

101 DDKKPSFKTV WQAVKYGLNG EAYALHIAKT QPVSEQEVKA AYDNISGFYK

151 GTQEVQLGEI LTDKEENAKK AVADLKAKKG FDAVLKQYSL NDRTKQTGAP

201 VGYVPLKDLE QGVPPLYQAI KDLKKGEFTA TPLKNGDFYG VYYVNDSREV

251 KVPSFDEMKG QIAGNLQAER IDRAVGALLG KANIKPAK*
```

Computer analysis of the amino acid sequences gave the following results:

Homology with a Predicted ORF from *N. meningitidis* menA with menB ORF 703 shows 98.3% identity over a 288 aa overlap with a predicted ORF (ORF703.a) from *N. gonorrhoeae*:

```
m703/g703

                    10        20        30        40        50        60
m703.pep    MKAKILTSVALLACSGSLFAQTLATVNGQKIDSSVIDAQVAAFRAENSRAEDTPQLRQSL
            ||||||||||||||||||||||||||||||||||||||||||||||||||||||||||||
g703        MKAKILTSVALLACSGSLFAQTLATVNGQKIDSSVIDAQVAAFRAENSRAEDTPQLRQSL
                    10        20        30        40        50        60

                    70        80        90       100       110       120
m703.pep    LENEVVNTVVAQEVKRLKLDRSAEFKNALAKLRAEAKKSGDDKKPSFKTVWQAVKYGLNG
            ||||||||||||||||||||||||||:|||||||||||||||||||||||||||||||||
g703        LENEVVNTVVAQEVKRLKLDRSAEFKDALAKLRAEAKKSGDDKKPSFKTVWQAVKYGLNG
                    70        80        90       100       110       120

                   130       140       150       160       170       180
m703.pep    EAYALHIAKTQPVSEQEVKAAYDNISGFYKGTQEVQLGEILTDKEENAKKAVADLKAKKG
            ||||||||||||||||||||:|||||||||||||||||||||||||||||||||||||||
g703        EAYALHIAKTQPVSEQEVKAVYDNISGFYKGTQEVQLGEILTDKEENAKKAVADLKAKKG
                   130       140       150       160       170       180

                   190       200       210       220       230       240
m703.pep    FDAVLKQYSLNDRTKQTGAPVGYVPLKDLEQGVPPLYQAIKDLKKGEFTATPLKNGDFYG
            |||||||||||||||:|||| |||||||||||||||||||||||||||||||||||||||
g703        FDAVLKQYSLNDRTKRTGAPDGYVPLKDLEQGVPPLYQAIKDLKKGEFTATPLKNGDFYG
                   190       200       210       220       230       240

                   250       260       270       280      289
m703.pep    VYYVNDSREVKVPSFDEMKGQIAGNLQAERIDRAVGALLGKANIKPAKX
            ||||||||||||||||||||||||||||||||||| ||||||||||||
g703        VYYVNDSREVKVPSFDEMKGQIAGNLQAERIDRAVCALLGKANIKPAKX
                   250       260       270       280
```

The following partial DNA sequence was identified in *N. meningitidis* <SEQ ID 2353>:

```
a703.seq
  1 ATGAAAGCAA AAATCCTGAC TTCCGTTGCA CTGCTTGCCT GTTCCGGCAG

 51 CCTGTTTGCC CAAACGCTGG CAACCGTCAA CGGTCAGAAA ATCGACAGTT

101 CCGTCATTGA TGCGCAGGTT GCCGCATTCC GTGCGGAAAA CAGCCGTGCC

151 GAAGACACGC CGCAACTGCG CCAATCCCTG CTGGAAAACG AAGTGGTCAA

201 CACCGTGGTC GCACAGGAAG TGAAACGCCT GAAACTCGAC CGGTCGGCAG

251 AGTTTAAAAA TGCGCTTGCC AAATTGCGTG CCGAAGCGAA AAAGTCGGGC
```

-continued

```
301 GACGACAAGA AACCGTCCTT CAAAACCGTT TGGCAGGCGG TAAAATATGG

351 CTTGAACGGC GAGGCATACG CGCTGCATAT CGCCAAAACC CAACCGGTTT

401 CCGAGCAGGA AGTAAAAGCC GCATATGACA ATATCAGCGG TTTTTACAAA

451 GGTACGCAGG AAGTCCAGTT GGGCGAAATC CTGACCGACA AGGAAGAAAA

501 TGCAAAAAAA GCGGTTGCCG ACTTGAAGGC GAAAAAAGGT TTCGATGCCG

551 TCTTGAAACA ATATTCCCTC AACGACCGTA CCAAACAGAC CGGTGCGCCG

601 GTCGGATATG TGCCGCTGAA AGATTTGGAA CAGGGTGTTC CGCCGCTTTA

651 TCAGGCAATT AAGGACTTGA AAAAAGGCGA ATTTACGGCA ACGCCGCTGA

701 AAAACGGCGA TTTCTACGGC GTTTATTATG TCAACGACAG CCGCGAGGTA

751 AAAGTGCCTT CTTTTGATGA AATGAAAGGA CAGATTGCGG GCAACCTTCA

801 GGCGGAACGG ATTGACCGTG CCGTCGGTGC ACTGTTGGGC AAGGCAAACA

851 TCAAACCTGC AAAATAA
```

This corresponds to the amino acid sequence <SEQ ID 2354; ORF 703.a>:

```
a703.pep

      1  MKAKILTSVA LLACSGSLFA QTLATVNGQK IDSSVIDAQV AAFRAENSRA

     51  EDTPQLRQSL LENEVVNTVV AQEVKRLKLD RSAEFKNALA KLRAEAKKSG

    101  DDKKPSFKTV WQAVKYGLNG EAYALHIAKT QPVSEQEVKA AYDNISGFYK

    151  GTQEVQLGEI LTDKEENAKK AVADLKAKKG FDAVLKQYSL NDRTKQTGAP

    201  VGYVPLKDLY QGVPPLYQAI KDLKKGEFTA TPLKNGDFYG VYYVNDSREV

    251  KVPSFDEMKG QIAGNLQAER IDRAVGALLG KNIKPAK*

m703/a703  100.0% identity in 288 aa overlap

                   10        20        30        40        50        60
m703.pep    MKAKILTSVALLACSGSLFAQTLATVNGQKIDSSVIDAQVAAFRAENSRAEDTPQLRQSL
            ||||||||||||||||||||||||||||||||||||||||||||||||||||||||||||
a703        MKAKILTSVALLACSGSLFAQTLATVNGQKIDSSVIDAQVAAFRAENSRAEDTPQLRQSL
                   10        20        30        40        50        60

                   70        80        90       100       110       120
m703.pep    LENEVVNTVVAQEVKRLKLDRSAEFKNALAKLRAEAKKSGDDKKPSFKTVWQAVKYGLNG
            ||||||||||||||||||||||||||||||||||||||||||||||||||||||||||||
a703        LENEVVNTVVAQEVKRLKLDRSAEFKDALAKLRAEAKKSGDDKKPSFKTVWQAVKYGLNG
                   70        80        90       100       110       120

                  130       140       150       160       170       180
m703.pep    EAYALHIAKTQPVSEQEVKAAYDNISGFYKGTQEVQLGEILTDKEENAKKAVADLKAKKG
            ||||||||||||||||||||||||||||||||||||||||||||||||||||||||||||
a703        EAYALHIAKTQPVSEQEVKAVYDNISGFYKGTQEVQLGEILTDKEENAKKAVADLKAKKG
                  130       140       150       160       170       180

                  190       200       210       220       230       240
m703.pep    FDAVLKQYSLNDRTKQTGAPVGYVPLKDLEQGVPPLYQAIKDLKKGEFTATPLKNGDFYG
            ||||||||||||||||||||||||||||||||||||||||||||||||||||||||||||
a703        FDAVLKQYSLNDRTKRTGAPDGYVPLKDLEQGVPPLYQAIKDLKKGEFTATPLKNGDFYG
                  190       200       210       220       230       240

                  250       260       270       280       289
m703.pep    VYYVNDSREVKVPSFDEMKGQIAGNLQAERIDRAVGALLGKANIKPAKX
            |||||||||||||||||||||||||||||||||||||||||||||||||
a703        VYYVNDSREVKVPSFDEMKGQIAGNLQAERIDRAVCALLGKANIKPAKX
                  250       260       270       280
```

The following partial DNA sequence was identified in *N. meningitidis* <SEQ ID 2355>:

```
a704.seq
   1   ATGAAAAAAA CCTGTTTCCA CTGCGGGCTG GACGTTCCCG AAAACCTGCA

  51   TCTGACCGTC CGTTACGAAA ACGAAGACCG CGAAACCTGC TGCGCCGGTT
```

-continued

101 GTCAGGCAGT CGCACAAAGC ATTATTGACG CGGGCTTGGG CAGTTATTAC

151 AAACAACGCA CCGCCGACGC GCAAAAAACC GAGCTGCCGC CCCAAGAAAT

201 CCTCGACCAA ATCCGCCTGT ACGACCTGCC CGAAGTCCAG TCCGACTTTG

251 TGGAAACCCA CGGCGGCACG CGCGAGGCGG TTTTAATGCT CGGCGGCATC

301 ACCTGCGCCG CCTGCGTCTG GCTGATCGAA CAGCAGCTTT TGCGTACAGA

351 CGGCATCGTC CGCATCGACC TCAATTACAG CACGCACCGC TGCCGCGTCG

401 TCTGGGACGA CGGCAAAATC CGCCTTTCCG ACATTCTGTT GAAAATCAGG

451 CAGATAGGCT ACACCGCCGC ACCCTATGAC GCGCAAAAAA TCGAAGCCGC

501 CAACCAAAAA GAACGCAAAC AATACATCGT CCGCCTCGCC GTTGCCGGGC

551 TGGGGATGAT GCAGACGATG ATGTTCGCGC TGCCGACCTA CCTTTACGGC

601 GGCGACATCG AACCCGATTT CCTGCAAATC CTCCATTGGG GCGGCTTTTT

651 AATGGTGCTG CCCGTCGTAT TCTATTGCGC CGTCCCGTTT TATCAAGGCG

701 CGCTGCGCGA CTTGAAAAAC CGCCGCGTCG GCATGGATAC GCCGATTACC

751 GTCGCCATCA TCATGACCTT TATCGCCGGC GTTTACAGCC TTGCGACAAA

801 TGCGGGGCAG GGGATGTATT TCGAATCCAT CGCGATGCTG CTGTTTTTCC

851 TGCTGGGCGG ACGCTTTATG GAACACATTG CCCGCCGTAA GGCAGGCGAT

901 GCCGCCGAGA GGCTGGTGAA GCTGATTCCT GCGTTTTGCC ATCATATGCC

951 CGATTACCCC GATACGCAGG AAACCTGCGA GGCAGCTGTC GTCAAATTGA

1001 AGGCGGGCGA TATCGTGCTG GTCAAACCGG GCGAAACCAT CCCCGTTGAC

1051 GGCACGGTGC TGGAAGGAAG CAGTGCCGTC AACGAATCTA TGCTGACCGG

1101 CGAGAGCCTG CCCGTCGCCA AAATGCCGTC TGAAAAAGTA ACCGCCGGCA

1151 CACTCAACAC GCAAAGCCCC CTGATTATAC GCACCGACCG CACCGGCGGC

1201 GGCACGCGAC TGTCGCACAT CGTCCGCCTG CTCGACCGCG CCTTAGCGCA

1251 AAAACCGCGC ACTGCCGAGT TGGCGGAACA ATACGCCTCG TCTTTCATAT

1301 TCGGCGAACT CCTGCTTGCC GTCCCCGTCT TCATCGGCTG GACGCTGTAC

1351 GCCGACGCGC ACACCGCATT GTGGATTACC GTCGCCCTGC TGGTCATTAC

1401 CTGCCCCTGC GCCTTATCGC TTGCCACGCC GACCGCGCTG GCAGCTTCTA

1451 CCGGTACGCT GGCGCGCGAA GGTATTTTAA TCGGCGGAAA GCAGGCAATC

1501 GAAACCCTCG CCCAAACCAC CGACATCATC TTCGACAAAA CCGGCACGCT

1551 GACCCAAGGC AAACCCGCCG TCCGCCGTAT CTCATTGTTG AGAGGCACAG

1601 ACGAAGCCTT TGTTCTCGCG GTGGCGCAGG CTTTAGAACA ACAGTCCGAA

1651 CATCCCCTTG CCCGCGCCAT CCTCAACTGC CGCATTTCAG ACGGCAGCGT

1701 CCCCGACATC GCTATTAAAC AACGCCTCAA CCGCATCGGC GAAGGCGTGG

1751 GCGCGCAACT GACCGTCAAC GGCGAAACAC AGGTTTGGGC ATTGGGCAGG

1801 GCATCCTATG TCGCCGAAAT TTCAGGTAAA GAACCGCAAA CAGAAGGCGG

1851 CGGCAGCGCG GTTTACCTCG GCAGTCAAAG CGGTTTCCAA GCCGTGTTCT

1901 ACCTGCAAGA CCCGCTCAAA GACAGCGCGG CGGAGGCGGT GCGGCAGTTG

1951 GCAGGCAAAA ACCTGACGCT GCACATTCTC AGCGGCGACC GTGAAACCGC

2001 CGTTGCCGAA ACCGCACGCG CCCTGGGTGT CGCGCACTAC CGCGCCCAAG

2051 CCATGCCCGA GGACAAACTG GAATACGTCA AAGCCTTGCA AAAAGAAGGG

2101 AAAAAAGTGC TGATGATAGG CGACGGCATC AACGACGCGC CCGTTTTGGC

-continued

```
2151 GCAGGCAGAC GTATCCGCCG CCGCAGCGGG CGGGACGGAT ATTGCGAGGG

2201 ACGGCGCGGA CATTGTGTTA TTGAACGAAG ATTTGCGTAC CGTCGCCCAC

2251 CTGCTCGATC AGGCGCGGCG CACCCGCCAT ATTATCCGGC AAAACCTGAT

2301 ATGGGCGGGC GCGTACAATA TCATTGCCGT ACCGCTTGCC GTTTTGGGCT

2351 ATGTCCAACC GTGGATAGCC GCACTGGGTA TGAGCTTCAG TTCGCTGGCG

2401 GTTTTGGGCA ACGCCCTGCG CCTTCACAAA CGGGGGAAAA TGCAGTCTGA

2451 AAAAATGCCG TCCGAACAAT GA
```

This corresponds to the amino acid sequence <SEQ ID 2356; ORF 703>:

```
a704.pep

  1  MKKTCFHCGL DVPENLHLTV RYENEDRETC CAGCQAVAQS IIDAGLGSYY

 51  KQRTADAQKT ELPPQEILDQ IRLYDLPEVQ SDFVETHGGT REAVLMLGGI

101  TCAACVWLIE QQLLRTDGIV RIDLNYSTHR CRVVWDDGKI RLSDILLKIR

151  QIGYTAAPYD AQKIEAANQK ERKQYIVRLA VAGLGMMQTM MFALPTYLYG

201  GDIEPDFLQI LHWGGFLMVL PVVFYCAVPF YQGALRDLKN RRVGMDTPIT

251  VAIIMTFIAG VYSLATNAGQ GMYFESIAML LFFLLGGRFM EHIARRKAGD

301  AAERLVKLIP AFCHHMPDYP DTQETCEAAV VKLKAGDIVL VKPGETIPVD

351  GTVLEGSSAV NESMLTGESL PVAKMPSEKV TAGTLNTQSP LIIRTDRTGG

401  GTRLSHIVRL LDRALAQKPR TAELAEQYAS SFIFGELLLA VPVFIGWTLY

451  ADAHTALWIT VALLVITCPC ALSLATPTAL AASTGTLARE GILIGGKQAI

501  ETLAQTTDII FDKTGTLTQG KPAVRRISLL RGTDEAFVLA VAQALEQQSE

551  HPLARAILNC RISDGSVPDI AIKQRLNRIG EGVGAQLTVN GETQVWALGR

601  ASYVAEISGK EPQTEGGGSA VYLGSQSGFQ AVFYLQDPLK DSAAEAVRQL

651  AGKNLTLHIL SGDRETAVAE TARALGVAHY RAQAMPEDKL EYVKALQKEG

701  KKVLMIGDGI NDAPVLAQAD VSAAAAGGTD IARDGADIVL LNEDLRTVAH

751  LLDQARRTRH IIRQNLIWAG AYNIIAVPLA VLGYVQPWIA ALGMSFSSLA

801  VLGNALRLHK RGKMQSEKMP SEQ*
```

m704/a704 99.8% identity in 823 aa overlap

```
                    10        20        30        40        50        60
m704.pep    MKKTCFHCGLDVPEHLHLTVRYENEDRETCCAGCQAVAQSIIDAGLGSYYKQRTADAQKT
            ||||||||||||||:|||||||||||||||||||||||||||||||||||||||||||||
a704        MKKTCFHCGLDVPENLHLTVRYENEDRETCCAGCQAVAQSIIDAGLGSYYKQRTADAQKT
                    10        20        30        40        50        60

                    70        80        90       100       110       120
m704.pep    ELPPQEILDQIRLYDLPEVQSDFVETHGGTREAVLMLGGITCAACVWLIEQQLLRTDGIV
            ||||||||||||||||||||||||||||||||||||||||||||||||||||||||||||
a704        ELPPQEILDQIRLYDLPEVQSDFVETHGGTREAVLMLGGITCAACVWLIEQQLLRTDGIV
                    70        80        90       100       110       120

                   130       140       150       160       170       180
m704.pep    RIDLNYSTHRCRVVWDDGKIRLSDILLKIRQIGYTAAPYDAQKIEAANQKERKQYIVRLA
            ||||||||||||||||||||||||||||||||||||||||||||||||||||||||||||
a704        RIDLNYSTHRCRVVWDDGKIRLSDILLKIRQIGYTAAPYDAQKIEAANQKERKQYIVRLA
                   130       140       150       160       170       180

                   190       200       210       220       230       240
m704.pep    VAGLGMMQTMMFALPTYLYGGDIEPDFLQILHWGGFLMVLPVVFYCAVPFYQGALRDLKN
            ||||||||||||||||||||||||||||||||||||||||||||||||||||||||||||
a704        VAGLGMMQTMMFALPTYLYGGDIEPDFLQILHWGGFLMVLPVVFYCAVPFYQGALRDLKN
                   190       200       210       220       230       240
```

-continued

```
                 250        260        270        280        290        300
m704.pep  RRVGMDTPITVAIIMTFIAGVYSLATNAGQGMYFESIAMLLFFLLGGRFMEHIARRKAGD
          ||||||||||||||||||||||||||||||||||||||||||||||||||||||||||||
a704      RRVGMDTPITVAIIMTFIAGVYSLATNAGQGMYFESIAMLLFFLLGGRFMEHIARRKAGD
                 250        260        270        280        290        300

                 310        320        330        340        350        360
m704.pep  AAERLVKLIPAFCHHMPDYPDTQETCEAAVVKLKAGDIVLVKPGETIPVDGTVLEGSSAV
          ||||||||||||||||||||||||||||||||||||||||||||||||||||||||||||
a704      AAERLVKLIPAFCHHMPDYPDTQETCEAAVVKLKAGDIVLVKPGETIPVDGTVLEGSSAV
                 310        320        330        340        350        360

                 370        380        390        400        410        420
m704.pep  NESMLTGESLPVAKMPSEKVTAGTLNTQSPLIIRTDRTGGGTRLSHIVRLLDRALAQKPR
          ||||||||||||||||||||||||||||||||||||||||||||||||||||||||||||
a704      NESMLTGESLPVAKMPSEKVTAGTLNTQSPLIIRTDRTGGGTRLSHIVRLLDRALAQKPR
                 370        380        390        400        410        420

                 430        440        450        460        470        480
m704.pep  TAELAEQYASSFIFGELLLAVPVFIGWTLYADAHTALWITVALLVITCPCALSLATPTAL
          ||||||||||||||||||||||||||||||||||||||||||||||||||||||||||||
a704      TAELAEQYASSFIFGELLLAVPVFIGWTLYADAHTALWITVALLVITCPCALSLATPTAL
                 430        440        450        460        470        480

                 490        500        510        520        530        540
m704.pep  AASTGTLAREGILIGGKQAIETLAQTTDIIFDKTGTLTQGKPAVRRISLLRGTDEAFVLA
          ||||||||||||||||||||||||||||||||||||||||||||||||||||||||||||
a704      AASTGTLAREGILIGGKQAIETLAQTTDIIFDKTGTLTQGKPAVRRISLLRGTDEAFVLA
                 490        500        510        520        530        540

                 550        560        570        580        590        600
m704.pep  VAQALEQQSEHPLARAILNCRISDGSVPDIAIKQRLNRIGEGVGAQLTVNGETQVWALGR
          ||||||||||||||||||||||||||||||||||||||||||||||||||||||||||||
a704      VAQALEQQSEHPLARAILNCRISDGSVPDIAIKQRLNRIGEGVGAQLTVNGETQVWALGR
                 550        560        570        580        590        600

                 610        620        630        640        650        660
m704.pep  ASYVAEISGKEPQTEGGGSAVYLGSQSGFQAVFYLTDPLKDSAAEAVRQLAGKNLTLHIL
          |||||||||||||||||||||||||||||||||||| |||||||||||||||||||||||
a704      ASYVAEISGKEPQTEGGGSAVYLGSQSGFQAVFYLQDPLKDSAAEAVRQLAGKNLTLHIL
                 610        620        630        640        650        660

               670        680        690        700        710        720
m704.pep  SGDRETAVAETARALGVAHYRAQAMPEDKLEYVKALQKEGKKVLMIGDGINDAPVLAQAD
          ||||||||||||||||||||||||||||||||||||||||||||||||||||||||||||
a704      SGDRETAVAETARALGVAHYRAQAMPEDKLEYVKALQKEGKKVLMIGDGINDAPVLAQAD
               670        680        690        700        710        720

                 730        740        750        760        770        780
m704.pep  VSAAAAGGTDIARDGADIVLLNEDLRTVAHLLDQARRTRHIIRQNLIWAGAYNIIAVPLA
          ||||||||||||||||||||||||||||||||||||||||||||||||||||||||||||
a704      VSAAAAGGTDIARDGADIVLLNEDLRTVAHLLDQARRTRHIIRQNLIWAGAYNIIAVPLA
                 730        740        750        760        770        780

                 790        800        810        820
m704.pep  VLGYVQPWIAALGMSFSSLAVLGNALRLHKRGKMQSEKMPSEQX
          ||||||||||||||||||||||||||||||||||||||||||||
a704      VLGYVQPWIAALGMSFSSLAVLGNALRLHKRGKMQSEKMPSEQX
                 790        800        810        820
```

The following partial DNA sequence was identified in *N. gonorrhoeae* <SEQ ID 2357>:

```
g705.seq
   1 GTGTTCAATA ATTTCCttgC CTCTCTGCCG TTTATGACGG AAACACGCGC

  51 TGATATGCTC ATCAGCGCGT TTTGGCCCAT GGTTAAAGCC GGCTTTACAG

 101 TGTCTTtgcC TTTGGCGATC GCTTCTTTCG TTATCGGCAT GATTATTGCC

 151 GTAGCCGTTG CTTTGGTAAG AATCATGCCT TCCGGCGGTA TTTTCCAAAA

 201 ATGCTTGTTG AAGCTGGTGG AATTTTATAT TTCCGTCGTT CGCGGTACGC

 251 CGCTGTTGGT TCAGCTTGTG ATTGTGTTTT ACGGGCTGCC GTCCGTCGGC

 301 ATCTATATCA ATCCGATTCC CGCCGCCATC ATCGGCTTTT CGCTCAATGT

 351 CGGCGCATAC GCTTCCGAAA CCATACGCGC GGCGATTTTG TCCGTGCCGA

 401 AAGGGCAGTG GGAAGCAGGT TTCTCCATCG GTATGACCTA TATGCAGACG

 451 TTCCGCCGCA TCGTCGCACC GCAGGCATTC CGCGTCGCCG TTCCGCCGTT
```

-continued

```
501 GAGCAACGAG TTTATCGGCT TGTTCAAAAA CACCTCGCTT GCCGCCGTGG

551 TAACGGTAAC GGAGCTTTTC CGTGTCGCAC AGGAAACGGC AAACCGCACT

601 TATGACTTTT TGCCTGTCTA TATCGAAGCT GCATTGGTTT ATTGGTGTTT

651 CTGTAAAGTG CTGTTTTTGA TTCAGGCGCG TTTGGAAAAA CGTTTCGACC

701 GTTATGTCGC CAAATAA
```

This corresponds to the amino acid sequence <SEQ ID 2358; ORF 705>:

```
g705.pep
  1 VFNNFLASLP FMTETRADML ISAFWPMVKA GFTVSLPLAI ASFVIGMIIA

 51 VAVALVRIMP SGGIFQKCLL KLVEFYISVV RGTPLLVQLV IVFYGLPSVG

101 IYINPIPAAI IGFSLNVGAY ASETIRAAIL SVPKGQWEAG FSIGMTYMQT

151 FRRIVAPQAF RVAVPPLSNE FIGLFKNTSL AAVVTVTELF RVAQETANRT

201 YDFLPVYIEA ALVYWCFCKV LFLIQARLEK RFDRYVAK*
```

The following partial DNA sequence wag identified in *N. meningitidis* <SEQ ID 2359>:

```
m705.seq
  1 GTGTTCAATA ATTTCCTTGC TTCGCTGCCG TTTATGACGG AAACACGCGC

 51 CGATATGATT GTCAGCGCGT TTTTGCCTAT GGTCAAAGCC GGCTTCGCGG

101 TCTCTCTGCC TTTGGCGGCA GCTTCTTTCG TTATCGGTAT GATGATTGCG

151 GTAGCCGTGG CTTTGGTGCG GATTATGCCC GCCGGCGGCA TCGTGCGGAA

201 AATCCTGCTG AAATTGGTGG AATTTTATAT TTCCGTCATT CGCGGTACGC

251 CGCTGTTGGT TCAGCTTGTG ATTGTGTTTT ACGGGCTGCC TTCCGTCGGC

301 ATCTATATCG ACCCGATTCC TGCCGCCATC ATCGGCTTTT CGCTCAATGT

351 CGGCGCATAC GCTTCCGAAA CCATACGCGC GGCAATTTTG TCCGTACCTA

401 AAGGCCAATG GGAAGCAGGT TTCTCCATCG GCATGACCTA TATGCAGACG

451 TTCCGCCGCA TTGTCGCGCC GCAGGCATTC CGCGTTGCCG TGCCGCCTTT

501 GAGCAACGAG TTTATCGGTT TGTTTAAAAA CACCTCGCTC GCGGCAGTCG

551 TGACGGTAAC GGAATTATTC CGCGTCGCGC AGGAAACGGC AAACCGCACT

601 TATGACTTTT TGCCCGTCTA TATCGAAGCC GCTTTGGTTT ACTGGTGTTT

651 TTGTAAAGTG CTGTTCCTGA TTCAGGCGCG TTTGGAAAAA CGTTTCGACC

701 GCTACGTCGC CAAATAA
```

This corresponds to the amino acid sequence <SEQ ID 2360; ORF 705>:

```
m705.pep
  1 VFNNFLASLP FMTETRADMI VSAFLPMVKA GFAVSLPLAA ASFVIGMMIA

 51 VAVALVRIMP AGGIVRKILL KLVEFYISVI RGTPLLVQLV IVFYGLPSVG

101 IYIDPIPAAI IGFSLNVGAY ASETIRAAIL SVPKGQWEAG FSIGMTYMQT

151 FRRIVAPQAF RVAVPPLSNE FIGLFKNTSL AAVVTVTELF RVAQETANRT

201 YDFLPVYIEA ALVYWCFCKV LFLIQARLEK RFDRYVAK*
```

Computer analysis of this amino acid sequence gave the following results:

Homology with a Predicted ORF from *N. gonorrhoeae*

ORF 705 shows 95.0% identity over a 238 aa overlap with a predicted ORF (ORF 705) from *N. gonorrhoeae*:

```
m705/g705  95.0% identity in 238 aa overlap

                    10        20        30        40        50        60
m705.pep    VFNNFLASLPFMTETRADMIVSAFLPMVKAGFAVSLPLAAASFVIGMMIAVAVALVRIMP
            |||||||||||||||||||::||| |||||||:|||||| |||||||:||||||||||||
g705        VFNNFLASLPFMTETRADMLISAFWPMVKAGFTVSLPLAIASFVIGMIIAVAVALVRIMP
                    10        20        30        40        50        60

                    70        80        90       100       110       120
m705.pep    AGGIVRKILLKLVEFYISVIRGTPLLVQLVIVFYGLPSVGIYIDPIPAAIIGFSLNVGAY
            :||| :| |||||||||||:|||||||||||||||||||||||:||||||||||||||||
g705        SGGIFQKCLLKLVEFYISVVRGTPLLVQLVIVFYGLPSVGIYINPIPAAIIGFSLVNGAY
                    70        80        90       100       110       120

                   130       140       150       160       170       180
m705.pep    ASETIRAAILSVPKGQWEAGFSIGMTYMQTFRRIVAPQAFRVAVPPLSNEFIGLFKNTSL
            ||||||||||||||||||||||||||||||||||||||||||||||||||||||||||||
g705        ASETIRAAILSVPKGQWEAGFSIGMTYMQTFRRIVAPQAFRVAVPPLSNEFIGLFKNTSL
                   130       140       150       160       170       180

                   190       200       210       220       230      239
m705.pep    AAVVTVTELFRVAQETANRTYDFLPVYIEAALVYWCFCKVLFLIQARLEKRFDRYVAKX
            |||||||||||||||||||||||||||||||||||||||||||||||||||||||||||
g705        AAVVTVTELFRVAQETANRTYDFLPVYIEAALVYWCFCKVLFLIQARLEKRFDRYVAKX
                   190       200       210       220       230
```

The following partial DNA sequence was identified in *N. meningitidis* <SEQ ID 2361>:

```
a705.seq
  1 GTGTTCAATA ATTTCCTTGC TTCGCTGCCG TTTATGACGG AAACACGCGC

 51 CGATATGATT GTCAGCGCGT TTTTGCCTAT GGTCAAAGCC GGCTTCGCGG

101 TCTCTCTGCC TTTGGCGGCA GCTTCTTTCG TTATCGGTAT GATGATTGCG

151 GTAGCCGTGG CTTTGGTGCG GATTATGCCC GCCGGCGGCA TCGTGCGGAA

201 AATCCTGCTG AAATTGGTGG AATTTTATAT TTCCGTCATT CGCGGTACGC

251 CGCTGTTGGT TCAGCTTGTG ATTGTGTTTT ACGGGCTGCC TTCCGTCGGC

301 ATCTATATCG ACCCGATTCC TGCCGCCATC ATCGGCTTTT CGCTCAATGT

351 CGGCGCATAT GCTTCCGAAA CCATACGCGC GGCAATTTTG TCCGTACCGA

401 AAGGCCAATG GGAAGCAGGT TTCTCCATCG GCATGACCTA TATGCAGACG

451 TTCCGCCGCA TCGTCGCGCC GCAGGCATTT CGCGTTGCCG TGCCGCCTTT

501 GAGCAACGAG TTTATCGGTT TGTTTAAAAA CACCTCGCTC GCGGCAGTCG

551 TGACGGTAAC GGAATTATTC CGCGTCGCGC AGGAAACGGC AAACCGCACT

601 TATGACTTTT TGCCCGTCTA TATCGAAGCC GCTTTGGTTT ACTGGTGTTT

651 TTGTAAAGTG CTGTTCCTGA TTCAGGCGCG TTTGGAAAAA CGTTTCGACC

701 GCTACGTCGC CAAATAA
```

This corresponds to the amino acid sequence <SEQ ID 2362; ORF 705.a>:

```
a705.pep
  1 VFNNFLASLP FMTETRADMI VSAFLPMVKA GFAVSLPLAA ASFVIGMMIA

 51 VAVALVRIMP AGGIVRKILL KLVEFYISVI RGTPLLVQLV IVFYGLPSVG

101 IYIDPIPAAI IGFSLNVGAY ASETIRAAIL SVPKGQWEAG FSIGMTYMQT

151 FRRIVAPQAF RVAVPPLSNE FIGLFKNTSL AAVVTVTELF RVAQETANRT
```

-continued

```
201 YDFLPVYIEA ALVYWCFCKV LFLIQARLEK RFDRYVAK*
```

Computer analysis of this amino acid sequence gave the following results:

Homology with a Predicted ORF from *N. meningitidis* ORF 705 shows 100.0% identity over a 238 aa overlap with a predicted ORF (ORF 705) from *N. meningitidis*:

```
a705/m705  100.0%  identity in 238 aa overlap

                    10        20        30        40        50        60
a705.pep    VFNNFLASLPFMTETRADMIVSAFLPMVKAGFAVSLPLAAASFVIGMMIAVAVALVRIMP
            ||||||||||||||||||||||||||||||||||||||||||||||||||||||||||||
m705        VFNNFLASLPFMTETRADMIVSAFLPMVKAGFAVSLPLAAASFVIGMMIAVAVALVRIMP
                    10        20        30        40        50        60
                    70        80        90       100       110       120
a705.pep    AGGIVRKILLKLVEFYISVIRGTPLLVQLVIVFYGLPSVGIYIDPIPAAIIGFSLNVGAY
            ||||||||||||||||||||||||||||||||||||||||||||||||||||||||||||
m705        AGGIVRKILLKLVEFYISVIRGTPLLVQLVIVFYGLPSVGIYIDPIPAAIIGFSLNVGAY
                    70        80        90       100       110       120
                   130       140       150       160       170       180
a705.pep    ASETIRAAILSVPKGQWEAGFSIGMTYMQTFRRIVAPQAFRVAVPPLSNEFIGLFKNTSL
            ||||||||||||||||||||||||||||||||||||||||||||||||||||||||||||
m705        ASETIRAAILSVPKGQWEAGFSIGMTYMQTFRRIVAPQAFRVAVPPLSNEFIGLFKNTSL
                   130       140       150       160       170       180
                   190       200       210       220       230      239
a705.pep    AAVVTVTELFRVAQETANRTYDFLPVYIEAALVYWCFCKVLFLIQARLEKRFDRYVAKX
            |||||||||||||||||||||||||||||||||||||||||||||||||||||||||||
m705        AAVVTVTELFRVAQETANRTYDFLPVYIEAALVYWCFCKVLFLIQARLEKRFDRYVAKX
                   190       200       210       220       230      239
```

The following partial DNA sequence was identified in *N. gonorrhoeae* <SEQ ID 2363>:

```
g706.seq
  1  ATGAACTCCT CGCAACGCAA ACGCCTTTCC GgccGCTGGC TCAACTCCTA

 51  CGAACGCTac cGCCaccGCC GCCTCATACA TGCCGTGCGG CTCGGCggaa

101  ccgtCCTGTT CGCCACCGCA CTCGCCCGgc tACTCCACCT CCAacacggc

151  gAATGGATAG GGAtgaCCGT CTTCGTCGTC CTCGGCATGC TCCAGTTCCA

201  AGGCgcgatt tActccaacg cggtgGAacg taTGctcggt acggtcatcg

251  ggctgGGCGC GGGTTTGGgc gTTTTATGGC TGAACCAGCA TTAtttccac

301  ggcaacCTcc tcttctacct gaccatcggc acggcaagcg cactggccgg

351  ctGGGCGGCG GTCGGCAAAA acggctacgt ccctatgctg GCGGGGctgA

401  CGATGTGCAT gctcatcggc gACAACGGCA GCGAATGGCT CGACAGCGGC

451  CTGATGCGCG CGATGAACGT CCTCATCGGC GCCGCCATCG CCATTGCCGC

501  CGCCAAACTG CTGCCGCTGA AATCCACACT GATGTGGCGT TTCATGCTTG

551  CCGACAACCT GGCCGACTGC AGCAAAATGA TTGCCGAAAT CAGCAACGGC

601  AGGCGTATGA CGCGCGAACG TTTGGAGCAG AATATGGTCA AAATGCGCCA

651  AATCAACGCA CGCATGGTCA AAAGCCGCAG CCACCTCGCC GCCACATCGG

701  GCGAAAGCCG CATCAGCCCC TCCATGATGG AAGCCATGCA GCACGCCCAC

751  CGCAAAATCG TCAACACCAC CGAGCTGCTC CTGACCACCG CCGCCAAGCT

801  GCAATCTCCC AAACTCAACG GCAGCGAAAT CCGGCTGCTC GACCGCCACT

851  TCACACTGCT CCAAACCGAC CTGCAACAAA CCGCCGCCCT CATCAACGGC

901  AGACACGCCC GCCGCATCCG CATCGACACC GCCATCAACC CCGAACTGGA
```

-continued

```
 951 AGCCCTCGCC GAACACCTCC ACTACCAATG GCAGGGCTTC CTCTGGCTCA

1001 GCACCAATAT GCGTCAGGAA ATTTCCGCCC TCGTCATCCT GCTGCAACGC

1051 ACCCGCCGCA AATGGCTGGA TGCCCACGAA CGCCAACACC TGCGCCAAAG

1101 CCTGCTTGAA ACACGGGAAC ACGGCTGA
```

This corresponds to the amino acid sequence <SEQ ID 2364; ORF 706.ng>:

```
g706.pep
  1 MNSSQRKRLS GRWLNSYERY RHRRLIHAVR LGGTVLFATA LARLLHLQHG

 51 EWIGMTVFVV LGMLQFQGAI YSNAVERMLG TVIGLGAGLG VLWLNQHYFH

101 GNLLFYLTIG TASALAGWAA VGKNGYVPML AGLTMCMLIG DNGSEWLDSG

151 LMRAMNVLIG AAIAIAAAKL LPLKSTLMWR FMLADNLADC SKMIAEISNG

201 RRMTRERLEQ NMVKMRQINA RMVKSRSHLA ATSGESRISP SMMEAMQHAH

251 RKIVNTTELL LTTAAKLQSP KLNGSEIRLL DRHFTLLQTD LQQTAALING

301 RHARRIRIDT AINPELEALA EHLHYQWQGF LWLSTNMRQE ISALVILLQR

351 TRRKWLDAHE RQHLRQSLLE TREHG*
```

The following partial DNA sequence was identified in *N. meningitidis* <SEQ ID 2365>:

```
m706.seq
   1 ATGAACACCT CGCAACGCAA CCGCCTCGTC AGCCGCTGGC TCAACTCCTA

  51 CGAACGCTAC CGCTACCGCC GCCTCATCCA CGCCGTCCGG CTCGGCGGGG

 101 CCGTCCTGTT CGCCACCGCC TCCGCCCGGC TGCTCCACCT CCAACACGGC

 151 GAGTGGATAG GGATGACCGT CTTCGTCGTC CTCGGCATGC TCCAGTTTCA

 201 AGGGGCGATT TACTCCAAGG CGGTGGAACG TATGCTCGGC ACGGTCATCG

 251 GGCTGGGCGC GGGTTTGGGC GTTTTATGGC TGAACCAGCA TTATTTCCAC

 301 GGCAACCTCC TCTTCTACCT CACCGTCGGC ACGGCAAGCG CACTGGCCGG

 351 CTGGGCGGCG GTCGGCAAAA ACGGCTACGT CCCTATGCTG GCAGGGCTGA

 401 CGATGTGTAT GCTCATCGGC GACAACGGCA GCGAATGGCT CGACAGCGGA

 451 CTCATGCGCG CCATGAACGT CCTCATCGGC GCGGCCATCG CCATCGCCGC

 501 CGCCAAACTG CTGCCGCTGA AATCCACACT GATGTGGCGT TTCATGCTTG

 551 CCGACAACCT GGCCGACTGC AGCAAAATGA TTGCCGAAAT CAGCAACGGC

 601 AGGCGCATGA CCCGCGAACG CCTCGAGGAG AACATGGCGA AAATGCGCCA

 651 AATCAACGCA CGCATGGTCA AAAGCCGCAG CCATCTCGCC GCCACATCGG

 701 GCGAAAGCCG CATCAGCCCC GCCATGATGG AAGCCATGCA GCACGCCCAC

 751 CGTAAAATCG TCAACACCAC CGAGCTGCTC CTGACCACCG CCGCCAAGCT

 801 GCAATCTCCC AAACTCAACG GCAGCGAAAT CCGGCTGCTT GACCGCCACT

 851 TCACACTGCT CCAAACCGAC CTGCAACAAA CCGTCGCCCT TATCAACGGC

 901 AGACACGCCC GCCGCATCCG CATCGACACC GCCATCAACC CCGAACTGGA

 951 AGCCCTCGCC GAACACCTCC ACTACCAATG GCAGGGCTTC CTCTGGCTCA

1001 GCACCAATAT GCGTCAGGAA ATTTCCGCCC TCGTCATCCT GCTGCAACGC

1051 ACCCGCCGCA AATGGCTGGA TGCCCACGAA CGCCAACACC TGCGCCAAAG
```

-continued

```
1101  CCTGCTTGAA ACACGGGAAC ACGGCTGA
```

This corresponds to the amino acid sequence <SEQ ID 2366; ORF 706>:

```
m706.pep
      1  MNTSQRNRLV SRWLNSYERY RYRRLIHAVR LGGAVLFATA SARLLHLQHG
     51  EWIGMTVFVV LGMLQFQGAI YSKAVERMLG TVIGLGAGLG VLWLNQHYFH
    101  GNLLFYLTVG TASALAGWAA VGKNGYVPML AGLTMCMLIG DNGSEWLDSG
    151  LMRAMNVLIG AAIAIAAAKL LPLKSTLMWR FMLADNLADC SKMIAEISNG
    201  RRMTRERLEE NMAKMRQINA RMVKSRSHLA ATSGESRISP AMMEAMQHAH
    251  RKIVNTTELL LTTAAKLQSP KLNGSEIRLL DRHFTLLQTD LQQTVALING
    301  RHARRIRIDT AINPELEALA EHLHYQWQGF LWLSTNMRQE ISALVILLQR
    351  TRRKWLDAHE RQHLRQSLLE TREHG*
```

```
m706/g706  96.5%  identity in 375 aa overlap

                   10        20        30        40        50        60
m706.pep   MNTSQRNRLVSRWLNSYERYRYRRLIHAVRLGGAVLFATASARLLHLQHGEWIGMTVFVV
           ||:|||:|| :|||||||||:||||||||||:|||||| |||||||||||||||||
g706       MNSSQRKRLSGRWLNSYERYRHRRLIHAVRLGGTVLFATALARLLHLQHGEWIGMTVFVV
                   10        20        30        40        50        60

                   70        80        90       100       110       120
m706.pep   LGMLQFQGAIYSKAVERMLGTVIGLGAGLGVLWLNQHYFHGNLLFYLTVGTASALAGWAA
           |||||||||||:||||||||||||||||||||||||||||||||||:|||||||||||
g706       LGMLQFQGAIYSNAVERMLGTVIGLGAGLGVLWLNQHYFHGNLLFYLTIGTASALAGWAA
                   70        80        90       100       110       120

                  130       140       150       160       170       180
m706.pep   VGKNGYVPMLAGLTMCMLIGDNGSEWLDSGLMRAMNVLIGAAIAIAAAKLLPLKSTLMWR
           ||||||||||||||||||||||||||||||||||||||||||||||||||||||||||||
g706       VGKNGYVPMLAGLTMCMLIGDNGSEWLDSGLMRAMNVLIGAAIAIAAAKLLPLKSTLMWR
                  130       140       150       160       170       180

                  190       200       210       220       230       240
m706.pep   FMLADNLADCSKMIAEISNGRRMTRERLEENMAKMRQINARMVKSRSHLAATSGESRISP
           |||||||||||||||||||||||||||:||:|||||||||||||||||||||||||||
g706       FMLADNLADCSKMIAEISNGRRMTRERLEQNMVKMRQINARMVKSRSHLAATSGESRISP
                  190       200       210       220       230       240

                  250       260       270       280       290       300
m706.pep   AMMEAMQHAHRKIVNTTELLLTTAAKLQSPKLNGSEIRLLDRHFTLLQTDLQQTVALING
           :|||||||||||||||||||||||||||||||||||||||||||||||||||:|||||
g706       SMMEAMQHAHRKIVNTTELLLTTAAKLQSPKLNGSEIRLLDRHFTLLQTDLQQTAALING
                  250       260       270       280       290       300

                  310       320       330       340       350       360
m706.pep   RHARRIRIDTAINPELEALAEHLHYQWQGFLWLSTNMRQEISALVILLQRTRRKWLDAHE
           ||||||||||||||||||||||||||||||||||||||||||||||||||||||||||||
g706       RHARRIRIDTAINPELEALAEHLHYQWQGFLWLSTNMRQEISALVILLQRTRRKWLDAHE
                  310       320       330       340       350       360

                  370
m706.pep   RQHLRQSLLETREHGX
           ||||||||||||||||
g706       RQHLRQSLLETREHGX
                  370
```

The following partial DNA sequence was identified in *N. meningitidis* <SEQ ID 2367>:

```
a706.seq
      1  ATGAACACCT CGCAACGCAA CCGCCTCGTC AGCCGCTGGC TCAACTCCTA
     51  CGAACGCTAC CGCTACCGCC GCCTCATCCA CGCCGTCCGG CTCGGCGGGG
    101  CCGTCCTGTT CGCCACCGCC TCCGCCCGGC TGCTCCACCT CCAACACGGC
    151  GAGTGGATAG GGATGACCGT CTTCGTCGTC CTCGGCATGC TCCAGTTTCA
    201  AGGGGCGATT TACTCCAAGG CGGTGGAACG TATGCTCGGC ACGGTCATCG
```

-continued

```
 251 GGCTGGGCGC GGGTTTGGGC GTTTTATGGC TGAACCAGCA TTATTTCCAC

 301 GGCAACCTCC TCTTCTACCT CACCGTCGGC ACGGCAAGCG CACTGGCCGG

 351 CTGGGCGGCG GTCGGCAAAA ACGGCTACGT CCCTATGCTG GCGGGGCTGA

 401 CGATGTGCAT GCTCATCGGC GACAACGGCA GCGAATGGTT CGACAGCGGC

 451 CTGATGCGCG CGATGAACGT CCTCATCGGC GCGGCCATCG CCATCGCCGC

 501 CGCCAAACTG CTGCCGCTGA AATCCACACT GATGTGGCGT TTCATGCTTG

 551 CCGACAACCT GACCGACTGC AGCAAAATGA TTGCCGAAAT CAGCAACGGC

 601 AGGCGCATGA CCCGCGAACG CCTCGAAGAG AACATGGCGA AAATGCGCCA

 651 AATCAACGCA CGCATGGTCA AAAGCCGCAG CCACCTCGCC GCCACATCGG

 701 GCGAAAGCCG CATCAGCCCC GCCATGATGG AAGCCATGCA GCACGCCCAC

 751 CGTAAAATTG TCAACACCAC CGAGCTGCTC CTGACCACCG CCGCCAAGCT

 801 GCAATCTCCC AAACTCAACG GCAGCGAAAT CCGGCTGCTT GACCGCCACT

 851 TCACACTGCT CCAAACCGAC CTGCAACAAA CCGTCGCCCT TATCAACGGC

 901 AGACACGCCC GCCGCATCCG CATCGACACC GCCATCAACC CCGAACTGGA

 951 AGCCCTCGCC GAACACCTCC ACTACCAATG GCAGGGCTTC CTCTGGCTCA

1001 GCACCAATAT GCGTCAGGAA ATTTCCGCCC TCGTCATCCT GCTGCAACGC

1051 ACCCGCCGCA AATGGCTGGA TGCCCACGAA CGCCAACACC TGCGCCAAAG

1101 CCTGCTTGAA ACACGGGAAC ACAGTTGA
```

This corresponds to the amino acid sequence <SEQ ID 2368; ORF 706.a>:

```
a706.pep
  1 MNTSQRNRLV SRWLNSYERY RYRRLIHAVR LGGAVLFATA SARLLHLQHG

 51 EWIGMTVFVV LGMLQFQGAI YSKAVERMLG TVIGLGAGLG VLWLNQHYFH

101 GNLLFYLTVG TASALAGWAA VGKNGYVPML AGLTMCMLIG DNGSEWFDSG

151 LMRAMNVLIG AAIAIAAAKL LPLKSTLMWR FMLADNLTDC SKMIAEISNG

201 RRMTRERLEE NMAKMRQINA RMVKSRSHLA ATSGESRISP AMMEAMQHAH

251 RKIVNTTELL LTTAAKLQSP KLNGSEIRLL DRHFTLLQTD LQQTVALING

301 RHARRIRIDT AINPELEALA EHLHYQWQGF LWLSTNMRQE ISALVILLQR

351 TRRKWLDAHE RQHLRQSLLE TREHS*
```

a706/m706 99.5% identity in 374 aa overlap

```
                    10        20        30        40        50        60
a706.pep    MNTSQRNRLVSRWLNSYERYRYRRLIHAVRLGGAVLFATASARLLHLQHGEWIGMTVFVV
            ||||||||||||||||||||||||||||||||||||||||||||||||||||||||||||
m706        MNTSQRNRLVSRWLNSYERYRYRRLIHAVRLGGAVLFATASARLLHLQHGEWIGMTVFVV
                    10        20        30        40        50        60

                    70        80        90       100       110       120
a706.pep    LGMLQFQGAIYSKAVERMLGTVIGLGAGLGVLWLNQHYFHGNLLFYLTVGTASALAGWAA
            ||||||||||||||||||||||||||||||||||||||||||||||||||||||||||||
m706        LGMLQFQGAIYSKAVERMLGTVIGLGAGLGVLWLNQHYFHGNLLFYLTVGTASALAGWAA
                    70        80        90       100       110       120

                   130       140       150       160       170       180
a706.pep    VGKNGYVPMLAGLTMCMLIGDNGSEWFDSGLMRAMNVLIGAAIAIAAAKLLPLKSTLMWR
            ||||||||||||||||||||||||||:|||||||||||||||||||||||||||||||||
m706        VGKNGYVPMLAGLTMCMLIGDNGSEWLDSGLMRAMNVLIGAAIAIAAAKLLPLKSTLMWR
                   130       140       150       160       170       180
```

-continued

```
                190        200        210        220        230        240
a706.pep  FMLADNLTDCSKMIAEISNGRRMTRERLEENMAKMRQINARMVKSRSHLAATSGESRISP
          |||||||:||||||||||||||||||||||||||||||||||||||||||||||||||||
m706      FMLADNLADCSKMIAEISNGRRMTRERLEENMAKMRQINARMVKSRSHLAATSGESRISP
                190        200        210        220        230        240

                250        260        270        280        290        300
a706.pep  AMMEAMQHAHRKIVNTTELLLTTAAKLQSPKLNGSEIRLLDRHFTLLQTDLQQTVALING
          ||||||||||||||||||||||||||||||||||||||||||||||||||||||||||||
m706      AMMEAMQHAHRKIVNTTELLLTTAAKLQSPKLNGSEIRLLDRHFTLLQTDLQQTVALING
                250        260        270        280        290        300

                310        320        330        340        350        360
a706.pep  RHARRIRIDTAINPELEALAEHLHYQWQGFLWLSTNMRQEISALVILLQRTRRKWLDAHE
          ||||||||||||||||||||||||||||||||||||||||||||||||||||||||||||
m706      RHARRIRIDTAINPELEALAEHLHYQWQGFLWLSTNMRQEISALVILLQRTRRKWLDAHE
                310        320        330        340        350        360

                370
a706.pep  RQHLRQSLLETREHSX
          ||||||||||||||:
m706      RQHLRQSLLETREHGX
                370

g704.seq  not found

g707.pep  not found
```

The following partial DNA sequence was identified in *N. meningitidis* <SEQ ID 2369>:

```
m707.seq
     1  ATGGAAATTA TTAACGATGC AGAACTTATC CGTTCCATGC AGCGTCAGCA

    51  GCACATAGAT GCTGAATTGT TAACTGATGC AAATGTCCGT TTCGAGCAAC

   101  CATTGGAGAA GAACAATTAT GTCCTGAGTG AAGATGAAAC ACCGTGTACT

   151  CGGGTAAATT ACATTAGTTT AGATGATAAG ACGGTGCGCA AATTTTCTTT

   201  TCTTCCTTCT GTGCTCATGA AAGAAACAGC TTTTAAAACT GGGATGTGTT

   251  TAGGTTCCAA TAATTTGAGC AGGCTACAAA AAGCCGCGCA ACAGATACTG

   301  ATCGTGCGTG GCTACCTCAC TTCCCAAGCT ATTATCCAAC CACAGAATAT

   351  GGATTCGGGA ATTCTGAAAT TACGGGTATC AGCAGGCGAA ATAGGGGATA

   401  TCCGCTATGA AGAAAAACGG GATGGGAAGT CTGCCGAGGG CAGTATTAGT

   451  GCATTCAATA ACAAATTTCC CTTATATAGG AACAAAATTC TCAATCTTCG

   501  CGATGTAGAG CAGGGCTTGG AAAACCTGCG TCGTTTGCCG AGTGTTAAAA

   551  CAGATATTCA GATTATACCG TCCGAAGAAG AAGGCAAAAG CGATTTACAG

   601  ATCAAATGGC AGCAGAATAA ACCCATACGG TTCAGTATCG GTATAGATGA

   651  TGCGGGCGGC AAAACGACCG GCAAATATCA AGGAAATGTC GCTTTATCGT

   701  TCGATAACCC TTTGGGCTTA AGCGATTTGT TTTATGTTTC ATATGGACGC

   751  GGTTTGGCGC ACAAAACGGA CTTGACTGAT GCCACCGGTA CGGAAACTGA

   801  AAGCGGATCC AGAAGTTACA GCGTGCATTA TTCGGTGCCC GTAAAAAAAT

   851  GGCTGTTTTC TTTTAATCAC AATGGACATC GTTACCACGA AGCAACCGAA

   901  GGCTATTCCG TCAATTACGA TTACAACGGC AAACAATATC AGAGCAGCCT

   951  GGCCGCCGAG CGCATGCTTT GGCGTAACAG ACTTCATAAA ACTTCAGTCG

  1001  GAATGAAATT ATGGACACGC CAAACCTATA AATACATCGA CGATGCCGAA

  1051  ATCGAAGTAC AACGCCGCCG CTCTGCAGGC TGGGAAGCCG AATTGCGCCA

  1101  CCGTGCTTAC CTCAACCGTT GGCAGCTTGA CGGCAAGTTG TCTTACAAAC

  1151  GCGGGACCGG CATGCGCCAA AGTATGCCTG CACCGGAAGA AAACGGCGGC
```

-continued

```
1201 GATATTCTTC CAGGTACATC TCGTATGAAA ATCATTACTG CCAGTTTGGA

1251 CGCAGCCGCC CCATTTATTT TAGGCAAACA GCAGTTTTTC TACGCAACCG

1301 CCATTCAAGC TCAATGGAAC AAAACGCCGT TGGTTGCCCA AGATAAATTG

1351 TCAATCGGCA GCCGCTACAC CGTTCGCGGA TTTGATGGGG AGCAGAGTCT

1401 TTTCGGAGAG CGAGGTTTCT ACTGGCAGAA TACTTTAACT TGGTATTTTC

1451 ATCCGAACCA TCAGTTCTAT CTCGGTGCGG ACTATGGCCG CGTATCTGGC

1501 GAAAGTGCAC AATATGTATC GGGCAAGCAG CTGATGGGTG CAGTGGTCGG

1551 CTTCAGAGGA GGGCATAAAG TAGGCGGTAT GTTTGCTTAT GATCTGTTTG

1601 CCGGCAAGCC GCTTCATAAA CCCAAAGGCT TTCAGACGAC CAACACCGTT

1651 TACGGCTTCA ACTTGAATTA CAGTTTCTAA
```

This corresponds to the amino acid sequence <SEQ ID 2370; ORF 707>:

```
m707.pep
  1 MEIINDAELI RSMQRQQHID AELLTDANVR FEQPLEKNNY VLSEDETPCT

 51 RVNYISLDDK TVRKFSFLPS VLMKETAFKT GMCLGSNNLS RLQKAAQQIL

101 IVRGYLTSQA IIQPQNMDSG ILKLRVSAGE IGDIRYEEKR DGKSAEGSIS

151 AFNNKFPLYR NKILNLRDVE QGLENLRRLP SVKTDIQIIP SEEEGKSDLQ

201 IKWQQNKPIR FSIGIDDAGG KTTGKYQGNV ALSFDNPLGL SDLFYVSYGR

251 GLAHKTDLTD ATGTETESGS RSYSVHYSVP VKKWLFSFNH NGHRYHEATE

301 GYSVNYDYNG KQYQSSLAAE RMLWRNRLHK TSVGMKLWTR QTYKYIDDAE

351 IEVQRRRSAG WEAELRHRAY LNRWQLDGKL SYKRGTGMRQ SMPAPEENGG

401 DILPGTSRMK IITASLDAAA PFILGKQQFF YATAIQAQWN KTPLVAQDKL

451 SIGSRYTVRG FDGEQSLFGE RGFYWQNTLT WYFHPNHQFY LGADYGRVSG

501 ESAQYVSGKQ LMGAVVGFRG GHKVGGMFAY DLFAGKPLHK PKGFQTTNTV

551 YGFNLNYSF*
```

The following partial DNA sequence was identified in *N. meningitidis* <SEQ ID 2371>:

```
a707.seq
  1 NTGAAAGAAA CAGCTTTTAA AACTGGGATG TGTTTAGGTT CCAATAATTT

 51 GAGCAGGCTA CAAAAAGCCG CGCAACAGAT ACTGATTGTG CGTGGCTACC

101 TCACTTCCCA AGCTATTATC CAACCACAGA ATATGGATTC GGGAATTCTG

151 AAATTACGGG TATCAGCAGG CGAAATAGGN GATATCCGCT ATGAAGAAAA

201 ACGGGATGNG AAGTCTGCCG AGGGCAGTAT TAGTGCATTC AATAACAAAN

251 TTCCCTTATA TAGGAACAAA ATTCTCAATC TTCGCGATGT AGAGCAGGGC

301 TTGGAAAACC TGCGTCGTTT GCCGAGTGTT AAAACAGATA TTCAGATTAT

351 ACCGTCCGAA GAAGAAGGCA AAAGCGATTT ACAGATCAAA TGGCAGCAGA

401 ATAAACCCAT ACGGTTCAGT ATCGGTATAG ATGATGCGGG CGGCAAAACG

451 ACCGGCAAAT ATCAAGGAAA TGTCGCTTTA TCGTNCGATA ACCCTTTGGG

501 NTTAAGCGAT TNGTTTTATG TTTCATATGG ACGCGGTTTG GTGCACAAAA

551 CGGACTTGAC TGNTGCCACC GGTACGGAAA CTGAAAGCGG ATCCAGAAGT
```

-continued

```
 601  TACAGCGTGC ATTATTCGGT GNNCGTAAAA AAATGGCTGT TTTCTTTTAA

 651  TCACAATGGA CATCGTTACC ACGAAGCAAC CGAAGGCTAT TCCGTCAATT

 701  ACGATTACAA CGGCAAACAA TATCAGAGCA GCCTGGCCGC CGAGCGCATG

 751  CTTTGGNNNN NNAGNTTTCN TNAAACTTCA GTCNGAATGA AATTATGGAC

 801  ACGCCAAACC TATAAATACA TCGACGATGC CGAAATCGAA GTGCAACGCC

 851  GCCGCTCTGC AGGCTGGGAA GCCGAATTGC GCCACCGTGC TTACCTCNAC

 901  CGTTGGCAGC TTGACGGCAA GTTGTCTTAC AAACGCGGGA CCGGCATGCG

 951  CCAAAGTATG CCCGCACCTG AAGAAAACGG CGGCGGTACT ATTCCAGNCA

1001  NATCCCGTAT GAAAATCATA ACCGCCGGAT TGGATGCAGC GGCCCCGTNT

1051  ATGTTGGGCA AACAGCAGTT TTTCTACGCA ACCGCCATTC AAGCTCAATG

1101  GAACAAAACG CCTTTGGTTG CCCAAGACAA GTTGTCTATC GGCAGCCGCT

1151  ACACCGTTCG CGGATTTGAT GGGGAGCAGA GTCTTTTCGG AGAGCGAGGT

1201  TTCTACTGGC AGAATACTTT AACTTGGTAT TTTCATCCGA ACCATCAGTT

1251  CTATCTCGGT GCGGACTATG GCCGCGTATC TGGCGAAAGT GCACAATATG

1301  TATCGGGCAA GCAGCTGATG GGTGCAGTGG TCGGCTTCAG AGGAGGGCAT

1351  AAAGTAGGCG GTATGTTTGC TTATGATCTG TTTGCCGGCA AGCCGCTTCA

1401  TAAACCCAAA GGCTTTCAGA CGACCAACAC CGTTTACGGC TTCAACTTGA

1451  ATTACAGTTT CTAA
```

This corresponds to the amino acid sequence <SEQ ID 2372; ORF 707.a>:

```
a707.pep
   1  XKETAFKTGM CLGSNNLSRL QKAAQQILIV RGYLTSQAII QPQNMDSGIL

  51  KLRVSAGEIG DIRYEEKRDX KSAEGSISAF NNKXPLYRNK ILNLRDVEQG

 101  LENLRRLPSV KTDIQIIPSE EEGKSDLQIK WQQNKPIRFS IGIDDAGGKT

 151  TGKYQGNVAL SXDNPLGLSD XFYVSYGRGL VHKTDLTXAT GTETESGSRS

 201  YSVHYSVXVK KWLFSFNHNG HRYHEATEGY SVNYDYNGKQ YQSSLAAERM

 251  LWXXXFXXTS VXMKLWTRQT YKYIDDAEIE VQRRRSAGWE AELRHRAYLX

 301  RWQLDGKLSY KRGTGMRQSM PAPEENGGGT IPXXSRMKII TAGLDAAAPX

 351  MLGKQQFFYA TAIQAQWNKT PLVAQDKLSI GSRYTVRGFD GEQSLFGERG

 401  FYWQNTLTWY FHPNHQFYLG ADYGRVSGES AQYVSGKQLM GAVVGFRGGH

 451  KVGGMFAYDL FAGKPLHKPK GFQTTNTVYG FNLNYSF*
```

a707/m707 95.3% identity in 486 aa overlap

```
                                                    10        20        30
a707.pep                                    XKETAFKTGMCLGSNNLSRLQKAAQQILIVR
                                             ||||||||||||||||||||||||||||||
m707        EDETPCTRVNYISLDDKTVRKFSFLPSVLMKETAFKTGMCLGSNNLSRLQKAAQQILIVR
                  50        60        70        80        90       100

                 40        50        60        70        80        90
a707.pep    GYLTSQAIIQPQNMDSGILKLRVSAGEIGDIRYEEKRDXKSAEGSISAFNNKXPLYRNKI
            ||||||||||||||||||||||||||||||||||||||| ||||||||||||| ||||||
m707        GYLTSQAIIQPQNMDSGILKLRVSAGEIGDIRYEEKRDGKSAEGSISAFNNKFPLYRNKI
                  110       120       130       140       150       160
```

-continued

```
              100        110        120        130        140        150
a707.pep  LNLRDVEQGLENLRRLPSVKTDIQIIPSEEEGKSDLQIKWQQNKPIRFSIGIDDAGGKTT
          ||||||||||||||||||||||||||||||||||||||||||||||||||||||||||||
m707      LNLRDVEQGLENLRRLPSVKTDIQIIPSEEEGKSDLQIKWQQNKPIRFSIGIDDAGGKTT
            170        180        190        200        210        220

              160        170        180        190        200        210
a707.pep  GKYQGNVALSXDNPLGLSDXFYVSYGRGLVHKTDLTXATGTETESGSRSYSVHYSVXVKK
          |||||||||| |||||||| |||||||||:|||||| ||||||||||||||||||| |||
m707      GKYQGNVALSFDNPLGLSDLFYVSYGRGLAHKTDLTDATGTETESGSRSYSVHYSVPVKK
            230        240        250        260        270        280

              220        230        240        250        260        270
A707.pep  WLFSFNHNGHRYHEATEGYSVNYDYNGKQYQSSLAAERMLWXXXFXXTSVXMKLWTRQTY
          |||||||||||||||||||||||||||||||||||||||||    :  ||| ||||||||
m707      WLFSFNHNGHRYHEATEGYSVNYDYNGKQYQSSLAAERMLWRNRLHKTSVGMKLWTRQTY
            290        300        310        320        330        340

              280        290        300        310        320        330
a707.pep  KYIDDAEIEVQRRRSAGWEAELRHRAYLXRWQLDGKLSYKRGTGMRQSMPAPEENGGGTI
          |||||||||||||||||||||||||||| |||||||||||||||||||||||||||   :
m707      KYIDDAEIEVQRRRSAGWEAELRHRAYLNRWQLDGKLSYKRGTGMRQSMPAPEENGGDIL
            350        360        370        380        390        400

              340        350        360        370        380        390
a707.pep  PXXSRMKIITAGLDAAAPXMLGKQQFFYATAIQAQWNKTPLVAQDKLSIGSRYTVRGFDG
          | :|||||||:|||||| :|||||||||||||||||||||||||||||||||||||||||
m707      PGTSRMKIITASLDAAAPFILGKQQFFYATAIQAQWNKTPLVAQDKLSIGSRYTVRGFDG
            410        420        430        440        450        460

              400        410        420        430        440        450
a707.pep  EQSLFGERGFYWQNTLTWYFHPNHQFYLGADYGRVSGESAQYVSGKQLMGAVVGFRGGHK
          ||||||||||||||||||||||||||||||||||||||||||||||||||||||||||||
m707      EQSLFGERGFYWQNTLTWYFHPNHQFYLGADYGRVSGESAQYVSGKQLMGAVVGFRGGHK
            470        480        490        500        510        520

              460        470        480
a707.pep  VGGMFAYDLFAGKPLHKPKGFQTTNTVYGFNLNYSFX
          |||||||||||||||||||||||||||||||||||||
m707      VGGMFAYDLFAGKPLHKPKGFQTTNTVYGFNLNYSFX
            530        540        550        560
```

The following partial DNA sequence was identified in *N. gonorrhoeae* <SEQ ID 2373>:

```
g708.seq
   1 ATGCCTTTTA AGCCATCCAA ACGAATCTCT TTATTACTTG TTCTTGCCTT

  51 GGGCGCGTGC AGCACTTCCT ACCGCCCCTC GCGGGCAGAA AAAGCCAATC

 101 AGGTTTCCAA TATCAAAACC CAGTTGGCGA TGGAATATAT GCGCGGTCAG

 151 GACTACCGTC AGGCAACGGC AAGTATTGAA GATGCCTTGA AATCGAACCC

 201 TAAAAACGAA CTTGCCTGGC TGGTCCGTGC CGAAATCTAT CAATACCTGA

 251 AAGTTAACGA CAAGGCGCAG GAAAGTTTCC GGCAAGCCCT CTCCATCAAA

 301 CCCGACAGTG CCGAAATCAA CAACAACTAC GGCTGGTTCC TGTGCGGCAG

 351 GCTCAACCGC CCTGCCGAAT CTATGGCATA TTTCGACAAA GCCCTGGCCG

 401 ACCCCACCTA CCCGACCCCT TATATTGCCA ACCTGAATAA AGGTATATGC

 451 AGCGCAAAAC AGGGGCAATT CGGATTGGCG GAAGCCTATT TGAAACGTTC

 501 CCTCGCCGCC CAGCCGCAGT TCCCACCCGC ATTTAAAGAA CTGGCGCGCA

 551 CCAAAATGCT GGCCGGGCAG TTGGGCGATG CCGATTACTA CTTTAAAAAA

 601 TACCAAAGCA GGGTAGAAGT CCTTCAGGCC GATGATTTGC TGCTAGGCTG

 651 GAAAATTGCC AAAGCCCTCG GCAACGTGCA GGCGGCATAC GAATATGAAG

 701 CACAATTGCA GGCAAATTTC CCCTACTCGG AAGAATTGCA AACCGTCCTC

 751 ACCGGTCAAT AA
```

This corresponds to the amino acid sequence <SEQ ID 2374; ORF 708.ng>:

```
g708.pep
   1 MPFKPSKRIS LLLVLALGAC STSYRPSRAE KANQVSNIKT QLAMEYMRGQ

  51 DYRQATASIE DALKSNPKNE LAWLVRAEIY QYLKVNDKAQ ESFRQALSIK

 101 PDSAEINNNY GWFLCGRLNR PAESMAYFDK ALADPTYPTP YIANLNKGIC

 151 SAKQGQFGLA EAYLKRSLAA QPQFPPAFKE LARTKMLAGQ LGDADYYFKK

 201 YQSRVEVLQA DDLLLGWKIA KALGNVQAAY EYEAQLQANF PYSEELQTVL

 251 TGQ*
```

The following partial DNA sequence was identified in *N. meningitidis* <SEQ ID 2375>:

```
m708.seq
   1 ATGCCTTTTA AGCCATCCAA ACGAATCTCT TTATTACTCG TTCTTGCCTT

  51 GGGCGCGTGC AGCACTTCCT ACCGCCCCTC GCGGGCAGAA AAAGCCAATC

 101 AGGTTTCCAA TATCAAAACC CAGTTGGCAA TGGAATATAT GCGCGGTCAG

 151 GACTACCGTC AGGCGACGGC AAGTATTGAA GACGCCCTGA AATCGGACCC

 201 TAAAAACGAG CTTGCCTGGC TGGTCCGTGC CGAAATCTAT CAATACCTGA

 251 AAGTTAACGA CAAGGCGCAG GAAAGTTTCC GGCAAGCCCT CTCCATCAAA

 301 CCCGACAGTG CCGAAATCAA CAACAACTAC GGTTGGTTCC TATGCGGCAG

 351 GCTCAACCGC CCTGCCGAAT CTATGGCATA TTTCGACAAA GCTCTGGCCG

 401 ACCCCACCTA CCCGACCCCT TATATTGCCA ACCTGAATAA AGGCATATGC

 451 AGCGCAAAAC AGGGGCAATT CGGATTGGCG GAAGCCTATT TGAAACGTTC

 501 CCTCGCCGCC CAGCCGCAGT TCCCACCCGC ATTTAAAGAA CTGGCGCGCA

 551 CCAAAATGCT GGCCGGGCAG TTGGGCGATG CCGATTACTA CTTTAAAAAA

 601 TACCAAAGCA GGGTAGAAGT CCTTCAGGCC GATGATTTGC TGCTAGGCTG

 651 GAAAATTGCC AAAGCCCTCG GCAACGCACA GGCGGCATAC GAATATGAAG

 701 CACAATTGCA GGCGAATTTC CCCTACTCGG AAGAATTGCA AACCGTCCTC

 751 ACCGGTCAAT AA
```

This corresponds to the amino acid sequence <SEQ ID 2376; ORF 708>:

```
m708.pep

      1  MPFKPSKRIS LLLVLALGAC STSYRPSRAE KANQVSNIKT QLAMEYMRGQ

     51  DYRQATASIE DALKSDPKNE LAWLVRAEIY QYLKVNDKAQ ESFRQALSIK

    101  PDSAEINNNY GWFLCGRLNR PAESMAYFDK ALADPTYPTP YIANLNKGIC

    151  SAKQGQFGLA EAYLKRSLAA QPQFPPAFKE LARTKMLAGQ LGDADYYFKK

    201  YQSRVEVLQA DDLLLGWKIA KALGNAQAAY EYEAQLQANF PYSEELQTVL

    251  TGQ*

m708/g708  99.2% identity in 253 aa overlap

                   10        20        30        40        50        60
m708.pep  MPFKPSKRISLLLVLALGACSTSYRPSRAEKANQVSNIKTQLAMEYMRGQDYRQATASIE
          ||||||||||||||||||||||||||||||||||||||||||||||||||||||||||||
g708      MPFKPSKRISLLLVLALGACSTSYRPSRAEKANQVSNIKTQLAMEYMRGQDYRQATASIE
                   10        20        30        40        50        60
```

-continued

```
             70        80        90        100       110       120
m708.pep  DALKSDPKNELAWLVRAEIYQYLKVNDKAQESFRQALSIKPDSAEINNNYGWFLCGRLNR
          |||||:||||||||||||||||||||||||||||||||||||||||||||||||||||||
g708      DALKSNPKNELAWLVRAEIYQYLKVNDKAQESFRQALSIKPDSAEINNNYGWFLCGRLNR
             70        80        90        100       110       120
            130       140       150       160       170       180
m708.pep  PAESMAYFDKALADPTYPTPYIANLNKGICSAKQGQFGLAEAYLKRSLAAQPQFPPAFKE
          ||||||||||||||||||||||||||||||||||||||||||||||||||||||||||||
g708      PAESMAYFDKALADPTYPTPYIANLNKGICSAKQGQFGLAEAYLKRSLAAQPQFPPAFKE
            130       140       150       160       170       180
            190       200       210       220       230       240
m708.pep  LARTKMLAGQLGDADYYFKKYQSRVEVLQADDLLLGWKIAKALGNAQAAYEYEAQLQANF
          ||||||||||||||||||||||||||||||||||||||||||||||:|||||||||||||
g708      LARTKMLAGQLGDADYYFKKYQSRVEVLQADDLLLGWKIAKALGNVQAAYEYEAQLQANF
            190       200       210       220       230       240
            250
m708.pep  PYSEELQTVLTGQX
          ||||||||||||||
g708      PYSEELQTVLTGQX
            250
```

The following partial DNA sequence was identified in *N. meningitidis* <SEQ ID 2377>:

```
a708.seq
  1 ATGCCTTTTA AGCCATCCAA ACGAATCTCT TTATTACTTG TCCTTGCCTT

 51 GGGCGCGTGC AGCACTTCCT ACCGCCCCTC GCGGGCAGAA AAAGCCAATC

101 AGGTTTCCAA TATCAAAACC CAGTTGGCAA TGGAATATAT GCGCGGTCAG

151 GACTACCGTC AGGNGACGGC AAGTATTGAA GACGCCTTGA AATCAGACCC

201 TAAAAACGAG CTTGCCTGGC TGGTCCGTGC CGAAATCTAT CAATACCTGA

251 AAGTTAACGA CAAGGCGCAG GAAAGTTTCC GGCAAGNCCT CTCCATCAAA

301 CCCGACAGTG CCGAAATCAA CAACAACTAC NGCTGGTTCC TGTGCGGCAG

351 GCTCAACCGC CCTGCCGAAT CTATGGCATA TTTCGACAAA GCCCTGGCCG

401 ACCCCACNTA CCCGANCCCT TATATTGCCA ACCTGAATAA AGGCATATGC

451 AGCGCAAAAC AGGGGCAATT CGGATTGGCG GAAGCCTATT TGAAACGTTC

501 CCTCGCCGCC CAGCCGCAGT TCCCACCCGC ATTTAAAGAA CTGGCGCGCA

551 CCAAAATGCT GGCCGGGCAG TTGGGCGATG CCGATTACTA CTTTAAAAAA

601 TACCAAAGCA GGGTAGAAGT CCTTCAGGCC GATGATTTGC TGCTAGGCTG

651 GAAAATTGCC AAAGCCCTCG GCAACGCACA GGCGGCATAC GAATATGAAG

701 CACAATTGCA GGCGAATTTC CCCTACTCGG AAGAATTGCA AACCGTCCTC

751 ATCGGTCAAT AA
```

This corresponds to the amino acid sequence <SEQ ID 2378; ORF 708.a>:

```
a708.pep
  1 MPFKPSKRIS LLLVLALGAC STSYRPSRAE KANQVSNIKT QLAMEYMRGQ

 51 DYRQXTASIE DALKSDPKNE LAWLVRAEIY QYLKVNDKAQ ESFRQXLSIK

101 PDSAEINNNY XWFLCGRLNR PAESMAYFDK ALADPTYPXP YIANLNKGIC

151 SAKQGQFGLA EAYLKRSLAA QPQFPPAFKE LARTKMLAGQ LGDADYYFKK

201 YQSRVEVLQA DDLLLGWKIA KALGNAQAAY EYEAQLQANF PYSEELQTVL

251 IGQ*
```

a708/m708 98.0% identity in 253 aa overlap

```
                      10        20        30        40        50        60
a708.pep      MPFKPSKRISLLLVLALGACSTSYRPSRAEKANQVSNIKTQLAMEYMRGQDYRQXTASIE
              |||||||||||||||||||||||||||||||||||||||||||||||||||||| |||||
m708          MPFKPSKRISLLLVLALGACSTSYRPSRAEKANQVSNIKTQLAMEYMRGQDYRQATASIE
                      10        20        30        40        50        60

                      70        80        90       100       110       120
a708.pep      DALKSDPKNELAWLVRAEIYQYLKVNDKAQESFRQXLSIKPDSAEINNNYXWFLCGRLNR
              ||||||||||||||||||||||||||||||||||| |||||||||||||| |||||||||
m708          DALKSDPKNELAWLVRAEIYQYLKVNDKAQESFRQALSIKPDSAEINNNYGWFLCGRLNR
                      70        80        90       100       110       120

                     130       140       150       160       170       180
a708.pep      PAESMAYFDKALADPTYPXPYIANLNKGICSAKQGQFGLAEAYLKRSLAAQPQFPPAFKE
              ||||||||||||||||||:|||||||||||||||||||||||||||||||||||||||||
m708          PAESMAYFDKALADPTYPTPYIANLNKGICSAKQGQFGLAEAYLKRSLAAQPQFPPAFKE
                     130       140       150       160       170       180

                     190       200       210       220       230       240
a708.pep      LARTKMLAGQLGDADYYFKKYQSRVEVLQADDLLLGWKIAKALGNAQAAYEYEAQLQANF
              ||||||||||||||||||||||||||||||||||||||||||||||||||||||||||||
m708          LARTKMLAGQLGDADYYFKKYQSRVEVLQADDLLLGWKIAKALGNAQAAYEYEAQLQANF
                     190       200       210       220       230       240

                     250
a708.pep      PYSEELQTVLIGQX
              |||||||||| |||
m708          PYSEELQTVLTGQX
                     250
```

The following partial DNA sequence was identified in *N. gonorrhoeae* <SEQ ID 2379>:

```
g709.seq
   1 ATGTTTGCTT TCAAATCCTT ACTCGATATG CCGCGCGGTG AGGCACTTGC

  51 CGTCGTCGTC GCTCTGATTG CCGCAATGGG CTATACCATC ATTTCATTGG

 101 AGTGGCTGCC GCATATGTCC ATTATTGCCG CCATCGTCGT GCTGATTTTG

 151 TACGGCTTGG CGCGCGGTTT GAAATACAAC GATATGCAGG CAGGGATGAT

 201 AGGCGCGTTG AATCAGGGTA TGGGCGCGGT TTACCTGTTT TTCTTCATCG

 251 GGCTGATGGT CAGCGCGCTG ATGATGAGCG GCGCGATTCC GACGCTGATG

 301 TATTACGGTT TCGGGCTGAT TTCCCCGACT TATTTTTATT TTTCCGCCTT

 351 CGCGCTGTGT TCCGTCATCG GCGTGTCCAT CGGCAGCAGC CTGACCGCCT

 401 GCGCCACTGT CGGCGTTGCC TTTATGGGGA TGGCGGCGGC GTTTCAGGCC

 451 GATATGGCGA TGACGgcggg cgcgattgTT tccggTGTGT TTTTCGGCGA

 501 TAAAATGTCC CCGCTTTCCG ACACCACGGG CATTTCCGCG TCCATCGTCG

 551 GTATCGACCT GTTTGAACAC ATCAAAAACA TGATGTACAC CACCATCCCT

 601 GCGTGGCTTA TCAGCGCGGC ACTGATGCTT TGGCTTCTTC CCAGCGTCGC

 651 CGCGCAGGAT TTGAACAGCG TCGAATCCTT CCGCAGCCAG CTTGAAGCCA

 701 CGGGATTGGT GCACGGCTAT TCGCTGATTC CGTTTGCACT GTTGGTCGTT

 751 TTGGCATTGA TGCGCGTCAA TGCCGTGGTC GCCATGCTCT TTACCGTCAT

 801 TGCCGCCGTT GCCGTAACGT ATCTGCACAG CACGCCCGAT CTGCGTCAGC

 851 TCGGCGCGTG GTTTTATGGC GGCTACAAAC TCGAAGGCGA AGCGTTTAAA

 901 GACATTGCCA AACTGATTTC GCGCGGCGGC TTGGAGAGTA TGTTCTTTAC

 951 GCAGACCATC GTTATCCTCG GTATGAGTTT GGGCGGGCTG CTGTTTGCGC

1001 TCGGTGTGAT TCCTTCCTTG CTGGAGGCCG TCCGTACCTT CTTGACGAAT

1051 GCCGGACGCG CGACGTTCAG CGTTGCCATG ACTTCGGTCG GGGTCAATTT

1101 CCTGATTGGA GAGCAATATT TGAGCATCCT GCTTTCGGGA GAAACGTTCA
```

-continued

```
1151 AACCCGTTTA CGACAAACTC GGCCTGCATT CGTGCAACCT GTCGCGGACT

1201 CTGGAAGATG CGGGGACGGT GATTAACCCG CTCGTGCCGT GGAGCGTGTG

1251 CGGCGTATTT ATCAGCCACG CCCTTGGCGT ACCCGTTTGG GAATATCTGC

1301 CTTATGCCTT TTTCTGCTAT TTGAGTTTGG CTTTAACCCT GTTATTCGGC

1351 TGGACGGGGC TGACTTTGAG CAAAAAATAA
```

This corresponds to the amino acid sequence <SEQ ID 2380; ORF 709.ng>:

```
g709.pep
   1 MFAFKSLLDM PRGEALAVVV ALIAAMGYTI ISLEWLPHMS IIAAIVVLIL

  51 YGLARGLKYN DMQAGMIGAL NQGMGAVYLF FFIGLMVSAL MMSGAIPTLM

 101 YYGFGLISPT YFYFSAFALC SVIGVSIGSS LTACATVGVA FMGMAAAFQA

 151 DMAMTAGAIV SGVFFGDKMS PLSDTTGISA SIVGIDLFEH IKNMMYTTIP

 201 AWLISAALML WLLPSVAAQD LNSVESFRSQ LEATGLVHGY SLIPFALLVV

 251 LALMRVNAVV AMLFTVIAAV AVTYLHSTPD LRQLGAWFYG GYKLEGEAFK

 301 DIAKLISRGG LESMFFTQTI VILGMSLGGL LFALGVIPSL LEAVRTFLTN

 351 AGRATFSVAM TSVGVNFLIG EQYLSILLSG ETFKPVYDKL GLHSCNLSRT

 401 LEDAGTVINP LVPWSVCGVF ISHALGVPVW EYLPYAFFCY LSLALTLLFG

 451 WTGLTLSKK*
```

The following partial DNA sequence was identified in *N. meningitidis* <SEQ ID 2381>:

```
m709.seq
   1 ATGTTCGCTT TCAAATCCTT ACTCGATATG CCGCGCGGTG AGGCACTTGC

  51 CGTCGTCGTC GCTCTGATTG CCGCGATGGG CTATACCATC ATTTCATTGG

 101 AGTGGTTGCC GCATATGTCC ATTATTGCCG CCATCGTCGT GCTGATTTTG

 151 TACGGCTTGG CGCGCGGTTT GAAATACAAC GATATGCAGC AGGGCATGAT

 201 AGGCGCGTTG AATCAGGGTA TGGGCGCGAT TTACCTGTTT TTCTTCATCG

 251 GGCTGATGGT CAGCGCGCTG ATGATGAGCG GCGCGATTCC GACGCTGATG

 301 TATTACGGTT TCGGACTGAT TTCCCCGACT TATTTTTATT TTTCCTCCTT

 351 CGCGCTGTGT TCCGTCATCG GCGTGTCCAT CGGCAGCAGC CTGACCACCT

 401 GCGCCACTGT CGGCGTTGCC TTTATGGGGA TGGCGGCGGC GTTTCAGGCC

 451 GATATGGCGA TGACGGCGGG CGCGATTGTT TCGGGCGCAT TTTTTGGCGA

 501 CAAAATGTCC CCGCTTTCGG ATACGACGGG TATTTCCGCG TCCATCGTCG

 551 GCATCGACTT GTTTGAGCAC ATCAAAAATA TGATGTACAC CACCATCCCC

 601 GCGTGGCTCA TTAGTGCGGC ACTGATGCTT TGGCTTTTGC CGAATGTCGC

 651 CGCGCAGGAT TTGAACAGCG TCGAATCCTT CCGCAGCCAG CTTGAAGCCA

 701 CGGGATTGGT GCACGGCTAT TCGCTGATTC CGTTTGCGCT GTTGGTCATT

 751 TTGGCATTGA TGCGCATCAA CGCCGTCGTC GCCATGCTCT TTACCGTCAT

 801 GGTTGCCGTT GCTGTAACGT ATCTGCACAG CACGCCCGAT CTGCGTCAGC

 851 TCGGTGCGTG GTTTTACGGC GGCTACAAAC TCGAAGGCGA AGCGTTTAAA

 901 GATGTTGTCA AACTGATTTC GCGCGGCGGT TTGGAAAGTA TGTTTTTCAC
```

-continued

```
 951 GCAAACCATC GTGATTCTCG GGATGAGTTT GGGCGGACTG TTGTTTGCGC
1001 TCGGTGTGAT TCCTTCCCTG TTGGAGGCCA TCCGTACCTT CTTGACGAAT
1051 GCCGGACGCG CGACGTTCAG CGTTGCCATG ACTTCGGTCG GGGTTAATTT
1101 CCTGATCGGC GAGCAATATT TGAGTATTTT GTTGTCGGGT GAAACGTTCA
1151 AACCCGTTTA CGATAAGCTC GGTCTGCATT CGCGCAATCT GTCGCGGACG
1201 CTGGAAGATG CGGGGACGGT GATTAACCCG CTCGTACCGT GGAGCGTATG
1251 CGGCGTGTTC ATCAGCCACG CGCTGGGCGT GCCGGTTTGG GAATATCTGC
1301 CGTATGCCTT TTTCTGCTAT TTGAGTTTGG CTTTGACCCT GTTATTCGGT
1351 TGGACGGGGC TGACTTTGAG CAAAAAATAA
```

This corresponds to the amino acid sequence <SEQ ID 2382; ORF 709>:

```
m709.pep

  1 MFAFKSLLDM PRGEALAVVV ALIAAMGYTI ISLEWLPHMS IIAAIVVLIL
 51 YGLARGLKYN DMQQGMIGAL NQGMGAIYLF FFIGLMVSAL MMSGAIPTLM
101 YYGFGLISPT YFYFSSFALC SVIGVSIGSS LTTCATVGVA FMGMAAAFQA
151 DMAMTAGAIV SGAFFGDKMS PLSDTTGISA SIVGIDLFEH IKNMMYTTIP
201 AWLISAALML WLLPNVAAQD LNSVESFRSQ LEATGLVHGY SLIPFALLVI
251 LALMRINAVV AMLFTVMVAV AVTYLHSTPD LRQLGAWFYG GYKLEGEAFK
301 DVVKLISRGG LESMFFTQTI VILGMSLGGL LFALGVIPSL LEAIRTFLTN
351 AGRATFSVAM TSVGVNFLIG EQYLSILLSG ETFKPVYDKL GLHSRNLSRT
401 LEDAGTVINP LVPWSVCGVF ISHALGVPVW EYLPYAFFCY LSLALTLLFG
451 WTGLTLSKK*
```

```
m709/g709  96.9% identity in 459 aa overlap

                  10        20        30        40        50        60
m709.pep   MFAFKSLLDMPRGEALAVVVALIAAMGYTIISLEWLPHMSIIAAIVVLILYGLARGLKYN
           ||||||||||||||||||||||||||||||||||||||||||||||||||||||||||||
g709       MFAFKSLLDMPRGEALAVVVALIAAMGYTIISLEWLPHMSIIAAIVVLILYGLARGLKYN
                  10        20        30        40        50        60

                  70        80        90       100       110       120
m709.pep   DMQQGMIGALNQGMGAIYLFFFIGLMVSALMMSGAIPTLMYYGFGLISPTYFYFSSFALC
           ||| ||||||||||:||||||||||||||||||||||||||||||||||||||||:||||
g709       DMQAGMIGALNQGMGAVYLFFFIGLMVSALMMSGAIPTLMYYGFGLISPTYFYFSAFALC
                  70        80        90       100       110       120

                 130       140       150       160       170       180
m709.pep   SVIGVSIGSSLTTCATVGVAFMGMAAAFQADMAMTAGAIVSGAFFGDKMSPLSDTTGISA
           ||||||||||||:|||||||||||||||||||||||||||||:|||||||||||||||||
g709       SVIGVSIGSSLTACATVGVAFMGMAAAFQADMAMTAGAIVSGVFFGDKMSPLSDTTGISA
                 130       140       150       160       170       180

                 190       200       210       220       230       240
m709.pep   SIVGIDLFEHIKNMMYTTIPAWLISAALMLWLLPNVAAQDLNSVESFRSQLEATGLVHGY
           ||||||||||||||||||||||||||||||||||:|||||||||||||||||||||||||
g709       SIVGIDLFEHIKNMMYTTIPAWLISAALMLWLLPSVAAQDLNSVESFRSQLEATGLVHGY
                 190       200       210       220       230       240

                 250       260       270       280       290       300
m709.pep   SLIPFALLVILALMRINAVVAMLFTVMVAVAVTYLHSTPDLRQLGAWFYGGYKLEGEAFK
           ||||||||:|||||:||||||||||::|||||||||||||||||||||||||||||||||
g709       SLIPFALLVVLALMRVNAVVAMLFTVIAAVAVTYLHSTPDLRQLGAWFYGGYKLEGEAFK
                 250       260       270       280       290       300

                 310       320       330       340       350       360
m709.pep   DVVKLISRGGLESMFFTQTIVILGMSLGGLLFALGVIPSLLEAIRTFLTNAGRATFSVAM
           |::|||||||||||||||||||||||||||||||||||||||:|||||||||||||||||
g709       DIAKLISRGGLESMFFTQTIVILGMSLGGLLFALGVIPSLLEAVRTFLTNAGRATFSVAM
                 310       320       330       340       350       360
```

-continued

```
                 370        380        390        400        410        420
m709.pep   TSVGVNFLIGEQYLSILLSGETFKPVYDKLGLHSRNLSRTLEDAGTVINPLVPWSVCGVF
           |||||||||||||||||||||||||||||||||| |||||||||||||||||||||||||
g709       TSVGVNFLIGEQYLSILLSGETFKPVYDKLGLHSCNLSRTLEDAGTVINPLVPWSVCGVF
                 370        380        390        400        410        420

                 430        440        450        460
m709.pep   ISHALGVPVWEYLPYAFFCYLSLALTLLFGWTGLTLSKKX
           ||||||||||||||||||||||||||||||||||||||||
g709       ISHALGVPVWEYLPYAFFCYLSLALTLLFGWTGLTLSKKX
                 430        440        450        460
```

The following partial DNA sequence was identified in *N. meningitidis* <SEQ ID 2383>:

```
a709.seq
   1 ATGTTCGCTT TCNAATCCTT ACTCGATATG CCGCGCGGTG AGGCNCTTGC

  51 CGTCGTCGTC GCTCTGATTG CCGCGATGGG CTATACCATC ATTTNNTTGG

 101 AGTGGCTGCC GCATATGTCC ATTATTGCCG CCATCGTNGT GCTGATTTTG

 151 TACGGCTTGG CGCGCGGTTT GAAATACAAC GATATGCAGC AGGGCATGAT

 201 AGGCGCGTTG AATCAGGGTA TGGGCGCGAT TTACCTNTTT TTCTTCATCG

 251 GGCTGATGGT CAGCGCGCTG ATGATGAGCG GCGCGATTCC GACGCTGATG

 301 TATTACGGTT TCGGACTGAT TTCCCCGACT TATTTTTATT TTTCCGCCTT

 351 CGCGCTGTGT TCCGTCATCG GCGTGTCCAT CGGCAGCAGC CTGACCACCT

 401 GCGCCACTGT CGGCGTTGCC TTNATGGGTA TNNNGNCGGC GTTTCNGGCC

 451 NANATGGNGN NGNNGNNGGN CNNGATTGTN NNGGNCGCAT TNTTNGGCGN

 501 CAAAATGTCN CCGCTTTCCG ATACGNCGGG CATNTCCGCG TCCATTGTCG

 551 GTATCGACCT GTTTGAACAC ATCAAAAATA TGATGTACAC NACCATTCCC

 601 GCGTGGCTCA TCAGTGNNNC ACTGATGCTG TNGCTTCTTC CCAGCGTCGC

 651 CGCGCAGGAT TTGAACAGCG TCGAATCCTT CCGCAGCCAG CTTGAAGCCA

 701 CGGGATTGGT GCACTGCTAT TCGCTGATTC CGTTTGCGCT GTTGGTCGTT

 751 TTGGCATTGA TGCGCGTCAA TGCCGTGGTC GCTATGCTCT TTACCGTCAT

 801 TGCCGCCGTT GCCGTAACGT ATCTGCACAG CACGCCCGAT CTGCGTCAGC

 851 TCGGCGCGTG GTTTTACGGC GGCTACAAAC TCGAAGGCGA AGCGTNTANA

 901 GACATTGCCA AACTCATTTC TCGCGGCGGT TTGGAAAGTA TGTTTTTCAC

 951 GCAGACCATC GTGATTCTTG GGATGAGCCT TGGCGGGCTG CTGTTTGCAC

1001 TGGGCGCGAT TCCTTCCCTG CTGGATGCCG TCCGCAGCTT TTTGACGAAT

1051 GCCGGGCGTN CCACATTCAG CGTTGCCATG ACTTCGGTCG GGGTTAATTT

1101 CCTGATCGGC GAGCAATATT TGAGTATTTT GTTGTCNGGT GAAACGTTCA

1151 AACCTGTTTA CGATAAGCTC GGTCTGCATT CGCGCAATCT GTCGCGGACG

1201 CTGGAAGATG CGGGGACGGT CATCAACCCG CTCGTACCGT GGAGCGTATG

1251 CGGCGTGTTC ATCANCCACG CGCTGGGCGT GCCGGTTTGG GAATATCTGC

1301 CGTATGCCTT TTTCTGCTAT TTGAGTTTGG CTTTGACCCT GTTATTCGGT

1351 TGGACGGGGC TGACTTTGAG CAAAAAATAA
```

This corresponds to the amino acid sequence <SEQ ID 2384; ORF 709.a>:

```
a709.pep
   1 MFAFXSLLDM PRGEALAVVV ALIAAMGYTI IXLEWLPHMS IIAAIVVLIL

  51 YGLARGLKYN DMQQGMIGAL NQGMGAIYLF FFIGLMVSAL MMSGAIPTLM

 101 YYGFGLISPT YFYFSAFALC SVIGVSIGSS LTTCATVGVA XMGXXXAFXA

 151 XMXXXXXXIV XXAXXGXKMS PLSDTXGXSA SIVGIDLFEH IKNMMYTTIP

 201 AWLISXXLML XLLPSVAAQD LNSVESFRSQ LEATGLVHCY SLIPFALLVV

 251 LALMRVNAVV AMLFTVIAAV AVTYLHSTPD LRQLGAWFYG GYKLEGEAXX

 301 DIAKLISRGG LESMFFTQTI VILGMSLGGL LFALGAIPSL LDAVRSFLTN

 351 AGRXTFSVAM TSVGVNFLIG EQYLSILLSG ETFKPVYDKL GLHSRNLSRT

 401 LEDAGTVINP LVPWSVCGVF IXHALGVPVW EYLPYAFFCY LSLALTLLFG

 451 WTGLTLSKK*
```

a709/m709 91.1% identity in 459 aa overlap

```
                  10        20        30        40        50        60
a709.pep  MFAFXSLLDMPRGEALAVVVALIAAMGYTIIXLEWLPHMSIIAAIVVLILYGLARGLKYN
          |||| |||||||||||||||||||||||||| |||||||||||||||||||||||||||||
m709      MFAFKSLLDMPRGEALAVVVALIAAMGYTIISLEWLPHMSIIAAIVVLILYGLARGLKYN
                  10        20        30        40        50        60

                  70        80        90       100       110       120
a709.pep  DMQQGMIGALNQGMGAIYLFFFIGLMVSALMMSGAIPTLMYYGFGLISPTYFYFSAFALC
          |||||||||||||||||||||||||||||||||||||||||||||||||||||||:||||
m709      DMQQGMIGALNQGMGAIYLFFFIGLMVSALMMSGAIPTLMYYGFGLISPTYFYFSSFALC
                  70        80        90       100       110       120

                 130       140       150       160       170       180
a709.pep  SVIGVSIGSSLTTCATVGVAXMGXXXAFXAXMXXXXXXIVXXAXXGXKMSPLSDTXGXSA
          |||||||||||||||||||| ||   || | |  :   ||  |  | ||||||||:| ||
m709      SVIGVSIGSSLTTCATVGVAFMGMAAAFQADMAMTAGAIVSGAFFGDKMSPLSDTTGISA
                 130       140       150       160       170       180

                 190       200       210       220       230       240
a709.pep  SIVGIDLFEHIKNMMYTTIPAWLISXXLMLXLLPSVAAQDLNSVESFRSQLEATGLVHCY
          |||||||||||||||||||||||||  ||| |||:||||||||||||||||||||||| |
m709      SIVGIDLFEHIKNMMYTTIPAWLISAALMLWLLPNVAAQDLNSVESFRSQLEATGLVHGY
                 190       200       210       220       230       240

                 250       260       270       280       290       300
a709.pep  SLIPFALLVVLALMRVNAVVAMLFTVIAAVAVTYLHSTPDLRQLGAWFYGGYKLEGEAXX
          |||||||||:|||||:||||||||||::||||||||||||||||||||||||||||||  
m709      SLIPFALLVILALMRINAVVAMLFTVMVAVAVTYLHSTPDLRQLGAWFYGGYKLEGEAFK
                 250       260       270       280       290       300

                 310       320       330       340       350       360
a709.pep  DIAKLISRGGLESMFFTQTIVILGMSLGGLLFALGAIPSLLDAVRSFLTNAGRXTFSVAM
          |::||||||||||||||||||||||||||||||||:|||||:|:|:||||||| ||||||
m709      DVVKLISRGGLESMFFTQTIVILGMSLGGLLFALGVIPSLLEAIRTFLTNAGRATFSVAM
                 310       320       330       340       350       360

                 370       380       390       400       410       420
a709.pep  TSVGVNFLIGEQYLSILLSGETFKPVYDKLGLHSRNLSRTLEDAGTVINPLVPWSVCGVF
          ||||||||||||||||||||||||||||||||||||||||||||||||||||||||||||
m709      TSVGVNFLIGEQYLSILLSGETFKPVYDKLGLHSRNLSRTLEDAGTVINPLVPWSVCGVF
                 370       380       390       400       410       420

                 430       440       450       460
a709.pep  IXHALGVPVWEYLPYAFFCYLSLALTLLFGWTGLTLSKKX
          | ||||||||||||||||||||||||||||||||||||||
m709      ISHALGVPVWEYLPYAFFCYLSLALTLLFGWTGLTLSKKX
                 430       440       450       460

g710.seq  not found

g710.pep  not found
```

The following partial DNA sequence was identified in *N. meningitidis* <SEQ ID 2385>:

```
m710.seq
   1 ATGGAAACCC ACGAAAAAAT CCGCCTGATG CGCGAATTGA ATAAATGGTC
```

-continued

```
 51 CCAGGAGGAT ATGGCGGAAA AGCTGGCGAT GTCGGCAGGC GGGTATGCCA

101 AAATCGAACG GGGCGAAACG CAGTTAAATA TCCCGCGTTT GGAGCAGTTG

151 GCTCAGATTT TCAAAATCGA TATGTGGGAC TTGCTCAAAT CGGGCGGTGG

201 TGGGATGGTG TTTCAGATTA ATGAAGGTGA TAGTGGTGGC GATATTGCGT

251 TGTATGCGTC GGGTGATGTT TCGATGAAAA TAGAATTTTT AAAAATGGAG

301 TTGAAACACT GCAAAGAAAT GTTGGAACAA AAAGACAAAG AAATCGAGCT

351 GCTCCGCAAG CTGACCGAAA CCGTTTAA
```

This corresponds to the amino acid sequence <SEQ ID 2386; ORF 710>:

```
m710.pep
  1 METHEKIRLM RELNKWSQED MAEKLAMSAG GYAKIERGET QLNIPRLEQL

 51 AQIFKIDMWD LLKSGGGGMV FQINEGDSGG DIALYASGDV SMKIEFLKME

101 LKHCKEMLEQ KDKEIELLRK LTETV*
```

The following partial DNA sequence was identified in *N. meningitidis* <SEQ ID 2387>:

```
a710.seq
  1 ATGGAAACCC ACGAAAAAAT CCGCCTGATG CGCGAATTGA ATAAATGGTC

 51 CCAGGAGGAT ATGGCGGAAA AGCTGGCGAT GTCGGCAGGC GGGTATGCCA

101 AAATCGAACG AGGCGAAACG CAGTTGAATA TCCCGCGTTT GGAGCAGTTG

151 GCGCAGATTT TCAAAATTGA TATGTGGGAC TTGCTCAAAT CGGGCGGCGG

201 CGGGATGGTG TTGCAGATTA ACGATGTGGA TACCAACAGC GGGGAATTTG

251 CAATCTATAC CGCTCAGGAT GCATCNGGTA AAGCTGGATT TGTTAAAATG

301 GAATTAAAAC ACTGTAAAGA AATGTTGGAA CACAAAGACA AAGAAATCGA

351 GCTGCTCCGC AAGCTGACCG AAACCGTTTA A
```

This corresponds to the amino acid sequence <SEQ ID 2388; ORF 710.a>:

```
a710.pep
  1 METHEKIRLM RELNKWSQED MAEKLAMSAG GYAKIERGET QLNIPRLEQL

 51 AQIFKIDMWD LLKSGGGGMV LQINDVDTNS GEFAIYTAQD ASGKAGFVKM

101 ELKHCKEMLE HKDKEIELLR KLTETV*
```

a710/m710 85.7% identity in 126 aa overlap

```
                    10        20        30        40        50        60
a710.pep    METHEKIRLMRELNKWSQEDMAEKLAMSAGGYAKIERGETQLNIPRLEQLAQIFKIDMWD
            ||||||||||||||||||||||||||||||||||||||||||||||||||||||||||||
m710        METHEKIRLMRELNKWSQEDMAEKLAMSAGGYAKIERGETQLNIPRELQLAQIFKIDMWD
                    10        20        30        40        50        60

                    70        80        90       100       110       120
a710.pep    LLKSGGGGMVLQINDVDTNSGEFAIYTAQDASGKAGFVKMELKHCKEMLEHKDKEIELLR
            ||||||||||:|||:  |:: |::|:|:: |:|  |:||:||||||||||||:||||||||
m710        LLKSGGGGMVFQINEGDSG-GDIALYASGDVSMKIEFLKMELKHCKEMLEQKDKEIELLR
                    70         80        90       100       110

a710.pep    KLTETVX
            |||||||
m710        KLTETVX
        120
```

-continued

```
g711.seq not found

g711.pep not found
```

The following partial DNA sequence was identified in *N. meningitidis* <SEQ ID 2389>:

```
m711.seq
     1  ATGCCCGCGC CTGATTTGGG ATTTGCCTTA AGTCTGCCGC CAAAAAAGGC

    51  AATCGAGTGG CTGGAAAGTA AAAAGGTTAC GGCGGAGAGC TACCGCAATC

   101  TGACAGCCTC CGAAATTGCC AAAGTCTATA CGATTGCCCG CATGACCGAC

   151  TTGGATATGC TCAACGACAT CAAAACTTCG ATGGTTGAAT CGGCAAAAAG

   201  TGGACAGTCG TTTGACGATT GGCGAAAAGG TATCTTGAAT CTGCTCAGCA

   251  ACAAGGGCTG GCTGCATCCG AACGGGCATA ACGGTAAGGA TATCATCGAC

   301  CCAGCCACCG GCGAGGTATT CGGTTCGCCG CGGAGGTTGG AGACGATTTA

   351  CCGTACCAAT ATGCAAACTG CCTACAACGC CGGTCAATAT CAAGGATATA

   401  TGGCAAATAT TGATGCACGA CCTTATTGGA TGTATGACGC GGTAGGCGAC

   451  AGCCGCACCC GTCCGGCGCA TTCGGCAATA GACGGGCTGG TGTACCGCTA

   501  CGACGACCCG TTTTGGGCAA CGTTTTACCC GCCCAACGGC TACAACTGCC

   551  GCTGCTCGGT CATCGCGCTG TCGGAGCGGG ATGTGGAACG CCAGGGGCGG

   601  ATTGTTGGGC AAAGCACGGC GGACAATCTG GTCGAGACCC ATAAAATCTA

   651  CAACAAAAAA GGCGATACTT ATCTGACCCT TGCCTATAAA GCACCGGATG

   701  GCAGTCTGTA CACGACCGAT CGAGGATTTG ATTACAACGC CGGACGAATG

   751  AACTACCGCC CCGATTTAGA CAAGTACGAC CGTGCGTTGG CGCATCAATT

   801  TGCCAAAGCG GAAATGGGTG GTGCGGATTT TAAAACCAGC TTTAAACAGC

   851  TTGAAAAAGA GTTTTATGAA GTCAAGCAAC GTTTGGATAT TGATGGCAAG

   901  CCCGATAAAG AGCAGAAAAT CAAAATCCGA AATGCGCTAT CAAGACAGCT

   951  TAAATTTGCT GCGGGTGTAT TGAGCAAGGA AACGCAAGAA TTGGCAGGTA

  1001  TGACACGAGC GACGGTGTGG CTGTCTGATG ATACGTTGGT TAAACAGGTA

  1051  GACAGCCGTG AGGGGCAGAA TTTCGATGAC TCCTACTATG CTTTTTTGCC

  1101  GGATATGCTG CAAAACCCTG AACATGTCAT CCGCGACAAT CGTGAATTGA

  1151  TTTTCACAGC TCGCTATAAA GGCTCGGCAT TGTGGGCAGT TTTAAAATAT

  1201  ATTAAGGAGG TGGATGAGAT TTATCTACAG TCGTACCGAA TCAGTAACGA

  1251  CAAAGAGATT GCCAAATTTA TGGCGAAGAA GAAAGTATTG AAATAG
```

This corresponds to the amino acid sequence <SEQ ID 2390; ORF 711>:

```
m711.pep
    1  MPAPDLGFAL SLPPKKAIEW LESKKVTAES YRNLTASEIA KVYTIARMTD

   51  LDMLNDIKTS MVESAKSGQS FDDWRKGILN LLSNKGWLHP NGHNGKDIID

  101  PATGEVFGSP RRLETIYRTN MQTAYNAGQY QGYMANIDAR PYWMYDAVGD

  151  SRTRPAHSAI DGLVYRYDDP FWATFYPPNG YNCRCSVIAL SERDVERQGR

  201  IVGQSTADNL VETHKIYNKK GDTYLTLAYK APDGSLYTTD RGFDYNAGRM
```

-continued

```
251 NYRPDLDKYD RALAHQFAKA EMGGADFKTS FKQLEKEFYE VKQRLDIDGK

301 PDKEQKIKIR NALSRQLKFA AGVLSKETQE LAGMTRATVW LSDDTLVKQV

351 DSREGQNFDD SYYAFLPDML QNPEHVIRDN RELIFTARYK GSALWAVLKY

401 IKEVDEIYLQ SYRISNDKEI AKFMAKKKVL K*
```

The following partial DNA sequence was identified in *N. meningitidis* <SEQ ID 2391>:

```
a711.seq
   1 ATGCCCGCGC CTGATTTGGG ATTTGCCTTA AGTCTGCCGC CAAAAAAGGC

  51 AATCGAGTGG CTGGAAAGTA AAAAGGTTAC GGCGGAGAGC TACCGCAATC

 101 TGACAGCCTC CGAAATTGCC AAAGTCTATA CGATTGCCCG CATGACCGAC

 151 TTGGATATGC TCAACGACAT CAAAACTTCG ATGGTTGAAT CGGCAAAAAG

 201 TGGACAGTCG TTTGACGATT GGCGAAAAGG TATCTTGAAT CTGCTCAGCA

 251 ACAAGGGCTG GCTGCATCCG AACGGGCATA ACGGTAAGGA TATCATCGAC

 301 CCAGCCACCG GCGAGGTATT CGGTTCGCCG CGGAGGTTGG AGACGATTTA

 351 CCGTACCAAC ATGCAAACTG CCTACAACGC CGGTCAATAT CAAGGATATA

 401 TGGCAAATAT TGATGCACGA CCTTATTGGA TGTATGACGC GGTAGGCGAC

 451 AGCCGCACCC GTCCGGCGCA TTCGGCAATA GACGGGCTGG TGTACCGCTA

 501 CGACGACCCG TTTTGGGCAA CGTTTTACCC GCCCAACGGC TACAACTGCC

 551 GTTGCTCGGT CATCGCGCTG TCGGAGCGGG ATGTGGAACG CCAGGGGCGG

 601 ATTGTCGGGC AAAGCACGTC GGACAATCTT GTTGAGACCC ATAAAATCTA

 651 CAACAAAAAA GGCGATACTT ATCTGACCCT TGCCTATAAA GCACCGGATG

 701 GCAGTCTGTA CACGACCGAT CGAGGATTTG ATTACAACGC CGGACGAATG

 751 AACTACCGCC CCGATTTAGA CAAGTACGAC CGTGCGTTGG CGCATCAATT

 801 TGCCAAAGCG GAAATGGGTG GTGCGGATTT TAAAACCAGC TTTAAACAGC

 851 TTGAAAAAGA GTTTTATGAA GTCAAGCAAC GTTTGGATAT TGATGGCAAG

 901 CCCGATAAAG AGCAGAAAAT CAAAATCCGA AATGCGCTAT CAAGACAGCT

 951 TAAATTTGCT GCGGGTGTAT TGAGCAAGGA AACGCAAGAA TTGGCAGGTA

1001 TGACACGAGC GACGGTGTGG CTGTCTGATG ATACGTTGGT TAAACAGGTA

1051 GACAGCCGTG AAGGGCAGAA TTTCGATGAC TCCTACTATG CTTTTTTGCC

1101 GGATATGCTG CAAAACCCTG AACATGTCAT CCGCGACAAT CGTGAATTGA

1151 TTTTCACAGC TCGCTATAAA GGCTCGGCAT TGTGGGCAGT TTTAAAATAT

1201 ATTAAGGAGG TGGATGAGAT TTATCTACAG TCGTACCGAA TCAGTAACGA

1251 CAAAGAGATT GCCAAATTTA TGGCGAAGAA GAAAGTATTG AAATAG
```

This corresponds to the amino acid sequence <SEQ ID 2392; ORF 711.a>:

```
a711.pep
  1 MPAPDLGFAL SLPPKKAIEW LESKKVTAES YRNLTASEIA KVYTIARMTD

 51 LDMLNDIKTS MVESAKSGQS FDDWRKGILN LLSNKGWLHP NGHNGKDIID

101 PATGEVFGSP RRLETIYRTN MQTAYNAGQY QGYMANIDAR PYWMYDAVGD

151 SRTRPAHSAI DGLVYRYDDP FWATFYPPNG YNCRCSVIAL SERDVERQGR
```

-continued

```
201 IVGQSTSDNL VETHKIYNKK GDTYLTLAYK APDGSLYTTD RGFDYNAGRM

251 NYRPDLDKYD RALAHQFAKA EMGGADFKTS FKQLEKEFYE VKQRLDIDGK

301 PDKEQKIKIR NALSRQLKFA AGVLSKETQE LAGMTRATVW LSDDTLVKQV

351 DSREGQNFDD SYYAFLPDML QNPEHVIRDN RELIFTARYK GSALWAVLKY

401 IKEVDEIYLQ SYRISNDKEI AKFMAKKKVL K*
```

a711/m711 99.8% identity in 431 aa overlap

```
                    10        20        30        40        50        60
a711.pep    MPAPDLGFALSLPPKKAIEWLESKKVTAESYRNLTASEIAKVYTIARMTDLDMLNDIKTS
            ||||||||||||||||||||||||||||||||||||||||||||||||||||||||||||
m711        MPAPDLGFALSLPPKKAIEWLESKKVTAESYRNLTASEIAKVYTIARMTDLDMLNDIKTS
                    10        20        30        40        50        60

                    70        80        90       100       110       120
a711.pep    MVESAKSGQSFDDWRKGILNLLSNKGWLHPNGHNGKDIIDPATGEVFGSPRRLETIYRTN
            ||||||||||||||||||||||||||||||||||||||||||||||||||||||||||||
m711        MVESAKSGQSFDDWRKGILNLLSNKGWLHPNGHNGKDIIDPATGEVFGSPRRLETIYRTN
                    70        80        90       100       110       120

                   130       140       150       160       170       180
a711.pep    MQTAYNAGQYQGYMANIDARPYWMYDAVGDSRTRPAHSAIDGLVYRYDDPFWATFYPPNG
            ||||||||||||||||||||||||||||||||||||||||||||||||||||||||||||
m711        MQTAYNAGQYQGYMANIDARPYWMYDAVGDSRTRPAHSAIDGLVYRYDDPFWATFYPPNG
                   130       140       150       160       170       180

                   190       200       210       220       230       240
a711.pep    YNCRCSVIALSERDVERQGRIVGQSTSDNLVETHKIYNKKGDTYLTLAYKAPDGSLYTTD
            ||||||||||||||||||||||||||:|||||||||||||||||||||||||||||||||
m711        YNCRCSVIALSERDVERQGRIVGQSTADNLVETHKIYNKKGDTYLTLAYKAPDGSLYTTD
                   190       200       210       220       230       240

                   250       260       270       280       290       300
a711.pep    RGFDYNAGRMNYRPDLDKYDRALAHQFAKAEMGGADFKTSFKQLEKEFYEVKQRLDIDGK
            ||||||||||||||||||||||||||||||||||||||||||||||||||||||||||||
m711        RGFDYNAGRMNYRPDLDKYDRALAHQFAKAEMGGADFKTSFKQLEKEFYEVKQRLDIDGK
                   250       260       270       280       290       300

                   310       320       330       340       350       360
a711.pep    PDKEQKIKIRNALSRQLKFAAGVLSKETQELAGMTRATVWLSDDTLVKQVDSREGQNFDD
            ||||||||||||||||||||||||||||||||||||||||||||||||||||||||||||
m711        PDKEQKIKIRNALSRQLKFAAGVLSKETQELAGMTRATVWLSDDTLVKQVDSREGQNFDD
                   310       320       330       340       350       360

                   370       380       390       400       410       420
a711.pep    SYYAFLPDMLQNPEHVIRDNRELIFTARYKGSALWAVLKYIKEVDEIYLQSYRISNDKEI
            ||||||||||||||||||||||||||||||||||||||||||||||||||||||||||||
m711        SYYAFLPDMLQNPEHVIRDNRELIFTARYKGSALWAVLKYIKEVDEIYLQSYRISNDKEI
                   370       380       390       400       410       420

                   430
a711.pep    AKFMAKKKVLKX
            ||||||||||||
m711        AKFMAKKKVLKX
                   430

g712.seq    not found yet

g712.pep    not found yet
```

The following partial DNA sequence was identified in *N. meningitidis* <SEQ ID 2393>:

```
m712.seq
   1  ATGATGCCCC ATATTGATTT TGACACGATT CCGGGCAGCA TCCGCGTGCC

  51  CGGGCAGTAT ATTGAATTTA ACACCCGCAA TGCCGTACAA GGTTTGCCGC

 101  AAAATCCGCA AAAGGTATTG ATGGTTGCAC CCATGCTGAC CGCGGGCATA

 151  CAGACCGTCT TAGAGCCGGT GCAACTATTT AGCGATGCCG AGGCGGCCGA

 201  TTTGTTCGGA CAAGGCTCGC TGGCGCATTT GATGGTGCGC CAAGCATTTG

 251  CCAACAACCC TTATTTGGAT TTGACCGTTA TCGGTATTGC CGACCACAGC
```

-continued

```
 301 GCAGGCGTGC AGGCAACCGC AACCGTTACC CTTTCCGGCA CGGCCACCGC
 351 GCCGGGCGTG GTGGAAATCA CGATTGGCGG CAAGCAGGTA AGCACGGCCG
 401 TTAACACCGG CGAGACCGCC GCCACAGTGG CAGACCGTCT GAAAACCGCC
 451 ATCACTGCCG CCGATGTAAC CGTTACCGCA TCCGGCAGCG GCGCAGCCGT
 501 TACGCTGACG GCCAAACACA AAGGCGAGAT CGGCAACGAG AGCGGCTTAA
 551 CCGTGAGCAC CGGCAATACC GGCCTAACTT ATCAAGCCAA TGCCTTTACC
 601 GGCGGTGCCA AAAATGCGGA CATTGCCACG GCCTTGTCCA AAGTGGCGGG
 651 CAAGCATTAT CACATTATTT GCAGCCCGTT TAGCGATGAC GCCAACGCCA
 701 AAGCCTTGAG CAACCATATT ACCAACGTAT CCAACGCCAT CGAGCAGCGC
 751 GGCTGTATCG GCGTATTGGG TATGAGTGCG GCCTTGAGCA CGGCCACCAC
 801 CGCTACCGGC GAAATCAACG ACGGCCGCAT GACCTGTGCT TGGTACAAAG
 851 GTGCGGTAGA GCCAAACGGC ATCATCGCCG CAGGTTATGC GGCGGTGTTG
 901 GCCTTTGAAG AAGACCCTGC CAAGCCGCTG AACACGCTGG AAATCAAAGG
 951 GCTGGCCGTT ACACCTGATG CGCAATGGCC GCTGTTTGCA GAATGCAACA
1001 ATGCGCTGTA CAACGGCTTG ACCCCGCTCA CAGTGGTCAA CAACCGCGTG
1051 CAGATTATGC GTGCCGTATC CACCTATACC AAGTCGGCCA ACAACACCGA
1101 CGACCCGGCA CTACTCGACA TTACCACCAT CCGCACGCTG GATTATGTGC
1151 GCCGCAGCGT TAAAGAGCGC ATTGCCCTGC GTTTTCCGCG CGACAAATTG
1201 AGCGACCGCC TGCTGCCCAA GGTTAAGAGC GAGATTTTGG ACGTGCTGAT
1251 TAAGCTCGAC CAAGCCGAAA TCATCGAAAA CGCCGAGGCC AACAAAGGCA
1301 AGCTGGTGGT GGCGCGTGCG CAAAACGACC CCAACCGTGT TAATGCCATT
1351 ATCACTGCCG ATGTGGTCAA CGGCCTGCAC GTCTTTGCCG GGCGCATTGA
1401 TTTGATTTTG TAA
```

This corresponds to the amino acid sequence <SEQ ID 2394; ORF 712>:

```
m712.pep
  1 MMPHIDFDTI PGSIRVPGQY IEFNTRNAVQ GLPQNPQKVL MVAPMLTAGI
 51 QPALEPVQLF SDAEAADLFG QGSLAHLMVR QAFANNPYLD LTVIGIADHS
101 AGVQATATVT LSGTATAPGV VEITIGGKQV STAVNTGETA ATVADRLKTA
151 ITAADVTVTA SGSGAAVTLT AKHKGEIGNE SGLTVSTGNT GLTYQANAFT
201 GGAKNADIAT ALSKVAGKHY HIICSPFSDD ANAKALSNHI TNVSNAIEQR
251 GCIGVLGMSA ALSTATTATG EINDGRMTCA WYKGAVEPNG IIAAGYAAVL
301 AFEEDPAKPL NTLEIKGLAV TPDAQWPLFA ECNNALYNGL TPLTVVNNRV
351 QIMRAVSTYT KSANNTDDPA LLDITTIRTL DYVRRSVKER IALRFPRDKL
401 SDRLLPKVKS EILDVLIKLD QAEIIENAEA NKGKLVVARA QNDPNRVNAI
451 IPADVVNGLH VFAGRIDLIL *
```

a712.seq not found yet a712.pep not found yet g713.seq not found yet g713.pep not found yet The following partial DNA sequence was identified in *N. meningitidis* <SEQ ID 2395>:

```
m713.seq
   1  ATGCAAAATA ATTCATACGG CTATGCCGTG TCGGTGCGCG TGGGCGGTAA
  51  AGAGCACCGC CACTGGGAGC GCTACGACAT CGACAGCGAC TTTTTAATCC
 101  CTGCCGACAG CTTCGATTTT GTCATCGGCA GGTTGGGACC GGAGGCGGCC
 151  ATACCCGATT TAAGCGGAGA GAGCTGCGAG GTAGTGATAG ACGGGCAAAT
 201  CGTGATGACG GGCATCATCG GCAGCCAGCG CCACGGCAAA AGCAAGGGCA
 251  GCCGCGAGTT GAGCTTGAGC GGGCGTGATT TGGCCGGTTT TTTGGTGGAT
 301  TGCTCCGCGC CGCAGCTCAA TGTAAAGGGC ATGACGGTAT TGGATGCAGC
 351  CAAAAAGCTG GCCGCGCCGT GGCCGCAGAT TAAAGCGGTG GTGCTTAAGG
 401  CCGAAAACAA CCCCGCTTTG GGCAAAATCG ACATCGAGCC GGGCGAAACC
 451  GTATGGCAGG CATTAACCCA TATTGCCAAC TCGGTCGGGC TGCATCCGTG
 501  GCTGGAGCCG GACGGCACGT TGGTGGTGGG CGGTGCGGAT TACAGCAGCC
 551  CGCCGGTGGC GACATTGTGT TGGAGCCGCA CCGACAGCCG CTGCAATATC
 601  GAGCGCATGG ACATTGAGTG GGATACCGAC AACCGCTTTT CCGAGGTTAC
 651  TTTTTTGGCG CAATCGCACG GCCGCAGCGG CGACAGCGCC AAACACGATT
 701  TAAAGTGGGT GTACAAAGAC CCGACGATGA CGCTGCACCG CCCTAAAACG
 751  GTGGTGGTGT CCGATGCCGA CAATTTGGCC GCATTGCAAA AGCAGGCTAA
 801  AAAGCAGCTG GCCGACTGGC GGCTGGAGGG ATTTACACTC ACGATAACCG
 851  TGGGCGGCCA TAAAACCCGC GACGGCGTAT TGTGGCAACC TGGCCTGCGT
 901  GTGCATGTGA TCGACGACGA GCACGGTATC GATGCGGTGT TTTTTCTGAT
 951  GGGGCGGCGG TTTATGCTAT CCCGCATGGA TGGTACGCAA ACCGAGCTGC
1001  GGCTCAAAGA GGACGGTATT TGGACACCCG ACGCTTACCC CAAAAAGGCC
1051  GAGGCGGCGC GCAAGCGCAA AGGCAAACGC AAAGGCGTGA GCCATAAGGG
1101  CAAAAAAGGC GGCAAAAAAC AAGCAGAAAC GGCGGTGTTT GAATGA
```

This corresponds to the amino acid sequence <SEQ ID 2396; ORF 713>:

```
m713.pep
  1 MQNNSYGYAV SVRVGGKEHR HWERYDIDSD FLIPADSFDF VIGRLGPEAA
 51 IPDLSGESCE VVIDGQIVMT GIIGSQRHGK SKGSRELSLS GRDLAGFLVD
101 CSAPQLNVKG MTVLDAAKKL AAPWPQIKAV VLKAENNPAL GKIDIEPGET
151 VWQALTHIAN SVGLHPWLEP DGTLVVGGAD YSSPPVATLC WSRTDSRCNI
201 ERMDIEWDTD NRFSEVTFLA QSHGRSGDSA KHDLKWVYKD PTMTLHRPKT
251 VVVSDADNLA ALQKQAKKQL ADWRLEGFTL TITVGGHKTR DGVLWQPGLR
301 VHVIDDEHGI DAVFFLMGRR FMLSRMDGTQ TELRLKEDGI WTPDAYPKKA
351 EAARKRKGKR KGVSHKGKKG GKKQAETAVF E*
```

The following partial DNA sequence was identified in *N. meningitidis* <SEQ ID 2397>:

```
a713.seq
  1   ATGCAAAATA ATTCATACGG CTATGCCGTG TCGGTGCGCG TGGGCGGTAA
```

```
 51 AGAGCACCGC CACTGGGAGC GCTACGACAT CGACAGCGAC TTTTTAATCC

101 CTGCCGACAG CTTCGATTTT GTCATCGGCA GGTTGGGGCC GGAGGCGGCC

151 ATACCCGATT TAAGCGGAGA GAGCTGCGAG GTAGTGATAG ACGGGCAAAT

201 CGTGATGACG GGCATCATCG GCAGCCAGCG CCACGGCAAA AGCAAGGGCG

251 GCCGCGAGTT GAGCTTGAGC GGGCGTGATT TGGCCGGTTT TTTGGTGGAT

301 TGCTCCGCGC CGCAGCTCAA TGTAAAGGGC ATGACGGTAT TGGATGCAGC

351 CAAAAAGCTG GCCGCGCCGT GGCCGCAGAT TAAAGCGGTG GTGCTTAAGG

401 TCGAAAACAA CCCCGCTTTG GACAAAATCG ACATCGAGCC GGGCGAAACC

451 GTATGGCAGG CATTAACCCA TATTGCCAAC TCGGTCGGGC TGCATCCGTG

501 GCTGGAGCCG GACGGCACGT TGGTGGTGGG CGGTGTGGAT TACAGCAGCC

551 CGCCGGTGGC GACATTGTGT TGGAGCCGCA CCGACAGCCG CCGCAATATC

601 GAGCGCATGG ACATTGAGTG GGATACCGAC AACCGCTTTT CTGAGGTTAC

651 TTTTTTGGCG CAATCGCACG GCCGCAGCGG CGACAGCGCC AAACACGATT

701 TAAAGTGGGT GTACAAAGAC CCGACGATGA CGCTGCACCG CCCTAAAACG

751 GTGGTGGTGT CCGATGCCGA CAATTTGGCC GCATTGCAAA AGCAGGCTAA

801 AAAGCAGCTG GCCGACTGGC GGCTGGAGGG ATTTACACTC ACGATAACCG

851 TGGGCGGCCA TAAAACCCGC GACGGCGTAT TGTGGCAACC TGGCCAGCGT

901 GTGCATGTGA TCGACGACGA GCACGGTATC GATGCGGTGT TTTTTCTGAT

951 GGGGCGGCGG TTTATGCTAT CTCGCATGGA TGGCACGCAA ACCGAGCTGC

1001 GGCTCAAAGA GGACGGTATT TGGACACCCG ACGCTTACCC CAAAAAGGCC

1051 GAGGCGGCGC GCAAGCGCAA AGGCAAACGC AAAGGCGTGA GCCATAAGGG

1101 CAAAAAAGGC GGCAAAAAAC AAGCAGAAAC GGCGGTGTTT GAATGA
```

This corresponds to the amino acid sequence <SEQ ID 2398; ORF 713.a>:

```
a713.pep
  1 MQNNSYGYAV SVRVGGKEHR HWERYDIDSD FLIPADSFDF VIGRLGPEAA

 51 IPDLSGESCE VVIDGQIVMT GIIGSQRHGK SKGGRELSLS GRDLAGFLVD

101 CSAPQLNVKG MTVLDAAKKL AAPWPQIKAV VLKVENNPAL DKIDIEPGET

151 VWQALTHIAN SVGLHPWLEP DGTLVVGGVD YSSPPVATLC WSRTDSRRNI

201 ERMDIEWDTD NRFSEVTFLA QSHGRSGDSA KHDLKWVYKD PTMTLHRPKT

251 VVVSDADNLA ALQKQAKKQL ADWRLEGFTL TITVGGHKTR DGVLWQPGQR

301 VHVIDDEHGI DAVFFLMGRR FMLSRMDGTQ TELRLKEDGI WTPDAYPKKA

351 EAARKRKGKR KGVSHKGKKG GKKQAETAVF E*
```

a713/m713 98.4% identity in 381 aa overlap

```
                 10         20         30         40         50         60
   a731.pep  MQNNSYGYAVSVRVGGKEHRHWERYDIDSDFLIPADSFDFVIGRLGPEAAIPDLSGESCE
             ||||||||||||||||||||||||||||||||||||||||||||||||||||||||||||
   m713      MQNNSYGYAVSVRVGGKEHRHWERYDIDSDFLIPADSFDFVIGRLGPEAAIPDLSGESCE
                 10         20         30         40         50         60

                 70         80         90        100        110        120
   a713.pep  VVIDGQIVMTGIIGSQRHGKSKGGRELSLSGRDLAGFLVDCSAPQLNVKGMTVLDAAKKL
             |||||||||||||||||||||||:||||||||||||||||||||||||||||||||||||
   m713      VVIDGQIVMTGIIGSQRHGKSKGSRELSLSGRDLAGFLVDCSAPQLNVKGMTVLKAAKKL
                 70         80         90        100        110        120
```

-continued

```
                 130       140       150       160       170       180
a713.pep  AAPWPQIKAVVLKVENNPALDKIDIEPGETVWQALTHIANSVGLHPWLEPDGTLVVGGVD
          |||||||||||||:|||||| |||||||||||||||||||||||||||||||||||||||:|
m713      AAPWPQIKAVVLKAENNPALGKIDIEPGETVWQALTHIANSVGLHPWLEPDGTLVVGGAD
                 130       140       150       160       170       180

                 190       200       210       220       230       240
a713.pep  YSSPPVATLCWSRTDSRRNIERMDIEWDTDNRFSEVTFLAQSHGRSGDSAKHDLKWVYKD
          |||||||||||||||||| ||||||||||||||||||||||||||||||||||||||||||
m713      YSSPPVATLCWSRTDSRCNIERMDIEWDTDNRFSEVTFLAQSHGRSGDSAKHDLKWVYKD
                 190       200       210       220       230       240

                 250       260       270       280       290       300
a713.pep  PTMTLHRPKTVVVSDADNLAALQKQAKKQLADWRLEGFTLTITVGGHKTRDGVLWQPGQR
          ||||||||||||||||||||||||||||||||||||||||||||||||||||||||||| |
m713      PTMTLHRPKTVVVSDADNLAALQKQAKKQLADWRLEGFTLTITVGGHKTRDGVLWQPGLR
                 250       260       270       280       290       300

                 310       320       330       340       350       360
a713.pep  VHVIDDEHGIDAVFFLMGRRFMLSRMDGTQTELRLKEDGIWTPDAYPKKAEAARKRKGKR
          |||||||||||||||||||||||||||||||||||||||||||||||||||||||||||||
m713      VHVIDDEHGIDAVFFLMGRRFMLSRMDGTQTELRLKEDGIWTPDAYPKKAEAARKRKGKR
                 310       320       330       340       350       360

                 370       380
a713.pep  KGVSHKGKKGGKKQAETAVFEX
          ||||||||||||||||||||||
m713      KGVSHKGKKGGKKQAETAVFEX
                 370       380

g714.seq not found yet

g714.pep not found yet
```

The following partial DNA sequence was identified in *N. meningitidis* <SEQ ID 2399>:

```
m714.seq
   1 ATGAGCTATC AAGACATCTT GCGGGGCCTG TTGCCCCCCG TGTCGTATGC

  51 CCGCAATGCC CCGCGTGTGC GGGCGCAGGC AGAAATAGAC GGCGCAGCGC

 101 TGGATGCGGT GGCGGAATCG GCTCAAAGCG TTGCCGATGC CGTCGACCCG

 151 CGCAGCGCCG GCCAAATGCT GGCCGATTGG GAGCGCGTAT TAGGTTTGGA

 201 CGGTACGGGC AAAAACCGCC AGCACCGTGT GTTGGCCGTC ATGGCCAAGC

 251 TAAACGAAAC AGGCGGCTTG AGTATTCCTT ATTTTGTGCG TTTGGCCGAG

 301 GCGGCGGGCT ATCAAATCCA AATCGACGAA CCGCAGCCGT TCCGCGCCGG

 351 TGTAAACCGC GCCGGCGACC GTCTTGCGCC GCAGGAAATC ATGTGGGTGT

 401 GGCACGTTAA CGTGCGCGGC GGCAACAACC GCATTACCCG ATTCCGCGCC

 451 GGTATCTCGG CGGCGGGCGA CAGGCTGACC GATTACAGCG ATGCCGTGAT

 501 CGAGAGCCTG TTCAACCGCC TCAAGCCCGC CCACACCGCT ATCCGATTTA

 551 CCTACCGCTA A
```

This corresponds to the amino acid sequence <SEQ ID 2400; ORF 714>:

```
m714.pep
   1 MSYQDILRGL LPPVSYARNA PRVRAQAEID GAALDAVAES AQSVADAVDP

  51 RSAGQMLADW ERVLGLDGTG KNRQHRVLAV MAKLNETGGL SIPYFVRLAE

 101 AAGYQIQIDE PQPFRAGVNR AGDRLAPQEI MWVWHVNVRG GNNRITRFRA

 151 GISAAGDRLT DYSDAVIESL FNRLKPAHTA IRFTYR*
```

The following partial DNA sequence was identified in *N. meningitidis* <SEQ ID 2401>:

```
a714.seq
   1 ATGAGCTATC AAGACATCTT GCGGGGTCTG TTGCCCCCCG TGTCGTATGC

  51 CCGCAATGCC CCGCGTGTGC GGGCGCAGGC AGAAATAGAC GGCGCAGCGC

 101 TGGATGCGGT GGCGGAATCG GCTCAAAGCG TTGCCGATGC CGTCGACCCG

 151 AGCAGCGCCG GCCAAATGCT GGCCGATTGG GAGCGCGTAT TAGGTTTGGA

 201 CGGTACGGGC AAAAACCGCC AGCGCCGTGT GTTGGCCGTC ATGGCCAAGC

 251 TAAACGAAAC AGGCGGCTTG AGTATTCCTT ATTTTGTGCG TTTGGCCGAG

 301 GCGGCGGGCT ATCAAATCCA AATCGACGAA CCGCAGCCGT TCCGCGCCGG

 351 TGTAAACCGC GCCGGCGACC GTCTTGCGCC GCAGGAAATC ATGTGGGTGT

 401 GGCACGTTAA CGTGCGCGGC GGCAACAACC GCATTACCCG ATTCCGCGCC

 451 GGTATCTCGG CGGCGGGCGA CAGGCTGACC GATTACAGCG ATGCCGTGAT

 501 CGAGAGCCTG TTCAACCGCC TCAAGCCCGC CCACACCGCT ATCCGATTTA

 551 CCTACCGATA A
```

This corresponds to the amino acid sequence <SEQ ID 2402; ORF 714.a>:

```
a714.pep
   1 MSYQDILRGL LPPVSYARNA PRVRAQAEID GAALDAVAES AQSVADAVDP

  51 SSAGQMLADW ERVLGLDGTG KNRQRRVLAV MAKLNETGGL SIPYFVRLAE

 101 AAGYQIQIDE PQPFRAGVNR AGDRLAPQEI MWVWHVNVRG GNNRITRFRA

 151 GISAAGDRLT DYSDAVIESL FNRLKPAHTA IRFTYR*
```

a714/m714 98.9% identity in 186 aa overlap

```
                    10        20        30        40        50        60
a714.pep    MSYQDILRGLLPPVSYARNAPRVRAQAEIDGAALDAVAESAQSVADAVDPSSAGQMLADW
            |||||||||||||||||||||||||||||||||||||||||||||||||| |||||||||
m714        MSYQDILRGLLPPVSYARNAPRVRAQAEIDGAALDAVAESAQSVADAVDPRSAGQMLADW
                    10        20        30        40        50        60

                    70        80        90       100       110       120
a714.pep    ERVLGLDGTGKNRQRRVLAVMAKLNETGGLSIPYFVRLAEAAGYQIQIDEPQPFRAGVNR
            ||||||||||||||:|||||||||||||||||||||||||||||||||||||||||||||
m714        ERVLGLDGTGKNRQHRVLAVMAKLNETGGLSIPYFVRLAEAAGYQIQIDEPQPFRAGVNR
                    70        80        90       100       110       120

                   130       140       150       160       170       180
a714.pep    AGDRLAPQEIMWVWHVNVRGGNNRITRFRAGISAAGDRLTDYSDAVIESLFNRLKPAHTA
            ||||||||||||||||||||||||||||||||||||||||||||||||||||||||||||
m714        AGDRLAPQEIMWVWHVNVRGGNNRITRFRAGISAAGDRLTDYSDAVIESLFNRLKPAHTA
                   130       140       150       160       170       180

a714.pep    IRFTYRX
            |||||||
m714        IRFTYRX

g715.seq    not found yet

g715.pep    not found yet
```

The following partial DNA sequence was identified in *N. meningitidis* <SEQ ID 2403>:

```
m715.seq
   1 ATGATTGATG TCAAAATAGA CAATATCTTT GTCGTCCTAA ACCAAATCGA

  51 GCGGCTTGGC AACGGGATCG AAAACCGCTA CCTGCTGATG CGCCGACTGT

 101 CCGAAACCAT GCACACGGCG GTCAAGCTCA ATTTCCGCTA CGCAGGCCGT
```

-continued

```
151 CCGAAATGGG TTGGGCTAAA ATACCGCGAC GGCAAGCCGC TTTCGGATTC

201 GGGTCGTCTG AAAGACAGTT TTTCCACACT GTCAGACAAC GATACAGCCC

251 TTGTCGGTAC GAATATCGTC TATGCCGCCA TCCACAACTT CGGCGGTATG

301 GCGGGGCGCA ACCGCAAAGT TCGGATTCCG CAACGGGAAT TTTGACGCT

351 GACGGACGAC GACAAACAGG CTTTGATGGA CGATGTGCAG GATTATTTTT

401 CGGGTCTGAT ACCGTGA
```

This corresponds to the amino acid sequence <SEQ ID 2404; ORF 715>:

```
m715.pep
   1 MIDVKIDNIF VVLNQIERLG NGIENRYLLM RRLSETMHTA VKLNFRYAGR

  51 PKWVGLKYRD GKPLSDSGRL KDSFSTLSDN DTALVGTNIV YAAIHNFGGM

 101 AGRNRKVRIP QREFLTLTDD DKQALMDDVQ DYFSGLIP*

   :
```

The following partial DNA sequence was identified in *N. meningitidis* <SEQ ID 2405>:

```
a715.seq
   1 ATGATTGATG TCAAAATAGA CAATATCTTT GTCGTCCTAA ACCAAATCGA

  51 GCGGCTTGGC AACGGGATCG AAAACCGCTA CCTGCTGATG CGCCGACTGT

 101 CCGAAACCAT GCACACGGCG GTCAAGCTCA ATTTCCGCTA CGCAGGCCGT

 151 CCGAAATGGT TGGGGCTAAA ATACCGCGAC GGCAAGCCGC TTTCGGATTC

 201 GGGTCGTCTG AAAGACAGTT TTTCCACACT GTCAGACAAC GATACAGCCC

 251 TTGTCGGTAC GAATATCGTC TATGCCGCCA TCCACAACTT CGGCGGTATG

 301 GCGGGGCGCA ACCGCAAAGT TCGGATTCCG CAACGGGAAT TTTGACGCT

 351 GACGGACGAC GACAAACAGG CTTTGATGGA CGATGTGCAG GATTATTTTT

 451 CGGGTCTGAT ACCGTGA
```

This corresponds to the amino acid sequence <SEQ ID 2406; ORF 715.a>

```
a715.pep
   1 MIDVKIDNIF VVLNQIERLG NGIENRYLLM RRLSETMHTA VKLNFRYAGR

  51 PKWLGLKYRD GKPLSDSGRL KDSFSTLSDN DTALVGTNIV YAAIHNFGGM

 101 AGRNRKVRIP QREFLTLTDD DKQALMDDVQ DYFSGLIP*
```

The following partial DNA sequence was identified in *N. gonorrhoeae* <SEQ ID 2407>:

```
g716.seq
   1 ATGAACAAAA ATATTGCTGC CGCACTCGCC GGTGCTTTAT CCCTGTCTCT

  51 GGCCGCCGGC GCCGTTGCCG CCCACAAACC GGCAAGCAAC GCAACAGGCG

 101 TTCAAAAATC CGCCCAAGGC TCTTGCGGCG CATCCAAATC TGCCGAAGGT

 151 TCGTGCGGCG CATCCAAATC TGCCGAAGGT TCGTGCGGCG CGGCTGCTTC

 201 TAAAGCAGGC GAAGGCAAAT GCGGCGAGGG CAAATGCGGT GCAACTGTAA

 251 AAAAAGCCCA CAAACACACC AAAGCATCTA AAGCCAAAGC CAAATCTGCC
```

-continued

```
301 GAAGGCAAAT GCGGCGAAGG CAAATGCGGT TCTAAATAA
```

This corresponds to the amino acid sequence <SEQ ID 2408; ORF 716.ng>:

```
g716.pep
   1 MNKNIAAALA GALSLSLAAG AVAAHKPASN ATGVQKSAQG SCGASKSAEG

  51 SCGASKSAEG SCGAAASKAG EGKCGEGKCG ATVKKAHKHT KASKAKAKSA

 101 EGKCGEGKCG SK*
```

The following partial DNA sequence was identified in *N. meningitidis* <SEQ ID 2409>:

```
m716.seq
   1 ATGAACAAAA ACATTGCTGC CGCTCTCGCC GGTGCTTTAT CCCTGTCTTT

  51 GGCCGCCGGT GCAGTTGCTG CCAACAAACC GGCAAGCAAC GCAACAGGCG

 101 TTCATAAATC CGCCCATGGC TCTTGCGGCG CGTCCAAATC TGCCGAAGGT

 151 TCGTGCGGCG CGGCTGGTTC TAAAGCAGGC GAAGGCAAAT GCGGCGAGGG

 201 CAAATGCGGT GCGACCGTAA AAAAAACCCA CAAACACACC AAAGCATCTA

 251 AAGCCAAGGC CAAATCTGCC GAAGGCAAAT GCGGCGAAGG CAAATGCGGT

 301 TCTAAATAA
```

This corresponds to the amino acid sequence <SEQ ID 2410; ORF 716>:

```
m716.pep

       1    MNKNIAAALA GALSLSLAAG AVAANKPASN ATGVHKSAHG SCGASKSAEG

      51    SCGAAGSKAG EGKCGEGKCG ATVKKTHKHT KASKAKAKSA EGKCGEGKCG

     101    SK*

m716/g716  86.6% identity in 112 aa overlap

                   10         20         30         40         50
m716.pep    MNKNIAAALAGALSLSLAAGAVAANKPASNATGVHKSAHGSCGASKSAEGSCGA------
            ||||||||||||||||||||||||:|||||||||:|||:||||||||||||||
g716        MNKNIAAALAGALSLSLAAGAVAAHKPASNATGVQKSAQGSCGASKSAEGSCGASKSAEG
                   10         20         30         40         50         60

                   60         70         80         90        100
m716.pep    ----AGSKAGEGKCGEGKCGATVKKTHKHTKASKAKAKSAEGKCGEGKCGSKX
                |:||||||||||||||||||:||||||||||||| ||||||||||||
g716        SCGAAASKAGEGKCGEGKCGATVKKAHKHTKASKAKAKSAEGKCGECKCGSKX
                   70         80         90        100        110
```

The following partial DNA sequence was identified in *N. meningitidis* <SEQ ID 2411>:

```
a716.seq
   1 ATGAACAAAA ACATTGCTGC CGCACTCGCC GGTGCTTTAT CCCTGTCTTT

  51 GGCCGCCGGT GCAGTTGCTG CCAACAAACC GGCAAGCAAC GCAACAGGCG

 101 TTCATAAATC CGCCCATGGC TCTTGCGGCG CGTCCAAATC TGCCGAAGGT

 151 TCGTGCGGCG CGGCTGGTTC TAAAGCAGGC GAAGGCAAAT GCGGCGAGGG

 201 CAAATGCGGT GCGACCGTAA AAAAAACCCA CAAACACACC AAAGCATCTA

 251 AAGCCAAGGC CAAATCTGCC GAAGGCAAAT GCGGCGAAGG CAAATGCGGT
```

-continued

```
301 TCTAAATAA
```

The following partial DNA sequence was identified in *N. meningitidis* <SEQ ID 2412.a>:

```
a716.pep
  1 MNKNIAAALA GALSLSLAAG AVAANKPASN ATGVHKSAHG SCGASKSAEG

 51 SCGAAGSKAG EGKCGEGKCG ATVKKTHKHT KASKAKAKSA EGKCGEGKCG

101 SK*
```

a716/m716 100.0% identity in 102 aa overlap

```
                 10        20        30        40        50        60
a716.pep MNKNIAAALAGALSLSLAAGAVAANKPASNATGVHKSAHGSCGASKSAEGSCGAAGSKAG
         ||||||||||||||||||||||||||||||||||||||||||||||||||||||||||||
m716     MNKNIAAALAGALSLSLAAGAVAANKPASNATGVHKSAHGSCGASKSAEGSCGAAGSKAG
                 10        20        30        40        50        60

                 70        80        90       100
a716.pep EGKCGEGKCGATVKKTHKHTKASKAKAKSAEGKCGEGKCGSKX
         ||||||||||||||||||||||||||||||||||||||||||
m716     EGKCGEGKCGATVKKTHKHTKASKAKAKSAEGKCGEGKCGSKX
                 70        80        90       100
```

The following partial DNA sequence was identified in *N. gonorrhoeae* <SEQ ID 2413>:

```
g717.seq
    1 ATGGACACAA AAGAAATCCT CGGCTACGCG GCAGGCTCGA TCGGCAGCGC

   51 GGTTTTAGCC GTCATCATCC TGCCGCTGCT GTCGTGGTAT TTCcccgCCG

  101 ACGACATCGG GCGCATCGTG CTGATGCAGA CGGCGGCGGG ACTGACGGTG

  151 TCGGTATTGT GCCTCGGGCT GGATCAGGCA TACGTCCGCG AATACTATGC

  201 CGCCGCCGAC AAAGACACTT TGTTCAAAAC CCTGTTCCTG CCGCCGCTGC

  251 TGTTTTCCGC CGCGATAGCC GCCCTGCTGC TTTCCCGCCC GTCCCTGCCG

  301 TCTGAAATCC TGTTTTCGCT CGACGATGCC GCCGCCGGCA TCGGGCTGGT

  351 GCTGTTTGAA CTGAGCTTCC TGCCCATCCG CTTTCTCTTA CTGGTTTTGC

  401 GTATGGAAGG GCGCGCCCTT GCCTTTTCGT CCGCGCAACT CGTGCCCAAA

  451 CTCGCCATTC TGCTGCTGTT GCCGCTGACG GTCGGGCTGC TGCACTTTCC

  501 GGCGAACACC TCCGTCCTGA CCGCCGTTTA CGCGCTGGCA AACCTTGCCG

  551 CCGCCGCCTT TTTGCTGTTT CAAAACCGAT GCCGTCTGAA GGCCGTCCGG

  601 CGCGCGCCGT TTTCGCCCGC CGTCCTGCAC CGGGGGCTGC GCTACGGCAT

  651 ACCGCTCGCA CTGAGCAGCC TTGCCTATTG GGGGCTGGCA TCCGCCGACC

  701 GTTTGTTCCT GAAAAAATAT GCGGGCCTGG AACAGCTCGG CGTTTATTCG

  751 ATGGGTATTT CGTTCGGCGG GGCGGCATTA TTGCTCCAAA GCATCTTTTC

  801 AACGGTCTGG ACACCGTATA TTTTCCGTGC AATCGAAGAA AACGCCACGC

  851 CCGCCCGCCT CTCGGCAACG GCAGAATCCG CCGCCGCCCT GCTTGCCTCC

  901 GCCCTCTGCC TGACCGGAAT TTTCTCGCCC CTCGCCTCCC TCCTGCTGCC

  951 GGAAAACTAC GCCGCCGTCC GGTTTACCGT CGTATCGTGT ATGCTGccgc

 1001 cgctGTTTTA CACGCTGACC GAAATCAGCG GCATCGGTTT GAACGTCGTC

 1051 CGCAAAACGC GTCCGATCGC GCTTGCCACC TTGGGCGCGC TGGCGGCAAA
```

-continued

```
1101 CCTGCTGCTG CTGGGGCTTG CCGTACCGTC CGGCGGCACG CGCGGCGCGG

1151 CGGTTGCCTG TGCCGCCTCA TTCTGGTTGT TTTTTGTTTT CAAGACAGAA

1201 AGCTCCTGCC GCCTGTGGCA GCCGCTCAAA CGCCTGCCGC TTTATATGCA

1251 CACATTGTTC TGCCTgGCCT CCTCGGCGGC CTACACCTGC TTCGGCACAC

1301 CGGCAAACTA CCCcctgttt gccggcgtAT GGGCGGCATA TCTGGCAGGC

1351 TGCATCCTGC GCCACCGGAA AAATTTGCAC AAACTGTTTC ATTATTTGAA

1401 AAAACAAGGT TTCCCATTAT GA
```

This corresponds to the amino acid sequence <SEQ ID 2414; ORF 717.ng>:

```
g717.pep
  1 MDTKEILGYA AGSIGSAVLA VIILPLLSWY FPADDIGRIV LMQTAAGLTV

 51 SVLCLGLDQA YVREYYAAAD KDTLFKTLFL PPLLFSAAIA ALLLSRPSLP

101 SEILFSLDDA AAGIGLVLFE LSFLPIRFLL LVLRMEGRAL AFSSAQLVPK

151 LAILLLLPLT VGLLHFPANT SVLTAVYALA NLAAAAFLLF QNRCRLKAVR

201 RAPFSPAVLH RGLRYGIPLA LSSLAYWGLA SADRLFLKKY AGLEQLGVYS

251 MGISFGGAAL LLQSIFSTVW TPYIFRAIEE NATPARLSAT AESAAALLAS

301 ALCLTGIFSP LASLLLPENY AAVRFTVVSC MLPPLFYTLT EISGIGLNVV

351 RKTRPIALAT LGALAANLLL LGLAVPSGGT RGAAVACAAS FWLFFVFKTE

401 SSCRLWQPLK RLPLYMHTLF CLASSAAYTC FGTPANYPLF AGVWAAYLAG

451 CILRHRKNLH KLFHYLKKQG FPL*
```

The following partial DNA sequence was identified in *N. meningitidis* <SEQ ID 2415>:

```
m717.seq
  1 ATGGACACAA AAGAAATCCT CGGCTACGCG GCAGGCTCGA TCGGCAGCGC

 51 GGTTTTAGCC GTCATCATCC TGCCGCTGCT GTCGTGGTAT TTCCCCGCCG

101 ACGACATCGG GCGCATCGTG CTGATGCAGA CGGCGGCGGG GCTGACGGTG

151 TCGGTGTTGT GCCTCGGGCT GGATCAGGCA TACGTCCGCG AATACTATGC

201 CACCGCCGAC AAAGACACCT TGTTCAAAAC CCTGTTCCTG CCGCCGCTGC

251 TGTCTGCCGC CGCGATAGCC GCCCTGCTGC TTTCCCGCCC GTCCCTGCCG

301 TCTGAAATCC TGTTTTCACT CGACGATGCC GCCGCCGGCA TCGGGCTGGT

351 GCTGTTTGAA CTGAGCTTCC TGCCCATCCG CTTTCTCTTA CTGGTTTTGC

401 GTATGGAAGG ACGCGCCCTT GCCTTTTCGT CCGCGCAACT CGTGCCCAAG

451 CTCGCCATCC TGCTGCTGCT GCCGCTGACG GTCGGGCTGC TGCACTTTCC

501 AGCGAACACC GCCGTCCTGA CCGCCGTTTA CGCGCTGGCA AACCTTGCCG

551 CCGCCGCCTT TTTGCTGTTT CAAAACCGAT GCCGTCTGAA GGCCGTCCGG

601 CACGCACCGT TTTCGCCCGC CGTCCTGCAC CGGGGGCTGC GCTACGGCAT

651 ACCGATCGCA CTGAGCAGCA TCGCCTATTG GGGGCTGGCA TCCGCCGACC

701 GTTTGTTCCT GAAAAAATAT GCCGGCCTGG AACAGCTCGG CGTTTATTCG

751 ATGGGTATTT CGTTCGGCGG GGCGGCATTA TTGTTCCAAA GCATCTTTTC

801 AACGGTCTGG ACACCGTATA TTTTCCGCGC AATCGAAGAA AACGCCCCGC
```

-continued

```
 851 CCGCCCGCCT CTCGGCAACG GCAGAATCCG CCGCCGCCCT GCTTGCCTCC

 901 GCCCTCTGCC TGACCGGCAT TTTCTCGCCC CTTGCCTCCC TCCTGCTGCC

 951 GGAAAACTAC GCCGCCGTCC GGTTTATCGT CGTATCGTGT ATGCTGCCGC

1001 CGCTGTTTTG CACGCTGGCG GAAATCAGCG GCATCGGTTT GAACGTCGTC

1051 CGCAAAACGC GCCCGATCGC GCTCGCCACC TTGGGCGCGC TGGCGGCAAA

1101 CCTGCTGCTG CTGGGGCTTG CCGTGCCGTC CGGCGGCGCG CGCGGCGCGG

1151 CGGTTGCCTG TGCCGCCTCA TTCTGGCTGT TTTTTGCCTT CAAGACCGAA

1201 AGCTCCTGCC GCCTGTGGCA GCCGCTCAAA CGCCTGCCGC TTTATCTGCA

1251 CACATTGTTC TGCCTGACCT CCTCGGCGGC CTACACCTGC TTCGGCACGC

1301 CGGCAAACTA TCCCCTGTTT GCCGGCGTAT GGGCGGCATA TCTGGCAGGC

1351 TGCATCCTGC GCCACCGGAA AGATTTGCAC AAACTGTTTC ATTATTTGAA

1401 AAAACAAGGT TTCCCATTAT GA
```

This corresponds to the amino acid sequence <SEQ ID 2416; ORF 717>:

```
m717.pep

  1  MDRKEILGYA AGSIGSAVLA VIILPLLSWY FPADDIGRIV LMQTAAGLTV

 51  SVLCLGLDQA YVREYYATAD KDTLFKTLFL PPLLSAAAIA ALLLSRPSLP

101  SEILFSLDDA AAGIGLVLFE LSFLPQRFLL LVLRMEGRAL AFSSAQLVPK

151  LAILLLLPLT VGLLHFPANT AVLTAVYALA NLAAAAFLLF QNRCRLKAVR

201  HAPFSPAVLH RGLRYGIPIA LSSIAYWGLA SADRLFLKKY AGLEQLGVYS

251  MGISFGGAAL LFQSIFSTVW TPYIFRAIEE NAPPARLSAT AESAAALLAS

301  ALCLTGIFSP LASLLLPENY AAVRFIVVSC MLPPLFCTLA EISGIGLNVV

351  RKTRPIALAT LGALAANLLL LGLAVPSGGA RGAAVACAAS FWLFFAFKTE

401  SSCRLWQPLK RLPLYLHTLE CLTSSAAYTC FGTPANYPLF AGVWAAYLAG

451  CILRHRKDLH KLFHYLKKQG FPL*
```

m717/g717 96.4% identity in 473 aa overlap

```
                   10        20        30        40        50        60
m717.pep   MDTKEILGYAAGSIGSAVLAVIILPLLSWYFPADDIGRIVLMQTAAGLTVSVLCLGLDQA
           ||||||||||||||||||||||||||||||||||||||||||||||||||||||||||||
g717       MDTKEILGYAAGSIGSAVLAVIILPLLSWYFPADDIGRIVLMQTAAGLTVSVLCLGLDQA
                   10        20        30        40        50        60

                   70        80        90       100       110       120
m717.pep   YVREYYATADKDTLFKTLFLPPLLSAAAIAALLLSRPSLPSEILFSLDDAAAGIGLVLFE
           |||||||:|||||||||||||||| :||||||||||||||||||||||||||||||||||
g717       YVREYYAAADKDTLFKTLFLPPLLFSAAIAALLLSRPSLPSEILFSLDDAAAGIGLVLFE
                   70        80        90       100       110       120

                  130       140       150       160       170       180
m717.pep   LSFLPIRFLLLVLRMEGRALAFSSAQLVPKLAILLLLPLTVGLLHFPANTAVLTAVYALA
           ||||||||||||||||||||||||||||||||||||||||||||||||||:|||||||||
g717       LSFLPIRFLLLVLRMEGRALAFSSAQLVPKLAILLLLPLTVGLLHFPANTSVLTAVYALA
                  130       140       150       160       170       180

                  190       200       210       220       230       240
m717.pep   NLAAAAFLLFQNRCRLKAVRHAPFSPAVLHRGLRYGIPIALSSIAYWGLASADRLFLKKY
           ||||||||||||||||||||:|||||||||||||||||:||||:||||||||||||||||
g717       NLAAAAFLLFQNRCRLKAVRRAPFSPAVLHRGLRYGIPLALSSLAYWGLASADRLFLKKY
                  190       200       210       220       230       240

                  250       260       270       280       290       300
m717.pep   AGLEQLGVYSMGISFGGAALLFQSIFSTVWTPYIFRAIEENAPPARLSATAESAAALLAS
           |||||||||||||||||||||:|||||||||||||||||||| |||||||||||||||||
g717       AGLEQLGVYSMGISFGGAALLLQSIFSTVWTPYIFRAIEENATPARLSATAESAAALLAS
                  250       260       270       280       290       300
```

-continued

```
                    310       320       330       340       350       360
m717.pep    ALCLTGIFSPLASLLLPENYAAVRFIVVSCMLPPLFCTLAEISGIGLNVVRKTRPIALAT
            |||||||||||||||||||||||| ||||||||| ||:|||||||||||||||||||
g717        ALCLTGIFSPLASLLLPENYAAVRFTVVSCMLPPLFYTLTEISGIGLNVVRKTRPIALAT
                    310       320       330       340       350       360

                    370       380       390       400       410       420
m717.pep    LGALAANLLLLGLAVPSGGARGAAVACAASFWLFFAFKTESSCRLWQPLKRLPLYLHTLF
            ||||||||||||||||||:||||||||||||||:||||||||||||||||||:||||
g717        LGALAANLLLLGLAVPSGGTRGAAVACAASFWLFFVFKTESSCRLWQPLKRLPLYMHTLF
                    370       380       390       400       410       420

                    430       440       450       460       470
m717.pep    CLTSSAAYTCFGTPANYPLFAGVWAAYLAGCILRHRKDLHKLFHYLKKQGFPLX
            ||:|||||||||||||||||||||||||||||||||:|||||||||||||||
g717        CLASSAAYTCFGTPANYPLFAGVWAAYLAGCILRHRKNLHKLFHYLKKQGFPLX
                    430       440       450       460       470
```

The following partial DNA sequence was identified in *N. meningitidis* <SEQ ID 2417>:

```
a717.seq
   1  ATGGACACAA AAGAAATCCT CGGCTACGCG GCAGGCTCGA TCGGCAGCGC

  51  GGTTTTAGCC GTCATCATCC TGCCGCTGCT GTCGTGGTAT TTCCCTGCCG

 101  ACGACATCGG ACGCATCGTG CTGATGCAGA CGGCGGCGGG GCTGACGGTG

 151  TCGGTGTTGT GCCTCGGGCT GGATCAGGCA TACGTCCGCG AATACTATGC

 201  CGCCGCCGAC AAAGACACTT TGTTCAAAAC CCTGTTCCTG CCGCCGCTGC

 251  TGTCTGCCGC CGCGATAGCC GCCCTGCTGC TTTTCCGCGC ATCCCTGCCG

 301  TCTGAAATCC TGTTTTCGCT CGACGATGCC GCCGCCGGCA TCGGGCTGGT

 351  GCTGTTTGAA CTGAGCTTCC TGCCCATCCG CTTTCTCTTA CTGGTTTTGC

 401  GTATGGAAGG ACGCGCCCTT GCCTTTTCGT CCGCGCAACT CGTGTCCAAG

 451  CTCGCCATCC TGCTGCTGCT GCCGCTGACG GTCGGGCTGC TGCACTTTCC

 501  GGCGAACACC GCCGTCCTGA CCGCCGTTTA CGCGCTGGCA AACCTTGCCG

 551  CCGCCGCCTT TTTGCTGTTT CAAAACCGAT GCCGTCTGAA GGCCGTCCGG

 601  CGCGCACCGT TTTCATCCGC CGTCCTGCAT CGCGGCCTGC GCTACGGCAT

 651  ACCGATCGCA CTAAGCAGCA TCGCCTATTG GGGGCTGGCA TCCGCCGACC

 701  GTTTGTTCCT GAAAAAATAT GCCGGCCTAG AACAGCTCGG CGTTTATTCG

 751  ATGGGTATTT CGTTCGGCGG AGCGGCATTA TTGTTCCAAA GCATCTTTTC

 801  AACGGTCTGG ACACCGTATA TTTTCCGCGC AATCGAAGCA AACGCCCCGC

 851  CCGCCCGCCT CTCGGCAACG GCAGAATCCG CCGCCGCCTT GCTTGCCTCC

 901  GCCCTCTGCC TGACCGGCAT TTTCTCGCCC CTCGCCTCCC TCCTGCTGCC

 951  GGAAAACTAC GCCGCCGTCC GGTTTATCGT CGTATCGTGT ATGCTGCCTC

1001  CGCTGTTTTG CACGCTGGTA GAAATCAGCG GCATCGGTTT GAACGTCGTC

1051  CGAAAAACAC GCCCGATCGC GCTCGCCACC TTGGGCGCGC TGGCGGCAAA

1101  CCTGCTGCTG CTGGGGCTTG CCGTACCGTC CGGCGGCGCG CGCGGCGCGG

1151  CGGTTGCCTG TGCCGCCTCA TTTTGGCTGT TTTTTGTTTT CAAGACCGAA

1201  AGCTCCTGCC GCCTGTGGCA GCCGCTCAAA CGCCTGCCGC TTTATATGCA

1251  CACATTGTTC TGCCTGGCCT CCTCGGCGGC CTACACCTGC TTCGGCACTC

1301  CGGCAAACTA CCCCCTGTTT GCCGGCGTAT GGGCGGTATA TCTGGCAGGC

1351  TGCATCCTGC GCCACCGGAA AGATTTGCAC AAACTGTTTC ATTATTTGAA

1401  AAAACAAGGT TTCCCATTAT GA
```

This corresponds to the amino acid sequence <SEQ ID 2418; ORF 717.a>:

```
a717.pep
   1 MDTKEILGYA AGSIGSAVLA VIILPLLSWY FPADDIGRIV LMQTAAGLTV

  51 SVLCLGLDQA YVREYYAAAD KDTLFKTLFL PPLLSAAAIA ALLLSRPSLP

 101 SEILFSLDDA AAGIGLVLFE LSFLPIRFLL LVLRMEGRAL AFSSAQLVSK

 151 LAILLLLPLT VGLLHFPANT AVLTAVYALA NLAAAAFLLF QNRCRLKAVR

 201 RAPFSSAVLH RGLRYGIPIA LSSIAYWGLA SADRLFLKKY AGLEQLGVYS

 251 MGISFGGAAL LFQSIFSTVW TPYIFRAIEA NAPPARLSAT AESAAALLAS

 301 ALCLTGIFSP LASLLLPENY AAVRFIVVSC MLPPLFCTLV EISGIGLNVV

 351 RKTRPIALAT LGALAANLLL LGLAVPSGGA RGAAVACAAS FWLFFVFKTE

 401 SSCRLWQPLK RLPLYMHTLF CLASSAAYTC FGTPANYPLF AGVWAVYLAG

 451 CILRHRKDLH KLFHYLKKQG FPL*
```

a717/m717 97.9% identity in 473 aa overlap

```
                    10        20        30        40        50        60
a717.pep    MDTKEILGYAAGSIGSAVLAVIILPLLSWYFPADDIGRIVLMQTAAGLTVSVLCLGLDQA
            ||||||||||||||||||||||||||||||||||||||||||||||||||||||||||||
m717        MDTKEILGYAAGSIGSAVLAVIILPLLSWYFPADDIGRIVLMQTAAGLTVSVLCLGLDQA
                    10        20        30        40        50        60

                    70        80        90       100       110       120
a717.pep    YVREYYAAADKDTLFKTLFLPPLLSAAAIAALLLSRPSLPSEILFSLDDAAAGIGLVLFE
            |||||||:||||||||||||||||||||||||||||||||||||||||||||||||||||
m717        YVREYYATADKDTLFKTLFLPPLLSAAAIAALLLSRPSLPSEILFSLDDAAAGIGLVLFE
                    70        80        90       100       110       120

                   130       140       150       160       170       180
a717.pep    LSFLPIRFLLLVLRMEGRALAFSSAQLVSKLAILLLLPLTVGLLHFPANTAVLTAVYALA
            |||||||||||||||||||||||||||| |||||||||||||||||||||||||||||||
m717        LSFLPIRFLLLVLRMEGRALAFSSAQLVPKLAILLLLPLTVGLLHFPANTAVLTAVYALA
                   130       140       150       160       170       180

                   190       200       210       220       230       240
a717.pep    NLAAAAFLLFQNRCRLKAVRRAPFSSAVLHRGLRYGIPIALSSIAYWGLASADRLFLKKY
            ||||||||||||||||||||:|||| ||||||||||||||||||||||||||||||||||
m717        NLAAAAFLLFQNRCRLKAVRHAPFSPAVLHRGLRYGIPIALSSIAYWGLASADRLFLKKY
                   190       200       210       220       230       240

                   250       260       270       280       290       300
a717.pep    AGLEQLGVYSMGISFGGAALLFQSIFSTVWTPYIFRAIEANAPPARLSATAESAAALLAS
            ||||||||||||||||||||||||||||||||||||||| ||||||||||||||||||||
m717        AGLEQLGVYSMGISFGGAALLFQSIFSTVWTPYIFRAIEENAPPARLSATAESAAALLAS
                   250       260       270       280       290       300

                   310       320       330       340       350       360
a717.pep    ALCLTGIFSPLASLLLPENYAAVRFIVVSCMLPPLFCTLVEISGIGLNVVRKTRPIALAT
            |||||||||||||||||||||||||||||||||||||||:||||||||||||||||||||
m717        ALCLTGIFSPLASLLLPENYAAVRFIVVSCMLPPLFCTLAEISGIGLNVVRKTRPIALAT
                   310       320       330       340       350       360

                   370       380       390       400       410       420
a717.pep    LGALAANLLLLGLAVPSGGARGAAVACAASFWLFFVFKTESSCRLWQPLKRLPLYMHTLF
            |||||||||||||||||||||||||||||||||||:|||||||||||||||||||:||||
m717        LGALAANLLLLGLAVPSGGARGAAVACAASFWLFFAFKTESSCRLWQPLKRLPLYLHTLF
                   370       380       390       400       410       420

                   430       440       450       460       470
a717.pep    CLASSAAYTCFGTPANYPLFAGVWAVYLAGCILRHRKDLHKLFHYLKKQGFPLX
            ||:||||||||||||||||||||||:|||||||||||||||||||||||||||
m717        CLTSSAAYTCFGTPANYPLFAGVWAAYLAGCILRHRKDLHKLFHYLKKQGFPLX
                   430       440       450       460       470

g718.seq not found yet

g718.sep not found yet
```

The following partial DNA sequence was identified in *N. meningitidis* <SEQ ID 2419>:

```
m718.seq
```

-continued

```
   1 TCAGACGGCC TTTACGTACC CCGAAACTTT ATCCACCGCC CGCAAAGCTG

  51 GTTCAAATGG GACAAAGACA ACGGGCTGCT GCTGCGTACC CGCGAAAATC

 101 CGGAAGGCGA AGCGTTGTGG CCGCTGGGCT GGGTCGTTCA TACCCAAAAA

 151 TCGCGCAGCG TCCAGCAGGC GCGCAACGGG CTTTTCCGCA CGCTTTCCTG

 201 GCTGTATATG TTCAAACACT ACGCCGTCCA CGATTTTGCC GAGTTTTTGG

 251 AGCTGTACGG CATGCCCATC CGTATCGGCA AATACGGCGC GGGCGCAACC

 301 AAAGAGGAAA AAAACACCCT GCTTCGAGCG GTGGCGGAAA TCGGTCACAA

 351 CGCGGCAGGC ATCATGCCAG AAGGTATGGA AATAGAGCTC CACAACGCGG

 401 CAAACGGTAC GACGGCAACC AGCAATCCGT TTTTGCAGAT GGCCGACTGG

 451 TGCGAAAAAT CGGCGGCGCG GCTGATTTTG GGGCAAACGC TGACCAGCGG

 501 TGCGGACGGA AAATCCAGCA CCAACGCGCT GGGCAATATC CACAACGAGG

 551 TACGCCGCGA TTTGCTGGTG TCGGACGCAA AACAGGTGGC GCAAACCATC

 601 ACAAGCCAAA TCATCGGACC GTTCCTGCAA ATCAACTATC CCCATGCCGA

 651 CCCAAACCGC GTGCCGAAAT TTGAATTTGA CACGCGCGAG CCGAAAGACA

 701 TCGCGGTCTT TGCCGACGCT ATCCCGAAAC TGGTGGATGT CGGCGTACAA

 751 ATCCCCGAAA GCTGGGTGCG CGACAAACTG GTCATTCCAG ATGTGCAGGA

 801 GGGTGAGGCT GTGTTGGTGC GGCAGGTACC GGACAATCCG GTAAACAGAA

 851 CTGCATTGGC GGCTTTATCC GCCCACACCG TACCATCTAA GGCTACGGGC

 901 AGGCATCAGG AAATATTGGA CGGCGCGTTG GATGACGCGC TGGTTGAGCC

 951 CGATTTCAAT TCTCAGCTCA ACCCGATGGT GCGTCAGGCG GTTGCCGCAC

1001 TTAATGCTTG CAACAGCTAC GAGGAGGCAG ATGCCGCACT GAATGCGCTT

1051 TATCCGAATT TGGACAACGC GAAACTGCGT ACCTATATGC AGCAGGCCTT

1101 GTTTATCAGC GATATTTTGG GACAAGACCA TGCCCGCGCC TGA
```

This corresponds to the amino acid sequence <SEQ ID 2420; ORF 718>:

```
m718.pep
  1 SDGLYVPRNF IHRPQSWFKW DKDNGLLLRT RENPEGEALW PLGWVVHTQK

 51 SRSVQQARNG LFRTLSWLYM FKHYAVHDFA EFLELYGMPI RIGKYGAGAT

101 KEEKNTLLRA VAEIGHNAAG IMPEGMEIEL HNAANGTTAT SNPFLQMADW

151 CEKSAARLIL GQTLTSGADG KSSTNALGNI HNEVRRDLLV SDAKQVAQTI

201 TSQIIGPFLQ INYPHADPNR VPKFEFDTRE PKDIAVFADA IPKLVDVGVQ

251 IPESWVRDKL VIPDVQEGEA VLVRQVPDNP VNRTALAALS AHTVPSKATG

301 RHQEILDGAL DDALVEPDFN SQLNPMVRQA VAALNACNSY EEADAALNAL

351 YPNLDNAKLR TYMQQALFIS DILGQDHARA *
```

The following partial DNA sequence was identified in *N. meningitidis* <SEQ ID 2421>:

```
a718.seq
  1  ATGGAGCCGA TAATGGCAAA AAAGAACAAT AAAACTAAAA TCCAAAAGCC

 51  CGAAGCTGCA TTGCAGACGG ACGTGGCTCA AATTACAGCG ACCGGTCGAG

101  TTATCGCCGA GCATCCATCC AATTTTATTA CGCCGCAAAA GATGCGCGCC
```

-continued

```
 151 CTCTTCGAGG ACGCAGAAAG CGGTGACATC CGCGCCCAAC ACGAGCTTTT

 201 CGCGGACATT GAGGAGCGCG ACAGCGACAT CGCGGCAAAT ATGGGGACGC

 251 GCAAACGCGC GCTGCTGACG CTCAACTGGC GCGTCGCCCC GCCGCGAAAT

 301 GCGACGCCCG AAGAAGAAAA GCTGTCCGAC CAAGCCTACG AAATGATGGA

 351 CAGCCTGCCT ACCCTCGAAG ACCTGATTAT GGATTTGATG GACGCGGTAG

 401 GGCACGGATT TTCTGCGTTG GAGGTCGAGT GGGTATTTTC AGACGGCCTT

 451 TACCTACCCC GAAACTTTAT CCACCGCCCG CAAAGCTGGT TCAAATGGGA

 501 CAAAGACAAC GGGCTGCTGC TGCGTACCCG CGAAAATCCG GAAGGCGAAG

 551 CGTTGTGGCC GCTGGGCTGG GTCGTTCATA CCCAAAAATC GCGCAGCGTC

 601 CAGCAGGCGC GCAACGGGCT TTTCCGCACG CTTTCCTGGC TGTATATGTT

 651 CAAACACTAC GCCGTCCACG ATTTTGCCGA GTTTTTGGAG CTGTACGGCA

 701 TGCCCATCCG TATCGGCAAA TACGGCGCGG GCGCAACCAA AGAGGAAAAA

 751 AACACCCTGC TTCGAGCGGT GGCGGAAATC GGTCACAACG CGGCAGGCAT

 801 CATGCCAGAA GGTATGGAAA TCGAGCTGCA CAACGCGGCA AACGGCATGA

 851 CTTCCGCCGG CAATCCGTTT TTGCAGATGG CCGACTGGTG CGAAAAATCG

 901 GCGGCGCGGC TGATTTTGGG GCAAACGCTA ACCAGCGGTG CGGACGGAAA

 951 ATCCAGCACC AACGCGCTGG GCAATATCCA CAACGAGATA CGCCGCGATT

1001 TGCTGGTGTC GGACGCAAAA CAGGTGGCGC AAACCATCAC AAGCCAAATC

1051 ATCGGACCGT TCCTGCAAAT CAACTATCCC CATGCCGACC CAAACCGCGT

1101 GCCGAAATTT GAATTTGACA CGCGCGAGCC GAAAGACATC GCGGTCTTTG

1151 CCGACGCTAT CCCGAAACTG GTGGATGTCG GCGTACAAAT CCCCGAAAGC

1201 TGGGTGCGCG ACAAACTGGT CATTCCAGAT GTGCAGGAGG GTGAGGCTGT

1251 GTTGGTGCGG CAGGTACCGG ACAATCCGGT AAACAGAACT GCATTGGCGG

1301 CTTTATCCGC CCACACCGTA CCATCTAAGG CTACGGGCAG GCATCAGGAA

1351 ATATTGGACG GCGCGTTGGA TGACGCGCTG GTTGAGCCCG ATTTCAATTC

1401 TCAGCTCAAC CCGATGGTGC GTCAGGCGGT TGCCGCACTT AATGCTTGCA

1451 ACAGCTACGA GGAGGCAGAT GCCGCACTGA ATGCGCTTTA TCCGAATTTG

1501 GACAACGCGA AACTGCGTAC CTATATGCAG CAGGCCTTGT TTATCAGCGA

1551 TATTTTGGGA CAAGACCATG CCCGCGCCTG A
```

This corresponds to the amino acid sequence <SEQ ID 2422; ORF 718.a>:

```
a718.pep
  1 MEPIMAKKNN KTKIQKPEAA LQTDVAQITA TGRVIAEHPS NFITPQKMRA

 51 LFEDAESGDI RAQHELFADI EERDSDIAAN MGTRKRALLT LNWRVAPPRN

101 ATPEEEKLSD QAYEMMDSLP TLEDLIMDLM DAVGHGFSAL EVEWVFSDGL

151 YLPRNFIHRP QSWFKWDKDN GLLLRTRENP EGEALWPLGW VVHTQKSRSV

201 QQARNGLFRT LSWLYMFKHY AVHDFAEFLE LYGMPIRIGK YGAGATKEEK

251 NTLLRAVAEI GHNAAGIMPE GMEIELHNAA NGMTSAGNPF LQMADWCEKS

301 AARLILGQTL TSGADGKSST NALGNIHNEI RRDLLVSDAK QVAQTITSQI

351 IGPFLQINYP HADPNRVPKF EFDTREPKDI AVFADAIPKL VDVGVQIPES
```

-continued

```
401 WVRDKLVIPD VQEGEAVLVR QVPDNPVNRT ALAALSAHTV PSKATGRHQE

451 ILDGALDDAL VEPDFNSQLN PMVRQAVAAL NACNSYEEAD AALNALYPNL

501 DNAKLRTYMQ QALFISDILG QDHARA*
```

a718/m718 98.4% identity in 380 aa overlap

```
                    120       130       140       150       160       170
a718.pep   DSLPTLEDLIMDLMDAVGHGFSALEVEWVFSDGLYLPRNFIHRPQSWFKWDKDNGLLLRT
                                         |||||:||||||||||||||||||||||||
m718                                     SDGLYVPRNFIHRPQSWFKWDKDNGLLLRT
                                                 10        20        30

                    180       190       200       210       220       230
a718.pep   RENPEGEALWPLGWVVHTQKSRSVQQARNGLFRTLSWLYMFKHYAVHDFAEFLELYGMPI
           ||||||||||||||||||||||||||||||||||||||||||||||||||||||||||||
m718       RENPEGEALWPLGWVVHTQKSRSVQQARNGLFRTLSWLYMFKHYAVHDFAEFLELYGMPI
                   40        50        60        70        80        90

                    240       250       260       270       280       290
a718.pep   RIGKYGAGATKEEKNTLLRAVAEIGHNAAGIMPEGMEIELHNAANGMTSAGNPFLQMADW
           |||||||||||||||||||||||||||||||||||||||||||||| |:::|||||||||
m718       RIGKYGAGATKEEKNTLLRAVAEIGHNAAGIMPEGMEIELHNAANGTTATSNPFLQMADW
                  100       110       120       130       140       150

                    300       310       320       330       340       350
a718.pep   CEKSAARLILGQTLTSGADGKSSTNALGNIHNEIRRDLLVSDAKQVAQTITSQIIGPFLQ
           ||||||||||||||||||||||||||||||||||:|||||||||||||||||||||||||
m718       CEKSAARLILGQTLTSGADGKSSTNALGNIHNEVRRDLLVSDAKQVAQTITSQIIGPGLQ
                  160       170       180       190       200       210

                    360       370       380       390       400       410
a718.pep   INYPHADPNRVPKFEFDTREPKDIAVFADAIPKLVDVGVQIPESWVRDKLVIPDVQEGEA
           ||||||||||||||||||||||||||||||||||||||||||||||||||||||||||||
m718       INYPHADPNRVPKFEFDTREPKDIAVFADAIPKLVDVGVQIPESWVRDKLVIPDVQEGEA
                  220       230       240       250       260       270

                    420       430       440       450       460       470
a718.pep   VLVRQVPDNPVNRTALAALSAHTVPSKATGRHQEILDGALDDALVEPDFNSQLNPMVRQA
           ||||||||||||||||||||||||||||||||||||||||||||||||||||||||||||
m718       VLVRQVPDNPVNRTALAALSAHTVPSKATGRHQEILDGALDDALVEPDFNSQLNPMVRQA
                  280       290       300       310       320       330

                    480       490       500       510       520
a718.pep   VAALNACNSYEEADAALNALYPNLDNAKLRTYMQQALFISDILGQDHARAX
           |||||||||||||||||||||||||||||||||||||||||||||||||||
m718       VAALNACNSYEEADAALNALYPNLDNAKLRTYMQQALFISDILGQDHARAX
                  340       350       360       370       380
```

The following partial DNA sequence was identified in *N. meningitidis* <SEQ ID 2423>:

```
m718-1.seq
  1  ATGGAGCCGA TAATGGCAAA AAAGAACAAT AAAACTAAAA TCCAAAAGCC

 51  CGAAGCTGCA TTGCAGACGG ACGTGGCTCA AATTACGGCG ACCGGTCGGG

101  TTATCGCCGA GCATCCGTCC AATTTTATTA CGCCGCAAAA GATGCGGGCC

151  CTCTTCGAGG ACGCAGAAAG CGGCGACATC CGCGCCCAAC ACGAGCTTTT

201  CGCGGACATT GAGGAGCGCG ACAGCGACAT CGCGGCAAAT ATGGGGACGC

251  GCAAACGCGC GCTGCTGACG CTCAACTGGC GCGTCGCCCC GCCGCGAAAT

301  GCGACGCCCG AAGAAGAAAA GCTGTCCGAC CAAGCCTACG AAATGATGGA

351  CAGCCTGCCT ACCCTCGAAG ACCTGATTAT GGATTTGATG GACGCGGTAG

401  GGCACGGATT TTCTGCGTTG GAGGTCGAGT GGGTATTTTC AGACGGCCTT

451  TACCTACCCC GAAACTTTAT CCACCGCCCG CAAAGCTGGT TCAAATGGGA

501  CAAAGACAAC GGGCTGCTGC TGCGTACCCG CGAAAATCCG GAAGGCGAAG

551  CGTTGTGGCC GCTGGGCTGG GTCGTTCATA CCCAAAAATC GCGCAGCGTC

601  CAGCAGGCGC GCAACGGGCT TTTCCGCACG CTTTCCTGGC TGTATATGTT

651  CAAACACTAC GCCGTCCACG ATTTTGCCGA GTTTTTGGAG CTGTACGGCA
```

-continued

```
701  TGCCCATCCG TATCGGCAAA TACGGCGCGG GCGCAACCAA AGAGGAAAAA

751  AACACCCTGC TTCGAGCGGT GGCGGAAATC GGTCACAACG CGGCAGGCAT

801  CATGCCAGAA GGTATGGAAA TAGAGCTCCA CAACGCGGCA AACGGTACGA

851  CGGCAACCAG CAATCCGTTT TTGCAGATGG CCGACTGGTG CGAAAAATCG

901  GCGGCGCGGC TGATTTTGGG GCAAACGCTG ACCAGCGGTG CGGACGGAAA

951  ATCCAGCACC AACGCGCTGG GCAATATCCA CAACGAGGTA CGCCGCGATT

1001 TGCTGGTGTC GGACGCAAAA CAGGTGGCGC AAACCATCAC AAGCCAAATC

1051 ATCGGACCGT TCCTGCAAAT CAACTATCCC CATGCCGACC CAAACCGCGT

1101 GCCGAAATTT GAATTTGACA CGCGCGAGCC GAAAGACATC GCGGTCTTTG

1151 CCGACGCTAT CCCGAAACTG GTGGATGTCG GCGTACAAAT CCCCGAAAGC

1201 TGGGTGCGCG ACAAACTGGT CATTCCAGAT GTGCAGGAGG GTGAGGCTGT

1251 GTTGGTGCGG CAGGTACCGG ACAATCCGGT AAACAGAACT GCATTGGCGG

1301 CTTTATCCGC CCACACCGTA CCATCTAAGG CTACGGGCAG GCATCAGGAA

1351 ATATTGGACG GCGCGTTGGA TGACGCGCTG GTTGAGCCCG ATTTCAATTC

1401 TCAGCTCAAC CCGATGGTGC GTCAGGCGGT TGCCGCACTT AATGCTTGCA

1451 ACAGCTACGA GGAGGCAGAT GCCGCACTGA ATGCGCTTTA TCCGAATTTG

1501 GACAACGCGA AACTGCGTAC CTATATGCAG CAGGCCTTGT TTATCAGCGA

1551 TATTTTGGGA CAAGACCATG CCCGCGCCTG A
```

This corresponds to the amino acid sequence <SEQ ID 2424; ORF 718-1>:

```
m718-1.pep.
  1 MEPIMAKKNN KTKIQKPEAA LQTDVAQITA TGRVIAEHPS NFITPQKMRA

 51 LFEDAESGDI RAQHELFADI EERDSDIAAN MGTRKRALLT LNWRVAPPRN

101 ATPEEEKLSD QAYEMMDSLP TLEDLIMDLM DAVGHGFSAL EVEWVFSDGL

151 YLPRNFIHRP QSWFKWDKDN GLLLRTRENP EGEALWPLGW VVHTQKSRSV

201 QQARNGLFRT LSWLYMFKHY AVHDFAEFLE LYGMPIRIGK YGAGATKEEK

251 NTLLRAVAEI GHNAAGIMPE GMEIELHNAA NGTTATSNPF LQMADWCEKS

301 AARLILGQTL TSGADGKSST NALGNIHNEV RRDLLVSDAK QVAQTITSQI

351 IGPFLQINYP HADPNRVPKF EFDTREPKDI AVFADAIPKL VDVGVQIPES

401 WVRDKLVIPD VQEGEAVLVR QVPDNPVNRT ALAALSAHTV PSKATGRHQE

451 ILDGALDDAL VEPDFNSQLN PMVRQAVAAL NACNSYEEAD AALNALYPNL

501 DNAKLRTYMQ QALFISDILG QDHARA*
```

The following partial DNA sequence was identified in *N. meningitidis* <SEQ ID 2425>:

```
a718.seq
  1  ATGGAGCCGA TAATGGCAAA AAAGAACAAT AAAACTAAAA TCCAAAAGCC

 51  CGAAGCTGCA TTGCAGACGG ACGTGGCTCA AATTACAGCG ACCGGTCGAG

101  TTATCGCCGA GCATCCATCC AATTTTATTA CGCCGCAAAA GATGCGCGCC

151  CTCTTCGAGG ACGCAGAAAG CGGTGACATC CGCGCCCAAC ACGAGCTTTT

201  CGCGGACATT GAGGAGCGCG ACAGCGACAT CGCGGCAAAT ATGGGGACGC
```

-continued

```
251  GCAAACGCGC GCTGCTGACG CTCAACTGGC GCGTCGCCCC GCCGCGAAAT
301  GCGACGCCCG AAGAAGAAAA GCTGTCCGAC CAAGCCTACG AAATGATGGA
351  CAGCCTGCCT ACCCTCGAAG ACCTGATTAT GGATTTGATG GACGCGGTAG
401  GGCACGGATT TTCTGCGTTG GAGGTCGAGT GGGTATTTTC AGACGGCCTT
451  TACCTACCCC GAAACTTTAT CCACCGCCCG CAAAGCTGGT TCAAATGGGA
501  CAAAGACAAC GGGCTGCTGC TGCGTACCCG CGAAAATCCG GAAGGCGAAG
551  CGTTGTGGCC GCTGGGCTGG GTCGTTCATA CCCAAAAATC GCGCAGCGTC
601  CAGCAGGCGC GCAACGGGCT TTTCCGCACG CTTTCCTGGC TGTATATGTT
651  CAAACACTAC GCCGTCCACG ATTTTGCCGA GTTTTTGGAG CTGTACGGCA
701  TGCCCATCCG TATCGGCAAA TACGGCGCGG GCGCAACCAA AGAGGAAAAA
751  AACACCCTGC TTCGAGCGGT GGCGGAAATC GGTCACAACG CGGCAGGCAT
801  CATGCCAGAA GGTATGGAAA TCGAGCTGCA CAACGCGGCA AACGGCATGA
851  CTTCCGCCGG CAATCCGTTT TTGCAGATGG CCGACTGGTG CGAAAAATCG
901  GCGGCGCGGC TGATTTTGGG GCAAACGCTA ACCAGCGGTG CGGACGGAAA
951  ATCCAGCACC AACGCGCTGG GCAATATCCA CAACGAGATA CGCCGCGATT
1001 TGCTGGTGTC GGACGCAAAA CAGGTGGCGC AAACCATCAC AAGCCAAATC
1051 ATCGGACCGT TCCTGCAAAT CAACTATCCC CATGCCGACC CAAACCGCGT
1101 GCCGAAATTT GAATTTGACA CGCGCGAGCC GAAAGACATC GCGGTCTTTG
1151 CCGACGCTAT CCCGAAACTG GTGGATGTCG GCGTACAAAT CCCCGAAAGC
1201 TGGGTGCGCG ACAAACTGGT CATTCCAGAT GTGCAGGAGG GTGAGGCTGT
1251 GTTGGTGCGG CAGGTACCGG ACAATCCGGT AAACAGAACT GCATTGGCGG
1301 CTTTATCCGC CCACACCGTA CCATCTAAGG CTACGGGCAG GCATCAGGAA
1351 ATATTGGACG GCGCGTTGGA TGACGCGCTG GTTGAGCCCG ATTTCAATTC
1401 TCAGCTCAAC CCGATGGTGC GTCAGGCGGT TGCCGCACTT AATGCTTGCA
1451 ACAGCTACGA GGAGGCAGAT GCCGCACTGA ATGCGCTTTA TCCGAATTTG
1501 GACAACGCGA AACTGCGTAC CTATATGCAG CAGGCCTTGT TTATCAGCGA
1551 TATTTTGGGA CAAGACCATG CCCGCGCCTG A
```

This corresponds to the amino acid sequence <SEQ ID 2426; ORF 718-1.a>:

```
a718.pep
      1 MEPIMAKKNN KTKIQKPEAA LQTDVAQITA TGRVIAEHPS NFITPQKMRA
     51 LFEDAESGDI RAQHELFADI EERDSDIAAN MGTRKRALLT LNWRVAPPRN
    101 ATPEEEKLSD QAYEMMDSLP TLEDLIMDLM DAVGHGFSAL EVEWVFSDGL
    151 YLPRNFIHRP QSWFKWDKDN GLLLRTRENP EGEALWPLGW VVHTQKSRSV
    201 QQARNGLFRT LSWLYMFKHY AVHDFAEFLE LYGMPIRIGK YGAGATKEEK
    251 NTLLRAVAEI GHNAAGIMPE GMEIELHNAA NGMTSAGNPF LQMADWCEKS
    301 AARLILGQTL TSGADGKSST NALGNIHNET RRDLLVSDAK QVAQTITSQI
    351 IGPFLQINYP HADPNRVPKF EFDTREPKDI AVFADAIPKL VDVGVQIPES
    401 WVRDKLVIPD VQEGEAVLVR QVPDNPVNRT ALAALSAHTV PSKATGRHQE
    451 ILDGALDDAL VEPDFNSQLN PMVRQAVAAL NACNSYEEAD AALNALYPNL
```

-continued

```
     501 DNAKLRTYMQ QALFISDILG QDHARA*

a718/m718-1  99.0% identity in526 aa overlap

                      10        20        30        40        50        60
 a718.pep    MEPIMAKKNNKTKIQKPEAALQTDVAQITATGRVIAEHPSNFITPQKMRALFEDAESGDI
             ||||||||||||||||||||||||||||||||||||||||||||||||||||||||||||
 m718-1      MEPIMAKKNNKTKIQKPEAALQTDVAQITATGRVIAEHPSNFITPQKMRALFEDAESGDI
                      10        20        30        40        50        60

                      70        80        90       100       110       120
a718.pep     RAQHELFADIEERDSDIAANMGTRKRALLTLNWRVAPPRNATPEEEKLSDQAYEMMDSLP
             ||||||||||||||||||||||||||||||||||||||||||||||||||||||||||||
m718-1       RAQHELFADIEERDSDIAANMGTRKRALLTLNWRVAPPRNATPEEEKLSDQAYEMMDSLP
                      70        80        90       100       110       120

                     130       140       150       160       170       180
a718.pep     TLEDLIMDLMDAVGHGFSALEVEWVFSDGLYLPRNFIHRPQSWFKWDKDNGLLLRTRENP
             ||||||||||||||||||||||||||||||||||||||||||||||||||||||||||||
m718-1       TLEDLIMDLMDAVGHGFSALEVEWVFSDGLYLPRNFIHRPQSWFKWDKDNGLLLRTRENP
                     130       140       150       160       170       180

                     190       200       210       220       230       240
a718.pep     EGEALWPLGWVVHTQKSRSVQQARNGLFRTLSWLYMFKHYAVHDFAEFLELYGMPIRIGK
             ||||||||||||||||||||||||||||||||||||||||||||||||||||||||||||
m718-1       EGEALWPLGWVVHTQKSRSVQQARNGLFRTLSWLYMFKHYAVHDFAEFLELYGMPIRIGK
                     190       200       210       220       230       240

                     250       260       270       280       290       300
a718.pep     YGAGATKEEKNTLLRAVAEIGHNAAGIMPEGMEIELHNAANGMTSAGNPFLQMADWCEKS
             |||||||||||||||||||||||||||||||||||||||||| |:::||||||||||||
m718-1       YGAGATKEEKNTLLRAVAEIGHNAAGIMPEGMEIELHNAANGTTATSNPFLQMADWCEKS
                     250       260       270       280       290       300

                     310       320       330       340       350       360
a718.pep     AARLILGQTLTSGADGKSSTNALGNIHNEIRRDLLVSDAKQVAQTITSQIIGPFLQINYP
             ||||||||||||||||||||||||||||:|||||||||||||||||||||||||||||||
m718-1       AARLILGQTLTSGADGKSSTNALGNIHNEVRRDLLVSDAKQVAQTITSQIIGPFLQINYP
                     310       320       330       340       350       360

                     370       380       390       400       410       420
a718.pep     HADPNRVPKFEFDTREPKDIAVFADAIPKLVDVGVQIPESWVRDKLVIPDVQEGEAVLVR
             ||||||||||||||||||||||||||||||||||||||||||||||||||||||||||||
m718-1       HADPNRVPKFEFDTREPKDIAVFADAIPKLVDVGVQIPESWVRDKLVIPDVQEGEAVLVR
                     370       380       390       400       410       420

                     430       440       450       460       470       480
a718.pep     QVPDNPVNRTALAALSAHTVPSKATGRHQEILDGALDDALVEPDFNSQLNPMVRQAVAAL
             ||||||||||||||||||||||||||||||||||||||||||||||||||||||||||||
m718-1       QVPDNPVNRTALAALSAHTVPSKATGRHQEILDGALDDALVEPDFNSQLNPMVRQAVAAL
                     430       440       450       460       470       480

                     490       500       510       520
a718.pep     NACNSYEEADAALNALYPNLDNAKLRTYMQQALFISDILGQDHARAX
             |||||||||||||||||||||||||||||||||||||||||||||||
m718-1       NACNSYEEADAALNALYPNLDNAKLRTYMQQALFISDILGQDHARAX
                     490       500       510       520

g719.seq not found yet

g719.seq not found yet
```

The following partial DNA sequence was identified in *N. meningitidis* <SEQ ID 2427>:

```
m719.seq
     1  ATGGCAAACG GGAACATGAA ACTGTCGTTG GTGTTAACCG CCCGAGATGA

    51  CGGAGCGAGA CGGCTACTGG CTGATACTCA ACGACAATTA GATCGTACCG

   101  CGAAATCGCG GGCGCAACTT GAACGGCAAA GCCATACTTA TGCGTTGACC

   151  GGCATCCGCT CAGAAAAACA GATTCAACGC GAAATCATGC TGACACAGGC

   201  TGCGTTTAAC CGTTTGGCGC GCAGCGGCAA GGCATCACAA AATGATTTGG

   251  CACGGGCGGC GGTCGCTACG CGTAACCGAA TTCGCGAGCT GAACGCGGAA

   301  CTGAAACAGG GCACGGGATT TGCGGACAAG ATGGGAAAAA TCGGAAGATT

   351  CGGTGCAGCT GCGGTGGCTG GTGGCGCGGC AGCGTATACG GTGCTTAAGC

   401  CTGCTATGGA CAACAGAAAG CAGCTTGATG AGAACATCAA CCGCGTGTCC
```

-continued

```
 451  AGACAGGCAT TTATTGAGGA TAACAGTAAA TCGGCAGCGT GGATTGCAAC
 501  TGAAGGTGCG CAACAGATCA AGGATTTGGC ACTTGAACTT GTCGAGAAAA
 551  ATGGCGGGAC CCACGATAAG GCTTTGGATT TAATCAGCGG CATGATGACC
 601  ACCGGTCTGA ATTTTGCCCA AACCAAGAAT GAAGCGCAGG CGGCATATGC
 651  TTTTGCACTT GCCTCAGAAG GCAGTGGCGA GGATACGGCA AAACTGATTA
 701  AAACCCTGAA AGATGGCGGC ATGAGCGGTA AAGACCTGCA ACTCGGGCTT
 751  GAGCACGTCT TGCAATCGGG TTTAGACGGC ACTTTCGAGG TGCGGGATAT
 801  GGTTCGGGAG CTGCCGAGCC TGCTCTCTGC CGCGCAACAG GCAGGGATGA
 851  ATGGTGTCGG CGGTTTGGAC TACCTGCTCT CACTCTTACA ATCTGCGGCG
 901  AATAAATCGG GCAGTCCTGC CGAAGCGGCG ACTAATGTGC AAAATCTTTT
 951  GAGTAAAACT CTGTCGCCTG ACACGATAGG TCGTCTGAAG AAGATGGCAA
1001  ATCCGAATGA CCCGAAGAAA GGTGTCGATT GGATAGGCTC GGTTGTGCAA
1051  GGCAAGCAAA ACGGCGAAAA CGCAGTGCAG GTGTTGTCCC GTCTTGCCGA
1101  TGCCATGCTA GTAAAGGATA AGCAATACCA AGATTATAAG AAACGCGCGG
1151  CTGCAGGCGA TAAGACGGCG GCGGAGCAGG CAAATATGCT TAAGGGCGCG
1201  CTTTTGGCGC AACTGCTGCC TGATTTGCAG GCAAAACAAG GTTTGCTGGC
1251  TGCAACGGAT ATGACGCAAA TCCGTGAATA TATGGCTTCG TTGGCTGGCG
1301  TAACGTTGGA TAACGGAAAA ATTGCTAAGA ACAACGAGGC GCGAATGTTG
1351  TCGGCAGCGG CGCAACAAGA GCAACAGGAA TCGCTGGCAA TGTTGCGGGA
1401  AAGTCTGACG GGAACATTGG TGGATATGGA AACCTCGTTT AAAAAGCTGG
1451  CAGCGGAATA CCCTAATGCC ACTCTAGCCC TGCAAGCATT GACGACGGCG
1501  GCAACAGCGG CGTCTGCCGC AATGTTATTA ACCGCCGGTG GCGGTAAAGG
1551  TGCAGGCTTT CTGAAAGATG TAGGTAGTAA AGCGTTGGGA TGGGGTAAGG
1601  CTTCCGCAGG CGGCGTGGCA GCAGGTGCCA CAGCGGCAGG CGGTAAGTTG
1651  CTGTCATGGG GAAAATCTGC CGGTAGCGGG CTCATGAATA ATCCAGCGTT
1701  AGTTAAACGG GCGGGTTTGT TAGGTATGTT GCTGTATTCC GAGTCTTTGG
1751  GTGACGGCAC ATTGCCAAAG GGTTTGCGTG GTACCAAGAC AACTCCTGAA
1801  ATGATTAATC GTCTGAAAAA CAACGGTATC CGATTTGAAC CTGCGCCGAA
1851  GCGGGAACAG GCGCGGGGTG GTGTCCCTCA GTATTTGGCT GCTCCGTCAG
1901  CGCAGCCTAC CGATAAGATG TTGTCTCCGT TGTTTTCAAC TCAGACGGCG
1951  GCGTATCAGG CAGCCATTCA GCAGCAGACG GCGGCGTATC AGGCAGCATT
2001  GGCGCAGGAT ACGGCTGCAG TTACAACAGG TTTGGCACAA GTGCAAAGTG
2051  CGATGGCGTC GGCAAGTCAG ACCATCAATA CCAATGTGAG CCTGAATATC
2101  GACGGACGTG TTATCGCGAA TGAGGTATCG CGGTATCAAG TGGCCATGTT
2151  CGGCCGTGGA GCGGGTCAAT AA
```

This corresponds to the amino acid sequence <SEQ ID 2428; ORF 719>:

```
m719.pep
   1  MANGNMKLSL VLTARDDGAR RLLADTQRQL DRTAKSRAQL ERQSHTYALT
  51  GIRSEKQIQR EIMLTQAAFN RLARSGKASQ NDLARAAVAT RNRIRELNAE
```

-continued

```
101 LKQGTGFADK MGKIGRFGAA AVAGGAAAYT VLKPAMDNRK QLDENINRVS

151 RQAFIEDNSK SAAWIATEGA QQIKDLALEL VEKNGGTHDK ALDLISGMMT

201 TGLNFAQTKN EAQAAYAFAL ASEGSGEDTA KLIKTLKDGG MSGKDLQLGL

251 EHVLQSGLDG TFEVRDMVRE LPSLLSAAQQ AGMNGVGGLD YLLSLLQSAA

301 NKSGSPAEAA TNVQNLLSKT LSPDTIGRLK KMANPNDPKK GVDWIGSVVQ

351 GKQNGENAVQ VLSRLADAML VKDKQYQDYK KRAAAGDKTA AEQANMLKGA

401 LLAQLLPDLQ AKQGLLAATD MTQIREYMAS LAGVTLDNGK IAKNNEARML

451 SAAAQQEQQE SLAMLRESLT GTLVDMETSF KKLAAEYPNA TLALQALTTA

501 ATAASAAMLL TAGGGKGAGF LKDVGSKALG WGKASAGGVA AGATAAGGKL

551 LSWGKSAGSG LMNNPALVKR AGLLGMLLYS ESLGDGTLPK GLRGTKTTPE

601 MINRLKNNGI RFEPAPKREQ ARGGVPQYLA APSAQPTDKM LSPLFSTQTA

651 AYQAAIQQQT AAYQAALAQD TAAVTTGLAQ VQSAMASASQ TINTNVSLNI

701 DGRVIANEVS RYQVAMFGRG AGQ*
```

a719.seq not found yet
a719.pep not found yet
g720.seq not found yet
g720.pep not found yet The following partial DNA sequence was identified in *N. meningitidis* <SEQ ID 2429>:

m720.seq

```
   1 ATGAGCGGAT GGCATACCTT ATTGCAGGAC GCATCTTACA AGGGCGTCGG

  51 CTTTGATATT GAGGTGGTGG ACGAGAGCAA CGGCAAGGCA TTGGCCGAGC

 101 ATGCGCGGCC GTTTGTGCAG GGTATCGACC TTGAAGACAT GGGCATGACC

 151 GGGCGGCAGG TGCAGATTAA TGCGGTGTTT TGGGGCAAGG GCTATGCAGG

 201 CCGTCTGAAA AAGCTGCTGG ATGCGCTGGA GCAGCCGGGC GGCGGCGTGC

 251 TGGTGCACCC TGTTTGGGGG CGGATGCACA ACATGATTGC GGCATCATGG

 301 AGTTACCGAC ATGAGGCCGA TTATGTGGAT TATGCGGGCA TCGATATTAC

 351 TTTCCGCGAG GCGGCCGAAG CGCAGGAAAT CTTTGTTTTT GAAAACGCCT

 401 TTTTGGTCGA GCTTGAGGCG TTGATTGCTA ATATCGACAC CTACCGCGAG

 451 GCGGCTATCG GCTTTGTTGA TGCGGTGTTG GCGGTGGATG CGGGCGTATC

 501 AGCTTTATGG GGCAGCGCGC TGGGCATTTG GAGTGCGGCA TCGGGTACGT

 551 TTGGCGCGGT GCGCCGTTTG TTTGATTTGG ACAAAATTGC CTTTCCCGAT

 601 CGGGGCGGAT ACAGTGCAGC GGCGTTTAAA AACGGCTCGG CCAAGCTGTT

 651 TGCGGATATA TCGGTCATGG TAGATACTGG CATACGCCGT GAGGCGGGTT

 701 TGGCCGATAA TGCCATGCAC CATGCCGGTT GGTCGCCGCG ACAGCGGTTT

 751 GACGGGGCTG CGGCTGTTGC CGACCGCGCC GCCGCTATCC CTGATAATTT

 801 GCTGACCGGC CGCTTTTCAG ACGGCCTGCA AAACCGCCTG AACCGGTTAA

 851 CCGCCAAACA GGTGCAGCCG GTAGCGCAGG CGGTGCGCCT GTTATCCACG

 901 TCATCGCTGT TGTCGGTGGC AACGGCATTA ATCGAGGCGC ATGGCGAAGA

 951 GATGACCGCG CCCGATTTGA TTGAGGTTAA CCGCGCCATG CGCCGCCGTA

1001 TGCAGGCCGA GATTGCCGCC TTGCGGGCGG TGCAGACGGC TGCTGCCGAG

1051 TCTGGTGGGC TGACGGCCAA CGCCGTGTAT ACCGAGGCTT ACCAAACGGC
```

-continued

1101 AGAATCCCTG CGCGCGGCGG CAGGCCGTCT GAATGCGTTG GTTGCGGCGG

1151 TCATCAACCA AAAGCCGCCG CTGATTGTGC GCCAAGCCCC AATCGACGGT

1201 ACGATACACC AAATCGCCCA CGAGTTTTAC GGCGATATAG CCCGCGCAGC

1251 AGAGCTGGTG CGGCTCAATC CCCATATCCA CCACCCCGCG TTTATCAAGC

1301 GCGGCACTTT GGTCAACAGC TATGCAAAAT AA

This corresponds to the amino acid sequence <SEQ ID 2430; ORF 720>:

m720.pep

1 MSGWHTLLQD ASYKGVGFDI EVVDESNGKA LAEHARPFVQ GIDLEDMGMT

51 GRQVQINAVF WGKGYAGRLK KLLDALEQPG GGVLVHPVWG RMHNMIAASW

101 SYRHEADYVD YAGIDITFRE AAEAQEIFVF ENAFLVELEA LIANIDTYRE

151 AAIGFVDAVL AVDAGVSALW GSALGIWSAA SGTFGAVRRL FDLDKIAFPD

201 RGGYSAAAFK NGSAKLFADI SVMVDTGIRR EAGLADNAMH HAGWSPRQRF

251 DGAAAVADRA AAIPDNLLTG RFSDGLQNRL NRLTAKQVQP VAQAVRLLST

301 SSLLSVATAL IEAHGEEMTA PDLIEVNRAM RRRMQAEIAA LRAVQTAAAE

351 SGGLTANAVY TEAYQTAESL RAAAGRLNAL VAAVINQKPP LIVRQAPIDG

401 TIHQIAHEFY GDIARAAELV RLNPHIHHPA FIKRGTLVNS YAK*

The following partial DNA sequence was identified in *N. meningitidis* <SEQ ID 2431>:

a720.seq (partial)

1 GGCCTGCAAA ACCGCCTGAA CCGGTTAACC GCCAAACAGG TGCAGCCGGT

51 AGCGCAGGCG GTGCGCCTGT TATCCACGTC ATCGCTGTTG TCGGTGGCAA

101 CGGCATTAAT CGAGGCGCAT GGCGAAGAGA TGACCGCGCC CGATTTGATT

151 GAGGTTAACC GCGCCATGCG CCGCCGTATG CAGGCCGAGA TTGCCGCCTT

201 ACGGGCGGTG CAGACGGCTG CTGCCGAGTC TGGTGGGCTG ACGGCCAACG

251 CCGTGTATAC CGAGGCTTAC CAAACGGCAG AATCCCTGCG CGCGGCGGCA

301 GGCCGTCTGA ATGCGTTGGT TGCGGCGGTC ATCAACCAAA AGCCGCCGCT

351 GATTGTGCGC CAAGCCCCAA TCGACGGTAC GATACACCAA ATCGCCCACG

401 AGTTTTACGG CGATATAGCC CGCGCAGCAG AGCTGGTGCG GCTCAATCCC

451 CATATCCACC ACCCCGCGTT TATCAAGCGC GGCACTTTGG TCAACAGCTA

501 TGCAAAATAA

This corresponds to the amino acid sequence <SEQ ID 2432; ORF 720.a>:

a720.pep (partial)

1 GLQNRLNRLT AKQVQPVAQA VRLLSTSSLL SVATALIEAH GEEMTAPDLI

51 EVNRAMRRRM QAEIAALRAV QTAAAESGGL TANAVYTEAY QTAESLRAAA

101 GRLNALVAAV INQKPPLIVR QAPIDGTIHQ IAHEFYGDIA RAAELVRLNP

151 HIHHPAFIKR GTLVNSYAK* m720/a720 100.0% identity in 169 aa overlap

```
               250        260        270        280        290        300
m720.pep    SPRQRFDGAAAVADRAAAIPDNLLTGRFSDGLQNRLNRLTAKQVQPVAQAVRLLSTSSLL
                                             ||||||||||||||||||||||||||||||
a720                                         GLQNRLNRLTAKQVQPVAQAVRLLSTSSLL
                                                     10        20        30

              310        320        330        340        350        360
m720.pep    SVATALIEAHGEEMTAPDLIEVNRAMRRRMQAEIAALRAVQTAAAESGGLTANAVYTEAY
            ||||||||||||||||||||||||||||||||||||||||||||||||||||||||||||
a720        SVATALIEAHGEEMTAPDLIEVNRAMRRRMQAEIAALRAVQTAAAESGGLTANAVYTEAY
                    40        50        60        70        80        90

               370        380        390        400        410        420
m720.pep    QTAESLRAAAGRLNALVAAVINQKPPLIVRQAPIDGTIHQIAHEFYGDIARAAELVRLNP
            ||||||||||||||||||||||||||||||||||||||||||||||||||||||||||||
a720        QTAESLRAAAGRLNALVAAVINQKPPLIVRQAPIDGTIHQIAHEFYGDIARAAELVRLNP
                   100       110       120       130       140       150

               430        440
m720.pep    HIHHPAFIKRGTLVNSYAKX
            ||||||||||||||||||||
a720        HIHHPAFIKRGTLVNSYAKX
                   160       170

g721.seq not found
g721.pep not found
```

The following partial DNA sequence was identified in *N. meningitidis* <SEQ ID 2433>:

```
m721.seq
     1  ATGTCCAAAA ATGCACAAAA AACCCTACTT GCCGTGTGCA GTTTCGAGGT

    51  GCAGCCAAAA GACGGGCGAA TCCAACTGCT GCCATATGGC GAATTTCGCG

   101  CAGTAGACGG TCGTCCGACT GATGTCCCTG CGTGGTATCT GACCGAAGAA

   151  AACGGTCATG ATGTCGCGTT GTTGGCCAAC AGCTCGCGCA ATCAGTTGGT

   201  TGTCGATTAT GAACACCAGA CGCTCTACAA AGAGAAAAAC GGACAACCTG

   251  CACCTGCCGC CGGTTGGATG CGTTGGCTGG AGTTCACGCC TAAAGGCATG

   301  TTTGCCGAAG TGGAGTGGAC GGACAAGGCG GCTGCGGCAA TTGCCGCAAA

   351  AGAGTATCGC TACATCTCTG CTGTGTTTTC CTATGACACA AAGGGATATG

   401  TAAGCAAAAT TTTTCACGCC GCGCTGACAA ATTTCCCCGC GTTGGACGGT

   451  ATGGACGAGG TGCTGGCGGC AGCGTCGGCG CAAATTTTAA AACCGGAAAC

   501  GGAGCAAAAC CCTATGAAAG AGTTGTTACA GCAACTGTTC GACCTGCCTG

   551  ATGCGGGCGA AGAAGAACTG AAGGCGGCAT TGTCCGCGCT CGTGGAAGCC

   601  AAGCCGAAAG ACGTGGCATT GTCTGCCGAC GTGTTCGCGC AGCTGGCGGA

   651  AAAAGACAGC CGCATCGCGG CATTGACGGC GCAAACCGCC AAGCCTGATT

   701  TGACTAAATA CGCGCCTATC TCAGTGGTTC AAGAGCTGCA AAGCAAAGTC

   751  GCCGCGCTGA CTGCCAAGCA GGAAGCAGAC AAAGGCAACG AATTGATTAC

   801  CGCCGCGCTG ACTTCAGGCA AATTGCTGCC TGCTCAGAAG GAGTGGGCAA

   851  AAGGCGTATT GAAACAGCCG GGCGGCTTGG CATTTTTGAC CGGCTTTATT

   901  GAAAACGCCC AGCCGGTCGC TGCACTGGCA GGCTCGCAAA CGGGCGGCAA

   951  AGCACCCGAC GAACGCGTCG CCGCACTGAC TGCGGAAGAG GCAGCCGCAG

  1001  CAAAAATGCT GGGCATGTCC GGCGAAGAAT TTGTAAAAAT CAAAGAAAGC

  1051  GAAGGTAAGT AA
```

This corresponds to the amino acid sequence <SEQ ID 2434; ORF 721>:

```
m721.pep
```

-continued

```
  1 MSKNAQKTLL AVCSFEVQPK DGRIQLLPYG EFRAVDGRPT DVPAWYLTEE
 51 NGHDVALLAN SSRNQLVVDY EHQTLYKEKN GQPAPAAGWM RWLEFTPKGM
101 FAEVEWTDKA AAAIAAKEYR YISAVFSYDT KGYVSKIFHA ALTNFPALDG
151 MDEVLAAASA QILKPETEQN PMKELLQQLF DLPDAGEEEL KAALSALVEA
201 KPKDVALSAD VFAQLAEKDS RIAALTAQTA KPDLTKYAPI SVVQELQSKV
251 AALTAKQEAD KGNELITAAL TSGKLLPAQK EWAKGVLKQP GGLAFLTGFI
301 ENAQPVAALA GSQTGGKAPD ERVAALTAEE AAAAKMLGMS GEEFVKIKES
351 EGK*
```

The following partial DNA sequence was identified in *N. meningitidis* <SEQ ID 2435>:

```
a721.seq
   1 ATGTCCAAAA ATGCACAAAA AACCCTACTT GCCGTGTGCA GTTTCGAGGT
  51 GCAGCCAAAA GACGGGCGAA TCCAACTGCT GCCATATGGC GAATTTCGCG
 101 CAGTAGACGG TCGTCCGACT GATGTCCCTG CGTGGTATCT GACCGAAGAA
 151 AACGGTCATG ATGTCGCGTT GTTGGCCAAC AGCTCGCGCA ATCAGTTGGT
 201 TGTCGATTAT GAACACTAGA CGCTCTACAA AGAGAAAAAC GGACAACCTG
 251 CACCTGCCGC CGGTTGGATG CGTTGGCTGG AGTTCACGCC TAAAGGCATG
 301 TTTGCCGAAG TGGAGTGGAC GGACAAGGCG GCTGCGGCAA TTGCCGCAAA
 351 AGAGTATCGC TACATCTCTG CTGTGTTTTC CTATGACACA AAGGGATATG
 401 TAAGCAAAAT TTTTCACGCC GCGCTGACAA ATTTCCCCGC GTTGGACGGT
 451 ATGGACGAGG TGCTGGCGGC AGCGTCGGCG CAAATTTTAA AACCGGAAAC
 501 GGAGCAAAAC CCTATGAAAG AGTTGTTACA GCAACTGTTC GGTCTGCCTG
 551 ATGCGGGCGA AGAAGAACTG AAGGCGGCAT TGTCCGCGCT CGTGGAAGCC
 601 AAGCCGAAAG ACGTGGCATT GTCTGCCGAC GTGTTCGCGC AGCTGGCGGA
 651 AAAAGACAGC CGCATCGCGG CATTGACGGC GCAAACCGCC AAGCCTGATT
 701 TGACTAAATA CGCGCCTATC TCAGTGGTTC AAGAGCTGCA AAGCAAAGTC
 751 GCCGCGCTGA CTGCCAAGCA GGAAGCAGAC AAAGGCAACG AATTGATTAC
 801 CGCCGCGCTG ACTTCAGGCA AATTGCTGCC TGCTCAGAAG GAGTGGGCAG
 851 AAGGCGTATT GAAACAGCCG GGCGGCTTGG CATTTTTGAC CGGCTTTATT
 901 GAAAACGCCC AGCCGGTCGC TGCACTGGCA GGCTCGCAAA CGGGCGGTAA
 951 AGCACCCGAC GAACGCGTCG CCGCACTGAC TGCGGAAGAG GCAGCCGCAG
1001 CAAAAATGCT GGGCATGTCC GGCGAAGAAT TTGTAAAAAT CAAAGAAAGC
1051 GAAGGTAAGT AA
```

This corresponds to the amino acid sequence <SEQ ID 2436; ORF 721.a>:

```
a721.pep
  1 MSKNAQKTLL AVCSFEVQPK DGRIQLLPYG EFRAVDGRPT DVPAWYLTEE
 51 NGHDVALLAN SSRNQLVVDY EH*TLYKEKN GQPAPAAGWM RWLEFTPKGM
101 FAEVEWTDKA AAAIAAKEYR YISAVFSYDT KGYVSKIFHA ALTNFPALDG
151 MDEVLAAASA QILKPETEQN PMKELLQQLF GLPDAGEEEL KAALSALVEA
```

-continued

```
201 KPKDVALSAD VFAQLAEKDS RIAALTAQTA KPDLTKYAPI SVVQELQSKV

251 AALTAKQEAD KGNELITAAL TSGKLLPAQK EWAEGVLKQP GGLAFLTGFI

301 ENAQPVAALA GSQTGGKAPD ERVAALTAEE AAAAKMLGMS GEEFVKIKES

351 EGK*
```

a721/m721 99.2% identity in 353 aa overlap

```
                    10        20        30        40        50        60
a721.pep    MSKNAQKTLLAVCSFEVQPKDGRIQLLPYGEFRAVDGRPTDVPAWYLTEENGHDVALLAN
            ||||||||||||||||||||||||||||||||||||||||||||||||||||||||||||
m721        MSKNAQKTLLAVCSFEVQPKDGRIQLLPYGEFRAVDGRPTDVPAWYLTEENGHDVALLAN
                    10        20        30        40        50        60

                    70        80        90       100       110       120
a721.pep    SSRNQLVVDYEHXTLYKEKNGQPAPAAGWMRWLEFTPKGMFAEVEWTDKAAAAIAAKEYR
            |||||||||||| |||||||||||||||||||||||||||||||||||||||||||||||
m721        SSRNQLVVDYEHQTLYKEKNGQPAPAAGWMRWLEFTPKGMFAEVEWTDKAAAAIAAKEYR
                    70        80        90       100       110       120

                   130       140       150       160       170       180
a721.pep    YISAVFSYDTKGYVSKIFHAALTNFPALDGMDEVLAAASAQILKPETEQNPMKELLQQLF
            ||||||||||||||||||||||||||||||||||||||||||||||||||||||||||||
m721        YISAVFSYDTKGYVSKIFHAALTNFPALDGMDEVLAAASAQILKPETEQNPMKELLQQLF
                   130       140       150       160       170       180

                   190       200       210       220       230       240
a721.pep    GLPDAGEEELKAALSALVEAKPKDVALSADVFAQLAEKDSRIAALTAQTAKPDLTKYAPI
             |||||||||||||||||||||||||||||||||||||||||||||||||||||||||||
m721        DLPDAGEEELKAALSALVEAKPKDVALSADVFAQLAEKDSRIAALTAQTAKPDLTKYAPI
                   190       200       210       220       230       240

                   250       260       270       280       290       300
a721.pep    SVVQELQSKVAALTAKQEADKGNELITAALTSGKLLPAQKEWAEGVLKQPGGLAFLTGFI
            |||||||||||||||||||||||||||||||||||||||||||:||||||||||||||||
m721        SVVQELQSKVAALTAKQEADKGNELITAALTSGKLLPAQKEWAKGVLKQPGGLAFLTGFI
                   250       260       270       280       290       300

                   310       320       330       340       350
a721.pep    ENAQPVAALAGSQTGGKAPDERVAALTAEEAAAAKMLGMSGEEFVKIKESEGKX
            ||||||||||||||||||||||||||||||||||||||||||||||||||||||
m721        ENAQPVAALAGSQTGGKAPDERVAALTAEEAAAAKMLGMSGEEFVKIKESEGKX
                   310       320       330       340       350

g722.seq not found yet

g722.pep not found yet
```

The following partial DNA sequence was identified in *N. meningitidis* <SEQ ID 2437>:

```
m722.seq
   1  GTGTTTGAAA CGCCGACATT TGAGCAAATC CGCGAGCGTA TCCTGCGCGA

  51  TACCAAAAGC CTGTGGCCGG ATGCCGATAT CAGCCCCGAC AGCGACCATT

 101  ATGTGCACGC CAGCCGTTTG GCCAGCTGCG CCGAAGGGCA ATATGCGCAT

 151  CAAAGCTGGA TTGTGCGGCA GATTTTCCCT GATACCGCCG ACCGCGAGTA

 201  TTTGGAGCGG CATGCCTCCA TGCGCGGCTT GAGCCGCCGC AATCCTACCA

 251  CGGCCAGCGG CACGCTGACC GTAAGCGGTA TTGCGCAATC CATGCTTTCA

 301  GACGACCTGC AAGTGCGTAT CGGCCAGCGT TTTTACCGCA CTACCGCCCG

 351  CGCCGTTATC GGCAGCGGCG GCACGGCGGA AATACCGGCA ATCGCCGACG

 401  AGCCGGGCGC GGCCGCCAAT GTGGGCGACG GCGAGGCGCA ACTGATGGCC

 451  GCCCCCGCCG GTGTGGCCAC CGAATGCCGC CTTACCGTAC AAGGCGGCAC

 501  CGACCGAGAA AGCGATGCCT CACTGCTGGC GCGTCTGTTG GAAATCATCC

 551  GCCGACCGCC CGCAGGCGGC AACCGTTACG ACTATAAAAA CTGGGCGTTG

 601  AGTGTTGACG GCGTAACCAG CGCATATGTT TATCCGCTGC GCCGCGGCTT
```

-continued

```
 651  GGGTACGGTG GATATTGCCA TTACCTCCGC CGACGGTGTG TCGTCGGAAG

 701  AAACTGTGCG CCGCGTACAG GCTTATATCG ACGAGATGCG CCCGGTAACG

 751  GCAAAAAATG CGCTGGTACT CAAGCCAACC GTAACGGCGG TGCCTGTTAC

 801  CGTGCAAGTC AAGCTCGACG GTATCGACTT GGACGAGGCC AAGCGCCGCA

 851  TACGGACGGC CCTAAAAGAA TATTTCGACA CCCTGATCCC CGGCGACGGC

 901  CTGACTGTGT CGCAAATCGA GGCTGCTATC AGCAATGTGG ATGGTGTGAT

 951  CGACCGCCGT CTGACTGCGC CGACGGCCAA CCGTGCCGCC GATACGGTTA

1001  ACCGCATCGA GTGGTTTAAA GCGGGCGCGA TTAATGTAAC GGAGATGCCG

1051  TCATGA
```

This corresponds to the amino acid sequence <SEQ ID 2438; ORF 722>:

```
m722.pep
  1 VFETPTFEQI RERILRDTKS LWPDADISPD SDHYVHASRL ASCAEGQYAH

 51 QSWIVRQIFP DTADREYLER HASMRGLSRR NPTTASGTLT VSGIAQSMLS

101 DDLQVRIGQR FYRTTARAVI GSGGTAEIPA IADEPGAAAN VGDGEAQLMA

151 APAGVATECR LTVQGGTDRE SDASLLARLL EIIRRPPAGG NRYDYKNWAL

201 SVDGVTSAYV YPLRRGLGTV DIAITSADGV SSEETVRRVQ AYIDEMRPVT

251 AKNALVLKPT VTAVPVTVQV KLDGIDLDEA KRRIRTALKE YFDTLIPGDG

301 LTVSQIEAAI SNVDGVIDRR LTAPTANRAA DTVNRIEWFK AGAINVTEMP

351 S*
```

The following partial DNA sequence was identified in *N. meningitidis* <SEQ ID 2439>:

```
a722.seq
   1  GTGTTTGAAA CGCCGACATT TGAGCAAATC CGCGAGCGTA TCCTGCGCGA

  51  TACCAAAAGC CTGTGGCCGG ATGCCGATAT CAGCCCCGAC AGCGACCATT

 101  ATGTGCACGC CAGCCGTTTG GCCAGCTGCG CCGAAGGGCA ATATGCGCAT

 151  CAAAGCTGGA TTGTGCGGCA GATTTTCCCT GATACCGCCG ACCGCGAGTA

 201  TTTGGAGCGG CATGCCTCCA TGCGCGGCTT GCGCCGCCGC AATCCTACCA

 251  CGGCCAGCGG CACGCTGACC GTAAGCGGTA TTGCGCAATC CATGCTTTCA

 301  GACGGCCTGC AAGTGCGTAT CGGCCAGCGT TTTTACCGCA CTACCGCCCG

 351  CGCCGTTATC GGCAGCGGCG GCACGGCGGA AATACCGGCA ATCGCCGACG

 401  AGCCGGGCGC GGCCGCCAAT GTGCGCGACG GCGAGGCGCA ACTGATGGCC

 451  GCCCCCGCCG GTGTGTCCAC CGAATGCCGC CTTACCGTAC AAGGCGGCAC

 501  CGACCGAGAA AGCGATGCCT CACTGCTGGC GCGTCTGTTG GAAATCATCC

 551  GCCGACCGCC CGCAGGCGGC AACCGTTACG ACTATAAAAA CTGGGCGTTG

 601  AGTGTTGACG GCGTAACCAG CGCATATGTT TATCCGCTGC GCCGCGGCTT

 651  GGGTACGGTG GATATTGCCA TTACCTCCGC CGACGGTGTG CCATCGGAAG

 701  AAACTGTGCG CCGCGTACAG GCTTATATCG ACGAGATGCG CCCGGTAACG

 751  GCAAAAAATG CGCTGGTACT CAAGCCAACC GTAACGGCGG TGCCTGTTAC

 801  CGTGCAAGTC AAGCTCGACG GCATCGACTT GGACGAGGCC AAGCGCCGCA
```

-continued

```
 851 TACGGACGGC CCTAAAAGAA TATTTCGACA CCCTGATCCC CGGCGACGGC

 901 CTGACTGTGT CGCAAATCGA GGCGGCTATC AGCAATGTGG ATGGTGTGAT

 951 CGACCTCCGT CTGACTGCGC CGACGGCCAA CCGTGCCGCC GATACGGTTA

1001 ACCGCATCGA GTGGTTTAAA GCGGGCGCGA TTAATGTAAC GGAGATGCCG

1051 TCATGA
```

This corresponds to the amino acid sequence <SEQ ID 2440; ORF 722.a>:

```
a722.pep
   1 VFETPTFEQI RERILRDTKS LWPDADISPD SDHYVHASRL ASCAEGQYAH

  51 QSWIVRQIFP DTADREYLER HASMRGLRRR NPTTASGTLT VSGIAQSMLS

 101 DGLQVRIGQR FYRTTARAVI GSGGTAEIPA IADEPGAAAN VRDGEAQLMA

 151 APAGVSTECR LTVQGGTDRE SDASLLARLL EIIRRPPAGG NRYDYKNWAL

 201 SVDGVTSAYV YPLRRGLGTV DIAITSADGV PSEETVRRVQ AYIDEMRPVT

 251 AKNALVLKPT VTAVPVTVQV KLDGIDLDEA KRRIRTALKE YFDTLIPGDG

 301 LTVSQIEAAI SNVDGVIDLR LTAPTANRAA DTVNRIEWFK AGAINVTEMP

 351 S*
```

```
g723.seq not found yet
g723.pep not found yet
```

The following partial DNA sequence was identified in *N. meningitidis* <SEQ ID 2441>:

```
m723.seq
   1 ATGCGACCCA AGCCCCGTTT CAGACGGTCT GTTATCGCTT GCTCAATATC

  51 AGTGATCACG CCCGAACACC TTATTTTTAC CGTTTACAAA CACAATACCG

 101 TCTTCGCCCG CGGCCACTTC TTCGCCGCTA TCATCCACGC CCAGCTGCAC

 151 TTCGCCTTTG GCCATAGCAC GCAGCAGGTC GAGCACGTCG ATTTTGTAGC

 201 GGTTGCGGAT TTCGTCGGTA ATCAACACGC CCTGAGCCGC CGTCAGACGG

 251 TAGCGGGCAA TGTCGCAGCA AAGGCGCACC AAGATGGGCG GCAGATCCTC

 301 AAAAGGTCGT CTGAACCGCC CCAGATACGC GTCGATTTCG GCAGTGGCGT

 351 CCACCAGCGC GGTTTGTGCG ACCTCGCGGT CAATCAGCCC CTCGTTGTTG

 401 CGGTCGGTGA GCTGCAAGAC TTCCAGCTCA CCGAAACGCG CAACCATATC

 451 CTCAACCGTC GCGTATGCCA TTACTCGACC GCCTTGCGTT GCAGCATAGG

 501 CTCGGCGCAG ATTGCCTTCC ACACCGCTTC GCCGACTTCG GCGCGCTTCA

 551 CTTCGCGCCA GCCGCCGTCA AACAGCAGGC CGCCGCGCCA AAATTCTTTG

 601 CCGTCTGCGC CGGTACTGAC GAGCATCACA TCGCGGCTGT CCGCCAAAGC

 651 GTCGGCGGCA CGTTGCGTAT GCTGCACTTT GAGTTCGGCA AGTTCGGCGG

 701 ACAGTGCCTT TTTGTCGTCT TCGGCTTTTT CCAAGGCTGT GGTCAGCATT

 751 TCGACATCGT TTCGGGCGGC GGCAAGCTCT GCCTGCACGG CGTCCAATTC

 801 GGCTTTGATG TCTTCAAACG ACGGGGCGGC GGTTTCGGCG GTTTCTGGTT

 851 TGTTGTTGGT TTTTGCCATG ATGACTCCTT GTTTCAGACG GCGGCGGATT

 901 CGCATTTGA
```

This corresponds to the amino acid sequence <SEQ ID 2442; ORF 723>:

```
m723.pep
   1 MRPKPRFRRS VIACSISVIT PEHLIFTVYK HNTVFARGHF FAAIIHAQLH

  51 FAFGHSTQQV EHVDFVAVAD FVGNQHALSR RQTVAGNVAA KAHQDGRQIL

 101 KRSSEPPQIR VDFGSGVHQR GLCDLAVNQP LVVAVGELQD FQLTETRNHI

 151 LNRRVCHYST ALRCSIGSAQ IAFHTASPTS ARFTSRQPPS NSRPPRQNSL

 201 PSAPVLTSIT SRLSAKASAA RCVCCTLSSA SSADSAFLSS SAFSKAVVSI

 251 STSFRAAASS ACTASNSALM SSNDGAAVSA VSGLLLVFAM MTPCFRRRRI

 301 RI*

a723.seq not found yet
a723.pep not found yet

g724.seq not found yet
g724.pep not found yet
```

The following partial DNA sequence, shown with its encoded amino acid sequence, was identified in *N. meningitidis* <SEQ ID 2443>:

```
m724.map
     ATGAGTTTGAGTAAATTGGCGAAAAAAACGGCACAAACTGCTAAAAATATCGGCGAAACC
   1 ---------+---------+---------+---------+---------+---------+  60
     TACTCAAACTCATTTAACCGCTTTTTTTGCCGTGTTTGACGATTTTTATAGCCGCTTTGG
a    M  S  L  S  K  L  A  K  K  T  A  Q  T  A  K  N  I  G  E  T   -

     CTGCGCGCGGCCTTTCGGGGAAAAATCACGCTGGTGGTGTCGTCCGAGCCGATACAGCGC
  61 ---------+---------+---------+---------+---------+---------+  120
     GACGCGCGCCGGAAAGCCCCTTTTTAGTGCGACCACCACAGCAGGCTCGGCTATGTCGCG
a    L  R  A  A  F  R  G  K  I  T  L  V  V  S  S  E  P  I  Q  R   -

     GTGCAGTTGAGCGGCTTGGCCGACGAAACCCTGCAAGACCTTGAACATTTGCAGGAATAC
 121 ---------+---------+---------+---------+---------+---------+  180
     CACGTCAACTCGCCGAACCGGCTGCTTTGGGACGTTCTGGAACTTGTAAACGTCCTTATG
a    V  Q  L  S  G  L  A  D  E  T  L  Q  D  L  E  H  L  Q  E  Y   -

     GGCTTTGCCAGCCATCCGCCCGACGGCAGCGAAGCGGTAGTGATACCGCTGGGCGGCAAT
 181 ---------+---------+---------+---------+---------+---------+  240
     CCGAAACGGTCGGTAGGCGGGCTGCCGTCGCTTCGCCATCACTATGGCGACCCGCCGTTA
a    G  F  A  S  H  P  P  D  G  S  E  A  V  V  I  P  L  G  G  N   -

     ACTTCGCACGGTGTGATTGTGTGCAGCCAGCACGGCAGCTACCGCATCAAAAACCTTAAG
 241 ---------+---------+---------+---------+---------+---------+  300
     TGAAGCGTGCCACACTAACACACGTCGGTCGTGCCGTCGATGGCGTAGTTTTTGGAATTC
a    T  S  H  G  V  I  V  C  S  Q  H  G  S  Y  R  I  K  N  L  K   -

     CCCGGCGAGACGGCGATTTTTAATCATGAGGGTGCAAAAATCGTGATTAAGCAAGGCAAA
 301 ---------+---------+---------+---------+---------+---------+  360
     GGGCCGCTCTGCCGCTAAAAATTAGTACTCCCACGTTTTTAGCACTAATTCGTTCCGTTT
a    P  G  E  T  A  I  F  N  H  E  G  A  K  I  V  I  K  Q  G  K   -

     ATCATTGAGGCCGATTGCGACGTGTACCGGGTTAACTGCAAACAATACGAGGTTAATGCG
 361 ---------+---------+---------+---------+---------+---------+  420
     TAGTAACTCCGGCTAACGCTGCACATGGCCCAATTGACGTTTGTTATGCTCCAATTACGC
a    I  I  E  A  D  C  D  V  Y  R  V  N  C  K  Q  Y  E  V  N  A   -

     GCCACGGATGCCAAATTTAACGCTCCGTTGGTGGAGACCAGTGCAGTGTTGACGGCGCAA
 421 ---------+---------+---------+---------+---------+---------+  480
     CGGTGCCTACGGTTTAAATTGCGAGGCAACCACCTCTGGTCACGTCACAACTGCCGCGTT
a    A  T  D  A  K  F  N  A  P  L  V  E  T  S  A  V  L  T  A  Q   -

     GGCCAAATCAACGGCAACGGCGGCATGGCCGTCGAGGGCGGCGACGGAGCCACCTTTAGC
 481 ---------+---------+---------+---------+---------+---------+  540
     CCGGTTTAGTTGCCGTTGCCGCCGTACCGGCAGCTCCCGCCGCTGCCTCGGTGGAAATCG
a    G  Q  I  N  G  N  G  G  M  A  V  E  G  G  D  G  A  T  F  S   -

     GGCGATGTTAACCAAACGGGCGGCAGCTTTAACACCGACGGCGACGTGGTGGCCGGCAAT
 541 ---------+---------+---------+---------+---------+---------+  600
     CCGCTACAATTGGTTTGCCCGCCGTCGAAATTGTGGCTGCCGCTGCACCACCGGCCGTTA
a    G  D  V  N  Q  T  G  G  S  F  N  T  D  G  D  V  V  A  G  N   -
```

-continued

```
     ATATCGTTGCGCCAGCACCCGCATACCGACAGCATCGGCGGCAAAACCTTACCGGCGGAA
 601---------+---------+---------+---------+---------+---------+ 660
     TATAGCAACGCGGTCGTGGGCGTATGGCTGTCGTAGCCGCCGTTTTGGAATGGCCGCCTT
a    I  S  L  R  Q  H  P  H  T  D  S  I  G  G  K  T  L  P  A  E   -

     CCGGCATAG
 661---------                                                    669
     GGCCGTATC
a    P  A  *                                                     -

Enzymes that do cut: NONE
Enzymes that do not cut: BamHI BglII EcoRI HindIII KpnI NdeI NheI
PstI SacI SalI SmaI SphI XbaI XhoI
```

This corresponds to the amino acid sequence <SEQ ID 2444; ORF 724>:

```
m724.pep
  1 MSLSKLAKKT AQTAKNIGET LRAAFRGKIT LVVSSEPIQR VQLSGLADET

 51 LQDLEHLQEY GFASHPPDGS EAVVIPLGGN TSHGVIVCSQ HGSYRIKNLK

101 PGETAIFNHE GAKIVIKQGK IIEADCDVYR VNCKQYEVNA ATDAKFNAPL

151 VETSAVLTAQ GQINGNGGMA VEGGDGATFS GDVNQTGGSF NTDGDVVAGN

201 ISLRQHPHTD SIGGKTLPAE PA*
```

The following partial DNA sequence was identified in *N. meningitidis* <SEQ ID 2445>:

```
a724.seq
  1 ATGAGTTTGA GTAAATTGGC GAAAAAAACG GCACAAACTG CTAAAAATAT

 51 CGGCGAAACC CTGCGCGCGG CCTTTCGGGG AAAAATCACG CTGGTGGTGT

101 CGTCCGAGCC GATACAGCGC GTGCAGTTGA GCGGCTTGGC CGACGAAACC

151 CTGCAAGACC TTGAACATTT GCAGGAATAC GGCTTTGCCA GCCATCCGCC

201 CGACGGCAGC GAAGCGGTAG TGATACCGCT GGGCGGCAAT ACTTCGCACG

251 GTGTGATTGT GTGCAGCCAG CACGGCAGCT ACCGCATCAA AAACCTTAAG

301 CCCGGCGAGA CGGCGATTTT TAATCATGAG GGTGCAAAAA TCGTGATTAA

351 GCAAGGCAAA ATCATTGAGG CCGATTGCGA CGTGTACCGG GTTAACTGCA

401 AACAATACGA GGTTAATGCG GCCACGGATG CCAAATTTAA CGCTCCGTTG

451 GTGGAGACCA GTGCAGTGTT GACGGCGCAA GGCCAAATCA ACGGCAACGG

501 CGGCATGGCC GTCGAGGGCG GCGACGGAGC CACCTTTAGC GGCGATGTTA

551 ACCAAACGGG CGGCAGCTTT AACACCGACG GCGACGTGGT GGCCGGCAAT

601 ATATCGTTGC GCCAGCACCC GCATACCGAC AGCATCGGCG GCAAAACCTT

651 ACCGGCGGAA CCGGCATAG
```

This corresponds to the amino acid sequence <SEQ ID 2446; ORF 724.a>:

```
a724.pep
  1 MSLSKLAKKT AQTAKNIGET LRAAFRGKIT LVVSSEPIQR VQLSGLADET

 51 LQDLEHLQEY GFASHPPDGS EAVVIPLGGN TSHGVIVCSQ HGSYRIKNLK

101 PGETAIFNHE GAKIVIKQGK IIEADCDVYR VNCKQYEVNA ATDAKFNAPL

151 VETSAVLTAQ GQINGNGGMA VEGGDGATFS GDVNQTGGSF NTDGDVVAGN

201 ISLRQHPHTD SIGGKTLPAE PA*
```

a724/m724 100.0% identity in 222 aa overlap

```
                   10        20        30        40        50        60
a724.pep    MSLSKLAKKTAQTAKNIGETLRAAFRGKITLVVSSEPIQRVQLSGLADETLQDLEHLQEY
            ||||||||||||||||||||||||||||||||||||||||||||||||||||||||||||
m724        MSLSKLAKKTAQTAKNIGETLRAAFRGKITLVVSSEPIQRVQLSGLADETLQDLEHLQEY
                   10        20        30        40        50        60

                   70        80        90       100       110       120
a724.pep    GFASHPPDGSEAVVIPLGGNTSHGVIVCSQHGSYRIKNLKPGETAIFNHEGAKIVIKQGK
            ||||||||||||||||||||||||||||||||||||||||||||||||||||||||||||
m724        GFASHPPDGSEAVVIPLGGNTSHGVIVCSQHGSYRIKNLKPGETAIFNHEGAKIVIKQGK
                   70        80        90       100       110       120

                  130       140       150       160       170       180
a724.pep    IIEADCDVYRVNCKQYEVNAATDAKFNAPLVETSAVLTAQGQINGNGGMAVEGGDGATFS
            ||||||||||||||||||||||||||||||||||||||||||||||||||||||||||||
m724        IIEADCDVYRVNCKQYEVNAATDAKFNAPLVETSAVLTAQGQINGNGGMAVEGGDGATFS
                  130       140       150       160       170       180

                  190       200       210       220
a724.pep    GDVNQTGGSFNTGDGVVAGNISLRQHPHTDSIGGKTLPAEPAX
            |||||||||||||||||||||||||||||||||||||||||||
m724        GDVNQTGGSFNTDGDVVAGNISLRQHPHTDSIGGKTLPAEPAX
                  190       200       210       220

g725.seq not found yet
g725.pep not found yet
```

The following partial DNA sequence was identified in *N. meningitidis* <SEQ ID 2447>:

```
m725.seq
   1 ATGGTGCGCA CGGTTAAAAG CTACAACGGC GAGGCCGACG ATTTGGCGGG

  51 GCAAATCCAT ACGCTGCCTG CGGTTTGGGT AACGTATGGC GGCAGCAAAG

 101 TTGAGCCTGC CAGCACCGGC GGCGTATGCG GACGTTATCA GGATACCGCC

 151 GAATTTGTGG TGATGGTGGC GGCCCGCAAT CTGCGCAACG AGCAGGCGCA

 201 GCGGCAAGGC GGCATCGACA GCCGCGAAAT CGGCAGCAAC GATTTAATCC

 251 GCGCTGTTCG CCGCCTGCTT GACGGCCAGC GGCTCGGTTT TGCCGATAGC

 301 CGCGGCTTGG TGCCCAAAGC GGTGCGCGCG ATTGCCAATC ATGTGCTGGT

 351 GCAAAACGCC GCAGTAAGCA TATATGCGGT TGAGTATGCC ATCCGCTTTA

 401 ACACCTGCGG GTTGGAAAAT GACCGCTACC CCGAACGCAC CGACAATCCC

 451 GACGACCCCA ACCATATCTT TACCAAGTAT CAGGGTACAT TGAGCGAGCC

 501 GTGGCCTGAT TTCGAGGGGT TGGACGGCAA AATTTACGAC CCGCAATCCG

 551 CCGATGAAAT ACCTGTAAAC CTAACCCTTA AGGATAAGCA ATGA
```

This corresponds to the amino acid sequence <SEQ ID 2448; ORF 725>:

```
m725.pep
   1 MVRTVKSYNG EADDLAGQIH TLPAVWVTYG GSKVEPASTG GVCGRYQDTA

  51 EFVVMVAARN LRNEQAQRQG GIDSREIGSN DLIRAVRRLL DGQRLGFADS

 101 RGLVPKAVRA IANHVLVQNA AVSIYAVEYA IRFNTCGLEN DRYPERTDNP

 151 DDPNHIFTKY QGTLSEPWPD FEGLDGKIYD PQSADEIPVN LTLKDKQ*

a725.seq not found yet

a725.pep not found yet

g726.seq not found yet

g726.pep not found yet
```

The following partial DNA sequence was identified in *N. meningitidis* <SEQ ID 2449>:

```
m726.seq
    1 ATGACCATCT ATTTCAAAAA CGGCTTTTAC GACGACACAT TGGGCGGCAT

   51 CCCCGAAGGC GCGGTTGCCG TCCGCGCCGA AGAATACGCC GCCCTTTTGG

  101 CAGGACAGGC GCAGGGCGGG CAGATTGCCG CAGATTCCGA CGGCCGCCCC

  151 GTTTTAACCC CGCCGCGCCC GTCCGATTAC CACGAATGGG ACGGCAAAAA

  201 ATGGAAAATC AGCAAAGCCG CCGCCGCCGC CCGTTTCGCC AAACAAAAAA

  251 CCGCCTTGGC ATTCCGCCTC GCGGAAAAGG CGGACGAACT CAAAAACAGC

  301 CTCTTGGCGG GCTATCCCCA AGTGGAAATC GACAGCTTTT ACAGGCAGGA

  351 AAAAGAAGCC CTCGCGCGGC AGGCGGACAA CAACGCCCCG ACCCCGATGC

  401 TGGCGCAAAT CGCCGCCGCA AGGGGCGTGG AATTGGACGT TTTGATTGAA

  451 AAAGTTATCG AAAAATCCGC CCGCCTGGCT GTTGCCGCCG GCGCGATTAT

  501 CGGAAAGCGT CAGCAGCTCG AAGACAAATT GAACACCATC GAAACCGCGC

  551 CCGGATTGGA CGCGCTGGAA AAGGAAATCG AAGAATGGAC GCTAAACATC

  601 GGCTGA
```

This corresponds to the amino acid sequence <SEQ ID 2450; ORF 726>:

```
m726.pep
    1 MTIYFKNGFY DDTLGGIPEG AVAVRAEEYA ALLAGQAQGG QIAADSDGRP

   51 VLTPPRPSDY HEWDGKKWKI SKAAAAARFA KQKTALAFRL AEKADELKNS

  101 LLAGYPQVEI DSFYRQEKEA LARQADNNAP TPMLAQIAAA RGVELDVLIE

  151 KVIEKSARLA VAAGAIIGKR QQLEDKLNTI ETAPGLDALE KEIEEWTLNI

  201 G*
```

The following partial DNA sequence was identified in *N. meningitidis* <SEQ ID 2451>:

```
a726.seq
    1 ATGACCATCT ATTTCAAAAA CGGCTTTTAC GACGACACCT TGGGCAGCAT

   51 CCCCGAAGGC GCGGTTGCCG TCCGCGCCGA AGAATACGCC GCCCTTTTGG

  101 CAGGACAGGC GCAGGGCGGG CAGATTGCCG CAGATTCCGA CGGCCGCCCC

  151 GTTTTAACCC CGCCGCGCCC GTCCGAATAC CACGAATGGG ACGGCAAGAA

  201 ATGGGAAATC GGCGAAGCCG CTGCCGCCGC CCGTTTCGCC GAACAAAAAA

  251 CCGCCACGGC ATTCCGCCTC GCGGCAAAGG CGGACGAACT CAAAAACAGC

  301 CTCTTGGCGG GCTATCCCCA AGTGGAAATC GACAGCTTTT ACAGGCAGGA

  351 AAAAGAAGCC CTCGCGCGGC AGGCGGACAA CAACGCCCCG ACCCCGATGC

  401 TGGCGCAAAT CGCCGCCGCA AGGGGCGTGG AATTGGACGT TTTGATTGAA

  451 AAAGTTGTCG AAAAATCCGC CCGCCTGGCC GTTGCCGCCG GCGCGATTAT

  501 CGGAAAGCGG CAGCAGCTCG AAGACAAATT GAACACCATC GAAACCGCGC

  551 CAGGATTGGA CGCGCTGGAA AAGGAAATCG AAGAATGGAC GCTAAACATC

  601 GGCTGA
```

This corresponds to the amino acid sequence <SEQ ID 2452; ORF 726.a>:

```
a726.pep
   1 MTIYFKNGFY DDTLGSIPEG AVAVRAEEYA ALLAGQAQGG QIAADSDGRP

  51 VLTPPRPSEY HEWDGKKWEI GEAAAAARFA EQKTATAFRL AAKADELKNS

 101 LLAGYPQVEI DSFYRQEKEA LARQADNNAP TPMLAQIAAA RGVELDVLIE

 151 KVVEKSARLA VAAGAIIGKR QQLEDKLNTI ETAPGLDALE KEIEEWTLNI

 201 G*
```

a726/m726 95.5% identity in 201 aa overlap

```
                    10        20        30        40        50        60
a726.pep    MTIYFKNGFYDDTLGSIPEGAVAVRAEEYAALLAGQAQGGQIAADSDGRPVLTPPRPSEY
            ||||||||||||||:|||||||||||||||||||||||||||||||||||||||||||:|
m726        MTIYFKNGFYDDTLGGIPEGAVAVRAEEYAALLAGQAQGGQIAADSDGRPVLTPPRPSDY
                    10        20        30        40        50        60

                    70        80        90       100       110       120
a726.pep    HEWDGKKWEIGEAAAAARFAEQKTATAFRLAAKADELKNSLLAGYPQVEIDSFYRQEKEA
            ||||||||:|::||||||||:|||| ||||| ||||||||||||||||||||||||||||
m726        HEWDGKKWKISKAAAAARFAKQKTALAFRLAEKADELKNSLLAGYPQVEIDSFYRQEKEA
                    70        80        90       100       110       120

                   130       140       150       160       170       180
a726.pep    LARQADNNAPTPMLAQIAAARGVELDVLIEKVVEKSARLAVAAGAIIGKRQQLEDKLNTI
            |||||||||||||||||||||||||||||||:||||||||||||||||||||||||||||
m726        LARQADNNAPTPMLAQIAAARGVELDVLIEKVIEKSARLAVAAGAIIGKRQQLEDKLNTI
                   130       140       150       160       170       180

                   190       200
a726.pep    ETAPGLDALEKEIEEWTLNIGX
            ||||||||||||||||||||||
m726        ETAPGLDALEKEIEEWTLNIGX
                   190       200

g727.seq not found yet

g727.pep not found yet
```

The following partial DNA sequence was identified in *N. meningitidis* <SEQ ID 2453>:

```
m727.seq
   1 ATGAATCTCG TGAAACTGCT GGCGAATAAC TGGCAACCGA TTGCCATTAT

  51 CGCGCTTGTC GGCACGGGCT TGGCTGTGTC GCACCATCAA GGCTACAAGT

 101 CGGCATTTGC GAAGCAGCAG GCGGTCATCG ACAAGATGGA GCGCGACAAG

 151 GCGCAAGCCC TGCTGTTGTC GGCTCAAAAC TATGCGCGCG AACTGGAACT

 201 GGCACGCGCG GAAGCTAAAA AATATGAAGT CAAGGCGCAC GCTGTCGGCA

 251 TGGCTTTGGC GAAAAAACAG GCGGAAGTCA GCCGTCTGAA AACGGAAAGA

 301 GACCTTTGCA AAATTCCTTT CCCTCCCGAC AGCCGAAACC CAAACACAGG

 351 TTTTCGGCTG TTTTCGCCCC AAATACCGCC TAATTTTACC CAAATACCCC

 401 CTTAA
```

This corresponds to the amino acid sequence <SEQ ID 2454; ORF 727>:

```
m727.pep
   1 MNLVKLLANN WQPIAIIALV GTGLAVSHHQ GYKSAFAKQQ AVIDKMERDK

  51 AQALLLSAQN YARELELARA EAKKYEVKAH AVGMALAKKQ AEVSRLKTER

 101 DLCKIPFPPD SRNPNTGFRL FSPQIPPNFT QIPP*
```

The following partial DNA sequence was identified in *N. meningitidis* <SEQ ID 2455>:

```
a727.seq
   1 ATGAATCTCG TGAAACTGCT GGCGAATAAC TGGCAACCGA TTGCCATCAT

  51 CGCGCTTGTC GGCACGGGTT TGGCGGTGTC GCACCATCAA GGCTACAAGT

 101 CGGCTTTTGC GAAGCAGCAG GCGGTCATTG AGAAAATGAA GCGCGACAAG

 151 GCGCAAGCCC TGCTGTTGTC GGCTCAAAAC TACGCCCGCG AACTGGAACA

 201 GGCGCGTGCG GAAGCTAAAA AATATGAAGT CAAGGCGCAC GCCGTCGGCA

 251 TGGCTTTGGC GAAAAAACAG GCGGAAGTCA GCCGTCTGAA AACGGAAAAT

 301 AAAAAGGAAA TCGAAAATGT CCTTACTCAA GACCGTAAAA ATGCAGGCGG

 351 CGGTTGTATT GACGGCTTTG GCCATCACGG CTTGCAGCTC TACAAGCGCG

 401 CCCTCGGCTA CGGAAATTAA
```

This corresponds to the amino acid sequence <SEQ ID 2456; ORF 727.a>:

```
a727.pep
   1 MNLVKLLANN WQPIAIIALV GTGLAVSHHQ GYKSAFAKQQ AVIEKMKRDK

  51 AQALLLSAQN YARELEQARA EAKKYEVKAH AVGMALAKKQ AEVSRLKTEN

 101 KKEIENVLTQ DRKNAGGGCI DGFGHHGLQL YKRALGYGN*
```

a727/m727 83.2% identity in 119 aa overlap

```
                   10        20        30        40        50        60
a727.pep   MNLVKLLANNWQPIAIIALVGTGLAVSHHQGYKSAFAKQQAVIEKMKRDKAQALLLSAQN
           ||||||||||||||||||||||||||||||||||||||||||:||:||||||||||||||
m727       MNLVKLLANNWQPIAIIALVGTGLAVSHHQGYKSAFAKQQAVIDKMERDKAQALLLSAQN
                   10        20        30        40        50        60

                   70        80        90       100       110      119
m717.pep   YARELEQARAEAKKYEVKAHAVGMALAKKQAEVSRLKTENKKEIENV-LTQDRKNAGGGC
           |||||| |||||||||||||||||||||||||||||||  ::: :: :  | :| : |
g717       YARELELARAEAKKYEVKAHAVGMALAKKQAEVSRLKTE--RDLCKIPFPPDSRNPNTGF
                     70        80        90          100       110

           120       130       140
m717.pep     IDGFGHHGLQLYKRALGYGNX

g717         RLFSPQIPPNFTQIPPX
            120       130
```

The following partial DNA sequence was identified in *N. gonorrhoeae* <SEQ ID 2457>:

```
g728.seq
    1  ATGTTTAAAA AATTCAAACC GGTACTGTTG TCATTTTTTG CACTTGTATT

   51  TGCCTTTTGG CTGGGAACAG GTATTGCCTA TGAGATTAAT CCGCGTTGGT

  101  TTTTGAGCGA TACGGCAACT GAAGTACCTG AAAATCCGAA TGCTTTTGTG

  151  GCGAAACTTG CCCGCCTGTT CCGAAATGCC GACAGGGCGG TTGTCATCGT

  201  GAAGGAATCG ATGAGGACGG AGGAAAGCCT TGCCGGAGCT GTGGATGACG

  251  GTCCGTTGCA GTCGGAGAAG GATTATCTCG CGCTCGCTAT CCGGCTCAGT

  301  CGTTTGAAAG AAAAGGCGAA ATGGTTTCAC GTAACGGAGC AGGAACATGG

  351  GGAAGAGGTT TGGCTGGATT ACTATATCGG CGAGGGCGGT TTGGTTGCGG

  401  TTTCGCTTTC GCAACGCTCG CCGGAAGCGT TTGTTAATGC CGAATATCTG

  451  TATCGGAACG ATCGTCCGTT TTCTGTAAAT GTGTACGGCG GAACGGCTCA

  501  CGGGGAAAAT TATGAAACGA CAGGAGAATA TCGGGTTGTT TGGCAACCGG
```

-continued

```
 551 ACGGTTCGGT ATTTGATGCG GCGGGGCGCG GGAAAATCGG GGAAGATGTT

 601 TATGAGCATT GCCTCGGGTG TTATCAGATG GCCCAGGTAT ATTTGGCGAA

 651 ATACCGGGAT GTCGCGAATG ACGAGCAGAA GGTTTGGGAC TTCCGCGAAG

 701 AGAGCAACCG GATTGCATCG GACTCGCGCG ATTATGTGTT TTATCAGAAT

 751 ATGCGGGAAT TGATGCCCCG GGGGATGAAG GCGAACAGTC TTGTGGTCGG

 801 CTATGATGCG GACGGTCTGC CGCAAAAAGT CTATTGGAGT TTCGACAATG

 851 GAAAAAAACG CCAGAGTTTC GAATATTATT TGAAAAACGG AAATCTTTTT

 901 ATTGCACAAT CTTCGACGGT AGCATTGAAA GCGGATGGCG TAACGGCGGA

 951 TATGCAGACC TATCATGCGC AACAGACGTG GTATTTGGAT GGCGGGCGGA

1001 TTATCCGCGA AGAGAAACAG GGAGACAGAC TGCCTGATTT TCCTTTGAAC

1051 TTGGAAGATT TGGAAAAAGA GGTGAGCCGT TATGCAGAGG CTGCGGCGAG

1101 ACGTTCGGGC GGCAGGCGCG GCCTTTCTCA CTGA
```

This corresponds to the amino acid sequence <SEQ ID 2458; ORF 728>:

```
g728.pep
  1 MFKKFKPVLL SFFALVFAFW LGTGIAYEIN PRWFLSDTAT EVPENPNAFV

 51 AKLARLFRNA DRAVVIVKES MRTEESLAGA VDDGPLQSEK DYLALAIRLS

101 RLKEKAKWFH VTEQEHGEEV WLDYYIGEGG LVAVSLSQRS PEAFVNAEYL

151 YRNDRPFSVN VYGGTAHGEN YETTGEYRVV WQPDGSVFDA AGRGKIGEDV

201 YEHCLGCYQM AQVYLAKYRD VANDEQKVWD FREESNRIAS DSRDYVFYQN

251 MRELMPRGMK ANSLVVGYDA DGLPQKVYWS FDNGKKRQSF EYYLKNGNLF

301 IAQSSTVALK ADGVTADMQT YHAQQTWYLD GGRIIREEKQ GDRLPDFPLN

351 LEDLEKEVSR YAEAAARRSG GRRGLSH*
```

The following partial DNA sequence was identified in *N. meningitidis* <SEQ ID 2459>:

```
m728.seq
  1  ATGTTTAAAA AATTCAAACC GGTACTGTTG TCATTTTTTG CACTTGTATT

 51  TGCCTTTTGG CTGGGAACGG GTATTGCCTA TGAGATTAAT CCGCGTTGGT

101  TTTTGAGCGA TACGGCAACT GAAGTACCTA AAAATCCGAA TGCTTTTGTG

151  GCGAAACTTG CCCGCCTGTT CCGAAATGCC GACAGGGCGG TTGTCATCGT

201  GAAGGAATCG ATAAGGACGG AGGAAAATCT TGCCGGAACT GTGGATGACG

251  GTCCGTTGCA GTCGGAGAAG GATTATCTCG CGCTCGCTAT CCGGCTCAGT

301  CGTTTGAAAG AAAAGGCGAA ATGGTTTCAC GTAACGGAGC AGGAACATGG

351  GAAAGAGGTT TGGCTGGATT ACCATATCGG CGAGGGCGGT TTGGTTGCGG

401  TTTCGCTTTC GCAACGCTCG CCGGAAGCAT TTGTTAATGC CGAATATCTG

451  TATCGGAACG ATCGTCCGTT TTCTGTAAAT GTGTACGGCG GAACGGTTCA

501  CGGGGAAAAT TATGAAACGA CAGGAGAATA TCGGGTTGTT TGGCAACCAG

551  ACGGTTCGGT ATTTGATGCG GCGGGGCGCG GGAAAATCGG GGAAGATGTT

601  TATGAGCATT GCCTCGGGTG TTATCAGATG GCCCAGGTAT ATTTGGCGAA

651  ATACCGGGAT GTCGCGAATG ACGAGCAGAA GGTTTGGGAC TTCCGCAAAG
```

-continued

```
 701 AGAGCAACCG AATTGCGTCG GACTCGCGCA ATTCTGTGTT TTATCAGAAT

 751 ATGCGGGAAT TGATGCCCCG AGGGATGAAG GCGAACAGTC TTGTGGTCGG

 801 CTATGATGCG GACGGTCTGC CGCAAAAAGT CTATTGGAGT TTCGACAATG

 851 GAAAAAAACG CCAGAGTTTC GAATATTATT TGAAAAACGG AAATCTTTTT

 901 ATTGCACAAT CTTCGACGGT AGCATTGAAA GCGGATGGCG TAACGGCGGA

 951 TATGCAGACC TATCATGCGC AACAGACGTG GTATTTGGAT GGCGGGCGGA

1001 TTGTCCGCGA AGAGAAACAG GGAGACAGAC TGCCTGATTT TCCTTTGAAC

1051 TTGGAAAATT TGGAAAAAGA GGTGCGCCGT TATGCAGAGG CTGCGGCGAG

1101 ACGTTCGGGC GGCAGGCGCG ACCTTTCTCA CTGA
```

This corresponds to the amino acid sequence <SEQ ID 2460; ORF 728>:

```
m728.pep
  1 MFKKFKPVLL SFFALVFAFW LGTGIAYEIN PRWFLSDTAT EVPKNPNAFV

 51 AKLARLFRNA DRAVVIVKES IRTEENLAGT VDDGPLQSEK DYLALAIRLS

101 RLKEKAKWFH VTEQEHGKEV WLDYHIGEGG LVAVSLSQRS PEAFVNAEYL

151 YRNDRPFSVN VYGGTVHGEN YETTGEYRVV WQPDGSVFDA AGRGKIGEDV

201 YEHCLGCYQM AQVYLAKYRD VANDEQKVWD FRKESNRIAS DSRNSVFYQN

251 MRELMPRGMK ANSLVVGYDA DGLPQKVYWS FDNGKKRQSF EYYLKNGNLF

301 IAQSSTVALK ADGVTADMQT YHAQQTWYLD GGRIVREEKQ GDRLPDFPLN

351 LENLEKEVRR YAEAAARRSG GRRDLSH*
```

Computer analysis of the amino acid sequences gave the following results:

Homology with a Predicted ORF from *N. meningitidis* menA with menB ORF 728 shows 96.3% identity over a 377 aa overlap with a predicted ORF (ORF728.a) from *N. gonorrhoeae*:

```
m728/g728

                   10        20        30        40        50        60
m728.pep   MFKKFKPVLLSFFALVFAFWLGTGIAYEINPRWFLSDTATEVPKNPNAFVAKLARLFRNA
           |||||||||||||||||||||||||||||||||||||||||||:||||||||||||||||
g728       MFKKFKPVLLSFFALVFAFWLGTGIAYEINPRWFLSDTATEVPENPNAFVAKLARLFRNA
                   10        20        30        40        50        60

                   70        80        90       100       110       120
m728.pep   DRAVVIVKESIRTEENLAGTVDDGPLQSEKDYLALAIRLSRLKEKAKWFHVTEQEHGKEV
           ||||||||||:||||:|||:|||||||||||||||||||||||||||||||||||||:||
g728       DRAVVIVKESMRTEESLAGAVDDGPLQSEKDYLALAIRLSRLKEKAKWFHVTEQEHGEEV
                   70        80        90       100       110       120

                  130       140       150       160       170       180
m728.pep   WLDYHIGEGGLVAVSLSQRSPEAFVNAEYLYRNDRPFSVNVYGGTVHGENYETTGEYRVV
           ||||:||||||||||||||||||||||||||||||||||||||||:||||||||||||||
g728       WLDYYIGEGGLVAVSLSQRSPEAFVNAEYLYRNDRPFSVNVYGGTAHGENYETTGEYRVV
                  130       140       150       160       170       180

                  190       200       210       220       230       240
m728.pep   WQPDGSVFDAAGRGKIGEDVYEHCLGCYQMAQVYLAKYRDVANDEQKVWDFRKESNRIAS
           ||||||||||||||||||||||||||||||||||||||||||||||||||||:|||||||
g728       WQPDGSVFDAAGRGKIGEDVYEHCLGCYQMAQVYLAKYRDVANDEQKVWDFREESNRIAS
                  190       200       210       220       230       240

                  250       260       270       280       290       300
m728.pep   DSRNSVFYQNMRELMPRGMKANSLVVGYDADGLPQKVYWSFDNGKKRQSFEYYLKNGNLF
           |||: |||||||||||||||||||||||||||||||||||||||||||||||||||||||
g728       DSRDYVFYQNMRELMPRGMKANSLVVGYDADGLPQKVYWSFDNGKKRQSFEYYLKNGNLF
                  250       260       270       280       290       300
```

-continued

```
                310        320        330        340        350        360
m728.pep   IAQSSTVALKADGVTADMQTYHAQQTWYLDGGRIVREEKQGDRLPDFPLNLENLEKEVRR
           ||||||||||||||||||||||||||||||||||:||||||||||||||||:||||| |
g728       IAQSSTVALKADGVTADMQTYHAQQTWYLDGGRIIREEKQGDRLPDFPLNLEDLEKEVSR
                310        320        330        340        350        360

                370
m728.pep   YAEAAARRSGGRRDLSHX
           ||||||||||||| ||||
g728       YAEAAARRSGGRRGLSHX
                370
```

The following partial DNA sequence was identified in *N. meningitidis* <SEQ ID 2461>:

```
a728.seq
   1 ATGTTTAAAA AATTCAAACC GGTACTGTTG TCATTTTTTG CACTTGTATT
  51 TGCCTTTTGG CTGGGAACGG GTATTGCCTA TGAGATTAAT CCGCGTTGGT
 101 TTTTGAGCGA TACGGCAACT GAAAATCCGA ATGCTTTTGT GGCGAAACTT
 151 GCCCGCCTGT TCCGAAATGC CGACAGGGCG GTTGTCATCG TGAAGGAATC
 201 GATGAGGACG GAGGAAAGTC TTGCCGGAGC TGTGGATGAC GGTCCGTTGC
 251 AGTCGGAGAA GGATTATCTT GCACTCGCTG TCCGGCTCAG TCGTTTGAAA
 301 GAAAAGGCGA AATGGTTTCA CGTAACGGAG CAGGAACATG GGGAAGAGGT
 351 TTGGCTGGAT TACTATATCG GCGAGGGCGG TTTGGTTGCG GTTTCGCTTT
 401 CGCAACGCTC GCCGGAAGCG TTTGTTAATG CCGAATATCT GTATCGGAAC
 451 GATCGTCCGT TTTCTGTAAA TGTGTACGGC GGAACGGTTC ACGGGGAAAA
 501 TTATGAAACG ACAGGAGAAT ATCGGGTTGT TTGGCAACCG GACGGTTCGG
 551 TATTTGATGC GTCGGGGCGC GGGAAAATCG GGGAAGATGT TTATGAGCAT
 601 TGCCTCGGGT GTTATCAGAT GGCCCAGGTA TATTTGGCGA AATATCGGGA
 651 TGTCGCGAAT GATGAGCAGA AGGTTTGGGA CTTCCGCGAA GAGAGTAACC
 701 GGATTGCGTC GGACTCGCGC GATTCTGTGT TTTATCAGAA TATGCGGGAA
 751 TTGATGCCCC GAGGGATGAA GGCAAACAGT CTTGTGGTCG GCTATGATGC
 801 GGACGGTCTG CCGCAGAAAG TCTATTGGAG TTTCGACAAT GGGAAAAAAC
 851 GCCAGAGTTT CGAATATTAT TTGAAAAACG GAAATCTTTT TATTGCACAA
 901 TCTTCGACGG TAGCATTGAA AGCGGATGGC GTAACGGCGG ATATGCAGAC
 951 CTATCATGCG CAACAGACGT GGTATTTAGA TGGCGGGCGG ATTGTCCGCG
1001 AAGAGAAACA GGGGGACAGA CTGCCTGATT TTCCTTTGAA CTTGGAAGAT
1051 TTGGAAAAAG AGGTGAGCCG TTATGCAGAG GCTGCGGCGA GACGTTCGGG
1101 CGGCAGGCGC GACCTTTCTC ACTGA
```

This corresponds to the amino acid sequence <SEQ ID 2462; ORF 728.a>:

```
a728.pep
  1 MFKKFKPVLL SFFALVFAFW LGTGIAYEIN PRWFLSDTAT ENPNAFVAKL
 51 ARLFRNADRA VVIVKESMRT EESLAGAVDD GPLQSEKDYL ALAVRLSRLK
101 EKAKWFHVTE QEHGEEVWLD YYIGEGGLVA VSLSQRSPEA FVNAEYLYRN
151 DRPFSVNVYG GTVHGENYET TGEYRVVWQP DGSVFDASGR GKIGEDVYEH
201 CLGCYQMAQV YLAKYRDVAN DEQKVWDFRE ESNRIASDSR DSVFYQNMRE
```

-continued

```
251 LMPRGMKANS LVVGYDADGL PQKVYWSFDN GKKRQSFEYY LKNGNLFIAQ

301 SSTVALKADG VTADMQTYHA QQTWYLDGGR IVREEKQGDR LPDFPLNLED

351 LEKEVSRYAE AAARRSGGRR DLSH*
```

a728/m728 96.3% identity in 377 aa overlap

```
                10        20        30        40             50
a728.pep  MFKKFKPVLLSFFALVFAFWLGTGIAYEINPRWFLSDTATE---NPNAFVAKLARLFRNA
          |||||||||||||||||||||||||||||||||||||||||   ||||||||||||||||
m728      MFKKFKPVLLSFFALVFAFWLGTGIAYEINPRWFLSDTATEVPKNPNAFVAKLARLFRNA
                10        20        30        40        50        60

           60        70        80        90       100       110
a728.pep  DRAVVIVKESMRTEESLAGAVDDGPLQSEKDYLALAVRLSRLKEKAKWFHVTEQEHGEEV
          |||||||||:||||:|||:|||||||||||||||||:|||||||||||||||||||||:||
m728      DRAVVIVKESIRTEENLAGTVDDGPLQSEKDYLALAIRLSRLKEKAKWFHVTEQEHGKEV
                70        80        90       100       110       120

          120       130       140       150       160       170
a728.pep  WLDYYIGEGGLVAVSLSQRSPEAFVNAEYLYRNDRPFSVNVYGGTVHGENYETTGEYRVV
          ||||:|||||||||||||||||||||||||||||||||||||||||||||||||||||||
m728      WLDYHIGEGGLVAVSLSQRSPEAFVNAEYLYRNDRPFSVNVYGGTVHGENYETTGEYRVV
                130       140       150       160       170       180

          180       190       200       210       220       230
a728.pep  WQPDGSVFDASGRGKIGEDVYEHCLGCYQMAQVYLAKYRDVANDEQKVWDFREESNRIAS
          ||||||||||:|||||||||||||||||||||||||||||||||||||||||:|||||||
m728      WQPDGSVFDAAGRGKIGEDVYEHCLGCYQMAQVYLAKYRDVANDEQKVWDFRKESNRIAS
                190       200       210       220       230       240

          240       250       260       270       280       290
a728.pep  DSRDSVFYQNMRELMPRGMKANSLVVGYDADGLPQKVYWSFDNGKKRQSFEYYLKNGNLF
          |||:||||||||||||||||||||||||||||||||||||||||||||||||||||||||
m728      DSRNSVFYQNMRELMPRGMKANSLVVGYDADGLPQKVYWSFDNGKKRQSFEYYLKNGNLF
                250       260       270       280       290       300

          300       310       320       330       340       350
a728.pep  IAQSSTVALKADGVTADMQTYHAQQTWYLDGGRIVREEKQGDRLPDFPLNLEDLEKEVSR
          |||||||||||||||||||||||||||||||||||||||||||||||||||:||||| |
m728      IAQSSTVALKADGVTADMQTYHAQQTWYLDGGRIVREEKQGDRLPDFPLNLENLEKEVRR
                310       320       330       340       350       360

          360       370
a728.pep  YAEAAARRSGGRRDLSHX
          ||||||||||||||||||
m728      YAEAAARRSGGRRDLSHX
                370
```

The following partial DNA sequence was identified in *N. gonorrhoeae* <SEQ ID 2463>:

```
g729.seq
    1  ATGAATACTA CATTGAAAAC TACCTTGACC TCTGTTGCAG CAGCCTTTGC

   51  ATTGTCTGCC TGCACCATGA TTCCTCAATA CGAGCAGCCC AAAGTCGAAG

  101  TTGCGGAAAC CTTCCAAAAC GACACATCGG TTTCTTCCAT CCGCGCGGTT

  151  GATTTGGGTT GGCATGACTA TTTTGCCGAC CCGCGCCTGC AAAAGCTGAT

  201  CGACATCGCA CTCGAGCGCA ATACCAGTTT GCGTACAGCC GTATTGAACA

  251  GCGAAATCTA CCGCAAACAA TACATGATCG AGCGCAACAA CCTCCTGCCC

  301  ACGCTTGCCG CCAATGCGAA CGGCTCGCGC CAAGGCAGCT TGAGCGGCgg

  351  caaTGTCAGC AGCAGCTACA ATGTCGGACT GGGTGcGGca tCTTACGAAC

  401  TCGATCTGTT CgGGCGCGTG CGCagcaacA GcgaagcAGC ACTGcaggGC

  451  tATTTTGCCA GCGTTGCCAA CcgcGATGCG GCACATTTGa ttCtGATTGC

  501  CACCGTTGCC AAAGCCTATT TCAAcgaGcG TTATGCCGAA AAAGcgatgT

  551  CTTTGGCGCa gcGTGTCTTG AAAACGCGCG AGGAAACCTA CAAGCTGTCC

  601  GAATTGCGGT ACAAGGCAGG CGTGATTTCC GCCGTCGCCC TGCGCCAGCA

  651  GGAAGCCTTG ATTGAATCTG CCAAAGCCGA TTATGCCCAT GCCGCGCGCa

  701  gcCGCGAACA GGCGCGCAAT GCCTTGGCAA CCTTGATTAA ccGTCCGATA
```

-continued

```
751  CCCGAagaCC TGCCCGCCGG TTTGCCGTTG GACAagcAGT TTTTTGTTGA
801  AAAACTGCCT GCCGGTTTGA GTTCCGAAGT ATTGCTCGAC CGTCCCGACA
851  TCCGCGCCGC CGAACACGCG CTCAAACAGG CAAACGCCAA TATCGGTGCG
901  gcgCGCGCCg ccTTTTTCCC GTCCATCCGC CTGACCGGAA GCGTCGGTAC
951  GGGTTCTGTC GAATTGGGCG GGCTGTTCAA AAGCGGCACG GGCGTTTGGG
1001 CGTTCGCTCC GTCTATTACC CTGCCGATTT TTACTTGGGG AACGAACAAG
1051 GCGAACCTTG ATGTGGCAAA ACTGCGCCAA CAGGCACAAA TTGTTGCCTA
1101 TGAATCCGCC GTCCAATCCG CCTTTCAAGA CGTGGCAAAC GCATTGGCGG
1151 CGCGCGAGCA GCTGGATAAA GCCTATGACG CTTTAAGCAA ACAAAGCCGC
1201 GCCTCTAAAG AAGCGTTGCG CTTGGTCGGA CTGCGTTACA AACACGGCGT
1251 ATCCGGCGCG CTCGATTTGC TCGATGCGGA ACGCATCAGC TATTCGGCGG
1301 AAGGTGCGGC TTTGTCGGCA CAACTGACCC GCGCCGAAAA CCTTGCCGAT
1351 TTGTACAAGG CGCTCgacGG CGGATTGAAA CGGGATACCC AAACCGGCAA
1401 ATAA
```

This corresponds to the amino acid sequence <SEQ ID 2464; ORF 729>:

```
g729.pep
  1 MNTTLKTTLT SVAAAFALSA CTMIPQYEQP KVEVAETFQN DTSVSSIRAV
 51 DLGWHDYFAD PRLQKLIDIA LERNTSLRTA VLNSEIYRKQ YMIERNNLLP
101 TLAANANGSR QGSLSGGNVS SSYNVGLGAA SYELDLFGRV RSNSEAALQG
151 YFASVANRDA AHLILIATVA KAYFNERYAE KAMSLAQRVL KTREETYKLS
201 ELRYKAGVIS AVALRQQEAL IESAKADYAH AARSREQARN ALATLINRPI
251 PEDLPAGLPL DKQFFVEKLP AGLSSEVLLD RPDIRAAEHA LKQANANIGA
301 ARAAFFPSIR LTGSVGTGSV ELGGLFKSGT GVWAFAPSIT LPIFTWGTNK
351 ANLDVAKLRQ QAQIVAYESA VQSAFQDVAN ALAAREQLDK AYDALSKQSR
401 ASKEALRLVG LRYKHGVSGA LDLLDAERIS YSAEGAALSA QLTRAENLAD
451 LYKALDGGLK RDTQTGK*
```

The following partial DNA sequence was identified in *N. meningitidis* <SEQ ID 2465>:

```
m729.seq
  1  ATGGATACTA CATTGAAAAC CACCTTGACT TCTGTTGCAG CAGCCTTTGC
 51  ATTGTCTGCC TGCACCATGA TTCCCCAATA CGAGCAGCCC AAAGTCGAAG
101  TTGCCGAAAC GTTCAAAAAC GATACCGCCG ACAGCGGCAT CCGCGCCGTC
151  GATTTAGGTT GGCATGACTA TTTTGCCGAC CCGCGCCTGC AAAAGCTGAT
201  CGACATCGCA CTCGAGCGCA ATACCAGTTT GCGTACCGCC GTATTGAACA
251  GCGAAATCTA CCGCAAACAA TACATGATTG AGCGCAACAA CCTCCTGCCC
301  ACGCTTGCCG CCAATGCGAA CGACTCGCGC CAAGGCAGCT TGAGCGGCGG
351  CAATGTAAGC AGCAGCTACA AAGTCGGACT GGGTGCGGCA TCTTACGAAC
401  TCGATCTGTT CGGGCGTGTA CGCAGCAGCA GCGAGGCGGC ACTGCAAGGC
451  TATTTCGCCA GCACCGCCAA CCGCGATGCG GCACATTTGA GCCTGATTGC
```

-continued

```
 501 CACCGTTGCC AAAGCCTATT TCAACGAACG TTACGCCGAA GAAGCGATGT
 551 CTTTGGCGCA ACGTGTTTTG AAAACGCGCG AGGAAACCTA CAAGCTGTCC
 601 GAATTACGTT ACAAGGCAGG CGTGATTTCC GCCGTCGCCC TACGTCAGCA
 651 GGAAGCCCTG ATCGAATCTG CCAAAGCCGA TTATGCCCAT GCCGCGCGCA
 701 GCCGCGAACA GGCGCGCAAT GCCTTGGCAA CCTTGATTAA CCAACCGATA
 751 CCCGAAGACC TGCCTGCCGG TTTGCCGCTG GACAAGCAGT TTTTTGTTGA
 801 AAAACTGCCG GCCGGTTTGA GTTCCGAAGT ATTGCTCGAC CGTCCCGATA
 851 TCCGTGCTGC CGAACACGCG CTCAAACAGG CAAACGCCAA TATCGGTGCG
 901 GCACGCGCCG CCTTTTTCCC ATCCATCCGC CTGACCGGAA CCGTCGGTAC
 951 GGGTTCTGCC GAATTGGGTG GGTTGTTCAA AAGCGGCACG GGCGTTTGGT
1001 CGTTCGCGCC GTCTATTACC CTGCCGATTT TTACCTGGGG TACGAACAAG
1051 GCGAACCTTG ATGTAGCCAA GCTGCGCCAA CAGGTACAAA TCGTTGCCTA
1101 TGAATCCGCC GTCCAATCCG CATTTCAAGA CGTGGCAAAC GCATTGGCGG
1151 CGCGCGAGCA GCTGGATAAA GCCTATGACG CTTTAAGCAA ACAAAGCCGC
1201 GCCTCTAAAG AAGCGTTGCG CTTGGTCGGC CTGCGTTACA AGCACGGCGT
1251 ATCCGGCGCG CTCGACTTGC TCGATGCGGA ACGCAGCAGC TATGCGGCGG
1301 AGGGTGCGGC TTTGTCGGCA CAACTGACCC GCGCCGAAAA CCTTGCCGAT
1351 TTGTACAAGG CACTCGGCGG CGGATTGAAA CGGGATACCC AAACCGACAA
1401 ATAA
```

This corresponds to the amino acid sequence <SEQ ID 2466; ORF 729>:

```
m729.pep
  1 MDTTLKTTLT SVAAAFALSA CTMIPQYEQP KVEVAETFKN DTADSGIRAV
 51 DLGWHDYFAD PRLQKLIDIA LERNTSLRTA VLNSEIYRKQ YMIERNNLLP
101 TLAANANDSR QGSLSGGNVS SSYKVGLGAA SYELDLFGRV RSSSEAALQG
151 YFASTANRDA AHLSLIATVA KAYFNERYAE EAMSLAQRVL KTREETYKLS
201 ELRYKAGVIS AVALRQQEAL IESAKADYAH AARSREQARN ALATLINQPI
251 PEDLPAGLPL DKQFFVEKLP AGLSSEVLLD RPDIRAAEHA LKQANANIGA
301 ARAAFFPSIR LTGTVGTGSA ELGGLFKSGT GVWSFAPSIT LPIFTWGTNK
351 ANLDVAKLRQ QVQIVAYESA VQSAFQDVAN ALAAREQLDK AYDALSKQSR
401 ASKEALRLVG LRYKHGVSGA LDLLDAERSS YAAEGAALSA QLTRAENLAD
451 LYKALGGGLK RDTQTDK*
```

Computer analysis of the amino acid sequences gave the following results:

Homology with a Predicted ORF from *N. meningitidis* menA with menB ORF 729 shows 95.7% identity over a 467 aa overlap with a predicted ORF (ORF729.a) from *N. gonorrhoeae*:

```
m729/g729 95.7% identity in 467 aa overlap
```

-continued

```
                 10         20         30         40         50         60
m729.pep   MDTTLKTTLTSVAAAFALSACTMIPQYEQPKVEVAETFKNDTADSGIRAVDLGWHDYFAD
           |:|||||||||||||||||||||||||||||||||||||:|||: |:||||||||||||||
g729       MNTTLKTTLTSVAAAFALSACTMIPQYEQPKVEVAETFQNDTSVSSIRAVDLGWHDYFAD
                 10         20         30         40         50         60

                 70         80         90        100        110        120
m729.pep   PRLQKLIDIALERNTSLRTAVLNSEIYRKQYMIERNNLLPTLAANANDSRQGSLSGGNVS
           |||||||||||||||||||||||||||||||||||||||||||||||| |||||||||||
g729       PRLQKLIDIALERNTSLRTAVLNSEIYRKQYMIERNNLLPTLAANANGSRQGSLSGGNVS
                 70         80         90        100        110        120

                130        140        150        160        170        180
m729.pep   SSYKVGLGAASYELDLFGRVRSSSEAALQGYFASTANRDAAHLSLIATVAKAYFNERYAE
           |||:||||||||||||||||||:|||||||||||:||||||| |||||||||||||||||
g729       SSYNVGLGAASYELDLFGRVRSNSEAALQGYFASVANRDAAHLILIATVAKAYFNERYAE
                130        140        150        160        170        180

                190        200        210        220        230        240
m729.pep   EAMSLAQRVLKTREETYKLSELRYKAGVISAVALRQQEALIESAKADYAHAARSREQARN
           :|||||||||||||||||||||||||||||||||||||||||||||||||||||||||||
g729       KAMSLAQRVLKTREETYKLSELRYKAGVISAVALRQQEALIESAKADYAHAARSREQARN
                190        200        210        220        230        240

                250        260        270        280        290        300
m729.pep   ALATLINQPIPEDLPAGLPLDKQFFVEKLPAGLSSEVLLDRPDIRAAEHALKQANANIGA
           |||||||:||||||||||||||||||||||||||||||||||||||||||||||||||||
g729       ALATLINRPIPEDLPAGLPLDKQFFVEKLPAGLSSEVLLDRPDIRAAEHALKQANANIGA
                250        260        270        280        290        300

                310        320        330        340        350        360
m729.pep   ARAAFFPSIRLTGTVGTGSAELGGLFKSGTGVWSFAPSITLPIFTWGTNKANLDVAKLRQ
           |||||||||||||:||||||:|||||||||||||:|||||||||||||||||||||||||
g729       ARAAFFPSIRLTGSVGTGSVELGGLFKSGTGVWAFAPSITLPIFTWGTNKANLDVAKLRQ
                310        320        330        340        350        360

                370        380        390        400        410        420
m729.pep   QVQIVAYESAVQSAFQDVANALAAREQLDKAYDALSKQSRASKEALRLVGLRYKHGVSGA
           |:||||||||||||||||||||||||||||||||||||||||||||||||||||||||||
g729       QAQIVAYESAVQSAFQDVANALAAREQLDKAYDALSKQSRASKEALRLVGLRYKHGVSGA
                370        380        390        400        410        420

                430        440        450        460
m729.pep   LDLLDAERSSYAAEGAALSAQLTRAENLADLYKALGGGLKRDTQTDKX
           |||||||| ||:|||||||||||||||||||||||| ||||||||| ||
g729       LDLLDAERISYSAEGAALSAQLTRAENLADLYKALDGGLKRDTQTGKX
                430        440        450        460
```

The following partial DNA sequence was identified in *N. meningitidis* <SEQ ID 2467>:

```
a729.seq
     1  ATGGATACTA CATTGAAAAC CACCTTGACT TCTGTTGCAG CAGCCTTCGC

    51  ATTATCCGCC TGCACCATGA TTCCCCAATA CGAGCAGCCC AAAGTCGAAG

   101  TTGCCGAAAC GTTCAAAAAC GATACCGCCG ACAGCGGCAT CCGTGCGGTC

   151  GATTTGGGTT GGCATGACTA TTTTGCCGAC CCGCGCCTGC AAAAGCTGAT

   201  CGACATCGCA CTCGAGCGCA ATACCAGTTT GCGTACCGCC GTATTGAACA

   251  GCGAAATCTA CCGCAAACAA TACATGATTG AGCGCAACAA CCTCCTGCCC

   301  ACGCTTGCCG CCAATGCGAA CGACTCGCGC CAAGGCAGCT TGAGCGGCGG

   351  CAATGTAAGC AGCAGCTACA AAGTCGGACT GGGTGCGGCA TCTTACGAAC

   401  TCGATCTGTT CGGGCGTGTA CGCAGCAGCA GCGAGGCGGC ACTGCAAGGC

   451  TATTTCGCCA GCACCGCCAA CCGCGATGCG GCACATTTGA GCCTGATTGC

   501  CACCGTTGCC AAAGCCTATT TCAACGAACG TTATGCCGAA GAAGCGATGT

   551  CTTTGGCGCA ACGTGTTTTG AAAACGCGCG AGGAAACCTA CAAGCTGTCC

   601  GAATTACGTT ACAAGGCAGG CGTGATTTCC GCCGTCGCCC TACGTCAGCA

   651  GGAAGCCCTA ATCGAATCTG CCAAAGCCGA TTATGCCCAT GCCGCGCGCA

   701  GCCGCGAACA GGCGCGCAAT GCCTTGGCAA CCCTGATTAA CCAACCGATA

   751  CCCGACGACC TGCCCGCCGG TTTGCCGTTG GACAAGCAGT TTTTTGTTGA
```

-continued

```
 801 GAAGCTGCCG GCCGGTTTGA GTTCCGAAGT ATTGCTCGAC CGTCCCGATA

 851 TCCGTGCTGC CGAACACGCG CTCAAACAGG CAAACGCCAA TATCGGTGCG

 901 GCACGCGCCG CCTTTTTCCC ATCCATCCGC CTGACCGGAA GCGTCGATAC

 951 GCATTCTGCC GAATTGGGCG GGCTGTTCAA AAGCGGCACC GGCGTTTGGT

1001 TGTTCGCACC TTCCATTACC CTGCCGATTT TTACCTGGGG TACGAACAAG

1051 GCGAACCTCG ATGTAGCCAA GCTGCGCCAA CAGGCACAAA TCGTTGCCTA

1101 TGAAGCCGCC GTCCAATCCG CATTTCAAGA CGTGGCAAAC GCATTGACCG

1151 CGCGCGAGCA GTTGGATAAA GCCTATGACG CTTTAAGCAA ACAAAGCCGC

1201 GCCTCTAAAG AAGCGTTGCG TTTGGTCGGT CTGCGTTACA AACACGGCGT

1251 ATCCGGCGCG CTCGACTTGC TCGATGCGGA ACGCAGCAGC TATTCGGCGG

1301 AAGGTGCGGC TTTGTCGGCA CAACTGACCC GCGCCGAAAA CCTTGCCGAT

1351 TTGTACAAGG CACTCGGCGG CGGATTGAAA CGGGATACCC AAACCGACAA

1401 ATAA
```

This corresponds to the amino acid sequence <SEQ ID 2468; ORF 729.a>:

```
a729.pep

  1 MDTTLKTTLT SVAAAFALSA CTMIPQYEQP KVEVAETFKN DTADSGIRAV

 51 DLGWHDYFAD PRLQKLIDIA LERNTSLRTA VLNSEIYRKQ YMIERNNLLP

101 TLAANANDSR QGSLSGGNVS SSYKVGLGAA SYELDLFGRV RSSSEAALQG

151 YFASTANRDA AHLSLIATVA KAYFNERYAE EAMSLAQRVL KTREETYKLS

201 ELRYKAGVIS AVALRQQEAL IESAKADYAH AARSREQARN ALATLINQPI

251 PDDLPAGLPL DKQFFVEKLP AGLSSEVLLD RPDIRAAEHA LKQANANIGA

301 ARAAFFPSIR LTGSVDTHSA ELGGLFKSGT GVWLFAPSIT LPIFTWGTNK

351 ANLDVAKLRQ QAQIVAYEAA VQSAFQDVAN ALTAREQLDK AYDALSKQSR

401 ASKEALRLVG LRYKHGVSGA LDLLDAERSS YSAEGAALSA QLTRAENLAD

451 LYKALGGGLK RDTQTDK*
```

```
 a729/m729  98.1% identity in 467 aa overlap

                   10        20        30        40        50        60
a729.pep    MDTTLKTTLTSVAAAFALSACTMIPQYEQPKVEVAETFKNDTADSGIRAVDLGWHDYFAD
            ||||||||||||||||||||||||||||||||||||||||||||||||||||||||||||
m729        MDTTLKTTLTSVAAAFALSACTMIPQYEQPKVEVAETFKNDTADSGIRAVDLGWHDYFAD
                   10        20        30        40        50        60

                   70        80        90       100       110       120
a729.pep    PRLQKLIDIALERNTSLRTAVLNSEIYRKQYMIERNNLLPTLAANANDSRQGSLSGGNVS
            ||||||||||||||||||||||||||||||||||||||||||||||||||||||||||||
m729        PRLQKLIDIALERNTSLRTAVLNSEIYRKQYMIERNNLLPTLAANANDSRQGSLSGGNVS
                   70        80        90       100       110       120

                  130       140       150       160       170       180
a729.pep    SSYKVGLGAASYELDLFGRVRSSSEAALQGYFASTANRDAAHLSLIATVAKAYFNERYAE
            ||||||||||||||||||||||||||||||||||||||||||||||||||||||||||||
m729        SSYKVGLGAASYELDLFGRVRSSSEAALQGYFASTANRDAAHLSLIATVAKAYFNERYAE
                  130       140       150       160       170       180

                  190       200       210       220       230       240
a729.pep    EAMSLAQRVLKTREETYKLSELRYKAGVISAVALRQQEALIESAKADYAHAARSREQARN
            ||||||||||||||||||||||||||||||||||||||||||||||||||||||||||||
m729        EAMSLAQRVLKTREETYKLSELRYKAGVISAVALRQQEALIESAKADYAHAARSREQARN
                  190       200       210       220       230       240

                  250       260       270       280       290       300
a729.pep    ALATLINQPIPDDLPAGLPLDKQFFVEKLPAGLSSEVLLDRPDIRAAEHALKQANANIGA
            ||||||||||:|||||||||||||||||||||||||||||||||||||||||||||||||
m729        ALATLINQPIPEDLPAGLPLDKQFFVEKLPAGLSSEVLLDRPDIRAAEHALKQANANIGA
                  250       260       270       280       290       300
```

-continued

```
                 310        320        330        340        350        360
a729.pep  ARAAFFPSIRLTGSVDTHSAELGGLFKSGTGVWLFAPSITLPIFTWGTNKANLDVAKLRQ
          |||||||||||||:| | |||||||||||||||| ||||||||||||||||||||||||||
m729      ARAAFFPSIRLTGTVGTGSAELGGLFKSGTGVWSFAPSITLPIFTWGTNKANLDVAKLRQ
                 310        320        330        340        350        360

                 370        380        390        400        410        420
a729.pep  QAQIVAYEAAVQSAFQDVANALTAREQLDKAYDALSKQSRASKEALRLVGLRYKHGVSGA
          |:|||||:|||||||||||||:||||||||||||||||||||||||||||||||||||||
m729      QVQIVAYESAVQSAFQDVANALAAREQLDKAYDALSKQSRASKEALRLVGLRYKHGVSGA
                 370        380        390        400        410        420

                 430        440        450        460
a729.pep  LDLLDAERSSYSAEGAALSAQLTRAENLADLYKALGGGLKRDTQTDKX
          |||||||||||:||||||||||||||||||||||||||||||||||||
m729      LDLLDAERSSYAAEGAALSAQLTRAENLADLYKALGGGLKRDTQTDKX
                 430        440        450        460
```

The following partial DNA sequence was identified in *N. gonorrhoeae* <SEQ ID 2469>:

```
g730.seq
   1  GTGAAACCGC TGCGCAGACT GACAAACCTC CTTGCCGCCT GCGCCGTAGC
  51  GGCGGTCGCA CTCATACAGC CCGCCCTCGC GGCGGACTTG GCGCAAGACC
 101  CGTTCATTAC CGATAACACC CAACGGCAGC ACTACGAACC CGGCGGCAAA
 151  TACCACCTCT TCGGcgaCCC GCGCGGCAGC GTTTCCGACC GCACCGGCAA
 201  AATCAACGTC ATCCAAGACT ATACCCACCA GATGGGCAAC CTGCTCATCC
 251  AACAGGCGGC AATCCAAGGC AATCTTGGTT ACACCGTCCG CTTTTCCGGA
 301  CACGGACACG AAGAACACGC CCCCTTCGAC AACCACGCCG CCGACAGCGC
 351  AAGCGAAGAA AAAGGCAACG TTGACGACGG CTTTACCGTG TACCGGCTCA
 401  ACTGGGAAGG ACACGAACAT CATCCCGCCG ATGCCTACGA CGGCCCGAAG
 451  GGCGGCAATT ACCCCAAACC TACGGGCGCA CGAGACGAAT ACACCTATCA
 501  CGTCAACGGC ACAGCCCGCA GTATCAAACT CAATCCGACC GACACCCGCA
 551  GCATCCGGCA ACGCATATTC GACAACTACA ACAACCTCGG CAGCAATTTC
 601  TCCGACCGCG CCGATGAAGC CAACAGAAAA ATGTTCGAGC ACAATGCCAA
 651  GCTCGACCGC TGGGGCAACA GCATGGAGTT TGTCAACGGC GTCGCCGCCG
 701  GCGCGCTCAA CCCCTTTATC AGCGCGGGCG AAGCCTTGGG CATAGGCGAC
 751  ATACTGTACG GAACGCGCTA TGCCATAGAC AAAGCCGCGA TGCGCAACAT
 801  CGCCCCCTTA CCCGCCGAGG GCAAATTCGC CGCCATCGGC GGCTTGGGCA
 851  GCGCGGCGGG CTTTGAAAAA AATACGCGCG AAGCCGTTGA CCGGTGGATA
 901  CAGGAAAACC CCAATGCCGC CGAAACCGTC GAAGCCCTGG TCAACGTCCT
 951  GCCGTTTGCC AAAGTCAAAA ACCTGACAAA GGCGGCAAAA CCGGGGAAGG
1001  CTGCGGTTAG TGGGGATTTT TCTAAATCCT ACACCTGCTC CTTCCACGGC
1051  AGCACCTTGG TCAAAACGGC AGACGGCTAC AAAGCCATTG CCCATATTCA
1101  AGCCGGAGAC CGCGTCCTTT CCAAGGACGA GGCAAGCGGA GAAACGGGAT
1151  ACAAACCCGT TACCGCCCGA TACGGCAATC CGTATCAAGA AACCGTTTAC
1201  ATTGAAGTTT CAGACGGCAT CGGCAACAGC CAAACCCTGA TTTCCAACCG
1251  CATCCACCCG TTTTATTCGG ACGGCAAATG GATTAAGGCG GAAGATTTAA
1301  AAGCGGGAAG CCGGCTGTTA TCCGAAAGCG GCAAAACCCA AACCGTCCGC
1351  AACATCGTTG TCAAACCAAA ACCGCTCAAA GCCTACAATC TGACCGTTGC
1401  CGATTGGCAT ACCTACTTCG TCAAGGGTAA TCAGGCGGAA ACGGAAGGGG
```

-continued

```
1451  TTTGGGTTCA TAATGATTGT CCGCCTAAAC CAAAACCAAC CAATCATGCC

1501  CAACAAAGAA AAGAAGAAGC TAAAAACGAT TCTCATCGAA GTGTGGGAGA

1551  TTCCAATCGT GTCGTTCGCG AAGGAAAGCA ATATTTAGAT TCCGACACAG

1601  GAAACCATGT TTATGTAAAA GGAGATAAAG TGGTTATTCT AACTCCTGAT

1651  GGAAGACAGG TAACTCAATT TAAGAACTCG AAAGCCAATA CGTCAAAAAG

1701  GGTAAAAAAT GGGAAATGGA CACCAAAATA A
```

This corresponds to the amino acid sequence <SEQ ID 2470; ORF 730.ng>:

```
g730.pep
  1 VKPLRRLTNL LAACAVAAVA LIQPALAADL AQDPFITDNT QRQHYEPGGK

 51 YHLFGDPRGS VSDRTGKINV IQDYTHQMGN LLIQQAAIQG NLGYTVRFSG

101 HGHEEHAPFD NHAADSASEE KGNVDDGFTV YRLNWEGHEH HPADAYDGPK

151 GGNYPKPTGA RDEYTYHVNG TARSIKLNPT DTRSIRQRIF DNYNNLGSNF

201 SDRADEANRK MFEHNAKLDR WGNSMEFVNG VAAGALNPFI SAGEALGIGD

251 ILYGTRYAID KAAMRNIAPL PAEGKFAAIG GLGSAAGFEK NTREAVDRWI

301 QENPNAAETV EALVNVLPFA KVKNLTKAAK PGKAAVSGDF SKSYTCSFHG

351 STLVKTADGY KAIAHIQAGD RVLSKDEASG ETGYKPVTAR YGNPYQETVY

401 IEVSDGIGNS QTLISNRIHP FYSDGKWIKA EDLKAGSRLL SESGKTQTVR

451 NIVVKPKPLK AYNLTVADWH TYFVKGNQAE TEGVWVHNDC PPKPKPTNHA

501 QQRKEEAKND SHRSVGDSNR VVREGKQYLD SDTGNHVYVK GDKVVILTPD

551 GRQVTQFKNS KANTSKRVKN GKWTPK*
```

The following partial DNA sequence was identified in *N. meningitidis* <SEQ ID 2471>:

```
m730.seq
  1  GTGAAACCGC TGCGCAGACT GACAAACCTC CTTGCCGCCT GCGCCGTAGC

 51  GGCGGCCGCA CTCATACAGC CCGCCCTCGC GGCGGACTTG GCGCAAGACC

101  CGTTCATTAC CGATAACGCC CAACGGCAGC ACTACGAACC CGGCGGCAAA

151  TACCACCTCT TCGGCGACCC GCGCGGCAGC GTTTCCGACC GCACCGGCAA

201  AATCAACGTC ATCCAAGACT ATACCCACCA GATGGGCAAC CTGCTCATCC

251  AACAGGCAAA CATCAACGGC ACAATCGGCT ACCACACCCG CTTTTCCGGA

301  CACGGACACG AAGAACACGC CCCCTTCGAC AACCACGCCG CCGACAGCGC

351  GAGCGAAGAA AAAGGCAACG TTGACGAAGG CTTTACCGTA TACCGGCTCA

401  ACTGGGAAGG ACACGAACAT CATCCCGCCG ATGCCTACGA CGGCCCGAAG

451  GGCGGCAATT ACCCCAAACC TACGGGCGCA CGAGACGAAT ACACCTATCA

501  CGTCAACGGC ACAGCCCGCA GTATCAAACT CAATCCGACC GACACCCGCA

551  GCATCCGGCA ACGCATATCC GACAATTACA GCAACCTCGG CAGCAATTTC

601  TCCGACCGCG CCGATGAAGC CAACAGAAAA ATGTTCGAGC ACAATGCCAA

651  GCTCGACCGC TGGGGCAACA GCATGGAGTT TATCAACGGC GTCGCCGCCG

701  GCGCGCTCAA CCCCTTTATC AGCGCGGGCG AAGCCTTGGG CATAGGCGAC

751  ATACTGTACG GAACGCGCTA TGCCATAGAC AAAGCCGCAA TGCGCAACAT
```

-continued

```
 801 CGCCCCCTTG CCCGCCGAGG GCAAATTCGC CGTCATCGGC GGCTTGGGCA

 851 GCGTGGCGGG CTTTGAAAAG AATACGCGCG AAGCCGTTGA CCGGTGGATA

 901 CAGGAAAATC CCAATGCCGC CGAAACCGTC GAAGCCGTCT TCAACGTTGC

 951 CGCAGCAGCC AAAGTCGCGA AGTTGGCAAA GGCGGCAAAA CCAGGGAAGG

1001 CTGCGGTTAG CGGGGATTTT GCTGATTCTT ATAAAAAGAA ATTGGCTTTG

1051 TCTGATAGTG CGAGACAGTT ATATCAAAAT GCAAAGTATA GAGAAGCTCT

1101 AGATATACAT TATGAAGATT TAATTAGAAG AAAAACTGAT GGTTCATCAA

1151 AATTTATTAA CGGCAGAGAA ATTGACGCTG TTACGAATGA TGCTTTAATA

1201 CAAGCCAAAA GAACAATTTC AGCAATAGAT AAACCTAAAA ATTTCTTAAA

1251 TCAAAAAAAT AGAAAGCAAA TTAAAGCAAC CATCGAAGCA GCAAACCAAC

1301 AGGGAAAACG TGCAGAATTT TGGTTTAAAT ACGGTGTTCA TTCACAAGTT

1351 AAGTCATATA TTGAATCAAA AGGCGGCATT GTTAAAACAG GTTTAGGAGA

1401 TTAA
```

This corresponds to the amino acid sequence <SEQ ID 2472; ORF 730>:

```
m730.pep
  1 VKPLRRLTNL LAACAVAAAA LIQPALAADL AQDPFITDNA QRQHYEPGGK

 51 YHLFGDPRGS VSDRTGKINV IQDYTHQMGN LLIQQANING TIGYHTRFSG

101 HGHEEHAPFD NHAADSASEE KGNVDEGFTV YRLNWEGHEH HPADAYDGPK

151 GGNYPKPTGA RDEYTYHVNG TARSIKLNPT DTRSIRQRIS DNYSNLGSNF

201 SDRADEANRK MFEHNAKLDR WGNSMEFING VAAGALNPFI SAGEALGIGD

251 ILYGTRYAID KAAMRNIAPL PAEGKFAVIG GLGSVAGFEK NTREAVDRWI

301 QENPNAAETV EAVFNVAAAA KVAKLAKAAK PGKAAVSGDF ADSYKKKLAL

351 SDSARQLYQN AKYREALDIH YEDLIRRKTD GSSKFINGRE IDAVTNDALI

401 QAKRTISAID KPKNFLNQKN RKQIKATIEA ANQQGKRAEF WFKYGVHSQV

451 KSYIESKGGI VKTGLGD*
```

g730/m730 93.0% identity in 344 aa overlap

```
                    10        20        30        40        50        60
g730.pep   VKPLRRLTNLLAACAVAAVALIQPALAADLAQDPFITDNTQRQHYEPGGKYHLFGDPRGS
           ||||||||||||||||||:|||||||||||||||||||||:|||||||||||||||||||
m730       VKPLRRLTNLLAACAVAAAALIQPALAADLAQDPFITDNAQRQHYEPGGKYHLFGDPRGS
                    10        20        30        40        50        60

                    70        80        90       100       110       120
g730.pep   VSDRTGKINVIQDYTHQMGNLLIQQAAIQGNLGYTVRFSGHGHEEHAPFDNHAADSASEE
           |||||||||||||||||||||||||| |:|::|| :||||||||||||||||||||||||
m730       VSDRTGKINVIQDYTHQMGNLLIQQANINGTIGYHTRFSGHGHEEHAPFDNHAADSASEE
                    70        80        90       100       110       120

                   130       140       150       160       170       180
g730.pep   KGNVDDGFTVYRLNWEGHEHHPADAYDGPKGGNYPKPTGARDEYTYHVNGTARSIKLNPT
           |||||:||||||||||||||||||||||||||||||||||||||||||||||||||||||
m730       KGNVDEGFTVYRLNWEGHEHHPADAYDGPKGGNYPKPTGARDEYTYHVNGTARSIKLNPT
                   130       140       150       160       170       180

                   190       200       210       220       230       240
g730.pep   DTRSIRQRIFDNYNNLGSNFSDRADEANRKMFEHNAKLDRWGNSMEFVNGVAAGALNPFI
           ||||||||| |||:|||||||||||||||||||||||||||||||||:||||||||||||
m730       DTRSIRQRISDNYSNLGSNFSDRADEANRKMFEHNAKLDRWGNSMEFINGVAAGALNPFI
                   190       200       210       220       230       240
```

-continued

```
                  250        260        270        280        290        300
g730.pep   SAGEALGIGDILYGTRYAIDKAAMRNIAPLPAEGKFAAIGGLGSAAGFEKNTREAVDRWI
           |||||||||||||||||||||||||||||||||||||:||||||:|||||||||||||||
m730       SAGEALGIGDILYGTRYAIDKAAMRNIAPLPAEGKFAVIGGLGSVAGFEKNTREAVDRWI
                  250        260        270        280        290        300

                  310        320        330        340        350        360
g730.pep   QENPNAAETVEALVNVLPFAKVKNLTKAAKPGKAAVSGDFSKSYTCSFHGSTLVKTADGY
           ||||||||||||: ||   ||| :|:||||||||||||||: ||
m730       QENPNAAETVEAVFNVAAAAKVAKLAKAAKPGKAAVSGDFADSYKKKLALSDSARQLYQN
                  310        320        330        340        350        360

                  370        380        390        400        410        420
g730.pep   KAIAHIQAGDRVLSKDEASGETGYKPVTARYGNPYQETVYIEVSDGIGNSQTLISNRIHP

m730       AKYREALDIHYEDLIRRKTDGSSKFINGREIDAVTNDALIQAKRTISAIDKPKNFLNQKN
                  370        380        390        400        410        420
```

The following partial DNA sequence was identified in *N. meningitidis* <SEQ ID 2473>:

```
a730.seq
     1  GTGAAACCGC TGCGAAGACT CATCAAGCTC CTTGCCGCCT GTGCCGTAGC

    51  GGCGGCCGCA CTCATACAGC CCGCCCTCGC GGCGGACTTG GCGCAAGACC

   101  CGTTCATTAC CGATAACGCC CAACGGCAGC ACTACGAACC CGGAGGCAAA

   151  TACCACCTCT TCGGCGACCC GCGCGGCAGC GTCTCCGACC GCACCGGTCA

   201  AATCAACGTC ATCCAAGACT ATACCCACCG GATGGGCAAC CTGCTCATCC

   251  AGCAGGCAAA CATCAACGGC ACAATCGGCT ACCACACCCG CTTTTCCGGA

   301  CACGGATACG AAGAACACGC CCCCTTCGAC AACCACGCCG CCGACAGCGC

   351  GAGCGAAGAA AAAGGCAACG TTGACGAAGG CTTTACCGTA TACCGGCTCA

   401  ACTGGGAAGG ACACGAACAT CATCCCGCCG ATGCCTACGA CGGCCCGAAG

   451  GGCGGCAATT ACCCCAAACC TACGGGTGCA CGCGACGAAT ACACCTATCA

   501  CGTCAACGGC ACAGCACGCA GCATCAAACT CAATCCGACC GACACCCGCA

   551  GCATCCGGCA ACGCATATCC GACAATTACA GCAACCTCGG CAGCAATTTC

   601  TCCGACCGCG CCGATGAAGC CAACAGAAAA ATGTTCGAGC ACAATGCCAA

   651  GCTCGACCGC TGGGGCAACA GCATGGAGTT TATCAACGGC GTCGCCGCCG

   701  GCGCGCTCAA CCCCTTTATC AGCGCGGGCG AAGCCTTGGG CATAGGCGAC

   751  ATACTGTACG GAACGCGCTA TGCCATAGAC AAAGCCGCAA TGCGCAACAT

   801  CGCCCCCTTG CCCGCCGAGG GCAAATTCGC CGTCATCGGC GGCTTGGGCA

   851  GCGTGGCGGG CTTTGAAAAA AATACGCGCG AAGCCGTTGA CCGGTGGATA

   901  CAGGAAAACC CCAATGCCGC CGAAACCGTC GAAGCCCTGG TCAACGTCCT

   951  GCCGTTTGCC AAAGTCAAAA ACCTGACAAA GGCGGCAAAA CCGGGGAAGG

  1001  CTGCGGTTAG CGGGGATTTT TCTGCTGCAT ACAATACAAG AACAACTAGA

  1051  AAAGTTACTA CAGAAACAGA GGGGTTAAAT AGAATCAGAC AGAACCAGAA

  1101  AAATAGTAAT ATACATGAGA AAAATTATGG AAGAGATAAT CCTAATCATA

  1151  TTAATGTTTT ATCTGGAAAT TCTATACAAC ATATACTGTA TGGAGATGAA

  1201  GCAGGAGGTG GGCATCTTTT TCCTGGCAAA CCTGGTAAGA CAACATTCCC

  1251  CCAACATTGG TCAGCCAGTA AAATAACTCA TGAAATTAGT GATATCGTTA

  1301  CATCCCCAAA AACGCAATGG TATGCACAGA CTGGAACAGG CGGCAAATAT

  1351  ATTGCTAAAG GAAGACCAGC TAGGTGGGTA TCATATGAAA CGAGAGATGG

  1401  AATTCGTATC AGAACAGTTT ATGAACCTGC AACAGGAAAA GTGGTAACTG
```

-continued

```
1451 CATTCCCCGA TAGAACCTCT AATCCCAAAT ATAACCCTGT AAAATAA
```

This corresponds to the amino acid sequence <SEQ ID 2474; ORF 730.a>:

```
a730.pep
  1 VKPLRRLIKL LAACAVAAAA LIQPALAADL AQDPFITDNA QRQHYEPGGK

 51 YHLFGDPRGS VSDRTGQINV IQDYTHRMGN LLIQQANING TIGYHTRFSG

101 HGYEEHAPFD NHAADSASEE KGNVDEGFTV YRLNWEGHEH HPADAYDGPK

151 GGNYPKPTGA RDEYTYHVNG TARSIKLNPT DTRSIRQRIS DNYSNLGSNF

201 SDRADEANRK MFEHNAKLDR WGNSMEFING VAAGALNPFI SAGEALGIGD

251 ILYGTRYAID KAAMRNIAPL PAEGKFAVIG GLGSVAGFEK NTREAVDRWI

301 QENPNAAETV EALVNVLPFA KVKNLTKAAK PGKAAVSGDF SAAYNTRTTR

351 KVTTETEGLN RIRQNQKNSN IHEKNYGRDN PNHINVLSGN SIQHILYGDE

401 AGGGHLFPGK PGKTTFPQHW SASKITHEIS DIVTSPKTQW YAQTGTGGKY

451 IAKGRPARWV SYETRDGIRI RTVYEPATGK VVTAFPDRTS NPKYNPVK*
```

a730/m730 88.6% identity in 376 aa overlap

```
                    10        20        30        40        50        60
a730.pep    VKPLRRLIKLLAACAVAAAALIQPALAADLAQDPFITDNAQRQHYEPGGKYHLFGDPRGS
            ||||||| :|||||||||||||||||||||||||||||||||||||||||||||||||||
m730        VKPLRRLTNLLAACAVAAAALIQPALAADLAQDPFITDNAQRQHYEPGGKYHLFGDPRGS
                    10        20        30        40        50        60

                    70        80        90       100       110       120
a730.pep    VSDRTGQINVIQDYTHRMGNLLIQQANINGTIGYHTRFSGHGYEEHAPFDNHAADSASEE
            ||||||:|||||||||:|||||||||||||||||||||| | :|||||||||||||||||
m730        VSDRTGKINVIQDYTHQMGNLLIQQANINGTIGYHTRFSCHCHEEHAPFDNHAADSASEE
                    70        80        90       100       110       120

                   130       140       150       160       170       180
a730.pep    KGNVDEGFTVYRLNWEGHEHHPADAYDGPKGGNYPKPTGARDEYTYHVNGTARSIKLNPT
            ||||||||||||||||||||||||||||||||||||||||||||||||||||||||||||
m730        KGNVDEGFTVYRLNWEGHEHHPADAYDGPKGGNYPKPTGARDEYTYHVNGTARSIKLNPT
                   130       140       150       160       170       180

                   190       200       210       220       230       240
a730.pep    DTRSIRQRISDNYSNLGSNFSDRADEANRKMFEHNAKLDRWGNSMEFINGVAAGALNPFI
            ||||||||||||||||||||||||||||||||||||||||||||||||||||||||||||
m730        DTRSIRQRISDNYSNLGSNFSDRADEANRKMFEHNAKLDRWGNSMEFINGVAAGALNPFI
                   190       200       210       220       230       240

                   250       260       270       280       290       300
a730.pep    SAGEALGIGDILYGTRYAIDKAAMRNIAPLPAEGKFAVIGGLGSVAGFEKNTREAVDRWI
            ||||||||||||||||||||||||||||||||||||||||||||||||||||||||||||
m730        SAGEALGIGDILYGTRYAIDKAAMRNIAPLPAEGKFAVIGGLGSVAGFEKNTREAVDRWI
                   250       260       270       280       290       300

                   310       320       330       340       350       360
a730.pep    QENPNAAETVEALVNVLPFAKVKNLTKAAKPGKAAVSGDFSAAYNTRTTRKVTTETEGLN
            ||||||||||||: ||   ||| :|:||||||||||||||: :|     :|  : :::
m730        QENPNAAETVEAVFNVAAAAKVAKLAKAAKPGKAAVSGDFADSY-----KKKLALSDSAR
                   310       320       330       340            350

                   370       380       390       400       410       420
a730.pep    RIRQNQKNSNIHEKNYGRDNPNHINVLSGNSIQHILYGDEAGGGHLFPGKPGKTTFPQHW
            :: || |  :  : :|
m730        QLYQNAKYREALDIHYEDLIRRKTDGSSKFINGREIDAVTNDALIQAKRTISAIDKPKNF
              360       370       380       390       400       410
```

The following partial DNA sequence was identified in *N. gonorrhoeae* <SEQ ID 2475>:

```
g731.seq
  1 gattttcgag cgttttcatG CGAGAACGGT TTGTCTGTGC GCGTCCGCAA

 51 TTTGGACGGC GGCAAAATCG CGTTGCGGCT GGACGGCAGG CGTGCCGTCC

101 TCTCTTCCGA CGTTGCCGCA TCCGGCGAAC GCTATACCGC CGAACACGGT
```

-continued

```
151 TTGTTCGGAA ACGGAACCGA GTGGCACCAG AAAGGCGGCG AAGCCTTTTT

201 CGGCTTTACC GATGCCTACG GCAATTCGGT CGAAACTTCC TGCCGCGCCC

251 GTTAA
```

This corresponds to the amino acid sequence <SEQ ID 2476; ORF 731.ng>:

```
g731.pep
  1 DFRAFSCENG LSVRVRNLDG GKIALRLDGR RAVLSSDVAA SGERYTAEHG

 51 LFGNGTEWHQ KGGEAFFGFT DAYGNSVETS CRAR*
```

The following partial DNA sequence was identified in *N. meningitidis* <SEQ ID 2477>:

```
m731.seq
  1 ATGAATATCA GGTTTTTCGC GCTGACCGTA CCGGTTTTGT CTTTGGCGGC

 51 CTGTGCCGTG CCGGAGGCGT ATGATGACGG CGGACGCGGG CATATGCCGC

101 CCGTTCAAAA CCAAGCCGGC ACGGACGATT TTCGGGCGTT TTCCTGCGAG

151 AACGGTTTGT CTGTGCGCGT CCGCCATTTG GACAGCGGCA AAGTCGCGTT

201 GCGGCTGGAC GGCAGGCGTG CCGTCCTCTC TTCCGACGTT GCCGCATCCG

251 GCGAACGCTA TACCGCCGAA CACGGTTTGT TCGGAAACGC AACCGAGTGG

301 CACCAGAAAG GCGGCGAAGC CTTTTTCGGC TTTACCGATG CCTACGGCAA

351 TTCGGTCGAA ACTTCCTGCC GCGCCCGTTA A
```

This corresponds to the amino acid sequence <SEQ ID 2478; ORF 731>:

```
m731.pep
  1 MNIRFFALTV PVLSLAACAV PEAYDDGGRG HMPPVQNQAG TDDFRAFSCE

 51 NGLSVRVRHL DSGKVALRLD GRRAVLSSDV AASGERYTAE HGLFGNATEW

101 HQKGGEAFFG FTDAYGNSVE TSCRAR*
```

g731/m731 95.2% identity in 84 aa overlap

```
                                                   10        20        30
g731.pep                                DFRAFSCENGLSVRVRNLDGGKIALRLDGR
                                        ||||||||||||||||:||:||:|||||||
m731         LSLAACAVPEAYDDGGRGHMPPVQNQAGTDDFRAFSCENGLSVRVRHLDSGKVALRLDGR
                   20        30        40        50        60        70

                     40        50        60        70        80
g731.pep     RAVLSSDVAASGERYTAEHGLFGNGTEWHQKGGEAFFGFTDAYGNSVETSCRARX
             ||||||||||||||||||||||||:||||||||||||||||||||||||||||||
m731         RAVLSSDVAASGERYTAEHGLFGNATEWHQKGGEAFFGFTDAYGNSVETSCRARX
                   80        90       100       110       120
```

The following partial DNA sequence was identified in *N. meningitidis* <SEQ ID 2479>:

```
a731.seq
  1 ATGAATATCA GGTTTTTCGC GCTGACCGTA CCGGTTTTGT CTTTGGCGGC

 51 CTGTGCCGTG CCGGAGGCGT ATGATGACGG CGGACGAGGG CATATGCCGC

101 CCGTTCAAAA CCAAGCCGGC ACGGCAGATT TTCGGGCATT TTCCTGCGAG
```

-continued

```
151 AACGGTTTGT CTGTGCACGT CCGCCGTTTG GACGGCGGCA GAATCGCGTT

201 GCGGTTGGAC GGCAGGCGTG CCGTCCTCTC TTCCGACGTT GCCGCATCCG

251 GCGAACGCTA TACCGCCGAA CACGGTTTGT TCGGAAACGG AACCGAGTGG

301 CATCAGAAAG GCGGCGAAGC CTTTTTCGGC TTTACCGATG CCTACGGCAA

351 TTCGGTCGAA ACCTCCTGCC GCGAACGCTA A
```

This corresponds to the amino acid sequence <SEQ ID 2480; ORF 731.a>:

```
a731.pep

      1 MNIRFFALTV PVLSLAACAV PEAYDDGGRG HMPPVQNQAG TADFRAFSCE

     51 NGLSVHVRRL DGGRIALRLD GRRAVLSSDV AASGERYTAE HGLFGNGTEW

    101 HQKGGEAFFG FTDAYGNSVE TSCRAR*

a731.pep  94.4% identity in 126 aa overlap

                  10        20        30        40        50        60
a731.pep  MNIRFFALTVPVLSLAACAVPEAYDDGGRGHMPPVQNQAGTADFRAFSCENGLSVHVRRL
          |||||||||||||||||||||||||||||||||||||||| ||||||||||||:||:|
m731      MNIRFFALTVPVLSLAACAVPEAYDDGGRGHMPPVQNQAGTDDFRAFSCENGLSVRVRHL
                  10        20        30        40        50        60

                  70        80        90       100       110       120
a731.pep  DGGRIALRLDGRRAVLSSDVAASGERYTAEHGLFGNGTEWHQKGGEAFFGFTDAYGNSVE
          |:|::|||||||||||||||||||||||||||||:|||||||||||||||||||||||
m731      DSGKVALRLDGRRAVLSSDVAASGERYTAEHGLFGNATEWHQKGGEAFFGFTDAYGNSVE
                  70        80        90       100       110       120

a731.pep  TSCRARX
          |||||||
m731      TSCRARX
```

The following partial DNA sequence was identified in *N. gonorrhoeae* <SEQ ID 2481>:

```
g732.seq
   1  ATGTCGAAAC CTGTTTTTAA GAAAATCGCA CTTTATACTT TGGGTGCAAT

  51  CAGCGGCGTG GCCGTAAGTC TGGCGGTGCA GGGTTTTGCC GCCGagaagg

 101  ACGGgcgGGA TAACGAagtC CTGCCGGTGC AATCCATCCG TACGATGGCG

 151  GAGGTTTACG GTCAGATTAA GGCAAACTAC TATCATGACA AACCCGATGC

 201  CGATTTGTTT GAAGGTGCGA TGAAGGGTAT GGTGGCCGGT TTGGATCCGC

 251  ATTCCGAATA TATGGATAAA AAAGGTTATG CCGAGATAAA GGAGTCCACC

 301  AGCGGCGAAT TTGGCGGCTT GGGGATGGAA ATCGGGCAGG AAGACGGTTT

 351  TGTCAAAGTG GTTTCGCCGA TTGAGGACAC GCCTGCCGAA CGGGCGGAGG

 401  TGAAAAGCGG CGATTTCATT GTGAAAATCG ATAATGTTTC GACGCGCGGT

 451  ATGACGGTCA GCGAAGCGGT GAAAAAAATG CGGGGCAAGC CGGGTACGAA

 501  GATTACTTTG ACGTTGTCGC GCAAAAATGC CGACAAGCCG ATAGTCGTCA

 551  ACCTGACCCG TGCCATTATT AAAGTGAAAA GCGTCCGCCA TCACCTGATC

 601  GAACCCGATT ACGGCTATAT CCGCGTGTCG CAGTTCCAAG AGCGGACGGT

 651  CGAAAGCGTC AATACCGCCG CAAAAGAGCT GGTAAAGGAA AATAAAGGAA

 701  AACCGCTCAA GGGGCTGGTG TTGGATTTGC GCGACGACCC CGGCGGGCTT

 751  TTGACCGGCG CGGTCGGCGT GTCGGCGGCG TTTCTGCCGT CTGAAGCGGT

 801  CGTCGTCAGC ACCAAGGGAC GCGACGGCAA AGACGGCATG GTACTGAAAG
```

-continued

```
 851  CCGTTCCCGA GGATTATGTG TACGGTATGG GCGGCGACCC TTTGGCGGGT

 901  ATTCCTGCCG AGTTGAAAAC GATTCCGATG ACGgtaTTGG TcaaTTCCGG

 951  TTCggcttCC GCGTCGGAGA TTGtcgCCGG CGCATTGCAG GACCACAAAC

1001  GCGCGGTCAT CGTCGGTACG CAGAGCTTCG GTAAAGGTTC GGTTCAGACT

1051  TTGATTCCTT TGTCCAACGG CAGCGCGGTC AAGTTGACGA CCGCCCTGTA

1101  TTACACGCCG AACGACCGTT CCATTCAGGC ACAGGGGATT GTTCCCGATG

1151  TCgaaGTAAA AGATAAGGAA CGTACTTTTG AAAGCCGCGA GGCGGACCTG

1201  GTCGGACACA TCGGCAATCC CTTgggcGGC GAGGATGTGA ACAGTGAAAC

1251  CCttgcCGTA CCGCTTGAAA AAGATGCGGA TAAGCCCGCT GCAAAAGAAA

1301  AAGGTAAAAA GAAAAAGGAC GAGGATTTGT CTTCAAGGCG GATTCCGAAC

1351  CCTGCGAAAG ACGATCAGTT GCGTAAGGCT TTGGATTTGG TCAAGTCGCC

1401  CGAGCAGTGG CAGAAGTCTT TGGGGCTGGC GGCGAAAAAA CCGGTTTCAA

1451  ATAAAGATAA AAAAGATAAG AAGTAG
```

This corresponds to the amino acid sequence <SEQ ID 2482; ORF 732>:

```
g732.pep
  1 MSKPVFKKIA LYTLGAISGV AVSLAVQGFA AEKDGRDNEV LPVQSIRTMA

 51 EVYGQIKANY YHDKPDADLF EGAMKGMVAG LDPHSEYMDK KGYAEIKEST

101 SGEFGGLGME IGQEDGFVKV VSPIEDTPAE RAEVKSGDFI VKIDNVSTRG

151 MTVSEAVKKM RGKPGTKITL TLSRKNADKP IVVNLTRAII KVKSVRHHLI

201 EPDYGYIRVS QFQERTVESV NTAAKELVKE NKGKPLKGLV LDLRDDPGGL

251 LTGAVGVSAA FLPSEAVVVS TKGRDGKDGM VLKAVPEDYV YGMGGDPLAG

301 IPAELKTIPM TVLVNSGSAS ASEIVAGALQ DHKRAVIVGT QSFGKGSVQT

351 LIPLSNGSAV KLTTALYYTP NDRSIQAQGI VPDVEVKDKE RTFESREADL

401 VGHIGNPLGG EDVNSETLAV PLEKDADKPA AKEKGKKKKD EDLSSRRIPN

451 PAKDDQLRKA LDLVKSPEQW QKSLGLAAKK PVSNKDKKDK K*
```

The following partial DNA sequence was identified in *N. meningitidis* <SEQ ID 2483>:

```
m732.seq
  1  ATGTCGAAAC CTGTTTTTAA GAAAATCGCA CTTTATACTT TGGGTGCAAT

 51  CAGCGGCGTG GCCGTCAGTC TGGCGGTGCA GGGTTTTGCC GCCGAGAAGG

101  ACAGGCGGGA TAACGAAGTC CTGCCGGTGC AATCCATCCG CACAATGGCG

151  GAGGTTTACG GTCAAATCAA GGCAAACTAC TATCAGGACA AACCCGATGC

201  CGATTTGTTT GAAGGTGCGA TGAAGGGTAT GGTGGCCGGT TTGGATCCGC

251  ATTCCGAATA TATGGATAAA AAAGGTTATG CCGAGATAAA GGAGTCCACC

301  AGCGGCGAAT TTGGCGGCTT GGGGATGGAA ATCGGGCAGG AAGACGGATT

351  TGTCAAAGTG GTTTCGCCGA TTGAGGACAC GCCTGCGGAA CGGGCGGGGG

401  TGAAAAGCGG CGATTTCATT GTGAAAATCG ATAATGTTTC GACACGCGGC

451  ATGACGGTCA GCGAAGCGGT GAAGAAAATG CGGGGCAAGC CGGGTACGAA

501  GATTACTTTG ACGCTGTCGC GCAAAAATGC CGACAAGCCG ATAGTCGTCA
```

-continued

```
 551 ACCTGACCCG TGCCATTATT AAAGTGAAAA GCGTCCGCCA TCACCTGATC

 601 GAACCCGATT ACGGCTATAT CCGCGTGTCG CAGTTCCAAG AGCGGACGGT

 651 CGAAAGCGTC AATACCGCCG CAAAAGAGCT GGTAAAGGAA AATAAAGGAA

 701 AACCGCTCAA GGGGCTGGTG TTGGATTTGC GCGACGACCC CGGCGGGCTT

 751 TTGACTGGCG CGGTCGGCGT GTCGGCGGCA TTTCTGCCGT CTGAAGCAGT

 801 CGTCGTCAGC ACCAAGGGAC GCGACGGCAA AGACCGCATG GTACTGAAAG

 851 CCATTCCTGA AGATTATGTG TACGGGATGG GCGGCGATTC GTTGGCGGGC

 901 ATTCCTGCCG AGTTGAAAAC CATACCGATG ACGGTATTGG TCAATTCCGG

 951 TTCGGCTTCC GCGTCGGAGA TTGTCGCAGG TGCATTGCAG GATCATAAAC

1001 GCGCGGTCAT CGTCGGTACG CAGAGCTTCG GCAAAGGTTC GGTTCAGACT

1051 TTGATTCCTT TGTCCAACGG CAGCGCGGTC AAGCTGACAA CGGCACTGTA

1101 TTATACGCCG AACGACCGTT CTATTCAGGC GCAGGGGATT GTTCCCGATG

1151 TCGAAGTAAA AGATAAGGAA CGCATTTTTG AAAGCCGCGA GGCGGATTTG

1201 GTCGGACACA TCGGCAATCC CTTGGGCGGC GAGGATGTGA ACGGTGAAAC

1251 CCTTGCCGTG CCGCTTGAAA AAGATGCGGA TAAGCCCGCT GTAAAAGAAA

1301 AAGGTAAAAA GAAAAAGGAC GAGGATTTGT CTTCAAGGCG GATTCCCAAC

1351 CCTGCCAAAG ACGACCAGTT GCGGAAAGCT TTGGATTTAG TCAAGTCGCC

1401 CGAGCAGTGG CAGAAGTCTT TGGGGCTGGC GGCGAAAAAG CCGGTTTCAA

1451 ATAAAGATAA GAAAGATAAA AAAGATAAGA AGTAG
```

This corresponds to the amino acid sequence <SEQ ID 2484; ORF 732>.

```
m732.pep
  1 MSKPVFKKIA LYTLGAISGV AVSLAVQGFA AEKDRRDNEV LPVQSIRTMA

 51 EVYGQIKANY YQDKPDADLF EGAMKGMVAG LDPHSEYMDK KGYAEIKEST

101 SGEFGGLGME IGQEDGFVKV VSPIEDTPAE RAGVKSGDFI VKIDNVSTRG

151 MTVSEAVKKM RGKPGTKITL TLSRKNADKP IVVNLTRAII KVKSVRHHLI

201 EPDYGYIRVS QFQERTVESV NTAAKELVKE NKGKPLKGLV LDLRDDPGGL

251 LTGAVGVSAA FLPSEAVVVS TKGRDGKDRM VLKAIPEDYV YGMGGDSLAG

301 IPAELKTIPM TVLVNSGSAS ASEIVAGALQ DHKRAVIVGT QSFGKGSVQT

351 LIPLSNGSAV KLTTALYYTP NDRSIQAQGI VPDVEVKDKE RIFESREADL

401 VGHIGNPLGG EDVNGETLAV PLEKDADKPA VKEKGKKKKD EDLSSRRIPN

451 PAKDDQLRKA LDLVKSPEQW QKSLGLAAKK PVSNKDKKDK KDKK*
```

Computer analysis of the amino acid sequences gave the following results:

Homology with a Predicted ORF from *N. meningitidis* menA with menB ORF 732 shows 98.2% identity over a 491 aa overlap with a predicted ORF (ORF732.a) from *N. gonorrhoeae*:

```
m732/g732      98.2% identity in 491 aa overlap
```

-continued

```
                      10        20        30        40        50        60
m732.pep      MSKPVFKKIALYTLGAISGVAVSLAVQGFAAEKDRRDNEVLPVQSIRTMAEVYGQIKANY
              |||||||||||||||||||||||||||||||||| |||||||||||||||||||||||||
g732          MSKPVFKKIALYTLGAISGVAVSLAVQGFAAEKDGRDNEVLPVQSIRTMAEVYGQIKANY
                      10        20        30        40        50        60

70        80        90       100       110       120
m732.pep      YQDKPDADLFEGAMKGMVAGLDPHSEYMDKKGYAEIKESTSGEFGGLGMEIGQEDGFVKV
              |:||||||||||||||||||||||||||||||||||||||||||||||||||||||||||
g732          YHDKPDADLFEGAMKGMVAGLDPHSEYMDKKGYAEIKESTSGEFGGLGMEIGQEDGFVKV
                      70        80        90       100       110       120

130       140       150       160       170       180
m732.pep      VSPIEDTPAERAGVKSGDFIVKIDNVSTRGMTVSEAVKKMRGKPGTKITLTLSRKNADKP
              |||||||||||| |||||||||||||||||||||||||||||||||||||||||||||||
g732          VSPIEDTPAERAEVKSGDFIVKIDNVSTRGMTVSEAVKKMRGKPGTKITLTLSRKNADKP
                     130       140       150       160       170       180

190       200       210       220       230       240
m732.pep      IVVNLTRAIIKVKSVRHHLIEPDYGYIRVSQFQERTVESVNTAAKELVKENKGKPLKGLV
              ||||||||||||||||||||||||||||||||||||||||||||||||||||||||||||
g732          IVVNLTRAIIKVKSVRHHLIEPDYGYIRVSQFQERTVESVNTAAKELVKENKGKPLKGLV
                     190       200       210       220       230       240

250       260       270       280       290       300
m732.pep      LDLRDDPGGLLTGAVGVSAAFLPSEAVVVSTKGRDGKDRMVLKAIPEDYVYGMGGDSLAG
              |||||||||||||||||||||||||||||||||||||| |||||:||||||||||| |||
g732          LDLRDDPGGLLTGAVGVSAAFLPSEAVVVSTKGRDGKDGMVLKAVPEDYVYGMGGDPLAG
                     250       260       270       280       290       300

310       320       330       340       350       360
m732.pep      IPAELKTIPMTVLVNSGSASASEIVAGALQDHKRAVIVGTQSFGKGSVQTLIPLSNGSAV
              ||||||||||||||||||||||||||||||||||||||||||||||||||||||||||||
g732          IPAELKTIPMTVLVNSGSASASEIVAGALQDHKRAVIVGTQSFGKGSVQTLIPLSNGSAV
                     310       320       330       340       350       360

370       380       390       400       410       420
m732.pep      KLTTALYYTPNDRSIQAQGIVPDVEVKDKERIFESREADLVGHIGNPLGGEDVNGETLAV
              ||||||||||||||||||||||||||||||| ||||||||||||||||||||||:|||||
g732          KLTTALYYTPNDRSIQAQGIVPDVEVKDKERTFESREADLVGHIGNPLGGEDVNSETLAV
                     370       380       390       400       410       420

430       440       450       460       470       480
m732.pep      PLEKDADKPAVKEKGKKKKDEDLSSRRIPNPAKDDQLRKALDLVKSPEQWQKSLGLAAKK
              ||||||||||:|||||||||||||||||||||||||||||||||||||||||||||||||
g732          PLEKDADKPAAKEKGKKKKDEDLSSRRIPNPAKDDQLRKALDLVKSPEQWQKSLGLAAKK
                     430       440       450       460       470       480

490
m732.pep      PVSNKDKKDKKDKKX
              |||||||||||
g732          PVSNKDKKDKKX
                     490
```

The following partial DNA sequence was identified in *N. meningitidis* <SEQ ID 2485>:

```
a732.seq
   1  ATGTCGAAAC CTGTTTTTAA GAAAATCGCA CTTTATACTT TGGGTGCAAT

51  CAGCGGCGTG GCCGTCAGTC TGGCGGTGCA GGGTTTTGCC GCCGAGAAGG

101  ACAGGCGGGA TAACGAAGTC CTGCCGGTGC AATCCATCCG CACAATGGCG

151  GAGGTTTACG GTCAAATCAA GGCAAACTAC TATCAGGACA AACCCGATGC

201  CGATTTGTTT GAAGGTGCGA TGAAGGGTAT GGTGGCCGGT TTGGATCCGC

251  ATTCCGAATA TATGGATAAA AAAGGTTATG CCGAGATAAA GGAGTCCACC

301  AGCGGCGAAT TTGGCGGCTT GGGGATGGAA ATCGGGCAGG AAGACGGATT

351  TGTCAAAGTG GTTTCGCCGA TTGAGGACAC GCCTGCGGAA CGGGCGGGGG

401  TGAAAAGCGG CGATTTCATT GTGAAAATCG ATAATGTTTC GACACGCGGC

451  ATGACGGTCA GCGAAGCGGT GAAGAAAATG CGGGGCAAGC CGGGTACGAA

501  GATTACTTTG ACGCTGTCGC GCAAAAATGC CGACAAGCCG ATAGTCGTCA

551  ACCTGACCCG TGCCATTATT AAAGTGAAAA GCGTCCGCCA TCACCTGATC

601  GAACCCGATT ACGGCTATAT CCGCGTGTCG CAGTTCCAAG AGCGGACGGT

651  CGAAAGCGTC AATACCGCCG CAAAAGAGCT GGTAAAGGAA AATAAAGGAA
```

-continued

```
 701  AACCGCTCAA GGGGCTGGTG TTGGATTTGC GCGACGACCC CGGCGGGCTT
 751  TTGACTGGCG CGGTCGGCGT GTCGGCGGCA TTTCTGCCGT CTGAAGCAGT
 801  CGTCGTCAGC ACCAAGGGAC GCGACGGCAA AGACCGCATG GTACTGAAAG
 851  CCGTTCCTGA AGATTATGTG TACGGGATGG GCGGCGATTC GTTGGCGGGC
 901  ATTCCTGCCG AGTTGAAAAC CATACCGATG ACGGTATTGG TCAATTCCGG
 951  TTCGGCTTCC GCGTCGGAGA TTGTCGCAGG TGCATTGCAG GATCATAAAC
1001  GCGCGGTCAT CGTCGGTACG CAGAGCTTCG GCAAAGGTTC GGTTCAGACT
1051  TTGATTCCTT TGTCCAACGG CAGCGCGGTC AAGCTGACAA CGGCACTGTA
1101  TTATACGCCG AACGACCGTT CTATTCAGGC GCAGGGGATT GTTCCCGATG
1151  TCGAAGTAAA AGATAAGGAA CGCATTTTTG AAAGCCGCGA GGCGGATTTG
1201  GTCGGACACA TCGGCAATCC TTTGGGCGGC GAGGATGTGA ACAGTGAAAC
1251  CCTTGCCGTG CCGCTTGAAA AAGATGCGGA TAAGCCCGCT GTAAAAGAAA
1301  AAGGTAAAAA GAAAAAGGAC GAGGATTTGT CTTCAAGGCG GATTCCCAAC
1351  CCTGCCAAAG ACGACCAGTT GCGGAAAGCT TTGGATTTAG TCAAGTCGCC
1401  CGAGCAGTGG CAGAAGTCTT TGGGGCTGGC GGCGAAAAAG CCGGTTTCAA
1451  ATAAAGATAA GAAAGATAAA AAAGATAAGA AGTAG
```

This corresponds to the amino acid sequence <SEQ ID 2486; ORF 732.a>:

```
a732.pep
      1  MSKPVFKKIA LYTLGAISGV AVSLAVQGFA AEKDRRDNEV LPVQSIRTMA
     51  EVYGQIKANY YQDKPDADLF EGAMKGMVAG LDPHSEYMDK KGYAEIKEST
    101  SGEFGGLGME IGQEDGFVKV VSPIEDTPAE RAGVKSGDFI VKIDNVSTRG
    151  MTVSEAVKKM RGKPGTKITL TLSRKNADKP IVVNLTRAII KVKSVRHHLI
    201  EPDYGYIRVS QFQERTVESV NTAAKELVKE NKGKPLKGLV LDLRDDPGGL
    251  LTGAVGVSAA FLPSEAVVVS TKGRDGKDRM VLKAVPEDYV YGMGGDSLAG
    301  IPAELKTIPM TVLVNSGSAS ASEIVAGALQ DHKRAVIVGT QSFGKGSVQT
    351  LIPLSNGSAV KLTTALYYTP NDRSIQAQGI VPDVEVKDKE RIFESREADL
    401  VGHIGNPLGG EDVNSETLAV PLEKDADKPA VKEKGKKKKD EDLSSRRIPN
    451  PAKDDQLRKA LDLVKSPEQW QKSLGLAAKK PVSNKDKKDK KDKK*

a732/m732    99.6% identity in 494 aa overlap

                    10        20        30        40        50        60
a732.pep    MSKPVFKKIALYTLGAISGVAVSLAVQGFAAEKDRRDNEVLPVQSIRTMAEVYGQIKANY
            ||||||||||||||||||||||||||||||||||||||||||||||||||||||||||||
m732        MSKPVFKKIALYTLGAISGVAVSLAVQGFAAEKDRRDNEVLPVQSIRTMAEVYGQIKANY
                    10        20        30        40        50        60

                    70        80        90       100       110       120
a732.pep    YQDKPDADLFEGAMKGMVAGLDPHSEYMDKKGYAEIKESTSGEFGGLGMEIGQEDGFVKV
            ||||||||||||||||||||||||||||||||||||||||||||||||||||||||||||
m732        YQDKPDADLFEGAMKGMVAGLDPHSEYMDKKGYAEIKESTSGEFGGLGMEIGQEDGFVKV
                    70        80        90       100       110       120

                   130       140       150       160       170       180
a732.pep    VSPIEDTPAERAGVKSGDFIVKIDNVSTRGMTVSEAVKKMRGKPGTKITLTLSRKNADKP
            ||||||||||||||||||||||||||||||||||||||||||||||||||||||||||||
m732        VSPIEDTPAERAGVKSGDFIVKIDNVSTRGMTVSEAVKKMRGKPGTKITLTLSRKNADKP
                   130       140       150       160       170       180

                   190       200       210       220       230       240
a732.pep    IVVNLTRAIIKVKSVRHHLIEPDYGYIRVSQFQERTVESVNTAAKELVKENKGKPLKGLV
            ||||||||||||||||||||||||||||||||||||||||||||||||||||||||||||
m732        IVVNLTRAIIKVKSVRHHLIEPDYGYIRVSQFQERTVESVNTAAKELVKENKGKPLKGLV
                   190       200       210       220       230       240
```

-continued

```
                   250        260        270        280        290        300
a732.pep    LDLRDDPGGLLTGAVGVSAAFLPSEAVVVSTKGRDGKDRMVLKAVPEDYVYGMGGDSLAG
            ||||||||||||||||||||||||||||||||||||||||||:|||||||||||||||||
m732        LDLRDDPGGLLTGAVGVSAAFLPSEAVVVSTKGRDGKDRMVLKAIPEDYVYGMGGDSLAG
                   250        260        270        280        290        300

                   310        320        330        340        350        360
a732.pep    IPAELKTIPMTVLVNSGSASASEIVAGALQDHKRAVIVGTQSFGKGSVQTLIPLSNGSAV
            ||||||||||||||||||||||||||||||||||||||||||||||||||||||||||||
m732        IPAELKTIPMTVLVNSGSASASEIVAGALQDHKRAVIVGTQSFGKGSVQTLIPLSNGSAV
                   310        320        330        340        350        360

                   370        380        390        400        410        420
a732.pep    KLTTALYYTPNDRSIQAQGIVPDVEVKDKERIFESREADLVGHIGNPLGGEDVNSETLAV
            ||||||||||||||||||||||||||||||||||||||||||||||||||||||:|||||
m732        KLTTALYYTPNDRSIQAQGIVPDVEVKDKERIFESREADLVGHIGNPLGGEDVNGETLAV
                   370        380        390        400        410        420

                   430        440        450        460        470        480
a732.pep    PLEKDADKPAVKEKGKKKKDEDLSSRRIPNPAKDDQLRKALDLVKSPEQWQKSLGLAAKK
            ||||||||||||||||||||||||||||||||||||||||||||||||||||||||||||
m732        PLEKDADKPAVKEKGKKKKDEDLSSRRIPNPAKDDQLRKALDLVKSPEQWQKSLGLAAKK
                   430        440        450        460        470        480

                   490
a732.pep    PVSNKDKKDKKDKKX
            |||||||||||||||
m732        PVSNKDKKDKKDKKX
                   490
```

The following partial DNA sequence was identified in *N. gonorrhoeae* <SEQ ID 2487>:

```
g733.seq
   1 ATGATGAATC CGAAAACCTT GGGCCGTTTG TCGCTGTGTG CGGCGGTCTT

  51 GGCTCTGACC GCCTGCGCCG GCGGCGGGCA TAAAAACCTG TATTATTACG

 101 GCGGTTATCC CGATACCGTC TATGAAGGTT TGAAAAACGa cgACACTTCG

 151 TTGGGCAAGC AGACCGAAAA GATGGAAAAA TACTTTGCGG AAGCCGCCAA

 201 CAAAAAAATG AATGCCGCCC CGGGTGCGCA CGCCCATTTG GGACTGCTGC

 251 TTTCCCGTTC GGGAGACAAA GAGGGCGCGT TCCGCCAATT TGAAGAAGAG

 301 AAAAGGCTGT TTCCCGAATC GGGCGTATTT ATGGACTTCC TGATGAAAAC

 351 CGGtaaAGGA GGCAAGCGAT GA
```

This corresponds to the amino acid sequence <SEQ ID 2488; ORF 733>:

```
g733.pep
   1 MMNPKTLGRL SLCAAVLALT ACAGGGHKNL YYYGGYPDTV YEGLKNDDTS

  51 LGKQTEKMEK YFAEAANKKM NAAPGAHAHL GLLLSRSGDK EGAFRQFEEE

 101 KRLFPESGVF MDFLMKTGKG GKR*
```

The following partial DNA sequence was identified in *N. meningitidis* <SEQ ID 2489>:

```
m733.seq
   1 ATGATGAATC CGAAAACCTT GAGCCGTTTG TCGCTGTGTG CGGCGGTCTT

  51 GGCTCTGACC GCCTGCGGCG GCAACGGGCA AAAATCCCTG TATTATTACG

 101 GCGGCTATCC CGATACCGTC TATGAAGGTT TGAAAAACGA CGACACTTCG

 151 TTGGGCAAGC AGACCGAAAA GATGGAAAAA TACTTTGTGG AAGCCGGCAA

 201 CAAAAAAATG AATGCCGCCC CGGGTGCGCA CGCCCATCTG GGACTGCTGC

 251 TTTCCCGTTC GGGAGACAAA GAGGGCGCGT TCCGCCAGTT TGAAGAAGAG

 301 AAAAGGCTGT TTCCCGAATC GGGCGTATTT ATGGACTTCC TGATGAAAAC
```

-continued

```
351 CGGTAAAGGA GGCAAGCGAT GA
```

This corresponds to the amino acid sequence <SEQ ID 2490; ORF 733>:

```
m733.pep
  1 MMNPKTLSRL SLCAAVLALT ACGGNGQKSL YYYGGYPDTV YEGLKNDDTS

 51 LGKQTEKMEK YFVEAGNKKM NAAPGAHAHL GLLLSRSGDK EGAFRQFEEE

101 KRLFPESGVF MDFLMKTGKG GKR*
```

Computer analysis of the amino acid sequences gave the following results:

Homology with a Predicted ORF from *N. meningitidis* menA with menB ORF 733 shows 94.3% identity over a 123 aa overlap with a predicted ORF (ORF733.a) from *N. gonorrhoeae*:

```
m733/g733
                    10        20        30        40        50        60
m733.pep    MMNPKTLSRLSLCAAVLALTACGGNGQKSLYYYGGYPDTVYEGLKNDDTSLGKQTEKMEK
            |||||||:|||||||||||||||:|:|:|:||||||||||||||||||||||||||||||
g733        MMNPKTLGRLSLCAACLALTACAGGGHKNLYYYGGYPDTVYEGLKNDDTSLGKQTEKMEK
                    10        20        30        40        50        60
                    70        80        90       100       110       120
m733.pep    YFVEAGNKKMNAAPGAHAHLGLLLSRSGDKEGAFRQFEEEKRLFPESGVFMDFLMKTGKG
            ||:||:||||||||||||||||||||||||||||||||||||||||||||||||||||||
g733        YFAEAANKKMNAAPGAHAHLGLLLSRSGDKEGAFRQFEEEKRLFPESGVFMDFLMKTGKG
                    70        80        90       100       110       120
m733.pep    GKRX
            ||||
g733        GKRX
```

The following partial DNA sequence was identified in *N. meningitidis* <SEQ ID 2491>:

```
a733.seq
  1 ATGATGAATC CGAAAACCTT GAGCCGTTTG TCGCTGTGTG CGGCGGTCTT

 51 GGCTCTGACC GCCTGCGGCG GCAACGGGCA AAAATCCCTG TATTATTACG

101 GCGGCTATCC CGATACCGTC TATGAAGGTT TGAAAAACGA CGACACTTCG

151 TTGGGCAAGC AGACCGAAAA GATGGAAAAA TACTTTGTGG AAGCCGGCAA

201 CAAAAAAATG AATGCCGCCC CGGGTGCGCA CGCCCATCTG GGACTGCTGC

251 TTTCCCGTTC GGGAGACAAA GAGGGCGCGT TCCGCCAGTT TGAAGAAGAG

301 AAAAGGCTGT TTCCCGAATC GGGCGTATTT ATGGACTTCC TGATGAAAAC

351 CGGTAAAGGA GGCAAGCGAT GA
```

This corresponds to the amino acid sequence <SEQ ID 2492; ORF 733.a>:

```
a733.pep

  1 MKNPKTLSRL SLCAAVLALT ACGGNGQKSL YYYGGYPDTV YEGLKNDDTS

 51 LGKQTEKMEK YFVEAGNKKM NAAPGAHAHL GLLLSRSGDK EGAFRQFEEE

101 KRLFPESGVF MDFLMKTGKG GKR*
```

-continued

```
a733/m733 100.0% identity in 123 aa overlap

                    10        20        30        40        50        60
m733.pep    MMNPKTLSRLSLCAAVLALTACGGNGQKSLYYYGGYPDTVYEGLKNDDTSLGKQTEKMEK
            ||||||||||||||||||||||||||||||||||||||||||||||||||||||||||||
m733        MMNPKTLGRLSLCAACLALTACAGGGHKNLYYYGGYPDTVYEGLKNDDTSLGKQTEKMEK
                    10        20        30        40        50        60
                    70        80        90       100       110       120
m733.pep    YFVEAGNKKMNAAPGAHAHLGLLLSRSGDKEGAFRQFEEEKRLFPESGVFMDFLMKTGKG
            ||||||||||||||||||||||||||||||||||||||||||||||||||||||||||||
m733        YFAEAANKKMNAAPGAHAHLGLLLSRSGDKEGAFRQFEEEKRLFPESGVFMDFLMKTGKG
                    70        80        90       100       110       120
m733.pep    GKRX
            ||||
m733        GKRX
```

The following partial DNA sequence was identified in *N. gonorrhoeae* <SEQ ID 2493>:

```
g734.seq
   1 ATGATGAAAA AGATACTGGC AGTATCGGCA CTATGCCTGA TGACTGCGGC

  51 GGCACAGGCT GCCGATACTT ACGGCTATCT CGCCGTTTGG CAGAATCCGC

 101 AGGATGCAAA CGATGTTTTG CAGGTTAAAA CCACAAAAGA AGATTCGGCG

 151 AAAAGCGAAG CGTTTGCCGA GTTGGAAGCC TTTTGCAAAG GTCAGGACAC

 201 GCTTGCGGGC ATTGCCGAAG ACGAGCCGAC CGGATGCCGG TCGGTCGTGT

 251 CGCTGAACAA TACCTGTGTC TCGCTGGCAT ACCCGAAAGC CTTGGGCGCG

 301 ATGCGCGTTG AAAACGCCGT CGTGATTACT TCTCCGCGTT TTACGAGCGT

 351 TCATCAGGTC GCACTCAACC AGTGCATAAA AAAATACGGC GCACAGGGAC

 401 AATGCGGCTT GGAAACAGTG TATTGCACGT CATCTTCTTA TTACGGCGGG

 451 GCTGTTCGCT CCTTAATCCA ACACCTGAAA TAA
```

This corresponds to the amino acid sequence <SEQ ID 2494; ORF 734.ng>:

```
g734.pep
   1 MMKKILAVSA LCLMTAAAQA ADTYGYLAVW QNPQDANDVL QVKTTKEDSA

  51 KSEAFAELEA FCKGQDTLAG IAEDEPTGCR SVVSLNNTCV SLAYPKALGA

 101 MRVENAVVIT SPRFTSVHQV ALNQCIKKYG AQGQCGLETV YCTSSSYYGG

 151 AVRSLIQHLK *
```

The following partial DNA sequence was identified in *N. meningitidis* <SEQ ID 2495>:

```
m734.seq (partial)
   1 TCGGGCATTG CTGAAGACGA GCCGACCGGA TGCCGGTCGG TCGTGTCGCT

  51 GAACAATACC TGTGTCGCGC TGGCATACCC GAAAGCCTTG GGCGCGCTGC

 101 GTGTCGACAA CGCCGTCGTG ATTACTTCTC CGCGTTTTAC GAGCGTTCAT

 151 CAGGTCGCAC TCAACCAGTG CATCAAAAAA TACGGCGTAC AGGGACAATG

 201 CGGCTTGGAA ACAGTGTATT GCACATCTTC TTCTTATTAC GGCGGAACTG

 251 TGCGCTCTTT GATTCAAAAT CTCAAATAA
```

This corresponds to the amino acid sequence <SEQ ID 2496; ORF 734>:

```
m734.pep (partial)
  1 SGIAEDEPTG CRSVVSLNNT CVALAYPKAL GALRVDNAVV ITSPRFTSVH

 51 QVALNQCIKK YGVQGQCGLE TVYCTSSSYY GGTVRSLIQN LK*
```

m734/g734 92.4% identity in 92 aa overlap

```
                                              10        20        30
m734.pep                               SGIAEDEPTGCRSVVSLNNTCVALAYPKAL
                                       :||||||||||||||||||||:|||||||
g734       VLQVKTTKEDSAKSEAFAELEAFCKGQDTLAGIAEDEPTGCRSVVSLNNTCVSLAYPKAL
           40        50        60        70        80        90
                  40        50        60        70        80        90
m734.pep   GALRVDNAVVITSPRFTSVHQVALNQCIKKYGVQGQCGLETVYCTSSSYYGGTVRSLIQN
           ||:||:|||| ||| ||||||||||||||||||:||||||||||||||||||:||||||:
g734       GAMRVENAVVITSPRFTSVHQVALNQCIKKYGAQGQCGLETVYCTSSSYYGGAVRSLIQH
           100       110       120       130       140       150
m734.pep   LKX
           |||
g734       LKX
          160
```

The following partial DNA sequence was identified in *N. meningitidis* <SEQ ID 2497>:

```
a734.seq
   1 ATGATGAAAA AGATACTGGC CGTATCGGCA CTATGCCTGA TGACTGCGGC

  51 GGCACGGGCT GCCGATACTT ACGGCTATCT CGCCGTTTGG CAGAATCCGC

 101 AGAATGCAAA CGATGTTTTG CAGGTTAAAA CCACAAAAGA AGATTCGACG

 151 AAAAGCGAAG CGTTTGCCGA GTTGGAAGCT TTCTGCAAAG GTCAGGACAC

 201 GCTTGCGGGC ATTGCCGAAG ACGAGCCGAC CGGATGCCGG TCGGTCGTGT

 251 CGCTGAACAA TACCTGTGTC GCGCTGGCAT ACCCGAAAGC CTTGGGCGCG

 301 ATGCGCGTTG AAAACGCCGT TGTGATTACT TCTCCGCGTT TTACGAGCGT

 351 TTATCAGGTC GCACTCAACC AGTGCATCAA AAAATACGGC GCACAGGGAC

 401 AATGCGGCTT GGAAACAGTG TATTGCACGT CTTCTTCTTA TTACGGGGGA

 451 ACTGTGCGCT CTTTGATTCA AAATCTCAAA TAA
```

This corresponds to the amino acid sequence <SEQ ID 2498; ORF 734.a>:

```
a734.pep
   1 MMKKILAVSA LCLMTAAARA ADTYGYLAVW QNPQNANDVL QVKTTKEDST

  51 KSEAFAELEA FCKGQDTLAG IAEDEPTGCR SVVSLNNTCV ALAYPKALGA

 101 MRVENAVVIT SPRFTSVYQV ALNQCIKKYG AQGQCGLETV YCTSSSYYGG

 151 TVRSLIQNLK *
```

a734/g734 95.6% identity in 160 aa overlap

```
                  10        20        30        40        50        60
a734.pep   MMKKILAVSALCLMTAAARAADTYGYLAVWQNPQNANDVLQVKTTKEDSTKSEAFAELEA
           |||||||||||||||||:|||||||||||||||:|||||||||||||||:||||||||||
g734       MMKKILAVSALCLMTAAAQAADTYGYLAVWQNPQDANDVLQVKTTKEDSAKSEAFAELEA
                  10        20        30        40        50        60

                  70        80        90       100       110       120
a734.pep   FCKGQDTLAGIAEDEPTGCRSVVSLNNTCVALAYPKALGAMRVENAVVITSPRFTSVYQV
           ||||||||||||||||||||||||||||||:|||||||||||||||||||||||||||:||
g734       FCKGQDTLAGIAEDEPTGCRSVVSLNNTCVSLAYPKALGAMRVENAVVITSPRFTSVHQV
                  70        80        90       100       110       120
```

-continued

```
                130        140        150        160
a734.pep  ALNQCIKKYGAQGQCGLETVYCTSSSYYGGTVRSLIQNLKX
          ||||||||||||||||||||||||||||||||:||||||:|||
g734      ALNQCIKKYGAQGQCGLETVYCTSSSYYGGAVRSLIQHLKX
                130        140        150        160
```

g735.seq not found yet g735.pep not found yet

The following partial DNA sequence was identified in *N. meningitidis* <SEQ ID 2499>:

```
m735.seq
   1 ATGAATCTCG TGAAACTGCT GGCGAATAAC TGGCAACCGA TTGCCATTAT

  51 CGCGCTTGTC GGCACGGGCT TGGCTGTGTC GCACCATCAA GGCTACAAGT

 101 CGGCATTTGC GAAGCAGCAG GCGGTCATCG ACAAGATGGA GCGCGACAAG

 151 GCGCAAGCCC TGCTGTTGTC GGCTCAAAAC TATGCGCGCG AACTGGAACT

 201 GGCACGCGCG GAAGCTAAAA AATATGAAGT CAAGGCGCAC GCTGTCGGCA

 251 TGGCTTTGGC GAAAAAACAG GCGGAAGTCA GCCGTCTGAA AACGGAAAAT

 301 AAAAAGGAAA TCGAAAATGT CCTTACTCAA GACCGTAAAA ATGCAAGCGG

 351 CGGTTGCATT GACGGCTTTG GCTCTCACGG CCTGCAGCTC TACAACCGCG

 401 CCCTCGGCTA CGGAAATTAA
```

This corresponds to the amino acid sequence <SEQ ID 2500; ORF 735>:

```
m735.pep
   1 MNLVKLLANN WQPIAIIALV GTGLAVSHHQ GYKSAFAKQQ AVIDKMERDK

  51 AQALLLSAQN YARELELARA EAKKYEVKAH AVGMALAKKQ AEVSRLKTEN

 101 KKEIENVLTQ DRKNASGGCI DGFGSHGLQL YNRALGYGN*
```

The following partial DNA sequence was identified in *N. meningitidis* <SEQ ID 2501>:

```
a735.seq
   1 ATGAATCTCG TGAAACTGCT GGCGAATAAC TGGCAACCGA TTGCCATCAT

  51 CGCGCTTGTC GGCACGGGTT TGGCGGTGTC GCACCATCAA GGCTACAAGT

 101 CGGCTTTTGC GAAGCAGCAG GCGGTCATTG AGAAAATGAA GCGCGACAAG

 151 GCGCAAGCCC TGCTGTTGTC GGCTCAAAAC TACGCCCGCG AACTGGAACA

 201 GGCGCGTGCG GAAGCTAAAA AATATGAAGT CAAGGCGCAC GCCGTCGGCA

 251 TGGCTTTGGC GAAAAAACAG GCGGAAGTCA GCCGTCTGAA AACGGAAAAT

 301 AAAAAGGAAA TCGAAAATGT CCTTACTCAA GACCGTAAAA ATGCAGGCGG

 351 CGGTTGTATT GACGGCTTTG GCCATCACGG CTTGCAGCTC TACAAGCGCG

 401 CCCTCGGCTA CGGAAATTAA
```

This corresponds to the amino acid sequence <SEQ ID 2502; ORF 735.a>:

```
a735.pep

   1  MNLVKLLANN WQPIAIIALV GTGLAVSHHQ GYKSAFAKQQ AVIEKMKRDK
```

-continued

```
 51  AQALLLSAQN YARELEQARA EAKKYEVKAH AVGMALAKKQ AEVSRLKTEN

101  KKEIENVLTQ DRKNAGGGCI DGFGHHGLQL YKRALGYGN*
```

```
a735/m735  95% identity in 139 aa overlap

                   10        20        30        40        50        60
a735.pep   MNLVKLLANNWQPIAIIALVGTGLAVSHHQGYKSAFAKQQAVIEKMKRDKAQALLLSAQN
           ||||||||||||||||||||||||||||||||||||||||||:||:||||||||||||||
m735       MNLVKLLANNWQPIAIIALVGTGLAVSHHQGYKSAFAKQQAVIDKMERDKAQALLLSAQN
                   10        20        30        40        50        60

                   70        80        90       100       110       120
a735.pep   YARELEQARAEAKKYEVKAHAVGMALAKKQAEVSRLKTENKKEIENVLTQDRKNAGGGCI
           |||||||||||||||||||||||||||||||||||||||||||||||||||||||:||||
m735       YARELELARAEAKKYEVKAHAVGMALAKKQAEVSRLKTENKKEIENVLTQDRKNASGGCI
                   70        80        90       100       110       120

                  130       140
a735.pep   DGFGHHGLQLYKRALGYGNX
           |||| ||||||:||||||||
m735       DGFGSHGLQLYNRALGYGNX
                  130       140
```

The following partial DNA sequence was identified in *N. gonorrhoeae* <SEQ ID 2503>:

```
g736.seq
  1 ATGAATTTTA TCCGTTCCGT CGGGGCGAAA ACCCTCGGCC TTATTCAATC

 51 CTTCGGCAGT ATCACGCTGT TTCTGCTGAA CATTTTGGCG AAATCCGGCA

101 CGGCTTTCGC CCGTCCGCGC CTGAGCGTGC GCCAAGTGTA TTTTGCCGGC

151 GTGCTGTCGG TGCTGATTGT TGCCGTTTCG GGGCTGTTCG TCGGTATGGT

201 TTTGGGTTTG CAGGGCTATA CGCAGTTGTC GAAATTCAAA TCCGCCGATA

251 TTTTGGGCTA TATGGTCGCG GCTTCTCTGT TGCGCGAACT GGGTCCCGTG

301 TTGGCGGCGA TTCTGTTTGC CAGCAGCGCG GGCGGTGCGA TGACCAGCGA

351 AATCGGTTTG ATGAAAACGA CCGGACAGCT CGAAGCGATG AACGTGATGG

401 CGGTCAACCC CGTCGCCCGC GTGGTTGCCC CGCGTTTTTG GGCGGGCGTG

451 TTTTCTATGC CGCTTTTGGC TTCGATTTTC AACGTCGCGG GCATTTTCGG

501 CGCGTATTTG GTCGGCGTGA GCTGGCTGGG TTTGGACAGC GGTATTTTCT

551 GGCCGCAGAT GCAGAACAAC ATTACGATAC ATTACGATGT AATCAACGGT

601 TTGATCAAAT CCGCCGCGTT CGGCGTGGCG GTAACGCTGA TTGCCGTGCA

651 TCAGGGCTTC CACTGCATCC CGACTTCGGA AGGCATTTTG CGCGCCAGCA

701 CGCGCACGGT GGTTTCGTCC GCCCTGACGA TTTTGGCGGT CGATTTTATA

751 TTGACCGCGT GGATGTTTAC AGATTGA
```

This corresponds to the amino acid sequence <SEQ ID 2504; ORF 736>:

```
g736.pep
  1 MNFIRSVGAK TLGLIQSFGS ITLFLLNILA KSGTAFARPR LSVRQVYFAG

 51 VLSVLIVAVS GLFVGMVLGL QGYTQLSKFK SADILGYMVA ASLLRELGPV

101 LAAILFASSA GGAMTSEIGL MKTTGQLEAM NVMAVNPVAR VVAPRFWAGV

151 FSMPLLASIF NVAGIFGAYL VGVSWLGLDS GIFWPQMQNN ITIHYDVING

201 LIKSAAFGVA VTLIAVHQGF HCIPTSEGIL RASTRTVVSS ALTILAVDFI

251 LTAWMFTD*
```

The following partial DNA sequence was identified in *N. meningitidis* <SEQ ID 2505>:

```
m736.seq
   1 ATGAATTTTA TCCGTTCCGT CGGGGCGAAA ACCCTCGGCC TTATTCAATC

  51 CTTCGGCAGT ATCACGCTGT TTCTGCTGAA CATTTTGGCG AAATCCGGCA

 101 CGGCTTTCGC CCGTCCGCGC CTGAGCGTGC GCCAAGTGTA TTTTGCCGGC

 151 GTGCTGTCGG TGCTGATTGT TGCCGTTTCG GGGCTGTTCG TCGGTATGGT

 201 TTTGGGTTTG CAGGGCTATA CGCAGTTGTC GAAATTCAAA TCCGCCGATA

 251 TTTTGGGCTA TATGGTCGCG GCTTCTCTGT TGCGCGAACT GGGTCCCGTG

 301 TTGGCGGCGA TTCTGTTTGC CAGCAGCGCG GGCGGTGCGA TGACCAGCGA

 351 AATCGGTTTG ATGAAAACGA CCGGACAGCT CGAAGCGATG AACGTGATGG

 401 CGGTCAACCC CGTCGCCCGC GTGGTTGCCC CGCGTTTTTG GGCGGGCGTG

 451 TTTTCTATGC CGCTTTTGGC TTCGATTTTC AACGTCGCGG GCATTTTCGG

 501 CGCGTATTTG GTCGGCGTGA GCTGGCTGGG TTTGGACAGC GGTATTTTCT

 551 GGCCGCAGAT GCAGAACAAC ATTACGATAC ATTACGATGT AATCAACGGT

 601 TTGATCAAAT CCGCCGCGTT CGGCGTGGCG GTAACGCTGA TTGCCGTGCA

 651 TCAGGGCTTC CACTGCATCC CGACTTCGGA AGGCATTTTG CGCGCCAGCA

 701 CGCGCACGGT GGTTTCGTCC GCCCTGACGA TTTTGGCGGT CGATTTTATA

 751 TTGACCGCGT GGATGTTTAC AGATTGA
```

This corresponds to the amino acid sequence <SEQ ID 2506; ORF 736>:

```
m736.pep
   1 MNFIRSVGAK TLGLIQSLGS ITLFLLNILA KSGTAFVRPR LSVRQVYFAG

  51 VLSVLIVAVS GLFVGMVLGL QGYTQLSKFK SADILGYMVA ASLLRELGPV

 101 LAAILFASSA GGAMTSEIGL MKTTEQLEAM NVMAVNPVAR VVAPRFWAGV

 151 FSMPLLASIF NVAGIFGAYL VGVTWLGLDS GIFWSQMQNN ITIHYDVING

 201 LIKSAAFGVA VTLIAVHQGF HCVPTSEGIL RASTRTVVSS ALTILAVDFI

 251 LTAWMFTD*
```

Computer analysis of the amino acid sequences gave the following results:

Homology with a Predicted ORF from *N. meningitidis* menA with menB ORF 736 shows 97.7% identity over a 258 aa overlap with a predicted ORF (ORF736.ng) from *N. gonorrhoeae*:

```
m736/g736

                    10        20        30        40        50        60
m736.pep    MNFIRSVGAKTLGLIQSLGSITLFLINILAKSGTAFVRPRLSVRQVYFAGVLSVLIVAVS
            |||||||||||||||||:||||||||||||||||||:|||||||||||||||||||||||
g736        MNFIRSVGAKTLGLIQSFGSITLFLLNILAKSGTAFARPRLSVRQVYFAGVLSVLIVAVS
                    10        20        30        40        50        60

                    70        80        90       100       110       120
m736.pep    GLFVGMVLGLQGYTQLSKFKSADILGYMVAASLLRELGPVLAAILFASSAGGAMTSEIGL
            ||||||||||||||||||||||||||||||||||||||||||||||||||||||||||||
g736        GLFVGMVLGLQGYTQLSKFKSADILGYMVAASLLRELGPVLAAILFASSAGGAMTSEIGL
                    70        80        90       100       110       120
```

-continued

```
                130        140        150        160        170        180
m736.pep  MKTTEQLEAMNVMAVNPVARVVAPRFWAGVFSMPLLASIFNVAGIFGAYLVGVTWLGLDS
          |||| |||||||||||||||||||||||||||||||||||||||||||||||:||||||
g736      MKTTGQLEAMNVMAVNPVARVVAPRFWAGVFSMPLLASIFNVAGIFGAYLVGVSWLGLDS
                130        140        150        160        170        180

                190        200        210        220        230        240
m736.pep  GIFWSQMQNNITIHYDVINGLIKSAAFGVAVTLIAVHQGFHCVPTSEGILRASTRTVVSS
          |||| ||||||||||||||||||||||||||||||||||||:|||||||||||||||||
g736      GIFWPQMQNNITIHYDVINGLIKSAAFGVAVTLIAVHQGFHCIPTSEGILRASTRTVVSS
                190        200        210        220        230        240

                250       259
m736.pep  ALTILAVDFILTAWMFTDX
          |||||||||||||||||||
g736      ALTILAVDFILTAWMFTDX
                250
```

The following partial DNA sequence was identified in *N. meningitidis* <SEQ ID 2507>:

```
a736.seq
   1 ATGAATTTTA TCCGTTCCGT CGGGGCGAAA ACCCTCGGCC TTATTCAATC

  51 TCTCGGCAGT ATCACGCTGT TTCTGCTGAA TATTCTGGCG AAATCCGGTA

 101 CGGCTTTCGT CCGTCCGCGC CTGAGCGTGC GCCAAGTGTA TTTTGCCGGC

 151 GTGCTGTCGG TGTTGATTGT TGCCGTTTCA GGGCTGTTTG TCGGCATGGT

 201 CTTGGGTTTG CAGGGCTATA CGCAGTTGTC GAAATTCAAA TCCGCCGATA

 251 TTTTGGGCTA TATGGTCGCG GCTTCGCTGT TGCGCGAACT GGGTCCGGTG

 301 TTGGCGGCGA TTCTGTTTGC CAGCAGCGCG GGCGGTGCGA TGACCAGCGA

 351 AATCGGTTTG ATGAAAACGA CCGAACAGCT CGAAGCGATG AACGTGATGG

 401 CGGTAAACCC CGTCGCCCGA GTGGTTGCGC CGCGCTTTTG GGCGGGCGTG

 451 TTTTCCATGC CGCTTTTGGC TTCGATTTTC AACGTGGCGG GTATTTTCGG

 501 CGCGTATTTG GTCGGTGTAA CCTGGCTGGG CTTGGACAGC GGTATTTTCT

 551 GGTCGCAAAT GCAGAACAAC ATCACGATAC ATTACGATGT AATCAACGGT

 601 CTGATCAAAT CCGCCGCGTT CGGCGTGGCG GTAACGCTGA TTGCCGTGCA

 651 TCAGGGCTTC CACTGCGTCC CGACCTCGGA AGGCATTTTG CGCGCCAGCA

 701 CGCGCACGGT GGTTTCGTCC GCCCTGACGA TTTTGGCGGT CGATTTTATA

 751 TTGACCGCGT GGATGTTTAC AGATTGA
```

This corresponds to the amino acid sequence <SEQ ID 2508; ORF 736.a>:

```
a736.pep

       1  MNFIRSVGAK TLGLIQSLGS ITLFLLNILA KSGTAFVRPR LSVRQVYFAG

      51  VLSVLIVAVS GLFVGMVLGL QGYTQLSKFK SADILGYMVA ASLLRELGPV

     101  LAAILFASSA GGAMTSEIGL MKTTEQLEAM NVMAVNPVAR VVAPRFWAGV

     151  FSMPLLASIF NVAGIFGAYL VGVTWLGLDS GIFWSQMQNN ITIHYDVING

     201  LIKSAAFGVA VTLIAVHQGF HCVPTSEGIL RASTRTVVSS ALTILAVDFI

     251  LTAWMFTD*

a736/m736  100.0% identity in 258 aa overlap

                10         20         30         40         50         60
a736.pep  MNFIRSVGAKTLGLIQSLGSITLFLINILAKSGTAFVRPRLSVRQVYFAGVLSVLIVAVS
          ||||||||||||||||||||||||||||||||||||||||||||||||||||||||||||
m736      MNFIRSVGAKTLGLIQSLGSITLFLLNILAKSGTAFVRPRLSVRQVYFAGVLSVLIVAVS
                10         20         30         40         50         60
```

-continued

```
              70         80         90        100        110        120
a736.pep   GLFVGMVLGLQGYTQLSKFKSADILGYMVAASLLRELGPVLAAILFASSAGGAMTSEIGL
           ||||||||||||||||||||||||||||||||||||||||||||||||||||||||||||
m736       GLFVGMVLGLQGYTQLSKFKSADILGYMVAASLLRELGPVLAAILFASSAGGAMTSEIGL
              70         80         90        100        110        120

             130        140        150        160        170        180
a736.pep   MKTTEQLEAMNVMAVNPVARVVAPRFWAGVFSMPLLASIFNVAGIFGAYLVGVTWLGLDS
           ||||||||||||||||||||||||||||||||||||||||||||||||||||||||||||
m736       MKTTEQLEAMNVMAVNPVARVVAPRFWAGVFSMPLLASIFNVAGIFGAYLVGVTWLGLDS
             130        140        150        160        170        180

             190        200        210        220        230        240
a736.pep   GIFWSQMQNNITIHYDVINGLIKSAAFGVAVTLIAVHQGFHCVPTSEGILRASTRTVVSS
           ||||||||||||||||||||||||||||||||||||||||||||||||||||||||||||
m736       GIFWSQMQNNITIHYDVINGLIKSAAFGVAVTLIAVHQGFHCVPTSEGILRASTRTVVSS
             190        200        210        220        230        240

             250      259
a736.pep   ALTILAVDFILTAWMFTDX
           |||||||||||||||||||
m736       ALTILAVDFILTAWMFTDX
             250
```

The following partial DNA sequence was identified in *N. gonorrhoeae* <SEQ ID 2509>:

```
g737.seq
   1 atgaACATCA AACACCTTCT CTTGACCGCC GCCGCAACCG CACTGTTGGG

  51 CATTTCCGCC CCCGCACTCG CCCACCACGA CGGACACGGC GATGACGACC

 101 ACGGACACGC CGCACACCAA CACGGCAAAC AAGACAAAAT CATCAGCCGC

 151 GCCCAAGCCG AAAAAGCGGC TTGGGCGCGT GTCGGCGGCA AAATCACCGA

 201 CATCGATCTC GAACACGACG ACGGCCGTCC GCACTATGAT GTCGAAATCG

 251 TCAAAAACGG ACAGGAATAC AAAGTCGTTG TCGATGCCCG TACCGGCCGC

 301 GTGATTTCCT CCCGCCGCGA CGACTGA
```

This corresponds to the amino acid sequence <SEQ ID 2510; ORF 737>:

```
g737.pep
   1 MNIKHLLLTA AATALLGISA PALAHHDGHG DDDHGHAAHQ HGKQDKIISR

  51 AQAEKAAWAR VGGKITDIDL EHDDGRPHYD VEIVKNGQEY KVVVDARTGR

 101 VISSRRDD*
```

The following partial DNA sequence was identified in *N. meningitidis* <SEQ ID 2511>:

```
m737.seq..
   1 ATGAACATCA AACACCTTCT CTTGACCTCC GCCGCAACCG CACTGCTGAG

  51 CATTTCCGCC CCCGCGCTCG CCCACCACGA CGGACACGGC GATGACGACC

 101 ACGGACACGC CGCACACCAA CACAACAAAC AAGACAAAAT CATCAGCCGC

 151 GCCCAAGCCG AAAAAGCAGC GTTGGCGCGT GTCGGCGGCA AAATCACCGA

 201 CATCGATCTC GAACACGACA ACGGCCGTCC GCACTATGAT GTCGAAATCG

 251 TCAAAAACGG ACAGGAATAC AAAGTCGTTG TCGATGCCCG TACCGGCCGC

 301 GTGATTTCCT CCCGCCGCGA CGACTGA
```

This corresponds to the amino acid sequence <SEQ ID 2512; ORF 737>:

```
m737.pep
    1 MNIKHLLLTS AATALLSISA PALAHHDGHG DDDHGHAAHQ HNKQDKIISR

   51 AQAEKAALAR VGGKITDIDL EHDNGRPHYD VEIVKNGQEY KVVVDARTGR

  101 VISSRRDD*
```

Computer analysis of the amino acid sequences gave the following results:

Homology with a Predicted ORF from *N. meningitidis* menA with menB ORF 737 shows 95.4% identity over a 108 aa overlap with a predicted ORF (ORF737.a) from *N. gonorrhoeae*:

```
m737/g737

                   10        20        30        40        50        60
m737.pep   MNIKHLLLTSAATALLSISAPALAHHDGHGDDDHGHAAHQHNKQDKIISRAQAEKAALAR
           |||||||||:||||||:||||||||||||||||||||||||:||||||||||||||| ||
g737       MNIKHLLLTAAATALLGISAPALAHHDGHGDDDHGHAAHQHGKQDKIISRAQAEKAAWAR
                   10        20        30        40        50        60

                   70        80        90       100       109
m737.pep   VGGKITDIDLEHDNGRPHYDVEIVKNGQEYKVVVDARTGRVISSRRDDX
           |||||||||||||:|||||||||||||||||||||||||||||||||||
g737       VGGKITDIDLEHDDGRPHYDVEIVKNGQEYKVVVDARTGRVISSRRDDX
                   70        80        90       100
```

The following partial DNA sequence was identified in *N. meningitidis* <SEQ ID 2513>:

```
a737.seq
    1 ATGAACTTCA AACGCCTTCT CTTGACCGCC GCCGCAACCG CACTGATGGG

   51 CATTTCCGCC CCCGCACTCG CCCACCACGA CGGACACGGC GATGACGACC

  101 ACGGACACGC CGCACACCAA CACAGCAAAC AAGACAAAAT CATCAGCCGC

  151 GCCCAAGCCG AAAAAGCAGC GTTGGCGCGT GTCGGCGGCA AAATCACCGA

  201 CATCGATCTC GAACACGACA ACGGCCGTCC GCACTATGAT GTCGAAATCG

  251 TCAAAAACGG ACAGGAATAC AAAGTCGTTG TCGATGCCCG TACCGGCCGC

  301 GTGATTTCCT CCCGCCGCGA CGACTGA
```

This corresponds to the amino acid sequence <SEQ ID 2514; ORF 737.a>:

```
a737.pep

         1 MNFKRLLLTA AATALMGISA PALAHHDGHG DDDHGHAAHQ HSKQDKIISR

        51 AQAEKAALAR VGGKITDIDL EHDNGRPHYD VEIVKNGQEY KVVVDARTGR

       101 VISSRRDD*

a737/m737  94.4% identity in 108 aa overlap

                   10        20        30        40        50        60
a737.pep   MNFKHLLLTAAATALMGISAPALAHHDGHGDDDHGHAAHQHSKQDKIISRAQAEKAALAR
           ||:||||||:|||||::||||||||||||||||||||||||:||||||||||||||| ||
m737       MNIKHLLLTSAATALLSISAPALAHHDGHGDDDHGHAAHQHNKQDKIISRAQAEKAAWAR
                   10        20        30        40        50        60

                   70        80        90       100       109
a737.pep   VGGKITDIDLEHDNGRPHYDVEIVKNGQEYKVVVDARTGRVISSRRDDX
           |||||||||||||||||||||||||||||||||||||||||||||||||
m737       VGGKITDIDLEHDNGRPHYDVEIVKNGQEYKVVVDARTGRVISSRRDDX
                   70        80        90       100
```

The following partial DNA sequence was identified in *N. gonorrhoeae* <SEQ ID 2515>:

```
g738.seq
     1 ATGTCCGCTG AAACGACCGT ATCCGGCGCG CGCCCCGCCG CCAAACTGCC
    51 GATTTACATC CTGCCCTGCT TCCTTTGGAT AGGCATCATC CCCTTTACCT
   101 TCGCACTCAG GCTGAAACCG TCGCCCGACT TTTACCACGA TGCCGCCGCC
   151 GCGGCCGGCC TGATTGTCCT GTTGTTCCTC ACGGCAGGAA AAAAGCTGTT
   201 TGATGTCAAA ATCCCCGCCA TCAGCTTCCT CCTGTTTGCA ATGGCGGCAT
   251 TTTGGTGGCT TCAGGCACGC CTGATGAACC TGATTTATCC CGGAATGAAC
   301 GACATCGCCT CTTGGGTTTT CATCTTGCTC GCCGTCAGCG CGTGGGCCTG
   351 CAAGAGTTTG GTCGCACACT ACGGACAAGA ACGCAtcgtT ACCCTGTTTG
   401 CCTGGTCGCT GCTTATCGGC TCCCTGCTTC AATCCTGCAT CGTcgtCATC
   451 CAGTTTGCCG GCTGGGAAAA CACCCCCCTG CTTCAAAACA TCATCGTTCA
   501 CAGAGGGCAA GGCGTAATCG GACACATCGG GCAGCGCAAC AACCTCGGAC
   551 ACTACCTCAT GTGGGGCATA CTCGCCTCCG CCTACCTCAA CGGACAACGA
   601 AAAATCCCCG CAGCCCTCGG CGCAATCTGC CTGATTATGC AGACCGCCGT
   651 TTTAGGTTTG GTCAATTCGC GCACCATCTT GACCTACATA GCCGCCATCG
   701 CCCTCATCCT TCCCTTCTGG TATTTCCGTT CGGACAAATC CAACAGACGG
   751 ACGATGCTCG GCATAGCCGC AGCCGTATTC CTTACCGCGC TGTTCCAATT
   801 TTCCATGAAC GCCATTCTGG AAACCTTTAC AGGCATCCGC TACGAAACTG
   851 CCGTCGAACG CGTCGCCAAC GGCGGTTTCA CAGACTTGCC GCGCCAAAGC
   901 GAATGGAATA AAGCCCTTGC CGCCTTCCAG TCCGCCCCGA TATTCGGGCA
   951 CGGCTGGAAC AGTTTTGCCC AACAAACCTT CCTGATCAAT GCCGAACAGC
  1001 ACACCATACA CGACAACTTC CTCAGCACCT TGTTCACCCA TTCCCACAAC
  1051 ATCATCCTCC AACTCCTTGC AGAAATGGGG ATCAGCGGCA CGCTTCTGGT
  1101 TGCCGCAACC CTGCTGACGG GCATTGCCGG GCTGCTGAAA CGCTCCCTGA
  1151 CCCCCGCATC ACTTTTCCTG CTGTGCGCGC TTGCCGTCAG TATGTGCCAC
  1201 AGTATGCTCG AATATCCTTT GTGGTATGTC TATTTCCTCA TCCCCTTCGG
  1251 ACTGATGCTC TTTCTGTCCC CCGCAGAGGC TTCAGACGGC ATCGCCTTCA
  1301 AAAAAGCCGC CAATCTCGGC ATACTGACCG CCTCCGCCGC CATATTCGCA
  1351 GGATTGCTGC ACTTGGACTG GACATACACC CGGCTGGTTA ACTCCTTTTC
  1401 CCCCGCCGCT GACGACAGTG CCAAAACCCT CAACCGGAAA ATCAACGAAC
  1451 TGCGCTATAT TTCCGCAAAC AGCCCGATGC TGTCCTTTTA TGCCGACTTC
  1501 TCCCTCGTAA ACTTCGCCCT GCCGGAATAC CCCGAAACCC AGACTTGGGC
  1551 GGAAGAAGCA ACCCTCAAAG CACTAAAATA CCGCCCCTAC TCCGCCACCT
  1601 ACCGCATCGC CCTCTACTTG ATGCGGCAAG GCAAAGTTGC AGAAGCAAAA
  1651 CAATGGATGC GGGCAACACA GTCCTATTAC CCCTACCTGA TGCCCCGATA
  1701 CGCCGACGAA ATCCGCAAAC TGCCCGTATG GGCACCGCTG CTGCCCGAAC
  1751 TGCTCAAAGA CTGCAAAGCC TTCGCCGCCG CTCCCGGCCA TCCGGAAACA
  1801 AAACCCTGCA AATGA
```

This corresponds to the amino acid sequence <SEQ ID 2516; ORF 738>:

```
g738.pep
   1 MSAETTVSGA RPAAKLPIYI LPCFLWIGII PFTFALRLKP SPDFYHDAAA

  51 AAGLIVLLFL TAGKKLFDVK IPAISFLLFA MAAFWWLQAR LMNLIYPGMN

 101 DIASWVFILL AVSAWACKSL VAHYGQERIV TLFAWSLLIG SLLQSCIVVI

 151 QFAGWENTPL LQNIIVHRGQ GVIGHIGQRN NLGHYLMWGI LASAYLNGQR

 201 KIPAALGAIC LIMQTAVLGL VNSRTILTYI AAIALILPFW YFRSDKSNRR

 251 TMLGIAAAVF LTALFQFSMN AILETFTGIR YETAVERVAN GGFTDLPRQS

 301 EWNKALAAFQ SAPIFGHGWN SFAQQTFLIN AEQHTIHDNF LSTLFTHSHN

 351 IILQLLAEMG ISGTLLVAAT LLTGIAGLLK RSLTPASLFL LCALAVSMCH

 401 SMLEYPLWYV YFLIPFGLML FLSPAEASDG IAFKKAANLG ILTASAAIFA

 451 GLLHLDWTYT RLVNSFSPAA DDSAKTLNRK INELRYISAN SPMLSFYADF

 501 SLVNFALPEY PETQTWAEEA TLKALKYRPY SATYRIALYL MRQGKVAEAK

 551 QWMRATQSYY PYLMPRYADE IRKLPVWAPL LPELLKDCKA FAAAPGHPET

 601 KPCK*
```

The following partial DNA sequence was identified in *N. meningitidis* <SEQ ID 2517>:

```
m738.seq
    1 ATGCCCGCTG AAACGACCGT ATCCGGCGCG CACCCCGCCG CCAAACTGCC

   51 GATTTACATC CTGCCCTGCT TCCTTTGGAT AGGCATCGTC CCCTTTACCT

  101 TCGCGCTCAA ACTGAAACCG TCGCCCGACT TTTACCACGA TGCCGCCGCC

  151 GCAGCCGGCC TGATTGTCCT GTTGTTCCTC ACGGCAGGAA AAAAACTGTT

  201 TGATGTCAAA ATCCCCGCCA TCAGCTTCCT TCTGTTTGCA ATGGCGGCGT

  251 TTTGGTATCT TCAGGCACGC CTGATGAACC TGATTTACCC CGGTATGAAC

  301 GACATCGTCT CTTGGATTTT CATCTTGCTC GCCGTCAGCG CGTGGGCCTG

  351 CCGGAGCTTG GTCGCACACT TCGGACAAGA ACGCATCGTG ACCCTGTTTG

  401 CCTGGTCGCT GCTTATCGGC TCCCTGCTTC AATCCTGCAT CGTCGTCATC

  451 CAGTTTGCCG GCTGGGAAGA CACCCCTCTG TTTCAAAACA TCATCGTTTA

  501 CAGCGGGCAA GGCGTAATCG GACACATCGG GCAGCGCAAC AACCTCGGAC

  551 ACTACCTCAT GTGGGGCATA CTCGCCGCCG CCTACCTCAA CGGACAACGA

  601 AAAATCCCCG CCGCCCTCGG CGTAATCTGC CTGATTATGC AGACCGCCGT

  651 TTTAGGTTTG GTCAACTCGC GCACCATCTT GACCTACATA GCCGCCATCG

  701 CCCTCATCCT TCCCTTCTGG TATTTCCGTT CGGACAAATC CAACAGGCGG

  751 ACGATGCTCG GCATAGCCGC AGCCGTATTC CTTACCGCGC TGTTCCAATT

  801 TTCCATGAAC ACCATTCTGG AAACCTTTAC TGGCATCCGC TACGAAACTG

  851 CCGTCGAACG CGTCGCCAAC GGCGGTTTCA CAGACTTGCC GCGCCAAATC

  901 GAATGGAATA AAGCCCTTGC CGCCTTCCAG TCCGCCCCGA TATTCGGGCA

  951 CGGCTGGAAC AGTTTTGCCC AACAAACCTT CCTCATCAAT GCCGAACAGC

 1001 ACAACATATA CGACAACCTC CTCAGCAACT TGTTCACCCA TTCCCACAAC

 1051 ATCGTCCTCC AACTCCTTGC AGAGATGGGA ATCAGCGGCA CGCTTCTGGT

 1101 TGCCGCAACC CTGCTGACGG GCATTGCCGG GCTGCTTAAA CGCCCCCTGA

 1151 CCCCCGCATC GCTTTTCCTA ATCTGCACGC TTGCCGTCAG TATGTGCCAC
```

-continued

```
1201 AGTATGCTCG AATATCCTTT GTGGTATGTC TATTTCCTCA TCCCTTTCGG

1251 ACTGATGCTC TTCCTGTCCC CCGCAGAGGC TTCAGACGGC ATCGCCTTCA

1301 AAAAAGCCGC CAATCTCGGC ATACTGACCG CCTCCGCCGC CATATTCGCA

1351 GGATTGCTGC ACTTGGACTG GACATACACC CGGCTGGTTA ACGCCTTTTC

1401 CCCCGCCACT GACGACAGTG CCAAAACCCT CAACCGGAAA ATCAACGAGT

1451 TGCGCTATAT TTCCGCAAAC AGTCCGATGC TGTCCTTTTA TGCCGACTTC

1501 TCCCTCGTAA ACTTCGCCCT GCCGGAATAC CCCGAAACCC AGACTTGGGC

1551 GGAAGAAGCA ACCCTCAAAT CACTAAAATA CCGCCCCCAC TCCGCCACCT

1601 ACCGCATCGC CCTCTACCTG ATGCGGCAAG GCAAAGTTGC AGAAGCAAAA

1651 CAATGGATGC GGGCGACACA GTCCTATTAC CCgTACCTGA TGCCCCGATA

1701 CGCCGACGAA ATCCGCAAAC TGCCCGTATG GGCGCCGCTG CTACCCGAAC

1751 TGCTCAAAGA CTGCAAAGCC TTCGCCGCCG CGCCCGGTCA TCCGGAAGCA

1801 AAACCCTGCA AATGA
```

This corresponds to the amino acid sequence <SEQ ID 2518; ORF 738>:

```
m738.pep
  1 MPAETTVSGA HPAAKLPIYI LPCFLWIGIV PFTFALKLKP SPDFYHDAAA

 51 AAGLIVLLFL TAGKKLFDVK IPAISFLLFA MAAFWYLQAR LMNLIYPGMN

101 DIVSWIFILL AVSAWACRSL VAHFGQERIV TLFAWSLLIG SLLQSCIVVI

151 QFAGWEDTPL FQNIIVYSGQ GVIGHIGQRN NLGHYLMWGI LAAAYLNGQR

201 KIPAALGVIC LIMQTAVLGL VNSRTILTYI AAIALILPFW YFRSDKSNRR

251 TMLGIAAAVF LTALFQFSMN TILETFTGIR YETAVERVAN GGFTDLPRQI

301 EWNKALAAFQ SAPIFGHGWN SFAQQTFLIN AEQHNIYDNL LSNLFTHSHN

351 IVLQLLAEMG ISGTLLVAAT LLTGIAGLLK RPLTPASLFL ICTLAVSMCH

401 SMLEYPLWYV YFLIPFGLML FLSPAEASDG IAFKKAANLG ILTASAAIFA

451 GLLHLDWTYT RLVNAFSPAT DDSAKTLNRK INELRYISAN SPMLSFYADF

501 SLVNFALPEY PETQTWAEEA TLKSLKYRPH SATYRIALYL MRQGKVAEAK

551 QWMRATQSYY PYLMPRYADE IRKLPVWAPL LPELLKDCKA FAAAPGHPEA

601 KPCK*
```

Computer analysis of the amino acid sequences gave the following results:

Homology with a Predicted ORF from *N. meningitidis* menA with menB ORF 738 shows 95.0% identity over a 604 aa overlap with a predicted ORF (ORF738.a) from *N. gonorrhoeae*:

```
m738/g738

                        10         20         30         40         50         60
m738.pep       MPAETTVSGAHPAAKLPIYILPCFLWIGIVPFTFALKLKPSPDFYHDAAAAAGLIVLLFL
               | ||||||||:|||||||||||||||||||:||||||:||||||||||||||||||||||
g738           MSAETTVSGARPAAKLPIYILPCFLWIGIIPFTFALRLKPSPDFYHDAAAAAGLIVLLFL
                        10         20         30         40         50         60
```

-continued

```
                      70        80        90       100       110       120
m738.pep      TAGKKLFDVKIPAISFLLFAMAAFWYLQARLMNLIYPGMNDIVSWIFILLAVSAWACRSL
              |||||||||||||||||||||||||:||||||||||||||||:||:|||||||||||:||
g738          TAGKKLFDVKIPAISFLLFAMAAFWWLQARLMNLIYPGMNDIASWVFILLAVSAWACKSL
                      70        80        90       100       110       120

                     130       140       150       160       170       180
m738.pep      VAHFGQERIVTLFAWSLLIGSLLQSCIVVIQFAGWEDTPLFQNIIVYSGQGVIGHIGQRN
              |||:||||||||||||||||||||||||||||||||:|||:|||||: ||||||||||||
g738          VAHYGQERIVTLFAWSLLIGSLLQSCIVVIQFAGWENTPLLQNIIVHRGQGVIGHIGQRN
                     130       140       150       160       170       180

                     190       200       210       220       230       240
m738.pep      NLGHYLMWGILAAAYLNGQRKIPAALGVICLIMQTAVLGLVNSRTILTYIAAIALILPFW
              ||||||||||||:||||||||||||||:||||||||||||||||||||||||||||||||
g738          NLGHYLMWGILASAYLNGQRKIPAALGAICLIMQTAVLGLVNSRTILTYIAAIALILPFW
                     190       200       210       220       230       240

                     250       260       270       280       290       300
m738.pep      YFRSDKSNRRTMLGIAAAVFLTALFQFSMNTILETFTGIRYETAVERVANGGFTDLPRQI
              ||||||||||||||||||||||||||||||:|||||||||||||||||||||||||||| 
g738          YFRSDKSNRRTMLGIAAAVFLTALFQFSMNAILETFTGIRYETAVERVANGGFTDLPRQS
                     250       260       270       280       290       300

                     310       320       330       340       350       360
m738.pep      EWNKALAAFQSAPIFGHGWNSFAQQTFLINAEQHNIYDNLLSNLFTHSHNIVLQLLAEMG
              ||||||||||||||||||||||||||||||||||:|:||:||:||||||||:||||||||
g738          EWNKALAAFQSAPIFGHGWNSFAQQTFLINAEQHTIHDNFLSTLFTHSHNIILQLLAEMG
                     310       320       330       340       350       360

                     370       380       390       400       410       420
m738.pep      ISGTLLVAATLLTGIAGLLKRPLTPASLFLICTLAVSMCHSMLEYPLWYVYFLIPFGLML
              ||||||||||||||||||||| ||||||||:|:|||||||||||||||||||||||||||
g738          ISGTLLVAATLLTGIAGLLKRSLTPASLFLLCALAVSMCHSMLEYPLWYVYFLIPFGLML
                     370       380       390       400       410       420

                     430       440       450       460       470       480
m738.pep      FLSPAEASDGIAFKKAANLGILTASAAIFAGLLHLDWTYTRLVNAFSPATDDSAKTLNRK
              ||||||||||||||||||||||||||||||||||||||||||||:||||:||||||||||
g738          FLSPAEASDGIAFKKAANLGILTASAAIFAGLLHLDWTYTRLVNSFSPAADDSAKTLNRK
                     430       440       450       460       470       480

                     490       500       510       520       530       540
m738.pep      INELRYISANSPMLSFYADFSLVNFALPEYPETQTWAEEATLKSLKYRPHSATYRIALYL
              |||||||||||||||||||||||||||||||||||||||||||:|||||:||||||||||
g738          INELRYISANSPMLSFYADFSLVNFALPEYPETQTWAEEATLKALKYRPYSATYRIALYL
                     490       500       510       520       530       540

                     550       560       570       580       590       600
m738.pep      MRQGKVAEAKQWMRATQSYYPYLMPRYADEIRKLPVWAPLLPELLKDCKAFAAAPGHPEA
              |||||||||||||||||||||||||||||||||||||||||||||||||||||||||||:
g738          MRQGKVAEAKQWMRATQSYYPYLMPRYADEIRKLPVWAPLLPELLKDCKAFAAAPGHPET
                     550       560       570       580       590       600

m738.pep      KPCKX
              |||||
g738          KPCKX
```

The following partial DNA sequence was identified in *N. meningitidis* <SEQ ID 2519>:

```
a738.seq
    1  ATGCCCGCTG AAACGACCGT ATCCGGCGCG CACCCCGCCG CCAAACTGCC

   51  GATTTACATC CTGCCCTGCT TCCTTTGGAT AGGCATCGTC CCCTTTACCT

  101  TTGCGCTCAG GCTGCAACCG TCGCCCGACT TTTACCACGA TGCCGCCGCC

  151  GCAGCCGGCC TGATTGTCCT GTTGTTCCTC ACGGCAGGAA AAAAGCTGTT

  201  TGATGTCAAA ATCCCACCTA TCAGCTTCCT TCTGTTTGCA ATGGCGGCGT

  251  TTTGGTATCT TCAGGCACGC CTGATGAACC TGATTTACCC CGGTATGAAC

  301  GACATCGTCT CTTGGATTTT CATCTTACTC GCCGTCAGCG CGTGGGCCTG

  351  CCGGAGCTTG GTCGCACACT ACGGACAAGA ACGCATCGTT ACCCTGTTTG

  401  CCTGGTCGCT GCTTATCGGC TCCCTGCTTC AATCCTGCAT CGTCGTCATC

  451  CAGTTTGCCG GCTGGGAAGA CACCCCTCTG TTTCAAAACA TCATTGTTTA

  501  CAGCGGGCAA GGCGTAATCG GACACATCGG ACAGCGCAAC AACCTCGGAC

  551  ACTACCTCAT GTGGGGCATA CTCGCCGCCG CCTACCTCAA CGGACAACGA
```

-continued

```
 601 AAAATCCCGC CCGCCTTGGG TGCAATCTGC CTGATTATGC AGACCGCCGT
 651 TTTAGGTTTG GTCAATTCGC GCACCATCTT GACCTACATA GCCGCCATCG
 701 CCCTCATCCT TCCCTTCTGG TATTTCCGTT CGGACAAATC CAACAGGCGG
 751 ACGATACTCG GCATAGCCGC AGCCGTATTC CTTACCGCGC TGTTCCAATT
 801 TTCCATGAAC ACCATTCTGG AAACCTTTAC CGGCATCCGC TACGAAACCG
 851 CCGTCGAACG CGTCGCCAAC GGCGGTTTCA CAGACCTGCC GCGCCAAATC
 901 GAATGGCGCA AAGCCCTCGC CGCCTTCCAG TCCGCCCCGA TATTCGGGCA
 951 CGGCTGGAAC AGTTTTGCCC AACAAACCTT CCTCATCAAT GCCGAACAGC
1001 ACAACATACA CGACAACCTC CTCAGCAACT TGTTCACCCA TTCCCACAAC
1051 ATCGTTCTCC AACTCCTTGC AGAGATGGGG ATCAGCGGCA CGCTTCTGGT
1101 TGCCGCAACC CTGCTGACGG GCATTGCCGG GCTGCTGAAA CGCCCCCTGA
1151 CCCCCGCATC GCTTTTCCTG ATCTGCACAC TTGCCGTCAG TATGTGCCAC
1201 AGTATGCTCG AATATCCTTT GTGGTATGTC TATTTCCTCA TCCCCTTCGG
1251 ACTGATGCTC TTTCTGTCCC CCGCAGAGGC TTCAGACGGC ATCGCCTTCA
1301 AAAAAGCCGC CAATCTCGGC ATACTAACCG CCTCCGCCGC CATATTCGCA
1351 GGATTGCTGC ACTTGGACTG GACATACACC CGGATGGTTA ACGCCTTTTC
1401 CCCCGCCACT GACGACAGTG CCAAAACCCT CAACCGGAAA ATCAACGAGT
1451 TGCGCTATAT TTCCGCAAAC AGTCCGATGC TGTCCTTTTA TGCCGACTTC
1501 TCCCTCGTAA ACTTCGCCCT GCCGGAATAC CCCGAAACCC AGACTTGGGC
1551 GGAAGAAGCA ACCCTCAAAT CACTAAAATA CCGCCCCCAC TCCGCCACCT
1601 ACCGCATCGC CCTCTACCTG ATGCGGCAAG GCAAAGTTGC AGAAGCAAAA
1651 CAATGGATGC GGGCGACACA GTCCTATTAC CCCTACCTGA TGCCCCGATA
1701 CGCCGACGAA ATCCGCAAAC TGCCCGTATG GGCGCCGCTG CTACCCGAAC
1751 TGCTCAAAGA CTGCAAAGCC TTCGCCGCCG CGCCCGGTCA TCCGGAAGCA
1801 AAACCCTGCA AATGA
```

This corresponds to the amino acid sequence <SEQ ID 2520; ORF 738.a>:

```
a738.pep
  1 MPAETTVSGA HPAAKLPIYI LPCFLWIGIV PFTFALRLQP SPDFYHDAAA
 51 AAGLIVLLFL TAGKKLFDVK IPPISFLLFA MAAFWYLQAR LMNLIYPGMN
101 DIVSWIFILL AVSAWACRSL VAHYGQERIV TLFAWSLLIG SLLQSCIVVI
151 QFAGWEDTPL FQNIIVYSGQ GVIGHIGQRN NLGHYLMWGI LAAAYLNGQR
201 KIPPALGAIC LIMQTAVLGL VNSRTILTYI AAIALILPFW YFRSDKSNRR
251 TILGIAAAVF LTALFQFSMN TILETFTGIR YETAVERVAN GGFTDLPRQI
301 EWRKALAAFQ SAPIFGHGWN SFAQQTFLIN AEQHNIHDNL LSNLFTHSHN
351 IVLQLLAEMG ISGTLLVAAT LLTGIAGLLK RPLTPASLFL ICTLAVSMCH
401 SMLEYPLWYV YFLIPFGLML FLSPAEASDG IAFKKAANLG ILTASAAIFA
451 GLLHLDWTYT RMVNAFSPAT DDSAKTLNRK INELRYISAN SPMLSFYADF
501 SLVNFALPEY PETQTWAEEA TLKSLKYRPH SATYRIALYL MRQGKVAEAK
551 QWMRATQSYY PYLMPRYADE IRKLPVWAPL LPELLKDCKA FAAAPGHPEA
```

-continued

```
     601  KPCK*

a738/m738     98.3% identity in 604 aa overlap

                    10        20        30        40        50        60
a738.pep    MPAETTVSGAHPAAKLPIYILPCFLWIGIVPFTFALRLQPSPDFYHDAAAAAGLIVLLFL
            |||||||||||||||||||||||||||||||||||||:|:||||||||||||||||||||
m738        MPAETTVSGAHPAAKLPIYILPCFLWIGIVPFTFALKLKPSPDFYHDAAAAAGLIVLLFL
                    10        20        30        40        50        60

                    70        80        90       100       110       120
a738.pep    TAGKKLFDVKIPPISFLLFAMAAFWYLQARLMNLIYPGMNDIVSWIFILLAVSAWACRSL
            |||||||||||| |||||||||||||||||||||||||||||||||||||||||||||||
m738        TAGKKLFDVKIPAISFLLFAMAAFWYLQARLMNLIYPGMNDIVSWIFILLAVSAWACRSL
                    70        80        90       100       110       120

                   130       140       150       160       170       180
a738.pep    VAHYGQERIVTLFAWSLLIGSLLQSCIVVIQFAGWEDTPLFQNIIVYSGQGVIGHIGQRN
            |||:||||||||||||||||||||||||||||||||||||||||||||||||||||||||
m738        VAHFGQERIVTLFAWSLLIGSLLQSCIVVIQFAGWEDTPLFQNIIVYSGQGVIGHIGQRN
                   130       140       150       160       170       180

                   190       200       210       220       230       240
a738.pep    NLGHYLMWGILAAAYLNGQRKIPPALGAICLIMQTAVLGLVNSRTILTYIAAIALILPFW
            ||||||||||||||||||||||| |||:||||||||||||||||||||||||||||||||
m738        NLGHYLMWGILAAAYLNGQRKIPAALGVICLIMQTAVLGLVNSRTILTYIAAIALILPFW
                   190       200       210       220       230       240

                   250       260       270       280       290       300
a738.pep    YFRSDKSNRRTILGIAAAVFLTALFQFSMNTILETFTGIRYETAVERVANGGFTDLPRQI
            |||||||||||:||||||||||||||||||||||||||||||||||||||||||||||||
m738        YFRSDKSNRRTMLGIAAAVFLTALFQFSMNTILETFTGIRYETAVERVANGGFTDLPRQI
                   250       260       270       280       290       300

                   310       320       330       340       350       360
a738.pep    EWRKALAAFQSAPIFGHGWNSFAQQTFLINAEQHNIHDNLLSNLFTHSHNIVLQLLAEMG
            || |||||||||||||||||||||||||||||||||:|||||||||||||||||||||||
m738        EWNKALAAFQSAPIFGHGWNSFAQQTFLINAEQHNIYDNLLSNLFTHSHNIVLQLLAEMG
                   310       320       330       340       350       360

                   370       380       390       400       410       420
a738.pep    ISGTLLVAATLLTGIAGLLKRPLTPASLFLICTLAVSMCHSMLEYPLWYVYFLIPFGLML
            ||||||||||||||||||||||||||||||||||||||||||||||||||||||||||||
m738        ISGTLLVAATLLTGIAGLLKRPLTPASLFLICTLAVSMCHSMLEYPLWYVYFLIPFGLML
                   370       380       390       400       410       420

                   430       440       450       460       470       480
a738.pep    FLSPAEASDGIAFKKAANLGILTASAAIFAGLLHLDWTYTRMVNAFSPATDDSAKTLNRK
            |||||||||||||||||||||||||||||||||||||||||:||||||||||||||||||
m738        FLSPAEASDGIAFKKAANLGILTASAAIFAGLLHLDWTYTRLVNAFSPATDDSAKTLNRK
                   430       440       450       460       470       480

                   490       500       510       520       530       540
a738.pep    INELRYISANSPMLSFYADFSLVNFALPEYPETQTWAEEATLKSLKYRPHSATYRIALYL
            ||||||||||||||||||||||||||||||||||||||||||||||||||||||||||||
m738        INELRYISANSPMLSFYADFSLVNFALPEYPETQTWAEEATLKSLKYRPHSATYRIALYL
                   490       500       510       520       530       540

                   550       560       570       580       590       600
a738.pep    MRQGKVAEAKQWMRATQSYYPYLMPRYADEIRKLPVWAPLLPELLKDCKAFAAAPGHPEA
            ||||||||||||||||||||||||||||||||||||||||||||||||||||||||||||
m738        MRQGKVAEAKQWMRATQSYYPYLMPRYADEIRKLPVWAPLLPELLHDCKAFAAAPGHPEA
                   550       560       570       580       590       600

a738.pep    KPCKX
            |||||
m738        KPCKX
```

The following partial DNA sequence was identified in *N. gonorrhoeae* <SEQ ID 2521>:

```
g739.seq
   1 ATGGCAAAAA AACCGAACAA ACCCTTCAGG CTGACCCCCA AACTCCTGAT

  51 ACGCGCCGTA TTGCTCATCT GTATCACCGC CATCGGCGCA TTGGCAGTAG

 101 GCATCGTCAG CACATTCAAC CCGAACGGCG ACAAAACCCT CCAAACCGAA

 151 CCGCAACACA CCGACAGCCC CCGCGAAACC GAATTCTGGC TGCCAAACGG

 201 CGCCGTCGGA CAAGATGCCG CCCAACCCGA ACACCACCAC GCCGCCTCAT

 251 CCGAACCCGC ACAGCCGGAC GGCACAGAAG AAAGCGGCAG CGGACTGCCG

 301 TCCCCTGCCG CACCCAAGAA AAACCGGGTc AAACCGCGCC CTTCGGATGC
```

-continued

```
351 GGCCCGGGCA GCCGATTCGT TAACCGGCAC CGGAACACAA GCTGAAAACA

401 CACTCAAAGA AACCCCCGTA CTGCCCACAA ACGCCCCCCA TCCCGAACCC

451 CGAAAAGAAA CACCCGAAAA ACAGGCGCAG CCCAAAGAAA CACCCAAAGA

501 AAAAGAAACG CCCAAAGAAA ACCATACCAA ACCGGACACC CCGAAAAACA

551 CGCCGGCCAA ACCCCATAAA GAGATTCTCG ACAACCTCTT TTGA
```

This corresponds to the amino acid sequence <SEQ ID 2522; ORF 739>:

```
g739.pep
  1 MAKKPNKPFR LTPKLLIRAV LLICITAIGA LAVGIVSTFN PNGDKTLQTE

 51 PQHTDSPRET EFWLPNGAVG QDAAQPEHHH AASSEPAQPD GTEESGSGLP

101 SPAAPKKNRV KPRPSDAARA ADSLTGTGTQ AENTLKETPV LPTNAPHPEP

151 RKETPEKQAQ PKETPKEKET PKENHTKPDT PKNTPAKPHK EILDNLF*
```

The following partial DNA sequence was identified in *N. meningitidis* <SEQ ID 2523>:

```
m739.seq
  1 ATGGCAAAAA AACCGAACAA ACCCTTCAGG CTGACCCCCA AACTCCTGAT

 51 ACGCGCCGTA TTGCTCATCT GTATCGCCGC CATCGGCGCA TTGGCAATAG

101 GCATCGTCAG CACATTCAAC CCGAACGGCG ACAAAACCCT TCAAGCCGAA

151 CCGCAACACA CCGACAGCCC CCGCGAAACC GAATTCTGGC TGCCAAACGG

201 CGTAGTCGGA CAAGATGCCG CCCAACCCGA ACACCACCAC GCCGCCTCAT

251 CCGAACCCGC ACAGCCGGAC GGCACAGACG AAAGCGGCAG CGGACTGCCG

301 TCCCCTGCCG CACCCAAGAA AAACCGGGTC AAACCGCAAC CTGCCGACAC

351 AGCTCAAACC GACAGGCAGC CGGACGACGC CGGAACACAA GCTGAAAACA

401 CACTCAAAGA AACCCCCGTA CTGCCCACAA ACGTCCCCCG TCCCGAACCC

451 CGAAAAGAAA CACCCGAAAA ACAGGCGCAG CCCAAAGAAA CGCCCAAAGA

501 AAACCATACC AAACCGGACA CCCCGAAAAA CACGCCGCCC AAACCCCATA

551 AAGAAATTCT CGACAAACTC TTC
```

This corresponds to the amino acid sequence <SEQ ID 2524; ORF 739>:

```
m739.pep
  1 MAKKPNKPFR LTPKLLIRAV LLICIAAIGA LAIGIVSTFN PNGDKTLQAE

 51 PQHTDSPRET EFWLPNGVVG QDAAQPEHHH AASSEPAQPD GTDESGSGLP

101 SPAAPKKNRV KPQPADTAQT DRQPDDAGTQ AENTLKETPV LPTNVPRPEP

151 RKETPEKQAQ PKETPKENHT KPDTPKNTPP KPHKEILDKL F
```

Computer analysis of the amino acid sequences gave the following results:

Homology with a Predicted ORF from *N. meningitidis* menA with menB ORF 739 shows 86.3% identity over a 197 aa overlap with a predicted ORF (ORF739.a) from *N. gonorrhoeae*:

m739/g739

-continued

```
                      10        20        30        40        50        60
m739.pep      MAKKPNKPFRLTPKLLIRAVLLICIAAIGALAIGIVSTFNPNGDKTLQAEPQHTDSPRET
              |||||||||||||||||||||||||:||||||:||||||||||||||||:||||||||||
g739          MAKKPNKPFRLTPKLLIRAVLLICITAIGALAVGIVSTFNPNGDKTLQTEPQHTDSPRET
                      10        20        30        40        50        60

                      70        80        90       100       110       120
m739.pep      EFWLPNGVVGQDAAQPEHHHAASSEPAQPDGTDESGSGLPSPAAPKKNRVKPQPADTAQT
              |||||||:||||||||||||||||||||||||:|||||||||||||||||||:|:|:|::
g739          EFWLPNGAVGQDAAQPEHHHAASSEPAQPDGTEESGSGLPSPAAPKKNRVKPRPSDAARA
                      70        80        90       100       110       120

                     130       140       150       160             170
m739.pep      DRQPDDAGTQAENTLKETPVLPTNVPRPEPRKETPEKQAQPKETPKE------NHTKPDT
                :   :|||||||||||||||||:|:||||||||||||||||||||      |||||||
g739          ADSLTGTGTQAENTLKETPVLPTNAPHPEPRKETPEKQAQPKETPKEKETPKENHTKPDT
                     130       140       150       160       170       180

                 180       190
m739.pep      PKNTPPKPHKEILDKLF
              ||||| ||||||||:||
g739          PKNTPAKPHKEILDNLFX
                     190
```

The following partial DNA sequence was identified in *N. meningitidis* <SEQ ID 2525>:

```
a739.seq
   1 ATGGCAAAAA AACCGAACAA ACCCTTCAGG CTGACCCCCA AACTCCTGAT

  51 ACGCGCCGTA TTGCTCATCT GTATCACCGC CATCGGCGCA TTGGCAATAG

 101 GCATCGTCAG CACATTCAAC CCGAACGGCG ACAAAACCCT CCAAACCGAA

 151 CCGCAACACA CCGACAGCCC CCGCGAAACC GAATTCTGGC TGCCAAACGG

 201 CGTAGTCGGA CAAGATGCCG CCCAACCCGA ACACCACCAC GCCTCCTCAT

 251 CCGCACCCGC ACAGCCGGAC GGCACAGACG AAAGCGGCAG CGGACTGCCG

 301 TCCCCTGCCG CACCCAAGAA AAACCGGGTC AAACCGCAAC CTGCCGACAC

 351 AGCTCAAACC GACAGGCAGC CGGACGACGC CGGAGCACAA GCTGAAAACA

 401 CACTCAAAGA AACCCCCGTA CTGCCCACAA ACGTCCCCCG TCCCGAACCC

 451 CGAAAAGAAA CACCCGAAAA ACAGGCACAG CCCAAAGAAA CACCCAAAGA

 501 AAAAGAAACG CCCAAAGAAA ACCATACCAA ACCGGACACC CCGAAAAACA

 551 CGCCGCCTAA ACCCCATAAA GAAATTCTCG ACAACCTCTT CTGA
```

This corresponds to the amino acid sequence <SEQ ID 2526; ORF 739.a>:

```
a739.pep

      1  MAKKPNKPFR LTPKLLIRAV LLICITAIGA LAIGIVSTFN PNGDKTLQTE

     51  PQHTDSPRET EFWLPNGVVG QDAAQPEHHH ASSSAPAQPD GTDESGSGLP

    101  SPAAPKKNRV KPQPADTAQT DRQPDDAGAQ AENTLKETPV LPTNVPRPEP

    151  RKETPEKQAQ PKETPKEKET PKENHTKPDT PKNTPPKPHK EILDNLF*

a739/m739   93.9% identity in 197 aa overlap

                      10        20        30        40        50        60
a739.pep      MAKKPNKPFRLTPKLLIRAVLLICITAIGALAIGIVSTFNPNGDKTLQTEPQHTDSPRET
              |||||||||||||||||||||||||:|||||||||||||||||||||||:||||||||||
m739          MAKKPNKPFRLTPKLLIRAVLLICIAAIGALAIGIVSTFNPNGDKTLQAEPQHTDSPRET
                      10        20        30        40        50        60

                      70        80        90       100       110       120
a739.pep      EFWLPNGVVGQDAAQPEHHHASSSAPAQPDGTDESGSGLPSPAAPKKNRVKPQPADTAQT
              |||||||||||||||||||||:|| |||||||||||||||||||||||||||||||||||
m739          EFWLPNGVVGQDAAQPEHHHAASSEPAQPDGTDESGSGLPSPAAPKKNRVKPQPADTAQT
                      70        80        90       100       110       120
```

-continued

```
                130         140         150         160         170         180
a739.pep   DRQPDDAGAQAENTLKETPVLPTNVPRPEPRKETPEKQAQPKETPKEKETPKENHTKPDT
           ||||||||:||||||||||||||||||||||||||||||||||||||      |||||||
m739       DRQPDDAGTQAENTLKETPVLPTNVPRPEPRKETPEKQAQPKETPK------ENHTKPDT
                130         140         150         160              170

                130
a739.pep   PKNTPPKPHKEILDNLFX
           ||||||||||||||:||
m739       PKNTPPKPHKEILDKLF
              180         190
```

The following partial DNA sequence was identified in *N. gonorrhoeae* <SEQ ID 2527>:

```
g740.seq
   1 ATGTCCCGAA ACCTGCTTGT CCGCTGGCTC GCCGTCTGCC TCATCCCCTT

  51 GgcgACGCTT GCCGTTTTCG CCGCCAATcc gcCCGAAGAC AAACCCCAGC

 101 ATCTGATCAA CGGCATCATC CTTGCCTGCG AAGCGACGTT TTTGTTTAAa

 151 ttcgtgctCT TTGAAACCAT CAAGCATCAT CTTAaacaag gGTTTGATTT

 201 GAAACgtcaa ACCATGTTTC TGTTTATTCC GATTGTTTTG CTGGTTGTGT

 251 ATTTGTTCCA CTATTTCGGC GCGTTTTag
```

This corresponds to the amino acid sequence <SEQ ID 2528; ORF 740.ng>:

```
g740.pep
 1  MSRNLLVRWL AVCLIPLATL AVFAANPPED KPQHLINGII LACEATFLFK

51  FVLFETIKHH LKQGFDLKRQ TMFLFIPIVL LVVYLFHYFG AF*
```

The following partial DNA sequence was identified in *N. meningitidis* <SEQ ID 2529>:

```
m740.seq
   1 ATGTCCCGAA ACCTGCTTGT CCGCTGGCTT GCCGTCTGCC TCATCCCGTT

  51 GGCGACGCTT GCCGTTTTCG CCGCCAATCC GCCCGAAGAC AAACTCCAGC

 101 ATCTGATCAA CGGCATCATC CTTGCCTGCG AAGCGACGTT TTTGTTTAAA

 151 TTCGTCCTTT TCGACACCAT CAAGCATCAT TTGAAACAAG AGTTTGATTT

 201 GAAACGTCAA ACTATGTTGC TGTTTATTCC GATTATTTTG CTGATTGTGT

 251 ATTTGTTCCA CTATTTTGGC GCGTTTTAG
```

This corresponds to the amino acid sequence <SEQ ID 2530; ORF 740>:

```
m740.pep

      1  MSRNLLVRWL AVCLIPLATL AVFAANPPED KLQHLINGII LACEATFLEK

     51  FVLFDTIKHH LKQEEDLKRQ TMLLFIPIIL LIVYLFHYFG AF*

m740/g740  93.5% identity in 92 aa overlap

                   10         20         30         40         50         60
m740.pep   MSRNLLVRWLAVCLIPLATLAVFAANPPEDKLQHLINGIILACEATFLFKFVLFDTIKHH
           |||||||||||||||||||||||||||||| ||||||||||||||||||||:|||||
g740       MSRNLLVRWLAVCLIPLATLAVFAANPPEDKPQHLINGIILACEATFLFKFVLFETIKHH
                   10         20         30         40         50         60
```

-continued

```
                    70        80        90
m740.pep   LKQEFDLKRQTMLLFIPIILLIVYLFHYFGAFX
           ||| ||||||||:|||||:||:|||||||||||
g740       LKQGFDLKRQTMFLFIPIVLLVVYLFHYFGAFX
                    70        80        90
```

The following partial DNA sequence was identified in *N. meningitidis* <SEQ ID 2531>:

```
a740.seq
   1 ATGTCCCGAA ACCTGCTTGT CCGCTGGCTT GTCGTCTGCC TGATACCCTT

  51 GGCGACGCTT GCCGTTTTCG CCGCCAATCC GCCCGAAGAC AAACCCCAGC

 101 ATCTGATTAA CGGCATCATC CTTGCCTGCG AAGCGACGTT TTTGTTCAAA

 151 TTCGTCCTTT TCGACACCAT CAAGCATCAT TTGAAACAAG AGTTTGATTT

 201 GAAACGTCAA ACTATGTTGC TGTTTATTCC GATTATTTTG CTGATTGTGT

 251 ATTTGTTCCA CTATTTTGGC GCGTTTTAG
```

This corresponds to the amino acid sequence <SEQ ID 2532; ORF 740.a>:

```
a740.pep
  1 MSRNLLVRWL VVCLIPLATL AVFAANPPED KPQHLINGII LACEATFLFK

 51 FVLFDTIKHH LKQEFDLKRQ TMLLFIPIIL LIVYLFHYFG AF*
```

a740/m740 97.8% identity in 92 aa overlap

```
                    10        20        30        40        50        60
a740.pep   MSRNLLVRWLVVCLIPLATLAVFAANPPEDKPQHLINGIILACEATFLFKFVLFDTIKHH
           ||||||||||:|||||||||||||||||||| ||||||||||||||||||||||||||||
m740       MSRNLLVRWLAVCLIPLATLAVFAANPPEDKLQHLINGIILACEATFLFKFVLFDTIKHH
                    10        20        30        40        50        60

                    70        80        90
a740.pep   LKQEFDLKRQTMLLFIPIILLIVYLFHYFGAFX
           |||||||||||||||||||||||||||||||||
m740       LKQEFDLKRQTMLLFIPIILLIVYLFHYFGAFX
                    70        80        90
```

The following partial DNA sequence was identified in *N. gonorrhoeae* <SEQ ID 2533>:

```
g741.seq
   1 GTGAACCGAA CTACCTTCTG CTGCCTTTCT TTGACCGCCG GCCCTGATTC

  51 TGACCGCCTG CAGCAGCGGA GGGGCGGAGG CGGTGGTGTC GCCGCCGACA

 101 TCGGCACGGG GCTTGCCGAT GCATTAACCG CGCCGCTCGA CCATAAAGAC

 151 AAAGGTTTGA AATCCCTAAC ATTGGAAGCC TCCATTCCCC AAAACGGAAC

 201 ACTGACCCTG TCGGCACAAG GTGCGGAAAA AACTTTCAAA GCCGGCGGCA

 251 AAGACAACAG CCTCAACACG GGCAAACTGA AGAACGACAA AATCAGCCGC

 301 TTCGACTTCG TGCAAAAAAT CGAAGTGGAC GGACAAACCA TCACACTGGC

 351 AAGCGGCGAA TTTCAAATAT ACAAACAGGA TCACTCCGcc gtcgtTgcCC

 401 TacgGATTGA AAAAATCAAC AACCCCGACA AAATCGACAG CCTGATAAAC

 451 CAACGCTCCT TCCTTGTCAG CGATTTGGGC GGAGAACATA CCGCCTTCAA

 501 CCAACTGCCT GACGGCAAAG CCGAGTATCA CGGCAAAGCA TTCAGCTCCG
```

-continued

```
551 ACGATGCCGA CGGAAAACTG ACCTATACCA TAGATTTCGC CGCCAAACAG

601 GGACACGGCA AAATCGAACA CCTGAAAACA CCCGAGCAGA ATGTTGAGCT

651 TGCCTCCGCC GAACTCAAAG CAGATGAAAA ATCACACGCC GTCATTTTGG

701 GCGACACGCG CTACGGCGGC GAAGAGAAAG GCACTTACCG CCTCGCCCTT

751 TTCGGCGACC GCGCCCAAGA AATCGCTGGC TCGGCAACCG TGAAGATAGG

801 GGAAAAGGTT CACGAAATCG GCATCGCCGA CAAACAGTAG
```

This corresponds to the amino acid sequence <SEQ ID 2534; ORF 741.ng>:

```
g741.pep
  1 VNRTTFCCLS LTAGPDSDRL QQRRGGGGGV AADIGTGLAD ALTAPLDHKD

 51 KGLKSLTLEA SIPQNGTLTL SAQGAEKTFK AGGKDNSLNT GKLKNDKISR

101 FDFVQKIEVD GQTITLASGE FQIYKQDHSA VVALRIEKIN NPDKIDSLIN

151 QRSFLVSDLG GEHTAFNQLP DGKAEYHGKA FSSDDADGKL TYTIDFAAKQ

201 GHGKIEHLKT PEQNVELASA ELKADEKSHA VILGDTRYGG EEKGTYRLAL

251 FGDRAQEIAG SATVKIGEKV HEIGIADKQ*
```

The following partial DNA sequence was identified in *N. meningitidis* <SEQ ID 2535>:

```
m741.seq
  1 GTGAATCGAA CTGCCTTCTG CTGCCTTTCT CTGACCACTG CCCTGATTCT

 51 GACCGCCTGC AGCAGCGGAG GGGGTGGTGT CGCCGCCGAC ATCGGTGCGG

101 GGCTTGCCGA TGCACTAACC GCACCGCTCG ACCATAAAGA CAAAGGTTTG

151 CAGTCTTTGA CGCTGGATCA GTCCGTCAGG AAAAACGAGA AACTGAAGCT

201 GGCGGCACAA GGTGCGGAAA AAACTTATGG AAACGGTGAC AGCCTCAATA

251 CGGGCAAATT GAAGAACGAC AAGGTCAGCC GTTTCGACTT TATCCGCCAA

301 ATCGAAGTGG ACGGGCAGCT CATTACCTTG GAGAGTGGAG AGTTCCAAGT

351 ATACAAACAA AGCCATTCCG CCTTAACCGC CTTTCAGACC GAGCAAATAC

401 AAGATTCGGA GCATTCCGGG AAGATGGTTG CGAAACGCCA GTTCAGAATC

451 GGCGACATAG CGGGCGAACA TACATCTTTT GACAAGCTTC CCGAAGGCGG

501 CAGGGCGACA TATCGCGGGA CGGCGTTCGG TTCAGACGAT GCCGGCGGAA

551 AACTGACCTA CACCATAGAT TTCGCCGCCA AGCAGGGAAA CGGCAAAATC

601 GAACATTTGA AATCGCCAGA ACTCAATGTC GACCTGGCCG CCGCCGATAT

651 CAAGCCGGAT GGAAAACGCC ATGCCGTCAT CAGCGGTTCC GTCCTTTACA

701 ACCAAGCCGA GAAAGGCAGT TACTCCCTCG GTATCTTTGG CGGAAAAGCC

751 CAGGAAGTTG CCGGCAGCGC GGAAGTGAAA ACCGTAAACG GCATACGCCA

801 TATCGGCCTT GCCGCCAAGC AATAA
```

This corresponds to the amino acid sequence <SEQ ID 2536; ORF 741>:

```
m741.pep
  1 VNRTAFCCLS LTTALILTAC SSGGGGVAAD IGAGLADALT APLDHKDKGL

 51 QSLTLDQSVR KNEKLKLAAQ GAEKTYGNGD SLNTGKLKND KVSRFDFIRQ
```

-continued

```
101 IEVDGQLITL ESGEFQVYKQ SHSALTAFQT EQIQDSEHSG KMVAKRQFRI

151 GDIAGEHTSF DKLPEGGRAT YRGTAFGSDD AGGKLTYTID FAAKQGNGKI

201 EHLKSPELNV DLAAADIKPD GKRHAVISGS VLYNQAEKGS YSLGIFGGKA

251 QEVAGSAEVK TVNGIRHIGL AAKQ*
```

m741/g741 61.4% identity in 280 aa overlap

```
                       10           20        30        40        50
m741.pep       VNRTAFCCLSLTT---ALILTACSSGGGGVAADIGAGLADALTAPLDHKDKGLQSLTLDQ
               ||||:|||||||:   :  |    :||||||||||:|||||||||||||||||:||||:
g741           VNRTTFCCLSLTAGPDSDRLQQRRGGGGGVAADIGTGLADALTAPLDHKDKGLKSLTLEA
                       10        20        30        40        50        60

                60        70           80        90       100       110
m741.pep       SVRKNEKLKLAAQGAEKTY---GNGDSLNTGKLKNDKVSRFDFIRQIEVDGQLITLESGE
               |: :|  | |:|||||||:   |: :|||||||||||:|||||:::|||||| ||| |||
g741           SIPQNGTLTLSAQGAEKTFKAGGKDNSLNTGKLKNDKISRFDFVQKIEVDGQTITLASGE
                       70        80        90       100       110       120

               120       130       140       150       160       170
m741.pep       FQVYKQSHSALTAFQTEQIQDSEHSGKMVAKRQFRIGDIAGEHTSFDKLPEGGRATYRGT
               ||:|||:|||::|:: |:|:: ::   ::: :|:| ::|::||||:|::||:| :| |:|
g741           FQIYKQDHSAVVALRIEKINNPDKIDSLINQRSFLVSDLGGEHTAFNQLPDG-KAEYHGK
                      130       140       150       160       170

               180       190       200       210       220       230
m741.pep       AFGSDDAGGKLTYTIDFAAKQGNGKIEHLKSPELNVDLAAADIKPDGKRHAVISGSVLYN
               ||:|||| ||||||||||||||:|||||||:|| ||:||:|::| | | |||| |:: |:
g741           AFSSDDADGKLTYTIDFAAKQGHGKIEHLKTPEQNVELASAELKADEKSHAVILGDTRYG
             180       190       200       210       220       230

               240       250       260       270
m741.pep       QAEKGSYSLGIFGGKAQEVAGSAEVKTVNGIRHIGLAAKQX
                 |||:| |::|| :|||:|||| ||  : :::||:| |||
g741           GEEKGTYRLALFGDRAQEIAGSATVKIGEKVHEIGIADKQX
             240       250       260       270       280
```

The following partial DNA sequence was identified in *N. meningitidis* <SEQ ID 2537>:

```
a741.seq
  1 GTGAACCGAA CTGCCTTCTG CTGCCTTTCT TTGACCGCCG CCCTGATTCT

 51 GACCGCCTGC AGCAGCGGAG GCGGCGGTGT CGCCGCCGAC ATCGGCGCGG

101 TGCTTGCCGA TGCACTAACC GCACCGCTCG ACCATAAAGA CAAAAGTTTG

151 CAGTCTTTGA CGCTGGATCA GTCCGTCAGG AAAAACGAGA AACTGAAGCT

201 GGCGGCACAA GGTGCGGAAA AAACTTATGG AAACGGCGAC AGCCTCAATA

251 CGGGCAAATT GAAGAACGAC AAGGTCAGCC GCTTCGACTT TATCCGTCAA

301 ATCGAAGTGG ACGGGCAGCT CATTACCTTG GAGAGCGGAG AGTTCCAAGT

351 GTACAAACAA AGCCATTCCG CCTTAACCGC CCTTCAGACC GAGCAAGTAC

401 AAGATTCGGA GCATTCAGGG AAGATGGTTG CGAAACGCCA GTTCAGAATC

451 GGCGATATAG CGGGTGAACA TACATCTTTT GACAAGCTTC CCGAAGGCGG

501 CAGGGCGACA TATCGCGGGA CGGCATTCGG TTCAGACGAT GCCAGTGGAA

551 AACTGACCTA CACCATAGAT TTCGCCGCCA AGCAGGGACA CGGCAAAATC

601 GAACATTTGA AATCGCCAGA ACTCAATGTT GACCTGGCCG CCTCCGATAT

651 CAAGCCGGAT AAAAAACGCC ATGCCGTCAT CAGCGGTTCC GTCCTTTACA

701 ACCAAGCCGA GAAAGGCAGT TACTCTCTAG GCATCTTTGG CGGGCAAGCC

751 CAGGAAGTTG CCGGCAGCGC AGAAGTGGAA ACCGCAAACG GCATACGCCA

801 TATCGGTCTT GCCGCCAAGC AGTAA
```

This corresponds to the amino acid sequence <SEQ ID 2538; ORF 741.a>:

```
a741.pep
   1 VNRTAFCCLS LTAALILTAC SSGGGGVAAD IGAVLADALT APLDHKDKSL

  51 QSLTLDQSVR KNEKLKLAAQ GAEKTYGNGD SLNTGKLKND KVSRFDFIRQ

 101 IEVDGQLITL ESGEFQVYKQ SHSALTALQT EQVQDSEHSG KMVAKRQFRI

 151 GDIAGEHTSF DKLPEGGRAT YRGTAFGSDD ASGKLTYTID FAAKQGHGKI

 201 EHLKSPELNV DLAASDIKPD KKRHAVISGS VLYNQAEKGS YSLGIFGGQA

 251 QEVAGSAEVE TANGIRHIGL AAKQ*
```

a741/m741 95.6% identity in 274 aa overlap

```
                    10        20        30        40        50        60
a741.pep   VNRTAFCCLSLTAALILTACSSGGGGVAADIGAVLADALTAPLDHKDKSLQSLTLDQSVR
           |||||||||||:||||||||||||||||||| |||||||||||||:|||||||||||
m741       VNRTAFCCLSLTTALILTACSSGGGGVAADIGAGLADALTAPLDHKDKGLQSLTLDQSVR
                    10        20        30        40        50        60

                    70        80        90       100       110       120
a741.pep   KNEKLKLAAQGAEKTYGNGDSLNTGKLKNDKVSRFDFIRQIEVDGQLITLESGEFQVYKQ
           ||||||||||||||||||||||||||||||||||||||||||||||||||||||||||||
m741       KNEKLKLAAQGAEKTYGNGDSLNTGKLKNDKVSRFDFIRQIEVDGQLITLESGEFQVYKQ
                    70        80        90       100       110       120

                   130       140       150       160       170       180
a741.pep   SHSALTALQTEQVQDSEHSGKMVAKRQFRIGDIAGEHTSFDKLPEGGRATYRGTAFGSDD
           |||||||:||||:|||||||||||||||||||||||||||||||||||||||||||||||
m741       SHSALTAFQTEQIQDSEHSGKMVAKRQFRIGDIAGEHTSFDKLPEGGRATYRGTAFGSDD
                   130       140       150       160       170       180

                   190       200       210       220       230       240
a741.pep   ASGKLTYTIDFAAKQGHGKIEHLKSPELNVDLAASDIKPDKKRHAVISGSVLYNQAEKGS
           |:|||||||||||||:|||||||||||||||||:||||| ||||||||||||||||||
m741       AGGKLTYTIDFAAKQGNGKIEHLKSPELNVDLAAADIKPDGKRHAVISGSVLYNQAEKGS
                   190       200       210       220       230       240

                   250       260       270
a741.pep   YSLGIFGGQAQEVAGSAEVETANGIRHIGLAAKQX
           ||||||||:|||||||||||:|:|||||||||||||
m741       YSLGIFGGKAQEVAGSAEVKTVNGIRHIGLAAKQX
                   250       260       270

g742.seq not found yet
g742.pep not found yet
```

The following partial DNA sequence was identified in *N. meningitidis* <SEQ ID 2539>:

```
m742.seq
   1  ATGGTTTACG GCATTGCCGA AGCCGATGCG GGCGACAGCA GTGTGCTTAC

  51  TTTGGGCGGC ATGTATCAGA AGAGTAGGGA GGTTCCTGAT TTTTCGGGCA

 101  TTATTTTGCC CTGTGAAAAT CAGAAAACTG CCCCGTTCAG TTCAACGCCT

 151  GCCTGCAACC GGCCTTTGCA ACTGCCGCGC AACACTTATT TGGGGGAGGA

 201  TTGGTCGCGG TTAAGTGCCG ACAAATACAA CCTTTTCTCA GGATTCAAAC

 251  ATGTGTTTGA CAACGGTTGG CAGCTCAATG CCGAAGTGTC TTATACCAAG

 301  AATGAATCCG ATGCGAAGGT GGGGCAGTTT TTTCTGAAAA ACGAATATGC

 351  GGCGGGTTTG TCGGGTGAGG ATGCGGTAGG CTTTTTGACT GAAAAAAACG

 401  AAGTCATCCC GTTCGAGCCG AAAGATAAGG CATTGGAGAA ACTGAAAGCA

 451  TATCGTGATG AAACCGCCAA GGAATACCGG GAGCGCAAAG ACGATTTTGT

 501  TAAAAACCGT TTCGATAATA CTGCTTTCGA ACAGTATCGC AGCCGCCGTG

 551  CCGCAGAACG CAAAGCCGGT TTTGACAAGT GTATGAGTGA CCCTTTCGCG

 601  CTGGACTTTA TCTGTCAAGG TTCTTGGGGG GATCCGGGCG TTGATGCCGA
```

-continued

```
 651 CAAGGCGGAA TTTGTCGATA AAGCCCTTGC GAAGGAGGGC ATCTTTAATA
 701 ATGCGGCACA ACGTTTTCCA AACAGCCTGT ATGACTCTTC CTTTAATCGG
 751 AAGGCTACCG CCAACCGACG ATACAGTTAT ATGCCGTTGC GGCATACCAA
 801 AGACGACCGC CAATGGGGAA TTAAACTTGA CCTGACCGGC ACATATGGGC
 851 TGTTCGGGCG GGAGCATGAT TTCTTTGTCG GCTATGCCTA CGGTGATGAA
 901 AAGATACGTT CGGAATATCT AGAAATCTAC GAACGCCGCT ACAGAGTACG
 951 TCCGAATACG GGGGCAACGC ACGGCGTGTA TGCGGGAAGT TGTCAGGAGG
1001 AGCCGGACGG CGATTTGTCG TCTCCTTTGG TCAGGGGGCA TAAAGAACCC
1051 GATTGGCAGG CGTACGATGA AAAAGGCAAC CGTACCGTTT ATGCCGAAGA
1101 ATGCAGGAAC GCCAAGAAAA TAAAAACCGA GCCCAAGCTC GATGCCGAAG
1151 GCAAGCAGGT GTATTACTAT GACGAATACA GCGGCAGCCG GACACCGGTA
1201 TATGTCGATG TATATGAGCT GGACGAAAAA GGCAACAAGA TTCAGGAGAC
1251 CAATCCCGAC GGCACGCCTG CCTTTACCGG TTTTTCCGGT ACGGTGCCGG
1301 TTTGGAAAAC CGTCAAAGTG GCAGACGACC ATGTTCCTGC GCTGTATAAC
1351 TACGCCAAAT ACCTCAACAC CAACAAAACC CATTCGCTGA CTGCCAGCAC
1401 GCGTTTCAAC GTAACCGGCC GACTGCACCT TTTGGGCGGG CTGCACTACA
1451 CGCGCTATGA GACTTCGCAA ACCAAAGATA TGCCTGTCCG CTATGGGCAG
1501 CCGGCAAGCG ATTTTCAGAC GGCATCGAGC ATTAGGGCGG ATCAGGACCA
1551 TTACACGGCC AAGATGCAAG GTCATAAATT GACGCCCTAT GCAGGCATTA
1601 CCTATGACTT GACACCGCAA CAGAGTATTT ACGGAAGTTA TACCAAAATC
1651 TTCAAACAGC AGGATAATGT CGATGTCAGT GCCAAAACCG TTTTACCGCC
1701 TTTGGTCGGC ACAAACTATG AGGTAGGCTG GAAAGGCGCG TTCTTGCAAG
1751 GACGGCTGAA TGCTTCGTTC GCATTGTTTT ACCTCGAACA GAAAAACCGC
1801 ACGGTCGTCG ATTTCGGCTA TGTTCCCGGA GCAGGCGGCA AGCAGGGGTC
1851 GTTCCAAACC GTTGCCAAAC CGATAGGCAA AGTGGTCAGC AGGGGTGCGG
1901 AATTCGAGTT GTCGGGTGAG TTGAACGAAG ATTGGAAAGT CTTTGCGGGT
1951 TACACCTACA ACAAGAGCCG CTACAAAAAC GCCGCCGAAG TCAACGCCGA
2001 ACGCCTTGCC AAAAATTCCA GTGCAGACCC GTACAACTTC AGCAATTTCA
2051 CACCCGTGCA CATATTCCGT TTCGGAACGA GCTTCCATAT ACCGAATACG
2101 GGGCTGACCG TCGGCGGCGG CGTGTCCGCA CAAAGCGGCA CAAGCAGTCT
2151 GTATAACATC AGGCAGGGCG GCTACGGGCT GATAGACGGT TTCGTCCGTT
2201 ACGAATTGGG CAAACACGCC AAATTGAGCC TCATCGGTAC GAACTTAAAC
2251 GGACGCACTT ATTTTGAGAA CAACTACAAC CGTACGCGCG GCGCAAACAA
2301 CTTCTACGGA GAGCCGCGCA CTGTCAGCAT GAAACTGGAT TGGCAGTTTT
2351 AA
```

This corresponds to the amino acid sequence <SEQ ID 2540; ORF 742>:

```
m742.pep
   1 MVYGIAEADA GDSSVLTLGG MYQKSREVPD FSGIILPCEN QKTAPFSSTP
  51 ACNRPLQLPR NTYLGEDWSR LSADKYNLFS GFKHVFDNGW QLNAEVSYTK
```

-continued

```
101 NESDAKVGQF FLKNEYAAGL SGEDAVGFLT EKNEVIPFEP KDKALEKLKA

151 YRDETAKEYR ERKDDFVKNR FDNTAFEQYR SRRAAERKAG FDKCMSDPFA

201 LDFICQGSWG DPGVDADKAE FVDKALAKEG IFNNAAQRFP NSLYDSSFNR

251 KATANRRYSY MPLRHTKDDR QWGIKLDLTG TYGLFGREHD FFVGYAYGDE

301 KIRSEYLEIY ERRYRVRPNT GATHGVYAGS CQEEPDGDLS SPLVRGHKEP

351 DWQAYDEKGN RTVYAEECRN AKKIKTEPKL DAEGKQVYYY DEYSGSRTPV

401 YVDVYELDEK GNKIQETNPD GTPAFTGFSG TVPVWKTVKV ADDHVPALYN

451 YAKYLNTNKT HSLTASTRFN VTGRLHLLGG LHYTRYETSQ TKDMPVRYGQ

501 PASDFQTASS IRADQDHYTA KMQGHKLTPY AGITYDLTPQ QSIYGSYTKI

551 FKQQDNVDVS AKTVLPPLVG TNYEVGWKGA FLQGRLNASF ALFYLEQKNR

601 TVVDFGYVPG AGGKQGSFQT VAKPIGKVVS RGAEFELSGE LNEDWKVFAG

651 YTYNKSRYKN AAEVNAERLA KNSSADPYNF SNFTPVHIFR FGTSFHIPNT

701 GLTVGGGVSA QSGTSSLYNI RQGGYGLIDG FVRYELGKHA KLSLIGTNLN

751 GRTYFENNYN RTRGANNFYG EPRTVSMKLD WQF*
```

The following partial DNA sequence was identified in *N. meningitidis* <SEQ ID 2541>:

```
a742.seq
   1 ATGGTTTACG GCATTGCCGA AGCCGATGCG GGCGACAGCA GTGTGCTTAC

  51 TTTGGGCGGC ATGTATCAGA AGAGTAGGGA GGTTCCTGAT TTTTCGGGCA

 101 TTATTTTGTC CTGTGAAAAT CAGAAAACTG CCCCGTTCAG TTCAACGCCT

 151 GCCTGCAACC GGCCTTTGCA ACTGCCGCGC AACACTTATT TGGGGGAGGA

 201 TTGGTCGCGG TTGAGTGCTG ACAAATACAA CCTTTTCTCA GGTTTCAAAC

 251 ATGTGTTTGA CAACGGTTGG CAGCTCAATG CCGAAGTGTC TTATACCAAG

 301 AATGAATCCG ATGCGAAGGT GGGGCAGTTT TTTCTGAAAA ACGAACATGC

 351 GGCGGGTTTG TCAGATGAGG ATGCGGTAGG CTTTTTGACC GAAAAAAACG

 401 AAGTCATCCC GTTCGAGCCG AAAGATAAGG CATTGGAGAA ACTGAAAGCA

 451 TATCGTGACG AAACCGCCAA GGAATACCGT GAGCGCAAAG ACGATTTTGT

 501 TAAAAACCGT TTCGATAATA CTGCTTTCGA GCAGTACCGC AGCCGCCGTG

 551 CCGCAGAACG CAAAGCCGGT TTTGACGAGT GTATGAGTGC CCCTTTTGCG

 601 CTGGACTTTA TCTGTCAAGG TTCTTGGGGG GATCCGGGTG TTGATGCCGA

 651 CAAGTCGGAA TTTGTCGATA AAGCCCTTGC GAAGGAAGGC ATCTTTAATA

 701 ATGCGGCACA ACGTTTTCCA AACAGCCTGT ATGACTCTTC CTTTAATCGG

 751 AAGGCTACCG CCAACCGACG ATACAGTTAT ATGCCGTTGC GGCATACCAA

 801 AGACGACCGC CAATGGGGAA TTAAACTTGA CCTGACCGGC ACATATGGGC

 851 TGTTCGGGCG GGAGCATGAT TTCTTTGTCG GCTATGCCTA CGGCGATGAA

 901 AAGATACGTT CCGAATATCT GGAAATCTAC GAACGCCGCC ACAGAGTACG

 951 TCCGAATACA GGGGCAACGC ACGGCGTGTA TGCGGGAAGT TGTCAGGGGG

1001 AGCCGGACGG TGATTTGTCT TCTCCTTTGG TCAGGGGGCA TAAAGAACCC

1051 GATTGGCAGG CGTACGATGA AAAAGGCAAC CGTACCGTTT ATGCCGAAGA

1101 ATGCAGGAAT GCCAAGAAAA TAAAAACCGA GCCCAAGCTC GATGCCGAAG
```

-continued

```
1151 GCAAGCAGGT GTATTACTAT GACGAATACA GCGGCAGCCG GACGCCAGTA
1201 TATGTCGATG TATATGAACT GGATGAAAAA GGCAATAAGA TTCAGGAGAC
1251 CAATCCCGAC GGCACGCCTG CCTTTACCGG TTTTTCCGGT ACGGTGCCGG
1301 TTTGGAAAAC CGTCAAAGTG GCCGACGACC ATGTTCCTGC GCTGTATAAC
1351 TACGCCAAAT ACCTCAACAC CAACAAAACC CATTCGCTGA CTGCCGGCAC
1401 GCGTTTCAAC GTAACCGGCC GACTGCATCT TTTGGGCGGG CTGCACTACA
1451 CGCGCTATGA AACCTCGCAA ACCAAAGATA TGCCTGTCCG CTATGGGCAG
1501 CCGGCAAGCG ATTTTCAGAC GGCATCGAGC ATTAAGGCGG ATCAGGACCA
1551 TTATACGGCC AAGATGCAAG GTCATAAATT GACGCCCTAT GCAGGCATTA
1601 CCTATGATTT GACACCGCAA CAGAGTATTT ACGGAAGTTA TACCAAAATC
1651 TTCAAACAGC AGGATAATGT CGATGTCAGT GCCAAAACCG TTTTACCGCC
1701 TTTGGTCGGC ACAAACTATG AGGTAGGCTG GAAAGGCGCG TTCTTGCAAG
1751 GACGGCTGAA TGCTTCGTTC GCATTGTTTT ACCTCGAACA GAAAAACCGC
1801 ACGGTCGTCG ATTTTGGCTA TGTTCCCGGA GCAGGCGGCA AGCAGGGGTC
1851 GTTCCAAACC GTTGCCAAAC CGATAGGCAA AGTGGTCAGC AGGGGTGCGG
1901 AATTCGAGTT GTCGGGTGAG TTGAACGAAG ATTGGAAAGT CTTTGCGGGT
1951 TACACCTACA ACAAGAGCCG CTACAAAAAC GCCGCCGAAG TCAACGCCGA
2001 ACGCCTCGCC AAAAACACAG GCGCAGACCC GTACAACTTC AGCAATTTCA
2051 CACCCGTGCA CATATTCCGT TTCGGAACGA GCTTCCATAT ACCGAATACG
2101 GGGCTGACCG TCGGCGGCGG CGTGTCCGCA CAAAGCGGCA CAAGCAGTCT
2151 GTATAACATC AGGCAGGGCG GCTACGGGCT GATAGACGGT TTCGTCCGTT
2201 ACGAATTGGG CAAACACGCT AAATTGAGCC TCATCGGTAC GAACTTAAAC
2251 GGACGCACTT ATTTTGAGAA CAACTACAAC CGTACGCGCG GCGCAAACAA
2301 CTTCTATGGA GAGCCGCGCA CTGTCAGCAT GAAACTGGAT TGGCAGTTTT
2351 AA
```

This corresponds to the amino acid sequence <SEQ ID 2542; ORF 742.a>:

```
a742.pep
  1 MVYGIAEADA GDSSVLTLGG MYQKSREVPD FSGIILSCEN QKTAPFSSTP
 51 ACNRPLQLPR NTYLGEDWSR LSADKYNLFS GFKHVFDNGW QLNAEVSYTK
101 NESDAKVGQF FLKNEHAAGL SDEDAVGFLT EKNEVIPFEP KDKALEKLKA
151 YRDETAKEYR ERKDDFVKNR FDNTAFEQYR SRRAAERKAG FDECMSAPFA
201 LDFICQGSWG DPGVDADKSE FVDKALAKEG IFNNAAQRFP NSLYDSSFNR
251 KATANRRYSY MPLRHTKDDR QWGIKLDLTG TYGLFGREHD FFVGYAYGDE
301 KIRSEYLEIY ERRHRVRPNT GATHGVYAGS CQGEPDGDLS SPLVRGHKEP
351 DWQAYDEKGN RTVYAEECRN AKKIKTEPKL DAEGKQVYYY DEYSGSRTPV
401 YVDVYELDEK GNKIQETNPD GTPAFTGFSG TVPVWKTVKV ADDHVPALYN
451 YAKYLNTNKT HSLTAGTRFN VTGRLHLLGG LHYTRYETSQ TKDMPVRYGQ
501 PASDFQTASS IKADQDHYTA KMQGHKLTPY AGITYDLTPQ QSIYGSYTKI
551 FKQQDNVDVS AKTVLPPLVG TNYEVGWKGA FLQGRLNASF ALFYLEQKNR
```

-continued

```
601 TVVDFGYVPG AGGKQGSFQT VAKPIGKVVS RGAEFELSGE LNEDWKVFAG

651 YTYNKSRYKN AAEVNAERLA KNTGADPYNF SNFTPVHIFR FGTSFHIPNT

701 GLTVGGGVSA QSGTSSLYNI RQGGYGLIDG FVRYELGKHA KLSLIGTNLN

751 GRTYFENNYN RTRGANNFYG EPRTVSMKLD WQF*
```

a742/m742 98.5% identity in 783 aa overlap

```
                   10        20        30        40        50        60
a742.pep   MVYGIAEADAGDSSVLTLGGMYQKSREVPDFSGIILSCENQKTAPFSSTPACNRPLQLPR
           ||||||||||||||||||||||||||||||||||||||||||||||||||||||||||||
m742       MVYGIAEADAGDSSVLTLGGMYQKSREVPDFSGIILPCENQKTAPFSSTPACNRPLQLPR
                   10        20        30        40        50        60

                   70        80        90       100       110       120
a742.pep   NTYLGEDWSRLSADKYNLFSGFKHVFDNGWQLNAEVSYTKNESDAKVGQFFLKNEHAAGL
           |||||||||||||||||||||||||||||||||||||||||||||||||||||||:||||
m742       NTYLGEDWSRLSADKYNLFSGFKHVFDNGWQLNAEVSYTKNESDAKVGQFFLKNEYAAGL
                   70        80        90       100       110       120

                  130       140       150       160       170       180
a742.pep   SDEDAVGFLTEKNEVIPFEPKDKALEKLKAYRDETAKEYRERKDDFVKNRFDNTAFEQYR
           | ||||||||||||||||||||||||||||||||||||||||||||||||||||||||||
m742       SGEDAVGFLTEKNEVIPFEPKDKALEKLKAYRDETAKEYRERKDDFVKNRFDNTAFEQYR
                  130       140       150       160       170       180

                  190       200       210       220       230       240
a742.pep   SRRAAERKAGFDECMSAPFALDFICQGSWGDPGVDADKSEFVDKALAKEGIFNNAAQRFP
           ||||||||||||:||| |||||||||||||||||||||:|||||||||||||||||||||
m742       SRRAAERKAGFDKCMSDPFALDFICQGSWGDPGVDADKAEFVDKALAKEGIFNNAAQRFP
                  190       200       210       220       230       240

                  250       260       270       280       290       300
a742.pep   NSLYDSSFNRKATANRRYSYMPLRHTKDDRQWGIKLDLTGTYGLFGREHDFFVGYAYGDE
           ||||||||||||||||||||||||||||||||||||||||||||||||||||||||||||
m742       NSLYDSSFNRKATANRRYSYMPLRHTKDDRQWGIKLDLTGTYGLFGREHDFFVGYAYGDE
                  250       260       270       280       290       300

                  310       320       330       340       350       360
a742.pep   KIRSEYLEIYERRHRVRPNTGATHGVYAGSCQGEPDGDLSSPLVRGHKEPDWQAYDEKGN
           |||||||||||||:|||||||||||||||||| |||||||||||||||||||||||||||
m742       KIRSEYLEIYERRYRVRPNTGATHGVYAGSCQEEPDGDLSSPLVRGHKEPDWQAYDEKGN
                  310       320       330       340       350       360

                  370       380       390       400       410       420
a742.pep   RTVYAEECRNAKKIKTEPKLDAEGKQVYYYDEYSGSRTPVYVDVYELDEKGNKIQETNPD
           ||||||||||||||||||||||||||||||||||||||||||||||||||||||||||||
m742       RTVYAEECRNAKKIKTEPKLDAEGKQVYYYDEYSGSRTPVYVDVYELDEKGNKIQETNPD
                  370       380       390       400       410       420

                  430       440       450       460       470       480
a742.pep   GTPAFTGFSGTVPVWKTVKVADDHVPALYNYAKYLNTNKTHSLTAGTRFNVTGRLHLLGG
           |||||||||||||||||||||||||||||||||||||||||||||:||||||||||||||
m742       GTPAFTGFSGTVPVWKTVKVADDHVPALYNYAKYLNTNKTHSLTASTRFNVTGRLHLLGG
                  430       440       450       460       470       480

                  490       500       510       520       530       540
a742.pep   LHYTRYETSQTKDMPVRYGQPASDFQTASSIKADQDHYTAKMQGHKLTPYAGITYDLTPQ
           |||||||||||||||||||||||||||||||:||||||||||||||||||||||||||||
m742       LHYTRYETSQTKDMPVRYGQPASDFQTASSIRADQDHYTAKMQGHKLTPYAGITYDLTPQ
                  490       500       510       520       530       540

                  550       560       570       580       590       600
a742.pep   QSIYGSYTKIFKQQDNVDVSAKTVLPPLVGTNYEVGWKGAFLQGRLNASFALFYLEQKNR
           ||||||||||||||||||||||||||||||||||||||||||||||||||||||||||||
m742       QSIYGSYTKIFKQQDNVDVSAKTVLPPLVGTNYEVGWKGAFLQGRLNASFALFYLEQKNR
                  550       560       570       580       590       600

                  610       620       630       640       650       660
a742.pep   TVVDFGYVPGAGGKQGSFQTVAKPIGKVVSRGAEFELSGELNEDWKVFAGYTYNKSRYKN
           ||||||||||||||||||||||||||||||||||||||||||||||||||||||||||||
m742       TVVDFGYVPGAGGKQGSFQTVAKPIGKVVSRGAEFELSGELNEDWKVFAGYTYNKSRYKN
                  610       620       630       640       650       660

                  670       680       690       700       710       720
a742.pep   AAEVNAERLAKNTGADPYNFSNFTPVHIFRFGTSFHIPNTGLTVGGGVSAQSGTSSLYNI
           ||||||||||||::||||||||||||||||||||||||||||||||||||||||||||||
m742       AAEVNAERLAKNSSADPYNFSNFTPVHIFRFGTSFHIPNTGLTVGGGVSAQSGTSSLYNI
                  670       680       690       700       710       720

                  730       740       750       760       770       780
a742.pep   RQGGYGLIDGFVRYELGKHAKLSLIGTNLNGRTYFENNYNRTRGANNFYGEPRTVSMKLD
           ||||||||||||||||||||||||||||||||||||||||||||||||||||||||||||
m742       RQGGYGLIDGFVRYELGKHAKLSLIGTNLNGRTYFENNYNRTRGANNFYGEPRTVSMKLD
                  730       740       750       760       770       780
```

-continued

```
a742.pep      WQFX
              ||||
m742          WQFX
```

```
a742 (SEQ ID 2542)/p25184 (SEQ ID 4167)
 sp|P25184|PUPA_PSEPU     FERRIC-PSEUDOBACTIN    358     RECEPTOR    PRECURSOR
>gi|94923|pir||S15169
ferric-pseudobactin receptor precursor-Pseudomonas putida >gi|45723 (x56605)
pseudobactin uptake protein [pseudomonas putida]Length = 819
 Score = 152 bits (381), Expect = 6e-36
 Identities = 110/356 (30%), Positives = 170/356 (46%), Gaps = 55/356 (15%)

Query: 436 KTVKVADDHV-PALYNYAKYLNTNKTHSLTAGTRFNVTGRLHLLGGLHYTRYETSQTKDM 494
           +T K  DD + P +    +Y  +N+        +RFN+T  LHL+ G    + Y
Sbjct: 511 QTPKPGDDEIIPGI----QYNISNRQSGYFVASRFNLTDDLHLILGARASNYRFDYAL-- 564

Query: 495 PVRYGQPASDFQTASSIKADQDHYTAKMQGHKLTPYAGITYDLTPQQSIYGSYTKIFKQQ 554
             R G   + ++                ++    +TPYAGI YDLT +QS+Y SYT IFK Q
Sbjct: 565 -WRIGNEPAPYKM--------------VERGVVTPYAGIVYDLTNEQSVYASYTDIFKPQ 609

Query: 555 DNVDVSAKTVLPPLVGTNYEVGWKGAFLQGRLNASFALFYLEQKNRTVVDFGYVPGAGGK 614
           +NVD++ K  L P VG NYE+GWKG FL+GRLNA+ AL+ +++ N        VP +GG
Sbjct: 610 NNVDITGKP-LDPEVGKNYELGWKGEFLEGRLNANIALYMVKRDNLAESTNEVVPDSGGL 668

Query: 615 QGSFQTVAKPIGKVVSRGAEFELSGELNEDWKVFAGYTYNKSRYKNAAEVNAERLAKNTG 674
             S      + +    ++G + ELSGE+   W VF GY++ ++
Sbjct: 669 IAS-----RAVDGAETKGVDVELSGEVLPGWNVFTGYSHTRTE----------------D 707

Query: 675 ADPYNFSNFTPVHIFRFGTSFHIPN--TGLTVGGGVSAQSGTS---SLYN--IRQGGYGL 727
           AD    +    P+  FRF   ++ +P      LT+GGGV+  S ++    + YN  + Q  Y +
Sbjct: 708 ADGKRLTPQLPMDTFRFWNTYRLPGEWEKLTLGGGVNWNSKSTLNFARYNSHVTQDDTFV 767

Query: 728 IDGFVRYELGKHAKLSLIGTNLNGRTYFENNYNRTRGANNFYGEPRTVSMKLDWQF 783
                RY + +     +L   N+  + Y     Y     G+    YG PR   ++ L + F
Sbjct: 768 TSLMARYRINESLAATLNVNNIFDKKY----YAGMAGSYGHYGAPRNATVTLRYDF 819
```

g743.seq not found yet g743.pep not found yet

The following partial DNA sequence was identified in *N. meningitidis* <SEQ ID 2543>:

```
m743.seq
   1 ATGAATCAAA ATCATTTTTC ACTTAAAATT CTGACCGTTA TGCTGTTATC

  51 GGCTTACGGT GGTTCTTTTG CAGACGGTGT TGTGCCTGTT TCAGACGGCA

 101 ATACCGTCAG TCTGGATACG GTCAATGTAC GCGGCTCTCA TGCTTTGTTG

 151 GGCAAGACCG AAAAGACCCG TTCTTATACG ATAGATCGGA TGTCCACCGC

 201 CACAGGTATG AGGATTGCGG GCAAGGATAC GCCGCAGTCG GTCAGCGTCA

 251 TCACGCGCAG CCGCCTTGAC GATAAGGCGG TGCATACGCT TGAAGAGGCA

 301 ATGAAAAACA CGACGGGTGT CAACGTTGTG CGCGATTCAG GCTTGCAGAC

 351 GCGGTTTTTG TCACGCGGTT TCTATATTGA TCAGATTGGT GAAGACGGTA

 401 TGACCGTCAA TGTTGCAGGC CGTTCGGGAT ATACGGCGAA AATCGACGTG

 451 TCTCCGAGTA CCGATTTGGC GGTTTATGAC CATATTGAAG TTGTACGGGG

 501 TGCAACGGGG TTGACCCAAT CCAATTCAGA GCCGGGAGGA ACCGTCAATT

 551 TGATCCGTAA GTGA
```

This corresponds to the amino acid sequence <SEQ ID 2544; ORF 743>:

```
m743.pep
   1 MNQNHFSLKI LTVMLLSAYG GSFADGVVPV SDGNTVSLDT VNVRGSHALL

  51 GKTEKTRSYT IDRMSTATGM RIAGKDTPQS VSVITRSRLD DKAVHTLEEA

 101 MKNTTGVNVV RDSGLQTRFL SRGFYIDQIG EDGMTVNVAG RSGYTAKIDV

 151 SPSTDLAVYD HIEVVRGATG LTQSNSEPGG TVNLIRK*
```

The following partial DNA sequence was identified in *N. meningitidis* <SEQ ID 2545>:

```
a743.seq
   1 ATGAATCAAA ATCATTTTTC ACTTAAAATT CTGACCGTTA TGCTGTTATC

  51 GGCTTACGGT GGTTCTTTTG CAGACGGTGT TGTGCCTGTT TCAGACGGCA

 101 ATACCGTCAG TTTGGATACG GTCAATGTAC GCGGCTCTCA TGCTCTGTCG

 151 GGCAAGACCG AGAAGACCCG TTCTTATACG ATAGATCGGA TGTCCACCGC

 201 CACAGGTATG AGGATTGCGG GCAAGGATAC GCCGCAGTCG GTCAGCGTCA

 251 TCACGCGCAG CCGCCTTGAC GATAAGGCGG TGCATACGCT TGAAGAGGCA

 301 ATGAAAAACA CGACGGGTGT CAACGTTGTG CGCGATTCAG GCTTGCAGAC

 351 GCGGTTTTTG TCACGCGGTT TCTATATTGA TCAGATTGGT GAAGACGGTA

 401 TTACCGTCAA TGTTGCAGGC CGTTCGGGAT ATACGGCGAA AATCGACGTG

 451 TCTCCGAGTA CCGATTTGGC GGTTTATGAC CATATTGAAG TTGTACGGGG

 501 TGCAACGGGG TTGACCCAAT CCAATTCAGA GCCGGGTGGA ACCGTCAATT

 551 TGATCCGTAA GCGA
```

This corresponds to the amino acid sequence <SEQ ID 2546; ORF 743.a>:

```
a743.pep
   1 MNQNHFSLKI LTVMLLSAYG GSFADGVVPV SDGNTVSLDT VNVRGSHALS

  51 GKTEKTRSYT IDRMSTATGM RIAGKDTPQS VSVITRSRLD DKAVHTLEEA

 101 MKNTTGVNVV RDSGLQTRFL SRGFYIDQIG EDGITVNVAG RSGYTAKIDV

 151 SPSTDLAVYD HIEVVRGATG LTQSNSEPGG TVNLIRKR
```

a743/m743 98.9% identity in 187 aa overlap

```
                    10        20        30        40        50        60
a743.pep    MNQNHFSLKILTVMLLSAYGGSFADGVVPVSDGNTVSLDTVNVRGSHALSGKTEKTRSYT
            ||||||||||||||||||||||||||||||||||||||||||||||||| ||||||||||
m743        MNQNHFSLKILTVMLLSAYGGSFADGVVPVSDGNTVSLDTVNVRGSHALLGKTEKTRSYT
                    10        20        30        40        50        60
                    70        80        90       100       110       120
a743.pep    IDRMSTATGMRIAGKDTPQSVSVITRSRLDDKAVHTLEEAMKNTTGVNVVRDSGLQTRFL
            ||||||||||||||||||||||||||||||||||||||||||||||||||||||||||||
m743        IDRMSTATGMRIAGKDTPQSVSVITRSRLDDKAVHTLEEAMKNTTGVNVVRDSGLQTRFL
                    70        80        90       100       110       120
                   130       140       150       160       170       180
a743.pep    SRGFYIDQIGEDGITVNVAGRSGYTAKIDVSPSTDLAVYDHIEVVRGATGLTQSNSEPGG
            |||||||||||||:||||||||||||||||||||||||||||||||||||||||||||||
m743        SRGFYIDQIGEDGMTVNVAGRSGYTAKIDVSPSTDLAVYDHIEVVRGATGLTQSNSEPGG
                   130       140       150       160       170       180

a743.pep    TVNLIRKR
            |||||||
m743        TVNLIRKX
g744 .seq not found yet
g744 .pep not found yet
```

The following partial DNA sequence was identified in *N. meningitidis* <SEQ ID 2547>:

```
m744.seq
   1   ATGAAACCGT TAAAAACATT AGAATTTGGA TTTGTGGATG CTGCAAACTA

  51   CAGAAGAAGA GAAAATAAAG ATTTATTTAA CCGAATATTT GTAAAAGGAG
```

-continued

```
101 AATATTTGGA TGAATTATGT GAACCAAATA TTTCGTTTTT AATCGGAGAA
151 AAGGGAACTG GAAAGACAGC ATATGCTGTT TATTTAACTA ATAACTTCTA
201 TAAAAACATA CATGCCACTA CTAAGTTTGT TCGTGAAACC GATTATTCAA
251 AATTTATTCA GCTAAAGAAA GCAAGACACT TAACTGTTTC AGATTTTACA
301 AGTATTTGGA AAGTCATTTT ATATCTGTTG ATATCAAATC AAATCAAATG
351 TAAAGAAAAC GGAATATTAT CTTCAATATT TAATAAATTT AAAGCCTTAG
401 ATGAGGCTAT AAATGAATAT TATTATGGCG CTTTTGATCC GGAAATTGTA
451 CAAGCAATAA CTTTAATAGA AAATTCAAAA GAAGCTGCGG AAATGATTTT
501 TGGAAAATTT GTTAAACTAG GTGAAGAGGA ATCCCAACAA ATAACTTTTA
551 CAGAAAGTAA ATTCCAAGCA AATTTAGGTT TTATTGAAAG AAAATTTAAA
601 GATGCTTTAT CTCAGTTAAA GCTAAAAGAT AATCATATTT TGTTTATTGA
651 TGGGATAGAT ATTAGACCAT CACAGATTCC ATTTGATGAA TATCATGAGT
701 GTGTAAAAGG TCTTGCTAAC GCCATATGGA TGTTAAATAA TGATATCTTC
751 CCTTCCATTA AAGATAGTAA GGGAAGGATG AGAGTTGTGT TATTGATTAG
801 ACCTGATATC TTTGATTCAT TAGGTTTACA AAATCAAAAT ACCAAACTTC
851 AAGATAATTC AGTATTTTTA GACTGGAGGA CGGATTATAA ATCTTATAGA
901 AGTTCAAAGA TTTTTGGCGT TTTTGATCAT CTTTTGAGAA CCCAGCAAGA
951 AAAACAAGAT AGTTTAGAAA AAGGCAACTC ATGGGATTAT TATTTTCCAT
1001 GGAATGCTCC TAATTTACAT GATGAGTATA AAAATTTAAC TTCATTTATT
1051 AGCTTCCTAA GAAAATCGTA TTATCGACCT CGCGATATTC TTCAGATGCT
1101 TACTTTGCTA CAAAAAAATA AGAAAAGTAA GGAAGATTAT GTCGTAGCAG
1151 AAGATTTTGA TAATACTTCT TTTCAAAGAG AATACTCGAT ATATTTACTT
1201 GGTGAAATCA AAGATCATCT TTTGTTTTAT TATAGTCAAA GTGATTATCA
1251 AAATTTCCTG AAATTTTTTG AATTTTTAAA CGGGAAAGAT AGATTTAAAT
1301 ATAGTGATTT TTTAAAAGCA TTTGAACGTT TGAAAAAGCA CTTACAAACA
1351 ACATCAGTGG AAATACCTAA ATTTATGAGT ACTGCTAATG AGTTTTTGCA
1401 ATTTTTATTT GACTTGAATG TTATTGCTTA TTTAGATAAC CCAGAAGATG
1451 AAACGAAACC ATATATCCAT TGGTGCTTTA AAGATAGAAA TTATGCAAAT
1501 ATTTCTCCTA AAATAAAAAC TGAAACTGAA TATTTAATAT TTTCAGGATT
1551 ATCAAAAGCC CTTGATGTTG GTACTCCATT TAAGAACAAA CAGTAA
```

This corresponds to the amino acid sequence <SEQ ID 2548; ORF 744>:

```
m744.pep
  1 MKPLKTLEFG FVDAANYRRR ENKDLFNRIF VKGEYLDELC EPNISFLIGE
 51 KGTGKTAYAV YLTNNFYKNI HATTKFVRET DYSKFIQLKK ARHLTVSDFT
101 SIWKVILYLL ISNQIKCKEN GILSSIFNKF KALDEAINEY YYGAFDPEIV
151 QAITLIENSK EAAEMIFGKF VKLGEEESQQ ITFTESKFQA NLGFIERKFK
201 DALSQLKLKD NHILFIDGID IRPSQIPFDE YHECVKGLAN AIWMLNNDIF
251 PSIKDSKGRM RVVLLIRPDI FDSLGLQNQN TKLQDNSVFL DWRTDYKSYR
301 SSKIFGVFDH LLRTQQEKQD SLEKGNSWDY YFPWNAPNLH DEYKNLTSFI
```

-continued

```
351 SFLRKSYYRP RDILQMLTLL QKNKKSKEDY VVAEDFDNTS FQREYSIYLL

401 GEIKDHLLFY YSQSDYQNFL KFFEFLNGKD RFKYSDFLKA FERLKKHLQT

451 TSVEIPKFMS TANEFLQFLF DLNVIAYLDN PEDETKPYIH WCFKDRNYAN

501 ISPKIKTETE YLIFSGLSKA LDVGTPFKNK Q*
```

g745.seq not found yet
g745.pep not found yet

The following partial DNA sequence was identified in *N. meningitidis* <SEQ ID 2549>:

```
m745.seq
   1 ATGTTTTGGC AACTGACCGT TGTTTCAGTA ACCGCCGTCA TTGCACTGGG

  51 GACAATATTC ATCAATAAGA AAACTTCAAA GCAAAAGGCG ACATTAGATG

 101 TTATTTTGAA TGATTACCAA GATGCACAAT TTGTAGAAGC CGACAATCAT

 151 ATTTCGCCTT ATATTCGCGG CACGGCAGTT GACGACAACA ACGCGCGGAT

 201 CGACCTGTAT GAAATTTATC AAAATAAGGG CGGACAATGG GAAAAAGAGA

 251 GAGGGCATTT ACTTACCGTA ATCAATCGGC ACGAGTTTTA TGCGTGCGCA

 301 ATCAACTCGG GAGTATTGGA TGAGGATTTG TTTAAACGGC TGCATTGCAC

 351 CAACTTCATA AAATTGTGGA ATGCAGTTTC GCCTCTTGTT ATGAAAATAC

 401 GCGAAGAAGA ACGCAAAGAC ACAATATTTA GAGAGTTGGA AATTTTGGTT

 451 GCATTATGGA AAGCAAACCC CCTAAAGGCA TCTGATTTGT GA
```

This corresponds to the amino acid sequence <SEQ ID 2550; ORF 745>:

```
m745.pep
   1 MFWQLTVVSV TAVIALGTIF INKKTSKQKA TLDVILNDYQ DAQFVEADNH

  51 ISPYIRGTAV DDNNARIDLY EIYQNKGGQW EKERGHLLTV INRHEFYACA

 101 INSGVLDEDL FKRLHCTNFI KLWNAVSPLV MKIREEERKD TIFRELEILV

 151 ALWKANPLKA SDL*
```

a745.seq not found yet
a745.pep not found yet

The following partial DNA sequence was identified in *N. gonorrhoeae* <SEQ ID 2551>:

```
g746.seq
   1  ATGTCCGAAA ACAAACAAAA CGAAGTCCTG ACCGGTTACG AACAGCTGAA

  51  ACGGCGCAAC CGCCGCCGCC TCGTAACGGC AAGCTCCCTG GTTGCCGCCT

 101  CCTGCATCCT GCTGGCAGCC GCACTCAGTT CCGATCCTGC CGACAGCAAT

 151  CCCGCACCGC AGGCCGGCGA AACCGGCGCA ACGGAAAGCC AAACGGCAAA

 201  CACGGCACAA ACCCCTGCCT TGAAATCCGC CGCCGAAAAC GGGGAAACCG

 251  CCGCCGACAA ACCGCAGGAC TTGGCAGGCG AAGACAAGCC TTCTGCCGCC

 301  GACAGCGAAA TCAGCGAGCC TGAAAACGTA GGCGCGCCGC TGGTGCTGAT

 351  TAACGACCGG CTCGAAGACA GCAACATCAA AGGTTTGGAA GAATCCGAGA

 401  AACTGCAACA GGCAGAAACC GCCAAAACCG AACCGAAGCA GGCAAAACAA

 451  CGCGCTGCCG AAAAAGTGTC GGCAACTGCC GACAGTACGG ATACGGTAGC
```

-continued

501 GGTTGAAAAA CCGAAACGCA CTGCCGAACC CAAACCGCAA AAAGCGGAAC

551 GCACTGCCGA AGCCAAGCCC AAAGCCAAAG AAACCAAAAC CGCCGAAAAA

601 GTTGCCGACA AACCGAAAAC TGCTGCCGAA AAAACCAAAC CGGATACGGC

651 AAAATCCGAC AGCGCGGTAA AAGAAGCGAA AAAAGCCGAC AAGGCTGAAG

701 GCAAAAAGAC AGCCGAAAAA GACCGTTCGG ACGGCAAAAA ACACGAAACG

751 GCGCAAAAAA CCGACAAAGC GGACAAAACC AAAACCGCCG AGAAGGAAAA

801 ATCCGGCAAG GCGGGCAAAA AAGCCGCCAT TCAGGCAGGT TATGCCGAAA

851 AAGAACGCGC CTTGAGCCTC CAGCGCAAAA TGAAGGCGGC GGGTATCGAT

901 TCGACCATCA CCGAAATCAT GACCGACAAC GGCAAAGTTT ACCGCGTCAA

951 ATCAAGCAAC TATAAAAACG CAAGGGATGC CGAACGCGAT TTGAACAAAC

1001 TGCGCGTGCA CGGCATCGCC GGCCAGGTAA CGAATGAATA G

This corresponds to the amino acid sequence <SEQ ID 2552; ORF 746.ng>:

g746.pep

1 MSENKQNEVL TGYEQLKRRN RRRLVTASSL VAASCILLAA ALSSDPADSN

51 PAPQAGETGA TESQTANTAQ TPALKSAAEN GETAADKPQD LAGEDKPSAA

101 DSEISEPENV GAPLVLINDR LEDSNIKGLE ESEKLQQAET AKTEPKQAKQ

151 RAAEKVSATA DSTDTVAVEK PKRTAEPKPQ KAERTAEAKP KAKETKTAEK

201 VADKPKTAAE KTKPDTAKSD SAVKEAKKAD KAEGKKTAEK DRSDGKKHET

251 AQKTDKADKT KTAEKEKSGK AGKKAAIQAG YAEKERALSL QRKMKAAGID

301 STITEIMTDN GKVYRVKSSN YKNARDAERD LNKLRVHGIA GQVTNE*

The following partial DNA sequence was identified in *N. meningitidis* <SEQ ID 2553>:

m746.seq

1 ATGTCCGAAA ACAAACAAAA CGAAGTCCTG AGCGGTTACG AACAACTCAA

51 ACGGCGCAAC CGCCGCCGCC TCGTAACGGC AAGTTGCCTG GTTGCCGCCT

101 CCTGCATCCT GCTGGCAGCC GCCCTCAGTT CCGGCCCTGC CGAACAGACT

151 GCCGGCGAAA CAAGCGGCGT AGAAAAACAAA GCGGCAGGTG CGGCACAAAC

201 CCCTGCCTTG AAATCCGCCG CCGACAAACC GCAGGACTTG GCAGGCGAAG

251 ACAAGCCTTC TGCCGCCGAC AGCGAAATCA GCGAGCCTGA AAACGTAGGC

301 GCGCCGCTGG TGCTGATTAA CGAGCGCCTC GAAGACAGCA ACATCAAAGG

351 TTTGGAAGCA TCCGAGAAAC TGCAACAGGC AGAAACCGCC AAAACCGCAC

401 CGAAGCAGGC AAAACAACGC GCTGCCGAAA AAGTGCCGGC AACTGCCGAC

451 AGTACGGATA CGGTAGCGGT TGAAAAACCG AAACGCACTG CCGAAACAAA

501 ACCGCAAAAA GCGGAACGCA CTGCCAAAGC CAAGCCCAAA GCCAAAGAAA

551 CCAAAACCGC CGAAAAAGTT GCCGACAAAC CGAAAACTGC CGCCGAAAAA

601 ACCAAACCGG ATACGGCAAA ATCCGACAGC GCGGTAAAAG AAGCGAAAAA

651 AGCCGACAAG GCTGAAAGCA AAAAAACAGC CGAAAAAGAC CGTTCGGACG

701 GCAAAAAACA CGAAACGGCA CAAAAAACCG ACAAAGCGGA CAAGACCAAA

751 ACCGCCGAGA AGGAAAAATC CGGTAAAAAA GCCGCCATTC AGGCAGGTTA

-continued

```
801 TGCCGAAAAA GAACGCGCCT TAAGCCTCCA GCGCAAAATG AAGGCGGCGG

851 GTATCGATTC GACCATCACC GAAATTATGA CCGACAACGG CAAAGTTTAC

901 CGCGTCAAAT CAAGCAACTA TAAAAACGCA AGGGATGCCG AACGCGATTT

951 GAACAAATTG CGCGTACACG GTATCGCCGG TCAGGTAACG AATGAATAG
```

This corresponds to the amino acid sequence <SEQ ID 2554; ORF 746>:

```
m746.pep
  1 MSENKQNEVL SGYEQLKRRN RRRLVTASCL VAASCILLAA ALSSGPAEQT

 51 AGETSGVENK AAGAAQTPAL KSAADKPQDL AGEDKPSAAD SEISEPENVG

101 APLVLINERL EDSNIKGLEA SEKLQQAETA KTAPKQAKQR AAEKVPATAD

151 STDTVAVEKP KRTAETKPQK AERTAKAKPK AKETKTAEKV ADKPKTAAEK

201 TKPDTAKSDS AVKEAKKADK AESKKTAEKD RSDGKKHETA QKTDKADKTK

251 TAEKEKSGKK AAIQAGYAEK ERALSLQRKM KAAGIDSTIT EIMTDNGKVY

301 RVKSSNYKNA RDAERDLNKL RVHGIAGQVT NE*
```

Computer analysis of this amino acid sequence gave the following results:

Homology with a Predicted ORF from *N. gonorrhoeae*

ORF 746 shows 89.9% identity over a 346 aa overlap with a predicted ORF (ORF 746) from *N. gonorrhoeae*:

```
m746/g746  89.9% identity in 346 aa overlap

                   10        20        30        40        50
m746.pep    MSENKQNEVLSGYEQLKRRNRRRLVTASCLVAASCILLAAALSSGPAEQT----AGETSG
            |||||||||:|||||||||||||||||| |||||||||||||| ||:::     ||||::
g746        MSENKQNEVLTGYEQLKRRNRRRLVTASSLVAASCILLAAALSSDPADSNPAPQAGETGA
                   10        20        30        40        50        60

              60        70               80        90       100       109
m746.pep    VENKAAGAAQTPALKSAA-------DKPQDLAGEDKPSAADSEISEPENVGAPLVLINER
            :|:::|::||||||||||       ||||||||||||||||||||||||||||||||||:|
g746        TESQTANTAQTPALKSAAENGETAADKPQDLAGEDKPSAADSEISEPENVGAPLVLINDR
                   70        80        90       100       110       120

          110       120       130       140       150       160       169
m746.pep    LEDSNIKGLEASEKLQQAETAKTAPKQAKQRAAEKVPATADSTDTVAVEKPKRTAETKPQ
            ||||||||| |||||||||||| ||||||||||| |||||||||||||||||| |||
g746        LEDSNIKGLEESEKLQQAETAKTEPKQAKQRAAEKVSATADSTDTVAVEKPKRTAEPKPQ
                  130       140       150       160       170       180

          170       180       190       200       210       220       229
m746.pep    KAERTAKAKPKAKETKTAEKVADKPKTAAEKTKPDTAKSDSAVKEAKKADKAESKKTAEK
            ||||||:||||||||||||||||||||||||||||||||||||||||||||||:||||||
g746        KAERTAEAKPKAKETKTAEKVADKPKTAAEKTKPDTAKSDSAVKEAKKADKAEGKKTAEK
                  190       200       210       220       230       240

          230       240       250            260       270       280
m746.pep    DRSDGKKHETAQKTDKADKTKTAEKEKSGK---KAAIQAGYAEKERALSLQRKMKAAGID
            ||||||||||||||||||||||||||||||   |||||||||||||||||||||||||||
g746        DRSDGKKHETAQKTDKADKTKTAEKEKSGKAGKKAAIQAGYAEKERALSLQRKMKAAGID
                  250       260       270       280       290       300

            DRSDGKKHETAQKTDKADKTKTAEKEKSGKAGKKAAIQAGYAEKERALSLQRKMKAAGID

             290       300       310       320       330
m746.pep    STITEIMTDNGKVYRVKSSNYKNARDAERDLNKLRVHGIAGQVTNEX
            |||||||||||||||||||||||||||||||||||||||||||||||
g746        STITEIMTDNGKVYRVKSSNYKNARDAERDLNKLRVHGIAGQVTNEX
                  310       320       330       340
```

The following partial DNA sequence was identified in *N. meningitidis* <SEQ ID 2555>:

```
a746.seq
   1 ATGTCCGAAA ACAAACAAAA CGAAGTCCTG AGCGGTTACG AACAACTCAA

  51 ACGGCGCAAC CGCCGCCGCC TCGTAACGGC AAGTTGCCTG GTTGCCGCCT

 101 CCTGCATCCT GCTGGCAGCC GCCCTCAGTT CCGGCCCTGC CGAACAGACT

 151 GCCGGCGAAA CAAGCGGCGT AGAAAACAAA GCGGCAGGTG CGGCACAAAC

 201 CCCTGCCTTG AAATCCGCCG CCGACAAACC GCAGGACTTG GCAGGCGAAG

 251 ACAAGCCTTC TGCCGCCGAC AGCGAAATCA GCGAGCCTGA AAACGTAGGC

 301 GCGCCGCTGG TGCTGATTAA CGACCGCCTC GAAGACAGCA ACATCAAAGG

 351 TTTGGAAGCA TCCGAGAAAC TGCAACAGGC AGAAACCGCC AAAACCGCAC

 401 CGAAGCAGGC AAAACAACGC GCTGCCGAAA AAGTGCCGGC AACTGCCGAC

 451 AGTACGGATA CGGTAGCGGT TGAAAAACCG AAACGCACTG CCGAAACAAA

 501 ACCGCAAAAA GCGGAACGCA CTGCCAAAGC CAAGCCCAAA GCCAAAGAAA

 551 CCAAAACCGC CGAAAAAGTT GCCGACAAAC CGAAAACTGC CGCCGAAAAA

 601 ACCAAACCGG ATACGGCAAA ATCCGACAGC GCGGTAAAAG AAGCGAAAAA

 651 AGCCGACAAG GCTGAAAGCA AAAAAACAGC CGAAAAAGAC CGTTCGGACG

 701 GCAAAAAACA CGAAACGGCA CAAAAAACCG ACAAAGCGGA CAAGACCAAA

 751 ACCGCCGAGA AGGAAAAATC CGGTAAAAAA GCCGCCATTC AGGCAGGTTA

 801 TGCCGAAAAA GAACGCGCCT TAAGCCTCCA GCGCAAAATG AAGGCGGCGG

 851 GTATCGATTC GACCATCACC GAAATTATGA CCGACAACGG CAAAGTTTAC

 901 CGCGTCAAAT CAAGCAACTA TAAAAACGCA AGGGATGCCG AACGCGATTT

 951 GAACAAATTG CGCGTACACG GTATCGCCGG TCAGGTAACG AATGAATAA
```

This corresponds to the amino acid sequence <SEQ ID 2556; ORF 746.a>:

```
a746.pep
   1 MSENKQNEVL SGYEQLKRRN RRRLVTASCL VAASCILLAA ALSSGPAEQT

  51 AGETSGVENK AAGAAQTPAL KSAADKPQDL AGEDKPSAAD SEISEPENVG

 101 APLVLINDRL EDSNIKGLEA SEKLQQAETA KTAPKQAKQR AAEKVPATAD

 151 STDTVAVEKP KRTAETKPQK AERTAKAKPK AKETKTAEKV ADKPKTAAEK

 201 TKPDTAKSDS AVKEAKKADK AESKKTAEKD RSDGKKHETA QKTDKADKTK

 251 TAEKEKSGKK AAIQAGYAEK ERALSLQRKM KAAGIDSTIT EIMTDNGKVY

 301 RVKSSNYKNA RDAERDLNKL RVHGIAGQVT NE*
```

Computer analysis of this amino acid sequence gave the following results:

Homology with a Predicted ORF from *N. meningitidis*

ORF 746 shows 99.7% identity over a 332 aa overlap with a predicted ORF (ORF 746) from *N. meningitidis*:

```
a746/m746;  99.7% identity in 332 aa overlap

                    10        20        30        40        50        60
a746.pep    MSENKQNEVLSGYEQLKRRNRRRLVTASCLVAASCILLAAALSSGPAEQTAGETSGVENK
            ||||||||||||||||||||||||||||||||||||||||||||||||||||||||||||
m746        MSENKQNEVLSGYEQLKRRNRRRLVTASCLVAASCILLAAALSSGPAEQTAGETSGVENK
                    10        20        30        40        50        60
```

-continued

```
                   70        80        90       100       110       120
a746.pep    AAGAAQTPALKSAADKPQDLAGEDKPSAADSEISEPENVGAPLVLINDRLEDSNIKGLEA
            ||||||||||||||||||||||||||||||||||||||||||||||||:|||||||||||
m746        AAGAAQTPALKSAADKPQDLAGEDKPSAADSEISEPENVGAPLVLINERLEDSNIKGLEA
                   70        80        90       100       110       120

                  130       140       150       160       170       180
a746.pep    SEKLQQAETAKTAPKQAKQRAAEKVPATADSTDTVAVEKPKRTAETKPQKAERTAKAKPK
            ||||||||||||||||||||||||||||||||||||||||||||||||||||||||||||
m746        SEKLQQAETAKTAPKQAKQRAAEKVPATADSTDTVAVEKPKRTAETKPQKAERTAKAKPK
                  130       140       150       160       170       180

                  190       200       210       220       230       240
a746.pep    AKETKTAEKVADKPKTAAEKTKPDTAKSDSAVKEAKKADKAESKKTAEKDRSDGKKHETA
            ||||||||||||||||||||||||||||||||||||||||||||||||||||||||||||
m746        AKETKTAEKVADKPKTAAEKTKPDTAKSDSAVKEAKKADKAESKKTAEKDRSDGKKHETA
                  190       200       210       220       230       240

                  250       260       270       280       290       300
a746.pep    QKTDKADKTKTAEKEKSGKKAAIQAGYAEKERALSLQRKMKAAGIDSTITEIMTDNGKVY
            ||||||||||||||||||||||||||||||||||||||||||||||||||||||||||||
m746        QKTDKADKTKTAEKEKSGKKAAIQAGYAEKERALSLQRKMKAAGIDSTITEIMTDNGKVY
                  250       260       270       280       290       300

                  310       320       330
a746.pep    RVKSSNYKNARDAERDLNKLRVHGIAGQVTNEX
            |||||||||||||||||||||||||||||||||
m746        RVKSSNYKNARDAERDLNKLRVHGIAGQVTNEX
                  310       320       330
```

g747.seq not found yet g747.pep not found yet

The following partial DNA sequence was identified in *N. meningitidis* <SEQ ID 2557>:

```
m747.seq
   1 CTGACCCCTT GGGCGGATGC ATATGCAGAT TTGCGCGGCA AAACCAAAGT

  51 GATGACGACC CAGATGGGTG CTTCCCGCGA TGTCAGCAAA AGCGCCAAAG

 101 GTTGGAGTGT CGGTATCGGT CTGAATGTAG GCAAACAGTT GACCGACAGC

 151 GTCGGTCTCG AGTTTGATCC ATACTACCGT CACAAAACAA TCTACAAACC

 201 CCGTGAGATT GTCTTGGACG GTGACAAAAC CAAAATGGGC CGCTCCAAAT

 251 CCAACGAGTA CGGCTTCCGC GTAGCCGCAA CGTTCTATAG TCAATTAAAA

 301 TCAAAATAG
```

This corresponds to the amino acid sequence <SEQ ID 2558; ORF 747>:

```
m747.pep
   1 LTPWADAYAD LRGKTKVMTT QMGASRDVSK SAKGWSVGIG LNVGKQLTDS

  51 VGLEFDPYYR HKTIYKPREI VLDGDKTKMG RSKSNEYGFR VAATFYSQLK

 101 SK*
```

The following partial DNA sequence was identified in *N. meningitidis* <SEQ ID 2559>:

```
a747.seq
   1 CTAACCCCTT GGGCGGATGC ATATGCAGAT TTGCGCGGCA AAACCAAAGT

  51 GATGACGACC CAGATGTGTG CTTCCCGCGA TGTCAGCAAA AGCGCCAAAG

 101 GTTGGAGTGT CGGTATCGGT CTGAATGTAG GCAAACAGTT GACCGACAGC

 151 GTCGGTCTCG AGTTTGATCC ATACTACCGT CACAAAACAA TCTGCAAACC

 201 CCGTGAGATT GTTTTGGACG GCGACAAAAC CAAAATGGGC CGCTCCAAAT

 251 CCAACGAGTA CGGCTTCCGC GTAACCGCAA CGTTCTATAG TCAATTAAAA
```

-continued

```
301 TCAAAGTAG
```

This corresponds to the amino acid sequence <SEQ ID 2560; ORF 747.a>:

```
a747.pep
   1 LTPWADAYAD LRGKTKVMTT QMCASRDVSK SAKGWSVGIG LNVGKQLTDS

  51 VGLEFDPYYR HKTICKPREI VLDGDKTKMG RSKSNEYGFR VTATFYSQLK

 101 SK*
```

Computer analysis of this amino acid sequence gave the following results:

Homology with a Predicted ORF from *N. meningitidis*

ORF 747 shows 97.1% identity over a 102 aa overlap with a predicted ORF (ORF 746) from *N. meningitidis*:

```
a747/m747     97.1% identity in 102 aa overlap

                       10        20        30        40        50        60
a747.pep     LTPWADAYADLRGKTKVMTTQMCASRDVSKSAKGWSVGIGLNVGKQLTDSVGLEFDPYYR
             |||||||||||||||||||||| |||||||||||||||||||||||||||||||||||||||
m747         LTPWADAYADLRGKTKVMTTQMGASRDVSKSAKGWSVGIGLNVGKQLTDSVGLEFDPYYR
                       10        20        30        40        50        60

                       70        80        90       100
a747.pep     HKTICKPREIVLDGDKTKMGRSKSNEYGFRVTATFYSQLKSKX
             |||| ||||||||||||||||||||||||||:|||||||||||
m747         HKTIYKPREIVLDGDKTKMGRSKSNEYGFRVAATFYSQLKSKX
                       70        80        90       100

a747 (SEQ ID 2560)/m80195 (SEQ ID 4168)
gi|150271 (M80195) outer membrane protein [Neisseria meningitidis] Length = 272
 Score = 59.3 bits (141), Expect = 6e-09
 Identities = 29/99 (29%), Positives = 51/99 (51%), Gaps = 4/99 (4%)

Query: 1   LTPWADAYADLRGKTKVMTTQMCASRDVSKSAKGWSVGIGLNVGKQLTDSVGLEFDPYYR 60
            + PW++   DL   + K+ T       +D+++    GW  G+G N+GK+L +S   +E  P+Y+
Sbjct: 174 INPWSEVKFDLNSRYKLNTGVTNLKKDINQKTNGWGFGLGANIGKKLGESASIEAGPFYK 233

Query: 61  HKTICKPREIVL---DGD-KTKMGRSKSNEYGFRVTATF 95
             +T  +  E  +    GD    + ++   EYG RV   F
Sbjct: 234 QRTYKESGEFSVTTKSGDVSLTIPKTSIREYGLRVGIKF 272
```

The following partial DNA sequence was identified in *N. gonorrhoeae* <SEQ ID 2561>:

```
g748.seq
    1  ATGAGTCAAA ACCAACCCGC ACAACCGACC AAACGCAATC TGTTCAAAAC

   51  CGCCCTTGCC GTCGGCGCAA TCGGCGCAAT CGGAGGTTAT TTCGGCGGCA

  101  AAAAACAGGG CGAAACCGCC GAACGCACCG CCGAAAGCCA ACACTCGCCC

  151  CAAGCCTATC CCTGCTACGG CGAACATCAG GCAGGTATCG TTACGCCGCG

  201  GCAGGCGTTT TCCATTATGT GCGCCTTCGA CGTAACCGCG CAAAGTGCCA

  251  AGCAGCTGGA AAACCTGTTC CGCACACTGA CCGCCCGCAT CGAGTTTCTC

  301  ACCCAAGGCG GAGAATACCA AGACGGCGAC GACAAACTCC CGTCAGCCGG

  351  CAGCGGCATT TTGGGTAAAG CCTTCAACCC CGACGGATTG ACCGTTACCG

  401  TGGGGGTGGG CAGCAGCCTG TTTGACGGCC GGTTCGGACT CAAAGACAAA

  451  AAAACGGTTC ATTTGCAGGA AATGCGCGAC TTCCCCAACG ATAAGCTGCA

  501  AAAAAGCTGG TGCGACGGCG ATTTGAGCCT GCAAATCTGC GCCTTCACCC

  551  CCGAAACCTG CCAAACCGCC CTGCGCGACA TCATCAAACA CACCGCCCAA

  601  ACCGCCGTCA TCCGCTGGAG TATCGACGGG TGGCAGCCTA AATCCGAACC
```

-continued

```
 651 CGGCGCGATG GCGGCGCGCA ACCTGTTGGG CTTCCGAGAC GGCACGGGCA

 701 ACCCCAAGGT TTCCGATCCC AAAACCGCCG ACGAGGTTTT ATGGACGGGC

 751 GTGGCCGCCA ACAGCCTCGA CGAACCGGAG TGGGCGAAAA ACGGCAGCTA

 801 TCAGGCAGTC CGCCTTATCC GCCGCTTTGT CGAGTTTTGG GACAGGACGC

 851 CGCTTCAAGA GCAAACCGAC ATTTTCGGGC GGCGAAAATA CAGCGGGGCG

 901 CCGATGGACG GCAAAAAAGA AGCCGACCAA CCGGATTTCG CCAAAGACCC

 951 CGAGGGTGAT ATCACGCCCA AAGACAGCCA TATGCGCCTG GCGAATCCGC

1001 GCGATCCCGA ATTCCTCAAA AAACACTGCC TCTTCCGCCG CGCCTACAGC

1051 TATTCTCGCG GACCCGCCTC AAGCGGACAG CTTGATGTCG GGCTGGTGTT

1101 CGTCTGCTAT CAGGCAAATC TTGCCGACGG TTTCATCTTC GTGCAAAACC

1151 TCCTCAACGG CGAACCGCTG GAAGAATACA TCAGCCCCTT CGGCGGCGGC

1201 TATTTCTTCG TCTTGCCCGG CGTGGGAAAA GGCGGATTCT TGGGACAAGG

1251 GCTGCCGGGC GTATAA
```

This corresponds to the amino acid sequence <SEQ ID 2562; ORF 748.ng>:

```
g748.pep
  1 MSQNQPAQPT KRNLFKTALA VGAIGAIGGY FGGKKQGETA ERTAESQHSP

 51 QAYPCYGEHQ AGIVTPRQAF SIMCAFDVTA QSAKQLENLF RTLTARIEFL

101 TQGGEYQDGD DKLPSAGSGI LGKAFNPDGL TVTVGVGSSL FDGRFGLKDK

151 KTVHLQEMRD FPNDKLQKSW CDGDLSLQIC AFTPETCQTA LRDIIKHTAQ

201 TAVIRWSIDG WQPKSEPGAM AARNLLGFRD GTGNPKVSDP KTADEVLWTG

251 VAANSLDEPE WAKNGSYQAV RLIRRFVEFW DRTPLQEQTD IFGRRKYSGA

301 PMDGKKEADQ PDFAKDPEGD ITPKDSHMRL ANPRDPEFLK KHCLFRRAYS

351 YSRGPASSGQ LDVGLVFVCY QANLADGFIF VQNLLNGEPL EEYISPFGGG

401 YFFVLPGVGK GGFLGQGLPG V*
```

The following partial DNA sequence was identified in *N. meningitidis* <SEQ ID 2563>:

```
m748.seq
  1 ATGAGCAAAA AACAACCCGC ACAACCGACC AGGCGCACTC TTTTTAAAAC

 51 CGCGATCGCA GCCGGAGCAG TCGGCGCAAT CGGAGGTTAT CTCGGCGGCA

101 AAAAACAGGG CGAAACCGCC GAACGCACCG CCGAAAGCCA ACACTCGCCC

151 CAAGCCTATC CCTGCTACGG CGAACATCAG GCAGGCATCG TTACGCCGCA

201 GCAGGCGTTT TCGATTATGT GCGCCTTCGA CGTAACCGCG CAAAGTGCCA

251 AGCAGCTGGA AAACCTGTTC CGCACGCTGA CCGCCCGCAT CGAGTTTCTC

301 ACCCAAGGCG GCGAATACCA AGACGGCGAC GACAAACTTC CGCCAGCCGG

351 CAGCGGCATT TTGGGCAAAG CCTTCAACCC CGACGGGTTG ACCGTTACCG

401 TGGGGGTGGG CAGCAGCCTG TTTGACGGCC GGTTCGGACT CAAAGACAAA

451 AAACCGATTC ATTTGCAGGA AATGCGCGAC TTCTCCAACG ATAAGCTGCA

501 AAAAAGCTGG TGCGACGGCG ATTTGAGCCT GCAAATCTGT GCCTTCACCC

551 CCGAAACCTG CCAAGCCGCC CTGCGCGACA TCATCAAACA CACCGTCCAA
```

-continued

```
 601 ACCGCCGTTA TCCGTTGGAG TATCGACGGG TGGCAGCCCA AATCCGAACC

 651 CGGCGCGATG GCGGCGCGCA ACCTGTTGGG CTTCAGGGAC GGCACGGGCA

 701 ACCCCAAAGT TTCCGATCCC AAAACTGCCG ACGAGGTTTT GTGGACGGGG

 751 GTGGCCGCCA ACAGCCTCGA CGAACCGGAG TGGGCGAAAA ACGGCAGCTA

 801 TCAGGCAGTC CGCCTTATCC GCCACTTTGT CGAGTTTTGG GACAGGACGC

 851 CGCTTCAAGA GCAAACCGAC ATTTTCGGGC GGCGCAAATA CAGCGGTGCG

 901 CCGATGGACG GCAAAAAAGA AGCCGACCAA CCGGATTTTG CCAAAGACCC

 951 CGAGGGTGAT ATCACGCCCA AAGACAGCCA TATACGCCTG GCGAATCCGC

1001 GCGATCCCGA ATTCCTCAAA AAACACCGCC TCTTCCGCCG CGCCTACAGC

1051 TATTCGCGCG GACTCGCCTC AAGCGGACAG CTTGATGTCG GGCTGGTGTT

1101 CGTCTGCTAT CAGGCAAACC TTGCCGACGG ATTCATCTTC GTGCAAAACC

1151 TCCTCAACGG CGAACCGCTG GAAGAATACA TCAGCCCCTT CGGCGGCGGC

1201 TATTTCTTCG TCTTGCCCGG CGTGGAAAAA GGCGGCTTTT TGGGGCAAGG

1251 GCTGCTGGGC GTATAA
```

This corresponds to the amino acid sequence <SEQ ID 2564; ORF 748>:

```
m748.pep
  1 MSKKQPAQPT RRTLFKTAIA AGAVGAIGGY LGGKKQGETA ERTAESQHSP

 51 QAYPCYGEHQ AGIVTPQQAF SIMCAFDVTA QSAKQLENLF RTLTARIEFL

101 TQGGEYQDGD DKLPPAGSGI LGKAFNPDGL TVTVGVGSSL FDGRFGLKDK

151 KPIHLQEMRD FSNDKLQKSW CDGDLSLQIC AFTPETCQAA LRDIIKHTVQ

201 TAVIRWSIDG WQPKSEPGAM AARNLLGFRD GTGNPKVSDP KTADEVLWTG

251 VAANSLDEPE WAKNGSYQAV RLIRHFVEFW DRTPLQEQTD IFGRRKYSGA

301 PMDGKKEADQ PDFAKDPEGD ITPKDSHIRL ANPRDPEFLK KHRLFRRAYS

351 YSRGLASSGQ LDVGLVFVCY QANLADGFIF VQNLLNGEPL EEYISPFGGG

401 YFFVLPGVEK GGFLGQGLLG V*
```

Computer analysis of this amino acid sequence gave the following results:

Homology with a Predicted ORF from *N. gonorrhoeae*

ORF 748 shows 95.0% identity over a 421 aa overlap with a predicted ORF (ORF 748) from *N. gonorrhoeae*

```
m748/g748     95.0% identity in 421 aa overlap

                       10        20        30        40        50        60
m748.pep      MSKKQPAQPTRRTLFKTAIAAGAVGAIGGYLGGKKQGETAERTAESQHSPQAYPCYGEHQ
              ||::||||||:|:|||||:|:||:||||||:|||||||||||||||||||||||||||||
g748          MSQNQPAQPTKRNLFKTALAVGAIGAIGGYFGGKKQGETAERTAESQHSPQAYPCYGEHQ
                       10        20        30        40        50        60

                       70        80        90       100       110       120
m748.pep      AGIVTPQQAFSIMCAFDVTAQSAKQLENLFRTLTARIEFLTQGGEYQDGDDKLPPAGSGI
              ||||||:|||||||||||||||||||||||||||||||||||||||||||||| |||||
g748          AGIVTPRQAFSIMCAFDVTAQSAKQLENLFRTLTARIEFLTQGGEYQDGDDKLPSAGSGI
                       70        80        90       100       110       120

                      130       140       150       160       170       180
m748.pep      LGKAFNPDGLTVTVGVGSSLFDGRFGLKDKKPIHLQEMRDFSNDKLQKSWCDGDLSLQIC
              ||||||||||||||||||||||||||||||| :|||||||| ||||||||||||||||||
g748          LGKAFNPDGLTVTVGVGSSLFDGRFGLKDKKTVHLQEMRDFPNDKLQKSWCDGDLSLQIC
                      130       140       150       160       170       180
```

-continued

```
                 190       200       210       220       230       240
m748.pep   AFTPETCQAALRDIIKHTVQTAVIRWSIDGWQPKSEPGAMAARNLLGFRDGTGNPKVSDP
           |||||||:|||||||||:||||||||||||||||||||||||||||||||||||||||||
g748       AFTPETCQTALRDIIKHTAQTAVIRWSIDGWQPKSEPGAMAARNLLGFRDGTGNPKVSDP
                 190       200       210       220       230       240

                 250       260       270       280       290       300
m748.pep   KTADEVLWTGVAANSLDEPEWAKNGSYQAVRLIRHFVEFWDRTPLQEQTDIFGRRKYSGA
           ||||||||||||||||||||||||||||||||||:|||||||||||||||||||||||||
g748       KTADEVLWTGVAANSLDEPEWAKNGSYQAVRLIRRFVEFWDRTPLQEQTDIFGRRKYSGA
                 250       260       270       280       290       300

                 310       320       330       340       350       360
m748.pep   PMDGKKEADQPDFAKDPEGDITPKDSHIRLANPRDPEFLKKHRLFRRAYSYSRGLASSGQ
           ||||||||||||||||||||||||||:||||||||||||||| ||||||||||| |||||
g748       PMDGKKEADQPDFAKDPEGDITPKDSHMRLANPRDPEFLKKHCLFRRAYSYSRGPASSGQ
                 310       320       330       340       350       360

                 370       380       390       400       410       420
m748.pep   LDVGLVFVSYQANLADGFIFVQNLLNGEPLEEYISPFGGGYFFVLPGVEKGGFLGQGLLG
           |||||||| ||||||||||||||||||||||||||||||| |||||||| ||||||||| |
g748       LDVGLVFVCYQANLADGFIFVQNLLNGEPLEEYISPFGGGTFFVLPGVGKGGFLGQGLPG
                 370       380       390       400       410       420

m748.pep   VX
           ||
g748       VX
```

The following partial DNA sequence was identified in *N. meningitidis* <SEQ ID 2565>:

```
a748.seq
     1  ATGAGCAAAA ACCAACCCGC ACAACCGACC AGGCGCACTC TTTTTAAAAC

    51  CGCGATCGCA GCTGGAGCAG TCGGCGCAAT CGGAGGTTAT CTCGGCGGCA

   101  AAAAACGGGG CGAAACCGCC GAACGCACCG CCGAAAGCCA ACACTCGCCC

   151  CAAGCCTATC CCTGCTACGG CGAACATCAG GCAGGCATCG TTACGCCGCA

   201  GCAGGCGTTT TCGATTATGT GCGCCTTCGA CGTAACCGCG CAAAGTGCCA

   251  AGCAGCTGGA AAACCTGTTC CGCACGCTGA CCGCCCGCAT CGAGTTTCTC

   301  ACCCAAGGCG GCGAATACCA AGACGGCGAC GACAAACTTC CGCCAGCCGG

   351  CAGCGGCATT TTGGGCAAAG CCTTCAACCC CGACGGGTTG ACCGTTACCG

   401  TGGGGGTGGG CAGCAGCCTG TTTGACGGCC GGTTCGGACT CAAAGACAAA

   451  AAACCGATTC ATTTGCAGGA AATGCGCGAC TTCTCCAACG ATAAGCTGCA

   501  AAAAAGCTGG TGCGACGGCG ATTTGAGCCT GCAAATCTGT GCCTTCACCC

   551  CCGAAACCTG CCAAGCCGCC CTGCGCGACA TCATCAAACA CACCGTCCAA

   601  ACCGCCGTTA TCCGCTGGAG TATCGACGGG TGGCAGCCTA AATCCGAACC

   651  CGGCGCGATG GCGGCGCGCA ACCTGTTGGG CTTCCGCGAC GGCACGGGCA

   701  ACCCCAAAGT TTCCGACCCC AAAACTGCCG ACGAGGTTTT GTGGACGGGG

   751  GTGGCCGCCA ACAGCCTCGA CGAACCGGAG TGGGCGAAAA ACGGCAGCTA

   801  TCAGGCAGTC CGCCTTATCC GCCACTTTGT TGAGTTTTGG GACAGGACGC

   851  CGCTTCAAGA GCAAACCGAC ATTTTCGGGC GGCGCAAATA CAGCGGCGCG

   901  CCGATGGACG GCAAAAAAGA AGCCGACCAA CCGGATTTTG CCAAAGACCC

   951  CGAGGGGAAT ACCACGCCCA AAGACAGCCA TATACGCCTG GCGAATCCGC

  1001  GCGATCCCGA GTTCCTTAAA AAACACCGCC TCTTCCGCCG CGCCTACAGC

  1051  TATTCGCGCG GACTCGCCTC AAGCGGACAG CTTGATGTCG GGCTGGTGTT

  1101  CGTCTGCTAT CAGGCAAACC TTGCCGACGG ATTCATCTTC GTGCAAAACC

  1151  TCCTCAACGG CGAACCGCTG GAAGAATACA TCAGCCCCTT CGGCGGCGGC
```

-continued

```
1201  TATTTCTTCG TCTTGCCCGG CGTGGAAAAA GGCGGCTTTT TGGGGCAAGG

1251  GCTGCTGGGC GTATAA
```

This corresponds to the amino acid sequence <SEQ ID 2566; ORF 748.a>:

```
a748.pep
   1  MSKNQPAQPT RRTLFKTAIA AGAVGAIGGY LGGKKRGETA ERTAESQHSP

  51  QAYPCYGEHQ AGIVTPQQAF SIMCAFDVTA QSAKQLENLF RTLTARIEFL

 101  TQGGEYQDGD DKLPPAGSGI LGKAFNPDGL TVTVGVGSSL FDGRFGLKDK

 151  KPIHLQEMRD FSNDKLQKSW CDGDLSLQIC AFTPETCQAA LRDIIKHTVQ

 201  TAVIRWSIDG WQPKSEPGAM AARNLLGFRD GTGNPKVSDP KTADEVLWTG

 251  VAANSLDEPE WAKNGSYQAV RLIRHFVEFW DRTPLQEQTD IFGRRKYSGA

 301  PMDGKKEADQ PDFAKDPEGN TTPKDSHIRL ANPRDPEFLK KHRLFRRAYS

 351  YSRGLASSGQ LDVGLVFVCY QANLADGFIF VQNLLNGEPL EEYISPFGGG

 401  YFFVLPGVEK GGFLGQGLLG V*
```

Computer analysis of this amino acid sequence gave the following results:

Homology with a Predicted ORF from *N. meningitidis* ORF 748 shows 99.0% identity over a 421 aa overlap with a predicted ORF (ORF 748) from *N. meningitidis*:

```
a748/m748     99.0% identity in 421 aa overlap

                      10        20        30        40        50        60
a748.pep      MSKNQPAQPTRRTLFKTAIAAGAVGAIGGYLGGKKRGETAERTAESQHSPQAYPCYGEHQ
              |||:||||||||||||||||||||||||||||||||:|||||||||||||||||||||||
m748          MSKKQPAQPTRRTLFKTAIAAGAVGAIGGYLGGKKQGETAERTAESQHSPQAYPCYGEHQ
                      10        20        30        40        50        60

                      70        80        90       100       110       120
a748.pep      AGIVTPQQAFSIMCAFDVTAQSAKQLENLFRTLTARIEFLTQGGEYQDGDDKLPPAGSGI
              ||||||||||||||||||||||||||||||||||||||||||||||||||||||||||||
m748          AGIVTPQQAFSIMCAFDVTAQSAKQLENLFRTLTARIEFLTQGGEYQDGDDKLPPAGSGI
                      70        80        90       100       110       120

                     130       140       150       160       170       180
a748.pep      LGKAFNPDGLTVTVGVGSSLFDGRFGLKDKKPIHLQEMEDFSNDKLQKSWCDGDLSLQIC
              ||||||||||||||||||||||||||||||||||||||||||||||||||||||||||||
m748          LGKAFNPDGLTVTVGVGSSLFDGRFGLKDKKPIHLQEMRDFSNDKLQKSWCDGDLSLQIC
                     130       140       150       160       170       180

                     190       200       210       220       230       240
a748.pep      AFTPETCQAALRDIIKHTVQTAVIRWSIDGWQPKSEPGAMAARNLLGFRDGTGNPKVSDP
              ||||||||||||||||||||||||||||||||||||||||||||||||||||||||||||
m748          AFTPETCQAALRDIIKHTVQTAVIRWSIDGWQPKSEPGAMAARNLLGFRDGTGNPKVSDP
                     190       200       210       220       230       240

                     250       260       270       280       290       300
a748.pep      KTADEVLWTGVAANSLDEPEWAKNGSYQAVRLIRHFVEFWDRTPLQEQTDIFGRRKYSGA
              ||||||||||||||||||||||||||||||||||||||||||||||||||||||||||||
m748          KTADEVLWTGVAANSLDEPEWAKNGSYQAVRLIRHFVEFWDRTPLQEQTDIFGRRKYSGA
                     250       260       270       280       290       300

                     310       320       330       340       350       360
a748.pep      PMDGKKEADQPDFAKDPEGNTTPKDSHIRLANPRDPEFLKKHRLFRRAYSYSRGLASSGQ
              |||||||||||||||||||: ||||||||||||||||||||||||||||||||||||||||
m748          PMDGKKEADQPDFAKDPEGDITPKDSHIRLANPRDPEFLKKHRLFRRAYSYSRGLASSGQ
                     310       320       330       340       350       360

                     370       380       390       400       410       420
a748.pep      LDVGLVFVCYQANLADGFIFVQNLLNGEPLEEYISPFGGGYFFVLPGVEKGGFLGQGLLG
              ||||||||||||||||||||||||||||||||||||||||||||||||||||||||||||
m748          LDVGLVFVCYQANLADGFIFVQNLLNGEPLEEYISPFGGGYFFVLPGVEKGGFLGQGLLG
                     370       380       390       400       410       420

a748.pep      VX
              ||
m748          VX
```

The following partial DNA sequence was identified in *N. gonorrhoeae* <SEQ ID 2567>:

```
g749.seq
   1 ATGAGAAAAT TCAATTTGAC CGCATTGTCC GTGATGCTTG CCTTGGGTTT
  51 GACCGCGTGC CAGCCGCCGG AGGCGGAGAA AGCCGCGCCG GCCGCGTCCG
 101 GTGAGACCCA ATCCGCCAAC GAAGGCGGTT CGGTCGGTAT CGCCGTCAAC
 151 GACAATGCCT GCGAACCGAT GAATCTGACC GTGCCGAGCG GACAGGTTGT
 201 GTTCAATATT AAAAACAACA GCGGCCGCAA GCTCGAATGG GAAATCCTGA
 251 AGGGCGTGAT GGTGGTGGAC GAACGCGAAA ATATCGCCCC GGGGCTTTCC
 301 GACAAAATGA CCGTAAccct GCTGCCGGGC GAATACGAAA TGACCTGCGG
 351 CCTTTTGACC AATCCGCGCG GCAAGCTGGT GGTAGCCGAC AGCGGCTTTA
 401 AAGACACCGC CAACGAAGCG GATTTGGAAA AACTGCCCCA ACCGCTCGCC
 451 GACTATAAAG CCTACGTTCA AGGCGAGGTT AAAGAGCTGG CGGCGAAAAC
 501 CAAAACCTTT ACCGAAGCCG TCAAAGCAGG CGACATTGAA AAGGCGAAAT
 551 CCCTGTTTGC CGCCACCCGC GTCCATTACG AACGCATCGA ACCGATTGCC
 601 GAGCTTTTCA GCGAACTCGA CCCCGTCATC GATGCGTGTG AAGACGACTT
 651 CAAAGACGGT GCGAAAGATG CCGGGTTTAC CGGCTTCCAC CGTATCGAAC
 701 ACGCCCTTTG GGTGGAAAAA GACGTATCCG GCGTGAAGGA AACCGCGGCC
 751 AAACTGATGA CCGATGTCGA AGCCCTGCAA AAAGAAATCG ACGCATTGGC
 801 GttccctCCG GGCAAAGTGG TCGGCGGCGC GTCCGAACTG ATTGAAGAAG
 851 CGGCGGGCAG TAAAATCAGC GGCGAAGAAG ACCgttaCAG CCACACCGAT
 901 TTGAGCGACT TCCAAGCTAA TGCGGACGGA TCTAAAAAAA TCGTCGATTT
 951 GTTCCGTCCG TTGATTGAGG CCAAAAACAA AGCCTTGTTG GAAAAAACCG
1001 ATACCAACTT CAAACAGGTC AACGAAATTC TGGCGAAATA CCGCACCAAA
1051 GACGGTTTTG AAACCTACGA CAAGCTGAGC GAAGCCGACC GCAAAGCATT
1101 ACAGGCTCCT ATTAACGCGC TTGCCGAAGA CCTTGCCCAA CTTCGCGGCA
1151 TACTCGGCTT GAAATAA
```

This corresponds to the amino acid sequence <SEQ ID 2568; ORF 749.ng>:

```
g749.pep
  1 MRKFNLTALS VMLALGLTAC QPPEAEKAAP AASGETQSAN EGGSVGIAVN
 51 DNACEPMNLT VPSGQVVFNI KNNSGRKLEW EILKGVMVVD ERENIAPGLS
101 DKMTVTLLPG EYEMTCGLLT NPRGKLVVAD SGFKDTANEA DLEKLPQPLA
151 DYKAYVQGEV KELAAKTKTF TEAVKAGDIE KAKSLFAATR VHYERIEPIA
201 ELFSELDPVI DACEDDFKDG AKDAGFTGFH RIEHALWVEK DVSGVKETAA
251 KLMTDVEALQ KEIDALAFPP GKVVGGASEL IEEAAGSKIS GEEDRYSHTD
301 LSDFQANADG SKKIVDLFRP LIEAKNKALL EKTDTNFKQV NEILAKYRTK
351 DGFETYDKLS EADRKALQAP INALAEDLAQ LRGILGLK*
```

The following partial DNA sequence was identified in *N. meningitidis* <SEQ ID 2569>:

```
m749.seq
```

-continued

```
   1 ATGAGAAAAT TCAATTTGAC CGCATTGTCC GTGATGCTTG CCTTAGGTTT

  51 GACCGCGTGC CAGCCGCCGG AGGCGGAGAA AGCTGCGCCG GCAGCGTCCG

 101 GTGAGGCGCA AACCGCCAAC GAGGGCGGTT CGGTCAGTAT CGCCGTCAAC

 151 GACAATGCCT GCGAACCGAT GGAACTGACC GTGCCGAGCG GACAGGTTGT

 201 GTTCAATATT AAAAACAACA GCGGCCGCAA GCTCGAATGG GAAATCCTGA

 251 AAGGCGTGAT GGTGGTGGAC GAGCGCGAAA ACATCGCCCC CGGACTTTCC

 301 GATAAAATGA CCGTCACCCT GTTGCCGGGC GAATACGAAA TGACTTGCGG

 351 TCTTTTGACC AATCCGCGCG GCAAGCTGGT GGTAACCGAC AGCGGCTTTA

 401 AAGACACCGC CAACGAAGCG GATTTGGAAA AACTGTCCCA ACCGCTCGCC

 451 GACTATAAAG CCTACGTTCA AGGCGAGGTT AAAGAGCTGG TGGCGAAAAC

 501 CAAAACTTTT ACCGAAGCCG TCAAAGCAGG CGACATTGAA AAGGCGAAAT

 551 CCCTGTTTGC CGACACCCGC GTCCATTACG AACGCATCGA ACCGATTGCC

 601 GAGCTTTTCA GCGAACTCGA CCCCGTCATC GATGCGCGTG AAGACGACTT

 651 CAAAGACGGC GCGAAAGATG CCGGATTTAC CGGCTTTCAC CGTATCGAAT

 701 ACGCCCTTTG GGTGGAAAAA GACGTGTCCG GCGTGAAGGA AATTGCAGCG

 751 AAACTGATGA CCGATGTCGA AGCCCTGCAA AAAGAAATCG ACGCATTGGC

 801 GTTTCCTCCG GGCAAGGTGG TCGGCGGCGC GTCCGAACTG ATTGAAGAAG

 851 TGGCGGGCAG TAAAATCAGC GGCGAAGAAG ACCGGTACAG CCACACCGAT

 901 TTGAGCGACT TCCAAGCCAA TGTGGACGGA TCTAAAAAAA TCGTCGATTT

 951 GTTCCGTCCG CTGATCGAGG CCAAAAACAA AGCCTTGTTG GAAAAAACCG

1001 ATACCAACTT CAAACAGGTC AACGAAATTC TGGCGAAATA CCGGACTAAA

1051 GACGGTTTTG AAACCTACGA CAAGCTGGGC GAAGCCGACC GCAAAGCGTT

1101 ACAGGCCTCT ATTAACGCGC TTGCCGAAGA CCTTGCCCAA CTTCGCGGCA

1151 TACTCGGCTT GAAATAA
```

This corresponds to the amino acid sequence <SEQ ID 2570; ORF 749>:

```
m749.pep
   1 MRKFNLTALS VMLALGLTAC QPPEAEKAAP AASGEAQTAN EGGSVSIAVN

  51 DNACEPMELT VPSGQVVFNI KNNSGRKLEW EILKGVMVVD ERENIAPGLS

 101 DKMTVTLLPG EYEMTCGLLT NPRGKLVVTD SGFKDTANEA DLEKLSQPLA

 151 DYKAYVQGEV KELVAKTKTF TEAVKAGDIE KAKSLFADTR VHYERIEPIA

 201 ELFSELDPVI DAREDDFKDG AKDAGFTGFH RIEYALWVEK DVSGVKEIAA

 251 KLMTDVEALQ KEIDALAFPP GKVVGGASEL IEEVAGSKIS GEEDRYSHTD

 301 LSDFQANVDG SKKIVDLFRP LIEAKNKALL EKTDTNFKQV NEILAKYRTK

 351 DGFETYDKLG EADRKALQAS INALAEDLAQ LRGILGLK*
```

Computer analysis of this amino acid sequence gave the following results:

Homology with a Predicted ORF from *N. gonorrhoeae*

ORF 749 shows 96.1% identity over a 388 aa overlap with a predicted ORF (ORF 749) from *N. gonorrhoeae*

```
m749/g749     96.1% identity in 388 aa overlap
```

-continued

```
                   10         20         30         40         50         60
m749.pep    MRKFNLTALSVMLALGLTACQPPEAEKAAPAASGEAQTANEGGSVSIAVNDNACEPMELT
            ||||||||||||||||||||||||||||||||||||:|:|||||||:|||||||||||:||
g749        MRKFNLTALSVMLALGLTACQPPEAEKAAPAASGETQSANEGGSVGIAVNDNACEPMNLT
                   10         20         30         40         50         60

                   70         80         90        100        110        120
m749.pep    VPSGQVVFNIKNNSGRKLEWEILKGVMVVDERENIAPGLSDKMTVTLLPGEYEMTCGLLT
            ||||||||||||||||||||||||||||||||||||||||||||||||||||||||||||
g749        VPSGQVVFNIKNNSGRKLEWEILKGVMVVDERENIAPGLSDKMTVTLLPGEYEMTCGLLT
                   70         80         90        100        110        120

                  130        140        150        160        170        180
m749.pep    NPRGKLVVTDSGFKDTANEADLEKLSQPLADYKAYVQGEVKELVAKTKTFTEAVKAGDIE
            ||||||||:|||||||||||||||| ||||||||||||||||||:|||||||||||||||
g749        NPRGKLVVADSGFKDTANEADLEKLPQPLADYKAYVQGEVKELAAKTKTFTEAVKAGDIE
                  130        140        150        160        170        180

                  190        200        210        220        230        240
m749.pep    KAKSLFADTRVHYERIEPIAELFSELDPVIDAREDDFKDGAKDAGFTGFHRIEYALWVEK
            ||||||| |||||||||||||||||||||||| ||||||||||||||||||||:||||||
g749        KAKSLFAATRVHYERIEPIAELFSELDPVIDACEDDFKDGAKDAGFTGFHRIEHALWVEK
                  190        200        210        220        230        240

                  250        260        270        280        290        300
m749.pep    DVSGVKEIAAKLMTDVEALQKEIDALAFPPGKVVGGASELIEEVAGSKISGEEDRYSHTD
            ||||||| ||||||||||||||||||||||||||||||||||||:|||||||||||||||
g749        DVSGVKETAAKLMTDVEALQKEIDALAFPPGKVVGGASELIEEAAGSKISGEEDRYSHTD
                  250        260        270        280        290        300

                  310        320        330        340        350        360
m749.pep    LSDFQANVDGSKKIVDLFRPLIEAKNKALLEKTDTNFKQVNEILAKYRTKDGFETYDKLG
            |||||||:||||||||||||||||||||||||||||||||||||||||||||||||||||:
g749        LSDFQANADGSKKIVDLFRPLIEAKNKALLEKTDTNFKQVNEILAKYRTKDGFETYDKLS
                  310        320        330        340        350        360

                  370        380      389
m749.pep    EADRKALQASINALAEDLAQLRGILGLKX
            ||||||||| |||||||||||||||||||
g749        EADRKALQAPINALAEDLAQLRGILGLKX
                  370        380
```

The following partial DNA sequence was identified in *N. meningitidis* <SEQ ID 2571>:

```
a749.seq
    1  ATGAGAAAAT TCAATTTGAC CGCATTGTCC GTGATGCTTG CCTTAGGTTT

   51  GACCGCGTGC CAGCCGCCGG AGGCGGAGAA AGCTGCGCCG GCAGCGTCCG

  101  GTGAGGCGCA AACCGCCAAC GAGGGCGGTT CGGTCAGTAT CGCCGTCAAC

  151  GACAATGCCT GCGAACCGAT GGAACTGACC GTGCCGAGCG GACAGGTTGT

  201  GTTCAATATT AAAAACAACA GCGGCCGCAA GCTCGAATGG GAAATCCTGA

  251  AAGGCGTGAT GGTGGTGGAC GAGCGCGAAA ACATCGCCCC CGGACTTTCC

  301  GATAAAATGA CCGTCACCCT GTTGCCGGGC GAATACGAAA TGACTTGCGG

  351  TCTTTTGACC AATCCGCGCG GCAAGCTGGT GGTAACCGAC AGCGGCTTTA

  401  AAGACACCGC CAACGAAGCG GATTTGGAAA AACTGTCCCA ACCGCTCGCC

  451  GACTATAAAG CCTATGTTCA AGGCGAAGTC AAAGAGCTGG TGGCGAAAAC

  501  CAAAACCTTT ACCGAAGCCG TCAAAGCAGG CGACATTGAA AAGGCGAAAT

  551  CCCTGTTTGC CGACACCCGC GTCCATTACG AACGCATCGA ACCGATTGCC

  601  GAGCTTTTCA GCGAACTCGA CCCCGTCATC GATGCGCGTG AAGACGACTT

  651  CAAAGACGGC GCGAAAGATG CCGGATTTAC CGGCTTCCAC CGTATCGAAT

  701  ACGCCCTTTG GGTGGAAAAA GACGTGTCCG GCGTGAAGGA AATTGCAGCG

  751  AAACTGATGA CCGATGTCGA AGCCCTGCAA AAAGAAATCG ACGCATTGGC

  801  GTTTCCTCCG GGCAAGGTGG TCGGCGGCGC GTCCGAACTG ATTGAAGAAG

  851  TGGCGGGCAG TAAAATCAGC GGCGAAGAAG ACCGGTACAG CCACACCGAT

  901  TTGAGCGACT TCCAAGCCAA TGTGGACGGA TCGAAAAAAA TCGTCGATTT
```

-continued

```
 951 GTTCCGTCCG TTGATCGAGA CCAAAAACAA AGCCTTGTTG GAAAAAACCG

1001 ATACCAACTT CAAACAGGTC AACGAAATTC TGGCGAAATA CCGGACTAAA

1051 GACGGTTTTG AAACCTACGA CAAGCTGGGC GAAGCCGACC GCAAAGCGTT

1101 ACAGGCCTCT ATTAACGCGC TTGCCGAAGA CCTTGCCCAA CTTCGCGGCA

1151 TACTCGGCTT GAAATAA
```

This corresponds to the amino acid sequence <SEQ ID 2572; ORF 749.a>:

```
a749.pep
  1 MRKFNLTALS VMLALGLTAC QPPEAEKAAP AASGEAQTAN EGGSVSIAVN

 51 DNACEPMELT VPSGQVVFNI KNNSGRKLEW EILKGVMVVD ERENIAPGLS

101 DKMTVTLLPG EYEMTCGLLT NPRGKLVVTD SGFKDTANEA DLEKLSQPLA

151 DYKAYVQGEV KELVAKTKTF TEAVKAGDIE KAKSLFADTR VHYERIEPIA

201 ELFSELDPVI DAREDDFKDG AKDAGFTGFH RIEYALWVEK DVSGVKEIAA

251 KLMTDVEALQ KEIDALAFPP GKVVGGASEL IEEVAGSKIS GEEDRYSHTD

301 LSDFQANVDG SKKIVDLFRP LIETKNKALL EKTDTNFKQV NEILAKYRTK

351 DGFETYDKLG EADRKALQAS INALAEDLAQ LRGILGLK*
```

Computer analysis of this amino acid sequence gave the following results:

Homology with a Predicted ORF from *N. meningitidis* ORF 749 shows 99.7% identity over a 388 aa overlap with a predicted ORF (ORF 749) from *N. meningitidis*:

```
a749/m749  99.7% identity in 388 aa overlap

                   10        20        30        40        50        60
a749.pep   MRKFNLTALSVMLALGLTACQPPEAEKAAPAASGEAQTANEGGSVSIAVNDNACEPMELT
           ||||||||||||||||||||||||||||||||||||||||||||||||||||||||||||
m749       MRKFNLTALSVMLALGLTACQPPEAEKAAPAASGEAQTANEGGSVSIAVNDNACEPMELT
                   10        20        30        40        50        60

                   70        80        90       100       110       120
a749.pep   VPSGQVVFNIKNNSGRKLEWEILKGVMVVDERENIAPGLSDKMTVTLLPGEYEMTCGLLT
           ||||||||||||||||||||||||||||||||||||||||||||||||||||||||||||
m749       VPSGQVVFNIKNNSGRKLEWEILKGVMVVDERENIAPGLSDKMTVTLLPGEYEMTCGLLT
                   70        80        90       100       110       120

                  130       140       150       160       170       180
a749.pep   NPRGKLVVTDSGFKDTANEADLEKLSQPLADYKAYVQGEVKELVAKTKTFTEAVKAGDIE
           ||||||||||||||||||||||||||||||||||||||||||||||||||||||||||||
m749       NPRGKLVVTDSGFKDTANEADLEKLSQPLADYDAYVQGEVKELVAKTKTFTEAVKAGDIE
                  130       140       150       160       170       180

                  190       200       210       220       230       240
a749.pep   KAKSLFADTRVHYERIEPIAELFSELDPVIDAREDDFKDGAKDAGFTGFHRIEYALWVEK
           ||||||||||||||||||||||||||||||||||||||||||||||||||||||||||||
m749       KAKSLFADTRVHYERIEPIAELFSELDPVIDAREDDFKDGAKDAGFTGFHRIEYALWVEK
                  190       200       210       220       230       240

                  250       260       270       280       290       300
a749.pep   DVSGVKEIAAKLMTDVEALQKEIDALAFPPGKVVGGASELIEEVAGSKISGEEDRYSHTD
           ||||||||||||||||||||||||||||||||||||||||||||||||||||||||||||
m749       DVSGVKEIAAKLMTDVEALQKEIDALAFPPGKVVGGASELIEEVAGSKISGEEDRYSHTD
                  250       260       270       280       290       300

                  310       320       330       340       350       360
a749.pep   LSDFQANVDGSKKIVDLFRPLIETKNKALLEKTDTNFKQVNEILAKYRTKDGFETYDKLG
           |||||||||||||||||||||||:||||||||||||||||||||||||||||||||||||
m749       LSDFQANVDGSKKIVDLFRPLIEAKNKALLEKTDTNFKQVNEILAKYRTKDGFETYDKLG
                  310       320       330       340       350       360

                  370       380      389
a749.pep   EADRKALQASINALAEDLAQLRGILGLKX
           |||||||||||||||||||||||||||||
m749       EADRKALQASINALAEDLAQLRGILGLKX
                  370       380
```

The following partial DNA sequence was identified in *N. gonorrhoeae* <SEQ ID 2573>:

```
g750.seq
  1 GTGAAACCGC GTTTTTATTG GGCAGcctGC GCCGTCCTGC CGGCCGCCTG
 51 TTCGCCCGAA CCTGCCGCCG AAAAAACTGT ATccgCCGCA TCCCAAGCCG
101 CATCCACACC TGTCGCCACG CTGACCGTGC CGACCGCGCG GGGCGATGCC
151 GTTGTGCCGA AGAATCCCGA ACgcgtcgcc gtgtAcgaCt ggGCGGCGTt
201 ggaTACGCTG ACCGAGCCGG GCGTGAATGT GGGCGCAACC ACCGCGCCGG
251 TGCGCGTGGA CTATTTGCAG CCTGCATTTG ACAAGGCGGC AACGGTGGGG
301 ACGCTGTTTG AGCCCGATTG CGAATCCCTG CACCGCCACA ATCCGCAGTT
351 TGTCATTACC GGCGGGCCGG GTGCGGAAGC GTATGAACAG TTGGCGAAAA
401 ACGCGACCAC CATAGATTTG ACGGTGGACA ACGGCAATAT CCGCACCAGC
451 GGCGAGAAGC AGATGGAGAC CCTGTCGCGG ATTTTCGGTA AGGAAGCGCG
501 CGTGGCGGAA TTGAATGCGC AGATTGACGC GCTGTTCGCC CAAAAGCGCG
551 AAGCCGCCAA AGGCAAAGGA CGCGGGCTGG TGCTGTCGGT TACAGGCAAC
601 AAGGTGTCCG CCTTCGGCAC GCAATCGCGG TTGGCAAGTT GGATACACGG
651 CGACATCGGC CTGCCGCCCG TGGACGAATC TTTACGCAAC GAAGGGCACG
701 GGCAGCCCGT TTCCTTCGAA TACATCAAAG AGAAAAACCC CGGCTGGATT
751 TTCATCATCG ACCGCACCGC CGCCATCGGG CAGGAAGGGC CGGCTGCCGT
801 GGAAGTGTTG GATAACGCGC TGGTATGCGG CACGAACGCT TGGAAGCGCA
851 AGCAAATCAT CGTCATGCCT GCCGCGAACT ACATTGTCGC GGGCGGCGCG
901 CGGCAGTTGA TACAGGCGGC GGAACAGTTG AAGGCGGCGT TTGAAAAGGC
951 AGAACCCGTT GCGGCGCAGT AG
```

This corresponds to the amino acid sequence <SEQ ID 2574; ORF 750.ng>:

```
g750.pep
  1 VKPRFYWAAC AVLPAACSPE PAAEKTVSAA SQAASTPVAT LTVPTARGDA
 51 VVPKNPERVA VYDWAALDTL TEPGVNVGAT TAPVRVDYLQ PAFDKAATVG
101 TLFEPDCESL HRHNPQFVIT GGPGAEAYEQ LAKNATTIDL TVDNGNIRTS
151 GEKQMETLSR IFGKEARVAE LNAQIDALFA QKREAAKGKG RGLVLSVTGN
201 KVSAFGTQSR LASWIHGDIG LPPVDESLRN EGHGQPVSFE YIKEKNPGWI
251 FIIDRTAAIG QEGPAAVEVL DNALVCGTNA WKRKQIIVMP AANYIVAGGA
301 RQLIQAAEQL KAAFEKAEPV AAQ*
```

The following partial DNA sequence was identified in *N. meningitidis* <SEQ ID 2575>:

```
m750.seq
  1 GTGAAACCGC GTTTTTATTG GGCAGCCTGC GCCGTCCTGC TGACCGCCTG
 51 TTCGCCCGAA CCTGCCGCCG AAAAAACTGT ATCCGCCGCA TCCGCATCTG
101 CCGCCACGCT GACCGTGCCG ACCGCGCGGG GCGATGCCGT TGTGCCGAAG
151 AATCCCGAAC GCGTCGCCGT GTACGACTGG GCGGCGTTGG ATACGCTGAC
201 CGAATTGGGC GTGAATGTGG GCGCAACCAC CGCGCCGGTG CGCGTGGATT
```

-continued

251 ATTTGCAGCC TGCATTTGAC AAGGCGGCAA CGGTGGGGAC GCTGTTCGAG

301 CCCGATTACG AAGCCCTGCA CCGCTACAAT CCTCAGCTTG TCATTACCGG

351 CGGGCCGGGC GCGGAAGCGT ATGAACAGTT AGCGAAAAAC GCGACCACCA

401 TAGATCTGAC GGTGGACAAC GGCAATATCC GCACCAGCGG CGAAAAGCAG

451 ATGGAGACCT TGGCGCGGAT TTTCGGCAAG GAAGCGCGCG CGGCGGAATT

501 GAAGGCGCAG ATTGACGCGC TGTTCGCCCA AACGCGCGAA GCCGCCAAAG

551 GCAAAGGACG CGGGCTGGTG CTGTCGGTTA CGGGCAACAA GGTGTCCGCC

601 TTCGGCACGC AGTCGCGGTT GGCAAGTTGG ATACACGGCG ACATCGGCCT

651 ACCGCCTGTA GACGAATCTT TACGCAACGA GGGGCACGGG CAGCCTGTTT

701 CCTTCGAATA CATCAAAGAG AAAAACCCCG ATTGGATTTT CATCATCGAC

751 CGTACCGCCG CCATCGGGCA GGAAGGGCCG GCGGCTGTCG AAGTATTGGA

801 TAACGCGCTG GTACGCGGCA CGAACGCTTG GAAGCGCAAG CAAATCATCG

851 TCATGCCTGC CGCGAACTAC ATTGTCGCGG GCGGCGCGCG GCAGTTGATT

901 CAGGCGGCGG AGCAGTTGAA GGCGGCGTTT AAAAAGGCAG AACCCGTTGC

951 GGCGGGGAAA AAGTAG

This corresponds to the amino acid sequence <SEQ ID 2576; ORF 750>:

m750.pep

1 VKPRFYWAAC AVLLTACSPE PAAEKTVSAA SASAATLTVP TARGDAVVPK

51 NPERVAVYDW AALDTLTELG VNVGATTAPV RVDYLQPAFD KAATVGTLFE

101 PDYEALHRYN PQLVITGGPG AEAYEQLAKN ATTIDLTVDN GNIRTSGEKQ

151 METLARIFGK EARAAELKAQ IDALFAQTRE AAKGKGRGLV LSVTGNKVSA

201 FGTQSRLASW IHGDIGLPPV DESLRNEGHG QPVSFEYIKE KNPDWIFIID

251 RTAAIGQEGP AAVEVLDNAL VRGTNAWKRK QIIVMPAANY IVAGGARQLI

301 QAAEQLKAAF KKAEPVAAGK K*

Computer analysis of this amino acid sequence gave the following results:

Homology with a Predicted ORF from *N. gonorrhoeae*

ORF 750 shows 93.8% identity over a 322 aa overlap with a predicted ORF (ORF 750) from *N. gonorrhoeae*

```
m750/g750   93.8% identity in 322 aa overlap

                        10        20        30            40        50
m750.pep        VKPRFYWAACAVLLTACSPEPAAEKTVSAASASA----ATLTVPTARGDAVVPKNPERVA
                ||||||||||||| :|||||||||||||||| :|    ||||||||||||||||||||||
g750            VKPRFYWAACAVLPAACSPEPAAEKTVSAASQAASTPVATLTVPTARGDAVVPKNPERVA
                        10        20        30        40        50        60

                  60        70        80        90       100       110
m750.pep        VYDWAALDTLTELGVNVGATTAPVRVDYLQPAFDKAATVGTLFEPDYEALHRYNPQLVIT
                |||||||||||| ||||||||||||||||||||||||||||||||| |:|||:|||:|||
g750            VYDWAALDTLTEPGVNVGATTAPVRVDYLQPAFDKAATVGTLFEPDCESLHRHNPQFVIT
                        70        80        90       100       110       120

                 120       130       140       150       160       170
m750.pep        GGPGAEAYEQLAKNATTIDLTVDNGNIRTSGEKQMETLARIFGKEARAAELKAQIDALFA
                ||||||||||||||||||||||||||||||||||||||:||||||||:|||:||||||||
g750            GGPGAEAYEQLAKNATTIDLTVDNGNIRTSGEKQMETLSRIFGKEARVAELNAQIDALFA
                       130       140       150       160       170       180

                 180       190       200       210       220       230
m750.pep        QTREAAKGKGRGLVLSVTGNKVSAFGTQSRLASWIHGDIGLPPVDESLRNEGHGQPVSFE
                | ||||||||||||||||||||||||||||||||||||||||||||||||||||||||||
g750            QKREAAKGKGRGLVLSVTGNKVSAFGTQSRLASWIHGDIGLPPVDESLRNEGHGQPVSFE
                       190       200       210       220       230       240
```

-continued

```
              240        250        260        270        280        290
m750.pep     YIKEKNPDWIFIIDRTAAIGQEGPAAVEVLDNALVRGTNAWKRKQIIVMPAANYIVAGGA
             |||||| ||||||||||||||||||||||||||||||| ||||||||||||||||||||||
g750         YIKEKNPGWIFIIDRTAAIGQEGPAAVEVLDNALVCGTNAWKRKQIIVMPAANYIVAGGA
                    250        260        270        280        290        300

              300        310        320
m750.pep     RQLIQAAEQLKAAFKKAEPVAAGKKX
             ||||||| |||||||||||||
g750         RQLIQAAEQLKAAFEKAEPVAAQX
                    310        320
```

The following partial DNA sequence was identified in *N. meningitidis* <SEQ ID 2577>:

```
a750.seq
   1 GTGAAACCGC GTTTTTATTG GGCAGCCTGC GCCGTCCTGC TGACCGCCTG

  51 TTCGCCCGAA CCTGCCGCCG AAAAAACTGT ATCCGCCGCA TCCGCATCTG

 101 CCGCCACACT GACCGTGCCG ACCGCGCGGG GCGATGCCGT TGTGCCGAAG

 151 AATCCCGAAC GCGTCGCCGT GTACGACTGG GCGGCGTTGG ATACGCTGAC

 201 CGAATTGGGT GTGAATGTGG GCGCAACCAC CGCGCCGGTG CGCGTGGATT

 251 ATTTGCAGCC TGCATTTGAC AAGGCGGCAA CGGTGGGGAC GCTGTTCGAG

 301 CCCGATTACG AAGCCCTGCA CCGCTACAAT CCTCAGCTTG TCATTACCGG

 351 CGGGCCGGGC GCGGAAGCGT ATGAACAGTT GGCGAAAAAC GCGACCACCA

 401 TAGATCTGAC GGTGGACAAC GGCAATATCC GCACCAGCGG CGAAAAGCAG

 451 ATGGAGACCT TGGCGCGGAT TTTCGGCAAG GAAGCGCGCG CGGCGGAATT

 501 GAAGGCGCAG ATTGACGCGC TGTTCGCCCA AACGCGCGAA GCCGCCAAAG

 551 GCAAAGGACG CGGGCTGGTG CTGTCGGTTA CGGGCAACAA GGTGTCCGCC

 601 TTCGGCACGC AGTCGCGGTT GGCAAGTTGG ATACACGGCG ACATCGGCCT

 651 ACCGCCTGTA GACGAATCTT TACGCAACGA GGGGCACGGG CAGCCTGTTT

 701 CCTTCGAATA CATCAAAGAG AAAAACCCCG ATTGGATTTT CATCATCGAC

 751 CGTACCGCCG CCATCGGGCA GGAAGGGCCG GCGGCTGTCG AAGTATTGGA

 801 TAACGCGCTG GTACGCGGCA CGAACGCTTG GAAGCGCAAG CAAATCATCG

 851 TCATGCCTGC CGCGAACTAC ATTGTCGCGG GCGGCTCGCG GCAGTTGATT

 901 CAGGCGGCGG AGCAGTTGAA GGAGGCGTTT GAAAAGGCAG AACCCGTTGC

 951 GGCGGGGAAA GAGTAG
```

This corresponds to the amino acid sequence <SEQ ID 2578; ORF 750.a>:

```
a750.pep
   1 VKPRFYWAAC AVLLTACSPE PAAEKTVSAA SASAATLTVP TARGDAVVPK

  51 NPERVAVYDW AALDTLTELG VNVGATTAPV RVDYLQPAFD KAATVGTLFE

 101 PDYEALHRYN PQLVITGGPG AEAYEQLAKN ATTIDLTVDN GNIRTSGEKQ

 151 METLARIFGK EARAAELKAQ IDALFAQTRE AAKGKGRGLV LSVTGNKVSA

 201 FGTQSRLASW IHGDIGLPPV DESLRNEGHG QPVSFEYIKE KNPDWIFIID

 251 RTAAIGQEGP AAVEVLDNAL VRGTNAWKRK QIIVMPAANY IVAGGSRQLI

 301 QAAEQLKEAF EKAEPVAAGK E*
```

Computer analysis of this amino acid sequence gave the following results:

Homology with a Predicted ORF from *N. meningitidis*

ORF 750 shows 98.8% identity over a 321 aa overlap with a predicted ORF (ORF 750) from *N. meningitidis*:

```
a750/m750   93.8% identity in 321 aa overlap

                      10        20        30        40        50        60
a750.pep    VKPRFYWAACAVLLTACSPEPAAEKTVSAASASAATLTVPTARGDAVVPKNPERVAVYDW
            ||||||||||||||||||||||||||||||||||||||||||||||||||||||||||||
m750        VKPRFYWAACAVLLTACSPEPAAEKTVSAASASAATLTVPTARGDAVVPKNPERVAVYDW
                      10        20        30        40        50        60

                      70        80        90       100       110       120
a750.pep    AALDTLTELGVNVGATTAPVRVDYLQPAFDKAATVGTLFEPDYEALHRYNPQLVITGGPG
            ||||||||||||||||||||||||||||||||||||||||||||||||||||||||||||
m750        AALDTLTELGVNVGATTAPVRVDYLQPAFDKAATVGTLFEPDYEALHRYNPQLVITGGPG
                      70        80        90       100       110       120

                     130       140       150       160       170       180
a750.pep    AEAYEQLAKNATTIDLTVDNGNIRTSGEKQMETLARIFGKEARAAELKAQIDALFAQTRE
            ||||||||||||||||||||||||||||||||||||||||||||||||||||||||||||
m750        AEAYEQLAKNATTIDLTVDNGNIRTSGEKQMETLARIFGKEARAAELKAQIDALFAQTRE
                     130       140       150       160       170       180

                     190       200       210       220       230       240
a750.pep    AAKGKGRGLVLSVTGNKVSAFGTQSRLASWIHGDIGLPPVDESLRNEGHGQPVSFEYIKE
            ||||||||||||||||||||||||||||||||||||||||||||||||||||||||||||
m750        AAKGKGRGLVLSVTGNKVSAFGTQSRLASWIHGDIGLPPVDESLRNEGHGQPVSFEYIKE
                     190       200       210       220       230       240

              240       250       260       270       280       290
a750.pep    KNPDWIFIIDRTAAIGQEGPAAVEVLDNALVRGTNAWKRKQIIVMPAANYIVAGGSRQLI
            |||||||||||||||||||||||||||||||||||||||||||||||||||||||:||||
m750        KNPDWIFIIDRTAAIGQEGPAAVEVLDNALVRGTNAWKRKQIIVMPAANYIVAGGARQLI
                     250       260       270       280       290       300

                     310       320
a750.pep    QAAEQLKEAFEKAEPVAAGKEX
            ||||||| ||:|||||||||:|
m750        QAAEQLKAAFKKAEPVAAGKKX
                     310       320

g751.seq    not found yet

g751.pep    not found yet
```

The following partial DNA sequence was identified in *N. meningitidis* <SEQ ID 2579>:

```
m751.seq..
     1  ATGGCTTGGA GTATGTTTGC CACAACCCAA GCCGATAGAG CGGTAAGGTC

    51  TGCAACTGCA CCTAAAGAAA TGTGGTTCCA TAAGAAGATA ATAGATGAAA

   101  AAACAGGTAA AGTATCCTTT GATACCAGAC AAATTTGGTC ATTGAATGAT

   151  TTAAGCAAGG AAGAACTGGC AAGCATTCAA GACACAAATG GCAAAGTTAT

   201  TACTGTGTCT AATCCTGGTA TTTTCAATAA TCGAGAAGAT TCATTAAGCA

   251  ACGCAGCAAA ACAAAATCGT AATAGTACAA ACGGTAGTGG TGTTATTGCA

   301  GTCATGAATC CTCCAACAGG GAAATATAAA TCTGATTCTA ATAACAAAAT

   351  AAAAGATTTT TTATGGCTCG GTTCAAGTCT TGTTTCTGAA CTGATGTATG

   401  TCGGTTACGA CCAATTAAAT AATAAAGTGT TCCAAGGCTA TTTACCCAAA

   451  ACCAATTCAG AAAAACTGAA TCAAGATATT TATCGAGAGG TTCAAAAAAT

   501  GGGTAACGGC TGGTCGGTTG ATACCAGTAA TCACAGTCGT GGGGGAATTA

   551  CAGCAAGCGT TTCCTTAAAA GATTGGGTAA ACAATCAAAA ACAAAATGGC

   601  ATTGCCCCAA TCAGAAAAGC ACGTTTCTAT GGTACAGCCA CAAATGTGCA

   651  GAATGATTAC GCCGATGTTT TACAGAAAAA CGGCTATACC TATACGGGTG

   701  CAGACGGCAA AACTTATAAC AGCGGATCCT ACTCAATCGT GCATGATAAA

   751  GATTTTGTGG GGAACAAATG GATACCTTTC TTGCTAGGAA CCAATGACAC
```

-continued

```
 801  CACACAAGGT ACATGTAAGG GGTTGTGCTA TTCGCATAGC AGTTATTTTG

 851  CGGAGGTGCC AAAAGCAGGT ACAAAAGAAT TTGATGACTA TGTAAAAATA

 901  TGGGGTGAAG TTGAATATGA CGCTCAAGGT AAGCCAATTA ACAAATCTAA

 951  ACCCATACTG GTAGAACCAA ACAAAACAAA AGATAATGAA AAATATGAAA

1001  AAGAAGCTTT CTAA
```

This corresponds to the amino acid sequence <SEQ ID 2580; ORF 751>:

```
m751.pep..
  1 MAWSMFATTQ ADRAVRSATA PKEMWFHKKI IDEKTGKVSF DTRQIWSLND

 51 LSKEELASIQ DTNGKVITVS NPGIFNNRED SLSNAAKQNR NSTNGSGVIA

101 VMNPPTGKYK SDSNNKIKDF LWLGSSLVSE LMYVGYDQLN NKVFQGYLPK

151 TNSEKLNQDI YREVQKMGNG WSVDTSNHSR GGITASVSLK DWVNNQKQNG

201 IAPIRKARFY GTATNVQNDY ADVLQKNGYT YTGADGKTYN SGSYSIVHDK

251 DFVGNKWIPF LLGTNDTTQG TCKGLCYSHS SYFAEVPKAG TKEFDDYVKI

301 WGEVEYDAQG KPINKSKPIL VEPNKTKDNE KYEKEAF*

a751.seq not found yet
a751.pep not found yet

g752.seq not found yet
g752.pep not found yet
```

The following partial DNA sequence was identified in *N. meningitidis* <SEQ ID 2581>:

```
m752.seq..
  1  ATGAAAATTT CCAGACCTCC GGAATTTACC CTGTTGCAAC AGGAATATAT

 51  GCAGCATCTC ACTGAAAGAA TGACGCAAAT TGCCAAGCTG CTGAATTCTT

101  CCGCAAACAA TCCTGATATA GACATTCCCG ATTTTCTTAC TGAAATCAAA

151  GATTATTCAG AATTTTCCGT GACAGATGAA AATGGAACCT ACCTGCATTG

201  GGACAAATTC CGCCGGATTC ACACGGAAGA TACGCGGATG AAATGGCGCG

251  CCGTTAAGGA AAGCCGCAAA AAAATCCAAA AACCAATTGA TTTCCCGTTT

301  GAACATCAGT TTTGGTTCTG CATTCCCGAC TCTTTGCAGG CACGGCTTCA

351  TTTGATTGAC AAAAGCTGCG GCAGTTCTAT CGGCACGTCT AGCTTGGGTG

401  GCTTCGGCAG AAGCGAGCAA AACAGATTCT TGCTCAAGTC TCTGATTATG

451  GAAGAAGCGA TTACATCCGC CCAACTGGAA GGTGCGGCTA CCACGCGTAA

501  AGTGGCCAAG GATATGCTCA AATCGCAGCG TAAACCCAAA ACAAAAGACG

551  AAATCATGAT AGTGAACAAC TATCACTTGA TGAAAAAAGC GGTAGAATTG

601  AAAAATACGC CGTTAAGTGT TGAAATGATT TTGGATTTGC ACCGCATTGC

651  TACCAGTAAC GCTATTGAAA ACAAGGCCGA GCCCGGACAA TTCAGGCAGG

701  ATGACGAAAT CTTTATCGCC GATATCAATG GTAACAGCCT GTATCAACCA

751  CCGCCGCACG GACAGGTTCA TACGCTGATG GAAGAGGTGT GTGCGTTTGC

801  CAATAATACC TATGACGGCG TGGAAAATCC GTTTATCCAT CCGGTTGTCC

851  AAGCTATTAT CTTGCATTTC CTCATCGGCT ACATCCACCC ATTTGGTGAT

901  GGCAACGGGC GGACAGCGCG GGCTTTGTTC TATTGGTTTA TGCTCAAAAA
```

-continued

```
 951  CGGCTACTGG CTATTTGAAT ACATATCCAT CAGCCGTCTT CTGAAAAACG

1001  CTCCTGCCCA ATACGCCAAA TCCTATTTGT ATGCGGAAAC TGACGATTTA

1051  GATTTAACCT ATTTCATCTA TTACCAATGC GATATTATCA AGCGGGCGGT

1101  TGCCGATTTG GAGCACTACA TTTCCGACAA ACAAAAACAC CAACAGGAAT

1151  TCAAAGCAGC GATTGCCCAA TATACTGAAA AGATAGGAAA GTTGAACCAA

1201  CGGCAAATTG GTATCCTGCA AAAAGCAGTG GAAGAAAGCG GAAAAATCTT

1251  TACTGCACAA GAAATTGCCA ACCAATACGG CATCTCCCTG AATACTGCCC

1301  GTAGCGATTT GAGTAAACTG GGAGAATATA GATTCCTAGT GCCGTTCAAA

1351  TCAGGAAATG CTTTAGAGTA TGTTGCTCCT CAGGATTTAT TGGAAAGGTT

1401  AGAAAAAAAA TAG
```

This corresponds to the amino acid sequence <SEQ ID 2582; ORF 752>:

```
m752.pep
  1 MKISRPPEFT LLQQEYMQHL TERMTQIAKL LNSSANNPDI DIPDFLTEIK

 51 DYSEFSVTDE NGTYLHWDKF RRIHTEDTRM KWRAVKESRK KIQKPIDFPF

101 EHQFWFCIPD SLQARLHLID KSCGSSIGTS SLGGFGRSEQ NRFLLKSLIM

151 EEAITSAQLE GAATTRKVAK DMLKSQRKPK TKDEIMIVNN YHLMKKAVEL

201 KNTPLSVEMI LDLHRIATSN AIENKAEPGQ FRQDDEIFIA DINGNSLYQP

251 PPHGQVHTLM EEVCAFANNT YDGVENPFIH PVVQAIILHF LIGYIHPFGD

301 GNGRTARALF YWFMLKNGYW LFEYISISRL LKNAPAQYAK SYLYAETDDL

351 DLTYFIYYQC DIIKRAVADL EHYISDKQKH QQEFKAAIAQ YTEKIGKLNQ

401 RQIGILQKAV EESGKIFTAQ EIANQYGISL NTARSDLSKL GEYRFLVPFK

451 SGNALEYVAP QDLLERLEKK *
```

The following partial DNA sequence was identified in *N. meningitidis* <SEQ ID 2583>:

```
m752-1.seq
  1  ATGAAAATTT CCAGACCTCC GGAATTTACC CTGTTGCAAC AGGAATATAT

 51  GCAGCATCTC ACTGAAAGAA TGACGCAAAT TGCCAAGCTG CTGAATTCTT

101  CCGCAAACAA TCCTGATATA GACATTCCCG ATTTTCTTAC TGAAATCAAA

151  GATTATTCAG AATTTTCCGT GACAGATGAA AATGGAACCT ACCTGCATTG

201  GGACAAATTC CGCCGGATTC ACACGGAAGA TACGCGGATG AAATGGCGCG

251  CCGTTAAGGA AAGCCGCAAA AAAATCCAAA AACCAATTGA TTTCCCGTTT

301  GAACATCAGT TTTGGTTCTG CATTCCCGAC TCTTTGCAGG CACGGCTTCA

351  TTTGATTGAC AAAAGCTGCG GCAGTTCTAT CGGCACGTCT AGCTTGGGTG

401  GCTTCGGCAG AAGCGAGCAA AACAGATTCT TGCTCAAGTC TCTGATTATG

451  GAAGAAGCGA TTACATCCGC CCAACTGGAA GGTGCGGCTA CCACGCGTAA

501  AGTGGCCAAG GATATGCTCA AATCGCAGCG TAAACCCAAA ACAAAAGACG

551  AAATCATGAT AGTGAACAAC TATCACTTGA TGAAAAAAGC GGTAGAATTG

601  AAAAATACGC CGTTAAGTGT TGAAATGATT TTGGATTTGC ACCGCATTGC

651  TACCAGTAAC GCTATTGAAA ACAAGGCCGA GCCCGGACAA TTCAGGCAGG
```

-continued

```
 701 ATGACGAAAT CTTTATCGCC GATATCAATG GTAACAGCCT GTATCAACCA

 751 CCGCCGCACG GACAGGTTCA TACGCTGATG GAAGAGGTGT GTGCGTTTGC

 801 CAATAATACC TATGACGGCG TGGAAAATCC GTTTATCCAT CCGGTTGTCC

 851 AAGCTATTAT CTTGCATTTC CTCATCGGCT ACATCCACCC ATTTGGTGAT

 901 GGCAACGGGC GGACAGCGCG GGCTTTGTTC TATTGGTTTA TGCTCAAAAA

 951 CGGCTACTGG CTATTTGAAT ACATATCCAT CAGCCGTCTT CTGAAAAACG

1001 CTCCTGCCCA ATACGCCAAA TCCTATTTGT ATGCGGAAAC TGACGATTTA

1051 GATTTAACCT ATTTCATCTA TTACCAATGC GATATTATCA AGCGGGCGGT

1101 TGCCGATTTG GAGCACTACA TTTCCGACAA ACAAAAACAC CAACAGGAAT

1151 TCAAAGCAGC GATTGCCCAA TATACTGAAA AGATAGGAAA GTTGAACCAA

1201 CGGCAAATTG GTATCCTGCA AAAAGCAGTG GAAGAAAGCG GAAAAATCTT

1251 TACTGCACAA GAAATTGCCA ACCAATACGG CATCTCCCTG AATACTGCCC

1301 GTAGCGATTT GAGTAAACTG GGAGAATATA GATTCCTAGT GCCGTTCAAA

1351 TCAGGAAATG CTTTAGAGTA TGTTGCTCCT CAGGATTTAT TGGAAAGGTT

1401 AGAAAAAAAA TAG
```

This corresponds to the amino acid sequence <SEQ ID 2584; ORF 752-1>:

```
m752-1.pep
   1 MKISRPPEFT LLQQEYMQHL TERMTQIAKL LNSSANNPDI DIPDFLTEIK

  51 DYSEFSVTDE NGTYLHWDKF RRIHTEDTRM KWRAVKESRK KIQKPIDFPF

 101 EHQFWFCIPD SLQARLHLID KSCGSSIGTS SLGGFGRSEQ NRFLLKSLIM

 151 EEAITSAQLE GAATTRKVAK DMLKSQRKPK TKDEIMIVNN YHLMKKAVEL

 201 KNTPLSVEMI LDLHRIATSN AIENKAEPGQ FRQDDEIFIA DINGNSLYQP

 251 PPHGQVHTLM EEVCAFANNT YDGVENPFIH PVVQAIILHF LIGYIHPFGD

 301 GNGRTARALF YWFMLKNGYW LFEYISISRL LKNAPAQYAK SYLYAETDDL

 351 DLTYFIYYQC DIIKRAVADL EHYISDKQKH QQEFKAAIAQ YTEKIGKLNQ

 401 RQIGILQKAV EESGKIFTAQ EIANQYGISL NTARSDLSKL GEYRFLVPFK

 451 SGNALEYVAP QDLLERLEKK *
```

```
a752.seq not found yet
a752.pep not found yet

g753.seq not found yet
g753.pep not found yet
```

The following partial DNA sequence was identified in *N. meningitidis* <SEQ ID 2585>:

```
m753.seq
   1 ATGCCCATCA CTCCACCCTT AAACATCATC TCTCCTAAAC TCTACCCCAA

  51 TGAACAATGG AACGAAAGCG AAGCACTCGG TGCCATCACT TGGCTATGGT

 101 ATCAGTCGCC TACGCATCGC CAAGTACCTA TTGTGGAGAT GATGACGTAT

 151 ATATTGCCTG TGTTAAAAAA CGGGCAGTTC GCTTTGTTTT GCAAGGGTAC

 201 CCAACCAATC GGTTATATCT CATGGGCTTA TTTTGATGAA GTGGCGCAGG

 251 CGCATTATTT AGAATCTGAC CGCCATTTGC GTGACAACAG CGATTGGAAC
```

-continued

```
301 TGTGGCGACA ATATTTGGCT GATTCAATGG TTTGCGCCAT TGGGACACAG

351 TCATCAAATG CGCTCAGCTG TGCGCCAGTT ATTTCCTAGT ACGACAGTAC

401 GCGCCTTGTA TCATAAAGGG AGCGATAAGG GTTTGAGAAT TTTAACTTTT

451 AAAACTTGA
```

This corresponds to the amino acid sequence <SEQ ID 2586; ORF 753>:

```
m753.pep
   1 MPITPPLNII SPKLYPNEQW NESEALGAIT WLWYQSPTHR QVPIVEMMTY

  51 ILPVLKNGQF ALFCKGTQPI GYISWAYFDE VAQAHYLESD RHLRDNSDWN

 101 CGDNIWLIQW FAPLGHSHQM RSAVRQLFPS TTVRALYHKG SDKGLRILTF

 151 KT*

a753.seq not found yet
a753.pep not found yet

g754.seq not found yet
g754.pep not found yet
```

The following partial DNA sequence was identified in *N. meningitidis* <SEQ ID 2587>:

```
m754.seq
     1 ATGATGAAGT CTATCCTCAC CGTATCCGGA AATCGTATGC GTAAACCCAG

    51 AATCACCTAT TTGGATGTTT GGGCAAACGA TGAAAGAATC GGTACTTTGG

   101 AAAAGGGGGC CATGTATCGG TTCGCATACG ACAATCCCAA TTCTTCGTTG

   151 CTGGGCCTGC ATTATCAAGA CAGAAGCAAG GTATATATCA GCAACAATAT

   201 GCCGCATATC TTTGCACAGT ATTTTCCGGA AGGCTTTTTG GATGCACACA

   251 TCACAAGCAA ATATGCTTTT CATGATGCGC CTTTTGAAGA CAATGAGATG

   301 CTGCGCTTGG CAATTCTGTG CAGAGAGACT TTGGGTCGGA TACATGTGCG

   351 CTGTAATGAC CCGCTTTTTA ATGAATGGAT TGACGGGTTG GAGATGAAAA

   401 ATCCAAGAAT ATTGACTGAA CGGGATTTGC TGGGCATAAA TGCCCGACAG

   451 GTTTTTCAGC AATATATGGC AGAAATCTTC CATCACGGCC GTTTCGTCAG

   501 TGTATCCGGG ATACAGCAGA AGATGTCCTT AGATGCCATC CGCAGAAATA

   551 CCAAGCAAAC TGCCTCATAT ATTGCCAAAG GTTTTGATGC ATCCGAATAT

   601 CCTTGCTTGG CTGCCAATGA ATTTTTATGC ATGCAGACCA TCAAACAAGC

   651 CGGCATTGCC GTTGCACAGA CCAGCCTGTC GGAAGATTCA TCAGTCTTAT

   701 TGGTACGTCG GTTTGATGTC AGTGAACAGG GTTATTTTTT AGGGATGGAA

   751 GACTTTACCA GTCTGCGCCA GTATTCGGTA GAAGATAAAT ATAAAGGCAG

   801 TTATGCGGCT ATTGCACAGA TTATCCGACA GATATCCGGC AGACCAGATG

   851 AAGATTTAAT CCATTTCTTT AATCAGCTTG CTGCCAGTTG CATATTGAAA

   901 AACGGCGATG CACACCTCAA AAATTTTTCA GTACTCTATC ATGACGAATA

   951 CGATGTTCGT CTTGCACCTG TCTATGATGT ATTGGATACA TCAATATACA

  1001 GGGTTGGAAC ACAAGGAATT TTTGATGCTT ATGACGATAC GCTGGCATTA

  1051 AACCTGACTA ACCACGGTAA GAAAACATAT CCTTCCAAGA ATACATTGTT

  1101 GGATTTTGCT GAGAAATATT GCGATTTGGG AAGAGAAGAT GCATCCTTTA
```

-continued

```
1151  TGATAGATAC AATCGTTCAA GCTAAAGAAC AGGTTCTTGT TAAATACTCG

1201  GATGTATTGC GTGAGAATGA ATGGTTGGCG CAGAAGTGGC ATTTTATCCC

1251  GGATGAAAAT GAAGAAGGTC TACCGTTTAC ATTCCGGTAG
```

This corresponds to the amino acid sequence <SEQ ID 2588; ORF 754>:

```
m754.pep
   1 MMKSILTVSG NRMRKPRITY LDVWANDERI GTLEKGAMYR FAYDNPNSSL

  51 LGLHYQDRSK VYISNNMPHI FAQYFPEGFL DAHITSKYAF HDAPFEDNEM

 101 LRLAILCRET LGRIHVRCND PLFNEWIDGL EMKNPRILTE RDLLGINARQ

 151 VFQQYMAEIF HHGRFVSVSG IQQKMSLDAI RRNTKQTASY IAKGFDASEY

 201 PCLAANEFLC MQTIKQAGIA VAQTSLSEDS SVLLVRRFDV SEQGYFLGME

 251 DFTSLRQYSV EDKYKGSYAA IAQIIRQISG RPDEDLIHFF NQLAASCILK

 301 NGDAHLKNFS VLYHDEYDVR LAPVYDVLDT SIYRVGTQGI FDAYDDTLAL

 351 NLTNHGKKTY PSKNTLLDFA EKYCDLGRED ASFMIDTIVQ AKEQVLVKYS

 401 DVLRENEWLA QKWHFIPDEN EEGLPFTFR*
```

a754.seq not found yet
a754.pep not found yet g755.seq not found yet
g755.pep not found yet The following partial DNA sequence was identified in *N. meningitidis* <SEQ ID 2589>:

```
m755.seq..
   1 ATGAGCCGTT ACCTGATTAC CTTTGATATG GATACCAACT GCCTGAAAGA

  51 CAATTACCAC GGAAATAACT ATACCAATGC CTACTCCGAT ATTAAAACCA

 101 TCTTGGCTAG ACATGGATTT GAGAACATTC AGGGCAGTGT TTATCTAGGC

 151 CGTGAAGGCA TCAGTGAAGC ACACGGAACA ATAGCCATTC AGGAACTGAC

 201 CGCTCGGTTT GATTGGTTTT ACTCCTGTAT TTCAAACATT AAGTTTTACC

 251 GCCTTGAAAG TGATTTGAAC GCACAATTTA TCGCTGATGG TGTGTATCAA

 301 GCCAAACAGG CTTTCCTTCA ACGTGTTGAA CAACTTCGTA TATCCCTAAC

 351 AGAAGCTGGA TTGTCTGATG AGCAAATCAA TCAGGTTCTG GAAAAACAGA

 401 AATTTGAATT GGAAAGTCCT AACCTGAAAT TAAATTAA
```

This corresponds to the amino acid sequence <SEQ ID 2590; ORF 755>:

```
m755.pep..
   1 MSRYLITFDM DTNCLKDNYH GNNYTNAYSD IKTILARHGF ENIQGSVYLG

  51 REGISEAHGT IAIQELTARF DWFYSCISNI KFYRLESDLN AQFIADGVYQ

 101 AKQAFLQRVE QLRISLTEAG LSDEQINQVL EKQKFELESP NLKLN*
```

a755.seq not found yet
a755.pep not found yet g756.seq not found yet
g756.pep not found yet The following partial DNA sequence was identified in *N. meningitidis* <SEQ ID 2591>:

```
m756.seq
    1 ATGACCGCCA ACTTTGCACA GACGCTGGTC GAAATACAGG ACAGTCTGTA

   51 CAGGGTTGTG TCAACCGTCC AATACGGGGA TGACAACCTC AAGCGGTTGA

  101 CAGCGGACAA ACGGAAGCAG TATGAGTTGA ACTTCAAGAT TTCCGAGGGT

  151 TCTACGCGTG TAGAGTCCGA CTTTAAAGAG ACTTTGGTTC GGTTCGGTAG

  201 AGATATGCTT CAAGATATGC CCCCTAAAAT CCGTTCGGCA ACGCTGGTAG

  251 CGTTGACGAC CCTGCTTGTC GGAGGGGCGT TGGGTTACGG TTATTTGGAA

  301 TACCTGAAGC AGGTTGCTTC GGAAGGGTAT CAGACCGAGC GTCTGTATAA

  351 TGCCGTCGAC CGTCTTGCAG AATCCCAAGA ACGGATAACG TCCGCCATCC

  401 TGAAGGGTGC TAGAGGTGCC GATTTCGTGC AAATCGGCAG ACGTTCCTAC

  451 AGTAGGGAGG ATATATCGGA GGCAAATAGA CGTGCAGAGC GTGTCCCGTA

  501 TGGCGCAGAG TTGGTTTCAG ACGGCAATTT TACCGCTGTT TTATCTGATA

  551 TAGGGGATTA A
```

This corresponds to the amino acid sequence <SEQ ID 2592; ORF 756>:

```
m756.pep
    1 MTANFAQTLV EIQDSLYRVV STVQYGDDNL KRLTADKRKQ YELNFKISEG

   51 STRVESDFKE TLVRFGRDML QDMPPKIRSA TLVALTTLLV GGALGYGYLE

  101 YLKQVASEGY QTERLYNAVD RLAESQERIT SAILKGARGA DFVQIGRRSY

  151 SREDISEANR RAERVPYGAE LVSDGNFTAV LSDIGD*
```

The following partial DNA sequence was identified in *N. meningitidis* <SEQ ID 2593>:

```
a756.seq
    1 ATGACCGCCA ACTTTGCACA GACGCTGGTC GAAATACAGG ACAGTCTGTA

   51 NAGGGTTGTG TCAACCGTCC AATACGGGGA TGACAACCTC AAGCGGTTGA

  101 CAGCGGACAA ACGGAAGCAG TATGAGTTGA ACTTCAAGAT TTCCGAGGGT

  151 TCTACGCGTG TAGAGTCCGA CTTTAAAGAG ACTTTGGTTC GGTTCGGTAG

  201 AGATATGCTT CAAGATATGC CCCCTAAAAT CCGTTCGGCA ACGCTGGTAG

  251 CGTTGACGAC CCTGCTTGTC GGAGGGGCGT TGGGTTACGG TTATTTGGAA

  301 TACCTGAAGC AGGTTGCTTC GGAAGGGTAT CAGACCGAGC GTCTGTATAA

  351 TGCCGTCGAC CGTCTTGCAG AATCCCAAGA ACGGATAACG TCCGCCATCC

  401 TGAAGGGTGC TAGAGGTGCC GATTTCGTGC AAATCGGCAG ACGTTCCTAC

  451 AGTAGGGAGG ATATATCGGA GGCAAATAGA CGTGCAGAGC GTGTCCCGTA

  501 TGGCGCAGAG TTGGTTTCAG ACGGCAATTT TACCGCTGTT TTATCTGATA

  551 TAGGGGATTA A
```

This corresponds to the amino acid sequence <SEQ ID 2594; ORF 756.a>:

```
a756.pep
  1  MTANFAQTLV EIQDSLXRVV STVQYGDDNL KRLTADKRKQ YELNFKISEG
```

-continued

```
 51 STRVESDFKE TLVRFGRDML QDMPPKIRSA TLVALTTLLV GGALGYGYLE

101 YLKQVASEGY QTERLYNAVD RLAESQERIT SAILKGARGA DFVQIGRRSY

151 SREDISEANR RAERVPYGAE LVSDGNFTAV LSDIGD*
```

m756/a756 99.5% identity in 186 aa overlap

```
                    10        20        30        40        50        60
m756.pep    MTANFAQTLVEIQDSLYRVVSTVQYGDDNLKRLTADKRKQYELNFKISEGSTRVESDFKE
            |||||||||||||||| |||||||||||||||||||||||||||||||||||||||||||
a756        MTANFAQTLVEIQDSLXRVVSTVQYGDDNLKRLTADKRKQYELNFKISEGSTRVESDFKE
                    10        20        30        40        50        60

                    70        80        90       100       110       120
m756.pep    TLVRFGRDMLQDMPPKIRSATLVALTTLLVGGALGYGYLEYLKQVASEGYQTERLYNAVD
            ||||||||||||||||||||||||||||||||||||||||||||||||||||||||||||
a756        TLVRFGRDMLQDMPPKIRSATLVALTTLLVGGALGYGYLEYLKQVASEGYQTERLYNAVD
                    70        80        90       100       110       120

                   130       140       150       160       170       180
m756.pep    RLAESQERITSAILKGARGADFVQIGRRSYSREDISEANRRAERVPYGAELVSDGNFTAV
            ||||||||||||||||||||||||||||||||||||||||||||||||||||||||||||
a756        RLAESQERITSAILKGARGADFVQIGRRSYSREDISEANRRAERVPYGAELVSDGNFTAV
                   130       140       150       160       170       180

m756.pep    LSDIGDX
            |||||||
a756        LSDIGDX

g757.seq    not found yet

g757.pep    not fiund yet
```

The following partial DNA sequence was identified in *N. meningitidis* <SEQ ID 2595>:

```
m757.seq
  1 ATGAAAATAC TCGCTTTATT AATTGCCGCT ACCTGTGCTT TATCTGCGTG

 51 TGGCAGCCAA TCTGAAGAAC AACCGGCATC TGCACAACCC CAAGAGCAGG

101 CACAATCCGA ATTAAAAACC ATGCCGGTAA GCTATACCGA CTATCAATCA

151 GCAGCCAATA AAGGGCTGAA TGACCAAAAA ACCGGTCTGA CCCTTCCTGA

201 ACATGTTGTC CCTATCGACA ATGCGGAAGG AAAGAATCTG CTGCATGACT

251 TTTCAGACGG CCTCACAATC TTAACCGTTG ATACCGATAA AGCCGACAAA

301 ATTACTGCTG TCCGAGTAGT CTGGAATACA GATGCAATGC CTCAAAAAGC

351 GGAAAAACTG TCCAAAGCTG CCGCAGCCTT GATTGCGGCA ACCGCTCCGG

401 AAGACCGCAC AATGCTGCGT GATACCGGCG ACCAAATCGA AATGGCGATT

451 GACAGCCATA ATGCGCAAAA AGAGCCAACC CGAGAATGGG CGCGTGGTGG

501 GATTGCTTAT AAAGTCACTG TTACCAATTT ACCGAGCGTG GTTTTGACGG

551 CAAAAGCTGA GTAA
```

This corresponds to the amino acid sequence <SEQ ID 2596; ORF 757>:

```
m757.pep (lipoprotein)
  1 MKILALLIAA TCALSACGSQ SEEQPASAQP QEQAQSELKT MPVSYTDYQS

 51 AANKGLNDQK TGLTLPEHVV PIDNAEGKNL LHDFSDGLTI LTVDTDKADK

101 ITAVRVVWNT DAMPQKAEKL SKAAAALIAA TAPEDRTMLR DTGDQIEMAI

151 DSHNAQKEPT REWARGGIAY KVTVTNLPSV VLTAKAE*

a757.seq not found yet

a757.pep not found yet
```

-continued

```
g758.seq not found yet

g758.pep not fiund yet
```

The following partial DNA sequence was identified in *N. meningitidis* <SEQ ID 2597>:

```
m758.seq
   1 ATGAACAATC TGACCGTGTT TACCCGTTTC GATACCGATT TGGCGACGCT

  51 TGCCGATGAA TTGCAATATG TGTGGGAACA CACCGCCGTT ACAGACCATC

 101 AGGGCAAACT GGTGGAAATT CCCGTCTGCT ACGGCGGCGA ATACGGCCCG

 151 GATTTGGCGG AAGTCGCTGC TTTCCATCAG ACGGTTATTT CCGAAATCGT

 201 CCGCCGCCAT ACGGCGCAAA CTTATACCGT ATTTATGATG GGCTTCCAGC

 251 CCGGTTTCCC TTATCTGGGC GGCTTGCCCG AAGCATTGCA CACGCCCCGC

 301 CGTGCCGTGC CGAGAACGTC CGTTCCTGCC GGTTCGGTCG GTATCGGCGG

 351 CAGTCAGACC GGTGTGTATC CGTTCGCTTC GCCCGGCGGC TGGCAGATTA

 401 TCGGCAGAAC CGAATTACCC TTGTTCCGAG CCGATTTGAA TCCGCCGACC

 451 CTGCTGGCGG CGGGTGACCA AGTCCGCTTT GTTGCAGAAA GGATTGAGCC

 501 ATGA
```

This corresponds to the amino acid sequence <SEQ ID 2598; ORF 758>:

```
m758.pep
   1 MNNLTVFTRF DTDLATLADE LQYVWEHTAV TDHQGKLVEI PVCYGGEYGP

  51 DLAEVAAFHQ TVISEIVRRH TAQTYTVFMM GFQPGFPYLG GLPEALHTPR

 101 RAVPRTSVPA GSVGIGGSQT GVYPFASPGG WQIIGRTELP LFRADLNPPT

 151 LLAAGDQVRF VAERIEP*
```

The following partial DNA sequence was identified in *N. meningitidis* <SEQ ID 2599>:

```
a758.seq
   1 ATGAACAATC TGACCGTGTT CACCCGTTTC GATACCGATT TGGCGACGCT

  51 TGCCGATGAA TTGCAATATG TGTGGGAACA CACCGCCGTT ACAGACCATC

 101 AGGGCAAACT GGTGGAAATT CCCGTCTGCT ACGGCGGCGA ATACGGCCCG

 151 GATTTGGCGG AAGTCGCTGC TTTCCATCAG ACGGTTATTT CCGAAATCGT

 201 CCGCCGCCAT ACGGCGCAAA CTTATACCGT ATTTATGATG GGCTTCCAGC

 251 CTGGTTTCCC TTATCTGGGC GGCTTGCCCG AAGCATTGCA CACGCCCCGC

 301 CGTGCCGTGC CGAGAACGTC CGTTCCTGCC GGTTCGGTCG GTATCGGCGG

 351 CAGTCAGACC GGTGTGTATC CGTTCGCTTC GCCCGGCGGC TGGCAGATTA

 401 TCGGCAGAAC CGAATTACCC TTGTTCCGAG CCGATTTGAA TCCGCCGACC

 451 CTGCTGGCGG CGGGTGACCA AGTCCGCTTT GTTGCAGAAA GGATTGAGCC

 501 ATGA
```

This corresponds to the amino acid sequence <SEQ ID 2600; ORF 758.a>:

```
a758.pep..
   1 MNNLTVFTRF DTDLATLADE LQYVWEHTAV TDHQGKLVEI PVCYGGEYGP

  51 DLAEVAAFHQ TVISEIVRRH TAQTYTVFMM GFQPGFPYLG GLPEALHTPR

 101 RAVPRTSVPA GSVGIGGSQT GVYPFASPGG WQIIGRTELP LFRADLNPPT

 151 LLAAGDQVRF VAERIEP*
```

m758/a758 100.0% identity in 167 aa overlap

```
                     10        20        30        40        50        60
    m758.pep    MNNLTVFTRFDTDLATLADELQYVWEHTAVTDHQGKLVEIPVCYGGEYGPDLAEVAAFHQ
                ||||||||||||||| ||||||||||||||||||||||||||||||||||||||||||||
    a758        MNNLTVFTRFDTDLATLADELQYVWEHTAVTDHQGKLVEIPVCYGGEYGPDLAEVAAFHQ
                     10        20        30        40        50        60

                     70        80        90       100       110       120
    m758.pep    TVISEIVRRHTAQTYTVFMMGFQPGFPYLGGLPEALHTPRRAVPRTSVPAGSVGIGGSQT
                ||||||||||||||||||||||||||||||||||||||||||||||||||||||||||||
    a758        TVISEIVRRHTAQTYTVFMMGFQPGFPYLGGLPEALHTPRRAVPRTSVPAGSVGIGGSQT
                     70        80        90       100       110       120

                    130       140       150       160
    m756.pep    GVYPFASPGGWQIIGRTELPLFRADLNPPTLLAAGDQVRFVAERIEPX
                ||||||||||||||||||||||||||||||||||||||||||||||||
    a758        GVYPFASPGGWQIIGRTELPLFRADLNPPTLLAAGDQVRFVAERIEPX
                    130       140       150       160

    g759.seq    not found yet

    g759.pep    not found yet
```

The following partial DNA sequence was identified in *N. meningitidis* <SEQ ID 2601>:

```
m759.seq
     1 ATGCGCTTCA CACACACCAC CCCATTTTGT TCCGTATTGT CCACCCTCGG

    51 TCTTTTTGCC GTTTCCCCTG CTTACTCATC CATTGTCCGC AACGATGTCG

   101 ATTACCAATA TTTTCGCGAC TTTGCCGAAA ATAAAGGCGC GTTCACCGTA

   151 GGTGCAAGCA ATATTTCCAT CCAAGACAAG CAAGGCAAAA TATTAGGCAG

   201 GGTTCTCAAC GGCATCCCCA TGCCCGACTT CCGCGTCAGC AACCGCCAAA

   251 CCGCCATCGC CACCCTGGTT CACCCCCAAT ACGTCAACAG TGTCAAACAC

   301 AACGTCGGCT ACGGTTCCAT ACAATTCGGC AACGACACCC AAAATCCAGA

   351 AGAACAAGCC TATACCTACC GCCTCGTATC ACGCAACCCG CACCCGGACT

   401 ACGACTACCA CCTTCCCCGC CTCAACAAAC TGGTTACCGA AATCTCACCT

   451 ACCGCACTCA GCAGCGTACC CTTGCTTGGA AACGGCCAGC CAAAGGCCAA

   501 TGCCTACCTC GATACCGACC GCTTCCCCTA CTTTGTACGA CTCGGCTCAG

   551 GCACGCAACA AGTCCGCAAA GCAGACGGCA CGCGTACACG AACCGCCCCG

   601 GCATACCAAT ACCTGACCGG CGGCACGCCG CTGAAAGTAT TGGGGTTCCA

   651 AAACCACGGC TTACTCGTCG GCGGCAGCCT GACCGACCAA CCCCTTAACA

   701 CCTACGCAAT CGCCGGAGAC AGCGGTTCCC CCTGTTTTGC CTTCGACAAG

   751 CATGAAAACC GCTGGGTGCT TGCGGGCGTA CTCAGCACCT ACGCCGGCTT

   801 CGATAATTTC TTCAACAAAT ACATCGTCAC GCAACCCGAA TTCATCCGTT

   851 CCACCATCCG CCAATACGAA ACCCGGCTGG ATGTCGGGCT GACCACCAAC

   901 GAACTCATAT GGCGCGACAA CGGTAATGGC AACAGCACCC TGCAAGGGCT

   951 CAACGAACGC ATCACCCTGC CCATTGCAAA CCCTTCGCTT GCCCCACAAA

  1001 ACGACAGCAG GCACATGCCG TCTGAAGATG CCGGCAAAAC GCTCATCCTA
```

-continued

1051 TCCAGCAGGT TCGACAACAA AACACTGATG CTGGCAGACA ATATCAACCA

1101 AGGCGCAGGC GCATTGCAGT TCGACAGCAA CTTCACCGTC GTCGGTAAAA

1151 ACCACACATG GCAAGGTGCA GGCGTTATCG TAGCCGACGG CAAACGCGTC

1201 TTCTGGCAAG TCAGCAACCC CAAAGGCGAC CGGCTCTCCA AACTGGGCGC

1251 AGGCACGCTT ATCGCCAACG GACAAGGCAT CAACCAGGGC GACATCAGCA

1301 TCGGGGAAGG CACTGTCGTA CTCGCCCAAA AAGCTGCTTC AGACGGCAGC

1351 AAACAAGCAT TCAACCAAGT CGGCATCACC AGCGGCAGGG GCACGGCCGT

1401 CCTCGCCGAC AGCCAGCAAA TCAAACCCGA AAACCTCTAT TTCGGCTTCA

1451 GGGGCGGACG GCTCGACCTC AACGGCAACA ACCTTGCCTT TACCCATATC

1501 CGCCATGCGG ACGGCGGCGC GCAAATCGTC AATCACAACC CTGACCAAGC

1551 CGCGACACTG ACGCTGACCG GCAACCCCGT CCTCAGTCCC GAGCATGTCG

1601 AGTGGGTGCA ATGGGGCAAC CGTCCGCAAG GCAACGCGGC GGTTTACGAA

1651 TACATCAACC CGCACCGCAA CCGTCGGACC GACTACTTCA TACTCAAACC

1701 CGGCGGCAAC CCGCGCGAAT TTTTCCCGTT AAATATGAAA AACTCAACAA

1751 GCTGGCAATT TATCGGCAAC AACAGGCAAC AGGCCGCCGA ACAAGTCGCC

1801 CAAGCCGAAA ATGCCCGCCC CGACCTGATT ACCTTCGGCG GATACTTGGG

1851 TGAAAACGCG CAAACGGGCA AAGCCGCGCC GAGTTACAGC AAAACCAATG

1901 AAGCAGCCAT AGAAAAAACC CGCCATATCG CAAATGCCGC CGTATACGGC

1951 CGGCCCGAAT ACCGTTACAA CGGCGCACTC AACCTGCACT ATCGTCCCAA

2001 ACGCACCGAC AGCACGCTGT TGCTCAACGG CGGCATGAAC CTTAACGGGG

2051 AAGTCTTGAT TGAGGGCGGC AATATGATTG TGTCAGGCAG GCCCGTACCC

2101 CATGCCTACG ACCACCAGGC CAAACGCGAA CCCGTTCTTG AAAACGAATG

2151 GACCGACGGC AGCTTCAAGG CTGCACGGTT CACCCTGCGA AACCATGCCC

2201 GACTGACGGC AGGGCGCAAT ACCGCGCATC TGGACGGCGA CATAACCGCA

2251 TACGATCTGT CCGGCATCGA CCTCGGCTTT ACCCAAGGCA AAACACCGGA

2301 ATGCTACCGC TCCTACCATA GCGGCAGCAC CCACTGCACA CCCAACGCCG

2351 TTTTAAAAGC CGAAAACTAT CGTGCACTAC CTGCAACGCA AGTACGCGGC

2401 GACATTACCC TTAACGACCG TTCAGAGCTC CGCCTGGGCA AAGCACACCT

2451 GTACGGCAGC ATCCGTGCCG GCAAAGACAC CGCAGTCCGC ATGGAAGCAG

2501 ACAGCAACTG GACACTTTCC CAGTCCAGCC ACACCGGCGC ACTGACGCTT

2551 GACGGCGCAC AAATTACCCT GAACCCCGAT TTCGCCAATA ATACACACAA

2601 CAACCGCTTC AACACACTGA CCGTCAACGG CACACTTGAC GGGTTCGGCA

2651 CATTCCGATT CCTGACCGGC ATCGTCCGAA AACAAAATGC CCCCCCCCTC

2701 AAACTGGAAG GGGACAGCCG CGGCGCATTC CAAATCCACG TCAAAAACAC

2751 CGGACAAGAA CCTCAAACAA CCGAATCGCT TGCACTTGTG AGCCTCAATC

2801 CGAAACACAG CCACCAAGCC CGATTCACCC TCCAAAACGG CTATGCCGAT

2851 TTGGGTGCCT ACCGCTACAT CCTCCGCAAA AACAACAACG GATACAGCCT

2901 GTACAACCCG CTCAAAGAGG CCGAACTTCA AATTGAAGCC ACGCGTGCGG

2951 AACATGAGCG CAACCAACAG GCATACAACC AATTACAGGC AACCGACATC

3001 AGCAGACAGG TTCAACATGA CTCTGACGCG ACCAGGCAGG CACTACAGGC

-continued

```
3051 CTGGCAGAAC AGTCAAACCG AACTTGCCCG CATCGACAGC CAAGTCCAAT

3101 ATCTGTCCGC CCAATTGAAA CAGACAGACC CGCTGACCGG CATTCTGACG

3151 CGTGCCCAAA ACCTGTGTGC CGCACAAGGA TACAGTGCCG ATATCTGCCG

3201 TCAGGTTGCC AAAGCCGCCG ACACGAACGA CCTGACACTC TTCGAAACCG

3251 AACTGGATAC GTATATAGAA CGTGTAGAAA TGGCCGAATC CGAACTTGAC

3301 AAAGCACGGC AAGGCGGCGA TGCGCAAGCC GTCGAAACAG CCCGGCACGC

3351 CTACCTGAAC GCACTCAACC GTCTGTCCCG ACAAATCCAC AGTTTGAAAA

3401 CCGGCGTTGC CGGCATCCGT ATGCCGAACC TGGCCGAACT GATCAGCCGG

3451 TCGGCCAACA CCGCCGTTTC CGAACAGGCC GCCTACAATA CCGGCCGGCA

3501 ACAGGCGGGA CGCCGCATCG ACCGCCACCT TACCGATCCG CAGCAGCAAA

3551 ACATCTGGCT GGAAACCGGT ACGCAACAAA CCGACTACCA TAGCGGCACA

3601 CACCGTCCCT ACCAACAAAC TACCAACTAT GCACATATCG GCATCCAAAC

3651 CGGCATCACC GACCGTCTCA GTGTCGGTAC GATTTTAACC GATGAGCGCA

3701 CAAACAACCG TTTTGATGAA GGCGTATCCG CCCGAAACCG CAGCAACGGC

3751 GCACATCTGT TCGTCAAAGG GGAAAACGGC GCACTCTTTG CCGCGGCAGA

3801 TTTAGGCTAC AGCAACAGCC GTACCCGATT TACCGATTAT GACGGGGCTG

3851 CCGTCCGCCG CCACGCATGG GATGCAGGCA TCAACACCGG CATCAAAATC

3901 GATACCGGCA TCAACCTCAG ACCCTATGCC GGCATCCGTA TAAACCGCAG

3951 CAACGGCAAC CGGTACGTAC TCGACGGCGC AGAGATAAAC AGCCCGGCGC

4001 AAATCCAAAC CACATGGCAT GCCGGCATCC GTCTCGATAA AACCGTCGAA

4051 CTGGGTCAAG CCAAGCTGAC CCCCGCCTTC AGCAGCGATT ACTACCATAC

4101 CCGCCAAAAC AGCGGTTCCG CCCTCAGCGT CAACGACCGT ACCTTACTGC

4151 AGCAAGCCGC CCACGGCACA CTGCATACCC TGCAAATCGA CGCCGGATAC

4201 AAAGGCTGGA ACGCCAAACT TCATGCCGCT TACGGCAAAG ACAGCAACAC

4251 CGCCCGCCAC AAACAGGCAG GAATCAAAAT AGGCTACAAC TGGTAA
```

This corresponds to the amino acid sequence <SEQ ID 2602; ORF 759>:

```
m759.pep
   1 MRFTHTTPFC SVLSTLGLFA VSPAYSSIVR NDVDYQYFRD FAENKGAFTV

  51 GASNISIQDK QGKILGRVLN GIPMPDFRVS NRQTAIATLV HPQYVNSVKH

 101 NVGYGSIQFG NDTQNPEEQA YTYRLVSRNP HPDYDYHLPR LNKLVTEISP

 151 TALSSVPLLG NGQPKANAYL DTDRFPYFVR LGSGTQQVRK ADGTRTRTAP

 201 AYQYLTGGTP LKVLGFQNHG LLVGGSLTDQ PLNTYAIAGD SGSPLFAFDK

 251 HENRWVLAGV LSTYAGFDNF FNKYIVTQPE FIRSTIRQYE TRLDVGLTTN

 301 ELIWRDNGNG NSTLQGLNER ITLPIANPSL APQNDSRHMP SEDAGKTLIL

 351 SSRFDNKTLM LADNINQGAG ALQFDSNFTV VGKNHTWQGA GVIVADGKRV

 401 FWQVSNPKGD RLSKLGAGTL IANGQGINQG DISIGEGTVV LAQKAASDGS

 451 KQAFNQVGIT SGRGTAVLAD SQQIKPENLY FGFRGGRLDL NGNNLAFTHI

 501 RHADGGAQIV NHNPDQAATL TLTGNPVLSP EHVEWVQWGN RPQGNAAVYE

 551 YINPHRNRRT DYFILKPGGN PREFFPLNMK NSTSWQFIGN NRQQAAEQVA
```

-continued

```
 601 QAENARPDLI TFGGYLGENA QTGKAAPSYS KTNEAAIEKT RHIANAAVYG

 651 RPEYRYNGAL NLHYRPKRTD STLLLNGGMN LNGEVLIEGG NMIVSGRPVP

 701 HAYDHQAKRE PVLENEWTDG SFKAARFTLR NHARLTAGRN TAHLDGDITA

 751 YDLSGIDLGF TQGKTPECYR SYHSGSTHCT PNAVLKAENY RALPATQVRG

 801 DITLNDRSEL RLGKAHLYGS IRAGKDTAVR MEADSNWTLS QSSHTGALTL

 851 DGAQITLNPD FANNTHNNRF NTLTVNGTLD GFGTFRFLTG IVRKQNAPPL

 901 KLEGDSRGAF QIHVKNTGQE PQTTESLALV SLNPKHSHQA RFTLQNGYAD

 951 LGAYRYILRK NNNGYSLYNP LKEAELQIEA TRAEHERNQQ AYNQLQATDI

1001 SRQVQHDSDA TRQALQAWQN SQTELARIDS QVQYLSAQLK QTDPLTGILT

1051 RAQNLCAAQG YSADICRQVA KAADTNDLTL FETELDTYIE RVEMAESELD

1101 KARQGGDAQA VETARHAYLN ALNRLSRQIH SLKTGVAGIR MPNLAELISR

1151 SANTAVSEQA AYNTGRQQAG RRIDRHLTDP QQQNIWLETG TQQTDYHSGT

1201 HRPYQQTTNY AHIGIQTGIT DRLSVGTILT DERTNNRFDE GVSARNRSNG

1251 AHLFVKGENG ALFAAADLGY SNSRTRFTDY DGAAVRRHAW DAGINTGIKI

1301 DTGINLRPYA GIRINRSNGN RYVLDGAEIN SPAQIQTTWH AGIRLDKTVE

1351 LGQAKLTPAF SSDYYHTRQN SGSALSVNDR TLLQQAAHGT LHTLQIDAGY

1401 KGWNAKLHAA YGKDSNTARH KQAGIKIGYN W*
```

The following partial DNA sequence was identified in *N. gonorrhoeae* <SEQ ID 2603>:

```
g760.seq (partial)
   1 AACAACCGCA ACACCCGTTA CGCCGCATTG GGCAAACGCG TGATGGAAGG

  51 CGTTGAGACC GAAATCAGCG GTGCGATTAC ACCGAAATGG CAAATCCATG

 101 CAGGTTACAG CTATCTGCAC AGCCAAATCA AAACCGCCGC CAATCCACGC

 151 GACGACGGCA TCTTCCTGCT GGTGCCCAAA CACAGCGCAA ACCTGTGGAC

 201 GACTTACCAA GTTACGCCCG GGCTGACCGT CGGCGGCGGC GTGAACGCGA

 251 TGAGCGGCAT TACTTCATCT GCAGGGATGC ATGCAGGCGG TTATGCCACG

 301 TTCGATGCGA TGGCGGCATA CCGCTTCACG CCCAAGCTGA AGCTGCAAAT

 351 CAATGCCGAC AACATCTTCA ACCGCCATTA CTACGCCCGC GTCGGCGGCA

 401 CGAACACCTT TAACATTCCC GGTTCGGAGC GCAGCCTGAC GGCAAACCTG

 451 CGTTACAGTT TTTAA
```

This corresponds to the amino acid sequence <SEQ ID 2604; ORF 760.ng>:

```
g760.pep (partial)
   1 NNRNTRYAAL GKRVMEGVET EISGAITPKW QIHAGYSYLH SQIKTAANPR

  51 DDGIFLLVPK HSANLWTTYQ VTPGLTVGGG VNAMSGITSS AGMHAGGYAT

 101 FDAMAAYRFT PKLKLQINAD NIFNRHYYAR VGGTNTFNIP GSERSLTANL

 151 RYSF*
```

The following partial DNA sequence was identified in *N. meningitidis* <SEQ ID 2605>:

```
m760.seq
```

-continued

```
   1 ATGGGACAGT TTATGTCAGT TTTCCGCATC AATATGACCG CCGCCACGGT
  51 TTTGGCAGCA CTCTCGTCTT CGGTTTTTGC CGCACAAACG GAAGGTTTGG
 101 AAACCGTCCA TATTAAGGGT CAGCGTTCTT ACAACGCGAT TGCCACCGAG
 151 AAAAACGGCG ATTACAGCTC GTTTGCCGCC ACCGTCGGTA CAAAAATCCC
 201 CGCTTCTTTG CGCGAAATTC CGCAATCCGT CAGCATCATT ACCAACCAGC
 251 AGGTCAAAGA CCGCAATGTT GATACGTTTG ACCAGTTGGC ACGCAAAACG
 301 CCCGGCCTGC GCGTGTTGAG CAACGACGAC GGACGCTCTT CGGTTTACGC
 351 GCGCGGTTAC GAATACAGCG AATACAACAT CGACGGCCTG CCCGCGCAGA
 401 TGCAGAGTAT CAACGGCACG CTGCCCAACC TGTTCGCCTT CGACCGCGTG
 451 GAAGTGATGC GCGGGCCGAG CGGACTGTTC GACAGCAGCG GCGAGATGGG
 501 CGGCATCGTG AATCTGGTGC GCAAACGCCC GACCAAAGCG TTCCAAGGTC
 551 ATGCGGCGGC AGGGTTCGGT ACGCACAAAC AATATAAAGC CGAGGCGGAC
 601 GTATCGGGCA GCCTCAATTC AGACGGCAGC GTGCGCGGCC GCGTGATGGC
 651 GCAGACCGTC GGCGCGTCTC CGCGTCCCGC CGAGAAAAAC AACCGGCGCG
 701 AAACCTTCTA CGCGGCGGCG GATTGGGACA TCAACCCCGA TACGGTTTTG
 751 GGCGCGGGCT ATCTTTACCA GCAACGCCGC CTCGCGCCGT ACAACGGCCT
 801 GCCTGCCGAT GCCAATAACA AATTACCGTC CCTGCCGCAA CACGTATTTG
 851 TCGGCGCGGA TTGGAACAAA TTTAAAATGC ACAGCCACGA CGTGTTCGCC
 901 GATTTGAAAC ATTACTTCGG CAACGGCGGC TACGGCAAAG TCGGTATGCG
 951 CTATTCCGAT CGGAAAGCCG ATTCCAATTA TACGTTTGCG GGCAGCAAAC
1001 TCAACAATAC CGGACAAGCC GACGTAGCGG GTTTGGGTAC GGACATTAAA
1051 CAAAAAGCCT TTGCGGTTGA CGCAAGTTAC AGCCGTCCGT TTGCCTTGGG
1101 CAACACCGCC AACGAATTTG TGATTGGTGC AGACTACAAC CGCTTGCGCA
1151 GTACTAATGA ACAAGGGCGT TCGACTTTGT CAAAAAGCGT CGCTTTAGAT
1201 GGTTTCCGCG CTTTGCCTTA TAACGGCATA CTTCAGAACG CCCGCGCCGG
1251 AAACAAAGGT TTCAATCACT CCGTTACCGA AGAAAACCTC GACGAAACCG
1301 GTTTGTATGC CAAGACGGTG TTCCGTCCTC TGGAAGGTTT GTCGTTGATT
1351 GCAGGCGGAC GTGTAGGACA TCACAAAATC GAGTCGGGCG ACGGCAAAAC
1401 CCTGCATAAA GCTTCGAAAA CCAAATTTAC AAGCTACGCC GGCGCGGTTT
1451 ACGATATAGA CGGCAGCAAC AGCCTGTACG CTTCCGCCTC CCAACTCTAC
1501 ACACCGCAAA CCAGCATCGG CACCGACGGC AAGCTGCTCA AACCGCGCGA
1551 AGGCAACCAG TTTGAAATCG GCTACAAAGG CAGCTACATG GACGACCGCC
1601 TCAATACCCG GGTTTCGTTC TACCGCATGA AGGATAAAAA CGCCGCCGCA
1651 CCGCTGGACT CAAACAACAA AAAAACCCGT TACGCCGCAT TGGGCAAACG
1701 CGTGATGGAA GGTGTTGAGA CCGAAATCAG CGGCGCGATG ACACCGAAAT
1751 GGCAAATCCA TGCAGGTTAC AGCTACCTGC ACAGCCAAAT CAAAACCGCC
1801 TCCAATTCGC GCGACGAAGG CATCTTCCTG CTGATGCCCA AACACAGCGC
1851 AAACCTGTGG ACGACTTACC AAGTTACGTC CGGGCTGACC ATCGGCGGCG
1901 GCGTGAACGC GATGAGCGGC ATTACTTCAT CTGCAGGGAT ACATGCAGGC
1951 GGTTATGCCA CGTTCGATGC GATGGCGGCA TACCGCTTCA CGCCCAAACT
2001 GAAGCTGCAA ATCAACGCCG ACAACATCTT CAACCGCCAT TACTACGCCC
```

-continued

```
2051  GCGTCGGCAG CGAGAGCACC TTTAACATTC CCGGTTCGGA GCGCAGCCTG

2101  ACGGCAAACC TGCGTTACAG TTTTTAA
```

This corresponds to the amino acid sequence <SEQ ID 2606; ORF 760>:

```
m760.pep
   1 MGQFMSVFRI NMTAATVLAA LSSSVFAAQT EGLETVHIKG QRSYNAIATE

  51 KNGDYSSFAA TVGTKIPASL REIPQSVSII TNQQVKDRNV DTFDQLARKT

 101 PGLRVLSNDD GRSSVYARGY EYSEYNIDGL PAQMQSINGT LPNLFAFDRV

 151 EVMRGPSGLF DSSGEMGGIV NLVRKRPTKA FQGHAAAGFG THKQYKAEAD

 201 VSGSLNSDGS VRGRVMAQTV GASPRPAEKN NRRETFYAAA DWDINPDTVL

 251 GAGYLYQQRR LAPYNGLPAD ANNKLPSLPQ HVFVGADWNK FKMHSHDVFA

 301 DLKHYFGNGG YGKVGMRYSD RKADSNYTFA GSKLNNTGQA DVAGLGTDIK

 351 QKAFAVDASY SRPFALGNTA NEFVIGADYN RLRSTNEQGR STLSKSVALD

 401 GFRALPYNGI LQNARAGNKG FNHSVTEENL DETGLYAKTV FRPLEGLSLI

 451 AGGRVGHHKI ESGDGKTLHK ASKTKFTSYA GAVYDIDGSN SLYASASQLY

 501 TPQTSIGTDG KLLKPREGNQ FEIGYKGSYM DDRLNTRVSF YRMKDKNAAA

 551 PLDSNNKKTR YAALGKRVME GVETEISGAM TPKWQIHAGY SYLHSQIKTA

 601 SNSRDEGIFL LMPKHSANLW TTYQVTSGLT IGGGVNAMSG ITSSAGIHAG

 651 GYATFDAMAA YRFTPKLKLQ INADNIFNRH YYARVGSEST FNIPGSERSL

 701 TANLRYSF*
```

m760/g760 91.6% identity in 154 aa overlap

```
                   530       540       550       560       570       580
    m760.pep  YKGSYMDDRLNTRVSFYRMKDKNAAAPLDSNNKKTRYAALGKRVMEGVETEISGAMTPKW
                                                ||::||||||||||||||||||||:||||
    g760                                        NNRNTRYAALGKRVMEGVETEISGAITPKW
                                                        10        20        30

                   590       600       610       620       630       640
    m760.pep  QIHAGYSYLHSQIKTASNSRDEGIFLLMPKHSANLWTTYQVTSGLTIGGGVNAMSGITSS
              |||||||||||||||:| |||||||:|||||||||||||| |||:|||||||||||||
    g760      QIHAGYSYLHSQIKTAANPRDDGIFLLVPKHSANLWTTYQVTPGLTVGGGVNAMSGITSS
                      40        50        60        70        80        90

                   650       660       670       680       690       700
    m760.pep  AGIHAGGYATFDAMAAYRFTPKLKLQINADNIFNRHYYARVGSESTFNIPGSERSLTANL
              ||:||||||||||||||||||||||||||||||||||||||: :||||||||||||||
    g760      AGMHAGGYATFDAMAAYRFTPKLKLQINADNIFNRHYYARVGGTNTFNIPGSERSLTANL
                     100       110       120       130       140       150

                 709
    m760.pep  RYSFX
              |||||
    g760      RYSFX

    g761.seq not found yet
    g761.pep not found yet
```

The following partial DNA sequence was identified in *N. meningitidis* <SEQ ID 2607>:

```
m761.seq
    1  ATGAAAATAT CATTTCATTT AGCTTTATTA CCCACGCTGA TTATTGCTTC

   51  CTTCCCTGTT GCTGCCGCCG ATACGCAGGA CAATGGTGAA CATTACACCG

  101  CCACTCTGCC CACCGTTTCC GTGGTCGGAC AGTCCGACAC CAGCGTACTC
```

-continued

151 AAAGGCTACA TCAACTACGA CGAAGCCGCC GTTACCCGCA ACGGACAGCT

201 CATCAAAGAA ACGCCGCAAA CCATCGATAC GCTCAATATC CAGAAAAACA

251 AAAATTACGG TACGAACGAT TTGAGTTCCA TCCTCGAAGG CAATGCCGGC

301 ATCGACGCTG CCTACGATAT GCGCGGTGAA AGCATTTTCC TGCGCGGTTT

351 TCAAGCCGAC GCATCCGATA TTTACCGCGA CGGCGTGCGC GAAAGCGGAC

401 AAGTGCGCCG CAGTACTGCC AACATCGAGC GCGTGGAAAT CCTGAAAGGC

451 CCGTCTTCCG TGCTTTACGG CCGCACCAAC GGCGGCGGCG TCATCAACAT

501 GGTCAGCAAA TACGCCAACT TCAAACAAAG CCGCAACATC GGAGCGGTTT

551 ACGGCTCATG GGCAAACCGC AGCCTGAATA TGGACATTAA CGAAGTGCTG

601 AACAAAAACG TCGCCATCCG TCTCACCGGC GAAGTCGGGC GCGCCAATTC

651 GTTCCGCAGC GGCATAGACA GCAAAAATGT CATGGTTTCG CCCAGCATTA

701 CCGTCAAACT CGACAACGGC TTGAAGTGGA CGGGGCAATA CACCTACGAC

751 AATGTGGAGC GCACGCCCGA CCGCAGTCCG ACCAAGTCCG TGTACGACCG

801 CTTCGGACTG CCTTACCGCA TGGGGTTCGC CCACCGGAAC GATTTTGTCA

851 AAGACAAGCT GCAAGTTTGG CGTTCCGACC TTGAATACGC CTTCAACGAC

901 AAATGGCGTG CCCAATGGCA GCTCGCCCAC CGCACGGCGG CGCAGGATTT

951 TGATCATTTC TATGCAGGCA GCGAAAATGG CAACTTAATC AAACGTAACT

1001 ACGCCTGGCA GCAGACCGAC AACAAAACCC TGTCGTCCAA CTTAACGCTC

1051 AACGGCGACT ACACCATCGG CCGTTTTGAA AACCACCTGA CCGTAGGCAT

1101 GGATTACAGC CGCGAACACC GCAACCCGAC ATTGGGTTTC AGCAGCGCCT

1151 TTTCCGCCTC CATCAACCCC TACGACCGCG CAAGCTGGCC GGCTTCGGGC

1201 AGATTGCAGC CTATTCTGAC CCAAAACCGC CACAAAGCCG ACTCCTACGG

1251 CATCTTTGTG CAAAACATCT TCTCCGCCAC GCCCGATTTG AAATTCGTCC

1301 TCGGCGGCCG TTACGACAAA TACACCTTTA ATTCCGAAAA CAAACTCACC

1351 GGCAGCAGCC GCCAATACAG CGGACACTCG TTCAGCCCCA ACATCGGCGC

1401 AGTGTGGAAC ATCAATCCCG TCCACACACT TTACGCCTCG TATAACAAAG

1451 GCTTCGCGCC TTATGGCGGA CGCGGCGGCT ATTTGAGCAT CGATACGTTG

1501 TCTTCCGCCG TGTTCAACGC CGACCCCGAG TACACCCGCC AATACGAAAC

1551 CGGCGTGAAA AGCAGTTGGC TGGACGACCG CCTCAGCACT ACGTTGTCTG

1601 CCTACCAAAT CGAACGCTTC AATATCCGCT ACCGCCCCGA TCCAAAAAAC

1651 AACCCTTATA TTTATGCGGT TAGCGGCAAA CACCGTTCGC GCGGCGTGGA

1701 ATTGTCCGCC ATCGGGCAAA TCATCCCCAA AAAACTCTAT CTGCGCGGTT

1751 CGTTGGGCGT GATGCAGGCG AAAGTCGTTG AAGACAAAGA AAATCCCGAC

1801 CGAGTGGGCA TCCATTTGAA TAATACCAGC AACGTTACCG GCAACCTGTT

1851 TTTCCGTTAT ACCCCGACCG AAAACCTCTA CGGCGAAATC GGCGTAACCG

1901 GTACAGGCAA ACGCTACGGT TACAACTCAA GAAATAAAGA AGTGACTACG

1951 CTTCCAGGCT TTGCCCGAGT TGATGCCATG CTTGGCTGGA ACCATAAAAA

2001 TGTTAACGTT ACCTTTGCCG CAGCCAATCT GCTCAATCAA AAATATTGGC

2051 GTTCGGACTC TATGCCGGGT AATCCGCGCG GCTATACTGC CCGGGTAAAT

2101 TACCGTTTCT GA

This corresponds to the amino acid sequence <SEQ ID 2608; ORF 761>:

```
m761.pep
   1 MKISFHLALL PTLIIASFPV AAADTQDNGE HYTATLPTVS VVGQSDTSVL

  51 KGYINYDEAA VTRNGQLIKE TPQTIDTLNI QKNKNYGTND LSSILEGNAG

 101 IDAAYDMRGE SIFLRGFQAD ASDIYRDGVR ESGQVRRSTA NIERVEILKG

 151 PSSVLYGRTN GGGVINMVSK YANFKQSRNI GAVYGSWANR SLNMDINEVL

 201 NKNVAIRLTG EVGRANSFRS GIDSKNVMVS PSITVKLDNG LKWTGQYTYD

 251 NVERTPDRSP TKSVYDRFGL PYRMGFAHRN DFVKDKLQVW RSDLEYAFND

 301 KWRAQWQLAH RTAAQDFDHF YAGSENGNLI KRNYAWQQTD NKTLSSNLTL

 351 NGDYTIGRFE NHLTVGMDYS REHRNPTLGF SSAFSASINP YDRASWPASG

 401 RLQPILTQNR HKADSYGIFV QNIFSATPDL KFVLGGRYDK YTFNSENKLT

 451 GSSRQYSGHS FSPNIGAVWN INPVHTLYAS YNKGFAPYGG RGGYLSIDTL

 501 SSAVFNADPE YTRQYETGVK SSWLDDRLST TLSAYQIERF NIRYRPDPKN

 551 NPYIYAVSGK HRSRGVELSA IGQIIPKKLY LRGSLGVMQA KVVEDKENPD

 601 RVGIHLNNTS NVTGNLFFRY TPTENLYGEI GVTGTGKRYG YNSRNKEVTT

 651 LPGFARVDAM LGWNHKNVNV TFAAANLLNQ KYWRSDSMPG NPRGYTARVN

 701 YRF*
```

The following partial DNA sequence was identified in *N. meningitidis* <SEQ ID 2609>:

```
a761.seq
   1  ATGAAAATAT CATTTCATTT AGCTTTATTA CCCACGCTGA TTATTGCTTC

  51  CTTCCCTGTT GCTGCCGCCG ATACGCAGGA CAATGGTGAA CATTACACCG

 101  CCACTCTGCC CACCGTTTCC GTGGTCGGAC AGTCCGACAC CAGCGTACTC

 151  AAAGGCTACA TCAACTACGA CGAAGCCGCC GTTACCCGCA ACGGACAGCT

 201  CATCAAAGAA ACGCCGCAAA CCATCGATAC GCTCAATATC CAGAAAAACA

 251  AAAATTACGG CACGAACGAT TTGAGTTCCA TCCTCGAAGG CAATGCCGGC

 301  ATCGACGCCG CCTACGATAT GCGCGGCGAA AGCATTTTCC TGCGCGGCTT

 351  TCAAGCCGAC GCATCTGATA TTTACCGCGA CGGCGTACGC GAAAGCGGGC

 401  AGGTGCGCCG TAGCACCGCC AACATCGAGC GCGTGGAAAT CCTGAAAGGT

 451  CCGTCCTCCG TGCTTTATGG GCGTACCAAC GGCGGCGGTG TCATCAACAT

 501  GGTCAGCAAA TACGCCAACT TCAAACAAAG CCGTAATATC GGTACGGTTT

 551  ATGGTTCGTG GGCAAACCGC AGCCTGAATA TGGACATCAA CGAAGTGCTG

 601  AACAAAAACG TCGCCATCCG TCTCACCGGC GAAGTCGGGC GCGCCAATTC

 651  GTTCCGCAGC GGCATAGACA GCAAAAATGT CATGGTTTCG CCCAGCATTA

 701  CCGTCAAACT CGACAACGGC TTGAAGTGGA CGGGGCAATA CACCTACGAC

 751  AATGTGGAGC GCACGCCCGA CCGCAGTCCG ACCAAGTCCG TGTACGACCG

 801  CTTCGGACTG CCTTACCGCA TGGGGTTCGC CCACCGGAAC GATTTTGTCA

 851  AAGACAAGCT GCAAGTTTGG CGTTCCGACC TTGAATACGC CTTCAACGAC

 901  AAATGGCGTG CCCAATGGCA GCTCGCCCAC CGCACGGCGG CGCAGGATTT

 951  TGATCATTTC TATGCAGGCA GCGAAAATGG CAACTTAATC AAACGTAACT
```

-continued

```
1001 ACGCCTGGCA GCAGACCGAC AACAAAACCC TGTCGTCCAA CTTAACGCTC
1051 AACGGCGACT ACACCATCGG CCGTTTTGAA AACCACCTGA CCGTAGGCAT
1101 GGATTACAGC CGCGAACACC GCAACCCGAC ATTGGGTTTC AGCAGCGCCT
1151 TTTCCGCCTC CATCAACCCC TACGACCGCG CAAGCTGGCC GGCTTCGGGC
1201 AGATTGCAGC CTATTCTGAC CCAAAACCGC CACAAAGCCG ACTCCTACGG
1251 CATCTTTGTG CAAAACATCT TCTCCGCCAC GCCCGATTTG AAATTCGTCC
1301 TCGGCGGCCG TTACGACAAA TACACCTTTA ATTCCGAAAA CAAACTCACC
1351 GGCAGCAGCC GCCAATACAG CGGACACTCG TTCAGCCCCA ACATCGGCGC
1401 AGTGTGGAAC ATCAATCCCG TCCACACACT TTACGCCTCG TATAACAAAG
1451 GCTTCGCGCC TTATGGCGGA CGCGGCGGCT ATTTGAGCAT CGATACGTTG
1501 TCTTCCGCCG TGTTCAACGC CGACCCCGAG TACACCCGCC AATACGAAAC
1551 CGGCGTGAAA AGCAGTTGGC TGGACGACCG CCTCAGCACT ACGTTGTCTG
1601 CCTACCAAAT CGAACGCTTC AATATCCGCT ACCGCCCCGA TCCAAAAAAC
1651 AACCCTTATA TTTATGCGGT TAGCGGCAAA CACCGTTCGC GCGGCGTGGA
1701 ATTGTCCGCC ATCGGGCAAA TCATCCCCAA AAAACTCTAT CTGCGCGGTT
1751 CGTTGGGCGT GATGCAGGCG AAAGTCGTTG AAGACAAAGA AAATCCCGAC
1801 CGAGTGGGCA TCCATTTGAA TAACACCAGC AACGTTACCG GCAACCTGTT
1851 TTTCCGTTAT ACCCCGACCG AAAACCTCTA CGGCGAAATC GGCGTAACCG
1901 GTACAGGCAA ACGCTACGGT TACGACTCAA GAAATAAAGA AGTGACTACG
1951 CTTCCAGGCT TTGCCCGAGT TGATGCCATG CTTGGCTGGA ACCATAAAAA
2001 TGTTAACGTT ACCTTTGCCG CAGCCAATCT GTTCAATCAA AAATATTGGC
2051 GTTCGGACTC TATGCCGGGT AATCCGCGCG GCTATACTGC CCGGGTAAAT
2101 TACCGTTTCT GA
```

This corresponds to the amino acid sequence <SEQ ID 2610; ORF 761.a>:

```
a761.pep
   1 MKISFHLALL PTLIIASFPV AAADTQDNGE HYTATLPTVS VVGQSDTSVL
  51 KGYINYDEAA VTRNGQLIKE TPQTIDTLNI QKNKNYGTND LSSILEGNAG
 101 IDAAYDMRGE SIFLRGFQAD ASDIYRDGVR ESGQVRRSTA NIERVEILKG
 151 PSSVLYGRTN GGGVINMVSK YANFKQSRNI GTVYGSWANR SLNMDINEVL
 201 NKNVAIRLTG EVGRANSFRS GIDSKNVMVS PSITVKLDNG LKWTGQYTYD
 251 NVERTPDRSP TKSVYDRFGL PYRMGFAHRN DFVKDKLQVW RSDLEYAFND
 301 KWRAQWQLAH RTAAQDFDHF YAGSENGNLI KRNYAWQQTD NKTLSSNLTL
 351 NGDYTIGRFE NHLTVGMDYS REHRNPTLGF SSAFSASINP YDRASWPASG
 401 RLQPILTQNR HKADSYGIFV QNIFSATPDL KFVLGGRYDK YTFNSENKLT
 451 GSSRQYSGHS FSPNIGAVWN INPVHTLYAS YNKGFAPYGG RGGYLSIDTL
 501 SSAVFNADPE YTRQYETGVK SSWLDDRLST TLSAYQIERF NIRYRPDPKN
 551 NPYIYAVSGK HRSRGVELSA IGQIIPKKLY LRGSLGVMQA KVVEDKENPD
 601 RVGIHLNNTS NVTGNLFFRY TPTENLYGEI GVTGTGKRYG YDSRNKEVTT
 651 LPGFARVDAM LGWNHKNVNV TFAAANLFNQ KYWRSDSMPG NPRGYTARVN
```

-continued

```
701 YRF*
```

m761/a761 99.6% identity in 703 aa overlap

```
                       10        20        30        40        50        60
     m761.pep   MKISFHLALLPTLIIASFPVAAADTQDNGEHYTATLPTVSVVGQSDTSVLKGYINYDEAA
                |||||||||||||||| |||||||||||||||||||||||||||||||||||||||||||
     a761       MKISFHLALLPTLIIASFPVAAADTQDNGEHYTATLPTVSVVGQSDTSVLKGYINYDEAA
                       10        20        30        40        50        60

                       70        80        90       100       110       120
     m761.pep   VTRNGQLIKETPQTIDTLNIQKNKNYGTNDLSSILEGNAGIDAAYDMRGESIFLRGFQAD
                ||||||||||||||||||||||||||||||||||||||||||||||||||||||||||||
     a751       VTRNGQLIKETPQTIDTLNIQKNKNYGTNDLSSILEGNAGIDAAYDMRGESIFLRGFQAD
                       70        80        90       100       110       120

                      130       140       150       160       170       180
     m761.pep   ASKIYRDGVRESGQVRRSTANIERVEILKGPSSVLYGRTNGGGVINMVSKYANFKQSRNI
                ||||||||||||||||||||||||||||||||||||||||||||||||||||||||||||
     a761       ASKIYRDGVRESGQVRRSTANIERVEILKGPSSVLYGRTNGGGVINMVSKYANFKQSRNI
                      130       140       150       160       170       180

                      190       200       210       220       230       240
     m761.pep   GAVYGSWANRSLNMDINEVLNKNVAIRLTGEVGRANSFRSGIDSKNVMVSPSITVKLDNG
                |:||||||||||||||||||||||||||||||||||||||||||||||||||||||||||
     a761       GTVYGSWANRSLNMDINEVLNKNVAIRLTGEVGRANSFRSGIDSKNVMVSPSITVKLDNG
                      190       200       210       220       230       240

                      250       260       270       280       290       300
     m761.pep   LKWTGQYTYDNVERTPDRSPTKSVYDRFGLPYRMGFAHRNDFVKDKLQVWRSDLEYAFND
                ||||||||||||||||||||||||||||||||||||||||||||||||||||||||||||
     a761       LKWTGQYTYDNVERTPDRSPTKSVYDRFGLPYRMGFAHRNDFVKDKLQVWRSDLEYAFND
                      250       260       270       280       290       300

                      310       320       330       340       350       360
     m761.pep   KWRAQWQLAHRTAAQDFDHFYAGSENGNLIKRNYAWQQTDNKTLSSNLTLNGDYTIGRFE
                ||||||||||||||||||||||||||||||||||||||||||||||||||||||||||||
     a761       KWRAQWQLAHRTAAQDFDHFYAGSENGNLIKRNYAWQQTDNKTLSSNLTLNGDYTIGRFE
                      310       320       330       340       350       360

                      370       380       390       400       410       420
     m761.pep   NHLTVGMDYSREHRNPTLGFSSAFSASINPYDRASWPASGRLQPILTQNRHKADSYGIFV
                ||||||||||||||||||||||||||||||||||||||||||||||||||||||||||||
     a761       NHLTVGMDYSREHRNPTLGFSSAFSASINPYDRASWPASGRLQPILTQNRHKADSYGIFV
                      370       380       390       400       410       420

                      430       440       450       460       470       480
     m761.pep   QNIFSATPDLKFVLGGRYDKYTFNSENKLTGSSRQYSGHSFSPNIGAVWNINPVHTLYAS
                ||||||||||||||||||||||||||||||||||||||||||||||||||||||||||||
     a761       QNIFSATPDLKFVLGGRYDKYTFNSENKLTGSSRQYSGHSFSPNIGAVWNINPVHTLYAS
                      430       440       450       460       470       480

                      430       440       450       460       470       480
     m761.pep   QNIFSATPDLKFVLGGRYDKYTFNSENKLTGSSRQYSGHSFSPNIGAVWNINPVHTLYAS
                ||||||||||||||||||||||||||||||||||||||||||||||||||||||||||||
     a761       QNIFSATPDLKFVLGGRYDKYTFNSENKLTGSSRQYSGHSFSPNIGAVWNINPVHTLYAS
                      430       440       450       460       470       480

                      490       500       510       520       530       540
     m761.pep   YNKGFAPYGGRGGYLSIDTLSSAVFNADPEYTRQYETGVKSSWLDDRLSTTLSAYQIERF
                ||||||||||||||||||||||||||||||||||||||||||||||||||||||||||||
     a761       YNKGFAPYGGRGGYLSIDTLSSAVFNADPEYTRQYETGVKSSWLDDRLSTTLSAYQIERF
                      490       500       510       520       530       540

                      550       560       570       580       590       600
     m761.pep   NIRYRPDPKNNPYIYAVSGKHRSRGVELSAIGQIIPKKLYLRGSLGVMQAKVVEDKENPD
                ||||||||||||||||||||||||||||||||||||||||||||||||||||||||||||
     a761       NIRYRPDPKNNPYIYAVSGKHRSRGVELSAIGQIIPKKLYLRGSLGVMQAKVVEDKENPD
                      550       560       570       580       590       600

                      610       620       630       640       650       660
     m761.pep   RVGIHLNNTSNVTGNLFFRYTPTENLYGEIGVTGTGKRYGYNSRNKEVTTLPGFARVDAM
                ||||||||||||||||||||||||||||||||||||||||||||||||||||||||||||
     a761       RVGIHLNNTSNVTGNLFFRYTPTENLYGEIGVTGTGKRYGYDSRNKEVTTLPGFARVDAM
                      610       620       630       640       650       660

                      670       680       690       700
     m761.pep   LGWNHKNVNVTFAAANLLNQKYWRSDSMPGNPRGYTARVNYRFX
                ||||||||||||||||:|||||||||||||||||||||||||||
     a761       LGWNHKNVNVTFAAANLFNQKYWRSDSMPGNPRGYTARVNYRFX
                      670       680       690       700

     g762.seq   Not yet found

     g762.pep   Not yet found
```

The following partial DNA sequence was identified in *N. meningitidis* <SEQ ID 2611>:

```
m762.seq
    1 ATGAAGTGGT TATTAAATAT GATAATGAGA CCTATTAAAT TTAGTATGGT

   51 AAATACGTTA TTATTTATTG TTATATGTAG TTCATTTTTT GATCTGCTCG

  101 TTCAATTATG TACAATTTTA TTTCATAGCC AAAAAATATA CTTTATTACA

  151 TTATTTTTAT TATTTATTTT TAATTTTGTT ACAAAATCTA TCTATATGGC

  201 AATTATTTAT CCTATTTTAT ATTTTTTTAC GATAAAAAAA TATTATCCTT

  251 ACTCTAGGAA AGTGATAATT CTATTATCAT TAGCATTATC TATATATTTT

  301 AGTTTTATGG ACTTTTACTT TTTTTCCATA TATTCAGATA ACCTTAGCTA

  351 TGAAACGGAG CCTTTACATT TATACATCCC TATTATTATT AATTTTTTCT

  401 CACTTTTAGT TTCTAATTTT ATTTTATCTT TTATCAACAA GTAA
```

This corresponds to the amino acid sequence <SEQ ID 2612; ORF 762>:

```
m762.pep
    1 MKWLLNMIMR PIKFSMVNTL LFIVICSSFF DLLVQLCTIL FHSQKIYFIT

   51 LFLLFIFNFV TKSIYMAIIY PILYFFTIKK YYPYSRKVII LLSLALSIYF

  101 SFMDFYFFSI YSDNLSYETE PLHLYIPIII NFFSLLVSNF ILSFINK*
```

The following partial DNA sequence was identified in *N. meningitidis* <SEQ ID 2613>:

```
a762.seq
    1 ATGAAGTGGT TATTAAATAT GATAATGAGA CCTATTAAAT TTAGTATGGT

   51 AAATACGTTA TTATTTATTG TTATATGTAG TTCATTTTTT GATCTGCTCG

  101 TTCAATTATG TACAATTTTA TTTCATAGCC AAAAAATATA CTTTATTACA

  151 TTATTTTTAT TATTTATTTT TAATTTTGTT ACAAAATCTA TCTATATGGC

  201 AATTATTTAT CCTATTTTAT ATTTTTTTAC GATAAAAAAA TATTATCCTT

  251 ACTCTAGGAA AGTGATAATT CTATTATCAT TAGCATTATC TATATATTTT

  301 AGTTTTATGG ACTTTTACTT TTTTTCCATA TATTCAGATA ACCTTAGCTA

  351 TGAAACGGAG CCTTTACATT TATACATCCC TATTATTATT AATTTTTTCT

  401 CACTTTTAGT TTCTAATTTT ATTTTATCTT TTATCAACAA
      GTAA
```

This corresponds to the amino acid sequence <SEQ ID 2614; ORF 762.a>:

```
a762.pep
    1 MKWLLNMIMR PIKFSMVNTL LFIVICSSFF DLLVQLCTIL FHSQKIYFIT

   51 LFLLFIFNFV TKSIYMAIIY PILYFFTIKK YYPYSRKVII LLSLALSIYF

  101 SFMDFYFFSI YSDNLSYETE PLHLYIPIII NFFSLLVSNF ILSFINK*
```

m762/a762 100.0% identity in 147 aa overlap

```
                     10        20        30        40        50        60
m762.pep     MKWLLNMIMPRIKFSMVNTLLFIVICSSFFDLLVQLCTILFHSQKIYFITLFLLFIFNFV
             |||||||||||||||| ||||||||||||||||||||||||||||||||||||||||||||
a762         MKWLLNMIMPRIKFSMVNTLLFIVICSSFFDLLVQLCTILFHSQKIYFITLFLLFIFNFV
                     10        20        30        40        50        60
```

-continued

```
                  70        80        90       100       110       120
m762.pep    TKSIYMAIIYPILYFFTIKKYYPYSRKVIILLSLALSIYFSFMDFYFFSIYSDNLSYETE
            ||||||||||||||||||||||||||||||||||||||||||||||||||||||||||||
a762        TKSIYMAIIYPILYFFTIKKYYPYSRKVIILLSLALSIYFSFMDFYFFSIYSDNLSYETE
                  70        80        90       100       110       120

                 130       140
m762.pep    PLHLYIPIIINFFSLLVSNFILSFINKX
            ||||||||||||||||||||||||||||
a762        PLHLYIPIIINFFSLLVSNFILSFINKX
                 130       140

g763.seq    not yet found

g763.pep    not yet found
```

The following partial DNA sequence was identified in *N. meningitidis* <SEQ ID 2615>:

```
m763.seq
   1  ATGACATTGC TCAATCTAAT GATAATGCAA GATTACGGTA TTTCCGTTTG

  51  CCTGACACTG ACGCCCTATT TGCAACATGA ACTATTTTCG GCTATGAAAT

 101  CCTATTTTTC CAAATATATC CTACCCGTTT CACTTTTTAC CTTGCCACTA

 151  TCCCTTTCCC CATCCGTTTC GGCTTTTACG CTGCCTGAAG CATGGCGGGC

 201  GGCGCAGCAA CATTCGGCTG ATTTTCAAGC GTCCCATTAC CAGCGTGATG

 251  CAGTGCGCGC ACGGCAACAA CAAGCCAAGG CCGCATTCCT TCCCCATGTA

 301  TCCGCCAATG CCAGCTACCA GCGCCAGCCG CCATCGATTT CTTCCACCCG

 351  CGAAACACAG GGATGGAGCG TGCAGGTGGG ACAAACCTTA TTTGACGCTG

 401  CCAAATTTGC ACAATACCGC CAAAGCAGGT TCGATACGCA GGCTGCAGAA

 451  CAGCGTTTCG ATGCGGCACG CGAAGAATTG CTGTTGAAAG TTGCCGAAAG

 501  TTATTTCAAC GTTTTACTCA GCCGAGACAC CGTTGCCGCC CATGCGGCGG

 551  AAAAAGAGGC TTATGCCCAG CAGGTAAGGC AGGCGCAGGC TTTATTCAAT

 601  AAAGGTGCTG CCACCGCGCT GGATATTCAC GAAGCCAAAG CCGGTTACGA

 651  CAATGCCCTG GCCCAAGAAA TCGCCGTATT GGCTGAGAAA CAAACCTATG

 701  AAAACCAGTT GAACGACTAC ACCGACCTGG ATAGCAAACA AATCGAGGCC

 751  ATAGATACCG CCAACCTGTT GGCACGCTAT CTGCCCAAGC TGGAACGTTA

 801  CAGTCTGGAT GAATGGCAGC GCATTGCCTT ATCCAACAAT CATGAATACC

 851  GGATGCAGCA GCTTGCCCTG CAAAGCAGCG GACAGGCGCT TCGGGCAGCA

 901  CAGAACAGCC GCTATCCCAC CGTTTCTGCC CATGTCGGCT ATCAGAATAA

 951  CCTCTACACT TCATCTGCGC AGAATAATGA CTACCACTAT CGGGGCAAAG

1001  GGATGAGCGT CGGCGTACAG TTGAATTTGC CGCTTTATAC CGGCGGAGAA

1051  TTGTCGGGCA AAATCCATGA AGCCGAAGCG CAATACGGGG CCGCCGAAGC

1101  ACAGCTGACC GCAACCGAGC GGCACATCAA ACTCGCCGTA CGCCAGGCTT

1151  ATACCGAAAG CGGTGCGGCG CGTTACCAAA TCATGGCGCA AGAACGGGTT

1201  TTGGAAAGCA GCCGTTTGAA ACTGAAATCG ACCGAAACCG GCCAACAATA

1251  CGGCATCCGC AACCGGCTGG AAGTAATACG GGCGCGGCAG GAAGTCGCCC

1301  AAGCAGAACA GAAACTGGCT CAAGCACGGT ATAAATTCAT GCTGGCTTAT

1351  TTGCGCTTGG TGAAAGAGAG CGGGTTAGGG TTGGAAACGG TATTTGCGGA

1401  ATAA
```

This corresponds to the amino acid sequence <SEQ ID 2616; ORF 763>:

```
m763.pep
  1 MTLLNLMIMQ DYGISVCLTL TPYLQHELFS AMKSYFSKYI LPVSLFTLPL

 51 SLSPSVSAFT LPEAWRAAQQ HSADFQASHY QRDAVRARQQ QAKAAFLPHV

101 SANASYQRQP PSISSTRETQ GWSVQVGQTL FDAAKFAQYR QSRFDTQAAE

151 QRFDAAREEL LLKVAESYFN VLLSRDTVAA HAAEKEAYAQ QVRQAQALFN

201 KGAATALDIH EAKAGYDNAL AQEIAVLAEK QTYENQLNDY TDLDSKQIEA

251 IDTANLLARY LPKLERYSLD EWQRIALSNN HEYRMQQLAL QSSGQALRAA

301 QNSRYPTVSA HVGYQNNLYT SSAQNNDYHY RGKGMSVGVQ LNLPLYTGGE

351 LSGKIHEAEA QYGAAEAQLT ATERHIKLAV RQAYTESGAA RYQIMAQERV

401 LESSRLKLKS TETGQQYGIR NRLEVIRARQ EVAQAEQKLA QARYKFMLAY

451 LRLVKESGLG LETVFAE*
```

The following partial DNA sequence was identified in *N. meningitidis* <SEQ ID 2617>:

```
a763.seq
   1 ATGACATTGC TCAATCTAAT GATAATGCAA GATTACGGTA TTTCCGTTTG

  51 CCTGACACTG ACGCCCTATT TGCAACATGA ACTATTTTCG GCTATGAAAT

 101 CCTATTTTTC CAAATATATC CTACCCGTTT CACTTTTTAC CTTGCCACTA

 151 TCCCTTTCCC CATCCGTTTC GGCTTTTACG CTGCCTGAAG CATGGCGGGC

 201 GGCGCAGCAA CATTCGGCTG ATTTTCAAGC GTCCCATTAC CAGCGTGATG

 251 CAGTGCGCGC ACGGCAACAA CAAGCCAAGG CCGCATTCCT TCCCCATGTA

 301 TCCGCCAATG CCAGCTACCA GCGCCAGCCG CCATCGATTT CTTCCACCCG

 351 CGAAACACAG GGATGGAGCG TGCAGGTGGG ACAAACCTTA TTTGACGCTG

 401 CCAAATTTGC ACAATACCGC CAAAGCAGGT TCGATACGCA GGCTGCAGAA

 451 CAGCGTTTCG ATGCGGCACG CGAAGAATTG CTGTTGAAAG TTGCCGAAAG

 501 TTATTTCAAC GTTTTACTCA GCCGAGACAC CGTTGCCGCC CATGCGGCGG

 551 AAAAAGAGGC TTATGCCCAG CAGGTAAGGC AGGCGCAGGC TTTATTCAAT

 601 AAAGGTGCTG CCACCGCGCT GGATATTCAC GAAGCCAAAG CCGGTTACGA

 651 CAATGCCCTG GCCCAAGAAA TCGCCGTATT GGCTGAGAAA CAAACCTATG

 701 AAAACCAGTT GAACGACTAC ACCGGCCTGG ACAGCAAACA AATCGAGGCC

 751 ATAGATACCG CCAACCTGTT GGCACGCTAT CTGCCGAAGC TGGAACGTTA

 801 CAGTCTGGAT GAATGGCAGC GCATTGCCTT ATCCAACAAT CATGAATACC

 851 GGATGCAGCA GCTTGCCCTG CAAAGCAGCG GACAGGCGCT TCGGGCAGCA

 901 CAGAACAGCC GCTATCCCAC CGTTTCTGCC CATGTCGGCT ATCAGAATAA

 951 CCTCTACACT TCATCTGCGC AGAATAATGA CTACCACTAT CGGGGCAAAG

1001 GGATGAGCGT CGGCGTACAG TTGAATTTGC CGCTTTATAC CGGCGGAGAA

1051 TTGTCGGGCA AAATCCATGA AGCCGAAGCG CAATACGGGG CTGCCGAAGC

1101 ACAGCTGACC GCAACCGAGC GGCACATCAA ACTCGCCGTA CGCCAGGCTT

1151 ATACCGAAAG CGGTGCGGCG CGTTACCAAA TCATGGCGCA AGAACGGGTT

1201 TTGGAAAGCA GCCGTTTGAA ACTGAAATCG ACCGAAACCG GCCAACAATA
```

-continued

```
1251 CGGCATCCGC AACCGGCTGG AAGTAATACG GGCGCGGCAG GAAGTCGCCC

1301 AAGCAGAACA GAAACTGGCT CAAGCACGGT ATAAATTCAT GCTGGCTTAT

1351 TTGCGCTTGG TGAAAGAGAG CGGGTTAGGG TTGGAAACGG TATTTGCGGA

1401 ATAA
```

This corresponds to the amino acid sequence <SEQ ID 2618; ORF 763.a>:

```
a763.pep
  1 MTLLNLMIMQ DYGISVCLTL TPYLQHELFS AMKSYFSKYI LPVSLFTLPL

 51 SLSPSVSAFT LPEAWRAAQQ HSADFQASHY QRDAVRARQQ QAKAAFLPHV

101 SANASYQRQP PSISSTRETQ GWSVQVGQTL FDAAKFAQYR QSRFDTQAAE

151 QRFDAAREEL LLKVAESYFN VLLSRDTVAA HAAEKEAYAQ QVRQAQALFN

201 KGAATALDIH EAKAGYDNAL AQEIAVLAEK QTYENQLNDY TGLDSKQIEA

251 IDTANLLARY LPKLERYSLD EWQRIALSNN HEYRMQQLAL QSSGQALRAA

301 QNSRYPTVSA HVGYQNNLYT SSAQNNDYHY RGKGMSVGVQ LNLPLYTGGE

351 LSGKIHEAEA QYGAAEAQLT ATERHIKLAV RQAYTESGAA RYQIMAQERV

401 LESSRLKLKS TETGQQYGIR NRLEVIRARQ EVAQAEQKLA QARYKFMLAY

451 LRLVKESGLG LETVFAE*
```

m763/a763 99.8% identity in 467 aa overlap

```
                       10        20        30        40        50        60
m763.pep       MTLLNLMIMQDYGISVCLTLTPYLQHELFSAMKSYFSKYILPVSLFTLPLSLSPSVSAFT
               ||||||||||||||||||||||||||||||||||||||||||||||||||||||||||||
a763           MTLLNLMIMQDYGISVCLTLTPYLQHELFSAMKSYFSKYILPVSLFTLPLSLSPSVSAFT
                       10        20        30        40        50        60

                       70        80        90       100       110       120
m763.pep       LPEAWRAAQQHSADFQASHYQRDAVRARQQQAKAAFLPHVSANASYQRQPPSISSTRETQ
               ||||||||||||||||||||||||||||||||||||||||||||||||||||||||||||
a763           LPEAWRAAQQHSADFQASHYQRDAVRARQQQAKAAFLPHVSANASYQRQPPSISSTRETQ
                       70        80        90       100       110       120

                      130       140       150       160       170       180
m763.pep       GWSVQVGQTLFDAAKFAQYRQSRFDTQAAEQRFDAAREELLLKVAESYFNVLLSRDTVAA
               ||||||||||||||||||||||||||||||||||||||||||||||||||||||||||||
a763           GWSVQVGQTLFDAAKFAQYRQSRFDTQAAEQRFDAAREELLLKVAESYFNVLLSRDTVAA
                      130       140       150       160       170       180

                      190       200       210       220       230       240
m763.pep       HAAEKEAYAQQVRQAQALFNKGAATALDIHEAKAGYDNALAQEIAVLAEKQTYENQLNDY
               ||||||||||||||||||||||||||||||||||||||||||||||||||||||||||||
a763           HAAEKEAYAQQVRQAQALFNKGAATALDIHEAKAGYDNALAQEIAVLAEKQTYENQLNDY
                      190       200       210       220       230       240

                      250       260       270       280       290       300
m763.pep       TDLDSKQIEAIDTANLLARYLPKLERYSLDEWQRIALSNNHEYRMQQLALQSSGQALRAA
               | ||||||||||||||||||||||||||||||||||||||||||||||||||||||||||
a763           TGLDSKQIEAIDTANLLARYLPKLERYSLDEWQRIALSNNHEYRMQQLALQSSGQALRAA
                      250       260       270       280       290       300

                      310       320       330       340       350       360
m763.pep       QNSRYPTVSAHVGYQNNLYTSSAQNNDYHYRGKGMSVGVQLNLPLYTGGELSGKIHEAEA
               ||||||||||||||||||||||||||||||||||||||||||||||||||||||||||||
a763           QNSRYPTVSAHVGYQNNLYTSSAQNNDYHYRGKGMSVGVQLNLPLYTGGELSGKIHEAEA
                      310       320       330       340       350       360

                      370       380       390       400       410       420
m763.pep       QYGAAEAQLTATERHIKLAVRQAYTESGAARYQIMAQERVLESSRLKLKSTETGQQYGIR
               ||||||||||||||||||||||||||||||||||||||||||||||||||||||||||||
a763           QYGAAEAQLTATERHIKLAVRQAYTESGAARYQIMAQERVLESSRLKLKSTETGQQYGIR
                      370       380       390       400       410       420

                      430       440       450       460
m763.pep       NRLEVIRARQEVAQAEQKLAQARYKFMLAYLRLVKESGLGLETVFAEX
               |||||||||||||||||||||||||||||||||||||||||||||||
a763           NRLEVIRARQEVAQAEQKLAQARYKFMLAYLRLVKESGLGLETVFAEX
                      430       440       450       460
```

-continued

```
g764.seq    not found yet

g764.pep    not found yet
```

The following partial DNA sequence was identified in *N. meningitidis* <SEQ ID 2619>:

```
m764.seq
   1  ATGTTTTTCT CCGCCCTGAA ATCCTTTCTT TCTCGATACA TTACTGTATG
  51  GCGCAATGTT TGGGCGGTGC GCGACCAGTT GAAACCGCCC AAACGCACGG
 101  CGGAAGAACA GGCGTTTTTG CCCGCGCATT TGGAACTGAC CGATACGCCG
 151  GTCTCTGCCG CTCCGAAATG GGCGGCGCGT TTTATTATGG CGTTTGCGCT
 201  TTTGGCTTTG TTGTGGTCCT GGTTCGGCAA AATCGATATT GTGGCGGCGG
 251  CTTCGGGCAA AACGGTGTCG GGCGGGCGCA GCAAAACCAT CCAGCCGCTG
 301  GAAACGGCGG TGGTTAAGGC GGTACATGTG CGCGACGGGC AGCATGTGAA
 351  ACAGGGAGAA ACGCTGGCGG AACTGGAGGC TGTGGGAACA GACAGCGATG
 401  TGGTGCAGTC GGAGCAGGCT TTGCAGGCTG CCCAATTGTC CAAACTGCGT
 451  TATGAAGCGG TATTGGCGGC ATTGGAAAGC CGTACCGTGC CGCATATCGA
 501  TATGGCGCAA GCACGGTCTT TAGGTCTCTC CGATGCCGAT GTGCAATCGG
 551  CGCAGGTGTT GGCGCAGCAC CAGTATCAGG CATGGGCGGC GCAGGATGCG
 601  CAATTGCAGT CGGCTTTGCG CGGCCATCAG GCGGAATTGC AGTCGGCCAA
 651  GGCGCAGGAG CAGAAGCTGG TTTCGGTGGG GGCGATCGAG CAGCAGAAAA
 701  CAGCAGACTA CCGCCGTTTG CGGGCCGACA ATTTTATTTC GGAACATGCG
 751  TTTTTGGAGC AGCAGAGCAA ATCGGTCAGC AATTGGAACG ATTTGGAAAG
 801  TACGCGCGGT CAGATGAGGC AGATTCAGGC GGCCATTGCA CAGGCGGAGC
 851  AGAATCGGGT GCTGAATACG CAGAACCTGA AACGCGATAC GCTGGATGCG
 901  CTGCGCCAGG CAAACGAACA GATTGACCAA TACCGCGGCC AAACGGATAA
 951  GGCAAAGCAG CGGCAGCAGC TGATGACAAT ACAGTCGCCT GCGGACGGCA
1001  CGGTGCAGGA ATTGGCTACC TATACGGTGG GCGGTGTGGT GCAGGCTGCC
1051  CAAAAAATGA TGGTGATTGC GCCCGATGAC GACAAAATGG ACGTGGAAGT
1101  TTTGGTATTG AACAAAGACA TCGGTTTTGT GGAACAGGGA CAGGATGCGG
1151  TGGTGAAGAT TGAGAGCTTT CCCTATACGC GCTACGGTTA TCTGACGGGC
1201  AAGGTGAAAA GTGTCAGCCA TGATGCGGTA AGCCACGAAC AGTTGGGCTT
1251  GGTTTATACG GCGGTGGTGT CGCTGGACAA ACATACCTTG AATATTGACG
1301  GCAAAGCAGT GAATCTGACG GCGGGCATGA ATGTCACGGC GGAGATTAAA
1351  ACGGGTAAAC GGCGGGTGCT GGATTATCTG TTAAGCCCGC TGCAAACCAA
1401  ATTGGACGAA AGCTTTAGGG AGCGATAG
```

This corresponds to the amino acid sequence <SEQ ID 2620; ORF 764>:

```
m764.pep
  1  MFFSALKSFL SRYITVWRNV WAVRDQLKPP KRTAEEQAFL PAHLELTDTP
 51  VSAAPKWAAR FIMAFALLAL LWSWFGKIDI VAAASGKTVS GGRSKTIQPL
101  ETAVVKAVHV RDGQHVKQGE TLAELEAVGT DSDVVQSEQA LQAAQLSKLR
```

-continued

```
151 YEAVLAALES RTVPHIDMAQ ARSLGLSDAD VQSAQVLAQH QYQAWAAQDA

201 QLQSALRGHQ AELQSAKAQE QKLVSVGAIE QQKTADYRRL RADNFISEHA

251 FLEQQSKSVS NWNDLESTRG QMRQIQAAIA QAEQNRVLNT QNLKRDTLDA

301 LRQANEQIDQ YRGQTDKAKQ RQQLMTIQSP ADGTVQELAT YTVGGVVQAA

351 QKMMVIAPDD DKMDVEVLVL NKDIGFVEQG QDAVVKIESF PYTRYGYLTG

401 KVKSVSHDAV SHEQLGLVYT AVVSLDKHTL NIDGKAVNLT AGMNVTAEIK

451 TGKRRVLDYL LSPLQTKLDE SFRER*
```

The following partial DNA sequence was identified in *N. meningitidis* <SEQ ID 2621>:

```
a764.seq (partial)
   1 ATGTTTTTCT CCGCCCTGAA ATCCTTTCTT TCCCGCTACA TTACCGTATG

  51 GCGCAATGTT TGGGCGGTGC GCGACCAGTT GGAACCGCCC AAACGCACGG

 101 CGGAAGAACA GGCGTTTTTG CCCGCGCATT TGGAACTGAC CGATACGCCG

 151 GTCTCTGCCG CTCCGAAATG GGCGGCGCGT TTTATTATGG CGTTTGCGCT

 201 TTTGGCTTTG TTGTGGTCCT GGTTCGGCAA AATCGATATT GTGGCGGCGG

 251 CTTCGGGCAA AACGGTGTCG GGCGGGCGCA GCAAAACCAT CCAGCCGCTG

 301 GAAACGGTGG TGGTTAAGGC GGTACATGTG CGCGACGGGC AGCATGTGAA

 351 ACAGGGAGAA ACGCTGGCGG AACTGGAGGC TGTGGGAACA GACAGCGATG

 401 TGGTGCAGTC GGAGCAGGCT TTGCAGGCTG CCCAATTGTC CAAACTGCGT

 451 TATGAAGCGG TATTGGCGGC ATTGGAAAGC CGTACCGTGC CGCATATCGA

 501 TATGGCGCAA GCACGGTCTT TAGGTCTCTC CGATGCCGAT GTGCAATCGG

 551 CGCAGGTGTT GGCGCAGCAC CAGTATCAGG CATGGGCGGC GCAGGATGCG

 601 CAATTGCAGT CGGCTTTGCG CGGCCATCAG GCGGAATTGC AGTCGGCCAA

 651 GGCGCAGGAG CAGAAGCTGG TTTCGGTGGG GGCGATCGAG CAGCAGAAAA

 701 CAGCAGACTA CCGCCGTTTG CGGGCCGACA ATTTTATTTC GGAACATGCG

 751 TTTTTGGAGC AGCAGAGCAA ATCGGTCAGC AATTGGAACG ATTTGGAAAG

 801 TACGCGCGGT CAGATGAGGC AGATTCAGGC GGCCATTGCA CAGGCGGAGC

 851 AGAATCGGGT GCTGAATACG CAGAACCTGA AACGCGATAC GCTGGATGCG

 901 CTGCGCCAGG CAAACGAACA GATTGACCAA TACCGCGGCC AAACGGATAA

 951 GGCAAAGCAG CGGCAGCAGC TGATGACAAT ACAGTCGCCT GCGGACGGCA

1001 CGGTGCAGGA ATTGGCCACC TATACGGTGG GCGGTGTGGT GCAGGCTGCC

1051 CAAAAAATGA TGGTGGTTGC GCCCGATGAC GACAAAATGG ACGTGGAAGT

1101 TTTGGTATTG AACAAAGACA TCGGTTTTGT GGAACAGGGA CAGGATGCGG

1151 TGGTGAAGAT TGAGAGTTTT CCCTATACGC GCTACGGTTA TCTGACGGGC

1201 AAGGTGAAAA GTGTCAGCCA TGATGCGGTA AGCCACGAAC AGTTGGGCTT

1251 GGTTTATACG GCGGTGGTGT CGCTGGACAA ACATACCTTG AATATTGACG

1301 GCAAA
```

This corresponds to the amino acid sequence <SEQ ID 2622; ORF 764.a>.

```
a764.pep (partial)
   1 MFFSALKSFL SRYITVWRNV WAVRDQLEPP KRTAEEQAFL PAHLELTDTP

  51 VSAAPKWAAR FIMAFALLAL LWSWFGKIDI VAAASGKTVS GGRSKTIQPL

 101 ETVVVKAVHV RDGQHVKQGE TLAELEAVGT DSDVVQSEQA LQAAQLSKLR

 151 YEAVLAALES RTVPHIDMAQ ARSLGLSDAD VQSAQVLAQH QYQAWAAQDA

 201 QLQSALRGHQ AELQSAKAQE QKLVSVGAIE QQKTADYRRL RADNFISEHA

 251 FLEQQSKSVS NWNDLESTRG QMRQIQAAIA QAEQNRVLNT QNLKRDTLDA

 301 LRQANEQIDQ YRGQTDKAKQ RQQLMTIQSP ADGTVQELAT YTVGGVVQAA

 351 QKMMVVAPDD DKMDVEVLVL NKDIGFVEQG QDAVVKIESF PYTRYGYLTG

 401 KVKSVSHDAV SHEQLGLVYT AVVSLDKHTL NIDGK
```

m764/a764 99.3% identity in 435 aa overlap

```
                       10        20        30        40        50        60
m764.pep    MFFSALKSFLSRYITVWRNVWAVRDQLKPPKRTAEEQAFLPAHLELTDTPVSAAPKWAAR
            |||||||||||||||||||||||||||:||||||||||||||||||||||||||||||||
a764        MFFSALKSFLSRYITVWRNVWAVRDQLEPPKRTAEEQAFLPAHLELTDTPVSAAPKWAAR
                       10        20        30        40        50        60

                       70        80        90       100       110       120
m764.pep    FIMAFALLALLWSWFGKIDIVAAASGKTVSGGRSKTIQPLETAVVKAVHVRDGQHVKQGE
            ||||||||||||||||||||||||||||||||||||||||||| ||||||||||||||||
a764        FIMAFALLALLWSWFGKIDIVAAASGKTVSGGRSKTIQPLETVVVKAVHVRDGQHVKQGE
                       70        80        90       100       110       120

                      130       140       150       160       170       180
m764.pep    TLAELEAVGTDSDVVQSEQALQAAQLSKLRYEAVLAALESRTVPHIDMAQARSLGLSDAD
            ||||||||||||||||||||||||||||||||||||||||||||||||||||||||||||
a764        TLAELEAVGTDSDVVQSEQALQAAQLSKLRYEAVLAALESRTVPHIDMAQARSLGLSDAD
                      130       140       150       160       170       180

                      190       200       210       220       230       240
m764.pep    VQSAQVLAQHQYQAWAAQDAQLQSALRGHQAELQSAKAQEQKLVSVGAIEQQKTADYRRL
            |||||||||||||||||||||||||||||||||||||||||||||||| |||||||||||
a764        VQSAQVLAQHQYQAWAAQDAQLQSALRGHQAELQSAKAQEQKLVSVGATEQQKTADYRRL
                      190       200       210       220       230       240

                      250       260       270       280       290       300
m764.pep    RADNFISEHAFLEQQSKSVSNWNDLESTRGQMRQIQAAIAQAEQNRVLNTQNLKRDTLDA
            ||||||||||||||||||||||||||||||||||||||||||||||||||||||||||||
a764        RADNFISEHAFLEQQSKSVSNWNDLESTRGQMRQIQAAIAQAEQNRVLNTQNLKRDTLDA
                      250       260       270       280       290       300

                      310       320       330       340       350       360
m764.pep    LRQANEQIDQYRGQTDKAKQRQQLMTIQSPADGTVQELATYTVGGVVQAAQKMMVIAPDD
            ||||||||||||||||||||||||||||||||||||||||||||||||||||||| ||||
a764        LRQANEQIDQYRGQTDKAKQRQQLMTIQSPADGTVQELATYTVGGVVQAAQKMMVVAPDD
                      310       320       330       340       350       360

                      370       380       390       400       410       420
m764.pep    DKMDVEVLVLNKDIGFVEQGQDAVVKIESFPYTRYGYLTGKVKSVSHDAVSHEQLGLVYT
            ||||||||||||||||||||||||||||||||||||||||||||||||||||||||||||
a764        DKMDVEVLVLNKDIGFVEQGQDAVVKIESFPYTRYGYLTGKVKSVSHDAVSHEQLGLVYT
                      370       380       390       400       410       420

                      430       440       450       460       470
m764.pep    AVVSLDKHTLNIDGKAVNLTAGMNVTAEIKTGKRRVLDYLLSPLQTKLDESFRERX
            |||||||||||||||
a764        AVVSLDKHTLNIDGK
                      430

g765.seq    not yet found

g765.pep    not yet found
```

The following partial DNA sequence was identified in *N. meningitidis* <SEQ ID 2623>:

```
m765.seq
   1 ATGTTAAGAT GCCGTCCGAA ATCCGTTTTG GATTCAGACG GCATTTTTTT

  51 GAAATTTAAT TTTTTAAGGA GTAAACCTAA ATATGAAATT TCCTTCCTTC

 101 CTTCCTTTAA ACGGATACTC TGCCTGTCGG CAGTAATCTC GGTATTGGGG
```

-continued

```
151 GCTTGTGCGG TCGTTGCTGA TGTTTACGGT CATGATTCCG CCACAATGAA
201 CGCTGCGGCT GCCAAAGATT ATATGAAAAC GGTTGAGTTA AACAAGTCTG
251 CCGGCAATGT CGATACCACA TCCAGAACAG CCCGCAGGGT GCAGGCAGTA
301 TTTCGACGTA TGCTGCCTTA TGCCGATGCG GCAAATAATA CCAGCCATAA
351 GTTTGACTGG AAAATGACGG TTTTCAAAAA CGATGAGCTG AACGCGTGGG
401 CAATGCCCGG TGGAAAAATG GCGTTTTATA CGGGGATAGT CGACAAACTC
451 AAGCTGACCG ATGACGAAAT TGCCGCCATT ATGGGGCATG AAATGACGCA
501 CGCCCTGCAT GAACACGGTA AAAATAAGGT CGGGCAGCAA ATCTTGACCA
551 ATACGGCGGC GCAGATAGGC ACGCAGATTA TATTAGACAA AAAACCGGAT
601 ACTAATCCGG AATTGGTCGG ATTGGGTATG GATATTTTGG GGACGTACGG
651 TCTTACCTTG CCTTATAGCC GCAGCTTGGA AGAAGAAGCC GATGAGGGGG
701 GAATGATGTT GATGGCGCAG GCAGGCTATC ATCCGGCGGC CGCTGTCAGG
751 GTTTGGGAAA AAATGAATCA GGAAAACGAC CAAAACGGCT TTATTTATGC
801 TATTACCTCT ACTCATCCGA CAAACAATGC CCGTATAGAA AATCTAAAAC
851 GGTTGTTGCC GACCGTTATG CCGGTTTATG AGCAAAGTGT CAGAAATAAG
901 GGGCGCGTTA ATAAAAAACG TCGGCGTTAA
```

This corresponds to the amino acid sequence <SEQ ID 2624; ORF 765>:

```
m765.pep
  1 MLRCRPKSVL DSDGIFLKFN FLRSKPKYEI SFLPSFKRIL CLSAVISVLG
 51 ACAVVADVYG HDSATMNAAA AKDYMKTVEL NKSAGNVDTT SRTARRVQAV
101 FRRMLPYADA ANNTSHKFDW KMTVFKNDEL NAWAMPGGKM AFYTGIVDKL
151 KLTDDEIAAI MGHEMTHALH EHGKNKVGQQ ILTNTAAQIG TQIILDKKPD
201 TNPELVGLGM DILGTYGLTL PYSRSLEEEA DEGGMMLMAQ AGYHPAAAVR
251 VWEKMNQEND QNGFIYAITS THPTNNARIE NLKRLLPTVM PVYEQSVRNK
301 GRVNKKRRR*
```

The following partial DNA sequence was identified in *N. meningitidis* <SEQ ID 2625>:

```
a765.seq
  1 ATGTTAAGAT GCCGTCCGAA ATCCGTTTTG GATTCAGACG GCATTTTTTT
 51 GAAATTTAAT TTTTTAAGGA GTAAACCTAA ATATGAAATT TCCTTCCTTC
101 CTTCCTTTAA ACGGATACTC TGCCTGTCGG CAGTAATCTC GGTATTGGGG
151 GCTTGTACGG TCGTTGCTGA TGTTTACGGT CAGGATTCCG CCACAATGAA
201 TGCTGCGGCT GCCGAAGATT ATATGAAAAC GGTTGAGTTG AACAAGTCTG
251 CCGGCAATGT CGATACTACA TCCAAAACAG CCCGTAGGGT GCAGGCAGTA
301 TTTCGACGTA TGTTGCCTTA TGCCGATGCG GCAAATAATA CCGGCCATAA
351 GTTTGACTGG AAAATGACGG TTTTCAAAAA CGATGAGCTG AACGCGTGGG
401 CAATGCCCGG CGGGAAAATG GCGTTTTATA CGGGGATAGT CGATAAACTT
451 AAGCTGACCG ATGGCGAAAT TGCCGCCATT ATGGGGCATG AAATGACGCA
501 TGCCCTGCAT GAACACGGTA AAAATAAGGT CGGGCAGAAA ATCTTGACTA
```

-continued

```
551 ATATGGCGGC GCAGATAGGC ACGCAGATTA TATTAGACAA AAAACCGGAC

601 ACTAATCCGG AATTGGTCGG ATTGGGTATG GATATTTTGG GGATGTACGG

651 CATTACCTTG CCTTATAGCC GCAGCTTGGA AGAAGAAGCC GATGAGGGGG

701 GAATGATGTT GATGGCGCAG GCAGGCTATC ATCCGGCAGC CGCTGTCAGG

751 GTTTGGGAAA AAATGAATCA GGAAAACGAC CAAAACGGCT TTATTTATGC

801 TATTACCTCT ACTCATCCGA CAAACAATGC CCGTATAGAA AATCTAAAAC

851 GGTTGTTGCC GACCGTTATG CCGGTTTATG AGCACAGTGT TAGAAATAAG

901 GGGCGCGTTA ATAAAAACCG TCGGCGTTAA
```

This corresponds to the amino acid sequence <SEQ ID 2626; ORF 765.a>:

```
a765.pep
   1 MLRCRPKSVL DSDGIFLKFN FLRSKPKYEI SFLPSFKRIL CLSAVISVLG

  51 ACTVVADVYG QDSATMNAAA AEDYMKTVEL NKSAGNVDTT SKTARRVQAV

 101 FRRMLPYADA ANNTGHKFDW KMTVFKNDEL NAWAMPGGKM AFYTGIVDKL

 151 KLTDGEIAAI MGHEMTHALH EHGKNKVGQK ILTNMAAQIG TQIILDKKPD

 201 TNPELVGLGM DILGMYGITL PYSRSLEEEA DEGGMMLMAQ AGYHPAAAVR

 251 VWEKMNQEND QNGFIYAITS THPTNNARIE NLKRLLPTVM PVYEHSVRNK

 301 GRVNKNRRR*
```

Computer analysis of this amino acid sequence gave the following results:

Homology with a Predicted ORF from *N. meningitidis* ORF 765 shows 96.18% identity over a 309 aa overlap with a predicted ORF (ORF 765) from *N. meningitidis*:

```
m765/a765  96.1% identity in 309 aa overlap

                    10        20        30        40        50        60
m765.pep   MLRCRPKSVLDSDGIFLKFNFLRSKPKYEISFLPSFKRILCLSAVISVLGACAVVADVYG
           ||||||||||||||||||||||||||||||||||||||||||||||||||||:|||||||
a765       MLRCRPKSVLDSDGIFLKFNFLRSKPKYEISFLPSFKRILCLSAVISVLGACTVVADVYG
                    10        20        30        40        50        60

                    70        80        90       100       110       120
m765.pep   HDSATMNAAAAKDYMKTVELNKSAGNVDTTSRTARRVQAVFRRMLPYADAANNTSHKFDW
           :||||||||||:|||||||||||||||||||:||||||||||||||||||||||:|||||
a765       QDSATMNAAAAEDYMKTVELNKSAGNVDTTSKTARRVQAVFRRMLPYADAANNTGHKFDW
                    70        80        90       100       110       120

                   130       140       150       160       170       180
m765.pep   KMTVFKNDELNAWAMPGGKMAFYTGIVDKLKLTDDEIAAIMGHEMTHALHEHGKNKVGQQ
           |||||||||||||||||||||||||||||||||| ||||||||||||||||||||||||:
a765       KMTVFKNDELNAWAMPGGKMAFYTGIVDKLKLTDGEIAAIMGHEMTHALHEHGKNKVGQK
                   130       140       150       160       170       180

                   190       200       210       220       230       240
m765.pep   ILTNTAAQIGTQIILDKKPDTNPELVGLGMDILGTYGLTLPYSRSLEEEADEGGMMLMAQ
           |||| |||||||||||||||||||||||||||||| ||:|||||||||||||||||||||
a765       ILTNMAAQIGTQIILDKKPDTNPELVGLGMDILGMYGITLPYSRSLEEEADEGGMMLMAQ
                   190       200       210       220       230       240

                   250       260       270       280       290       300
m765.pep   AGYHPAAAVRVWEKMNQENDQNGFIYAITSTHPTNNARIENLKRLLPTVMPVYEQSVRNK
           ||||||||||||||||||||||||||||||||||||||||||||||||||||||:|||||
a765       AGYHPAAAVPVWEKMNQENDQNGFIYAITSTHPTNNARIENLKRLLPTVMPVYEHSVRNK
                   250       260       270       280       290       300

                   310
m765.pep   GRVNKKRRRX
           |||||:||||
a765       GRVNKNRRRX
                   310
```

The following partial DNA sequence was identified in *N. gonorrhoeae* <SEQ ID 2627>:

```
g767.seq
   1 ATGAAGTTTA AACATCTGTT GCCGCTGCTG CTGTCGGCAG TGTTGTCCGC

  51 GCAGGCATAT GCCCTGACGG AAGGGGAAGA CTATCTTGTG TTGGATAAAC

 101 CCATTCCTCA AGAACAGCCG GGAAAAATTG AGGTTTTGGA ATTTTTCGGC

 151 TATTTTTGCG TACATTGCCA TCATTTCGAT CCTTTGTTAT TGAAACTGGG

 201 CAAGGCATTG CCGTCTGATA CTTATCTGCG GACGGAGCAC GTGGTCTGGC

 251 GGCCTGAAAT GCTCGGTCTG GCAAGAATGG CTGCTGCGGT CAAGCTGTCG

 301 GGTTTGAAAT ATCAGGCAAA CTCTGCTGTG TTTAAAGCAG TTTACGAACA

 351 AAAAATCCGT TTGGAAAACA GGGCTGTTGC CGGGAAATGG GCTTTATCTC

 401 AAAAAGGTTT TGACGGCAAA AAACTGATGC GCGCCTATGA TTCCCCCGAA

 451 GCTGCCGCCG TCGCATTAAA AATGCAGAAA CTGACGGAAC AATACGGTAT

 501 TGACAGCACG CCGACCGTTA TTGTCGGCGG AAAATACCGC GTTATCTTCA

 551 ATAATGGCTT TGATGGCGGC GTTCATACGA TTAAAGAATT GGTTGCCAAA

 601 GTCAGGGAAG AACGCAAGCG TCAGACCCCT GCTGTACAGA AATAG
```

This corresponds to the amino acid sequence <SEQ ID 2628; ORF 767.ng>:

```
g767.pep
   1 MKFKHLLPLL LSAVLSAQAY ALTEGEDYLV LDKPIPQEQP GKIEVLEFFG

  51 YFCVHCHHFD PLLLKLGKAL PSDTYLRTEH VVWRPEMLGL ARMAAAVKLS

 101 GLKYQANSAV FKAVYEQKIR LENRAVAGKW ALSQKGFDGK KLMRAYDSPE

 151 AAAVALKMQK LTEQYGIDST PTVIVGGKYR VIFNNGFDGG VHTIKELVAK

 201 VREERKRQTP AVQK*
```

The following partial DNA sequence was identified in *N. meningitidis* <SEQ ID 2629>:

```
m767.seq
   1 ATGAAGCTCA AACATCTGTT GCCGCTGCTG CTGTCGGCAG TGTTGTCCGC

  51 GCAGGCATAT GCCCTGACGG AAGGGGAAGA CTATCTTGTG TTGGATAAAC

 101 CCATTCCTCA AGAACAGTCG GGTAAAATTG AGGTTTTGGA ATTTTTCGGC

 151 TATTTCTGCG TACATTGCCA TCATTTCGAT CCTTTGTTAT TGAAACTGGG

 201 CAAGGCATTG CCGTCTGATG CCTATTTGAG GACGGAGCAC GTGGTCTGGC

 251 AGCCTGAAAT GCTCGGTTTG GCTAGGATGG CGGCTGCCGT CAATTTGTCG

 301 GGTTTGAAAT ATCAGGCAAA CCCTGCTGTG TTTAAAGCAG TTTACGAACA

 351 AAAAATCCGC TTGGAAAACA GGTCGGTTGC CGGAAAATGG GCTTTGTCTC

 401 AAAAAGGCTT TGACGGCAAA AAACTGATGC GCGCCTATGA TTCCCCCGAA

 451 GCTGCCGCCG CCGCATTAAA AATGCAGAAA CTGACGGAAC AATACCGCAT

 501 CGACAGCACG CCGACCGTTA TTGTCGGCGG AAAATACCGC GTTATCTTCA

 551 ATAACGGCTT TGACGGCGGC GTTCATACGA TTAAAGAATT GGTTGCCAAA

 601 GTCAGGGAAG AACGCAAGCG TCAGACCCCT GCTGTACAGA AATAG
```

This corresponds to the amino acid sequence <SEQ ID 2630; ORF 767>:

```
m767.pep
    1 MKLKHLLPLL LSAVLSAQAY ALTEGEDYLV LDKPIPQEQS GKIEVLEFFG

   51 YFCVHCHHFD PLLLKLGKAL PSDAYLRTEH VVWQPEMLGL ARMAAAVNLS

  101 GLKYQANPAV FKAVYEQKIR LENRSVAGKW ALSQKGFDGK KLMRAYDSPE

  151 AAAAALKMQK LTEQYRIDST PTVIVGGKYR VIFNNGFDGG VHTIKELVAK

  201 VREERKRQTP AVQK*
```

Computer analysis of this amino acid sequence gave the following results:

Homology with a Predicted ORF from *N. gonorrhoeae*

ORF 767 shows 95.8% identity over a 214 aa overlap with a predicted ORF (ORF 767) from *N. gonorrhoeae*

```
m767/g767   95.8% identity in 214 aa overlap

                     10        20        30        40        50        60
g767.pep    MKFKHLLPLLLSAVLSAQAYALTEGEDYLVLDKPIPQEQPGKIEVLEFFGYFCVHCHHFD
            ||:|||||||||||||||||||||||||||||||||||| ||||||||||||||||||||
m767        MKLKHLLPLLLSAVLSAQAYALTEGEDYLVLDKPIPQEQSGKIEVLEFFGYFCVHCHHFD
                     10        20        30        40        50        60

                     70        80        90       100       110       120
g767.pep    PLLLKLGKALPSDTYLRTEHVVWRPEMLGLARMAAAVKLSGLKYQANSAVFKAVYEQKIR
            |||||||||||||:|||||||||:|||||||||||||:||||||||| ||||||||||||
m767        PLLLKLGKALPSDAYLRTEHVVWQPEMLGLARMAAAVNLSGLKYQANPAVFDAVYEQKIR
                     70        80        90       100       110       120

                    130       140       150       160       170       180
g767.pep    LENRAVAGKWALSQKGFDGKKLMRAYDSPEAAAVALKMQKLTEQYGIDSTPTVIVGGKYR
            ||||:||||||||||||||||||||||||||||:||||||||||| ||||||||||||||
m767        LENRSVAGKWALSQKGFDGKKLMRAYDSPEAAAAALKMQKLTEQYRIDSTPTVIVGGKYR
                    130       140       150       160       170       180

                    190       200       210
g767.pep    VIFNNGFDGGVHTIKELVAKVREERKRQTPAVQKX
            |||||||||||||||||||||||||||||||||||
m767        VIFNNGFDGGVHTIKELVAKVREERKRQTPAVQKX
                    190       200       210
```

The following partial DNA sequence was identified in *N. meningitidis* <SEQ ID 2631>:

```
a767.seq
    1 ATGAAGCTCA AACATCTGTT GCCGCTGCTG CTGTCGGCAG TGTTGTCCGC

   51 GCAGGCATAT GCCCTGACGG AAGGGGAAGA CTATCTTGTG TTGGATAAAC

  101 CCATTCCTCA AAAACAGTCG GGCAAAATTG AGGTTTTGGA ATTTTTCGGC

  151 TATTTCTGCG TACATTGCCA TCATTTCGAT CCTTTGTTAT TGAAATTGGG

  201 CAAGGCATTG CCGTCTGATG CCTATTTAAG GACGGAGCAC GTGGTCTGGC

  251 AGCCTGAAAT GCTCGGTCTG GCAAGAATGG CTGCTGCGGT CAAGCTGTCA

  301 GGTTTGAAAT ATCAGGCAAA CCCTGCCGTG TTTAAAGCAG TTTACGAACA

  351 AAAAATCCGC TTGGAAAACA GGTCGGTTGC CGAAAAATGG GCTTTGTCTC

  401 AAAAAGGCTT TGACGGCAAA AAACTGATGC GCGCCTACGA CTCTCCTGCG

  451 GCAGCGGCTG CTGCATCAAA AATGCAGCAA TTGACGGAAC AGTACCGCAT

  501 CGACAGTACG CCGACCGTTG TCGTCGGCGG AAAATACCGC GTTATCTTCA

  551 ATAATGGCTT TGACGGCGGT GTTCATACGA TTAAAGAATT GGTTGCCAAA

  601 GTCAGGGAAG AACGCAAGCG TCAGACCCCT GCTGTACAGA AATAG
```

This corresponds to the amino acid sequence <SEQ ID 2632; ORF 767.a>:

```
a767.pep
   1 MKLKHLLPLL LSAVLSAQAY ALTEGEDYLV LDKPIPQKQS GKIEVLEFFG

  51 YFCVHCHHFD PLLLKLGKAL PSDAYLRTEH VVWQPEMLGL ARMAAAVKLS

 101 GLKYQANPAV FKAVYEQKIR LENRSVAEKW ALSQKGFDGK KLMRAYDSPA

 151 AAAAASKMQQ LTEQYRIDST PTVVVGGKYR VIFNNGFDGG VHTIKELVAK

 201 VREERKRQTP AVQK*
```

Computer analysis of this amino acid sequence gave the following results:

Homology with a Predicted ORF from *N. meningitidis*

ORF 767 shows 96.7% identity over a 214 aa overlap with a predicted ORF (ORF 767) from *N. meningitidis*:

```
m767/a767  96.7% identity in 214 aa overlap

                   10        20        30        40        50        60
a767.pep   MKLKHLLPLLLSAVLSAQAYALTEGEDYLVLDKPIPQKQSGKIEVLEFFGYFCVHCHHFD
           |||||||||||||||||||||||||||||||||||||:||||||||||||||||||||||
m767       MKLKHLLPLLLSAVLSAQAYALTEGEDYLVLDKPIPQEQSGKIEVLEFFGYFCVHCHHFD
                   10        20        30        40        50        60

                   70        80        90       100       110       120
a767.pep   PLLLKLGKALPSDAYLRTEHVVWQPEMLGLARMAAAVKLSGLKYQANPAVFKAVYEQKIR
           |||||||||||||||||||||||||||||||||||||:||||||||||||||||||||||
m767       PLLLKLGKALPSDAYLRTEHVVWQPEMLGLARMAAAVNLSGLKYQANPAVFKAVYEQKIR
                   70        80        90       100       110       120

                  130       140       150       160       170       180
a767.pep   LENRSVAEKWALSQKGFDGKKLMRAYDSPAAAAAASKMQQLTEQYRIDSTPTVVVGGKYR
           ||||||| ||||||||||||||||||||| ||||| |||:|||||||||||||:||||||
m767       LENRSVAGKWALSQKGFDGKKLMRAYDSPEAAAAALKMQKLTEQYRIDSTPTVIVGGKYR
                  130       140       150       160       170       180

                  190       200       210
a767.pep   VIFNNGFDGGVHTIKELVAKVREERKRQTPAVQKX
           |||||||||||||||||||||||||||||||||||
m767       VIFNNGFDGGVHTIKELVAKVREERKRQTPAVQKX
                  190       200       210
```

The following partial DNA sequence was identified in *N. gonorrhoeae* <SEQ ID 2633>:

```
g768.seq
   1 ATGAATATCA AACAATTGAT TACCGCCGCA CTCATTGCCT CAGCCGCCTT

  51 TGCCACGCAG GCAGCCCCGC AAAAACCCGT ATCCGCCGCC CAAACCGCGC

 101 AACATTCAGC CGTTTGGATC GATGTCCGTT CCGAACAGGA ATTTAGCGAA

 151 GGTCATTTGC ACAACGCGGT CAACATCCCC GTCGACCAAA TCGTCCGCCG

 201 CATATACGAA GCCGCGCCCG ACAAAGACAC GCCGGTCAAC CTCTACTGCC

 251 GCAGCGGACG GCGTGCCGAA GCCGCCCTTC AAGAGCTGAA AAAAGCAGGT

 301 TATACAAATG TTGCCAATCA CGGCGGTTAT GAAGACCTGC TCAAAAAAGG

 351 GATGAAATGA
```

This corresponds to the amino acid sequence <SEQ ID 2634; ORF 768.ng>:

```
g768.pep
   1 MNIKQLITAA LIASAAFATQ AAPQKPVSAA QTAQHSAVWI DVRSEQEFSE

  51 GHLHNAVNIP VDQIVRRIYE AAPDKDTPVN LYCRSGRRAE AALQELKKAG

 101 YTNVANHGGY EDLLKKGMK*
```

The following partial DNA sequence was identified in *N. meningitidis* <SEQ ID 2635>:

```
m768.seq
   1 ATGAATATCA AACACCTGAT TACCGCCGCA CTCATTGCCT CAGCCGCCTT

  51 TGCCGCGCAG GCAGCCCCGC AAAAACCCGT ATCCGCCGCC CAAACCGCGC

 101 AACATCCGGC CGTTTGGATC GATGTCCGTT CCGAACAGGA ATTTAGCGAA

 151 GGGCATTTGC ACAACGCGGT CAACATCCCC GTCGACCAAA TCGTCCGCCG

 201 CATACACGAA GCCGCGCCCG ACAAAGACAC GCCGGTCAAC CTCTACTGCC

 251 GCAGCGGACG GCGTGCCGAA GCCGCCCTTC AAGAGCTGAA AAAAGCAGGT

 301 TATACAAATG TTGCCAATCA CGGCGGTTAT GAAGACCTGC TCAAAAAAGG

 351 GATGAAATGA
```

This corresponds to the amino acid sequence <SEQ ID 2636; ORF 768>:

```
m768.pep
   1 MNIKHLITAA LIASAAFAAQ AAPQKPVSAA QTAQHPAVWI DVRSEQEFSE

  51 GHLHNAVNIP VDQIVRRIHE AAPDKDTPVN LYCRSGRRAE AALQELKKAG

 101 YTNVANHGGY EDLLKKGMK*
```

Computer analysis of this amino acid sequence gave the following results:

Homology with a Predicted ORF from *N. gonorrhoeae*

ORF 768 shows 96.6% identity over a 119 aa overlap with a predicted ORF (ORF 768) from *N. gonorrhoeae*

```
m768/g768  96.6% identity in 119 aa overlap

                   10        20        30        40        50        60
g768.pep  MNIKQLITAALIASAAFATQAAPQKPVSAAQTAQHSAVWIDVRSEQEFSEGHLHNAVNIP
          ||||:|||||||||||||:||||||||||||||||| |||||||||||||||||||||||
m768      MNIKHLITAALIASAAFAAQAAPQKPVSAAQTAQHPAVWIDVRSEQEFSEGHLHNAVNIP
                   10        20        30        40        50        60

                   70        80        90       100       110       120
g768.pep  VDQIVRRIYEAAPDKDTPVNLYCRSGRRAEAALQELKKAGYTNVANHGGYEDLLKKGMKX
          ||||||||:|||||||||||||||||||||||||||||||||||||||||||||||||||
m768      VDQIVRRIHEAAPDKDTPVNLYCRSGRRAEAALQELKKAGYTNVANHGGYEDLLKKGMKX
                   70        80        90       100       110       120
```

The following partial DNA sequence was identified in *N. meningitidis* <SEQ ID 2637>:

```
a768.seq
   1 ATGAATATCA AACACCTGAT TACCGCCGCA CTCATTGCCT CAGCCGCCTT

  51 TGCCGCGCAG GCAGCCCCGC AAAAACCCGT ATCCGCCGCC CAAACCGCGC

 101 AACATTCAGC CGTTTGGATC GATGTCCGCA GCGAACAGGA ATTTAGCGAA

 151 GGTCATTTGC ACAACGCGGT CAACATCCCC GTCGACCAAA TCGTCCGCCG

 201 CATACACGAA GCCGCGCCCG ACAAAGACAC GCCGGTCAAC CTCTACTGCC

 251 GCAGCGGACG GCGTGCCGAA GCCGCCCTTC AAGAACTGAA AAAAGCAGGC

 301 TATACGAATG TTGCCAATCA CGGCGGTTAT GAAGACCTGC TCAAAAAAGG

 351 GATGAAATGA
```

This corresponds to the amino acid sequence <SEQ ID 2638; ORF 768.a>:

```
a768.pep
```

-continued

```
  1 MNIKHLITAA LIASAAFAAQ AAPQKPVSAA QTAQHSAVWI DVRSEQEFSE

 51 GHLHNAVNIP VDQIVRRIHE AAPDKDTPVN LYCRSGRRAE AALQELKKAG

101 YTNVANHGGY EDLLKKGMK*
```

Computer analysis of this amino acid sequence gave the following results:

Homology with a Predicted ORF from *N. meningitidis* ORF 768 shows 99.2% identity over a 119 aa overlap with a predicted ORF (ORF 768) from *N. meningitidis*:

```
m768/a768  99.2% identity in 119 aa overlap

                   10        20        30        40        50        60
a768.pep   MNIKHLITAALIASAAFAAQAAPQKPVSAAQTAQHSAVWIDVRSEQEFSEGHLHNAVNIP
           |||||||||||||||||||||||||||||||||||| |||||||||||||||||||||||
m768       MNIKHLITAALIASAAFAAQAAPQKPVSAAQTAQHPAVWIDVRSEQEFSEGHLHNAVNIP
                   10        20        30        40        50        60

                   70        80        90       100       110       120
a768.pep   VDQIVRRIHEAAPDKDTPVNLYCRSGRRAEAALQELKKAGYTNVANHGGYEDLLKKGMKX
           ||||||||||||||||||||||||||||||||||||||||||||||||||||||||||||
m768       VDQIVRRIHEAAPDKDTPVNLYCRSGRRAEAALQELKKAGYTNVANHGGYEDLLKKGMKX
                   70        80        90       100       110       120
```

The following partial DNA sequence was identified in *N. gonorrhoeae* <SEQ ID 2639>:

```
g769.seq
   1 TTGATAATGG TTATTTTTTA TTTTTATTTT TGTGGGAAGA CATTTATGCC

  51 TGCACGAAAC AGATGGATGC TGCTGCCTTT ATTGGCAAGC GCGGCATACG

 101 CCGAAgaAAC ACCgtgCGAA CCGGATTTGA GAAGCCGTCC CGAGTTCAGG

 151 CTTCATGAAG CGGAGGTCAA ACCGATCGAC AGGGAGAAGG TACCGGGGCA

 201 GGTGCGGGAA AAAGGAAAAG TTTTGCAGGT TGACGgcGAA ACCCTGCTGA

 251 AAAATCCCGA ATTGTTGTCG CGTGCCATGT ATTCCGCAGT GGTCTCAAAC

 301 AATATTGCCG GTATCCGCGT GATTTTGCCG ATTTACCTAC AACAGGCGCG

 351 GCAGGATAAG ATGTTGGCAC TTTATGCACA AGGGATTTTG GCGCAGGCAG

 401 AGGGCAGGGT GAAGGAGGCG GTTTCCCATT ACCGGGAATT GATTGCCGCC

 451 CAACCCGACG CGCCCGCCGT CCGTATGCGT TTGGCGGCGG CATTGTTTGA

 501 AGACAGGCAG AACGAGGCGG CGGCAGACCA GTTCGACCGC CTGAAAACAG

 551 AAGATCTGCC GCCGCAGCTT ATGGAGCAGG TCGAGCTGTA CCGCAAGGCA

 601 TTGCGCGAAC GCGATGCGTG GAAGGTAAAC GGCGGTTTCA GCGTTACCCG

 651 CGAACACAAT ATCAACCAAG CCCCGAAACA GCAGCAGTAC GGCAATTGGA

 701 CTTTCCCGAA ACAGGTGGAC GGCACGGCAG TCAATTACCG GTTCGGCGCG

 751 GAGAAAAAAT GGTCGCTGAA AAACGGCTGG TACACGACGG CGGGCGGCGA

 801 CGTGTCCGGC AGGGTTTATC CGGGGAATAA GAAATTCAAC GATATGACGG

 851 CAGGTGTTTC CGGCGGCATC GGTTTTGCCG ACCGGCGTAA AGATGTCGGG

 901 CTGGCAGTGT TCCACGAACG CCGCACCTAC GGCAACGACG CTTATTCTTA

 951 CGCCAACGGC GCACGCCTTT ATTTCAACCG TTGGCAAACC CCGAGATGGC

1001 AAACGCTGTC TTCGGCGGAG TGGGGGCGTT TGAAGAATAC GCGCCGGGCG

1051 CGTTCCGACA ATACCCATTT GCAAATTTCC AATTCGCTGG TGTTTTACCG

1101 GAATGCGCGC CAATATTGGA CGGGCGGTTT GGATTTTTAC CGCGAGCGCA
```

-continued

```
1151  ACCCCGCCGA CCGTGGCGAC AATTTCAACC GTTACGGCCT GCGCTTTGCC

1201  TGGGGGCAGG AATGGGGCGG CAGCGGCCTG TCTTCGCTGT TCCGCCTCGG

1251  CGTGGCGAAA CGGCATTATG AAAAACCCGG CTTCTTCAGC AGTTTTAAAG

1301  GGGAAAGGCG CAGGGATAAA GAATCGGACA CATCCTTGAG CCTTTGGCAC

1351  CGGGCATTGC ATTTCAAAGG CATCACGCCG CGCCTGACGC TGTCGCACCG

1401  CGAAACGTGG AGCAACGATG TGTTTAACGA ATACGAGAAA AACAGGGCGT

1451  TTGTCGAGTT TAACAAAACG TTCTGA
```

This corresponds to the amino acid sequence <SEQ ID 2640; ORF 769.ng>:

```
g769.pep
   1 LIMVIFYFYF CGKTFMPARN RWMLLPLLAS AAYAEETPCE PDLRSRPEFR

  51 LHEAEVKPID REKVPGQVRE KGKVLQVDGE TLLKNPELLS RAMYSAVVSN

 101 NIAGIRVILP IYLQQARQDK MLALYAQGIL AQAEGRVKEA VSHYRELIAA

 151 QPDAPAVRMR LAAALFEDRQ NEAAADQFDR LKTEDLPPQL MEQVELYRKA

 201 LRERDAWKVN GGFSVTREHN INQAPKQQQY GNWTFPKQVD GTAVNYRFGA

 251 EKKWSLKNGW YTTAGGDVSG RVYPGNKKFN DMTAGVSGGI GFADRRKDVG

 301 LAVFHERRTY GNDAYSYANG ARLYFNRWQT PRWQTLSSAE WGRLKNTRRA

 351 RSDNTHLQIS NSLVFYRNAR QYWTGGLDFY RERNPADRGD NFNRYGLRFA

 401 WGQEWGGSGL SSLFRLGVAK RHYEKPGFFS SFKGERRRDK ESDTSLSLWH

 451 RALHFKGITP RLTLSHRETW SNDVFNEYEK NRAFVEFNKT F*
```

The following partial DNA sequence was identified in *N. meningitidis* <SEQ ID 2641>:

```
m769.seq
   1  TTGATAATGG TTATTTTTTA TTTTTGTGGG AAGACATTTA TGCCTGCACG

  51  AAACAGATGG ATGCTGCTGC TGCCTTTATT GGCAAGCGCG GCATATGCCG

 101  AAGAAACACC GCGCGAACCG GATTTGAGAA GCCGTCCCGA GTTCAGGCTT

 151  CATGAAGCGG AGGTCAAACC GATCGACAGG GAGAAGGTGC CGGGGCAGGT

 201  GCGGGAAAAA GGAAAAGTTT TGCAGATTGA CGGCGAAACC CTGCTGAAAA

 251  ATCCCGAATT GTTGTCCCGC GCGATGTATT CCGCAGTGGT CTCAAACAAT

 301  ATTGCCGGTA TCCGCGTTAT TTTGCCGATT TACCTACAAC AGGCGCAGCA

 351  GGATAAGATG TTGGCACTTT ATGCACAAGG GATTTTGGCG CAGGCAGACG

 401  GTAGGGTGAA GGAGGCGATT TCCCATTACC GGGAATTGAT TGCCGCCCAA

 451  CCCGACGCGC CCGCCGTCCG TATGCGTTTG GCGGCAGCAT TGTTTGAAAA

 501  CAGGCAGAAC GAGGCGGCGG CAGACCAGTT CGACCGCCTG AAGGCGGAAA

 551  ACCTGCCGCC GCAGCTGATG GAGCAGGTCG AGCTGTACCG CAAGGCATTG

 601  CGCGAACGCG ATGCGTGGAA GGTAAATGGC GGCTTCAGCG TCACCCGCGA

 651  ACACAATATC AACCAAGCCC CGAAACGGCA GCAGTACGGC AAATGGACTT

 701  TCCCGAAACA GGTGGACGGC ACGGCGGTCA ATTACCGGCT CGGCGCGGAG

 751  AAAAAATGGT CGCTGAAAAA CGGCTGGTAC ACGACGGCGG GCGGCGACGT

 801  GTCCGGCAGG GTTTATCCGG GGAATAAGAA ATTCAACGAT ATGACGGCAG
```

-continued

```
 851 GCGTTTCCGG CGGCATCGGT TTTGCCGACC GGCGCAAAGA TGCCGGGCTG

 901 GCAGTGTTCC ACGAACGCCG CACCTACGGC AACGACGCTT ATTCTTACAC

 951 CAACGGCGCA CGCCTTTATT TCAACCGTTG GCAAACCCCG AAATGGCAAA

1001 CGTTGTCTTC GGCGGAGTGG GGGCGTTTGA AGAATACGCG CCGGGCGCGT

1051 TCCGACAATA CCCATTTGCA AATTTCCAAT TCGCTGGTGT TTTACCGGAA

1101 TGCGCGCCAA TATTGGATGG GCGGTTTGGA TTTTTACCGC GAGCGCAACC

1151 CCGCCGACCG GGGCGACAAT TTCAACCGTT ACGGCCTGCG CTTTGCCTGG

1201 GGGCAGGAAT GGGGCGGCAG CGGCCTGTCT TCGCTGTTGC GCCTCGGCGC

1251 GGCGAAACGG CATTATGAAA AACCCGGCTT TTTCAGCGGT TTTAAAGGGG

1301 AAAGGCGCAG GGATAAAGAA TTGAACACAT CCTTGAGCCT TTGGCACCGG

1351 GCATTGCATT TCAAAGGCAT CACGCCGCGC CTGACGTTGT CGCACCGCGA

1401 AACGCGGAGT AACGATGTGT TCAACGAATA CGAGAAAAAT CGGGCGTTTG

1451 TCGAGTTTAA TAAAACGTTC TGA
```

This corresponds to the amino acid sequence <SEQ ID 2642; ORF 769>:

```
m769.pep
  1 LIMVIFYFCG KTFMPARNRW MLLLPLLASA AYAEETPREP DLRSRPEFRL

 51 HEAEVKPIDR EKVPGQVREK GKVLQIDGET LLKNPELLSR AMYSAVVSNN

101 IAGIRVILPI YLQQAQQDKM LALYAQGILA QADGRVKEAI SHYRELIAAQ

151 PDAPAVRMRL AAALFENRQN EAAADQFDRL KAENLPPQLM EQVELYRKAL

201 RERDAWKVNG GFSVTREHNI NQAPKRQQYG KWTFPKQVDG TAVNYRLGAE

251 KKWSLKNGWY TTAGGDVSGR VYPGNKKFND MTAGVSGGIG FADRRKDAGL

301 AVFHERRTYG NDAYSYTNGA RLYFNRWQTP KWQTLSSAEW GRLKNTRRAR

351 SDNTHLQISN SLVFYRNARQ YWMGGLDFYR ERNPADRGDN FNRYGLRFAW

401 GQEWGGSGLS SLLRLGAAKR HYEKPGFFSG FKGERRRDKE LNTSLSLWHR

451 ALHFKGITPR LTLSHRETRS NDVFNEYEKN RAFVEFNKTF *
```

Computer analysis of this amino acid sequence gave the following results:

Homology with a Predicted ORF from *N. gonorrhoeae*

ORF 769 shows 95.1% identity over a 492 aa overlap with a predicted ORF (ORF 769) from *N. gonorrhoeae*

```
m769/g769   95.1% identity in 492 aa overlap

                      10        20        30        40        50        59
g769.pep    LIMVIFYFYFCGKTFMPARNRWMLL-PLLASAAYAEETPCEPDLRSRPEFRLHEAEVKPI
            |||||||  |||||||||||||||| ||||||||||||| ||||||||||||||||||||
m769        LIMVIFY--FCGKTFMPARNRWMLLLPLLASAAYAEETPREPDLRSRPEFRLHEAEVKPI
                        10        20        30        40        50

           60        70        80        90       100       110       119
g769.pep    DREKVPGQVREKGKVLQVDGETLLKNPELLSRAMYSAVVSNNIAGIRVILPIYLQQARQD
            ||||||||||||||||:||||||||||||||||||||||||||||||||||||||||:||
m769        DREKVPGQVREKGKVLQIDGETLLKNPELLSRAMYSAVVSNNIAGIRVILPIYLQQAQQD
           60        70        80        90       100       110

          120       130       140       150       160       170       179
g769.pep    KMLALYAQGILAQAEGRVKEAVSHYRELIAAQPDAPAVRMRLAAALFEDRQNEAAADQFD
            |||||||||||||:|||||:||||||||||||||||||||||||||||:|||||||||||
a769        KMLALYAQGILAQADGRVKEAISHYRELIAAQPDAPAVRMRLAAALFENRQNEAAADQFD
           120       130       140       150       160       170
```

-continued

```
                 180       190       200       210       220       230       239
g769.pep    RLKTEDLPPQLMEQVELYRKALRERDAWKVNGGFSVTREHNINQAPKQQQYGNWTFPKQV
            ||||||||||||||||||||||||||||||||||||||||||||||||||||||||||||
m769        RLKAENLPPQLMEQVELYRKALRERDAWKVNGGFSVTREHNINQAPKRQQYGKWTFPKQV
              180       190       200       210       220       230

            240       250       260       270       280       290       299
g769.pep    DGTAVNYRFGAEKKWSLKNGWYTTAGGDVSGRVYPGNKKFNDMTAGVSGGIGFADRRKDV
            ||||||||:||||||||||||||||||||||||||||||||||||||||||||||||||:
m769        DGTAVNYRLGAEKKWSLKNGWYTTAGGDVSGRVYPGNKKFNDMTAGVSGGIGFADRRKDA
            240       250       260       270       280       290

            300       310       320       330       340       350       359
g769.pep    GLAVFHERRTYGNDAYSYANGARLYFNRWQTPRWQTLSSAEWGRLKNTRRARSDNTHLQI
            ||||||||||||||||||:|||||||||||||:|||||||||||||||||||||||||||
m769        GLAVFHERRTYGNDAYSYTNGARLYFNRWQTPKWQTLSSAEWGRLKNTRRARSDNTHLQI
              300       310       320       330       340       350

            360       370       380       390       400       410       419
g769.pep    SNSLVFYRNARQYWTGGLDFYRERNPADRGDNFNRYGLRFAWGQEWGGSGLSSLFRLGVA
            |||||||||||||| |||||||||||||||||||||||||||||||||||||||:|||:|
m769        SNSLVFYRNARQYWMGGLDFYRERNPADRGDNFNRYGLRFAWGQEWGGSGLSSLLRLGAA
              360       370       380       390       400       410

            420       430       440       450       460       470       479
g769.pep    KRHYEKPGFFSSFKGERRRDKESDTSLSLWHRALHFKGITPRLTLSHRETWSNDVFNEYE
            |||||||||||:|||||||||| :|||||||||||||||||||||||||| |||||||||
m769        KRHYEKPGFFSGFKGERRRDKELNTSLSLWHRALHFKGITPRLTLSHRETRSNDVFNEYE
              420       430       440       450       460       470

            480       490
g769.pep    KNRAFVEFNKTFX
            |||||||||||||
m769        KNRAFVEFNKTFX
              490
```

The following partial DNA sequence was identified in *N. meningitidis* <SEQ ID 2643>:

```
a769.seq
     1  TTGATAATGG TTATTTTTTA TTTTTGTGGG AAGACATTTA TGCCTGCACG

    51  AAACAGATGG ATGCTGCTGC TGCCTTTATT GGCAAGCGCG GCATATGCCG

   101  AAGAAACACC GCGCGAACCG GATTTGAGAA GCCGTCCCGA GTTCAGGCTT

   151  CATGAAGCGG AGGTCAAACC AATCGACAGG GAGAAGGTAC CGGGGCAGGT

   201  GCGGGAAAAA GGAAAAGTTT TGCAGATTGA CGGCGAAACC CTGCTGAAAA

   251  ATCCCGAATT GCTGTCCCGC GCGATGTATT CCGCAGTGGT CTCAAACAAT

   301  ATTGCCGGTA TCCGCGTTAT TTTGCCGATT TACCTACAAC AGGCGCAGCA

   351  GGATAAGATG TTGGCACTTT ATGCACAAGG GATTTTGGCG CAGGCAGACG

   401  GTAGGGTGAA GGAGGCGATT TCCCATTACC GGGAATTGAT TGTCGCCCAA

   451  CCCGACGCGC CCGCCGTCCG TATGCGTTTG GCGGCGGCAT TGTTTGAAAA

   501  CAGGCAGAAC GAGGCGGCGG CAGACCAGTT CGACCGCCTG AAGGCGGAAA

   551  ACCTGCCGCC GCAGCTGATG GAGCAGGTCG AGCTGTACCG CAAGGCATTG

   601  CGCGAACGCG ATGCGTGGAA GGTAAATGGC GGCTTCAGCG TTACCCGCGA

   651  ACACAATATC AACCAAGCCC CGAAACGGCA GCAGTACGGC AAATGGACTT

   701  TCCCGAAACA GGTGGACGGC ACGGCGGTCA ATTACCGGCT CGGCGCGGAG

   751  AAAAAATGGT CGCTGAAAAA CGGCTGGTAC ACGACGGCGG GCGGCGACGT

   801  GTCCGGCAGG GTTTATCCGG GGAATAAGAA ATTCAACGAT ATGACGGCAG

   851  GCGTTTCCGG CGGCATCGGT TTTGCCGACC GGCGCAAAGA TGCCGGGCTG

   901  GCAGTGTTCC ACGAACGCCG CACCTACGGC AACGACGCTT ATTCTTACAC

   951  CAACGGCGCA CGCCTTTATT TCAACCGTTG GCAAACCCCG AAATGGCAAA

  1001  CGTTGTCTTC GGCGGAGTGG GGGCGTTTGA AGAATACGCG CCGGGCGCGT

  1051  TCCGACAATA CCCATTTGCA AATTTCCAAT TCGCTGGTGT TTTACCGGAA
```

-continued

```
1101  TGCGCGCCAA TATTGGATGG GCGGTTTGGA TTTTTACCGC GAGCGCAACC

1151  CCGCCGACCG GGGCGACAAT TTCAACCGTT ACGGCCTGCG CTTTGCCTGG

1201  GGGCAGGAAT GGGGCGGCAG CGGCCTGTCT TCGCTGTTGC GCCTCGGCGC

1251  GGCGAAACGG CATTATGAAA AACCCGGCTT TTTCAGCGGT TTTAAAGGGG

1301  AAAGGCGCAG GGATAAAGAA TTGAACACAT CCTTGAGCCT TTGGCACCGG

1351  GCATTGCATT TCAAAGGCAT CACGCCGCGC CTGACGTTGT CGCACCGCGA

1401  AACGCGGAGT AACGATGTGT TCAACGAATA CGAGAAAAAT CGGGCGTTTG

1451  TCGAGTTTAA TAAAACGTTC TGA
```

This corresponds to the amino acid sequence <SEQ ID 2644; ORF 769.a>:

```
a769.pep
   1  LIMVIFYFCG KTFMPARNRW MLLLPLLASA AYAEETPREP DLRSRPEFRL

  51  HEAEVKPIDR EKVPGQVREK GKVLQIDGET LLKNPELLSR AMYSAVVSNN

 101  IAGIRVILPI YLQQAQQDKM LALYAQGILA QADGRVKEAI SHYRELIVAQ

 151  PDAPAVRMRL AAALFENRQN EAAADQFDRL KAENLPPQLM EQVELYRKAL

 201  RERDAWKVNG GFSVTREHNI NQAPKRQQYG KWTFPKQVDG TAVNYRLGAE

 251  KKWSLKNGWY TTAGGDVSGR VYPGNKKFND MTAGVSGGIG FADRRKDAGL

 301  AVFHERRTYG NDAYSYTNGA RLYFNRWQTP KWQTLSSAEW GRLKNTRRAR

 351  SDNTHLQISN SLVFYRNARQ YWMGGLDFYR ERNPADRGDN FNRYGLRFAW

 401  GQEWGGSGLS SLLRLGAAKR HYEKPGFFSG FKGERRRDKE LNTSLSLWHR

 451  ALHFKGITPR LTLSHRETRS NDVFNEYEKN RAFVEFNKTF *
```

Computer analysis of this amino acid sequence gave the following results:

Homology with a Predicted ORF from *N. meningitidis*

ORF 769 shows 99.8% identity over a 490 aa overlap with a predicted ORF (ORF 769) from *N. meningitidis*:

```
a769/a769   99.8% identity in 490 aa overlap

                     10        20        30        40        50        60
a769.pep    LIMVIFYFCGKTFMPARNRWMLLLPLLASAAYAEETPREPDLRSRPEFRLHEAEVKPIDR
            ||||||||||||||||||||||||||||||||||||||||||||||||||||||||||||
m769        LIMVIFYFCGKTFMPARNRWMLLLPLLASAAYAEETPREPDLRSRPEFRLHEAEVKPIDR
                     10        20        30        40        50        60

                     70        80        90       100       110       120
a769.pep    EKVPGQVREKGKVLQIDGETLLKNPELLSRAMYSAVVSNNIAGIRVILPIYLQQAQQDKM
            ||||||||||||||||||||||||||||||||||||||||||||||||||||||||||||
m769        EKVPGQVREKGKVLQIDGETLLKNPELLSRAMYSAVVSNNIAGIRVILPIYLQQAQQDKM
                     70        80        90       100       110       120

                    130       140       150       160       170       180
a769.pep    LALYAQGILAQADGRVKEAISHYRELIVAQPDAPAVRMRLAAALFENRQNEAAADQFDRL
            ||||||||||||||||||||||||||:|||||||||||||||||||||||||||||||||
m769        LALYAQGILAQADGRVKEAISHYRELIAAQPDAPAVRMRLAAALFENRQNEAAADQFDRL
                    130       140       150       160       170       180

                    190       200       210       220       230       240
a769.pep    KAENLPPQLMEQVELYRKALRERDAWKVNGGFSVTREHNINQAPKRQQYGKWTFPKQVDG
            ||||||||||||||||||||||||||||||||||||||||||||||||||||||||||||
m769        KAENLPPQLMEQVELYRKALRERDAWKVNGGFSVTREHNINQAPKRQQYGKWTFPKQVDG
                    190       200       210       220       230       240

                    250       260       270       280       290       300
a769.pep    TAVNYRLGAEKKWSLKNGWYTTAGGDVSGRVYPGNKKFNDMTAGVSGGIGFADRRKDAGL
            ||||||||||||||||||||||||||||||||||||||||||||||||||||||||||||
m769        TAVNYRLGAEKKWSLKNGWYTTAGGDVSGRVYPGNKKFNDMTAGVSGGIGFADRRKDAGL
                    250       260       270       280       290       300
```

-continued

```
                 310       320       330       340       350       360
a769.pep    AVFHERRTYGNDAYSYTNGARLYFNRWQTPKWQTLSSAEWGRLKNTRRARSDNTHLQISN
            ||||||||||||||||||||||||||||||||||||||||||||||||||||||||||||
m769        AVFHERRTYGNDAYSYTNGARLYFNRWQTPKWQTLSSAEWGRLKNTRRARSDNTHLQISN
                 310       320       330       340       350       360

                 370       380       390       400       410       420
a769.pep    SLVFYRNARQYWMGGLDFYRERNPADRGDNFNRYGLRFAWGQEWGGSGLSSLLRLGAAKR
            ||||||||||||||||||||||||||||||||||||||||||||||||||||||||||||
m769        SLVFYRNARQYWMGGLDFYRERNPADRGDNFNRYGLRFAWGQEWGGSGLSSLLRLGAAKR
                 370       380       390       400       410       420

                 430       440       450       460       470       480
a769.pep    HYEKPGFFSGFKGERRRDKELNTSLSLWHRALHFKGITPRLTLSHRETRSNDVFNEYEKN
            ||||||||||||||||||||||||||||||||||||||||||||||||||||||||||||
m769        HYEKPGFFSGFKGERRRDKELNTSLSLWHRALHFKGITPRLTLSHRETRSNDVFNEYEKN
                 430       440       450       460       470       480

                 490
a769.pep    RAFVEFNKTFX
            |||||||||||
m769        RAFVEFNKTFX
                 490
```

The following partial DNA sequence was identified in *N. gonorrhoeae* <SEQ ID 2645>:

```
g770.seq
  1 ATGAACAGAC TGCTACTGCT GTCTGCCGCC GTCCTGCCGA CTGCCTGCGG

 51 CAGCGGCGAA ACCGATAAAA TCGGACGGGC AAGTACCGTT TTCAACATGT

101 TGGGCAAAAA CGACCGTATC GAAGTGGAAG GATTCGACGA TCCCGACGTT

151 CAAGGGGTTG CCTGTTATAT TTCGTATGCA AAAAAAGGCG GCTTGAAGGA

201 AATGGTCAAT TTGGAAGAGG ACGCGTCCGA CGCATCGGTT TCGTGCGTTC

251 AGACGGCATC TTCGATTTCT TTTGACGAAA CCGCCGTGCG CAAACCGAAA

301 GAAGTTTTCA AGCGCGGTAC GGGCTTCGCG TTCAAGAGCC GGCAGATTGT

351 CCGTTATTAC GACCCCAAAC GCAAAGCCTT CGCCTATTTG GTTTACAGCG

401 ATAAAATCGT CCAAGGATCG CCGAAAAATT CCTTAAGCGC GGTTTCCTGT

451 TTCGGCAGCG GCATACCGCA AACCGACGGG GTGCAAGCCG ATACTTCCGG

501 CAAACTGCTT GCCGGCGCCT GCATTATTTC CAACCCGATA AAAAATCCCG

551 ACAAACGCTG A
```

This corresponds to the amino acid sequence <SEQ ID 2646; ORF 770.ng>:

```
g770.pep
  1 MNRLLLLSAA VLPTACGSGE TDKIGRASTV FNMLGKNDRI EVEGFDDPDV

 51 QGVACYISYA KKGGLKEMVN LEEDASDASV SCVQTASSIS FDETAVRKPK

101 EVFKRGTGFA FKSRQIVRYY DPKRKAFAYL VYSDKIVQGS PKNSLSAVSC

151 FGSGIPQTDG VQADTSGKLL AGACIISNPI KNPDKR*
```

The following partial DNA sequence was identified in *N. meningitidis* <SEQ ID 2647>:

```
m770.seq
  1 ATGAACAGAC TGCTACTGCT GTCTGCCGCC GTCCTGCTGA CTGCCTGCGG

 51 CAGCGGCGAA ACCGATAAAA TCGGACGGGC AAGTACCGTT TTCAACATAC

101 TGGGCAAAAA CGACCGTATC GAAGTGGAAG GATTCGACGA TCCCGACGTT

151 CAAGGGGTTG CCTGTTATAT TTCGTATGCA AAAAAAGGCG GCTTGAAGGA
```

-continued

```
201 AATGGTCAAT TTGGAAGAGG ACGCGTCCGA CGCATCGGTT TCGTGCGTTC

251 AGACGGCATC TTCGATTTCT TTTGACGAAA CCGCCGTGCG CAAACCGAAA

301 GAAGTTTTCA AACACGGTGC GAGCTTCGCG TTCAAGAGCC GGCAGATTGT

351 CCGTTATTAC GACCCCAAAC GCAAAACCTT CGCCTATTTG GTGTACAGCG

401 ATAAAATCAT CCAAGGCTCG CCGAAAAATT CCTTAAGCGC GGTTTCCTGT

451 TTCGGCGGCG GCATACCGCA AACCGATGGG GTGCAAGCCG ATACTTCCGG

501 CAACCTGCTT GCCGGCGCCT GCATGATTTC CAACCCGATA GAAAATCTCG

551 ACAAACGCTG A
```

This corresponds to the amino acid sequence <SEQ ID 2648; ORF 770>:

```
m770.pep
  1 MNRLLLLSAA VLLTACGSGE TDKIGRASTV FNILGKNDRI EVEGFDDPDV

 51 QGVACYISYA KKGGLKEMVN LEEDASDASV SCVQTASSIS FDETAVRKPK

101 EVFKHGASFA FKSRQIVRYY DPKRKTFAYL VYSDKIIQGS PKNSLSAVSC

151 FGGGIPQTDG VQADTSGNLL AGACMISNPI ENLDKR*
```

Computer analysis of this amino acid sequence gave the following results:

Homology with a Predicted ORF from *N. gonorrhoeae*

ORF 770 shows 93.5% identity over a 186 aa overlap with a predicted ORF (ORF 770) from *N. gonorrhoeae*

```
m770/g770   93.5% identity in 186 aa overlap

                     10        20        30        40        50        60
g770.pep    MNRLLLLSAAVLPTACGSGETDKIGRASTVFNMLGKNDRIEVEGFDDPDVQGVACYISYA
            ||||||||||| |||||||||||||||||||||:||||||||||||||||||||||||||
m770        MNRLLLLSAAVLLTACGSGETDKIGRASTVFNILGKNDRIEVEGFDDPDVQGVACYISYA
                     10        20        30        40        50        60

                     70        80        90       100       110       120
g770.pep    KKGGLKEMVNLEEDASDASVSCVQTASSISFDETAVRKPKEVFKRGTGFAFKSRQIVRYY
            |||||||||||||||||||||||||||||||||||||||||||||:|::|||||||||||
m770        EKVPGQVREKGKVLQIDGETLLKNPELLSRAMYSAVVSNNIAGIRVILPIYLQQAQQDKM
                     70        80        90       100       110       120

                    130       140       150       160       170       180
g770.pep    DPKRKAFAYLVYSDKIVQGSPKNSLSAVSCFGSGIPQTDGVQADTSGKLLAGACIISNPI
            |||||||||||||||||||||||||||:||||||||||||||||||||||||||||||||
m770        DPKRKTFAYLVYSDKIIQGSPKNSLSAVSCFGGGIPQTDGVQADTSGNLLAGACMISNPI
                    130       140       150       160       170       180

g770.pep    KNPDKRX
            :| ||||
m770        ENLDKRX
```

The following partial DNA sequence was identified in *N. meningitidis* <SEQ ID 2649>:

```
a770.seq
  1 ATGAACAGAC TGCTACTGCT GTCTGCCGCC GTCCTGCTGA CTGCCTGCGG

 51 CAGCGGCGAA ACCGATAAAA TCGGACGGGC AAGTACCGTT TTCAACATAC

101 TGGGCAAAAA CGACCGTATC GAAGTGGAAG GATTCGACGA TCCCGACGTT

151 CAAGGGGTTG CCTGTTATAT TTCGTATGCA AAAAAAGGCG GCTTGAAGGA

201 AATGGTCAAT TTGGAAGAGG ACGCGTCCGA CGCATCGGTT TCGTGCGTTC

251 AGACGGCATC TTCGATTTCT TTTGACGAAA CCGCCGTGCG CAAACCGAAA

301 GAAGTTTTCA AACACGGTGC GAGCTTCGCG TTCAAGAGCC GGCAGATTGT
```

-continued

```
351 CCGTTATTAC GACCCCAAAC GCAAAACCTT CGCCTATTTG GTGTACAGCG

401 ATAAAATCAT CCAAGGCTCG CCGAAAAATT CCTTAAGCGC GGTTTCCTGT

451 TTCGGCGGCG GCATACCGCA AACCGATGGG GTGCAAGCCG ATACTTCCGG

501 CAACCTGCTT GCCGGCGCCT GCATGATTTC CAACCCGATA GAAAATCCCG

551 ACAAACGCTG A
```

This corresponds to the amino acid sequence <SEQ ID 2650; ORF 770.a>:

```
a770.pep
   1 MNRLLLLSAA VLLTACGSGE TDKIGRASTV FNILGKNDRI EVEGFDDPDV

  51 QGVACYISYA KKGGLKEMVN LEEDASDASV SCVQTASSIS FDETAVRKPK

 101 EVFKHGASFA FKSRQIVRYY DPKRKTFAYL VYSDKIIQGS PKNSLSAVSC

 151 FGGGIPQTDG VQADTSGNLL AGACMISNPI ENPDKR*
```

Computer analysis of this amino acid sequence gave the following results:

Homology with a Predicted ORF from *N. meningitidis*

ORF 770 shows 99.5% identity over a 186 aa overlap with a predicted ORF (ORF 770) from *N. meningitidis*:

```
m770/a770  99.5% identity in 186 aa overlap

                   10        20        30        40        50        60
a770.pep   MNRLLLLSAAVLLTACGSGETDKIGRASTVFNILGKNDRIEVEGFDDPDVQGVACYISYA
           ||||||||||||||||||||||||||||||||||||||||||||||||||||||||||||
m770       MNRLLLLSAAVLLTACGSGETDKIGRASTVFNILGKNDRIEVEGFDDPDVQGVACYISYA
                   10        20        30        40        50        60

                   70        80        90       100       110       120
a770.pep   KKGGLKEMVNLEEDASDASVSCVQTASSISFDETAVRKPKEVFKHGASFAFKSRQIVRYY
           ||||||||||||||||||||||||||||||||||||||||||||||||||||||||||||
m770       KKGGLKEMVNLEEDASDASVSCVQTASSISFDETAVRKPKEVFKHGASFAFKSRQIVRYY
                   70        80        90       100       110       120

                  130       140       150       160       170       180
a770.pep   DPKRKTFAYLVYSDKIIQGSPKNSLSAVSCFGGGIPQTDGVQADTSGNLLAGACMISNPI
           ||||||||||||||||||||||||||||||||||||||||||||||||||||||||||||
m770       DPKRKTFAYLVYSDKIIQGSPKNSLSAVSCFGGGIPQTDGVQADTSGNLLAGACMISNPI
                  130       140       150       160       170       180

a770.pep   ENPDKRX
           || ||||
m770       ENLDKRX
```

The following partial DNA sequence was identified in *N. gonorrhoeae* <SEQ ID 2651>:

```
g771.seq
   1 ATGGATTTAT TATCGGTTTT CCACAAATAC CGTCTGAAAT ATGCGGTGGC

  51 GGTGCTGACG ATGCTGCTTT TGGCGGCAGT CGGGCTGCAC GCTTCCGTAT

 101 ATCGCACCTT CACGCCCGAA AACATCCGCA GCCGCCTCCA ACAAAGCATT

 151 GCCCATACCC ACCGGAAAAT CTCGTTTGAT GCGGATATAC GGCGCAGGCT

 201 TCTGCCCCGC CCGACCGTCA TCCTGAAAAA CCTGACCATT ACCGAACCCG

 251 ACGGCGGCCG GGTCGCCGTT TCCGTCAAAG AAACCAAAAT CGGATTGAGC

 301 TGGAAAAACC TGTGGTCGGA TCGGATACAG GTTGAAAAAT GGGTGGTTTC

 351 GGGTGCGGAT CTTGCCCTGA CGCGCGACAG AAACGGCGCT TGGAACATCC

 401 AAGACCTGTT CGACGGCGCG AAACACTCCG CCTCAGTCAA CCGCATTATC
```

-continued

```
 451 GTCGAAAACA GCACCGTCCG CCTCAATTTC CTGCAGCAAC AGCTTATCCT
 501 GAAGGAAATC AGCCTCAACC TGCAATCCCC CGATTCGTCG GGGCAGCAGT
 551 TTGAAAGTTC GGGCATACTG GTTTGGAGAA AGCTGTCCGT CCCGTGGAAA
 601 AGCAGGGGGC TGTTCCTTTC AGACGGCATC GGCACGCCCG AAATCTCACC
 651 GTTCCATTTT GAAGCTTCCA CTTCGCTGGA CGGACACGGC ATCACCATTT
 701 CCACCACCGG CAGCCCTTCT GTCCGCTTCA ACGCCGGCGG AGCGGATGCC
 751 GCCGGCCTCG GCCTGCGTGC AGACACTTCC TTCCGCAACC TCCACCTGAC
 801 CGCGCAAATC CCCGCACTGG CACTCAAAAA CAACAGCATC AAAACCGGCA
 851 CGGTCAACGG CACGTTTACC GCCGGCGGCG AATATGCCCG ATGGGACGGT
 901 TCGTTCAAAC TCGACAAAGC CAACCTGCAC TCCGGCATCG CCAACATCGG
 951 CAACGCCGAA ATCTCCGGCA GCTTCAAAAC ACCGCGCCTT CAAACCAATT
1001 TCTCCCTCGG CTCGCCGTTG GTTTGGAGTC GGGACAACGG GCTGGACGCC
1051 CCGCGCCTGC ACATATCGAC CCTTCAGGAT ACCGTCGACC GCCTGCCGCA
1101 ACCCCGTTTC ATCAGCCGGC TCGACGGTTC GCTGTCCATA CCGAATCTGC
1151 AAAATTGGAA TGCCGAATTA AACGGCACAT TCGACCGCCA ACCCGTTGCC
1201 GCAAAATTCA AATATACGCG GGAAGGCGCA CCGCACCTGG AAGCCGCCGC
1251 CGCGCTGCAA AAATTAAACC TCGCCCCCTA TCTTGACGAA TTTCGGCAAC
1301 AAAACGGCAA AATATTCCCC GACATCCTCG GCAGGCTGTC CGGCAACGTC
1351 GAGGCACACC TCAAAATCGG CAGCATCCAA CTCCCCGGCT TGCAACTGGA
1401 CGATATGGAA ACCTACCTCC ACGCCGACAA AGACCATATC GCGCTCAGCC
1451 GTTTCAAGTC AGGGCTTTAC GGCGGCCATA CCGAAGGCGG CATCAGCATC
1501 GCCAACACCC GTCCCGCCAC TTACCGCCTG CAACAGAATG CAAGCAACAT
1551 CCAAATCCAA CCGCTGCTGC AAGACCTGTT CGGCTTCCAC AGCTTCAGCG
1601 GCAACGGCGA TGCGGTCATC GACCTGACCG CAAGCGGCGA AAACCGCAAA
1651 CAGCTTATCC GCTCGCTGCA AGGCAGCCTG TCGCTGAATA TTTCCAACGG
1701 CGCGTGGCAC GGCATCGATA TGGACAGCAT TTTAAAAAAC GGCCTTTCCG
1751 GGAAAATCTC GGGCAGCACA CCCTTCTACC GATTCACGCT CAACAGCGAA
1801 ATTTCAGACG GCATCAGCCG CCACATCGAT ACCGAACTCT TCTCCGACAG
1851 CCTCTATGTT ACCAGCAACG GCTATACCAA TCTGGATACG CAGGAATTGT
1901 CTGAAGATGT CCTTATCCGC AACGCCGTCC ATCCGAAAAA CAAACCGATT
1951 CCCCTGAAAA TCACCGGTAC GGTGGACAAG CCGTCCATTA CCGTCGATTA
2001 CGGCAGGCTG ACCGGCGGCA TCAATTCGCG CAAAGAGAAA CAGAAAATCC
2051 TCGAAGACAC CCTGCTGGAA CAATGGCAGT GGCTCAAACC TAAAGAACCG
3051 TAA
```

This corresponds to the amino acid sequence <SEQ ID 2652; ORF 771.ng>:

```
g771.pep
  1 MDLLSVFHKY RLKYAVAVLT MLLLAAVGLH ASVYRTFTPE NIRSRLQQSI
 51 AHTHRKISFD ADIRRRLLPR PTVILKNLTI TEPDGGRVAV SVKETKIGLS
101 WKNLWSDRIQ VEKWVVSGAD LALTRDRNGA WNIQDLFDGA KHSASVNRII
```

-continued

```
151 VENSTVRLNF LQQQLILKEI SLNLQSPDSS GQQFESSGIL VWRKLSVPWK

201 SRGLFLSDGI GTPEISPFHF EASTSLDGHG ITISTTGSPS VRFNAGGADA

251 AGLGLRADTS FRNLHLTAQI PALALKNNSI KTGTVNGTFT AGGEYARWDG

301 SFKLDKANLH SGIANIGNAE ISGSFKTPRL QTNFSLGSPL VWSRDNGLDA

351 PRLHISTLQD TVDRLPQPRF ISRLDGSLSI PNLQNWNAEL NGTFDRQPVA

401 AKFKYTREGA PHLEAAAALQ KLNLAPYLDE FRQQNGKIFP DILGRLSGNV

451 EAHLKIGSIQ LPGLQLDDME TYLHADKDHI ALSRFKSGLY GGHTEGGISI

501 ANTRPATYRL QQNASNIQIQ PLLQDLFGFH SFSGNGDAVI DLTASGENRK

551 QLIRSLQGSL SLNISNGAWH GIDMDSILKN GLSGKISGST PFYRFTLNSE

601 ISDGISRHID TELFSDSLYV TSNGYTNLDT QELSEDVLIR NAVHPKNKPI

651 PLKITGTVDK PSITVDYGRL TGGINSRKEK QKILEDTLLE QWQWLKPKEP

701 *
```

The following partial DNA sequence was identified in *N. meningitidis* <SEQ ID 2653>:

```
m771.seq
   1 ATGGATTTAT TATCGGTTTT CCACAAATAC CGTCTGAAAT ATGCGGTGGC

  51 CGTGCTGACG ATACTGCTTT TGGCGGCAGT CGGGCTGCAC GCTTCCGTAT

 101 ATCGCACCTT CACGCCTGAA AACATCCGCA GCCGCCTACA ACAAAGCATT

 151 GCACACACAC ACCGGAAAAT CTCGTTTGAT GCGGACATTC AGCGCAGGCT

 201 CCTGCCCCGG CCGACCGTCA TCCTGAAAAA CCTGACCATT ACCGAACCCG

 251 GCGGCGACCA GACTGCCGTT TCCGTCCAAG AAACCAAAAT CGGATTGAGC

 301 TGGAAAAACC TGTGGTCGGA TCAGATACAG ATTGAAAAAT GGGTGGTTTC

 351 GAGTGCGGAA CTTGCCCTGA CGCGCGACGG GAAAGGTGTT TGGAACATCC

 401 AAGACCTGAT CGACAGCCAA AAACGCCAAG CCTCAGTCAA CCGCATTATC

 451 GTCGAAAACA GCACCGTCCG CCTCAATTTC CTGCAGGAAC AGCTTATCCT

 501 GAAGGAAATC AACCTCAACC TGCAATCCCC CGATTCGTCG GGGCAGCCGT

 551 TTGAAAGTTC GGGCATACTG GTTTGGGGAA AGCTGTCCGT CCCGTGGAAA

 601 AGCAGGGGGC TGTTCCTTTC AAACGGCATC GGCCCGCCCG AAATCTCACC

 651 GTTCCATTTT GAAGCTTCCA CTTCGCTGGA CGGACACGGC ATTACCATTT

 701 CCACCACCGG CAGCCCTTCT GTCCGCTTCA ACGCCGGCGG AGCGGATGCC

 751 GCCGGCCTCG GCCTGCGTGC AGACACTTCC TTCCGCAACC TCCACCTGAC

 801 CGCCCAAATC CCCGCGCTGG CACTCAGGAA CAACAGCATT AAAATTGAAA

 851 CCGTCAACGG CGCATTTACC GCCGGCGGCG AATATGCCCG ATGGGACGGT

 901 TCGTTCAAAC TCGACAAAGC CAACCTGCAC TCCGGCATCG CCAACATCGG

 951 CAACGCCGAA ATCTCCGGCA GCTTCAAAAC ACCGCGCCAC CAGACCAACT

1001 TCTCCCTCAA TTCGCCGCTC GTATGGACGG AAAACAAAGG GCTGGACGCG

1051 CCGCGCCTGT ATGTATCGAC CCTTCAGGAT ACCGTCAACC GCCTGCCGCA

1101 ACCCCGTTTC ATCAGCCGGC TCGACGGTTC GCTGTCCGTA CCGAATCTGC

1151 AAAATTGGAA TGCCGAATTA AACGGCACAT TCGACCGCCA AACCGTTGCC

1201 GCGAAATTCA GATACACACA TGAAGACGCA CCGCATCTGG AAGCCGCCGT
```

-continued

```
1251 CGCACTGCAA AAATTGAACC TGACCCCCTA TCTTGACGAC GTGCGGCAAC

1301 AAAACGGCAA AATATTTCCC GACACCCTCG CCAAGCTGTC CGGCGACATC

1351 GAGGCGCACC TGAAAATCGG AAAAGTCCAA CTTCCCGGCC TGCAACTGGA

1401 CGATATGGAA ACCTACCTCC ACGCCGACAA AGGCCATATC GCGCTCAGCC

1451 GTTTCAAGTC AGGGCTTTAC GGCGGCCATA CCGAAGGCGG CATCAGCATC

1501 GCCAACACCC GTCCCGCCAC TTACCGCCTG CAACAGAATG CAAGCAACAT

1551 CCAAATCCAA CCGCTGCTGC AAGACCTGTT CGGCTTCCAC AGCTTCAGCG

1601 GCAACGGCGA CGCGGTCATC GACCTGACCG CGGGCGGCGA AACCCGAAAA

1651 GAGCTTATCC GCTCGCTTCA GGGCAGCCTG TCGCTAAATA TTTCCAACGG

1701 TGCATGGCAC GGTATCGACA TGGACAATAT CCTGAAAAAC GGCATTTCGG

1751 GCAAAACTGC CGACAATGCC GCACCCAGCA CACCCTTCCA CCGATTCACG

1801 CTCAACAGCG AAATTTCAGA CGGCATCAGC CGCCACATCG ATACCGAACT

1851 CTTCTCCGAC AGCCTCTATG TTACCAGCAA CGGCTATACC AATCTGGATA

1901 CGCAGGAATT GTCTGAAGAT GTCCTTATCC GCAACGCCGT CCATCCGAAA

1951 AACAAACCGA TTCCCCTGAA AATCACCGGC ACGGTGGACA AACCGTCCAT

2001 TACCGTCGAT TACGGCAGGC TGACCGGCGG CATCAATTCG CGCAAAGAGA

2051 AACAGAAAAT CCTCGAAGAC ACCCTGCTGG AACAATGGCA GTGGCTCAAA

2101 CCTAAAGAAC CGTA
```

This corresponds to the amino acid sequence <SEQ ID 2654; ORF 771>:

```
m771.pep
  1 MDLLSVFHKY RLKYAVAVLT ILLLAAVGLH ASVYRTFTPE NIRSRLQQSI

 51 AHTHRKISFD ADIQRRLLPR PTVILKNLTI TEPGGDQTAV SVQETKIGLS

101 WKNLWSDQIQ IEKWVVSSAE LALTRDGKGV WNIQDLIDSQ KRQASVNRII

151 VENSTVRLNF LQEQLILKEI NLNLQSPDSS GQPFESSGIL VWGKLSVPWK

201 SRGLFLSNGI GPPEISPFHF EASTSLDGHG ITISTTGSPS VRFNAGGADA

251 AGLGLRADTS FRNLHLTAQI PALALRNNSI KIETVNGAFT AGGEYARWDG

301 SFKLDKANLH SGIANIGNAE ISGSFKTPRH QTNFSLNSPL VWTENKGLDA

351 PRLYVSTLQD TVNRLPQPRF ISRLDGSLSV PNLQNWNAEL NGTFDRQTVA

401 AKFRYTHEDA PHLEAAVALQ KLNLTPYLDD VRQQNGKIFP DTLAKLSGDI

451 EAHLKIGKVQ LPGLQLDDME TYLHADKGHI ALSRFKSGLY GGHTEGGISI

501 ANTRPATYRL QQNASNIQIQ PLLQDLFGFH SFSGNGDAVI DLTAGGETRK

551 ELIRSLQGSL SLNISNGAWH GIDMDNILKN GISGKTADNA APSTPFHRFT

601 LNSEISDGIS RHIDTELFSD SLYVTSNGYT NLDTQELSED VLIRNAVHPK

651 NKPIPLKITG TVDKPSITVD YGRLTGGINS RKEKQKILED TLLEQWQWLK

701 PKEP*
```

Computer analysis of this amino acid sequence gave the following results:

Homology with a Predicted ORF from *N. gonorrhoeae*

ORF 771 shows 90.3% identity over a 704 aa overlap with a predicted ORF (ORF 771) from *N. gonorrhoeae*

```
m771/g771   90.3% identity in 704 aa overlap

                     10        20        30        40        50        60
g771.pep     MDLLSVFHKYRLKYAVAVLTMLLLAAVGLHASVYRTFTPENIRSRLQQSIAHTHRKISFD
             ||||||||||||||||||||:|||||||||||||||||||||||||||||||||||||||
m771         MDLLSVFHKYRLKYAVAVLTILLLAAVGLHASVYRTFTPENIRSRLQQSIAHTHRKISFD
                     10        20        30        40        50        60
                     70        80        90       100       110       120
g771.pep     ADIRRRLLPRPTVILKNLTITEPDGGRVAVSVKETKIGLSWKNLWSDRIQVEKWVVSGAD
             |||:||||||||||||||||||| | ::||||:||||||||||||||:||:||||||:|:
m771         ADIQRRLLPRPTVILKNLTITEPGGDQTAVSVQETKIGLSWKNLWSDQIQIEKWVVSSAE
                     70        80        90       100       110       120
                    130       140       150       160       170       180
g771.pep     LALTRDRNGAWNIQDLFDGAKHSASVNRIIVENSTVRLNFLQQQLILKEISLNLQSPDSS
             |||||| :|:||||||:|: |::|||||||||||||||||||:|||||||:|||||||||
m771         LALTRDGKGVWNIQDLIDSQKRQASVNRIIVENSTVRLNFLQEQLILKEINLNLQSPDSS
                    130       140       150       160       170       180
                    190       200       210       220       230       240
g771.pep     GQQFESSGILVWRKLSVPWKSRGLFLSDGIGTPEISPFHFEASTSLDGHGITISTTGSPS
             || ||||||||| ||||||||||||||:||| ||||||||||||||||||||||||||||
m771         GQPFESSGILVWGKLSVPWKSRGLFLSNGIGPPEISPFHFEASTSLDGHGITISTTGSPS
                    190       200       210       220       230       240
                    250       260       270       280       290       300
g771.pep     VRFNAGGADAAGLGLRADTSFRNLHLTAQIPALALKNNSIKTGTVNGTFTAGGEYARWDG
             |||||||||||||||||||||||||||||||||||:|||||  ||||:||||||||||||
m771         VRFNAGGADAAGLGLRADTSFRNLHLTAQIPALALRNNSIKIETVNGAFTAGGEYARWDG
                    250       260       270       280       290       300
                    310       320       330       340       350       360
g771.pep     SFKLDKANLHSGIANIGNAEISGSFKTPRLQTNFSLGSPLVWSRDNGLDAPRLHISTLQD
             ||||||||||||||||||||||||||||| ||||||:|||||::::|||||||::|||||
m771         SFKLDKANLHSGIANIGNAEISGSFKTPRHQTNFSLNSPLVWTENKGLDAPRLYVSTLQD
                    310       320       330       340       350       360
                    370       380       390       400       410       420
g771.pep     TVDRLPQPRFISRLDGSLSIPNLQNWNAELNGTFDRQPVAAKFKYTREGAPHLEAAAALQ
             ||:||||||||||||||||:||||||||||||||||| |||||:||:| |||||||:|||
m771         TVNRLPQPRFISRLDGSLSVPNLQNWNAELNGTFDRQTVAAKFRYTHEDAPHLEAAVALQ
                    370       380       390       400       410       420
                    430       440       450       460       470       480
g771.pep     KLNLAPYLDEFRQQNGKIFPDILGRLSGNVEAHLKIGSIQLPGLQLDDMETYLHADKDHI
             ||||:||||: |||||||||| |::|||::|||||||::|||||||||||||||||| ||
m771         KLNLTPYLDDVRQQNGKIFPDTLAKLSGDIEAHLKIGKVQLPGLQLDDMETYLHADKGHI
                    430       440       450       460       470       480
                    490       500       510       520       530       540
g771.pep     ALSRFKSGLYGGHTEGGISIANTRPATYRLQQNASNIQIQPLLQDLFGFHSFSGNGDAVI
             ||||||||||||||||||||||||||||||||||||||||||||||||||||||||||||
m771         ALSRFKSGLYGGHTEGGISIANTRPATYRLQQNASNIQIQPLLQDLFGFHSFSGNGDAVI
                    490       500       510       520       530       540
                    550       560       570       580           590
g771.pep     DLTASGENRKQLIRSLQGSLSLNISNGAWHGIDMDSILKNGLSGKISG----STPFYRFT
             ||||:||:||:||||||||||||||||||||||||:|||||:||| :     ||||:|||
m771         DLTAGGETRKELIRSLQGSLSLNISNGAWHGIDMDNILKNGISGKTADNAAPSTPFHRFT
                    550       560       570       580       590       600
              600       610       620       630       640       650
g771.pep     LNSEISDGISRHIDTELFSDSLYVTSNGYTNLDTQELSEDVLIRNAVHPKNKPIPLKITG
             ||||||||||||||||||||||||||||||||||||||||||||||||||||||||||||
m771         LNSEISDGISRHIDTELFSDSLYVTSNGYTNLDTQELSEDVLIRNAVHPKNKPIPLKITG
                    610       620       630       640       650       660
              660       670       680       690       700
g771.pep     TVDKPSITVDYGRLTGGINSRKEKQKILEDTLLEQWQWLKPKEPX
             |||||||||||||||||||||||||||||||||||||||||||||
m771         TVDKPSITVDYGRLTGGINSRKEKQKILEDTLLEQWQWLKPKEPX
                    670       680       690       700
```

The following partial DNA sequence was identified in *N. meningitidis* <SEQ ID 2655>:

a771.seq
```
   1 ATGGATTTAT TATCGGTCTT CCACAAATAC CGTCTGAAAT ATGCGGTAGC
  51 CGTGCTGACG ATACTGCTTT TGGCGGCAAT CGGGCTGCAC GCTTCCGTAT
 101 ATCGCATCTT CACACCTGAA AACATCCGAA GCCGCCTCCA ACAAAGCATT
 151 GCCCATACGC ACCGGAAAAT CTCGTTTGAT GCGGATATAC AGCGCAGGCT
 201 TCTGCCCCGG CCGACCGTCA TCCTGAAAAA CCTGACCATT ACCGAACCCG
 251 GCGGCGACCG GACTGCCGTT TCCGTCCAAG AAACCAAAAT CGGATTGAGC
 301 TGGAAAAACC TGTGGTCGGA TCAGATACAG ATTGAAAAAT GGGTGGTTTC
 351 GAGTGCGGAA CTTGCCCTGA CGCGCGACGG GAAAGGTGTT TGGAACATCC
 401 AAGACCTGAT CGACAGCCAA AAACGCCAAG CCTCAGTCAA CCGCATTATC
 451 GTCGAAAACA GCACCGTCCG CCTCAATTTC CTGCAGGAAC AGCTTATCCT
 501 GAAGGAAATC AACCTCAACC TGCAATCCCC CGATTCGTCG GGGCAGCCGT
 551 TTGAAAGTTC GGGCATACTG GTTTGGGGAA AGCTGTCCGT CCCGTGGAAA
 601 AGCAGGGGGC TGTTCCTTTC AGACGGCATC GGCACGCCCA AAATCTCACC
 651 GTTCCATTTT GAAGCTTCCA CTTCGCTGGA CGGACACGGC ATTACCATTT
 701 CCACCACCGG CAGCCCTTCT GTCCGCTTCA ACGCCGGCGG AGCGGATGCC
 751 GCCGGCCTCG GCCTGCGTGC AGACACTTCC TTCCGCAACC TCCACCTGAC
 801 CGCCCAAATC CCTACGCTGG CACTCAGGAA CAACAGCATT AAAATTGAAA
 851 CCGTCAACGG CGCATTTACC GCCGGCGGCG AATATGCCCA ATGGGACGGT
 901 TCGTTCAAAC TCGACAAAGC CAACCTGCAC TCCGGCATCG CCAACATCGG
 951 CAACGCCGAA ATCTCCGGCA GCTTCAAAAC ACCGCGCCAC CAGACCAACT
1001 TCTCCCTCAA TTCGCCGCTC GTATGGACGG AAAACAAAGG GCTGGACGCG
1051 CCGCGCCTGT ATGTATCGAC CCTTCAGGAT ACCGTCAACC GCCTGCCGCA
1101 ACCCCGTTTC ATCAGCCGGC TCGACGGTTC GCTGTCCGTA CCGAATCTGC
1151 AAAATTGGAA TGCCGAATTA AACGGCACAT TCGACCGCCA AACCGTTGCC
1201 GCGAAATTCA GATACACACA TGAAGACGCA CCGCATCTGG AAGCCGCCGT
1251 CGCACTGCAA AAATTGAACC TGACCCCCTA TCTTGACGAC GTGCGGCAAC
1301 AAAACGGCAA AATATTTCCC GACACCCTCG CCAAGCTGTC CGGCGACATC
1351 GAGGCGCACC TGAAAATCGG AAAAGTCCAA CTTCCCGGCC TGCAACTGGA
1401 CGATATGGAA ACCTACCTCC ACGCCGACAA AGGCCATATC GCGCTCAGCC
1451 GTTTCAAGTC AGGGCTTTAC GGCGGCCATA CCGAAGGCGG CATCAGCATC
1501 GCCAACACCC GTCCCGCCAC TTACCGCCTG CAACAGAATG CAAGCAACAT
1551 CCAAATCCAA CCGCTGCTGC AAGACCTGTT CGGCTTCCAC AGCTTCAGCG
1601 GCAACGGCGA CGCGGTCATC GACCTGACCG CGGGCGGCGA AACCCGAAAA
1651 GAGCTTATCC GCTCGCTTCA GGGCAGCCTG TCGCTAAATA TTTCCAACGG
1701 TGCATGGCAC GGTATCGACA TGGACAATAT CCTGAAAAAC GGCATTTCGG
1751 GCAAAACTGC CGACAATGCC GCACCCAGCA CACCCTTCCA CCGATTCACG
1801 CTCAACAGCG AAATTTCAGA CGGCATCAGC CGCCACATCG ATACCGAACT
1851 CTTCTCCGAC AGCCTCTATG TTACCAGCAA CGGCTATACC AATCTGGATA
1901 CGCAGGAATT GTCTGAAGAT GTCCTTATCC GCAACGCCGT CCATCCGAAA
1951 AACAAACCGA TTCCCCTGAA AATCACCGGT ACGGTGGACA AACCGTCCAT
```

-continued

```
2001 TACCGTCGAT TACGGCAGGC TGACCGGCGG CATCAATTCG CGCAAAGAGA

2051 AACAGAAAAT CCTCGAAGAC ACCCTGCTGG AACAATGGCA GTGGCTCAAA

2101 CCTAAAGAAC CGTAA
```

This corresponds to the amino acid sequence <SEQ ID 2656; ORF 771.a>:

```
a771.pep
   1 MDLLSVFHKY RLKYAVAVLT ILLLAAIGLH ASVYRIFTPE NIRSRLQQSI

  51 AHTHRKISFD ADIQRRLLPR PTVILKNLTI TEPGGDRTAV SVQETKIGLS

 101 WKNLWSDQIQ IEKWVVSSAE LALTRDGKGV WNIQDLIDSQ KRQASVNRII

 151 VENSTVRLNF LQEQLILKEI NLNLQSPDSS GQPFESSGIL VWGKLSVPWK

 201 SRGLFLSDGI GTPKISPFHF EASTSLDGHG ITISTTGSPS VRFNAGGADA

 251 AGLGLRADTS FRNLHLTAQI PTLALRNNSI KIETVNGAFT AGGEYAQWDG

 301 SFKLDKANLH SGIANIGNAE ISGSFKTPRH QTNFSLNSPL VWTENKGLDA

 351 PRLYVSTLQD TVNRLPQPRF ISRLDGSLSV PNLQNWNAEL NGTFDRQTVA

 401 AKFRYTHEDA PHLEAAVALQ KLNLTPYLDD VRQQNGKIFP DTLAKLSGDI

 451 EAHLKIGKVQ LPGLQLDDME TYLHADKGHI ALSRFKSGLY GGHTEGGISI

 501 ANTRPATYRL QQNASNIQIQ PLLQDLFGFH SFSGNGDAVI DLTAGGETRK

 551 ELIRSLQGSL SLNISNGAWH GIDMDNILKN GISGKTADNA APSTPFHRFT

 601 LNSEISDGIS RHIDTELFSD SLYVTSNGYT NLDTQELSED VLIRNAVHPK

 651 NKPIPLKITG TVDKPSITVD YGRLTGGINS RKEKQKILED TLLEQWQWLK

 701 PKEP*
```

Computer analysis of this amino acid sequence gave the following results:

Homology with a Predicted ORF from *N. meningitidis*

ORF 771 shows 98.9% identity over a 704 aa overlap with a predicted ORF (ORF 771) from *N. meningitidis*

```
m771/a771   98.9% identity in 704 aa overlap

                    10        20        30        40        50        60
a771.pep    MDLLSVFHKYRLKYAVAVLTILLLAAIGLHASVYRIFTPENIRSRLQQSIAHTHRKISFD
            ||||||||||||||||||||||||||:||||||| |||||||||||||||||||||||||
m771        MDLLSVFHKYRLKYAVAVLTILLLAAVGLHASVYRTFTPENIRSRLQQSIAHTHRKISFD
                    10        20        30        40        50        60

                    70        80        90       100       110       120
a771.pep    ADIQRRLLPRPTVILKNLTITEPGGDRTAVSVQETKIGLSWKNLWSDQIQIEKWVVSSAE
            ||||||||||||||||||||||||||:|||||||||||||||||||||||||||||||||
m771        ADIQRRLLPRPTVILKNLTITEPGGDQTAVSVQETKIGLSWKNLWSDQIQIEKWVVSSAE
                    70        80        90       100       110       120

                   130       140       150       160       170       180
a771.pep    LALTRDGKGVWNIQDLIDSQKRQASVNRIIVENSTVRLNFLQEQLILKEINLNLQSPDSS
            ||||||||||||||||||||||||||||||||||||||||||||||||||||||||||||
m771        LALTRDGKGVWNIQDLIDSQKRQASVNRIIVENSTVRLNFLQEQLILKEINLNLQSPDSS
                   130       140       150       160       170       180

                   190       200       210       220       230       240
a771.pep    GQPFESSGILVWGKLSVPWKSRGLFLSDGIGTPKISPFHFEASTSLDGHGITISTTGSPS
            ||||||||||||||||||||||||||:||| |:|||||||||||||||||||||||||||
m771        GQPFESSGILVWGKLSVPWKSRGLFLSNGIGPPEISPFHFEASTSLDGHGITISTTGSPS
                   190       200       210       220       230       240
```

-continued

```
                250        260        270        280        290        300
a771.pep  VRFNAGGADAAGLGLRADTSFRNLHLTAQIPTLALRNNSIKIETVNGAFTAGGEYAQWDG
          ||||||||||||||||||||||||||||||:|||||||||||||||||||||||||:|||
m771      VRFNAGGADAAGLGLRADTSFRNLHLTAQIPALALRNNSIKIETVNGAFTAGGEYARWDG
                250        260        270        280        290        300

                310        320        330        340        350        360
a771.pep  SFKLDKANLHSGIANIGNAEISGSFKTPRHQTNFSLNSPLVWTENKGLDAPRLYVSTLQD
          ||||||||||||||||||||||||||||||||||||||||||||||||||||||||||||
m771      SFKLDKANLHSGIANIGNAEISGSFKTPRHQTNFSLNSPLVWTENKGLDAPRLYVSTLQD
                310        320        330        340        350        360

                370        380        390        400        410        420
a771.pep  TVNRLPQPRFISRLDGSLSVPNLQNWNAELNGTFDRQTVAAKFRYTHEDAPHLEAAVALQ
          ||||||||||||||||||||||||||||||||||||||||||||||||||||||||||||
m771      TVNRLPQPRFISRLDGSLSVPNLQNWNAELNGTFDRQTVAAKFRYTHEDAPHLEAAVALQ
                370        380        390        400        410        420

                430        440        450        460        470        480
a771.pep  KLNLTPYLDDVRQQNGKIFPDTLAKLSGDIEAHLKIGKVQLPGLQLDDMETYLHADKGHI
          ||||||||||||||||||||||||||||||||||||||||||||||||||||||||||||
m771      KLNLTPYLDDVRQQNGKIFPDTLAKLSGDIEAHLKIGKVQLPGLQLDDMETYLHADKGHI
                430        440        450        460        470        480

                490        500        510        520        530        540
a771.pep  ALSRFKSGLYGGHTEGGISIANTRPATYRLQQNASNIQIQPLLQDLFGFHSFSGNGDAVI
          ||||||||||||||||||||||||||||||||||||||||||||||||||||||||||||
m771      ALSRFKSGLYGGHTEGGISIANTRPATYRLQQNASNIQIQPLLQDLFGFHSFSGNGDAVI
                490        500        510        520        530        540

                550        560        570        580        590        600
a771.pep  DLTAGGETRKELIRSLQGSLSLNISNGAWHGIDMDNILKNGISGKTADNAAPSTPFHRFT
          ||||||||||||||||||||||||||||||||||||||||||||||||||||||||||||
m771      DLTAGGETRKELIRSLQGSLSLNISNGAWHGIDMDNILKNGISGKTADNAAPSTPFHRFT
                550        560        570        580        590        600

                610        620        630        640        650        660
a771.pep  LNSEISDGISRHIDTELFSDSLYVTSNGYTNLDTQELSEDVLIRNAVHPKNKPIPLKITG
          ||||||||||||||||||||||||||||||||||||||||||||||||||||||||||||
m771      LNSEISDGISRHIDTELFSDSLYVTSNGYTNLDTQELSEDVLIRNAVHPKNKPIPLKITG
                610        620        630        640        650        660

                670        680        690        700
a771.pep  TVDKPSITVDYGRLTGGINSRKEKQKILEDTLLEQWQWLKPKEPX
          |||||||||||||||||||||||||||||||||||||||||||||
m771      TVDKPSITVDYGRLTGGINSRKEKQKILEDTLLEQWQWLKPKEPX
                670        680        690        700
```

The following partial DNA sequence was identified in *N. gonorrhoeae* <SEQ ID 2657>:

```
g772.seq
  1 GTGTTCGGCA CGGTCTTGCG GACTGATGCC GACTGCCTGC AAATCATCGT

 51 CGTCGGCAAG TTCTTTCAGG TTGTTGCGTA TGGTTTTGCG GCGTTGGCGG

101 AAGGCGAGTT TCACCAGTTT GGCGAAATGA TCGAAATCGT CCGCCTTGCC

151 GATACGGTGT TTCACCGGAA TCATGCGCAC CACTGCGGAA TCGATTTTCG

201 GCGCGGGATC GAACGATTCG GGCGGCACGT CAATCAGCAG CTCCATATCG

251 AAAAAATATT GCAGCATCAC ACCCAAGCGA CCGTAGTCGT TGCTTTTCGG

301 CGCGGCAACC ATGCGCTCGA CCACTTCTTT TTGCAACATA AAGTGCATAT

351 CGGCGACATC GTCCGCCACC TCCGCCAGTT TGAACAAAAG CGGCGTGGAG

401 ATGTTATACG GCAGGTTGCC GACGATTTTC TTTTTGCCTG AGATGCCGTT

451 GAAATCAAAC TGCAACACGT CGCCTTCGTG AATCACCAGT TTATCCGCAA

501 ACGGCAGCGT TTTCAGACGG CATACGATGT CGCGGTCGAT TTCGACAACG

551 TGCAGGCGGT TCAGCTTTTT CGCCAAAGGT TCGGTAATTG CCGCCAAACC
```

-continued

```
601 CGGGCCGATT TCAATCACGA CATCATCCGC CTGCGGGCGC ACGGCGTTGA

651 CAATATCGCC GATAATCCGC GTGTCCTGCA AAAAATTCTG CCCGAAACGC

701 TTGCGGGCTT TGTGTTCTTT CATCGTGTTT CCTCTTCGGT TGAAACCCCG

751 CCCTTTAGGG CGGCAGGATC AGACTCTGTT TGGGCGGGGC GTAACCCCTT

801 CCAAATCAGG ACGACACATA GGGCGGTGCT TTATGTGTCG TCCTGTGTGT

851 TGGAACATAA ATGTGTTTAC AGTATCCGTT TGATGTCGGC ATTGTAA
```

This corresponds to the amino acid sequence <SEQ ID 2658; ORF 772.ng>:

```
g772.pep
  1 VFGTVLRTDA DCLQIIVVGK FFQVVAYGFA ALAEGEFHQF GEMIEIVRLA

 51 DTVFHRNHAH HCGIDFRRGI ERFGRHVNQQ LHIEKILQHH TQATVVVAFR

101 RGNHALDHFF LQHKVHIGDI VRHLRQFEQK RRGDVIRQVA DDFLFA*DAV

151 EIKLQHVAFV NHQFIRKRQR FQTAYDVAVD FDNVQAVQLF RQRFGNCRQT

201 RADFNHDIIR LRAHGVDNIA DNPRVLQKIL PETLAGFVFF HRVSSSVETP

251 PFRAAGSDSV WAGRNPFQIR TTHRAVLYVS SCVLEHKCVY SIRLMSAL*
```

The following partial DNA sequence was identified in *N. meningitidis* <SEQ ID 2659>:

```
m772.seq
  1 ATGTTCGGCG CGGTCTTGCG GATTGATGCC GACTGCCTGC AAATCATCGT

 51 CGCCTGCAAG CTCTTTCAGA TTGTTGCGTA TGGTTTTGCG GCGTTGGTGG

101 AAGGCGAGTT TCACGAGTTT GGCAAAATGC TCGAAATCGT CCGCCTTGCC

151 GATGCGGTGT TTCACCGGAA TCATACGGAC GACGGCGGAA TCCACTTTCG

201 GCGCAGGGTC GAACGATTCG GGCGGTACGT CAATCAGCAT TTCCATATCG

251 AAAAAATATT GCAGCATCAC GCCCAAGCGG CCGTAGTCGT TGCTTTTCGG

301 CGCGGCAACC ATACGCTCGA CCACTTCTTT TTGCAGCATA AAGTGCATAT

351 CGACGACATC GTCCGCCACC TCCGCCAGCT TGAACAAAAG CGGTGTGGAA

401 ATGTTGTACG GGAGGTTGCC GACGATTTTC TTTTTGCCTG CGATGCCGTT

451 GAAATCAAAC TGCAATACAT CGCCTTCGTG AATCACCAGT TTATCCGCAA

501 ACGGCAGCGT TTTCAGACGG CATACGATGT CGCGGTCGAT TTCGACAACG

551 TGCAGGCGGT TCAGCTTTTT CGCCAAAGGT TCGGTAATCG CCGCCAAACC

601 CGGGCCGATT TCAATCACGA CATCATCCGC CTGCGGGCGC ACGGCGTTGA

651 CAATATCGCT GATAATCCGC GTGTCCTGCA AAAAATTCTG CCCGAAACGC

701 TTGCGGGCTT TGTGTTCTTT CATCGTGTTT CCTTTTCGGT TGAAACCCCG

751 CCCTTTAGGG CGGTAGAATC AGACTCTATT TGGGAGGGGC GTAACTCTTT

801 CCAAATCAGG ATGGCACATA GGGCGGTGCT TTATGTGTCG TCCTGTGTGT

851 TGAAACATAA ATGTGTTTAC AGTATCCGTT TGATGTCGGC ATTGTAA
```

This corresponds to the amino acid sequence <SEQ ID 2660; ORF 772>:

```
m772.pep
  1 MFGAVLRIDA DCLQIIVACK LFQIVAYGFA ALVEGEFHEF GKMLEIVRLA
```

-continued

```
 51 DAVFHRNHTD DGGIHFRRRV ERFGRYVNQH FHIEKILQHH AQAAVVVAFR

101 RGNHTLDHFF LQHKVHIDDI VRHLRQLEQK RCGNVVREVA DDFLFACDAV

151 EIKLQYIAFV NHQFIRKRQR FQTAYDVAVD FDNVQAVQLF RQRFGNRRQT

201 RADFNHDIIR LRAHGVDNIA DNPRVLQKIL PETLAGFVFF HRVSFSVETP

251 PFRAVESDSI WEGRNSFQIR MAHRAVLYVS SCVLKHKCVY SIRLMSAL*
```

Computer analysis of this amino acid sequence gave the following results:

Homology with a Predicted ORF from *N. gonorrhoeae*

ORF 772 shows 85.2% identity over a 298 aa overlap with a predicted ORF (ORF 772) from *N. gonorrhoeae*

```
m772/g772  85.2% identity in 298 aa overlap

                       10        20        30        40        50        60
g772.pep      VFGTVLRTDADCLQIIVVGKFFQVVAYGFAALAEGEFHQFGEMIEIVRLADTVFHRNHAH
              :||:||| |||||||||: |:||:||||||||:|||||:||:|:|||||||:||||||: 
m772          MFGAVLRIDADCLQIIVACKLFQIVAYGFAALVEGEFHEFGKMLEIVRLADAVFHRNHTD
                       10        20        30        40        50        60

                       70        80        90       100       110       120
g772.pep      HCGIDFRRGIERFGRHVNQQLHIEKILQHHTQATVVVAFRRGNHALDHFFLQHKVHIGDI
                || |||  :|||||:|||::|||||||||:||:||||||||||:|||||||||||| ||
m772          DGGIHFRRRVERFGRYVNQHFHIEKILQHHAQAAVVVAFRRGNHTLDHFFLQHKVHIDDI
                       70        80        90       100       110       120

                      130       140       150       160       170       180
g772.pep      VRHLRQFEQKRRGDVIRQVADDFLFAXDAVEIKLQHVAFVNHQFIRKRQRFQTAYDVAVD
              ||||||:|||| |:|:|:|||||||| ||||||||::|||||||||||||||||||||||
m772          VRHLRQLEQKRCGNVVREVADDFLFACDAVEIKLQYIAFVNHQFIRKRQRFQTAYDVAVD
                      130       140       150       160       170       180

                      190       200       210       220       230       240
g772.pep      FDNVQAVQLFRQRFGNCRQTRADFNHDIIRLRAHGVDNIADNPRVLQKILPETLAGFVFF
              |||||||||||||||| |||||||||||||||||||||||||||||||||||||||||||
m772          FDNVQAVQLFRQRFGNRRQTRADFNHDIIRLRAHGVDNIADNPRVLQKILPETLAGFVFF
                      190       200       210       220       230       240

                      250       260       270       280       290      299
g772.pep      HRVSSSVETPPFRAAGSDSVWAGRNPFQIRTTHRAVLYVSSCVLEHKCVYSIRLMSALX
              |||| |||||||||: |||:| ||| |||| :||||||||||||:||||||||||||||
m772          HRVSFSVETPPFRAVESDSIWEGRNSFQIRMAHRAVLYVSSCVLKHKCVYSIRLMSALX
                      250       260       270       280       290
```

The following partial DNA sequence was identified in *N. meningitidis* <SEQ ID 2661>:

```
a772.seq
  1 ATGTTCGGCG CGGTCTTGCG GATTGATGCC GACTGCCTGC AAATCATCGT

 51 CGCCTGCAAG CTCTTTCAGA TTGTTGCGTA TGGTTTTGCG GCGTTGGTGG

101 AAGGCGAGTT TCACGAGTTT GGCGAAATGC TCGAAATCGT CCGCCTTGCC

151 GATACGGTGT TTCACCGGAA TCATGCGGAC GACGGCCGAA TCCACTTTCG

201 GCGCGGGGTC GAACGATTCG GGCGGCACGT CAATCAGCAT TTCCATATCG

251 AAGAAATATT GCAGCATCAC GCCCAAGCGG CCGTAGTCGT TGCTTTTCGG

301 CGCGGCAACC ATACGATCGA CCACTTCTTT TTGCAGCATA AAGTGCATAT

351 CGACGACATC GTCCGCCACC TCCGCCAGCT TGAACAAAAG CGGCGTGGAA

401 ATGTTGTAGG GCAGGTTGCC GACGATTTTC TTTTTGCCTG CGATGCCGTT

451 GAAATCAAAC TGCAATACAT CGCCTTCGTG AATCACCAGT TTATCCGCAA

501 ACGGCAGCGT TTTCAGACGG CATACGATGT CGCGGTCGAT TTCGACAACG

551 TGCAGGCGGT TCAGCTTTTT CGCCAAAGGT TCGGTAATCG CCGCCAAACC

601 CGGACCGATT TCAATCACGA CATCATCCGC CTGCGGGCGC ACGGCGTTGA
```

-continued

```
651 CAATATCGCT GATAATCCGC GTGTCCTGCA AAAAATTCTG CCCGAAACGC

701 TTGCGGGCTT TGTGTTCTTT CATCGTGTTT CCTTTTCGGT TGAAACCCCG

751 CCCTTTAGGG CGGTAGAATC AGACTCTATT TGGGAGGGGC GTAACTCCTT

801 CCAAATCAGG ACGGCACATA GGGCGGTGCT TTATGTGTCG TCCTGTGTGT

851 TGAAACATAA ATGTGTTTAC AGTATCCGTT TGATGTCGGC ATTGTAA
```

This corresponds to the amino acid sequence <SEQ ID 2662; ORF 772.a>:

```
a772.pep
  1 MFGAVLRIDA DCLQIIVACK LFQIVAYGFA ALVEGEFHEF GEMLEIVRLA

 51 DTVFHRNHAD DGRIHFRRGV ERFGRHVNQH FHIEEILQHH AQAAVVVAFR

101 RGNHTIDHFF LQHKVHIDDI VRHLRQLEQK RRGNVVGQVA DDFLFACDAV

151 EIKLQYIAFV NHQFIRKRQR FQTAYDVAVD FDNVQAVQLF RQRFGNRRQT

201 RTDFNHDIIR LRAHGVDNIA DNPRVLQKIL PETLAGFVFF HRVSFSVETP

251 PFRAVESDSI WEGRNSFQIR TAHRAVLYVS SCVLKHKCVY SIRLMSAL*
```

Computer analysis of this amino acid sequence gave the following results:

Homology with a Predicted ORF from *N. meningitidis*

ORF 772 shows 95.6% identity over a 298 aa overlap with a predicted ORF (ORF 772) from *N. meningitidis*

```
m772/a772  95.6% identity in 298 aa overlap

                   10        20        30        40        50        60
a772.pep   MFGAVLRIDADCLQIIVACKLFQIVAYGFAALVEGEFHEFGEMLEIVRLADTVFHRNHAD
           |||||||||||||||||||||||||||||||||||||||||:|||||||||:||||||:|
m772       MFGAVLRIDADCLQIIVACKLFQIVAYGFAALVEGEFHEFGKMLEIVRLADAVFHRNHTD
                   10        20        30        40        50        60

                   70        80        90       100       110       120
a772.pep   DGRIHFRRGVERFGRHVNQHFHIEEILQHHAQAAVVVAFRRGNHTIDHFFLQHKVHIDDI
           || ||||| |||||:||||||||:||||||||||||||||||||:||||||||||||||
m772       DGGIHFRRRVERFGRYVNQHFHIEKILQHHAQAAVVVAFRRGNHTLDHFFLQHKVHIDDI
                   70        80        90       100       110       120

                  130       140       150       160       170       180
a772.pep   VRHLRQLEQKRRGNVVGQVADDFLFACDAVEIKLQYIAFVNHQFIRKRQRFQTAYDVAVD
           ||||||||||| ||||  ||||||||||||||||||||||||||||||||||||||||||
m772       VRHLRQLEQKRCGNVVREVADDFLFACDAVEIKLQYIAFVNHQFIRKRQRFQTAYDVAVD
                  130       140       150       160       170       180

                  190       200       210       220       230       240
a772.pep   FDNVQAVQLFRQRFGNRRQTRTDFNHDIIRLRAHGVDNIADNPRVLQKILPETLAGFVFF
           |||||||||||||||||||||:||||||||||||||||||||||||||||||||||||||
m772       FDNVQAVQLFRQRFGNRRQTRADFNHDIIRLRAHGVDNIADNPRVLQKILPETLAGFVFF
                  190       200       210       220       230       240

                  250       260       270       280       290      299
a772.pep   HRVSFSVETPPFRAVESDSIWEGRNSFQIRTAHRAVLYVSSCVLKHKCVYSIRLMSALX
           |||||||||||||||||||||||||||||| |||||||||||||||||||||||||||
m772       HRVSFSVETPPFRAVESDSIWEGRNSFQIRMAHRAVLYVSSCVLKHKCVYSIRLMSALX
                  250       260       270       280       290

g773.seq not found yet
g773.pep not found yet
```

The following partial DNA sequence was identified in *N. meningitidis* <SEQ ID 2663>:

```
m773.seq
  1 ATGGGATTGG GTGCAACGAC TTTTGTCGGT TCGGGTGCTA TAGGCGGAGG

 51 TCTGTGCAGT ACCGGGATTG GCTGTGCGGC CGGTGGACTT ATTGCAACGG

101 CAGGTATGAC CGGTGGTTAT ACACAGGCCT CAGAAGGAAG CCGGCAATTG
```

-continued

```
151 TTTGGCACTT ACCAGTCCGA TTTTGGTAAA AAAGTTGTCC TATCTTTGGG

201 TACACCAATA GAATACGAAT CGCCGTTAGT ATCTGATGCG AAAAATCTAG

251 CCGTATGGGG ATTGGAAACG CTGATTACGC GCAAATTGGG AAACTTGGCA

301 ACGGGTGTGA AAACTTCCTT GACTCCGAAA ACTGCTGACG TACAGCGAAA

351 TATCCTGTCC CAATCCGAAG TCGGTATCAA GTGGGGCAAG GGGATTGAAG

401 GACAGGGAAT GCCTTGGGAG GATTATGTCG GTAAGGGCTT GTCTGCCAAT

451 GCAAGGTTAC CTAAAAATTT TAAAACATTT GATTATTTTG ATCGTGGTAC

501 AGGCACGGCA ATCAGTGCCA AAACTCTGGA TACGCAAACT ACGGCACGCC

551 TGTCCAAACC CGAACAGCTT TACAGTACCA TGAAAGGGTA CATCGATAAG

601 ACGGCAAATT TCAAAAGTTA TGAATTATCA GAAGTACCGT TAAGGGCAGA

651 CATGATCAAA CAGCGCGAAA TCCATCTGGC CATACCCGCA CAAACTAATA

701 AGGAGCAAAG ATTGCAGTTG CAACGTGTGG TAGAGTATGG CAAAAGTCAA

751 AACATTACAG TCAAAATTAC GGAGATCGAA TAA
```

This corresponds to the amino acid sequence <SEQ ID 2664; ORF 773>:

```
m773.pep
  1 MGLGATTFVG SGAIGGGLCS TGIGCAAGGL IATAGMTGGY TQASEGSRQL

 51 FGTYQSDFGK KVVLSLGTPI EYESPLVSDA KNLAVWGLET LITRKLGNLA

101 TGVKTSLTPK TADVQRNILS QSEVGIKWGK GIEGQGMPWE DYVGKGLSAN

151 ARLPKNFKTF DYFDRGTGTA ISAKTLDTQT TARLSKPEQL YSTMKGYIDK

201 TANFKSYELS EVPLRADMIK QREIHLAIPA QTNKEQRLQL QRVVEYGKSQ

251 NITVKITEIE *

a773.seq not found yet
a773.pep not found yet
```

The following partial DNA sequence was identified in *N. gonorrhoeae* <SEQ ID 2665>:

```
g774.seq
  1 ATGAAGACCA AATTACCGCT TTTTATCATT TGGCTGTCTG TGTCTGCCTC

 51 CTGTGCTTCC GTTTTACCCG TTCCGGAGGG CAGCCGAACC GAAATGCCGA

101 CACAGGAAAA TGCTTCAGAC GGCATTCCCT ATCCCGTTCC CACTCTGCAA

151 GACCGTTTGG ACTATCTGGA AGGCAAAATC GTCCGGCTGT CGAACGAAGT

201 GGAAATGTTA AACGGGAAAG TCAAAGCATT GGAGCATACG AAAATACACC

251 CTTCCGGCAG GACATACGTC CAAAAACTCG ACGACCGCAA ATTGAAAGAG

301 CATTACCTCA ATACCGAAGG CGGCAGCGCA TCCGCACATA CCGTCGAAAC

351 CGCACAAAAC CTCTACAATC AGGCACTCAA ACACTATCAA AACGGCAGGT

401 TTTCTGCCGC AGCCGCCTTG TTGAAGGGGG CGGACGGCGG AGACGGCGGC

451 AGCATCGCGC AACGCAGTAT GTACCTGTTG CTGCAAAGCA GGGCGCGTAT

501 GGGGAACTGT GAATCTGTCA TCGAAATCGG AGGGCGTTAC GCCAACCGTT

551 TCAAAGACAG CCCAACCGCG CCCGAAGTCA TATTCAAAAT CGGCGAATGC

601 CAATACAGGC TTCAGCAAAA AGACATTGCA AGGGCGACTT GGCGCAGCCT

651 GATACAGACC TATCCCGGCA GCCCGGCGGC AAAACGCGCC GCCGCAGCCG
```

-continued

```
701 TACGCAAACG ATAG
```

This corresponds to the amino acid sequence <SEQ ID 2666; ORF 774.ng>:

```
g774.pep
   1 MKTKLPLFII WLSVSASCAS VLPVPEGSRT EMPTQENASD GIPYPVPTLQ

  51 DRLDYLEGKI VRLSNEVEML NGKVKALEHT KIHPSGRTYV QKLDDRKLKE

 101 HYLNTEGGSA SAHTVETAQN LYNQALKHYQ NGRFSAAAAL LKGADGGDGG

 151 SIAQRSMYLL LQSRARMGNC ESVIEIGGRY ANRFKDSPTA PEVIFKIGEC

 201 QYRLQQKDIA RATWRSLIQT YPGSPAAKRA AAAVRKR*
```

The following partial DNA sequence was identified in *N. meningitidis* <SEQ ID 2667>:

```
m774.seq
   1 ATGAAGATCA AATTACCGCT TTTTATCATT TGGCTGTCTG TGTCCGCCTC

  51 CTGTGCTTCC GTTTCACCCG TTCCGGCAGG CAGCCAAACC GAAATGTCGA

 101 CACGGGAAAA TGCTTCAGAC GGCATTCCCT ATCCCGTTCC GACCTTGCAA

 151 GACCGTTTGG ACTATCTGGA AGGCAAAATC GTCCGGCTGT CGAACGAAGT

 201 GGAAACCTTA AACGGCAAAG TCAAAGCACT GGAACACGCA AAAACACATT

 251 CTTCCGGCAG GGCATACGTC CAAAAACTCG ACGACCGCAA GTTGAAAGAG

 301 CATTACCTCA ATACCGAAGG CGGCAGCGCA TCCGCACATA CTGTCGAAAC

 351 CGCACAAAAC CTCTACAATC AGGCACTCAA ACACTATAAA AGCGGCAAGT

 401 TTTCTGCCGC TGCCTCCCTG TTGAAAGGCG CGGACGGAGG CGACGGCGGC

 451 AGCATCGCGC AACGCAGTAT GTACCTGTTG CTGCAAAGCA GGGCGCGTAT

 501 GGGCAACTGC GAATCCGTCA TCGAAATCGG AGGGCGTTAC GCCAACCGTT

 551 TCAAAGACAG CCCAACCGCG CCTGAAGCCA TGTTCAAAAT CGGCGAATGC

 601 CAATACAGGC TTCAGCAAAA AGACATTGCA AGGGCGACTT GGCGCAGCCT

 651 GATACAGACC TATCCCGGCA GCCCGGCGGC AAAACGCGCC GCCGCAGCCG

 701 TGCGCAAACG ATAG
```

This corresponds to the amino acid sequence <SEQ ID 2668; ORF 774>:

```
m774.pep
   1 MKIKLPLFII WLSVSASCAS VSPVPAGSQT EMSTRENASD GIPYPVPTLQ

  51 DRLDYLEGKI VRLSNEVETL NGKVKALEHA KTHSSGRAYV QKLDDRKLKE

 101 HYLNTEGGSA SAHTVETAQN LYNQALKHYK SGKFSAAASL LKGADGGDGG

 151 SIAQRSMYLL LQSRARMGNC ESVIEIGGRY ANRFKDSPTA PEAMFKIGEC

 201 QYRLQQKDIA RATWRSLIQT YPGSPAAKRA AAAVRKR*
```

Computer analysis of this amino acid sequence gave the following results:

Homology with a Predicted ORF from *N. gonorrhoeae*

ORF 774 shows 92.8% identity over a 237 aa overlap with a predicted ORF (ORF 774) from *N. gonorrhoeae*

```
m774/g774  92.8% identity in 237 aa overlap

                   10        20        30        40        50        60
g774.pep   MKTKLPLFIIWLSVSASCASVLPVPEGSRTEMPTQENASDGIPYPVPTLQDRLDYLEGKI
           || |||||||||||||||||| ||| ||:||| |:|||||||||||||||||||||||||
m774       MKIKLPLFIIWLSVSASCASVSPVPAGSQTEMSTRENASDGIPYPVPTLQDRLDYLEGKI
                   10        20        30        40        50        60

                   70        80        90       100       110       120
g774.pep   VRLSNEVEMLNGKVKALEHTKIHPSGRTYVQKLDDRKLKEHYLNTEGGSASAHTVETAQN
           |||||||| ||||||||||:| | |||:||||||||||||||||||||||||||||||||
m774       VRLSNEVETLNGKVKALEHAKTHSSGRAYVQKLDDRKLKEHYLNTEGGSASAHTVETAQN
                   70        80        90       100       110       120

                  130       140       150       160       170       180
g774.pep   LYNQALKHYQNGRFSAAAALLKGADGGDGGSIAQRSMYLLLQSRARMGNCESVIEIGGRY
           |||||||||::|:|||||:|||||||||||||||||||||||||||||||||||||||||
m774       LYNQALKHYKSGKFSAAASLLKGADGGDGGSIAQRSMYLLLQSRARMGNCESVIEIGGRY
                  130       140       150       160       170       180

                  190       200       210       220       230
g774.pep   ANRFKDSPTAPEVIRKIGECQYRLQQKDIARATWRSLIQTYPGSPAAKRAAAAVRKRX
           |||||||||||||::|||||||||||||||||||||||||||||||||||||||||||
m774       ANRFKDSPTAPEAMFKIGECQYRLQQKDIARATWRSLIQTYPGSPAAKRAAAAVRKRX
                  190       200       210       220       230
```

The following partial DNA sequence was identified in *N. meningitidis* <SEQ ID 2669>:

```
a774.seq
   1 ATGAAGACCA AATTACCGCT TTTTATCATT TGGCTGTCCG TATCCGCCGC

  51 CTGTTCTTCC CCTGTTTCCC GCAATATTCA GGATATGCGG CTCGAACCGC

 101 AGGCAGAGGC AGGTAGTTCG GACGCTATTC CCTATCCCGT TCCCACTCTG

 151 CAAGACCGTT TGGATTATCT GGAAGGCACA CTCGTCCGCC TGTCGAACGA

 201 AGTGGAAACC TTAAACGGCA AAGTCAAAGC ACTGGAGCAT GCGAAAACAC

 251 ACCCTTCCAG CAGGGCATAC GTCCAAAAAC TCGACGACCG CAAGTTGAAA

 301 GAGCATTACC TCAATACCGA AGGCGGCAGC GCATCCGCAC ATACCGTCGA

 351 AACCGCACAA AACCTCTACA ATCAGGCACT CAAACACTAT AAAAGCGGCA

 401 GGTTTTCTGC CGCTGCCTCC CTGTTGAAAG GCGCGGACGG AGGCGACGGC

 451 GGCAGCATCG CGCAACGCAG TATGTACCTG TTGCTGCAAA GCAGGGCGCG

 501 TATGGGCAAC TGCGAATCCG TCATCGAAAT CGGAGGGCGT TACGCCAACC

 551 GTTTCAAAGA CAGCCCAACC GCGCCTGAAG CCATGTTCAA AATCGGCGAA

 601 TGCCAATACA GGCTTCAGCA AAAAGACATT GCAAGGGCGA CTTGGCGCAG

 651 CCTGATACAG ACCTATCCCG GCAGCCCGGC GGCAAAACGC GCCGCCGCAG

 701 CCGTGCGCAA ACGATAG
```

This corresponds to the amino acid sequence <SEQ ID 2670; ORF 774.a>:

```
a774.pep
   1 MKTKLPLFII WLSVSAACSS PVSRNIQDMR LEPQAEAGSS DAIPYPVPTL

  51 QDRLDYLEGT LVRLSNEVET LNGKVKALEH AKTHPSSRAY VQKLDDRKLK

 101 EHYLNTEGGS ASAHTVETAQ NLYNQALKHY KSGRFSAAAS LLKGADGGDG

 151 GSIAQRSMYL LLQSRARMGN CESVIEIGGR YANRFKDSPT APEAMFKIGE

 201 CQYRLQQKDI ARATWRSLIQ TYPGSPAAKR AAAAVRKR*
```

Computer analysis of this amino acid sequence gave the following results:

Homology with a Predicted ORF from *N. meningitidis*

ORF 774 shows 89.5% identity over a 238 aa overlap with a predicted ORF (ORF 774) from *N. meningitidis*

```
m774/a774   89.5% identity in 238 aa overlap

                   10        20        30        40        50        60
a774.pep   MKTKLPLFIIWLSVSAACSSPVSRNIQDMRLEPQAEAGSSDAIPYPVPTLQDRLDYLEGT
           || |||||||||||||:|:| ||      : | ::: ::||:||||||||||||||||||
m774       MKIKLPLFIIWLSVSASCAS-VSPVPAGSQTEMSTRENASDGIPYPVPTLQDRLDYLEGK
                   10        20         30        40        50
                   70        80        90       100       110       120
a774.pep   LVRLSNEVETLNGKVKALEHAKTHPSSRAYVQKLDDRKLKEHYLNTEGGSASAHTVETAQ
           :||||||||||||||||||||||| |:|||||||||||||||||||||||||||||||||
m774       IVRLSNEVETLNGKVKALEHAKTHSSGRAYVQKLDDRKLKEHYLNTEGGSASAHTVETAQ
          60        70        80        90       100       110
                  130       140       150       160       170       180
a774.pep   NLYNQALKHYKSGRFSAAASLLKGADGGDGGSIAQRSMYLLLQSRARMGNCESVIEIGGR
           ||||||||||||||:|||||||||||||||||||||||||||||||||||||||||||||
m774       NLYNQALKHYKSGKFSAAASLLKGADGGDGGSIAQRSMYLLLQSRARMGNCESVIEIGGR
         120       130       140       150       160       170
                  190       200       210       220       230      239
a774.pep   YANRFKDSPTAPEAMFKIGECQYRLQQKDIARATWRSLIQTYPGSPAAKRAAAAVRKRX
           |||||||||||||||||||||||||||||||||||||||||||||||||||||||||||
m774       YANRFKDSPTAPEAMFKIGECQYRLQQKDIARATWRSLIQTYPGSPAAKRAAAAVRKRX
         180       190       200       210       220       230

g790. seq not found yet
g790. pep not found yet
```

The following partial DNA sequence was identified in *N. meningitidis* <SEQ ID 2671>:

```
m790.seq
  1  ATGGCAAGAA GGTCAAAAAC ATTTGAAGAA GCTGCTGCTG AGGTTGAGGA

 51  ACGTTTCGGT CATCGTGGCA TTAAGTTGGT CGAGTTTGAG GGTACAGCCA

101  AGCCGTGTGT AATCAACTGC CCTAAACATG GAAACCAAAC CTGTTCGAGG

151  TACTCCAATA TGTTCATAGG AAGTAGCTGG GGTTGCCCCT CTTGTGGTAA

201  TGAGCAAGCT GCAAAAGCCG GTATAGCGAC CCTTAGGAAG AATCACATAG

251  CGTTAGAAAT GCTGAAACAG GCTGTAACAG GTATGACCAA GCAAGAGCGC

301  ATCACGACGC AAGCCTACAA TGAGATGACC AAATCCGTGG CAGGTTCAAA

351  CAGCATAGTC CTTAACGATG TCCAAGGCGA TACGACCATC AACAACCATC

401  ATACGCATAC GCACAACCAC AGCGATGCCG ATGGCAAAGC ACTGTCGATG

451  AGGCTCACAC CCCGTCCTTT GTTGTCAGAC CGTCAGGCGG CGGCTTTCGC

501  CCGTACAGGC AAACTCACGG GCAGTTTCGA CCTGTTTGCT TCGGTGgTCG

551  CCCCCTCGCA GTACACGTTT GCCGTTGCCA TGCCCGACAC GTCCATGTCG

601  CCGGTTATCG AAAAGGGAGA CTTGCTGGTG GTCGAGCCGC GTATGTGCCC

651  TGCGGACGAA GACATCGCGC TGATTGAACT GTCCGACAAG CGGCTGGTCG

701  TCGCGCACCT TGTTATCGAT ATTGCGGGCA GGATGCTGAT TTATCAGACG

751  GGCAGGCCGT CTGAAGCCTT TGACCTGCCC GAAGGCAGCA CGATTTTAGG

801  TGTGGTGCTG GAGTCAAAAA ACGGTTTATG TCCGCCGCAC AGGCAAGAAG

851  GCGTGTTGAT TCGGATTACC GCCCCTGATG TGTGGACGGT TGGTATGATT

901  TCCGCTTCCA AAACGTCGTG TACGCGCCCG ACCGCAGCCC GGAAATCAGC
```

-continued

```
 951 CGTATGCTTT CTTCGATTTT GGCAGGCTAC GCGTGGGATA CCGAAAACCC

1001 GTTCGTGGCG AAATCCGAAC AACGCCTGA
```

This corresponds to the amino acid sequence <SEQ ID 2672; ORF 790>:

```
m790.pep
  1MARRSKTFEE AAAEVEERFG HRGIKLVEFE GTAKPCVINC PKHGNQTCSR

 51YSNMFIGSSW GCPSCGNEQA AKAGIATLRK NHIALEMLKQ AVTGMTKQER

101ITTQAYNEMT KSVAGSNSIV LNDVQGDTTI NNHHTHTHNH SDADGKALSM

151RLTPRPLLSD RQAAAFARTG KLTGSFDLFA SVVAPSQYTF AVAMPDTSMS

201PVIEKGDLLV VEPRMCPADE DIALIELSDK RLVVAHLVID IAGRMLIYQT

251GRPSEAFDLP EGSTILGVVL ESKNGLCPPH RQEGVLIRIT APDVWTVGMI

301SASKTSCTRP TAARKSAVCF LRFWQATRGI PKTRSWRNPN NA*
```

The following partial DNA sequence was identified in *N. meningitidis* <SEQ ID 2673>:

```
a790.seq
   1 ATGGCAAGAA GGTCAAAAAC ATTTGAAGAA GCTGCTGCTG AGGTTGAGGA

  51 ACGTTTCGGT CATCGTGGCA TTAAGTTGGT CGAGTTTGAG GGTACAGCCA

 101 AGCCGTGTGT AATCAACTGC CCTAAACATG GAAACCAAAC CTGTTCGAGG

 151 TACTCCAATA TGTTCATAGG AAGTAGCTGG GGTTGCCCCT CTTGTGGTAA

 201 TGAGCAAGCT GCAAAAGCCG GTATAGCGAC CCTTAGGAAG AATCACATAG

 251 CGTTAGAAAT GCTGAAACAG GCTGTAACAG GTATGACCAA GCAAGAGCGC

 301 ATCACGACGC AAGCCTACAA TGAGATGACC AAATCCGTGG CAGGTTCAAA

 351 CAGCATAATC CTTAACGATG TCCAAGGCGA TACGACCATC AACAACCATC

 401 ATACGCATAC GCACAACCAC AGCGATGCCG ACGGCAAAGC ACTGTCGATG

 451 AGGCTCACAC CCCGTCCTTT GTTGTCAGAC CGTCAGGCGG CGGCTTTCGC

 501 CCGTACAGGC AAACTCACGG GCAGTTTCGA CCTGTTTGCT TCGGTGGTCG

 551 CCCCTTCACA ATATACGTTT GCCGTTGCCA TGCCCGACAC GTCCATGTCG

 601 CCGGTTATCG AAAAGGGGGA TTTGCTGGTG GTCGAGCCGC GTATGCGCCC

 651 TGCGGACGAA GACATCGTAC TGATTGAACT GTCCGACAAG CGGCTGGTCG

 701 TCGCGCACCT TGTTATCGAT ATTGCGGGCA GGATGCTGAT TTATCAGACG

 751 GGCAGGCCGT CTGAAGCCCT CGACCTGCCC GAAGGCAGCG TGATTTTAGG

 801 TGTGGTGCTG GAGTCAAAAA ACGGTTTATG TCCGCCGCAC AGGCAAGAAG

 851 GCGTGTTGAT TCGGATTACC GCCCCTGATG TGTGGACGGT TGGTACGATT

 901 TCCGCTTCCA AAACGTCGTG TACGCGCCCG ACCGCAGCCC GGAAATCAGC

 951 CGTATGCTTT CTTCGATTTT GGCAGGCTAC GCGTGGGATA CCGAAAACCC

1001 GTTCGTGGCG AAATCCGAAC AACGCCTGT
```

This corresponds to the amino acid sequence <SEQ ID 2674; ORF 790.a>:

```
a790.pep
 1 MARRSKTFEE AAAEVEERFG HRGIKLVEFE GTAKPCVINC PKHGNQTCSR
```

-continued

```
 51YSNMFIGSSW GCPSCGNEQA AKAGIATLRK NHIALEMLKQ AVTGMTKQER

101ITTQAYNEMT KSVAGSNSII LNDVQGDTTI NNHHTHTHNH SDADGKALSM

151RLTPRPLLSD RQAAAFARTG KLTGSFDLFA SVVAPSQYTF AVAMPDTSMS

201PVIEKGDLLV VEPRMRPADE DIVLIELSDK RLVVAHLVID IAGRMLIYQT

251GRPSEALDLP EGSVILGVVL ESKNGLCPPH RQEGVLIRIT APDVWTVGTI

301SASKTSCTRP TAARKSAVCF LRFWQATRGI PKTRSWRNPN NAC
```

Computer analysis of this amino acid sequence gave the following results:

Homology with a Predicted ORF from *N. meningitidis*

ORF 790 shows 98.2% identity over a 342 aa overlap with a predicted ORF (ORF 790) from *N. meningitidis*

```
a790/m790  98.2% identity in 342 aa overlap

                    10        20        30        40        50        60
a790.pep   MARRSKTFEEAAAEVEERFGHRGIKLVEFEGTAKPCVINCPKHGNQTCSRYSNMFIGSSW
           ||||||||||||||||||||||||||||||||||||||||||||||||||||||||||||
m790       MARRSKTFEEAAAEVEERFGHRGIKLVEFEGTAKPCVINCPKHGNQTCSRYSNMFIGSSW
                    10        20        30        40        50        60

                    70        80        90       100       110       120
a790.pep   GCPSCGNEQAAKAGIATLRKNHIALEMLKQAVTGMTKQERITTQAYNEMTKSVAGSNSII
           |||||||||||||||||||||||||||||||||||||||||||||||||||||||||||:
m790       GCPSCGNEQAAKAGIATLRKNHIALEMLKQAVTGMTKQERITTQAYNEMTKSVAGSNSIV
                    70        80        90       100       110       120

                   130       140       150       160       170       180
a790.pep   LNDVQGDTTINNHHTHTHNHSDADGKALSMRLTPRPLLSDRQAAAFARTGKLTGSFDLFA
           ||||||||||||||||||||||||||||||||||||||||||||||||||||||||||||
m790       LNDVQGDTTINNHHTHTHNHSDADGKALSMRLTPRPLLSDRQAAAFARTGKLTGSFDLFA
                   130       140       150       160       170       180

                   190       200       210       220       230       240
a790.pep   SVVAPSQYTFAVAMPDTSMSPVIEKGDLLVVEPRMRPADEDIVLIELSDKRLVVAHLVID
           ||||||||||||||||||||||||||||||||||| ||||||:|||||||||||||||||
m790       SVVAPSQYTFAVAMPDTSMSPVIEKGDLLVVEPRMCPADEDIALIELSDKRLVVAHLVID
                   190       200       210       220       230       240

                   250       260       270       280       290       300
a790.pep   IAGRMLIYQTGRPSEALDLPEGSVILGVVLESKNGLCPPHRQEGVLIRITAPDVWTVGTI
           ||||||||||||||||:||||||:|||||||||||||||||||||||||||||||||| |
m790       IAGRMLIYQTGRPSEAFDLPEGSTILGVVLESKNGLCPPHRQEGVLIRITAPDVWTVGMI
                   250       260       270       280       290       300

                   310       320       330       340
a790.pep   SASKTSCTRPTAARKSAVCFLRFWQATRGIPKTRSWRNPNNAC
           ||||||||||||||||||||||||||||||||||||||||||
m790       SASKTSCTRPTAARKSAVCFLRFWQATRGIPKTRSWRNPNNAX
                   310       320       330       340
```

The following partial DNA sequence was identified in *N. gonorrhoeae* <SEQ ID 2675>:

```
g791.seq
  1   ATGGTAAATT ATTATTCAGC TATGATTAAA AAGATTTTAA CTACTTGTTT

 51   TGGTTTGTTT TTTGGTTTTT GTGTATTTGG AGTGGGTCTG GTTGCCATTG

101   CTATTTTGGT AACGTATCCG AAACTGCCGT CTTTGGATTC TTTGCAGCAT

151   TACCAGCCTA AAATGCCGTT GACTATTTAT TCGGCGGATG GAGAAGTCAT

201   CGGTATGTAT GGGGAGCAGC GGCGCGAATT TACAAAAATC GGCGATTTCC

251   CCGAGGTGTT GCGGAATGCG GTTATTGCCG CCGAGGATAA ACGCTTTTAC

301   CGGCATTGGG GGGTGGATGT TTGGGGTGTT GCCCGCGCTG CCGTCGGCAA

351   TGTCGTGTCC GGCAGCGTGC AGTCGGGTGC GAGTACGATT ACACAGCAGG

401   TGGCGAAAAA TTTTTATTTG AGCAGTGAAA AAACGTTCAC ACGCAAATTC

451   AATGAGGTGT TGCTTGCCTA TAAAATCGAG CAGTCTTTAA GCAAAGACAA
```

-continued

```
 501 AATCCTTGAG TTGTATTTCA ATCAGATTTA CCTCGGTCAG CGCGCCTATG
 551 GTTTTGCATC TGCCGCGCAA ATCTATTTCA ATAAGAATGT CCGAGATTTG
 601 ACTTTGGCGG AAGCCGCCAT GCTTGCGGGA CTGCCCAAGG CTCCGTCTGC
 651 CTATAATCCG ATTGTTAATC CGGAGCGTGC CAAGTTGCGC CAGAAGTATA
 701 TTTTGAACAA TATGCTCGAG GAGAAGATGA TTACCGTGCA ACAGCGCGAT
 751 CAGGCATTGA ATGAGGAACT GCATTATGAG CGGTTTGTTC GGAAAATCGA
 801 TCAGAGTGCT TTATATGTGG CGGAAATGGT GCGTCGGGAA CTGTATGAGA
 851 AATATGGTGA AGATGCCTAT ACGCAGGGTT TTAAGGTTTA TACCACGGTC
 901 CGCACCGATC ATCAGAAGGC GGCAACCGAG GCATTGCGCA AGGCTCTACG
 951 GAATTTCGAT CGCGGCAGCA GCTACCGCGG TGCGGAAAAC TATATCGATT
1001 TGAGTAAGAG TGAAGATGTC GAGGAGACTG TCAGCCAGTA TCTGTCGGGA
1051 CTCTATACCG TCGATAAAAT GGTTCCCGCC GTTGTGTTGG ATGTTACTAA
1101 AAAGAAAAAT GTCGTCATAC AGCTGCCCGG CGGCAGGCGG GTTGCGCTTG
1151 ACAGGCGCGC CTTGGGTTTT GCGGCCCGAG CGGTCGATAA TGAGAAAATG
1201 GGGGAGGACC GTATCCGCAG GGGCGCGGTC ATCCGTGTCA AAAACAACGG
1251 CGGGCGTTGG GCGGTGGTTC AAGAGCCGTT GCTGCAGGGG GCTTTGGTTT
1301 CGCTGGATGC AAAAACCGGA GCTGTGCGCG CGCTGGTCGG CGGTTATGAT
1351 TTTCACAGCA AAACATTCAA TCGTGCCGTT CAGGCAATGC GGCAGCCGGG
1401 TTCGACCTTT AAGCCGTTTG TCTATTCGGC GGCATTATCT AAGGGGATGA
1451 CCGCGTCCAC AGTGGTTAAC GATGCGCCGA TTTCCCTGCC GGGGAAAGGG
1501 CCGAACGGTT CGGTTTGGAC ACCTAAAAAT TCAGACGGCA GATATTCCGG
1551 CTACATTACT TTGAGACAGG CTCTGACGGC TTCCAAGAAT ATGGTTTCCA
1601 TCCGTATTTT GATGTCTATC GGTGTCGGTT ACGCGCAACA GTATATCCGG
1651 CGTTTCGGCT TCAGGCCGTC CGAGCTGCCG GCAAGCCTGT CTATGGCTTT
1701 AGGTACGGGC GAGACGACGC CGTTGAAAGT GGCGGAGGCA TATAGTGTAT
1751 TTGCGAACGG CGGATATAGG GTTTCTTCGC ACGTGATCGA TAAGATTTAT
1801 GACAGAGACG GCAGGTTGCG CGCCCAAATG CAACCTTTGG TGGCAGGGCA
1851 AAATGCGCCT CAGGCAATCG ATCCGCGCAA TGCCTATATT ATGTATAAGA
1901 TTATGCAGGA TGTGGTCCGT GTCGGTACGG CAAGGGGGGC AGCTGCGTTG
1951 GGAAGAACGG ATATTGCCGG TAAAACGGGT ACGACCAACG ACAATAAAGA
2001 TGCGTGGTTT GTCGGTTTTA ACCCTGATGT GGTTACTGCC GTATATATCG
2051 GCTTCGACAA ACCTAAGAGT ATGGGGCGTG CCGGCTACGG CGGTACGATT
2101 GCGGTGCCGG TTTGGGTGGA CTATATGCGT TTTGCGTTGA AAGGAAAGCA
2151 GGGCAAAGGG ATGAAAATGC CTGAAGGTGT GGTCAGCAGC AATGGCGAAT
2201 ACTATATGAA GGAACGTATG GTAACCGATC CGGGCTTGAT GCTGGACAAC
2251 AGCGGTATTG CGCCGCAACC TTCCCGACGG GCAAAAGAAG ATGATGAAGC
2301 GGCAGTAGAA AACGAACAGC AGGGAAGGTC TGACGAAACG CGTCAGGACG
2351 TACAGGAAAC GCCGGTGCTT CCGAGCAATA CGGATTCCAA ACAGCAGCAG
2401 TTGGATTCCC TGTTTTAA
```

This corresponds to the amino acid sequence <SEQ ID 2676; ORF 791.ng>:

```
g791.pep
  1 MVNYYSAMIK KILTTCFGLF FGFCVFGVGL VAIAILVTYP KLPSLDSLQH

 51 YQPKMPLTIY SADGEVIGMY GEQRREFTKI GDFPEVLRNA VIAAEDKRFY

101 RHWGVDVWGV ARAAVGNVVS GSVQSGASTI TQQVAKNFYL SSEKTFTRKF

151 NEVLLAYKIE QSLSKDKILE LYFNQIYLGQ RAYGFASAAQ IYFNKNVRDL

201 TLAEAAMLAG LPKAPSAYNP IVNPERAKLR QKYILNNMLE EKMITVQQRD

251 QALNEELHYE RFVRKIDQSA LYVAEMVRRE LYEKYGEDAY TQGFKVYTTV

301 RTDHQKAATE ALRKALRNFD RGSSYRGAEN YIDLSKSEDV EETVSQYLSG

351 LYTVDKMVPA VVLDVTKKKN VVIQLPGGRR VALDRRALGF AARAVDNEKM

401 GEDRIRRGAV IRVKNNGGRW AVVQEPLLQG ALVSLDAKTG AVRALVGGYD

451 FHSKTFNRAV QAMRQPGSTF KPFVYSAALS KGMTASTVVN DAPISLPGKG

501 PNGSVWTPKN SDGRYSGYIT LRQALTASKN MVSIRILMSI GVGYAQQYIR

551 RFGFRPSELP ASLSMALGTG ETTPLKVAEA YSVFANGGYR VSSHVIDKIY

601 DRDGRLRAQM QPLVAGQNAP QAIDPRNAYI MYKIMQDVVR VGTARGAAAL

651 GRTDIAGKTG TTNDNKDAWF VGFNPDVVTA VYIGFDKPKS MGRAGYGGTI

701 AVPVWVDYMR FALKGKQGKG MKMPEGVVSS NGEYYMKERM VTDPGLMLDN

751 SGIAPQPSRR AKEDDEAAVE NEQQGRSDET RQDVQETPVL PSNTDSKQQQ

801 LDSLF*
```

The following partial DNA sequence was identified in *N. meningitidis* <SEQ ID 2677>:

```
m791.seq
   1 ATGGTAAATT ATTATTCAGC TATGATTAAA AAGATTTTAA CGACTTGTTT

  51 TGGTTTGGTT TTTGGGTTTT GTGTATTTGG AGTGGGTTTG GTTGCCATTG

 101 CTATTTTGGT AACGTATCCG AAACTGCCGT CTTTGGATTC TTTGCAGCAT

 151 TACCAGCCTA AAATGCCGTT GACTATTTAT TCGGCGGATG GGGAAGTCAT

 201 CGGTATGTAT GGGGAGCAGC GGCGCGAATT TACAAAAATC GGCGATTTCC

 251 CAGAGGTGTT GCGGAATGCG GTTATCGCCG CCGAGGATAA ACGCTTTTAC

 301 CGGCATTGGG GGGTGGATGT TTGGGGTGTT GCCCGCGCTG CCGTCGGCAA

 351 TGTCGTGTCC GGCAGCGTGC AGTCGGGTGC GAGTACGATT ACGCAGCAGG

 401 TGGCGAAAAA TTTTTATTTG AGCAGTGAAA AAACGTTCAC ACGCAAATTC

 451 AATGAGGTGT TGCTTGCCTA TAAAATCGAG CAGTCTTTAA GCAAAGACAA

 501 AATCCTCGAG TTGTATTTCA ATCAGATTTA CCTCGGTCAG CGCGCCTATG

 551 GTTTTGCATC TGCCGCGCAA ATCTATTTCA ATAAGAATGT CCGAGATTTG

 601 ACTTTGGCGG AAGCCGCCAT GCTTGCGGGA CTGCCCAAGG CTCCGTCTGC

 651 CTATAATCCG ATTGTTAATC CAGAACGTGC CAAGTTGCGC CAGAAGTATA

 701 TTTTGAACAA TATGCTCGAG GAGAAGATGA TTACCGTGCA ACAGCGCGAT

 751 CAGGCGTTGA ATGAGGAACT GCATTACGAG CGGTTTGTTC GGAAAATCGA

 801 TCAGAGTGCG TTATATGTGG CGGAAATGGT GCGTCAGGAA CTGTATGAGA

 851 AATACGGTGA AGATGCCTAT ACGCAGGGTT TTAAGGTTTA TACCACGGTC

 901 CGCGCCGATC ATCAGAAGGT GGCAACCGAG GCATTGCGCA AGGCTCTACG

 951 GAATTTCGAT CGCGGCAGCA GCTACCGCGG TGCGGAAAAC TATATCGATT
```

-continued

```
1001 TGAGTAAGAG TGAAGATGTC GAGGAGACTG TCAGCCAGTA TCTGTCGGGA
1051 CTCTATACCG TCGATAAAAT GGTTCCCGCC GTTGTGTTGG ATGTGACTAA
1101 AAAGAAAAAT GTCGTCATAC AGCTGCCCGG CGGCAGGCGG GTTACGCTTG
1151 ACAGGCGCGC CTTGGGTTTT GCGGCCCGCG CGGTCAATAA TGAAAAAATG
1201 GGGGAGGACC GTATCCGCAG GGGCGCGGTC ATCCGTGTCA AAAACAACGG
1251 CGGGCGTTGG GCGGTGGTTC AAGAGCCGTT GCTGCAGGGG GCTTTGGGTT
1301 CGCTGGATGC AAAAACCGGA GCTGTGCGCG CGCTGGTCGG CGGTTATGAT
1351 TTTCACAGCA AAACATTCAA TCGTGCCGTT CAGGCAATGC GGCAGCCGGG
1401 TTCGACCTTT AAGCCGTTTG TCTATTCGGC GGCATTATCT AAGGGGATGA
1451 CCGCGTCCAC AGTGGTTAAC GATGCGCCGA TTTCCCTGCC GGGGAAAGGG
1501 CCGAACGGTT CGGTTTGGAC ACCTAAAAAT TCAGACGGCA GATATTCCGG
1551 CTACATTACT TTGAGACAGG CTCTGACGGC TTCCAAGAAT ATGGTTTCCA
1601 TCCGTATTTT GATGTCTATC GGTGTCGGTT ACGCGCAACA GTATATCCGG
1651 CGTTTCGGCT TCAGGTCGTC CGAGCTGCCG GCAAGCCTGT CTATGGCTTT
1701 AGGTACGGGC GAGACAACGC CGTTGAAAGT GGCGGAGGCA TATAGCGTAT
1751 TTGCGAACGG CGGATATAGG GTTTCTTCGC ACGTAATCGA TAAGATTTAT
1801 GACAGAGACG GCAGGTTGCG CGCCCAAATG CAACCTTTGG TGGCTGGGCA
1851 AAATGCGCCT CAGGCAATCG ATCCGCGCAA TGCCTATATT ATGTATAAGA
1901 TTATGCAGGA TGTGGTCCGT GTTGGTACGG CAAGGGGGGC AGCTGCGTTG
1951 GGAAGAACGG ATATTGCCGG TAAAACGGGT ACGACCAATG ACAATAAGGA
2001 TGCGTGGTTT GTCGGTTTTA ACCCTGATGT GGTTACTGCC GTATATATCG
2051 GCTTCGACAA ACCTAAGAGT ATGGGGCGTG TCGGCTACGG CGGTACGATT
2101 GCGGTGCCGG TTTGGGTGGA CTATATGCGT TTTGCGTTGA AAGGAAAGCA
2151 GGGCAAGGGG ATGAAAATGC CTGAAGGTGT GGTCAGCAGC AATGGCGAAT
2201 ACTATATGAA GGAACGTATG GTAACCGATC CGGGCTTGAC GCTGGACAAC
2251 AGCGGTATTG CGCCGCAACC TTCCCGACGG GCAAAAGAAG ATGACGGGGG
2301 CGCGGCAGAA GGCGGACGGC AGGCGGCGGA TGACGAAGTC CGCCAAGATA
2351 TGCAGGAAAC GCCGGTGCTT CCGAGTAATA CTGGTTCCAA ACAGCAGCAG
2401 TTGGATTCTC TGTTTTAA
```

This corresponds to the amino acid sequence <SEQ ID 2678; ORF 791>:

```
m791.pep
  1 MVNYYSAMIK KILTTCFGLV FGFCVFGVGL VAIAILVTYP KLPSLDSLQH
 51 YQPKMPLTIY SADGEVIGMY GEQRREFTKI GDFPEVLRNA VIAAEDKRFY
101 RHWGVDVWGV ARAAVGNVVS GSVQSGASTI TQQVAKNFYL SSEKTFTRKF
151 NEVLLAYKIE QSLSKDKILE LYFNQIYLGQ RAYGFASAAQ IYFNKNVRDL
201 TLAEAAMLAG LPKAPSAYNP IVNPERAKLR QKYILNNMLE EKMITVQQRD
251 QALNEELHYE RFVRKIDQSA LYVAEMVRQE LYEKYGEDAY TQGRKVYTTV
301 RADHQKVATE ALRKALRNFD RGSSYRGAEN YIDLSKSEDV EETVSQYLSG
351 LYTVDKMVPA VVLDVTKKKN VVIQLPGGRR VTLDRRALGF AARAVNNEKM
```

-continued

```
401  GEDRIRRGAV IRVKNNGGRW AVVQEPLLQG ALGSLDAKTG AVRALVGGYD

451  FHSKTFNRAV QAMRQPGSTF KPFVYSAALS KGMTASTVVN DAPISLPGKG

501  PNGSVWTPKN SDGRYSGYIT LRQALTASKN MVSIRILMSI GVGYAQQYIR

551  RFGFRSSELP ASLSMALGTG ETTPLKVAEA YSVFANGGYR VSSHVIDKIY

601  DRDGRLRAQM QPLVAGQNAP QAIDPRNAYI MYKIMQDVVR VGTARGAAAL

651  GRTDIAGKTG TTNDNKDAWF VGFNPDVVTA VYIGRDKPKS MGRVGYGGTI

701  AVPVWVDYMR FALKGKQGKG MKMPEGVVSS NGEYYMKERM VTDPGLTLDN

751  SGIAPQPSRR AKEDDGGAAE GGRQAADDEV RQDMQETPVL PSNTGSKQQQ

801  LDSLF*
```

g791/m791 97.3% identity in 805 aa overlap

```
                    10        20        30        40        50        60
g791.pep   MVNYYSAMIKKILTTCFGLFFGFCVFGVGLVAIAILVTYPKLPSLDSLQHYQPKMPLTIY
           |||||||||||||||||||||| |||||||||||||||||||||||||||||||||||||
m791       MVNYYSAMIKKILTTCFGLVFGFCVFGVGLVAIAILVTYPKLPSLDSLQHYQPKMPLTIY
                   10        20        30        40        50        60

                   70        80        90       100       110       120
g791.pep   SADGEVIGMYGEQRREFTKIGDFPEVLRNAVIAAEDKRFYRHWGVDVWGVARAAVGNVVS
           ||||||||||||||||||||||||||||||||||||||||||||||||||||||||||||
m791       SADGEVIGMYGEQRREFTKIGDFPEVLRNAVIAAEDKRFYRHWGVDVWGVARAAVGNVVS
                   70        80        90       100       110       120

                  130       140       150       160       170       180
g791.pep   GSVQSGASTITQQVAKNFYLSSEKTFTRKFNEVLLAYKIEQSLSKDKILELYFNQIYLGQ
           ||||||||||||||||||||||||||||||||||||||||||||||||||||||||||||
m791       GSVQSGASTITQQVAKNFYLSSEKTFTRKFNEVLLAYKIEQSLSKDKILELYFNQIYLGQ
                  130       140       150       160       170       180

                  190       200       210       220       230       240
g791.pep   RAYGFASAAQIYFNKNVRDLTLAEAAMLAGLPKAPSAYNPIVNPERAKLRQKYILNNMLE
           ||||||||||||||||||||||||||||||||||||||||||||||||||||||||||||
m791       RAYGFASAAQIYFNKNVRDLTLAEAAMLAGLPKAPSAYNPIVNPERAKLRQKYILNNMLE
                  190       200       210       220       230       240

                  250       260       270       280       290       300
g791.pep   EKMITVQQRDQALNEELHYERFVRKIDQSALYVAEMVRRELYEKYGEDAYTQGFKVYTTV
           ||||||||||||||||||||||||||||||||||||||:|||||||||||||||||||||
m791       EKMITVQQRDQALNEELHYERFVRKIDQSALYVAEMVRQELYEKYGEDAYTQGFKVYTTV
                  250       260       270       280       290       300

                  310       320       330       340       350       360
g791.pep   RTDHQKAATEALRKALRNFDRGSSYRGAENYIDLSKSEDVEETVSQYLSGLYTVDKMVPA
           |:||||:|||||||||||||||||||||||||||||||||||||||||||||||||||||
m791       RADHQKVATEALRKALRNFDRGSSYRGAENYIDLSKSEDVEETVSQYLSGLYTVDKMVPA
                  310       320       330       340       350       360

                  370       380       390       400       410       420
g791.pep   VVLDVTKKKNVVIQLPGGRRVALDRRALGFAARAVDNEKMGEDRIRRGAVIRVKNNGGRW
           ||||||||||||||||||||:|||||||||||||||:|||||||||||||||||||||||
m791       VVLDVTKKKNVVIQLPGGRRVTLDRRALGFAARAVNNEKMGEDRIRRGAVIRVKNNGGRW
                  370       380       390       400       410       420

                  430       440       450       460       470       480
g791.pep   AVVQEPLLQGALVSLDAKTGAVRALVGGYDFHSKTFNRAVQAMRQPGSTFKPFVYSAALS
           |||||||||||| |||||||||||||||||||||||||||||||||||||||||||||||
m791       AVVQEPLLQGALGSLDAKTGAVRALVGGYDFHSKTFNRAVQAMRQPGSTFKPFVYSAALS
                  430       440       450       460       470       480

                  490       500       510       520       530       540
g791.pep   KGMTASTVVNDAPISLPGKGPNGSVWTPKNSDGRYSGYITLRQALTASKNMVSIRILMSI
           ||||||||||||||||||||||||||||||||||||||||||||||||||||||||||||
m791       KGMTASTVVNDAPISLPGKGPNGSVWTPKNSDGRYSGYITLRQALTASKNMVSIRILMSI
                  490       500       510       520       530       540

                  550       560       570       580       590       600
g791.pep   GVGYAQQYIRRFGFRPSELPASLSMALGTGETTPLKVAEAYSVFANGGYRVSSHVIDKIY
           ||||||||||||||| ||||||||||||||||||||||||||||||||||||||||||||
m791       GVGYAQQYIRRFGFRSSELPASLSMALGTGETTPLKVAEAYSVFANGGYRVSSHVIDKIY
                  550       560       570       580       590       600
```

-continued

```
                 610        620        630        640        650        660
g791.pep  DRDGRLRAQMQPLVAGQNAPQAIDPRNAYIMYKIMQDVVRVGTARGAAALGRTDIAGKTG
          ||||||||||||||||||||||||||||||||||||||||||||||||||||||||||||
m791      DRDGRLRAQMQPLVAGQNAPQAIDPRNAYIMYKIMQDVVRVGTARGAAALGRTDIAGKTG
                 610        620        630        640        650        660

                 670        680        690        700        710        720
g791.pep  TTNDNKDAWFVGFNPDVVTAVYIGFDKPKSMGRAGYGGTIAVPVWVDYMRFALKGKQGKG
          |||||||||||||||||||||||||||||||||:||||||||||||||||||||||||||
m791      TTNDNKDAWFVGFNPDVVTAVYIGFDKPKSMGRVGYGGTIAVPVWVDYMRFALKGKQGKG
                 670        680        690        700        710        720

                 730        740        750        760        770        780
g791.pep  MKMPEGVVSSNGEYYMKERMVTDPGLMLDNSGIAPQPSRRAKEDDEAAVENEQQGRSDET
          |||||||||||||||||||||||||| ||||||||||||||||||| :|:|: :|: :||:
m791      MKMPEGVVSSNGEYYMKERMVTDPGLTLDNSGIAPQPSRRAKEDDGGAAEGGRQAADDEV
                 730        740        750        760        770        780

                 790        800
g791.pep  RQDVQETPVLPSNTDSKQQQLDSLFX
          |||:|||||||||| |||||||||||
m791      RQDMQETPVLPSNTGSKQQQLDSLFX
                 790        800
```

The following partial DNA sequence was identified in *N. meningitidis* <SEQ ID 2679>:

```
a791.seq
   1  ATGGTAAATT ATTATTCAGC TATGATTAAA AAGATTTTAA CGACTTGTTT
  51  TGGTTTGGTT TTTGGGTTTT GTGTATTTGG AGTGGGTTTG GTTGCCATTG
 101  CTATTTTGGT AACGTATCCG AAACTGCCGT CTTTGGATTC TTTGCAGCAT
 151  TACCAGCCTA AAATGCCGTT GACTATTTAT TCGGCGGATG GGGAAGTCAT
 201  CGGTATGTAT GGGGAGCAGC GGCGCGAATT TACAAAAATC GGCGATTTCC
 251  CAGAGGTGTT GCGGAATGCG GTTATCGCCG CCGAGGATAA ACGCTTTTAC
 301  CGGCATTGGG GGGTGGATGT TTGGGGTGTT GCCCGCGCTG CCGTCGGCAA
 351  TGTCGTGTCC GGCAGCGTGC AGTCGGGTGC GAGTACGATT ACGCAGCAGG
 401  TGGCGAAAAA TTTTTATTTG AGCAGTGAAA AAACGTTCAC ACGCAAATTC
 451  AATGAGGTGT TGCTTGCCTA TAAAATCGAG CAGTCTTTAA GCAAAGACAA
 501  AATCCTCGAG TTGTATTTCA ATCAGATTTA CCTCGGTCAG CGCGCCTATG
 551  GTTTTGCATC TGCCGCGCAA ATCTATTTCA ATAAGAATGT CCGAGATTTG
 601  ACTTTGGCGG AAGCCGCCAT GCTTGCGGGA CTGCCCAAGG CTCCGTCTGC
 651  CTATAATCCG ATTGTTAATC CAGAACGTGC CAAGTTGCGC CAGAAGTATA
 701  TTTTGAACAA TATGCTCGAG GAGAAGATGA TTACCGTGCA ACAGCGCGAT
 751  CAGGCGTTGA ATGAGGAACT GCATTACGAG CGGTTTGTTC GGAAAATCGA
 801  TCAGAGTGCT TTATATGTGG CGGAAATGGT GCGTCAGGAA CTGTATGAGA
 851  AATACGGTGA AGATGCCTAT ACGCAGGGTT TTAAGGTTTA TACCACGGTC
 901  CGCGCCGATC ATCAGAAGGT GGCAACCGAG GCATTGCGCA AGGCTCTACG
 951  GAATTTCGAT CGCGGCAGCA GCTACCGCGG TGCGGAAAAC TATATCGATT
1001  TGAGTAAGAG TGAAGATGTC GAGGAGACTG TCAGCCAGTA TCTGTCGGGA
1051  CTCTATACCG TCGATAAAAT GGTTCCCGCC GTTGTGTTGG ATGTGACTAA
1101  AAAGAAAAAT GTCGTCATAC AGCTGCCCGG CGGCAGGCGG GTTACGCTTG
1151  ACAGGCGCGC CTTGGGTTTT GCGGCCCGCG CGGTCAATAA TGAAAAAATG
```

-continued

```
1201 GGGGAGGACC GTATCCGCAG GGGCGCGGTC ATCCGTGTCA AAAACAACGG
1251 CGGGCGTTGG GCGGTGGTTC AAGAGCCGTT GCTGCAGGGG GCTTTGGTTT
1301 CGCTGGATGC AAAAACCGGA GCTGTGCGCG CGCTGGTCGG CGGTTATGAT
1351 TTTCACAGCA AAACATTCAA TCGTGCCGTT CAGGCAATGC GGCAGCCGGG
1401 TTCGACCTTT AAGCCGTTTG TCTATTCGGC GGCATTATCT AAGGGGATGA
1451 CCGCGTCCAC AGTGGTTAAC GATGCGCCGA TTTCCCTGCC GGGGAAAGGG
1501 CCGAACGGTT CGGTTTGGAC ACCTAAAAAT TCAGACGGCA GATATTCCGG
1551 CTACATTACT TTGAGACAGG CTCTGACGGC TTCCAAGAAT ATGGTTTCCA
1601 TCCGTATTTT GATGTCTATC GGTGTCGGTT ACGCGCAACA GTATATCCGG
1651 CGTTTCGGCT TCAGGTCGTC CGAGCTGCCG GCAAGCCTGT CTATGGCTTT
1701 AGGTACGGGC GAGACAACGC CGTTGAAAGT GGCGGAGGCA TATAGCGTAT
1751 TTGCGAACGG CGGATATAGG GTTTCTTCGC ACGTAATCGA TAAGATTTAT
1801 GACAGAGACG GCAGGTTGCG CGCCCAAATG CAACCTTTGG TGGCCGGGCA
1851 AAATGCGCCT CAGGCAATCG ATCCGCGCAA TGCCTATATT ATGTATAAGA
1901 TTATGCAGGA TGTGGTCCGT GTTGGTACGG CAAGGGGGGC AGCTGCGTTG
1951 GGAAGAACGG ATATTGCCGG TAAAACGGGT ACGACCAATG ACAATAAGGA
2001 TGCGTGGTTT GTCGGTTTTA ACCCTGATGT GGTTACTGCC GTATATATCG
2051 GCTTCGACAA ACCTAAGAGT ATGGGGCGTG TCGGCTACGG CGGTACGATT
2101 GCGGTGCCGG TTTGGGTGGA CTATATGCGT TTTGCGTTGA AAGGAAAGCA
2151 GGGCAAGGGG ATGAAAATGC CTGAAGGTGT GGTCAGCAGC AATGGCGAAT
2201 ACTATATGAA GGAACGTATG GTAACCGATC CGGGCTTGAC GCTGGACAAC
2251 AGCGGTATTG CGCCGCAACC TTCCCGACGG GCAAAAGAAG ATGACGGGGG
2301 CGCGGCAGAA GGCGGACGGC AGGCGGCGGA TGACGAAGTC CGCCAAGATA
2351 TGCAGGAAAC GCCGGTGCTT CCGAGTAATA CTGGTTCCAA ACAGCAGCAG
2401 TTGGATTCTC TGTTTTAA
```

This corresponds to the amino acid sequence <SEQ ID 2680; ORF 791.a>:

```
a791.pep
  1 MVNYYSAMIK KILTTCFGLV FGFCVFGVGL VAIAILVTYP KLPSLDSLQH
 51 YQPKMPLTIY SADGEVIGMY GEQRREFTKI GDFPEVLRNA VIAAEDKRFY
101 RHWGVDVWGV ARAAVGNVVS GSVQSGASTI TQQVAKNFYL SSEKTFTRKF
151 NEVLLAYKIE QSLSKDKILE LYFNQIYLGQ RAYGFASAAQ IYFNKNVRDL
201 TLAEAAMLAG LPKAPSAYNP IVNPERAKLR QKYILNNMLE EKMITVQQRD
251 QALNEELHYE RFVRKIDQSA LYVAEMVRQE LYEKYGEDAY TQGFKVYTTV
301 RADHQKVATE ALRKALRNFD RGSSYRGAEN YIDLSKSEDV EETVSQYLSG
351 LYTVDKMVPA VVLDVTKKKN VVIQLPGGRR VTLDRRALGF AARAVNNEKM
401 GEDRIRRGAV IRVKNNGGRW AVVQEPLLQG ALVSLDAKTG AVRALVGGYD
451 FHSKTFNRAV QAMRQPGSTF KPFVYSAALS KGMTASTVVN DAPISLPGKG
501 PNGSVWTPKN SDGRYSGYIT LRQALTASKN MVSIRILMSI GVGYAQQYIR
551 RFGFRSSELP ASLSMALGTG ETTPLKVAEA YSVFANGGYR VSSHVIDKIY
601 DRDGRLRAQM QPLVAGQNAP QAIDPRNAYI MYKIMQDVVR VGTARGAAAL
```

-continued

```
651  GRTDIAGKTG TTNDNKDAWF VGFNPDVVTA VYIGFDKPKS MGRVGYGGTI

701  AVPVWVDYMR FALKGKQGKG MKMPEGVVSS NGEYYMKERM VTDPGLTLDN

751  SGIAPQPSRR AKEDDGGAAE GGRQAADDEV RQDMQETPVL PSNTGSKQQQ

801  LDSLF*
```

a791/m791 99.9% identity in 805 aa overlap

```
                   10        20        30        40        50        60
a791.pep   MVNYYSAMIKKILTTCFGLVFGFCVFGVGLVAIAILVTYPKLPSLDSLQHYQPKMPLTIY
           ||||||||||||||||||||||||||||||||||||||||||||||||||||||||||||
m791       MVNYYSAMIKKILTTCFGLVFGFCVFGVGLVAIAILVTYPKLPSLDSLQHYQPKMPLTIY
                   10        20        30        40        50        60

                   70        80        90       100       110       120
a791.pep   SADGEVIGMYGEQRREFTKIGDFPEVLRNAVIAAEDKRFYRHWGVDVWGVARAAVGNVVS
           ||||||||||||||||||||||||||||||||||||||||||||||||||||||||||||
m791       SADGEVIGMYGEQRREFTKIGDFPEVLRNAVIAAEDKRFYRHWGVDVWGVARAAVGNVVS
                   70        80        90       100       110       120

                  130       140       150       160       170       180
a791.pep   GSVQSGASTITQQVAKNFYLSSEKTFTRKFNEVLLAYKIEQSLSKDKILELYFNQIYLGQ
           ||||||||||||||||||||||||||||||||||||||||||||||||||||||||||||
m791       GSVQSGASTITQQVAKNFYLSSEKTFTRKFNEVLLAYKIEQSLSKDKILELYFNQIYLGQ
                  130       140       150       160       170       180

                  190       200       210       220       230       240
a791.pep   RAYGFASAAQIYFNKNVRDLTLAEAAMLAGLPKAPSAYNPIVNPERAKLRQKYILNNMLE
           ||||||||||||||||||||||||||||||||||||||||||||||||||||||||||||
m791       RAYGFASAAQIYFNKNVRDLTLAEAAMLAGLPKAPSAYNPIVNPERAKLRQKYILNNMLE
                  190       200       210       220       230       240

                  250       260       270       280       290       300
a791.pep   EKMITVQQRDQALNEELHYERFVRKIDQSALYVAEMVRQELYEKYGEDAYTQGFKVYTTV
           ||||||||||||||||||||||||||||||||||||||||||||||||||||||||||||
m791       EKMITVQQRDQALNEELHYERFVRKIDQSALYVAEMVRQELYEKYGEDAYTQGFKVYTTV
                  250       260       270       280       290       300

                  310       320       330       340       350       360
a791.pep   RADHQKVATEALRKALRNFDRGSSYRGAENYIDLSKSEDVEETVSQYLSGLYTVDKMVPA
           ||||||||||||||||||||||||||||||||||||||||||||||||||||||||||||
m791       RADHQKVATEALRKALRNFDRGSSYRGAENYIDLSKSEDVEETVSQYLSGLYTVDKMVPA
                  310       320       330       340       350       360

                  370       380       390       400       410       420
a791.pep   VVLDVTKKKNVVIQLPGGRRVTLDRRALGFAARAVNNEKMGEDRIRRGAVIRVKNNGGRW
           ||||||||||||||||||||||||||||||||||||||||||||||||||||||||||||
m791       VVLDVTKKKNVVIQLPGGRRVTLDRRALGFAARAVNNEKMGEDRIRRGAVIRVKNNGGRW
                  370       380       390       400       410       420

                  430       440       450       460       470       480
a791.pep   AVVQEPLLQGALVSLDAKTGAVRALVGGYDFHSKTFNRAVQAMRQPGSTFKPFVYSAALS
           |||||||||||| |||||||||||||||||||||||||||||||||||||||||||||||
m791       AVVQEPLLQGALGSLDAKTGAVRALVGGYDFHSKTFNRAVQAMRQPGSTFKPFVYSAALS
                  430       440       450       460       470       480

                  490       500       510       520       530       540
a791.pep   KGMTASTVVNDAPISLPGKGPNGSVWTPKNSDGRYSGYITLRQALTASKNMVSIRILMSI
           ||||||||||||||||||||||||||||||||||||||||||||||||||||||||||||
m791       KGMTASTVVNDAPISLPGKGPNGSVWTPKNSDGRYSGYITLRQALTASKNMVSIRILMSI
                  490       500       510       520       530       540

                  550       560       570       580       590       600
a791.pep   GVGYAQQYIRRFGFRPSELSASLSMALGTGETTPLKVAEAYSVFANGGYRVSSHVIDKIY
           ||||||||||||||||||||||||||||||||||||||||||||||||||||||||||||
m791       GVGYAQQYIRRFGFRSSELPASLSMALGTGETTPLKVAEAYSVFANGGYRVSSHVIDKIY
                  550       560       570       580       590       600

                  610       620       630       640       650       660
a791.pep   DRDGRLRAQMQPLVAGQNAPQAIDPRNAYIMYKIMQDVVRVGTARGAAALGRTDIAGKTG
           ||||||||||||||||||||||||||||||||||||||||||||||||||||||||||||
m791       DRDGRLRAQMQPLVAGQNAPQAIDPRNAYIMYKIMQDVVRVGTARGAAALGRTDIAGKTG
                  610       620       630       640       650       660

                  670       680       690       700       710       720
a791.pep   TTNDNKDAWFVGFNPDVVTAVYIGFDKPKSMGRVGYGGTIAVPVWVDYMRFALKGKQGKG
           ||||||||||||||||||||||||||||||||||||||||||||||||||||||||||||
m791       TTNDNKDAWFVGFNPDVVTAVYIGFDKPKSMGRVGYGGTIAVPVWVDYMRFALKGKQGKG
                  670       680       690       700       710       720
```

-continued

```
                730       740       750       7760      770       780
a791.pep  MKMPEGVVSSNGEYYMKERMVTDPGLTLDNSGIAPQPSRRAKEDDGGAAEGGRQAADDEV
          ||||||||||||||||||||||||||||||||||||||||||||||||||||||||||||
m791      MKMPEGVVSSNGEYYMKERMVTDPGLTLDNSGIAPQPSRRAKEDDGGAAEGGRQAADDEV
                730       740       750       760       770       780

                790       800
a791.pep  RQDMQETPVLPSNTGSKQQQLDSLFX
          ||||||||||||||||||||||||||
m791      RQDMQETPVLPSNTGSKQQQLDSLFX
                790       800
```

The following partial DNA sequence was identified in *N. gonorrhoeae* <SEQ ID 2681>:

```
g792.seq
   1 ATGTTCCGCA TCGTCAAATG GCTGATTGCC CTGCCCGTCG GCATCTTTAT

  51 CTTTTTCAAT GCCTATGTGT ACGGCAACAT CATCACCTAC CGCGCCGTCG

 101 CGCCCCATCG GACTGCCTTT ATGTCGATGC GGATGAAGCA GTTTGAACAA

 151 GAAGGTCGCG ATGTCGCACT GGATTACCGC TGGGTGCCCT ACAACCGCAT

 201 TTCCACCAAC CTGAAAAAAG CCCTGATTGC TTCCGAAGAT GTCCGTTTTG

 251 CCggacacgg gggcttcGat GGGGACGGCa tTCAAAACGC CATCAGGCGC

 301 AACCGGAACA GCGGCGAAGT GAAGGCGGGC GGATCGACCA TCAGCCAGCA

 351 GCTTGCCAAA AACCTCTTCC TCAACGAAAG CCGCAACTAT CTGCGCAAAG

 401 GGGAAGAGGC GGCCATTACG GCAATGATGG AAGCTGTTAC CGACAAAAAC

 451 AGGATTTTCG AACTGTATTT AAACTCAATC GAATGGCACT ACGGCgtTTT

 501 CGGCGCGGAA GCTGCGTCCC GGtatTttTA TAAAAAACCG GCcgcaGACC

 551 TGACcAAACA GCAggcggcG aaactgacgg tactcgtccc cgccccgttt

 601 tactactctg accatccaaa aagcaaacgg ctgcgcaaca aaaccaatat

 651 cgtgctcaga cgcatgggtt cggcaaatta ccccaaagcg aaacggactg

 701 attgttccag atatggaaat gccgcctgaa ctggggttcg aacggcatat

 751 gttttctggg acttataa
```

This corresponds to the amino acid sequence <SEQ ID 2682; ORF 792.ng>:

```
g792.pep
   1 MFRIVKWLIA LPVGIFIFFN AYVYGNIITY RAVAPHRTAF MSMRMKQFEQ

  51 EGRDVALDYR WVPYNRISTN LKKALIASED VRFAGHGGFD GDGIQNAIRR

 101 NRNSGEVKAG GSTISQQLAK NLFLNESRNY LRKGEEAAIT AMMEAVTDKN

 151 RIFELYLNSI EWHYGVFGAE AASRYFYKKP AADLTKQQAA KLTVLVPAPF

 201 YYSDHPKSKR LRNKTNIVLR RMGSANYPKA KRTDCSRYGN AA*TGVRTAY

 251 VFWDL*
```

The following partial DNA sequence was identified in *N. meningitidis* <SEQ ID 2683>:

```
m792.seq
   1 ATGTTCCGCA TCATCAAATG GCTGATTGCC CTGCCCGTCG GCATCTTTAT

  51 CTTTTTCAAT GCCTATGTGT ACGGCAACAT CATTACCTAC CGCGCCGTCG
```

-continued

```
101 CGCCCCATCG GACTGCCTTT ATGTCGATGC GGATGAAGCA GTTTGAACAG

151 GAAGGTCGCG ATGTCGCACT GGATTACCGC TGGATGCCCT ACAAACGCAT

201 TTCCACCAAC CTGAAAAAAG CCCTGATTGC TTCCGAAGAT GCCCGTTTCG

251 CCGGGCACGG CGGCTTCGAT TGGGGCGGCA TTCAAAACGC CATCAGGCGC

301 AACCGGAACA GCGGCAAAGT GAAGGCGGGC GGCTCGACCA TCAGCCAGCA

351 GCTTGCCAAA AACCTGTTTT TAAACGAAAG CCGCAGCTAT ATCCGCAAAG

401 GCGAAGAAGC GGCGATTACC GCGATGATGG AAGCCGTTAC CGACAAAGAC

451 AGGATTTTTG AACTGTATTT AAACTCAATC GAATGGCACT ACGGCGTTTT

501 CGGCGCGGAA GCCGCGTCCC GGTATTTTTA TCAAATACCC GCCGCCAAGC

551 TGACCAAACA GCAGGCGGCA AAACTGACGG CGCGCGTCCC CGCCCCGCTC

601 TACTACGCCG ACCATCCGAA AAGCAAACGG CTCCGCAACA AAACCAATAT

651 CGTGCTCAAA CGCATGGGTT CGGCAGAGTT GCCTGAAAGC GACACGGACT

701 GA
```

This corresponds to the amino acid sequence <SEQ ID 2684; ORF 792>:

```
m792.pep

      1  MFRIIKWLIA LPVGIFIFFN AYVYGNIITY RAVAPHRTAF MSMRMKQFEQ

     51  EGRDVALDYR WMPYKRISTN LKKALIASED ARFAGHGGFD WGGIQNAIRR

    101  NRNSGKVKAG GSTISQQLAK NLFLNESRSY IRKGEEAAIT AMMEAVTDKD

    151  RIFELYLNSI EWHYGVFGAE AASRYFYQIP AAKLTKQQAA KLTARVPAPL

    201  YYADHPKSKR LRNKTNIVLK RMGSAELPES DTD*

g792/m792 90.4% identity in 230 aa overlap

                   10        20        30        40        50        60
g792.pep  MFRIVKWLIALPVGIFIFFNAYVYGNIITYRAVAPHRTAFMSMRMKQFEQEGRDVALDYR
          ||||:|||||||||||||||||||||||||||||||||||||||||||||||||||||||
m792      MFRIIKWLIALPVGIFIFFNAYVYGNIITYRAVAPHRTAFMSMRMKQFEQEGRDVALDYR
                   10        20        30        40        50        60

                   70        80        90       100       110       120
g792.pep  WVPYNRISTNLKKALIASEDVRFAGHGGFDGDGIQNAIRRNRNSGEVKAGGSTISQQLAK
          |:||:||||||||||||||||:|||||||||  ||||||||||||:||||||||||||||
m792      WMPYKRISTNLKKALIASEDARPAGHGGFDWGGIQNAIRRNRNSGKVKAGGSTISQQLAK
                   70        80        90       100       110       120

                  130       140       150       160       170       180
g792.pep  NLFLNESRNYLRKGEEAAITAMMEAVTDKNRIFELYLNSIEWHYGVFGAEAASRYFYKKP
          ||||||||:|:||||||||||||||||||||:||||||||||||||||||||||||||: |
m792      NLFLNESRSYIRKGEEAAITAMMEAVTDKDRIFELYLNSIEWHYGVFGAEAASRYFYQIP
                  130       140       150       160       170       180

                  190       200       210       220       230       240
g792.pep  AADLTKQQAAKLTVLVPAPFYYSDHPKSKRLRNKTNIVLRRMGSANYPKAKRTDCSRYGN
          || |||||||||: ||||:||:||||||||||||||||:|||||: |::
m792      AAKLTKQQAAKLTARVPAPLYYADHPKSKRLRNKTNIVLKMGSAELPESDTDX
                  190       200       210       220       230

                  250
g792.pep  AAXTGVRTAYVFWDLX
```

The following partial DNA sequence was identified in *N. meningitidis* <SEQ ID 2685>:

```
a792.seq
  1 ATGTTCCGCA TCATCAAATG GCTGATTGCC CTGCCCGTCG GCATCTTTAT

 51 CTTTTTCAAT GCCTATGTGT ACGGCAACAT CATTACCTAC CGCGCCGTCG

101 CGCCCCATCG GACTGCCTTT ATGTCGATGC GGATGAAGCA GTTTGAACAG
```

-continued

```
151 GAAGGTCGCG ATGTCGCACT GGATTACCGC TGGATGCCCT ACAAACGCAT

201 TTCCACCAAC CTGAAAAAAG CCCTGATTGC TTCCGAAGAT GCCCGTTTCG

251 CCGGGCACGG CGGCTTCGAT TGGGGCGGCA TTCAAAACGC CATCAGGCGC

301 AACCGGAACA GCGGCAAAGT GAAGGCGGGC GGCTCGACCA TCAGCCAGCA

351 GCTTGCCAAA AACCTGTTTT TAAACGAAAG CCGCAGCTAT ATCCGCAAAG

401 GCGAAGAAGC GGCGATTACC GCGATGATGG AAGCCGTTAC CGACAAAGAC

451 AGGATTTTTG AACTGTATTT AAACTCAATC GAATGGCACT ACGGCGTTTT

501 CGGCGCGGAA GCCGCGTCCC GGTATTTTTA TCAAATACCC GCCGCCAAGC

551 TGACCAAACA GCAGGCGGCA AAACTGACGG CGCGCGTCCC CGCCCCGCTC

601 TACTACGCCG ACCATCCGAA AAGCAAACGG CTCCGCAACA AAACCAATAT

651 CGTGCTCAGA CGCATGGGTT CGGCAGAGTT GCCTGAAAGC GACACGGACT

701 GA
```

This corresponds to the amino acid sequence <SEQ ID 2686; ORF 792.a>:

```
a792.pep

      1  MFRIIKWLIA LPVGIFIFFN AYVYGNIITY RAVAPHRTAF MSMRMKQFEQ

     51  EGRDVALDYR WMPYKRISTN LKKALIASED ARFAGHGGFD WGGIQNAIRR

    101  NRNSGKVKAG GSTISQQLAK NLFLNESRSY IRKGEEAAIT AMMEAVTDKD

    151  RIFELYLNSI EWHYGVFGAE AASRYFYQIP AAKLTKQQAA KLTARVPAPL

    201  YYADHPKSKR LRNKTNIVLR RMGSAELPES DTD*

m792/a792 99.6% identity in 233 aa overlap

                 10        20        30        40        50        60
a792.pep  MFRIIKWLIALPVGIFIFFNAYVYGNIITYRAVAPHRTAFMSMRMKQFEQEGRDVALDYR
          ||||||||||||||||||||||||||||||||||||||||||||||||||||||||||||
m792      MFRIIKWLIALPVGIFIFFNAYVYGNIITYRAVAPHRTAFMSMRMKQFEQEGRDVALDYR
                 10        20        30        40        50        60

                 70        80        90       100       110       120
a792.pep  WMPYKRISTNLKKALIASEDARFAGHGGFDWGGIQNAIRRNRNSGKVKAGGSTISQQLAK
          ||||||||||||||||||||||||||||||||||||||||||||||||||||||||||||
m792      WMPYKRISTNLKKALIASEDARFAGHGGFDWGGIQNAIRRNRNSGKVKAGGSTISQQLAK
                 70        80        90       100       110       120

                130       140       150       160       170       180
a792.pep  NLFLNESRSYIRKGEEAAITAMMEAVTDKDRIFELYLNSIEWHYGVFGAEAASRYFYQIP
          ||||||||||||||||||||||||||||||||||||||||||||||||||||||||||||
m792      NLFLNESRSYIRKGEEAAITAMMEAVTDKDRIFELYLNSIEWHYGVFGAEAASRYFYQIP
                130       140       150       160       170       180

                190       200       210       220       230
a792.pep  AAKLTKQQAAKLTARVPAPLYYADHPKSKRLRNKTNIVLRRMGSAELPESDTDX
          ||||||||||||||||||||||||||||||||||||||:|||||||||||||||
m792      AAKLTKQQAAKLTARVPAPLYYADHPKSKRLRNKTNIVLKRMGSAELPESDTDX
                190       200       210       220       230
```

The following partial DNA sequence was identified in *N. gonorrhoeae* <SEQ ID 2687>:

```
g793.seq
   1  ATGTTGATTA AAAGCGAATA TAAGCCCCGG ATGCTGCCCA AAGAAGAGCA

  51  GGTCAAAAAG CCGATGACCA GTAACGGACG GATTAGCTTC GTCCTGATGG

 101  CAATGGCGGT CTTGTTTGCC TGTCTGATTG CCCGCGGGCT GTATCTGCAG
```

-continued

```
 151 ACGGTAACGT ATAACTTTTT GAAAGAACAG GGCGACAACC GGATTGTGCG

 201 GACTCAAGCA TTGCCGGCTA CACGCGGTAC GGTTTCGGAC CGGAACGGTG

 251 CGGTTTTGGC GTTGAGCGCG CCGACGGAGT CCCTGTTTGC CGTGCCTAAA

 301 GATATGAAGG AAATGCCGTC TGCCGCCCAA TTGGAACGCC TGTCCGAGCT

 351 TGTCGATGTG CCGGTCGATG TTTTGAGGAA CAAACTCGAA CAGAAAGGCA

 401 AGTCGTTTAT TTGGATCAAG CGGCAGCTCG ATCCCAAGGT TGCCGAAGAG

 451 GTCAAAGCCT TGGGTTTGGA AAACTTTGTA TTTGAAAAAG AATTAAAACG

 501 CCATTACCCG ATGGGCAACC TGTTTGCACA CGTCATCGGA TTTACCGATA

 551 TTGACGGCAA AGGTCAGGAA GGTTTGGAAC TTTCGCTTGA AGACAGCCTG

 601 TATGGCGAAG ACGGCGCGGA AGTTGTTTTG CGGGACCGGC AGGGCAATAT

 651 TGTGGACAGC TTGGACTCCC CGCGCAATAA AGCACCGCAA AACGGCAAAG

 701 ACATCATCCT TTCCCTCGAT CAGAGGATTC AGACCTTGGC CTATGAAGAG

 751 TTGAACAAGG CGGTCGAATA CCATCAGGCA AAAGCCGGAA CGGTGGTGGT

 801 TTTGGATGCC CGCACGGGGG AAATCCTCGC CTTGGCCAAT ACGCCCGCCT

 851 ACGATCCCAA CAGACCCGGC CGGGCAGACA GCGAACAGCG GCGCAACCGT

 901 GCCGTAACCG ATATGATCGA ACCTGGTTCG GCAATCAAAC CGTTCGTGAT

 951 TGCGAAGGCA TTGGATGCGG GCAAAACCGA TTTGAACGAA CGGCTGAATA

1001 CGCAGCCTTA TAAAATCGGA CCGTCTCCCG TGCGCGATGA TACCCATGTT

1051 TACCCCTCTT TGGATGTGCG CGGCATTATG CAGAAATCGT CCAACGTCGG

1101 CACAAGCAAA CTGTCTGCGC GTTTCGGCGC CGAAGAAATG TATGACTTCT

1151 ATCATGAATT GGGCATCGGT GTGCGTATGC ACTCGGGCTT TCCGGGGGAA

1201 ACTGCAGGTT TGTTGAGAAA TTGGCGCAGG TGGCGGCCCA TCGAACAGGC

1251 GACGATGTCT TTCGGTTACG GTCTGCAATT GAGCCTGCTG CAATTGGCGC

1301 GCGCCTATAC CGCACTGACG CACGACGGCG TTTTGCTGCC GCTCAGCTTT

1351 GAGAAGCAGG CGGTTGCGCC GCAAGGCAAA CGCATATTCA AAGAATCGAC

1401 CGCGCGCGAG GTACGCAATC TGATGGTTTC CGTAACCGAG CCGGGCGGCA

1451 CCGGTACGGC GGGTGCGGTG GACGGTTTCG ATGTCGGCGC TAAAACCGGC

1501 ACGGCGCGCA AGTTCGTCAA CGGGCGTTAT GCCGACAACA AACACGTCGC

1551 TACCTTTATC GGTTTTGCCC CCGCCAAAAA CCCCCGTGTG ATTGTGGCGG

1601 TAACCATCGA CGAACCGACT GCCCACGGCT ATTACGGCGG CGTAGTGGCA

1651 GGGCCGCCCT TCAAAAAAAT TATGGGCGGC AGCCTGAACA TCTTGGGCAT

1701 TTCCCCGACC AAGCCACTGA CCGCCGCAGC CGTCAAAACA CCGTCTTAA
```

This corresponds to the amino acid sequence <SEQ ID 2688; ORF 793.ng>:

```
g793.pep
  1 MLIKSEYKPR MLPKEEQVKK PMTSNGRISF VLMAMAVLFA CLIARGLYLQ

 51 TVTYNFLKEQ GDNRIVRTQA LPATRGTVSD RNGAVLALSA PTESLFAVPK

101 DMKEMPSAAQ LERLSELVDV PVDVLRNKLE QKGKSFIWIK RQLDPKVAEE

151 VKALGLENFV FEKELKRHYP MGNLFAHVIG FTDIDGKGQE GLELSLEDSL

201 YGEDGAEVVL RDRQGNIVDS LDSPRNKAPQ NGKDIILSLD QRIQTLAYEE
```

-continued

```
251 LNKAVEYHQA KAGTVVVLDA RTGEILALAN TPAYDPNRPG RADSEQRRNR

301 AVTDMIEPGS AIKPFVIAKA LDAGKTDLNE RLNTQPYKIG PSPVRDDTHV

351 YPSLDVRGIM QKSSNVGTSK LSARFGAEEM YDFYHELGIG VRMHSGFPGE

401 TAGLLRNWRR WRPIEQATMS FGYGLQLSLL QLARAYTALT HDGVLLPLSF

451 EKQAVAPQGK RIFKESTARE VRNLMVSVTE PGGTGTAGAV DGFDVGAKTG

501 TARKFVNGRY ADNKHVATFI GFAPAKNPRV IVAVTIDEPT AHGYYGGVVA

551 GPPFKKIMGG SLNILGISPT KPLTAAAVKT PS*
```

The following partial DNA sequence was identified in *N. meningitidis* <SEQ ID 2689>:

```
m793.seq
   1 ATGTTGATTA AGAGCGAATA TAAGCCTCGG ATGCTGCCCA AAGAAGAGCA

  51 GGTCAAAAAG CCGATGACCA GTAACGGACG GATCAGCTTC GTCCTGATGG

 101 CAATAGCGGT CTTGTTTGCC GGTCTGATTG CTCGCGGACT GTATCTGCAG

 151 ACGGTAACGT ATAACTTTTT GAAAGAACAG GGCGACAACC GGATTGTGCG

 201 GACTCAAACA TTGCCGGCTA CACGCGGTAC GGTTTCGGAC CGGAACGGTG

 251 CGGTTTTGGC GTTGAGTGCG CCGACGGAGT CCCTGTTTGC CGTGCCTAAA

 301 GAGATGAAGG AAATGCCGTC TGCCGCACAA TTGGAACGCC TGTCCGAGCT

 351 TGTCGATGTG CCGGTTGATG TTTTGAGGAA CAAGCTCGAA CAGAAAGGCA

 401 AGTCGTTTAT CTGGATTAAG CGGCAGCTCG ATCCCAAGGT TGCCGAAGAG

 451 GTCAAAGCCT TGGGTTTGGA AAACTTTGTA TTTGAAAAAG AATTAAAACG

 501 CCATTACCCG ATGGGCAACC TGTTTGCACA CGTCATCGGA TTTACCGATA

 551 TTGACGGCAA AGGTCAGGAA GGTTTGGAAC TTTCGCTTGA AGACAGCCTG

 601 CATGGCGAAG ACGGCGCGGA AGTCGTTTTG CGGGACCGGC AGGGCAATAT

 651 TGTGGACAGC TTGGACTCCC CGCGCAATAA AGCCCCGAAA AACGGCAAAG

 701 ACATCATCCT TTCCCTCGAT CAGAGGATTC AGACCTTGGC CTATGAAGAG

 751 TTGAACAAGG CGGTCGAATA CCATCAGGCA AAAGCCGGAA CGGTGGTGGT

 801 TTTGGATGCC CGCACGGGGG AAATCCTCGC CTTGGCCAAT ACGCCCGCCT

 851 ACGATCCCAA CAGGCCCGGC CGGGCAGACA GCGAACAGCG GCGCAACCGT

 901 GCCGTAACCG ATATGATCGA ACCCGGTTCG GCAATCAAAC CGTTTGTGAT

 951 TGCGAAGGCA TTGGATGCGG GCAAAACCGA TTTGAACGAA CGGCTGAATA

1001 CGCAGCCTTA TAAAATCGGA CCGTCTCCCG TGCGCGATAC CCATGTTTAC

1051 CCCTCTTTGG ATGTGCGCGG CATCATGCAG AAATCGTCCA ACGTCGGCAC

1101 AAGCAAACTG TCTGCGCGTT TCGGTGCCGA AGAAATGTAT GACTTCTATC

1151 ATGAGTTGGG CATCGGTGTG CGTATGCACT CGGGCTTTCC GGGCGAAACT

1201 GCAGGTTTGT TGAGAAATTG GCGCAGGTGG CGGCCTATCG AACAGGCGAC

1251 GATGTCTTTC GGTTACGGCC TGCAATTGAG CCTGCTGCAA TTGGCGCGCG

1301 CCTATACCGC ACTGACGCAC GACGGCGTTT TACTGCCGGT CAGCTTTGAA

1351 AAACAGGCGG TTGCGCCGCA AGGCAAACGC ATATTCAAAG AATCGACCGC

1401 GCGCGAGGTA CGCAATCTGA TGGTTTCCGT AACCGAGCCG GGCGGCACCG

1451 GTACGGCGGG TGCGGTGGAC GGTTTCGATG TCGGCGCGAA AACCGGCACG
```

-continued

```
1501 GCGCGCAAGT TCGTCAACGG GCGTTATGCC GACAACAAAC ACATCGCTAC

1551 CTTTATCGGT TTTGCCCCCG CCAAAAATCC CCGTGTGATT GTGGCGGTAA

1601 CCATTGACGA ACCGACTGCC CACGGTTATT ACGGCGGCGT AGTGGCAGGG

1651 CCGCCCTTCA AAAAAATTAT GGGCGGCAGC CTGAACATCT TGGGCATTTC

1701 CCCGACCAAG CCACTGACCG CCGCAGCCGT CAAAACACCG TCTTAA
```

This corresponds to the amino acid sequence <SEQ ID 2690; ORF 793>:

```
m793.pep

      1  MLIKSEYKPR MLPKEEQVKK PMTSNGRISF VLMAIAVLFA GLIARGLYLQ

     51  TVTYNFLKEQ GDNRIVRTQT LPATRGTVSD RNGAVLALSA PTESLFAVPK

    101  EMKEMPSAAQ LERLSELVDV PNDVLRNKLE QKGKSFIWIK RQLDPKVAEE

    151  VKALGLENFV FEKELKRHYP MGNLFAHVIG FTDIDGKGQE GLELSLEDSL

    201  HGEDGAEVVL RDRQGNIVDS LDSPRNKAPK NGKDIILSLD QRIQTLAYEE

    251  LNKAVEYHQA KAGTVVVLDA RTGEILALAN TPAYDPNRPG RADSEQRRNR

    301  AVTDMIEPGS AIKPFVIAKA LDAGKTDLNE RLNTQPYKIG PSPVRDTHVY

    351  PSLDVRGIMQ KSSNVGTSKL SARFGAEEMY DFYHELGIGV RMHSGFPGET

    401  AGLLRNWRRW RPIEQATMSF GYGLQLSLLQ LARAYTALTH DGVLLPVSFE

    451  KQAVAPQGKR IFKESTAREV RNLMVSVTEP GGTGTAGAVD GFDVGAKTGT

    501  ARKFVNGRYA DNKHIATFIG FAPAKNPRVI VAVTIDEPTA HGYYGGVVAG

    551  PPFKKIMGGS LNILGISPTK PLTAAAVKTP S*

g793/m793 98.5% identity in 582 aa overlap

                  10        20        30        40        50        60
g793.pep  MLIKSEYKPRMLPKEEQVKKPMTSNGRISFVLMAMAVLFACLIARGLYLQTVTYNFLKEQ
          ||||||||||||||||||||||||||||||||||:||||| ||||||||||||||||||
m793      MLIKSEYKPRMLPKEEQVKKPMTSNGRISFVLMAIAVLFAGLIARGLYLQTVTYNFLKEQ
                  10        20        30        40        50        60

                  70        80        90       100       110       120
g793.pep  GDNRIVRTQALPATRGTVSDRNGAVLALSAPTESLFAVPKDMKEMPSAAQLERLSELVDV
          |||||||||:||||||||||||||||||||||||||||||:|||||||||||||||||||
m793      GDNRIVRTQTLPATRGTVSDRNGAVLALSAPTESLFAVPKEMKEMPSAAQLERLSELVDV
                  70        80        90       100       110       120

                 130       140       150       160       170       180
g793.pep  PVDVLRNKLEQKGKSFIWIKRQLDPKVAEEVKALGLENFVFEKELKRHYPMGNLFAHVIG
          ||||||||||||||||||||||||||||||||||||||||||||||||||||||||||||
m793      PVDVLRNKLEQKGKSFIWIKRQLDPKVAEEVKALGLENFVFEKELKRHYPMGNLFAHVIG
                 130       140       150       160       170       180

                 190       200       210       220       230       240
g793.pep  FTDIDGKGQEGLELSLEDSLYGEDGAEVVLRDRQGNIVDSLDSPRNKAPQNGKDIILSLD
          ||||||||||||||||||||:||||||||||||||||||||||||||||||:||||||||||
m793      FTDIDGKGQEGLELSLEDSLHGEDGAEVVLRDRQGNIVDSLDSPRNKAPKNGKDIILSLD
                 190       200       210       220       230       240

                 250       260       270       280       290       300
g793.pep  QRIQTLAYEELNKAVEYHQAKAGTVVVLDARTGEILALANTPAYDPNRPGRADSEQRRNR
          ||||||||||||||||||||||||||||||||||||||||||||||||||||||||||||
m793      QRIQTLAYEELNKAVEYHQAKAGTVVVLDARTGEILALANTPAYDPNRPGRADSEQRRNR
                 250       260       270       280       290       300

                 310       320       330       340       350       360
g793.pep  AVTDMIEPGSAIKPFVIAKALDAGKTDLNERLNTQPYKIGPSPVRDDTHVYPSLDVRGIM
          |||||||||||||||||||||||||||||||||||||||||||||| |||||||||||||
m793      AVTDMIEPGSAIKPFVIAKALDAGKTDLNERLNTQPYKIGPSPVRD-THVYPSLDVRGIM
                 310       320       330       340       350
```

-continued

```
                 370        380        390        400        410        420
g793.pep  QKSSNVGTSKLSARFGAEEMYDFYHELGIGVRMHSGFPGETAGLLRNWRRWRPIEQATMS
          ||||||||||||||||||||||||||||||||||||||||||||||||||||||||||||
m793      QKSSNVGTSKLSARFGAEEMYDFYHELGIGVRMHSGFPGETAGLLRNWRRWRPIEQATMS
        360        370        380        390        400        410

                 430        440        450        460        470        480
g793.pep  FGYGLQLSLLQLARAYTALTHDGVLLPLSFEKQAVAPQGKRIFKESTAREVRNLMVSVTE
          ||||||||||||||||||||||||||:|||||||||||||||||||||||||||||||||
m793      FGYGLQLSLLQLARAYTALTHDGVLLPVSFEKQAVAPQGKRIFKESTAREVRNLMVSVTE
        420        430        440        450        460        470

                 490        500        510        520        530        540
g793.pep  PGGTGTAGAVDGFDVGAKTGTARKFVNGRYADNKHVATFIGFAPAKNPRVIVAVTIDEPT
          ||||||||||||||||||||||||||||||||||||:|||||||||||||||||||||||
m793      PGGTGTAGAVDGFDVGAKTGTARKFVNGRYADNKHIATFIGFAPAKNPRVIVAVTIDEPT
        480        490        500        510        520        530

                 550        560        570        580
g793.pep  AHGYYGGVVAGPPFKKIMGGSLNILGISPTKPLTAAAVKTPSX
          |||||||||||||||||||||||||||||||||||||||||||
m793      AHGYYGGVVAGPPFKKIMGGSLNILGISPTKPLTAAAVKTPSX
        540        550        560        570        580
```

The following partial DNA sequence was identified in *N. meningitidis* <SEQ ID 2691>:

```
a793.seq
     1  ATGTTGATTA AGAGCGAATA TAAGCCTCGG ATGCTGCCCA AAGAAGAGCA
    51  GGTCAAAAAG CCGATGACCA GTAACGGACG GATCAGCTTC GTCCTGATGG
   101  CAATAGCGGT CTTGTTTGCC GGTCTGATTG CTCGCGGACT GTATCTGCAG
   151  ACGGTAACGT ATAACTTTTT GAAAGAACAG GGCGACAACC GGATTGTGCG
   201  GACTCAAACA TTGCCGGCTA CACGCGGTAC GGTTTCGGAC CGGAACGGTG
   251  CGGTTTTGGC GTTGAGTGCG CCGACGGAGT CCCTGTTTGC CGTGCCTAAA
   301  GAGATGAAGG AAATGCCGTC TGCCGCACAA TTGGAACGCC TGTCCGAGCT
   351  TGTCGATGTG CCGGTTGATG TTTTGAGGAA CAAGCTCGAA CAGAAAGGCA
   401  AGTCGTTTAT CTGGATTAAG CGGCAGCTCG ATCCCAAGGT TGCCGAAGAG
   451  GTCAAAGCCT TGGGTTTGGA AAACTTTGTA TTTGAAAAAG AATTAAAACG
   501  CCATTACCCG ATGGGCAACC TGTTTGCACA CGTCATCGGA TTTACCGATA
   551  TTGACGGCAA AGGTCAGGAA GGTTTGGAAC TTTCGCTTGA AGACAGCCTG
   601  CATGGCGAAG ACGGCGCGGA AGTCGTTTTG CGGGACCGGC AGGGCAATAT
   651  TGTGGACAGC TTGGACTCCC CGCGCAATAA AGCCCCGAAA AACGGCAAAG
   701  ACATCATCCT TTCCCTCGAT CAGAGGATTC AGACCTTGGC CTATGAAGAG
   751  TTGAACAAGG CGGTCGAATA CCATCAGGCA AAAGCCGGAA CGGTGGTGGT
   801  TTTGGATGCC CGCACGGGGG AAATCCTCGC CTTGGCCAAT ACGCCCGCCT
   851  ACGATCCCAA CAGGCCCGGC CGGGCAGACA GCGAACAGCG GCGCAACCGT
   901  GCCGTAACCG ATATGATCGA ACCCGGTTCG GCAATCAAAC CGTTTGTGAT
   951  TGCGAAGGCA TTGGATGCGG GCAAAACCGA TTTGAACGAA CGGCTGAATA
  1001  CGCAGCCTTA TAAAATCGGA CCGTCTCCCG TGCGCGATAC CCATGTTTAC
  1051  CCCTCTTTGG ATGTGCGCGG CATCATGCAG AAATCGTCCA ACGTCGGCAC
  1101  AAGCAAACTG TCTGCGCGTT TCGGTGCCGA AGAAATGTAT GACTTCTATC
  1151  ATGAGTTGGG CATCGGTGTG CGTATGCACT CGGGCTTTCC GGGCGAAACT
```

-continued

```
1201 GCAGGTTTGT TGAGAAATTG GCGCAGGTGG CGGCCTATCG AACAGGCGAC

1251 GATGTCTTTC GGTTACGGCC TGCAATTGAG CCTGCTGCAA TTGGCGCGCG

1301 CCTATACCGC ACTGACGCAC GACGGCGTTT TACTGCCGGT CAGCTTTGAA

1351 AAACAGGCGG TTGCGCCGCA AGGCAAACGC ATATTCAAAG AATCGACCGC

1401 GCGCGAGGTA CGCAATCTGA TGGTTTCCGT AACCGAGCCG GGCGGCACCG

1451 GTACGGCGGG TGCGGTGGAC GGTTTCGATG TCGGCGCGAA AACCGGCACG

1501 GCGCGCAAGT TCGTCAACGG GCGTTATGCC GACAACAAAC ACATCGCTAC

1551 CTTTATCGGT TTTGCCCCCG CCAAAAATCC CCGTGTGATT GTGGCGGTAA

1601 CCATTGACGA ACCGACTGCC CACGGTTATT ACGGCGGCGT AGTGGCAGGG

1651 CCGCCCTTCA AAAAAATTAT GGGCGGCAGC CTGAACATCT TGGGCATTTC

1701 CCCGACCAAG CCACTGACCG CCGCAGCCGT CAAAACACCG TCTTAA
```

This corresponds to the amino acid sequence <SEQ ID 2692; ORF 793.a>:

```
a793.pep

      1  MLIKSEYKPR MLPKEEQVKK PMTSNGRISF VLMAIAVLFA GLIARGLYLQ

     51  TVTYNFLKEQ GDNRIVRTQT LPATRGTVSD RNGAVLALSA PTESLFAVPK

    101  EMKEMPSAAQ LERLSELVDV PVDVLRNKLE QKGKSFIWIK RQLDPKVAEE

    151  VKALGLENFV FEKELKRHYP MGNLFAHVIG FTDIDGKGQE GLELSLEDSL

    201  HGEDGAEVVL RDRQGNIVDS LDSPRNKAPK NGKDIILSLD QRIQTLAYEE

    251  LNKAVEYHQA KAGTVVVLDA RTGEILALAN TPAYDPNRPG RADSEQRRNR

    301  AVTDMIEPGS AIKPFVIAKA LDAGKTDLNE RLNTQPYKIG PSPVRDTHVY

    351  PSLDVRGIMQ KSSNVGTSKL SARFGAEEMY DFYHELGIGV RMHSGFPGET

    401  AGLLRNWRRW RPIEQATMSF GYGLQLSLLQ LARAYTALTH DGVLLPVSFE

    451  KQAVAPQGKR IFKESTAREV RNLMVSVTEP GGTGTAGAVD GFDVGAKTGT

    501  ARKFVNGRYA DNKHIATFIG FAPAKNPRVI VAVTIDEPTA HGYYGGVVAG

    551  PPFKKIMGGS LNILGISPTK PLTAAAVKTP S*

a793/m793 100.0% identity in 581 aa overlap

                    10        20        30        40        50        60
a793.pep    MLIKSEYKPRMLPKEEQVKKPMTSNGRISFVLMAIAVLFAGLIARGLYLQTVTYNFLKEQ
            ||||||||||||||||||||||||||||||||||||||||||||||||||||||||||||
m793        MLIKSEYKPRMLPKEEQVKKPMTSNGRISFVLMAIAVLFAGLIARGLYLQTVTYNFLKEQ
                    10        20        30        40        50        60

                    70        80        90       100       110       120
a793.pep    GDNRIVRTQTLPATRGTVSDRNGAVLALSAPTESLFAVPKEMKEMPSAAQLERLSELVDV
            ||||||||||||||||||||||||||||||||||||||||||||||||||||||||||||
m793        GDNRIVRTQTLPATRGTVSDRNGAVLALSAPTESLFAVPKEMKEMPSAAQLERLSELVDV
                    70        80        90       100       110       120

                   130       140       150       160       170       180
a793.pep    PVDVLRNKLEQKGKSFIWIKRQLDPKVAEEVKALGLENFVFEKELKRHYPMGNLFAHVIG
            ||||||||||||||||||||||||||||||||||||||||||||||||||||||||||||
m793        PVDVLRNKLEQKGKSFIWIKRQLDPKVAEEVKALGLENFVFEKELKRHYPMGNLFAHVIG
                   130       140       150       160       170       180

                   190       200       210       220       230       240
a793.pep    FTDIDGKGQEGLELSLEDSLHGEDGAEVVLRDRQGNIVDSLDSPRNKAPKNGKDIILSLD
            ||||||||||||||||||||||||||||||||||||||||||||||||||||||||||||
m793        FTDIDGKGQEGLELSLEDSLHGEDGAEVVLRDRQGNIVDSLDSPRNKAPKNGKDIILSLD
                   190       200       210       220       230       240
```

-continued

```
                 250        260        270        280        290        300
a793.pep  QRIQTLAYEELNKAVEYHQAKAGTVVVLDARTGEILALANTPAYDPNRPGRADSEQRRNR
          ||||||||||||||||||||||||||||||||||||||||||||||||||||||||||||
m793      QRIQTLAYEELNKAVEYHQAKAGTVVVLDARTGEILALANTPAYDPNRPGRADSEQRRNR
                 250        260        270        280        290        300
                 310        320        330        340        350        360
a793.pep  AVTDMIEPGSAIKPFVIAKALDAGKTDLNERLNTQPYKIGPSPVRDTHVYPSLDVRGIMQ
          ||||||||||||||||||||||||||||||||||||||||||||||||||||||||||||
m793      AVTDMIEPGSAIKPFVIAKALDAGKTDLNERLNTQPYKIGPSPVRDTHVYPSLDVRGIMQ
                 310        320        330        340        350        360
                 370        380        390        400        410        420
a793.pep  KSSNVGTSKLSARFGAEEMYDFYHELGIGVRMHSGFPGETAGLLRNWRRWRPIEQATMSF
          ||||||||||||||||||||||||||||||||||||||||||||||||||||||||||||
m793      KSSNVGTSKLSARFGAEEMYDFYHELGIGVRMHSGFPGETAGLLRNWRRWRPIEQATMSF
                 370        380        390        400        410        420
                 430        440        450        460        470        480
a793.pep  GYGLQLSLLQLARAYTALTHDGVLLPVSFEKQAVAPQGKRIFKESTAREVRNLMVSVTEP
          ||||||||||||||||||||||||||||||||||||||||||||||||||||||||||||
m793      GYGLQLSLLQLARAYTALTHDGVLLPVSFEKQAVAPQGKRIFKESTAREVRNLMVSVTEP
                 430        440        450        460        470        480
                 490        500        510        520        530        540
a793.pep  GGTGTAGAVDGFDVGAKTGTARKFVNGRYADNKHIATFIGFAPAKNPRVIVAVTIDEPTA
          ||||||||||||||||||||||||||||||||||||||||||||||||||||||||||||
m793      GGTGTAGAVDGFDVGAKTGTARKFVNGRYADNKHIATFIGFAPAKNPRVIVAVTIDEPTA
                 490        500        510        520        530        540
                 550        560        570        580
a793.pep  HGYYGGVVAGPPFKKIMGGSLNILGISPTKPLTAAAVKTPSX
          ||||||||||||||||||||||||||||||||||||||||||
m793      HGYYGGVVAGPPFKKIMGGSLNILGISPTKPLTAAAVKTPSX
                 550        560        570        580
```

The following partial DNA sequence was identified in *N. gonorrhoeae* <SEQ ID 2693>:

```
g794.seq
   1  gtgcgtttca ATCATTTCAT AATGGTAACG ATTATTATAT ATGTGATTTC
  51  CCCTGCAAAC AAGCCGGTCC GCCGCCCCGG CGTTCCCACT TATCCGGCTT
 101  TGCCTTATAA TTGCTTTTTT TATGTAACAG ATTCACCTAT GAATTTCCCC
 151  AAAACAGCGG CCTCCCTGCT GCTGCTTCTC GCCTCCCTCG CCGCACACGC
 201  GCTCGATACC GGCCGCATTC CGCAAAACGA AATCGCTGTA TATGTCCAAG
 251  AGCTTGACAG CGGAAAAGTC ATCATTGACC ACCGTGCCGG CATACCCGTC
 301  AATCCCGCGT CCACGATGAA GCTCGTTACC GCGTTTGCCG CCTTCAAAAC
 351  CTTCGGCAGC AATTACCGCT GGGCGACCGA GTTTAAAAGC AACGGTACGG
 401  TAAACGACGG CACGCTTGAC GGAAACCTGT ATTGGGCGGG CAGCGGCGAC
 451  CCCGTTTTCA ATCAGGAAAA CCTGCTTGCC GTCCAACGCC AGTTGCGCGA
 501  CAAAGGCATC CGCAATATCA CGGGGCGCCT GATGCTCGAC CACAGCCTGT
 551  GGGGCGAAGT CGGCAGTCCC GACCATTTTG AAGCCGACAG CGGTTCGCCG
 601  TTTATGACGC CCCCAAATCC GACTATGCTG TCTGCCGGTA TGGTTATGGT
 651  GCGCGCCGAA CGCAATGCCG CCGGCAGTAC CGACATCCTC ACCGATCCGC
 701  CTTTGCCGCA TATTTTTGCC CAAAACAACT TGAAAATTAC CGCCTCCCAA
 751  GCTGCCTGCC CTTCGGTCAA AAAACTGATG CGCGCATCTT TTTCGGGCAA
 801  TACGCTGAAA TTGCGCGGCA ATATTCCCGA AAGCTGTTTG GGCAAGCCTG
 851  TCGGTGTCCG GATGTTCGCG CTTGACGAAC TGATCCGCCA AAGTTTTACC
```

-continued

```
 901 AACCGCTGGC TGCTCGGCGG CGGACGGATT TCAGACGGCA TCGGCATAGC
 951 CGACACACCG GAAGGCGCGC AGACGCTTGC CGTTGCACAC TCCAAACCGA
1001 TGAAGGAAAT TTTGACGGAC ATGAACAAGC GTTCGGACAA TCTGATTGCG
1051 CGTTCCGTCT TCCTCAAACT CGGCGGCGAC GGCAAACTGC CCGCCGTTTC
1101 CGAACAGGCG GCGTCTGCCG TCCGGCGAGA ACTTGCCGTA TCGGGCATCG
1151 ATGTTGCGGA TTTGGTTTTG GAAAACGGTT CGGGTCTGTC CAGAAAAGAA
1201 AGGGTAACGG CGAGAATGAT GGCGCAAATG TTGGAAACGG CTTATTTCAG
1251 CCCGTTTGCA CAAGATTTCA TCGACACGCT GCCCATCGCC GGCACAGACG
1301 GGACTTTACG CAACCGCTTC AAACAAAGCG GCGGGCTGTT GCGCTTAAAA
1351 ACCGGCACGC TCAACAATGT CCGCGCCCTT GCAGGTTATT GGCTGGGCGA
1401 CAAACCGATG GCGGTGGTCG TCATCATCAA CAGCGGCCGC GCCGTTTCCC
1451 TGCTGCCCGA CTTGGACAAC TTCGTTGCCA AAAACATCAT CTCCGGCGGC
1501 GACGGCTGGC TGGATGCGAA ACTGATGTGC AAAGAACGCC GCGCCTGA
```

This corresponds to the amino acid sequence <SEQ ID 2694; ORF 794.ng>:

```
g794.pep
  1 VRFNHFIMVT IIIYVISPAN KPVRRPGVPT YPALPYNCFF YVTDSPMNFP
 51 KTAASLLLLL ASLAAHALDT GRIPQNEIAV YVQELDSGKV IIDHRAGIPV
101 NPASTMKLVT AFAAFKTFGS NYRWATEFKS NGTVNDGTLD GNLYWAGSGD
151 PVFNQENLLA VQRQLRDKGI RNITGRLMLD HSLWGEVGSP DHFEADSGSP
201 FMTPPNPTML SAGMVMVRAE RNAAGSTDIL TDPPLPHIFA QNNLKITASQ
251 AACPSVKKLM RASFSGNTLK LRGNIPESCL GKPVGVRMFA LDELIRQSFT
301 NRWLLGGGRI SDGIGIADTP EGAQTLAVAH SKPMKEILTD MNKRSDNLIA
351 RSVFLKLGGD GKLPAVSEQA ASAVRRELAV SGIDVADLVL ENGSGLSRKE
401 RVTARMMAQM LETAYFSPFA QDFIDTLPIA GTDGTLRNRF KQSGGLLRLK
451 TGTLNNVRAL AGYWLGDKPM AVVVIINSGR AVSLLPDLDN FVAKNIISGG
501 DGWLDAKLMC KERRA*
```

The following partial DNA sequence was identified in *N. meningitidis* <SEQ ID 2695>:

```
m794.seq
  1 GTGCGTCTCA ATCATTTCAT AATGATAGCG ATTATTATAT ATGTGATTTC
 51 CCCTGCAAAC AAGCCGGCCC GCCGCCACAG CGTTCCCACT TATCCGGCTT
101 TGCCTTATAA TTGCTTTTTT TATGTAACAG ATTTACCTAT GAATTTCCCC
151 AAAACAGCGG CCTCCCTGCT GCTGCTTCTC GCCTCCCTCG CCGCACACGC
201 GCTCGATACC GGCCGCATTC CGCAAAACGA AATCGCCGTA TATGTCCAAG
251 AGCTTGACAG CGGAAAAGTC ATCATTGACC ACCGCTCGGA TGTCCCCGTC
301 AACCCCGCCT CCACAATGAA ACTCGTTACC GCGTTTGCCG CCTTCAAAAC
351 CTTCGGCAGC AATTACCGCT GGGCGACCGA GTTTAAAAGC AACGGTACGG
401 TAAACGACGG CACGCTTGAC GGAAACCTAT ATTGGGCGGG CAGCGGCGAC
451 CCCGTTTTCA ATCAGGAAAA CCTGCTTGAT GCTCAAAAAC AGTTGCGCGA
```

-continued

```
 501 ACAAGGCATA CTCAATATCA CGGGACACCT GATGCTCGAC CACAGCCTGT

 551 GGGGCGAAGT CGGCAGCCCC GACGATTTCG AAGCCGACAG CGGTTCGCCG

 601 TTTATGACGC CCCCCAATCC AACTATGCTG TCTGCCGGTA TGGTTATGGT

 651 GCGCGCCGAA CGCAATGCCG CCGGCAGTAC CGACATCCTC ACCGATCCGC

 701 CTTTGCCGCA TATTTTCGCC CAAAACAACT TGAAAATTAC CGCCTCCCAA

 751 GCTGCCTGCC CTTCGATCAA AAAACTGATG CGTGCATCTT TTTCGGACAA

 801 TACGCTGAAA TTGCGCGGCA ATATTCCCGA GAGCTGTTTG GGCAAGCCTG

 851 TCGGTGTCCG GATGTTCGCG CTTGACGAAC TGATCCGGCA AAGTTTTACC

 901 AACCACTGGC TGCTCGGCGG CGGACGGATT TCAGACGGTA TCGGCATAGC

 951 CGACACGCCG GAAGGCGCGC AGACACTTGC CGTTGCACAC GCCAAACCGA

1001 TGAAAGAAAT TTTGACGGAC ATGAACAAGC GTTCGGACAA TCTAATTGCG

1051 CGTTCCGTCT TCCTCAAACT CGGCGGCGAC GGCAAACTGC CCGCCGTTTC

1101 CGAACAGGCG GCGTCTGCCG TCCGGCGCGA ACTTGCCGTA TCGGGCATCG

1151 ATGTTGCGGA TTTGGTTTTG GAAAACGGTT CGGGCCTGTC CAGAAAAGAA

1201 AGGGTAACGG CGAGAATGAT GGCGCAAATG TTGGAAACGG CTTATTTCAG

1251 CCCGTTTGCA CAAGATTTCA TCGACACGCT ACCCATCGCC GGCACAGACG

1301 GAACTTTACG CAACCGCTTC AAACAAAGCG GCGGGCTGTT GCGCTTAAAA

1351 ACCGGCACGC TCAACAATGT CCGCGCCCTT GCAGGTTATT GGCTGGGCGA

1401 CAAACCGATG GCGGTGGTCG TCATCATCAA CAGCGGCCGC GCCGTTTCCC

1451 TGCTGCCAGA CTTGGACAAC TTCGTTGCCA ACAACATCAT CTCCGGCGGC

1501 GATGGCTGGC TGGATGCGAA ACTGATGTGC AAAGAACGCC GAGCCTGA
```

This corresponds to the amino acid sequence <SEQ ID 2696; ORF 794>:

```
m794.pep

  1  VRLNHFIMIA IIIYVISPAN KPARRHSVPT YPALPYNCFF YVTDLPMNFP

 51  KTAASLLLLL ASLAAHALDT GRIPQNEIAV YVQELDSGKV IIDHRSDVPV

101  NPASTMKLVT AFAAFKTFGS NYRWATEFKS NGTVNDGTLD GNLYWAGSGD

151  PVFNQENLLD AQKQLREQGI LNITGHLMLD HSLWGEVGSP DDFEADSGSP

201  FMTPPNPTML SAGMVMVRAE RNAAGSTDIL TDPPLPHIFA QNNLKITASQ

251  AACPSIKKLM RASFSDNTLK LRGNIPESCL GKPVGVRMFA LDELIRQSFT

301  NHWLLGGGRI SDGIGIADTP EGAQTLAVAH AKPMKEILTD MNKRSDNLIA

351  RSVFLKLGGD GKLPAVSEQA ASAVRRELAV SGIDVADLVL ENGSGLSRKE

401  RVTARMMAQM LETAYFSPFA QDFIDTLPIA GTDGTLRNRF KQSGGLLRLK

451  TGTLNNVRAL AGYWLGDKPM AVVVIINSGR AVSLLPDLDN FVANNIISGG

501  DGWLDAKLMC KERRA*

g794/m794 95.5% identity in 515 aa overlap

                    10        20        30        40        50        60
g794.pep  VRFNHFIMVTIIIYVISPANKPVRRPGVPTYPALPYNCFFYVTDSPMNFPKTAASLLLLL
          ||:|||||::||||||||||||:|| :||||||||||||||||| |||||||||||||||
m794      VRLNHFIMIAIIIYVISPANKPARRHSVPTYPALPYNCFFYVTDLPMNFPKTAASLLLLL
                    10        20        30        40        50        60
```

-continued

```
                    70        80        90       100       110       120
g794.pep    ASLAAHALDTGRIPQNEIAVYVQELDSGKVIIDHRAGIPVNPASTMKLVTAFAAFKTFGS
            ||||||||||||||||||||||||||||||||||: :|||||||||||||||||||||||
m794        ASLAAHALDTGRIPQNEIAVYVQELDSGKVIIDHRSDVPVNPASTMKLVTAFAAFKTFGS
                    70        80        90       100       110       120

                   130       140       150       160       170       180
g794.pep    NYRWATEFKSNGTVNDGTLDGNLYWAGSGDPVFNQENLLAVQRQLRDKGIRNITGRLMLD
            |||||||||||||||||||||||||||||||||||||| :|:|||::|| ||||:||||
m794        NYRWATEFKSNGTVNDGTLDGNLYWAGSGDPVFNQENLLDAQKQLREQGILNITGHLMLD
                   130       140       150       160       170       180

                   190       200       210       220       230       240
g794.pep    HSLWGEVGSPDHFEADSGSPFMTPPNPTMLSAGMVMVRAERNAAGSTDILTDPPLPHIFA
            |||||||||| |||||||||||||||||||||||||||||||||||||||||||||||||
m794        HSLWGEVGSPDDFEADSGSPFMTPPNPTMLSAGMVMVRAERNAAGSTDILTDPPLPHIFA
                   190       200       210       220       230       240

                   250       260       270       280       290       300
g794.pep    QNNLKITASQAACPSVKKLMRASFSGNTLKLRGNIPESCLGKPVGVRMFALDELIRQSFT
            ||||||||||||||:|||||||||| ||||||||||||||||||||||||||||||||||
m794        QNNLKITASQAACPSIKKLMRASFSDNTLKLRGNIPESCLGKPVGVRMFALDELIRQSFT
                   250       260       270       280       290       300

                   310       320       330       340       350       360
g794.pep    NRWLLGGGRISDGIGIADTPEGAQTLAVAHSKPMKEILTDMNKRSDNLIARSVFLKLGGD
            |:||||||||||||||||||||||||||||:|||||||||||||||||||||||||||||
m794        NHWLLGGGRISDGIGIADTPEGAQTLAVAHAKPMKEILTDMNKRSDNLIARSVFLKLGGD
                   310       320       330       340       350       360

                   370       380       390       400       410       420
g794.pep    GKLPAVSEQAASAVRRELAVSGIDVADLVLENGSGLSRKERVTARMMAQMLETAYFSPFA
            ||||||||||||||||||||||||||||||||||||||||||||||||||||||||||||
m794        GKLPAVSEQAASAVRRELAVSGIDVADLVLENGSGLSRKERVTARMMAQMLETAYFSPFA
                   370       380       390       400       410       420

                   430       440       450       460       470       480
g794.pep    QDFIDTLPIAGTDGTLRNRFKQSGGLLRLKTGTLNNVRALAGYWLGDKPMAVVVIINSGR
            ||||||||||||||||||||||||||||||||||||||||||||||||||||||||||||
m794        QDFIDTLPIAGTDGTLRNRFKQSGGLLRLKTGTLNNVRALAGYWLGDKPMAVVVIINSGR
                   430       440       450       460       470       480

                   490       500       510
g794.pep    AVSLLPDLDNFVAKNIISGGDGWLDAKLMCKERRAX
            |||||||||||||:||||||||||||||||||||||
m794        AVSLLPDLDNFVANNIISGGDGWLDAKLMCKERRAX
                   490       500       510
```

The following partial DNA sequence was identified in *N. meningitidis* <SEQ ID 2697>:

```
a794.seq
    1  GTGCGTCTCA ATCATTTCAT AATGATAGCG ATTATTATAT ATGTGATTTC
   51  CCCTGCAAAC AAGCCGGCCC GCCGCCACAG CGTTCCCACT TATCCGGCTT
  101  TGCCTTATAA TTGCTTTTTT TATGTAACAG ATTTACCTAT GAATTTCCCC
  151  AAAACAGCGG CCTCCCTGCT GCTGCTTCTC GCCTCCCTCG CCGCACACGC
  201  GCTCGATACA GGTCGCATTC CGCAAAACGA AATCGCCGTA TATGTCCAAG
  251  AGCTTGACAG CGGAAAAGTC ATCATTGACC ACCGCTCGGA TGTCCCCGTC
  301  AACCCCGCCT CCACAATGAA ACTCGTTACC GCGTTTGCCG CCTTCAAAAC
  351  CTTCGGCAGC AATTACCGCT GGGCGACCGA GTTTAAAAGC AACGGTACGG
  401  TAAACGACGG CACGCTTGAC GGAAACCTGT ATTGGGCGGG CAGCGGCGAC
  451  CCCGTTTTCA ATCAGGAAAA CCTGCTTGCC GTCCAACGCC AGTTGCGCGA
  501  ACAAGGCATA CGCAATATCA CGGGACACCT GATGCTCGAC CACAGCCTGT
  551  GGGGCGAAGT CGGCAGCCCC GACGATTTCG AAGCCGACAG CGGTTCGCCG
```

-continued

```
 601 TTTATGACGC CCCCCAATCC AACTATGCTG TCTGCCGGTA TGGTTATGGT
 651 GCGCGCCGAA CGCAATGCCG CCGACAGTAC CGACATCCTC ACCGATCCGC
 701 CTTTGCCGCA TATTTTCGCC CAAAACAACT TGAAAATTAC CGCCTCCCAA
 751 GCTGCCTGCC CTTCGATCAA AAAACTGATG CGTGCATCTT TTTCGGACAA
 801 TACGCTGAAA TTGCGCGGCA ATATTCCCGA GAGCTGTTTG GGCAAGCCTG
 851 TCGGTGTCCG GATGTTCGCG CTTGACGAAC TGATCCGGCA AAGTTTTACC
 901 AACCACTGGC TGCTCGGCGG CGGACGGATT TCAGACGGCA TCGGCATATC
 951 CGACACGCCG GAAGGCGCGC AGACGCTTGC CGTTGCACAC TCAAAGCCGA
1001 TGAAGGAAAT TTTGACGGAC ATGAACAAGC GTTCGGACAA TCTAATTGCG
1051 CGTTCCGTCT TCCTCAAACT CGGCGGCGAC GGCAAACTGC CCGCCGTTTC
1101 CGAACAGGCA GCGTCTGCCG TCCGGCGTGA ACTTGCCGTG TCGGGCATCG
1151 ATGTTGCGGA TTTGGTTTTG GAAAACGGTT CAGGTCTGTC CAGAAAAGAA
1201 AGGGTAACGG CGAGAATGAT GGCGCAAATG TTGGAAACGG CTTATTTCAG
1251 CCCGTTTGCA CAAGATTTCA TCGATACGCT GCCCATCGCC GGCACAGACG
1301 GGACTTTACG CAACCGCTTC AAACAAAGCG GCGGGCTGTT GCGCTTAAAA
1351 ACCGGCACGC TCAACAATGT CCGCGCCCTT GCAGGTTATT GGCTGGGCGA
1401 CAAACCGATG GCGGTGGTCG TCATCATCAA CAGCGGCCGC GCCGTTTCCC
1451 TGCTGCCCGA CTTGGACAAC TTCGTTGCCA ACAACATCAT CTCCGGCGGC
1501 GATGGCTGGC TGGATGCGAA ACTGATGTGC AAAGAACGCC GAGCCTGA
```

This corresponds to the amino acid sequence <SEQ ID 2698; ORF 794.a>:

```
a794.pep

  1 VRLNHFIMIA IIIYVISPAN KPARRHSVPT YPALPYNCFF YVTDLPMNFP
 51 KTAASLLLLL ASLAAHALDT GRIPQNEIAV YVQELDSGKV IIDHRSDVPV
101 NPASTMKLVT AFAAFKTFGS NYRWATEFKS NGTVNDGTLD GNLYWAGSGD
151 PVFNQENLLA VQRQLREQGI RNITGHLMLD HSLWGEVGSP DDFEADSGSP
201 FMTPPNPTML SAGMVMVRAE RNAADSTDIL TDPPLPHIFA QNNLKITASQ
251 AACPSIKKLM RASFSDNTLK LRGNIPESCL GKPVGVRMFA LDELIRQSFT
301 NHWLLGGGRI SDGIGISDTP EGAQTLAVAH SKPMKEILTD MNKRSDNLIA
351 RSVFLKLGGD GKLPAVSEQA ASAVRRELAV SGIDVADLVL ENGSGLSRKE
401 RVTARMMAQM LETAYFSPFA QDFIDTLPIA GTDGTLRNRF KQSGGLLRLK
451 TGTLNNVRAL AGYWLGDKPM AVVVIINSGR AVSLLPDLDN FVANNIISGG
501 DGWLDAKLMC KERRA*

a794/m794 98.6% identity in 515 aa overlap

                   10        20        30        40        50        60
a794.pep   VRLNHFIMIAIIIYVISPANKPARRHSVPTYPALPYNCFFYVTDLPMNFPKTAASLLLLL
           ||||||||||||||||||||||||||||||||||||||||||||||||||||||||||||
m794       VRLNHFIMIAIIIYVISPANKPARRHSVPTYPALPYNCFFYVTDLPNMFPKTAASLLLLL
                   10        20        30        40        50        60

                   70        80        90       100       110       120
a794.pep   ASLAAHALDTGRIPQNEIAVYVQELDSGKVIIDHRSDVPVNPASTMKLVTAFAAFKTFGS
           ||||||||||||||||||||||||||||||||||||||||||||||||||||||||||||
m794       ASLAAHALDTGRIPQNEIAVYVQELDSGKVIIDHRSDVPVNPASTMKLVTAFAAFKTFGS
                   70        80        90       100       110       120
```

```
              130         140        150         160         170        180
a794.pep   NYRWATEFKSNGTVNDGTLDGNLYWAGSGDPVFNQENLLAVQRQLREQGIRNITGHLMLD
           ||||||||||||||||||||||||||||||||||||||:|:||||||| ||||||||||
m794       NYRWATEFKSNGTVNDGTLDGNLYWAGSGDPVFNQENLLDAQKQLREQGILNITGHLMLD
              130         140        150         160         170        180

              190         200        210         220         230        240
a794.pep   HSLWGEVGSPDDFEADSGSPFMTPPNPTMLSAGMVMVRAERNAADSTDILTDPPLPHIFA
           |||||||||||||||||||||||||||||||||||||||||||| |||||||||||||||
m794       HSLWGEVGSPDDFEADSGSPFMTPPNPTMLSAGMVMVRAERNAAGSTDILTDPPLPHIFA
              190         200        210         220         230        240

              250         260        270         280         290        300
a794.pep   QNNLKITASQAACPSIKKLMRASFSDNTLKLRGNIPESCLGKPVGVRMFALDELIRQSFT
           ||||||||||||||||||||||||||||||||||||||||||||||||||||||||||||
m794       QNNLKITASQAACPSIKKLMRASFSDNTLKLRGNIPESCLGKPVGVRMFALDELIRQSFT
              250         260        270         280         290        300

              310         320        330         340         350        360
a794.pep   NHWLLGGGRISDGIGISDTPEGAQTLAVAHSKPMKEILTDMNKRSDNLIARSVFLKLGGD
           |||||||||||||||:||||||||||||||:|||||||||||||||||||||||||||||
m794       NHWLLGGGRISDGIGIADTPEGAQTLAVAHAKPMKEILTDMNKRSDNLIARSVFLKLGGD
              310         320        330         340         350        360

              370         380        390         400         410        420
a794.pep   GKLPAVSEQAASAVRRELAVSGIDVADLVLENGSGLSRKERVTARMMAQMLETAYFSPFA
           ||||||||||||||||||||||||||||||||||||||||||||||||||||||||||||
m794       GKLPAVSEQAASAVRRELAVSGIDVADLVLENGSGLSRKERVTARMMAQMLETAYFSPFA
              370         380        390         400         410        420

              430         440        450         460         470        480
a794.pep   QDFIDTLPIAGTDGTLRNRFKQSGGLLRLKTGTLNNVRALAGYWLGDKPMAVVVIINSGR
           ||||||||||||||||||||||||||||||||||||||||||||||||||||||||||||
m794       QDFIDTLPIAGTDGTLRNRFKQSGGLLRLKTGTLNNVRALAGYWLGDKPMAVVVIINSGR
              430         440        450         460         470        480

              490         500        510
a794.pep   AVSLLPDLDNFVANNIISGGDGWLDAKLMCKERRAX
           ||||||||||||||||||||||||||||||||||||
m794       AVSLLPDLDNFVANNIISGGDGWLDAKLMCKERRAX
              490         500        510
```

The following partial DNA sequence was identified in *N. gonorrhoeae* <SEQ ID 2699>:

```
g900.seq
    1  ATGccgTCTG AAATGCCGTC TGAAACGTGG CAGGCGGAGG TTCGGACGGC

   51  ATTGGGTTTA TTTCAACGGG CGGATGCCGA CCGCATCGCG TACTTTATCC

  101  AACAATTCGC GCGCTTCTTT GCGCGCTTTT TGCGCGCcctg cctGCAAAAT

  151  CTCTTCGATT TGCGAAGGAT TAGAGGTCAA TGCGTTGTAG CGTTCGCGCA

  201  GTTCTGCCAA TTCGGCGTTG ATTTTCGCCG CCGAAAGTTT TTTCGCCTCG

  251  CCCCAAGCCA AGCCGTCGGC AAGCATTTGC GTAAATTCCG CCGTTTCAGA

  301  CGGCGTGGAG AAGGCTTTAT AGATTTCAAA CAAAGGGCTT TCGTCGGGCT

  351  GTTTCGGCTC GCCCGGCTCT TTCATGTTGG TAATGATTTT GTTGACCGAT

  401  TTTTGGGTTT TTTTGTCGTT TTCCCAAAGC GGAATGGTAT TGCCGTAGGA

  451  TTTGGACATT TTGCGTCCGT CCAAACCGAC CAAGAGTTCG ACGTTTTCGT

  501  CGATTTTCAC TTCGGGCagg GTGaagagtt cTTGGAaacc gtgggtgaag

  551  cggccggcAa tgtcgcgcgc cATTTcgacg tgttgGATTT GGTCGCGCCC

  601  GACGGGGACT TCGTTGGCGT TGAACATCAA AATGTCGGCA GTCATCAGAA

  651  TCGGATAACT GAACAAACCC ATTTCCACAC CGAAATCGGG GTCTTCCTGC

  701  CCGTTTTCCG CATTGGCTTG AACGGCGGCT TTGTAGGCGT GGGCGCGGTT

  751  CATCAAACCC TTGGCGGTGA TGCAGGTCAG AATCCAGTTC AACTCCATCA

  801  CTTCGGGAAT GTCGCTTTGG CGGTAGAAGG TGGTGCGCTC GGGGTCGAGT

  851  CCGCAGGCAA GCCAAGTGGC GGCAACGGCt tgGGTGGATT GGTGAATCAT

  901  CTCCTGCTCG TGGCATTTGA TGATGCCGTG GTAATCGGCG AGGAAGAGGA
```

-continued

```
 951 AGGATTCGGT ATCGGGGTTT TGCGCCGCGC GGACGGCGGG GCGGATGGCG

1001 CCGACGTAGT TGCCCAGATG CGGGGTGCCG GTGGTGGTTA CGCCGGTCAG

1051 AACTCGTTTT TTGCTCATAA AAATGTCCTT ACGGCAGCAA TGCCGTCTGA

1101 AAGGGAAAa. gatgcgCCGA TTATACCCGA TTTGCCACAT ACATCCAGCC

1151 GacaACagaC TTTTCCATAT TAA
```

This corresponds to the amino acid sequence <SEQ ID 2700; ORF 900.ng:

```
g900.pep
  1 MPSEMPSETW QAEVRTALGL FQRADADRIA YFIQQFARFF ARFLRACLQN

 51 LFDLRRIRGQ CVVAFAQFCQ FGVDFRRRKF FRLAPSQAVG KHLRKFRRFR

101 RRGEGFIDFK QRAFVGLFRL ARLFHVGNDF VDRFLGFFVV FPKRNGIAVG

151 FGHFASVQTD QEFDVFVDFH FGQGEEFLET VGEAAGNVAR HFDVLDLVAP

201 DGDFVGVEHQ NVGSHQNRIT EQTHFHTEIG VFLPVFRIGL NGGFVGVGAV

251 HQTLGGDAGQ NPVQLHHFGN VALAVEGGAL GVESAGKPSG GNGLGGLVNH

301 LLLVAFDDAV VIGEEEEGFG IGVLRRADGG ADGADVVAQM RGAGGGYAGQ

351 NSFFAHKNVL TAAMPSEREK DAPIIPDLPH TSSRQQTFPY *
```

The following partial DNA sequence was identified in *N. meningitidis* <SEQ ID 2701>:

```
m900.seq
   1 ATGCCGTCTG AAACGCGGCA GGCGGAGGTT CGGACGGCAT CGGGTTCATT

  51 TCAACGGGCG GATGcCGACC GCATCgG.TA CTTTGTCCAA TAATTCGCGT

 101 GCTTCTTTAC GCGCTTTCGC CGCGCCTGCC TGCAAAATCT CTTCGATTTG

 151 CGAAGGGTCG GCGGTCAGCT CGTTGTAGCG TTCGCGCGGT TCGGCGAGTT

 201 CGGCGTTGAT TTTCGCCGCC AAAAGTTTTT TGGCTTCACC CCACGCCAAG

 251 CCGTCGGCAA GCATTTTCGT AAATTCCACC GTTTCAGACG GCGTGGAGAA

 301 GGCTTTGTAG ATTTCAAACA ATGGGCTTTC GTCGGGCTGT TTCGGCTCGC

 351 CCGGCTCTTT CATATTGGTG ATGATTTTGT TGACCGATTT TTGGGTTTTT

 401 tTGTCGTTTT CCCAAAGCGG AATGGTGTTG CCGTAGGATT TGGACATTTT

 451 GCGTCCGTCC AAACCGACCA AGAGTTCGAC GTTTTCATCG ATTTTCACTT

 501 CGGGCAGGGT GAAGAGTTCC CGGAAGCGGT GGTTGAAGCG GCCGGCGATG

 551 TCGCGCGCCA TTTCGACGTG TTGGATTTGG TCGCGCCCGA CgGGCaCTTC

 601 GTTGGCGTTG AACATCAGAA TATCGGCAGT CATCAGAATC GGATAACTGA

 651 ACAAACCCAT TTCCACACCG AAATCAGGGT CTTCCTGCCC GTTTTCTGCA

 701 TTTGCCTGCA CGGCGGCTTT GTAGGCATGG GCGCGGTTCA TCAAACCCTT

 751 GGCAGTGATG CAGGTCAGAA TCCAGTTCAA TTCCATCACT TCgGGAGTGT

 801 CGCTTTGGCG GTAGAAGGTG GTGCGCTCGG GGTCGAGTCC GCAgGCAAGC

 851 CAAGTGGCGG CAACGGCTTG GGTGGATTGG TGAATCATCT CCGGCTCGTG

 901 GCATTTGATG ATACCGTGGT AATCGGCGAG GAAGAGGAAG GATTCGGTAT

 951 CGAGGTTTTG CGCCGCGCGG ACGGCGGGGC GGATGGCGCC GACGTAGTTG

1001 CCCAGATGCG GGATGCCGGT GGTGGTTACG CCGGTCAGAA CTCGTTTTTT
```

-continued

```
1051 GCTCATAAAA ATGTCCTTGC GGCATCAATG CCGTCTGAAA GGGAAAAAGA

1101 TGTGCCGATT ATACCCGATT TGCCACCTAC ATCCAGCCGA CAACAGACTT

1151 TTCCATATTA A
```

This corresponds to the amino acid sequence <SEQ ID 2702; ORF 900>:

```
m900.pep
  1 MPSETRQAEV RTASGSFQRA DADRIXYFVQ *FACFFTRFR RACLQNLFDL

 51 RRVGGQLVVA FARFGEFGVD FRRQKFFGFT PRQAVGKHFR KFHRFRRRGE

101 GFVDFKQWAF VGLFRLARLF HIGDDFVDRF LGFFVVFPKR NGVAVGFGHF

151 ASVQTDQEFD VFIDFHFGQG EEFPEAVVEA AGDVARHFDV LDLVAPDGHF

201 VGVEHQNIGS HQNRITEQTH FHTEIRVFLP VFCICLHGGF VGMGAVHQTL

251 GSDAGQNPVQ FHHFGSVALA VEGGALGVES AGKPSGGNGL GGLVNHLRLV

301 AFDDTVVIGE EEEGFGIEVL RRADGGADGA DVVAQMRDAG GGYAGQNSFF

351 AHKNVLAASM PSEREKDVPI IPDLPPTSSR QQTFPY*
```

Computer analysis of this amino acid sequence gave the following results:

Homology with a Predicted ORF from *N. gonorrhoeae*

ORF 900 shows 87.0% identity over a 386 aa overlap with a predicted ORF (ORF 900.ng) from *N. gonorrhoeae*:

```
m900/g900

                        10        20        30        40        50
m900.pep        MPSETRQAEVRTASGSFQRADADRIGYFVQXFACFFTRFRRACLQNLFDLRRVGGQ
                ||||| ||||||| | |||||||||:||:| || ||:|| ||||||||||||: ||
g900        MPSEMPSETWQAEVRTALGLFQRADADRIAYFIQQFARFFARFLRACLQNLFDLRRIRGQ
                    10        20        30        40        50        60

              60        70        80        90       100       110
m900.pep    LVVAFARFGEFGVDFRRQKFFGFTPRQAVGKHFRKFHRFRRRGEGFVDFKQWAFVGLFRL
             |||||:| :|||||||:||| ::| ||||||:|||:|||||||||:|||| | ||||||
g900        CVVAFAQFCQFGVDFRRRKFFRLAPSQAVGKHLRKFRRFRRRGEGFIDFKQRAGVGLFRL
                    70        80        90       100       110       120

             120       130       140       150       160       170
m900.pep    ARLFHIGDDFVDRFLGFFVVFPKRNGVAVGFGHFASVQTDQEFDVFIDFHFGQGEEFPEA
            |||||:|:||||||||||||||||||:|||||||||||||||||||:|||||||||| |:
g900        ARLFHVGNDFVDRFLGFFVVFPKRNGIAVGFGHFASVQTDQEFDVFVDFHFGQGEEFLET
                   130       140       150       160       170       180

             180       190       200       210       220       230
m900.pep    VVEAAGDVARHFDVLDLVAPDGHFVGVEHQNIGSHQNRITEQTHFHTEIRVFLPVFCICL
            | ||||:||||||||||||||| ||||||||:||||||||||||||||| |||||| | |
g900        VGEAAGNVARHFDVLDLVAPDGDFVGVEHQNVGSHQNRITEQTHFHTEIGVFLPVFRIGL
                   190       200       210       220       230       240

             240       250       260       270       280       290
m900.pep    HGGFVGMGAVHQTLGSDAGQNPVQFHHFGSVALAVEGGALGVESAGKPSGGNGLGGLVNH
            :|||||:||||||||:||||||||:||||:||||||||||||||||||||||||||||||
g900        NGGFVGVGAVHQTLGGDAGQNPVQLHHFGNVALAVEGGALGVESAGKPSGGNGLGGLVNH
                   250       260       270       280       290       300

             300       310       320       330       340       350
m900.pep    LRLVAFDDTVVIGEEEEGFGIEVLRRADGGADGADVVAQMRDAGGGYAGQNSFFAHKNVL
            | ||||||:|||||||||||| ||||||||||||||||||| ||||||||||||||||||
g900        LLLVAFDDAVVIGEEEEGFGIGVLRRADGGADGADVVAQMRGAGGGYAGQNSFFAHKNVL
                   310       320       330       340       350       360

             360       370       380
m900.pep    AASMPSEREKDVPIIPDLPPTSSRQQTFPYX
            :|:||||||||:||||||| |||||||||||
g900        TAAMPSEREKDAPIIPDLPHTSSRQQTFPYX
                   370       380       390
```

The following partial DNA sequence was identified in *N. meningitidis* <SEQ ID 2703>:

```
a900.seq (partial)
     1  GAGGTTCGGA CGGCATTGGG TTTATTTCAA CGGGCGGATA CCGACCGCAT

    51  CACGTACTTT GCCCAATAAT TCGCGTGCTT CTTTACGCGC TTTTTGCGCG

   101  CCTGCCTGCA AAATCTCTTC GATTTGCGAA GGGTCGGCGG TCAGCTCGTT

   151  GTAGCGTTCG CGCGGTTCGG CGAGTTCGGC GTTGATTTTC GCCGCCAAAA

   201  GTTTTTTTGC CTCGCCCCAA GCCAAGCCGT CGGCAAGCAT TTTCGTAAAT

   251  TCTGCCGTTT CAGACGGCGT GGAGAAAGCT TTGTAGATTT CAAACAGAGG

   301  GCTTTCGTCG GGCTTCTTCG GCTCGCCCGG CTCTTTCATA TTGGTGATGA

   351  TTTTGTTGAC CGATTTTTGG GTTTTTTTGT CGTTTTCCCA AAGCGGAATG

   401  GTGTTGCCGT AGGATTTGGA CATTTTGCGT CCGTCCAAAC CAACCAAGAG

   451  TTCGACGTTT TCGTCGATTT TCACTTCGGG CAGTGTGAAG AGTTCCCGGA

   501  AGCGGTGGTT GAAGCGGCCG GCAATATCGC GTGCCATTTC AACGTGTTGG

   551  ATTTGGTCGC GACCGACTGG AACTTCATGG GCATTGAACA TGAGAATGTC

   601  GGCAGTCATG AGGATAGGGT AGCTGTACAA ACCCATTTCC ACGCCGAAAT

   651  CGGGGTCTTC CTGCCCGTTT TCCGCATTTG CCTGCACGGC GGCTTTGTAG

   701  GCGTGGGCGC GGTTCATCAA ACCCTTGGCG GTGATGCAGG TCAGAATCCA

   751  GTTCAATTCC ATCACTTCGG GAATGTCGCT TTGACGGTAG AAGGTGGTGC

   801  GCTCGGGGTC GAGTCCGCAG GCAAGCCAAG TGGCGGCAAC GGCTTGGGTG

   851  GATTGGTGAA TCATCTCCGG CTCGTGGCAT TTGATGATAC CGTGGTAATC

   901  GGCGAGGAAG AGGAAGGATT CGGTATCAGG GTTTTGCGCC GCGCGGACGG

   951  CGGGGCGGAT AGCACCGACG TAGTTGCCCA GATGCGGGAT GCCGGTGGTG

  1001  GTTACGCCGG TCAGAACTCG TTTTTTGCTC ATAAAAATGT CCTTGCGGCA

  1051  TCAATGCCGT CTGAAAGGGA AAAAGATGCG CCGATTATAC CCGATTTGCC

  1101  ACCTACATCC AGCCGACAAC AGACTTTTCC ATATTAA
```

This corresponds to the amino acid sequence <SEQ ID 2704; ORF 900.a>:

```
a900.pep (partial)
     1  EVRTALGLFQ RADTDRITYF AQ*FACFFTR FLRACLQNLF DLRRVGGQLV

    51  VAFARFGEFG VDFRRQKFFC LAPSQAVGKH FRKFCRFRRR GESFVDFKQR

   101  AFVGLLRLAR LFHIGDDFVD RFLGFFVVFP KRNGVAVGFG HFASVQTNQE

   151  FDVFVDFHFG QCEEFPEAVV EAAGNIACHF NVLDLVATDW NFMGIEHENV

   201  GSHEDRVAVQ THFHAEIGVF LPVFRICLHG GFVGVGAVHQ TLGGDAGQNP

   251  VQFHHFGNVA LTVEGGALGV ESAGKPSGGN GLGGLVNHLR LVAFDDTVVI

   301  GEEEEGFGIR VLRRADGGAD STDVVAQMRD AGGGYAGQNS FFAHKNVLAA

   351  SMPSEREKDA PIIPDLPPTS SRQQTFPY*
```

m900/a900 88.4% identity in 378 aa overlap

```
                       10        20        30        40        50        60
m900.pep   MPSETRQAEVRTASGSFQRADADRIXYFVQXFACFFTRFRRACLQNLFDLRRVGGQLVVA
                   ||||| | |||||:|||:||:|||||||||| ||||||||||||||||||||
a900               EVRTALGLFQRADTDRITYFAQXFACFFTRFLRACLQNLFDLRRVGGQLVVA
                           10        20        30        40        50
```

-continued

```
                  70         80         90        100        110        120
m900.pep  FARFGEFGVDFRRQKFFGFTPRQAVGKHFRKFHRFRRRGEGFVDFKQWAFVGLFRLARLF
          |||||||||||||||||  ::| |||||||||| |||||||:|||||| |||||:||||||
a900      FARFGEFGVDFRRQKFFCLAPSQAVGKHFRKFCRFRRRGESFVDFKQRAFVGLLRLARLF
                60         70         80         90        100        110

                 130        140        150        160        170        180
m900.pep  HIGDDFVDRFLGFFVVFPKRNGVAVGFGHFASVQTDQEFDVFIDFHFGQGEEFPEAVVEA
          |||||||||||||||||||||||||||||||||||:||||||:|||||| ||||||||||
a900      HIGDDFVDRFLGFFVVFPKRNGVAVGFGHFASVQTNQEFDVFVDFHFGQCEEFPEAVVEA
               120        130        140        150        160        170

                 190        200        210        220        230        240
m900.pep  AGDVARHFDVLDLVAPDGHFVGVEHQNIGSHQNRITEQTHFHTEIRVFLPVFCICLHGGF
          ||::| ||:|||||| | :|:|:||:|:|||::|:: |||||:|| |||||| |||||||
a900      AGNIACHFNVLDLVATDWNFMGIEHENVGSHEDRVAVQTHFHAEIGVFLPVFRICLHGGF
               180        190        200        210        220        230

                 250        260        270        280        290        300
m900.pep  VGMGAVHQTLGSDAGQNPVQFHHFGSVALAVEGGALGVESAGKPSGGNGLGGLVNHLRLV
          ||:||||||||:|||||||||||||:|||:||||||||||||||||||||||||||||||
a900      VGVGAVHQTLGGDAGQNPVQFHHFGNVALTVEGGALGVESAGKPSGGNGLGGLVNHLRLV
               240        250        260        270        280        290

                 310        320        330        340        350        360
m900.pep  AFDDTVVIGEEEEGFGIEVLRRADGGADGADVVAQMRDAGGGYAGQNSFFAHKNVLAASM
          |||||||||||||||||:||||||||||::||||||||||||||||||||||||||||||
a900      AFDDTVVIGEEEEGFGIRVLRRADGGADSTDVVAQMRDAGGGYAGQNSFFAHKNVLAASM
               300        310        320        330        340        350

                 370        380
m900.pep  PSEREKDVPIIPDLPPTSSRQQTFPYX
          |||||||:|||||||||||||||||||
a900      PSEREKDAPIIPDLPPTSSRQQTFPYX
               360        370

g901.seq not found yet
g901.pep not found yet
```

The following partial DNA sequence was identified in *N. meningitidis* <SEQ ID 2705>:

```
m901.seq
   1 ATGCCCGATT TTTCGATGTC CAATTTGGCC GTTGCCTTTT CCATCACATT

  51 GGCTGCCGGT TTGTTTACCG TATTAkGyAG TGGCTTGGTG ATGTTTTCCA

 101 AAACGCCCAA TCCGCGTGTG TTGTCGTTTG GTTTGGCGTT TGCCGGCGGT

 151 GCGATGGTAT ATGTTTCCCT GACGGAGATT TTCAGTAAGT CCAGCGAGGC

 201 GTTCGCTGAA ATTTATGATA AAGACCACGC GTTTGCGGCG GCGACCATGG

 251 CATTTTTGGC CGGGATGGGC GGCATTGCGC TGATTGACCG TCTGGTGCCG

 301 AACCCGCATG AAACTTTAGA CGCGCAAGAC CCGTCGTTTC AAGAAAGCAA

 351 ACGCCGCCAT ATCGCGCGAG TCGGCATGAT GGCGGCGTTT GCGATTACTG

 401 CGCACAATTT CCCCGAAGGC TTGGCGACGT TTTTTGCCAC ATTGGAAAAT

 451 CCAGCAGTCG GGATGCCTTT GGCCTTGGCG ATTGCCATCC ATAATATTCC

 501 GGAGGGCATT TCCATCGCCG CGCCGGTTTA TTTTGCCACC CGCAGCCGTA

 551 AGAAAACGGT GTGGGCGTGT CTGCTATCCG GCTTGGCCGA GCCGTTGGGG

 601 GCGGCTTTGG GCTATTTGGT TTTGCAGCCG TTTTTGTCGC CTGCCGTGTT

 651 TGGTTCGGTA TTCGGCGTGA TAGCCGGTGT GATGGTGTTT TTGGCGTTGG

 701 ACGAGCTGnt GCCGGCTGCC AAACGCTATT CAGACGGCCA TGAAACCGTT

 751 TACGGCCTGA CAACGGGTAT GGCGGTGATT GCCGTCAGCC TGGTATTGTT

 801 CCATTTTTAA
```

This corresponds to the amino acid sequence <SEQ ID 2706; ORF 901>:

```
m901.pep
   1 MPDFSMSNLA VAFSITLAAG LFTVLXSGLV MFSKTPNPRV LSFGLAFAGG

  51 AMVYVSLTEI FSKSSEAFAE IYDKDHAFAA ATMAFLAGMG GIALIDRLVP

 101 NPHETLDAQD PSFQESKRRH IARVGMMAAF AITAHNFPEG LATFFATLEN

 151 PAVGMPLALA IAIHNIPEGI SIAAPVYFAT RSRKKTVWAC LLSGLAEPLG

 201 AALGYLVLQP FLSPAVFGSV FGVIAGVMVF LALDELXPAA KRYSDGHETV

 251 YGLTTGMAVI AVSLVLFHF*
```

The following partial DNA sequence was identified in *N. meningitidis* <SEQ ID 2707>:

```
a901.seq
   1 ATGCCCGATT TTTCGATGTC CAATTTGGCC GTTGCCTTTT CCATTACGTT

  51 GGCTGCCGGT TTGTTTACCG TATTAGGCAG CGGCTTGGTG ATGTTTTCCA

 101 AAACGCCCAA TCCGCGCGTG TTGTCGTTTG GTTTGGCATT TGCCGGCGGT

 151 GCGATGGTGT ATGTTTCCCT GACGGAGATT TTCAGTAAGT CCAGCGAGGC

 201 GTTCGCTGAA ATTTATGATA AAGACCACGC GTTTGCGGCG GCGACCATGG

 251 CATTTTTGGC AGGGATGGGC GGCATTGCGC TGATTGACCG TCTGGTGCCG

 301 AACCCGCATG AAACTTTAGA CGCGCAAGAC CCGTCGTTTC AAGAAAGCAA

 351 ACGCCGCCAT ATCGCGCGAG TCGGCATGAT GGCGGCGTTT GCGATTACTG

 401 CGCACAATTT CCCCGAAGGC TTGGCGACGT TTTTTGCCAC ATTGGAAAAT

 451 CCAGCAGTCG GGATGCCTTT GGCCTTGGCG ATTGCCATCC ATAATATTCC

 501 GGAGGGCATT TCCATCGCCG CGCCGGTTTA TTTTGCCACC CGCAGCCGTA

 551 AGAAAACGGT GTGGGCGTGT CTGCTATCCG GCTTGGCCGA GCCGTTGGGG

 601 GCGGCTTTGG GCTATTTGGT TTTGCAGCCG TTTTTGTCGC CTGCCGTGTT

 651 TGGTTCGGTA TTCGGCGTGA TAGCCGGTGT GATGGTGTTT TTGGCGTTGG

 701 ACGAGCTGCT GCCGGCTGCC AAACGCTATT CAGACGGCCA TGAAACCGTT

 751 TACGGCCTGA CAATGGGCAT GGCGGTGATT GCCGTCAGCC TGGTATTGTT

 801 CCATTTTTAA
```

This corresponds to the amino acid sequence <SEQ ID 2708; ORF 901.a>:

```
a901.pep
   1 MPDFSMSNLA VAFSITLAAG LFTVLGSGLV MFSKTPNPRV LSFGLAFAGG

  51 AMVYVSLTEI FSKSSEAFAE IYDKDHAFAA ATMAFLAGMG GIALIDRLVP

 101 NPHETLDAQD PSFQESKRRH IARVGMMAAF AITAHNFPEG LATFFATLEN

 151 PAVGMPLALA IAIHNIPEGI SIAAPVYFAT RSRKKTVWAC LLSGLAEPLG

 201 AALGYLVLQP FLSPAVFGSV FGVIAGVMVF LALDELLPAA KRYSDGHETV

 251 YGLTMGMAVI AVSLVLFHF*
```

m901/a901 98.9% identity in 269 aa overlap

```
                 10         20         30         40         50         60
m901.pep  MPDFSMSNLAVAFSITLAAGLFTVLXSGLVMFSKTPNPRVLSFGLAFAGGAMVYVSLTEI
          |||||||||||||||||||||||||| |||||||||||||||||||||||||||||||||||
a901      MPDFSMSNLAVAFSITLAAGLFTVLGSGLVMFSKTPNPRVLSFGLAFAGGAMVYVSLTEI
                 10         20         30         40         50         60

                 70         80         90        100        110        120
m901.pep  FSKSSEAFAEIYDKDHAFAAATMAFLAGMGGIALIDRLVPNPHETLDAQDPSFQESKRRH
          ||||||||||||||||||||||||||||||||||||||||||||||||||||||||||||
a901      FSKSSEAFAEIYDKDHAFAAATMAFLAGMGGIALIDRLVPNPHETLDAQDPSFQESKRRH
                 70         80         90        100        110        120

                130        140        150        160        170        180
m901.pep  IARVGMMAAFAITAHNFPEGLATFFATLENPAVGMPLALAIAIHNIPEGISIAAPVYFAT
          ||||||||||||||||||||||||||||||||||||||||||||||||||||||||||||
a901      IARVGMMAAFAITAHNFPEGLATFFATLENPAVGMPLALAIAIHNIPEGISIAAPVYFAT
                130        140        150        160        170        180

                190        200        210        220        230        240
m901.pep  RSRKKTVWACLLSGLAEPLGAALGYLVLQPFLSPAVFGSVFGVIAGVMVFLALDELXPAA
          |||||||||||||||||||||||||||||||||||||||||||||||||||||||| |||
a901      RSRKKTVWACLLSGLAEPLGAALGYLVLQPFLSPAVFGSVFGVIAGVMVFLALDELLPAA
                190        200        210        220        230        240

                250        260        270
m901.pep  KRYSDGHETVYGLTTGMAVIAVSLVLFHFX
          |||||||||||||| |||||||||||||||
a901      KRYSDGHETVYGLTMGMAVIAVSLVLFHFX
                250        260        270
```

The following partial DNA sequence was identified in *N. gonorrhoeae* <SEQ ID 2709>:

```
g902.seq
   1  ATGCCGTCCG AACCCGAACG GCGGCATGGC AATACTGCCC TACCCTTCCC

  51  GATAGCCGCA CGCCCAACGG TCGGTTTTTC CGGCAAGCCT TTCAAGATAA

 101  CCGGCAAGTG TGTCGTATTG CGCCGCCGCA TTGTCCAAGC GGTTGATTTC

 151  ACGCCGCGCC TGTTCGCCGT CGGGCATTTC GCCGATGTAC CAGCCTATGT

 201  GTTTGCGTGC GATGCGCACA CCGACGGTCT CACCATAAAA CGCGTGCATG

 251  GCGCGGATGT GGTTCAAAAT GGCGGCTCTG CATTCTGCCA AACTCAAGGC

 301  AGGCGGTAAA ACGCCGTGTT CGGCATAATG CTTCAAATCG CGGAAAAACC

 351  ACGGCCTGCC TTGCGCGCCG CGCCCTATCA TGATGCCGTC GGCGGCGGTT

 401  TGTTTGAGGA cggCGGCGGC TTTTTgcggc GAagtGATGT CGCCGTTGac

 451  cCaggCCGGG ATGTTCAGAc ggCTTTTGGT CTCGGcgatg agttCGTAAC

 501  gcGCCTCGCC TTTGTACATT TGCGTGcgcG CGcgcccgtg aacggcaaGg

 551  gcggcaatgc cgcaatcttc ggcgattttg gcgacggcgG gcaggttttg

 601  atcgtcgtcg tgccaaccca AacggGTTTT GaggGTAACG GGTAcgcCCG

 651  CCGCCTTgac caccgcctcc aAAatggcGg caaccagcgg CTCGTCCTGC

 701  ATCagcGCGC TACCGGCTTG GACGTTGCAC ACTTTCttgg cgggGCAGCC

 751  CATAttgATG TCGATGACCT GCGCCCCGAG TCCGACGTTg taacgcgccg

 801  catCCGCCAT CtgttcggGG TCGCTGCCGG CAATCTGCAC GGCAACGATG

 851  CCGccttcat cggcaAAAtc actgcggtgc aGGGTTTTTC CGGTATTCCT

 901  GAGCGTCGGA TCGCTGGCCA GCATTTCGCA CACCGCCCAA CCTGCGCCAA

 951  ACGCCCGACA GAGGCGGCGG AAGGGTTTGT CGGCAATGCC CGCCATCGGC

1001  GCAAGTGCGA TGGGGTTGTC GATAAAATAA CCGCCGATGT GCATAATGGG

1051  CCCGCGTTTC AAAAAAGTGC GCCATTGTAC ATTTTTTAA
```

This corresponds to the amino acid sequence <SEQ ID 2710; ORF 902.ng>:

```
g902.pep
    1 MPSEPERRHG NTALPFPIAA RPTVGFSGKP FKITGKCVVL RRRIVQAVDF

   51 TPRLFAVGHF ADVPAYVFAC DAHTDGLTIK RVHGADVVQN GGSAFCQTQG

  101 RR*NAVFGIM LQIAEKPRPA LRAAPYHDAV GGGLFEDGGG FLRRSDVAVD

  151 PGRDVQTAFG LGDEFVTRLA FVHLRARAPV NGKGGNAAIF GDFGDGGQVL

  201 IVVVPTQTGF EGNGYARRLD HRLQNGGNQR LVLHQRATGL DVAHFLGGAA

  251 HIDVDDLRPE SDVVTRRIRH LFGVAAGNLH GNDAAFIGKI TAVQGFSGIP

  301 ERRIAGQHFA HRPTCAKRPT EAAEGFVGNA RHRRKCDGVV DKITADVHNG

  351 PAFQKSAPLY IF*
```

The following partial DNA sequence was identified in *N. meningitidis* <SEQ ID 2711>:

```
m902.seq
     1  TTGCACTTTC AAAGGATAAT CAAGTGTTCA GAAGGCATTT GGGCGGTAGG

    51  CGCACGCCCA ACTGTCGGTT TTTTCGGCAA GTCTTTCAAG ATAACCTGCA

   101  AGCATGTCGT ATTGCGCCGC CGCACTGTCC AAGCGGTTGA TTTCACGACG

   151  TgTCTgTTCG CCGTcGGGCA TTTCGTCGAT GTACCAGCCT ATGTGTTTGC

   201  GTGCGATGCG CACACCGGCG GTGTCGCCGT AAAACGCGTG TATGGCGCGG

   251  ATGTGGTTCA AAATAGCGGC GGCGCATTCT GCCAAACTCA AGGCAGGCGG

   301  CAAAACACCG TGTTCGGCAT AATGTTTCAA ATCGCGGAAG AACCACGGCC

   351  TGCCTTGCGC GCCGCGCCCT ATCATAATGC CGTCGGCGGC GGTTTGTTTG

   401  AGGACGGCTT GGGCTTTTTG CGGCGAAGTA ATGTCGCCGT TGACCCAGAC

   451  CGGGATGTTC AGACGGCATT TGGTTTCGGC GATGAGTTCG TAACGCGCTT

   501  CGCCTTTGTA CATTTGCGTA CGCGTGCGTC CGTGGACGGC AAGGGCGGCG

   551  ATGCCGCAAT CTTCGGCGAT TTTGGCGATG ACGGGCAGGT TTTGATGGTC

   601  GTCGTGCCAA CCCAAACGGG TTTTGAGGGT AACGGGTACG CCTGCCGCAC

   651  GGACGACGGC TTCCAAAATG GCGGCAACCA GCGGCTCGTT CTGCATCAGC

   701  GCGCTACCGG CTTGGACATT GCAGACTTTT TTAGCGGGAC AGCCCATGTT

   751  GATGTCGATA AGCTGCGCCC CAAGGCTGAC GTTGTAACGC GCGGCATCCG

   801  CCATCTGCTG CGGATCGCTT CCGGCAATCT GCACGGCAAC AATGCCGCCT

   851  TCATCGGCAA AATCGCTGCG GTGCAAGGTT TTTCTAGTAT TTCTGAGCGT

   901  CGGGTCGCTG GTCAGCATTT CGCACACCGC CCAACCTGCG CCAAAATCTC

   951  GGCAAAGTCG GCGGAACGGT TTGTCGGTAA TGCCCGCCAT CGGcGCaAGT

  1001  GCGATGGGGT TGTCGATAAA ATAGCCGCCG ATGTGCATAA TGGATCCGCG

  1051  TTTCAAAAAA GTACGCCATT GTACATTTTT TAA
```

This corresponds to the amino acid sequence <SEQ ID 2712; ORF 902>:

```
m902.pep
    1 LHFQRIIKCS EGIWAVGARP TVGFFGKSFK ITCKHVVLRR RTVQAVDFTT

   51 CLFAVGHFVD VPAYVFACDA HTGGVAVKRV YGADVVQNSG GAFCQTQGRR

  101 QNTVFGIMFQ IAEEPRPALR AAPYHNAVGG GLFEDGLGFL RRSNVAVDPD

  151 RDVQTAFGFG DEFVTRFAFV HLRTRASVDG KGGDAAIFGD FGDDGQVLMV
```

-continued

```
201 VVPTQTGFEG NGYACRTDDG FQNGGNQRLV LHQRATGLDI ADFFSGTAHV

251 DVDKLRPKAD VVTRGIRHLL RIASGNLHGN NAAFIGKIAA VQGFSSISER

301 RVAGQHFAHR PTCAKISAKS AERFVGNARH RRKCDGVVDK IAADVHNGSA

351 FQKSTPLYIF *
```

Computer analysis of this amino acid sequence gave the following results:

Homology with a Predicted ORF from *N. gonorrhoeae*

ORF 902 shows 80.9% identity over a 345 aa overlap with a predicted ORF (ORF 902.ng) from *N. gonorrhoeae*:

```
m902/g902

                        10        20        30        40        50
m902.pep    LHFQRIIKCSEGIWAVGARPTVGFFGKSFKITCKHVVLRRRTVQAVDFTTCLFAVGHF
                               ::||||||| || |||| | |||||| |||||||  |||||||
g902      MPSEPERRHGNTALPFPIAARPTVGFSGKPFKITGKCVVLRRRIVQAVDFTPRLFAVGHF
                  10        20        30        40        50        60

          60        70        80        90       100       110
m902.pep  VDVPAYVFACDAHTGGVAVKRVYGADVVQNSGGAFCQTQGRRQNTVFGIMFQIAEEPRPA
          :|||||||||||| |:::|||:|||||||:|:||||||||| |:|||||:||||:||||
g902      ADVPAYVFACDAHTDGLTIKRVHGADVVQNGGSAFCQTQGRRXNAVFGIMLQIAEKPRPA
                  70        80        90       100       110       120

           120       130       140       150       160       170
m902.pep   LRAAPYHNAVGGGLFEDGLGFLRRSNVAVDPDRDVQTAFGFGDEFVTRFAFVHLRTRASV
           ||||||:|||||||||| ||||||:||||| ||||||||:|||||||:||||||:|| |
g902       LRAAPYHDAVGGGLFEDGGGFLRRSDVAVDPGRDVQTAFGLGDEFVTRLAFVHLRARAPV
                  130       140       150       160       170       180

           180       190       200       210       220       230
m902.pep   DGKGGDAAIFGDFGDDGQVLMVVVPTQTGFEGNGYACRTDDGFQNGGNQRLVLHQRATGL
           :||||:|||||||||| ||||:|||||||||||||| | |  :||||||||||||||||
g902       NGKGGNAAIFGDFGDGGQVLIVVVPTQTGFEGNGYARRLDHRLQNGGNQRLVLHQRATGL
                  190       200       210       220       230       240

          240       250       260       270       280       290
m902.pep   DIADFFSGTAHVDVDKLRPKADVVTRGIRHLLRIASGNLHGNNAAFIGKIAAVQGFSSIS
           |:| |::|:||:||| |||::||||| ||||: :|:||||||:|||||||:||||||:|
g902       DVAHFLGGAAHIDVDDLRPESDVVTRRIRHLFGVVAAGNLHGNDAAFIGKITAVQGFSGIP
                  250       260       270       280       290       300

          300       310       320       330       340       350
m902.pep   ERRVAGQHFAHRPTCAKISAKSAERFVGNARHRRKCDGVVDKIAADVHNGSAFQKSTPLY
           |||:|||||||||||||  :::|| |||||||||||||||||:|||||| |||||:|||
g902       ERRIAGQHFAHRPTCAKRPTEAAEGFVGNARHRRKCDGVVDKITADVHNGPAFQKSAPLY
                  310       320       330       340       350       360

          360
m902.pep   IFX
           |||
g902       IFX
```

The following partial DNA sequence was identified in *N. meningitidis* <SEQ ID 2713>:

```
a902.seq
    1  TTGCACTTTC AAAGGATAAT CAAGTGTTCA GAAGGCATTT GGGCGGTAGG

   51  CGCACGCCCA ACTGTCGGTT TTTTCGGCAA GTCTTTCAAG ATAACCTGCA

  101  AACATGTCGT ATTGCGCCGC CGCACTGTCC AAGCGGTTGA TTTCACGACG

  151  TGTCTGTTCG CCGTCGGGCA TTTCGTCGAT GTACCAGCCT ATGTGTTTGC

  201  GTGCGATGCG CACACCGGCG GTGTCGCCGT AAAACGCGTG CATGGCTCGG

  251  ATGTGGTTCA AAATAGTGGC GGTACATTCT GCCAAACTCA AGGCAGGCGG
```

-continued

```
 301 TAAAACACCG TGTTCGGCGT AATGTTTCAA ATCGCGGAAG AACCACGGTC

 351 TGCCTTGCGC GCCGCGCCCT ATCATAATGC CGTCTGCGGC GGTTTGTTTG

 401 AGGACGGCTT GGGCTTTTTG CGGCGAGGTA ATGTCGCCGT TGACCCAGAC

 451 CGGGATGTTC AGACGGCATT TGGTTTCGGC AATCAGGTCG TAAGCCGCTT

 501 CGCCTTTGTA CATTTGCGTG CGCGTGCGTC CGTGGACGGC AAGGGCGGCA

 551 ATGCCGCAAT CTTCGGCGAT TTTGGCGATG ACGGGCAGGT TTTGATGGTC

 601 GTCGTGCCAA CCCAAACGGG TTTTGAGGGT AACGGGTACG CCCGCCGCTT

 651 TGACCACCGC CTCCAAAATG GCGGCAACCA GCGGCTCGTT CTGCATCAGC

 701 GCGCTACCGG CTTGGACATT GCAGACTTTT TTAGCGGGAC AGCCCATGTT

 751 GATGTCGATA AGCTGCGCCC CAAGGCTGAC GTTGTAACGC GCGGCATCCG

 801 CCATCTGCTG CGGATCGCTT CCGGCAATCT GCACGGCAAC AATGCCGCCT

 851 TCATCGGCAA AATCGCTGCG GTGCAAGGTT TTTCTAGTAT TTCTGAGCGT

 901 CGGGTCGCTG GTCAGCATTT CGCACACCGC CCAACCTGCG CCAAAATCTC

 951 GGCAAAGTCG GCGGAACGGT TTGTCGGTAA TGCCCGCCAT CGGCGCAAGT

1001 GCGATGGGGT TGTCGATAAA ATAGCCGCCG ATGTGCATAA TGGATCCGCG

1051 TTTCAAAAAA GTACGCCATT GTACATTTTT TAA
```

This corresponds to the amino acid sequence <SEQ ID 2714; ORF 902.a>:

```
a902.pep
  1 LHFQRIIKCS EGIWAVGARP TVGFFGKSFK ITCKHVVLRR RTVQAVDFTT

 51 CLFAVGHFVD VPAYVFACDA HTGGVAVKRV HGSDVVQNSG GTFCQTQGRR

101 *NTVFGVMFQ IAEEPRSALR AAPYHNAVCG GLFEDGLGFL RRGNVAVDPD

151 RDVQTAFGFG NQVVSRFAFV HLRARASVDG KGGNAAIFGD FGDDGQVLMV

201 VVPTQTGFEG NGYARRFDHR LQNGGNQRLV LHQRATGLDI ADFFSGTAHV

251 DVDKLRPKAD VVTRGIRHLL RIASGNLHGN NAAFIGKIAA VQGFSSISER

301 RVAGQHFAHR PTCAKISAKS AERFVGNARH RRKCDGVVDK IAADVHNGSA

351 FQKSTPLYIF *
```

m902/a902 94.7% identity in 360 aa overlap

```
                    10        20        30        40        50        60
m902.pep    LHFQRIIKCSEGIWAVGARPTVGFFGKSFKITCKHVVLRRRTVQAVDFTTCLFAVGHFVD
            ||||||||||||||||||||||||||||||||||||||||||||||||||||||||||||
a902        LHFQRIIKCSEGIWAVGARPTVGFFGKSFKITCKHVVLRRRTVQAVDFTTCLFAVGHFVD
                    10        20        30        40        50        60

                    70        80        90       100       110       120
m902.pep    VPAYVFACDAHTGGVAVKRVYGADVVQNSGGAFCQTQGRRQNTVFGIMFQIAEEPRPALR
            ||||||||||||||||||||:|:||||||||:|||||||| |||||:||||||||| |||
a902        VPAYVFACDAHTGGVAVKRVHGSDVVQNSGGTFCQTQGRRXNTVFGVMFQIAEEPRSALR
                    70        80        90       100       110       120

                   130       140       150       160       170       180
m902.pep    AAPYHNAVGGGLFEDGLGFLRRSNVAVDPDRDVQTAFGFGDEFVTRFAFVHLRTRASVDG
            |||||||| |||||||||||||| :|||||||||||||||||:: |:||||||||:||||||
a902        AAPYHNAVCGGLFEDGLGFLRRGNVAVDPDRDVQTAFGFGNQVVSRFAFVHLRARASVDG
                   130       140       150       160       170       180
```

-continued

```
                 190       200       210       220       230       240
m902.pep   KGGDAAIFGDFGDDGQVLMVVVPTQTGFEGNGYACRTDDGFQNGGNQRLVLHQRATGLDI
           |||:|||||||||||||||||||||||||||||| | |  :||||||||||||||||||
a902       KGGNAAIFGDFGDDGQVLMVVVPTQTGFEGNGYARRFDHRLQNGGNQRLVLHQRATGLDI
                 190       200       210       220       230       240

                 250       260       270       280       290       300
m902.pep   ADFFSGTAHVDVDKLRPKADVVTRGIRHLLRIASGNLHGNNAAFIGKIAAVQGFSSISER
           ||||||||||||||||||||||||||||||||||||||||||||||||||||||||||||
a902       ADFFSGTAHVDVDKLRPKADVVTRGIRHLLRIASGNLHGNNAAFIGKIAAVQGFSSISER
                 250       260       270       280       290       300

                 310       320       330       340       350       360
m902.pep   RVAGQHFAHRPTCAKISAKSAERFVGNARHRRKCDGVVDKIAADVHNGSAFQKSTPLYIF
           ||||||||||||||||||||||||||||||||||||||||||||||||||||||||||||
a902       RVAGQHFAHRPTCAKISAKSAERFVGNARHRRKCDGVVDKIAADVHNGSAFQKSTPLYIF
                 310       320       330       340       350       360

m902.pep   X
           |
a902       X
```

The following partial DNA sequence was identified in *N. gonorrhoeae* <SEQ ID 2715>:

```
g903.seq
   1  ATGGCAACAC AGGTAGGCGG TGCAAattcG gatgaggCAA GCCCCTGCTT
  51  TCCTATTTCT GAGGTGGAaT TGGTGGGTGA aGaaacggct aAATTCCGgt
 101  tTGCGCTcaa ccaTGCCTTG tgccAAACAC ATTTTGtttc cGgcaagtgt
 151  CTGcATGcgg gcgacatTAA TCAAAtcaTG TCCTTAGCAC AAAATGCTTT
 201  GATCGGCAGG GGATATACCA CGACCCGTAT CTTGGCTGCG CCACAGGATT
 251  TGAATAGTGG caaGCTTCAA TTAAccctga tgccggGCTA TCtgcgctcC
 301  ATAcgaATCG atcggtccaa cgatgatcaa ACCCATgcAG GACGTATTGC
 351  AGCATTCCAA AACAAATTTC CCACCCGCTC GAACGATCTG TTGAATCTGC
 401  GTGATTTGGA ACAAGGACTG GAAAATCTCA AATGTCTCCC GACTGCGGAA
 451  GCCGATCTCC AAATCgttcc cgtaGAGAGA GAACcAAACC AAAGTGATGT
 501  CGTGGTGCAA TGGCGGTAAC GTCTGCTGCC CTACTGTGTG AGTGTGGGGA
 551  TGGATAATTC GGGTAGTGAG GCGACAGGAA AATACCAAGG AAATATCACT
 601  TTCTCTGCCG ACAATCCTTT TggactgAGT GATATGTTCT ATGTAAATTA
 651  TGGACGTTCA ATTGGCGGTA CGcccgATGA GGAAAATTTT GACGGCCATC
 701  GCAAAGAAGG CGGATCAAAC AATTACGCCG TACATTATTC AGCCCCTTTC
 751  GGTAAATGGA CATGGGCATT CAATCACAAT GGCTACCGTT ACCATCAGGC
 801  GGTTTCCGGA TTATCGGAAG TCTATGACTA TAATGGAAAA AGTTACAACA
 851  CTGATTTCGG CTTCAACCGC CTGTTGTATC GTGATGCCAA ACGCAAAACC
 901  TATCTCAGTG TAAAACTGTG GACGAGGGAA ACAAAAAGTT ACATTGATGA
 951  TGCCGAACTG ACTGTACAAC GGCGTAAAAC CACAGGTTGG TTGGCAGAAC
1001  TTTCCCACAA AGGATATATC GGTCGCAGTA CGGCAGATTT TAAGTTGAAA
1051  TATAAACACG GCACCGGCAT GAAAGATGCT CTGCGCGCGC CTGAAGAAGC
1101  CTTTGGCGAA GGCACGTCAC GTATGAAAAT TTGGACGGCA TCGGCTGATG
1151  TAAATACTCC TTTTCAAATC GGTAAACAGC TATTTGCCTA TGACACATCC
1201  GTTCATGCAC AATGGAACAA AACCCCGCTA ACATCGCAAG ACAAACTGGC
1251  TATCGGCGGA CACCACACCG TACGTGGCTT CGACGGTGAA ATGAGTTTGC
```

```
1301 CTGCCGAGCG GGGATGGTAT TGGCGCAACG ATTTGAGCTG GCAATTTAAA

1351 CCAGGCCATC AGCTTTATCT TGGGGCTGAT GTAGGACATG TTTCAGGACA

1401 ATCCGCCAAA TGGTTATCGG GCCAAACTCT AGCCGGCACA GCAATTGGGA

1451 TACGCGGGCA GATAAAGCTT GGCGGCAACC TGCATTACGA TATATTTACC

1501 GGCCGTGCAT TGAAAAAGCC cgaatatttt cAGACGAAGA Aatgggtaac

1551 ggggtTTCAG gtgggttatt cgTTTTGA
```

This corresponds to the amino acid sequence <SEQ ID 2716; ORF 903.ng>:

```
g903.pep
  1 MATQVGGANS DEASPCFPIS EVELVGEETA KFRFALNHAL CQTHFVSGKC

 51 LHAGDINQIM SLAQNALIGR GYTTTRILAA PQDLNSGKLQ LTLMPGYLRS

101 IRIDRSNDDQ THAGRIAAFQ NKFPTRSNDL LNLRDLEQGL ENLKCLPTAE

151 ADLQIVPVER EPNQSDVVVQ WRXRLLPYCV SVGMDNSGSE ATGKYQGNIT

201 FSADNPFGLS DMFYVNYGRS IGGTPDEENF DGHRKEGGSN NYAVHYSAPF

251 GKWTWAFNHN GYRYHQAVSG LSEVYDYNGK SYNTDFGFNR LLYRDAKRKT

301 YLSVKLWTRE TKSYIDDAEL TVQRRKTTGW LAELSHKGYI GRSTADFKLK

351 YKHGTGMKDA LRAPEEAFGE GTSRMKIWTA SADVNTPFQI GKQLFAYDTS

401 VHAQWNKTPL TSQDKLAIGG HHTVRGFDGE MSLPAERGWY WRNDLSWQFK

451 PGHQLYLGAD VGHVSGQSAK WLSGQTLAGT AIGIRGQIKL GGNLHYDIFT

501 GRALKKPEYF QTKKWVTGFQ VGYSF*
```

The following partial DNA sequence was identified in *N. meningitidis* <SEQ ID 2717>:

```
m903.seq
  1 ATGCAGCGTC AGCAGCACAT AGATGCTGAA TTGTTAACTG ATGCAAATGT

 51 CCGTTTCGAG CAACCATTGG AGAAGAACAA TTATGTCCTG AGTGAAGATG

101 AAACACCGTG TACTCGGGTA AATTACATTA GTTTAGATGA TAAGACGGTG

151 CGCAAATTTT CTTTTCTTCC TTCTGTGCTC ATGAAAGAAA CAGCTTTTAA

201 AACTGGGATG TGTTTAGGTT CCAATAATTT GAGCAGGCTA CAAAAAGCCG

251 CGCAACAGAT ACTGATCGTG CGTGGCTACC TCACTTCCCA AGCTATTATC

301 CAaCCACAGA ATATGGATTC GGGAATTCTG AAATTACGGG TATCAGCAGG

351 CGAAATAGGG GATATCCGCT ATGAAGAAAA ACGGGATGGG AAGTCTGCCG

401 AGGGCAGTAT TAGTGCATTC AATAACAAAT TTCCCTTATA TAGGAACAAA

451 ATTCTCAATC TTCGCGATGT AGAGCAGGGC TTGGAAAACC TGCGTCGTTT

501 GCCGAGTGTT AAAACAGATA TTCAGATTAT ACCGTCCGAA GAAGAAGGCA

551 AAAGCGATTT ACAGATCAAA TGGCAGCAGA ATAAACCCAT ACGGTTCAGT

601 ATCGGTATAG ATGATGCGGG CGGCAAAACG ACCGGCAAAT ATCAAGGAAA

651 TGTCGCTTTA TCGTTCGATA ACCCTTTGGG CTTAAGCGAT TTGTTtTATG

701 TTTCATATGG ACGCGGTTTG GCGCACAAAA CGGACTTGAC TGATGCCACC

751 GGTACGGAAA CTGAAAGCGG ATCCAGAAGT TACAGCGTGC ATTATTCGGT

801 GCCCGTAAAA AAATGGCTGT TTTCTTTTAA TCACAATGGA CATCGTTACC
```

-continued

```
 851 ACGAAGCAAC CGAAGGCTAT TCCGTCAATT ACGATTACAA CGGCAAACAA

 901 TATCAGAGCA GCCTGGCCGC CGAGCGCATG CTTTGGCGTA ACAGACTTCA

 951 TAAAACTTCA GTCGGAATGA AATTATGGAC ACGCCAAACC TATAAATACA

1001 TCGACGATGC CGAAATCGAA GTACAACGCC GCCGCTCTGC AGGCTGGGAA

1051 GCCGAATTGC GCCACCGTGC TTACCTCAAC CGTTGGCAGC TTGACGGCAA

1101 GTTGTCTTAC AAACGCGGGA CCGGCATGCG CCAAAGTATG CCTGCACCGG

1151 AAGAAAACGG CGGCGATATT CTTCCAGGTA CATCTCGTAT GAAAATCATT

1201 ACTGCCAGTT TGGACGCAGC CGCCCCATTT AyTTTAGGCA AACAGCAGTT

1251 TTTCTACGCA ACCGCCATTC AAGCTCAATG GAACAAAACG CCGTTGGTTG

1301 CCCAAGATAA ATTGTCAATC GGCAGCCGCT ACACCGTTCG CGGATTTGAT

1351 GGGGAGCAGA GTCTTTTCGG AGAGCGAGGT TTCTACTGGC AGAATACTTT

1401 AACTTGGTAT TTTCATCCGA ACCATCAGTT CTATCTCGGT GCGGACTATG

1451 GCCGCGTATC TGGCGAAAGT GCACAATATG TATCGGGCAA GCAGCTGATG

1501 GGTGCAGTGG TCGGCTTCAG AGGAGGGCAT AAAGTAGGCG GTATGTTTGC

1551 TTATGATCTG TTTGCCGGCA AGCCGCTTCA TAAACCCAAA GGCTTTCAGA

1601 CGACCAACAC CGTTTACGGC TTCAACTTGA ATTACAGTTT CTAA
```

This corresponds to the amino acid sequence <SEQ ID 2718; ORF 903>:

```
m903.pep
  1 MQRQQHIDAE LLTDANVRFE QPLEKNNYVL SEDETPCTRV NYISLDDKTV

 51 RKFSFLPSVL MKETAFKTGM CLGSNNLSRL QKAAQQILIV RGYLTSQAII

101 QPQNMDSGIL KLRVSAGEIG DIRYEEKRDG KSAEGSISAF NNKFPLYRNK

151 ILNLRDVEQG LENLRRLPSV KTDIQIIPSE EEGKSDLQIK WQQNKPIRFS

201 IGIDDAGGKT TGKYQGNVAL SFDNPLGLSD LFYVSYGRGL AHKTDLTDAT

251 GTETESGSRS YSVHYSVPVK KWLFSFNHNG HRYHEATEGY SVNYDYNGKQ

301 YQSSLAAERM LWRNRLHKTS VGMKLWTRQT YKYIDDAEIE VQRRRSAGWE

351 AELRHRAYLN RWQLDGKLSY KRGTGMRQSM PAPEENGGDI LPGTSRMKII

401 TASLDAAAPF XLGKQQFFYA TAIQAQWNKT PLVAQDKLSI GSRYTVRGFD

451 GEQSLFGERG FYWQNTLTWY FHPNHQFYLG ADYGRVSGES AQYVSGKQLM

501 GAVVGFRGGH KVGGMFAYDL FAGKPLHKPK GFQTTNTVYG FNLNYSF*
```

Computer analysis of this amino acid sequence gave the following results:

Homology with a Predicted ORF from *N. gonorrhoeae*

ORF 903 shows 48.9% identity over a 519 aa overlap with a predicted ORF (ORF 903.ng) from *N. gonorrhoeae*:

```
 m903/g903

10        20        30        40        50        60
m903.pep  MQRQQHIDAELLTDANVRFEQPLEKNNYVLSEDETPCTRVNYISLDDKTVRKFSFLPSVL
                                        |:: :||  :: : |  : : || |  :
g903                          MATQVGGANSDEASPCFPISEVELVGEETAKFRFALNHA
                                      10        20        30
```

-continued

```
70          80         90         100        110        120
m903.pep    MKETAFKTGMCLGSNNLSRLQKAAQQILIVRGYLTSQAIIQPQNMDSGILKLRVSAGEIG
            : :| | :| || :::::::: ||: || ||| |:: :  ||:::|| |:| :  | :
g903        LCQTHFVSGKCLHAGDINQIMSLAQNALIGRGYTTTRILAAPQDLNSGKLQLTLMPGYLR
          40         50         60         70         80         90

                130        140        150        150        170        180
 m903.pep   DIRYEEKRDGKSAEGSISAFNNKFPLYRNKILNLRDVEQGLENLRRLPSVKTDIQIIPS:
            :|| ::: | ::  | |:||:||||    | :|||||:|||||||: ||::::|:||:|
 g903       SIRIDRSNDDQTHAGRIAAFQNKFPTRSNDLLNLRDLEQGLENLKCLPTAEADLQIVPV:
          100        110        120        130        140        150

190         200        210        220        230
m909.pep    EE-GKSDLQIKWQQNK-PIRFSIGIDDAGGKTTGKYQGNVALSFDNPLGLSDLFYVSYGR
            :| ::||: ::|:     |    |:|:|::|:::|||||||:::| |||:||||:|||:|||
g903        REPNQSDVVVQWRXRLLPYCVSVGMDNSGSEATGKYQGNITFSADNPFLGLSDMFYVNYG
         160        170        180        190        200        210

240         250       260        270         280        290
m903.pep    GLAHKTDLTDATGTETESGSRSYSVHYSVPVKKWLFSFNHNGHRYHEATEGYSVNYDYNG
            :::    |  :   | : |::| :|:||||:|   || ::|||||:|||:|: | |  |||||
g903        SIGGTPDEENFDGHRKEGGSNNYAVHYSAPFGTWTWAFNHNGYRYHQAVSGLSEVYDYNG
         220        230        240        250        260        270

300         310        320        330        340        350
m903.pep    KQYQSSLAAERMLWRNRLHKTSVGMKLWTRQTYKYIDDAEIEVQRRRSAGWEAELRHRAY
            |:|::::: :|:|:|:   :|| :::|||||:| :||||||: ||||:::|| ||| |::|
g903        KSYNTDFGFNRLLYRDAKRKTYLSVKLWTRETSKYIDDAELTVQRRKTTGWLAELSHKGY
         280        290        300        310        320        330

360         370        380        390        400        410
m903.pep    LNRWQLDGKLSYKRGTGMRQSMPAPEENGGDILPGTSRMKIITASLDAAAPFXLGKQQFF
            ::|    | ||:||:||||:::: ||||   |:    ||||||| ||| |: :|| :||| |
g903        IGRSTADFKLKYKHGTGMKDALRAPEEAFGE---GTSRMKIWTASADVNTPFQIGKQLFA
         340        350        360        370         380        390

420         430        440        450        460        470
m903.pep    YATAIQAQWNKTPLVAQDKLSIGSRYTVRGFDGEQSLFGERGFYWQNTLTWYFHPNHQFY
            | |:::||||||||::||||:||:::||||||||:|| :|||:||:| |:| |:|:||:|
g903        LGADVGHVSGQSAKWLSGQTLAGTAIGIRGQIKLGGNLHYDIFTGRALKKPEYFQTKKWV
          460        470        480        490        500        510

480         490        500        510        520        530
m903.pep    LGADYGRVSGESAQYVSGKQLMGAVVGFRGGHKVGGMFAYDLFAGKPLHKPKGFQTTNTV
            |||| |:|||:||:::||: | |:::|:||   |:|| : ||:|:|: |:||: ||| : |
g903        LGADVGHVSGQSAKWLSGQTLAGTAIGIRGQIKLGGNLHYDIFTGRALKKPKEFQTKKWV
          460        470        480        490        500         510

            540
m903.pep    YGFNLNYSFX
             ||:::||||
g903        TGFQVGYSFX
             520
```

The following partial DNA sequence was identified in *N. meningitidis* <SEQ ID 2719>:

```
a903.seq
   1  ATGCAGCGTC AGCAGCACAT AGATGCTGAA TTGTTAACTG ATGCAAATGT

  51  CCGTTTCGAG CAACCATTGG AGAAGAACAA TTATGTCCTG AGTGAAGATG

 101  AAACACCGTG TACTCGGGTA AATTACATTA GTTTAGATGA TAAGACGGCG

 151  CGCAAATTTT CTTTTCTTCC TTCTGTGCTC ATGAAAGAAA CAGCTTTTAA

 201  AACTGGGATG TGTTTAGGTT CCAATAATTT GAGCAGGCTA CAAAAAGCCG

 251  CGCAACAGAT ACTGATTGTG CGTGGCTACC TCACTTCCCA AGCTATTATC

 301  CAACCACAGA ATATGGATTC GGGAATTCTG AAATTACGGG TATCAGCAGG

 351  CGAAATAGGG GATATCCGCT ATGAAGAAAA ACGGGATGGG AAGTCTGCCG

 401  AGGGCAGTAT TAGTGCATTC AATAACAAAT TTCCCTTATA TAGGAACAAA

 451  ATTCTCAATC TTCGCGATGT AGAGCAGGGC TTGGAAAACC TGCGTCGTTT

 501  GCCGAGTGTT AAAACAGATA TTCAGATTAT ACCGTCCGAA GAAGAAGGCA

 551  AAAGCGATTT ACAGATCAAA TGGCAGCAGA ATAAACCCAT ACGGTTCAGT

 601  ATCGGTATAG ATGATGCGGG CGGCAAAACG ACCGGCAAAT ATCAAGGAAA

 651  TGTCGCTTTA TCGTTCGATA ACCCTTTGGG CTTAAGCGAT TTGTTTTATG
```

-continued

```
 701 TTTCATATGG ACGCGGTTTG GTGCACAAAA CGGACTTGAC TGATGCCACC

 751 GGTACGGAAA CTGAAAGCGG ATCCAGAAGT TACAGCGTGC ATTATTCGGT

 801 GCCCGTAAAA AAATGGCTGT TTTCTTTTAA TCACAATGGA CATCGTTACC

 851 ACGAAGCAAC CGAAGGCTAT TCCGTCAATT ACGATTACAA CGGCAAACAA

 901 TATCAGAGCA GCCTGGCCGC CGAGCGCATG CTTTGGCGTA ACAGGTTTCA

 951 TAAAACTTCA GTCGGAATGA AATTATGGAC ACGCCAAACC TATAAATACA

1001 TCGACGATGC CGAAATCGAA GTGCAACGCC GCCGCTCTGC AGGCTGGGAA

1051 GCCGAATTGC GCCACCGTGC TTACCTCAAC CGTTGGCAGC TTGACGGCAA

1101 GTTGTCTTAC AAACGCGGGA CCGGCATGCG CCAAAGTATG CCCGCACCTG

1151 AAGAAAACGG CGGCGGTACT ATTCCAGGCA CATCCCGTAT GAAAATCATA

1201 ACCGCCGGAT TGGATGCAGC GGCCCCGTTT ATGTTGGGCA AACAGCAGTT

1251 TTTCTACGCA ACCGCCATTC AAGCTCAATG GAACAAAACG CCTTTGGTTG

1301 CCCAAGACAA GTTGTCTATC GGCAGCCGCT ACACCGTTNG CGGATTTGAT

1351 GGGGAGCAGA GTCTTTTCGG AGAGCGAGGT TTCTACTGGC AGAATACTTT

1401 AACTTGGTAT TTTCATCCGA ACCATCAGTT CTATCTCGGT GCGGACTATG

1451 GCCGCGTATC TGGCGAAAGT GCACAATATG TATCGGGCAA GCAGCTGATG

1501 GGTGCAGTGG TCGGNTTCAG AGGAGGNCAT AAAGTAGGCG GTATGTTTGC

1551 TTATGATCTG TTTGCCGGCA AGCCGCTTCA TAAACCCAAA GGCTTTCAGA

1601 CGACCAACAC CGTTTACGGC TTCAACTTGA ATTACAGTTT CTAA
```

This corresponds to the amino acid sequence <SEQ ID 2720; ORF 903.a>:

```
a903.pep
   1 MQRQQHIDAE LLTDANVRFE QPLEKNNYVL SEDETPCTRV NYISLDDKTA

  51 RKFSFLPSVL MKETAFKTGM CLGSNNLSRL QKAAQQILIV RGYLTSQAII

 101 QPQNMDSGIL KLRVSAGEIG DIRYEEKRDG KSAEGSISAF NNKFPLYRNK

 151 ILNLRDVEQG LENLRRLPSV KTDIQIIPSE EEGKSDLQIK WQQNKPIRFS

 201 IGIDDAGGKT TGKYQGNVAL SFDNPLGLSD LFYVSYGRGL VHKTDLTDAT

 251 GTETESGSRS YSVHYSVPVK KWLFSFNHNG HRYHEATEGY SVNYDYNGKQ

 301 YQSSLAAERM LWRNRFHKTS VGMKLWTRQT YKYIDDAEIE VQRRRSAGWE

 351 AELRHRAYLN RWQLDGKLSY KRGTGMRQSM PAPEENGGGT IPGTSRMKII

 401 TAGLDAAAPF MLGKQQFFYA TAIQAQWNKT PLVAQDKLSI GSRYTVXGFD

 451 GEQSLFGERG FYWQNTLTWY FHPNHQFYLG ADYGRVSGES AQYVSGKQLM

 501 GAVVGFRGGH KVGGMFAYDL FAGKPLHKPK GFQTTNTVYG FNLNYSF*
```

m903/a903 98.4% identity in 547 aa overlap

```
                    10        20        30        40        50        60
m903.pep    MQRQQHIDAELLTDANVRFEQPLEKNNYVLSEDETPCTRVNYISLDDKTVRKFSFLPSVL
            |||||||||||||||||||||||||||||||||||||||||||||||||:||||||||||
a903        MQRQQHIDAELLTDANVRFEQPLEKNNYVLSEDETPCTRVNYISLDDKTARKFSFLPSVL
                    10        20        30        40        50        60
```

-continued

```
70         80         90        100        110        120
m903.pep   MKETAFGTGMCLGSNNLSRLQKAAQQILIVRGYLTSQAIIQPQNMDSGILKLRVSAGEIG
           ||||||||||||||||||||||||||||||||||||||||||||||||||||||||||||
a903       MKETAFKTGMCLGSNNLSRLQKAAQQILIVRGYLTSQAIIQPQNMDSGILKLRVSAGEIG
                   70        80        90       100       110       120

130        140        150        160        170        180
m903.pep   DIRYEEKRDGKSAEGSISAFNNKFPLYRNKILNLRDVEQGLENLRRLPSVKTDIQIIPSE
           ||||||||||||||||||||||||||||||||||||||||||||||||||||||||||||
a903       DIRYEEKRDGKSAEGSISAFNNKFPLYRNKILNLRDVEQGLENLRRLPSVKTDIQIIPSE
                  130       140       150       160       170       180

190        200        210        220        230        240
m903.pep   EEGKSDLQIKWQQNKPIRFSIGIDDAGGKTTGKYQGNVALSFDNPLGLSDLFYVSYGRGL
           ||||||||||||||||||||||||||||||||||||||||||||||||||||||||||||
a903       EEGKSDLQIKWQQNKPIRFSIGIDDAGGKTTGKYQGNVALSFDNPLGLSDLFYVSYGRGL
                  190       200       210       220       230       240

250        260        270        280        290        300
m903.pep   AHKTDLTDATGTETESGSRSYSVHYSVPVKKWLFSFNHNGHRYHEATEGYSVNYDyNGKQ
           :|||||||||||||||||||||||||||||||||||||||||||||||||||||||||||
a903       VHKTDLTDATGTETESGSRSYSVHYSVPVKKWLFSFNHNGHRYHEATEGYSVNYDyNGKQ
                  250       260       270       280       290       300

310        320        330        340        350        360
m903.pep   YQSSLAAERMLWRNRLHKTSVGMKLWTRQTYKYIDDAEIEVQRRRSAGWEAELRHRAYLN
           ||||||||||||||:|||||||||||||||||||||||||||||||||||||||||||||
a903       YQSSLAAERMLWRNRFHKTSVGMKLWTRQTYKYIDDAEIEVQRRRSAGWEAELRHRAYLN
                  310       320       330       340       350       360

370        380        390        400        410        420
m903.pep   RWQLDGKLSYKYRGTGMRQSSMPAPEENGGDILPGTSRMKIITASLDAAPFXLGKQQFFYA
           |||||||||||||||||||||||||||||   :|||||||||||:|||||| |||||||||
           RWQLDGKLSYKYRGTGMRQSSMPAPEENGGTIPGTSRMKIITAGLDAAPFMLGKQQFFYA
                  370       380       390        400       410       420

430        440        450        460        470        480
m903.pep   TAIQAQWNKTPLVAQDKLSIGSRYTVRGFDGEQSLFGERGFYWQNTLTWYFHPNHQFYLG
           ||||||||||||||||||||||||| ||||||||||||||||||||||||||||||||||
a903       TAIQAQWNKTPLVAQDKLSIGSRYTVRGFDGEQSLFGERGFYWQNTLTWYFHPNHQFYLG
                  430       440       450      460        470       480

490        500        510        520        530        540
m903.pep   ADYGRVSGESAQYVSGKQLMGAVVGFRGGHKVGGMFAYDLFAGKPLHKPKGFQTTNTVYG
           ||||||||||||||||||||||||||||||||||||||||||||||||||||||||||||
a903       ADYGRVSGESAQYVSGKQLMGAVVGFRGGHKVGGMFAYDLFAGKPLHKPKGFQTTNTVYG
                  490       500       510       520       530      540

m903.pep   FNLNYSFX
           ||||||||
a903       FNLNYSFX
```

The following partial DNA sequence was identified in *N. gonorrhoeae* <SEQ ID 2721>:

```
g904.seq
   1  ATGATGCAGC ACAATCGTTT CTTCGCGGTC GGGGCCGGTg gaGACGATGG

  51  CGACCGGCGC GCCGCAGACT TCTTCAATCC GTTTCAAATA TGCTTTGGCA

 101  TTGGCAGGCA ATGCGTCGTA GCTTTTCACG CCGACAGTCG ATTCGCGCCA

 151  GCCGGGCATG GTTTCGTAAA TCGGTTTGCA GGTTTCCACC GCATCCGAAC

 201  CGCAAGGCAG GATGTCGGTT TTGCCGCCGC CTGGCAATTC GTAGCCGACG

 251  CAGATATTGA TGGTTTCAAC GCCGTCCATT ACATCGAGTT TGGTAATGCA

 301  CATACCGGAA ATGCCGTTGA TTTGGATGGA GCGTTTCAGG GCGGCGGCAT

 351  CAAACCAGCC GCAGCGGCGC GCGCGGCCGG TTACCGAACC GAATTCGTGT

 401  CCGCGCTCCG CCAAACCTGC GCCTACTTCG TCGAACAATT CGGTCGGGAA

 451  CGGGCCCGAA CCGACGCGCG TGGTATAGGC TTTGACGATG CCCAAAACAT

 501  AATCCAGCAT TTGAGGACCT ACGCCCGCGC CTGCCGAAGC CGCGCCGGCG

 551  AGACAGTTGG ACGAGGTAAC GAAGGGGTAA GTGCCGTAGT CGATGTCCAA

 601  CAACGCACCT TGCGCGCCTT CAAACAGCAG TTTTTCGCCG TTTTTGTTTT

 651  TTTCGTTCAA CACGCgggaC acgtcgGCAA TCATCGGCGC AATGCGCGGC

 701  GCGACTTTTT CGATAACCGC CATCACGTCT TCCGCTTTAA CCGGTCCGGC
```

-continued

```
 751  GTTATGCAGG TATTGGAGTT GGACGTTGTA ATAGGCAAGG ACGGCATCCA

 801  GTTTTTCACG CAGTTTTTCA GGATGCAGCA AATCGGCGGC GCGAATGGCG

 851  CGGCGTGCCA CTTTGTCTTC GTAGGCAGGG CCGATGCCGC GGCCGGTCGT

 901  GCCGATTTTG CCTTTGCCGC GCGATGCTTC GCGGGCTTGG TCGAGCGCGA

 951  TGTGGTAAGG CAGGATCAGC GGGCAGGTCG GCGCGATTTT CAGACGGCCT

1001  TCGACGTTTT TCACGCCTGC CGCGTTCAAC TCGTCGATTT CGCCCAACAG

1051  GGCTTCGGGg gaaacgAcaa cGCCCGAACC gatGAAGCAA TCCAATCCTT

1101  CGTGCAGGAT ACCGCTCGGA ATCAGGCGCA AAATGGTTTT TTTGCCGCCG

1151  ACGACCAAGG TATGGCCCGC ATTGTGGCCG CCTTGGAAGC GCACgacGct

1201  gCCGGCTTCT TCCGCCAGCC AGTCAACGAT TTTACCTTTA CCCTCGTCGC

1251  CCCACTGTgc gccGATTACT ACAACATTTT TAGCCATAGC CATATAACCT

1301  ATCGatatTA A
```

This corresponds to the amino acid sequence <SEQ ID 2722; ORF 904.ng>:

```
g904.pep
   1 MMQHNRFFAV GAGGDDGDRR AADFFNPFQI CFGIGRQCVV AFHADSRFAP

  51 AGHGFVNRFA GFHRIRTARQ DVGFAAAWQF VADADIDGFN AVHYIEFGNA

 101 HTGNAVDLDG AFQGGGIKPA AAARAAGYRT EFVSALRQTC AYFVEQFGRE

 151 RARTDARGIG FDDAQNIIQH LRTYARACRS RAGETVGRGN EGVSAVVDVQ

 201 QRTLRAFKQQ FFAVFVFFVQ HAGHVGNHRR NARRDFFDNR HHVFRFNRSG

 251 VMQVLELDVV IGKDGIQFFT QFFRMQQIGG ANGAACHFVF VGRADAAAGR

 301 ADFAFAARCF AGLVERDVVR QDQRAGRRDF QTAFDVFHAC RVQLVDFAQQ

 351 GFGGNDNART DEAIQSFVQD TARNQAQNGF FAADDQGMAR IVAALEAHDA

 401 AGFFRQPVND FTFTLVAPLC ADYYNIFSHS HITYRY*
```

The following partial DNA sequence was identified in *N. meningitidis* <SEQ ID 2723>:

```
m904.seq
   1  ATGATGCAGC ACAATCGTTT CTTCTCGGTC GGGGCCGGtG GAGACGATGG

  51  CGACCGGCGC GCCGCAGACT TCTTCAATCC GTTTCAAATA TGCTTTGGCG

 101  TTTTCGGGCA ATGCGCCGTA GTCCTTCACG CCGAAAGTGG ATTCGCGCCA

 151  GCCGGGCATG GTTTCGTAAA TCGGCTTGCA GGTTTCCACC GCATCGGAAC

 201  CGCAAGGCAG GATGTCGGTT TTGCCGCCGT CGGGCAATTC ATAGCCGACG

 251  CAGATATTGA TGGTTTCAAC GCCGTCCATT ACATCGAGTT TAGTAATACA

 301  CATACCGGAA ATGCCGTTGA TTTGGATGGA GCGTTTCAGG GCGGCGGCAT

 351  CAAACCAGCC GCAGCGGCGT GCGCGTCCGG TTACCGAACC GAATTCGTGT

 401  CCGCGTTCTG CCAAACCTAC GCCTACTTCG TCGAACAATT CGGTCGGGAA

 451  CGGGCCCGAA CCGACGCGCG TGGTATAGGC TTTGACGATG CCCAAAACAT

 501  AATCCAGCAT TTGAGGACCT ACGCCCGCGC CTGCCGAAGC TGCGCCCGCC

 551  AGACAGTTGG ACGAGGTAAC GAAGGGATAA GTGCCGTAGT CGATGTCCAA

 601  CAACGCACCT TGCGCGCCTT CAAACAGCAG TTTTTCGCCG TTTTTGTTTT
```

-continued

```
 651 TCTCGTTCAA CACGCGGGAC ACGTCGGTAA TCATCGGCGC AATGCGCGGC
 701 GCGACTTTTT CGATAACCGC CATCACGTCT TCCGCTTTAA CCGGCTCGGC
 751 ATTGTGCAGA TGTTGCAGTT GGACATTGTA ATAGGCAAGG ACGGCATCCA
 801 GTTTTTCACG CAGTTTyTCA GGATGCAGCA AATCGGCGGC GCGAATGGCG
 851 CGGCGTGCCA CTTTGTCTTC GTAGGCAGGG CCGATGCCGC GGCCGGTCGT
 901 GCCGATTTTG CCTTTGCCGC GCG.ATcTTC GCGGGCTTGG TCGAGCGCGA
 951 TGTGGTAAGG CAGGATCAGC GGGCAGGTCG GCGCGATTTT CAGACGGCCT
1001 TCGACGTTTT TCACGCCTGC CGCGTTCAAC TCGTCGATTT CGCCCAACAG
1051 GGCTTCGGGG GAGACGACAA CGCCCGAACC GATGAAGCAG TCCAAACTTT
1101 CATGCAGGAT GCCGCTCGGA ATCAGGCGCA AAATGGTTTT TTTGCCGCCG
1151 ACAACCAAGG TATGGCCCGC ATTGTGGCCG CCTTGGAAGC GCACCaCGCC
1201 GCCGGCTTCT TCCGCCAGCC AGTCAACGAT TTTACCTTTA CCCTCGTCGC
1251 CCCACTGTGC GCCGATTAsT ACAACATTTT TAGCCATAGC CATATAACCT
1301 ATCGATATTA A
```

This corresponds to the amino acid sequence <SEQ ID 2724; ORF 904>:

```
m904.pep
  1 MMQHNRFFSV GAGGDDGDRR AADFFNPFQI CFGVFGQCAV VLHAESGFAP
 51 AGHGFVNRLA GFHRIGTARQ DVGFAAVGQF IADADIDGFN AVHYIEFSNT
101 HTGNAVDLDG AFQGGGIKPA AAACASGYRT EFVSAFCQTY AYFVEQFGRE
151 RARTDARGIG FDDAQNIIQH LRTYARACRS CARQTVGRGN EGISAVVDVQ
201 QRTLRAFKQQ FFAVFVFLVQ HAGHVGNHRR NARRDFFDNR HHVFRFNRLG
251 IVQMLQLDIV IGKDGIQFFT QFXRMQQIGG ANGAACHFVF VGRADAAAGR
301 ADFAFAAXIF AGLVERDVVR QDQRAGRRDF QTAFDVFHAC RVQLVDFAQQ
351 GFGGDDNART DEAVQTFMQD AARNQAQNGF FAADNQGMAR IVAALEAHHA
401 AGFFRQPVND FTFTLVAPLC ADXYNIFSHS HITYRY*
```

Computer analysis of this amino acid sequence gave the following results:

Homology with a Predicted ORF from *N. gonorrhoeae*

ORF 904 shows 90.4% identity over a 436 aa overlap with a predicted ORF (ORF 904.ng) from *N. gonorrhoeae*:

```
m904/g904

                   10        20        30        40        50        60
m904.pep  MMQHNRFFSVGAGGDDGDRRAADFFNPFQICFGVFGQCAVVLHAESGFAPAGHGFVNRLA
          ||||||||:||||||||||||||||||||||||:  ||:|::||:| |||||||||||:|
g904      MMQHNRFFAVGAGGDDGDRRAADFFNPFQICFGIGRQCVVAFHADSRFAPAGHGFVNRFA
                   10        20        30        40        50        60

70        80        90       100       110       120
m904.pep  GFHRIGTARQDVGFAAVGQFIADADIDGFNAVHYIEFSNTHTGNAVDLDGAFQGGGIKPA
          ||||| ||||||||||: ||:||||||||||||||||:|:||||||||||||||||||||
g904      GFHRIRTARQDVGFAAAWQFVADADIDGFNAVHYIEFGNAHTGNAVDLDGAFQGGGIKPA
                   70        80        90       100       110       120

130       140       140       160       170       180
m904.pep  AAACASGYRTEFVSAFCQTYAYFVEQFGRERARTDARGIGFDDAQNIIQHLRTYARACRS
          ||| |:||||||||||: || |||||||||||||||||||||||||||||||||||||||
g904      AAACAAGYRTEFVSALRQTCAYFVEQFGRERARTDARGIGFDDAQNIIQHLRTYARACRS
                  130       140       140       160       170       180
```

-continued

```
190        200        210        220        230        240
m904.pep   CARQTVGRGNEGISAVVDVQQRTLRAFKQQFFAVFVFLVQHAGHVGNHRRNARRDFFDNR
            | :||||||||:||||||||||||||||||||||||:||||||||||||||||||||||
g904       RAGETVGRGNEGVSAVVDVQQRTLRAFKQQFFAVFVFFVQHAGHVGNHRRNARRDFFDNR
                  190       200       210       220       230       240

250        260        270        280        290        300
m904.pep   HHVFRFNRLGIVQMLQLDIVIGKDGIQFFTQFXRMQQIGGANGAACHFVFVGRADAAAGR
           |||||||| |::|:|:||:||:|||||||||| |||||||||||||||||||||||||||
           HHVFRFNRSGVMQVLELDVVIGKDGIQFFTQFFRMQQIGGANGAACHFVFVGRADAAAGR
g904              250       260       270       280       290       300

310        320        330        340        350        360
m904.pep   ADFAFAARIFAGLVERDVVRQDQRAGRRDFQTAFDVFHACRVQLVDFAQQGFGGDDNART
           |||||||| |||||||||||||||||||||||||||||||||||||||||||||||:|||||
g904       ADFAFAARCFAGLVERDVVRQDQRAGRRDFQTAFDVFHACRVQLVDFAQQFDFFDDNART
                  310       320       330       340       350       360

370        380        390        400        410        420
m904.pep   DEAVQTFMQDAARNQAQNGFFAADNQGMARIVAALEAHHAAGFFRQPVNDFTFTLVAPLC
           |||:|:|:||:|||||||||||||:|||||||||||||| ||||||||||||||||||||
           DEAIQSFVQDTARNQAQNGFFAADDQGMARIVAALEAHDAAGFFRQPVNDFTFTLVAPLC
                  370       380       390       400       410       420

430
m904.pep   ADXYNIFSHSHITYRYX
g904       || ||||||||||||||
           ADYYNIFSHSHITYRYX
                  430
```

The following partial DNA sequence was identified in *N. meningitidis* <SEQ ID 2725>:

```
a904.seq
     1 ATGATGCAGC ACAATCGTTT CTTCGCGGTC GGGGCCGGTG GAGACGATGG

    51 CGACCGGCGC ACCGCAGACT TCTTCAATCC GTTTCAAATA TGCTTTGGCA

   101 TTGGCAGGTA ATGCGTCGTA GCTTTTCACG CCGAAAGTGG ATTCGCTCCA

   151 ACCGGGCATG GTTTCGTAAA TCGGCTTGCA GGCTTCTACC GCATCAGAGC

   201 CGCAAGGCAG GATGTCGGTT TTGCCGCCGT CGGGCAATTC GTAGCCGACG

   251 CAGATATTGA TGGTTTCAAC GCCGTCCATT ACATCGAGTT TGGTAATACA

   301 CATACCGGAA ATGCCGTTGA TTTGGATGGA GCGTTTCAGG GCGGCGGCAT

   351 CAAACCAGCC GCAGCGGCGT GCGCGTCCGG TTACCGAACC GAATTCGTGT

   401 CCGCGTTCTG CCAAACCTGC TCCGACTTCG TCGAACAATT CGGTCGGGAA

   451 CGGGCCCGAA CCGACGCGCG TGGTATAGGC TTTGACGATG CCCAAAACAT

   501 AATCCAGCAT TTGAGGGCCT ACGCCCGCGC CTGCCGAAGC CGCGCCGGCG

   551 AGGCAGTTGG ACGAAGTAAC GAAGGGGTAA GTGCCGTAGT CGATGTCCAA

   601 CAACGCACCT TGCGCGCCTT CAAACAGCAG TTTTTCGCCG TTTTTGTTTT

   651 TTTCGTTCAA CACGCGGGAC ACGTCGGTAA TCATCGGCGT AATGCGCGGC

   701 GCGACTTTTT CGATAACCGC CATCACGTCT TCCGCTTTCA CCGACTCGGC

   751 ATTGTGCAGA TGTTGCAGTT GGACGTTGTA ATAAGCAAAG ACGGCATCCA

   801 GTTTTTCACG CAGTTTTTCA GGATGCAGCA AATCGGCGGC GCGAATGGCG

   851 CGGCGTGCCA CTTTGTCTTC GTAGGCAGGG CCGATGCCGC GGCCGGTCGT

   901 GCCGATTTTG CCTTTGCCGC GCGATGCTTC TCGGGCTTGG TCGAGCGCGA

   951 TGTGATAAGG CAGGATCAGC GGGCAGGTCG GCGCGATTTT CAGACGGCCT

  1001 TCGACGTTTT TCACGCCTGC CGCGTTCAAC TCGTCGATTT CGCCCAACAG

  1051 GGCTTCGGGG GAGACGACAA CGCCCGAACC GATGAAGCAG TCCAGACTTT

  1101 CATGCAGGAT GCCGCTCGGA ATCAGGCGCA AAATGGTTTT TTTGCCGCCG

  1151 ACAACCAAGG TATGACCCGC ATTGTGGCCG CCTTGGAAGC GCACCACGCC
```

-continued

```
1201  TCCGGCTTCT TCCGCCAGCC AGTCAACGAT TTTACCTTTA CCCTCGTCGC

1251  CCCACTGTGC GCCGATTACT ACAACATTTT TAGCCATAGC CATATAACCT

1301  .TCGATATTA A
```

This corresponds to the amino acid sequence <SEQ ID 2726; ORF 904.a>:

```
a904.pep
   1 MMQHNRFFAV GAGGDDGDRR TADFFNPFQI CFGIGR*CVV AFHAESGFAP

  51 TGHGFVNRLA GFYRIRAARQ DVGFAAVGQF VADADIDGFN AVHYIEFGNT

 101 HTGNAVDLDG AFQGGGIKPA AAACASGYRT EFVSAFCQTC SDFVEQFGRE

 151 RARTDARGIG FDDAQNIIQH LRAYARACRS RAGEAVGRSN EGVSAVVDVQ

 201 QRTLRAFKQQ FFAVFVFFVQ HAGHVGNHRR NARRDFFDNR HHVFRFHRLG

 251 IVQMLQLDVV ISKDGIQFFT QFFRMQQIGG ANGAACHFVF VGRADAAAGR

 301 ADFAFAARCF SGLVERDVIR QDQRAGRRDF QTAFDVFHAC RVQLVDFAQQ

 351 GFGGDDNART DEAVQTFMQD AARNQAQNGF FAADNQGMTR IVAALEAHHA

 401 SGFFRQPVND FTFTLVAPLC ADYYNIFSHS HITXRY*
```

m904/a904 91.3% identity in 436 aa overlap

```
                   10        20        30        40        50        60
m904.pep   MMQHNRFFSVGAGGDDGDRRAADFFNPFQICFGVFGQCAVVLHAESGFAPAGHGFVNRLA
           ||||||||:|||||||||||:|||||||||||:   |:|::||||||||:||||||||||
a904       MMQHNRFFAVGAGGDDGDRRTADFFNPFQICFGIGRXCVVAFHAESGFAPTGHGFVNRLA
                   10        20        30        40        50        60

                   70        80        90       100       110       120
m904.pep   GFHRIGTARQDVGFAAVGQFIADADIDGFNAVHYIEFSNTHTGNAVDLDGAFQGGGIKPA
           ||:|| :|||||||||||||:||||||||||||||||:||||||||||||||||||||||
a904       GFYRIRAARQDVGFAAVGQFVADADIDGFNAVHYIEFGNTHTGNAVDLDGAFQGGGIKPA
                   70        80        90       100       110       120

                  130       140       150       160       170       180
m904.pep   AAACASGYRTEFVSAFCQTYAYFVEQFGRERARTDARGIGFDDAQNIIQHLRTYARACRS
           ||||||||||||||||||| : ||||||||||||||||||||||||||||||:|||||||
a904       AAACASGYRTEFVSAFCQTCSDFVEQFGRERARTDARGIGFDDAQNIIQHLRAYARACRS
                  130       140       150       160       170       180

                  190       200       210       220       230       240
m904.pep   CARQTVGRGNEGISAVVDVQQRTLRAFKQQFFAVFVFLVQHAGHVGNHRRNARRDFFDNR
            | ::|||:|||:||||||||||||||||||||||||:||||||||||||||||||||||
a904       RAGEAVGRSNEGVSAVVDVQQRTLRAFKQQFFAVFVFFVQHAGHVGNHRRNARRDFFDNR
                  190       200       210       220       230       240

                  250       260       270       280       290       300
m904.pep   HHVFRFNRLGIVQMLQLDIVIGKDGIQFFTQFXRMQQIGGANGAACHFVFVGRADAAAGR
           ||||||:|||||||||||:||:|||||||||| |||||||||||||||||||||||||||
a904       HHVFRFHRLGIVQMLQLDVVISKDGIQFFTQFFRMQQIGGANGAACHFVFVGRADAAAGR
                  250       260       270       280       290       300

                  310       320       330       340       350       360
m904.pep   ADFAFAAXIFAGLVERDVVRQDQRAGRRDFQTAFDVFHACRVQLVDFAQQGFGGDDNART
           |||||||  |:|||||||:|||||||||||||||||||||||||||||||||||||||||
a904       ADFAFAARCFSGLVERDVIRQDQRAGRRDFQTAFDVFHACRVQLVDFAQQGFGGDDNART
                  310       320       330       340       350       360

                  370       380       390       400       410       420
m904.pep   DEAVQTFMQDAARNQAQNGFFAADNQGMARIVAALEAHHAAGFFRQPVNDFTFTLVAPLC
           ||||||||||||||||||||||||||||:|||||||||||:|||||||||||||||||||
a904       DEAVQTFMQDAARNQAQNGFFAADNQGMTRIVAALEAHHASGFFRQPVNDFTFTLVAPLC
                  370       380       390       400       410       420

                  430
m904.pep   ADXYNIFSHSHITYRYX
           || |||||||||| |||
a904       ADYYNIFSHSHITXRYX
                  430

g906.seq not found yet
g906.pep not found yet
```

The following partial DNA sequence was identified in *N. meningitidis* <SEQ ID 2727>:

```
m906.seq
   1 ATGAAATATA TCGTATCAAT CTCTCTGGCT ATGGGATTGG CTGCCTGTTC

  51 GTTTGGGGGA TTTAAACCAA ATCCGTGGGA CGCCGCGTCA TTTTGGGAAT

 101 TGAAAAATTA CGCCAATCCC TATCCGGGAT CAGCCTCGGC GGCACTTGAC

 151 CAATATCCAT CGAAAGCAAG ACGAAGGCAA CTGAAAGACA TGCAAGAGTG

 201 CGGCTATGAC CCAATAGACG GCGGAAAGTC TGAAGCAGAT GCCTGCCTGA

 251 GGAAAAAAGG CTGGTGTCGT AAGGGTTTCG ACCCTTATCC CGAAAACAAA

 301 AAATACGAAT GGCCTCGAGA AGAAGGAAAA ACAAAATGA
```

This corresponds to the amino acid sequence <SEQ ID 2728; ORF 906>:

```
m906.pep
   1 MKYIVSISLA MGLAACSFGG FKPNPWDAAS FWELKNYANP YPGSASAALD

  51 QYPSKARRRQ LKDMQECGYD PIDGGKSEAD ACLRKKGWCR KGFDPYPENK

 101 KYEWPREEGK TK*
```

The following partial DNA sequence was identified in *N. gonorrhoeae* <SEQ ID 2729>:

```
g907.seq (partial)
   1 ATGAAAAAAC CGACCGATAC CCTACCCGTC AATCTgcaAC GCCGCCGCCT

  51 GCTGTGTGCC GCCGGCGCGC TGTTGATCAG CCCGCTGGCG CACGCCGGCG

 101 CGCAACGTGA AGAAACGCtt gCCGACGATG TGGCTTCCGT GATGAGGAGT

 151 TCTGTCGGCA GCGTCAATCC GCCGAGGCTG GTGTTCGACA ATCCGAAAGA

 201 GGGCGAACGT TGGTTGTCCG CGATGTCGGC ACGTTTGGCA AGATTCGTCC

 251 CCGACGAGGG GGAGCGGCGC AGGCTGCTGG TCAATATCCA ATACGAAAGC

 301 AGCCGGGCCG GTTTGGATAC GCAGATTGTG TTGGGGCTGa ttgaagtgga

 351 aagcgggtac cgagctcgaa tcatatca..
```

This corresponds to the amino acid sequence <SEQ ID 2730; ORF 907.ng>:

```
g907.pep (partial)
   1 MKKPTDTLPV NLQRRRLLCA AGALLISPLA HAGAQREETL ADDVASVMRS

  51 SVGSVNPPRL VFDNPKEGER WLSAMSARLA RFVPDEGERR RLLVNIQYES

 101 SRAGLDTQIV LGLIEVESGY RARIIS...
```

The following partial DNA sequence was identified in *N. meningitidis* <SEQ ID 2731>:

```
m907.seq
   1 ATGAGAAAAC CGACCGATAC CCTACCCGTT AATCTGCAAC GCCGCCGCCT

  51 GTTGTGTGCC GCCGGTGCGT TGTTGCTCAG TCCTCTGGCG CACGCCGGCG

 101 CGCAACGTGA GGAAACGCTT GCCGACGATG TGGCTTCCGT GATGAGGAGT

 151 TCTGTCGGCA GCGTCAATCC GCCGAGGCTG GTGTTTGACA ATCCGAAAGA

 201 GGGCGAGCGT TGGTTGTCTG CCATGTCGGC ACGTTTGGCA AGGTTCGTCC
```

-continued

```
251 CCGAGGAGGA GGAGCGGCGC AGGCTGCTGG TCAATATCCA GTACGAAAGC

301 AGCCGGGCCG GTTTGGATAC GCAGATTGTG TTGGGGCTGA TTGAGGTGGA

351 AAGCGCGTTC CGCCAGTATG CAATCAGCGG TGTCGGCGCG CGCGGCCTGA

401 TGCAGGTTAT GCCGTTkTGG AAAAACTACA TCGGCAAACC GGCGCACAAC

451 CTGTTCGACA TCCGCACCAA CCTGCGTTAC GGCTGTACCA TCCTGCGCCA

501 TTACCGGAAT CTTGAAAAAG GCAACATCGT CCGCGCGCTT GCCCGCTTTA

551 ACGGCAGCTT GGGCAGCAAT AAATATCCGA ACGCCGTTTT GGgCGCGTGG

601 CGCAACCGCT GGCAGTGGCG TTGA
```

This corresponds to the amino acid sequence <SEQ ID 2732; ORF 907>:

```
m907.pep
  1 MRKPTDTLPV NLQRRRLLCA AGALLLSPLA HAGAQREETL ADDVASVMRS

 51 SVGSVNPPRL VFDNPKEGER WLSAMSARLA RFVPEEEERR RLLVNIQYES

101 SRAGLDTQIV LGLIEVESAF RQYAISGVGA RGLMQVMPXW KNYIGKPAHN

151 LFDIRTNLRY GCTILRHYRN LEKGNIVRAL ARFNGSLGSN KYPNAVLGAW

201 RNRWQWR*
```

Computer analysis of this amino acid sequence gave the following results:

Homology with a Predicted ORF from *N. gonorrhoeae*

ORF 907 shows 92.9% identity over a 126 aa overlap with a predicted ORF (ORF 907.ng) from *N. gonorrhoeae*:

```
g907/m907

                     10        20        30        40        50        60
g907.pep      MKKPTDTLPVNLQRRRLLCAAGALLISPLAHAGAQREETLADDVASVMRSSVGSVNPPRL
              |:||||||||||||||||||||||||||||||||:|||||||||||||||||||||||||
m907          MRKPTDTLPVNLQRRRLLCAAGALLLSPLAHAGAQREETLADDVASVMRSSVGSVNPPRL
                     10        20        30        40        50        60

70            80        90        100       110       120
m907.pep      VFDNPKEGERWLSAMSARLARFVPDEGERRRLLVNIQYESSRAGLDTQIVLGLIEVESGY
              ||||||||||||||||||||||||:| |||||||||||||||||||||||||||||||::
m907          VFDNPKEGERWLSAMSARLARFVPEEEERRRLLVNIQYESSRAGLDTQIVLGLIEVESAF
                     70        80        90       100       110       120

907.pep       RARIIS
              |    ||
              RQYAISGVGARGLMQVMPXWKNYIGKPAHNLFDIRTNLRYGCTILRHYRNLEKGNIVRAL
                    130       140       150       160       170       180
```

The following partial DNA sequence was identified in *N. meningitidis* <SEQ ID 2733>:

```
a907.seq
  1 ATGAAAAAAC CGACCGATAC CCTACCCGTC AATCTGCAAC GCCGCCGCCT

 51 ATTGTGTGCT GCCGGCGCGC TGTTGCTCAG CCCGCTGGCA CAAGCCGGCG

101 CGCAACGTGA AGAAACGCTT GCCGACGATG TGGCTTCCGT GATGAGGAGC

151 TCTGTCGGCA GCATAAATCC GCCGAGGCTG GTGTTCGACA ATCCGAAAGA

201 GGGCGAGCGT TGGCTGTCCG CGATGTCTGC TCGGTTGGCA AGGTTCGTCC

251 CCGATGAGGA GGAGCGGCGC AGGCTGCTGG TCAATATCCA GTACGAAAGC

301 AGCCGGGCCG GTTTGGATAC GCAGATTGTG TTGGGGCTGA TTGAGGTGGA
```

-continued

```
351 AAGCGCGTTC CGCCAGTATG CAATCAGCGG TGTCGGCGCG CGCGGCCTGA

401 TGCAGGTTAT GCCGTTTTGG AAAAACTACA TCGGCAAACC GGCGCACAAC

451 CTGTTCGACA TCCGCACCAA CCTGCGTTAC GGCTGTACCA TCCTGCGCCA

501 TTACCGGAAT CTTGAAAAAG GCAACATCGT CCGCGCACTC GCCCGTTTTA

551 ACGGTAGCCT CGGCAGCAAT AAATATCCGA ACGCCGTTTT GGGCGCGTGG

601 CGCAACCGCT GGCAGTGGCG TTGA
```

This corresponds to the amino acid sequence <SEQ ID 2734; ORF 907.a>:

```
a907.pep
  1 MKKPTDTLPV NLQRRRLLCA AGALLLSPLA QAGAQREETL ADDVASVMRS

 51 SVGSINPPRL VFDNPKEGER WLSAMSARLA RFVPDEEERR RLLVNIQYES

101 SRAGLDTQIV LGLIEVESAF RQYAISGVGA RGLMQVMPFW KNYIGKPAHN

151 LFDIRTNLRY GCTILRHYRN LEKGNIVRAL ARFNGSLGSN KYPNAVLGAW

201 RNRWQWR*
```

m907/a907 97.6% identity in 207 aa overlap

```
                    10        20        30        40        50        60
m907.pep    MRKPTDTLPVNLQRRRLLCAAGALLLSPLAHAGAQREETLADDVASVMRSSVGSVNPPRL
            |:||||||||||||||||||||||||||||:|||||||||||||||||||||||:|||||
a907        MKKPTDTLPVNLQRRRLLCAAGALLLSPLAQAGAQREETLADDVASVMRSSVGSINPPRL
                    10        20        30        40        50        60

                    70        80        90       100       110       120
m907.pep    VFDNPKEGERWLSAMSARLARFVPEEEERRRLLVNIQYESSRAGLDTQIVLGLIEVESAF
            ||||||||||||||||||||||||:|||||||||||||||||||||||||||||||||||
a907        VFDNPKEGERWLSAMSARLARFVPDEEERRRLLVNIQYESSRAGLDTQIVLGLIEVESAF
                    70        80        90       100       110       120

                   130       140       150       160       170       180
m907.pep    RQYAISGVGARGLMQVMPXWKNYIGKPAHNLFDIRTNLRYGCTILRHYRNLEKGNIVRAL
            |||||||||||||||||| |||||||||||||||||||||||||||||||||||||||||
a907        RQYAISGVGARGLMQVMPFWKNYIGKPAHNLFDIRTNLRYGCTILRHYRNLEKGNIVRAL
                   130       140       150       160       170       180

                   190       200
m907.pep    ARFNGSLGSNKYPNAVLGAWRNRWQWRX
            ||||||||||||||||||||||||||||
a907        ARFNGSLGSNKYPNAVLGAWRNRWQWRX
                   190       200
```

The following partial DNA sequence was identified in *N. gonorrhoeae* <SEQ ID 2735>:

```
g908.seq
  1 ATGAG.AAAA GCCGTCTAAG CCGGTATAAA CAAAATAAAC TCATTGGGCT

 51 ATTTGTCGCA GGTGTAACTG CAAGAACAGC GGCAGAGTTG GTAGGCATTA

101 ATAAAAATAC CGCAGCCTAT GATTTTCATC GTTTACGATG ACTGATTTAT

151 CAAAACGGTC CGCATTTAGA AATGTTTGAT GGCGAAGTAG AAGCAGATGA

201 AAGTTATTTT GGCGGACAAC GCAAAGGCAA ACGCGGTCGC GGTGCTGCCG

251 GTAAAGTCGC CGTATTCGGT CTTTTGAAGC GAAATGGTAA GGTTTATACG

301 GTTACAGTAC CGAATACTCA AACCGCTACT TTATTTCCTA TTATCCGTGA

351 acaagtgaaa cctgacagta ttgtttatac ggattgttat CgTAGCTATG

401 ATGTATTAGA Tgtgagcgaa tttagccatT TTagcttcgc tgaaacttcg

451 ttttcgtaTC AATCACAGCA CACATTTTGC CGAACGACAA AACCATATTA
```

-continued

```
501 A
```

This corresponds to the amino acid sequence <SEQ ID 2736; ORF 908.ng>:

```
g908.pep
   1 MXKSRLSRYK QNKLIGLFVA GVTARTAAEL VGINKNTAAY DFHRLR*LIY

  51 QNGPHLEMFD GEVEADESYF GGQRKGKRGR GAAGKVAVFG LLKRNGKVYT

 101 VTVPNTQTAT LFPIIREQVK PDSIVYTDCY RSYDVLDVSE FSHFSFAETS

 151 FSYQSQHTFC RTTKPY*
```

The following partial DNA sequence was identified in *N. meningitidis* <SEQ ID 2737>:

```
m908.seq
   1 ATGAGAAAAA GTCGTCTAAG CCAGTATAAA CAAAmTAAAC TCATTGAACT

  51 GTTTGTCACA GGTGTAACTG CAAGAACGGC AGCAGAGTTA GTAGGCGTTA

 101 ATAAAAATAC CGCAGCCTAT TATTTTCATC GTTTACGATT ACTTATTTAT

 151 CAAAACAGTC CGCATTTGGA AATGTTTGAT GGCGAAGTAG AAGCAGATGA

 201 AAGTTATTTT GGCGGACAAC GCAAAGGCAA ACGCGGTCGC GGTGCTGCCG

 251 GTAAAGTCGC CGTATTCGGT CTTTTGAAGC GAAATGGTAA GGTTTATACG

 301 GTTACAGTAC CGAATACTCA AACCGCTACT TTATTTCCTA TTATCCGTGA

 351 ACAAGTGAAA CCTGACAGCA TTTTTTATAC GGATTGTTAT CGTAGCTATG

 401 ATGTATTAGA TGTGCGCGAA TTTAGCCATT TTAGCTTCGC TGAAACTTCG

 451 TTTTCGTATC AATCACAGCA CACATTTTGC CGAACGACAA AACCATATTA

 501 A
```

This corresponds to the amino acid sequence <SEQ ID 2738; ORF 908>:

```
m908.pep
   1 MRKSRLSQYK QXKLIELFVT GVTARTAAEL VGVNKNTAAY YFHRLRLLIY

  51 QNSPHLEMFD GEVEADESYF GGQRKGKRGR GAAGKVAVFG LLKRNGKVYT

 101 VTVPNTQTAT LFPIIREQVK PDSIFYTDCY RSYDVLDVRE FSHFSFAETS

 151 FSYQSQHTFC RTTKPY*
```

Computer analysis of this amino acid sequence gave the following results:

Homology with a Predicted ORF from *N. gonorrhoeae*

ORF 908 shows 93.4% identity over a 166 aa overlap with a predicted ORF (ORF 908.ng) from *N. gonorrhoeae*:

```
g908/m908

                    10        20        30        40        50        60
g908.pep    MXKSRLSRYKQNKLIGLFVAGVTARTAAELVGINKNTAAYDFHRLRXLIYQNGPHLEDFD
            | |||||:||| ||| |||:||||||||||||:||||||| ||||| |||||:|||||||
m908        MRKSRLSQYKQXKLIELFVTGVTARTAAELVGVNKNTAAYYFHRLRLLIYQNSPHLEMFD
                    10        20        30        40        50        60

                    70        80        90       100       110       120
g908.pep    GEVEADESYFGGQRKGKRGRGAAGKVAVFGLLKRNGKVYTVTVPNTQTATLFPIIREQVK
            ||||||||||||||||||||||||||||||||||||||||||||||||||||||||||||
m908        GEVEADESYFGGQRKGKRGRGAAGKVAVFGLLKRNGKVYTVTVPNTQTATLFPIIREQVK
                    70        80        90       100       110       120
```

-continued

```
               130        140        150        160
g908.pep  PDSIVYTDCYRSYDVLDVSEFSHFSFAETSFSYQSQHTFCRTTKPYX
          |||| ||||||||||||| ||||||||||||||||||||||||||||
m908      PDSIFYTDCYRSYDVLDVREFSHFSFAETSFSYQSQHTFCRTTKPYX
               130        140        150        160
```

The following partial DNA sequence was identified in *N. meningitidis* <SEQ ID 2739>:

```
a908.seq
   1 ATGAGAAAAA GTCGTCTAAG CCAGTATAAA CAAAATAAAC TCATTGAGCT

  51 ATTTGTCGCA GGTGTAACTG CAAGAACGGC AGCAGAGTTA GTAGGCGTTA

 101 ATAAAAATAC CGCAGCCTAT TATTTTCATC GTTTACGATT ACTTATTTAT

 151 CAAAACAGTC CGCATTTGGA AATGTTTGAT GGCGAAGTAG AAGCAGATGA

 201 AAGTTATTTT GGCGGACAAC GCAAAGGCAA ACGCGGTCGC GGTGCTGCCG

 251 GTAAAGTCGC CGTATTCGGT CTTTTGAAGC GAAATGGTAA GGTTTATACG

 301 GTTACAGTAC CGAATACTCA AACCGCTACT TTATTTCCTA TTATCCGTGA

 351 ACAAGTGAAA CCTGACAGCA TTGTTTATAC GGATTGTTAT CGTAGCTATG

 401 ATGTATTAGA TGTGCGCGAA TTTAGCCATT TTAGCTTCGC TGAAACTTCG

 451 TTTTCGTATC AATCACAGCA CACATTTTGC CGAACGACAA AACCATATTA

 501 A
```

This corresponds to the amino acid sequence <SEQ ID 2740; ORF 908.a>:

```
a908.pep
   1 MRKSRLSQYK QNKLIELFVA GVTARTAAEL VGVNKNTAAY YFHRLRLLIY

  51 QNSPHLEMFD GEVEADESYF GGQRKGKRGR GAAGKVAVFG LLKRNGKVYT

 101 VTVPNTQTAT LFPIIREQVK PDSIVYTDCY RSYDVLDVRE FSHFSFAETS

 151 FSYQSQHTFC RTTKPY*
```

m908/a908 98.2% identity in 166 aa overlap

```
                  10         20         30         40         50         60
m908.pep  MRKSRLSQYKQXKLIELFVTGVTARTAAELVGVNKNTAAYYFHRLRLLIYQNSPHLEMFD
          |||||||||| |||||||:|||||||||||||||||||||||||||||||||||||||||
a908      MRKSRLSQYKQNKLIELFVAGVTARTAAELVGVNKNTAAYYFHRLRLLIYQNSPHLEMFD
                  10         20         30         40         50         60

                  70         80         90        100        110        120
m908.pep  GEVEADESYFGGQRKGKRGRGAAGKVAVFGLLKRNGKVYTVTVPNTQTATLFPIIREQVK
          ||||||||||||||||||||||||||||||||||||||||||||||||||||||||||||
a908      GEVEADESYFGGQRKGKRGRGAAGKVAVFGLLKRNGKBYTVTVPNTQTATLFPIIREQVK
                  70         80         90        100        110        120

                 130        140        150        160
m908.pep  PDSIFYTDCYRSYDVLDVREFSHFSFAETSFSYQSQHTFCRTTKPYX
          |||| ||||||||||||||||||||||||||||||||||||||||||
a908      PDSIVYTDCYRSYDVLDVREFSHFSFAETSFSYQSQHTFCRTTKPYX
                 130        140        150        160
```

The following partial DNA sequence was identified in *N. gonorrhoeae* <SEQ ID 2741>:

```
g909.seq (partial)
   1 atgcgtaaaa ccgtacttat cCTgaccatc tccgccgccc ttttgtcggg

  51 ctgcacatgG gaaacttatc aagacggcag cggcaaaacc gccgtccgtg
```

-continued

```
101 caaaatgttc caccggcacg ccgctgtgtt ggcaagacgg gcgcggctcg

151 aaaaaggtgg actgcgacga gtacggtggc gaacgccggg ccgtgttgcg

201 caaccaaaag cgggggaagc ccgcgacgag gagagccgca acgctgggga

251 aaccgagttt ccgggcgagg gacggggggg ggcgggtgaa cagggcagaa

301 acgggggagg ggaagcgatc ggcgagg..
```

This corresponds to the amino acid sequence <SEQ ID 2742; ORF 909.ng>:

```
g909.pep (partial)
   1 MRKTVLILTI SAALLSGCTW ETYQDGSGKT AVRAKCSTGT PLCWQDGRGS

  51 KKVDCDEYGG ERRAVLRNQK RGKPATRRAA TLGKPSFRAR DGGGRVNRAE

 101 TGEGKRSAR..
```

The following partial DNA sequence was identified in *N. meningitidis* <SEQ ID 2743>:

```
m909.seq
   1 ATGCGTAAAA CCTTCCTCTT CCTGACCGCT GCCGCCGCCC TTTTGTCGGG

  51 CTGCGCGTGG GAAACTTATC AAGACGGCAA CGGCAAGACC GCCGTCCGTC

 101 AAAAATATCC CGCCGGCACG CCCGTTTATT ACCAAGACGG CAGCTACTCG

 151 AAAAATATGA ACTACAACCA ATACCGTCCC GAACGCCATG CCGTGTTACC

 201 CAATCAAACC GGCAACAACG CCGACGAAGA GCATCGCCAA CACTGGCAAA

 251 AACCAAAGTT TCAAAACCGA TAA
```

This corresponds to the amino acid sequence <SEQ ID 2744; ORF 909>:

```
m909.pep
  1 MRKTFLFLTA AAALLSGCAW ETYQDGNGKT AVRQKYPAGT PVYYQDGSYS

 51 KNMNYNQYRP ERHAVLPNQT GNNADEEHRQ HWQKPKFQNR *
```

Computer analysis of this amino acid sequence gave the following results:

Homology with a Predicted ORF from *N. gonorrhoeae*

ORF 909 shows 53.3% identity over a 90 aa overlap with a predicted ORF (ORF 909.ng) from *N. gonorrhoeae*:

```
m909/g909

                   10        20        30        40        50        60
m909.pep    MRKTFLFLTAAAALLSGCAWETYQDGNGKTAVRQKYPAGTPVYYQDGSYSKNMNYNQYRP
            |||| |:|| :||||||:|||||||:||||| |  :|||: :|||  ||::: ::|
g909        MRKTVLILTISAALLSGCTWETYQDGSGKTAVRAKCSTGTPLCWQDGRGSKKVDCDEYGG
                   10        20        30        40        50        60

                   70        80        90
m909.pep    ERHAVLPNQTGNNADEEHRQHWQKPKFQNRX
            ||:||| ||  ::   ::     ||:|: |
g909        ERRAVLRNQKRGKPATRRAATLGKPSFRARDGGGRVNRAETGEGKRSAR
                   70        80        90       100
```

The following partial DNA sequence was identified in *N. meningitidis* <SEQ ID 2745>:

```
a909.seq
    1 ATGCGTAAAA CCTTCCTTAT CCTGATGACT GCCGCCGCCC TTTTGTCGGG

   51 CTGCGCGTGG GAAACTTATC AAGACGGCAA CGGCAAGACC GCCGTCCGTC

  101 AAAAATATCC CGCCGGCACG CCCGTTTATT ACCAAGACGG CAGCTACTCG

  151 AAAAATATGA ACTACAACCA ATACCGTCCC GAACGCCATG CCGTGTTACC

  201 CAACCAAACC GGCAACAACG CCGACGAAGA GCATCGCCAA CACTGGCAAA

  251 AGCCCAAATT TCAAAACCGA TAA
```

This corresponds to the amino acid sequence <SEQ ID 2746; ORF 909.a>:

```
a909.pep
    1 MRKTFLILMT AAALLSGCAW ETYQDGNGKT AVRQKYPAGT PVYYQDGSYS

   51 KNMNYNQYRP ERHAVLPNQT GNNADEEHRQ HWQKPKFQNR *
```

20 m909/a909 96.7% identity in 90 aa overlap

```
                      10        20        30        40        50        60
m909.pep      MRKTFLFLTAAAALLSGCAWETYQDGNGKTAVRQKYPAGTPVYYQDGSYSKNMNYNQYRP
              ||||||:| :||||||||||||||||||||||||||||||||||||||||||||||||||
a909          MRKTFLILMTAAALLSGCAWETYQDGNGKTAVRQKYPAGTPVYYQDGSYSKNMNYNQYRP
                      10        20        30        40        50        60

                      70        80        90
m909.pep      ERHAVLPNQTGNNADEEHRQHWQKPKFQNRX
              |||||||||||||||||||||||||||||||
a909          ERHAVLPNQTGNNADEEHRQHWQKPKFQNRX
                      70        80        90
```

The following partial DNA sequence was identified in *N. gonorrhoeae* <SEQ ID 2747>:

```
g910.seq
    1 ATGAAAAAAC TGTTATTGGC CGCCGTTGTT TCCCTAAATG CCGCAACCGC

   51 ATTTGCCGGC GACTCTGCCG AGCGTCAGAT TTACGGCGAT CCCCATTTTG

  101 AACAAAACCG CACAAAAGCC GTGAAAATGT TGGAACAGCG CGGTTATCAG

  151 GTTTACGATG TCGATGCCGA CGACTACTGG GGCAAACCTG TTTTGGAAGT

  201 GGAAGCCTAT AAAGACGGCC GCGAATACGA CATCGTGTTG TCTTACCCCG

  251 ACCTGAAAAT CATCAAAGAG CAGCTCGATC GCTGA
```

This corresponds to the amino acid sequence <SEQ ID 2748; ORF 910.ng>:

```
g910.pep
    1 MKKLLLAAVV SLNAATAFAG DSAERQIYGD PHFEQNRTKA VKMLEQRGYQ

   51 VYDVDADDYW GKPVLEVEAY KDGREYDIVL SYPDLKIIKE QLDR*
```

The following partial DNA sequence was identified in *N. meningitidis* <SEQ ID 2749>:

```
m910.seq
    1 ATGAAAAAAC TGTTATTGGC TGCCGTTGTT TCTCTGAGTG CCGCTGCCGC

   51 ATTTGCCGGC GACTCTGCCG AGCGTCAGAT TTACGGCGAT CCCCATTTTG

  101 AACAAAACCG CACAAAAGCT GTGAAAATGT TGGAGCAGCG CGGTTATCAG
```

-continued

```
151 GTTTACGATG TCGATGCCGA CGACCATTGG GGTAAGCCTG TGCTGGAAGT

201 GGAAGCCTAT AAAGACGGCC GCGAATACGA CATCGTGTTG TCTTACCCCG

251 ACCTGAAAAT CATCAAAGAG CAGCTCGATC GCTGA
```

This corresponds to the amino acid sequence <SEQ ID 2750; ORF 910>:

```
m910.pep
   1 MKKLLLAAVV SLSAAAAFAG DSAERQIYGD PHFEQNRTKA VKMLEQRGYQ

  51 VYDVDADDHW GKPVLEVEAY KDGREYDIVL SYPDLKIIKE
     QLDR*
```

Computer analysis of this amino acid sequence gave the following results:

Homology with a Predicted ORF from *N. gonorrhoeae*

ORF 910 shows 96.8% identity over a 94 aa overlap with a predicted ORF (ORF 910.ng) from *N. gonorrhoeae*:

```
g910/m910

                    10        20        30        40        50        60
g910.pep    MKKLLLAAVVSLNAATAFAGDSAERQIYGDPHFEQNRTKAVKMLEQRGYQVYDVDADDYM
            |||||||||||:||:|||||||||||||||||||||||||||||||||||||||||||:|
m910        MKKLLLAAVVSLSAAAAFAGDSAERQIYGDPHFEQNRTKAVKMLEQRGYQVYDVDADDHW
                    10        20        30        40        50        60

                    70        80        90
g910.pep    GKPVLEVEAYKDGREYDIVLSYPDLKIIKEQLDRX
            |||||||||||||||||||||||||||||||||||
m910        GKPVLEVEAYKDGREYDIVLSYPDLKIIKEQLDRX
                    70        80        90
```

The following partial DNA sequence was identified in *N. meningitidis* <SEQ ID 2751>:

```
a910.seq
   1 ATGAAAAAAC TGTTATTGGT CGCCGTTGTT TCCTTGAGTG CCGCAACCGC

  51 ATTTGCCGGC GACTCTGCCG AGCGTCAGAT TTACGGCGAT CCCTATTTTG

 101 AACAAAACCG CACAAAAGCC GTGAAAATGT TGGAACAGCG CGGTTATCAG

 151 GTTCACGATG TCGATGCCGA CGACCATTGG GGCAAACCTG TTTTGGAAGT

 201 GGAAGCCTAT AAAGACGGCC GCGAATACGA CATTGTGTTG TCTTACCCCG

 251 ACCTGAAAAT CATCAAAGAG CAGCTCGATC GCTGA
```

This corresponds to the amino acid sequence <SEQ ID 2752; ORF 910.a>:

```
a910.pep
   1 MKKLLLVAVV SLSAATAFAG DSAERQIYGD PYFEQNRTKA VKMLEQRGYQ

  51 VHDVDADDHW GKPVLEVEAY KDGREYDIVL SYPDLKIIKE QLDR*
```

m910/a910 95.7% identity in 94 aa overlap

```
                    10        20        30        40        50        60
m910.pep    MKKLLLAAVVSLSAAAAFAGDSAERQIYGDPHFEQNRTKAVKMLEQRGYQVYDVDADDHW
            ||||||:||||||||:|||||||||||||||:|||||||||||||||||||:||||||||
a910        MKKLLLVAVVSLSAATAFAGDSAERQIYGDPYFEQNRTKAVKMLEQRGYQVHDVDADDHW
                    10        20        30        40        50        60
```

-continued

```
                      70         80         90
m910.pep     GKPVLEVEAYKDGREYDIVLSYPDLKIIKEQLDRX
             |||||||||||||||||||||||||||||||||||
a910         GKPVLEVEAYKDGREYDIVLSYPDLKIIKEQLDRX
                      70         80         90
```

The following partial DNA sequence was identified in *N. gonorrhoeae* <SEQ ID 2753>:

```
g911.seq
   1 ATGAAAAAGA ACATATTGGA ATTTTGGGTC GGACTGTTCG TCTTGATCGG
  51 CGCGGCGGCG GTTGCCTTTC TCGCTTTCCG CGTGGCGGGC GGCGCGGCGT
 101 TCGGCGGTTC GGACAAAACT TACGCCGTTT ATGCCGATTT CGGCGACATC
 151 GGCGGTTTGA AGGTCAATGC CCCCGTCAAA TCCGCAGGCG TATTGGTCGG
 201 GCGCGTCGGC GCTATCGGGC TTGACCCGAA ATCCTATCAG GCGAGGGTGC
 251 GCCTTGATTT GGACGGCAAG TATCAGTTCA GCAGTGACGT TTCCGCGCAA
 301 ATCCTGACTT CGGGACTTTT GGGCGAACAG TACATCGGGC TGCAGCAGGG
 351 CGGCGATACG GAAAACCTTG CTGCCGGCGA CACCATCTCC GTAACCAGTT
 401 CTGCAATGGT TCTGGAAAAC CTGATCGGTA AATTCATGAC CAGCTTCGCC
 451 GAGAAAAACG CTGAGGGCGG CAATGCGGAA AAAGCCGcag aAtaa
```

This corresponds to the amino acid sequence <SEQ ID 2754; ORF 911.ng>:

```
g911.pep
   1 MKKNILEFWV GLFVLIGAAA VAFLAFRVAG GAAFGGSDKT YAVYADFGDI
  51 GGLKVNAPVK SAGVLVGRVG AIGLDPKSYQ ARVRLDLDGK YQFSSDVSAQ
 101 ILTSGLLGEQ YIGLQQGGDT ENLAAGDTIS VTSSAMVLEN LIGKFMTSFA
 151 EKNAEGGNAE KAAE*
```

The following partial DNA sequence was identified in *N. meningitidis* <SEQ ID 2755>:

```
m911.seq
   1 ATGAAGAAGA ACATATTGGA ATTTTGGGTC GGACTGTTCG TCCTGATTGG
  51 CGCGGCGGCG GTTGCCTTTC TCGCTTTCCG CGTGGCCGGC GGTGCGGCGT
 101 TCGGCGGTTC GGACAAAACT TACGCCGTTT ATGCCGATTT CGGCGACATC
 151 GGCGGTTTGA AGGTCAATGC CCCCGTCAAA TCCGCAGGCG TATTGGTCGG
 201 GCGCGTCGGC GCTATCGGAC TTGACCCGAA ATCCTATCAG GCGAGGGTGC
 251 GCCTCGATTT GGACGGCAAG TATCAGTTCA GCAGCGACGT TTCCGCGCAA
 301 ATCCTGACTT CGGGACTTTT GGGCGAGCAG TACATCGGGC TGCAGCAGGG
 351 CGGCGACACG GAAAACCTTG CTGCCGGCGA CACCATCTCC GTAACCAGTT
 401 CTGCAATGGT TCTGGAAAAC CTTATCGGCA AATTCATGAC GAGTTTTGCC
 451 GAGAAAAATG CCGACGGCGG CAATGCGGAA AAAGCCGCCG AATAA
```

This corresponds to the amino acid sequence <SEQ ID 2756; ORF 911>:

```
m911.pep
```

-continued

```
  1 MKKNILEFWV GLFVLIGAAA VAFLAFRVAG GAAFGGSDKT YAVYADFGDI

 51 GGLKVNAPVK SAGVLVGRVG AIGLDPKSYQ ARVRLDLDGK YQFSSDVSAQ

101 ILTSGLLGEQ YIGLQQGGDT ENLAAGDTIS VTSSAMVLEN LIGKFMTSFA

151 EKNADGGNAE KAAE*
```

Computer analysis of this amino acid sequence gave the following results:

Homology with a Predicted ORF from *N. gonorrhoeae*

ORF 911 shows 99.4% identity over a 164 aa overlap with a predicted ORF (ORF 911.ng) from *N. gonorrhoeae*:

```
g911/m911

                    10        20        30        40        50        60
g911.pep    MKKNILEFWVGLFVLIGAAAVAFLAFRVAGGAAFGGSDKTYAVYADFGDIGGLKVNAPVK
            ||||||||||||||||||||||||||||||||||||||||||||||||||||||||||||
m911        MKKNILEFWVGLFVLIGAAAVAFLAFRVAGGAAFGGSDKTYAVYADFGDIGGLKVNAPVK
                    10        20        30        40        50        60

                    70        80        90       100       110       120
g911.pep    SAGVLVGRVGAIGLDPKSYQARVRLDLDGKYQFSSDVSAQILTSGLLGEQYIGLQQGGDT
            ||||||||||||||||||||||||||||||||||||||||||||||||||||||||||||
m911        SAGVLVGRVGAIGLDPKSYQARVRLDLDGKYQFSSDVSAQILTSGLLGEQYIGLQQGGDT
                    70        80        90       100       110       120

                   130       140       150       160
g911.pep    ENLAAGDTISVTSSAMVLENLIGKFMTSFAEKNAEGGNAEKAAEX
            ||||||||||||||||||||||||||||||||||:||||||||||
m911        ENLAAGDTISVTSSAMVLENLIGKFMTSFAEKNADGGNAEKAAEX
                   130       140       150       160
```

The following partial DNA sequence was identified in *N. meningitidis* <SEQ ID 2757>:

```
a911.seq
  1 ATGAAAAAGA ACATATTGGA ATTTTGGGTC GGACTGTTCG TCCTGATTGG

 51 CGCGGCGGCG GTTGCCTTTC TCGCTTTCCG CGTGGCCGGC GGTGCGGCGT

101 TCGGCGGTTC GGACAAAACT TACGCCGTTT ATGCCGATTT CGGCGACATC

151 GGCGGTTTGA AGGTCAATGC CCCCGTCAAA TCCGCAGGCG TATTGGTCGG

201 GCGCGTCGGC GCTATCGGAC TTGACCCGAA ATCCTATCAG GCGAGGGTGC

251 GCCTCGATTT GGACGGCAAG TATCAGTTCA GCAGCGACGT TTCCGCGCAA

301 ATCCTGACTT CGGGACTTTT GGGCGAGCAG TACATCGGGC TGCAGCAGGG

351 CGGCGACACG GAAAACCTTG CTGCCGGCGA CACCATCTCC GTAACCAGTT

401 CTGCAATGGT TCTGGAAAAC CTTATCGGCA AATTCATGAC GAGTTTTGCC

451 GAGAAAAATG CCGACGGCGG CAATGCGGAA AAAGCCGCCG AATAA
```

This corresponds to the amino acid sequence <SEQ ID 2758; ORF 911.a>:

```
a911.pep
  1 MKKNILEFWV GLFVLIGAAA VAFLAFRVAG GAAFGGSDKT YAVYADFGDI

 51 GGLKVNAPVK SAGVLVGRVG AIGLDPKSYQ ARVRLDLDGK YQFSSDVSAQ

101 ILTSGLLGEQ YIGLQQGGDT ENLAAGDTIS VTSSAMVLEN LIGKFMTSFA

151 EKNADGGNAE KAAE*
```

m911/a911 100.0% identity in 164 aa overlap

```
                   10         20         30         40         50         60
m911.pep   MKKNILEFWVGLFVLIGAAAVAFLAFRVAGGAAFGGSDKTYAVYADFGDIGGLKVNAPVK
           ||||||||||||||||||||||||||||||||||||||||||||||||||||||||||||
a911       MKKNILEFWVGLFVLIGAAAVAFLAFRVAGGAAFGGSDKTYAVYADFGDIGGLKVNAPVK
                   10         20         30         40         50         60

                   70         80         90        100        110        120
m911.pep   SAGVLVGRVGAIGLDPKSYQARVRLDLDGKYQFSSDVSAQILTSGLLGEQYIGLQQGGDT
           ||||||||||||||||||||||||||||||||||||||||||||||||||||||||||||
a911       SAGVLVGRVGAIGLDPKSYQARVRLDLDGKYQFSSDVSAQILTSGLLGEQYIGLQQGGDT
                   70         80         90        100        110        120

                  130        140        150        160
m911.pep   ENLAAGDTISVTSSAMVLENLIGKFMTSFAEKNADGGNAEKAAEX
           |||||||||||||||||||||||||||||||||||||||||||||
a911       ENLAAGDTISVTSSAMVLENLIGKFMTSFAEKNADGGNAEKAAEX
                  130        140        150        160
```

The following partial DNA sequence was identified in *N. gonorrhoeae* <SEQ ID 2759>:

```
g912.seq
   1 gtgAAAAaat cctcctTcat cagcGCATTG GGCATCGgtA TTTTGAGCAT

  51 CGGCATGGCA TTTGCCTCCC CGGCCGACGC AGTGGGACAA ATCCGCCAAA

 101 ACGCCACACA GGTTTTGACC ATCCTCAAAA GCGGCGACGC GGCTTCTGCA

 151 CGCCCAAAAG CCGAAGCCTA TGCGGTTCCC TATTTCGATT TCCAACGTAT

 201 GACCGCATTG GCGGTCGGCA ACCCTTGGCG TACCGCGTCC GACGCGCAAA

 251 AACAAGCGTT GGCCAAAGAA TTTCAAACCC TGCTGATCCG CACCTATTCC

 301 GGCACGATGC TGAAATTCAA AAACGCGACC GTCAACGTCA AGACAATCC

 351 CATCGTCAAT AAGGGCGGCA AGGAAATCGT CGTCCGTGCC GAAGTCGGCA

 401 TCCCCGGTCA GAAGCCCGTC AATATGGACT TTACCACCTA CCAAAGCGGC

 451 GGCAAATACC GTACCTACAA CGTCGCCATC GAAGGCACGA GCCTGGTTAC

 501 CGTGTACCGC AACCAATTCG GCGAAATCAT CAAAGCCAAA GGCATCGACG

 551 GGCTGATTGC CGAGTTGAAA GCCAAAAACG GCGGCAAATA A
```

This corresponds to the amino acid sequence <SEQ ID 2760; ORF 912.ng>:

```
g912.pep
   1 VKKSSFISAL GIGILSIGMA FASPADAVGQ IRQNATQVLT ILKSGDAASA

  51 RPKAEAYAVP YFDFQRMTAL AVGNPWRTAS DAQKQALAKE FQTLLIRTYS

 101 GTMLKFKNAT VNVKDNPIVN KGGKEIVVRA EVGIPGQKPV NMDFTTYQSG

 151 GKYRTYNVAI EGTSLVTVYR NQFGEIIKAK GIDGLIAELK AKNGGK*
```

The following partial DNA sequence was identified in *N. meningitidis* <SEQ ID 2761>:

```
m912.seq
   1 ATGAAAAAAT CCTCCCTCAT CAGCGCATTG GGCATCGGTA TTTTGAGCAT

  51 CGGCATGGCA TTTGCCGCCC CTGCCGACGC GGTAAGCCAA ATCCGTCAAA

 101 ACGCCACTCA AGTATTGAGC ATCTTAAAAA ACGGCGATGC CAACACCGCT

 151 CGCCAAAAAG CCGAAGCCTA TGCGATTCCC TATTTCGATT TCCAACGTAT

 201 GACCGCATTG GCGGTCGGCA ACCCTTGGCG CACCGCGTCC GACGCGCAAA

 251 AACAAGCGTT GGCCAAAGAA TTTCAAACCC TGCTGATCCG CACCTATTCC
```

-continued

```
301 GGCACGATGC TGAAATTAAA AAACGCCAAC GTCAACGTCA AAGACAATCC

351 CATCGTCAAT AAAGGCGGCA AAGAAATCAT CGTCCGCGCC GAAGTCGGCG

401 TACCCGGGCA AAAACCCGTC AACATGGACT TCACCACCTA CCAAAGCGGC

451 GGTAAATACC GTACCTACAA CGTCGCCATC GAAGGCGCGA GCCTGGTTAC

501 CGTGTACCGC AACCAATTCG GCGAAATTAT CAAAGCGAAA GGCGTGGACG

551 GACTGATTGC CGAGTTGAAA GCCAAAAACG GCGGCAAATA A
```

This corresponds to the amino acid sequence <SEQ ID 2762; ORF 912>:

```
m912.pep
  1 MKKSSLISAL GIGILSIGMA FAAPADAVSQ IRQNATQVLS ILKNGDANTA

 51 RQKAEAYAIP YFDFQRMTAL AVGNPWRTAS DAQKQALAKE FQTLLIRTYS

101 GTMLKLKNAN VNVKDNPIVN KGGKEIIVRA EVGVPGQKPV NMDFTTYQSG

151 GKYRTYNVAI EGASLVTVYR NQFGEIIKAK GVDGLIAELK AKNGGK*
```

Computer analysis of this amino acid sequence gave the following results:

Homology with a Predicted ORF from *N. gonorrhoeae*

ORF 912 shows 91.8% identity over a 196 aa overlap with a predicted ORF (ORF 912.ng) from *N. gonorrhoeae*:

```
g912/m912

                   10        20        30        40        50        60
g912.pep    VKKSSFISALGIGILSIGMAFASPADAVGQIRQNATQVLTIKLSGDAASARPKAEAYAVP
            :||||:||||||||||||||||:|||||:||||||||||:|  :|||  :||  ||||||:|
m912        MKKSSLISALGIGILSIGMAFAAPADAVSQIRQNATQVLSILKNGDANTARQKAEAYAIP
                   10        20        30        40        50        60

                   70        80        90       100       110       120
g912.pep    YFDFQRMTALAVGNPWRTASDAQKQALAKEFQTLLIRTYSGTMLKFKNATVNVKDNPIVN
            |||||||||||||||||||||||||||||||||||||||||||||:|||:||||||||||
m912        YFDFQRMTALAVGNPWRTASDAQKQALAKEFQTLLIRTYSGTMLKLKNANVNVKDNPIVN
                   70        80        90       100       110       120

                  130       140       150       160       170       180
g912.pep    KGGKEIVVRAEVGIPGQKPVNMDFTTYQSGGKYRTYNVAIEGTSLVTVYRNQFGEIIKAK
            ||||||:||||||:||||||||||||||||||||||||||||:|||||||||||||||||
m912        KGGKEIIVRAEVGVPGQKPVNMDFTTYQSGGKYRTYNVAIEGASLVTVYRNQFGEIIKAK
                  130       140       150       160       170      180

                  190
g912.pep    GIDGLIAELKAKNGGKX
            |:|||||||||||||||
m912        GVDGLIAELKAKNGGKX
                  190
```

The following partial DNA sequence was identified in *N. meningitidis* <SEQ ID 2763>:

```
a912.seq
  1 ATGAAAAAAT CCTCCTTCAT CAGCGCATTG GGCATCGGTA TTTTGAGCAT

 51 CGGCATGGCA TTTGCCGCCC CTGCCGACGC GGTAAACCAA ATCCGTCAAA

101 ACGCCACTCA AGTATTGAGC ATCTTAAAAA GCGGTGATGC CAACACCGCC

151 CGCCAAAAAG CCGAAGCCTA TGCGATTCCC TATTTCGATT TCCAACGTAT

201 GACCGCATTG GCGGTCGGCA ACCCTTGGCG CACCGCGTCC GACGCGCAAA

251 AACAAGCGTT GGCCAAAGAA TTTCAAACCC TGCTGATCCG CACCTATTCC

301 GGCACGATGC TGAAATTAAA AAACGCCAAC GTCAACGTCA AAGACAATCC

351 CATCGTCAAT AAAGGCGGCA AAGAAATCAT CGTCCGCGCC GAAGTCGGCG
```

-continued

```
401 TACCCGGGCA AAAACCCGTC AACATGGACT TCACCACCTA CCAAAGCGGC

451 GGTAAATACC GTACCTACAA CGTCGCCATC GAAGGCGCGA GCCTGGTTAC

501 CGTGTACCGC AACCAATTCG GCGAAATTAT CAAAGCGAAA GGCGTGGACG

551 GACTGATTGC CGAGTTGAAG GCTAAAAACG GCAGCAAGTA A
```

This corresponds to the amino acid sequence <SEQ ID 2764; ORF 912.a>:

```
a912.pep
   1 MKKSSFISAL GIGILSIGMA FAAPADAVNQ IRQNATQVLS ILKSGDANTA

  51 RQKAEAYAIP YFDFQRMTAL AVGNPWRTAS DAQKQALAKE FQTLLIRTYS

 101 GTMLKLKNAN VNVKDNPIVN KGGKEIIVRA EVGVPGQKPV NMDFTTYQSG

 151 GKYRTYNVAI EGASLVTVYR NQFGEIIKAK GVDGLIAELK AKNGSK*
```

20 m912/a912 98.0% identity in 196 aa overlap

```
                 10        20        30        40        50        60
m912.pep  MKKSSLISALGIGILSIGMAFAAPADAVSQIRQNATQVLSILKNGTANTARQKAEAYAIP
          |||||:|||||||||||||||||||||||:||||||||||||||:|||||||||||||||
a912      MKKSSFISALGIGILSIGMAFAAPADAVNQIRQNATQVLSILKSGDANTARQKAEAYAIP
                 10        20        30        40        50        60

70        80        90        100       110       120
m912.pep  YFDFQRMTALAVGNPWRTASDAQKQALAKEFQTLLIRTYSGTMLKLKNANVNVKDNPIVN
          ||||||||||||||||||||||||||||||||||||||||||||||||||||||||||||
a912      YFDFQRMTALAVGNPWRTASDAQKQALAKEFQTLLIRTYSGTMLKLKNANVNVKDNPIVN
                 70        80        90        100       110       120

130       140       150       160       170       180
m912.pep  KGGKEIIVRAEVGVPGQKPVNMDFTTYQSGGKYRTYNVAIEGASLVTVYRNQFGEIIKAK
          ||||||||||||||||||||||||||||||||||||||||||||||||||||||||||||
a912      KGGKEIIVRAEVGVPGQKPVNMDFTTYQSGGKYRTYNVAIEGASLVTVYRNQFGEIIKAK
                 130       140       150       160       171       180

190
m912.pep  GVDGLIAELKAKNGGKX
          ||||||||||||||:||
a912      GVDGLIAELKAKNGSKX
                 190
```

The following partial DNA sequence was identified in *N. gonorrhoeae* <SEQ ID 2765>:

```
g913.seq
   1 atGAAAAAAA CCGCCTACGC CATCCTCCTG CTGATCGGGT TCGCTTCCGC

  51 CCCTGCATTT GCAGAAACCC GCCCCGCCGA CCCTTATGAA GGCTACAACC

 101 GCGCCGTTTC CAAATTCAAC GACCAAGCCG ACCGCTACAT TTTCGCCCCT

 151 GCCGCGCGCG GCTACCGCAA AGTTACGCCG AAACCCGTCC GCGCCGGCGT

 201 GTCCAATTTT TTTAACAACC TGCGCGACGT GGTCAGTTTC GGCAGCAATA

 251 TCTTGCGTTT GGAcatCAAA cgcgcAAGcg aAGACCtcgT CCGcgtcggc

 301 atCAATACCA CCTTCGGTTT GGgcgGGCTC ATTGATATTG CCGGcgcGGg

 351 cggcgttccc gacaataaaa AcacTttgGg cgacacgttt gcctcgtGGG

 401 GctgGAAAaa cagcaATTAT TTCGTgttgc CCGtcttagg cccgtccacc

 451 gtccgcgacg cgctcggcac gggcattacc tCTGTTTATC CGCccaagaa

 501 tatcgttttc catacccctg ccggacgctg GGgcacgact gCCGCTGCCG

 551 CCGTcagtac gcgcgaaggc ctcctcgatt tgaccgacag TCtggacgaa
```

-continued

```
601 gccgccatCG ACAAATACAG CTACACGCGc gacctctata tgAAAGTCCG

651 CGcacgGCag AccgGTGCAA CACCTGCCGA AGgtacggaa gataacatcg

701 acatcgacat cgACGAATTG GTCGAAAGTG CCGAAACCGG CGCGGCAGAG

751 CCCGCCGTTC ACGAAGATTC CGTATCCGAA ACACAGGCAG AAGCAGCAGG

801 GGAAGCCGAA ACGCAACCTG GAACACAACC CTAA
```

This corresponds to the amino acid sequence <SEQ ID 2766; ORF 913.ng>:

```
g913.pep
   1 MKKTAYAILL LIGFASAPAF AETRPADPYE GYNRAVSKFN DQADRYIFAP

  51 AARGYRKVTP KPVRAGVSNF FNNLRDVVSF GSNILRLDIK RASEDLVRVG

 101 INTTFGLGGL IDIAGAGGVP DNKNTLGDTF ASWGWKNSNY FVLPVLGPST

 151 VRDALGTGIT SVYPPKNIVF HTPAGRWGTT AAAAVSTREG LLDLTDSLDE

 201 AAIDKYSYTR DLYMKVRARQ TGATPAEGTE DNIDIDIDEL VESAETGAAE

 251 PAVHEDSVSE TQAEAAGEAE TQPGTQP*
```

The following partial DNA sequence was identified in *N. meningitidis* <SEQ ID 2767>:

```
m913.seq
   1 ATGAAAAAAA CCGCCTATGC CTTCCTCCTG CTGATCGGGT TCGCTTCCGC

  51 CCCTGCATTT GCCGAAACCC GCCCCGCCGA CCCTTATGAA GGCTACAACC

 101 GCGCCGTTTT CAAATTCAAC GACCAAGCCG ACCGCTACAT TTTCGCCCCT

 151 GCCGCGCGCG GCTACCGCAA AGTTGCGCCG AAACCCGTCC GCGCCGGCGT

 201 GTCCAATTTT TTTAACAACC TGTGCGACGT GGTCAGCTTC GGCAGCAATA

 251 TCTTGCGCTT GGACATCAAA CGCGCAAGCG AAGACCTTGT CCGCGTCGGC

 301 ATCAACACCA CTTTCGGTTT GGGCGGGCTT ATCGACATCG CCGGCGCGGG

 351 CGGCATTCCC GACAATAAAA ACACCTTGGG CGACACGTTT GCCTCGTGGG

 401 GATGGAAAAA CAGCAATTAT TTCGTGTTGC CCGTCTTAGG GCCGTCCACC

 451 GTCCGCGACG CGCTCGGCAC GGGTATTACC TCCGTTTATT CGCCCAAGAA

 501 TATCGTCTTC CGCACCCCTG TCGGACGCTG GGGCACGACT GCCGTATCCG

 551 CCGTCAGTAC GCGCGAAGGC CTgCTCGATT TGACCGACAG TCTGGACGAA

 601 GCCGCCATCG ACAAATACAG CTACACGCGC GACCTCTATA TGAAAGTCCG

 651 TGCGCGGCAG ACCGGTGCAA CACCTGCCGA AGgTACGGAA GATAACATCG

 701 ACATCGACGA ATTGGTCGAA AGTGCCGAAA CCGGCGCGGC GGAAACTGCC

 751 GTTCAAGAAG ATTCCGTATC CGAAACACAG GCAGAAGCAG CAGGGGAAGC

 801 CGAAACGCAA CCTGGAACAC AACCTTAA
```

This corresponds to the amino acid sequence <SEQ ID 2768; ORF 913>:

```
m913.pep
   1 MKKTAYAFLL LIGFASAPAF AETRPADPYE GYNRAVFKFN DQADRYIFAP

  51 AARGYRKVAP KPVRAGVSNF FNNLCDVVSF GSNILRLDIK RASEDLVRVG

 101 INTTFGLGGL IDIAGAGGIP DNKNTLGDTF ASWGWKNSNY FVLPVLGPST
```

-continued

```
151 VRDALGTGIT SVYSPKNIVF RTPVGRWGTT AVSAVSTREG LLDLTDSLDE

201 AAIDKYSYTR DLYMKVRARQ TGATPAEGTE DNIDIDELVE SAETGAAETA

251 VQEDSVSETQ AEAAGEAETQ PGTQP*
```

Computer analysis of this amino acid sequence gave the following results:

Homology with a Predicted ORF from *N. gonorrhoeae*

ORF 913 shows 94.9% identity over a 277 aa overlap with a predicted ORF (ORF 913.ng) from *N. gonorrhoeae*:

```
g913/m913

                    10        20        30        40        50        60
g913.pep    MKKTAYAILLLIGFASAPAFAETRPADPYEGYNRAVSKFNDQADRYIFAPAARGYRKVTP
            |||||||:|||||||||||||||||||||||||||| |||||||||||||||||||||:|
m913        MKKTAYAFLLLIGFASAPAFAETRPADPYEGYNRAVFKFNDQADRYIFAPAARGYRKVAP
                    10        20        30        40        50        60

                    70        80        90       100       110       120
g913.pep    KPVRAGVSNFFNNLRDVVSFGSNILRLDIKRASEDLVRVGINTTFGLGGLIDIAGAGGVP
            |||||||||||||| |||||||||||||||||||||||||||||||||||||||||||:|
m913        KPVRAGVSNFFNNLCDVVSFGSNILRIDIKRASEDLVRVGINTTFGLGGLIDIAGAGGIP
                    70        80        90       100       110       120

                   130       140       150       160       170       180
g913.pep    DNKNTLGDTFASWGWKNSNYFVLPVLGPSTVRDALGTGITSVYPPKNIVFHTPAGRWGTT
            |||||||||||||||||||||||||||||||||||||||||||| ||||||:||:||||||
m913        DNKNTLGDTFASWGWKNSNYFVLPVLGPSTVRDALGTGITSVYSPKNIVFRTPVGRWGTT
                   130       140       150       160       170       180

                   190       200       210       220       230       240
g913.pep    AAAAVSTREGLLDLTDSLDEAAIDKYSYTRDLYMKVRARQTGATPAEGTEDNIDIDIDEL
            |::|||||||||||||||||||||||||||||||||||||||||||||||||||||  |||
m913        AVSAVSTREGLLDLTDSLDEAAIDKYSYTRDLYMKVRARQTGATPAEGTEDNIDI--DEL
                   190       200       210       220       230

                   250       260       270
g913.pep    VESAETGAAEPAVHEDSVSETQAEAAGEAETQPGTQPX
            |||||||||| ||:||||||||||||||||||||||||
m913        VESAETGAAETAVQEDSVSETQAEAAGEAETQPGTQPX
          240       250       260       270
```

The following partial DNA sequence was identified in *N. meningitidis* <SEQ ID 2769>:

```
a913.seq
  1 ATGAAAAAAA CCGCCTATGC CTTCCTCCTG CTGATCGGGT TCGCTTCCGC

 51 CCCTGCATTT GCCGAAACCC GCCCCGCCGA CCCTTATGAA GGCTACAACC

101 GCGCCGTTTT CAAATTCAAC GACCAAGCCG ACCGCTACAT TTTCGCCCCT

151 GCCGCGCGCG GCTACCGCAA AGTTGCGCCG AAACCCGTCC GCGCCGGCGT

201 GTCCAATTTT TTTAACAACC TGTGCGACGT GGTCAGCTTC GGCAGCAATA

251 TCTTGCGCTT AGACATCAAA CGCGCAAGCG AAGACCTTGT CCGCGTCGGT

301 ATCAACACCA CTTTCGGTTT GGGCGGGCTT ATCGACATCG CCGGCGCGGG

351 CGGCATTCCC GACAATAAAA ACACCTTGGG CGACACGTTT GCTTCGTGGG

401 GATGGAAAAA CAGCAATTAT TTCGTGTTGC CCGTCTTAGG GCCGTCCACC

451 GTCCGCGACG CGCTCGGCAC GGGTATTACC TCCGTTTATT CGCCCAAGAA

501 TATCGTCTTC CGCACCCCTG TCGGACGCTG GGGCACGACT GCCGTATCCG

551 CCGTCAGTAC GCGCGAAGGC CTGCTCGATT TGACCGACAG TCTGGACGAA

601 GCCGCCATCG ACAAATACAG CTACACGCGC GACCTCTATA TGAAAGTCCG

651 TGCGCGGCAG ACCGGTGCAA CACCTGCCGA AGGTACGGAA GATAACATCG

701 ACATCGACGA ATTGGTCGAA AGTGCCGAAA CCGGCGCGGC GGAAACTGCC
```

-continued

```
751 GTTCAAGAAG ATTCCGTATC CGAAACACAG GCAGAAGCAG CAGGGGAAGC

801 CGAAACGCAA CCTGGAACAC AACCTGGAAC ACAACCTTAA
```

This corresponds to the amino acid sequence <SEQ ID 2770; ORF 913.a>:

```
a913.pep
   1 MKKTAYAFLL LIGFASAPAF AETRPADPYE GYNRAVFKFN DQADRYIFAP

  51 AARGYRKVAP KPVRAGVSNF FNNLCDVVSF GSNILRLDIK RASEDLVRVG

 101 INTTFGLGGL IDIAGAGGIP DNKNTLGDTF ASWGWKNSNY FVLPVLGPST

 151 VRDALGTGIT SVYSPKNIVF RTPVGRWGTT AVSAVSTREG LLDLTDSLDE

 201 AAIDKYSYTR DLYMKVRARQ TGATPAEGTE DNIDIDELVE SAETGAAETA

 251 VQEDSVSETQ AEAAGEAETQ PGTQPGTQP*
```

m913/a913 100.0% identity in 275 aa overlap

```
                    10        20        30        40        50        60
m913.pep    MKKTAYAFLLLIGFASAPAFAETRPADPYEGYNRAVFKFNDQADRYIFAPAARGYRKVTP
            ||||||||||||||||||||||||||||||||||||||||||||||||||||||||||||
a913        MKKTAYAFLLLIGFASAPAFAETRPADPYEGYNRAVFKFNDQADRYIFAPAARGYRKVAP
                    10        20        30        40        50        60

                    70        80        90       100       110       120
m913.pep    KPVRAGVSNFFNNLCDVVSFGSNILRLDIKRASEDLVRVGINTTFGLGGLIDIAGAGGIP
            ||||||||||||||||||||||||||||||||||||||||||||||||||||||||||||
a913        KPVRAGVSNFFNNLCDVVSFGSNILRIDIKRASEDLVRVGINTTFGLGGLIDIAGAGGIP
                    70        80        90       100       110       120

                   130       140       150       160       170       180
m913.pep    DNKNTLGDTFASWGWKNSNYFVLPVLGPSTVRDALGTGITSVYSPKNIVFRTPVGRWGTT
            ||||||||||||||||||||||||||||||||||||||||||||||||||||||||||||
a913        DNKNTLGDTFASWGWKNSNYFVLPVLGPSTVRDALGTGITSVYSPKNIVFRTPVGRWGTT
                   130       140       150       160       170       180

                   190       200       210       220       230       240
m913.pep    AVSAVSTREGLLDLTDSLDEAAIDKYSYTRDLYMKVRARQTGATPAEGTEDNIDIDELVE
            ||||||||||||||||||||||||||||||||||||||||||||||||||||||||||||
a913        AVSAVSTREGLLDLTDSLDEAAIDKYSYTRDLYMKVRARQTGATPAEGTEDNIDIDELVE
                   190       200       210       220       230       240

                   250       260       270
g913.pep    SAETGAAETAVQEDSVSETQAEAAGEAETQPGTQPX
            ||||||||||||||||||||||||||||||||||||
m913        SAETGAAETAVQEDSVSETQAEAAGEAETQPGTQPGTQPX
                   250       260       270       280
```

The following partial DNA sequence was identified in *N. gonorrhoeae* <SEQ ID 2771>:

```
g914.seq
   1 ATGAAAAAAT GTATTTTGGG CATTTTGACC GCGTGTGCCG CCATGCCTGC

  51 ATTTGCCGAC AGAATCAGCG ATTTGGAAGC ACGTCTGGCG CAGTTGGAAC

 101 ACCGTGTCGC CGTATTGGAA AGCGGCGGCA ATACCGTCAA AATCGACCTT

 151 TTCGGTTCAA ATTCCACCAT GTATGTATGC AGCGTTACGC CTTTTCAGAA

 201 GacgtttGag gCAAGCGATC GGAATGAAGG CGTGGCGCGG CAGAAAGTGC

 251 GTCAGGCGTG CAACCGCGAA ACTTCGGCAA TGTTTTGCGG AGATGAGGCA

 301 ATCCGATGCA GAAAATTCGA TTGATGTATC GGTTGGACGG ATAAAGAAAC

 351 GGATACGGAG CTTGGCTTCC GTCTCTGTTT TTCTCTGCCC GATTTTCCAT

 401 GCATCGGGTT TCAGACGGCA TTGGAGTGTC AGTCGTGTTC TGCCGATTCG

 451 taggctTCGA CGATTTTTTG CACCAGAGGA TGCCGGACAA CGTCTTCGCC

 501 GGTGAAGGTA TGGAAATACA GTCCTGCCAC GCCGTGCAGT TTCTCACGTG
```

-continued

```
551 CGTCTTTCAA TCCCGATTTG ATGTTTTTGG GCAGGTcgaT TTGGCTGGTG

601 TCGCCGGTAA TGACGGCTTT CGCgccgaag ccGATGCGGG TCAGGAACAT

651 TTTCATTTGT TCGGGCGTGg tgTtttGcgC TTCGTCGAGG ATGATGTATG

701 CGCCGTTGAg cgTCCTGCCG CGCATATAG
```

This corresponds to the amino acid sequence <SEQ ID 2772; ORF 914.ng>:

```
g914.pep
   1 MKKCILGILT ACAAMPAFAD RISDLEARLA QLEHRVAVLE SGGNTVKIDL

  51 FGSNSTMYVC SVTPFQKTFE ASDRNEGVAR QKVRQACNRE TSAMFCGDEA

 101 IRCRKFD*CI GWTDKETDTE LGFRLCFSLP DFPCIGFQTA LECQSCSADS

 151 *ASTIFCTRG CRTTSSPVKV WKYSPATPCS FSRASFNPDL MFLGRSIWLV

 201 SPVMTAFAPK PMRVRNIFIC SGVVFCASSR MMYAPLSVLP
     RI*
```

The following partial DNA sequence was identified in *N. meningitidis* <SEQ ID 2773>:

```
m914.seq
   1 ATGAAAAAAT GTATTTTGGG CATTTTGACC GCGTGTGCCG CCATGCCTGC

  51 ATTTGCCGAC AGAATCGGCG ATTTGGAAGC ACGTCTGGCG CAGTTGGAAC

 101 ACCGTGTCGC CGTATTGGAA AGCGGCGGCA ATACCGTCAA AATCGACCTT

 151 TTCGGTTCAA ATTCCACCAT GTATGTATGC AGCGTTACGC CTTTTCAGAA

 201 GACGTTTGAG GCAAGCGATC GGAATGAAGG CGTGGCGCGG CAGAAAGTGC

 251 GTCAGGCGTG CAACCGCGAA ACTTCGGCAA TGTTTTGCGA AGATGAGGCA

 301 ATCCGATGCA GAAAATTCGA TTGATGTATC GGTTGGACGG ATAAAGAAAC

 351 GGATACGGAT ACGGAGCTTG GCTTCCGTAT CTGTTTTTCT CTGCCTGATT

 401 TTCCATGCAT CGGGTTTCAG ACGGCATTGG AATGTCAGTC GTGTTCTGCC

 451 GATTCGTAGG CTTCGACGAT TTTTTGCACC AAAGGATGCC GGACAACGTC

 501 TTCGCCGGTA AAGGTGTGGA AATACAGCCC TTCCACGTTG TGCAGTTTCT

 551 CACGCGCATC TTTTAATCCC GATTTGATGT TTTTGGGCAG GTCGATTTGG

 601 CTGGTGTCGC CGGTAATGAC GGCTTTCGCG CCGAAGCCGA TGCGGGTCAG

 651 GAACATTTTC ATTTGTTCGG GCGTGGTGTT TTGCGCTTCG TCGAGGATGA

 701 TGTATGCGCC GTTGAGCGTC CTGCCGCGCA TATAG
```

This corresponds to the amino acid sequence <SEQ ID 2774; ORF 914>:

```
m914.pep
   1 MKKCILGILT ACAAMPAFAD RIGDLEARLA QLEHRVAVLE SGGNTVKIDL

  51 FGSNSTMYVC SVTPFQKTFE ASDRNEGVAR QKVRQACNRE TSAMFCEDEA

 101 IRCRKFDXCI GWTDKETDTD TELGFRICFS LPDFPCIGFQ TALECQSCSA

 151 DSXASTIFCT KGCRTTSSPV KVWKYSPSTL CSFSRASFNP DLMFLGRSIW

 201 LVSPVMTAFA PKPMRVRNIF ICSGVVFCAS SRMMYAPLSV
     LPRI*
```

Computer analysis of this amino acid sequence gave the following results:

Homology with a Predicted ORF from *N. gonorrhoeae*

ORF 914 shows 96.7% identity over a 244 aa overlap with a predicted ORF (ORF 914.ng) from *N. gonorrhoeae*:

```
g914/m914

                   10        20        30        40        50        60
g914.pep    MKKCILGILTACAAMPAFADRISDLEARLAQLEHRVAVLESGGNTVKIDLFGSNSTMYVC
            |||||||||||||||||||||:||||||||||||||||||||||||||||||||||||||
m914        MKKCILGILTACAAMPAFADRIGDLEARLAQLEHRVAVLESGGNTVKIDLFGSNSTMYVC
                   10        20        30        40        50        60

                   70        80        90       100       110      119
g914.pep    SVTPFQKTFEASDRNEGVARQKVRQACNRETSAMFCGDEAIRCRKFDXCIGWTDKETDT-
            |||||||||||||||||||||||||||||||||| |||||||||||||||||||||||| 
m914        SVTPFQKTFEASDRNEGVARQKVRQACNRETSAMFCEDEAIRCRKFDXCIGWTDKETDTD
                   70        80        90       100       110       120

           120       130       140       150       160       170
g914.pep    -ELGFRLCFSLPDFPCIGFQTALECQSCSADSXASTIFCTRGCRTTSSPVKVWKYSPATP
             |||||:|||||||||||||||||||||||||||||||||:||||||||||||||||:| 
m914        TELGFRICFSLPDFPCIGFQTALECQSCSADSXASTIFCTKGCRTTSSPVKVWKYSPSTL
                  130       140       150       160       170       180

           180       190       200       210       220       230
g914.pep    CSFSRASFNPDLMFLGRSIWLVSPVMTAFAPKPMRVRNIFICSGVVFCASSRMMYAPLSV
            ||||||||||||||||||||||||||||||||||||||||||||||||||||||||||||
m914        CSFSRASFNPDLMFLGRSIWLVSPVMTAFAPKPMRVRNIFICSGVVFCASSRMMYAPLSV
                  190       200       210       220       230       240

           240
g914.pep    LPRIX
            |||||
m914        LPRIX
```

The following partial DNA sequence was identified in *N. meningitidis* <SEQ ID 2775>:

```
a914.seq
   1 ATGAAAAAAT GTATTTTGGG CATTTTGACC GCGTGTGCCG CCATGCCTGC

  51 ATTTGCCGAC AGAATCGGCG ATTTGGAAGC ACGTCTGGCG CAGTTGGAAC

 101 ACCGTGTCGC CGTATTGGAA AGCGGCAGCA ATACCGTCAA AATCGACCTT

 151 TTCGGTTCAA ATTCCACCAT GTATGTATGC AGCGTTACGC CTTTTCAGAA

 201 GACGTTTGAG GCAAGCGATC GGAATGAAGG CGTGGCGCGG CAGAAAGTGC

 251 GTCAGGCGTG CAACCGCGAA ACTTCGGCAA TGTTTTGCGA AGATGAGGCA

 301 ATCCGATGCA GAAAATTCGA TTGATGTATC GGTTGGACGG ATAAAGAAAC

 351 GGATACGGAG CTTGGCTTCC GTATCTGTTT TTCTCTGCCC GATTTTCCAT

 401 GCATCGGGTT TCAGACGGCA TTGGAATGTC AGTCGTGTTC TGCCGATTCG

 451 TAGGCTTCGA CGATTTTTTG CACCAAAGGA TGCCGGACAA CGTCTTCGCC

 501 GGTAAAGGTG TGGAAATACA GCCCTTCCAC GCCGTGCAGT TTCTCACGCG

 551 CATCTTTTAA TCCCGATTTG ATGTTTTTGG GCAGGTCGAT TTGGCTGGTG

 601 TCGCCGGTAA TGACGGCTTT CGCGCCGAAG CCGATGCGGG TCAGGAACAT

 651 TTTCATTTGT TCGGGCGTGG TGTTTTGCGC TTCGTCGAGG ATGATGTATG

 701 CGCCGTTGAG CGTCCTGCCG CGCATATAG
```

This corresponds to the amino acid sequence <SEQ ID 2776; ORF 914.a>:

```
a914.pep
   1 MKKCILGILT ACAAMPAFAD RIGDLEARLA QLEHRVAVLE SGSNTVKIDL

  51 FGSNSTMYVC SVTPFQKTFE ASDRNEGVAR QKVRQACNRE TSAMFCEDEA
```

```
-continued
101 IRCRKFD*CI GWTDKETDTE LGFRICFSLP DFPCIGFQTA LECQSCSADS

151 *ASTIFCTKG CRTTSSPVKV WKYSPSTPCS FSRASFNPDL MFLGRSIWLV

201 SPVMTAFAPK PMRVRNIFIC SGVVFCASSR MMYAPLSVLP
    RI*
```

m914/a914 98.4% identity in 244 aa overlap

```
                  10         20         30         40         50         60
m914.pep   MKKCILGILTACAAMPAFADRIGDLEARLAQLEHRVAVLESGGNTVKIDLFGSNSTMYVC
           ||||||||||||||||||||||||||||||||||||||||:|||||||||||||||||||
a914       MKKCILGILTACAAMPAFADRIGDLEARLAQLEHRVAVLESGSNTVKIDLFGSNSTMYVC
                  10         20         30         40         50         60

                  70         80         90        100        110        120
m914.pep   SVTPFQKTFEASDRNEGVARQKVRQACNRETSAMFCEDEAIRCRKFDXCIGWTDKETDTD
           ||||||||||||||||||||||||||||||||||||||||||||||||||||||||
a914       SVTPFQKTFEASDRNEGVARQKVRQACNRETSAMFCEDEAIRCRKFDXCIGWTDKETD--
                  70         80         90        100        110

                 130        140        150        160        170        180
m914.pep   TELGFRLCFSLPDFPCIGFQTALECQSCSADSXASTIFCTRGCRTTSSPVKVWKYSPATL
           |||||| |||||||||||||||||||||||||||||||| ||||||||||||||||||
a914       TELGFRICFSLPDFPCIGFQTALECQSCSADSXASTIFCTKGCRTTSSPVKVWKYSPSTP
              120        130        140        150        160        170

                 190        200        210        220        230        240
m914.pep   CSFSRASFNPDLMFLGRSIWLVSPVMTAFAPKPMRVRNIFICSGVVFCASSRMMYAPLSV
           ||||||||||||||||||||||||||||||||||||||||||||||||||||||||||||
a914       CSFSRASFNPDLMFLGRSIWLVSPVMTAFAPKPMRVRNIFICSGVVFCASSRMMYAPLSV
              180        190        200        210        220        230

m914.pep   LPRIX
           |||||
a914       LPRIX
           240
```

The following partial DNA sequence was identified in *N. gonorrhoeae* <SEQ ID 2777>:

```
g915.seq
  1 ATGAAGAAAA CCCTGTTGGc AATTGTTGCC gtTTTCGCCT TAAGTGCCTG

 51 CCGGCaggcg gaAGaggcac cgccgCCTTT ACCCCGGCAG AtTAGCGacc

101 gttcggtcgg aCACTAttgC Agtatgaacc tgaccgaaca caacggcccc

151 aaagcccaga tttttttgaa cGGCAAACCC GATCAGCCCG TTTGGTTCTC

201 CACCGTcaag cagatgttcg GCTATACCAA GCTGCCCGAA GAGCCCAAAG

251 GCATCCGCGT GATTTACGTT ACCGATATGG GCAATGTTAC CGATTGGACG

301 AATCCTAATG CCGACACGGA GTGGATAGAT GCGAAAAAAG CCTTTTACGT

351 CATCGACAGC GGCTTTATCG GCGGTATGGG CGCGGAAGAC GCGCTGCCGT

401 TCGGCAACAA GGAGCAGGCT GAAAAATTTG CAAAGGATAA AGGCGGCAAG

451 GTCGTCGGTT TTGACGATAT GCCCGATGCT TACATTTTCA AGTAA
```

This corresponds to the amino acid sequence <SEQ ID 2778; ORF 915.ng>:

```
g915.pep
  1 MKKTLLAIVA VFALSACRQA EEAPPPLPRQ ISDRSVGHYC SMNLTEHNGP

 51 KAQIFLNGKP DQPVWFSTVK QMFGYTKLPE EPKGIRVIYV TDMGNVTDWT

101 NPNADTEWID AKKAFYVIDS GFIGGMGAED ALPFGNKEQA EKFAKDKGGK

151 VVGFDDMPDA YIFK*
```

The following partial DNA sequence was identified in *N. meningitidis* <SEQ ID 2779>:

```
m915.seq
  1 ATGAAAAAAA CCCTGTTGGC AATTGTTGCC GTTTCCGCCT TAAGTGC.tG

 51 CCGGCAGGCG GAAGAGGGAC CGCCGCCTTT ACCcCGGCAG ATTAGCGACC

101 GTTCGGTCGG ACACTATTGC AGTATGAACC TGACCGAACA CAACGGCCCC

151 AAAGCCCAGA TTTTCTTGAA CGGCAAACCC GATCAGCCCG TtTGGTTCTC

201 CACCATCAAG CAGATGTTCG GCTATACCAA GCTGCCCGAA GAGCCTAAAG

251 GCATCCGCGT GATTTACGTT ACCGATATGG GCAATGTTAC CGATTGGACG

301 AATCCCAATG CCGACACGGA GTGGATGGAT GCGAAAAAAG CCTTTTACGT

351 CATCGACAGC GGCTTTATCG GCGGTATGGG TGCGGAAGAC GCGCTGCCGT

401 TCGGCAACAA AGAGCAGGCT GAGAAATTTG CAAAGGATAA AGGCGGTAAG

451 GTTGTCGGTT TCGACGATAT GCCTGATACC TATATTTTCA AATAA
```

This corresponds to the amino acid sequence <SEQ ID 2780; ORF 915>:

```
m915.pep
  1 MKKTLLAIVA VSALSXCRQA EEGPPPLPRQ ISDRSVGHYC SMNLTEHNGP

 51 KAQIFLNGKP DQPVWFSTIK QMFGYTKLPE EPKGIRVIYV TDMGNVTDWT

101 NPNADTEWMD AKKAFYVIDS GFIGGMGAED ALPFGNKEQA EKFAKDKGGK

151 VVGFDDMPDT YIFK*
```

Computer analysis of this amino acid sequence gave the following results:

Homology with a Predicted ORF from *N. gonorrhoeae*

ORF 915 shows 97.0% identity over a 164 aa overlap with a predicted ORF (ORF 915.ng) from *N. gonorrhoeae*:

```
m915/g915

                    10        20        30        40        50        60
m915.pep    MKKTLLAIVAVSALSACRQAEEGPPPLPRQISDRSVGHYCSMNLTEHNGPKAQIFLNGKP
            |||||||||| |||||||||:|||||||||||||||||||||||||||||||||||||||
g915        MKKTLLAIVAVFALSACRQAEEAPPPLPRQISDRSVGHYCSMNLTEHNGPKAQIFLNGKP
                    10        20        30        40        50        60

                    70        80        90       100       110       120
m915.pep    DQPVWFSTIKQMFGYTKLPEEPKGIRVIYVTDMGNVTDWTNPNADTEWMDAKKAFYVIDS
            ||||||||:||||||||||||||||||||||||||||||||||||||||:||||||||||
g915        DQPVWFSTVKQMFGYTKLPEEPKGIRVIYVTDMGNVTDWTNPNADTEWIDAKKAFYVIDS
                    70        80        90       100       110       120

                   130       140       150       160
m915.pep    GFIGGMGAEDALPFGNKEQAEKFAKDKGGKVVGFDDMPDTYIFKX
            |||||||||||||||||||||||||||||||||||||||:|||||
g915        GFIGGMGAEDALPFGNKEQAEKFAKDKGGKVVGFDDMPDAYIFKX
                   130       140       150       160
```

The following partial DNA sequence was identified in *N. meningitidis* <SEQ ID 2781>:

```
a915.seq
  1 ATGAAAAAAA CCCTGTTGGC AATTGTTGCC GTTTCCGCCT TAAGTGCCTG

 51 CCGGCAGGCG GAAGAGGGAC CGCCGCCTTT ACCCCGGCAG ATTAGCGACC

101 GTTCGGTCGG ACACTATTGC AGTATGAACC TGACCGAACA CAACGGCCCC

151 AAAGCCCAGA TTTTCTTGAA CGGCAAACCC GATCAGCCCG TTTGGTTCTC
```

-continued

```
201 CACCATCAAG CAGATGTTCG GCTATACCAA GCTGCCCGAA GAGCCTAAAG

251 GCATCCGCGT GATTTACGTT ACCGATATGG GCAATGTTAC CGATTGGACG

301 AATCCCAATG CCGACACGGA GTGGATGGAT GCGAAAAAAG CCTTTTACGT

351 CATCGACAGC GGCTTTATCG GCGGTATGGG TGCGGAAGAC GCGCTGCCGT

401 TCGGCAACAA AGAGCAGGCT GAGAAATTTG CAAAGGATAA AGGCGGTAAG

451 GTTGTCGGTT TCGACGATAT GCCTGATACC TATATTTTCA
    AATAA
```

This corresponds to the amino acid sequence <SEQ ID 2782; ORF 915.a>:

```
a915.pep
   1 MKKTLLAIVA VSALSACRQA EEGPPPLPRQ ISDRSVGHYC SMNLTEHNGP

  51 KAQIFLNGKP DQPVWFSTIK QMFGYTKLPE EPKGIRVIYV TDMGNVTDWT

 101 NPNADTEWMD AKKAFYVIDS GFIGGMGAED ALPFGNKEQA EKFAKDKGGK

 151 VVGFDDMPDT YIFK*
```

m915/a915 99.4% identity in 164 aa overlap

```
                   10        20        30        40        50        60
m915.pep    MKKTLLAIVAVSALSXCRQAEEGPPPLPRQISDRSVGHYCSMNLTEHNGPKAQIFLNGKP
            |||||||||||||||| |||||||||||||||||||||||||||||||||||||||||||
a915        MKKTLLAIVAVSALSACRQAEEGPPPLPRQISDRSVGHYCSMNLTEHNGPKAQIFLNGKP
                   10        20        30        40        50        60

                   70        80        90       100       110       120
m915.pep    DQPVWFSTIKQMFGYTKLPEEPKGIRVIYVTDMGNVTDWTNPNADTEWMDAKKAFYVIDS
            ||||||||||||||||||||||||||||||||||||||||||||||||||||||||||||
a915        DQPVWFSTIKQMFGYTKLPEEPKGIRVIYVTDMGNVTDWTNPNADTEWMDAKKAFYVIDS
                   70        80        90       100       110       120

                  130       140       150       160
m915.pep    GFIGGMGAEDALPFGNKEQAEKFAKDKGGKVVGFDDMPDTYIFKX
            |||||||||||||||||||||||||||||||||||||||||||||
a915        GFIGGMGAEDALPFGNKEQAEKFAKDKGGKVVGFDDMPDTYIFKX
                  130       140       150       160
```

The following partial DNA sequence was identified in *N. gonorrhoeae* <SEQ ID 2783>:

```
g917.seq
   1  ATGGTCAAac atctgccacT cgcCGTCctg actgctTtgc tgcttgcagc

  51  gtgcGGCGGT Tcggacaaac cgcctgccga Aaaaccggca ccggcgGaAA

 101  accaaAacgt atTgaAAATT TataACTGGT CGGAATACGT CGATCCGGAA

 151  ACCGTTGCCG ATTTTGAAAA GAAAAACGGC ATCAAGGTTA CTTATGATGT

 201  GTACGACAGT GATGAAACGC TGGAAAGCAA GGTGCTGACC GGAAAATCCG

 251  GTTACGACAT TGTCGCGCCG TCCAATGCGT TTGTGGGCAG GCAGATTAAG

 301  GCAGGTGCGT ATCAGAAAAT CGATAAGTCG ATGATTCCCA ATTATAAACA

 351  TCTCAACCCT GAAATGATGA GGCTGATGGA CGGGGTCGAT CCCGACCACG

 401  AATACGCCGT GCCGTTTTAT TGGGGGACAA ATACCTTCGC CATCAATACC

 451  GAACGCGTGA AAAAGGCTTT GGGTACGGAC AAGCTGCCGG ACAACCAGTG

 501  GGATTTGGTG TTCAACCCCG AATACACGTT CAAACTCAAA CAATGCGGCA

 551  TCAGCTATTT GGACAGCGCG GCGGAAATTT ATCCCATGGT GTTGAACTAT

 601  TTGGGCAAAA ACCCGAACAG CAGCAATACG GAAGACATCA GGGAGGCAAC
```

-continued

```
 651 CGCCCTGCTC AAGAAAAACC GCCCCAATAT CAAACGCTTT ACTTCGTCCG
 701 GCTTTATCGA TGATTTGGCG CGCGGCGATA CCTGCGTAAC AATCGGTTTC
 751 GGCGGAGATT TGAACATCGC CAAACGCCGT GCCGAAGAAG CGGGCGGCAA
 801 GGAAAAAATC CGCGTGATGA TGCCGAAAGA GGGCGTGGGG ATTTGGGTGG
 851 ATTCTTTCGT GATTCCGAAA GATGCGAAAA ACGTCGCCAA CGCGCACAAA
 901 TACATCAACG ACTTCCTCGA TCCGGAAGTG TCGGCGAAAA ACGGCAATTT
 951 cgttacCTAC GCGCCTTCGA GCAAGCCGGC GCGCGATTTG ATGGAGGACG
1001 AATTTAAAAA CGACAATACG ATTTTCCCGA GCGGGGAAGA TTTGAAAAAC
1051 AGCTTTATCA TGGTGCCTAT CCGGCCGGCG GCATTGAAGT TTATGGTGCG
1101 CCAGTGGCAG GATGTGAAGG CGGGGAAATA A
```

This corresponds to the amino acid sequence <SEQ ID 2784; ORF 917.ng>:

```
g917.pep
  1 MVKHLPLAVL TALLLAACGG SDKPPAEKPA PAENQNVLKI YNWSEYVDPE
 51 TVADFEKKNG IKVTYDVYDS DETLESKVLT GKSGYDIVAP SNAFVGRQIK
101 AGAYQKIDKS MIPNYKHLNP EMMRLMDGVD PDHEYAVPFY WGTNTFAINT
151 ERVKKALGTD KLPDNQWDLV FNPEYTFKLK QCGISYLDSA AEIYPMVLNY
201 LGKNPNSSNT EDIREATALL KKNRPNIKRF TSSGFIDDLA RGDTCVTIGF
251 GGDLNIAKRR AEEAGGKEKI RVMMPKEGVG IWVDSFVIPK DAKNVANAHK
301 YINDFLDPEV SAKNGNFVTY APSSKPARDL MEDEFKNDNT IFPSGEDLKN
351 SFIMVPIRPA ALKFMVRQWQ DVKAGK*
```

The following partial DNA sequence was identified in *N. meningitidis* <SEQ ID 2785>:

```
m917.seq
  1 ATGACCAAAC ATCTGCCCCT GGCCGTCCTG ACTGCTTTGC TGCTTGCAGC
 51 GTGCGGCGGT TCGGACAAAC CGCCTGCCGA AAAACCGGCA CCGGCGGAAA
101 ACCAAAACGT ATTGAAAATT TACAACTGGT CGGAATATGT CGATCCGGAA
151 ACCGTTGCCG ATTTTGAAAA GAAAAACGGC ATCAAGGTTA CTTATGATGT
201 GTACGACAGC GATGAAACGC TGGAAAGCAA GGTGCTGACA GGCAAGTCCG
251 GTTACGACAT TGTCGCGCCG TCCAATGCGT TTGTGGGCAG GCAGATTAAG
301 GCAGGTGCGT ATCAGAAAAT CGATAAGTCG CTGATTCCCA ATTATAAACA
351 CCTCAACCCC GAAATGATGA GGCTGATGGA CGGGGTCGAT CCCGGCCACG
401 AATACGCCGT GCCGTTTTAT TGGGGGACAA ATACCTTCGC CATCAATACC
451 GAACGCGTGA AAAAGGCTTT GGGTACGGAC AAGCTGCCGG ACAACCAGTG
501 GGATTTGGTG TTCGACCCCG AATACACGTC CAAACTCAAG CAATGCGGCA
551 TCAGCTATTT GGACAGCGCG GCGGAAATCT ATCCTATGGT GTTGAACTAT
601 TTGGGTAAAA ACCCGAACAG CAGCAATACG GAAGACATCA GGGAGGCAAC
651 CGCCCTACTC AAGAAAAACC GCCCCAATAT CAAACGCTTT ACTTCGTCCG
701 GCTTTATCGA TGATTTGGCG CGCGGCGATA CCTGCGTAAC AATCGGTTTC
751 GGCGGCGATT TGAACATCGC CAAACGCCGT GCCGAAGAAG CGGGCGGCAA
```

-continued

```
 801 GGAAAAAATC CGCGTGATGA TGCCCAAAGA GGGCGTGGGG ATTTGGGTGG

 851 ATTCTTTCGT GATTCCGAAA GATGCGAAAA ACGTCGCCAA CGCGCACAAA

 901 TACATCAACG ACTTCCTCGA CCCGGAAGTG TCGGCGAAAA ACGGCAATTT

 951 CGTTACTTAC GCGCCTTCGA GCAAGCCTGC GCGTGAGCTG ATGGAAGACG

1001 AATTTAAAAA CGACAATACG ATTTTCCCAA CCGAGGAGGA TTTGAAAAAC

1051 AGCTTTATCA TGGTGCCTAT CCAGCCGGCG GCATTGAAGT TTATGGTGCG

1101 CCAGTGGCAG GATGTGAAGG CGGGGAAATA A
```

This corresponds to the amino acid sequence <SEQ ID 2786; ORF 917>:

```
m917.pep
   1 MTKHLPLAVL TALLLAACGG SDKPPAEKPA PAENQNVLKI YNWSEYVDPE

  51 TVADFEKKNG IKVTYDVYDS DETLESKVLT GKSGYDIVAP SNAFVGRQIK

 101 AGAYQKIDKS LIPNYKHLNP EMMRLMDGVD PGHEYAVPFY WGTNTFAINT

 151 ERVKKALGTD KLPDNQWDLV FDPEYTSKLK QCGISYLDSA AEIYPMVLNY

 201 LGKNPNSSNT EDIREATALL KKNRPNIKRF TSSGFIDDLA RGDTCVTIGF

 251 GGDLNIAKRR AEEAGGKEKI RVMMPKEGVG IWVDSFVIPK DAKNVANAHK

 301 YINDFLDPEV SAKNGNFVTY APSSKPAREL MEDEFKNDNT IFPTEEDLKN

 351 SFIMVPIQPA ALKFMVRQWQ DVKAGK*
```

Computer analysis of this amino acid sequence gave the following results:

Homology with a Predicted ORF from *N. gonorrhoeae*

ORF 917 shows 97.6% identity over a 376 aa overlap with a predicted ORF (ORF 917.ng) from *N. gonorrhoeae*:

```
m917/g917

                    10        20        30        40        50        60
m917.pep    MTKHLPLAVLTALLLAACGGSDKPPAEKPAPAENQNVLKIYNWSEYVDPETVADFEKKNG
            |:||||||||||||||||||||||||||||||||||||||||||||||||||||||||||
g917        MVKHLPLAVLTALLLAACGGSDKPPAEKPAPAENQNVLKIYNWSEYVDPETVADFEKKNG
                    10        20        30        40        50        60

                    70        80        90       100       110       120
m917.pep    IKVTYDVYDSDETLESKVLTGKSGYDIVAPSNAFVGRQIKAGAYQKIDKSLIPNYKHLNP
            |||||||||||||||||||||||||||||||||||||||||||||||||:||||||||||
g917        IKVTYDVYDSDETLESKVLTGKSGYDIVAPSNAFVGRQIKAGAYQKIDKSMIPNYKHLNP
                    70        80        90       100       110       120

                   130       140       150       160       170       180
m917.pep    EMMRLMDGVDPGHEYAVPFYWGTNTFAINTERVKKALGTDKLPDNQWDLVFDPEYTSKLK
            |||||||||| |||||||||||||||||||||||||||||||||||||||:|||| |||
g917        EMMRLMDGVDPDHEYAVPFYWGTNTFAINTERVKKALGTDKLPDNQWDLVFNPEYTFKLK
                   130       140       150       160       170       180

                   190       200       210       220       230       240
m917.pep    QCGISYLDSAAEIYPMVLNYLGKNPNSSNTEDIREATALLKKNRPNIKRFTSSGFIDDLA
            ||||||||||||||||||||||||||||||||||||||||||||||||||||||||||||
g917        QCGISYLDSAAEIYPMVLNYLGKNPNSSNTEDIREATALLKKNRPNIKRFTSSGFIDDLA
                   190       200       210       220       230       240

                   250       260       270       280       290       300
m917.pep    RGDTCVTIGFGGDLNIAKRRAEEAGGKEKIRVMMPKEGVGIWVDSFVIPKDAKNVANAHK
            ||||||||||||||||||||||||||||||||||||||||||||||||||||||||||||
g917        RGDTCVTIGFGGDLNIAKRRAEEAGGKEKIRVMMPKEGVGIWVDSFVIPKDAKNVANAHK
                   250       260       270       280       290       300

                   310       320       330       340       350       360
m917.pep    YINDFLDPEVSAKNGNFVTYAPSSKPARELMEDEFKNDNTIFPTEEDLKNSFIMVPIQPA
            ||||||||||||||||||||||||||||:||||||||||||||: |||||||||||:||
g917        YINDFLDPEVSAKNGNFVTYAPSSKPARDLMEDEFKNDNTIFPSGEDLKNSFIMVPIRPA
                   310       320       330       340       350       360
```

-continued

```
                    370
m917.pep      ALKFMVRQWQDVKAGKX
              |||||||||||||||||
g917          ALKFMVRQWQDVKAGKX
                    370
```

The following partial DNA sequence was identified in *N. meningitidis* <SEQ ID 2787>:

```
a917.seq
   1 ATGACCAAAC ATCTGCCCCT GGCCGTCCTG ACTGCTTTGC TGCTTGCAGC
  51 GTGCGGCGGT TCGGACAAAC CGCCTGCCGA AAAACCGGCG CCGGCGGAAA
 101 ACCGAAACGT ATTGAAAATT TACAACTGGT CGGAATACGT CGATCCGGAA
 151 ACCGTTGCCG ATTTTGAAAA GAAAAACGGC ATCAAGGTTA CTTATGATGT
 201 GTACGACAGC GATGAAACGC TGGAAAGCAA GGTGCTGACC GGAAAATCTG
 251 GTTACGACAT TGTCGCGCCG TCCAATGCGT TTGTGGGCAG GCAGATTAAG
 301 GCAGGTGCGT ATCAGAAAAT CGATAAGTCG CTGATTCCCA ATTATAAACA
 351 CCTCAACCCC GAAATGATGA GGCTGATGGA CGGGGTCGAT CCCGGCCACG
 401 AATACGCCGT GCCGTTTTAT TGGGGGACAA ATACCTTCGC CATCAATACC
 451 GAACGCGTGA AAAAGGCTTT GGGTACGGAC AAGCTGCCGG ACAACCAGTG
 501 GGATTTGGTG TTCGACCCCG AATACACGTC CAAACTCAAG CAATGCGGCA
 551 TCAGCTATTT GGACAGCGCG GCGGAAATCT ATCCTATGGT GTTGAACTAT
 601 TTGGGTAAAA ACCCGAACAG CAGCAATACG GAAGACATCA GGGAGGCAAC
 651 CGCCCTACTC AAGAAAAACC GCCCCAATAT CAAACGCTTT ACTTCGTCCG
 701 GCTTTATCGA TGATTTGGCG CGCGGCGATA CCTGCGTAAC AATCGGTTTC
 751 GGCGGCGATT TGAACATCGC CAAACGCCGT GCCGAAGAAG CGGGCGGCAA
 801 GGAAAAAATC CGCGTGATGA TGCCCAAAGA GGGCGTGGGG ATTTGGGTGG
 851 ATTCTTTCGT GATTCCGAAA GATGCGAAAA ACGTCGCCAA CGCGCACAAA
 901 TACATCAACG ACTTCCTCGA CCCGGAAGTG TCGGCGAAAA ACGGCAATTT
 951 CGTTACTTAC GCGCCTTCGA GCAAGCCTGC GCGTGAGCTG ATGGAAGACG
1001 AATTTAAAAA CGACAATACG ATTTTCCCAA CCGAGGAGGA TTTGAAAAAC
1051 AGCTTTATCA TGGTGCCTAT CCAGCCGGCG GCATTGAAGT TTATGGTGCG
1101 CCAGTGGCAG GATGTGAAGG CGGGGAAATA A
```

This corresponds to the amino acid sequence <SEQ ID 2788; ORF 917.a>:

```
a917.pep
  1 MTKHLPLAVL TALLLAACGG SDKPPAEKPA PAENRNVLKI YNWSEYVDPE
 51 TVADFEKKNG IKVTYDVTDS DETLESKVLT GKSGYDIVAP SNAFVGRQIK
101 AGAYQKIDKS LIPNYKHLNP EMMRLMDGVD PGHEYAVPFY WGTNTFAINT
151 ERVKKALGTD KLPDNQWDLV FDPEYTSKLK QCGISYLDSA AEIYPMVLNY
201 LGKNPNSSNT EDIREATALL KKNRPNIKRF TSSGFIDDLA IFPTEEDLKN
251 GGDLNIAKRR AEEAGGKEGI RVMMPKEGVG IWVDSFVIPK DAKNVANAHK
301 YINDFLDPEV SAKNGNFVTY APSSKPAREL MEDEFKNDNT IFPTEEDLKN
```

-continued

```
     351  SFIMVPIQPA ALKFMVRQWQ DVKAGK*

m917/a917  99.7% identity in 376 aa overlap

10         20         30         40         50         60
m917.pep   MTKHLPLAVLTALLLAACGGSDKPPAEKPAPAENQNVLKIYNWSEYVDPETVADFEKKNG
           ||||||||||||||||||||||||||||||||||:|||||||||||||||||||||||||
a917       MTKHLPLAVLTALLLAACGGSDKPPAEKPAPAENRNVLKIYNWSEYVDPETVADFEKKNG
                  10         20         30         40         50         60

70         80         90         100        110        120
m917.pep   IKVTYDVYDSDETLESKVLTGKSGYDIVAPSNAFVGRQIKAGAYQKIDKSLIPNYKHLNP
           ||||||||||||||||||||||||||||||||||||||||||||||||||||||||||||
a917       IKVTYDVYDSDETLESKVLTGKSGYDIVAPSNAFVGRQIKAGAYQKIDKSLIPNYKHLNP
                  70         80         90         100        110        120

130        140        150        160        170        180
m917.pep   EMMRLMDGVDPGHEYAVPFYWGTNTFAINTERVKKALGTDKLPDNQWDLVFDPEYTSKLK
           ||||||||||||||||||||||||||||||||||||||||||||||||||||||||||||
           EMMRLMDGVDPGHEYAVPFYWGTNTFAINTERVKKALGTDKLPDNQWDLVFDPEYTSKLK
a917              130        140        150        160        170        180
                  190        200        210        220        230        240
           QCGISYLDSAAEIYPMVNLNYLGKNPNSSNTEDIREATALLKKNRPNIKRFTSSGFIDDLA
m917.pep   ||||||||||||||||||||||||||||||||||||||||||||||||||||||||||||
           QCGISYLDSAAEIYPMVNLNYLGKNPNSSNTEDIREATALLKKNRPNIKRFTSSGFIDDLA
                  190        200        210        220        230        240
```

The following partial DNA sequence was identified in *N. gonorrhoeae* <SEQ ID 2789>:

```
g919.seq
     1  ATGAAAAAAC ACCTGCTCCG CTCCGCCCTG TACGGcatCG CCGCCgccAT

    51  CctcgCCGCC TGCCAAAgca gGAGCATCCA AACCTTTCCG CAACCCGACA

   101  CATCCGTCAT CAACGGCCCG GACCGGCCGG CCGGCATCCC CGACCCCGCC

   151  GGAACGACGG TTGCCGGCGG CGGGGCCGTC TATACCGTTG TGCCGCACCT

   201  GTCCATGCCC CACTGGGCGG CGCaggATTT TGCCAAAAGC CTGCAATCCT

   251  TCCGCCTCGG CTGCGCCAAT TTGAAAAACC GCCAAGGCTG GCAGGATGTG

   301  TGCGCCCAAG CCTTTCAAAC CCCCGTGCAT TCCTTTCAGG CAAAGcGgTT

   351  TTTTGAACGC TATTTCACGC cgtGGCaggt tgcaggcaAC GGAAGcCTTG

   401  Caggtacggt TACCGGCTAT TACGAACCGG TGCTGAAGGG CGACGGCAGG

   451  CGGACGGAAC GGGCCCGCTT CCCGATTTAC GGTATTCCCG ACGATTTTAT

   501  CTCCGTCCCG CTGCCTGCCG GTTTGCGGGG CGGAAAAAAC CTTGTCCGCA

   551  TCAGGCAGac ggGGAAAAAC AGCGGCACGA TCGACAATGC CGGCGGCACG

   601  CATACCGCCG ACCTCTCCCG ATTCCCCATC ACCGCGCGCA CAACGGcaat

   651  caaaGGCAGG TTTGAaggAA GCCGCTTCCT CCCTTACCAC ACGCGCAACC

   701  AAAtcaacGG CGGCgcgcTT GACGGCAAag cccCCATCCT CggttacgcC

   751  GAagacccCG tcgaactttT TTTCATGCAC AtccaaggCT CGGGCCGCCT

   801  GAAAACCCcg tccggcaaat acatCCGCAt cggaTacgcc gacAAAAACG

   851  AACAtccgTa tgtttccatc ggACGctaTA TGGCGGACAA AGGCTACCTC

   901  AAGctcgggc agACCTCGAT GCAGGgcatc aaagcCTATA TGCGGCAAAA

   951  TCCGCAACGC CTCGCCGAAG TTTTGGGTCA AAACCCCAGC TATATCTTTT

  1001  TCCGCGAGCT TGCCGGAAGC GGCAATGAGG GCCCCGTCGG CGCACTGGGC

  1051  ACGCCACTGA TGGGGGAATA CGCCGGCGCA ATCGACCGGC ACTACATTAC

  1101  CTTGGGCGCG CCCTTATTTG TCGCCACCGC CCATCCGGTT ACCCGCAAAG

  1151  CCCTCAACCG CCTGATTATG GCGCAGGATA CAGGCAGCGC GATCAAAGGC
```

-continued

```
1201 GCGGTGCGCG TGGATTATTT TTGGGGTTAC GGCGACGAAG CCGGCGAACT

1251 TGCCGGCAAA CAGAAAACCA CGGGATACGT CTGGCAGCTC CTGCCCAACG

1301 GCATGAAGCC CGAATACCGC CCGTGA
```

This corresponds to the amino acid sequence <SEQ ID 2790; ORF 919.ng>:

```
g919.pep
  1 MKKHLLRSAL YGIAAAILAA CQSRSIQTFP QPDTSVINGP DRPAGIPDPA

 51 GTTVAGGGAV YTVVPHLSMP HWAAQDFAKS LQSFRLGCAN LKNRQGWQDV

101 CAQAFQTPVH SFQAKRFFER YFTPWQVAGN GSLAGTVTGY YEPVLKGDGR

151 RTERARFPIY GIPDDFISVP LPAGLRGGKN LVRIRQTGKN SGTIDNAGGT

201 HTADLSRFPI TARTTAIKGR FEGSRFLPYH TRNQINGGAL DGKAPILGYA

251 EDPVELFFMH IQGSGRLKTP SGKYIRIGYA DKNEHPYVSI GRYMADKGYL

301 KLGQTSMQGI KAYMRQNPQR LAEVLGQNPS YIFFRELAGS GNEGPVGALG

351 TPLMGEYAGA IDRHYITLGA PLFVATAHPV TRKALNRLIM AQDTGSAIKG

    AVRVDYFWGY GDEAGELAGK QKTTGYVWQL LPNGMKPEYR P*
```

The following partial DNA sequence was identified in *N. meningitidis* <SEQ ID 2791>:

```
m919.seq
   1 ATGAAAAAAT ACCTATTCCG CGCCGCCCTG TACGGCATCG CCGCCGCCAT

  51 CCTCGCCGCC TGCCAAAGCA AGAGCATCCA AACCTTTCCG CAACCCGACA

 101 CATCCGTCAT CAACGGCCCG GACCGGCCGG TCGGCATCCC CGACCCCGCC

 151 GGAACGACGG TCGGCGGCGG CGGGGCCGTC TATACCGTTG TACCGCACCT

 201 GTCCCTGCCC CACTGGGCGG CGCAGGATTT CGCCAAAAGC CTGCAATCCT

 251 TCCGCCTCGG CTGCGCCAAT TTGAAAAACC GCCAAGGCTG GCAGGATGTG

 301 TGCGCCCAAG CCTTTCAAAC CCCCGTCCAT TCCTTTCAGG CAAAACAGTT

 351 TTTTGAACGC TATTTCACGC CGTGGCAGGT TGCAGGCAAC GGAAGCCTTG

 401 CCGGTACGGT TACCGGCTAT TACGAACCGG TGCTGAAGGG CGACGACAGG

 451 CGGACGGCAC AAGCCCGCTT CCCGATTTAC GGTATTCCCG ACGATTTTAT

 501 CTCCGTCCCC CTGCCTGCCG GTTTGCGGAG CGGAAAAGCC CTTGTCCGCA

 551 TCAGGCAGAC GGGAAAAAAC AGCGGCACAA TCGACAATAC CGGCGGCACA

 601 CATACCGCCG ACCTCTCCcG ATTCCCCATC ACCGCGCGCA CAACAGCAAT

 651 CAAAGGCAGG TTTGAAGGAA GCCGCTTCCT CCCCTACCAC ACGCGCAACC

 701 AAATCAACGG CGGCGCGCTT GACGGCAAAG CCCCGATACT CGGTTACGCC

 751 GAAGACCCTG TCGAACTTTT TTTTATGCAC ATCCAAGGCT CGGGCCGTCT

 801 GAAAACCCCG TCCGGCAAAT ACATCCGCAT CGGCTATGCC GACAAAAACG

 851 AACATCCyTA CGTTTCCATC GGACGCTATA TGGCGGATAA GGGCTACCTC

 901 AAACTCGGAC AAACCTCCAT GCAGGGCATT AAGTCTTATA TGCGGCAAAA

 951 TCCGCAACGC CTCGCCGAAG TTTTGGGTCA AAACCCCAGC TATATCTTTT

1001 TCCGCGAGCT TGCCGGAAGC AGCAATGACG GCCCTGTCGG CGCACTGGGC

1051 ACGCCGCTGA TGGGGGAATA TGCCGGCGCA GTCGACCGGC ACTACATTAC
```

-continued

```
1101  CTTGGGTGCG CCCTTATTTG TCGCCACCGC CCATCCGGTT ACCCGCAAAG

1151  CCCTCAACCG CCTGATTATG GCGCAGGATA CCGGCAGCGC GATTAAAGGC

1201  GCGGTGCGCG TGGATTATTT TTGGGGATAC GGCGACGAAG CCGGCGAACT

1251  TGCCGGCAAA CAGAAAACCA CGGGATATGT CTGGCAGCTC CTACCCAACG

      GTATGAAGCC CGAATACCGc CCGTAA
```

This corresponds to the amino acid sequence <SEQ ID 2792; ORF 919>:

```
m19.pep

          1 MKKYLFRAAL YGIAAAILAA CQSKSIQTFP QPDTSVINGP DRPVGIPDPA

         51 GTTVGGGGAV YTVVPHLSLP HWAAQDFAKS LQSFRLGCAN LKNRQGWQDV

        101 CAQAFQTPVH SFQAKQFFER YFTPWQVAGN GSLAGTVTGY YEPVLKGDDR

        151 RTAQARFPIY GIPDDFISVP LPAGLRSGKA LVRIRQTGKN SGTIDNTGGT

        201 HTADLSRFPI TARTTAIKGR FEGSRFLPYH TRNQINGGAL DGKAPILGYA

        251 EDPVELFFMH IQGSGRLKTP SGKYIRIGYA DKNEHPYVSI GRYMADKGYL

        301 KLGQTSMQGI KSYMRQNPQR LAEVLQGNPS YIFFRELAGS SNDGPVGALG

        351 TPLMGEYAGA VDRHYITLGA PLFVATAHPV TRKALNRLIM AQDTGSAIKG

        401 AVRVDYFWGY GDEAGELAGK QKTTGYVWQL LPNGMKPEYR P*
```

```
Computer analysis of this amino acid sequence gave the following result:
Homology with a predicted ORF from N.gonorrhoeae
ORF 919 shows 95.9% identity over a 441 aa overlap with a predicted ORF(ORF
919.ng) from N. gonorrhoeae:
m919/g919
10          20         30         40         50         60
m919.pep    MKKYLFRAALYGIAAAILAACQSKSIQTFPQPDTSVINGPDRPVGIPDPAGTTVGGGGAV
            |||:|:|:||||||||||||||:||||||||||||||||||:||||||||||:|||||
g919        MKKHLLRSALYGIAAAILAACQSRSIQTFPQPDTSVINGPDRPAGIPDPAGTTVAGGGAV
                    10         20         30         40         50         60
70          80         90         100        110        120
m919.pep    YTVVPHLSLPHWAAQDFAKSLQSFRLGCANLKNRQGWQDVCAQAFQTPVHSFQAKQFFER
            |||||||:||||||||||||||||||||||||||||||||||||||||||||:||||
g919        YTVVPHLSMPHWAAQDFAKSLQSFRLGCANLKNRQGWQDVCAQAFQTPVHSFQAKRFFER
                    70         80         90         100        110        120
130         140        150        160        170        180
m919.pep    YFTPWQVAGNGSLAGTVTGYYEPVLKGDDRRTAQARFPIYGIPDDFISVPLPAGLRSGKA
            |||||||||||||||||||||||||| ||| :|||||||||||||||||||||:||
g919        YFTPWQVAGNGSLAGTVTGYYEPVLKGDGRRTERARFPIYGIPDDFISVPLPAGLRGGKN
                    130        140        150        160        170        180
190         200        210        220        230        240
m919.pep    LVRIRQTGKNSGTIDNTGGTHTADLSRFPITARTTAIKGRFEGSRFLPYHTRNQINGGAL
            |||||||||||||||:||||||||||||||||||||||||||||||||||||||||||||
g919        LVRIRQTGKNSGTIDNAGGTHTADLSRFPITARTTAIKGRFEGSRFLPYHTRNQINGGAL
                    190        200        210        220        230        240
250         260        270        280        290        300
m919.pep    DGKAPILGYAEDPVELFFMHIQGSGRLKTPSGKYIRIGYADKNEHPYVSIGRYMADKGYL
            ||||||||||||||||||||||||||||||||||||||||||||||||||||||||||||
g919        DGKAPILGYAEDPVELFFMHIQGSGRLKTPSGKYIRIGYADKNEHPYVSIGRYMADKGYL
                    250        260        270        280        290        300
310         320        330        340        350        360
m919.pep    KLGQTSMQGIKSYMRQNPQRLAEVLGQNPSYIFFRELAGSSNDGPVGALGTPLMGEYAGA
            ||||||||||:||||||||||||||||||||||||||||:|:||||||||||||||||
            KLGQTSMQGIKAYMRQNPQRLAEVLGQNPSYIFFRELAGSGNEGPVGALGTPLMGEYAGA
g919                310        320        330        340        350        360
                    370        380        390        400        410        420
  m919.pep    VDRHYITLGAPLFVATAHPVTRKALNRLIMAQDTGSAIKGAVRVDYFWGYGDEAGELAGK
              :|||||||||||||||||||||||||||||||||||||||||||||||||||||||||||
  g919        IDRHYITLGAPLFVATAHPVTRKALNRLIMAQDTGSAIKGAVRVDYFWGYGDEAGELAGK
                      370        380        390        400        410        420
                    430        440
m919.pep    QKTTGYVWQLLPNGMKPEYRPX
            ||||||||||||||||||||
            QKTTGYVWQLLPNGMKPEYRPX
g919                430        440
```

The following partial DNA sequence was identified in *N. meningitidis* <SEQ ID 2793>:

```
a919.seq
   1  ATGAAAAAAT ACCTATTCCG CGCCGCCCTG TGCGGCATCG CCGCCGCCAT
  51  CCTCGCCGCC TGCCAAAGCA AGAGCATCCA AACCTTTCCG CAACCCGACA
 101  CATCCGTCAT CAACGGCCCG GACCGGCCGG TCGGCATCCC CGACCCCGCC
 151  GGAACGACGG TCGGCGGCGG CGGGGCCGTT TATACCGTTG TGCCGCACCT
 201  GTCCCTGCCC CACTGGGCGG CGCAGGATTT CGCCAAAAGC CTGCAATCCT
 251  TCCGCCTCGG CTGCGCCAAT TTGAAAAACC GCCAAGGCTG GCAGGATGTG
 301  TGCGCCCAAG CCTTTCAAAC CCCCGTCCAT TCCGTTCAGG CAAAACAGTT
 351  TTTTGAACGC TATTTCACGC CGTGGCAGGT TGCAGGCAAC GGAAGCCTTG
 401  CCGGTACGGT TACCGGCTAT TACGAGCCGG TGCTGAAGGG CGACGACAGG
 451  CGGACGGCAC AAGCCCGCTT CCCGATTTAC GGTATTCCCG ACGATTTTAT
 501  CTCCGTCCCC CTGCCTGCCG GTTTGCGGAG CGGAAAAGCC CTTGTCCGCA
 551  TCAGGCAGAC GGGAAAAAAC AGCGGCACAA TCGACAATAC CGGCGGCACA
 601  CATACCGCCG ACCTCTCCCA ATTCCCCATC ACTGCGCGCA CAACGGCAAT
 651  CAAAGGCAGG TTTGAAGGAA GCCGCTTCCT CCCCTACCAC ACGCGCAACC
 701  AAATCAACGG CGGCGCGCTT GACGGCAAAG CCCCGATACT CGGTTACGCC
 751  GAAGACCCCG TCGAACTTTT TTTTATGCAC ATCCAAGGCT CGGGCCGTCT
 801  GAAAACCCCG TCCGGCAAAT ACATCCGCAT CGGCTATGCC GACAAAAACG
 851  AACATCCCTA CGTTTCCATC GGACGCTATA TGGCGGACAA AGGCTACCTC
 901  AAGCTCGGGC AGACCTCGAT GCAGGGCATC AAAGCCTATA TGCAGCAAAA
 951  CCCGCAACGC CTCGCCGAAG TTTTGGGGCA AAACCCCAGC TATATCTTTT
1001  TCCGAGAGCT TACCGGAAGC AGCAATGACG GCCCTGTCGG CGCACTGGGC
1051  ACGCCGCTGA TGGGCGAGTA CGCCGGCGCA GTCGACCGGC ACTACATTAC
1101  CTTGGGCGCG CCCTTATTTG TCGCCACCGC CCATCCGGTT ACCCGCAAAG
1151  CCCTCAACCG CCTGATTATG GCGCAGGATA CCGGCAGCGC GATTAAAGGC
1201  GCGGTGCGCG TGGATTATTT TTGGGGATAC GGCGACGAAG CCGGCGAACT
1251  TGCCGGCAAA CAGAAAACCA CGGGATATGT CTGGCAGCTT CTGCCCAACG
1301  GTATGAAGCC CGAATACCGC CCGTAA
```

This corresponds to the amino acid sequence <SEQ ID 2794; ORF 919.a>:

```
a19.pep
   1  MKKYLFRAAL YGIAAAILAA CQSKSIQTFP QPDTSVINGP DRPVGIPDPA
  51  GTTVGGGGAV YTVVPHLSLP HWAAQDFAKS LQSFRLGCAN LKNRQGWQDV
 101  CAQAFQTPVH SFQAKQFFER YFTPWQVAGN GSLAGTVTGY YEPVLKGDDR
 151  RTAQARFPIY GIPDDFISVP LPAGLRSGKA LVRIRQTGKN SGTIDNTGGT
 201  HTADLSRFPI TARTTAIKGR FEGSRFLPYH TRNQINGGAL DGKAPILGYA
 251  EDPVELFFMH IQGSGRLKTP SGKYIRIGYA DKNEHPYVSI GRYMADKGYL
 301  KLGQTSMQGI KSYMRQNPQR LAEVLQGNPS YIFFRELAGS SNDGPVGALG
 351  TPLMGEYAGA VDRHYITLGA PLFVATAHPV TRKALNRLIM AQDTGSAIKG
```

-continued

```
401 AVRVDYFWGY GDEAGELAGK QKTTGYVWQL LPNGMKPEYR P*
```

```
m919/g919 98.6% identity in 441 aa overlap
           10        20        30        40        50        60
m919.pep   MKKYLFRAALYGIAAAILAACQSKSIQTFPQPDTSVINGPDRPVGIPDPAGTTVGGGGAV
           |||||||||| |||||||||||||||||||||||||||||||||||||||||||||||||
a919       MKKHLLRSALCGIAAAILAACQSRSIQTFPQPDTSVINGPDRPAGIPDPAGTTVAGGGAV
                   10        20        30        40        50        60

           70        80        90        100       110       120
m919.pep   YTVVPHLSLPHWAAQDFAKSLQSFRLGCANLKNRQGWQDVCAQAFQTPVHSFQAKQFFER
           |||||||||||||||||||||||||||||||||||||||||||||||||||| |||||||
a919       YTVVPHLSMPHWAAQDFAKSLQSFRLGCANLKNRQGWQDVCAQAFQTPVHSVQAKRFFER
                   70        80        90        100       110       120

           130       140       150       160       170       180
m919.pep   YFTPWQVAGNGSLAGTVTGYYEPVLKGDDRRTAQARFPIYGIPDDFISVPLPAGLRSGKA
           ||||||||||||||||||||||||||||||||||||||||||||||||||||||||||||
a919       YFTPWQVAGNGSLAGTVTGYYEPVLKGDGRRTERARFPIYGIPDDFISVPLPAGLRSGKN
                   130       140       150       160       170       180

           190       200       210       220       230       240
m919.pep   LVRIRQTGKNSGTIDNTGGTHTADLSRFPITARTTAIKGRFEGSRFLPYHTRNQINGGAL
           ||||||||||||||||||||||||||:|||||||||||||||||||||||||||||||||
a919       LVRIRQTGKNSGTIDNAGGTHTADLSQFPITARTTAIKGRFEGSRFLPYHTRNQINGGAL
                   190       200       210       220       230       240

           250       260       270       280       290       300
m919.pep   DGKAPILGYAEDPVELFFMHIQGSGRLKTPSGKYIRIGYADKNEHPYVSIGRYMADKGYL
           ||||||||||||||||||||||||||||||||||||||||||||||||||||||||||||
a919       DGKAPILGYAEDPVELFFMHIQGSGRLKTPSGKYIRIGYADKNEHPYVSIGRYMADKGYL
                   250       260       270       280       290       300

           310       320       330       340       350       360
m919.pep   KLGQTSMQGIKSYMRQNPQRLAEVLGQNPSYIFFRELAGSSNDGPVGALGTPLMGEYAGA
           ||||||||||||||||||||||||||||||||||||||:|||||||||||||||||||||
           KLGQTSMQGIKAYMRQNPQRLAEVLGQNPSYIFFRELTGSSNDGPVGALGTPLMGEYAGA
a919               310       320       330       340       350       360

           370       380       390       400       410       420
m919.pep   VDRHYITLGAPLFVATAHPVTRKALNRLIMAQDTGSAIKGAVRVDYFWGYGDEAGELAGK
           ||||||||||||||||||||||||||||||||||||||||||||||||||||||||||||
a919       IDRHYITLGAPLFVATAHPVTRKALNRLIMAQDTGSAIKGAVRVDYFWGYGDEAGELAGK
                   370       380       390       400       410       420

           430       440
m919.pep   QKTTGYVWQLLPNGMKPEYRPX
           ||||||||||||||||||||||
           QKTTGYVWQLLPNGMKPEYRPX
a919               430       440
```

Expression of ORF 919

The primer described in Example 1 for ORF 919 was used to locate and clone ORF 919. This sequence was purified and expressed in *E. coli* as provided in FIG. 1 #. The hydrophilicity plots, antigenic index, and amphipatic regions of ORF 919 is provided in FIG. 5 #. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 919 is provided in Exhibit C #.

The following partial DNA sequence was identified in *N. gonorrhoeae* <SEQ ID 2795>:

```
g920.seq (partial)
   1 ..ccgatgcagc tggttaccga aaaAGGTAAG GAAAACATGA TTCAACGCGG

  51   CACATACAAC TACCAATACC GCAGCAACCG TCCGGTCAAA GACGGCAGCT

 101   ACCTCGTTAC CGCCGAATAT CAGCCTACTT TCCGGTCAAA AAACAAAGCA

 151   GGCTGGAAAC AGGCTGGCAT CAAAGAAATG CCTGACGCAA GCTATTGCGA

 201   ACAAACCCGT ATGTTCGGTA AAAACATTGT CAACGTGGGA CACGAAAGCG

 251   CGGACACCGC CATCATCACC AAACCGGTCG GACAAAACTT GGAAATCGTC

 301   CCGCTGGACA ATCccgccga caTTCACgtg ggctaacgCt tcaaaGTccg

 351   cgttCtgttc cgtGGCgaac cgCTGcccaa tgccACCgtt accgCtacAT

 401   TTGacggctt cGAcaccagc gaccgcagca aaacgcacaa Aaccgaagcc

 451   caagcctTCT ccgacaccac cgacggcgaa ggcgaagtgg acatcatCCC

 501   CTTGCgccaa GGCTTttgga aAgcGAGTGT CGAATAcaaa gccgAtttcc
```

-continued

```
551   CCGATcaaAG CCTGTGccga AAACAggcgA ACTACaCaac TTtaaccttc

601   caaatcgccc attctCacca tTAa
```

This corresponds to the amino acid sequence <SEQ ID 2796; ORF 920.ng>:

```
g920.pep (partial)
   1 ..PMQLVTEKGK ENMIQRGTYN YQYRSNRPVK DGSYLVTAEY QPTFRSKNKA

  51   GWKQAGIKEM PDASYCEQTR MFGKNIVNVG HESADTAIIT KPVGQNLEIV

 101   PLDNPADIHV GXRFKVRVLF RGEPLPNATV TATFDGFDTS DRSKTHKTEA

 151   QAFSDTTDGE GEVDIIPLRQ GFWKASVEYK ADFPDQSLCR KQANYTTLTF

 201   QIAHSHH*
```

The following partial DNA sequence was identified in *N. meningitidis* <SEQ ID 2797>:

```
m920.seq
   1 ATGAAGAAAA CATTGACACT GCTCTCCGTT TCCGCCCTAT TTGCCACATC

  51 CGCCCACGCC CACCGmGTCT GGGTCGAAAC CGCCCACACG CACGGCGGCG

 101 AATACCTTAA AGCCGACTTG GGCTACGGCG AATTTCCCGA ACTCGAACCC

 151 ATCGCCAAAG ACCGCCTGCA CATCTTCAGC AAACCGATGC AGCTGGTTAC

 201 CGAAAAAGGC AAGGAAAACA TGATTCAACG CGGCACATAC AACTACCAGT

 251 ACCGAAGCAA CCGTCCCGTT AAGGACGGCA GTTACCTCGT CATCGCCGAA

 301 TATCAGCCTA CTTTCTGGTC AAAAwACAAA GCAGGCTGGA AACAGGCGGG

 351 CATCAAAGAA ATGCCTGACG CAAGCTATTG CGAACAAACC CGAATGTTCG

 401 GCAAAAACAT CGTCAACGTC GGACACGAAA GCGCGGACAC CGCCATCATC

 451 ACCAArCCGG TCGGACAAAA CTTGGAAATC GTCCCGCTGG ACAATCCCGC

 501 CAACATTCAC GTAGGCGAAC GCTTCAAAGT CCGCGTTCTG TTCCGTGGCG

 551 AACCGCTGCC CAATGCCACC GTTACCGCCA CCTTTGACGG CTTCGACACC

 601 AGCGACCGCA GCAAAACGCA CAAwmCCGAA GCACAGGCTT TCTCCGACAG

 651 CACAGACGAC AAAGGCGAAG TGGACATCAT CmCCTTGCGC CAAGGCTTCT

 701 GGAAAGCCAA TGTCGAACAC AAAACCGACT TCCCCGATCA AAGCGTGTGC

 751 CAAAAACAGG CGAACTACTC GACTTTAACC TTCCAAATCG GTCATTCGCA

 801 CCATTAA
```

This corresponds to the amino acid sequence <SEQ ID 2798; ORF 920>:

```
m920.pep
   1 MKKTLTLLSV SALFATSAHA HRVWVETAHT HGGEYLKADL GYGEFPELEP

  51 IAKDRLHIFS KPMQLVTEKG KENMIQRGTY NYQYRSNRPV KDGSYLVIAE

 101 YQPTFWSKXK AGWKQAGIKE MPDASYCEQT RMFGKNIVNV GHESADTAII

 151 TKPVGQNLEI VPLDNPANIH VGERFKVRVL FRGEPLPNAT VTATFDGFDT

 201 SDRSKTHXXE AQAFSDSTDD KGEVDIIXLR QGFWKANVEH KTDFPDQSVC

 251 QKQANYSTLT FQIGHSHH*
```

Computer analysis of this amino acid sequence gave the following results:

Homology with a Predicted ORF from *N. gonorrhoeae*

ORF 920 shows 91.3% identity over a 207 aa overlap with a predicted ORF (ORF 920.ng) from *N. gonorrhoeae*:

```
g920/m920

                                                  10        20        30
g920.pep                                PMQLVTEKGKENMIQRGTYNYQYRSNRPVK
                                        ||||||||||||||||||||||||||||||
m920        GGEYLKADLGYGEFPELEPIAKDRLHIFSKPMQLVTEKGKENMIQRGTYNYQYRSNRPVK
                    40        50        60        70        80        90

                    40        50        60        70        80        90
g920.pep    DGSYLVTAEYQPTFRSKNKAGWKQAGIKEMPDASYCEQTRMFGKNIVNVGHESADTAIIT
            |||||| ||||||| || ||||||||||||||||||||||||||||||||||||||||||
m920        DGSYLVIAEYQPTFWSKXKAGWKQAGIKEMPDASYCEQTRMFGKNIVNVGHESADTAIIT
                   100       110       120       130       140       150

                   100       110       120       130       140       150
g920.pep    KPVGQNLEIVPLDNPADIHVGXRFKVRVLFRGEPLPNATVTATFDGFDTSDRSKTHKTEA
            ||||||||||||||||:|||| |||||||||||||||||||||||||||||||||| :||
m920        KPVGQNLEIVPLDNPANIHVGERFKVRVLFRGEPLPNATVTATFDGFDTSDRSKTHXXEA
                   160       170       180       190       200       210

                   160       170       180       190       200
g920.pep    QAFSDTTDGEGEVDIIPLRQGFWKASVEYKADFPDQSLCRKQANYTTLTFQIAHSHHX
            |||||:|| :|||||| ||||||||:||:|:||||||:|:|||||:||||||:|||||
m920        QAFSDSTDDKGEVDIIXLRQGFWKANVEHKTDFPDQSVCQKQANYSTLTFQIGHSHHX
                   220       230       240       250       260
```

The following partial DNA sequence was identified in *N. meningitidis* <SEQ ID 2799>:

```
a920.seq
   1 TGAAAGAAAA CATTGACACT GCTCGCCGTT TCCGCCCTAT TTGCCGCATC

  51 CGCCCACGCC CACCGCGTCT GGGTCGAAAC CGCCCACACG CACGGCGGCG

 101 AATACCTTAA AGCCGACTTG GGCTACGGCG AATTTCCCGA ACTCGAACCC

 151 ATCGCCAAAG ACCGCCTGCA CATCTTCAGC AAACCGATGC AGCTGGTTAC

 201 CGAAAAAGGC AAGGAAAACA TGATTCAACG CGGCACATAC AACTACCAGT

 251 ACCGAAGCAA CCGTCCCGTT AAGGACGGCA GTTACCTCGT CATCGCCGAA

 301 TATCAGCCTA CTTTCTGGTC AAAAAACAAA GCAGGCTGGA AACAGGCGGG

 351 CATCAAACAA ATGCCTGACG CAAGCTATTG CGAACAAACC CGAATGTTCG

 401 GCAAAAACAT CGTCAACGTC GGACACGAAA GCGCGGACAC CGCCATCATC

 451 ACCAAACCGG TCGGACAAAA CTTGGAAATC GTCCCGCTGG ACAATCCCGC

 501 CAACATTCAC GTAGGCGAAC GCTTCAAAGT CCGCGTTCTG TTCCGTGGCG

 551 AACCGCTGCC CAATGCCACC GTTACCGCCA CCTTTGACGG CTTCGACACC

 601 AGCGACCGCA GCAAAACGCA CAAAACCGAA GCACAGGCTT TCTCCGACAG

 651 CACAGACGAC AAAGGCGAAG TGGACATCAT CCCCTTGCGC CAAGGCTTCT

 701 GGAAAGCCAA TGTCGAACAC AAAGCCGACT TCCCCGATCA AAGCGTGTGC

 751 CAAAAACAGG CGAACTACTC GACTTTAACC TTCCAAATCG GCCATTCGCA

 801 CCATTAA
```

This corresponds to the amino acid sequence <SEQ ID 2800; ORF 920.a>:

```
a920.pep
   1 *KKTLTLLAV SALFAASAHA HRVWVETAHT HGGEYLKADL GYGEFPELEP

  51 IAKDRLHIFS KPMQLVTEKG KENMIQRGTY NYQYRSNRPV KDGSYLVIAE

 101 YQPTFWSKNK AGWKQAGIKQ MPDASYCEQT RMFGKNIVNV GHESADTAII

 151 TKPVGQNLEI VPLDNPANIH VGERFKVRVL FRGEPLPNAT VTATFDGFDT
```

-continued

```
201 SDRSKTHKTE AQAFSDSTDD KGEVDIIPLR QGFWKANVEH KADFPDQSVC

251 QKQANYSTLT FQIGHSHH*
```

m920/a920 97.0% identity in 267 aa overlap

```
                10        20        30        40        50        60
m920.pep MKKTLTLLSVSALFATSAHAHRVWETAHTHGGEYLKADLGYGEFPELEPIAKDRLHIFS
         ||||||||:||||||:||||||||||||||||||||||||||||||||||||||||||||
a920     XKKTLTLLAVSALFAASAHAHRVWETAHTHGGEYLKADLGYGEFPELEPIAKDRLHIFS
                10        20        30        40        50        60

70        80        90        100       110       120
m920.pep KPMQLVTEKGENMIQRGTYNYQYRSNRPVKDGSYLVIAEYQPTFWSKXKAGWKQAGIKE
         ||||||||||||||||||||||||||||||||||||||||||||||| |||||||||||:
a920     KPMQLVTEKGENMIQRGTYNYQYRSNRPVKDGSYLVIAEYQPTFWSKNKAGWKQAGIKQ
                70        80        90        100       110       120

130       140       150       160       170       180
m920.pep MPDASYCEQTRMFGKNIVNVGHESADTAIITKPVGQNLEIVPLDNPAIHVGERFKVRVL
         |||||||||||||||||||||||||||||||||||||||||||||||||||||||||||:
a920     MPDASYCEQTRMFGKNIVNVGHESADTAIITKPVGQNLEIVPLDNPAIHVGERFKVRVL
                130       140       150       160       170       180

190       200       210       220       230       240
m920.pep FRGEPLPNATVTATFDGFDTSDRSKTHXXEAQAFSDSTDDKGEVDIIXLRQGFWKANVEH
         ||||||||||||||||||||||||||| :||||||||||||||||||||||||||||||||
a920     FRGEPLPNATVTATFDGFDTSDRSKTHKTEAQAFSDSTDDKGEVDIIPLRQGFWKANVEH
                190       200       210       220       230       240

250       260       269
m920.pep KTDFPDQSVCQKQANYSTLTFQIGHSHHX
         |:|||||||||||||||||||||||||||
a920     KADFPDQSVCQKQANYSTLTFQIGHSHHX
                250       260
```

The following partial DNA sequence was identified in *N. gonorrhoeae* <SEQ ID 2801>:

```
g920-1.seq
  1 ATGAAGAAAA CATTGACACT GCTCGCcgtt TcCGCACTAT TTGCCACATc

 51 cgCaCACCCC CACCgCGTCT GGGTCGAAAC CgccCACACg cAcgGCGGCG

101 AATACCTTAA AGCCGACTTG GGCTACGGCG AATTCCCCGA ACTCGAACCC

151 ATCGccAAAG ACCgccTGCA CATCTTCAGC AAACCGATGC AGCTGGTTAC

201 CGAAAAAGGT AAGGAAAACA TGATTCAACG CGGCACATAC AACTACCAAT

251 ACCGCAGCAA CCGTCCCGTC AAAGACGGCA GCTACCTCGT TACCGCCGAA

301 TATCAGCCTA CTTTCCGGTC AAAAAACAAA GCAGGCTGGA AACAGGCTGG

351 CATCAAAGAA ATGCCTGACG CAAGCTATTG CGAACAAACC CGTATGTTCG

401 GTAAAAACAT TGTCAACGTG GGACACGAAA GCGCGGACAC CGCCATCATC

451 ACCAAACCGG TCGGACAAAA CTTGGAAATC GTCCCGCTGG ACAATCCCGC

501 CAACATTCAC GTAGGCGAAC GCTTCAAAGT CCGCGTTCTG TTCCGTGGCG

551 AACCGCTGCC CAATGCCACC GTTACCGCTA CATTTGACGG CTTCGACACC

601 AGCGACCGCA GCAAAACGCA CAAAACCGAA GCCCAAGCCT TCTCCGACAC

651 CACCGACGGC AAAGGCGAAG TGGACATCAT CCCCTTGCGC CAAGGCTTTT

701 GGAAAGCGAG TGTCGAATAC AAAGCCGATT TCCCCGATCA AAGCCTGTGC

751 CAAAAACAGG CGAACTACAC AACTTTAACC TTCCAAATCG GCCATTCTCA

801 CCATTAA
```

This corresponds to the amino acid sequence <SEQ ID 2802; ORF 920-1.ng>:

```
g920-1.pep
   1 MKKTLTLLAV SALFATSAHP HRVWVETAHT HGGEYLKADL GYGEFPELEP

  51 IAKDRLHIFS KPMQLVTEKG KENMIQRGTY NYQYRSNRPV KDGSYLVTAE

 101 YQPTFRSKNK AGWKQAGIKE MPDASYCEQT RMFGKNIVNV GHESADTAII

 151 TKPVGQNLEI VPLDNPANIH VGERFKVRVL FRGEPLPNAT VTATFDGFDT

 201 SDRSKTHKTE AQAFSDTTDG KGEVDIIPLR QGFWKASVEY KADFPDQSLC

 251 QKQANYTTLT FQIGHSHH*
```

The following partial DNA sequence was identified in *N. meningitidis* <SEQ ID 2803>:

```
m920-1.seq
   1 ATGAAGAAAA CATTGACACT GCTCGCCGTT TCCGCCCTAT TTGCCACATC

  51 CGCCCACGCC CACCGCGTCT GGGTCGAAAC CGCCCACACG CACGGCGGCG

 101 AATACCTTAA AGCCGACTTG GGCTACGGCG AATTTCCCGA ACTCGAACCC

 151 ATCGCCAAAG ACCGCCTGCA CATCTTCAGC AAACCGATGC AGCTGGTTAC

 201 CGAAAAAGGC AAGGAAAACA TGATTCAACG CGGCACATAC AACTACCAGT

 251 ACCGAAGCAA CCGTCCCGTT AAGGACGGCA GTTACCTCGT CATCGCCGAA

 301 TATCAGCCTA CTTTCTGGTC AAAAAACAAA GCAGGCTGGA AACAGGCGGG

 351 CATCAAAGAA ATGCCTGACG CAAGCTATTG CGAACAAACC CGAATGTTCG

 401 GCAAAAACAT CGTCAACGTC GGACACGAAA GCGCGGACAC CGCCATCATC

 451 ACCAAACCGG TCGGACAAAA CTTGGAAATC GTCCCGCTGG ACAATCCCGC

 501 CAACATTCAC GTAGGCGAAC GCTTCAAAGT CCGCGTTCTG TTCCGTGGCG

 551 AACCGCTGCC CAATGCCACC GTTACCGCCA CCTTTGACGG CTTCGACACC

 601 AGCGACCGCA GCAAAACGCA CAAAACCGAA GCACAGGCTT TCTCCGACAG

 651 CACAGACGAC AAAGGCGAAG TGGACATCAT CCCCTTGCGC CAAGGCTTCT

 701 GGAAAGCCAA TGTCGAACAC AAAACCGACT TCCCCGATCA AAGCGTGTGC

 751 CAAAAACAGG CGAACTACTC GACTTTAACC TTCCAAATCG GTCATTCGCA

 801 CCATTAA
```

This corresponds to the amino acid sequence <SEQ ID 2804; ORF 920-1>:

```
m920-1.pep

     1  MKKTLTLLAV SALFATSAHA HRVWVETAHT HGGEYLKADL GYGEFPELEP

    51  IAKDRLHIFS HRVWVETAHT KENMIQRGTY NYQYRSNRPV KDGSYLVIAE

   101  YQPTFWSKNK AGWKQAGIKE MPDASYCEQT RMFGKNIVNV GHESADTAII

   151  TKPVGQNLEI VPLDNPANTH VGERFKVRVL FRGEPLPNAT VTATFDGFDT

   201  SDRSKTHKTE AQAFSDSTDD KGEVDIIPLR QGFWKANVEH KTDFPDQSVC

   251  QKANYSTLT FQIGHSHH*
```

```
m920-1/g920-1 96.3% identity in 268 aa overlap

                    10        20         30        40        50        60
m920-1.pep MKKTLTLLAVSALFATSAHAHRVWVETAHTHGGEYLKADLGYGEFPELEPIAKDRLHIFS
           |||||||||||||||||||| ||||||||||||||||||||||||||||||||||||||||
g920-1     MKKTLTLLAVSALFATSAHPHRVWVETAHTHGGEYLKADLGYGEFPELEPIAKDRLHIFS
                    10        30         30        40        50        60
```

-continued

```
          70        80        90       100       110       120
m920-1.pep KPMQLVTEKGKENMIQRGTYNYQYRSNRPVKDGSYLVIAEYQPTFQSKNKAGWKQAGIKE
           ||||||||||||||||||||||||||||||||||||| ||||||| ||||||||||||||
g920       KPMQLVTEKGKENMIQRGTYNYQYRSNRPVKDGSYLVTAEYQPTFRSKNKAGWKQAGIKE
                   70        90        90       100       110

          130       140       150       160       170       180
m920-1.pep MPDASYCEQTRMFGKNIVNVGHESADTAIITKPVGQNLEIVPLDNPAHIHVGERFKVRVL
           ||||||||||||||||||||||||||||||||||||||||||||||||||||||||||||
           MPDASYCEQTRMFGKNIVNVGHESADTAIITKPVGQNLEIVPLDNPANIHVGERFKVRVL
                  130       140       150       160       170       180

          190       200       210       220       230       240
m920-1.pep FRGEPLPNATVTATFDGFDTSGRSKTHKTEAQAFSDSTDDKGEVDIIPLRQGFWKANVEH
           ||||||||||||||||||||||||||||||||||||:|| ||||||||||||||||:||:
g920-1     FRGEPLPNATVTATFDGFDTSGRSKTHKTEAQAFSDTTDGKGEVDIIPLRQGFWKASVEY
                  190       200       210       220       230       240

          250       260      269
m920-1.pep KTDFPDQSVCQKQANYSTLTFQIGHSHHX
           |:||||||:|||||||:||||||||||||
g920-1     KADFPDQSLCQKQANYTTLTFQIGHSHHX
                  250       260
```

The following partial DNA sequence was identified in *N. meningitidis* <SEQ ID 2805>:

```
a920.seq
   1 TGAAAGAAAA CATTGACACT GCTCGCCGTT TCCGCCCTAT TTGCCGCATC

  51 CGCCCACGCC CACCGCGTCT GGGTCGAAAC CGCCCACACG CACGGCGGCG

 101 AATACCTTAA AGCCGACTTG GGCTACGGCG AATTTCCCGA ACTCGAACCC

 151 ATCGCCAAAG ACCGCCTGCA CATCTTCAGC AAACCGATGC AGCTGGTTAC

 201 CGAAAAAGGC AAGGAAAACA TGATTCAACG CGGCACATAC AACTACCAGT

 251 ACCGAAGCAA CCGTCCCGTT AAGGACGGCA GTTACCTCGT CATCGCCGAA

 301 TATCAGCCTA CTTTCTGGTC AAAAAACAAA GCAGGCTGGA AACAGGCGGG

 351 CATCAAACAA ATGCCTGACG CAAGCTATTG CGAACAAACC CGAATGTTCG

 401 GCAAAAACAT CGTCAACGTC GGACACGAAA GCGCGGACAC CGCCATCATC

 451 ACCAAACCGG TCGGACAAAA CTTGGAAATC GTCCCGCTGG ACAATCCCGC

 501 CAACATTCAC GTAGGCGAAC GCTTCAAAGT CCGCGTTCTG TTCCGTGGCG

 551 AACCGCTGCC CAATGCCACC GTTACCGCCA CCTTTGACGG CTTCGACACC

 601 AGCGACCGCA GCAAAACGCA CAAAACCGAA GCACAGGCTT TCTCCGACAG

 651 CACAGACGAC AAAGGCGAAG TGGACATCAT CCCCTTGCGC CAAGGCTTCT

 701 GGAAAGCCAA TGTCGAACAC AAAGCCGACT TCCCCGATCA AAGCGTGTGC

 751 CAAAAACAGG CGAACTACTC GACTTTAACC TTCCAAATCG GCCATTCGCA

 801 CCATTAA
```

This corresponds to the amino acid sequence <SEQ ID 2806; ORF 920-1.a>:

```
A920.pep

  1 *KKTLTLLAV SALFAASAHA HRVWVETAHT HGGEYLKADL GYGEFPELEP

 51 IAKDLRHIFS KPMQLVTEKG KENMIQRGTY NYQYRSNRPV KDGSYLVIAE

101 YQPTFWSKNK AGWKQAGIKQ MPDASYCEQT RMFGKNIVNY GHESADTAII

151 TKPVGQNLEI VPLDNPANIH VGERFKVRVL FRGEPLPNAT VTATFDGFDT

201 SDRSKTHKTE AQAFSDSTDD KGEVDIIPLR QGFWKANVEH KADFPDQSVC
```

-continued

```
      251  QKQANYSTLT FQIGHSHH*

    m920-1/a920 98.9% identity in 268 aa overlap

   10        20        30        40        50        60
   m920-1.pep  MKKTLTLLAVSALFATSAHAHRVWVETAHTHGGEYLKADLGYGEFPELEPIAKDRLHIFS
               ||||||||||||||:|||||||||||||||||||||||||||||||||||||||||||||
   a920-1      MKKTLTLLAVSALFAASAHAHRVWVETAHTHGGEYLKADLGYGEFPELEPIAKDRLHIFS
                       10        20        30        40        50        60

   70        80        90        100       110       120
   m920-1.pep  KPMQLVTEKGKENMIQRGTYNYQYRSNRPVKDGSYLVIAEYQPTFWSKNKAGWKQAGIKE
               ||||||||||||||||||||||||||||||||||||||||||||||||||||||||||||:
   a920-1      KPMQLVTEKGKENMIQRGTYNYQYRSNRPVKDGSYLVIAEYQPTFRSKNKAGWKQAGIKQ
                       70        80        90        100       110       120

   130       140       150       160       170       180
   m920-1.pep  MPDASYCEQTRMFGKNIVNVGHESADTAIITKPVGQNLEIVPLDNPANIHVGERFKVRVL
               ||||||||||||||||||||||||||||||||||||||||||||||||||||||||||||
   a920-1      MPDASYCEQTRMFGKNIVNVGHESADTAIITKPVGQNLEIVPLDNPANIHVGERFKVRVL
                      130       140       150       160       170       180

   190       200       210       220       230       240
   m920-1.pep  FRGEPLPNATVTATFDGFDTSDRSKTHKTEAQAFSDSTDDKGEVDIIPLRQGFWKANVEH
               ||||||||||||||||||||||||||||||||||||||||||||||||||||||||||||
   a920-1      FRGEPLPNATVTATFDGFDTSDRSKTHKTEAQAFSDSTDDKGEVDIIPLRQGFWKANVEH
                      190       200       210       220       230       250

   250       260       269
   m920-1.pep  KTDFPDQSVCQKQANYSTLTFQIGHSHHX
               |||||||||||||||||||||||||||||
   a920-1      KADFPDQSVCQKQANYSTLTFQIGHSHHX
                      250       260
```

The following partial DNA sequence was identified in *N. gonorrhoeae* <SEQ ID 2807>:

```
g921.seq
   1 ATGAAAAAAT ACCTTATCCC TCTTTCCATT GCGGCAGTCC TTTCCGggtG

  51 Ccagtctatt tatGtgccca cattgacggA aatccccgTg aatcccatca

 101 ataCCgtcaa aacggaagCA CCTGCAAAAG GTTTTCGCCT CGCCCCTTCG

 151 CATTGGGCGG ATGTTGCCAA AATCAGCGAT GAAGCGACGC GCTTGGGCTA

 201 TCAGGTGGGT ATCGGTAAAA TGACCAAGGT TCAGGcgGCG CAATATCTGA

 251 ACAACTTCAG AAAACGCCTG GTCGGACGCA ATGCCGTCGA TGACAGTATG

 301 TATGAAATCT ACCTGCGTTC GGCGGTAGAC AGCCAGCGCG GCGAAATCAA

 351 TACGGAACAG TCCAAGCTGT ATATCGAGAA TGCCTTGCGC GGCTGGCAGC

 401 AGCGTtggAA AAATATGGAT GCCAAACCCG ATAATCCCGC ATTTACCAAC

 451 TTTTTGATGG AAGTGATGAA GATGCAGCCC TTGAAATGA
```

This corresponds to the amino acid sequence <SEQ ID 2808; ORF 921.ng>:

```
g921.pep
   1 MKKYLIPLSI AAVLSGCQSI YVPTLTEIPV NPINTVKTEA PAKGFRLAPS

  51 HWADVAKISD EATRLGYQVG IGKMTKVQAA QYLNNFRKRL VGRNAVDDSM

 101 YEIYLRSAVD SQRGEINTEQ SKLYIENALR GWQQRWKNMD AKPDNPAFTN

 151 FLMEVMKMQP LK*
```

The following partial DNA sequence was identified in *N. meningitidis* <SEQ ID 2809>:

```
m921.seq
   1 ATGAAAAAAT ACCTTATCCC TCTTTCCATT GCGGCAGTTC TTTCCGGCTG

  51 CCAGTCTATT TATGTGCCCA CATTGACGGA AATCCCCGTG AATCCTATCA
```

-continued

```
101 ATACCGTCAA AACGGAAGCA CCTGCAAAAG GTTTCCGCCT TGCCTCTTCG

151 CATTGGACGG ATGTTGCCAA AATCAGCGAT GAAGCGACGC GCTTGGGCTA

201 TCAGGTGGGT ATCGGTAAAA TGACCAAGGT TCAGGCGGCG CAATATCTGA

251 ACAACTTCAG AAAACGCCTG GTCGGACGCA ATGCCGTCGA TGACAGTATG

301 TATGAAATCT ACCTGCGTTC GGCGATAGAC AGCCAGCGGG GCGCAATCAA

351 TACGGAACAG TCCAAGCTGT ATATCCAGAA TGCCTTGCGC GGCTGGCAGC

401 AGCGTTGGAA AAATATGGAT GTCAAACCCA ACAACCCCGC ATTTACCAAC

451 TTTTTGATGG AAGTGATGAA GATGCAGCCC TTGAAATGA
```

This corresponds to the amino acid sequence <SEQ ID 2810; ORF 921>:

```
m921.pep
  1 MKKYLIPLSI AAVLSGCQSI YVPTLTEIPV NPINTVKTEA PAKGFRLASS

 51 HWTDVAKISD EATRLGYQVG IGKMTKVQAA QYLNNFRKRL VGRNAVDDSM

101 YEIYLRSAID SQRGAINTEQ SKLYIQNALR GWQQRWKNMD VKPNNPAFTN

151 FLMEVMKMQP LK*
```

Computer analysis of this amino acid sequence gave the following results:

Homology with a Predicted ORF from *N. gonorrhoeae*

ORF 921 shows 95.7% identity over a 162 aa overlap with a predicted ORF (ORF 921.ng) from *N. gonorrhoeae*:

```
m921/g921
                  10        20        30        40        50        60
m921.pep  MKKYLIPLSIAAVLSGCQSIYVPTLTEIPVNPINTVKTEAPAKGFRLASSHWTDVAKISD
          |||||||||||||||||||||||||||||||||||||||||||||||| |||:||||||
g921      MKKYLIPLSIAAVLSGCQSIYVPTLTEIPVNPINTVKTEAPAKGFRLAPSHWADVAKISD
                  10        20        30        40        50        60
                  70        80        90       100       110       120
m921.pep  EATRLGYQVGIGKMTKVQAAQYLNNFRKRLVGRNAVDDSMYEIYLRSAIDSQRGAINTEQ
          ||||||||||||||||||||||||||||||||||||||||||||||:||||| |||||
g921      EATRLGYQVGIGKMTKVQAAQYLNNFRKRLVGRNAVDDSMYEIYLRSAVDSQRGEINTEQ
                  70        80        90       100       110       120
                 130       140       150       160
m921.pep  SKLYIQNALRGWQQRWKNMDVKPNNPAFTNFLMEVMKMQPLKX
          |||||:||||||||||||||:||:||||||||||||||||||
g921      SKLYIENALRGWQQRWKNMDAKPDNPAFTNFLMEVMKMQPLKX
                 130       140       150       160
```

The following partial DNA sequence was identified in *N. meningitidis* <SEQ ID 2811>:

```
a921.seq
  1 ATGAAAAAAT ACCTTATCCC TCTTTCCATT GTGGCAGTTC TTTCCGGCTG

 51 CCAGTCTATT TATGTGCCCA CATTGACGGA AATCCCCGTG AATCCTATCA

101 ATACCGTCAA AACGGAAGCA CCTGCAAAAG GTTTCCGCCT TGCCTCTTCG

151 CATTGGACGG ATGTTGCCAA AATCAGCGAT GAAGCGACGC GCTTGGGCTA

201 TCAGGTGGGT ATCGGTAAAA TGACCAAGGT TCAGGCGGCG CAATATCTGA

251 ACAACTTCAG AAAACGCCTG GTCGGACGCA ATGCCGTCGA TGACAGTATG

301 TATGAAATCT ACCTGCGTTC GGCGATAGAC AGCCAGCGGG GCGCAATCAA

351 TACGGAACAG TCCAAGCTGT ATATCCAGAA TGCCTTGCGC GGCTGGCAGC
```

-continued

```
401 AGCGTTGGAA AAATATGGAT GTCAAACCCA ACAACCCCGC ATTTACCAAC

451 TTTTTGATGG AAGTGATGAA GATGCAGCCC TTGAAATGA
```

This corresponds to the amino acid sequence <SEQ ID 2812; ORF 921.a>:

```
a921.pep
   1 MKKYLIPLSI VAVLSGCQSI YVPTLTEIPV NPINTVKTEA PAKGFRLASS

  51 HWTDVAKISD EATRLGYQVG IGKMTKVQAA QYLNNFRKRL VGRNAVDDSM

 101 YEIYLRSAID SQRGAINTEQ SKLYIQNALR GWQQRWKNMD VKPNNPAFTN

 151 FLMEVMKMQP LK*
```

m921/a921 99.4% identity in 162 aa overlap

```
                   10        20        30        40        50        60
m921.pep   MKKYLIPLSIAAVLSGCQSIYVPTLTEIPVNPINTVKTEAPAKGFRLASSHWTDVAKISD
           ||||||||||:|||||||||||||||||||||||||||||||||||||||||||||||||
a921       MKKYLIPLSIVAVLSGCQSIYVPTLTEIPVNPINTVKTEAPAKGFRLASSHWTDVAKISD
                   10        20        30        40        50        60
                   70        80        90       100       110       120
m921.pep   EATRLGYQVGIGKMTKVQAAQYLNNFRKRLVGRNAVDDSMYEIYLRSAIDSQRGAINTEQ
           ||||||||||||||||||||||||||||||||||||||||||||||||||||||||||||
a921       EATRLGYQVGIGKMTKVQAAQYLNNFRKRLVGRNAVDDSMYEIYLRSAIDSQRGAINTEQ
                   70        80        90       100       110       120
                  130       140       150       160
m921.pep   SKLYIQNALRGWQQRWKNMDVKPNNPAFTNFLMEVMKMQPLKX
           |||||||||||||||||||||||||||||||||||||||||||
a921       SKLYIQNALRGWQQRWKNMDVKPNNPAFTNFLMEVMKMQPLKX
                  130       140       150       160
```

The following partial DNA sequence was identified in *N. gonorrhoeae* <SEQ ID 2813>:

```
g922.seq
   1 ATGGAAAAGA GAAAAATACT GCCGCTGGCA ATTTGTTTGG CGGCTTTGTC

  51 TGCCTGTACG GCGATGGAGG CCCGCACACC CCGGGCAAAT GAAGCCCAAG

 101 CCCCCCGCGC GGATGAAATG AAAAAAGAAA GCCGCCCCGC GTTTGACGCG

 151 GCAGCCGTAC CGGTATCCGA CAGCGGGTTT GCCGCCAATG CAAATGTCCG

 201 CCGTTTTGTG GACGATGAAG TCGGGAAAGG GGATTTTTCC CAGGCGGAAT

 251 GGCAGGATTT TTTTGACAAA GCGGCTTACA AGGCGGACAT CGTCAAGATt

 301 ATGCACCGAC CCTCCACATC GCGtCCGTGG TATGtgttcc gCacggGAAa

 351 ttcGGgcagg gcgaaAtttc ACggcgCGCG Caggttttat GcggaaAacc

 401 gcgcggttat cgatgatgtg gcgCAAAAat acggcgtGCC TGCCGAGCTT

 451 ATCGTGGCGA TTATCGGGAT TGAAACGAAT TACGGCAAAA ATACGGGCAG

 501 TTTCCGTGTG GCGGACGCAT TGGCGACTTT AGGCTTTGAT TATCCCCGCC

 551 GCGCCGGGTT TTTCCAAAAA GAATTGGTCG AGCTTTTAAA GCTGGCAAAA

 601 GAAGAAGGCG GTGATGTTTT CGCCTTTAAG GGCagcTATG CGGGTGCAAT

 651 GGGTATGCCG CAATTTATGC CTTCGAGCTA CCGGAAATGG GCGGTGGATT

 701 ATGAcgggga cggacatCGG GATATAtggg GCAACGTcgg tgatgtcgcg

 751 gcatcggTTG CCAATTAtat gaagCAGCAC GGTTGGCGCA CgggcggtAA

 801 AATGTTGGTG TCGGCGAcgt tggcgccggg tgcggATGTT CAggcAATCA
```

-continued

```
 851 TTGGCGAAAA AACCGCCCTG ACGCGGACGG TGGCGGATTT GAaggCGTAc
 901 ggcatcatcc ccggggaaaC GCTCGCAGAT GATGAAAAGg cgGTTTTGTT
 951 CAAACTGGAA ACCGCACCCG GCGTGTTTGA ATATTATTTG GGCTTGAACA
1001 ATTTTTATAC GGTATGGCAG TACAACCACA GCCGGATGTA TGTAACGgcg
1051 gtcaggGACA TTGCCAATTC GCTCGGCGGC CCGGGATTGT Aa
```

This corresponds to the amino acid sequence <SEQ ID 2814; ORF 922.ng>:

```
g922.pep
  1 MEKRKILPLA ICLAALSACT AMEARTPRAN EAQAPRADEM KKESRPAFDA
 51 AAVPVSDSGF AANANVRRFV DDEVGKGDFS QAEWQDFFDK AAYKADIVKI
101 MHRPSTSRPW YVFRTGNSGR AKFHGARRFY AENRAVIDDV AQKYGVPAEL
151 IVAIIGIETN YGKNTGSFRV ADALATLGFD YPRRAGFFQK ELVELLKLAK
201 EEGGDVFAFK GSYAGAMGMP QFMPSSYRKW AVDYDGDGHR DIWGNVGDVA
251 ASVANYMKQH GWRTGGKMLV SATLAPGADV QAIIGEKTAL TRTVADLKAY
301 GIIPGETLAD DEKAVLFKLE TAPGVFEYYL GLNNFYTVWQ YNHSRMYVTA
351 VRDIANSLGG PGL*
```

The following partial DNA sequence was identified in *N. meningitidis* <SEQ ID 2815>:

```
m922.seq
   1 ATGAAAAAGA GAAAAATACT GCCGCTGGCA ATTTGTTTGG CGGCTTTGTC
  51 TGCCTGTACG GCGATGGAGG CACGCCCACC CCGGGCAAAT GAAGCCCAAG
 101 CCCCCCGCGC GGTTGAAATG AAAAAAGAAA GCCGCCCCGC GTTTGACGCG
 151 GCAGCCGTAT TTGACGCGGC AGCCGTACCG GTATCCGACA GCGGGTTTGC
 201 CGCCAATGCA AATGTCCGCC GTTTTGTGGA CGATGAAGTC GGGAAAGGGG
 251 ATTTTTCCCG GGCGGAATGG CAGGATTTTT TTGACAAAGC GGCTTACAAG
 301 GCGGACATCG TCAAGATTAT GCACCGCCCC TCCACATCGC GTCCGTGGTA
 351 TGTGTTCCGC ACGGGAAATT CGGGCAAGGC GAAATTTCGC GGCGCGCGCC
 401 GGTTTTATGC GGAAAACCGC GCGCTTATCG ATGATGTGGC GCAAAAATAC
 451 GGCGTGCCTG CCGAACTTAT CGTGGCGGTT ATCGGGATTG AAACGAATTA
 501 CGGCAAAAAT ACGGGCAGTT TCCGTGTGGC GGACGCATTG GCGACCTTAG
 551 GCTTTGATTA CCCCCGCCGC GCCGGGTTTT TCCAAAAAGA ATTGGTCGAG
 601 CTTTTAAAGC TGGCAAAAGA AGAAGGCGGC GATGTTTTCG CCTTTAAAGG
 651 CAGCTATGCG GGCGCAATGG GGATGCCGCA ATTTATGCCT TCGAGCTACC
 701 GGAAATGGGC GGTGGATTAT GACGGGGACG GACATCGGGA CATATGGGGC
 751 AACGTCGGCG ATGTCGCGGC ATCGGTTGCC AATTATATGA AGCAGCACGG
 801 TTGGCGCACG GGCGGGAAAA TGCTGGTGTC TGCAACATTG GCGCCGGGTG
 851 CGGATGTTCA GGCAATCATT GGCGAAAAAA CCGCCCTGAC GCGGACGGTG
 901 GCGGATTTGA AGGCGTACGG CATCATCCCC GGCGAAGAGC TTGCAGATGA
 951 TGAAAAGGCG GTTTTGTTCA AACTGGAAAC CGCACCGGGC GTGTTTGAAT
1001 ATTATTTGGG CTTGAACAAT TTTTATACGG TATGGCAGTA CAACCACAGC
```

-continued

```
1051 CGGATGTATG TAACGGCGGT CAGGGACATT GCCAATTCGC TTGGCGGCCC

1101 GGGATTGTAA
```

This corresponds to the amino acid sequence <SEQ ID 2816; ORF 922>:

```
m922.pep
   1 MKKRKILPLA ICLAALSACT AMEARPPRAN EAQAPRAVEM KKESRPAFDA

  51 AAVFDAAAVP VSDSGFAANA NVRRFVDDEV GKGDFSRAEW QDFFDKAAYK

 101 ADIVKIMHRP STSRPWYVFR TGNSGKAKFR GARRFYAENR ALIDDVAQKY

 151 GVPAELIVAV IGIETNYGKN TGSFRVADAL ATLGFDYPRR AGFFQKELVE

 201 LLKLAKEEGG DVFAFKGSYA GAMGMPQFMP SSYRKWAVDY DGDGHRDIWG

 251 NVGDVAASVA NYMKQHGWRT GGKMLVSATL APGADVQAII GEKTALTRTV

 301 ADLKAYGIIP GEELADDEKA VLFKLETAPG VFEYYLGLNN FYTVWQYNHS

 351 RMYVTAVRDI ANSLGGPGL*
```

Computer analysis of this amino acid sequence gave the following results:

Homology with a Predicted ORF from *N. gonorrhoeae*

ORF 922 shows 95.9% identity over a 369 aa overlap with a predicted ORF (ORF 922.ng) from *N. gonorrhoeae*:

```
m922/g922
                    10        20        30        40        50        60
m922.pep    MKKRKILPLAICLAALSACTAMEARPPRANEAQAPRAVEMKKESRPAFDAAAVFDAAAVP
            |:||||||||||||||||||||||| ||||||||||| |||||||||||||
g922        MEKRKILPLAICLAALSACTAMEARTPRANEAQAPRADEMKKESRPAFDAA------AVP
                    10        20        30        40        50

                    70        80        90       100       110       120
m922.pep    VSDSGFAANANVRRFVDDEVGKGDFSRAEWQDFFDKAAYKADIVKIMHRPSTSRPWYVFR
            ||||||||||||||||||||||||||:|||||||||||||||||||||||||||||||||
g922        VSDSGFAANANVRRFVDDEVGKGDFSQAEWQDFFDKAAYKADIVKIMHRPSTSRPWYVFR
                60        70        80        90       100       110

                   130       140       150       160       170       180
m922.pep    TGNSGKAKFRGARRFYAENRALIDDVAQKYGVPAELIVAVIGIETNYGKNTGSFRVADAL
            |||||:|||:|||||||||||:|||||||||||||||||:||||||||||||||||||||
g922        TGNSGRAKFHGARRFYAENRAVIDDVAQKYGVPAELIVAIIGIETNYGKNTGSFRVADAL
               120       130       140       150       160       170

                   190       200       210       220       230       240
m922.pep    ATLGFDYPRRAGFFQKELVELLKLAKEEGGDVFAFKGSYAGAMGMPQFMPSSYRKWAVDY
            ||||||||||||||||||||||||||||||||||||||||||||||||||||||||||||
g922        ATLGFDYPRRAGFFQKELVELLKLAKEEGGDVFAFKGSYAGAMGMPQFMPSSYRKWAVDY
               180       190       200       210       220       230

                   250       260       270       280       290       300
m922.pep    DGDGHRDIWGNVGDVAASVANYMKQHGWRTGGKMLVSATLAPGADVQAIIGEKTALTRTV
            ||||||||||||||||||||||||||||||||||||||||||||||||||||||||||||
g922        DGDGHRDIWGNVGDVAASVANYMKQHGWRTGGKMLVSATLAPGADVQAIIGEKTALTRTV
               240       250       260       270       280       290

                   310       320       330       340       350       360
m922.pep    ADLKAYGIIPGEELADDEKAVLFKLETAPGVFEYYLGLNNFYTVWQYNHSRMYVTAVRDI
            |||||||||||| |||||||||||||||||||||||||||||||||||||||||||||||
g922        ADLKAYGIIPGETLADDEKAVLFKLETAPGVFEYYLGLNNFYTVWQYNHSRMYVTAVRDI
               300       310       320       330       340       350

                   370
m922.pep    ANSLGGPGLX
            ||||||||||
g922        ANSLGGPGLX
               370
```

The following partial DNA sequence was identified in *N. meningitidis* <SEQ ID 2817>:

```
a922.seq
     1  ATGAAAAACA GAAAAATACT GCCGCTGGCA ATTTGTTTGG CGGCTTTGTC

    51  TGCCTGTACG GCGATGGAGG CACGCCCGCC CCGGGCAAAT GAAGCCCAAG

   101  CCCCCCGCGC GGATGAAATG AAAAAAGAAA GCCGCCCCGC GTTTGACGCG

   151  GCAGCCGTAT TTGACGCGGC AGCCGTACCG GTATCCGACA GCGGGTTTGC

   201  CGCCAATGCA AATGTCCGCC GTTTTGTGGA CGATGAAGTC GGGAAAGGGG

   251  ATTTTTCCCG GGCGGAATGG CAGGATTTTT TTGACAAAGC GGCTTACAAG

   301  GCGGACATCG TCAAGATTAT GCACCGCCCC TCCACATCGC GTCCGTGGTA

   351  TGTGTTCCGC ACGGGAAATT CGGGCAAGGC GAAATTTCGC GGCGCGCGCC

   401  GGTTTTATGC GGAAAACCGC GCGCTTATCG ATGATGTGGC GCAAAAATAC

   451  GGCGTGCCTG CCGAACTTAT CGTGGCGGTT ATCGGGATTG AAACGAATTA

   501  CGGCAAAAAT ACGGGCAGTT TCCGTGTGGC GGACGCATTG GCGACCTTAG

   551  GCTTTGATTA CCCCCGCCGC GCCGGGTTTT TCCAAAAAGA ATTGGTCGAG

   601  CTTTTAAAGC TGGCAAAAGA AGAAGGCGGC GATGTTTTCG CCTTTAAAGG

   651  CAGCTATGCG GGCGCAATGG GGATGCCGCA ATTTATGCCT TCGAGCTACC

   701  GGAAATGGGC GGTGGATTAT GACGGGGACG GACATCGGGA CATATGGGGC

   751  AATGTTGGCG ATGTCGCGGC ATCGATTGCC AATTATATGA AGCAGCACGG

   801  TTGGCGCACG GGCGGGAAAA TACTGGTGTC TGCAACATTG GCGCCGGGTG

   851  CGGATGTTCA GGCAATCATT GGCGAAAAAA CCGCCCTGAC GCGGACGGTG

   901  GCGGATTTGA AGGCGTACGG CATCATCCCC GGCGAAGAGC TTGCCGATGA

   951  TGAAAAGGCG GTTTTGTTCA AACTGGAAAC CGCACCCGGC GTGTTTGAAT

  1001  ATTATTTGGG CTTGAACAAT TTTTATACGG TATGGCAGTA CAATCACAGT

  1051  CGGATGTATG TAACGGCGGT CAGGGACATT GCCAATTCGC TTGGCGGCCC

  1101  GGGATTGTAA
```

This corresponds to the amino acid sequence <SEQ ID 2818; ORF 922.a>:

```
a922.pep.
   1  MKNRKILPLA ICLAALSACT AMEARPPRAN EAQAPRADEM KKESRPAFDA

  51  AAVFDAAAVP VSDSGFAANA NVRRFVDDEV GKGDFSRAEW QDFFDKAAYK

 101  ADIVKIMHRP STSRPWYVFR TGNSGKAKFR GARRFYAENR ALIDDVAQKY

 151  GVPAELIVAV IGIETNYGKN TGSFRVADAL ATLGFDYPRR AGFFQKELVE

 201  LLKLAKEEGG DVFAFKGSYA GAMGMPQFMP SSYRKWAVDY DGDGHRDIWG

 251  NVGDVAASIA NYMKQHGWRT GGKILVSATL APGADVQAII GEKTALTRTV

 301  ADLKAYGIIP GEELADDEKA VLFKLETAPG VFEYYLGLNN FYTVWQYNHS

 351  RMYVTAVRDI ANSLGGPGL*
```

m922/a922 98.9% identity in 369 aa overlap

```
                    10        20        30        40        50        60
m922.pep    MKKRKILPLAICLAALSACTAMEARPPRANEAQAPRAVEMKKESRPAFDAAAVFDAAAVP
            ||:|||||||||||||||||||||||||||||||||| ||||||||||||||||||||||
a922        MKNRKILPLAICLAALSACTAMEARTPRANEAQAPRADEMKKESRPAFDAAAVFDAAAVP
                    10        20        30        40        50        60
```

-continued

```
                 70        80        90       100       110       120
m922.pep  VSDSGFAANANVRRFVDDEVGKGDFSRAEWQDFFDKAAYKADIVKIMHRPSTSRPWYVFR
          ||||||||||||||||||||||||||||||||||||||||||||||||||||||||||||
a922      VSDSGFAANANVRRFVDDEVGKGDFSRAEWQDFFDKAAYKADIVKIMHRPSTSRPWYVFR
                 70        80        90       100       110       120

                130       140       150       160       170       180
m922.pep  TGNSGKAKFRGARRFYAENRALIDDVAQKYGVPAELIVAVIGIETNYGKNTGSFRVADAL
          ||||||||||||||||||||||||||||||||||||||||||||||||||||||||||||
a922      TGNSGKAKFRGARRFYAENRALIDDVAQKYGVPAELIVAVIGIETNYGKNTGSFRVADAL
                130       140       150       160       170       180

                190       200       210       220       230       240
m922.pep  ATLGFDYPRRAGFFQKELVELLKLAKEEGGDVFAFKGSYAGAMGMPQFMPSSYRKWAVDY
          ||||||||||||||||||||||||||||||||||||||||||||||||||||||||||||
a922      ATLGFDYPRRAGFFQKELVELLKLAKEEGGDVFAFKGSYAGAMGMPQFMPSSYRKWAVDY
                190       200       210       220       230       240

                250       260       270       280       290       300
m922.pep  DGDGHRDIWGNVGDVAASVANYMKQHGWRTGGKMLVSATLAPGADVQAIIGEKTALTRTV
          ||||||||||||||||||:||||||||||||||:||||||||||||||||||||||||||
a922      DGDGHRDIWGNVGDVAASIANYMKQHGWRTGGKILVSATLAPGADVQAIIGEKTALTRTV
                250       260       270       280       290       300

                310       320       330       340       350       360
m922.pep  ADLKAYGIIPGEELADDEKAVLFKLETAPGVFEYYLGLNNFYTVWQYNHSRMYVTAVRDI
          |||||||||||| |||||||||||||||||||||||||||||||||||||||||||||||
g922      ADLKAYGIIPGETLADDEKAVLFKLETAPGVFEYYLGLNNFYTVWQYNHSRMYVTAVRDI
                310       320       330       340       350       360

                370
m922.pep  ANSLGGPGLX
          ||||||||||
a922      ANSLGGPGLX
                370
```

The following partial DNA sequence was identified in *N. gonorrhoeae* <SEQ ID 2819>:

```
g923.seq
  1 ATGAAGCGGC AGGCTTTCTT CAAACCGATG GCGTGTGCGG CATTTCTGTC

 51 CGCCGTTTCG CTGCGCCTCC CCGTATTGGG CGCGTGTTAC GCAATATTGT

101 CCCTCTATGC GTTTGCACTT TACGGCATCG ACAAACGGCG TGCCGTGCGG

151 GGAAAACGCC GCATTCCCGA ACACCGCCTG CTCCTGCCTG CCTTGTTCGG

201 CGGTTGGACG GGCGCATACT TGGGTAGTAG GATGTTCAGG CATAAAACGG

251 CGAAAAAGCG TTTTGTTGTG CTGTTCCGTC TGACTGTTTC GGGCAATGTC

301 CTGGCGACCT GCATCCTGAT TGATTATTTC GTTCCGCCCG AACTTTTTGT

351 AAAACTCGGG CAACATCTCT GA
```

This corresponds to the amino acid sequence <SEQ ID 2820; ORF 923.ng>:

```
g923.pep
  1 MKRQAFFKPM ACAAFLSAVS LRLPVLGACY AILSLYAFAL YGIDKRRAVR

 51 GKRRIPEHRL LLPALFGGWT GAYLGSRMFR HKTAKKRFVV LFRLTVSGNV

101 LATCILIDYF VPPELFVKLG QHL*
```

The following partial DNA sequence was identified in *N. meningitidis* <SEQ ID 2821>:

```
m923.seq
  1 ATGAAGCGGC AGGCTTTCTT CAAACTGATG GCGTGTGCGG CATTTCTGTC

 51 TGCCGTTTCG CTGCGCCTCC CCGTATTGGG CGCGTGTTAC GCAATATTGT
```

-continued

```
101 CCCTCTATGC GTTTGCACTT TACGGCATCG ACAAACGGTG CGCCATACGG

151 GGGCAACGCC GCATTCCCGA ACACCGCCTG CTGCTGCCTG CATTGCTCGG

201 CGGCTGGGTG GGCGCGTATT TCGGCAGCAT GACATTCAAA CATAAGACAG

251 CGAAAAAGCG TTTTGTTGTG CTGTTCCGTC TGACTGTTTC AGGTAATGTC

301 TTGGCGACCC TCATCCTGAT TTATAGTGGA TTAAATTTAA ACCAGTACGG

351 CGTTGCCTCG CCTTGCCGTA CTATTTGTAC TGTCTGCGGC TTCGTCGCCT

401 TGTCCTGATT TTTGTTAATC CACTATAT.T ATTTTGTCCC GCCTGAATTT

451 TTCGTAAAAC TCGGGCAGAA TACCTGA
```

This corresponds to the amino acid sequence <SEQ ID 2822; ORF 923>:

```
m923.pep
  1 MKRQAFFKLM ACAAFLSAVS LRLPVLGACY AILSLYAFAL YGIDKRCAIR

 51 GQRRIPEHRL LLPALLGGWV GAYFGSMTFK HKTAKKRFVV LFRLTVSGNV

101 LATLILIYSG LNLNQYGVAS PCRTICTVCG FVALS*FLLI HYXYFVPPEF

151 FVKLGQNT*
```

Computer analysis of this amino acid sequence gave the following results:

Homology with a Predicted ORF from *N. gonorrhoeae*

ORF 923 shows 68.8% identity over a 157 aa overlap with a predicted ORF (ORF 923.ng) from *N. gonorrhoeae*:

```
g923/m923
                 10        20        30        40        50        60
g923.pep  MKRQAFFKPMACAAFLSAVSLRLPVLGACYAILSLYAFALYGIDKRRAVRGKRRIPEHRL
          |||||||| ||||||||||||||||||||||||||||||||||||| |:||:|||||||
m923      MKRQAFFKLMACAAFLSAVSLRLPVLGACYAILSLYAFALYGIDKRCAIRGQRRIPEHRL
                 10        20        30        40        50        60

                 70        80        90       100
g923.pep  LLPALFGGWTGAYLGSRMFRHKTAKKRFVVLFRLTVSGNVLATCILID------------
          |||||:|||:|||:||   |:||||||||||||||||||||||| |||
m923      LLPALLGGWVGAYFGSMTFKHKTAKKRFVVLFRLTVSGNVLATLILIYSGLNLNQYGVAS
                 70        80        90       100       110       120

                                110       120
g923.pep  -----------------------YFVPPELFVKLGQHLX
                                 ||||||||:||:
m923      PCRTICTVCGFVALSXFLLIHYIYFVPPEFFVKLGQNTX
                130       140       150
```

The following partial DNA sequence was identified in *N. meningitidis* <SEQ ID 2823>:

```
a923.seq
  1 ATGAAGCGGC AGGCTTTCTT CAAACTGATG GCGTGTGCGG CATTTCTGTC

 51 TGCCGTTTCG CTGCGCCTCC CCGTATTGGG CGCGTGTTAC GCAATATTGT

101 CCCTCTATGC GTTTGCACTT TACGGCATCG ACAAACGGCG TGCCGTGCGG

151 GGAAAACGCC GCATTCCCGA ACACCGCCTG CTGCTGCCTG CCTTGTTCGG

201 CGGTTGGGCG GGCGCATACT TGGGCAGCAG GATATTCAGG CATAAAACGG

251 CGAAAAAGCG TTTTGTTGTG CTGTTCCGTC TGACTGTTTC GGGCAATGTC

301 CTGGCGACCC TCATCCTGAT TTATAGTGGA TTAAATTTAA ACCAGTACGG

351 CGTTGCCTCG CCTTA.GCTC AAAGAGAACG ATTCTCTAAG GTGCTGAAGC
```

-continued

```
401 ACCAAGTGAA TCGGTTCCGT ACTATTTGTA CTGTCTGCGG CTTCGTCGCC

451 TTGTCCTGAT TTTTGTTAAT CCACTAT.AT TATTTTGTCC CGCCTGAATT

501 TTTCGTAAAA CTCGGGCAGA ATACCTGA
```

This corresponds to the amino acid sequence <SEQ ID 2824; ORF 923.a>:

```
a923.pep
  1 MKRQAFFKLM ACAAFLSAVS LRLPVLGACY AILSLYAFAL YGIDKRRAVR

 51 GKRRIPEHRL LLPALFGGWA GAYLGSRIFR HKTAKKRFVV LFRLTVSGNV

101 LATLILIYSG LNLNQYGVAS PXAQRERFSK VLKHQVNRFR TICTVCGFVA

151 LS*FLLIHYX YFVPPEFFVK LGQNT*
```

m923/a923 84.6% identity in 175 aa overlap

```
                   10        20        30        40        50        60
m923.pep   MKRQAFFKLMACAAFLSAVSLRLPVLGACYAILSLYAFALYGIDKRCAIRGQRRIPEHRL
           ||||||||||||||||||||||||||||||||||||||||||||||| |:||:|||||||
a923       MKRQAFFKLMACAAFLSAVSLRLPVLGACYAILSLYAFALYGIDKRRAVRGKRRIPEHRL
                   10        20        30        40        50        60

                   70        80        90       100       110       120
m923.pep   LLPALLGGWVGAYFGSMTFKHKTAKKRFVVLFRLTVSGNVLATLILIYSGLNLNQYGVAS
           |||||:|||:|||:||  |:||||||||||||||||||||||||||||||||||||||||
a923       LLPALFGGWAGAYLGSRIFRHKTAKKRFVVLFRLTVSGNVLATLILIYSGLNLNQYGVAS
                   70        80        90       100       110       120

                                   130       140       150      159
m923.pep   PC-----------------RTICTVCGFVALSXFLLIHYXYFVPPEFFVKLGQNTX
           |                  |||||||||||||||||||||||||||||||||||||
a923       PXAQRERFSKVLKHQVNRFRTICTVCGFVALSXFLLIHYXYFVPPEFFVKLGQNTX
                  130       140       150       160       170
```

The following partial DNA sequence was identified in *N. gonorrhoeae* <SEQ ID 2825>:

```
g925.seq
  1 ATGAAACAAA TGCTTTTGGC cgtcggcgtg ggcGCGGTGT TGGCGGGCTG

 51 CGGCAaggat gcCGGCGGtt acgagggtTA TTGGCGCGAA AAGTCGGACA

101 AAAAagaggG CGTGATTGCC GTCAAAAAAA AAGGCAATTA CTTCCTTAAT

151 AAAATCAACG TGTTTACAGG CAAGGAGGAG TCTTTGCTTT TGTCTGAAAA

201 AGACGGCGCG CTTTCGATAA ACACGGGGAT AGGGGAAATC CCGATCAAAC

251 TTTCCGACGA CGGGAAAGAG CTGTATGTCG AACGCAGGCG GTATGTGAAA

301 ACCGATGCGG CGATGAAGGA CAAAATCATC GCCCACCAGA AAAAGTGCGG

351 ACAAACGGCA CAGGCATACC TCGACGCGCG AAATGCGTTG CCGTCAAACC

401 AAACGTATCA GCAGCGTCAG GCGGCGATCG AGCAATTGAA ACGGCGGTTT

451 GAAGCCGAGT TTGACGAATT GGAAAAAGAA ATCAAATGCA ACGGCAAACC

501 GACATTGTTG TTTTAG
```

This corresponds to the amino acid sequence <SEQ ID 2826; ORF 925.ng>:

```
g925.pep
  1 MKQMLLAVGV GAVLAGCGKD AGGYEGYWRE KSDKKEGVIA VKKKGNYFLN
```

-continued

```
 51 KINVFTGKEE SLLLSEKDGA LSINTGIGEI PIKLSDDGKE LYVERRRYVK

101 TDAAMKDKII AHQKKCGQTA QAYLDARNAL PSNQTYQQRQ AAIEQLKRRF

151 EAEFDELEKE IKCNGKPTLL F*
```

The following partial DNA sequence was identified in *N. meningitidis* <SEQ ID 2827>:

```
m925.seq (partial)
  1 ATGAAACAAA TGCTTTTAGC CGTCGGCGTG GTGGCGGTGT TGGCGGGCTG

 51 CGGCAAGGAT GCCGGCGGTT ACGAGGGTTA TTGGCGCGAA AAGTCGGACA

101 AAAAAGAGGG TATGATTGCC GTCAAAAAAG AAAAAGGCAA TTACTTCCTT
    .......
```

This corresponds to the amino acid sequence <SEQ ID 2828; ORF 925>:

```
m925.pep (partial)
  1 MKQMLLAVGV VAVLAGCGKD AGGYEGYWRE KSDKKEGMIA VKKEKGNYFL..
```

(In m925.pep, "MKQMLLAVGV VAVLAG" is underlined.)

Computer analysis of this amino acid sequence gave the following results:

Homology with a Predicted ORF from *N. gonorrhoeae*

ORF 925 shows 94.0% identity over a 50 aa overlap with a predicted ORF (ORF 925.ng) from *N. gonorrhoeae*:

```
m925/g925
                  10        20        30        40        50
m925.pep  MKQMLLAVGVVAVLAGCGKDAGGYEGYWREKSDKKEGMIAVKKEKGNYFL
          ||||||||| |||||||||||||||||||||||||||:||||| ||||||
g925      MKQMLLAVGVGAVLAGCGKDAGGYEGYWREKSDKKEGVIAVKK-KGNYFLNKINVFTGKE
                  10        20        30        40         50

g925      ESLLLSEKDGALSINTGIGEIPIKLSDDGKELYVERRRYVKTDAAMKDKIIAHQKKCGQT
        60        70        80        90       100       110
```

The following partial DNA sequence was identified in *N. gonorrhoeae* <SEQ ID 2829>:

```
g925-1.seq
  1 ATGAAACAAA TGCTTTTGGC CGTCGGCGTG GCGGCGGTGT TGGCGGGCTG

 51 CGGCAAGGAT GCCGGCGGTT ACGAGGGTTA TTGGCGCGAA AAGTCGGACA

101 AAAAAGAGGG CGTGATTGCC GTCAAAAAAA AAGGCAATTA CTTCCTTAAT

151 AAAATCAACG TGTTTACAGG CAAGGAGGAG TCTTTGCTTT TGTCTGAAAA

201 AGACGGCGCG CTTTCGATAA ACACGGGGAT AGGGGAAATC CCGATCAAAC

251 TTTCCGACGA CGGGAAAGAG CTGTATGTCG AACGCAGGCG GTATGTGAAA

301 ACCGATGCGG CGATGAAGGA CAAAATCATC GCCCACCAGA AAAAGTGCGG

351 ACAAACGGCA CAGGCATACC TCGACGCGCG AAATGCGTTG CCGTCAAACC

401 AAACGTATCA GCAGCGTCAG GCGGCGATCG AGCAATTGAA ACGGCGGTTT

451 GAAGCCGAGT TTGACGAATT GGAAAAAGAA ATCAAATGCA ACGGCAAACC

501 GACATTGTTG TTTTAG
```

This corresponds to the amino acid sequence <SEQ ID 2830; ORF 925-1.ng>:

```
g925-1.pep
  1 MKQMLLAVGV AAVLAGCGKD AGGYEGYWRE KSDKKEGVIA VKKKGNYFLN
```

(In g925-1.pep, "MKQMLLAVGV AAVLAG" is underlined.)

```
 51 KINVFTGKEE SLLLSEKDGA LSINTGIGEI PIKLSDDGKE LYVERRRYVK

101 TDAAMKDKII AHQKKCGQTA QAYLDARNAL PSNQTYQQRQ AAIEQLKRRF

151 EAEFDELEKE IKCNGKPTLL F*
```

The following partial DNA sequence was identified in *N. meningitidis* <SEQ ID 2831>:

```
m925-1.seq
  1 ATGAAACAAA TGCTTTTAGC CGTCGGCGTG GTGGCGGTGT TGGCGGGCTG

 51 CGGCAAGGAT GCCGGCGGTT ACGAGGGTTA TTGGCGCGAA AAGTCGGACA

101 AAAAGAGGG TATGATTGCC GTCAAAAAAG AAAAAGGCAA TTACTTCCTT

151 AATAAAATCC ACGTGGTTAC AGGCAAGGAA GAGTCCTTGC TTTTGTCTGA

201 AAAAGACGGC GCGCTTTCGA TAAACACAGG GATAGGGGAA ATCCCGATCA

251 AACTTTCCGA CGACGGGAAA GAGCTGTATG TCGAACGTAG GCAGTATGTC

301 AAAACCGATG CGGCGATGAA GGACAAAATC ATCGCCCATC AGAAAAAGTG

351 CGGACAAACA GCACAGGCAT ACCGCGACGC GCGAAATGCG TTGCCGTCAA

401 ACCAGACGTA TCAGCAGCAT CTGGCGGCGA TCGAGCAATT GAAACGGCGG

451 TTTGAAGCCG AGTTTGACGA ATTGGAAAAA GAAATCAAAT GCAACGGCAG

501 AAGCCCGGCA TTGTTGCTTT AG
```

This corresponds to the amino acid sequence <SEQ ID 2832; ORF 925-1>:

```
  m925-1.pep

     1 MKQMLLAVGV VAVLAGCGKD AGGYEGYWRE KSDKKEGMIA VKKEKGNYFL

    51 NKIHVVTGKE ESLLLSEKDG ALSINTGIGE IPIKLSDDGK ELYVERRQYV

   101 KTDAAMKDKI IAHQKKCGQT AQAYRDARNA LPSNQTYQQH LAAIEQLKRR

   151 FEAEFDELEK EIKCNGRSPA LLL*

  m925/g925  92.5% identity in 173 aa overlap

          10         20         30         40         50         60
m925-1.pep MKQMLLAVGVVAVLAGCGKDAGGYEGYWREKSDKKEGMIAVKKEKGNYFLNKIHVVTGKE
           ||||||||||:||||||||||||||||||||||||||:|||||  |||||||||:| ||||
g925-1     MKQMLLAVGVAAVLAGCGKDAGGYEGYWREKSDKKEGVIAVKK-KGNYFLNKINVFTGKE
                    10         20         30         40         50

          70         80         90        100        110        120
m925-1.pep ESLLLSEKDGALSINTGIGEIPIKLSDDGKELYVERRQYVKTDAAMKDKIIAHQKKCGQT
           |||||||||||||||||||||||||||||||||||||:||||||||||||||||||||||
g925-1     ESLLLSEKDGALSINTGIGEIPIKLSDDGKELYVERRRYVKTDAAMKDKIIAHQKKCGQT
                    60         70         80         90        100        110

          130        140        150        160        170
m925-1.pep AQAYRDARNALPSNQTYQQHLAAIEQLKRRFEAFDELEKEIKCNGRSPALLLX
           ||||  |||||||||||||:||||||||||||||||||||||||||: |:||:|
           AQAYLDARNALPSNQTYQQRQAAIEQLKRRFEAFDELEKEIKCNGK-PTLLFX
                    120        130        140        150        160        170
```

The following partial DNA sequence was identified in *N. meningitidis* <SEQ ID 2833>:

```
a925-1.seq
  1 AATAAAATCA ACGTGTTTAC AGGTAAGGAA GAATCTATGC TTTTGTCTGA

 51 AAAAGACGGC GCGCTTTCGA TAAACACGGG GATAGGGGAA ATCCCGATCA

101 AACTTTCCGA CGACGGGAAA GAGCTGTATG TCGAACGCAG GCAGTATGTC
```

-continued
```
151 AAAACCGATG CGGCGATGAA GGACAAAATC ATCGCCCATC AGAAAAAGTG

201 CGGACAAACG GCACAGGCAT ATCTCGACGC GCGAAATGCG TTGCCGTCAA

251 ACCAGACGTA TCAGCAGCAT CAGGCGGCGA TCGAGCAGTT GAAACGGCGG

301 TTTGAAGCCG AGTTTGACGA ATTGGAAAAA GAAATCAAAT GCAACGGCAA

351 ACCGACATTG TTGTTTTAG
```

This corresponds to the amino acid sequence <SEQ ID 2834; ORF 925-1.a>:

```
a925-1.pep

    1 NKINVFTGKE ESMLLSEKDG ALSINTGIGE IPIKLSDDGK ELYVERRQYV

   51 KTDAAMKDKI IAHQKKCGQT AQAYLDARNA LPSNQTYQQH QAAIEQLKRR

  101 FEAEFDELEK EIKCNGKPTL LF*

a925-1/m925-1  92.7% identity in 123 aa overlap

                                           10        20        30
    a925-1.pep                     NKINVFTGKEESMLLSEKDGALSINTGIGE
                                   |||:| ||||||:||||||||||||||||||
    m925-1    AGGYEGYWREKSDKKEGMIAVKKEKGNYFLNKIHVVTGKEESLLLSEKDGALSINTGIGE
               30        40        50        60        70        80

              40        50        60        70        80        90
    a925-1.pep IPIKLSDDGKELYVERRQYVKTDAAMKDKIIAHQKKCGQTAQAYLDARNALPSNQTYQQH
               ||||||||||||||||||||||||||||||||||||||||||||:|||||||||||||||
    m925-1    IPIKLSDDGKELYVERRQYVKTDAAMKDKIIAHQKKCGQTAQAYRDARNALPSNQTYQQH
              90       100       110       120       130       140

             100       110       120
    a925-1.pep QAAIEQLKRRFEAEFDELEKEIKCNGK-PTLLFX
               ||||||||||||||||||||||||||:| :|||:|
    m925-1    LAAIEQLKRRFEAEFDELEKEIKCNGRSPALLLX
              150       160       170
```

The following partial DNA sequence was identified in *N. gonorrhoeae* <SEQ ID 2835>:

```
g926.seq (partial)
   1 ATGAAACACA CCGTATCCGC ATCGGTCATC CTGCTTTTGA CCGCTTGCGC

  51 GCAATTACCT CAAAATAACG AAAACCTGTG GCAGCCGTCC GAACACATCA

 101 GCAGTTTTGC AGCGGAAGGG CGGTTGGCAG TCAAAGCGGA AGGGAAAGGT

 151 TCGTATGCAA ATTTCGATTG GACATACCAA CCGCCCGTGG AAACCATCAA

 201 TATCAACACC CCTTTGGGCA GTACGCTCGG ACAGTTGTGT CAAGacAGGG

 251 ACGGCGCATT GGCAGTGGAC GGCAAAGGAA ATGTCTATCA GGCAGAGGGT

 301 ACGgaagact tGAGCAGGCA GCTGGTCGGT TTCAAACTGC CAATCCAATA

 351 TCTGCATATC TGGGCGGAAG GCAGGCGTGT GGCGGGCGCG CCTtaccGCA

 401 TCCGTTCAGA CGGCATATTG GAACAATAcg GttggACAAT cgggCagaac

 451 tgcCGACAGT GGGGGGCaag tccgaacgtt gcaactGAa...
```

This corresponds to the amino acid sequence <SEQ ID 2836; ORF 926.ng>:

```
g926.pep (partial)
   1 MKHTVSASVI LLLTACAQLP QNNENLWQPS EHISSFAAEG RLAVKAEGKG

  51 SYANFDWTYQ PPVETININT PLGSTLGQLC QDRDGALAVD GKGNVYQAEG
```

-continued

```
101 TEDLSRQLVG FKLPIQYLHI WAEGRRVAGA PYRIRSDGIL EQYGWTIGQN

151 CRQWGASPNV ATE...
```

The following partial DNA sequence was identified in *N. meningitidis* <SEQ ID 2837>:

```
m926.seq
   1 ATGAAACACA CCGTATCCGC ATCGGTCATC CTGCTTTTGA CCGCTTGCGC

  51 GCAATTACCT CAAAATAACG AAAACCTGTG GCAGCCGTCC GAACACATCA

 101 GCAGTTTTGC AGCAGAAGGG CGGTTGGCAG TGAAAGCGGA AGGGAAAGGT

 151 TCGTATGCAA ATTTCGATTG GACATACCAA CCGCCCGTGG AAACCATCAA

 201 TATCAATACC CCTTTGGGCA GTACGCTCGG GCAGTTGTGT CAAGACAGGG

 251 ACGGCGCATT GGCAGTGGAC GGCAAAGGAA ATGTCTATCA GGCGGAAAGT

 301 GCGGAAGAAT TGAGCAGGCA GCTGGTCGGT TTCAAACTGC CAATCCAATA

 351 TCTGCATATC TGGGCAGATG GCAGGCGTGT GGCGGGCGCG CCTTACCGCA

 401 TCCTGCCGGA CGGCATATTG GAACAATACG GTTGGACTGT CGGCAGAACC

 451 GCCGACAGTG GGGGGCAAGT CCGAACGTTG CAACTGAATA ACGGAAATTT

 501 GAACATCAGG CTGGTTTTCA CCGAAATCGG TATGCCGTCT GAAACCGAAA

 551 CCCCGGAACG CTGTGCGGCG CGCACGAGAT AA
```

This corresponds to the amino acid sequence <SEQ ID 2838; ORF 926>:

```
m926.pep

      1 MKHTVSASVI LLLTACAQLP QNNENLWQPS EHISSFAAEG RLAVKAEGKG

     51 SYANFDWTYQ PPVETININT PLGSTLGQLC QDRDGALAVD GKGNVYQAES

    101 AEELSRQLVG FKLPIQYLHI WADGRRVAGA PYRILPDGIL EQYGWTVGRT

    151 ADSGGQVRTL QLNNGNLNIR LVFTEIGMPS ETETPERCAA RTR*

g926/m926  91.6% identity in 155 aa overlap

                   10        20        30        40        50        60
g926.pep    MKHTVSASVILLLTACAQLPQNNENLWQPSEHISSFAAEGRLAVKAEGKGSYANFDWTYQ
            ||||||||||||||||||||||||||||||||||||||||||||||||||||||||||||
m926        MKHTVSASVILLLTACAQLPQNNENLWQPSEHISSFAAEGRLAVKAEGKGSYANFDWTYQ
                   10        20        30        40        50        60

                   70        80        90       100       110       120
g926.pep    PPVETININTPLGSTLGQLCQDRDGALAVDGKGNVYQAEGTEDLSRQLVGFKLPIQYLHI
            |||||||||||||||||||||||||||||||||||||||::|:|||||||||||||||||
m926        PPVETININTPLGSTLGQLCQDRDGALAVDGKGNVYQAESAEELSRQLVGFKLPIQYLHI
                   70        80        90       100       110       120

                  130       140       150       160
g926.pep    WAEGRRVAGAPYRIRSDGILEQYGWTIGQNCRQWGASPNVATE
            ||:|||||||||||  ||||||||||:|::   :  |
m926        WADGRRVAGAPYRILPDGILEQYGWTVGRTADSGGQVRTLQLNNGNLNIRLVFTEIGMPS
                  130       140       150       160       170       180

a926.seq

      1 ATGAAACACA CTGTATCCGC ATCGGTCATC CTGCTTTTGA CCGCTTGCGC

     51 GCAATTACCT CAAAATAACG AAAACCTGTG GCAGCCGTCC GAACACACCC

    101 GCAGTTTCAC GGCGGAAGGG CGGTTGGCAG TGAAAGCGGA AGGGAAAGGT

    151 TCGTATGCAA ATTTCGATTG GACATACCAA CCGCCCGTGG AAACCATCAA

    201 TATCAACACC CCTTTGGGCA GTACGCTCGG GCAGTTGTGT CAAGACAGGG

    251 ACGGCGCATT GGCAGTGGAC GGCAAAGGAA ATGTCTATCA GGCGGAAAGT
```

-continued

```
301 GCGGAAGAAT TGAGCAGGCA GCTGGTCGGT TTCAAACTGC CAATCCAATA

351 TCTGCATATC TGGGCAGATG GCAGGCCTGT GGCGGGCGCG CCTTACCGCA

401 TCCTGCCGGA CGGCATATTG GAACAATACG GTTGGACTGT CGGCAGAACC

451 GCCGACAGTG GGGGGCAAGT CCGAACGTTG CAACTGAATA ACGGAAATTT

501 GAACATCAGG CTGGTTTTCA CCGAGATTGG TATGAAGTCT GAAACCGAAA

551 CCCAAGAACA ATGCGCGGCA CGCATACAGT AA
```

a926.pep

```
  1 MKHTVSASVI LLLTACAQLP QNNENLWQPS EHTRSFTAEG RLAVKAEGKG

 51 SYANFDWTYQ PPVETININT PLGSTLGQLC QDRDGALAVD GKGNVYQAES

101 AEELSRQLVG FKLPIQYLHI WADGRPVAGA PYRILPDGIL EQYGWTVGRT

151 ADSGGQVRTL QLNNGNLNIR LVFTEIGMPS ETETQEQCAA RIQ*
```

m926/a926 96.9% identity in 191 aa overlap

```
                    10        20        30        40        50        60
m926.pep    MKHTVSASVILLLTACAQLPQNNENLWQPSEHISSFAAEGRLAVKAEGKGSYANFDWTYQ
            ||||||||||||||||||||||||||||||||  ||:|||||||||||||||||||||||
a926        MKHTVSASVILLLTACAQLPQNNENLWQPSEHTRSFTAEGRLAVKAEGKGSYANFDWTYQ
                    10        20        30        40        50        60

                    70        80        90       100       110       120
m926.pep    PPVETININTPLGSTLGQLCQDRDGALAVDGKGNVYQAESAEELSRQLVGFKLPIQYLHI
            ||||||||||||||||||||||||||||||||||||||||||||||||||||||||||||
a926        PPVETININTPLGSTLGQLCQDRDGALAVDGKGNVYQAESAEELSRQLVGFKLPIQYLHI
                    70        80        90       100       110       120

                   130       140       150       160       170       180
m926.pep    WADGRRVAGAPYRILPDGILEQYGWTVGRTADSGGQVRTLQLNNGNLNIRLVFTEIGMPS
            ||||| ||||||||||||||||||||||||||||||||||||||||||||||||||||||
a926        WADGRPVAGAPYRILPDGILEQYGWTVGRTADSGGQVRTLQLNNGNLNIRLVFTEIGMPS
                   130       140       150       160       170       180

                   190
m926.pep    ETETPERCAARTRX
            |||| |:||||
a926        ETETQEQCAARIQX
                   190
```

The following partial DNA sequence was identified in *N. gonorrhoeae* <SEQ ID 2839>:

g927.seq

```
  1 atgaaaacct acGCAcAggC ACTCTATacc GCAGCCCTGC TCACCGCCTG

 51 CAGCCCCgca GCcgatTcaa accaTCCGTC CGGAcAaAAT GCCCCGGCCA

101 ATACCGAATC cgacGgaaAA AACATtaccC TGctcaatgc cTcgtacgat

151 gtGACACGGT ATTTttacaa agaatacgac cacTtgtttg tcggaaCATA

201 CCAATCCGAA CACCCCGGCA CATCCGTCAG CATCCAACAA TCCCACGGCG

251 GCTTCAGCAA ACAGGCATTA TCCGTAGCCA ACGGCCTTCA AGCCGATGTC

301 GTAACCATGA ACCAATCTTC CGACATCGAC CTGCTCGAAA AAAA.GGACT

351 GGTAGAAAAA GGCTGGCAAC AAGCCCTCCC CGATCACGCC GCACCCTACA

401 CCAGCACTAT GGTTTTCCTT GTCCGAAAAA ACAACCCcaa ACAGAtccgC

451 GATTGGAACG ACCTTGCCAA AGACGGCGTT AACATCGTCA TCGCCAAGAC

501 CTCGGGCAAC GGACGCTACG CCTTCCTCGG CGCATACGGT TACGGTCTGA

551 AAGCCAACAA CGGcaaCGAG CAGGAAGCCC AAAAACTCGT CGCATCCATC

601 CTCAAAAACA CACCCGTTTT TGAAAACGGC GGACGCGc.C CGCCGCCACC
```

-continued

```
651 ACCTTCACAC AACGCAACAT CGGCGACGTA CTCATCACTT TTGAAAACga

701 agCcaactac gtCAGCAAAA AACTGA
```

This corresponds to the amino acid sequence <SEQ ID 2840; ORF 927.ng>:

```
g927.pep
  1 MKTYAQALYT AALLTACSPA ADSNHPSGQN APANTESDGK NITLLNASYD

 51 VTRYFYKEYD HLFVGTYQSE HPGTSVSIQQ SHGGFSKQAL SVANGLQADV

101 VTMNQSSDID LLEKXGLVEK GWQQALPDHA APYTSTMVFL VRKNNPKQIR

151 DWNDLAKDGV NIVIAKTSGN GRYAFLGAYG YGLKANNGNE QEAQKLVASI

201 LKNTPVFENG GRXPPPPPSH NATSATYSSL LKTKPTTSAK N*
```

The following partial DNA sequence was identified in *N. meningitidis* <SEQ ID 2841>:

```
m927.seq
  1 ATGAAAACCT ACGCACCGGC ACTCTATACC GCAGCCCTGC TCACCGCCTG

 51 CAGCCCCGCA GCCGATTCAA ACCATCCGTC CGGACAAAAT GCCCCGGCCA

101 ATACCGAATC CGACGGAAAA AACATTACCC TGCTCAACGC CTCATACGAT

151 GTGGCACGGG ATTTTTACAA AGAATACAAC CCCTTATTTA TCAAAACATA

201 CCAATCCGAA CACCCCGGCA CATCCGTCAG CATCCAACAG TCCCACGGCG

251 GCTCCAGCAA ACAGGCATTA TCCGTAGCCA ACGGCCTTCA AGCCGATGTC

301 GTAACCATGA ACCAATCCTC CGACATCGAC CTGCTCGAAA AAAAAGGACT

351 GGTAGAAAAA GGCTGGCAAC AAGCCCTCCC CGACCACGCC GCGCCCTACA

401 CCAGCACTAT GGTTTTCCTT GTCCGAAAAA ACAACCCCAA ACAGATCCGC

451 GATTGGAACG ACCTTGCCAA AGACGGCGTT AACATCGTCA TCGCCAATCC

501 CAAAACCTCG GGCAACGGAC GCTACGCCTT CCTCGGCGCA TACGGTTACG

551 GTCTGAAAAC CACCAACGGC AACGAACAGG AAGCCCAAAA ACTCGTCGCA

601 TCCATCCTCA AAAACACCCC CGTTTTTGAA AACGGCGGAC GCkCgCCACC

651 ACCACCTTCA CACAACGCAA CATCGGCGAC GTACTCATCA CTTTTGAAAA

701 CGAAGCCAAC TACGTCAGCr AAAAACtGA
```

This corresponds to the amino acid sequence <SEQ ID 2842; ORF 927>:

```
m927.pep
  1MKTYAPALYT AALLTACSPA ADSNHPSGQN APANTESDGK NITLLNASYD

 51VARDFYKEYN PLFIKTYQSE HPGTSVSIQQ SHGGSSKQAL SVANGLQADV

101VTMNQSSDID LLEKKGLVEK GWQQALPDHA APYTSTMVFL VRKNNPKQIR

151DWNDLAKDGV NIVIANPKTS GNGRYAFLGA YGYGLKTTNG NEQEAQKLVA

201SILKNTPVFE NGGRXPPPPS HNATSATYSS LLKTKPTTSA KN*
```

Computer analysis of this amino acid sequence gave the following results:

Homology with a Predicted ORF from *N. gonorrhoeae*

ORF 927 shows 94.2% identity over a 243 aa overlap with a predicted ORF (ORF 927.ng) from *N. gonorrhoeae*:

```
g927/m927
                    10        20        30        40        50        60
g927.pep   MKTYAQALYTAALLTACSPAADSNHPSGQNAPANTESDGKNITLLNASYDVTRYFYKEYD
           ||||| ||||||||||||||||||||||||||||||||||||||||||||||:| |||||:
m927       MKTYAPALYTAALLTACSPAADSNHPSGQNAPANTESDGKNITLLNASYDVARDFYKEYN
                    10        20        30        40        50        60
                    70        80        90       100       110       120
g927.pep   HLFVGTYQSEHPGTSVSIQQSHGGFSKQALSVANGLQADVVTMNQSSDIDLLEKXGLVEK
            ||: |||||||||||||||||||| |||||||||||||||||||||||||||||| |||||
m927       PLFIKTYQSEHPGTSVSIQQSHGGSSKQALSVANGLQADVVTMNQSSDIDLLEKKGLVEK
                    70        80        90       100       110       120
                   130       140       150       160         170
g927.pep   GWQQALPDHAAPYTSTMVFLVRKNNPKQIRDWNDLAKDGVNIVIA--KTSGNGRYAFLGA
           |||||||||||||||||||||||||||||||||||||||||||||  |||||||||||||
m927       GWQQALPDHAAPYTSTMVFLVRKNNPKQIRDWNDLAKDGVNIVIANPKTSGNGRYAFLGA
                   130       140       150       160       170       180
          180       190       200       210       220       230
g927.pep   YGYGLKANNGNEQEAQKLVASILKNTPVFENGGRXPPPPPSHNATSATYSSLLKTKPTTS
           ||||||::|||||||||||||||||||||||||||||||| |||||||||||||||||||
m927       YGYGLKTTNGNEQEAQKLVASILKNTPVFENGGRXPPPP-SHNATSATYSSLLKTKPTTS
                   190       200       210        220       230
          240
g927.pep   AKNX
           ||||
m927       AKNX
          240
```

The following partial DNA sequence was identified in *N. meningitidis* <SEQ ID 2843>:

```
a927.seq
    1 ATGAAAACCT ACGCACCGGC ACTCTATACC GCAGCCCTGC TCAGCGCCTG

   51 CAGCCCCGCA GCCGATTCAA ACCATCCGTC CGGACAAAAT GCCCCGGCCA

  101 ATACCGAATC CGACGGAAAA AACATTACCC TGCTCAACGC CTCATACGAT

  151 GTGGCACGGG ATTTTTACAA AGAATACAAC CCCTTATTTA TCAAAACATA

  201 CCAATCCGAA CACCCCGGCA CATCCGTCAG CATCCAACAG TCCCACGGCG

  251 GCTCCAGCAA ACAGGCATTA TCCGTAGCCA ACGGCCTTCA AGCCGATGTC

  301 GTAACCATGA ACCAATCCTC CGACATCGAC CTGCTCGAAA AAAAAGGACT

  351 GGTAGAAAAA GGCTGGCAAC AAGCCCTCCC CGACCACGCC GCGCCCTACA

  401 CCAGCACTAT GGTTTTCCTT GTCCGAAAAA ACAACCCCAA ACAGATCCGC

  451 GATTGGAACG ACCTTGCCAA AGACGGCGTT AACATCGTCA TCGCCAATCC

  501 CAAAACCTCG GGCAACGGAC GCTACGCCTT CCTCGGCGCA TACGGTTACG

  551 GTCTGAAAAC CACCAACGGC AACGAACAGG AAGCCCAAAA ACTCGTCGCA

  601 TCCATCCTCA AAAACACCCC CGTTTTTGAA AACGGCGGAC GCGCGCCACC

  651 ACCACCTTCA CACAACGCAA CATCGGCGAC GTACTCATCA CTTTTGAAAA

  701 CGAAGCCAAC TACGTCAGCA AAAAACTGA
```

This corresponds to the amino acid sequence <SEQ ID 2844; ORF 927.a>:

```
a927.pep
   1 MKTYAPALYT AALLSACSPA ADSNHPSGQN APANTESDGK NITLLNASYD

  51 VARDFYKEYN PLFIKTYQSE HPGTSVSIQQ SHGGSSKQAL SVANGLQADV

 101 VTMNQSSDID LLEKKGLVEK GWQQALPDHA APYTSTMVFL VRKNNPKQIR
```

-continued

```
151DWNDLAKDGV NIVIANPKTS GNGRYAFLGA YGYGLKTTNG NEQEAQKLVA

201SILKNTPVFE NGGRAPPPPS HNATSATYSS LLKTKPTTSA KN*
```

m927/a927 99.2% identity in 242 aa overlap

```
                    10        20        30        40        50        60
m927.pep    MKTYAPALYTAALLTACSPAADSNHPSGQNAPANTESDGKNITLLNASYDVARDFYKEYN
            |||||||||||||:||||||||||||||||||||||||||||||||||||||||||||||
a927        MKTYAPALYTAALLSACSPAADSNHPSGQNAPANTESDGKNITLLNASYDVARDFYKEYN
                    10        20        30        40        50        60
                    70        80        90       100       110       120
m927.pep    PLFIKTYQSEHPGTSVSIQQSHGGSSKQALSVANGLQADVVTMNQSSDIDLLEKKGLVEK
            ||||||||||||||||||||||||||||||||||||||||||||||||||||||||||||
a927        PLFIKTYQSEHPGTSVSIQQSHGGSSKQALSVANGLQADVVTMNQSSDIDLLEKKGLVEK
                    70        80        90       100       110       120
                   130       140       150       160       170       180
m927.pep    GWQQALPDHAAPYTSTMVFLVRKNNPKQIRDWNDLAKDGVNIVIANPKTSGNGRYAFLGA
            ||||||||||||||||||||||||||||||||||||||||||||||||||||||||||||
a927        GWQQALPDHAAPYTSTMVFLVRKNNPKQIRDWNDLAKDGVNIVIANPKTSGNGRYAFLGA
                   130       140       150       160       170       180
                   190       200       210       220       230       240
m927.pep    YGYGLKTTNGNEQEAQKLVASILKNTPVFENGGRXPPPPSHNATSATYSSLLKTKPTTSA
            |||||||||||||||||||||||||||||||||| |||||||||||||||||||||||||
a927        YGYGLKTTNGNEQEAQKLVASILKNTPVFENGGRAPPPPSHNATSATYSSLLKTKPTTSA
                   190       200       210       220       230       240
m927.pep    KNX
            |||
a927        KNX
```

The following partial DNA sequence was identified in *N. gonorrhoeae* <SEQ ID 2845>:

```
g929.seq
   1  ATGAAATTGG GTTTCAAACC GATACCCCTC GCCATTGCCG CAGTATTGTG

  51  CGCCCTGGTT TTGGCACTGC CCGTACccga CGGGGTCAAG CCTCAGGCTT

 101  GGACGCTGCT GGCTATGTTT GTCGGTGTGA TTGCCGCCAT TATCGGCAAG

 151  GTTATGCCGT TGGGCGCGCT GTCGATTATT GCCGTCGGGT TGGTCGCAGT

 201  AACCGGCGTA ACCGCCGACA AACCGGGCGC GGCGATGAGC GATGCGTTGA

 251  GTGCGTTCGC CAATCCGTTG ATTTGGCTGA TTGCCATCGC AGTTATGATT

 301  TCGCGCGGTT TGCTCAAAAC AGGGCTGGGG ATGCGTATCG GATATTTGTT

 351  TATCGCCGTT TTTGGAAGAA AAAcgctggG CATCGGTTAC AGTCTCGCTC

 401  TTTCCGAACT GCTGCTGGCT CCCGTTACCC CTTCCAATAC CGCGCGCGGC

 451  GGCGGCATTA TACATCcgaT TATGCagtcg attgCcggCA GttacggctC

 501  caatCCCGCA AAAGGCACag aaggcaagat gggtaAATAT TtggcTTtgg

 551  tcaattaTCA TTCcaaTCCC atttcgtcgg ctAtggctat taCTGcaact

 601  gCCCCcaaCC CTTTAATcgt caacttgatt gccGaaaaTt taggcagtag

 651  tttccgtCTT TCttgggggg cgTGGGcgtg ggcaaTGGCT Gttcccggcg

 701  ttatcgcctt TTtcgTTATG CCTTTGATTT TATATTTTTT GTATCCGCCT

 751  GAAATTAAAG AAACGCCCAA TGCTGttcAA TTTGCCAAAG ACCGTCTGAG

 801  CGAGATGGGT AAAATGtcgg CAGACGAAAT CATTATGGCG GTCATTTTCG

 851  GTATCTTGCT GCTGTTGTGG GCAGATGTTC CCGCCCTTAT TACCGGCAAT

 901  CACGCTTTTA GTATCAacgc caccGCCACC GCATTTATCG GATTAAGCCT
```

-continued

```
 951 GCTTTTGCTT TCCGGTGTAT TGACTTGGGA CGATGTTTTG AAAGAAAAAA

1001 GCGCGTGGGA TACGATTATT TGGTTTGGCG CATTGATTAT GATGGCCGCA

1051 TTTTTaAATA AActcggact gattaaatGG TTCTCCGGAG TGTTGGCGGA

1101 AagtgtcggC GGTTTGGGCG TTAGCGGCAC GGCTGCGGGC GTAATCCTCG

1151 TGCTTGCtta TATGTATGCG CATTATATGT TTGCCAGTAC TACTGCACAT

1201 ATTACCGCTA TGTTCGGCGC ATTTCTCGCT GCTGCCGTTT CACTGAATGC

1251 CCCGGCGATG CCGACTGCGC TGATGATGGC GGCCGCATCC AACATTATGA

1301 TGACCCTCAC TCATTATGCG ACCGGTACTT CACCTGTGAT TTTCGGCTCG

1351 GGCTACACCA CAATGGGAGA ATGGTGGAAG GCGGGTTTTA TCATGAGCGT

1401 AGTCAATTTT CTGATTTTTT CCGTTATCGG CAGCATTTGG TGGAAAGTTC

1451 TGGGATATTG GTAA
```

This corresponds to the amino acid sequence <SEQ ID 2846; ORF 929.ng>:

```
g929.pep
  1 MKLGFKPIPL AIAAVLCALV LALPVPDGVK PQAWTLLAMF VGVIAAIIGK

 51 VMPLGALSII AVGLVAVTGV TADKPGAAMS DALSAFANPL IWLIAIAVMI

101 SRGLLKTGLG MRIGYLFIAV FGRKTLGIGY SLALSELLLA PVTPSNTARG

151 GGIIHPIMQS IAGSYGSNPA KGTEGKMGKY LALVNYHSNP ISSAMAITAT

201 APNPLIVNLI AENLGSSFRL SWGAWAWAMA VPGVIAFFVM PLILYFLYPP

251 EIKETPNAVQ FAKDRLSEMG KMSADEIIMA VIFGILLLLW ADVPALITGN

301 HAFSINATAT AFIGLSLLLL SGVLTWDDVL KEKSAWDTII WFGALIMMAA

351 FLNKLGLIKW FSGVLAESVG GLGVSGTAAG VILVLAYMYA HYMFASTTAH

401 ITAMFGAFLA AAVSLNAPAM PTALMMAAAS NIMMTLTHYA TGTSPVIFGS

451 GYTTMGEWWK AGFIMSVVNF LIFSVIGSIW WKVLGYW*
```

The following partial DNA sequence was identified in *N. meningitidis* <SEQ ID 2847>:

```
m929.seq
  1 ATGAAATTGG GTTTCAAACC GATACCCCTC GCCATTGCCG CAGTATTGTG

 51 CGCCCTGGTT TTGGCACTGC CCGTACCCGA CGGGGTCAAG CCTCAGGCTT

101 GGACGCTGCT GGCCATGTTT GTCGGTGTGA TTGCCGCCAT TATCGGCAAG

151 GCCATGCCGT TGGGCGCGCT GTCGATTATT GCCGTCGGGT TGGTCGCAGT

201 AACCGGCGTA ACCGCCGACA AACCGGGCGC GGCGATGAGC GATGCGTTGA

251 GTGCGTTCGC CAATCCGTTG ATTTGGCTGA TTGCCATCGC AGTTATGATT

301 TCGCGCGGTT TGCTCAAAAC AGGGCTGGGG ATGCGTATCG GATATTTGTT

351 TATCGCCGTT TTTGGAAGAA AAACGCTGGG CATCGGTTAC AGTCTCGCTC

401 TTTCCGAACT GCTGCTGGCT CCCGTTACCC CTTCCAATAC CGCGCGCGGC

451 GGCGGCATTA TACATCCGAT TATGCAGTCG ATTGCCGGCA GTTACGGCTC

501 CAATCCCGCA AAAGGCACAG AAGGCAAGAT GGGTAAATAT TTGGCTTTGG

551 TCAACTATCA TTCCAATCCC ATTTCGTCGG CTATGTTTAT TACTGCAACT

601 GCCCCCAACC CTTTAATCGT CAACTTGATT GCCGAAAATT TAGGCAGTAG
```

-continued

```
 651 TTTCCGTCTT TCTTGGGGGG CGTGGGCGTG GGCAATGGCT GTTCCCGGCG

 701 TTATCGCCTT TTTCGTTATG CCTTTGATTT TATATTTwyT GTATCCGCCT

 751 GAAATTAAAG AAACGCCCAA TGCCGTTCAA TTTGCCAAAG ACCGTCTGAG

 801 GGAGATGGGT AAAATGTCGG CAGACGAAAT CATTATGGCG GTCATTTTCG

 851 GTATCTTGCT GCTGTTGTGG GCAGATGTTC CCGCCCTTAT TACCGGCAAT

 901 CACGCTTTTA GTATCAACGC CACCGCCACC GCATTTATCG GATTAAGCCT

 951 GCTTTTGCTT TCCGGTGTAT TGACTTGGGA CGATGTTTTG AAAGAAAAAA

1001 GCGCGTGGGA TACGATTATT TGGTTTGGCG CATTGATTAT GATGGCCGCA

1051 TTTTTAAATA AACTCGGACT GATTAAATGG TTCTCCGGAG TGTTGGCGGA

1101 AAGTGTCGGC GGTTTGGGCG TTAGCGGCAC GGCTGCGGGC GTAATCCTCG

1151 TGCTTGCTTA TATGTATGCG CATTATATGT TTGCCAGTAC TACTGCACAT

1201 ATTACCGCTA TGTTCGGCGC ATTTTTCGCT GCTGCCGTTT CACTGAATGC

1251 CCCGGCGATG CCGACCGCGC TGATGATGGC GgCCGCATCC AACATTATGA

1301 TGACCCTCAC TCATTATGCG ACCGGTACTT CGCCTGTGAT TTTCGGTTCG

1351 GGCTACACCA CAATGGGAGA ATGGTGGAAG GCGGGTTTTA TCATGAGCGT

1401 AGTCAATTTT CTGATTTTTT TCGTTATCGG CAGCATTTGG TGGAAAGTTC

1451 TGGGGTATTG GTAA
```

This corresponds to the amino acid sequence <SEQ ID 2848; ORF 929>:

```
m929.pep
  1 MKLGFKPIPL AIAAVLCALV LALPVPDGVK PQAWTLLAMF VGVIAAIIGK

 51 AMPLGALSII AVGLVAVTGV TADKPGAAMS DALSAFANPL IWLIAIAVMI

101 SRGLLKTGLG MRIGYLFIAV FGRKTLGIGY SLALSELLLA PVTPSNTARG

151 GGIIHPIMQS IAGSYGSNPA KGTEGKMGKY LALVNYHSNP ISSAMFITAT

201 APNPLIVNLI AENLGSSFRL SWGAWAWAMA VPGVIAFFVM PLILYXLYPP

251 EIKETPNAVQ FAKDRLREMG KMSADEIIMA VIFGILLLLW ADVPALITGN

301 HAFSINATAT AFIGLSLLLL SGVLTWDDVL KEKSAWDTII WFGALIMMAA

351 FLNKLGLIKW FSGVLAESVG GLGVSGTAAG VILVLAYMYA HYMFASTTAH

401 ITAMFGAFFA AAVSLNAPAM PTALMMAAAS NIMMTLTHYA TGTSPVIFGS

451 GYTTMGEWWK AGFIMSVVNF LIFFVIGSIW WKVLGYW*
```

Computer analysis of this amino acid sequence gave the following results:

Homology with a Predicted ORF from *N. gonorrhoeae*

ORF 929 shows 98.8% identity over a 487 aa overlap with a predicted ORF (ORF 929.ng) from *N. gonorrhoeae*:

```
g929/m929

                    10        20        30        40        50        60
g929.pep    MKLGFKPIPLAIAAVLCALVLALPVPDGVKPQAWTLLAMFVGVIAAIIGKVMPLGALSII
            ||||||||||||||||||||||||||||||||||||||||||||||||||:|||||||||
m929        MKLGFKPIPLAIAAVLCALVLALPVPDGVKPQAWTLLAMFVGVIAAIIGKAMPLGALSII
                    10        20        30        40        50        60

                    70        80        90       100       110       120
g929.pep    AVGLVAVTGVTADKPGAAMSDALSAFANPLIWLIAIAVMISRGLLKTGLGMRISYLFIAV
            ||||||||||||||||||||||||||||||||||||||||||||||||||||||||||||
m929        AVGLVAVTGVTADKPGAAMSDALSAFANPLIWLIAIAVMISRGLLKTGLGMRISYLFIAV
                    70        80        90       100       110       120
```

-continued

```
                      130       140       150       160       170       180
g929.pep    FGRKTLGIGYSLALSELLLAPVTPSNTARGGGIIHPIMQSIAGSUGSNPAKGTEGKMGKY
            ||||||||||||||||||||||||||||||||||||||||||||||||||||||||||||
m929        FGRKTLGIGYSLALSELLLAPVTPSNTARGGGIIHPIMQSIAGSUGSNPAKGTEGKMGKY
                      130       140       150       160       170       180

                      190       200       210       220       230       240
g929.pep    LALVNYHSNPISSAMAITATAPNPLIVNLIAENLGSSFRLSWGAWAWAMAVPGVIAFFVM
            ||||||||||||||| ||||||||||||||||||||||||||||||||||||||||||||
m929        LALVNYHSNPISSAMFITATAPNPLIVNLIAENLGSSFRLSWGAWAWAMAVPGVIAFFVM
                      190       200       210       220       230       240

                      250       260       270       280       290       300
g929.pep    PLILYFLYPPEIKETPNAVQFAKDRLSEMGKMSADEIIMAVIFGILLLLWADVPALITGN
            ||||| |||||||||||||||||||| |||||||||||||||||||||||||||||||||
m929        PLILYXLYPPEIKETPNAVQFAKDRLREMGKMSADEIIMAVIFGILLLLWADVPALITGN
                      250       260       270       280       290       300

                      310       320       330       340       350       360
g929.pep    HAFSINATATAFIGLSLLLLSGVLTWDDVLKEKSAWDTIIWFGALIMMAAFLNKLGLIKW
            ||||||||||||||||||||||||||||||||||||||||||||||||||||||||||||
m929        HAFSINATATAFIGLSLLLLSGVLTWDDVLKEKSAWDTIIWFGALIMMAAFLNKLGLIKW
                      310       320       330       340       350       360

                      370       380       390       400       410       420
g929.pep    FSGVLAESVGGLGVSGTAAGVILVLAYMYAHYMFASTTAHITAMFGAFLAAAVSLNAPAM
            ||||||||||||||||||||||||||||||||||||||||||||||||:|||||||||||
m929        FSGVLAESVGGLGVSGTAAGVILVLAYMYAHYMFASTTAHITAMFGAFFAAAVSLNAPAM
                      370       380       390       400       410       420

                      430       440       450       460       470       480
g929.pep    PTALMMAAASNIMMTLTHYATGTSPVIFGSGYTTMGEWWKAGFIMSVVNFLIFSVIGSIW
            ||||||||||||||||||||||||||||||||||||||||||||||||||||| ||||||
m929        PTALMMAAASNIMMTLTHYATGTSPVIFGSGYTTMGEWWKAGFIMSVVNFLIFFVIGSIW
                      430       440       450       460       470       480

g929.pep    WKVLGYWX
            ||||||||
m929        WKVLGYWX
```

The following partial DNA sequence was identified in *N. meningitidis* <SEQ ID 2849>:

```
a929.seq
   1  ATGAAATTGG GTTTCAAACC GATACCCCTC GCCATTGCCG CAGTATTGTG

  51  CGCCTTGGTT TTGGCACTGC CCGTACCCGA CGGGGTCAAG CCTCAGGCTT

 101  GGACGCTGCT GGCCATGTTT ATCGGTGTGA TTGCCGCCAT TATCGGCAAG

 151  GCCATGCCGT TGGGTGCGCT GTCGATTATT GCCGTCGGGT TGGTCGCAGT

 201  AACCGGCGTA ACCGCCGACA AACCGGGTGC GGCGATGAGC GATGCGTTGA

 251  GTGCGTTCGC CAATCCGTTG ATTTGGCTGA TTGCCATCGC AGTTATGATT

 301  TCGCGCGGTT TGCTCAAAAC AGGGCTGGGG ATGCGTATCG GATATTTGTT

 351  TATCGCCGTT TTTGGAAGAA AAACGCTGGG CATCGGTTAC AGTCTCGCTC

 401  TTTCCGAACT GCTGCTGGCT CCCGTTACCC CTTCCAATAC CGCGCGCGGC

 451  GGCGGCATTA TACATCCGAT TATGCAGTCG ATTGCCGGCA GTTACGGCTC

 501  CAATCCCGCA AAAGGCACAG AAGGCAAGAT GGGTAAATAT TTGGCTTTGG

 551  TCAACTATCA TTCCAATCCC ATTTCGTCGG CTATGTTTAT TACTGCAACT

 601  GCCCCCAACC CTTTAATCGT CAACTTGATT GCCGAAAATT TAGGCAGTAG

 651  TTTCCGTCTT TCTTGGGGGG CGTGGGCGTG GGCAATGGCT GTTCCCGGCG

 701  TTATCGCCTT TTTCGTTATG CCTTTGATTT TATATTTTTT GTATCCGCCT

 751  GAAATTAAAG AAACGCCCAA TGCCGTTCAA TTTGCCAAAG ACCGTCTGAG

 801  GGAGATGGGT AAAATGTCGG CAGACGAAAT CATTATGGCG GTCATTTTCG

 851  GTATCTTGTT GCTGTTGTGG GCAGATGTTC CCGCCCTTAT TACCGGCAAT

 901  CACGCTTTTA GTATCAACGC CACCGCCACC GCATTTATCG GATTAAGCCT

 951  GCTTTTGCTT TCCGGTGTAT TGACTTGGGA CGATGTTTTG AAAGAAAAAA
```

-continued

```
1001 GCGCGTGGGA TACGATTATT TGGTTTGGCG CATTGATTAT GATGGCCGCA

1051 TTTTTAAATA AACTCGGACT GATTAAATGG TTCTCCGGAG TGTTGGCGGA

1101 AAGTGTCGGC GGTTTGGGCG TTAGCGGCAC GGCTGCGGGC GTAATCCTCG

1151 TGCTTGCTTA TATGTATGCG CATTATATGT TTGCCAGTAC TACTGCACAT

1201 ATTACCGCTA TGTTCGGCGC ATTTTTCGCT GCTGCCGTTT CACTGAATGC

1251 CCCGGCGATG CCGACCGCGC TGATGATGGC GGCCGCATCT AACATTATGA

1301 TGACCCTCAC TCATTATGCG ACCGGTACTT CGCCTGTGAT TTTCGGTTCG

1351 GGCTACACCA CAATGGGAGA ATGGTGGAAG GCGGGTTTTA TCATGAGCGT

1401 AGTCAATTTT CTGATTTTTT TCGTTATCGG CAGCATTTGG TGGAAAGTTC

1451 TGGGGTATTG GTAA
```

This corresponds to the amino acid sequence <SEQ ID 2850; ORF 929.a>:

```
a929.pep
  1 MKLGFKPIPL AIAAVLCALV LALPVPDGVK PQAWTLLAMF IGVIAAIIGK

 51 AMPLGALSII AVGLVAVTGV TADKPGAAMS DALSAFANPL IWLIAIAVMI

101 SRGLLKTGLG MRIGYLFIAV FGRKTLGIGY SLALSELLLA PVTPSNTARG

151 GGIIHPIMQS IAGSYGSNPA KGTEGKMGKY LALVNYHSNP ISSAMFITAT

201 APNPLIVNLI AENLGSSFRL SWGAWAWAMA VPGVIAFFVM PLILYFLYPP

251 EIKETPNAVQ FAKDRLREMG KMSADEIIMA VIFGILLLLW ADVPALITGN

301 HAFSINATAT AFIGLSLLLL SGVLTWDDVL KEKSAWDTII WFGALIMMAA

351 FLNKLGLIKW FSGVLAESVG GLGVSGTAAG VILVLAYMYA HYMFASTTAH

401 ITAMFGAFFA AAVSLNAPAM PTALMMAAAS NIMMTLTHYA TGTSPVIFGS

451 GYTTMGEWWK AGFIMSVVNF LIFFVIGSIW WKVLGYW*
```

m929/a929 99.6% identity in 487 aa overlap

```
                    10        20        30        40        50        60
m929.pep    MKLGFKPIPLAIAAVLCALVLALPVPDGVKPQAWTLLAMFVGVIAAIIGKVMPLGALSII
            ||||||||||||||||||||||||||||||||||||||||:|||||||||||||||||||
a929        MKLGFKPIPLAIAAVLCALVLALPVPDGVKPQAWTLLAMFIGVIAAIIGKVMPLGALSII
                    10        20        30        40        50        60

                    70        80        90       100       110       120
m929.pep    AVGLVAVTGVTADKPGAAMSDALSAFANPLIWLIAIAVMISRGLLKTGLGMRISYLFIAV
            ||||||||||||||||||||||||||||||||||||||||||||||||||||||||||||
a929        AVGLVAVTGVTADKPGAAMSDALSAFANPLIWLIAIAVMISRGLLKTGLGMRISYLFIAV
                    70        80        90       100       110       120

                   130       140       150       160       170       180
m929.pep    FGRKTLGIGYSLALSELLLAPVTPSNTARGGGIIHPIMQSIAGSUGSNPAKGTEGKMGKY
            ||||||||||||||||||||||||||||||||||||||||||||||||||||||||||||
a929        FGRKTLGIGYSLALSELLLAPVTPSNTARGGGIIHPIMQSIAGSUGSNPAKGTEGKMGKY
                   130       140       150       160       170       180

                  190       200       210       220       230       240
m929.pep    LALVNYHSNPISSAMAITATAPNPLIVNLIAENLGSSFRLSWGAWAWAMAVPGVIAFFVM
            ||||||||||||||||||||||||||||||||||||||||||||||||||||||||||||
a929        LALVNYHSNPISSAMFITATAPNPLIVNLIAENLGSSFRLSWGAWAWAMAVPGVIAFFVM
                  190       200       210       220       230       240

                   250       260       270       280       290       300
m929.pep    PLILYXLYPPEIKETPNAVQFAKDRLSEMGKMSADEIIMAVIFGILLLLWADVPALITGN
            ||||| ||||||||||||||||||||||||||||||||||||||||||||||||||||||
a929        PLILYFLYPPEIKETPNAVQFAKDRLREMGKMSADEIIMAVIFGILLLLWADVPALITGN
                   250       260       270       280       290       300
```

-continued

```
              310       320       330       340       350       360
m929.pep    HAFSINATATAFIGLSLLLLSGVLTWDDVLKEKSAWDTIIWFGALIMMAAFLNKLGLIKW
            ||||||||||||||||||||||||||||||||||||||||||||||||||||||||||||
a929        HAFSINATATAFIGLSLLLLSGVLTWDDVLKEKSAWDTIIWFGALIMMAAFLNKLGLIKW
              310       320       330       340       350       360

              370       380       390       400       410       420
m929.pep    FSGVLAESVGGLGVSGTAAGVILVLAYMYAHYMFASTTAHITAMFGAFFAAAVSLNAPAM
            ||||||||||||||||||||||||||||||||||||||||||||||||||||||||||||
a929        FSGVLAESVGGLGVSGTAAGVILVLAYMYAHYMFASTTAHITAMFGAFFAAAVSLNAPAM
              370       380       390       400       410       420

              430       440       450       460       470       480
m929.pep    PTALMMAAASNIMMTLTHYATGTSPVIFGSGYTTMGEWWKAGFIMSVVNFLIFFVIGSIW
            ||||||||||||||||||||||||||||||||||||||||||||||||||||||||||||
m929        PTALMMAAASNIMMTLTHYATGTSPVIFGSGYTTMGEWWKAGFIMSVVNFLIFFVIGSIW
              430       440       450       460       470       480

m929.pep    WKVLGYWX
            ||||||||
a929        WKVLGYWX

g930.seq not found yet
g930.pep net found yet
```

The following partial DNA sequence was identified in *N. meningitidis* <SEQ ID 2851>:

```
m930.seq
  1 ATGAAACTTC CTTTATCCTA TTTGCCTAAT ATTCGCTTTT TGTCTTGGTG

 51 CTGCTTATTG GCAGGTATCA TTGCTCCTGC TACTTTGTTG GCCTCCCCCA

101 ACCCTGCCGA AATCCGTATG CAGCAAGATA TTCAGCAACG CCAACGCGAA

151 GAGCAGTTGC GCCAAACCAT GCAGCCTGAA AGCGATGTGC GTTTGCATCA

201 AAAAAACACG GGGGAAACGG TTAATCAGTT GATGGGCGAT GACAGCAGCC

251 AACCGTGTTT TGCCATTAAC GAAtGGGTGT TGGAAGGCGA ACACCATGCT

301 CGGTTTCAGT TTGCCCTAAA ACGTGCCTTG CGCGAAACGG GTTTTCAGGC

351 TGGCAAGTGT CTGCATGCGG GCAACATTAA TCAAATCATG TCCTTAGCAC

401 AAAATGCTTT GATCGGCAGG GGATATACCA CGACCCGTAT CTTGGCTGCG

451 CCACAGGATT TGAATAgTGG aAGCTTCAAT TAA
```

This corresponds to the amino acid sequence <SEQ ID 2852; ORF 930>:

```
m930.pep
  1 MKLPLSYLPN IRFLSWCCLL AGIIAPATLL ASPNPAEIRM QQDIQQRQRE

 51 EQLRQTMQPE SDVRLHQKNT GETVNQLMGD DSSQPCFAIN EWVLEGEHHA

101 RFQFALKRAL RETGFQAGKC LHAGNINQIM SLAQNALIGR GYTTTRILAA

151 PQDLNSGSFN *
```

The following partial DNA sequence was identified in *N. gonorrhoeae* <SEQ ID 2853>:

```
g930-1.seq (partial)
  1 GGCAAGTGTC TGCATGCGGG CGACATTAAT CAAATCATGT CCTTAGCACA

 51 AAATGCTTTG ATCGGCAGGG GATATACCAC GACCCGTATC TTGGCTGCGC

101 CACAGGATTT GAATAGTGGC AAGCTTCAAT TAACCCTGAT GCCGGGCTAT

151 CTGCGCTCCA TACGAATCGA TCGGTCCAAC GATGATCAAA CCCATGCAGG

201 ACGTATTGCA GCATTCCAAA ACAAATTTCC CACCCGCTCG AACGATCTGT

251 TGAATCTGCG TGATTTGGAA CAAGGACTGG AAAATCTCAA ATGTCTCCCG
```

-continued

```
 301 ACTGCGGAAG CCGATCTCCA AATCGTTCCC GTAGAGAGAG AACCAAACCA
 351 AAGTGATGTC GTGGTGCAAT GGCGGTAACG TCTGCTGCCC TACTGTGTGA
 401 GTGTGGGGAT GGATAATTCG GGTAGTGAGG CGACAGGAAA ATACCAAGGA
 451 AATATCACTT TCTCTGCCGA CAATCCTTTT GGACTGAGTG ATATGTTCTA
 501 TGTAAATTAT GGACGTTCAA TTGGCGGTAC GCCCGATGAG GAAAATTTTG
 551 ACGGCCATCG CAAAGAAGGC GGATCAAACA ATTACGCCGT ACATTATTCA
 601 GCCCCTTTCG GTAAATGGAC ATGGGCATTC AATCACAATG GCTACCGTTA
 651 CCATCAGGCG GTTTCCGGAT TATCGGAAGT CTATGACTAT AATGGAAAAA
 701 GTTACAACAC TGATTTCGGC TTCAACCGCC TGTTGTATCG TGATGCCAAA
 751 CGCAAAACCT ATCTCAGTGT AAAACTGTGG ACGAGGGAAA CAAAAAGTTA
 801 CATTGATGAT GCCGAACTGA CTGTACAACG GCGTAAAACC ACAGGTTGGT
 851 TGGCAGAACT TTCCCACAAA GGATATATCG GTCGCAGTAC GGCAGATTTT
 901 AAGTTGAAAT ATAAACACGG CACCGGCATG AAAGATGCTC TGCGCGCGCC
 951 TGAAGAAGCC TTTGGCGAAG GCACGTCACG TATGAAAATT TGGACGGCAT
1001 CGGCTGATGT AAATACTCCT TTTCAAATCG GTAAACAGCT ATTTGCCTAT
1051 GACACATCCG TTCATGCACA ATGGAACAAA ACCCCGCTAA CATCGCAAGA
1101 CAAACTGGCT ATCGGCGGAC ACCACACCGT ACGTGGCTTC GACGGTGAAA
1151 TGAGTTTGCC TGCCGAGCGG GGATGGTATT GGCGCAACGA TTTGAGCTGG
1201 CAATTTAAAC CAGGCCATCA GCTTTATCTT GGGGCTGATG TAGGACATGT
1251 TTCAGGACAA TCCGCCAAAT GGTTATCGGG CCAAACTCTA GCCGGCACAG
1301 CAATTGGGAT ACGCGGGCAG ATAAAGCTTG GCGGCAACCT GCATTACGAT
1351 ATATTTACCG GCCGTGCATT GAAAAAGCCC GAATATTTTC AGACGAAGAA
1401 ATGGGTAACG GGGTTTCAGG TGGGTTATTC GTTTTGA
```

This corresponds to the amino acid sequence <SEQ ID 2854; ORF 930-1.ng>:

```
g930-1.pep (partial)
  1 GKCLHAGDIN QIMSLAQNAL IGRGYTTTRI LAAPQDLNSG KLQLTLMPGY
 51 LRSIRIDRSN DDQTHAGRIA AFQNKFPTRS NDLLNLRDLE QGLENLKCLP
101 TAEADLQIVP VEREPNQSDV VVQWR*RLLP YCVSVGMDNS GSEATGKYQG
151 NITFSADNPF GLSDMFYVNY GRSIGGTPDE ENFDGHRKEG GSNNYAVHYS
201 APFGKWTWAF NHNGYRYHQA VSGLSEVYDY NGKSYNTDFG FNRLLYRDAK
251 RKTYLSVKLW TRETKSYIDD AELTVQRRKT TGWLAELSHK GYIGRSTADF
301 KLKYKHGTGM KDALRAPEEA FGEGTSRMKI WTASADVNTP FQIGKQLFAY
351 DTSVHAQWNK TPLTSQDKLA IGGHHTVRGF DGEMSLPAER GWYWRNDLSW
401 QFKPGHQLYL GADVGHVSGQ SAKWLSGQTL AGTAIGIRGQ IKLGGNLHYD
451 IFTGRALKKP EYFQTKKWVT GFQVGYSF*
```

The following partial DNA sequence was identified in *N. meningitidis* <SEQ ID 2855>:

```
m930-1.seq
  1   ATGAAACTTC CTTTATCCTA TTTGCCTAAT ATTCGCTTTT TGTCTTGGTG
```

-continued

```
  51 CTGCTTATTG GCAGGTATCA TTGCTCCTGC TACTTTGTTG GCCTCCCCCA
 101 ACCCTGCCGA AATCCGTATG CAGCAAGATA TTCAGCAACG CCAACGCGAA
 151 GAGCAGTTGC GCCAAACCAT GCAGCCTGAA AGCGATGTGC GTTTGCATCA
 201 AAAAAACACG GGGGAAACGG TTAATCAGTT GATGGGCGAT GACAGCAGCC
 251 AACCGTGTTT TGCCATTAAC GAAGTGGTGT TGGAAGGCGA ACACCATGCT
 301 CGGTTTCAGT TTGCCCTAAA ACGTGCCTTG CGCGAAACGG GTTTTCAGGC
 351 TGGCAAGTGT CTGCATGCGG GCAACATTAA TCAAATCATG TCCTTAGCAC
 401 AAAATGCTTT GATCGGCAGG GGATATACCA CGACCCGTAT CTTGGCTGCG
 451 CCACAGGATT TGAATAGTGG CAAGCTTCAA TTAACCCTGA TACCGAGCTA
 501 TCTGCGCTCC ATACGAATCG ATCGGTCTAA CGATGATCAA ACCCATGCAG
 551 GACGTATTGC AGCATTCCAG AACAAATTTC CCACCCGCTC GAACGATCTG
 601 TTGAATCTGC GTGATTTGGA ACAAGGACTG GAAAATCTCA AACGTCTCCC
 651 GACTGCGGAA GCCGATCTCC AAATCGTTCC CGTAGAGGGA GAACCAAACC
 701 AAAGTGATGT CGTGGTGCAA TGGCGGCAAC GTCTGCTGCC CTACCGTGTG
 751 AGTGTGGGGA TGGATAATTC GGGTAGTGAG GCGACAGGAA AATACCAAGG
 801 AAATATCACT TTCTCTGCCG ACAATCCTTT GGGACTGAGT GATATGTTCT
 851 ATGTAAATTA TGGACGTTCG ATTGGCGGTA CGCCCGATGA GGAAAGTTTT
 901 GACGGCCATC GCAAAGAAGG CGGATCAAAC AATTACGCCG TACATTATTC
 951 AGCCCCTTTC GGTAAATGGA CATGGGCATT CAATCACAAT GGCTACCGTT
1001 ACCATCAGGC AGTTTCCGGA TTATCGGAAG TCTATGACTA TAATGGAAAA
1051 AGTTACAATA CTGATTTCGG CTTCAACCGC CTGTTGTATC GTGATGCCAA
1101 ACGCAAAACC TATCTCGGTG TAAAACTGTG GATGAGGGAA ACAAAAAGTT
1151 ACATTGATGA TGCCGAACTG ACTGTACAAC GGCGTAAAAC TGCGGGTTGG
1201 TTGGCAGAAC TTTCCCACAA AGAATATATC GGTCGCAGTA CGGCAGATTT
1251 TAAGTTGAAA TATAAACGCG GCACCGGCAT GAAAGATGCT CTGCGCGCGC
1301 CTGAAGAAGC CTTTGGCGAA GGCACGTCAC GTATGAAAAT TTGGACGGCA
1351 TCGGCTGATG TAAATACTCC TTTTCAAATC GGTAAACAGC TATTTGCCTA
1401 TGACACATCC GTTCATGCAC AATGGAACAA AACCCCGCTA ACATCGCAAG
1451 ACAAACTGGC TATCGGCGGA CACCACACCG TACGTGGCTT CGACGGTGAA
1501 ATGAGTTTGT CTGCCGAGCG GGGATGGTAT TGGCGCAACG ATTTGAGCTG
1551 GCAATTTAAA CCAGGCCATC AGCTTTATCT TGGGGCTGAT GTAGGACATG
1601 TTTCAGGACA ATCCGCCAAA TGGTTATCGG GCCAAACTCT AGTCGGCACA
1651 GCAATTGGGA TACGCGGGCA GATAAAGCTT GGCGGCAACC TGCATTACGA
1701 TATATTTACC GGCCGCGCAT TGAAAAAGCC CGAATTTTTC CAATCAAGGA
1751 AATGGGCAAG CGGTTTTCAG GTAGGCTATA CGTTTTAA
```

This corresponds to the amino acid sequence <SEQ ID 2856; ORF 930-1>:

```
m930-1.pep

      1 MKLPLSYLPN IRFLSWCCLL AGIIAPATLL ASPNPAEIRM QQDIQQRQRE
```

-continued

```
 51 EQLRQTMQPE SDVRLHQKNT GETVNQLMGD DSSQPCFAIN EVVLEGEHHA

101 RFQFALKRAL RETGFQAGKC LHAGNINQIM SLAQNALIGR GYTTTRILAA

151 PQDLNSGKLQ LTLIPSYLRS IRIDRSNDDQ THAGRIAAFQ NKFPTRSNDL

201 LNLRDLEQGL ENLKRLPTAE ADLQIVPVEG EPNQSDVVVQ WRQRLLPYRV

251 SVGMDNSGSE ATGKYQGNIT FSADNPLGLS DMFYVNYGRS IGGTPDEESF

301 DGHRKEGGSN NYAVHUSAPF GKWTWAFNHN GYRYHQABSG LSEVYDYNGK

351 SYNTDFGFNR LLYRDAKRKT YLGVKLWMRE TKSYIDDAEL TVQRRKTAGW

401 LAELSHKEYI GRSTADFKLK YKRGTGMKDA LRAPEEAFGE GTSRMKIWTA

451 SADVNTPFQI GKQLFAYDTS VHAQWNKTPL TSQDKLAIGG HHTVRGFDGE

501 MSLSAERGWY WRNDLSWQFK PGHQLYLGAD VGHVSGQSAK WLSGQTLVGT

551 AIGIRGQIKL GGNLHYDIFT GRALKKPEFF QSRKWASGFQ VGYTF*
```

m930-1/g930-1 95.4% indentity in 478 aa overlap

```
                 90        100       110       120       130       140
m930-1.pep   AINEVVLEGEHHARFQFALKRALRETGFQAGKCLHAGNINQIMSLAQNALIGRGYTTTRI
                                              |||||||:|||||||||||||||||||||
g930-1                                        GKCLHAGDINQIMSLAQNALIGRGYTTTRI
                                                      10        20        30

             150       160       170       180       190       200
m930-1.pep   LAAPQDLNSGKLQLTLIPSYLRSIRIDRSNDDQTHAGRIAAFQNKFPTRSNDLLNLRDLE
             |||||||||||||||:|:||||||||||||||||||||||||||||||||||||||||||
g930-1       LAAPQDLNSGKLQLTLMPGYLRSIRIDRSNDDQTHAGRIAAFQNKFPTRSNDLLNLRDLE
                     40        50        60        70        80        90

             210       220       230       240       250       260
m930-1.pep   QGLENLKRLPTAEADLQIVPVEGEPNQSDVVVQWRQRLLPYRVSVGMDNSGSEATGKYQG
             ||||||| |||||||||||||| |||||||||||| ||||| ||||||||||||||||||
g930-1       QGLENLKCLPTAEADLQIVPVEREPNQSDVVVQWRXRLLPYCVSVGMDNSGSEATGKYQG
                    100       110       120       130       140       150

             270       280       290       300       310       320
m930-1.pep   NITFSADNPLGLSDMFYVNYGRSIGGTPDEESFDGHRKEGGSNNYAVHYSAPFGKWTWAF
             ||||:||||:||||||||||||||||||||||:|||||||||||||||||||||||||||
g930-1       NITGSADNPFGLSDMFYVNYGRSIGGTPDEENFDGHRKEGGSNNYAVHYSAPFGKWTWAF
                    160       170       180       190       200       210

             330       340       350       360       370       380
m930-1.pep   NHNGYRYHQAVSGLSEVYDYNGKSYNTDFGFNRLLYRDAKRKTYLGVKLWMRETKSYIDD
             ||||||||||||||||||||||||||||||||||||||||||||:|||| ||||||||||
g930-1       NHNGYRYHQAVSGLSEVYDYNGKSYNTDFGFNRLLYRDAKRKTYLSVKLWTRETKSYIDD
                    220       230       240       250       260       270

             390       400       410       420       430       440
m930-1.pep   AELTVQRRKTAGWLAELSHKEYIFRSTADFKLKYKRGTGMKDALRAPEEAFGEGTSRMKI
             ||||||||||:|||||||||| ||||||||||||||:|||||||||||||||||||||||
g930-1       AELTVQRRKTTGWLAELSHKGYIFRSTADFKLKYKHGTGMKDALRAPEEAFGEGTSRMKI
                    280       290       300       310       320       330

             450       460       470       480       490       500
m930-1.pep   WTASADVNTPFQIGKQLFAYDTSVHAQWNKTPLTSQDKLAIGGHHTVRGFDGEMSLSAER
             |||||||||||||||||||||||||||||||||||||||||||||||||||||| |||||
g930-1       WTASADVNTPFQIGKQLFAYDTSVHAQWNKTPLTSQDKLAIGGHHTVRGFDGEMPLSAER
                    340       350       360       370       380       390

             510       520       530       540       550       560
m930-1.pep   GWYWRNDLSWQFKPGHQLYLGADVGHVSGQSAKWLSGQTLVGTAIGIRGQIKLGGNLHYD
             ||||||||||||||||||||||||||||||||||||||||:|||||||||||||||||||
g930-1       GWYWRNDLSWQFKPGHQLYLGADVGHVSGQSAKWLSGQTLAGTAIGIRGQIKLGGNLHYD
                    400       410       420       430       440       450

             570       580       590
m930-1.pep   IFTGRALKKPEFFQSRKWASGFQVGYTF
             ||||||||||:||::||::||||||:|
g930-1       IFTGRALKKPEYFQVTKWVTGFQVGYSFX
                    460       470
```

a930-1.seq not found yet a930-1.pep net found yet

The following partial DNA sequence was identified in *N. gonorrhoeae* <SEQ ID 2857>:

```
g931.seq
  1  ATGAAACCCA AATTCAAAAC CGTTTTAACC GCGCTGCTTT TGGCGGTTTC
```

-continued

```
 51 CCTGCCGTCT ATGGCGGCAA CCCGCGTCCT GATGGAAACC GATATGGGCA

101 ATATCCGTTT GGTTTTGGAC GAATCCAAAG CCTCCAAAAC CGTTGCCAAT

151 TTCGTGCGCT ATGCCCGAAA AGGCTTTTAC GACAACACGA TTTTCCACCG

201 CGTcatCGGC GGCTTCGTCA TCCAAGGCGA CGGATTGACC GAGGACTTGG

251 TGCAAAAGGC AACCGATAAG GCCGTTGCCA ACGAATCCGG caacgGCTTG

301 AAAAACACCG TCGGCACCAT CGCAATGGCG CGGACGGCAG CCCCCGATTC

351 CGCCGCCGCC CAATTCTTTA TCAATCTGGC GGACAACGGT TCGCTCGACT

401 ACAAAAACGG ACAATACGGC TACACCGTTT TCGGCAGGGT AGAAAGCGGA

451 ATGGACACCG TTTCCAAAAT CGCCCGCGTC AAAACCGCCA CGCGCGGCTT

501 TTATCAAAAC GTACCCGTAC AGCCCGTCAA AATCCGTCGC GTTGTTGTCG

551 GGCAGTAACA CGCAGACAGA CGTTCAGACG GCGTCGCCCG TTTCCCAAAA

601 AACGCCGTTT AA
```

This corresponds to the amino acid sequence <SEQ ID 2858; ORF 931.ng>:

```
g931.pep
  1 MKPKFKTVLT ALLLAVSLPS MAATRVLMET DMGNIRLVLD ESKASKTVAN

 51 FVRYARKGFY DNTIFHRVIG GFVIQGDGLT EDLVQKATDK AVANESGNGL

101 KNTVGTIAMA RTAAPDSAAA QFFINLADNG SLDYKNGQYG YTVFGRVESG

151 MDTVSKIARV KTATRGFYQN VPVQPVKIRR VVVGQ*
```

The following partial DNA sequence was identified in *N. meningitidis* <SEQ ID 2859>:

```
m931.seq
  1 ATGAAACCCA AATTCAAAAC CGTTTTAACC GCGCTGCTTT TGGCGGTTTC

 51 CCTGCCGTCT ATGGCGGCAA CCCATGTTTT GATGGAAACC GATATGGGCA

101 ATATCCGTTT GGTTTTGGAC GAATCCAAAG CCCCCAAAAC CGTTGCTAAT

151 TTCGTGCGCT ATGCCCGAAA AGGCTTTTAC GACGACACCG TTTTTCACCG

201 CGTTATCGAC GGTTTTGTTA TCCAGGGCGG TGGATTGACC GAGGACTTGG

251 CACAAAAGGC AAGCGATAAG GCCGTTGCCA ACGAATCCGG CAACGGCTTG

301 AAAAACACCG CCGGCACCAT CGCCATGGCG CGGACGACAG CCCCCGATTC

351 CGCCACCAGC CAATTCTTTA TCAATCTGGC GGACcA.kCT TCGCTCGACT

401 ACAAAAACGG ACAATACGGC TATACCGTTT TCGGCAGGGT CGAAAGCGGC

451 ATGAACACCG TTTCCAAAAT CGCCCGCGTC AAAACCGCCA CGCGCGGCTT

501 TTATCAAAAC GTACCCGTAC AGCCCGTCAA AATCCGTCGC GTTGTTGTCG

551 GGCAGTAA
```

This corresponds to the amino acid sequence <SEQ ID 2860; ORF 931>:

```
m931.pep..
  1 MKPKFKTVLT ALLLAVSLPS MAATHVLMET DMGNIRLVLD ESKAPKTVAN

 51 FVRYARKGFY DDTVFHRVID GFVIQGGGLT EDLAQKASDK AVANESGNGL

101 KNTAGTIAMA RTTAPDSATS QFFINLADXX SLDYKNGQYG YTVFGRVESG
```

-continued

151 MNTVSKIARV KTATRGFYQN VPVQPVKIRR VVVGQ*

Computer analysis of this amino acid sequence gave the following results:

Homology with a Predicted ORF from *N. gonorrhoeae*

ORF 931 shows 91.9% identity over a 185 aa overlap with a predicted ORF (ORF 931.ng) from *N. gonorrhoeae*:

```
g931/m931
                    10        20        30        40        50        60
g931.pep    MKPKFKTVLTALLLAVSLPSMAATRVLMETDMGNIRLVLDESKASKTVANFVRYARKGFY
            ||||||||||||||||||||||||:||||||||||||||||||| |||||||||||||||
m931        MKPKFKTVLTALLLAVSLPSMAATHVLMETDMGNIRLVLDESKAPKTVANFVRYARKGFY
                    10        20        30        40        50        60

                    70        80        90       100       110       120
g931.pep    DNTIFHRVIGGFVIQGDGLTEDLVQKATDKAVANESGNGLKNTVGTIAMARTAAPDSAAA
            |:|:||||| |||||| ||||||:|||:|||||||||||||||:||||||||:|||||::
m931        DDTVFHRVIDGFVIQGGGLTEDLAQKASDKAVANESGNGLKNTAGTIAMARTTAPDSATS
                    70        80        90       100       110       120

                   130       140       150       160       170       180
g931.pep    QFFINLADNGSLDYKNGQYGYTVFGRVESGMDTVSKIARVKTATRGFYQNVPVQPVKIRR
            ||||||||  ||||||||||||||||||||||:|||||||||||||||||||||||||||
m931        QFFINLADXXSLDYKNGQYGYTVFGRVESGMNTVSKIARVKTATRGFYQNVPVQPVKIRR
                   130       140       150       160       170       180

g931.pep    VVVGQX
            ||||||
m931        VVVGQX
```

The following partial DNA sequence was identified in *N. meningitidis* <SEQ ID 2861>:

a931.seq

1 ATGAAACCCA AATTCAAAAC CGTTTTAACC GCGCTGCTTT TGGCGGTTTC

51 CCTGCCGTCT ATGGCGGCAA CCCATGTTTT GATGGAAACC GATATGGGCA

101 ATATCCGTTT GGTTTTGGAC GAATCCAAAG CACCCAAAAC CGTTGCCAAT

151 TTCGTGCGCT ATGCCCGAAA AGGCTTTTAC GACAATACGA TTTTTCACCG

201 CGTCATCGGC GGCTTCGTTA TCCAAGGCGG CGGATTGACC GAGGACTTGG

251 CACAAAAGGC AAGCGATAAG GCCGTTGCCA ACGAATCCGG CAACGGCTTG

301 AAAAACACTG TCGGCACCAT CGCCATGGCG CGGACGGCCG ATCCGGATTC

351 CGCCACCAGC CAATTCTTTA TCAATCTGGT GGACAATGAT TCGCTCAACT

401 ACAAAAACGG ACAATACGGC TATACCGTTT TCGGCAGGGT CGAAAGCGGC

451 ATGAACACCG TTTCCAAAAT CGCCCGCGTC AAAACCGCCA CGCGCGGCTT

501 TTATCAAAAC GTACCCGTAC AGCCCGTCAA AATCCGTCGC GTTGTTGTCG

551 GGCAGTAA

This corresponds to the amino acid sequence <SEQ ID 2862; ORF 931.a>:

a931.pep

1 MKPKFKTVLT ALLLAVSLPS MAATHVLMET DMGNIRLVLD ESKAPKTVAN

51 FVRYARKGFY DNTIFHRVIG GFVIQGGGLT EDLAQKASDK AVANESGNGL

101 KNTVGTIAMA RTADPDSATS QFFINLVDND SLNYKNGQYG YTVFGRVESG

151 MNTVSKIARV KTATRGFYQN VPVQPVKIRR VVVGQ* m931/a931 94.6% identity in 185 aa overlap

```
             10         20         30         40         50         60
m931.pep    MKPKFKTVLTALLLAVSLPSMAATHVLMETDMGNIRLVLDESKAPKTVANFVRYARKGFY
            ||||||||||||||||||||||||||||||||||||||||||||||||||||||||||||
a931        MKPKFKTVLTALLLAVSLPSMAATHVLMETDMGNIRLVLDESKAPKTVANFVRYARKGFY
             10         20         30         40         50         60
             70         80         90        100        110        120
m931.pep    DDTVFHRVIDGFVIQGGGLTEDLAQKASDKAVANESGNGLKNTAGTIAMARTTAPDSATS
            |:|:||||| |||||| |||||||||||||||||||||||||:||||||||: ||||||
a931        DNTIFHRVIGGFVIQGGGLTEDLAQKASDKAVANESGNGLKNTVGTIAMARTADPDSATS
             70         80         90        100        110        120
            130        140        150        160        170        180
m931.pep    QFFINLADXXSLDYKNGQYGYTVFGRVESGMNTVSKIARVKTATRGFYQNVPVQPVKIRR
            ||||||:|   ||:|||||||||||||||||||||||||||||||||||||||||||||
a931        QFFINLVDNDSLNYKNGQYGYTVFGRVESGMNTVSKIARVKTATRGFYQNVPVQPVKIRR
            130        140        150        160        170        180
m931.pep    VVVGQX
            ||||||
a931        VVVGQX
```

The following partial DNA sequence was identified in *N. meningitidis* <SEQ ID 2863>:

```
m932.seq
   1 ATGAAATATA TCGTATCAAT CTCTCTGGCT ATGGGATTGG CTGCCTGTTC

  51 GTTTGGGGGA TTTAAACCAA ATCCGTGGGA CGCCGCGTCA TTTTGGGAAT

 101 TGAAAAATTA CGCCAATCCC TATCCGGGAT CAGCCTCGGC GGCACTTGAC

 151 CAATATCCAT CGAAAGCAAG ACGAAGGCAA CTGAAAGACA TGCAAGAGTG

 201 CGGCTATGAC CCAATAGACG GCGGAAAGTC TGAAGCAGAT GCCTGCCTGA

 251 GGAAAAAAGG CTGGTGTCGT AAGGGTTTCG ACCCTTATCC CGAAAACAAA

 301 AAATACGAAT GGCCTCGAGA AGAAGGAAAA ACAAAATGA
```

This corresponds to the amino acid sequence <SEQ ID 2864; ORF 932>:

```
m932.pep
   1 MKYIVSISLA MGLAACSFGG FKPNPWDAAS FWELKNYANP YPGSASAALD

  51 QYPSKARRRQ LKDMQECGYD PIDGGKSEAD ACLRKKGWCR KGFDPYPENK

 101 KYEWPREEGK TK*
```

Computer analysis of this amino acid sequence gave the following results:

Homology with a Predicted ORF from *N. gonorrhoeae*

ORF 932 shows % identity over a aa overlap with a predicted ORF (ORF 932.ng) from *N. gonorrhoeae:*

The following partial DNA sequence was identified in *N. gonorrhoeae* <SEQ ID 2865>:

```
g934.seq
   1 ATGAAAAAAA TCATCGCCTC CGCGCTTATC GCAACATTCG CACTCACCGC

  51 CTGCCAAGAC GACACGCAGG CGCGGCTCGA ACGGCAGCAG AAACAGATTG

 101 AAGCCCTGCA ACAGCAGCTC GCACAGCAGG CAGACGATAC GGTTTACCAA

 151 CTGACTCCCG AAGCAGTCAA AGACACCATT CCTGCCCAGG CGCAGGCAAA

 201 CGGCAACAAC GGTCAGCCCG TTACCGGCAA .AGAcggGCA GCAGTATATT

 251 TACGACCAAT CGACAGGAAG CTGGCTGCTG CAAAGCCTGA TTGGCGCGGC

 301 GGCAGGCGCG TTTATCGGCA ACGCGCTGGC AAACAAATTC ACACGGGCGG

 351 GCAACCAAGA CAGCCCCGTC GCCCGTCGCG CGCGTGCTGC CTACCATCAG
```

-continued

```
401 TCCGCACGCC CCAATGCGCG CACCAGCAGG GATTTGAACA CGCGCAGCCT

451 CCGTGCAAAA CAACAGGCGG CGCAGGCGCA GCGTTACCGC CCGACAACGC

501 GCCCGCCCGT CAAttaccgc catcgcgcta tgcGCGGTTT CGgcagAagg

551 cggtaaaCCC GGCGCGTCAA TGCCGTCTGA AGGGCTTTCA GACGGCATTT

601 TTGTATTTGT TAGGGGCATT GTTATGTTGC CGTTTGATTT TCAGACGGCA

651 TTTTGTTTCC AAGCGTTTGA TGTcggGATG GCAATTCTGA
```

This corresponds to the amino acid sequence <SEQ ID 2866; ORF 934.ng>:

```
g934.pep
  1 MKKIIASALI ATFALTACQD DTQARLERQQ KQIEALQQQL AQQADDTVYQ

 51 LTPEAVKDTI PAQAQANGNN GQPVTGKRRA AVYLRPIDRK LAAAKPDWRG

101 GRRVYRQRAG KQIHTGGQPR QPRRPSRACC LPSVRTPQCA HQQGFEHAQP

151 PCKTTGGAGA ALPPDNAPAR QLPPSRYARF RQKAVNPARQ CRLKGFQTAF

201 LYLLGALLCC RLIFRRHFVS KRLMSGWQF*
```

The following partial DNA sequence was identified in *N. meningitidis* <SEQ ID 2867>:

```
m934.seq (partial)
  1 ..CGGCTCGAAC AGCAGCAGAA ACAGATTGAA GCCCTGCAAC AGCAGCTCGC

 51   ACAGCAGGCA GACGATACGG TTTACCAACT GACTCCCGAA GCAGTCAAAG

101   ACACCATTCC TGCCGAAGCA CAGGCAAACG GCAACAACgG GCAACCCGTT

151   ACCGGTAA.A GACGGGCAGC AGTATATTTA CGACCAATCG ACAGGAAGCT

201   GGCTGCTGCA AAGCCTGGTC GGCGCGGCGG CAGGCGCGTT TATCGGCAAC

251   GCGCTGGCAA ACAAATTCAC ACGGGCAGGC AACCAAGACA GTCCCGTCGC

301   CCGGCGCGCG CGTGCAGCCT ACCATCAGTC CGCACGCCCC AATGCGCGCA

351   yCAGCAGGGA TTTGAACACG CGCAGCCTCC GTGCAAAACA ACAGGCGGCG

401   CAkGCGCAGC GTTACCGCCC GACAACGCGC CCGsCCGsCA ATTACCGCCG

451   CCCCGCTATG CGCGGTTTCG GCAGGAGGCG GTAAACCCGG CGCGCCAATG

501   CCGTCTGAAG AGCTTTCAGA CGGCATTTnT GCATTTGTTA GGGACATTGT

551   TATGTTGCCG TTTGATTTTC AGACGGCATT TTGTTTCCAA GCGTTTGATG

601   TCGGGATGGC AATTCTGA
```

This corresponds to the amino acid sequence <SEQ ID 2868; ORF 934>:

```
m934.pep (partial)
  1 ..RLEQQQKQIE ALQQQLAQQA DDTVYQLTPE AVKDTIPAEA QANGNNGQPV

 51   TGXRRAAVYL RPIDRKLAAA KPGRRGGRRV YRQRAGKQIH TGRQPRQSRR

101   PARACSLPSV RTPQCAHQQG FEHAQPPCKT TGGAXAALPP DNAPXRQLPP

151   PRYARFRQEA VNPARQCRLK SFQTAFXHLL GTLLCCRLIF RRHFVSKRLM

201   SGWQF*
```

Computer analysis of this amino acid sequence gave the following results:

Homology with a Predicted ORF from *N. gonorrhoeae*

ORF 934 shows 91.7% identity over a 205 aa overlap with a predicted ORF (ORF 934.ng) from *N. gonorrhoeae*:

```
m934/g934

                                              10        20        30
m934.pep                              RLEQQQKQIEALQQQLAQQADDTVYQLTPEAVKDTI
                                      |||:||||||||||||||||||||||||||||||||
g934        MKKIIASALIATFALTACQDDTQARLERQQKQIEALQQQLAQQADDTVYQLTPEAVKDTI
                    10        20        30        40        50        60

              40        50        60        70        80        90
m934.pep    PAEAQANGNNGQPVTGXRRAAVYLRPIDRKLAAAKPGRRGGRRVYRQRAGKQIHTGRQPR
            ||:|||||||||||| ||||||||||||||||||| ||||||||||||||||||| |||
g934        PAQAQANGNNGQPVTGKRRAAVYLRPIDRKLAAAKPDWRGGRRVYRQRAGKQIHTGGQPR
                    70        80        90       100       110       120

             100       110       120       130       140       150
m934.pep    QSRRPARACSLPSVRTPQCAHQQGFEHAQPPCKTTGGAXAALPPDNAPXRQLPPPRYARF
            | |||||:| ||||||||||||||||||||||||||| |||||||| ||||| |||||
g934        QPRRPARSCCLPSVRTPQCAHQQGFEHAQPPCKTTGGAGAALPPDNAPARQLPPSRYARF
                   130       140       150       160       170       180

             160       170       180       190       200
m934.pep    RQEAVNPARQCRLKSFQTAFXHLLGTLLCCRLIFRRHFVSKRLMSGWQFX
            ||:||||||||||:||||| :|||:|||||||||||||||||||||||||
g934        RQKAVNPARQCRLKGFQTAFLYLLGALLCCRLIFRRHFVSKRLMSGWQFX
                   190       200       210       220       230
```

The following partial DNA sequence was identified in *N. meningitidis* <SEQ ID 2869>:

```
a934.seq
   1 ATGAAAAAAA TCATCGCCTC CGCGCTTATC GCAACATTCG CACTCGCCGC

  51 CTGCCAAGAC GACGCGCAGG CGCGGCTCGA ACAGCAGCAG AAACAGATTG

 101 AAGCCCTGCA ACAGCAGCTC GCACAGCAGG CAGACGATAC GGTTTACCAA

 151 CTGACTCCCG AAGCAGTCAA AGACACCATT CCTGCCGAAG CACAGGCAAA

 201 CGGCAACAAC GGGCAACCCG TTACCGG.TA AAGACGGGCA GCAGTATATT

 251 TACGACCAAT CGACAGGAAG CTGGCTGCTG CAAAGCCTGG TCGGCGCGGC

 301 GGCAGGCGCG TTTATCGGCA ACGCGCTGGC AAACAAATTC ACACGGGCAG

 351 GCAACCAAGA CAGTCCCGTC GGCAGGCGCG CGCGTGCCGC CTACCATCAG

 401 TCCGCACATC CCAATGCGCG CACCAGCAGG GATTTGAACA CGCGCAGCCT

 451 CCGTGCAAAA CAACAGGCGG CGCAGGCGCA GCGTTACCGC CCGACAACGC

 501 GCCCGCCCGC CAATTACCGC CGCCCCGCCA TGCGCGGTTT CGGCAGAAGG

 551 CGGTAAATCC GGCGTGCCAA TGCCGTCTGA AGGGCTTTCA GACGGCATTT

 601 TTGTATTTGT TAGGGACATT GTTATGTTGC CGTTTGATTT TTAGACGGCA

 651 TTTTGTTTCC AAGAGTTTGA TGTCGGGATG GCAATTCTGA
```

This corresponds to the amino acid sequence <SEQ ID 2870; ORF 934.a>:

```
a934.pep
   1 MKKIIASALI ATFALAACQD DAQARLEQQQ KQIEALQQQL AQQADDTVYQ

  51 LTPEAVKDTI PAEAQANGNN GQPVTX*RRA AVYLRPIDRK LAAAKPGRRG

 101 GRRVYRQRAG KQIHTGRQPR QSRRPARACR LPSVRTSQCA HQQGFEHAQP

 151 PCKTTGGAGA ALPPDNAPAR QLPPPRHARF RQKAVNPACQ CRLKGFQTAF

 201 LYLLGTLLCC RLIFRRHFVS KSLMSGWQF*
```

m934/a934 94.1% identity in 205 aa overlap

```
                                      10        20        30
m934.pep                     RLEQQQKQIEALQQQLAQQADDTVYQLTPEAVKDTI
                             ||||||||||||||||||||||||||||||||||||
a934        MKKIIASALIATFALTACQDDTQARLEQQQKQIEALQQQLAQQADDTVYQLTPEAVKDTI
                    10        20        30        40        50        60

              40        50        60        70        80        90
m934.pep    PAEAQANGNNGQPVTGXRRAAVYLRPIDRKLAAAKPGRRGGRRVYRQRAGKQIHTGRQPR
            |||||||||||||||| |||||||||||||||||||||||||||||||||||||||||||
a934        PAEAQANGNNGQPVTXKRRAAVYLRPIDRKLAAAKPGRRGGRRVYRQRAGKQIHTGRQPR
                    70        80        90       100       110       120

             100       110       120       130       140       150
m934.pep    QSRRPARACSLPSVRTPQCAHQQGFEHAQPPCKTTGGAXAALPPDNAPXRQLPPPRYARF
            |||||||| |||||| ||||||||||||||||||||| ||||||||| |||||||:|||
a934        QSRRPARSCRLPSVRTSQCAHQQGFEHAQPPCKTTGGAGAALPPDNAPARQLPPSRHARF
                   130       140       150       160       170       180

             160       170       180       190       200
m934.pep    RQEAVNPARQCRLKSFQTAFXHLLGTLLCCRLIFRRHFVSKRLMSGWQFX
            ||:||||||| ||:||||| :|||:|||||||||||||| ||||||||
a934        RQKAVNPARQCCLKGFQTAFLYLLGALLCCRLIFRRHFVSKSLMSGWQFX
                   190       200       210       220       230

g935.seq not found yet
g935.pep not found yet
```

The following partial DNA sequence was identified in *N. meningitidis* <SEQ ID 2871>:

```
m935.seq
     1  ATGTTGTATT TCAGATACGG CTTTTTGGTT GTTTGGTGTG CGGCAGGTGT

    51  TTCTGCCGCC TATGGGGCGG ATGCGCCCGC GATTTTGGAT GACAAGGCAT

   101  TGTTGCAGGT GCAGCGGTCG GTGTCGGATA AGTGGGCGGA ATCAGATTGG

   151  AAAGTTGAAA ATGATGCCCC GCGCGTGGTT GACGGGGATT TTTTGTTGGC

   201  GCATCCGAAA ATGTTGGAAC ATAGTTTGCG CGACGCGCTC AACGGCAATC

   251  AGGCGGATTT AATCGCTTCG TTGGCGGATT TGTATGCCAA GCTGCCGGAT

   301  TATGACGCGG TTTTGTACGG CAGGGCGCGG GCTTTGCTGG CGAAATTGGC

   351  GGGAAGGCCG GCGGAGGCGG TGGCGCGGTA TCGGGAACTG CACGGGGAAA

   401  ATGCGGCAGA CGAGCGGATT TTGCTGGATT TGGCGGCGGC GGAGTTTGAC

   451  GATTTCCGGC TGAAGTCGGC AGAAAGGCAT TTTGCGGAGG CGGCAAAATT

   501  GGATTTGCCG GCACCGGTTT TGGAAAATGT GGGGCGTTTT CGGAAAAAAA

   551  CGGAGGGGCT GACGGGCTGG CGTTTTTCGG GCGGCATCAG TCCGGCGGTC

   601  AATAGAAATG CCAATAATGC CGCGCCGCAA TATTGCCGGC AAAACGGAGG

   651  CCGGCAGATA TGCAGTGTCA GCCGGGCGGA GCGGGCGGCA GGGTTGAATT

   701  ATGAAATCGA GGCGGAAAAG CTGACGCCGT TGGCAGATAA TCATTATTTG

   751  TTGTTCCGTT CCAATATCGG CGGCACGAGC TATTATTTCA GTAAAAAATC

   801  AGCTTATGAT GACGGGTTCG GCAGGGCGTA TTTGGGTTGG CAGTATAAAA

   851  ATGCACGGCA GACGGCGGGG ATTTTGCCGT TTTATCAGGT GCAGTTGTCG

   901  GGCAGCGACG GCTTTGATGC GAAAACAAAA CGGGTAAACA ACCGCCGCCT

   951  GCCGCCGTAT ATGCTGGCGC ACGGAGTCGG CGTGCAGCTG TCCCATACTT

  1001  ACCGCCCAAA CCCGGGATGG CAATTTTCGG TCGCGCTGGA ACATTACCGC

  1051  CAACGCTACC GCGAACAGGA TAGGGCGGAA TACAATAACG GCAGGCAGGA

  1101  CGGGTTTTAT GTTTCGTCGG CAAAACGTTT GGGCGAATCG GCAACTGTGT

  1151  TCGGCGGCTG GCAGTTTGTG CGGTTTGTGC CGAAACGCGA AACGGTGGGC
```

-continued

```
1201  GGCGCGGTCA ATAATGCCGC CTACCGGCGC AACGGTGTTT ATGCCGGTTG

1251  GGCGCAGGAG TGGCGGCAGT TGGGCGGTTT GAACAGTCGG GTTTCCGCGT

1301  CTTATGCCCG CCGCAACTAT AAGGGCATTG CGGCTTTCTC GACAGAGGCG

1351  CAACGCAACC GCGAATGGAA TGTCTCGCTG GCTTTGAGCC ACGACAAGTT

1401  GTCGTACAAA GGTATCGTGC CGGCGTTGAA TTATCGTTTC GGCAGGACGG

1451  AAAGTAATGT GCCGTATGCG AAACGCCGCA ACAGCGAGGT GTTTGTGTCG

1501  GCGGATTGGC GGTTTTGA
```

This corresponds to the amino acid sequence <SEQ ID 2872; ORF 925>:

```
m935.pep
   1  MLYFRYGFLV VWCAAGVSAA YGADAPAILD DKALLQVQRS VSDKWAESDW

  51  KVENDAPRVV DGDFLLAHPK MLEHSLRDAL NGNQADLIAS LADLYAKLPD

 101  YDAVLYGRAR ALLAKLAGRP AEAVARYREL HGENAADERI LLDLAAAEFD

 151  DFRLKSAERH FAEAAKLDLP APVLENVGRF RKKTEGLTGW RFSGGISPAV

 201  NRNANNAAPQ YCRQNGGRQI CSVSRAERAA GLNYEIEAEK LTPLADNHYL

 251  LFRSNIGGTS YYFSKKSAYD DGFGRAYLGW QYKNARQTAG ILPFYQVQLS

 301  GSDGFDAKTK RVNNRRLPPY MLAHGVGVQL SHTYRPNPGW QFSVALEHYR

 351  QRYREQDRAE YNNGRQDGFY VSSAKRLGES ATVFGGWQFV RFVPKRETVG

 401  GAVNNAAYRR NGVYAGWAQE WRQLGGLNSR VSASYARRNY KGIAAFSTEA

 451  QRNREWNVSL ALSHDKLSYK GIVPALNYRF GRTESNVPYA KRRNSEVFVS

 501  ADWRF*
```

The following partial DNA sequence was identified in *N. meningitidis* <SEQ ID 2873>:

```
a935.seq
   1  ATGTTGTATT TCAGATACGG TTTTTTGGTT GTTTGGTGTG CGGCAGGTGT

  51  TTCTGCCGCC TATGGGGCGG ATGCGCCCGC GATTTTGGAT GACAAGGCAT

 101  TGTTGCAGGT GCAGCGGTCG GTGTCGGATA AGTGGGCGGA ATCGGATTGG

 151  AAAGTTGACA ATGATGCCCC GCGCGTGGTT GACGGGGATT TTTTGTTGGC

 201  GCATCCGAAA ATGTTGGAAC ATAGTTTGCG CGACGTGCTC AACGGCAATC

 251  AGGCGGATTT GATCGCTTCG TTGGCGGATT TGTATGCCAA GCTGCCGGAT

 301  TATGACGCGG TTTTGTACGG CAGGGCGCGG GCTTTGCTGG CGAAATTGGC

 351  GGGAAGGCCG GCGGAGGCGG TGGCGCGGTA TCGGGAACTG CACGGGGAAA

 401  ATGCGGCAGA CGAGCGGATT TTGCTGGATT TGGCGGCGGC GGAGTTTGAC

 451  GATTTCCGGC TGAAGTCGGC AGAAAGGCAT TTTGCCGAGG CGGAAAAATT

 501  GGATTTGCCG GCGCCGGTTT TGGAAAATGT GGGGCGTTTT CGGAAAAAAG

 551  CGGAGGGGCT GACGGGCTGG CGTTTTTCGG GCGGCATCAG TCCGGCGGTC

 601  AATAGAAATG CCAATAATGC CGCGCCGCAG TATTGCCGGC AAAACGGAGG

 651  CCGGCAGATA TGCAGTGTCA GCCGGGCGGA GCGGGCGGCA GGCTTGAATT

 701  ATGAAATCGA GGCGGAAAAA CTGACGGCGT TGGCAGATAA TCATTATTTG

 751  TTGTTCCGTT CCAATATCGG CGGCACGAGC TATTATTTCA GTAAAAAATC
```

-continued

```
 801 AGCTTATGAC GACGGGTTCG GCAGAGCGTA TTTGGGTTGG CAGTATAAAA

 851 ATGCACGGCA GACGGCGGGG ATTTTGCCGT TTTATCAGGT GCAGTTGTCG

 901 GGCAGCGACG GCTTTGATGC GAAAACAAAA CGGGTAAACA ACCGCCGCCT

 951 GCCGCCGTAT ATGCTGGCGC ACGGAGTCGG CGTGCAGTTG TCCCATACTT

1001 ACCGCCCAAA CCCGGGATGG CAATTTTCGG TCGCGCTGGA ACATTACCGC

1051 CAACGCTACC GCGAACAGGA TAGGGCGGAA TACAATAACG GTCGGCAGGA

1101 CGGGTTTTAT GTTTCGTCGG CAAAACGTTT GGGCGAATCG GCAACTGTGT

1151 TCGGCGGCTG GCAGTTTGTG CGGTTTGTGC CGAAACGCGA AACGGTGGGC

1201 GGCGCGGTCA ATAATGCCGC CTACCGGCGC AACGGTGTTT ATGCCGGCTG

1251 GGCGCAGGAG TGGCGGCAGT TGGGCGGTTT GAACAGTCGG GTTTCCGCGT

1301 CTTATGCCCG CCGCAACTAT AAGGGCGTTG CGGCTTTCTC GACAGAGGCG

1351 CAACGCAACC GCGAATGGAA TGTCTCGCTG GCTTTGAGCC ACGACAAGTT

1401 GTCGTACAAA GGTATCGTGC CCGCGTTGAA TTATCGTTTC GGCAGGACGG

1451 AAAGTAATGT GCCGTATGCG AAACGCCGCA ACAGCGAGGT GTTTGTGTCG

1501 GCGGATTGGC GGTTTTGA
```

This corresponds to the amino acid sequence <SEQ ID 2874; ORF 935.a>:

```
a935.pep
  1 MLYFRYGFLV VWCAAGVSAA YGADAPAILD DKALLQVQRS VSDKWAESDW

 51 KVDNDAPRVV DGDFLLAHPK MLEHSLRDVL NGNQADLIAS LADLYAKLPD

101 YDAVLYGRAR ALLAKLAGRP AEAVARYREL HGENAADERI LLDLAAAEFD

151 DFRLKSAERH FAEAEKLDLP APVLENVGRF RKKAEGLTGW RFSGGISPAV

201 NRNANNAAPQ YCRQNGGRQI CSVSRAERAA GLNYEIEAEK LTALADNHYL

251 LFRSNIGGTS YYFSKKSAYD DGFGRAYLGW QYKNARQTAG ILPFYQVQLS

301 GSDGFDAKTK RVNNRRLPPY MLAHGVGVQL SHTYRPNPGW QFSVALEHYR

351 QRYREQDRAE YNNGRQDGFY VSSAKRLGES ATVFGGWQFV RFVPKRETVG

401 GAVNNAAYRR NGVYAGWAQE WRQLGGLNSR VSASYARRNY KGVAAFSTEA

451 QRNREWNVSL ALSHDKLSYK GIVPALNYRF GRTESNVPYA KRRNSEVFVS

501 ADWRF*
```

m935/a935 98.8% identity in 505 aa overlap

```
                      10        20        30        40        50        60
m935.pep      MLYFRYGFLVVWCAAGVSAAYGADAPAILDDKALLQVQRSVSDKWAESDWKVENDAPRVV
              |||||||||||||||||||||||||||||||||||||||||||||||||||:||||||||
a935          MLYFRYGFLVVWCAAGVSAAYGADAPAILDDKALLQVQRSVSDKWAESDWKVDNDAPRVV
                      10        20        30        40        50        60

                      70        80        90       100       110       120
m935.pep      DGDFLLAHPKMLEHSLRDALNGNQADLIASLADLYAKLPDYDAVLYGRARALLAKLAGRP
              ||||||||||||||||||:|||||||||||||||||||||||||||||||||||||||||
a935          DGDFLLAHPKMLEHSLRDVLNGNQADLIASLADLYAKLPDYDAVLYGRARALLAKLAGRP
                      70        80        90       100       110       120

                     130       140       150       160       170       180
m935.pep      AEAVARYRELHGENAADERILLDLAAAERDDFRLKSAERHFAEAAKLDLPAPVLENVGRF
              |||||||||||||||||||||||||||||||||||||||||||| |||||||||||||||
a935          AEAVARYRELHGENAADERILLDLAAAERDDFRLKSAERHFAEAEKLDLPAPVLENVGRF
                     130       140       150       160       170       180
```

```
                190       200       210       220       230       240
m935.pep   RKKTEGLTGWRFSGGISPAVNRNANNAAPQYCRQNGGRQICSVSRAERAAGLNYEIEAEK
           |||:||||||||||||||||||||||||||||||||||||||||||||||||||||||||
a935       RKKAEGLTGWRFSGGISPAVNRNANNAAPQYCRQNGGRQICSVSRAERAAGLNYEIEAEK
                190       200       210       220       230       240

                250       260       270       280       290       300
m935.pep   LTPLADNHYLLFRSNIGGTSYYFSKKSAYDDGFGRAYLGWQYKNARQTAGILPFYQVQLS
           ||:||||||||||||||||||||||||||||||||||||||||||||||||||||||||
a935       LTALADNHYLLFRSNIGGTSYYFSKKSAYDDGFGRAYLGWQYKNARQTAGILPFYQVQLS
                250       260       270       280       290       300

                310       320       330       340       350       360
m935.pep   GSDGFDAKTKRVNNRRLPPYMLAHGVGVQLSHTYRPNPGWQFSVALEHYRQRYREQDRAE
           ||||||||||||||||||||||||||||||||||||||||||||||||||||||||||||
a935       GSDGFDAKTKRVNNRRLPPYMLAHGVGVQLSHTYRPNPGWQFSVALEHYRQRYREQDRAE
                310       320       330       340       350       360

                370       380       390       400       410       420
m935.pep   YNNGRQDGFYVSSAKRLGESATVFGGWQFVRFVPKRETVGGAVNNAAYRRNGVYAGWAQE
           ||||||||||||||||||||||||||||||||||||||||||||||||||||||||||||
a935       YNNGRQDGFYVSSAKRLGESATVFGGWQFVRFVPKRETVGGAVNNAAYRRNGVYAGWAQE
                370       380       390       400       410       420

                430       440       450       460       470       480
m935.pep   WRQLGGLNSRVSASYARRNYKGIAAFSTEAQRNREWNVSLALSHDKLSYKGIVPALNYRF
           |||||||||||||||||||||||||:||||||||||||||||||||||||||||||||||
a935       WRQLGGLNSRVSASYARRNYKGVAAFSTEAQRNREWNVSLALSHDKLSYKGIVPALNYRF
                430       440       450       460       470       480

                490       500
m935.pep   GRTESNVPYAKRRNSEVFVSADWRFX
           |||||||||||||||||||||||||
a935       GRTESNVPYAKRRNSEVFVSADWRFX
                490       500
```

The following partial DNA sequence was identified in *N. gonorrhoeae* <SEQ ID 2875>:

```
g936.seq
   1 ATGAAACCCA AACCACACAC CGTCCGCACC CTGATTGCCG CCGTCCTCAG

  51 CCTTGCCCTC GGCGGCTGCT TCAGCGCAGT CGTCGGCGGG GCCGCCGTCG

 101 GCGCAAAATC CGTCATCGAC CGcccgAACCA CCGgcgcgca AACCGATGac

 151 aACGTTATGG CGTTGCGTAT CGAAACCACC GCCCGTTCCT ACCTGCGCCA

 201 AAACAACCAA ACCAAAGGCT ACACGCCCCA AATCTCCGTC GTCGGCTACA

 251 ACCGCCACCT GCTGCTGCTC GGACAAGTCG CCACCGAAGG CGAAAAACAG

 301 TTCGTCGGTC AGATTGCACG TTCCGAACAG GCCGCCGAAG GCGTATACAA

 351 CTACATTACC GTCGCCTCCC TGCCGCGCAC TGCGGGCGAC ATCGCCGGCG

 401 ACACTTGGAA CACGTCCAAA GTCCGCGCca cgCTGCTGGG CATCAGCCCC

 451 GCTACACAGG CGCGCGTCAA AATCATTACC TACGGCAATG TAACCTACGT

 501 TATGGGCATC CTCACCCCCG AAGAACAGGC GCAGATTACC CAAAAAGTCA

 551 GCACCAccgT CGGCGTACAA AAAGTCATTA CCCTCTACCA AAACTACGTC

 601 CAACGCTGA
```

This corresponds to the amino acid sequence <SEQ ID 2876; ORF 936.ng>:

```
g936.pep
   1 MKPKPHTVRT LIAAVLSLAL GGCFSAVVGG AAVGAKSVID RRTTGAQTDD

  51 NVMALRIETT ARSYLRQNNQ TKGYTPQISV VGYNRHLLLL GQVATEGEKQ

 101 FVGQIARSEQ AAEGVYNYIT VASLPRTAGD IAGDTWNTSK VRATLLGISP

 151 ATQARVKIIT YGNVTYVMGI LTPEEQAQIT QKVSTTVGVQ KVITLYQNYV

 201 QR*
```

The following partial DNA sequence was identified in *N. meningitidis* <SEQ ID 2877>:

```
m936.seq (partial)
   1 ATGAAACCCA AACCGCACAC CGTCCGCACC CTGATTGCCG CCATTTTCAG

  51 CCTTGCCCTT AGCGGCTGCG TCAGCGCAGT AATCGGAAGC GCCGCCGTCG

 101 GCGCGAAATC CGCCGTCGAC CGCCGAACCA CCGGCGCGCA AACCGACGAC

 151 AACGTTATGG CGTTGCGTAT CGAAACCACC GCCCGTTCCT ATCTGCGCCA

 201 AAACAACCAA ACCAAAGGCT ACACGCCCCA AATCTCCGTC GTCGGCTACA

 251 ACCGCCACCT GCTGCTGCTC GGACAAGTCG CCACCGAAGG CGAAAAACAG

 301 TTCGTCGGTC AGATTGCACG TTCCGAACAG GCCGCCGAAG GCGTGTACAA

 351 CTATATTACC GTCGCCTCCC TGCCGCGCAC TGCC...
```

This corresponds to the amino acid sequence <SEQ ID 2878; ORF 936>:

```
m936.pep (partial)
   1 MKPKPHTVRT LIAAIFSLAL SGCVSAVIGS AAVGAKSAVD RRTTGAQTDD

  51 NVMALRIETT ARSYLRQNNQ TKGYTPQISV VGYNRHLLLL GQVATEGEKQ

 101 FVGQIARSEQ AAEGVYNYIT VASLPRTA...
```

Computer analysis of this amino acid sequence gave the following results:

Homology with a Predicted ORF from *N. gonorrhoeae*

ORF 936 shows 93.8% identity over a 128 aa overlap with a predicted ORF (ORF 936.ng) from *N. gonorrhoeae*:

```
m936/g936
                    10        20        30        40        50        60
m936.pep    MKPKPHTVRTLIAAIFSLALSGCVSAVIGSAAVGAKSAVDRRTTGAQTDDNVMALRIETT
            |||||||||||||::||||:|| |||:|:|||||||::||||||||||||||||||||||
g936        MKPKPHTVRTLIAAVLSLALGGCFSAVVGGAAVGAKSVIDRRTTGAQTDDNVMALRIETT
                    10        20        30        40        50        60

                    70        80        90       100       110       120
m936.pep    ARSYLRQNNQTKGYTPQISVVGYNRHLLLLGQVATEGEKQFVGQIARSEQAAEGVYNYIT
            ||||||||||||||||||||||||||||||||||||||||||||||||||||||||||||
g936        ARSYLRQNNQTKGYTPQISVVGYNRHLLLLGQVATEGEKQFVGQIARSEQAAEGVYNYIT
                    70        80        90       100       110       120

                   130
m936.pep    VASLPRTAXXX
            ||||||||
g936        VASLPRTAGDIAGDTWNTSKVRATLLGISPATQARVKIITYGNVTYVMGILTPEEQAQIT
                   130       140       150       160       170       180
```

The following partial DNA sequence was identified in *N. meningitidis* <SEQ ID 2879>:

```
a936.seq
   1 ATGAAACCCA AACCGCACAC CGTCCGCACC CTGACTGCCG CCGTCCTCAG

  51 CCTTGCCCTC GGCGGCTGCG TCAGCGCAGT CGTCGGCGGC GCGGCGGTCG

 101 GCGCGAAATC CGCCGTCGAC CGCCGAACCA CCGGCGCGCA AACCGACGAC

 151 AACGTAATGG CGCTGCGTAT CGAAACCACC GCCCGCTCCT ATCTGCGCCA

 201 AAACAACCAA ACCAAAGGCT ACACGCCCCA AATCTCCGTT GTCGGCTACA

 251 ACCGCCACCT GCTGCTGCTC GGACAAGTCG CCACCGAAGG CGAGAAACAG

 301 TTCGTCGGTC AGATTGCACG TTCCGAACAG GCCGCCGAAG GCGTGTACAA

 351 CTACATTACC GTCGCCTCCC TGCCGCGCAC TGCCGGCGAC ATCGCCGGCG
```

```
401 ACACTTGGAA CACATCCAAA GTCCGCGCCA CGCTGTTGGG CATCAGCCCC

451 GCCACACAGG CGCGCGTCAA AATCGTTACC TACGGCAACG TAACCTACGT

501 TATGGGCATC CTCACCCCCG AAGAACAGGC GCAGATTACC CAAAAAGTCA

551 GCACCACCGT CGGCGTACAA AAAGTCATCA CCCTCTACCA AAACTACGTC

601 CAACGCTGA
```

This corresponds to the amino acid sequence <SEQ ID 2880; ORF 936.a>:

```
a936.pep
  1 MKPKPHTVRT LTAAVLSLAL GGCVSAVVGG AAVGAKSAVD RRTTGAQTDD

 51 NVMALRIETT ARSYLRQNNQ TKGYTPQISV VGYNRHLLLL GQVATEGEKQ

101 FVGQIARSEQ AAEGVYNYIT VASLPRTAGD IAGDTWNTSK VRATLLGISP

151 ATQARVKIVT YGNVTYVMGI LTPEEQAQIT QKVSTTVGVQ KVITLYQNYV

201 QR*
```

M936/a936 95.3% identity in 128 aa overlap

```
                   10        20        30        40        50        60
m936.pep    MKPKPHTVRTLIAAIFSLALSGCVSAVIGSAAVGAKSAVDRRTTGAQTDDNVMALRIETT
            |||||||||| ||::||||:||||||:|:||||||||||||||||||||||||||||||
a936        MKPKPHTVRTLTAAALSLALGGCVSAVGGGAAVGAKSAVDRRTTGAQTDDNVMALRIETT
                   10        20        30        40        50        60

                   70        80        90       100       110       120
m936.pep    ARSYLRQNNQTKGYTPQISVVGYNRHLLLLGQVATEGEKQFVGQIARSEQAAEGVYNYIT
            ||||||||||||||||||||||||||||||||||||||||||||||||||||||||||||
a936        ARSYLRQNNQTKGYTPQISVVGYNRHLLLLGQVATEGEKQFVGQIARSEQAAEGVYNYIT
                   70        80        90       100       110       120

m936.pep    VASLPRTA
            ||||||||
a936        VASLPRTAGDIAGDTWNTSKVRATLLGISPATQARVKIVTYGNVTYVMGILTPEEQAQIT
                  130       140       150       160       170       180
```

The following partial DNA sequence was identified in *N. gonorrhoeae* <SEQ ID 2881>:

```
g936-1.seq
  1 ATGAAACCCA AACCACACAC CGTCCGCACC CTGATTGCCG CCGTCCTCAG

 51 CCTTGCCCTC GGCGGCTGCT TCAGCGCAGT CGTCGGCGGG GCCGCCGTCG

101 GCGCAAAATC CGTCATCGAC CGccgAACCA CCGgcgcgca AACCGATGac

151 aACGTTATGG CGTTGCGTAT CGAAACCACC GCCCGTTCCT ACCTGCGCCA

201 AAACAACCAA ACCAAAGGCT ACACGCCCCA AATCTCCGTC GTCGGCTACA

251 ACCGCCACCT GCTGCTGCTC GGACAAGTCG CCACCGAAGG CGAAAAACAG

301 TTCGTCGGTC AGATTGCACG TTCCGAACAG GCCGCCGAAG GCGTATACAA

351 CTACATTACC GTCGCCTCCC TGCCGCGCAC TGCGGGCGAC ATCGCCGGCG

401 ACACTTGGAA CACGTCCAAA GTCCGCGCca cgCTGCTGGG CATCAGCCCC

451 GCTACACAGG CGCGCGTCAA AATCATTACC TACGGCAATG TAACCTACGT

501 TATGGGCATC CTCACCCCCG AAGAACAGGC GCAGATTACC CAAAAAGTCA

551 GCACCAccgT CGGCGTACAA AAAGTCATTA CCCTCTACCA AAACTACGTC

601 CAACGCTGA
```

This corresponds to the amino acid sequence <SEQ ID 2882; ORF 936-1.ng>:

```
g936-1.pep
   1 MKPKPHTVRT LIAAVLSLAL GGCFSAVVGG AAVGAKSVID RRTTGAQTDD

  51 NVMALRIETT ARSYLRQNNQ TKGYTPQISV VGYNRHLLLL GQVATEGEKQ

 101 FVGQIARSEQ AAEGVYNYIT VASLPRTAGD IAGDTWNTSK VRATLLGISP

 151 ATQARVKIIT YGNVTYVMGI LTPEEQAQIT QKVSTTVGVQ KVITLYQNYV

 201 QR*
```

The following partial DNA sequence was identified in *N. meningitidis* <SEQ ID 2883>:

```
m936-1.seq
   1 ATGAAACCCA AACCGCACAC CGTCCGCACC CTGATTGCCG CCATTTTCAG

  51 CCTTGCCCTT AGCGGCTGCG TCAGCGCAGT AATCGGAAGC GCCGCCGTCG

 101 GCGCGAAATC CGCCGTCGAC CGCCGAACCA CCGGCGCGCA AACCGACGAC

 151 AACGTTATGG CGTTGCGTAT CGAAACCACC GCCCGTTCCT ATCTGCGCCA

 201 AAACAACCAA ACCAAAGGCT ACACGCCCCA AATCTCCGTC GTCGGCTACA

 251 ACCGCCACCT GCTGCTGCTC GGACAAGTCG CCACCGAAGG CGAAAAACAG

 301 TTCGTCGGTC AGATTGCACG TTCCGAACAG GCCGCCGAAG GCGTGTACAA

 351 CTATATTACC GTCGCCTCCC TGCCGCGCAC TGCCGGCGAC ATCGCCGGCG

 401 ACACTTGGAA CACATCCAAA GTCCGCGCCA CGCTGTTGGG CATCAGCCCC

 451 GCCACACAGG CGCGCGTCAA AATCGTTACC TACGGCAACG TAACCTACGT

 501 TATGGGCATC CTCACCCCCG AAGAACAGGC GCAGATTACC CAAAAAGTCA

 551 GCACCACCGT CGGCGTACAA AAAGTCATCA CCCTCTACCA AAACTACGTC

 601 CAACGCTGA
```

This corresponds to the amino acid sequence <SEQ ID 2884; ORF 936-1>:

```
m936-1.pep

      1 MKPKPHTVRT LIAAIFSLAL SGCVSAVIGS AAVGAKSAVD RRTTGAQTDD

     51 NVMALRIETT ARSYLRQNNQ TKGYTPQISV VGYNRHLLLL GQVATEGEKQ

    101 FVGQIARSEQ AAEGVYNYIT VASLPRTAGD IAGDTWNTSK VRATLLGISP

    151 ATQARVKIVT YGNVTYVMGI LTPEEQAQIT QKVSTTVGVQ KVITLYQNYV

    201 QR*

m936-1/g936-1  95.5% identity in 202 aa overlap

                    10        20        30        40        50        60
m936-1.pep  MKPKPHTVRILIAAIFSLALSGCVSAVIGSAAVGAKSAVDRRTTGAQTDDNVMALRIETT
            ||||||||||||||::||||:|| |||:|:|||||||::|||||||||||||||||||||
g936-1      MKPKPHTVRILIAAVLSLALGGCFSAVVGGAAVGAKSVIDRRTTGAQTDDNVMALRIETT
                    10        20        30        40        50        60

                    70        80        90       100       110       120
m936-1.pep  ARSYLRQNNQTKGYTPQISVVGYNRHLLLLGQVATEGEKQFVGQIARSEQAAEGVYNYIT
            ||||||||||||||||||||||||||||||||||||||||||||||||||||||||||||
g936-1      ARSYLRQNNQTKGYTPQISVVGYNRHLLLLGQVATEGEKQFVGQIARSEQAAEGVYNYIT
                    70        80        90       100       110       120

                   130       140       150       160       170       180
m936-1.pep  VASLPRTAGDIAGDTWNTSKVRATLLGISPATQARVKIVTYGNVTYVMGILTPEEQAQIT
            ||||||||||||||||||||||||||||||||||||||||||||:|||||||||||||||
g936-1      VASLPRTAGDIAGDTWNTSKVRATLLGISPATQARVKIITYGNVTYVMGILTPEEQAQIT
                   130       140       150       160       170       180
```

-continued

```
                          190            200
    m936-1.pep    QKVSTTVGVQKVITLYQNYVQRX
                  |||||||||||||||||||||||
    g936-1        QKVSTTVGVQKVITLYQNYVQRX
                          190            200
```

The following partial DNA sequence was identified in *N. meningitidis* <SEQ ID 2885>:

```
a936-1.seq
  1 ATGAAACCCA AACCGCACAC CGTCCGCACC CTGACTGCCG CCGTCCTCAG

 51 CCTTGCCCTC GGCGGCTGCG TCAGCGCAGT CGTCGGCGGC GCGGCGGTCG

101 GCGCGAAATC CGCCGTCGAC CGCCGAACCA CCGGCGCGCA AACCGACGAC

151 AACGTAATGG CGCTGCGTAT CGAAACCACC GCCCGCTCCT ATCTGCGCCA

201 AAACAACCAA ACCAAAGGCT ACACGCCCCA AATCTCCGTT GTCGGCTACA

251 ACCGCCACCT GCTGCTGCTC GGACAAGTCG CCACCGAAGG CGAGAAACAG

301 TTCGTCGGTC AGATTGCACG TTCCGAACAG GCCGCCGAAG GCGTGTACAA

351 CTACATTACC GTCGCCTCCC TGCCGCGCAC TGCCGGCGAC ATCGCCGGCG

401 ACACTTGGAA CACATCCAAA GTCCGCGCCA CGCTGTTGGG CATCAGCCCC

451 GCCACACAGG CGCGCGTCAA AATCGTTACC TACGGCAACG TAACCTACGT

501 TATGGGCATC CTCACCCCCG AAGAACAGGC GCAGATTACC CAAAAAGTCA

551 GCACCACCGT CGGCGTACAA AAAGTCATCA CCCTCTACCA AAACTACGTC

601 CAACGCTGA
```

This corresponds to the amino acid sequence <SEQ ID 2886; ORF 936-1.a>:

```
a936-1.pep

      1  MKPKPHTVRT LTAAVLSLAL GGCVSAVVGG AAVGAKSAVD RRTTGAQTDD

     51  NVMALRIETT ARSYLRQNNQ TKGYTPQISV VGYNRHLLLL GQVATEGEKQ

    101  FVGQIARSEQ AAEGVYNYIT VASLPRTAGD IAGDTWNTSK VRATLLGISP

    151  ATQARVKIVT YGNVTYVMGI LTPEEQAQIT QKVSTTVGVQ KVITLYQNYV

    201  QR*
```

```
  a936-1/m936-1    97.0% identity in 202 aa overlap

                     10        20        30        40        50        60
   m936-1.pep   MKPKPHTVRTLIAAIFSLALSGCVSAVIGSAAVGAKSAVDRRTTGAQTDDNVMALRIETT
                ||||||||||  ::||||:||||| |:||||||||||||||||||||||||||||||||
   a936-1       MKPKPHTVRTLTAAVLSLALGGCVSAVVGGAAVGAKSAVDRRTTGAQTDDNVMALRIETT
                     10        20        30        40        50        60

                     70        80        90       100       110       120
   m936-1.pep   ARSYLRQNNQTKGYTPQISVVGYNRHLLLLGQVATEGEKQFVGQIARSEQAAEGVYNYIT
                ||||||||||||||||||||||||||||||||||||||||||||||||||||||||||||
   a936-1       ARSYLRQNNQTKGYTPQISVVGYNRHLLLLGQVATEGEKQFVGQIARSEQAAEGVYNYIT
                     70        80        90       100       110       120

                    130       140       150       160       170       180
   m936-1.pep   VASLPRTAGDIAGDTWNTSKVRATLLGISPATQARVKIVTYGNVTYVMGILTPEEQAQIT
                ||||||||||||||||||||||||||||||||||||||||||||||||||||||||||||
   a936-1       VASLPRTAGDIAGDTWNTSKVRATLLGISPATQARVKIVTYGNVTYVMGILTPEEQAQIT
                    130       140       150       160       170       180
```

-continued

```
                   190       200
    m936-1.pep  QKVSTTVGVQKVITLYQNYVQRX
                |||||||||||||||||||||||
    a936-1      QKVSTTVGVQKVITLYQNYVQRX
                   190       200
```

The following partial DNA sequence was identified in *N. gonorrhoeae* <SEQ ID 2887>:

```
g937.seq
   1 atGAAAAATA TTCTCTTAgt ATTTGTTAGC TTTGTGCCAT TATGTGTCCG
  51 CACTGATCTG CCGCTGAata tCGAAGACAT AATGaccgAC AAGGGAAAAT
 101 GGAAactGGA AACTTccctt acctacctgA acaGCGAAAA cagCCGCGCC
 151 GCACTTGCCT CACCGGTTTA CATTCAGACC GGCTCCGCTT CCTTTATCCC
 201 CGTCCCGACC GAAATTCAGG AAAACGGCAG CAATACCGAT ATGCTCGCCG
 251 GCACGCTCGG TTTGCGCTAC GGACTGAccg GCAataccgA CATTTACGGC
 301 AGCGGCAGCT ATCTGTGGCA CGAAGAACGC AAACTCGacg GCAACGGCAA
 351 AACCCGCAAC AAACGGATGT CCGACATATC CGCCGGCATC AGCCACACCT
 401 TCCttaAAGa cgGCAAAAAT CCCGCACTCA TCGCTTTCCT CGAAAGCACG
 451 GTTTACGAAA AATCGCGCAA CAAAGCCTCG TCGGGAAAAT CGTGGCTCAT
 501 CGGCGCCACC ACCTACAAAG CCATAGATCC GATTGTCCTT TCCCTCACCG
 551 CCGCCTACCG CATCAACGGC AGCAAAACCC TTTCAGACGA CGTCAAATAC
 601 AAAGCAGGCA ATTACTGGAT GCTGAATCCC AACATCTCAT TTGCCGCCAA
 651 CGACAGAATC AGCCTGACCG GAGGCATCCA ATGGCTGGGC AAACAGCCCG
 701 ACCGCATAGA CGGCAAAAAA GAATCCGCAA GAAACACATC CACCTACGCC
 751 CATTTCGGCG CAGGTTTCGG TTTCACCAAA ACCGCGGCTT TAAACGCATC
 801 CGCACGTTTC AACGTTTCAG GGCAAAGCAG TTCCGAACTG AAATTGGGCG
 851 TACAGCATAC ATTTTAA
```

This corresponds to the amino acid sequence <SEQ ID 2888; ORF 937.ng>:

```
g937.pep
   1 MKNILLVFVS FVPLCVRTDL PLNIEDIMTD KGKWKLETSL TYLNSENSRA
  51 ALASPVYIQT GSASFIPVPT EIQENGSNTD MLAGTLGLRY GLTGNTDIYG
 101 SGSYLWHEER KLDGNGKTRN KRMSDISAGI SHTFLKDGKN PALIAFLEST
 151 VYEKSRNKAS SGKSWLIGAT TYKAIDPIVL SLTAAYRING SKTLSDDVKY
 201 KAGNYWMLNP NISFAANDRI SLTGGIQWLG KQPDRIDGKK ESARNTSTYA
 251 HFGAGFGFTK TAALNASARF NVSGQSSSEL KLGVQHTF*
```

The following partial DNA sequence was identified in *N. meningitidis* <SEQ ID 2889>:

```
m937.seq
   1 ATGAAGCGCA TCTTTTTGCC CGCCTTGCCC GCCATCCTGC CTTTATCCAC
  51 TTATGCCGAC CTGCCCTTGA CGATTGAAGA CATAATGACC GACAAGGGAA
 101 AATGGAAACT GGAAACTTCC CTTACCTACC TGAACAGCGA AAACAACCGC
```

-continued

```
151 GCCGAACTTG CCGCACCGGT TTACATTCAA ACCGGCGCAA CCTCGTTTAT

201 CCCCATTCCG ACCGAAATCC AAgAAAaCGG CAGCAATACC GATATGCTCG

251 TCGGCACGCT CGGTTTGCGC TACGGACTGA CCGGGAATAC CGACATTTAC

301 GGCAGCGGCA GCTATCTGTG GCACGAAGAA CGCAAACTCG ACGGCAACAG

351 CAAAACCCGC AACAAACGGA TGTCCGACGT ATCCCTCGGC ATCAGCCACA

401 CTTTCCTTAA AGACGACAAA AACCCCGCCC TAATCAGCTT TCTTGAAAGC

451 ACGGTTTACG AAAAATCGCG CAACAAAGCC TCGTCGGGAA AATCCTGGCT

501 CATCGGCGCC ACCACCTACA AAGCCATAGA TCCGATTGTC CTTTCCTTAA

551 CCGCCGCCTA CCGCATCAAC GGCAGCAAAA CCCTTTCAGA CGGCATCCGC

601 TACAAATCGG GCAACTACCT GCTGCTCAAC CCCAACATCT CATTTGCTGC

651 CAACGACAGA ATCAGCCTGA CCGGAGGCAT CCAATGGCTG GGCAGGCAGC

701 CCGACCGGAC GGACGGCAAA CGGGAATCCT CCAGAAACAC ATCCACCTAC

751 GCCCATTTCG GCGCAGGTTT CGGTTTCACC AAAACCACGG CTTTAAACGC

801 ATCCGCACGT TTCAACGTTT CAGGGCAAAG CAGTTCCGAA CTGAAATTTG

851 GCGTACAGCA TACATTTTAA
```

This corresponds to the amino acid sequence <SEQ ID 2890; ORF 937>:

```
m937.pep..
  1 MKRIFLPALP AILPLSTYAD LPLTIEDIMT DKGKWKLETS LTYLNSENNR

 51 AELAAPVYIQ TGATSFIPIP TEIQENGSNT DMLVGTLGLR YGLTGNTDIY

101 GSGSYLWHEE RKLDGNSKTR NKRMSDVSLG ISHTFLKDDK NPALISFLES

151 TVYEKSRNKA SSGKSWLIGA TTYKAIDPIV LSLTAAYRIN GSKTLSDGIR

201 YKSGNYLLLN PNISFAANDR ISLTGGIQWL GRQPDRTDGK RESSRNTSTY

251 AHFGAGFGFT KTTALNASAR FNVSGQSSSE LKFGVQHTF*
```

Computer analysis of this amino acid sequence gave the following results:

Homology with a Predicted ORF from *N. gonorrhoeae*

ORF 937 shows 86.9% identity over a 289 aa overlap with a predicted ORF (ORF 937.ng) from *N. gonorrhoeae*:

```
g937/m937

                     10        20        30        40        50        59
g937.pep    MKNILL-VFVSFVPLCVRTDLPLNIEDIMTDKGKWKLETSLTYLNSENSRAALASPVYIQ
            || |:| :: :::|| : :||||:||||||||||||||||||||||||:|| ||:|||||
m937        MKRIFLPALPAILPLSTYADLPLTIEDIMTDKGKWKLETSLTYLNSENNRAELAAPVYIQ
                    10        20        30        40        50        60

            60        70        80        90       100       110       119
g937.pep    TGSASFIPVPTEIQENGSNTDMLAGTLGLRYGLTGNTDIYGSGSYLWHEERKLDGNGKTR
            ||::||||:||||||||||||||:||||||||||||||||||||||||||||||||:|||
m937        TGATSFIPIPTEIQENGSNTDMLVGTLGLRYGLTGNTDIYGSGSYLWHEERKLDGNSKTR
                    70        80        90       100       110       120

           120       130       140       150       160       170       179
g937.pep    NKRMSDISAGISHTFLKDGKNPALIAFLESTVYEKSRNKASSGKSWLIGATTYKAIDPIV
            ||||||:| ||||||||| ||||||:||||||||||||||||||||||||||||||||||
m937        NKRMSDVSLGISHTFLKDDKNPALISFLESTVYEKSRNKASSGKSWLIGATTYKAIDPIV
                   130       140       150       160       170       180

           180       190       200       210       220       230       239
g937.pep    LSLTAAYRINGSKTLSDDVKYKAGNYWMLNPNISFAANDRISLTGGIQWLGKQPDRIDGK
            ||||||||||||||||| ::||:||| :|||||||||||||||||||||||:|||| |||
m937        LSLTAAYRINGSKTLSDGIRYKSGNYLLLNPNISFAANDRISLTGGIQWLGRQPDRTDGK
                   190       200       210       220       230       240
```

-continued

```
                240       250       260       270       280       289
g937.pep   KESARNTSTYAHFGAGFGFTKTAALNASARFNVSGQSSSELKLGVQHTFX
           :||:||||||||||||||||||:|||||||||||||||||||:|||||||
m937       RESSRNTSTYAHFGAGFGFTKTTALNASARFNVSGQSSSELKFGVQHTFX
                    250       260       270       280
```

The following partial DNA sequence was identified in *N. meningitidis* <SEQ ID 2891>:

```
a937.seq
  1 ATGAAGCGCA TCTTTTTGCC CGCCTTGCCC GCCATCCTGC CTTTATCCGC

 51 TTATGCCGAC CTGCCCTTGA CGATTGAAGA CATAATGACC GACAAGGGCA

101 AATGGAAACT GGAAACTTCC CTTACCTACC TGAACAGCGA AAACAACCGC

151 GCCGAACTTG CCGCACCGGT TTACATCCAA ACCGGCGCAA CCTCGTTTAT

201 CCCCATTCCG ACCGAAATCC AAGAAAACGG CAGCAATACC GATATGCTCG

251 TTGGCACGCT CGGTTTGCGC TACGGACTGA CCGGGAATAC CGACATTTAC

301 GGCAGCGGCA GCTATCTGTG GCACGAAGAA CGCAAACTCG ACGGCAACGG

351 CAAAACCCGA AACAAACGGA TGTCCGACGT ATCCCTCGGC ATCAGCCACA

401 CCTTCCTTAA AGACGACAAA AACCCCGCCC TAATCAGCTT TCTTGAAAGC

451 ACGGTTTACG AAAAATCGCG CAACAAAGCC TCGTCGGGAA AATCCTGGCT

501 CATCGGCGCC ACCACCTACA AAGCCATCGA CCCCGTCGTC CTCTCATTGA

551 CCGCTGCCTA CCGTATCAAC GGCAGCAAAA CCCTTTCAAG CAACACCAAA

601 TACAAAGCAG GCAATTACTG GATGCTGAAT CCCAATATAT CCTTCGCCGC

651 CAACGACAGA ATCAGCCTCA CGGGCGGCAT CCAATGGCTG GGCAAGCAGC

701 CCGACCGTCT GGACGGCAAA AAAGAATCCG CAAGAAACAC ATCCACCTAT

751 GCCCATTTCG GCGCAGGTTT CGGTTTCACC AAAACCACGG CTTTAAACGC

801 ATCCGCACGT TTCAACGTTT CAGGGCAAAG CAGTTCCGAA CTGAAATTTG

851 GCGTACAGCA TACGTTTTAA
```

This corresponds to the amino acid sequence <SEQ ID 2892; ORF 937.a>:

```
a937.pep
  1 MKRIFLPALP AILPLSAYAD LPLTIEDIMT DKGKWKLETS LTYLNSENNR

 51 AELAAPVYIQ TGATSFIPIP TEIQENGSNT DMLVGTLGLR YGLTGNTDIY

101 GSGSYLWHEE RKLDGNGKTR NKRMSDVSLG ISHTFLKDDK NPALISFLES

151 TVYEKSRNKA SSGKSWLIGA TTYKAIDPVV LSLTAAYRIN GSKTLSSNTK

201 YKAGNYWMLN PNISFAANDR ISLTGGIQWL GKQPDRLDGK KESARNTSTY

251 AHFGAGFGFT KTTALNASAR FNVSGQSSSE LKFGVQHTF*
```

m937/a937 95.2% identity in 289 aa overlap

```
                     10        20        30        40        50        60
m937.pep   MKRIFLPALPAILPLSTYADLPLTIEDIMTDKGKWKLETSLTYLNSENNRAELAAPVYIQ
           ||||||||||||||||:|||||||||||||||||||||||||||||||||||||||||||
a937       MKRIFLPALPAILPLSAYADLPLTIEDIMTDKGKWKLETSLTYLNSENNRAELAAPVYIQ
                     10        20        30        40        50        60
```

-continued

```
                  70        80        90       100       110       120
m937.pep  TGATSFIPIPTEIQENGSNTDMLVGTLGLRYGLTGNTDIYGSGSYLWHEERKLDGNSKTR
          ||||||||||||||||||||||||||||||||||||||||||||||||||||||||:|||
a937      TGATSFIPIPTEIQENGSNTDMLVGTLGLRYGLTGNTDIYGSGSYLWHEERKLDGNGKTR
                  70        80        90       100       110       120

                 130       140       150       160       170       180
m937.pep  NKRMSDVSLGISHTFLKDDKNPALISFLESTVYEKSRNKASSGKSWLIGATTYKAIDPIV
          ||||||||||||||||||||||||||||||||||||||||||||||||||||||||||:|
a937      NKRMSDVSLGISHTFLKDDKNPALISFLESTVYEKSRNKASSGKSWLIGATTYKAIDPVV
                 130       140       150       160       170       180

                 190       200       210       220       230       240
m937.pep  LSLTAAYRINGSKTLSDGIRYKSGNYLLLNPNISFAANDRISLTGGIQWLGRQPDRTDGK
          ||||||||||||||||:: :||:||| :|||||||||||||||||||||||:||||:|||
a937      LSLTAAYRINGSKTLSSNTKYKAGNYWMLNPNISFAANDRISLTGGIQWLGKQPDRLDGK
                 190       200       210       220       230       240

                 250       260       270       280       290
m937.pep  RESSRNTSTYAHFGAGFGFTKTTALNASARFNVSGQSSSELKFGVQHTFX
          :||:||||||||||||||||||||||||||||||||||||||||||||||
a937      KESARNTSTYAHFGAGFGFTKTTALNASARFNVSGQSSSELKFGVQHTFX
                 250       260       270       280       290

g939.seq not found yet
g939.pep not found yet
```

The following partial DNA sequence was identified in *N. meningitidis* <SEQ ID 2893>:

```
m939.seq (partial)
   1 ATGAAACGAT TGACTTTATT GGCCTTTGTT TTGGCTGCCG GTGCGGTTTC

  51 CGCCTCTCCC AAAGCAGACG TGGAAAAAGG CAAACAGGTT GCCGCAACGG

 101 TTTGTGCGGC TTGCCATGCA GCAGACGGTA ACAGCGGCAT TGCGATGTAT

 151 CCGCGTTTGG CGGCACAGCA TACTGCTTAC ATCTATCATC AAACTATCGG

 201 CATCCGCGAC GTAAACGCAC CC...
```

This corresponds to the amino acid sequence <SEQ ID 2894; ORF 939>:

```
m939.pep (partial)
  1 MKRLTLLAFV LAAGAVSASP KADVEKGKQV AATVCAACHA ADGNSGIAMY

 51 PRLAAQHTAY IYHQTIGIRD VNAP...
```

The following partial DNA sequence was identified in *N. meningitidis* <SEQ ID 2895>:

```
a939.seq
   1 ATGAAACGAT TGACTTTATT GGCCTTTGTT TTGGCTGCCG GTGCGGTTTC

  51 CGCATCTCCC AAAGCAGACG TGGAAAAAGG CAAACAGGTT GCCGCAACGG

 101 TTTGTGCGGC TTGCCATGCA GCAGACGGTA ACAGCGGCAT TGCGATGTAT

 151 CCGCGTTTGG CGGCACAGCA TACTGCTTAC ATCTATCATC AAACCATCGG

 201 CATCCGCGAC GGTAAACGCA CCCACGGTTC GGCAGCTGTG ATGAAACCGG

 251 TGGTAATGAA TTTGAGCGAT CAGGATATTT TGAACGTATC CGCATTCTAT

 301 GCCAAACAGC AGCCCAAATC CGGTGAAGCC AATCCTAAGG AAAATCCCGA

 351 ATTGGGTGCG AAAATCTATC GCGGCGGTTT GAGCGATAAA AAAGTGCCGG

 401 CGTGTATGTC CTGCCACGGT CCGAGCGGTG CGGGTATGCC GGGGGGCGGA

 451 AGCGAAATTC AGGCTTATCC GCGTTTGGGC GGTCAGCATC AGGCATATAT

 501 TGTTGAACAG ATGAATGCCT ACAAGTCCGG TCAGCGTAAA AATACCATCA

 551 TGGAAGATAT TGCAAACCGT ATGTCTGAAG AAGATTTGAA AGCGGTCGCC
```

```
601 AACTTTATCC AAGGTTTGCG TTAA
```

This corresponds to the amino acid sequence <SEQ ID 2896; ORF 939.a>:

```
a939.pep
   1 MKRLTLLAFV LAAGAVSASP KADVEKGKQV AATVCAACHA ADGNSGIAMY

  51 PRLAAQHTAY IYHQTIGIRD GKRTHGSAAV MKPVVMNLSD QDILNVSAFY

 101 AKQQPKSGEA NPKENPELGA KIYRGGLSDK KVPACMSCHG PSGAGMPGGG

 151 SEIQAYPRLG GQHQAYIVEQ MNAYKSGQRK NTIMEDIANR MSEEDLKAVA

 201 NFIQGLR*
```

m939/a939 100.0% identity in 70 aa overlap

```
                    10        20        30        40        50        60
m939.pep   MKRLTLLAFVLAAGAVSASPKADVEKGKQVAATVCAACHAADGNSGIAMYPRLAAQHTAY
           ||||||||||||||||||||||||||||||||||||||||||||||||||||||||||||
a939       MKRLTLLAFVLAAGAVSASPKADVEKGKQVAATVCAACHAADGNSGIAMYPRLAAQHTAY
                    10        20        30        40        50        60

                    70
m939.pep   IYHQTIGIRDVNAP
           ||||||||||
a939       IYHQTIGIRDGKRTHGSAAVMKPVVMNLSDQDILNVSAFYAKQQPKSGEANPKENPELGA
                    70        80        90       100       110       120
```

The following partial DNA sequence was identified in *N. gonorrhoeae* <SEQ ID 2897>:

```
g950.seq
   1 ATGAACAAAA ATATTGCTGC CGCACTCGCC GGTGCTTTAT CCCTGTCTCT

  51 GGCCGCCGGC GCCGTTGCCG CCCACAAACC GGCAAGCAAC GCAACAGGCG

 101 TTCAAAAATC CGCCCAAGGC TCTTGCGGCG CATCCAAATC TGCCGAAGGT

 151 TCGTGCGGCG CATCCAAATC TGCCGAAGGT TCGTGCGGCG CGGCTGCTTC

 201 TAAAGCAGGC GAAGGCAAAT GCGGCGAGGG CAAATGCGGT GCAACTGTAA

 251 AAAAAGCCCA CAAACACACC AAAGCATCTA AAGCCAAAGC CAAATCTGCC

 301 GAAGGCAAAT GCGGCGAAGG CAAATGCGGT TCTAAATAA
```

This corresponds to the amino acid sequence <SEQ ID 2898; ORF 950.ng>:

```
g950.pep
   1 MNKNIAAALA GALSLSLAAG AVAAHKPASN ATGVQKSAQG SCGASKSAEG

  51 SCGASKSAEG SCGAAASKAG EGKCGEGKCG ATVKKAHKHT KASKAKAKSA

 101 EGKCGEGKCG SK*
```

The following partial DNA sequence was identified in *N. meningitidis* <SEQ ID 2899>:

```
m950.seq
   1 ATGAACAAAA ACATTGCTGC CGCTCTCGCC GGTGCTTTAT CCCTGTCTTT

  51 GGCCGCCGGT GCAGTTGCTG CCAACAAACC GGCAAGCAAC GCAACAGGCG

 101 TTCATAAATC CGCCCATGGC TCTTGCGGCG CGTCCAAATC TGCCGAAGGT
```

-continued

```
151 TCGTGCGGCG CGGCTGGTTC TAAAGCAGGC GAAGGCAAAT GCGGCGAGGG

201 CAAATGCGGT GCGACCGTAA AAAAAACCCA CAAACACACC AAAGCATCTA

251 AAGCCAAGGC CAAATCTGCC GAAGGCAAAT GCGGCGAAGG CAAATGCGGT

301 TCTAAATAA
```

This corresponds to the amino acid sequence <SEQ ID 2900; ORF 950>:

```
m950.pep
  1 MNKNIAAALA GALSLSLAAG AVAANKPASN ATGVHKSAHG SCGASKSAEG

 51 SCGAAGSKAG EGKCGEGKCG ATVKKTHKHT KASKAKAKSA EGKCGEGKCG

101 SK
```

Computer analysis of this amino acid sequence gave the following results:

Homology with a Predicted ORF from *N. gonorrhoeae*

ORF 950 shows 86.6% identity over a 112 aa overlap with a predicted ORF (ORF 950) from *N. gonorrhoeae*

```
m950/g950   86.6% identity in 112 aa overlap

                    10        20        30        40        50
m950.pep    MNKNIAAALAGALSLSLAAGAVAANKPASNATGVHKSAHGSCGASKSAEGSCGA------
            |||||||||||||||||||||||:|||||||||||||||||||||||||||||
g950        MNKNIAAALAGALSLSLAAGAVAAHKPASNATGVQKSAQGSCGASKSAEGSCGASKSAEG
                    10        20        30        40        50        60

                    60        70        80        90       100
m950.pep    ----AGSKAGEGKCGEGKCGATVKKTHKHTKASKAKAKSAEGKCGEGKCGSK
                |:||||||||||||||:|||||||||||||||||||||||||||
g950        SCGAAASKAGEGKCGEGKCGATVKKAHKHTKASKAKAKSAEGKCGEGKCGSKX
                    70        80        90       100       110
```

The following partial DNA sequence was identified in *N. meningitidis* <SEQ ID 2901>:

```
a950.seq
  1 ATGAACAAAA ACATTGCTGC CGCACTCGCC GGTGCTTTAT CCCTGTCTTT

 51 GGCCGCCGGT GCAGTTGCTG CCAACAAACC GGCAAGCAAC GCAACAGGCG

101 TTCATAAATC CGCCCATGGC TCTTGCGGCG CGTCCAAATC TGCCGAAGGT

151 TCGTGCGGCG CGGCTGGTTC TAAAGCAGGC GAAGGCAAAT GCGGCGAGGG

201 CAAATGCGGT GCGACCGTAA AAAAAACCCA CAAACACACC AAAGCATCTA

251 AAGCCAAGGC CAAATCTGCC GAAGGCAAAT GCGGCGAAGG CAAATGCGGT

301 TCTAAATAA
```

This corresponds to the amino acid sequence <SEQ ID 2902; ORF 950.a>:

```
a950.pep
  1 MNKNIAAALA GALSLSLAAG AVAANKPASN ATGVHKSAHG SCGASKSAEG

 51 SCGAAGSKAG EGKCGEGKCG ATVKKTHKHT KASKAKAKSA EGKCGEGKCG

101 SK*
```

Computer analysis of this amino acid sequence gave the following results:

Homology with a Predicted ORF from *N. meningitidis*

ORF 950 shows 100.0% identity over a 102 aa overlap with a predicted ORF (ORF 950) from *N. meningitidis*

```
a950/m950   100.0% identity in 102 aa overlap

                    10        20        30        40        50        60
a950.pep    MNKNIAAALAGALSLSLAAGAVAANKPASNATGVHKSAHGSCGASKSAEGSCGAAGSKAG
            ||||||||||||||||||||||||||||||||||||||||||||||||||||||||||||
m950        MNKNIAAALAGALSLSLAAGAVAANKPASNATGVHKSAHGSCGASKSAEGSCGAAGSKAG
                    10        20        30        40        50        60
                    70        80        90       100
a950.pep    EGKCGECKCGATVKKTHKHTKASKAKAKSAEGKCGEGKCGSKX
            ||||||||||||||||||||||||||||||||||||||||||
m950        EGKCGEGKCGATVKKTHKHTKASKAKAKSAEGKCGEGKCGSK
                    70        80        90       100
```

The following partial DNA sequence was identified in *N. gonorrhoeae* <SEQ ID 2903>:

```
g951.seq
   1 ATGATTATGT TACCCGCCCG TTTCACTATT TTATCTGTCC TCGCAGCAGC

  51 CCTGCTTGCC GGACAGGCGT ATGCTGCCGG CGCGGCGGAT GTGGAGCTGC

 101 CGAAGGAAGT CGGAAAGGTT TTAAGGAAAC ATCGGCGTTA CAGCGAGGAA

 151 GAAATCAAAA ACGAACGCGC ACGGCTTGCG GCAGTGGGCG AACGGGTCAA

 201 CAGGGTGTTT ACGCTGTTGG GCGGTGAAAC GGCTTTGCAG AAAGGGCAGG

 251 CGGGAACGGC TCTGGCAACC TATATGCTGA TGTTGGAACG CACAAAATCC

 301 CCCGAAGTCG CCGAACGCGC CTTGGAAATG GCCGTGTCGC TGAACGCGTT

 351 TGAACAGGCG GAAATGATTT ATCAGAAATG GCGGCAGATC GAGCCTATAC

 401 CGGGTGAGGC GCAAAAACGG GCGGGGTGGC TGCGGAACGT ATTGAGGGAA

 451 GGGGGAAATC AGCATCTGGA CGGGTTGGAA GAGGTGCTGG CGCAATCGGA

 501 CGATGTGCAA AAACGCAGGA TATTTTTGCT GCTGGTGCAA GCCGCCGTGC

 551 AGCAGGGTGG GGTGGCTCAA AAAGCATCGA AAGCGGTTCG CCGTGCGGCG

 601 TTGAAGTATG AACATCTGCC CGAAGCGGCG GTTGCCGATG CGGTGTTCGG

 651 CGTACAGGGA CGCGAAAAGG AAAAGGCAAT CGAAGCTTTG CAGCGTTTGG

 701 CGAAGCTCGA TACGGAAATA TTGCCCCCCA CTTTAATGAC GTTGCGTCTG

 751 ACTGCACGCA AATATCCCGA AATACTCGAC GGCTTTTTCG AGCAGACAGA

 801 CACCCAAAAC CTTTCGGCCG TCTGGCAGGA AATGGAAATT ATGAATCTGG

 851 TTTCCCTGCG TAAGCCGGAT GATGCCTATG CGCGTTTGAA CGTGCTGTTG

 901 GAACACAACC CGAATGCAAA CCTGTATATT CAGGCGGCGA TATTGGCGGC

 951 AAACCGAAAA GAAGGTGCGT CCGTTATCGA CGGCTACGCC GAAAAGGCAT

1001 ACGGCAGGGG GACGGGGGAA CAGCGGGGCA GGGCGGCAAT GACGGCGGCG

1051 ATGATATATG CCGACCGCAG GGATTACGCC AAAGTCAGGC AGTGGTTGAA

1101 AAAAGTGTCC GCGCCGGAAT ACCTGTTCGA CAAAGGCGTG CTGGCGGCTG

1151 CGGCGGCTGC CGAATTGGAC GGAGGCCGGG CGGCTTTGCG GCAGATCGGC

1201 AGGGTGCGGA AACTTCCCGA ACAGCAGGGG CGGTATTTTA CGGCAGACAA

1251 TTTGTCCAAA ATACAGATGC TCGCCCTGTC GAAGCTGCCC GACAAACGGG

1301 AAGCCCTGAT CGGGCTGAAC AACATCATCG CCAAACTTTC GGCGGCGGGA

1351 AGCACGGAAC CTTTGGCGGA AGCATTGGCA CAGCGTTCCA TTATTTACGA

1401 ACAGTTCGGC AAACGGGGAA AAATGATTGC CGACCTTGAA ACCGCGCTCA

1451 AACTTACGCC CGATAATGCA CAAATTATGA ATAATCTGGG CTACAGCCTG
```

-continued

```
1501 CTTTCCGATT CCAAACGTTT GGACGAGGGT TTCGCCCTGC TTCAGACGGC

1551 ATACCAAATC AACCCGGACG ATACCGCCGT TAACGACAGC ATAGGCTGGG

1601 CGTATTACCT GAAAGGCGAC GCGGAAAGCG CGCTGCCGTA TCTGCGGTAT

1651 TCGTTTGAAA ACGACCCCGA GCCCGAAGTT GCCGCCCATT TGGGCGAAGT

1701 GTTGTGGGCA TTGGGCGAAC GCGATCAGGC GGTTGACGTA TGGACGCAGG

1751 CGGCACACCT TAGGGGAGAC AAGAAAATAT GGCGGGAGAC GCTCAAACGC

1801 TACGGAATCG CCTTGCCCGA GCCTTCCCGA AAACCCCGGA AATAA
```

This corresponds to the amino acid sequence <SEQ ID 2904; ORF 951.ng>:

```
g951.pep
  1 MIMLPARFTI LSVLAAALLA GQAYAAGAAD VELPKEVGKV LRKHRRYSEE

 51 EIKNERARLA AVGERVNRVF TLLGGETALQ KGQAGTALAT YMLMLERTKS

101 PEVAERALEM AVSLNAFEQA EMIYQKWRQI EPIPGEAQKR AGWLRNVLRE

151 GGNQHLDGLE EVLAQSDDVQ KRRIFLLLVQ AAVQQGGVAQ KASKAVRRAA

201 LKYEHLPEAA VADAVFGVQG REKEKAIEAL QRLAKLDTEI LPPTLMTLRL

251 TARKYPEILD GFFEQTDTQN LSAVWQEMEI MNLVSLRKPD DAYARLNVLL

301 EHNPNANLYI QAAILAANRK EGASVIDGYA EKAYGRGTGE QRGRAAMTAA

351 MIYADRRDYA KVRQWLKKVS APEYLFDKGV LAAAAAAELD GGRAALRQIG

401 RVRKLPEQQG RYFTADNLSK IQMLALSKLP DKREALIGLN NIIAKLSAAG

451 STEPLAEALA QRSIIYEQFG KRGKMIADLE TALKLTPDNA QIMNNLGYSL

501 LSDSKRLDEG FALLQTAYQI NPDDTAVNDS IGWAYYLKGD AESALPYLRY

551 SFENDPEPEV AAHLGEVLWA LGERDQAVDV WTQAAHLRGD KKIWRETLKR

601 YGIALPEPSR KPRK*
```

The following partial DNA sequence was identified in *N. meningitidis* <SEQ ID 2905>:

```
m951.seq
  1 ATGATTATGT TACCTAACCG TTTCAAAATG TTAACTGTGT TGACGGCAAC

 51 CTTGATTGCC GGACAGGTAT CTGCCGCCGG AGGCGGTGCG GGGGATATGA

101 AACAGCCGAA GGAAGTCGGA AAGGTTTTCA GAAAGCAGCA GCGTTACAGC

151 GAGGAAGAAA TCAAAAACGA ACGCGCACGG CTTGCGGCAG TGGGCGAGCG

201 GGTTAATCAG ATATTTACGT TGCTGGGAGG GGAAACCGCC TTGCAAAAGG

251 GGCAGGCGGG AACGGCTCTG GCAACCTATA TGCTGATGTT GGAACGCACA

301 AAATCCCCCG AAGTCGCCGA ACGCGCCTTG GAAATGGCCG TGTCGCTGAA

351 CGCGTTTGAA CAGGCGGAAA TGATTTATCA GAAATGGCGG CAGATTGAGC

401 CTATACCGGG TAAGGCGCAA AAACGGGCGG GGTGGCTGCG GAACGTGCTG

451 AGGGAAAGAG GAAATCAGCA TCTGGACGGA CTGGAAGAAG TGCTGGCTCA

501 GGCGGACGAA GGACAGAACC GCAGGGTGTT TTTATTGTTG GCACAAGCCG

551 CCGTGCAACA GGACGGGTTG GCGCAAAAAG CATCGAAAGC GGTTCGCCGC

601 GCGGCGTTGA AATATGAACA TCTGCCCGAA GCGGCGGTTG CCGATGTGGT

651 GTTCAGCGTA CAGGGACGCG AAAAGGAAAA GGCAATCGGA GCTTTGCAGC
```

-continued

```
 701 GTTTGGCGAA GCTCGATACG GAAATATTGC CCCCCACTTT AATGACGTTG

 751 CGTCTGACTG CACGCAAATA TCCCGAAATA CTCGACGGCT TTTTCGAGCA

 801 GACAGACACC CAAAACCTTT CGGCCGTCTG GCAGGAAATG GAAATTATGA

 851 ATCTGGTTTC CCTGCACAGG CTGGATGATG CCTATGCGCG TTTGAACGTG

 901 CTGTTGGAAC GCAATCCGAA TGCAGACCTG TATATTCAGG CAGCGATATT

 951 GGCGGCAAAC CGAAAAGAAG GTGCTTCCGT TATCGACGGC TACGCCGAAA

1001 AGGCATACGG CAGGGGGACG GAGGAACAGC GGAGCAGGGC GGCGCTAACG

1051 GCGGCGATGA TGTATGCCGA CCGCAGGGAT TACGCCAAAG TCAGGCAGTG

1101 GCTGAAAAAA GTATCCGCGC CGGAATACCT GTTCGACAAA GGTGTGCTGG

1151 CGGCTGCGGC GGCTGTCGAG TTGGACGGCG GCAGGGCGGC TTTGCGGCAG

1201 ATCGGCAGGG TGCGGAAACT TCCCGAACAG CAGGGGCGGT ATTTTACGGC

1251 AGACAATTTG TCCAAAATAC AGATGCTCGC CCTGTCGAAG CTGCCCGATA

1301 AACGGGAGGC TTTGAGGGGG TTGGACAAGA TTATCGAAAA ACCGCCTGCC

1351 GGCAGTAATA CAGAGTTACA GGCAGAGGCA TTGGTACAGC GGTCAGTTGT

1401 TTACGATCGG CTTGGCAAGC GGAAAAAAAT GATTTCAGAT CTTGAAAGGG

1451 CGTTCAGGCT TGCACCCGAT AACGCTCAGA TTATGAATAA TCTGGGCTAC

1501 AGCCTGCTGA CCGATTCCAA ACGTTTGGAC GAAGGTTTCG CCCTGCTTCA

1551 GACGGCATAC CAAATCAACC CGGACGATAC CGCTGTCAAC GACAGCATAG

1601 GCTGGGCGTA TTACCTGAAA GGCGACGCGG AAAGCGCGCT GCCGTATCTG

1651 CGGTATTCGT TTGAAAACGA CCCCGAGCCC GAAGTTGCCG CCCATTTGGG

1701 CGAAGTGTTG TGGGCATTGG GCGAACGCGA TCAGGCGGTT GACGTATGGA

1751 CGCAGGCGGC ACACCTTACG GGAGACAAGA AAATATGGCG GGAAACGCTC

1801 AAACGTCACG GCATCGCATT GCCCCAACCT TCCCGAAAAC CTCGGAAATA

1851 A
```

This corresponds to the amino acid sequence <SEQ ID 2906; ORF 791>:

```
m951.pep
  1 MIMLPNRFKM LTVLTATLIA GQVSAAGGGA GDMKQPKEVG KVFRKQQRYS

 51 EEEIKNERAR LAAVGERVNQ IFTLLGGETA LQKGQAGTAL ATYMLMLERT

101 KSPEVAERAL EMAVSLNAFE QAEMIYQKWR QIEPIPGKAQ KRAGWLRNVL

151 RERGNQHLDG LEEVLAQADE GQNRRVFLLL AQAAVQQDGL AQKASKAVRR

201 AALKYEHLPE AAVADVVFSV QGREKEKAIG ALQRLAKLDT EILPPTLMTL

251 RLTARKYPEI LDGFFEQTDT QNLSAVWQEM EIMNLVSLHR LDDAYARLNV

301 LLERNPNADL YIQAAILAAN RKEGASVIDG YAEKAYGRGT EEQRSRAALT

351 AAMMYADRRD YAKVRQWLKK VSAPEYLFDK GVLAAAAAVE LDGGRAALRQ

401 IGRVRKLPEQ QGRYFTADNL SKIQMLALSK LPDKREALRG LDKIIEKPPA

451 GSNTELQAEA LVQRSVVYDR LGKRKKMISD LERAFRLAPD NAQIMNNLGY

501 SLLTDSKRLD EGFALLQTAY QINPDDTAVN DSIGWAYYLK GDAESALPYL

551 RYSFENDPEP EVAAHLGEVL WALGERDQAV DVWTQAAHLT GDKKIWRETL

601 KRHGIALPQP SRKPRK*
```

Computer analysis of this amino acid sequence gave the following results:

Homology with a Predicted ORF from *N. gonorrhoeae*

ORF 951 shows 88.6% identity over a 616 aa overlap with a predicted ORF (ORF 951) from *N. gonorrhoeae*

```
m951/g951 88.6% indentity in 616 aa overlap

                   10        20        30        40        50        60
m951.pep    MIMLPNRFKMLTVLTATLIAGQVSAAGGGAGDMKQPKEVGKVFRKQQRYSEEEIKNERAR
            ||||| || :|:||:|:|:|||: ||  ||:|:: ||||||:||::||||||||||||
g951        MIMLPNRFTILSVLAAALLAGQAYAA--GAAADVELPKEVGKVFLKQHRYSEEEIKNERAR
                   10        20         30         40        50

                   70        80        90       100       120       130
m951.pep    LAAVGERVNQIFTLLGGETALQKGQAGTALATYMLMLERTKSPEVAERALEMAVSLNAFE
            ||||||||::||||||||||||||||||||||||||||||||||||||||||||||||||
g951        LAAVGERVNRVFTLLGGETALQKGQAGTALATYMLMLERTKSPEVAERALEMAVSLNAFE
            60        70        80        90       100       110

                  130       140       150       160       170       180
m951.pep    QAEMIYQKWRQIEPIPGKAQKRAGQLRNVLRERGNQHLDGLEEVLAQADEGQNRRVFLLL
            ||||||||||||||||:||||||||||||| |||||||||||||:|: |:||:||||
g951        QAEMIYQKWRQIEPIPGEAQKRAGQLRNVLREGGNQHLDGLEEVLAQSDDVQKRRIFLLL
           120       130       140       150       160       170

                  190       200       210       220       230       240
m951.pep    AQAAVQQDGLAQKASKAVRRAALKYEHLPEAAVADVVFSVQGREKEKAIGALQRLAKLDT
            :|||||| |:||||||||||||||||||||||||:||:||||||||| |||||||||
g951        VQAAVQQGGVAQKASKAVRRAALKYEHLPEAAVADAVFGVQGREKEKAIEALQRLAKLDT
           180       190       200       210       220       230

                  250       260       270       280       290       300
m951.pep    EILPPTLMTLRLTARKYPEILDGFFEQTDTQNLSAVWQEMEIMNLVSLHRLDDAYARLNV
            |||||||||||||||||||||||||||||||||||||||||||||||:: |||||||||
g51         EILPPTLMTLRLTARKYPEILDGFFEQTDTQNLSAVWQEMEIMNLVSLRKPDDAYARLNV
           240       250       260       270       280       290

                  310       320       330       340       350       360
m951.pep    LLERNPNADLUIQAAILAANRKEGASVIDGYAEKAYGRGTEEQRSRAALTAAMMYSDRRD
            |||:||||:|||||||||||||||||||||||||||| |||:|||:||||:||||||
g951        LLEHNPNANLUIQAAILAANRKEGASVIDGYAEKAYGRGTGEQRGRAAMTAAMIYSDRRD
           300       310       320       330       340       350

                  370       380       390       400       410       420
m951.pep    YAKVRQWLKKVSAPEYLFDKGVLAAAAAVELDGGRAALRQIGRVRKLPEQQGRYFTADNL
            ||||||||||||||||||||||||||:|||||||||||||||||||||||||||||||||
g951        YAKVRQWLKKVSAPEYLFDKGVLAAAAAAELDGGRAALRQIGRVRKLPEQQGRYFTADNL
           260       370       380       390       400       410

                  430       440       450       460       470       480
m951.pep    SKIQMLALSKLPDKREALRGLDKIIEKPPAGSNTELQAEALVQRSVVYDRLGKRKKMISD
            ||||||||||||||||| ||::|| |  |:::||  ||||:|||::|:::||| |||:|
g951        SKIQMLALSKLPDKREALIGLNNIIAKLSAAGSTEPLAEALAQRSIIYEQFGKRGKMIAD
           420       430       440       450       460       470

                  490       500       510       520       530       540
m951.pep    LERAFRLAPDNAQIMNNLGYSLLTDSKRLDEGFALLQTAYQINPDDTAVNDSIGWAYYLK
            || |::|:||||||||||||||:||||||||||||||||||||||||||||||||||||
g951        LETALKLTPDNAQIMNNLGYSLLSDSKRLDEGFALLQTAYQINPDDTAVNDSIGWAYYLK
           480       490       500       510       520       530

                  550       560       570       580       590       600
m951.pep    GDAESALPYLRYSFENDPEPEVAAHLGEVLWALGERDQAVDVWTQAAHLTGDKKIWRETL
            ||||||||||||||||||||||||||||||||||||||||||||||||| ||||||||||
g951        GDAESALPYLRYSFENDPEPEVAAHLGEVLWALGERDQAVDVWTQAAHLRGDKKIWRETL
           540       550       560       570       580       590

                  610
m951.pep    KRHGIALPQPSRKPRK
            ||:|||||:|||||||
g951        KRYGIALPEPSRKPRKX
           600       610
```

The following partial DNA sequence was identified in *N. meningitidis* <SEQ ID 2907>:

```
a951.seq
    1  ATGTTACCCG CCCGTTTCAC CATTTTATCT GTGCTCGCGG CAGCCCTGCT

   51  TGCCGGGCAG GCGTATGCCG CCGGCGCGGC GGATGCGAAG CCGCCGAAGG

  101  AAGTCGGAAA GGTTTTCAGA AAGCAGCAGC GTTACAGCGA GGAAGAAATC

  151  AAAAACGAAC GCGCACGGCT TGCGGCAGTG GGCGAGCGGG TTAATCAGAT

  201  ATTTACGTTG CTGGGAGGGG AAACCGCCTT GCAAAAGGGG CAGGCGGGAA

  251  CGGCTCTGGC AACCTATATG CTGATGTTGG AACGCACAAA ATCCCCCGAA
```

-continued

```
 301 GTCGCCGAAC GCGCCTTGGA AATGGCCGTG TCGCTGAACG CGTTTGAACA
 351 GGCGGAAATG ATTTATCAGA AATGGCGGCA GATTGAGCCT ATACCGGGTA
 401 AGGCGCAAAA ACGGGCGGGG TGGCTGCGGA ACGTGCTGAG GGAAAGAGGA
 451 AATCAGCATC TAGACGGACT GGAAGAAGTG CTGGCTCAGG CGGACGAAGG
 501 ACAGAACCGC AGGGTGTTTT TATTGTTGGC ACAAGCCGCC GTGCAACAGG
 551 ACGGGTTGGC GCAAAAAGCA TCGAAAGCGG TTCGCCGCGC GGCGTTGAGA
 601 TATGAACATC TGCCCGAAGC GGCGGTTGCC GATGTGGTGT TCAGCGTACA
 651 GGGACGCGAA AAGGAAAAGG CAATCGGAGC TTTGCAGCGT TTGGCGAAGC
 701 TCGATACGGA AATATTGCCC CCCACTTTAA TGACGTTGCG TCTGACTGCA
 751 CGCAAATATC CCGAAATACT CGACGGCTTT TTCGAGCAGA CAGACACCCA
 801 AAACCTTTCG GCCGTCTGGC AGGAAATGGA AATTATGAAT CTGGTTTCCC
 851 TGCACAGGCT GGATGATGCC TATGCGCGTT TGAACGTGCT GTTGGAACGC
 901 AATCCGAATG CAGACCTGTA TATTCAGGCA GCGATATTGG CGGCAAACCG
 951 AAAAGAAGGT GCTTCCGTTA TCGACGGCTA CGCCGAAAAG GCATACGGCA
1001 GGGGGACGGG GGAACAGCGG GGCAGGGCGG CAATGACGGC GGCGATGATA
1051 TATGCCGACC GAAGGGATTA CACCAAAGTC AGGCAGTGGT TGAAAAAAGT
1101 GTCCGCGCCG GAATACCTGT TCGACAAAGG TGTGCTGGCG GCTGCGGCGG
1151 CTGTCGAGTT GGACGGCGGC AGGGCGGCTT TGCGGCAGAT CGGCAGGGTG
1201 CGGAAACTTC CCGAACAGCA GGGGCGGTAT TTTACGGCAG ACAATTTGTC
1251 CAAAATACAG ATGTTCGCCC TGTCGAAGCT GCCCGACAAA CGGGAGGCTT
1301 TGAGGGGGTT GGACAAGATT ATCGAAAAAC CGCCTGCCGG CAGTAATACA
1351 GAGTTACAGG CAGAGGCATT GGTACAGCGG TCAGTTGTTT ACGATCGGCT
1401 TGGCAAGCGG AAAAAAATGA TTTCAGATCT TGAAAGGGCG TTCAGGCTTG
1451 CACCCGATAA CGCTCAGATT ATGAATAATC TGGGCTACAG CCTGCTTTCC
1501 GATTCCAAAC GTTTGGACGA AGGCTTCGCC CTGCTTCAGA CGGCATACCA
1551 AATCAACCCG GACGATACCG CTGTCAACGA CAGCATAGGC TGGGCGTATT
1601 ACCTGAAAGG CGACGCGGAA AGCGCGCTGC CGTATCTGCG GTATTCGTTT
1651 GAAAACGACC CCGAGCCCGA AGTTGCCGCC CATTTGGGCG AAGTGTTGTG
1701 GGCATTGGGC GAACGCGATC AGGCGGTTGA CGTATGGACG CAGGCGGCAC
1751 ACCTTACGGG AGACAAGAAA ATATGGCGGG AAACGCTCAA ACGTCACGGC
1801 ATCGCATTGC CCCAACCTTC CCGAAAACCT CGGAAATAA
```

This corresponds to the amino acid sequence <SEQ ID 2908; ORF 951.a>:

```
a951.pep
   1 MLPARFTILS VLAAALLAGQ AYAAGAADAK PPKEVGKVFR KQQRYSEEEI
  51 KNERARLAAV GERVNQIFTL LGGETALQKG QAGTALATYM LMLERTKSPE
 101 VAERALEMAV SLNAFEQAEM IYQKWRQIEP IPGKAQKRAG WLRNVLRERG
 151 NQHLDGLEEV LAQADEGQNR RVFLLLAQAA VQQDGLAQKA SKAVRRAALR
 201 YEHLPEAAVA DVVFSVQGRE KEKAIGALQR LAKLDTEILP PTLMTLRLTA
 251 RKYPEILDGF FEQTDTQNLS AVWQEMEIMN LVSLHRLDDA YARLNVLLER
```

-continued

```
301 NPNADLYIQA AILAANRKEG ASVIDGYAEK AYGRGTGEQR GRAAMTAAMI

351 YADRRDYTKV RQWLKKVSAP EYLFDKGVLA AAAAVELDGG RAALRQIGRV

401 RKLPEQQGRY FTADNLSKIQ MFALSKLPDK REALRGLDKI IEKPPAGSNT

451 ELQAEALVQR SVVYDRLGKR KKMISDLERA FRLAPDNAQI MNNLGYSLLS

501 DSKRLDEGFA LLQTAYQINP DDTAVNDSIG WAYYLKGDAE SALPYLRYSF

551 ENDPEPEVAA HLGEVLWALG ERDQAVDVWT QAAHLTGDKK IWRETLKRHG

600 IALPQPSRKP RK*
```

Computer analysis of this amino acid sequence gave the following results:

Homology with a Predicted ORF from *N. meningitidis*

ORF 951 shows 96.4% identity over a 614 aa overlap with a predicted ORF (ORF 951) from *N. meningitidis*

```
a951/m951   96.4% identity in 614 aa overlap

                        10        20        30        40        50
a951.pep        MLPARFTILSVLAAALLAGQAYAAG--AADAKPPKEVGKVFRKQQRYSEEEIKNERAR
                ||| || :|:||:|:|:|||: |||  |:| | |||||||||||||||||||||||||
951           MIMLPNRFKMLTVLTATLIAGQVSAAGGGAGDMKQPKEVGKVFRKQQRYSEEEIKNERAR
                      10        20        30        40        50        60

                60        70        80        90       100       110
a951.pep      LAAVGERVNQIFTLLGGETALQKGQAGTALATYMLMLERTKSPEVAERALEMAVSLNAFE
              ||||||||||||||||||||||||||||||||||||||||||||||||||||||||||||
m951          LAAVGERVNQIFTLLGGETALQKGQAGTALATYMLMLERTKSPEVAERALEMAVSLNAFE
                      70        80        90       100       110       120

               120       130       140       150       160       170
a951.pep      QAEMIYQKWRQIEPIPGKAQKRAGWLRNVLRERGNQHLDGLEEVLAQADEGQNRRVFLLL
              ||||||||||||||||||||||||||||||||||||||||||||||||||||||||||||
m951          QAEMIYQKWRQIEPIPGKAQKRAGWLRNVLRERGNQHLDGLEEVLAQADEGQNRRVFLLL
                     130       140       150       160       170       180

               180       190       200       210       220       230
a951.pep      AQAAVQQDGLAQKASKAVRRAALRYEHLPEAAVADVVFSVQGREKEKAIGALQRLAKLDT
              |||||||||||||||||||||||:||||||||||||||||||||||||||||||||||||
m951          AQAAVQQDGLAQKASKAVRRAALKYEHLPEAAVADVVFSVQGREKEKAIGALQRLAKLDT
                     190       200       210       220       230       240

               240       250       260       270       280       290
a951.pep      EILPPTLMTLRLTARKYPEILDGFFEQTDTQNLSAVWQEMEIMNLVSLHRLDDAYARLNV
              ||||||||||||||||||||||||||||||||||||||||||||||||||||||||||||
m951          EILPPTLMTLRLTARKYPEILDGFFEQTDTQNLSAVWQEMEIMNLVSLHRLDDATARLNV
                     250       260       270       280       290       300

               300       310       320       330       340       350
a951.pep      LLERNPNADLYIQAAILAANRKEGASVIDGYAEKAYGRGTGEQRGRAAMTAAMIYADRRD
              |||||||||||||||||||||||||||||||||||||||| |||:|||:||||:||||||
m951          LLERNPNADLYIQAAILAANRKEGASVIDGYAEKAYGRGTEEQRSRAALTAAMMYADRRD
                     310       320       330       340       350       360

               360       370       380       390       400       410
a951.pep      YTKVRQWLKKVSAPEYLFDKGVLAAAAAVELDGGRAALRQIFRVRKLPEQQGRYFTADNL
              |:||||||||||||||||||||||||||||||||||||||||||||||||||||||||||
m951          YAKVRQWLKKVSAPEYLFDKGVLAAAAAVELDGGRAALRQIGRVRKLPEQQGRYFTADNL
                     370       380       390       400       410       420

               420       430       440       450       460       470
a951.pep      SKIQMFALSKLPDKREALRGLDKIIEKPPAGSNTELQAEALVQRSVVYDRLGKRKKMISD
              |||||:||||||||||||||||||||||||||||||||||||||||||||||||||||||
m951          SKIQMLALSKLPDKREALRGLDKIIEKPPAGSNTALQAEALVQRSVVYDRLGKRKKMISD
                     430       440       450       460       470       480

               480       490       500       510       520       530
a951.pep      LERAFRLAPDNAQIMNNLGYSLLSDLKRLDEGFALLQTAYQINPDDTAVNDSIGWAYYLK
              |||||||||||||||||||||||:||||||||||||||||||||||||||||||||||||
m951          LERAFRLAPDANQIMNNLGYSLLTDSKRLDEGFALLQTAYQINPDDTAVNDSIGWAYYLK
                     490       500       510       520       530       540

               540       550       560       570       580       590
a951.pep      GDAESALPYLRYSFENDPEPEVAAHLGEVLWALGERDQAVDVWTQAAHLTGDKKIWRETL
              ||||||||||||||||||||||||||||||||||||||||||||||||||||||||||||
m951          GDAESALPYLRYSFENDPEPEVAAHLGEVLWALGERDQAVDVWTQAAHLTGDKKIWRETL
                     550       560       570       580       590       600

               600       610
a951.pep      KRHGIALPQPSRKPRK
              ||||||||||||||||
m951          KRHGIALPQPSRKPRK
                     610
```

The following partial DNA sequence was identified in *N. gonorrhoeae* <SEQ ID 2909>:

```
g952.seq (partial)
  1 ..TTGTCTTATC GTTTGAATGC TGCACCGATG TTTAACGATA ATCCTGTTGT

 51   TTACGGAAAA ATCAAATTGC AGAGTTGGAA AGCGCGGCGG GATTTCAATA

101   TTGTAAAGCA GGATTTGGAT TTTTCCTGCG GGCGGCTTC GGTGGCGACG

151   CTTTTGAACA ATTTTTACGG GCAAAAGCTG ACGGAAGAAG AAGTGTTGGA

201   AAAACTGGGT AAGGAACAGA TGCGCGCGTC GTTTGAGGAT ATGCGGCGCA

251   TTATGCCCGA TTTGGGTTTT GAGGCGAAAG GCTATGCCCT GTCTTTCGAA

301   CAGCTCGCGC AGTTGAAAAT CCCCGTCATC GTGTATCTGA AATACCGCAA

351   AGACGACCAT TTTTCGGTAT TGCGCGGAGT GGATGGCAAT ACGGTTTTGC

401   TTGCCGACCC GTCGCCGGGT CATGTTTCGA TGAGCAGGGC GCAGTTTTTG

451   GAGGCTTGGC AAACCCGTGA GGGAAATTTG GCAGGCAAAA TTTTGGCGGT

501   CGTGCCGAAA AAAGCGGAGG CGATTTCAAA TAAATTGTTT TTCACACATC

551   ATCCCAAGCG GCAGACGGAG TTTGCAGTCG GACAGGTAAA ATGGTGGCGT

601   GCTTATTGA
```

This corresponds to the amino acid sequence <SEQ ID 2910; ORF 952.ng>:

```
g952.pep (partial)
  1 ..LSYRLNAAPM FNDNPVVYGK IKLQSWKARR DFNIVKQDLD FSCGAASVAT

 51   LLNNFYGQKL TEEEVLEKLG KEQMRASFED MRRIMPDLGF EAKGYALSFE

101   QLAQLKIPVI VYLKYRKDDH FSVLRGVDGN TVLLADPSPG HVSMSRAQFL

151   EAWQTREGNL AGKILAVVPK KAEAISNKLF FTHHPKRQTE FAVGQVKWWR

201   AY*
```

The following partial DNA sequence was identified in *N. meningitidis* <SEQ ID 2911>:

```
m952.seq
  1 ATGATGAAGT TCAAATATGT TTTTCTGTTG GCGTGTGTTG TCGTTTCTTT

 51 ATCTTATCGT TTGAATGCTG CACCGATGTT TAACGATAAT CCTGTTGTTT

101 ACGGAAAAAT CAAAGTGCAG AGTTGGAAAG CGCGGCGGGA TTTCAATATT

151 GTAAAGCAGG ATTTGGATTT TTCCTGTGGG GCGGCTTCGG TGGCGACGCT

201 TTTGAACAAT TTTTACGGGC AAACGCTGAC GGAAGAAGAA GTGTTGAAAA

251 AGCTGGATAA GGAGCAGATG CGCGCGTCGT TTGAGGATAT GCGGCGCATT

301 ATGCCTGATT TGGGTTTTGA GGCGAAGGGC TATGCCCTGT CTTTCGAGCA

351 GCTCGCGCAG TTGAAAATCC CCGTCATCGT GTATCTGAAA TACCGCAAAG

401 ACGACCATTT TTCGGTATTG CGCGGTATAG ACGGCAATAC GGTTTTGCTT

451 GCCGACCCGT CGCTGGGGCA TGTTTCAATG AGCAGGGCGC AGTTTTTGGA

501 TGCTTGGCAA ACCCGTGAGG GAAATTTGGC AGGTAAGATT TTGGCTGTCA

551 TACCGAAAAA AGCCGAGACA ATTTCAAATA AATTGTTTTT CACACAACAC

601 CCAAAACGGC AGACGGAGTT TACAGTCGGA CAAATCAGGC AAGCACGTGC

651 AGAGTAA
```

This corresponds to the amino acid sequence <SEQ ID 2912; ORF 952>:

```
m952.pep
   1 MMKFKYVFLL ACVVVSLSYR LNAAPMFNDN PVVYGKIKVQ SWKARRDFNI

  51 VKQDLDFSCG AASVATLLNN FYGQTLTEEE VLKKLDKEQM RASFEDMRRI

 101 MPDLGFEAKG YALSFEQLAQ LKIPVIVYLK YRKDDHFSVL RGIDGNTVLL

 151 ADPSLGHVSM SRAQFLDAWQ TREGNLAGKI LAVIPKKAET ISNKLFFTQH

 201 PKRQTEFTVG QIRQARAE*
```

Computer analysis of this amino acid sequence gave the following results:

Homology with a Predicted ORF from *N. gonorrhoeae*

ORF 952 shows 92.5% identity over a 201 aa overlap with a predicted ORF (ORF 952) from *N. gonorrhoeae*

```
g952/m952;  92.5% identity in 201 aa overlap

                                    10        20        30        40
g952.pep                    LSYRLNAAPMFNDNPVVYGKIKLQSWKARRDFNIVKQDLDFSCG
                            ||||||||||||||||||||||:|||||||||||||||||||||
m952        MMKFKYVFLLACVVVSLSYRLNAAPMFNDNPVVYGKIKVQSWKARRDFNIVKQDLDFSCG
                    10        20        30        40        50        60

                 50        60        70        80        90       100
g952.pep    AASVATLLNNFYGQKLTEEEVLEKLGKEQMRASFEDMRRIMPDLGFEAKGYALSFEQLAQ
            |||||||||||||| ||||||||:|| |||||||||||||||||||||||||||||||||
m952        AASVATLLNNFYGQTLTEEEVLKKLDKEQMRASFEDMRRIMPDLGFEAKGYALSFEQLAQ
                    70        80        90       100       110       120

                110       120       130       140       150       160
g952.pep    LKIPVIVYLKYRKDDHFSVLRGVDGNTVLLADPSPGHVSMSRAQFLEAWQTREGNLAGKI
            ||||||||||||||||||||||:||||||||||| |||||||||||:|||||||||||||
m952        LKIPVIVYLKYRKDDHFSVLRGIDGNTVLLADPSLGHVSMSRAQFLDAWQTREGNLAGKI
                   130       140       150       160       170       180

                170       180       190       200
g952.pep    LAVVPKKAEAISNKLFFTHHPKRQTEFAVGQVKWWRAYX
            |||:||||||||||||||:||||||||:|||::  ||
m952        LAVIPKKAEAISNKLFFTQHPKRQTEFTVGQIRQARAE
                   190       200       210
```

The following partial DNA sequence was identified in *N. meningitidis* <SEQ ID 2913>:

```
a952.seq
   1 ATGATGAAGT TCAAATATGT TTTTCTGTTG GCGTGTGTTG TCGTTTCTTT

  51 ATCTTATCGT TTGAATGCTG CACCGATGTT TAACGATAAT CCTGTTGTTT

 101 ACGGAAAAAT CAAAGTGCAG AGTTGGAAAG AAAGGCGGGA TTTCAATATT

 151 GTAAAGCAGG ATTTGGATTT TTCCTGCGGG GCGGCTTCGG TGGCGACGCT

 201 TTTGAACAAT TTTTACGGGC AAACGCTGAC GGAAGAAGAA GTGTTGAAAA

 251 AGCTGGATAA GGAGCAGATG CGCGCGTCGT TTGAGGATAT GCGGCGCATT

 301 ATGCCAGATT TGGGTTTTGA AGCGAAAGGC TATGCCCTGT CTTTCGAGCA

 351 GCTCGCACAG TTGAAAATCC CCGTCATCGT GTATCTGAAA TACCGCAAGG

 401 ATGATCATTT CTCGGTATTG CGCGGGATAG ACGGCAATAC GGTTTTGCTT

 451 GCCGACCCGT CGCTGGGTCA TGTTTCAATG AGCAGGGCGC AGTTTTNGGA

 501 TGCTTGGCAA ACCCGTGAGG GAAATTTGGC AGGTAAGATT TTGGCGGTCG

 551 TGCCGAAAAA AGCCGAGACA ATTTCAAATA AATTGTTTTT CACACATCAT

 601 CCCAAGCGGC AGACGGAGTT TGCAGTCGGA CAAATCAGGC AAGCACGTGC

 651 AGAGTAA
```

This corresponds to the amino acid sequence <SEQ ID 2914; ORF 952.a>:

```
a952.pep
   1 MMKFKYVFLL ACVVVSLSYR LNAAPMFNDN PVVYGKIKVQ SWKERRDFNI

  51 VKQDLDFSCG AASVATLLNN FYGQTLTEEE VLKKLDKEQM RASFEDMRRI

 101 MPDLGFEAKG YALSFEQLAQ LKIPVIVYLK YRKDDHFSVL RGIDGNTVLL

 151 ADPSLGHVSM SRAQFXDAWQ TREGNLAGKI LAVVPKKAET ISNKLFFTHH

 201 PKRQTEFAVG QIRQARAE*
```

Computer analysis of this amino acid sequence gave the following results:

Homology with a Predicted ORF from *N. meningitidis*

ORF 952 shows 97.7% identity over a 218 aa overlap with a predicted ORF (ORF 952) from *N. meningitidis*

```
a952/m952   97.7% identity in 218 aa overlap

                    10        20        30        40        50        60
a952.pep    MMKFKYVFLLACVVVSLSYRLNAAPMFNDNPVVYGKIKVQSWKERRDFNIVKQDLDFSCG
            |||||||||||||||||||||||||||||||||||||||||| |||||||||||||||||
m952        MMKFKYVFLLACVVVSLSYRLNAAPMFNDNPVVYGKIKVQSWKARRDFNIVKQDLDFSCG
                    10        20        30        40        50        60

                    70        80        90       100       110       120
a952.pep    AASVATLLNNFYGQTLTEEEVLKKLDLEQMRASFEDMRRIMPDLGFEAKGYALSFEQLAQ
            ||||||||||||||||||||||||||||||||||||||||||||||||||||||||||||
m952        AASVATLLNNFYGQTLTEEEVLKKLDKEQMRASFEDMRRIMPDLGFEAKGYALSFEQLAQ
                    70        80        90       100       110       120

                   130       140       150       160       170       180
a952.pep    LKIPVIVYLKYRKDDHFSVLRGIDGNTVLLADPSLGHVSMSRAQFXDAWQTREGNLAGKI
            ||||||||||||||||||||||||||||||||||||||||||||| ||||||||||||||
m952        LKIPVIVYLKYRKDDHFSVLRGIDGNTVLLADPSLGHVSMSRAQFLDAWQTREGNLAGKI
                   130       140       150       160       170       180

                   190       200       210      219
a952.pep    LAVVPKKAETISNKLFFTHHPKRQTEFAVGQIRQARAEX
            |||:||||||||||||||:||||||||:||||||||||
m952        LAVIPKKAETISNKLFFTQHPKRQTEFTVGQIRQARAE
                   190       200       210
```

The following partial DNA sequence was identified in *N. gonorrhoeae* <SEQ ID 2915>:

```
g953.seq
   1 ATGAAAAAAA TCATCTTCGC CGCGCTCGCA GCGGCAGCCG TCGGCACTGC

  51 CTCCGCCACC TACAAAGTGG ACGAATATCA CGCCAACGTC CGTTTCGCCA

 101 TCGACCACTT CAACACCAGC ACCAACGTCG GCGGTTTTTA CGGTCTGACC

 151 GGTTCCGTCG AGTTCGATCA AGCAAAACGC GACGGCAAAA TCGACATCAC

 201 CATTCCCGTC GCCAACCTGC AAAGCGGTTC GCAACCCTTC ACCGGCCACC

 251 TGAAATCCGC CGACATCTTC GATGCCGCTC AATATCCGGA CATCCGCTTC

 301 GTTTCCACCA AATTCAACTT CAACGGCAAA AAACTTGTTT CCGTTGACGG

 351 CAACCTGACC ATGCGCGGCA AAACCGCCCC CGTCAAACTC AAAGCCGAAA

 401 AATTCAACTG CTACCAAAGC CCGATGGCGG AAACCGAAGT TTGCGGCGGC

 451 GACTTCAGCA CCACCATCGA CCGCACCAAA TGGGGCGTGG ACTACCTCGT

 501 TAACGCCGGT ATGACCAAAA ACGTCCGCAT CGACATCCAA ATCGAAGCTG

 551 CAAAACAATA A
```

This corresponds to the amino acid sequence <SEQ ID 2916; ORF 953.ng>:

```
g953.pep
   1 MKKIIFAALA AAAVGTASAT YKVDEYHANV RFAIDHFNTS TNVGGFYGLT

  51 GSVEFDQAKR DGKIDITIPV ANLQSGSQPF TGHLKSADIF DAAQYPDIRF

 101 VSTKFNFNGK KLVSVDGNLT MRGKTAPVKL KAEKFNCYQS PMAETEVCGG

 151 DFSTTIDRTK WGVDYLVNAG MTKNVRIDIQ IEAAKQ*
```

The following partial DNA sequence was identified in *N. meningitidis* <SEQ ID 2917>:

```
m953.seq
   1 ATGAAAAAAA TCATCTTCGC CGCACTCGCA GCCGCCGCCA TCAGTACTGC

  51 CTCCGCCGCC ACCTACAAAG TGGACGAATA TCACGCCAAC GCCCGTTTCG

 101 CCATCGACCA TTTCAACACC AGCACCAACG TCGGCGGTTT TTACGGTCTG

 151 ACCGGTTCCG TCGAGTTCGA CCAAGCAAAA CGCGACGGTA AAATCGACAT

 201 CACCATCCCC ATTGCCAACC TGCAAAGCGG TTCGCAACAC TTTACCGACC

 251 ACCTGAAATC AGCCGACATC TTCGATGCCG CCCAATATCC GGACATCCGC

 301 TTTGTTTCCA CCAAATTCAA CTTCAACGGC AAAAAACTGG TTTCCGTTGA

 351 CGGCAACCTG ACCATGCACG GCAAAACCGC CCCCGTCAAA CTCAAAGCCG

 401 AAAAATTCAA CTGCTACCAA AGCCCGATGG AGAAAACCGA AGTTTGTGGC

 451 GGCGACTTCA GCACCACCAT CGACCGCACC AAATGGGGCA TGGACTACCT

 501 CGTTAACGTT GGTATGACCA AAAGCGTCCG CATCGACATC CAAATCGAGG

 551 CAGCCAAACA ATAA
```

This corresponds to the amino acid sequence <SEQ ID 2918; ORF 953>:

```
m953.pep
   1 MKKIIFAALA AAAISTASAA TYKVDEYHAN ARFAIDHFNT STNVGGFYGL

  51 TGSVEFDQAK RDGKIDITIP IANLQSGSQH FTDHLKSADI FDAAQYPDIR

 101 FVSTKFNFNG KKLVSVDGNL TMHGKTAPVK LKAEKFNCYQ SPMEKTEVCG

 151 GDFSTTIDRT KWGMDYLVNV GMTKSVRIDI QIEAAKQ*
```

Computer analysis of this amino acid sequence gave the following results:

Homology with a Predicted ORF from *N. gonorrhoeae*

ORF 953 shows 93.0% identity over a 187 aa overlap with a predicted ORF (ORF 953) from *N. gonorrhoeae*

```
m953/g953  93.0% identity in 187 aa overlap

                      10        20        30        40        50        60
m953.pep      MKKIIFAALAAAAISTASAATYKVDEYHANARFAIDHFNTSTNVGGFYGLTGSVEFDQAK
              |||||||||||||::|||| ||||||||||:|||||||||||||||||||||||||||||
g953          MKKIIFAALAAAAVGTASA-TYKVDEYHANVRFAIDHFNTSTNVGGFYGLTGSVEFDQAK
                      10         20        30        40        50

                      70        80        90       100       110       120
m953.pep      RDGKIDITIPIANLQSGSQHFTDHLKSADIFDAAQYPDIRFVSTKFNFNGKKLVSVDGNL
              ||||||||||:|||||||| || |||||||||||||||||||||||||||||||||||||
g953          RDGKIDITIPVANLQSGSQPFTGHLKSADIFDAAQYPDIRFVSTKFNFNGKKLVSVDGNL
            60        70        80        90       100       110

                     130       140       150       160       170       180
m953.pep      TMHGKTAPVKLKAEKFNCYQSPMEKTEVCGGDFSTTIDRTKWGMDYLVNVGMTKSVRIDI
              ||:|||||||||||||||||||| :||||||||||||||||||:||||||:||||:||||
g953          TMRGKTAPVKLKAEKFNCYQSPMAETEVCGGDFSTTIDRTKWGVDYLVNAGMTKNVRIDI
           120       130       140       150       160       170
```

-continued

```
m953.pep   QIEAAKQX
           ||||||||
g953       QIEAAKQX
         180
```

The following partial DNA sequence was identified in *N. meningitidis* <SEQ ID 2919>:

```
a953.seq
   1 ATGAAAAAAA TCATCATCGC CGCGCTCGCA GCAGCCGCCA TCGGCACTGC

  51 CTCCGCCGCC ACCTACAAAG TGGACGAATA TCACGCCAAC GCCCGTTTCT

 101 CTATCGACCA TTTCAACACC AGCACCAACG TCGGCGGTTT TTACGGTCTG

 151 ACCGGTTCCG TTGAGTTCGA CCAAGCAAAA CGCGACGGTA AAATCGACAT

 201 CACCATCCCC GTTGCCAACC TGCAAAGCGG TTCGCAACAC TTTACCGACC

 251 ACCTGAAATC AGCCGACATC TTCGATGCCG CCCAATATCC GGACATCCGC

 301 TTTGTTTCCA CCAAATTCAA CTTCAACGGC AAAAAACTGG TTTCCGTTGA

 351 CGGCAACCTG ACCATGCACG GCAAAACCGC CCCCGTCAAA CTCAAAGCCG

 401 AAAAATTCAA CTGCTACCAA AGCCCGATGT TGAAAACCGA AGTTTGCGGC

 451 GGCGACTTCA GCACCACCAT CGACCGCACC AAATGGGGCA TGGACTACCT

 501 CGTTAACGTT GGTATGACCA AAAGCGTCCG CATCGACATC CAAATCGAGG

 551 CAGCCAAACA ATAA
```

This corresponds to the amino acid sequence <SEQ ID 2920; ORF 953.a>:

```
a953.pep
   1 MKKIIIAALA AAAIGTASAA TYKVDEYHAN ARFSIDHFNT STNVGGFYGL

  51 TGSVEFDQAK RDGKIDITIP VANLQSGSQH FTDHLKSADI FDAAQYPDIR

 101 FVSTKFNFNG KKLVSVDGNL TMHGKTAPVK LKAEKFNCYQ SPMLKTEVCG

 151 GDFSTTIDRT KWGMDYLVNV GMTKSVRIDI QIEAAKQ*
```

Computer analysis of this amino acid sequence gave the following results:

Homology with a Predicted ORF from *N. meningitidis*

ORF 953 shows 97.3% identity over a 187 aa overlap with a predicted ORF (ORF 953) from *N. meningitidis*

```
a953/m953 97.3% identity in 187 aa overlap

                   10        20        30        40        50        60
a953.pep   MKKIIIAALAAAAIGTASAATYKVDEYHANARFSIDHFNTSTNVGGFYGLTGSVEFDQAK
           |||||:||||||||:||||||||||||||||||:||||||||||||||||||||||||||
m953       MKKIIFAALAAAAISTASAATYKVDEYHANARFAIDHFNTSTNVGGFYGLTGSVEFDQAK
                   10        20        30        40        50        60

                   70        80        90       100       110       120
a953.pep   RDGKIDITIPVANLQSGSQHFTDHLKSADIFDAAQYPDIRFVSTKFNFNGKKLVSVDGNL
           ||||||||||:|||||||||||||||||||||||||||||||||||||||||||||||||
m953       RDGKIDITIPIANLQSGSQHFTDHLKSADIFDAAQYPDIRFVSTKFNFNGKKLVSVDGNL
                   70        80        90       100       110       120

                  130       140       150       160       170       180
a953.pep   TMHGKTAPVKLKAEKFNCYQSPMLKTEVCGGDFSTTIDRTKWGMDYLVNVGMTKSVRIDI
           |||||||||||||||||||||| ||||||||||||||||||| ||||||||||||||||
m953       TMHGKTAPVKLKAEKFNCYQSPMEKTEVCGGDFSTTIDRTKWGVDYLVNVGMTKSVRIDI
                  130       140       150       160       170       180

a953.pep   QIEAAKQX
           ||||||||
m953       QIEAAKQX
```

g954.seq not found yet

-continued

```
g954.pep not found yet
```

The following partial DNA sequence was identified in *N. meningitidis* <SEQ ID 2921>:

```
m954.seq
   1 ATGAAAAAGT TTTATTTTGT GCTGCTGGCG TTGGGTTTGG CAGCGTGTGG

  51 GCAAGAACAA TCGCAGAAAG CTGATGCGGA GCAGTATTTT TTTGCCAATA

 101 AATATCAATT TGCAGATGAG AAACAGGCTT TTTATTTTGA ACGCGCCGCC

 151 CGTTTCCGTG TATTGCAACA AGGCCTTGGC GGGGATTTTG AGAGGTTTTT

 201 AAAAGGAGAA ATACCTAATC AAGAAAATCT TGCAAAGTAT CGTGAAAATA

 251 TTACTCAAGC AGTCGCTTAT TATGCGGACA CGAATGGAGA TGATGACCCA

 301 TACCGCGTCT GCAAACAGGC TGCGCAAGAT GCAGAAATCC TGATGAAGAG

 351 TATGGTAACA AGCGGTGGAG GCGGTACAAC TGATTTAGAT AAGGAAAGTT

 401 ATCAAAATTA CCGAAAATCA ATGCAAGAAT GCCGTAAAAC AATAACGGAA

 451 GCTGAAGCCA ATTTGCCGAA AAAATAA
```

This corresponds to the amino acid sequence <SEQ ID 2922; ORF 954>:

```
m954.pep
   1 MKKFYFVLLA LGLAACGQEQ SQKADAEQYF FANKYQFADE KQAFYFERAA

  51 RFRVLQQGLG GDFERFLKGE IPNQENLAKY RENITQAVAY YADTNGDDDP

 101 YRVCKQAAQD AEILMKSMVT SGGGGTTDLD KESYQNYRKS MQECRKTITE

 151 AEANLPKK*

a954.seq not found yet
a954.pep not found yet
```

The following partial DNA sequence was identified in *N. gonorrhoeae* <SEQ ID 2923>:

```
g957.seq (partial)
   1 ATGTTTAAAA AATTCAAACC GGTACTGTTG TCATTTTTTG CACTTGTATT

  51 TGCCTTTTGG CTGGGAACAG GTATTGCCTA TGAGATTAAT CCGCGTTGGT

 101 TTTTGAGCGA TACGGCAACT GAAGTACCTG AAAATCCGAA TGCTTTTGTG

 151 GCGAAACTTG CCCGCCTGTT CCGAAATGCC GACAGGGCGG TTGTCATCGT

 201 GAAGGAATCG ATGAGGACGG AGGAAAGCCT TGCCGGAGCT GTGGATGACG

 251 GTCCGTTGCA GTCGGAGAAG GATTATCTCG CGCTCGCTAT CCGGCTCAGT

 301 CGTTTGAAAG AAAAGGCGAA ATGGTTTCAC GTAACGGAGC AGGAACATGG

 351 GGAAGAGGTT TGGCTGGATT ACTATATCGG CGAGGGCGGT TTGGTTGCGG

 401 TTTCGCTTTC GCAACGCTCG CCGGAAGCGT TTGTTAATGC CGAATATCTG

 451 TATCGGAACG ATCGTCCGTT TTCTGTAAAT GTGTACGGCG GAACGGCTCA

 501 CGGGGAAAAT TATGAAACGA CAGGAGAATA TCGGGTTGTT TGGCAACCGG

 551 ACGGTTCGGT ATTTGATGCG GCGGGGCGCG GGAAAATCGG GGAAGATGTT

 601 TATGAGCATT GCCTCGGGTG TTATCAGATG GCCCAGGTAT ATTTGGCGAA

 651 ATACCGGGAT GTCGCGAATG ACGAGCAGAA GGTTTGGGAC TTCCGCGAAG
```

-continued

```
701 AGAGCAACCG GATTGCATCG GACTCGCGCG ATTATGTGTT TTATCAGAAT

751 ATGCGGGAAT TGATGCCCCG GGGGatgaaG gcgaacagtc ttgtggtcgg

801 ctatgatgcg gacggtCtgc CgcaAAAagt ctattggagt gtcgacaatg

851 gaaaaaaacc ccaaagtgtc gaatattatt tgaaaaacgg aaatcttttt

901 attgcccaat cttcgacggt aaccttgaaa acggatggcg taacggcgga

951 tatgcaaacc tatcatgcgc aacaaacgtt gtatttggat
    ggg...
```

This corresponds to the amino acid sequence <SEQ ID 2924; ORF 957.ng>:

```
g957.pep (partial)
  1 MFKKFKPVLL SFFALVFAFW LGTGIAYEIN PRWFLSDTAT EVPENPNAFV

 51 AKLARLFRNA DRAVVIVKES MRTEESLAGA VDDGPLQSEK DYLALAIRLS

101 RLKEKAKWFH VTEQEHGEEV WLDYYIGEGG LVAVSLSQRS PEAFVNAEYL

151 YRNDRPFSVN VYGGTAHGEN YETTGEYRVV WQPDGSVFDA AGRGKIGEDV

201 YEHCLGCYQM AQVYLAKYRD VANDEQKVWD FREESNRIAS DSRDYVFYQN

251 MRELMPRGMK ANSLVVGYDA DGLPQKVYWS VDNGKKPQSV EYYLKNGNLF

301 IAQSSTVTLK TDGVTADMQT YHAQQTLYLD G...
```

The following partial DNA sequence was identified in *N. meningitidis* <SEQ ID 2925>:

```
m957.seq
  1 ATGTTTAAAA AATTCAAACC GGTACTGTTG TCATTTTTTG CACTTGTATT

 51 TGCCTTTTGG CTGGGAACGG GTATTGCCTA TGAGATTAAT CCGCGTTGGT

101 TTTTGAGCGA TACGGCAACT GAAGTACCTA AAAATCCGAA TGCTTTTGTG

151 GCGAAACTTG CCCGCCTGTT CCGAAATGCC GACAGGGCGG TTGTCATCGT

201 GAAGGAATCG ATAAGGACGG AGGAAAATCT TGCCGGAACT GTGGATGACG

251 GTCCGTTGCA GTCGGAGAAG GATTATCTCG CGCTCGCTAT CCGGCTCAGT

301 CGTTTGAAAG AAAAGGCGAA ATGGTTTCAC GTAACGGAGC AGGAACATGG

351 GAAAGAGGTT TGGCTGGATT ACCATATCGG CGAGGGCGGT TTGGTTGCGG

401 TTTCGCTTTC GCAACGCTCG CCGGAAGCAT TTGTTAATGC CGAATATCTG

451 TATCGGAACG ATCGTCCGTT TTCTGTAAAT GTGTACGGCG GAACGGTTCA

501 CGGGGAAAAT TATGAAACGA CAGGAGAATA TCGGGTTGTT TGGCAACCAG

551 ACGGTTCGGT ATTTGATGCG GCGGGGCGCG GGAAAATCGG GGAAGATGTT

601 TATGAGCATT GCCTCGGGTG TTATCAGATG GCCCAGGTAT ATTTGGCGAA

651 ATACCGGGAT GTCGCGAATG ACGAGCAGAA GGTTTGGGAC TTCCGCAAAG

701 AGAGCAACCG AATTGCGTCG GACTCGCGCA ATTCTGTGTT TTATCAGAAT

751 ATGCGGGAAT TGATGCCCCG AGGGATGAAG GCGAACAGTC TTGTGGTCGG

801 CTATGATGCG GACGGTCTGC CGCAAAAAGT CTATTGGAGT TTCGACAATG

851 GAAAAAAACG CCAGAGTTTC GAATATTATT TGAAAAACGG AAATCTTTTT

901 ATTGCACAAT CTTCGACGGT AGCATTGAAA GCGGATGGCG TAACGGCGGA

951 TATGCAGACC TATCATGCGC AACAGACGTG GTATTTGGAT GGCGGGCGGA
```

-continued

```
1001  TTGTCCGCGA AGAGAAACAG GGAGACAGAC TGCCTGATTT TCCTTTGAAC

1051  TTGGAAAATT TGGAAAAAGA GGTGCGCCGT TATGCAGAGG CTGCGGCGAG

1101  ACGTTCGGGC GGCAGGCGCG ACCTTTCTCA CTGA
```

This corresponds to the amino acid sequence <SEQ ID 2926; ORF 957>:

```
m957.pep
   1 MFKKFKPVLL SFFALVFAFW LGTGIAYEIN PRWFLSDTAT EVPKNPNAFV

  51 AKLARLFRNA DRAVVIVKES IRTEENLAGT VDDGPLQSEK DYLALAIRLS

 101 RLKEKAKWFH VTEQEHGKEV WLDYHIGEGG LVAVSLSQRS PEAFVNAEYL

 151 YRNDRPFSVN VYGGTVHGEN YETTGEYRVV WQPDGSVFDA AGRGKIGEDV

 201 YEHCLGCYQM AQVYLAKYRD VANDEQKVWD FRKESNRIAS DSRNSVFYQN

 251 MRELMPRGMK ANSLVVGYDA DGLPQKVYWS FDNGKKRQSF EYYLKNGNLF

 301 IAQSSTVALK ADGVTADMQT YHAQQTWYLD GGRIVREEKQ GDRLPDFPLN

 351 LENLEKEVRR YAEAAARRSG GRRDLSH*
```

Computer analysis of this amino acid sequence gave the following results:

Homology with a Predicted ORF from *N. gonorrhoeae*

ORF 957 shows 95.2% identity over a 331 aa overlap with a predicted ORF (ORF 957) from *N. gonorrhoeae*

```
g957/m957 95.2% identity in 331 aa overlap

                   10        20        30        40        50        60
g957.pep   MFKKFKPVLLSFFALVFAFWLGTGIAYEINPRWFLSDTATEVPENPNAFVAKLARLFRNA
           |||||||||||||||||||||||||||||||||||||||||||:||||||||||||||||
m957       MFKKFKPVLLSFFALVFAFWLGTGIAYEINPRWFLSDTATEVPKNPNAFVAKLARLFRNA
                   10        20        30        40        50        60

                   70        80        90       100       110       120
g957.pep   DRAVVIVKESMRTEESLAGAVDDGPLQSEKDYLALAIRLSRLKEKAKWFHVTEQEHGEEV
           ||||||||||:||||:|||:|||||||||||||||||||||||||||||||||||||:||
m957       DRAVVIVKESIRTEENLAGTVDDGPLQSEKDYLALAIRLSRLKEKAKWFHVTEQEHGKEV
                   70        80        90       100       110       120

                  130       140       150       160       170       180
g957.pep   WLDYYIGEGGLVAVSLSQRSPEAFVNAEYLYRNDRPFSVNVYGGTAHGENYETTGEYRVV
           ||||:||||||||||||||||||||||||||||||||||||||||:||||||||||||||
m957       WLDYHIGEGGLVAVSLSQRSPEAFVNAEYLYRNDRPFSVNVYGGTVHGENYETTGEYRVV
                  130       140       150       160       170       180

                  190       200       210       220       230       240
g957.pep   WQPDGSVFDAAGRGKIGEDVYEHCLGCYQMAQVYLAKYRDVANDEQKVWDFREESNRIAS
           ||||||||||||||||||||||||||||||||||||||||||||||||||||:|||||||
m957       WQPDGSVFDAAGRGKIGEDVYEHCLGCYQMAQVYLAKYRDVANDEQKVWDFRKESNRIAS
                  190       200       210       220       230       240

                  250       260       270       280       290       300
g957.pep   DSRDYVFYQNMRELMPRGMKANSLVVGYDADGLPQKVYWSVDNGKKPQSVEYYLKNGNLF
           ||||||||||||||||||||||| ||||||||||||||||||||||||||||||||||||
m957       DSRNSVFYQNMRELMPRGMKANSLVVGYDADGLPQKVYWSFDNGKKRQSFEYYLKNGNLF
                  250       260       270       280       290       300

                  310       320       330
g957.pep   IAQSSTVTLKTDGVTADMQTYHAQQTLYLDG
           |||||||:||:||||||||||||||| ||||
m957       IAQSSTVALKADGVTADMQTYHAQQTWYLDGGRIVREEKQGDRLPDFPLNLENLEKEVRR
                  310       320       330       340       350       360

m957       YAEAAARRSGGRRDLSHX
                  370
```

The following partial DNA sequence was identified in *N. meningitidis* <SEQ ID 2927>:

```
a957.seq
   1   ATGTTTAAAA AATTCAAACC GGTACTGTTG TCATTTTTTG CACTTGTATT

  51   TGCCTTTTGG CTGGGAACGG GTATTGCCTA TGAGATTAAT CCGCGTTGGT
```

-continued

```
 101  TTTTGAGCGA TACGGCAACT GAAAATCCGA ATGCTTTTGT GGCGAAACTT

 151  GCCCGCCTGT TCCGAAATGC CGACAGGGCG GTTGTCATCG TGAAGGAATC

 201  GATGAGGACG GAGGAAAGTC TTGCCGGAGC TGTGGATGAC GGTCCGTTGC

 251  AGTCGGAGAA GGATTATCTT GCACTCGCTG TCCGGCTCAG TCGTTTGAAA

 301  GAAAAGGCGA AATGGTTTCA CGTAACGGAG CAGGAACATG GGGAAGAGGT

 351  TTGGCTGGAT TACTATATCG GCGAGGGCGG TTTGGTTGCG GTTTCGCTTT

 401  CGCAACGCTC GCCGGAAGCG TTTGTTAATG CCGAATATCT GTATCGGAAC

 451  GATCGTCCGT TTTCTGTAAA TGTGTACGGC GGAACGGTTC ACGGGGAAAA

 501  TTATGAAACG ACAGGAGAAT ATCGGGTTGT TTGGCAACCG GACGGTTCGG

 551  TATTTGATGC GTCGGGGCGC GGGAAAATCG GGGAAGATGT TTATGAGCAT

 601  TGCCTCGGGT GTTATCAGAT GGCCCAGGTA TATTTGGCGA AATATCGGGA

 651  TGTCGCGAAT GATGAGCAGA AGGTTTGGGA CTTCCGCGAA GAGAGTAACC

 701  GGATTGCGTC GGACTCGCGC GATTCTGTGT TTTATCAGAA TATGCGGGAA

 751  TTGATGCCCC GAGGGATGAA GGCAAACAGT CTTGTGGTCG GCTATGATGC

 801  GGACGGTCTG CCGCAGAAAG TCTATTGGAG TTTCGACAAT GGGAAAAAAC

 851  GCCAGAGTTT CGAATATTAT TTGAAAAACG GAAATCTTTT TATTGCACAA

 901  TCTTCGACGG TAGCATTGAA AGCGGATGGC GTAACGGCGG ATATGCAGAC

 951  CTATCATGCG CAACAGACGT GGTATTTAGA TGGCGGGCGG ATTGTCCGCG

1001  AAGAGAAACA GGGGGACAGA CTGCCTGATT TTCCTTTGAA CTTGGAAGAT

1051  TTGGAAAAAG AGGTGAGCCG TTATGCAGAG GCTGCGGCGA GACGTTCGGG

1101  CGGCAGGCGC GACCTTTCTC ACTGA
```

This corresponds to the amino acid sequence <SEQ ID 2928; ORF 957.a>:

```
a957.pep
  1 MFKKFKPVLL SFFALVFAFW LGTGIAYEIN PRWFLSDTAT ENPNAFVAKL

 51 ARLFRNADRA VVIVKESMRT EESLAGAVDD GPLQSEKDYL ALAVRLSRLK

101 EKAKWFHVTE QEHGEEVWLD YYIGEGGLVA VSLSQRSPEA FVNAEYLYRN

151 DRPFSVNVYG GTVHGENYET TGEYRVVWQP DGSVFDASGR GKIGEDVYEH

201 CLGCYQMAQV YLAKYRDVAN DEQKVWDFRE ESNRIASDSR DSVFYQNMRE

251 LMPRGMKANS LVVGYDADGL PQKVYWSFDN GKKRQSFEYY LKNGNLFIAQ

301 SSTVALKADG VTADMQTYHA QQTWYLDGGR IVREEKQGDR LPDFPLNLED

351 LEKEVSRYAE AAARRSGGRR DLSH*
```

Computer analysis of this amino acid sequence gave the following results:

Homology with a Predicted ORF from *N. meningitidis*

ORF 957 shows 96.3% identity over a 377 aa overlap with a predicted ORF (ORF 957) from *N. meningitidis*

```
a957/m957 96.3% identity in 377 aa overlap

                    10        20        30        40          50
a957.pep  MFKKFKPVLLSFFALVFAFWLGTGIAYEINPRWFLSDTATE---NPNAFVAKLARLFRNA
          |||||||||||||||||||||||||||||||||||||||||   ||||||||||||||||
m957      MFKKFKPVLLSFFALVFAFWLGTGIAYEINPRWFLSDTATEVPKNPNAFVAKLARLFRNA
                    10        20        30        40        50        60
```

-continued

```
                60        70        80        90       100       110
a957.pep     DRAVVIVKESMRTEESLAGAVDDGPLQSEKDYLALAVRLSRLKEKAKWFHVTEQEHGEEV
             ||||||||||:||||:||||:|||||||||||||||:||||||||||||||||||||:||
m957         DRAVVIVKESIRTEENLAGTVDDGPLQSEKDYLALAIRLSRLKEKAKWFHVTEQEHGKEV
                     70        80        90       100       110       120

               120       130       140       150       160       170
a957.pep     WLDYYIGEGGLVAVSLSQRSPEAFVNAEYLYRNDRPFSVNVYGGTVHGENYETTGEYRVV
             ||||:|||||||||||||||||||||||||||||||||||||||||||||||||||||||
m957         WLDYHIGEGGLVAVSLSQRSPEAFVNAEYLYRNDRPFSVNVYGGTVHGENYETTGEYRVV
                    130       140       150       160       170       180

               180       190       200       210       220       230
a957.pep     WQPDGSVFDASGRGKIGEDVYEHCLGCYQMAQVYLAKYRDVANDEQKVWDFREESNRIAS
             ||||||||||:||||||||||||||||||||||||||||||||||||||||:||||||||
m957         WQPDGSVFDAAGRGKIGEDVYEHCLGCYQMAQVYLAKYRDVANDEQKVWDFRKESNRIAS
                    190       200       210       220       230       240

               240       250       260       270       280       290
a957.pep     DSRDSVFYQNMRELMPRGMKANSLVVGYDADGLPQKVYWSFDNGKKRQSFEYYLKNGNLF
             |||:||||||||||||||||||||||||||||||||||||||||||||||||||||||||
m957         DSRNSVFYQNMRELMPRGMKANSLVVGYDADGLPQKVYWSFDNGKKRQSFEYYLKNGNLF
                    250       260       270       280       290       300

               300       310       320       330       340       350
a957.pep     IAQSSTVALKADGVTADMQTYHAQQTWYLDGGRIVREEKQGDRLPDFPLNLEDLEKEVSR
             ||||||||||||||||||||||||||||||||||||||||||||||||||||:||||| |
m957         IAQSSTVALKADGVTADMQTYHAQQTWYLDGGRIVREEKQGDRLPDFPLNLENLEKEVRR
                    310       320       330       340       350       360

               360       370
a957.pep     YAEAAARRSGGRRDLSHX
             |||||||||||||||||
m957         YAEAAARRSGGRRDLSHX
                    370
```

The following partial DNA sequence was identified in *N. gonorrhoeae* <SEQ ID 2929>:

```
g958.seq
   1  TTGGCTCGTT TATTTTCACT CAAACCACTG GTGCTGGCAT TGGGCTTCTG

  51  TTTCGGCACG CATTGCGCCG CCGATACCGT TGCGGCGGAA GAGGCGGACG

 101  GGCGTGTCGC AGAAGGCGGT GCGCAGGGCG CGTCCGAATC CGCACAAGCT

 151  TCCGATTTGA CCCTCGGTTC GACCTGCCTG TTTTGCAGTA ACGAAAGCGG

 201  CAGCCCCGAG AGAACCGAAG CCGCCGTCCA AGGCAGCGGC GAAGCATCCG

 251  TCCCCGAAGA CTATACGCGC ATTGTTGCCG ACAGGATGGA AGGACAGTCG

 301  AAGGTTAAGG TGCGCGCGGA AGGAAGCGTT ATCATCGAAC GGGACGGCGC

 351  AGTCCTCAAT ACCGATTGGG CGGATTACGA CCAGTCGGGC GACACCGTTA

 401  CCGTAGGCGA CCGGTTCGCC CTCCAACAGG ACGGTACGCT GATTCGGGGC

 451  GAAACCCTGA CCTACAATCT CGATCAGCAG ACCGGCGAAG CGCACAACGT

 501  CCGTATGGAA ACCGAACAAG GCGGACGGCG GCTGCAAAGC GTCAGCCGCA

 551  CCGCCGAAAT GTTGGGCGAA GGGCGTTACA AACTGACGGA AACCCAATTC

 601  AACACCTGTT CCGCCGGAGA TGCCGGCTGG TATGTCAAGG CCGCCTCTGT

 651  CGAAGCCGAT CGGGGAAAAG GCATAGGCGT TGCCAAACAC GCCGCCTTCG

 701  TGTTCGGCGG CGTTCCCCTT TTCTATACGC CTTGGGCGGA CTTCCCGCTT

 751  GACGGCAACC GCAAAAGCGG ACTGCTCGTC CCGTCCGTAT CTGCCGGTTC

 801  GGACGGCGTT TCCCTTTCCG TCCCCTATTA TTTCAACCTT GCCCCCAACT

 851  TCGATGCCAC TTTCGCCCCC GGCATTATCG GCGAACGCGG CGCGACGTTT

 901  GACGGACAAA TCCGTTACCT GCGTCCCGAT TACAGCGGAC AGACCGACCT

 951  GACCTGGTTG CCGCACGATA AGAAAAGCGG CAGGAACAAC CGCTATCAGG

1001  CAAAATGGCA GCACCGGCAC GACATTTCCG ACACGCTTCA GGCGGGTGTC
```

-continued

```
1051 GATTTCAACC AAGTCTCCGA CAGCGGCTAC TACCGCGACT TTTACGGCGG

1101 CGAAGAAATC GCCGGCAACG TCAACCTCAA CCGCCGCGTA TGGCTGGATT

1151 ATGGCGGCAG GGCGGCGGGA GGCAGCCTGA ATGCCGGCCT TTCGGTTCAG

1201 AAATACCAGA CGCTGGCAAA CCAAAGCGGC TACAAAGACG AACCTTACGC

1251 CATCATGCCC CGCCTTTCTG CCGATTGGCA TAAAAACGCA GGCAGGGCGC

1301 AAATCGGCGT GTCCGCACAA TTTACCCGCT TCAGCCACGA CGGCCGCCAA

1351 GACGGCAGCC GACTGGTCGT GTATCCCGGT ATCAAATGGG ATTTCAGCAA

1401 CAGCTGGGGC TACGTCCGCC CCAAACTCGG GCTGCACGCC ACTTATTACA

1451 GCCTCGACAG TTTCGGCGGC AAAGCATCCC GCAGCGTCGG GCGCGTTTTG

1501 CCCGTTGTCA ATATCGACGG CGGCACAACC TTCGAACGCA ATACGCGCCT

1551 GTTCGGCGGC GGAGTCGTGC AAACCATCGA GCCGCGCCTG TTCTACAACT

1601 ATATTCCTGC CAAATCTCAA AACGACCTGC CCAATTTCGA TTCGTCGGAA

1651 AGCAGCTTCG GCTACGGGCA GCTTTTCCGC GAAAACCTCT ATTACGGCAA

1701 CGACCGCATC AACGCCGCCA ACAGCCTTTC CACCGCCGTG CAGAGCCGTA

1751 TTTTGGACGG CGCGACGGGG GAGGAGCGTT TCCGCGCCGG TATCGGTCAG

1801 AAATTCTATT TCAAGGATGA TGCGGTGATG CTTGACGGCA GCGTCGGCAA

1851 AAATCCGCGC AGCCGTTCCG ACTGGGTGGC ATTCGCCTCC GGCGGCATAG

1901 GCGGGCGTTT CACCCTCGAC AGCAGCATCC ACTACAACCA AAACGACAAA

1951 CGCGCCGAAC ATTACGCCGT CGGCGCAGGC TACCGCCCCG CCCCCGGAAA

2001 AGTGTTGAAC GCCCGCTACA AATACGGGCG CAACGAAAAA ATCTACCTGC

2051 AGGCGGACGG TTCCTATTTT TACGACAAAC TCAGCCAGCT CGACCTGTCC

2101 GCACAATGGC CGCTGACGCG CAACCTGTCT GCCGTCGTCC GCTACAACTA

2151 CGGTTTTGAA GCCAAAAAAC CGATAGAAAT GCTTGCCGGT GCAGAATACA

2201 AAAGCAGTTG CGGCTGCTGG GGCGCGGGCG TGTACGCCCA ACGCTACGTT

2251 ACCGGCGAAA ACACCTACAA AAACGCCGTC TTTTTTTCAC TTCAGTTGAA

2301 AGACCTCAGC AGCGTCGGCA GAAACCCCGC AGGCAGGATG GATGTCGCCG

2351 TTCCCGGCTA CATCCCCGCC CACTCTCTTT CCGCCGGACG CAACAAACGG

2401 CCCTGA
```

This corresponds to the amino acid sequence <SEQ ID 2930; ORF 958.ng>:

```
g958.pep
   1 LARLFSLKPL VLALGFCFGT HCAADTVAAE EADGRVAEGG AQGASESAQA

  51 SDLTLGSTCL FCSNESGSPE RTEAAVQGSG EASVPEDYTR IVADRMEGQS

 101 KVKVRAEGSV IIERDGAVLN TDWADYDQSG DTVTVGDRFA LQQDGTLIRG

 151 ETLTYNLDQQ TGEAHNVRME TEQGGRRLQS VSRTAEMLGE GRYKLTETQF

 201 NTCSAGDAGW YVKAASVEAD RGKGIGVAKH AAFVFGGVPL FYTPWADFPL

 251 DGNRKSGLLV PSVSAGSDGV SLSVPYYFNL APNFDATFAP GIIGERGATF

 301 DGQIRYLRPD YSGQTDLTWL PHDKKSGRNN RYQAKWQHRH DISDTLQAGV

 351 DFNQVSDSGY YRDFYGGEEI AGNVNLNRRV WLDYGGRAAG GSLNAGLSVQ

 401 KYQTLANQSG YKDEPYAIMP RLSADWHKNA GRAQIGVSAQ FTRFSHDGRQ
```

-continued

```
451 DGSRLVVYPG IKWDFSNSWG YVRPKLGLHA TYYSLDSFGG KASRSVGRVL

501 PVVNIDGGTT FERNTRLFGG GVVQTIEPRL FYNYIPAKSQ NDLPNFDSSE

551 SSFGYGQLFR ENLYYGNDRI NAANSLSTAV QSRILDGATG EERFRAGIGQ

601 KFYFKDDAVM LDGSVGKNPR SRSDWVAFAS GGIGGRFTLD SSIHYNQNDK

651 RAEHYAVGAG YRPAPGKVLN ARYKYGRNEK IYLQADGSYF YDKLSQLDLS

701 AQWPLTRNLS AVVRYNYGFE AKKPIEMLAG AEYKSSCGCW GAGVYAQRYV

751 TGENTYKNAV FFSLQLKDLS SVGRNPAGRM DVAVPGYIPA HSLSAGRNKR

801 P*
```

The following partial DNA sequence was identified in *N. meningitidis* <SEQ ID 2931>:

```
m958.seq
   1 TTGGCTCGTT TATTTTCACT CAAACCACTG GTGCTGGCAT TGGGCCTCTG

  51 CTTCGGCACG CATTGCGCCG CCGCCGATGC CGTTGCGGCG GAGGAAACGG

 101 ACAATCCGAC CGCCGGAGAA AGCGTTCGGA GCGTGTCCGA ACCCATACAG

 151 CCTACCAGCC TGAGCCTCGG TTCGACCTGC CTGTTTTGCA GTAACGAAAG

 201 CGGCAGCCCC GAGAGAACCG AAGCCGCCGT CCAAGGCAGC GGCGAAGCAT

 251 CCATCCCCGA AGACTATACG CGCATTGTTG CCGACAGGAT GGAAGGACAG

 301 TCGCAGGTGC AGGTGCGTGC CGAAGGCAAC GTCGTCGTCG AACGCAACCG

 351 GACGACCCTC AATACCGATT GGGCGGATTA CGACCAGTCG GGCGACACCG

 401 TTACCGCAGG CGACCGGTTC GCCCTCCAAC AGGACGGTAC GCTGATTCGG

 451 GGCGAAACCC TGACCTACAA TCTCGAGCAG CAGACCGGGG AAGCGCACAA

 501 CGTCCGCATG GAAATCGAAC AAGGCGGACG GCGGCTGCAA AGCGTCAGCC

 551 GCACCGCCGA AATGTTGGGC GAAGGGCATT ACAAACTGAC GGAAACCCAA

 601 TTCAACACCT GTTCCGCCGG CGATGCCGGC TGGTATGTCA AGGCAGCCTC

 651 TGTCGAAGCC GATCGGGAAA AAGGCATAGG CGTTGCCAAA CACGCCGCCT

 701 TCGTGTTCGG CGGCGTTCCC ATTTTCTACA CCCCTTGGGC GGACTTCCCG

 751 CTTGACGGCA ACCGCAAAAG CGGCCTGCTT GTTCCCTCAC TGTCCGCCGG

 801 TTCGGACGGC GTTTCCCTTT CCGTTCCCTA TTATTTCAAC CTTGCCCCCA

 851 ATCTCGATGC CACGTTCGCG CCCAGCGTGA TCGGCGAACG CGGCGCGGTC

 901 TTTGACGGGC AGGTACGCTA CCTGCGGCCG GATTATGCCG GCCAGTCCGA

 951 CCTGACCTGG CTGCCGCACG ACAAGAAAAG CGGCAGGAAT AACCGCTATC

1001 AGGCGAAATG GCAGCATCGG CACGACATTT CCGACACGCT TCAGGCGGGT

1051 GTCGATTTCA ACCAAGTCTC CGACAGCGGC TACTACCGCG ACTTTTACGG

1101 CAACAAAGAA ATCGCCGGCA ACGTCAACCT CAACCGCCGT GTATGGCTGG

1151 ATTATGGCGG CAGGGCGGCG GGCGGCAGCC TGAATGCCGG CCTTTCGGTT

1201 CTGAAATACC AGACGCTGGC AAACCAAAGC GGCTACAAAG ACAAACCGTA

1251 TGCCCTCATG CCGCGCCTTT CGGTCGAGTG GCGTAAAAAC ACCGGCAGGG

1301 CGCAAATCGG CGTGTCCGCA CAATTTACCC GATTCAGCCA CGACAGCCGC

1351 CAAGACGGCA GCCGCCTGGT CGTCTATCCC GACATCAAAT GGGATTTCAG

1401 CAACAGCTGG GGCTATGTCC GTCCCAAACT CGGACTGCAC GCCACCTATT
```

-continued

1451 ACAGCCTCAA CCGCTTCGGC AGCCAAGAAG CCCGACGCGT CAGCCGCACT

1501 CTGCCCATTG TCAACATCGA CAGCGGCGCA ACTTTTGAGC GGAATACGCG

1551 GATGTTCGGC GGAGAAGTCC TGCAAACCCT CGAGCCGCGC CTGTTCTACA

1601 ACTATATTCC TGCCAAATCC CAAAACGACC TGCCCAATTT CGATTCGTCG

1651 GAAAGCAGCT TCGGCTACGG GCAGCTCTTT CGCGAAAACC TCTATTACGG

1701 CAACGACAGG ATTAACACCG CAAACAGCCT TTCCGCCGCC GTGCAAAGCC

1751 GTATTTTGGA CGGCGCGACG GGGGAAGAGC GTTTCCGCGC CGGCATCGGT

1801 CAGAAATTCT ATTTCAAGGA TGATGCGGTG ATGCTTGACG GCAGCGTCGG

1851 CAAAAAACCG CGCAACCGTT CCGACTGGGT GGCATTTGCC TCCGGCAGCA

1901 TCGGCAGCCG CTTCATCCTC GACAGCAGCA TCCACTACAA CCAAAACGAC

1951 AAACGCGCCG AGAACTACGC CGTCGGTGCA AGCTACCGTC CCGCACAGGG

2001 CAAAGTGCTG AACGCCCGCT ACAAATACGG GCGCAACGAA AAAATCTACC

2051 TGAAGTCCGA CGGTTCCTAT TTTTACGACA AACTCAGCCA GCTCGACCTG

2101 TCCGCACAAT GGCCGCTGAC GCGCAACCTG TCGGCCGTCG TCCGTTACAA

2151 CTACGGTTTT GAAGCCAAAA AACCGATAGA GGTGCTGGCG GGTGCGGAAT

2201 ACAAAAGCAG TTGCGGCTGC TGGGGCGCGG GCGTGTACGC CCAACGCTAC

2251 GTTACCGGCG AAAACACCTA CAAAAACGCT GTCTTTTTCT CACTTCAGTT

2301 GAAAGACCTC AGCAGTGTCG GCAGAAACCC CGCAGACAGG ATGGATGTCG

2351 CCGTTCCCGG CTATATCACC GCCCACTCTC TTTCCGCCGG ACGCAACAAA

2401 CGACCCTGA

This corresponds to the amino acid sequence <SEQ ID 2932; ORF 958>:

m958.pep

1 LARLFSLKPL VLALGLCFGT HCAAADAVAA EETDNPTAGE SVRSVSEPIQ

51 PTSLSLGSTC LFCSNESGSP ERTEAAVQGS GEASIPEDYT RIVADRMEGQ

101 SQVQVRAEGN VVVERNRTTL NTDWADYDQS GDTVTAGDRF ALQQDGTLIR

151 GETLTYNLEQ QTGEAHNVRM EIEQGGRRLQ SVSRTAEMLG EGHYKLTETQ

201 FNTCSAGDAG WYVKAASVEA DREKGIGVAK HAAFVFGGVP IFYTPWADFP

251 LDGNRKSGLL VPSLSAGSDG VSLSVPYYFN LAPNLDATFA PSVIGERGAV

301 FDGQVRYLRP DYAGQSDLTW LPHDKKSGRN NRYQAKWQHR HDISDTLQAG

351 VDFNQVSDSG YYRDFYGNKE IAGNVNLNRR VWLDYGGRAA GGSLNAGLSV

401 LKYQTLANQS GYKDKPYALM PRLSVEWRKN TGRAQIGVSA QFTRFSHDSR

451 QDGSRLVVYP DIKWDFSNSW GYVRPKLGLH ATYYSLNRFG SQEARRVSRT

501 LPIVNIDSGA TFERNTRMFG GEVLQTLEPR LFYNYIPAKS QNDLPNFDSS

551 ESSFGYGQLF RENLYYGNDR INTANSLSAA VQSRILDGAT GEERFRAGIG

601 QKFYFKDDAV MLDGSVGKKP RNRSDWVAFA SGSIGSRFIL DSSIHYNQND

651 KRAENYAVGA SYRPAQGKVL NARYKYGRNE KIYLKSDGSY FYDKLSQLDL

701 SAQWPLTRNL SAVVRYNYGF EAKKPIEVLA GAEYKSSCGC WGAGVYAQRY

751 VTGENTYKNA VFFSLQLKDL SSVGRNPADR MDVAVPGYIT AHSLSAGRNK

801 RP*

Computer analysis of this amino acid sequence gave the following results:

Homology with a Predicted ORF from *N. gonorrhoeae*

ORF 958 shows 89.3% identity over a 802 aa overlap with a predicted ORF (ORF 958) from *N. gonorrhoeae*

```
m958/g958  89.3% identity in 802 aa overlap

                   10        20        30        40        50        60
m958.pep    LARLFSLKPLVLALGLCFGTHCAAADAVAAEETDNPTAGESVRSVSEPIQPTSLSLGSTC
            ||||||||||||||:|||||||| |:|||||:|: :|  ::::||  | ::|:|||||
g958        LARLFSLKPLVLALGFCFGTHCAA-DTVAAEEADGRVAEGGAQGASESAQASDLTLGSTC
                   10        20         30        40        50

                   70        80        90       100       110       120
m958.pep    LFCSNESGSPERTEAAVQGSGEASIPEDYTRIVADRMEGQSQVQVRAEGNVVVERNRTTL
            ||||||||||||||||||||||||:||||||||||||||||:|:|||||:|::||: ::|
g958        LFCSNESGSPERTEAAVQGSGEASVPEDYTRIVADRMEGQSKVKVRAEGSVIIERDGAVL
           60        70        80        90       100       110

                  130       140       150       160       170       180
m958.pep    NTDWADYDQSGDTVTAGDRFALQQDGTLIRGETLTYNLEQQTGEAHNVRMEIEQGGRRLQ
            ||||||||||||||:|||||||||||||||||||||||:||||||||||||| |||||||
g958        NTDWADYDQSGDTVTVGDRFALQQDGTLIRGETLTYNLDQQTGEAHNVRMEIEQGGRRLQ
          120       130       140       150       160       170

                  190       200       210       220       230       240
m958.pep    SVSRTAEMLGEGHYKLTETQFNTCSAGDAGWYVKAASVEADREKGIGVAKHAAFVFGGVP
            |||||||||||:||||||||||||||||||||||||||||||| ||||||||||||||||
g958        SVSRTAEMLGEGRYKLTETQFNTCSAGDAGWYVKAASVEADRGKGIGVAKHAAFVFGGVP
          180       190       200       210       220       230

                  250       260       270       280       290       300
m958.pep    IFYTPWADFPLDGNRKSGLLVPSLSAGSDGVSLSVPYYFNLAPNLDATFAPSVIGERGAV
            :|||||||||||||||||||||:||||||||||||||||||||||:||||||::||||||:
g958        LFYTPWADFPLDGNRKSGLLVPSVSAGSDGVSLSVPYYFNLAPNFDATFAPGIIGERGAT
          240       250       260       270       280       290

                  310       320       330       340       350       360
m958.pep    FDGQVRYLRPDYAGQSDLTWLPHDKKSGRNNRYQAKWQHRHDISDTLQAGVDFNQVSDSG
            ||||:|||||||:||:||||||||||||||||||||||||||||||||||||||||||||
g958        FDGQIRYLRPDYSGQTDLTWLPHDKKSGRNNRYQAKWQHRHDISDTLQAGVDFNQVSDSG
          300       310       320       330       340       350

                  370       380       390       400       410       420
m958.pep    YYRDFYGNKEIAGNVNLNRRVWLDYGGRAAGGSLNAGLSVLKYQTLANQSGYKDKPYALM
            ||||||::|||||||||||||||||||||||||||||||| ||||||||||||:|||:|
g958        YYRDFYGGEEIAGNVNLNRRVWLDYGGRAAGGSLNAGLSVQKYQTLANQSGYKDEPYAIM
          360       370       380       390       400       410

                  430       440       450       460       470       480
m958.pep    PRLSVEWRKNTGRAQIGVSAQFTRFSHDSRQDGSRLVVYPDIKWDFSNSWGYVRPKLGLH
            ||||::|:||:|||||||||||||||||:|||||||||| ||||||||||||||||||||
g958        PRLSADWHKNAGRAQIGVSAQFTRFSHDGRQDGSRLVVYPGIKWDFSNSWGYVRPKLGLH
          420       430       440       450       460       470

                  490       500       510       520       530       540
m958.pep    ATYYSLNRFGSQEARRVSRTLPIVNIDSGATFERNTRMFGGEVLQTLEPRLFYNYIPAKS
            ||||||: ||:: :| |:|:||:||||:|:||||||||:||| |:||:||||||||||||
g958        ATYYSLDSFGGKASRSVGRVLPVVNIDGGTTFERNTRLFGGGVVQTIEPRLFYNYIPAKS
          480       490       500       510       520       530

                  550       560       570       580       590       600
m958.pep    QNDLPNFDSSESSFGYGQLFRENLYYGNDRINTANSLSAAVQSRILDGATGEERFRAGIG
            ||||||||||||||||||||||||||||||||:|||||:|||||||||||||||||||||
g958        QNDLPNFDSSESSFGYGQLFRENLYYGNDRINAANSLSTAVQSRILDGATGEERFRAGIG
          540       550       560       570       580       590

                  610       620       630       640       650       660
m958.pep    QKFYFKDDAVMLDGSVGKKPRNRSDWVAFASGSIGSRFILDSSIHYNQNDKRAENYAVGA
            ||||||||||||||||:||:||||||||||:||:|| |||||||||||||||:|||||
g958        QKFYFKDDAVMLDGSVGKNPRSRSDWVAFASGGIGGRFTLDSSIHYNQNDKRAENYAVGA
          600       610       620       630       640       650

                  670       680       690       700       710       720
m958.pep    SYRPAQGKVLNARYKYGRNEKIYLKSDGSYFYDKLSQLDLSAQWPLTRNLSAVVRYNYGF
            :|||| |||||||||||||||||::|||||||||||||||||||||||||||||||||||
g958        GYRPAPGKVLNARYKYGRNEKIYLQADGSYFYDKLSQLDLSAQWPLTRNLSAVVRYNYGF
          660       670       680       690       700       710

                  730       740       750       760       770       780
m958.pep    EAKKPIEVLAGAEYKSSCGCWGAGVYAQRYVTGENTYKNAVFFSLQLKDLSSVGRNPADR
            ||||||:|||||||||||||||||||||||||||||||||||||||||||||||||| |
g958        EAKKPIEMLAGAEYKSSCGCWGAGVYAQRYVTGENTYKNAVFFSLQLKDLSSVGRNPAGR
          720       730       740       750       760       770

                  790       800
m958.pep    MDVAVPGYITAHSLSAGRNKRP
            ||||||||||:|||||||||||
g958        MDVAVPGYIPAHSLSAGRNKRPX
          780       790       800
```

The following partial DNA sequence was identified in *N. meningitidis* <SEQ ID 2933>:

a958.seq

1 TTGGCTCGTT TATTTTCACT CAAACCACTG GTGCTGGCAT TGGGCTTCTG

51 TTTCGGCACG CATTGCGCCG CCGCCGATGC CGTTGCGGCG GAGGAAACGG

101 ACAATCCGAC CGCCGGAGGA AGCGTTCGGA GCGTGTCCGA ACCCATACAG

151 CCTACCAGCC TGAGCCTCGG TTCGACCTGC CTGTTTTGCA GTAACGAAAG

201 CGGCAGCCCC GAGAGAACCG AAGCCGCCGT CCAAGGCAGC GGCGAAGCAT

251 CCATCCCCGA AGACTATACG CGCATTGTTG CCGACAGGAT GGAAGGACAG

301 TCGCAGGTGC AGGTGCGTGC CGAAGGCAAC GTCGTCGTCG AACGCAATCG

351 GACGACCCTC AATGCCGATT GGGCGGATTA CGACCAGTCG GGCGACACCG

401 TTACCGCAGG CGACCGGTTC GCCCTCCAAC AGGACGGTAC GCTGATTCGG

451 GGCGAAACCC TGACCTACAA TCTCGAGCAG CAGACCGGGG AAGCGCACAA

501 CGTCCGTATG GAAACCGAAC ACGGCGGACG GCGGCTGCAA AGCGTCAGCC

551 GCACCGCCGA AATGTTGGGC GAAGGGCATT ACAAACTGAC GGAAACCCAA

601 TTCAACACCT GTTCCGCCGG CGATGCCGGC TGGTATGTCA AGGCCGCTTC

651 CGTCGAAGCC GATCGGGAAA AAGGCATAGG CGTTGCCAAA CACGCCGCCT

701 TCGTGTTCGG CGGCGTTCCC ATTTTCTACA CCCCTTGGGC GGACTTCCCG

751 CTTGACGGCA ACCGCAAAAG CGGCCTGCTC GTTCCCTCAC TGTCCGCCGG

801 TTCGGACGGC GTTTCCCTTT CCGTTCCCTA TTATTTCAAC CTTGCCCCCA

851 ATCTCGATGC CACGTTCGCG CCCGGCGTGA TCGGCGAACG CGGCGCGGTC

901 TTTGACGGGC AGGTACGCTA CCTGCGGCCG GATTATGCCG GCCAGTCCGA

951 CCTGACCTGG CTGCCGCACG ACAAGAAAAG CGGCAGGAAT AACCGCTATC

1001 AGGCGAAATG GCAGCACCGG CACGACATTT CCGACACGCT TCAGGCGGGT

1051 GTCGATTTCA ACCAAGTCTC CGACAGCGGC TACTACCGCG ACTTTTACGG

1101 CAACAAAGAA ATCGCCGGCA ACGTCAACCT CAACCGCCGT GTATGGCTGG

1151 ATTATGGCGG CAGGGCGGCG GGCGGCAGCC TGAATGCCGG CCTTTCGGTT

1201 CTGAAATACC AGACGCTGGC AAACCAAAGC GGCTACAAAG ACAAACCGTA

1251 TGCCCTGATG CCGCGCCTTT CCGCCGATTG GCGCAAAAAC ACCGGCAGGG

1301 CGCAAATCGG CGTGTCCGCC CAATTTACCC GCTTCAGCCA CGACAGCCGC

1351 CAAGACGGCA GCCGCCTCGT CGTCTATCCC GACATCAAAT GGGATTTCAG

1401 CAACAGCTGG GGTTACGTCC GTCCCAAACT CGGACTGCAC GCCACCTATT

1451 ACAGCCTCAA CCGCTTCGGC AGCCAAGAAG CCCGACGCGT CAGCCGCACT

1501 CTGCCCATCG TCAACATCGA CAGCGGCATG ACCTTCGAAC GCAATACGCG

1551 GATGTTCGGC GGCGGAGTCC TGCAAACCCT CGAGCCGCGC CTGTTCTACA

1601 ACTATATTCC TGCCAAATCC CAAAACGACC TGCCCAATTT CGATTCGTCG

1651 GAAAGCAGCT TCGGCTACGG GCAGCTTTTT CGTGAAAACC TCTATTACGG

1701 CAACGACAGG ATTAACACCG CAAACAGCCT TTCCGCCGCC GTGCAAAGCC

1751 GTATTTTGGA CGGCGCGACG GGGGAAGAGC GTTTCCGCGC CGGCATCGGG

1801 CAGAAATTCT ACTTCAAAAA CGACGCAGTC ATGCTTGACG GCAGTGTCGG

1851 CAAAAAACCG CGCAGCCGTT CCGACTGGGT GGCATTCGCC TCCAGCGGCA

1901 TCGGCAGCCG CTTCATCCTC GACAGCAGCA TCCACTACAA CCAAAACGAC

1951 AAACGCGCCG AGAACTACGC CGTCGGTGCA AGCTACCGTC CCGCACAGGG

-continued

```
2001 CAAAGTGCTG AACGCCCGCT ACAAATACGG GCGCAACGAA AAAATCTACC

2051 TGAAGTCCGA CGGTTCCTAT TTTTACGACA AACTCAGCCA GCTCGACCTG

2101 TCCGCACAAT GGCCGCTGAC GCGCAACCTG TCGGCCGTCG TCCGTTACAA

2151 CTACGGTTTT GAAGCCAAAA AACCGATAGA GGTGCTGGCG GGTGCGGAAT

2201 ACAAAAGCAG TTGCGGCTGC TGGGGCGCGG GCGTGTACGC CCAACGCTAC

2251 GTTACCGGCG AAAACACCTA CAAAAACGCT GTCTTTTTCT CACTTCAGTT

2301 GAAAGACCTC AGCAGTGTCG GCAGAAACCC CGCAGACAGG ATGGATGTCG

2351 CCGTTCCCGG CTATATCCCC GCCCACTCTC TTTCCGCCGG ACGCAACAAA

2401 CGGCCCTGA
```

This corresponds to the amino acid sequence <SEQ ID 2934; ORF 958.a>:

```
a958.pep
   1 LARLFSLKPL VLALGFCFGT HCAAADAVAA EETDNPTAGG SVRSVSEPIQ

  51 PTSLSLGSTC LFCSNESGSP ERTEAAVQGS GEASIPEDYT RIVADRMEGQ

 101 SQVQVRAEGN VVVERNRTTL NADWADYDQS GDTVTAGDRF ALQQDGTLIR

 151 GETLTYNLEQ QTGEAHNVRM ETEHGGRRLQ SVSRTAEMLG EGHYKLTETQ

 201 FNTCSAGDAG WYVKAASVEA DREKGIGVAK HAAFVFGGVP IFYTPWADFP

 251 LDGNRKSGLL VPSLSAGSDG VSLSVPYYFN LAPNLDATFA PGVIGERGAV

 301 FDGQVRYLRP DYAGQSDLTW LPHDKKSGRN NRYQAKWQHR HDISDTLQAG

 351 VDFNQVSDSG YYRDFYGNKE IAGNVNLNRR VWLDYGGRAA GGSLNAGLSV

 401 LKYQTLANQS GYKDKPYALM PRLSADWRKN TGRAQIGVSA QFTRFSHDSR

 451 QDGSRLVVYP DIKWDFSNSW GYVRPKLGLH ATYYSLNRFG SQEARRVSRT

 501 LPIVNIDSGM TFERNTRMFG GGVLQTLEPR LFYNYIPAKS QNDLPNFDSS

 551 ESSFGYGQLF RENLYYGNDR INTANSLSAA VQSRILDGAT GEERFRAGIG

 601 QKFYFKNDAV MLDGSVGKKP RSRSDWVAFA SSGIGSRFIL DSSIHYNQND

 651 KRAENYAVGA SYRPAQGKVL NARYKYGRNE KIYLKSDGSY FYDKLSQLDL

 701 SAQWPLTRNL SAVVRYNYGF EAKKPIEVLA GAEYKSSCGC WGAGVYAQRY

 751 VTGENTYKNA VFFSLQLKDL SSVGRNPADR MDVAVPGYIP AHSLSAGRNK

 801 RP*
```

Computer analysis of this amino acid sequence gave the following results:

Homology with a Predicted ORF from *N. meningitidis*

ORF 957 shows 96.3% identity over a 377 aa overlap with a predicted ORF (ORF 957) from *N. meningitidis*

```
a958/m958 98.1% identity in 802 aa overlap

                   10        20        30        40        50        60
a958.pep    LARLFSLKPLVLALGFCFGTHCAAADAVAAEETDNPTAGGSVRSVSEPIQPTSLSLGSTC
            ||||||||||||||:||||||||||||||||||||||||| ||||||||||||||||||||
m958        LARLFSLKPLVLALGLCFGTHCAAADAVAAEETDNPTAGESVRSVSEPIQPTSLSLGSTC
                   10        20        30        40        50        60

                   70        80        90       100       110       120
a958.pep    LFCSNESGSPERTEAAVQGSGEASIPEDYTRIVADRMEGQSQVQVRAEGNVVVERNRTTL
            ||||||||||||||||||||||||||||||||||||||||||||||||||||||||||||
m958        LFCSNESGSPERTEAAVQGSGEASIPEDYTRIVADRMEGQSQVQVRAEGNVVVERNRTTL
                   70        80        90       100       110       120
```

-continued

```
                 130       140       150       160       170       180
a958.pep   NADWADYDQSGDTVTAGDRFALQQDGTLIRGETLTYNLEQQTGEAHNVRMETEHGGRRLQ
           |:||||||||||||||||||||||||||||||||||||||||||||||||| |:||||||
m958       NTDWADYDQSGDTVTAGDRFALQQDGTLIRGETLTYNLEQQTGEAHNVRMEIEQGGRRLQ
                 130       140       150       160       170       180

                 190       200       210       220       230       240
a958.pep   SVSRTAEMLGEGHYKLTETQFNTCSAGDAGWYVKAASVEADREKGIGVAKHAAFVFGGVP
           ||||||||||||||||||||||||||||||||||||||||||||||||||||||||||||
m958       SVSRTAEMLGEGHYKLTETQFNTCSAGDAGWYVKAASVEADREKGIGVAKHAAFVFGGVP
                 190       200       210       220       230       240

                 250       260       270       280       290       300
a958.pep   IFYTPWADFPLDGNRKSGLLVPSLSAGSDGVSLSVPYYFNLAPNLDATFAPGVIGERGAV
           ||||||||||||||||||||||||||||||||||||||||||||||||||||||||||||
m958       IFYTPWADFPLDGNRKSGLLVPSLSAGSDGVSLSVPYYFNLAPNLDATFAPSVIGERGAV
                 250       260       270       280       290       300

                 310       320       330       340       350       360
a958.pep   FDGQVRYLRPDYAGQSDLTWLPHDKKSGRNNRYQAKWQHRHDISDTLQAGVDFNQVSDSG
           ||||||||||||||||||||||||||||||||||||||||||||||||||||||||||||
m958       FDGQVRYLRPDYAGQSDLTWLPHDKKSGRNNRYQAKWQHRHDISDTLQAGVDFNQVSDSG
                 310       320       330       340       350       360

                 370       380       390       400       410       420
a958.pep   YYRDFYGNKEIAGNVNLNRRVWLDYGGRAAGGSLNAGLSVLKYQTLANQSGYKDKPYALM
           ||||||||||||||||||||||||||||||||||||||||||||||||||||||||||||
m958       YYRDFYGMKEIAGNVNLNRRVWLDYGGRAAGGSLNAGLSVLKYQTLANQSGYKDKPYALM
                 370       380       390       400       410       420

                 430       440       450       460       470       480
a958.pep   PRLSADWRKNTGRAQIGVSAQFTRFSHDSRQDGSRLVVYPDIKWDFSNSWGYVRPKLGLH
           ||||::||||||||||||||||||||||||||||||||||||||||||||||||||||||
m958       PRLSVEWRKNTGRAQIGVSAQFTRFSHDGRQDGSRLVVYPDIKWDFSNSWGYVRPKLGLH
                 430       440       450       460       470       480

                 490       500       510       520       530       540
a958.pep   ATYYSLNRFGSQEARRVSRTLPIVNIDSGMTFERNTRMFGGGVLQTLEPRLFYNYIPAKS
           |||||||||||||||||||||||||||||| ||||||||||| ||||||||||||||||||
m958       ATYYSLNRFGSQEARRVSRTLPIVNIDSGATFERNTRMFGGEVLQTLEPRLFYNYIPAKS
                 490       500       510       520       530       540

                 550       560       570       580       590       600
a958.pep   QNDLPNFDSSESSFGYGQLFRENLYYGNDRINTANSLSAAVQSRILDGATGEERFRAGIG
           ||||||||||||||||||||||||||||||||||||||||||||||||||||||||||||
m958       QNDLPNFDSSESSFGYGQLFRENLYYGNDRINTANSLSAAVQSRILDGATGEERFRAGIG
                 550       560       570       580       590       600

                 610       620       630       640       650       660
a958.pep   QKFYFKNDAVMLDGSVGKKPRSRSDWVAFASSGIGSRFILDSSIHYNQNDKRAENYAVGA
           ||||||:||||||||||||||:|||||||||::|||||||||||||||||||||||||||
m958       QKFYFKDDAVMLDGSVGKKPRNRSDWVAFASGSIGSRFILDSSIHYNQNDKRAENYAVGA
                 610       620       630       640       650       660

                 670       680       690       700       710       720
a958.pep   SYRPAQGKVLNARYKYGRNEKIYLKSDGSYFYDKLSQLDLSAQWPLTRNLSAVVRYNYGF
           ||||||||||||||||||||||||||||||||||||||||||||||||||||||||||||
m958       SYRPAQGKVLNARYKYGRNEKIYLKSDGSYFYDKLSQLDLSAQWPLTRNLSAVVRYNYGF
                 670       680       690       700       710       720

                 730       740       750       760       770       780
a958.pep   EAKKPIEVLAGAEYKSSCGCWGAGVYAQRYVTGENTYKNAVFFSLQLKDLSSVGRNPADR
           ||||||||||||||||||||||||||||||||||||||||||||||||||||||||||||
m958       EAKKPIEVLAGAEYKSSCGCWGAGVYAQRYVTGENTYKNAVFFSLQLKDLSSVGRNPAGR
                 730       740       750       760       770       780

                 790       800
a958.pep   MDVAVPGYIPAHSLSAGRNKRPX
           |||||||||||||||||||||
m958       MDVAVPGYITAHSLSAGRNKRP
                 790       800
```

The following partial DNA sequence was identified in *N. gonorrhoeae* <SEQ ID 2935>:

```
g959.seq
   1 ATGAACATCA AACACCTTCT CTTGACCGCC GCCGCAACCG CACTGTTGGG

  51 CATTTCCGCC CCCGCACTCG CCCACCACGA CGGACACGGC GATGACGACC

 101 ACGGACACGC CGCACACCAA CACGGCAAAC AAGACAAAAT CATCAGCCGC

 151 GCCCAAGCCG AAAAAGCGGC TTGGGCGCGT GTCGGCGGCA AAATCACCGA

 201 CATCGATCTC GAACACGACG ACGGCCGTCC GCACTATGAT GTCGAAATCG

 251 TCAAAAACGG ACAGGAATAC AAAGTCGTTG TCGATGCCCG TACCGGCCGC
```

-continued

```
301 GTGATTTCCT CCCGCCGCGA CGACTGA
```

This corresponds to the amino acid sequence <SEQ ID 2936; ORF 959.ng>:

```
g959.pep
   1 MNIKHLLLTA AATALLGISA PALAHHDGHG DDDHGHAAHQ HGKQDKIISR

  51 AQAEKAAWAR VGGKITDIDL EHDDGRPHYD VEIVKNGQEY KVVVDARTGR

 101 VISSRRDD*
```

The following partial DNA sequence was identified in *N. meningitidis* <SEQ ID 2937>:

```
m959.seq
   1 ATGAACATCA AACACCTTCT CTTGACCTCC GCCGCAACCG CACTGCTGAG

  51 CATTTCCGCC CCCGCGCTCG CCCACCACGA CGGACACGGC GATGACGACC

 101 ACGGACACGC CGCACACCAA CACAACAAAC AAGACAAAAT CATCAGCCGC

 151 GCCCAAGCCG AAAAAGCAGC GTTGGCGCGT GTCGGCGGCA AAATCACCGA

 201 CATCGATCTC GAACACGACA ACGGCCGTCC GCACTATGAT GTCGAAATCG

 251 TCAAAAACGG ACAGGAATAC AAAGTCGTTG TCGATGCCCG TACCGGCCGC

 301 GTGATTTCCT CCCGCCGCGA CGACTGA
```

This corresponds to the amino acid sequence <SEQ ID 2938; ORF 959>:

```
m959.pep
   1 MNIKHLLLTS AATALLSISA PALAHHDGHG DDDHGHAAHQ HNKQDKIISR

  51 AQAEKAALAR VGGKITDIDL EHDNGRPHYD VEIVKNGQEY KVVVDARTGR

 101 VISSRRDD*
```

Computer analysis of this amino acid sequence gave the following results:

Homology with a Predicted ORF from *N. gonorrhoeae*

ORF 959 shows 95.4% identity over a 108 aa overlap with a predicted ORF (ORF 959) from *N. gonorrhoeae*

```
m959/g959   95.4% identity in 108 aa overlap

                    10        20        30        40        50        60
m959.pep    MNIKHLLLTSAATALLSISAPALAHHDGHGDDDHGHAAHQHNKQDKIISRAQAEKAALAR
            |||||||||:||||||:||||||||||||||||||||||||:||||||||||||||| ||
g959        MNIKHLLLTAAATALLGISAPALAHHDGHGDDDHGHAAHQHGKQDKIISRAQAEKAAWAR
                    10        20        30        40        50        60

                    70        80        90       100      109
m959.pep    VGGKITDIDLEHDNGRPHYDVEIVKNGQEYKVVVDARTGRVISSRRDDX
            |||||||||||||:|||||||||||||||||||||||||||||||||||
g959        VGGKITDIDLEHDDGRPHYDVEIVKNGQEYKVVVDARTGRVISSRRDDX
                    70        80        90       100
```

The following partial DNA sequence was identified in *N. meningitidis* <SEQ ID 2939>:

```
a959.seq
   1 ATGAACTTCA AACGCCTTCT CTTGACCGCC GCCGCAACCG CACTGATGGG

  51 CATTTCCGCC CCCGCACTCG CCCACCACGA CGGACACGGC GATGACGACC

 101 ACGGACACGC CGCACACCAA CACAGCAAAC AAGACAAAAT CATCAGCCGC
```

-continued

```
151 GCCCAAGCCG AAAAAGCAGC GTTGGCGCGT GTCGGCGGCA AAATCACCGA

201 CATCGATCTC GAACACGACA ACGGCCGTCC GCACTATGAT GTCGAAATCG

251 TCAAAAACGG ACAGGAATAC AAAGTCGTTG TCGATGCCCG TACCGGCCGC

301 GTGATTTCCT CCCGCCGCGA CGACTGA
```

This corresponds to the amino acid sequence <SEQ ID 2940; ORF 959.a>:

```
a959.pep
  1 MNFKRLLLTA AATALMGISA PALAHHDGHG DDDHGHAAHQ HSKQDKIISR

 51 AQAEKAALAR VGGKITDIDL EHDNGRPHYD VEIVKNGQEY KVVVDARTGR

101 VISSRRDD*
```

Computer analysis of this amino acid sequence gave the following results:

Homology with a Predicted ORF from *N. meningitidis*

ORF 959 shows 94.4% identity over a 108 aa overlap with a predicted ORF (ORF 959) from *N. meningitidis*

```
a959/m959   94.4% identity in 108 aa overlap

                      10        20        30        40        50        60
a959.pep    MNFKRLLLTAAATALMGISAPALAHHDGHGDDDHGHAAHQHSKQDKIISRAQAEKAALAR
            ||:|:||||:|||||::||||||||||||||||||||||||:||||||||||||||||||
m959        MNIKHLLLTSAATALLSISAPALAHHDGHGDDDHGHAAHQHNKQDKIISRAQAEKAALAR
                      10        20        30        40        50        60

                      70        80        90       100      109
a959.pep    VGGKITDIDLEHDNGRPHYDVEIVKNGQEYKVVVDARTGRVISSRRDDX
            |||||||||||||||||||||||||||||||||||||||||||||||||
m959        VGGKITDIDLEHDNGRPHYDVEIVKNGQEYKVVVDARTGRVISSRRDDX
                      70        80        90       100

g960.seq not found yet

g960.pep not found yet
```

The following partial DNA sequence was identified in *N. meningitidis* <SEQ ID 2941>:

```
m960.seq
  1 ATGCAAGTAA ATATTCAGAT TCCCTGTATG CTGTACAGAC GCGGGAGTGT

 51 TAAGCCCCCC TTGTTTGAAG CTCCGCGGCT CCTGCCGAGC TTCACCGACC

101 CCGTTGTGCC CAAGCTCTCT GCTCCCGGCG GCTACATTGT CGACATCCCC

151 AAAGGCAATC TGAAAACCGA AATCGAAAAG CTGGCCAAAC AGCCCGAGTA

201 TGCCTATCTG AAACAGCTCC AAGTAGCGAA AAACGTCAAC TGGAACCAGG

251 TGCAACTGGC TTACGATAAA TGGGACTATA AGCAGGAAGG CTTAACCAGA

301 GCCGGTGCAG CGATTATCGC GCTGGCTGTT ACCGTGGTTA CTGCGGGCGC

351 GGGAGTCGGA GCCGCACTAG GCTTAAACGG CGCAGCCGCA GCAGCGGCCG

401 ATGCCGCCTT TGCCTCACTC GCTTCTCAGG CTTCCGTATC GCTCATCAAC

451 AATAAAGGCG ATGTCGGCAA AACCCTGAAG GAACTGGGCA GAAGCCGCAC

501 GGTAAAAAAT CTGGTTGTAG CGGCGGCAAC GGCAGGCGTA TCCAACAAAC

551 TCGGTGCCTC TTCCCTTGCC ACTTGGAGCG AAACCCCTTG GGTAAACAAC

601 CTCAACGTTA ACCTGGCCAA TGCGGGCAGT GCCGCGCTGA TCAACACCGC

651 TGTTAACGGC GGCAGCCTGA AAGACAATCT GGAGGCAAAT ATCCTGGCGG

701 CATTGGTGAA TACCGCGCAT GGGGAGGCGG CGAGTAAGAT CAAAGGACTG
```

-continued

```
751 GATCAGCACT ATGTCGCCCA CAAAATCGCT CATGCCGTAG CGGGCTGTGC

801 GGCTGCAGCG GCGAATAAGG GCAAATGTCA GGACGGCGCG ATCGGTGCGG

851 CTGTGGGTGA GATTGTCGGG GAGGCTTTGG TTAAAAATAC CGATTTTAGC

901 GATATGACCC CGGAACAATT AGATCTGGAA GTTAAGAAAA TTACCGCCTA

951 TGCCAAACTT GCGGCAGGTA CAGTTGCAGG CGTAACGGGA GGAGATGTCA

1001 ATACTGCTGC ACAAACCGCA CAAAACGCGG TAGAAAATAA TGCGGTTAAA

1051 GCTGTTGTAA CTGCTGCAAA AGTGGTTTAT AAGGTAGCCA GAAAAGGATT

1101 AAAAAACGGG AAAATCAACG TTAGAGATTT AAAACAGACG TTGAAAGACG

1151 AAGGTTATAA TTTAGCCGAC AACCTGACCA CCTTATTCGA CGAAACATTG

1201 GATTGGAACG ATGCCAAAGC CGTTATTGAT ATTGTCGTCG GAACAGAGCT

1251 GAATCGCGCT AATAAAGGGG AAGCGGCACA AAAGGTCAAG GAAGTTTTAG

1301 AAAAAAATCG TCCTTATATC CCTAATAAAG GTGCTGTACC GAATATGAGT

1351 ACATACATGA AAAATAATCC TTTTGGAAAA CAGCTGGCTC AAATTTCAGA

1401 AAAGACAACG CTTCCGACGC AGCAAGGGCA GTCTGTCTTC TTGGTAAAAA

1451 GAAACCAAGG GTTATTAAAA ACCGGTGATA GGTTTTATTT AGATGGCCAA

1501 CATAAAAATC ATTTAGAGGT TTTTGATAAA AATGGGAACT TTAAGTTTGT

1551 TCTAAATATG GATGGTTCGC TTAACCAAAT GAAAACTGGG GCAGCAAAAG

1601 GTCGTAAATT AAACTTAAAA TAG
```

This corresponds to the amino acid sequence <SEQ ID 2942; ORF 960>:

```
m960.pep
   1 MQVNIQIPCM LYRRGSVKPP LFEAPRLLPS FTDPVVPKLS APGGYIVDIP

  51 KGNLKTEIEK LAKQPEYAYL KQLQVAKNVN WNQVQLAYDK WDYKQEGLTR

 101 AGAAIIALAV TVVTAGAGVG AALGLNGAAA AAADAAFASL ASQASVSLIN

 151 NKGDVGKTLK ELGRSRTVKN LVVAAATAGV SNKLGASSLA TWSETPWVNN

 201 LNVNLANAGS AALINTAVNG GSLKDNLEAN ILAALVNTAH GEAASKIKGL

 251 DQHYVAHKIA HAVAGCAAAA ANKGKCQDGA IGAAVGEIVG EALVKNTDFS

 301 DMTPEQLDLE VKKITAYAKL AAGTVAGVTG GDVNTAAQTA QNAVENNAVK

 351 AVVTAAKVVY KVARKGLKNG KINVRDLKQT LKDEGYNLAD NLTTLFDETL

 401 DWNDAKAVID IVVGTELNRA NKGEAAQKVK EVLEKNRPYI PNKGAVPNMS

 451 TYMKNNPFGK QLAQISEKTT LPTQQGQSVF LVKRNQGLLK TGDRFYLDGQ

 501 HKNHLEVFDK NGNFKFVLNM DGSLNQMKTG AAKGRKLNLK *
```

```
a960.seq not found yet
a960.pep not found yet
g961.seq not found yet
g961.pep not found yet
```

The following partial DNA sequence was identified in *N. meningitidis* <SEQ ID 2943>:

```
m961.seq
   1 ATGAGCATGA AACACTTTCC AGCCAAAGTA CTGACCACAG CCATCCTTGC

  51 CACTTTCTGT AGCGGCGCAC TGGCAGCCAC AAGCGACGAC GATGTTAAAA

 101 AAGCTGCCAC TGTGGCCATT GTTGCTGCCT ACAACAATGG CCAAGAAATC
```

-continued

```
 151 AACGGTTTCA AAGCTGGAGA GACCATCTAC GACATTGGTG AAGACGGCAC

 201 AATTACCCAA AAAGACGCAA CTGCAGCCGA TGTTGAAGCC GACGACTTTA

 251 AAGGTCTGGG TCTGAAAAAA GTCGTGACTA ACCTGACCAA AACCGTCAAT

 301 GAAAACAAAC AAAACGTCGA TGCCAAAGTA AAAGCTGCAG AATCTGAAAT

 351 AGAAAAGTTA ACAACCAAGT TAGCAGACAC TGATGCCGCT TTAGCAGATA

 401 CTGATGCCGC TCTGGATGAA ACCACCAACG CCTTGAATAA ATTGGGAGAA

 451 AATATAACGA CATTTGCTGA AGAGACTAAG ACAAATATCG TAAAAATTGA

 501 TGAAAAATTA GAAGCCGTGG CTGATACCGT CGACAAGCAT GCCGAAGCAT

 551 TCAACGATAT CGCCGATTCA TTGGATGAAA CCAACACTAA GGCAGACGAA

 601 GCCGTCAAAA CCGCCAATGA AGCCAAACAG ACGGCCGAAG AAACCAAACA

 651 AAACGTCGAT GCCAAAGTAA AAGCTGCAGA AACTGCAGCA GGCAAAGCCG

 701 AAGCTGCCGC TGGCACAGCT AATACTGCAG CCGACAAGGC CGAAGCTGTC

 751 GCTGCAAAAG TTACCGACAT CAAAGCTGAT ATCGCTACGA ACAAAGCTGA

 801 TATTGCTAAA AACTCAGCAC GCATCGACAG CTTGGACAAA AACGTAGCTA

 851 ATCTGCGCAA AGAAACCCGC CAAGGCCTTG CAGAACAAGC CGCGCTCTCC

 901 GGCCTGTTCC AACCTTACAA CGTGGGTCGG TTCAATGTAA CGGCTGCAGT

 951 CGGCGGCTAC AAATCCGAAT CGGCAGTCGC CATCGGTACC GGCTTCCGCT

1001 TTACCGAAAA CTTTGCCGCC AAAGCAGGCG TGGCAGTCGG CACTTCGTCC

1051 GGTTCTTCCG CAGCCTACCA TGTCGGCGTC AATTACGAGT GGTAA
```

This corresponds to the amino acid sequence <SEQ ID 940; ORF 2944>:

```
m961.pep
   1 MSMKHFPAKV LTTAILATFC SGALAATSDD DVKKAATVAI VAAYNNGQEI

  51 NGFKAGETIY DIGEDGTITQ KDATAADVEA DDFKGLGLKK VVTNLTKTVN

 101 ENKQNVDAKV KAAESEIEKL TTKLADTDAA LADTDAALDE TTNALNKLGE

 151 NITTFAEETK TNIVKIDEKL EAVADTVDKH AEAFNDIADS LDETNTKADE

 201 AVKTANEAKQ TAEETKQNVD AKVKAAETAA GKAEAAAGTA NTAADKAEAV

 251 AAKVTDIKAD IATNKADIAK NSARIDSLDK NVANLRKETR QGLAEQAALS

 301 GLFQPYNVGR FNVTAAVGGY KSESAVAIGT GFRFTENFAA KAGVAVGTSS

 351 GSSAAYHVGV NYEW*

a961.seq not found yet
a961.pep not found yet
g972.seq not found yet
g972.pep not found yet
```

The following partial DNA sequence was identified in *N. meningitidis* <SEQ ID 2945>:

```
m972.seq
   1 TTGACTAACA GGGGGGGAGC GAAATTAAAA ACCArTTCCA AGAGTAGTGA

  51 ACGAATGAGT GAAGTTGAAT ATTTCTCACA CTTTATATCG GACGGAAAAG

 101 GGAAGCTTTT AGAAATTCCG CAGCGAAGAG GTAAGCAAGA CggGGTTTTT

 151 GTTGATTGGA TTTCATTCAC ATTCCATGAA GATACTTTAC TGAAAGTTTC
```

-continued

201 CGGTTGCCCT TTATTTTCTG ATGCTGAATA CATGTATGTA TTAAGCAGAA

251 AGCTGGAAGA AATTCTAGGT TTTGGCATAA CGCGCAAATG CAAATCAAGG

301 GGCAACAAAT TCTATGAATC CATGTATAGG TTAGGTTCGG ATGATGTTGA

351 TTATGGAGAG GTGCATTTCG GArGTCAGCG CAATACTGTT TTAGTTGAGT

401 TGAAAGGTAC TGGTTGCAGC GTTGCAAGTC CGGGTTGGGA GTTGAGGCTA

451 AAGCAGTTTC TCGATGATTC GATAAGGACA AGAATAACGC GAATTGACCT

501 AGCACTTGAT TTTTTTGATG GAGAGTACAC GCCGGATCAG GCGTTGTTAG

551 ATCACGATAA TGGTTTTTTT GATAACAGCA ATCAAAGGCC GAAATCTGAA

601 ACGATCGGTA CGGCTTGGCG GAATGAGGAC GGGAGCGGCA AGACATTTTA

651 TGTAGGTCGC AAGAAAAATT CTCGTTTTGT TCGTGTTTAT GAGAAAGGCA

701 GGCAGCTTGG AGATAAAGAA AGCAAATGGG TAAGGTTCGA GATCCAGTTT

751 AATTATGGAG ATATAGAAAT ACCCTTGGAT ATTTTAATAA ATCAGGGTTC

801 GTATTTCTGT GGAGCTTTTC CAATTTGTAG AAAATTTAAA AATATGCCGG

851 TTCCCGAAAG GTTTGATCAG AGAAAGAAAA AGCTTAATTT AACTTTCGAG

901 CATAAATTGC ATTACGCGAA AAACGCGGTT GGAAAACTGG TCAATTTCAT

951 GATTGAAATG GGTTTTGATA ATAGCGAAAT TGTGGAATCT TTAAAGGCAG

1001 ATTCGGGATT TCCCAAAGGA TTAGAACCTG AAAAATATGC TCTGGAAATG

1051 TTAAGGGACG GTTTGAAACA CGGTTTTATT CATGAACAGC CGGATATTGA

1101 TTTGGAAATT GAACTTGATG AATTGGGGGT TATTGCTTTT AAAAATTCTG

1151 ACAAATTCGA TAGGGAAAAA AGGCTTTTTA GTCCTGATTA TGATGTCGAG

1201 AAAGAAAGGA AATATCAGGA ATATTTAAGT AAAGTTTATC ATCAAAATGT

1251 AGATTATGAT TATTTTTAA

This corresponds to the amino acid sequence <SEQ ID 2946; ORF 972>:

m972.pep

1 LTNRGGAKLK TXSKSSERMS EVEYFSHFIS DGKGKLLEIP QRRGKQDGVF

51 VDWISFTFHE DTLLKVSGCP LFSDAEYMYV LSRKLEEILG FGITRKCKSR

101 GNKFYESMYR LGSDDVDYGE VHFGXQRNTV LVELKGTGCS VASPGWELRL

151 KQFLDDSIRT RITRIDLALD FFDGEYTPDQ ALLDHDNGFF DNSNQRPKSE

201 TIGTAWRNED GSGKTFYVGR KKNSRFVRVY EKGRQLGDKE SKWVRFEIQF

251 NYGDIEIPLD ILINQGSYFC GAFPICRKFK NMPVPERFDQ RKKKLNLTFE

301 HKLHYAKNAV GKLVNFMIEM GFDNSEIVES LKADSGFPKG LEPEKYALEM

351 LRDGLKHGFI HEQPDIDLEI ELDELGVIAF KNSDKFDREK RLFSPDYDVE

401 KERKYQEYLS KVYHQNVDYD YF*

The following partial DNA sequence was identified in *N. meningitidis* <SEQ ID 2947>:

a972.seq

1 TTGACTAACA GGGGGGGAGC GAAATTAAAA ACCAATTCCA AGAGTAGTGA

51 ACGAATGAGT GAAGTTGAAT ATTTCTCACA CTTTATATCG GACGGAAAAG

101 GGAAGCTTTT AGAAATTCCG CAGCGAAGAG GTAAGCAAGA CGGGGTTTTT

-continued

```
 151 GTTGATTGGA TTTCATTCAC ATTCCATGAA GATACTTTAC TGAAAGTTTC
 201 CGGTTGCCCT TTATTTTCTG ATGCTGAATA CATGTATGTA TTAAGCAGAA
 251 AGCTGGAAGA AATTCTAGGT TTTGGCATAA CGCGCAAATG CAAATCAAGG
 301 GGCAACAAAT TCTATGAATC CATGTATAGG TTAGGTTCGG ATGATGTTGA
 351 TTATGGAGAG GTGCATTTCG GAGGTCAGCG CAATACTGTT TTAGTTGAGT
 401 TGAAAGGTAC TGGTTGCAGC GTTGCAAGTC CGGGTTGGGA GTTGAGGCTA
 451 AAGCAGTTTC TCGATGATTC GATAAGGACA AGAATAACGC GAATTGACCT
 501 AGCACTTGAT TTTTTTGATG GAGAGTACAC GCCGGATCAG GCGTTGTTAG
 551 ATCACGATAA TGGTTTTTTT GATAACAGCA ATCAAAGGCC GAAATCTGAA
 601 ACGATCGGTA CGGCTTGGCG GAATGAGGAC GGGAGCGGCA AGACATTTTA
 651 TGTAGGTCGC AAGAAAAATT CTCGTTTTGT TCGTGTTTAT GAGAAAGGCA
 701 GGCAGCTTGG AGATAAAGAA AGCAAATGGG TAAGGTTCGA GATCCAGTTT
 751 AATTATGGAG ATATAGAAAT ACCCTTGGAT ATTTTAATAA ATCAGGGTTC
 801 GTATTTCTGT GGAGCTTTTC CAATTTGTAG AAAATTTAAA AATATGCCGG
 851 TTCCCGAAAG GTTTGATCAG AGAAAGAAAA CGCTTAATTT AACTTTCGAG
 901 CATAAATTGC ATTACGCGAA AAACGCGGTT GGAAAACTGG TCAATTTCAT
 951 GATTGAAATG GGTTTTGATA ATAGCGAAAT TGTGGAATCT TTAAAGGCAG
1001 ATTCGGGATT TCCCAAAGGA TTAGAACCTG AAAAATATGC TCTGGAAATG
1051 TTAAGGGACG GTTTGAAACA CGGTTTTATT CATGAACAGC CGGATATTGA
1101 TTTGGAAATT GAACTTGATG AATTGGGGGT TATTGCTTTT AAAAATTCTG
1151 ACAAATTCGA TAGGGAAAAA AGGCTTTTTA GTCCTGATTA TGATGTCGAG
1201 AAAGAAAGGA AATATCAGGA ATATTTAAGT AAAGTTTATC ATCAAAATGT
1251 AGATTATGAT TATTTTTAA
```

This corresponds to the amino acid sequence <SEQ ID 2948; ORF 972.a>:

```
a972.pep
   1 LTNRGGAKLK TNSKSSERMS EVEYFSHFIS DGKGKLLEIP QRRGKQDGVF
  51 VDWISFTFHE DTLLKVSGCP LFSDAEYMYV LSRKLEEILG FGITRKCKSR
 101 GNKFYESMYR LGSDDVDYGE VHFGGQRNTV LVELKGTGCS VASPGWELRL
 151 KQFLDDSIRT RITRIDLALD FFDGEYTPDQ ALLDHDNGFF DNSNQRPKSE
 201 TIGTAWRNED GSGKTFYVGR KKNSRFVRVY EKGRQLGDKE SKWVRFEIQF
 251 NYGDIEIPLD ILINQGSYFC GAFPICRKFK NMPVPERFDQ RKKTLNLTFE
 301 HKLHYAKNAV GKLVNFMIEM GFDNSEIVES LKADSGFPKG LEPEKYALEM
 351 LRDGLKHGFI HEQPDIDLEI ELDELGVIAF KNSDKFDREK RLFSPDYDVE
 401 KERKYQEYLS KVYHQNVDYD YF*
```

m972/a972 99.3% identity in 422 aa overlap

```
                     10        20        30        40        50        60
m972.pep     LTNRGGAKLKTXSKSSERMSEVEYFSHFISDGKGKLLEIPQRRGKQDGVFVDWISFTFHE
             |||||||||| |||||||||||||||||||||||||||||||||||||||||||||||||
a972         LTNRGGAKLKTNSKSSERMSEVEYFSHFISDGKGKLLEIPQRRGKQDGVFVDWISFTFHE
                     10        20        30        40        50        60
```

-continued

```
                    70        80        90       100       110       120
m972.pep    DTLLKVSGCPLFSDAETMTVLSRKLEEILGFGITRKCKSRGNKFYESMYRLGSDDVDYGE
            ||||||||||||||||||||||||||||||||||||||||||||||||||||||||||||
a972        DTLLKVSGCPLFSDAEYMYVLSRKLEEILGFGITRKCKSRGNKFYESMYRLGSDDVDYGE
                    70        80        90       100       110       120

                   130       140       150       160       170       180
m972.pep    VHFGXQRNTVLVELKGTGCSVASPGWELRLKQFLDDSIRTRITRIDLALDFFDGEYTPDQ
            |||| |||||||||||||||||||||||||||||||||||||||||||||||||||||||
a972        VHFGGQRNTVLVELKGTGCSVASPGWELRLKQFLDDSIRTRITRIDLALDFFDGEYTPDQ
                   130       140       150       160       170       180

                   190       200       210       220       230       240
m972.pep    ALLDHDNGFFDNSNQRPKSETIGTAWRNEDGSGKTFYVGRKKNSRFVRVYEKGRQLGDKE
            ||||||||||||||||||||||||||||||||||||||||||||||||||||||||||||
a972        ALLDHDNGFFDNSNQRPKSETIGTAWRNEDGSGKTFYVGRKKNSRFVRVYEKGRQLGDKE
                   190       200       210       220       230       240

                   250       260       270       280       290       300
m972.pep    SKWVRFEIQFNYGDIEIPLDILINQGSYFCGAFPICRKFKNMPVPERFDQRKKKLNLTFE
            ||||||||||||||||||||||||||||||||||||||||||||||||||||| ||||||
a972        SKWVRFEIQFNYGDIEIPLDILINQGSYFCGAFPOCRKFKNMPVPERFDQRKKTLNLTFE
                   250       260       270       280       290       300

                   310       320       330       340       350       360
m972.pep    HKLHYAKNAVGKLVNFMIEMGFDNSEIVESLKADSGFPKGLEPEKYALEMLRDGLKHGFI
            ||||||||||||||||||||||||||||||||||||||||||||||||||||||||||||
a972        HKLHYAKNAVGKLVNFMIEMGFDNSEIVESLKADSGFPKGLEPEKYALEMLRDGLKHGFI
                   310       320       330       340       350       360

                   370       380       390       400       410       420
m972.pep    HEQPDIDLEIELDELGVIAFKNSDKFDREKRLFSPDYDVEKERKYQEYLSKVYHQNVDYD
            ||||||||||||||||||||||||||||||||||||||||||||||||||||||||||||
a972        HEQPDIDLEIELDELGVIAFKNSDKFDREKRLFSPDYDVEKERKYQEYLSKVYHQNVDYD
                   370       380       390       400       410       420

m972.pep    YFX
            |||
a972        YFX
```

The following partial DNA sequence was identified in *N. gonorrhoeae* <SEQ ID 2949>:

```
g973.seq
  1 ATGGACGGCG CACAACCGAA AACAAATTTT TTTGAACGCC TGATTGCCCG

 51 actCGCCCGC GAACCCGATT CCGCCGAAGA CGTATTAAAC CTGCTTCGGC

101 AGGCGCACGA ACAGGAAGTT TTTGATGCCG ACACACTGAC CCGGCTGGAA

151 AAAGTATTGG ACTTTGCCGA GCTGGAAGTG CGCGATGCGA TGATTACGCG

201 CAGCCGCATG AACGTATTGA AAGAAAACGA CAGCATCGAA CGCATCACCG

251 CCTACGTCAT CGATACCGCC CATTCGCGCT TCCCCGTCAT CGGCGAAGAC

301 AAAGACGAAG TTTTGGGCAT TTTGCACGCC AAAGACCTGC TCAAATATAT

351 GTTCAACCCC GAGCAGTTCC ACCTGAAATC CGTCTTGCGC CCTGCCGTTT

401 TCGTGCCCGA AGGCAAATCT TTGACCGCCC TTTTAAAAGA GTTCCGCGAA

451 CAGCGCAACC ATATGGCAAT CGTCATCGAC GAATACGGCG GCACGTCGGG

501 TTTGGTCACC TTTGAAGACA TCATCGAGCa aatcgtcggt gacaTCGAAG

551 ACGAGTTTGA CGAAGACGAA AGCGccgacg acatCCACTC cgTTTccgCC

601 GAACGCTGGC GCATCCacgc ggctaCCGAA ATCGAAGaca TCAACGCCTT

651 TTTCGGTACG GAatacggca gcgaagaagc cgacaccatc ggcggctTGG

701 TCATTCAGGA ATTGGGACAC CTGCCCGTGC GCGGCGAAAA AGTCCTTAtc

751 ggcgGTTTGC agttcaccgt CGCCCGCGCC GACAACCGCC GCCTGCACAC

801 GCTGATGGCG ACCCGCGTGA AGTAAGCAGA GCCTGCCcgc accgccgttT

851 CTGCacAGTT TAG
```

This corresponds to the amino acid sequence <SEQ ID 2950; ORF 973.ng>:

```
g973.pep
   1 MDGAQPKTNF FERLIARLAR EPDSAEDVLN LLRQAHEQEV FDADTLTRLE

  51 KVLDFAELEV RDAMITRSRM NVLKENDSIE RITAYVIDTA HSRFPVIGED

 101 KDEVLGILHA KDLLKYMFNP EQFHLKSVLR PAVFVPEGKS LTALLKEFRE

 151 QRNHMAIVID EYGGTSGLVT FEDIIEQIVG DIEDEFDEDE SADDIHSVSA

 201 ERWRIHAATE IEDINAFFGT EYGSEEADTI GGLVIQELGH LPVRGEKVLI

 251 GGLQFTVARA DNRRLHTLMA TRVK*
```

The following partial DNA sequence was identified in *N. meningitidis* <SEQ ID 2951>:

```
m973.seq
   1 ATGGACGGCG CACAACCGAA AACGAATTTT TTTGAACGCC TGATTGCCCG

  51 ACTCGCCCGC GAACCCGATT CCGCCGAAGA CGTATTAAAC CTGCTTCGGC

 101 AGGCGCACGA GCAGGAAGTT TTTGATGCGG ATACGCTTTT AAGATTGGAA

 151 AAAGTCCTCG ATTTTTCCGA TTTGGAAGTG CGCGACGCGA TGATTACGCG

 201 CAGCCGTATG AACGTTTTAA AAGAAAACGA CAGCATCGAG CGCATCACCG

 251 CCTACGTTAT CGATACCGCC CATTCGCGCT TCCCCGTCAT CGGCGAAGAC

 301 AAAGACGAAG TTTTGGGCAT TTTGCACGCC AAAGACCTGC TCAAATATAT

 351 GTTTAACCCC GAGCAGTTCC ACCTCAAATC CATTCTCCGC CCCGCCGTCT

 401 TCGTCCCCGA AGGCAAATCG CTGACCGCCC TTTTAAAAGA GTTCCGCGAA

 451 CAGCGCAACC ATATGGCGAT TGTCATCGAC GAATACGGCG GCACATCCGG

 501 CTTGGTCACC TTTGAAGACA TCATCGAGCA AATCGTCGGC GAAATCGAAG

 551 ACGAGTTTGA CGAAGACGAT AGCGCCGACA ATATCCATGC CGTTTCTTCm

 601 GaACGcTGGC GCATCCATGC AGCTACCGAA ATCGAAGACA TCAACACCTT

 651 CTTCGGCACG GAATACAGCA kCGAAGAAGC CGACACCATT GGCGGCCTGG

 701 TCATTCAAGA GTTGGGACAT CTGCCCGTGC GCGGCGAAAA AGTCCTTATC

 751 GGCGGTTTGC AGTTCACCGT CGCACGCGCC GACAACCGCC GCCTGCATAC

 801 GCTGATGGCG ACCCGCGTGA AGTAA
```

This corresponds to the amino acid sequence <SEQ ID 2952; ORF 973>:

```
m973.pep
   1 MDGAQPKTNF FERLIARLAR EPDSAEDVLN LLRQAHEQEV FDADTLLRLE

  51 KVLDFSDLEV RDAMITRSRM NVLKENDSIE RITAYVIDTA HSRFPVIGED

 101 KDEVLGILHA KDLLKYMFNP EQFHLKSILR PAVFVPEGKS LTALLKEFRE

 151 QRNHMAIVID EYGGTSGLVT FEDIIEQIVG EIEDEFDEDD SADNIHAVSS

 201 ERWRIHAATE IEDINTFFGT EYSXEEADTI GGLVIQELGH LPVRGEKVLI

 251 GGLQFTVARA DNRRLHTLMA TRVK*
```

Computer analysis of this amino acid sequence gave the following results:

Homology with a Predicted ORF from *N. gonorrhoeae*

ORF 973 shows 95.6% identity over a 274 aa overlap with a predicted ORF (ORF 973.ng) from *N. gonorrhoeae*:

```
m973/g973
```

-continued

```
                  10        20        30        40        50        60
m973.pep   MDGAQPKTNFFERLIARLAREPDSAEDVLNLLRQAHEQEVFDADTLLRLEKVLDFSDLEV
           |||||||||||||||||||||||||||||||||||||||||||||| ||||||||::|||
g973       MDGAQPKTNFFERLIARLAREPDSAEDVLNLLRQAHEQEVFDADTLTRLEKVLDFAELEV
                  10        20        30        40        50        60

                  70        80        90       100       110       120
m973.pep   RDAMITRSRMNVLKENDSIERITAYVIDTAHSRFPVIGEDKDEVLGILHAKDLLKYMFNP
           ||||||||||||||||||||||||||||||||||||||||||||||||||||||||||||
g973       RDAMITRSRMNVLKENDSIERITAYVIDTAHSRFPVIGEDKDEVLGILHAKDLLKYMFNP
                  70        80        90       100       110       120

                 130       140       150       160       170       180
m973.pep   EQFHLKSILSPAVFVPEGKSLTALLKEFREQRNHMAIVIDEYGGTSGLVTFEDIIEQIVG
           |||||||:||||||||||||||||||||||||||||||||||||||||||||||||||||
g973       EQFHLKSVLRPAVFVPEGKSLTALLKEFREQRNHMAIVIDEYGGTSGLVTFEDIIEQIVG
                 130       140       150       160       170       180

                 190       200       210       220       230       240
m973.pep   EIEDEFDEDDSADNIHAVSSERWRIHAATEIEDINTFFGTEYSXEEADTIGGLVIQELGH
           :||||||||:|||:||:||:|||||||||||||||:||||||: ||||||||||||||||
g973       DIEDEFDEDESADDIHSVSAERWRIHAATEIEDINAFFGTEYGSEEADTIGGLVIQELGH
                 190       200       210       220       230       240

                 250       260       270
m973.pep   LPVRGEKVLIGGLQFTVARADNRRLHTLMATRVKX
           |||||||||||||||||||||||||||||||||||
g973       LPVRGEKVLIGGLQFTVARADNRRLHTLMATRVKX
                 250       260       270
```

The following partial DNA sequence was identified in *N. meningitidis* <SEQ ID 2953>:

```
a973.seq
  1 ATGGACGGCG CACAACCGAA AACAAATTTT TTTGAACGCC TGATTGCCCG

 51 ACTCGCCCGC GAACCCGATT CCGCCGAAGA CGTATTGACC CTGTTGCGCC

101 AAGCGCACGA ACAGGAAGTA TTTGATGCGG ATACGCTTTT AAGATTGGAA

151 AAAGTCCTCG ATTTTTCTGA TTTGGAAGTG CGCGACGCGA TGATTACGCG

201 CAGCCGTATG AACGTTTTAA AAGAAAACGA CAGCATCGAA CGCATCACCG

251 CCTACGTTAT CGATACCGCC CATTCGCGCT TCCCCGTCAT CGGTGAAGAC

301 AAAGACGAAG TTTTGGGTAT TTTGCACGCC AAAGACCTGC TCAAATATAT

351 GTTCAACCCC GAGCAGTTCC ACCTCAAATC GATATTGCGC CCTGCCGTCT

401 TCGTCCCCGA AGGCAAATCG CTGACCGCCC TTTTAAAAGA GTTCCGCGAA

451 CAGCGCAACC ATATGGCAAT CGTCATCGAC GAATACGGCG GCACGTCGGG

501 TTTGGTAACT TTTGAAGACA TCATCGAGCA AATCGTCGGC GACATCGAAG

551 ATGAGTTTGA CGAAGACGAA AGCGCGGACA ACATCCACGC CGTTTCCGCC

601 GAACGCTGGC GCATCCACGC GGCTACCGAA ATCGAAGACA TCAACGCCTT

651 TTTCGGCACG GAATACAGCA GCGAAGAAGC CGACACCATC GGCGGCCTGG

701 TCATTCAGGA ATTGGGACAC CTGCCCGTGC GCGGCGAAAA AGTCCTTATC

751 GGCGGTTTGC AGTTCACCGT CGCCCGCGCC GACAACCGCC GCCTGCATAC

801 GCTGATGGCG ACCCGCGTGA AGTAA
```

This corresponds to the amino acid sequence <SEQ ID 2954; ORF 973.a>:

```
a973.pep
  1 MDGAQPKTNF FERLIARLAR EPDSAEDVLT LLRQAHEQEV FDADTLLRLE

 51 KVLDFSDLEV RDAMITRSRM NVLKENDSIE RITAYVIDTA HSRFPVIGED

101 KDEVLGILHA KDLLKYMFNP EQFHLKSILR PAVFVPEGKS LTALLKEFRE

151 QRNHMAIVID EYGGTSGLVT FEDIIEQIVG DIEDEFDEDE SADNIHAVSA
```

-continued

```
201 ERWRIHAATE IEDINAFFGT EYSSEEADTI GGLVIQELGH LPVRGEKVLI

251 GGLQFTVARA DNRRLHTLMA TRVK*
```

m973/a973 97.8% identity in 274 aa overlap

```
                    10        20        30        40        50        60
m973.pep    MDGAQPKTNFFERLIARLAREPDSAEDVLNLLRQAHEQEVFDADTLLRLEKVLDFSDLEV
            |||||||||||||||||||||||||||||:||||||||||||||||||||||||||||||
a973        MDGAQPKTNFFERLIARLAREPDSAEDVLTLLRQAHEQEVFDADTLLRLEKVLDFAELEV
                    10        20        30        40        50        60

                    70        80        90       100       110       120
m973.pep    RDAMITRSRMNVLKENDSIERITAYVIDTAHSRFPVIGEDKDEVLGILHAKDLLKYMFNP
            ||||||||||||||||||||||||||||||||||||||||||||||||||||||||||||
a973        RDAMITRSRMNVLKENDSIERITAYVIDTAHSRFPVIGEDKDEVLGILHAKDLLKYMFNP
                    70        80        90       100       110       120

                   130       140       150       160       170       180
m973.pep    EQFHLKSILSPAVFVPEGKSLTALLKEFREQRNHMAIVIDEYGGTSGLVTFEDIIEQIVG
            ||||||||||||||||||||||||||||||||||||||||||||||||||||||||||||
a973        EQFHLKSILRPAVFVPEGKSLTALLKEFREQRNHMAIVIDEYGGTSGLVTFEDIIEQIVG
                   130       140       150       160       170       180

                   190       200       210       220       230       240
m973.pep    EIEDEFDEDDSADNIHAVSSERWRIHAATEIEDINTFFGTEYSXEEADTIGGLVIQELGH
            :||||||||:|||||||||:|||||||||||||||:||||||| ||||||||||||||||
a973        DIEDEFDEDESADNIHAVSAERWRIHAATEIEDINAFFGTEYGSEEADTIGGLVIQELGH
                   190       200       210       220       230       240

                   250       260       270
m973.pep    LPVRGEKVLIGGLQFTVARADNRRLHTLMATRVKX
            |||||||||||||||||||||||||||||||||||
a973        LPVRGEKVLIGGLQFTVARADNRRLHTLMATRVKX
                   250       260       270
```

The following partial DNA sequence was identified in *N. gonorrhoeae* <SEQ ID 2955>:

```
g981.seq
  1 ATGAAAAAAT GGATTGCCGC CGCCCTTGCC TGTTCCGCAC TCGCGCTGTC

 51 TGCCTGCGGC GGTCAGGGCA AAGATGCCGC CGCGCCTGCC GCCAACCCCG

101 GCAAAGTGTA CCGCGTGGCT TCCAACGCCG AGTTTGCCCC CTTTGAATCT

151 TTAGACTCGA AAGGCAATGT CGAAGGTTTC GACGTGGATT TGATGAACGC

201 GATGGCGAAG GCGGGCAATT TTAAAATCGA ATTCAAACAC CAGCCGTGGG

251 ACAGCCTTTT CCCCGCCTTG AACAACGGCG ATGCGGACGT TGTGATGTCG

301 GGCGTAACCA TTACCGACGA CCGCAAACAG TCTATGGATT TCAGCGACCC

351 GTATTTTGAA ATCACCCAAG TCGTCCTCGT TCCGAAAGGC AAAAAAGTAT

401 CTTCTTCCGA AGATTTGAAA AAGATGAACA AAGTCGGCGT GGTTACCGGC

451 CACACGGGCG ATTTCTCCGT TTCCAAACTC TTGGGCAACG ACAATCCGAA

501 AATCGCGCGC TTCGAAAACG TCCCCCTGAT TATCAAAGAA CTGGAAAACG

551 GCGGCTTGGA TTCCGTGGTC AGCGACAGCG CGGTCATCGC CAATTATGTG

601 AAAAACAACC CGGCCAAAGG AATGGACTTC GTTACCCTGC CCGACTTCAC

651 CACCGAACAC TACGGCATCG CGGTACGCAA AGGCGACGAA GCAACCGTCA

701 AAATGCTGAA CGATGCGTTG GAAAAAGTAC GCGAAAGCGG CGAATACGAC

751 AAGATCTACG CCAAATATTT TGCCAAAGAG GGCGGACAGG CTGCGAAATA

801 A
```

This corresponds to the amino acid sequence <SEQ ID 2956; ORF 981.ng>:

```
g981.pep
   1 MKKWIAAALA CSALALSACG GQGKDAAAPA ANPGKVYRVA SNAEFAPFES

  51 LDSKGNVEGF DVDLMNAMAK AGNFKIEFKH QPWDSLFPAL NNGDADVVMS

 101 GVTITDDRKQ SMDFSDPYFE ITQVVLVPKG KKVSSSEDLK KMNKVGVVTG

 151 HTGDFSVSKL LGNDNPKIAR FENVPLIIKE LENGGLDSVV SDSAVIANYV

 201 KNNPAKGMDF VTLPDFTTEH YGIAVRKGDE ATVKMLNDAL EKVRESGEYD

 251 KIYAKYFAKE GGQAAK*
```

The following partial DNA sequence was identified in *N. meningitidis* <SEQ ID 2957>:

```
m981.seq
   1 ATGAAAAAAT GGATTGCCGC CGCCCTTGCC TGTTCCGCGC TCGCGCTGTC

  51 TGCCTGCGGC GGTCAGGGCA AAGATACCGC CGCGCCTGCC GCCAACCCCG

 101 ACAAAGTGTA CCGCGTGGCT TCCAACGCCG AGTTTGCCCC CTTTGAATCT

 151 TTAGACTCGA AAGGCAATGT CGAAGGTTTC GATGTGGATT TGATGAACGC

 201 GATGGCGAAG GCGGGCAATT TTAAAATCGA ATTCAAACAC CAGCCGTGGG

 251 ACAGCCTTTT CCCCGCCTTA AACAACGGCG ATGCGGACGT TGTGATGTCG

 301 GGCGTAACCA TTACCGACGA CCGCAAACAG TCTATGGACT TCAGCGACCC

 351 GTATTTTGAA ATCACCCAAG TCGTCCTCGT TCCGAAAGGC AAAAAAGTAT

 401 CTTCTTCCGA AGATTTGAAA AACATGAACA AAGTCGGCGT GGTAACCGGC

 451 TACACGGGCG ATTTCTCCGT ATCCAAACTC TTGGGCAACG ACAATCCGAA

 501 AATCGCGCGC TTTGAAAACG TTCCCCTGAT TATCAAAGAA CTGGAAAACG

 551 GCGGCTTGGA TTCCGTGGTC AGCGACAGCG CGGTCATCGC CAATTATGTG

 601 AAAAACAATC CGGCCAAAGG GATGGACTTC GTTACCCTGC CCGACTTCAC

 651 CACCGAACAC TACGGCATCG CGGTACGCAA AGGCGACGAA GCAACCGTCA

 701 AAATGCTGAA CGATGCGTTG GAAAAAGTAC GCGAAAGCGG CGAATACGAC

 751 AAGATTTACG CCAAATATTT TGCAAAAGAA GACGGACAGG CCGCAAAATA

 801 A
```

This corresponds to the amino acid sequence <SEQ ID 2958; ORF 981>:

```
m981.pep

     1 MKKWIAAALA CSALALSACG GQGKDTAAPA ANPDKVYRVA SNAEFAPFES

    51 LDSKGNVEGF DVDLMNAMAK AGNFKIEFKH QPWDSLFPAL NNGDADVVMS

   101 GVTITDDRKQ SMDFSDPYFE ITQVVLVPKG KKVSSSEDLK NMNKVGVVTG

   150 YTGDFSVSKL LGNDNPKIAR FENVPLIIKE LENGGLDSVV SDSAVIANYV

   201 KNNPAKGMDF VTLPDFTTEH YGIAVRKGDE ATVKMLNDAL EKVRESGEYD

   251 KIYAKYFAKE DGQAAK*

m981/g981   98.1% identity in 266 aa overlap

                     10        20        30        40        50        60
981.pep     MKKWIAAALACSALALSACGGQGKDTAAPAANPDKVYRVASNAEFAPFESLDSKGNVEGF
            |||||||||||||||||||||||||:||||||| ||||||||||||||||||||||||||
g981        MKKWIAAALACSALALSACGGQGKDAAAPAANPDKVYRVASNAEFAPFESLDSKGNVEGF
                     10        20        30        40        50        60
```

-continued

```
                       70        80        90       100       110       120
981.pep       DVDLMNAMAKAGNFKIEFKHQPWDSLFPALNNGDADVVMSGVTITDDRKQSMDFSDPYFE
              ||||||||||||||||||||||||||||||||||||||||||||||||||||||||||||
g981          DVDLMNAMAKAGMFKIEFKHQPWDSLFPALNNGDADVVMSGVTITDDRKQSMDFSDPYFE
                       70        80        90       100       110       120

                      130       140       150       160       170       180
981.pep       ITQVVLVPKGKKVSSSEDLKNMNKVGVVTGYTGDFSVSKLLGNDNPKIARFENVPLIIKE
              ||||||||||||||||||||||||||||||:|||||||||||||||||||||||||||||
g981          ITQVVLVPKGKKVSSSEDLKNMNKVGVVTGYTGDFSVSKLLGNDNPKIARFENVPLIIKE
                      130       140       150       160       170       180

                      190       200       210       220       230       240
981.pep       LENGGLDSVVSDSAVIANYVKNNPAKGMDFVTKPDFTTEHYGIAVRKGDEATVKMLNDAL
              ||||||||||||||||||||||||||||||||||||||||||||||||||||||||||||
g981          LENGGLDSVVSDSAVIANYVKNNPTKGMDFVTLPDFTTEHYGIAVRKGDEATVKMLNDAL
                      190       200       210       220       230       240

                      250       260
981.pep       EKVRESGEYDKIYAKYFAKEDGQAAKX
              |||||||||||||||||||| ||||||
g981          KKVRESGEYDKIYAKYFAKEDGQAAKX
                      250       260
```

The following partial DNA sequence was identified in *N. meningitidis* <SEQ ID 2959>:

```
a981.seq
   1 ATGAAAAAAT GGATTGCCGC CGCCCTTGCC TGTTCCGCGC TCGCGCTGTC

  51 TGCCTGCGGC GGTCAGGGTA AAGATGCCGC CGCGCCCGCC GCAAATCCCG

 101 ACAAAGTGTA CCGCGTGGCT TCCAACGCCG AGTTTGCCCC CTTTGAATCT

 151 TTAGACTCGA AAGGCAATGT CGAAGGTTTC GATGTGGATT TGATGAACGC

 201 GATGGCGAAG GCGGGCAATT TTAAAATCGA ATTCAAACAC CAGCCGTGGG

 251 ACAGCCTTTT CCCCGCCTTG AACAACGGCG ATGCGGACGT TGTGATGTCG

 301 GGCGTAACCA TTACCGACGA CCGCAAACAG TCTATGGACT TCAGCGACCC

 351 GTATTTTGAA ATCACCCAAG TCGTCCTCGT TCCGAAAGGC AAAAAAATAT

 401 CTTCTTCCGA AGATTTGAAA AACATGAACA AAGTCGGCGT GGTAACCGGC

 451 TACACGGGCG ATTTCTCCGT ATCCAAACTC TTGGGCAACG ACAACCCGAA

 501 AATCGCGCGC TTTGAAAACG TTCCCCTGAT TATCAAAGAA CTGGAAAACG

 551 GCGGCTTGGA TTCCGTGGTC AGCGACAGCG CAGTCATCGC CAATTATGTG

 601 AAAAACAATC CGACCAAAGG GATGGACTTC GTTACCCTGC CCGACTTCAC

 651 CACCGAACAC TACGGCATCG CGGTACGCAA AGGCGACGAA GCAACCGTCA

 701 AAATGCTGAA CGATGCGTTG AAAAAAGTAC GCGAAAGCGG CGAATACGAC

 751 AAAATCTACG CCAAATATTT TGCAAAAGAA GACGGACAGG CCGCAAAATA

 801 A
```

This corresponds to the amino acid sequence <SEQ ID 2960; ORF 981.a>:

a981.pep<br>
   1 <u>MKKWIAAALA CSALALSA</u>CG GQGKDAAAPA ANPDKVYRVA SNAEFAPFES

```
  51 LDSKGNVEGF DVDLMNAMAK AGNFKIEFKH QPWDSLFPAL NNGDADVVMS

 101 GVTITDDRKQ SMDFSDPYFE ITQVVLVPKG KKISSSEDLK NMNKVGVVTG

 151 YTGDFSVSKL LGNDNPKIAR FENVPLIIKE LENGGLDSVV SDSAVIANYV

 201 KNNPTKGMDF VTLPDFTTEH YGIAVRKGDE ATVKMLNDAL KKVRESGEYD

 251 KIYAKYFAKE DGQAAK*
```

m981/a981 98.5% identity in 266 aa overlap

```
                      10        20        30        40        50        60
m981.pep     MKKWIAAALACSALALSACGGQGKDTAAPAANPDKVYRVASNAEFAPFESLDSKGNVEGF
             |||||||||||||||||||||||||:||||||||||||||||||||||||||||||||||
a981         MKKWIAAALACSALALSACGGQGKDAAAPAANPDKVYRVASNAEFAPFESLDSKGNVEGF
                      10        20        30        40        50        60

                      70        80        90       100       110       120
m981.pep     DVDLMNAMAKAGNFKIEFKHQPWDSLFPALNNGDADVVMSGVTITDDRKQSMDFSDPYFE
             ||||||||||||||||||||||||||||||||||||||||||||||||||||||||||||
a81          DVDLMNAMAKAGMFKIEFKHQPWDSLFPALNNGDADVVMSGVTITDDRKQSMDFSDPYFE
                      70        80        90       100       110       120

                     130       140       150       160       170       180
m981.pep     ITQVVLVPKGKKVSSSEDLKNMNKVGVVTGYTGDFSVSKLLGNDNPKIARFENVPLIIKE
             ||||||||||||:|||||||||||||||||||||||||||||||||||||||||||||||
a981         ITQVVLVPKGKKVSSSEDLKNMNKVGVVTGYTGDFSVSKLLGNDNPKIARFENVPLIIKE
                     130       140       150       160       170       180

                     190       200       210       220       230       240
m981.pep     LENGGLDSVVSDSAVIANYVKNNPAKGMDFVTKPDFTTEHYGIAVRKGDEATVKMLNDAL
             ||||||||||||||||||||||||:|||||||||||||||||||||||||||||||||||
a981         LENGGLDSVVSDSAVIANYVKNNPTKGMDFVTLPDFTTEHYGIAVRKGDEATVKMLNDAL
                     190       200       210       220       230       240

                     250       260
m981.pep     EKVRESGEYDKIYAKYFAKEDGQAAKX
             :||||||||||||||||||||||||||
a981         KKVRESGEYDKIYAKYFAKEDGQAAKX
                     250       260
```

The following partial DNA sequence was identified in *N. gonorrhoeae* <SEQ ID 2961>:

```
g982.seq
     1  atcgcatcgc aaaaccttcg attcgacaat cgattcctcc aaaaaatggt

    51  caacggcgTg aatattttgc cggccgcCga ttgggtagcC ttgGGcgcCA

   101  AAGGCCGCAA CGTGGTGGTT GACCGCGCTT TCGGCGGCCC GCACATCACC

   151  AAAGACGGCG TAACCGTCGC CAAAGAAATC GAACTGAAAG ACAAGTTTGA

   201  AAATATGGGC GCGCAAATGG TAAAAGAAGT CGCGTCCAAA ACCAAcgaCg

   251  tagCCGgcga cggtacgact accgCCACCG TATTGGCACA ATCCATCGTT

   301  GCCGAAggcA TGAAATACGT TACCGCCGGC ATGAACCCGA CCGATCTGAA

   351  ACGCGGCATC GACAAAGccg ttgCCGCTtt ggttgAAGAg cTGAAAAACA

   401  TCGCCAAACC TTGCGATACT TCCAAAGAAA TCGCCCAAGT CGGCTCGATT

   451  TCCGCCAACT CCGACGAACA AGtcgGCGCG ATTATCGCCG AAGCGATGGA

   501  AAAAGTCGGC AAAGAAGgcg tgattacCGT TGAAGACGGC AAATCTTTGG

   551  AAAACGAGCT GGACGTGGTT GAAGGTATGC AGTTCGACCG CGGCTACCTG

   601  TCCCCTTACT TTATCAACGA CGCGGAAAAA CAAATCGCCG GTCTGGACAA

   651  TCCGTTTGTT TTGCTGTTCG ACAAAAAAAT CAGCAACATC CGCGACCTGC

   701  TGCCCGTGTT GGAACAAGTG GCGAAAGCCA GCCGCCCGCT GTTGATTATC

   751  GCTGAAGACG TAGAAGGCGA AGCCTTGGCG ACTTTGGTCG TGAACAACAT

   801  CCGCGGCATC CTGAAAACCG TTGCCGTCAA AGCccccggc tTCGGcGACC

   851  GCCGCAAAGC GATgctgcaa gaCATCGCCA TCCTGACcgg cggcgTagtG

   901  ATTtccGAAG Aagtcggcct GTCTTTGGAA AAAgcgactT TGgacgaCTT

   951  Gggtcaaacc aaACGcatCG AAATCGGtga agaaaacact ACCGTCATcg

  1001  acgGCTTCGG CGACGcagcC CAAAtcgaag cgCGTGTTGC CGAAATCCGC

  1051  CAACAAATCG AAACCGCGAC CAGCGATTAC GACAAAGAAA AACTGCAAGA

  1101  GCGCGTTGCC AAACTGGCAG GAGGCGTGGC AGTGATCAAA GTCGGCGCGG
```

-continued

```
1151  CGACCGAAGT CGAAATGAAA GAGAAAAAAG ACCGCGTGGA AGACGCGCTG

1201  CACGCTACCC GCGCAGCCGT TGAAGAAGGC GTGGTTGCAG GCGGCGGCGT

1251  AGCCCTGTTG CGCGCCCGTG CCGCTTTGGA AAACCTGCAC ACCGGCAATG

1301  CCGACCAAGA CGCAGGCGTA CAAATCGTAT TGCGCGCCGT TGAGTCTCCG

1351  CTGCGCCAAA TCGTTGCCAA CGCAGGCGGA GAACCCAGCG TGGTGGTGAA

1401  CAAAGTGTTG GAAGGCAAAG GCAactacgG TTACAACGCa ggctcCGGCG

1451  AATACGgcga CATGATCGGA ATGGGCGTAC TCGACCCTGC CAAAGTAACC

1501  CGTTCCGCGC TGCAACACGC CGCGTCTAtC GCCGGTCTGA TGCTGACGAC

1551  CGACTGCATG ATTGCCGAAA TCCCTGAAGA AAAACCGGCT GTGCCCGATA

1601  TGGGGGGAAT GGGCGGTATG GGCGGCATGA TGTAA
```

This corresponds to the amino acid sequence <SEQ ID 2962; ORF 982.ng>:

```
g982.pep
  1 IASQNLRFDN RFLQKMVNGV NILPAADWVA LGAKGRNVVV DRAFGGPHIT

 51 KDGVTVAKEI ELKDKFENMG AQMVKEVASK TNDVAGDGTT TATVLAQSIV

101 AEGMKYVTAG MNPTDLKRGI DKAVAALVEE LKNIAKPCDT SKEIAQVGSI

151 SANSDEQVGA IIAEAMEKVG KEGVITVEDG KSLENELDVV EGMQFDRGYL

201 SPYFINDAEK QIAGLDNPFV LLFDKKISNI RDLLPVLEQV AKASRPLLII

251 AEDVEGEALA TLVVNNIRGI LKTVAVKAPG FGDRRKAMLQ DIAILTGGVV

301 ISEEVGLSLE KATLDDLGQT KRIEIGEENT TVIDGFGDAA QIEARVAEIR

351 QQIETATSDY DKEKLQERVA KLAGGVAVIK VGAATEVEMK EKKDRVEDAL

401 HATRAAVEEG VVAGGGVALL RARAALENLH TGNADQDAGV QIVLRAVESP

451 LRQIVANAGG EPSVVVNKVL EGKGNYGYNA GSGEYGDMIG MGVLDPAKVT

501 RSALQHAASI AGLMLTTDCM IAEIPEEKPA VPDMGGMGGM GGMM*
```

The following partial DNA sequence was identified in *N. meningitidis* <SEQ ID 2963>:

```
m982.seq
  1  ATGGCAGCAA AAGACGTACA GTTCGGCAAT GAAGTCCGTC AAAAAATGGT

 51  AAACGGCGTG AACATTCTGG CAAACGCCGT CCGCGTAACC TTGGGCCCCA

101  AAGGTCGCAA CGTAGTCGTT GACCGCGCAT TCGGCGGCCC GCACATCACC

151  AAAGACGGCG TAACCGTCGC CAAAGAAATC GAACTGAAAG ACAAGTTTGA

201  AAATATGGGC GCGCAAATGG TGAAAGAAGT TGCGTCCAAA ACCAACGACG

251  TGGCAGGCGA CGGTACGACT ACCGCCACCG TACTGGCGCA ATCCATCGTT

301  GCCGAAGGTA TGAAATATGT TACCGCAGGT ATGAATCCGA CCGACCTGAA

351  ACGCGGTATC GATAAAGCCG TCGCCGCTTT GGTTGACGAA CTGAAAAACA

401  TCGCCAAACC TTGCGACACT TCTAAAGAAA TCGCCCAAGT CGGCTCTATT

451  TCCGCCAACT CCGACGAACA AGTCGGCGCG ATTATCGCCG AAGCGATGGA

501  AAAAGTCGGC AAAGAAGGCG TGATTACCGT TGAAGACGGC AAGTCTTTGG

551  AAAACGAGCT GGACGTAGTT GAAGGTATGC AGTTCGACCG CGGCTACCTG

601  TCTCCTTACT TCATCAACGA TGCGGAAAAA CAAATCGCTG CTTTGGACAA
```

-continued

```
 651  TCCGTTTGTA TTGTTGTTCG ACAAAAAAAT CAGCAACATC CGCGACCTGC
 701  TGCCTGTTTT GGAACAAGTG GCAAAAGCCA GCCGTCCGCT GTTGATTATC
 751  GCTGAAGACG TAGAAGGCGA AGCCTTGGCG ACTTTGGTCG TGAACAACAT
 801  CCGAGGCATC CTGAAAACCG TTGCCGTCAA AGCCCCTGGC TTCGGCGACC
 851  GCCGCAAAGC GATGTTGCAA GACATCGCCA TCCTGACCGG CGGCGTGGTG
 901  ATTTCCGAAG AAGTCGGTCT GTCTTTGGAA AAAGCGACTT TGGACGACTT
 951  GGGTCAAGCC AAACGCATCG AAATCGGTAA AGAAAACACC ACCATCATCG
1001  ACGGCTTTGG CGACGCAGCC CAAATCGAAG CGCGTGTTGC CGAAATCCGC
1051  CAACAAATCG AAACCGCAAC CAGCGATTAC GACAAAGAAA AACTGCAAGA
1101  GCGCGTGGCT AAATTGGCAG GCGGCGTGGC AGTCATCAAA GTCGGTGCCG
1151  CGACCGAAGT CGAAATGAAA GAGAAAAAAG ACCGCGTGGA AGACGCGCTG
1201  CACGCTACCC GCGCAGCCGT TGAAGAAGGC GTGGTTGCAG GCGGCGGCGT
1251  AGCCCTGTTG CGTGCCCGTG CTGCTTTGGA AAACCTGCAC ACCGGCAATG
1301  CCGACCAAGA CGCAGGCGTA CAAATCGTCT TGCGCGCCGT TGAGTCTCCG
1351  CTGCGCCAAA TCGTTGCCAA CGCAGGCGGC GAACCCAGCG TGGTTGTGAA
1401  CAAAGTATTG GAAGGCAAAG GCAACTACGG TTACAACGCT GGCAGCGGCG
1451  AATACGGCGA TATGATCGAA ATGGGCGTAC TCGACCCCGC CAAAGTAACC
1501  CGTTCTGCGC TGCAACACGC CGCATCTATC GCCGGCTTGA TGCTGACCAC
1551  TGATTGCATG ATCGCTGAAA TCCCCGAAGA CAAACCGGCT GTGCCTGATA
1601  TGGGCGGCAT GGGTGGTATG GGCGGCATGA TGTAA
```

This corresponds to the amino acid sequence <SEQ ID 2964; ORF 982>:

```
m982.seq
   1  ATGGCAGCAA AAGACGTACA GTTCGGCAAT GAAGTCCGTC AAAAAATGGT
  51  AAACGGCGTG AACATTCTGG CAAACGCCGT CCGCGTAACC TTGGGCCCCA
 101  AAGGTCGCAA CGTAGTCGTT GACCGCGCAT TCGGCGGCCC GCACATCACC
 151  AAAGACGGCG TAACCGTCGC CAAAGAAATC GAACTGAAAG ACAAGTTTGA
 201  AAATATGGGC GCGCAAATGG TGAAAGAAGT TGCGTCCAAA ACCAACGACG
 251  TGGCAGGCGA CGGTACGACT ACCGCCACCG TACTGGCGCA ATCCATCGTT
 301  GCCGAAGGTA TGAAATATGT TACCGCAGGT ATGAATCCGA CCGACCTGAA
 351  ACGCGGTATC GATAAAGCCG TCGCCGCTTT GGTTGACGAA CTGAAAAACA
 401  TCGCCAAACC TTGCGACACT TCTAAAGAAA TCGCCCAAGT CGGCTCTATT
 451  TCCGCCAACT CCGACGAACA AGTCGGCGCG ATTATCGCCG AAGCGATGGA
 501  AAAAGTCGGC AAAGAAGGCG TGATTACCGT TGAAGACGGC AAGTCTTTGG
 551  AAAACGAGCT GGACGTAGTT GAAGGTATGC AGTTCGACCG CGGCTACCTG
 601  TCTCCTTACT TCATCAACGA TGCGGAAAAA CAAATCGCTG CTTTGGACAA
 651  TCCGTTTGTA TTGTTGTTCG ACAAAAAAAT CAGCAACATC CGCGACCTGC
 701  TGCCTGTTTT GGAACAAGTG GCAAAAGCCA GCCGTCCGCT GTTGATTATC
 751  GCTGAAGACG TAGAAGGCGA AGCCTTGGCG ACTTTGGTCG TGAACAACAT
 801  CCGAGGCATC CTGAAAACCG TTGCCGTCAA AGCCCCTGGC TTCGGCGACC
```

-continued

```
 851  GCCGCAAAGC GATGTTGCAA GACATCGCCA TCCTGACCGG CGGCGTGGTG

 901  ATTTCCGAAG AAGTCGGTCT GTCTTTGGAA AAAGCGACTT TGGACGACTT

 951  GGGTCAAGCC AAACGCATCG AAATCGGTAA AGAAAACACC ACCATCATCG

1001  ACGGCTTTGG CGACGCAGCC CAAATCGAAG CGCGTGTTGC CGAAATCCGC

1051  CAACAAATCG AAACCGCAAC CAGCGATTAC GACAAAGAAA AACTGCAAGA

1101  GCGCGTGGCT AAATTGGCAG GCGGCGTGGC AGTCATCAAA GTCGGTGCCG

1151  CGACCGAAGT CGAAATGAAA GAGAAAAAAG ACCGCGTGGA AGACGCGCTG

1201  CACGCTACCC GCGCAGCCGT TGAAGAAGGC GTGGTTGCAG GCGGCGGCGT

1251  AGCCCTGTTG CGTGCCCGTG CTGCTTTGGA AAACCTGCAC ACCGGCAATG

1301  CCGACCAAGA CGCAGGCGTA CAAATCGTCT TGCGCGCCGT TGAGTCTCCG

1351  CTGCGCCAAA TCGTTGCCAA CGCAGGCGGC GAACCCAGCG TGGTTGTGAA

1401  CAAAGTATTG GAAGGCAAAG GCAACTACGG TTACAACGCT GGCAGCGGCG

1451  AATACGGCGA TATGATCGAA ATGGGCGTAC TCGACCCCGC CAAAGTAACC

1501  CGTTCTGCGC TGCAACACGC CGCATCTATC GCCGGCTTGA TGCTGACCAC

1551  TGATTGCATG ATCGCTGAAA TCCCCGAAGA CAAACCGGCT GTGCCTGATA

1601  TGGGCGGCAT GGGTGGTATG GGCGGCATGA TGTAA
```

Computer analysis of this amino acid sequence gave the following results:

Homology with a Predicted ORF from *N. gonorrhoeae*

```
m982/g982 95.8% identity in 544 aa overlap

                   10        20        30        40        50        60
m982.pep   MAAKDVQFGNEVRQKMVNGVNILANAVRVTLGPKGRNVVVDRAFGGPHITKDGVTVAKEI
           :|:::::| |:  ||||||||||  |  |:|| |||||||||||||||||||||||||||
g982       IASQNLRFDNRFLQKMVNGVNILPAADWVALGAKGRNVVVDRAFGGPHITKDGVTVAKEI
                   10        20        30        40        50        60

                   70        80        90       100       110       120
m982.pep   ELKDKFENMGAQMVKEVASKTNDVAGDGTTTATVLAQSIVAEGMKYVTAGMNPTDLKRGI
           ||||||||||||||||||||||||||||||||||||||||||||||||||||||||||||
g982       ELKDKFENMGAQMVKEVASKTNDVAGDGTTTATVLAQSIVAEGMKYVTAGMNPTDLKRGI
                   70        80        90       100       110       120

                  130       140       150       160       170       180
m982.pep   DKAVAALVDELKNIAKPCDTSKEIAQVGSISANSDEQVGAIIAEAMEKVGKEGVITVEDG
           ||||||||:|||||||||||||||||||||||||||||||||||||||||||||||||||
g982       DKAVAALVEELKNIAKPCDTSKEIAQVGSISANSDEQVGAIIAEAMEKVGKEGVITVEDG
                  130       140       150       160       170       180

                  190       200       210       220       230       240
m982.pep   KSLENELDVVEGMQFDRGYLSPYFINDAEKQIAALDNPFVLLFDKKISNIRDLLPVLEQV
           |||||||||||||||||||||||||||||||||:||||||||||||||||||||||||||
g982       KSLENELDVVEGMQFDRGYLSPYFINDAEKQIAGLDNPFVLLFDKKISNIRDLLPVLEQV
                  190       200       210       220       230       240

                  250       260       270       280       290       300
m982.pep   AKASRPLLIIAEDVEGEALATLVVNNIRGILKTVAVKAPGFGDRRKAMLQDIAILTGGVV
           ||||||||||||||||||||||||||||||||||||||||||||||||||||||||||||
g982       AKASRPLLIIAEDVEGEALATLVVNNIRGILKTVAVKAPGFGDRRKAMLQDIAILTGGVV
                  250       260       270       280       290       300

                  310       320       330       340       350       360
m982.pep   ISEEVGLSLEKATLDDLGQAKRIEIGKENTTIIDGFGDAAQIEARVAEIRQQIETATSDY
           |||||||||||||||||||:||||||:||||:||||||||||||||||||||||||||||
g982       ISEEVGLSLEKATLDDLGQTKRIEIGEENTTVIDGFGDAAQIEARVAEIRQQIETATSDY
                  310       320       330       340       350       360

                  370       380       390       400       410       420
m982.pep   DKEKLQERVAKLAGGVAVIKVGAATEVEMKEKKDRVEDALHATRAAVEEGVVAGGGVALL
           ||||||||||||||||||||||||||||||||||||||||||||||||||||||||||||
g982       DKEKLQERVAKLAGGVAVIKVGAATEVEMKEKKDRVEDALHATRAAVEEGVVAGGGVALL
                  370       380       390       400       410       420

                  430       440       450       460       470       480
m982.pep   RARAALENLHTGNADQDAGVQIVLRAVESPLRQIVANAGGEPSVVVNKVLEGKGNYGYNA
           ||||||||||||||||||||||||||||||||||||||||||||||||||||||||||||
g982       RARAALENLHTGNADQDAGVQIVLRAVESPLRQIVANAGGEPSVVVNKVLEGKGNYGYNA
                  430       440       450       460       470       480
```

-continued

```
                   490        500        510        520        530        540
m982.pep   GSGEYGDMIEMGVLDPAKVTRSALQHAASIAGLMLTTDCMIAEIPEDKPAVPDMGGMGGM
           ||||||||| |||||||||||||||||||||||||||||||||||:||||||||||||||
g982       GSGEYGDMIGMGVLDPAKVTRSALQHAASIAGLMLTTDCMIAEIPEEKPAVPDMGGMGGM
                   490        500        510        520        530        540

m982.pep   GGMMX
           |||||
g982       GGMMX
```

The following partial DNA sequence was identified in *N. meningitidis* <SEQ ID 2965>:

```
a982.seq
     1  ATGGCAGCAA AAGACGTACA ATTCGGCAAT GAAGTCCGCC AAAAAATGGT
    51  AAACGGCGTG AACATTTTGG CAAACGCCGT GCGCGTAACC TTGGGTCCCA
   101  AAGGCCGCAA CGTGGTGGTT GACCGCGCTT TCGGCGGCCC GCACATCACC
   151  AAAGACGGCG TAACCGTCGC CAAAGAAATC GAACTGAAAG ACAAGTTTGA
   201  AAATATGGGC GCGCAAATGG TGAAAGAAGT CGCGTCCAAA ACCAACGACG
   251  TGGCGGGCGA CGGTACGACT ACCGCCACCG TATTGGCGCA ATCCATCGTT
   301  GCCGAAGGTA TGAAATACGT TACCGCCGGT ATGAACCCGA CCGACCTGAA
   351  ACGCGGTATC GACAAAGCCG TCGCCGCTTT GGTTGAAGAG CTGAAAAACA
   401  TCGCCAAACC TTGCGACACT TCTAAAGAAA TCGCCCAAGT CGGCTCTATT
   451  TCCGCCAACT CTGACGAACA AGTCGGCGCG ATTATTGCCG AAGCGATGGA
   501  AAAAGTCGGC AAAGAAGGCG TGATTACCGT TGAAGACGGC AAATCTTTGG
   551  AAAACGAGCT GGACGTGGTT GAAGGTATGC AATTCGACCG CGGCTACCTG
   601  TCTCCTTACT TCATCAACGA TGCGGAAAAA CAAATCGCCG GCTTGGACAA
   651  TCCGTTTGTA TTGCTGTTCG ACAAAAAAAT CAGCAATATC CGCGACCTGC
   701  TGCCTGTTTT GGAACAAGTG GCCAAAGCCA GCCGTCCGCT GTTGATTATC
   751  GCTGAAGACG TAGAAGGCGA AGCCTTGGCG ACTTTGGTCG TGAACAACAT
   801  CCGCGGCATT CTGAAAACCG TTGCCGTTAA AGCTCCGGGC TTCGGCGACC
   851  GCCGCAAAGC GATGCTGCAA GACATCGCTA TCCTGACCGG CGGCACAGTG
   901  ATTTCCGAAG AAGTCGGCCT GTCTTTGGAA AAAGCGACTT TGGACGACTT
   951  GGGTCAGGCC AAACGCATCG AAATCGGTAA AGAAAACACC ACCATCATCG
  1001  ACGGCTTCGG CGACGCAGCC CAAATCGAAG CGCGTGTTGC CGAAATCCGC
  1051  CAACAAATCG AAACCGCAAC CAGCGATTAC GACAAAGAAA AACTGCAAGA
  1101  GCGCGTTGCC AAACTGGCAG GCGGCGTGGC AGTAATCAAA GTCGGTGCCG
  1151  CGACCGAAGT GGAAATGAAA GAGAAAAAAG ACCGCGTGGA AGACGCGCTG
  1201  CACGCTACCC GCGCAGCCGT TGAAGAAGGC GTGGTTGCAG GCGGCGGCGT
  1251  AGCCCTGTTG CGCGCCCGTG CCGCTCTGGA AAACCTGCAC ACCGGCAATG
  1301  CAGACCAAGA CGCAGGCGTA CAAATCGTCT TGCGCGCCGT TGAGTCTCCG
  1351  CTGCGCCAAA TCGTTGCCAA CGCAGGCGGC GAACCCAGCG TGGTTGTGAA
  1401  CAAAGTGTTG GAAGGCAAAG GCAACTATGG TTACAACGCT GGCAGCGGCG
  1451  AATACGGCGA CATGATCGAA ATGGGCGTAC TCGACCCCGC CAAAGTAACC
  1501  CGTTCCGCGC TGCAACACGC CGCGTCTATC GCCGGCCTGA TGCTGACCAC
  1551  AGACTGCATG ATTGCTGAAA TCCCTGAAGA CAAACCGGCT ATGCCTGATA
```

-continued

```
1601  TGGGCGGCAT GGGTGGTATG GGCGGCATGA TGTAA
```

This corresponds to the amino acid sequence <SEQ ID 2966; ORF 982.a>:

```
a982.pep

      1  MAAKDVQFGN EVRQKMVNGV NILANAVRVT LGPKGRNVVV DRAFGGPHIT

     51  KDGVTVAKEI ELKDKFENMG AQMVKEVASK TNDVAGDGTT TATVLAQSIV

    101  AEGMKYVTAG MNPTDLKRGI DKAVAALVEE LKNIAKPCDT SKEIAQVGSI

    151  SANSDEQVGA IIAEAMEKVG KEGVITVEDG KSLENELDVV EGMQFDRGYL

    201  SPYFINDAEK QIAGLDNPFV LLFDKKISNI RDLLPVLEQV AKASRPLLII

    251  AEDVEGEALA TLVVNNIRGI LKTVAVKAPG FGDRRKAMLQ DIAILTGGTV

    301  ISEEVGLSLE KATLDDLGQA KRIEIGKENT TIIDGFGDAA QIEARVAEIR

    351  QQIETATSDY DKEKLQERVA KLAGGVAVIK VGAATEVEMK EKKDRVEDAL

    401  HATRAAVEEG VVAGGGVALL RARAALENLH TGNADQDAGV QIVLRAVESP

    451  LRQIVANAGG EPSVVVNKVL EGKGNYGYNA GSGEYGDMIE MGVLDPAKVT

    501  RSALQHAASI AGLMLTTDCM IAEIPEDKPA MPDMGGMGGM GGMM*

m982/a982 99.3% identity in 544 aa overlap

                   10        20        30        40        50        60
m982.pep  MAAKDVQFGNEVRQKMVNGVNILANAVRVTLGPKGRNVVVDRAFGGPHITKDGVTVAKEI
          ||||||||||||||||||||||||||||||||||||||||||||||||||||||||||||
a982      MAAKDVQFGNEVRQKMVNGVNILANAVRVTLGPKGRNVVVDRAFGGPHITKDGVTVAKEI
                   10        20        30        40        50        60

                   70        80        90       100       110       120
m982.pep  ELKDKFENMGAQMVKEVASKTNDVAGDGTTTATVLAQSIVAEGMKYVTAGMNPTDLKRGI
          ||||||||||||||||||||||||||||||||||||||||||||||||||||||||||||
a982      ELKDKFENMGAQMVKEVASKTNDVAGDGTTTATVLAQSIVAEGMKYVTAGMNPTDLKRGI
                   70        80        90       100       110       120

                  130       140       150       160       170       180
m982.pep  DKAVAALVDELKNIAKPCDTSKEIAQVGSISANSDEQVGAIIAEAMEKVGKEGVITVEDG
          ||||||||:|||||||||||||||||||||||||||||||||||||||||||||||||||
a982      DKAVAALVEELKNIAKPCDTSKEIAQVGSISANSDEQVGAIIAEAMEKVGKEGVITVEDG
                  130       140       150       160       170       180

                  190       200       210       220       230       240
m982.pep  KSLENELDVVEGMQFDRGYLSPYFINDAEKQIAALDNPFVLLFDKKISNIRDLLPVLEQV
          ||||||||||||||||||||||||||||||||||:|||||||||||||||||||||||||
a982      KSLENELDVVEGMQFDRGYLSPYFINDAEKQIAGLDNPFVLLFDKKISNIRDLLPVLEQV
                  190       200       210       220       230       240

                  250       260       270       280       290       300
m982.pep  AKASRPLLIIAEDVEGEALATLVVNNIRGILKTVAVKAPGFGDRRKAMLQDIAILTGGVV
          ||||||||||||||||||||||||||||||||||||||||||||||||||||||||||:|
a982      AKASRPLLIIAEDVEGEALATLVVNNIRGILKTVAVKAPGFGDRRKAMLQDIAILTGGTV
                  250       260       270       280       290       300

                  310       320       330       340       350       360
m982.pep  ISEEVGLSLEKATLDDLGQAKRIEIGKENTTIIDGFGDAAQIEARVAEIRQQIETATSDY
          ||||||||||||||||||||||||||||||||||||||||||||||||||||||||||||
a982      ISEEVGLSLEKATLDDLGQAKRIEIGKENTTIIDGFGDAAQIEARVAEIRQQIETATSDY
                  310       320       330       340       350       360

                  370       380       390       400       410       420
m982.pep  DKEKLQERVAKLAGGVAVIKVGAATEVEMKEKKDRVEDALHATRAAVEEGVVAGGGVALL
          ||||||||||||||||||||||||||||||||||||||||||||||||||||||||||||
a982      DKEKLQERVAKLAGGVAVIKVGAATEVEMKEKKDRVEDALHATRAAVEEGVVAGGGVALL
                  370       380       390       400       410       420

                  430       440       450       460       470       480
m982.pep  RARAALENLHTGNADQDAGVQIVLRAVESPLRQIVANAGGEPSVVVNKVLEGKGNYGYNA
          ||||||||||||||||||||||||||||||||||||||||||||||||||||||||||||
a982      RARAALENLHTGNADQDAGVQIVLRAVESPLRQIVANAGGEPSVVVNKVLEGKGNYGYNA
                  430       440       450       460       470       480

                  490       500       510       520       530       540
m982.pep  GSGEYGDMIEMGVLDPAKVTRSALQHAASIAGLMLTTDCMIAEIPEDKPAVPDMGGMGGM
          |||||||||||||||||||||||||||||||||||||||||||||||||||:||||||||
a982      GSGEYGDMIEMGVLDPAKVTRSALQHAASIAGLMLTTDCMIAEIPEDKPAMPDMGGMGGM
                  490       500       510       520       530       540

m982.pep  GGMMX
          |||||
a982      GGMMX
```

The following partial DNA sequence was identified in *N. gonorrhoeae* <SEQ ID 2967>:

```
g986.seq
     1 GTGTTCAAAA AATACCAATA CTTCGCTTTG GCGGCACTGT GTGCCGCCTT
    51 GCTGGCAGGC TGCGAAAAGG CAGGCAGCTT TTTCGGTGCG GACAAAAAAG
   101 AAGCATCCTT CGTAGAACGC ATCGAACACA CCAAAGACGA CGGCAGTGTC
   151 AGTATGCTGC TGCCCGACTT TGCCCAACTG GTTCAAAGCG AAGGCCCGGC
   201 AGTCGTCAAT ATTCAGGCAG CCCCCGCCCC GCGCACCCAA AACGGCAGCG
   251 GCAATGCCGA AACCGATTCC GACCCGCTTG CCGACAGCGA CCCGTTCTAC
   301 GAATTTTTCA AACGCCTCGT CCCGAACATG CCCGAAATCC CCCAAGAAGA
   351 AGCAGATGAC GGCGGATTGA ACTTCGGTTC GGGCTTCATC ATCAGCAAAA
   401 ACGGCTACAT CCTGACCAAT ACCCACGTCG TTGCCGGTAT GGGCAGTATC
   451 AAAGTCCTGC TCAACGACAA GCGCGAATAT ACCGCCAAAC TCATCGGTTC
   501 GGATGTCCAA TCCGATGTCG CCCTTCTGAA AATCGACGCA ACGGAAGAGC
   551 TACCCGTCGT CAAAATCGGC AATCCCAAAA ATTTGAAACC GGGCGAATGG
   601 GTCGCTGCCA TCGGCGCGCC CTTCGGCTTT GACAACAGCG TGACCGCCGG
   651 CATCGTGTCC GCCAAAGGCA GAAGCCTGCC CAACGAAAgc tACACACCCT
   701 TCATCCAAAC CGACGTTGCC ATCAATCCGG GCAATTCCGG CGGCCCGCTG
   751 TTCAACTTAA AAGGACAGGt cgTCGGCATC AATTCGCAAA TATACAGCCG
   801 CAGCGgcgga ttCATGGGCA TCTCCTTTGC CATCCCGATT GACGTTGCCA
   851 TGAATGTCGC CGAACAGCTG AAAAACACCG GCAAAGTCCA ACGCGGACAA
   901 CTGGGCGTGA TTATTCAGGA AGTATCCTAC GGTTTGGCAC AGTCGTTCGG
   951 TCTGGATAAA GCCAGCGGCG CATTGATTGC CAAAATCCTT CCCGGCAGCC
  1001 CCGCAGAACG TGCCGGCCTG CAGGCGGGCG ACATCGTCCT CAGCCTCGAC
  1051 GGCGGAGAAA TACGTTCTTC CGGCGACCTT CCCGTCATGG TCGGCGCCAT
  1101 TACGCCGGGA AAAGAAGTCA GCCTCGGCGT ATGGCGCAAA GGCGAAGAAA
  1151 TCACAATCAA AGCCAAGCTG GGCAACGCCg ccgagcATAC CGGCgcatCA
  1201 TCCAAAACAG ATGAAgcccc ctacaccgAA CAGCAATCCG GTACGTTCTC
  1251 GGTCGAATCC GCAGGCATTA CCCTTCAGAC ACATACCGAC AGCAGCGGca
  1301 aacacctcgt cgtcgtacgg gtttccgacg cggcagaacg cGCAGGCTTA
  1351 AGgcgcggcg acgaaatcct cgcggtcggg caagtccccg tcaatgacga
  1401 agccgGTTTC cgcaaaGCTA TGGACAAGGC AGGCAAAAAC GTCCCCCTGC
  1451 TGGTCAtgcg ccgTGGCAAC ACGCTGTTCA TCGCATTAAA CCTGCAATAA
```

This corresponds to the amino acid sequence <SEQ ID 2968; ORF 986.ng>:

```
g986.pep
    1 VFKKYQYFAL AALCAALLAG CEKAGSFFGA DKKEASFVER IEHTKDDGSV
   51 SMLLPDFAQL VQSEGPAVVN IQAAPAPRTQ NGSGNAETDS DPLADSDPFY
  101 EFFKRLVPNM PEIPQEEADD GGLNFGSGFI ISKNGYILTN THVVAGMGSI
  151 KVLLNDKREY TAKLIGSDVQ SDVALLKIDA TEELPVVKIG NPKNLKPGEW
  201 VAAIGAPFGF DNSVTAGIVS AKGRSLPNES YTPFIQTDVA INPGNSGGPL
```

-continued

```
251 FNLKGQVVGI NSQIYSRSGG FMGISFAIPI DVAMNVAEQL KNTGKVQRGQ

301 LGVIIQEVSY GLAQSFGLDK ASGALIAKIL PGSPAERAGL QAGDIVLSLD

351 GGEIRSSGDL PVMVGAITPG KEVSLGVWRK GEEITIKAKL GNAAEHTGAS

401 SKTDEAPYTE QQSGTFSVES AGITLQTHTD SSGKHLVVVR VSDAAERAGL

451 RRGDEILAVG QVPVNDEAGF RKAMDKAGKN VPLLVMRRGN TLFIALNLQ*
```

The following partial DNA sequence was identified in *N. meningitidis* <SEQ ID 2969>:

```
m986.seq
   1 GTGTTCAAAA AATACCAATA CCTCGCTTTG GCAGCACTGT GTGCAGCCTC

  51 GCTGGCAGGC TGCGACAAGG CAGGCAGCTT CTTCGTGGCG GACAAAAAAG

 101 AAGCATCCTT CGTAGAACGC ATCGAACACA CCAAAGACGA CGGCAGCGTC

 151 AGTATGCTGC TGCCCGACTT TGCCCAACTG GTTCAAAGTG AAGGTCCGGC

 201 AGTCGTCAAT ATTCAGGCAG CCCCCGCCCC GCGCACCCAA AACGGCAGCG

 251 GCAATGCCGA AAACGATTCC GACCCGATTG CCGACAACGA CCCGTTCTAC

 301 GAATTTTTCA AACGCCTCGT CCCGAATATG CCCGAAATCC CCCAAGAAGA

 351 AGCAGATGAC GGCGGATTGA ACTTCGGTTC GGGCTTCATC ATCAGCAAAG

 401 ACGGCTACAT CCTGACCAAT ACCCACGTCG TTACCGGCAT GGGCAGTATC

 451 AAAGTCCTGC TCAACGACAA GCGCGAATAT ACCGCCAAAC TCATCGGTTC

 501 GGATGTCCAA TCCGATGTCG CCCTTCTGAA AATCGACGCA ACGGAAGAGC

 551 TGCCCGTCGT CAAAATCGGC AATCCCAAAG ATTTGAAACC GGGCGAATGG

 601 GTCGCCGCCA TCGGCGCGCC CTTCGGCTTC GACAACAGCG TGACCGCCGG

 651 CATCGTGTCC GCCAAAGGCA GAAGCCTGCC CAACGAAAGC TACACACCCT

 701 TCATCCAAAC CGACGTTGCC ATCAATCCGG GCAACTCCGG CGGCCCGCTG

 751 TTCAACTTAA AAGGACAGGT CGTCGGCATC AACTCGCAAA TATACAGCCG

 801 CAGCGGCGGA TTCATGGGCA TTTCCTTCGC CATCCCGATT GACGTTGCCA

 851 TGAATGTCGC CGAACAGCTG AAAAACACCG GCAAAGTCCA ACGCGGACAA

 901 CTGGGCGTGA TTATTCAAGA AGTATCCTAC GGTTTGGCAC AATCGTTCGG

 951 TTTGGACAAA GCCGGCGGCG CACTGATTGC CAAAATCCTG CCCGGCAGCC

1001 CCGCAGAACG TGCCGGCCTG CAGGCGGGCG ACATCGTCCT CAGCCTCGAC

1051 GGCGGAGAAA TACGTTCTTC CGGCGACCTT CCCGTTATGG TCGGCGCCAT

1101 TACGCCGGGA AAAGAAGTCA GCCTCGGCGT ATGGCGCAAA GGCGAAGAAA

1151 TCACAATCAA AGTCAAGCTG GGCAACGCCG CCGAGCATAT CGGCGCATCA

1201 TCCAAAACAG ATGAAGCCCC CTACACCGAA CAGCAATCCG GTACGTTCTC

1251 GGTCGAATCC GCAGGCATTA CCCTTCAGAC ACATACCGAC AGCAGCGGCG

1301 GACACCTCGT CGTCGTACGG GTTTCCGACG CGGCAGAACG CGCAGGCTTG

1351 AGGCGCGGCG ACGAAATTCT TGCCGTCGGG CAAGTCCCCG TCAATGACGA

1401 AGCCGGTTTC CGCAAAGCTA TGGACAAGGC AGGCAAAAAC GTCCCCCTGC

1451 TGATCATGCG CCGTGGCAAC ACGCTGTTTA TCGCATTAAA CCTGCAATAA
```

This corresponds to the amino acid sequence <SEQ ID 2970; ORF 986>:

```
m986.pep..
   1 VFKKYQYLAL AALCAASLAG CDKAGSFFVA DKKEASFVER IEHTKDDGSV

  51 SMLLPDFAQL VQSEGPAVVN IQAAPAPRTQ NGSGNAENDS DPIADNDPFY

 101 EFFKRLVPNM PEIPQEEADD GGLNFGSGFI ISKDGYILTN THVVTGMGSI

 151 KVLLNDKREY TAKLIGSDVQ SDVALLKIDA TEELPVVKIG NPKDLKPGEW

 201 VAAIGAPFGF DNSVTAGIVS AKGRSLPNES YTPFIQTDVA INPGNSGGPL

 251 FNLKGQVVGI NSQIYSRSGG FMGISFAIPI DVAMNVAEQL KNTGKVQRGQ

 301 LGVIIQEVSY GLAQSFGLDK AGGALIAKIL PGSPAERAGL QAGDIVLSLD

 351 GGEIRSSGDL PVMVGAITPG KEVSLGVWRK GEEITIKVKL GNAAEHIGAS

 401 SKTDEAPYTE QQSGTFSVES AGITLQTHTD SSGGHLVVVR VSDAAERAGL

 451 RRGDEILAVG QVPVNDEAGF RKAMDKAGKN VPLLIMRRGN TLFIALNLQ*
```

Computer analysis of this amino acid sequence gave the following results:

Homology with a Predicted ORF from *N. gonorrhoeae*

```
m986/g986 97.0% identity in 499 aa overlap

                    10        20        30        40        50        60
m986.pep    VFKKYQYLALAALCAASLAGCDKAGSFFVADKKEASFVERIEHTKDDGSVSMLLPDFAQL
            |||||||:|||||||| ||||:|||||| |||||||||||||||||||||||||||||||
g986        VFKKYQYFALAALCAALLAGCEKAGSFFGADKKEASFVERIEHTKDDGSVSMLLPDFAQL
                    10        20        30        40        50        60

                    70        80        90       100       110       120
m986.pep    VQSEGPAVVNIQAAPAPRTQNGSGNAENDSDPIADNDPFYEFFKRLVPNMPEIPQEEADD
            |||||||||||||||||||||||||||:||||:||:||||||||||||||||||||||||
g986        VQSEGPAVVNIQAAPAPRTQNGSGNAETDSDPLADSDPFYEFFKRLVPNMPEIPQEEADD
                    70        80        90       100       110       120

                   130       140       150       160       170       180
m986.pep    GGLNFGSGFIISKDGYILTNTHVVTGMGSIKVLLNDKREYTAKLIGSDVQSDVALLKIDA
            |||||||||||||:||||||||||:|||||||||||||||||||||||||||||||||||
g986        GGLNFGSGFIISKNGYILTNTHVVAGMGSIKVLLNDKREYTAKLIGSDVQSDVALLKIDA
                   130       140       150       160       170       180

                   190       200       210       220       230       240
m986.pep    TEELPVVKIGNPKDLKPGEWVAAIGAPFGFDNSVTAGIVSAKGRSLPNESYTPFIQTDVA
            |||||||||||||:||||||||||||||||||||||||||||||||||||||||||||||
g986        TEELPVVKIGNPKNLKPGEWVAAIGAPFGFDNSVTAGIVSAKGRSLPNESYTPFIQTDVA
                   190       200       210       220       230       240

                   250       260       270       280       290       300
m986.pep    INPGNSGGPLFNLKGQVVGINSQIYSRSGGFMGISFAIPIDVAMNVAEQLKNTGKVQRGQ
            ||||||||||||||||||||||||||||||||||||||||||||||||||||||||||||
g986        INPGNSGGPLFNLKGQVVGINSQIYSRSGGFMGISFAIPIDVAMNVAEQLKNTGKVQRGQ
                   250       260       270       280       290       300

                   310       320       330       340       350       360
m986.pep    LGVIIQEVSYGLAQSFGLDKAGGALIAKILPGSPAERAGLQAGDIVLSLDGGEIRSSGDL
            |||||||||||||||||||||:||||||||||||||||||||||||||||||||||||||
g986        LGVIIQEVSYGLAQSFGLDKASGALIAKILPGSPAERAGLQAGDIVLSLDGGEIRSSGDL
                   310       320       330       340       350       360

                   370       380       390       400       410       420
m986.pep    PVMVGAITPGKEVSLGVWRKGEEITIKVKLGNAAEHIGASSKTDEAPYTEQQSGTFSVES
            |||||||||||||||||||||||||||:|||||||| |||||||||||||||||||||||
g986        PVMVGAITPGKEVSLGVWRKGEEITIKAKLGNAAEHTGASSKTDEAPYTEQQSGTFSVES
                   370       380       390       400       410       420

                   430       440       450       460       470       480
m986.pep    AGITLQTHTDSSGGHLVVVRVSDAAERAGLRRGDEILAVGQVPVNDEAGFRKAMDKAGKN
            ||||||||||||| ||||||||||||||||||||||||||||||||||||||||||||||
g986        AGITLQTHTDSSGKHLVVVRVSDAAERAGLRRGDEILAVGQVPVNDEAGFRKAMDKAGKN
                   430       440       450       460       470       480

                   490       500
m986.pep    VPLLIMRRGNTLFIALNLQX
            ||||:|||||||||||||||
g986        VPLLVMRRGNTLFIALNLQX
                   490       500
```

The following partial DNA sequence was identified in *N. meningitidis* <SEQ ID 2971>:

a986.seq

```
   1 GTGTTCAAAA AATACCAATA CCTCGCTTTG GCAGCACTGT GTGCCGCCTC
  51 GCTGGCAGGC TGCGACAAAG CCGGCAGCTT TTTCGGTGCG GACAAAAAAG
 101 AAGCATCCTT TGTAGAACGC ATCAAACACA CCAAAGACGA CGGCAGCGTC
 151 AGTATGCTGC TGCCCGACTT TGTCCAACTG GTTCAAAGCG AAGGCCCGGC
 201 AGTCGTCAAT ATTCAGGCAG CCCCCGCCCC GCGCACCCAA AACGGCAGCA
 251 GCAATGCCGA AACCGATTCC GACCCGCTTG CCGACAGCGA CCCGTTCTAC
 301 GAATTTTTCA AACGCCTCGT CCCGAACATG CCCGAAATCC CCCAAGAAGA
 351 AGCAGATGAC GGNGGATTGA ACTTCGGTTC GGGCTTCATC ATCAGCAAAG
 401 ACGGCTATAT TCTGACCAAT ACGCACGTCG TTACCGGCAT GGGCAGTATC
 451 AAAGTCCTGC TCAACGACAA GCGCGAATAT ACCGCCAAAC TCATCGGTTC
 501 GGATGTCCAA TCCGATGTCG CCCTTCTGAA AATCGACGCA ACGGAAGAGC
 551 TGCCCGTCGT CAAAATCGGC AATCCCAAAG ATTTGAAACC GGGCGAATGG
 601 GTCGCCGCCA TCGGCGCGCC CTTCGGCTTC GACAACAGCG TGACCGCCGG
 651 CNTCGTGTCC GCCAAAGGCA GAAGCCTGCC CAACGAAAGC TACACACCCT
 701 TCATCCAAAC CGACGTTGCC ATCAATCCGG GCAACTCCGG CGGCCCGCTG
 751 TTCAACTTAA AAGGACAGGT CGTCGGCATC AACTCGCAAA TATACAGCCG
 801 CAGCGGCGGA TTCATGGGCA TTTCCTTCGC CATCCCGATT GACGTTGCCA
 851 TGAATGTCGC CGAACAGCTG AAAAACACCG GCAAAGTCCA ACGCGGACAA
 901 CTGGGCGTGA TTATTCAAGA AGTATCCTAC GGTTTGGCAC AATCGTTCGG
 951 TTTGGACAAA GCCGGCGGCG CACTGATTGC CAAAATCCTG CCCGGCAGCC
1001 CCGCAGAACG TGCCGGCCTG CGGGCGGGCG ACATCGTCCT CAGCCTCGAC
1051 GGCGGAGAAA TACGTTCTTC CGGCGACCTT CCCGTTATGG TCGGCGCCAT
1101 TACGCCGGGA AAAGAAGTCA GCCTCGGCGT ATGGCGCAAA GGCGAAGAAA
1151 TCACAATCAA AGTCAAGCTG GGCAACGCCG CCGAGCATAT CGGCGCATCA
1201 TCCAAAACAG ATGAAGCCCC CTACACCGAA CAGCAATCCG GTACGTTCTC
1251 GGTCGAATCC GCAGGCATTA CCCTTCAGAC ACATACCGAC AGCAGCGGCG
1301 GACACCTCGT CGTCGTACGG GTTTCCGACG CGGCAGAACG CGCAGGCTTG
1351 AGGCGCGGCG ACGAAATTCT TGCCGTCGGG CAAGTCCCCG TCAATGACGA
1401 AGCCGGTTTC CGCAAAGCTA TGGACAAGGC AGGCAAAAAC GTCCCCCTGC
1451 TGATCATGCG CCGTGGCAAC ACGCTGTTTA TCGCATTAAA CCTGCAATAA
```

This corresponds to the amino acid sequence <SEQ ID 2972; ORF 986.a>:

a986.pep

```
   1 VFKKYQYLAL AALCAASLAG CDKAGSFFGA DKKEASFVER IKHTKDDGSV
  51 SMLLPDFVQL VQSEGPAVVN IQAAPAPRTQ NGSSNAETDS DPLADSDPFY
 101 EFFKRLVPNM PEIPQEEADD GGLNFGSGFI ISKDGYILTN THVVTGMGSI
 151 KVLLNDKREY TAKLIGSDVQ SDVALLKIDA TEELPVVKIG NPKDLKPGEW
 201 VAAIGAPFGF DNSVTAGXVS AKGRSLPNES YTPFIQTDVA INPGNSGGPL
 251 FNLKGQVVGI NSQIYSRSGG FMGISFAIPI DVAMNVAEQL KNTGKVQRGQ
 301 LGVIIQEVSY GLAQSFGLDK AGGALIAKIL PGSPAERAGL RAGDIVLSLD
```

-continued

```
351 GGEIRSSGDL PVMVGAITPG KEVSLGVWRK GEEITIKVKL GNAAEHIGAS

401 SKTDEAPYTE QQSGTFSVES AGITLQTHTD SSGGHLVVVR VSDAAERAGL

451 RRGDEILAVG QVPVNDEAGF RKAMDKAGKN VPLLIMRRGN TLFIALNLQ*
```

```
m986/a986  98.2% identity in 499 aa overlap

                   10        20        30        40        50        60
m986.pep    VFKKYQYLALAALCAASLAGCDKAGSFFVADKKEASFVERIEHTKDDGSVSMLLPDFAQL
            |||||||||||||||||||||||||||| ||||||||||||:|||||||||||||||:||
a986        VFKKYQYLALAALCAASLAGCDKAGSFFGADKKEASFVERIKHTKDDGSVSMLLPDFVQL
                   10        20        30        40        50        60

                   70        80        90       100       110       120
m986.pep    VQSEGPAVVNIQAAPAPRTQNGSGNAENDSDPIADNDPFYEFFKRLVPNMPEIPQEEADD
            ||||||||||||||||||||||:|||:||||:||:|||||||||||||||||||||||||
a986        VQSEGPAVVNIQAAPAPRTQNGSSNAETDSDPLADSDPFYEFFKRLVPNMPEIPQEEADD
                   70        80        90       100       110       120

                  130       140       150       160       170       180
m986.pep    GGLNFGSGFIISKDGYILTNTHVVTGMGSIKVLLNDKREYTAKLIGSDVQSDVALLKIDA
            ||||||||||||||||||||||||||||||||||||||||||||||||||||||||||||
a986        GGLNFGSGFIISKDGYILTNTHVVTGMGSIKVLLNDKREYTAKLIGSDVQSDVALLKIDA
                  130       140       150       160       170       180

                  190       200       210       220       230       240
m986.pep    TEELPVVKIGNPKDLKPGEWVAAIGAPFGFDNSVTAGIVSAKGRSLPNESYTPFIQTDVA
            ||||||||||||||||||||||||||||||||||||| ||||||||||||||||||||||
a986        TEELPVVKIGNPKDLKPGEWVAAIGAPFGFDNSVTAGXVSAKGRSLPNESYTPFIQTDVA
                  190       200       210       220       230       240

                  250       260       270       280       290       300
m986.pep    INPGNSGGPLFNLKGQVVGINSQIYSRSGGFMGISFAIPIDVAMNVAEQLKNTGKVQRGQ
            ||||||||||||||||||||||||||||||||||||||||||||||||||||||||||||
a986        INPGNSGGPLFNLKGQVVGINSQIYSRSGGFMGISFAIPIDVAMNVAEQLKNTGKVQRGQ
                  250       260       270       280       290       300

                  310       320       330       340       350       360
m986.pep    LGVIIQEVSYGLAQSFGLDKAGGALIAKILPGSPAERAGLQAGDIVLSLDGGEIRSSGDL
            ||||||||||||||||||||||||||||||||||||||||:|||||||||||||||||||
a986        LGVIIQEVSYGLAQSFGLDKAGGALIAKILPGSPAERAGLRAGDIVLSLDGGEIRSSGDL
                  310       320       330       340       350       360

                  370       380       390       400       410       420
m986.pep    PVMVGAITPGKEVSLGVWRKGEEITIKVKLGNAAEHIGASSKTDEAPYTEQQSGTFSVES
            ||||||||||||||||||||||||||||||||||||||||||||||||||||||||||||
a986        PVMVGAITPGKEVSLGVWRKGEEITIKVKLGNAAEHIGASSKTDEAPYTEQQSGTFSVES
                  370       380       390       400       410       420

                  430       440       450       460       470       480
m986.pep    AGITLQTHTDSSGGHLVVVRVSDAAERAGLRRGDEILAVGQVPVNDEAGFRKAMDKAGKN
            ||||||||||||||||||||||||||||||||||||||||||||||||||||||||||||
a986        AGITLQTHTDSSGGHLVVVRVSDAAERAGLRRGDEILAVGQVPVNDEAGFRKAMDKAGKN
                  430       440       450       460       470       480

                  490       500
m986.pep    VPLLIMRRGNTLFIALNLQX
            ||||||||||||||||||||
a986        VPLLIMRRGNTLFIALNLQX
                  490       500
```

The following partial DNA sequence was identified in *N. gonorrhoeae* <SEQ ID 2973>:

```
g987.seq
  1  ATGAAAACAC GCAGCCTCAT TTCCCTTTTA TGCCTCCTTC TCTGTTCATG

 51  TTCTTCATGG TTGCCCCCAC TGGAAGAACG GACGGAAAGC CGTCATTTTA

101  ATACTTCCAA ACCTGTCCTC CTGGACAACA TCCTGCAAAT CCGGCACACC

151  CCTCATAACA ACGGGCTATC CGACATCTAC CTGCTCGACG ACCCCCACGA

201  AGCCTTTGCC GCCCGCGCCG CCCTTATCGA ATCTGCCGAA CACAGCCTCG

251  ATTTGCAATA CTACATTTGG CGCAACGaCA TTTCCGGCAG GCTGCTGTTC

301  AACCTCATGT ACCTTGCCGC agaacgcGGC GTGCGCGTAC GCCTGCTGTt

351  ggacgacaAC AACAcgcgcg gcttggacga tctcctGCTC GCCCTCGACA

401  GCCATCCCAA TAtctaagtG CGCCTGTTCA ACCCCTtcgt CCTACGCAAA

451  TGGCGCGCAC TCGGCTACCT GACCGACTTC CCCCGCCTCA ACCGCCGCAT
```

-continued

```
 501 GCACAACAAA TCCTTTACCG CCGACAACCG CGCCACCATA CTCGGCGGAC
 551 GCAATATCGG CGACGAATAC TTCAAAGTCG GTGAGGACAC CGTTTTCGCC
 601 GACCTGGACA TCCTCGCCAC CGGCAGCGTC GTCGGCGAAG TATCGCACGA
 651 CTTCGACCGC TACTGGGCAA GCCATTCCGC CCACAACGCC ACGCGCATCA
 701 TCCGCAGCGG CAACATCGGC AAGGGTCTTC AAGCACTCGG ATACAACGAC
 751 GAAACATCCA GACACGCGCT CCTGCGCTAC CGCGAAACCG TCGAACAGTC
 801 GCCCCTCTAC CAAAAAATAC AGACGGGACG CATCGACTGG CAGAGCGTCC
 851 AAACCCGCCT GATCAGCGAC AGCCCTGCAA AAGGACTCGA CCGCGACCGC
 901 CGCAAACCGC CGATTGCCGG GAGGCTGCAA GACGCGCTCA AACAGCCCGA
 951 AAAAAGCGTC TATCTGGTTT CACCCTATTT CGTCCCTACA AAATCCGGCA
1001 CAGACGCACT GGCAAAACTG GTGCAGGACG GCATAGACGT TACCGTCCTG
1051 ACCAACTCGC TACAGGCGAC CGACGTTGCC GCCGTCCATT CCGGCTACGT
1101 CAAATACCGA AAACCGCTGC TCAAAGCCGG CATCAAACTC TACGAGCTGC
1151 AACCCAACCA TGCCGTCCCC GCCACAAAAG ACAAAGGCCT GACCGGCAGC
1201 TCCGTAACCA GCCTGCATGC CAAAACCTTC ATTGTGGacg gCAAACGCAT
1251 CTTCATCGGC TCATTCAACC TCGACCCCCG TTCCGCACGG CTCAATACCG
1301 AAATGGGCGT CGTCATCGAA AGCCCCAAAA TCGCAGAACA GATGGAGCGC
1351 AccctCGCCG AtacCACACC CGAATACGCC TACCGCGTTA CCCTCGACAA
1401 ACACAACCGC CTGCAATGGC ACGATCCCGC CACCCGAAAA ACCTACCCGA
1451 ACGAACCCGA AGCCAAACTT TGGAAACGCA TCGCCGCAAA AATCCTATCC
1501 CTGCTGCCCA TCGAAGGTTT ATTATAG
```

This corresponds to the amino acid sequence <SEQ ID 2974; ORF 987.ng>:

```
g987.pep
  1 MKTRSLISLL CLLLCSCSSW LPPLEERTES RHFNTSKPVL LDNILQIRHT
 51 PHNNGLSDIY LLDDPHEAFA ARAALIESAE HSLDLQYYIW RNDISGRLLF
101 NLMYLAAERG VRVRLLLDDN NTRGLDDLLL ALDSHPNI*V RLFNPFVLRK
151 WRALGYLTDF PRLNRRMHNK SFTADNRATI LGGRNIGDEY FKVGEDTVFA
201 DLDILATGSV VGEVSHDFDR YWASHSAHNA TRIIRSGNIG KGLQALGYND
251 ETSRHALLRY RETVEQSPLY QKIQTGRIDW QSVQTRLISD SPAKGLDRDR
301 RKPPIAGRLQ DALKQPEKSV YLVSPYFVPT KSGTDALAKL VQDGIDVTVL
351 TNSLQATDVA AVHSGYVKYR KPLLKAGIKL YELQPNHAVP ATKDKGLTGS
401 SVTSLHAKTF IVDGKRIFIG SFNLDPRSAR LNTEMGVVIE SPKIAEQMER
451 TLADTTPEYA YRVTLDKHNR LQWHDPATRK TYPNEPEAKL WKRIAAKILS
501 LLPIEGLL*
```

The following partial DNA sequence was identified in *N. meningitidis* <SEQ ID 2975>:

```
m987.seq
  1  ATGAAAACAC GCAGCCTAAT TTCCCTTTTA TGCCTCCTTC TCTGTTCATG
 51  TTCTTCATGG TTGCCCCCAC TGGAAGAACG GACGGAAAGC CGTCATTTCA
```

-continued

```
 101  ATACTTCCAA ACCCGTCCGC CTGGACAACA TCCTGCAAAT CCGGCACACC
 151  CCTCATACCA ACGGGCTATC CGATATCTAT CTGTTGAACG ACCCCCACGA
 201  AGCCTTTGCC GCCCGCGCCG CCCTTATCGA ATCTGCCGAA CACAGCCTCG
 251  ATTTGCAATA CTACATCTGG CGCAACGACA TTTCCGGCAG GCTGCTGTTC
 301  AACCTCGTGT ACCTTGCCGC AGAACGCGGT GTGCGCGTAC GCCTGCTGTT
 351  GGACGACAAC AACACGCGCG GATTGGACGA CCTCCTGCTT GCCCTCGACA
 401  GCCATCCCAA TATCGAAGTG CGCCTGTTCA ACCCCTTCGT CTTACGAAAA
 451  TGGCGCGCAC TCGGCTACCT GACCGACTTC CCCCGCCTCA ACCGCCGCAT
 501  GCACAACAAA TCCTTTACCG CCGACAACCG CGCCACCATA CTCGGCGGAC
 551  GCAATATCGG CGACGAATAC TTCAAAGTCG GTGAGGACAC CGTTTTCGCC
 601  GATTTGGACA TCCTCGCCAC CGGCAGCGTC GTCGGCGAAG TATCGCACGA
 651  CTTCGACCGC TACTGGGCAA GCCATTCCGC CCACAACGCC ACGCGCATCA
 701  TCCGCAGCGG CGACATCGGC AAGGGTCTTC AAGCACTCGG ATACAACGAC
 751  GAAACGTCCA GACACGCGCT CCTGCGCTAC CGCGAAACCG TCGAACAGTC
 801  GCCCCTCTAC CAAAAAATAC AGACAGGATG CATCGACTGG CAGAGCGTCC
 851  GAACCCGCCT CATCAGCGAC GACCCTGCAA AAGGACTCGA CCGCGACCGC
 901  CGCAAACCGC CGATTGCCGG GCGGCTGCAA GACGCGCTCA AACAGCCCGA
 951  AAAAAGCGTC TATCTGGTTT CACCCTATTT CGTTCCCACA AAATCCGGCA
1001  CAGACGCACT GGCAAAACTG GTGCAGGACG GCATAGACGT TACCGTTCTG
1051  ACCAACTCGC TGCAGGCGAC CGACGTTGCC GCCGTCCATT CCGGCTATGT
1101  CAAATACCGA AAACCGCTGC TCAAAGCCGG CATCAAACTC TACGAGCTGC
1151  AACCCAACCA TGCCGTCCCC GCCACAAAAG ACAAAGGCCT GACCGGCAGC
1201  TCCGTAACCA GCCTGCACGC CAAAACCTTC ATTGTGGACG GCAAACGCAT
1251  CTTCATCGGT TCGTTCAACC TCGACCCCCG TTCCGCGCGT CTCAACACCG
1301  AAATGGGCGT TGTTATCGAA AGCCCCAAAA TCGCAGAACA GATGGAGCGC
1351  ACCCTTGCCG ATACCACACC CGCCTACGCC TACCGCGTTA CCCTCGACAG
1401  GCACAACCGC CTGCAATGGC ACGATCCCGC CACCCGAAAA ACCTACCCGA
1451  ACGAACCCGA AGCCAAACTT TGGAAACGCA TCGCCGCAAA AATCCTATCC
1501  CTGCTGCCCA TAGAAGGTTT ATTATAG
```

This corresponds to the amino acid sequence <SEQ ID 2976; ORF 987>:

```
m987.pep
  1 MKTRSLISLL CLLLCSCSSW LPPLEERTES RHFNTSKPVR LDNILQIRHT
 51 PHTNGLSDIY LLNDPHEAFA ARAALIESAE HSLDLQYYIW RNDISGRLLF
101 NLVYLAAERG VRVRLLLDDN NTRGLDDLLL ALDSHPNIEV RLFNPFVLRK
151 WRALGYLTDF PRLNRRMHNK SFTADNRATI LGGRNIGDEY FKVGEDTVFA
201 DLDILATGSV VGEVSHDFDR YWASHSAHNA TRIIRSGDIG KGLQALGYND
251 ETSRHALLRY RETVEQSPLY QKIQTGCIDW QSVRTRLISD DPAKGLDRDR
301 RKPPIAGRLQ DALKQPEKSV YLVSPYFVPT KSGTDALAKL VQDGIDVTVL
351 TNSLQATDVA AVHSGYVKYR KPLLKAGIKL YELQPNHAVP ATKDKGLTGS
```

-continued

```
401 SVTSLHAKTF IVDGKRIFIG SFNLDPRSAR LNTEMGVVIE SPKIAEQMER

451 TLADTTPAYA YRVTLDRHNR LQWHDPATRK TYPNEPEAKL WKRIAAKILS

501 LLPIEGLL*
```

Computer analysis of this amino acid sequence gave the following results:

Homology with a Predicted ORF from *N. gonorrhoeae*

```
m987/g987  97.8% identity in 508 aa overlap

                   10        20        30        40        50        60
m987.pep   MKTRSLISLLCLLLCSCSSWLPPLEERTESRHFNTSKPVRLDNILQIRHTPHTNGLSDIY
           ||||||||||||||||||||||||||||||||||||||| ||||||||||||:|||||||
g987       MKTRSLISLLCLLLCSCSSWLPPLEERTESRHFNTSKPVLLDNILQIRHTPHNNGLSDIY
                   10        20        30        40        50        60

                   70        80        90       100       110       120
m987.pep   LLNDPHEAFAARAALIESAEHSLDLQYYIWRNDISGRLLFNLVYLAAERGVRVRLLLDDN
           ||:|||||||||||||||||||||||||||||||||||||||:|||||||||||||||||
g987       LLDDPHEAFAARAALIESAEHSLDLQYYIWRNDISGRLLFNLMYLAAERGVRVRLLLDDN
                   70        80        90       100       110       120

                  130       140       150       160       170       180
m987.pep   NTRGLDDLLLALDSHPNIEVRLFNPFVLRKWRALGYLTDFPRLNRRMHNKSFTADNRATI
           ||||||||||||||||||||||||||||||||||||||||||||||||||||||||||||
g987       NTRGLDDLLLALDSHPNIXVRLFNPFVLRKWRALGYLTDFPRLNRRMHNKSFTADNRATI
                  130       140       150       160       170       180

                  190       200       210       220       230       240
m987.pep   LGGRNIGDEYFKVGEDTVFADLDILATGSVVGEVSHDFDRYWASHSAHNATRIIRSGDIG
           |||||||||||||||||||||||||||||||||||||||||||||||||||||||||:||
g987       LGGRNIGDEYFKVGEDTVFADLDILATGSVVGEVSHDFDRYWASHSAHNATRIIRSGNIG
                  190       200       210       220       230       240

                  250       260       270       280       290       300
m987.pep   KGLQALGYNDETSRHALLRYRETVEQSPLYQKIQTGCIDWQSVRTRLISDDPAKGLDRDR
           |||||||||||||||||||||||||||||||||||| ||||||:||||||:|||||||||
g987       KGLQALGYNDETSRHALLRYRETVEQSPLYQKIQTGRIDWQSVQTRLISDSPAKGLDRDR
                  250       260       270       280       290       300

                  310       320       330       340       350       360
m987.pep   RKPPIAGRLQDALKQPEKSVYLVSPYFVPTKSGTDALAKLVQDGIDVTVLTNSLQATDVA
           ||||||||||||||||||||||||||||||||||||||||||||||||||||||||||||
g987       RKPPIAGRLQDALKQPEKSVYLVSPYFVPTKSGTDALAKLVQDGIDVTVLTNSLQATDVA
                  310       320       330       340       350       360

                  370       380       390       400       410       420
m987.pep   AVHSGYVKYRKPLLKAGIKLYELQPNHAVPATKDKGLTGSSVTSLHAKTFIVDGKRIFIG
           ||||||||||||||||||||||||||||||||||||||||||||||||||||||||||||
g987       AVHSGYVKYRKPLLKAGIKLYELQPNHAVPATKDKGLTGSSVTSLHAKTFIVDGKRIFIG
                  370       380       390       400       410       420

                  430       440       450       460       470       480
m987.pep   SFNLDPRSARLNTEMGVVIESPKIAEQMERTLADTTPAYAYRVTLDRHNRLQWHDPATRK
           ||||||||||||||||||||||||||||||||||||| ||||||||:|||||||||||||
g987       SFNLDPRSARLNTEMGVVIESPKIAEQMERTLADTTPEYAYRVTLDKHNRLQWHDPATRK
                  430       440       450       460       470       480

                  490       500      509
m987.pep   TYPNEPEAKLWKRIAAKILSLLPIEGLLX
           ||||||||||||||||||||||||||||
g987       TYPNEPEAKLWKRIAAKILSLLPIEGLLX
                  490       500
```

The following partial DNA sequence was identified in *N. meningitidis* <SEQ ID 2977>:

```
a987.seq
  1  ATGAAAACAC GCAGCCTAAT TTCCCTTTTA TGCCTCCTTC TCTGTTCATG

 51  TTCTTCATGG TTGCCCCCAC TGGAAGAACG GACGGAAAGC CGTCATTTCA

101  ATACTTCCAA ACCCGTCCGC CTGGACAACA TCCTGCAAAT CCGGCACACC

151  CCTCATACCA ACGGGCTATC CGATATCTAT CTGTTGAACG ACCCCCACGA

201  AGCCTTTGCC GCCCGCGCCG CCCTTATCGA ATCTGCCGAA CACAGCCTCG

251  ATTTGCAATA CTACATCTGG CGCAACGACA TTTCCGGCCG ACTGCTGTTC
```

-continued

```
301 AACCTCGTGT ACCTTGCCGC AGAACGCGGT GTGCGCGTAC GCCTGCTGTT
351 GGACGACAAC AACACGCGCG GATTGGACGA CCTCCTGCTC GACCTGGACA
401 GCCATCCCAA TATCGAAGTG CGCCTGTTCA ACCCCTTCGT CTTACGAAAA
451 TGGCGCGCAC TCGGCTACCT GACCGACTTC CCCCGCCTCA ACCGCCGCAT
501 GCACAACAAA TCCTTTACCG CCGACAACCG CGCCACCATA CTCGGCGGAC
551 GCAATATCGG CGACGAATAC TTCAAAGTCG GTGAGGACAC CGTTTTCGCC
601 GACCTGGACA TCCTCGCCAC CGGCAGCGTC GTCGGCGAAG TATCGCACGA
651 CTTCGACCGC TACTGGGCAA GCCATTCCGC CCACAACGCC ACGCGCATCA
701 TCCGCAGCGG CAACATCGGC AAGGGTCTTC AAGCACTCGG ATACAACGAC
751 GAAACGTCCA GACACGCGCT CCTGCGCTAC CGCGAAACCG TCGAACAGTC
801 GCCCCTCTAC CAAAAAATAC AGACAGGACG CATCGACTGG CAGAGCGTCC
851 AAACCCGCCT CATCAGCGAC GACCCTGCAA AAGGACTCGA CCGCGACCGC
901 CGCAAACCGC CGATTGCCGG GCGGCTGCAA GACGCGCTCA AACAGCCCGA
951 AAAAAGCGTC TATCTGGTTT CACCCTATTT CGTCCCCACA AAATCCGGCA
1001 CAGACGCACT GGCAAAACTG GTGCAGGACG GCATAGACGT TACCGTCCTG
1051 ACCAACTCGC TACAGGCGAC CGACGTTGCC GCCGTCCATT CCGGCTATGT
1101 CAAATACCGA AAACCGCTGC TCAAAGCCGG CATCAAACTC TACGAGCTGC
1151 AACCCAACCA TGCCGTCCCT GCCACAAAAG ACAAAGGCCT GACCGGCAGC
1201 TCCGTAACCA GCCTGCATGC CAAAACCTTC ATTGTGGACG GCAAACGCAT
1251 CTTCATCGGC TCATTCAACC TCGACCCCCG TTCCGCACGG CTCAATACTG
1301 AAATGGGCGT TGTTATCGAA AGCCCCAAAA TCGCAGAACA GATGGAGCGC
1351 ACCCTTGCCG ATACCTCACC CGAATACGCC TACCGCGTTA CCCTCGACAG
1401 GCACAACCGC CTGCAATGGC ACGATCCCGC CACCCGAAAA ACCTACCCGA
1451 ACGAACCCGA AGCCAAACTT TGGAAACGCA TCGCCGCAAA AATCCTATCC
1501 CTGCTGCCCA TAGAAAGTTT ATTATAG
```

This corresponds to the amino acid sequence <SEQ ID 550; ORF 2978.a>:

```
a987.pep

  1 MKTRSLISLL CLLLCSCSSW LPPLEERTES RHFNTSKPVR LDNILQIRHT
 51 PHTNGLSDIY LLNDPHEAFA ARAALIESAE HSLDLQYYIW RNDISGRLLF
101 NLVYLAAERG VRVRLLLDDN NTRGLDDLLL ALDSHPNIEV RLFNPFVLRK
151 WRALGYLTDF PRLNRRMHNK SFTADNRATI LGGRNIGDEY FKVGEDTVFA
201 DLDILATGSV VGEVSHDFDR YWASHSAHNA TRIIRSGNIG KGLQALGYND
251 ETSRHALLRY RETVEQSPLY QKIQTGRIDW QSVQTRLISD DPAKGLDRDR
301 RKPPIAGRLQ DALKQPEKSV YLVSPYFVPT KSGTDALAKL VQDGIDVTVL
351 TNSLQATDVA AVHSGYVKYR KPLLKAGIKL YELQPNHAVP ATKDKGLTGS
401 SVTSLHAKTF IVDGKRIFIG SFNLDPRSAR LNTEMGVVIE SPKIAEQMER
451 TLADTSPEYA YRVTLDRHNR LQWHDPATRK TYPNEPEAKL WKRIAAKILS
501 LLPIESLL*

m987/a987  98.8% identity in 508 aa overlap
```

-continued

```
                    10        20        30        40        50        60
m987.pep   MKTRSLISLLCLLLCSCSSWLPPLEERTESRHFNTSKPVRLDNILQIRHTPHTNGLSDIY
           ||||||||||||||||||||||||||||||||||||||||||||||||||||||||||||
a987       MKTRSLISLLCLLLCSCSSWLPPLEERTESRHFNTSKPVRLDNILQIRHTPHTNGLSDIY
                    10        20        30        40        50        60

                    70        80        90       100       110       120
m987.pep   LLNDPHEAFAARAALIESAEHSLDLQYYIWRNDISGRLLFNLVYLAAERGVRVRLLLDDN
           ||||||||||||||||||||||||||||||||||||||||||||||||||||||||||||
a987       LLNDPHEAFAARAALIESAEHSLDLQYYIWRNDISGRLLFNLVYLAAERGVRVRLLLDDN
                    70        80        90       100       110       120

                   130       140       150       160       170       180
m987.pep   NTRGLDDLLLALDSHPNIEVRLFNPFVLRKWRALGYLTDFPRLNRRMHNKSFTADNRATI
           ||||||||||||||||||||||||||||||||||||||||||||||||||||||||||||
a987       NTRGLDDLLLALDSHPNIEVRLFNPFVLRKWRALGYLTDFPRLNRRMHNKSFTADNRATI
                   130       140       150       160       170       180

                   190       200       210       220       230       240
m987.pep   LGGRNIGDEYFKVGEDTVFADLDILATGSVVGEVSHDFDRYWASHSAHNATRIIRSGDIG
           |||||||||||||||||||||||||||||||||||||||||||||||||||||||||:||
a987       LGGRNIGDEYFKVGEDTVFADLDILATGSVVGEVSHDFDRYWASHSAHNATRIIRSGNIG
                   190       200       210       220       230       240

                   250       260       270       280       290       300
m987.pep   KGLQALGYNDETSRHALLRYRETVEQSPLYQKIQTGCIDWQSVRTRLISDDPAKGLDRDR
           |||||||||||||||||||||||||||||||||||| ||||||:||||||||||||||||
a987       KGLQALGYNDETSRHALLRYRETVEQSPLYQKIQTGRIDWQSVQTRLISDDPAKGLDRDR
                   250       260       270       280       290       300

                   310       320       330       340       350       360
m987.pep   RKPPIAGRLQDALKQPEKSVYLVSPYFVPTKSGTDALAKLVQDGIDVTVLTNSLQATDVA
           ||||||||||||||||||||||||||||||||||||||||||||||||||||||||||||
a987       RKPPIAGRLQDALKQPEKSVYLVSPYFVPTKSGTDALAKLVQDGIDVTVLTNSLQATDVA
                   310       320       330       340       350       360

                   370       380       390       400       410       420
m987.pep   AVHSGYVKYRKPLLKAGIKLYELQPNHAVPATKDKGLTGSSVTSLHAKTFIVDGKRIFIG
           ||||||||||||||||||||||||||||||||||||||||||||||||||||||||||||
a987       AVHSGYVKYRKPLLKAGIKLYELQPNHAVPATKDKGLTGSSVTSLHAKTFIVDGKRIFIG
                   370       380       390       400       410       420

                   430       440       450       460       470       480
m987.pep   SFNLDPRSARLNTEMGVVIESPKIAEQMERTLADTTPAYAYRVTLDRHNRLQWHDPATRK
           ||||||||||||||||||||||||||||||||||:| |||||||||||||||||||||||
a987       SFNLDPRSARLNTEMGVVIESPKIAEQMERTLADTSPEYAYRVTLDRHNRLQWHDPATRK
                   430       440       450       460       470       480

                   490       500      509
m987.pep   TYPNEPEAKLWKRIAAKILSLLPIEGLLX
           |||||||||||||||||||||||||:|||
a987       TYPNEPEAKLWKRIAAKILSLLPIESLLX
                  490       500
```

The following partial DNA sequence was identified in *N. gonorrhoeae* <SEQ ID 2979>:

```
g988.seq
   1  ATGAATAAAA ATATTAAATC TTTAAATTTA CGGGAAAAAG ACCCGTTTTT

  51  AAGTCGTGAA AAACAGCGTT ATGAACATCC TTTGCCCAGT CGGgaATGGA

 101  TAATCGAATT GTTGGAGCGC AAAGGTGTGC CTTCAAAAAT CGAATCGCTT

 151  GCACGCGAGC TGTCGATTAC GGAAGacgag tATGTCTTTT TTGAACGCCG

 201  TCTGAaggCG atgGCGCGGG AcggtCAGGT TTTAATCAAC CGCCgaggcg

 251  CagtTTGCGc gGCggacaag ctgGATTTGG TCAAATGccg Cgtcgaggcg

 301  catAAgGAcg gtttcggctt cgcCGTGCCG CTCATGCCGA TGGACGAAGG

 351  GGATTTCGTT TTATACGAAC GCCAgatgcg tggTGtcatG CAcggcgaca

 401  ccgttACCGT CCGTCCTGCg ggtatggaCC GCAGGGGccg ccgcGAAggg

 451  acgtttctGG ATATTGTCGA ACGCGCGCAA AGCAAAGTTG TCGGCCGTTT

 501  CTATATGGAT AGGGGCGTGG CGATTTTGGA GCCGGAAGAC AAGCGTCTGA

 551  ACCAAAGCAT CGTGTTGGAA CCGGACGGCG TGGCGCGTTT CAAACCCGAA

 601  TCCGGTCAGG TTATCGTCGG CAAAATTGAG GTTTATCCCG AGCAAAACCG

 651  GCCTGCAGTG GCAAAAATCA TTGAAGTTTT GGGCGATTAT GCCGACAGCG
```

-continued

```
 701 GGATGGAAAt cgAAATTGCC GTGCGCAAGC ATCATTTGCC GCAccgaTTC
 751 AGTGAagcgt gtGcCAAATC CGcgaaAAAA ATtcccgacc ATGTACGCAA
 801 AAGCGATTTG AAAGGCCGCG TCGATTTGTG CGACCTTCCT TTGGTAACGA
 851 TAGACGGCGA AACGGCGCGC GATTTCGACG ACGCGGTGTT TGCCGAAAAA
 901 GTCGGACGCA ATTACCGCCT GGTCGTGGCG ATTGCGGATG TCAGCCATTA
 951 TGTCCGCCCT GACGATGCGA TTGATGCAGA TGCTCAAGAA CGCAGTACCA
1001 GCGTGTATTT CCCGCGCCGT ATGATTCCGA TGCTGCCGGA AAACCTGTCC
1051 AACGGCATCT GCTCGCTCAA TCCCGATGTC GAGCGTTTGT GTATGGTGTG
1101 CGATATGGTC GTTACCTATG CGGGCAATAT CAAAGAATAC CGCTTCTATC
1151 CCGCCGTGAT GCGCTCTCAT GCCCGCCTGA CCTACAACCA AGTTTGGAAA
1201 TGGCTTTCAG ACGGCATCGG GAATCCGCAC AAAGCCCAAA TCGACACGCT
1251 TTACAAGCTG TTTAAAATTT TGCAGAAAAA ACGTCTGGCG CGCGGGGCGG
1301 TGGAGTTTGA AAGCGTCGAA ACCCAGATGA TTTTCGACGA CAACGGCAAA
1351 ATCGAAAAAA TTGTCCCCGT CGTCCGCAAC gatGCCCACA AGCTGATTGA
1401 AGAATGTATG CTGGCGGCGA ATGTTTGCGC GGCGGATTTT CTGTTGAAAA
1451 ACAAACATAC GGCTTTGTTC CGCAACCATT TGGGCCCCAC GCCCGAAAAA
1501 CTCGCCACCC TGCGCGAGCA GCTCGGTCTG TTGGGGCTTC AACTTGGCGG
1551 CGGCGACAAC CCGTCGCCGA AAGACTATGC CGCGCTTGCC GAACAATTCA
1601 AAGGCAGGCC GGATGCCGAA TTGCTGCAAG TCATGATGTT GCGCTCCATG
1651 CAGCAGGCGG TTTACGAACC GCATTGCGAA GGGCATTTCG GTTTGGCTTA
1701 TGAAGCATAC GCCCACTTTA CCTCGCCCAT CCGCCGCTAT CCCGACCTGA
1751 CCGTCCACCG TGCCATCAAA GCCGTATTGA ACCGGAAAAC CTACACGCCA
1801 AACAAAAGCT GGCAGGCTTT GGGCGTGCAT ACTTCGTTTT GCGAACGCCG
1851 TGCCGACGAT GCTGGCCGCG ATGTGGAAAA CTGGCTGAAA ACTTATTATA
1901 TGCGCGATAA GGTCGGTGAA ATATTTGAAG GcaaaatCtc ccggggtgtg
1951 gcaaaTtttg gaATATTTGT CACTTTGGAC GATATccata tcgacggtct
2001 ggtacaTATC AGCGatttgg gcgaAGATTA TTTCaacttc cgccccgAAA
2051 TCATGGCAAT CGAAGGCGAA CGCAGCGGCA TCCGTTTCAA TATGGGGGAC
2101 AGGGTTGCCG TCCGGGTCGC GCGTGCCGAT TTGGATGATG GAAAAATCGA
2151 CTTTGTCCTA ATTGCCGGAG AAAGCGGCAG GCGGCGGAAG GTCAAATTAT
2201 CCGCATCTGC CAAACCGGCA GGGGCGGCGG GGAAAGGGAA ATCGAAAACC
2251 ACCGCCGAGA AAAAAACAGC CCGATGCGGC AAAGTAAGGG GAAGGGGCGT
2301 GCCTGCCGTT GCCGAATCGG GGAAAAAGGC AAAGAAACCG GTTCCGATTA
2351 AGGTCAAAAA ACGGAAAGGC AAATCATAA
```

This corresponds to the amino acid sequence <SEQ ID 2980; ORF 988.ng>:

```
g988.pep
  1 MNKNIKSLNL REKDPFLSRE KQRYEHPLPS REWIIELLER KGVPSKIESL
 51 ARELSITEDE YVFFERRLKA MARDGQVLIN RRGAVCAADK LDLVKCRVEA
101 HKDGFGFAVP LMPMDEGDFV LYERQMRGVM HGDTVTVRPA GMDRRGRREG
```

-continued

```
151TFLDIVERAQ SKVVGRFYMD RGVAILEPED KRLNQSIVLE PDGVARFKPE

201SGQVIVGKIE VYPEQNRPAV AKIIEVLGDY ADSGMEIEIA VRKHHLPHRF

251SEACAKSAKK IPDHVRKSDL KGRVDLCDLP LVTIDGETAR DFDDAVFAEK

301VGRNYRLVVA IADVSHYVRP DDAIDADAQE RSTSVYFPRR MIPMLPENLS

351NGICSLNPDV ERLCMVCDMV VTYAGNIKEY RFYPAVMRSH ARLTYNQVWK

401WLSDGIGNPH KAQIDTLYKL FKILQKKRLA RGAVEFESVE TQMIFDDNGK

451IEKIVPVVRN DAHKLIEECM LAANVCAADF LLKNKHTALF RNHLGPTPEK

501LATLREQLGL LGLQLGGGDN PSPKDYAALA EQFKGRPDAE LLQVMMLRSM

551QQAVYEPHCE GHFGLAYEAY AHFTSPIRRY PDLTVHRAIK AVLNRKTYTP

601NKSWQALGVH TSFCERRADD AGRDVENWLK TYYMRDKVGE IFEGKISRGV

651ANFGIFVTLD DIHIDGLVHI SDLGEDYFNF RPEIMAIEGE RSGIRFNMGD

701RVAVRVARAD LDDGKIDFVL IAGESGRRRK VKLSASAKPA GAAGKGKSKT

751TAEKKTARCG KVRGRGVPAV AESGKKAKKP VPIKVKKRKG KS*
```

The following partial DNA sequence was identified in *N. meningitidis* <SEQ ID 2981>:

```
m988.seq (partial)
   1 ..ACAGTTCTGG ATATTGTCGA ACGCGCGCAA AGCAAAGTGG TCGGCCGTTT

  51   CTATATGGAT AGGGGCGTGG CGATTTTGGA GCCGGAAGAC AAGCGTCTGA

 101   ACCAAAGCAT CGTATTGGAA CCGGACGGCG TGGCGCGTTT CAAACCTGAA

 151   TCCGGTCAGG TCATCGTCGG CGAAATTGAG GTTTATCCTG AGCAAAACCG

 201   GCCGGCAGTG GCAAAAATCA TCGAAGTTTT GGGCGATTAT GCCGACAGCG

 251   GCATGGAGAT TGAAATTGCC GTGCGCAAGC ATCATTTGCC GCACCAATTC

 301   AGTGAAGCGT GTGCCAAAGC TGCGAAAAAA ATTCCCGTCC ATGTACGCAA

 351   AAGCGATTTG AAAGGCCGCG TCGATTTGCG CGACCTGCCT TTGGTAACGA

 401   TAGACGGCGA AACGGCGCGC GATTTCGACG ACGCGGTGTT TGCCGAAAAA

 451   GTCGGACGCA ATTACCGTCT GGTCGTGGCG ATTGCGGATG TCAGCCATTA

 501   TGTCCGCCCT GACGATGTGA TTGATGCAGA TGCTCAAGAA CGCAGTACCA

 551   GCGTATATTT CCCGCGCCGT GTGATTCCGA TGCTGCCGGA AAACCTGTCT

 601   AACGGCATTT GCTCGCTCAA TCCCGATGTC GAGCGTTTGT GTATGGTGTG

 651   CGATATGGTC GTTACCTATG CGGGCAATAT CAAAGAATAC CGCTTCTACC

 701   CCGCCGTAAT GCGCTCTCAT GCCCGCCTGA CCTACAACCA AGTTTGGAAA

 751   TGGATTTCAG ACGGCATCGA CCATCCGTAC AAAGCCCAAA TCGACACCCT

 801   TTACAAACTC TTCAAAATCC TTCAGAAAAA GCGTTTCGAA CGCGGCGCGG

 851   TGGAGTTTGA AAGCGTCGAA ACCCAGATGA TTTTCGATGA CAACGGCAAA

 901   ATCGAAAAAA TCGTCCCCGT TGTCCGCAAC GATGCCCACA AGCTGATTGA

 951   AGAATGTATG CTGGCGGCGA ATGTTTGCGC AGCGGATTTC CTGTTGAAAA

1001   ACAAGCATAC GGCTTTGTTC CGCAACCATT TGGGCCCCAC GCCCGAAAAA

1051   CTCGCCACCC TGCGCGAGCA GCTCGGTCTG TTGGGGCTTC AACTTGGCGG

1101   CGGCGACAAC CCGTCGCCGA AAGACTATGC CGCGCTTGTC GAACAATTCA

1151   AAGGCAGACC TGATGCCGAA TTGCTGCAAG TCATGATGTT GCGCTCCATG
```

-continued

```
1201  CAGCAGGCGG TTTACGAACC GCATTGCGAC GGACACTTTG GTCTTGCCTA
1251  CGAAGCATAC GCCCACTTCA CCTCGCCCAT CCGCCGCTAT CCCGACCTGA
1301  CCGTACACCG CGCCATCAAA GCCGTGTTGA ATCAGCAAAC CTACACGCCA
1351  AAAAAAAGCT GGCAGGCTTT GGGCGTGCAT ACCTCGTTCT GTGAGCGCCG
1401  TGCCGACGAC GCCAGCCGCG ACGTGGAAAA CTGGCTGAAA ACCTATTATA
1451  TGCGCGATAA GGTCGGCGAA GTATTCGAAG GTAAAATCTC CGGCATGACC
1501  AGTTTTGGTA TCTTTGTAAC ACTGGACGGC ATCCACATTG ACGGCTTGGT
1551  GCATATCAGC GATTTGGGCG AAGACTATTT CAACTTCCGC CCCGAAATCA
1601  TGGCAATCGA AGGCGAACGC AGCGGCATCC GTTTCAACAT GGGGGACAGG
1651  GTTGCCGTCC GGGTCGCCCG TGCCGATTTG GATGACGGAA AAATCGATTT
1701  TGTCCTGATT GCCGGGGGGA GCGGCAGGGG GCGGAAAGTT AAATCATCCG
1751  CGTCTGCCAA ACCGGCAGGG ACGGCGGGGA AAGGGAAGCC GAAAACCGCC
1801  GCCGAGAAAA AAACAGCCCG AGGCGGCAAA GTAAGGGGAA GGGGCGCGTC
1851  TGCCGCCGCA GAATCGAGGA AAAAGGCAAA GAAACCGGTT CCGATTAAGG
1901  TAAAAAAACG GAAAGGCAAA TCATAA
```

This corresponds to the amino acid sequence <SEQ ID 2982; ORF 988>:

```
m988.pep (partial)
   1 ..TVLDIVERAQ SKVVGRFYMD RGVAILEPED KRLNQSIVLE PDGVARFKPE
  51   SGQVIVGEIE VYPEQNRPAV AKIIEVLGDY ADSGMEIEIA VRKHHLPHQF
 101   SEACAKAAKK IPVHVRKSDL KGRVDLRDLP LVTIDGETAR DFDDAVFAEK
 151   VGRNYRLVVA IADVSHYVRP DDVIDADAQE RSTSVYFPRR VIPMLPENLS
 201   NGICSLNPDV ERLCMVCDMV VTYAGNIKEY RFYPAVMRSH ARLTYNQVWK
 251   WISDGIDHPY KAQIDTLYKL FKILQKKRFE RGAVEFESVE TQMIFDDNGK
 301   IEKIVPVVRN DAHKLIEECM LAANVCAADF LLKNKHTALF RNHLGPTPEK
 351   LATLREQLGL LGLQLGGGDN PSPKDYAALV EQFKGRPDAE LLQVMMLRSM
 401   QQAVYEPHCD GHFGLAYEAY AHFTSPIRRY PDLTVHRAIK AVLNQQTYTP
 451   KKSWQALGVH TSFCERRADD ASRDVENWLK TYYMRDKVGE VFEGKISGMT
 501   SFGIFVTLDG IHIDGLVHIS DLGEDYFNFR PEIMAIEGER SGIRFNMGDR
 551   VAVRVARADL DDGKIDFVLI AGGSGRGRKV KSSASAKPAG TAGKGKPKTA
 601   AEKKTARGGK VRGRGASAAA ESRKKAKKPV PIKVKKRKGK S*
```

Computer analysis of this amino acid sequence gave the following results:

Homology with a Predicted ORF from *N. gonorrhoeae*

```
m988/g988  94.2% identity in 642 aa overlap

                                                     10        20        30
m988.pep                                       TVLDIVERAQSKVVGRFYMDRGVAILEPED
                                               | ||||||||||||||||||||||||||||
g988            LYERQMRGVMHGDTVTVRPAGMDRRGRREGTFLDIVERAQSKVVGRFYMDRGVAILEPED
                       130       140       150       160       170       180

                       40        50        60        70        80        90
m988.pep        KRLNQSIVLEPDGVARFKPESGQVIVGEIEVYPEQNRPAVAKIIEVLGDYADSGMEIEIA
                ||||||||||||||||||||||||||:|||||||||||||||||||||||||||||||||
g988            KRLNQSIVLEPDGVARFKPESGQVIVGKIEVYPEQNRPAVAKIIEVLGDYADSGMEIEIA
                       190       200       210       220       230       240
```

-continued

```
                   100       110       120       130       140       150
m988.pep    VRKHHLPHQFSEACAKAAKKIPVHVRKSDLKGRVDLRDLPLVTIDGETARDFDDAVFAEK
            ||||||||:|||||||:||||| ||||||||||||| |||||||||||||||||||||||
g988        VRKHHLPHRFSEACAKSAKKIPDHVRKSDLKGRVDLCDLPLVTIDGETARDFDDAVFAEK
                   250       260       270       280       290       300

                   160       170       180       190       200       210
m988.pep    VGRNYRLVVAIADVSHYVRPDDVIDADAQERSTSVYFPRRVIPMLPENLSNGICSLNPDV
            ||||||||||||||||||||||:|||||||||||||||||:|||||||||||||||||||
g988        VGRNYRLVVAIADVSHYVRPDDAIDADAQERSTSVYFPRRMIPMLPENLSNGICSLNPDV
                   310       320       330       340       350       360

                   220       230       240       250       260       270
m988.pep    ERLCMVCDMVVTYAGNIKEYRFYPAVMRSHARLTYNQVWKWISDGIDHPYKAQIDTLYKL
            |||||||||||||||||||||||||||||||||||||||||:|||| :|:||||||||||
g988        ERLCMVCDMVVTYAGNIKEYRFYPAVMRSHARLTYNQVWKWLSDGIGNPHKAQIDTLYKL
                   370       380       390       400       410       420

                   280       290       300       310       320       330
m988.pep    FKILQKKRFERGAVEFESVETQMIFDDNGKIEKIVPVVRNDAHKLIEECMLAANVCAADF
            ||||||||: ||||||||||||||||||||||||||||||||||||||||||||||||||
g988        FKILQKKRLARGAVEFESVETQMIFDDNGKIEKIVPVVRNDAHKLIEECMLAANVCAADF
                   430       440       450       460       470       480

                   340       350       360       370       380       390
m988.pep    LLKNKHTALFRNHLGPTPEKLATLREQLGLLGLQLGGGDNPSPKDYAALVEQFKGRPDAE
            |||||||||||||||||||||||||||||||||||||||||||||||||:||||||||||
g988        LLKNKHTALFRNHLGPTPEKLATLREQLGLLGLQLGGGDNPSPKDYAALAEQFKGRPDAE
                   490       500       510       520       530       540

                   400       410       420       430       440       450
m988.pep    LLQVMMLRSMQQAVYEPHCDGHFGLAYEAYAHFTSPIRRYPDLTVHRAIKAVLNQQTYTP
            |||||||||||||||||||:||||||||||||||||||||||||||||||||||::||||
g988        LLQVMMLRSMQQAVYEPHCEGHFGLAYEAYAHFTSPIRRYPDLTVHRAIKAVLNRKTYTP
                   550       560       570       580       590       600

                   460       470       480       490       500       509
m988.pep    KKSWQALGVHTSFCERRADDASRDVENWLKTYYMRDKVGEVFEGKIS-GMTSFGIFVTLD
            :||||||||||||||||||||:||||||||||||||||||:|||||| |:::||||||||
g988        NKSWQALGVHTSFCERRADDAGRDVENWLKTYYMRDKVGEIFEGKISRGVANFGIFVTLD
                   610       620       630       640       650       660

          510       520       530       540       550       560       569
m988.pep    GIHIDGLVHISDLGEDYFNFRPEIMAIEGERSGIRFNMGDRVAVRVARADLDDGKIDFVL
             |||||||||||||||||||||||||||||||||||||||||||||||||||||||||||
g988        DIHIDGLVHISDLGEDYFNFRPEIMAIEGERSGIRFNMGDRVAVRVARADLDDGKIDFVL
                   670       680       690       700       710       720

          570       580       590       600       610       620       629
m988.pep    IAGGSGRGRKVKSSASAKPAGTAGKGKPKTAAEKKTARGGKVRGRGASAAAESRKKAKKP
            ||| ||| |||| ||||||||:||||| ||:||||||| |||||||: |:||| ||||||
g988        IAGESGRRRKVKLSASAKPAGAAGKGKSKTTAEKKTARCGKVRGRGVPAVAESGKKAKKP
                   730       740       750       760       70        780

          630       640
m988.pep    VPIKVKKRKGKSX
            |||||||||||||
g988        VPIKVKKRKGKSX
                   790
```

The following partial DNA sequence was identified in *N. meningitidis* <SEQ ID 2983>:

```
a988.seq
  1 ATGAATAAAA ATATTAAATC TTTAAATTTA CGGGAAAAAG ACCCGTTTTT

 51 AAGTCGTGAA AAACAGCGTT ATGAACATCC TTTGCCCAGT CGGGAATGGA

101 TAATCGAGCT GCTTGAACGT AAAGGCGTAC CATCCAAGAT TGAAGCTTTG

151 GTACGCGAAT TGTCGATTAA GGAAGAAGAG TACGAATTTT TCGAACGTCG

201 TCTGAAGGCG ATGGCGCGGG ACGGTCAGGT TTTAATCAAC CGTCGGGGCG

251 CGGTTTGCGC GGCGGACAAA TTGGATTTGG TCAAATGCCG TGTCAAGGCG

301 CACAAAGACC GCTTCGGTTT CGCCGTGCCG CTCACGCCCG CCAAAGACGG

351 TGATTTTGTC TTGTACGAAC GCCAGATGCG CGGCATTATG CACGGCGATA

401 TTGTCACTGT TCGTCCTGCC GGCATGGACG GTAGGGGCCG CCGCGAAGGG

451 ACGGTTCTGG ATATTGTCGA ACGCGCGCAA AGCAAAGTGG TCGGCCGTTT

501 CTANATGGAT AGGGGCGTGG CGATTTTGGA GCCGGAAGAC AAGCGTCTGA
```

-continued

```
 551 ACCAAAGCAT CGTATTGGAA CCGGACGGCG TGGCGCGTTT CAAACCTGAA

 601 TCCGGTCAGG TCATCGTCGG CGAAATTGAG GTTTATCCTG AGCAAAACCG

 651 GCCGGCAGTG GCAAAAATCA TCGAAGTTTT GGGCGATTAT GCCGACAGCG

 701 GCATGGAGAT TGAAATTGCC GTGCGCAAGC ATCATTTGCC GCACCAATTC

 751 AGTGAAGCGT GTGCCAAAGC CGCGAAAAAA ATTCCCGACC ATGTACGCAA

 801 AAGCGATTTG AAAGGCCGCG TCGATTTGCG CGACCTGCCT TTGGTAACGA

 851 TAGACGGCGA AACGGCTCGA GATTTTGACG ATGCGGTGTT TGCCGAGAAA

 901 ATCGGACGCA ATTACCGTCT GGTCGTGGCG ATTGCCGATG TCAGCCATTA

 951 TGTCCGCCCC GATGACGCTA TCGACACGGA CGCTCAGGAA CGCAGCACCA

1001 GTGTTTACTT CCCGCGCCGC GTGATTCCCA TGTTGCCGGA AAACCTGTCC

1051 AACGGCATCT GCTCGCTCAA TCCTCATGTC GAGCGTTTGT GTGTGGTGTG

1101 CGATATGGTT ATCACTTACG CGGGCAATAT CAAAGAATAC CGCTTCTACC

1151 CCGCCGTGAT GCGCTCTCAT GCCCGCCTGA CCTACAACCA AGTTTGGAAA

1201 TGGCTTTCAG GCGGCATCGA GCATCCGTTC AAAACCCAAA TCGACACGCT

1251 TTACAAACTC TTCAAAATCC TTCAGAAAAA GCGTTTCGAA CGCGGGGCGG

1301 TGGAGTTTGA CAGCATCGAA ACCCAAATGC TTTTCGACGA CAACGGTAAA

1351 ATTGAAAAAA TCGTCCCCGT TGTCCGCAAC GATGCCCACA AGCTGATTGA

1401 AGAATGTATG TTGGCGGCAA ACGTTTGCGC AGCGGATTTT CTGTTGAAAA

1451 ACAAGCATAC CGCATTGTTC CGCAACCATT TGGGGCCCAC GCCCGAAAAA

1501 CTCGCCGCCT TGCGCGAGCA GCTCGGTCTG TTGGGGCTTC AACTTGGCGG

1551 CGGCGACAAC CCGTCGCCGA AAGACTATGC CGCGCTTGCC GGACAGTTCA

1601 AAGGCAGGCC GGATGCCGAA TTGCTGCAAG TCATGATGTT GCGCTCCATG

1651 CAACAGGCGG TTTACGAACC GCATTGCGAC GGACACTTTG GTCTTGCCTA

1701 CGAAGCATAC GCCCACTTCA CCTCGCCCAT CCGCCGCTAT CCCGACCTGA

1751 CCGTACACCG CGCCATCAAA GCCGTGTTGA ATCAGCAAAC CTACACGCCA

1801 AAAAAAAGCT GGCAGGCTTT GGGCGTGCAT ACCTCGTTCT GTGAGCGCCG

1851 TGCCGACGAC GCCAGCCGCG ACGTGGAAAA CTGGCTGAAA ACCTATTATA

1901 TGCGCGATAA GGTCGGCGAA GTATTCGAAG GTAAAATCTC CGGCATGACC

1951 AGTTTTGGTA TCTTTGTAAC ACTGGACGGC ATCCACATTG ACGGCTTGGT

2001 GCATATCAGC GATTTGGGCG AAGACTATTT CAACTTCCGC CCCGAAATCA

2051 TGGCAATCGA AGGCGAACGC AGCGGCATCC GTTTCAACAT GGGGGACAGG

2101 GTTGCCGTCC GGGTCGCCCG TGCCGATTTG GATGACGGAA AAATCGATTT

2151 TGTCCTGATT GCCGGGGGGA GCGGCAGGGG GCGGAAAGTT AAATCATCCG

2201 CGTCTGCCAA ACCGGCAGGG ACGGCGGGGA AAGGGAAGCC GAAAACCGCC

2251 GCCGAGAAAA AAACAGCCCG AGGCGGCAAA GTAAGGGGAA GGGGCGCGTC

2301 TGCCGCCGCA GAATCGAGGA AAAAGGCAAA GAAACCGGTT CCGATTAAGG

2351 TAAAAAAACG GAAAGGCAAA TCATAA
```

This corresponds to the amino acid sequence <SEQ ID 2984; ORF 988.a>:

```
a988.pep

      1 MNKNIKSLNL REKDPFLSRE KQRYEHPLPS REWIIELLER KGVPSKIEAL

     51 VRELSIKEEE YEFFERRLKA MARDGQVLIN RRGAVCAADK LDLVKCRVKA

    101 HKDRFGFAVP LTPAKDGDFV LYERQMRGIM HGDIVTVRPA GMDGRGRREG

    151 TVLDIVERAQ SKVVGRFXMD RGVAILEPED KRLNQSIVLE PDGVARFKPE

    201 SGQVIVGEIE VYPEQNRPAV AKIIEVLGDY ADSGMEIEIA VRKHHLPHQF

    251 SEACAKAAKK IPDHVRKSDL KGRVDLRDLP LVTIDGETAR DFDDAVFAEK

    301 IGRNYRLVVA IADVSHYVRP DDAIDTDAQE RSTSVYFPRR VIPMLPENLS

    351 NGICSLNPHV ERLCVVCDMV ITYAGNIKEY RFYPAVMRSH ARLTYNQVWK

    401 WLSGGIEHPF KTQIDTLYKL FMILQKKRFE RGAVEFDSIE TQMLFDDNGK

    451 IEKIVPVVRN DAHKLIEECM LAANVCAADF LLKNKHTALF RHNLGPTPEK

    501 LAALREQLGL LGLQLGGGDN PSPKDYAALA GQFKGRPDAE LLQVMMLRSM

    551 QQAVYEPHCD GHFGLAYEAY AHFTSPIRRY PDLTVHRAIK AVLNQQTYTP

    601 KKSWQALGVH TSFCERRADD ASRDVENWLK TYYMRDKVGE VFEGKISGMT

    651 SFGIFVTLDG IHIDGLVHIS DLGEDYFNFR PEIMAIEGER SGIRFNMGDR

    701 VAVRVARADL DDGKIDFVLI AGGSGRGRKV KSSASAKPAG TAGKGKPKTA

    751 AEKKTARGGK VRGRGASAAA ESRKKAKKPV PIKVKKRKGK S*

m988/a988  97.0% identity in 641 aa overlap

                                                      10        20        30
m988.pep                                    TVLDIVERAQSKVVGRFYMDRGVAILEPED
                                            ||||||||||||||||| ||||||||||||
a986          LYERQMRGIMHGDIVTVRPAGMDGRGRREGTVLDIVERAQSKVVGRFXMDRGVAILEPED
                    130       140       150       160       170       180

                    40        50        60        70        80        90
m988.pep      KRLNQSIVLEPDGVARFKPESGQVIVGEIEVYPEQNRPAVAKIIEVLGDYADSGMEIEIA
              ||||||||||||||||||||||||||||||||||||||||||||||||||||||||||||
a988          KRLNQSIVLEPDGVARFKPESGQVIVGEIEVYPEQNRPAVAKIIEVLGDYADSGMEIEIA
                    190       200       210       220       230       240

                   100       110       120       130       140       150
m988.pep      VRKHHLPHQFSEACAKAAKKIPVHVRKSDLKGRVDLRDLPLVTIDGETARDFDDAVFAEK
              |||||||||||||||||||||| |||||||||||||||||||||||||||||||||||||
a988          VRKHHLPHQFSEACAKAAKKIPDHVRKSDLKGRVDLRDLPLVTIDGETARDFDDAVFAEK
                    250       260       270       280       290       300

                   160       170       180       190       200       210
m988.pep      VRGNYRLVVAIADVSHYVRPDDVIDADAQERSTSVYFPRRVIPMLPENLSNGICSLNPDV
              :|||||||||||||||||||||:||:|||||||||||||||||||||||||||||||| |
a988          IGRNYRLVVAIADVSHYVRPDDAIDTDAQERSTSVYFPRRVIPMLPENLSNGICSLNPHV
                    310       320       330       340       350       360

                   220       230       240       250       260       270
m988.pep      ERLCMVCDMVVTYAGNIKEYRFYPAVMRSHARLTYNQVWKWISDGIDHPYKAQIDTLYKL
              ||||:|||||:|||||||||||||||||||||||||||||:| ||:||:|:|||||||||
a988          ERLCVVCDMVITYAGNIKEYRFYPAVMRSHARLTYNQVWKWLSGGIEHPFKTQIDTLYKL
                    370       380       390       400       410       420

                   280       290       300       310       320       330
m988.pep      FKILQKKRFERGAVEFESVETQMIFDDNGKIEKIVPVVRNDAHKLIEECMLAANVCAADF
              ||||||||||||||||:|:||||:||||||||||||||||||||||||||||||||||||
a988          FKILQKKRFERGAVEFDSIETQMLFDDNGKIEKIVPVVRNDAHKLIEECMLAANVCAADF
                    430       440       450       460       470       480

                   340       350       360       370       380       390
m988.pep      LLKNKHTALFRNHLGPTPEKLATLREQLGLLGLQLGGGDNPSPKDYAALVEQFKGRPDAE
              ||||||||||||||||||||||:||||||||||||||||||||||||||: |||||||||
a988          LLKNKHTALFRNHLGPTPEKLAALREQLGLLGLQLGGGDNPSPKDYAALAGQFKGRPDAE
                    490       500       510       520       530       540

                   400       410       420       430       440       450
m988.pep      LLQVMMLRSMQQAVYEPHCDGHFGLAYEAYAHFTSPIRRYPDLTVHRAIKAVLNQQTYTP
              ||||||||||||||||||||||||||||||||||||||||||||||||||||||||||||
a988          LLQVMMLRSMQQAVYEPHCDGHFGLAYEAYAHFTSPIRRYPDLTVHRAIKAVLNQQTYTP
                    550       560       570       580       590       600

                   460       470       480       490       500       510
m988.pep      KKSWQALGVHTSFCERRADDASRDVENWLKTYYMRDKVGEVFEGKISGMTSFGIFVTLDG
              ||||||||||||||||||||||||||||||||||||||||||||||||||||||||||||
a988          KKSWQALGVHTSFCERRADDASRDVENWLKTYYMRDKVGEVFEGKISGMTSFGIFVTLDG
                    610       620       630       640       650       660
```

-continued

```
                520        530        540        550        560        570
m988.pep   IHIDGLVHISDLGEDYFNFRPEIMAIEGERSGIRFNMGDRVAVRVARADLDDGKIDFVLI
           ||||||||||||||||||||||||||||||||||||||||||||||||||||||||||||
a988       IHIDGLVHISDLGEDYFNFRPEIMAIEGERSGIRFNMGDRVAVRVARADLDDGKIDFVLI
                670        680        690        700        710        720

                580        590        600        610        620        630
m988.pep   AGGSGRGRKVKSSASAKPAGTAGKGKPKTAAEKKTARGGKVRGRGASAAAESRKKAKKPV
           ||||||||||||||||||||||||||||||||||||||||||||||||||||||||||||
a988       AGGSGRGRKVKSSASAKPAGTAGKGKPKTAAEKKTARGGKVRGRGASAAAESRKKAKKPV
                730        740        750        760        770        780

                640
m988.pep   PIKVKKRKGKSX
           ||||||||||||
a988       PIKVKKRKGKSX
                790
```

The following partial DNA sequence was identified in *N. gonorrhoeae* <SEQ ID 2985>:

```
g989.seq
   1 ATGACCCCTT TCACACTGAA AAAAACCGTC CTGCTGCTCG GCACTGCCTT

  51 TGCCGCCGCA TCTGTCCACG CATCCGGCTA CCACTTCGGC ACACAGTCGG

 101 TCAACGCGCA AAGCACGGCA AATGCCGCCG ACGCGTCGAC CATCTTCTAC

 151 AATCCCGCCG GCCTGACCAA ACTCGACAGC AGCCAGATTT CCGTCAACGC

 201 CAACATCGTG CTGCCCAGCA TTCATTATGA AGCAGATTCC GCCACCGACT

 251 TTACCGGGCT TCCCGTCCAA GGTTCTAAAA ACGGCAAAAT CACCAAAACC

 301 ACGGTCGCAC CCCACATTTA CGGCGCATAC AAAGTCAACG ACAATCTGAC

 351 CGTGGGCTTG GGCGTGTACG TCCCCTTCGG CTCTGCCACC GAATACGAAA

 401 AAGATTCCGT GTTGCGCCAC AACATCAACA AACTCGGTCT GACCAGCATC

 451 GCCGTCGAAC CTGTCGCCGC GTGGAAACTC AACGAACGCC ATTCCTTCGG

 501 CGCAGGCATC ATCGCCCAAC ATAATTCCGC CGAACTGCGC AAATATGCCG

 551 ACTGAGGAAT CCCAAAAAAA GCGCAAATGC TGCAAGCAAC ACCTTCTAAT

 601 CCTACTGCCG CTGCTCAAAT CAAGGCCGAC GGACACGCCG ATGTCAAAGG

 651 CAGCGATTGG GGCGTCGGCT ACCAACTGGC GTGGATGTGG GACATCAACG

 701 ACCGCGCGCG CGTGGGCGTG AACTACCGTT CCAAAGTTTC ACACACGCTC

 751 AAAGGCGATG CCGAATGGGC GGCAGACGGC GCGGCGGCGA AACAACAGTG

 801 GAATGACAAT ATGCTCACAC CGCTCGGTTA CACGGCGAAT GAAAAAGCCA

 851 GTGTCAAAAT CGTAACGCCT GAGTCTTTGT CCGTACACGG CATGTACAAA

 901 GTGTCCGACA AAGCCGACCT GTTCGGCGAC GTAACTTGGA CGCGCCACAG

 951 CCGCTTCAAT AAGGCGGAAC TGTTTTTTGA AAAAGAAAAA AATATTGCTA

1001 ATGGCAAAAA ATCCGACCGC ACCACCATCA CCCCCAACTG GCGCAACACC

1051 TACAAAGTCG GCTTGGGCGG TTCTTATCAA ATCAGCGAAC CGCTGCAACT

1101 GCGCGTCGGC ATCGCTTTTG ACAAACCGCC TGTCCGCAAC GCCGACTacC

1151 GCATGAACAG CCTGCCCGAC GGCAACCGCA TCTGGTTCTC CGCCGGCATG

1201 AAATACCATA TCGGCAAAAA CCACGTCGTC GATGCCGCCT ACACCCACAT

1251 CCACATCAAC GACACCAGCT ACCGCACGGC GAAGGCAAGC GGCAACGATG

1301 TGGACAGCAA AGGTGCGTCT TGCGCACGTT TCAAAAACCA CGCCGACATC

1351 ATCGGCCTGC AATACACCTA CAAATTCAAA TAA
```

This corresponds to the amino acid sequence <SEQ ID 2986; ORF 989.ng>:

```
g989.pep
   1 MTPFTLKKTV LLLGTAFAAA SVHASGYHFG TQSVNAQSTA NAADASTIFY

  51 NPAGLTKLDS SQISVNANIV LPSIHYEADS ATDFTGLPVQ GSKNGKITKT

 101 TVAPHIYGAY KVNDNLTVGL GVYVPFGSAT EYEKDSVLRH NINKLGLTSI

 151 AVEPVAAWKL NERHSFGAGI IAQHNSAELR KYAD*GIPKK AQMLQATPSN

 201 PTAAAQIKAD GHADVKGSDW GVGYQLAWMW DINDRARVGV NYRSKVSHTL

 251 KGDAEWAADG AAAKQQWNDN MLTPLGYTAN EKASVKIVTP ESLSVHGMYK

 301 VSDKADLFGD VTWTRHSRFN KAELFFEKEK NIANGKKSDR TTITPNWRNT

 351 YKVGLGGSYQ ISEPLQLRVG IAFDKPPVRN ADYRMNSLPD GNRIWFSAGM

 401 KYHIGKNHVV DAAYTHIHIN DTSYRTAKAS GNDVDSKGAS CARFKNHADI

 451 IGLQYTYKFK *
```

The following partial DNA sequence was identified in *N. meningitidis* <SEQ ID 2987>:

```
m989.seq
   1 ATGACCCCTT CCGCACTGAA AAAAACCGTC CTGCTGCTCG GCACTGCCTT

  51 TGCCGCCGCA TCCGTCCACG CATCCGGCTA CCACTTCGGC ACACAGTCGG

 101 TCAACGCGCA AAGCACGGCA AATGCCGCCG CCGCAGAAGC CGCCGACGCA

 151 TCGACCATCT TCTACAACCC TGCCGGCCTG ACCAAACTCG ACAGCAGCCA

 201 GATTTCCGTC AACGCCAACA TCGTGCTGCC CAGCATTCAT TATGAGGCGG

 251 ATTCCGCCAC CGACTTTACC GGGCTTCCCG TCCAAGGTTC GAAAAGCGGC

 301 AAAATCACCA AAACCACGGT CGCGCCCCAC ATCTACGGCG CATACAAAGT

 351 CAACGACAAT CTGACCGTGG GCTTGGGCGT GTACGTCCCC TTCGGCTCTG

 401 CCACCGAATA CGAAAAAGAT TCCGTGTTGC GCCACAACAT CAACAAACTC

 451 GGTCTGACCA GCATCGCCGT CGAACCTGTC GCCGCGTGGA AACTCAACGA

 501 CCGCCATTCC TTCGGCGCAG GCATCATCGC CCAACATACT TCCGCCGAAC

 551 TGCGCAAATA TGCCGACTGG GGGATTAAGA GTAAAGCAGA GATATTGACG

 601 GCAAAACCGC CCAAACCTAA CGGTGTAGCC GAAGCTGCAA AAATTCAGGC

 651 CGACGGACAC GCCGATGTCA AAGGCAGCGA TTGGGGCTTC GGCTACCAAC

 701 TGGCGTGGAT GTGGGACATC AACGACCGTG CGCGCGTGGG CGTGAACTAC

 751 CGTTCCAAAG TCTCGCACAC GCTCAAAGGC GATGCCGAAT GGGCGGCAGA

 801 CGGCGCGGCG GCGAAAGCAA TGTGGAGTAC GATGCTTGCA GCAAACGGCT

 851 ACACGGCGAA TGAAAAAGCC CGCGTTAAAA TCGTTACGCC TGAGTCTTTG

 901 TCCGTACACG GTATGTACAA AGTGTCCGAT AAAGCCGACC TGTTCGGCGA

 951 CGTAACTTGG ACGCGCCACA GCCGCTTCGA TAAGGCGGAA CTGGTTTTTG

1001 AAAAAGAAAA AACCGTCGTC AAAGGCAAAT CCGACCGCAC CACCATCACC

1051 CCCAACTGGC GCAACACCTA CAAAGTCGGC TTCGGCGGTT CTTATCAAAT

1101 CAGCGAACCG CTGCAACTGC GCGCCGGCAT CGCTTTTGAC AAATCGCCCG

1151 TCCGCAACGC CGACTACCGC ATGAACAGCC TACCCGACGG CAACCGCATC

1201 TGGTTCTCCG CCGGTATGAA ATACCATATC GGTAAAAACC ACGTCGTCGA
```

```
-continued
1251 TGCCGCCTAC ACCCACATCC ACATCAACGA CACCAGCTAC CGCACGGCGA

1301 AGGCAAGCGG CAACGATGTG GACAGCAAAG GCGCGTCTTC CGCACGTTTC

1351 AAAAACCACG CCGACATCAT CGGTCTGCAA TACACCTACA AATTCAAATA

1401 A
```

This corresponds to the amino acid sequence <SEQ ID 2988; ORF 989>:

```
m989.pep
  1 MTPSALKKTV LLLGTAFAAA SVHASGYHFG TQSVNAQSTA NAAAAEAADA

 51 STIFYNPAGL TKLDSSQISV NANIVLPSIH YEADSATDFT GLPVQGSKSG

101 KITKTTVAPH IYGAYKVNDN LTVGLGVYVP FGSATEYEKD SVLRHNINKL

151 GLTSIAVEPV AAWKLNDRHS FGAGIIAQHT SAELRKYADW GIKSKAEILT

201 AKPPKPNGVA EAAKIQADGH ADVKGSDWGF GYQLAWMWDI NDRARVGVNY

251 RSKVSHTLKG DAEWAADGAA AKAMWSTMLA ANGYTANEKA RVKIVTPESL

301 SVHGMYKVSD KADLFGDVTW TRHSRFDKAE LVFEKEKTVV KGKSDRTTIT

351 PNWRNTYKVG FGGSYQISEP LQLRAGIAFD KSPVRNADYR MNSLPDGNRI

401 WFSAGMKYHI GKNHVVDAAY THIHINDTSY RTAKASGNDV DSKGASSARF

451 KNHADIIGLQ YTYKFK*
```

Computer analysis of this amino acid sequence gave the following results:

Homology with a Predicted ORF from *N. gonorrhoeae*

```
    g989/m989  90.0% identity in 468 aa overlap

                    10         20         30         40         50
    g989.pep   MTPFTLKKTVLLLGTAFAAASVHASGYHFGTQSVNAQSTANAA-----DASTIFYNPAGL
               |||:||||||||||||||||||||||||||||||||||||||      ||||||||||||
    m989       MTPSALKKTVLLLGTAFAAASVHASGYHFGTQSVNAQSTANAAAAEAADASTIFYNPAGL
                    10         20         30         40         50         60

                    60         70         80         90        100        110
    g989.pep   TKLDSSQISVNANIVLPSIHYEADSATDFTGLPVQGSKNGKITKTTVAPHIYGAYKVNDN
               |||||||||||||||||||||||||||||||||||||||:||||||||||||||||||||
    m989       TKLDSSQISVNANIVLPSIHYEADSATDFTGLPVQGSKSGKITKTTVAPHIYGAYKVNDN
                    70         80         90        100        110        120

                   120        130        140        150        160        170
    g989.pep   LTVGLGVYVPFGSATEYEKDSVLRHNINKLGLTSIAVEPVAAWKLNERHSFGAGIIAQHN
               |||||||||||||||||||||||||||||||||||||||||||||||:|||||||||||:
    m989       LTVGLGVYVPFGSATEYEKDSVLRHNINKLGLTSIAVEPVAAWKLNDRHSFGAGIIAQHT
                   130        140        150        160        170        180

                   180        190        200        210        220        230
    g989.pep   SAELRKYADXGIPKKAQMLQATPSNPTA---AAQIKADGHADVKGSDWGVGYQLAWMWDI
               ||||||||||  ||:||::|   |  |:::    ||:|:|||||||||||| ||||||||
    m989       SAELRKYADWGIKSKAEILTAKPPKPNGVAEAAKIQADGHADVKGSDWGFGYQLAWMWDI
                   190        200        210        220        230        240

                   240        250        260        270        280        290
    g989.pep   NDRARVGVNYRSKVSHTLKGDAEWAADGAAAKQQWNDNMLTPLGYTANEKASVKIVTPES
               ||||||||||||||||||||||||||||||:|: :||: ||||||||||||:||||||||
    m989       NDRARVGVNYRSKVSHTLKGDAEWAADGAAAKAMWS-TMLAANGYTANEKARVKIVTPES
                   250        260        270        280        290

                   300        310        320        330        340        350
    g989.pep   LSVHGMYKVSDKADLFGDVTWTRHSRFNKAELFFEKEKNIANGKKSDRTTITPNWRNTYK
               ||||||||||||||||||||||||||||:||||||||::::|||| |||||||||||||
    m989       LSVHGMYKVSDKADLFGDVTWTRHSRFDKAELVFEKEKTVVKGK-SDRTTITPNWRNTYK
                  300        310        320        330        340        350

                   360        370        380        390        400        410
    g989.pep   VGLGGSYQISEPLQLRVGIAFDKPPVRNADYRMNSLPDGNRIWFSAGMKYHIGKNHVVDA
               ||:||||||||||||:||||||:||||||||||||||||||||||||||||||||||||
    m989       VGFGGSYQISEPLQLRAGIAFDKSPVRNADYRMNSLPDGNRIWFSAGMKYHIGKNHVVDA
                  360        370        380        390        400        410
```

-continued

```
              420        430        440        450        460
g989.pep    AYTHIHINDTSYRTAKASGNDVDSKGASCARFKNHADIIGLQYTYKFKX
            |||||||||||||||||||||||||||| ||||||||||||||||||||
m989        AYTHIHINDTSYRTAKASGNDVDSKGASSARFKNHADIIGLQYTYKFKX
           420        430        440        450        460
```

The following partial DNA sequence was identified in *N. meningitidis* <SEQ ID 2989>:

```
a989.seq
   1 ATGACCCCTT CCGCACTGAA AAAAACCGTC CTACTGCTCG GCACTGCCTT

  51 TGCCGCCGCA TCCGCACAAG CCTCCGGCTA CCACTTCGGC ACACAGTCGG

 101 TCAACGCGCA AAGCACGGCA AATGCCGCCG CCGCAGAAGC CGCCGACGCA

 151 TCGACCATCT TCTACAACCC TGCCGGCCTG ACCAAACTCG ACAGCAGCCA

 201 GATTTCCGTC AACGCCAACA TCGTGCTGCC CAGCATTCAT TATGAGGCGG

 251 ATTCCGCCAC CGACTTTACC GGGCTTCCCG TCCAAGGTTC GAAAAGCGGC

 301 AAAATCACCA AAACCACGGT CGCGCCCCAC ATCTACGGCG CATACAAAGT

 351 CAACGACAAT CTGACCGTAG GCTTGGGCGT GTACGTCCCC TTCGGTTCTG

 401 CCACCGAATA CGAAAAAGAT TCCGTGTTGC GCCACAACAT CAACAAACTC

 451 GGTCTGACCA GCATCGCCGT CGAACCTGTC GCCGCGTGGA AACTCAACGA

 501 ACGCCATTCC TTCGGCGCAG GCATCATCGC CCAACATACT TCCGCCGAGC

 551 TGCGCAAATA TGCCGACTGG GGGATTATGG AAAAAGCGAA AGCACTAAAA

 601 GAAACACCCC CCAATCCAAC TAAAGCCGCC CAAATCAAAG CCGACGGACA

 651 CGCCGATGTC AAAGGCAGCG ATTGGGGCTT CGGCTACCAA CTGGCGTGGA

 701 TGTGGGACAT CAACGACCGT GCGCGCGTGG GCGTGAACTA CCGTTCCAAA

 751 GTCTCACACA CGCTCAAAGG CGATGCCGAA TGGGCGGCAG ACGACGCAAT

 801 GGCGAAACAG TTATGGGATG CAAACAAACT CGCACTGCTC GGCTACACGC

 851 CAAGCGAAAA AGCCCGCGTT AAAATCGTTA CGCCCGAGTC TTTGTCCGTA

 901 CACGGTATGT ACAAAGTGTC CGACAAAGCC GACCTGTTCG GCGACGTAAC

 951 TTGGACGCGC CACAGCCGCT TCGATAAGGC GGAACTGGTT TTTGAAAAAG

1001 AAAAAACCAT CGTCAACGGC AAATCCGACC GCACCACCAT CACCCCCAAC

1051 TGGCGCAACA CCTACAAAGT CGGCTTCGGC GGTTCTTATC AAATCAGCGA

1101 ACCGCTGCAA CTGCGCGCCG GCATCGCTTT TGACAAATCG CCCGTCCGCA

1151 ACGCCGACTA CCGCATGAAC AGCCTGCCCG ACGGCAACCG CATCTGGTTC

1201 TCCGCCGGCA TGAAATACCA TATCGGCAAA AACCACGTCG TCGATGCCGC

1251 CTACACCCAC ATCCACATCA ACGACACCAG CTACCGCACG GCGAAGGCAA

1301 GCGGCAACGA TGTGGACAGC AAAGGCGCGT CTTCCGCACG TTTCAAAAAC

1351 CACGCCGACA TCATCGGCCT GCAATACACC TACAAATTCA AATAA
```

This corresponds to the amino acid sequence <SEQ ID 2990; ORF 989.a>:

```
a989.pep

  1 MTPSALKKTV LLLGTAFAAA SAQASGYHFG TQSVNAQSTA NAAAAEAADA

 51 STIFYNPAGL TKLDSSQISV NANIVLPSIH YEADSATDFT GLPVQGSKSG
```

-continued

```
101 KITKTTVAPH IYGAYKVNDN LTVGLGVYVP FGSATEYEKD SVLRHNINKL

151 GLTSIAVEPV AAWKLNERHS FGAGIIAQHT SAELRKYADW GIMEKAKALK

201 ETPPNPTKAA QIKADGHADV KGSDWGFGYQ LAWMWDINDR ARVGVNYRSK

251 VSHTLKGDAE WAADDAMAKQ LWDANKLALL GYTPSEKARV KIVTPESLSV

301 HGMYKVSDKA DLFGDVTWTR HSRFDKAELV FEKEKTIVNG KSDRTTITPN

351 WRNTYKVGFG GSYQISEPLQ LRAGIAFDKS PVRNADYRMN SLPDGNRIWF

401 SAGMKYHIGK NHVVDAAYTH ININDTSYRT AKASGNDVDS KGASSARFKN

451 HADIIGLQYT YKFK*
```

```
m989/a989  93.1% identity in 467 aa overlap

                        10        20        30        40        50        60
m989.pep        MTPSALKKTVLLLGTAFAAASVHASGYHFGTQSVNAQSTANAAAAEAADASTIFYNPAGL
                |||||||||||||||||||||::|||||||||||||||||||||||||||||||||||||
a989            MTPSALKKTVLLLGTAFAAASAQASGYHFGTQSVNAQSTANAAAAEAADASTIFYNPAGL
                        10        20        30        40        50        60

                        70        80        90       100       110       120
m989.pep        TKLDSSQISVNANIVLPSIHYEADSATDFTGLPVQGSKSGKITKTTVAPHIYGAYKVNDN
                ||||||||||||||||||||||||||||||||||||||||||||||||||||||||||||
a989            TKLDSSQISVNANIVLPSIHYEADSATDFTGLPVQGSKSGKITKTTVAPHIYGAYKVNDN
                        70        80        90       100       110       120

                       130       140       150       160       170       180
m989.pep        LTVGLGVYVPFGSATEYEKDSVLRHNINKLGLTSIAVEPVAAWKLNDRHSFGAGIIAQHT
                |||||||||||||||||||||||||||||||||||||||||||||:||||||||||||||
a989            LTVGLGVYVPFGSATEYEKDSVLRHNINKLGLTSIAVEPVAAWKLNERHSFGAGIIAQHT
                       130       140       150       160       170       180

                       190       200       210       220       230       240
m989.pep        SAELRKYADWGIKSKAEILTAKPPKPNGVAEAAKIQADGHADVKGSDWGFGYQLAWMWDI
                ||||||||||||  ||: |    ||:|:   :||:|:||||||||||||||||||||||||
a989            SAELRKYADWGIMEKAKALKETPPNPT---KAAQIKADGHADVKGSDWGFGYQLAWMWDI
                       190       200          210       220       230

                       250       260       270       280       290       299
m989.pep        NDRARVGVNYRSKVSHTLKGDAEWAADGAAAKAMW-STMLAANGYTANEKARVKIVTPES
                ||||||||||||||||||||||||||| | || :| :: ||  ||| :||||||||||||
a989            NDRARVGVNYRSKVSHTLKGDAEWAADDAMAKQLWDANKLALLGYTPSEKARVKIVTPES
                  240       250       260       270       280       290

              300       310       320       330       340       350      359
m989.pep        LSVHGMYKVSDKADLFGDVTWTRHSRFDKAELVFEKEKTVVKGKSDRTTITPNWRNTYKV
                |||||||||||||||||||||||||||||||||||||||:|:||||||||||||||||||
a989            LSVHGMYKVSDKADLFGDVTWTRHSRFDKAELVFEKEKTIVNGKSDRTTITPNWRNTYKV
                  300       310       320       330       340       350

              360       370       380       390       400       410      419
m989.pep        GFGGSYQISEPLQLRAGIAFDKSPVRNADYRMNSLPDGNRIWFSAGMKYHIGKNHVVDAA
                ||||||||||||||||||||||||||||||||||||||||||||||||||||||||||||
a989            GFGGSYQISEPLQLRAGIAFDKSPVRNADYRMNSLPDGNRIWFSAGMKYHIGKNHVVDAA
                  360       370       380       390       400       410

              420       430       440       450       460
m989.pep        YTHIHINDTSYRTAKASGNDVDSKGASSARFKNHADIIGLQYTYKFKX
                |||||||||||||||||||||||||||||||||||||||||||||||
a989            YTHIHINDTSYRTAKASGNDVDSKGASSARFKNHADIIGLQYTYKFKX
                  420       430       440       450       460
```

The following partial DNA sequence was identified in *N. meningitidis* <SEQ ID 2991>:

```
m990.seq
    1  ATGTTCAGAG CTCAGCTTGG TTCAAATACT CGTTCTACCA AAATCGGCGA

   51  CGATGCCGAT TTTTCATTTT CAGACAAGCC GAAACCCGGC ACTTCCCATT

  101  ATTTTTCCAG CGGTAAAACC GATCAAAATT CATCCGAATA TGGGTATGAC

  151  GAAATCAATA TCCAAGGTAA AAATTACAAT AGCGGCATCC TCGCCGTCGA

  201  TAATATGCCC GTTGTCAAAA AATATATTAC AGAGAAGTAT GGGGCTGATT

  251  TAAAGCAGGC GGTTAAAAGT CAATTACAGG ATTTATACAA AACAAGACCG

  301  GAAGCTTGGG CAGAAAATAA AAAACGGACT GAGGAGGCGT ATATAGCACA

  351  GTTTGGAACA AAATTTAGTA CGCTCAAACA GACGATGCCC GATTTAATTA
```

-continued

```
 401 ATAAATTGGT AGAAGATTCC GTACTCACTC CTCATAGTAA TACATCACAG
 451 ACTAGTCTCA ACAACATCTT CAATAAAAAA TTACACGTCA AAATCGAAAA
 501 CAAATCCCAC GTCGCCGGAC AGGTGTTGGA ACTGACCAAG ATGACGCTGA
 551 AAGATTCCCT TTGGGAACCG CGCCGCCATT CCGACATCCA TACGCTGGAA
 601 ACTTCCGATA ATGCCCGCAT CCGCCTGAAC ACGAAAGATG AAAAACTGAC
 651 CGTCCATAAG GATTATGCGG GCGGCGCGGA TTTCCTGTTC GGCTACGACG
 701 TGCGGGAGTC GGACGAACCC GCCCTGACCT TTGAAGACAA AGTCAGCGGA
 751 CAATCCGGCG TGGTTTTGGA ACGCCGGCCG GAAAATCTGA AAACGCTCGA
 801 CGGGCGCAAA CTGATTGCGG CAAAAACGGC GGATTCCGGT TCGTTTGCGT
 851 TTAAACAAAA TTACCGGCAG GGACTGTACG AATTATTGCT CAAGCAATGC
 901 GAAGGCGGAT TTTGCTTGGG CGTGCAGCGT TTGGCTATCC CCGAGGCGGA
 951 AGCGGTTTTA TATGCCCAAC AGGCTTATGC GGCAAATACT TTGTTTGGGC
1001 TGCGTGCCGC CGACAGGGGC GACGACGTGT ATGCCGCCGA TCCGTCCCGT
1051 CAAAAATTGT GGCTGCGCTT CATCGGCGGC CGGTCGCATC AAAATATACG
1101 GGGCGGCGCG GCTGCGGACG GGTGGCGCAA AGGCGTGCAA ATCGGCGGCG
1151 AGGTGTTTGT ACGGCAAAAT GAAGGCAGCC GACTGGCAAT CGGCGTGATG
1201 GGCGGCAGGG CCGGCCAGCA CGCATCAGTC AACGGCAAAG GCGGTGCGGC
1251 AGGCAGTGAT TTGTATGGTT ATGGCGGGGG TGTTTATGCT GCGTGGCATC
1301 AGTTGCGCGA TAAACAAACG GGTGCGTATT TGGACGGCTG GTTGCAATAC
1351 CAACGTTTCA AACACCGCAT CAATGATGAA AACCGTGCGG AACGCTACAA
1401 AACCAAAGGT TGGACGGCTT CTGTCGAAGG CGGCTACAAC GCGCTTGTGG
1451 CGGAAGGCAT TGTCGGAAAA GGCAATAATG TGCGGTTTTA CCTACAACCG
1501 CAGGCGCAGT TTACCTACTT GGGCGTAAAC GGCGGCTTTA CCGACAGCGA
1551 GGGGACGGCG GTCGGACTGC TCGGCAGCGG TCAGTGGCAA AGCCGCGCCG
1601 GCATTCGGGC AAAAACCCGT TTTGCTTTGC GTAACGGTGT CAATCTTCAG
1651 CCTTTTGCCG CTTTTAATGT TTTGCACAGG TCAAAATCTT TCGGCGTGGA
1701 AATGGACGGC GAAAAACAGA CGCTGGCAGG CAGGACGGCA CTCGAAGGGC
1751 GGTTCGGTAT TGAAGCCGGT TGGAAAGGCC ATATGTCCGC ACGCATCGGA
1801 TATGGCAAAA GGACGGACGG CGACAAAGAA GCCGCATTGT CGCTCAAATG
1851 GCTGTTTTGA
```

This corresponds to the amino acid sequence <SEQ ID 2992; ORF 990>:

```
m990.pep
   1 MFRAQLGSNT RSTKIGDDAD FSFSDKPKPG TSHYFSSGKT DQNSSEYGYD
  51 EINIQGKNYN SGILAVDNMP VVKKYITEKY GADLKQAVKS QLQDLYKTRP
 101 EAWAENKKRT EEAYIAQFGT KFSTLKQTMP DLINKLVEDS VLTPHSNTSQ
 151 TSLNNIFNKK LHVKIENKSH VAGQVLELTK MTLKDSLWEP RRHSDIHTLE
 201 TSDNARIRLN TKDEKLTVHK DYAGGADFLF GYDVRESDEP ALTFEDKVSG
 251 QSGVVLERRP ENLKTLDGRK LIAAKTADSG SFAFKQNYRQ GLYELLLKQC
 301 EGGFCLGVQR LAIPEAEAVL YAQQAYAANT LFGLRAADRG DDVYAADPSR
```

-continued

```
351 QKLWLRFIGG RSHQNIRGGA AADGWRKGVQ IGGEVFVRQN EGSRLAIGVM

401 GGRAGQHASV NGKGGAAGSD LYGYGGGVYA AWHQLRDKQT GAYLDGWLQY

451 QRFKHRINDE NRAERYKTKG WTASVEGGYN ALVAEGIVGK GNNVRFYLQP

501 QAQFTYLGVN GGFTDSEGTA VGLLGSGQWQ SRAGIRAKTR FALRNGVNLQ

551 PFAAFNVLHR SKSFGVEMDG EKQTLAGRTA LEGRFGIEAG WKGHMSARIG

601 YGKRTDGDKE AALSLKWLF*
```

The following partial DNA sequence was identified in *N. meningitidis* <SEQ ID 2993>:

```
a990.seq
   1 ATGTTCAGAG CTCAGCTTGG TTCAAATACT CGTTCTACCA AAATCGGCGA

  51 CGATGCCGAT TTTTCATTTT CAGACAAGCC GAAACCCGGC ACTTCCCATT

 101 ATTTTTCCAG CGGTAAAACC GATCAAAATT CATCCGAATA TGGGTATGAC

 151 GAAATCAATA TCCAAGGTAA AAACTACAAT AGCGGCATAC TCGCCGTCGA

 201 TAATATGCCC GTTGTTAAGA AATATATTAC AGATACTTAC GGGGATAATT

 251 TAAAGGATGC GGTTAAGAAG CAATTACAGG ATTTATACAA AACAAGACCC

 301 GAAGCTTGGG AAGAAAATAA AAAACGGACT GAGGAGGCGT ATATAGAACA

 351 GCTTGGACCA AAATTTAGTA TACTCAAACA GAAAAACCCC GATTTAATTA

 401 ATAAATTGGT AGAAGATTCC GTACTCACTC CTCATAGTAA TACATCACAG

 451 ACTAGTCTCA ACAACATCTT CAATAAAAAA TTACACGTCA AAATCGAAAA

 501 CAAATCCCAC GTCGCCGGAC AGGTGTTGGA ACTGACCAAG ATGACGCTGA

 551 AAGATTCCCT TTGGGAACCG CGCCGCCATT CCGACATCCA TATGCTGGAA

 601 ACTTCCGATA ATGCCCGCAT CCGCCTGAAC ACGAAAGATG AAAAACTGAC

 651 CGTCCATAAA GCGTATCAGG GCGGTGCGGA TTTCCTGTTC GGCTACGACG

 701 TGCGGGAGTC GGACAAACCC GCCCTGACCT TTGAAGAAAA AGTCAGCGGA

 751 CAATCCGGCG TGGTTTTGGA ACGCCGGCCG GAAAATCTGA AAACGCTCGA

 801 CGGGCGCAAA CTGATTGCGG CGGAAAAGGC AGACTCTAAT TCGTTTGCGT

 851 TTAAACAAAA TTACCGGCAG GGACTGTACG AATTATTGCT CAAGCAATGC

 901 GAAGGCGGAT TTTGCTTGGG CGTGCAGCGT TTGGCTATCC CCGAGGCGGA

 951 AGCGGTTTTA TATGCCCAAC AGGCTTATGC GGCAAATACT TTGTTCGGGC

1001 TGCGTGCCGC CGACAGGGGC GACGACGTGT ATGCCGCCGA TCCGTCCCGT

1051 CAAAAATTGT GGCTGCGCTT CATCGGCGGC CGGTCGCATC AAAATATACG

1101 GGGCGGCGCG GCTGCGGACG GGCGGCGCAA AGGCGTGCAA ATCGGCGGCG

1151 AGGTGTTTGT ACGGCAAAAT GAAGGCAGCC GGCTGGCAAT CGGCGTGATG

1201 GGCGGCAGGG CTGGCCAGCA CGCATCAGTC AACGGCAAAG GCGGTGCGGC

1251 AGGCAGTTAT TTGCATGGTT ATGGCGGGGG TGTTTATGCT GCGTGGCATC

1301 AGTTGCGCGA TAAACAAACG GGTGCGTATT TGGACGGCTG GTTGCAATAC

1351 CAACGTTTCA AACACCGCAT CAATGATGAA AACCGTGCGG AACGCTACAA

1401 AACCAAAGGT TGGACGGCTT CTGTCGAAGG CGGCTACAAC GCGCTTGTGG

1451 CGGAAGGCGT TGTCGGAAAA GGCAATAATG TGCGGTTTTA CCTGCAACCG

1501 CAGGCGCAGT TTACCTACTT GGGCGTAAAC GGCGGCTTTA CCGACAGCGA
```

-continued

```
1551 GGGGACGGCG GTCGGACTGC TCGGCAGCGG TCAGTGGCAA AGCCGCGCCG

1601 GCATTCGGGC AAAAACCCGT TTTGCTTTGC GTAACGGTGT CAATCTTCAG

1651 CCTTTTGCCG CTTTTAATGT TTTGCACAGG TCAAAATCTT TCGGCGTGGA

1701 AATGGACGGC GAAAAACAGA CGCTGGCAGG CAGGACGGCG CTCGAAGGGC

1751 GGTTCGGCAT TGAAGCCGGT TGGAAAGGCC ATATGTCCGC ACGCATCGGA

1801 TACGGCAAAA GGACGGACGG CGACAAAGAA GCCGCATTGT CGCTCAAATG

1851 GCTGTTTTGA
```

This corresponds to the amino acid sequence <SEQ ID 2994; ORF 990.a>:

```
a990.pep

  1 MFRAQLGSNT RSTKIGDDAD FSFSDKPKPG TSHYFSSGKT DQNSSEYGYD

 51 EINIQGKNYN SGILAVDNMP VVKKYITDTY GDNLKDAVKK QLQDLYKTRP

101 EAWEENKKRT EEAYIEQLGP KFSILKQKNP DLINKLVEDS VLTPHSNTSQ

151 TSLNNIFNKK LHVKIENKSH VAGQVLELTK MTLKDSLWEP RRHSDIHMLE

201 TSDNARIRLN TKDEKLTVHK AYQGGADFLF GYDVRESDKP ALTFEEKVSG

251 QSGVVLERRP ENLKTLDGRK LIAAEKADSN SFAFKQNYRQ GLYELLLKQC

301 EGGFCLGVQR LAIPEAEAVL YAQQAYAANT LFGLRAADRG DDVYAADPSR

351 QKLWLRFIGG RSHQNIRGGA AADGRRKGVQ IGGEVFVRQN EGSRLAIGVM

401 GGRAGQHASV NGKGGAAGSY LHGYGGGVYA AWHQLRDKQT GAYLDGWLQY

451 QRFKHRINDE NRAERYKTKG WTASVEGGYN ALVAEGVVGK GNNVRFYLQP

501 QAQFTYLGVN GGFTDSEGTA VGLLGSGQWQ SRAGIRAKTR FALRNGVNLQ

551 PFAAFNVLHR SKSFGVEMDG EKQTLAGRTA LEGRFGIEAG WKGHMSARIG

601 YGKRTDGDKE AALSLKWLF*
```

```
m990/a990  96.0% identity in 619 aa overlap

                   10        20        30        40        50        60
m990.pep   MFRAQLGSNTRSTKIGDDADFSFSDKPKPGTSHYFSSGKTDQNSSEYGYDEINIQGKNYN
           ||||||||||||||||||||||||||||||||||||||||||||||||||||||||||||
a990       MFRAQLGSNTRSTKIGDDADFSFSDKPKPGTSHYFSSGKTDQNSSEYGYDEINIQGKNYN
                   10        20        30        40        50        60

                   70        80        90       100       110       120
m990.pep   SGILAVDNMPVVKKYITEKYGADLKQAVKSQLQDLYKTRPEAWAENKKRTEEAYIAQFGT
           |||||||||||||||||: || :||:|||:||||||||||||| ||||||||||| |:|
a990       SGILAVDNMPVVKKYITDTYGDNLKDAVKKQLQDLYKTRPEAWEEMKKRTEEAYIEQLGP
                   70        80        90       100       110       120

                  130       140       150       160       170       180
m990.pep   KFSTLKQTMPDLINKLVEDSVLTPHSNTSQTSLNNIFNKKLHVKIENKSHVAGQVLELTK
           ||| |||  ||||||||||||||||||||||||||||||||||||||||||||||||||
a990       KFSILKQKNPDLINKLVEDSVLTPHSNTSQTSLNNIFNKKLHVKIENKSHVAGQVLELTK
                  130       140       150       160       170       180

                  190       200       210       220       230       240
m990.pep   MTLKDSLWEPRRHSDIHTLETSDNARIRLNTKDEKLTVHKDYAGGADFLFGYDVRESDEP
           ||||||||||||||||| |||||||||||||||||||||| | |||||||||||||||:|
a990       MTLKDSLWEPRRHSDIHMLETSDNARIRLNTKDEKLTVHKAYQGGADFLFGYDVRESDKP
                  190       200       210       220       230       240

                  250       260       270       280       290       300
m990.pep   ALTFEDKVSGQSGVVLERRPENLKTLDGRKLIAAKTADSGSFAFKQNYRQGLYELLLKQC
           |||||:||||||||||||||||||||||||||||: |||:||||||||||||||||||||
a990       ALTFEEKVSGQSGVVLERRPENLKTLDGRKLIAAEKADSNSFAFKQNYRQGLYELLLKQC
                  250       260       270       280       290       300

                  310       320       330       340       350       360
m990.pep   EGGFCLGVQRLAIPEAEAVLYAQQAYAANTLFGLRAADRGDDVYAADPSRQKLWLRFIGG
           ||||||||||||||||||||||||||||||||||||||||||||||||||||||||||||
a990       EGGFCLGVQRLAIPEAEAVLYAQQAYAANTLFGLRAADRGDDVYAADPSRQKLWLRFIGG
                  310       320       330       340       350       360
```

-continued

```
                 370       380       390       400       410       420
m990.pep    RSHQNIRGGAAADGWRKGVQIGGEVFVRQNEGSRLAIGVMGGRAGQHASVNGKGGAAGSD
            |||||||||||||| |||||||||||||||||||||||||||||||||||||||||||| 
a990        RSHQNIRGGAAADGRRKGVQIGGEVFVRQNEGSRLAIGVMGGRAGQHASVNGKGGAAGSY
                 370       380       390       400       410       420

                 430       440       450       460       470       480
m990.pep    LYGYGGGVYAAWHQLRDKQTGAYLDGWLQYQRFKHTINDENRAERYKTKGWTASVEGGYN
            |:||||||||||||||||||||||||||||||||||||||||||||||||||||||||||
a990        LHGYGGGVYAAWHQLRDKQTGAYLDGWLQYQRFKHTINDENRAERYKTKGWTASVEGGYN
                 430       440       450       460       470       480

                 490       500       510       520       530       540
m990.pep    ALVAEGIVGKGNNVRFYLQPQAQFTYLGVNGGFTDSEGTAVGLLGSGQWQSRAGIRAKTR
            ||||||:|||||||||||||||||||||||||||||||||||||||||||||||||||||
a990        ALVAEGVVGKGNNVRFYLQPQAQFTYLGVNGGFTDSEGTAVGLLGSGQWQSRAGIRAKTR
                 490       500       510       520       530       540

                 550       560       570       580       590       600
m990.pep    FALRNGVNLQPFAAFNVLHRSKSFGVEMDGEKQTLAGRTALEGRFGIEAGWKGHMSARIG
            ||||||||||||||||||||||||||||||||||||||||||||||||||||||||||||
a990        FALRNGVNLQPFAAFNVLHRSKSFGVEMDGEKQTLAGRTALEGRFGIEAGWKGHMSARIG
                 550       560       570       580       590       600

                 610       620
m990.pep    YGKRTDGDKEAALSLKWLFX
            ||||||||||||||||||||
a990        YGKRTDGDKEAALSLKWLFX
                 610       620
```

The following partial DNA sequence was identified in *N. gonorrhoeae* <SEQ ID 2995>:

```
g992.seq
   1 ATGTTCAGAC GGCATCGGCA TTTGAAAAAT ATGCAGATTA AAAAAATCAT

  51 GAAATGGCTT CCCGTCGCCC TGTCGCTTTT GGGCGCGTTG GGTTATACGG

 101 GATATGACAG TGAGGCGGTG CGGACGGCGG TTGCCGTACT CGACGTACTC

 151 GGCACTGCAG GGGACGTGGG TTTCGACGCG CCCGTTCGCC GACGGGCATC

 201 GGCGAAATCC GGCCACAGCT ACACAGGCAC GGTGTCCAAA GTCTATGACG

 251 GCGATACCCT TCACGTCATC GACGGCGACG GCGCGAAACA TAAAATTCGG

 301 ATGGCGTATA TCGACGCACC GGAGATGAAA CAGGCTTACG GTACACGTTC

 351 GCGCGACAAC CTGCGCGCGG CGGCGGAGGG TAGGAAAGTC AGTGTACGTG

 401 TGTTTGAAAC CGACCGCTAT CAGCGCGAAG TGGCGCAGGT ATCCGCCGGC

 451 AAAACCGATT TGAACCTGAT GCAGGTGCAG GACGGGGCGG CGTGGCATTA

 501 TAAAAGTTAT GCTAAAGAAC AGCAGGATAA GGCGGATTTT GCCGACTATG

 551 CCGACGCTCA AATTCAGGCG GAAAGGGAAC GCAAAGGATT GTGGAAAGCT

 601 AAAAATCCGC AAGCGCCGTG GGCGTACCGC CGGGCAGGCA GGAGCGGCGG

 651 GGGCAATAAG GATTGGATGG ATTCCGTGGG CGAATGGTTG GGCATTTGGT

 701 AA
```

This corresponds to the amino acid sequence <SEQ ID 2996 ORF 992.ng>:

```
g992.pep
   1 MFRRHRHLKN MQIKKIMKWL PVALSLLGAL GYTGYDSEAV RTAVAVLDVL

  51 GTAGDVGFDA PVRRRASAKS GHSYTGTVSK VYDGDTLHVI DGDGAKHKIR

 101 MAYIDAPEMK QAYGTRSRDN LRAAAEGRKV SVRVFETDRY QREVAQVSAG

 151 KTDLNLMQVQ DGAAWHYKSY AKEQQDKADF ADYADAQIQA ERERKGLWKA

 201 KNPQAPWAYR RAGRSGGGNK DWMDSVGEWL GIW*
```

The following partial DNA sequence was identified in *N. meningitidis* <SEQ ID 2997>:

```
m992.seq
   1 ATGTTCAGAC GGCATCGGCA TTTGAAAAAT ATGCAGATTA AAAAAATCAT

  51 GAAATGGCTT CCCGTCGCCC TGTCGCTTTT GGGTGCGTTG GGTTATACGG

 101 GGTACGGCAG CGAGGCGGTG CGGACGGCGG TTGCCGTACT CGACGTACTC

 151 GGCGCGGCAG GGGACGCGGG TTCCGACGCG CCCGCCCGCC GCCGAGCATC

 201 GGCGAAATCC GGCCACCGCT ACACAGGCAC GGTGTCCAAA GTCTATGACG

 251 GCGACACCCT TCACGTTATC GACGGCGACG GCGCGAAACA CAAAATCCGG

 301 ATGGCGTATA TCGACGCGCC GGAGATGAAA CAGGCTTACG GCACGCGTTC

 351 GCGCGACAAC CTGCGCGCGG CGGCGGAAGG CAGGAAAGTC AGCGTGCGCG

 401 TGTTCGATAC CGACCGCTAC CAGCGCGAAG TGGCGCAGGT TTCTGTCGGC

 451 AAAACCGATT TGAACCTGAT GCAGGTGCAG GACGGGGCGG CGTGGCATTA

 501 TAAAAGTTAT GCTAAAGAAC AGCAGGATAA GGCGGATTTT GCCGATTATG

 551 CCGACGCTCA AATTCAGGCG GAAAGGGAAC GCAAAGGATT GTGGAAAGCT

 601 AAAAATCCGC AAGCGCCGTG GGCGTACCGC CGAGCAGGCA GGAGCGGCGG

 651 GGGCAATAAG GATTGGATGG ATGCCGTGGG CGAATGGTTG GGCATTTGGT

 701 AA
```

This corresponds to the amino acid sequence <SEQ ID 2998; ORF 992>:

```
m992.pep
   1 MFRRHRHLKN MQIKKIMKWL PVALSLLGAL GYTGYGSEAV RTAVAVLDVL

  51 GAAGDAGSDA PARRRASAKS GHRYTGTVSK VYDGDTLHVI DGDGAKHKIR

 101 MAYIDAPEMK QAYGTRSRDN LRAAAEGRKV SVRVFDTDRY QREVAQVSVG

 151 KTDLNLMQVQ DGAAWHYKSY AKEQQDKADF ADYADAQIQA ERERKGLWKA

 201 KNPQAPWAYR RAGRSGGGNK DWMDAVGEWL GIW*
```

Computer analysis of this amino acid sequence gave the following results:

Homology with a Predicted ORF from *N. gonorrhoeae*

ORF 992 shows 96.1% identity over a 233 aa overlap with a predicted ORF (ORF 992) from *N. gonorrhoeae*

```
m992/g992   96.1% identity in 233 aa overlap

                    10        20        30        40        50        60
m992.pep    MFRRHRHLKNMQIKKIMKWLPVALSLLGALGYTGYGSEAVRTAVAVLDVLGAAGDAGSDA
            |||||||||||||||||||||||||||||||||||| ||||||||||||||:|||:| ||
g992        MFRRHRHLKNMQIKKIMKWLPVALSLLGALGYTGYDSEAVRTAVAVLDVLGTAGDVGFDA
                    10        20        30        40        50        60

                    70        80        90       100       110       120
m992.pep    PARRRASAKSGHRYTGTVSKVYDGDTLHVIDGDGAKHKIRMAYIDAPEMKQAYGTRSRDN
            |:|||||||||| |||||||||||||||||||||||||||||||||||||||||||||||
g992        PVRRRASAKSGHSYTGTVSKVYDGDTLHVIDGDGAKHKIRMAYIDAPEMKQAYGTRSRDN
                    70        80        90       100       110       120

                   130       140       150       160       170       180
m992.pep    LRAAAEGRKVSVRVFDTDRYQREVAQVSVGKTDLNLMQVQGGAAWHYKSYAKEQQDKADF
            |||||||||||||||:|||||||||||:||||||||||||||||||||||||||||||||
g992        LRAAAEGRKVSVRVFETDRYQREVAQVSAGKTDLNLMQVQDGAAWHYKSYAKEQQDKADF
                   130       140       150       160       170       180

                   190       200       210       220       230
m992.pep    ADYADAQIQAERERKGLWKAKNPQAPWAYRRAGRSGGGNKDWMDAVGEWLGIWX
            |||||||||||||||||||||||||||||||||||||||||||||:|||||||||
g992        ADYADAQIQAERERKGLWKAKNPQAPWAYRRAGRSGGGNKDWMDSVGEWLGIWX
                   190       200       210       220       230
```

The following partial DNA sequence was identified in *N. meningitidis* <SEQ ID 2999>:

```
a992.seq
   1 ATGTTCAGAC GGCATCGGCA TTTGAAAAAT ATGCAGATTA AAAAAATCAT

  51 GAAATGGCTT CCCGTCGCCT TGTCGCTTTT GGGTGCGTTG GGTTATACGG

 101 GGTACGGCAG CGAGGCGGTG CGGACGGCGG TTGCCGTACT CGACGTACTC

 151 GGCGCGGCAG GGGACGCGGG TTCCGACGCG CCCGCCCGCC GCCGAGCATC

 201 GGCGAAATCC GGCCACCGCT ACACAGGCAC GGTGTCCAAA GTCTATGACG

 251 GCGACACCCT TCACGTTATC GACGGCGACG GCGCGAAACA CAAAATCCGG

 301 ATGGCGTATA TCGACGCGCC GGAGATGAAA CAGGCTTACG GCACGCGTTC

 351 GCGCGACAAC CTGCGCGCGG CGGCGGAAGG CAGGAAAGTC AGCGTCCGCG

 401 TGTTCGACAC CGACCGCTAC CAGCGCGAAG TGGCGCAGGT TTCTGTCGGC

 451 AAAACCGATT TGAACCTGAT GCAGGTGCAG GACGGGGCGG CGTGGCATTA

 501 TAAAAGTTAT GCTAAAGAAC AGCAGGATAA GGCGGATTTT GCCGATTATG

 551 CCGACGCTCA AATTCAGGCG GAAAGGGAAC GCAAAGGATT GTGGAAAGCT

 601 AAAAATCCGC AAGCGCCGTG GGCGTACCGC CGGGCAGGCA GGAGCGGCGG

 651 GGGCAATAAG GATTGGATGG ATGCCGTGGG CGAATGGTTG GGCATTTGGT

 701 AA
```

This corresponds to the amino acid sequence <SEQ ID 3000; ORF 992.a>:

```
a992.pep
   1 MFRRHRHLKN MQIKKIMKWL PVALSLLGAL GYTGYGSEAV RTAVAVLDVL

  51 GAAGDAGSDA PARRRASAKS GHRYTGTVSK VYDGDTLHVI DGDGAKHKIR

 101 MAYIDAPEMK QAYGTRSRDN LRAAAEGRKV SVRVFDTDRY QREVAQVSVG

 151 KTDLNLMQVQ DGAAWHYKSY AKEQQDKADF ADYADAQIQA ERERKGLWKA

 201 KNPQAPWAYR RAGRSGGGNK DWMDAVGEWL GIW*
```

Computer analysis of this amino acid sequence gave the following results:

Homology with a Predicted ORF from *N. meningitidis*

ORF 992 shows 100.0% identity over a 233 aa overlap with a predicted ORF (ORF 992) from *N. meningitidis*

```
a992/m992   100.0% identity in 233 aa overlap

                     10        20        30        40        50        60
a992.pep    MFRRHRHLKNMQIKKIMKWLPVALSLLGALGYTGYGSEAVRTAVAVLDVLGAAGDAGSDA
            ||||||||||||||||||||||||||||||||||||||||||||||||||||||||||||
m992        MFRRHRHLKNMQIKKIMKWLPVALSLLGALGYTGYGSEAVRTAVAVLDVLGAAGDAGSDA
                     10        20        30        40        50        60

                     70        80        90       100       110       120
a992.pep    PARRRASAKSGHRYTGTVSKVYDGDTLHVIDGDGAKHKIRMAYIDAPEMKQAYGTRSRDN
            ||||||||||||||||||||||||||||||||||||||||||||||||||||||||||||
m992        PARRRASAKSGHRYTGTVSKVYDGDTLHVIDGDGAKHKIRMAYIDAPEMKQAYGTRSRDN
                     70        80        90       100       110       120

                    130       140       150       160       170       180
a992.pep    LRAAAEGRKVSVRVFDTDRYQREVAQVSVGKTDLNLMQVQDGAAWHYKSYAKEQQDKADF
            ||||||||||||||||||||||||||||||||||||||||||||||||||||||||||||
m992        LRAAAEGRKVSVRVFDTDRYQREVAQVSVGKTDLNLMQVQDGAAWHYKSYAKEQQDKADF
                    130       140       150       160       170       180

                    190       200       210       220       230
a992.pep    ADYADAQIQAERERKGLWKAKNPQAPWAYRRAGRSGGGNKDWMDAVGEWLGIWX
            ||||||||||||||||||||||||||||||||||||||||||||||||||||||
m992        ADYADAQIQAERERKGLWKAKNPQAPWAYRRAGRSGGGNKDWMDAVGEWLGIWX
                    190       200       210       220       230
```

The following partial DNA sequence was identified in *N. gonorrhoeae* <SEQ ID 3001>:

```
g993.seq
   1 CTGAAAGTCG TATTGGGCAG TTTTCAAGGC CCTTTGGATC TGCTGCTCTA

  51 CCTTATCCGC AAGCAGAACA TCGATGTTCT CGATATTCCG ATGGTGGAAA

 101 TTACCGGGCA GTATCTGCAC TATATTGCCC AAATGGAAGC CTATCAGTTT

 151 GATTTGGCGG CGGAATATCT TTTGATGGCG GCAATGCTGA TTGAAATCAA

 201 ATCGCGCCTG CTGCTGCCGC GTACCGAAGC CGTCGAAGAC GAAGAGGCCG

 251 ACCCGCGTGC CGAGTTGGTG CGCCGTCTGC TTGCCTACGA GCAAATGAAA

 301 CTGGCGGCGC AGGGTTTGGA CGCGCTGCCG CGTGCGGGAC GGGATTTCGC

 351 GTGGGCTTAC CTGCCGCTGG AAATTGCAGC CGAGACGAAG CTGCCCGAGG

 401 TTTACATCGC CGATTTGATG CAGGCATGGT TGGGCATTCT TTCTCGGGCA

 451 AAACATACGC GCAGCCACGA AGTAATCCAA GAAACCCTTT CCGTGCGCGC

 501 GCAAATGACG GCAATCCTGC GCCGTTTGAA CGAACACGGG ATATGCAGGT

 551 TTCACGCCCT GTTCAATCCC GAACAGGGCG CGGCTTACGT GATCGTCAAC

 601 TTCATCGCCC TGTTGGAGCT TGCCAAAGAA GGATTGGTCG GAATCGTACA

 651 GGAAGACGGT TTCGGAGAAA TCCGAATCAG CCTCAATCAT GAGGGGGCGC

 701 ATTCAGACGG CATTTTCGGC ACACGGGGCG GGCGCGATGT GTTCTAA
```

This corresponds to the amino acid sequence <SEQ ID 3002 ORF 993.ng>:

```
g993.pep
   1 LKVVLGSFQG PLDLLLYLIR KQNIDVLDIP MVEITGQYLH YIAQMEAYQF

  51 DLAAEYLLMA AMLIEIKSRL LLPRTEAVED EEADPRAELV RRLLAYEQMK

 101 LAAQGLDALP RAGRDFAWAY LPLEIAAETK LPEVYIADLM QAWLGILSRA

 151 KHTRSHEVIQ ETLSVRAQMT AILRRLNEHG ICRFHALFNP EQGAAYVIVN

 201 FIALLELAKE GLVGIVQEDG FGEIRISLNH EGAHSDGIFG TRGGRDVF*
```

The following partial DNA sequence was identified in *N. meningitidis* <SEQ ID 3003>:

```
m993.seq
   1 TTGAAAGTCG TATTGGGCAG CTTCCAAGGC CCTTTGGATC TACTGCTGTA

  51 TCTGATCCGC AAACAGAATA TCGACGTACT GGATATTCCG ATGGTGAAGA

 101 TTACCGAGCA GTATCTGCAC TACATCGCCC AAATAGAAAC CTATCAGTTT

 151 GATTTGGCGG CGGAATATCT TTTGATGGCA GCAATGCTGA TTGAAATCAA

 201 ATCGCGCCTG CTGCTGCCGC GTACCGAAAC CGTCGAAGAC GAAGAAGCCG

 251 ACCCGCGTGC CGAGTTGGTG CGCCGCCTGC TGGCTTACGA ACAGATGAAG

 301 CTGGCGGCGC AGGGTTTGGA CGCGCTGCCC CGAGCCGGAC GGGATTTCGC

 351 GTGGGCTTAC CTGCCGCTGG AAATTGCCGT CGAAGCCAAG CTGCCCGAAG

 401 TCTATATTAC CGACTTGACG CAAGCGTGGC TGGGTATTTT GTCTCGGGCA

 451 AAACACACGC GCAGCCACGA AGTAATCAAA GAAACCATCT CCGTGCGCGC

 501 GCAAATGACG GCAATCCTGC GCCGTTTGAA CGGACACGGA ATATGCAGGT

 551 TTCACGACCT GTTCAATCCC AAACAGGGCG CGGCTTACGT GGTCGTCAAC
```

-continued

```
601 TTCATCGCAC TGTTGGAGCT TGCCAAAGAA GGATTGGTCA GAATCGTGCA

651 GGAAGACGGT TTCGGAGAAA TCCGAATCAG CCTCAATCAT GAGGGGGCGC

701 ATTCAGACGG CATTTCCGGC ACACGAGGCG GGCGCGATGT GTTCTAA
```

This corresponds to the amino acid sequence <SEQ ID 3004; ORF 993>:

```
m993.pep
   1 LKVVLGSFQG PLDLLLYLIR KQNIDVLDIP MVKITEQYLH YIAQIETYQF

  51 DLAAEYLLMA AMLIEIKSRL LLPRTETVED EEADPRAELV RRLLAYEQMK

 101 LAAQGLDALP RAGRDFAWAY LPLEIAVEAK LPEVYITDLT QAWLGILSRA

 151 KHTRSHEVIK ETISVRAQMT AILRRLNGHG ICRFHDLFNP KQGAAYVVVN

 201 FIALLELAKE GLVRIVQEDG FGEIRISLNH EGAHSDGISG TRGGRDVF*
```

Computer analysis of this amino acid sequence gave the following results:

Homology with a Predicted ORF from *N. gonorrhoeae*

ORF 993 shows 93.1% identity over a 248 aa overlap with a predicted ORF (ORF 993) from *N. gonorrhoeae*

```
m993/g993   93.1% identity in 248 aa overlap

                     10        20        30        40        50        60
m993.pep    LKVVLGSFQGPLDLLLYLIRKQNIDVLDIPMVKITEQYLHYIAQIETYQFDLAAEYLLMA
            |||||||||||||||||||||||||||||||:|| |||||||:|:|||||||||||||
g993        LKVVLGSFQGPLDLLLYLIRKQNIDVLDIPMVEITGQYLHYIAQMEAYQFDLAAEYLLMA
                     10        20        30        40        50        60

                     70        80        90       100       110       120
m993.pep    AMLIEIKSRLLLPRTETVEDEEADPRAELVRRLLAYEQMKLAAQGLDALPRAGRDFAWAY
            |||||||||||||||:||||||||||||||||||||||||||||||||||||||||||||
g993        AMLIEIKSRLLLPRTEAVEDEEADPRAELVRRLLAYEQMKLAAQGLDALPRAGRDFAWAY
                     70        80        90       100       110       120

                    130       140       150       160       170       180
m993.pep    LPLEIAVEAKLPEVYITDLTQAWLGILSREKHTRSHEVIKETISVRAQMTAILRRLNGHG
            ||||||:|:|||||||:|||||||||||||||||||||:||:||||||||||||| ||
g993        LPLEIAAETKLPEVYIADLMQAWLGILSRAKHTRSHEVIQETLSVREQMTAILRRLNEHG
                    130       140       150       160       170       180

                    190       200       210       220       230       240
m993.pep    ICRFHDLFNPKQGAAYVVVNFIALLELAKEGLVRIVQEDGFGEIRISLNHEGAHSDGISG
            ||||| ||||:||||||:||||||||||||||| |||||||||||||||||||||||| |
g993        ICRFHALFNPEQGAAYVIVNFIALLELAKEGLVGIVQEDGFGEIRISLNHEGAHSDGIFG
                    190       200       210       220       230       240

                  249
m993.pep    TRGGRDVFX
            |||||||||
g993        TRGGRDVFX
```

The following partial DNA sequence was identified in *N. meningitidis* <SEQ ID 3005>:

```
a993.seq
   1 CTGAAAGTCG TATTGAGCAG TTTTCAAGGC CCTTTGGATC TGCTGCTCTA

  51 CCTTATCCGC AAGCAGAACA TCGATGTTCT CGATATTCCG ATGGTGAAGA

 101 TTACCGAACA GTATCTGCAC TACATCGCCC AAATAGAAAC CTATCAGTTT

 151 GATTTGGCGG CGGAATATCT TTTGATGGCA GCAATGCTGA TTGAAATCAA

 201 ATCGCGCCTG CTGCTGCCGC GTACCGAAAC CGTCGAAGAC GAAGAAGCCG

 251 ACCCGCGTGC CGAGTTGGTG CGCCGCCTGC TGGCTTACGA GCAGATGAAG

 301 CTGGCGGCAC AAGGGTTGGA TGCGCTTCCT CGTGCGGGCC GGGATTTCGC

 351 ATGGGCATAC CTGCCACTGG AAATTGCCGT CGAAGCCAAG CTGCCCGAAG

 401 TCTATATTAC CGACTTGACG CAGGCGTGGC TGAGTATTTT GTCTCGGGCA
```

-continued

```
451 AAACATACGC GCAGCCACGA AGTTATCAAA GAAACCATCT CCGTGCGCGC

501 GCAAATGACG GCAATCCTGC GCCGTTTGAA CAAACACGGG ATATGCAGGT

551 TTCACGACCT GTTCAATCCC GAACAGGGCG CGGCTTACGT GGTCGTCAAC

601 TTCATCGCAC TGTTGGAGCT TGCCAAAGAA GGTTTGGTCG GAATCGTACA

651 GGAAGTCGGT TTCGGAGAAA TCCGAATCAG CCTCAATCAT GAGGGGGCGC

701 ATTCAGACGG CATTTCCGGC ACACGGGGCG GGCGCGATGT GTTCTAA
```

This corresponds to the amino acid sequence <SEQ ID 3006; ORF 993.a>:

```
a993.pep
   1 LKVVLSSFQG PLDLLLYLIR KQNIDVLDIP MVKITEQYLH YIAQIETYQF

  51 DLAAEYLLMA AMLIEIKSRL LLPRTETVED EEADPRAELV RRLLAYEQMK

 101 LAAQGLDALP RAGRDFAWAY LPLEIAVEAK LPEVYITDLT QAWLSILSRA

 151 KHTRSHEVIK ETISVRAQMT AILRRLNKHG ICRFHDLFNP EQGAAYVVVN

 201 FIALLELAKE GLVGIVQEVG FGEIRISLNH EGAHSDGISG TRGGRDVF*
```

Computer analysis of this amino acid sequence gave the following results:

Homology with a Predicted ORF from *N. meningitidis*

ORF 993 shows 97.6% identity over a 248 aa overlap with a predicted ORF (ORF 993) from *N. meningitidis*

```
a993/m993   97.6% identity in 248 aa overlap

                    10        20        30        40        50        60
a993.pep    LKVVLSSFQGPLDLLLYLIRKQNIDVLDIPMVKITEQYLHYIAQIETYQFDLAAEYLLMA
            |||||:||||||||||||||||||||||||||||||||||||||||||||||||||||||
m993        LKVVLGSFQGPLDLLLYLIRKQNIDVLDIPMVKITEQYLHYIAQIETYQFDLAAEYLLMA
                    10        20        30        40        50        60

                    70        80        90       100       110       120
a993.pep    AMLIEIKSRLLLPRTETVEDEEADPRAELVRRLLAYEQMKLAAQGLDALPRAGRDFAWAY
            ||||||||||||||||||||||||||||||||||||||||||||||||||||||||||||
m993        AMLIEIKSRLLLPRTETVEDEEADPRAELVRRLLAYEQMKLAAQGLDALPRAGRDFAWAY
                    70        80        90       100       110       120

                   130       140       150       160       170       180
a993.pep    LPLEIAVEAKLPEVYITDLTQAWLSILSRAKHTRSHEVIKETISVRAQMTAILRRLNKHG
            ||||||||||||||||||||||||:||||||||||||||||||||||||||||||||| ||
m993        LPLEIAVEAKLPEVYITDLTQAWLGILSRAKHTRSHEVIKETISVRAQMTAILRRLNGHG
                   130       140       150       160       170       180

                   190       200       210       220       230       240
a993.pep    ICRFHDLFNPEQGAAYVVVNFIALLELAKEGLVGIVQEVGFGEIRISLNHEGAHSDGISG
            ||||||||||:||||||||||||||||||||||| |||| ||||||||||||||||||||
m993        ICRFHDLFNPKQGAAYVVVNFIALLELAKEGLVRIVQEDGFGEIRISLNHEGAHSDGISG
                   190       200       210       220       230       240

                  249
a993.pep    TRGGRDVFX
            |||||||||
m993        TRGGRDVFX
```

The following partial DNA sequence was identified in *N. gonorrhoeae* <SEQ ID 3007>:

```
g996.seq
   1 ATGAACAGAA GAACCTTCCT CCTCGGCGCA GGCGCGTTGC TTCTTACCGC

  51 CTGCGGCAGA AAATCCGCCC GAACCCACGC CAAAATTCCC GAAGGAAGCA

 101 CCGTGCTTGC CTTGGGCGAT TCGCTCACCT TCGGCTACGG AGCAAACCCC

 151 GGCGAATCCT ACCCCGCGCA ACTGCAAAAA CTGACGGGTT GGAATATTGT

 201 CAACGGCGGC GTATCGGGCG ATACGTCCGC GCAAGCCCTA TCGCGCCTGC
```

-continued

```
251 CCGCGCTGTT GGCACGCAAA CCCAAGCTTG TGATTGTCGG CATAGGCGGC

301 AACGACTTTC TGCGCAAAGT TCCCGAGGAG CAGACCCGCG CCAATATCGC

351 GAAAATCATC GAAACCGTGC AAAAGGAAAA CATTCCCGCC GTCCTCGTCG

401 GCGTGCCGCA CATCACACTG GGCGCGTTGT TCGGGCATTT GAGCGACCAT

451 CCGCTGTATG AGGATTTGTC CGAGGAATAC GGCATTCCGT TGTTCGGCGG

501 CGCGTGGGCG GAAATTTTGG GCAATAATAA TCTGAAATCC GACCAAATCC

551 ACGCCAACGG CAAAGGCTAT CGGAAATTCG CCGAAAATTT GAATCAATTT

601 TTGAGAAAAC ATGGGTTTAG ATAA
```

This corresponds to the amino acid sequence <SEQ ID 3008 ORF 996.ng>:

```
g996.pep
  1 MNRRTFLLGA GALLLTACGR KSARTHAKIP EGSTVLALGD SLTFGYGANP

 51 GESYPAQLQK LTGWNIVNGG VSGDTSAQAL SRLPALLARK PKLVIVGIGG

101 NDFLRKVPEE QTRANIAKII ETVQKENIPA VLVGVPHITL GALFGHLSDH

151 PLYEDLSEEY GIPLFGGAWA EILGNNNLKS DQIHANGKGY RKFAENLNQF

201 LRKHGFR*
```

The following partial DNA sequence was identified in *N. meningitidis* <SEQ ID 3009>:

```
m996.seq
  1 ATGAACAGAA GAACCTTCCT CCTCGGCGCA GGCGCGTTGC TGCTTACCGC

 51 CTGCGGCAGA AAATCCGCCC GAACCCACGC CAAAATTCCC GAAGGAAGCA

101 CCGTACTTGC CTTGGGCGAT TCGCTTACCT TCGGCTACGG CGCAAACCCT

151 GGCGAATCCT ACCCCGCGCA ACTGCAAAAA CTGACGGGTT GGAATATTGT

201 CAACGGCGGC GTATCGGGCG ATACATCTGC CCAAGCCCTG TCGCGCCTGC

251 CCGCGCTGTT GGCACGCAAA CCCAAGCTTG TGATTGTCGG CATAGGCGGC

301 AACGACTTTC TGCGCAAAGT TCCCAAGGAG CAGACCCGCG CCAATATCGC

351 GAAAATCATC GAAACCGTGC AGAAGGAAAA CATCCCCGCC GTCCTCGTCG

401 GCGTGCCGCA CATCACACTG GGTGCGTTGT TCGGGCATTT GAGCGATCAT

451 CCGCTGTATG AGGATTTGTC CGAGGAATAC GGCATTCCGC TGTTCGGCGG

501 CGCGTGGGCG GAAATTTTGG GCGATAATAA TCTGAAATCC GACCAAATCC

551 ACGCCAACGG CAAAGGCTAT CGGAAATTTG CCGAAGATTT GAATCAATTT

601 TTGAGAAAAC AGGGGTTTAG ATAA
```

This corresponds to the amino acid sequence <SEQ ID 3010; ORF 996>:

```
m996.pep
  1 MNRRTFLLGA GALLLTACGR KSARTHAKIP EGSTVLALGD SLTFGYGANP

 51 GESYPAQLQK LTGWNIVNGG VSGDTSAQAL SRLPALLARK PKLVIVGIGG

101 NDFLRKVPKE QTRANIAKII ETVQKENIPA VLVGVPHITL GALFGHLSDH

151 PLYEDLSEEY GIPLFGGAWA EILGDNNLKS DQIHANGKGY RKFAEDLNQF

201 LRKQGFR
```

Computer analysis of this amino acid sequence gave the following results:

Homology with a Predicted ORF from *N. gonorrhoeae*

ORF 996 shows 98.1% identity over a 207 aa overlap with a predicted ORF (ORF 996) from *N. gonorrhoeae*

```
m996/g996  98.1% identity in 207 aa overlap

                   10        20        30        40        50        60
m996.pep   MNRRTFLLGAGALLLTACGRKSARTHAKIPEGSTVLALGDSLTFGYGANPGESYPAQLQK
           ||||||||||||||||||||||||||||||||||||||||||||||||||||||||||||
g996       MNRRTFLLGAGALLLTACGRKSARTHAKIPEGSTBLALGDSLTGGYGANPGESYPAQLQK
                   10        20        30        40        50        60

                   70        80        90       100       110       120
m996.pep   LTGWNIVNGGVSGDTSAQALSRLPALLARKPKLVIVGIGGNDFLRKVPKEQTRANIAKII
           ||||||||||||||||||||||||||||||||||||||||||||||||:|||||||||||
g996       LTGWNIVNGGVSGDTSAQALSRLPALLARKPKLVIVGIGGNDFLRKVPEEQTRANIAKII
                   70        80        90       100       110       120

                  130       140       150       160       170       180
m999.pep   ETVQKENIPAVLVGVPHITLGALFGHLSDHPLYEDLSEEYGIPLFGGAWAEILGDNNLKS
           ||||||||||||||||||||||||||||||||||||||||||||||||||||||:|||||
g996       ETVQKENIPAVLVGVPHITLGALFGHLSDHPLYEDLSEEYGIPLFGGAWAEILGNNNLKS
                  130       140       150       160       170       180

                  190       200
m996.pep   DQIHANGKGYRKFAEDLNQFLRKQGFR
           ||||||||||||||:|||||||:|||
g996       DQIHANGKGYRKFAENLNQFLRKHGFRX
                  190       200
```

The following partial DNA sequence was identified in *N. meningitidis* <SEQ ID 3011>:

```
a996.seq
   1 ATGAACAGAA GAACCTTCCT CCTCGGCGCA GGCGCGTTGC TCCTTACCGC

  51 CTGCGGCAGA AAATCCGCCC GAACCCACGC CAAAATTCCC GAAGGAAGCA

 101 CCGTACTTGC CTTGGGCGAT TCGCTTACCT TCGGCTACGG CGCAAACCCC

 151 GGCGAATCCT ACCCCGCGCA ACTGCAAAAA CTGACGGGTT GGAATATTGT

 201 CAACGGCGGC GTATCGGGCG ATACATCCGC CCAAGCCCTG TCGCGCCTGC

 251 CCGCGCTGTT GGCACGCAAA CCCAAGCTTG TGATTGTCGG CATAGGCGGC

 301 AACGACTTTC TGCGCAAAGT TCCCAAGGAG CAGACCCGCG CCAATATCGC

 351 GAAAATCATC GAAACCGTGC AGAAGGAAAA CATCCCCGCC GTCCTCGTCG

 401 GCGTGCCGCA CATTACCTTG GGCGCGTTGT TCGGGCATTT GAGCGATCAT

 451 CCGCTGTATG AGGATTTGTC CGAGGAATAC GGCATTCCGC TGTTCGGCGG

 501 CGCGTGGGCG GAAATTTTGG GCGATAATAA TCTGAAATCC GACCAAATCC

 551 ACGCCAACGG CAAAGGCTAT CGGAAATTTG CCGAAGATTT GAATCAATTT

 601 TTGAGAAAAC AGGGGTTTAG ATAA
```

This corresponds to the amino acid sequence <SEQ ID 3012; ORF 996.a>:

```
a996.pep
   1 MNRRTFLLGA GALLLTACGR KSARTHAKIP EGSTVLALGD SLTFGYGANP

  51 GESYPAQLQK LTGWNIVNGG VSGDTSAQAL SRLPALLARK PKLVIVGIGG

 101 NDFLRKVPKE QTRANIAKII ETVQKENIPA VLVGVPHITL GALFGHLSDH

 151 PLYEDLSEEY GIPLFGGAWA EILGDNNLKS DQIHANGKGY RKFAEDLNQF

 201 LRKQGFR*
```

Computer analysis of this amino acid sequence gave the following results:

Homology with a Predicted ORF from *N. meningitidis*

ORF 996 shows 100.0% identity over a 207 aa overlap with a predicted ORF (ORF 996) from *N. meningitidis*

```
a996/m996   100.0% identity in 207 aa overlap

                    10        20        30        40        50        60
a996.pep    MNRRTFLLGAGALLLTACGRKSARTHAKIPEGSTVLALGDSLTFGYGANPGESYPAQLQK
            ||||||||||||||||||||||||||||||||||||||||||||||||||||||||||||
m996        MNRRTFLLGAGALLLTACGRKSARTHAKIPEGSTVLALGDSLTFGYGANPGESYPAQLQK
                    10        20        30        40        50        60
                    70        80        90       100       110       120
a996.pep    LTGWNIVNGGVSGDTSAQALSRLPALLARKPKLVIVGIGGNDFLRKVPKEQTRANIAKII
            ||||||||||||||||||||||||||||||||||||||||||||||||||||||||||||
m996        LTGWNIVNGGVSGDTSAQALSRLPALLARKPKLVIVGIGGNDFLRKVPKEQTRANIAKII
                    70        80        90       100       110       120
                   130       140       150       160       170       180
a996.pep    ETVQKENIPAVLVGVPHITLGALFGHLSDHPLYEDLSEEYGIPLFGGAWAEILGDNNLKS
            ||||||||||||||||||||||||||||||||||||||||||||||||||||||||||||
m996        ETVQKENIPAVLVGVPHITLGALFGHLSDHPLYEDLSEEYGIPLFGGAWAEILGDNNLKS
                   130       140       150       160       170       180
                   190       200
a996.pep    DQIHANGKGYRKFAEDLNQFLRKQGFRX
            |||||||||||||||||||||||||||
m996        DQIHANGKGYRKFAEDLNQFLRKQGFR
                   190       200
```

The following partial DNA sequence was identified in *N. gonorrhoeae* <SEQ ID 3013>:

```
g997.seq (partial)
   1  ATGATGAACA CGCCGCATCC GCGCCCGAAA ATCGCCGTCA TCGGCGCAGG

  51  CTGGGCCGGC TTGTCCGCCG CCGTCACCTT GGCGCGGCAC GCCGACGTTA

 101  CCCTGTTTGA AGCCGGCCGG CAGGCGGGCG GAAGGGCGCG CACACTGGCC

 151  GGAAATACCG ACGGTTTCGG TTTTTTGGAC AACGGGCAGC ACATTTTGCT

 201  CGGCGCATAC CGGGGCGTGT TGCGCCTGAT GAAAACCATC GGTTCAGACC

 251  CCCGTGCCGC CTTTTTGCGC GTACCGCTGC ACTGGCATAT GCACGGCGGT

 301  TTGCAGTTCC GCGCCCTCCC CCTGCCCGCG CCGCTGCATA TTTTGGGCGG

 351  CGTGCTGCTT GCCCGGCGCG TACCGTCCGC ATTCAAAGCC AAACTGCTTG

 401  CCGATATGTC CGATTTGCAG AAGTCCGCAC GCCTCGGACA GCCCGACACG

 451  ACAGTTGCAC AATGGCTGAA ACAGCGGAAC GTGCCGCGTG CCGCCGTAAT

 501  GCAGTTTTGG CAGCCCTTGG TCTGGGGCGC GCTCAACACG CCTTTGGAAA

 551  CCGCAAGCCT GCGCGTGTTG TGCAACGTTT TGTCCGACGG CGTGCTGACG

 601  AAAAAATCCG GCAGCGACTA TCTCCTACCC AAACAGGATT TGGGCGCAAT

 651  CGTCGCCGAA CCCGCCTTGG CGGAGCTTCA ACGGCTCGGC GCGGACATCC

 701  GCCTCGAAAC GCGCGTATGC CGTCTGAACA CCCTCCCGGA CGGAAAAGTC

 751  CTCGTCAACG GCGAAGCCTT CGATGCCGCC ATACTTGCCA CCGCGCCCTA

 801  CCACGCCGCC GCGCTCCTGC CCGAAGGCAC GCCCGAACAC GTTCAGACGG

 851  CATATCAAAA CCTTCGCTAC CACGCCATCA CCACCGTCTA TCTGCGCTAC

 901  GCCGAACCCG TCCGcCTGCc CGCCCCGCTG ACcGGCATtg CCGAcggcAC

 951  ggcaCaatgG CTGCTTTgcc cgGGGCAGGC tccggactgc CcccaaAacg

1001  aagTCTCCGC cGTCAttagc GTTTCCGAcc GCGtcggcgC Gtttgcaaac

1051  cga...
```

This corresponds to the amino acid sequence <SEQ ID 3014 ORF 997.ng>:

g997.pep (partial)
```
  1 MMNTPHPRPK IAVIGAGWAG LSAAVTLARH ADVTLFEAGR QAGGRARTLA
 51 GNTDGFGFLD NGQHILLGAY RGVLRLMKTI GSDPRAAFLR VPLHWHMHGG
101 LQFRALPLPA PLHILGGVLL ARRVPSAFKA KLLADMSDLQ KSARLGQPDT
151 TVAQWLKQRN VPRAAVMQFW QPLVWGALNT PLETASLRVL CNVLSDGVLT
201 KKSGSDYLLP KQDLGAIVAE PALAELQRLG ADIRLETRVC RLNTLPDGKV
251 LVNGEAFDAA ILATAPYHAA ALLPEGTPEH VQTAYQNLRY HAITTVYLRY
301 AEPVRLPAPL TGIADGTAQW LLCPGQAPDC PQNEVSAVIS VSDRVGAFAN
351 R....
```

The following partial DNA sequence was identified in *N. meningitidis* <SEQ ID 3015>:

m997.seq
```
   1 ATGATGAACA CGCCGCATCC GCGCCCGAAA ATCGCCGTCA TCGGCGCAGG
  51 CTGGGCAGGA CTGTCCGCCG CCGTCACCTT GGCGCGGCAC GCCGACGTTA
 101 CCCTGTTTGA AGCCGGCCGG CAGGCGGGCG GCAGGGCGCG CACACTGGCC
 151 GGAAATACCG ACGGTTTCGG TTTTTTGGAC AACGGGCAGC ACATTTTGCT
 201 CGGCGCATAC CGGGGCGTGT TGCGCCTGAT GAAAACCATC GGTTCGGATC
 251 CCCGTGCCGC CTTTTTGCGC GTACCGCTGC ACTGGCATAT GCACGGCGGT
 301 TTGCAGTTCC GCGCCCTCCC CCTGCCCGCG CCGCTGCATA TTTTGGGCGG
 351 CGTGCTGCTT GCCCGGCGTG CACCGACTGC ATTCAAAGCC AAACTGCTTG
 401 CCGATATGTC CGATTTGCAG AAGTCCGCAC GCCTCGGACA GCCCGACACG
 451 ACAGTGGCGC AATGGCTGAA ACAGCGGAAC GTGCCGCGTG CCGCCGTGAT
 501 GCAGTTTTGG CAGCCCTTGG TTTGGGGCGC GCTCAACACG CCTTTGGAAA
 551 CCGCAAGCCT GCGCGTGTTG TGCAACGTTT TGTCCGACGG CGTGCTGACG
 601 AAAAAATCCG GCAGCGACTA TCTCCTACCC AAGCAGGATT TGGGCGCAAT
 651 CGTCGCCGAA CCCGCCTTGG CGGATCTTCA ACGGCTCGGC GCGGACATCC
 701 GCCTCGAAAC GCGCGTATGC CGTCTGAACA CCCTCCCGGA CGGGAAAGTG
 751 CTCGTCAACG GCGAAGCTTT CGATGCCGCC GTCCCCGCCA CCGCGCCCTA
 801 CCACGCCGCC GCGCTCCTGC CCGAAGGCAC GCCCGAACAC GTTCAGACGG
 851 CATATCAAAA CCTTCGCTAC CACGCCATCA CCACCGTCTA TCTGCGCTAC
 901 GCCGAACCCG TCCGCCTGCC CGCCCCGCTG ACCGGCCTTG CCGACGGCAC
 951 GGTGCAATGG CTGCTTTGCC GGGGCAGGCT CGGACTGCCT GAAAACGAAG
1001 TGTCCGCCGT CATCAGCGTT TCCGACCGCG TCGGCGCGTT TGCAAACCGG
1051 GCGTGGGCGG ACAAAGCCCA CGCCGACCTC AAACGCATCC TTCCGCATTT
1101 GGGCGAACCC GAAGCCGTGC GCGTCATCAC CGAAAAACGC GCCACAACCG
1151 CAGCCGATGC CCCGCCGCCG GACTTGTCGT GGTTGCACCG GCACCGCATC
1201 TTCCCCGCCG GCGACTACCT CCACCCGGAC TACCCCGCCA CGCTCGAAGC
1251 CGCCGTACAA TCAGGTTTCG CGTCGGCGGA AGCCTGCCTG CAAAGCCTGA
1301 GCGATGCCGT CTGA
```

This corresponds to the amino acid sequence <SEQ ID 3016; ORF 997>:

```
m997.pep
   1 MMNTPHPRPK IAVIGAGWAG LSAAVTLARH ADVTLFEAGR QAGGRARTLA

  51 GNTDGFGFLD NGQHILLGAY RGVLRLMKTI GSDPRAAFLR VPLHWHMHGG

 101 LQFRALPLPA PLHILGGVLL ARRAPTAFKA KLLADMSDLQ KSARLGQPDT

 151 TVAQWLKQRN VPRAAVMQFW QPLVWGALNT PLETASLRVL CNVLSDGVLT

 201 KKSGSDYLLP KQDLGAIVAE PALADLQRLG ADIRLETRVC RLNTLPDGKV

 251 LVNGEAFDAA VPATAPYHAA ALLPEGTPEH VQTAYQNLRY HAITTVYLRY

 301 AEPVRLPAPL TGLADGTVQW LLCRGRLGLP ENEVSAVISV SDRVGAFANR

 351 AWADKAHADL KRILPHLGEP EAVRVITEKR ATTAADAPPP DLSWLHRHRI

 401 FPAGDYLHPD YPATLEAAVQ SGFASAEACL QSLSDAV*
```

Computer analysis of this amino acid sequence gave the following results:

Homology with a Predicted ORF from *N. gonorrhoeae*

ORF 997 shows 96.0% identity over a 351 aa overlap with a predicted ORF (ORF 997) from *N. gonorrhoeae*

```
g997/m997   96.0% identity in 351 aa overlap

                     10        20        30        40        50        60
g997.pep    MMNTPHPRPKIAVIGAGEAGLSAAVTLARHADVTLFEAGRQAGGRARTLAGNTDGFGFLD
            ||||||||||||||||||||||||||||||||||||||||||||||||||||||||||||
m997        MMNTPHPRPKIAVIGAGWAGLSAAVTLARHADVTLFEAGRQAGGRARTLAGNTDGFGFLD
                     10        20        30        40        50        60

                     70        80        90       100       110       120
g997.pep    NGQHILLGAYRGVLRLMKTIGSDPRAAFLRVPLHWHMHGGLQFRALPLPAPLHILGGVLL
            ||||||||||||||||||||||||||||||||||||||||||||||||||||||||||||
m997        NGQHILLGAYRGVLRLMKTIGSDPRAAFLRVPLHWHMHGGLQFRALPLPAPLHILGGVLL
                     70        80        90       100       110       120

                    130       140       150       160       170       180
g997.pep    ARRVPSAFKAKLLADMSDLQKSARLGQPDTTVAQWLKQRNVPRAAVMQFWQPLVWGALNT
            |||:|:||||||||||||||||||||||||||||||||||||||||||||||||||||||
m997        ARRAPTAFKAKLLADMSDLQKSARLGQPDTTVAQWLKQRNVPRAAVMQFWQPLVWGALNT
                    130       140       150       160       170       180

                    190       200       210       220       230       240
g997.pep    PLETASLRVLCNCLSDGVLTKKSGSDYLLPKQDLGAIVAEPALAELQRLGADIRLETRVC
            |||||||||||| |||||||||||||||||||||||||||||||:|||||||||||||||
m997        PLETASLRVLCNVLSDGVLTKKSGSDYLLPKQDLGAIVAEPALADLQRLGADIRLETRVC
                    190       200       210       220       230       240

                    250       260       270       280       290       300
g997.pep    RLNTLPDGKVLVNGEAFDAAILATAPYHAAALLPEGTPEHVQTAYQNLRYHAITTVYLRY
            ||||||||||||||||||||: ||||||||||||||||||||||||||||||||||||||
m997        RLNTLPDGKVLVNGEAFDAAVPATAPYHAAALLPEGTPEHVQTAYQNLRYHAITTVYLRY
                    250       260       270       280       290       300

                    310       320       330       340       350
g997.pep    AEPVRLPAPLTGIADGTAQWLLCPGQAPDCPQNEVSAVISVSDRVGAFANR
            ||||||||||||:||||:||||| |:    |:|||||||||||||||||||
m997        AEPVRLPAPLTGLADGTVQWLLCRGRL-GLPENEVSAVISVSDRVGAFANRAWADKAHAD
                    310       320       330       340       350
```

The following partial DNA sequence was identified in *N. meningitidis* <SEQ ID 3017>:

```
a997.seq
   1  ATGATGAACA CGCCGCATCC GCGCCCGAAA ATCGCCGTCA TCGGCGCAGG

  51  CTGGGCCGGC TTGTCCGCCG CCGTTACCTT GGCGCGGCAC GCCGACGTTA

 101  CCCTGTTTGA AGCCGGCCGG CAGGCGGGCG GCAGGGCGCG CGCACTGGCC

 151  GGAAATACCG ACGGTTTCGG TTTTTTGGAC AACGGGCAGC ATATTTTACT

 201  CGGCGCATAC CGGGGCGTGT TGCGCCTGAT GAAAACCATC GGTTCAGACC

 251  CCCATGCCGC CTTTTTGCGC GTACCGCTGC ACTGGCATAT GCACGGCGGT

 301  TTGCAGTTCC GCGCCCTCCC CCTGCCCGCG CCCCTGCATA TTTTGGGCGG
```

-continued
```
 351 CGTGCTGCTT GCCCGGCGCG TACCGTCCGC ATTCAAAGCC AAACTGCTTG

 401 CCGATATGTC CGATTTGCAG AAGTCCGCAC GCCTCGGACA GCCCGACACG

 451 ACAGTGGCGC AATGGCTGAA ACAGCGGAAC GTGCCGCGTG CCGCCGTAAT

 501 GCAGTTTTGG CAGCCCTTGG TTTGGGGCGC GCTCAACACG CCTTTGGAAA

 551 CCGCAAGCCT GCGCGTGTTG TGCAACGTTT TGTCCGACGG CGTGCTGACG

 601 AAAAAATCCG GCAGCGACTA TCTCCTACCC AAACAGGATT TGGGCGCAAT

 651 CGTCGCCGAA CCCGCCTTGG CGGAGCTTCA ACGGCTCGGC GCGGACATCC

 701 GCCTCGAAAC GCGCATATGC CGTCTGAACA CCCTCCCGGA CGGGAAAGTG

 751 CTCGTCAACG GCGAACCTTT CGATGCCGCC GTCCCCGCCA CCGCGCCCTA

 801 CCACGCCGCC GCGCTCCTGC CCGAAGGCAC GCCCGAACAC GTTCAGACGG

 851 CATATCAAAA CCTTCGCTAT CACGCCATCA CCACCGTCTA TCTGCGCTAT

 901 GCCGAACCCG TCCGCTTGCC TGCCCCGCTG ACCGGACTTG CCGACGGCAC

 951 GGTGCAATGG CTGCTTTGCC GGGGCAGGCT CGGACTGCCT GAAAACGAAG

1001 TGTCCGCCGT CATCAGCGTT TCCGACCGCG TCGGCGCGTT TGCAAACCGG

1051 GCGTGGGCGG ACAAAGTTCA CGCCGACCTC AAACGCATCC TTCCGCATTT

1101 GGGCGAACCC GAAGCCGTGC GCGTCATCAC CGAAAAACGC GCCACAACCG

1151 CAGCCGATGC CCCGCCGCCG GATTTGTCGT GGTTGCACCG GCACCGCATC

1201 TTCCCCGCCG GCGACTACCT CCACCCAGAC TACCCCGCCA CGCTCGAAGC

1251 CGCCGTACAA TCAGGTTTCG CGTCGGCGGA AGCCTGCCTG CAAAGCCTGA

1301 GCGATGCCGT CTGA
```

This corresponds to the amino acid sequence <SEQ ID 3018; ORF 997.a>:

```
a997.pep
  1 MMNTPHPRPK IAVIGAGWAG LSAAVTLARH ADVTLFEAGR QAGGRARALA

 51 GNTDGFGFLD NGQHILLGAY RGVLRLMKTI GSDPHAAFLR VPLHWHMHGG

101 LQFRALPLPA PLHILGGVLL ARRVPSAFKA KLLADMSDLQ KSARLGQPDT

151 TVAQWLKQRN VPRAAVMQFW QPLVWGALNT PLETASLRVL CNVLSDGVLT

201 KKSGSDYLLP KQDLGAIVAE PALAELQRLG ADIRLETRIC RLNTLPDGKV

251 LVNGEPFDAA VPATAPYHAA ALLPEGTPEH VQTAYQNLRY HAITTVYLRY

301 AEPVRLPAPL TGLADGTVQW LLCRGRLGLP ENEVSAVISV SDRVGAFANR

351 AWADKVHADL KRILPHLGEP EAVRVITEKR ATTAADAPPP DLSWLHRHRI

401      FPAGDYLHPD YPATLEAAVQ SGFASAEACL QSLSDAV*
```

Computer analysis of this amino acid sequence gave the following results:
Homology with a Predicted ORF from *N. meningitidis*

ORF 997 shows 98.2% identity over a 437 aa overlap with a predicted ORF (ORF 997) from *N. meningitidis*

```
    a997/m997  98.2% identity in 437 aa overlap

                  10         20         30         40         50         60
     a997.pep  MMNTPHPRPKIAVIGAGWAGLSAAVTLARHADVTLFEAGRQAGGRARALAGNTDGFGFLD
               ||||||||||||||||||||||||||||||||||||||||||||||:||||||||||||
     m997      MMNTPHPRPKIAVIGAGWAGLSAAVTLARHADVTLFEAGRQAGGRARTLAGNTDGFGFLD
                  10         20         30         40         50         60
```

-continued

```
                  70        80        90       100       110       120
a997.pep   NGQHILLGAYRGVLRLMKTIGSDPHAAFLRVPLHWHMHGGLQFRALPLPAPLHILGGVLL
           |||||||||||||||||||||||:||||||||||||||||||||||||||||||||||||
m997       NGQHILLGAYRGVLRLMKTIGSDPRAAFLRVPLHWHMHGGLQFRALPLPAPLHILGGVLL
                  70        80        90       100       110       120

                 130       140       150       160       170       180
a997.pep   ARRVPSAFKAKLLADMSDLQKSARLGQPDTTVAQWLKQRNVPRAAVMQFWQPLVWGALNT
           |||:|:||||||||||||||||||||||||||||||||||||||||||||||||||||||
m997       ARRAPTAFKAKLLADMSDLQKSARLGQPDTTVAQWLKQRNVPRAAVMQFWQPLVWGALNT
                 130       140       150       160       170       180

                 190       200       210       220       230       240
a997.pep   PLETASLRVLCNVLSDGVLTKKSGSDYLLPKQDLGAIVAEPALAELQRLGADIRLETRIC
           ||||||||||||||||||||||||||||||||||||||||||||:|||||||||||||:|
m997       PLETASLRVLCNVLSDGVLTKKSGSDYLLPKQDLGAIVAEPALADLQRLGADIRLETRVC
                 190       200       210       220       230       240

                 250       260       270       280       290       300
a997.pep   RLNTLPDGKVLVNGEPFDAAVPATAPYHAAALLPEGTPEHVQTAYQNLRYHAITTVYLRY
           |||||||||||||| |||||||||||||||||||||||||||||||||||||||||||||
m997       RLNTLPDGKVLVNGEAFDAAVPATAPYHAAALLPEGTPEHVQTAYQNLRYHAITTVYLRY
                 250       260       270       280       290       300

                 310       320       330       340       350       360
a997.pep   AEPVRLPAPLTGLADGTVQWLLCRGRLGLPENEVSAVISVSDRVGAFANRAWADKVHADL
           |||||||||||||||||||||||||||||||||||||||||||||||||||||||:||||
m997       AEPVRLPAPLTGLADGTVQWLLCRGRLGLPENEVSAVISVSDRVGAFANRAWADKAHADL
                 310       320       330       340       350       360

                 370       380       390       400       410       420
a997.pep   KRILPHLGEPEAVRVITEKRATTAADAPPPDLSWLHRHRIFPAGDYLHPDYPATLEAAVQ
           ||||||||||||||||||||||||||||||||||||||||||||||||||||||||||||
m997       KRILPHLGEPEAVRVITEKRATTAADAPPPDLSWLHRHRIFPAGDYLHPDYPATLEAAVQ
                 370       380       390       400       410       420

                 430
a997.pep   SGFASAEACLQSLSDAVX
           ||||||||||||||||||
m997       SGFASAEACLQSLSDAVX
                 430
```

g999.seq Not found yet g999.pep Not found yet

The following partial DNA sequence was identified in *N. meningitidis* <SEQ ID 3019>:

```
m999.seq
   1 ATGAATATGA AAAAATTGAT TTCCGCAATT TGTGTTTCAA TTGTTTTATC

  51 AGCCTGCAAC CAACAATCAA AAACGGCACA AGCCGAAGAA CCTGTCCAAA

 101 GTATCCAGGC TGCTGATTGT ACCGCCCCAA TGGACATCAC AGTTGAACAA

 151 TATCTCATCA ATTTGGAGCA AGCATTTAAA ACTCAGAACG TCTCAACAAA

 201 AATCCATAAT AAAAATATTG TCAAGACCGA TTGTGGTTAT GACCTTACTT

 251 TGGTAATGGA TTTTGGGGCG ATTGCGCTCA AACTGGACGA GCAGCAAAAA

 301 ATTAGAGCTA TCTCAGTAGG CTACATTTTA AAAACCGACG GAGAGAAAGG

 351 ACAAAATCTA GTCAATAATG CCATAAATGG ATTACACAGT ATTCAGGCAG

 401 TTCTGTCTTT AACTACCACA GACAAATTGG GCGAATCGGA AGCAGGAAAA

 451 CAACTTTTTA CAGCTTTAAC CGAAGTCGTC AAAGAATCCA ATCAGACAGG

 501 AGCAACAGCG CAAAAAGACG TTCCGGCAGA TGGTATTTTA TATAGCGTTG

 551 TTTTTGAAAA AGAAACAAAC ACCATTGCAA TAATCGGCAG AAAACAACCC

 601 TAA
```

This corresponds to the amino acid sequence <SEQ ID 3020; ORF 999>:

```
m999.pep
   1 MNMKKLISAI CVSIVLSACN QQSKTAQAEE PVQSIQAADC TAPMDITVEQ

  51 YLINLEQAFK TQNVSTKIHN KNIVKTDCGY DLTLVMDFGA IALKLDEQQK

 101 IRAISVGYIL KTDGEKGQNL VNNAINGLHS IQAVLSLTTT DKLGESEAGK

 151 QLFTALTEVV KESNQTGATA QKDVPADGIL YSVVFEKETN TIAIIGRKQP *

a999.seq Not found yet

a999.pep Not found yet
```

The foregoing examples are intended to illustrate but not to limit the invention.

SEQUENCE LISTING (4171 sequences)

SEQ ID NO: 1 - DNA, 396 bp, Neisseria gonorrhoeae
atgctgccgcaggggaaggcggcgcggagggtgtcggcgaacgaggtgtccggcagggcttgcgcccggatggtgctggtcatctgccagacgctgccgaaacgcgatactttaaacggctcgggtacgcatactttaccggtttgggcgattttgccgaggtcgttgcgcagcaaatcgacaatcatcacgttttcggcgcggtttttcgggtcggtttgtaactcggcggcgcggcgttcgtcttgtccgtcgcccaaaatcggcgcggtgcctttcatcggttcggtgctgatggtgccgtctgaagcgatgttgaggaagagttcgggcgagaaacacagcgtccacgcggattgcccggcttcatcgggcaggtgggacaatacggcatag

SEQ ID NO: 2 - protein, 131 aa, Neisseria gonorrhoeae
MLPQGKAARRVSANEVSGRACARMVLVICQTLPKRDTLNGSGTHTLPVWAILPRSLRSKSTIITFSARFFGSVCNSAARRSSCPSPKIGAVPFIGSVLMVPSEAMLRKSSGEKHSVHADCPASSGRWDNTA

SEQ ID NO: 3 - DNA, 395 bp, Neisseria meningitidis
atgctgccgcaggggaaggcggcgcggaggatgtcggcgaacgaggtgtgcggcasscttssgcttggayggtgctggtcatctgccaaacgctgccgaaacgcgatactttaaacggttcgggtacgcatactgtgccggtttgggcgattttgccgagatcgttacgcagcaaatcgacaatcatcacgttttcggcgcggtttttcgggtctgcttgcaactcggcggcgcggcgttcgtcttgtccgtcgcccaaaatcggcgcggtgcctttcatcggttcggtgctgatggtgccgtccgaaccgattttgaggaagagttcgggcgagaaacacagcgtccacgcggattgcccctccgcatcgggcaggtgggacaagacggcatag

SEQ ID NO: 4 - protein, 131 aa, Neisseria meningitidis
  misc_feature (19)..(19): Xaa can be any naturally occurring amino acid
  misc_feature (21)..(21): Xaa can be any naturally occurring amino acid
  misc_feature (24)..(24): Xaa can be any naturally occurring amino acid
MLPQGKAARRMSANEVCGXLXAWXVLVICQTLPKRDTLNGSGTHTVPVWAILPRSLRSKSTIITFSARFFGSACNSAARRSSCPSPKIGAVPFIGSVLMVPSEPILRKSSGEKHSVHADCPSASGRWDKTA

SEQ ID NO: 5 - DNA, 396 bp, Neisseria meningitidis
atgctgccgcaggggaaggcggcgcggaggatgtcggcgaacgaggtgtgcggcaaggcttgggcttggatggtgctggtcatctgccaaacgctgccgaaacgcgatactttaaacggttcgggtacgcatactgtgccggtttgggcgattttgccgaggtcgttacgcagcaaatcgacaatcatcacgttttcggcgcggtttttcgggtctgcttgcaactcggcggcgcggcgttcgtcttgtccgtcgcccaaaatcggcgcggtgcctttcatcggttcggtgctgatggtgccgtccgaaccgattttgaggaagagttcgggcgagaaacacagcgtccacgcggattgcccttgtgcatcgggcaggtgggacaaaacggcatag

SEQ ID NO: 6 - protein, 131 aa, Neisseria meningitidis
MLPQGKAARRMSANEVCGKAWAWMVLVICQTLPKRDTLNGSGTHTVPVWAILPRSLRSKSTIITFSARFFGSACNSAARRSSCPSPKIGAVPFIGSVLMVPSEPILRKSSGEKHSVHADCPCASGRWDKTA

SEQ ID NO: 7 - DNA, 663 bp, Neisseria gonorrhoeae
  misc_feature (529)..(529): n is a, c, g, or t
atggtcgtattcgtggctgaaggcgtattcggtcgcgctgttttgggtcacttggtattgctcttcggtcagggtgcgtttgagttcggcgtcactcggttttttatacgttgccgcgtcgaagcctttgccttgcggtgcggctttggttttgcccggcagcggttcgtcggctttgcggatgtcgatgtggcagtagccgttggggtttttaatcaggtagtcctgatggtattcctcggcgtcgtagaagtttttcagcggttcgttttcaacaacgaggggcagttggtatttttgctgctcgcgtttgagggcggcggcgatgacggctttttcggcggggtcggtgtagtacacgccgctgcggtattgcgtgccggtgtcgttaccctgtttgttgaggctggtcggatcaacgacgcggaaataatattgcaggatgtcgtccaggctgagtttgtcggcatcgtaggtcactttgacggtctcggcatgacccgtatggcggtaggacacttcttcgtanctcgggttttccgtgttgccgttggcgttaccggataccgcgtcaaccacgccgtcgatgcgttggaaataggcttccaagccccaaaagcagccgccggcgaagtaaatggtgcccgtgttcatgattgctga

SEQ ID NO: 8 - protein, 219 aa, Neisseria gonorrhoeae
MVVFVAEGVFGRAVLGHLVLLFGQGAFEFGVTRFFIRCRVEAFALRCGFGFARQRFVGFADVDVAVAVGVFNQVVLMVFLGVVEVFQRFVFNNEGQLVFLLLAFEGGGDDGFFGGVGVVHAAAVLRAGVVTLFVEAGRINDAEIILQDVVQAEFVGIVGHFDGLGMTRMAVGHFFVRVFRVAVGVTGYRVNHAVDALEIGFQAPKAAAGEVNGARVHDC

SEQ ID NO: 9 - DNA, 662 bp, Neisseria meningitidis
atggtcgtattcgtggctgaaggcatattcggtcgcgctgttttgggtaacttgstattgctcttcggtcagggtgcgtttgagttcggcgtcactcggttttttatacgttgccgcgtcgaagcctttgccttgcggggcggtcttggttttgcccggcagcggttcgtcagckttgcggatgtcgatgtggcagtagccgttggggtttttaatcaagtagtcctgatggtattcctcggcatcgtagaagtttttcagcggctcgttttcaacaacgaggggcagttggtatttttgctgctcgcgtttgagggcgkcggcgatgacggctttttcgkcggggtcggtgtagtacacgccgctgcggtattgcgtaccggtgtcgttgccctgtttgttgaggctggtcggatcaacgacgcggaagaaatattgcaggatgtcgtctaggctgagtttgtcggcatcgtaggtcactttgacggtttcggcgtggcccgtatggcggtaggacacgtcttcatagctcggatttttcgtgttgccgttggcgtagccggataccgcgtcaaccacgccgtcgatgcgttggaaataggcttccaagccccagaagcagcgccggcgaggtaaatggtgcgcgtgttcatgatttttga

SEQ ID NO: 10 - protein, 219 aa, Neisseria meningitidis
  misc_feature (19)..(19): Xaa can be any naturally occurring amino acid
  misc_feature (59)..(59): Xaa can be any naturally occurring amino acid
  misc_feature (107)..(107): Xaa can be any naturally occurring amino acid
  misc_feature (114)..(114): Xaa can be any naturally occurring amino acid
  misc_feature (208)..(208): Xaa can be any naturally occurring amino acid
MVVFVAEGIFGRAVLGNLXLLFGQGAFEFGVTRFFIRCRVEAFALRGGLGFARQRFVSXADVDVAVAVGVFNQVVLMVFLGIVEVFQRLVFNNEGQLVFLLLAFEGXGDDGFFXGVGVVHAAAVLRTGVVALFVEAGRINDAEEILQDVVAEFVGIVGHFDGFGVARMAVGHVFIARIFRVAVGVAGYRVNHAVDALEIGFQAPEAAXGEVNGARVHDF

SEQ ID NO: 11 - DNA, 663 bp, Neisseria meningitidis
atggtcgtattcgtggctgaaggcatattcggtcgcgctgttttgggtaacttggtattgctcttcggtcagggtgcgtttgagttcggcgtcactcggttttttatacgttgccgcgtcgaagcctttgccttgcggtgcggtcttggttttgcccggcagcggttcgtcggctttgcggatatcgatgtggcagtagccgttggggtttttaatcaagtagtcctgatggtattcctcggcatcgtagaagtttttcagcggctcgttttcaacaacgaggggcagttggtatttttgctgctcgcgtttgagggcggcggcgatgacggctttttcggcggggtcggtgtagtacacgccgctgcggtattgcgtaccggtgtcgttgccctgtttgttgaggctggtcggatcaacgacgcggaagaaatattgcaggatgtcgtctaggctgagtttgtcggcatcgtaggtcactttgacggtttcggcgtggcccgtatggcggtaggacacgtcttcatagctcggatttttcgtgttgccgttggcgtagccggataccgcgtcaaccacgccgtcgatgcgttggaaataggcttccaagccccagaagcagccgccggcgaggtagatggtgcgcgtgttcatgatttttga

SEQ ID NO: 12 - protein, 219 aa, Neisseria meningitidis
MVVFVAEGIFGRAVLGNLVLLFGQGAFEFGVTRFFIRCRVEAFALRCGLGFARQRFVGFADIDVAVAVGVFNQVVLMVFLGIVEVFQRLVFNNEGQLVFLLLAFEGGGDDGFFGGVGVVHAAAVLRTGVVALFVEAGRINDAEEILQDVVAEFVGIVGHFDGFGVARMAVGHVFIARIFRVAVGVAGYRVNHAVDALEIGFQAPEAAAGEVDGARVHDF

SEQ ID NO: 13 - DNA, 777 bp, Neisseria gonorrhoeae
atggtagaacggcatatccagcatttgcggaacggtcatcttcatttgatgcgcccatgccaacaagtgagccaaatgttcggcggcagggcctacgatttccgcgccgataaagcggccggtggctttttcggcatacaggcgcatatggcctttgtttaccagcatcacgcggctgcgaccttgatttttgaacgatacttcgccgatgacaaattcgtcggcttggtattgcgcggcaacctgcgcgtatttcaaaccgacaaagccgatttgcggactggtaaacaccacgccaatggtgctgcggcgcaaaccgctgccgatattcgggtagcggccccgcgttattgcccggcaatcttaccttggtcggcggcttcatgcagcaggggcagttggttggacgcgtcgcccgcaataaagatatgcggaatgctggtctgcatggtcagcggatcggcaacgggtacgccgcgcgcgtctttgtcgatattgatgttttccaaaccgatattgtcaacgttcggacggcgacctacggctgccaacatatattcggcaacaaatacgcctttttcgccatcctgctcccaatggacttctacattgccgtctgcgtcgagtttgacctcggttttagcatccagatgcagtttcaattcttctccgaacacggctttcgcctcgtctgaaacaacggggtcggaaatgccgccgatgattccgcccaaaccgaaaatttcaactttcacacccaaacggtgcaatgcctga

SEQ ID NO: 14 - protein, 258 aa, Neisseria gonorrhoeae
MVERHIQHLRNGHLHLMRPCQQVSQMFGGRAYDFRADKAAGGFFGIQAHMAFVYQHHAAATLIFERYFADDKFVGLVLRGNLRVFQTDKADLRTGKHHANGAAAQTAADIRVAAPRYCPAILPWSAASCSRGSWLDASPAIKICGMLVCMVSGSATGTPRASLSILMFSKPILSTFGRRPTAANIYSATNTPFSPSCSQWTSTLPSASSLTSVLASRCSFNSSPNTAFASSETTGSEMPPMIPPKPKISTFTPKRCNA

SEQ ID NO: 15 - DNA, 774 bp, Neisseria meningitidis
atggtagaacggcatatccagcatttgcggaacggtcatcttcatttgatgtgcccaagccaacaggtgcgccaaatgttcggcggcagggcctacgatttccgcgccgataaagcggccggtggctttttcggcatacaggcgcatatggcctttgttcaccagcatcacgcggctgcggccttggtttttgaacgatacttcgccgatgacaaattcgtcggcttggtattgcgcggcaacctgcgcgtatttcagaccgacaaagccgatttgcggactggtaaacaccacgccgatggtgctgcgccgcaaaccgccgccgatattcgggtagcggccgcgttatcgccggcaatcttgccttggtcggcagcttcatgcagcagaggcagttggttggacgcatcgcctgcgatgaagatatgcggaatactggtctgcatggtcagcgggtcggcaacaggtacgccgcgcgcatctttttcgatattgatattttccaaaccgatattgtcaacgttcggacggcggcccacggctgccagcatatattcggcaacaaatacgcctttttcgccatcctgctcccaatggacttctacattgccgtctgcatcgagtttgacctcggttttagcatccagatgcagtttcaattcttcgccgaacacggcgttcgcctcgtctgaaacgacggggtcggaaatgccgccgatgattccgcccaaaccgaaaatttcaactttcacgcccaaacggtgcaatgcctga

SEQ ID NO: 16 - protein, 257 aa, Neisseria meningitidis
MVERHIQHLRNGHLHLMCPSQQVRQMFGGRAYDFRADKAAGGFFGIQAHMAFVHQHHAAAALVFERYFADDKFVGLVLRGNLRVFQTDKADLRTGKHHADGAAPQTAADIRVAAALSPAILPWSAASCSRGSWLDASPAMKICGILVCMVSGSATGTPRASFSILIFSKPILSTFGRRPTAASIYSATNTPFSPSCSQWTSTLPSASSLTSVLASRCSFNSSPNTAFASSETTGSEMPPMIPPKPKISTFTPKRCNA

SEQ ID NO: 17 - DNA, 774 bp, Neisseria meningitidis
atggtagaacggcatatccagcatttgcggaacggtcatcttcatttgatgtgcccaagccaacaggtgcgccaaatgttcggcggccggacctacgatttctgcgccgatgaagcggccggtggctttttcggcatacaggcgcatatggcctttgtttaccagcatcacgcggctgcggccttggtttttgaacgatacttcgccgatgacaaattcgtcggcttggtattgcgcggcaacctgcgcgtatttcaaaccgacaaagccgatttgcggactggtgaacactacgccgatggtgctgcggcgcaaaccgccgccgatattcgggtagcggccgcgttatcgccggcaatcttgccttggtcggcggcttcatgcagcaggggcagttggttggacgcgtcgcccgcaataaagatatgcggaatactggtctgcatagtcagcggatcggcaacgggtacgccgcgcgcatctttttcgatattgatgttttccaaaccgatattgtcaacgttcggacggcggcctacggctgccagcatatattcggcaacaaatacgcctttttcgccatcctgctcccaatggacttctacattgccgtctgcgtcgagtttggcctcggttttagcatccaaatgcagtttcaattcttcaccgaacacggctttcgcctcgtctgaaacgacggggtcggaaatgccgccgatgatgccacccaaaccgaaaatttcaactttcacgcccaaacggtgcaatgcctga

SEQ ID NO: 18 - protein, 257 aa, Neisseria meningitidis
MVERHIQHLRNGHLHLMCPSQQVRQMFGGRTYDFCADEAAGGFFGIQAHMAFVYQHHAAAALVFERYFADDKFVGLVLRGNLRVFQTDKADLRTGEHYADGAAAQTAADIRVAAALSPAILPWSAASCSRGSWLDASPAIKICGILVCIVSGSATGTPRASFSILMFSKPILSTFGRRPTAASIYSATNTPFSPSCSQWTSTLPSASSLASVLASKCSFNSSPNTAFASSETTGSEMPPMMPPKPKISTFTPKRCNA

SEQ ID NO: 19 - DNA, 1107 bp, Neisseria gonorrhoeae
atggggatggacaatattgatatgttcatgcctgaacaagaggaaatccaatcaatgtggaaagaaattttactgaattacggtattttcctgctcgaactgcttaccgtgttcggcgcaattgcgctgattgtgttggctatcgtacagagtaagaaacagtcggaaagcggcagtgtcgtactgacagatttttcggaaaattataaaaaacagcggcaatcgtttgaaacattctttttaagcgaggaagagacaaaacatcaggaaaaaaaagaaaagaaaaaggaaaaggcggaagccaaagcagagaaaaagcgtttgaaggagggcggggagaaatctgccgaaacgcaaaaatcccgcctttttgtgttggattttgacggcgatttgtatgcacacgccgtagaatccttgcgtcatgagattacggcggtgcttttgattgccaagcctgaagatgaggttctgctcagattggaaagtccgggcggcgtggttcacggttacggtttggcggcttcgcagcttaggcgtttgcgcgaacgcaatattccgctgaccgtcgccgtcgataaggtcgcggcaagcggcggctatatgatggcgtgtgtggcggataaaattgtttccgctccgtttgcggtcatcggttcggtgggtgtggtggcggaagtgccgaatatccaccgcctgttgaaaaaacatgatattgatgtggatgtgatgacggcgggcgaatttaagcgcacggttacttttatgggtgaaaatacggaaaagggcaaacagaaattccggcaggaactggaggaaacgcatcagttgttcaagcagtttgtcagtgaaaaccgccccgggttggatattgaaaaaatagcgacgggcgagcattggttcggccggcaggcgttggcgttgaacttgattgacgagatttcgaccagtgatgatttgttgttgaaagcgtttgaaaacaaacaggttatcgaagtgaaatatcaggagaagcgaagcctgatccagcgcattggtttgcaggcggaagcttccgttgaaaagttgtttgccaaacttgtcaaccggcgagcggatgtgatgtag

SEQ ID NO: 20 - protein, 368 aa, Neisseria gonorrhoeae
MGMDNIDMFMPEQEEIQSMWKEILLNYGIFLLELLTVFGAIALIVLAIVQSKKQSESGSVVLTDFSENYKKQRQSFETFFLSEEETKHQEKKEKKKEKAEAKAEKKRLKEGGEKSAETQKSRLFVLDFDGDLYAHAVESLRHEITAVLLIAKPEDEVLLRLESPGGVVHGYGLAASQLRRLRERNIPLTVAVDKVAASGGYMMACVADKIVSAPFAVIGSVGVVAEVPNIHRLLKKHDIDVDVMTAGEFKRTVTFMGENTEKGKQKFRQELEETHQLFKQFVSENRPGLDIEKIATGEHWFGRQALALNLIDEISTSDDLLLKAFENKQVIEVKYQEKRSLIQRIGLQAEASVEKLFAKLVNRRADVM

SEQ ID NO: 21 - DNA, 1100 bp, Neisseria meningitidis
  misc_feature (350)..(350): n is a, c, g, or t
  misc_feature (374)..(581): n is a, c, g, or t
atggacaatattgacatgttcatgcctgaacaagaggaaatccaatcaatgtggaaagaaattttactgaattacggtattttcctgctcgaactgcttaccgtgttcggcgcaattgcgctgattgtgttggctatcgtacagagtaagaaacagtcggawagcggcagtgtcgtactgacggatttttcggaaaattataaaaaacagcggcaatcgtttgaagcattctttttaagcggggaagaggcacaacatcaggaaaaagaggaaaagaaaaaggaaaaggcggaagccaaagcagagaaaaacgtttgaaggagggtggggagaaatctgccgaaacgcanaaatcacgcctttttgtgttggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgagcggcggttatatgatggcgtgtgtggcggataaaattgcttccgctccgtttgcgattgtcggttcggtgggtgtggtggcggaagtaccgaatatccaccgcctgttgaaaaaacatgatattgatgtggatgtgatgacggcgggcgaatttaagcgcacggttacttttatgggtgaaaatacggaaaagggcaaacagaaattccgacaggaactggaggaaacgcatcagttgttcaagcagtttgtcagcgagaaccgccctcaattggatattgaggaagtggcaacgggcgagcattggttcggtcggcaggcgttggcgttgaacttgattgacgagatttcgaccagtgatgatttgttgttgaaagcgtttgaaaacaaacaggttatcgaagtgaaatatcaggagaagcaaagcctgatccagcgcattggtttgcaggcggaagcttctgttgaaaagttgtttgccaaacttgtcaaccggcgggcggatgtgatgtag

SEQ ID NO: 22 - protein, 366 aa, Neisseria meningitidis
  misc_feature (54)..(54): Xaa can be any naturally occurring amino acid
  misc_feature (104)..(104): Xaa can be any naturally occurring amino acid
  misc_feature (117)..(117): Xaa can be any naturally occurring amino acid
  misc_feature (125)..(194): Xaa can be any naturally occurring amino acid
MDNIDMFMPEQEEIQSMWKEILLNYGIFLLELLTVFGAIALIVLAIVQSKKQSXSGSVVLTDFSENYKKQRQSFEAFFLSGEEAQHQEKEEKKKEKAEAKAEKXRLKEGGEKSAETXKSRLFVLXXXXXXXXXXXXXXXXXXXXXXXXXXXXXXXXXXXXXXXXXXXXXXXXXXXXXXXXXXXXXXXXXXXXXXASGGYMMACVADKIASAPFAIVGSVGVVAEVPNIHRLLKKHDIDVDVMTAGEFKRTVTFMGENTEKGKQKFRQELEETHQLFKQFVSENRPQLDIEEVATGEHWFGRQALALNLIDEISTSDDLLLKAFENKQVIEVKYQEKQSLIQRIGLQAEASVEKLFAKLVNRRADVM

SEQ ID NO: 23 - DNA, 1101 bp, Neisseria meningitidis
atggacaatattgacatgttcatgcctgaacaagaggaaatccaatcaatgtggaaagaaattttactgaattacggtattttcctgctcgaactgcttaccgtgttcggcgcaattgcgctgattgtgttggctatcgtacagagtaagaaacagtcggaaagcggcagtgtcgtactgacggatttttcggaaaattataaaaaacagcggcaatcgtttgaagcattctttttaagcggggaagaggcaaaacatcaggaaaaagaggaaaagaaaaaggaaaaggcggaagccaaagcagagaaaaagcgtttgaaggagggtggggagaaatcttccgaaacgcaaaaatcccgcctttttgtgttggattttgacggcgatttgtatgcacacgccgtagaatccttgcgtcatgagattacggcggtgcttttgattgccaagcctgaagatgaggttctgcttagattggaaagtccgggcggcgtggttcacggttacggtttggcggcttcgcagcttaggcgtttgcgcgaacgcaatattccgctgaccgtcgccgtcgataaggtggcggcgagcggtggttatatgatggcgtgtgtggcggataaaattgtttccgctccgtttgcgattgtcggttcggtgggtgttgtagcggaagtaccgaatatccaccgcctgttgaaaaaacatgatattgatgtggatgtgatgacggcgggcgaatttaagcgcacggttacttttatgggtgaaaatacggaaaagggcaaacagaaattccgacaggaactggaggaaacgcatcagttgttcaagcagtttgtcagcgagaaccgccctcaattggatattgaggaagtggcaacgggcgagcattggttcggtcggcaggcgttggcgttgaacttgattgacgagatttcgaccagtgatgatttgttgttgaaagcgtttgaaaacaaacaggttatcgaagtgaaatatcaggagaagcaaagcctgatccagcgcattggtttgcaggcggaagcttctgttgaaaagttgtttgccaaacttgtcaaccggcgggcggatgtgatgtag

SEQ ID NO: 24 - protein, 366 aa, Neisseria meningitidis
MDNIDMFMPEQEEIQSMWKEILLNYGIFLLELLTVFGAIALIVLAIVQSKKQSESGSVVLTDFSENYKKQRQSFEAFFLSGEEAKHQEKEEKKKEKAEAKAEKKRLKEGGEKSSETQKSRLFVLDFDGDLYAHAVESLRHEITAVLLIAKPEDEVLLRLESPGGVVHGYGLAASQLRRLRERNIPLTVAVDKVAASGGYMMACVADKIVSAPFAIVGSVGVVAEVPNIHRLLKKHDIDVDVMTAGEFKRTVTFMGENTEKGKQKFRQELEETHQLFKQFVSENRPQLDIEEVATGEHWFGRQALALNLIDEISTSDDLLLKAFENKQVIEVKYQEKQSLIQRIGLQAEASVEKLFAKLVNRRADVM

SEQ ID NO: 25 - DNA, 462 bp, Neisseria gonorrhoeae
atgctgctggtgctggaattttggttcggcgtgtcggcggtgggcatacttgcgttgtttttatggcttttgccacgttttgccgccatcagcgaaaacctgtatttccgcctgaacaacagcttggaacgcgacaaccactttatccgaaaaggcgacgagcggcagctgtaccgccattacggactggtttcgcgcctgcgtgtgctgatttccaaccgcgaagccttcggctatctctgcgtcggcgcggcgatgggtattttgttcggctttgcttttgtgatgatgacgctcaaaggctacggcagcgcggggcatatttattcggtcggcacttatctgtggatgtttgccatgagtttggacgatgtgccgcgattggtcgaacaatattccaatttgaaagacatcggacaacggatagagtggtcggaacggaacatcaaagccggaacttga

SEQ ID NO: 26 - protein, 153 aa, Neisseria gonorrhoeae
MLLVLEFWFGVSAVGILALFLWLLPRFAAISENLYFRLNNSLERDNHFIRKGDERQLYRHYGLVSRLRVLISNREAFGYLCVGAAMGILFGFAFVMMTLKGYGSAGHIYSVGTYLWMFAMSLDDVPRLVEQYSNLKDIGQRIEWSERNIKAGT

SEQ ID NO: 27 - DNA, 462 bp, Neisseria meningitidis
atgctgctggtgctggaattttgggtcggcgtgtcggcggtgggcatacttgcgttgtttttatggcttttgccacgttttgccgccatcagcgaaaacctgtatttccgcctgaacaacagcttggaacgcgacaaccactttatccgaaaaggcgaccggcggcagctgtaccgccattacggactgcttgcgcgcctgcgtgtgctgatttccaaccgcgaagccttcggctatctctgcgtcggcacggcgatgggtattttgttcggctttgcttttgtgatgatgacgctcaaaggctacagcagcgcggggcatgtctattcggtcggcacttatctgtggatgtttgccatgagtttggacgacgtgccgcgattggtcgaacaatattccaatttgaaagacatcggacaacggatagagtggtcggaacggaacatcaaagccggaacttga

SEQ ID NO: 28 - protein, 153 aa, Neisseria meningitidis
MLLVLEFWVGVSAVGILALFLWLLPRFAAISENLYFRLNNSLERDNHFIRKGDRRQLYRHYGLLARLRVLISNREAFGYLCVGTAMGILFGFAFVMMTLKGYSSAGHVYSVGTYLWMFAMSLDDVPRLVEQYSNLKDIGQRIEWSERNIKAGT

SEQ ID NO: 29 - DNA, 462 bp, Neisseria meningitidis
atgctgctggtgctggaattttgggtcggcgtgtcggcggtgggcatacttgcgttgtttttatggcttttgccacgttttgccgccatcagcgaaaacctgtatttccgcctgaagaacagcttggaacgcgacaaccactttatccgaaaaggcgacgagcggcagctggaccgccattacggactgcttgcgcgcctgcgtgtgctgatttccaaccgcgaagccttcggctatctctgcgtcggcacggcgatgggtattttgttcggctttgcttttgtgatgatgacgctcaaaggctacagcagcgcggggcatgtctattcggtcggcacttatctgtggatgtttgccataagtttggacgacgtgccgcgattggtcgaacaatattccaatttgaaagacatcggacaacggatagagtggtcgaaacggaacatcaaagccggaacttga

SEQ ID NO: 30 - protein, 153 aa, Neisseria meningitidis
MLLVLEFWVGVSAVGILALFLWLLPRFAAISENLYFRLKNSLERDNHFIRKGDERQLDRHYGLLARLRVLISNREAFGYLCVGTAMGILFGFAFVMMTLKGYSSAGHVYSVGTYLWMFAISLDDVPRLVEQYSNLKDIGQRIEWSKRNIKAGT

SEQ ID NO: 31 - DNA, 867 bp, Neisseria gonorrhoeae
atgtggaaaatgttgaaacacatagccaaaacccaccgcaagcgattgattggcacattttccccggtcggactggaaaaccttttgatgctggggtatccggtgtttggcggctgggcgattaatgccgtgattgcggggagggtgtggcaggcgttgctgtacgctttggttgtatttttgatgtggctggtcggtgcggcacggcggattgccgatacgcgcacgtttacgcggatttataccgaaatcgccgtgccggttgtgttggaacaacggcagcggcaagtcccgcattcagcggtaactgcacgggttgccctgtcgcgtgaatttgtcagcttttttgaagaacacctgccgattgccgcgacatccgtcgtatccatattcggcgcgtgcatcatgctgctggtgctggaattttgggtcggcgtgtcggcggtgggcatacttgcgttgtttttatggcttttgccacgttttgccgccatcagcgaaaacctgtatttccgcctgaacaacagcttggaacgcgacaaccactttatccgaaaaggcgacgagcggcagctgtaccgccattacggactggtttcgcgcctgcgtgtgctgatttccaaccgcgaagccttcggctatctctgcgtcggcgcggcgatgggtattttgttcggctttgcttttgtgatgatgacgctcaaaggctacggcagcgcggggcatatttattcggtcggcacttatctgtggatgtttgccatgagtttggacgatgtgccgcgattggtcgaacaatattccaatttgaaagacatcggacaacggatagagtggtcggaacggaacatcaaagccggaacttga

SEQ ID NO: 32 - protein, 288 aa, Neisseria gonorrhoeae
MWKMLKHIAKTHRKRLIGTFSPVGLENLLMLGYPVFGGWAINAVIAGRVWQALLYALVVFLMWLVGAARRIADTRTFTRIYTEIAVPVVLEQRQRQVPHSAVTARVALSREFVSFFEEHLPIAATSVVSIFGACIMLLVLEFWVGVSAVGILALFLWLLPRFAAISENLYFRLNNSLERDNHFIRKGDERQLYRHYGLVSRLRVLISNREAFGYLCVGAAMGILFGFAFVMMTLKGYGSAGHIYSVGTYLWMFAMSLDDVPRLVEQYSNLKDIGQRIEWSERNIKAGT

SEQ ID NO: 33 - DNA, 867 bp, Neisseria meningitidis
atgtggaaaatgttgaaacacatagcccaaacccaccgcaagcgattgattggcacattttccctggtcggactggaaaaccttttgatgctggtgtatccggtgtttggcggccgggcgatcaatgccgtgattgcgggggaggtgtggcaggcgttgctgtacgctttggttgtgcttttgatgtggctggtcggtgcggtgcggcggattgccgatacgcgcacgtttacgcggatttataccgaaatcgccgtgccggtcgtgttggaacagcggcagcgacaagtcccgcattcggcggtaactgcgcgggttgccctgtcgcgtgagtttgtcagcttttttgaagaacacctgccgattgccgcgacatccgtcgtatccatattcggcgcgtgcatcatgctgctggtgctggaattttgggtcggcgtgtcggcggtgggcatacttgcgttgtttttatggcttttgccacgttttgccgccatcagcgaaaacctgtatttccgcctgaacaacagcttggaacgcgacaaccactttatccgaaaaggcgaccggcggcagctgtaccgccattacggactgcttgcgcgcctgcgtgtgctgatttccaaccgcgaagccttcggctatctctgcgtcggcacggcgatgggtattttgttcggctttgcttttgtgatgatgacgctcaaaggctacagcagcgcggggcatgtctattcggtcggcacttatctgtggatgtttgccatgagtttggacgacgtgccgcgattggtcgaacaatattccaatttgaaagacatcggacaacggatagagtggtcggaacggaacatcaaagccggaacttga

SEQ ID NO: 34 - protein, 288 aa, Neisseria meningitidis
MWKMLKHIAQTHRKRLIGTFSLVGLENLLMLVYPVFGGRAINAVIAGEVWQALLYALVVLLMWLVGAVRRIADTRTFTRIYTEIAVPVVLEQRQRQVPHSAVTARVALSREFVSFFEEHLPIAATSVVSIFGACIMLLVLEFWVGVSAVGILALFLWLLPRFAAISENLYFRLNNSLERDNHFIRKGDRRQLYRHYGLLARLRVLISNREAFGYLCVGTAMGILFGFAFVMMTLKGYSSAGHVYSVGTYLWMFAMSLDDVPRLVEQYSNLKDIGQRIEWSERNIKAGT

SEQ ID NO: 35 - DNA, 843 bp, Neisseria meningitidis
agccaaaaccaccgcaagcgattgattggcacattttttctggtcggactggaaaaccttttgatgctggtgtatccggtgtttggcggctgggcgattaatgccgtgattgcggggcaggcgtggcaggcgttgctgtacgctttggttgtgcttttgatgtggctggtcggtgcggcgcggcggattgccgatacgcgcacgtttacgcggatttataccgaaatcgccgtgccggttgtgttggaacagcggcagcggcaagtcccgcattcggcggtaactgcgcgggttgccctgtcgcgtgagtttgtcagcttttttgaagaacacctgccgattgccgcgacatccgtcgtatccatattcggcgcgtgcatcatgctgctggtgctggaattttgggtcggcgtgtcggcggtgggcatacttgcgttgtttttatggcttttgccacgttttgccgccatcagcgaaaacctgtatttccgcctgaagaacagcttggaacgcgacaaccactttatccgaaaaggcgacgagcggcagctggaccgccattacggactgcttgcgcgcctgcgtgtgctgatttccaaccgcgaagccttcggctatctctgcgtcggcacggcgatgggtattttgttcggctttgcttttgtgatgatgacgctcaaaggctacagcagcgcggggcatgtctattcggtcggcacttatctgtggatgtttgccataagtttggacgacgtgccgcgattggtcgaacaatattccaatttgaaagacatcggacaacggatagagtggtcgaaacggaacatcaaagccggaacttga

SEQ ID NO: 36 - protein, 280 aa, Neisseria meningitidis
SQNHRKRLIGTFFLVGLENLLMLVYPVFGGWAINAVIAGQAWQALLYALVVLLMWLVGAARRIADTRTFTRIYTEIAVPVVLEQRQRQVPHSAVTARVALSREFVSFFEEHLPIAATSVVSIFGACIMLLVLEFWVGVSAVGILALFLWLLPRFAAISENLYFRLKNSLERDNHFIRKGDERQLDRHYGLLARLRVLISNREAFGYLCVGTAMGILFGFAFVMMTLKGYSSAGHVYSVGTYLWMFAISLDDVPRLVEQYSNLKDIGQRIEWSKRNIKAGT

SEQ ID NO: 37 - DNA, 342 bp, Neisseria gonorrhoeae
atgaacacaacccgactgccgaccgccttcatcttgtgctgcctctgcgccgccgcttctgccgccgacaacagcatcatgacaaaagggcaaaaagtgtacgaatccaactgcatcgcctgccacggcaagaaaggggaagggcgcggcactgcgtttcctccgcttttccggtcggactgtattatgaacaaaccgcacgtcctgctgcacagcatggtcaaaggcatcgacgggacattcaaagtggagcggcaaaacctacgacggatttatgcccgcaaccgccatcagcgatgcggacattgccgccgtcgccacttatatcatgaacgcctttga

SEQ ID NO: 38 - protein, 113 aa, Neisseria gonorrhoeae
MNTTRLPTAFILCCLCAAASAADNSIMTKGQKVYESNCIACHGKKGEGRGTAFPPLFRSDCIMNKPHVLLHSMVKGIDGTFKVERQNLRRIYARNRHQRCGHCRRRHLYHERL

SEQ ID NO: 39 - DNA, 341 bp, Neisseria meningitidis
atgaacacaacccgactgccgaccgccctcgtcttgggctgcttctgcgccgccgcttctgccgccgacaacagcatcatgacaaaagggcaaaaagtgtacgaatccaactgcgtcgcctgccacggcaaaaagggcgaaggccgcggaaccatgtttccgccgctctaccgctccgacttcatcatgaaaaaaccgcaggtgctgctgcacagcatggtcaaaggcatcaacggtacaatcaaagtcaacggcaaaacctacaacggattcatgcccgcaaccgccatcagcgatgcggacattgccgccgtcgccacttatatcatgaacgcctttga

SEQ ID NO: 40 - protein, 113 aa, Neisseria meningitidis
  misc_feature (84)..(84): Xaa can be any naturally occurring amino acid
MNTTRLPTALVLGCFCAAASAADNSIMTKGQKVYESNCVACHGKKGEGRGTMFPPLYRSDFIMKKPQVLLHSMVKGINGTIKVXRQNLQRIHARNRHQRCGHCRRRHLYHERL

SEQ ID NO: 41 - DNA, 341 bp, Neisseria meningitidis
atgaacacaacccgactgccgaccgccctcgtcttgggctgcctctgcgccgccgcttctgccgccgacaacagcatcatgacaaaagggcaaaaagtgtacgaatccaactgcgtcgcctgccacggcaaaaagggcgaaggccgcggaaccatgtttccgccgctctaccgctccgacttcatcatgaaaaaaccgcaggtgctgctgcacagcatggtcaaaggcatcaacggtacaatcaaagtcaacggcaaaacctacaacggattcatgcccgccactgccatcagcgatgcggacattgccgccgtcgccacttatatcatgaacgcctttga

SEQ ID NO: 42 - DNA, 341 bp, Neisseria meningitidis; identical to SEQ ID NO: 41

SEQ ID NO: 43 - DNA, 399 bp, Neisseria gonorrhoeae
atgaacacaacccgactgccgaccgccttcatcttgtgctgcctctgcgccgccgcttctgccgccgacaacagcatcatgacaaaagggcaaaaagtgtacgaatccaactgcatcgcctgccacggcaagaaaggggaagggcgcggcactgcgtttcctccgcttttccggtcggactatattatgaacaaaccgcacgtcctgctgcacagcatggtcaaaggcatcaacggtacaatcaaagtcaacggcaaaacctacaacggattcatgcccgcaaccgccatcagcgatgcggacattgccgccgtcgccacttatatcatgaacgcctttgacaacggcggcggaagcgttaccgaaaaagacgtaaaacaggcaaaaggcaaaaaaaac

SEQ ID NO: 44 - protein, 133 aa, Neisseria gonorrhoeae
MNTTRLPTAFILCCLCAAASAADNSIMTKGQKVYESNCIACHGKKGEGRGTAFPPLFRSDYIMNKPHVLLHSMVKGINGTIKVNGKTYNGFMPATAISDADIAAVATYIMNAFDNGGGSVTEKDVKQAKGKKN

SEQ ID NO: 45 - DNA, 402 bp, Neisseria meningitidis
atgaacacaacccgactgccgaccgccctcgtcttgggctgcttctgcgccgccgcttctgccgccgacaacagcatcatgacaaaagggcaaaaagtgtacgaatccaactgcgtcgcctgccacggcaaaaagggcgaaggccgcggaaccatgtttccgccgctctaccgctccgacttcatcatgaaaaaaccgcaggtgctgctgcacagcatggtcaaaggcatcaacggtacaatcaaagtcaacggcaaaacctacaacggattcatgcccgcaaccgccatcagcgatgcggacattgccgccgtcgccacttatatcatgaacgcctttgacaacggcggcggaagcgttaccgaaaaagacgtaaaacaggcaaaaagcaaaaaaaactaa

SEQ ID NO: 46 - protein, 133 aa, Neisseria meningitidis
MNTTRLPTALVLGCFCAAASAADNSIMTKGQKVYESNCVACHGKKGEGRGTMFPPLYRSDFIMKKPQVLLHSMVKGINGTIKVNGKTYNGFMPATAISDADIAAVATYIMNAFDNGGGSVTEKDVKQAKSKKN

SEQ ID NO: 47 - DNA, 396 bp, Neisseria meningitidis
atgaacacaacccgactgccgaccgccctcgtcttgggctgcctctgcgccgccgcttctgccgccgacaacagcatcatgacaaaagggcaaaaagtgtacgaatccaactgcgtcgcctgccacggcaaaaagggcgaaggccgcggaaccatgtttccgccgctctaccgctccgacttcatcatgaaaaaaccgcaggtgctgctgcacagcatggtcaaaggcatcaacggtacaatcaaagtcaacggcaaaacctacaacggattcatgcccgccactgccatcagcgatgcggacattgccgccgtcgccacttatatcatgaacgcctttgacaacggcggcggaagcgttaccgaaaaagacgtaaaacaggcaaaaaacaaaaaa

SEQ ID NO: 48 - protein, 132 aa, Neisseria meningitidis
MNTTRLPTALVLGCLCAAASAADNSIMTKGQKVYESNCVACHGKKGEGRGTMFPPLYRSDFIMKKPQVLLHSMVKGINGTIKVNGKTYNGFMPATAISDADIAAVATYIMNAFDNGGGSVTEKDVKQAKNKK

SEQ ID NO: 49 - DNA, 495 bp, Neisseria gonorrhoeae
atgaacaacagacattttgccgtcatcgccttgggcagcaaccttgacaaccccgcacaacaaatacgcggcgcattagacgcgctctcgtcccatcctgacatccggcttgaacaggtttcctcactgtatatgaccgcacctgtcggttacgacaatcagcccgatttcatcaatgccgtctgcaccgtttccaccaccttggacggcattgccctgcttgccgaactcaaccgtatcgaagccgatttcggacgcgaacgcagtttccgcaatgcaccgcgcacattggatttggacattatcgactttgacggcatctccagcgacgacccccgccttaccctgccgcatccgcgcgcgcacgaacgcagtttcgtcatacgccctttggcagaaatcctccctgattttattttgggaaaatacggaaaggttgtcgaattgtcaaaacggctgggcaatcaaggcatccgtcttttaccggacaggtaa

SEQ ID NO: 50 - protein, 164 aa, Neisseria gonorrhoeae
MNNRHFAVIALGSNLDNPAQQIRGALDALSSHPDIRLEQVSSLYMTAPVGYDNQPDFINAVCTVSTTLDGIALLAELNRIEADFGRERSFRNAPRTLDLDIIDFDGISSDDPRLTLPHPRAHERSFVIRPLAEILPDFILGKYGKVVELSKRLGNQGIRLLPDR

SEQ ID NO: 51 - DNA, 497 bp, Neisseria meningitidis
atgaacaacagacattttgccgtcatcgccctgggcagtaatcttgaaaaccctgctcaacaggtacgcgccgcattggacacgctgtcgtcccatcctgacatccgtcttaaacaggcttcctcactgtatatgaccgcgcccgtcggttacgacaatcagcccgattttgtcaatgccgtctgcaccgtttccaccactctggacggcattgccytgcttgccgaactcaaccgtatcgaggctgatttcggacgcgaacgcagcttccgcaacgcgccgcgcacattgkatttggacattatcgactttgacggcatctccagcgacgacacscgactcaccttgccgcatccgcgcgcgcacgaacgcagtttcgtcatccgccctttggcagaaatcctccctgattttgttttaggaaaacacggaaaggttgccgaattgtcaaaacggytgggcaatcaaggtatccgtcttttaccggacaggtaatt

SEQ ID NO: 52 - protein, 164 aa, Neisseria meningitidis
  misc_feature (98)..(98): Xaa can be any naturally occurring amino acid
MNNRHFAVIALGSNLENPAQQVRAALDTLSSHPDIRLKQASSLYMTAPVGYDNQPDFVNAVCTVSTTLDGIALLAELNRIEADFGRERSFRNAPRTLXLDIIDFDGISSDDTRLTLPHPRAHERSFVIRPLAEILPDFVLGKHGKVAELSKRLGNQGIRLLPDR

SEQ ID NO: 53 - DNA, 495 bp, Neisseria meningitidis
atgaacaacagacattttgccgtcatcgccctgggcagtaatcttgaaaaccctgcccaacaggtacgcgccgcattggacacgctgtcgtcccatcctgacatccgtcttaaacaggcttcctcactgtatatgaccgcgcccgtcggttacgacaatcagcccgatttcgtcaatgccgtctgcaccgtttccaccaccttggacggcattgccctgcttgccgaactcaaccgtatcgaagccgatttcggacgcgaacgcagcttccgcaacgcgccgcgcacattggatttggacattatcgactttgacggcatctccagcgacgacccccgactcaccctgccgcatccgcgcgcgcacgaacgcagtttcgtcatacgccctttggcagaaatcctccctgattttattttgggaaaacacggaaaggttgccgaattgtcaaaacggctgggcaatcaaggcatccgtcttttaccggataagtaa

SEQ ID NO: 54 - protein, 164 aa, Neisseria meningitidis
MNNRHFAVIALGSNLENPAQQVRAALDTLSSHPDIRLKQASSLYMTAPVGYDNQPDFVNAVCTVSTTLDGIALLAELNRIEADFGRERSFRNAPRTLDLDIIDFDGISSDDPRLTLPHPRAHERSFVIRPLAEILPDFILGKHGKVAELSKRLGNQGIRLLPDK

SEQ ID NO: 55 - DNA, 261 bp, Neisseria gonorrhoeae
atgccccgcgctgccgtagcctttgagcgtcatcatcacaaaagcaaagccgaacaaaatacccatcgccgcgccgacgcagagatagccgaaggcttcgcggttggaaatcagcacacgcaggcgcgaaaccagtccgtaatggcggtacagctgccgctcgtcgccttttcggataaagtggttgtcgcgttccaagctgttgttcaggcggaaatacaggttttcgctgatggcggcaaaacgtggcaaaagccataa

SEQ ID NO: 56 - protein, 86 aa, Neisseria gonorrhoeae
MPRAAVAFERHHHKSKAEQNTHRRADAEIAEGFAVGNQHTQARNQSVMAVQLPLVAFSDKVVVAFQAVVQAEIQVFADGGKTWQKP

SEQ ID NO: 57 - DNA, 261 bp, Neisseria meningitidis
atgccccgcgctgctgtagcctttgagcgtcatcatcacaaaagcaaagccgaacaaaatacccatcgccgtgccgacgcagagatagccgaaggcttcgcggttggaaatcagcacacgcaggcgcgcaagcagtccgtaatggcggtacagctgccgccggtcgccttttcggataaagtggttgtcgcgttccaagctgttgttcaggcggaaatacaggttttcgctgatggcggcaaaacgtggcaaaagccataa

SEQ ID NO: 58 - protein, 86 aa, Neisseria meningitidis
MPRAAVAFERHHHKSKAEQNTHRRADAEIAEGFAVGNQHTQARKQSVMAVQLPPVAFSDKVVVAFQAVVQAEIQVFADGGKTWQKP

SEQ ID NO: 59 - DNA, 261 bp, Neisseria meningitidis
atgccccgcgctgctgtagcctttgagcgtcatcatcacaaaagcaaagccgaacaaaatacccatcgccgtgccgacgcagagatagccgaaggcttcgcggttggaaatcagcacacgcaggcgcgcaagcagtccgtaatggcggtccagctgccgctcgtcgccttttcggataaagtggttgtcgcgttccaagctgttcttcaggcggaaatacaggttttcgctgatggcggcaaaacgtggcaaaagccataa

SEQ ID NO: 60 - protein, 86 aa, Neisseria meningitidis
MPRAAVAFERHHHKSKAEQNTHRRADAEIAEGFAVGNQHTQARKQSVMAVQLPLVAFSDKVVVAFQAVLQAEIQVFADGGKTWQKP

SEQ ID NO: 61 - DNA, 1248 bp, Neisseria gonorrhoeae
atgggttttcctgttcgcaagtttgatgccgtgattgtcggcggtggcggtgcaggtttacgtgcagccctccaattatccaaatccggtttgaattgtgccgttttgtctaaagtgttcccgacccgctcgcataccgtagcggcgcagggcggtatttccgcctctctgggtaatgtgcaggaggaccgttgggactggcacatgtacgataccgtgaaaggttccgactggctgggcgaccaagatgcgattgagtttatgtgtcgcgctgcgcctgaagcggtgattgagttggaacacatgggtatgccttttgaccgcgttgaaagcggcaaaatttatcagcgtcctttcggcggacatactgccgaacatggtaaacgtgcggtagaacgtgcatgtgcggttgccgaccgtaccggtcatgcgatgttgcatactttgtaccaacaaaacgtccgtgccaatacacaattctttgtggaatggacggcgcaagatttgattcgtgatgaaaacggcgatgtcgtcggcgtaaccgccatggaaatggaaacgggcgaagtttatattttccacgccaaggccgtgatgtttgctaccggtggcggcggtcgtatttatgcttcttctaccaatgcttatatgaataccggtgacggtttgggcatttgcgcccgtgcgggcattccgttggaagatatggaattctggcaattccacccgaccggcgtggcgggtgcgggcgtgttgattaccgaaggcgtacgcggcgagggcggtattctgttgaacgccgacggcgaacgctttatggaacgctatgcgccgaccgtaaaagacttggcttctcgcgacgtggtttcacgcgcgatggcgatggaaatctatgaaggtcgcggctgtggtaaaaacaaagaccacgtcttactgaaaatcgaccatatcggtgcagaaaaaattatggaaaaactgccgggcatccgcgagatttccattcagtttgccggtatcgatccgattaaagacccgattccggttgtgccgactacccactatatgatgggcggcattccgaccaattatcacggtgaagttgttgttccgcaaggcgacgagtacgaagtacctgtaaaaggcctgtatgccgcaggtgagtgcgcctgtgcttccgtacacggtgcgaaccgtttgggtacgaactccctgctggacttggtggtgttccgcccaaccccccggtga

SEQ ID NO: 62 - protein, 415 aa, Neisseria gonorrhoeae
MGFPVRKFDAVIVGGGGAGLRAALQLSKSGLNCAVLSKVFPTRSHTVAAQGGISASLGNVQEDRWDWHMYDTVKGSDWLGDQDAIEFMCRAAPEAVIELEHMGMPFDRVESGKIYQRPFGGHTAEHGKRAVERACAVADRTGHAMLHTLYQQNVRANTQFFVEWTAQDLIRDENGDVVGVTAMEMETGEVYIFHAKAVMFATGGGGRIYASSTNAYMNTGDGLGICARAGIPLEDMEFWQFHPTGVAGAGVLITEGVRGEGGILLNADGERFMERYAPTVKDLASRDVVSRAMAMEIYEGRGCGKNKDHVLLKIDHIGAEKIMEKLPGIREISIQFAGIDPIKDPIPVVPTTHYMMGGIPTNYHGEVVVPQGDEYEVPVKGLYAAGECACASVHGANRLGTNSLLDLVVFRPTPR

SEQ ID NO: 63 - DNA, 696 bp, Neisseria meningitidis
  misc_feature (1)..(1): n is a, c, g, or t
  misc_feature (100)..(100): n is a, c, g, or t
ntccaattatccaaatccggtctgaattgtgccgttttgtctaaagtgttcccgacccgttcgcataccgtagcggcgcagggcggtatttccgcctctntgggtaatgtgcaggaagaccgttgggactggcacatgtacgataccgtgaaaggttccgactggttgggcgaccaagatgcgattgagtttatgtgccgcgccgcgcctgaagccgtaattgagttggaacacatgggtatgccttttgaccgtgtggaaagcggtaaaatttatcagcgtcctttcggcggccatactgccgaacacggtaaacgcgcggtagaacgcgyctgtgcggttgccgaccgtacaggtcatgcgatgctgcatactttgtaccaacaaaacgtccgtgccaatacgcaattctttgtggaatggacggcacaagatttgattcgtgatgaaaacggcgatgtcgtcggcgtaaccgccatggaaatggaaaccggcgaagtttatattttccacgctaaagctgtgatgtttgctaccggcggcggcggtcgtatttatgcgtcttctaccaatgcctatatgaataccggcgatggtttgggtatttgtgcgcgtgcaggtatcccgttggaagacatggaattctggcaattccagccgaccggcgtggcgggtgcgggcgtgttgattaccgaa

SEQ ID NO: 64 - protein, 202 aa, Neisseria meningitidis
  misc_feature (1)..(1): Xaa can be any naturally occurring amino acid
  misc_feature (34)..(34): Xaa can be any naturally occurring amino acid
XQLSKSGLNCAVLSKVFPTRSHTVAAQGGISASXGNVQEDRWDWHMYDTVKGSDWLGDQDAIEFMCRAAPEAVIELEHMGMPFDRVESGKIYQRPFCAVADRTGHAMLHTLYQQNVRANTQFFVEWTAQDLIRDENGDVVGVTAMEMETGEVYIFHAKAVMFATGGGGRIYASSTNGIPLEDMEFWQFQPTGVAGAGVLITE

SEQ ID NO: 65 - DNA, 1764 bp, Neisseria meningitidis
  misc_feature (67)..(67): n is a, c, g, or t
  misc_feature (408)..(408): n is a, c, g, or t
atgggctttcctgttcgcaagtttgatgccgtgattgtcggcggtggtggtgcaggtttacgcgcanccctccaattatccaaatccggtctgaattgtgccgttttgtctaaagtgttcccgacccgttcgcataccgtagcggcgcagggcggtatttccgcctctctgggtaatgtgcaggaagaccgttgggactggcacatgtacgataccgtgaaaggttccgactggttgggcgaccaagatgcgattgagtttatgtgccgcgccgcgcctgaagccgtaattgagttggaacacatgggtatgccttttgaccgtgtggaaagcggtaaaatttatcagcgtcctttcggcggccatactgccgaacacggtaaacgcgcggtagaacgcgcctgtgcngttgccgaccgtacaggtcatgcgatgctgcatactttgtaccaacaaaatgtccgtgccaatacgcaattctttgtggaatggacggcacaagatttgattcgtgatgaaaacggcgatgtcgtcggcgtaaccgccatggaaatggaaaccggcgaagtttatattttccacgctaaagctgtgatgtttgctaccggcggcggcggccgtatttatgcgtcttctaccaatgcctatatgaataccggcgatggtttgggtatttgtgcgcgtgcaggtatcccgttggaagacatggaattctggcaattccacccgaccggcgtggcaggtgcgggcgtgttgattaccgaaggcgtacgcggcgagggcggtattctgttgaatgccgacggcgaacgctttatggaacgctatgcgccgaccgtaaaagacttggcttctcgcgacgttgtttcccgcgcgatggcgatggaaatctacgaaggtcgcggctgcggtaaaaacaaagaccatgtcttactgaaaatcgaccatatcggcgcagaaaaaattatggaaaaactgccgggcatccgcgagatttccattcagttcgccggtatcgatccgattaaagacccgattcccgttgtgccgactacccactatatgatgggcggtattccgaccaactaccatggcgaagttgtcgttcctcaaggcgacgaatacgaagtgcctgtaaaaggtctgtatgcggcaggtgagtgcgcctgtgcttccgtacacggtgcgaaccgcttgggtacgaactccctgctggacttagtggtattcggtaaagctgccggcgacagcatgattaaattcatcaaagagcaaagcgactggaaacctttgcctgctaatgccggcgaactgacccgccaacgtatcgagcgtttggacaatcaaactgatggtgaaaacgttgatgcattgcgccgcgaactgcaacgctccgtacaattgcacgccggcgtgttccgtactgatgagattctgagcaaaggcgttcgagaagtcatggcgattgccgagcgtgtgaaacgtaccgaaatcaaagacaagagcaaagtgtggaataccgcgcgtatcgaggctttggaattggataacctaattgaagtggcgaaagcgactttggtgtctgccgaagcacgtaaagaatcacgcggtgcgcacgcttcagacgaccatcctgagcgcgatgatgaaaactggatgaaacatacgctgtaccattcagatgccaataccttgtcctacaaaccggtgcacaccaagcctttgagcgtggaatacatcaaaccggccaagcgcgtttattga

SEQ ID NO: 66 - protein, 587 aa, Neisseria meningitidis
  misc_feature (23)..(23): Xaa can be any naturally occurring amino acid
MGFPVRKFDAVIVGGGGAGLRAXLQLSKSGLNCAVLSKVFPTRSHTVAAQGGISASLGNVQEDRWDWHMYDTVKGSDWLGDQDAIEFMCRAAPEAVIELEHMGMPFDRVESGKIYQRPFGGHTAEHGKRAVERACAVADRTGHAMLHTLYQQNVRANTQFFVEWTAQDLIRDENGDVVGVTAMEMETGEVYIFHAKAVMFATGGGGRIYASSTNAYMNTGDGLGICARAGIPLEDMEFWQFHPTGVAGAGVLITEGVRGEGGILLNADGERFMERYAPTVKDLASRDVVSRAMAMEIYEGRGCGKNKDHVLLKIDHIGAEKIMEKLPGIREISIQFAGIDPIKDPIPVVPTTHYMMGGIPTNYHGEVVVPQGDEYEVPVKGLYAAGECACASVHGANRLGTNSLLDLVVFGKAAGDSMIKFIKEQSDWKPLPANAGELTRQRIERLDNQTDGENVDALRRELQRSVQLHAGVFRTDEILSKGVREVMAIAERVKRTEIKDKSKVWNTARIEALELDNLIEVAKATLVSAEARKESRGAHASDDHPERDDENWMKHTLYHSDANTLSYKPVHTKPLSVEYIKPAKRVY

SEQ ID NO: 67 - DNA, 1248 bp, Neisseria gonorrhoeae; identical to SEQ ID NO: 61

SEQ ID NO: 68 - protein, 415 aa, Neisseria gonorrhoeae; identical to SEQ ID NO: 62

SEQ ID NO: 69 - DNA, 1767 bp, Neisseria meningitidis
atgggttttcctgttcgcaagtttgatgccgtgattgtcggcggtggtggtgcaggtttacgcgcagccctccaattatccaaatccggtctgaattgtgccgttttgtctaaagtgttcccgacccgttcgcataccgtagcggcgcagggcggtatttccgcctctctgggtaatgtgcaggaagaccgttgggactggcacatgtacgataccgtgaaaggttccgactggttgggcgaccaagatgcgattgagtttatgtgccgcgccgcgcctgaagccgtaattgagttggaacacatgggtatgccttttgaccgtgtggaaagcggtaaaatttatcagcgtcctttcggcggccatactgccgaacacggtaaacgcgcggtagaacgcgcctgtgcggttgccgaccgtacaggtcatgcgatgctgcatactttgtaccaacaaaacgtccgtgccaatacgcaattctttgtggaatggacggcacaagatttgattcgtgatgaaaacggcgatgtcgtcggcgtaaccgccatggaaatggaaaccggcgaagtttatattttccacgctaaagctgtgatgtttgctaccggcggcggcggtcgtatttatgcgtcttctaccaatgcctatatgaataccggcgatggtttgggtatttgtgcgcgtgcaggtatcccgttggaagacatggaattctggcaattccacccgaccggcgtggcgggtgcgggcgtgttgattaccgaaggcgtacgcggcgagggcggtattctgttgaatgccgacggcgaacgctttatggaacgctatgcgccgaccgtaaaagacttggcttctcgcgacgttgtttcccgcgcgatggcgatggaaatctacgaaggtcgcggctgcggtaaaaacaaagaccatgtcttactgaaaatcgaccatatcggcgcagaaaaaattatggaaaaactgccgggcatccgcgagatttccattcagttcgccggtatcgatccgattaaagacccgattcccgttgtgccgactacccactatatgatgggcggcattccgaccaattaccacggcgaagttgtcgttccgcaaggtgaagattacgaagtgcctgtaaaaggtctgtatgcggcaggtgagtgcgcttgtgcttccgtacacggtgcgaaccgcttgggtaccaactccctgttggacttggtggtattcggtaaagctgccggcgacagcatgattaaattcatcaaagagcaaagcgactggaaacctttgcctgctaatgcaggtgagttgacccgccaacgtatcgagcgtttggacaaccaaaccgatggtgaaaacgttgatgcattgcgtcgcgaactgcaacgctctgtacaactgcacgccggcgtgttccgtactgatgagattctgagcaaaggcgttcgagaagtcatggcgattgccgagcgtgtgaaacgtaccgaaatcaaagacaagagcaaagtgtggaataccgcgcgtatcgaggctttggaattggataacctgattgaagtggcgaaagcgactttggtgtctgccgaagcacgtaaagaatcacgcggtgcgcacgcttcagacgaccatcctgagcgcgatgatgaaaactggatgaaacatacgctgtaccattcagatatcaataccttgtcctacaaaccggtgcacaccaagcctttgagcgtggaatacatcaaaccggccaagcgcgtttattgatga

SEQ ID NO: 70 - protein, 587 aa, Neisseria meningitidis
MGFPVRKFDAVIVGGGGAGLRAALQLSKSGLNCAVLSKVFPTRSHTVAAQGGISASLGNVQEDRWDWHMYDTVKGSDWLGDQDAIEFMCRAAPEAVIELEHMGMPFDRVESGKIYQRPFGGHTAEHGKRAVERACAVADRTGHAMLHTLYQQNVRANTQFFVEWTAQDLIRDENGDVVGVTAMEMETGEVYIFHAKAVMFATGGGGRIYASSTNAYMNTGDGLGICARAGIPLEDMEFWQFHPTGVAGAGVLITEGVRGEGGILLNADGERFMERYAPTVKDLASRDVVSRAMAMEIYEGRGCGKNKDHVLLKIDHIGAEKIMEKLPGIREISIQFAGIDPIKDPIPVVPTTHYMMGGIPTNYHGEVVVPQGEDYEVPVKGLYAAGECACASVHGANRLGTNSLLDLVVFGKAAGDSMIKFIKEQSDWKPLPANAGELTRQRIERLDNQTDGENVDALRRELQRSVQLHAGVFRTDEILSKGVREVMAIAERVKRTEIKDKSKVWNTARIEALELDNLIEVAKATLVSAEARKESRGAHASDDHPERDDENWMKHTLYHSDINTLSYKPVHTKPLSVEYIKPAKRVY

SEQ ID NO: 71 - DNA, 1764 bp, Neisseria meningitidis; identical to SEQ ID NO: 65
  misc_feature (67)..(67): n is a, c, g, or t
  misc_feature (408)..(408): n is a, c, g, or t

SEQ ID NO: 72 - protein, 587 aa, Neisseria meningitidis; identical to SEQ ID NO: 66
  misc_feature (23)..(23): Xaa can be any naturally occurring amino acid

SEQ ID NO: 73 - DNA, 543 bp, Neisseria gonorrhoeae
atgaagacacaccgcaagacctgctctgcggtgtgttttgcttttcagacggcatcgaaacccgccgtttccatccgacatcccagcgaggacatcatgagcctgaaaacccgccttaccgaagatatgaaaaccgcgatgcgcgccaaagatcaagtttccctcggcaccatccgcctcatcaatgccgccgtcaaacagtttgaagtagacgaacgcaccgaagccgacgatgccaaaatcaccgccatcctgaccaaaatggtcaaacagcgcaaagacggcgcgaaaatctacactgaagccggccgtcaggatttggcagacaaagaaaacgccgaaatcgacgtgctgcaccgctacctgccgcaaatgctctccgccggcgaaatccgcaccgccgtcgaagcagccgttgccgaaaccggcgcggcaggtatggcggatatgggcaaagtgatggtcgtattgaaaacccgcctcgccggcaaagccgatatgggcgaagtcaacaaaatcttgaaaaccgtactgaccgcctga

SEQ ID NO: 74 - protein, 180 aa, Neisseria gonorrhoeae
MKTHRKTCSAVCFAFQTASKPAVSIRHPSEDIMSLKTRLTEDMKTAMRAKDQVSLGTIRLINAAVKQFEVDERTEADDAKITAILTKMVKQRKDGAKIYTEAGRQDLADKENAEIDVLHRYLPQMLSAGEIRTAVEAAVAETGAAGMADMGKVMVVLKTRLAGKADMGEVNKILKTVLTA

SEQ ID NO: 75 - DNA, 497 bp, Neisseria meningitidis
atgaggacacaccgcaagacctgctctgcggtgtgttttgcttttcagacggcatcgaaacccgccgtttccatccgacatcccagcgaggacatcatgagcctgaaaatccgccttaccgaagacatgaaaaccgcgatgcgcgccaaagaccaagtttccctcggcaccatccgcctcatcaacgccgccgtcaaacagtttgaagtggacgaacgcaccgaagccgacgatgccaaaatcaccgccatcctgaccaaaatggtcaaacagcgaaaagacagcgcgaaaatctacactgaagccggccgtcaggatttggcagacaaagaaaacgccgaaatcgaggtactgcaccgctaccttccccaaatgctttccgccggcgaaatccgtaccgaggtcgaagctgccgttgccgaaaccggcgcggcaggtatggcggatatgggtaaagtcatggggctgctgaaaacccgcctcgcaggtaaagccga

SEQ ID NO: 76 - protein, 165 aa, Neisseria meningitidis
MRTHRKTCSAVCFAFQTASKPAVSIRHPSEDIMSLKIRLTEDMKTAMRAKDQVSLGTIRLINAAVKQFEVDERTEADDAKITAILTKMVKQRKDSAKIYTEAGRQDLADKENAEIEVLHRYLPQMLSAGEIRTEVEAAVAETGAAGMADMGKVMGLLKTRLAGKA

SEQ ID NO: 77 - DNA, 657 bp, Neisseria gonorrhoeae
atgctcgcccgtcgctattttttcaatatccaacccggggcggttttcactgacaaactgcttgaacaactgatgcgtttcctccagttcctgccggaatttctgtttgcccttttccgtattttcacccataaaagtaaccgtgcgcttaaattcgcccgccgtcatcacatccacatcaatatcatgttttttcaacaggcggtggatattcggcacttccgccaccacacccaccgaaccgatgaccgcaaacggagcggaaacaattttatccgccacacacgccatcatatagccgccgcttgccgcgaccttatcgacggcgacggtcagcggaatattgcgttcgcgcaaacgcctaagctgcgaagccgccaaaccgtaaccgtgaaccacgccgcccggactttccaatctgagcagaacctcatcttcaggcttggcaatcaaaagcaccgccgtaatctcatgacgcaaggattctacggcgtgtgcatacaaatcgccgtcaaaatccaacacaaaaaggcgggatttttgcgtttcggcagatttctccccgccctccttcaaacgctttttctctgctttggcttccgccttttcctttttcttttcttttttttcctgatgttttgtctcttcctcgcttaa

SEQ ID NO: 78 - protein, 218 aa, Neisseria gonorrhoeae
MLARRYFFNIQPGAVFTDKLLEQLMRFLQFLPEFLFALFRIFTHKSNRALKFARRHHIHINIMFFQQAVDIRHFRHHTHRTDDRKRSGNNFIRHTRHHIAAACRDLIDGDGQRNIAFAQTPKLRSRQTVTVNHAARTFQSEQNLIFRLGNQKHRRNLMTQGFYGVCIQIAVKIQHKKAGFLRFGRFLPALLQTLFLCFGFRLFLFLFFFFLMFCLFLA

SEQ ID NO: 79 - DNA, 657 bp, Neisseria meningitidis
  misc_feature (310)..(519): n is a, c, g, or t
  misc_feature (541)..(541): n is a, c, g, or t
atgctcgcccgttgccacttcctcaatatccaattgagggcggttctcgctgacaaactgcttgaacaactgatgcgtttcctccagttcctgtcggaatttctgtttgcccttttccgtattttcacccataaaagtaaccgtgcgcttaaattcgcccgccgtcatcacatccacatcaatatcatgttttttcaacaggcggtggatattcggtacttccgccaccacacccaccgaaccgacaatcgcaaacggagcggaagcaattttatccgccacacacgccatcatataaccgccgctcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacacaaaaaggcgtgatttntgcgtttcggcagatttctccccaccctccttcaaacgtttttcctctgctttggcttccgccttttcctttttcttttcctctttttcctgatgttgtgcctcttccccgcttaa

SEQ ID NO: 80 - protein, 217 aa, Neisseria meningitidis
  misc_feature (104)..(173): Xaa can be any naturally occurring amino acid
  misc_feature (180)..(180): Xaa can be any naturally occurring amino acid
MLARCHFLNIQLRAVLADKLLEQLMRFLQFLSEFLFALFRIFTHKSNRALKFARRHHIHINIMFFQQAVDIRYFRHHTHRTDNRKRSGSNFIRHTRHHITAARXXXXXXXXXXXXXXXXXXXXXXXXXXXXXXXXXXXXXXXXXXXXXXXXXXXXXXXXXXXXXXXXXXXXXXQHKKAFXRFGRFLPTLLQTFFLCFGFRLFLFLFLFFLMLCLFPA

SEQ ID NO: 81 - DNA, 657 bp, Neisseria meningitidis
atgctcgcccgttgccacttcctcaatatccaattgagggcggttctcgctgacaaactgcttgaacaactgatgcgtttcctccagttcctgtcggaatttctgtttgcccttttccgtattttcacccataaaagtaaccgtgcgcttaaattcgcccgccgtcatcacatccacatcaatatcatgttttttcaacaggcggtggatattcggtacttccgctacaacacccaccgaaccgacaatcgcaaacggagcggaaacaattttatccgccacacacgccatcatataaccaccgctcgccgccaccttatcgacggcgacggtcagcggaatattgcgttcgcgcaaacgcctaagctgcgaagccgccaaaccgtaaccgtgaaccacgccgcccggactttccaatctaagcagaacctcatcttcaggcttggcaatcaaaagcaccgccgtaatctcatgacgcaaggattctacggcgtgtgcatacaaatcgccgtcaaaatccaacacaaaaaggcgggatttttgcgtttcggaagatttctccccaccctccttcaaacgctttttctctgctttggcttccgccttttcctttttcttttcctctttttcctgatgttttgcctcttccccgcttaa

SEQ ID NO: 82 - protein, 218 aa, Neisseria meningitidis
MLARCHFLNIQLRAVLADKLLEQLMRFLQFLSEFLFALFRIFTHKSNRALKFARRHHIHINIMFFQQAVDIRYFRYNTHRTDNRKRSGNNFIRHTRHHITTARRHLIDGDGQRNIAFAQTPKLRSRQTVTVNHAARTFQSKQNLIFRLGNQKHRRNLMTQGFYGVCIQIAVKIQHKKAGFLRFGRFLPTLLQTLFLCFGFRLFLFLFLFFLMFCLFPA

SEQ ID NO: 83 - DNA, 657 bp, Neisseria meningitidis
atgctcgcccgttgccacttcctcaatatccaattgagggcggttctcgctgacaaactgcttgaacaactgatgcgtttcctccagttcctgtcggaatttctgtttgcccttttccgtattttcacccataaaagtaaccgtgcgcttaaattcgcccgccgtcatcacatccacatcaatatcatgttttttcaacaggcggtggatattcggtacttccgccaccacacccaccgaaccgacaatcgcaaacggagcggaagcaattttatccgccacacacgccatcatataaccgccgctcgccgccaccttatcgacggcgacggtcagcggaatattgcgttcgcgcaaacgcytaagctgcgaagccgccaaaccgtaaccgtgaaccacgccgcccggactttccaatctgagcagaacctcatcttcaggcttggcaatcaaaagcaccgccgtaatctcatgacgcaaggattctacggcgtgtgcatacaaatcgccgtcaaaatccaacacaaaaaggcgggatttttgcgtttcggcagatttctccccaccctccttcaaacgctttttctctgctttggcttccgccttttcctttttcttttcctctttttcctgatgttttgcctcttccccgcttaa

SEQ ID NO: 84 - protein, 218 aa, Neisseria meningitidis
  misc_feature (121)..(121): Xaa can be any naturally occurring amino acid
MLARCHFLNIQLRAVLADKLLEQLMRFLQFLSEFLFALFRIFTHKSNRALKFARRHHIHINIMFFQQAVDIRYFRHHTHRTDNRKRSGSNFIRHTRHHITAARRHLIDGDGQRNIAFAQTXKLRSRQTVTVNHAARTFQSEQNLIFRLGNQKHRRNLMTQGFYGVCIQIAVKIQHKKAGFLRFGRFLPTLLQTLFLCFGFRLFLFLFLFFLMFCLFPA

SEQ ID NO: 85 - DNA, 657 bp, Neisseria meningitidis; identical to SEQ ID NO: 81

SEQ ID NO: 86 - protein, 218 aa, Neisseria meningitidis; identical to SEQ ID NO: 82

SEQ ID NO: 87 - DNA, 318 bp, Neisseria gonorrhoeae
atgcctttgaccatgctgtgcagcaggacgtgcggtttgttcataatacagtccgaccggaaaagcggaggaaacgcagtgccgcgcccttcccctttcttgccgtggcaggcgatgcagttggattcgtacactttttgcccttttgtcatgatgctgttgtcggcggcagaagcggcggcgcagaggcagcacaagatgaaggcggtcggcagtcgggttgtgttcattggcgtttcccctaatgttttgaaaccttgttttttgattttgcctttacggggtgaaaagtttttttggcccaaatccggaatttag

SEQ ID NO: 88 - protein, 105 aa, Neisseria gonorrhoeae
MPLTMLCSRTCGLFIIQSDRKSGGNAVPRPSPFLPWQAMQLDSYTFCPFVMMLLSAAEAAAQRQHKMKAVGSRVVFIGVSPNVLKPCFLILPLRGEKFFWPKSGI

SEQ ID NO: 89 - DNA, 306 bp, Neisseria meningitidis
atgcctttgaccatgctgtgcagcagcacctgcggttttttcatgatgaagtcggagcggtagagcggcggaaacatggttccgcggccttcgccctttttgccgtggcaggcgacgcagttggattcgtacactttttgcccttttgtcatgatgctgttgtcggcggcagaagcggcggcgcagaagcagcccaagacgagggcggtcggcagtcgggttgtgttcattggtgtttccttcatgtttgaaaccttgttgttgattttgcgtagcgggtgaaagatttttttgccgaatcagtag

SEQ ID NO: 90 - protein, 101 aa, Neisseria meningitidis
  misc_feature (21)..(21): Xaa can be any naturally occurring amino acid
  misc_feature (94)..(94): Xaa can be any naturally occurring amino acid
MPLTMLCSSTCGFFMMKSERXSGGNMVPRPSPFLPWQATQLDSYTFCPFVMMLLSAAEAAAQKQPKTRAVGSRVVFIGVSFMFETLLLILRSGXKIFLPNQ

SEQ ID NO: 91 - DNA, 306 bp, Neisseria meningitidis
atgcctttgaccatgctgtgcagcagcacctgcggttttttcatgatgaagtcggagcggtagagcggcggaaacatggttccgcggccttcgccctttttgccgtggcaggcgacgcagttggattcgtacactttttgcccttttgtcatgatgctgttgtcggcggcagaagcggcggcgcagaggcagcccaagacgagggcggtcggcagtcgggttgtgttcattggtgtttccttaatgtttgaaaccttgttgttgattttgcgtagcgggtgaaagattttcttgccgaatcggtag

SEQ ID NO: 92 - protein, 99 aa, Neisseria meningitidis
MPLTMLCSSTCGFFMMKSERSGGNMVPRPSPFLPWQATQLDSYTFCPFVMMLLSAAEAAAQRQPKTRAVGSRVVFIGVSLMFETLLLILRSGKIFLPNR

SEQ ID NO: 93 - DNA, 375 bp, Neisseria gonorrhoeae
atgcagtatctgattgtcaaatacagccatcaaatcttcgttaccatcaccattttggtattcaacatccgttttttcctactttggaaaaatccagaaaagcccttggtcggcttttggaaagcactgccccacctcaacgacacgatgctgctgtttacgggattgtggctgatgaagattacccatttctccccgttcaacgcgccttggctcggcacaaaaatcctgctcctgttcgcctacatcgcactgggcatggtaatgatgcgcgcccgtccgcgttcgaccaagttctacaccgtttacctgctcgctatgtgttgcatcgcctgcatcgtttaccttgccaaaaccaaagtcctgccattctga

SEQ ID NO: 94 - protein, 124 aa, Neisseria gonorrhoeae
MQYLIVKYSHQIFVTITILVFNIRFFLLWKNPEKPLVGFWKALPHLNDTMLLFTGLWLMKITHFSPFNAPWLGTKILLLFAYIALGMVMMRARPRSTKFYTVYLLAMCCIACIVYLAKTKVLPF

SEQ ID NO: 95 - DNA, 285 bp, Neisseria meningitidis
aaaatcagaaaagccttggcgggcttttggaaggcactgccccaccttaacgacaccatgctgctgtttacgggattgtggctgatgaaaattacccatttctccccgttcaacgcgccttggctcggtacaaaaatcctgcttctgctcgcctatatcgcattgggtatgatgatgatgcgcgcccgtccgcgttcgaccaagttctacaccgtttacctgctcgccatgtgttgcgtcgcctgcatcgtttaccttgccaaaaccaaagtcctgcctttctga

SEQ ID NO: 96 - protein, 94 aa, Neisseria meningitidis
KIRKALAGFWKALPHLNDTMLLFTGLWLMKITHFSPFNAPWLGTKILLLLAYIALGMMMMRARPRSTKFYTVYLLAMCCVACIVYLAKTKVLPF

SEQ ID NO: 97 - DNA, 375 bp, Neisseria meningitidis
  misc_feature (79)..(79): n is a, c, g, or t
atgcagtatctgattgtcaaatacagccatcaaatcttcgttaccatcaccattttggtattcaacatccgtgttttcntactttggaaaaatccagaaaagcccttggcgggcttttggaaggcactgccccaccttaacgacaccatgctgctgtttacgggattgtggctgatgaaaattacccatttctccccgttcaacgcgccttggctcggtacaaaaatcctgcttctgctcgcctatatcgcattgggtatgatgatgatgcgcgcccgtccgcgttcgaccaagttctacaccgtttacctgctcgccatgtgttgcctcacctgcatcgtttaccttgccaaaaccaaagtcctgcctttctga

SEQ ID NO: 98 - protein, 124 aa, Neisseria meningitidis
  misc_feature (27)..(27): Xaa can be any naturally occurring amino acid
MQYLIVKYSHQIFVTITILVFNIRVFXLWKNPEKPLAGFWKALPHLNDTMLLFTGLWLMKITHFSPFNAPWLGTKILLLLAYIALGMMMMRARPRSTKFYTVYLLAMCCLTCIVYLAKTKVLPF

SEQ ID NO: 99 - DNA, 312 bp, Neisseria gonorrhoeae
atgcagcaggggcagttggttggacgcgtcgcccgcaataaagatatgcggaatgctggtctgcatggtcagcggatcggcaacgggtacgccgcgcgcgtctttgtcgatattgatgttttccaaaccgatattgtcaacgttcggacggcgacctacggctgccaacatatattcggcaacaaatacgcctttttcgccatcctgctcccaatggacttctacattgccgtctgcgtcgagtttgacctcggttttagcatccagatgcagtttcaattcttctccgaacacggctttcgcctcgtctga

SEQ ID NO: 100 - protein, 103 aa, Neisseria gonorrhoeae
MQQGQLVGRVARNKDMRNAGLHGQRIGNGYAARVFVDIDVFQTDIVNVRTATYGCQHIFGNKYAFFAILLPMDFYIAVCVEFDLGFSIQMQFQFFSEHGFRLV

SEQ ID NO: 101 - DNA, 312 bp, Neisseria meningitidis
atgcagcagaggcagttggttggacgcatcgcctgcgatgaagatatgcggaatactggtctgcatggtcagcgggtcggcaacaggtacgccgcgcgcatctttttcgatattgatattttccaaaccgatattgtcaacgttcggacggcggcccacggctgccagcatatattcggcaacaaatacgcctttttcgccatcctgctcccaatggacttctacattgccgtctgcatcgagtttgacctcggttttagcatccagatgcagtttcaattcttcgccgaacacggcgttcgcctcgtctga

SEQ ID NO: 102 - protein, 103 aa, Neisseria meningitidis
MQQRQLVGRIACDEDMRNTGLHGQRVGNRYAARIFFDIDIFQTDIVNVRTAAHGCQHIFGNKYAFFAILLPMDFYIAVCIEFDLGFSIQMQFQFFAEHGVRLV

SEQ ID NO: 103 - DNA, 312 bp, Neisseria meningitidis
atgcagcaggggcagttggttggacgcgtcgcccgcaataaagatatgcggaatactggtctgcatagtcagcggatcggcaacgggtacgccgcgcgcatctttttcgatattgatgttttccaaaccgatattgtcaacgttcggacggcggcctacggctgccagcatatattcggcaacaaatacgcctttttcgccatcctgctcccaatggacttctacattgccgtctgcgtcgagtttggcctcggttttagcatccaaatgcagtttcaattcttcaccgaacacggctttcgcctcgtctga

SEQ ID NO: 104 - protein, 103 aa, Neisseria meningitidis
MQQGQLVGRVARNKDMRNTGLHSQRIGNGYAARIFFDIDVFQTDIVNVRTAAYGCQHIFGNKYAFFAILLPMDFYIAVCVEFGLGFSIQMQFQFFTEHGFRLV

SEQ ID NO: 105 - DNA, 268 bp, Neisseria gonorrhoeae
ctgctggcggccctggtgcttgccgcgtgttcttcgacaaacacactgccagccggcaagaccccggcagacaatatagaaactgccgacctttcggcaagcgttcccacccgccctgccgaaccggaaggaaaaacgctggcagattacggcggctacccgtccgcactggatgcagtgaaacagaacaacgatgcggcagccgccgcctatttggaaaacgcaggagacagcgcgatggcggaaaatgtccgcaaggagtggctga

SEQ ID NO: 106 - protein, 89 aa, Neisseria gonorrhoeae
LLAALVLAACSSTNTLPAGKTPADNIETADLSASVPTRPAEPEGKTLADYGGYPSALDAVKQNNDAAAAAYLENAGDSAMAENVRKEWL

SEQ ID NO: 107 - DNA, 1572 bp, Neisseria meningitidis
atgtacctaccctctatgaagcattccctgccgctgctggcggccctggtgcttgccgcgtgttcttcgacaaacacactgccagccggcaagaccccggcagacaatatagaaactgccgacctttcggcaagcgttcccacccgccctgccgaacccgaaagaaaaacgctggcagattacggcggctacccgtccgcactggatgcagtgaaacagaaaaacgatgccgccgtcgccgcctatttggaaaacgccggcgacagcgcgatggcggaaaatgtccgcaacgagtggctgaagtctttgggcgcacgcagacagtggacgctgtttgcacaggaatacgccaaactcgaaccggcagggcgcgcccaagaagtcgaatgctacgccgattcgagccgcaacgactatacgcgtgccgctgaactggtcaaaaatacgggcaaactgccttcgggctgcaccaaactgttggaacaggcagccgcatccggcttgttggacggcaacgacgcctggaggcgcgtgcgcggactgctggccggccgccaaaccacagacgcacgcaaccttgccgccgcattgggcagcccgtttgacggcggtacacaaggttcgcgcgaatatgccctgttgaacgtcatcggcaaagaagcacgcaaatcgccgaatgccgccgccctgctgtccgaaatggaaagcggtttaagcctcgaacaacgcagtttcgcgtggggcgtattggggcattatcagtcgcaaaacctcaatgtgcctgccgccttggactattacggcaaggttgccgaccgccgccaactgaccgacgaccaaatcgagtggtacgcccgcgccgccttgcgcgcccgacgttgggacgagctggcctccgttatctcgcatatgcccgaaaaactgcaaaaaagcccgacctggctctactggctggcacgcagccgcgccgcaacgggcaacacgcaagaggcggaaaaactttacaaacaggcggcagcgacgggcaggaatttttatgcggtgctggcaggggaagaattgggtcggaaaatcgatacgcgcaacaatgtgcccgatgccggcaaaaacagcgtccgccgcatggcggaagacggtgcagtcaaacgcgcactggtactgttccaaaacagccaatctgccggtgatgcaaaaatgcgccgtcaggctcaggcggaatggcgttttgccacacgcggctttgacgaagacaagctgctgaccgccgcgcaaaccgcgttcgaccacggtttttacgatatggcggtcaacagcgcggaacgcaccgaccgcaaactcaactacaccttgcgctatatttcgccgtttaaagacacggtaatccgccacgcgcaaaatgttaatgtcgatccggcttgggtttatgggctgattcgtcaggaaagccgcttcgttataggcgcgcaatcccgcgtaggcgcgcaggggctgatgcaggttatgcctgccaccgcgcgcgaaatcgccggcaaaatcggtatggatgccgcacaactttacaccgccgacggg

SEQ ID NO: 108 - protein, 524 aa, Neisseria meningitidis
MYLPSMKHSLPLLAALVLAACSSTNTLPAGKTPADNIETADLSASVPTRPAEPERKTLADYGGYPSALDAVKQKNDAAVAAYLENAGDSAMAENVRNEWLKSLGARRQWTLFAQEYAKLEPAGRAQEVECYADSSRNDYTRAAELVKNTGKLPSGCTKLLEQAAASGLLDGNDAWRRVRGLLAGRQTTDARNLAAALGSPFDGGTQGSREYALLNVIGKEARKSPNAAALLSEMESGLSLEQRSFAWGVLGHYQSQNLNVPAALDYYGKVADRRQLTDDQIEWYARAALRARRWDELASVISHMPEKLQKSPTWLYWLARSRAATGNTQEAEKLYKQAAATGRNFYAVLAGEELGRKIDTRNNVPDAGKNSVRRMAEDGAVKRALVLFQNSQSAGDAKMRRQAQAEWRFATRGFDEDKLLTAAQTAFDHGFYDMAVNSAERTDRKLNYTLRYISPFKDTVIRHAQNVNVDPAWVYGLIRQESRFVIGAQSRVGAQGLMQVMPATAREIAGKIGMDAAQLYTADG

SEQ ID NO: 109 - DNA, 1851 bp, Neisseria meningitidis
  misc_feature (44)..(44): n is a, c, g, or t
  misc_feature (68)..(68): n is a, c, g, or t
  misc_feature (145)..(145): n is a, c, g, or t
  misc_feature (163)..(163): n is a, c, g, or t
  misc_feature (173)..(173): n is a, c, g, or t
  misc_feature (335)..(335): n is a, c, g, or t
  misc_feature (342)..(342): n is a, c, g, or t
  misc_feature (351)..(351): n is a, c, g, or t
  misc_feature (367)..(367): n is a, c, g, or t
  misc_feature (801)..(801): n is a, c, g, or t
  misc_feature (864)..(865): n is a, c, g, or t
  misc_feature (867)..(868): n is a, c, g, or t
  misc_feature (871)..(873): n is a, c, g, or t
  misc_feature (876)..(877): n is a, c, g, or t
  misc_feature (881)..(881): n is a, c, g, or t
  misc_feature (883)..(883): n is a, c, g, or t
  misc_feature (885)..(885): n is a, c, g, or t
  misc_feature (888)..(889): n is a, c, g, or t
  misc_feature (894)..(895): n is a, c, g, or t
  misc_feature (899)..(900): n is a, c, g, or t
  misc_feature (902)..(902): n is a, c, g, or t
  misc_feature (904)..(904): n is a, c, g, or t
  misc_feature (907)..(910): n is a, c, g, or t
  misc_feature (914)..(915): n is a, c, g, or t
  misc_feature (918)..(918): n is a, c, g, or t
  misc_feature (923)..(928): n is a, c, g, or t
  misc_feature (930)..(930): n is a, c, g, or t
  misc_feature (933)..(933): n is a, c, g, or t
  misc_feature (935)..(936): n is a, c, g, or t
  misc_feature (938)..(939): n is a, c, g, or t
  misc_feature (941)..(941): n is a, c, g, or t
  misc_feature (943)..(943): n is a, c, g, or t
  misc_feature (945)..(946): n is a, c, g, or t
  misc_feature (948)..(948): n is a, c, g, or t
  misc_feature (951)..(952): n is a, c, g, or t
  misc_feature (972)..(972): n is a, c, g, or t
  misc_feature (988)..(988): n is a, c, g, or t
  misc_feature (990)..(990): n is a, c, g, or t
  misc_feature (996)..(996): n is a, c, g, or t
  misc_feature (1002)..(1002): n is a, c, g, or t
  misc_feature (1021)..(1021): n is a, c, g, or t
  misc_feature (1028)..(1028): n is a, c, g, or t
  misc_feature (1041)..(1041): n is a, c, g, or t
  misc_feature (1048)..(1048): n is a, c, g, or t
  misc_feature (1050)..(1050): n is a, c, g, or t
  misc_feature (1070)..(1070): n is a, c, g, or t
  misc_feature (1109)..(1109): n is a, c, g, or t
  misc_feature (1205)..(1205): n is a, c, g, or t
  misc_feature (1363)..(1367): n is a, c, g, or t
  misc_feature (1369)..(1369): n is a, c, g, or t
  misc_feature (1371)..(1371): n is a, c, g, or t
atgtacccaccctctctgaagcattccctgccgctgctggtggncctggtgcttgccgcgtgttcttngacaaacacactgtcagccgacaagaccccggcagacaatatagaaactgccgacctttcggcaagcgttcccaccngccctgccgaacccgaangaaaaacgtnggcagattacggcggctacccgtccgcactggatgcagtgaaacagaaaaacgatgccgccgtcgccgcctatttggaaaacgccggcgacagcgcgatggcggaaaatgtccgcaacgagtggctgaagtctttgggcgcgcgcagacagtggacgctgtntgcacangaatatgcnaaactcgaaccggcanggcgcgcccaagaagtcgaatgctacgccgattcgagccgcaacgactatacgcgtgccgccgaactggtcaaaaatacgggcaaactgccttcgggctgcaccaaactgttggaacaggcagccgcatccggcttgttggacggcaacgacgcctggaggcgcgtgcgcggactgctggccggccgccaaaccacagacgcacgcaaccttgccgccgcattgggcagcccgtttgacggcggtacacaaggttcgcgcgaatatgccctgttgaacgtcatcggcaaagaagcacgcaaatcgccgaatgccgccgccctgctgtccgaaatggaaagcggtttaagcctcgaacaacgcagtttcgcgtggggcgtattggggcattatcagtcgcaaaacctcaatgtgcctgccgccttggactattanggcaaggttgccgaccgccgccaactgaccgacgaccaaatcgagtggtacgcccgcgccgcnntnngcnnncgnngttngnanganntggcnnccgnnancncgnnnntgcnnganaaacnnnnnnanagncnnanntngntnnantgnntggcacgcagccgcgccgcnacgggcaacacgcaanangcgganaaactntacaaacaggcggcagcancgggcangaatttttatgcngtgctgncnggggaagagttggggcgcanaatcgatacgcgcaacaatgtgcccgatgccggcaaaancagcgtcctccgtatggcggaagacggcgcgattaagcgcgcgctggtgctgttccgaaacagccgaaccgccggcgatgcgaaaatgcgccgtcnggctcaggcggaatggcgtttcgccacacgcggcttcgatgaagacaagctgctgaccgccgcgcaaaccgcgttcgaccacggtttttacgatatggcggtcaacagcgcggaacgcaccgaccgcaaactcaactacaccttgcgctacatttcgnnnnntnangacacggtaatccgccacgcgcaaaatgttaatgtcgatccggcgtgggtttacgggctgattcgtcaggaaagccgcttcgttatgggcgcgcaatcccgcgtaggcgcgcaggggctgatgcaggttatgcctgccaccgcgcgcgaaatcgccggcaaaatcggtatggatgccgcacaactttacaccgccgacggcaatatccgtatggggacgtggtatatggcggacaccaaacgccgcctgcaaaacaacgaagtcctcgccaccgcaggctataacgccggtcccggcagggcgcgccgatggcaggcggacacgcccctcgaaggcgcggtatatgccgaaaccatcccgttttccgaaacgcgcgactatgtcaaaaaagtgatggccaatgccgcctactacgcctccctcttcggcgcgccgcacatcccgctcaaacagcgtatgggcattgtccccgcccgctga

SEQ ID NO: 110 - protein, 616 aa, Neisseria meningitidis
  misc_feature (15)..(15): Xaa can be any naturally occurring amino acid
  misc_feature (23)..(23): Xaa can be any naturally occurring amino acid
  misc_feature (49)..(49): Xaa can be any naturally occurring amino acid
  misc_feature (55)..(55): Xaa can be any naturally occurring amino acid
  misc_feature (58)..(58): Xaa can be any naturally occurring amino acid
  misc_feature (112)..(112): Xaa can be any naturally occurring amino acid
  misc_feature (114)..(114): Xaa can be any naturally occurring amino acid
  misc_feature (123)..(123): Xaa can be any naturally occurring amino acid
  misc_feature (267)..(267): Xaa can be any naturally occurring amino acid
  misc_feature (289)..(291): Xaa can be any naturally occurring amino acid
  misc_feature (293)..(297): Xaa can be any naturally occurring amino acid
  misc_feature (299)..(306): Xaa can be any naturally occurring amino acid
  misc_feature (308)..(318): Xaa can be any naturally occurring amino acid
  misc_feature (330)..(330): Xaa can be any naturally occurring amino acid
  misc_feature (332)..(332): Xaa can be any naturally occurring amino acid
  misc_feature (341)..(341): Xaa can be any naturally occurring amino acid
  misc_feature (343)..(343): Xaa can be any naturally occurring amino acid
  misc_feature (350)..(350): Xaa can be any naturally occurring amino acid
  misc_feature (357)..(357): Xaa can be any naturally occurring amino acid
  misc_feature (370)..(370): Xaa can be any naturally occurring amino acid
  misc_feature (402)..(402): Xaa can be any naturally occurring amino acid
  misc_feature (455)..(457): Xaa can be any naturally occurring amino acid
MYPPSLKHSLPLLVXLVLAACSXTNTLSADKTPADNIETADLSASVPTXPAEPEXKTXADYGGYPSALDAVKQKNDAAVAAYLENAGDSAMAENVRNEWLKSLGARRQWTLXAXEYAKLEPAXRAQEVECYADSSRNDYTRAAELVKNTGKLPSGCTKLLEQAAASGLLDGNDAWRRVRGLLAGRQTTDARNLAAALGSPFDGGTQGSREYALLNVIGKEARKSPNAAALLSEMESGLSLEQRSFAWGVLGHYQSQNLNVPAALDYXGKVADRRQLTDDQIEWYARAAXXXRXXXXXAXXXXXXXXKXXXXXXXXXXXARSRAATGNTQXAXKLYKQAAAXGXNFYAVLXGEELGRXIDTRNNVPDAGKXSVLRMAEDGAIKRALVLFRNSRTAGDAKMRRXAQAEWRFATRGFDEDKLLTAAQTAFDHGFYDMAVNSAERTDRKLNYTLRYISXXXDTVIRHAQNVNVDPAWVYGLIRQESRFVMGAQSRVGAQGLMQVMPATAREIAGKIGMDAAQLYTADGNIRMGTWYMADTKRRLQNNEVLATAGYNAGPGRARRWQADTPLEGAVYAETIPFSETRDYVKKVMANAAYYASLFGAPHIPLKQRMGIVPAR

SEQ ID NO: 111 - DNA, 342 bp, Neisseria gonorrhoeae
atggtagaacgtaaattgaccggtgcccattacggtttgcgcgattgggtaatgcagcgtgcgactgcggttattatgttgatttataccgttgcacttttagtggttctatttgccctgcctaaagaatatccggcatggcaggcattttttagtcaagcttgggtaaaagtatttacccaagtgagctttatcgccgtattcttgcacgcttgggtgggtatccgcgatttgtggatggactatatcaaacccttcggcgtgcgtttgtttttgcaggttgccaccattgtctggctggtcggctgcctcgtgtattcagttaaagtgatttgggggtaa

SEQ ID NO: 112 - protein, 113 aa, Neisseria gonorrhoeae
MVERKLTGAHYGLRDWVMQRATAVIMLIYTVALLVVLFALPKEYPAWQAFFSQAWVKVFTQVSFIAVFLHAWVGIRDLWMDYIKPFGVRLFLQVATIVWLVGCLVYSVKVIWG

SEQ ID NO: 113 - DNA, 342 bp, Neisseria meningitidis
atggtagaacgtaaattgaccggtgcccattacggtttgcgcgattgggtgatgcaacgtgcgactgcggttattatgttgatttataccgttgcacttttagtggttctattttccctgcctaaagaatattcggcatggcaggcattttttagtcaaacttgggtaaaagtatttacccaagtgagcttcatcgccgtattcttgcacgcttgggtgggtatccgcgatttgtggatggactatatcaaacccttcggcgtgcgtttgtttttgcaggttgccaccatcgtttggctggtcggctgtctcgtgtattcagttaaagtgatttgggggtaa

SEQ ID NO: 114 - protein, 113 aa, Neisseria meningitidis
MVERKLTGAHYGLRDWVMQRATAVIMLIYTVALLVVLFSLPKEYSAWQAFFSQTWVKVFTQVSFIAVFLHAWVGIRDLWMDYIKPFGVRLFLQVATIVWLVGCLVYSVKVIWG

SEQ ID NO: 115 - DNA, 342 bp, Neisseria meningitidis
  misc_feature (249)..(249): n is a, c, g, or t
atggtagaacgtaaattgaccggtgcccattacggtttgcgggattgggcgatgcaacgtgcgaccgcggttattatgttgatttataccgttgcacttttagtggttctatttgctctgcctaaagaatattcggcatggcaggcattttttagtcaaacttgggtaaaagtatttacccaagtgagcttcatcgccgtattcttgcacgcttgggtgggtatccgcgatttgtggatggactatatnaaacccttcggcgtgcgtttgtttttgcaggttgccaccatcgtctggctggtcggctgcttggtgtattcaattaaagtaatttgggggtaa

SEQ ID NO: 116 - protein, 113 aa, Neisseria meningitidis
  misc_feature (83)..(83): Xaa can be any naturally occurring amino acid
MVERKLTGAHYGLRDWAMQRATAVIMLIYTVALLVVLFALPKEYSAWQAFFSQTWVKVFTQVSFIAVFLHAWVGIRDLWMDYXKPFGVRLFLQVATIVWLVGCLVYSIKVIWG

SEQ ID NO: 117 - DNA, 1014 bp, Neisseria meningitidis
atgttgaaacaaacgacacttttggcagcttgtaccgccgttgccgctctgttgggcggttgcgccacccaacagcctgctcctgtcattgcaggcaattcaggtatgcagaccgtatcgtctgcgccggtttacaatccttatggcgcaacgccgtacaatgccgctcctgccgccaacgatgcgccgtatgtgccgcccgtgcaaactgcgccggtttattcgcctcctgcttatgttccgccgtctgcacctgccgtttcgggtacatatgttccttcttacgcacccgtcgacatcaacgcggcgacgcatactattgtgcgtggcgacacggtgtacaacatttccaaacgctaccatatctctcaagacgatttccgtgcgtggaacggcatgaccgacaatacgttgagcatcggtcagattgttaaagtcaaaccggcaggatatgccgcaccgaaaaccgcagccgtagaaagcaggcccgccgtaccggctgccgcgcaaacccctgtgaaacccgccgcgcaaccgcccgttcagtccgcgccgcaacctgccgcgcccgctgcggaaaataaagcggttcccgcccccgcgcccgccccgcaatctcctgccgcttcgccttccggcacgcgttcggtcggcggcattgtttggcagcgtccgacccaaggtaaagtggttgccgatttcggcggcggcaacaagggtgtcgatattgccggcaatgccggacaacccgttttggcggcggctgacggcaaagtggtttatgccggttcaggtttgaggggatacggaaacttggtcatcatccagcacaattcctctttcctgaccgcgtacgggcacaaccaaaaattgctggtcggcgaaggtcagcaggtcaaacgcggtcagcaggttgctttgatgggtaataccgatgcttccagaacgcagcttcatttcgaggtgcgtcaaaacggcaaaccggttaacccgaacagctatatcgcgttctga

SEQ ID NO: 118 - protein, 337 aa, Neisseria meningitidis
MLKQTTLLAACTAVAALLGGCATQQPAPVIAGNSGMQTVSSAPVYNPYGATPYNAAPAANDAPYVPPVQTAPVYSPPAYVPPSAPAVSGTYVPSYAPVDINAATHTIVRGDTVYNISKRYHISQDDFRAWNGMTDNTLSIGQIVKVKPAGYAAPKTAAVESRPAVPAAAQTPVKPAAQPPVQSAPQPAAPAAENKAVPAPAPAPQSPAASPSGTRSVGGIVWQRPTQGKVVADFGGGNKGVDIAGNAGQPVLAAADGKVVYAGSGLRGYGNLVIIQHNSSFLTAYGHNQKLLVGEGQQVKRGQQVALMGNTDASRTQLHFEVRQNGKPVNPNSYIAF

SEQ ID NO: 119 - DNA, 1056 bp, Neisseria gonorrhoeae
gtgccgccggtgcaaagcgcgccggtttatacgcctcctgcttatgttccgccgtctgcacctgccgtttcgggtacatacgttccttcttacgcacccgtcgacatcaacgcggcgacgcatactattgtgcgcggcgacacggtgtacaacatttccaaacgctaccatatctctcaagacgatttccgtgcgtggaacggcatgaccgacaatacgttgagcatcggtcagattgttaaagtcaaaccggcaggatatgccgcaccgaaagccgcagccgtaaaaagcaggcccgccgtaccggctgccgcgcaaccgcccgtacagtccgcacccgtcgacattaacgcggcgacgcatactattgtgcgcggcgacacggtgtacaacatttccaaacgctaccatatctctcaagacgatttccgtgcgtggaacggcatgaccgacaatatgttgagcatcggtcagattgttaaagtcaaaccggcaggatatgccgcaccgaaaaccgcagccgtagaaagcaggcccgccgtaccggctgccgtgcaaacccctgtgaaacccgccgcgcaaccgcctgtgcagtccgcgccgcaacctgccgcgcccgctgcggaaaataaagcggttcccgcgcccgccccgcaatctcctgccgcttcgccttccggcacgcgttcggtcggcggcattgtttggcagcgtccgacgcaaggtaaagtggttgccgatttcggcggcaacaacaagggtgtcgatattgccggtaatgcgggacagcccgttttggcggcggctgacggcaaagtggtttatgccggttcaggtttgaggggatacggaaacttggtcatcatccagcataattcttctttcctgaccgcatacgggcacaaccaaaaattgctggtcggcgaggggcagcaggtcaaacgcggtcagcaggttgctttgatgggcaataccgatgcttccagaacgcagcttcatttcgaggtgcgtcaaaacggcaaaccggttaacccgaacagctatatcgcgttctga

SEQ ID NO: 120 - protein, 509 aa, Neisseria meningitidis
MAAADKQLGSDRRSVAIIGDGAMTAGQAFEALNCAGDMDVDLLVVLNDNEMSISPNVGALPKYLASNVVRDMHGLLSTVKAQTGKVLDKIPGAMEFAQKVEHKIKTLAEEAEHAKQSLSLFENFGFRYTGPVDGHNVENLVDVLEDLRGRKGPQLLHVITKKGNGYKLAENDPVKYHAVANLPKESAAQMPSEKEPKPAAKPTYTQVFGKWLCDRAAADSRLVAITPAMREGSGLVEFEQRFPDRYFDVGIAEQHAVTFAGGLACEGMKPVVAIYSTFLQRAYDQLVHDIALQNLPVLFAVDRAGIVGADGPTHAGLYDLSFLRCIPNMIVAAPSDENECRLLLSTCYQADAPAAVRYPRGTGTGVPVSDGMETVEIGKGIIRREGEKTAFIAFGSMVAPALAVAGKLNATVADMRFVKPIDEELIVRLARSHDRIVTLEENAEQGGAGSAVLEVLAKHGICKPVLLLGVADTVTGHGDPKKLLDDLGLSAEAVERRVRAWLSDRDAAN

SEQ ID NO: 121 - DNA, 1140 bp, Neisseria gonorrhoeae
atgagccgtttatggttttttgccgtaaaaaacattataatccgccttatttacctattgcccaaggagacacaaatggcactcgtatccatgcgccaactgcttgaccacgccgccgaaaacagctacggcctgcccgcgttcaacgtcaacaacctcgaacaaatgcgcgccattatggaagccgccgaccaagtcaacgcgcccgtcatcgtacaggcgagcgcaggtgcgcgcaaatacgcgggcgcgccgtttttgcgccacctgattctggcggcagtcgaagaatttccgcacatccccgtcgtgatgcaccaagaccacggcgcatcgcccgacgtgtgccaacgctccatccaactgggcttctcctccgtgatgatggacggctctttgctcgaagacggcaaaaccccttcttcttacgaatacaacgtcaacgccacccgtaccgtcgtcaacttctcccacgcctgcggcgtgtccgtcgaaggcgaaatcggcgtattgggcaacctcgaaaccggcgaagcaggcgaagaagacggagtgggcgcggcaggcaaactctcacacgaccaaatgctcaccagcgttgaagatgccgtgcgtttcgttaaagataccggcgttgacgcattggcgattgccgtcggcaccagccacggcgcatacaaattcacccgtccgcccacaggcgacgtattgcgtatcgaccgcatcaaggaaatccaccaagccctgcccaatacacacatcgtgatgcacggctccagctccgttccgcaagaatggctgaaagtcatcaacgaatacggcggcaatatcggcgaaacctacggcgtgccggttgaagaaatcgtcgaaggcatcaaacacggcgtgcgcaaagtcaacatcgataccgacctgcgcctcgcttccaccggcgcggtacgccgctaccttgccgaaaacccgtccgactttgatccgcgcaaatacttgggcaaaaccattgaagcgatgaagcaaatctgcctcgaccgttatcttgcgttcggttgcgaaggtcaggcaggcaaaatcaaacctgtttcgttggaaaaaatggcaagccgttatgccaagggcgaattgaaccaaatcgtcaaataa

SEQ ID NO: 122 - protein, 379 aa, Neisseria gonorrhoeae
MSRLWFFAVKNIIIRLIYLLPKETQMALVSMRQLLDHAAENSYGLPAFNVNNLEQMRAIMEAADQVNAPVIVQASAGARKYAGAPFLRHLILAAVEEFPHIPVVMHQDHGASPDVCQRSIQLGFSSVMMDGSLLEDGKTPSSYEYNVNATRTVVNFSHACGVSVEGEIGVLGNLETGEAGEEDGVGAAGKLSHDQMLTSVEDAVRFVKDTGVDALAIAVGTSHGAYKFTRPPTGDVLRIDRIKEIHQALPNTHIVMHGSSSVPQEWLKVINEYGGNIGETYGVPVEEIVEGIKHGVRKVNIDTDLRLASTGAVRRYLAENPSDFDPRKYLGKTIEAMKQICLDRYLAFGCEGQAGKIKPVSLEKMASRYAKGELNQIVK

SEQ ID NO: 123 - DNA, 771 bp, Neisseria meningitidis
atgagctgtttatggttttttgctgtaaaaaacattataatccgccttatttacctattgcccaaggagacacaaatggcactcgtatccatgcgccaactgcttgatcatgctgccgaawacagctacggcytgccggcgttcaacgtcaacaacctcgwacagatgcgcgccatcatggaggctgcagaccaagtcgacgcccccgtcatcgtacaggcgagtgccggtgcgcgcaaatatgcgggtgcgccgtttttacgccacctgattttggcggctgtcgaagtatttccacacatccccgtcgtcatgcaccaagaccacggcgcatcacccgacgtgtgccaacgctccatccaactgggcttctcctctgtaatgatggacggctcgctgatggaagacggcaaaaccccttcttcttacgaatacaacgtcaacgccacacgtaccgtggttaacttctcccacgcttgcggcgtatccgttgaaggcgaaatcggcgtattgggcaacctcgaaaccggcgatgcaggcgaagaagacggtgtaggcgcagtgggcaaactttcccacgaccaaatgctgaccagcgtcgaagatgccgtatgtttcgttaaagataccggcgttgacgcattggctattgccgtcggcaccagccacggcgcatacaaattcacccgtccgcccacaggcgatgtattacgtatcgaccgcatcaaagaaatccaccaagccctgcccaatacacacatcgtgatgcac

SEQ ID NO: 124 - protein, 257 aa, Neisseria meningitidis
  misc_feature (41)..(41): Xaa can be any naturally occurring amino acid
  misc_feature (54)..(54): Xaa can be any naturally occurring amino acid
MSCLWFFAVKNIIIRLIYLLPKETQMALVSMRQLLDHAAEXSYGLPAFNVNNLXQMRAIMEAADQVDAPVIVQASAGARKYAGAPFLRHLILAAVEVFPHIPVVMHQDHGASPDVCQRSIQLGFSSVMMDGSLMEDGKTPSSYEYNVNATRTVVNFSHACGVSVEGEIGVLGNLETGDAGEEDGVGAVGKLSHDQMLTSVEDAVCFVKDTGVDALAIAVGTSHGAYKFTRPPTGDVLRIDRIKEIHQALPNTHIVMH

SEQ ID NO: 125 - DNA, 1140 bp, Neisseria meningitidis
atgagccgtttatggttttttgccgcaaaaaacattataatccgccttatttacctattgcccaaggagacacaaatggcactcgtatccatgcgccaactgcttgatcatgctgccgaaaacagctacggcctgcccgcgttcaacgtcaacaacctcgaacaaatgcgcgccattatggaagccgccgaccaagtcaacgcgcccgtcatcgtacaggcgagcgcaggtgcgcgcaaatacgcgggcgcgccgtttttgcgccacctgattttggcggctgtcgaagaatttccgcacatccccgtcgtgatgcaccaagaccacggcgcatcgcccgacgtgtgccaacgctccatccaactgggcttttcctccgtgatgatggacggctcgctgatggaagacggcaaaaccccttcttcttatgaatacaacgtcaacgccacccgtaccgtggttaatttctcccacgcctgcggcgtatccgttgaaggcgaaatcggcgtattgggcaacctcgaaactggcgaagccggcgaagaagacggtgtaggcgcagtgggcaaactttcccacgaccaaatgctcaccagcgtcgaagatgccgtgcgtttcgttaaagataccggcgttgacgcattggcgattgccgtcggcaccagccacggcgcgtacaaattcacccgtccgcccacaggcgacgtgttgcgtatcgaccgcatcaaagaaatccaccaagccctgcccaatacacacatcgtgatgcacggctccagctccgttccgcaagaatggctgaaagtcatcaacgaatacggcggcaatatcggcgaaacctacggcgtgccggttgaagaaatcgtcgaaggcatcaaacacggcgtgcgtaaagtcaacatcgataccgacttgcgccttgcttccaccggcgcggtacgccgctaccttgccgaaaacccgtccgacttcgatccgcgcaaatatttgagcaaaaccattgaagcgatgaagcaaatctgcctcgaccgctacctcgcgttcggttgcgaaggtcaggcaggcaaaatcaaaccggtttccttggaaaaaatggcaaaccgttatgccaagggcgaattgaaccaaatcgtcaaataa

SEQ ID NO: 126 - protein, 379 aa, Neisseria meningitidis
MSRLWFFAAKNIIIRLIYLLPKETQMALVSMRQLLDHAAENSYGLPAFNVNNLEQMRAIMEAADQVNAPVIVQASAGARKYAGAPFLRHLILAAVEEFPHIPVVMHQDHGASPDVCQRSIQLGFSSVMMDGSLMEDGKTPSSYEYNVNATRTVVNFSHACGVSVEGEIGVLGNLETGEAGEEDGVGAVGKLSHDQMLTSVEDAVRFVKDTGVDALAIAVGTSHGAYKFTRPPTGDVLRIDRIKEIHQALPNTHIVMHGSSSVPQEWLKVINEYGGNIGETYGVPVEEIVEGIKHGVRKVNIDTDLRLASTGAVRRYLAENPSDFDPRKYLSKTIEAMKQICLDRYLAFGCEGQAGKIKPVSLEKMANRYAKGELNQIVK

SEQ ID NO: 127 - DNA, 816 bp, Neisseria gonorrhoeae
atgctgaagccgtgtttggtatacagtgcctgtgcggcggcgttgcctgcgcggacttcgagcagcaggcgttgcgtgccttcgggcagatgtgcgtaccaatattcgagcagggcggacgcaacgccccgtcggcggcattcgggcgcggtggcaatcaggtgcagttcggattcgtcgggcaggttctgccaaacgataaaggcggcaatcctgccgtctttttccgcaaggaaaacctgttcggacggcgaaacaagcgcggactcaaattggcgttgcgtccacgcggacgggttgcagacggtatcgagcgcggccagtgcggcgcagtcggacggtgaggctgggcggatgttcatgttcgtgccttccgttccgcctgttctttggcagtcagggcgattttgttgcggacgtagagcagttcggcgtgtgccgcgccagttgcgggatagccgccgccgagggcgagcgcgagaaaatcggcggcggtcggcatatcgggtttgcctgagaagggcggacggttttccagtgcgaacgcactgccgatgccgtctgaaaagacgtacccctcggggagggcaatgtctgccgccctaccgacttgataatcgctcaaacggcggcggttcagcgtgtcgaaccacgcataaaacacttcgcccatacgcgcgtccgcagcggcgagtatgcagctttgcggcggcggcagcgaggcggcggcatcgagcgtggggatgccgattaaaggcgtgtcgaacggcgttgccaaaccttgcgccacgccgatgccgatacgcagtccggtaa

SEQ ID NO: 128 - protein, 271 aa, Neisseria gonorrhoeae
MLKPCLVYSACAAALPARTSSSRRCVPSGRCAYQYSSRADATPRRRHSGAVAIRCSSDSSGRFCQTIKAAILPSFSARKTCSDGETSADSNWRCVHADGLQTVSSAASAAQSDGEAGRMFMFVPSVPPVLWQSGRFCCGRRAVRRVPRQLRDSRRRGRARENRRRSAYRVCLRRADGFPVRTHCRCRLKRRTPRGGQCLPPYRLDNRSNGGGSACRTTHKTLRPYARPQRRVCSFAAAAARRRHRAWGCRLKACRTALPNLAPRRCRYAVR

SEQ ID NO: 129 - DNA, 815 bp, Neisseria meningitidis
atgctgaagccgtgcgccgtgtacagtgcctgtgcggcggtgttgcctgcacggacttcgagcagcaggcgttgcgtgtcttcgggcagatgtgtgaaccaatattcgagcagggcggacgcaattccttggcggcggcattcgggcgcggtggcaatcaggtgcagttcggattcgtcgggcaggttctgccaaacgataaaggcggcaatcccgcgtctttttccgcaaggaaaacctgttcggacggcgaaaccagtgcggactcaaattggcgttgcgtccatgcggacgggttgcagacggcatcgagtgcggccagctcctcacaatcggcacaaacggcacggcggatgttcacgggcgcgctctccgttcggcctgttctttggcagtcagggcgattttgttgcggacgtagagcaaaccggcgtgtgcggcatggacggcaggataaccgcccttggctgccaatgcgagaaagtcggcggcagtcggcatatccggtctgcctgagaacggcggagcttcttccagcgcgaacgcgctgcctatgccgtctgaaaaggcgcatccctccggcagccggatgtctgccgcccgcccgacctgataatcgctcaaacggtggcagttcagcgtatcgaaccatgcataaaacacttcgcccatacgagcgtccgtagcggcaaggatgcagctttgcggcggcggcagcgaggcggcggcatcgagcgagggtacgccgattaagggggtatcaaacggcgttgccaaaccctgagctacaccgatgccgatacgcagtccggtaa

SEQ ID NO: 130 - protein, 270 aa, Neisseria meningitidis
  misc_feature (73)..(73): Xaa can be any naturally occurring amino acid
MLKPCAVYSACAAVLPARTSSSRRCVSSGRCVNQYSSRADAIPWRRHSGAVAIRCSSDSSGRFCQTIKAAIPXSFSARKTCSDGETSADSNWRCVHADGLQTASSAASSSQSAQTARRMFTGALSVRPVLWQSGRFCCGRRANRRVRHGRQDNRPWLPMRESRRQSAYPVCLRTAELLPARTRCLCRLKRRIPPAAGCLPPARPDNRSNGGSSAYRTMHKTLRPYERPRQGCSFAAAAARRRHRARVRRLRGYQTALPNPELHRCRYAVR

SEQ ID NO: 131 - DNA, 816 bp, Neisseria meningitidis
atgctgaagccgtgcgccgtgtacagtgcctgtgcggcggtgttgcctgcacggacttcgagcagcaggcgttgcgtgtcttcgggcagatgtgtgaaccaatattcgagcagggcggacgcaattccttggcggcggcattcgggcgcggtggcaatcaggtgcagttcggattcgtcgggcaggttctgccaaacgataaaggcggcaatcccgccgtctttttccgcaaggaaaacctgttcggacggcgaaaccagtgcggactcaaattggcgttgcgtccacgcggacgggttgcagacggcatcgagcgcggcgagtgcggcgcaatcggcataaacggcgcggcggatgttcacaggcgcgccctccgttccgcctgttctttggcagtcaaggcgattttgttgcggacgtagagcagctcggcgtgtgccgcagcgacggcgggaaaaccgccttcagccgccagattgaggaagtcggcggcggtcggcatatcgggtttgcctgagaagggcggacggttttccagcgcgaacgcattgccgatgccgtctgaaaaggcgcatccttccggcagccggatgtctgccgcccgaccgacctgataatcgctcaaacggcggcggttcagcgtgtcgaaccatgcataaaacacttcgcccatacgtgcgtccgcagcggcaaggatgcagctttgcggcggcggcagcgaggcggcggcatcgagcgagggtacgccgattaaaggagtatcaaacggcgttgccaaaccttgcgccacgccgatgccgatacgcagtcccgtaa

SEQ ID NO: 132 - protein, 269 aa, Neisseria meningitidis
MLKPCAVYSACAAVLPARTSSSRRCVSSGRCVNQYSSRADAIPWRRHSGAVAIRCSSDSSGRFCQTIKAAIPPSFSARKTCSDGETSADSNWRCVHADGLQTASSAASAAQSATARRMFTGAPSVPPVLWQSRRFCCGRRAARRVPQRRRENRLQPPDGSRRRSAYRVCLRRADGFPARTHCRCRLKRRILPAAGCLPPDRPDNRSNGGGSACRTMHKTLRPYVRPQRQGCSFAAAAARRRHRARVRRLKEYQTALPNLAPRRCRYAVP

SEQ ID NO: 133 - DNA, 687 bp, Neisseria meningitidis
atgctgaagccgtgcgccgtgtacagtgcctgtgcggcggtgttgcctgcacggacttcgagcagcaggcgttgcgtgtcttcgggcagatgtgtgaaccaatattcgagcagggcggacgcaattccttggcggcggcattcgggcgcggtggcaatcaggtgcagttcggattcgtcgggcaggttctgccaaacgataaaggcggcaatcccgccgtctttttccgcaaggaaaacctgttcggacggcgaaaccagtgcggactcaaattggcgttgcgtccatgcggacgggttgcagacggcatcgagtgcggccagctcctcacaatcggcacaaacggcacggcggatgttcacgggcgcgctctccgttcggcctgttctttggcagtcagggcgattttgttgcggacgtagagcaaaccggcgtgtgcggcatggacggcaggataaccgcccttggctgccaatgcgagaaagtcggcggcagtcggcatatccggtctgcctgagaacggcggagcttcttccagcgcgaacgcgctgcctatgccgtctgaaaaggcgcatccctccggcagccggatgtctgccgcccgcccgacctgataatcgctcaaacggtggcagttcagcgtatcgaaccatgcataaaacacttcgcccatacgagcgtccgtag

SEQ ID NO: 134 - protein, 228 aa, Neisseria meningitidis
MLKPCAVYSACAAVLPARTSSSRRCVSSGRCVNQYSSRADAIPWRRHSGAVAIRCSSDSSGRFCQTIKAAIPPSFSARKTCSDGETSADSNWRCVHADGLQTASSAASSSQSAQTARRMFTGALSVRPVLWQSGRFCCGRRANRRVRHGRQDNRPWLPMRESRRQSAYPVCLRTAELLPARTRCLCRLKRRIPPAAGCLPPARPDNRSNGGSSAYRTMHKTLRPYERP

SEQ ID NO: 135 - DNA, 642 bp, Neisseria gonorrhoeae
atgactgatttccgccaagatttcctcaaattctccctcgcccaaaatgttttgaaattcggcgaatttaccaccaaagccggacggcggtcgccctatttcttcaatgccggcctcttcaacgacggcgcgtccacgctgcaactggcaaaattctatgcacaatccatcattgaaagcggcatccgattcgatatgctgttcggccccgcctacaaaggcattattttggcggcggcaaccgcgatgatgctggcggaaaaaggcgtgaacgtcccgtttgcctacaaccgcaaagaagccaaagaccgcggcgaaggcggcgtgttggtcggcgcgccgcttaaagggcgcgtgctgattatcgacgacgtgatttccgccggcacatccgtacgcgaatcaatcaaactgattgaagcggagggtgcaacccccgccggtgtcgccatcgcgctcgaccgcatggaaaaaggcacgggtaaattgtccgccgttcaggaagtggaaaaacaatacggcctgcccgtcgcccccatcgccagcctgaacgatttgtttatcctgttgcaaaacaaccccgaattcggacagttcctcgaacccgtccgcacctaccgccggcagtacggcgtagaataa

SEQ ID NO: 136 - protein, 213 aa, Neisseria gonorrhoeae
MTDFRQDFLKFSLAQNVLKFGEFTTKAGRRSPYFFNAGLFNDGASTLQLAKFYAQSIIESGIRFDMLFGPAYKGIILAAATAMMLAEKGVNVPFAYNRKEAKDRGEGGVLVGAPLKGRVLIIDDVISAGTSVRESIKLIEAEGATPAGVAIALDRMEKGTGKLSAVQEVEKQYGLPVAPIASLNDLFILLQNNPEFGQFLEPVRTYRRQYGVE

SEQ ID NO: 137 - DNA, 642 bp, Neisseria meningitidis
atgaccgatttccgccaagatttcctcaaattctccctcgcccaaaatgttttgaaattcggcgaatttaccaccaaggcaggacggcggtcgccctatttcttcaatgccggcctctttaacgacggcttgtccacgctgcaactggcaaaattttacgcacaatccatcattgaaagcggcatccgattcgatatgctgttcggtcccgcctacaaaggcattattttggcggcggcaaccgcgatgatgctggcggaaaaaggcgtgaacgtcccgtttgcctacaaccgcaaagaagccaaagaccacggcgaaggcggcgtgttggtcggcgcgccgcttaaagggcgcgtgctgattatcgacgacgtgatttccgccggcacatccgtacgcgaatcgatcaaactgattgaagcggagggtgcaacccccgccggtgtcgccatcgcgctcgatcgcatggaaaaaggcacgggtgaattgagcgcggttcaggaagtggaraaacaatacggkctgcccgtcgcccccatcgccagcctgaacgatttgtttattctgttgcaaaacaaccccgaattcggacagttcctcgaacccgtccgagcctaccgtcggcagtacggcgtagaataa

SEQ ID NO: 138 - protein, 213 aa, Neisseria meningitidis
MTDFRQDFLKFSLAQNVLKFGEFTTKAGRRSPYFFNAGLFNDGLSTLQLAKFYAQSIIESGIRFDMLFGPAYKGIILAAATAMMLAEKGVNVPFAYNRKEAKDHGEGGVLVGAPLKGRVLIIDDVISAGTSVRESIKLIEAEGATPAGVAIALDRMEKGTGELSAVQEVEKQYGLPVAPIASLNDLFILLQNNPEFGQFLEPVRAYRRQYGVE

SEQ ID NO: 139 - DNA, 642 bp, Neisseria meningitidis
atgaccgatttccgccaagatttcctcaaattctccctcgcccaaaatgttttgaaattcggcgaattcaccaccaaagccggacggcggtcgccctatttcttcaatgccggcctctttaacgacggcttgtccacgctgcaactggcaaaattttacgcacaatccatcattgaaagcggcatccgattcgatatgctgttcggccccgcctacaaaggcattattttggcggcggcaaccgcgatgatgctggcggaaaaaggcgtgaacgtcccgtttgcctacaaccgcaaagaagccaaagaccacggcgaaggcggcgtgttggtcggcgcgccgcttaaagggcgcgtgctgattatcgacgacgtgatttccgccggcacatccgtacgcgaatcgatcaaactgattgaagcggagggtgcaacccccgccggtgtcgccatcgcgctcgaccgcatggaaaaaggcacgggtgaattgagcgcggttcaggaagtggaaaaacaatacggcctgcccgtcgcccccatcgccagcctgaacgatttgtttattctgttgcaaaacaaccccgaattcggacagttcctcgaacccgtccgagcctaccgtcggcagtacggcgtagaataa

SEQ ID NO: 140 - protein, 213 aa, Neisseria meningitidis; identical to SEQ ID NO: 138

SEQ ID NO: 141 - DNA, 492 bp, Neisseria gonorrhoeae
atgccgtccgaaccacctgccgcttcagacggcatcaaaccgacacacaccgagaaaacatcatgcccgcctgtttctgtccgcactgcaaaacccgcctctgggtcaaagaaacccagctcaacgtcgcccaaggcttcgtcgtctgccaaaaatgcgaagggctgtttaaagccaaagaccatctggcaagcacgaaagaacctatattcaacgattggcccgaagctgtttcgggatgtcaaactcgtccaccgcatcggcacgcacgccattagcaagaaacagatgtcccgcgacgaaatcgccgatatcctcaacggcggtacaaccctgcacgatacgccgcccgcaaccgccgctgccgcacctgccgccgcaccgcaggtttccgtaccgcccgcccgtcaggaagggctcaactggactattgcaaccctgttcgcacttatcgtcctcattatgcagctttcctacctcttcatcctatga

SEQ ID NO: 142 - protein, 163 aa, Neisseria gonorrhoeae
MPSEPPAASDGIKPTHTEKTSCPPVSVRTAKPASGSKKPSSTSPKASSSAKNAKGCLKPKTIWQARKNLYSTIGPKLFRDVKLVHRIGTHAISKKQMSRDEIADILNGGTTLHDTPPATAAAAPAAAPQVSVPPARQEGLNWTIATLFALIVLIMQLSYLFIL

SEQ ID NO: 143 - DNA, 513 bp, Neisseria meningitidis
  misc_feature (133)..(237): n is a, c, g, or t
atgccgtccgaaccgccttacgcctcagacggcatcaaacctgacacacacgaggaaataccatgcccgcctgtttctgcccccactgcaaaacccgtctctgggtcaaagaaacccaactcaatgtcgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgaggctgtttcggatgtcaaactcgttcaccgtatcggcacgcgcgccatcggcaagaaacagatttcccgtgacgaaatcgccggcatcctcaacggcggtacaacccagcccgatattccgcccgcaaccgccgccacccctgctgccgcaccgcaggttaccgtaccgcccgccgcgcccgcccgtcaggatgggttcaactggacgattgcaaccctgtttgcccttatcgtcctcattatgcagctttcctacctcgtcatcctatga

SEQ ID NO: 144 - protein, 170 aa, Neisseria meningitidis
  misc_feature (45)..(79): Xaa can be any naturally occurring amino acid
MPSEPPYASDGIKPDTHEEIPCPPVSAPTAKPVSGSKKPNSMSPXXXXXXXXXXXXXXXXXXXXXXXXXXXXXXXXXXXPEAVSDVKLVHRIGTRAIGKKQISRDEIAGILNGGTTQPDIPPATAATPAAAPQVTVPPAAPARQDGFNWTIATLFALIVLIMQLSYLVIL

SEQ ID NO: 145 - DNA, 497 bp, Neisseria meningitidis
atgccgtctgaaccgccttacgcctcagacggcatcaaacctgacacacacgaggaaataccatgcccgcctgtttctgcccccactgcaaaacccgtctctgggtcaaagaaacccaactcaatgtcgcccaaggcttcgtcgtctgccaaaaatgcgaaggaatgtttaaagccaaagaccatctggcaagcacgaaagaacccatattcaacgatttgcccgaagctgtttcggatgtcaaactcgttcaccgcatcggcacgagcgccatcggcaagaaacagatttcccgtgacgaaatcgccggcatcctcaacggcggcacaacccagcccgatattccgcccgcaaccgccgccacccctgctgccgcaccgcaggttaccgtaccgcccgccgcgcccgcccgtcaggatgggttcaactggacgattgcaaccctgtttgcccttatcgtcctcattatgcagctttcctacctcgtcatcctatga

SEQ ID NO: 146 - protein, 165 aa, Neisseria meningitidis
  misc_feature (74)..(74): Xaa can be any naturally occurring amino acid
MPSEPPYASDGIKPDTHEEIPCPPVSAPTAKPVSGSKKPNSMSPKASSSAKNAKECLKPKTIWQARKNPYSTIXPEAVSDVKLVHRIGTSAIGKKQISRDEIAGILNGGTTQPDIPPATAATPAAAPQVTVPPAAPARQDGFNWTIATLFALIVLIMQLSYLVIL

SEQ ID NO: 147 - DNA, 1311 bp, Neisseria gonorrhoeae
atgaacgcgcccgacagctttgtcgcccacttccgcgaagccgccccctacatccgccaaatgcgcggcacgacactggtcgccggcatagacggccgcctgctcgaaggcggcaccttaaataagctcgccgccgacatcgggctgttgtcgcaactgggcatccgactcgtcctcatccacggcgcgtaccacttcctcgaccgcctcgccgccgcgcaaggccgcacgccgcattattgccggggtttgcgcgttaccgacgaaacctcgctcggacaggcgcagcagtttgccggcaccgtccgcagccgttttgaagccgcattgtgcggcagcgtttcaggattcgcgcgcgcgccttccgtcccgctcgtatcgggcaacttcctgaccgcccgtccgatgggcgtgattgacggaaccgatatggaatacgcgggggttatccgcaaaaccgacaccgccgccctccgtttccaactcgacgcgggcaatatcgtctggatgccgccgctcgggcattcctacggcggcaaaaccttcaatctcgatatggtgcaggccgccgcttccgtcgccgtctcgcttcaggccgaaaaactcgtttacctgaccctttcagacggcatttcccgccccgacggcacgctcgccgaaaccctctcggcacaggaagcgcaatcgctggcggaacacgccgccagcgaaacccgacgactgatttcgtccgccgttgccgcgctcgaaggcggcgtgcatcgcgtccaaatcctcaacggggccgccgacggcagcctgctgcaagaactcttcacccgcaacggcatcggcacgtccattgccaaagaagccttcgtctccatccggcaggcgcacagcggcgacatcccgcacatcgccgccctcatccgcccgctggaagaacagggcgtcctattgcaccgcagccgcgaatacctcgaaaaccacatttccgaattttccatcctcgaacacgacggcgacctgtacggctgtgccgcactcaaaacctttgccgaagccgattgcggcgaaatcgcctgccttgccgtctcgccgcaggcacaggacggcggctacggcgaacgcctgcttgcccacattatcgataaggcgcgcggcataggcataagcaggctgttcgcactgtccacaaataccggcgaatggtttgccgaacgcggctttcagacggcatcggaagacgagctgcccgaaacgcggcgcaaagactaccgcagcaacggacgaaacccgcatattctggtgcgtcgcctgcaccgctga

SEQ ID NO: 148 - protein, 436 aa, Neisseria gonorrhoeae
MNAPDSFVAHFREAAPYIRQMRGTTLVAGIDGRLLEGGTLNKLAADIGLLSQLGIRLVLIHGAYHFLDRLAAAQGRTPHYCRGLRVTDETSLGQAQQFAGTVRSRFEAALCGSVSGFARAPSVPLVSGNFLTARPMGVIDGTDMEYAGVIRKTDTAALRFQLDAGNIVWMPPLGHSYGGKTFNLDMVQAAASVAVSLQAEKLVYLTLSDGISRPDGTLAETLSAQEAQSLAEHAASETRRLISSAVAALEGGVHRVQILNGAADGSLLQELFTRNGIGTSIAKEAFVSIRQAHSGDIPHIAALIRPLEEQGVLLHRSREYLENHISEFSILEHDGDLYGCAALKTFAEADCGEIACLAVSPQAQDGGYGERLLAHIIDKARGIGISRLFALSTNTGEWFAERGFQTASEDELPETRRKDYRSNGRNPHILVRRLHR

SEQ ID NO: 149 - DNA, 1236 bp, Neisseria meningitidis
  misc_feature (1039)..(1039): n is a, c, g, or t
atgagcgcgcccgacctctttgtcgcccacttccgcgaagccgtcccctacatccgccaaatgcgcggcaaaacgctggtcgccggcatagacgaccgcctgctcgaaggtgataccttaaacaagctcgccgccgacatcgggctgttgtcgcaactgggcatcaggctcgtcctcatccacggcgcgcgccacttcctcgaccgccacgccgccgctcaaggccgcacgccgcattattgccggggcttgcgcgttaccgacgaaacctcgctcgaacaggcgcagcagtttgccggcaccgtccgcagccgttttgaagccgcattgtgcggcagcgtttccgggttcgcgcgcgcgccttccgtcccgctcgtatcgggcaacttcctgaccgcccgtccgataggtgtgattgacggaaccgatatggaatacgcgggcgttatccgcaaaaccgacaccgccgccctccgtttccaactcgacgcgggcaatatcgtctggctgccgccgctcggacattcctacagcggcaagaccttctatctcgatatgcttcaaaccgccgcctccgccgccgtctcgcttcaggccgaaaaactcgtttacctgaccctttcagacggcatttcccgccccgacggcacgctcgccgaaaccctctcggcacaggaagcgcaatcgctggcggaacacgccggcgggcaaacgcgacggctgatttcgtccgccgaactcttcacccgcaacggcatcggcacgtccattgccaaagaagccttcgtctccatccggcargcgcaywgggcgacatcccgcacatcgccgccctcatccgcccgctggaagaacagggcatcctgctgcaccgcascgcgaatacctcgaaaaccacatttccgaattttccatcctcgaacacgacggcaacctgtacggttgcgccgccctgaaaacctttgccgaagccgattgcggcgaaatcgcctgccttgccgtctcgccgcagcacaggacggcggctacggcgaacgcntgcttgcccacattatcgataaggcgcgcggcataggcataagcaggctgttcgcactgtccacaaataccggcgaatggtttgccgaacgcggctttcagacggcatcggaagacgagttgcccgaaacgcggcgcaaagactaccgcagcaacggacggaactcgcatattctggtacgtcgcctgcaccgctga

SEQ ID NO: 150 - protein, 412 aa, Neisseria meningitidis
  misc_feature (270)..(271): Xaa can be any naturally occurring amino acid
  misc_feature (293)..(293): Xaa can be any naturally occurring amino acid
  misc_feature (339)..(339): Xaa can be any naturally occurring amino acid
  misc_feature (348)..(348): Xaa can be any naturally occurring amino acid
MSAPDLFVAHFREAVPYIRQMRGKTLVAGIDDRLLEGDTLNKLAADIGLLSQLGIRLVLIHGARHFLDRHAAAQGRTPHYCRGLRVTDETSLEQAQQFAGTVRSRFEAALCGSVSGFARAPSVPLVSGNFLTARPIGVIDGTDMEYAGVIRKTDTAALRFQLDAGNIVWLPPLGHSYSGKTFYLDMLQTAASAAVSLQAEKLVYLTLSDGISRPDGTLAETLSAQEAQSLAEHAGGQTRRLISSAELFTRNGIGTSIAKEAFVSIRQAHXXDIPHIAALIRPLEEQGILLHRXREYLENHISEFSILEHDGNLYGCAALKTFAEADCGEIACLAVSPQXQDGGYGERXLAHIIDKARGIGISRLFALSTNTGEWFAERGFQTASEDELPETRRKDYRSNGRNSHILVRRLHR

SEQ ID NO: 151 - DNA, 1311 bp, Neisseria meningitidis
atgatcgtgcccgacctctttgtcgcccacttccgcgaagccgccccctacatccgccaaatgcgcggcaaaacgctggtcgccggcatagacgaccgcctgctcgaaggtgataccttaaacaagttcgccgccgacatcgggcttttgtcgcaactgggcatcaggctcgtcctcatccacggcgcgcgccacttcctcgaccgccacgccgccgcgcaaggccgcacgccgcattattgccggggcttgcgcgttaccgacgaaacctcgctcgaacaggcgcagcagtttgccggcaccgtccgcagccgttttgaagccgcattgtgcggcagcgtttccgggttcgcgcgcgcgccttccgtcccgctcgtatcgggcaacttcctgaccgcccgtccgataggtgtgattgacggaaccgatatggaatacgcgggcgttatccgcaaaaccgacaccgccgccctccgtttccaactcgacgcgggcaatatcgtctggctgccgccgctcggacattcctacagcggcaagaccttccatctcgatatgcttcaaaccgccgcctccgtcgccgtctcgcttcaggccgaaaaactcgtttacctgaccctttcagacggcatttcccgccccgacggcacgctcgccgtaaccctctcggcacaggaagcgcaatcgctggcggaacacgccggcggcgaaacgcgacggctgatttcgtccgccgttgccgcgctcgaaggcggcgtgcatcgcgtccaaatcctcaacggagccgccgacggcagcctgctgcaagaactcttcacccgcaacggcatcggcacgtccattgccaaagaagccttcgtctccatccggcaggcgcacagcggcgacatcccgcacattgccgccctcatccgcccgctggaagaacagggcatcctgctgcaccgcagccgcgaatacctcgaaaaccacatttccgaattttccatcctcgaacacgacggcaacctgtacggttgcgccgccctgaaaacctttgccgaagccgattgcggcgaaatcgcctgccttgccgtctcgccgcaggcacaggacggcggctacggcgaacgcctgcttgcccacattatcgataaggcgcgcggcataggcataagcaggctgttcgcactgtccacaaataccggcgaatggtttgccgaacgcggctttcagacggcatcggaagacgagttgcccgaaacgcggcgcaaagactaccgcagcaacggacggaactcgcatattctggtgcgtcgcctgcaccgctga

SEQ ID NO: 152 - protein, 436 aa, Neisseria meningitidis
MIVPDLFVAHFREAAPYIRQMRGKTLVAGIDDRLLEGDTLNKFAADIGLLSQLGIRLVLIHGARHFLDRHAAAQGRTPHYCRGLRVTDETSLEQAQQFAGTVRSRFEAALCGSVSGFARAPSVPLVSGNFLTARPIGVIDGTDMEYAGVIRKTDTAALRFQLDAGNIVWLPPLGHSYSGKTFHLDMLQTAASVAVSLQAEKLVYLTLSDGISRPDGTLAVTLSAQEAQSLAEHAGGETRRLISSAVAALEGGVHRVQILNGAADGSLLQELFTRNGIGTSIAKEAFVSIRQAHSGDIPHIAALIRPLEEQGILLHRSREYLENHISEFSILEHDGNLYGCAALKTFAEADCGEIACLAVSPQAQDGGYGERLLAHIIDKARGIGISRLFALSTNTGEWFAERGFQTASEDELPETRRKDYRSNGRNSHILVRRLHR

SEQ ID NO: 153 - DNA, 465 bp, Neisseria gonorrhoeae
atgagttcgcccaaacacatcggcttgcagggcggcagcaacggcggcctgattaccgccgccgccttcgtgcgcgaaccgcaaagcatcggtgcgctggtgtgcgaagtaccgctgaccgatatgatccgttatccgctgctgtccgccggttcaagttggacggacgaatacggcaatccgcagaaatacgaagcctgcaaacgccggctgggcgaattgtcgccgtatcacaatctttcagacggcatcgattatccgcccgcactcattaccaccagcctcagcgacgaccgcgtccatcccgcccacgcgctcaaattctacgccaaactgcgcgaaacctcgccgcaatcttggctctactcgcctgacggcggcggccataccggcaacggcacccaacgcgaatccgccgacaaactcgcctgcgtgttgctgtttttgaaagaatttttgggataa

SEQ ID NO: 154 - protein, 154 aa, Neisseria gonorrhoeae
MSSPKHIGLQGGSNGGLITAAAFVREPQSIGALVCEVPLTDMIRYPLLSAGSSWTDEYGNPQKYEACKRRLGELSPYHNLSDGIDYPPALITTSLSDDRVHPAHALKFYAKLRETSPQSWLYSPDGGGHTGNGTQRESADKLACVLLFLKEFLG

SEQ ID NO: 155 - DNA, 465 bp, Neisseria meningitidis
atcagttcgcccgaacacatcggcttgcagggcggcagcaacggcggactgattactgccgccgccttcgtgcgcgaaccgcaaagcatcggcgcgctggtgtgcgaagtgccgctgaccgacatgatccgttatccgctgctctccgccggttcaagctggacagacgaatacggcaatccgcaaaaatacgaagtctgcaaacgccggttgggcgaattgtcgccgtatcacaatctttcagacggcatcgattatccgcccgcgctcattaccaccagcctgtccgacgatcgcgtccatcccgcccacgcgctcaagttctacgccaaactgcgcgaaacctccgcgcaatcttggctctactcgcctgacggcggcggccataccggcaacggcacccaacgcgaatccgccgacgaactcgcctgcgtcttgctgtttttgaaagagtttttgggctaa

SEQ ID NO: 156 - protein, 154 aa, Neisseria meningitidis
ISSPEHIGLQGGSNGGLITAAAFVREPQSIGALVCEVPLTDMIRYPLLSAGSSWTDEYGNPQKYEVCKRRLGELSPYHNLSDGIDYPPALITTSLSDDRVHPAHALKFYAKLRETSAQSWLYSPDGGGHTGNGTQRESADELACVLLFLKEFLG

SEQ ID NO: 157 - DNA, 465 bp, Neisseria meningitidis
atcagttcgcccgaacacatcggcttgcagggcggcagcaacggcggactgattactgccgccgccttcgtgcgcgaaccgcaaagcataggcgcgctggtgtgcgaagtgccgctgaccgacatgatccgttatccgctgctctccgccggttcaagctggacagacgaatacggcaatccgcaaaaatacgaagtctgcaaacgccggttgggcgaattgtcgccgtatcacaatctttcagacggcatcgattatccgcccgcgctcattaccaccagcctgtccgacgatcgcgtccatcccgcccacgcgctcaagttctacgccaaactgcgcgaaacctcgccgcaatcttggctctactcgcctgacggcggcggccataccggcaacggcacgcagcgcgaagccgccgacgaactcgcctgcgtgttgctgtttttgaaagagtttttgggctaa

SEQ ID NO: 158 - protein, 154 aa, Neisseria meningitidis
ISSPEHIGLQGGSNGGLITAAAFVREPQSIGALVCEVPLTDMIRYPLLSAGSSWTDEYGNPQKYEVCKRRLGELSPYHNLSDGIDYPPALITTSLSDDRVHPAHALKFYAKLRETSPQSWLYSPDGGGHTGNGTQREAADELACVLLFLKEFLG

SEQ ID NO: 159 - DNA, 2016 bp, Neisseria gonorrhoeae
atgaaatcctaccccgacccctaccgccattttgaaaacctcgattccgccgaaacgcaaaacttcgctgctgaagcgaatgccgaaacgcgcgcgcgttttttaaacaacgacaaggcgcgcgcactttcagacggcattttgaatcaaatgcaggacacgcggcagattccgttttgtcaggaacaccgcgcgcggatgtaccatttccatcagaatgcggaatatccgaagggcgtgtaccgcatgtgtacggcggcgacctaccgttccggctatcccgagtggaaaatcctgttttcggtggcggatttcgatgagttgctcggcgacgatgtgtatttgggcggcgtgtcgcacttggtggagcagcccaaccgcgcgctgctgactttgaacaaatcgggcggcgatacggcgtatacgctggaagtggatttggaagcaggggaattggtagagggcggttttcactttccggcaggcaaaaaccatgtgtcgtggcgcgatgaaaacagcgtgtgggtgtgtccggcttgggacgaacgccagttgaccgaatcgggctatccgcgcgaagtgtggctggtggaacgcggcaagagtttcgaggaaagcctgccggcgtaccaaatcgataaaggcgcgatgatggtaaacgcgtggcgttacctcgatccgcagggttcgccgattgatttgattgaagcgtcggacggtttttacaccaagacgtatttgcaggtgtcgtccgaaggcggggcgaaaccgttgaacctgcctaatgattgcgatgtggtcggctatctggcgggacatcttttgctgacgctgcgcaaggactggcaccgcgcgaaccaaagctatccgagtggcgcgttggtggcggtgaaactgaatcggggcgaactcggggcggcgcagcttttgtttgcgcccgatgaaacgcaggcattggaaagcgtggaaacgaccaagcgttttgtggtggcaagcctgctggagaatgtacaaggccgtctgaaagcgtggcggtttgccgacagcaaatggcaggaagccgagttgccgcacctgccctcgggcgcgttggaaatgaccgaccaaccgtggggcggcgacgtggtttatcttgccgccagcgatttcaccacgccgctgacgctgtttgcgctggatttgaacgtgatggaactgaccgtcatgcgcctccagccgcagcagtttgtttcagacggcatcgaagtgcggcagttttgggcggtgtcgtccgacggcgaacgcattccttatttccacgtcggcaaaaacgccgcgcccgacacgccgaccttagtctatgcttacggaggtttcggcattcctgaattgccgcattatctgggcagcgtcggcaaatattggctggaagagggcaatgcctttgtattggcaaacatccgcggcggcggagaattcggcccgcgctggcatcaggcggcgcagggaatcagcaaacacaaaagcgttgatgatttgttggcagtcgtgcgtgatttgtccgaacgcggcatgagttcgcccaaacacatcggcttgcagggcggcagcaacggcggcctgattaccgccgccgccttcgtgcgcgaaccgcaaagcatcggtgcgctggtgtgcgaagtaccgctgaccgatatgatccgttatccgctgctgtccgccggttcaagttggacggacgaatacggcaatccgcagaaatacgaagcctgcaaacgccggctgggcgaattgtcgccgtatcacaatctttcagacggcatcgattatccgcccgcactcattaccaccagcctcagcgacgaccgcgtccatcccgcccacgcgctcaaattctacgccaaactgcgcgaaacctcgccgcaatcttggctctactcgcctgacggcggcggccataccggcaacggcacccaacgcgaatccgccgacaaactcgcctgcgtgttgctgtttttgaaagaatttttgggataa

SEQ ID NO: 160 - protein, 671 aa, Neisseria gonorrhoeae
MKSYPDPYRHFENLDSAETQNFAAEANAETRARFLNNDKARALSDGILNQMQDTRQIPFCQEHRARMYHFHQNAEYPKGVYRMCTAATYRSGYPEWKILFSVADFDELLGDDVYLGGVSHLVEQPNRALLTLNKSGGDTAYTLEVDLEAGELVEGGFHFPAGKNHVSWRDENSVWVCPAWDERQLTESGYPREVWLVERGKSFEESLPAYQIDKGAMMVNAWRYLDPQGSPIDLIEASDGFYTKTYLQVSSEGGAKPLNLPNDCDVVGYLAGHLLLTLRKDWHRANQSYPSGALVAVKLNRGELGAAQLLFAPDETQALESVETTKRFVVASLLENVQGRLKAWRFADSKWQEAELPHLPSGALEMTDQPWGGDVVYLAASDFTTPLTLFALDLNVMELTVMRLQPQQFVSDGIEVRQFWAVSSDGERIPYFHVGKNAAPDTPTLVYAYGGFGIPELPHYLGSVGKYWLEEGNAFVLANIRGGGEFGPRWHQAAQGISKHKSVDDLLAVVRDLSERGMSSPKHIGLQGGSNGGLITAAAFVREPQSIGALVCEVPLTDMIRYPLLSAGSSWTDEYGNPQKYEACKRRLGELSPYHNLSDGIDYPPALITTSLSDDRVHPAHALKFYAKLRETSPQSWLYSPDGGGHTGNGTQRESADKLACVLLFLKEFLG

SEQ ID NO: 161 - DNA, 2016 bp, Neisseria meningitidis
atgaaatcctaccccgacccctaccgccattttgaaaacctcgattccgccgaaacgcaaaacttcgctgctgaagcgaatgccgaaacgcgcgcgcgttttttagaaaacgacaaggcgcgcgcgctttcagacggcattttggcgcagttgcaggacacgcggcagattccgttttgtcaggaacaccgcgcgcggatgtaccatttccatcaggacgcggagtatccgaagggcgtgtaccgcgtgtgtaccgcggcgacgtatcgttccggctatcccgagtggaaaatcctgttttcggtggcggatttcgacgaattgcttggcgacgatgtgtatttgggcggcgtgtcgcacttggtggaacagcccaaccgcgcgttgttaacactgagcaaattgggcagcgatacggcgtacacgctggaagtggatttggaagcaggggagttggtcgaaggcggttttcactttccggcaggcaaaaaccatgtgtcgtggcgcgatgaaaacagcgtgtgggtgtgtccggcttggaacgaacgccagttgacccaatcgggctatccgcgcgaagtatggctggtggaacgcggcaagagtttcgaggaaagcctgcctgtgtatcaaatcggcgaagacggcatgatggtgaacgcgtggcgttatctcgatccgcagggttcgccgattgatttgattgaagcgtcggacggtttttacaccaaaacctatttgcgggtctcagccgaaggcgaggcgaaaccgttaaacctgcccaacgattgcgacgtggtcggctatctggcggggcatcttttgctgacgctgcgcaaggactggaaccgcgcgaaccaaagctatccgagcggcgcgctggtggcggtgaagctgaatcggggcgaactcggggcggcgcagcttttgtttgcgcccgatgaaacgcaggcattggaaagcgtggaaacgaccaagcgttttgtggtggcgagcctgttggagaacgtacaaggccgtctgaaagcatggcggtttgccgacggcaaatggcaggaagtcgaattgccgcgcctgccttcgggcgcgttggaaatgaccgaccaaccttggggcggcgacgtggtttaccttgccgccagcgatttcaccacgccgctgacgctgtttgcgctggatttgaacgtgatggaactgaccgtcatgcgccgccagccgcagcagtttgattcagacggcattaacgtgcagcagttttggacgacttcggctgacggcgagcgcattccttatttccacgtcggcaaaaacgccgcgcccgacatgccgacgctggtctatgcctacggcggtttcggcattcccgaattgccgcattatctgggcagcattggcaaatattggctggaagagggcaatgcctttgtattggcgaacatccgcggcggcggcgagttcggcccgcgctggcatcaggcggcgcagggaatcagcaaacataaaagcgttgatgatttattggcagtcgtgcgcgatttgtccgaacgcggtatcagttcgcccgaacacatcggcttgcagggcggcagcaacggcggactgattactgccgccgccttcgtgcgcgaaccgcaaagcatcggcgcgctggtgtgcgaagtgccgctgaccgacatgatccgttatccgctgctctccgccggttcaagctggacagacgaatacggcaatccgcaaaaatacgaagtctgcaaacgccggttgggcgaattgtcgccgtatcacaatctttcagacggcatcgattatccgcccgcgctcattaccaccagcctgtccgacgatcgcgtccatcccgcccacgcgctcaagttctacgccaaactgcgcgaaacctccgcgcaatcttggctctactcgcctgacggcggcggccataccggcaacggcacccaacgcgaatccgccgacgaactcgcctgcgtcttgctgtttttgaaagagtttttgggctaa

SEQ ID NO: 162 - protein, 671 aa, Neisseria meningitidis
MKSYPDPYRHFENLDSAETQNFAAEANAETRARFLENDKARALSDGILAQLQDTRQIPFCQEHRARMYHFHQDAEYPKGVYRVCTAATYRSGYPEWKILFSVADFDELLGDDVYLGGVSHLVEQPNRALLTLSKLGSDTAYTLEVDLEAGELVEGGFHFPAGKNHVSWRDENSVWVCPAWNERQLTQSGYPREVWLVERGKSFEESLPVYQIGEDGMMVNAWRYLDPQGSPIDLIEASDGFYTKTYLRVSAEGEAKPLNLPNDCDVVGYLAGHLLLTLRKDWNRANQSYPSGALVAVKLNRGELGAAQLLFAPDETQALESVETTKRFVVASLLENVQGRLKAWRFADGKWQEVELPRLPSGALEMTDQPWGGDVVYLAASDFTTPLTLFALDLNVMELTVMRRQPQQFDSDGINVQQFWTTSADGERIPYFHVGKNAAPDMPTLVYAYGGFGIPELPHYLGSIGKYWLEEGNAFVLANIRGGGEFGPRWHQAAQGISKHKSVDDLLAVVRDLSERGISSPEHIGLQGGSNGGLITAAAFVREPQSIGALVCEVPLTDMIRYPLLSAGSSWTDEYGNPQKYEVCKRRLGELSPYHNLSDGIDYPPALITTSLSDDRVHPAHALKFYAKLRETSAQSWLYSPDGGGHTGNGTQRESADELACVLLFLKEFLG

SEQ ID NO: 163 - DNA, 2016 bp, Neisseria meningitidis
atgaaatcctaccccgacccctaccgccattttgaaaacctcgattccgccgaaacgcaaaacttcgctgctgaagcgaatgccgaaacgcgcgcgcgttttttaaacaacgacaaggcacgcgcattgtctgacggcattttggcgcagttgcaggacacgcggcaaattccgttttgtcaggaacaccgcgcgcggatgtaccatttccatcaagatgcggaatatccgaaaggcgtgtaccgcgtgtgtaccgcggcgacttaccgttcgggctatcctgagtggaaaatcctgttttcggtggcggatttcgacgaattgctcggtgacgatgtatatctaggcggcgtgtcgcacctggtggaacagcccaaccgcgcgttgttaacactgagcaaatcgggcggcgataccgcgtacacgctggaagtggatttggaagcaggggagttggtagaaggcggttttcactttccggcaggcaaaaaccatgtgtcgtggcgcgatgaaaacagcgtgtgggtgtgtccggcttgggacgaacgccagttgaccgaatcgggctatccgcgcgaggtgtggctggtggaacgcggcaagagtttcgaggaaagcctgccggtgtaccaaattgctgaagacggcatgatggtgaacgcgtggcgttacctcgatccgcagggttcgccgattgatttgattgaagcgtctgacggtttttacaccaaaacctatttgcaggtctcagccgaaggcgaagcgaaaccgttaaacctgcccaacgattgcgacgtagtcggctatctggccggacatcttttgctgaccttgcgtaaagactggcaccgcgcgaaccaaagctatccgagtggcgcattggtagcagtaaaattaaaccgcggcgaattgggcgcggcgcagcttttgtttgcgcccaatgaaacgcaggcattggaaagcgtggaaacgaccaagcgttttgtcgtggcgagcctgctggaaaacgtacagggtcgtctgaaagcgtggcgttttactgatggcaaatggcaggaaaccgagttgccgcgcctgccttcgggcgcgttggaaatgaccgaccaaccgtgggggggcgacgtagtttaccttgccgccagcgatttcaccacgccgctgacgctgtttgcattggatttgaacgtgatggaactgaccgtcatgcgccgccagccgcagcagtttgattcagacggcattaacgtgcagcagttttggacgacttcggctgacggcgagcgcattccttatttccacgtcggcaaaaacgccgcgcccgacatgccgacgctggtctatgcctacggcggtttcggcattcccgaattgccgcattatctgggcagcattggcaaatattggctggaagagggcaatgcctttgtattggcgaacatccgcggcggcggcgagttcggcccgcgctggcatcaggcggcgcagggaatcagcaaacataaaagcgttgatgatttattggcagtcgtgagcgatttgtccgaacgcggtatcagttcgcccgaacacatcggcttgcagggcggcagcaacggcggactgattactgccgccgccttcgtgcgcgaaccgcaaagcataggcgcgctggtgtgcgaagtgccgctgaccgacatgatccgttatccgctgctctccgccggttcaagctggacagacgaatacggcaatccgcaaaaatacgaagtctgcaaacgccggttgggcgaattgtcgccgtatcacaatctttcagacggcatcgattatccgcccgcgctcattaccaccagcctgtccgacgatcgcgtccatcccgcccacgcgctcaagttctacgccaaactgcgcgaaacctcgccgcaatcttggctctactcgcctgacggcggcggccataccggcaacggcacgcagcgcgaagccgccgacgaactcgcctgcgtgttgctgtttttgaaagagtttttgggctaa

SEQ ID NO: 164 - protein, 671 aa, Neisseria meningitidis
MKSYPDPYRHFENLDSAETQNFAAEANAETRARFLNNDKARALSDGILAQLQDTRQIPFCQEHRARMYHFHQDAEYPKGVYRVCTAATYRSGYPEWKILFSVADFDELLGDDVYLGGVSHLVEQPNRALLTLSKSGGDTAYTLEVDLEAGELVEGGFHFPAGKNHVSWRDENSVWVCPAWDERQLTESGYPREVWLVERGKSFEESLPVYQIAEDGMMVNAWRYLDPQGSPIDLIEASDGFYTKTYLQVSAEGEAKPLNLPNDCDVVGYLAGHLLLTLRKDWHRANQSYPSGALVAVKLNRGELGAAQLLFAPNETQALESVETTKRFVVASLLENVQGRLKAWRFTDGKWQETELPRLPSGALEMTDQPWGGDVVYLAASDFTTPLTLFALDLNVMELTVMRRQPQQFDSDGINVQQFWTTSADGERIPYFHVGKNAAPDMPTLVYAYGGFGIPELPHYLGSIGKYWLEEGNAFVLANIRGGGEFGPRWHQAAQGISKHKSVDDLLAVVSDLSERGISSPEHIGLQGGSNGGLITAAAFVREPQSIGALVCEVPLTDMIRYPLLSAGSSWTDEYGNPQKYEVCKRRLGELSPYHNLSDGIDYPPALITTSLSDDRVHPAHALKFYAKLRETSPQSWLYSPDGGGHTGNGTQREAADELACVLLFLKEFLG

SEQ ID NO: 165 - DNA, 606 bp, Neisseria gonorrhoeae
atgacgatgatttgcttgcgcttccaagcgttcgtgccgcataccagcgcgttatccaacacttccacggcagccggcccttcctgcccgatggcggcggtgcggtcgatgatgaaaatccagccggggtttttctctttgatgtattcgaaggaaacgggctgcccgtgcccttcgttgcgtaaagattcgtccacgggcggcaggccgatgtcgccgtgtatccaacttgccaaccgcgattgcgtgccgaaggcggacaccttgttgcctgtaaccgacagcaccagcccgcgtcctttgcctttggcggcttcgcgcttttgggcgaacagcgcgtcaatctgcgcattcaattccgccacgcgcgcttccttaccgaaaatccgcgacagggtctccatctgcttctcgccgctggtgcggatattgccgttgtccaccgtcaaatctatggtggtcgcgtttttcgccaactgttcatacgcttccgcacccggcccgccggtaatgacaaactgcggattgtggcggtgcagggattcgcaatcgggctcaaacagcgtccccaccgttgccgccttgtcaaatgcaggctgcaaatag

SEQ ID NO: 166 - protein, 201 aa, Neisseria gonorrhoeae
MTMICLRFQAFVPHTSALSNTSTAAGPSCPMAAVRSMMKIQPGFFSLMYSKETGCPCPSLRKDSSTGGRPMSPCIQLANRDCVPKADTLLPVTDSTSPRPLPLAASRFWANSASICAFNSATRASLPKIRDRVSICFSPLVRILPLSTVKSMVVAFFANCSYASAPGPPVMTNCGLWRCRDSQSGSNSVPTVAALSNAGCK

SEQ ID NO: 167 - DNA, 606 bp, Neisseria meningitidis
atgacgatgatttgcttgcgcttccaagcgttcgtgccgcgtaccagcgcgttatccamtacttcgacagccgccggccyttcytgcccgatggcggcggtacggtcgatgatgaaaatccaatcggggtttttctctttgatgtattcgaaggaaacaggctgcccgtgcccctcgttgcgtaaagattcgtctacaggcggtaggccgatgtcgccgtgtatccaacttgccaaccgcgactgcgtgccgaaggcggacaccttgttgcccgtaaccgacagcaccagcccgcgtcctttgcctttggcggcttcgcgcgtttgggcgaacagcgcgtcaatctgcgccttcaattccgccgcgcgcgcttccttgccgaaaatccgcgccaaggtctccatctgcttttcgccgctggtgcggatattgccgttgtccaccgtcagatctatggtggtcgcgtttttcgctaactgttcatacgcttccgcgcccggcccgccggtaatgacaagctgaggattgtagcggtgcagggcttcgtaatcgggctcgaacagcgtccccaccgttgccgccttgtcaaatgcaggctgcaaataa

SEQ ID NO: 168 - protein, 201 aa, Neisseria meningitidis
  misc_feature (20)..(20): Xaa can be any naturally occurring amino acid
  misc_feature (27)..(27): Xaa can be any naturally occurring amino acid
  misc_feature (174)..(174): Xaa can be any naturally occurring amino acid
  misc_feature (177)..(177): Xaa can be any naturally occurring amino acid
  misc_feature (183)..(183): Xaa can be any naturally occurring amino acid
MTMICLRFQAFVPRTSALSXTSTAAGXSCPMAAVRSMMKIQSGFFSLMYSKETGCPCPSLRKDSSTGGRPMSPCIQLANRDCVPKADTLLPVTDSTSPRPLPLAASRVWANSASICAFNSAARASLPKIRAKVSICFSPLVRILPLSTVRSMVVAFFANCSYASAPGPPVMTSXGLXRCRASXSGSNSVPTVAALSNAGCK

SEQ ID NO: 169 - DNA, 606 bp, Neisseria meningitidis
atgacgatgatttgcttgcgcttccaagcgttcgtgccgcgtaccagcgcgttatccaatacttcgacagccgccggcccttcctgcccgatggcggcggtacggtcgatgatgaaaatccaatcggggtttttctctttgatgtattcgaaggaaacaggctgcccgtgcccctcgttgcgtaaagattcgtctacaggcggtaggccgatgtcgccgtgtatccaacttgccaaccgcgactgcgtgccgaaggcggacaccttgttgcccgtaaccgacagcaccagcccgcgtcctttgcctttggcggcttcgcgcgtttgggcgaacagcgcgtcaatctgcgccttcaattccgccgcgcgcgcttccttgccgaaaatccgcgccaaggtctccatctgcttttcgccgctggtgcggatattgccgttgtccaccgtcagatctatggtggtcgcgtttttcgccaactgttcatacgcttccgcgcccggcccgccggtaatgacaagctgaggattgtagcggtgcagggcttcgtaatcgggctcgaacagcgtccccaccgttgccgccttgtcaaatgcaggctgcaaataa

SEQ ID NO: 170 - protein, 198 aa, Neisseria meningitidis
MTMICLRFQAFVPRTSALSNTSTAAGPSCPMAAVRSMMKIQSGFFSLMYSKETGCPCPSLRKDSSTGGRPMSPCIQLANRDCVPKADTLLPVTDSTSPRPLPLAASRVWANSASICAFNSAARASLPKIRAKVSICFSPLVRILPLSTVRSMVVAFFANCSYASAPGPPVMTSGLRCRASSGSNSVPTVAALSNAGCK

SEQ ID NO: 171 - DNA, 511 bp, Neisseria meningitidis
atgacgatgatttgcttgcgcttccaagcgttcgtgccgcgtaccagcgcgttatccaatacttcgacagccgccggcccttcctgcccgatggcggcggtacggtcgatgatgaaaatccaatcggggtttttctctttgatgtattcgaaggaaacaggctgcccgtgcccctcgttgcgtaaagattcgtctacaggcggtaggccgatgtcgccgtgtatccaacttgccaaccgcgactgcgtgccgaaggcggacaccttgttgcccgtaaccgacagcaccagcccgcgtcctttgcctttggcggcttcgcgcgtttgggcgaacagcgcgtcaatctgcgccttcaattccgccgcgcgcgcttccttgccgaaaatccgcgccaaggtctccatctgcttttcgccgctggtgcggatattgccgttgtccaccgtcagatctatggtggtcgcgtttttcgctaactgttcatacgcttccgcgcccggcccgccggtaa

SEQ ID NO: 172 - protein, 173 aa, Neisseria meningitidis
MTMICLRFQAFVPRTSALSNTSTAAGPSCPMAAVRSMMKIQSGFFSLMYSKETGCPCPSLRKDSSTGGRPMSPCIQLANRDCVPKADTLLPVTDSTSPRPLPLAASRVWANSASICAFNSAARASLPKIRAKVSICFSPLVRILPLSTVRSMVVAFFANCSYASAPGPPVMTS

SEQ ID NO: 173 - DNA, 511 bp, Neisseria meningitidis
atgacgatgatttgcttgcgcttccaagcgttcgtgccgcgtaccagcgcgttatccaatacttcgacagccgccggcccttcctgcccgatggcggcggtacggtcgatgatgaaaatccaatcggggtttttctctttgatgtattcgaaggaaacaggctgcccgtgcccctcgttgcgtaaagattcgtctacaggcggtaggccgatgtcgccgtgtatccaacttgccaaccgcgactgcgtgccgaaggcggacaccttgttgcccgtaaccgacagcaccagcccgcgtcctttgcctttggcggcttcgcgcgtttgggcgaacagcgcgtcaatctgcgccttcaattccgccgcgcgcgcttccttgccgaaaatccgcgccaaggtctccatctgcttttcgccgctggtgcggatattgccgttgtccaccgtcagatctatggtggtcgcgtttttcgccaactgttcatacgcttccgcgcccggcccgccggtaa

SEQ ID NO: 174 - protein, 173 aa, Neisseria meningitidis; identical to SEQ ID NO: 172

SEQ ID NO: 175 - DNA, 387 bp, Neisseria gonorrhoeae
atggttgtttcaaatcaaaatatctatgccgtcggcccatcagcactttttcacatccgaaggcaaaaatccgtaatgccgcctgaacgcttcgttgaaccgtcccgcgtggcggtagccgcaaaagtgcatcgcggcttggatggtgctgcccgattcgatgagggcgagcgcgtgttccagccgcaggcggcgcaggcgtccggcgacggtttcgccggtttgcgctttgaaatagcgtttcaggtagcattcgttcagcccgacgcggcgggcgatttcggcgatggtcagcgggcgggcgaattcgctgttcaaaatatcggcggcttcgtctatgcgccggcggcggtagccgttgtcgtggcggcggaaggtgaagcgtaa

SEQ ID NO: 176 - protein, 128 aa, Neisseria gonorrhoeae
MVVSNQNIYAVGPSALFHIRRQKSVMPPERFVEPSRVAVAAKVHRGLDGAARFDEGERVFQPQAAQASGDGFAGLRFEIAFQVAFVQPDAAGDFGDGQRAGEFAVQNIGGFVYAPAAVAVVVAAEGEA

SEQ ID NO: 177 - DNA, 390 bp, Neisseria meningitidis
atggttgtttcaaatcaaaatatctatgccgccggcccctcagcacttcttcacatccgaaggcaaaaatccgtaatgccgtctgaacgcttcgttgaaccgtcccgcgtggcggtagccgcaaaagtgcatggcggcttggacggtgctgccggattcgatgagggcgagcgcgtgttccagccgcaggcggcgcaggcatccggcgacggtttcgccggtttgcgctttgaaatagcgtttcaggtagcattcgttcagtccgacgcggcgggcgatttcggcgatggtcagcggacgggcgaattcgtgttgcaggatgtcggcggcttcgtctatgcgccgacggcggtaaccgttgtcgtggcggcggaaggtgaagcgcaataa

SEQ ID NO: 178 - protein, 129 aa, Neisseria meningitidis
MVVSNQNIYAAGPSALLHIRRQKSVMPSERFVEPSRVAVAAKVHGGLDGAAGFDEGERVFQPQAAQASGDGFAGLRFEIAFQVAFVQSDAAGDFGDGQRTGEFVLQDVGGFVYAPTAVTVVVAAEGEAQ

SEQ ID NO: 179 - DNA, 390 bp, Neisseria meningitidis; identical to SEQ ID NO: 177

SEQ ID NO: 180 - protein, 129 aa, Neisseria meningitidis; identical to SEQ ID NO: 178

SEQ ID NO: 181 - DNA, 270 bp, Neisseria gonorrhoeae
atgctgcccgaccagagcgtcgagttcttgccacaagtcgtcgtttttgacgggctgtttggcggcggttttccagccgttgcgcttccaaccgtgtatccagttttccatgccgtttttgacgtattgcgagtcggtgcagatgatgacggtgcagcggcgtttgagcgatttcagcccttcgataacggcggtcagctccatgcggttgttggtggtttgcgcttcgccgccgaaaagttctttttcgcggctgccgtagcgcattaa

SEQ ID NO: 182 - protein, 89 aa, Neisseria gonorrhoeae
MLPDQSVEFLPQVVVFDGLFGGGFPAVALPTVYPVFHAVFDVLRVGADDDGAAAFERFQPFDNGGQLHAVVGGLRFAAEKFFFAAAVAH

SEQ ID NO: 183 - DNA, 270 bp, Neisseria meningitidis
atgccgtccgactagagcgtcgagttctttccagaagtcgtcgtttttgacgggctgtttggaggcggttttccagccgttgcgcttccaaccgtgtatccagttttccatgccatttttgacgtattgcgagtcggtgcagatgatgacggtgcagcggcgtttgagcgatttcagtccttcgatgacggcagtcagttccatgcggttgttggtggtttgcgcttcgccgccgaaaagttctttttcgtggctaccgtagcgcaytaa

SEQ ID NO: 184 - protein, 89 aa, Neisseria meningitidis
  misc_feature (5)..(5): Xaa can be any naturally occurring amino acid
MPSDXSVEFFPEVVVFDGLFGGGFPAVALPTVYPVFHAIFDVLRVGADDDGAAAFERFQSFDDGSQFHAVVGGLRFAAEKFFFVATVAH

SEQ ID NO: 185 - DNA, 270 bp, Neisseria meningitidis
gtgccgtccgaccagcgcgtcgagttctttccacaagtcgtcgtttttgacgggctgtttggcggcggttttccagccgttgcgcttccaaccgtgtatccagttttccatgccgtttttgacgtattgcgagtcggtgcagatgatgacggtgcagcggcgtttgagcgatttcagtccttcgatgacggcggtcagttccatacggttgttggtggtttgcgcttcgccgccgaaaagttctttttcgtggctgccgtagcgcattaa

SEQ ID NO: 186 - protein, 89 aa, Neisseria meningitidis
VPSDQRVEFFPQVVVFDGLFGGGFPAVALPTVYPVFHAVFDVLRVGADDDGAAAFERFQSFDDGGQFHTVVGGLRFAAEKFFFVAAVAH

SEQ ID NO: 187 - DNA, 561 bp, Neisseria gonorrhoeae
atgtcggcaatgctgcgtccgacaagcagcccgccgcgccgcgcctgtatgatgaccatccgcacgcggtcgtctgcaaaacgtaaaacctgcaatgcgcccgggcagtctatcaggccggcaagctgttcggtaacgagctgttcggggctgatggtttcggttatgccgaatatggaaaggctgccgttttcgttgttttcgagcttggggctgaggtattcgaggtattcgctggaacggacgcgcgcgatgcggccggggatgttgaacaggtcggcggcaactttgcaggcgacgatgttggtttcgtcgctgcgggagagcgcgagcagcaagtcggcatcttccgcgccggcgcgttataatgtgaagggggatgcgccgttgccgaaaacggtttggacatcgaggcggctgcctgtttcctgcaatgctttttcgtcgatgtcgataacggttacgtcgttgttggtgatggcggcaaggttttgcgcgacggtagaacctacctgcccgttgcctaaaatgaggattttcacggtatgggtcgccgggtga

SEQ ID NO: 188 - protein, 186 aa, Neisseria gonorrhoeae
MSAMLRPTSSPPRRACMMTIRTRSSAKRKTCNAPGQSIRPASCSVTSCSGLMVSVMPNMERLPFSLFSSLGLRYSRYSLERTRAMRPGMLNRSAATLQATMLVSSLRESASSKSASSAPARYNVKGDAPLPKTVWTSRRLPVSCNAFSSMSITVTSLLVMAARFCATVEPTCPLPKMRIFTVWVAG

SEQ ID NO: 189 - DNA, 559 bp, Neisseria meningitidis
atgtcggcaatgctgcgtccgacaagcastccgcrsgcgcgcctgtatgatgaccatccgcacgcggtcgtctgcaaaacgtaaaacctgcaatgcgcccgggcagtctatcaggccggcaagctgttcggtaacgagctgttcggggctgatggtttcggttatgccgaatatggaaaggctgccgttttcgttgttttcgagcttggggctgaggtattcgaggtattcgctggaacggacgcgcgcgatgcggccggggatgttgaacaggtcggcggcaactttgcaggcgacgatgttggtttcgtcgctgcgggagagcgcgagcagcaagtcggcatcttccgcgccggcgcgttctaatgtgaagggggatgcgccgttgccgaaaacggtttggacatcgaggcggctgcctgtttcctgcaatgctttttcgtcgatgtcgataacggttacgtcgttgttgggtatggcggcaaggttttgtgcgacggtagaacctacctgtccgttgcctaaaatgaggattttcacggtgtgggtcgccgagtga

SEQ ID NO: 190 - protein, 186 aa, Neisseria meningitidis
  misc_feature (10)..(10): Xaa can be any naturally occurring amino acid
  misc_feature (12)..(13): Xaa can be any naturally occurring amino acid
MSAMLRPTSXPXXRACMMTIRTRSSAKRKTCNAPGQSIRPASCSVTSCSGLMVSVMPNMERLPFSLFSSLGLRYSRYSLERTRAMRPGMLNRSAATLQATMLVSSLRESASSKSASSAPARSNVKGDAPLPKTVWTSRRLPVSCNAFSSMSITVTSLLGMAARFCATVEPTCPLPKMRIFTVWVAE

SEQ ID NO: 191 - DNA, 561 bp, Neisseria meningitidis
atgtcggcaatgctgcgtccgacaagcagtccgccgcgccgcgcctgtatgatgaccatccgcacgcggtcgtctgcaaaacgtaaaacctgcaatgcgcccgggcagtctatcaggccggcaagctgttcggtaacgagctgttcggggctgatggtttcggttatgccgaatatggaaaggctgccgttttcgttgttttcgagcttggggctgaggtattcgaggtattcgctggaacggacgcgcgcgatgcggccggggatgttgaacaggtcggcggcaactttgcaggcgacgatgttggtttcgtcgctgcgggagagcgcgagcagcaagtcggcatcttccgcgccggcgcgttctaatgtgaagggggatgcgccgttgccgaaaacggtttggacatcgaggcggctgcctgtttcctgcaatgctttttcgtcgatgtcgataacggttacgtcgttgttgggtatggcggcaaggttttgtgcgacggtagaacctacctgtccgttgcctaaaatgaggattttcacggtgtgggtcgccgagtga

SEQ ID NO: 192 - protein, 186 aa, Neisseria meningitidis
MSAMLRPTSSPPRRACMMTIRTRSSAKRKTCNAPGQSIRPASCSVTSCSGLMVSVMPNMERLPFSLFSSLGLRYSRYSLERTRAMRPGMLNRSAATLQATMLVSSLRESASSKSASSAPARSNVKGDAPLPKTVWTSRRLPVSCNAFSSMSITVTSLLGMAARFCATVEPTCPLPKMRIFTVWVAE

SEQ ID NO: 193 - DNA, 930 bp, Neisseria gonorrhoeae
atggtcatcatacaggcgcggcgcggcgggctgcttgtcggacgcagcattgccgacatcgcccaagatttgcccgacggggccgactgccaaatctgcgccgtttaccgcaacaaccgcctcatcgtccccgcgccgcaaaccgtcatcatcgaaggcgacgaaatcctgtttgccgccgccgccgaaaacatcggggcggtcatacccgaattgcgccccaaagaaaccagcacccgccgcatcatgattgccggcggcggcaacatctgctaccgcctcgccaagcagctcgaacacgcatacaacgtcaaaatcatcgaatgccggccgcgccgtgccgaatggatagccgaaaacctcgacaacaccctcgtcctgcaaggttcggcaaccgacgaaaccctgctcgacaacgaatacatcgacgaaatcgacgtattctgcgccctgaccaacgacgacgaaagcaacattatgtccgcccttttggcgaaaaacctcggcgcgaagcgcgtcatcggcatcgtcaaccgctcaagctacgtcgatttgctcgaaggcaacaaaatcgacatcgtcgtctccccccacctcatcaccatcggctcgatactcgcccacatccggcgcggcgacatcgttgccgtccaccccatccggcgcggcacggcggaagccatcgaagtcgtcgcgcacggcgacaaaaaaacttccgccatcatcggcaggcgcatcagcggcatcaaatggcccgaaggctgccacattgccgccgtcgtccgcgccggaaccggcgaaaccattatgggacaccataccgaaaccgtcatccaagacggtgaccacatcatctttttcgtctcgcgccggcgcatcctgaacgaactggagaaactcatccaagtcaaaatgggctttttcggataa

SEQ ID NO: 194 - protein, 309 aa, Neisseria gonorrhoeae
MVIIQARRGGLLVGRSIADIAQDLPDGADCQICAVYRNNRLIVPAPQTVIIEGDEILFAAAAENIGAVIPELRPKETSTRRIMIAGGGNICYRLAKQLEHAYNVKIIECRPRRAEWIAENLDNTLVLQGSATDETLLDNEYIDEIDVFCALTNDDESNIMSALLAKNLGAKRVIGIVNRSSYVDLLEGNKIDIVVSPHLITIGSILAHIRRGDIVAVHPIRRGTAEAIEVVAHGDKKTSAIIGRRISGIKWPEGCHIAAVVRAGTGETIMGHHTETVIQDGDHIIFFVSRRRILNELEKLIQVKMGFFG

SEQ ID NO: 195 - DNA, 937 bp, Neisseria meningitidis
atggtcatcatacaggcgcgcsygcggastgcttgtcggacgcagcattgccgacatcgcccaagatttgcccgacggggccgactgccaaatctgcgccgtttaccgcaacaaccgcctcatcgtccccgcgccgcaaaccgtcatcatcgaaggcgacgaaatcctatttgccgccgccgccgaaaacatcggcgcggtcatacccgaattgcgccccaaagaaacccaaagaaaccagcccmgmmgcatcatgattkccggcggcggcaacatcggctaccgtctcgccaagcagctcgaacacgcatacaacgtyaaaatcatcgaatgccggccgcgccgtgccgaatggatagccgaaaacctcgacaacaccctcgtcytgcaaggttcggcaaccgacgaaaccctgctcgacaacgaatacatcgacgaaatcgacgtattctgcgccctgaccaacgacgacgaaagcaacattatgtccgcccttttggcgaaaaacctcggcgcgaagcgcgtcatcggcatcgtcaaccgctcaagctacgtcgatttgctcgaaggcaacaaaatcgacatcgtcgtctccccccacctcatcaccatcggctcgatactcgcccacatccggcgcggcgacatcgttgccgtccaccccatccggcgcggcacggcggaagccatcgaagtcgtcgcacacggcgacaaaaaaacttccgccatcatcggcaggcgcatcagcggcatcaaatggcccgaaggctgccacattgccgccgtcgtccgcgccggaaccggcgaaaccattatgggacaccataccgaaaccgtcatccaagacggcgaccacatcatctttttcgtctcgcgccggcgcatcctgaacgaactggaaaaactcatccaggtcaaaatgggctttttcggataa

SEQ ID NO: 196 - protein, 312 aa, Neisseria meningitidis
  misc_feature (8)..(9): Xaa can be any naturally occurring amino acid
  misc_feature (11)..(11): Xaa can be any naturally occurring amino acid
  misc_feature (83)..(84): Xaa can be any naturally occurring amino acid
  misc_feature (88)..(88): Xaa can be any naturally occurring amino acid
MVIIQARXXGXLVGRSIADIAQDLPDGADCQICAVYRNNRLIVPAPQTVIIEGDEILFAAAAENIGAVIPELRPKETQRNQPXXIMIXGGGNIGYRLAKQLEHAYNVKIIECRPRRAEWIAENLDNTLVLQGSATDETLLDNEYIDEIDVFCALTNDDESNIMSALLAKNLGAKRVIGIVNRSSYVDLLEGNKIDIVVSPHLITIGSILAHIRRGDIVAVHPIRRGTAEAIEVVAHGDKKTSAIIGRRISGIKWPEGCHIAAVVRAGTGETIMGHHTETVIQDGDHIIFFVSRRRILNELEKLIQVKMGFFG

SEQ ID NO: 197 - DNA, 930 bp, Neisseria meningitidis
atggtcatcatacaggcgcggcgcggcggactgcttgtcggacgcagcattgccgacatcgcccaagatttgcccgacggggccgactgccaaatctgcgccgtttaccgcaacaaccgcctcatcgtccccgcgccgcaaaccgtcatcatcgaaggcgacgaaatcctatttgccgccgccgccgaaaacatcggcgcggtcatacccgaattgcgccccaaagaaaccagcacccgccgcatcatgattgccggcggcggcaacatcggctaccgtctcgccaagcagctcgaacacgcatacaacgtcaaaatcatcgaatgccggccgcgccgtgccgaatggatagccgaaaacctcgacaacaccctcgtcctgcaaggttcggcaaccgacgaaaccctgctcgacaacgaatacatcgacgaaatcgacgtattctgcgccctgaccaacgacgacgaaagcaacattatgtccgcccttttggcgaaaaacctcggcgcgaagcgcgtcatcggcatcgtcaaccgctcaagctacgtcgatttgctcgaaggcaacaaaatcgacatcgtcgtctccccccacctcatcaccatcggctcgatactcgcccacatccggcgcggcgacatcgttgccgtccaccccatccggcgcggcacggcggaagccatcgaagtcgtcgcacacggcgacaaaaaaacttccgccatcatcggcaggcgcatcagcggcatcaaatggcccgaaggctgccacattgccgccgtcgtccgcgccggaaccggcgaaaccattatgggacaccataccgaaaccgtcatccaagacggcgaccacatcatctttttcgtctcgcgccggcgcatcctgaacgaactggaaaaactcatccaagtcaaaatgggctttttcggataa

SEQ ID NO: 198 - protein, 309 aa, Neisseria meningitidis
MVIIQARRGGLLVGRSIADIAQDLPDGADCQICAVYRNNRLIVPAPQTVIIEGDEILFAAAAENIGAVIPELRPKETSTRRIMIAGGGNIGYRLAKQLEHAYNVKIIECRPRRAEWIAENLDNTLVLQGSATDETLLDNEYIDEIDVFCALTNDDESNIMSALLAKNLGAKRVIGIVNRSSYVDLLEGNKIDIVVSPHLITIGSILAHIRRGDIVAVHPIRRGTAEAIEVVAHGDKKTSAIIGRRISGIKWPEGCHIAAVVRAGTGETIMGHHTETVIQDGDHIIFFVSRRRILNELEKLIQVKMGFFG

SEQ ID NO: 199 - DNA, 453 bp, Neisseria gonorrhoeae
atgctcgacaaaggcgaggagttgcccgtcgatttcaccaaccgcctgatttactacgtcggccccgtcgatccggtcggcgatgaagtcgtcggtcccgcaggtccgaccacagccacccgcatggacaaatttacccgccaaatgctcaaacaaaccggcctcttgggcatgatcggcaaatccgagcgcggcgcggccacctgcgaagccatcgccgacaacaaggccgtgtacctcatggcagtcggcggcgcggcatacctcgtggcaaaagccatcaaatcttccaaagtcttggcgttccccgaattgggtatggaagccgtttacgaatttgaagtcaaagatatgcccgtaaccgtcgccgtggacagcaaaggcgaatccatccacgccaccgccccgcgcaaatggcaggcgaaaatcggcatcatccccgtcgagtcttga

SEQ ID NO: 200 - protein, 150 aa, Neisseria gonorrhoeae
MLDKGEELPVDFTNRLIYYVGPVDPVGDEVVGPAGPTTATRMDKFTRQMLKQTGLLGMIGKSERGAATCEAIADNKAVYLMAVGGAAYLVAKAIKSSKVLAFPELGMEAVYEFEVKDMPVTVAVDSKGESIHATAPRKWQAKIGIIPVES

SEQ ID NO: 201 - DNA, 453 bp, Neisseria meningitidis
atgctcaacaaaggcgaagaattgcccgtcgatttcaccaaccgcctgatttactacgtcggccccgtcgatccggtcggcgatgaagtcgtcggtccggcaggtccgaccacagccacccgcatggacaaattcacccgccaaatgctcgaacaaaccgacctcttgggcatgatcggcaaatccgagcgcggcgtggccacctgcgaagccatcgccgacaacaaagccgtgtacctcatggcagtcggcggcgcggcgtatctcgtggcaaaagccatcaaatcttccaaagtcttggcgttccccgaattgggcatggaagccatttacgaatttgaagtcaaagacatgcccgtaaccgtcgccgtagatagcaaaggcgaatccatccacgccaccgccccgcgcaaatggcaggcgaaaatcggcatcatccccgtcgaatcttga

SEQ ID NO: 202 - protein, 150 aa, Neisseria meningitidis
MLNKGEELPVDFTNRLIYYVGPVDPVGDEVVGPAGPTTATRMDKFTRQMLEQTDLLGMIGKSERGVATCEAIADNKAVYLMAVGGAAYLVAKAIKSSKVLAFPELGMEAIYEFEVKDMPVTVAVDSKGESIHATAPRKWQAKIGIIPVES

SEQ ID NO: 203 - DNA, 453 bp, Neisseria meningitidis
atgctcgacaaaggcgaagaattgcccgtcgatttcaccaaccgcctgatttactacgtcggccccgtcgatccggtcggcgacgaaatcgtcggcccagcaggtccgaccaccgccacccgcatggacaaattcacccgccaaatgctcgaacaaaccgacctcttgggcatgatcggcaaatccgagcgcggcgcggccacctgcgaagccatcgccgacaacaaagccgtgtacctcatggcagtcggcggcgcggcgtatctcgtggcaaaagccatcaaatcttccaaagtcttggcgttccccgaattgggcatggaagccatttacgaatttgaagtcaaagacatgcccgtaaccgtcgccgtagacagcaaaggcgaatccatccacgccaccgccccgccccaatggcaggcgaaaatcggcatcatccccgtcaaatcttga

SEQ ID NO: 204 - protein, 150 aa, Neisseria meningitidis
MLDKGEELPVDFTNRLIYYVGPVDPVGDEIVGPAGPTTATRMDKFTRQMLEQTDLLGMIGKSERGAATCEAIADNKAVYLMAVGGAAYLVAKAIKSSKVLAFPELGMEAIYEFEVKDMPVTVAVDSKGESIHATAPPQWQAKIGIIPVKS

SEQ ID NO: 205 - DNA, 420 bp, Neisseria gonorrhoeae
atgcgggcgcaggcgtttgatcaaccgttcggtcagctcctgttcggacaggcagaacacttcgcgccggttgacggctttcgggttcaggatattgatttggacgggcatcaacgcctcttccgcaccgccttcgccgttttccgcaaccccgtctgccgccgtaccggattctgccgcatcggcgttttccccgccctcaatctgtgcggtttcaaattcggcactgtcttttttggcatcgaaccggattctccgccgcgattcgatgtgtttttccgaaaccggcatttgcagggaagcctgcgcgttgagccagttttcctgaaggacgatcatcgggtcggtttcgacttcctcgccgcaatcggcaacggcgctgttgtgttcttcctgccatttcttcagatacgcctttaa

SEQ ID NO: 206 - protein, 139 aa, Neisseria gonorrhoeae
MRAQAFDQPFGQLLFGQAEHFAPVDGFRVQDIDLDGHQRLFRTAFAVFRNPVCRRTGFCRIGVFPALNLCGFKFGTVFFGIEPDSPPRFDVFFRNRHLQGSLRVEPVFLKDDHRVGFDFLAAIGNGAVVFFLPFLQIRL

SEQ ID NO: 207 - DNA, 417 bp, Neisseria gonorrhoeae
atgcgggcgcaggcgtttgatcagccgttcggtcagctcctgttcggacaggcagaacacttcgcgccggttgacggctttcgggttcaggatattgatttggacgggcatcaacgtttcttccgcatcgttttccccgttttccgaaaccgccggctcattcgtgccggattctgcctcgtcggcgttttccccgctttcaatctgtccggtttcaaattcgacactgtcttttttggtatcaaaccggattctccgccgcgattcgatgtgtttttccgaaaccgacatttgcagggaagcctgcgcgttgagccagttttcctgaaggacgatcatcgggtcggtttcgacttcctcgccgcaatcggcaacggcggcattgtgttcctcctgccattttttcagatacgcctt

SEQ ID NO: 208 - protein, 139 aa, Neisseria meningitidis
MRAQAFDQPFGQLLFGQAEHFAPVDGFRVQDIDLDGHQRFFRIVFPVFRNRRLIRAGFCLVGVFPAFNLSGFKFDTVFFGIKPDSPPRFDVFFRNRHLQGSLRVEPVFLKDDHRVGFDFLAAIGNGGIVFLLPFFQIRL

SEQ ID NO: 209 - DNA, 417 bp, Neisseria meningitidis
atgcgggcgcaggcgtttgatcagccgttcggtcagctcctgttcggacaggcagaacacttcgcgccggttgacggctttcgggttcagaatattgatttggacgggcatcaacgcttcttccgcaccgccttcgccgttttccgcaaccccgtctgccgccgtacccgattctgccgcatcggcgttttccccgccttcaatctgtccggtttcaaattcggcactgtcttttttggcatcaaaccggattctccgccgcgattcgatgtgtttttccgaaaccgacatttgcagggaagcctgcgcgttgagccagttttcctgaaggacgatcatcgggtcggtttcgacttcctcgccgcaatcggcaacggcggcattgtgttcctcctgccattttttcagatacgcctt

SEQ ID NO: 210 - protein, 139 aa, Neisseria meningitidis
MRAQAFDQPFGQLLFGQAEHFAPVDGFRVQNIDLDGHQRFFRTAFAVFRNPVCRRTRFCRIGVFPAFNLSGFKFGTVFFGIKPDSPPRFDVFFRNRHLQGSLRVEPVFLKDDHRVGFDFLAAIGNGGIVFLLPFFQIRL

SEQ ID NO: 211 - DNA, 384 bp, Neisseria gonorrhoeae
atgggcgcgggctggtgtcctcccggcatcttgggcatcggcatcggcggcacgcccgaaaaagccgtgttgatggcaaaagaatccctgatgagccacatcgacatccaagaattgcaggaaaaagccgcgtccggggcggaattgtccaccaccgaagccctgcgcctcgaactctttgaaaaggtcaacgcgctgggcatcggcgcgcaaggcttgggcggtctgaccaccgtgttggacgtgaaaatcctcgattacccgacccatgccgcctccaaaccgattgccatgattcccaactgtgccgccacccgccacgtcgaatttgaattggacggctcaggtcctgtcgaactcacgccgccgcgtgtcgaagactga

SEQ ID NO: 212 - protein, 127 aa, Neisseria gonorrhoeae
MGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVED

SEQ ID NO: 213 - DNA, 298 bp, Neisseria meningitidis
atgggcgcgggctggtgtcctcccggcatcttgggtatcggcatcggcggcagccgaaaaagccgtgctgatggcaaaagagtccctgatgagccacatcgacattcaagaattgcaggaaaaggccgcgtccggcgcggaattgtccaccaccgaagccctgcgcctcgaactctttgaaaaagtcaacgcgctgggcatcggcgcacaaggcttgggcggactgaccaccgtgttggacgtgaaaatcctcgattatccgacccacgccgcctccaaaccgattgccatgattccg

SEQ ID NO: 214 - protein, 130 aa, Neisseria meningitidis
  misc_feature (18)..(18): Xaa can be any naturally occurring amino acid
MGAGWCPPGILGIGIGGXAEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDGPI

SEQ ID NO: 215 - DNA, 387 bp, Neisseria meningitidis
atgggcgcgggctggtgtcctcccggcatcttgggcatcggcatcggcggtacgcccgaaaaagccgtgttgatggcgaaagaatccctgatgagccacatcgacatccaagaattgcaggaaaaagccgcgtccggcgcggaattgtccaccaccgaagccctgcgcctcgaactctttgaaaaagtcaacgcgctaggcatcggcgcgcaaggcttgggcggtctgaccaccgtgttggacgtgaaaatcctcgattacccgacccacgccgcctccaaaccgattgccatgattccgaactgcgccgccacccgccacgtcgaatttgaattggacggctcaggccctgtcgaactcacgccgccgcgcgtcgaagactggccc

SEQ ID NO: 216 - protein, 129 aa, Neisseria meningitidis
MGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDWP

SEQ ID NO: 217 - DNA, 1524 bp, Neisseria gonorrhoeae
atgaccgttatcaagcaagaagactttattcaaagtatctgcgatgccttccaattcatcagctactaccatccaaaagactacatcgacgcgctttataaggcgtggcagaaggaagaaaatcccgccgccaaagacgcgatgacgcagattttggtcaacagccgtatgtgtgccgaaaacaaccgccccatctgccaagacacaggtatcgcaaccgtcttcctcaaagtcggtatggatgtgcaatgggatgcggacatgagcgtggaaaagatggttaacgaaggcgtacgccgcgcctacacttgggaaggcaacaccctgcgcgcttccgtcctcgccgatccggccggcaaacgccaaaacaccaaagacaacacccccgccgtcatccacatgagcatcgtgccgggcggtaaagtcgaagtaacctgcgcggcaaaaggcggcggctctgaaaacaaatccaaactcgctatgctcaacccttccgacaacatcgtcgattgggtattgaaaaccatcccgacgatgggcgcgggctggtgtcctcccggcatcttgggcatcggcatcggcggcacgcccgaaaaagccgtgttgatggcgaaagaatccctgatgagccacatcgacatccaagaattgcaggaaaaagccgcgtccggcgcggaattgtccaccaccgaagccctgcgcctcgaactctttgaaaaggtcaacgcgctgggcatcggcgcgcaaggcttgggcggtctgaccaccgtgttggacgtgaaaatcctcgattacccgacccatgccgcctccaaaccgattgccatgattcccaactgtgccgccacccgccacgtcgaatttgaattggacggctcaggtcctgtcgaactcacgccgccgcgcgtcgaagactgacccgatctgacttacagccccgacaacggcaaacgcgtcgatgtcgataagctgaccaaagaagaagtggcaagctggaaaaccggcgacgtattgctgttgaacggcaaaatcctcaccggccgcgatgccgcgcacaaacgcctcgtcaatatgctcgacaaaggcgaggagttgcccgtcgatttcaccaaccgcctgatttactacgtcggccccgtcgatccggtcggcgatgaagtcgtcggtcccgcaggtccgaccacagccacccgcatggacaaatttacccgccaaatgctcaaacaaaccggcctcttgggcatgatcggcaaatccgagcgcggcgcggccacctgcgaagccatcgccgacaacaaggccgtgtacctcatggcagtcggcggcgcggcatacctcgtggcaaaagccatcaaatcttccaaagtcttggcgttccccgaattgggtatggaagccgtttacgaatttgaagtcaaagatatgcccgtaaccgtcgccgtggacagcaaaggcgaatccatccacgccaccgccccgcgcaaatggcaggcgaaaatcggcatcatccccgtcgagtcttga

SEQ ID NO: 218 - protein, 506 aa, Neisseria gonorrhoeae
MTVIKQEDFIQSICDAFQFISYYHPKDYIDALYKAWQKEENPAAKDAMTQILVNSRMCAENNRPICQDTGIATVFLKVGMDVQWDADMSVEKMVNEGVRRAYTWEGNTLRASVLADPAGKRQNTKDNTPAVIHMSIVPGGKVEVTCAAKGGGSENKSKLAMLNPSDNIVDWVLKTIPTMGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDPDLTYSPDNGKRVDVDKLTKEEVASWKTGDVLLLNGKILTGRDAAHKRLVNMLDKGEELPVDFTNRLIYYVGPVDPVGDEVVGPAGPTTATRMDKFTRQMLKQTGLLGMIGKSERGAATCEAIADNKAVYLMAVGGAAYLVAKAIKSSKVLAFPELGMEAVYEFEVKDMPVTVAVDSKGESIHATAPRKWQAKIGIIPVES

SEQ ID NO: 219 - DNA, 1524 bp, Neisseria meningitidis
atgaccgtcatcaaacaggaagactttatccaaagcatttgcgatgccttccaattcatcagctactatcatcccaaagactacatcgacgcgctttataaggcgtggcagaaggaagaaaatcctgccgccaaagacgcgatgacgcagattttggtcaacagccgtatgtgtgcggaaaacaaccgccccatctgccaagacacaggtatcgcaaccgtcttcctcaaagtcggtatgaacgtccaatgggatgcggacatgagcgtggaagagatggttaacgaaggcgtacgccgcgcctacacttgggaaggcaatacgctgcgcgcttccgtcctcgccgatccggccggcaaacgccaaaacaccaaagacaacacccccgccgtcatccatatgagcatcgtgccgggcggtaaagtcgaagtaacctgcgcggcaaaaggcggcggctctgaaaacaaatccaaactcgccatgctcaatccttccgacaacatcgtcgattgggtattgaaaaccatcccgaccatgggcgcgggctggtgtcctcccggcatcttgggtatcggcatcggcggcacgcccgaaaaagccgtgctgatggcaaaagagtccctgatgagccacatcgacattcaagaattgcaggaaaaggccgcgtccggcgcggaattgtccaccaccgaagccctgcgcctcgaactctttgaaaaagtcaacgcgctgggcatcggcgcacaaggcttgggcggactgaccaccgtgttggacgtgaaaatcctcgattatccgacccacgccgcctccaaaccgattgccatgattccgaactgcgccgccacccgccacgtcgaatttgaattggacggctcaggccctgtcgaactcacgccgccgcgcgtcgaagactggcccgatttgacttacagccccgacaacggcaaacgcgtcgatgtcgacaagctgaccaaagaagaagtggcaagctggaaaaccggcgacgtattgctgttgaacggcaaaatcctcaccggccgcgatgccgcacacaaacgcctcgtcgatatgctcaacaaaggcgaagaattgcccgtcgatttcaccaaccgcctgatttactacgtcggccccgtcgatccggtcggcgatgaagtcgtcggtccggcaggtccgaccacagccacccgcatggacaaattcacccgccaaatgctcgaacaaaccgacctcttgggcatgatcggcaaatccgagcgcggcgtggccacctgcgaagccatcgccgacaacaaagccgtgtacctcatggcagtcggcggcgcggcgtatctcgtggcaaaagccatcaaatcttccaaagtcttggcgttccccgaattgggcatggaagccatttacgaatttgaagtcaaagacatgcccgtaaccgtcgccgtagatagcaaaggcgaatccatccacgccaccgccccgcgcaaatggcaggcgaaaatcggcatcatccccgtcgaatcttga

SEQ ID NO: 220 - protein, 507 aa, Neisseria meningitidis
MTVIKQEDFIQSICDAFQFISYYHPKDYIDALYKAWQKEENPAAKDAMTQILVNSRMCAENNRPICQDTGIATVFLKVGMNVQWDADMSVEEMVNEGVRRAYTWEGNTLRASVLADPAGKRQNTKDNTPAVIHMSIVPGGKVEVTCAAKGGGSENKSKLAMLNPSDNIVDWVLKTIPTMGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDWPDLTYSPDNGKRVDVDKLTKEEVASWKTGDVLLLNGKILTGRDAAHKRLVDMLNKGEELPVDFTNRLIYYVGPVDPVGDEVVGPAGPTTATRMDKFTRQMLEQTDLLGMIGKSERGVATCEAIADNKAVYLMAVGGAAYLVAKAIKSSKVLAFPELGMEAIYEFEVKDMPVTVAVDSKGESIHATAPRKWQAKIGIIPVES

SEQ ID NO: 221 - DNA, 1524 bp, Neisseria meningitidis
atgaccgtcatcaaacaggaagactttatccaaagcatttgcgatgccttccaattcatcagctactaccatcccaaagactacatcgacgcgctttataaggcgtggcagaaggaagaaaaccccgccgccaaagacgcgatgacgcagattttggtcaacagccgcatgtgtgccgaaaacaaccgccccatctgccaagataccggtatcgcgaccgtgtttttgaaagtcggtatggatgtgcaatgggatgcagacatgagcgtcgaagagatggttaacgaaggcgtgcgccgcgcctacacttgggaaggcaatacgctgcgcgcttccgttctcgccgaccccgccggcaaacgccaaaataccaaagacaacacgcccgccgtcatccatatgagcatcgtgccgggcgacaaagtcgaagtaacctgcgcggcaaaaggcggcggttctgaaaacaaatccaaactcgccatgctcaacccttccgacaacatcgtcgattgggtattgaaaaccattccgaccatgggcgcgggctggtgtcctcccggcatcttgggcatcggcatcggcggtacgcccgaaaaagccgtgttgatggcgaaagaatccctgatgagccacatcgacatccaagaattgcaggaaaaagccgcgtccggcgcggaattgtccaccaccgaagccctgcgcctcgaactctttgaaaaagtcaacgcgctaggcatcggcgcgcaaggcttgggcggtctgaccaccgtgttggacgtgaaaatcctcgattacccgacccacgccgcctccaaaccgattgccatgattccgaactgcgccgccacccgccacgtcgaatttgaattggacggctcaggccctgtcgaactcacgccgccgcgcgtcgaagactggcccgatttgacttacagccccgacaacggcaaacgcgtcgatgtcgacaagctgaccaaagaagaagtggcaagctggaaaaccggcgacgtattgctgttgaacggcaaaatcctcaccggccgcgatgccgcacacaaacgcctcgtcgatatgctcgacaaaggcgaagaattgcccgtcgatttcaccaaccgcctgatttactacgtcggccccgtcgatccggtcggcgacgaaatcgtcggcccagcaggtccgaccaccgccacccgcatggacaaattcacccgccaaatgctcgaacaaaccgacctcttgggcatgatcggcaaatccgagcgcggcgcggccacctgcgaagccatcgccgacaacaaagccgtgtacctcatggcagtcggcggcgcggcgtatctcgtggcaaaagccatcaaatcttccaaagtcttggcgttccccgaattgggcatggaagccatttacgaatttgaagtcaaagacatgcccgtaaccgtcgccgtagacagcaaaggcgaatccatccacgccaccgccccgccccaatggcaggcgaaaatcggcatcatccccgtcaaatcttga

SEQ ID NO: 222 - protein, 507 aa, Neisseria meningitidis
MTVIKQEDFIQSICDAFQFISYYHPKDYIDALYKAWQKEENPAAKDAMTQILVNSRMCAENNRPICQDTGIATVFLKVGMDVQWDADMSVEEMVNEGVRRAYTWEGNTLRASVLADPAGKRQNTKDNTPAVIHMSIVPGDKVEVTCAAKGGGSENKSKLAMLNPSDNIVDWVLKTIPTMGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDWPDLTYSPDNGKRVDVDKLTKEEVASWKTGDVLLLNGKILTGRDAAHKRLVDMLDKGEELPVDFTNRLIYYVGPVDPVGDEIVGPAGPTTATRMDKFTRQMLEQTDLLGMIGKSERGAATCEAIADNKAVYLMAVGGAAYLVAKAIKSSKVLAFPELGMEAIYEFEVKDMPVTVAVDSKGESIHATAPPQWQAKIGIIPVKS

SEQ ID NO: 223 - DNA, 360 bp, Neisseria gonorrhoeae
atggctttggtggcggaggaaacggaaatatccgcgccgtgtttcaaaggctgcgagccgacgggcgacagcaggctgttgtccaccaccaagagcgcgccgatgccgtgcgccaattccgccaaggcttccaagtcggccacttcgcccaaggggttggacggcgtttccaaaaacagcagtttggtgttggctttgacggcggctttccattcatttatatcagtcggcgacacgcggctcactccgatgccgaatttggtaacgatgttattgataaagccgacggtcgtgccgaacaggctgcggctggaaaccacatggtcgcccgcctgcaggaaggtgaaaaacgccgcctga

SEQ ID NO: 224 - protein, 119 aa, Neisseria gonorrhoeae
MALVAEETEISAPCFKGCEPTGDSRLLSTTKSAPMPCANSAKASKSATSPKGLDGVSKNSSLVLALTAAFHSFISVGDTRLTPMPNLVTMLLIKPTVVPNRLRLETTWSPACRKVKNAA

SEQ ID NO: 225 - DNA, 360 bp, Neisseria meningitidis; identical to SEQ ID NO: 223

SEQ ID NO: 226 - protein, 119 aa, Neisseria meningitidis; identical to SEQ ID NO: 224

SEQ ID NO: 227 - DNA, 360 bp, Neisseria meningitidis
atggctttggtcgcggaggaaacggaaatatccgcgccgtgtttcaaaggctgagagccgacaggcgacagcaggctgttgtccaccaccaagagcgcgccgatgccgtgcgccaattccgccaaggcttccaagtcggccacttctcccaagggattggacggcgtttccaaaaacagcagtttggtgttggctttgacggcggctttccattcgtttatatcagtcggcgacacgtgactcacttcgatgccgaatttggtaacgatgttattgataaagccgacggtcgtgccgaacaggctgcggctggaaatcacatggtcgcccgcctgcaaaaaggtgaaaaacgccgcctga

SEQ ID NO: 228 - protein, 117 aa, Neisseria meningitidis
MALVAEETEISAPCFKGEPTGDSRLLSTTKSAPMPCANSAKASKSATSPKGLDGVSKNSSLVLALTAAFHSFISVGDTLTSMPNLVTMLLIKPTVVPNRLRLEITWSPACKKVKNAA

SEQ ID NO: 229 - DNA, 387 bp, Neisseria gonorrhoeae
atgtgtatgccatacgcaataagggtttcagacggcatctgccgcatttttccgccgatgccgtctgaaacacgcaatcagcgcgcgagtgcctgtttcaaatcgtcaatcaaatcgccaacatattccaaaccgaccgacaggcgcaccagtccggggcggataccggcggcgagtttttcttcgggctgcatcctgccgtgcgtggttgtccacggattggtgatggtcgagcgcacgtcgccgaggttggcggtacgggaaaagagttccacgactttccacgcggctgcttggtcggcgacttcaaaaccgatgacgatgccgccgccgttttgctgtttgcggataagctccgcctgcggatggtcgggcaatccggtgtag

SEQ ID NO: 230 - protein, 128 aa, Neisseria gonorrhoeae
MCMPYAIRVSDGICRIFPPMPSETRNQRASACFKSSIKSPTYSKPTDRRTSPGRIPAASFSSGCILPCVVVHGLVMVERTSPRLAVREKSSTTFHAAAWSATSKPMTMPPPFCCLRISSACGWSGNPV

SEQ ID NO: 231 - DNA, 387 bp, Neisseria meningitidis
atgtgtatgccatataagataagggtttcagacggcatctgctgtccaatgccgtctgaaacacgcaatcagcgtgcgagtgcctgtttcaaatcgtcaatcaaatcgccaacatattccaaaccgaccgacaggcgcaccaatccggggcggatgttggcggcgagtttttcttcgggctgcatcctgccgtgcgtggttgtccacgggtgggtaatggtcgagcgcacgtcaccgaggttggcggtgcgggaaaagagttccacgccgtccacaactttccacgccgcttcttgatcggcaacttcaaagccgatgacgatgccgccgccgttttgctgtttgcggataagcgccgcctgaggatggtcggacaatccggtgtag

SEQ ID NO: 232 - protein, 128 aa, Neisseria meningitidis
  misc_feature (99)..(99): Xaa can be any naturally occurring amino acid
  misc_feature (121)..(121): Xaa can be any naturally occurring amino acid
MCMPYKIRVSDGICCPMPSETRNQRASACFKSSIKSPTYSKPTDRRTNPGRMLAASFSSGCILPCVVVHGWVMVERTSPRLAVREKSSTPSTTFHAASXSATSKPMTMPPPFCCLRISAAXGWSDNPV

SEQ ID NO: 233 - DNA, 395 bp, Neisseria meningitidis
acgtgtatgtcatataagataagggtttcagacggcatttgcggtgtttttccgccgatgccgtctgaacacgcaatcagcgcgcgagtgcctgtttcaaatcgtcaatcaaatcgccaacatattccaaaccgaccgacaggcgcaccaatccggggcggatgttggcggcgagtttttcttcgggctgcatcctgccgtgcgtggttgtccacggatgggtaatggtcgagcgcacgtcgccgaggttggcggtacgggagaaaagttcgacgccgtccacgactttccacgcggctgcttggtcggcgacttcaaagccgatgacgatgccgccgccgttttgctgtttgcggataagctccgcctgaggatggtcgggtaatccggtgtaa

SEQ ID NO: 234 - protein, 130 aa, Neisseria meningitidis
  misc_feature (24)..(24): Xaa can be any naturally occurring amino acid
TCMSYKIRVSDGICGVFPPMPSEXRNQRASACFKSSIKSPTYSKPTDRRTNPGRMLAASFSSGCILPCVVVHGWVMVERTSPRLAVREKSSTPSTTFHAAAWSATSKPMTMPPPFCCLRISSAGWSGNPV

SEQ ID NO: 235 - DNA, 414 bp, Neisseria gonorrhoeae
atgccgccttacttcatcaccctcttaacgatggaaaatacaaaaagcgcggcgaaaacgcccactacaatccaaccggcttccataccgtccgcttttgcggcttccaaagcgttttttgccgtttcgggcaacgctgcgtttgcctgtgccgccaaagccagcggggcggctgttacaacagccagttttgcgccgtatttacggcaggtgttaataaatttcatgatattttcctttacgaaatttttaaaaaaatgtgtttgcgggctttgtgaaggttttagagaccgcctgccgggcctcttaaacttaatcttctttttcgtagaatccgaaaattacaaattccccgcctatctcttccaatgccgagctaaaagcgtcttcatagctgtcatatttaccggctga

SEQ ID NO: 236 - protein, 137 aa, Neisseria gonorrhoeae
MPPYFITLLTMENTKSAAKTPTTIQPASIPSAFAASKAFFAVSGNAAFACAAKASGAAVTTASFAPYLRQVLINFMIFSFTKFLKKCVCGLCEGFRDRLPGLLNLIFFFVESENYKFPAYLFQCRAKSVFIAVIFTG

SEQ ID NO: 237 - DNA, 411 bp, Neisseria meningitidis
atgccgtcttacttcatcactctcttaacgatggaaaatacaaaaagcgcggcgaaaatgcccactacaatccaaccggcttccataccgtccgcttttgcggcttccaaagcgttttttgccgtatcgggcaacgttgcatttgcatgtgcggccaaagccaggggagcagctgttacaacagccagttttgcgccgtatttacggcaggtgttaataaatttcatgatattttccttcaaaaagtgtttggcggtaatggatggagcgtttttcagacgaccgccgaacatccgaaaatcagtctttcaaaaatccgaatacgacaaattcgtattggttgccgatttcttccaaacctgcgttaatcgcttcttcgaagtcgtagaaataatcggcattggtgattaa

SEQ ID NO: 238 - protein, 136 aa, Neisseria meningitidis
MPSYFITLLTMENTKSAAKMPTTIQPASIPSAFAASKAFFAVSGNVAFACAAKARGAAVTTASFAPYLRQVLINFMIFSFKKCLAVMDGAFFRRPPNIRKSVFQKSEYDKFVLVADFFQTCVNRFFEVVEIIGIGD

SEQ ID NO: 239 - DNA, 411 bp, Neisseria meningitidis
atgccgtcttacttcatcactctcttaacgatggaaaagacaaaaagcgcggcgaaaacgcccactacaatccaaccggcttccataccgtccgcttttgcggcttccaaagcgttttttgctgtatcgggcaacgttgcatttgcatgtgcggccaaagccaggggagcagctgttacaacagccagttttgcgccgtatttacggcaggtgttaataaatttcatgatattttccttcaaaaagtgtttggcggtaatggatggagcgtttttcagacgaccgccgaacatccgaaaatcagtctttcaaaaatccgaatacgacaaattcgtattggttgccgatttcttccaaacctgcgttaatcgcttcttcgaagtcgtagaaataatcggcattggtgattaa

SEQ ID NO: 240 - protein, 136 aa, Neisseria meningitidis
MPSYFITLLTMEKTKSAAKTPTTIQPASIPSAFAASKAFFAVSGNVAFACAAKARGAAVTTASFAPYLRQVLINFMIFSFKKCLAVMDGAFFRRPPNIRKSVFQKSEYDKFVLVADFFQTCVNRFFEVVEIIGIGD

SEQ ID NO: 241 - DNA, 828 bp, Neisseria gonorrhoeae
atgtgggataatgccgaagcgatggaacggctgacgcgctggctgcttgtcatgatggcgatgctgcttgctgcgtccgggctggtttggttttacaattcgaatcatctgcccgtcaagcaggtgtcgctgaagggcaacctggtttattccgataagaaggcattgggcagtttggcgaaagaatacatccatgggaatattttgaggacggacatcaatggcgcacaggaagcctaccgccggtatccgtggattgcgtcggtcatggtgcgccgccgttttcccgatacggttgaggtcgtcctgaccgagcgcaagccggttgcacgttggggcgaccatgccttggtggacggcgaaggcaatgtttttgaagcccgcttggacagacccggaatgccggtattcagaggcgcggaaggaacgtctgccgaaatgctccgccgttatgacgaattttcgactgttttggcaaaacagggtttgggcatcaaagagatgacctatacggcacgttcggcgtggaatgtcgttttggacaacggcatcaccgtcaggctcggacgggaaaacgagatgaaacgcctccggctttttaccgaagcgtggcagcatctgttgcgtaagaataaaaatcggttatcctatgtggatatgaggtataaggacggattttcagtcccccatgctcccgacggtttacccgaaaaagaatccgaagaatattgggaacaggtttgggacatattacggcctggcgtcggaaacggttcgacgcaaatttcaatcagttataagggcagacgaacaatggaacagcagtaa

SEQ ID NO: 242 - protein, 275 aa, Neisseria gonorrhoeae
MWDNAEAMERLTRWLLVMMAMLLAASGLVWFYNSNHLPVKQVSLKGNLVYSDKKALGSLAKEYIHGNILRTDINGAQEAYRRYPWIASVMVRRRFPDTVEVVLTERKPVARWGDHALVDGEGNVFEARLDRPGMPVFRGAEGTSAEMLRRYDEFSTVLAKQGLGIKEMTYTARSAWNVVLDNGITVRLGRENEMKRLRLFTEAWQHLLRKNKNRLSYVDMRYKDGFSVPHAPDGLPEKESEEYWEQVWDILRPGVGNGSTQISISYKGRRTMEQQ

SEQ ID NO: 243 - DNA, 729 bp, Neisseria meningitidis
atgtgggataatgccgaagcgatggaacggctgacgcgctggctgcttgtcatgatggcgatgctgcttgctgcgtccgggctggtttggttttacaattcgaatcatctgcccgtcaagcaggtgtcgctgaagggcaacctggtttattccgataagaagacattgggcagtttggcgaaagaatacatccatgggaatattttgaggacggacatcaatggcgcacaggaggcctaccgccggtatccgtggattgcgtcggtcatggtgcgccgccgttttcccgacacggttgaggtcgtcctgaccgagcgcaagccggtcgcgcgttggggcgaccatgccttggtggacggcgaaggcaatgtttttgaagcccgcttggacagacccggaatgccggtattcagaggcgcggaaggaacgtctgccgaaatgctccgccgttatgacgaattttcgactgttttggcaaaacagggtttgggcatcaaagagatgacctatacggcacgttcggcgtggattgtcgttttggacaacggcatcaccgtcaggctcggacgggaaaacgagatgaaacgcctccggctttttaccgaagcgtggcagcatctgttgcgtaaaaataaaaatcggttatcctatgtggatatgaggtataaggacggattttcagtccgctatgcttccgacggtttacccgaaaaagaatccgaagaatag

SEQ ID NO: 244 - protein, 242 aa, Neisseria meningitidis
MWDNAEAMERLTRWLLVMMAMLLAASGLVWFYNSNHLPVKQVSLKGNLVYSDKKTLGSLAKEYIHGNILRTDINGAQEAYRRYPWIASVMVRRRFPDTVEVVLTERKPVARWGDHALVDGEGNVFEARLDRPGMPVFRGAEGTSAEMLRRYDEFSTVLAKQGLGIKEMTYTARSAWIVVLDNGITVRLGRENEMKRLRLFTEAWQHLLRKNKNRLSYVDMRYKDGFSVRYASDGLPEKESEE

SEQ ID NO: 245 - DNA, 729 bp, Neisseria meningitidis
atgtgggataatgccgaagcgatggaacggctgacgcgctggctgcttgtcatgatggcgatgctgcttgctgcgtccgggctggtttggttttacaattcgaatcatctgcccgtcaagcaggtgtcgctgaagggcaacctagtttattccgataagaaagcattgggcagtttggcgaaagaatacatccatgggaatattttgaggacggacatcaatggcgcacaggaggcctaccgccggtatccgtggattgcgtcggtcatggtgcgccgccgttttcccgacacggttgaggtcgtcctgaccgagcgcaagccggtcgcgcgttggggcgaccatgccttggtggacggcgaaggcaatgtttttgaagcccgtttggacagacccggaatgccggtattcagaggcgcggaaggaacgtctgccgaaatgctccgccgttatgacgaattttcgactgttttggcaaaacagggtttgggcatcaaagagatgacctatacggcacgttcggcgtggattgtcgttttggacaacggcatcaccgtcaggctcggacgggaaaacgagatgaaacgcctccggctttttaccgaagcgtggcaacatctgttgcgtaaaaataaaaatcggttatcctatgtggatatgaggtataaggacggattttcagtccgctatgctcccgacggtttacccgaaaaagaatccgaagaatag

SEQ ID NO: 246 - protein, 242 aa, Neisseria meningitidis
MWDNAEAMERLTRWLLVMMAMLLAASGLVWFYNSNHLPVKQVSLKGNLVYSDKKALGSLAKEYIHGNILRTDINGAQEAYRRYPWIASVMVRRRFPDTVEVVLTERKPVARWGDHALVDGEGNVFEARLDRPGMPVFRGAEGTSAEMLRRYDEFSTVLAKQGLGIKEMTYTARSAWIVVLDNGITVRLGRENEMKRLRLFTEAWQHLLRKNKNRLSYVDMRYKDGFSVRYAPDGLPEKESEE

SEQ ID NO: 247 - DNA, 1359 bp, Neisseria gonorrhoeae
atgaaaccactggacctaaatttcatctgccaagccctcaagcttccgatgccgtctgaaaacaaacccgtgtcgcgcatcgtaaccgacagccgcgatattcgggaaggcgatgtgtttttcgcattggcgggcgggcggtttgacgcgcatgattttgttggaggcgtattgtctgcgggcgcggcggcggttgtggtttcgcgcgaagattgcgcggctttgggcggcgcgttgaaagtcgatgacacgcttgccgcgttgcaaacgttggcgaaggcgtggcgcgataatgtgaacccgtttgtgttcggcattaccggttcgggcggcaagacgacggtgaaggagatgctggctgcggtattgcgccgccgtttcggcgatgatgccgtttcggcgacggcaggcaacttcaacaaccacatcggattgccgctgactttattgaaattaaacgaaaaacaccgctatgccgtgattgaaatgggcatgaaccattttggcgaactggcggttttaacgcaaatcgccaaacccgatgccgctttggtcaacaacgccctgcgcgcccatgtcggatgcggtttcgacggagtgggcgatattgccaaagcgaaaagcgagatttatgcaggcttatgttcagacggcatggcactgattcctcaagaagatgccaatatggctgtcttcaaaacggcaacgtttaatttgaatacgtgcactttcggcgtcgatagcggcgatgtccgcgcggaaaatatcgtgctgaaacctttgtcgtgcgaatttgatttggtgtgcggcgacgagcgcactgccgtggtgctgcctgttcccggccgccacaatgtccacaacgccgccgctgccgccgcgctggctttggctgccggtttgagtttgaacgatgtggcggaaggtttgcaaggcttcagcaacatcaaaggccgtctgaacgtcaaagccggcatcaagggcgcaaccctgattgacgatacttataatgcgaatcccgacagtatgaaagccgcggttgacgtgttggcgcgtatgcctgcgccgcgcattttcgtgatgggcgatatgggcgaactgggcgaggacgaagccgccgccatgcacgccgaagtcggcgcgtacgcccgcgaccaaggcatcgaagcggcttattttgtcggcgacaacagcgtcgaagcggcggaaaaatttggcgcggacggtttgtggttcgccgccaaagacccgttgattcaagtgttgagccacgatttgcccgaacgcgccaccgtgttggtgaaaggttcgcgctttatgcagatggaagaagtggtcgaggcattggaggataagtga

SEQ ID NO: 248 - protein, 452 aa, Neisseria gonorrhoeae
MKPLDLNFICQALKLPMPSENKPVSRIVTDSRDIREGDVFFALAGGRFDAHDFVGGVLSAGAAAVVVSREDCAALGGALKVDDTLAALQTLAKAWRDNVNPFVFGITGSGGKTTVKEMLAAVLRRRFGDDAVSATAGNFNNHIGLPLTLLKLNEKHRYAVIEMGMNHFGELAVLTQIAKPDAALVNNALRAHVGCGFDGVGDIAKAKSEIYAGLCSDGMALIPQEDANMAVFKTATFNLNTCTFGVDSGDVRAENIVLKPLSCEFDLVCGDERTAVVLPVPGRHNVHNAAAAAALALAAGLSLNDVAEGLQGFSNIKGRLNVKAGIKGATLIDDTYNANPDSMKAAVDVLARMPAPRIFVMGDMGELGEDEAAAMHAEVGAYARDQGIEAAYFVGDNSVEAAEKFGADGLWFAAKDPLIQVLSHDLPERATVLVKGSRFMQMEEVVEALEDK

SEQ ID NO: 249 - DNA, 1368 bp, Neisseria meningitidis
atgaaaccactggacctaaatttcatctgccaagccctcaagcttccgatgccgtctgaaagcaaacccgtgtcgcgcatcgtaaccgacagccgcgacatccgcgcgggcgatgtgtttttcgcattggcgggcgagcggtttgacgcgcatgattttgttgaagacgtattggctgctggtgcggcggcggttgtggtttcgcgcgaagattgtgctgcaatggatggcgcgttgaaagtcgatgacacgcttgccgcattgcaaacgctggcaaaggcgtggcgtgaaaatgtgaatccgtttgtgttcggcattaccggttcgggcggcaagacgacggtgaaggaaatgctggctgcggtattgcgccgccgtttcggcgatgatgccgtgttggcgacggcaggcaacttcaacaaccatatcggattgccgctgactttgttgaagttaaacgaaaaacaccgctatgccgtgattgaaatgggcatgaaccatttcggcgaactggcggttttaacgcamatcgccaaaccaaatgccgcattggtcaacaacgccatgcgcgcccatgtcggctgcggtttcgacggagtgggcgatattgccaaagcgaaaagcgagatttaccaaggtttatgttcagacggcattgcactgattcctcaagaagatgccaatatggctgtcttcaaaacggcaacgcttaatttgaatacgcgcactttcggcatcgatagcggcgatgttcacgcggaaaatattgtgctgaaaccgttgtcgtgcgaatttgatttggtgtgcggcgatgagcgcgccgccgtggtgctgcctgttcccggccgccacaatgtccacaacgccgccgctgccgccgcgctggctttggctgcgggtttgagtttgaacgatgtggcggaaggtttgaaaggcttcagcaatatcaaaggccgtctgaacgtcaaatccggaatcaagggcgcaaccctgattgacgatacttataatgcgaaccctgacagcatgaaagctgcgattgacgtgttggcgcgtatgcctgcgccgcgtattttcgtgatgggcgatatgggcgaactgggcgaactgggcgaggacgaagccgccgctatgcacgccgaagtcggcgcgtatgcccgcgaccaaggcatcgaagcggcttattttgtcggcgacaacagcgtcgaagcggcggaaaaatttggcgcggacggtttgtggttcgccgccaaagacccgttgattcaagtgttgcgccacgatttgcccgaacgcgccaccgtgttggtgaaaggttcgcgctttatgcagatggaagaagtggtcgaggcattggaggataagtga

SEQ ID NO: 250 - protein, 455 aa, Neisseria meningitidis
  misc_feature (176)..(176): Xaa can be any naturally occurring amino acid
MKPLDLNFICQALKLPMPSESKPVSRIVTDSRDIRAGDVFFALAGERFDAHDFVEDVLAAGAAAVVVSREDCAAMDGALKVDDTLAALQTLAKAWRENVNPFVFGITGSGGKTTVKEMLAAVLRRRFGDDAVLATAGNFNNHIGLPLTLLKLNEKHRYAVIEMGMNHFGELAVLTXIAKPNAALVNNAMRAHVGCGFDGVGDIAKAKSEIYQGLCSDGIALIPQEDANMAVFKTATLNLNTRTFGIDSGDVHAENIVLKPLSCEFDLVCGDERAAVVLPVPGRHNVHNAAAAAALALAAGLSLNDVAEGLKGFSNIKGRLNVKSGIKGATLIDDTYNANPDSMKAAIDVLARMPAPRIFVMGDMGELGELGEDEAAAMHAEVGAYARDQGIEAAYFVGDNSVEAAEKFGADGLWFAAKDPLIQVLRHDLPERATVLVKGSRFMQMEEVVEALEDK

SEQ ID NO: 251 - DNA, 1359 bp, Neisseria meningitidis
atgaaaccactggacctaaatttcatctgccaagccctcaagcttccgatgccgtctgaaagcaaacccgtgtcgcgcatcgtaaccgacagccgcgacatccgcgcgggcgatgtgtttttcgcattggcgggcgggcggtttgatgcgcatgattttgttgaagacgtattggctgcgggtgcggcggcggttgtggtttcgcgcgaagattgcgttgcaatggatggcgcgttgaaagtcgatgacacgcttaccgcgttgcaaatgttggcgaaggcgtggcgcgagaatgtgaacccgtttgtgttcggtattaccggctcgggcggcaagacgacggtgaaggaaatgttggctgcggtattgcgccgccgtttcggcgataatgccgttttggcgacggcaggcaacttcaacaaccacatcggattgccgttgactttgttgaaattaaacgaaaaacaccgctatgccgtgattgaaatgggtatgaaccattttggcgaactggcggttttgacacaaatcgccaaacccgatgccgcattggtcaacaacgccatgcgcgcccatgtcggctgcggtttcgacggagtgggcgatattgccaaagcgaaaagcgagatttatcaaggcttatgttcagacggcatggcgctgattcctcaagaagatgccaatatggctgtcttcaaaacggcaacgcttaatttgaatacgcgcactttcggcatcgatagcggcgatgtccacgcggaaaatatcgtgctgaaaccgttgtcgtgcgaatttgatttggtgtgcggcaacgagtgcgcagccgtggttctgcccgttcccggccgccacaatgtccacaacgccgccgccgccgccgcgctgtctttggctgcaggtttgagtttgaacgatgtggcggaaggtttgaaaggcttcagcaatatcaaaggccgtctgaacgtcaaatccggaatcaagggcgcaaccctgattgacgatacttataatgcgaaccctgacagcatgaaagctgcggttgacgtgttggcgcgtatgcctgcgccgcgtattttcgtgatgggcgatatgggcgaactgggtgaggacgaagccgccgccatgcacgccgaagtcggcgcgtacgcccgcgaccaaggcatcgaagcggcttattttgtcggcgacaacagcgtcgaagcggcggaaaaatttggcgcggacggtttgtggttcgccgccaaagacccgttgattcaagtgttgcgccacgatttgcccgaacgcgccaccgtgttggtgaaaggttcgcgctttatgcagatggaagaagtggtcgaggcattggaggataagtga

SEQ ID NO: 252 - protein, 452 aa, Neisseria meningitidis
MKPLDLNFICQALKLPMPSESKPVSRIVTDSRDIRAGDVFFALAGGRFDAHDFVEDVLAAGAAAVVVSREDCVAMDGALKVDDTLTALQMLAKAWRENVNPFVFGITGSGGKTTVKEMLAAVLRRRFGDNAVLATAGNFNNHIGLPLTLLKLNEKHRYAVIEMGMNHFGELAVLTQIAKPDAALVNNAMRAHVGCGFDGVGDIAKAKSEIYQGLCSDGMALIPQEDANMAVFKTATLNLNTRTFGIDSGDVHAENIVLKPLSCEFDLVCGNECAAVVLPVPGRHNVHNAAAAAALSLAAGLSLNDVAEGLKGFSNIKGRLNVKSGIKGATLIDDTYNANPDSMKAAVDVLARMPAPRIFVMGDMGELGEDEAAAMHAEVGAYARDQGIEAAYFVGDNSVEAAEKFGADGLWFAAKDPLIQVLRHDLPERATVLVKGSRFMQMEEVVEALEDK

SEQ ID NO: 253 - DNA, 744 bp, Neisseria gonorrhoeae
atgtggttgttgaagttgcctgccgtcgccgaaacggcatcatcgccgaaacggcggcgcaataccgcagccagcatctccttcaccgtcgtcttgccgcccgaaccggtaatgccgaacacaaacgggttcacattatcgcgccacgccttcgccaacgtttgcaacgcggcaagcgtgtcatcgactttcaacgcgccgcccaaagccgcgcaatcttcgcgcgaaaccacaaccgccgccgcgcccgcagacaatacgcctccaacaaaatcatgcgcgtcaaaccgcccgcccgccaatgcgaaaaacacatcgccttcccgaatatcgcggctgtcggttacgatgcgcgacacgggtttgttttcagacggcatcggaagcttgagggcttggcagatgaaatttaggtccagtggtttcatatttgctttcgttaatattcgggcggcggacacatcggtagcggctgatttttttatcgcctgttttgctgtggtaaaacacagattattttcccattctcattcggcattttttctgtacgtatcattttttagacgtatttttagccgatttgccttttcccgcataccacggcgcggggtcgtcggactgtctgtcgataaaggcaaggttattgccttcgcccggcacatcggggacattcccccaaaaatcatagccgtcatcgggcaactcgtcggtttcgatacccgtccaactgccgaatccgcgtaa

SEQ ID NO: 254 - protein, 247 aa, Neisseria gonorrhoeae
MWLLKLPAVAETASSPKRRRNTAASISFTVVLPPEPVMPNTNGFTLSRHAFANVCNAASVSSTFNAPPKAAQSSRETTTAAAPADNTPPTKSCASNRPPANAKNTSPSRISRLSVTMRDTGLFSDGIGSLRAWQMKFRSSGFIFAFVNIRAADTSVAADFFIACFAVVKHRLFSHSHSAFFLYVSFFRRIFSRFAFSRIPRRGVVGLSVDKGKVIAFARHIGDIPPKIIAVIGQLVGFDTRPTAESA

SEQ ID NO: 255 - DNA, 744 bp, Neisseria meningitidis
  misc_feature (4)..(5): n is a, c, g, or t
atgnngttgttgaagttgcctgccgtcgccaacacggcatcatcgccgaaacggcggcgcaataccgcagccagcatttccttcaccgtcgtcttgccgcccgaaccggtaatgccgaacacaaacggattcacattttcacgccacgcctttgccagcgtttgcaatgcggcaagcgtgtcatcgactttcaacgcgccatccattgcagcacaatcttcgcgcgaaaccacaaccgccgccgcaccagcagccaatacgtcttcaacaaaatcatgcgcgtcaaaccgctcgcccgccaatgcgaaaaacacatcgcccgcgcggatgtcgcggctgtcggttacgatgcgcgacacgggtttgctttcagacggcatcggaagcttgagggcttggcagatgaaatttaggtccagtggtttcatatttactttcgttaatattcgggcggcggacacatcggtagcggctgatttttttatcgcctgttttgctgtggtaaaacacagattattttcccattctcattcggsattttttctgtacgtatcattttttagacgtatttttagtcgatttgccttttcccgcataccacggcgcggggtcgtcgggcagtccgtcgataaaggcaaggttattgccttcgccctgcacatcgggaacattcccccaaaaatcatagccgtcatcgggcaactcgtcggtttcgatacccgtccaactgccgaatccgcgtaa

SEQ ID NO: 256 - protein, 247 aa, Neisseria meningitidis
  misc_feature (2)..(2): Xaa can be any naturally occurring amino acid
  misc_feature (179)..(179): Xaa can be any naturally occurring amino acid
MXLLKLPAVANTASSPKRRRNTAASISFTVVLPPEPVMPNTNGFTFSRHAFASVCNAASVSSTFNAPSIAAQSSRETTTAAAPAANTSSTKSCASNRSPANAKNTSPARMSRLSVTMRDTGLLSDGIGSLRAWQMKFRSSGFIFTFVNIRAADTSVAADFFIACFAVVKHRLFSHSHSXFFLYVSFFRRIFSRFAFSRIPRRGVVGQSVDKGKVIAFALHIGNIPPKIIAVIGQLVGFDTRPTAESA

SEQ ID NO: 257 - DNA, 744 bp, Neisseria meningitidis
atgtggttgttgaagttgcctgccgtcgccaaaacggcattatcgccgaaacggcggcgcaataccgcagccaacatttccttcaccgtcgtcttgccgcccgagccggtaataccgaacacaaacgggttcacattctcgcgccacgccttcgccaacatttgcaacgcggtaagcgtgtcatcgactttcaacgcgccatccattgcaacgcaatcttcgcgcgaaaccacaaccgccgccgcacccgcagccaatacgtcttcaacaaaatcatgcgcatcaaaccgcccgcccgccaatgcgaaaaacacatcgcccgcgcggatgtcgcggctgtcggttacgatgcgcgacacgggtttgctttcagacggcatcggaagcttgagggcttggcagatgaaatttaggtccagtggtttcatatttactttcgttaatattcgggcggcggacacatcggtagcggctgatttttttatcgcctgttttgctgtggtaaaacacagattattttcccattctcattcggcattttttctgtacgtatcattttttagacgtatttttagtcgatttgccttttcccgcataccacggcgcggggtcgtcgggcagtccgtcgataaaggcaaggttattgccttcgccctgcacatcgggaacattcccccaaaaatcatagccgtcatcgggcaactcgtcggtttcgatacccgtccaactgccgaatccgcgtaa

SEQ ID NO: 258 - protein, 247 aa, Neisseria meningitidis
MWLLKLPAVAKTALSPKRRRNTAANISFTVVLPPEPVIPNTNGFTFSRHAFANICNAVSVSSTFNAPSIATQSSRETTTAAAPAANTSSTKSCASNRPPANAKNTSPARMSRLSVTMRDTGLLSDGIGSLRAWQMKFRSSGFIFTFVNIRAADTSVAADFFIACFAVVKHRLFSHSHSAFFLYVSFFRRIFSRFAFSRIPRRGVVGQSVDKGKVIAFALHIGNIPPKIIAVIGQLVGFDTRPTAESA

SEQ ID NO: 259 - DNA, 696 bp, Neisseria gonorrhoeae
atgaaacaatccgcccgaataaaaaatatggatcagacattaaaaaatacattgggcatttgcgcgcttttagccttttgttttggcgcggccatcgcatcaggttatcacttggaatatgaatacggctaccgttattctgccgtgggcgctttggcttcggttgtatttttattattattggcacgcggcttcccgcgcgtttcttcagttgttttactgatttacgtcggcacaaccgccctatatttgccggtcggctggctgtatggtgcgccttcttatcagatagtcggttcgatattggaaagcaatcctgccgaggcgcgtgaatttgtcggcaatcttcccgggtcgctttattttgtgcaggcattatttttcatttttggcttgacagtttggaaatattgtgtatctgtgggggtatttgctgacgtaaaaaactataaacgtcgcagcaaaatatggctgaccatattattgactttgattttgtcctgcgcggtgatggagaaaatcgccggcgataaagattggcgagaacctgatgccggcctgttgttgaatattttcgacctgtattacgacttggctttccgcgccggcacaatatgccgccaagcgcgcccacattttggaagcagcaaaaaaagcgtcaacatggcatatccgccaacttgcgcccaagtataa

SEQ ID NO: 260 - protein, 231 aa, Neisseria gonorrhoeae
MKQSARIKNMDQTLKNTLGICALLAFCFGAAIASGYHLEYEYGYRYSAVGALASVVFLLLLARGFPRVSSVVLLIYVGTTALYLPVGWLYGAPSYQIVGSILESNPAEAREFVGNLPGSLYFVQALFFIFGLTVWKYCVSVGVFADVKNYKRRSKIWLTILLTLILSCAVMEKIAGDKDWREPDAGLLLNIFDLYYDLAFRAGTICRQARPHFGSSKKSVNMAYPPTCAQV

SEQ ID NO: 261 - DNA, 694 bp, Neisseria meningitidis
  misc_feature (78)..(104): n is a, c, g, or t
  misc_feature (113)..(113): n is a, c, g, or t
atgaaacaatccgcccgaataaaaatatgaatcagacattactttatacattgggcatttgcgcgcttttaacctttnnnnnnnnnnnnnnnnnnnnnnnnnnntatcacccngaatatgaatacggctaccgttattctgccgtgggtgctttggcttcggttgtatttttattattattggcacgcggtttcccgcgcgtttcttcagttgttttactgatttacgtcggcacaaccgccctatatttgccggtcggctggctgtatggtgcgccgtcttatcagatagtcggttcgatattggaaagcaatcctgccgaggcgcgtgaatttgtcggcaatcttcccgggtcgctttattttgtgcaggcattatttttcatttttggcttgacagtttggaaatattgtgtatcggggggggtatttgctgacgtaaaaaactataaacgccgcagcaaaatatggctgactatattattgactttgattttgtcctgcgcggtgatggataaaatcgccagcgataaagatttgcgagaacctgatgccggcctgttgttgaatattttcgacctgtattacgatttggcttccgcgccggcacaatatgccgccaagcgcgcccacattttggaagcagcaaaaaaagcgtcaacatggcatatccgtcatgttgcgcccaagtataa

SEQ ID NO: 262 - protein, 231 aa, Neisseria meningitidis
  misc_feature (9)..(9): Xaa can be any naturally occurring amino acid
  misc_feature (27)..(35): Xaa can be any naturally occurring amino acid
  misc_feature (200)..(200): Xaa can be any naturally occurring amino acid
MKQSARIKXMNQTLLYTLGICALLTFXXXXXXXXXYHPEYEYGYRYSAVGALASVVFLLLLARGFPRVSSVVLLIYVGTTALYLPVGWLYGAPSYQIVGSILESNPAEAREFVGNLPGSLYFVQALFFIFGLTVWKYCVSGGVFADVKNYKRRSKIWLTILLTLILSCAVMDKIASDKDLREPDAGLLLNIFDLYYDLAXRAGTICRQARPHFGSSKKSVNMAYPSCCAQV

SEQ ID NO: 263 - DNA, 695 bp, Neisseria meningitidis
atgaaacaatccgcccgaataaaaaatatggatcagacattaaaaaatacattgggcatttgcgcgcttttagccttttgttttggcgcggccatcgcatcaggttatcacttggaatatgaatacggctaccgttattctgccgtgggtgctttggcttcggttgtatttttattattattggcacgcggtttcccgcgcgtttcttcagttgttttactgatttacgtcggcacaaccgccctatatttgccggtcggctggctgtatggtgcgccgtcttatcagatagtcggttcgatattggaaagcaatcctgccgaggcgcgtgaatttgtcggcaatcttcccgggtcgctttattttgtgcaggcattatttttcatttttggcttgacagtttggagatattgtgtatcggggggggtatttgctgacgtaaaaaactataaacgccgcagcaaaatatggctgactatattattgactttgattttgtcctgcgcggtgatggataaaatcgccagcgataaagatttgcgagaacctgatgccggcctgttgttgaatattttcgacctgtattacgatttggcttccgcgccggcacaatatgccgccaagcgcgcccacattttggaagcagcaaaaaaagcgtcaacatggcatatccgtcatgttgcgcccaagtataa

SEQ ID NO: 264 - protein, 231 aa, Neisseria meningitidis
  misc_feature (201)..(201): Xaa can be any naturally occurring amino acid
MKQSARIKNMDQTLKNTLGICALLAFCFGAAIASGYHLEYEYGYRYSAVGALASVVFLLLLARGFPRVSSVVLLIYVGTTALYLPVGWLYGAPSYQIVGSILESNPAEAREFVGNLPGSLYFVQALFFIFGLTVWRYCVSGGVFADVKNYKRRSKIWLTILLTLILSCAVMDKIASDKDLREPDAGLLLNIFDLYYDLASXAGTICRQARPHFGSSKKSVNMAYPSCCAQV

SEQ ID NO: 265 - DNA, 285 bp, Neisseria gonorrhoeae
atgggcaaagggcaggacttcacgcccctgcgcgacgcgttgaaagataaggcaaaaggcgtgttcctgatcggcgtcgatgcgccgcaaatccgccgcgatttggacggctgcggcttgaacctgaccgactgcgtcactttggaagaggcggttcagacggcatacgcccaagccgaagcgggcgatattgtcttgctcagccccgcctgcgcgagtttcgatatgtttaaaggctacgcgcaccgttcggaagtgtttatcgaagcgtttaaggctttgtga

SEQ ID NO: 266 - protein, 94 aa, Neisseria gonorrhoeae
MGKGQDFTPLRDALKDKAKGVFLIGVDAPQIRRDLDGCGLNLTDCVTLEEAVQTAYAQAEAGDIVLLSPACASFDMFKGYAHRSEVFIEAFKAL

SEQ ID NO: 267 - DNA, 285 bp, Neisseria meningitidis
atgggtaaagggcaggacttcacgcccctgcgcgatgcactggtaggcaaggcaaaaggcgtgttcttgattggtgtcgatgcgccgcaaatccgccgcgatttggacggctgcggcttgaatatgaccgactgcgccactttgggagaagccgttcagacggcatatgcccaagccgaagcaggcgatattgtgttgctcagccccgcctgcgcgagctttgatatgttcaaaggctacgcgcaccgttcggaagtgtttatcgaagcgtttaaggctttgtga

SEQ ID NO: 268 - protein, 94 aa, Neisseria meningitidis
MGKGQDFTPLRDALVGKAKGVFLIGVDAPQIRRDLDGCGLNMTDCATLGEAVQTAYAQAEAGDIVLLSPACASFDMFKGYAHRSEVFIEAFKAL

SEQ ID NO: 269 - DNA, 285 bp, Neillia sinensis
atgggcaaagggcaggacttcacgcccctgcgcgacgcgcttgccggcaaggcaaaaggcgtgttcctgatcggtgtcgatgcgccgcaaatccgccgcgatttggacggctgcgatctgaatatgaccgactgcgccactttggaagaagcggttcagaaggcatatgcccaagccgaagcgggcgatatcgtgctgctcagccccgcctgcgcgagtttcgatatgtttaaaggctacgcgcaccgttcggaagtgtttatcggggcgtttaaggctttgtga

SEQ ID NO: 270 - protein, 94 aa, Neisseria meningitidis
MGKGQDFTPLRDALAGKAKGVFLIGVDAPQIRRDLDGCDLNMTDCATLEEAVQKAYAQAEAGDIVLLSPACASFDMFKGYAHRSEVFIGAFKAL

SEQ ID NO: 271 - DNA, 1192 bp, Neisseria gonorrhoeae
atggtggtgctgatgacggcgttcggcctgctgatgatttattcggcttctgtgtatttggcatcgaaggaaggcggcgatcagtttttctatttgaccaggcaggcggggttcgtcgttgccggccttatagcgagcggttttttatggtttctttgcaggatgaggacatggcggcggcttgtgccgtggatttttgccttatccggcctgttgctggtagccgtattgattgccgggcgcgaaatcaatggcgcgacccgttggatacctttgggtccgttgaatttccagccgaccgagctgttcaagctggcagtcatcctttatttggcaagcctgttcacgcgccgtgaagaagtgttgcgcagcatggaaagtttgggttggcagtcgatttggcgggggacggccaacctgattatgtccgccaccaatccgcaggcacgtcgtgaaacattagaaatgtacggccgtttccgggcgatcatcctgccgattatgctggtggcgttcggtttggtgctgataatggtacagccggatttcggttcgtttgtcgtcattaccgtcattaccgttggaatgctgtttctggcaggattgccgtggaaatatttttttgtcctggtaggcagcgtcttgggtgggatggtgctgatgattaccgccgctccctaccgtgtgcagcgggtagtggcatttttggacccgtggaaagacccgcagggtgccggctaccagcttacccactctctgatggcaatcgggcgcggagagtggttcggtatgggtttgggtgcgagtttgagcaaacgcggctttctgccggaagcgcataccgattttatttttgccatcatcgctgaagaattcggcttcttcgggatgtgcgtgctgatattctgttacggctggctggtggtgcgggcgttttccatcggcaagcagtcgcgcgatttgggtttgactttcaacgcctatatcgcttcgggtatcggcatttggatcggtatccaaagtttcttcaatatcggtgtgaacatcggtgctttgccgaccaaaggtctgacgctgccgttgatgtcctatggcggttcgtcagtctttttcatgctgatcagcatgatgctgctgttgcgtatcgattatgaaaaccgccagaaaatgcgcggttaccgggtggagtaaa

SEQ ID NO: 272 - protein, 396 aa, Neisseria gonorrhoeae
MVVLMTAFGLLMIYSASVYLASKEGGDQFFYLTRQAGFVVAGLIASGFLWFLCRMRTWRRLVPWIFALSGLLLVAVLIAGREINGATRWIPLGPLNFQPTELFKLAVILYLASLFTRREEVLRSMESLGWQSIWRGTANLIMSATNPQARRETLEMYGRFRAIILPIMLVAFGLVLIMVQPDFGSFVVITVITVGMLFLAGLPWKYFFVLVGSVLGGMVLMITAAPYRVQRVVAFLDPWKDPQGAGYQLTHSLMAIGRGEWFGMGLGASLSKRGFLPEAHTDFIFAIIAEEFGFFGMCVLIFCYGWLVVRAFSIGKQSRDLGLTFNAYIASGIGIWIGIQSFFNIGVNIGALPTKGLTLPLMSYGGSSVFFMLISMMLLLRIDYENRQKMRGYRVE

SEQ ID NO: 273 - DNA, 1190 bp, Neisseria meningitidis
atggtggtgctgatgacggcgttcagcctgctgatgatttattcggcttctgtgtatttggcatcaaaagaaggcggcgatcagtttttctatttgaccagacaggcggggttcgtcgttgccggcttgatagcgagcggtttgttatggtttctttgcaggatgaggacatggcggcggcttgtgccgtggatttttgccctatccggcctgttgctggtagtcgtattgattgccgggcgcgaaatcaatggcgcgacccgttggatacctttgggtccgttgaatttccagccgaccgagctgttcaagctggcggtcatcctttatttggcaagcctgttcacgcgccgtgaagaagtgttgcgcagcatggaaagtttgggttggcagtcgatttggcgggggacggccaatctgatcatgtccgccaccaatccgcagrcacgtcgtgaaacattagaaatgtacggccgtwtccgggcgatcatcctgccgattatgctggtggcgttcggtttggtgctgataatggtacagccggatttcggttcgtttgtcgtcattaccgtcattgccgttggaatgctgtttttggcaggattgccgtggaaatattttttcgtcctggtaggcagcgtcttgggcgggatggtgctgatgattaccgccgctccctaccgtgtgcagcgggtagtggcatttttggacccgtggaaagacccgcagggtgccggctaccagcttacccactctctgatggcaatcgggcgcggagagtggttcggtatgggtttgggtgcgagtttgagcaaacgcggctttctgccggaagcgcataccgattttatttttgccatcatcgccgaagaattcggtttcttcggtatgtgcgtgctgatattctgttacggctggctggtggtgcgggcgttttccatcggcaagcagtcgcgcgatttgggtttgactttcaacgcctatatcgcttcgggtatcggcatttggatcggkrtccaaagtttcttcaatatcggtgtgaacatcggtgctttgccgamcaaaggyctgacgcygccgtgatgtccwatggcggttcgtcagtctttttcatgctgatcagcatgatgctgctgtkgcgtatagattatgaaaaccgccggaaaatgcgcggttatcgggtggagtaa

SEQ ID NO: 274 - protein, 396 aa, Neisseria meningitidis
  misc_feature (149)..(149): Xaa can be any naturally occurring amino acid
  misc_feature (160)..(160): Xaa can be any naturally occurring amino acid
  misc_feature (339)..(339): Xaa can be any naturally occurring amino acid
  misc_feature (354)..(354): Xaa can be any naturally occurring amino acid
  misc_feature (359)..(359): Xaa can be any naturally occurring amino acid
  misc_feature (361)..(361): Xaa can be any naturally occurring amino acid
  misc_feature (364)..(364): Xaa can be any naturally occurring amino acid
  misc_feature (380)..(380): Xaa can be any naturally occurring amino acid
MVVLMTAFSLLMIYSASVYLASKEGGDQFFYLTRQAGFVVAGLIASGLLWFLCRMRTWRRLVPWIFALSGLLLVVVLIAGREINGATRWIPLGPLNFQPTELFKLAVILYLASLFTRREEVLRSMESLGWQSIWRGTANLIMSATNPQXRRETLEMYGRXRAIILPIMLVAFGLVLIMVQPDFGSFVVITVIAVGMLFLAGLPWKYFFVLVGSVLGGMVLMITAAPYRVQRVVAFLDPWKDPQGAGYQLTHSLMAIGRGEWFGMGLGASLSKRGFLPEAHTDFIFAIIAEEFGFFGMCVLIFCYGWLVVRAFSIGKQSRDLGLTFNAYIASGIGIWIGXQSFFNIGVNIGALPXKGLTXPXMSXGGSSVFFMLISMMLLXRIDYENRRKMRGYRVE

SEQ ID NO: 275 - DNA, 1191 bp, Neisseria meningitidis
atggtggtgctgatgacggcgttcagcctgctgatgatttattcggcttctgtgtatttggcatcaaaagaaggcggcgatcagtttttctatttgaccagacaggcggggttcgtcgttgccggcttgatagcgagcggtttgttatggtttctttgcaggatgaggacatggcggcggcttgtgccgtggatttttgccctatccggcctgttgctggtagtcgtattgattgccgggcgcgaaatcaatggcgcgacccgttggatacctttgggtccgttgaatttccagccgaccgagctgttcaagctggcggtcatcctttatttggcaagcctgttcacgcgccgtgaagaagtgttgcgcagcatggaaagtttgggttggcagtcgatttggcgggggacggccaatctgatcatgtccgccaccaatccgcaggcacgtcgtgaaacattagaaatgtacggccgtttccgggcgatcatcctgccgattatgctggtggcgttcggtttggtgctgataatggtacagccggatttcggttcgtttgtcgtcattaccgtcattgccgttggaatgctgtttttggcaggattgccgtggaaatattttttcgtcctggtaggcagcgtcttgggcgggatggtgctgatgattaccgccgctccctaccgtgtgcagcgggtagtggcatttttggacccgtggaaagacccgcagggtgccggctaccagcttacccactctctgatggcaatcgggcgcggagagtggttcggtatgggtttgggtgcgagtttgagcaaacgcggctttctgccggaagcgcataccgattttatttttgccatcatcgccgaagaattcggtttcttcggtatgtgcgtgctgatattctgttacggctggctggtggtgcgggcgttttccatcggcaagcagtcgcgcgatttgggtttgactttcaacgcctatatcgcttcgggtatcggcatttggatcggtatccaaagtttcttcaatatcggtgtgaacatcggtgctttgccgaccaaaggtctgacgctgccgttgatgtcctatggcggttcgtcagtctttttcatgctgatcagcatgatgctgctgttgcgtatagattatgaaaaccgccggaaaatgcgcggttaccgggtggagtaa

SEQ ID NO: 276 - protein, 396 aa, Neisseria meningitidis
MVVLMTAFSLLMIYSASVYLASKEGGDQFFYLTRQAGFVVAGLIASGLLWFLCRMRTWRRLVPWIFALSGLLLVVVLIAGREINGATRWIPLGPLNFQPTELFKLAVILYLASLFTRREEVLRSMESLGWQSIWRGTANLIMSATNPQARRETLEMYGRFRAIILPIMLVAFGLVLIMVQPDFGSFVVITVIAVGMLFLAGLPWKYFFVLVGSVLGGMVLMITAAPYRVQRVVAFLDPWKDPQGAGYQLTHSLMAIGRGEWFGMGLGASLSKRGFLPEAHTDFIFAIIAEEFGFFGMCVLIFCYGWLVVRAFSIGKQSRDLGLTFNAYIASGIGIWIGIQSFFNIGVNIGALPTKGLTLPLMSYGGSSVFFMLISMMLLLRIDYENRRKMRGYRVE

SEQ ID NO: 277 - DNA, 1069 bp, Neisseria gonorrhoeae
atgggcggtaaaacctttatgctgatggcgggcggaacgggcggacacattttcccagctctggctgtggcggattcattgcgcgtgcgcggtcatcatgtaatttggctgggcagcaaggattcgatggaagagcgcatcgtgccgcaatacggcatacgcttggaaacgctggcgattaaaggaatacgcggcaacggcatcaaacgcaagctgatgcttccgtttactctgtacaaaaccgtccgcgaagcgcagcggattatccgcaaacaccgtgtcgagtgcgtcatcggcttcggcggttttgttacctttcccggcggtctggcggcgaaactcttgggcgtgccgattgtgattcacgagcaaaacgccgtggcaggcttgtccaaccgccacctgtcgcgctgggcgaaacgggtgttgtacgcttttccgaaagcgttcagccacgaaggcggtttggtcggcaaccccgtccgcgccgatattagcaacctgcccgtgcctgccgaacgcttccaagggcgcgaaggccgtctgaaaattttggtggtcggcggcagtttgggtgcggacgttttgaacaaaaccgtaccgcaggcgttggcactgctgcctgaagaggtgcgcccgcagatgtaccaccagtcggggcgtaacaagctgggcaatcttcaggcggattatgacgcgttgggcgtgaaagcggaatgcgtggaatttattaccgacatggtgtccgcctaccgtgatgccgatttggtgatttgccgtgccggcgcgctgacgattgccgagttgacggcggcggggctgggcgcgttgttagtgccgtatcctcacgccgttgatgaccatcaaaccgccaacgcgcgtttcatggtgcaggcagaagcggggctgctgttgccgcaaacccagttgacggcggaaaaactcgccgaaatcctcggcagcctcaaccgcgaaaaatgcctcaaatgggcggaaaacgcccgtacgttggcattgccgcacagcgcggatgacgttgccgaagccgcgattgcgtgtgcggcgtaaa

SEQ ID NO: 278 - protein, 355 aa, Neisseria gonorrhoeae
MGGKTFMLMAGGTGGHIFPALAVADSLRVRGHHVIWLGSKDSMEERIVPQYGIRLETLAIKGIRGNGIKRKLMLPFTLYKTVREAQRIIRKHRVECVIGFGGFVTFPGGLAAKLLGVPIVIHEQNAVAGLSNRHLSRWAKRVLYAFPKAFSHEGGLVGNPVRADISNLPVPAERFQGREGRLKILVVGGSLGADVLNKTVPQALALLPEEVRPQMYHQSGRNKLGNLQADYDALGVKAECVEFITDMVSAYRDADLVICRAGALTIAELTAAGLGALLVPYPHAVDDHQTANARFMVQAEAGLLLPQTQLTAEKLAEILGSLNREKCLKWAENARTLALPHSADDVAEAAIACAA

SEQ ID NO: 279 - DNA, 1008 bp, Neisseria meningitidis
  misc_feature (688)..(753): n is a, c, g, or t
atgggcggtaaaacctttatgctgawkkcgggcggaacgggcggacatattttccccgcgctggcggtggcggattcattgcgcgcgcgcggccatcatgtgatttggctgggcagcaaggattcgatggaagagcgtatcgtgccgcaatacggcatacgcttggaaacgctggcgattaaaggcgtgcgcggcaacggcatcaaacgcaaactgatgctgccggttactttgtatcaaaccgtccgcgaagcgcagcggattatccgcaaacaccgtgtcgagtgcgtcatcggcttcggcggcttcgttaccttccccggcggtttggcggcgaagctattargcgtgccgattgtgattcacgagcaaaacgccgtggcaggtttgtccaaccgccacctgtcgcgctgggcgaagcgggtgttgtacgcttttccgaaagcgttcagccacgaaggcggcttggtcggcaaccccgtccgcgccgatattagcaacctgcccgtgcctgccgaacgcttccaagggcgtgaaggccgtctgaaaattttggtggtcggcggcagtttgggcgcggacgttttgaacaaaaccgtaccgcatgcattggctttgctgcccgacaatgcgcgtccgcatatgtaccaccaatcgggacggggcaagctgggcatcttgcaggcgnnnnnnnnnnnnnnnnnnnnnnnnnnnnnnnnnnnnnnnnnnnnnnnnnnnnnnnnnnnnnnnnnngcgggattgggtgcgttgttagtgccgtatcctcacgcggttgacgatcaccaaaccgccaacgcgcgttttatggtgcaggcggaggcgggattgctgttgccgcaaacccagttgacggcggaaaaactcgccgagattctcggcggcttaaaccgcgaaaaatgcctcaaatgggcagaaaacgcccgtacgttggcactgccgcacagtgcggacgacgtggcggaagccgcgattgcgtgtgcggcgtaa

SEQ ID NO: 280 - protein, 335 aa, Neisseria meningitidis
  misc_feature (9)..(10): Xaa can be any naturally occurring amino acid
  misc_feature (116)..(116): Xaa can be any naturally occurring amino acid
  misc_feature (230)..(251): Xaa can be any naturally occurring amino acid
MGGKTFMLXXGGTGGHIFPALAVADSLRARGHHVIWLGSKDSMEERIVPQYGIRLETLAIKGVRGNGIKRKLMLPVTLYQTVREAQRIIRKHRVECVIGFGGFVTFPGGLAAKLLXVPIVIHEQNAVAGLSNRHLSRWAKRVLYAFPKAFSHEGGLVGNPVRADISNLPVPAERFQGREGRLKILVVGGSLGADVLNKTVPHALALLPDNARPHMYHQSGRGKLGILQAXXXXXXXXXXXXXXXXXXXXXXAGLGALLVPYPHAVDDHQTANARFMVQAEAGLLLPQTQLTAEKLAEILGGLNREKCLKWAENARTLALPHSADDVAEAAIACAA

SEQ ID NO: 281 - DNA, 1068 bp, Neisseria meningitidis
atgggcggtaaaacctttatgctgatggcgggcggaacgggcggacatattttccccgcgctggcggtggcggattcattgcgcgcgcgcggccatcatgtaatttggctgggcagcaaggattcgatggaagagcgcatcgtgccgcaatacgacatcctgctcgaaacgctggcgattaaaggcgtgcgcggcaacggcatcaaacgcaagctgatgctgccgtttactttgtatcaaactgtccgcgaagcgcagcagattatccgcaaacaccgtgtcgagtgcgtcatcggcttcggcggcttcgttacctttcccggcggtttggcggcgaagttattaggcgtgccgattgtgattcacgagcaaaacgccgtggcaggtttgtccaaccgccacctgtcgcgctgggcgaagcgggtgttgtacgcttttccgaaagcgttcagccacgaaggcggcttggtcggcaaccccgtccgcgccgatattagcaacctgcccgtgcctgccgaacgcttccaagggcgtgaaggccgtctgaaaattttggtggtcggcggcagtttgggcgcggacgttttgaacaaaaccgtaccgcaggcattggctttgctgcccgacaatgcgcgtccgcagatgtaccaccaatcgggacggggcaagctgggcagcttgcaggcggattacgacgcgctgggcgtgcaagcggaatgcgtggaatttattaccgatatggtgtccgcctaccgcgatgccgatttggtgatttgccgtgccggcgcgctgacgattgccgagttgacggcggcgggattgggtgcgttgttagtgccgtatcctcacgccgttgatgaccatcaaaccgccaacgcgcgttttatggtgcaggcggaggcgggattgctgttgccgcaaacccagttgacggcggaaaaactcgccgagattctcggcggcttaaaccgcgaaaaatgcctcaaatgggcagaaaacgcccgtacgttggcactgccgcacagtgcggacgacgttgccgaagccgcgattgcgtgtgcggcgtaa

SEQ ID NO: 282 - protein, 355 aa, Neisseria meningitidis
MGGKTFMLMAGGTGGHIFPALAVADSLRARGHHVIWLGSKDSMEERIVPQYDILLETLAIKGVRGNGIKRKLMLPFTLYQTVREAQQIIRKHRVECVIGFGGFVTFPGGLAAKLLGVPIVIHEQNAVAGLSNRHLSRWAKRVLYAFPKAFSHEGGLVGNPVRADISNLPVPAERFQGREGRLKILVVGGSLGADVLNKTVPQALALLPDNARPQMYHQSGRGKLGSLQADYDALGVQAECVEFITDMVSAYRDADLVICRAGALTIAELTAAGLGALLVPYPHAVDDHQTANARFMVQAEAGLLLPQTQLTAEKLAEILGGLNREKCLKWAENARTLALPHSADDVAEAAIACAA

SEQ ID NO: 283 - DNA, 1131 bp, Neisseria gonorrhoeae
atgtttttatggctcgcacatttcagcaactggttaaccggtctgaatatttttcaatacaccacattccgcgccgttatggcggcgttgaccgccttggcgttttccctgatgttcggcccgtggacgatacgcaggctgaccgcgctcaaatgcgggcaggcagtgcgtaccgacggcccgcaaacccacctcgtcaaaaacggcacgccgacgatgggcggttcgctgattctgaccgccattaccgtgtccaccctgttgtggggcaactgggcgaacccgtatatctggattctcttgggcgtactgcttgccaccggtgcgctcggtttttacgacgactggcgcaaagtcgtttataaagaccccaacggcgtgtccgccaaattcaaaatggtgtggcagtcaagcgttgccgttatcgccggtttggcattgttttaccttgccgccaattccgccaacaatattttgattgtcccgtttttcaaacaaatcgccctgccgctgggcgtggtcggctttttggtgttgtcttacctgaccatcgtcggcacatccaacgccgtcaacctcaccgacggcttggacggccttgccgccttcccgttcgtcctcgttgccgccgggctcgccattttcgcctacgtcagcggacactaccaattttcccaatacctccagcttccctatgtcgccggcgcgaacgaagtcgctatattctgcaccgccatgtgcggcgcgtgcctcggatttttgtggttcaacgcctatcccgcgcaagtctttatgggcgatgtcggcgcgctggcattgggtgccgcgctcggtaccgttgccgtcatcgtccgccaagaatttgtcctcgtcattatgggcggtctgttcgtcgtagaagccgtgtccgttatgcttcatgtcggctggtacaagaaaaccaaaaaacgcatcttcctgacggcaccgattcatcaccattaccaacttcgatgctggaaagaaacgcaagtcgtcgtccgtttctggattattaccatcgtcgtggttttgataggtttgagtaccctcaaaattcgcggaaactatgccgtccgaacacctttcagacggcatttgaacgcgcaataa

SEQ ID NO: 284 - protein, 376 aa, Neisseria gonorrhoeae
MFLWLAHFSNWLTGLNIFQYTTFRAVMAALTALAFSLMFGPWTIRRLTALKCGQAVRTDGPQTHLVKNGTPTMGGSLILTAITVSTLLWGNWANPYIWILLGVLLATGALGFYDDWRKVVYKDPNGVSAKFKMVWQSSVAVIAGLALFYLAANSANNILIVPFFKQIALPLGVVGFLVLSYLTIVGTSNAVNLTDGLDGLAAFPFVLVAAGLAIFAYVSGHYQFSQYLQLPYVAGANEVAIFCTAMCGACLGFLWFNAYPAQVFMGDVGALALGAALGTVAVIVRQEFVLVIMGGLFVVEAVSVMLHVGWYKKTKKRIFLTAPIHHHYQLRCWKETQVVVRFWIITIVVVLIGLSTLKIRGNYAVRTPFRRHLNAQ

SEQ ID NO: 285 - DNA, 1131 bp, Neisseria meningitidis
  misc_feature (29)..(29): n is a, c, g, or t
  misc_feature (49)..(513): n is a, c, g, or t
atgtttttatggctcgcacatttcagcanctggttaaccggtctgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgtggtcggctttttggtgttgtcttacctgaccatcgtcggcacatccaatgccgtcaacctcaccgacggcttggacggccttgcgaccttccccgtcgtcctcgttgccgccggcctcgccatcttcgcctatgccagcggccactcacaatttgcccaatacctgcaattaccttacgttgccggcgcaaacgaagtggtgattttctgtaccgccatgtgcggcgcgtgcctcggtttcttgtggtttaacgcctatcccgcgcaagtctttatgggcgatgtcggtgcattggcattgggtgccgcgctcggtaccgtcgccgttatcgtccgccaagagtttgtcctcgtcattatgggcggattatttgtcgtagaagccgtatccgttatgcttcaggttggctggtataagaaaaccaaaaaacgcatcttcctgatggcgcccatccatcaccactacgaacaaaaaggctggaaagaaacccaagtcgtcgtccgcttttggattattaccatcgtcttggtgttgatcggtttgagtaccctcaaaatccgctgaacctatgccgtctgaacatctttcagacggcatttgaacgcgcaataa

SEQ ID NO: 286 - protein, 376 aa, Neisseria meningitidis
  misc_feature (361)..(361): Xaa can be any naturally occurring amino acid
  misc_feature (366)..(366): Xaa can be any naturally occurring amino acid
MFLWLAHFSNWLTGLNIFQYTTFRAVMAALTALAFSLMFGPWTIRRLTALKCGQAVRTDGPQTHLVKNGTPTMGGSLILTAITVSTLLWGNWANPYIWILLGVLLATGALGFYDDWRKVVYKDPNGVSAKFKMVWQSSVAVIAGLALFYLAANSANNILIVPFFKQIALPLGVVGFLVLSYLTIVGTSNAVNLTDGLDGLATFPVVLVAAGLAIFAYASGHSQFAQYLQLPYVAGANEVVIFCTAMCGACLGFLWFNAYPAQVFMGDVGALALGAALGTVAVIVRQEFVLVIMGGLFVVEAVSVMLQVGWYKKTKKRIFLMAPIHHHYEQKGWKETQVVVRFWIITIVLVLIGLSTLKIRXTYAVXTSFRRHLNAQ

SEQ ID NO: 287 - DNA, 1131 bp, Neisseria meningitidis
atgtttttatggctcgcacatttcagcaactggttaaccggtctgaatatttttcaatacaccacattccgcgccgtcatggcggcgttgaccgccttggcgttttccctgatgttcggcccgtggacgatacgcaggctgaccgcgctcaaatgcgggcaggcagtgcgtaccgacggtccgcaaacccacctcgtcaaaaacggcacgccgacgatgggcggttcgctgattctgaccgccattaccgtgtccaccctgttgtggggcaactgggcaaacccgtatatctggattctcttgggcgtattgctcgccacgggcgcactcggtttttacgacgactggcgcaaagtcgtctataaagaccccaacggcgtgtccgccaaattcaaaatggtgtggcagtcaagcgttgccattatcgccggtttggcattgttttaccttgccgccaattccgccaacaatattttgattgtcccgttcttcaaacaaatcgccctgccgctgggcgtggtcggctttttggtgttgtcttacctgaccatcgtcggcacatccaatgccgtcaacctcaccgacggcttggacggccttgcgaccttccccgtcgtcctcgttgccgccggcctcgccatcttcgcctatgccagcggccactcacaatttgcccaatacctgcaattaccttacgttgccggcgcaaacgaagtggtgattttctgtaccgccatgtgcggcgcgtgcctcggtttcttgtggtttaacgcctatcccgcgcaagtctttatgggcgatgtcggtgcattggcattgggtgccgcgctcggtaccgtcgccgtcatcgtccgccaagagtttgtcctcgtcattatgggcggattatttgtcgtagaagccgtatccgttatgcttcaggtcggctggtataagaaaaccaaaaaacgcatcttcctgatggcgcccatccatcaccactacgaacaaaaaggctggaaagaaacccaagtcgtcgtccgcttttggattattaccatcgtcttggtgttgatcggtttgagtaccctcaaaatccgctgaacctatgccgtctgaacacctttcagacggcatttgaacgcgcaataa

SEQ ID NO: 288 - protein, 374 aa, Neisseria meningitidis
MFLWLAHFSNWLTGLNIFQYTTFRAVMAALTALAFSLMFGPWTIRRLTALKCGQAVRTDGPQTHLVKNGTPTMGGSLILTAITVSTLLWGNWANPYIWILLGVLLATGALGFYDDWRKVVYKDPNGVSAKFKMVWQSSVAIIAGLALFYLAANSANNILIVPFFKQIALPLGVVGFLVLSYLTIVGTSNAVNLTDGLDGLATFPVVLVAAGLAIFAYASGHSQFAQYLQLPYVAGANEVVIFCTAMCGACLGFLWFNAYPAQVFMGDVGALALGAALGTVAVIVRQEFVLVIMGGLFVVEAVSVMLQVGWYKKTKKRIFLMAPIHHHYEQKGWKETQVVVRFWIITIVLVLIGLSTLKIRTYAVTPFRRHLNAQ

SEQ ID NO: 289 - DNA, 450 bp, Neisseria gonorrhoeae
atgccgcccaaaatcacgaagagcgggttttgcaaaccggcaatcgcggcggcggtcgcgccgacattcgtgcctttgctgtcgtcgatgaataccacgccgtttttctcgccgattttttccacacggtgcggcaagccttggaaggttttgacgtgttccagcaatgcttcgcgcggcaaaccgacggcctcgcacaaagccacggcagccataacgttggcggcgttgtgcaaaccttgcagcgggatgtcttgcgtagaaatcaaatcttcattgccttgttttaaacagcccgtcccgcgttccaaccaaaaatcggcttcgtgttccaaggaaaaccgtttcacttcacgccctgcccgtttcatggcgcggcagaacacgtcgtccgcattcaaaacctgcactccatcgccacggaaaatctcggctttggtatgcgcgtag

SEQ ID NO: 290 - protein, 149 aa, Neisseria gonorrhoeae
MPPKITKSGFCKPAIAAAVAPTFVPLLSSMNTTPFFSPIFSTRCGKPWKVLTCSSNASRGKPTASHKATAAITLAALCKPCSGMSCVEIKSSLPCFKQPVPRSNQKSASCSKENRFTSRPARFMARQNTSSAFKTCTPSPRKISALVCA

SEQ ID NO: 291 - DNA, 450 bp, Neisseria meningitidis
atgccgcccaaaatcackawgagcggattttgcaaaccggcaatcgcggcggcagtcgcgccgacattcgtgcctttgctgtcgtcgataaacaccacgccgtttttctcgccgattttttccacgcggtgcggcaggccttggaaggttttgacgtgttcgagcaatgcttcgcgcgacaaaccgatggcctcacacaaagccackgcagccatgacgttagcggcgttgtgcakaccttgcaacggwatgtcttgcgtgacaatcaaatcttcattgccttgtttcaggcggcctgtctcgcgttccaaccagaaatcagcttcgtgttccaacgaaaaccattttacctcgcgcccggcacgcttcatcgcgcggcagaacgcatcgtccgcattcaaaacctgcacgccgtcgccacggaaaatcttggctttggtatgcgcatag

SEQ ID NO: 292 - protein, 149 aa, Neisseria meningitidis
  misc_feature (7)..(7): Xaa can be any naturally occurring amino acid
  misc_feature (79)..(79): Xaa can be any naturally occurring amino acid
MPPKITXSGFCKPAIAAAVAPTFVPLLSSINTTPFFSPIFSTRCGRPWKVLTCSSNASRDKPMASHKATAAMTLAALCXPCNGMSCVTIKSSLPCFRRPVSRSNQKSASCSNENHFTSRPARFIARQNASSAFKTCTPSPRKILALVCA

SEQ ID NO: 293 - DNA, 450 bp, Neisseria meningitidis
atgccgcctaaaatcacgaagagcggattttgcaaaccggcaatcgcggcggcggtcgcaccgacgttcgtgcctttgctgtcgtcgatgaacaccacgccatttttctcgccgattttttccacgcggtgcggcaggccttgaaaggttttgacgtgttcgagcaatgcttcgcgcggcaaaccgacggcttcgcacaaggcaacggcagccatcacgttagtggcgttgtgcaagccttgcagcggaatatcttgcgtggcaatcaaatcttcattgccttgtttcaggcgacctgtctcacgttccaaccaaaaatcggcttcgtattccaacgaaaaccatttcacctcgcgcccggcgcgcttcatcgcacgacagaacgcatcgtccgcattcaaaacctgcacaccgtcgccacggaaaatcttggctttggtatgcgcgtag

SEQ ID NO: 294 - protein, 148 aa, Neisseria meningitidis
MPPKITKSGFCKPAIAAAVAPTFVPLLSSMNTTPFFSPIFSTRCGRPKVLTCSSNASRGKPTASHKATAAITLVALCKPCSGISCVAIKSSLPCFRRPVSRSNQKSASYSNENHFTSRPARFIARQNASSAFKTCTPSPRKILALVCA

SEQ ID NO: 295 - DNA, 356 bp, Neisseria gonorrhoeae
atgcgcgtagtcgagcaaatcgtcgtagcggtcgagatggtcttcggaaatgttcatcaccgtcgccgcagtcgggcgcaggctttcggtgttttccagttggaagctggaaagctcccacacccacacgtccgcctttttgccttcgcgctgcaattctgcctccaagacgggcgtaccgatattgcccgcaatgacggtatccagcccgcacttgatgcagagatagcggaccaggctggttaccgtggttttgccgttgctgccggtaatcgcaatcaccttgtcgccgcggcggttcacaatgtccgccagcaattggatgtcgcctagcacgcgcccgccgttttgcttga

SEQ ID NO: 296 - protein, 118 aa, Neisseria gonorrhoeae
  misc_feature (111)..(111): Xaa can be any naturally occurring amino acid
  misc_feature (114)..(114): Xaa can be any naturally occurring amino acid
MRVVEQIVVAVEMVFGNVHHRRRSRAQAFGVFQLEAGKLPHPHVRLFAFALQFCLQDGRTDIARNDGIQPALDAEIADQAGYRGFAVAAGNRNHLVAAAVHNVRQQLDVAXHAXRRFA

SEQ ID NO: 297 - DNA, 356 bp, Neisseria meningitidis
atgcgcatagtcgagcaagtcgtcgtagcggtcgagatggtcttcggaaatgttcagcaccgtcgccgcagtcggacgcaggctttcggtgttttccagttggaagctggaaagctccaacacccacacgtccgcctttttgccttcgcgctgccattccgcctccaaaaccggcgtgccgatattgcccgcgataacggtatccagcccgcacttgatacagagatagccgaccaggctcgttaccgtggttttgccgttgctgccggtaatcgcaattaccttgtcgtcccggcggttcacaatgtccgccagcaattcgatgtcgcccaacacgcgtccgccgttttgcttga

SEQ ID NO: 298 - protein, 118 aa, Neisseria meningitidis
  misc_feature (114)..(114): Xaa can be any naturally occurring amino acid
MRIVEQVVVAVEMVFGNVQHRRRSRTQAFGVFQLEAGKLQHPHVRLFAFALPFRLQNRRADIARDNGIQPALDTEIADQARYRGFAVAAGNRNYLVVPAVHNVRQQFDVAQHAXRRFA

SEQ ID NO: 299 - DNA, 356 bp, Neisseria meningitidis
atgcgcgtagtcgagcaagtcgtcgtagcggtcgagatggtcttcggaaatgttcagcactgtcgccgcagtcgggcgcaggctttcggtgttttccagttggaaactggaaagctccaacacccacacgtccgcctttttgccttcgcgctgcaattccgcctccaaaaccggcgcgccgatattgcccgcgataacggtatccagcccacacttgatgcagagatagccgaccaggctcgttaccgtggttttgccgttgctgccggtaatcgcaatcaccttgtcgccgcggcggttcacaatgtccgccagcaattcgatgtcgcccaacacgcgtccgccgtttcgcttaa

SEQ ID NO: 300 - protein, 118 aa, Neisseria meningitidis
  misc_feature (114)..(114): Xaa can be any naturally occurring amino acid
MRVVEQVVVAVEMVFGNVQHCRRSRAQAFGVFQLETGKLQHPHVRLFAFALQFRLQNRRADIARDNGIQPTLDAEIADQARYRGFAVAAGNRNHLVAAAVHNVRQQFDVAQHAXRRFA

SEQ ID NO: 301 - DNA, 1380 bp, Neisseria meningitidis
atgacggcgtttgcatttcagacggcatcacaaagccttaaacgcttcgataaacacttccgaacggtgcgcgtagcctttgaacatatcaaagctcgcgcaggcggggctgagcaacacaatatcgcctgcttcggcttgggcatatgccgtctgaacggcttctcccaaagtggcgcagtcggtcatattcaagccgcagccgtccaaatcgcggcggatttgcggcgcatcgacaccaatcaagaacacgccttttgccttgcctaccagtgcatcgcgcaggggcgtgaagtcctgccctttacccatgccgcccaaaatcacgaagagcggattttgcaaaccggcaatcgcggcggcagtcgcgccgacattcgtgcctttgctgtcgtcgataaacaccacgccgtttttctcgccgattttttccacgcggtgcggcaggccttggaaggttttgacgtgttcgagcaatgcttcgcgcgacaaaccgatggcctcacacaaagccacggcagccatgacgttagcggcgttgtgcagaccttgcaacggaatgtcttgcgtgacaatcaaatcttcattgccttgtttcaggcggcctgtctcgcgttccaaccagaaatcagcttcgtgttccaacgaaaaccattttacctcgcgcccggcacgcttcatcgcgcggcagaacgcatcgtccgcattcaaaacctgcacgccgtcgccacggaaaatcttggctttggtatgcgcatagtcgagcaagtcgtcgtagcggtcgagatggtcttcggaaatgttcagcaccgtcgccgcagtcggacgcaggctttcggtgttttccagttggaagctggaaagctccaacacccacacgtccgcctttttgccttcgcgctgccattccgcctccaaaaccggcgtgccgatattgcccgcgataacggtatccagcccgcacttgatacagagatagccgaccaggctcgttaccgtggttttgccgttgctgccggtaatcgcaattaccttgtcgtcccggcggttcacaatgtccgccagcaattcgatgtcgcccaacacgcgtccgccgttttgcttgaacgcctcaatatccggctgccgctcgctgatgccgggactgagagccagaatatcgaaaccgttgtccagcgcatctttcagacggcccgtgtaaaacaccaacccgtcaaacatcttaccgatttgcgacacgcgttccggcttcagctccgcatcatacgcagcaacctccgcgccgtttttgcgcaggtaggcaatcatggaaatacccgtaccgccgagtccggcgacgaggatttttttgttttgaaaagtcattttggtttgtcctaa

SEQ ID NO: 302 - protein, 459 aa, Neisseria meningitidis
MTAFAFQTASQSLKRFDKHFRTVRVAFEHIKARAGGAEQHNIACFGLGICRLNGFSQSGAVGHIQAAAVQIAADLRRIDTNQEHAFCLAYQCIAQGREVLPFTHAAQNHEERILQTGNRGGSRADIRAFAVVDKHHAVFLADFFHAVRQALEGFDVFEQCFARQTDGLTQSHGSHDVSGVVQTLQRNVLRDNQIFIALFQAACLAFQPEISFVFQRKPFYLAPGTLHRAAERIVRIQNLHAVATENLGFGMRIVEQVVVAVEMVFGNVQHRRRSRTQAFGVFQLEAGKLQHPHVRLFAFALPFRLQNRRADIARDNGIQPALDTEIADQARYRGFAVAAGNRNYLVVPAVHNVRQQFDVAQHASAVLLERLNIRLPLADAGTESQNIETVVQRIFQTARVKHQPVKHLTDLRHAFRLQLRIIRSNLRAVFAQVGNHGNTRTAESGDEDFFVLKSHFGLS

SEQ ID NO: 303 - DNA, 309 bp, Neisseria gonorrhoeae
atggaaatacccgtgccgccaagtccggcgacgaggatttttttgtttgaaagtcattttggttttgtcctaaaacaaatcatattgggcaggagacgtccgcccttgcccaagccgctttcagacggcatcgcgagccgattaataacccgccttcaggcgttggtcattgtcgcagctgttttggtctccgttttgacaagccttgccaagccattgttgagcgagcgcaaggtcttggcgcacgccgcgtccatcgtaatacatcaagcccaaattgtattgggcttgggcatccccttgttctga

SEQ ID NO: 304 - protein, 102 aa, Neisseria gonorrhoeae
MEIPVPPSPATRIFLFESHFGFVLKQIILGRRRPPLPKPLSDGIASRLITRLQALVIVAAVLVSVLTSLAKPLLSERKVLAHAASIVIHQAQIVLGLGIPLF

SEQ ID NO: 305 - DNA, 306 bp, Neisseria meningitidis
atggaaatacccgtaccgccgagtccggcgacgaggatttttttgtttgaaaagtcattttggtttgtcctaaaacaaatcatattgagcaggagatgtccgcccctgcccaagccgctttcagacggcatcgcgagctgttcaataacccgccttcaggcgttggtcattgtcgcagccgtcttggtctccgttttgacaagccttgccaaaccattcttgtgcaagggcgcggtcttggcgcacgccgcgtctttcggcatacatcacgcccaaattgttttgggcttgggctaccccctgcgc

SEQ ID NO: 306 - protein, 102 aa, Neisseria meningitidis
MEIPVPPSPATRIFLFEKSFWFVLKQIILSRRCPPLPKPLSDGIASCSITRLQALVIVAAVLVSVLTSLAKPFLCKGAVLAHAASFGIHHAQIVLGLGYPLR

SEQ ID NO: 307 - DNA, 288 bp, Neisseria meningitidis
atggaaatacccgtgccgccaagtccggcgacgaggatttttttgttttggaaatcattttggtttgtcctaaaacaaatcatattgagcaggggatgtctgatcctgctcaagccgctttcagacggcatcgcgagctgttcaataacccgctttcaggcgttggtcattgtcgcagctgtcttggtatccgttttgacaagccttgccaagccattcttgtgcaagggcgcggtcttggcgcacgccgcgtctttcggcatacatcacgcccaaattgttttgggc

SEQ ID NO: 308 - protein, 96 aa, Neisseria meningitidis
MEIPVPPSPATRIFLFWKSFWFVLKQIILSRGCLILLKPLSDGIASCSITRFQALVIVAAVLVSVLTSLAKPFLCKGAVLAHAASFGIHHAQIVLG

SEQ ID NO: 309 - DNA, 1521 bp, Neisseria gonorrhoeae
atgttttttatttcaatccgctatatatttgtcagaaaactatggtgcgcaaacggtcagacctttaaaataacgcctttacgcactaaaaaccaaccggaacgcaacattatgatgaaaaatcgagtaagcaacatccattttgtcggtatcggcggcgtcggcatgagcggtatcgccgaagtcttgcacaatttgggctttaaagtttccggttcggatcaggcgcgaaatgccgctaccgagcatttgagcagcctgggcattcaagtttatcccggccataccgcagaacacgttaacggtgcggatgtcgtcgttgcctctaccgccgtcaagaaagaaaatcccgaagttgtcgctgcgttggagcggcaaattcccgttattccgcgcgccttgatgctggcagagctgatgcgcttccgtgacggcatcgccattgccggtacgcacggcaaaaccacgaccaccagcctgaccgcctccatcctcggcgcggcaggactcgaccccactttcgttatcggcggcaaactcaacgccgcaggcaccaacgcccgcttgggcaaaggcgaatacatcgttgccgaagccgacgaatccgatgcctctttcctacatctgaccccgattatgtccgtcgttaccaatatcgacgaagaccatatggatacctacgggcacagcgtcgaaaaactgcatcaggcgtttatcgatttcatccaccgtatgcccttctacggcaaagcctttttgtgtgttgacagcgaacacgtccgcgcgattttgcccaaagtgagcaaaccttatgctacttacggtttggacgataccgccgacatctacgccaccgacatcgaaaacgtcggcgcgcaaatgaaattcaccgtccatgttcaaatgaaaggacatgagcaggggtcgtttgaagtcgtgctgaatatgcccggcagacacaacgtgctgaacgcattggcagccatcggcgtggcgctggaagtcggcgcatcggttgaagcgatccaaaaaggcttgctcggctttgaaggcgtcggccgccgcttccaaaaatacggcgacatcaagttgccaaacggcgggaccgctttgctggtggacgattacggacaccaccccgtcgaaatggcggcaacccttgccgctgcacgcggcgcgtatccggaaaaacgtttggtgctcgccttccagccgcaccgctatacccgcacgcgcgatttgtttgaagactttaccaaagtactcaataccgttgatgcgctggtactgaccgaagtttatgccgccggcgaagagccggttgccgccgccgactcccgcgccttggcgcgtgctatccgcgtattgggcaaacttgagccgatttactgcgaaaatgtcgccgacctgccgcaaatgctgatgaatgttttacaggatggcgatgttgtgttgaatatgggtgcgggaagcatcaaccgcgttccttccgcgctgttggaattgtcgaaacagatttga

SEQ ID NO: 310 - protein, 506 aa, Neisseria gonorrhoeae
MFFISIRYIFVRKLWCANGQTFKITPLRTKNQPERNIMMKNRVSNIHFVGIGGVGMSGIAEVLHNLGFKVSGSDQARNAATEHLSSLGIQVYPGHTAEHVNGADVVVASTAVKKENPEVVAALERQIPVIPRALMLAELMRFRDGIAIAGTHGKTTTTSLTASILGAAGLDPTFVIGGKLNAAGTNARLGKGEYIVAEADESDASFLHLTPIMSVVTNIDEDHMDTYGHSVEKLHQAFIDFIHRMPFYGKAFLCVDSEHVRAILPKVSKPYATYGLDDTADIYATDIENVGAQMKFTVHVQMKGHEQGSFEVVLNMPGRHNVLNALAAIGVALEVGASVEAIQKGLLGFEGVGRRFQKYGDIKLPNGGTALLVDDYGHHPVEMAATLAAARGAYPEKRLVLAFQPHRYTRTRDLFEDFTKVLNTVDALVLTEVYAAGEEPVAAADSRALARAIRVLGKLEPIYCENVADLPQMLMNVLQDGDVVLNMGAGSINRVPSALLELSKQI

SEQ ID NO: 311 - DNA, 1521 bp, Neisseria meningitidis
atgttttttatttcaatccgctatatatttgtcagaaaactatggcgcgcaaacggtcagccctttaaaataacgcctttacgcatcgaaaatccaccggaacgcaacattatgatgaaaaatcgagttaccaacatccattttgtcggtatcggcggcgtcggcatgagcggcatcgccgaagtcttgcacaatttgggctttaaagtttccggttcggatcaggcgcgaaatgccgctaccgagcatttgggcagcctgggcattcaagtttatcccggccataccgccgaacacgttaacggtgcggatgtcgtcgttacctctaccgccgtcaaaaaagaaaatcccgaagttgtcgctgcgttggagcagcaaattcccgttattccgcgcgccctgatgttggcggagttgatgcgcttccgtgacggcatcgccattgccggcacgcacggcaaaaccacgaccaccagcctgaccgcctccatcctcggcgcggcaggacttgacccgactttcgttatcggcggcaaactcaacgccgcaggcactaacgcccgcttgggcaaaggcgaatacatcgttgccgaagccgacgagtcggatgcatcctttctgcacctgacaccgattatgtccgtcgttaccaatatcgacgaagaccatatggatacctacgggcacagcgtcgaaaaactgcatcaggcgtttatcgatttcatccaccgtatgcccttctacggcaaagcctttttgtgtattgacagcgaacacgtccgcgcgattttgcccaaagtgagcaaaccttatgctacttacggtttggacgataccgccgacatctacgccaccgacatcgaaaacgtcggcgcgcaaatgaaattcaccgtccatgttcaaatgaaaggacatgagcaggggtcgtttgaagtcgtgctgaatatgcccggcagacacaacgtgctgaacgcattggcagccatcggcgtggcgctggaagtcggcgcatcggttgaagcgatccaaaaaggcttgctcggctttgaaggcgtcggccgccgcttccaaaaatacggcgacatcaagttgccaaacggcgggaccgcgctcttggtggacgactacggacaccaccccgtcgaaatggcggcgacccttgccgccgcacgcggcgcgtatctggaaaaacgtttggtactcgccttccagccgcaccgctatacccgcacgcgcgatttgtttgaagactttaccaaagtcctcaataccgttgacgcgctggtgctgaccgaagtttatgccgccggtgaagagccgattgccgccgccgattcccgcgctcttgcccgcgccatccgcgtgttgggcaaactcgagccgatttactgcgaaaacgttgccgatctgcccgaaatgctgttgaacgttttgcaggacggcgacatcgtgttgaatatgggcgcgggaagcatcaaccgcgtccccgccgcgctgctggcattgtcgaaacagatttga

SEQ ID NO: 312 - protein, 506 aa, Neisseria meningitidis
MFFISIRYIFVRKLWRANGQPFKITPLRIENPPERNIMMKNRVTNIHFVGIGGVGMSGIAEVLHNLGFKVSGSDQARNAATEHLGSLGIQVYPGHTAEHVNGADVVVTSTAVKKENPEVVAALEQQIPVIPRALMLAELMRFRDGIAIAGTHGKTTTTSLTASILGAAGLDPTFVIGGKLNAAGTNARLGKGEYIVAEADESDASFLHLTPIMSVVTNIDEDHMDTYGHSVEKLHQAFIDFIHRMPFYGKAFLCIDSEHVRAILPKVSKPYATYGLDDTADIYATDIENVGAQMKFTVHVQMKGHEQGSFEVVLNMPGRHNVLNALAAIGVALEVGASVEAIQKGLLGFEGVGRRFQKYGDIKLPNGGTALLVDDYGHHPVEMAATLAAARGAYLEKRLVLAFQPHRYTRTRDLFEDFTKVLNTVDALVLTEVYAAGEEPIAAADSRALARAIRVLGKLEPIYCENVADLPEMLLNVLQDGDIVLNMGAGSINRVPAALLALSKQI

SEQ ID NO: 313 - DNA, 1521 bp, Neisseria meningitidis
atgttttttatttcaatccgctatatatttgtcagaaaactatggcgcgcaaacggtcagccctttaaaataacgcctttacgcatcgaaaatccaccggaacgcaacattatgatgaaaaatcgagtgaccaacatccattttgtcggtatcggcggcgtcggcatgagcggtatcgccgaagtcttgcacaatttgggttttaaagtttccggttcggatcaggcgcgaaatgccgctaccgagcatttgggcagcctgggcattcaagtttatcccggccataccgcagaacacgttaacggtgcggatgtcgtcgttacctctaccgccgtcaaaaaagaaaatcccgaagttgtcgctgcgttggagcagcaaattcccgttattccgcgcgccctgatgttggcggagttgatgcgcttccgtgacggcatcgccattgccggcacgcacggcaaaaccacgaccaccagcctgaccgcctccatcctcggcgcggcaggacttgacccgactttcgttatcggcggcaaactcaacgccgcaggcaccaacgcccgcttgggcaaaggcgaatacatcgttgccgaagccgacgagtcggatgcatcctttctgcacctgacaccgattatgtccgtcgttaccaatatcgacgaagaccatatggatacctacgggcacagtgttgagaagctgcatcaggcgtttatcgatttcatccaccgtatgcccttctacggcaaagcctttttgtgtattgacagcgaacacgtccgcgcgattttgcccaaagtgagcaaaccttatgctacttacggtttggacgataccgccgacatctacgccaccgacatcgaaaacgtcggcgcgcaaatgaaattcaccgtccatgttcaaatgaaaggacatgagcaggggtcgtttgaagtcgtgctgaatatgcccggcagacacaacgtgctgaacgcattggcagccatcggcgtggcgctggaagtcggcgcatcggttgaagcgatccaaaaaggcttgctcggctttgaaggtgtcggccgccgcttccaaaaatacggcgacatcaagttgccaaacggtggaaccgcgctcttggtggacgactacggacaccaccccgtcgaaatggcggcgaccctttccgccgcacgcggcgcgtatccggaaaaacgtttggtactcgccttccagccgcaccgctatacccgcacgcgcgatttgtttgaagactttaccaaagtcctcaataccgttgacgcgctggtgctgaccgaagtttatgccgccggtgaagagccgattgccgccgctgattcccgcgctcttgcccgcgccatccgcgtgttgggcaaactcgagccgatttactgcgaaaacgttgccgatctgcccgaaatgctgttgaacgttttgcaggacggcgacatcgtgttgaatatgggtgcgggaagcatcaaccgcgtccccgccgcgctgctggaattgtcgaaacagatttga

SEQ ID NO: 314 - protein, 506 aa, Neisseria meningitidis
MFFISIRYIFVRKLWRANGQPFKITPLRIENPPERNIMMKNRVTNIHFVGIGGVGMSGIAEVLHNLGFKVSGSDQARNAATEHLGSLGIQVYPGHTAEHVNGADVVVTSTAVKKENPEVVAALEQQIPVIPRALMLAELMRFRDGIAIAGTHGKTTTTSLTASILGAAGLDPTFVIGGKLNAAGTNARLGKGEYIVAEADESDASFLHLTPIMSVVTNIDEDHMDTYGHSVEKLHQAFIDFIHRMPFYGKAFLCIDSEHVRAILPKVSKPYATYGLDDTADIYATDIENVGAQMKFTVHVQMKGHEQGSFEVVLNMPGRHNVLNALAAIGVALEVGASVEAIQKGLLGFEGVGRRFQKYGDIKLPNGGTALLVDDYGHHPVEMAATLSAARGAYPEKRLVLAFQPHRYTRTRDLFEDFTKVLNTVDALVLTEVYAAGEEPIAAADSRALARAIRVLGKLEPIYCENVADLPEMLLNVLQDGDIVLNMGAGSINRVPAALLELSKQI

SEQ ID NO: 315 - DNA, 831 bp, Neisseria gonorrhoeae
atgcagaattttggcaaagtggccgtattgatgggtggtttttccagcgaacgagaaatctcgctggacagcggtaccgccattttgaacgccttaaaaagcaaaggcatagacgcatacgccttcgaccctaaggaaacgccgttatccgaactgaaggagcggggctttcagacggcattcaacatccttcacggtacttacggcgaagacggggctgttcagggtgcattggaactgttgggcattccctataccggcagcggtgtcgccgcctccgccatcggcatggacaaataccgctgcaaactgatttggcaggcattgggattacccgttcccgagttcgccgtactgtacgatgataccgatttcgatgccgtcgaagaaaaattgggtctgccgatgtttgtgaagccggcggccgaaggcagcagcgtcggcgtggtaaaagtcaaagaaaaaggccgtctgaaaagcgtttacgaagaattgaaacaccttcaggggcgaaatcattgccgaacgttttatcggcggcggcgaatattcctgccccgtcctgaacggcaaagggctgcccggcatacacatcatccccgcaaccgagttttacgactacgaagccaagtacaaccgagacgacaccatttatcaatgtccttcggaagatttgaccgaagccgaagaaagcctgatgcgcgaactggcggttcgcggcgcacaggcaatcggtgcggaaggctgcgtgcgcgtcgatttcctcaaagataccgacggcaaactctatctgttggaaatcaacaccctgcccggtatgaccggccatag

SEQ ID NO: 316 - protein, 276 aa, Neisseria gonorrhoeae
MQNFGKVAVLMGGFSSEREISLDSGTAILNALKSKGIDAYAFDPKETPLSELKERGFQTAFNILHGTYGEDGAVQGALELLGIPYTGSGVAASAIGMDKYRCKLIWQALGLPVPEFAVLYDDTDFDAVEEKLGLPMFVKPAAEGSSVGVVKVKEKGRLKSVYEELKHLQGRNHCRTFYRRRRIFLPRPERQRAARHTHHPRNRVLRLRSQVQPRRHHLSMSFGRFDRSRRKPDARTGGSRRTGNRCGRLRARRFPQRYRRQTLSVGNQHPARYDRP

SEQ ID NO: 317 - DNA, 830 bp, Neisseria meningitidis
atgcagaattttggcaaagtggccgtattgatgggcggtttttccagcgaacgagaaatctcgctggacagcggcaccgccattttgaatgctttaaaaagcaaaggcatagacgcatacgccttcgatcctaaagaaaccccattgtctgaattgaaggcacaaggttttcagacggcattcaacatccttcacggtacttacggcraagacggggcggttcagggtgcattggaactgttgggcattccctataccggcagcggtgtcgccgcatccgccatcggcatggacaaataccgctgcaaactgatttggcaggcattgggattgcccgttcccgagttcgccgtcctgcacgacgacactgatttcgatgccgtcgaagaaaaattgggcctgccgatgtttgtgaaaccggcggccgaaggcagcagcgtaggcgtggtaaaagtcaaaggaaaaggccgtctgaaaagcgtttacgaagaattgaaacaccttcagggcgaaatcattgccgaacgttttatcggcggcggcgaatattcctgccccgtcctgaacggcaaagggctgcccggcatacacatcattcccgcaaccgagttttacgactacgaagccaagtacaaccgcgacgacaccatttatcaatgtccttcggaagatttgaccgaagccgaagaaagcctgatgcgcgaactggcggttcgcggcgcgcaggcaatcggtgcggaaggctgcgtgcgcgtcgatttcctcaaagataccgacggcaaactctatctgttggaaatcaacaccctgcccggtatgacgagccatag

SEQ ID NO: 318 - protein, 276 aa, Neisseria meningitidis
  misc_feature (70)..(70): Xaa can be any naturally occurring amino acid
  misc_feature (170)..(170): Xaa can be any naturally occurring amino acid
MQNFGKVAVLMGGFSSEREISLDSGTAILNALKSKGIDAYAFDPKETPLSELKAQGFQTAFNILHGTYGXDGAVQGALELLGIPYTGSGVAASAIGMDKYRCKLIWQALGLPVPEFAVLHDDTDFDAVEEKLGLPMFVKPAAEGSSVGVVKVKGKGRLKSVYEELKHLQXRNHCRTFYRRRRIFLPRPERQRAARHTHHSRNRVLRLRSQVQPRRHHLSMSFGRFDRSRRKPDARTGGSRRAGNRCGRLRARRFPQRYRRQTLSVGNQHPARYDEP

SEQ ID NO: 319 - DNA, 830 bp, Neisseria meningitidis
atgcagaattttggcaaagtggccgtattgatgggcggtttttccagcgaacgagaaatctcgctggacagcggcaccgccattttgaatgctttaaaaagcaaaggcatagacgcatacgccttcgatcccaaggaaaccccattgtctgaattgaaggcacaaggttttcagacggcattcaacatccttcacggtacttacggcgaagacggggctgttcagggtgcattggaactgttgggcattccctataccggcagcggtgtcgccgcatccgccatcggcatggacaaataccgctgcaaactgatttggcaggcattgggattgcccgttcccgagttcgccgtcctgcacgacgacactgatttcgatgccgtcgaagaaaaattgggcctgccgatgtttgtgaaaccggcggccgaaggcagcagcgtaggcgtggtaaaagtcaaaggaaaaggccgtctgaaaagcgtttacgaagaattgaaacactttcagggcgaaatcattgccgaacggtttatcggcggcggcgaatattcctgccctgtgttgaacggcaaaggcctgcccggcatacacatcatccccgcgaccgagttttatgactacgaagccaagtacaaccgcaacgacaccatttatcaatgtccttcggaagatctgaccgaagccgaagaaagcctgatgcgcgaactggcggttcgcggcgcgcaggcaatcggtgcggaaggctgcgtgcgcgtcgatttcctcaaagataccgacggcaaactctatctgttggaaatcaacaccctgcccggtatgaccggccatag

SEQ ID NO: 320 - protein, 275 aa, Neisseria meningitidis
  misc_feature (170)..(170): Xaa can be any naturally occurring amino acid
MQNFGKVAVLMGGFSSEREISLDSGTAILNALKSKGIDAYAFDPKETPLSELKAQGFQTAFNILHGTYGEDGAVQGALELLGIPYTGSGVAASAIGMDKYRCKLIWQALGLPVPEFAVLHDDTDFDAVEEKLGLPMFVKPAAEGSSVGVVKVKGKGRLKSVYEELKHFQXRNHCRTVYRRRRIFLPCVERQRPARHTHHPRDRVLLRSQVQPQRHHLSMSFGRSDRSRRKPDARTGGSRRAGNRCGRLRARRFPQRYRRQTLSVGNQHPARYDRP

SEQ ID NO: 321 - DNA, 312 bp, Neisseria gonorrhoeae
atgtattcgcctttgcccaagcgggcgttggtgcctgcggcgttgagtttgccgccgataacgaaagtggggtcgagtcctgccgcgccgaggatggaggcggtcaggctggtggtcgtggttttgccgtgcgtaccggcaatggcgatgccgtcacggaagcgcatcagctctgccagcatcaaggcgcgcggaataacgggaatttgccgctccaacgcagcgacaacttcgggattttctttcttgacggcggtagaggcaacgacgacatccgcaccgttaacgtgttctgcggtatggccgggataa

SEQ ID NO: 322 - protein, 103 aa, Neisseria gonorrhoeae
MYSPLPKRALVPAALSLPPITKVGSSPAAPRMEAVRLVVVVLPCVPAMAMPSRKRISSASIKARGITGICRSNAATTSGFSFLTAVEATTTSAPLTCSAVWPG

SEQ ID NO: 323 - DNA, 312 bp, Neisseria meningitidis
atgtattcgcctttgcccaagcgggcgttagtgcctgcggcgttgagtttgccgccgataacgaaagtcgggtcaagtcctgccgcgccgaggatggaggcggtcaggctggtggtcgtggttttgccgtgcgtgccggcaatggcgatgccgtcacggaagcgcatcaactccgccaacatcagggcgcgcggaataacgggaatttgctgctccaacgcagcgacaacttcgggattttcttttttgacggcggtagaggtaacgacgacatccgcaccgttaacgtgttcggcggtatggccgggataa

SEQ ID NO: 324 - protein, 103 aa, Neisseria meningitidis
MYSPLPKRALVPAALSLPPITKVGSSPAAPRMEAVRLVVVVLPCVPAMAMPSRKRINSANIRARGITGICCSNAATTSGFSFLTAVEVTTTSAPLTCSAVWPG

SEQ ID NO: 325 - DNA, 312 bp, Neisseria meningitidis
atgtattcgcctttgcccaagcgggcgttggtgcctgcggcgttgagtttgccgccgataacgaaagtcgggtcaagtcctgccgcgccgaggatggaggcggtcaggctggtggtcgtggttttgccgtgcgtgccggcaatggcgatgccgtcacggaagcgcatcaactccgccaacatcagggcgcgcggaataacgggaatttgctgctccaacgcagcgacaacttcgggattttcttttttgacggcggtagaggtaacgacgacatccgcaccgttaacgtgttctgcggtatggccgggataa

SEQ ID NO: 326 - protein, 103 aa, Neisseria meningitidis; identical to SEQ ID NO: 324

SEQ ID NO: 327 - DNA, 375 bp, Neisseria gonorrhoeae
atgtcctttcatttgaacatggacggtgaatttcatttgcgcgccgacgttttcgatgtcggtggcgtagatgtcggcggtatcgtccaaaccgtaagtagcataaggtttgctcactttgggcaaaatcgcgcggacgtgttcgctgtcaacacacaaaaaggctttgccgtagaagggcatacggtggatgaaatcgataaacgcctgatgcagtttttcgacgctgtgcccgtaggtatccatatggtcttcgtcgatattggtaacgacggacataatcggggtcagtgtaggaaagaggcatcggatcgtcggcttcggcaacgatgtattcgcctttgcccaagcgggcgttggtgcctgcggcgttga

SEQ ID NO: 328 - protein, 124 aa, Neisseria gonorrhoeae
MSFHLNMDGEFHLRADVFDVGGVDVGGIVQTVSSIRFAHFGQNRADVFAVNTQKGFAVEGHTVDEIDKRLMQFFDAVPVGIHMVFVDIGNDGHNRGQCRKEASDRRLRQRCIRLCPSGRWCLRR

SEQ ID NO: 329 - DNA, 375 bp, Neisseria meningitidis
atgtcctttcatttgaacatggacggtgaatttcatttgcgcgccgacgttttcgatgtcggtggcgtagatgtcggcggtatcgtccaaaccgtaagtagcataaggtttgctcactttgggcaaaatcgcgcggacgtgttcgctgtcaatacacaaaaaggctttgccgtagaagggcatacggtggatgaaatcgataaacgcctgatgcagtttttcgacgctgtgcccgtaggtatccatatggtcttcgtcgatattggtaacgacggacataatcggtgtcagtgcagaaaggatgcatccgaccgtcggcttcggcaacgatgtattcgcctttgcccaagcgggcgttagtgcctgcggcgttga

SEQ ID NO: 330 - protein, 124 aa, Neisseria meningitidis
  misc_feature (120)..(120): Xaa can be any naturally occurring amino acid
MSFHLNMDGEFHLRADVFDVGGVDVGGIVQTVSSIRFAHFGQNRADVFAVNTQKGFAVEGHTVDEIDKRLMQFFDAVPVGIHMVFVDIGNDGHNRCQCRKDASDRRLRQRCIRLCPSGRXCLRR

SEQ ID NO: 331 - DNA, 375 bp, Neisseria meningitidis
atgtcctttcatttgaacatggacggtgaatttcatttgcgcgccgacgttttcgatgtcggtggcgtagatgtcggcggtatcgtccaaaccgtaagtagcataaggtttgctcactttgggcaaaatcgcgcggacgtgttcgctgtcaatacacaaaaaggctttgccgtagaagggcatacggtggatgaaatcgataaacgcctgatgcagcttctcaacactgtgcccgtaggtatccatatggtcttcgtcgatattggtaacgacggacataatcggtgtcagtgcagaaaggatgcatccgaccgtcggcttcggcaacgatgtattcgcctttgcccaagcgggcgttggtgcctgcggcgttga

SEQ ID NO: 332 - protein, 124 aa, Neisseria meningitidis
MSFHLNMDGEFHLRADVFDVGGVDVGGIVQTVSSIRFAHFGQNRADVFAVNTQKGFAVEGHTVDEIDKRLMQLLNTVPVGIHMVFVDIGNDGHNRCQCRKDASDRRLRQRCIRLCPSGRWCLRR

SEQ ID NO: 333 - DNA, 375 bp, Neisseria gonorrhoeae
atggccggtcataccgggcagggtgttgatttccaacagatagagtttgccgtcggtatctttgaggaaatcgacgcgcacgcagccttccgcaccgattgcctgtgcgccgcgaaccgccagttcgcgcatcaggctttcttcggcttcggtcaaatcttccgaaggacattgataaatggtgtcgtctcggttgtacttggcttcgtagtcgtaaaactcggttgcggggatgatgtgtatgccgggcagccctttgccgttcaggacggggcaggaatattcgccgccgccgataaaacgttcggcaatgatttcgcccctgaaggtgtttcaattcttcgtaaacgcttttcagacggcctttttctttga

SEQ ID NO: 334 - protein, 124 aa, Neisseria gonorrhoeae
MAGHTGQGVDFQQIEFAVGIFEEIDAHAAFRTDCLCAANRQFAHQAFFGFGQIFRRTLINGVVSVVLGFVVVKLGCGDDVYAGQPFAVQDGAGIFAAADKTFGNDFAPEGVSILRKRFSDGLFL

SEQ ID NO: 335 - DNA, 374 bp, Neisseria meningitidis
atggctcgtcataccgggcagggtgttgatttccaacagatagagtttgccgtcggtatctttgaggaaatcgacgcgcacgcagccttccgcaccgattgcctgcgcgccgcgaaccgccagttcgcgcatcaggctttcttcggcttcggtcaaatcttccgaaggacattgataaatggtgtcgtcgcggttgtacttggcttcgtagtcgtaaaactcggttgcgggaatgatgtgtatgccgggcagccctttgccgttcaggacggggcaggaatattcgccgccgccgataaaacgttcggcaatgatttcgccctgaaggtgtttcaattcttcgtaaacgcttttcagacggccttttcctttga

SEQ ID NO: 336 - protein, 124 aa, Neisseria meningitidis
  misc_feature (108)..(108): Xaa can be any naturally occurring amino acid
MARHTGQGVDFQQIEFAVGIFEEIDAHAAFRTDCLRAANRQFAHQAFFGFGQIFRRTLINGVVAVVLGFVVVKLGCGNDVYAGQPFAVQDGAGIFAAADKTFGNDFAXEGVSILRKRFSDGLFL

SEQ ID NO: 337 - DNA, 374 bp, Neisseria meningitidis
atggccggtcataccgggcagggtgttgatttccaacagatagagtttgccgtcggtatctttgaggaaatcgacgcgcacgcagccttccgcaccgattgcctgcgcgccgcgaaccgccagttcgcgcatcaggctttcttcggcttcggtcagatcttccgaaggacattgataaatggtgtcgttgcggttgtacttggcttcgtagtcataaaactcggtcgcggggatgatgtgtatgccgggcaggcctttgccgttcaacacagggcaggaatattcgccgccgccgataaaccgttcggcaatgatttcgccctgaaagtgtttcaattcttcgtaaacgcttttcagacggccttttcctttga

SEQ ID NO: 338 - protein, 124 aa, Neisseria meningitidis
  misc_feature (108)..(108): Xaa can be any naturally occurring amino acid
MAGHTGQGVDFQQIEFAVGIFEEIDAHAAFRTDCLRAANRQFAHQAFFGFGQIFRRTLINGVVAVVLGFVVIKLGRGDDVYAGQAFAVQHRAGIFAAADKPFGNDFAXESVSILRKRFSDGLFL

SEQ ID NO: 339 - DNA, 1311 bp, Neisseria gonorrhoeae
atggatatttcaaaacaaacattgctggatagggtttttaacctgaaggcaaacggtacgacggtacgtaccgagttgatggcgggtttgacgacctttttgacgatgtgctacatcgttatcgtcaatcccctgattttgggcgagaccggaatggatatgggggcggtattcgtcgctacctgtatcgcatccgccatcggctgttttgtcatgggttttatcggcaactatccgattgcgcttgccccggggatggggctgaatgcctatttcacctttgccgtcgttaagggtatgggcgtgccttggcaggtggcgttgggtgcggtgttcatttccggtctgattttcatcctgttcagcttttttaaagtcagggaaatgctggtcaacgcactgcctatgggtttgaaaatgtcgattgccgccggtatcggtttgtttttggcactgatttccctgaaaggcgcaggcattatcgttgccaatccggcaaccttggtcggcttgggcgatattcatcagcccagcgcactgttggcattgttcggttttgtcatggtggtcgtattggggtatttccgcgttcaaggcgcaatcatcatcaccattctgacgattaccgtcattgccagcctgatgggtttgaacgagtttcacggcgtggtcggcgaagtaccgggcattgcgccgacctttatgcagatggattttaaaggtctgtttaccgtcagcatggtcagcgtgattttcgtcttcttcttggtcgatttgttcgacagtaccggaacgctggtcggcgtatcccaccgtgccggactgctggtggacggtaagctgccccgcctgaaacgcgcactgcttgcagactctaccgccattgtggcaggtgcggctttgggtacttcttcaaccacgccttatgtggaaagcgcggcgggcgtatcggcaggcggacggaccggcctgacggcggttaccgtcggcgtattgatgctggcgtgtctgatgttctccccattggcgaaaagtgttccggtatttgccaccgcgcccgcactgctttatgtcggcacgcagatgctccgcagtgcgagggacattgattgggacgatatgactgaagccgcgcccgcgttcctgaccattgtcttcatgccgtttacctattcgattgcagacggcatcgccttcggcttcatcagctatgccgtggtcaaacttttgtgtcgccggactggggacgtgccgcctatggtatgggttgttgccgtattgtgggcattgaaattctggtatttgggctga

SEQ ID NO: 340 - protein, 436 aa, Neisseria gonorrhoeae
MDISKQTLLDRVFNLKANGTTVRTELMAGLTTFLTMCYIVIVNPLILGETGMDMGAVFVATCIASAIGCFVMGFIGNYPIALAPGMGLNAYFTFAVVKGMGVPWQVALGAVFISGLIFILFSFFKVREMLVNALPMGLKMSIAAGIGLFLALISLKGAGIIVANPATLVGLGDIHQPSALLALFGFVMVVVLGYFRVQGAIIITILTITVIASLMGLNEFHGVVGEVPGIAPTFMQMDFKGLFTVSMVSVIFVFFLVDLFDSTGTLVGVSHRAGLLVDGKLPRLKRALLADSTAIVAGAALGTSSTTPYVESAAGVSAGGRTGLTAVTVGVLMLACLMFSPLAKSVPVFATAPALLYVGTQMLRSARDIDWDDMTEAAPAFLTIVFMPFTYSIADGIAFGFISYAVVKLLCRRTGDVPPMVWVVAVLWALKFWYLG

SEQ ID NO: 341 - DNA, 1311 bp, Neisseria meningitidis
atggacacttcaaaacaaacactgttggacgggatttttaagctgaaggcaaacggtackacggtgcgtaccgagttgatggcgggtttgacaacttttttgacgatgtgctacatcgttatcgtcaaccctcygattttgggcgagaccggcatggatatgggggcggtattcgtcgctacctgtatcgcgtctgccatcggctgttttgttatgggttttgtcggcaactatccgattgcactcgcaccggggatggggctgaatgcctatttcacctttgccgtcgttaagggtatgggcgtgccttggcaggttgcgttgggtgcggtgttcatctccggtctgatttttatcctgttcagcttttttaaagtcagggaaatgctggtcaacgcactgcctatgggtttgaaaatgtcgattgctgccggtatcggtttgtttttggcactgatttccctgaaaggcgcaggcattatcgttgccaatccggcaaccttggtcggtttgggcgatattcatcagccgtccgcgttgttggcattgttcggttttgctatggtggtcgtattgggacatttccgcgttcaaggcgcaatcatcatcaccatcttgaccattaccgtcattgccagcctgatgggtttgaatgaatttcacggcatcatcggcgaagtaccgagcattgcgccgacttttatgcagatggattttgaaggcctgtttaccgtcagcatggtcagtgtgattttcgtcttcttcttggtcgatctatttgacagtaccggaacgctggtcggcatatcccaccgtgccgggctgctggtggacggtaagctgccccgcctgaaacgcgcactgcttgcagactctaccgccattgtggcaggtgcggctttgggtacttcttccaccacgccttatgtggaaagcgcggcgggcgtatcggcaggcggacggaccggcctgacggcggttaccgtcggcgtattgatgctcgcctgcctgatgttttcacctttggcgaaaagtgttcccgcttttgccaccgcgcccgccctgctttatgtcggcacgcagatgctccgcagtgcgagggatattgattgggacgatatgacggaagccgcacctgcgttcctgaccattgttttcatgccgtttacttattcgattgcagacggcatcgctttcggcttcatcagttatgccgtggttaaacttttatgccgccgcaccaaagacgttccgcctatggtatggattgttgccgtattgtgggcactgaaattctggtatttgggctga

SEQ ID NO: 342 - protein, 436 aa, Neisseria meningitidis
  misc_feature (45)..(45): Xaa can be any naturally occurring amino acid
MDTSKQTLLDGIFKLKANGTTVRTELMAGLTTFLTMCYIVIVNPXILGETGMDMGAVFVATCIASAIGCFVMGFVGNYPIALAPGMGLNAYFTFAVVKGMGVPWQVALGAVFISGLIFILFSFFKVREMLVNALPMGLKMSIAAGIGLFLALISLKGAGIIVANPATLVGLGDIHQPSALLALFGFAMVVVLGHFRVQGAIIITILTITVIASLMGLNEFHGIIGEVPSIAPTFMQMDFEGLFTVSMVSVIFVFFLVDLFDSTGTLVGISHRAGLLVDGKLPRLKRALLADSTAIVAGAALGTSSTTPYVESAAGVSAGGRTGLTAVTVGVLMLACLMFSPLAKSVPAFATAPALLYVGTQMLRSARDIDWDDMTEAAPAFLTIVFMPFTYSIADGIAFGFISYAVVKLLCRRTKDVPPMVWIVAVLWALKFWYLG

SEQ ID NO: 343 - DNA, 1311 bp, Neisseria meningitidis
atggacacttcaaaacaaacactgttggacgggatttttaagctgaaggcaaacggtacgacggtgcgtaccgagttgatggcgggtttgacaacttttttgacgatgtgctacatcgttatcgtcaaccctctgattttgggcgagaccggcatggatatgggggcggtattcgtcgctacctgtatcgcgtctgccatcggctgttttgttatgggttttgtcggcaactatccgattgcactcgcaccggggatggggctgaatgcctatttcacctttgccgtcgttaagggtatgggcgtgccttggcaggttgcgttgggtgcggtgttcatctccggtctgattttcatcctgttcagcttttttaaagtcagggaaatgctggtcaacgcactgcctatgggtttgaaaatgtcgattgctgccggtatcggtttgtttttggcactgatttccctgaaaggcgcaggcattatcgttgccaatccggcaaccttggtcggcttgggcgatattcatcagccgtccgcgttgttggcactgttcggttttgccatggtggtcgtattgggacatttccgcgttcaaggcgcaatcatcatcaccattttgacgattaccgtcattgccagcctgatgggtttgaacgaatttcacggcatcatcggcgaagtgccgagcattgcgccgacttttatgcagatggattttaaagggttgtttaccgtcagcatggtcagcgtgattttcgtctttttcctagtcgatctgttcgacagtaccggaacactggtcggtgtatcgcatcgtgccggactgctggtggacggtaagctgccccgcctgaaacgcgcactgcttgcagactctaccgctattgtggcaggtgcggctttgggtacttcttcaaccacgccttatgtggaaagtgcggcgggcgtatcggcaggcgggcggacaggtctgacggcggttaccgtcggcgtattgatgctcgcctgcctgatgttttcacctttggcgaaaagtgttcccgcttttgccaccgcgcccgccctgctttatgtcggcacgcagatgctccgcagtgcgagggacatcgattgggacgatatgacggaagccgcacccgcattcctgaccattgtcttcatgccgtttacctattcgattgcagacggcatcgctttcggcttcatcagttatgccgtggttaaacttttatgccgccgcaccaaagacgttccgcctatggtatggattgttgccgtattgtgggcactgaaattctggtatttgggctga

SEQ ID NO: 344 - protein, 436 aa, Neisseria meningitidis
MDTSKQTLLDGIFKLKANGTTVRTELMAGLTTFLTMCYIVIVNPLILGETGMDMGAVFVATCIASAIGCFVMGFVGNYPIALAPGMGLNAYFTFAVVKGMGVPWQVALGAVFISGLIFILFSFFKVREMLVNALPMGLKMSIAAGIGLFLALISLKGAGIIVANPATLVGLGDIHQPSALLALFGFAMVVVLGHFRVQGAIIITILTITVIASLMGLNEFHGIIGEVPSIAPTFMQMDFKGLFTVSMVSVIFVFFLVDLFDSTGTLVGVSHRAGLLVDGKLPRLKRALLADSTAIVAGAALGTSSTTPYVESAAGVSAGGRTGLTAVTVGVLMLACLMFSPLAKSVPAFATAPALLYVGTQMLRSARDIDWDDMTEAAPAFLTIVFMPFTYSIADGIAFGFISYAVVKLLCRRTKDVPPMVWIVAVLWALKFWYLG

SEQ ID NO: 345 - DNA, 378 bp, Neisseria gonorrhoeae
atgaccgccgacggtctcttcgtcgctttcaacttcaatacgtttgccgttgtgcgaatattgataccagtacagcaggatgctgcccaggctggcgatcagtttgtcggcgatgtcgcgcgcttcgctgtcgggatggctttcgcgttcgggatgaacgcagccgagcatggacacgccggtacgcatcacgtccatcggatgggtatgtgcaggcaggctttccaaaactttaatcacacggataggcaggccgcgcatggatttgagcttggttttataagcggccagctcgaatttgttgggcagatggccgtgaatcagcaagtgtgcgacttcttcaaactcgcatttttgtgccaaattagaatgtcgtaa

SEQ ID NO: 346 - protein, 125 aa, Neisseria gonorrhoeae
MTADGLFVAFNFNTFAVVRILIPVQQDAAQAGDQFVGDVARFAVGMAFAFGMNAAEHGHAGTHHVHRMGMCRQAFQNFNHTDRQAAHGFELGFISGQLEFVGQMAVNQQVCDFFKLAFLCQIRMS

SEQ ID NO: 347 - DNA, 378 bp, Neisseria meningitidis
atgaccgccgatggtctcttcgtcgctttcaacctcaatgcgtttgccgttgtgcgaatattgataccagtacaagaggatgctgccgaggctggcgatcagtttgtcggcgatgtcgcgcgcttcactttccggatggctttcacgttcaggatgaacgcagcccagcatggatacgccggtacgcattacgtccatcggatgggtatgtgcaggcaggctttccaaaactttaatcacacggataggcaggccgcgcatggatttgagcttggttttataagcggccagctcgaatttgttgggcagatggccgtgaatcagcaggtgggcgacttcttcaaactcgcatttttgtgccaaatcagaatgtcgtaa

SEQ ID NO: 348 - protein, 125 aa, Neisseria meningitidis
MTADGLFVAFNLNAFAVVRILIPVQEDAAEAGDQFVGDVARFTFRMAFTFRMNAAQHGYAGTHYVHRMGMCRQAFQNFNHTDRQAAHGFELGFISGQLEFVGQMAVNQQVGDFFKLAFLCQIRMS

SEQ ID NO: 349 - DNA, 378 bp, Neisseria meningitidis; identical to SEQ ID NO: 347

SEQ ID NO: 350 - protein, 125 aa, Neisseria meningitidis; identical to SEQ ID NO: 348

SEQ ID NO: 351 - DNA, 1920 bp, Neisseria gonorrhoeae
atgctgggacgcgcgtccatgatgcgcctgcccgatattgtcggcgtggagctgacgggcaaacggcaggcgggcattactgccacagacatcgtgttggcactgaccgaattcttgcgtaaagagcgcgtggtcggggcgtttgtcgaatttttcggcgagggcgcgagaagcctgtctatcggcgaccgcgcgaccatttccaacatgacgccggagttcggcgcgactgccgccatgttcgccatcgacgcgcaaactattgattatttgaaactgaccggacgtgacgacgcgcaggtgaaattggtggaaacctacgccaaaaccgcaggcttatgggcaggtggcttgaaaaccgccgtttatccgcgcgttttgaaatttgatttgagcagcgtaacgcgcaatatggcaggcccgagcaacccgcacgcgcgttttgccaccgccgatttggcggcgaaagggctggcgaagccttacgaagagccttcagacggccaaatgcctgacggtgcagtgattattgccgcgattacttcgtgtaccaatacttccaacccgcgcaacgttgtcgccgccgcactgttggcacgcaatgccaaccgcctcggcttgaaacgcaaaccttgggtgaaatcttcgtttgccccgggttcaaaagtagccggaatctatttgaaagaagcaggcttgttgcccgaaatggaaaaactcggcttcggtatcgtcgccttcgcatgtaccacctgtaacggcatgagcggcgcgctcgacccgaaaatccaacaagaaatcatcgaccgcgatttgtacgccaccgccgtattgtcaggcaaccgcaacttcgacggccgtatccatccgtatgcgaaacaggctttcctcgcttcgcctcctttggtcgttgcctacgcattggcaggtagcatccgtttcgatattgaaaacgacgtactcggcgttgcagacggccgcgaaatccgcctgaaagatatctggccgacagacgaagaaatcgatgccatcgttgccgaatatgtgaaaccgcaacaattccgcgacatttatatcccgatgtccgacaccggcacagcgcaaaaagcaccaagcccgctgtacgactggcgaccgatgtccacctacatccgccgtccgccctattgggaaggcgcactggcaggggaacgtacattaagaggtatgcgtccgccggcgattttgcccgacaacatcaccaccgaccacatctcgccatccaatgcgattttggccggcagtgccgcaggtgaatatttggcgaaaatgggtttgcctgaagaagacttcaactcttacgcaacccaccgcggcgaccacttgaccgcccaacgcgcaaccttcgccaatccgaaactgtttaacgaaatggtgagaaacgaagacggcagcgtacgccaaggttcgttggcacgcgttgaaccagaaggccaaaccatgcgcatgtgggaagccatcgaaacctatatgaaccgcaaacagccgcttatcatcattgccggtgcggactatggtcaaggctcaagccgcgactgggcggcgaagggcgtgcggctggcgggtgtggaagccatcgccgccgaaggtttcgagcgcatccaccgcaccaacctcatcggcatgggcgtcttgccgctgcaattcaaacccggcaccaaccgccataccctgcaactggacggtacggaaacctacgacgttgtcggcgaacgcacaccgcgctgcggcctgaccctcgtgattcaccgtaaaaacggagaaaccgtcgaagttccggttacctgccgccccgataccgcagaagaagcattggtatatgaagccggcggcgtattgcaacggtttgcacaggactttttggaagggaacgcggcttag

SEQ ID NO: 352 - protein, 639 aa, Neisseria gonorrhoeae
MLGRASMMRLPDIVGVELTGKRQAGITATDIVLALTEFLRKERVVGAFVEFFGEGARSLSIGDRATISNMTPEFGATAAMFAIDAQTIDYLKLTGRDDAQVKLVETYAKTAGLWAGGLKTAVYPRVLKFDLSSVTRNMAGPSNPHARFATADLAAKGLAKPYEEPSDGQMPDGAVIIAAITSCTNTSNPRNVVAAALLARNANRLGLKRKPWVKSSFAPGSKVAGIYLKEAGLLPEMEKLGFGIVAFACTTCNGMSGALDPKIQQEIIDRDLYATAVLSGNRNFDGRIHPYAKQAFLASPPLVVAYALAGSIRFDIENDVLGVADGREIRLKDIWPTDEEIDAIVAEYVKPQQFRDIYIPMSDTGTAQKAPSPLYDWRPMSTYIRRPPYWEGALAGERTLRGMRPPAILPDNITTDHISPSNAILAGSAAGEYLAKMGLPEEDFNSYATHRGDHLTAQRATFANPKLFNEMVRNEDGSVRQGSLARVEPEGQTMRMWEAIETYMNRKQPLIIIAGADYGQGSSRDWAAKGVRLAGVEAIAAEGFERIHRTNLIGMGVLPLQFKPGTNRHTLQLDGTETYDVVGERTPRCGLTLVIHRKNGETVEVPVTCRPDTAEEALVYEAGGVLQRFAQDFLEGNAA

SEQ ID NO: 353 - DNA, 1920 bp, Neisseria meningitidis
atgctgggacgcgcgtccatgatgcgcctgcccgatattgtcggcgttgagctgaacggcaaacggcaggcgggcattacggcgacggatattgtgttggcactgaccgagtttctgcgcaaagaacgcgtggtcggggcgtttgtcgaattcttcggcgagggcgcgagaagcctgtctatcggcgaccgcgcgaccatttccaacatgacgccggagttcggcgcgactgccgcgatgttcgctattgatgagcaaaccattgattatttgaaactgaccggacgcgacgacgcgcaggtgaaattggtggaaacctacgccaaaaccgcaggcttgtgggcagatgccttgaaaaccgccgtttatcctcgcgttttgaaatttgatttgagcagcgtaacgcgcaatatggcaggcccaagtaacccgcatgcccgttttgcgaccgccgatttggcggcgaaagggctggcgaagccttacgaagagccttcggacggccaaatgcccgacggctcggtcatcatcgccgcgattaccagttgcaccaacacttccaacccgcgcaacgttgttgccgccgcgctcttggcacgcaatgccaaccgtctcggcttgaaacgcaaaccttgggtgaaatcttcgtttgccccgggttcaaaagtagccgaaatctatttgaaagaagcgggcctgttgcccgaaatggaaaaactcggcttcggtatcgtcgccttcgcctgcaccacctgcaacggcatgagtggcgcgctggatccgaaaatccagaaagaaatcatcgaccgcgatttgtacgccaccgccgtattatcaggcaaccgcaacttcgacggccgtatccacccgtatgcgaaacaggctttcctcgcttcgcctccgttggtcgttgcctacgcgctggcaggcagtatccgtttcgatattgaaaacgacgtactcggcgttgcagacggcaaggaaatccgcctgaaagacatttggcctgccgatgaagaaatcgatgccgtcgttgccgaatatgtgaaaccgcagcagttccgcgatgtgtatgtaccgatgttcgacaccggcacagcgcaaaaagcacccagtccgctgtacgattggcgtccgatgtccacctacatccgccgtccgccttactgggaaggcgcgctggcaggggaacgcacattaagaggtatgcgtccgctggcgattttgcccgacaacatcaccaccgaccacctctcgccgtccaatgcgattttggccgtcagtgccgcaggcgagtatttggcgaaaatgggtttgcctgaagaagacttcaactcttacgcaacccaccgcggcgaccacttgaccgcccaacgcgctaccttcgccaatccgaaactgtttaacgaaatggtgaaaaacgaagacggcagcgtgcgccaaggctcgttcgcccgcgtcgaacccgaaggcgaaaccatgcgcatgtgggaagccatcgaaacctatatgaaccgcaaacagccgctcatcatcattgccggtgcggactatggtcaaggctcaagccgcgactgggctgcaaaaggcgtacgcctcgccggcgtagaagcgattgttgccgaaggcttcgagcgtatccaccgcaccaaccttatcggcatgggcgtgttgccgctgcagttcaaacccgacaccaaccgccataccctgcaactggacggtacggaaacctacgacgtggtcggcgaacgcacaccgcgctgcgacctgaccctcgtgattcaccgtaaaaacggcgaaaccgttgaagttcccgttacctgctgcctcgatactgcagaagaagtattggtatatgaagccggcggcgtgttgcaacggtttgcacaggattttttggaagggaacgcggcttag

SEQ ID NO: 354 - protein, 639 aa, Neisseria meningitidis
MLGRASMMRLPDIVGVELNGKRQAGITATDIVLALTEFLRKERVVGAFVEFFGEGARSLSIGDRATISNMTPEFGATAAMFAIDEQTIDYLKLTGRDDAQVKLVETYAKTAGLWADALKTAVYPRVLKFDLSSVTRNMAGPSNPHARFATADLAAKGLAKPYEEPSDGQMPDGSVIIAAITSCTNTSNPRNVVAAALLARNANRLGLKRKPWVKSSFAPGSKVAEIYLKEAGLLPEMEKLGFGIVAFACTTCNGMSGALDPKIQKEIIDRDLYATAVLSGNRNFDGRIHPYAKQAFLASPPLVVAYALAGSIRFDIENDVLGVADGKEIRLKDIWPADEEIDAVVAEYVKPQQFRDVYVPMFDTGTAQKAPSPLYDWRPMSTYIRRPPYWEGALAGERTLRGMRPLAILPDNITTDHLSPSNAILAVSAAGEYLAKMGLPEEDFNSYATHRGDHLTAQRATFANPKLFNEMVKNEDGSVRQGSFARVEPEGETMRMWEAIETYMNRKQPLIIIAGADYGQGSSRDWAAKGVRLAGVEAIVAEGFERIHRTNLIGMGVLPLQFKPDTNRHTLQLDGTETYDVVGERTPRCDLTLVIHRKNGETVEVPVTCCLDTAEEVLVYEAGGVLQRFAQDFLEGNAA

SEQ ID NO: 355 - DNA, 1920 bp, Neisseria meningitidis
atgctgggacgcgcgtccatgatgcgcctgcccgatattgtcggcgttgagctgaacggcaaacggaaggcgggcattacggcgacggatattgtgttggcactgaccgagtttctgcgcaaagaacgcgtggtcggggcgtttgtcgaattcttcggcgagggcgcgagaagcctgtctatcggcgaccgcgcgaccatttccaacatgacgccggagttcggcgcgactgccgcgatgttcgctattgatgagcaaaccattgattatttgaaactgaccggacgcgacgacgcgcaggtgaaattggtggaaacctacgccaaaaccgcaggcttgtgggcagatgccttgaaaaccgccgtttatccgcgcgttttgaaatttgatttgagcagcgtaacgcgcaatatggcaggcccgagcaacccgcacgcgcgttttgcgaccgccgatttggccggcaaaggcttggctaaaccttacgaagagccttcagacggccaaatgcctgacggtgcagtgattattgccgcgattacttcctgtaccaatacttccaatccgcgcaacgttgtcgccgccgcgctgttggcacgcaatgccaaccgcctcggcttgcaacgcaaaccttgggtgaaatcttcgtttgccccgggttcaaaagtagccgaaatctatttgaaagaagcagatctgctgcccgaaatggaaaaactcggcttcggtatcgttgccttcgcatgtaccacctgtaacggcatgagcggcgcgctggatccgaaaatccagaaagaaatcatcgaccgcgatttgtacgccaccgccgtattgtcaggcaaccgcaactttgacggccgtatccatccgtatgcgaaacaggctttcctcgcttcgcctccgttggtcgttgcctacgcgctggcaggcagcatccgtttcgatattgaaaacgacgtactcggcgttgcagacggcaaagaaatccgcctgaaagacatttggcctaccgatgaagaaatcgatgccatcgttgccgaatatgtgaaaccgcagcaatttcgcgacgtttatatcccgatgttcgacaccggcacagcgcaaaaagcaccaagcccgctgtacgactggcgtccaatgtctacctatatccgccgcccaccttactgggaaggcgcactggcaggggaacgcacattaagcggtatgcgtccgctggcgattttgcccgacaacatcaccaccgaccatctctcgccatccaatgcgattttggcaagcagtgccgcaggcgaatatttggcaaaaatgggtttgcctgaagaagacttcaactcttacgcaacccaccgtggcgaccacttgaccgcccaacgcgcaaccttcgccaatccgaaactgtttaacgaaatggtgagaaacgaagacggcagcgtacgccaaggttcgctggcacgcgttgaacccgaaggccaaaccatgcgcatgtgggaagccatcgaaacctatatgaaccgcaaacagccgctcatcatcattgccggcgcggactacggtcaaggctcaagccgcgactgggctgcaaaaggcgtacgcctcgccggcgtggaagcgattgttgccgaaggcttcgagcgtatccaccgcaccaacttgatcggtatgggcgtgttgccgctgcagttcaaaccgggtaccaaccgccacaccctgcaactggacggtacggaaacctacgacgttgtcggcgaacgcacaccgcgctgcgacctgacccttgtgattcaccgtaaaaacggcgagaccgtcgaagtccccattacctgccgcctcgataccgcagaagaagtgttggtatatgaagccggtggcgtattgcaacggtttgcacaggattttttggaagggaacgcggcttag

SEQ ID NO: 356 - protein, 639 aa, Neisseria meningitidis
MLGRASMMRLPDIVGVELNGKRKAGITATDIVLALTEFLRKERVVGAFVEFFGEGARSLSIGDRATISNMTPEFGATAAMFAIDEQTIDYLKLTGRDDAQVKLVETYAKTAGLWADALKTAVYPRVLKFDLSSVTRNMAGPSNPHARFATADLAGKGLAKPYEEPSDGQMPDGAVIIAAITSCTNTSNPRNVVAAALLARNANRLGLQRKPWVKSSFAPGSKVAEIYLKEADLLPEMEKLGFGIVAFACTTCNGMSGALDPKIQKEIIDRDLYATAVLSGNRNFDGRIHPYAKQAFLASPPLVVAYALAGSIRFDIENDVLGVADGKEIRLKDIWPTDEEIDAIVAEYVKPQQFRDVYIPMFDTGTAQKAPSPLYDWRPMSTYIRRPPYWEGALAGERTLSGMRPLAILPDNITTDHLSPSNAILASSAAGEYLAKMGLPEEDFNSYATHRGDHLTAQRATFANPKLFNEMVRNEDGSVRQGSLARVEPEGQTMRMWEAIETYMNRKQPLIIIAGADYGQGSSRDWAAKGVRLAGVEAIVAEGFERIHRTNLIGMGVLPLQFKPGTNRHTLQLDGTETYDVVGERTPRCDLTLVIHRKNGETVEVPITCRLDTAEEVLVYEAGGVLQRFAQDFLEGNAA

SEQ ID NO: 357 - DNA, 1245 bp, Neisseria gonorrhoeae
atgtccgccaaaactccgtcgctcttcggcggcgcgatgattatcgccgggaaggttatcggcgcaggtatgttccccaaccccaccgccaacttgggggacgggttaataggctcgctgattgtgctgctgtacacctggtttccattctcctccggcgccctcatgattttggaagtcaacacccataacccccgaggggcaagttttgacaccatggtcaaagacctgctcggacgcggctggaacatcatcaacggcatcgccgtcgctttggtcctatacggctcgacctacgcgtacattttagtcggcggtgacctgaccgccaaaggcatcggcagcgcagtaggcggcaaaatttcgctcaccgtcggacaactcgtcttcttcggcatcctcgccttttgcgtatgggcatccgcacgcttggtcgaccgctttaccggcgtcctcatcggcggcatggtattaacctttatttgggcaaccggcggcctggttgccgatgccaaaccgtccgtcctcttcgacacccaagcccccgtcggcaccggctactggatttacgccgccaccgccctgcccgtctgcctcgcttccttcggcttccacggcaacgtttccagcctgctcaaatactttaaaggcgacgcgcccaaagtggcgaaatccatctgggcaggtacattggttgccttggtaatttacgtcctctggcaaaccgccatccaaagcaacctgccgcgcaacgagttcgcccccgtgattgccgccgagaggcaactctccgtcctgaatgaaaccctgtccaaattcgcccaaaccggcgatatggataaaatattgtccctatttccctacatggcaatcgccacctcctttttaggcgtaaccttaggcctgtttgacaacatcgccgacatcttcaaatggaacgacagtatgtccgggcggggcaccaaaaccgtcgcgctgaacttcctgccgcccctgatttcctggctgctcctccccaccggcttctttaccgccattggtgcgtccggcctggcggcaaccgtctgggaccaaggcatcatccccgccatgctgctctacgtttccccccaaaaaattggcgcaggcaagacttataaagtttacggcggcttgtggctgatgttagtcttccttttcggcatcgccaacatcgccgcacaggtattgagccaaatggaactcgtccccgtatttaaaggataa

SEQ ID NO: 358 - protein, 414 aa, Neisseria gonorrhoeae
MSAKTPSLFGGAMIIAGKVIGAGMFPNPTANLGDGLIGSLIVLLYTWFPFSSGALMILEVNTHNPRGASFDTMVKDLLGRGWNIINGIAVALVLYGSTYAYILVGGDLTAKGIGSAVGGKISLTVGQLVFFGILAFCVWASARLVDRFTGVLIGGMVLTFIWATGGLVADAKPSVLFDTQAPVGTGYWIYAATALPVCLASFGFHGNVSSLLKYFKGDAPKVAKSIWAGTLVALVIYVLWQTAIQSNLPRNEFAPVIAAERQLSVLNETLSKFAQTGDMDKILSLFPYMAIATSFLGVTLGLFDNIADIFKWNDSMSGRGTKTVALNFLPPLISWLLLPTGFFTAIGASGLAATVWDQGIIPAMLLYVSPQKIGAGKTYKVYGGLWLMLVFLFGIANIAAQVLSQMELVPVFKG

SEQ ID NO: 359 - DNA, 1242 bp, Neisseria meningitidis
atgcccaacaaaaccccttcactgttcggcggcgcgatgattatcgccggcacggtcatcggcgcaggcatgctcgccaacccgaccgccacatccggcgtatggtttaccggctcgctggccgtgttgctgtacacctggttttctatgctttccagcggcctgatgattttggaagtcaacacccattatccgcacggcgcaagtttcgacacgatggtcaaagacctgctcggacgcggctggaacatcatcaacggcatcgccgtcgccttcgttttatacctgcttacttacgcttatatcttcgtcggcggcgacctgaccgccaaaggcttaggcagcgcggcaggcggcgacgtttcactcaccgtcggacaactcgtcttcttcggcatcctcgccttttgcgtatgggcatccgcacgcttggtcgaccgcttcaccggcgtccttatcggcggcatggtattgacctttatttgggcggccggcgggctgattgccgatgccaagccgtccgtcctcttcgatacccaagcccccgccggcacaaactactggatttacgccgccaccgccctgcccgtctgcctcgcttccttcggcttccacggcaacgtctccagcctgctcaaatactttaaaggcgacgcgcccaaagtggctaaatccatctggacgggcacactgattgcgctggtaatttacgtcctctggcaaaccgccatccaaggcaacctgccgcgcaacgagttcgcccccgtcatcgccgccgaagggcaagtctccgtcctcatcgaaaccctgtccaaattcgcccaaaccggcaatatggacaaaatattgtccctgttttcctatatggcgatcgccacctcgtttttaggcgtaacgctcggactcttcgactacatcgccgacatcttcaaatggaacgacagcatctccggccgcaccaaaaccgccgcgctgaccttcctgccgcccctgatttcctgcctgctcttccccaccggcttcgttaccgccatcggctacgtcggcctggcggcaaccgtctggacaggcatcatccccgccatgctgctctaccgttcgcgcaaaaaattcggcgcaggcaaaacctataaagtttacggcggcttgtggctgatggtttgggtcttccttttcggcatcgtcaacatcgccgcacaggtattgagccaaatggaactcgtccccgtatttaaaggataa

SEQ ID NO: 360 - protein, 413 aa, Neisseria meningitidis
MPNKTPSLFGGAMIIAGTVIGAGMLANPTATSGVWFTGSLAVLLYTWFSMLSSGLMILEVNTHYPHGASFDTMVKDLLGRGWNIINGIAVAFVLYLLTYAYIFVGGDLTAKGLGSAAGGDVSLTVGQLVFFGILAFCVWASARLVDRFTGVLIGGMVLTFIWAAGGLIADAKPSVLFDTQAPAGTNYWIYAATALPVCLASFGFHGNVSSLLKYFKGDAPKVAKSIWTGTLIALVIYVLWQTAIQGNLPRNEFAPVIAAEGQVSVLIETLSKFAQTGNMDKILSLFSYMAIATSFLGVTLGLFDYIADIFKWNDSISGRTKTAALTFLPPLISCLLFPTGFVTAIGYVGLAATVWTGIIPAMLLYRSRKKFGAGKTYKVYGGLWLMVWVFLFGIVNIAAQVLSQMELVPVFKG

SEQ ID NO: 361 - DNA, 1242 bp, Neisseria meningitidis
  misc_feature (55)..(55): n is a, c, g, or t
  misc_feature (206)..(206): n is a, c, g, or t
  misc_feature (736)..(736): n is a, c, g, or t
  misc_feature (796)..(796): n is a, c, g, or t
  misc_feature (991)..(991): n is a, c, g, or t
  misc_feature (1038)..(1038): n is a, c, g, or t
  misc_feature (1092)..(1092): n is a, c, g, or t
  misc_feature (1183)..(1183): n is a, c, g, or t
  misc_feature (1200)..(1200): n is a, c, g, or t
atgcccaccaaaaccccttcactgttcggcggcgcgatgattatcgccggcacgntcatcggcgcaggtatgctcgccaacccgaccgccacatccggcgtatggtttaccggctcgctggccgtgttgctgtacacctggttttccatgctctccagcggcctgatgattttggaagtcaacacccactacccccacggcgcgancttcgacaccatggttaaagacctgctcggacggagctggaacatcatcaacggcatcgccgtcgccttcgttttatacctgcttacttacgcttatatcttcgtcggcggcgacctgaccgccaaaggcttaggcagcgcggcaggcggcaatgtttcactcaccgtcggacaactcgtcttcttcggcattctcgccttttgcgtatgggcatccgcacgcttggtcgaccgattcaccagcgtcctcatcggcggcatggtattaacctttatttgggcaaccggcggcctgattgccgatgccaaactgcccgtcctcttcgacacccaagcccctaccggcaccaactactggatttatgtcgccaccgccctgcccgtctgccttgcgtcattcggtttccacggcaacgtctccagcctgctcaaatactttaaaggcgacgcgcccaaagtggctaaatccatctggacgggcacactgattgcgctggtaatttacgtcctctggcaaaccgccatccaangcaacctgccgcgcaacgagttcgcccccgtgattgccgccgaagggcaagtctccgtcntgattgaaaccctgtccaaattcgcccaaaccggcaatatggacaaaatattgtccctgttttcctatatggcgatcgccacctcgtttttaggcgtaacgctcggactcttcgactacatcgccgacatcttcaaatggaacgacagcgtgtccggccgcaccaaaaccgccgcgctgaccttcctgccgcctntaatttcctgcctgctcttccccaccggctttgttaccgccatcggntacgtcggcctggcggcaaccgtctggacaggcatcatccccgccatgctgctntaccgttcgcgcaaaaaattcggcgcaggcaaaacctataaagtttacggcggcttgtggctgatggtttgggtcttccttttcggcatcntcaacatcgccgcacangtattgagccaaatggaactcgtccccgtatttaaaggataa

SEQ ID NO: 362 - protein, 413 aa, Neisseria meningitidis
  misc_feature (19)..(19): Xaa can be any naturally occurring amino acid
  misc_feature (69)..(69): Xaa can be any naturally occurring amino acid
  misc_feature (246)..(246): Xaa can be any naturally occurring amino acid
  misc_feature (266)..(266): Xaa can be any naturally occurring amino acid
  misc_feature (331)..(331): Xaa can be any naturally occurring amino acid
  misc_feature (395)..(395): Xaa can be any naturally occurring amino acid
  misc_feature (400)..(400): Xaa can be any naturally occurring amino acid
MPTKTPSLFGGAMIIAGTXIGAGMLANPTATSGVWFTGSLAVLLYTWFSMLSSGLMILEVNTHYPHGAXFDTMVKDLLGRSWNIINGIAVAFVLYLLTYAYIFVGGDLTAKGLGSAAGGNVSLTVGQLVFFGILAFCVWASARLVDRFTSVLIGGMVLTFIWATGGLIADAKLPVLFDTQAPTGTNYWIYVATALPVCLASFGFHGNVSSLLKYFKGDAPKVAKSIWTGTLIALVIYVLWQTAIQXNLPRNEFAPVIAAEGQVSVXIETLSKFAQTGNMDKILSLFSYMAIATSFLGVTLGLFDYIADIFKWNDSVSGRTKTAALTFLPPXISCLLFPTGFVTAIGYVGLAATVWTGIIPAMLLYRSRKKFGAGKTYKVYGGLWLMVWVFLFGIXNIAAXVLSQMELVPVFKG

SEQ ID NO: 363 - DNA, 870 bp, Neisseria gonorrhoeae
atgtccgcagaaacatacacacaaatcggctgggtaggcttagggcaaatgggtctgcctatggtaacgcggctcttggacggcggcatcgaagtcggcgtatacaaccgctcgcccgacaaaactgcccccatctccgccaaaggagcaaaagtttacggcagcaccgccgaactcgtccgcgcctgccccgtcattttcctgatggtttccgactatgccgccgtgtgcgacatcctgaacggagtccgcgacggattggccggcaaaatcatcgtcaacatgagcaccatctccccgaccgaaaacctcgccgtcaaagcacttgtcgaagccgcaggcggacagtttgccgaagcacccgtttccggatcggtcggacccgccaccaacggcacactgctgattctgttcggcggcagcgaagccgttttaaacccgctgcaaaaaatattttcccttgtcggcaaaaaaaccttccatttcggcgatgtcggcaaaggctcgggcgcgaaactcgtcttgaactcgctcttaggcattttcggcgaagcgtacagcgaagcgatgctgatggcgcggcagttcggcatcgataccgacaccatcgtcgaagccatcggcggctcggcaatggactcgcctatgtttcaaacaaaaaaatcactatgggcaaaccgtgagttcccccctgcctttgcactcaaacacgcttccaaagaccttaacctcgccgtcaaagagcttgaacaggcaggcaacaccctgcccgccgtcgaaaccgttgctgccagctaccgcaaagcagttgaagccggctacggcgaacaggacgtttccggcgtttacctgaaattggcagaacactga

SEQ ID NO: 364 - protein, 289 aa, Neisseria gonorrhoeae
MSAETYTQIGWVGLGQMGLPMVTRLLDGGIEVGVYNRSPDKTAPISAKGAKVYGSTAELVRACPVIFLMVSDYAAVCDILNGVRDGLAGKIIVNMSTISPTENLAVKALVEAAGGQFAEAPVSGSVGPATNGTLLILFGGSEAVLNPLQKIFSLVGKKTFHFGDVGKGSGAKLVLNSLLGIFGEAYSEAMLMARQFGIDTDTIVEAIGGSAMDSPMFQTKKSLWANREFPPAFALKHASKDLNLAVKELEQAGNTLPAVETVAASYRKAVEAGYGEQDVSGVYLKLAEH

SEQ ID NO: 365 - DNA, 864 bp, Neisseria meningitidis
atgtccgcaaacgaatacgcacaaatcggctggataggcttagggcaaatgggtctgcctatggtaacgcggctcttggacggcggcatcgaagtcggcgtatacaaccgctcgcccgacaaaactgcccccatctccgccaaaggcgcaaaagtttacggcaacaccgccgaactcgtccgcgactatcccgtcattttcctgatggtttccgactatgccgccgtgtgcgacatcctgaacggagtccgcgacggattggccggcaamatcatcgtcaacatgagcaccatctccccgaccgaaaagctcgccgtcaaagcacttgtcgaagcgcagmgacagtttgccgaagcacccgtttccggatcggtcgggcccgccaccaacggcacgctgctgattctgttcggcggcagcgaaccgttttaaacccgctgcaaaaaatattttccctcgtcggcaaaaaaaccttccatttcggcgatgtcggcaaaggttcgggcgcgaaactcgtcttgaactcgctcttgggcattttcggcgaacgtacagcgaasgmtgctgatggcgcggcagttcggcatcgataccgacaccatcgtcgaagccatcggsgactcggcaatggactcgcccatgttccaaaccaaaaaatccctgtgggcaaaccgcgaattcccgmccgmcttcgccctcaaacacgcctccaaagacctcaacctcgccgtcaaagagcttgaacaggcaggcaacaccctgcccgccgtcgaaaccgttgctgccagctaccgcaaagcagtcgaagccggctacgggacacaggacgtttccggcgtttacctgaaactggcagaacactga

SEQ ID NO: 366 - protein, 287 aa, Neisseria meningitidis
  misc_feature (90)..(90): Xaa can be any naturally occurring amino acid
  misc_feature (144)..(144): Xaa can be any naturally occurring amino acid
  misc_feature (174)..(174): Xaa can be any naturally occurring amino acid
  misc_feature (187)..(188): Xaa can be any naturally occurring amino acid
  misc_feature (229)..(230): Xaa can be any naturally occurring amino acid
MSANEYAQIGWIGLGQMGLPMVTRLLDGGIEVGVYNRSPDKTAPISAKGAKVYGNTAELVRDYPVIFLMVSDYAAVCDILNGVRDGLAGXIIVNMSTISPTEKLAVKALVEAQRQFAEAPVSGSVGPATNGTLLILFGGSEPFXTRCKKYFPSSAKKPSISAMSAKVRARNSSXTRSWAFSANVQRXXLMARQFGIDTDTIVEAIGDSAMDSPMFQTKKSLWANREFPXXFALKHASKDLNLAVKELEQAGNTLPAVETVAASYRKAVEAGYGTQDVSGVYLKLAEH

SEQ ID NO: 367 - DNA, 870 bp, Neisseria meningitidis
atgtccgcaaacgaatacacacaaatcggctggataggcttagggcaaatgggtctgcctatggtaacgcggctcttggacggcggcatcgaagtcggcgtatacaaccgctcgcccgacaaaactgcccccatctccgccaaaggcgcaaaagtttacggcaacaccgccgaactcgtccgcgactatcccgtcattttcctgatggtttccgactatgccgccgtgtgcgacatcctgaacggagtccgcgacggattggccggcaaaatcatcgtcaacatgagcaccatctccccgaccgaaaacctcgccgtcaaagcacttgtcgaagccgcaggcggacagtttgccgaagcacccgtttccggatcggtcgggcccgccaccaacggcacgctgctgattctgttcggcggcagcgaagccgttttaaacccgctgcaaaaaatattttccctcgtcggcaaaaaaaccttccatttcggcgatgtcggcaaaggttcgggcgcgaaactcgtcttgaactcgctcttgggcattttcggcgaagcgtacagcgaagcgatgctgatggcgcggcagttcggcatcgataccgacaccatcgtcgaagccatcggcggctcggcaatggactcgcccatgttccaaaccaaaaaatccctgtgggcaaaccgcgaattcccacccgccttcgccctcaaacacgcctccaaagacctcaacctcgccgtcaaagagcttgaacaggcaggcaacaccctgcccgccgtcgaaaccgttgctgccagctaccgcaaagcagtcgaagccggctacggcgaacaggacgtttccggcgtttacctgaaattggcagaacactga

SEQ ID NO: 368 - protein, 289 aa, Neisseria meningitidis
MSANEYTQIGWIGLGQMGLPMVTRLLDGGIEVGVYNRSPDKTAPISAKGAKVYGNTAELVRDYPVIFLMVSDYAAVCDILNGVRDGLAGKIIVNMSTISPTENLAVKALVEAAGGQFAEAPVSGSVGPATNGTLLILFGGSEAVLNPLQKIFSLVGKKTFHFGDVGKGSGAKLVLNSLLGIFGEAYSEAMLMARQFGIDTDTIVEAIGGSAMDSPMFQTKKSLWANREFPPAFALKHASKDLNLAVKELEQAGNTLPAVETVAASYRKAVEAGYGEQDVSGVYLKLAEH

SEQ ID NO: 369 - DNA, 870 bp, Neisseria gonorrhoeae; identical to SEQ ID NO: 363

SEQ ID NO: 370 - protein, 289 aa, Neisseria gonorrhoeae; identical to SEQ ID NO: 364

SEQ ID NO: 371 - DNA, 870 bp, Neisseria meningitidis
  misc_feature (565)..(565): n is a, c, g, or t
atgtccgcaaacgaatacgcacaaatcggctggataggcttagggcaaatgggtctgcctatggtaacgcggctcttggacggcggcatcgaagtcggcgtatacaaccgctcgcccgacaaaactgcccccatctccgccaaaggcgcaaaagtttacggcaacaccgccgaactcgtccgcgactatcccgtcattttcctgatggtttccgactatgccgccgtgtgcgacatcctgaacggagtccgcgacggattggccggcaaaatcatcgtcaacatgagcaccatctccccgaccgaaaacctcgccgtcaaagcacttgtcgaagccgcaggcggacagtttgccgaagcacccgtttccggatcggtcgggcccgccaccaacggcacgctgctgattctgttcggcggcagcgaagccgttttaaacccgctgcaaaaaatattttccctcgtcggcaaaaaaaccttccatttcggcgatgtcggcaaaggttcgggcgcgaaactcgtcttgaactcgctcttgggcattttcggcgaagcgtacagcgaancgatgctgatggcgcggcagttcggcatcgataccgacaccatcgtcgaagccatcggsgactcggcaatggactcgcccatgttccaaaccaaaaaatccctgtgggcaaaccgcgaattcccgcccgccttcgccctcaaacacgcctccaaagacctcaacctcgccgtcaaagagcttgaacaggcaggcaacaccctgcccgccgtcgaaaccgttgctgccagctaccgcaaagcagtcgaagccggctacggcgaacaggacgtttccggcgtttacctgaaactggcagaacactga

SEQ ID NO: 372 - protein, 289 aa, Neisseria meningitidis
  misc_feature (189)..(189): Xaa can be any naturally occurring amino acid
MSANEYAQIGWIGLGQMGLPMVTRLLDGGIEVGVYNRSPDKTAPISAKGAKVYGNTAELVRDYPVIFLMVSDYAAVCDILNGVRDGLAGKIIVNMSTISPTENLAVKALVEAAGGQFAEAPVSGSVGPATNGTLLILFGGSEAVLNPLQKIFSLVGKKTFHFGDVGKGSGAKLVLNSLLGIFGEAYSEXMLMARQFGIDTDTIVEAIGDSAMDSPMFQTKKSLWANREFPPAFALKHASKDLNLAVKELEQAGNTLPAVETVAASYRKAVEAGYGEQDVSGVYLKLAEH

SEQ ID NO: 373 - DNA, 870 bp, Neisseria meningitidis; identical to SEQ ID NO: 367

SEQ ID NO: 374 - protein, 289 aa, Neisseria meningitidis; identical to SEQ ID NO: 368

SEQ ID NO: 375 - DNA, 513 bp, Neisseria gonorrhoeae
atggtattaacctttatttgggcaaccggcggcctggttgccgatgccaaaccgtccgtcctcttcgacacccaagcccccgtcggcaccggctactggatttacgccgccaccgccctgcccgtctgcctcgcttccttcggcttccacggcaacgtttccagcctgctcaaatactttaaaggcgacgcgcccaaagtggcgaaatccatctgggcaggtacattggttgccttggtaatttacgtcctctggcaaaccgccatccaaagcaacctgccgcgcaacgagttcgcccccgtgattgccgccgagaggcaactctccgtcctgaatgaaaccctgtccaaattcgcccaaaccggcgatatggataaaatattgtccctatttccctacatggcaatcgccacctcctttttaggcgtaaccttaggcctgtttgacaacatcgccggacatcttcaaatggaacgacagtatgtccgggcggcaccaaaaccgtcgcgctga

SEQ ID NO: 376 - protein, 170 aa, Neisseria gonorrhoeae
MVLTFIWATGGLVADAKPSVLFDTQAPVGTGYWIYAATALPVCLASFGFHGNVSSLLKYFKGDAPKVAKSIWAGTLVALVIYVLWQTAIQSNLPRNEFAPVIAAERQLSVLNETLSKFAQTGDMDKILSLFPYMAIATSFLGVTLGLFDNIAGHLQMERQYVRAAPKPSR

SEQ ID NO: 377 - DNA, 510 bp, Neisseria meningitidis
atggtattgacctttatttgggcggccggcgggctgattgccgatgccaagccgtccgtcctcttcgatacccaagcccccgccggcacaaactactggatttacgccgscaccgccctgcccgtctgcctcgcttccttcggcttccacggcaacgtctccagcctgctcaaatactttaaaggcgacgcgcccaaagtggctaaatccatctggacgggcacactgattgcgctggtaatttacgtcctctggcaaaccgccatccaaggcaacctgccgcgcaacgagttcgcccccgtcatcgccgccgaagggcaagtctccgtcctcatcgaaaccctgtccaaattcgcccaaaccggcaatatggacaaaatattgtccctgttttcctatatggcgatcgccacctcgtttttaggcgtaacgctcggactcttcgactacatcgcccatcttcaaatggaacgacagcatctccgggccgcaccaaaaccgccgcgctga

SEQ ID NO: 378 - protein, 169 aa, Neillia sinensis
  misc_feature (37)..(37): Xaa can be any naturally occurring amino acid
MVLTFIWAAGGLIADAKPSVLFDTQAPAGTNYWIYAXTALPVCLASFGFHGNVSSLLKYFKGDAPKVAKSIWTGTLIALVIYVLWQTAIQGNLPRNEFAPVIAAEGQVSVLIETLSKFAQTGNMDKILSLFSYMAIATSFLGVTLGLFDYIAHLQMERQHLRAAPKPPR

SEQ ID NO: 379 - DNA, 777 bp, Neisseria meningitidis
atggtattaacctttatttgggcaaccggcggcctgattgccgatgccaaactgcccgtcctcttcgacacccaagcccctaccggcaccaactactggatttatgtcgccaccgccctgcccgtctgccttgcgtcattcggtttccacggcaacgtctccagcctgctcaaatactttaaaggcgacgcgcccaaagtggctaaatccatctggacgggcacactgattgcgctggtaatttacgtcctctggcaaaccgccatccaaggcaacctgccgcgcaacgagttcgcccccgtgattgccgccgaagggcaagtctccgtcctgattgaaaccctgtccaaattcgcccaaaccggcaatatggacaaaatattgtccctgttttcctatatggcgatcgccacctcgtttttaggcgtaacgctcggactcttcgactacatcgccgacatcttcaaatggaacgacagcgtgtccggccgcaccaaaaccgccgcgctgaccttcctgccgcctctaatttcctgcctgctcttccccaccggctttgttaccgccatcggctacgtcggcctggcggcaaccgtctggacaggcatcatccccgccatgctgctctaccgttcgcgcaaaaaattcggcgcaggcaaaacctataaagtttacggcggcttgtggctgatggtttgggtcttccttttcggcatcgtcaacatcgccgcacaggtattgagccaaatggaactcgtccccgtatttaaaggataa

SEQ ID NO: 380 - protein, 258 aa, Neisseria meningitidis
MVLTFIWATGGLIADAKLPVLFDTQAPTGTNYWIYVATALPVCLASFGFHGNVSSLLKYFKGDAPKVAKSIWTGTLIALVIYVLWQTAIQGNLPRNEFAPVIAAEGQVSVLIETLSKFAQTGNMDKILSLFSYMAIATSFLGVTLGLFDYIADIFKWNDSVSGRTKTAALTFLPPLISCLLFPTGFVTAIGYVGLAATVWTGIIPAMLLYRSRKKFGAGKTYKVYGGLWLMVWVFLFGIVNIAAQVLSQMELVPVFKG

SEQ ID NO: 381 - DNA, 519 bp, Neisseria gonorrhoeae
atgttgccgggcttcaaccggatattcaaacggtttgctccaacactcggaacggcgcataaaacgccgcccttcgcgttatcccgaacggggcggctaatcagatcctatcgccataaaaggcggggtttcaaccgaaaaggaattgagatgaataaaaccttgtctattttgccggcggcaatcttactcggcgggtgcgccgccggcggcaacacattcggcagcttagacggcggcacgggtatgggtggcagcatcgtcaaaatgacggtagaaagccaatgccgtgcggaattggacaggcgcagcgaatggcgtttgaccgcgctggcgatgagtgccgaaaaacaggcggaatgggaaaacaagatttgcggctgcgctaccgaagaagcacctaaccagctgaccggcaacgatgtgatgcagatgctgaaccagtccacgcgcaatcaggcacttgccgccctgaccgtcaaaacggtttccgcctgcttcaaacgcctgtaccgctaa

SEQ ID NO: 382 - protein, 172 aa, Neisseria gonorrhoeae
MLPGFNRIFKRFAPTLGTAHKTPPFALSRTGRLIRSYRHKRRGFNRKGIEMNKTLSILPAAILLGGCAAGGNTFGSLDGGTGMGGSIVKMTVESQCRAELDRRSEWRLTALAMSAEKQAEWENKICGCATEEAPNQLTGNDVMQMLNQSTRNQALAALTVKTVSACFKRLYR

SEQ ID NO: 383 - DNA, 522 bp, Neisseria meningitidis
atgttgccgggcttcaaccggatattcaaacggtttgttccaacactcggaacggcgcataaaacgccgcccttcgcgttatcccgaacggggcggctaatcagattctatcgccataaaaggcggggtttcaaccgaaaaggaattgagatgaataaaaccttgtctattttgccggtggcaatcttactcggcggctgcgccgccggaggcggtaacacattcggcagcttagacggtggcacaggcatgggcggcagcatcgtcaaaatggcggttgggagccaatgccgtgcggaattggacaaacgcagcgaatggcgtttgaccgcgctggcgatgagtgccgaaaaacaggcggagtgggaaaacaagatttgcgcttgcgtcgcccaagaagcacccgaacggatgaccggcaacgatgtgatgcagatgctggctccgtccacgcgcaatcaggcacttgccgccctgaccgccaaaacggtttccgcctgcttcaaacacctgtaccgctaa

SEQ ID NO: 384 - protein, 173 aa, Neisseria meningitidis
MLPGFNRIFKRFVPTLGTAHKTPPFALSRTGRLIRFYRHKRRGFNRKGIEMNKTLSILPVAILLGGCAAGGGNTFGSLDGGTGMGGSIVKMAVGSQCRAELDKRSEWRLTALAMSAEKQAEWENKICACVAQEAPERMTGNDVMQMLAPSTRNQALAALTAKTVSACFKHLYR

SEQ ID NO: 385 - DNA, 522 bp, Neisseria meningitidis
atgttgccgggcttcaaccggatattcaaacggtttgttccaacactcggaacggcgcataaaacgccgcccttcgcgttatcccgaacggggcggctaatcagattctatcgccataaaaggcggggtttcaaccgaaaaggaattgagatgaataaaaccttgtctattttgccggtggcaatcttactcggcggctgcgccgccgggggcggtaacacattcggcagcttagacggcggcacaggtatgggcggcagcatcgtcaaaatggcggtagaaagccaatgccgtgcggaattgaacaaacgcagcgaatggcgtttgaccgcgctggcgatgagtgccgaaaaacaggcggaatgggaaaacaagatttgcgcttgcgtcgcccaagaagcacccaaccagctgaccggcaacgatgtgatgcagatgctggatccgtccacgcgcaatcaggcacttgccgccctgaccgccaaaacggtttccgcctgcttcaaacacctgtaccgctaa

SEQ ID NO: 386 - protein, 173 aa, Neisseria meningitidis
MLPGFNRIFKRFVPTLGTAHKTPPFALSRTGRLIRFYRHKRRGFNRKGIEMNKTLSILPVAILLGGCAAGGGNTFGSLDGGTGMGGSIVKMAVESQCRAELNKRSEWRLTALAMSAEKQAEWENKICACVAQEAPNQLTGNDVMQMLDPSTRNQALAALTAKTVSACFKHLYR

SEQ ID NO: 387 - DNA, 369 bp, Neisseria gonorrhoeae
atgtattatcgccgggttgtggggctatccgatggacttggcgatttggcagccggtattgatcgtaggcgtatgcttaccgcttttggaagcgggcatggaaatgacgcgcaaaggcaaaaccacccaatccgccgccatcgtggtgttctcttccgtctggtcaatccggttttcggctgggcgttgacgatgctgttggataatttgggcttaatcggctgcaaagaacgcagcgcgcaattaggttttgtcggacgagtattgatacccgcagtaggtttcttaatcttgtgtgtggcgatgggtgcggtcgggatgctgcccggtatccctccgtttttggagcagttcaaatctttgggctag

SEQ ID NO: 388 - protein, 122 aa, Neisseria gonorrhoeae
MYYRRVVGLSDGLGDLAAGIDRRRMLTAFGSGHGNDAQRQNHPIRRHRGVLFRLVNPVFGWALTMLLDNLGLIGCKERSAQLGFVGRVLIPAVGFLILCVAMGAVGMLPGIPPFLEQFKSLG

SEQ ID NO: 389 - DNA, 381 bp, Neisseria meningitidis
atgtattatcgccgggttatggggctatccgatggacttggcgatttggcagccggtattgagcgtagccttggtcgtaggcgtatacttaccgcttttggaagcgggcatggaaatgacgcgcaaaggcaaaaccacccaatccgccgccatcgtggtgttctcttccgccttgtcaatccggttttcggctgggcgttgacgatgctgttggataatttgggcttaatcggctgcaaagagcgcagtgcgcaattaggtttcgccggacgcgtgttgatacccgcagtaggtttcttgatcttgtgtgtggcgatgggtgcggtcgggatgctgcccggtatcccgccgtttttggaacacttcaaatctttgggctag

SEQ ID NO: 390 - protein, 126 aa, Neisseria meningitidis
MYYRRVMGLSDGLGDLAAGIERSLGRRRILTAFGSGHGNDAQRQNHPIRRHRGVLFRLVNPVFGWALTMLLDNLGLIGCKERSAQLGFAGRVLIPAVGFLILCVAMGAVGMLPGIPPFLEHFKSLG

SEQ ID NO: 391 - DNA, 381 bp, Neisseria meningitidis
atgtattatcgccgggttgtggggctatccgatggacttggcgatttggcagccggtattgagcgtagccttggtcgtaggcgtatacttaccgcttttggaagcgggcatggaaatgacgcgcaaaggcaaaaccacccaatccgccgccaccgtggtgttctcttccgcttggtcaatccggttttcggctgggcgttgacgatgctgttggataatttgggcttaatcggctgcaaagagcgcagcgcgcaattaggtttcaccggacgcgtattgatacccgtagtaggtttcttgatcttgtgtgtggcgatgggtgcggtcgggatgctgcccggtatcccgccgtttttggagcacttcaaatctttgggctag

SEQ ID NO: 392 - protein, 126 aa, Neisseria meningitidis
MYYRRVVGLSDGLGDLAAGIERSLGRRRILTAFGSGHGNDAQRQNHPIRRHRGVLFRLVNPVFGWALTMLLDNLGLIGCKERSAQLGFTGRVLIPVVGFLILCVAMGAVGMLPGIPPFLEHFKSLG

SEQ ID NO: 393 - DNA, 372 bp, Neisseria gonorrhoeae
  misc_feature (280)..(280): n is a, c, g, or t
  misc_feature (302)..(302): n is a, c, g, or t
  misc_feature (311)..(311): n is a, c, g, or t
atgccgtctgaaacacgcctgccgaaccttatccgcgccttgatatttgccctgggtttcatcttcctgaacgcctgttcggaacaaaccgcgcaaaccgttaccctgcaaggcgaaacgatgggtacgacctataccgtcaaatacctttcaaataatcgggacaaactcccctcccctgccaaaatacaaaagcgcattgatgatgcgcttaaagaagtcaaccggcagatgtccacctaccagaccgattccgaaatcagccggtttatacagacanatgctggagagctcttcgcgtntcatgcagnttctataactgattccgccgaagactgtctgcctaatacgcctatctcatcggcgctctga

SEQ ID NO: 394 - protein, 120 aa, Neisseria gonorrhoeae
MPSETRLPNLIRALIFALGFIFLNACSEQTAQTVTLQGETMGTTYTVKYLSNNRDKLPSPAKIQKRIDDALKEVNRQMSTYQTDSEISRFIQTAGELFAHASITDSAEDCLPNTPISSAL

SEQ ID NO: 395 - DNA, 1056 bp, Neisseria meningitidis
atgccgtctgaaacacgcctgccgaactttatccgcgtcttgatatttgccctgggtttcatcttcctgaacgcctgttcggaacaaaccgcgcaaaccgttaccctgcaaggcgaaacgatgggcacgacctataycgtcaaatacctttcaaataatcgggacaaactcccctcacctgccgaaatacawaaacgcatcgatgacgcgcttaaagaaktcaaccggyagatgtccacctatcagcccgactccgaaatcagccggttcaaccaacacacagccggcaagcccctccgcatttcaagcgacttcgcacacgttactgccgaagccgtccgcctgaaccgcctgacacacggcgcgctggacgtaaccgtcggccccttggtcaacctttggggattcggccccgacaaatccgttacccgtgaaccgtcgccggaacaaatcaaacaggcggcatcttatacgggcatagacaaaatcattttgaaacaaggcaaagattacgcttccttgagcaaaacccaccccaaggcctatttggatttatcttcgattgccaaaggcttcggcgttgataaagttgcgggcgaactggaaaaatacggcattcaaaattatctggtcgaaatcggcggcgagttgcacggcaaaggcaaaaacgcgcgcggcgaaccgtggcgcatcggtatcgagcagcccaatatcgtccaaggcggcaatacgcagattatcgtcccgctgaacaaccgttcgcttgccacttccggcgattaccgtattttccacgtcgataaaaacggcaaacgcctctcccatatcatcaacccgaacaacaaacgacccatcagccacaacctcgcctccatcagcgtggtcgcagacagtgcgatgacggcggacggcttgtccacaggattattcgtattgggcgaaaccgaagccttaaagctggcagagcgcgaaaaactcgctgttttcctgattgtcagggataaaggcggctaccgcaccgccatgtcttccgaatttgaaaaactgctccgctaa

SEQ ID NO: 396 - protein, 351 aa, Neisseria meningitidis
  misc_feature (46)..(46): Xaa can be any naturally occurring amino acid
  misc_feature (64)..(64): Xaa can be any naturally occurring amino acid
  misc_feature (74)..(74): Xaa can be any naturally occurring amino acid
  misc_feature (77)..(77): Xaa can be any naturally occurring amino acid
MPSETRLPNFIRVLIFALGFIFLNACSEQTAQTVTLQGETMGTTYXVKYLSNNRDKLPSPAEIXKRIDDALKEXNRXMSTYQPDSEISRFNQHTAGKPLRISSDFAHVTAEAVRLNRLTHGALDVTVGPLVNLWGFGPDKSVTREPSPEQIKQAASYTGIDKIILKQGKDYASLSKTHPKAYLDLSSIAKGFGVDKVAGELEKYGIQNYLVEIGGELHGKGKNARGEPWRIGIEQPNIVQGGNTQIIVPLNNRSLATSGDYRIFHVDKNGKRLSHIINPNNKRPISHNLASISVVADSAMTADGLSTGLFVLGETEALKLAEREKLAVFLIVRDKGGYRTAMSSEFEKLLR

SEQ ID NO: 397 - DNA, 1056 bp, Neisseria meningitidis
atgccgtctgaaacacgcctgccgaactttatccgcaccttgatatttgccctgagttttatcttcctgaacgcctgttcggaacaaaccgcgcaaaccgttaccctgcaaggtgaaacgatgggcacgacctataccgtcaaatacctttcaaataatcgggacaaactcccctcacctgccgaaatacaaaagcgcatcgatgacgcgcttaaagaagtcaaccggcagatgtccacctatcagcccgactccgaaatcagccggttcaaccaacacacagccggcaagcccctccgcatttcaagcgacttcgcacacgttactgccgaagccgtccacctgaaccgcctgacacacggcgcgctggacgtaaccgtcggccccttggtcaacctttggggattcggccccgacaaatccgttacccgtgaaccgtcgccggaacaaatcaaacaagcagcatcttatacgggcatagacaaaatcattttgaaacaaggcaaagattacgcttccttgagcaaaacccaccccaaggcctatttggatttatcttcgattgccaaaggcttcggcgttgataaagttgcgggcgaactggaaaaatacggcattcaaaattatctggtcgaaatcggcggcgagttgcacggcaaaggcaaaaacgcgcgcggcgaaccttggcgcatcggcatcgaacagcccaacatcgtccaaggcggcaatacgcagattatcgtcccgctgaacaaccgttcgcttgccacttccggcgattaccgtattttccacgtcgataaaagcggcaaacgcctctcccatatcattaatccgaacaacaaacgacccatcagccacaacctcgcctccatcagcgtggtcgcagacagtgcgatgacggcggacggcttgtccacaggattattcgtattgggcgaaaccgaagccttaaagctggcagagcgcgaaaaactcgctgttttcctgattgtcagggataaaggcggctaccgcaccgccatgtcttccgaatttgaaaaactgctccgctaa

SEQ ID NO: 398 - protein, 351 aa, Neisseria meningitidis
MPSETRLPNFIRTLIFALSFIFLNACSEQTAQTVTLQGETMGTTYTVKYLSNNRDKLPSPAEIQKRIDDALKEVNRQMSTYQPDSEISRFNQHTAGKPLRISSDFAHVTAEAVHLNRLTHGALDVTVGPLVNLWGFGPDKSVTREPSPEQIKQAASYTGIDKIILKQGKDYASLSKTHPKAYLDLSSIAKGFGVDKVAGELEKYGIQNYLVEIGGELHGKGKNARGEPWRIGIEQPNIVQGGNTQIIVPLNNRSLATSGDYRIFHVDKSGKRLSHIINPNNKRPISHNLASISVVADSAMTADGLSTGLFVLGETEALKLAEREKLAVFLIVRDKGGYRTAMSSEFEKLLR

SEQ ID NO: 399 - DNA, 1056 bp, Neisseria gonorrhoeae
atgccgtctgaaacacgcctgccgaaccttatccgcgccttgatatttgccctgggtttcatcttcctgaacgcctgttcggaacaaaccgcgcaaaccgttaccctgcaaggcgaaacgatgggtacgacctataccgtcaaatacctttcaaataatcgggacaaactcccctcccctgccaaaatacaaaagcgcattgatgatgcgcttaaagaagtcaaccggcagatgtccacctaccagaccgattccgaaatcagccggttcaaccaacacacagccggcaagcccctccgcatttcaagcgatttcgcacacgttaccgccgaagccgtccgcctgaaccgcctgactcacggcgcactggacgtaaccgtcggccctttggtcaacctttgggggttcggccccgacaaatccgttacccgtgaaccgtcgccggaacaaatcaaacaggcggcatcttatacgggcatagacaaaatcattttgcaacaaggcaaagattacgcttccttgagcaaaacccaccccaaagcctatttggatttatcttcgattgccaaaggcttcggcgttgataaagttgcgggcgaactggaaaaatacggcattcaaaattatctggtcgaaatcggcggcgagttgcacggcaaaggcaaaaatgcgcacggcgaaccgtggcgcatcggtatagagcaacccaatatcatccaaggcggcaatacgcagattatcgtcccgctgaacaaccgttcgcttgccacttccggcgattaccgtattttccacgtcgataaaaacggcaaacgcctttcccacatcatcaatcccaacaacaaacgacccatcagccacaacctcgcctccatcagcgtggtctcagacagtgcaatgacggcggacggtttatccacaggattatttgttttaggcgaaaccgaagccttaaggctggcagaacaagaaaaactcgctgttttcctaattgtccgggataaggacggctaccgcaccgccatgtcttccgaatttgccaagctgctccgctaa

SEQ ID NO: 400 - protein, 351 aa, Neisseria gonorrhoeae
MPSETRLPNLIRALIFALGFIFLNACSEQTAQTVTLQGETMGTTYTVKYLSNNRDKLPSPAKIQKRIDDALKEVNRQMSTYQTDSEISRFNQHTAGKPLRISSDFAHVTAEAVRLNRLTHGALDVTVGPLVNLWGFGPDKSVTREPSPEQIKQAASYTGIDKIILQQGKDYASLSKTHPKAYLDLSSIAKGFGVDKVAGELEKYGIQNYLVEIGGELHGKGKNAHGEPWRIGIEQPNIIQGGNTQIIVPLNNRSLATSGDYRIFHVDKNGKRLSHIINPNNKRPISHNLASISVVSDSAMTADGLSTGLFVLGETEALRLAEQEKLAVFLIVRDKDGYRTAMSSEFAKLLR

SEQ ID NO: 401 - DNA, 1056 bp, Neisseria meningitidis
atgccgtctgaaacacgcctgccgaactttatccgcgtcttgatatttgccctgggtttcatcttcctgaacgcctgttcggaacaaaccgcgcaaaccgttaccctgcaaggcgaaacgatgggcacgacctataccgtcaaatacctttcaaataatcgggacaaactcccctcacctgccgaaatacaaaaacgcatcgatgacgcgcttaaagaagtcaaccggcagatgtccacctatcagcccgactccgaaatcagccggttcaaccaacacacagccggcaagcccctccgcatttcaagcgacttcgcacacgttactgccgaagccgtccgcctgaaccgcctgacacacggcgcgctggacgtaaccgtcggccccttggtcaacctttggggattcggccccgacaaatccgttacccgtgaaccgtcgccggaacaaatcaaacaggcggcatcttatacgggcatagacaaaatcattttgaaacaaggcaaagattacgcttccttgagcaaaacccaccccaaggcctatttggatttatcttcgattgccaaaggcttcggcgttgataaagttgcgggcgaactggaaaaatacggcattcaaaattatctggtcgaaatcggcggcgagttgcacggcaaaggcaaaaacgcgcgcggcgaaccgtggcgcatcggtatcgagcagcccaatatcgtccaaggcggcaatacgcagattatcgtcccgctgaacaaccgttcgcttgccacttccggcgattaccgtattttccacgtcgataaaaacggcaaacgcctctcccatatcatcaacccgaacaacaaacgacccatcagccacaacctcgcctccatcagcgtggtcgcagacagtgcgatgacggcggacggcttgtccacaggattattcgtattgggcgaaaccgaagccttaaagctggcagagcgcgaaaaactcgctgttttcctgattgtcagggataaaggcggctaccgcaccgccatgtcttccgaatttgaaaaactgctccgctaa

SEQ ID NO: 402 - protein, 351 aa, Neisseria meningitidis
MPSETRLPNFIRVLIFALGFIFLNACSEQTAQTVTLQGETMGTTYTVKYLSNNRDKLPSPAEIQKRIDDALKEVNRQMSTYQPDSEISRFNQHTAGKPLRISSDFAHVTAEAVRLNRLTHGALDVTVGPLVNLWGFGPDKSVTREPSPEQIKQAASYTGIDKIILKQGKDYASLSKTHPKAYLDLSSIAKGFGVDKVAGELEKYGIQNYLVEIGGELHGKGKNARGEPWRIGIEQPNIVQGGNTQIIVPLNNRSLATSGDYRIFHVDKNGKRLSHIINPNNKRPISHNLASISVVADSAMTADGLSTGLFVLGETEALKLAEREKLAVFLIVRDKGGYRTAMSSEFEKLLR

SEQ ID NO: 403 - DNA, 1056 bp, Neisseria meningitidis; identical to SEQ ID NO: 397

SEQ ID NO: 404 - protein, 351 aa, Neisseria meningitidis; identical to SEQ ID NO: 398

SEQ ID NO: 405 - DNA, 423 bp, Neisseria gonorrhoeae
atggcttccatcacttcgccgctgcacggggcgcagcaggaatgcagcaagacttttttatgtccgccgggcgggacgagtatggggcggtcaatgtcggtaacggtaggtttgttttgtgtttccattaacttaacaatatctgtcgaatacggtcaaagcggctattttaccagagccgccgaatgtaaaacagggtgtcagggcatcagcccgagctgcctgaacgaacggacggtttgcgaggtaacgataaaatggtcgagcagcgaaacatcaaccagcgacatggcctgtgccagccgccttgtgaacatgatgtcttcctgcgaaggttcaggcgagccgcccggatggttgtgcgcgataatcaggctgtcggcatattcgtccaatgccagtttgacgatttcgcggatgtaa

SEQ ID NO: 406 - protein, 140 aa, Neisseria gonorrhoeae
MASITSPLHGAQQECSKTFLCPPGGTSMGRSMSVTVGLFCVSINLTISVEYGQSGYFTRAAECKTGCQGISPSCLNERTVCEVTIKWSSSETSTSDMACASRLVNMMSSCEGSGEPPGWLCAIIRLSAYSSNASLTISRM

SEQ ID NO: 407 - DNA, 423 bp, Neisseria meningitidis
atggcttccatcacttcgccgctgcacggggcgcacagagaatgcagcaagacttttttatgtccaccgggcgggacgagtatagggcggtcaatgtcggtaacggtaggtttgttttgtgtttccattaacttaacaatatctgttgaatacggttgaagcggctattttatcagagccgccgcatgtaaaacagagtgtcagggcatcaacccgagctgtctgaacgaacagacgctttgcgakgtaacgataaaatggtcgagcagcgacacatcgaccagcgacattgcctgtgccagccgccttgtgaacatgatgtcttcctgcgaargttcsggcgagccgcccggatggttgtgcgcaataatcaggctgtcggcatattcgtccaatgccagtttgacgatttcgcggatgtaa

SEQ ID NO: 408 - protein, 140 aa, Neisseria meningitidis
  misc_feature (53)..(53): Xaa can be any naturally occurring amino acid
  misc_feature (82)..(82): Xaa can be any naturally occurring amino acid
  misc_feature (112)..(112): Xaa can be any naturally occurring amino acid
MASITSPLHGAHRECSKTFLCPPGGTSIGRSMSVTVGLFCVSINLTISVEYGXSGYFIRAAACKTECQGINPSCLNEQTLCXVTIKWSSSDTSTSDIACASRLVNMMSSCEXSGEPPGWLCAIIRLSAYSSNASLTISRM

SEQ ID NO: 409 - DNA, 438 bp, Neisseria gonorrhoeae
atgccggaggcaagcatcgcctccatcacttcgccgctgcacggggcgcaacaggaatgcagcaagacttttttatgtccgccgggcgggacgagtatggggcggtcaatgtcggtaacggtaggtttgttttgtgtttccattaacttaacgatatctgtcgaatacggttgaagcggctattttatcagagccgccgcatgtaaaacagggtgtcagggcatcagcccgagctgcctgaacgaacggacggtttgcgccgttacgataaaatggtcgagcagcgacacatcgaccagcgacattgcctgtgccagccgccttgtgaacatgatgtcttcctgcgaaggttcgggcgagccgcccggatggttgtgcgcgataatcaggctgtcggcatattcgtccaatgccagtttgacaatttcacggatgtaa

SEQ ID NO: 410 - protein, 144 aa, Neisseria gonorrhoeae
MPEASIASITSPLHGAQQECSKTFLCPPGGTSMGRSMSVTVGLFCVSINLTISVEYGSGYFIRAAACKTGCQGISPSCLNERTVCAVTIKWSSSDTSTSDIACASRLVNMMSSCEGSGEPPGWLCAIIRLSAYSSNASLTISRM

SEQ ID NO: 411 - DNA, 2007 bp, Neisseria gonorrhoeae
atggtcgacgaactcgacctgctgcccgatgccgtcgccgccaccctgcttgccgacatcggacgctacgtccccgattggaacctattggtttccgagcgctgcaacagcaccgtcgccgagctggtcaaaggtgtggacgaagtgcagaaacttacccacttcgcccgggtggacagcctcgccacgccggaagaacgcgcacagcaagcggaaaccatgcggaaaatgctgctggcgatggttaccgacatccgcgtcgtattaatcaaactggcgatgcgtacgcgcaccctgctatttttaagcaacgcccccgacagccctgaaaaacgcgccgtcgccaaagaaaccctcgacatcttcgccccgctcgccaaccgcttgggcgtgtggcagctcaaatggcagctcgaagatttgggcttccgccatcaagaacccgaaaaataccgcgaaatcgccctgcttttggacgaaaaacgcaccgaacgcctcgaatacatcgaaaacttcctcgatatcctgcgtacggaactcaaaaaatacaatatccactttgaagtcgccggccgtccgaaacacatctactccatttacaaaaaaatggtgaagaaaaaactcagcttcgacggcctgttcgacatccgcgccgtgcggattctggtcgataccgtccccgagtgttacaccacgctgggcatcgtccacagcctctggcagcccattcccggcgagttcgacgactacatcgccaaccccaaaggcaacggttataaaagtttgcacaccgtcatcgtcggcccggaagacaaaggtgtggaagtgcaaatccgcaccttcgatatgcaccaattcaacgaattcggtgtcgccgcccactggcgttacaaagaaggcggcaaaggcgattccgcctacgaacaaaaaatcgcctggttgcgccaactcttggactggcgcgaaaatatggcggaaagcggcaaggaagacctcgccgccgccttcaaaaccgagcttttcaacgacacgatttatgttttgaccccgcacggcaaagtcctctctctgccaacgggcgcaacccccatcgacttcgcctacgccctgcacagcagcatcggcgaccgctgccggggcgcgaaagtcgaagggcagattgtgccgctgtccaccccgctcgaaaacggacagcgcgtcgaaatcattaccgccaaagaagggcatccttccgtcaactggctttacgaaggctgggtcaaatccggcaaggccatcggcaaaatccgcgcctacatccgccagcaaaacgccgacaccgtgcgcgaagaaggccgtgtccaactcgacaagcagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccccccgtgcccgtcagcgcaaccaccatcgtcaaacagtccaaaatcaaaaaaggtggcaaaaccggcgtgctcatcgacggcgaagacggcttgatgaccacgcttgccaaatgctgcaaacccgcgccgcccgacgatattgccggcttcgttacccgcgagcgcggcatttccgtccaccgcaaaacctgcccctctttccgacaccttgccgaacacgcgcccgaaaaagtactggacgcaagttgggcggcgttgcaggaagggcaagtgttcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagtcaacgacctcccgcgcgtcctcgccggcctcggcgatgtcaaaggcgtattgagcgttacccggctttaa

SEQ ID NO: 412 - protein, 668 aa, Neisseria gonorrhoeae
MVDELDLLPDAVAATLLADIGRYVPDWNLLVSERCNSTVAELVKGVDEVQKLTHFARVDSLATPEERAQQAETMRKMLLAMVTDIRVVLIKLAMRTRTLLFLSNAPDSPEKRAVAKETLDIFAPLANRLGVWQLKWQLEDLGFRHQEPEKYREIALLLDEKRTERLEYIENFLDILRTELKKYNIHFEVAGRPKHIYSIYKKMVKKKLSFDGLFDIRAVRILVDTVPECYTTLGIVHSLWQPIPGEFDDYIANPKGNGYKSLHTVIVGPEDKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSGKAIGKIRAYIRQQNADTVREEGRVQLDKQLAKLTPKPNLQELAENLGYKKPEDLYTAVGQGEISNRAIQKACGTLNEPPPVPVSATTIVKQSKIKKGGKTGVLIDGEDGLMTTLAKCCKPAPPDDIAGFVTRERGISVHRKTCPSFRHLAEHAPEKVLDASWAALQEGQVFAVDIEIRAQDRSGLLRDVSDALARHKLNVTAVQTQSRDLEASMRFTLEVKQVNDLPRVLAGLGDVKGVLSVTRL

SEQ ID NO: 413 - DNA, 1476 bp, Neisseria meningitidis
gtgaaactcaagaaatacaatgtccatttcgaagtcgccggccgcccgaaacacatctactccatttacaaaaaaatggtgaagaaaaaactcagcttcgacggcctctttgacatccgcgccgtgcgaattctggttgataccgtccccgagtgttacaccacgctgggtatcgtccacagcctctggcagcccattcccggcgagttcgacgactacatcgccaatcccaaaggcaacggctataaaagtttgcacaccgtcatcgtcggcccggaagacaaaggcgtggaagtacaaatccgcaccttcgatatgcaccaattcaacgaattcggtgtcgccgcccactggcgttacaaagagggcggcaagggcgattccgcctacgaacagaaaatcgcctggttgcgccaactcttggactggcgcgaaaacatggcggaaagcggcaaggaagacctcgccgccgccttcaaaaccgagcttttcaacgacacgatttatgttttgaccccgcacggcaaagtcctctccctgcccacgggcgcgacccccatcgacttcgcctacgccctgcacagcagcatcggcgaccgttgccgcggtgcgaaagtcgaagggcagattgtgccgctgtccaccccgctcgaaaacggacagcgcgtcgaaatcattaccgccaaagaagggcatccttccgtcaactggctttacgaaggctgggtcaaatccaacaaggcaatcggcaaaatccgcgcctacatccgccagcaaaacgccgacaccgtgcgcgaagaaggccgcgtccaactcgacaaacagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccgcccgtacccgtcagcgaaaccaccatcgtcaaacagtccaaaatcaaaaaaggcggcaaaaacggcgtgctcatcgacggcgaagacggtctgatgaccacgcttgccaaatgctgcaaacccgcgccgcccgacgatattatcggcttcgttacccgcgagcgcggcatttcagtgcaccgcaaawyytkcycgtctttccaacacctcgccgaacacgcgcccgawaaagtgctggacgcaagctgggcggcattgcaggaaggacaagtattcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagtcaacgacctcccgcgcgtcctcgccagcctcggcgacgtcaaaggcgtattgagcgttacccggctttaa

SEQ ID NO: 414 - protein, 491 aa, Neisseria meningitidis
  misc_feature (388)..(390): Xaa can be any naturally occurring amino acid
  misc_feature (401)..(401): Xaa can be any naturally occurring amino acid
VKLKKYNVHFEVAGRPKHIYSIYKKMVKKKLSFDGLFDIRAVRILVDTVPECYTTLGIVHSLWQPIPGEFDDYIANPKGNGYKSLHTVIVGPEDKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSNKAIGKIRAYIRQQNADTVREEGRVQLDKQLAKLTPKPNLQELAENLGYKKPEDLYTAVGQGEISNRAIQKACGTLNEPPPVPVSETTIVKQSKIKKGGKNGVLIDGEDGLMTTLAKCCKPAPPDDIIGFVTRERGISVHRKXXXSFQHLAEHAPXKVLDASWAALQEGQVFAVDIEIRAQDRSGLLRDVSDALARHKLNVTAVQTQSRDLEASMRFTLEVKQVNDLPRVLASLGDVKGVLSVTRL

SEQ ID NO: 415 - DNA, 2007 bp, Neisseria meningitidis
atggttcatgaactcgacctgctccccgatgccgtcgccgccaccctgcttgccgacatcggacgctacgtccccgactggaacctattggtttccgaacgctgcaacagtaccgtcgccgagctggtcaaaggtgtggacgaagtgcagaaactcacccacttcgcccgggtggacagcctcgccacgccggaagaacgcgcccagcaggcagaaactatgcggaaaatgctgctggcgatggttaccgacatccgcgtcgtgttaatcaaactggcgatgcgtacgcgcaccctgcaatttttaagcaacgcccccgacagccccgaaaaacgcgccgtcgccaaagaaaccctcgacatcttcgccccgctcgccaaccgtttgggcgtgtggcagctcaaatggcagctcgaagatttgggcttccgccatcaagaacccgaaaaataccgcgaaatcgccctgcttttggacgaaaaacgcaccgaacgcctcgaatacatcgaaaacttccttaatatcctgcgtacggaactcaaaaaatacaatatccactttgaagtcgccggccgtccgaaacacatctactccatttacaaaaaaatggtgaagaaaaaactcagcttcgacgggttgttcgacatccgcgccgtgcggattctggttgataccgtccccgagtgttacaccacactgggcattgtccacagcctctggcagcccattcccggcgagttcgacgactacatcgccaacccgaaaggcaacggctataaaagtttgcacaccgtcatcgtcggcccggaagacaaaggcgtggaagtgcaaatccgcaccttcgatatgcaccaattcaacgaattcggtgtcgccgcgcactggcgttacaaagagggcggcaaaggcgattccgcctacgaacaaaaaatcgcctggttacgccaacttttggactggcgcgaaaacatggcggaaagcggcaaggaagacctcgccgccgccttcaaaaccgagcttttcaacgacacgatttatgttttgaccccgcacggcaaagtcctctccctgcccacaggcgcgacccccatcgacttcgcctacgccctgcacagcagcatcggcgaccgttgccgcggtgcgaaagtcgaagggcagattgtgccgctgtccaccccgctcgaaaacggacagcgtgtcgaaatcattaccgccaaagaagggcatccttccgtcaactggctttacgaaggctgggtcaaatccaacaaggcaatcggcaaaatccgcgcctacatccgccagcaaaacgccgacaccgtgcgcgaagaaggccgcgtccaactcgacaaacagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccgcccgtacccgtcagcgaaaccaccatcgtcaaacagtccaaaatcaaaaaaggcggcaaaaacggcgtgctcatcgacggcgaagacggtctgatgaccacgcttgccaaatgctgcaaacccgcgccgcccgacgacattgtcggcttcgttacccgcgatcgcggcatttcggtacaccgcaaaacctgcccctctttccgacacctcgccgaacacgcgcccgaaaaagtactggacgcaagttgggcggcgttgcaggaaggacaagtgttcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagttaccgacctcccacgcgtcctcgccagcctcggcgacgtcaaaggcgtattgagcgttacccggctttaa

SEQ ID NO: 416 - protein, 668 aa, Neisseria meningitidis
MVHELDLLPDAVAATLLADIGRYVPDWNLLVSERCNSTVAELVKGVDEVQKLTHFARVDSLATPEERAQQAETMRKMLLAMVTDIRVVLIKLAMRTRTLQFLSNAPDSPEKRAVAKETLDIFAPLANRLGVWQLKWQLEDLGFRHQEPEKYREIALLLDEKRTERLEYIENFLNILRTELKKYNIHFEVAGRPKHIYSIYKKMVKKKLSFDGLFDIRAVRILVDTVPECYTTLGIVHSLWQPIPGEFDDYIANPKGNGYKSLHTVIVGPEDKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSNKAIGKIRAYIRQQNADTVREEGRVQLDKQLAKLTPKPNLQELAENLGYKKPEDLYTAVGQGEISNRAIQKACGTLNEPPPVPVSETTIVKQSKIKKGGKNGVLIDGEDGLMTTLAKCCKPAPPDDIVGFVTRDRGISVHRKTCPSFRHLAEHAPEKVLDASWAALQEGQVFAVDIEIRAQDRSGLLRDVSDALARHKLNVTAVQTQSRDLEASMRFTLEVKQVTDLPRVLASLGDVKGVLSVTRL

SEQ ID NO: 417 - DNA, 2214 bp, Neisseria gonorrhoeae
atgaccgccatcagcccgattcaagacacgcaaagcgcgaccctgcaagaattgcgcgaatggttcgacagctactgcgccgctctgccggacaacgataaaaacctcatcggtaccgcatggtcgctggcgcaggaacattatcctgccgatgccgccacgccgtatggcgagccgctgcccgaccacttcctcggcgcggcgcaaatggtcgacgaactcgacctgctgcccgatgccgtcgccgccaccctgcttgccgacatcggacgctacgtccccgattggaacctattggtttccgagcgctgcaacagcaccgtcgccgagctggtcaaaggtgtggacgaagtgcagaaacttacccacttcgcccgggtggacagcctcgccacgccggaagaacgcgcacagcaagcggaaaccatgcggaaaatgctgctggcgatggttaccgacatccgcgtcgtattaatcaaactggcgatgcgtacgcgcaccctgcaatttttaagcaacgcccccgacagccctgaaaaacgcgccgtcgccaaagaaaccctcgacatcttcgccccgctcgccaaccgcttgggcgtgtggcagctcaaatggcagctcgaagatttgggcttccgccatcaagaacccgaaaaataccgcgaaatcgccctgcttttggacgaaaaacgcaccgaacgcctcgaatacatcgaaaacttcctcgatatcctgcgtacggaactcaaaaaatacaatatccactttgaagtcgccggccgtccgaaacacatctactccatttacaaaaaaatggtgaagaaaaaactcagcttcgacggcctgttcgacatccgcgccgtgcggattctggtcgataccgtccccgagtgttacaccacgctgggcatcgtccacagcctctggcagcccattcccggcgagttcgacgactacatcgccaaccccaaaggcaacggttataaaagtttgcacaccgtcatcgtcggcccggaagaaaaaggtgtggaagtgcaaatccgcaccttcgatatgcaccaattcaacgaattcggtgtcgccgcccactggcgttacaaagaaggcggcaaaggcgattccgcctacgaacaaaaaatcgcctggttgcgccaactcttggactggcgcgaaaatatggcggaaagcggcaaggaagacctcgccgccgccttcaaaaccgagcttttcaacgacacgatttatgttttgaccccgcacggcaaagtcctctctctgccaacgggcgcaacccccatcgacttcgcctacgccctgcacagcagcatcggcgaccgctgccggggcgcgaaagtcgaagggcagattgtgccgctgtccaccccgctcgaaaacggacagcgcgtcgaaatcattaccgccaaagaagggcatccttccgtcaactggctttacgaaggctgggtcaaatccggcaaggccatcggcaaaatccgcgcctacatccgccagcaaaacgccgacaccgtgcgcgaagaaggccgtgtccaactcgacaagcagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccgcccgtgcccgtcagcgcaaccaccatcgtcaaacagtccaaaatcaaaaaaggtggcaaaaccggcgtgctcatcgacggcgaagacggcttgatgaccacgcttgccaaatgctgcaaacccgcgccgcccgacgatattgccggcttcgttacccgcgagcgcggcatttccgtccaccgcaaaacctgcccctctttccgacaccttgccgaacacgcgcccgaaaaagtactggacgcaagttgggcggcgttgcaggaagggcaagtgttcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagtcaacgacctcccgcgcgtcctcgccggcctcggcgatgtcaaaggcgtattgagcgttacccggctttaa

SEQ ID NO: 418 - protein, 737 aa, Neisseria gonorrhoeae
MTAISPIQDTQSATLQELREWFDSYCAALPDNDKNLIGTAWSLAQEHYPADAATPYGEPLPDHFLGAAQMVDELDLLPDAVAATLLADIGRYVPDWNLLVSERCNSTVAELVKGVDEVQKLTHFARVDSLATPEERAQQAETMRKMLLAMVTDIRVVLIKLAMRTRTLQFLSNAPDSPEKRAVAKETLDIFAPLANRLGVWQLKWQLEDLGFRHQEPEKYREIALLLDEKRTERLEYIENFLDILRTELKKYNIHFEVAGRPKHIYSIYKKMVKKKLSFDGLFDIRAVRILVDTVPECYTTLGIVHSLWQPIPGEFDDYIANPKGNGYKSLHTVIVGPEEKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSGKAIGKIRAYIRQQNADTVREEGRVQLDKQLAKLTPKPNLQELAENLGYKKPEDLYTAVGQGEISNRAIQKACGTLNEPPPVPVSATTIVKQSKIKKGGKTGVLIDGEDGLMTTLAKCCKPAPPDDIAGFVTRERGISVHRKTCPSFRHLAEHAPEKVLDASWAALQEGQVFAVDIEIRAQDRSGLLRDVSDALARHKLNVTAVQTQSRDLEASMRFTLEVKQVNDLPRVLAGLGDVKGVLSVTRL

SEQ ID NO: 419 - DNA, 2214 bp, Neisseria meningitidis
atgaccgccatcagcccgattcaagacacgcaaagcgcgactctgcaagaattgcgcgaatggttcgacagctactgcgccgctctgccggacaacgataaaaacctcatcggtaccgcatggttgctggcgcaggaacattaccccgccgatgccgccacgccgtatggcgagccgctgcccgaccacttcctcggcgcggcgcaaatggttcatgaactcgacctgctccccgatgccgtcgccgccaccctgcttgccgacatcggacgctacgtccccgactggaacctattggtttccgaacgctgcaacagtaccgtcgccgagctggtcaaaggtgtggacgaagtgcagaaactcacccacttcgcccgggtggacagcctcgccacgccggaagaacgcgcccagcaggcagaaactatgcggaaaatgctgctggcgatggttaccgacatccgcgtcgtgttaatcaaactggcgatgcgtacgcgcaccctgcaatttttaagcaacgcccccgacagccccgaaaaacgcgccgtcgccaaagaaaccctcgacatcttcgccccgctcgccaaccgtttgggcgtgtggcagctcaaatggcagctcgaagatttgggcttccgccatcaaaagcccgaaaaataccgcgaaatcgcgctgcttttggacgaaaaacgcaccgaacgcctcgaatacatcgaaaacttcctcaacatcctgcgcggtgaactcaagaaatacaatgtccatttcgaagtcgccggccgcccgaaacacatctactccatttacaaaaaaatggtgaagaaaaaactcagcttcgacggcctctttgacatccgcgccgtgcgaattctggttgataccgtccccgagtgttacaccacgctgggtatcgtccacagcctctggcagcccattcccggcgagttcgacgactacatcgccaatcccaaaggcaacggctataaaagtttgcacaccgtcatcgtcggcccggaagacaaaggcgtggaagtacaaatccgcaccttcgatatgcaccaattcaacgaattcggtgtcgccgcccactggcgttacaaagagggcggcaagggcgattccgcctacgaacagaaaatcgcctggttgcgccaactcttggactggcgcgaaaacatggcggaaagcggcaaggaagacctcgccgccgccttcaaaaccgagcttttcaacgacacgatttatgttttgaccccgcacggcaaagtcctctccctgcccacgggcgcgacccccatcgacttcgcctacgccctgcacagcagcatcggcgaccgttgccgcggtgcgaaagtcgaagggcagattgtgccgctgtccaccccgctcgaaaacggacagcgcgtcgaaatcattaccgccaaagaagggcatccttccgtcaactggctttacgaaggctgggtcaaatccaacaaggcaatcggcaaaatccgcgcctacatccgccagcaaaacgccgacaccgtgcgcgaagaaggccgcgtccaactcgacaaacagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccgcccgtacccgtcagcgaaaccaccatcgtcaaacagtccaaaatcaaaaaaggcggcaaaaacggcgtgctcatcgacggcgaagacggtctgatgaccacgcttgccaaatgctgcaaacccgcgccgcccgacgatattatcggcttcgttacccgcgagcgcggcatttcagtgcaccgcaaaacctgcccgtctttccaacacctcgccgaacacgcgcccgaaaaagtgctggacgcaagctgggcggcattgcaggaaggacaagtattcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagtcaacgacctcccgcgcgtcctcgccagcctcggcgacgtcaaaggcgtattgagcgttacccggctttaa

SEQ ID NO: 420 - protein, 737 aa, Neisseria meningitidis
MTAISPIQDTQSATLQELREWFDSYCAALPDNDKNLIGTAWLLAQEHYPADAATPYGEPLPDHFLGAAQMVHELDLLPDAVAATLLADIGRYVPDWNLLVSERCNSTVAELVKGVDEVQKLTHFARVDSLATPEERAQQAETMRKMLLAMVTDIRVVLIKLAMRTRTLQFLSNAPDSPEKRAVAKETLDIFAPLANRLGVWQLKWQLEDLGFRHQKPEKYREIALLLDEKRTERLEYIENFLNILRGELKKYNVHFEVAGRPKHIYSIYKKMVKKKLSFDGLFDIRAVRILVDTVPECYTTLGIVHSLWQPIPGEFDDYIANPKGNGYKSLHTVIVGPEDKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSNKAIGKIRAYIRQQNADTVREEGRVQLDKQLAKLTPKPNLQELAENLGYKKPEDLYTAVGQGEISNRAIQKACGTLNEPPPVPVSETTIVKQSKIKKGGKNGVLIDGEDGLMTTLAKCCKPAPPDDIIGFVTRERGISVHRKTCPSFQHLAEHAPEKVLDASWAALQEGQVFAVDIEIRAQDRSGLLRDVSDALARHKLNVTAVQTQSRDLEASMRFTLEVKQVNDLPRVLASLGDVKGVLSVTRL

SEQ ID NO: 421 - DNA, 2214 bp, Neisseria meningitidis
atgaccgccatcagcccgattcaagacacgcaaagcgcgactctgcaagaattgcgcgaatggttcgacagctactgcaccgcgctgccgaacaacgataaaaaacttgtcttagccgcccgttcgctggcggaagcacattaccccgccgatgccgccacgccgtatggcgaaccgctgcccgaccacttcctcggcgcggcgcaaatggttcatgaactcgacctgctccccgatgccgtcgccgccaccctgcttgccgacatcggacgctacgtccccgactggaacctattggtttccgaacgctgcaacagtaccgtcgccgagctggtcaaaggtgtggacgaagtgcagaaactcacccacttcgcccgggtggacagcctcgccacgccggaagaacgcgcccagcaggcagaaactatgcggaaaatgctgctggcgatggttaccgacatccgcgtcgtgttaatcaaactggcgatgcgtacgcgcaccctgcaatttttaagcaacgcccccgacagccccgaaaaacgcgccgtcgccaaagaaaccctcgacatcttcgccccgctcgccaaccgtttgggcgtgtggcagctcaaatggcagctcgaagatttgggcttccgccatcaagaacccgaaaaataccgcgaaatcgccctgcttttggacgaaaaacgcaccgaacgcctcgaatacatcgaaaacttccttaatatcctgcgtacggaactcaaaaaatacaatatccactttgaagtcgccggccgtccgaaacacatctactccatttacaaaaaaatggtgaagaaaaaactcagcttcgacgggttgttcgacatccgcgccgtgcggattctggttgataccgtccccgagtgttacaccacactgggcattgtccacagcctctggcagcccattcccggcgagttcgacgactacatcgccaacccgaaaggcaacggctataaaagtttgcacaccgtcatcgtcggcccggaagacaaaggcgtggaagtgcaaatccgcaccttcgatatgcaccaattcaacgaattcggtgtcgccgcgcactggcgttacaaagagggcggcaaaggcgattccgcctacgaacaaaaaatcgcctggttacgccaacttttggactggcgcgaaaacatggcggaaagcggcaaggaagacctcgccgccgccttcaaaaccgagcttttcaacgacacgatttatgttttgaccccgcacggcaaagtcctctccctgcccacaggcgcgacccccatcgacttcgcctacgccctgcacagcagcatcggcgaccgttgccgcggtgcgaaagtcgaagggcagattgtgccgctgtccaccccgctcgaaaacggacagcgtgtcgaaatcattaccgccaaagaagggcatccttccgtcaactggctttacgaaggctgggtcaaatccaacaaggcaatcggcaaaatccgcgcctacatccgccagcaaaacgccgacaccgtgcgcgaagaaggccgcgtccaactcgacaaacagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccgcccgtacccgtcagcgaaaccaccatcgtcaaacagtccaaaatcaaaaaaggcggcaaaaacggcgtgctcatcgacggcgaagacggtctgatgaccacgcttgccaaatgctgcaaacccgcgccgcccgacgacattgtcggcttcgttacccgcgatcgcggcatttcggtacaccgcaaaacctgcccctctttccgacacctcgccgaacacgcgcccgaaaaagtactggacgcaagttgggcggcgttgcaggaaggacaagtgttcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagttaccgacctcccacgcgtcctcgccagcctcggcgacgtcaaaggcgtattgagcgttacccggctttaa

SEQ ID NO: 422 - protein, 737 aa, Neisseria meningitidis
MTAISPIQDTQSATLQELREWFDSYCTALPNNDKKLVLAARSLAEAHYPADAATPYGEPLPDHFLGAAQMVHELDLLPDAVAATLLADIGRYVPDWNLLVSERCNSTVAELVKGVDEVQKLTHFARVDSLATPEERAQQAETMRKMLLAMVTDIRVVLIKLAMRTRTLQFLSNAPDSPEKRAVAKETLDIFAPLANRLGVWQLKWQLEDLGFRHQEPEKYREIALLLDEKRTERLEYIENFLNILRTELKKYNIHFEVAGRPKHIYSIYKKMVKKKLSFDGLFDIRAVRILVDTVPECYTTLGIVHSLWQPIPGEFDDYIANPKGNGYKSLHTVIVGPEDKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSNKAIGKIRAYIRQQNADTVREEGRVQLDKQLAKLTPKPNLQELAENLGYKKPEDLYTAVGQGEISNRAIQKACGTLNEPPPVPVSETTIVKQSKIKKGGKNGVLIDGEDGLMTTLAKCCKPAPPDDIVGFVTRDRGISVHRKTCPSFRHLAEHAPEKVLDASWAALQEGQVFAVDIEIRAQDRSGLLRDVSDALARHKLNVTAVQTQSRDLEASMRFTLEVKQVTDLPRVLASLGDVKGVLSVTRL

SEQ ID NO: 423 - DNA, 378 bp, Neisseria gonorrhoeae
atgtgcgagttcaaggattttagaagaaacatcccttgttttgaagagtatgacgaaaattcatttattggcaaatggtatgatgacggggtgtgggatgatgaagaatattggaagctggagaatgatttaatcgaggttaggagaaaatatccttatccgatggatataccaagggatattgtgattggaatcggtaccattattgattttttaatggttccaaattgggagctttttgaaattaaagcttccccttggttgcctgatagcgtgggaattcatgaacgttatgaaagattcacaacgatgctccgttatatttttaccgagaaagacatagtcaacgtgcgatttgattattacaacaaaaaatag

SEQ ID NO: 424 - protein, 125 aa, Neisseria gonorrhoeae
MCEFKDFRRNIPCFEEYDENSFIGKWYDDGVWDDEEYWKLENDLIEVRRKYPYPMDIPRDIVIGIGTIIDFLMVPNWELFEIKASPWLPDSVGIHERYERFTTMLRYIFTEKDIVNVRFDYYNKK

SEQ ID NO: 425 - DNA, 378 bp, Neisseria meningitidis
atgtgtgagttcaaggatattataagaaacgttccttattttgaggggtatgacgaaaattcatttattggcaaatggtatgatgacggggtgtgggatgatgaagaatattggaagttggagaatgatttaatcgaggttagaaaaaaatatccttatccgatggacataccaagatatgttgtcattggaatcggtaccattattgatttcttaatggttccaaattggaaactttttgaaattaaagcttccccttggttgcctgatagtgtgggaattcatgaacgttatgaaagattcacaacgatgctccgttatatttttaccgagaaagacatagtcaacgtgcgatttgattattacaacaaaaaatag

SEQ ID NO: 426 - protein, 125 aa, Neisseria meningitidis
MCEFKDIIRNVPYFEGYDENSFIGKWYDDGVWDDEEYWKLENDLIEVRKKYPYPMDIPRYVVIGIGTIIDFLMVPNWKLFEIKASPWLPDSVGIHERYERFTTMLRYIFTEKDIVNVRFDYYNKK

SEQ ID NO: 427 - DNA, 378 bp, Neisseria meningitidis
atgtgtgagttcaaggattttagaagaaacatcccttgttttgaagagtatgacgaaaattcatttattggcaaatggtatgatgacggggtgtgggatgatgaagaatattggaaattggagaatgatttaatcgaggttagaaaaaaatatccttatccgatggatataccaagggatattgtgattggaatcggtaccattattgattttttaatggttccaaattgggagctttttgaaattaaagcttccccttggttgcctgatagtgtgggaattcatgaacgttatgaaagattcacaacgatgctccgttatatttttaccgagaaagacatagtcaacgtgcgatttgattattacaacaaaaaatag

SEQ ID NO: 428 - protein, 125 aa, Neisseria meningitidis
MCEFKDFRRNIPCFEEYDENSFIGKWYDDGVWDDEEYWKLENDLIEVRKKYPYPMDIPRDIVIGIGTIIDFLMVPNWELFEIKASPWLPDSVGIHERYERFTTMLRYIFTEKDIVNVRFDYYNKK

SEQ ID NO: 429 - DNA, 672 bp, Neisseria gonorrhoeae
atgatgaagacttttaaaaatatattttccgccgccattttgtccgccgccctgccgtgcgcgtatgcggcaaggctaccccaatccgccgtgctgcactattccggcagctacggcattcccgccacgatgacatttgaacgcagcggcaatgcttacaaaatcgtttcgacgattaaagtgccgctatacaatatccgtttcgaatccggcggtacggttgtcggcaataccctgcaccctgcctactataaagacatacgcaggggcaaactgtatgcggaagccaaattcgccgacggcagcgtaacctacggcaaagcgggcgagagcaaaaccgagcaaagccccaaggctatggatttgttcacgcttgcctggcagttggcggcaaatgacgcgaaactccccccgggtctgaaaatcaccaacggcaaaaaactttattccgtcggcggcctgaataaggcgggtacgggaaaatacagcataggcggcgtggaaaccgaagtcgtcaaatatcgggtgcggcgcggcgacgatacggtaacgtatttcttcgcaccgtccctgaacaatattccggcacaaatcggctataccgacgacggcaaaacctatacgctgaagctcaaatcggtgcagatcaacggacaggccgccaaaccgtaa

SEQ ID NO: 430 - protein, 223 aa, Neisseria gonorrhoeae
MMKTFKNIFSAAILSAALPCAYAARLPQSAVLHYSGSYGIPATMTFERSGNAYKIVSTIKVPLYNIRFESGGTVVGNTLHPAYYKDIRRGKLYAEAKFADGSVTYGKAGESKTEQSPKAMDLFTLAWQLAANDAKLPPGLKITNGKKLYSVGGLNKAGTGKYSIGGVETEVVKYRVRRGDDTVTYFFAPSLNNIPAQIGYTDDGKTYTLKLKSVQINGQAAKP

SEQ ID NO: 431 - DNA, 669 bp, Neisseria meningitidis
atgatgaagacttttaaaaatatattttccgccgccattttgtccgccgccctgccgtgcgcgtatgcggcagggctgccccaatccgccgtgctgmactattccggcagctacggcattcccgccacgatgacatttgaacgcagcggcaatgcttacaaaatcgtttcgacgattaaagtgccgctatacaatatccgtttcgagtccggcggtacggttgtcggcaataccctgcaccctacctactatagagacatacgcaggggcaaactgtatgcggaagccaaattcgccgacggcagcgtaacttacggcaaagcgggcgagagcaaaaccgagcaaagccccaaggctatggatttgttcacgcttgcctggcagttggcggcaaatgacgcgaaactccccccggggctgaaaatcaccaacggcaaaaaactttattccgtcggcggtttgaataaggcgggtacaggaaaatacagcataggcggcgtggaaaccgaagtcgtcaaatatcgggtgcggcgcggcgacgatgcggtaatgtatttcttcgcaccgtccctgaacaatattccggcacaaatcggctataccgacgacggcaaaacctatacgctgaaactcaaatcggtgcagatcaacggccaggcagccaaaccg

SEQ ID NO: 432 - protein, 223 aa, Neisseria meningitidis
  misc_feature (33)..(33): Xaa can be any naturally occurring amino acid
MMKTFKNIFSAAILSAALPCAYAAGLPQSAVLXYSGSYGIPATMTFERSGNAYKIVSTIKVPLYNIRFESGGTVVGNTLHPTYYRDIRRGKLYAEAKFADGSVTYGKAGESKTEQSPKAMDLFTLAWQLAANDAKLPPGLKITNGKKLYSVGGLNKAGTGKYSIGGVETEVVKYRVRRGDDAVMYFFAPSLNNIPAQIGYTDDGKTYTLKLKSVQINGQAAKP

SEQ ID NO: 433 - DNA, 672 bp, Neisseria meningitidis
atgatgaagacttttaaaaatatattttccgccgccattttgtccgccgccctgccgtgcgcgtatgcggcagggctgccccaatccgccgtgctgcactattccggcagctacggcattcccgccacgatgacatttgaacgcagcggcaatgcttacaaaatcgtttcgacgattaaagtgccgctatacaatatccgtttcgagtccggcggtacggttgtcggcaataccctgcaccctacctactatagagacatacgcaggggcaaactgtatgcggaagccaaattcgccgacggcagcgtaacctacggcaaagcgggcgagagcaaaaccgagcaaagccccaaggctatggatttgttcacgcttgcctggcagttggcggcaaatgacgcgaaactccccccggggctgaaaatcaccaacggcaaaaaactttattccgtcggcggtttgaataaggcgggtacaggaaaatacagcataggcggcgtggaaaccgaagtcgtcaaatatcgggtgcggcgcggcgacgatgcggtaatgtatttcttcgcaccgtccctgaacaatattccggcacaaatcggctataccgacgacggcaaaacctatacgctgaaactcaaatcggtgcagatcaacggccaggcagccaaaccgtaa

SEQ ID NO: 434 - protein, 223 aa, Neisseria meningitidis
MMKTFKNIFSAAILSAALPCAYAAGLPQSAVLHYSGSYGIPATMTFERSGNAYKIVSTIKVPLYNIRFESGGTVVGNTLHPTYYRDIRRGKLYAEAKFADGSVTYGKAGESKTEQSPKAMDLFTLAWQLAANDAKLPPGLKITNGKKLYSVGGLNKAGTGKYSIGGVETEVVKYRVRRGDDAVMYFFAPSLNNIPAQIGYTDDGKTYTLKLKSVQINGQAAKP

SEQ ID NO: 435 - DNA, 1101 bp, Neisseria gonorrhoeae
atggaaacacagctttacatcggcattatgtcgggaaccagtatggacggggcggatgccgtgctggtacggatggacggcggcaaatggctgggcgcggaagggcacgcctttaccccctaccctgaccggttgcgccgcaaattgctggatttgcaggacacaggcacagacgaactgcaccgcagcaggatgttgtcgcaagaactcagccgcctgtacgcgcaaaccgccgccgaactgctgtgcagtcaaaacctcgctccgtgcgacattaccgccctcggctgccacgggcaaaccgtccgacacgcgccggaacacggttacagcatacagcttgccgatttgccgctgctggcggaactgacgcggatttttaccgtcggcgacttccgcagccgcgaccttgctgccggcggacaaggtgcgccgctcgtccccgcctttcacgaagccctgttccgcgatgacagggaaacacgcgtggtactgaacatcggcgggattgccaacatcagcgtactcccccccggcgcacccgccttcggcttcgacacagggccgggcaatatgctgatggacgcgtggacgcaggcacactggcagctgccttacgacaaaaacggtgcaaaggcggcacaaggcaacatattgccgcaactgctcggcaggctgctcgcccacccgtatttctcacaaccccacccaaaaagcacggggcgcgaactgtttgccctaaattggctcgaaacctaccttgacggcggcgaaaaccgatacgacgtattgcggacgctttcccgattcaccgcgcaaaccgtttgggacgccgtctcacacgcagcggcagatgcccgtcaaatgtacatttgcggcggcggcatccgcaatcctgttttaatggcggatttggcagaatgtttcggcacacgcgtttccctgcacagcaccgccgaactgaacctcgatcctcaatgggtggaggcggccgcatttgcgtggttggcggcgtgttggattaaccgcattcccggtagtccgcacaaagcgaccggcgcatccaaaccgtgtattctgggcgcgggatattattattga

SEQ ID NO: 436 - protein, 366 aa, Neisseria gonorrhoeae
METQLYIGIMSGTSMDGADAVLVRMDGGKWLGAEGHAFTPYPDRLRRKLLDLQDTGTDELHRSRMLSQELSRLYAQTAAELLCSQNLAPCDITALGCHGQTVRHAPEHGYSIQLADLPLLAELTRIFTVGDFRSRDLAAGGQGAPLVPAFHEALFRDDRETRVVLNIGGIANISVLPPGAPAFGFDTGPGNMLMDAWTQAHWQLPYDKNGAKAAQGNILPQLLGRLLAHPYFSQPHPKSTGRELFALNWLETYLDGGENRYDVLRTLSRFTAQTVWDAVSHAAADARQMYICGGGIRNPVLMADLAECFGTRVSLHSTAELNLDPQWVEAAAFAWLAACWINRIPGSPHKATGASKPCILGAGYYY

SEQ ID NO: 437 - DNA, 1101 bp, Neisseria meningitidis
  misc_feature (364)..(606): n is a, c, g, or t
  misc_feature (995)..(995): n is a, c, g, or t
  misc_feature (1082)..(1082): n is a, c, g, or t
atggaaacacagctttacatcggcatcatgtcgggaaccagcatggacggggcggatgccgtactgatacggatggacggcggcaaatggctgggcgcggaagggcacgcctttaccccctaccccggcaggttacgccgccaattgctggatttgcaggacacaggcgcagacgaactgcaccgcagcaggattttgtcgcaagaactcagccgcctatatgcgcaaaccgccgccgaactgctgtgcagtcaaaacctcgcaccgtccgacattaccgccctcggctgccacgggcaaaccgtccgacacgcgccggaacacggttacagcatacagcttgccgatttgccgctgctggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcttccttacgacaaaaacggtgcaaagtcggcacaaggcaacatattgccgcaactgctcgacaggctgctcgcccacccgtatttcgcacaacgccaccctaaaagcacggggcgcgaactgtttgccataaattggctcgaaacctaccttgacggcggcgaaaaccgatacgacgtattgcggacgctttcccgttttaccgcgcaaaccgtttgcgacgccgtctcacacgcagcggcagatgcccgtcaaatgtacatttgcgacggcggcatccgcaatcctgttttaatggcggatttggcagaatgtttcggcacacgcgtttccctgcacagcaccgccgacctgaacctcgatccgcaatgggtggaagccgccgnatttgcgtggttggcggcgtgttggattaatcgcattcccggtagtccgcacaaagcaaccggcgcatccaaaccgtgtattctgancgcgggatattattattga

SEQ ID NO: 438 - protein, 366 aa, Neisseria meningitidis
  misc_feature (122)..(202): Xaa can be any naturally occurring amino acid
  misc_feature (332)..(332): Xaa can be any naturally occurring amino acid
  misc_feature (361)..(361): Xaa can be any naturally occurring amino acid
METQLYIGIMSGTSMDGADAVLIRMDGGKWLGAEGHAFTPYPGRLRRQLLDLQDTGADELHRSRILSQELSRLYAQTAAELLCSQNLAPSDITALGCHGQTVRHAPEHGYSIQLADLPLLAXXXXXXXXXXXXXXXXXXXXXXXXXXXXXXXXXXXXXXXXXXXXXXXXXXXXXXXXXXXXXXXXXXXXXXXXXXXXXXXXXQLPYDKNGAKSAQGNILPQLLDRLLAHPYFAQRHPKSTGRELFAINWLETYLDGGENRYDVLRTLSRFTAQTVCDAVSHAAADARQMYICDGGIRNPVLMADLAECFGTRVSLHSTADLNLDPQWVEAAXFAWLAACWINRIPGSPHKATGASKPCILXAGYYY

SEQ ID NO: 439 - DNA, 1101 bp, Neisseria meningitidis
atggaaacacagctttacatcggcatcatgtcgggaaccagcatggacggggcggatgccgtactgatacggatggacggcggcaaatggctgggcgcggaagggcacgcctttaccccctaccccggcaggttacgccgcaaattgctggatttgcaggacacaggcgcggacgaactgcaccgcagcaggatgttgtcgcaagaactcagccgcctgtacgcgcaaaccgccgccgaactgctgtgcagtcaaaacctcgcgccgtccgacattaccgccctcggctgccacgggcaaaccgtcagacacgcgccggaacacagttacagcgtacagcttgccgatttgccgctgctggcggaacggactcagatttttaccgtcggcgacttccgcagccgcgaccttgcggccggcggacaaggcgcgccgctcgtccccgcctttcacgaagccctgttccgcgacgacagggaaacacgcgcggtactgaacatcggcgggattgccaacatcagcgtactcccccccgacgcacccgccttcggcttcgacacaggaccgggcaatatgctgatggacgcgtggatgcaggcacactggcagcttccttacgacaaaaacggtgcaaaggcggcacaaggcaacatattgccgcaactgctcgacaggctgctcgcccacccgtatttcgcacaaccccaccctaaaagcacggggcgcgaactgtttgccctaaattggctcgaaacctaccttgacggcggcgaaaaccgatacgacgtattgcggacgctttcccgattcaccgcgcaaaccgttttcgacgccgtctcacacgcagcggcagatgcccgtcaaatgtacatttgcggcggcggcatccgcaatcctgttttaatggcggatttggcagaatgtttcggcacacgcgtttccctgcacagcaccgccgaactgaacctcgatccgcaatgggtagaagccgccgcgttcgcatggatggcggcgtgttgggtcaaccgcattcccggtagtccgcacaaagcaaccggcgcatccaaaccgtgtattctgggcgcgggatattattattga

SEQ ID NO: 440 - protein, 366 aa, Neisseria meningitidis
METQLYIGIMSGTSMDGADAVLIRMDGGKWLGAEGHAFTPYPGRLRRKLLDLQDTGADELHRSRMLSQELSRLYAQTAAELLCSQNLAPSDITALGCHGQTVRHAPEHSYSVQLADLPLLAERTQIFTVGDFRSRDLAAGGQGAPLVPAFHEALFRDDRETRAVLNIGGIANISVLPPDAPAFGFDTGPGNMLMDAWMQAHWQLPYDKNGAKAAQGNILPQLLDRLLAHPYFAQPHPKSTGRELFALNWLETYLDGGENRYDVLRTLSRFTAQTVFDAVSHAAADARQMYICGGGIRNPVLMADLAECFGTRVSLHSTAELNLDPQWVEAAAFAWMAACWVNRIPGSPHKATGASKPCILGAGYYY

SEQ ID NO: 441 - DNA, 1101 bp, Neisseria meningitidis
  misc_feature (995)..(995): n is a, c, g, or t
  misc_feature (1082)..(1082): n is a, c, g, or t
atggaaacacagctttacatcggcatcatgtcgggaaccagcatggacggggcggatgccgtactgatacggatggacggcggcaaatggctgggcgcggaagggcacgcctttaccccctaccccggcaggttacgccgccaattgctggatttgcaggacacaggcgcagacgaactgcaccgcagcaggattttgtcgcaagaactcagccgcctatatgcgcaaaccgccgccgaactgctgtgcagtcaaaacctcgcaccgtccgacattaccgccctcggctgccacgggcaaaccgtccgacacgcgccggaacacggttacagcatacagcttgccgatttgccgctgctggcggaacggacgcggatttttaccgtcggcgacttccgcagccgcgaccttgcggccggcggacaaggcgcgccactcgtccccgcctttcacgaagccctgttccgcgacaacagggaaacacgcgcggtactgaacatcggcgggattgccaacatcagcgtactcccccccgacgcacccgccttcggcttcgacacagggccgggcaatatgctgatggacgcgtggacgcaggcacactggcagcttccttacgacaaaaacggtgcaaaggcggcacaaggcaacatattgccgcaactgctcgacaggctgctcgcccacccgtatttcgcacaaccccaccctaaaagcacggggcgcgaactgtttgccctaaattggctcgaaacctaccttgacggcggcgaaaaccgatacgacgtattgcggacgctttcccgttttaccgcgcaaaccgtttgcgacgccgtctcacacgcagcggcagatgcccgtcaaatgtacatttgcggcggcggcatccgcaatcctgttttaatggcggatttggcagaatgtttcggcacacgcgtttccctgcacagcaccgccgacctgaacctcgatccgcaatgggtggaagccgccgnatttgcgtggttggcggcgtgttggattaatcgcattcccggtagtccgcacaaagcaaccggcgcatccaaaccgtgtattctgancgcgggatattattattga

SEQ ID NO: 442 - protein, 366 aa, Neisseria meningitidis
  misc_feature (332)..(332): Xaa can be any naturally occurring amino acid
  misc_feature (361)..(361): Xaa can be any naturally occurring amino acid
METQLYIGIMSGTSMDGADAVLIRMDGGKWLGAEGHAFTPYPGRLRRQLLDLQDTGADELHRSRILSQELSRLYAQTAAELLCSQNLAPSDITALGCHGQTVRHAPEHGYSIQLADLPLLAERTRIFTVGDFRSRDLAAGGQGAPLVPAFHEALFRDNRETRAVLNIGGIANISVLPPDAPAFGFDTGPGNMLMDAWTQAHWQLPYDKNGAKAAQGNILPQLLDRLLAHPYFAQPHPKSTGRELFALNWLETYLDGGENRYDVLRTLSRFTAQTVCDAVSHAAADARQMYICGGGIRNPVLMADLAECFGTRVSLHSTADLNLDPQWVEAAXFAWLAACWINRIPGSPHKATGASKPCILXAGYYY

SEQ ID NO: 443 - DNA, 1101 bp, Neisseria meningitidis; identical to SEQ ID NO: 439

SEQ ID NO: 444 - protein, 366 aa, Neisseria meningitidis; identical to SEQ ID NO: 440

SEQ ID NO: 445 - DNA, 732 bp, Neisseria gonorrhoeae
atggctttactgagcatccgcaagctgcacaaacaatacggcagcgtaaccgccatccaatccttagacttggacttggaaaaaggcgaagtcatcgtactgctgggcccgtccggctgcggcaaatccaccctcctgcgctgcgtcaacggtttggagccgcaccaaggcggcagcatcgtgatggacggtgtcggcgaattcggcaaagacgtttcctggcaaaccgcccggcaaaaagtcggtatggtctttcaaagtaacgaactgtttgcccacatgaccgtcatcgaaaacatcttcttaggcccggtaaaggaacaaaaccgcgaccgtgccgaagcagaggcgcaagccggcaaactgttggaacgcgtcggactgctagaccgcaaaaacgcctatccgcgcgaactttccggcggtcagaaacagcgcatcgccattgtccgcgccctgtgcctgaatccggaagtcatcctgctggacgaaatcaccgccgcacttgaccccgaaatggtgcgcgaagtcttggaagtggttttggaactcgcccgcgaagggatgagtatgctcatcgtaacccacgaaatggggttcgcacgcaaagttgccgaccgcatcgtctttatggacaaaggcggcatcgtcgaatcgtccgaccccgaaacctttttttccgcaccaaaaagcgaacgcgcccgccaatttctggcaggtatggactactga

SEQ ID NO: 446 - protein, 243 aa, Neisseria gonorrhoeae
MALLSIRKLHKQYGSVTAIQSLDLDLEKGEVIVLLGPSGCGKSTLLRCVNGLEPHQGGSIVMDGVGEFGKDVSWQTARQKVGMVFQSNELFAHMTVIENIFLGPVKEQNRDRAEAEAQAGKLLERVGLLDRKNAYPRELSGGQKQRIAIVRALCLNPEVILLDEITAALDPEMVREVLEVVLELAREGMSMLIVTHEMGFARKVADRIVFMDKGGIVESSDPETFFSAPKSERARQFLAGMDY

SEQ ID NO: 447 - DNA, 762 bp, Neisseria meningitidis
gttgtcatgattaaaatccgcaatatccataagacctttggcgaaaacactattttgcgcggcatcgatttggatgtgtgcaaagggcaggtggtcgtcatcctcgggccttccggctcaggcaaaacgacgtttctgcgatgcctaaacgcgttggaaatgcccgaagacggacaaatcgagttcgacaacgagcgaccgctgaaaatcgatttttctaaaaaaccaagcaaacacgatattttggcactgcgccgcaaatcakgcatggtgtttcaacaatacaayctctttccgcacaaaaccgccttggaaaacgtaatggaaggaccggttgccgtacagggcaagcctgccgcccaagcgcgcgaagaggctctgaaactgctggaaaaagtcggcttgggcgacaaagtggatttgtatccctaccagctttccggcggtcagcagcagcgcgtcggcattgcccgcgcattggcgattcagcctgaactgatgctgtttgacgaaccgacttccgcgctcgatcctgaattggtgcaagatgttttggatmccatgaaggaattggcgcaagaaggctggaccatggttgtcgttacgcatgaaatcaagttcgccttagaagtggcaaccaccgwcgtcgtgatggacrgcggcgttattgtcgaacaaggcagcccgcaagatttgttcgaccaccccaaacacgaacggacgcggagatttttaagccaaatccaatctaccaagatttga

SEQ ID NO: 448 - protein, 253 aa, Neisseria meningitidis
  misc_feature (89)..(89): Xaa can be any naturally occurring amino acid
  misc_feature (187)..(187): Xaa can be any naturally occurring amino acid
  misc_feature (215)..(215): Xaa can be any naturally occurring amino acid
  misc_feature (220)..(220): Xaa can be any naturally occurring amino acid
VVMIKIRNIHKTFGENTILRGIDLDVCKGQVVVILGPSGSGKTTFLRCLNALEMPEDGQIEFDNERPLKIDFSKKPSKHDILALRRKSXMVFQQYNLFPHKTALENVMEGPVAVQGKPAAQAREEALKLLEKVGLGDKVDLYPYQLSGGQQQRVGIARALAIQPELMLFDEPTSALDPELVQDVLDXMKELAQEGWTMVVVTHEIKFALEVATTXVVMDXGVIVEQGSPQDLFDHPKHERTRRFLSQIQSTKI

SEQ ID NO: 449 - DNA, 762 bp, Neisseria meningitidis
gttgtcatgattaaaatccgcaatatccataagaccttcggcaaaaataccattttgcgcggcatcaatttggatgtgtgcaaagggcaggtggtcgtcatcctcgggccttccggctcaggcaaaacgacgtttctgcgatgcctaaacgcgttggaaatgcccgaagacggacaaatcgagttcgacaacgagcgaccgctgaaaatcgatttttctaaaaaaccaagcaaacacgatattttggcactgcgccgcaaatcaggcatggtgtttcaacaatacaacctctttccgcacaaaaccgccttggaaaacgtgatggaaggaccggttgccgtacagggcaagcctgccgcccaagcgcgcgaagaggctctgaaactgctggaaaaagtcggcttgggcgacaaagtggatttgtatccctaccagctttccggcggtcagcagcagcgcgtcggcattgcccgagcattggcgattcagcccgagctgatgttgtttgacgaacccacttccgcgcttgaccccgagttggtgcaagacgtgttgaacgccatgaaggaattggcgcgggaaggttggacgatggtcgtcgttacccacgaaatcaagttcgcgctggaagttgccacgaccgttgtcgtgatggacggcggcgttatcgtagagcagggcagcccgaaagagttgttcgaccaccccaaacacgaacggacgcggagatttttaagccaaatccaatctaccaagatttga

SEQ ID NO: 450 - protein, 253 aa, Neisseria meningitidis
VVMIKIRNIHKTFGKNTILRGINLDVCKGQVVVILGPSGSGKTTFLRCLNALEMPEDGQIEFDNERPLKIDFSKKPSKHDILALRRKSGMVFQQYNLFPHKTALENVMEGPVAVQGKPAAQAREEALKLLEKVGLGDKVDLYPYQLSGGQQQRVGIARALAIQPELMLFDEPTSALDPELVQDVLNAMKELAREGWTMVVVTHEIKFALEVATTVVVMDGGVIVEQGSPKELFDHPKHERTRRFLSQIQSTKI

SEQ ID NO: 451 - DNA, 756 bp, Neisseria gonorrhoeae
atgattaaaatccgcaatatccataagacctttggcgaaaacaccattttgcgcggcatcgatttggatgtgggcaaagggcaggtggtcgtcatcctcgggccttccggctcgggtaaaacaacatttctgcgctgcctaaacgcgttggaaatgcccgaagacggacaaatcgagttcgacaacgcgcggccgttacgcattgatttttccaaaaaaacaagcaaacacgatattttggcactgcgccgcaagtccggaatggtattccaacaatacaacctcttcccgcataaaaccgtgttggaaaacgtgatggaagggccggttgccgtacagggcaagcctgccgcccaagcgcgcgaagaggctttgaaactgctggaaaaagtcggcttgggcgataaagtggatttgtatccctaccagctttccggcggtcagcagcagcgtgtcggtatcgcccgcgcactggcgattcagcctgaattgatgctgtttgacgaacccacttccgcgctggaccccgagttggtgcaagacgtgttggacgccatgaaggaattggcgcgggaaggttggacgatggtcgtcgttacccacgaaatcaagttcacgctggaagttgccacgaacgtcgtcgtgatggacggcggcgttatcgtagagcagggcagcccgaaagagttgttcgaccacctcaaacacgaacggacgcggagatttttaagccaaatccaatctgccaagatttga

SEQ ID NO: 452 - protein, 251 aa, Neisseria gonorrhoeae
MIKIRNIHKTFGENTILRGIDLDVGKGQVVVILGPSGSGKTTFLRCLNALEMPEDGQIEFDNARPLRIDFSKKTSKHDILALRRKSGMVFQQYNLFPHKTVLENVMEGPVAVQGKPAAQAREEALKLLEKVGLGDKVDLYPYQLSGGQQQRVGIARALAIQPELMLFDEPTSALDPELVQDVLDAMKELAREGWTMVVVTHEIKFTLEVATNVVVMDGGVIVEQGSPKELFDHLKHERTRRFLSQIQSAKI

SEQ ID NO: 453 - DNA, 756 bp, Neisseria meningitidis
atgattaaaatccgcaatatccataagacctttggcgaaaacactattttgcgcggcatcgatttggatgtgtgcaaagggcaggtggtcgtcatcctcgggccttccggctcaggcaaaacgacgtttctgcgatgcctaaacgcgttggaaatgcccgaagacggacaaatcgagttcgacaacgagcgaccgctgaaaatcgatttttctaaaaaaccaagcaaacacgatattttggcactgcgccgcaaatcaggcatggtgtttcaacaatacaacctctttccgcacaaaaccgccttggaaaacgtaatggaaggaccggttgccgtacagggcaagcctgccgcccaagcgcgcgaagaggctctgaaactgctggaaaaagtcggcttgggcgacaaagtggatttgtatccctaccagctttccggcggtcagcagcagcgcgtcggcattgcccgcgcattggcgattcagcctgaactgatgctgtttgacgaaccgacttccgcgctcgatcctgaattggtgcaagatgttttggataccatgaaggaattggcgcaagaaggctggaccatggttgtcgttacgcatgaaatcaagttcgccttagaagtggcaaccaccgtcgtcgtgatggacggcggcgttattgtcgaacaaggcagcccgcaagatttgttcgaccaccccaaacacgaacggacgcggagatttttaagccaaatccaatctaccaagatttga

SEQ ID NO: 454 - protein, 251 aa, Neisseria meningitidis
MIKIRNIHKTFGENTILRGIDLDVCKGQVVVILGPSGSGKTTFLRCLNALEMPEDGQIEFDNERPLKIDFSKKPSKHDILALRRKSGMVFQQYNLFPHKTALENVMEGPVAVQGKPAAQAREEALKLLEKVGLGDKVDLYPYQLSGGQQQRVGIARALAIQPELMLFDEPTSALDPELVQDVLDTMKELAQEGWTMVVVTHEIKFALEVATTVVVMDGGVIVEQGSPQDLFDHPKHERTRRFLSQIQSTKI

SEQ ID NO: 455 - DNA, 756 bp, Neisseria meningitidis
atgattaaaatccgcaatatccataagaccttcggcaaaaataccattttgcgcggcatcaatttggatgtgtgcaaagggcaggtggtcgtcatcctcgggccttccggctcaggcaaaacgacgtttctgcgatgcctaaacgcgttggaaatgcccgaagacggacaaatcgagttcgacaacgagcgaccgctgaaaatcgatttttctaaaaaaccaagcaaacacgatattttggcactgcgccgcaaatcaggcatggtgtttcaacaatacaacctctttccgcacaaaaccgccttggaaaacgtgatggaaggaccggttgccgtacagggcaagcctgccgcccaagcgcgcgaagaggctctgaaactgctggaaaaagtcggcttgggcgacaaagtggatttgtatccctaccagctttccggcggtcagcagcagcgcgtcggcattgcccgagcattggcgattcagcccgagctgatgttgtttgacgaacccacttccgcgcttgaccccgagttggtgcaagacgtgttgaacgccatgaaggaattggcgcgggaaggttggacgatggtcgtcgttacccacgaaatcaagttcgcgctggaagttgccacgaccgttgtcgtgatggacggcggcgttatcgtagagcagggcagcccgaaagagttgttcgaccaccccaaacacgaacggacgcggagatttttaagccaaatccaatctaccaagatttga

SEQ ID NO: 456 - protein, 251 aa, Neisseria meningitidis
MIKIRNIHKTFGKNTILRGINLDVCKGQVVVILGPSGSGKTTFLRCLNALEMPEDGQIEFDNERPLKIDFSKKPSKHDILALRRKSGMVFQQYNLFPHKTALENVMEGPVAVQGKPAAQAREEALKLLEKVGLGDKVDLYPYQLSGGQQQRVGIARALAIQPELMLFDEPTSALDPELVQDVLNAMKELAREGWTMVVVTHEIKFALEVATTVVVMDGGVIVEQGSPKELFDHPKHERTRRFLSQIQSTKI

SEQ ID NO: 457 - DNA, 1032 bp, Neisseria gonorrhoeae
atgtcgggcaatgcctcctctccttcatcttccgccgccatcgggctggtttggttcggcgcggcggtatcgattgccgaaatcagcacgggtacgctgctcgcccccttgggctggcagcgcggtctggcggccctgcttttgggtcatgccgtcggcggcgcgctgttttttgcggcggcgtatatcggcgcactgaccggacgcagctcgatggaaagtgtgcgcctgtcgttcggcaaatgcggttcagtgctgttttccgtggcgaatatgctgcaactggccggctggacggcggtgatgatttacgtcggcgcaacggtcagctccgctttgggcaaagtgttgtgggacggcgaatcctttgtctggtgggcattggcaaacggcgcactgatcgtgctgtggctggttttcggcgcacgcagaacgggcgggctgaaaaccgtttcgatgctgctgatgctgcttgccgtgttgtggttgagcgtcgaagtgttcgcttcgtccggcacaaacgccgcgcccgccgtttcagacggcatgaccttcggaacggcagtcgaactgtccgccgtcatgccgctttcctggctgccgctggccgccgactacacgcgccaagcacgccgcccgtttgcggcaaccctgacggcaacgctcgcctatacgctgacgggctgctggatgtatgccttgggtttggcggcggctctgtttaccggagaaaccgacgtggcgaaaatcctgttgggcgcgggcttgggcataacgggcattctggcagtcgtcctctccaccgttaccacaacgtttctcgatacctattccgccggcgcgagtgcgaacaacatttccgcgcgttttgcggaaatacccgtcgctgtcggcgttaccctgatccgcaccgtgcttgccgtcatgctgcccgttaccgaatataaaaacttcctgctgcttatccgctcggtatttgggccgatggcgggtggttttgattgccgacttttttgtcttaaaacggcgtga

SEQ ID NO: 458 - protein, 1 aa, Neisseria gonorrhoeae
C

SEQ ID NO: 459 - DNA, 1029 bp, Neisseria meningitidis
atgtcgggcaatgcctcctctccttcatcttcctccgccatcgggctgatttggttcggcgcggcggtatcgattgccgaaatcagcacgggtacgctgcttgcgcctttgggctggcagcgcggtctggcggctctacttttgggtcatgccgtcggcggcgcgctgttttttgcggcggcgtatatcggcgcactgaccggacgcagctcgatggaaagcgtgcgcctgtcgttcggcaaacgcggttcagtgctgttttccgtggcgaatatgctgcaactggccggctggacggcggtgatgatttacgccggcgcaacggtcagctccgctttgggcaaagtgttgtgggacggcgaatcttttgtctggtgggcattggcaaacggcgcgctgattgtgctgtggctggttttcggcgcacgcaaaacaggcgggctgaaaaccgtttcgatgctgctgatgctgttggcggttctgtggctgagtgccgaagtcttttccacggcaggcagcaccgccgcacaggtttcagacggcatgagtttcggaacggcagtcgagctgtccgccgtgatgccgctttcctggctgccgcttgccgccgactacacgcgccacgcgcgccgcccgtttgcggcaaccctgacggcaacgctcgcctacacgctgaccggctgctggatgtatgccttgggtttggcagcggcgttgttcaccggagaaaccgacgtggcaaaaatcctgctgggcgcargtttgggtgcggcaggcattttggcggtcgtcctctccaccgttaccacaacgtttctcgatgcctattccgccggcgcgagtgcgaacaacatttccgcgcgttttgcggaaacacccgtcgctgtcrgcgttaccctgatcggcacggtacttgccgtcatgctgcccgttaccgaatatgaaaacttcctgctgcttatcggctcggtatttgcgccgatggcgggcggttttgattgccgactttttcgtcttgaaacggcgtga

SEQ ID NO: 460 - protein, 342 aa, Neisseria meningitidis
  misc_feature (254)..(254): Xaa can be any naturally occurring amino acid
  misc_feature (297)..(297): Xaa can be any naturally occurring amino acid
MSGNASSPSSSSAIGLIWFGAAVSIAEISTGTLLAPLGWQRGLAALLLGHAVGGALFFAAAYIGALTGRSSMESVRLSFGKRGSVLFSVANMLQLAGWTAVMIYAGATVSSALGKVLWDGESFVWWALANGALIVLWLVFGARKTGGLKTVSMLLMLLAVLWLSAEVFSTAGSTAAQVSDGMSFGTAVELSAVMPLSWLPLAADYTRHARRPFAATLTATLAYTLTGCWMYALGLAAALFTGETDVAKILLGAXLGAAGILAVVLSTVTTTFLDAYSAGASANNISARFAETPVAVXVTLIGTVLAVMLPVTEYENFLLLIGSVFAPMAGGFDCRLFRLETA

SEQ ID NO: 461 - DNA, 1028 bp, Neisseria meningitidis
atgtcgggcaatgcctcctctccttcatcttccgccgccatcgggctgatttggttcggcgcggcggtatcgattgccgaaatcagcacgggtacactgcttgcgcctttgggctggcagcgcggtctggcggctctgcttttgggtcatgccgtcggcggcgcgctgttttttgcggcggcgtatatcggcgcactgaccggacgcagctcgatggaaagcgtgcgcctgtcgttcggcaaacgcggttcagtgctgttttccgtggcgaatatgctgcaactggccggctggacggcggtgatgatttacgccggcgcaacggtcagctccgctttgggcaaagtgttgtgggacggcgaatcttttgtctggtgggcattggcaaacggcgcgctgattgtgctgtggctggttttcggcgcacgcaaaacaggcgggctgaaaaccgtttcgatgctgctgatgctgttggcggttctgtggctgagtgccgaagtcttttccacggcaggcagcaccgccgcacaggtttcagacggcatgagtttcggaacggcagtcgagctgtccgccgtgatgccgctttcttggctgccgctggccgccgactacacgcgccacgcgcgccgcccgtttgcggcaaccctgacggcaacgctcgcctacacgctgaccggctgctggatgtatgccttgggtttggcagcggcgttgttcaccggagaaaccgacgtggcaaaaatcctgctgggcgcaggtttgggtgcggcaggcattttggcggtcgtcctgtcgaccgttaccaccacttttctcgatgcctactccgccggcgtaagtgccaacaatatttccgccaaactttcggaaatacccatcgccgttgccgtcgccgttgtcggcacactgcttgccgtcctcctgcccgttaccgaatatgaaaacttcctgctgcttatcggctcggtatttgcgccgatggcggcggttttgattgccgactttttcgtcttgaaacggcgtga

SEQ ID NO: 462 - protein, 342 aa, Neisseria meningitidis
  misc_feature (330)..(330): Xaa can be any naturally occurring amino acid
MSGNASSPSSSAAIGLIWFGAAVSIAEISTGTLLAPLGWQRGLAALLLGHAVGGALFFAAAYIGALTGRSSMESVRLSFGKRGSVLFSVANMLQLAGWTAVMIYAGATVSSALGKVLWDGESFVWWALANGALIVLWLVFGARKTGGLKTVSMLLMLLAVLWLSAEVFSTAGSTAAQVSDGMSFGTAVELSAVMPLSWLPLAADYTRHARRPFAATLTATLAYTLTGCWMYALGLAAALFTGETDVAKILLGAGLGAAGILAVVLSTVTTTFLDAYSAGVSANNISAKLSEIPIAVAVAVVGTLLAVLLPVTEYENFLLLIGSVFAPMAXGFDCRLFRLETA

SEQ ID NO: 463 - DNA, 867 bp, Neisseria gonorrhoeae
atgccgtctgaaaccccaaaggcacgccgccggctttcagacggcatcgcgtccgacaaccataccaaagaatccatcatgctcaccctgtacggcgaaactttcccttcgcggctgctgctcggcacggcggcctacccgacccctgaaatcctcaaacaatccgtccgaaccgcccggcccgcgatgattaccgtctcgctgcgccgcacgggatgcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggataaaattggaactcatcggcgacgacgacaccttgcagccggacgtgttccaactcgtcgaagcggcggaaatcctgattaaagacggcttcaaagtgctgccttattgcaccgaagacctgattgcctgccgccgcctgctcgatgcgggctgtcaggcgttgatgccgtgggcggctcccatcggcacgggtttgggggcggttcacgcctatgcgctcaaaatcctgcgcgaacgcctgcccgacacgccgctgattatcgacgcgggcttgggtttgccttcccaagcggcacaagtgatggaatggggttttgacggcgtattgttaaacaccgccgtttcccgcagcggcgaccccgtcaacatggcgcgcgccttcgcactcgccgtcgaatccggacggctggcatttgaagccgggccggtcgaagcgcgaaccaaagcccaagccagcacgccgacagtcggacaaccgttttggcattcggcggaatattga

SEQ ID NO: 464 - protein, 288 aa, Neisseria gonorrhoeae
MPSETPKARRRLSDGIASDNHTKESIMLTLYGETFPSRLLLGTAAYPTPEILKQSVRTARPAMITVSLRRTGCGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALKILRERLPDTPLIIDAGLGLPSQAAQVMEWGFDGVLLNTAVSRSGDPVNMARAFALAVESGRLAFEAGPVEARTKAQASTPTVGQPFWHSAEY

SEQ ID NO: 465 - DNA, 810 bp, Neisseria gonorrhoeae
cactatacaaaggaacccattatgctcaccctatacggcgaaactttcccctcgcggctgctgctcggcacggctgcctacccgacccccgaaatcctcaaacaatccatccaaaccgcccagcctgcgatgattaccgtctcgctgcgccgcgcgggaagcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggataaaattggaactcatcggagatgacgacaccttgcagccggatgtgttccagcttgtcgaagcggcggaaatcctgattaaagacggcttcaaagtgctgccttattgcaccgaagacctgattgcctgccgccgcctgctcgacgcgggctgtcaggcgttgatgccgtgggcggccccgatcggcacgggtttgggcgcggttcacgcctacgcgttgaacgtcctgcgcgaacgcctgcccgacacgccgctgattatcgacgcgggcttgggtttgccctcacaggcggcacaagtgatggaatggggctttgacggcgtgcttttgaatactgccgtttcccgcagcggcgatccggtcaatatggcacgcgccttcgcactcgccgtcgaatccggacggctggcatttgaagccggaccggtcgaagcacgcgacaaagcgcaagccagcacgccgacagtcggacaaccgttttggcattcggcggaatattga

SEQ ID NO: 466 - protein, 269 aa, Neisseria meningitidis
HYTKEPIMLTLYGETFPSRLLLGTAAYPTPEILKQSIQTAQPAMITVSLRRAGSGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALNVLRERLPDTPLIIDAGLGLPSQAAQVMEWGFDGVLLNTAVSRSGDPVNMARAFALAVESGRLAFEAGPVEARDKAQASTPTVGQPFWHSAEY

SEQ ID NO: 467 - DNA, 819 bp, Neisseria meningitidis
ttgttaatccactatacaaaggaacccattatgctcaccctgtacagcgaaactttcccttcgcggctgctgctcggcacagccgcctacccgacccctgaaatcctcaaacaatccgtccgaaccgcccggcccgcgatgattaccgtctcgctgcgccgcgcgggatgcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggattaaactcgaactcatcggcgacgacgacaccttgcagccggatgtgttccaacttgtcgaagcggcggaaatcctgattaaagacggcttcaaagtgctgccttattgcaccgaagacctgattgcctgccgccgcctgctcgacgcgggctgtcaggcgttgatgccgtgggcggccccgatcggcacgggtttgggcgcggttcacgcctacgcgttgaacgtcctgcgcgaacgcctgcccgacacgccgctgattatcgacgcgggcttgggtttgccctcacaggcggcacaagtgatggaatggggctttgacggcgtgcttttgaatactgccgtttcccgcagcggcgatccggtcaatatggcacgcgccttcgcactcgccgtcgaatccggacggctggcatttgaagccggaccggtcgaagcacgcgacaaagcgcaagccagcacgccgacagtcggacaaccgttttggcattcggcggaatattga

SEQ ID NO: 468 - protein, 272 aa, Neisseria meningitidis
LLIHYTKEPIMLTLYSETFPSRLLLGTAAYPTPEILKQSVRTARPAMITVSLRRAGCGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALNVLRERLPDTPLIIDAGLGLPSQAAQVMEWGFDGVLLNTAVSRSGDPVNMARAFALAVESGRLAFEAGPVEARDKAQASTPTVGQPFWHSAEY

SEQ ID NO: 469 - DNA, 789 bp, Neisseria gonorrhoeae
atgctcaccctgtacggcgaaactttcccttcgcggctgctgctcggcacggccgcctacccgacccctgaaatcctcaaacaatccgtccgaaccgcccggcccgcgatgattaccgtctcgctgcgccgcacgggatgcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggataaaattggaactcatcggcgacgacgacaccttgcagccggacgtgttccaactcgtcgaagcggcggaaatcctgattaaagacggcttcaaagtgctgccttattgcaccgaagacctgattgcctgccgccgcctgctcgatgcgggctgtcaggcgttgatgccgtgggcggctcccatcggcacgggtttgggggcggttcacgcctatgcgctcaaaatcctgcgcgaacgcctgcccgacacgccgctgattatcgacgcgggcttgggtttgccttcccaagcggcacaagtgatggaatggggttttgacggcgtattgttaaacaccgccgtttcccgcagcggcgaccccgtcaacatggcgcgcgccttcgcactcgccgtcgaatccggacggctggcatttgaagccgggccggtcgaagcgcgaaccaaagcccaagccagcacgccgacagtcggacaaccgttttggcattcggcggaatattga

SEQ ID NO: 470 - protein, 262 aa, Neisseria gonorrhoeae
MLTLYGETFPSRLLLGTAAYPTPEILKQSVRTARPAMITVSLRRTGCGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALKILRERLPDTPLIIDAGLGLPSQAAQVMEWGFDGVLLNTAVSRSGDPVNMARAFALAVESGRLAFEAGPVEARTKAQASTPTVGQPFWHSAEY

SEQ ID NO: 471 - DNA, 789 bp, Neisseria meningitidis
atgctcaccctatacggcgaaactttcccctcgcggctgctgctcggcacggctgcctacccgacccccgaaatcctcaaacaatccatccaaaccgcccagcctgcgatgattaccgtctcgctgcgccgcgcgggaagcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggataaaattggaactcatcggagatgacgacaccttgcagccggatgtgttccagcttgtcgaagcggcggaaatcctgattaaagacggcttcaaagtgctgccttattgcaccgaagacctgattgcctgccgccgcctgctcgacgcgggctgtcaggcgttgatgccgtgggcggccccgatcggcacgggtttgggcgcggttcacgcctacgcgttgaacgtcctgcgcgaacgcctgcccgacacgccgctgattatcgacgcgggcttgggtttgccctcacaggcggcacaagtgatggaatggggctttgacggcgtgcttttgaatactgccgtttcccgcagcggcgatccggtcaatatggcacgcgccttcgcactcgccgtcgaatccggacggctggcatttgaagccggaccggtcgaagcacgcgacaaagcgcaagccagcacgccgacagtcggacaaccgttttggcattcggcggaatattga

SEQ ID NO: 472 - protein, 262 aa, Neisseria meningitidis
MLTLYGETFPSRLLLGTAAYPTPEILKQSIQTAQPAMITVSLRRAGSGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALNVLRERLPDTPLIIDAGLGLPSQAAQVMEWGFDGVLLNTAVSRSGDPVNMARAFALAVESGRLAFEAGPVEARDKAQASTPTVGQPFWHSAEY

SEQ ID NO: 473 - DNA, 789 bp, Neisseria meningitidis
atgctcaccctgtacagcgaaactttcccttcgcggctgctgctcggcacagccgcctacccgacccctgaaatcctcaaacaatccgtccgaaccgcccggcccgcgatgattaccgtctcgctgcgccgcgcgggatgcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggattaaactcgaactcatcggcgacgacgacaccttgcagccggatgtgttccaacttgtcgaagcggcggaaatcctgattaaagacggcttcaaagtgctgccttattgcaccgaagacctgattgcctgccgccgcctgctcgacgcgggctgtcaggcgttgatgccgtgggcggccccgatcggcacgggtttgggcgcggttcacgcctacgcgttgaacgtcctgcgcgaacgcctgcccgacacgccgctgattatcgacgcgggcttgggtttgccctcacaggcggcacaagtgatggaatggggctttgacggcgtgcttttgaatactgccgtttcccgcagcggcgatccggtcaatatggcacgcgccttcgcactcgccgtcgaatccggacggctggcatttgaagccggaccggtcgaagcacgcgacaaagcgcaagccagcacgccgacagtcggacaaccgttttggcattcggcggaatattga

SEQ ID NO: 474 - protein, 262 aa, Neisseria meningitidis
MLTLYSETFPSRLLLGTAAYPTPEILKQSVRTARPAMITVSLRRAGCGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALNVLRERLPDTPLIIDAGLGLPSQAAQVMEWGFDGVLLNTAVSRSGDPVNMARAFALAVESGRLAFEAGPVEARDKAQASTPTVGQPFWHSAEY

SEQ ID NO: 475 - DNA, 873 bp, Neisseria gonorrhoeae
atggaaatatggaatatgttgaacacttggcccgatgccgtcccgatacgcgcggaggcggccgaatccgtggcggcggtcgcggctttgctgctggcgcgcgcccttctgttgaatatccacttcagacggcatccggatttcggcatcgaaagcaagcggcggtttttggttgccagccgcaatataacgctgcttttggtgctgttttcgctggcatttatctggtcggcgcaaattcaaacgctggctttgtcgatgtttgcggtggcggcggcggtcgtcgtggcgacaaaagaactgattatgtgtctgtcgggcagtattttaaggtctgccacccagcaatactcggtcggcgactatatcgaaatcaacggcctgcgcgggcgcgtggtcgacatcaatctgttgaacacgctgatgatgcaggtcggtccgaaccccttggtcggacagcttgcgggaaccaccgtttctttccccaacagcctgttgttgagccaccccgtgcgccgcgacaatattttgggcgactatgtcatccatacggtcgaaatccccgttcccatccatttggattcggatgaagccgtatgccgtctgaaagccgtactcgagcccttgtgcgcgccctacatccccgccattcagcggtatttggaaaacgtgcaggcggaaaaactgtttatcacgcccgccgccaggccgcgcgttacccgcgtaccgtacgacgacaaggcataccgcatcatcgtccgcttcgcctcccccgtttcaaagcggctggaaatccaacaggcggttatggacgaatttttgcgcgtacaataccgcctgttaaatcatcccgccggctccgaaacactttaa

SEQ ID NO: 476 - protein, 290 aa, Neisseria gonorrhoeae
MEIWNMLNTWPDAVPIRAEAAESVAAVAALLLARALLLNIHFRRHPDFGIESKRRFLVASRNITLLLVLFSLAFIWSAQIQTLALSMFAVAAAVVVATKELIMCLSGSILRSATQQYSVGDYIEINGLRGRVVDINLLNTLMMQVGPNPLVGQLAGTTVSFPNSLLLSHPVRRDNILGDYVIHTVEIPVPIHLDSDEAVCRLKAVLEPLCAPYIPAIQRYLENVQAEKLFITPAARPRVTRVPYDDKAYRIIVRFASPVSKRLEIQQAVMDEFLRVQYRLLNHPAGSETL

SEQ ID NO: 477 - DNA, 873 bp, Neisseria meningitidis
atggaaatatggaatatgttggacacttggctcggtgccgtcccgatacgtgcggaggcggtcgaatccgtggcggcggttgcggctttgctgctggcgcgcgcccttctgttgaatatccacttcaaacggcatccggatttcggcatcgaaagcaagcggcggtttttggttgccagccgcaatataacgctgcttttggtgctgttttcgctggcatttatctggtcggcgcaaatccaaacgctggctttgtcgatgtttgcggtggcggcggcggtcgtcgtggcgacgaaggaactgattatgtgtctgtcgggcagtattttaaggtctgccacccagcaatactcggtcggcgactatatcgaaatcaacggcctgcgcgggcgcgtggtcgacatcaacctgttgaacacgctgatgatgcaggtcggtccgaaccccttggtcggacagcttgcgggaaccaccgtttctttccccaacagcctgttgttgagccaccccgtgcgccgcgacaatattttgggcgactatgtcatccatacggtcgaaatccccgttcccatccatttggattcggatgaagccgtatgccgtctgaaagccgtactcgagcccttgtgcgcgccctacatccccgccatccaacggsatttggaaaacgtgcaggcggaaaaactgtttatcacgcccgccgccagaccgcgcgttacccgcgtgccgtacgatgacaaggcataccgcatcatcgtccgcttcgcttcccccgtttcaaagcggctggaaatccaacaggcggttatggacgaatttttgcgcgtacaataccgcctgttaaatcaccccgccggctccgaaacactttaa

SEQ ID NO: 478 - protein, 290 aa, Neisseria meningitidis
  misc_feature (220)..(220): Xaa can be any naturally occurring amino acid
MEIWNMLDTWLGAVPIRAEAVESVAAVAALLLARALLLNIHFKRHPDFGIESKRRFLVASRNITLLLVLFSLAFIWSAQIQTLALSMFAVAAAVVVATKELIMCLSGSILRSATQQYSVGDYIEINGLRGRVVDINLLNTLMMQVGPNPLVGQLAGTTVSFPNSLLLSHPVRRDNILGDYVIHTVEIPVPIHLDSDEAVCRLKAVLEPLCAPYIPAIQRXLENVQAEKLFITPAARPRVTRVPYDDKAYRIIVRFASPVSKRLEIQQAVMDEFLRVQYRLLNHPAGSETL

SEQ ID NO: 479 - DNA, 873 bp, Neisseria meningitidis
atggaaatatggaatatgttggacacttggctcggtgccgtcccgatacgtgcggaggcggtcgaatccgtggcggtggtcgcggctttgctgctggcgcgcgcccttctgttgaatatccacttcaaacggcatccggatttcggcatcgaaagcaagcggcggtttttggttgccagccgcaatataacgctgcttttggtgctgttttcgctggcatttatctggtcggcgcaaatccaaacgctggctttgtcgatgtttgcggtggcggcggcggtcgtcgtggcgacgaaggaactgattatgtgtctgtcgggcagcattttaaggtctgccacccagcaatactcggtcggcgactatatcgaaatcaacggcctgcgcgggcgcgtggtcgacatcaacctgttgaacacgctgatgatgcaggtcggtccgaaccccttggtcggacagcttgcgggaaccaccgtttctttccccaacagcctgttgttgagccaccccgtgcgccgcgacaatattttgggcgactacgtcatccatacggtcgaaatcccggttcccatccatttggattcggatgaagccgtatgccgtctgaaagccgtactcgagcccttgtgcgcgccctacatccccgccatccaacggcatttggaaaacgtgcaggcggaaaaactgtttatcacgcccgccgccaaaccgcgcgttacccgcgtgccgtacgatgacaaggcataccgcatcatcgtccgcttcgcctcccccgtttcaaagcggctggaaatccaacaggcggttatggacgaatttttgcgcgtacaataccgcctgttaaattaccccgccggctccgaaacactttaa

SEQ ID NO: 480 - protein, 290 aa, Neisseria meningitidis
MEIWNMLDTWLGAVPIRAEAVESVAVVAALLLARALLLNIHFKRHPDFGIESKRRFLVASRNITLLLVLFSLAFIWSAQIQTLALSMFAVAAAVVVATKELIMCLSGSILRSATQQYSVGDYIEINGLRGRVVDINLLNTLMMQVGPNPLVGQLAGTTVSFPNSLLLSHPVRRDNILGDYVIHTVEIPVPIHLDSDEAVCRLKAVLEPLCAPYIPAIQRHLENVQAEKLFITPAAKPRVTRVPYDDKAYRIIVRFASPVSKRLEIQQAVMDEFLRVQYRLLNYPAGSETL

SEQ ID NO: 481 - DNA, 2037 bp, Neisseria gonorrhoeae
atgattgacaacgcactgctccacttgggcgaagaaccccgttttaatcaaatccaaaccgaagacatcaaacccgccgtccaaaccgccatcgccgaagcgcgcggacaaatcgccgccgtcaaagcgcaaacgcacaccggctgggcgaacaccgtcgagcgtctgaccggcatcaccgaacgcgtcggcaggatttggggcgtcgtgtcccatctcaactccgtcgtcgacacgcccgaactgcgcgccgtctataacgaactgatgcctgaaatcaccgtcttcttcaccgaaatcggacaagacatcgaactgtacaaccgcttcaaaaccatcaaaaattcccccgaatttgcaacgctttcccccgcacaaaaaaccaagctcgatcacgacctgcgcgatttcgtattgagcggcgcggaactgccgcccgaacggcaggcagaactggcaaaactgcaaaccgaaggcgcgcaactttccgccaaattctcccaaaacgtcctagacgcgaccgacgcgttcggcatttactttgacgatgccgcaccgcttgccggcattcccgaagacgcgctcgccatgtttgccgccgccgcgcaaagcgaaggcaaaacaggttacaaaatcggcttgcagattccgcactaccttgccgttatccaatacgccggcaaccgcgaactgcgcgaacaaatctaccgcgcctacgttacccgtgccagcgaactttcaaacgacggcaaattcgacaacaccgccaacatcgaccgcacgctcgaaaacgcattgaaaaccgccaaactgctcggctttaaaaattacgccgaattgtcgctggcaaccaaaatggcggacacgcccgaacaggttttaaacttcctgcacgacctcgcccgccgcgccaaaccctacgccgaaaaagacctcgccgaagtcaaagccttcgcccgcgaacacctcggtctcgccgacccgcagccgtgggacttgagctacgccggcgaaaaactgcgcgaagccaaatacgcattcagcgaaaccgaagtcaaaaaatacttccccgtcggcaaagttctggcaggcctgttcgcccaaatcaaaaaactctacggcatcggattcgccgaaaaaaccgttcccgtctggcacaaagacgtgcgctattttgaattgcaacaaaacggcaaaaccatcggcggcgtttatatggatttgtacgcacgcgaaggcaaacgcggcggcgcgtggatgaacgactacaaaggccgccgccgctttgccgacggcacgctgcaactgcccaccgcctacctcgtctgcaacttcgccccgcccgtcggcggcaaagaagcgcgtttaagccacgacgaaatcctcaccctcttccacgaaaccggccacggactgcaccacctgcttacccaagtggacgaactgggcgtgtccggcatcaacggcgtagaatgggacgcggtcgaactgcccagccagtttatggaaaacttcgtttgggaatacaatgtattggcacaaatgtccgcccacgaagaaaccggcgagcccctgccgaaagaactcttcgacaaaatgctcgccgccaaaaacttccagcgcggtatgttcctcgtccggcaaatggagttcgccctcttcgatatgatgatttacagtgaaagcgacgaatgccgtctgaaaaactggcagcaggttttagacagcgtgcgcaaagaagtcgccgtcatccaaccgcccgaatacaaccgcttcgccaacagcttcggccacatcttcgccggcggctattccgcaggctattacagctacgcatgggccgaagtcctcagcaccgatgcctacgccgcctttgaagaaagcgacgacgtcgccgccacaggcaaacgcttctggcaagaaatccttgccgtcggcggctcccgcagcgcggcggaatccttcaaagccttccgcggacgcgaaccgagcatagacgcactgctgcgccaaagcggtttcgacaacgcggcttga

SEQ ID NO: 482 - protein, 678 aa, Neisseria gonorrhoeae
MIDNALLHLGEEPRFNQIQTEDIKPAVQTAIAEARGQIAAVKAQTHTGWANTVERLTGITERVGRIWGVVSHLNSVVDTPELRAVYNELMPEITVFFTEIGQDIELYNRFKTIKNSPEFATLSPAQKTKLDHDLRDFVLSGAELPPERQAELAKLQTEGAQLSAKFSQNVLDATDAFGIYFDDAAPLAGIPEDALAMFAAAAQSEGKTGYKIGLQIPHYLAVIQYAGNRELREQIYRAYVTRASELSNDGKFDNTANIDRTLENALKTAKLLGFKNYAELSLATKMADTPEQVLNFLHDLARRAKPYAEKDLAEVKAFAREHLGLADPQPWDLSYAGEKLREAKYAFSETEVKKYFPVGKVLAGLFAQIKKLYGIGFAEKTVPVWHKDVRYFELQQNGKTIGGVYMDLYAREGKRGGAWMNDYKGRRRFADGTLQLPTAYLVCNFAPPVGGKEARLSHDEILTLFHETGHGLHHLLTQVDELGVSGINGVEWDAVELPSQFMENFVWEYNVLAQMSAHEETGEPLPKELFDKMLAAKNFQRGMFLVRQMEFALFDMMIYSESDECRLKNWQQVLDSVRKEVAVIQPPEYNRFANSFGHIFAGGYSAGYYSYAWAEVLSTDAYAAFEESDDVAATGKRFWQEILAVGGSRSAAESFKAFRGREPSIDALLRQSGFDNAA

SEQ ID NO: 483 - DNA, 1431 bp, Neisseria meningitidis
  misc_feature (1216)..(1216): n is a, c, g, or t
  misc_feature (1334)..(1334): n is a, c, g, or t
  misc_feature (1347)..(1347): n is a, c, g, or t
atgactgacaacgcactgctccatttgggcgaagaaccccgttttgatcaaatcaaaaccgaagacatcaaacccgccctgcaaaccgccatcgccgaagcgcgcgaacaaatcgccgccatcaaagcccaaacgcacaccggctgggcaaacactgtcgaacccctgaccggcatcaccgaacgcgtcggcaggatttggggcgtggtgtcgcacctcaactgcgtcgccgacacgcccgaactgcgcgccgtctataacgaactgatgcccgaaatcaccgtcttcttcaccgaaatcggacaagacatcgagctgtacaaccgcttcaaaaccatcaaaaattcccccgaattcgacaccctctcccccgcacaaaaaaccaaactcaaccactacgccagcgaaaaactgcgcgaagccaaatacgcgttcagcgaaaccgawgtcaaaaaatayttcccygtcggcaawgtattaaacggactgttcgcccaamtcaaaaaactmtacggcatcggatttaccgaaaaaacygtccccgtctggcacaaagacgtgcgctattktgaattgcaacaaaacggcgaamccataggcggcgtttatatggatttgtacgcacgcgaaggcaaacgcggcggcgcgtggatgaacgactacaaaggccgccgccgtttttcagacggcacgctgcaaytgcccaccgcctacctcgtctgcaacttcgccccacccgtcggcggcagggaagcccgcytgagccacgacgaaatcctcatcctcttccacgaaaccggacacgggctgcaccacctgcttacccaagtggacgaactgggcgtatccggcatcaacggcgtakaatgggacgcggtcgaactgcccagccagtttatggaaaatttcgtttgggaatacaatgtcttggcacaamtgtcagcccacgaagaaaccggcgttcccytgccgaaagaactcttsgacaaawtgctcgccgccaaaaacttccaasgcggcatgttcytsgtccggcaawtggagttcgccctctttgatatgatgatttacagcgaagacgacgaaggccgtctgaaaaactggcaacaggttttagacagcgtgcgcaaaaaagtcgccgtcatccagccgcccgaatacaaccgcttcgccttgagcttcggccacatcttcgcaggcggctattccgcagctnattacagctacgcgtgggcggaagtattgagcgcggacgcatacgccgcctttgaagaaagcgacgatgtcgccgccacaggcaaacgcttttggcaggaaatcctcgccgtcggggnatcgcgcagcggngcagaatccttcaaagccttccgcggccgcgaaccgagcatagacgcactcttgcgccacagcggtttcgacaacgcggtctga

SEQ ID NO: 484 - protein, 476 aa, Neisseria meningitidis
  misc_feature (149)..(149): Xaa can be any naturally occurring amino acid
  misc_feature (158)..(158): Xaa can be any naturally occurring amino acid
  misc_feature (167)..(167): Xaa can be any naturally occurring amino acid
  misc_feature (190)..(190): Xaa can be any naturally occurring amino acid
  misc_feature (198)..(198): Xaa can be any naturally occurring amino acid
  misc_feature (289)..(289): Xaa can be any naturally occurring amino acid
  misc_feature (313)..(313): Xaa can be any naturally occurring amino acid
  misc_feature (328)..(328): Xaa can be any naturally occurring amino acid
  misc_feature (331)..(331): Xaa can be any naturally occurring amino acid
  misc_feature (339)..(339): Xaa can be any naturally occurring amino acid
  misc_feature (343)..(343): Xaa can be any naturally occurring amino acid
  misc_feature (347)..(347): Xaa can be any naturally occurring amino acid
  misc_feature (406)..(406): Xaa can be any naturally occurring amino acid
  misc_feature (445)..(445): Xaa can be any naturally occurring amino acid
MTDNALLHLGEEPRFDQIKTEDIKPALQTAIAEAREQIAAIKAQTHTGWANTVEPLTGITERVGRIWGVVSHLNCVADTPELRAVYNELMPEITVFFTEIGQDIELYNRFKTIKNSPEFDTLSPAQKTKLNHYASEKLREAKYAFSETXVKKYFPVGXVLNGLFAQXKKLYGIGFTEKTVPVWHKDVRYXELQQNGEXIGGVYMDLYAREGKRGGAWMNDYKGRRRFSDGTLQLPTAYLVCNFAPPVGGREARLSHDEILILFHETGHGLHHLLTQVDELGVSGINGVXWDAVELPSQFMENFVWEYNVLAQXSAHEETGVPLPKELXDKXLAAKNFQXGMFXVRQXEFALFDMMIYSEDDEGRLKNWQQVLDSVRKKVAVIQPPEYNRFALSFGHIFAGGYSAAXYSYAWAEVLSADAYAAFEESDDVAATGKRFWQEILAVGXSRSGAESFKAFRGREPSIDALLRHSGFDNAV

SEQ ID NO: 485 - DNA, 2037 bp, Neisseria meningitidis
atgactgacaacgcactgctccatttgggcgaagaaccccgttttgatcaaatcaaaaccgaagacatcaaacccgccctgcaaaccgccattgccgaagcgcgcgaacaaatcgccgccatcaaagcccaaacgcacaccggctgggcaaacactgtcgaacccctgaccggcatcaccgaacgcgtcggcaggatttggggcgtggtgtcgcacctcaactccgtcaccgacacgcccgaactgcgcgccgcctacaatgaattaatgcccgaaattaccgtcttcttcaccgaaatcggacaagacatcgagctgtacaaccgcttcaaaaccatcaaaaactcccccgagttcgacaccctctcccacgcgcaaaaaaccaaactcaaccacgatctgcgcgatttcgtcctcagcggcgcggaactgccgcccgaacagcaggcagaattggcaaaactgcaaaccgaaggcgcgcaactttccgccaaattctcccaaaacgtcctagacgcgaccgacgcgttcggcatttactttgacgatgccgcaccgcttgccggcattcccgaagacgcgctcgccatgtttgccgctgccgcgcaaagcgaaggcaaaacaggctacaaaatcggtttgcagattccgcactacctcgccgtcatccaatacgccgacaaccgcaaactgcgcgaacaaatctaccgcgcctacgttacccgcgccagcgagctttcagacgacggcaaattcgacaacaccgccaacatcgaccgcacgctcgaaaacgccctgcaaaccgccaaactgctcggcttcaaaaactacgccgaattgtcgctggcaaccaaaatggcggacacccccgaacaagttttaaacttcctgcacgacctcgcccgccgcgccaaaccctacgccgaaaaagacctcgccgaagtcaaagccttcgcccgcgaaagcctcggcctcgccgatttgcaaccgtgggacttgggctacgccggcgaaaaactgcgcgaagccaaatacgcattcagcgaaaccgaagtcaaaaaatacttccccgtcggcaaagtattaaacggactgttcgcccaaatcaaaaaactctacggcatcggatttaccgaaaaaaccgtccccgtctggcacaaagacgtgcgctattttgaattgcaacaaaacggcgaaaccataggcggcgtttatatggatttgtacgcacgcgaaggcaaacgcggcggcgcgtggatgaacgactacaaaggccgccgccgtttttcagacggcacgctgcaactgcccaccgcctacctcgtctgcaacttcaccccgcccgtcggcggcaaagaagcccgcttgagccatgacgaaatcctcaccctcttccacgaaaccggacacggcctgcaccacctgcttacccaagtcgacgaactgggcgtatccggcatcaacggcgtagaatgggacgcagtcgaactgcccagtcagtttatggaaaatttcgtttgggaatacaatgtcttggcgcaaatgtccgcccacgaagaaaccggcgttcccctgccgaaagaactcttcgacaaaatgctcgccgccaaaaacttccaacgcggaatgttcctcgtccgccaaatggagttcgccctctttgatatgatgatttacagcgaagacgacgaaggccgtctgaaaaactggcaacaggttttagacagcgtgcgcaaagaagtcgccgtcgtccgaccgcccgaatacaaccgcttcgccaacagcttcggccacatcttcgcaggcggctattccgcaggctattacagctacgcgtgggcggaagtattgagcgcggacgcatacgccgcctttgaagaaagcgacgatgtcgccgccacaggcaaacgcttttggcaggaaatcctcgccgtcggcggatcgcgcagcgcggcagaatccttcaaagccttccgcggacgcgaaccgagcatagacgcactcttgcgccacagcggcttcgacaacgcggcttga

SEQ ID NO: 486 - protein, 678 aa, Neisseria meningitidis
MTDNALLHLGEEPRFDQIKTEDIKPALQTAIAEAREQIAAIKAQTHTGWANTVEPLTGITERVGRIWGVVSHLNSVTDTPELRAAYNELMPEITVFFTEIGQDIELYNRFKTIKNSPEFDTLSHAQKTKLNHDLRDFVLSGAELPPEQQAELAKLQTEGAQLSAKFSQNVLDATDAFGIYFDDAAPLAGIPEDALAMFAAAAQSEGKTGYKIGLQIPHYLAVIQYADNRKLREQIYRAYVTRASELSDDGKFDNTANIDRTLENALQTAKLLGFKNYAELSLATKMADTPEQVLNFLHDLARRAKPYAEKDLAEVKAFARESLGLADLQPWDLGYAGEKLREAKYAFSETEVKKYFPVGKVLNGLFAQIKKLYGIGFTEKTVPVWHKDVRYFELQQNGETIGGVYMDLYAREGKRGGAWMNDYKGRRRFSDGTLQLPTAYLVCNFTPPVGGKEARLSHDEILTLFHETGHGLHHLLTQVDELGVSGINGVEWDAVELPSQFMENFVWEYNVLAQMSAHEETGVPLPKELFDKMLAAKNFQRGMFLVRQMEFALFDMMIYSEDDEGRLKNWQQVLDSVRKEVAVVRPPEYNRFANSFGHIFAGGYSAGYYSYAWAEVLSADAYAAFEESDDVAATGKRFWQEILAVGGSRSAAESFKAFRGREPSIDALLRHSGFDNAA

SEQ ID NO: 487 - DNA, 1473 bp, Neisseria gonorrhoeae
atgattgacaacgcactgctccacttgggcgaagaaccccgttttaatcaaatcaaaaccgaagacatcaaacccgccgtccaaaccgccatcgccgaagcgcgcggacaaatcgccgccgtcaaagcgcaaacgcacaccggctgggcgaacaccgtcgagcgtctgaccggcatcaccgaacgcgtcggcaggatttggggcgtcgtgtcccatctcaactccgtcgtcgacacgcccgaactgcgcgccgtctataacgaactgatgcctgaaatcaccgtcttcttcaccgaaatcggacaagacatcgaactgtacaaccgcttcaaaaccatcaaaaattcccccgaatttgcaacgctttcccccgcacaaaaaaccaagctcgatcacgacctgcgcgatttcgtattgagcggcgcggaactgccgcccgaacggcaggcagaactggcaaaactgcaaaccgaaggcgcgcaactttccgccaaattctcccaaaacgtcctagacgcgaccgacgcgttcggcatttactttgacgatgccgcaccgcttgccggcattcccgaagacgcgctcgccatgtttgccgccgccgcgcaaagcgaaggcaaaacaggttacaaaatcggcttgcagattccgcactaccttgccgttatccaatacgccggcaaccgcgaactgcgcgaacaaatctaccgcgcctacgttacccgtgccagcgaactttcaaacgacggcaaattcgacaacaccgccaacatcgaccgcacgctcgaaaacgcattgaaaaccgccaaactgctcggctttaaaaattacgccgaattgtcgctggcaaccaaaatggcggacacgcccgaacaggttttaaacttcctgcacgacctcgcccgccgcgccaaaccctacgccgaaaaagacctcgccgaagtcaaagccttcgcccgcgaacacctcggtctcgccgacccgcagccgtgggacttgagctacgccggcgaaaaactgcgcgaagccaaatacgcattcagcgaaaccgaagtcaaaaaatacttccccgtcggcaaagttctggcaggcctgttcgcccaaatcaaaaaactctacggcatcggattcgccgaaaaaaccgttcccgtctggcacaaagacgtgcgctattttgaattgcaacaaaacggcaaaaccatcggcggcgtttatatggatttgtacgcacgcgaaggcaaacgcggcggcgcgtggatgaacgactacaaaggccgccgccgctttgccgacggcacgctgcaactgcccaccgcctacctcgtctgcaacttcgccccgcccgtcggcggcaaagaagcgcgtttaagccacgacgaaatcctcaccctcttccacgaaaccggccacggactgcaccacctgcttacccaagtggacgaactgggcgtgtccggcatcaacggcgtaaaa

SEQ ID NO: 488 - protein, 491 aa, Neisseria gonorrhoeae
MIDNALLHLGEEPRFNQIKTEDIKPAVQTAIAEARGQIAAVKAQTHTGWANTVERLTGITERVGRIWGVVSHLNSVVDTPELRAVYNELMPEITVFFTEIGQDIELYNRFKTIKNSPEFATLSPAQKTKLDHDLRDFVLSGAELPPERQAELAKLQTEGAQLSAKFSQNVLDATDAFGIYFDDAAPLAGIPEDALAMFAAAAQSEGKTGYKIGLQIPHYLAVIQYAGNRELREQIYRAYVTRASELSNDGKFDNTANIDRTLENALKTAKLLGFKNYAELSLATKMADTPEQVLNFLHDLARRAKPYAEKDLAEVKAFAREHLGLADPQPWDLSYAGEKLREAKYAFSETEVKKYFPVGKVLAGLFAQIKKLYGIGFAEKTVPVWHKDVRYFELQQNGKTIGGVYMDLYAREGKRGGAWMNDYKGRRRFADGTLQLPTAYLVCNFAPPVGGKEARLSHDEILTLFHETGHGLHHLLTQVDELGVSGINGVK

SEQ ID NO: 489 - DNA, 2037 bp, Neisseria meningitidis
atgactgacaacgcactgctccatttgggcgaagaaccccgttttgatcaaatcaaaaccgaagacatcaaacccgccctgcaaaccgccatcgccgaagcgcgcgaacaaatcgccgccatcaaagcccaaacgcacaccggctgggcaaacactgtcgaacccctgaccggcatcaccgaacgcgtcggcaggatttggggcgtggtgtcgcacctcaactccgtcgccgacacgcccgaactgcgcgccgtctataacgaactgatgcccgaaatcaccgtcttcttcaccgaaatcggacaagacatcgagctgtacaaccgcttcaaaaccatcaaaaattcccccgaattcgacaccctctcccccgcacaaaaaaccaaactcaaccacgatctgcgcgatttcgtcctcagcggcgcggaactgccgcccgaacagcaggcagaactggcaaaactgcaaaccgaaggcgcgcaactttccgccaaattctcccaaaacgtcctagacgcgaccgacgcgttcggcatttactttgacgatgccgcaccgcttgccggcattcccgaagacgcgctcgccatgtttgccgccgccgcgcaaagcgaaagcaaaacaggctacaaaatcggcttgcagattccacactacctcgccgtcatccaatacgccgacaaccgcgaactgcgcgaacaaatctaccgcgcctacgttacccgcgccagcgaactttcagacgacggcaaattcgacaacaccgccaacatcgaccgcacgctcgcaaacgccctgcaaaccgccaaactgctcggcttcaaaaactacgccgaattgtcgctggcaaccaaaatggcggacacgcccgaacaagttttaaacttcctgcacgacctcgcccgccgcgccaaaccctacgccgaaaaagacctcgccgaagtcaaagccttcgcccgcgaaagcctgaacctcgccgatttgcaaccgtgggacttgggctacgccagcgaaaaactgcgcgaagccaaatacgcgttcagcgaaaccgaagtcaaaaaatacttccccgtcggcaaagtattaaacggactgttcgcccaaatcaaaaaactctacggcatcggatttaccgaaaaaaccgtccccgtctggcacaaagacgtgcgctattttgaattgcaacaaaacggcgaaaccataggcggcgtttatatggatttgtacgcacgcgaaggcaaacgcggcggcgcgtggatgaacgactacaaaggccgccgccgtttttcagacggcacgctgcaactgcccaccgcctacctcgtctgcaacttcgccccacccgtcggcggcagggaagcccgcctgagccacgacgaaatcctcatcctcttccacgaaaccggacacgggctgcaccacctgcttacccaagtggacgaactgggcgtatccggcatcaacggcgtagaatgggacgcggtcgaactgcccagccagtttatggaaaatttcgtttgggaatacaatgtcttggcacaaatgtcagcccacgaagaaaccggcgttcccctgccgaaagaactcttcgacaaaatgctcgccgccaaaaacttccaacgcggcatgttcctcgtccggcaaatggagttcgccctctttgatatgatgatttacagcgaagacgacgaaggccgtctgaaaaactggcaacaggttttagacagcgtgcgcaaaaaagtcgccgtcatccagccgcccgaatacaaccgcttcgccttgagcttcggccacatcttcgcaggcggctattccgcaggctattacagctacgcgtgggcggaagtattgagcgcggacgcatacgccgcctttgaagaaagcgacgatgtcgccgccacaggcaaacgcttttggcaggaaatcctcgccgtcggcggatcgcgcagcgcggcagaatccttcaaagccttccgcggccgcgaaccgagcatagacgcactcttgcgccacagcggtttcgacaacgcggtctga

SEQ ID NO: 490 - protein, 678 aa, Neisseria meningitidis
MTDNALLHLGEEPRFDQIKTEDIKPALQTAIAEAREQIAAIKAQTHTGWANTVEPLTGITERVGRIWGVVSHLNSVADTPELRAVYNELMPEITVFFTEIGQDIELYNRFKTIKNSPEFDTLSPAQKTKLNHDLRDFVLSGAELPPEQQAELAKLQTEGAQLSAKFSQNVLDATDAFGIYFDDAAPLAGIPEDALAMFAAAAQSESKTGYKIGLQIPHYLAVIQYADNRELREQIYRAYVTRASELSDDGKFDNTANIDRTLANALQTAKLLGFKNYAELSLATKMADTPEQVLNFLHDLARRAKPYAEKDLAEVKAFARESLNLADLQPWDLGYASEKLREAKYAFSETEVKKYFPVGKVLNGLFAQIKKLYGIGFTEKTVPVWHKDVRYFELQQNGETIGGVYMDLYAREGKRGGAWMNDYKGRRRFSDGTLQLPTAYLVCNFAPPVGGREARLSHDEILILFHETGHGLHHLLTQVDELGVSGINGVEWDAVELPSQFMENFVWEYNVLAQMSAHEETGVPLPKELFDKMLAAKNFQRGMFLVRQMEFALFDMMIYSEDDEGRLKNWQQVLDSVRKKVAVIQPPEYNRFALSFGHIFAGGYSAGYYSYAWAEVLSADAYAAFEESDDVAATGKRFWQEILAVGGSRSAAESFKAFRGREPSIDALLRHSGFDNAV

SEQ ID NO: 491 - DNA, 2037 bp, Neisseria meningitidis; identical to SEQ ID NO: 485

SEQ ID NO: 492 - protein, 678 aa, Neisseria meningitidis; identical to SEQ ID NO: 486

SEQ ID NO: 493 - DNA, 507 bp, Neisseria gonorrhoeae
atgctttcacctcctcggcgtaaaacggcggcacatcaatcaagccgtctttcatttgcgtgcggaaaaaatgcggcgtgttgccgtgatcaaaatcaatatcgtgcagcatccagcccaaatcgcggtttgcctcgctttccgataacgccgacggcggcagcggttcacccttatccgcgctttcgccatttgccctttcaggctgcgggcataggggcggaacaggcggcggtcgaatcctgtttcatccggacaaacgcgttggcagtcggaaaatccggccggccgtgtcaaataatgcgttactttggccgggtcttgtcctttgtaagcggcggtctttttttgcgcgccatccgcatctgtttgggcgcatggcaaacggcggctgccgtacaatcaaaatgtttggcgatttcatgcagacaggcatccggatgccgcccgacatatcgagccggtttttgcctatccgatttggcggcatttaggccggtaacttga

SEQ ID NO: 494 - protein, 168 aa, Neisseria gonorrhoeae
MLSPPRRKTAAHQSSRLSFACGKNAACCRDQNQYRAASSPNRGLPRFPITPTAAAVHPYPRFRHLPFQAAGIGAEQAAVESCFIRTNALAVGKSGRPCQIMRYFGRVLSFVSGGLFLRAIRICLGAWQTAAAVQSKCLAISCRQASGCRPTYRAGFCLSDLAAFRPVT

SEQ ID NO: 495 - DNA, 333 bp, Neisseria meningitidis
tatctgcgctttcactatttgccctttcaggctgcgggcatagggacggaacaggtagcggtcaaatcctgtttcatccaaataaacacgttggtagtcggaaaattcggccggctgtgtcaaataatgcgttactttggccgggtcttgttctttgtaagtggtggtctttttttgcgcgttatccccatctgtttgagtgcatagcaaatggtggctgccgtacaatcaaaatgtttggcgatttcatgcagataggcatccgggtgttgcccaacatattgagccggtttttgcctatccgatttgacggcatttagaccggtaacttga

SEQ ID NO: 496 - protein, 110 aa, Neisseria meningitidis
  misc_feature (69)..(69): Xaa can be any naturally occurring amino acid
  misc_feature (86)..(86): Xaa can be any naturally occurring amino acid
  misc_feature (95)..(95): Xaa can be any naturally occurring amino acid
YLRFHYLPFQAAGIGTEQVAVKSCFIQINTLVVGKFGRLCQIMRYFGRVLFFVSGGLFLRVIPICLSAXQMVAAVQSKCLAISCRXASGCCPTYXAGFCLSDLTAFRPVT

SEQ ID NO: 497 - DNA, 333 bp, Neisseria meningitidis
tatctgcgctttcactatttgccctttcaggctgcgggcatagggacggaacaggtagcggtcaaatcctgtttcatccaaataaacacgttggtagtcggaaaattcggccagctgtgtcaaataatgcgttactttggccgggtcttgttctttgtaagtggtggtctttttttgcgcgttatccccatctgtttgagtgcatagcaaatggtggctgccgtacaatcaaaatgtttggcgatttcatgcagataggcatcctggtgttgcccaacatattgagccggtttttgcctatccgatttgacggcatttagaccggtaacttga

SEQ ID NO: 498 - protein, 107 aa, Neisseria meningitidis
YLRFHYLPFQAAGIGTEQVAVKSCFIQINTLVVGKFGQLCQIMRYFGRVLFFVSGGLFLRVIPICLSAQMVAAVQSKCLAISCRASWCCPTYAGFCLSDLTAFRPVT

SEQ ID NO: 499 - DNA, 840 bp, Neisseria gonorrhoeae
atgaaacaactccgcgacaacaaagcccaaggctctgcactgtttacccttgtgagcggtatcgttattgttattgcagtcctttatttcctgattaagctggcgggcagtggatcgttcggcgatgtcgatgccactacggaagcggcaacgcagacccgcatccagcctgtcggacaattgacgatgggtgacggcatccccgtcggcgaacgccaaggcgaacagattttcggcaaaatctgtatccaatgccacgcggcggacagcaatgtgccgaacgctccgaaactggaacacaacggcgactgggcgccgcgtatcgcgcaaggcttcgataccttgttccaacacgcgctgaacggctttaacgccatgcctgccaaaggcggtgcggcagacctgaccgatcaggaactcaaacgggcgattacctacatggcgaataaaagcggcggttctttcccgaatcctgatgaggctgcgcctgccgacaatgccgcttcaggaacagcttctgctcctgccgatagtgcagctccggcagaagcgaaggcagaagacaagggtgcggcagcccctgcggtcggcgttgacggtaaaaaagtcttcgaagcaacctgtcaggtgtgccacggcggttcgattcccggtattcccggcataggcaaaaaagacgattgggcaccgcgtatcaaaaaaggcaaagaaaccttgcacaaacatgcccttgaaggctttaacgcgatgccggccaaaggcggcaatgcaggtttgagcgatgacgaagtcaaagcggctgttgactatatggcaaaccaatccggtgcaaaattctaa

SEQ ID NO: 500 - protein, 279 aa, Neisseria gonorrhoeae
MKQLRDNKAQGSALFTLVSGIVIVIAVLYFLIKLAGSGSFGDVDATTEAATQTRIQPVGQLTMGDGIPVGERQGEQIFGKICIQCHAADSNVPNAPKLEHNGDWAPRIAQGFDTLFQHALNGFNAMPAKGGAADLTDQELKRAITYMANKSGGSFPNPDEAAPADNAASGTASAPADSAAPAEAKAEDKGAAAPAVGVDGKKVFEATCQVCHGGSIPGIPGIGKKDDWAPRIKKGKETLHKHALEGFNAMPAKGGNAGLSDDEVKAAVDYMANQSGAKF

SEQ ID NO: 501 - DNA, 619 bp, Neisseria meningitidis
ggcgaacagattttcggcaaaatctgtatccaatgccacgcggcggacagcaatgtgccgaacgctccgaaactggaacacaacggcgattrggcaccgcgtatcggcaaggcttcgataccttgttccaacacgcgctgaacggctttaacgccatgcctgcaaaaggcggtgcggcagacctgaccgatcaggaacttaaacgggcgattacttacatggcgaacaaaagcggcggttctttcccgaatcctgatgaggctgcgcctgccgacaatgccgcttcaggaacagcttctgctcctgccgatagtgcagctccggcagaagcgaaggcagaagacaagggtgcggcacccctgcggtcggcgttgacggtaaaaaagtcttcgaagcaacctgtcaggtgtgccacggcggttcgattcccggtattcccggcataggcaaaaaagacgattgggcaccgcgtatcaaaaaaggcaaagaaaccttgcacaaacacgcccttgaaggctttaacgcgatgcctgccaaargcggcaatgcaggtttgagcgatgacgaagtcaaagcggctgttgactatatggcaaaccaatccggtgcaaaattctaa

SEQ ID NO: 502 - protein, 204 aa, Neisseria meningitidis
  misc_feature (31)..(31): Xaa can be any naturally occurring amino acid
  misc_feature (179)..(179): Xaa can be any naturally occurring amino acid
GEQIFGKICIQCHAADSNVPNAPKLEHNGDXAPRIQGFDTLFQHALNGFNAMPAKGGAADLTDQELKRAITYMANKSGGSFPNPDEAAPADNAASGTASAPADSAAPAEAKAEDKGAAPAVGVDGKKVFEATCQVCHGGSIPGIPGIGKKDDWAPRIKKGKETLHKHALEGFNAMPAKXGNAGLSDDEVKAAVDYMANQSGAKF

SEQ ID NO: 503 - DNA, 840 bp, Neisseria meningitidis
atgaaacaactccgcgacaacaaagcccaaggctctgcactgtttacccttgtgagcggtatcgttattgttattgcagtcctttatttcctgattaagctggcgggcagcggctcgttcggcgatgtcgatgccactacggaagcagcaacgcagacccgtatccagcctgtcggacaattgacgatgggcgacggcatccccgtcggcgaacgccaaggcgaacagattttcggcaaaatctgtatccaatgccacgcggcggacagcaatgtgccgaacgctccgaaactggaacacaacggcgattgggcgccgcgtatcgcgcaaggcttcgataccttgttccaacacgcgctgaacggctttaacgccatgcctgccaaaggcggtgcggtagacctgaccgatcaggaactcaaacgggcgattacttacatggcgaacaaaagcggcggttctttcccgaatcctgatgaggctgcgcctgccgacaatgccgcttcaggaacagcttctgctcctgccgatagtgcagctccggcagaagcgaaggcagaagacaagggtgcggcagcccctgcggtcggcgttgacggtaaaaaagtcttcgaagcaacctgtcaggtgtgccacggcggttcgattcccggtattcccggcataggcaaaaaagacgattgggcaccgcgtatcaaaaaaggcaaagaaaccttgcacaaacacgcccttgaaggctttaacgcgatgcctgccaaaggcggcaatgcaggtttgagcgatgacgaagtcaaagcggctgttgactatatggcaaaccaatccggtgcaaaattctaa

SEQ ID NO: 504 - protein, 279 aa, Neisseria meningitidis
MKQLRDNKAQGSALFTLVSGIVIVIAVLYFLIKLAGSGSFGDVDATTEAATQTRIQPVGQLTMGDGIPVGERQGEQIFGKICIQCHAADSNVPNAPKLEHNGDWAPRIAQGFDTLFQHALNGFNAMPAKGGAVDLTDQELKRAITYMANKSGGSFPNPDEAAPADNAASGTASAPADSAAPAEAKAEDKGAAAPAVGVDGKKVFEATCQVCHGGSIPGIPGIGKKDDWAPRIKKGKETLHKHALEGFNAMPAKGGNAGLSDDEVKAAVDYMANQSGAKF

SEQ ID NO: 505 - DNA, 378 bp, Neisseria gonorrhoeae
atggaagccttcaaaaccctaatttggattattaatattatttccgctttggccgtcatcgtgttagtattgctccaacacggcaaaggcgcggatgccggcgcgaccttcggatcgggaagcggcagcgcgcaaggcgtattcggctctgccggcaacgccaacttcctcagccgctcgaccgccgttgcagcaacatttttctttgcaacctgcatgggctatggtgtatattcacacccacacgacaaaacacggtttggacttcagcaacatacgacagactcagcaagcacccaaacccgtaagcaataccgaaccttctgcccctgttcctcagcagcagaaataacagtttttcaaatgccgacatggtga

SEQ ID NO: 506 - protein, 125 aa, Neisseria gonorrhoeae
MEAFKTLIWIINIISALAVIVLVLLQHGKGADAGATFGSGSGSAQGVFGSAGNANFLSRSTAVAATFFFATCMGYGVYSHPHDKTRFGLQQHTTDSASTQTRKQYRTFCPCSSAAEITVFQMPTW

SEQ ID NO: 507 - DNA, 114 bp, Neisseria meningitidis
atggaacccttcaaaaccttaatttggattgttaatttaatttccgctttggccgtcttcgtgttagtattgctccaacacggcaaaggcgcggatgccggcgcgactttcgga

SEQ ID NO: 508 - protein, 38 aa, Neisseria meningitidis
MEPFKTLIWIVNLISALAVFVLVLLQHGKGADAGATFG

SEQ ID NO: 509 - DNA, 378 bp, Neisseria meningitidis
atggaagccttcaaaaccctaatttggattgttaatataatttccgctttggccgtcatcgtgttagtattgctccaacacggcaaaggcgcggatgccggcgcgactttcggatcgggaagcggcagcgcgcaaggcgtattcggctctgccggcaacgctaacttcctcagccgctcgaccgccgttgcagcaacatttttctttgcaacctgcatgggctatggtgtatattcacacccacacgacaaaacacggtttggacttcagcaacgtacaacaaactcagcaagcacccaaacccgtaagcaataccgaaccttctgcccctgttcctcagcagcagaaataacagtttttcaaatgccgacatggtga

SEQ ID NO: 510 - protein, 125 aa, Neisseria meningitidis
MEAFKTLIWIVNIISALAVIVLVLLQHGKGADAGATFGSGSGSAQGVFGSAGNANFLSRSTAVAATFFFATCMGYGVYSHPHDKTRFGLQQRTTNSASTQTRKQYRTFCPCSSAAEITVFQMPTW

SEQ ID NO: 511 - DNA, 1596 bp, Neisseria gonorrhoeae
atgtcccaagaaatcctcgaccaagtgcgccgccgccgcacgtttgccatcatctcccaccccgatgcgggtaaaaccacgctgaccgaaaaactgctgctgttttcgggcgcgattcaaagcgcaggcacggtgaaaggtaagaaaaccggcaaattcgccacctccgactggatggacatcgagaagcagcgcggcatttccgtggcatcaagcgtgatgcagttcgactacaaagaccacaccgtcaacctcttggacacgccgggacaccaagacttctccgaagacacctaccgcgttttaaccgcagtggacagcgccttgatggtcatcgacgcggcaaaaggcgtggaagcgcaaaccatcaaactcttgaacgtctgccgcctgcgcgatacgccgattgttaccttcatgaacaaatacgaccgcgaagtgcgcgattctttggaactcttggacgaagtggaagacatcctgcaaatccgctgcgcgcccgttacctggccgatcggtatgggcaaaaacttcaagggcgtgtaccacatcctgaacgacgaaatctatctctttgaagcgggcggcgaacgcctgccgcacgagttcgacatcatcaaaggcataaacaatcccgaattggaacaacgctttccgttggaaatccagcagttgcgcgacgaaatcgaattggtgcaggcggcttccaacgaatttaatctcgacgaatttctcgccggcgaactcacgccagtgttcttcggctctgcgattaacaacttcggcattcaggaaatcctcaattcattgattgactgggcacccgcaccgaaaccgcgcgacgcgaccatgcgcatggtcgggccggacgagccgaaattttccggatttatctttaaaatccaagccaatatggacccgaaacaccgcgaccgtatcgccttcttgcgcgtctgctccggtaaattcgagcgcggcatgaagatgaaacacctgcgtatcaaccgcgaaatcgccgcctccagcgtagtaaccttcatgtcgcacgaccgcgaactggcggaagaagcctacgccggcgacatcatcggcatcccgaaccacggcaacatccaaatcggcgacagcttctccgaaggcgaacaactggcgtttaccggcatcccattcttcgcgcccgaactgttccgcagcgtccgcatcaaaaacccgctgaaaatcaaacaactgcaaaaaggtttgcaacaactcggcgaagaaggtgcggttcaagtattcaaaccgatgagcggcgcggatttgattttgggtgcggtcggcgtgttgcagtttgaagtcgtaacctcacgcctcgccaacgaatacggcgtggaagccgtgttcgacagcgcatccatctggtcggcgcgctgggtatcgtgcgacgacaagaaaaaactggcggaatttgaaaaagccaacgcaggcaacctcgccatcgacgcaggcggcaacctcgcctacctcgcccccaaccgcgtgaatttggggttgacgcaagaacgctggccggacatcgtgttccacgaaacgcgcgaacattcggtcaaactctaa

SEQ ID NO: 512 - protein, 531 aa, Neisseria gonorrhoeae
MSQEILDQVRRRRTFAIISHPDAGKTTLTEKLLLFSGAIQSAGTVKGKKTGKFATSDWMDIEKQRGISVASSVMQFDYKDHTVNLLDTPGHQDFSEDTYRVLTAVDSALMVIDAAKGVEAQTIKLLNVCRLRDTPIVTFMNKYDREVRDSLELLDEVEDILQIRCAPVTWPIGMGKNFKGVYHILNDEIYLFEAGGERLPHEFDIIKGINNPELEQRFPLEIQQLRDEIELVQAASNEFNLDEFLAGELTPVFFGSAINNFGIQEILNSLIDWAPAPKPRDATMRMVGPDEPKFSGFIFKIQANMDPKHRDRIAFLRVCSGKFERGMKMKHLRINREIAASSVVTFMSHDRELAEEAYAGDIIGIPNHGNIQIGDSFSEGEQLAFTGIPFFAPELFRSVRIKNPLKIKQLQKGLQQLGEEGAVQVFKPMSGADLILGAVGVLQFEVVTSRLANEYGVEAVFDSASIWSARWVSCDDKKKLAEFEKANAGNLAIDAGGNLAYLAPNRVNLGLTQERWPDIVFHETREHSVKL

SEQ ID NO: 513 - DNA, 1596 bp, Neisseria meningitidis
atgtcccaagaaatcctcgaccaagtgcgccgccgccgcacgtttgccatcatctcccaccctgacgcaggtaaaaccacgttgactgaaaaactcttgctgttttcgggcgcgattcagagcgcgggtacggtaaaaggcaagaaaaccggcaaattcgccacttccgactggatggaaatcgagaagcagcgcggcatttccgtggcatcaagtgtgatgcagttcgattacaaagaccacaccgtcaacctcttggacacgccgggacaccaagacttctccgaagacacctaccgcgttttaaccgccgtggacagcgcattaatggtcatcgacgcggcaaaaggcgtggaagcgcaaaccatcaagctcttaaacgtctgccgcctgcgcgatacaccgattgttacgtttatgaacaaatacgaccgcgaagtgcgcgattccctggaacttttggacgaagtggaaaacattttaaaaatccgctgcgcgcccgttacctggccgatcggtatgggcaaaaacttcaagggcgtgtaccacatcctgaacgatgaaatttatctctttgaagctggcggcgaacgcctgccgcacgagttcgacatcatcaaaggcatcgataatcctgaattggaacaacgctttccgttggaaatccagcagttgcgcgacgaaatcgaattggtgcaggcggcttccaacgagtttaatctcgacgaattcctcgccggcgaactcacgcccgtattcttcggctctgcgattaacaacttcggtattcaggaaatcctcaattcattgattgactgggcgcccgcgccgaaaccgcgcgacgcgaccgtacgtatggtcgagccggacgagccgaagttttccggatttatcttcaaaatccaagccaatatggacccgaaacaccgcgaccgtattgccttcttgcgcgtctgctccggcaaattcgagcgcggcatgaagatgaaacacctgcgtatcaaccgcgaaatcgccgcctccagcgtggttaccttcatgtcgcacgaccgcgagctggttgaagaagcctacgccggcgacattatcggcatcccgaaccacggcaacatccaaatcggcgacagcttctccgaaggcgaacaactggcgttcaccggcatcccattcttcgcacccgaactgttccgcagcgtacgcatcaaaaacccgctgaaaatcaaacaactgcaaaaaggcttgcaacagctcggcgaagaaggcgcggtgcaggtgttcaaaccgatgagcggcgcggatttgattttgggcgcggtcggcgtgttgcagtttgaagtcgttacctcgcgcctcgccaacgaatacggcgtagaagccgtgttcgacagcgcatccatctggtcggcgcgctgggtatcgtgcgacgacaagaaaaaactggctgaatttgaaaaagccaacgcgggcaacctcgccatcgacgcaggcggcaacctcgcctacctcgcccccaaccgcgtgaatttgggactcacgcaagaacgttggccggacatcgtgttccacgaaacacgcgaacattcggtcaaactgtaa

SEQ ID NO: 514 - protein, 531 aa, Neisseria meningitidis
MSQEILDQVRRRRTFAIISHPDAGKTTLTEKLLLFSGAIQSAGTVKGKKTGKFATSDWMEIEKQRGISVASSVMQFDYKDHTVNLLDTPGHQDFSEDTYRVLTAVDSALMVIDAAKGVEAQTIKLLNVCRLRDTPIVTFMNKYDREVRDSLELLDEVENILKIRCAPVTWPIGMGKNFKGVYHILNDEIYLFEAGGERLPHEFDIIKGIDNPELEQRFPLEIQQLRDEIELVQAASNEFNLDEFLAGELTPVFFGSAINNFGIQEILNSLIDWAPAPKPRDATVRMVEPDEPKFSGFIFKIQANMDPKHRDRIAFLRVCSGKFERGMKMKHLRINREIAASSVVTFMSHDRELVEEAYAGDIIGIPNHGNIQIGDSFSEGEQLAFTGIPFFAPELFRSVRIKNPLKIKQLQKGLQQLGEEGAVQVFKPMSGADLILGAVGVLQFEVVTSRLANEYGVEAVFDSASIWSARWVSCDDKKKLAEFEKANAGNLAIDAGGNLAYLAPNRVNLGLTQERWPDIVFHETREHSVKL

SEQ ID NO: 515 - DNA, 1596 bp, Neisseria meningitidis
atgtcccaagaaatcctcgaccaagtgcgccgccgccgcacgtttgccatcatctcccaccctgacgcaggtaaaaccacgttgactgaaaaactcttgctgttttcaggtgcgattcaaagcgcgggtacggtaaaaggcaagaaaaccggcaaattcgccacctccgactggatggacatcgagaagcagcgcggcatttccgtggcatcaagcgtgatgcagttcgactataaagaccacaccgtcaaccttttggacacgccgggacaccaagacttctccgaagacacctaccgcgttttgaccgccgtcgatagtgccttgatggtcatcgacgcggcaaaaggcgtggaagcgcaaaccatcaaactcttgaacgtctgccgcctgcgcaatacgccgattgttacgttcatgaacaaatacgaccgcgaagtgcgcgattccctggaattgctggacgaagtggaaaacatcctgcaaatccgctgcgcgcccgtaacctggccgatcggcatgggcaaaaacttcaaaggcgtgtaccacatcctgaacgacgaaatctatctctttgaagcgggcggcgaacgcttgccgcacgagttcgacatcatcaaaggcatcgataatcccgaattggaacaacgctttccgttagaaatacagcagttgcgcgacgaaatcgaattggtgcaggcggcttccaacgagttcaatctcgacgaattcctcgccggcgaactcacgcccgtattcttcggctctgcgattaacaacttcggtattcaggaaatcctcaattcattgattgaatgggcgcccgcgccgaaaccacgcgatgcgaccgtgcgtatggtcgagccggacgagccgaagttttccggatttatcttcaaaatccaagccaatatggacccgaaacaccgcgaccgtattgccttcttgcgcgtctgctccggcaaattcgagcgcggcatgaaaatgaaacacctgcgtatcaaccgcgaaatcgccgcctccagcgtggtaaccttcatgtcccacgaccgcgagctggttgaagaagcctacgccggcgacattatcggtatcccaaaccacggcaacatccaaatcggcgacagcttctccgaaggcgaacaactgacgtttaccggcatcccattcttcgcgcccgaactgttccgcagcgttcgcatcaaaaacccgctgaaaatcaagcaactgcaaaaaggtttgcaacagcttggcgaagaaggtgcggtgcaggtgttcaaaccaatgagcggcgcggatttgattttgggcgcggtcggcgtgttgcagtttgaagtcgttacctcgcgccttgccaacgaatacggcgtggaagccgtgttcgacaacgcatccatctggtcggcgcgctgggtatcgtgcgacgacaagaaaaaactggcggaatttgaaaaagccaacgcgggcaacctcgccatcgacgcgggcggcaacctcgcctacctcgcccctaaccgcgtgaatctgggactcacgcaagaacgctggccggacatcgtgttccacgaaacgcgcgagcattcggtcaaactttaa

SEQ ID NO: 516 - protein, 531 aa, Neisseria meningitidis
MSQEILDQVRRRRTFAIISHPDAGKTTLTEKLLLFSGAIQSAGTVKGKKTGKFATSDWMDIEKQRGISVASSVMQFDYKDHTVNLLDTPGHQDFSEDTYRVLTAVDSALMVIDAAKGVEAQTIKLLNVCRLRNTPIVTFMNKYDREVRDSLELLDEVENILQIRCAPVTWPIGMGKNFKGVYHILNDEIYLFEAGGERLPHEFDIIKGIDNPELEQRFPLEIQQLRDEIELVQAASNEFNLDEFLAGELTPVFFGSAINNFGIQEILNSLIEWAPAPKPRDATVRMVEPDEPKFSGFIFKIQANMDPKHRDRIAFLRVCSGKFERGMKMKHLRINREIAASSVVTFMSHDRELVEEAYAGDIIGIPNHGNIQIGDSFSEGEQLTFTGIPFFAPELFRSVRIKNPLKIKQLQKGLQQLGEEGAVQVFKPMSGADLILGAVGVLQFEVVTSRLANEYGVEAVFDNASIWSARWVSCDDKKKLAEFEKANAGNLAIDAGGNLAYLAPNRVNLGLTQERWPDIVFHETREHSVKL

SEQ ID NO: 517 - DNA, 888 bp, Neisseria gonorrhoeae
atgaaatacaaaagaatcgtatttaaagtcggcacatcttcgattacccgttcggacggcagcctctcgcgcggcaaaatccaaaccatcacccgccagcttgccgcattgcatcatgcgggacacgagctggtcttggtgtcttccggcgcggttgctgcagggttcggcgcgctgggtttcaaaaaacgtccggtcaaaatcgccgacaaacaggcttccgccgccgtcgggcaggggctgctgatggaagaatatacggcaaacctgtcttcagacggcatcgtgtccgcacaaatcctgctcagccgtgccgactttgccgacaaacgccgctaccaaaatgccggcggcgcactttccgtgctgctgcaacgccgcgcgattcccatcatcaatgaaaacgacacggtttcggttgaggagttgaaaatcggcgacaacgacacattgagtgcgcaagtggcggcgatgatacaggcagacctcttggtgctgctgaccgacatagacggtctttacaccggcaacccgaacagcaatcccgatgccgtacggctggacaaaatcgaacacatcaaccatgaaatcatcgaaatggcgggcggctcgggttcggcaaacggcacgggcggtatgctgaccaaaatcaaagcggcaaccatcgccgccgaatccggcgtaccggtgtatatctgttcctcactcaaacccgattcattggccgaagccgccgaacatcaggcggacggctcgtttttcgtcccccgtgccaaaggtttgcggacacagaagcaatggctggcgttctattccgaaagcgggggcagcgtttatgtggacgaaagtgcggaacacgctttgtccgaacaagggaaagcctgctga

SEQ ID NO: 518 - protein, 295 aa, Neisseria gonorrhoeae
MKYKRIVFKVGTSSITRSDGSLSRGKIQTITRQLAALHHAGHELVLVSSGAVAAGFGALGFKKRPVKIADKQASAAVGQGLLMEEYTANLSSDGIVSAQILLSRADFADKRRYQNAGGALSVLLQRRAIPIINENDTVSVEELKIGDNDTLSAQVAAMIQADLLVLLTDIDGLYTGNPNSNPDAVRLDKIEHINHEIIEMAGGSGSANGTGGMLTKIKAATIAAESGVPVYICSSLKPDSLAEAAEHQADGSFFVPRAKGLRTQKQWLAFYSESGGSVYVDESAEHALSEQGKAC

SEQ ID NO: 519 - DNA, 1110 bp, Neisseria meningitidis
atgaaatacaaaagaatcgtatttaaagtcggcacatcttcgattacccattcggacggcagtctctcgcgcggcaaaatccaaaccatcacctgccagcttgccgcattgcatcatgcgggacacgagctggtcttggtgtcttccggcgcggttgcggcagggttcggtgcgctgggtttcaaaaaacgtccggtcaaaatcgccgacaaacaggcttccgccgccgtcgggcaggggctgctgatggaagaatatacggcaaacctgtcttcagacggcatcgtgtccgcgcaaatcctgctcagccgcgccgactttgccgacaaacgccgctaccaaaatgccggcggcgcactttccgtgctgctgcaacgccgcgccgtccccatcatcaatgaaaacgatacggtttcggttgaggaattgaaaatcggcgacaacgacacattgagtgcgcaagtggcggcgatgatacaggcagacctcttggtgctgctgaccgacatagacggtctttacacgggcaacccgaacagcaatcccgatgccgtacggctggacaaaatcgaacacatcaaccatgaaatcatcgaaatggcgggcggctcgggttcggcaaacggcacgggcggtatgctgaccaaaatcaaagcggcaaccatcgccgccgaatccggcgtaccggtgtatatctgttcctcgctcaaacccgatgcacttgccgaagctgccgaacatcaggcggacggctcgtttttcgtcccccgtgccaaaggtttgcggacgcagaagcaatggctggcgttctattccgaaagccggggcagcgtttatgtggacgaaggtgcggaacacgctttgtccgaacaggggaaaagcctgctgatgtcgggcattgccggaatcgaagggcatttttcccgtatggacaccgtaaccgtgtacagcaaggcaaccaaacagcccctgggcaaagggcgcgtcctgttcggctctgccgccgccgaagacctgctcaaatcgcgtaaggcgaaaggcgtgttcatccatcgggacgactggatttccatcacgcccgaaatacgcctgcttctgaccgaattttag

SEQ ID NO: 520 - protein, 369 aa, Neisseria meningitidis
MKYKRIVFKVGTSSITHSDGSLSRGKIQTITCQLAALHHAGHELVLVSSGAVAAGFGALGFKKRPVKIADKQASAAVGQGLLMEEYTANLSSDGIVSAQILLSRADFADKRRYQNAGGALSVLLQRRAVPIINENDTVSVEELKIGDNDTLSAQVAAMIQADLLVLLTDIDGLYTGNPNSNPDAVRLDKIEHINHEIIEMAGGSGSANGTGGMLTKIKAATIAAESGVPVYICSSLKPDALAEAAEHQADGSFFVPRAKGLRTQKQWLAFYSESRGSVYVDEGAEHALSEQGKSLLMSGIAGIEGHFSRMDTVTVYSKATKQPLGKGRVLFGSAAAEDLLKSRKAKGVFIHRDDWISITPEIRLLLTEF

SEQ ID NO: 521 - DNA, 1110 bp, Neisseria meningitidis
atgaaatacaaaagaatcgtatttaaagtcggcacatcttcgattacccattcggacggcagtctctcgcgcggcaaaatccaaaccatcacccgccagcttgccgcattgcatcatgcgggacacgagctggtcttggtgtcttccggcgcggttgcggcagggttcggtgcgctgggtttcaaaaaacgtccggtcaaaatcgccgacaaacaggcttccgccgccgtcgggcaggggctgctgatggaagaatatacggcaaacctgtcttcagacggcatcgtgtccgcacaaatcctgctcagccgcgccgactttgccgacaaacgccgctaccaaaatgccggcggcgcactttccgtgctgctgcaacgccgcgccgtccccatcatcaatgaaaacgatacggtttcggttgaggaattgaaaatcggcgacaacgacacattgagtgcgcaagtggcggcgatgatacaggcagacctcttggtgctgctgaccgacatagacggtctttacaccggcaacccgaacagcaatcccgatgccgtacggctggacaaaatcgaacacatcaaccatgaaatcatcgaaatggcgggcggctcgggttcggcaaacggcacaggcggtatgctgactaaaatcaaagcggcgacgattgcgaccgagtccggcgtaccggtctatatctgttcctcgctcaaacccgatgcacttgccgaagcggcagataatcaggcggacggctcgtttttcgtcccccgtgccaaaggtttgcggacgcagaagcaatggctggcgttctattccgaaagcaggggcggcgtttatgtggacgaaggtgcggaacacgctttgtccgaacagggaaaaagcctgctgatgtcgggcattgccggaatcgaagggcatttttcccgtatggacaccgtaaccgtgtacagcaaggcaaccaaacagcctttgggcaaagggcgagtcctgttcggctctgccgccgccgaagacctgctcaaattgcgtaaggcgaaaggcgtgttcatccatcgggacgactggatttccatcacgcccgaaatacgcctgcttctgaccgaattttag

SEQ ID NO: 522 - protein, 369 aa, Neisseria meningitidis
MKYKRIVFKVGTSSITHSDGSLSRGKIQTITRQLAALHHAGHELVLVSSGAVAAGFGALGFKKRPVKIADKQASAAVGQGLLMEEYTANLSSDGIVSAQILLSRADFADKRRYQNAGGALSVLLQRRAVPIINENDTVSVEELKIGDNDTLSAQVAAMIQADLLVLLTDIDGLYTGNPNSNPDAVRLDKIEHINHEIIEMAGGSGSANGTGGMLTKIKAATIATESGVPVYICSSLKPDALAEAADNQADGSFFVPRAKGLRTQKQWLAFYSESRGGVYVDEGAEHALSEQGKSLLMSGIAGIEGHFSRMDTVTVYSKATKQPLGKGRVLFGSAAAEDLLKLRKAKGVFIHRDDWISITPEIRLLLTEF

SEQ ID NO: 523 - DNA, 672 bp, Neisseria gonorrhoeae
atggaaatccggtttcagacagcatttttacgtttggttcagatgaaaacaaacgcttcaattcttaccgcaacacgccttgtatttcctgccgctgccgcacggacagggatcgttcctgccggttttttccccttccctgcggacggtttgcggtttgttgatgaccgcctgccagtagcggtagatgtctgccagcgcgtaaggcagttcggacgcaagttccgccagctcgccttcggtgaattgcaggcggataacgccgttttcctcttcgtcgtaaatgccgcccactgccatcacggggtaaaacagctcttcaaacgcttcatcatcggcggcttcaaaccaatcggtcggcacaatgtccaaaccgtaaagataggcgttgcaccaagtgtaaaaatcgctgccgccctcgccgtcgtcgtagagccacaaatcgggcagctttttatccgacatcgcggcggttgtttccatcgccattgccaaaaccagccgttcgatttcggaacgttcggcggcggtaaattgcgattcgtcgcccaacacttcgggcagccagtcgagcggtgccaatttgtccggcccgctcaacagcgccgtcataaaaccttgaacctcgtcgcaacgcatcgtgttgccttgttcgcttttggcatccaataa

SEQ ID NO: 524 - protein, 223 aa, Neisseria gonorrhoeae
MEIRFQTAFLRLVQMKTNASILTATRLVFPAAAARTGIVPAGFFPFPADGLRFVDDRLPVAVDVCQRVRQFGRKFRQLAFGELQADNAVFLFVVNAAHCHHGVKQLFKRFIIGGFKPIGRHNVQTVKIGVAPSVKIAAALAVVVEPQIGQLFIRHRGGCFHRHCQNQPFDFGTFGGGKLRFVAQHFGQPVERCQFVRPAQQRRHKTLNLVATHRVALFAFGIQ

SEQ ID NO: 525 - DNA, 732 bp, Neisseria meningitidis
atggaaacaaacgcttcaattcttaccgcaacacgccttgtattttctgccgctgccgcacggacagggatcgttcctgcctgttttttcgccttccctgcggacggtttgcggtttgttgatgactgcctgccagtagcggtagatatccgccaatgcataaggcaactcggattccagttccgccagctcgccttctgtgaattgcagacggatagcgccgttttcctcttcgtcgtaaataccgcccaatgccatgatgggataaaacaactcttcaaacgcttcatcatcgacggcttcaaaccaatcggtcggcacaatatccaaaccgtaaagataagcattgcaccatgtgtaaaaatcgctgccgccgtcttcgttttcatacagccacaaatcgggcagttttttatccgacatcgcggcggttgtttccatcgccattgccaaaaccagccgttcgatttcggaacgttcggcggcggtaaattgcgattcgtcgcccaacacttcgggcagccagtcgagcggtgtcaatttgtccggcccgctcaacagcgccgtcataaaaccttgaacctcgtcgcaacgcatcgtgttgccttgttcgcttttggcatccaacaattcgctcaaccgccgtttggatgcttcggtaaattttcgggaatccatcattttccttttcaaatgggttttgcgccctattatcgccgcaatgccgtctga

SEQ ID NO: 526 - protein, 243 aa, Neisseria meningitidis
METNASILTATRLVFSAAAARTGIVPACFFAFPADGLRFVDDCLPVAVDIRQCIRQLGFQFRQLAFCELQTDSAVFLFVVNTAQCHDGIKQLFKRFIIDGFKPIGRHNIQTVKISIAPCVKIAAAVFVFIQPQIGQFFIRHRGGCFHRHCQNQPFDFGTFGGGKLRFVAQHFGQPVERCQFVRPAQQRRHKTLNLVATHRVALFAFGIQQFAQPPFGCFGKFSGIHHFPFQMGFAPYYRRNAV

SEQ ID NO: 527 - DNA, 837 bp, Neisseria meningitidis
atggaaacaaacgcttcaattcttaccgcaacacgccttgtattttctgccgctgccgcacggacagggatcgttcctgcctgttttttcgccttccctgcggacggtttgcggcttgttgatgaccgcctgccagtagcggtagatatccgccaatgcataaggcaactcggattccagttccgccagctcgccttctgtgaattgcagacggatagtgccgttgtcctcttcgtcgtaaataccgcccaatgccatgatgggataaaacaactcttcaaacgcttcatcatcgacggcttcaaaccaatcggtcggcacaatatccaaaccgtaaagataagcattgcaccatgtgtaaaaatcgctgccgccgtcttcgttttcatacagccacaaatcgggcagttttttatccgacatcgcggcggttgtttccatcgccattgccaaaaccagccgttcgatttcggaacgttcggcggcggtaaattgcgattcgtcgcccaacacttcgggcagccagtcgagcggtgtcaatttgtccggcccgctcaacagcgccgtcataaaaccttgaacctcgtcgcaacgcatcgtgttgccttgttcgcttttggcatccaacaattcgctcaaccgccgtttggatgcttcggtaaattttcgggaatccatcattttccttttccaatgggttttgcgccctattatagtggattaaatttaaatcaggacaaggcgacgaagccgcagacagtacaaatagtacggcaaggcgaggcaacgccgtactggtttaaatttaatccactatatcgccgcaatgccgtctga

SEQ ID NO: 528 - protein, 278 aa, Neisseria meningitidis
METNASILTATRLVFSAAAARTGIVPACFFAFPADGLRLVDDRLPVAVDIRQCIRQLGFQFRQLAFCELQTDSAVVLFVVNTAQCHDGIKQLFKRFIIDGFKPIGRHNIQTVKISIAPCVKIAAAVFVFIQPQIGQFFIRHRGGCFHRHCQNQPFDFGTFGGGKLRFVAQHFGQPVERCQFVRPAQQRRHKTLNLVATHRVALFAFGIQQFAQPPFGCFGKFSGIHHFPFPMGFAPYYSGLNLNQDKATKPQTVQIVRQGEATPYWFKFNPLYRRNAV

SEQ ID NO: 529 - DNA, 852 bp, Neisseria gonorrhoeae
atgattatccatcaccaattcgatcccgtcctcatcagtatcggcccgcttgccgtccgctggtatgccttaagctacatcctcggatttattctttttacctttctcggcagaaggcgcatcgcgcaaggcttgtccgtttttaccaaagaatcgctcgacgacttcctgacatggggcattttgggcgtgattttgggcggacgcttgggctatgtcctgttttacaaattctccgactacctcgcccatccgcttgatattttcaaggtatgggaaggcggaatgtcgttccacggcggctttttgggtgtagttattgccatatggttgttcagccgcaagcacggcatcggcttcctcaaactgatggacacggtcgcgccgctcgttccgctgggtctcgcttcgggacgtatcggcaactttatcaacggcgaactttggggacgcattaccgacattaacgcattttgggcaatgggcttcccgcaagcgcattacgaagatgccgaagccgccgcgcacaatccgctttgggcagaatggctgcaacaatacggtatgctgccgcgtcatccctcgcagctttatcagtttgcccttgaaggcatctgcctgttcgccgtcgtttggctgttttccaaaaaaccgcgcccgaccgggcagactgccgcgctttttctcggcggctacggcgtgttccgctttattgccgaatttgcgcgccaacccgacgactatctcgggctgctgaccttggggctgtcgatggggcaatggttgagcgtcccgatgattgttttgggtatcgtcggctttgtccggttcggcatgaaaaaacagcactga

SEQ ID NO: 530 - protein, 283 aa, Neisseria gonorrhoeae
MIIHHQFDPVLISIGPLAVRWYALSYILGFILFTFLGRRRIAQGLSVFTKESLDDFLTWGILGVILGGRLGYVLFYKFSDYLAHPLDIFKVWEGGMSFHGGFLGVVIAIWLFSRKHGIGFLKLMDTVAPLVPLGLASGRIGNFINGELWGRITDINAFWAMGFPQAHYEDAEAAAHNPLWAEWLQQYGMLPRHPSQLYQFALEGICLFAVVWLFSKKPRPTGQTAALFLGGYGVFRFIAEFARQPDDYLGLLTLGLSMGQWLSVPMIVLGIVGFVRFGMKKQH

SEQ ID NO: 531 - DNA, 852 bp, Neisseria meningitidis
atgattacccatccccaattcgatcccgtccttatcagtatcggcccgcttgccgtccgctggtatgccctaagctacatcctcggatttattctttttacctttctcggcagaaggcgcatcgcgcaaggcttgtccgtttttaccaaagaatcgctcgacgacttcctgacatggggcattttgggcgtaattttgggcgggcgtttgggttacgtcctgttttacaagttttccgactacctcgcccatccgcttgatattttcaaggtatgggaaggcggaatgtcgttccacggcggctttttgggtgtagttattgccatacggttgttcggccgcaaacacggcatcggcttcctcaaactgatggatacggtcgcaccgctcgttccgctgggtctcgcttcgggacgtatcggcaacttcatcaacggcgaactttggggacgcgttaccgacatcaacgcattttgggcaatgggcttcccgcaggcgcgttacgaagatgccgaagccgccgcgcacaatccgctttgggcagaatggctgcaacaatacggtatgctgccgcgtcatccctcgcagctttatcagtttgcacttgaaggcatctgcctgttcaccgtcatttggctgttctctaaaaaacagcggtcgaccggacaagtcgcctcgctcttcctcggcggctacggcatattccgcttcattgccgaattcgcacgccaacccgacgactatctcgggctgctgaccttggggctgtcgatggggcaatggttgagcgtcccgatgattgttttgggtatcgtcggctttgtccggttcggcatgaaaaaacagcactga

SEQ ID NO: 532 - protein, 283 aa, Neisseria meningitidis
MITHPQFDPVLISIGPLAVRWYALSYILGFILFTFLGRRRIAQGLSVFTKESLDDFLTWGILGVILGGRLGYVLFYKFSDYLAHPLDIFKVWEGGMSFHGGFLGVVIAIRLFGRKHGIGFLKLMDTVAPLVPLGLASGRIGNFINGELWGRVTDINAFWAMGFPQARYEDAEAAAHNPLWAEWLQQYGMLPRHPSQLYQFALEGICLFTVIWLFSKKQRSTGQVASLFLGGYGIFRFIAEFARQPDDYLGLLTLGLSMGQWLSVPMIVLGIVGFVRFGMKKQH

SEQ ID NO: 533 - DNA, 852 bp, Neisseria meningitidis
atgattacccatccccaattcgaccccgtccttatcagtatcggcccgcttgccgtccgctggtatgccctaagctacatcctcggatttattctttttacctttctcggcagaaggcgcatcgcgcaaggcttgtccgtttttaccaaagaatcgctcgacgacttcctgacatggggcattttgggcgtaattttgggcgggcgtttgggttacgtcctgttttacaagttttccgactacctcgcccatccgcttgatattttcaaggtatgggaaggcggaatgtcgttccacggcggctttttgggtgtagttattgccatatggttgttcggtcgcaaacacggcatcggcttcctcaaactgatggacacggtcgcaccgctcgttccactgggtctcgcttcgggacgtatcggcaacttcatcaacggcgaactttggggacgcgttaccgacatcaacgcattttgggcaatgggcttcccgcaggcgcgttacgaagacctcgaagccgccgcgcacaatccgctttgggcagaatggctgcaacaatacggtatgctgccgcgtcatccctcgcagctttatcagtttgcacttgaaggcatctgcctgttcgccgtcgtttggctgttctctaaaaaacagcggccgaccggacaagtcgcctcactcttcctcggcggctacggcatattccgcttcattgccgaatttgcacgccaacccgacgactatctcgggctgctgaccttggggctgtcgatggggcaatggttgagcgtcccgatgattgttttgggtatcgtcggctttgtccggttcggcatgaaaaaacagcactga

SEQ ID NO: 534 - protein, 283 aa, Neisseria meningitidis
MITHPQFDPVLISIGPLAVRWYALSYILGFILFTFLGRRRIAQGLSVFTKESLDDFLTWGILGVILGGRLGYVLFYKFSDYLAHPLDIFKVWEGGMSFHGGFLGVVIAIWLFGRKHGIGFLKLMDTVAPLVPLGLASGRIGNFINGELWGRVTDINAFWAMGFPQARYEDLEAAAHNPLWAEWLQQYGMLPRHPSQLYQFALEGICLFAVVWLFSKKQRPTGQVASLFLGGYGIFRFIAEFARQPDDYLGLLTLGLSMGQWLSVPMIVLGIVGFVRFGMKKQH

SEQ ID NO: 535 - DNA, 897 bp, Neisseria gonorrhoeae
atggagtttgaaaacattatttccgccgccgacaaggcgcgtatccttgccgaagcactgccttacatccgccggttttccggttcggtcgccgtcatcaagtatggcggcaacgcgatgaccgaacctgccttgaaagaagggtttgcccgcgatgtcgtgctgctgaagctggtcggcattcatcccgtcatcgttcacggcggcgggccgcagatcaatgcgatgcttgaaaaagtcggcaaaaagggcgaatttgtccaaggaatgcgcgttaccgacaaagagacgatggatattgtcgaaatggtattgggcgggcacgtcaacaaggaaatcgtgtcgatgattaacacatatggagggcacgcggtcggcgtgagcgggcgcgacgaccatttcattaaggcgaagaaacttttggtcgatacgcccgaacagaatagcgtggacatcggacaggtcggtacggtggaaagcatcgataccggtttggttaaagggctgatagaacgcggctgcattcccgtcgtcgcccccgtcggcgtaggtgaaaaaggcgaagcgttcaacatcaacgccgatttggtggcaggcaaattggcggaagaattgaacgccgaaaaactcttgatgatgacgaatatcgccggtgtgatggacaaaacgggcaatctgctgaccaaactcacgccgaaacggattgatgggctgattgccgacggcacgctgtatggcggtatgctgccgaaaatcgcttctgcggtcgaagccgccgtcaacggtgtgaaagccacgcacatcatcgacggcaggttgcccaacgcgcttttgctggaaatctttaccgatgccggtatcgggtcgatgattttaggcagaggggaagatgcctga

SEQ ID NO: 536 - protein, 298 aa, Neisseria gonorrhoeae
MEFENIISAADKARILAEALPYIRRFSGSVAVIKYGGNAMTEPALKEGFARDVVLLKLVGIHPVIVHGGGPQINAMLEKVGKKGEFVQGMRVTDKETMDIVEMVLGGHVNKEIVSMINTYGGHAVGVSGRDDHFIKAKKLLVDTPEQNSVDIGQVGTVESIDTGLVKGLIERGCIPVVAPVGVGEKGEAFNINADLVAGKLAEELNAEKLLMMTNIAGVMDKTGNLLTKLTPKRIDGLIADGTLYGGMLPKIASAVEAAVNGVKATHIIDGRLPNALLLEIFTDAGIGSMILGRGEDA

SEQ ID NO: 537 - DNA, 897 bp, Neisseria meningitidis
atggagtctgaaaacattatttccgccgccgacaaggcgcgtatccttgccgaagcgctgccttacatccgccggttttccggttcggtcgccgtcatcaaatacggcggcaacgcgatgaccgaacctgccttgaaagaagggtttgcccgcgatgtcgtgctgctgaagctggtcggcattcatcccgtcatcgttcacggcggcgggccgcagatcaatgcgatgcttgaaaaagtcggcaaaaagggtgagtttgtccaaggaatgcgcgttaccgacaaagaggcgatggatattgtcgaaatggtgttgggcgggcatgtcaataaagaaatcgtgtcgatgattaacacatatggcggacacgcggtcggcgtaagcggacgcgacgaccatttcattaaggcgaagaaacttttgatcgatacgcccgaacagaatggcgtggacatcggacaggtcggtacggtggaaagcatcgataccggtttggttaaagggctgatagaacgtggctgcattcccgtcgtcgcccccgtcggcgtaggtgaaaaaggcgaagcgttcaacatcaacgccgatttggtagcaggcaaattggcggaagaattgaacgccgaaaaactcttgatgatgacgaatatcgccggtgtgatggacaaaacgggcaatctgctgaccaaactcacgccgaaacggattgatgaactgattgccgacggcacgctgtatggcggtatgctgccgaaaatcgcttctgcggtcgaagccgccgtcaacggtgtgaaagccacgcatatcatcgacggcaggttgcccaacgcgcttttgctggaaatctttaccgatgccggtatcggttcgatgattttgggcggtggggaagatgcctga

SEQ ID NO: 538 - protein, 298 aa, Neisseria meningitidis
MESENIISAADKARILAEALPYIRRFSGSVAVIKYGGNAMTEPALKEGFARDVVLLKLVGIHPVIVHGGGPQINAMLEKVGKKGEFVQGMRVTDKEAMDIVEMVLGGHVNKEIVSMINTYGGHAVGVSGRDDHFIKAKKLLIDTPEQNGVDIGQVGTVESIDTGLVKGLIERGCIPVVAPVGVGEKGEAFNINADLVAGKLAEELNAEKLLMMTNIAGVMDKTGNLLTKLTPKRIDELIADGTLYGGMLPKIASAVEAAVNGVKATHIIDGRLPNALLLEIFTDAGIGSMILGGGEDA

SEQ ID NO: 539 - DNA, 897 bp, Neisseria meningitidis
atggagtctgaaaacattatttccgccgccgacaaggcgcgtatccttgccgaagcgctgccttacatccgccggttttccggttcggtcgccgtcatcaaatacggcggcaacgcgatgaccgaacctgccttgaaagaagggtttgcccgcgatgtcgtgctgctgaagctggtcggcattcatcccgtcatcgttcacggcggcgggccgcagatcaatgcgatgcttgaaaaagtcggcaaaaagggtgagtttgtccaaggaatgcgcgttaccgacaaagaggcgatggatattgtcgaaatggtgttgggcgggcatgtcaataaagaaatcgtgtcgatgattaacacatatggcggacacgcggtcggcgtaagcggacgcgacgaccatttcattaaggcgaagaaacttttgatcgatacgcccgaacagaatggcgtggacatcggacaggtcggtacggtggaaagcatcgataccggtttggttaaagggctgatagaacgtggctgcattcccgtcgtcgcccccgtcggcgtaggtgaaaaaggcgaagcgttcaacatcaacgccgatttggtagcaggcaaattggcggaagaattgaacgccgaaaaactcttgatgatgacgaatatcgccggtgtgatggacaaaacgggcaatctgctgaccaaactcacgccgaaacggattgatgaactgattgccgacggcacgctgtatggcggtatgctgccgaaaatcgcttctgcggtcgaagccgccgtcaacggcgtgaaagccacgcatatcatcgacggcagggtgcccaacgcgcttttgctggaaatctttaccgatgccggtatcggttcgatgattttgggcggtggggaagatgcctga

SEQ ID NO: 540 - protein, 298 aa, Neisseria meningitidis
MESENIISAADKARILAEALPYIRRFSGSVAVIKYGGNAMTEPALKEGFARDVVLLKLVGIHPVIVHGGGPQINAMLEKVGKKGEFVQGMRVTDKEAMDIVEMVLGGHVNKEIVSMINTYGGHAVGVSGRDDHFIKAKKLLIDTPEQNGVDIGQVGTVESIDTGLVKGLIERGCIPVVAPVGVGEKGEAFNINADLVAGKLAEELNAEKLLMMTNIAGVMDKTGNLLTKLTPKRIDELIADGTLYGGMLPKIASAVEAAVNGVKATHIIDGRVPNALLLEIFTDAGIGSMILGGGEDA

SEQ ID NO: 541 - DNA, 537 bp, Neisseria gonorrhoeae
atgcgaaccacctcaaccttccctacaaaaactttcaaaccggctgccatggcgttagctgttgcaacaacactttctgcctgcttaggcggcggcggaggcggcacttctgctcccgactttaatgcaggcggcaccggtatcggcagcaacagcagggcaacgatagcggaatcagcagcagtatcttacgccggtataaaaaacgaaatgtgcaaagacagaagcatgctctgtgccggtcgggatgacgttgcggttacagacagggatgccaaaatcaaagccccccgaatctgcataccggagacttttcaaacccaaatgaccaatattaagaatatgatcaacctcaaacctgcaattgaagcaggctatacaggacgcggggtagaggtaggtatcgtcgatacaggcgaatccgtcggcagcatatcctttcccgaactgtatggcagaaaagaacacggctataacgaaaattacaaaaacaaattacaaaaactatacggcgtatatgcggaaggaagcgcctga

SEQ ID NO: 542 - protein, 178 aa, Neisseria gonorrhoeae
MRTTSTFPTKTFKPAAMALAVATTLSACLGGGGGGTSAPDFNAGGTGIGSNSRATIAESAAVSYAGIKNEMCKDRSMLCAGRDDVAVTDRDAKIKAPRICIPETFQTQMTNIKNMINLKPAIEAGYTGRGVEVGIVDTGESVGSISFPELYGRKEHGYNENYKNKLQKLYGVYAEGSA

SEQ ID NO: 543 - DNA, 528 bp, Neisseria meningitidis
atgcgaacgaccccaaccttccctacaaaaactttcaaaccgactgccatggcgttagctgttgcaacaacactttctgcctgcttaggcggcggcggaggcggcacttctgcgcccgacttcaatgcaggcggtaccggtatcggcagcaacagcagagcaacaacagcgaaatcagcagcagtatcttacgccggtatcaagaacgaaatgtgcaaagacagaagcatgctctgtgccggtcgggatgacgttgcggttacagacagggatgccaaaatcaatgcccccccccgaatctgcataccggagactttccaaacccaaatgacgcattacaagaatttgatcaacctcaaacctgcaattgaagcaggctatacaggacgcggggtagaggtaggtatcgtcgacacaggcgaatccgtcggcagcatatcctttcccgaactgtatggcagaaaagaacacggctataacgaaaattacgaaaaactatacggcgtatatgcggaaggaagcgcctga

SEQ ID NO: 544 - protein, 175 aa, Neisseria meningitidis
MRTTPTFPTKTFKPTAMALAVATTLSACLGGGGGGTSAPDFNAGGTGIGSNSRATTAKSAAVSYAGIKNEMCKDRSMLCAGRDDVAVTDRDAKINAPPRICIPETFQTQMTHYKNLINLKPAIEAGYTGRGVEVGIVDTGESVGSISFPELYGRKEHGYNENYEKLYGVYAEGSA

SEQ ID NO: 545 - DNA, 526 bp, Neisseria meningitidis
atgcgaacgaccccaaccttccctacaaaaactttcaaaccggctgccatggcgttagctgttgcaacaacactttctgcctgcttaggcggcggcggaggcggcacttctgcgcccgacttcaatgcaggcggcaccggtatcggcagcaacagcagggcaacaacagcgaaatcagcagcaatatcttacgccggtatcaagaacgaaatgtgcaaagacagaagcatgctctgtgccggtcgggatgacgttgcggttacagacagggatgccaaaatcaatgcccccccccgaatctgcataccggagactttacaaacccaaatgacgcatacaagaatttgatcaacctcaaacctgcaattgaagcaggctatacaggacgcggggtagaggtaggtatcgtcgacacaggcgaatccgtcggcagcatatcctttcccgaactgtatggcagaaaagaacacggctataacgaaaattacaaaaactatacggcgtatatgcggaaggaagcgcctga

SEQ ID NO: 546 - protein, 175 aa, Neisseria meningitidis
  misc_feature (113)..(113): Xaa can be any naturally occurring amino acid
  misc_feature (164)..(164): Xaa can be any naturally occurring amino acid
MRTTPTFPTKTFKPAAMALAVATTLSACLGGGGGGTSAPDFNAGGTGIGSNSRATTAKSAAISYAGIKNEMCKDRSMLCAGRDDVAVTDRDAKINAPPRICIPETLQTQMTHXKNLINLKPAIEAGYTGRGVEVGIVDTGESVGSISFPELYGRKEHGYNENYXKLYGVYAEGSA

SEQ ID NO: 547 - DNA, 1365 bp, Neisseria gonorrhoeae
atgtcggcacgcggcaagggggcaggctatctcaacagtaccggacgacatgttcccttcctgagtgccgccaaaatcgggcaggattattctttcttcaaaaatatcaaaaccgacggcggtctgctggcttccctcgacagcgtcgaaaaaacagcgggcagtgaaggcgacacgccgtcctattatgtccgtcgcggcaatgcggcacggactgcttcggcagcggcacattccgcgcccgccggtctgaaacacgccgtagaacagggcggcagcaatctggaaaacctgatggtcgagctggatgcctccgaatcatccgcaacacccgagacggttgaaactgcggtcgccgaccgcacagatatgccgggcatccgcctacggcgcacaactttccgcacagcggcagccgtacagcatgcgaataccgccgacggcgtacgcatcttcaacagtctcgccgctaccgtctatgccgacagtgccgccgcccatgccgatatgcagggacgccgcctgaaagccgtatcggacgggttggaccacaacggtacgggtctgcgcgtcatcgcgcaaacccaacaggacggtggaacgtgggaacagggcggtgtcgaaggcaaaatgcgcggcagtacccaaactatcggcattgccgcgaaaaccggcgaaaatacgacagcagccgccacactgggcataggacgcagcacatggagcgaaaacagtgcaaatgcaaaaaccgacagcattagtctgtttgcaggcatacggcacgatgtgggcgatatcggctatctcaaaggcctgttctcctacggacgctacaaaaacagcatcagccgcagcaccggtgcggatgaatatgcggaaggcagcgtcaacggcacgctgatgcagctgggcgcactgggtggtgtcaacgttccgtttgccgcaacgggagatttgacggttgaaggcggtctgcgccacgacctgctcaaacaggatgcattcgccgaaaaaggcagtgctttgggctggagcggcaacagcctcactgaaggcacactggtcggactcgcgggtctgaaactgtcgcaacccttgagcgataaagccgtcctgtctgcgacggcgggcgtggaacgcgacctgaacggacgcgactacgcggtaacgggcggctttaccggcgcggctgcagcaaccggcaagacgggtgcacgcaatatgccgcacacccgccgggttgccggtctgggggtggatgtcgaattcggcaacggctggaacggcttggcacgttacagctacaccggttccaaacagtacggcaaccacagcggacaaatcggcgtaggctaccggttctga

SEQ ID NO: 548 - protein, 454 aa, Neisseria gonorrhoeae
MSARGKGAGYLNSTGRHVPFLSAAKIGQDYSFFKNIKTDGGLLASLDSVEKTAGSEGDTPSYYVRRGNAARTASAAAHSAPAGLKHAVEQGGSNLENLMVELDASESSATPETVETAVADRTDMPGIRLRRTTFRTAAAVQHANTADGVRIFNSLAATVYADSAAAHADMQGRRLKAVSDGLDHNGTGLRVIAQTQQDGGTWEQGGVEGKMRGSTQTIGIAAKTGENTTAAATLGIGRSTWSENSANAKTDSISLFAGIRHDVGDIGYLKGLFSYGRYKNSISRSTGADEYAEGSVNGTLMQLGALGGVNVPFAATGDLTVEGGLRHDLLKQDAFAEKGSALGWSGNSLTEGTLVGLAGLKLSQPLSDKAVLSATAGVERDLNGRDYAVTGGFTGAAAATGKTGARNMPHTRRVAGLGVDVEFGNGWNGLARYSYTGSKQYGNHSGQIGVGYRF

SEQ ID NO: 549 - DNA, 1365 bp, Neisseria meningitidis
atgtcggcacgcggcaagggggcaggctatctcaacagtaccggacgacgtgttcccttcctgagtgccgccaaaatcgggcaggattattctttcttcacaaacatcgaaaccgacggcggcctgctggcttccctcgacagcgtcgaaaaaacagcgggcagtgaaggcgacacgctgtcctattatgtccgtcgcggcaatgcggcacggactgcttcggcagcggcacattccgcgcccgccggtctgaaacacgccgtagaacagggcggcagcaatctggaaaacctgatggtcgaactggatgcctccgaatcatccgcaacacccgagacggttgaaactgcggcagccgaccgcacagatatgccgggcatccgcccctacggcgcaactttccgcgcagcggcagccgtacagcatgcgaatgccgccgacggtgtacgcatcttcaacagtctcgccgctaccgtctatgccgacagtaccgccgcccatgccgatatgcagggacgccgcctgaaagccgtatcggacgggttggaccacaacggcacgggtctgcgcgtcatcgcgcaaacccaacaggacggtggaacgtgggaacagggcggtgttgaaggcaaaatgcgcggcagtacccaaaccgtcggcattgccgcgaaaaccggcgaaaatacgacagcagccgccacactgggcatgggacgcagcacatggagcgaaaacagtgcaaatgcaaaaaccgacagcattagtctgtttgcaggcatacggcacgatgcgggcgatatcggctatctcaaaggcctgttctcctacggacgctacaaaaacagcatcagccgcagcaccggtgcggacgaacatgcggaaggcagcgtcaacggcacgctgatgcagctgggcgcactgggcggtgtcaacgttccgtttgccgcaacgggagatttgacggtcgaaggcggtctgcgctacgacctgctcaaacaggatgcattcgccgaaaaaggcagtgctttgggctggagcggcaacagcctcactgaaggcacgctggtcggactcgcgggtctgaagctgtcgcaacccttgagcgataaagccgtcctgtttgcaacggcgggcgtggaacgcgacctgaacggacgcgactacacggtaacgggcggctttaccggcgcgactgcagcaaccggcaagacgggggcacgcaatatgccgcacacccgtctggttgccggcctgggcgcggatgtcgaattcggcaacggctggaacggcttggcacgttacagctacgccggttccaaacagtacggcaaccacagcggacgagtcggcgtaggctaccggttctga

SEQ ID NO: 550 - protein, 454 aa, Neisseria meningitidis
MSARGKGAGYLNSTGRRVPFLSAAKIGQDYSFFTNIETDGGLLASLDSVEKTAGSEGDTLSYYVRRGNAARTASAAAHSAPAGLKHAVEQGGSNLENLMVELDASESSATPETVETAAADRTDMPGIRPYGATFRAAAAVQHANAADGVRIFNSLAATVYADSTAAHADMQGRRLKAVSDGLDHNGTGLRVIAQTQQDGGTWEQGGVEGKMRGSTQTVGIAAKTGENTTAAATLGMGRSTWSENSANAKTDSISLFAGIRHDAGDIGYLKGLFSYGRYKNSISRSTGADEHAEGSVNGTLMQLGALGGVNVPFAATGDLTVEGGLRYDLLKQDAFAEKGSALGWSGNSLTEGTLVGLAGLKLSQPLSDKAVLFATAGVERDLNGRDYTVTGGFTGATAATGKTGARNMPHTRLVAGLGADVEFGNGWNGLARYSYAGSKQYGNHSGRVGVGYRF

SEQ ID NO: 551 - DNA, 1365 bp, Neisseria meningitidis
atgtcggcaggcggtaagggggcaggctatctcaaccgtaccggacaacgtgttcccttcctgagtgccgccaaaatcgggcgggattattctttcttcacaaacatcgaaaccgacggcggtctgctggcttccctcgacagcgtcgaaaaaacagcgggtagtgaaggcgacacgctgtcctattatgtccgtcgcggcaatgcggcacggactgcttcggcagcggcacattccgcgcccgccggtctgaaacacgccgtagaacagggcggcagcaatctggaaaacctgatggtcgaactggatgcctccgaatcatccgcaacacccgagacggttgaaactgcggccgccgaccgcacagatatgccgggcatccgcccctacggcgcaactttccgcgcagcggcagccgtacagcatgcgaatgccgccgacggtgtacgcatcttcaacaatctcgccgctaccgtctatgccgacagtaccgccgcccatgccgatatgcagggacgccgcctgaaagccgtatcggacgggttggaccacaacgctacgggtctgcgcgtcatcgcgcaaacccaacaggacggtggaacgtgggaacagggcggtgttgaaggcaaaatgcgcggcagtacccaaaccgtcggcattgccgcgaaaaccggcgaaaatacgacagcagccgccacactgggcatgggacacagcacatggagcgaaaacagtgcaaatgcaaaaaccgacagcattagtctgtttgcaggcatacggcacgatgcgggcgatatcggctatctcaaaggcctgttctcctacggacgctacaaaaacagcatcagccgcagcaccggtgcggacgaacatgcggaaggcagcgtcaacggcacgctgatgcagctgggcgcactgggcggtgtcaacgttccgtttgccgcaacgggagatttgacggtcgaaggcggtctgcgctacgacctgctcaaacaggatgcattcgccgaaaaaggcagtgctttgggctggagcggcaacagcatcactgaaggcacactggtcggactcgcgggtctgaagctgtcgcaacccttgagcgataaagccgtcctgtttgcaacggcgggcgtggaacgcgacctgaacggacgcgactacacggtaacgggcggctttaccggcgcgactgcagcaaccggcaagacgggggcacgcaatatgccgcacacccgcctggttgccggtctgggcgcggatgtcgaattcggcaacggctggaacggcttggcacgttacagctacgccggttccaaacagtacggcaaccacagcggacgagtcggcgtaggctaccggttctga

SEQ ID NO: 552 - protein, 454 aa, Neisseria meningitidis
MSAGGKGAGYLNRTGQRVPFLSAAKIGRDYSFFTNIETDGGLLASLDSVEKTAGSEGDTLSYYVRRGNAARTASAAAHSAPAGLKHAVEQGGSNLENLMVELDASESSATPETVETAAADRTDMPGIRPYGATFRAAAAVQHANAADGVRIFNNLAATVYADSTAAHADMQGRRLKAVSDGLDHNATGLRVIAQTQQDGGTWEQGGVEGKMRGSTQTVGIAAKTGENTTAAATLGMGHSTWSENSANAKTDSISLFAGIRHDAGDIGYLKGLFSYGRYKNSISRSTGADEHAEGSVNGTLMQLGALGGVNVPFAATGDLTVEGGLRYDLLKQDAFAEKGSALGWSGNSITEGTLVGLAGLKLSQPLSDKAVLFATAGVERDLNGRDYTVTGGFTGATAATGKTGARNMPHTRLVAGLGADVEFGNGWNGLARYSYAGSKQYGNHSGRVGVGYRF

SEQ ID NO: 553 - DNA, 1677 bp, Neisseria gonorrhoeae
atgagcttcaaaaccgatgccgaaaccgcccaatcctccaccatgcgcccgattggcgaaattgccgccaagctgggtttgaacgttgacaacattgagccttacggtcattacaaagccaaaatcaatcctgccgaagcgttcaagctgccgcaaaaacaaggcaggctgattttggttaccgccatcaacccgactccggcgggcgaaggcaaaaccaccgtaaccatcggtttggcggacgcattgcgccatatcggcaaagactctgtgattgctttgcgcgagccttctttgggtccggtgttcggcgtgaaaggcggcgcggcaggcggcggctacgcgcaagttttgccgatggaagacatcaacctgcacttcaccggcgacttccacgccatcggtgcggcgaataacctcctcgccgccatgctcgacaaccatatctaccaaggtaacgagttgaacatcgaccccaaacgcgtgctgtggcggcgcgtggtcgatatgaacgaccgccagttgcgcaacatcatcgacggtatgggcaagcctgttgacggcgtgatgcgtcccgacggcttcgacatcaccgtcgcctccgaagtgatggcggtattctgccttgccaaagacatcagcgatttgaaagagcgttttggcaatattctcgtcgcctacgccaaagacggcagccccgtttacgccaaagatttgaaggcacacggcgcgatggcggcattgctaaaagatgcgattaagcccaatttggtgcaaaccatcgaaggcactccggcctttgtacacggcggcccgttcgccaacatcgcccacggctgcaactccgttaccgcaacccgtctggcgaaacaccttgccgattacgccgtaaccgaagcaggcttcggcgcggacttgggtgcggaaaaattctgcgacatcaaatgccgccttgccggtttgaaacctgatgcggcagtcgtcgtggcgactgtccgcgccctgaaatacaacggcggcgtggaacgcgccaaccttggtgaagaaaacctcgaagccttggcaaaaggtttgcccaacctgttgaaacacatttccaacctgaaaaacgtattcggactgcccgtcgtcgttgcgctcaaccgcttcgtgtccgactccgatgccgagttggcgatgattgaaaaagcctgtgccgaacacggcgttgaagtttccctgaccgaagtgtggggcaaaggcggcgcgggcggcgcggatttggcgcgcaaagtcgtcaatgccatcgacaaccaacctaataacttcggtttcgcctacgatgtcgagttgggcatcaaagacaaaatccgtgcgattgcccaaaaagtgtacggcgcggaagatgtcgatttcagcgcggaagcgtctgccgaaatcgcctcgctggaaaaactgggcttggacaaaatgccgatctgcatggcgaaaacccaatattcattgagcgacaacgccaaactcttgggctgccccgaaggcttccgcatcgccgtacgcggtatcactgtttccgccggcgcgggcttcatcgttgcgttgtgcggcaatatgatgaaaatgccgggcctgccgaaagttccggctgccgagaaaatcgatgtggacgaacacggcgtgattcacggcttgttctga

SEQ ID NO: 554 - protein, 558 aa, Neisseria gonorrhoeae
MSFKTDAETAQSSTMRPIGEIAAKLGLNVDNIEPYGHYKAKINPAEAFKLPQKQGRLILVTAINPTPAGEGKTTVTIGLADALRHIGKDSVIALREPSLGPVFGVKGGAAGGGYAQVLPMEDINLHFTGDFHAIGAANNLLAAMLDNHIYQGNELNIDPKRVLWRRVVDMNDRQLRNIIDGMGKPVDGVMRPDGFDITVASEVMAVFCLAKDISDLKERFGNILVAYAKDGSPVYAKDLKAHGAMAALLKDAIKPNLVQTIEGTPAFVHGGPFANIAHGCNSVTATRLAKHLADYAVTEAGFGADLGAEKFCDIKCRLAGLKPDAAVVVATVRALKYNGGVERANLGEENLEALAKGLPNLLKHISNLKNVFGLPVVVALNRFVSDSDAELAMIEKACAEHGVEVSLTEVWGKGGAGGADLARKVVNAIDNQPNNFGFAYDVELGIKDKIRAIAQKVYGAEDVDFSAEASAEIASLEKLGLDKMPICMAKTQYSLSDNAKLLGCPEGFRIAVRGITVSAGAGFIVALCGNMMKMPGLPKVPAAEKIDVDEHGVIHGLF

SEQ ID NO: 555 - DNA, 1677 bp, Neisseria meningitidis
atgagcttcaaaaccgatgccgaaatcgcccaatcctccaccatgcgcccgattggcgaaattgccgccaagcttggtctgaatgccgacaacattgagccttacggtcattacaaggcgaaaatcaatcctgccgaagcgttcaaactgccgcaaaaacagggcaggctgattttggttaccgccatcaacccgactccggcgggcgaaggcaaaaccaccgtaaccatcggtttggcggacgcgttgcgccacatcggcaaagatgccgtgattgccctgcgcgaaccttctctggggccggtgttcggcgtgaaaggcggcgcggcaggcggcggctatgcccaagttttgccgatggaagacatcaacctgcacttcaccggagattttcacgccatcggtgcggcaaataatctgcttgccgcgatgctcgacaaccatatctaccaaggcaacgagttgaacatcgaccccaaacgcgtgctgtggcggcgcgtggtcgatatgaacgaccgccagttgcgcaacatcatcgacggcatgggtaaacccgttgacggcgtgatgcgtcctgacggtttcgatattaccgttgcttccgaagtgatggcggtattctgtcttgccaaagacatcagcgatttgaaagagcgtttgggcaacatccttgtcgcctacgccaaagacggcagccccgtttacgccaaagatttgaaagcgaatggcgcgatggcggcattgcttaaagatgcgattaagcccaacttggtgcaaaccatcgaaggcacgcccgccttcgtacacggcggcccgttcgccaacatcgcccacggctgcaactccgtaaccgcaacccgtctggcgaaacaccttgccgattacgccgtaaccgaagcaggcttcggcgcggacttgggcgcggaaaaattctgcgacatcaaatgccgccttgccggtttgaaacctgatgcggctgttgtcgtggcgactgtccgcgcgttgaaatataacggcggcgtggaacgcgccaacctcggcgaagaaaatttagacgctttggaaaaaggtttgcccaacctgctgaaacacatttccaacctgaaaaacgtattcggactgcccgtcgtcgttgcgctcaaccgcttcgtgtccgacgccgatgccgagttggcgatgattgaaaaagcctgtgccgaacacggcgttgaagtttccctgaccgaagtgtggggcaaaggtggtgcgggcggcgcggatttggcgcgcaaagtcgtcaacgccattgaaagtcaaaccaataacttcggtttcgcctacgatgtcgagttgggcatcaaagacaaaatccgtgcgattgcccaaaaagtgtacggcgcggaagatgttgatttcagcgcggaagcgtctgccgaaatcgcttcactggaaaaactgggcttggacaaaatgccgatctgcatggcgaaaacccaatactctttgagcgacaacgccaaactgttgggctgccccgaagacttccgcatcgccgtgcgcggcatcaccgtttccgcaggcgcaggtttcatcgtcgccctgtgcggcaacatgatgaaaatgcccggcctgcccaaagttccggctgccgagaaaatcgatgtggacgcagaaggcgtgattcacggcttgttctga

SEQ ID NO: 556 - protein, 558 aa, Neisseria meningitidis
MSFKTDAEIAQSSTMRPIGEIAAKLGLNADNIEPYGHYKAKINPAEAFKLPQKQGRLILVTAINPTPAGEGKTTVTIGLADALRHIGKDAVIALREPSLGPVFGVKGGAAGGGYAQVLPMEDINLHFTGDFHAIGAANNLLAAMLDNHIYQGNELNIDPKRVLWRRVVDMNDRQLRNIIDGMGKPVDGVMRPDGFDITVASEVMAVFCLAKDISDLKERLGNILVAYAKDGSPVYAKDLKANGAMAALLKDAIKPNLVQTIEGTPAFVHGGPFANIAHGCNSVTATRLAKHLADYAVTEAGFGADLGAEKFCDIKCRLAGLKPDAAVVVATVRALKYNGGVERANLGEENLDALEKGLPNLLKHISNLKNVFGLPVVVALNRFVSDADAELAMIEKACAEHGVEVSLTEVWGKGGAGGADLARKVVNAIESQTNNFGFAYDVELGIKDKIRAIAQKVYGAEDVDFSAEASAEIASLEKLGLDKMPICMAKTQYSLSDNAKLLGCPEDFRIAVRGITVSAGAGFIVALCGNMMKMPGLPKVPAAEKIDVDAEGVIHGLF

SEQ ID NO: 557 - DNA, 1677 bp, Neisseria meningitidis
atgagtttcaaaaccgatgccgaaatcgcccaatcctccaccatgcgcccgattggcgaaattgccgccaagctgggtttgaacgttgacaacattgagccttacggtcattacaaagccaaaatcaatcctgccgaagcgttcaaactgccgcaaaaacagggcaggctgattttggttaccgccatcaacccgactccggcgggcgaaggtaaaaccaccgtaaccatcggtttggcggacgcattgcgccatatcggcaaagactctgtgattgctttgcgcgagccttctttgggtccggtgttcggcgtgaaaggcggcgcggcaggcggcggctatgcccaagttttgccgatggaagacatcaacctgcacttcaccggagattttcacgccatcggtgcggcaaataatctgcttgccgcgatgctcgacaaccatatctaccaaggcaacgagttgaacatcgaccccaaacgcgtgctgtggcggcgcgtggtcgatatgaacgaccgccagttgcgcaacatcatcgacggcatgggcaagcctgttgacggcgtgatgcgtcctgacggtttcgatattaccgttgcttccgaagtgatggcggtattctgtcttgccaaagacatcagcgatttgaaagagcgtttgggcaacatccttgtcgcctacgccaaagacggcagccccgtttacgccaaagatttgaaagcgaatggcgcgatggcggcattgcttaaagatgcgattaagcccaacttggtgcaaaccatcgaaggcacgcccgccttcgtacacggcggcccgttcgccaacatcgcccacggctgcaactccgtaaccgcaacccgtctggcgaaacaccttgccgattacgccgtaaccgaagcaggcttcggcgcggacttgggcgcggaaaaattctgcgacatcaaatgccgccttgccggtttgaaacctgatgcggctgttgtcgtggcgactgtccgcgcgttgaaatataacggcggcgtggaacgcgccaacctcggcgaagaaaatttagacgctttggaaaaaggtttgcccaacctgctgaaacacatttccaacctgaaaaacgtattcggactgcccgtcgtcgttgcgctcaaccgcttcgtgtccgactccgatgccgagttggcgatgattgaaaaagcctgtgccgaacacggcgttgaagtttccctgaccgaagtgtggggcaaaggtggtgcgggcggcgcggatttggcgcgcaaagtcgtcaacgccattgaaagtcaaaccaataacttcggtttcgcctacgatgtcgagttgggcatcaaagacaaaatccgtgcgattgcccaaaaagtgtacggcgcggaagatgttgatttcagcgcggaagcgtctgccgaaatcgcttcactggaaaaactgggcttggacaaaatgccgatctgcatggcgaaaacccaatactctttgagcgacaacgccaaactgttgggctgccccgaagacttccgcatcgccgtgcgcggcatcaccgtttccgcaggcgcaggtttcatcgtcgccctgtgcggcaacatgatgaaaatgcccggcctgcccaaagttccggctgccgagaaaatcgatgtggacgcagaaggcgtgattcacggcttgttctga

SEQ ID NO: 558 - protein, 558 aa, Neisseria meningitidis
MSFKTDAEIAQSSTMRPIGEIAAKLGLNVDNIEPYGHYKAKINPAEAFKLPQKQGRLILVTAINPTPAGEGKTTVTIGLADALRHIGKDSVIALREPSLGPVFGVKGGAAGGGYAQVLPMEDINLHFTGDFHAIGAANNLLAAMLDNHIYQGNELNIDPKRVLWRRVVDMNDRQLRNIIDGMGKPVDGVMRPDGFDITVASEVMAVFCLAKDISDLKERLGNILVAYAKDGSPVYAKDLKANGAMAALLKDAIKPNLVQTIEGTPAFVHGGPFANIAHGCNSVTATRLAKHLADYAVTEAGFGADLGAEKFCDIKCRLAGLKPDAAVVVATVRALKYNGGVERANLGEENLDALEKGLPNLLKHISNLKNVFGLPVVVALNRFVSDSDAELAMIEKACAEHGVEVSLTEVWGKGGAGGADLARKVVNAIESQTNNFGFAYDVELGIKDKIRAIAQKVYGAEDVDFSAEASAEIASLEKLGLDKMPICMAKTQYSLSDNAKLLGCPEDFRIAVRGITVSAGAGFIVALCGNMMKMPGLPKVPAAEKIDVDAEGVIHGLF

SEQ ID NO: 559 - DNA, 477 bp, Neisseria gonorrhoeae
atgcgtgccgatttcatgtttgccgacaatatgcccgtgcaggtgcgccaacgcgccttctatttcaagttgtcccgttttgccgcgatgccaaatatggtaggcaaaccgctcttcgggcgacaggccggtcagcccggcaaaatgttcggcaacatcctgatgttcgtccgccagcatattgatgcagaggctgccgttttccgacaggatcggaatgattcgcgcactccggtttatgcacagcatcacggtcggcggctcgtcggtaaccggcgcaaccgccgtcattgtaatgccgtaacgccctgccgcaccgtctgtcgtgatgacatgaacgcctgccgcacaggatgccatcgcatcacggaacgaagtttgaaaagttttctgcaaatccgccatttttcccctttaaaccgtcccctatataagaatgctgcacacaaggcatccccccatgtgcagcagttctga

SEQ ID NO: 560 - protein, 158 aa, Neisseria gonorrhoeae
MRADFMFADNMPVQVRQRAFYFKLSRFAAMPNMVGKPLFGRQAGQPGKMFGNILMFVRQHIDAEAAVFRQDRNDSRTPVYAQHHGRRLVGNRRNRRHCNAVTPCRTVCRDDMNACRTGCHRITERSLKSFLQIRHFSPLNRPLYKNAAHKASPHVQQF

SEQ ID NO: 561 - DNA, 477 bp, Neisseria meningitidis
atgcgtgccgatttcatgtttgccgacaatatgcccgtgcaggtgcgccaacgcgccctctatttcaagttgtcccgttttgccgcgatgccagatgtggtaggcaaaccgctcttcgggcgacaggccggtcagcccggcaaaatgttcggcaacatcctgatgttcgtccgccagcgtattgatgcagaggctgccgttttccgacaggatcggaatgattcgcgcactccggttgatgcacagcatcacggtcggcggctcgtcggtaaccggcgcgaccgccgtcattgtaatgccgtaacgccctgccgcaccgtctgtcgtgatgacatgaacgcctgccgcgcaagatgccatcgcatcacggaacgaagtttgaaaatttttctgcaaatccgccatttttcccctttaaactgtcccctatataagaatgctgcacacaaggcatccccccatgtgcagcagttttga

SEQ ID NO: 562 - protein, 158 aa, Neisseria meningitidis
MRADFMFADNMPVQVRQRALYFKLSRFAAMPDVVGKPLFGRQAGQPGKMFGNILMFVRQRIDAEAAVFRQDRNDSRTPVDAQHHGRRLVGNRRDRRHCNAVTPCRTVCRDDMNACRARCHRITERSLKIFLQIRHFSPLNCPLYKNAAHKASPHVQQF

SEQ ID NO: 563 - DNA, 948 bp, Neisseria meningitidis
atgcgtgccgatttcatgtttgccgacaatatgcccgtgcaggtgcgccaacgcgccctctatttcaagttgtcccgttttgccgcgatgccagatgtggtaggcaaaccgctcttcgggcgacaggccggtcagcccggcaaaatgttcggcaacatcctgatgttcgtccgccagcgtattgatgcagaggctgccgttttccgacaggatcggaatgattcgcgcactccggttgatgcacagcatcacggtcggcggctcgtccgtaaccggcgcaaccgccgtcattgtaatgccgtaacgccctgccgcaccgtctgtcgtgatgacatgaacgcctgccgcacaggatgccatcgcatcacggaacgaagtttgaaaagttttctgcaaatccgccatttttcccctttaaactgtcccctatataagaatgctgcacacaaggcaccccccatgtgcagcagttctgattcaaaaagccgtcggtcggacatttccgcgcgttacggcgtattacgagttcaacgcatcctcgattttggcaagttctgccaacaggtctttaagcagcagcattttctcgcggcccagcacttcctcgatagcgtcgtaacgctcgtccacttcttcgccgatttcctcatacagcttctcgccctcggcagtcagcttcagaaaaacacgtcgttggtcgttggaaggtttcaggcggacaaccaaacccgctttttcaaggcgggtcaggataccggtcaggctggggcgcaaaatgcacgcctgattcgccaaatcttgaaagtccagcgtgccgttttccgccaaaagacggataatccgccattgctgatcggtaatattcgcctgattcagaataggcctgaattgggtcatcagggcttcccttgcctgtatcagaccgatattgatagacgcatgttttga

SEQ ID NO: 564 - protein, 315 aa, Neisseria meningitidis
MRADFMFADNMPVQVRQRALYFKLSRFAAMPDVVGKPLFGRQAGQPGKMFGNILMFVRQRIDAEAAVFRQDRNDSRTPVDAQHHGRRLVRNRRNRRHCNAVTPCRTVCRDDMNACRTGCHRITERSLKSFLQIRHFSPLNCPLYKNAAHKAPPMCSSSDSKSRRSDISARYGVLRVQRILDFGKFCQQVFKQQHFLAAQHFLDSVVTLVHFFADFLIQLLALGSQLQKNTSLVVGRFQADNQTRFFKAGQDTGQAGAQNARLIRQILKVQRAVFRQKTDNPPLLIGNIRLIQNRPELGHQGFPCLYQTDIDRRMF

SEQ ID NO: 565 - DNA, 1290 bp, Neisseria gonorrhoeae
atgttgagcttcggctatctcggcgttcagacggcctttaccctgcaaagctcgcagatgagccgcatttttcaaacgctaggcgcagacccgcacaatttgggctggtttttcatcctgccgccgctggcggggatgctggttcagccgatagtgggctactactcagaccgcacttggaagccgcgcttgggcggccgccgcctgccgtatctgctttacggcacgctgattgcggtcatcgtgatgattttgatgccgaactcgggcagcttcggtttcggctatgcgtcgctggcggccttgtcgttcggcgcgctgatgattgcgctgttggacgtgtcgtcgaatatggcgatgcagccgtttaagatgatggtcggcgatatggtcaacgaggagcagaaaagctacgcctacgggattcaaagtttcttagcgaatacggacgcggttgtggcagcgattctgccgtttgtgttcgcgtatatcggtttggcgaacactgccgagaaaggcgttgtgccacaaaccgtggtcgtagcattctatgtgggtgcggcgttactgattattaccagtgcgttcacaatctccaaagtcaaagaatacgacccggaaacctacgcccgttaccacggcatcgatgtcgccgcgaatcaggaaaaagccaactggttcgaactcttaaaaaccgcgcctaaagtgttttggacggttactccggtacagtttttctgctggttcgccttccggtatatgtggacttactcggcaggcgcgattgcagaaaacgtctggcacactaccgatgcgtcttccgtaggccatcaggaggcgggcaaccggtacggcgttttggcggcggtgtagtcggttgcggcggtgatttgttcgtttattctggcaaaagtaccgaataaataccataaggcgggttatttcggctgtttggctttgggcgcgctcggtttcttctctatcttcttcatctacaatcaatacgcactcatcctgtcttatatcttaatcggcatcgcttgggcgggcattatcacttatccgctgacgattgtggccaacgctttgtcgggcaaacacatggatacttatttgggcctgtttaacggctctgtctgtatgccgcaaatcgtcgcttcgctgttgagtttcgtgcttttcccgatgctgggcggccatcaggcaaccatgttcttggttgcaggcgcagtcttgctgctgggagccttctcagtctgtctgattaaagagatccacggcggggtttga

SEQ ID NO: 566 - protein, 428 aa, Neisseria gonorrhoeae
MLSFGYLGVQTAFTLQSSQMSRIFQTLGADPHNLGWFFILPPLAGMLVQPIVGYYSDRTWKPRLGGRRLPYLLYGTLIAVIVMILMPNSGSFGFGYASLAALSFGALMIALLDVSSNMAMQPFKMMVGDMVNEEQKSYAYGIQSFLANTDAVVAAILPFVFAYIGLANTAEKGVVPQTVVVAFYVGAALLIITSAFTISKVKEYDPETYARYHGIDVAANQEKANWFELLKTAPKVFWTVTPVQFFCWFAFRYMWTYSAGAIAENVWHTTDASSVGHQEAGNRYGVLAAVSVAAVICSFILAKVPNKYHKAGYFGCLALGALGFFSIFFIYNQYALILSYILIGIAWAGIITYPLTIVANALSGKHMDTYLGLFNGSVCMPQIVASLLSFVLFPMLGGHQATMFLVAGAVLLLGAFSVCLIKEIHGGV

SEQ ID NO: 567 - DNA, 1290 bp, Neisseria meningitidis
atgctcagtttcggctttctcggcgttcagacggcctttaccctgcaaagctcgcaaatgagccgcatttttcaaacgctaggcgcagacccgcacaatttgggctggtttttcatcctgccgccgctggcggggatgctggtgcagccgattgtcggccattactccgaccgcacttggaagccgcgtttgggcggccgccgtctgccgtatctgctttatggcacgctgattgcggttattgtgatgattttgatgccgaactcgggcagcttcggtttcggctatgcgtcgctggcggctttgtcgttcggcgcgctgatgattgcgctgttagacgtgtcgtcaaatatggcgatgcagccgtttaagatgatggtcggcgacatggtcaacgaggagcagaaaggctacgcctacgggattcaaagtttcttagcaaatacgggcgcggtcgtggcggcgattctgccgtttgtgtttgcgtatatcggtttggcgaacaccgccgagaaaggcgttgtgccgcagaccgtggtcgtggcgttttatgtgggtgcggcgttgctggtgattaccagcgcgttcacgattttcaaagtgaaggaatacgatccggaaacctacgcccgttaccacggcatcgatgtcgccgcgaatcaggaaaaagccaactggatcgaactcttgaaaaccgcgcctaaggcgttttggacggttactttggtgcaattcttctgctggttcgccttccaatatatgtggacttactcggcaggcgcgattgcggaaaacgtctggcacaccaccgatgcgtcttccgtaggttatcaggaggcgggtaactggtacggcgttttggcggcggtgcagtcggttgcggcggtgatttgttcgtttgtattggcgaaagtgccgaataaataccataaggcgggttatttcggctgtttggctttgggcgcgctcggctttttctccgttttcttcatcggcaaccaatacgcgctggtgttgtcttataccttaatcggcatcgcttgggcgggcattatcacttatccgctgacgattgtgaccaacgccttgtcgggcaagcatatgggcacttacttgggcttgtttaacggctctatctgtatgcctcaaatcgtcgcttcgctgttgagtttcgtgcttttccctatgctgggcggcttgcaggccactatgttcttggtagggggcgtcgtcctgctgctgggcgcgttttccgtgttcctgattaaagaaacacacggcggggtttga

SEQ ID NO: 568 - protein, 429 aa, Neisseria meningitidis
MLSFGFLGVQTAFTLQSSQMSRIFQTLGADPHNLGWFFILPPLAGMLVQPIVGHYSDRTWKPRLGGRRLPYLLYGTLIAVIVMILMPNSGSFGFGYASLAALSFGALMIALLDVSSNMAMQPFKMMVGDMVNEEQKGYAYGIQSFLANTGAVVAAILPFVFAYIGLANTAEKGVVPQTVVVAFYVGAALLVITSAFTIFKVKEYDPETYARYHGIDVAANQEKANWIELLKTAPKAFWTVTLVQFFCWFAFQYMWTYSAGAIAENVWHTTDASSVGYQEAGNWYGVLAAVQSVAAVICSFVLAKVPNKYHKAGYFGCLALGALGFFSVFFIGNQYALVLSYTLIGIAWAGIITYPLTIVTNALSGKHMGTYLGLFNGSICMPQIVASLLSFVLFPMLGGLQATMFLVGGVVLLLGAFSVFLIKETHGGV

SEQ ID NO: 569 - DNA, 1290 bp, Neisseria meningitidis
atgctcagtttcggctttctcggcgttcagacggcctttaccctgcaaagctcgcagatgagccgcatcttccagacgctcggtgccgatccgcacagcctcggctggttctttatcctgccgccgctggcggggatgctggtgcagccgattgtcggccattactccgaccgcacttggaagccgcgtttgggcggccgccgtctgccgtatctgctttatggcacgctgattgcggttattgtgatgattttgatgccgaactcgggcagcttcggtttcggctatgcgtcgctggcggctttgtcgttcggcgcgctgatgattgcgctgttagacgtgtcgtcaaatatggcgatgcagccgtttaagatgatggtcggcgacatggtcaacgaggagcagaaaggctacgcctacgggattcaaagtttcttagcgaatacgggcgcggtcgtggcggcgattctgccgtttgtgtttgcgtatatcggtttggcgaacaccgccgagaaaggcgttgtgccgcagaccgtggtcgtggcgttttatgtgggtgcggcgttgctggtgattaccagcgcgttcacgattttcaaagtgaaggaatacaatccggaaacctacgcccgttaccacggcatcgatgtcgccgcgaatcaggaaaaagccaactggatcgaactcttgaaaaccgcgcctaaggcgttttggacggttactttggtgcaattcttctgctggttcgccttccaatatatgtggacttactcggcaggcgcgattgcggaaaacgtctggcacaccaccgatgcgtcttccgtaggttatcaggaggcgggtaactggtacggcgttttggcggcggtgcagtcggttgcggcggtgatttgttcgtttgtattggcgaaagtgccgaataaataccataaggcgggttatttcggctgtttggctttgggcgcgctcggctttttctccgttttcttcatcggcaaccaatacgcgctggtgttgtcttataccttaatcggcatcgcttgggcgggcattatcacttatccgctgacgattgtgaccaacgccttgtcgggcaagcatatgggcacttacttgggcctgtttaacggctctatctgtatgccgcaaatcgtcgcttcgctgttgagtttcgtgcttttccctatgctgggcggcttgcaggccactatgttcttggtagggggcgtcgtcctgctgctgggcgcgttttccgtgttcctgattaaagaaacacacggcggggtttga

SEQ ID NO: 570 - protein, 429 aa, Neisseria meningitidis
MLSFGFLGVQTAFTLQSSQMSRIFQTLGADPHSLGWFFILPPLAGMLVQPIVGHYSDRTWKPRLGGRRLPYLLYGTLIAVIVMILMPNSGSFGFGYASLAALSFGALMIALLDVSSNMAMQPFKMMVGDMVNEEQKGYAYGIQSFLANTGAVVAAILPFVFAYIGLANTAEKGVVPQTVVVAFYVGAALLVITSAFTIFKVKEYNPETYARYHGIDVAANQEKANWIELLKTAPKAFWTVTLVQFFCWFAFQYMWTYSAGAIAENVWHTTDASSVGYQEAGNWYGVLAAVQSVAAVICSFVLAKVPNKYHKAGYFGCLALGALGFFSVFFIGNQYALVLSYTLIGIAWAGIITYPLTIVTNALSGKHMGTYLGLFNGSICMPQIVASLLSFVLFPMLGGLQATMFLVGGVVLLLGAFSVFLIKETHGGV

SEQ ID NO: 571 - DNA, 612 bp, Neisseria gonorrhoeae
atgagcgatacccccgctacccgcgatttcggcctgatcgacgggcgggccgtaaccggctatgtgctgtccaaccggcgtggtacgtgcgtcttcgtgctggacttgggcgggattgtgcaggaattttccgttttggcagacggcgtgcgcgaaaaccccgtggtgtcgttcgacgatgcggcttcctatgcggacaatccgtttcagattaacaagcagatagggcgcgtggccggacgcatccgcggtgcggcgttcgacatcaacggtaggacttaccgcgtggaggccaacgaaggcaggaacgcgctgcacggcggttcgcacgggctggccgttacccgtttcaacgcggtggcggcagacggccgacggttatcccaacgatttggatatttcctaccgcttggacgaggacggccggcttaccgttacctatcgcgccaccgcgctcggcgacacggtgttcgacccgacgctgcacatttactggcggctggacgcgggcctgcacgatgcggttctgcatattccgcagggcggacatattccggccgatgccgaaaaactgcccgtcttaacggtttcagacggcctcgaagtatttga

SEQ ID NO: 572 - protein, 203 aa, Neisseria gonorrhoeae
MSDTPATRDFGLIDGRAVTGYVLSNRRGTCVFVLDLGGIVQEFSVLADGVRENPVVSFDDAASYADNPFQINKQIGRVAGRIRGAAFDINGRTYRVEANEGRNALHGGSHGLAVTRFNAVAADGRRLSQRFGYFLPLGRGRPAYRYLSRHRARRHGVRPDAAHLLAAGRGPARCGSAYSAGRTYSGRCRKTARLNGFRRPRSI

SEQ ID NO: 573 - DNA, 657 bp, Neisseria meningitidis
atgagcgatacccccgctacccgcgatttcggtctgatcgacgggcgtgccgtaaccggctatgtgctgtccaaccggcgtggtacgcgtgtctgcgtgctggacttgggcgggattgtgcaggaattttccgttttggcagacggcgtgcgcgaaaacctcgtggtgtcgttcgatgatgcggcttcctatgcggacaatccgtttcagattaacaaacagatagggcgcgtggccggacgcatccgcggtgcggcgttcgacatcaacggcaggacttaccgcgtggaggccaacgaaggcaggaacgcgctgcacggcggttcgcacgggctggccgttacccgtttcaacgcggtggcggcagacggccgttcggtggtgctgcgcagccgcctggcaacagtcggccgacggttatcccaacgatttggatttggatatttcctaccgcttggacgaggacgaccggcttaccgttacctatcgcgccaccgcgctcggcgacacggtgttcgacccgacgctgcacatttactggcggctggacgcgggcctgcacgatgcggttctgcatattccgcagggcggacatatgccggccgatgccgaaaaactgcccgtctcaacggtttcagacgacctcgaagtatttga

SEQ ID NO: 574 - protein, 218 aa, Neisseria meningitidis
MSDTPATRDFGLIDGRAVTGYVLSNRRGTRVCVLDLGGIVQEFSVLADGVRENLVVSFDDAASYADNPFQINKQIGRVAGRIRGAAFDINGRTYRVEANEGRNALHGGSHGLAVTRFNAVAADGRSVVLRSRLATVGRRLSQRFGFGYFLPLGRGRPAYRYLSRHRARRHGVRPDAAHLLAAGRGPARCGSAYSAGRTYAGRCRKTARLNGFRRPRSI

SEQ ID NO: 575 - DNA, 656 bp, Neisseria meningitidis
atgagcgatacccccgctacccgcgatttcggcctgatcgacgggcgtgccgtaaccggctatgtgctgtccaaccggcgtggtacgcgtgtctgcgtgctggacttgggcgggattgtgcaggaattttccgttttggcagacggcgtgcgcgaaaacctcgtggtgtcgttcgacgatgcggcttcctatgcggacaatccgtttcagattaacaagcagatagggcgcgtggccggacgcatccgcggtgcggcgttcgacatcaacggcaggacttaccgcgtggaggccaacgaaggcaggaacgcgctgcacggcggttcgcacgggctggccgttacccgtttcaacgcggtggcggcagacggccgttcggtggtgctgcgcagccgcctgcaacagtcggccgacggttatcccaacgatttggatttggatatttcctaccgcttggacgaggacgaccggcttaccgttacctatcgcgccaccgcgctcggcgacacggtgttcgacccgacgctgcacatttactggcggctggacgcgggcctgcacgatgcggttctgcatattccgcagggcggacatattccggccgatgccgaaaaactgcccgtctcaacggtttcagacgacctcgaagtatttga

SEQ ID NO: 576 - protein, 218 aa, Neisseria meningitidis
  misc_feature (134)..(134): Xaa can be any naturally occurring amino acid
MSDTPATRDFGLIDGRAVTGYVLSNRRGTRVCVLDLGGIVQEFSVLADGVRENLVVSFDDAASYADNPFQINKQIGRVAGRIRGAAFDINGRTYRVEANEGRNALHGGSHGLAVTRFNAVAADGRSVVLRSRLXTVGRRLSQRFGFGYFLPLGRGRPAYRYLSRHRARRHGVRPDAAHLLAAGRGPARCGSAYSAGRTYSGRCRKTARLNGFRRPRSI

SEQ ID NO: 577 - DNA, 639 bp, Neisseria gonorrhoeae
atgaagcaaatccccctccgccttctccaggtcgtcattgaccacgacaaagtcgaacaatacggactgttcgatttcatgccttgccttcgacagcctcctttggataacttcccgactgtccgtcccgcgccctttgaggcgcgcggcaagcacgtcgaaagaaggcggcaggataaagataccgacagcttccggcagcgcgttgcgaacctgcgccgcgccctgaacgtcgatttccaaaatcacgtcatagcctgccgccgccaacgcattcacgccctccgtgcttgtgccgtaatagttgccgaatacgtctgcgtattccaaaaaagcctcctgcgcgataagcgattcaaactcttctttggaaacaaagtgataatgtacgccgtttgcttcgccttcacgcggcgggcgcgtcgtatgcgacacggaaacgcgcaaaccgttatggtttgccaacagccgcgacaccagcgtggttttgcccgtgccggaagcggccgaaatgataaagatgttgccttttcgataagcggacatattttttacctgtatattttccaaccgattgtatcacaacggacaccctatttcatatttgccgatgcccatattttgccgctattgttttga

SEQ ID NO: 578 - protein, 212 aa, Neisseria gonorrhoeae
MKQIPLRLLQVVIDHDKVEQYGLFDFMPCLRQPPLDNFPTVRPAPFEARGKHVERRRQDKDTDSFRQRVANLRRALNVDFQNHVIACRRQRIHALRACAVIVAEYVCVFQKSLLRDKRFKLFFGNKVIMYAVCFAFTRRARRMRHGNAQTVMVCQQPRHQRGFARAGSGRNDKDVAFSISGHIFYLYIFQPIVSQRTPYFIFADAHILPLLF

SEQ ID NO: 579 - DNA, 639 bp, Neisseria meningitidis
atggcgcaaatcctcctccgctcgcgccaagtcgtcattgaccacgacaaagtcaaacaatacggactgctcgatttcatgccttgccttcgacagcctcctttggataacttcccgactgtccgtcccgcgtccgttgaggcgcgcggcaagtacgtcgaaagaaggcggcaggataaagatgccgacggcttcgggcagcgcgtcgcgaacctgcgccgcgccctgaacgtcgatttccaaaatcacgtcatagcctgccgccgccaacgcattcacaccctccgcgcctgtgccgtaatagttgccaaatacgtcggcgtattccaaaaaagcttcctgcgcgataagcgactcaaactcttctttggaaacaaagtgataatgtacgccgtttgcttcgccttcacgcggcgggcgcgtcgtgtgcgacacggaaacgcgcaaaccgttatggtttgccaacagccgcgacaccagcgtggttttgcccgtgccggaagcggccgaaatgataaagatgttgccttttcgataagcggacatattttttacctgtatattttccagccgattgtatcacaatggacacccagtttcctatttgccgatgcccatattttgccgctattgttttga

SEQ ID NO: 580 - protein, 212 aa, Neisseria meningitidis
MAQILLRSRQVVIDHDKVKQYGLLDFMPCLRQPPLDNFPTVRPASVEARGKYVERRRQDKDADGFGQRVANLRRALNVDFQNHVIACRRQRIHTLRACAVIVAKYVGVFQKSFLRDKRLKLFFGNKVIMYAVCFAFTRRARRVRHGNAQTVMVCQQPRHQRGFARAGSGRNDKDVAFSISGHIFYLYIFQPIVSQWTPSFLFADAHILPLLF

SEQ ID NO: 581 - DNA, 639 bp, Neisseria meningitidis
atggcgcaaatcctcctccgcccgcgccaagtcatcattgaccacgacaaaatcgaacaatacggactgttcgatttcatgccttgccttcgacagcctcctttggataacttcccgactgtccgtcccgcgtccgttgagacgcgcagcaagcacatcgaaagacggcggcaggataaagatgccgacggcttcgggcagcgcatctcgaacctgagccgcgccctgaacgtcgatttccaaaatcacgtcataacctgccgccgccaacgcattcacaccctccgcgcttgtgccgtaatagttgccgaacacgtccgcgtattccaaaaaagcctcctgcgcgataagcgactcaaactcttctttggaaacaaagtgataatgtacgccgtttgcttcgccttcacgcggcggacgcgtcgtgtgcgacacggaaacgcgcaaaccgttatggtttgccaacagccgcgacaccagcgtggttttgcccgtgccggaagcggccgaaatgataaagatgttgccttttcgataagcggacatattttttacctgtatattttccagccgattgtatcacaacggacacccggtttcctatttgccgatgcccatattttgccgctattgttttga

SEQ ID NO: 582 - protein, 212 aa, Neisseria meningitidis
MAQILLRPRQVIIDHDKIEQYGLFDFMPCLRQPPLDNFPTVRPASVETRSKHIERRRQDKDADGFGQRISNLSRALNVDFQNHVITCRRQRIHTLRACAVIVAEHVRVFQKSLLRDKRLKLFFGNKVIMYAVCFAFTRRTRRVRHGNAQTVMVCQQPRHQRGFARAGSGRNDKDVAFSISGHIFYLYIFQPIVSQRTPGFLFADAHILPLLF

SEQ ID NO: 583 - DNA, 522 bp, Neisseria gonorrhoeae
atgcgacgagaagccaaaatggcacaaatcacactcaaacccattgttttatcaattcttttaatcaacacacccctcctcgcccaagcgcatgaaactgagcaatcggtgggcttggaaacggtcagcgtcgtcggcaaaagccgtccgcgcgcgacttcggggctgctgcacacttcgaccgcctccgacaaaatcatctccggcgatactttgcgccaaaaagccgtcaacttgggcgacgctttggacggcgtaccgggcatccacgcttcgcaatacggcggcggcgcatccgctcccgttattcgcggtcaaacgggcagacggattaaagtattgaaccatcacggcgaaacgggcgatatggcggacttttctcccgatcacgccattatggtagataccgccttgtcgcaacaggttgaaatcctgcgcgggccggttacgctcttgtacagctcgggcaatgtggccggggctggtcaatgttgccgatggaaaaatcccccaaaaaatgcc

SEQ ID NO: 584 - protein, 174 aa, Neisseria gonorrhoeae
MRREAKMAQITLKPIVLSILLINTPLLAQAHETEQSVGLETVSVVGKSRPRATSGLLHTSTASDKIISGDTLRQKAVNLGDALDGVPGIHASQYGGGASAPVIRGQTGRRIKVLNHHGETGDMADFSPDHAIMVDTALSQQVEILRGPVTLLYSSGNVAGAGQCCRWKNPPKNA

SEQ ID NO: 585 - DNA, 2205 bp, Neisseria meningitidis
ccgcataaaactgagcaatcggtggatttggaaacggtcagcgtcgtcggcaaaagccgtccgcgcgccacgtcggggctgttgcacacttcgaccgcctccgacaaaatcatctccggcgataccttgcgccaaaaagccgtcaacttgggcgacgctttagacggcgtaccgggcatccacgcttcgcaatacggcggcggcgcgtctgctcccgtcattcgcggtcaaacaggcaggcggattaaagtgttgaaccatcacggcgaaacaggcgatatggcggatttttcgcccgatcacgccattatggtagataccgccttgtcgcaacaggtcgaaatcctgcgcgggccggttacgctcttgtacagctcgggcaatgtggcggggctggtcgatgttgccgatggcaaaatccccgaaaaaatgcctgaaaacggcgtatcgggcgaactcggattgcgtttgagcagcggcaatctggaaaaactcacgtccggcggcatcaatatcggtttgggcaaaaactttgtattgcacacggaagggctgtaccgcaaatcgggggattacgccgtaccgcgttaccgcaatctgaaacgcctgcccgacagccacgccgattcgcaaacgggcagcatcgggctgtcttgggttggcgaaaaaggttttatcggcgtagcgtacagcgaccgtcgcgaccaatatggtctgcctgcccacagccacgaatacgatgattgccacgccgacatcatctggcaaaagagcttgattaacaaacgctatttacagctttatccgcacctgttgaccgaagaagacatcgattacgacaatccgggcttgagctgcggcttccacgacgacgataatgcacacgcacacacccacagcggcagaccgtggatagacctgcgcaacaaacgctacgaactccgtgccgaatggaagcaaccgttccccggttttgaagccctgcgcgtacacctgaaccgcaacgactaccgccacgacgaaaaagcaggcgatgcagtcgaaaacttttttaacaaccaaacgcaaaacgcccgcatcgagttgcgccaccaacccataggtcgtctgaaaggcagctggggcgtgcaatatttacaacaaaaatccagtgctttatctgccatatccgaagcggttaaacaaccgatgctgcttgacaacaaagtgcaacattacagctttttcggtgtagaacaggcaaactgggacaacttcacgcttgaaggaggcgtacgcgtggaaaaacaaaaagcctccattcagtacgacaaagcattgattgatcgggaaaactactacaaccaccccctgcccgacctcggcgcgcaccgccaaaccgcccgctcattcgcactttcgggcaactggtatttcacgccacaacacaaactcagcctgaccgcctcccatcaggaacgcctgccgtcaacgcaagagctgtacgcacacggcaaacacgtcgccaccaacacctttgaagtcggcaacaaacacctcaacaaagagcgttccaacaatatcgaactcgcgctgggctacgaaggcgaccgctggcaatacaatctggcactctaccgcaaccgcttcggtaactacatttacgcccaaaccttaaacgacggacgcggccccaaatccatcgaagacgacagcgaaatgaagctcgtgcgctacaaccaatccggcgccgacttctacggcgcggaaggcgaaatctacttcaaaccgacaccgcgctaccgcatcggcgtttccggcgactatgtacgaggccgtctgaaaaacctgccttccctacccggcagagaagatgcctacggcaaccgtcctttcatcgcacaggacgaccaaaatgccccccgtgttccggctgcgcgcctcggcttccacctgaaagcctcgctgaccgaccgtatcgatgccaatttggactactaccgcgtgttcgcccaaaacaaactcgcccgctacgaaacgcgcacgcccggacaccatatgctcaacctcggcgcaaactaccgccgcaatacgcgctatggcgagtggaattggtacgtcaaagccgacaacctgctcaaccaatccgtttacgcccacagcagctttctctctgatacgccgcaaatgggccgcagctttaccggcggcgtgaacgagttttaa

SEQ ID NO: 586 - protein, 735 aa, Neisseria meningitidis
PHKTEQSVDLETVSVVGKSRPRATSGLLHTSTASDKIISGDTLRQKAVNLGDALDGVPGIHASQYGGGASAPVIRGQTGRRIKVLNHHGETGDMADFSPDHAIMVDTALSQQVEILRGPVTLLYSSGNVAGLVDVADGKIPEKMPENGVSGELGLRLSSGNLEKLTSGGINIGLGKNFVLHTEGLYRKSGDYAVPRYRNLKRLPDSHADSQTGSIGLSWVGEKGFIGVAYSDRRDQYGLPAHSHEYDDCHADIIWQKSLINKRYLQLYPHLLTEEDIDYDNPGLSCGFHDDDNAHAHTHSGRPWIDLRNKRYELRAEWKQPFPGFEALRVHLNRNDYRHDEKAGDAVENFFNNQTQNARIELRHQPIGRLKGSWGVQYLQQKSSALSAISEAVKQPMLLDNKVQHYSFFGVEQANWDNFTLEGGVRVEKQKASIQYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPFIAQDDQNAPRVPAARLGFHLKASLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 587 - DNA, 2295 bp, Neisseria meningitidis
atgcgacgagaagccaaaatggcacaaactacactcaaacccattgttttatcaattcttttaatcaacacacccctcctctcccaagcgcatggaactgagcaatcagtgggcttggaaacggtcagcgtcgtcggcaaaagccgtccgcgcgccacttcggggctgctgcacacttctaccgcctccgacaaaatcatcagcggcgacaccttgcgacaaaaagccgtcaacttgggtgatgctttagacggcgtaccgggcattcatgcctcgcaatacggcggcggcgcatccgctcccgttattcgcggtcaaacaggcagacggattaaagtgttgaaccatcacggcgaaacgggcgacatggcggacttctctccagaccatgcaatcatggtggacagcgccttgtcgcaacaggtcgaaatcctgcgcggtccggttacgctcttgtacagctcgggcaatgtggcggggctggtcgatgttgccgatggcaaaatccccgaaaaaatgcctgaaaacggcgtatcgggcgaactcggattgcgtttgagcagcggcaatctggaaaaactcacgtccggcggcatcaatatcggtttgggcaaaaactttgtattgcacacggaagggctgtaccgcaaatcgggggattacgccgtaccgcgttaccgcaatctgaaacgcctgcccgacagccacgccgattcgcaaacgggcagcatcgggctgtcttgggttggcgaaaaaggctttatcggcgcagcatacagcgaccgtcgcgaccaatatggtctgcctgcccacagccacgaatacgatgattgccacgccgacatcatctggcaaaagagtttgattaacaaacgctatttgcagctttatccgcacctgttgaccgaagaagacatcgattacgacaatccgggcttgagctgcggctttcacgacgacgatgatgcacacgcccatgcccacaacggcaaaccttggatagacctgcgcaacaaacgctacgaactccgcgccgaatggaagcaaccgttccccggttttgaagccctgcgcgtacacctgaaccgcaacgactaccgccacgacgaaaaagcaggcgatgcagtagaaaacttttttaacaaccaaacgcaaaacgcccgtatcgagttgcgccaccaacccataggccgtctgaaaggcagctggggcgtgcaatatttgggacaaaaatccagtgctttatctgccacatccgaagcggtcaaacaaccgatgctgcttgacaataaagtgcaacattacagctttttcggtgtagaacaggcaaactgggacaacttcacgcttgaaggcggcgtacgcgtggaaaaacaaaaagcctccatccgctacgacaaagcattgattgatcgggaaaactactacaaccatcccctgcccgacctcggcgcgcaccgccaaaccgcccgctcattcgcactttcgggcaactggtatttcacgccacaacacaaactcagcctgaccgcctcccatcaggaacgcctgccgtcaacgcaagagctgtacgcacacggcaaacacgtcgccaccaacacctttgaagtcggcaacaaacacctcaacaaagagcgttccaacaatatcgaactcgcgctgggctacgaaggcgaccgctggcaatacaatctggcactctaccgcaaccgcttcggcaactacatttacgcccaaaccttaaacgacggacgcggccccaaatccatcgaagacgacagcgaaatgaagctcgtgcgctacaaccaatccggtgcggacttctacggcgcggaaggcgaaatctacttcaaaccgacaccgcgctaccgcatcggcgtttccggcgactatgtacgaggccgtctgaaaaacctgccttccctacccggcagggaagacgcctacggcaaccgcccactcattgcccaagccgaccaaaacgcccctcgcgttccggctgcgcgcctcggcgtccacctgaaagcctcgctgaccgaccgcatcgatgccaatttggactactaccgcgtgttcgcccaaaacaaactcgcccgctacgaaacgcgcacgcccggacaccatatgctcaacctcggcgcaaactaccgccgcaatacgcgctatggcgagtggaattggtacgtcaaagccgacaacctgctcaaccaatccgtttacgcccacagcagcttcctctctgatacgccgcaaatgggccgcagctttaccggcggcgtgaacgtgaagttttaa

SEQ ID NO: 588 - protein, 764 aa, Neisseria meningitidis
MRREAKMAQTTLKPIVLSILLINTPLLSQAHGTEQSVGLETVSVVGKSRPRATSGLLHTSTASDKIISGDTLRQKAVNLGDALDGVPGIHASQYGGGASAPVIRGQTGRRIKVLNHHGETGDMADFSPDHAIMVDSALSQQVEILRGPVTLLYSSGNVAGLVDVADGKIPEKMPENGVSGELGLRLSSGNLEKLTSGGINIGLGKNFVLHTEGLYRKSGDYAVPRYRNLKRLPDSHADSQTGSIGLSWVGEKGFIGAAYSDRRDQYGLPAHSHEYDDCHADIIWQKSLINKRYLQLYPHLLTEEDIDYDNPGLSCGFHDDDDAHAHAHNGKPWIDLRNKRYELRAEWKQPFPGFEALRVHLNRNDYRHDEKAGDAVENFFNNQTQNARIELRHQPIGRLKGSWGVQYLGQKSSALSATSEAVKQPMLLDNKVQHYSFFGVEQANWDNFTLEGGVRVEKQKASIRYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPLIAQADQNAPRVPAARLGVHLKASLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 589 - DNA, 600 bp, Neisseria gonorrhoeae
atggcgttaaaaacatcaaacttggaacacgcaatgctggttcatcccgaagctatgagtgtcggcgcgcttgccgacaaaatccgcaaaatcgaaaactggccgcaaaaaggcatcttattccacgacatcacgcccgtcctgcaaagtgcggaatacttccgccttttggtcgatttgctggtttaccgctatatggatcagaaaatcgacatcgttgccggcttggacgcgcgcggcttcattatcggcgcggcactcgcctaccagctcaacgtcggcttcgtccccatccgcaaaaaaggcaagctgccttttgaaaccgtatcgcaaagctacgcgctcgaatacggggaagctgcggtggaaatccacaccgatgccgtcaaacccggttcgcgcgtcctgctggtcgatgatttggttgccacgggcggcacaatgcttgccgggctggaactgatccgcaaactcggcggggaaattgtcgaagccgccgccattttggaatttaccgaccttcaaggcggcaagaatatccgcgcaagtggcgcgcccttatttaccctgcttcaaaacgaaggctgcatgaaaggctga

SEQ ID NO: 590 - protein, 199 aa, Neisseria gonorrhoeae
MALKTSNLEHAMLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKPGSRVLLVDDLVATGGTMLAGLELIRKLGGEIVEAAAILEFTDLQGGKNIRASGAPLFTLLQNEGCMKG

SEQ ID NO: 591 - DNA, 600 bp, Neisseria meningitidis
atggcgttaaaaacatcaaacttggaacacgcaatgctggttcatcccgaagctatgagtgtcggcgcgcttgccgacaaaatccgcaaaatcgaaaactggccgcaaaaaggcatcttattccacgacatcacgcccgtccttcaaagcgcggaatacttccgccttttggttgatttattggtttaccgctatatggatcagaaaatcgacatcgttgccggtttggacgcgcgcggcttcattatcggcgcggcactcgcctaccagctcaacgtcggtttcgtccccatccgcaaaaaaggcaagctgccttttgaaaccgtatcgcaaagctacgcgctcgaatacggggaagctgcggtggaaatccacaccgatgccgtcaaactcggttcgcgcgtgctgctggtcgatgatttgattgccacgggcggcacgatgcttgccggactggaactgatccgcaaactcggcggagaaattgtcgaagccgccgccattttggaatttaccgaccttcaaggcggcaagaatatccgtgcaagcggcgcgcccttatttaccctgcttcaaaacgaaggctgtatgaagggctga

SEQ ID NO: 592 - protein, 199 aa, Neisseria meningitidis
MALKTSNLEHAMLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKLGSRVLLVDDLIATGGTMLAGLELIRKLGGEIVEAAAILEFTDLQGGKNIRASGAPLFTLLQNEGCMKG

SEQ ID NO: 593 - DNA, 600 bp, Neisseria meningitidis
atggcgttaaaaacatcaaacttggaacacgcaatgctggttcatcccgaagctatgagtgtcggtgcgcttgccgacaaaatccgcaaaatcgaaaactggccgcaaaaaggcatcttattccacgacatcacgcccgtcctgcaaagcgcggaatacttccgacttttggttgatttattggtttaccgctatatggatcagaaaatcgacatcgttgccggtttggacgcgcgcggcttcattatcggcgcggcactcgcctaccagctcaacgtcggtttcgtccccatccgcaaaaaaggcaagctgccttttgaaaccgtatcgcaaagctacgcgctcgaatacggggaagctgcggtggaaatccacaccgatgccgtcaaactcggttcgcgcgtgctgctggtcgatgatttggttgccacgggcggcacgatgcttgccggactggagctgatccgcaaactcggcggggaaattgtcgaagccgccgccattttggaatttaccgaccttcaaggcggcaagaatatccgtgcaagcggcgcgcccttatttaccctgcttcaaaacgaaggctgtatgaagggctga

SEQ ID NO: 594 - protein, 199 aa, Neisseria meningitidis
MALKTSNLEHAMLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKLGSRVLLVDDLVATGGTMLAGLELIRKLGGEIVEAAAILEFTDLQGGKNIRASGAPLFTLLQNEGCMKG

SEQ ID NO: 595 - DNA, 1020 bp, Neisseria gonorrhoeae
atgttgattgacaacaatgtccgccattacagctttttcggtgtagaacaggcaaattgggacaacttcacgcttgaaggcggcgtacgcgtggaaaaacaaaaagcctccatccggtacgacaaagcattgattgatcgagaaaactactacaaccagcccctgcccgacctcggcgcgcaccgccaaaccgcccgctcgttcgcactttcgggcaactggtatttcacgccacaccacaaactcagcctgaccgcctcccatcaggaacgcctgccgtcaacgcaagaactgtacgcacacggcaagcacgtcgccaccaacacctttgaagtcggcaacaaacacctcaacaaagagcgttccaacaatatcgaactcgcgctgggctacaaaggcgaccgctggcaatacaatctggcagcctaccgcaaccgattcggcaactacatttacgcccaaaccttaaacgacggacgcggccccaaatccatcgaagacgacagcgaaatgaagctcgtgcgctacaaccaatccggtgccgacttctacggcgcggaaggcgaaatctacttcaaaccgacaccgcgctaccgcatcggtgtttccggcgactatgtacgaggccgtctgaaaaacctgccgtccctacccggcagggaagatccctacggcaaacgtcccttcatcgcacaagccgaccaaaacgccccccgcattccggctgcgcgcctcggcttccacctgaaaacctcgctaaccgaccgtatcgatgccaatttggactactaccgcgtgttcgcccaaaacaaactcgcccgctacgaaacgcgtacgcccggacaccatatgctcaacctcggtgcaaactaccgccgcaatacgcgctatggcgagtggaattggtacgtcaaagccgacaacctgctcaaccaatccgtttacgcccacagcagcttcctctctgatacgccgcaaatgggccgcagctttgccggcggcgtaaacgtgaagttttaa

SEQ ID NO: 596 - protein, 339 aa, Neisseria gonorrhoeae
MLIDNNVRHYSFFGVEQANWDNFTLEGGVRVEKQKASIRYDKALIDRENYYNQPLPDLGAHRQTARSFALSGNWYFTPHHKLSLTASHQERLPSTQELYAHGKHVATNTFEVGNKHLNKERSNNIELALGYKGDRWQYNLAAYRNRFGNYIYAQTLNDGRGPKSIEDDSEMKLVRYNQSGADFYGAEGEIYFKPTPRYRIGVSGDYVRGRLKNLPSLPGREDPYGKRPFIAQADQNAPRIPAARLGFHLKTSLTDRIDANLDYYRVFAQNKLARYETRTPGHHMLNLGANYRRNTRYGEWNWYVKADNLLNQSVYAHSSFLSDTPQMGRSFAGGVNVKF

SEQ ID NO: 597 - DNA, 1020 bp, Neisseria meningitidis
atgctgcttgacaacaaagtgcaacattacagctttttcggtgtagaacaggcaaactgggacaacttcacgcttgaaggaggcgtacgcgtggaaaaacaaaaagcctccattcagtacgacaaagcattgattgatcgggaaaactactacaaccaccccctgcccgacctcggcgcgcaccgccaaaccgcccgctcattcgcactttcgggcaactggtatttcacgccacaacacaaactcagcctgaccgcctcccatcaggaacgcctgccgtcaacgcaagagctgtacgcacacggcaaacacgtcgccaccaacacctttgaagtcggcaacaaacacctcaacaaagagcgttccaacaatatcgaactcgcgctgggctacgaaggcgaccgctggcaatacaatctggcactctaccgcaaccgcttcggtaactacatttacgcccaaaccttaaacgacggacgcggccccaaatccatcgaagacgacagcgaaatgaagctcgtgcgctacaaccaatccggcgccgacttctacggcgcggaaggcgaaatctacttcaaaccgacaccgcgctaccgcatcggcgtttccggcgactatgtacgaggccgtctgaaaaacctgccttccctacccggcagagaagatgcctacggcaaccgtcctttcatcgcacaggacgaccaaaatgccccccgtgttccggctgcgcgcctcggcttccacctgaaagcctcgctgaccgaccgtatcgatgccaatttggactactaccgcgtgttcgcccaaaacaaactcgcccgctacgaaacgcgcacgcccggacaccatatgctcaacctcggcgcaaactaccgccgcaatacgcgctatggcgagtggaattggtacgtcaaagccgacaacctgctcaaccaatccgtttacgcccacagcagctttctctctgatacgccgcaaatgggccgcagctttaccggcggcgtgaacgtgaagttttaa

SEQ ID NO: 598 - protein, 339 aa, Neisseria meningitidis
MLLDNKVQHYSFFGVEQANWDNFTLEGGVRVEKQKASIQYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPFIAQDDQNAPRVPAARLGFHLKASLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 599 - DNA, 1020 bp, Neisseria meningitidis
atgctgcttgacaataaagtgcaacattacagctttttcggtgtagaacaggcaaactgggacaacttcacgcttgaaggcggcgtacgcgtggaaaaacaaaaagcctccatccgctacgacaaagcattgattgatcgggaaaactactacaaccatcccctgcccgacctcggcgcgcaccgccaaaccgcccgctcattcgcactttcgggcaactggtatttcacgccacaacacaaactcagcctgaccgcctcccatcaggaacgcctgccgtcaacgcaagagctgtacgcacacggcaaacacgtcgccaccaacacctttgaagtcggcaacaaacacctcaacaaagagcgttccaacaatatcgaactcgcgctgggctacgaaggcgaccgctggcaatacaatctggcactctaccgcaaccgcttcggcaactacatttacgcccaaaccttaaacgacggacgcggccccaaatccatcgaagacgacagcgaaatgaagctcgtgcgctacaaccaatccggtgcggacttctacggcgcggaaggcgaaatctacttcaaaccgacaccgcgctaccgcatcggcgtttccggcgactatgtacgaggccgtctgaaaaacctgccttccctacccggcagggaagacgcctacggcaaccgcccactcattgcccaagccgaccaaaacgcccctcgcgttccggctgcgcgcctcggcgtccacctgaaagcctcgctgaccgaccgcatcgatgccaatttggactactaccgcgtgttcgcccaaaacaaactcgcccgctacgaaacgcgcacgcccggacaccatatgctcaacctcggcgcaaactaccgccgcaatacgcgctatggcgagtggaattggtacgtcaaagccgacaacctgctcaaccaatccgtttacgcccacagcagcttcctctctgatacgccgcaaatgggccgcagctttaccggcggcgtgaacgtgaagttttaa

SEQ ID NO: 600 - protein, 339 aa, Neisseria meningitidis
MLLDNKVQHYSFFGVEQANWDNFTLEGGVRVEKQKASIRYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPLIAQADQNAPRVPAARLGVHLKASLTDRIDANLDYYRVFAQNKLARYETRTPGHHMLNLGANYRRNTRYGEWNWYVKADNLLNQSVYAHSSFLSDTPQMGRSFTGGVNVKF

(The sequence listing continues in the following parts.)

We claim:

1. A composition comprising an immunostimulatory effective amount of aluminum hydroxide adjuvant and a substantially purified polypeptide comprising a fragment of an amino acid sequence of SEQ ID NO: 1200, 1202, or 1204, wherein said fragment comprises 14 or more consecutive amino acids from said amino acid sequence and wherein the fragment does not comprise the N-terminal leader sequence MFKRSVIAMACIFPLSA (SEQ ID NO: 4169), if the fragment comprises 14 or more consecutive amino acids from the amino acid sequence of SEQ ID NO: 1200; the fragment does not comprise the N-terminal leader sequence MFKRSVIAMACIFALSA (SEQ ID NO: 4170), if the fragment comprises 14 or more consecutive amino acids from the amino acid sequence of SEQ ID NO: 1202; or the fragment does not comprise the N-terminal leader sequence MFKRSVIAMACIVALSA (SEQ ID NO: 4171), if the fragment comprises 14 or more consecutive amino acids from the amino acid sequence of SEQ ID NO: 1204.

2. The composition of claim 1 wherein the substantially purified polypeptide is immunogenic.

3. The composition of claim 1 further comprising a pharmaceutically acceptable excipient.

4. The composition of claim 1 wherein the fragment comprises 16 or more consecutive amino acids from said amino acid sequence.

5. The composition of claim 1 wherein the fragment comprises 18 or more consecutive amino acids from said amino acid sequence.

6. The composition of claim 1 wherein the fragment comprises 20 or more consecutive amino acids from said amino acid sequence.

7. The composition of claim 4 further comprising a pharmaceutically acceptable excipient.

8. The composition of claim 5 further comprising a pharmaceutically acceptable excipient.

9. The composition of claim 6 further comprising a pharmaceutically acceptable excipient.

* * * * *